United States Patent
Foltz et al.

(10) Patent No.: US 12,312,412 B2
(45) Date of Patent: May 27, 2025

(54) MAGEB2 BINDING CONSTRUCTS

(71) Applicants: Amgen Inc., Thousand Oaks, CA (US); Amgen Research (Munich) GmbH, Munich (DE); Immatics Biotechnologies GmbH, Tubingen (DE)

(72) Inventors: Ian Nevin Foltz, Burnaby (CA); Weihsu Claire Chen, Vancouver (CA); Lars Gaedtke, Munich (DE); Susmith Mukund, Foster City, CA (US); Tobias Raum, Eurasburg (DE); Heiko Schuster, Tubingen (DE); Kristin Tarbell, Millbrae, CA (US); Derek E. Piper, Santa Clara, CA (US); Johannes Brozy, Munich (DE); Markus Muenz, Lenggries (DE); Igor D'Angelo, Carlsbad, CA (US); Alexander Sternjak, Munich (DE)

(73) Assignees: Amgen Inc., Thousand Oaks, CA (US); Amgen Research (Munich) GmbH, Munich (DE); Immatics Biotechnologies GmbH, Tubingen (DE)

( * ) Notice: Subject to any disclaimer, the term of this patent is extended or adjusted under 35 U.S.C. 154(b) by 0 days.

(21) Appl. No.: 17/323,884

(22) Filed: May 18, 2021

(65) Prior Publication Data
US 2022/0017636 A1 Jan. 20, 2022

Related U.S. Application Data

(60) Provisional application No. 63/128,773, filed on Dec. 21, 2020, provisional application No. 63/027,148, filed on May 19, 2020.

(51) Int. Cl.
| | | |
|---|---|---|
| *C07K 16/30* | (2006.01) | |
| *A61P 35/00* | (2006.01) | |
| *C07K 16/28* | (2006.01) | |
| *A61K 39/00* | (2006.01) | |

(52) U.S. Cl.
CPC .............. *C07K 16/30* (2013.01); *A61P 35/00* (2018.01); *C07K 16/2809* (2013.01); *A61K 2039/505* (2013.01); *C07K 2317/31* (2013.01); *C07K 2317/622* (2013.01); *C07K 2317/92* (2013.01)

(58) Field of Classification Search
CPC .... C07K 16/30; A61P 35/00; A61K 2039/505
See application file for complete search history.

(56) References Cited

U.S. PATENT DOCUMENTS

| | | |
|---|---|---|
| 3,691,016 A | 9/1972 | Patel |
| 3,969,287 A | 7/1976 | Jaworek et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,301,144 A | 11/1981 | Iwashita et al. |
| 4,330,440 A | 5/1982 | Ayers et al. |
| 4,439,196 A | 3/1984 | Higuchi |
| 4,447,224 A | 5/1984 | DeCant, Jr. et al. |
| 4,447,233 A | 5/1984 | Mayfield |
| 4,475,196 A | 10/1984 | La Zor |
| 4,486,194 A | 12/1984 | Ferrara |
| 4,487,603 A | 12/1984 | Harris |
| 4,496,689 A | 1/1985 | Mitra |
| 4,596,556 A | 6/1986 | Morrow et al. |
| 4,640,835 A | 2/1987 | Shimizu et al. |
| 4,670,417 A | 6/1987 | Iwasaki et al. |
| 4,694,778 A | 9/1987 | Learn et al. |
| 4,751,180 A | 6/1988 | Cousens et al. |
| 4,790,824 A | 12/1988 | Morrow et al. |
| 4,791,192 A | 12/1988 | Nakagawa et al. |
| 4,816,397 A | 3/1989 | Boss et al. |
| 4,816,567 A | 3/1989 | Cabilly et al. |
| 4,935,233 A | 6/1990 | Bell et al. |
| 4,941,880 A | 7/1990 | Burns |
| 4,946,778 A | 8/1990 | Ladner et al. |
| 5,064,413 A | 11/1991 | McKinnon et al. |
| 5,223,409 A | 6/1993 | Ladner et al. |

(Continued)

FOREIGN PATENT DOCUMENTS

| | | |
|---|---|---|
| EP | 0171496 B1 | 2/1986 |
| EP | 0173494 A2 | 3/1986 |

(Continued)

OTHER PUBLICATIONS

Almagro JC, Fransson J. Humanization of antibodies. Front Biosci. Jan. 1, 2008;13:1619-33. (Year: 2008).*

Kussie et al. A single engineered amino acid substitution changes antibody fine specificity.J Immunol. Jan. 1, 1994;152(1):146-52. (Year: 1994).*

Edwards et al. The remarkable flexibility of the human antibody repertoire;isolation of over one thousand different antibodies to a single protein,BLyS. J Mol Biol Nov. 14, 2003;334(1):103-18. (Year: 2003).*

Adams PD, Grosse-Kunstleve RW, Hung LW, Ioerger TR, McCoy AJ, Moriarty NW, Read RJ, Sacchettini JC, Sauter NK, Terwilliger TC. Phenix: building new software for automated crystallographic structure determination. Acta Crystallogr D Biol Crystallogr. Nov. 2002; 58(Pt 11): 1948-54.

(Continued)

*Primary Examiner* — Aurora M Fontainhas
*Assistant Examiner* — Jennifer A Benavides

(57) ABSTRACT

The present invention relates to antibody constructs comprising a domain which binds to a MAGEB2 peptide complexed with an HLA and optionally, another domain which binds to CD3. Moreover, the invention provides polynucleotides encoding the antibody constructs, vectors comprising said polynucleotides and host cells transformed or transfected with said polynucleotides or vectors. Furthermore, the invention provides processes for producing the antibody constructs of the invention, medical uses of said antibody constructs, and kits comprising said antibody constructs.

11 Claims, 74 Drawing Sheets

Specification includes a Sequence Listing.

(56) References Cited

U.S. PATENT DOCUMENTS

| | | |
|---|---|---|
| 5,225,539 A | 7/1993 | Winter |
| 5,260,203 A | 11/1993 | Ladner et al. |
| 5,292,658 A | 3/1994 | Cormier et al. |
| 5,312,335 A | 5/1994 | McKinnon et al. |
| 5,383,851 A | 1/1995 | McKinnon, Jr. et al. |
| 5,399,163 A | 3/1995 | Peterson et al. |
| 5,418,155 A | 5/1995 | Cormier et al. |
| 5,476,996 A | 12/1995 | Wilson et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,585,089 A | 12/1996 | Queen et al. |
| 5,591,669 A | 1/1997 | Krimpenfort et al. |
| 5,612,205 A | 3/1997 | Kay et al. |
| 5,625,126 A | 4/1997 | Lonberg et al. |
| 5,625,825 A | 4/1997 | Rostoker et al. |
| 5,633,425 A | 5/1997 | Lonberg et al. |
| 5,643,763 A | 7/1997 | Dunn et al. |
| 5,648,260 A | 7/1997 | Winter et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,698,767 A | 12/1997 | Wilson et al. |
| 5,721,367 A | 2/1998 | Kay et al. |
| 5,741,668 A | 4/1998 | Ward et al. |
| 5,770,429 A | 6/1998 | Lonberg et al. |
| 5,777,079 A | 7/1998 | Tsien et al. |
| 5,789,215 A | 8/1998 | Berns et al. |
| 5,789,650 A | 8/1998 | Lonberg et al. |
| 5,804,387 A | 9/1998 | Cormack et al. |
| 5,814,318 A | 9/1998 | Lonberg et al. |
| 5,859,205 A | 1/1999 | Adair et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,939,598 A | 8/1999 | Kucherlapati et al. |
| 5,958,765 A | 9/1999 | Brams et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,300,064 B1 | 10/2001 | Knappik et al. |
| 6,407,213 B1 | 6/2002 | Carter et al. |
| 6,673,986 B1 | 1/2004 | Kucherlapati et al. |
| 6,706,265 B1 | 3/2004 | Bolt et al. |
| 7,381,803 B1 | 6/2008 | Weiner et al. |
| 7,541,429 B2 | 6/2009 | Hildebrand et al. |
| 7,718,777 B2 | 5/2010 | Hoogenboom et al. |
| 7,728,114 B2 | 6/2010 | Mach et al. |
| 7,811,828 B2 | 10/2010 | Lemmel et al. |
| 7,994,289 B2 | 8/2011 | Waldmann et al. |
| 9,791,443 B2 | 10/2017 | Weinschenk et al. |
| 10,064,926 B2 | 9/2018 | Weinschenk et al. |
| 10,545,154 B2 | 1/2020 | Weinschenk et al. |
| 10,981,996 B1 | 4/2021 | Weidanz et al. |
| 10,981,997 B1 | 4/2021 | Weidanz et al. |
| 11,017,882 B2 | 5/2021 | Cameron et al. |
| 2003/0070185 A1 | 4/2003 | Jakobovits et al. |
| 2003/0096298 A1 | 5/2003 | Barnea et al. |
| 2003/0228308 A1 | 12/2003 | Zhang et al. |
| 2003/0228325 A1 | 12/2003 | Bilsborough et al. |
| 2004/0033541 A1 | 2/2004 | Zhang et al. |
| 2005/0053918 A1 | 3/2005 | Barnea et al. |
| 2005/0249743 A1 | 11/2005 | Boon-Falleur et al. |
| 2009/0304679 A1 | 12/2009 | Weidanz |
| 2013/0210648 A1* | 8/2013 | Hewitt ............... G01N 33/6893 435/7.1 |
| 2013/0266565 A1 | 10/2013 | Jenewein et al. |
| 2014/0010825 A1 | 1/2014 | Ravindranath et al. |
| 2014/0065708 A1 | 3/2014 | Weidanz |
| 2014/0302037 A1 | 10/2014 | Borges et al. |
| 2014/0308285 A1 | 10/2014 | Yan et al. |
| 2016/0193295 A1 | 7/2016 | Kannan et al. |
| 2016/0250307 A1 | 9/2016 | Weinschenk et al. |
| 2017/0080070 A1 | 3/2017 | Weinschenk et al. |
| 2018/0071398 A1 | 3/2018 | Willemsen et al. |
| 2018/0154013 A1 | 6/2018 | Renes et al. |
| 2018/0179283 A1 | 6/2018 | Peled Kamar et al. |
| 2019/0000947 A1 | 1/2019 | Weinschenk et al. |
| 2019/0071502 A1 | 3/2019 | Weidanz |
| 2019/0092834 A1 | 3/2019 | Hayes et al. |
| 2019/0127436 A1 | 5/2019 | Tribble et al. |
| 2019/0135892 A1 | 5/2019 | Tribble et al. |
| 2019/0144521 A1 | 5/2019 | Tribble et al. |
| 2020/0276237 A1 | 9/2020 | Shiku et al. |
| 2020/0291116 A1 | 9/2020 | Weidanz |
| 2020/0291127 A1 | 9/2020 | Weidanz |
| 2020/0291128 A1 | 9/2020 | Weidanz |
| 2020/0325244 A1 | 10/2020 | Weidanz |
| 2020/0399377 A1 | 12/2020 | Weidanz |
| 2021/0147550 A1 | 5/2021 | Jooss et al. |
| 2021/0147572 A1 | 5/2021 | Weidanz |
| 2021/0196806 A1 | 7/2021 | Yelensky et al. |
| 2021/0230278 A1 | 7/2021 | Weinzierl et al. |
| 2021/0253713 A1 | 8/2021 | Weidanz |
| 2023/0406929 A1 | 12/2023 | Rau et al. |

FOREIGN PATENT DOCUMENTS

| | | |
|---|---|---|
| EP | 0 183 070 B1 | 6/1986 |
| EP | 0 239 400 B1 | 9/1987 |
| EP | 0 244 234 B1 | 11/1987 |
| EP | 0 402 226 A1 | 12/1990 |
| EP | 0 463 151 B1 | 1/1992 |
| EP | 0 546 073 B1 | 6/1993 |
| GB | 2177096 A | 1/1987 |
| JP | 3 068 180 B2 | 6/1992 |
| JP | 3 068 506 B2 | 6/1998 |
| JP | 3 068 507 B2 | 6/1998 |
| WO | WO 87/05330 A1 | 9/1987 |
| WO | WO 88/01649 A1 | 3/1988 |
| WO | WO 88/09344 A1 | 12/1988 |
| WO | WO 92/03918 A1 | 3/1992 |
| WO | WO92/15673 A1 | 9/1992 |
| WO | WO 92/22645 A1 | 12/1992 |
| WO | WO 92/22647 A1 | 12/1992 |
| WO | WO 92/22670 A1 | 12/1992 |
| WO | WO 93/12227 A1 | 6/1993 |
| WO | WO 94/00569 A1 | 1/1994 |
| WO | WO 94/02602 A1 | 2/1994 |
| WO | WO 94/10308 A1 | 5/1994 |
| WO | WO 94/25585 A1 | 11/1994 |
| WO | WO95/07463 A1 | 3/1995 |
| WO | WO 96/14436 A1 | 5/1996 |
| WO | WO 96/33735 A1 | 10/1996 |
| WO | WO 96/34096 A1 | 10/1996 |
| WO | WO 97/13852 A1 | 4/1997 |
| WO | WO98/14605 A1 | 4/1998 |
| WO | WO 98/24884 A1 | 6/1998 |
| WO | WO 98/24893 A2 | 6/1998 |
| WO | WO98/26277 A2 | 6/1998 |
| WO | WO 98/52976 A1 | 11/1998 |
| WO | WO99/49019 A2 | 9/1999 |
| WO | WO 99/54440 A1 | 10/1999 |
| WO | WO 00/006605 A2 | 2/2000 |
| WO | WO 00/34317 A2 | 6/2000 |
| WO | WO 00/76310 A1 | 12/2000 |
| WO | WO02/094981 A2 | 11/2002 |
| WO | WO 03/47336 A2 | 6/2003 |
| WO | WO03/070752 A2 | 8/2003 |
| WO | WO 2005/040220 A1 | 5/2005 |
| WO | WO 2006/138181 A2 | 12/2006 |
| WO | WO2007/042261 A2 | 4/2007 |
| WO | WO2007/098420 A1 | 8/2007 |
| WO | WO 2008/119567 A2 | 10/2008 |
| WO | WO2009/026547 A1 | 2/2009 |
| WO | WO2009/108372 A2 | 9/2009 |

(56) References Cited

FOREIGN PATENT DOCUMENTS

| | | |
|---|---|---|
| WO | WO2009/127691 A1 | 10/2009 |
| WO | WO2009/151487 A1 | 12/2009 |
| WO | WO 2010/037838 A2 | 4/2010 |
| WO | WO 2011/051489 A2 | 5/2011 |
| WO | WO 2012/059486 A1 | 5/2012 |
| WO | WO 2012/150319 A1 | 11/2012 |
| WO | WO 2013/026833 A1 | 2/2013 |
| WO | WO 2013/026837 A1 | 2/2013 |
| WO | WO 2013/075066 A2 | 5/2013 |
| WO | WO 2013/135896 A1 | 9/2013 |
| WO | WO 2014/072481 A1 | 5/2014 |
| WO | WO 2014/144722 A2 | 9/2014 |
| WO | WO 2014/151910 A1 | 9/2014 |
| WO | WO 2015/048272 A1 | 4/2015 |
| WO | WO2016/199140 A1 | 12/2016 |
| WO | WO2016/199141 A2 | 12/2016 |
| WO | WO2017/174824 A1 | 10/2017 |
| WO | WO2018/140525 A1 | 8/2018 |
| WO | WO2018/225732 A1 | 12/2018 |
| WO | WO2019/036688 A1 | 2/2019 |
| WO | WO2019/140196 A1 | 7/2019 |
| WO | WO2019/165307 A1 | 8/2019 |
| WO | WO2019/204683 A1 | 10/2019 |
| WO | WO2019/226941 A1 | 11/2019 |
| WO | WO2020/023548 A1 | 1/2020 |
| WO | WO2021/122875 A1 | 6/2021 |

OTHER PUBLICATIONS

Altschul et al. (J Mol Biol. Oct. 5, 1990;215(3):403-10.).
Altschul et al., (Methods Enzymol. 1996; 266:460-80).
Altschul et al., (Nucleic Acids Res. Sep. 1, 1997;25(17):3389-402).
Aplin and Wriston, 1981, CRC Crit. Rev. Biochem., pp. 259-306.
Arakawa T. et al., Pharm Res. Mar. 1991;8(3):285-91.
Artsaenko et al. (1995) The Plant J 8: 745-750.
Bird (1988) Science vol. 242: pp. 423-426.
Bjorkman PJ, Saper MA, Samraoui B, Bennett WS, Strominger JL, Wiley DC. The foreign antigen binding site and T cell recognition regions of class I histocompatibility antigens. Nature. Oct. 8-14, 1987;329(6139):512-8.
Brühl, Immunol., (2001), 166, 2420-2426.
Cano et al., "Common and Well-Documented HLA Alleles", Human Immunology, vol. 68, Issue 5, May 2007, pp. 392-417.
Carter et al. (Biotechnology (NY) Feb. 1992;10(2):163-7).
Chalfie et al., 1994, Science 263:802-805.
Chames et al., "Direct selection of a human antibody fragment directed against the tumor T-cell epitope HLA-A1-MAGE-A1 from a nonimmunized phage-FAB library," PNAS, 2000, vol. 97, No. 14, pp. 7969-7974.
Chang et al., "A Therapeutic TCR Mimic Monoclonal Antibody for Intracellular PRAME Protein in Leukemias," Blood, 2015.
Cheadle et al. (Mol Immunol (1992) 29, 21-30).
Chothia et al., J. Mol. Biol, 1987, 196: 901-917.
Chothia et al., Nature, 1989, 342: 877-883.
Clackson et al., Nature, 352: 624-628 (1991).
Cohen et al., "Direct Phenotypic Analysis of Human MGC Class I Antigen Presentation: Visualization, Quantitation, and In Situ Detection of Human Viral Epitopes Using Peptide-Specific, MHC-Restricted Human Recombinant Antibodies", The Journal of Immunology, 2003, pp. 4349-4361.
Cole et al., Monoclonal Antibodies and Cancer Therapy, Alan R. Liss, Inc. (1985), 77-96.
Cook, G.P. et al. (1995) Immunol. Today vol. 16 (5): 237-242.
Cunningham B.C. and Wells J.A. (Science. Jun. 2, 1989;244(4908):1081-5).
Dall'Acqua et al. (Biochem. (1998) 37, 9266-9273).
Dao et al., "Targeting the Intracellular WT1 Oncogene Product with a Therapeutic Human Antibody", Sci Transl Med. 2013.
Dao et al., "Therapeutic bispecific T-cell engager antibody targeting the intracellular oncoprotein WT1", Nat. Biotechnol, Oct. 2015.

Delano, W.L. The PyMOL Molecular Graphics System. (Palo Alto, 2002); https://wires.onlinelibrary.wiley.com/doi/10.1002/wcms.1298.
Denkberg et al., "Direct visualization of distinct T cell epitopes derived from a melanoma tumor-associated antigen by using human recombinant antibodies with MHC-restricted T cell receptor-like specificity", PNAS, 2002, vol. 99, No. 14, pp. 9421-9426.
Devereux et al. (Nucleic Acids Res. Jan. 11, 1984;12(1 Pt 1):387-95.
Duksin et al., 1982, J. Biol. Chem. 257:3105.
Edge et al., 1981, Anal. Biochem. 118: pp. 131-137.
Emsley P, Cowtan K. Coot: model-building tools for molecular graphics. Acta Crystallogr D Biol Crystallogr. Dec. 2004; 60(Pt 12 Pt 1):2126-32.
Epel et al., "Targeting TARP, a novel breast and prostate tumor-associated antigen, with T-cell receptor-like human recombinant antibodies", Eur J Immunol, 2008.
Fan, Gaowei; Wang, Zujian; Hao, Mingju; Li, Jinming (2015). "Bispecific antibodies and their applications". Journal of Hematology & Oncology. 8: 130.
Fanslow et al., 1994, Semin. Immunol. 6:267-78.
Fecker et al. (1996) Plant Mol Biol 32: 979-986.
Feng and Doolittle (J Mol Evol. 1987;25(4):351-60);.
George et. al"Current Methods in Sequence Comparison and Analysis," Macromolecular Sequencing and Synthesis, Selected Methods and Applications edited by David H. Schlesinger, pp. 127-149 (1988), Alan R. Liss, Inc.
Graham et al., J. Gen Virol. 36 : 59-72 (1977).
Green and Jakobovits J. Exp. Med. vol. 188: pp. 483-495 (1998).
Green et al. (1994) Nature Genetics 7:13-21.
Gundlach et al., "Specificity and Degeneracy of Minor Histocompatibility Antigen-Specific MHC-Restricted CTL", The Journal of Immunology, 1996, pp. 3645-3651.
Hakimuddin Sojar et al., 1987, Arch. Biochem. Biophys. 259:52-57.
Eds. Harlow et al., Antibodies: A Laboratory Manual, Cold Spring Harbor Laboratory, 1988.
Eds. Harlow et al., Using Antibodies: a laboratory manual, CSHL Press (1999); table of contents.
Hawkins et al. J. Mol. Biol. vol. 226, 889-896 (1992).
Hawkins et al., "An HLA-Presented Fragment of Macrophage Migration Inhibitory Factor Is a Therapeutic Target for Invasive Breast Cancer", The Journal of Immunology, 2011, pp. 6607-6616.
Heim et al., 1996, Curr. Biol. 6:178-182.
Held et al., Dissecting cytotoxic T cell responses towards the NY-ESO-1 protein by peptide/MHC-specific antibody fragements, EUR J. Immunol, 2004, pp. 2919-2929.
Hiatt et al., Nature (1989) 342: 76-78.
Higgins and Sharp (Comput Appl Biosci. Apr. 1989;5(2):151-3).
Holland et al., "Specificity of bispecific T cell receptors and antibodies targeting peptide-HLA", The Journal of Clinical Investigation, 2020.
Holliger, Philipp et al., (Jul. 1993) Proceedings of the National Academy of Sciences of the United States of America 90 (14): 6444-8.
Hoppe et al., 1994, FEBS Letters 344: pp. 191-195.
Hoydahl et al., "Targeting the MHC Ligandome by Use of TCR-Like Antibodies", *Antibodies*, 2019.
Huston et al. (1988) Proc. Natl. Acad. Sci. USA 85: pp. 5879-5883.
Hwai-Chen Guo et al., Nature 360(6402):364-66 (1992).
Hwang, W.Y. et al., Methods. 2005; pp. 35-42.
Ichiki et al., 1993, J. Immunol. 150:5408-5417.
Eds. Honjo et al., Immunoglobulin Genes, 2nd ed., Academic Press, San Diego, CA, 1995.
International Search Report for PCT/US2021/032961 mailed Nov. 5, 2021.
Janeway CA Jr, Travers P, Walport M, et al. Immunobiology: The Immune System in Health and Disease. 5th edition. New York: Garland Science; 2001.
Jones et al., Nature, vol. 321: pp. 522-525 (1986).
Karlin and Altschul (Proc Natl Acad Sci U S A. Jun. 15, 1993;90(12):5873-7).
Kendrick et al., "Physical stabilization of proteins in aqueous solution" in: Rational Design of Stable Protein Formulations-

(56) References Cited

OTHER PUBLICATIONS

Theory and Practice (Carpenter and Manning, eds.) Pharmaceutical Biotechnology. 13: 61-84 (2002).
Kim et al., "A novel T cell receptor mimic defines dendritic cells that present an immunodominant West Nile virus epitope in mice", Eur J Immunol, 2014.
Kipriyanov, J. Mol. Biol., (1999), 293, 41-56.
Klechevsky et al., "Antitumor Activity of Immunotoxins with T-cell Receptor-like Specificity against Human Melanoma Xenografts", Cancer Res 2008.
Klinger et al., Immunol Reviews 2016.
Köhler et al., Nature, vol. 256: 495-497 (1975).
Kozbor, Immunology Today vol. 4, No. 3 (1983), pp. 72-79.
Krissinel E, Henrick K. Inference of macromolecular assemblies from crystalline state. J Mol Biol. Sep. 21;372(3):774-97 (2007).
Kufer P. et al., (2004) Trends in Biotechnology 22(5):238-244.
Kufer, Cancer Immunol. Immunother., (1997), 45, 193-197.
Landschulz et al., 1988, Science 240: pp. 1759-1764.
Lee and Potts, J. Mol. Biol., 2018.
Lev et al., Cancer Research, 2002, pp. 3184-3194.
Little, Recombinant Antibodies for Immunotherapy, Cambridge University Press 2009.
Löffler, Blood, (2000), 95, 6, 2098-2103.
Lowman et al., Biochemistry 30, 10832- 10837 (1991).
MacCallum et al., J. Mol. Biol, 1996, 262: 732-745.
Mack et al. Tissue Antigens. Apr. 2013; 81(4): 194-203.
Mack, J. Immunol. (1997), 158, 3965-3970.
Mack, PNAS, (1995), 92, 7021-7025.
Makler et al., European Journal of Immunology, 2010; pp. 1552-1565.
Malmborg, J. Immunol. Methods 183 (1995), 7-13.
Marks et al., J. Mol. Biol., 222: 581-597 (1991).
Martin and Thornton, J. Mol. Biol, 1996, 263: 800-815.
Mather et al., Annals N. Y Acad. Sci. (1982) 383: 44-68).
Mather, Biol. Reprod. 23: 243-252 (1980).
McCoy AJ, Grosse-Kunstleve RW, Storoni LC, Read RJ. Likelihood-enhanced fast translation functions. Acta Crystallogr D Biol Crystallogr. Apr. 2005;61(Pt 4):458-64.
Mendez et al. Nature Genetics 15:146-156 (1997).
Michaeli et al., The Journal of Immunology, 2009, pp. 6328-6341.
Morrison (1985) Science 229:1202-1207.
Morrison et al., Proc. Natl. Acad. Sci. USA, 81: 6851-6855 (1984).
Morrison KL & Weiss GA. (Cur Opin Chem Biol. Jun. 2001;5(3):302-7).
Needleman and Wunsch (J Mol Biol. Mar. 1970;48(3):443-53),.
Neethling et al., "Assessing vaccine potency using TCRmimic antibodies", Vaccine, 2008, pp. 3092-3102.
Nolan et al., 1988, Proc. Natl. Acad. Sci. U.S.A. 85:2603-2607.
Oi et al. (1986) BioTechniques vol. 4, No. 3, pp. 214-221.
Olsson et al., Meth. Enzymol., vol. 92: pp. 3-16, 1982.
Owen et al. (1992) Bio/Technology 10: 790-794.
Padlan, Molecular Immunology, 31(3), 169-217 (1993).
Pearson and Lipman (Proc Natl Acad Sci USA. Apr. 1988;85(8):2444-8.
Peche et al., The Journal of Biological Chemistry, 2015, pp. 29652-39662.
Pluckthun in The Pharmacology of Monoclonal Antibodies, vol. 113, Rosenburg and Moore eds. Springer-Verlag, New York, pp. 269-315 (1994).
Polakova et al., The Journal of Immunology, 2000, pp. 5703-5712.
Porgador et al., Immunity, 1997, vol. 6, pp. 715-726.
Presta, Curr. Op. Struct. Biol., 2: 593-596 (1992).
Ed.: Duebel, S. and Kontermann, R., Protein Sequence and Structure Analysis of Antibody Variable Domains. In: Antibody Engineering Lab Manual Springer-Verlag, Heidelberg.
Raag and Whitlow (FASEB (1995) 9(1), 73-80).
Randolph and Jones, Pharm Biotechnol. 2002; 13:159-75.
Reichmann et al., Nature, 332: 323-329 (1988).
Remington's Pharmaceutical Sciences, 18" Edition, 1990, Mack Publishing Company.
Roberts, Trends Biotechnol. Jul. 2014;32(7):372-80.
Sambrook et al., Molecular Cloning: A Laboratory Manual, Cold Spring Harbor Laboratory Press, Cold Spring Harbor, New York, 2001.
Sastry et al., Journal of Virology, 2011, vol. 85, No. 5, Stewa pp. 1935-1942.
Schier, Human Antibodies Hybridomas 7 (1996), 97-105.
Schlereth et al. (Cancer Immunol. Immunother. 20 (2006), 1-12).
Fremont et al., Science, vol. 257:919-27 (1992).
Skerra et al. (1988) Science 240:1038-1041.
Smith (1985) Science 228:1315-1317.
Smith and Waterman, 1981, Adv. Appl. Math. 2: pp. 482-489.
Songsivilai & Lachmann, Clin. Exp. Immunol. 79:315-321 (1990).
Stauber, 1998, Biotechniques 24:462-471.
Stewart-Jones et al., PNAS, 2009, vol. 106, No. 14, pp. 5784-5788.
Storoni LC, McCoy AJ, Read RJ. Likelihood-enhanced fast rotation functions. Acta Crystallogr D Biol Crystallogr. Mar. 2004;60(Pt 3):432-8.
Stryhn et al., PNAS, 1996, vol. 93, pp. 10338-10342.
T. E. Creighton, Proteins: Structure and Molecular Properties, W. H. Freeman & Co., San Francisco, 1983, pp. 70-86.
T.G.G. Battye, L. Kontogiannis, O. Johnson, H.R. Powell and A.G.W. Leslie. IMosflm: a new graphical interface for diffraction-image processing with MOSFLM. Acta Cryst. D67, 271-81 (2011).
Takeda et al., Nature 314:452, 1985.
Teng et al., Proc. Natl. Acad. Sci. U.S.A., 80: 7308-7312, 1983.
The CCP4 suite: programs for protein crystallography. Acta Crystallogr D Biol Crystallogr 50, 760-3 (1994).
Thotakura et al., 1987, Meth. Enzymol. 138: pp. 350-359.
Tomlinson et al. (1995) EMBO J. vol. 14, No. 18, pp. 4628-4638.
Tomlinson, et al. (1992) J. Mol. Biol. 227:776-798.
Tynan et al., Nat Immunol 6(11): 1114-22 (2005).
Urlaub et al., Proc. Natl. Acad. Sci. USA 77: 4216-4220 (1980).
Verma et al., J Immunol, 2011, pp. 3265-3276.
Wang, Int J Pharm. Aug. 20, 1999;185(2): 129-88.
Ward et al. (1989) Nature vol. 341: pp. 544-546.
Weidanz et al., Int Rev Immunol, 2011.
Weidanz et al., The Journal of Immunology, 2006, pp. 5088-5097.
Written Opinion for PCT/US2021/032961 mailed Nov. 5, 2021.
Yang, Fa; Wen, Weihong; Qin, Weijun (2016). "Bispecific Antibodies as a Development Platform for New Concepts and Treatment Strategies". International Journal of Molecular Sciences. 18 (1): 48.
Z. Otwinowski and W. Minor, "Processing of X-ray Diffraction Data Collected in Oscillation Mode ", Methods in Enzymology, vol. 276: Macromolecular Crystallography, part A, p. 307-326, 1997,C.W. Carter, Jr. & R.M. Sweet, Eds., Academic Press.
Zhu, K, Day, T, Warshaviak, D, Murrett, C, Friesner, R, Pearlman, D. Antibody structure determination using a combination of homology modeling, energy-based refinement, and loop prediction, Proteins. 2014, 82(8): 1646-55.
Eds. John E. Coligan et al., Current Protocols In Immunology, John Wiley & Sons, Inc., 2001, table of contents only.
Editors I. Johnson and M. T.Z. Spence, The Molecular Probes Handbook: A Guide to Fluorescent Probes and Labeling Technologies, 11$^{TH}$ Edition, ISBN 9780982927915, Year 2010, Life Technologies Corp., table of contents only.

\* cited by examiner

MAGEB2 and similar peptides

| | 1 | 2 | 3 | 4 | 5 | 6 | 7 | 8 | 9 | 10 | |
|---|---|---|---|---|---|---|---|---|---|---|---|
| MAGEB2 | G | V | Y | D | G | E | F | H | S | V | (SEQ ID NO: 1) |
| MAGEA4 | G | V | Y | D | G | R | E | H | T | V | (SEQ ID NO: 2) |
| MAGEA8 | G | L | Y | D | G | R | E | H | S | V | (SEQ ID NO: 3) |
| KEA | G | V | I | D | G | H | I | Y | A | V | (SEQ ID NO: 18461) |
| MB | G | L | S | D | E | W | Q | L | | V | (SEQ ID NO: 18462) |
| ADF | G | V | M | A | G | D | I | Y | S | V | (SEQ ID NO: 18463) |
| DPYSL4 | G | L | Y | D | G | P | M | H | E | V | (SEQ ID NO: 18464) |
| CNPD2 | G | V | Y | G | G | S | V | H | E | A | (SEQ ID NO: 18465) |
| MYOF | F | V | Y | D | E | P | G | H | A | V | (SEQ ID NO: 18466) |
| COX14 | T | V | Y | G | G | Y | L | C | S | V | (SEQ ID NO: 18467) |
| STXBP5 | Y | T | Y | D | E | A | I | H | S | V | (SEQ ID NO: 18468) |
| SLK | F | I | V | D | G | V | E | V | S | V | (SEQ ID NO: 18469) |

FIG. 1

Cell-based affinity determination by fluorescence cytometry and nonlinear regression (one site - specific binding) analysis on T2 cells loaded with MAGEB2 peptide. Tested MAGEB2 pMHC HLE bispecific antibody constructs are 1 = MA 03-E11_AS; 2 = MA 09-E2; 3 = MA 09-F12; 4 = MA 09-G10; 5 = MA 09-H7; 6 = MA 09-H10 and 7 = MA 10-B5.

Cytotoxicity assay on the MAGEB2 pMHC bearing cell line DAN-G. Tested MAGEB2 pMHC HLE bispecific antibody constructs are 1 = MA 03-G10_AS; 2 = MA 98-C7; 3 = MA 03-G11_AS; 4 = MA 98-G12_AS and 5 = MA 03-E7_AS.

TDCC activity of Ten BiTE molecules on cell lines with known MAGEB2 pMHC copies per cell

| BiTE | DANG (660 cpc) ECSO (pM) | Max Killing (%) | NCI-H1792 (473 cpc) ECSO (pM) | Max Killing (%) | SK-MEL (174 cpc) ECSO (pM) | Max Killing (%) | SNU-475 (17 cpc) ECSO (pM) | Max Killing (%) |
|---|---|---|---|---|---|---|---|---|
| C4K | 183.7 | 96.2 | 319.4 | 64.0 | 112.4 | 93.8 | 1470.0 | 89.9 |
| D1U | 62.5 | 97.2 | 92.6 | 79.0 | 42.5 | 97.6 | 1400.0 | 90.6 |
| H6H | 47.9 | 91.7 | 55.2 | 66.4 | 25.8 | 90.8 | 1456.0 | 14.3 |
| L6A | 28.7 | 95.7 | 23.3 | 79.0 | 9.4 | 96.9 | 10943.0 | 32.8 |
| L7E | 10.3 | 97.6 | 8.6 | 77.1 | 6.6 | 98.6 | 2799.0 | 56.7 |
| N3H | 53.4 | 95.0 | 21.90 | 64.6 | 20.8 | 96.1 | 3577.0 | 21.7 |
| O4R | 38.4 | 96.1 | 24.8 | 83.2 | 14.2 | 97.1 | 14815.0 | 28.3 |
| Q4C | 160.9 | 91.5 | 148.1 | 69.5 | 66.3 | 87.9 | N/A | 13.4 |
| V8T | 76.1 | 93.6 | N/A | 44.3 | 46.2 | 94.1 | N/A | 17.5 |
| Y8P | 28.2 | 93.3 | 33.5 | 64.1 | 15.3 | 95.9 | N/A | 28.8 |

"cpc" = copies per cell

FIG. 8

**TDCC Activity on MAGEA4(+) MAGEB2(-) HLA-A*02:01 Cell Lines**

| ID | Family | NCI-H1703 EC50 (pM) | NCI-H1703 Max | ScaBER EC50 (pM) | ScaBER Max |
|---|---|---|---|---|---|
| Y8P | 4 | 4338 | 67 | 516 | 21 |
| L7E | 4 | 406 | 92 | 1293 | 32 |
| G2H | 4 | 4436 | 74 | ND | 28 |
| L6A | 4 | 2352 | 85 | 2360 | 36 |
| L6M | 4 | 424 | 88 | 1869 | 33 |
| N3H | 4 | 7533 | 72 | 12549 | 27 |
| O4R | 4 | 2224 | 86 | ND | 36 |
| V8T | 7 | 17 | 95 | 238 | 47 |
| H6H | 7 | 14 | 93 | 154 | 63 |
| Q4C | 7 | 33 | 96 | 348 | 75 |

*Family 7 molecules show activity against MAGE-A4 expressing cell lines;*
*Family 4 molecules to not cross-react with MAGE-A4 expressing cell lines*

FIG. 12B

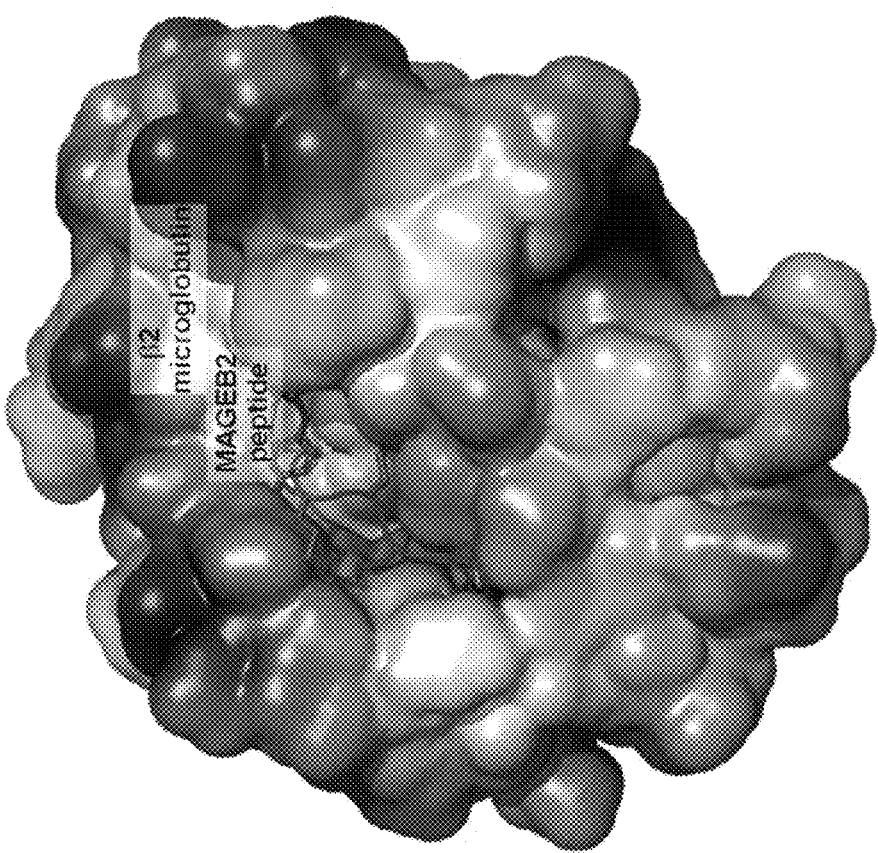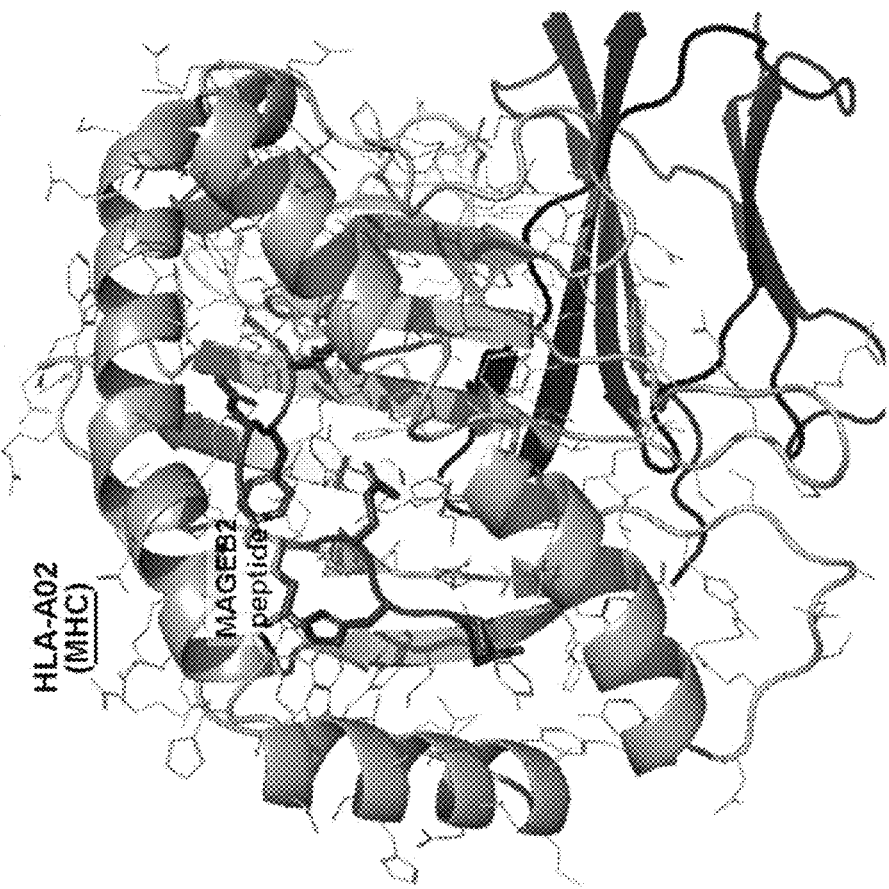
FIG. 13A

N3H scFv Heavy Chain Makes Direct Interactions with MAGEB2 Peptide, Light Chain Makes HLA and MAGEB2 Interactions Mutations in LC CDR3 preserves a key HC-LC H-bond keeping Trp90 in place to pick up the same water mediated H-bond. Gln95 now picks up another stabilizing interactions as well through the same water molecule. Distance denoted by ------ dash line.

Sequence alignment of the Family 4 BiTE® Molecules

Heavy chain:

```
              1              20                    CDR1        40                         CDR2          60
L7E  _HC_ EVQLLESGGGLVQPGGSLRLSCAASGFTF SNAMS WVRQAPGKCLEWVS TISGSGGTVY    (SEQ ID NO: 18470)
H6N  _HC_ EVQLLESGGGLVQPGGSLRLSCAASGFTF SNAMS WVRQAPGKCLEWVS TISGSGGTVY    (SEQ ID NO: 18471)
N3H  _HC_ EVQLLESGGGLRLSCAASGFTF SSxAMS WVRQAPGKCLEWVS AISGSGGTVY          (SEQ ID NO: 18472)

61    CDR2         80                                        100      CDR3             118
L7E  _HC_ AASVKGRFTISRDNSKNTLYLQMNSLRAEDTAVYYCAT GKGVHLGFDYW GQGTLVTVS
H6N  _HC_ AxSVKGRFTISRDNSKNTLYLQMNSLRAEDTAVYYCAT GKGVHLGFDYW GQGTLVTVS
N3H  _HC_ AASVKGRFTISRDNSKNTLYLQMNSLRAEDTAVYYCAT GKGVHLGFDYW GQGTLVTVS
```

Light chain:

```
              1              20   CDR1               40                           CDR2        55
L7E  _LC_ SYVLTQPPSVSVAPGQTARITC GGNNIGSKSVH WYQQKPGQAPVMVV DDNDRPS          (SEQ ID NO: 556)
H6N  _LC_ SYVLTQPPSVSVAPGQTARITC GGNNIGSKSVH WYQQKPGQAPVMVV DDNDRPS          (SEQ ID NO: 556)
N3H  _LC_ SYVLTQPPSVSVAPGQTARITC GGNNIGSKSVH WYQQKPGQAPVMVV DDNDRPS          (SEQ ID NO: 556)

60        CDR         80                              CDR3             100           108
L7E  _LC_ IPERFSGSN FGNTATLIISRVEAGDEADYYC QVWDYRTLDWV FGGGTKLTVL
H6N  _LC_ IPERFSGSN FGNTATLIISRVEAGDEADYYC QVWDYRTLDWV FGGGTKLTVL
N3H  _LC_ IPERFSGSN GNTATLIISRVEAGDEADYYC QVWDxSxRxV FGGGTKLTVL
```

FIG. 25

Sequence alignment of the Family 7 BiTE® Molecules

Heavy chain:

```
                            20    CDR1                      40              CDR2 60
       1
H6H    LVQPGGSLRLSCAASGFTFS NAWMS WVRQAPGKCLEWVG RIRSRSYGGTTDYAAPVKGRF
Q4C    LVQPGGSLRLSCAASGFTFS NAWMS WVRQAPGKCLEWVG RIKSKTYGGTTDYAAPVKGRF
V8T    LVQPGGSLRLSCAASGFTFS NAWMS WVRQAPGKCLEWVG RIKSKTYGGTTDYAAPVKGRF 61               80                          CDR3     100                  117
H6H    TISRDDSKNTLFLQMNSLKTEDTAVYYCTT PSYGSYYNYFSVMDV WGQGTTVTVSS   (SEQ ID NO: 18473)
Q4C    TISRDDSKNTLYLQMNSLKTEDTAVYYCTT PSYGSYYNYFSVMDV WGQGTTVTVSS   (SEQ ID NO: 18474)
V8T    TISRDDSKNTLFLQMNSLKTEDTAVYYCTT PSYGSYYNYFSVMDV WGQGTTVTVSS   (SEQ ID NO: 18475)
```

Light chain:

```
                              20    CDR1                   40                CDR2  60
       1
H6H    DIQMTQSPSSLSASVGDRVTITC RTSQSISSYLN WYQQKPGKAPKLLIF AASSLQG GVPS
Q4C    ELQMTQSPSSLSASVGDRVTITC RTSQSISSYLN WYQQKPGKAPKLLIF AASSLQG GVPS
V8T    DIQMTQSPSSLSASVGDRVTITC RTSQSISSYLN WYQQKPGKAPKLLIF AASSLQG GVPS 61               80                      CDR3     100              108
H6H    RFSGSGSGTDFTLTISSLQPEDFATYYC QQTYSMPFT FGCGTKVEIKS   (SEQ ID NO: 18476)
Q4C    RFSGSGSGTDFTLTISSLQPEDFATYYC QQSYSSPFT FGCGTKVEIKS   (SEQ ID NO: 18477)
V8T    RFSGSGSGTDFTLTISSLQPEDFATYYC QQSYSSPFT FGCGTKVEIKS   (SEQ ID NO: 18478)
```

FIG. 26

Results for N3H Against Various HLA*02 Expressing Cells
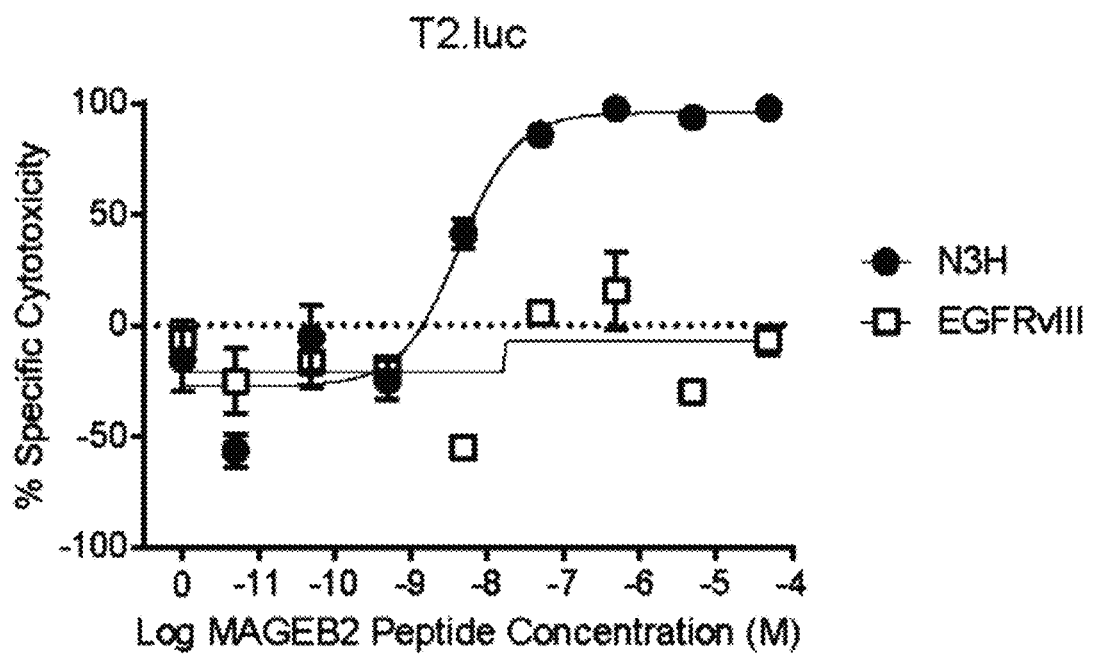
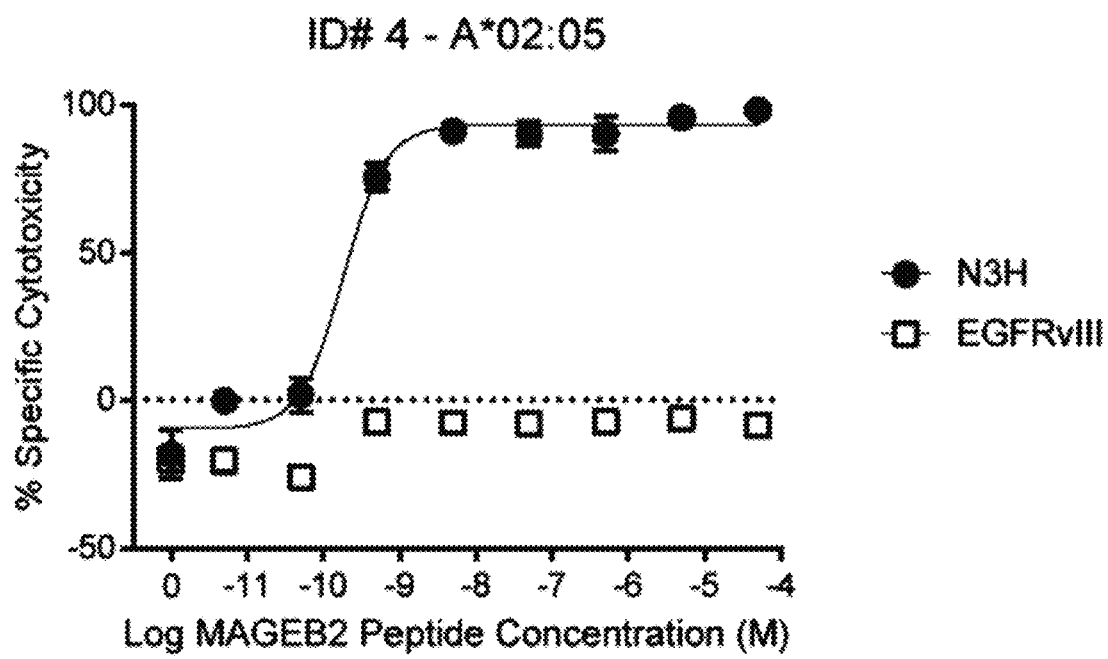
FIG. 37A

Results for N3H Against Various HLA*02 Expressing Cells

**Results for N3H Against Various HLA*02 Expressing Cells**
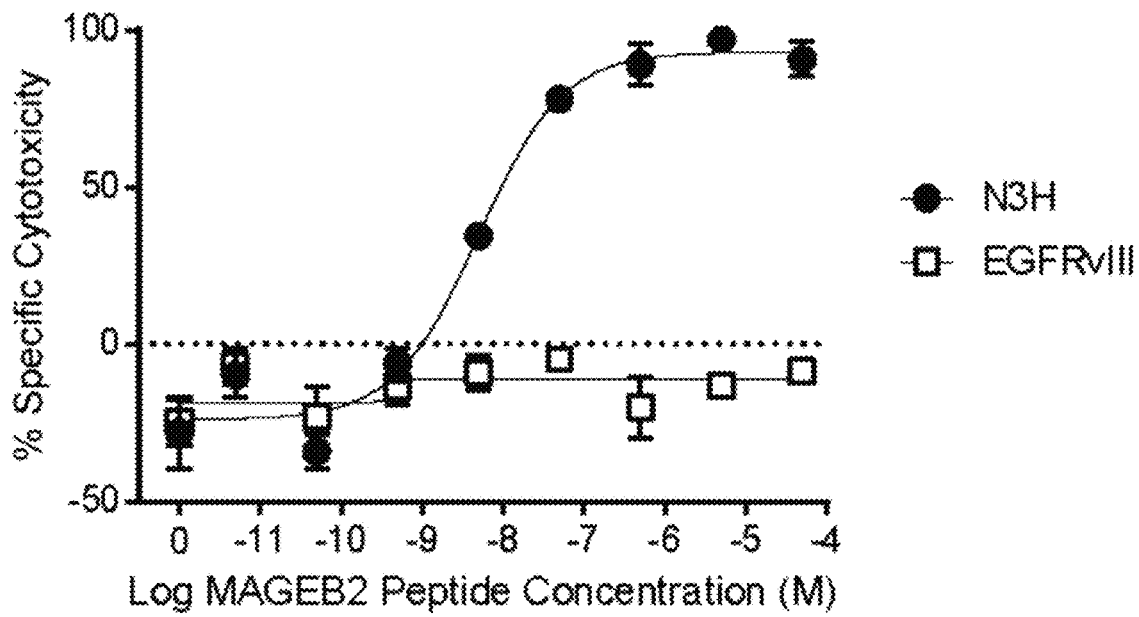
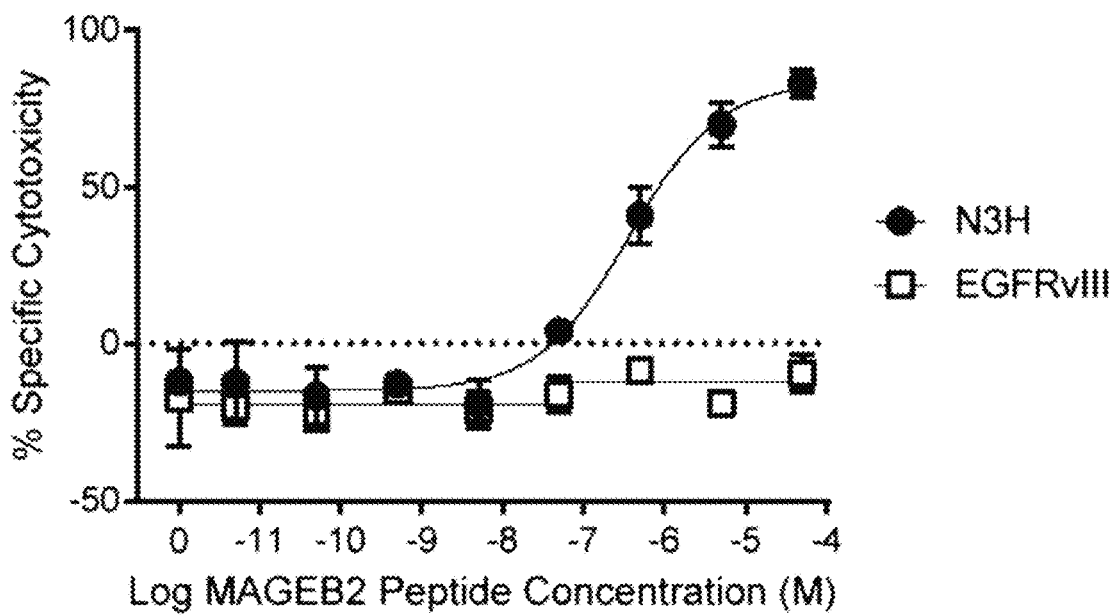
FIG. 37C

Hla-a2 FACS STAINING AFTER PEPTIDE PULSE
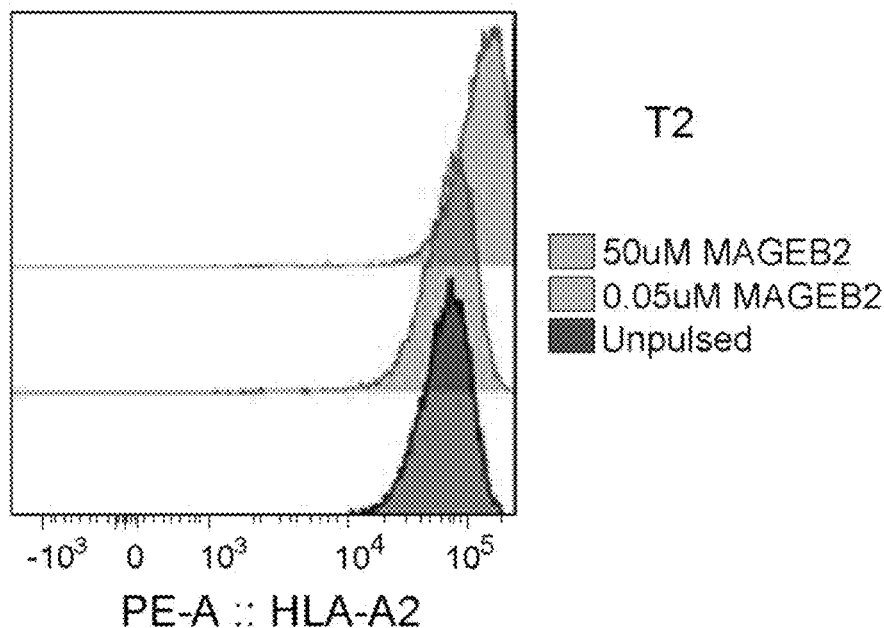
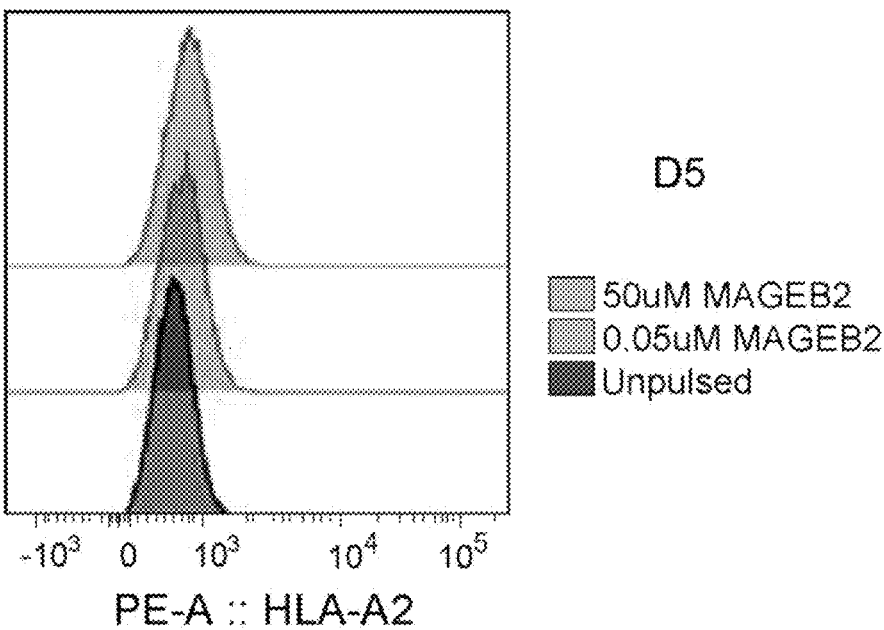
FIG. 38A

Hla-a2 FACS STAINING AFTER PEPTIDE PULSE
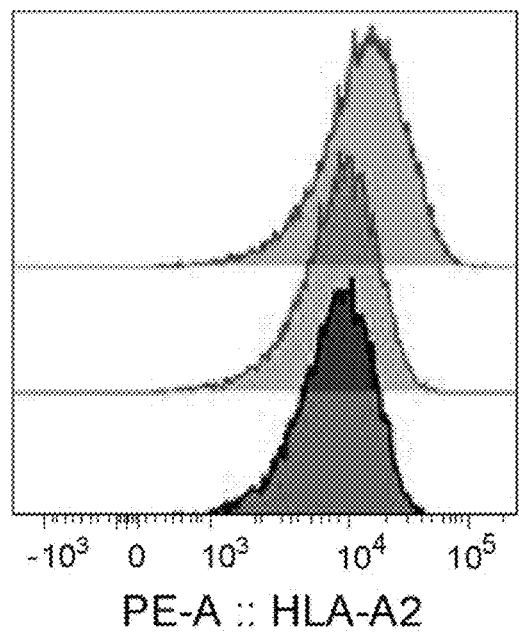
A*02:01
- 50uM MAGEB2
- 0.05uM MAGEB2
- Unpulsed
| Sample Name | Subset Name | Count | Median:PE-A |
|---|---|---|---|
| 50uM MAGEB2_ID#1_003.fcs | Live | 19920.00 | 13450.21 |
| 0-05uM MAGEB2_ID#1_009.fcs | Live | 19945.00 | 8638.76 |
| Unpulsed_ID#1_015.fcs | Live | 20013.00 | 8116.90 |
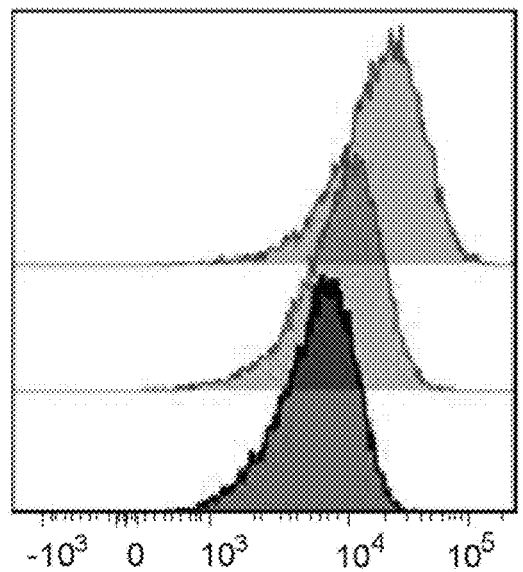
A*02:05
- 50uM MAGEB2
- 0.05uM MAGEB2
- Unpulsed
| Sample Name | Subset Name | Count | Median:PE-A |
|---|---|---|---|
| 50uM MAGEB2_ID#4_004.fcs | Live | 19912.00 | 19714.25 |
| 0-05uM MAGEB2_ID#4_010.fcs | Live | 19929.00 | 9620.16 |
| Unpulsed_ID#4_016.fcs | Live | 19999.00 | 6106.58 |
FIG. 38B

Hla-a2 FACS STAINING AFTER PEPTIDE PULSE
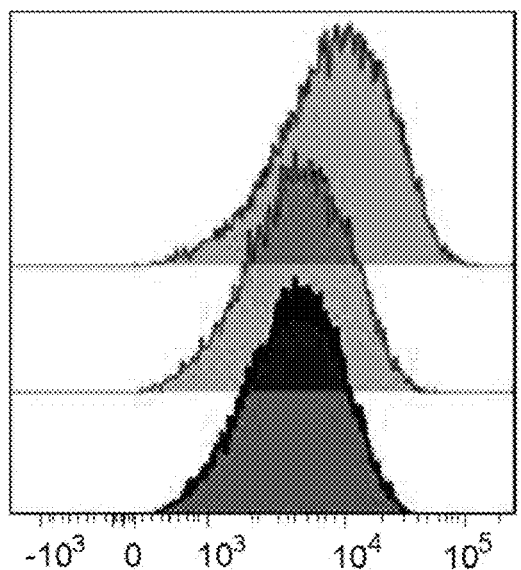
A*02:06
- 50uM MAGEB2
- 0.05uM MAGEB2
- Unpulsed
| Sample Name | Subset Name | Count | Median:PE-A |
|---|---|---|---|
| 50uM MAGEB2_ID#5_005.fcs | Live | 19864.00 | 8429.51 |
| 0-05uM MAGEB2_ID#5_011.fcs | Live | 19844.00 | 4316.49 |
| Unpulsed_ID#5_017.fcs | Live | 19939.00 | 4015.84 |
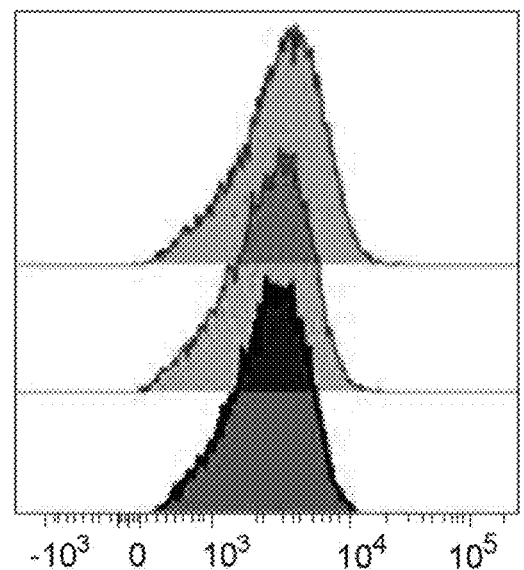
A*02:07
- 50uM MAGEB2
- 0.05uM MAGEB2
- Unpulsed
| Sample Name | Subset Name | Count | Median:PE-A |
|---|---|---|---|
| 50uM MAGEB2_ID#6_006.fcs | Live | 19893.00 | 3076.57 |
| 0-05uM MAGEB2_ID#6_012.fcs | Live | 19872.00 | 2514.23 |
| Unpulsed_ID#6_018.fcs | Live | 19920.00 | 2504.51 |
FIG. 38C

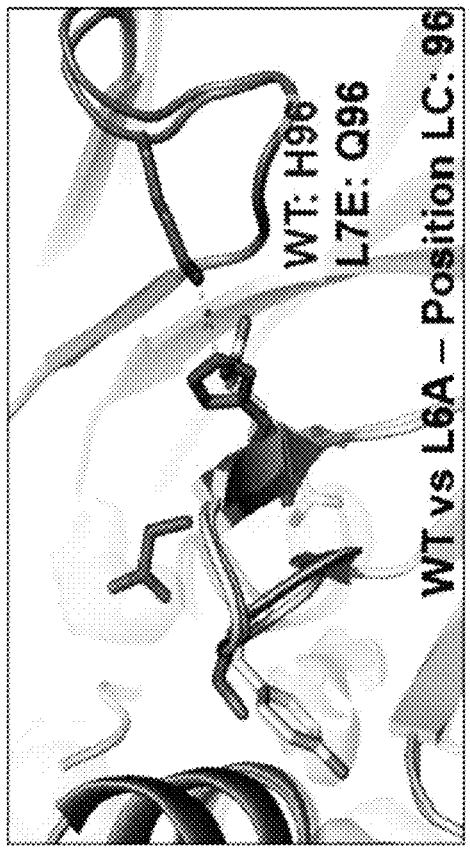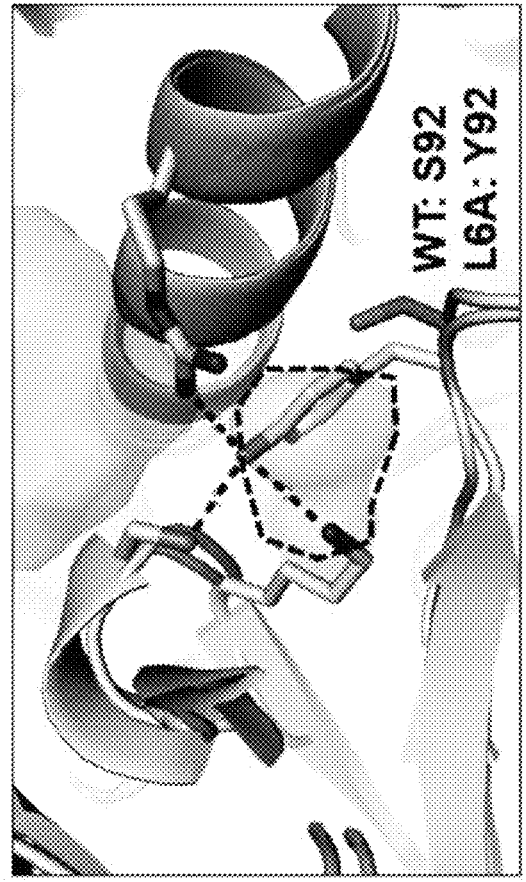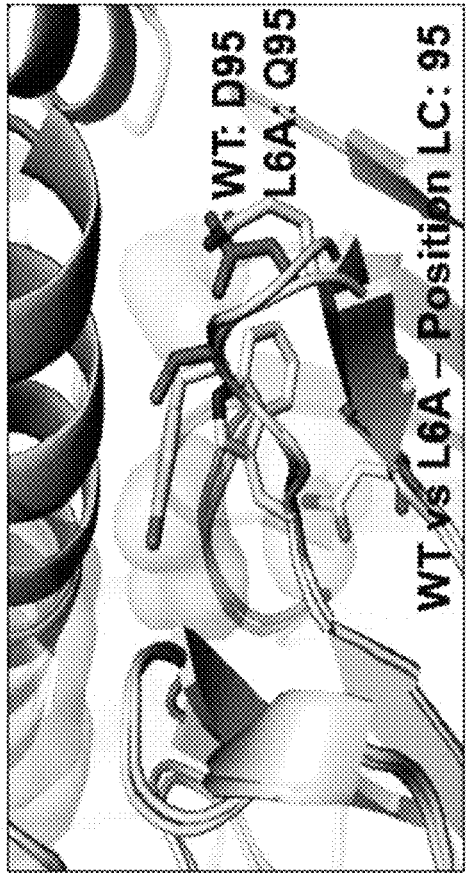
FIG. 44

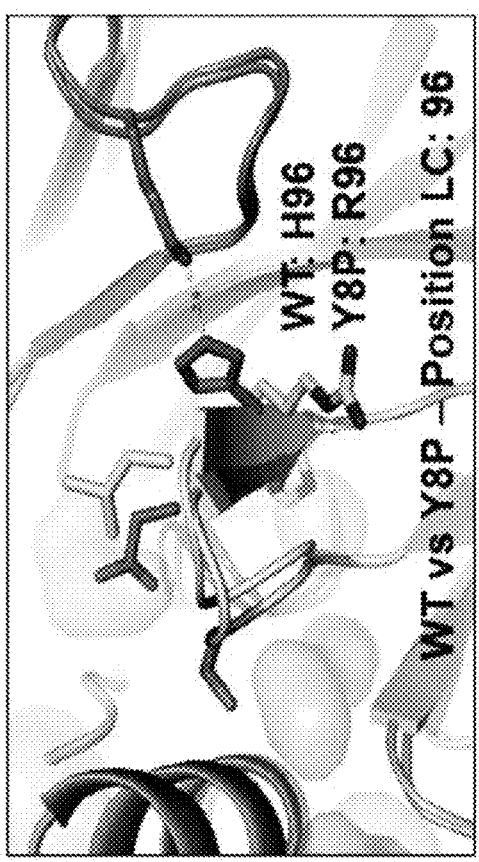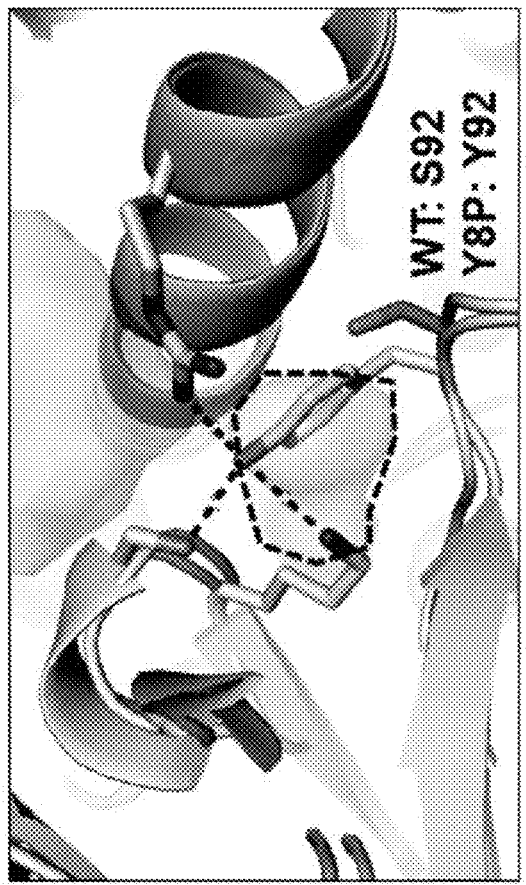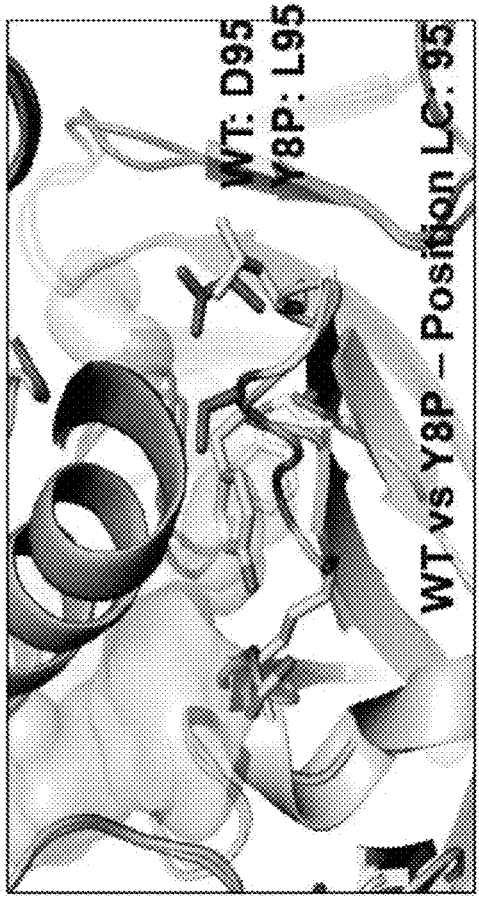
FIG. 46

MAGEB2 BINDING CONSTRUCTS

CROSS-REFERENCE TO RELATED APPLICATIONS

This application claims priority to U.S. Provisional Application No. 63/027,148, filed May 19, 2020 and U.S. Provisional Application No. 63/128,773, filed Dec. 21, 2020. The above-identified applications are each hereby incorporated herein by reference for all purposes.

REFERENCE TO THE SEQUENCE LISTING

The instant application contains a Sequence Listing which has been submitted electronically in ASCII format and is hereby incorporated by reference in its entirety. Said ASCII copy, created on May 14, 2021, is named A-2635-US-NP sequence listing.txt and is 7,139,825 bytes in size.

FIELD OF THE INVENTION

The field of this invention relates to compositions and methods related to biopharmaceuticals, including bispecific antibody constructs.

BACKGROUND OF THE INVENTION

The MAGE (melanoma antigen genes) family contains about 60 genes that are categorized into several subfamilies. The MAGE-A, -B, and -C subfamilies are expressed mainly in the testis and are aberrantly expressed in various cancer types. The MAGE-D, -E, -F, -G, -H, -L, and -N subfamilies are expressed in a wide variety of tissues. See, e.g., Lee and Potts, J. Mol. Biol., 2018. One of the MAGE family members, MAGEB2, is typically only expressed in normal testis. MAGEB2, which may function to enhance ubiquitin ligase activity of RING-type zinc finger containing E3 ubiquitin protein ligases, has been found to be aberrantly expressed in a variety of human tumors such as lung carcinoma, breast carcinoma, melanoma, and others. Given this aberrant expression, MAGEB2 is a potential target for therapeutic agents.

Many types of cancers, although having a variety of available treatments, still are considered to have a high unmet medical need, with patients needing improved, effective therapeutics.

Protein-based pharmaceuticals have a significant role in almost every field of medicine and account for many of the therapeutic agents in development and already commercially available. Compared to the more traditional small molecule pharmaceuticals, protein-based pharmaceuticals can have higher specificity and activity at relatively lower concentrations and can provide for treatment of high impact diseases such as various cancers, auto-immune diseases, and metabolic disorders (Roberts, Trends Biotechnol. 2014 July; 32(7):372-80, Wang, Int J Pharm. 1999 Aug. 20; 185(2): 129-88).

One type of protein-based pharmaceutical is a bispecific antibody which typically can simultaneously bind to two different types of antigen. They are known in several structural formats, and current applications have been explored for cancer immunotherapy and drug delivery (Fan, Gaowei; Wang, Zujian; Hao, Mingju; Li, Jinming (2015). "Bispecific antibodies and their applications". Journal of Hematology & Oncology. 8: 130).

Bispecific antibodies can be made in several different formats. For example, they can be IgG-like, e.g., full length bispecific antibodies, or they can be non-IgG-like bispecific antibodies, which are not full-length antibody constructs. Full length bispecific antibodies typically retain the traditional monoclonal antibody (mAb) structure of two Fab arms and one Fc region, except the two Fab sites bind different antigens. Non full-length bispecific antibodies can lack an Fc region entirely. These include chemically linked Fabs, consisting of only the Fab regions, and various types of bivalent and trivalent single-chain variable fragments (scFvs). There are also fusion proteins mimicking the variable domains of two antibodies. An example of such a format is the bi-specific T-cell engager (BiTE®) (Yang, Fa; Wen, Weihong; Qin, Weijun (2016). "Bispecific Antibodies as a Development Platform for New Concepts and Treatment Strategies". International Journal of Molecular Sciences. 18 (1): 48).

Although treatments for various cancers exist, patients are still in need of more effective treatments. Accordingly, the invention provides bispecific antibody constructs that target tumor cells that express MAGEB2, and CD3 expressed by immune effector cells.

SUMMARY OF THE INVENTION

In one embodiment, the invention provides an isolated antibody construct comprising a binding domain that binds to a MAGEB2 peptide-HLA complex on the surface of a target cell.

In another embodiment, the invention provides an isolated antibody construct comprising a first domain that binds to a MAGEB2 peptide-HLA complex on the surface of a target cell, and a second domain that binds to human CD3 on the surface of a T cell.

In further embodiments, the invention provides isolated antibody constructs that bind to the same epitope as the antibody constructs provided herein.

In yet further embodiments, the invention provides isolated antibody constructs that bind to an epitope comprising a MAGEB2 peptide (e.g., SEQ ID NO: 1), wherein the antibody constructs bind to at least one of the following MAGEB2 peptide residues: Asp4, Gly5, Glu6, Glu7, His8, Ser9, or Val10.

In other embodiments, the invention provides isolated antibody constructs that bind to an epitope comprising both a MAGEB2 peptide (e.g., SEQ ID NO: 1) and an HLA-A2, wherein the antibody constructs bind to at least one of the following residues HLA-A2 residues: Arg65, Lys66, Ala69, Gln72, Thr73, Val76, Lys146, Ala149, Ala150, His151, Glu154, Gln155, Gly16, Arg17, Gly18, Glu19, Pro20, Gln43, Lys68, Ser71, Arg75, Gly79, Thr80, Arg82, Gly83, or Glu89.

In another embodiment, the invention provides isolated antibody constructs that bind to an epitope comprising both a MAGEB2 peptide (e.g., SEQ ID NO: 1) and an HLA-A2/MHC, wherein the antibody constructs bind to at least one of the following MAGEB2 residues: Asp4, Gly5, Glu6, Glu7, His8, Ser9, or Val10, and wherein the antibody construct further binds to at least one of the following residues HLA-A2 residues: Arg65, Lys66, Ala69, Gln72, Thr73, Val76, Lys146, Ala149, Ala150, His151, Glu154, Gln155, Gly16, Arg17, Gly18, Glu19, Pro20, Gln43, Lys68, Ser71, Arg75, Gly79, Thr80, Arg82, Gly83, or Glu89.

In one embodiment, the invention provides isolated antibody constructs that bind to an epitope comprising both a MAGEB2 peptide (e.g., SEQ ID NO: 1) and an HLA-A2/MHC, wherein the antibody constructs comprise at least one of the following heavy chain amino acid residues: Ser30, Ser31, His32, Tyr32, Ala33, Ser52, Gly53, Ser54, Gly56, Gly57, Tyr59, Lys100, Gly101, Val102, His103, Leu104, or Gly105.

In another embodiment the invention provides antibody constructs that further comprise at least one of the following light chain amino acid residues: Asn25, Asn26, Gly28, Ser29, Lys30, Ser31, His33, Tyr48, Asp49, Asp50, Asn51, Asp52, Arg53, Asn65, Phe66, Ser66, Gly67, Trp90, Tyr92, Arg93, Leu95, or Gln95.

BRIEF DESCRIPTION OF THE DRAWINGS

FIG. 1. This figure depicts the amino acid sequences for the MAGE-B2, MAGE-A4, and MAGE-A8 peptides, highlighting the differences in three sequences. This figures also depicts other similar peptides. SEQ ID NOs 1-3 and 18461-18469 are disclosed in their respective order of appearance.

FIG. 2A depicts expression of the MAGEB2 peptide-HLA-A*02:01 complex in various cancer tissues and normal tissues, with the left panel, upper part, showing the median relative MS signal intensities from technical replicate measurements are plotted as colored dots for single HLA-A*02 positive normal (left part of figure) and tumor samples (right part of figure) on which the peptide was detected, and the right panel depicting results from the absolute quantitation analysis (AbsQuant) of MAGEB2 peptide on 12 different tumor tissues. Each data point on the logarithmic scale corresponds to replicate measurements of one tumor sample. The median peptide copy number per cell of 67 is indicated by a red line; FIG. 2B depicts mRNA expression of MAGEB2 in various tumor tissues; FIG. 2C depicts mRNA expression of MAGEA4 in various tumor tissues; FIG. 2D depicts mRNA expression of MAGEB2 in various normal tissues; FIG. 2E depicts mRNA expression of MAGEA4 in various normal tissues; FIG. 2F depicts mRNA expression of MAGEB2 in various normal tissues.

FIG. 3A is a visual representation of the preparation of the multivalent peptide-MHC (pMHC) immunogen used to immunize XenoMouse; FIG. 3B depicts the results of a titer analysis of immunized XenoMouse, with the y-axis representing GeoMean fold over a control peptide (soluble) and the x-axis having the various different groups of immunized mice.

FIG. 4A depicts the results of cell-based affinity determination by fluorescence cytometry and non-linear regression (one site—specific binding) analysis on T2 cells loaded with MAGEB2 peptide. Tested MAGEB2 pMHC HLE bispecific antibody constructs are the following (with sequences provided in Table 22 herein:
   1=MA_03-E11_AS_CC_x_I2C0_x_scFc_(G2B);
   2=MA_09-E2_CC_x_I2C0_x_scFc_(V8T);
   3=MA_09-F12_CC_x_I2C0_x_scFc_(D1U);
   4=MA_09-G10_CC_x_I2C0_x_scFc_(C4K);
   5=MA_09-H7_CC_x_I2C0_x_scFc_(T3S);
   6=MA_09-H10_CC_x_I2C0_x_scFc_(B6N); and
   7=MA_10-B5_CC_x_I2C0_x_scFc_(H6H).

FIG. 4B depicts the results of a cytotoxicity assay on the MAGEB2 pMHC bearing cell line DAN-G. Tested MAGEB2 pMHC HLE BiTE® molecules are the following (with sequences provided in Table 22 herein):
   1=MA_03-G10_AS_CC_x_I2C0_x_scFc_(N3H);
   2=MA_98-C7_CC_x_I2C0_x_scFc_(Y8P);
   3=MA_03-G11_AS_CC_x_I2C0_x_scFc_(O4R);
   4=MA_98-G12_AS_CC_x_I2C0_x_scFc_(Q4Z); and
   5=MA_03-E7_AS_CC_x_I2C0_x_scFc_(L6M).

FIG. 5A depicts the response of the BiTE® molecule MA_10-B5_CC_x_I2C0_x_scFc_(H6H) against 112 MAGE-B2 similar peptides, MAGE-B2 and relevant controls in 2 different T-cell donors, with % T2Luc viability (Donor RG1198) on the y-axis and % T2Luc viability (Donor 330) on the x-axis; FIG. 5B depicts the response of the BiTE® molecule MA_03-G10_AS CC_x_I2C0_x_ scFc_(N3H) against 112 MAGE-B2 similar peptides, MAGE-B2 and relevant controls in 2 different T-cell donors, with % T2Luc viability (Donor RG1198) on the y-axis and % T2Luc viability (Donor 330) on the x-axis.

FIG. 6A depicts the potency of the MA_10-B5_CC_x_I2C0_x_scFc_(H6H) BiTE® molecule against MAGE-B2 and various reactive similar peptides, with % T2Luc viability on the x-axis and the log concentration [nM] on the x-axis; FIG. 6B depicts the potency of the MA_03-G10_AS CC_x_I2C0_x_scFc_(N3H) BiTE® molecule against MAGE-B2 and various reactive similar peptides, with % T2Luc viability on the x-axis and the log concentration [nM] on the x-axis.

FIG. 8. This figure summarizes in table format the TDCC activity of ten BiTE® molecules on four different cell lines with known MAGEB2 pMHC copies per cell. Note that the BiTE® molecule 3-character name is a shortened version of the full BiTE® molecule nomenclature as seen in Table 22 herein, where the 3-character name is in parentheses.

FIG. 11A depicts TDCC plots of two different BiTE® molecules on human primary cells (cardiac myocytes, endothelial cells, and epithelial cells), with % specific lysis (cytotoxicity) on the y-axis and BiTE® molecule concentration (nM) on the x-axis; FIG. 11B depicts BiTE® molecule induced target cell lysis on MAGEB2 negative cells, with % cytotoxicity on the y-axis and log BiTE® molecule concentration (pM) on the x-axis. Note that the BiTE® molecule 3-character name is a shortened version of the full BiTE® molecule nomenclature as seen in Table 22 herein, where the 3-character name is in parentheses.

FIGS. 12A and 12B. FIG. 12A depicts TDCC plots of varying BiTE® molecules on MAGEA4(+)/MAGEB2(−) cell lines (NCI-H1703 and SCaBER), with % specific cytotoxicity on the y-axis and log BiTE® molecule concentration (pM) on the x-axis. Note that the BiTE® molecule 3-character name is a shortened version of the full BiTE® molecule nomenclature as seen in Table 22 herein, where the 3-character name is in parentheses. FIG. 12B is a table form of the data from FIG. 12A and highlights the differences in activity between Family 4 molecules and Family 7 molecules, where only Family 7 molecules show activity against MAGE-A4 expressing cells.

FIGS. 13A and 13B. FIG. 13A depicts the structure of the MAGEB2 peptide interactions with MHC. The left structure is a protein structure representation of the peptide-MHC complex (pMHC) and the right structure is a representation of the electrostatic surface of the pM HC; FIG. 13B depicts the structure of the MAGEB2 peptide interactions with other HLA-A*02 serotypes.

FIG. 25. This figure summarizes sequence alignments of three different Family 4 BiTE® molecules. SEQ ID NOs 18470-18472, 556, 556, and 576, are disclosed in their respective order of appearance.

FIG. 26. This figure summarizes sequence alignments of three different Family 7 BiTE® molecules. SEQ ID NOs 18473-18478 are disclosed in their respective order of appearance.

FIGS. 37A-37C. These figures contain six different graphical summaries of TDCC assays using the N3H molecule to target cells expressing various different HLAs, demonstrating effective cell targeting and killing against cells expressing HLA A*02:01 (FIG. 37C), HLA A*02:05 (FIG. 37A), HLA A*02:06 (FIG. 37B), and HLA A*02:07 (FIG. 37C) and as further detailed in Example 13 herein. The y-axis shows % specific cytotoxicity and the x-axis shows the log MAGEB2 peptide concentration (M).

FIGS. 38A-38C. These figures summarize FACS analyses performed on cells expressing various different HLAs and pulsed with the MAGEB2 peptide at 50 μM and 0.05 μM (and unpulsed controls) (FIGS. 38A-38C), demonstrating effective loading with peptide of HLA A*02:01 (FIG. 38B), HLA A*02:05 (FIG. 38B), HLA A*02:06 (FIG. 38C), and HLA A*02:07 (FIG. 38C) and as further detailed in Example 13 herein.

FIG. 44. This figure provides an in silico model comparison between WT and L6A at light chain positions 92, 95, 96, and 97, and is further described in Example 14 herein.

FIG. 46. This figure provides an in silico model comparison between WT and Y8P at light chain positions 92, 95, 96, and 97, and is further described in Example 14 herein.

Figure 47:
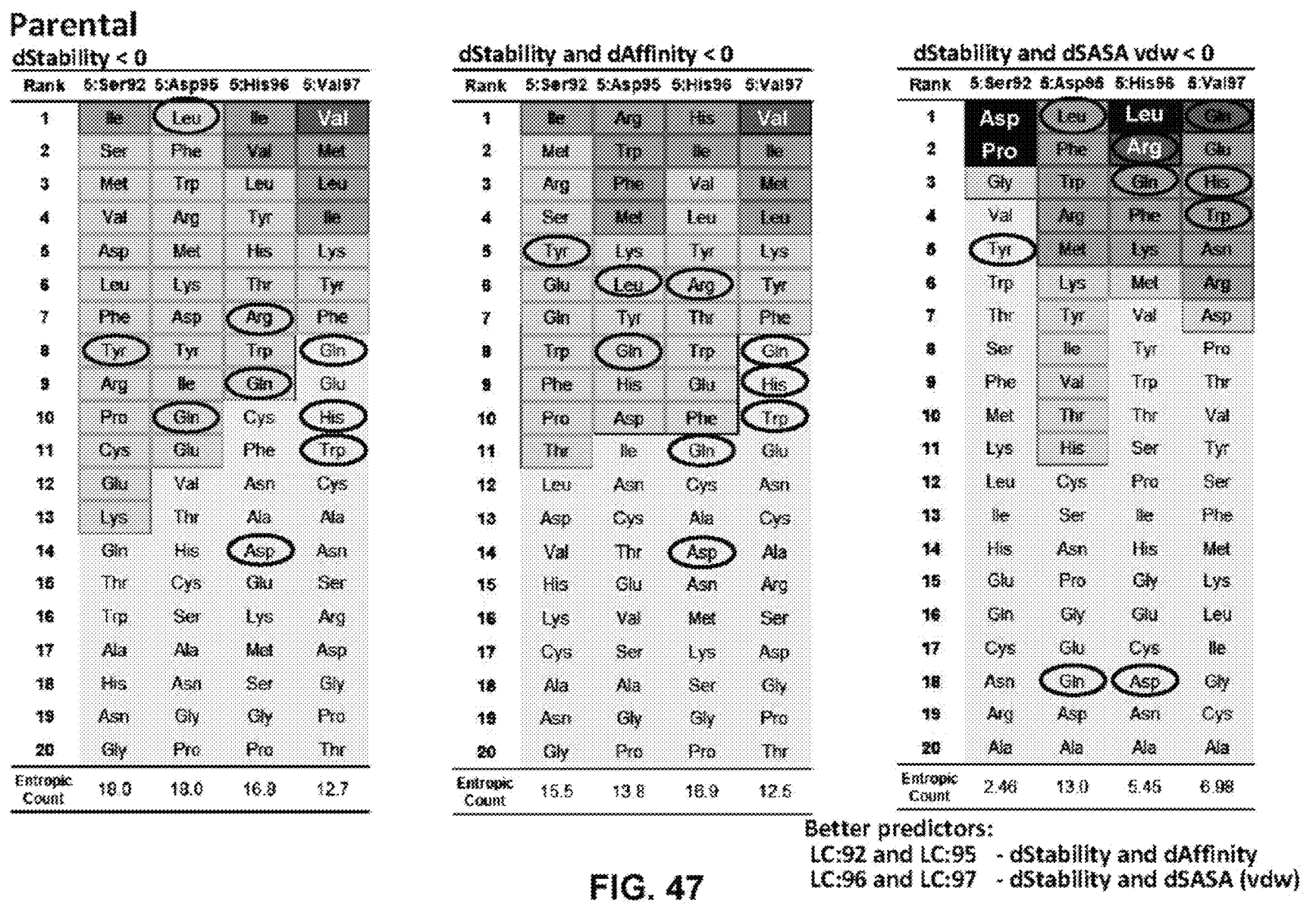

FIG. 47. This figure provides in silico model predicted alternate residues at light chain positions 92, 95, 96, and 97 in the parental molecule, and is further described in Example 14 herein.

Figure 49:
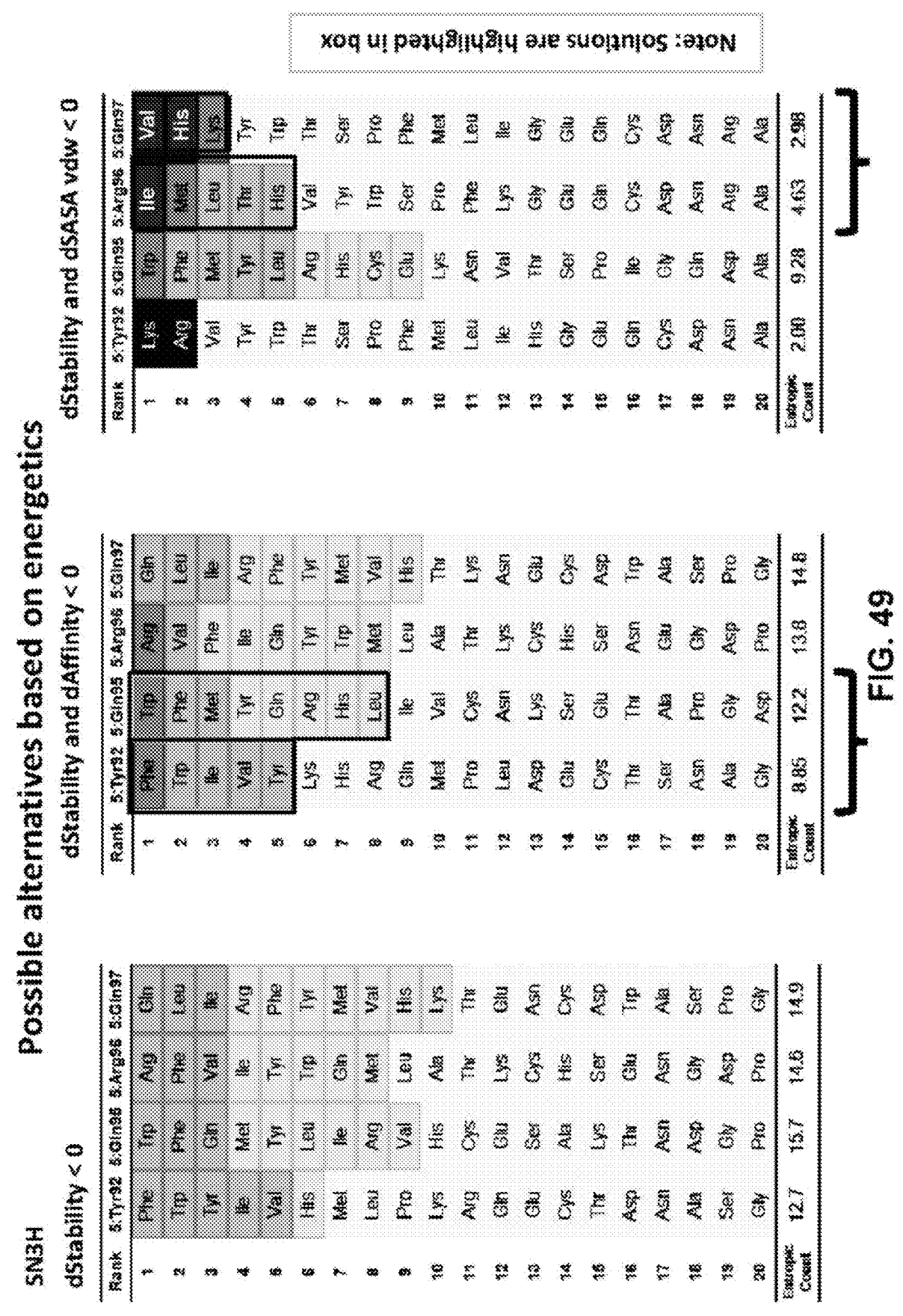

FIG. 49. This figure provides in silico model predicted alternate residues at light chain positions 92, 95, 96, and 97 in the N3H molecule, and is further described in Example 14 herein.

Figure 50:
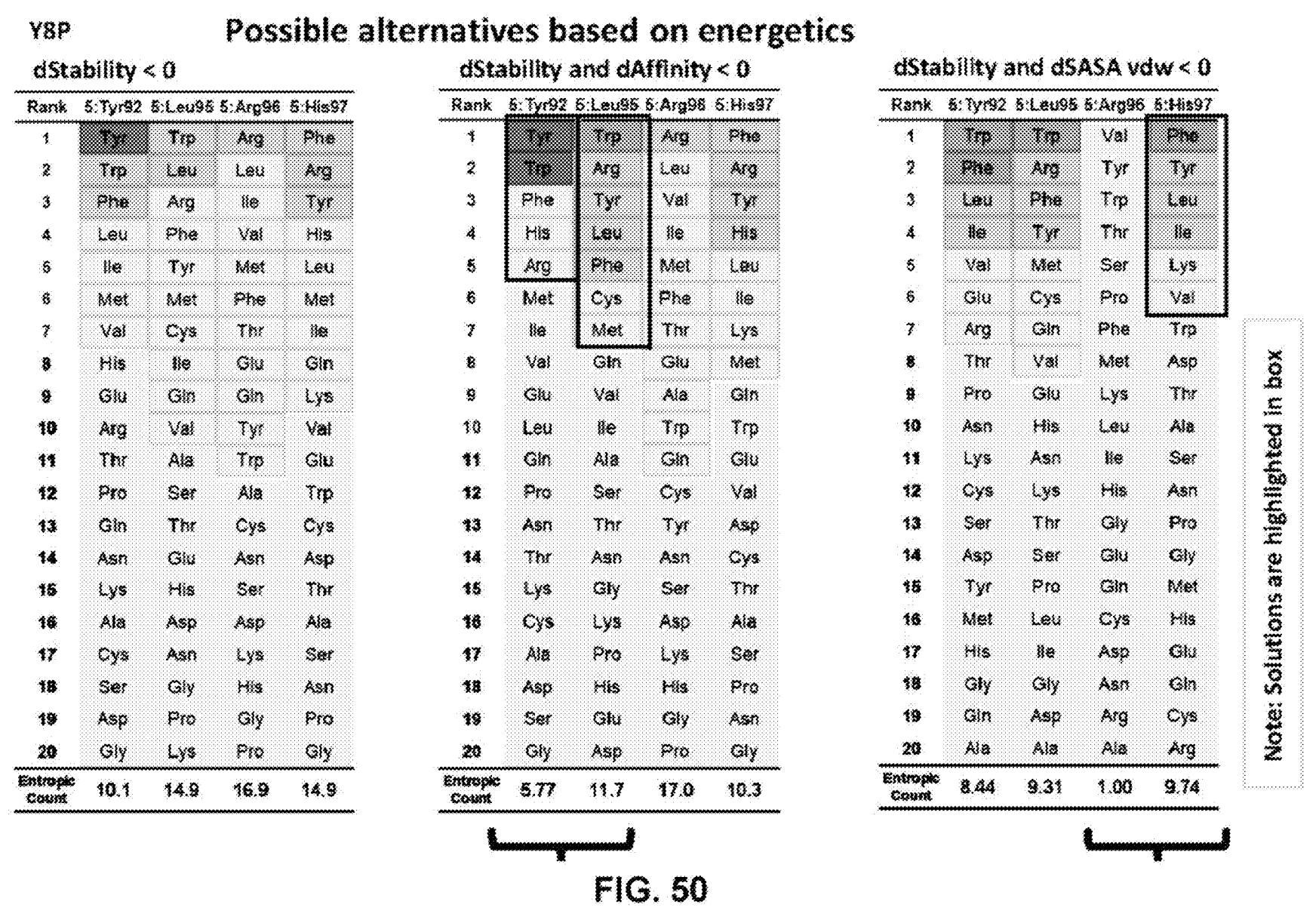

FIG. 50. This figure provides in silico model predicted alternate residues at light chain positions 92, 95, 96, and 97 in the Y8P molecule, and is further described in Example 14 herein.

DETAILED DESCRIPTION

Figure 2A:
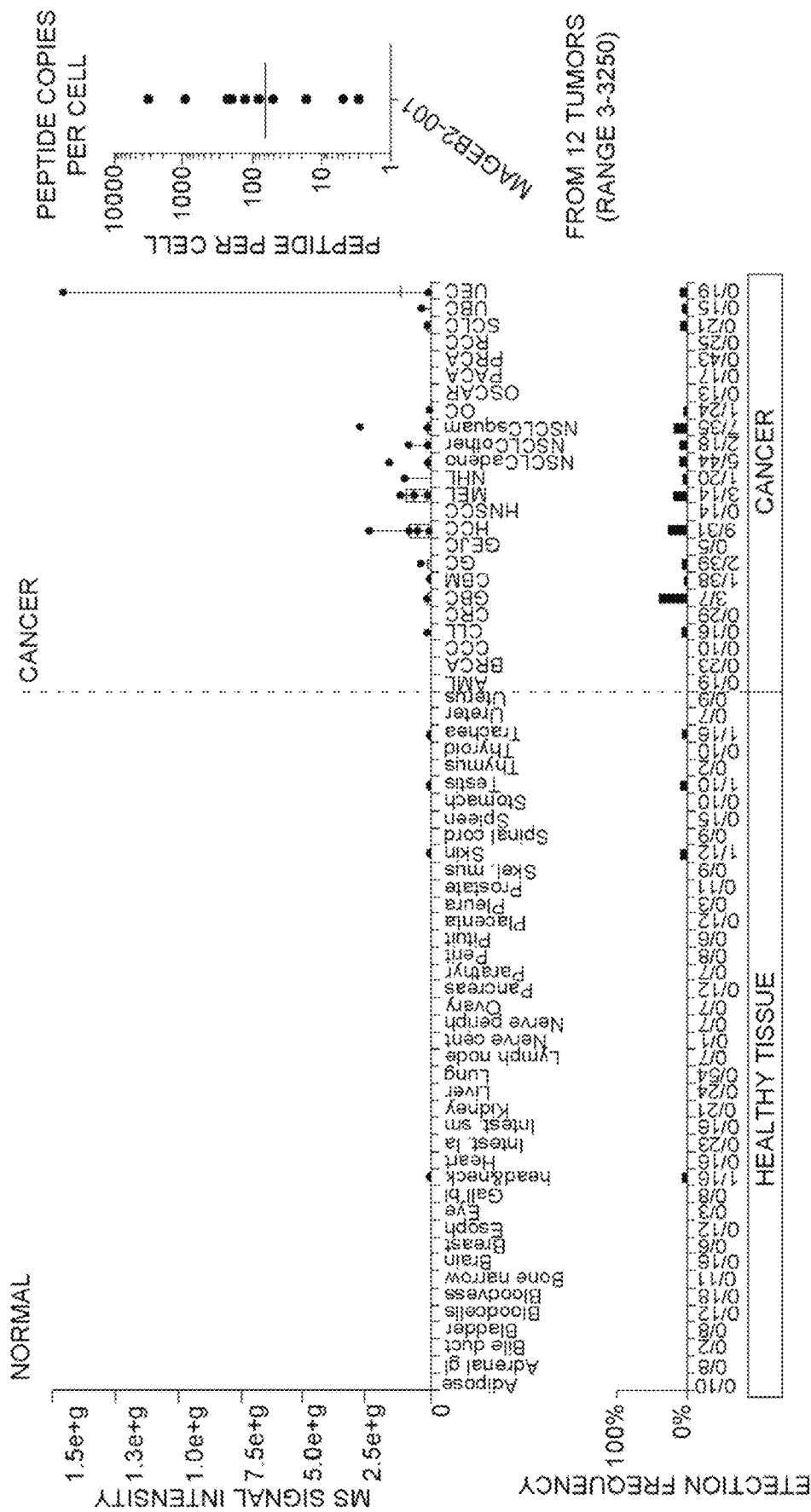
FIGS. 2A-2F.

HLA class I and HLA class II (alternatively called MHC class I and MHC class II) molecules on the cell surface present antigens to the immune system. In some cases, endogenously produced proteins, such as MAGEB2, are proteolytically cleaved into peptides within the cell and presented on the cell surface via the MHC class I molecule. Typically, these peptides are 8-13 amino acid residues long and also comprise "anchor residues" that help bind the peptide to the MHC molecule's binding groove.

As discussed above, MAGEB2 is aberrantly expressed in a variety of human cancer types. MAGEB2 is not typically expressed on the surface of cells. MAGEB2 peptides, however, are displayed on the surface of tumor cells by the MHC class I molecule. In particular, the MAGEB2 peptide GVYDGEEHSV (SEQ ID NO: 1) is displayed on the surface of tumor cells by the MHC class I molecule as a peptide-MHC ("pMHC") complex. See, for example, U.S. Patent Appl. Publ. No. US2016/0250307A1 (U.S. patent application Ser. No. 14/975,952) and US2017/0080070A1 (U.S. patent application Ser. No. 15/357,757).

Given that this MAGEB2 peptide is displayed on the surface of a cell (e.g., a cancer cell), albeit in the context of a peptide-MHC complex, it is potentially targetable by specific binding agents such as monoclonal antibodies or bispecific antibody constructs. Generating an antibody or bispecific antibody construct or other binding construct that targets this peptide-MHC complex poses a unique and difficult challenge due to expression of the MHC on nearly all cells in the body and the possibility of detrimental binding to MHC not presenting the MAGEB2 peptide. This is compounded by the peptide being so relatively small in comparison to the MHC complex. As will be described herein, the binding constructs of the invention overcome those challenges.

The term "pMAGE-HLA" as used herein refers to the MAGEB2 peptide GVYDGEEHSV (SEQ ID NO: 1), the MAGEA4 peptide GVYDGREHTV (SEQ ID NO: 2) and/or the MAGEA8 peptide GLYDGREHSV (SEQ ID NO: 3) when complexed with an HLA (e.g., HLA-A*02:01). Alternatively, the term "pMHC" as used herein can refer to the same and be used interchangeably, or it can refer to simply a peptide-MHC (HLA) complex in more general terms.

Bispecific antibody constructs comprising one domain that binds to CD3 expressed on a T-cell surface and one domain that binds to a target protein expressed on a target cell directly connect T-cells to target cells to induce T-cell redirected lysis. This mechanism of action is distinct from chemotherapies, other types of targeted therapies, and other immunotherapies in that it can work with any CD3-positive T-cell, independent of a costimulatory activating signal (Klinger et al., Immunol Reviews 2016). The presence of the pMAGE-HLA on the cell surface of cancer cells such as non-small cell lung carcinoma, hepatocellular carcinoma, or head and neck carcinoma provides a basis for targeting these cancers with a bispecific antibody construct that binds to a pMAGE-HLA (e.g., the MAGEB2 peptide of SEQ ID NO: 1 complexed with an HLA) and CD3.

In certain embodiments of the present invention, antibody constructs, including bispecific antibody constructs, targeting specifically a pMAGE-HLA derived from MAGEB2 associated with a malignancy are provided. To further this invention, MAGEB2 may be identified as a gene that is upregulated and/or aberrantly expressed in tumors relative to normal tissue expression of MAGEB2. In this regard, it may be shown that the MAGEB2 protein or a specific MAGEB2 peptide is expressed in particular tumors, or displayed on the cell surface, according to methods known in the art, for example, genetic analyses, immunohistochemistry, or mass spectrometry.

In an embodiment, the present disclosure provides for methods of initiating a T cell-mediated immune response to a target cell or tissue in a subject. The method, in some embodiments, includes administering an effective amount of a binding domain or antibody construct, e.g. a bispecific antibody, described herein, specifically targeting pMAGE-HLA (e.g., with a MAGEB2 peptide) and/or a modified T cell, e.g. a CAR-T cell, that contains a nucleic acid encoding the binding domain or antibody construct, e.g. a bispecific antibody, to a subject in need thereof. In another embodiment, the modified T cell expresses a binding domain or antibody construct, e.g. a bispecific antibody, that may be anchored on a cell surface of the modified T cell or may be secreted from the modified T cell.

One particular example of mass spectrometry that can be used to show MAGEB2 expression by a cell is a high-throughput platform that is based on ultra-sensitive mass spectrometry, known as XPRESIDENT® (www.immatics.com/x-president.html). This high throughput platform identifies HLA-bound peptides presented on tumor cells and has very high sensitivity allowing detection of these HLA-bound peptides at attomolar levels. All XPRESIDENT® peptides are sourced from native tumors (in 20 major cancer indications) including primary tissues and metastatic biopsies as well as tissues derived from healthy organs (40 most relevant organs of the human body). This target database comprises over 2000 tissue samples. Peptides are analyzed and identified through a combination of quantitative HLA peptidomics (mass spectrometry) complemented by quantitative transcriptomics (mRNA sequencing), enabling the analysis of differential expression and presentation of these potential drug targets between tumor and normal tissue. All HLA-restricted targets discovered by XPRESIDENT® on any allele are proven to be present on patients' cancer tissues in contrast to those predicted by in silico techniques. See also, U.S. Pat. Nos. 10,545,154, 9,791,443, and 7,811,828.

It may also be demonstrated by flow cytometry that the pMAGE-HLA is present on the cell surface of particular cancer cell lines. Accordingly, MAGEB2, and in particular the MAGEB2 peptide GVYDGEEHSV (SEQ ID NO: 1) complexed with an HLA, may be identified as a valid target associated with particular cancer types.

It is a surprising finding in the context of the present invention that the bispecific antibody constructs according to the present invention target the MAGEB2 peptide GVYDG-EEHSV (SEQ ID NO: 1) that is presented on a cancer cell surface by an MHC class I molecule with very high specificity, as will be discussed further herein. Lack of killing of non-cancer cells by the bispecific antibody constructs according to the present invention can likewise be confirmed in vitro and in vivo.

It is envisaged in the context of the present invention, that preferred bispecific antibody constructs do not only show a favorable ratio of cytotoxicity to affinity, but additionally show sufficient stability characteristics in order to facilitate practical handling in formulating, storing and administrating said constructs. Sufficient stability is, for example, characterized by a high monomer content (i.e. non-aggregated and/or non-associated, native molecule) after standard preparation, such as at least 65% as determined by preparative size exclusion chromatography (SEC), more preferably at least 70% and even more preferably at least 75%. Also, the turbidity measured, e.g., at 340 nm as optical absorption at a concentration of 2.5 mg/ml should, preferably, be equal to or lower than 0.025, more preferably 0.020, e.g., in order to conclude to the essential absence of undesired aggregates. Advantageously, high monomer content is maintained after incubation in stress conditions such as freeze/thaw or incubation at 37 or 40° C.

pMAGE-HLA Binding Molecules

The invention provides antibody construct comprising a domain which binds to a pMAGE-HLA and optionally, another domain which binds to CD3.

Table 1 below provides amino acid sequences of exemplary MAGEB2 binding molecules VH-CDRs and VL-CDRs. Table 2 below provides amino acid sequences of exemplary MAGEB2 binding molecule VH and VL domains.

In certain embodiments, in addition to binding the MAGEB2 peptide (SEQ ID NO: 1) complexed with an MHC molecule, the binding molecules may bind to a MAGEA4 peptide (e.g., SEQ ID NO: 2) complexed with an MHC molecule and/or a MAGEA8 peptide (e.g., SEQ ID NO: 3) complexed with an MHC molecule.

TABLE 1

| Molecule | CDR-L1 | CDR-L2 | CDR-L3 | CDR-H1 | CDR-H2 | CDR-H3 |
|---|---|---|---|---|---|---|
| H6H | RTSQSISSYLN (SEQ ID NO: 223) | AASSLQG (SEQ ID NO: 224) | QQTYSMPFT (SEQ ID NO: 225) | NAWMS (SEQ ID NO: 439) | RIRSRSYGGTTDYAAPVKG (SEQ ID NO: 440) | PSYSGSYYNYFSVMDV (SEQ ID NO: 441) |
| N3H | GGNNIGSKSVH (SEQ ID NO: 145) | DDNDRPS (SEQ ID NO: 146) | QVWDYSGQRQV (SEQ ID NO: 147) | SYAMS (SEQ ID NO: 361) | AISGSGGGTYYAASVKG (SEQ ID NO: 362) | GKGVHLGFDY (SEQ ID NO: 363) |
| Y8P | GGNNIGSKSVH (SEQ ID NO: 307) | DDNDRPS (SEQ ID NO: 308) | QVWDYSPLRHV (SEQ ID NO: 309) | SHAMS (SEQ ID NO: 523) | SISGSGGGTYYAASVKG (SEQ ID NO: 524) | GKGVHLGFDY (SEQ ID NO: 525) |
| L7E | GGNNIGSKSVH (SEQ ID NO: 115) | DDNDRPS (SEQ ID NO: 116) | QVWDYRTLDWV (SEQ ID NO: 117) | SHAMS (SEQ ID NO: 331) | TISGSGGGTYYAASVKG (SEQ ID NO: 332) | GKGVHLGFDY (SEQ ID NO: 333) |
| H6N | GGNNIGSKSVH (SEQ ID NO: 121) | DDNDRPS (SEQ ID NO: 122) | QVWDYRTLDWV (SEQ ID NO: 123) | SHAMS (SEQ ID NO: 337) | TISGSGGGTYYADSVKG (SEQ ID NO: 338) | GKGVHLGFDY (SEQ ID NO: 339) |

TABLE 2

| Molecule | VL | VH |
|---|---|---|
| H6H | DIQMTQSPSSLSASV GDRVTITCRTSQSIS SYLNWYQQKPGRAPK LLIFAASSLQGGVPS RFSGSGSGTDFTLTI SSLQPEDFATYYCQ QTYSMPFTFGCGTK VEIK (SEQ ID NO: 628) | EVQLVESGGGLVQPG GSLRLSCAASGFTFS NAWMSWVRQAPGKCL EWVGRIRSRSYGGTT DYAAPVKGRFTISRD DSKNTLFLQMNSLKT EDTAVYYCTTPSYSG SYYNYFSVMDVWGQG TTVTVSS (SEQ ID NO: 629) |
| N3H | SYVLTQPPSVSVAPG QTARITCGGNNIGSK SVHWYQQKPGQAPVM VVYDDNDRPSGIPER FSGSNSGNTATLTIS RVEAGDEADYYCQVW DYSGQRQVFGCGTKL TVL (SEQ ID NO: 576) | EVQLLESGGGLVQPG GSLRLSCAASGFTFS SYAMSWVRQAPGKCL EWVSAISGSGGGTYY AASVKGRFTISRDNS KNTLYLQMSSLRAED TAVYYCATGKGVHLG FDYWGQGTLVTVSS (SEQ ID NO: 577) |
| Y8P | SYVLTQPPSVSVAPG QTARITCGGNNIGSK SVHWYQQKPGQAPVM VVYDDNDRPSGIPER FSGSNSGNTATLTIS RVEAGDEADYYCQVW DYSPLRHVFGCGTKL TVL (SEQ ID NO: 684) | EVQLLESGGGLVQPG GSLRLSCAASGFTFS SHAMSWVRQAPGKCL EWVSSISGSGGGTYY AASVKGRFTISRDNS KNTLYLQMNSLRAED TAVYYCATGKGVHLG FDYWGQGTLVTVSS (SEQ ID NO: 685) |
| L7E | SYVLTQPPSVSVAPG QTARITCGGNNIGSK SVHWYQQKPGQAPVM WYDDNDRPSGIPERF SGSNFGNTATLIISR VEAGDEADYYCQVWD YRTLDWVFGCGTKLT VL (SEQ ID NO: 556) | EVQLLESGGGLVQPG GSLRLSCAASGFTFS SHAMSWVRQAPGKCL EWVSTISGSGGGTYY AASVKGRFTISRDNS KNTLYLQMNSLRAED TAVYYCATGKGVHLG FDYWGQGTLVTVSS (SEQ ID NO: 557) |
| H6N | SYVLTQPPSVSVAPG QTARITCGGNNIGSK SVHWYQQKPGQAPVM WYDDNDRPSGIPERF SGSNFGNTATLIISR VEAGDEADYYCQVWD YRTLDWVFGCGTKLT VL (SEQ ID NO: 560) | EVQLLESGGGLVQPG GSLRLSCAASGFTFS SHAMSWVRQAPGKCL EWVSTISGSGGGTYY ADSVKGRFTISRDNS KNTLYLQMNSLRAED TAVYYCATGKGVHLG FDYWGQGTLVTVSS (SEQ ID NO: 561) |

In one embodiment, the invention provides an isolated binding domain that binds to a pMAGE-HLA on the surface of a target cell, wherein the binding domain comprises:
a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225; or
b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147; or
c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309; or
d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117; or
e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123; or
f) [H6H] a VH region as depicted in SEQ ID NO: 629, and a VL region as depicted in SEQ ID NO: 628; or
g) [N3H] a VH region as depicted in SEQ ID NO: 577, and a VL region as depicted in SEQ ID NO: 576; or
h) [Y8P] a VH region as depicted in SEQ ID NO: 684, and a VL region as depicted in SEQ ID NO: 685; or
i) [L7E] a VH region as depicted in SEQ ID NO: 557, and a VL region as depicted in SEQ ID NO: 556; or
j) [H6N] a VH region as depicted in SEQ ID NO: 561, and a VL region as depicted in SEQ ID NO: 560.

In one embodiment, the invention provides an isolated antibody construct comprising a binding domain that binds to a pMAGE-HLA on the surface of a target cell, wherein the binding domain comprises:
a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225; or
b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147; or
c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309; or
d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117; or
e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123; or
f) [H6H] a VH region as depicted in SEQ ID NO: 629, and a VL region as depicted in SEQ ID NO: 628; or
g) [N3H] a VH region as depicted in SEQ ID NO: 577, and a VL region as depicted in SEQ ID NO: 576; or
h) [Y8P] a VH region as depicted in SEQ ID NO: 684, and a VL region as depicted in SEQ ID NO: 685; or
i) [L7E] a VH region as depicted in SEQ ID NO: 557, and a VL region as depicted in SEQ ID NO: 556; or j) [H6N] a VH region as depicted in SEQ ID NO: 561, and a VL region as depicted in SEQ ID NO: 560.

In one embodiment, the invention provides a T-cell receptor (TCR) comprising an isolated binding domain that binds to a pMAGE-HLA on the surface of a target cell, wherein the binding domain comprises:
a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225; or
b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147; or
c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309; or
d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117; or
e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123; or
f) [H6H] a VH region as depicted in SEQ ID NO: 629, and a VL region as depicted in SEQ ID NO: 628; or
g) [N3H] a VH region as depicted in SEQ ID NO: 577, and a VL region as depicted in SEQ ID NO: 576; or
h) [Y8P] a VH region as depicted in SEQ ID NO: 684, and a VL region as depicted in SEQ ID NO: 685; or
i) [L7E] a VH region as depicted in SEQ ID NO: 557, and a VL region as depicted in SEQ ID NO: 556; or
j) [H6N] a VH region as depicted in SEQ ID NO: 561, and a VL region as depicted in SEQ ID NO: 560.

In one embodiment, the invention provides an isolated binding domain that binds to a pMAGE-HLA on the surface of a target cell, wherein the binding domain binds to the same epitope as an antibody or antibody construct that comprises:
a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225; or
b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147; or
c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309; or
d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117; or
e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123; or
f) [H6H] a VH region as depicted in SEQ ID NO: 629, and a VL region as depicted in SEQ ID NO: 628; or
g) [N3H] a VH region as depicted in SEQ ID NO: 577, and a VL region as depicted in SEQ ID NO: 576; or
h) [Y8P] a VH region as depicted in SEQ ID NO: 684, and a VL region as depicted in SEQ ID NO: 685; or
i) [L7E] a VH region as depicted in SEQ ID NO: 557, and a VL region as depicted in SEQ ID NO: 556; or
j) [H6N] a VH region as depicted in SEQ ID NO: 561, and a VL region as depicted in SEQ ID NO: 560.

In one embodiment, the invention provides an isolated antibody construct comprising a binding domain that binds to a pMAGE-HLA on the surface of a target cell, wherein the binding domain binds to the same epitope as an antibody or antibody construct that comprises:
a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225;
b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147;
c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309;
d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117;
e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123;
f) [H6H] a VH region as depicted in SEQ ID NO: 629, and a VL region as depicted in SEQ ID NO: 628;
g) [N3H] a VH region as depicted in SEQ ID NO: 577, and a VL region as depicted in SEQ ID NO: 576;
h) [Y8P] a VH region as depicted in SEQ ID NO: 684, and a VL region as depicted in SEQ ID NO: 685;
i) [L7E] a VH region as depicted in SEQ ID NO: 557, and a VL region as depicted in SEQ ID NO: 556; or j) [H6N] a VH region as depicted in SEQ ID NO: 561, and a VL region as depicted in SEQ ID NO: 560.

In one embodiment, the invention provides a T-cell receptor (TCR) comprising an isolated binding domain that binds to a pMAGE-HLA on the surface of a target cell, wherein the binding domain binds to the same epitope as an antibody or antibody construct that comprises:
  a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225; or
  b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147; or
  c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309; or
  d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117; or
  e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123; or
  f) [H6H] a VH region as depicted in SEQ ID NO: 629, and a VL region as depicted in SEQ ID NO: 628; or
  g) [N3H] a VH region as depicted in SEQ ID NO: 577, and a VL region as depicted in SEQ ID NO: 576; or
  h) [Y8P] a VH region as depicted in SEQ ID NO: 684, and a VL region as depicted in SEQ ID NO: 685; or
  i) [L7E] a VH region as depicted in SEQ ID NO: 557, and a VL region as depicted in SEQ ID NO: 556; or
  j) [H6N] a VH region as depicted in SEQ ID NO: 561, and a VL region as depicted in SEQ ID NO: 560.

In another embodiment, the invention provides an isolated antibody construct comprising a binding domain that binds to a pMAGE-HLA on the surface of a target cell, wherein the binding domain binds to the same epitope as an antibody or antibody construct that comprises a VH region selected from the group consisting of any VH region and/or a VL region as depicted in any of the sequences in Tables 27 (SEQ ID NOs: 550-697), 35 (SEQ ID NOs: 3083-3118), 43 (SEQ ID NOs: 3979-4010), 51 (SEQ ID NOs: 5023-5118), 57 (SEQ ID NOs: 9351-10066), or 67 (SEQ ID NOs: 16667-16718).

In another embodiment, the invention provides an isolated antibody construct comprising a binding domain that binds to a pMAGE-HLA on the surface of a target cell, wherein the binding domain binds to the same epitope as an antibody or antibody construct that comprises a CDR-H1, CDR-H2, CDR-H3 from a VH region selected from the group consisting of any VH region as depicted in any of the sequences in Tables 24 (SEQ ID NOs: 322-537), 32 (SEQ ID NOs: 2984-3064), 40 (SEQ ID NOs: 3891-3962), 48 (SEQ ID NOs: 4759-4974), 56 (SEQ ID NOs: 7561-9350), or 66 (SEQ ID NOs: 16537-16666) and/or further comprises a CDR-L1, CDR-L2, CDR-L3 from a VL region selected from the group consisting of any VL region as depicted in any of the sequences in Tables 23 (SEQ ID NOs: 106-321), 31 (SEQ ID NOs: 2975-3055), 39 (SEQ ID NOs: 3883-3954), 47 (SEQ ID NOs: 4735-4950), 55 (SEQ ID NOs: 7203-8992), or 65 (SEQ ID NOs: 16511-16640).

In one embodiment, the invention provides an isolated antibody construct comprising a first binding domain that binds to a pMAGE-HLA on the surface of a target cell, and a second binding domain that binds to human CD3 on the surface of a T cell, wherein the first binding domain comprises:
  a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225; or
  b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147; or
  c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309; or
  d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117; or
  e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123; or
  f) [H6H] a VH region as depicted in SEQ ID NO: 629, and a VL region as depicted in SEQ ID NO: 628; or
  g) [N3H] a VH region as depicted in SEQ ID NO: 577, and a VL region as depicted in SEQ ID NO: 576; or
  h) [Y8P] a VH region as depicted in SEQ ID NO: 684, and a VL region as depicted in SEQ ID NO: 685; or
  i) [L7E] a VH region as depicted in SEQ ID NO: 557, and a VL region as depicted in SEQ ID NO: 556; or
  j) [H6N] a VH region as depicted in SEQ ID NO: 561, and a VL region as depicted in SEQ ID NO: 560.

and the second binding domain comprises:
  k) a VH region comprising CDR-H1 as depicted in SEQ ID NO: 547, CDR-H2 as depicted in SEQ ID NO: 548, and CDR-H3 as depicted in SEQ ID NO: 549, and a VL region comprising CDR-L1 as depicted in SEQ ID NO: 541, CDR-L2 as depicted in SEQ ID NO: 542 and CDR-L3 as depicted in SEQ ID NO: 543; or
  l) a VH region as depicted in SEQ ID NO: 697, and a VL region as depicted in SEQ ID NO: 696.

In another embodiment, the invention provides an isolated antibody construct comprising a first binding domain that binds to a pMAGE-HLA on the surface of a target cell, and a second binding domain that binds to human CD3 on the surface of a T cell, wherein the first binding domain binds to the same epitope as an antibody or antibody construct that comprises:

a) [H6H] a VH region comprising CDR-H1 as depicted in SEQ ID NO: 439, CDR-H2 as depicted in SEQ ID NO: 440, and CDR-H3 as depicted in SEQ ID NO: 441, and a VL region comprising CDR-L1 as depicted in SEQ ID NO: 223, CDR-L2 as depicted in SEQ ID NO: 224 and CDR-L3 as depicted in SEQ ID NO: 225; or b) [N3H] a VH region comprising CDR-H1 as depicted in SEQ ID NO: 361, CDR-H2 as depicted in SEQ ID NO: 362, and CDR-H3 as depicted in SEQ ID NO: 363, and a VL region comprising CDR-L1 as depicted in SEQ ID NO: 145, CDR-L2 as depicted in SEQ ID NO: 146 and CDR-L3 as depicted in SEQ ID NO: 147; or c) [Y8P] a VH region comprising CDR-H1 as depicted in SEQ ID NO: 523, CDR-H2 as depicted in SEQ ID NO: 524, and CDR-H3 as depicted in SEQ ID NO: 525, and a VL region comprising CDR-L1 as depicted in SEQ ID NO: 307, CDR-L2 as depicted in SEQ ID NO: 308 and CDR-L3 as depicted in SEQ ID NO: 309; or d) [L7E] a VH region comprising CDR-H1 as depicted in SEQ ID NO: 331, CDR-H2 as depicted in SEQ ID NO: 332, and CDR-H3 as depicted in SEQ ID NO: 333, and a VL region comprising CDR-L1 as depicted in SEQ ID NO: 115, CDR-L2 as depicted in SEQ ID NO: 116 and CDR-L3 as depicted in SEQ ID NO: 117; or e) [H6N] a VH region comprising CDR-H1 as depicted in SEQ ID NO: 337, CDR-H2 as depicted in SEQ ID NO: 338, and CDR-H3 as depicted in SEQ ID NO: 339, and a VL region comprising CDR-L1 as depicted in SEQ ID NO: 121, CDR-L2 as depicted in SEQ ID NO: 122 and CDR-L3 as depicted in SEQ ID NO: 123; or f) [H6H] a VH region as depicted in SEQ ID NO: 629, and a VL region as depicted in SEQ ID NO: 628; or g) [N3H] a VH region as depicted in SEQ ID NO: 577, and a VL region as depicted in SEQ ID NO: 576; or h) [Y8P] a VH region as depicted in SEQ ID NO: 684, and a VL region as depicted in SEQ ID NO: 685; or i) [L7E] a VH region as depicted in SEQ ID NO: 557, and a VL region as depicted in SEQ ID NO: 556; or j) [H6N] a VH region as depicted in SEQ ID NO: 561, and a VL region as depicted in SEQ ID NO: 560.

and the second binding domain comprises:

k) a VH region comprising CDR-H1 as depicted in SEQ ID NO: 547, CDR-H2 as depicted in SEQ ID NO: 548, and CDR-H3 as depicted in SEQ ID NO: 549, and a VL region comprising CDR-L1 as depicted in SEQ ID NO: 541, CDR-L2 as depicted in SEQ ID NO: 542 and CDR-L3 as depicted in SEQ ID NO: 543; or l) a VH region as depicted in SEQ ID NO: 697, and a VL region as depicted in SEQ ID NO: 696.

In another embodiment, the invention provides an isolated antibody construct comprising a first binding domain that binds to a pMAGE-HLA on the surface of a target cell, and a second binding domain that binds to human CD3 on the surface of a T cell, wherein the first binding domain comprises a VH region selected from the group consisting of any VH region and/or a VL region as depicted in any of the sequences in Tables 27 (SEQ ID NOs: 550-697), 35 (SEQ ID NOs: 3083-3118), 43 (SEQ ID NOs: 3979-4010), 51 (SEQ ID NOs: 5023-5118), 57 (SEQ ID NOs: 9351-10066), or 67 (SEQ ID NOs: 16667-16718).

In another embodiment, the invention provides an isolated antibody construct comprising a first binding domain that binds to a pMAGE-HLA on the surface of a target cell, and a second binding domain that binds to human CD3 on the surface of a T cell, wherein the first binding domain comprises a CDR-H1, CDR-H2, CDR-H3 from a VH region selected from the group consisting of any VH region as depicted in any of the sequences in Tables 24 (SEQ ID NOs: 322-537), 32 (SEQ ID NOs: 2984-3064), 40 (SEQ ID NOs: 3891-3962), 48 (SEQ ID NOs: 4759-4974), 56 (SEQ ID NOs: 7561-9350), or 66 (SEQ ID NOs: 16537-16666) and/or further comprises a CDR-L1, CDR-L2, CDR-L3 from a VL region selected from the group consisting of any VL region as depicted in any of the sequences in Tables 23 (SEQ ID NOs: 106-321), 31 (SEQ ID NOs: 2975-3055), 39 (SEQ ID NOs: 3883-3954), 47 (SEQ ID NOs: 4735-4950), 55 (SEQ ID NOs: 7203-8992), or 65 (SEQ ID NOs: 16511-16640).

In another embodiment, the invention provides an isolated antibody construct comprising a first binding domain that binds to a pMAGE-HLA on the surface of a target cell, and a second binding domain that binds to human CD3 on the surface of a T cell, wherein the first binding domain binds to the same epitope as an antibody or antibody construct that comprises a VH region selected from the group consisting of any VH region and/or a VL region as depicted in any of the sequences in Tables 27 (SEQ ID NOs: 550-697), 35 (SEQ ID NOs: 3083-3118), 43 (SEQ ID NOs: 3979-1010), 51 (SEQ ID NOs: 5023-5118), 57 (SEQ ID NOs: 9351-10066), or 67 (SEQ ID NOs: 16667-16718).

In another embodiment, the invention provides an isolated antibody construct comprising a first binding domain that binds to a pMAGE-HLA on the surface of a target cell, and a second binding domain that binds to human CD3 on the surface of a T cell, wherein the first binding domain binds to the same epitope as an antibody or antibody construct that comprises a CDR-H1, CDR-H2, CDR-H3 from a VH region selected from the group consisting of any VH region as depicted in any of the sequences in Tables 24 (SEQ ID NOs: 322-537), 32 (SEQ ID NOs: 2984-3064), 40 (SEQ ID NOs: 3891-3962), 48 (SEQ ID NOs: 4759-4974), 56 (SEQ ID NOs: 7561-9350), or 66 (SEQ ID NOs: 16537-16666) and/or further comprises a CDR-L1, CDR-L2, CDR-L3 from a VL region selected from the group consisting of any VL region as depicted in any of the sequences in Tables 23 (SEQ ID NOs: 106-321), 31 (SEQ ID NOs: 2975-3055), 39 (SEQ ID NOs: 3883-3954), 47 (SEQ ID NOs: 4735-4950), 55 (SEQ ID NOs: 7203-8992), or 65 (SEQ ID NOs: 16511-16640).

In a further embodiment, the invention provides an isolated antibody construct comprising a binding domain that binds to a pMAGE-HLA on the surface of a target cell, wherein the binding domain comprises consensus sequences of any of the VH and/or VL and/or CDRs and/or framework regions set forth in Tables 29 (SEQ ID NOs: 1832-2965), 37 (SEQ ID NOs: 3497-3874), 45 (SEQ ID NOs: 4361-4710), 53 (SEQ ID NOs: 5982-6844), 61 (SEQ ID NOs: 13276-16184), 62 (SEQ ID NOs: 13434-16257), 63 (SEQ ID NOs: 13507-16484), 71 (SEQ ID NOs: 16971-17195), 72 (SEQ ID NOs: 16980-17204), 73 (SEQ ID NOs: 16989-17222), 111, 112, 113, 114, 115, 116, or 117. Note that in the consensus sequence tables herein above (Tables 29, 37, 45, 53, 61, 62, 63, 71, 72, and 73), the "*" found in some of the germline sequences designates a stop codon within the consensus sequence. Tables 111-117 provide consensus sequences from the tables herein above, however, they are in a different format that provides numerical positions for each amino acid residue in the consensus sequence.

In a specific embodiment, the invention provides an isolated antibody construct comprising a binding domain that binds to a pMAGE-HLA on the surface of a target cell, wherein the binding domain comprises a VH that comprises the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises the following amino acid residues: Asn25, Asn26, Gly28, Ser29, Lys30, Ser31, His33, Tyr48, Asp49, Asp50, Asn51, Asp52, Asn65, Phe66, Gly67, Trp90, Tyr92, Arg93, and Leu95.

In a specific embodiment, the invention provides an isolated antibody construct comprising a binding domain that binds to a pMAGE-HLA on the surface of a target cell, wherein the binding domain comprises a VH that comprises at least one, at least two, at least three, at least four, at least five, at least six, at least seven, at least eight, at least nine, at least ten, at least eleven, at least twelve, at least thirteen, at least fourteen, or at least fifteen of the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, or at least eighteen of the following amino acid residues: Asn25, Asn26, Gly28, Ser29, Lys30, Ser31, His33, Tyr48, Asp49, Asp50, Asn51, Asp52, Asn65, Phe66, Gly67, Trp90, Tyr92, Arg93, and Leu95.

In another embodiment, the invention provides an isolated antibody construct comprising a binding domain that binds to a pMAGE-HLA on the surface of a target cell, wherein the binding domain comprises a VH that comprises the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises the following amino acid residues: Asn25, Asn26, Gly28, Ser29, Lys30, Ser31, His33, Tyr48, Asp49, Asp50, Asn51, Asp52, Arg53, Asn65, Ser66, Gly67, Trp90, Tyr92, and Gln95.

In another embodiment, the invention provides an isolated antibody construct comprising a binding domain that binds to a pMAGE-HLA on the surface of a target cell, wherein the binding domain comprises a VH that comprises at least one, at least two, at least three, at least four, at least five, at least six, at least seven, at least eight, at least nine, at least ten, at least eleven, at least twelve, at least thirteen, at least fourteen, or at least fifteen of the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, or at least eighteen of the following amino acid residues: Asn25, Asn26, Gly28, Ser29, Lys30, Ser31, His33, Tyr48, Asp49, Asp50, Asn51, Asp52, Arg53, Asn65, Ser66, Gly67, Trp90, Tyr92, and Gln95.

In another embodiment, the invention provides an isolated antibody construct comprising a binding domain that binds to a pMAGE-HLA on the surface of a target cell, wherein the binding domain comprises a VH that comprises the following amino acid residues: Ser30, Asn31, Trp33, Arg50, Arg52, Arg54, Ser55, Tyr56, Gly57, Thr59, Tyr103, Ser104, Gly105, Ser106, Tyr107, Tyr108, Asn109, Tyr110, Phe111, and Ser112; and a VL that comprises the following amino acid residues: Ser30, Ser31, Tyr32, Ala50, Ser67, Thr91, Tyr92, Ser93, Met94, and Phe96.

In another embodiment, the invention provides an isolated antibody construct comprising a binding domain that binds to a pMAGE-HLA on the surface of a target cell, wherein the binding domain comprises a VH that comprises at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, or at least nineteen of the following amino acid residues: Ser30, Asn31, Trp33, Arg50, Arg52, Arg54, Ser55, Tyr56, Gly57, Thr59, Tyr103, Ser104, Gly105, Ser106, Tyr107, Tyr108, Asn109, Tyr110, Phe111, and Ser112; and a VL that comprises at least one, at least two, at least three, at least four, at least five, at least six, at least seven, at least eight, or at least nine of the following amino acid residues: Ser30, Ser31, Tyr32, Ala50, Ser67, Thr91, Tyr92, Ser93, Met94, and Phe96.

In another embodiment, the invention provides an isolated antibody construct comprising a binding domain that binds to a pMAGE-HLA on the surface of a target cell, wherein the binding domain comprises a VH from any of the VH sequences provided herein, and a VL that comprises the following amino acid residues: Tyr92, Leu95, Asp96, and Trp97.

In another embodiment, the invention provides an isolated antibody construct comprising a binding domain that binds to a pMAGE-HLA on the surface of a target cell, wherein the binding domain comprises a VH from any of the VH sequences provided herein, and a VL that comprises at least one, at least two, or at least three of the following amino acid residues: Tyr92, Leu95, Asp96, and Trp97.

In another embodiment, the invention provides an isolated antibody construct comprising a binding domain that binds to a pMAGE-HLA on the surface of a target cell, wherein the binding domain comprises a VH from any of the VH sequences provided herein, and a VL that comprises the following amino acid residues: Tyr92, Gln95, Gln96, and Gln97.

In another embodiment, the invention provides an isolated antibody construct comprising a binding domain that binds to a pMAGE-HLA on the surface of a target cell, wherein the binding domain comprises a VH from any of the VH sequences provided herein, and a VL that comprises at least one, at least two, or at least three of the following amino acid residues: Tyr92, Gln95, Gln96, and Gln97.

In another embodiment, the invention provides an isolated antibody construct comprising a binding domain that binds to a pMAGE-HLA on the surface of a target cell, wherein the binding domain comprises a VH from any of the VH sequences provided herein, and a VL that comprises the following amino acid residues: Tyr92, Gln95, Arg96, and Gln97.

In another embodiment, the invention provides an isolated antibody construct comprising a binding domain that binds to a pMAGE-HLA on the surface of a target cell, wherein the binding domain comprises a VH from any of the VH sequences provided herein, and a VL that comprises at least one, at least two, or at least three of the following amino acid residues: Tyr92, Gln95, Arg96, and Gln97. In another embodiment, the invention provides an isolated antibody construct comprising a binding domain that binds to a pMAGE-HLA on the surface of a target cell, wherein the binding domain comprises a VH from any of the VH sequences provided herein, and a VL that comprises the following amino acid residues: Tyr92, Leu95, Arg96, and His97.

In another embodiment, the invention provides an isolated antibody construct comprising a binding domain that binds to a pMAGE-HLA on the surface of a target cell, wherein the binding domain comprises a VH from any of the VH sequences provided herein, and a VL that comprises at least one, at least two, or at least three of the following amino acid residues: Tyr92, Leu95, Arg96, and His97.

In a further embodiment, the invention provides an isolated antibody construct comprising a first domain that binds to a pMAGE-HLA on the surface of a target cell, and a second binding domain that binds to human CD3 on the surface of a T cell, wherein the first binding domain comprises consensus sequences of any of the VH and/or VL and/or CDRs and/or framework regions set forth in Tables 29 (SEQ ID NOs: 1832-2965), 37 (SEQ ID NOs: 3497-3874), 45 (SEQ ID NOs: 4361-4710), 53 (SEQ ID NOs: 5982-6844), 61 (SEQ ID NOs: 13276-16184), 62 (SEQ ID NOs: 13434-16257), 63 (SEQ ID NOs: 13507-16484), 71 (SEQ ID NOs: 16971-17195), 72 (SEQ ID NOs: 16980-17204), 73 (SEQ ID NOs: 16989-17222), 111, 112, 113, 114, 115, 116, or 117.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH that comprises the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises the following amino acid residues: Asn25, Asn26, Gly28, Ser29, Lys30, Ser31, His33, Tyr48, Asp49, Asp50, Asn51, Asp52, Asn65, Phe66, Gly67, Trp90, Tyr92, Arg93, and Leu95.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH that comprises at least one, at least two, at least three, at least four, at least five, at least six, at least seven, at least eight, at least nine, at least ten, at least eleven, at least twelve, at least thirteen, at least fourteen, or at least fifteen of the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, or at least eighteen of the following amino acid residues: Asn25, Asn26, Gly28, Ser29, Lys30, Ser31, His33, Tyr48, Asp49, Asp50, Asn51, Asp52, Asn65, Phe66, Gly67, Trp90, Tyr92, Arg93, and Leu95.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH that comprises the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises the following amino acid residues: Asn25, Asn26, Gly28, Ser29, Lys30, Ser31, His33, Tyr48, Asp49, Asp50, Asn51, Asp52, Arg53, Asn65, Ser66, Gly67, Trp90, Tyr92, and Gln95.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH that comprises at least one, at least two, at least three, at least four, at least five, at least six, at least seven, at least eight, at least nine, at least ten, at least eleven, at least twelve, at least thirteen, at least fourteen, or at least fifteen of the following amino acid residues: Ser30, Ser31, His32, Ala33, Ser52, Gly53, Ser54, Gly56, Gly57, Tyr59, Lys100, Gly101, Val102, His103, Leu104, and Gly105; and a VL that comprises at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, or at least eighteen of the following amino acid residues: Asn25, Asn26, Gly28, Ser29, Lys30, Ser31, His33, Tyr48, Asp49, Asp50, Asn51, Asp52, Arg53, Asn65, Ser66, Gly67, Trp90, Tyr92, and Gln95.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH that comprises the following amino acid residues: Ser30, Asn31, Trp33, Arg50, Arg52, Arg54, Ser55, Tyr56, Gly57, Thr59, Tyr103, Ser104, Gly105, Ser106, Tyr107, Tyr108, Asn109, Tyr110, Phe111, and Ser112; and a VL that comprises the following amino acid residues: Ser30, Ser31, Tyr32, Ala50, Ser67, Thr91, Tyr92, Ser93, Met94, and Phe96.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH that comprises at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, or at least nineteen of the following amino acid residues: Ser30, Asn31, Trp33, Arg50, Arg52, Arg54, Ser55, Tyr56, Gly57, Thr59, Tyr103, Ser104, Gly105, Ser106, Tyr107, Tyr108, Asn109, Tyr110, Phe111, and Ser112; and a VL that comprises at least one, at least two, at least three, at least four, at least five, at least six, at least seven, at least eight, or at least nine of the following amino acid residues: Ser30, Ser31, Tyr32, Ala50, Ser67, Thr91, Tyr92, Ser93, Met94, and Phe96.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises the following amino acid residues: Tyr92, Leu95, Asp96, and Trp97.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises at least one, at least two, or at least three of the following amino acid residues: Tyr92, Leu95, Asp96, and Trp97.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises the following amino acid residues: Tyr92, Gln95, Gln96, and Gln97.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises at least one, at least two, or at least three of the following amino acid residues: Tyr92, Gln95, Gln96, and Gln97.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises the following amino acid residues: Tyr92, Gln95, Arg96, and Gln97.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises at least one, at least two, or at least three of the following amino acid residues: Tyr92, Gln95, Arg96, and Gln97.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises the following amino acid residues: Tyr92, Leu95, Arg96, and His97.

In another embodiment, the invention provides an isolated antibody construct comprising a first domain that binds to a pMAGE-HLA on the surface of a target cell, and a second binding domain that binds to human CD3 on the surface of a T cell, wherein the first binding domain comprises a VH from any of the VH sequences provided herein, and a VL that comprises at least one, at least two, or at least three of the following amino acid residues: Tyr92, Leu95, Arg96, and His97.

In another specific embodiment, the first domain of the antibody construct binds to an epitope comprising a MAGEB2 peptide (SEQ ID NO: 1), wherein the antibody construct comprises a VH region comprising a CDR-H1, a CDR-H2, and a CDR-H3, wherein CDR-H3 comprises a lysine at position 2, a valine at position 4, and/or a histidine at position 5.

In another specific embodiment, the first domain of the antibody construct binds to an epitope comprising a MAGEB2 peptide (SEQ ID NO: 1), wherein the antibody construct comprises a VH region comprising a CDR-H1, a CDR-H2, and a CDR-H3, wherein CDR-H2 comprises a glycine at position 5 and/or a tyrosine at position 11.

In another specific embodiment the first domain of the antibody construct binds to an epitope comprising a MAGEB2 peptide (SEQ ID NO: 1), wherein the antibody construct comprises a VL region comprising a CDR-L1, a CDR-L2, and a CDR-L3, wherein CDR-L3 comprises a tryptophan at position 3 and/or a tyrosine at position 5.

Exemplary bispecific binding molecule full sequences are presented below:

H6H:
(SEQ ID NO: 73)
MDMRVPAQLLGLLLLWLRGARCEVQLVESGGGLVQ

PGGSLRLSCAASGFTFSNAWMSWVRQAPGKCLEWV

GRIRSRSYGGTTDYAAPVKGRFTISRDDSKNTLFL

QMNSLKTEDTAVYYCTTPSYSGSYYNYFSVMDVWG

QGTTVTVSSGGGGSGGGGSGGGGSDIQMTQSPSSL

SASVGDRVTITCRTSQSISSYLNWYQQKPGRAPKL

LIFAASSLQGGVPSRFSGSGSGTDFTLTISSLQPE

DFATYYCQQTYSMPFTFGCGTKVEIKSGGGGSEVQ

LVESGGGLVQPGGSLKLSCAASGFTFNKYAMNWVR

QAPGKGLEWVARIRSKYNNYATYYADSVKDRFTIS

RDDSKNTAYLQMNNLKTEDTAVYYCVRHGNFGNSY

ISYWAYWGQGTLVTVSSGGGGSGGGGSGGGGSQTV

VTQEPSLTVSPGGTVTLTCGSSTGAVTSGNYPNWV

QQKPGQAPRGLIGGTKFLAPGTPARFSGSLLGGKA

ALTLSGVQPEDEAEYYCVLWYSNRWVFGGGTKLTV

LGGGGDKTHTCPPCPAPELLGGPSVFLFPPKPKDT

LMISRTPEVTCVVVDVSHEDPEVKFNWYVDGVEVH

NAKTKPCEEQYGSTYRCVSVLTVLHQDWLNGKEYK

CKVSNKALPAPIEKTISKAKGQPREPQVYTLPPSR

EEMTKNQVSLTCLVKGFYPSDIAVEWESNGQPENN

YKTTPPVLDSDGSFFLYSKLTVDKSRWQQGNVFSC

SVMHEALHNHYTQKSLSLSPGKGGGGSGGGGSGGG

GSGGGGSGGGGSGGGGSDKTHTCPPCPAPELLGGP

SVFLFPPKPKDTLMISRTPEVTCVVVDVSHEDPEV

KFNWYVDGVEVHNAKTKPCEEQYGSTYRCVSVLTV

LHQDWLNGKEYKCKVSNKALPAPIEKTISKAKGQP

REPQVYTLPPSREEMTKNQVSLTCLVKGFYPSDIA

VEWESNGQPENNYKTTPPVLDSDGSFFLYSKLTVD

KSRWQQGNVFSCSVMHEALHNHYTQKSLSLSPGK

N3H:
(SEQ ID NO: 47)
MDMRVPAQLLGLLLLWLRGARCEVQLLESGGGLVQ

PGGSLRLSCAASGFTFSSYAMSWVRQAPGKCLEWV

SAISGSGGGTYYAASVKGRFTISRDNSKNTLYLQM

SSLRAEDTAVYYCATGKGVHLGFDYWGQGTLVTVS

SGGGGSGGGGSGGGGSSYVLTQPPSVSVAPGQTAR

ITCGGNNIGSKSVHWYQQKPGQAPVMVVYDDNDRP

```
SGIPERFSGSNSGNTATLTISRVEAGDEADYYCQV
WDYSGQRQVFGCGTKLTVLSGGGGSEVQLVESGGG
LVQPGGSLKLSCAASGFTFNKYAMNWVRQAPGKGL
EWVARIRSKYNNYATYYADSVKDRFTISRDDSKNT
AYLQMNNLKTEDTAVYYCVRHGNFGNSYISYWAYW
GQGTLVTVSSGGGGSGGGGSGGGGSQTVVTQEPSL
TVSPGGTVTLTCGSSTGAVTSGNYPNWVQQKPGQA
PRGLIGGTKFLAPGTPARFSGSLLGGKAALTLSGV
QPEDEAEYYCVLWYSNRWVFGGGTKLTVLGGGGDK
THTCPPCPAPELLGGPSVFLFPPKPKDTLMISRTP
EVTCVVVDVSHEDPEVKFNWYVDGVEVHNAKTKPC
EEQYGSTYRCVSVLTVLHQDWLNGKEYKCKVSNKA
LPAPIEKTISKAKGQPREPQVYTLPPSREEMTKNQ
VSLTCLVKGFYPSDIAVEWESNGQPENNYKTTPPV
LDSDGSFFLYSKLTVDKSRWQQGNVFSCSVMHEAL
HNHYTQKSLSLSPGKGGGGSGGGGSGGGGSGGGGS
GGGGSGGGGSDKTHTCPPCPAPELLGGPSVFLFPP
KPKDTLMISRTPEVTCVVVDVSHEDPEVKFNWYVD
GVEVHNAKTKPCEEQYGSTYRCVSVLTVLHQDWLN
GKEYKCKVSNKALPAPIEKTISKAKGQPREPQVYT
LPPSREEMTKNQVSLTCLVKGFYPSDIAVEWESNG
QPENNYKTTPPVLDSDGSFFLYSKLTVDKSRWQQG
NVFSCSVMHEALHNHYTQKSLSLSPGK

Y8P:
                                        (SEQ ID NO: 101)
MDMRVPAQLLGLLLLWLRGARCEVQLLESGGGLVQ
PGGSLRLSCAASGFTFSSHAMSWVRQAPGKCLEWV
SSISGSGGGTYYAASVKGRFTISRDNSKNTLYLQM
NSLRAEDTAVYYCATGKGVHLGFDYWGQGTLVTVS
SGGGGSGGGGSGGGGSSYVLTQPPSVSVAPGQTAR
ITCGGNNIGSKSVHWYQQKPGQAPVMVVYDDNDRP
SGIPERFSGSNSGNTATLTISRVEAGDEADYYCQV
WDYSPLRHVFGCGTKLTVLSGGGGSEVQLVESGGG
LVQPGGSLKLSCAASGFTFNKYAMNWVRQAPGKGL
EWVARIRSKYNNYATYYADSVKDRFTISRDDSKNT
AYLQMNNLKTEDTAVYYCVRHGNFGNSYISYWAYW
GQGTLVTVSSGGGGSGGGGSGGGGSQTVVTQEPSL
TVSPGGTVTLTCGSSTGAVTSGNYPNWVQQKPGQA
PRGLIGGTKFLAPGTPARFSGSLLGGKAALTLSGV
QPEDEAEYYCVLWYSNRWVFGGGTKLTVLGGGGDK
THTCPPCPAPELLGGPSVFLFPPKPKDTLMISRTP
EVTCVVVDVSHEDPEVKFNWYVDGVEVHNAKTKPC
```

```
EEQYGSTYRCVSVLTVLHQDWLNGKEYKCKVSNKA
LPAPIEKTISKAKGQPREPQVYTLPPSREEMTKNQ
VSLTCLVKGFYPSDIAVEWESNGQPENNYKTTPPV
LDSDGSFFLYSKLTVDKSRWQQGNVFSCSVMHEAL
HNHYTQKSLSLSPGKGGGGSGGGGSGGGGSGGGGS
GGGGSGGGGSDKTHTCPPCPAPELLGGPSVFLFPP
KPKDTLMISRTPEVTCVVVDVSHEDPEVKFNWYVD
GVEVHNAKTKPCEEQYGSTYRCVSVLTVLHQDWLN
GKEYKCKVSNKALPAPIEKTISKAKGQPREPQVYT
LPPSREEMTKNQVSLTCLVKGFYPSDIAVEWESNG
QPENNYKTTPPVLDSDGSFFLYSKLTVDKSRWQQG
NVFSCSVMHEALHNHYTQKSLSLSPGK

L7E:
                                        (SEQ ID NO: 37)
MDMRVPAQLLGLLLLWLRGARCEVQLLESGGGLVQ
PGGSLRLSCAASGFTFSSHAMSWVRQAPGKCLEWV
STISGSGGGTYYAASVKGRFTISRDNSKNTLYLQM
NSLRAEDTAVYYCATGKGVHLGFDYWGQGTLVTVS
SGGGGSGGGGSGGGGSSYVLTQPPSVSVAPGQTAR
ITCGGNNIGSKSVHWYQQKPGQAPVMVVYDDNDRP
SGIPERFSGSNFGNTATLIISRVEAGDEADYYCQV
WDYRTLDWVFGCGTKLTVLSGGGGSEVQLVESGGG
LVQPGGSLKLSCAASGFTFNKYAMNWVRQAPGKGL
EWVARIRSKYNNYATYYADSVKDRFTISRDDSKNT
AYLQMNNLKTEDTAVYYCVRHGNFGNSYISYWAYW
GQGTLVTVSSGGGGSGGGGSGGGGSQTVVTQEPSL
TVSPGGTVTLTCGSSTGAVTSGNYPNWVQQKPGQA
PRGLIGGTKFLAPGTPARFSGSLLGGKAALTLSGV
QPEDEAEYYCVLWYSNRWVFGGGTKLTVLGGGGDK
THTCPPCPAPELLGGPSVFLFPPKPKDTLMISRTP
EVTCVVVDVSHEDPEVKFNWYVDGVEVHNAKTKPC
EEQYGSTYRCVSVLTVLHQDWLNGKEYKCKVSNKA
LPAPIEKTISKAKGQPREPQVYTLPPSREEMTKNQ
VSLTCLVKGFYPSDIAVEWESNGQPENNYKTTPPV
LDSDGSFFLYSKLTVDKSRWQQGNVFSCSVMHEAL
HNHYTQKSLSLSPGKGGGGSGGGGSGGGGSGGGGS
GGGGSGGGGSDKTHTCPPCPAPELLGGPSVFLFPP
KPKDTLMISRTPEVTCVVVDVSHEDPEVKFNWYVD
GVEVHNAKTKPCEEQYGSTYRCVSVLTVLHQDWLN
GKEYKCKVSNKALPAPIEKTISKAKGQPREPQVYT
LPPSREEMTKNQVSLTCLVKGFYPSDIAVEWESNG
```

-continued
QPENNYKTTPPVLDSDGSFFLYSKLTVDKSRWQQG

NVFSCSVMHEALHNHYTQKSLSLSPGK

H6N:
(SEQ ID NO: 39)
MDMRVPAQLLGLLLLWLRGARCEVQLLESGGGLVQ

PGGSLRLSCAASGFTFSSHAMSWVRQAPGKCLEWV

STISGSGGGTYYADSVKGRFTISRDNSKNTLYLQM

NSLRAEDTAVYYCATGKGVHLGFDYWGQGTLVTVS

SGGGGSGGGGSGGGGSSYVLTQPPSVSVAPGQTAR

ITCGGNNIGSKSVHWYQQKPGQAPVMVVYDDNDRP

SGIPERFSGSNFGNTATLIISRVEAGDEADYYCQV

WDYRTLDWVFGCGTKLTVLSGGGGSEVQLVESGGG

LVQPGGSLKLSCAASGFTFNKYAMNWVRQAPGKGL

EWVARIRSKYNNYATYYADSVKDRFTISRDDSKNT

AYLQMNNLKTEDTAVYYCVRHGNFGNSYISYWAYW

GQGTLVTVSSGGGGSGGGGSGGGGSQTVVTQEPSL

TVSPGGTVTLTCGSSTGAVTSGNYPNWVQQKPGQA

PRGLIGGTKFLAPGTPARFSGSLLGGKAALTLSGV

QPEDEAEYYCVLWYSNRWVFGGGTKLTVLGGGGDK

THTCPPCPAPELLGGPSVFLFPPKPKDTLMISRTP

EVTCVVVDVSHEDPEVKFNWYVDGVEVHNAKTKPC

EEQYGSTYRCVSVLTVLHQDWLNGKEYKCKVSNKA

LPAPIEKTISKAKGQPREPQVYTLPPSREEMTKNQ

VSLTCLVKGFYPSDIAVEWESNGQPENNYKTTPPV

LDSDGSFFLYSKLTVDKSRWQQGNVFSCSVMHEAL

HNHYTQKSLSLSPGKGGGGSGGGGSGGGGSGGGGS

GGGGSGGGGSDKTHTCPPCPAPELLGGPSVFLFPP

KPKDTLMISRTPEVTCVVVDVSHEDPEVKFNWYVD

GVEVHNAKTKPCEEQYGSTYRCVSVLTVLHQDWLN

GKEYKCKVSNKALPAPIEKTISKAKGQPREPQVYT

LPPSREEMTKNQVSLTCLVKGFYPSDIAVEWESNG

QPENNYKTTPPVLDSDGSFFLYSKLTVDKSRWQQG

NVFSCSVMHEALHNHYTQKSLSLSPGK

Additional exemplary bispecific binding molecule full sequences of the present invention are presented in Tables 88 (SEQ ID NOs: 17390-17398) and 94 (SEQ ID NOs: 18145-18147) herein.

In one embodiment, the invention provides an isolated antibody construct comprising a first domain that binds to a pMAGE-HLA on the surface of a target cell, and a second binding domain that binds to human CD3 on the surface of a T cell, wherein the antibody construct comprises:
  a) SEQ ID NO: 73; or
  b) SEQ ID NO: 47; or
  c) SEQ ID NO: 101; or
  d) SEQ ID NO: 37; or
  e) SEQ ID NO: 39.

Affinity/Potency

The interaction between the binding domain and the epitope or the region comprising the epitope implies that a binding domain exhibits appreciable affinity for the epitope/the region comprising the epitope on a particular protein or antigen (here: the specific pMAGE-HLA and CD3, respectively, for both binding domains if present) and, unless otherwise specified, does not exhibit significant reactivity with proteins or antigens other than the pMAGE-HLA or CD3. In certain embodiments, only a pMAGE-HLA binding molecule is provided (i.e., the molecule does not also bind to another target such as CD3) and these molecules will exhibit appreciable affinity for the pMAGE-HLA target. This affinity can be measured by various techniques known to one skilled in the art, such as in a surface plasmon resonance assay, such as a Biacore assay, or in a cell based assay.

"Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than the pMAGE-HLA or CD3. Preferably, a binding domain of the invention does not essentially or substantially bind to proteins or antigens other than the pMAGE-HLA or CD3 (i.e., the first binding domain is not capable of binding to proteins other than the pMAGE-HLA and the second binding domain is not capable of binding to proteins other than CD3). In certain embodiments, it is an envisaged characteristic of the antibody constructs according to the present invention to have superior affinity characteristics in comparison to other HLE formats. Such a superior affinity, in consequence, suggests a prolonged half-life in vivo. In these embodiments, the longer half-life of the antibody constructs according to the present invention may reduce the duration and frequency of administration which typically contributes to improved patient compliance. This is of particular importance as the antibody constructs of the present invention are particularly beneficial for highly weakened or even multimorbid cancer patients.

It is notable that the pMAGE-HLA binding molecules of the present invention display surprising potency. This potency displayed by the binding molecules of the invention is a critical attribute for a therapeutic molecule, yet can be quite difficult to achieve without also resulting in off-target binding and associated side-effects and toxicities. This potency can be due to binding to the MAGEB2 peptide of SEQ ID NO: 1, and/or the MAGEA4 peptide of SEQ ID NO: 2, and/or the MAGEA8 peptide of SEQ ID NO: 3, in each case where the peptide is complexed with an HLA and present on the surface of a target cell. In one embodiment, the potency is measured in a cell based assay such as the TDCC assay as described herein, e.g., in the Examples.

Accordingly, in one embodiment the pMAGE-HLA binding molecules of the present invention have an $EC_{50}$ of <250 pM on endogenous pMAGE-HLA expressing cells. (e.g., cells with an HLA-A*02:01 complexed with a MAGEB2, MAGEA4, or MAGEA8 peptide). In another embodiment, the pMAGE-HLA binding molecules of the present invention have an $EC_{50}$ of <200 pM on endogenous pMAGE-HLA expressing cells. In another embodiment, the pMAGE-HLA binding molecules of the present invention have an $EC_{50}$ of <150 pM on endogenous pMAGE-HLA expressing cells. In another embodiment, the pMAGE-HLA binding molecules of the present invention have an $EC_{50}$ of <100 pM on endogenous pMAGE-HLA expressing cells. In another embodiment, the pMAGE-HLA binding molecules of the present invention have an $EC_{50}$ of <50 pM on endogenous pMAGE-HLA expressing cells. In another embodiment, the pMAGE-HLA binding molecules of the present invention have an $EC_{50}$ of <25 pM on endogenous pMAGE-HLA expressing cells. In another embodiment, the pMAGE-HLA binding molecules of the present invention have an $EC_{50}$ of <10 pM on endogenous pMAGE-HLA expressing cells. In another embodiment, the pMAGE-HLA binding molecules of the present invention have an $EC_{50}$ of <5 pM on endogenous pMAGE-HLA expressing cells. In another embodiment, the pMAGE-HLA binding molecules of the present invention have an $EC_{50}$ of <1 pM on endogenous pMAGE-HLA expressing cells.

Specificity

The term "does not significantly bind" means that an antibody construct or binding domain of the present invention does not bind to a protein or antigen other than the MAGEB2-HLA peptide complex (pMAGE-HLA) or CD3, when said protein or antigen is expressed on the surface of a cell. For example, an antibody construct or binding domain that exhibits binding to an HLA, e.g., HLA-A1*02:01, that is not presenting a MAGEB2 peptide (i.e., another peptide from the HLA peptidome) would not be a desirable antibody construct or binding molecule. The term "HLA peptidome" refers to a pool of peptides which specifically interact with a particular HLA class and can encompass thousands of different peptide sequences. HLA peptidomes include a diversity of peptides, derived from both normal and abnormal proteins expressed in the cells. In another example, an antibody construct or binding domain that exhibits binding to an HLA, e.g., HLA-A1*02:01 without any complexed peptide also would not be a desirable antibody construct or binding molecule.

In the present invention, the pMAGE-HLA binding molecule possesses surprising levels of specificity and selectivity to its target, as evidenced by its lack of binding to target negative cells (e.g., HLA-A*02:01 negative and/or MAGE-B2 negative cells), including those cells that are expressing an HLA and peptides that are similar to the MAGEB2 peptide GVYDGEEHSV (SEQ ID NO: 1), and/or the MAGEA4 peptide GVYDGREHTV (SEQ ID NO: 2), and/or the MAGEA8 peptide GLYDGREHSV (SEQ ID NO: 3). See, for example, the similar peptides shown in FIG. 1, where those similar peptides (e.g., KEA, MB, ADF, DPYSL4, CNPD2, MYOF, COX14, STXBP5, or SLK) complexed with HLA are not specifically bound by the pMAGE-HLA binding molecules of the present invention.

One skilled in the art would be led to expect quite the opposite. In a recent publication, the specificity of both bispecific T-cell receptors and bispecific antibodies that target peptide-HLA complexes was examined. (see Holland et al., J Clin Invest. 2020). Although favourable properties for the TCR-based molecules were reported, the antibodies that bind the peptide-HLA complex were reportedly much less specific, exhibiting greater levels of cross-reactivity which would not be desirable in a therapeutic molecule.

This specificity and selectivity is a highly desired, yet difficult to achieve, property for a therapeutic molecule as it limits, reduces, or eliminates off-target binding and any potential associated toxicities or side effects. The pMAGE-HLA binding molecules of the present invention unexpectedly achieve this desired specificity and selectivity.

In the present invention, it is also quite surprising, however, that the affinities of the various pMAGE-HLA binding molecules do not appear to be determinative for specificity and selectivity. For example, antibodies can possess very similar affinities towards the pMAGE-HLA target as expressed on cells, yet display quite different levels of specificity and selectivity against MAGEB2 negative cell lines. See, for example, FIG. 11B.

Accordingly, in one embodiment, the selectivity of the pMAGE-HLA binding molecule yields an $EC_{50}$ that is >50 nM on target negative cells (e.g., HLA-A*02:01 negative and/or MAGE-B2 negative cells). In another embodiment, the selectivity of the pMAGE-HLA binding molecule yields an $EC_{50}$ that is >45 nM on target negative cells. In another embodiment, the selectivity of the pMAGE-HLA binding molecule yields an $EC_{50}$ that is >40 nM on target negative cells. In another embodiment, the selectivity of the pMAGE-HLA binding molecule yields an $EC_{50}$ that is >35 nM on target negative cells. In another embodiment, the selectivity of the pMAGE-HLA binding molecule yields an $EC_{50}$ that is >30 nM on target negative cells. In another embodiment, the selectivity of the pMAGE-HLA binding molecule yields an $EC_{50}$ that is >25 nM on target negative cells. In another embodiment the selectivity of the pMAGE-HLA binding molecule yields an $EC_{50}$ that is >20 nM on target negative cells. In another embodiment the selectivity of the pMAGE-HLA binding molecule yields an $EC_{50}$ that is >15 nM on target negative cells. In another embodiment the selectivity of the pMAGE-HLA binding molecule yields an $EC_{50}$ that is >10 nM on target negative cells. This selectivity can be measured by one skilled in the art using the TDCC assay provided herein in the Examples.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-side with its specific antigen may result in a simple binding of said side to the antigen. Moreover, the specific interaction of the antigen-interaction-side with its specific antigen may alternatively or additionally result in the initiation of a signal, e.g. due to the induction of a change of the conformation of the antigen, an oligomerization of the antigen, etc.

As discussed herein below regarding the structural analyses, the surprising specificity of the pMAGE-HLA binding molecules of the invention to a difficult target such as the pMAGE-HLA complex may be due to particular structural conformation of the molecule paratope that results in a "hole" that interacts with particular amino acids that protrude out of the pMAGE-HLA complex.

The first domain of the antibody construct of the invention binds to the pMAGE-HLA on the surface of a target cell. The "target cell" can be any cell expressing or displaying the MAGEB2 peptide on its surface; preferably the target cell is a cell that is part of the human or animal body, such as a specific MAGEB2 expressing cancer or tumor cell or a cell of a MAGEB2 positive neoplasm. It is understood that the term "on the surface", in the context of the present invention, means that a domain of the antibody construct specifically binds to an epitope that comprises the MAGEB2 peptide (GVYDGEEHSV, SEQ ID NO: 1) complexed with the MHC (pMAGE-HLA) and presented by the MHC molecule on a cell surface. The first domain according to the invention may hence bind to the pMAGE-HLA when it is expressed naturally by MAGEB2 expressing cells or cell lines and/or by cells or cell lines transformed or (stably/transiently) transfected with MAGEB2, or even when the MHC is exogenously loaded with a peptide.

Competitive Binding

Whether or not an antibody or antibody construct competes for binding to an antigen (such as a pMAGE-HLA) on the surface of a target cell with another given antibody or antibody construct can be measured in a competition assay such as a competitive ELISA. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added, and any additional binding is determined. Read-out occurs via flow cytometry. Preferably a cell-based competition assay is used, using either cells that naturally express MAGEB2 and HLA, or cells that were stably or transiently transformed with MAGEB2 and/or HLA. The term "competes for binding", in the present context, means that competition occurs between the two tested antibodies of at least 20%, at least 30%, at least 40%, at least 50%, at least 60%, at least 70%, at least 80% or at least 90%, as determined by any one of the assays disclosed above, preferably the cell-based assay. The same analysis can of course be applied for other targets such as CD3.

Competitive antibody binding assays include assays determining the competitive binding of two antibodies/antibody constructs to a cell surface bound antigen. Common methods aim to detect binding of two antibodies/antibody constructs, A and B, to the same antigen on the surface of a cell may include steps of:
  a) blocking of the cell surface antigen by pre-incubation of cells with antibody/antibody construct A followed by a sub-maximal addition of labeled antibody/antibody construct B and detecting the binding of B compared with binding in the absence of A;
  b) titration (i.e. adding different amounts) of antibody/antibody construct A in the presence of sub-maximal amounts of labeled antibody/antibody construct B and detecting the effect on binding of B; or
  c) co-titration of A and B, wherein both antibodies/antibody constructs are incubated together at maximal concentration and detecting whether the total binding equals or exceeds that of either A or B alone, i.e. a method which cannot be affected by the order of addition or relative amounts of the antibodies/antibody constructs.

When two antibodies/antibody constructs A and B compete for a cell surface bound antigen, the antibodies will very often compete with each other in blocking assays independently from the order of the addition of the antibodies. In other words, competition is detected if the assay is carried out in either direction. However, this is not always the case, and under certain circumstances the order of the addition of the antibodies or the direction of the assay may have an effect on the signal generated. This may be due to differences in affinities or avidities of the potentially competing antibodies/antibody constructs. If the order of the addition has a significant effect on the signal generated, it is concluded that the two antibodies/antibody constructs do compete if competition is detected in at least one order.

Epitope Amino Acid Residues

The term "epitope" refers to a region on an antigen, or specific amino acid residues, to which a binding domain, such as an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where a contiguous amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically, a conformational epitope comprises an increased number of amino acids relative to a linear epitope, and comprises noncontiguous amino acid sequences. With regard to recognition of conformational epitopes, the binding domain paratope recognizes a three-dimensional structure of the antigen, preferably a peptide or protein or fragment thereof (in the context of the present invention, the antigenic structure for one of the binding domains is comprised within the target cell surface antigen protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

In one embodiment of the present invention, the epitope comprises the MAGEB2 peptide GVYDGEEHSV (SEQ ID NO: 1) complexed with an HLA molecule on a cell surface. In some embodiments, the antibody construct binds an epitope comprising only amino acid residues of the MAGEB2 peptide of SEQ ID NO: 1. In other embodiments, the antibody construct binds an epitope comprising the MAGEB2 peptide of SEQ ID NO: 1 and also comprising at least some amino acid residues of the HLA that is complexed with, i.e., presenting, the MAGEB2 peptide GVYDGEEHSV (SEQ ID NO: 1).

Structural analysis of the interaction between the target polypeptide and binding domain of, for example, a BiTE® molecule contemplated herein provides amino acid residues of the target epitope involved with the binding interaction. Further, whether or not an antibody, antibody construct or binding domain binds to the same epitope of a pMAGE-HLA on the surface of a target cell as another given antibody, antibody construct or binding domain can be measured by different analyses as described herein. For example, in certain embodiments, the crystal structure of the target-binder interaction can provide these amino acid residues. In other embodiments, various other analyses can be performed to ascertain amino acid residues involved in the binding interaction. For example, in silico modeling and analysis, Xscan, alanine scanning, arginine scanning, epitope mapping, and other techniques known to those skilled in the art.

In the context of the present invention where the MAGEB2 peptide or other MAGE peptide sequence is short, e.g., only ten amino acids for GVYDGEEHSV (SEQ ID NO: 1), a more useful to determine the contribution of a specific residue of MAGEB2 or the MAGEB2 specific peptide to the recognition by an antibody construct or binding domain is a technique known as Xscan, which is known to those skilled in the art. X-scan is a peptide analysis technique where each amino acid residue of the peptide to be analyzed is mutated to all possible amino acids in turn. In certain instances, this approach can provide significantly enhanced sensitivity and specificity for detection of tolerated substitutions, or those substitutions that are not tolerated. A position is considered essential for binding in X-scan analysis if most amino acid substitutions are not allowed. In alternative embodiments of X-scan analysis, particular anchor residues within the peptide are not mutated.

These structural analyses presented herein in Examples 6-10 and 14 provide insight into why our pMAGE-HLA binding molecules have such surprising specificity. In certain determined molecule structures as depicted, it appears that the pMAGE-HLA complex has a small "groove" or a "cleft" on the surface caused by the protruding conformation of the 10-mer MAGEB2 peptide bound to the peptide-binding groove of the HLA, presenting a complementary and quite unexpected and remarkable surface for the pMAGE-HLA binders to specifically recognize.

The various MAGEB2 residues (1-10) all appear to contribute in varying ways to the target epitope of the pMAGE-HLA complex. Accordingly, in one embodiment, the first domain of the antibody construct of the invention binds to a human MAGEB2 peptide GVYDGEEHSV (SEQ ID NO: 1) complexed with an HLA on the surface of a target cell, wherein at least one, at least two, at least three, at least four, at least five, at least six, at least seven, at least eight, at least nine, or ten of the amino acid residues Gly1, Val2, Tyr3, Asp4, Gly5, Glu6, Glu7, His8, Ser9, and/or Val10 of the MAGEB2 peptide is/are essential for the binding of a first domain. In this context, the term "is essential for the binding" means that the specified amino acid is necessary for the binding of the antibody construct binding domain to a MAGEB2 peptide to occur.

According to another embodiment, the first domain of the antibody construct of the invention binds to a human MAGEB2 peptide (e.g., SEQ ID NO: 1) complexed with an HLA on the surface of a target cell (pMAGE-HLA), wherein at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, at least twenty one, at least twenty two, at least twenty three, at least twenty four, at least twenty five, at least twenty six, at least twenty seven, at least twenty eight, at least twenty nine, or at least thirty of the amino acid residues Arg65, Lys66, Ala69, Gln72, Thr73, Val76, Lys146, Ala149, Ala150, His151, Glu154, Gln155, Gly16, Arg17, Gly18, Glu19, Pro20, Gln43, Lys68, Ser71, Arg75, Gly79, Thr80, Arg82, Gly83, and/or Glu89 of the MHC is essential for the binding of the first domain. In this context, the term "is essential for the binding" means that the specified amino acid is necessary for the binding of the antibody construct binding domain to the MHC to occur.

In further embodiments, the first domain of the antibody construct of the invention binds to a human MAGEB2 peptide (e.g., SEQ ID NO: 1) complexed with an HLA on the surface of a target cell (pMAGE-HLA), wherein at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, at least twenty one, at least twenty two, at least twenty three, or at least twenty four of the amino acid residues Glu55, Glu58, Tyr59, Asp61, Gly62, Glu63, Arg65, Lys66, Ala69, Ala158, Gly162, Thr163, Glu166, Trp167, Arg170 and also Gln54, Glu55, Gly56, Pro57, Glu58, Tyr59, Trp167, Arg170.

Paratope Amino Acid Residues

The region of the binding domain that binds to the epitope is called a "paratope." Specific binding is believed to be accomplished by specific motifs in the amino acid sequence of the binding domain and the antigen. Thus, binding is achieved as a result of their primary, secondary and/or tertiary structure as well as the result of potential secondary modifications of said structures. As described above, structural analysis of the interaction between the target polypeptide and binding domain of, for example, a BiTE® molecule contemplated herein provides amino acid residues of the binding molecule paratope involved with the binding interaction with the target epitope. This structural analysis can be performed using the methods already described, e.g., crystal structure analysis or alanine scanning.

In one embodiment, the binding domain of an antibody construct binds to a human MAGEB2 peptide complexed with an HLA on the surface of a target cell (pMAGE-HLA), wherein the paratope comprises at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, at least twenty, at least twenty one, at least twenty two, at least twenty three, at least twenty four, at least twenty five, at least twenty six, at least twenty seven, at least twenty eight, at least twenty nine, at least thirty, at least thirty one, at least thirty two, at least thirty three, at least thirty four, or at least thirty five of the following amino acid residues:

Heavy Chain: Ser30, Ser31, His32, Tyr32, Ala33, Ser52, Gly53, Ser54, Gly56, Gly57, Tyr59, Lys100, Gly101, Val102, His103, Leu104, or Gly105

Light Chain: Asn25, Asn26, Gly28, Ser29, Lys30, Ser31, His33, Tyr48, Asp49, Asp50, Asn51, Asp52, Arg53, Asn65, Phe66, Ser66, Gly67, Trp90, Tyr92, Arg93, Leu95, Gln95

In other embodiments, the first domain of the antibody construct of the invention binds to a human MAGEB2 peptide (e.g., SEQ ID NO: 1) complexed with an HLA on the surface of a target cell (pMAGE-HLA), wherein at least one, at least two, at least three, at least four, at least five, at least six, at least seven, at least eight, at least nine, at least ten, at least eleven, at least twelve, or at least thirteen of the amino acid residue(s) Ser30, Ser31, Ser52, Gly53, Ser54, Gly56, Gly57, Tyr59, Lys100, Val102, His103, Leu104, or Gly105 of the heavy chain is/are essential for the binding of the first domain to the MHC.

In other embodiments, the first domain of the antibody construct of the invention binds to a human MAGEB2 peptide (e.g., SEQ ID NO: 1) complexed with an HLA on the surface of a target cell (pMAGE-HLA), wherein at least one, at least two, at least three, at least four, at least five, at least six, at least seven, at least eight, at least nine, at least ten, at least eleven, or at least twelve of the amino acid residue(s) Ser30, Ser31, His32, Ala33, Ser52, Gly53, Ser54, Lys100, Gly101, Val102, His103, or Leu104 of the heavy chain is/are essential for the binding of the first domain to the MAGEB2 peptide.

In other embodiments, the first domain of the antibody construct of the invention binds to a human MAGEB2 peptide (e.g., SEQ ID NO: 1) complexed with an HLA on the surface of a target cell (pMAGE-HLA), wherein at least one, at least two, at least three, at least four, at least five, at least six, at least seven, at least eight, at least nine, at least ten, at least eleven, at least twelve, at least thirteen, at least fourteen, at least fifteen, or at least sixteen of the amino acid residue(s) Trp33, Arg50, Arg52, Ser55, Tyr56, Gly57, Thr59, Tyr103, Gly105, Ser106, Tyr107, Tyr108, Asn109, Tyr110, Phe111, or Ser112 of the heavy chain is/are essential for the binding of the first domain to the MHC.

In other embodiments, the first domain of the antibody construct of the invention binds to a human MAGEB2 peptide (e.g., SEQ ID NO: 1) complexed with an HLA on the surface of a target cell (pMAGE-HLA), wherein at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, or at least twenty of the amino acid residue(s) Asn25, Asn26, Gly28, Ser29, Lys30, Ser31, His33, Tyr48, Asp49, Asp50, Asn51, Asp52, Asn65, Phe66, Gly67, Trp90, Tyr92, Arg93, Leu95 of the light chain is/are essential for the binding of the first domain MHC.

In other embodiments, the first domain of the antibody construct of the invention binds to a human MAGEB2 peptide (e.g., SEQ ID NO: 1) complexed with an HLA on the surface of a target cell (pMAGE-HLA), wherein at least one, at least two, at least three, at least four, at least five, at least six, at least seven, at least eight, at least nine, or at least ten of the amino acid residue(s) Ser30, Ser31, Tyr32, Ala50, Ser67, Thr91, Tyr92, Ser93, Met94, or Phe96 of the light chain is/are essential for the binding of the first domain MHC.

In other embodiments, the first domain of the antibody construct of the invention binds to a human MAGEB2 peptide GVYDGEEHSV (SEQ ID NO: 1) complexed with an HLA on the surface of a target cell, wherein the amino acid residue Trp90 of the light chain is/are essential for the binding of the first domain to the MAGEB2 peptide.

In other embodiments, the first domain of the antibody construct of the invention binds to a human MAGEB2 peptide (e.g., SEQ ID NO: 1) complexed with an HLA on the surface of a target cell, wherein at least one, at least two, at least three, at least four, at least five, at least six, at least seven, at least eight, at least nine, at least ten, at least eleven, at least twelve, or at least thirteen of the amino acid residue(s) Ser30, Ser31, Ser52, Gly53, Ser54, Gly56, Gly57, Tyr59, Lys100, Val102, His103, Leu104, Gly105 of the heavy chain is/are essential for the binding of the first domain to the MHC.

In other embodiments, the first domain of the antibody construct of the invention binds to a human MAGEB2 peptide (e.g., SEQ ID NO: 1) complexed with an HLA on the surface of a target cell, wherein at least one, at least two, at least three, at least four, at least five, at least six, at least seven, at least eight, at least nine, at least ten, at least eleven, or at least twelve of the amino acid residue(s) Ser30, Ser31, His32, Ala33, Ser52, Gly53, Ser54, Lys100, Gly101, Val102, His103, or Leu104 of the heavy chain is/are essential for the binding of the first domain to the MAGEB2 peptide.

In other embodiments, the first domain of the antibody construct of the invention binds to a human MAGEB2 peptide (e.g., SEQ ID NO: 1) complexed with an HLA on the surface of a target cell, wherein at least one, at least two, at least three, at least four, at least five, at least six, at least seven, at least eight, at least nine, at least ten, at least eleven, or at least twelve of the amino acid residue(s) Ser30, Asn31, Arg54, Ser55, Tyr56, Ser104, Gly105, Ser106, or Tyr110 of the heavy chain is/are essential for the binding of the first domain to the MAGEB2 peptide.

In other embodiments, the first domain of the antibody construct of the invention binds to a human MAGEB2 peptide (e.g., SEQ ID NO: 1) complexed with an HLA on the surface of a target cell, wherein at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, at least nineteen, or at least twenty of the amino acid residue(s) Asn25, Asn26, Gly28, Ser29, Lys30, Ser31, His33, Tyr48, Asp49, Asp50, Asn51, Asp52, Arg53, Asn65, Phe66, Gly67, Trp90, Tyr92, Arg93, Leu95 of the light chain is/are essential for the binding of the first domain MHC.

In other embodiments, the first domain of the antibody construct of the invention binds to a human MAGEB2 peptide (e.g., SEQ ID NO: 1) complexed with an HLA on the surface of a target cell, wherein the amino acid residue Trp90 of the light chain is/are essential for the binding of the first domain to the MAGEB2 peptide.

In other embodiments, the first domain of the antibody construct of the invention binds to a human MAGEB2 peptide (e.g., SEQ ID NO: 1) complexed with an HLA on the surface of a target cell, wherein the amino acid residues at positions 92, 95, 96, or 97 of the light chain is/are essential for the binding of the first domain to the MAGEB2 peptide.

In another embodiment, the first domain of the antibody construct of the invention binds to a human MAGEB2 peptide (e.g., SEQ ID NO: 1) complexed with an HLA on the surface of a target cell, wherein the amino acid residues at position 92 of the light chain is Trp, Tyr, Phe, Leu, Arg, Met, Gln, or Glu.

In a specific embodiment, the first domain of the antibody construct of the invention binds to a human MAGEB2 peptide (e.g., SEQ ID NO: 1) complexed with an HLA on the surface of a target cell, wherein the amino acid residues at position 92 of the light chain is Trp, Phe, Tyr, Leu, Glu, Gln, Arg, or Met.

In a specific embodiment, the first domain of the antibody construct of the invention binds to a human MAGEB2 peptide (e.g., SEQ ID NO: 1) complexed with an HLA on the surface of a target cell, wherein the amino acid residues at position 92 of the light chain is Phe, Trp, Ile, Val, or Tyr.

In a specific embodiment, the first domain of the antibody construct of the invention binds to a human MAGEB2 peptide (e.g., SEQ ID NO: 1) complexed with an HLA on the surface of a target cell, wherein the amino acid residues at position 92 of the light chain is Tyr, Trp, Phe, His, or Arg.

In a specific embodiment, the first domain of the antibody construct of the invention binds to a human MAGEB2 peptide (e.g., SEQ ID NO: 1) complexed with an HLA on the surface of a target cell, wherein the amino acid residues at position 92 of the light chain is selected from any of those set forth as predicted alternatives in FIGS. 47-50 herein.

In another embodiment, the first domain of the antibody construct of the invention binds to a human MAGEB2 peptide (e.g., SEQ ID NO: 1) complexed with an HLA on the surface of a target cell, wherein the amino acid residues at position 95 of the light chain is Trp, Tyr, Phe, Arg, Met, Lys, or Gln.

In another embodiment, the first domain of the antibody construct of the invention binds to a human MAGEB2 peptide (e.g., SEQ ID NO: 1) complexed with an HLA on the surface of a target cell, wherein the amino acid residues at position 95 of the light chain is Trp, Phe, Met, Tyr, Gln, Arg, His, or Leu.

In another embodiment, the first domain of the antibody construct of the invention binds to a human MAGEB2 peptide (e.g., SEQ ID NO: 1) complexed with an HLA on the surface of a target cell, wherein the amino acid residues at position 95 of the light chain is Trp, Arg, Tyr, Leu, Phe, Cys, or Met.

In a specific embodiment, the first domain of the antibody construct of the invention binds to a human MAGEB2 peptide (e.g., SEQ ID NO: 1) complexed with an HLA on the surface of a target cell, wherein the amino acid residues at position 95 of the light chain is selected from any of those set forth as predicted alternatives in FIGS. 47-50 herein.

In another embodiment, the first domain of the antibody construct of the invention binds to a human MAGEB2 peptide (e.g., SEQ ID NO: 1) complexed with an HLA on the surface of a target cell, wherein the amino acid residues at position 96 of the light chain is Met, Asn, His, or Asp.

In another embodiment, the first domain of the antibody construct of the invention binds to a human MAGEB2 peptide (e.g., SEQ ID NO: 1) complexed with an HLA on the surface of a target cell, wherein the amino acid residues at position 96 of the light chain is Ile, Met, Leu, Thr, or His.

In a specific embodiment, the first domain of the antibody construct of the invention binds to a human MAGEB2 peptide (e.g., SEQ ID NO: 1) complexed with an HLA on the surface of a target cell, wherein the amino acid residues at position 96 of the light chain is selected from any of those set forth as predicted alternatives in FIGS. 47-50 herein.

In another embodiment, the first domain of the antibody construct of the invention binds to a human MAGEB2 peptide (e.g., SEQ ID NO: 1) complexed with an HLA on the surface of a target cell, wherein the amino acid residues at position 97 of the light chain is Tyr, Phe, Ile, Met, His, Asn, Ala, or Ser.

In another embodiment, the first domain of the antibody construct of the invention binds to a human MAGEB2 peptide (e.g., SEQ ID NO: 1) complexed with an HLA on the surface of a target cell, wherein the amino acid residues at position 97 of the light chain is Val, His, or Lys.

In another embodiment, the first domain of the antibody construct of the invention binds to a human MAGEB2 peptide (e.g., SEQ ID NO: 1) complexed with an HLA on the surface of a target cell, wherein the amino acid residues at position 97 of the light chain is Phe, Tyr, Leu, Ile, Lys, or Val.

In a specific embodiment, the first domain of the antibody construct of the invention binds to a human MAGEB2 peptide (e.g., SEQ ID NO: 1) complexed with an HLA on the surface of a target cell, wherein the amino acid residues at position 97 of the light chain is selected from any of those set forth as predicted alternatives in FIGS. 47-50 herein.

In other embodiments, the first domain of the antibody construct of the invention binds to a human MAGEB2 peptide (e.g., SEQ ID NO: 1) complexed with an HLA on the surface of a target cell, wherein at least one, at least two, at least three, at least four, at least five, at least six, at least seven, at least eight, at least nine, at least ten, at least eleven, at least twelve, or at least thirteen of the amino acid residue(s) Ser30, Ser31, Tyr32, Ser52, Gly53, Ser54, Gly56, Gly57, Tyr59, Lys100, His103, Leu104, or Gly105 of the heavy chain is/are essential for the binding of the first domain to the MHC.

In other embodiments, the first domain of the antibody construct of the invention binds to a human MAGEB2 peptide (e.g., SEQ ID NO: 1) complexed with an HLA on the surface of a target cell, wherein at least one, at least two, at least three, at least four, at least five, at least six, at least seven, at least eight, at least nine, at least ten, at least eleven, or at least twelve of the amino acid residue(s) Ser30, Ser31, Tyr32, Ala33, Ser52, Gly53, Ser54, Lys100, Gly101, Val102, His103, or Leu104 of the heavy chain is/are essential for the binding of the first domain to the MAGEB2 peptide.

In other embodiments, the first domain of the antibody construct of the invention binds to a human MAGEB2 peptide (e.g., SEQ ID NO: 1) complexed with an HLA on the surface of a target cell, wherein at least one, at least two, at least three, at least four, at least five, at least six, at least seven, at least eight, at least nine, at least ten, at least eleven, at least twelve, at least thirteen, at least fourteen, at least fifteen, at least sixteen, at least seventeen, at least eighteen, or at least nineteen of the amino acid residue(s) Asn25, Asn26, Gly28, Ser29, Lys30, Ser31, His33, Tyr48, Asp49, Asp50, Asn51, Asp52, Arg53, Asn65, Ser66, Gly67, Trp90, Tyr92, or Gln95 of the light chain is/are essential for the binding of the first domain MHC.

In other embodiments, the first domain of the antibody construct of the invention binds to a human MAGEB2 peptide (e.g., SEQ ID NO: 1) complexed with an HLA on the surface of a target cell, wherein the amino acid residue at least one and/or at least two of the amino acid residues Trp90 or Gln95 of the light chain is/are essential for the binding of the first domain to the MAGEB2 peptide.

In another specific embodiment, the first domain of the antibody construct binds to an epitope comprising a MAGEB2 peptide (SEQ ID NO: 1), wherein the antibody construct comprises a VH region comprising a CDR-H1, a CDR-H2, and a CDR-H3, wherein CDR-H3 comprises a lysine at position 2, a valine at position 4, and/or a histidine at position 5 that is/are essential for the binding of the first domain to the MAGEB2 peptide.

In another specific embodiment, the first domain of the antibody construct binds to an epitope comprising a MAGEB2 peptide (SEQ ID NO: 1), wherein the antibody construct comprises a VH region comprising a CDR-H1, a CDR-H2, and a CDR-H3, wherein CDR-H2 comprises a glycine at position 5 and/or a tyrosine at position 11 that is/are essential for the binding of the first domain to the MAGEB2 peptide.

In another specific embodiment the first domain of the antibody construct binds to an epitope comprising a MAGEB2 peptide (SEQ ID NO: 1), wherein the antibody construct comprises a VL region comprising a CDR-L1, a CDR-L2, and a CDR-L3, wherein CDR-L3 comprises a tryptophan at position 3 and/or a tyrosine at position 5 that is/are essential for the binding of the first domain to the MAGEB2 peptide.

In this context, the term "is essential for the binding" means that the specified amino acid, or functional equivalents thereof, is necessary for the binding of the antibody construct binding domain to the target (e.g., the MAGEB2 peptide complexed with an HLA on the surface of a target cell) to occur.

CD3 Mechanism of Cell Killing

In embodiments where the antibody constructs comprise a second domain that binds to CD3, the mechanism for cell killing will be T cell mediated in most instances. T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (α) and beta (β) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors.

In one embodiment, it is envisaged that the second domain of the antibody constructs of the invention binds to an extracellular epitope of the human and/or the Macaca CD3ε chain.

The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3ε gene which resides on chromosome 11. The most preferred epitope of CD3 epsilon is comprised within amino acid residues 1-27 of the human CD3 epsilon extracellular domain. It is envisaged that antibody constructs according to the present invention typically and advantageously show less unspecific T cell activation, which is not desired in specific immunotherapy. This translates to a reduced risk of side effects.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not typically affected by immune escape mechanisms interfering with peptide antigen processing and presentation, or clonal T cell differentiation; see, for example, WO 2007/042261. However, loss of MAGEB2 expression or even loss of MHC class I expression by tumor cells may be a possible escape mechanism.

CD3 Binding

The second domain of the antibody construct of the invention binds to CD3. More preferably, it binds to CD3 on the surface of a T cell. It is furthermore envisaged that the second domain binds to human CD3, preferably to human CD3 on the surface of a T cell. It is also envisaged that the second domain binds to CD3 epsilon. More preferably, it binds to human CD3 epsilon, e.g. to human CD3 epsilon on the surface of a T cell.

The CD3 binding domain of the antibody construct of the invention is/are preferably cross-species specific for members of the mammalian order of primates. Cross-species specific CD3 binding domains are, for example, described in WO 2008/119567. According to one embodiment, the CD3 binding domain, in addition to binding to human CD3, will also bind to CD3 of primates including (but not limited to) new world primates (such as *Callithrix jacchus, Saguinus oedipus* or *Saimiri sciureus*), old world primates (such as baboons and macaques), gibbons, and non-human homininae.

In one embodiment of the present invention, the second domain of the antibody construct binds to human CD3 epsilon (or human CD3 epsilon on the surface of a T cell) and to *Callithrix jacchus* or *Saimiri sciureus* CD3 epsilon. It is also envisaged that the second domain binds to an extracellular epitope of CD3 epsilon, preferably to an extracellular epitope of human CD3 epsilon. It is also envisaged that the second domain binds to an extracellular epitope of the human and the Macaca CD3 epsilon chain. One preferred epitope of CD3 epsilon is comprised within amino acid residues 1-27 of the human CD3 epsilon extracellular domain. Even more specifically, the epitope comprises at least the amino acid sequence Gln-Asp-Gly-Asn-Glu (SEQ ID NO: 18452). *Callithrix jacchus* is a new world primate belonging to the family of Callitrichidae, while *Saimiri sciureus* is a new world primate belonging to the family of Cebidae. Binders having such characteristics are described in detail in WO 2008/119567.

Antibodies or bispecific antibody constructs directed against (human) CD3 or specifically against CD3 epsilon are known in the art, and their CDRs, VH and VL sequences can serve as a basis for the second binding domain of the antibody construct of the invention. For example, Kung et al. reported in 1979 the development of OKT3 (Ortho Kung T3), the first mAb recognizing CD3 (specifically, the epsilon chain of CD3) on human T cells. OKT3 (muromonab) was the first monoclonal antibody of murine origin to become available for therapy in humans. Newer anti-CD3 monoclonal antibodies include otelixizumab (TRX4), teplizumab (MGA031), foralumab and visilizumab, all targeting the epsilon chain of CD3. Bispecific antibody constructs directed against a (cancer) target and CD3 are also being developed and (pre-) clinically tested, and their CD3 binding domain (CDRs, VH, VL) may serve as a basis for the second binding domain of the antibody construct of the invention. Examples include, but are not limited to, Blinatumomab, Solitomab (MT110, AMG 110), Catumaxomab, Duvortuxizumab, Ertumaxomab, Mosunetuzumab, FBTA05 (Bi20, TPBs05), CEA-TCB (RG7802, RO6958688), AFM11, and MGD006 (S80880). Other examples of CD3 binding domains are disclosed e.g. in U.S. Pat. No. 7,994,289 B2, U.S. Pat. No. 7,728,114 B2, U.S. Pat. No. 7,381,803 B1, U.S. Pat. No. 6,706,265 B1.

It is envisaged for the antibody construct of the present invention that the second domain which binds to CD3 on the surface of a T cell comprises a VL region comprising a CDR-L1 (SEQ ID NO: 541), a CDR-L2 (SEQ ID NO: 542) and aCDR-L3 (SEQ ID NO: 543) and a VH region comprising CDR-H1 (SEQ ID NO: 547), CDR-H2 (SEQ ID NO: 548) and CDR-H3 (SEQ ID NO: 549).

It is envisaged for the antibody construct of the present invention that the second domain which binds to CD3 on the surface of a T cell comprises a VL (SEQ ID NO: 696) region and a VH region (SEQ ID NO: 697).

In some embodiments, the second domain of the antibody construct of the invention binds to human CD3 epsilon and/or to Macaca CD3 epsilon. In a preferred embodiment the second domain further binds to *Callithrix jacchus, Saguinus oedipus* or *Saimiri sciureus* CD3 epsilon. *Callithrix jacchus* and *Saguinus oedipus* are both new world primate belonging to the family of Callitrichidae, while *Saimiri sciureus* is a new world primate belonging to the family of Cebidae.

In one embodiment, the antibody construct of the present invention the second domain which binds to an extracellular epitope of the human and/or the Macaca CD3 epsilon chain comprises a VL region comprising CDR-L1, CDR-L2 and CDR-L3 selected from:
- (a) CDR-L1 as depicted in SEQ ID NO: 27 of WO 2008/119567, CDR-L2 as depicted in SEQ ID NO: 28 of WO 2008/119567 and CDR-L3 as depicted in SEQ ID NO: 29 of WO 2008/119567;
- (b) CDR-L1 as depicted in SEQ ID NO: 117 of WO 2008/119567, CDR-L2 as depicted in SEQ ID NO: 118 of WO 2008/119567 and CDR-L3 as depicted in SEQ ID NO: 119 of WO 2008/119567; and
- (c) CDR-L1 as depicted in SEQ ID NO: 153 of WO 2008/119567, CDR-L2 as depicted in SEQ ID NO: 154 of WO 2008/119567 and CDR-L3 as depicted in SEQ ID NO: 155 of WO 2008/119567.

In another embodiment of the antibody construct of the present invention, the second domain which binds to an extracellular epitope of the human and/or the Macaca CD3 epsilon chain comprises a VH region comprising CDR-H 1, CDR-H2 and CDR-H3 selected from:
- (a) CDR-H1 as depicted in SEQ ID NO: 12 of WO 2008/119567, CDR-H2 as depicted in SEQ ID NO: 13 of WO 2008/119567 and CDR-H3 as depicted in SEQ ID NO: 14 of WO 2008/119567;
- (b) CDR-H1 as depicted in SEQ ID NO: 30 of WO 2008/119567, CDR-H2 as depicted in SEQ ID NO: 31 of WO 2008/119567 and CDR-H3 as depicted in SEQ ID NO: 32 of WO 2008/119567;
- (c) CDR-H1 as depicted in SEQ ID NO: 48 of WO 2008/119567, CDR-H2 as depicted in SEQ ID NO: 49 of WO 2008/119567 and CDR-H3 as depicted in SEQ ID NO: 50 of WO 2008/119567;
- (d) CDR-H1 as depicted in SEQ ID NO: 66 of WO 2008/119567, CDR-H2 as depicted in SEQ ID NO: 67 of WO 2008/119567 and CDR-H3 as depicted in SEQ ID NO: 68 of WO 2008/119567;
- (e) CDR-H1 as depicted in SEQ ID NO: 84 of WO 2008/119567, CDR-H2 as depicted in SEQ ID NO: 85 of WO 2008/119567 and CDR-H3 as depicted in SEQ ID NO: 86 of WO 2008/119567;
- (f) CDR-H1 as depicted in SEQ ID NO: 102 of WO 2008/119567, CDR-H2 as depicted in SEQ ID NO: 103 of WO 2008/119567 and CDR-H3 as depicted in SEQ ID NO: 104 of WO 2008/119567;
- (g) CDR-H1 as depicted in SEQ ID NO: 120 of WO 2008/119567, CDR-H2 as depicted in SEQ ID NO: 121 of WO 2008/119567 and CDR-H3 as depicted in SEQ ID NO: 122 of WO 2008/119567;
- (h) CDR-H1 as depicted in SEQ ID NO: 138 of WO 2008/119567, CDR-H2 as depicted in SEQ ID NO: 139 of WO 2008/119567 and CDR-H3 as depicted in SEQ ID NO: 140 of WO 2008/119567;
- (i) CDR-H1 as depicted in SEQ ID NO: 156 of WO 2008/119567, CDR-H2 as depicted in SEQ ID NO: 157 of WO 2008/119567 and CDR-H3 as depicted in SEQ ID NO: 158 of WO 2008/119567; and
- (j) CDR-H1 as depicted in SEQ ID NO: 174 of WO 2008/119567, CDR-H2 as depicted in SEQ ID NO: 175 of WO 2008/119567 and CDR-H3 as depicted in SEQ ID NO: 176 of WO 2008/119567.

In another embodiment of the antibody construct of the invention the above described three groups of VL CDRs are combined with the above described ten groups of VH CDRs within the second binding domain to form (30) groups, each comprising CDR-L 1-3 and CDR-H 1-3.

It is preferred for the antibody construct of the present invention that the second domain which binds to CD3 comprises a VL region selected from the group consisting of those depicted in SEQ ID NOs: 17, 21, 35, 39, 53, 57, 71, 75, 89, 93, 107, 111, 125, 129, 143, 147, 161, 165, 179 or 183 of WO 2008/119567 or as depicted in SEQ ID NO: 696 according to the present invention.

It is also preferred that the second domain which binds to CD3 comprises a VH region selected from the group consisting of those depicted in SEQ ID NO: 15, 19, 33, 37, 51, 55, 69, 73, 87, 91, 105, 109, 123, 127, 141, 145, 159, 163, 177 or 181 of WO 2008/119567 or as depicted in SEQ ID NO: 697 according to the present invention.

More preferably, the antibody construct of the present invention is characterized by a second domain which binds to CD3 comprising a VL region and a VH region selected from the group consisting of:
- (a) a VL region as depicted in SEQ ID NO: 17 or 21 of WO 2008/119567 and a VH region as depicted in SEQ ID NO: 15 or 19 of WO 2008/119567;
- (b) a VL region as depicted in SEQ ID NO: 35 or 39 of WO 2008/119567 and a VH region as depicted in SEQ ID NO: 33 or 37 of WO 2008/119567;
- (c) a VL region as depicted in SEQ ID NO: 53 or 57 of WO 2008/119567 and a VH region as depicted in SEQ ID NO: 51 or 55 of WO 2008/119567;
- (d) a VL region as depicted in SEQ ID NO: 71 or 75 of WO 2008/119567 and a VH region as depicted in SEQ ID NO: 69 or 73 of WO 2008/119567;
- (e) a VL region as depicted in SEQ ID NO: 89 or 93 of WO 2008/119567 and a VH region as depicted in SEQ ID NO: 87 or 91 of WO 2008/119567;
- (f) a VL region as depicted in SEQ ID NO: 107 or 111 of WO 2008/119567 and a VH region as depicted in SEQ ID NO: 105 or 109 of WO 2008/119567;
- (g) a VL region as depicted in SEQ ID NO: 125 or 129 of WO 2008/119567 and a VH region as depicted in SEQ ID NO: 123 or 127 of WO 2008/119567;
- (h) a VL region as depicted in SEQ ID NO: 143 or 147 of WO 2008/119567 and a VH region as depicted in SEQ ID NO: 141 or 145 of WO 2008/119567;
- (i) a VL region as depicted in SEQ ID NO: 161 or 165 of WO 2008/119567 and a VH region as depicted in SEQ ID NO: 159 or 163 of WO 2008/119567; and
- (j) a VL region as depicted in SEQ ID NO: 179 or 183 of WO 2008/119567 and a VH region as depicted in SEQ ID NO: 177 or 181 of WO 2008/119567.

Also preferred in connection with the antibody construct of the present invention is a second domain which binds to CD3 comprising a VL region as depicted in SEQ ID NO: 696 and a VH region as depicted in SEQ ID NO: 697 of the present invention.

In other embodiments, the antibody construct of the present invention is characterized by a second domain which binds to CD3 comprising a VL region and a VH region selected from any of those presented in Tables 80 (SEQ ID NOs: 17230-17231), 85 (SEQ ID NOs: 17302-17305), 91 (SEQ ID NOs: 17507-17542), or 97 (SEQ ID NOs: 18184-18195) herein.

In yet other embodiments, the antibody construct of the present invention is characterized by a second domain which binds to CD3 comprising a VL region and a VH region which comprise CDRs selected from those presented in Tables 79 (SEQ ID NOs: 17224-17229), 84 (SEQ ID NOs: 17290-17301), 89 (SEQ ID NOs: 17399-17488), 90 (SEQ ID NOs: 17417-17506), 95 (SEQ ID NOs: 18148-18177), or 96 (SEQ ID NOs: 18154-18183) herein.

In other embodiments, the antibody construct of the present invention is characterized by a second domain which binds to CD3 comprising a sequence selected from those presented in Tables 78 (SEQ ID NOs: 17223) or 83 (SEQ ID NOs: 17288-17289).

In yet other embodiments, the antibody construct of the present invention is characterized by a second domain which binds to CD3 comprising a sequence disclosed in U.S. Provisional Patent Application No. 63/110,545, entitled "Polypeptide Constructs Binding to CD3."

Antibody Constructs

In one embodiment, the present invention provides an antibody construct comprising a first domain which binds to a pMAGE-HLA complex on the surface of a target cell and a second domain which binds to CD3 on the surface of a T-cell.

The term "antibody construct" refers to a molecule in which the structure and/or function is/are based on the structure and/or function of an antibody, e.g., of a full-length or whole immunoglobulin molecule. An antibody construct is capable of binding to its specific target or antigen and comprises the variable heavy chain (VH) and/or variable light chain (VL) domains of an antibody or fragment thereof. Furthermore, the domain which binds to its binding partner according to the present invention is understood herein as a binding domain of an antibody construct according to the invention. Typically, a binding domain according to the present invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. An alternative approach to define the minimal structure requirements of an antibody is the definition of the epitope the antibody binds within the structure of a specific target, respectively, the protein domain of the target protein composing the epitope region (epitope cluster) or by reference to a specific antibody competing with the epitope of the defined antibody. Alternatively, the minimal structure requirements may be defined by the paratope sequences within the binding domain of the antibody. The antibodies on which the constructs according to the invention are based include for example monoclonal, recombinant, chimeric, deimmunized, humanized and human antibodies.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms an antigen-binding site.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding side (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding side is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

In some embodiments, the CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is often the greatest source of molecular diversity within the antibody-binding side. H3, for example, can be as short as two amino acid residues or greater than 26 amino acids.

The sequence of antibody genes after assembly and somatic mutation is highly varied, and these varied genes are estimated to encode 1010 different antibody molecules (Immunoglobulin Genes, 2nd ed., eds. Jonio et al., Academic Press, San Diego, CA, 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

Antibody constructs of the present invention comprise at least one binding domain. The term "binding domain" characterizes in connection with the present invention a domain which specifically binds to, interacts with, or recognizes a given target epitope or a given target region on the target molecule, e.g., pMAGE-HLA or CD3. The structure and function of the first binding domain (recognizing pMAGE-HLA), and also the structure and/or function of the second binding domain (recognizing CD3), is based on the structure and/or function of an antibody, e.g. of a full-length or whole immunoglobulin molecule, and is from the variable heavy chain (VH) and/or variable light chain (VL) domains of an antibody or fragment thereof. In certain embodiments, the first binding domain comprises the presence of three light chain CDRs (i.e. CDR1, CDR2 and CDR3 of the VL region) and/or three heavy chain CDRs (i.e. CDR1, CDR2 and CDR3 of the VH region). The second binding domain, if present, comprises at least three light chain CDRs (i.e. CDR1, CDR2 and CDR3 of the VL region) and/or three heavy chain CDRs (i.e. CDR1, CDR2 and CDR3 of the VH region). In certain embodiments, the first and/or second binding domain is produced by or obtainable by phage-display or library screening methods rather than by grafting CDR sequences from a pre-existing (monoclonal) antibody into a scaffold.

The binding domain of an antibody construct according to the invention may, e.g., comprise the above referred groups of CDRs. Preferably, those CDRs are comprised in the framework of an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a F(ab')$_2$ fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Nonlimiting examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, WO 2014/144722, WO 2014/151910, and WO 2015/048272.

Also within the definition of "binding domain" or "domain which binds" are fragments of full-length antibodies, such as VH, VHH, VL, (s)dAb, Fv, light chain (VL-CL), Fd (VH-CH1), heavy chain, Fab, Fab', F(ab')$_2$ or "r IgG" ("half antibody" consisting of a heavy chain and a light chain). Antibody constructs according to the invention may also comprise modified fragments of antibodies, also called antibody variants or antibody derivatives. Examples include, but are not limited to, scFv, di-scFv or bi(s)-scFv, scFv-Fc, scFv-zipper, scFab, Fab$_2$, Fab$_3$, diabodies, single chain diabodies, tandem diabodies (Tandab's), tandem di-scFv, tandem tri-scFv, "minibodies" exemplified by a structure which is as follows: (VH-VL-CH3)$_2$, (scFv-CH3)$_2$, ((scFv)$_2$-CH3+CH3), ((scFv)$_2$-CH3) or (scFv-CH3-scFv)$_2$, multibodies such as triabodies or tetrabodies, and single domain antibodies such as nanobodies or single variable domain antibodies comprising merely one variable region, which might be VHH, VH or VL, that specifically bind to an antigen or target independently of other variable regions or domains. Further possible formats of the antibody constructs according to the invention are cross bodies, maxi bodies, hetero Fc constructs, mono Fc constructs and scFc constructs. Examples for those formats will be described herein below.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids).

The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a heteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected, e.g., by post-translational modifications like glycosylation, acetylation, phosphorylation and the like. A "peptide", "polypeptide" or "protein" when referred to herein may also be chemically modified such as pegylated. Such modifications are well known in the art and described herein below.

The term "hinge" refers to the IgG hinge region. This region can be identified by analogy using the Kabat numbering, see e.g. Kabat positions 223-243. In line with the above, the minimal requirement for a "hinge" are the amino acid residues corresponding to the IgG1 sequence stretch of D231 to P243 according to the Kabat numbering.

In line with the present invention, the terms "CH2" and "CH3" refer to the immunoglobulin heavy chain constant regions 2 and 3. These regions can as well be identified by analogy using the Kabat numbering, see e.g. Kabat positions 244-360 for CH2 and Kabat positions 361-478 for CH3. It is understood that there is some variation between the immunoglobulins in terms of their IgG1 Fc region, IgG2 Fc region, IgG3 Fc region, IgG4 Fc region, IgM Fc region, IgA Fc region, IgD Fc region and IgE Fc region (see, e.g., Padlan, Molecular Immunology, 31(3), 169-217 (1993)).

The term "Fc region" refers to the last two heavy chain constant regions of IgA, IgD, and IgG, and the last three heavy chain constant regions of IgE and IgM. The Fc region can also include the flexible hinge N-terminal to these domains. For IgA and IgM, the Fc region may include the J chain. For IgG, the Fc region comprises immunoglobulin domains CH2 and CH3 and the hinge between the first two domains and CH2. Although the boundaries of the Fc region of an immunoglobulin may vary, an example for a human IgG heavy chain Fc portion comprising a functional hinge, CH2 and CH3 domain can be defined e.g. to comprise residues D231 (of the hinge domain) to P476 (of the C-terminus of the CH3 domain), or D231 to L476, respectively, for IgG4, wherein the numbering is according to Kabat.

The term "Fc portion" or "Fc monomer" means in connection with this invention a polypeptide comprising at least one domain having the function of a CH2 domain and at least one domain having the function of a CH3 domain of an immunoglobulin molecule. As apparent from the term "Fc monomer", the polypeptide comprising those CH domains is a "polypeptide monomer". An Fc monomer can be a polypeptide comprising at least a fragment of the constant region of an immunoglobulin excluding the first constant region immunoglobulin domain of the heavy chain (CH1), but maintaining at least a functional part of one CH2 domain and a functional part of one CH3 domain, wherein the CH2 domain is amino terminal to the CH3 domain.

In one embodiment of this definition, an Fc monomer can be a polypeptide constant region comprising a portion of the Ig-Fc hinge region, a CH2 region and a CH3 region, wherein the hinge region is amino terminal to the CH2 domain. It is envisaged that the hinge region of the present invention promotes dimerization. Such Fc polypeptide molecules can be obtained by papain digestion of an immunoglobulin region (of course resulting in a dimer of two Fc polypeptide), for example and not limitation. In another aspect of this definition, an Fc monomer can be a polypeptide region comprising a portion of a CH2 region and a CH3 region. Such Fc polypeptide molecules can be obtained by pepsin digestion of an immunoglobulin molecule, for example and not limitation.

In one embodiment, the polypeptide sequence of an Fc monomer is substantially similar to an Fc polypeptide sequence of: an IgG1 Fc region, an IgG2 Fc region, an IgG3 Fc region, an IgG4 Fc region, an IgM Fc region, an IgA Fc region, an IgD Fc region and an IgE Fc region. (See, e.g., Padlan, Molecular Immunology, 31(3), 169-217 (1993)). Because there is some variation between immunoglobulins, and solely for clarity, Fc monomer refers to the last two heavy chain constant region immunoglobulin domains of IgA, IgD, and IgG, and the last three heavy chain constant region immunoglobulin domains of IgE and IgM. As mentioned, the Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion may vary an example for a human IgG heavy chain Fc portion comprising a functional hinge, CH2 and CH3 domain can be defined e.g. to comprise residues D231 (of the hinge domain—corresponding to D234 in Table 3 below) to P476, respectively L476 (for IgG4) of the carboxyl-terminus of the CH3 domain, wherein the numbering is according to Kabat. The two Fc portion or Fc monomer, which are fused to each other via a peptide linker define the third domain of the antibody construct of the invention, which may also be defined as scFc domain.

In one embodiment of the invention it is envisaged that a scFc domain as disclosed herein, respectively the Fc monomers fused to each other are comprised only in the third domain of the antibody construct.

In some embodiments an IgG hinge region can be identified by analogy using the Kabat numbering as set forth in Table 3. In line with the above, it is envisaged that for a hinge domain/region of the present invention the minimal requirement comprises the amino acid residues corresponding to the IgG1 sequence stretch of D231 D234 to P243 according to the Kabat numbering. It is likewise envisaged that a hinge domain/region of the present invention comprises or consists of the IgG1 hinge sequence DKTHTCPPCP (SEQ ID NO: 4) (corresponding to the stretch D234 to P243 as shown in Table 3 below—variations of said sequence are also envisaged provided that the hinge region still promotes dimerization). In a preferred embodiment of the invention the glycosylation site at Kabat position 314 of the CH2 domains in the third domain of the antibody construct is removed by a N314X substitution, wherein X is any amino acid excluding Q. Said substitution is preferably a N314G substitution. In a more preferred embodiment, said CH2 domain additionally comprises the following substitutions (position according to Kabat) V321C and R309C (these substitutions introduce the intra domain cysteine disulfide bridge at Kabat positions 309 and 321).

TABLE 3

Kabat numbering of the amino acid residues of the hinge region

| IMGT numbering for the hinge | IgG1 amino acid translation | Kabat numbering |
| --- | --- | --- |
| 1 | (E) | 226 |
| 2 | P | 227 |
| 3 | K | 228 |
| 4 | S | 232 |
| 5 | C | 233 |
| 6 | D | 234 |
| 7 | K | 235 |
| 8 | T | 236 |
| 9 | H | 237 |
| 10 | T | 238 |
| 11 | C | 239 |
| 12 | P | 240 |
| 13 | P | 241 |
| 14 | C | 242 |
| 15 | P | 243 |

In further embodiments of the present invention, the hinge domain/region comprises or consists of the IgG2 subtype hinge sequence ERKCCVECPPCP (SEQ ID NO: 5), the IgG3 subtype hinge sequence ELKTPLDTTHTCPRCP (SEQ ID NO: 6) or ELKTPLGDTTHTCPRCP (SEQ ID NO: 7), and/or the IgG4 subtype hinge sequence ESKYGPPCPSCP (SEQ ID NO: 8). The IgG1 subtype hinge sequence may be the following one EPKSCDKTHTCPPCP (SEQ ID NO: 9). These core hinge regions are thus also envisaged in the context of the present invention.

The location and sequence of the IgG CH2 and IgG CD3 domain can be identified by analogy using the Kabat numbering as set forth in Table 4:

TABLE 4

Kabat numbering of the amino acid residues of the IgG CH2 and CH3 region

| IgG subtype | CH2 aa translation | CH2 Kabat numbering | CH3 aa translation | CH3 Kabat numbering |
| --- | --- | --- | --- | --- |
| IgG$_1$ | APE ... KAK | 244 ... 360 | GQP ... PGK | 361 ... 478 |
| IgG$_2$ | APP ... KTK | 244 ... 360 | GQP ... PGK | 361 ... 478 |
| IgG$_3$ | APE ... KTK | 244 ... 360 | GQP ... PGK | 361 ... 478 |
| IgG$_4$ | APE ... KAK | 244 ... 360 | GQP ... LGK | 361 ... 478 |

In one embodiment of the invention the emphasized bold amino acid residues in the CH3 domain of the first or both Fc monomers are deleted.

In a classical full-length antibody or immunoglobulin, each light (L) chain is linked to a heavy (H) chain by one covalent disulfide bond, while the two H chains are linked to each other by one or more disulfide bonds depending on the H chain isotype. The heavy chain constant (CH) domain most proximal to VH is usually designated as CH1. The constant ("C") domains are not directly involved in antigen binding, but exhibit various effector functions, such as antibody-dependent cell-mediated cytotoxicity (ADCC) and complement activation (complement dependent cytotoxicity, CDC). The Fc region of an antibody is the "tail" region of a classical antibody that interacts with cell surface receptors called Fc receptors and some proteins of the complement system. In IgG, IgA and IgD antibody isotypes, the Fc region is composed of two identical protein fragments, derived from the second and third constant domains (CH2 and CH3) of the antibody's two heavy chains. IgM and IgE Fc regions contain three heavy chain constant domains (CH2, CH3 and CH4) in each polypeptide chain. The Fc regions also contains part of the so-called "hinge" region held together by one or more disulfides and noncovalent interactions. The Fc region of a naturally occurring IgG bears a highly conserved N-glycosylation site. Glycosylation of the Fc fragment is essential for Fc receptor-mediated activity.

In molecules comprising an Fc region, antibody-dependent cellular cytotoxicity ("ADCC"), another mechanism of cell killing mediated by the Fc region is contemplated. ADCC is a mechanism of cell-mediated immune defense whereby an effector cell of the immune system actively lyses a target cell, whose membrane-surface antigens have been bound by specific antibodies. ADCC requires an immune effector cell which classically is known to be a natural killer (NK) cell that typically interacts with IgG antibodies. However, ADCC can also be mediated by macrophages, neutrophils and eosinophils. ADCC involves activation of effector cells expressing Fc receptors by antibodies expressing an Fc portion. For example, the most common Fc receptor on the surface of an NK cell is called CD16 or FcγRIII. Once the Fc receptor binds to the Fc region of IgG, the NK cell releases cytotoxic factors that cause the death of the target cell. Likewise, the Fc receptor (FceRI) of an eosinophil will recognize IgE. In CDC, in contrast, the molecule "C1q" of the complement system binds to the antibody Fc region, and this binding triggers the complement cascade which leads to the formation of the membrane attack complex (MAC) at the surface of the target cell, as a result of the classical pathway complement activation. In therapeutic antibodies or antibody constructs, both ADCC and CDC can be modulated by Fc isotype engineering, Fc genetic mutations, or Fc glycosylation profile modifications.

In some embodiments of the invention the CH2 domain of one or preferably each (both) polypeptide monomers of the third domain comprises an intra domain cysteine disulfide bridge. As known in the art the term "cysteine disulfide bridge" refers to a functional group with the general structure R—S—S—R. The linkage is also called an SS-bond or a disulfide bridge or a cysteine clamp and is derived by the coupling of two thiol groups of cysteine residues. In certain embodiments, the cysteines forming the cysteine disulfide bridge in the mature antibody construct are introduced into the amino acid sequence of the CH2 domain corresponding to 309 and 321 (Kabat numbering). In other embodiments, the cysteine clamps are introduced in other domains of the antibody constructs. See also, e.g. US 2016/0193295.

In one embodiment of the invention a glycosylation site in Kabat position 314 of the CH2 domain is removed. It is preferred that this removal of the glycosylation site is achieved by a N314X substitution, wherein X is any amino acid excluding Q. Said substitution is preferably a N314G. In a more preferred embodiment, said CH2 domain additionally comprises the following substitutions (position according to Kabat) V321C and R309C (these substitutions introduce the intra domain cysteine disulfide bridge at Kabat positions 309 and 321).

The definition of "antibody" according to the invention comprises full-length antibodies, also including camelid antibodies and other immunoglobulins generated by biotechnological or protein engineering methods or processes. These full-length antibodies may be for example monoclonal, recombinant, chimeric, deimmunized, humanized and human antibodies, as well as antibodies from other species such as mouse, hamster, rabbit, rat, goat, or non-human primates.

Given that the antibody constructs according to some embodiments of the invention comprise one domain binding to a pMAGE-HLA and, alternatively, another domain binding to CD3, they do not occur naturally and they are markedly different in their function from naturally occurring products. An antibody construct of the invention is hence an artificial molecule comprising at least two distinct binding domains with different specificities.

As used herein, the terms "single-chain Fv," "single-chain antibodies" or "scFv" refer to single polypeptide chain antibody fragments that comprise the variable regions from both the heavy and light chains, but lack the constant regions. Generally, a single-chain antibody further comprises a polypeptide linker between the VH and VL domains which enables it to form the desired structure which would allow for antigen binding. Single chain antibodies are discussed in detail by Pluckthun in The Pharmacology of Monoclonal Antibodies, vol. 113, Rosenburg and Moore eds. Springer-Verlag, New York, pp. 269-315 (1994). Various methods of generating single chain antibodies are known, including those described in U.S. Pat. Nos. 4,694,778 and 5,260,203; International Patent Application Publication No. WO 88/01649; Bird (1988) Science 242:423-442; Huston et al. (1988) Proc. Natl. Acad. Sci. USA 85:5879-5883; Ward et al. (1989) Nature 334:54454; Skerra et al. (1988) Science 242:1038-1041. In specific embodiments, single-chain antibodies can also be bispecific, multispecific, human, and/or humanized and/or synthetic.

In certain embodiments either the first, the second or the first and the second domain may comprise a single domain antibody, respectively the variable domain or at least the CDRs of a single domain antibody. Single domain antibodies comprise merely one (monomeric) antibody variable domain which is able to bind selectively to a specific antigen, independently of other V regions or domains. The first single domain antibodies were engineered from heavy chain antibodies found in camelids, and these are called VHH fragments. Cartilaginous fishes also have heavy chain antibodies (IgNAR) from which single domain antibodies called VNAR fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)2 is hence a monoclonal antibody construct composed of (at least) two single domain monoclonal antibodies, which are individually selected from the group comprising VH, VL, VHH and VNAR. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

Furthermore, the definition of the term "antibody construct" includes monovalent, bivalent and polyvalent/multivalent constructs and, thus, bispecific constructs, specifically binding to only two antigenic structures, as well as polyspecific/multispecific constructs, which specifically bind more than two antigenic structures, e.g. three, four or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The term "bispecific" as used herein refers to an antibody construct which is "at least bispecific", i.e., it comprises at least a first binding domain and a second binding domain, wherein the first binding domain binds to one antigen or target (e.g., peptide GVYDGEEHSV, SEQ ID NO: 1 of MAGEB2 in the context of an HLA), and the second binding domain binds to another antigen or target (e.g., CD3). Accordingly, antibody constructs according to the invention comprise specificities for at least two different antigens or targets. For example, the first domain does preferably not bind to an extracellular epitope of CD3ε of one or more of the species as described herein. The term "target cell surface antigen" refers to an antigenic structure expressed by a cell and which is present at the cell surface such that it is accessible for an antibody construct as described herein. It may be a protein, preferably the extracellular portion of a protein, or a carbohydrate structure, preferably a carbohydrate structure of a protein, such as a glycoprotein. It is preferably a tumor antigen, and in more specific embodiments, a peptide tumor antigen presented on a tumor cell surface by an HLA. The term "bispecific antibody construct" of the invention also encompasses multispecific antibody constructs such as trispecific antibody constructs, the latter ones including three binding domains, or constructs having more than three (e.g. four, five . . . ) specificities.

In a specific embodiment, the first and the second domain of the antibody construct of the invention is a "bispecific single chain antibody construct", including but not limited to, a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain antibody constructs are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dubel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format (scFv)2 can be engineered by linking two scFv molecules (e.g. with linkers as described hereinbefore). If these two scFv molecules have the same binding specificity, the resulting (scFv)2 molecule will preferably be called bivalent (i.e. it has two valences for the same target epitope). If the two scFv molecules have different binding specificities, the resulting (scFv)2 molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8).

Bispecific antibody constructs can be produced by a variety of methods including fusion of hybridomas or linking of Fab' fragments. See, e.g., Songsivilai & Lachmann, Clin. Exp. Immunol. 79:315-321 (1990). Bispecific antibody constructs can be produced by other methods that would be apparent to one skilled in the art, including, e.g., use of any of the binding domain sequences provided herein.

Bispecific antibody derived molecules such as BiTE® antibody constructs are recombinant protein constructs made from two flexibly linked antibody derived binding domains. One binding domain of BiTE® antibody constructs is specific for a selected tumor-associated surface antigen on target cells; the second binding domain is specific for CD3, a subunit of the T cell receptor complex on T cells. By their particular design, BiTE® antibody constructs are uniquely suited to transiently connect T cells with target cells and, at the same time, potently activate the inherent cytolytic potential of T cells against target cells. An important further development of the first generation of BiTE® antibody constructs (see WO 99/54440 and WO 2005/040220) developed into the clinic as AMG 103 and AMG 110 was the provision of bispecific antibody constructs binding to a context independent epitope at the N-terminus of the CD3ε chain (WO 2008/119567). BiTE® antibody constructs binding to this elected epitope do not only show cross-species specificity for the human and the Macaca, or Callithrix jacchus, Saguinus oedipus or Saimiri sciureus CD3ε chain, but also, due to recognizing this specific epitope (instead of previously described epitopes of CD3 binders in bispecific T cell engaging molecules), do not demonstrate unspecific activation of T cells to the same degree as observed for the previous generation of T cell engaging antibodies. This reduction in T cell activation was connected with less or reduced T cell redistribution in patients, the latter being identified as a risk for side effects, e.g. in pasotuximab.

Antibody constructs as described in WO 2008/119567 are characterized by rapid clearance from the body; thus, while they are able to reach most parts of the body rapidly, their in vivo applications may be limited by their brief persistence in vivo. On the other hand, their concentration in the body can be adapted and fine-tuned at short notice. Prolonged administration by continuous intravenous infusion is used to achieve therapeutic effects because of the short in vivo half-life of this small, single chain molecule. However, now bispecific antibody constructs are available which have more favorable pharmacokinetic properties, including a longer half-life. An increased half-life is generally useful in in vivo applications of immunoglobulins, especially antibodies and most especially antibody fragments or constructs of small size, e.g. in the interest of patient compliance.

In some embodiments, the antibody constructs of the present invention are "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. In other embodiments, the antibody construct sequences are generated by genomic rearrangement in an immune cell in an animal. This term thus preferably excludes sequences generated solely by genomic rearrangement in an immune cell in an animal. It is envisaged that the first and/or second domain of the antibody construct is produced by or obtainable by phage display or library screening methods rather than by grafting CDR sequences from a pre-existing (monoclonal) antibody into a scaffold. However, the use of CDR sequences from a monoclonal antibody generated as taught in the present disclosure is not precluded and would be readily apparent to one skilled in the art.

A "recombinant antibody" is an antibody made through the use of recombinant DNA technology or genetic engineering.

The term "monoclonal antibody" (mAb) or "monoclonal antibody construct" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts, and refers to an overall polypeptide structure that is similar to naturally occurring antibodies as understood by one of skill in the art (e.g., an IgG with the structure of two heavy chains and two light chains). Monoclonal antibodies are highly specific, being directed against a single antigenic site or epitope on the antigen, in contrast to conventional (polyclonal) antibody preparations which typically include different antibodies directed against different antigenic sites or epitopes. In addition to their specificity, the monoclonal antibodies are advantageous in that they are synthesized by clonal cell culture and are uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance analysis, e.g. Biacore™ to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the Biacore system can be used to increase the efficiency of phage antibodies which bind to an epitope of a target cell surface antigen (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetic diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sides (e. g. 6-7 sides) are mutated to generate all possible amino acid substitutions at each side. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sides for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., the pMAGE-HLA. Such contact residues and neighboring residues are candidates for substitution according to the techniques elaborated herein. Once such variants are generated, the panel of variants is subjected to screening as described herein and antibodies with superior properties in one or more relevant assays may be selected for further development.

The antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or side-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse. Preferably, a "fully human antibody" does not include amino acid residues not encoded by human germline immunoglobulin sequences.

Preferably the binding domain which binds to pMAGE-HLA and/or the binding domain which binds to CD3ε is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/ antibody constructs can be generated through the introduction of human antibody function into a rodent so that the rodent produces fully human antibodies.

The ability to clone and reconstruct megabase-sized human loci in yeast artificial chromosomes YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first XenoMouse mouse strains (see Green et al. Nature Genetics 7:13-21 (1994)). The XenoMouse strains were engineered with YACs containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions may recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse® animals is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430, 938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545, 807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023,010 to Krimpenfort and Berns, U.S. Pat. Nos. 5,612,205; 5,721, 367; and 5,789,215 to Berns et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161, 739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against a pMAGE-HLA and a human binding domain against CD3ε in order to vitiate concerns and/or effects of HAMA or HACA response.

In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. It is understood that the isolated protein may constitute a wide range of percent concentration, e.g., from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

Peptides are short chains of amino acid monomers linked by covalent peptide (amide) bonds. Hence, peptides fall under the broad chemical classes of biological oligomers and polymers. Amino acids that are part of a peptide or polypeptide chain are termed "residues" and can be consecutively numbered. All peptides except cyclic peptides have an N-terminal residue at one end and a C-terminal residue at the other end of the peptide. An oligopeptide consists of only a few amino acids (usually between two and twenty). A polypeptide is a longer, continuous, and unbranched peptide chain. Peptides are distinguished from proteins on the basis of size, and as an arbitrary benchmark can be understood to contain approximately 50 or fewer amino acids. Proteins consist of one or more polypeptides, usually arranged in a biologically functional way. While aspects of the lab techniques applied to peptides versus polypeptides and proteins differ (e.g., the specifics of electrophoresis, chromatography, etc.), the size boundaries that distinguish peptides from polypeptides and proteins are not absolute. Therefore, in the context of the present invention, the terms "peptide", "polypeptide" and "protein" may be used interchangeably, and the term "polypeptide" is often preferred.

Polypeptides may further form multimers such as dimers, trimers and higher oligomers, which consist of more than one polypeptide molecule. Polypeptide molecules forming such dimers, trimers etc. may be identical or non-identical. The corresponding structures of higher order of such multimers are, consequently, termed homo- or heterodimers, homo- or heterotrimers etc. An example for a hereteromultimer is an antibody or immunoglobulin molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is accomplished e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

An antigen binding protein is said to "specifically bind" or "immunospecifically bind" to its antigen when the antigen binding protein binds its antigen with a dissociation constant (KD) is 3.0-7 M as measured via a surface plasma resonance technique (e.g., BIACore, GE-Healthcare Uppsala, Sweden) or Kinetic Exclusion Assay (KinExA, Sapidyne, Boise, Idaho). In accordance with this invention an antigen binding protein specifically binds or immunospecifically binds to pMAGE-HLA (e.g., GVYDGEEHSV (SEQ ID NO: 1) complexed with HLA-A*02:01) and CD3ε.

Because of the sequence similarity between homologous proteins in different species, an antibody construct or a binding domain that specifically binds to its target (such as a human target) may, however, cross-react with homologous target molecules from different species (such as, from non-human primates). The term "specific/immunospecific binding" can hence include the binding of an antibody construct or binding domain to epitopes or structurally related epitopes in more than one species.

Moreover, because of sequence similarity between, for example, different MAGE peptides, an antibody construct or binding domain may cross-react with the various peptides. See FIG. 1 for a sequence comparison. For example, in some embodiments the antibody construct or binding domain may specifically bind to a pMAGE-HLA, where the peptide is GVYDGEEHSV, SEQ ID NO: 1, GVYDGREHTV, SEQ ID NO: 2, and/or GLYDGREHSV, SEQ ID NO: 3. In other embodiments, the antibody construct or binding domain may specifically bind only to GVYDGEEHSV, SEQ ID NO: 1 in the context of a pMAGE-HLA.

Linkers

The at least two binding domains and the variable domains (VH/VL) of the antibody construct of the present invention may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. The peptide linkers can also be used to fuse the third domain to the other domains of the antibody construct of the invention. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct of the invention.

Examples of useful peptide linkers are provided herein, in addition to those known in the art. Nonlimiting examples of linkers include:

```
G4S linker
                                    (SEQ ID NO: 10)
GGGGS (G4S)2 linker
                                    (SEQ ID NO: 11)
GGGGSGGGGS (G4S)3 linker
                                    (SEQ ID NO: 12)
GGGGSGGGGSGGGGS (G4S)4 linker
                                    (SEQ ID NO: 13)
GGGGSGGGGSGGGGSGGGGS (G4S)5 linker
                                    (SEQ ID NO: 14)
GGGGSGGGGSGGGGSGGGGSGGGGS (G4S)6 linker
                                    (SEQ ID NO: 15)
GGGGSGGGGSGGGGSGGGGSGGGGS

GGGGS
```

```
                -continued
(G4S)7 linker
                                        (SEQ ID NO: 16)
GGGGSGGGGSGGGGSGGGGSGGGGS

GGGGSGGGGS (G4S)8 linker
                                        (SEQ ID NO: 17)
GGGGSGGGGSGGGGSGGGGSGGGGS

GGGGSGGGGSGGGGS

Peptide linker
                                        (SEQ ID NO: 18)
PGGGGS

Peptide linker
                                        (SEQ ID NO: 19)
PGGDGS

Peptide linker
                                        (SEQ ID NO: 20)
SGGGGS

Peptide linker
                                        (SEQ ID NO: 21)
GGGG
```

In the present context, a "short" linker has between 2 and 50 amino acids, preferably between 3 and 35, between 4 and 30, between 5 and 25, between 6 and 20 or between 6 and 17 amino acids. The linker between two variable regions of one binding domain may have a different length (e.g. may be longer) than the linker between the two binding domains. For example, the linker between two variable regions of one binding domain may have a length between 7 and 15 amino acids, preferably between 9 and 13, and the linker between the two binding domains may have a length between 3 and 10 amino acids, preferably between 4 and 8. It is further envisaged that the peptide linkers are glycine/serine linkers, such as those depicted in SEQ ID NOs: 10-17. In some embodiments, the majority of the amino acids in glycine/serine linkers are selected from glycine and serine.

In the event that a linker is used to fuse the first domain to the second domain, or the first or second domain to the third domain, this linker is preferably of a length and sequence sufficient to ensure that each of the first and second domains can, independently from one another, retain their differential binding specificities. For peptide linkers which connect the at least two binding domains (or two variable domains) in the antibody construct of the invention, those peptide linkers are preferred which comprise only a few number of amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred.

A "single amino acid" linker in the context of said "peptide linker" is Gly. Accordingly, said peptide linker may consist of the single amino acid Gly. Another embodiment of a peptide linker is characterized by the amino acid sequence Gly-Gly-Gly-Gly-Ser, i.e., Gly4Ser (SEQ ID NO: 10), or polymers thereof, i.e. (Gly4Ser)x, where x is an integer of 1 or greater (e.g. 2 or 3) (SEQ ID NO: 18448). The characteristics of said peptide linkers are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which do not promote any secondary structures are preferred. The linkage of said domains to each other can be provided, e.g., by genetic engineering. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, New York, 2001).

The peptide linker, by whom the polypeptide monomers ("Fc portion" or "Fc monomer") of the third domain are fused to each other, in one embodiment comprises at least 25 amino acid residues (25, 26, 27, 28, 29, 30 etc.). In another embodiment, this peptide linker comprises at least 30 amino acid residues (30, 31, 32, 33, 34, 35 etc.). In a further embodiment the linker comprises up to 40 amino acid residues, up to 35 amino acid residues, or exactly 30 amino acid residues. A specific embodiment of such peptide linker is characterized by the amino acid sequence Gly-Gly-Gly-Gly-Ser, i.e. Gly4Ser (SEQ ID NO: 10), or polymers thereof, i.e. (Gly4Ser)x, where x is an integer of 5 or greater (e.g. 6, 7 or 8) (SEQ ID NO: 18449). Preferably the integer is 6 or 7, more preferably the integer is 6.

Exemplary Molecule Formats

As described herein above, the invention provides an embodiment wherein the antibody construct is in a format selected from the group consisting of (scFv)2, scFv-single domain mAb, diabodies and oligomers of any of the aforementioned formats. The term "is in a format" does not exclude that the construct can be further modified, e.g. by attachment or fusion to other moieties, as described herein.

The antibody construct of the invention may hence comprise in an N- to C-terminal order:
  (a) the first domain;
  (b) a peptide linker;
  (c) the second domain;
  (d) a peptide linker;
  (e) the first polypeptide monomer of the third domain (comprising a hinge, a CH2 and a CH3 domain);
  (f) a peptide linker; and
  (g) the second polypeptide monomer of the third domain (comprising a hinge, a CH2 and a CH3 domain).

According to one embodiment of the antibody construct of the present invention, the first and/or the second domain are in the format of an scFv. In an scFv, the VH region and the and VL region are arranged in the order VH-VL or VL-VH (from N- to C-terminus). It is envisaged that the VH and the VL regions of the first and/or the second binding domain are connected via a linker, preferably a peptide linker. According to one embodiment of the first and/or the second domain, the VH-region is positioned N-terminally of the linker, and the VL-region is positioned C-terminally of the linker. In other words, in one embodiment of the first and/or the second domain, the scFv comprises from the N-terminus to the C-terminus: VH-linker-VL. It is furthermore envisaged that the first domain and the second domain of the antibody construct are connected via a linker, preferably a peptide linker. The antibody construct may e.g. comprise the domains in the order (from N-terminus to C-terminus) first domain-linker-second domain. The inverse order (second domain-linker-first domain) is also possible.

According to one embodiment of the invention, the antibody construct of the invention is a "single chain antibody construct". It is also envisaged that either the first or the second or both binding domains may be in the format of a "single chain Fv" (scFv). Although the two domains of the Fv fragment, VL and VH, are coded for by separate genes, they can be joined, using recombinant methods, by an artificial linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are full-length antibodies or IgGs. A single-chain variable fragment (scFv) is hence a fusion protein of the variable region of the heavy chain (VH) and of the light chain (VL) of immunoglobulins, usually connected with a short linker peptide. The linker is usually rich in glycine for flexibility, as well as serine or also threonine for solubility, and can either connect the N-terminus of the VH with the C-terminus of the VL, or vice versa. This protein retains the specificity of the original immunoglobulin, despite removal of the constant regions and introduction of the linker.

In certain embodiments of the antibody construct of the present invention the first and second domain form an antibody construct in a format selected from the group consisting of (scFv)2, scFv-single domain mAb, diabody and oligomers of any of these formats.

In certain embodiments, a bispecific binding molecule may not be desired, and instead a more standard antibody format (e.g., an IgG monoclonal antibody) by be the molecule desired. Accordingly, in one embodiment the invention provides an antibody comprising a VH and VL. In another embodiment, the invention provides an antibody comprising a VH-CDR1, VH-CDR2, VH-CDR3 and a VL-CDR1, VL-CDR2, VL-CDR3.

In one embodiment of the invention either the first, the second or the first and the second domain may comprise a single domain antibody, the variable domain, or at least the CDRs of a single domain antibody.

Antibody constructs denominated "single domain antibodies" comprise one (monomeric) antibody variable region which is able to bind selectively to a specific antigen, independently of other variable regions. The first single domain antibodies were engineered from heavy chain antibodies found in camelids, and these are called VHH fragments. Cartilaginous fishes also have heavy chain antibodies (IgNAR) from which single domain antibodies called VNAR fragments can be obtained. An alternative approach is to split the dimeric variable regions from common immunoglobulins into monomers, hence obtaining VH or VL as a single domain Ab. Although most research into single domain antibodies is currently based on heavy chain variable regions, nanobodies derived from light chains were also shown to bind specifically to target epitopes. Examples of single domain antibodies are called sdAb, nanobodies or single variable domain antibodies.

A (single domain mAb)2 is hence a monoclonal antibody construct composed of (at least) two single domain monoclonal antibody constructs, which are individually selected from the group comprising VH, VL, VHH and VNAR. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

It is also envisaged that the antibody construct of the invention has, in addition to its function to bind to the target molecules the pMAGE-HLA and CD3, a further function. In this format, the antibody construct may be a trifunctional or multifunctional antibody construct by targeting target cells through the pMAGE-HLA binding, mediating cytotoxic T cell activity through CD3 binding and providing a further function such as means or domains to enhance or extend serum half-life, a fully functional or modified Fc constant domain mediating ADCC through recruitment of effector cells, a label (fluorescent etc.), a therapeutic agent such as a toxin or radionuclide, etc.

According to another embodiment, the antibody construct of the invention comprises (in addition to the first and second domain) a third domain which comprises two polypeptide monomers, each comprising a hinge, a CH2 and a CH3 domain, wherein said two polypeptide monomers are fused to each other via a peptide linker. It is envisaged that said third domain comprises in an N-terminal to C-terminal order: hinge-CH2-CH3-linker-hinge-CH2-CH3. Amino acid sequences that can be used for said third domain are depicted in SEQ ID NOs: 22-29. Each of said polypeptide monomers can have an amino acid sequence that is selected from the group consisting of SEQ ID NOs: 22-29, or that is at least 90% identical to those sequences. In another embodiment, the first and second domains of the antibody construct of the invention are fused to the third domain via a peptide linker.

Half-Life Extension

Examples for means or domains to extend serum half-life of the antibody constructs of the invention include peptides, proteins or domains of proteins, which are fused or otherwise attached to the antibody constructs. The group of peptides, proteins or protein domains includes peptides binding to other proteins with preferred pharmacokinetic profile in the human body such as serum albumin (see WO 2009/127691). An alternative concept of such half-life extending peptides includes peptides binding to the neonatal Fc receptor (FcRn, see WO 2007/098420), which can also be used in the antibody constructs of the present invention. The concept of attaching larger domains of proteins or complete proteins includes the fusion of human serum albumin, variants or mutants of human serum albumin (see WO 2011/051489, WO 2012/059486, WO 2012/150319, WO 2013/135896, WO 2014/072481, WO 2013/075066) or domains thereof, as well as the fusion of an immunoglobulin constant region (Fc domain) and variants thereof. Such variants of Fc domains are called Fc-based domains and may e.g. be optimized/modified in order to allow the desired pairing of dimers or multimers, to abolish Fc receptor binding (e.g. to avoid ADCC or CDC) or for other reasons. A further concept known in the art to extend the half-life of substances or molecules in the human body is the pegylation of those molecules (such as the antibody constructs of the present invention).

In one embodiment, the antibody constructs according to the invention are linked (e.g. via peptide bond) with a fusion partner (such as a protein, polypeptide or peptide), e.g. for the purpose of extending the construct's serum half-life. These fusion partners can be selected from human serum albumin ("HSA" or "HALB") as wells as sequence variants thereof, peptides binding to HSA, peptides binding to FcRn ("FcRn BP"), or constructs comprising an (antibody derived) Fc region. In general, the fusion partners may be linked to the N-terminus or to the C-terminus of the antibody constructs according to the invention, either directly (e.g. via peptide bond) or through a peptide linker such as (GGGGS)n (wherein "n" is an integer of 2 or greater, e.g. 2 or 3 or 4) (SEQ ID NO: 18450). Suitable peptide linkers are provided herein.

Amino Acid Sequence Modifications

Amino acid sequence modifications of the antibody constructs described herein are also contemplated. For example, it may be desirable to improve the binding affinity and/or other biological properties of the antibody construct. Amino acid sequence variants of the antibody constructs are prepared by peptide synthesis or by introducing appropriate nucleotide changes into the nucleic acid molecule encoding the antibody constructs. All below described amino acid sequence modifications should result in an antibody construct which retains the desired biological activity of the unmodified parental molecule (such as binding to a pMAGE-HLA and to CD3, inducing cytotoxicity against MAGEB2 positive target cells).

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (Ile or I): leucine (Leu or L); lysine (Lys or K); methionine (Met or M); phenylalanine (Phe or F); proline (Pro or P); serine (Ser or S); threonine (Thr or T); tryptophan (Trp or W); tyrosine (Tyr or Y); and valine (Val or V), although modified, synthetic, or rare amino acids may be used as desired. There are basically four different classes of amino acids determined by different side chains:

(1) non-polar and neutral (uncharged): Ala, Gly, Ile, Leu, Met, Phe, Pro, Val
(2) polar and neutral (uncharged): Asn, Cys (being only slightly polar), Gln, Ser, Thr, Trp (being only slightly polar), Tyr
(3) acidic and polar (negatively charged): Asp and Glu
(4) basic and polar (positively charged): Arg, His, Lys Hydrophobic amino acids can be divided according to whether they have aliphatic or aromatic side chains. Phe and Trp (being very hydrophobic), Tyr and His (being less hydrophobic) are classified as aromatic amino acids. Strictly speaking, aliphatic means that the side chain contains only hydrogen and carbon atoms. By this strict definition, the amino acids with aliphatic side chains are alanine, isoleucine, leucine (also norleucine), proline and valine. Alanine's side chain, being very short, means that it is not particularly hydrophobic, and proline has an unusual geometry that gives it special roles in proteins. It is often convenient to consider methionine in the same category as isoleucine, leucine and valine, although it also contains a sulphur atom. The unifying theme is that these amino acids contain largely non-reactive and flexible side chains. The amino acids alanine, cysteine, glycine, proline, serine and threonine are often grouped together for the reason that they are all small in size. Gly and Pro may influence chain orientation.

Amino acid modifications include, for example, deletions of residues from, insertions of residues into, and/or substitutions of residues within the amino acid sequences of the antibody constructs. Any combination of deletion, insertion, and/or substitution is made to arrive at a final antibody construct, provided that the final construct possesses the desired characteristics, e.g. the biological activity of the unmodified parental molecule (such as binding to a pMAGE-HLA and to CD3, inducing cytotoxicity against MAGEB2 positive target cells). The amino acid changes may also alter post-translational processes of the antibody constructs, such as changing the number or position of glycosylation sites.

For example, 1, 2, 3, 4, 5, or 6 amino acids may be inserted, deleted and/or substituted in each of the CDRs (of course, dependent on their respective length), while 1, 2, 3, 4, 5, 6, 7, 8, 9, 10, 11, 12, 13, 14, 15, 16, 17, 18, 19, 20, or 25 amino acids may be inserted, deleted and/or substituted in each of the FRs. Amino acid sequence insertions also include N-terminal and/or C-terminal additions of amino acids ranging in length from e.g. 1, 2, 3, 4, 5, 6, 7, 8, 9 or 10 residues to polypeptides containing more than 10, e.g. one hundred or more residues, as well as intra-sequence insertions of single or multiple amino acid residues. An insertional variant of the antibody construct of the invention includes the fusion of a polypeptide which increases or extends the serum half-life of the antibody construct to the N-terminus or to the C-terminus of the antibody construct. It is also conceivable that such insertion occurs within the antibody construct, e.g. between the first and the second domain.

The sites of greatest interest for amino acid modifications, in particular for amino acid substitutions, include the hypervariable regions, in particular the individual CDRs of the heavy and/or light chain, but FR alterations in the heavy and/or light chain are also contemplated. The substitutions can be conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR, respectively. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

As described herein, a useful method for the identification of certain residues or regions within the antibody constructs that are preferred locations for mutagenesis is called "alanine scanning mutagenesis," which is a mature technology, and is further described e.g. in Cunningham B. C. and Wells J. A. (Science. 1989 Jun. 2; 244(4908):1081-5) and Morrison K L & Weiss G A. (Cur Opin Chem Biol. 2001 June; 5(3):302-7). Here, a residue or group of residues within the antibody construct is/are identified (e.g. charged residues such as Arg, His, Lys, Asp, and Glu) and replaced by a neutral or non-polar amino acid (most preferably alanine or polyalanine), e.g., via peptide synthesis or site-directed mutagenesis, to affect the interaction of the respective amino acid(s) with the epitope of the target protein. Alanine scanning is a technique used to determine the contribution of a specific residue to the stability or function of given protein. Alanine is used because of its non-bulky, chemically inert, methyl functional group that nevertheless mimics the secondary structure preferences that many of the other amino acids possess. Sometimes bulky amino acids such as valine or leucine can be used in cases where conservation of the size of mutated residues is needed. This technique can also be useful to determine whether the side chain of a specific residue plays a significant role in bioactivity. Alanine scanning is usually accomplished by site-directed mutagenesis or randomly by creating a PCR library. Furthermore, computational methods to estimate thermodynamic parameters based on a theoretical alanine substitutions have been developed. The data can be tested by IR, NMR Spectroscopy, mathematical methods, bioassays, etc.

Those amino acid locations demonstrating functional sensitivity to the substitutions (as determined e.g. by alanine scanning) can then be refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done e.g. using assays of antigen (e.g. pMAGE-HLA or CD3) binding activity and/or of cytotoxic activity.

Generally, if amino acids are substituted in one or more or all of the CDRs of the heavy and/or light chain, it is envisaged that the then-obtained "substituted" sequence is at least 60% or 65%, more preferably 70% or 75%, even more preferably 80% or 85%, and particularly preferably 90% or 95% identical/homologous to the "original" or "parental" CDR sequence. This means that the degree of identity/homology between the original and the substituted sequence depends on the length of the CDR. For example, a CDR having 5 amino acids in total and comprising one amino acid substitution is 80% identical to the "original" or "parental" CDR sequence, while a CDR having 10 amino acids in total and comprising one amino acid substitution is 90% identical to the "original" or "parental" CDR sequence. Accordingly, the substituted CDRs of the antibody construct of the invention may have different degrees of identity to their original sequences, e.g., CDRL1 may have 80%, while CDRL3 may have 90% of homology. The same considerations apply to the framework regions and to the entire VH and VL regions.

A "variant CDR" is a CDR with a specific sequence homology, similarity, or identity to the parent CDR of the invention, and shares biological function with the parent CDR, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR. Generally, the amino acid homology, similarity, or identity between individual variant CDRs is at least 60% to the parent sequences depicted herein, and more typically with increasing homologies, similarities or identities of at least 65% or 70%, preferably at least 75% or 80%, more preferably at least 85%, 90%, 91%, 92%, 93%, 94%, and most preferably 95%, 96%, 97%, 98%, 99%, and almost 100%. The same applies to "variant VH" and "variant VL". According to one embodiment, the sequence variations within a "variant VH" and/or a "variant VL" do not extend to the CDRs. The present invention is hence directed to an antibody construct as defined herein, comprising VH and VL sequences having a certain sequence homology (see above) to the specific sequences as defined herein (the "parental" VH and VL), wherein the CDR sequences are 100% identical to the specific CDR sequences as defined herein (the "parental" CDRs).

Preferred substitutions (or replacements) are conservative substitutions. However, any substitution (including non-conservative substitutions or one or more from the "exemplary substitutions" listed in Table 5, below) is envisaged, as long as the antibody construct retains its capacity to bind to a pMAGE-HLA via the first domain and to CD3 or CD3 epsilon via the second domain, and/or provided its CDRs, FRs, VH and/or VL sequences have a degree of identity to the original or parental sequence of at least 60% or 65%, more preferably at least 70% or 75%, even more preferably at least 80% or 85%, and particularly preferably at least 90% or 95%.

A conservative replacement (also called a conservative mutation or a conservative substitution) is an amino acid replacement that changes a given amino acid to a different amino acid with similar biochemical properties (e.g. charge, hydrophobicity, size). Conservative replacements in proteins often have a smaller effect on protein function than non-conservative replacements. Conservative substitutions are shown in Table 5. Exemplary conservative substitutions are shown as "exemplary substitutions". If such substitutions result in a change in biological activity, then more substantial changes, as further described herein in reference to amino acid classes, may be introduced and the products screened for a desired characteristic.

TABLE 5

Amino acid substitutions (aa = amino acid)

| Original aa | Conservative substitutions | Exemplary Substitutions |
|---|---|---|
| Ala (A) | Small aa | Gly, Ser, Thr |
| Arg (R) | Polar aa, in particular Lys | Lys, Gln, Asn |
| Asn (N) | Polar aa, in particular Asp | Asp, Gln, His, Lys, Arg |
| Asp (D) | Glu or other polar aa, in particular Asn | Glu, Asn |
| Cys (C) | Small aa | Ser, Ala |
| Gln (Q) | Polar aa, in particular Glu | Glu, Asn |
| Glu (E) | Asp or other polar aa, in particular Gln | Asp, Gln |
| Gly (G) | Small aa, such as Ala | Ala |
| His (H) | | Asn, Gln, Arg, Lys, Tyr |
| Ile (I) | Hydrophobic, in particular aliphatic aa | Ala, Val, Met, Leu, Phe |
| Leu (L) | Hydrophobic, in particular aliphatic aa | Norleucine, Ile, Ala, Val, Met |
| Lys (K) | Polar aa, in particular Arg | Arg, Gln, Asn |
| Met (M) | Hydrophobic, in particular aliphatic aa | Leu, Ala, Ile, Val, Phe |
| Phe (F) | Aromatic or hydrophobic aa, in particular Tyr | Tyr, Trp, Leu, Val, Ile, Ala |
| Pro (P) | Small aa | Ala |
| Ser (S) | Polar or small aa, in particular Thr | Thr |
| Thr (T) | Polar aa, in particular Ser | Ser |
| Trp (W) | Aromatic aa | Tyr, Phe |
| Tyr (Y) | Aromatic aa, in particular Phe | Phe, Trp, Thr, Ser |
| Val (V) | Hydrophobic, in particular aliphatic aa | Leu, Ile, Ala, Met, Phe |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Non-conservative substitutions will usually entail exchanging a member of one of the above defined amino acid classes (such as polar, neutral, acidic, basic, aliphatic, aromatic, small . . . ) for another class. Any cysteine residue not involved in maintaining the proper conformation of the antibody construct may be substituted, generally with serine, to improve the oxidative stability of the antibody construct.

In addition to the above described substitutions, other substitutions within the CDRs that contribute to binding can be made. For example, the consensus sequences set forth in Tables 29 (SEQ ID NOs: 1832-2965), 37 (SEQ ID NOs: 3497-3874), 45 (SEQ ID NOs: 4361-4710), 53 (SEQ ID NOs: 5982-6844), 61 (SEQ ID NOs: 13276-16184), 62 (SEQ ID NOs: 13434-16257), 63 (SEQ ID NOs: 13507-16484), 71 (SEQ ID NOs: 16971-17195), 72 (SEQ ID NOs: 16980-17204), 73 (SEQ ID NOs: 16989-17222), 111, 112, 113, 114, 115, 116, or 117 herein provide such substitutions. In certain embodiments, deletions as guided by the provided consensus sequences may also be made. With the guidance provided herein by the consensus sequences set forth in Tables 29 (SEQ ID NOs: 1832-2965), 37 (SEQ ID NOs: 3497-3874), 45 (SEQ ID NOs: 4361-4710), 53 (SEQ ID NOs: 5982-6844), 61 (SEQ ID NOs: 13276-16184), 62 (SEQ ID NOs: 13434-16257), 63 (SEQ ID NOs: 13507-16484), 71 (SEQ ID NOs: 16971-17195), 72 (SEQ ID NOs: 16980-17204), 73 (SEQ ID NOs: 16989-17222), 111, 112, 113, 114, 115, 116, or 117 various amino acid substitutions, and functional equivalents thereof, or deletions, can be readily made by one of ordinary skill in the art.

Sequence identity, homology and/or similarity of amino acid sequences is determined by using standard techniques known in the art, including, but not limited to, the local sequence identity algorithm of Smith and Waterman, 1981, Adv. Appl. Math. 2:482, the sequence identity alignment algorithm of Needleman and Wunsch (J Mol Biol. 1970 March; 48(3):443-53), the search for similarity method of Pearson and Lipman (Proc Natl Acad Sci USA. 1988 April; 85(8):2444-8), computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al. (Nucleic Acids Res. 1984 Jan. 11; 12(1 Pt 1): 387-95), preferably using the default settings, or by inspection. It is envisaged that percent identity is calculated by FastDB based upon the following parameters: mismatch penalty of 1; gap penalty of 1; gap size penalty of 0.33; and joining penalty of 30. See also "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng and Doolittle (J Mol Evol. 1987; 25(4):351-60); the method is similar to that described by Higgins and Sharp (Comput Appl Biosci. 1989 April; 5(2):151-3). Useful PILEUP parameters include a default gap weight of 3.00, a default gap length weight of 0.10, and weighted end gaps.

Another example of a useful algorithm is the BLAST algorithm, described in: Altschul et al. (J Mol Biol. 1990 Oct. 5; 215(3):403-10.); Altschul et al., (Nucleic Acids Res. 1997 Sep. 1; 25(17):3389-402); and Karlin and Altschul (Proc Natl Acad Sci USA. 1993 Jun. 15; 90(12):5873-7). A particularly useful BLAST program is the WU-Blast-2 program which was obtained from Altschul et al., (Methods Enzymol. 1996; 266:460-80). WU-Blast-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al. (Nucleic Acids Res. 1997 Sep. 1; 25(17):3389-402). Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

In line herewith, the term "percent (%) nucleic acid sequence identity/homology/similarity" with respect to the nucleic acid sequence encoding the antibody constructs identified herein is defined as the percentage of nucleotide residues in a candidate sequence that are identical with the nucleotide residues in the coding sequence of the antibody construct. One method to align two sequences and thereby determine their homology uses the BLASTN module of WU-Blast2 set to the default parameters, with overlap span and overlap fraction set to 1 and 0.125, respectively. Generally, the nucleic acid sequence homology, similarity, or identity between the nucleotide sequences encoding individual variant CDRs and the nucleotide sequences depicted herein are at least 60%, and more typically with increasing homologies, similarities or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Again, the same applies to nucleic acid sequence encoding the "variant VH" and/or "variant VL".

In one embodiment, the percentage of identity to human germline of the antibody constructs according to the invention, or of the first and second domain (binding domains) of these antibody constructs, is 70% or 75%, more preferably 80% or 85%, even more preferably 90%, and most preferably 91%, 92%, 93%, 94%, 95% or even 96%. Identity to human antibody germline gene products is thought to be an important feature to reduce the risk of therapeutic proteins to elicit an immune response against the drug in the patient during treatment. Hwang W. Y. and Foote J. (Methods. 2005 May; 36(1):3-10) demonstrate that the reduction of non-human portions of drug antibody constructs leads to a decrease of risk of inducing anti-drug antibodies in the patients during treatment. By comparing an exhaustive number of clinically evaluated antibody drugs and the respective immunogenicity data, the trend is shown that humanization of the variable regions of antibodies/antibody constructs makes the protein less immunogenic (average 5.1% of patients) than antibodies/antibody constructs carrying unaltered non-human variable regions (average 23.59% of patients). A higher degree of identity to human sequences is hence desirable for protein therapeutics based on variable regions and in the form of antibody constructs. For the purpose of determining the germline identity, the V-regions of VL can be aligned with the amino acid sequences of human germline V segments and J segments (http://www2.mrc-lmb.cam.ac.uk/vbasen using Vector NTI software and the amino acid sequence calculated by dividing the identical amino acid residues by the total number of amino acid residues of the VL in percent. The same can be done for the VH segments (http://www2.mrc-lmb.cam.ac.uk/vbasen with the exception that the VH CDR3 may be excluded due to its high diversity and a lack of existing human germline VH CDR3 alignment partners. Recombinant techniques can then be used to increase sequence identity to human antibody germline genes.

Nucleotides Encoding the Antibody Constructs

The invention further provides a polynucleotide/nucleic acid molecule encoding an antibody construct of the invention. Nucleic acid molecules are biopolymers composed of nucleotides. A polynucleotide is a biopolymer composed of 13 or more nucleotide monomers covalently bonded in a chain. DNA (such as cDNA) and RNA (such as mRNA) are examples of polynucleotides/nucleic acid molecules with distinct biological function. Nucleotides are organic molecules that serve as the monomers or subunits of nucleic acid molecules like DNA or RNA. The nucleic acid molecule or polynucleotide of the present invention can be double stranded or single stranded, linear or circular. It is envisaged that the nucleic acid molecule or polynucleotide is comprised in a vector. It is furthermore envisaged that such vector is comprised in a host cell. Said host cell is, e.g. after transformation or transfection with the vector or the polynucleotide/nucleic acid molecule of the invention, capable of expressing the antibody construct. For this purpose, the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code.

Degeneracy of codons is the redundancy of the genetic code, exhibited as the multiplicity of three-base pair codon combinations that specify an amino acid. Degeneracy results because there are more codons than encodable amino acids. The codons encoding one amino acid may differ in any of their three positions; however, more often than not, this difference is in the second or third position. For instance, codons GAA and GAG both specify glutamic acid and exhibit redundancy; but, neither specifies any other amino acid and thus demonstrate no ambiguity. The genetic codes of different organisms can be biased towards using one of the several codons that encode the same amino acid over the others—that is, a greater frequency of one will be found than expected by chance. For example, leucine is specified by six distinct codons, some of which are rarely used. Codon usage tables detailing genomic codon usage frequencies for most organisms are available. Recombinant gene technologies commonly take advantage of this effect by implementing a technique termed codon optimization, in which those codons are used to design a polynucleotide which are preferred by the respective host cell (such as a cell of human hamster origin, an *Escherichia coli* cell, or a *Saccharomyces cerevisiae* cell), e.g. in order to increase protein expression. It is hence envisaged that the polynucleotides/nucleic acid molecules of the present disclosure are codon optimized. Nevertheless, the polynucleotide/nucleic acid molecule encoding an antibody construct of the invention may be designed using any codon that encodes the desired amino acid.

According to one embodiment, the polynucleotide/nucleic acid molecule of the present invention encoding the antibody construct of the invention is in the form of one single molecule or in the form of two or more separate molecules. If the antibody construct of the present invention is a single chain antibody construct, the polynucleotide/nucleic acid molecule encoding such construct will most likely also be in the form of one single molecule. However, it is also envisaged that different components of the antibody construct (such as the different domains, e.g. the domain which binds to the pMAGE-HLA, the domain which binds to CD3, and/or further domains such as antibody constant domains) are located on separate polypeptide chains, in which case the polynucleotide/nucleic acid molecule is most likely in the form of two or more separate molecules.

The same applies for the vector comprising a polynucleotide/nucleic acid molecule of the present invention. If the antibody construct of the present invention is a single chain antibody construct, one vector may comprise the polynucleotide which encodes the antibody construct in one single location (as one single open reading frame, ORF). One vector may also comprise two or more polynucleotides/nucleic acid molecules at separate locations (with individual ORFs), each one of them encoding a different component of the antibody construct of the invention. It is envisaged that the vector comprising the polynucleotide/nucleic acid molecule of the present invention is in the form of one single vector or two or more separate vectors. In one embodiment, and for the purpose of expressing the antibody construct in a host cell, the host cell of the invention should comprise the polynucleotide/nucleic acid molecule encoding the antibody construct or the vector comprising such polynucleotide/nucleic acid molecule in their entirety, meaning that all components of the antibody construct—whether encoded as one single molecule or in separate molecules/locations—will assemble after translation and form together the biologically active antibody construct of the invention.

The invention also provides a vector comprising a polynucleotide/nucleic acid molecule of the invention. A vector is a nucleic acid molecule used as a vehicle to transfer (foreign) genetic material into a cell, usually for the purpose of replication and/or expression. The term "vector" encompasses—but is not restricted to—plasmids, viruses, cosmids, and artificial chromosomes. Some vectors are designed specifically for cloning (cloning vectors), others for protein expression (expression vectors). So-called transcription vectors are mainly used to amplify their insert. The manipulation of DNA is normally conducted on *E. coli* vectors, which contain elements necessary for their maintenance in *E. coli*. However, vectors may also have elements that allow them to be maintained in another organism such as yeast, plant or mammalian cells, and these vectors are called shuttle vectors. Insertion of a vector into the target or host cell is usually called transformation for bacterial cells and transfection for eukaryotic cells, while insertion of a viral vector is often called transduction.

In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. While the genetic code determines the polypeptide sequence for a given coding region, other genomic regions can influence when and where these polypeptides are produced. Modern vectors may therefore encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, a Kozak sequence and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the nucleotide sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using biological particles (such as viral transfection, also called viral transduction), chemical-based methods (such as using calcium phosphate, lipofection, Fugene, cationic polymers, nanoparticles) or physical treatment (such as electroporation, microinjection, gene gun, cell squeezing, magnetofection, hydrostatic pressure, impalefection, sonication, optical transfection, heat shock).

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which might occur as a time-limited response to environmental conditions such as starvation and cell density, and can also be artificially induced.

Moreover, the invention provides a host cell transformed or transfected with the polynucleotide/nucleic acid molecule of the invention or with the vector of the invention.

As used herein, the terms "host cell" or "recipient cell" are intended to include any individual cell or cell culture that can be or has been recipient of vectors, exogenous nucleic acid molecules and/or polynucleotides encoding the antibody construct of the present invention; and/or recipients of the antibody construct itself. The introduction of the respective material into the cell is carried out by way of transformation, transfection and the like (vide supra). The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include—but are not limited to—bacteria (such as *E. coli*), yeast cells, fungi cells, plant cells, and animal cells such as insect cells and mammalian cells, e.g., hamster, murine, rat, macaque or human.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans,* and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as *Neurospora, Penicillium, Tolypocladium,* and *Aspergillus* hosts such as *A. nidulans* and *A. niger.*

Suitable host cells for the expression of a glycosylated antibody construct are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia,* tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (cell culture) has become a routine procedure. Examples of useful mammalian host cell lines are monkey kidney CV1 line transformed by SV40 (such as COS-7, ATCC CRL 1651); human embryonic kidney line (such as 293 or 293 cells subcloned for growth in suspension culture, Graham et al., J. Gen Virol. 36: 59 (1977)); baby hamster kidney cells (such as BHK, ATCC CCL 10); Chinese hamster ovary cells/– DHFR (such as CHO, Urlaub et al., Proc. Natl. Acad. Sci. USA 77: 4216 (1980)); mouse sertoli cells (such as TM4, Mather, Biol. Reprod. 23: 243-251 (1980)); monkey kidney cells (such as CVI ATCC CCL 70); African green monkey kidney cells (such as VERO-76, ATCC CRL1587); human cervical carcinoma cells (such as HELA, ATCC CCL 2); canine kidney cells (such as MDCK, ATCC CCL 34); buffalo rat liver cells (such as BRL 3A, ATCC CRL 1442); human lung cells (such as W138, ATCC CCL 75); human liver cells (such as Hep G2,1413 8065); mouse mammary tumor (such as MMT 060562, ATCC CCL-51); TRI cells (Mather et al., Annals N. Y Acad. Sci. (1982) 383: 44-68); MRC 5 cells; FS4 cells; and a human hepatoma line (such as Hep G2).

Production of Antibody Constructs

In a further embodiment, the invention provides a process for producing an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. Cells are grown and maintained in a cell growth medium at an appropriate temperature and gas mixture. Culture conditions vary widely for each cell type. Typical growth conditions are a temperature of about 37° C., a CO2 concentration of about 5% and a humidity of about 95%. Recipes for growth media can vary e.g. in pH, concentration of the carbon source (such as glucose), nature and concentration of growth factors, and the presence of other nutrients (such as amino acids or vitamins). The growth factors used to supplement media are often derived from the serum of animal blood, such as fetal bovine serum (FBS), bovine calf serum (FCS), equine serum, and porcine serum. Cells can be grown either in suspension or as adherent cultures. There are also cell lines that have been modified to be able to survive in suspension cultures so they can be grown to a higher density than adherent conditions would allow.

The term "expression" includes any step involved in the production of an antibody construct of the invention including, but not limited to, transcription, post-transcriptional modification, translation, folding, post-translational modification, targeting to specific subcellular or extracellular locations, and secretion. The term "recovering" refers to a series of processes intended to isolate the antibody construct from the cell culture. The "recovering" or "purification" process may separate the protein and non-protein parts of the cell culture, and finally separate the desired antibody construct from all other polypeptides and proteins. Separation steps usually exploit differences in protein size, physico-chemical properties, binding affinity and biological activity. Preparative purifications aim to produce a relatively large quantity of purified proteins for subsequent use, while analytical purification produces a relatively small amount of a protein for a variety of research or analytical purposes.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. The antibody construct of the invention may e.g. be produced in bacteria such as E. coli. After expression, the construct is isolated from the bacterial cell paste in a soluble fraction and can be purified e.g. via affinity chromatography and/or size exclusion. Final purification can be carried out in a manner similar to the process for purifying an antibody construct expressed in mammalian cells and secreted into the medium. Carter et al. (Biotechnology (NY) 1992 February; 10(2):163-7) describe a procedure for isolating antibodies which are secreted to the periplasmic space of E. coli.

Where the antibody is secreted into the medium, supernatants from such expression systems are generally first concentrated using a commercially available protein concentration filter, for example, an ultrafiltration unit.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, mixed mode ion exchange, HIC, ethanol precipitation, size exclusion chromatography, reverse phase HPLC, chromatography on silica, chromatography on heparin sepharose, chromatography on an anion or cation exchange resin (such as a polyaspartic acid column), immunoaffinity (such as Protein A/G/L) chromatography, chromato-focusing, SDS-PAGE, ultracentrifugation, and ammonium sulfate precipitation are also available depending on the antibody construct to be recovered.

A protease inhibitor may be included in any of the foregoing steps to inhibit proteolysis, and antibiotics may be included to prevent the growth of contaminants.

Molecule Properties

A molecule may exhibit various different properties that are desired in a therapeutic pharmaceutical, e.g., stability during various storage states, in vivo stability, purity, and other properties that can be assayed.

Accordingly, in a further embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥3 mg/L supernatant.

Likewise, the yield of the dimeric antibody construct isoforms and hence the monomer percentage (i.e., monomer: (monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In one embodiment, the antibody constructs have a preferred plasma stability (ratio of EC50 with plasma to EC50 w/o plasma) of ≤5 or ≤4, more preferably ≤3.5 or ≤3, even more preferably ≤2.5 or ≤2, and most preferably ≤1.5 or ≤1. The plasma stability of an antibody construct can be tested by incubation of the construct in human plasma at 37° C. for 24 hours followed by EC50 determination in a 51 chromium release cytotoxicity assay. The effector cells in the cytotoxicity assay can be stimulated enriched human CD8 positive T cells. Target cells can e.g. be cells transfected with human MAGEB2. The effector to target cell (E:T) ratio can be chosen as 10:1 or 5:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control).

It is furthermore preferred that the monomer to dimer conversion of antibody constructs of the invention is low. The conversion can be measured under different conditions and analyzed by high performance size exclusion chromatography. For example, incubation of the monomeric isoforms of the antibody constructs can be carried out for 7 days at 37° C. and concentrations of e.g. 100 μg/ml or 250 μg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤1.5%, and most preferably ≤1% or ≤0.5% or even 0%.

It is also preferred that the bispecific antibody constructs of the present invention present with very low dimer conversion after a number of freeze/thaw cycles. For example, the antibody construct monomer is adjusted to a concentration of 250 µg/ml e.g. in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤1.5%, and most preferably ≤1% or even ≤0.5%, for example after three freeze/thaw cycles.

The bispecific antibody constructs of the present invention preferably show a favorable thermostability with aggregation temperatures ≥45° C. or ≥50° C., more preferably ≥52° C. or ≥54° C., even more preferably ≥56° C. or ≥57° C., and most preferably ≥58° C. or ≥59° C. The thermostability parameter can be determined in terms of antibody aggregation temperature as follows: Antibody solution at a concentration 250 µg/ml is transferred into a single use cuvette and placed in a Dynamic Light Scattering (DLS) device. The sample is heated from 40° C. to 70° C. at a heating rate of 0.5° C./min with constant acquisition of the measured radius. Increase of radius indicating melting of the protein and aggregation is used to calculate the aggregation temperature of the antibody.

Alternatively, temperature melting curves can be determined by Differential Scanning calorimetry (DSC) to determine intrinsic biophysical protein stabilities of the antibody constructs. These experiments are performed using a MicroCal LLC (Northampton, MA, U.S.A) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

The pMAGE-HLA xCD3 bispecific antibody constructs of the invention are also envisaged to have a turbidity (as measured by OD340 after concentration of purified monomeric antibody construct to 2.5 mg/ml and overnight incubation) of ≤0.2, preferably of ≤0.15, more preferably of ≤0.12, even more preferably of ≤0.1, and most preferably of ≤0.08.

In a further embodiment the antibody construct according to the invention is stable at physiologic or slightly lower pH, i.e. about pH 7.4 to 6.0. The more tolerant the antibody construct behaves at unphysiologic pH such as about pH 6.0, the higher is the recovery of the antibody construct eluted from an ion exchange column relative to the total amount of loaded protein. Recovery of the antibody construct from an ion (e.g., cation) exchange column at about pH 6.0 is preferably ≥30%, more preferably ≥40%, more preferably ≥50%, even more preferably ≥60%, even more preferably ≥70%, even more preferably ≥80%, even more preferably ≥90%, even more preferably ≥95%, and most preferably ≥99%.

In a further embodiment, the antibody construct according to the invention is stable at acidic pH. The more tolerant the antibody construct behaves at unphysiologic pH such as pH 5.5 (a pH which is required to run e.g. a cation exchange chromatography), the higher is the recovery of the antibody construct eluted from an ion exchange column relative to the total amount of loaded protein. Recovery of the antibody construct from an ion (e.g., cation) exchange column at pH 5.5 is preferably ≥30%, more preferably ≥40%, more preferably ≥50%, even more preferably ≥60%, even more preferably ≥70%, even more preferably ≥80%, and most preferably ≥95%. The percentage represents the area under the curve (=AUC) of the main peak.

Changes in the potency of a target x CD3 antibody construct as a function of preincubation of the construct on the target cells in the absence of T cells can be measured. If an antibody construct is internalized, it is expected to undergo lysosomal degradation. The effective concentration is hence expected to decrease over time, and thus the apparent potency should decrease as well. The effect has been observed with some targets, for which this is a known phenomenon. Antibody constructs of the invention are envisaged to not be internalized or to not undergo significant internalization by the target cell. The rate of internalization can be assayed e.g. as described in the following: T cells are counted and diluted to a concentration of 1×105/ml in assay media. Target positive target cells are counted and plated e.g. at 2500 cells per well (cpw). The antibody construct is diluted serially 1:2, e.g. at a starting concentration of 100 nM. The antibody construct is added to the culture assay plates to allow for 0 hours, 1 hour or 2 hours of incubation prior to addition of the T cells. Then the T cells are plated at 25000 cpw (E:T=10:1), and the assay is incubated for 48 hours at 37° C. Target cell survival is analyzed e.g. with the Steady-Glo® system (25 µl/well). Preferably, the internalization rate (e.g. measured as a decrease in cytotoxicity) is 20% after a 2-hour (pre-)incubation of the antibody construct with the target cell, more preferably ≤15%, even more preferably ≤10%, and most preferably ≤5%.

It is furthermore envisaged for an antibody construct of the invention that shed or soluble target does not significantly impair its efficacy or biologic activity. This can be measured e.g. in a cytotoxicity assay where soluble target is added at increasing concentrations to the assay, e.g. at 0 nM-0.3 nM-0.7 nM-1 nM-3 nM-7 nM-12 nM. An exemplary E:T value is 10:1. The EC50 value of the tested antibody construct should not be significantly increased in the presence of soluble target.

It is furthermore envisaged that the antibody constructs of the present invention exhibit therapeutic efficacy, which manifests as anti-tumor activity or tumor growth inhibition. This can, e.g., be assessed in a study as disclosed in Example 10. In one embodiment, the tumor growth inhibition of the antibody construct of the invention T/C [%] is ≤70, ≤60, ≤50, ≤40, ≤30, ≤20, ≤10, ≤5, ≤4, ≤3, or ≤2. Modification or adjustment of certain parameters of these studies (such as the number of injected tumor cells, the site of injection, the number of transplanted human T cells, the amount of antibody constructs to be administered, and the timelines) is also envisaged, while still arriving at a meaningful and reproducible result.

Covalent Modifications of Constructs

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form 0-acetyl tyrosyl species and 3-nitro derivatives, respectively. Tyrosyl residues are iodinated using 125I or 131I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed herein.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:
  a) isotopic labels, which may be radioactive or heavy isotopes, such as radioisotopes or radionuclides (e.g., $^3H$, $^{14}C$, $^{15}N$, $^{35}S$, $^{89}Zr$, $^{90}Y$, $^{99}Tc$, $^{111}In$, $^{125}I$, $^{131}I$)
  b) magnetic labels (e.g., magnetic particles)
  c) redox active moieties
  d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluors or proteinaceous fluors
  e) enzymatic groups (e.g. horseradish peroxidase, β-galactosidase, luciferase, alkaline phosphatase)
  f) biotinylated groups
  g) predetermined polypeptide epitopes recognized by a secondary reporter (e.g., leucine zipper pair sequences, binding sides for secondary antibodies, metal binding domains, epitope tags, etc.)

Leucine zipper domains are peptides that promote oligomerization of the proteins in which they are found. Leucine zippers were originally identified in several DNA-binding proteins (Landschulz et al., 1988, Science 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191. The use of a modified leucine zipper that allows for stable trimerization of a heterologous protein fused thereto is described in Fanslow et al., 1994, Semin. Immunol. 6:267-78.

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs may comprise a His-tag domain, which is generally known as a repeat of consecutive His residues in the amino acid sequence of a molecule, preferably of five, and more preferably of six His residues (hexa-histidine) (SEQ ID NO: 18451). The His-tag may be located e.g. at the N- or C-terminus of the antibody construct, preferably it is located at the C-terminus. Most preferably, a hexa-histidine tag (HHHHHH) (SEQ ID NO: 30) is linked via peptide bond to the C-terminus of the antibody construct according to the invention. Additionally, a conjugate system of PLGA-PEG-PLGA may be combined with a poly-histidine tag for sustained release application and improved pharmacokinetic profile.

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus*, or *Aequorea* species of GFP (Chalfie et al., 1994, Science 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, Biotechniques 24:462-471; Heim et al., 1996, Curr. Biol. 6:178-182), enhanced yellow fluorescent protein (EYFP, Clontech Laboratories, Inc.), luciferase (Ichiki et al., 1993, J. Immunol. 150:5408-5417), β galactosidase (Nolan et al., 1988, Proc. Natl. Acad. Sci. U.S.A. 85:2603-2607) and Renilla (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

Pharmaceutical Formulations

Moreover, the invention provides a pharmaceutical composition or formulation comprising an antibody construct of the invention or an antibody construct produced according to the process of the invention.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention for a wide variety of purposes, such as adjusting physical, chemical, or biological properties of formulations, such as adjustment of viscosity, and or processes of the invention to improve effectiveness and/or to stabilize such formulations and processes against degradation and spoilage e.g. due to stresses that occur during manufacturing, shipping, storage, pre-use preparation, administration, and thereafter. Excipients should in general be used in their lowest effective concentrations.

In certain embodiments, the pharmaceutical composition may contain formulation materials for the purpose of modifying, maintaining or preserving certain characteristics of the composition such as the pH, osmolarity, viscosity, clarity, color, isotonicity, odor, sterility, stability, rate of dissolution or release, adsorption or penetration (see, Remington's Pharmaceutical Sciences, 18" Edition, 1990, Mack Publishing Company). In such embodiments, suitable formulation materials may include, but are not limited to, e.g., amino acids, antimicrobials such as antibacterial and antifungal agents, antioxidants, buffers, buffer systems and buffering agents which are used to maintain the composition at physiological pH or at a slightly lower pH, typically within a pH range of from about 5 to about 8 or 9, non-aqueous solvents, vegetable oils, and injectable organic esters, aqueous carriers including water, alcoholic/aqueous solutions, emulsions or suspensions, including saline and buffered media, biodegradable polymers such as polyesters, bulking agents, chelating agents, isotonic and absorption delaying agents, complexing agents, fillers, carbohydrates, (low molecular weight) proteins, polypeptides or proteinaceous carriers, preferably of human origin, coloring and flavouring agents, sulfur containing reducing agents, diluting agents, emulsifying agents, hydrophilic polymers, salt-forming counter-ions, preservatives, metal complexes, solvents and co-solvents, sugars and sugar alcohols, suspending agents, surfactants or wetting agents, stability enhancing agents, tonicity enhancing agents, parenteral delivery vehicles, or intravenous delivery vehicles.

Different constituents of the pharmaceutical composition can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

In the context of the present invention, a pharmaceutical composition may comprise: (a) an antibody construct as described herein, (b) at least one buffer agent, (c) at least one saccharide, and (d) at least one surfactant; wherein the pH of the pharmaceutical composition is in the range of 3.5 to 6.

In the composition described above, the first domain preferably has an isoelectric point (pI) in the range of 4 to 9.5; the second domain has a pI in the range of 8 to 10, preferably 8.5 to 9.0; and the antibody construct optionally comprises a third domain comprising two polypeptide monomers, each comprising a hinge, a CH2 domain and a CH3 domain, wherein said two polypeptide monomers are fused to each other via a peptide linker;

In the composition described above, it is further envisaged that the at least one buffer agent is present at a concentration range of 5 to 200 mM, more preferably at a concentration range of 10 to 50 mM. It is also envisaged that the at least one saccharide is selected from the group consisting of monosaccharide, disaccharide, cyclic polysaccharide, sugar alcohol, linear branched dextran or linear non-branched dextran. It is also envisaged that the disaccharide is selected from the group consisting of sucrose, trehalose and mannitol, sorbitol, and combinations thereof. It is further envisaged that the sugar alcohol is sorbitol. It is also envisaged that the at least one saccharide is present at a concentration in the range of 1 to 15% (m/V), preferably in a concentration range of 9 to 12% (m/V). It is further envisaged that the antibody construct is present in a concentration range of 0.1 to 8 mg/ml, preferably of 0.2-2.5 mg/ml, more preferably of 0.25-1.0 mg/ml.

According to one embodiment of the composition described above, the at least one surfactant is selected from the group consisting of polysorbate 20, polysorbate 40, polysorbate 60, polysorbate 80, poloxamer 188, pluronic F68, triton X-100, polyoxyethylen, PEG 3350, PEG 4000 and combinations thereof. It is further envisaged that the at least one surfactant is present at a concentration in the range of 0.004 to 0.5% (m/V), preferably in the range of 0.001 to 0.01% (m/V). It is envisaged that the pH of the composition is in the range of 4.0 to 5.0, preferably 4.2. It is also envisaged that the pharmaceutical composition has an osmolarity in the range of 150 to 500 mOsm. It is further envisaged that the pharmaceutical composition further comprises an excipient selected from the group consisting of one or more polyol(s) and one or more amino acid(s). It is envisaged in the context of the present invention that said one or more excipient is present in the concentration range of 0.1 to 15% (w/V).

The present invention also provides a pharmaceutical composition comprising
(a) the antibody construct as described herein, preferably in a concentration range of 0.1 to 8 mg/ml, preferably of 0.2-2.5 mg/ml, more preferably of 0.25-1.0 mg/ml;
(b) 10 mM glutamate or acetate;

(c) 9% (m/V) sucrose or 6% (m/V) sucrose and 6% (m/V) hydroxypropyl-β-cyclodextrin;
(d) 0.01% (m/V) polysorbate 80;
wherein the pH of the liquid pharmaceutical composition is 4.2.

It is envisaged that the composition of the invention might comprise, in addition to the antibody construct of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions, drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In this context, it is envisaged that the pharmaceutical composition of the invention (which comprises an antibody construct comprising a first domain which binds to the pMAGE-HLA on the surface of a target cell and a second domain which binds to CD3 on the surface of a T cell, as described in more detail herein above) furthermore comprises an agent, preferably an antibody or antibody construct, which binds to a protein of the immune checkpoint pathway (such as PD-1 or CTLA-4) or to a co-stimulatory immune checkpoint receptor (such as 4-1BB). The present invention also refers to a combination of an antibody construct according to the invention (which comprises an antibody construct comprising a first domain which binds to the pMAGE-HLA on the surface of a target cell and a second domain which binds to CD3 on the surface of a T cell, as described in more detail herein above) and an agent, preferably an antibody or antibody construct, which binds to a protein of the immune checkpoint pathway (such as PD-1 or CTLA-4) or to a co-stimulatory immune checkpoint receptor (such as 4-1BB). Due to the nature of the at least two ingredients of the combination, namely their pharmaceutical activity, the combination can also be referred to as a therapeutic combination. In some embodiments, the combination can be in the form of a pharmaceutical composition or of a kit. According to one embodiment, the pharmaceutical composition or the combination comprises an antibody construct of the invention and an antibody or antibody construct which binds to PD-1. Anti-PD-1 binding proteins useful for this purpose are e.g. described in detail in PCT/US2019/013205.

In certain embodiments, the optimal pharmaceutical composition is determined depending upon, for example, the intended route of administration, delivery format and desired dosage. See, for example, Remington's Pharmaceutical Sciences, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection or physiological saline solution, possibly supplemented with other materials common in compositions for parenteral administration. In certain embodiments, the compositions comprising the antibody construct of the invention may be prepared for storage by mixing the selected composition having the desired degree of purity with optional formulation agents (Remington's Pharmaceutical Sciences, supra) in the form of a lyophilized cake or an aqueous solution. Further, in certain embodiments, the antibody construct of the invention may be formulated as a lyophilizate using appropriate excipients.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent that may provide controlled or sustained release of the product which can be delivered via depot injection, or that may promote sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained or controlled delivery formulations. Techniques for formulating a variety of sustained- or controlled-delivery means are known to those skilled in the art. The antibody construct may also be entrapped in microcapsules prepared, for example, by coacervation techniques or by interfacial polymerization, in colloidal drug delivery systems, or in macroemulsions. Such techniques are disclosed in Remington's Pharmaceutical Sciences, supra.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions are generally placed into a container having a sterile access port, for example, an intravenous solution bag or vial having a stopper pierceable by a hypodermic injection needle.

Another aspect of the invention includes self-buffering formulations comprising the antibody construct of the invention, which can be used as pharmaceutical compositions, as described in international patent application WO 2006/138181. A variety of publications are available on protein stabilization and formulation materials and methods useful in this regard, such as Arawaka T. et al., Pharm Res. 1991 March; 8(3):285-91; Kendrick et al., "Physical stabilization of proteins in aqueous solution" in: Rational Design of Stable Protein Formulations: Theory and Practice, Carpenter and Manning, eds. Pharmaceutical Biotechnology. 13: 61-84 (2002), and Randolph and Jones, Pharm Biotechnol. 2002; 13:159-75, see particularly the parts pertinent to excipients and processes for self-buffering protein formulations, especially as to protein pharmaceutical products and processes for veterinary and/or human medical uses.

Salts may be used in accordance with certain embodiments of the invention, e.g. in order to adjust the ionic strength and/or the isotonicity of a composition or formulation and/or to improve the solubility and/or physical stability of an antibody construct or other ingredient of a composition in accordance with the invention. Ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes are commonly used at high concentrations to precipitate proteins from solution ("salting-out"). Chaotropes are commonly used to denature and/or to solubilize proteins ("salting-in"). The relative effectiveness of ions to "salt-in" and "salt-out" defines their position in the Hofmeister series.

Free amino acids can be used in formulations or compositions comprising the antibody construct of the invention in accordance with various embodiments of the invention as bulking agents, stabilizers, and antioxidants, as well as for other standard uses. Certain amino acids can be used for stabilizing proteins in a formulation, others are useful during lyophilization to ensure correct cake structure and properties of the active ingredient. Some amino acids may be useful to inhibit protein aggregation in both liquid and lyophilized formulations, and others are useful as antioxidants.

Polyols are kosmotropic and are useful as stabilizing agents in both liquid and lyophilized formulations to protect proteins from physical and chemical degradation processes. Polyols are also useful for adjusting the tonicity of formulations and for protecting against freeze-thaw stresses during transport or the preparation of bulks during the manufacturing process. Polyols can also serve as cryoprotectants in the context of the present invention.

Certain embodiments of the formulation or composition comprising the antibody construct of the invention can comprise surfactants. Proteins may be susceptible to adsorption on surfaces and to denaturation and resulting aggregation at air-liquid, solid-liquid, and liquid-liquid interfaces. These deleterious interactions generally scale inversely with protein concentration and are typically exacerbated by physical agitation, such as that generated during the shipping and handling of a product. Surfactants are routinely used to prevent, minimize, or reduce surface adsorption. Surfactants also are commonly used to control protein conformational stability. The use of surfactants in this regard is protein specific, since one specific surfactant will typically stabilize some proteins and destabilize others.

Certain embodiments of the formulation or composition comprising the antibody construct of the invention can comprise one or more antioxidants. To some extent deleterious oxidation of proteins can be prevented in pharmaceutical formulations by maintaining proper levels of ambient oxygen and temperature and by avoiding exposure to light. Antioxidant excipients can also be used to prevent oxidative degradation of proteins. It is envisaged that antioxidants for use in therapeutic protein formulations in accordance with the present invention can be water-soluble and maintain their activity throughout the shelf life of the product (the composition comprising the antibody construct). Antioxidants can also damage proteins and should hence—among other things—be selected in a way to eliminate or sufficiently reduce the possibility of antioxidants damaging the antibody construct or other proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. Ca+2 ions (up to 100 mM) can increase the stability of human deoxyribonuclease. Mg+2, Mn+2, and Zn+2, however, can destabilize rhDNase. Similarly, Ca+2 and Sr+2 can stabilize Factor VIII, it can be destabilized by Mg+2, Mn+2 and Zn+2, Cu+2 and Fe+2, and its aggregation can be increased by Al+3 ions.

Certain embodiments of the formulation or composition comprising the antibody construct of the invention can comprise one or more preservatives. Preservatives are necessary for example when developing multi-dose parenteral formulations that involve more than one extraction from the same container. Their primary function is to inhibit microbial growth and ensure product sterility throughout the shelf-life or term of use of the drug product. Although preservatives have a long history of use with small-molecule parenterals, the development of protein formulations that include preservatives can be challenging. Preservatives very often have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time during which a preservative is in contact with the antibody construct, significantly minimizing the associated stability risks. With liquid formulations, preservative effectiveness and stability should be maintained over the entire product shelf-life. An important point to note is that preservative effectiveness should be demonstrated in the final formulation containing the active drug and all excipient components. Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration. Formulations and compositions thus may be designed in accordance with the invention for delivery by any suitable route of administration. In the context of the present invention, the routes of administration include, but are not limited to topical routes, enteral routes and parenteral routes.

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447,233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization. The pharmaceutical compositions and the antibody construct of this invention are particularly useful for parenteral administration, e.g., intravenous delivery, for example by injection or infusion. Pharmaceutical compositions may be administered using a medical device. Examples of medical devices for administering pharmaceutical compositions are described in U.S. Pat. Nos. 4,475,196; 4,439, 196; 4,447,224; 4,447, 233; 4,486,194; 4,487,603; 4,596, 556; 4,790,824; 4,941,880; 5,064,413; 5,312,335; 5,312, 335; 5,383,851; and 5,399,163.

In an embodiment, a pharmaceutical composition comprising a binding domain or antibody construct, e.g. a bispecific antibody, described herein specifically targeting pMAGE-HLA derived from MAGEB2 and/or a modified T cell, e.g. a CAR-T cell, expressing a binding domain or antibody construct, e.g. a bispecific antibody, may be administered to a subject in need thereof in order to increase a cellular immune response. The immune response may include, for example, cellular immune responses mediated by cytotoxic T cells capable of killing cancer cells, regulatory T cells, and helper T cell responses. Humoral immune responses, mediated primarily by helper T cells capable of activating B cells thus leading to antibody production, may also be induced. A variety of techniques may be used for analyzing the type of immune responses induced by the compositions, which are described in the literature for example, in Current Protocols in Immunology, Edited by: John E. Coligan, Ada M. Kruisbeek, David H. Margulies, Ethan M. Shevach, Warren Strober (2001) John Wiley & Sons, NY, N.Y, the content of which is herein incorporated by reference in its entirety.

Human Leukocyte Antigen (HLA) System

The human leukocyte antigen system (HLA) is the human version of the gene complex which encodes the major histocompatibility complex (MHC). Those of ordinary skill in the art will recognize that the terms "major histocompatibility complex (MHC)", "MHC molecules", "MHC proteins" and "human leukocyte antigen (HLA) system", "HLA molecules", "HLA proteins" are used interchangeably herein.

HLA proteins are classified into two types, referred to as HLA class I (corresponding to MHC class I) and HLA class II (corresponding to MHC class II), and includes the three main HLA class I molecules (A, B & C) and also the three main HLA class II molecules (DP, DQ, & DR).

The structures of the proteins of the two HLA classes are very similar; however, they have very different functions. Class I HLA proteins are present on the surface of almost all cells of the body, including most tumor cells. Class I HLA proteins have bound, or "loaded", peptide antigens that usually originate from endogenous proteins or from pathogens present inside cells. These proteins are processed by the cell into peptides which bind the Class I HLA, and are then presented on the cell surface to immune cells, such as cytotoxic T-lymphocytes (CTLs). This can also be referred to as the peptide-HLA complex, or more specifically, the MAGEB2 peptide-HLA complex, or pMAGE-HLA, or peptide-MHC, or simply pMHC.

HLA class II proteins are present on antigen presenting cells (APCs), including but not limited to dendritic cells, B cells, and macrophages. They typically present peptides, which are derived from external antigen sources, i.e. outside of the cells, that have been internalized and processed into peptides. The HLA class II with peptide bound to it is then presented to immune cells such as helper T cells. Most of the peptides bound by the HLA class I proteins originate from cytoplasmic proteins produced in the healthy host cells of an organism itself, and do not normally stimulate an immune reaction.

Of particular relevance to the present invention, HLA class I alleles A, B, and C present peptides (e.g., the MAGEB2 peptide of SEQ ID NO: 1) derived from proteins expressed within the cell, such as the MAGEB2 protein. See, Janeway C A Jr, Travers P, Walport M, et al. Immunobiology: The Immune System in Health and Disease. 5th edition. New York: Garland Science; 2001. The major histocompatibility complex and its functions. See also, Tissue Antigens. 2013 April; 81(4): 194-203, and Human Immunology, Volume 68, Issue 5, May 2007, Pages 392-417.

Class I HLA molecules consist of a heavy chain and a light chain and are capable of binding a peptide of about 7 to 13 amino acids, if this peptide has suitable binding motifs, and presenting it to cytotoxic T-lymphocytes. The peptides bound by class I HLA molecules originate from an endogenous protein antigen. The heavy chain of the HLA molecules of class I can be an HLA-A, HLA-B or HLA-C monomer, and the light chain is β-2-microglobulin. Class I HLA occurs as an α chain composed of three domains—α1, α2, and α3. This chain is often referred to as the class I heavy chain, and is referred to herein as the class I alpha-chain. The α1 rests upon a unit of the non-HLA molecule β2 microglobulin (encoded on human chromosome 15). The α3 domain is transmembrane, anchoring the HLA class I molecule to the cell membrane. The peptide being presented is held by the floor of the peptide-binding groove, in the central region of the α1/α2 heterodimer (a molecule composed of two nonidentical subunits). Class I HLA-A, HLA-B or HLA-C are highly polymorphic.

There is a known geographic distribution of the different HLA alleles. For example, one HLA allele of particular interest, HLA-A*02:01, is widely expressed throughout North America, Europe and Australia. Peptides presented by, for example, the HLA-A*02:01 can be referred to as being "HLA-A*02:01 restricted". Other HLA-A alleles of particular interest include HLA-A*02:02, HLA-A*02:05, HLA-A*02:06, and HLA-A*02:07.

In one embodiment, the invention provides a binding domain that binds to a MAGEB2 peptide (SEQ ID NO: 1) complexed with a class I HLA, wherein the HLA is an HLA-A. In a further embodiment, the invention provides a binding domain that binds to a MAGEB2 peptide (SEQ ID NO: 1) complexed with a class I HLA, wherein the HLA is an HLA-A*02. In a specific embodiment, the invention provides a binding domain that binds to a MAGEB2 peptide (SEQ ID NO: 1) complexed with a class I HLA, wherein the HLA is an HLA-A*02:01. In a specific embodiment, the invention provides a binding domain that binds to a MAGEB2 peptide (SEQ ID NO: 1) complexed with a class I HLA, wherein the HLA is an HLA-A*02:05. In a specific embodiment, the invention provides a binding domain that binds to a MAGEB2 peptide (SEQ ID NO: 1) complexed with a class I HLA, wherein the HLA is an HLA-A*02:06. In a specific embodiment, the invention provides a binding domain that binds to a MAGEB2 peptide (SEQ ID NO: 1) complexed with a class I HLA, wherein the HLA is an HLA-A*02:07.

Other HLA-A alleles of interest are HLA-A*01:01, HLA-A*24:02, HLA-A*11:01, HLA-A*03:01, HLA-A*02:03, HLA-A*02:04, HLA-A*29:02, HLA-A*31:01, HLA-A*68:02, HLA-A*68:01, HLA-A*26:01, HLA-A*74:01, and HLA-A*32:01, and accordingly it is envisaged that the binding domains of the invention bind to one of these aforementioned HLA-A alleles complexed with the MAGEB2 peptide (SEQ ID NO: 1).

Widely expressed HLA-B alleles of interest are HLA-B*35:01, HLA-B*07:02 and HLA-B*35:02. Other HLA-B alleles of interest are HLA-B*35:01, HLA-B*44:02, HLA-B*44:03, HLA-B*51:01, HLA-B*54:01, HLA-B*57:01.

HLA-C alleles of interest are HLA-C*01:02, HLA-C*03:02, HLA-C*03:04, HLA-C*04:01, HLA-C*05:01, HLA-C*06:02, HLA-C*07:02, HLA-C*08:01, HLA-C*08:02, HLA-C*12:02, HLA-C*14:02, HLA-C*14:03, HLA-C*15:02, and HLA-C*16:01.

Cytotoxicity Assays

The Examples herein provide exemplary cytotoxicity assays and results for the various binding constructs of the invention. However, cytotoxicity mediated by the constructs of the invention can be measured in various other ways. Effector cells can be e.g. stimulated enriched (human) CD8 positive T cells or unstimulated (human) peripheral blood mononuclear cells (PBMC). The target cells should express MAGEB2, e.g. human MAGEB2, and present pMAGE-HLA on their surface, or have the desired MAGEB2 peptide exogenously loaded onto the MHC. Target cells can be an HLA (e.g., HLA-A*02:01) positive cell line which is stably or transiently transfected with MAGEB2, e.g. human MAGEB2, or alternatively an HLA positive cell line that endogenously expresses sufficient levels of MAGEB2, or an HLA positive cell line that is exogenously loaded with the MAGEB2 peptide. Usually EC50 values are expected to be lower with target cell lines expressing higher levels of the MAGEB2 peptide-HLA complex on the cell surface. The effector to target cell (E:T) ratio is usually about 10:1, but can also vary. Cytotoxic activity of bispecific antibody constructs can be measured in a 51Cr-release assay (incubation time of about 18 hours), a luciferase readout, in a in a FACS-based cytotoxicity assay (incubation time of about 48 hours), or other assay techniques known to one skilled in the art. Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

As discussed herein above with regard to affinity and potency, the cytotoxic activity mediated by pMAGE-HLAxCD3 bispecific antibody constructs of the present invention can be measured in a cell-based cytotoxicity assay, such as the TDCC assay described herein in the Examples. This activity is represented by the EC50 value, which corresponds to the half maximal effective concentration (concentration of the antibody construct which induces a cytotoxic response halfway between the baseline and maximum). Preferably, the EC50 value of the MAGEB2×CD3 bispecific antibody constructs is ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤10 pM, and most preferably ≤5 pM or lower.

The above given EC50 values can be measured in different assays. The skilled person is aware that an EC50 value can be expected to be lower when stimulated/enriched CD8+ T cells are used as effector cells, compared with unstimulated PBMC. It can furthermore be expected that the EC50 values are lower when the target cells express a high number of pMAGE-HLA compared with a low target expression. For example, when stimulated/enriched human CD8+ T cells are used as effector cells (and either MAGEB2 transfected cells, MAGEB2 peptide loaded cells, or MAGEB2 positive human cell lines are used as target cells), the EC50 value of the pMAGE-HLAxCD3 bispecific antibody construct is preferably ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤10 pM, and most preferably pM or lower. When human PBMCs are used as effector cells, the EC50 value of the pMAGE-HLAxCD3 bispecific antibody construct is preferably ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤10 pM, and most preferably ≤5 pM or lower.

Preferably, the pMAGE-HLAxCD3 bispecific antibody constructs of the present invention do not induce and/or mediate lysis or do not essentially induce and/or mediate lysis of MAGEB2 negative cells at particular desired concentrations of molecule. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6%, 5%, 4%, 3%, 2%, 1% or less of MAGEB2 negative cells, whereby lysis of a MAGEB2 positive human cell line that has on its surface the pMAGE-HLA (e.g., the MAGEB2 peptide of SEQ ID NO:1 complexed with an HLA-A*02:01) is set to be 100%. This usually applies for concentrations of the antibody construct of up to 500 nM. The skilled person can readily measure cell lysis using known techniques and the guidance provided herein.

Activity Assays for Patients

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of formulation of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to, white blood cell counts, differentials, fluorescence activated cell sorting, bone marrow aspiration. In addition, various disease specific clinical chemistry parameters and other established standard methods may be used. Furthermore, computer-aided tomography, X-ray, nuclear magnetic resonance tomography, positron-emission tomography scanning, lymph node biopsies/histologies and other established standard methods may be used.

Pharmacokinetics

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" is the time required for a quantity to reduce to half its initial value. The medical sciences refer to the half-life of substances or drugs in the human body. In a medical context, half-life may refer to the time it takes for a substance/drug to lose one-half of its activity, e.g. pharmacologic, physiologic, or radiological activity. The half-life may also describe the time that it takes for the concentration of a drug or substance (e.g., an antibody construct of the invention) in blood plasma/serum to reach one-half of its steady-state value ("serum half-life"). Typically, the elimination or removal of an administered substance/drug refers to the body's cleansing through biological processes such as metabolism, excretion, also involving the function of kidneys and liver. The "first-pass metabolism" is a phenomenon of drug metabolism whereby the concentration of a drug is reduced before it reaches the circulation. It is the fraction of drug lost during the process of absorption. Accordingly, by "hepatic first-pass metabolism" is meant the propensity of a drug to be metabolized upon first contact with the liver, i.e. during its first pass through the liver. "Volume of distribution" (VD) means the degree to which a drug is distributed in body tissue rather than the blood plasma, a higher VD indicating a greater amount of tissue distribution. The retention of a drug can occur throughout the various compartments of the body, such as intracellular and extracellular spaces, tissues and organs, etc. "Degree of blood serum binding" means the propensity of a drug to interact with and bind to blood serum proteins, such as albumin, leading to a reduction or loss of biological activity of the drug.

Pharmacokinetic parameters also include bioavailability, lag time (T lag), Tmax, absorption rates, and/or Cmax for a given amount of drug administered. "Bioavailability" refers to the fraction of an administered dose of a drug/substance that reaches the systemic circulation (the blood compartment). When a medication is administered intravenously, its bioavailability is considered to be 100%. However, when a medication is administered via other routes (such as orally), its bioavailability generally decreases. "Lag time" means the time delay between the administration of the drug and its detection and measurability in blood or plasma. Cmax is the maximum plasma concentration that a drug achieves after its administration (and before the administration of a second dose). Tmax is the time at which Cmax is reached. The time to reach a blood or tissue concentration of the drug which is required for its biological effect is influenced by all parameters. Pharmacokinetic parameters of antibody constructs exhibiting cross-species specificity may be determined in preclinical animal testing in non-chimpanzee primates as outlined above and set forth e.g. in Schlereth et al. (supra).

Treatment Methods

One embodiment provides the antibody construct of the invention (or the antibody construct produced according to the process of the invention) for use in the prevention, treatment or amelioration of a disease, preferably a neoplasm. Another embodiment provides the use of the antibody construct of the invention (or of the antibody construct produced according to the process of the invention) in the manufacture of a medicament for the prevention, treatment or amelioration of a disease, preferably a neoplasm. It is also envisaged to provide a method for the prevention, treatment or amelioration of a disease, preferably a neoplasm, comprising the step of administering to a subject in need thereof the antibody construct of the present invention (or the antibody construct produced according to the process of the present invention).

The terms "subject in need", "patient" or those "in need of treatment" include those already with the disease, as well as those in which the disease is to be prevented. The terms also include human and other mammalian subjects that receive either prophylactic or therapeutic treatment.

The antibody constructs of the invention and the formulations/pharmaceutical compositions described herein are useful in the treatment, amelioration and/or prevention of the medical condition as described herein in a patient in need thereof. The term "treatment" refers to both therapeutic treatment and prophylactic or preventative measures. Treatment includes the application or administration of the antibody constructs/pharmaceutical composition to the body, to an isolated tissue, or to a cell from a patient or a subject in need who has a disease/disorder as described herein, a symptom of such disease/disorder, or a predisposition toward such disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient, by the administration of an antibody construct according to the invention to such patient or subject in need thereof. Such an improvement may be seen as a slowing or stopping of the progression of the disease of the patient, and/or as a decrease in severity of disease symptoms, an increase in frequency or duration of disease symptom-free periods or a prevention of impairment or disability due to the disease.

The term "prevention" as used herein means the avoidance of the occurrence or of the re-occurrence of a disease as specified herein, by the administration of an antibody construct according to the invention to a subject in need thereof.

The term "disease" refers to any condition that would benefit from treatment with the antibody construct or the pharmaceutical composition described herein. This includes chronic and acute disorders or diseases including those pathological conditions that predispose the mammal to the disease in question. The disease is preferably a neoplasm, cancer or tumor. The disease, neoplasm, cancer or tumor is preferably MAGEB2 positive, i.e. it is characterized by expression or overexpression of MAGEB2.

A "neoplasm" is an abnormal growth of tissue, usually but not always forming a mass. When also forming a mass, it is commonly referred to as a "tumor". In brain tumors, the uncontrolled division of cells means that the mass of a neoplasm increases in size, and in a confined space such as the intracranial cavity this quickly becomes problematic because the mass invades the space of the brain pushing it aside, leading to compression of the brain tissue and increased intracranial pressure and destruction of brain parenchyma. Neoplasms or tumors can be benign, potentially malignant (pre-cancerous), or malignant (cancerous). Malignant neoplasms/tumors are commonly called cancer. They usually invade and destroy the surrounding tissue and may form metastases, i.e., they spread to other parts, tissues or organs of the body. A "primary tumor" is a tumor growing at the anatomical site where tumor progression began and proceeded to yield a cancerous mass. For example, a brain tumor occurs when abnormal cells form within the brain. Most cancers develop at their primary site but then go on to metastasize or spread to other parts (e.g. tissues and organs) of the body. These further tumors are "secondary tumors". Most cancers continue to be called after their primary site, even after they have spread to other parts of the body.

Lymphomas and leukemias are lymphoid neoplasms. For the purposes of the present invention, they are also encompassed by the terms "tumor" or "cancer". For the purposes of the present invention, the terms "neoplasm", "tumor" and "cancer" may be used interchangeably, and they comprise both primary tumors/cancers and secondary tumors/cancers (or "metastases"), as well as mass-forming neoplasms (tumors) and lymphoid neoplasms (such as lymphomas and leukemias), and also MRD.

The term "minimal residual disease" (MRD) refers to the evidence for the presence of small numbers of residual cancer cells that remain in the patient after cancer treatment, e.g. when the patient is in remission (no symptoms or signs of disease). A very small number of remaining cancer cells usually cannot be detected by routine means because the standard tests used to assess or detect cancer are not sensitive enough to detect MRD. Nowadays, very sensitive molecular biology tests for MRD are available, such as flow cytometry, PCR and next-generation sequencing. These tests can measure minimal levels of cancer cells in tissue samples, sometimes as low as one cancer cell in a million normal cells. In the context of the present invention, the terms "prevention", "treatment" or "amelioration" of a cancer are envisaged to also encompass "prevention, treatment or amelioration of MRD", whether the MRD was detected or not.

In one embodiment, the neoplasm, cancer or tumor is selected from the group including, but not limited to, gastrointestinal cancer, ovarian cancer and lung cancer. According to one embodiment of the invention, the gastrointestinal cancer is selected from the group consisting of gastric or stomach cancer, esophageal cancer, gastroesophageal cancer, pancreatic cancer, and colorectal cancer. According to another embodiment of the invention, the ovarian cancer is mucinous ovarian cancer. According to a further embodiment of the invention, the lung cancer is non-small cell lung cancer.

In a specific embodiment of the invention, the neoplasm, cancer or tumor is selected from the group including, but not limited to, (or consisting of) non-small cell lung carcinoma (NSCLC), hepatocellular carcinoma (HCC), head and neck carcinoma (HNSCC), colon adenocarcinoma (COAD), rectal adenocarcinoma (READ), and stomach adenocarcinoma (STAD). The non-small cell lung carcinoma can be a squamous cell carcinoma (LUSC) or an adenocarcinoma (LUAD).

The compositions of the present invention can be administered to the subject at a suitable dose which can be determined e.g. in dose escalating studies. As set forth above, the antibody construct of the invention exhibiting cross-species specificity as described herein can also be advantageously used in in preclinical testing in non-chimpanzee primates. The dosage regimen will be determined by the attending physician and clinical factors. As is well known in the medical art, dosages for any one patient depend upon many factors, including the patient's size, body surface area, age, the particular compound to be administered, sex, time and route of administration, general health, and other drugs being administered concurrently.

An "effective dose" is an amount of a therapeutic agent sufficient to achieve or at least partially achieve a desired effect. A "therapeutically effective dose" is an amount sufficient to cure or at least partially arrest the disease and its complications, signs and symptoms in a patient suffering from the disease. Amounts or doses effective for this use will depend on the disease to be treated (the indication), the delivered antibody construct, the therapeutic context and objectives, the severity of the disease, prior therapy, the patient's clinical history and response to the therapeutic agent, the route of administration, the size (body weight, body surface) and/or condition (the age and general health) of the patient, and the general state of the patient's own immune system. The proper dose can be adjusted according to the judgment of the attending physician, in order to obtain the optimal therapeutic effect.

A therapeutically effective amount of an antibody construct of the invention preferably results in a decrease in severity of disease symptoms, an increase in frequency or duration of disease symptom-free periods or a prevention of impairment or disability due to the disease. In the treatment of MAGEB2-expressing tumors, a therapeutically effective amount of the antibody construct of the invention preferably inhibits tumor cell growth by at least about 20%, at least about 40%, at least about 50%, at least about 60%, at least about 70%, at least about 80%, or at least about 90% relative to untreated patients. The ability of a compound to inhibit tumor growth may also be evaluated in an animal model predictive of efficacy in human tumors.

In a further embodiment, the invention provides a kit comprising an antibody construct of the invention, an antibody construct produced according to the process of the invention, a polynucleotide of the invention, a vector of the invention, and/or a host cell of the invention. In the context of the present invention, the term "kit" means two or more components—one of which corresponding to the antibody construct, the pharmaceutical composition, the polynucleotide, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct or the pharmaceutical composition of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct or pharmaceutical composition and a second recipient comprising an aqueous formulation. In certain embodiments of this invention, kits containing single-chambered and multi-chambered pre-filled syringes are provided.

As used herein, the singular forms "a", "an", and "the" include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range. It also includes the concrete value, e.g., "about 50" includes the value "50".

Throughout this specification and the claims, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein, any of the terms "comprising", "consisting essentially of" and "consisting of" may be replaced with either of the other two terms.

It should be understood that the above description and the below examples provide exemplary arrangements, but the present invention is not limited to the particular methodologies, techniques, protocols, material, reagents, substances, etc., described herein and as such can vary. The terminology used herein is for the purpose of describing particular embodiments only, and is not intended to limit the scope of the present invention, which is defined solely by the claims. Aspects of the invention are provided in the independent claims. Some optional features of the invention are provided in the dependent claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

A better understanding of the present invention and of its advantages will be obtained from the following examples, offered for illustrative purposes only. The examples are not intended and should not be construed as to limit the scope of the present invention in any way.

EXAMPLES

Example 1: MAGEB2 mRNA Expression and Immunization

1a: MAGEB2 mRNA Expression

An internal database was searched for MAGEB2 and MAGEA4 in ArrayStudio. Solid Tissue Normal samples were removed. For each gene, visualization of FPKM data across available tumor samples was depicted by selecting View→RNA-Seq Quantification→Gene FPKM. Results are summarized in FIGS. 2A and 2B, for MAGEB2 and MAGEA4, respectively. The box bounds the interquartile range (IQR) with a bold line indicating the median; the whiskers indicate the bounds of 1.5*IQR; the plus sign indicates the mean.

A similar database analysis was performed for MAGEB2 and MAGEA4 mRNA expression in normal tissue. Results are summarized in FIGS. 2C, 2D, and 2E. Numbers in parenthesis indicate sample size.

Example 1b: MAGEB2 Peptide Presentation Analysis by Mass Spectrometry

Qualitative and quantitative peptide presentation data for the MAGEB2 peptide were extracted from the XPRESIDENT database.

HLA-A*02 bound peptides were purified from shock-frozen human normal and tumor tissue samples by immunoaffinity chromatography. Isolated peptides were further separated and identified using nano-electrospray-ionization (nanoESI) liquid chromatography-mass spectrometry (LC-MS). Data processing was performed by combining different algorithms for sequence identification, spectral clustering, ion counting, retention time alignment, charge state deconvolution and normalization. The left panel depicts the combined results of these analyses for a total of 474 normal tissue and 539 tumor tissue samples showing presentation of the MAGEB2 peptide in a strongly tumor-associated manner (see FIG. 2A, left panel). Tumor and normal samples are grouped according to organ of origin. Box-and-whisker plots represent normalized signal intensities over multiple samples and have been defined in the log space. Boxes display median, 25th and 75th percentile. Whiskers extend to the lowest data point still within 1.5 interquartile range (IQR) of the lower quartile, and the highest data point still within 1.5 IQR of the upper quartile. Lower part: The relative peptide detection frequency in every organ is shown as spine plot. Numbers below the panel indicate number of samples on which the peptide was detected out of the total number of samples evaluable for this analysis for each organ (N=474 for normal samples, N=539 for tumor samples). If the peptide has been detected on a sample but could not be quantified for technical reasons, the sample is included in this representation of detection frequency, but no dot is shown in the upper part of the figure. [adipose: adipose tissue; adrenal gl: adrenal gland; bladder: urinary bladder; bloodvess: blood vessel; esoph: esophagus; gall bl: gallbladder; intest. la: large intestine; intest. sm: small intestine; nerve cent: central nerve; nerve perith: peritheral nerve; parathyr: parathyroid gland; perit: peritoneum; pituit: pituitary; skel. mus: skeletal muscle; AML: acute myeloid leukemia; BRCA: breast cancer; CCC: cholangiocellular carcinoma; CLL: chronic lymphocytic leukemia; CRC: colorectal cancer; GBC: gallbladder cancer; GBM: glioblastoma; GC: gastric cancer; GEJC: gastroesophageal junction cancer; HCC: hepatocellular carcinoma; HNSCC: head and neck squamous cell carcinoma; MEL: melanoma; NHL: Non-Hodgkin lymphoma; NSCLCadeno: non-small cell lung cancer adenocarcinoma; NSCLCother: NSCLC samples that could not unambiguously be assigned to NSCLCadeno or NSCLCsquam; NSCLCsquam: squamous cell non-small cell lung cancer; OC: ovarian cancer; OSCAR: esophageal cancer; PACA: pancreatic cancer; PRCA: prostate cancer; RCC: renal cell carcinoma; SCLC: small cell lung cancer; UBC: urinary bladder carcinoma; UEC: uterine and endometrial cancer.]

Figure 2B:
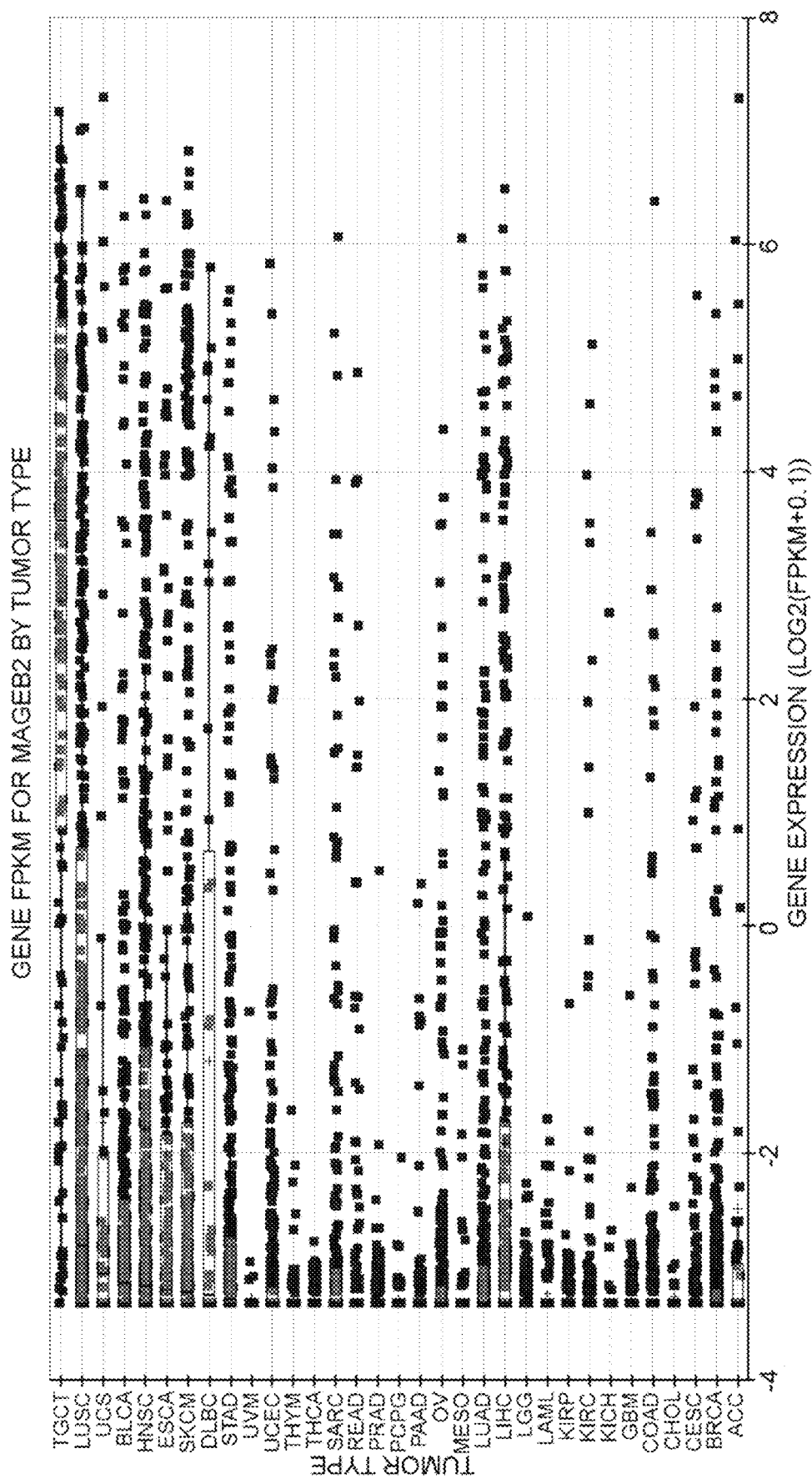
Figure 2C:
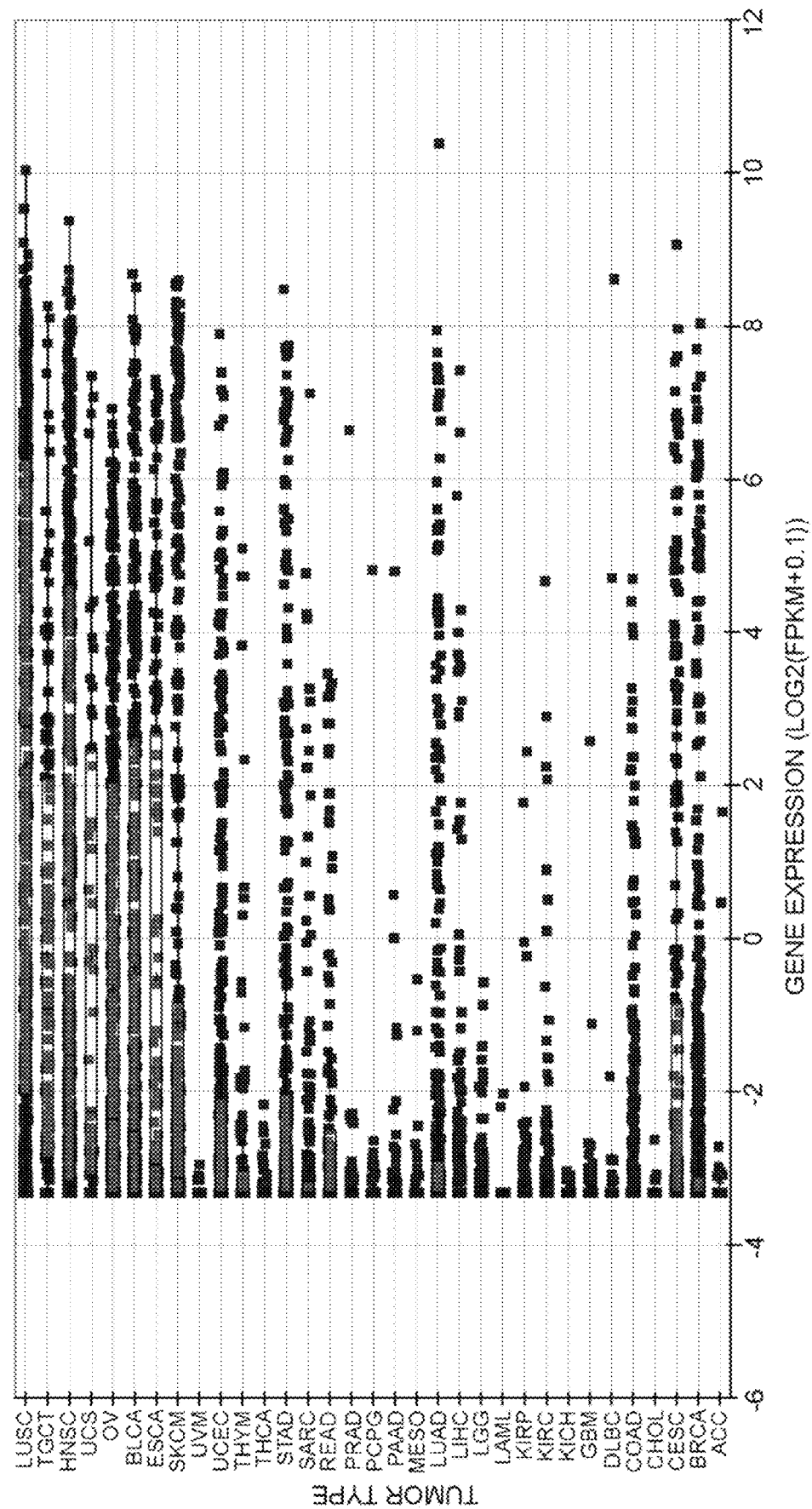
Figure 2D:
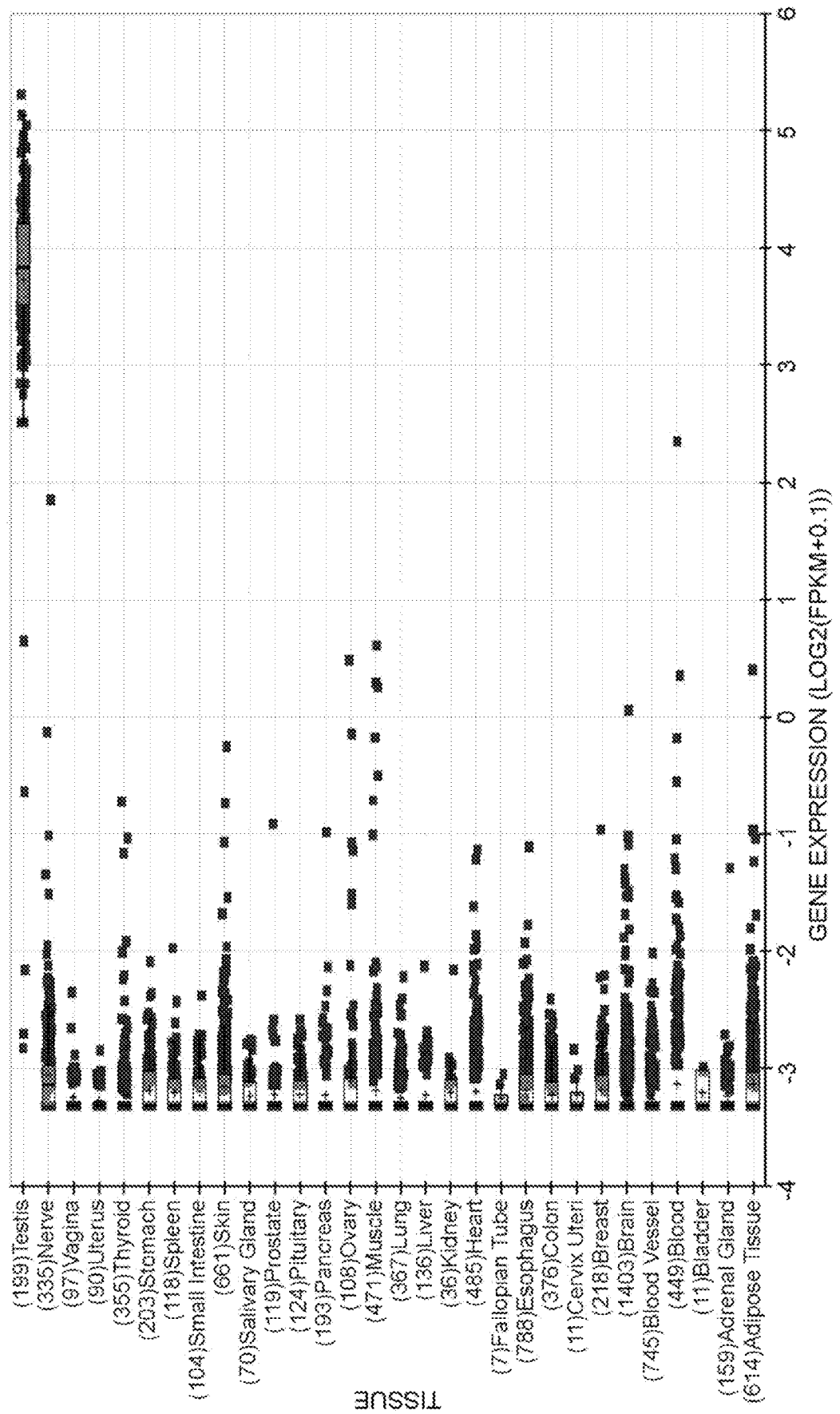
Figure 2E:
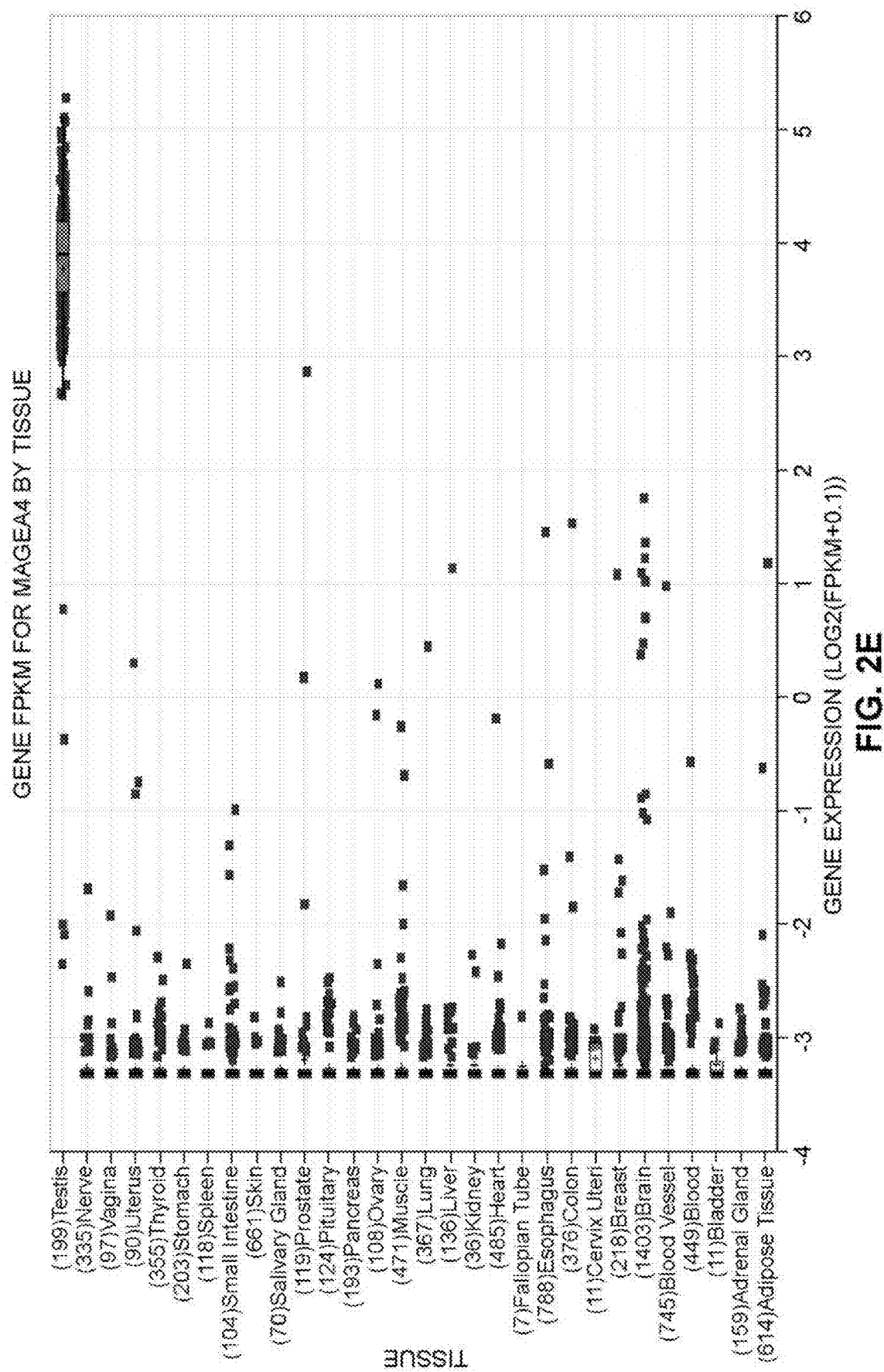
Figure 2F:
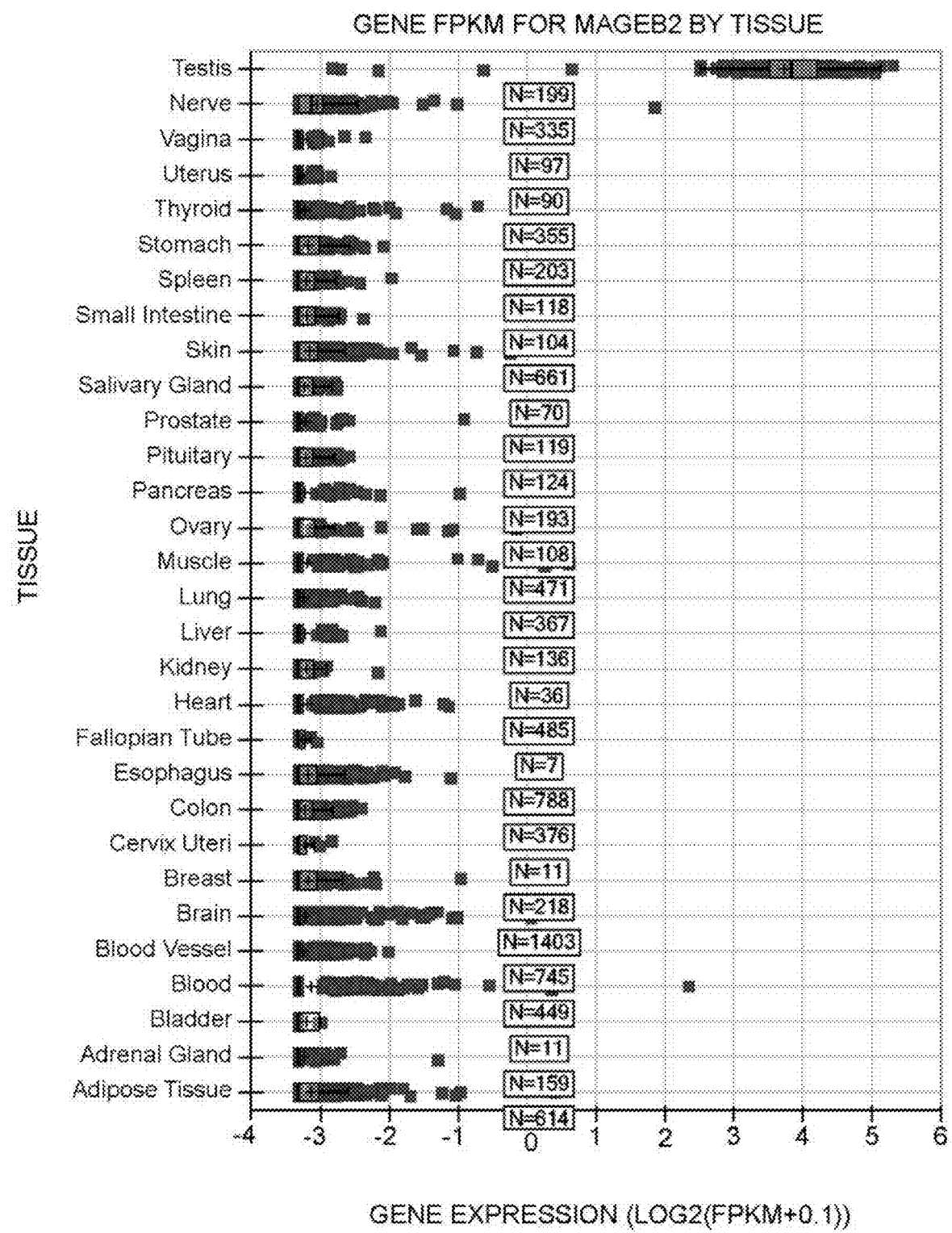

For a subset of 12 tumor tissues absolute quantitative presentation levels for the MAGEB2 peptide were determined as copies per cell (see FIG. 2A right panel). This was accomplished by performing a set of additional experiments to determine the absolute amount of peptide within a sample, the isolation efficiency of the peptide purification process and the total amount of cells within a sample. For this purpose different isotopically labeled versions of the MAGEB2 peptide were spiked into the sample during the peptide purification process and analyzed together with the natural MAGEB2 peptide using dedicated targeted mass spectrometry measurements.

Example 1c: Immunogen Strategy and Titer Analysis

Figure 3A:
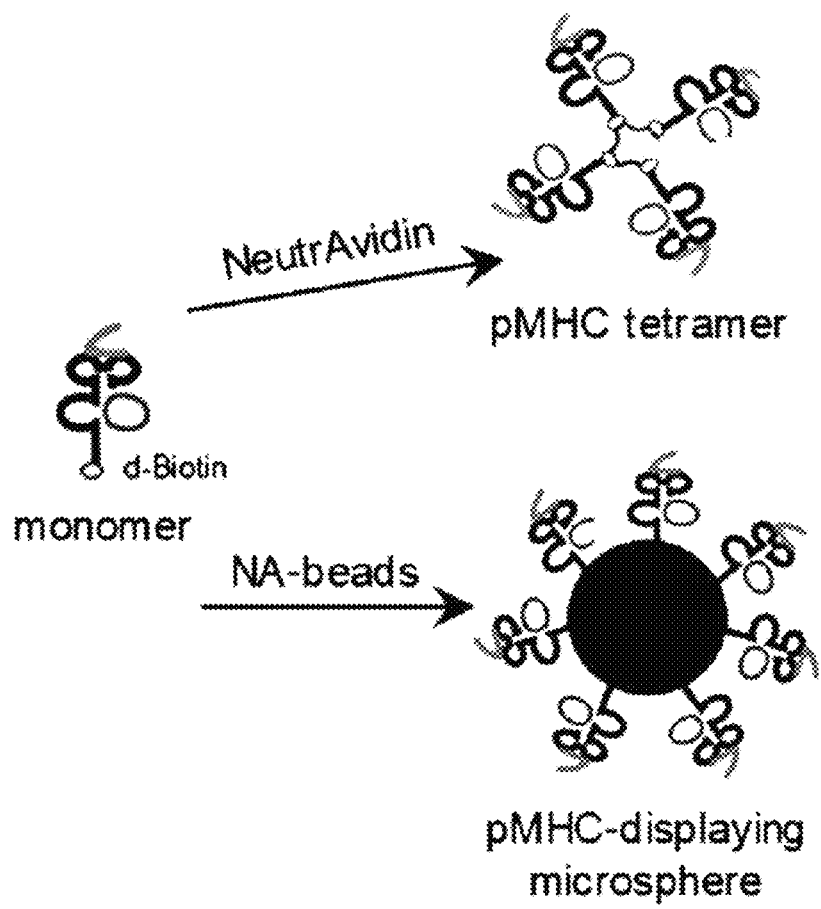
FIGS. 3A-3B.
Figure 3B:
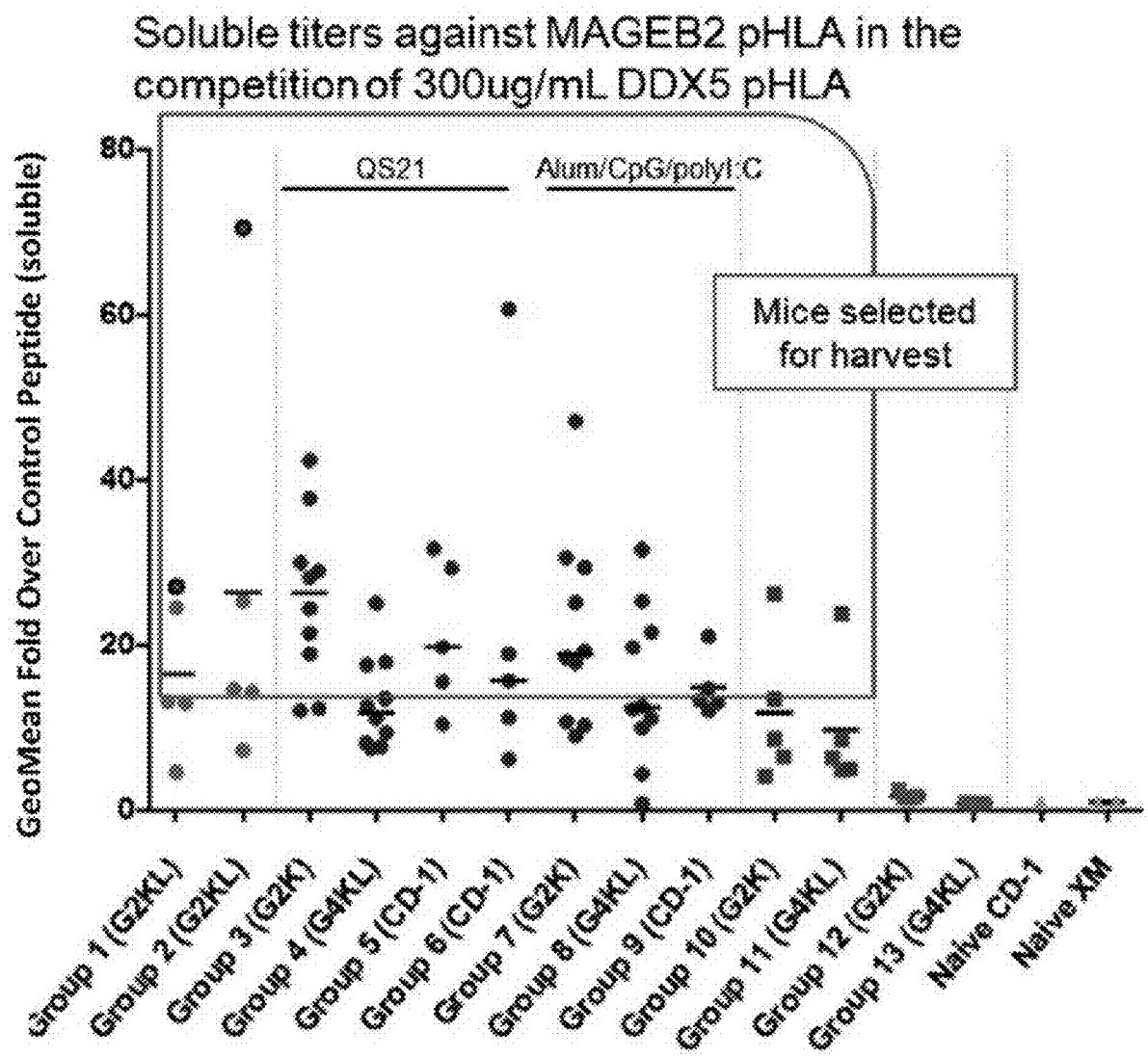

The purified biotinylated MAGEB2 pMHC monomers were incubated with the neutravidin protein to generate pMHC tetramers. Each neutravidin protein can bind up to four biotin molecules and form avidin-biotin complexes. The biotinylated pMHC monomers were also coupled directly to the neutravidin coated microspheres to form pMHC-displaying microspheres. See representation in FIG. 3. Depending on size of microspheres, there are roughly 1600-2000 neutravidin groups per microsphere for the bead that has an average diameter of about 0.1 µm. Both MAGEB2 pMHC tetramers and pMHC-displaying microspheres were adjuvated with QS21 or alum/CpG/poly(I:C) and were used as immunogens for XenoMouse immunization via subcutaneous injection.

At 4- and 8-weeks post immunization, serum samples were collected from animals and analyzed for titers against MAGEB2 pMHC. Identification of MAGEB2 immune response required depletion of titer against other components. In brief, 1:1000 serum dilution was incubated with control peptide pMHC at 300 ug/mL to absorb irrelevant binders that recognize MHC molecules. The serum was then tested for binding of the MAGEB2 pMHC by FACS in the presence of control peptide pMHC. Animals with sera titers showing greatest Geomean Fold-change MAGEB2 over the irrelevant control peptide were selected for harvest and downstream hybridoma generation and screening. See FIG. 3B.

Example 2: Initial Screening of MAGEB2 scFv Binding Constructs

Binding of pMAGE-HLA scFv constructs, generated from the XenoMouse, on peptide loaded T2 cells was evaluated by flow cytometry. T2 cells (DSMZ, ACC 598) were loaded with MAGEB2 peptide or nine different peptides sharing high sequence homology with the MAGEB2 peptide prior to incubation with scFv constructs containing bacterial lysates. Bound scFv constructs were detected with anti-Flag M2 (Sigma-Aldrich, F3165) and anti-mouse IgG-PE (Jackson ImmunoResearch, 115-116-071) and signals were analyzed by flow cytometry. Binding profiles of representative pMAGE-HLA specific scFv candidates are shown in Table 6.

TABLE 6

Binding profiles of representative pMAGE-HLA specific scFv candidates on peptide loaded T2 cells.

Signal/background on peptide loaded T2 cells

| Clone | MAGE B2 | MB | DPYSL4 | SLK | MYOF | KEA | ADF | CNDP2 | COX14 | STXBP5 |
|---|---|---|---|---|---|---|---|---|---|---|
| 18089-D12 | 176 | 1.1 | 1.1 | 1.3 | 1.1 | 1.0 | 1.1 | 1.0 | 1.1 | 1.0 |
| 18179-G12 | 42 | 0.9 | 1.1 | 1.1 | 0.9 | 0.9 | 1.1 | 0.8 | 1.2 | 0.9 |
| 18179-C1 | 43 | 1.0 | 1.0 | 1.0 | 0.9 | 1.0 | 1.3 | 0.8 | 1.0 | 0.9 |
| 18093-B11 | 219 | 1.2 | 1.0 | 1.1 | 1.2 | 1.1 | 1.1 | 1.0 | 1.2 | 1.1 |
| 18182-G2 | 320 | 1.0 | 1.1 | 1.0 | 1.0 | 0.9 | 1.0 | 1.0 | 0.9 | 0.9 |
| 18182-E1 | 193 | 0.9 | 0.9 | 1.0 | 0.9 | 0.9 | 1.0 | 0.9 | 0.8 | 1.0 |
| 18182-B5 | 560 | 1.0 | 1.0 | 1.0 | 1.0 | 0.9 | 0.9 | 1.0 | 1.0 | 1.0 |
| 18182-H9 | 481 | 1.0 | 1.1 | 1.2 | 1.1 | 1.0 | 1.0 | 1.0 | 0.9 | 1.1 |
| 18182-E10 | 273 | 0.9 | 0.9 | 1.0 | 0.9 | 0.8 | 0.9 | 0.8 | 0.9 | 0.8 |
| 18182-G8 | 289 | 1.1 | 1.0 | 1.1 | 1.0 | 0.9 | 1.0 | 0.9 | 0.9 | 1.0 |
| 18182-E6 | 431 | 0.9 | 0.9 | 1.0 | 1.0 | 0.9 | 1.0 | 1.0 | 1.0 | 0.9 |
| 18182-G6 | 365 | 1.0 | 1.0 | 1.0 | 1.0 | 1.0 | 1.0 | 1.0 | 1.0 | 1.0 |
| 18182-B12 | 208 | 0.8 | 1.0 | 0.9 | 0.8 | 0.9 | 1.0 | 0.8 | 1.0 | 0.9 |
| 18182-A4 | 202 | 1.0 | 1.0 | 1.0 | 1.0 | 0.9 | 1.1 | 0.8 | 0.9 | 0.8 |
| 18182-H12 | 298 | 1.2 | 1.0 | 1.0 | 1.2 | 0.9 | 1.0 | 1.0 | 1.1 | 1.0 |
| 18182-E5 | 205 | 0.9 | 1.0 | 1.0 | 0.9 | 0.9 | 1.0 | 0.8 | 0.9 | 0.8 |
| 18081-E7 | 298 | 1.0 | 1.2 | 1.4 | 1.1 | 1.0 | 1.0 | 1.0 | 1.1 | 1.1 |
| 18081-B9 | 153 | 1.1 | 1.1 | 1.1 | 1.1 | 1.1 | 1.0 | 1.0 | 1.0 | 1.0 |
| 18089-D11 | 78 | 1.2 | 1.1 | 1.2 | 1.1 | 1.0 | 1.0 | 1.0 | 1.1 | 1.1 |
| 18089-C9 | 39 | 1.1 | 0.9 | 1.1 | 1.0 | 1.0 | 1.0 | 1.0 | 1.0 | 1.0 |
| 18089-D8 | 36 | 1.0 | 1.2 | 1.1 | 1.1 | 1.0 | 1.0 | 0.9 | 1.0 | 1.0 |
| 18081-F9 | 36 | 1.0 | 1.2 | 1.2 | 1.0 | 0.9 | 1.0 | 1.0 | 1.0 | 1.0 |
| 18081-H11 | 32 | 1.0 | 1.0 | 1.1 | 1.1 | 0.9 | 0.9 | 0.9 | 1.0 | 0.9 |
| 18081-B6 | 22 | 1.1 | 1.0 | 1.1 | 1.0 | 1.0 | 1.1 | 1.0 | 1.0 | 1.0 |
| 18181-G8 | 489 | 0.9 | 1.1 | 1.0 | 1.0 | 0.9 | 1.0 | 1.0 | 1.0 | 1.0 |
| 18179-B12 | 368 | 1.0 | 1.0 | 1.0 | 1.0 | 1.0 | 1.0 | 1.0 | 1.0 | 1.0 |
| 18181-F1 | 443 | 1.0 | 1.1 | 1.1 | 1.1 | 0.9 | 1.1 | 1.1 | 1.1 | 1.0 |
| 18181-A6 | 430 | 1.0 | 1.0 | 1.1 | 1.1 | 0.9 | 1.0 | 1.0 | 0.9 | 1.0 |
| 18179-E1 | 419 | 1.0 | 1.0 | 1.1 | 1.0 | 1.0 | 0.9 | 1.0 | 0.9 | 1.0 |
| 18179-D11 | 345 | 1.0 | 1.1 | 1.0 | 1.1 | 1.0 | 1.0 | 1.0 | 1.0 | 1.0 |
| 18179-D7 | 281 | 1.0 | 1.1 | 1.1 | 1.0 | 1.0 | 1.0 | 1.1 | 1.0 | 1.0 |
| 18179-A7 | 267 | 1.1 | 1.0 | 1.0 | 1.0 | 0.9 | 1.0 | 1.0 | 1.0 | 1.0 |
| 18181-F3 | 232 | 0.9 | 1.1 | 1.0 | 1.1 | 1.0 | 1.0 | 1.1 | 0.9 | 1.2 |
| 18179-H7 | 399 | 1.0 | 1.0 | 0.9 | 1.1 | 1.0 | 1.1 | 1.0 | 1.0 | 1.0 |
| 18181-H7 | 229 | 1.0 | 1.0 | 1.0 | 1.0 | 1.0 | 1.0 | 1.0 | 0.9 | 1.0 |
| 18181-B8 | 179 | 0.9 | 1.0 | 1.0 | 1.0 | 0.9 | 1.0 | 1.0 | 0.9 | 0.9 |
| 18181-C9 | 140 | 1.0 | 0.9 | 1.0 | 1.1 | 0.9 | 1.0 | 1.0 | 0.9 | 1.1 |
| 18181-G10 | 121 | 1.0 | 1.0 | 1.1 | 1.0 | 1.0 | 1.0 | 1.1 | 1.0 | 1.0 |
| 18181-E2 | 103 | 1.0 | 1.0 | 1.1 | 1.1 | 1.0 | 1.1 | 1.0 | 1.1 | 1.1 |
| 18089-B2 | 318 | 1.1 | 1.0 | 1.1 | 1.1 | 1.0 | 1.0 | 1.0 | 0.9 | 1.0 |

Figure 4A:
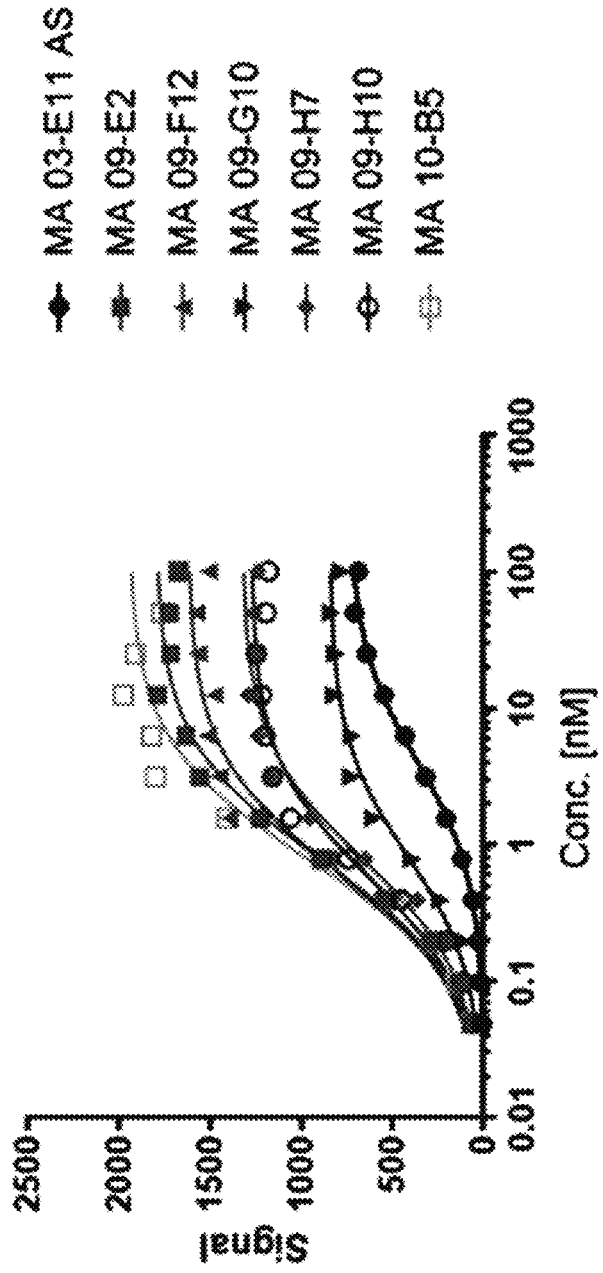
FIG. 4A-4B.
Figure 4B:
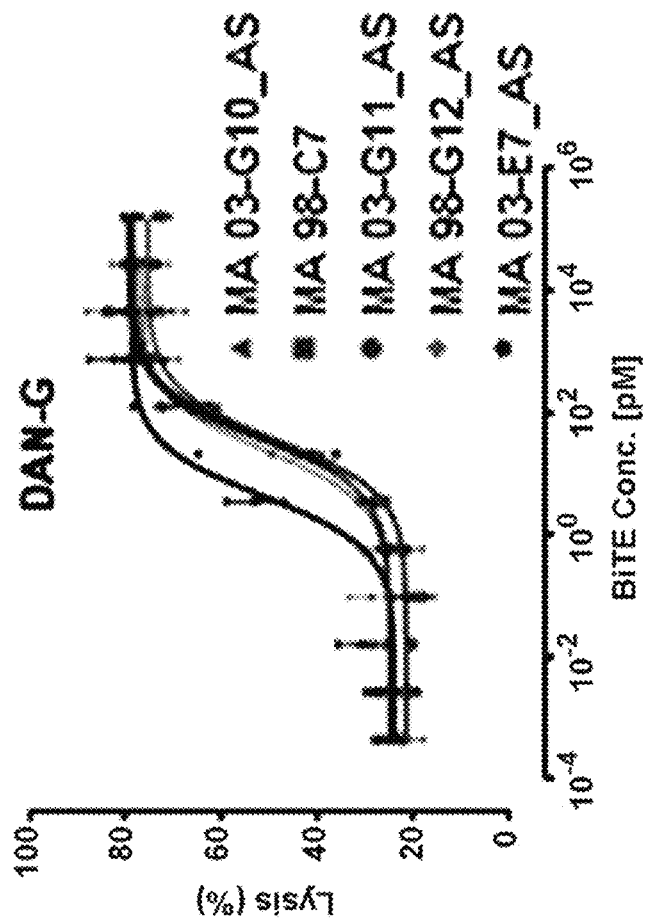

Example 3: Evaluation of pMAGE-HLA HLE Bispecific Antibody Constructs In Vitro Affinity and Efficacy Cell-based affinity of pMAGE-HLA bispecific antibody constructs was determined by fluorescence cytometry and nonlinear regression (one site—specific binding) analysis. MAGEB2 peptide loaded T2 cells were incubated with decreasing concentrations of pMAGE-HLA bispecific antibody constructs. Bound antibody constructs were detected by Alexa Fluor 488-conjugated anti-human IgG (Jackson ImmunoResearch, 109-547-003). Prior signal detection by fluorescence cytometry fixed cells were stained with DRAQ5. Respective equilibrium dissociation constant (Kd) values were calculated with the one site specific binding evaluation tool in the GraphPad Prism software. Cell activity of pMAGE-HLA HLE bispecific antibody constructs was evaluated in T cell-dependent cytotoxicity (TDCC) assays. Human PBMC were incubated at 10:1 with target cells expressing pMAGE-HLA complexes (U266B1 and DAN-G cells) in the presence of a dose range of antibody constructs. After 48 h incubation, cell cytotoxicity was assessed using flow cytometry as a readout for cellular cytotoxicity. Results are depicted in FIGS. 4A-4B and Table 7.

TABLE 7

Binding affinities and efficacies of representative pMAGE-HLA HLE bispecific antibody constructs

| Candidates x aCD3 x HLE | KD on MAGEB2 loaded T2 [nM] | EC50 [pM] U266 | EC50 [pM] DAN-G |
|---|---|---|---|
| MA 86-A4-N-F5 CC | 51.8 | 135 | 4340 |
| MA 88-B3-F9 CC | 74.1 | not active | not active |
| MA SG-F28 CC | 76.8 | 313 | 23743 |
| MA 81-B9 CC | 18.8 | 282 | 4035 |
| MA 98-C7 CC | 0.7 | 3.5 | 70.5 |
| MA 03-D8 AS CC | 0.5 | 0.3 | 15.2 |
| MA 03-E11 AS CC | 4.2 | 3.5 | 212 |
| MA 09-E2 CC | 0.7 | 2.0 | 68.7 |
| MA 09-F12 CC | 0.5 | 2.9 | 83.5 |
| MA 09-G10 CC | 0.8 | 12.6 | 90.8 |
| MA 09-H7 CC | 0.8 | 10.5 | 227 |
| MA 09-H10 CC | 0.6 | 3.2 | 103 |
| MA 10-B5 CC | 0.7 | 1.0 | 33.3 |
| MA 10-D3 CC | 1.1 | 9.8 | 197 |
| MA 10-D6 CC | 0.7 | 1.2 | 45.0 |
| MA 10-G10 AS CC | 1.7 | 2.9 | 141 |
| MA 86-A4 CC | 35.5 | 540 | 2858 |
| MA 98-G12_AS CC | 0.9 | 0.9 | 42.6 |
| MA 03-C7_AS CC | 1.5 | 1.2 | 89.6 |

TABLE 7-continued

Binding affinities and efficacies of representative pMAGE-HLA HLE bispecific antibody constructs

| Candidates × aCD3 × HLE | KD on MAGEB2 loaded T2 [nM] | EC50 [pM] U266 | EC50 [pM] DAN-G |
|---|---|---|---|
| MA 03-D12_AS CC | 0.7 | 0.7 | 24.8 |
| MA 03-E7_AS CC | 0.5 | 0.6 | 8.5 |
| MA 03-G10_AS CC | 0.9 | 1.0 | 59.9 |
| MA 03-G11_AS CC | 1.3 | 2.4 | 73.7 |
| MA 03-H12_AS CC | 1.1 | 1.5 | 79.9 |
| MA 09-C7 CC | 0.9 | 12.8 | 374 |
| MA 09-F11 CC | 0.6 | 11.4 | 204 |
| MA 09-G11 CC | 0.6 | 6.7 | 170 |
| MA 09-H11 CC | 0.5 | 1.9 | 41.4 |
| MA 10-G2 CC | 1.0 | 2.8 | 126 |
| MA 10-H1 CC | 1.2 | 2.9 | 225 |
| MA 10-H3 CC | 0.7 | 1.3 | 111 |

Example 4A: Screening of Similar Peptide Panels

Single Point

Figure 5A:
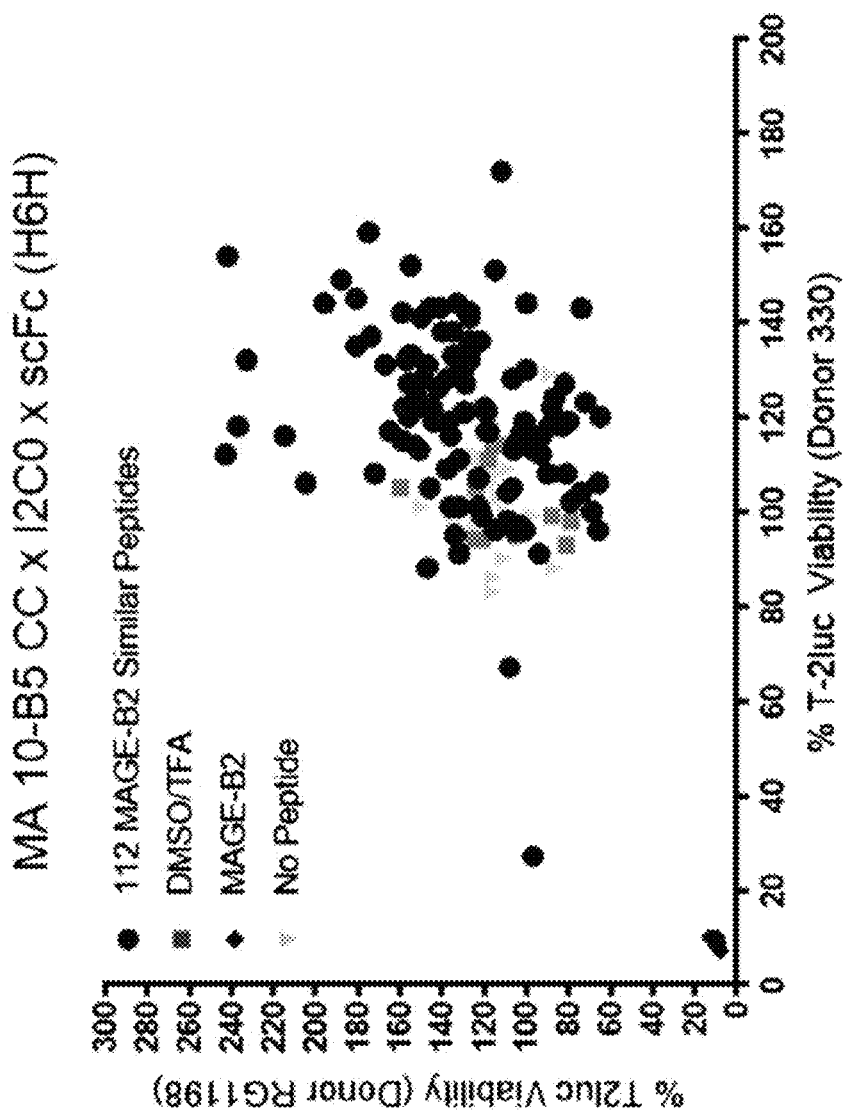
FIG. 5A-5B.
Figure 5B:
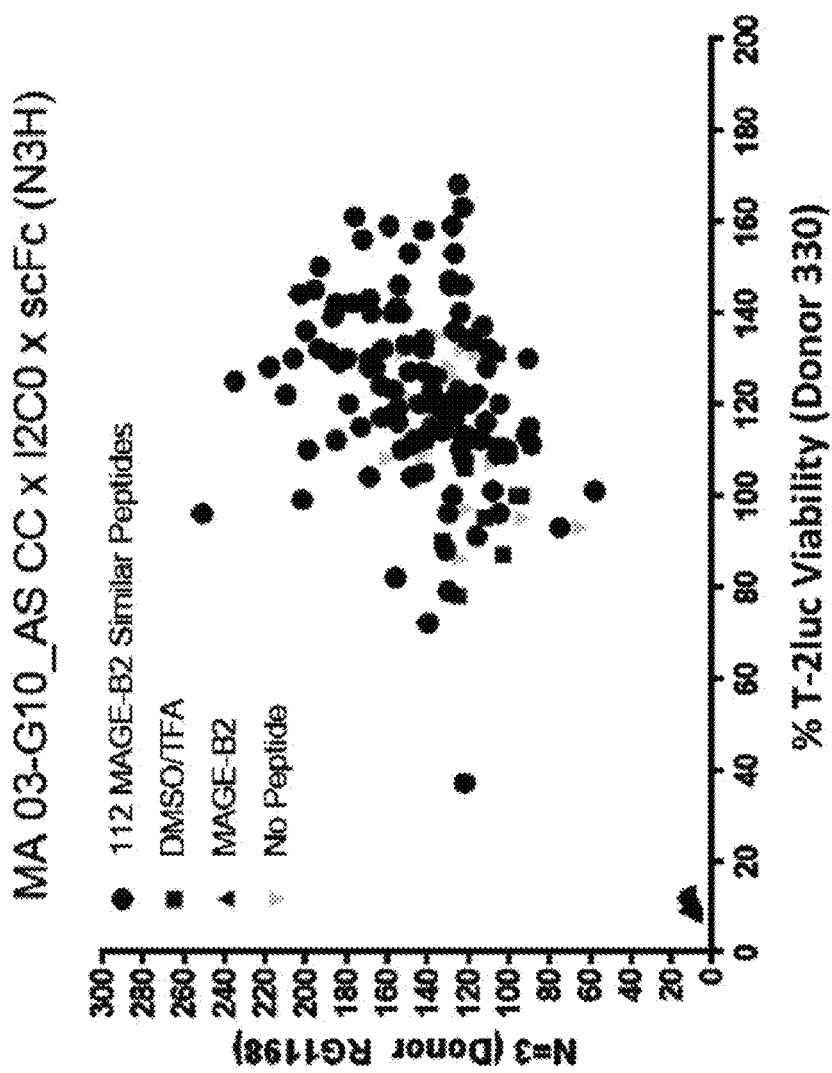

T2luc cells (luciferase expressing T2 cells generated at Amgen) were incubated with similar peptides, target specific peptide or DMOS/TFA control at 10 uM final concentration for 2 hrs at 37° C./5% CO2 in serum free media. Frozen or pre-activated primary human pan T-cells were washed and added to white-clear bottom 384-well assay plates at 20,000 cells/20 uL in 10% ICM (Immune Cell Media). Pre-activated T-cells were prepared by seeding 2×10E6 cells/mL into 1 ug/mL pre-coated TC flask anti CD3 (OKT3 clone, eBioscience, catalog #160037)+1 ug/mL anti CD28 (CD28.2 clone, eBioscience, catalog #16-0289-81) for 72 hrs in 10% ICM at 37° C./5% CO2. Pre-activated T-cells were expanded with 10 ng/mL rhIL-2 (R&D Systems, cat #202-IL-50). Peptide loaded T2luc cells were added to the primary T-cells at 2000 cells/20 uL. MAGE-B2 pMHC BiTE® HLE molecules were added to the T-cells and peptide loaded T2luc cells at 10 nM final concentration in 10% ICM and incubated for 48 or 24 hours (frozen or pre-activated respectively) at 37 deg C./5% CO2. T2luc cell viability was determined using Bio-Glo™ Luciferase Assay System (Promega cat #G7940) according to the manufacturer's recommendation. Luminescence was detected using EnVision® Multilable Plate Reader (Perkin Elmer). Percent viability was calculated using the following formula: % Viability=(Sample raw RLU value/Average DMSO/TFA control RLU)×100. FIGS. 5A and 5B depict the response of MAGE-B2 pMHC BiTE® against 112 MAGE-B2 similar peptides, MAGE-B2 and relevant controls in 2 different T-cell donors. It was a striking result to achieve binding specificity to the MAGEB2 peptide-MHC complex, yet demonstrate minimal binding to other similar peptides-MHC complexes (e.g., those in FIG. 1 and elsewhere herein).

Potency

Figure 6A:
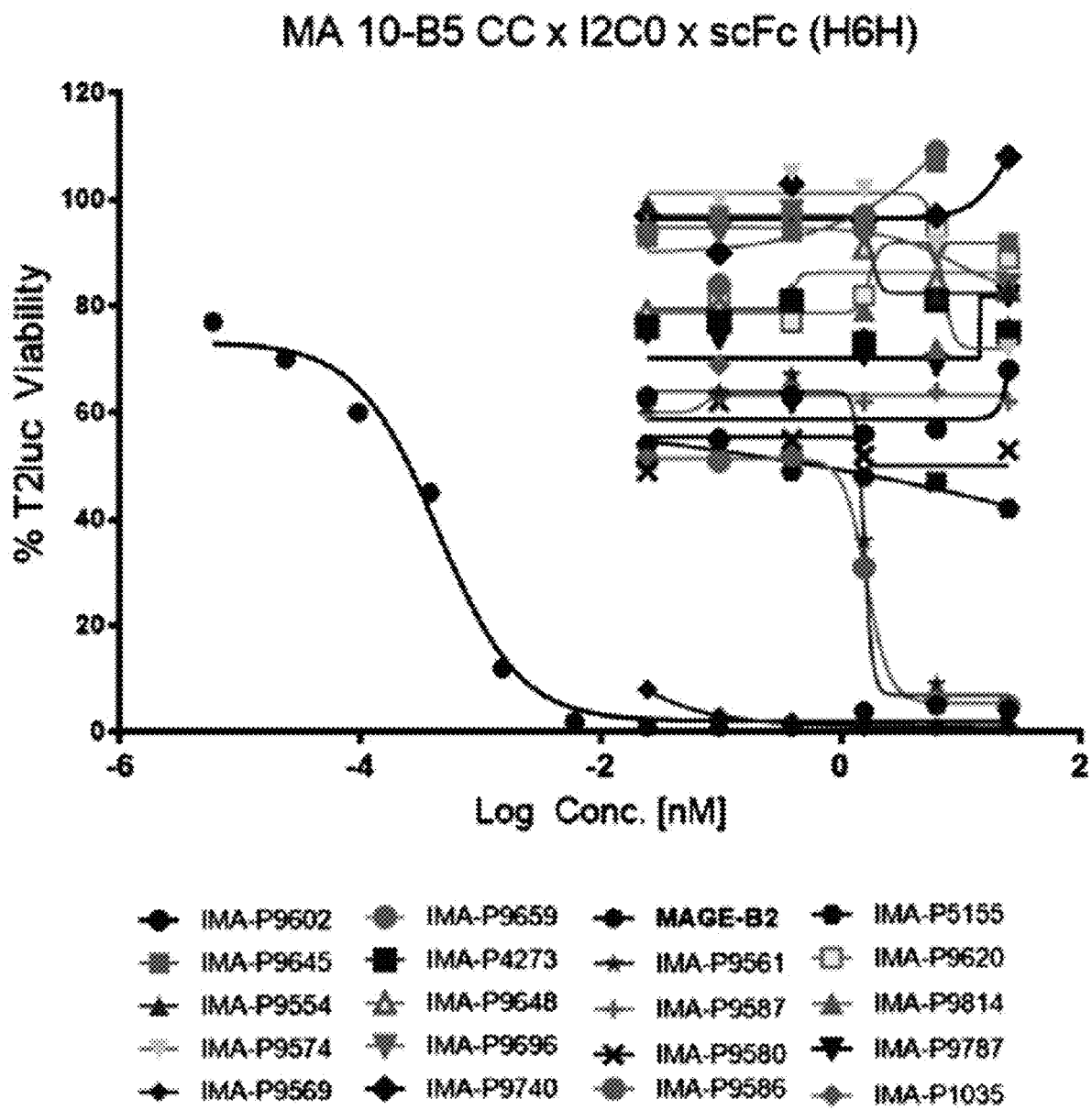
FIG. 6A-6B.
Figure 6B:
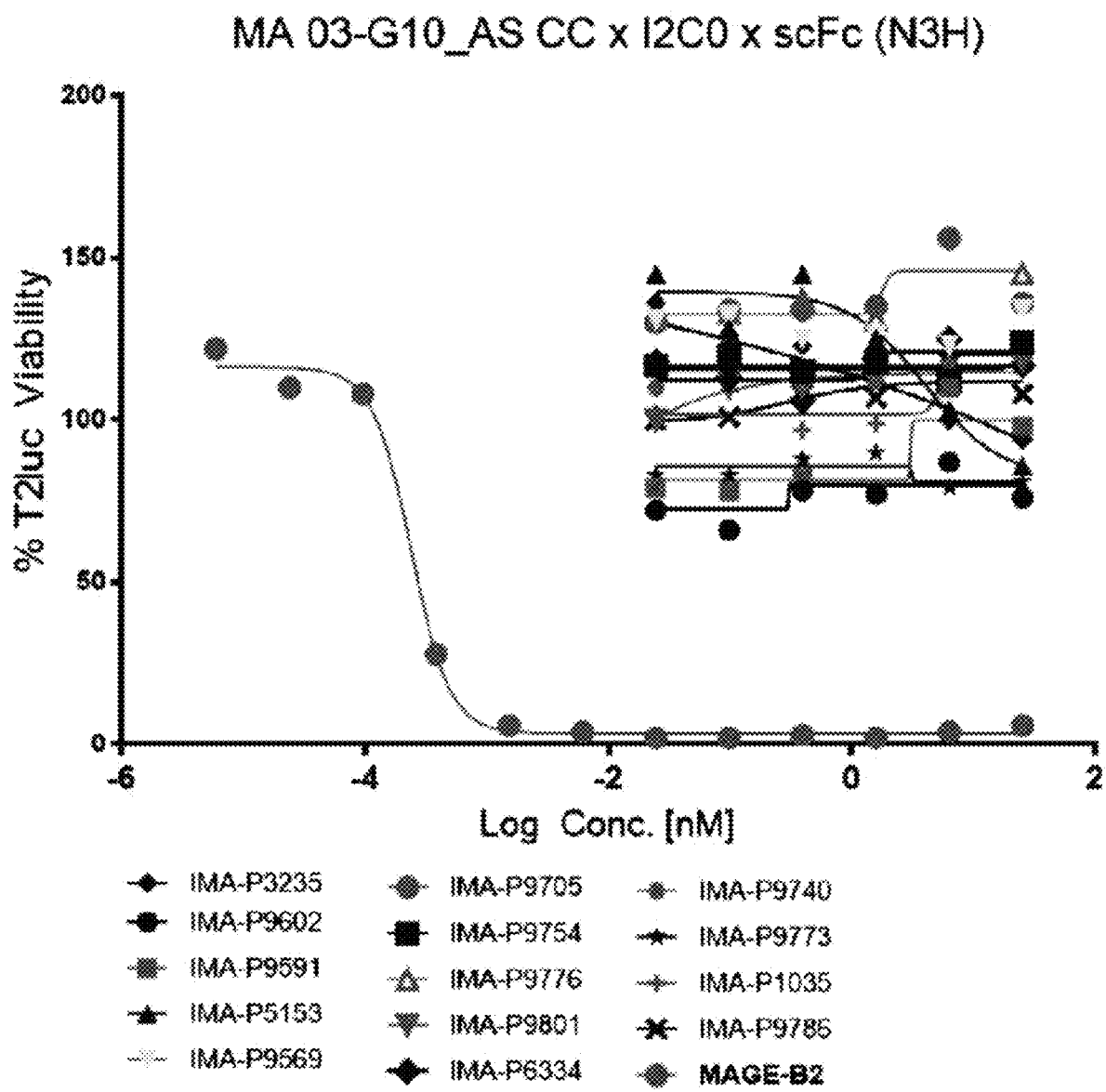

T2luc cells were incubated with reactive similar peptides, target specific peptide or DMOS/TFA control at 10 uM final concentration for 2 hrs at 37° C./5% CO2 in serum free media. Frozen or pre-activated primary human pan T-cells were washed and added to white-clear bottom 384-well assay plates at 20,000 cells/20 uL in 10% ICM (Immune Cell Media). Pre-activated T-cells were prepared by seeding 2×10E6 cells/mL into 1 ug/mL pre-coated TC flask anti CD3 (OKT3 clone, eBioscience, catalog #160037)+1 ug/mL anti CD28 (CD28.2 clone, eBioscience, catalog #16-0289-81) for 72 hrs in 10% ICM at 37° C./5% CO2. Pre-activated T-cells were expanded with 10 ng/mL rhIL-2 (R&D Systems, cat #202-IL-50). Peptide loaded T2luc cells were added to the primary T-cells at 2000 cells/20 uL. MAGE-B2 pMHC BiTE® HLE molecules were added to the T-cells and peptide loaded T2luc cells at 25 nM to 0.006 pM final concentration in 10% ICM and incubated for 48 or 24 hours (frozen or pre-activated respectively) at 37° C./5% CO2. T2luc cell viability was determined using Bio-GLo Luciferase Assay System (Promega cat #G7940) according to the manufacturer's recommendation. Luminescence was detected using EnVision Multilable Plate Reader (Perkin Elmer). Percent viability was calculated using the following formula: % Viability=(Sample raw RLU value/Average DMSO/TFA control RLU)×100. EC50 was determined using GraphPad Prism (non-linear regression curve fit analysis). FIGS. 6A and 6B depict the potency of MAGE-B2 pMHC BiTE® against MAGE-B2 and various reactive similar peptides.

Example 4B: Screening of MAGEB2 9-Mer Peptides

Figure 7:
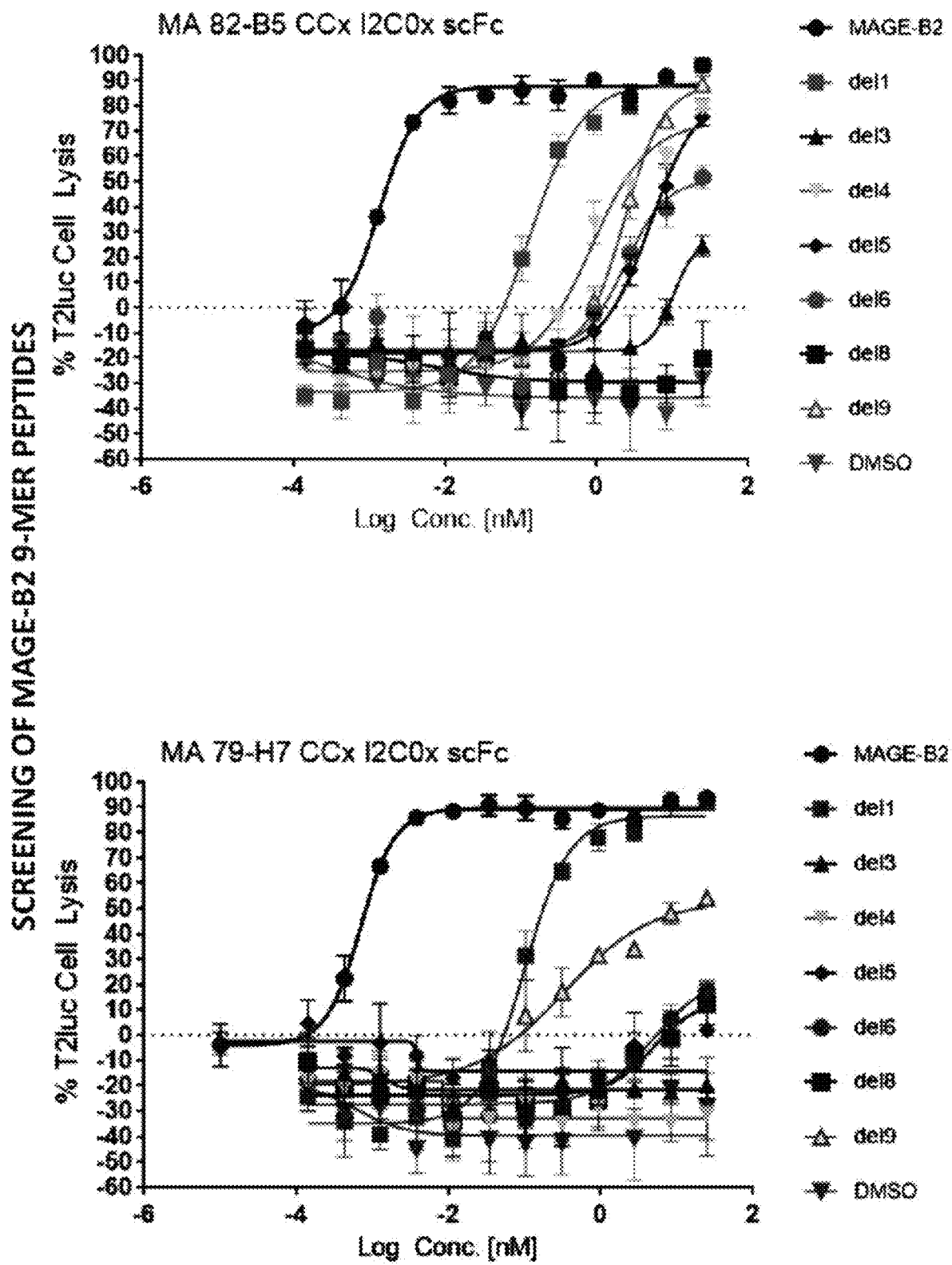
FIG. 7. This figure depicts the potency of two different BiTE® molecules against the full length 10-mer MAGEB2 peptide as compared to 9-mer deletion variants of the MAGEB2 peptide.

T2luc cells were incubated with MAGE-B2 9-mer peptides (i.e., single amino acid deletions from the full MAGEB2 10-mer peptide), target specific peptide, or DMOS/TFA control at 10 uM final concentration for 2 hrs at 37° C./5% CO2 in serum free media. Frozen primary human pan T-cells were washed 3 times in sterile 10% ICM and added to white-clear bottom 384-well assay plates at 20,000 cells/20 uL in 10% ICM (Immune Cell Media). Peptide loaded T2luc cells were added to the primary T-cells at 2000 cells/20 uL. MAGE-B2 pMHC BiTE® HLE molecules were added to the T-cells and peptide loaded T2luc cells at 25 nM to 0.006 pM final concentration in 10% ICM and incubated for 48 hours at 37° C./5% CO2. T2luc cell viability was determined using Bio-GLo Luciferase Assay System (Promega cat #G7940) according to the manufacturer's recommendation. Luminescence was detected using EnVision Multilable Plate Reader (Perkin Elmer). Percent viability was calculated using the following formula: % Viability=(Sample raw RLU value/Average DMSO/TFA control RLU)×100. EC50 was determined using Graph Pad Prism (non-linear regression curve fit analysis). FIG. 7 depicts the potency of MAGE-B2 pMHC BiTE® against the various MAGEB2 9-mer peptides.

Examples 5A-5E: Bite® Molecule TDCC Potency Assays on Cell Lines and Primary Cells Methodologies for the TDCC assays performed in the following examples is described at the end of this section.

In Example 5A, BiTE® molecule activity was measured by TDCC assays on various cell lines with known MAGEB2 copies per cell (DANG, NCI-H1792, SK-MEL, SNU-475). Results are depicted in FIG. 8.

Figure 9:
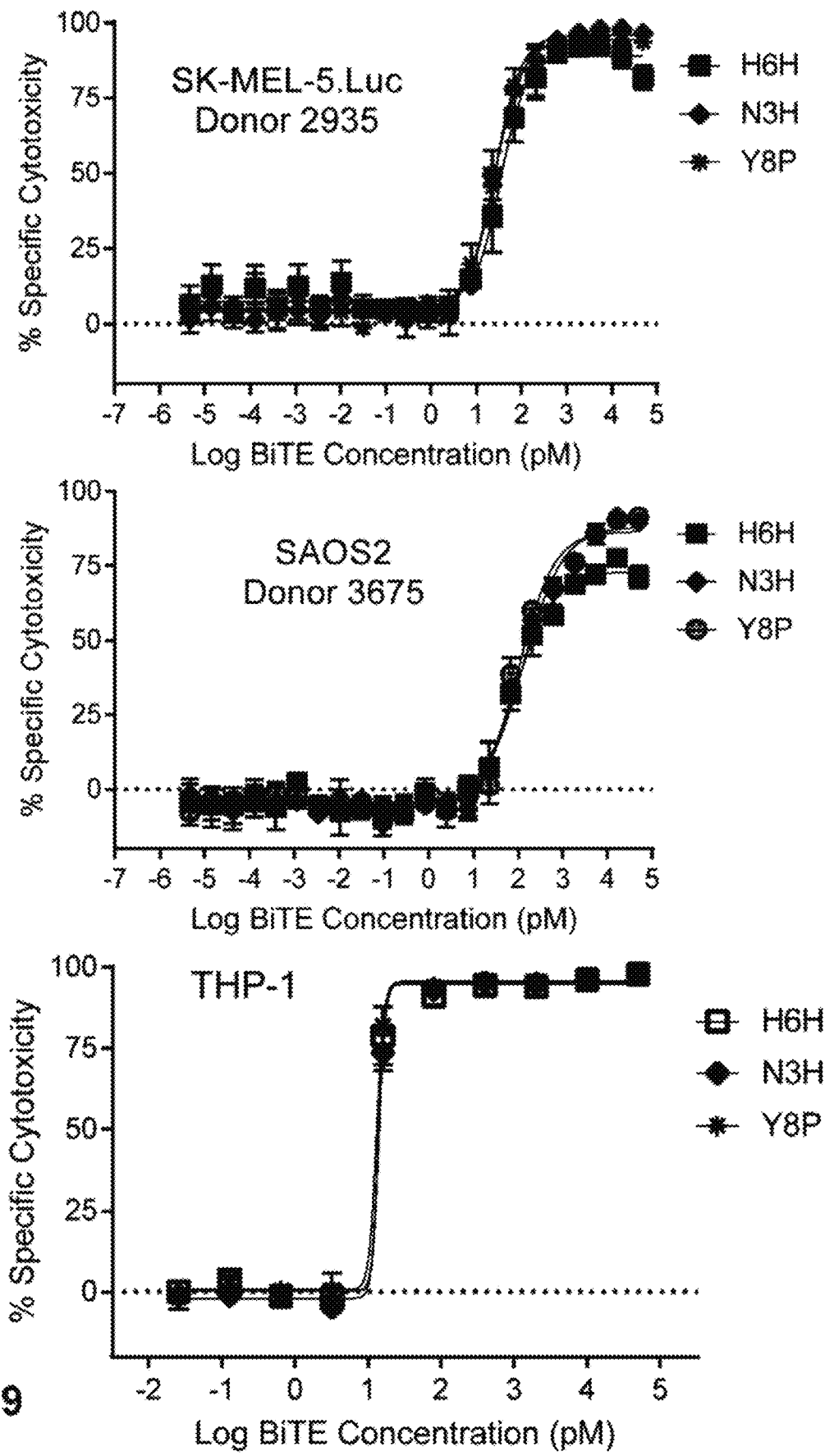
FIG. 9. This figure depicts TDCC plots of three different BiTE® molecules on cell lines with intermediate-low expression of MAGEB2, with % specific cytotoxicity on the y-axis and log BiTE® molecule concentration (pM) on the x-axis. Note that the BiTE® molecule 3-character name is a shortened version of the full BiTE® molecule nomenclature as seen in Table 22 herein, where the 3-character name is in parentheses.

In Example 5B, BiTE® molecule activity was measured by TDCC assays on cell lines with low/intermediate MAGEB2 expression. Results are depicted in FIG. 9.

Figure 10:
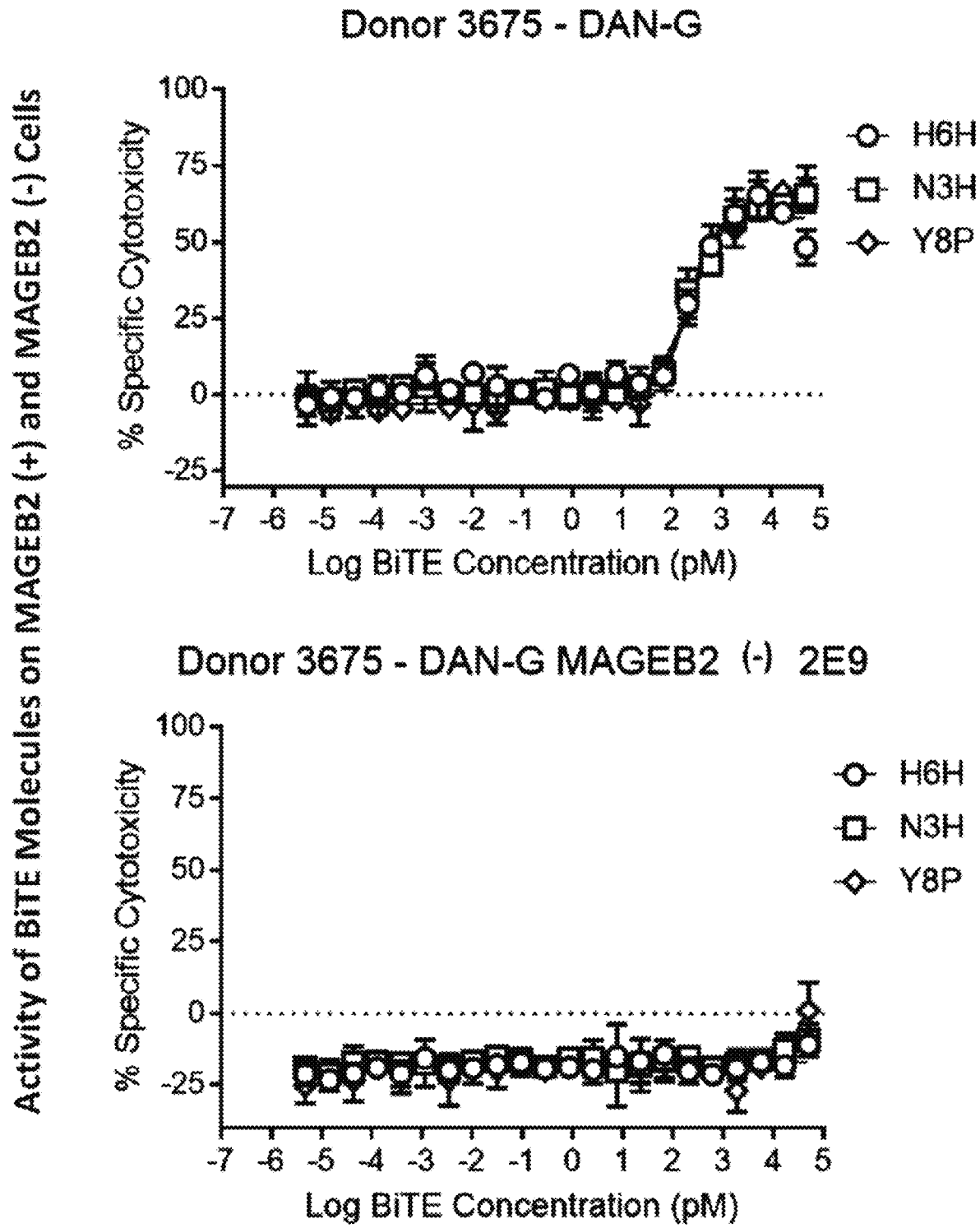
FIG. 10. This figure depicts TDCC plots of three different BiTE® molecules on the DAN-G MAGEB2 (−) cell line, with % specific cytotoxicity on the y-axis and log BiTE® molecule concentration (pM) on the x-axis. Note that the BiTE® molecule 3-character name is a shortened version of the full BiTE® molecule nomenclature as seen in Table 22 herein, where the 3-character name is in parentheses.

In Example 5C, BiTE® molecule activity was measured by TDCC assays on DAN-G MAGEB2 positive and DAN-G MAGEB2 negative cell lines. Results are depicted in FIG. 10.

Figure 11A:
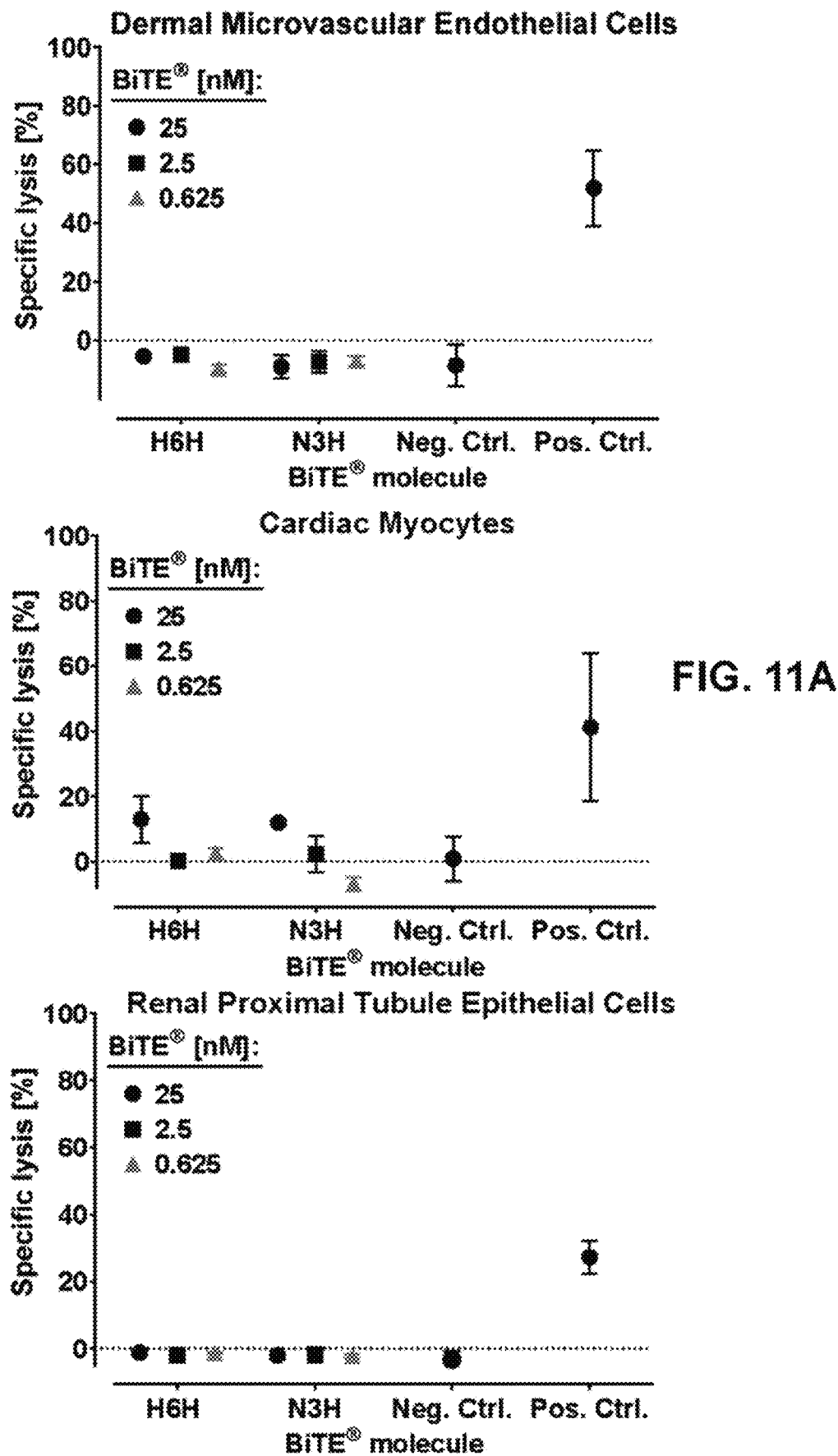
FIGS. 11A-B.

In Example 5D, BiTE® molecule activity was measured by TDCC assays on human primary cells (cardiac myocytes, endothelial cells, and epithelial cells). Results are depicted in FIG. 11A.

Figure 11B:
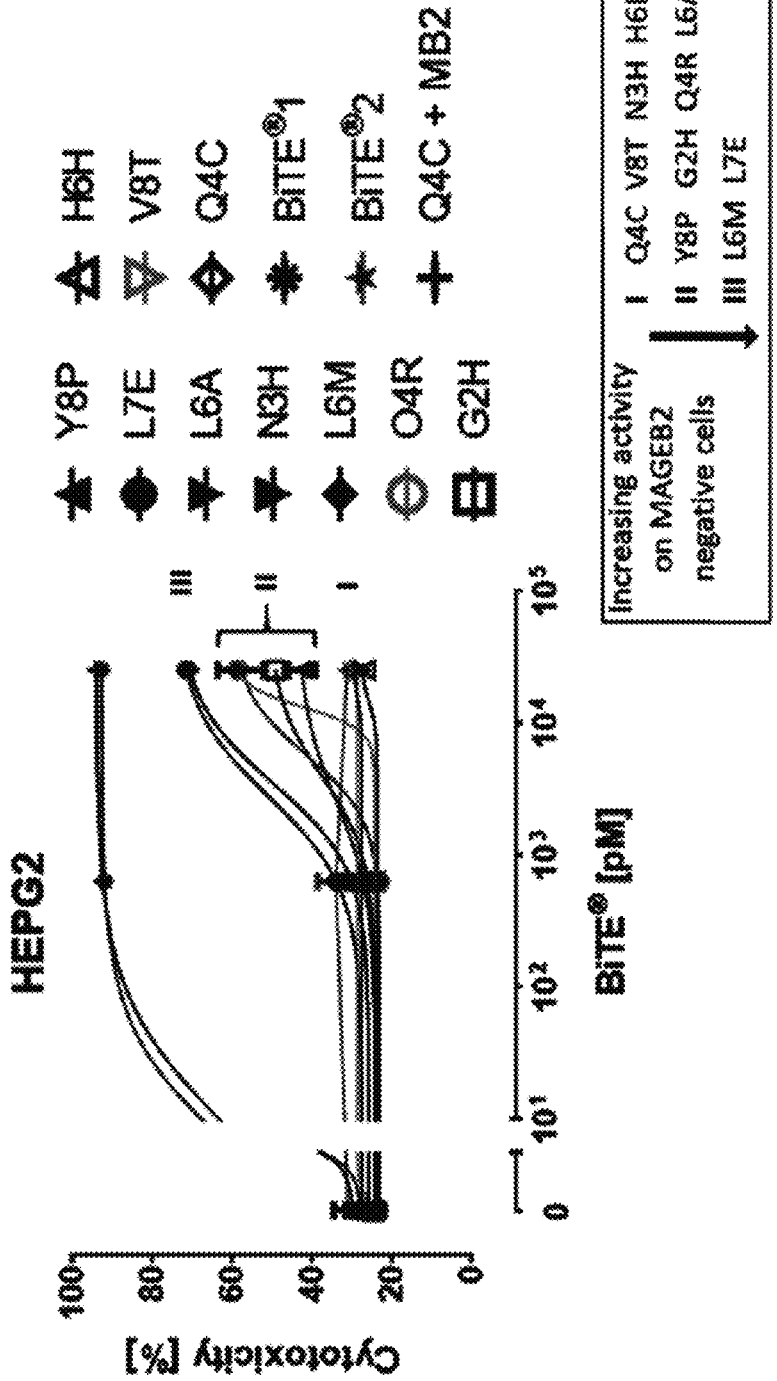

In Example 5E, BiTE® molecule activity on MAGEB2 (−) cells was evaluated by TDCC assay for various BiTE® molecules, many of which have comparable binding affinities to the pMAGE-HLA. Human T cells were co-cultured at ratios of 10:1 with HLA-A*02:01-positive tumor cells not expressing MAGEB2 (HEPG2 cells) in the presence of antibody constructs. After 48 h incubation, cell cytotoxicity was assessed by flow cytometric determination of dead tumor cells. Results are depicted in FIG. 11B.

Figure 12A:
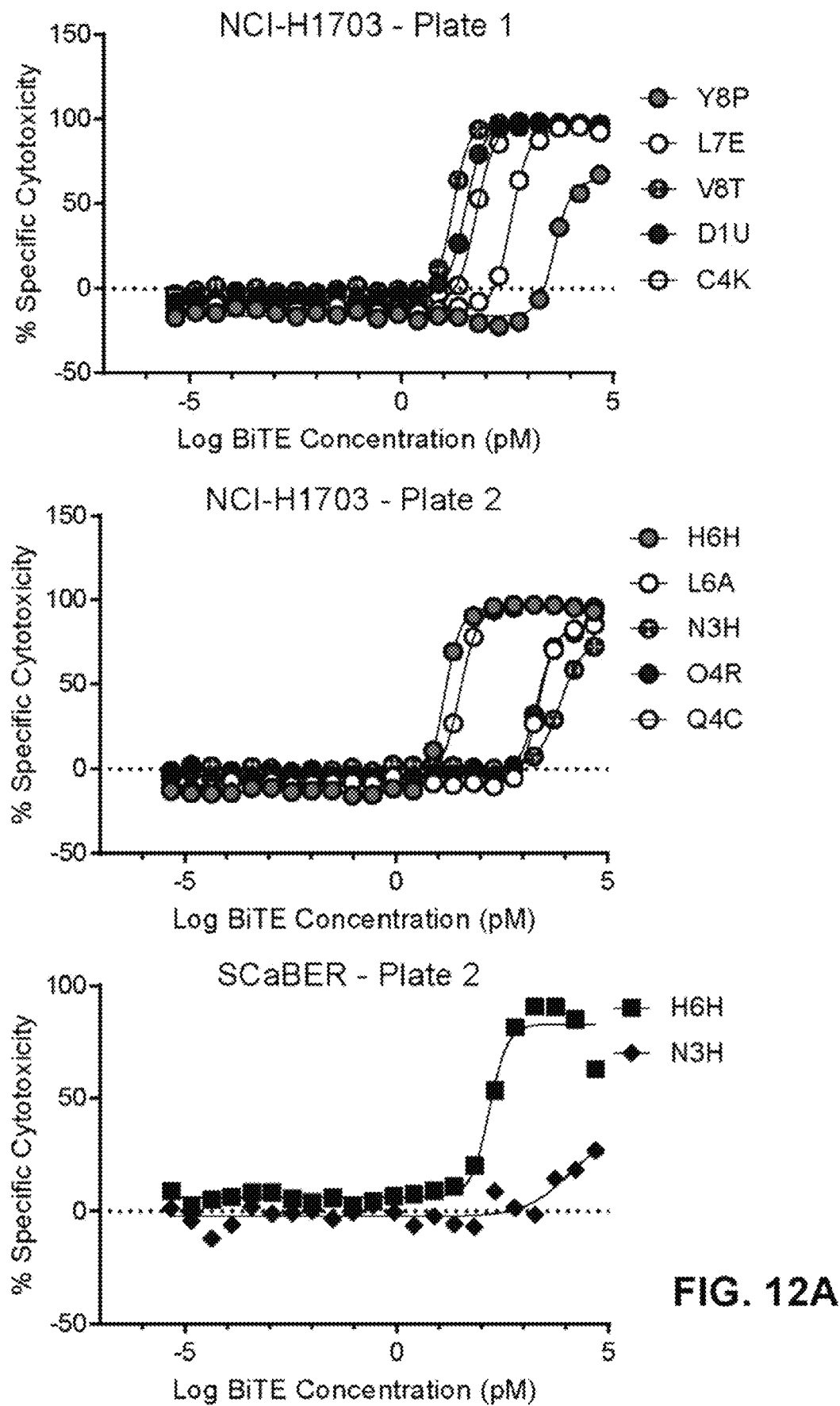

In Example 5F, BiTE® molecule activity was measured by TDCC assays on various MAGEA4(+)/MAGEB2(−) cell lines. Results are depicted in FIG. 12.

BiTE® Molecule TDCC Methods—for Adherent Cells

BiTE® molecules—Indicated BiTE® molecule dilutions were prepared in complete RPMI media, cRPMI (RPMI 1640 supplemented with 10% FBS, Glutamax, non-essential amino acids, sodium pyruvate, HEPES, and penicillin/streptomycin). Target cells—Media of adherent target cells were aspirated, and cells were rinsed with PBS without calcium or magnesium. Corning CellStripper Dissociation Reagent was added, and flasks were incubated at 37° C. to lift cells from flask. Cells were collected, washed with cRPMI, and resuspended at 1e5 cells/ml in cRPMI. Effector T cells—Frozen human pan T cells isolated from normal peripheral blood were thawed in warm cRPMI and centrifuged at 300 g for 20 minutes. Cell pellets were resuspended at 1.25e6 cells/ml.

2,500 target cells and 25,000 T cells (E:T 10:1) were co-cultured with diluted BiTE® molecule in 384 well plates. Samples are run in triplicate. Plates were incubated at room temperature for 20 minutes to allow cells to settle to bottom. Prepared MicroClime lids were added to the assay plates and plates were incubated at 37° C. for 48 hours. For readouts, plates were gently washed with room temperature PBS with calcium and magnesium. After final wash, 20 ul of PBS was added to each well. Promega Cell Titer Glo was added to wells and plates are placed on a shaker at room temperature for 10 minutes in the dark before luminescence of viable target cells are read from plates.

BiTE® Molecule TDCC Methods—for Suspension Cells

BiTE® molecules and effector T cells were prepared as above. Suspension target cells were mixed thoroughly, washed with cRPMI, and resuspended at 1e6 cells/ml in serum-free RPMI 1640. Target cells were labeled with Invitrogen CFDA-SE dye for 5 minutes at 37° C. in the dark at a final concentration of 2.5 uM. Cells were washed with cRPMI and resuspended at 1.25e5 cells/ml in cRPMI.

10,000 target cells and 100,000 T cells (E:T 10:1) were co-cultured with diluted BiTE® molecule in 96 well plates. Samples were run in duplicate. Plates were incubated at room temperature for 20 minutes to allow cells to settle to bottom. Prepared MicroClime lids were added to the assay plates and plates were incubated at 37° C. for 48 hours. For readout, cells were pelleted in plates by centrifugation and media was removed. Cells were resuspended with FACS Buffer (1% FBS in PBS) and stained with ThermoFisher LIVE/DEAD Fixable Near-IR viability dye. Samples were acquired on BD Fortessa flow cytometer to determine labeled target cell viability.

BiTE® Molecule TDCC Methods—Human Primary Cells

BiTE® molecule TDCC assays with HLA-A*02:01-positive human primary cells: cardiac myocytes (PromoCell, Cat. No.: C-12810), dermal microvascular endothelial cells (PromoCell, Cat. No.: C-12212, renal proximal tubule epithelial cells (Lonza, Cat. No.: CC-2553) and HLA-A*02: 01-positive pan T cells (PPA, Cat. No.: 15-00061).

Cardiac myocytes, endothelial cells, renal epithelial cells and T cells were carefully thawed and cultured in their recommended media over night at 37° C. in a 5% CO2 incubator. T cell media: 10% FCS in RPMI 1640; PromoCell's cardiac myocyte medium: basal medium, Cat. No.: C-22270, supplemented with the growth medium supplement pack, Cat. No.: C-39270. PromoCell's endothelial cell growth medium: basal medium MV, Cat. No.: C-22220, supplemented with the growth medium MV supplement pack, Cat. No.: C-39220. Lonza's renal epithelial cell medium: renal epithelial cell growth basal medium, Cat. No.: CC-3191, supplemented with the renal epithelial cell growth medium kit, Cat. No.: CC-4127.

Cardiac myocytes, endothelial cells and epithelial cells were either cultured alone or co-cultured with T cells at a ratio of 1 (1×104 cells):10 in the presence or absence of BiTE® molecules for 48 hours at 37° C. in a 5% CO2 chamber. Cell culture assays were performed in a 1-to-1 media mix containing T cell medium and the corresponding media for myocytes, endothelial and epithelial cells without the supplement hydrocortisone.

Negative control assays were run with a BiTE® molecule specific for an antigen not expressed by healthy normal cells and positive controls were performed with a BiTE® molecule binding to a cell surface antigen with varying expression on healthy tissues. Cardiac myocytes, endothelial cells and epithelial cells cultured alone were lysed at the end of the culture period with Triton X-100 (maximal lysis). LDH release by dying cells into the assay supernatants was measured with Promega's LDH-Glo™ Cytotoxicity Assay Kit and monitored by a luminometer.

Example 6: Interaction of the MAGEB2 Peptide with HLA-A*02 MHC

Introduction

Bi-specific T cell engagers (BiTE®) specific to a MAGEB2 peptide (p) bound to HLA-A02 major histocompatibility complex (MHC) ("pMHC" when the peptide is bound to the MHC; alternatively "pMAGE-HLA") were successfully generated. The results presented here describe the interactions of the MAGEB2 10-mer peptide GVYDGEEHSV (SEQ ID NO: 1) with the HLA-A02 MHC as derived from the crystal structure of pMHC:N3H BiTE® complex. Refer to the methods in Example 7 herein for this structure.

Results

The 10-Mer MAGEB2 Peptide Binds in the Peptide Binding Groove of the MHC

Crystal Structure of pMHC:N3H

Coordinates are provided in Table 8.

The crystal structure of MAGEB2 pMHC:N3H has been determined at 1.76 Å. From the extracted pMHC coordinate file, the interactions of the MAGEB2 peptide to the MHC was determined to occupy the full peptide binding cleft in the MHC with the N- and C-terminal end of the peptide buried into the ends of the peptide cleft and the residues picking up several interactions across this peptide binding region.

The following is a list of residues involved in the interaction interface between the MHC and the peptide.

The core residues on HLA-A02 interaction interface with MAGEB2 peptide:

Met5, Tyr7, Phe9, Met45, Glu63, Arg65, Lys66, Val67, Ala69, His70, Thr73, Val76, Asp77, Thr80, Leu81, Tyr84, Arg97, Tyr99, Glu116, Tyr123, Ile124, Thr143, Lys146, Trp147, Ala150, Val152, Gln155, Leu156, Tyr159, Thr163, Trp167, and Tyr171.

The core residues on MAGEB2 interaction interface with HLA-A02 MHC:
Gly1, Val2, Tyr3, Asp4, Gly5, Glu6, Glu7, His8, Ser9 and Val10.

The following is a list of intermolecular bonded interactions between the MHC and the peptide.

The pairs of residues involved in intermolecular salt bridges and the distance cut-off as determined by PISA in angstroms (Å) are shown below in Table 9:

TABLE 9

| HLA-A02 MHC | MAGEB2 peptide | Length (in Å) |
|---|---|---|
| Arg65 NH1 | Asp4 OD1 | 3.2 |
| Arg65 NH1 | Asp4 OD2 | 3.9 |
| Arg65 NH2 | Asp4 OD2 | 3.5 |
| His70 ND1 | Glu7 OE1 | 2.9 |
| His70 ND1 | Glu7 OE2 | 4.0 |
| Lys146 NZ | Val10 O | 2.8 |
| Lys146 NZ | Val10 OXT | 3.8 |

The pairs of residues involved in intermolecular Hydrogen bonding and the distance cut-off as determined by PISA (in Å) are shown in Table 10:

TABLE 10-A

| HLA-A02 MHC | MAGEB2 peptide | Length (in Å) |
|---|---|---|
| Tyr159 OH | Gly1 O | 2.6 |
| Lys66 NZ | Val2 O | 2.9 |
| Gln155 NE2 | Glu6 OE2 | 2.8 |
| His70 N | Glu7 OE1 | 3.5 |
| Thr73 OG1 | Glu7 OE2 | 2.7 |
| Lys146 NZ | Ser9 OG | 3.7 |
| Tyr84 OH | Val10 OXT | 2.7 |
| Thr143 OG1 | Val10 OXT | 2.8 |
| Tyr171 OH | Gly1 N | 2.6 |
| Glu63 OE2 | Val2 N | 2.9 |
| Tyr99 OH | Tyr3 N | 3.0 |
| Gln155 OE1 | His8 NE2 | 2.8 |
| Asp77 OD1 | Val10 N | 2.9 |

Specificity of MAGEB2 Peptide to this HLA-A02 Vis-à-Vis Other HLA-A02 Subtypes

The table 1013 below summarizes some of the residue position changes in other HLA-A02 subtypes as identified from our analyses.

TABLE 10-B

| HLA-A02 residue | variant residues in other subtypes | Residue number (as in Structure) |
|---|---|---|
| F33 | Y33 | F9 |
| Q67 | R67 | Q43 |
| K90 | N90 | K66 |
| T97 | I97 | T73 |
| H98 | D98 | H74 |
| V119 | L119 | V95 |
| R121 | M121 | R97 |
| Y123 | C123, F123 | Y99 |
| W131 | G131 | W107 |
| Y140 | F140 | Y116 |
| K151 | N151 | K127 |
| A173 | T173 | A149 |
| V176 | E176 | V152 |
| L180 | W180 | L156 |
| A260 | E260 | A236 |

Figure 13B:
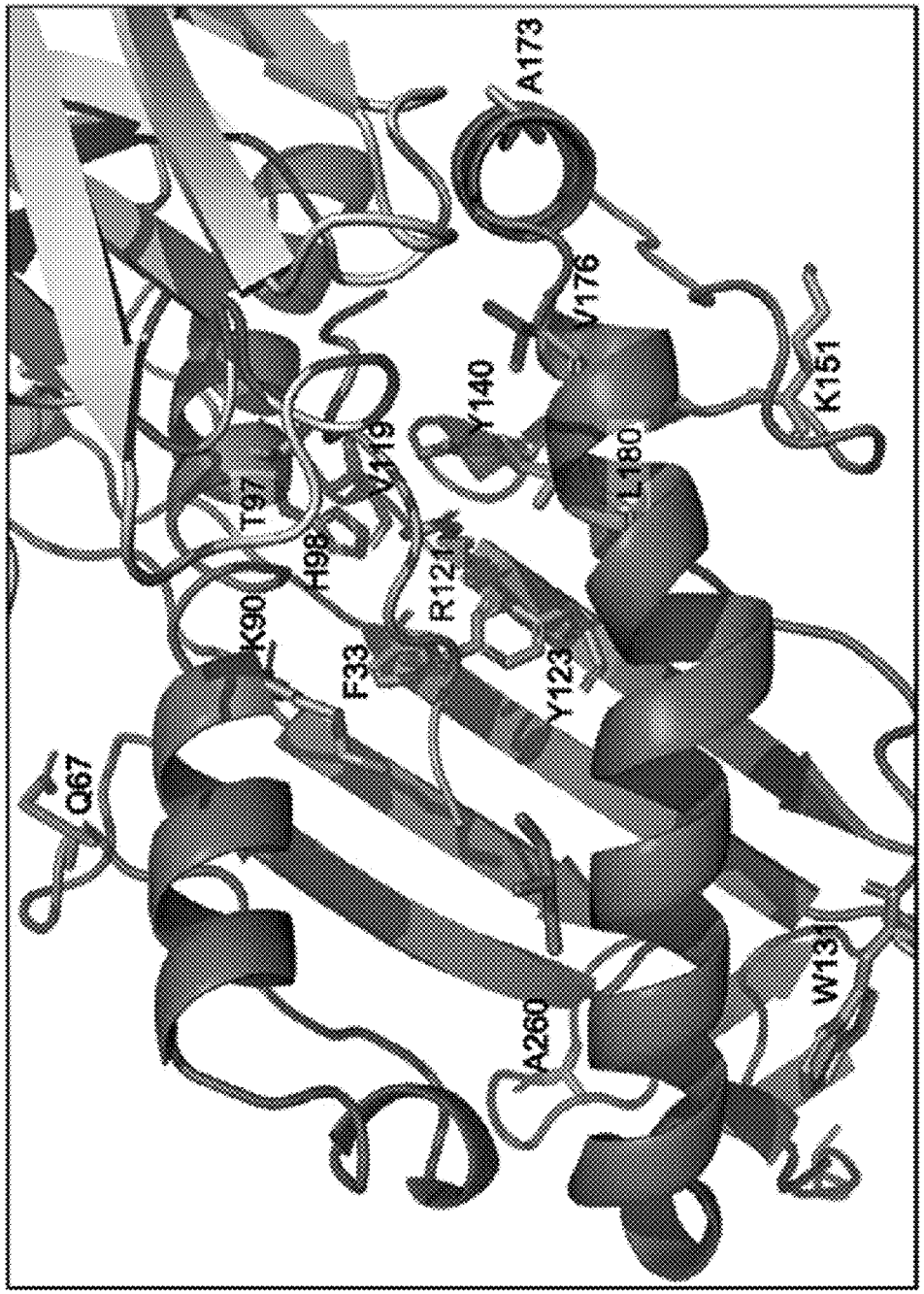

FIG. 13A shows the MAGEB2 peptide-MHC interactions. FIG. 13B shows the positions of variant residues in other HLA-A02 subtypes. From analyses of the structure examples (7, 8 and 9) and an in silico mutation analyses with the variant residues for each of the HLA-A02 subtype using PyMOL1, it seems to be highly likely that MAGEB2 peptide would be able to bind to most, if not all, of these subtypes in what is a fairly conserved binding pocket.

Conclusion

The MAGEB2 peptide makes canonical interactions with the HLA-A02 MHC in the peptide binding groove of MHC class I that is used for peptide binding and recognition. The peptide binds by burying its NH2- and —COOH terminal ends into the two ends of the peptide groove and picking up key H-bonding and hydrophobic interactions with MHC, which is purported to account for the high affinity of binding and diversity of peptides that bind to class I MHC4. The MAGE-B2 10-mer peptide is one amino acid longer vis-à-vis the 9-mer peptides that mostly bind, and the longer peptide is accommodated in the same groove by bulging out the center part of the peptide from the pocket5,6. The other interactions of the peptide with the MHC are through bonded, hydrophobic and van der Waals interactions with the peptide core residues and its backbone to core residues in the MHC binding groove as listed above.

Methods

Reference the methods section in Example 7.

Structure Analyses

A free state structure of the MAGEB2 peptide bound MHC in the absence of BiTE® binders was not attempted. In order to determine the interaction residues between MAGEB2 peptide and HLA-A02 MHC, the pMHC coordinates was extracted from the pMHC:N3H structure in PyMOL1 and this extracted coordinate file (pMHC only) was subject to extensive interface analyses using PISA2 (CCP4i3 package) as well as visual structure analyses using PyMOL. The core interaction interface amino acids were determined as being all amino acid residues with at least one atom less than or equal to 5 Å from the pMHC protein. The 5 Å core region cut-off distance allowed both atoms within a van der Waals radius and potential water-mediated hydrogen bonds in addition to hydrogen bonds, salt bridges and hydrophobic interactions. Furthermore, specific residue pairs from these core residues that are involved in electrostatic salt bridges or hydrogen bonding between the MHC and peptide (intermolecular interaction) with distances were also obtained from PISA and verified in PyMOL.

BIBLIOGRAPHY

1. DeLano, W. L. The PyMOL Molecular Graphics System. (Palo Alto, 2002).
2. Krissinel E, Henrick K. Interface of macromolecular assemblies from crystalline state. J Mol Biol. September 21; 372(3):774-97 (2007).
3. CCP4. The CCP4 suite: programs for protein crystallography. Acta Crystallogr D Biol Crystallogr 50, 760-3 (1994).
4. Fremont D H, Matsumura M, Stura E A, Peterson P A, Wilson I A. Crystal structures of two viral peptides in complex with murine MHC class I H-2Kb. Science 257 (5072):919-27 (1992).
5. Guo H C, Jardetzky T S, Garrett T P, Lane W S, Strominger J L, Wiley DC. Different length peptides bind to HLA-Aw68 similarly at their ends but bulge out in the middle. Nature 360(6402):364-66 (1992).

6. Tynan F E, et al. T cell receptor recognition of a 'super-bulged' major histocompatibility complex class I-bound peptide. Nat Immunol 6(11):1114-22 (2005).

Example 7: Crystal Structure and Interaction Identification of the MAGEB2 Peptide/HLA-A02 MHC/Family 4 L7E BiTE® scFv Complex Introduction Bi-specific T-cell engagers (BiTE®) specific to MAGEB2 peptide (p) bound HLA-A02 major histocompatibility complex (MHC) through engaging specific HLA interactions enabling MAGEB2 recognition were successfully generated. The following Examples 7, 8 and 9 describe how the crystal structures were obtained and the interactions that the family 4 BiTE® molecules make in order to identify and engage this pMHC specifically were defined.

Results

L7E scFv Heavy Chain Makes Direct Interactions with MAGEB2 Peptide, Light Chain Makes HLA and MAGEB2 Interactions to Identify and Engage this Complex Coordinates are provided in Table 11.

The crystal structure of MAGEB2 pMHC:L7E has been determined at 1.9 Å. The scFv interactions with MAGEB2 peptide are from the heavy chain CDRs: CDR1, CDR2, CDR3 and the light chain CDR3. The light chain also interacts with HLA residues on the a-helix that form a part of the peptide binding groove to stabilize the molecule and this interaction.

Figure 14:
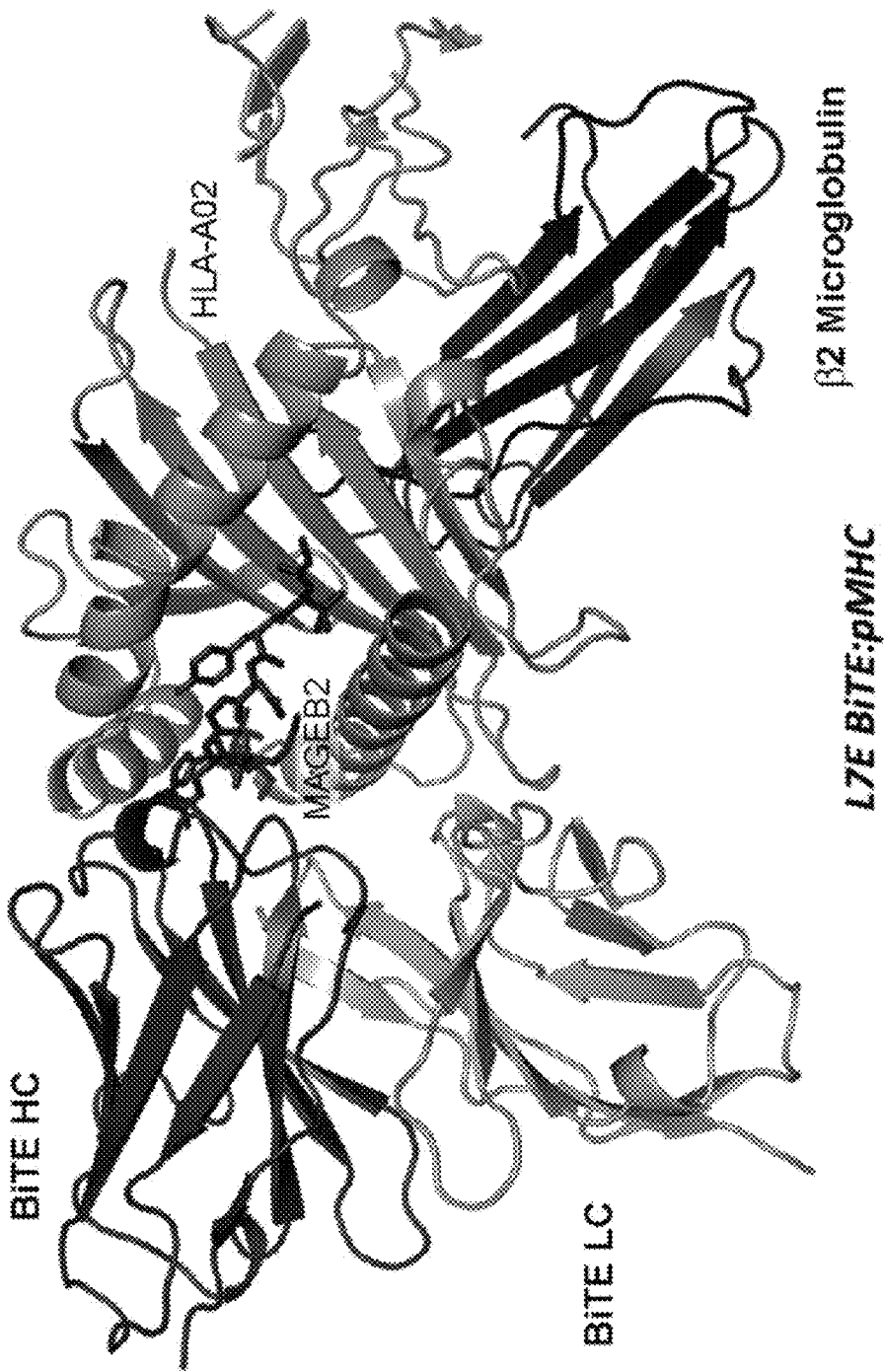
FIG. 14. This figure depicts the structure of the Family 4 L7E scFv SEQ115734 bound mage-b2 HLA-A: overall structure at 1.9 Å.
Figure 15:
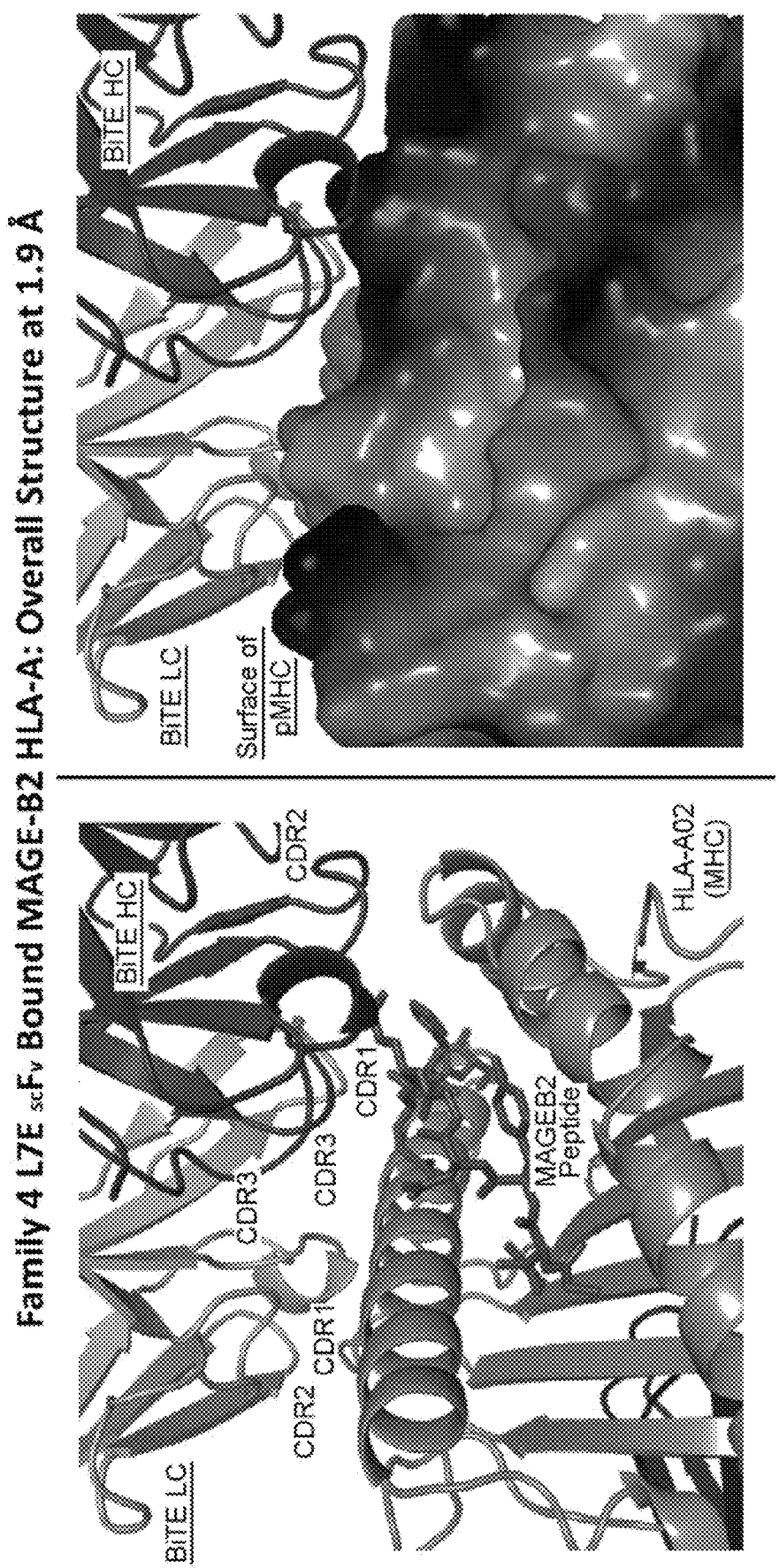
FIG. 15. This figure depicts the structure of the Family 4 L7E scFv SEQ115734 bound mage-b2 HLA-A: overall structure at 1.9 Å, with the left panel highlighting CDR interactions with the MAGEB2 peptide and MHC, and the right panel highlighting light chain (LC) and heavy chain (HC) interactions with the MHC.
Figure 16:
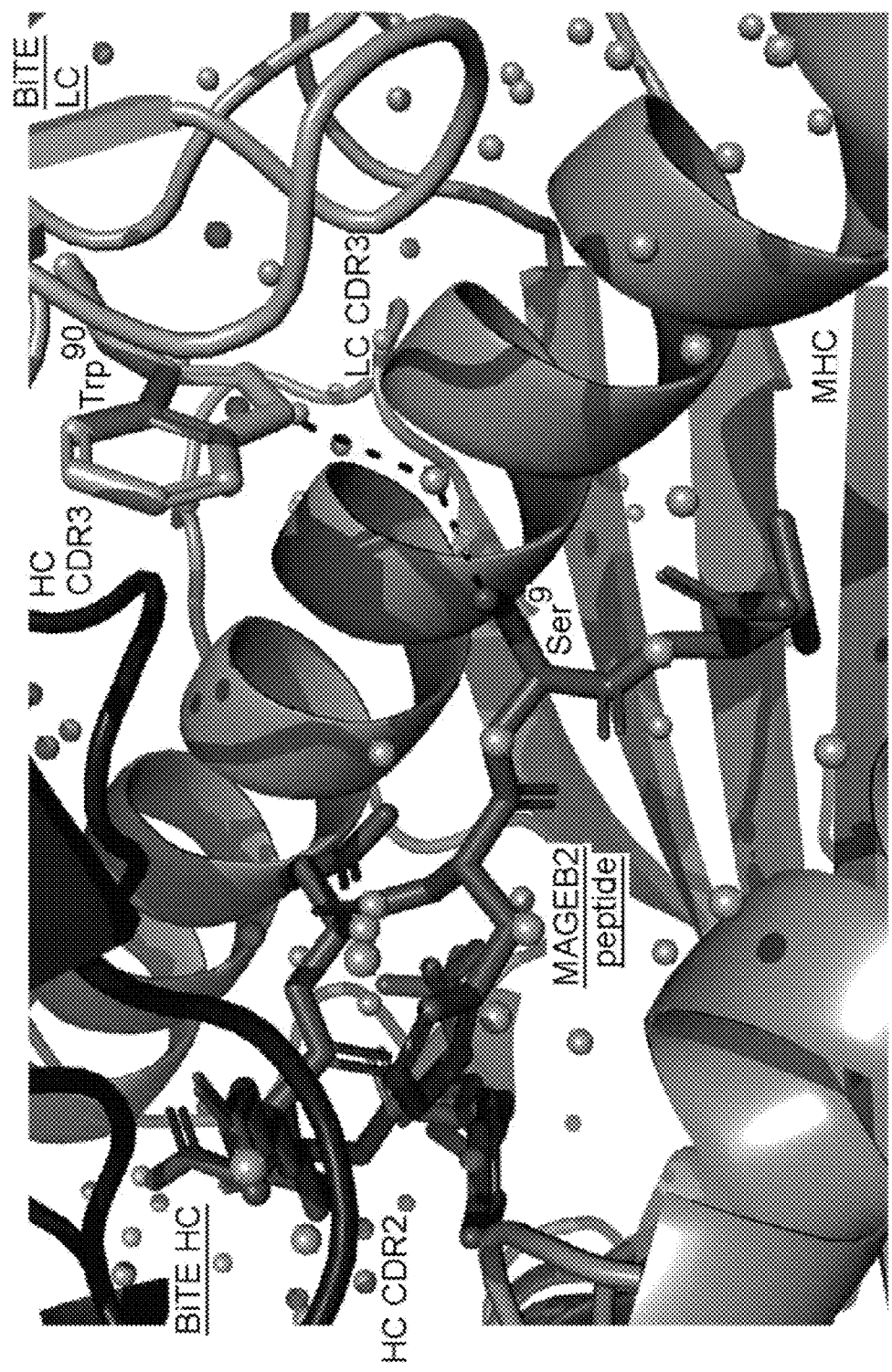
FIG. 16. This figure depicts the structure of the Family 4 L7E scFv SEQ115734 bound MAGEB2 HLA-A: overall structure at 1.9 Å and certain water-mediated interactions.

The representations in FIGS. 14-16 show the key regions of the BiTE® and the surface of pMHC to capture the interacting interface of these molecules.

The core pMHC amino acid residues of the interaction interface with L7E were defined as pMHC residues that are within 5 Å of the L7E scFv BiTE®, listed below.

MHC interaction with heavy chain (HC): Arg65, Lys66, Ala69, Gln72, Thr73, Val76, Lys146, Ala149, Ala150, His151, Gln155.

MHC interaction with light chain (LC): Gly16, Arg17, Gly18, Glu19, Gln43, Arg65, Lys68, Ser71, Gln72, Arg75, Val76, Gly79, Thr80, Arg82, Gly83, Glu89, Lys146

MAGEB2 interaction with HC: Asp4, Gly5, Glu6, Glu7, His8, Ser9

MAGEB2 interaction with LC: Ser9

The core L7E scFv BiTE® amino acid residues of the interaction interface with pMHC were defined as L7E residues that are within 5 Å of the pMHC, listed below.

L7E HC interaction with MHC: Ser30, Ser31, Ser52, Gly53, Ser54, Gly56, Gly57, Tyr59, Lys100, Val102, His103, Leu104, Gly105

L7E LC interaction with MHC: Asn25, Asn26, Gly28, Ser29, Lys30, Ser31, His33, Tyr48, Asp49, Asp50, Asn51, Asp52, Asn65, Phe66, Gly67, Trp90, Tyr92, Arg93, Leu95

L7E HC interaction with MAGEB2: Ser30, Ser31, His32, Ala33, Ser52, Gly53, Ser54, Lys100, Gly101, Val102, His103, Leu104

L7E LC interaction with MAGEB2: Trp90

The following is a list of intermolecular bonded interactions between the pMHC and the family 4 L7E BiTE®. The pairs of residues involved in intermolecular salt bridges and the distance cut-off as determined by PISA in angstroms (Å) are shown in Table 12:

TABLE 12

| pMHC | L7E BiTE ® | Length (in Å) |
|---|---|---|
| p: Asp4 OD1 | HC: Lys100 NZ | 3.2 |
| MHC: Arg75 NH1 | LC: Asp49 OD1 | 2.8 |
| MHC: Arg75 NH1 | LC: Asp50 OD1 | 3.8 |
| MHC: Arg75 NH2 | LC: Asp50 OD2 | 3.1 |
| MHC: Arg75 NH1 | LC: Asp50 OD2 | 2.7 |
| MHC: Lys68 NZ | LC: Asp52 OD1 | 2.9 |

The pairs of residues involved in intermolecular Hydrogen bonding and the distance cut-off as determined by PISA (in Å) are shown in Table 13:

TABLE 13

| pMHC | L7E BiTE ® | Length (in Å) |
|---|---|---|
| p: Asp4 O | HC: Lys100 NZ | 2.9 |
| p: Gly5 O | HC: Lys100 NZ | 3.0 |
| p: Glu6 OE1 | HC: Gly53 N | 2.7 |
| p: Glu7 N | HC: Lys100 O | 2.9 |
| p: Ser9 OG | LC: Trp 90 NE1 | 2.7/2.9* |
| MHC: Thr73 OG1 | HC: His103 NE2 | 2.8 |
| MHC: Ala149 O | HC: Ser54 OG | 3.5 |
| MHC: Arg75 NH2 | LC: Gly28 O | 2.8 |
| MHC: Arg75 NH1 | LC: Ser31 OG | 3.7 |
| MHC: Arg82 NH2 | LC: Tyr 92 OH | 3.3 |

*analysis in PyMOL. This is a notable water-mediated interaction. Not all water-mediated interactions are specifically denoted.

Conclusions

The L7E BiTE® molecule makes notable interactions with both the peptide and HLA-A02 MHC through both the HC and LC of the BiTE®. The LC of family 4 L7E BiTE® make notable interactions on the MHC surface that seems to position the L7E HC for recognition of MAGEB2 peptide.

Methods

Purification, Complex Formation of pMHC and Family 4 BiTE® scFv and Crystallization The L7E scFv BiTE® molecule was recombinantly over-expressed in mammalian cells and purified using affinity chromatography and SEC to yield a monomeric peak. The HLA-A02 (MHC) was over-expressed in E. coli and refolded and purified in the presence of MAGE-B2 peptide to generate the pMHC complex.

The ~25 kDa scFv BiTE® and the ~47 kDa pMHC was mixed in 1.2:1 molar ratio and the resultant pMHC complex was separated by size exclusion chromatography. This highly purified pMHC complex was concentrated and subject to sitting drop vapor diffusion crystallization trials. Crystals of pMHC:L7E was obtained in 0.1M MES monohydrate pH 6.5, 12% PEG20000.

Data Collection and Structure Determination and Analyses

Data for this structure was collected from a single crystal, flash-frozen at 100K in the presence of 20% glycerol in respective crystallization mother liquor, at the Advanced Light Source (ALS, Lawrence Berkeley National Laboratory) at beamline 5.0.1. All data were processed using DENZO1 or Mosflm2 and Aimless (CCP4i3 package).

L7E complex crystals grew in the P22121 space group with the unit cell dimensions of a=44.208, b=108.086, c=163.569 Å and α=β=γ=90° C., with a single complex per asymmetric unit and diffracted to 1.9 Å resolution. The structure of pMHC:L7E was solved by molecular replacement with the program PHASER4 using an ensemble of the published 1HLA MHC structure5 and a model structure for scFv generated internally using Schrödinger6 as the starting search model. Following initial refinement using Phenix7, the pMHC, β2 microglobulin domain and scFv chains were manually corrected for best fit in density as much as possible with Coot8. The overall structure improved with iterative rounds of manual model building and refinement using Phenix.

The complex structures were subject to rigorous quaternary structural analyses, interface analyses and distance measurements. The core interaction interface amino acids were determined as being all amino acid residues with at least one atom less than or equal to 5 Å from the pMHC protein. The 5 Å core region cut-off distance allowed both atoms within a van der Waals radius and potential water-mediated hydrogen bonding. All amino acids meeting the distance criterion were further analyzed using PyMOL9 and the interface residues were obtained from the interface and quaternary structure analyses program PISA10 (CCP4i package) using the respective completed structure as input files.

Sequence Alignment and Analyses

The family 4 scFv BiTE® sequences used in structure determination were multiple sequence aligned for comparison using geneious11 software. The resulting alignment was annotated using the structural data.

Sequences of the pMHC and L7E scFv BiTE®

```
pMHC
>HLA_A02
                                      (SEQ ID NO: 18454)
MGSHSMRYFFTSVSRPGRGEPRFIAVGYVDDTQFV

RFDSDAASQRMEPRAPWIEQEGPEYWDGETRKVKA

HSQTHRVDLGTLRGYYNQSEAGSHTVQRMYGCDVG

SDWRFLRGYHQYAYDGKDYIALKEDLRSWTAADMA

AQTTKHKWEAAHVAEQLRAYLEGTCVEWLRRYLEN

GKETLQRTDAPKTHMTHHAVSDHEATLRCWALSFY

PAEITLTWQRDGEDQTQDTELVETRPAGDGTFQKW

AAVVVPSGQEQRYTCHVQHEGLPKPLTLRWEP

>MAGEB2peptide
                                      (SEQ ID NO: 1)
GVYDGEEHSV
>β2microglobulin
                                      (SEQ ID NO: 18455)
MIQRTPKIQVYSRHPAENGKSNFLNCYVSGFHPSD

IEVDLLKNGERIEKVEHSDLSFSKDWSFYLLYYTE

FTPTEKDEYACRVNHVTLSQPKIVKWDRDM scFv BiTE®
(L7E)
                                      (SEQ ID NO: 18456)
EVQLLESGGGLVQPGGSLRLSCAASGFTFSSHAMS

WVRQAPGKCLEWVSTISGSGGGTYYAASVKGRFTI

SRDNSKNTLYLQMNSLRAEDTAVYYCATGKGVHLG

FDYWGQGTLVTVSSGGGGSGGGGSGGGGSSYVLTQ

PPSVSVAPGQTARITCGGNNIGSKSVHWYQQKPGQ

APVMVVYDDNDRPSGIPERFSGSNFGNTATLIISR

VEAGDEADYYCQVWDYRTLDWVFGCGTKLTVLG
```

Example 7

BIBLIOGRAPHY 1. a. Z. Otwinowski and W. Minor, "Processing of X-ray Diffraction Data Collected in Oscillation Mode", Methods in Enzymology, Volume 276: Macromolecular Crystallography, part A, p. 307-326, 1997, C. W. Carter, Jr. & R. M. Sweet, Eds., Academic Press.
   b. Until 1988 Denzo and Scalepack were developed at the University of Chicago, from 1989 through 1994 at Yale University, and currently at the University of Texas, Southwestern Medical Center at Dallas.
2. T. G. G. Battye, L. Kontogiannis, O. Johnson, H. R. Powell and A. G. W. Leslie. IMosflm: a new graphical interface for diffraction-image processing with MOSFLM. Acta Cryst. D67, 271-81 (2011).
3. CCP4. The CCP4 suite: programs for protein crystallography. Acta Crystallogr D Biol Crystallogr 50, 760-3 (1994).
4. a. Storoni L C, McCoy A J, Read R J. Likelihood-enhanced fast rotation functions. Acta Crystallogr D Biol Crystallogr. 2004 March; 60(Pt 3):432-8.
   b. McCoy A J, Grosse-Kunstleve R W, Storoni L C, Read R J. Likelihood-enhanced fast translation functions. Acta Crystallogr D Biol Crystallogr. 2005 April; 61(Pt 4):458-64.
5. Bjorkman P J, Saper M A, Samraoui B, Bennett W S, Strominger J L, Wiley DC. The foreign antigen binding site and T cell recognition regions of class I histocompatibility antigens. Nature. 1987 Oct. 8-14; 329(6139): 512-8.
6. a. (https://www.schrodinger.com/).
   b. Zhu, K, Day, T, Warshaviak, D, Murrett, C, Friesner, R, Pearlman, D. Antibody structure determination using a combination of homology modeling, energy-based refinement, and loop prediction," Proteins. 2014, 82(8):1646-55.
7. Adams P D, Grosse-Kunstleve R W, Hung L W, Ioerger T R, McCoy A J, Moriarty N W, Read R J, Sacchettini J C, Sauter N K, Terwilliger T C. PHENIX: building new software for automated crystallographic structure determination. Acta Crystallogr D Biol Crystallogr. 2002 November; 58(Pt 11):1948-54.
8. Emsley P, Cowtan K. Coot: model-building tools for molecular graphics. Acta Crystallogr D Biol Crystallogr. 2004 December; 60(Pt 12 Pt 1):2126-32.
9. DeLano, W. L. The PyMOL Molecular Graphics System. (Palo Alto, 2002).
10. Krissinel E, Henrick K. Interface of macromolecular assemblies from crystalline state. J Mol Biol. September 21; 372(3):774-97 (2007).
11. Geneious (https://www.geneious.com/)

Example 8: Crystal Structure and Interaction Identification of the MAGEB2 Peptide/HLA-A02 MHC/Family 4 BiTE® H6N scFv Complex Introduction As described in Example 7.

Results

H6N scFv Heavy Chain Makes Direct Interactions with MAGEB2 Peptide, Light Chain Makes HLA and MAGEB2 Interactions to Identify and Engage this Complex Coordinates are provided in Table 14.

Figure 17:
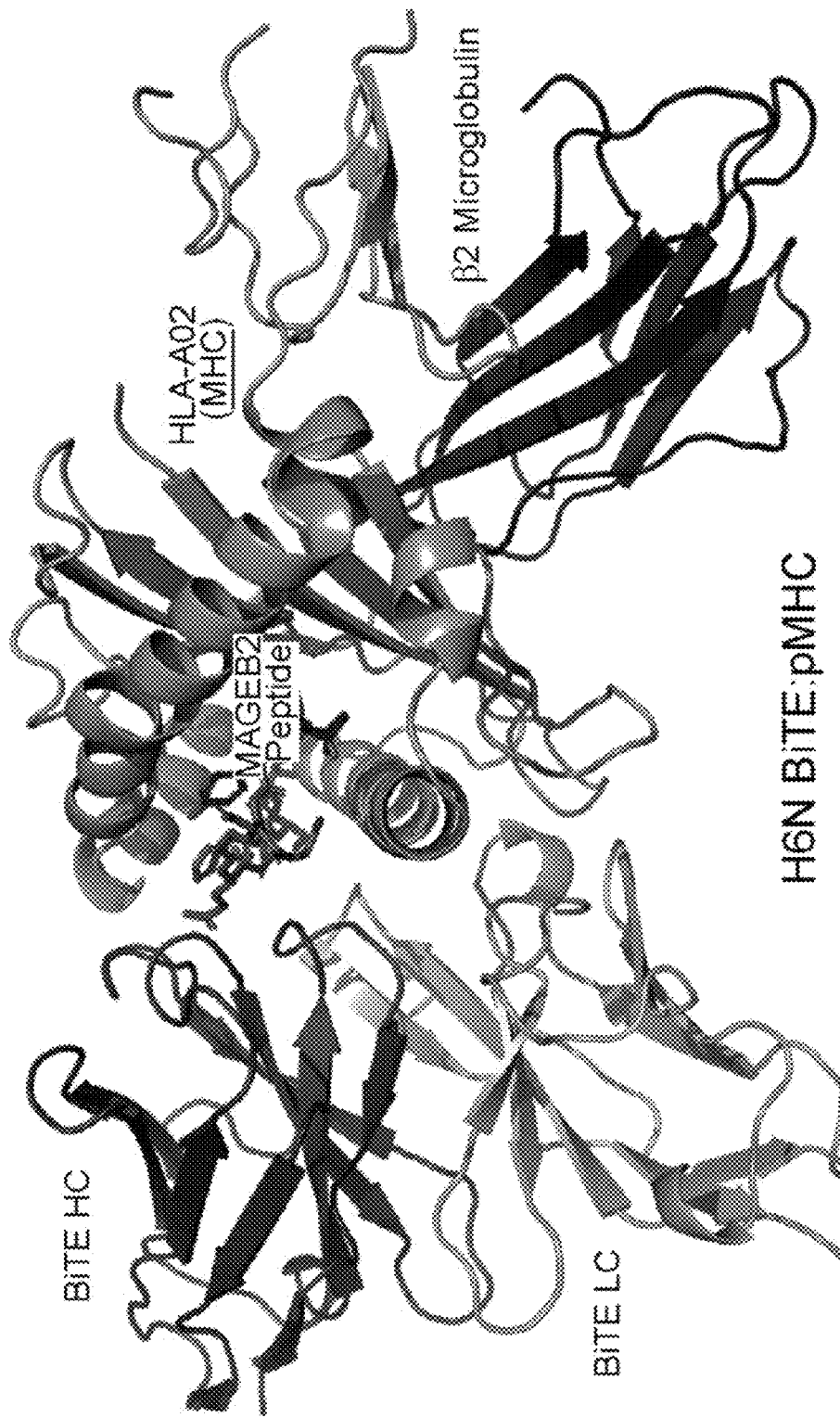
FIG. 17. This figure depicts the structure of the H6N scFv heavy chain (HC) interactions with the MAGEB2 peptide, and H6N scFv light chain (LC) interactions with the HLA and the MAGEB2 peptide.

The crystal structure of MAGEB2 pMHC: H6N (shown in FIG. 17) has been determined at 1.96 Å. The H6N interactions with pMHC are similar to the family 4 L7E structure in Example 7. The H6N residue Asp62 in HC (Ala62 in L7E), potentially contributes to an energetically favorable LC CDR3 interaction as seen from the H6N secondary structure conformation in this region vis-à-vis L7E.

Figure 18:
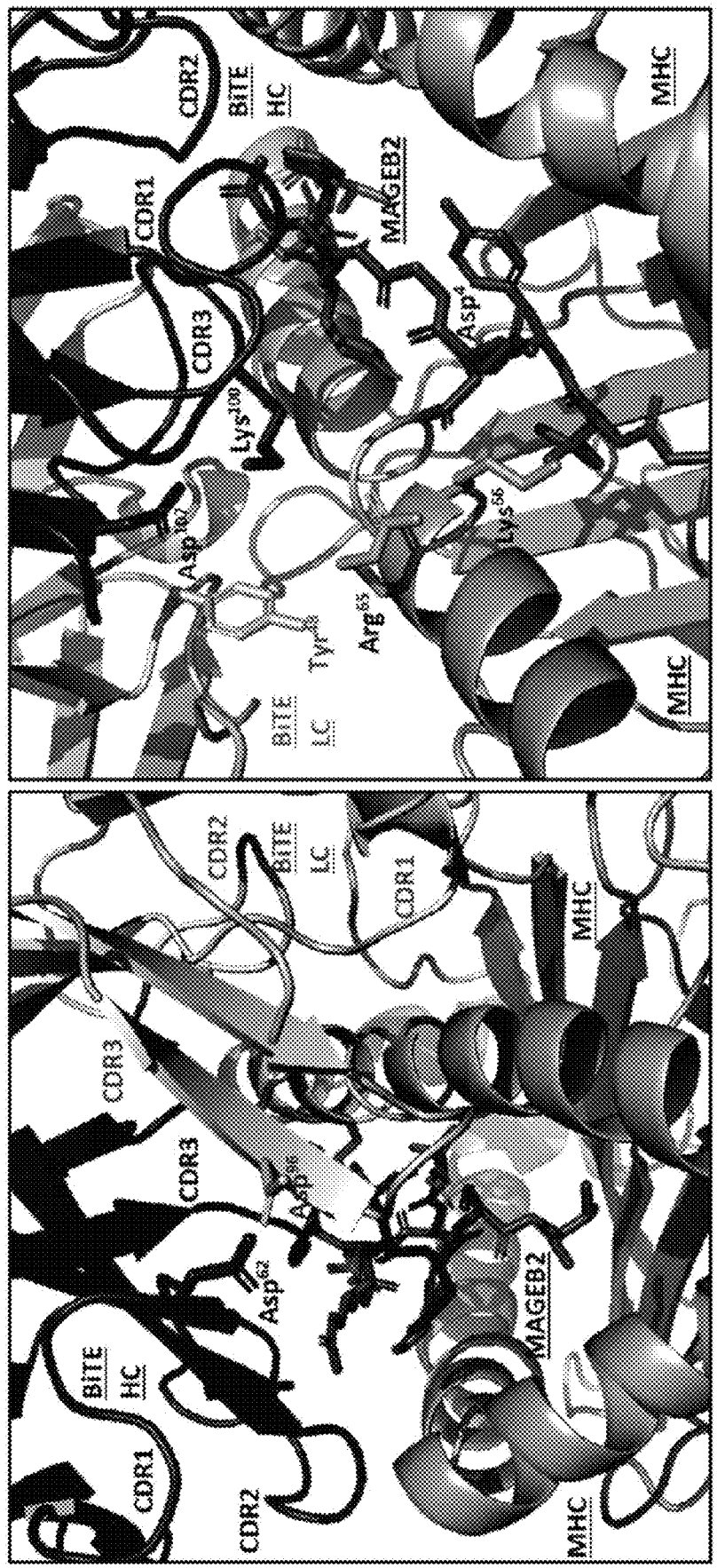
FIG. 18. This figure depicts the structure of the H6N scFv heavy chain (HC) interactions with the MAGEB2 peptide, and the H6N scFv light chain (LC) interactions with the HLA and the MAGEB2 peptide.
Figure 19:
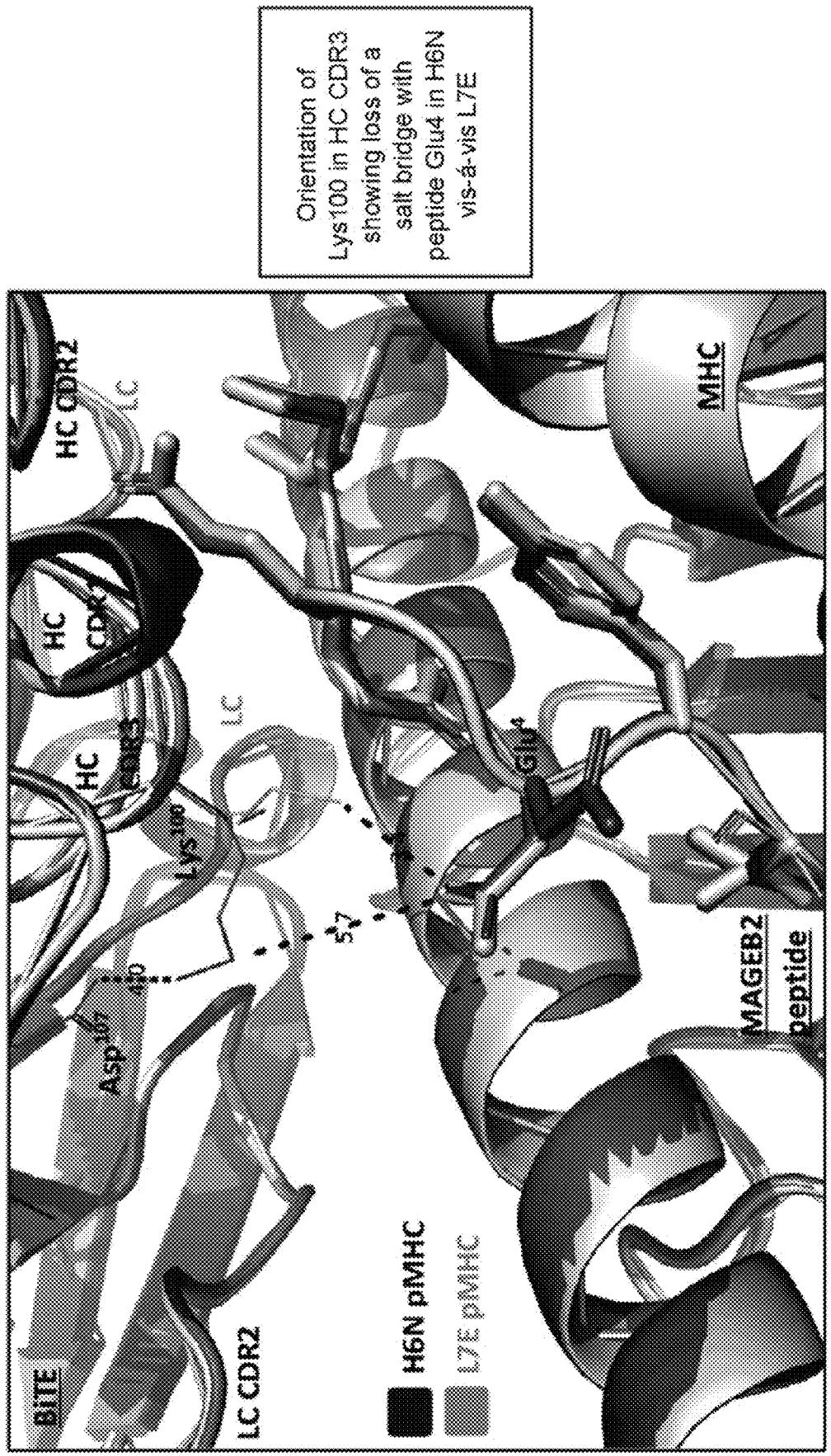
FIG. 19. This figure depicts the structure of the H6N scFv heavy chain (HC) interactions with the MAGEB2 peptide, and the H6N scFv light chain (LC) interactions with the HLA and the MAGEB2 peptide.
Figure 20:
FIG. 20. This figure depicts the structure of the H6N scFv heavy chain (HC) interactions with the MAGEB2 peptide, and the H6N scFv light chain (LC) interactions with the HLA and the MAGEB2 peptide.

The 2 panel representations in FIG. 18 show the key differences of the H6N BiTE® vis-à-vis L7E from Example 7. Left panel shows Asp62 which could form a stabilizing interaction of LC CDR2 and the right panel shows a different conformation for Lys100 in HC CDR3. FIGS. 19 and 20 show additional structural features of H6N and its interactions with the pMHC (pMAGE-HLA).

The core pMHC amino acid residues of the interaction interface with H6N were defined as pMHC residues that are within 5 Å of the H6N scFv BiTE®, listed below. The vast majority of H6N interactions show similarity with L7E showcasing common motifs of family 4 scFv and similar molecular basis for MAGEB2 recognition.

MHC interactions with heavy chain (HC): Arg65, Ala69, Gln72, Thr73, Val76, Lys146, Ala149, Ala150, His151, Glu154, Gln155.

MHC interactions with light chain (LC): Gly16, Arg17, Gly18, Glu19, Pro20, Gln43, Arg65, Lys68, Ser71, Gln72, Arg75, Val76, Gly79, Thr80, Arg82, Gly83, Glu89, Lys146

MAGEB2 interactions with HC: Asp4, Gly5, Glu6, Glu7, His8, Ser9

MAGEB2 interactions with LC: Ser9

The core H6N scFv BiTE® amino acid residues of the interaction interface with pMHC were defined as H6N residues that are within 5 Å of the pMHC, listed below.

H6N HC interactions with MHC: Ser30, Ser31, Ser52, Gly53, Ser54, Gly56, Gly57, Tyr59, Lys100, Val102, His103, Leu104, Gly105

H6N LC interactions with MHC: Asn25, Asn26, Gly28, Ser29, Lys30, Ser31, His33, Tyr48, Asp49, Asp50, Asn51, Asp52, Arg53, Asn65, Phe66, Gly67, Trp90, Tyr92, Arg93, Leu95

H6N HC interactions with MAGEB2: Ser30, Ser31, His32, Ala33, Ser52, Gly53, Ser54, Lys100, Gly101, Val102, His103, Leu104

H6N LC interactions with MAGEB2: Trp90

The following is a list of intermolecular bonded interactions between the pMHC and the family 4 H6N BiTE®.

The pairs of residues involved in intermolecular salt bridges and the distance cut-off as determined by PISA in angstroms (Å) are shown in Table 15:

TABLE 15

| pMHC | H6N BiTE® | Length (in Å) |
| --- | --- | --- |
| MHC: Arg75 NH1 | LC: Asp49 OD1 | 2.9 |
| MHC: Arg75 NH1 | LC: Asp50 OD1 | 3.8 |
| MHC: Arg75 NH2 | LC: Asp50 OD1 | 3.9 |
| MHC: Arg75 NH1 | LC: Asp50 OD2 | 2.9 |
| MHC: Arg75 NH2 | LC: Asp50 OD2 | 3.2 |
| MHC: Lys68 NZ | LC: Asp52 OD1 | 3.0 |

The pairs of residues involved in intermolecular Hydrogen bonding and the distance cut-off as determined by PISA (in Å) are shown in Table 16:

TABLE 16

| pMHC | H6N BiTE® | Length (in Å) |
| --- | --- | --- |
| p: Glu6 OE1 | HC: Gly53 N | 2.8 |
| p: Glu7 N | HC: Lys100 O | 2.9 |
| p: Ser9 OG | LC: Trp 90 NE1 | 2.7/2.9* |

TABLE 16-continued

| pMHC | H6N BiTE® | Length (in Å) |
| --- | --- | --- |
| MHC: Thr73 OG1 | HC: His103 NE2 | 2.7 |
| MHC: Ala149 O | HC: Ser54 OG | 3.6 |
| MHC: Glu89 OE1 | LC: Asp26 ND2 | 2.6 |
| MHC: Arg75 NH2 | LC: Gly28 O | 2.9 |
| MHC: Arg75 NH2 | LC: Lys30 O | 3.4 |
| MHC: Arg75 NH1 | LC: Ser31 OG | 3.7 |
| MHC: Arg82 NH2 | LC: Tyr 92 OH | 3.3 |

*analysis in PyMOL. This is a notable water-mediated interaction. Not all water-mediated interactions are specifically denoted.

Conclusions

The H6N BiTE® molecule makes notable interactions with both the peptide and HLA-A02 MHC through both the HC and LC of the BiTE®. The LC of family 4 H6N BiTE® make notable interactions on the MHC surface that seems to poise the H6N HC for key recognition of MAGEB2 peptide. Subtle differences although exist in recognition between the L7E and H6N BiTE® as indicated above. The positioning and recognition of HLA-A02 MHC by the LC of family 4 BiTE® molecules is a key characteristic (tables here and Example 7).

Methods

Purification, Complex Formation of pMHC and H6N BiTE® scFv and Crystallization

The scFv BiTE® molecule H6N was recombinantly overexpressed in *E. coli* as inclusion bodies, refolded and purified by ion-exchange chromatography. The HLA-A02 (MHC) was over-expressed in *E. coli* and refolded and purified in the presence of MAGE-B2 peptide to generate the pMHC complex.

The ~25 kDa scFv BiTE® and the ~47 kDa pMHC was mixed in 1.2:1 molar ratio and the resultant pMHC complex was separated by size exclusion chromatography. This highly purified pMHC complex was concentrated and subject to sitting drop vapor diffusion crystallization trials. Crystals of pMHC: H6N was obtained in 0.1M MES monohydrate pH 6.5, 15% PEG6000, 5% MPD.

Data Collection and Structure Determination and Analyses

Data for this structure was collected from a single crystal, flash-frozen at 100K in the presence of 20% glycerol in respective crystallization mother liquor, at the Advanced Light Source (ALS, Lawrence Berkeley National Laboratory) at beamline 5.0.2. Data was processed using DENZO1 or Mosflm2 and Aimless (CCP4i3 package).

Crystals of H6N complex grew in the P22121 space group with the unit cell dimensions of a=44.068, b=106.329, c=162.508 Å and α=β=γ=90° C., with a single complex per asymmetric unit and diffracted to 1.96 Å resolution. The structure was solved by molecular replacement with the program PHASER4 using the previously solved pMHC:L7E structure (Example 7) as the starting search model. Following initial refinement using Phenix7, the pMHC, β2 microglobulin domain and scFv chains were manually corrected for best fit in density as much as possible with Coot8. The overall structure improved with iterative rounds of manual model building and refinement using Phenix.

The structure was subject to rigorous quaternary structural analyses, interface analyses and distance measurements. The core interaction interface amino acids were determined as being all amino acid residues with at least one atom less than or equal to 5 Å from the pMHC protein. The 5 Å core region cut-off distance allowed both atoms within a van der Waals radius and potential water-mediated hydrogen bonding. All amino acids meeting the distance criterion were further analyzed using PyMOL9 and the interface residues were obtained from the interface and quaternary structure analyses program PISA10 (CCP4i package) using the respective completed structure as input files.

Sequence Alignment and Analyses

As described in Example 7.

Sequences of the pMHC and H6N scFv BiTE® Used in the Structure

```
pMHC
>HLA_A
                              (SEQ ID NO: 18454)
MGSHSMRYFFTSVSRPGRGEPRFIAVGYVDDTQFV

RFDSDAASQRMEPRAPWIEQEGPEYWDGETRKVKA

HSQTHRVDLGTLRGYYNQSEAGSHTVQRMYGCDVG

SDWRFLRGYHQYAYDGKDYIALKEDLRSWTAADMA

AQTTKHKWEAAHVAEQLRAYLEGTCVEWLRRYLEN

GKETLQRTDAPKTHMTHHAVSDHEATLRCWALSFY

PAEITLTWQRDGEDQTQDTELVETRPAGDGTFQKW

AAVVVPSGQEQRYTCHVQHEGLPKPLTLRWEP

>MAGEB2peptide
                              (SEQ ID NO: 1)
GVYDGEEHSV

>β2microglobulin
                              (SEQ ID NO: 18455)
MIQRTPKIQVYSRHPAENGKSNFLNCYVSGFHPSD

IEVDLLKNGERIEKVEHSDLSFSKDWSFYLLYYTE

FTPTEKDEYACRVNHVTLSQPKIVKWDRDM scFv BiTE®
(H6N)
                              (SEQ ID NO: 18457)
EVQLLESGGGLVQPGGSLRLSCAASGFTFSSHAMS

WVRQAPGKCLEWVSTISGSGGGTYYADSVKGRFTI

SRDNSKNTLYLQMNSLRAEDTAVYYCATGKGVHLG

FDYWGQGTLVTVSSGGGGSGGGGSGGGGSSYVLTQ

PPSVSVAPGQTARITCGGNNIGSKSVHWYQQKPGQ

APVMVVYDDNDRPSGIPERFSGSNFGNTATLIISR

VEAGDEADYYCQVWDYRTLDWVFGCGTKLTVLG
```

BIBLIOGRAPHY

See Example 7.

Example 9: Crystal Structure and Interaction Identification of the MAGEB2 Peptide/HLA-A02 MHC/Family 4 BiTE® N3H scFv Complex Introduction As described in Example 7.

Results

N3H scFv Heavy Chain Makes Direct Interactions with MAGEB2 Peptide, Light Chain Makes HLA and MAGEB2 Interactions to Identify and Engage this Complex Coordinates are provided in Table 17.

Figure 21:
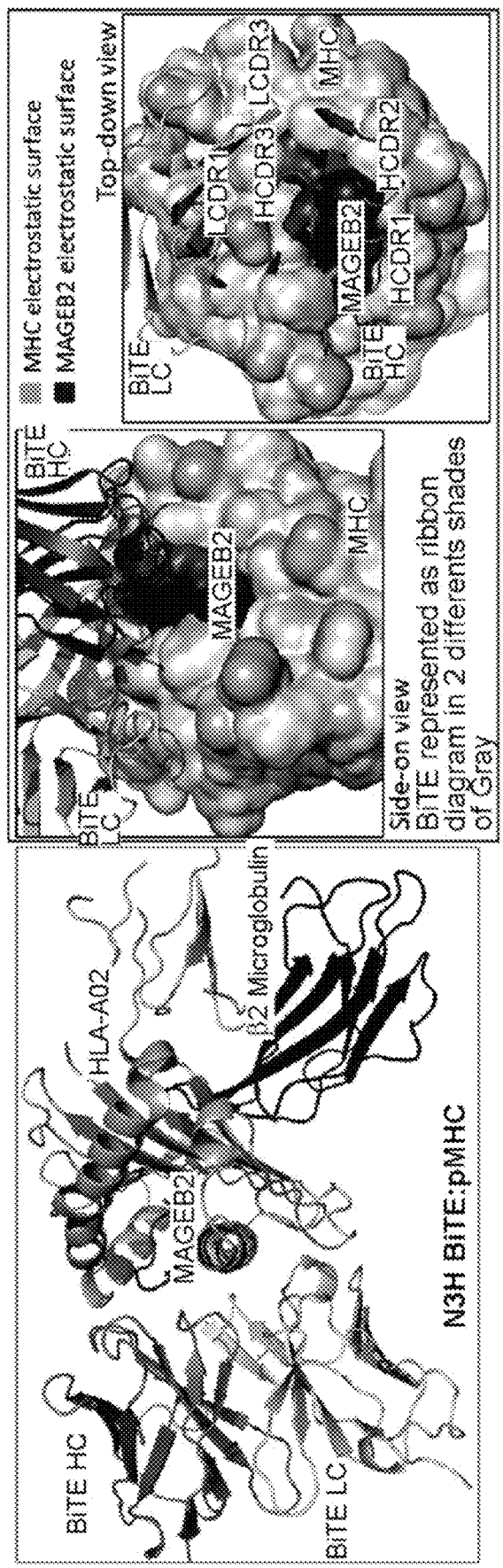
FIG. 21. This figure depicts the structure of the N3H scFv heavy chain (HC) interactions with the MAGEB2 peptide, and the N3H scFv light chain (LC) interactions with the HLA and the MAGEB2 peptide.

The crystal structure of MAGEB2 pMHC:N3H (shown in FIG. 21) has been determined at 1.76 Å. The major interactions recapitulate the family 4 structures presented in Examples 7 and 8. The residues in scFv HC position 62: ALA vs ASP, contribute to water-mediated LC CDR3 interaction.

Figure 22:
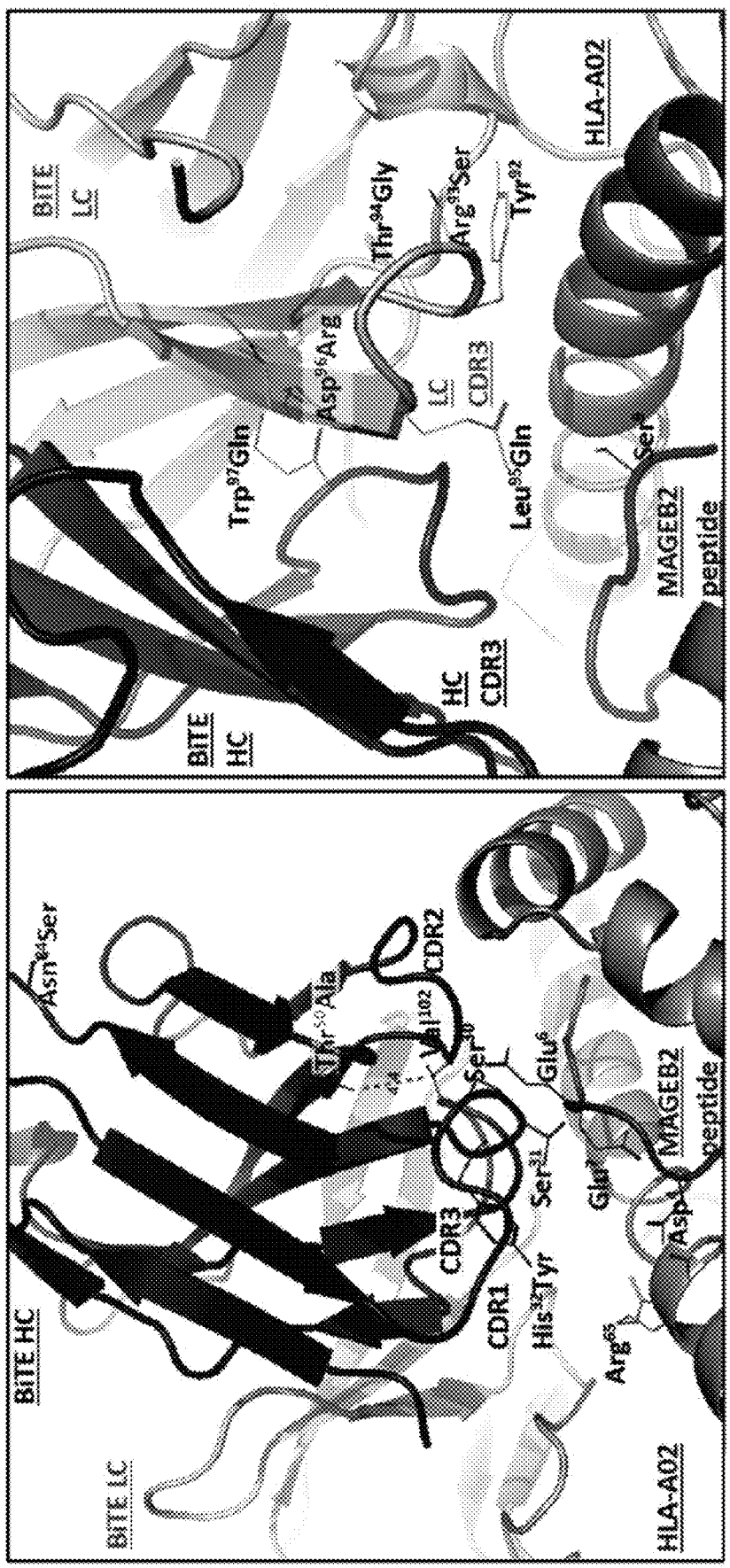
FIG. 22. This figure depicts the structure of the N3H scFv heavy chain (HC) interactions with the MAGEB2 peptide, and the N3H scFv light chain (LC) interactions with the HLA and the MAGEB2 peptide.

The 2 panel representations in FIG. 22 show the key differences of the N3H BiTE® vis-à-vis L7E (Example 7) and H6N (Example 8). Left panel shows the differing heavy chain (HC) residues in N3H: Tyr32, Ala50 and Ser84. The right panel shows differing light chain (LC) residues, all in CDR3: Ser93, Gly94, Gln95, Arg96 and Gln97.

The core pMHC amino acid residues of the interaction interface with N3H were defined as pMHC residues that are within 5 Å of the N3H scFv BiTE®, listed below. The vast majority of N3H interactions show similarity with L7E (Example 7) and H6N (Example 8) showcasing common motifs of family 4 scFv and similar molecular basis for MAGEB2 recognition.

MHC interactions with N3H HC: Arg65, Lys66, Ala69, Gln72, Thr73, Val76, Lys146, Ala149, Ala150, His151, Gln155.

MHC interactions with N3H LC: Gly16, Arg17, Gly18, Glu19, Pro20, Gln43, Arg65, Lys68, Ser71, Gln72, Arg75, Val76, Gly79, Thr80, Arg82, Glu89, Lys146

MAGEB2 interactions with N3H HC: Asp4, Gly5, Glu6, Glu7, His8, Ser9

MAGEB2 interactions with N3H LC: Ser9, Val10

The core N3H scFv BiTE® amino acid residues of the interaction interface with pMHC were defined as N3H residues that are within 5 Å of the pMHC, listed below.

N3H HC interactions with MHC: Ser30, Ser31, Tyr32, Ser52, Gly53, Ser54, Gly56, Gly57, Tyr59, Lys100, His103, Leu104, Gly105

N3H LC interactions with MHC: Asn25, Asn26, Gly28, Ser29, Lys30, Ser31, His33, Tyr48, Asp49, Asp50, Asn51, Asp52, Arg53, Asn65, Ser66, Gly67, Trp90, Tyr92, Gln95

N3H HC interactions with MAGEB2: Ser30, Ser31, Tyr32, Ala33, Ser52, Gly53, Ser54, Lys100, Gly101, Val102, His103, Leu104

N3H LC interactions with MAGEB2: Trp90, Gln95

The following is a list of intermolecular bonded interactions between the pMHC and the family 4 N3H BiTE®.

The pairs of residues involved in intermolecular salt bridges and the distance cut-off as determined by PISA in angstroms (Å) are shown in Table 18:

TABLE 18

| pMHC | N3H BiTE ® | Length (in Å) |
|---|---|---|
| p: Asp4 OD1 | HC: Lys100 NZ | 3.0 |
| MHC: Arg75 NH1 | LC: Asp49 OD1 | 2.9 |
| MHC: Arg75 NH1 | LC: Asp50 OD1 | 3.7 |
| MHC: Arg75 NH1 | LC: Asp50 OD2 | 2.8 |
| MHC: Arg75 NH2 | LC: Asp50 OD2 | 3.1 |
| MHC: Lys68 NZ | LC: Asp52 OD1 | 3.1 |

The pairs of residues involved in intermolecular Hydrogen bonding and the distance cut-off as determined by PISA (in Å) are shown in Table 19:

TABLE 19

| pMHC | N3H BiTE ® | Length (in Å) |
|---|---|---|
| p: Asp4 O | HC: Lys100 NZ | 2.8 |
| p: Glu6 OE1 | HC: Gly53 N | 2.8 |
| p: Glu7 N | HC: Lys100 O | 2.9 |

TABLE 19-continued

| pMHC | N3H BiTE® | Length (in Å) |
| --- | --- | --- |
| p: Ser9 OG | LC: Trp 90 NE1 | 2.8/3.1* |
| p: Ser9 OG | LC: Gln 95 OE1 | 2.8/3.1* |
| MHC: Thr73 OG1 | HC: His103 NE2 | 2.8 |
| MHC: Ala149 O | HC: Ser54 OG | 3.5 |
| MHC: Gln72 OE1 | LC: His33 NE2 | 3.4 |
| MHC: Glu89 OE2 | LC: Asp26 ND2 | 2.7 |
| MHC: Arg75 NH2 | LC: Gly28 O | 2.8 |
| MHC: Arg75 NH1 | LC: Ser31 OG | 3.7 |
| MHC: Arg82 NH2 | LC: Tyr92 OH | 3.4 |

Figure 23:
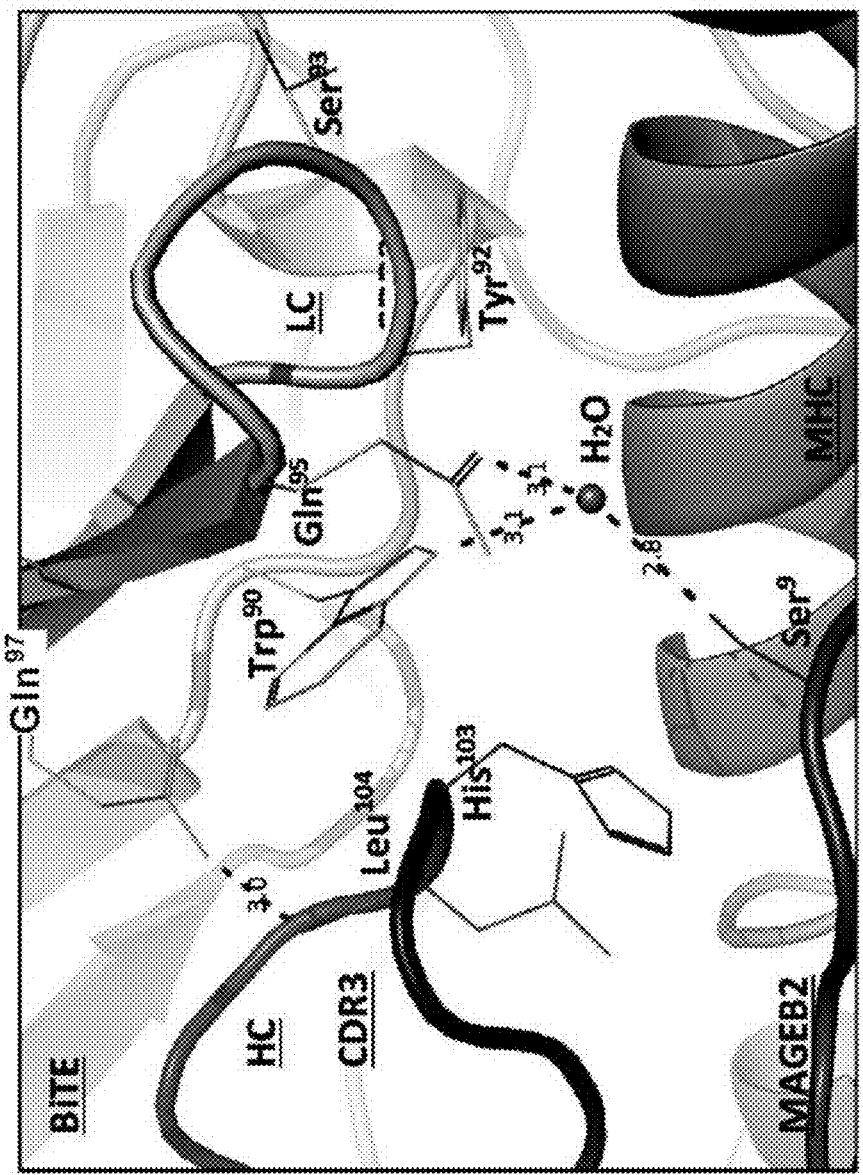
FIG. 23. This figure depicts the structure of the N3H scFv heavy chain (HC) interactions with the MAGEB2 peptide, and the N3H scFv light chain (LC) interactions with the HLA and the MAGEB2 peptide.

*Analysis in PyMOL. As shown in FIG. 23, these are 2 notable water-mediated interactions, coordinated by same water molecule. Mutations in LC CDR3 preserves a key HC-LC H-bond keeping Trp90 in place to pick up the same water-mediated H-bond. Gln95 now picks up another stabilizing interaction as well through the same water molecule. Distances denoted by ------ dash. Not all water-mediated interactions are denoted.

Figure 24:
FIG. 24. This figure depicts the structure of the N3H scFv heavy chain (HC) interactions with the MAGEB2 peptide, and the N3H scFv light chain (LC) interactions with the HLA and the MAGEB2 peptide.

Another key feature of the Family 4 BiTE® molecules from the different structure examples (7, 8 and 9) are the interactions picked up by the LC on the HLA-A02 MHC (water molecules shown as grey spheres) as shown in FIG. 24. This figure shows the interface of LC of family 4 BiTE® molecules and HLA-A02 and shows the interactions the LC makes with HLA-A02 (water shown as grey spheres). The LC interaction with HLA-A02 helps orient the HC and LC CDRs towards the MAGEB2 pMHC for specific recognition. The H-bond and salt bridged interactions between N3H LC and HLA-A02 are shown in the tables above. This is a key feature of the Family 4 BiTE® molecules as determined from the different structure examples (7, 8 and 9) and energy minimized family 4 models of other candidates (data not shown). In addition to these interactions, buried surface area (BSA) calculations also show several other residues (in HLA-A02 and N3H LC) to be involved, as indicated below and listed above.

| | BSA* |
| --- | --- |
| MHC* | |
| Gly16 | 36.75 |
| Arg17 | 15.07 |
| Gly18 | 47.43 |
| Glu19 | 29.24 |
| Pro20 | 0.34 |
| Gln43 | 12.10 |
| Arg65 | 8.19 |
| Ser71 | 5.76 |
| Val76 | 50.47 |
| Gly79 | 26.19 |
| Thr80 | 26.71 |
| Lys146 | 26.67 |
| N3H LC* | |
| Asn25 | 10.62 |
| Ser29 | 30.56 |
| Lys30 | 5.64 |
| Tyr48 | 52.63 |
| Asn51 | 20.65 |
| Arg53 | 0.29 |
| Asn65 | 11.07 |
| Ser66 | 20.43 |
| Gly67 | 24.84 |
| Trp90 | 28.64 |
| Gln95 | 34.97 |

*These residues in the HLA-A02 and LC interaction face are largely common across family 4 BiTE® molecules with some variations in the calculated BSA.

Sequence Alignment of the Family 4 BiTE® Molecules

Sequence alignment for family 4 BiTE® molecules demarcating the CDR's and portraying similarities albeit some sequence variations are shown in FIG. 25. Grey shaded boxes highlight interactions with the pMHC. Note that not all of the interactions are captured in this comparison.

Conclusions

The family 4 BiTE® molecules, including N3H, make notable interactions with both the peptide and HLA-A02 MHC through both the HC and LC. The LC picks up key interactions on the MHC surface through its CDR1 and CDR2 as well as some other regions, that position the HC for recognition of MAGEB2 peptide. Subtle differences exist in recognition between the different BiTE® molecules as indicated (Examples 7, 8 and 9). In addition to the Trp90 interaction with the peptide, N3H LC CDR3 contributes an additional favorable water mediated interaction via Gln95. The positioning of the LC for recognition of HLA-A02 MHC and MAGEB2 peptide recognition mostly by the HC is a notable characteristic. Of note is that all structures also show a small surface groove or cleft formed due to the MAGEB2 binding to HLA-A02 in the binding pocket, which together with the protruding MAGEB2 peptide conformation presents a complementary and remarkable surface for the family 4 BiTE® molecules to specifically recognize and bind.

Methods

Purification, Complex Formation of pMHC and N3H BiTE® scFv and Crystallization

The scFv BiTE® molecule N3H was recombinantly over-expressed in *E. coli* as inclusion bodies, refolded and purified by ion-exchange chromatography. The HLA-A02 (MHC) was over-expressed in *E. coli* and refolded and purified in the presence of MAGE-B2 peptide to generate the pMHC complex.

The ~25 kDa scFv BiTE® and the ~47 kDa pMHC was mixed in 1.2:1 molar ratio and the resultant pMHC complex was separated by size exclusion chromatography. This highly purified pMHC complex was concentrated and subject to sitting drop vapor diffusion crystallization trials. Crystals of pMHC:N3H was obtained in 0.1M Trisodium citrate pH 5.5, 20% PEG3000.

Data Collection and Structure Determination and Analyses

Data for this structure was collected from a single crystal, flash-frozen at 100K in the presence of 20% glycerol in the above crystallization mother liquor, at the Advanced Light Source (ALS, Lawrence Berkeley National Laboratory) beamline 5.0.2. Data was processed using DENZO1 or Mosflm2 and Aimless (CCP4i3 package).

Crystals of H6N complex grew in the P22121 space group with the approximate unit cell dimensions of a=44, b=108, c=162 Å and α=β=γ=90° C., with a single complex per asymmetric unit and diffracted to 1.76 Å resolution. The structure was solved by molecular replacement with the program PHASER4 using the previously solved pMHC:L7E structure (example 7) as the starting search model. Following initial refinement using Phenix7, the pMHC, β2 microglobulin domain and scFv chains were manually corrected for best fit in density as much as possible with Coot8. The overall structure improved with iterative rounds of manual model building and refinement using Phenix.

The structure was subject to rigorous quaternary structural analyses, interface analyses and distance measurements. The core interaction interface amino acids were determined as being all amino acid residues with at least one atom less than or equal to 5 Å from the pMHC protein. The 5 Å core region cut-off distance allowed both atoms within a van der Waals radius and potential water-mediated hydrogen bonding. All amino acids meeting the distance criterion were further analyzed using PyMOL9 and the interface residues were obtained from the interface and quaternary structure analyses program PISA10 (CCP4i package) using the respective completed structure as input files.

Sequence Alignment and Analyses

As described in Example 7, data presented here.

Sequences of the pMHC and N3H scFv BiTE® Used in the Structure

```
pMHC
>HLA_A
                                (SEQ ID NO: 18454)
MGSHSMRYFFTSVSRPGRGEPRFIAVGYVDDTQFV

RFDSDAASQRMEPRAPWIEQEGPEYWDGETRKVKA

HSQTHRVDLGTLRGYYNQSEAGSHTVQRMYGCDVG

SDWRFLRGYHQYAYDGKDYIALKEDLRSWTAADMA

AQTTKHKWEAAHVAEQLRAYLEGTCVEWLRRYLEN

GKETLQRTDAPKTHMTHHAVSDHEATLRCWALSFY

PAEITLTWQRDGEDQTQDTELVETRPAGDGTFQKW

AAVVVPSGQEQRYTCHVQHEGLPKPLTLRWEP

>MAGEB2peptide
                                (SEQ ID NO: 1)
GVYDGEEHSV

>B2microglobulin
                                (SEQ ID NO: 18455)
MIQRTPKIQVYSRHPAENGKSNFLNCYVSGFHPSD

IEVDLLKNGERIEKVEHSDLSFSKDWSFYLLYYTE

FTPTEKDEYACRVNHVTLSQPKIVKWDRDM scFv BiTE®
(N3H)
                                (SEQ ID NO: 18458)
MKEVQLLESGGGLVQPGGSLRLSCAASGFTFSSYA

MSWVRQAPGKCLEWVSAISGSGGGTYYAASVKGRF

TISRDNSKNTLYLQMSSLRAEDTAVYYCATGKGVH

LGFDYWGQGTLVTVSSGGGGSGGGGSGGGGSSYVL

TQPPSVSVAPGQTARITCGGNNIGSKSVHWYQQKP

GQAPVMVVYDDNDRPSGIPERFSGSNSGNTATLTI

SRVEAGDEADYYCQVWDYSGQRQVFGCGTKLTVLG
```

BIBLIOGRAPHY

See Example 7.

Example 10: Crystal Structure and Interaction Identification of the MAGEB2 Peptide/HLA-A02 MHC/Family 7 H6H BiTE® Fab Version 10B5 Complex Introduction Bi-specific T-cell engagers (BiTE®) specific to MAGEB2 peptide (p) bound HLA-A02 major histocompatibility complex (MHC) through engaging specific interactions enabling MAGEB2 recognition were successfully generated. This example describes how a crystal structure was obtained and defines the interactions that the family 7 molecule makes in order to identify and engage this pMHC specifically. The recognition by family 7 is distinct from any of the family 4 examples previously described (see Examples 7, 8 and 9 herein) and further exemplifies differing modes of specific recognition by these molecules.

Results

H6H Fab Version 10B5 Heavy Chain Makes Direct Interactions with MAGEB2 Peptide, Light Chain Makes Critical HLA Interactions to Identify and Engage this Complex Coordinates are provided in Table 77 herein.

Figure 28:
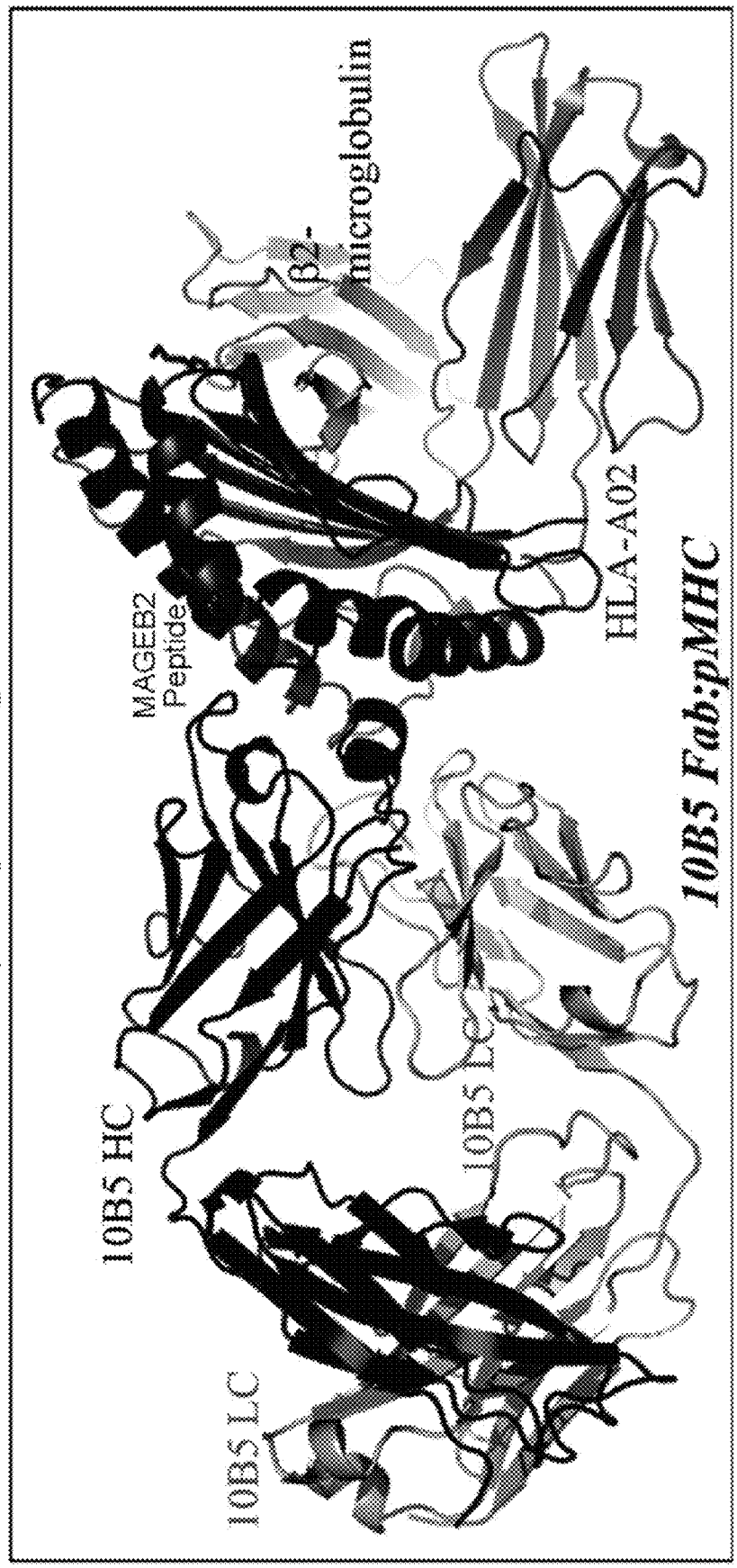
FIG. 28. This figure depicts the overall structure of the Family 7 10B5 (H6H) bound MAGEB2 HLA-A at 2.02 Å.

The crystal structure of MAGEB2 pMHC:10B5 Fab has been determined at 2.02 Å and is represented in FIG. 28. The major interactions in recognition of MAGEB2 peptide by this molecule of family 7 are distinct from all the family 4 structures presented in Examples 7, 8 and 9 herein.

Figure 29:
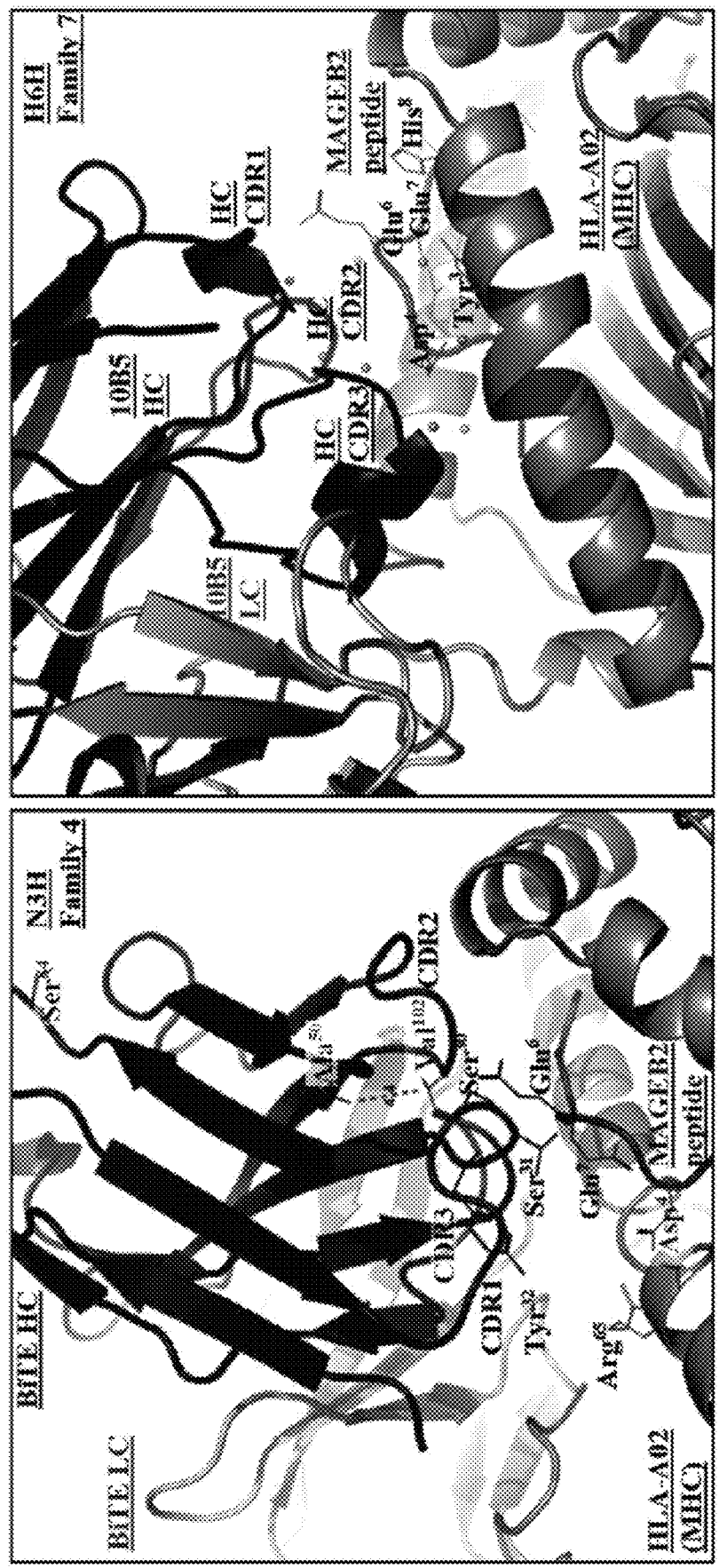
FIG. 29. This figure depicts the structure of Family 7 10B5 (H6H) in the right panel as compared to the structure of Family 4 molecule N3H in the left panel, highlighting the different interactions observed and described in Example 10 herein.

The 2 panel representations in FIG. 29 show the differences between recognition of the family 4 N3H BiTE® as compared to this family 7 1065 Fab (H6H BiTE®). The left panel of FIG. 29 shows the N3H heavy chain (HC) and some light chain (LC) in MAGEB2 recognition. The right panel of FIG. 29 shows the HC and LC of family 7 and the role of 10B5 HC CDR's in MAGEB2 recognition on mostly the N-terminal part of the peptide rather than the mid-region as in family 4 molecules. Also, the LC of 10B5 is completely on the other side and only contributes to MHC interactions and stability.

The core pMHC amino acid residues of the interaction interface with H6H were defined as pMHC residues that are within 5 Å of the 10B5 Fab, listed below.

MHC with H6H HC: Glu55, Glu58, Tyr59, Asp61, Gly62, Glu63, Arg65, Lys66, Ala69, Ala158, Gly162, Thr163, Glu166, Trp167, Arg170

MHC with H6H LC: Gln54, Glu55, Gly56, Pro57, Glu58, Tyr59, Asp61, Trp167, Arg170

MAGEB2 with H6H HC: Gly1, Val2, Asp4, Gly5, Glu6, Glu7

The core 10B5 Fab amino acid residues of the interaction interface with pMHC were defined as H6H residues that are within 5 Å of the pMHC, listed below.

H6H HC to MHC: Trp33, Arg50, Arg52, Ser55, Tyr56, Gly57, Thr59, Tyr103, Gly105, Ser106, Tyr107, Tyr108, Asn109, Tyr110, Phe111, Ser112

H6H LC to MHC: Ser30, Ser31, Tyr32, Ala50, Ser67, Thr91, Tyr92, Ser93, Met94, Phe96

H6H HC to MAGEB2: Ser30, Asn31, Arg54, Ser55, Tyr56, Ser104, Gly105, Ser106, Tyr110

There are no H6H LC residues within the distance requirements that directly contribute to the MAGEB2 peptide interacting interface which is a notable difference in recognition as compared to family 4 molecules.

The following is a list of intermolecular bonded interactions between the pMHC and the family 7 H6H BiTE®-10B5 Fab.

The pairs of residues in Table 74 below are involved in intermolecular salt bridges and the distance cut-off as determined by PISA in angstroms (Å) is shown:

TABLE 74

| pMHC | 10B5 Fab | Length (in Å) |
|---|---|---|
| MHC: Glu58 OE1 | HC: Arg50 NH2 | 3.8 |
| MHC: Glu58 OE2 | HC: Arg50 NH2 | 3.0 |
| MHC: Glu58 OE2 | HC: Arg50 NH1 | 2.7 |
| MHC: Asp61 OD2 | HC: Arg52 NH1 | 3.3 |
| MHC: Asp61 OD2 | HC: Arg52 NH2 | 2.3 |

The pairs of residues in the table below are involved in intermolecular Hydrogen bonding and the distance cut-off as determined by PISA (in Å) is shown (bb—backbone) in Table 75 below.

TABLE 75

| pMHC | N3H BiTE® | Length (in Å) |
|---|---|---|
| p: Asp4 OD2 | HC: Ser106 N (bb) | 2.9 |
| MHC: Glu63 OE1 | HC: Tyr110 OH | 2.6 |
| MHC: Glu63 N (bb) | HC: Tyr110 OH | 3.3 |
| MHC: Arg65 NH1 | HC: Thr59 OG1 | 3.3 |
| MHC: Arg65 NH1 | HC: Tyr56 O (bb) | 3.8 |
| MHC: Ala158 O (bb) | HC: Tyr103 OH | 3.5 |
| MHC: Thr163 OG1 | HC: Ser106 N (bb) | 3.9 |
| MHC: Glu166 OE2 | HC: Tyr108 OH | 3.8 |
| MHC: Glu54 NE2 | LC: Ser30 OG | 2.9 |
| MHC: Glu55 OE1 | LC: Tyr32 OH | 2.6 |
| MHC: Arg170 NH1 | LC: Ser31 OG | 2.8 |
| MHC: Arg170 NH2 | LC: Ser30 OG | 3.4 |
| MHC: Arg170 NH2 | LC: Ser31 OG | 3.1 |

Figure 30:
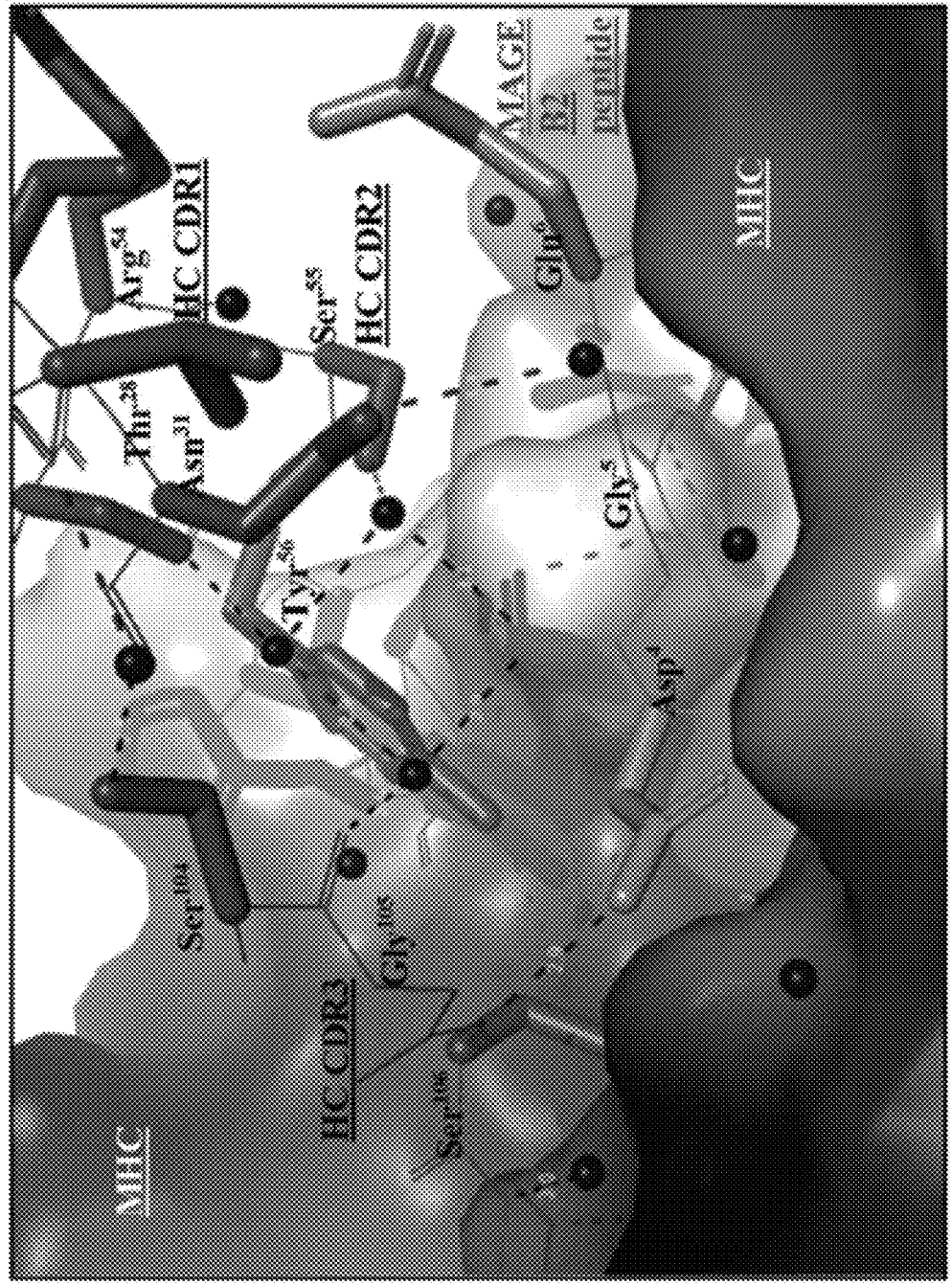
FIG. 30. This figure depicts some of the water mediated bonding network elucidated by the crystal structure of the 10B5 (H6H) and MAGEB2 pMHC interaction, where water is represented as black spheres, and as further described in Example 10 herein.

FIG. 30 shows some of the water-mediated bonding network. In the figure, water is represented as black spheres, distances are shown (black dashed line, distances in Å), MHC is shown as vacuum electrostatic surface representation (greyscale), and the residues of the MAGEB2 peptide are shown in light grey and heavy chain CDR's of 10B5 are shown as dark grey. The critical water-mediated interactions are shown in this figure. The several water molecules mediate key H-bond's bridging the peptide bound MHC to the HC CDR's of 10B5.

Figure 31:
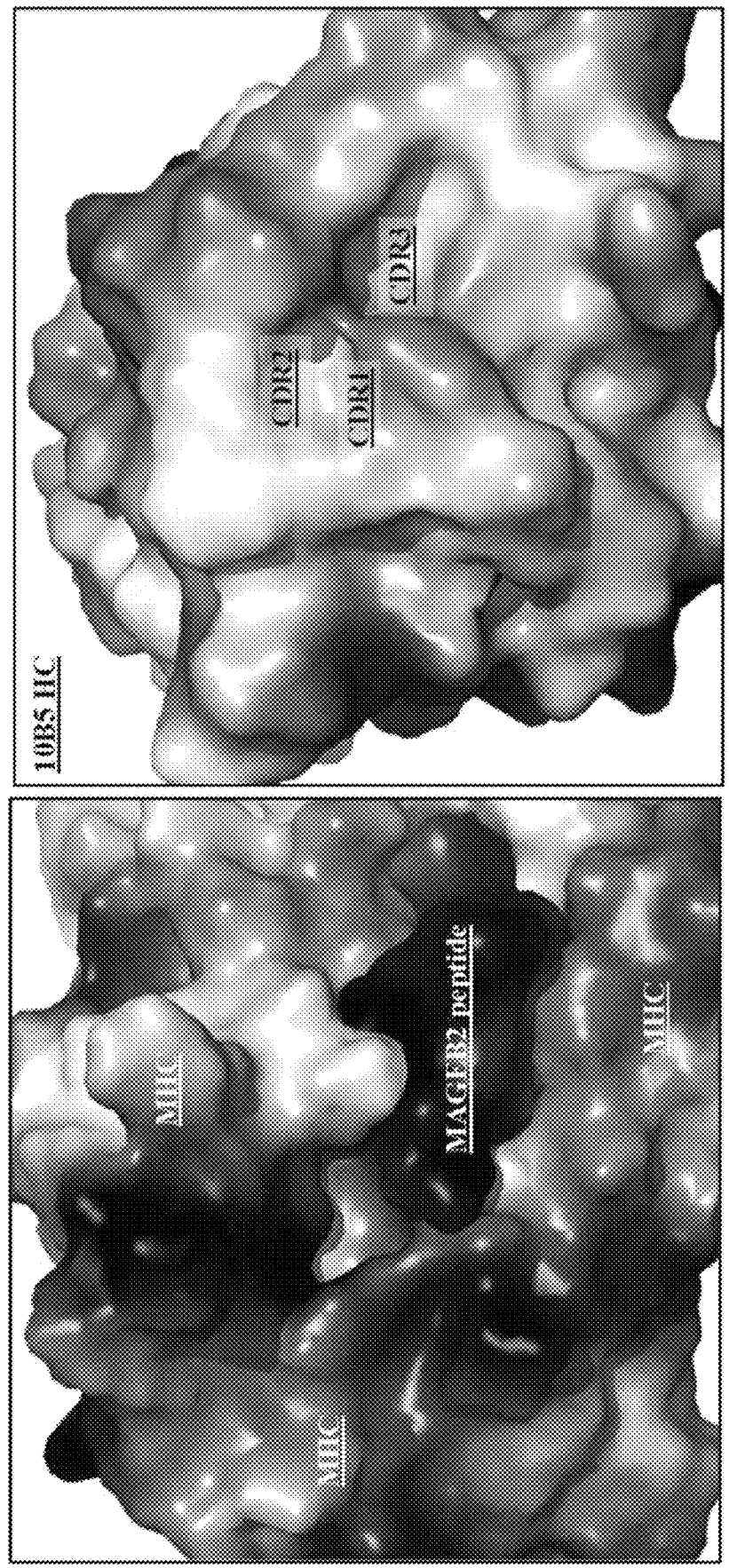
FIG. 31. This figure depicts the complementary surface of the heavy chain to the pMHC surface that facilitates this unique recognition. The figure panels show the vacuum electrostatic surfaces, pMHC (left panel) and the HC CDR's (right panel) in grayscale, and is further described in Example 10 herein.
Figure 32:
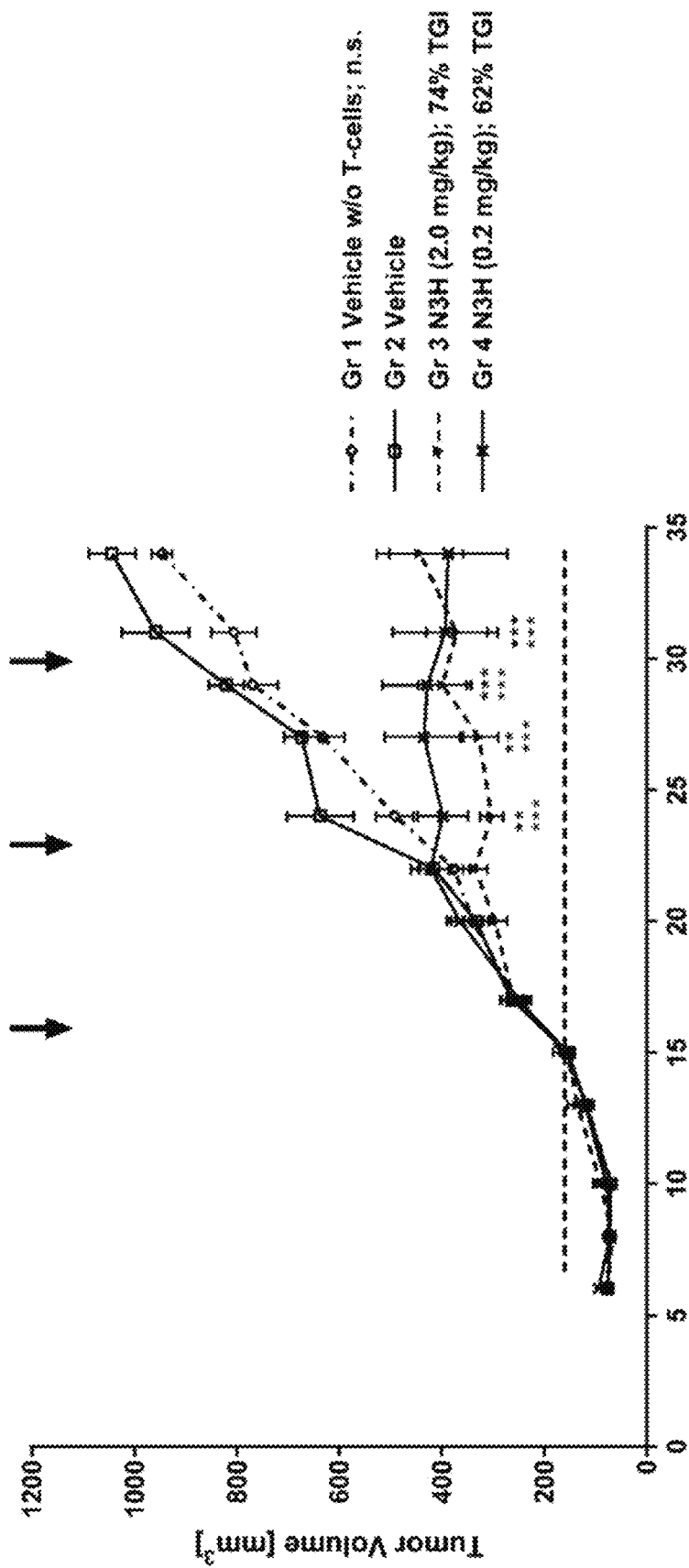
FIG. 32. This figure is a graphical summary of data from an in vivo tumor study, where animals with HCT-116 were treated with the N3H molecule on three different time points over the course of the study and as further detailed in Example 11 herein.
Figure 33:
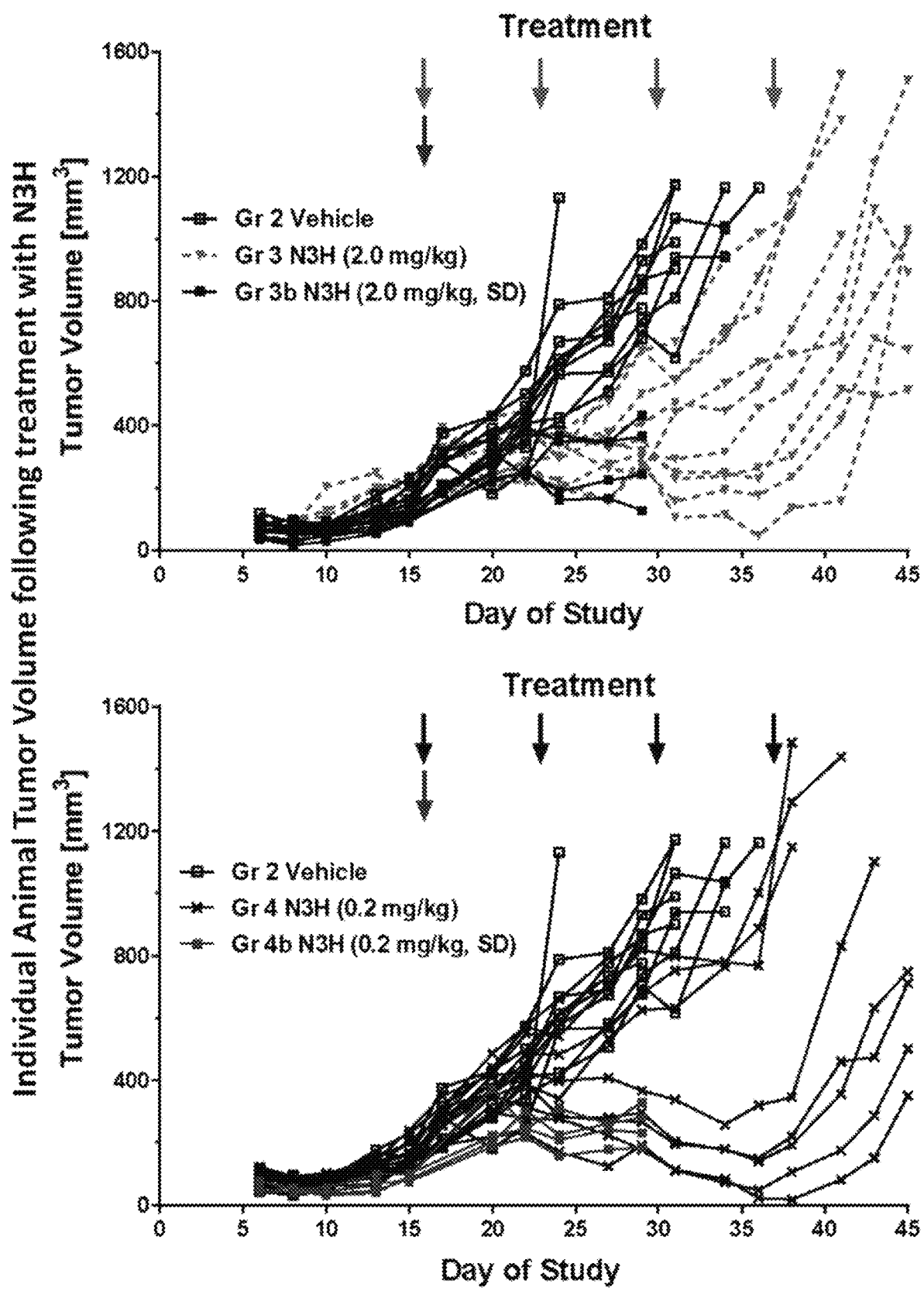
FIG. 33. This figure is a graphical summary of data from two treatment groups receiving different doses in an in vivo tumor study, where animals with HCT-116 were treated with the N3H molecule on three different time points over the course of the study and as further detailed in Example 11 herein. The upper panel has results from the 2.0 mg/kg treatment group and the lower panel has results from the 0.2 mg/kg treatment group.
Figure 34:
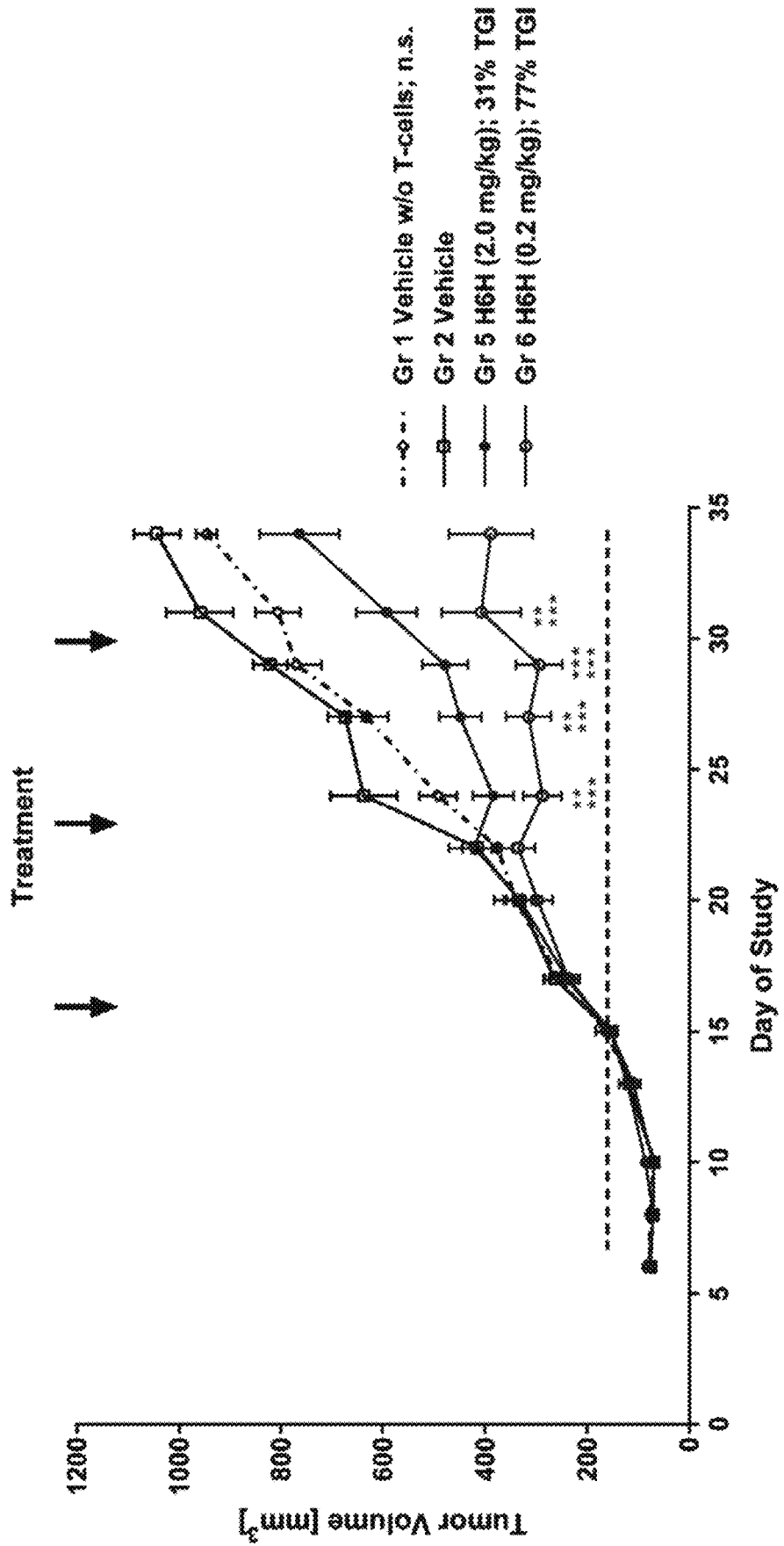
FIG. 34. This figure is a graphical summary of data from an in vivo tumor study, where animals with HCT-116 were treated with the H6H molecule on three different time points over the course of the study and as further detailed in Example 11 herein.
Figure 35:
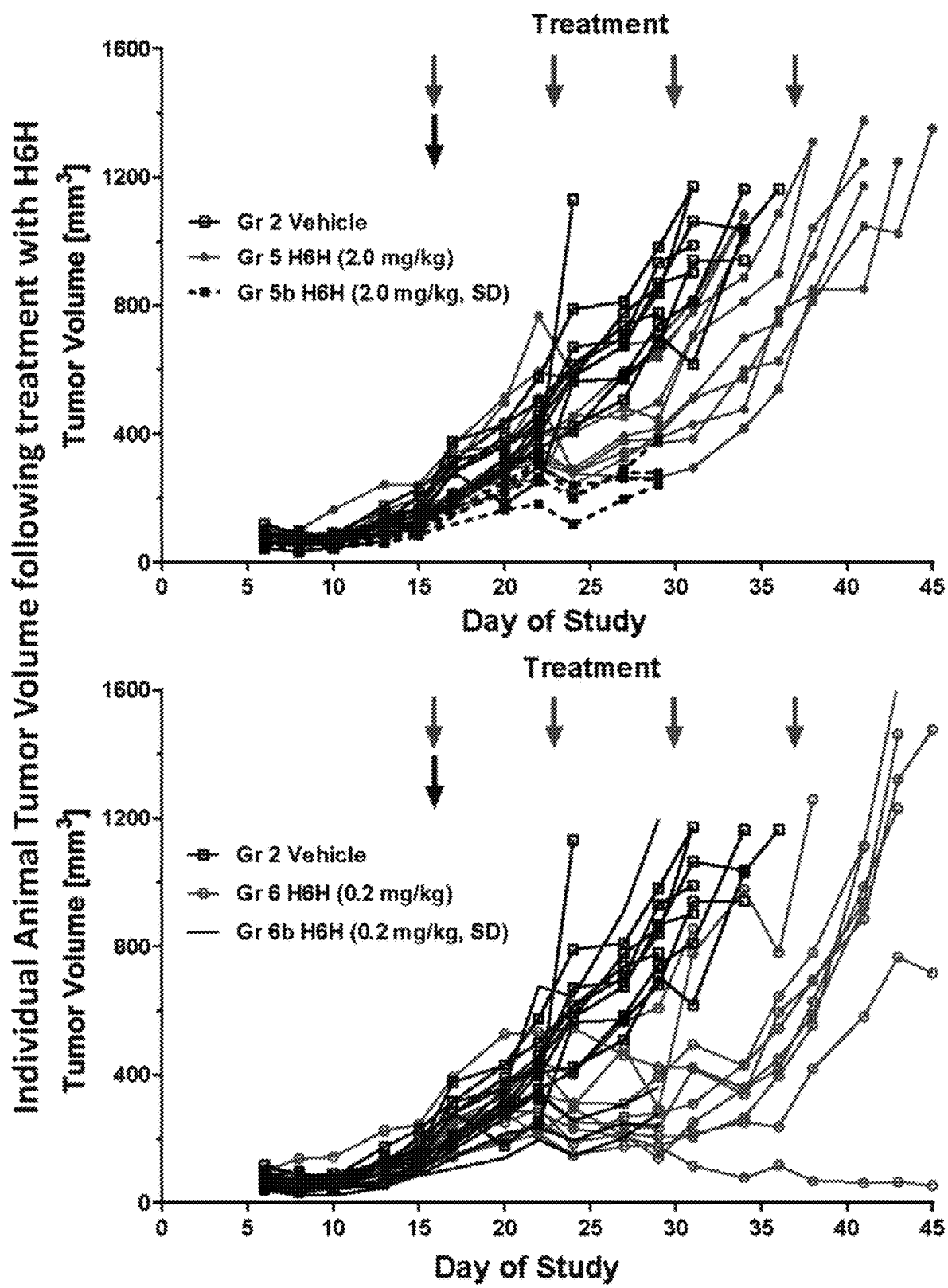
FIG. 35. This figure is a graphical summary of data from two treatment groups receiving different doses in an in vivo tumor study, where animals with HCT-116 were treated with the H6H molecule on three different time points over the course of the study and as further detailed in Example 11 herein. The upper panel has results from the 2.0 mg/kg treatment group and the lower panel has results from the 0.2 mg/kg treatment group.

Another key feature is the complementary surface of the HC to the pMHC surface that facilitates this unique recognition. FIG. 31 shows the vacuum electrostatic surfaces, pMHC (left panel) and the HC CDR's (right panel) in grayscale.

Conclusions

The family 7 BiTE® molecule H6H Fab version (10B5) makes critical direct and water-mediated interactions with the peptide through the HC, and with the HLA-A02 MHC through both the HC and LC. There are key differences in recognition between the different BiTE® molecules as indicated (see family 4 examples 7, 8 and 9 as compared to this family 7 example).

Methods

Purification, Complex Formation of pMHC and 10B5 Fab (H6H BiTE®) and Crystallization The Fab version of H6H BiTE® represented by 10B5 was recombinantly expressed and purified by chromatography. The HLA-A02 (MHC) was over-expressed in E. coli and refolded and purified in the presence of MAGE-B2 peptide to generate the pMHC complex.

The ~50 kDa 10B5 Fab and the ~47 kDa pMHC was mixed in 1:1 molar ratio and the resultant pMHC complex was separated by size exclusion chromatography. This highly purified pMHC:Fab complex was concentrated and subjected to sitting drop vapor diffusion crystallization trials. Crystals of pMHC:10B5 Fab was obtained in 10% v/v 2-Propanol, 0.1M Sodium citrate tribasic pH 5.0, 26% PEG 400.

Data Collection and Structure Determination and Analyses

Data for this structure was collected from a single crystal, flash-frozen at 100K in the presence of 20% glycerol in the above crystallization mother liquor, at the Advanced Light Source (ALS, Lawrence Berkeley National Laboratory) beamline 5.0.2. Data was processed using DENZO[1] or Mosflm[2] and Aimless (CCP4i[3] package).

Crystals of pMHC:10B5 Fab complex grew in the C222$_1$ space group with the approximate unit cell dimensions of a=98, b=193, c=109 Å and α=β=γ=90° C., with a single complex per asymmetric unit and diffracted to 2.02 Å resolution. The structure was solved by molecular replacement with the program PHASER[4] using the previously solved pMHC structure (only the pMHC part from example 7) and Fab model structure (Schrödinger[6]) as the starting search model. Following initial refinement using Phenix[7], the pMHC and β2 microglobulin domain were manually corrected for best fit in density as much as possible with Coot[8]. The Fab heavy and light chains were subject to subsequent iterations of refinement following extensive manual model building based on the experimental data and the sequences of 10B5. The overall complex structure improved with iterative rounds of manual model building and refinement using Phenix.

The structure was subject to rigorous quaternary structural analyses, interface analyses and distance measurements. The core interaction interface amino acids were determined as being all amino acid residues with at least one atom less than or equal to 5 Å from the pMHC protein. The 5 Å core region cut-off distance allowed both atoms within a van der Waals radius and potential water-mediated hydrogen bonding. All amino acids meeting the distance criterion were further analyzed using PyMOL[9] and the interface residues were obtained from the interface and quaternary structure analyses program PISA[10] (CCP4i package) using the respective completed structure as input files.

Sequences of the pMHC and 10B5 Fab (Version of H6H BiTE®) Used in the Structure

```
pMHC
>HLA_A
                           (SEQ ID NO: 18454)
MGSHSMRYFFTSVSRPGRGEPRFIAVGYVDDTQFV

RFDSDAASQRMEPRAPWIEQEGPEYWDGETRKVKA

HSQTHRVDLGTLRGYYNQSEAGSHTVQRMYGCDVG

SDWRFLRGYHQYAYDGKDYIALKEDLRSWTAADMA

AQTTKHKWEAAHVAEQLRAYLEGTCVEWLRRYLEN

GKETLQRTDAPKTHMTHHAVSDHEATLRCWALSFY

PAEITLTWQRDGEDQTQDTELVETRPAGDGTFQKW

AAVVVPSGQEQRYTCHVQHEGLPKPLTLRWEP

>MAGEB2peptide
                              (SEQ ID NO: 1)
GVYDGEEHSV

>B2microglobulin
                           (SEQ ID NO: 18455)
MIQRTPKIQVYSRHPAENGKSNFLNCYVSGFHPSD

IEVDLLKNGERIEKVEHSDLSFSKDWSFYLLYYTE

FTPTEKDEYACRVNHVTLSQPKIVKWDRDM

10B5 Fab (Fab version of family 7
H6H BiTE®)
>10B5Fab_HC
                           (SEQ ID NO: 18459)
EVQLVESGGGLVQPGGSLRLSCAASGFTFSNAWMS

WVRQAPGKGLEWVGRIRSRSYGGTTDYAAPVKGRF

TISRDDSKNTLFLQMNSLKTEDTAVYYCTTPSYSG

SYYNYFSVMDVWGQGTTVTVSSASTKGPSVFPLAP

SSKSTSGGTAALGCLVKDYFPEPVTVSWNSGALTS
```

-continued

```
GVHTFPAVLQSSGLYSLSSVVTVPSSSLGTQTYIC

NVNHKPSNTKVDKKVEPKSCDHHHHHHHHHH

>10B5Fab_LC
                          (SEQ ID NO: 18460)
DIQMTQSPSSLSASVGDRVTITCRTSQSISSYLNW

YQQKPGRAPKLLIFAASSLQGGVPSRFSGSGSGTD

FTLTISSLQPEDFATYYCQQTYSMPFTFGGGTKVE

IKRTVAAPSVFIFPPSDEQLKSGTASVVCLLNNFY

PREAKVQWKVDNALQSGNSQESVTEQDSKDSTYSL

SSTLTLSKADYEKHKVYACEVTHQGLSSPVTKSFN

RGEC
```

BIBLIOGRAPHY

See Example 7.

Example 11: Anti-Tumor Activity of a MAGEB2 BiTE® Molecule

To evaluate the anti-tumor activity of representative BiTE® molecules, an in vivo tumor experiment was performed using the following criteria.

Test system: Female NOD/SCID mice subcutaneously injected with human HCT-116 colon carcinoma cells Effector cells: In vitro expanded and activated human CD3+ T cells (Day 13)

Treatment start: After tumors had reached a volume of 200 mm3 (Day 16); Once weekly (q7d); 4 administrations
Treatment:
  2 control groups (w/ and w/o T cells)
  2 BiTE® molecules: N3H and H6H at 2 dose levels each: 2.0 and 0.2 mg/kg
    Route of administration: Intravenous bolus injections
    PK analysis: Following initial treatment at
    0.5, 8, 24, 48, 120, 168 hours post injection; (n=3 animals of main study/time point)
    168, 240, 312 hours post injection; (n=4 additional animals following single dosing)
Animal Care Female non-obese diabetic, severe combined immunodeficient (NOD SCID) mice were obtained from Charles River Laboratories (Sulzfeld, Germany). Studies were performed at Amgen Research (Munich) GmbH in accordance with the German Animal Welfare Law with permission from the responsible local authorities, in accordance with the standards of the Association for Assessment and Accreditation of Laboratory Animal Care (AAALAC). Mice were cared for in accordance with the Guide for the Care and Use of Laboratory Animals, 8$^{th}$ Edition. Mice were housed in individual ventilated caging systems on sterilized aspen bedding. Animal rooms were set to maintain a temperature of 22° C.±2° C., relative humidity of 55±20%, and intermittent light and dark cycles of 12 hours. Sterile food and sterile water were made freely available throughout the studies. Cages were changed weekly inside an engineered cage changing station.

Antitumor Efficacy Study in an HCT-116 Colon Carcinoma Xenograft Model

Sublethal irradiated (2 Gy) female NOD/SCID mice were implanted subcutaneously with HCT-116 cells ($5 \times 10^6$/mouse) on day 1. On day 9, all animals received a single intravenous dose of anti-asialo GM1 antibody (50 µL of a 1:2.5 dilution/mouse) into the lateral tail vein, in order to deplete remaining natural killer (NK) cells. As the anti-MAGEB2 N3H molecule does not cross-react to mouse CD3, activated human T cells were administered to mice bearing xenograft tumors ($2 \times 10^7$/mouse) on day 13 (see below for details). On day 16, when the tumors reached approximately 200 mm$^3$, treatment was initiated. Because of the extended half-life, N3H (at dose levels of 2.0 or 0.2 mg/kg/admin) or vehicle control was administered once weekly by bolus IV injection on days 16, 23, 30 and 37. After the initial dose on day 16, blood samples were collected from the periorbital venous plexus for pharmacokinetic (PK) analysis (see below for details). Tumor volume was measured by calipers (DCS-1, Plexx B.V.) 3 times a week and progress was evaluated by intra- and intergroup comparison of tumor volumes (TV). The study was terminated on day 45.

All statistical analyses were performed using GraphPad Prism version 7.02. Data were analyzed by one-way analysis of variance (ANOVA), and differences in experimental results for tumor growth were assessed by Dunnett's post-hoc test for comparison against a control group. A p value of <0.05 was considered to be statistically significant. The statistical significance is reported as follows: *=p<0.05; =p<0.01; *=p<0.001.

The following criteria were used to quantify the anti-tumor activity.
  (i) Tumor eradication is achieved, when no measurable tumors are present at study end.
  (ii) If the TV of a given animal or group is smaller as compared to the TV of the same animal or group at treatment start, a tumor regression (TR) is achieved and calculated as follows:

$$TR[\%] = 100 - \left( \frac{100 \times TV_{after\ treatment}}{TV_{at\ treatment\ start}} \right).$$

(iii) The tumor growth inhibition TGI [%] is determined in case the TV of an animal or group equals or exceeds the TV at treatment start and is calculated relative to the growth of control group 2 using the formula:

$$TGI[\%] = 100 - \left( \frac{100 \times \Delta TV_{treated\ animal/group}}{\Delta TV_{control\ animal/group}} \right), \text{with}$$

$$\Delta TV = TV_{at\ observation} - TV_{at\ treatment\ start}.$$

T Cell Expansion and Activation

Normal peripheral blood CD3$^+$ T cells from a healthy donor (#2336) were isolated from a LeukoPak through negative selection and cryopreserved by vendor (AllCells LLC, Alameda, CA, USA) prior to shipment. In order to obtain sufficient human T cells from a single donor for use in one mouse xenograft study, cells were activated and expanded for 10 days using ImmunoCult™ Human CD3/CD28 T Cell Activator (#10970), ImmunoCult™-XF T Cell Expansion Medium (#10981) and Human Recombinant IL-2 (#78036.3, all STEMCELL, Cologne, Germany) in accordance with the manufacturer's instructions. The cell suspension was split on day 3, 6 and 8 of expansion. On the day of injection, cells were resuspended, pooled, centrifuged, washed twice with DPBS and adjusted to a concentration of $1 \times 10^8$ cells/mL in RPMI 1640 (#FG1215, Gibco/Fisher Scientific GmbH, Schwerte, Germany). Cell viability was 93% as evaluated by flow cytometry. T cell activation was assessed by flow cytometric analysis of CD25 cell surface expression, and T cell expansion was measured by the T cell count over time.

Blood Sampling

For peri-orbital blood sampling, animals were placed under anesthesia with 3-4% isoflurane (CP Pharma, Burgdorf, Germany; #798-932) using an Isotec3 isoflurane evaporator (Voelker GmbH, Kaltenkirchen, Germany). Blood was taken by rupture of the peri-orbital sinus with heparinized MiniCAPS capillaries (5 μL, Hirschmann Laborgeräte, Eberstadt, Germany, #6122437). Approximately 100 μL of blood was sampled into MiniCollect® Clot Activator and Gel Tubes (Greiner Bio One, Frickenhausen, Germany, #450472) and allowed to coagulate for 45 minutes at room temperature. Samples were centrifuged at 3000×g for 10 minutes at room temperature in an Eppendorf centrifuge (Type 5424R, Hamburg, Germany) and serum (50 μL per blood sample) was separated from blood cells via a pipette. Serum was stored at −20° C. and after 24 h at −80° C. N3H concentration in mouse serum was analyzed by an electrochemiluminescence-based immunoassay developed at Amgen Research (Munich) GmbH.

Quantification of Mouse Serum Levels

Serum levels were quantified using an electrochemiluminescence-based immunoassay (ECL-Assay) at BA, ARM. Mouse serum samples were stored at −80° C. prior to analysis. Samples were first pre-diluted in 100% NOD/SCID serum, if applicable, followed by a 1:10 dilution in Casein Blocker (Thermo Scientific, 37532, 1% in TBS) to reach a final dilution of 1:10 to 1:500. For immobilization of analytes streptavidin microplates (Mesoscale Discovery; L55SA-1) were coated with 30 μL MAGE-B2 pMHC-Biotin at 5 μg/mL in PBS and incubated overnight at 5±3° C., followed by a wash step with 3×300 μL PBS/0.05% Tween-20 and blocking with 150 μL Casein Blocker (Thermo Scientific, 37532, 1% in TBS) for 60 min at 25±2° C. on a rotational shaker (700-750 rpm). After a second wash step (3×300 μL PBS/0.05% Tween-20) 30 μL of standard, QC or study samples were added to each well and incubated for 60±20 min at 25±2° C. on a rotational shaker (700-750 rpm). Standard samples, QC and study samples were tested in duplicates. Subsequently, plates were washed once more (3×300 μL PBS/0.05% Tween-20), followed by addition of 25 μL detection antibody anti-anti-CD3-SulfoTAG (clone 1C1.1) at 1 μg/mL in Casein Blocker (Thermo Scientific, 37532, 1% in TBS) and incubation for 60±20 min at 25±2° C. on a rotational shaker (700-750 rpm). After a last wash (3×300 μL BS/0.05% Tween-20) Read Buffer (Mesoscale Discovery; R92TG-2; 150 μL/well) was added and the plate was read on a QuickPlex SQ120 (Mesoscale Discovery).

Data analysis was performed using SoftMaxPro (version 6.4.1). Mean ECL values were applied for standard curve fitting against the nominal concentrations using a 5-Parameter Fit (weighting: 1/y2). Analyte concentrations in serum samples were calculated from the standard curve and multiplied with the respective dilution factor.

The quantitation limits for each assay run were derived from an acceptable recovery of quality control samples (low control 1 ng/mL; high control 160 ng/mL; prepared in 10% serum). This confirmed an LLOQ of 10 ng/mL and an ULOQ of 1600 ng/mL analyte in 100% serum. Samples with higher serum concentrations were diluted into the dynamic range of the assay. All samples were quantified within the dynamic range of the assay.

PK Data Analysis

Noncompartmental analysis (NCA) was performed on the individual serum concentration-nominal time data using Phoenix WinNonlin (Version 6.4.0.768, Pharsight Corporation) to estimate the following TK parameters:

The maximum observed concentration ($C_{max}$) was taken directly from the concentration-time data.

The area under the concentration-time curve from time zero to the time of the last quantifiable concentration ($AUC_{last}$) was calculated by the linear trapezoidal method, where data permitted.

The clearance (CL) was calculated by dividing the dose with the $AUC_{inf}$, where data permitted.

The terminal half-life ($t_{1/2}$) was determined by log-linear regression from the terminal elimination phase of the concentration-time curve, where data permitted.

Figure 36:
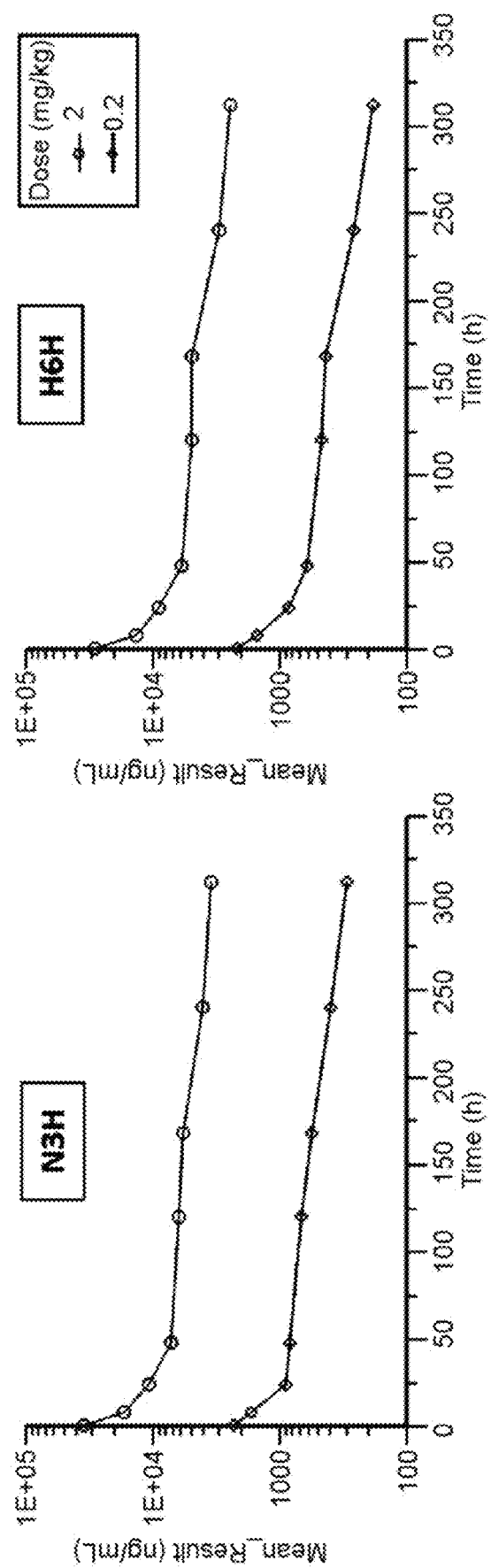
FIG. 36. This figure is a graphical summary of data from a pharmacokinetic (pK) study performed on samples taken from the animal studies summarized in FIGS. 32-34 and further detailed in Example 11 herein. The left panel summarizes pK data from the 2.0 mg/kg and 0.2 mg/kg doses in the N3H molecule treatment groups, and the right panel summarizes pK data from the 2.0 mg/kg and 0.2 mg/kg doses in the H6H molecule treatment groups.

PK data is summarized in graphical formats in FIG. 36 herein. The left panel is data for the N3H molecule and the right panel is data for the H6H molecule.

Conclusions

As represented in FIGS. 32-35 herein, treatment of animals with tumors resulted in a clear inhibition of tumor growth from both the N3H molecule (FIGS. 32 and 33) and the H6H molecule (FIGS. 34 and 35) as compared to appropriate controls.

TABLE 20-A

Experimental Plan and Treatment Schedule

| Group | Mice/Group | Target Cells/Mouse (SC) | Effector Cells/Mouse (IP) | Treatment | Dose Level (mg/kg) | Dose Volume (mL) | RoA | Treatment Days |
|---|---|---|---|---|---|---|---|---|
| 1 | 5 | 5 × 10⁶ HCT-116/LUC | — | Vehicle | 0 | 0.1 | IV | 16, 23, 30, 37 |
| 2 | 10 | 5 × 10⁶ HCT-116/LUC | 2 × 10⁷ CD3⁺ T cells | Vehicle | 0 | 0.1 | IV | 16, 23, 30, 37 |
| 3 | 10 | 5 × 10⁶ HCT-116/LUC | 2 × 10⁷ CD3⁺ T cells | N3H | 2 | 0.1 | IV | 16, 23, 30, 37 |
| 3b* | 4 | 5 × 10⁶ HCT-116/LUC | 2 × 10⁷ CD3⁺ T cells | N3H | 2 | 0.1 | IV | Single shot, D 16 |
| 4 | 10 | 5 × 10⁶ HCT-116/LUC | 2 × 10⁷ CD3⁺ T cells | N3H | 0.2 | 0.1 | IV | 16, 23, 30, 37 |

TABLE 20-A-continued

Experimental Plan and Treatment Schedule

| Group | Mice/ Group | Target Cells/Mouse (SC) | Effector Cells/Mouse (IP) | Treatment | Dose Level (mg/kg) | Dose Volume (mL) | RoA | Treatment Days |
|---|---|---|---|---|---|---|---|---|
| 4b* | 4 | $5 \times 10^6$ HCT-116/LUC | $2 \times 10^7$ CD3$^+$ T cells | N3H | 0.2 | 0.1 | IV | Single shot, D 16 |
| 5 | 10 | $5 \times 10^6$ HCT-116/LUC | $2 \times 10^7$ CD3$^+$ T cells | H6H | 2 | 0.1 | IV | 16, 23, 30, 37 |
| 5b* | 4 | $5 \times 10^6$ HCT-116/LUC | $2 \times 10^7$ CD3$^+$ T cells | H6H | 2 | 0.1 | IV | Single shot, D 16 |
| 6 | 10 | $5 \times 10^6$ HCT-116/LUC | $2 \times 10^7$ CD3$^+$ T cells | H6H | 0.2 | 0.1 | IV | 16, 23, 30, 37 |
| 6b* | 4 | $5 \times 10^6$ HCT-116/LUC | $2 \times 10^7$ CD3$^+$ T cells | H6H | 0.2 | 0.1 | IV | Single shot, D 16 |
| 7** | 8 | $5 \times 10^6$ HCT-116/LUC | $2 \times 10^7$ CD3$^+$ T cells | AMG CNTRL | 1 | 0.1 | IV | 23, 30, 37, 44 |
| — | 55 + 16 | $5 \times 10^6$ HCT-116/LUC | | Additional animals used for staging | | | | |
| Σ | 110 | $7.5 \times 10^8$ (with 20% surplus) | $>1.8 \times 10^9$ (with surplus) | | | | | |

Serum was sampled from 3-4 animals/group/timepoint as indicated in the following Table 20-B.

TABLE 20-B

Serum sample overview

| Day of experiment | Time point p.i. [h] | Group | Animals | Eye | Serum Quantity |
|---|---|---|---|---|---|
| 16 | 0.5 | 3 | 36, 37, 59 | right | 50 µL |
| | | 4 | 11, 42, 43 | | |
| | | 5 | 38, 83, 89 | | |
| | | 6 | 04, 30, 51 | | |
| | 8 | 3 | 06, 32, 104 | | |
| | | 4 | 26, 39, 57 | | |
| | | 5 | 01, 13, 15 | | |
| | | 6 | 14, 63, 65 | | |
| 17 | 24 | 3 | 55, 66, 69 | | |
| | | 4 | 82, 98, 10 | | |
| | | 5 | 24, 27, 07 | | |
| | | 6 | 34, 56, 68 | | |
| 18 | 48 | 3 | 36, 37, 59 | left | |
| | | 4 | 11, 42, 43 | | |
| | | 5 | 38, 83, 89 | | |
| | | 6 | 04, 30, 51 | | |
| 21 | 120 | 3 | 06, 32, 104 | | |
| | | 4 | 26, 39, 57 | | |
| | | 5 | 01, 13, 15 | | |
| | | 6 | 14, 63, 65 | | |
| 23 | 168 | 3 | 55, 66, 69 | | |
| | | 4 | 82, 98, 10 | | |
| | | 5 | 24, 27, 07 | | |
| | | 6 | 34, 56, 68 | | | h = hours;
p.i. = post injection

TABLE 20-C

Serum sample overview (single shot, long time PK)

| Day of experiment | Time point p.i. [h] | Group | Animals | Eye | Serum Quantity |
|---|---|---|---|---|---|
| 23 | 168 | 3B | 46, 49, 102, 105 | right | 50 µL |
| | | 4B | 05, 23, 106, 107 | | |
| | | 5B | 53, 64, 86 | | |
| | | 6B | 62, 76, 80, 99 | | |
| 26 | 240 | 3B | 46, 49, 102, 105 | left | |
| | | 4B | 05, 23, 106, 107 | | |
| | | 5B | 53, 64, 86 | | |
| | | 6B | 62, 76, 80, 99 | | |
| 29 | 312 | 3B | 46, 49, 102, 105 | right | |
| | | 4B | 05, 23, 106, 107 | | |
| | | 5B | 53, 64, 86 | | |
| | | 6B | 62, 76, 80, 99 | | | h = hours;
p.i. = post injection

Example 12: BLCL Killing Assay—Maximum Il-2 Production by HLA-A*02:06 and HLA-A*02:07 Expressing BLCLs This experiment was performed to determine whether the binding molecules of the invention bind to the pMAGE-HLA target when the MAGEB2 peptide of SEQ ID NO: 1 is complexed with different HLA-A serotypes.

B-lymphoblastoid cell lines (BLCL) target cells were harvested and resuspended at 1e6 cells/ml in media (RPMI 1640 with 15% fetal bovine serum and 1 mM sodium pyruvate). BLCLs were peptide pulsed with MAGEB2 peptide at 50 uM for 4 hours at 37 C or left unpulsed. After incubation, target cells were resuspended at 1e5 cells/ml without washing off peptide. BiTE® molecule dilutions were prepared ranging from 5e4 pM to 20 pM for co-culture with peptide pulsed BLCLs. Only 5e4 pM and 20 pM of BiTE® dilution were used for co-culture with unpulsed BLCLs as negative controls. Effector cells were human pan T cells and resuspended at 1.25e6 cells/ml. 25,000 T cells and 2,500 target cells (E:T 10:1) were co-cultured with diluted BiTE® in 384 well plates. After 72 hours, supernatant was harvested and stored at −20 C until assayed for IL-2 with PerkinElmer IL-2 (human) AlphaLISA Detection Kit. BLCL 165 is HLA-A*02:01 negative. HG01786 is HLA-A*02:01 positive. 1346-8357 is HLA-A*02:06/01:01 positive and T7526 is HLA-A*02:06/02:07 positive.

| Cell Line Name | IHW Reference | A1 | A2 |
| --- | --- | --- | --- |
| 1346-8357 | IHW01080 | A*02:06 | A*01:01 |
| T7526 | IHW09076 | A*02:06 | A*02:07 |
| HG01786 (+) | | #12 | A*02:01 |
| 165 (−) | | | A*02:01 Negative Line |

Figure 27:
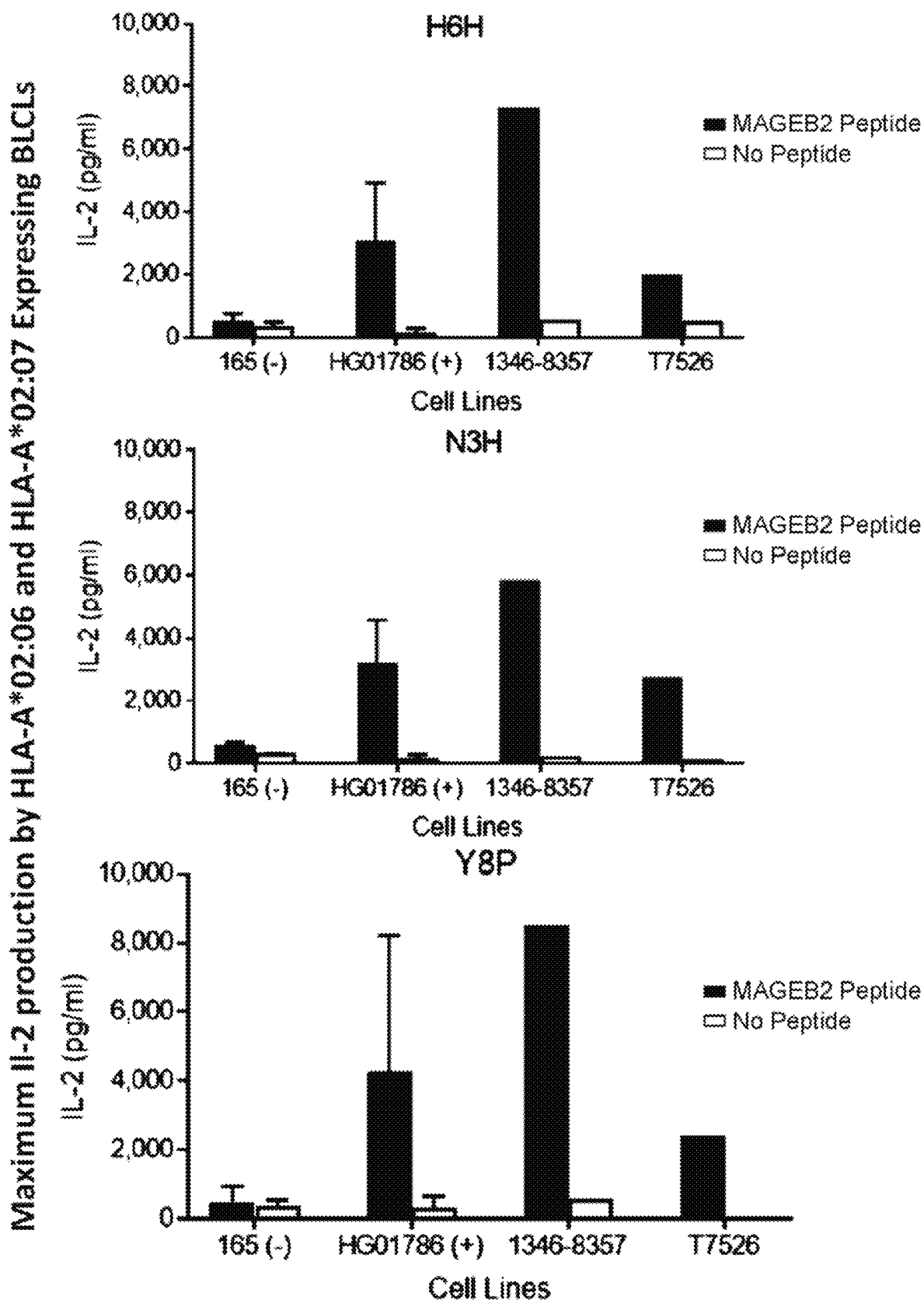
FIG. 27. This figure summarizes the results—activity as measured by IL-2 production—of three different BiTE® molecules binding to cell lines expressing different HLA-A serotypes and exogenously loaded with the MAGEB2 peptide of SEQ ID NO: 1.

Results of this experiment are depicted in FIG. 27 and indicate that the three different binding molecules (H6H, N3H, Y8P) do bind to the pMAGE-HLA complex where the HLA is an HLA-A*01:01 and/or HLA-A*02:06 and/or an HLA-A*02:07.

Example 13: MAGEB2 BiTE® Molecule TDCC: MAGEB2 Peptide Titration on Various Different HLA-A2 Cells The purpose of this experiment was to titrate MAGEB2 peptide onto HLA-A2 T2 cells with various HLAs in TDCC assays with the MAGEB2 N3H BiTE® molecule and evaluate cell killing.
TDCC Assay Overview
  Donor pan T cells: RG1872
  E:T of 10:1
  25,000 pan T cells
  2500 target cells
  Samples run in triplicate
  Incubate plates at 37.0 for 48 hrs
  Readout: luminescence signal via BioGlo
Calculations
  Values normalized to Target Cell Only values for each peptide concentration
  EC50 values calculated without unpulsed values
  Unpulsed values labeled as 0 on plots
Methods
  CD3e and HLA-A*02:01 were knocked out in T2.luciferase cells to generate D5.H6-E1 T2.luc (D5) cells that do not express the HLA-A*02:01 allele. These D5 cells were were used to generate cells that express the different HLA-A family alleles that were assayed. For the T cell-dependent cellular cytotoxicity assay, target cells were resuspended at 1e6 cells/ml in media (RPMI 1640 with 10% fetal bovine serum, 1 mM sodium pyruvate, 100U/ml penicillin/streptomycin, 2 mM Glutamax, 10 mM HEPES, and 1×MEM NEAA). Cells were pulsed with MAGEB2 peptide at 8 10-fold MAGEB2 peptide dilutions starting at 50 uM for 2 hours at 37 C and then peptides were washed off. Target cells including unpulsed cells were resuspended at 1e5 cells/ml. MAGEB2 N3H BiTE® molecule was used at 5e4 pM and EGFRvIII BiTE® molecule was used at 1e4 for co-culture with peptide pulsed cells. Effector cells were human pan T cells and resuspended at 1.25e6 cells/ml. 25,000 pan T cells and 2,500 target cells (E:T 10:1) were co-cultured with N3H BiTE® in 384 well plates and run in triplicate. After 48 hours incubation at 37 C, luminescence signal was assayed using Bio-Glo reagent. Values were normalized to target cell only values for each peptide concentration for each cell line for specific cytotoxicity calculations.

Figure 37B:
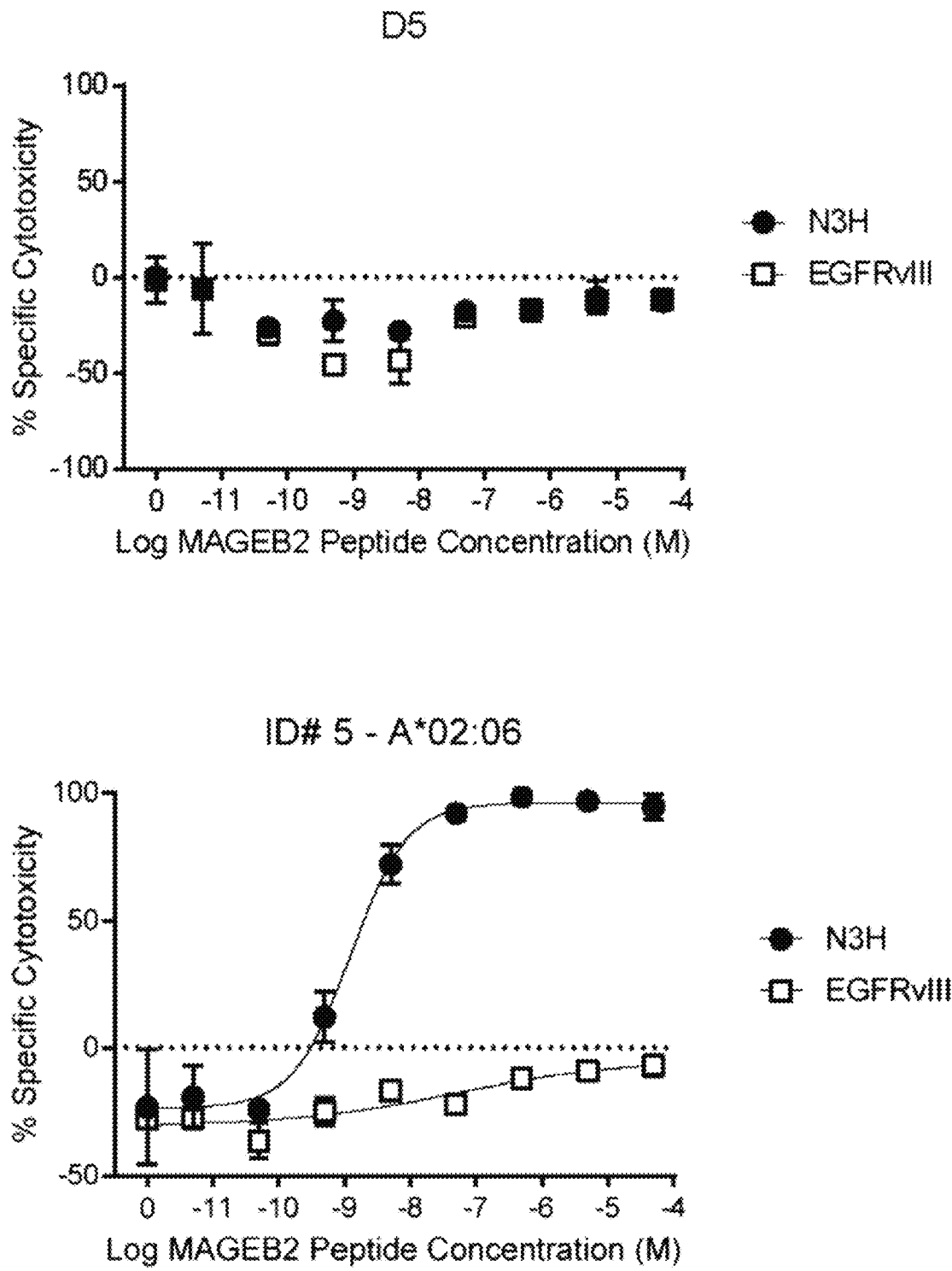
Figure 39A:
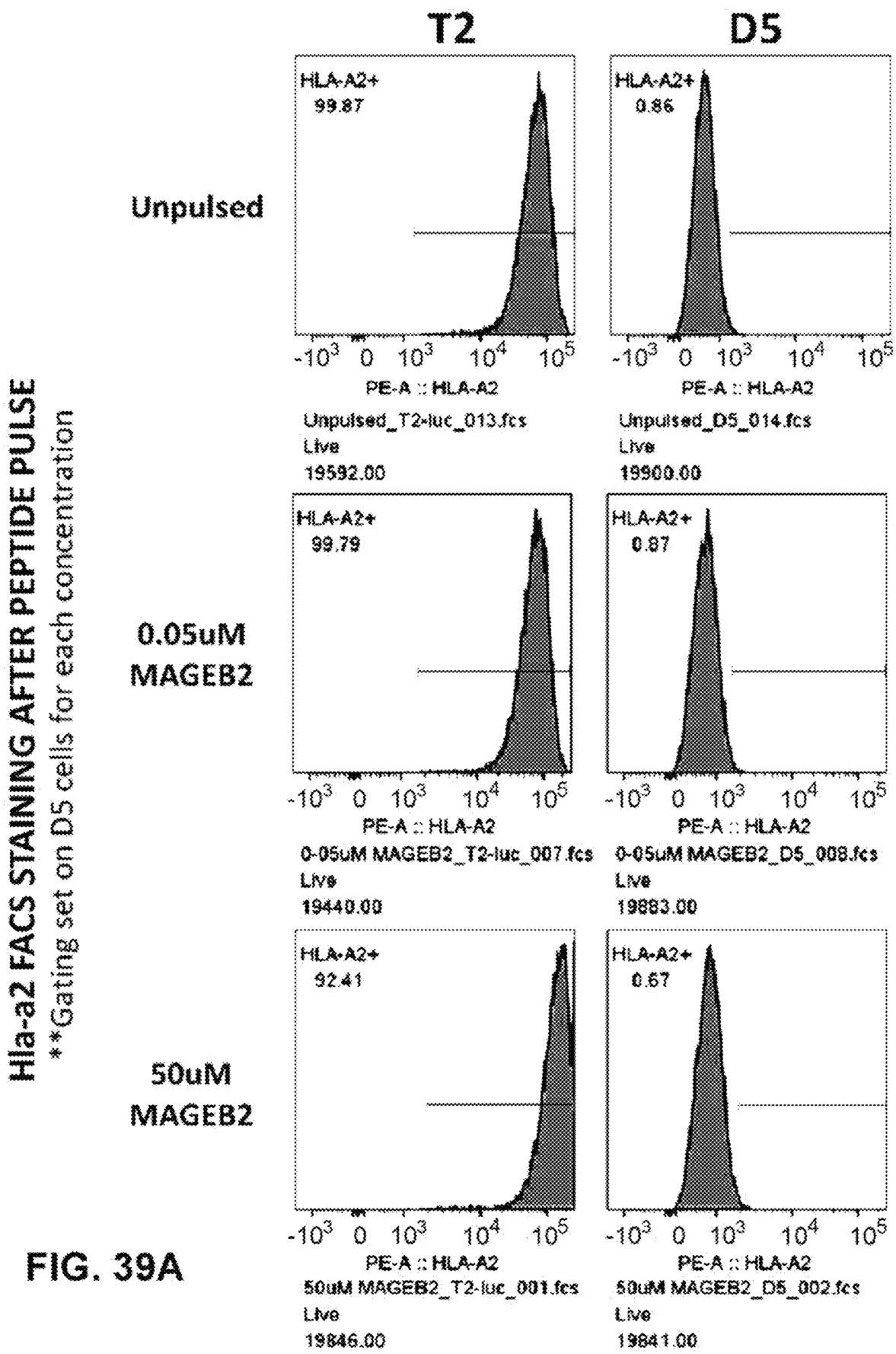
FIGS. 39A-39C. These figures summarize FACS analyses performed on cells expressing various different HLAs and pulsed with the MAGEB2 peptide at 50 µM and 0.05 µM (and unpulsed controls) (FIGS. 39A-39C), but where FACS gating was set on D5 cells for each concentration to better illustrate loading, and demonstrating effective loading with peptide of HLA A*02:01 (FIG. 39B), HLA A*02:05 (FIG. 39B), HLA A*02:06 (FIG. 39C), and HLA A*02:07 (FIG. 39C) and as further detailed in Example 13 herein.
Figure 39B:
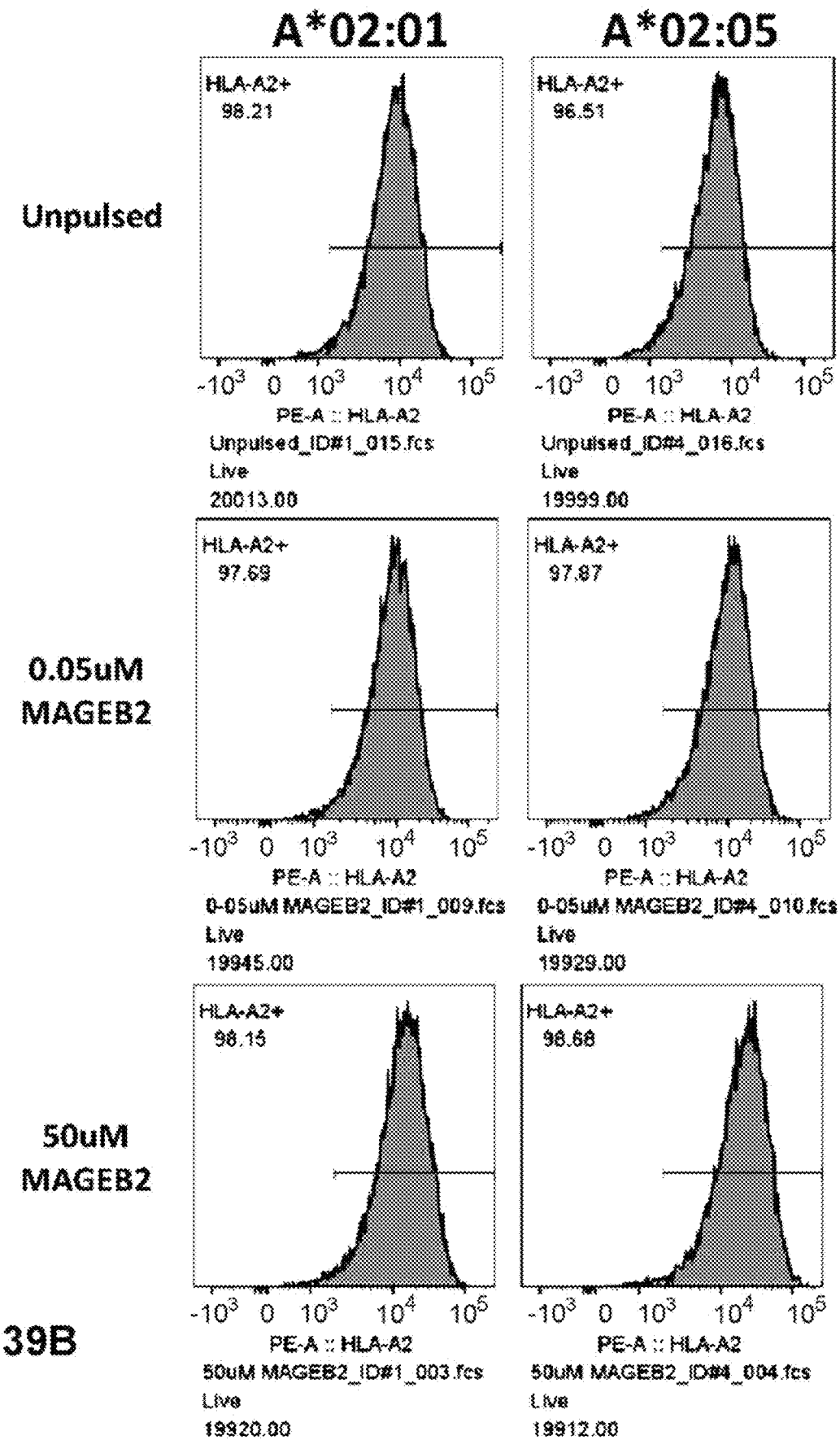
Figure 39C:
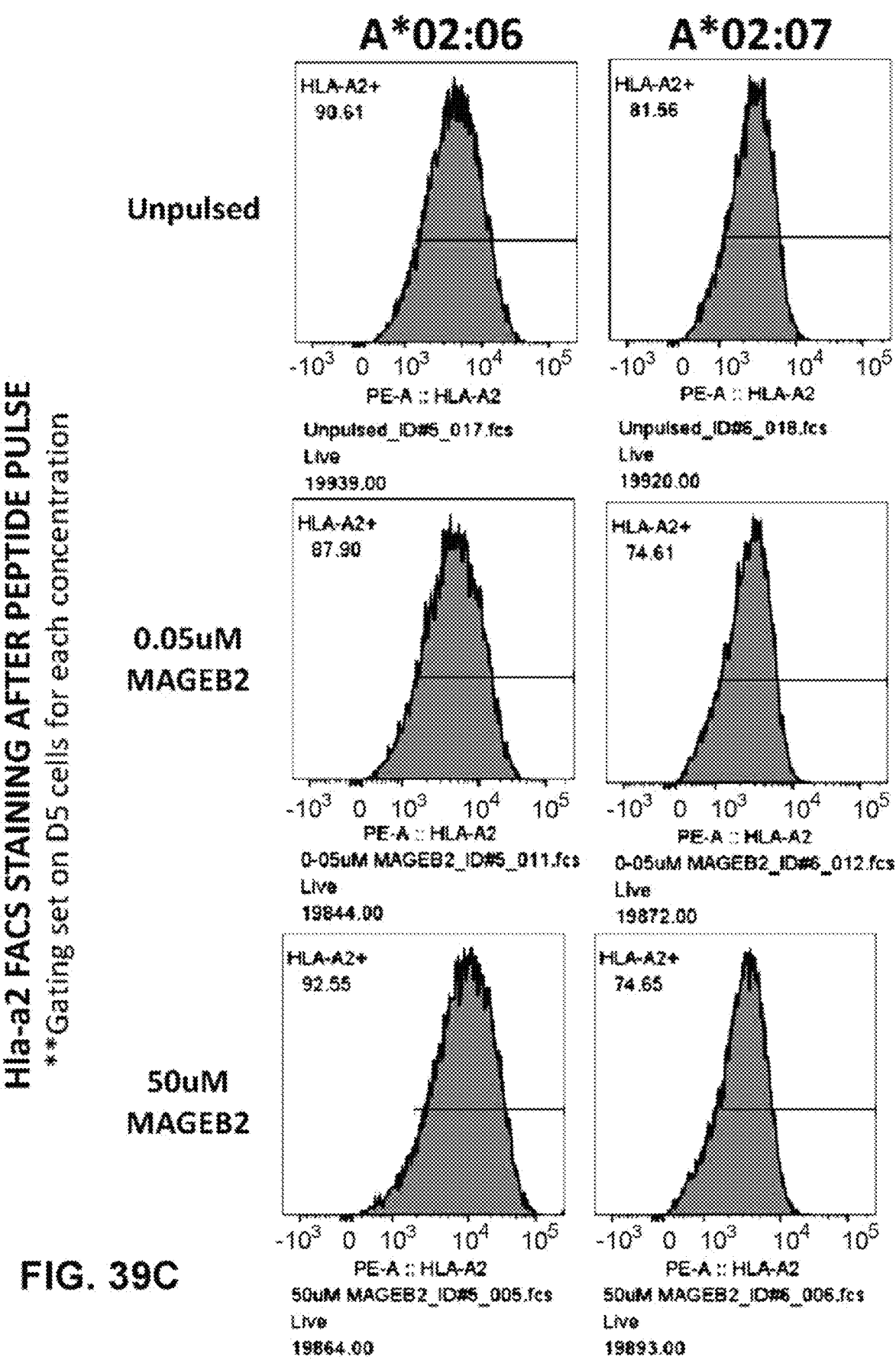

Results are depicted graphically in FIGS. 37-39, and summarized below in Table 76. N3H BiTE® exhibits dose-dependent killing on MAGEB2 peptide titrated onto various T2 HLA-A2 family allele knock-in cells. A*02:05 resulted in lower EC50 compared to T2.luc or A*02:01 rescue and A*02:06 appears similarly potent to A*02:01. A*02:07 resulted in an approximately 2 log higher peptide EC50 concentration compared to A*02:01, which is in line with previous results with N3H BiTE® titrated against this cell line pulsed at a high concentration. At the highest peptide pulse concentration (50 uM), A*02:05 and A*02:06 increased HLA-A2 MFI by 2-to-3-fold compared to unpulsed cells.

TABLE 76

| Cell Line ID # | HLA-A Allele | EC50 (M) | Max Killing (%) |
| --- | --- | --- | --- |
| T2.Luc | A*02:01 | 3.43e−9 | 97.73 |
| D5 | N/A | N/A | 0.35 |
| 1 | A*02:01:01:01 | 5.24e−9 | 96.91 |
| 4 | A*02:05:01:01 | 2.59e−10 | 98.20 |
| 5 | A*02:06:01:01 | 1.23e−9 | 98.29 |
| 6 | A*02:07:01:01 | 3.54e−7 | 82.83 |

Figure 40:
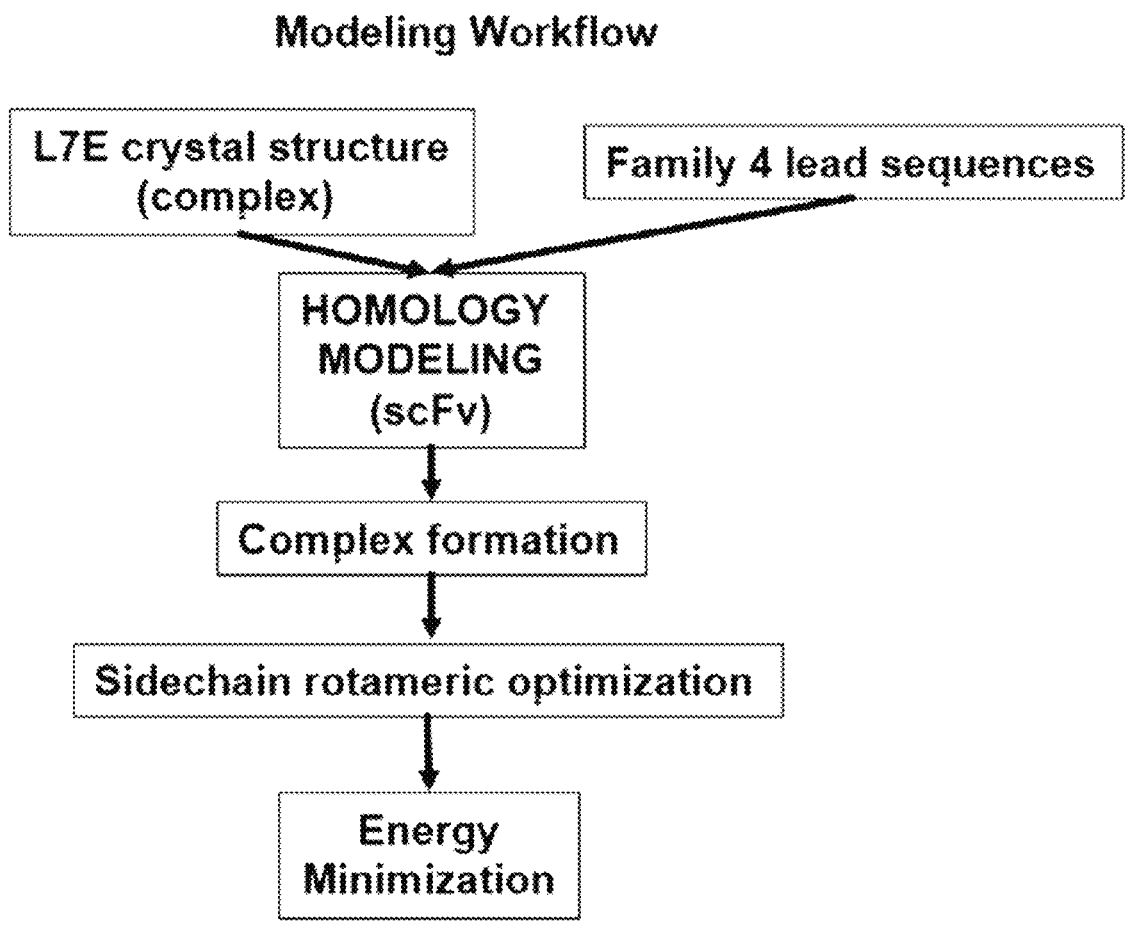
FIG. 40. This figure summarizes the structural in silico modeling workflow for the Family 4 molecules.

Example 14: Homology Model Generation and Analysis of MAGEB2 Peptide/HLA-A02 MHC/Family 4 scFvs Introduction Homology models of several lead scFvs specific for MAGEB2 peptide (p) bound HLA-A02 major histocompatibility complex (MHC) belonging to family 4 were successfully generated. These "in silico" structures are useful to further identify key amino acid residues that play a role in binding of the molecules of the invention to the MAGEB2 pMHC. Homology models were generated utilizing a structural computational approach, utilizing the known crystal structure of one family 4 scFv (L7E) in complex with its pMHC target and generally following the workflow set forth in FIG. 40 herein.

Following the creation of the homology models, predictive mutagenesis algorithms were used to propose alternative mutations at each key residue target binding position and these results are summarized in FIGS. 47-50 herein.

Homology Modeling of scFv N3H Correlates Well with its Crystal Structure.

Figure 41:
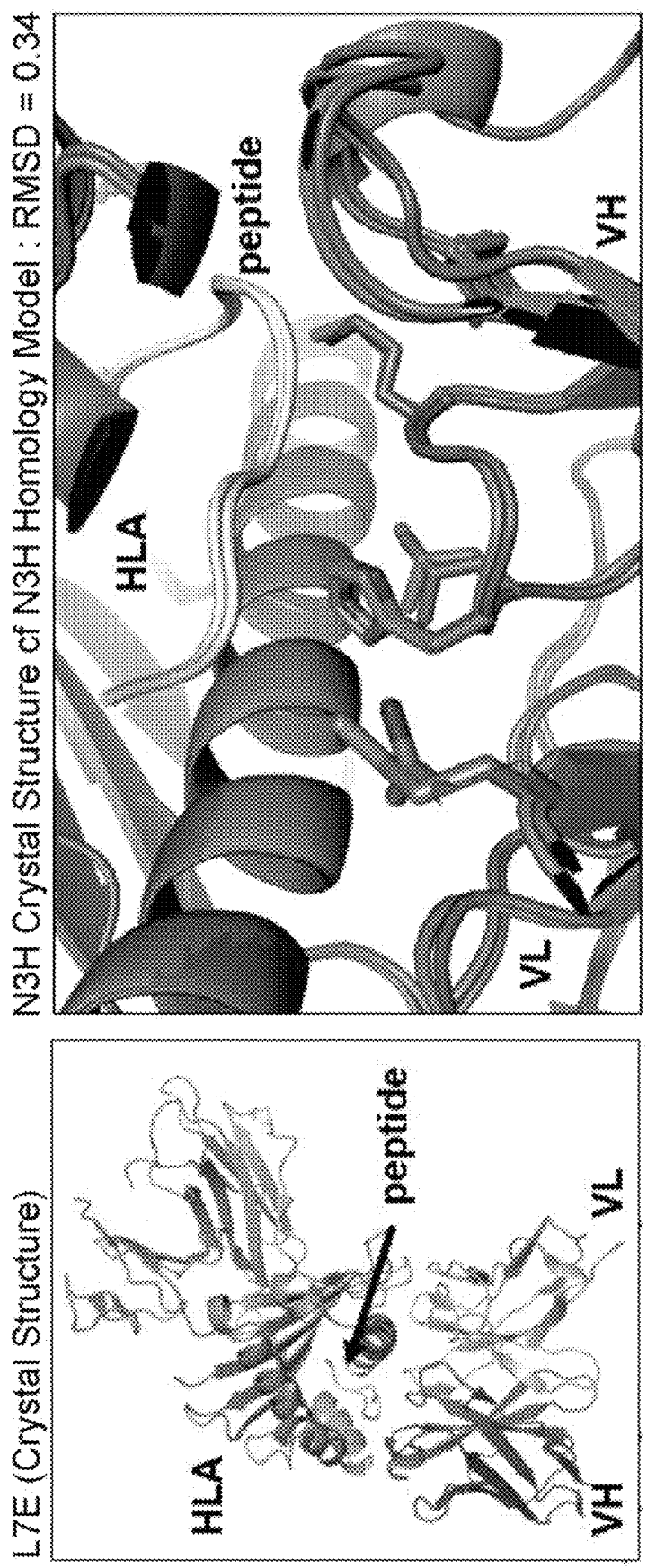
FIG. 41. This figure provides an overview structure of both the L7E molecule crystal structure and the N3H molecule crystal structure overlayed with the N3H in silico homology model, and is further described in Example 14 herein.

A homology model for scFv N3H was generated following the procedure outlined in the methods below, superimposing with its crystal structure with an RMSD of 0.3 A2 (full atom). The region of highest correlation was in the apical regions of the scFv (i.e. away from the target binding site). See FIG. 41 herein. This result supported the validity of models subsequently generated.

Models for Several Family 4 scFvs Show Interactions within the Binding Interface Consistent with Varying Degrees of Stability.

Figure 42:
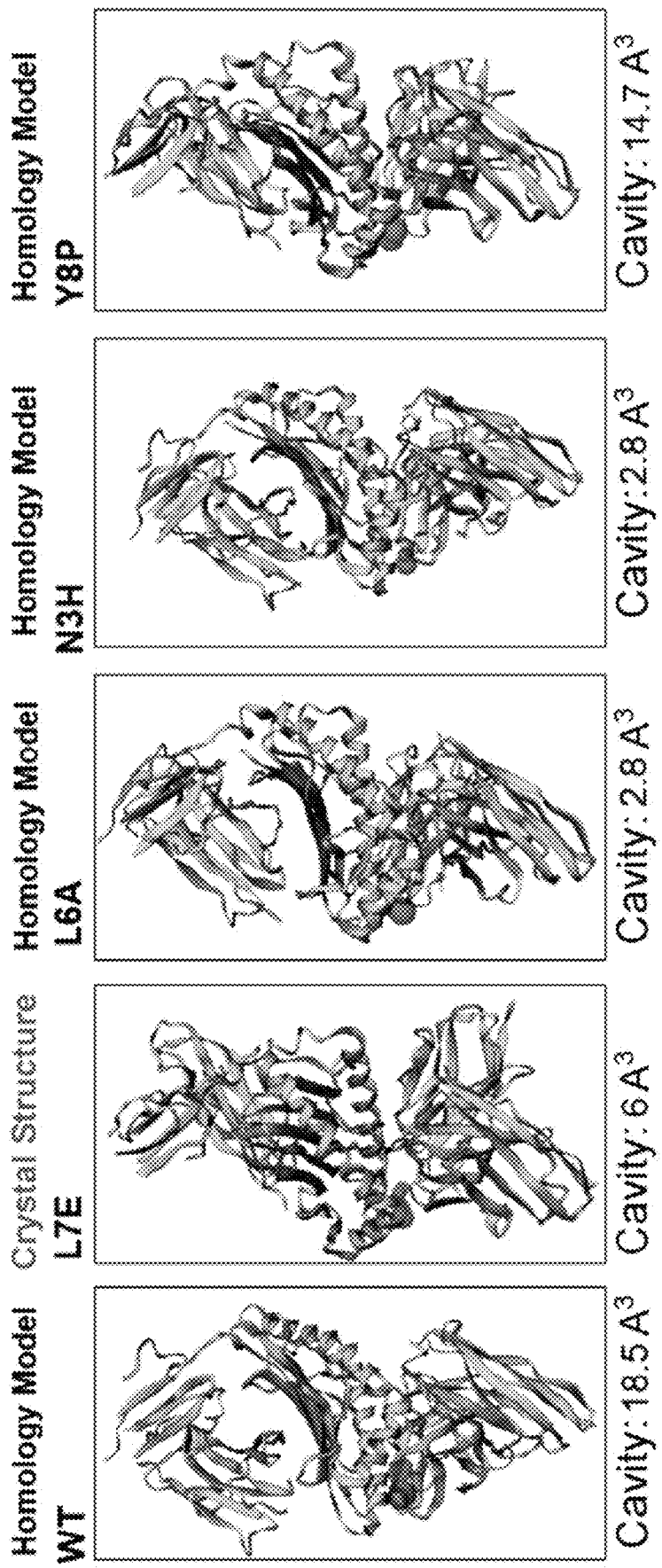
FIG. 42. This figure provides a comparison between the L7E crystal structure and homology in silico models for WT, L6A, N3H, and Y8P, and is further described in Example 14 herein.
Figure 43:
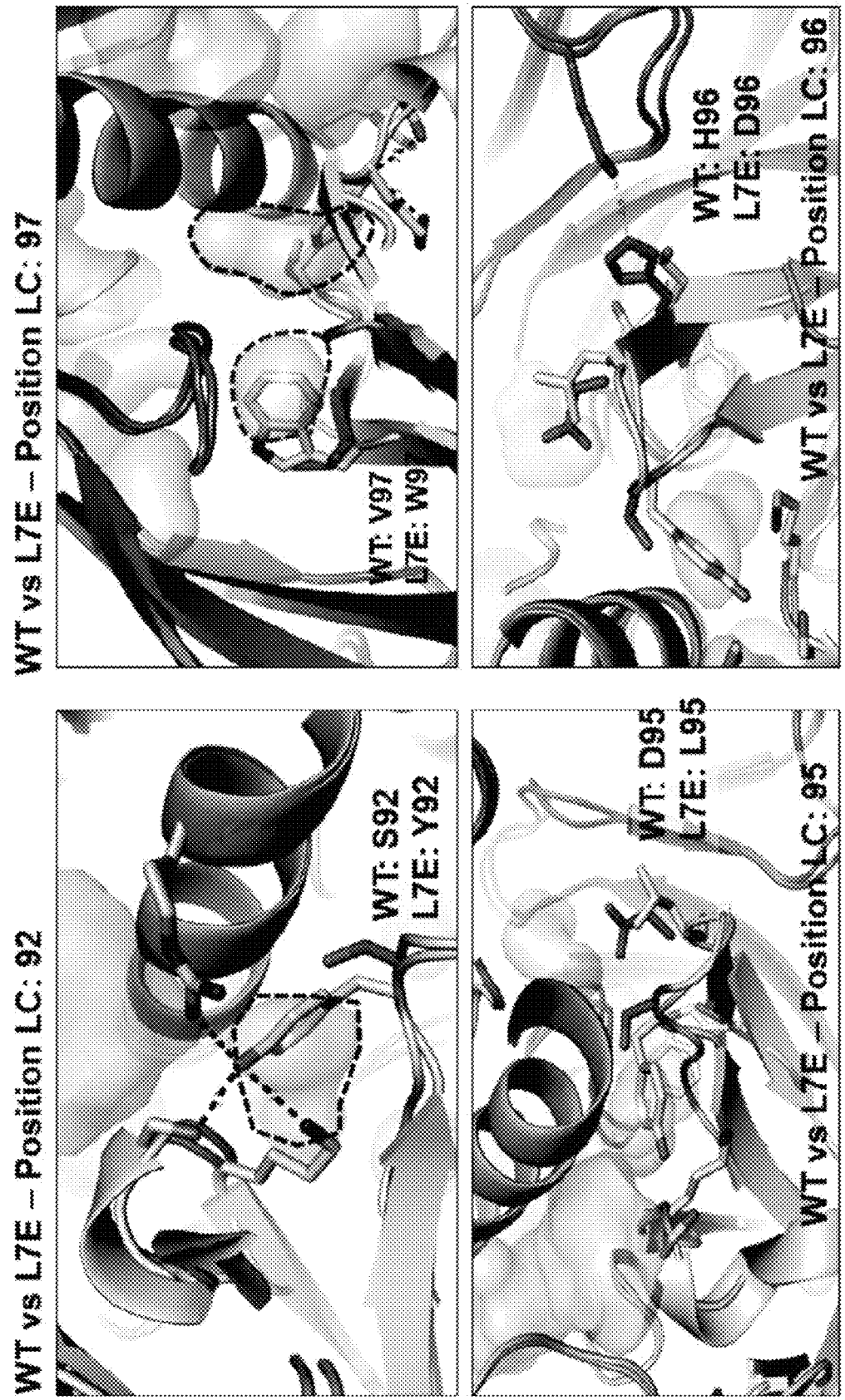
FIG. 43. This figure provides an in silico model comparison between WT and L7E at light chain positions 92, 95, 96, and 97, and is further described in Example 14 herein.
Figure 45:
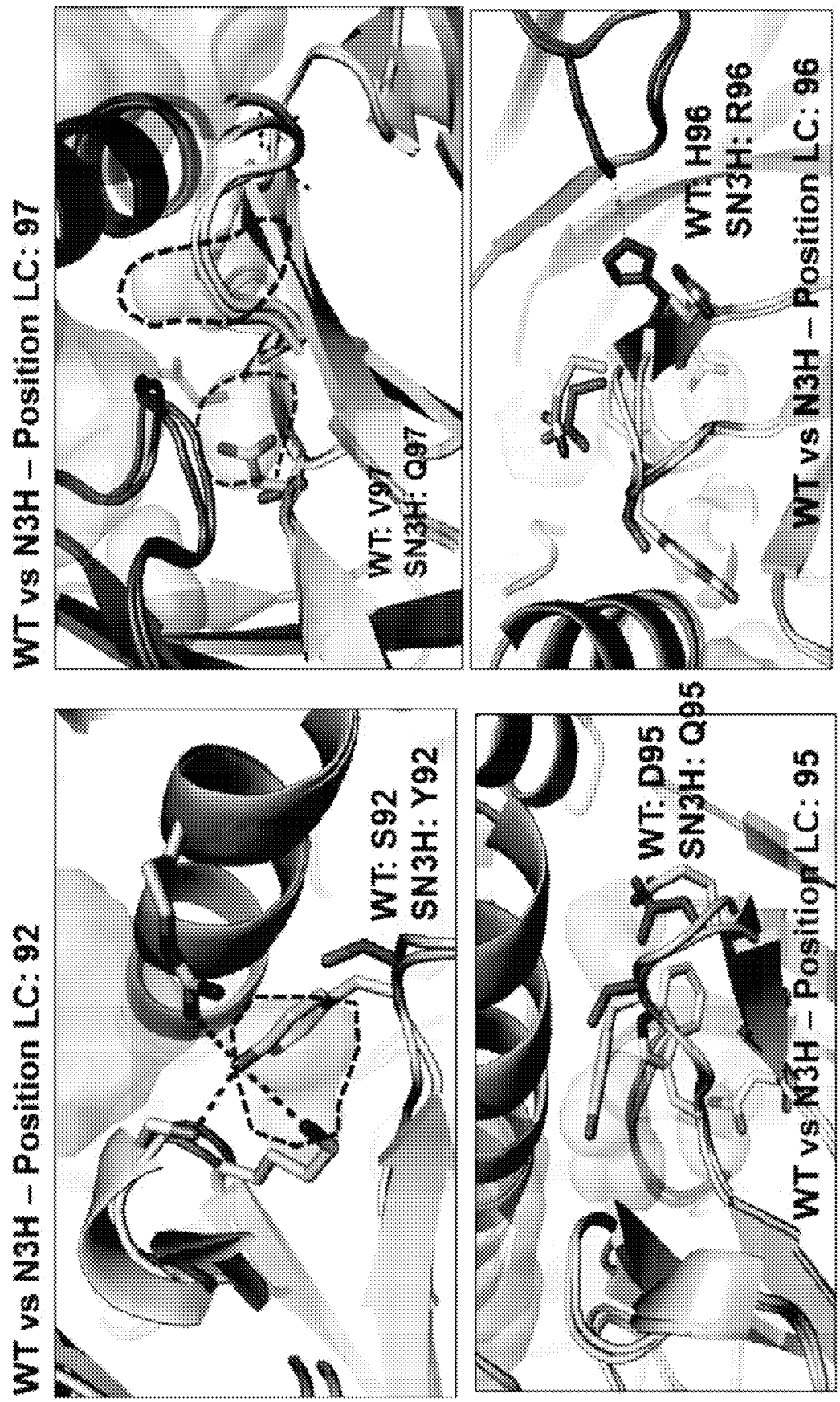
FIG. 45. This figure provides an in silico model comparison between WT and N3H at light chain positions 92, 95, 96, and 97, and is further described in Example 14 herein.
Figure 48:
FIG. 48. This figure provides in silico model predicted alternate residues at light chain positions 92, 95, 96, and 97 in the L6A molecule, and is further described in Example 14 herein.

The homology model for the WT, L6A, N3H and Y8P scFvs was energy minimized and the target binding interface analyzed for the presence of cavities surrounding key residues engaged in binding to the MAGEB2 pM HC. FIG. 42 herein is representative of the results of this analysis. The models indicate varying degrees of contacts and residual cavities upon complex formation, which may translate in different thermostability and affinity. N3H and L6A show smaller cavities, indicating potentially better binding, whereas Y8P and WT, harboring larger cavities, may be less stable.

A closer look at the interactions between the scFvs and the MAGE B2 suggests that the VH and VL portion of the scFv play different roles: the former contacts primarily the peptide, while the latter is engaged in stabilizing the HLA portion of the target receptor. Key determinants of binding have therefore been identified in VL residues: 92, 95, 96 and 97, and position 97 playing a central role in binding. The interaction of those key hotspots was assessed in the context of the four homology models generated (including the parental molecule), as shown in FIGS. 43-46 herein.

VL position 92: Parental residue is a SER, while in all the four models created the residue at position 92 is mutated to TYR, which occupies a cavity (originally present in WT) and engages in hydrogen bonds with three surrounding residues (SER, ARG and LYS) belonging to the target or VL itself.

VL position 95: Parental residue is an ASP. Mutated to GLN or LEU in different models, LEU appears to be more stable and yields more favorable interaction energies.

VL position 96: Parental residue is a HIS. Mutated to ASP, GLN or ARG. The ARG (Y8P) appears to be in a non-favorable position Both GLN and ASP engage in charged contacts (GLN appears most energetically favorable).

VL position 97: Parental residue is a VAL. Mutated to HIS, GLN and TRP. This position serves as bridging region between the VH:VL and HLA.

Interaction energies were calculated utilizing Schrodinger as described in the Methods below and were correlated with observed Tm. The energies have various degrees of predictive power due to insufficient degrees of variation between experiments.

TABLE 100

Energetics vs. WT (B3K)

| Molecule | ΔG - interaction Ab:Ag (kcal/mol) | Δstability (kcal/mol) | dVdW (kcal/mol) | Observed Tm (C) |
|---|---|---|---|---|
| L7E | −380 | −35 | −12 | 53.6 |
| L6A | −466 | −146 | −33 | 56.4 |
| N3H | −460 | −233 | −21 | 57.1 |
| Y8P | −450 | −170 | −18 | 57.0 |
| G2H | −481 | −145 | −35 | 57.0 |
| L6M | −486 | −138 | −22 | 52.7 |
| G2B | −466 | −165 | −21 | 54.5 |
| Q4R | −471 | −151 | −43 | 56.9 |
| Q4Z | −465 | −108 | −23 | 53.6 |
| T1C | −214 | −101 | −33 | 54.1 |

Stability metrics from models show correlation with observed Tm.

Conclusions

Homology models were generated for selected Family 4 scFvs and show high correlation with at least one corresponding crystal structure (N3H). Structural analysis supports the notion that key residues on the light chain (LC) contact the HLA while the heavy chain (HC) appears to play a role in stabilizing the peptide via specific amino acid contacts. Energetic and interaction analysis provides insights into possible key determinants of binding and stability, including the presence of specific voids within the interface. Structural modeling and predictive mutagenesis were also used to broaden the analysis, providing additional mutations for key determinants of binding that are likely to play an equally important role.

Methods

The existing crystal structure of L7E was utilized as basis for the creation of homology models of the parental as well as three additional scFv variants. The complex for all models was optimized by rotameric search along residues at the interface, extending spherically 7 A around each residue and followed by energy minimization. Initial model correction was performed using Coot/Pymol, homology modeling, minimization and energetic analysis was performed using the Schrodinger suite and predictive mutagenesis was done using MOE 2019.02. The modeling workflow is summarized in FIG. 40 herein.

Example 15: Effect of Test Articles on Human T Cell Mediating Killing of Patient-Derived Organoids (PDXOs)

TABLE 101

Abbreviations for Example 15

| | |
|---|---|
| PDXO | Patient-derived xenograft organoid |
| ELISA | Enzyme-linked immunosorbent assay |
| NSCLC | Non Small Cell Lung Cancer |
| SCLC | Small Cell Lung Cancer |
| LUTM | Lung Tumor Medium |
| CRTM | Colonrectal Tumor Medium |
| PBS | Phosphate Buffer Saline |
| FACS | Fluorescence-activated Cell Sorting |
| RPMI | Roswell Park Memorial Institute |
| FBS | Fetal Bovine Serum |
| Cat #. | Catalog number |
| hPBMC | Human peripheral blood mononuclear cell |
| min | Minute |
| hr | Hour |
| RT | Room Temperature |

Objectives

This study aimed to evaluate the capacity of test molecules to retarget human T cells on patient-derived xenograft organoids (PDXOs) in order to induce their killing, as assessed by the enzyme-linked immunosorbent assay (ELISA) and flow cytometry.

Materials
Human Peripheral Blood Mononuclear Cell (hPBMC)
The frozen PBMCs from 1 donor (coded as LP200601B) were obtained and used for 4.2.
PDXOs

TABLE 102

Organoid information

| No. | Model_Name | Race | Cancer Type | Subtype | Culture Medium |
|---|---|---|---|---|---|
| 1 | LU1206 | Asian | Lung Cancer | NSCLC, SCC | LUTM |
| 2 | CR5088 | Western | Colonrectal Cancer | NA | CRTM |

Reagents

TABLE 103

Major reagents used in this study

| Item | Supplier | Cat# |
|---|---|---|
| Advanced DMEM/F12 | Life Technologies | 12634028 |
| DMEM | Hyclone | SH30243.01 |
| RPMI1640 | Gibco | A1049101 |
| Matrigel GFR, Phenol Red-free | Corning | 356231 |
| Organoid culture media LUTM, CRTM | Crownbio | |
| Coculture medium | Crownbio | |
| PBMC | Allcells | PB006-C |
| TrypLE ™ Express | Life Technologies | 12605010 |
| 2-ME | Gibco | 21985-023 |
| FBS | Gibco | 100991-148 |
| EDTA | Gibco | 15575-038 |
| PBS | Hyclone | SH30256.01 |
| CFSE | eBioscience | 65-0850-84 |
| IL-2 ELISA Kit | R&D | D2050 |
| IFNγ ELISA Kit | R&D | DIF50 |
| Granzyme B ELISA Kit | R&D | DGZB00 |
| HLA-A2 antibody | BD | 558570 |

Note:
Complete T cell Medium: RPMI 1640 with 10% FBS, 1% P/S and 55 uM 2-ME
Coculture medium: Complete T cell Medium/LUTM (1:1) + 5% MG or Complete T cell Medium/CRTM (1:1) + 5% MG Test Articles

TABLE 104

Test Articles supplied by Sponsor

| Name | M.W. Da | Stocking Conc. | | Storage |
|---|---|---|---|---|
| N3H | 104636.6 | 5 mg/mL | 47.8 μM | −80° C. |
| H6H | 105934.1 | 5 mg/mL | 47.2 μM | −80° C. |
| W5C | 106863.0 | 1 mg/mL | 9.4 μM | −80° C. |
| Q9R | 54385.6 | 1 mg/mL | 18.4 μM | −80° C. |

Other Equipment

TABLE 105

Other equipment used in this study.

| Item | Supplier | Cat# |
|---|---|---|
| 6 Well Clear TC-Treated Multiple Well Plates | Corning | 3516 |
| 12 Well Clear TC-Treated Multiple Well Plates | Corning | 3512 |

TABLE 105-continued

Other equipment used in this study.

| Item | Supplier | Cat# |
|---|---|---|
| 96-Well Ultra-Low Attachment Microplate | Corning | 3340 |
| 20 μm cell filters | PluriSelect | 43-50020-03 |
| 70 μm cell filters | Greiner | 542070 |
| CO2 Water Jacketed Incubator | Thermo Scientific | |

Procedures
HLA-A2 Screening

The selected organoids models, LU1206B and CR50886, were thawed and cultured in the corresponding medium, LU™ and CR™, until they reached 2-3 wells of 6 well plate. The organoids (20-100 μm in size) were harvested and counted, and $1\times10^5$ organoids were used for HLA-A2 staining, and then dissociated into single cell by TryLE digestion. The TryLE activity was stopped by adding the wash medium and then centrifuged at 300 g for 5 mins. The organoid cells were washed twice and counted by trypan blue exclusion assay to get an estimation of the single cells/organoid for later coculture use. All cells were transferred to labeled FACS tubes. 2 mL of FACS buffer was added to each tube and cells were re-suspended gently. Tubes were then centrifuged at 300 g for 5 mins and then discarded the supernatant. The wash steps were repeated 2×. Anti-human HLA-A2 antibody diluted in FACS buffer was added to each sample and incubated at RT for 30 mins in the dark. Cells were washed twice with 2 ml of FACS wash buffer, centrifuged and then decanted supernatant. Cells were resuspended in 100 μL of FACS staining buffer. 5 μL of 7-AAD staining solution was added to each sample, and incubated for 10 mins before analysis. The data are analyzed by Kaluza.

Redirected T Cell Killing for Organoids
Organoid Seeding

Expanded the selected organoid models (LU1206B and CR50886) to $1\text{-}2\times10^6$ organoids (20-70 μm in size). On the day of the experiment, collected the organoids into the labeled centrifuge tubes, counted the organoid numbers. Resuspended the desired number of organoid (2500 organoid/well) with 5 ml of PBS. Prepared 2×CFSE solution (4 μM) in PBS (pre-warmed to RT), added 5 ml of 2×CFSE solution to 5 ml of organoid suspension to a final concentration of 2 μM according to CFSE cell labeling kit, incubated at RT for 5 mins. Stopped labeling by adding 40 ml of pre-chilled medium (RPMI1640+10% FBS), and then centrifuged at 300 g, 4° C. for 5 mins. Supernatant was discarded and then the wash step was repeated. Resuspended the organoid in the coculture medium and seeded 90 μl of organoids suspension to each well (2500 organoid/well) of 96-well ultra low attachment U bottom plate.

hPBMCs Preparation

Frozen hPBMC were used for the coculture. Thawed the frozen hPBMCs rapidly using a water bath at 37° C. and immersed the cryotubes with gentle agitation. Added pre-warmed complete T cell medium to 12 ml and centrifuged at 2000 rpm for 5 min RT. Repeated the wash again and centrifuged at 2000 rpm for 5 min RT. Removed the medium and resuspended the hPBMC in coculture medium and counted the cell number by trypan blue exclusion assay.

Cytotoxicity Assay

Added 90 μl of hPBMCs with desired cell numbers to corresponding E:T ratios (E: effector cells, T: target cells).

Prepared the antibody solution (1:100 dilution), treated the cells with 20 μl antibody solution per well (final concentration is 50,000 pM). Incubated the cells at 37° C. for 48 hrs, checked the medium color and cell status every day. After incubation, centrifuged the 96-well plate at 300 g for 5 min, then collected 80 μl of the supernatant for the ELISA analysis of on IL-2, IFN-γ and Granzyme B by following the instruction from the kit. Transferred the cells with care to 96-V bottom plate and combine 2 wells into 1 sample and 3 samples for each treatment. Dissociated the organoids into single cell with 50-100 μl TrypLE, incubated the organoids at 37° C. until the cells were getting dissociated by several rounds of pipetting. Added 100-150 μl of RPMI 1640 to stop TrypLE digestion, centrifuged at 300 g, 5 min, discarded the supernatant. Transferred all cells in 200 μL FACS buffer to labeled FACS tube, centrifuged at 300 g for 5 mins at 4° C. Added 1 μL Fixable Viability Dye eFluor™ 780 to the cells and incubate at 4° C. for 30 mins in the dark. Added 2 mL FACS buffer to each well and re-suspended cells gently. Centrifuged the plates at 300 g for 5 mins at 4° C. and discarded the supernatant. Repeated the wash steps. Resuspended the cells in 200 μL of FACS buffer and analyzed on a flow cytometer. The data are analyzed by Kaluza.

Data Analysis

ELISA data are analyzed by GraphPad Prism. FACS data are analyzed by Kaluza. All statistics were performed using Prism 8, version 8.3.0. The comparison between treatment and control group was performed by the Student's t-test.

Results

LU1206B

HLA-A2 Expression in LU1206B

1×10^5 organoids were digested into single cell suspension with TrypLE and HLA-A2 expression was analyzed by using flow cytometry.

ELISA of IFN-γ, IL-2 and Granzyme B

Figure 51A:
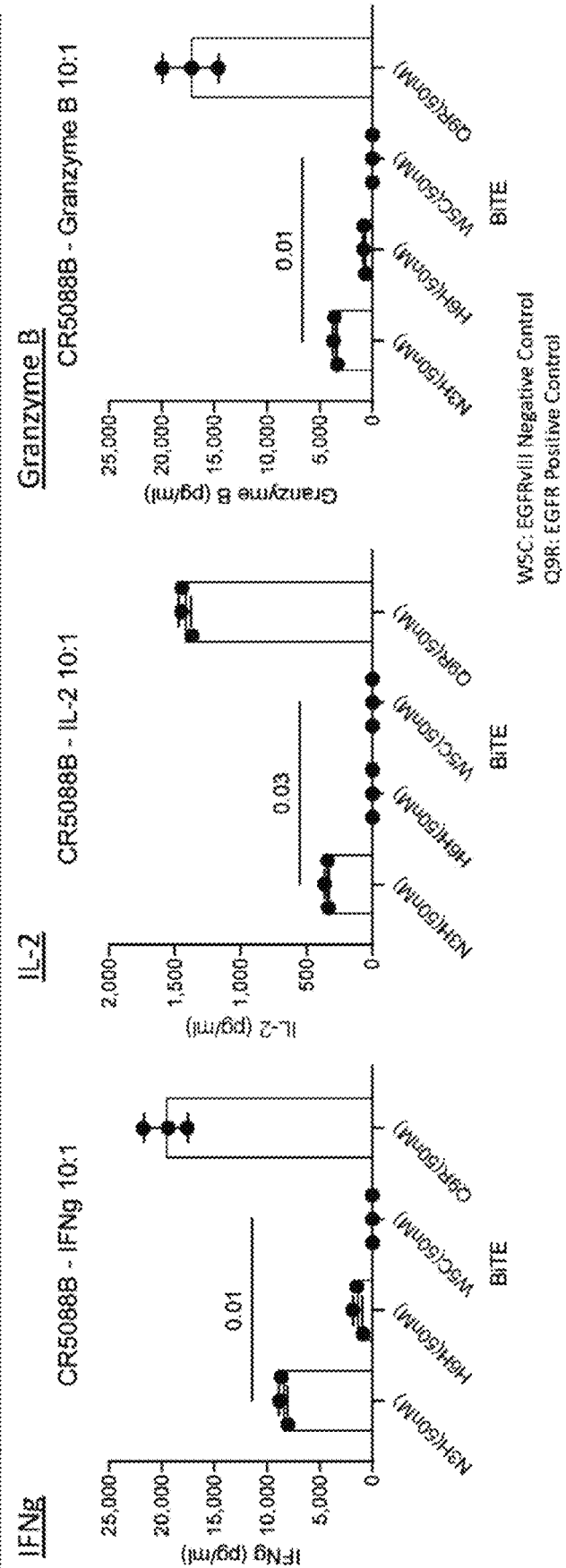
FIGS. 51A and 51B. These figures provide in graph format summaries of results of the N3H, H6H, and control molecules against tumor organoids using two different T-cell donors. The y-axis is IFNg concentration in pg/ml and the x-axis is each different molecule tested.

The supernatant from coculture of LU1206B with hPBMC was collected and IFN-γ, IL-2 and Granzyme B in the supernatant was measured by ELISA. The production of the three cytokines in the coculture is shown in FIG. 51A herein.

CR5088B

HLA-A2 Expression in CR5088B

1×10^5 organoids were digested into single cell suspension with TrypLE and HLA-A2 expression was analyzed by using flow cytometry.

6.2.2 ELISA of IFN-γ, IL-2 and GranzymeB in CR5088B

Figure 51B:
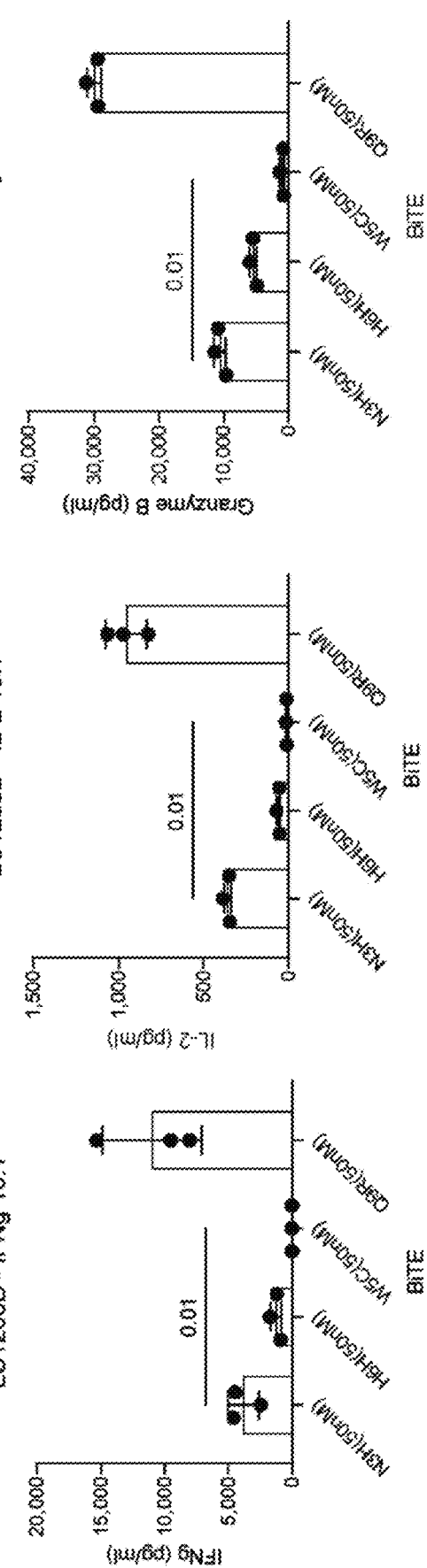

The supernatant from coculture of CR5088B with hPBMC was collected and IFN-γ, IL-2 and Granzyme B in the supernatant was measured by ELISA. The production of the three cytokines in the coculture is shown in FIG. 51B herein.

Summary

In the LU1206B coculture assay, the production of IFN-γ, IL-2 and Granzyme B in N3H- and H6H groups was dramatically increased as compared to the W5C group (a negative control molecule) at both E/T ratios. Such an increase was also observed in the Q9R group, serving as a positive control. A small killing effect on LU1206B was observed in N3H and H6H groups. In the CR5088B coculture assay, N3H- and H6H groups showed a much higher production of IFN-γ, IL-2 and Granzyme B as compared to the W5C control group. A small killing effect was observed in the N3H and Q9R groups at both E/T ratios and in the H6H groups at higher E/T ratios. This data indicates proper targeting and associated effects by both the N3H and H6H molecules.

Example 16: TDCC Assays Against DAN-G Cells

BiTE® molecule-induced redirected lysis and T cell activation against MAGEB2 pMAGE-HLA expressing target cells was determined in cytotoxicity assays by flow cytometry (Becton, Dickinson and Company (BD), FACSCanto II).

Figure 52A:
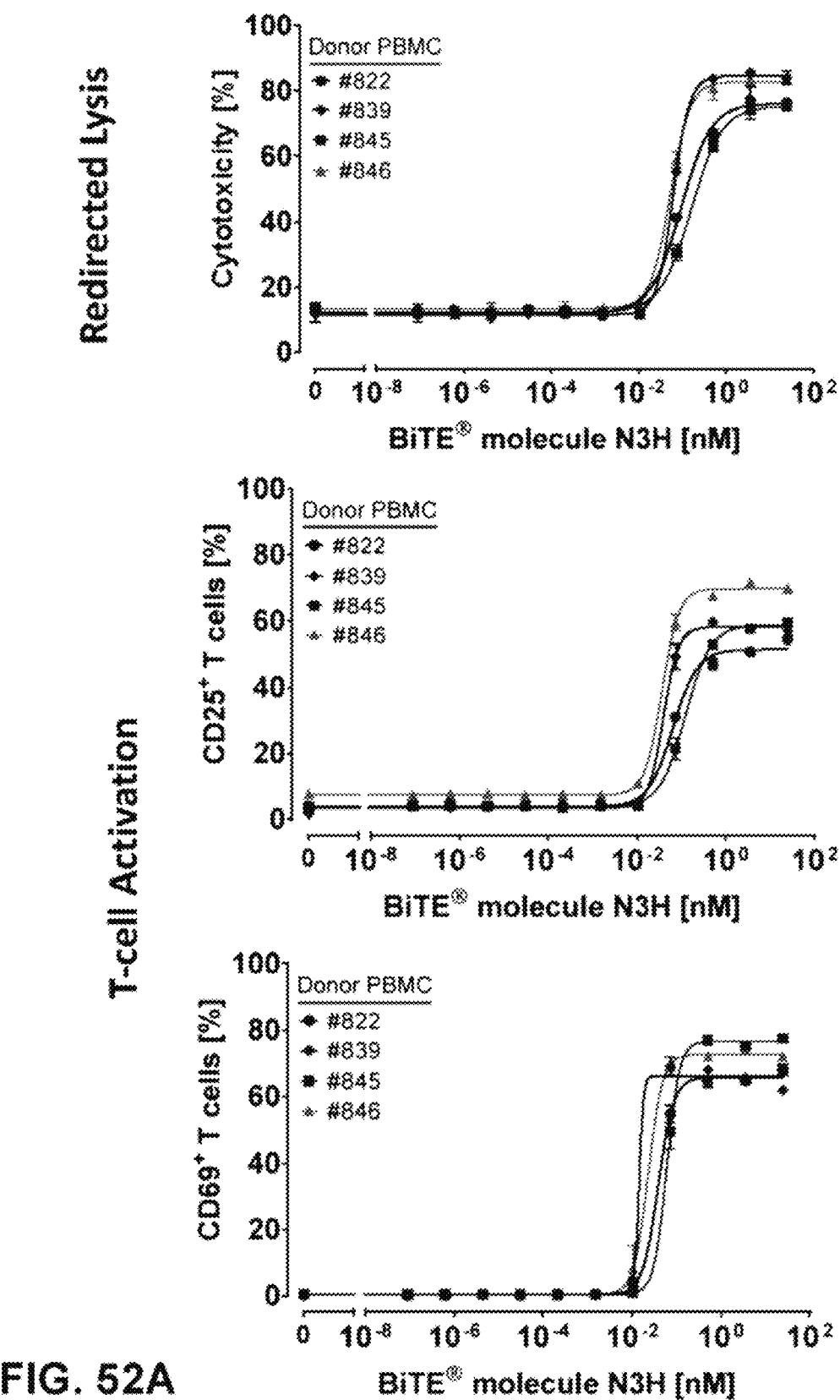
FIGS. 52A-52D. These figures provide in graph format summaries of results of the N3H (FIG. 52A) and H6H (FIG. 52B-52D) molecules in TDCC assays using Dan-G target cells. The x-axis is log BiTE® molecule concentration (nM) and the y-axis is % cytotoxicity.
Figure 52B:
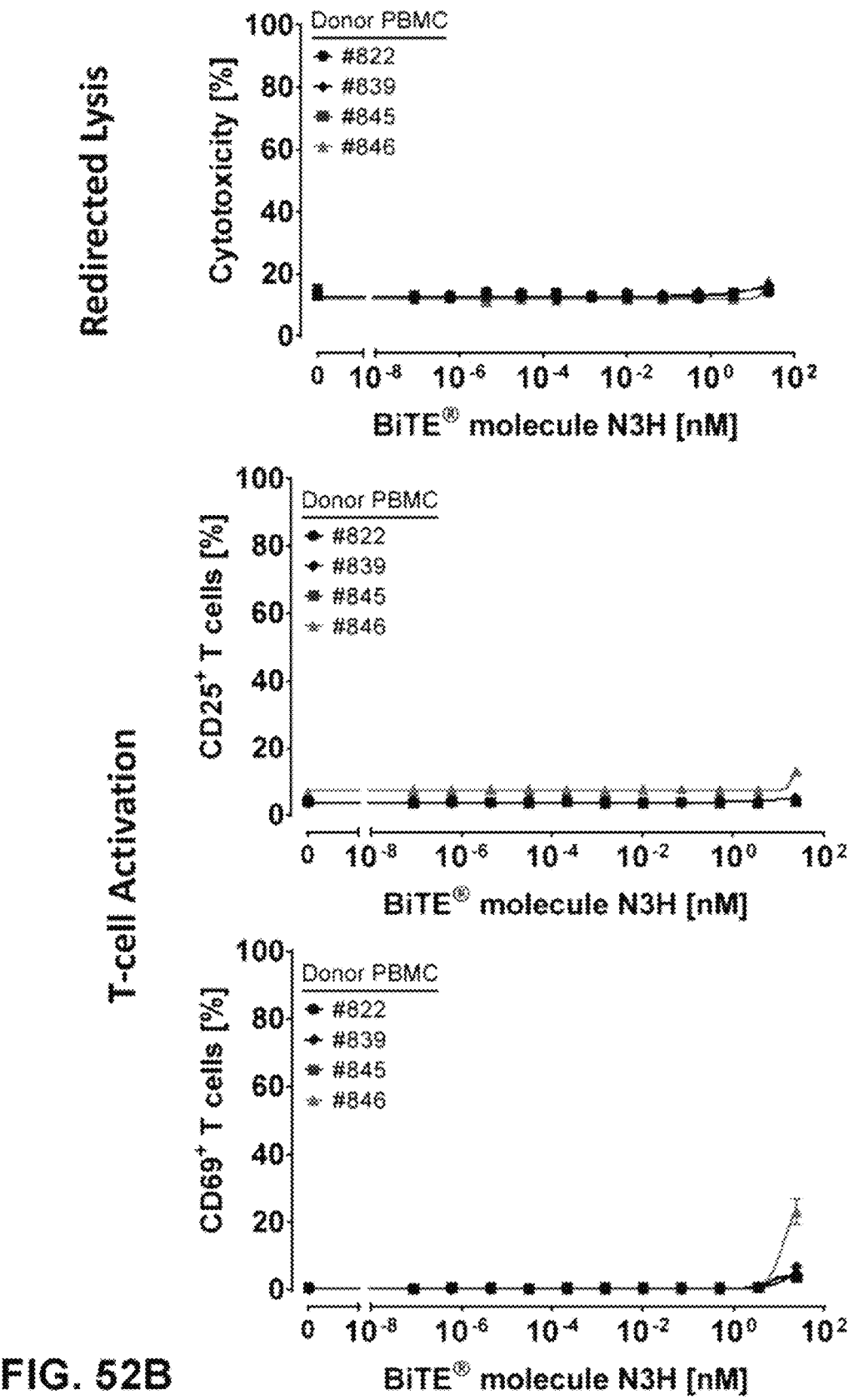
Figure 52C:
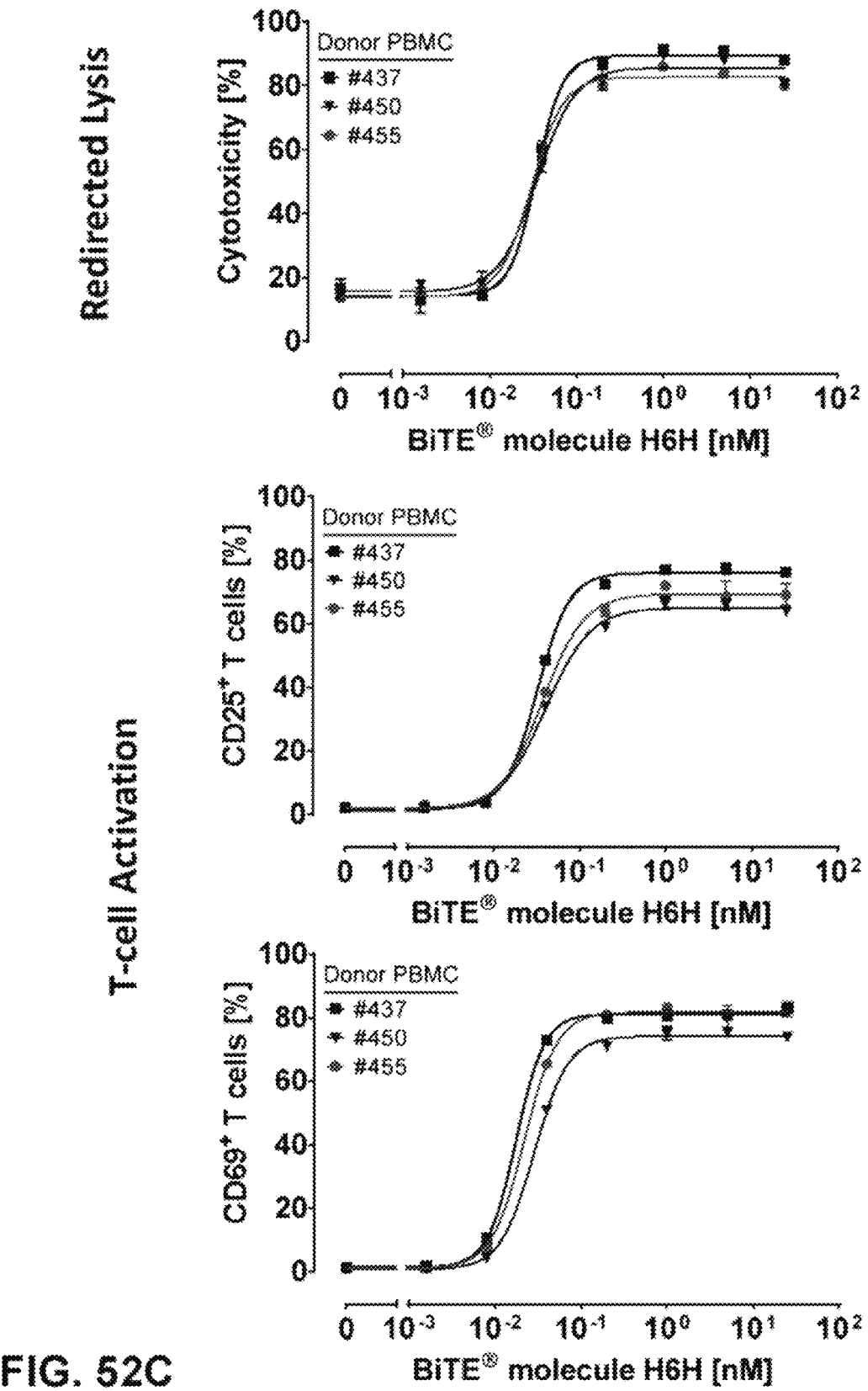
Figure 52D:
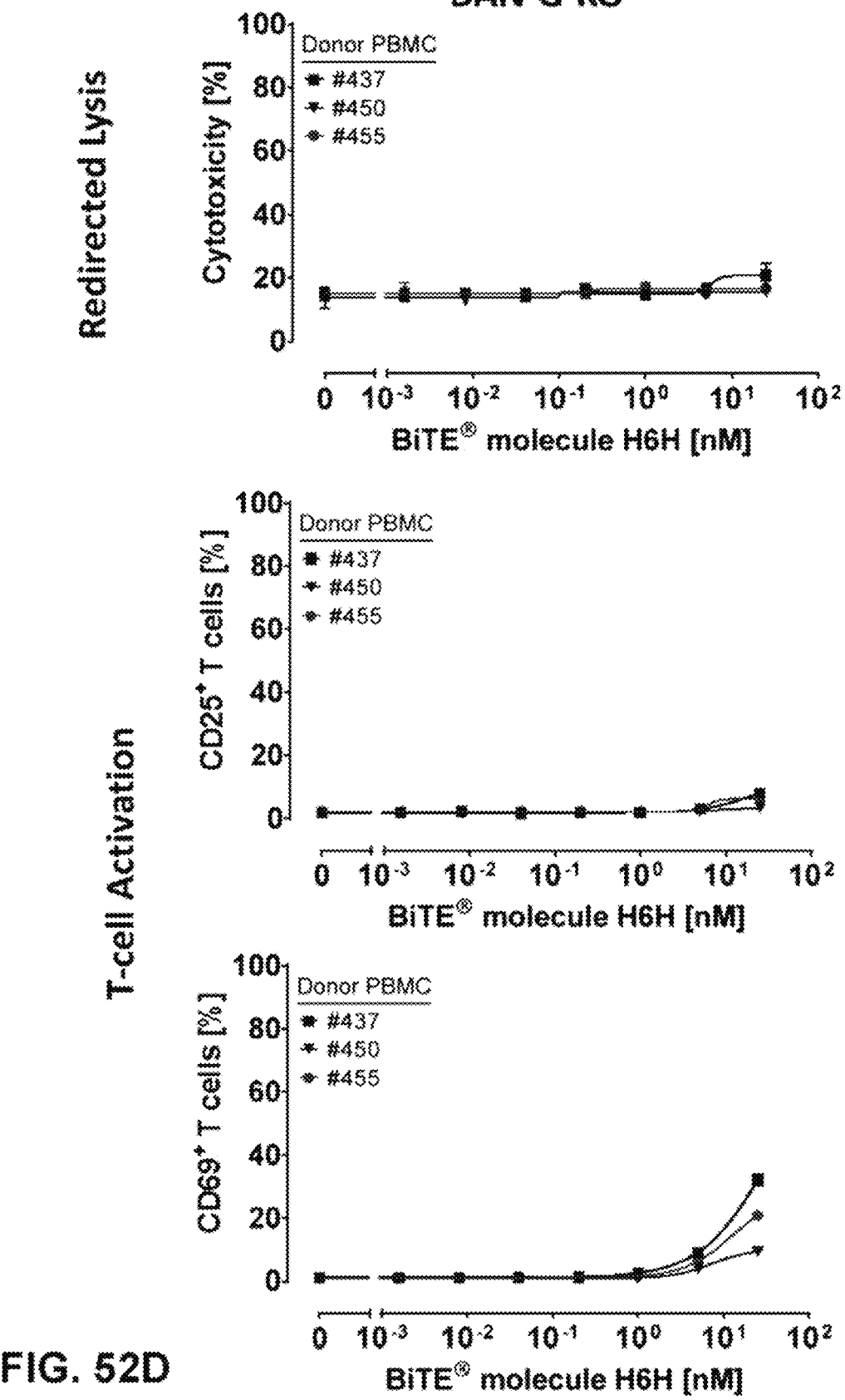

The MAGE-B2-positive tumor cell line DAN-G (German Collection of Microorganisms and Cell Cultures GmbH (DSMZ), Cat. No. ACC 249) and the tumor cell line DAN-G knocked-out for MAGE-B2 were labelled with the fluorescent membrane dye DiO (Invitrogen, Cat. No. V22886) according to the manufacturer's instructions. Human T cells ($1\times10^5$) were co-cultured with DiO labelled tumor cells ($1\times10^4$) and serial dilutions of the MAGE-B2 BiTE® molecules H6H and N3H in 96 well flat bottom plates. Co-cultures were performed at 37° C. in a 5% CO2 incubator for 48 hours. Following incubation, adherent cells were detached by Trypsin/EDTA (Gibco, Cat. No. 15400054) and pooled with non-adherent cells. Flow cytometric analysis was performed to investigate tumor cell lysis and T cell activation on pooled cells. Tumor cells were identified as DiO-positive cells. Redirected lysis of DiO-positive tumor cells was determined by measurement of PI incorporation. T cells were identified by antibodies directed to CD4 (BD, Cat. No. 651849/566703) and CD8 (BD, Cat. No. 560179); their activation status was monitored by antibodies directed to the extracellular proteins CD25 (BD, Cat. No. 555432) and CD69 (BD, Cat. No. 557745). Antibody staining was performed for 30 minutes at 4-8° C. in the dark. Percentages of tumor cell lysis and up-regulation of CD25, CD69 on T cells were plotted against the logarithm of BiTE® molecule concentrations. Data demonstrating proper targeting and cell killing by the BiTE® molecules is summarized in FIGS. 52A (for N3H) and 52B (for H6H) herein.

Example 17: In Vivo Efficacy of MAGEB2 BiTE® Molecules

The aim of the study is the evaluation of BiTE® molecules that target a pMAGE-HLA, specifically, one complexed with a MAGEB2 peptide, and their efficacy on NCI-H2023 human NSCLC xenograft tumor formation and the pharmacokinetic properties in female NXG mice.

Experimental Schedule

Day −1: Prearrangement: assign to cages, earmark, shave, take first body weight; tumor and PBMC cell mix injection, group allocation (w/o irradiation)

Day 3: Treatment start—planned q7dx3

Start of PK

First Tumor Volume measurement

Day X: Study end

TABLE 106

Study Design

| | | Cell Injection | | | | Treatment | | |
|---|---|---|---|---|---|---|---|---|
| | | NCI-H2023 | hu PBMC | | | | | |
| Group | Mice/ Group | Tumor Cells/Mouse | Effector Cells/Mouse | E:T Ratio | Matrigel* 1.5 mg/Mouse | Treatment | RoA | Dosing Schedule |
| 1 | 8 | $5 \times 10^6$ | $2.5 \times 10^6$ | 1:2 | Yes | Vehicle | IV | Days 3, 10, 17 |
| 2 | 8 | $5 \times 10^6$ | $2.5 \times 10^6$ | 1:2 | Yes | N3H 2 mg/kg | IV | Days 3, 10, 17 |
| 3 | 8 | $5 \times 10^6$ | $2.5 \times 10^6$ | 1:2 | Yes | N3H 0.2 mg/kg | IV | Days 3, 10, 17 |
| 4 | 8 | $5 \times 10^6$ | $2.5 \times 10^6$ | 1:2 | yes | N3H 0.02 mg/kg | IV | Days 3, 10, 17 |
| Σ | 32 | $\sim 2 \times 10^8$ with 20% surplus | $\sim 1 \times 10^8$ with 20% surplus | | | | | |

*Reduced Growth Factor Basement Membrane Extract, Path Clear ® (Matrigel) will be adjusted to a final concentration of ~7.5 mg/mL (~1.5 mg/mouse when injected 200 μL).

TABLE 107

Test Species

| | |
|---|---|
| Species/Strain: | Mouse/NOD-Prkdcscid-IL2rgTm1/Rj "NXG" |
| Number/Sex: | 32/female |
| Vendor: | Janvier |
| Age at arrival: | 7 weeks |
| Weight at start of experiment: | tbd |
| Age at start of experiment: | tbd |
| Subject's disease status: | Immunocompromised mice with SC injected cell mix of NCI-H2023 tumor cells and human PBMC effector cells |
| Animal care: | ARM animal facility |
| Animal housing: | Single-sex groups will be housed free of specific pathogens (SPF according to FELASA recommendations; Mahler et al, 2014) in IVC's under sterile and standardized environmental conditions: target temperature of 22 ± 2° C.; target relative humidity of 55 ± 10%; 12 hour light-dark cycle, ad libitum food and drinking water. |

Necessary Material
4.1 Basement Membrane Extract (Matrigel) for In Vivo Growth of Tumor Cells Matrigel will be used for adequate in vivo growth of NCI-H2023 cells. Reduced Growth Factor Basement Membrane Extract, Path Clear® (Matrigel; Cat. No. 3433-005-01; R&D Systems, Inc., Minneapolis).

Target Cells
Human Non Small Lung Cancer Cell Line NCI-H2023

*Mycoplasma* test is performed on: tbd, test: lotno. and cells should be negative Before Injection:

Cells will be counted, centrifuged, washed with cold DPBS and adjusted to a concentration of $1 \times 10^8$ cells/mL. Cell viability will be determined. Cells will be filtered through a cell strainer (70 μm) to ensure homogenous cell suspension (w/o clumps) after trypsinization. Cells will be stored on ice prior to injection Matrigel (Reduced Growth Factor Basement Membrane Extract, Path Clear®) will be used. Tumor cells will be mixed with human 1) PBMC (E:T ratio=1:2) and 2) Matrigel. Tumor-target cell mix will be SC injected in a final volume of 200 μL/mouse into the right dorsal flank. Cell line used will be NCI-H2023 (HuNSCLC) at $1 \times 10^8$ cells/ml.

Effector Cells

Human PBMC isolated from Buffy coat of donor. On the day of injection, human PBMC will be counted and washed 2× with cold DPBS. Cell number will be adjusted to $5 \times 10^7$ cells/mL. If necessary, filter cells through a cell strainer to avoid cell clumps. Cells will be stored on ice prior to injection. Before injection: human PBMC will be mixed with tumor cells (E:T=1:2) and Matrigel as described above. Cells will be SC injected in a final volume of 200 μL/mouse into the right dorsal flank.

TABLE 108

Formulation of Cell Mix For In Vivo Injection

| Tumor Cell Suspension | | | PBMC Cell Suspension | | | Matrigel* | | DPBS | | Final Injection Volume | |
|---|---|---|---|---|---|---|---|---|---|---|---|
| Number of Cells per Mouse | Volume Per mouse (μL) | Minimal Total Volume (μL) | Number of Cells per Mouse | Volume Per Mouse (μL) | Minimal Total Volume (μL) | Vol. Per Mouse (μL) | Min. Total Vol. (μL) | Vol. Per Mouse (μL) | Min. Total Vol. (μL) | Per Mouse (μL) | Min. Total Vol. (μL) |
| $5 \times 10^6$ | 50 | 2000 | $2.5 \times 10^5$ | 50 | 2000 | 90 | 3600 | 10 | 400 | 200 | 8000 |

*Calculated for a Matrigel concentration between 16 and 17.5 mg/mL

Treatment

Animals will receive the MAGEB2 BiTE® construct or control vehicle by IV injection into the lateral tail vein. Mice will be treated as described herein. The dose volume will be kept constant to a total of 100 µL per mouse, per injection. The BiTE® molecule will be diluted in the corresponding vehicle to the appropriate concentration (c) according to the most recently determined group mean body weight. The dose concentration is calculated using the formula:

$$c\left[\frac{\mu g}{\mu l}\right] = \frac{\text{dose}\left[\frac{\mu g}{kg}\right] \times \text{mean } BW[\text{kg}]}{\text{dose volume }[\mu l]}$$

Treatment duration: q7dx3 (days 3, 10, 17)

TABLE 109

Test/Control Items

| Item | Specified | Concentration | Formulation |
|---|---|---|---|
| Vehicle | Solution suitable for dilution of test item and in vivo use; treatment solution for control groups | — | 25 mM L-lysine monohydrochloride, 0.002% (w/v) polysorbate 80 in 0.9% (w/v) sodium chloride pH 6.8 (next retest: January 2022) |
| N3H BiTE® | Half-life extended BiTE® molecule (scFc) directed against human MAGE B2 pMAGE-HLA | 5.04 mg/mL | 10 mM L-glutamic acid, 9.0% sucrose, 0.010% polysorbate 80, pH 4.2 |

Data Collection

During the course of the study, all animals will be observed daily for general appearance, activity, behavior and survival. Abnormalities or discrepancies will be noted in the appropriate sheet in the study file. Additionally, a Score Sheet will be used for stress evaluation of every mouse and stored in the appropriate study file. Scoring frequency is done as defined in the Score Sheet. Body weight will be determined 2-3×/week or more often if required and recorded via Vivo Manager Software. Tumor size will be determined with an external caliper 2-3×/week or more often if required and tumor volume will be calculated using the formula:

$$TV = \frac{\text{height} \times \text{width}^2}{2}.$$

Data will be recorded via Vivo Manager Software.

Sampling

After the 1$^{st}$ treatment, serum sampling for standard PK analysis planned: maximal 10% of blood volume will be sampled within 2 weeks by alternating retro-orbital rupture of the sinus plexus and processed to serum. Two animals per group per bleeding time point.

TABLE 110

Sampling Information

| Day of experiment | Time point p.i. | Group | Animals | Eye | Serum Quantity |
|---|---|---|---|---|---|
| 3 | 30 min/0.0125 day | 2, 3, 4 | 1, 2 | right | 50 µL |
| 3 | 8 h/0.33 day | 2, 3, 4 | 3, 4 | right | 50 µL |
| 4 | 24 h/1 day | 2, 3, 4 | 5, 6 | right | 50 µL |
| 5 | 48 h/2 days | 2, 3, 4 | 1, 2 | left | 50 µL |
| 8 | 120 h/5 days | 2, 3, 4 | 3, 4 | left | 50 µL |
| 10 | 168 h/7 days* | 2, 3, 4 | 5, 6 | left | 50 µL | p.i.: post injection

At study end, data will be analyzed and summarized in graph format to further demonstrate the therapeutic effect of the anti-pMAGE-HLA (MAGEB2) BiTE® molecules in an in vivo setting.

Sequences

TABLE 21

Misc. Sequences

| SEQ ID NO: | Molecule | SEQUENCE |
|---|---|---|
| 22 | Fc monomer-1 +c/-g | DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 23 | Fc monomer-2 +c/-g/delGK | DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP |
| 24 | Fc monomer-3 -c/+g | DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 25 | Fc monomer-4 -c/+g/delGK | DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP |

TABLE 21-continued

Misc. Sequences

| SEQ ID NO: | Molecule | SEQUENCE |
|---|---|---|
| 26 | Fc monomer-5 -c/-g | DKTHTCPPCPAPELLGGPSV FLFPPKPKDTLMISRTPEVT CVVVDVSHEDPEVKFNWYVD GVEVHNAKTKPREEQYGSTY RVVSVLTVLHQDWLNGKEYK CKVSNKALPAPIEKTISKAK GQPREPQVYTLPPSREEMTK NQVSLTCLVKGFYPSDIAVE WESNGQPENNYKTTPPVLDS DGSFFLYSKLTVDKSRWQQG NVFSCSVMHEALHNHYTQKS LSLSPGK |
| 27 | Fc monomer-6 -c/-g/delGK | DKTHTCPPCPAPELLGGPSV FLFPPKPKDTLMISRTPEVT CVVVDVSHEDPEVKFNWYVD GVEVHNAKTKPREEQYGSTY RVVSVLTVLHQDWLNGKEYK CKVSNKALPAPIEKTISKAK GQPREPQVYTLPPSREEMTK NQVSLTCLVKGFYPSDIAVE WESNGQPENNYKTTPPVLDS DGSFFLYSKLTVDKSRWQQG NVFSCSVMHEALHNHYTQKS LSLSP |
| 28 | Fc monomer-7 +c/+g | DKTHTCPPCPAPELLGGPSV FLFPPKPKDTLMISRTPEVT CVVVDVSHEDPEVKFNWYVD GVEVHNAKTKPCEEQYNSTY RCVSVLTVLHQDWLNGKEYK CKVSNKALPAPIEKTISKAK GQPREPQVYTLPPSREEMTK NQVSLTCLVKGFYPSDIAVE WESNGQPENNYKTTPPVLDS DGSFFLYSKLTVDKSRWQQG NVFSCSVMHEALHNHYTQKS LSLSPGK |
| 29 | Fc monomer-8 +c/+g/delGK | DKTHTCPPCPAPELLGGPSV FLFPPKPKDTLMISRTPEVT CVVVDVSHEDPEVKFNWYVD GVEVHNAKTKPCEEQYNSTY RCVSVLTVLHQDWLNGKEYK CKVSNKALPAPIEKTISKAK GQPREPQVYTLPPSREEMTK NQVSLTCLVKGFYPSDIAVE WESNGQPENNYKTTPPVLDS DGSFFLYSKLTVDKSRWQQG NVFSCSVMHEALHNHYTQKS LSLSP |
| 31 | CD3ε binder VL | QTVVTQEPSLTVSPGGTVTL TCGSSTGAVTSGNYPNWVQQ KPGQAPRGLIGGTKFLAPGT PARFSGSLLGGKAALTLSGV QPEDEAEYYCVLWYSNRWVF GGGTKLTVL |
| 32 | CD3ε binder VH | EVQLVESGGGLVQPGGSLRL SCAASGFTFNSYAMNWVRQA PGKGLEWVARIRSKYNNYAT YYADSVKGRFTISRDDSKNT AYLQMNSLKTEDTAVYYCVR HGNFGNSYVSWWAYWGQGTL VTVSS |
| 33 | CD3ε binder scFv | EVQLVESGGGLVQPGGSLRL SCAASGFTFNSYAMNWVRQA PGKGLEWVARIRSKYNNYAT YYADSVKGRFTISRDDSKNT AYLQMNSLKTEDTAVYYCVR HGNFGNSYVSWWAYWGQGTL VTVSSGGGSGGGGSGGGGS QTVVTQEPSLTVSPGGTVTL TCGSSTGAVTSGNYPNWVQQ KPGQAPRGLIGGTKFLAPGT PARFSGSLLGGKAALTLSGV QPEDEAEYYCVLWYSNRWVF GGGTKLTVL |

TABLE 8

| ATOM | 1 | N | GLY | A | 1 | 0.130 | 37.741 | 19.027 | 1.00 | 49.27 | N |
|---|---|---|---|---|---|---|---|---|---|---|---|
| ATOM | 2 | CA | GLY | A | 1 | −1.266 | 37.350 | 19.127 | 1.00 | 46.92 | C |
| ATOM | 3 | C | GLY | A | 1 | −1.550 | 36.300 | 20.193 | 1.00 | 37.59 | C |
| ATOM | 4 | O | GLY | A | 1 | −0.642 | 35.842 | 20.890 | 1.00 | 39.64 | O |
| ATOM | 5 | N | SER | A | 2 | −2.822 | 35.936 | 20.315 | 1.00 | 34.68 | N |
| ATOM | 6 | CA | SER | A | 2 | −3.277 | 34.966 | 21.299 | 1.00 | 31.34 | C |
| ATOM | 7 | C | SER | A | 2 | −3.011 | 33.547 | 20.794 | 1.00 | 33.02 | C |
| ATOM | 8 | O | SER | A | 2 | −2.872 | 33.305 | 19.592 | 1.00 | 32.26 | O |
| ATOM | 9 | CB | SER | A | 2 | −4.762 | 35.204 | 21.594 | 1.00 | 39.46 | C |
| ATOM | 10 | OG | SER | A | 2 | −5.427 | 34.027 | 21.993 | 1.00 | 54.90 | O |
| ATOM | 11 | N | HIS | A | 3 | −2.915 | 32.602 | 21.729 | 1.00 | 29.59 | N |
| ATOM | 12 | CA | HIS | A | 3 | −2.580 | 31.230 | 21.375 | 1.00 | 29.79 | C |
| ATOM | 13 | C | HIS | A | 3 | −3.376 | 30.271 | 22.246 | 1.00 | 28.23 | C |
| ATOM | 14 | O | HIS | A | 3 | −3.904 | 30.643 | 23.295 | 1.00 | 27.30 | O |
| ATOM | 15 | CB | HIS | A | 3 | −1.080 | 30.956 | 21.544 | 1.00 | 30.88 | C |
| ATOM | 16 | CG | HIS | A | 3 | −0.211 | 31.772 | 20.639 | 1.00 | 31.63 | C |
| ATOM | 17 | ND1 | HIS | A | 3 | −0.005 | 31.446 | 19.315 | 1.00 | 31.63 | N |
| ATOM | 18 | CD2 | HIS | A | 3 | 0.499 | 32.901 | 20.866 | 1.00 | 34.99 | C |
| ATOM | 19 | CE1 | HIS | A | 3 | 0.802 | 32.337 | 18.767 | 1.00 | 35.23 | C |
| ATOM | 20 | NE2 | HIS | A | 3 | 1.114 | 33.237 | 19.685 | 1.00 | 37.29 | N |
| ATOM | 21 | N | SER | A | 4 | −3.422 | 29.011 | 21.828 | 1.00 | 29.94 | N |
| ATOM | 22 | CA | SER | A | 4 | −4.136 | 28.018 | 22.613 | 1.00 | 26.23 | C |
| ATOM | 23 | C | SER | A | 4 | −3.440 | 26.667 | 22.495 | 1.00 | 25.67 | C |
| ATOM | 24 | O | SER | A | 4 | −2.748 | 26.396 | 21.511 | 1.00 | 28.76 | O |
| ATOM | 25 | CB | SER | A | 4 | −5.592 | 27.888 | 22.159 | 1.00 | 32.69 | C |
| ATOM | 26 | OG | SER | A | 4 | −5.658 | 27.459 | 20.809 | 1.00 | 34.22 | O |
| ATOM | 27 | N | MET | A | 5 | −3.595 | 25.845 | 23.532 | 1.00 | 22.94 | N |

TABLE 8-continued

| | | | | | | | | | | |
|---|---|---|---|---|---|---|---|---|---|---|
| ATOM | 28 | CA | MET | A | 5 | −3.290 | 24.422 | 23.455 | 1.00 | 25.20 | C |
| ATOM | 29 | C | MET | A | 5 | −4.567 | 23.656 | 23.760 | 1.00 | 28.11 | C |
| ATOM | 30 | O | MET | A | 5 | −5.298 | 23.994 | 24.702 | 1.00 | 26.06 | O |
| ATOM | 31 | CB | MET | A | 5 | −2.186 | 24.005 | 24.429 | 1.00 | 26.76 | C |
| ATOM | 32 | CG | MET | A | 5 | −1.813 | 22.517 | 24.310 | 1.00 | 25.71 | C |
| ATOM | 33 | SD | MET | A | 5 | −0.370 | 22.056 | 25.302 | 1.00 | 29.87 | S |
| ATOM | 34 | CE | MET | A | 5 | −1.000 | 22.064 | 26.988 | 1.00 | 27.01 | C |
| ATOM | 35 | N | ARG | A | 6 | −4.843 | 22.636 | 22.964 | 1.00 | 24.83 | N |
| ATOM | 36 | CA | ARG | A | 6 | −6.065 | 21.863 | 23.120 | 1.00 | 22.66 | C |
| ATOM | 37 | C | ARG | A | 6 | −5.777 | 20.397 | 22.872 | 1.00 | 25.38 | C |
| ATOM | 38 | O | ARG | A | 6 | −5.100 | 20.061 | 21.901 | 1.00 | 27.14 | O |
| ATOM | 39 | CB | ARG | A | 6 | −7.146 | 22.305 | 22.128 | 1.00 | 28.31 | C |
| ATOM | 40 | CG | ARG | A | 6 | −7.465 | 23.773 | 22.139 | 1.00 | 38.75 | C |
| ATOM | 41 | CD | ARG | A | 6 | −8.736 | 24.036 | 22.895 | 1.00 | 56.66 | C |
| ATOM | 42 | NE | ARG | A | 6 | −9.232 | 25.382 | 22.636 | 1.00 | 55.29 | N |
| ATOM | 43 | CZ | ARG | A | 6 | −8.932 | 26.445 | 23.375 | 1.00 | 54.76 | C |
| ATOM | 44 | NH1 | ARG | A | 6 | −9.441 | 27.625 | 23.055 | 1.00 | 67.98 | N |
| ATOM | 45 | NH2 | ARG | A | 6 | −8.129 | 26.332 | 24.433 | 1.00 | 35.14 | N |
| ATOM | 46 | N | TYR | A | 7 | −6.351 | 19.533 | 23.707 | 1.00 | 23.20 | N |
| ATOM | 47 | CA | TYR | A | 7 | −6.334 | 18.091 | 23.488 | 1.00 | 21.68 | C |
| ATOM | 48 | C | TYR | A | 7 | −7.753 | 17.593 | 23.241 | 1.00 | 24.91 | C |
| ATOM | 49 | O | TYR | A | 7 | −8.703 | 18.054 | 23.883 | 1.00 | 24.41 | O |
| ATOM | 50 | CB | TYR | A | 7 | −5.738 | 17.371 | 24.685 | 1.00 | 24.00 | C |
| ATOM | 51 | CG | TYR | A | 7 | −4.233 | 17.470 | 24.755 | 1.00 | 21.61 | C |
| ATOM | 52 | CD1 | TYR | A | 7 | −3.439 | 16.613 | 24.001 | 1.00 | 24.74 | C |
| ATOM | 53 | CD2 | TYR | A | 7 | −3.604 | 18.424 | 25.564 | 1.00 | 24.09 | C |
| ATOM | 54 | CE1 | TYR | A | 7 | −2.052 | 16.686 | 24.060 | 1.00 | 22.80 | C |
| ATOM | 55 | CE2 | TYR | A | 7 | −2.222 | 18.511 | 25.627 | 1.00 | 24.23 | C |
| ATOM | 56 | CZ | TYR | A | 7 | −1.453 | 17.634 | 24.869 | 1.00 | 26.94 | C |
| ATOM | 57 | OH | TYR | A | 7 | −0.091 | 17.695 | 24.933 | 1.00 | 25.99 | O |
| ATOM | 58 | N | PHE | A | 8 | −7.884 | 16.663 | 22.298 | 1.00 | 21.88 | N |
| ATOM | 59 | CA | PHE | A | 8 | −9.167 | 16.088 | 21.908 | 1.00 | 21.69 | C |
| ATOM | 60 | C | PHE | A | 8 | −9.053 | 14.576 | 22.045 | 1.00 | 26.69 | C |
| ATOM | 61 | O | PHE | A | 8 | −8.081 | 13.985 | 21.553 | 1.00 | 27.68 | O |
| ATOM | 62 | CB | PHE | A | 8 | −9.520 | 16.451 | 20.468 | 1.00 | 22.48 | C |
| ATOM | 63 | CG | PHE | A | 8 | −9.573 | 17.941 | 20.212 | 1.00 | 23.95 | C |
| ATOM | 64 | CD1 | PHE | A | 8 | −8.400 | 18.666 | 20.022 | 1.00 | 27.35 | C |
| ATOM | 65 | CD2 | PHE | A | 8 | −10.780 | 18.600 | 20.161 | 1.00 | 31.65 | C |
| ATOM | 66 | CE1 | PHE | A | 8 | −8.453 | 20.038 | 19.790 | 1.00 | 32.65 | C |
| ATOM | 67 | CE2 | PHE | A | 8 | −10.837 | 19.968 | 19.924 | 1.00 | 29.75 | C |
| ATOM | 68 | CZ | PHE | A | 8 | −9.678 | 20.681 | 19.741 | 1.00 | 29.13 | C |
| ATOM | 69 | N | PHE | A | 9 | −10.043 | 13.959 | 22.696 | 1.00 | 23.26 | N |
| ATOM | 70 | CA | PHE | A | 9 | −10.039 | 12.523 | 22.982 | 1.00 | 22.60 | C |
| ATOM | 71 | C | PHE | A | 9 | −11.377 | 11.929 | 22.565 | 1.00 | 26.22 | C |
| ATOM | 72 | O | PHE | A | 9 | −12.423 | 12.444 | 22.959 | 1.00 | 25.43 | O |
| ATOM | 73 | CB | PHE | A | 9 | −9.834 | 12.248 | 24.479 | 1.00 | 19.94 | C |
| ATOM | 74 | CG | PHE | A | 9 | −8.619 | 12.894 | 25.063 | 1.00 | 21.08 | C |
| ATOM | 75 | CD1 | PHE | A | 9 | −8.678 | 14.187 | 25.587 | 1.00 | 27.47 | C |
| ATOM | 76 | CD2 | PHE | A | 9 | −7.402 | 12.227 | 25.070 | 1.00 | 23.74 | C |
| ATOM | 77 | CE1 | PHE | A | 9 | −7.555 | 14.791 | 26.115 | 1.00 | 27.18 | C |
| ATOM | 78 | CE2 | PHE | A | 9 | −6.267 | 12.828 | 25.606 | 1.00 | 24.64 | C |
| ATOM | 79 | CZ | PHE | A | 9 | −6.345 | 14.109 | 26.135 | 1.00 | 26.34 | C |
| ATOM | 80 | N | THR | A | 10 | −11.350 | 10.830 | 21.813 | 1.00 | 23.11 | N |
| ATOM | 81 | CA | THR | A | 10 | −12.569 | 10.156 | 21.368 | 1.00 | 22.84 | C |
| ATOM | 82 | C | THR | A | 10 | −12.428 | 8.674 | 21.669 | 1.00 | 29.08 | C |
| ATOM | 83 | O | THR | A | 10 | −11.410 | 8.072 | 21.317 | 1.00 | 26.11 | O |
| ATOM | 84 | CB | THR | A | 10 | −12.809 | 10.324 | 19.861 | 1.00 | 25.25 | C |
| ATOM | 85 | OG1 | THR | A | 10 | −12.810 | 11.711 | 19.501 | 1.00 | 27.84 | O |
| ATOM | 86 | CG2 | THR | A | 10 | −14.132 | 9.673 | 19.430 | 1.00 | 27.92 | C |
| ATOM | 87 | N | ASER | A | 11 | −13.428 | 8.089 | 22.330 | 0.63 | 22.86 | N |
| ATOM | 88 | CA | ASER | A | 11 | −13.486 | 6.640 | 22.527 | 0.63 | 24.01 | C |
| ATOM | 89 | C | ASER | A | 11 | −14.806 | 6.113 | 21.982 | 0.63 | 25.58 | C |
| ATOM | 90 | O | ASER | A | 11 | −15.871 | 6.629 | 22.327 | 0.63 | 24.32 | O |
| ATOM | 91 | CB | ASER | A | 11 | −13.339 | 6.250 | 24.006 | 0.63 | 24.14 | C |
| ATOM | 92 | OG | ASER | A | 11 | −12.078 | 6.611 | 24.556 | 0.63 | 25.08 | O |
| ATOM | 93 | N | BSER | A | 11 | −13.457 | 8.089 | 22.277 | 0.37 | 24.26 | N |
| ATOM | 94 | CA | BSER | A | 11 | −13.500 | 6.653 | 22.519 | 0.37 | 24.50 | C |
| ATOM | 95 | C | BSER | A | 11 | −14.818 | 6.100 | 21.997 | 0.37 | 25.24 | C |
| ATOM | 96 | O | BSER | A | 11 | −15.889 | 6.591 | 22.366 | 0.37 | 24.64 | O |
| ATOM | 97 | CB | BSER | A | 11 | −13.344 | 6.348 | 24.009 | 0.37 | 24.57 | C |
| ATOM | 98 | OG | BSER | A | 11 | −13.219 | 4.959 | 24.228 | 0.37 | 23.53 | O |
| ATOM | 99 | N | VAL | A | 12 | −14.741 | 5.067 | 21.161 | 1.00 | 23.50 | N |
| ATOM | 100 | CA | VAL | A | 12 | −15.913 | 4.503 | 20.493 | 1.00 | 25.62 | C |
| ATOM | 101 | C | VAL | A | 12 | −16.015 | 3.029 | 20.872 | 1.00 | 25.71 | C |
| ATOM | 102 | O | VAL | A | 12 | −15.083 | 2.259 | 20.614 | 1.00 | 27.88 | O |
| ATOM | 103 | CB | VAL | A | 12 | −15.827 | 4.666 | 18.965 | 1.00 | 25.72 | C |
| ATOM | 104 | CG1 | VAL | A | 12 | −17.038 | 3.997 | 18.277 | 1.00 | 25.47 | C |
| ATOM | 105 | CG2 | VAL | A | 12 | −15.662 | 6.158 | 18.568 | 1.00 | 31.47 | C |
| ATOM | 106 | N | SER | A | 13 | −17.140 | 2.629 | 21.467 | 1.00 | 26.26 | N |
| ATOM | 107 | CA | SER | A | 13 | −17.257 | 1.249 | 21.941 | 1.00 | 28.51 | C |

TABLE 8-continued

| ATOM | 108 | C | SER | A | 13 | −17.491 | 0.274 | 20.788 | 1.00 | 31.92 | C |
|---|---|---|---|---|---|---|---|---|---|---|---|
| ATOM | 109 | O | SER | A | 13 | −17.999 | 0.629 | 19.721 | 1.00 | 28.14 | O |
| ATOM | 110 | CB | SER | A | 13 | −18.371 | 1.113 | 22.987 | 1.00 | 28.15 | C |
| ATOM | 111 | OG | SER | A | 13 | −19.659 | 1.288 | 22.402 | 1.00 | 26.71 | O |
| ATOM | 112 | N | ARG | A | 14 | −17.085 | −0.977 | 21.008 | 1.00 | 30.70 | N |
| ATOM | 113 | C | ARG | A | 14 | −17.893 | −3.218 | 20.609 | 1.00 | 33.69 | C |
| ATOM | 114 | O | ARG | A | 14 | −17.268 | −4.111 | 21.198 | 1.00 | 34.65 | O |
| ATOM | 115 | CA | AARG | A | 14 | −17.162 | −2.031 | 19.997 | 0.54 | 30.81 | C |
| ATOM | 116 | CB | AARG | A | 14 | −15.770 | −2.418 | 19.500 | 0.54 | 33.54 | C |
| ATOM | 117 | CG | AARG | A | 14 | −15.076 | −1.361 | 18.629 | 0.54 | 34.17 | C |
| ATOM | 118 | CD | AARG | A | 14 | −13.573 | −1.522 | 18.773 | 0.54 | 38.19 | C |
| ATOM | 119 | NE | AARG | A | 14 | −12.797 | −1.056 | 17.630 | 0.54 | 38.89 | N |
| ATOM | 120 | CZ | AARG | A | 14 | −11.485 | −0.850 | 17.672 | 0.54 | 40.25 | C |
| ATOM | 121 | NH1 | AARG | A | 14 | −10.802 | −1.053 | 18.813 | 0.54 | 22.18 | N |
| ATOM | 122 | NH2 | AARG | A | 14 | −10.861 | −0.428 | 16.584 | 0.54 | 36.32 | N |
| ATOM | 123 | CA | BARG | A | 14 | −17.163 | −2.033 | 19.997 | 0.46 | 31.10 | C |
| ATOM | 124 | CB | BARG | A | 14 | −15.773 | −2.425 | 19.496 | 0.46 | 33.45 | C |
| ATOM | 125 | CG | BARG | A | 14 | −15.002 | −1.285 | 18.826 | 0.46 | 33.39 | C |
| ATOM | 126 | CD | BARG | A | 14 | −15.702 | −0.791 | 17.572 | 0.46 | 31.29 | C |
| ATOM | 127 | NE | BARG | A | 14 | −14.938 | 0.265 | 16.913 | 0.46 | 37.48 | N |
| ATOM | 128 | CZ | BARG | A | 14 | −15.453 | 1.133 | 16.046 | 0.46 | 37.13 | C |
| ATOM | 129 | NH1 | BARG | A | 14 | −16.747 | 1.078 | 15.728 | 0.46 | 27.91 | N |
| ATOM | 130 | NH2 | BARG | A | 14 | −14.675 | 2.060 | 15.501 | 0.46 | 29.96 | N |
| ATOM | 131 | N | PRO | A | 15 | −19.217 | −3.255 | 20.496 | 1.00 | 36.39 | N |
| ATOM | 132 | CA | PRO | A | 15 | −20.005 | −4.298 | 21.167 | 1.00 | 36.04 | C |
| ATOM | 133 | C | PRO | A | 15 | −19.515 | −5.700 | 20.838 | 1.00 | 37.13 | C |
| ATOM | 134 | O | PRO | A | 15 | −19.367 | −6.071 | 19.670 | 1.00 | 35.03 | O |
| ATOM | 135 | CB | PRO | A | 15 | −21.424 | −4.066 | 20.635 | 1.00 | 37.17 | C |
| ATOM | 136 | CG | PRO | A | 15 | −21.447 | −2.632 | 20.248 | 1.00 | 49.20 | C |
| ATOM | 137 | CD | PRO | A | 15 | −20.063 | −2.299 | 19.761 | 1.00 | 42.13 | C |
| ATOM | 138 | N | GLY | A | 16 | −19.209 | −6.459 | 21.889 | 1.00 | 41.68 | N |
| ATOM | 139 | CA | GLY | A | 16 | −18.868 | −7.860 | 21.763 | 1.00 | 49.76 | C |
| ATOM | 140 | C | GLY | A | 16 | −17.473 | −8.155 | 21.271 | 1.00 | 47.36 | C |
| ATOM | 141 | O | GLY | A | 16 | −17.187 | −9.318 | 20.971 | 1.00 | 49.99 | O |
| ATOM | 142 | N | ARG | A | 17 | −16.577 | −7.148 | 21.212 | 1.00 | 40.00 | N |
| ATOM | 143 | CA | ARG | A | 17 | −15.316 | −7.302 | 20.491 | 1.00 | 41.70 | C |
| ATOM | 144 | C | ARG | A | 17 | −14.092 | −6.682 | 21.167 | 1.00 | 53.85 | C |
| ATOM | 145 | O | ARG | A | 17 | −13.094 | −6.435 | 20.485 | 1.00 | 73.33 | O |
| ATOM | 146 | CB | ARG | A | 17 | −15.410 | −6.687 | 19.101 | 1.00 | 43.76 | C |
| ATOM | 147 | CG | ARG | A | 17 | −16.445 | −7.303 | 18.205 | 1.00 | 55.62 | C |
| ATOM | 148 | CD | ARG | A | 17 | −16.663 | −6.428 | 16.986 | 1.00 | 69.05 | C |
| ATOM | 149 | NE | ARG | A | 17 | −15.894 | −6.874 | 15.828 | 1.00 | 76.82 | N |
| ATOM | 150 | CZ | ARG | A | 17 | −16.437 | −7.287 | 14.685 | 1.00 | 78.53 | C |
| ATOM | 151 | NH1 | ARG | A | 17 | −17.757 | −7.299 | 14.538 | 1.00 | 75.13 | N |
| ATOM | 152 | NH2 | ARG | A | 17 | −15.658 | −7.678 | 13.686 | 1.00 | 79.62 | N |
| ATOM | 153 | N | GLY | A | 18 | −14.117 | −6.409 | 22.459 | 1.00 | 40.16 | N |
| ATOM | 154 | CA | GLY | A | 18 | −12.915 | −5.889 | 23.101 | 1.00 | 30.25 | C |
| ATOM | 155 | C | GLY | A | 18 | −12.795 | −4.385 | 23.303 | 1.00 | 32.22 | C |
| ATOM | 156 | O | GLY | A | 18 | −13.806 | −3.705 | 23.487 | 1.00 | 31.42 | O |
| ATOM | 157 | N | GLU | A | 19 | −11.562 | −3.868 | 23.281 | 1.00 | 27.72 | N |
| ATOM | 158 | CA | GLU | A | 19 | −11.305 | −2.487 | 23.687 | 1.00 | 26.44 | C |
| ATOM | 159 | C | GLU | A | 19 | −11.954 | −1.499 | 22.723 | 1.00 | 24.50 | C |
| ATOM | 160 | O | GLU | A | 19 | −12.097 | −1.772 | 21.530 | 1.00 | 28.01 | O |
| ATOM | 161 | CB | GLU | A | 19 | −9.802 | −2.194 | 23.761 | 1.00 | 29.62 | C |
| ATOM | 162 | CG | GLU | A | 19 | −9.088 | −2.295 | 22.416 | 1.00 | 38.35 | C |
| ATOM | 163 | CD | GLU | A | 19 | −7.618 | −1.895 | 22.482 | 1.00 | 51.98 | C |
| ATOM | 164 | OE1 | GLU | A | 19 | −7.111 | −1.645 | 23.592 | 1.00 | 54.65 | O |
| ATOM | 165 | OE2 | GLU | A | 19 | −6.975 | −1.818 | 21.413 | 1.00 | 54.08 | O |
| ATOM | 166 | N | PRO | A | 20 | −12.335 | −0.330 | 23.227 | 1.00 | 25.73 | N |
| ATOM | 167 | CA | PRO | A | 20 | −12.847 | 0.729 | 22.347 | 1.00 | 29.54 | C |
| ATOM | 168 | C | PRO | A | 20 | −11.772 | 1.231 | 21.392 | 1.00 | 28.32 | C |
| ATOM | 169 | O | PRO | A | 20 | −10.571 | 1.129 | 21.654 | 1.00 | 28.28 | O |
| ATOM | 170 | CB | PRO | A | 20 | −13.264 | 1.837 | 23.328 | 1.00 | 33.63 | C |
| ATOM | 171 | CG | PRO | A | 20 | −13.220 | 1.236 | 24.713 | 1.00 | 35.29 | C |
| ATOM | 172 | CD | PRO | A | 20 | −12.320 | 0.047 | 24.655 | 1.00 | 29.13 | C |
| ATOM | 173 | N | ARG | A | 21 | −12.204 | 1.790 | 20.274 | 1.00 | 26.58 | N |
| ATOM | 174 | CA | ARG | A | 21 | −11.276 | 2.575 | 19.468 | 1.00 | 26.07 | C |
| ATOM | 175 | C | ARG | A | 21 | −11.033 | 3.908 | 20.171 | 1.00 | 30.37 | C |
| ATOM | 176 | O | ARG | A | 21 | −11.982 | 4.650 | 20.453 | 1.00 | 25.42 | O |
| ATOM | 177 | CB | ARG | A | 21 | −11.827 | 2.781 | 18.060 | 1.00 | 26.16 | C |
| ATOM | 178 | CG | ARG | A | 21 | −10.959 | 3.658 | 17.160 | 1.00 | 29.60 | C |
| ATOM | 179 | CD | ARG | A | 21 | −9.683 | 2.944 | 16.743 | 1.00 | 32.86 | C |
| ATOM | 180 | NE | ARG | A | 21 | −8.885 | 3.684 | 15.761 | 1.00 | 30.58 | N |
| ATOM | 181 | CE | ARG | A | 21 | −9.141 | 3.748 | 14.455 | 1.00 | 36.43 | C |
| ATOM | 182 | NH1 | ARG | A | 21 | −10.198 | 3.125 | 13.925 | 1.00 | 36.87 | N |
| ATOM | 183 | NH2 | ARG | A | 21 | −8.327 | 4.438 | 13.673 | 1.00 | 37.23 | N |
| ATOM | 184 | N | PHE | A | 22 | −9.776 | 4.203 | 20.487 | 1.00 | 24.37 | N |
| ATOM | 185 | CA | PHE | A | 22 | −9.417 | 5.410 | 21.237 | 1.00 | 24.04 | C |
| ATOM | 186 | C | PHE | A | 22 | −8.423 | 6.242 | 20.440 | 1.00 | 27.86 | C |
| ATOM | 187 | O | PHE | A | 22 | −7.384 | 5.727 | 20.012 | 1.00 | 26.44 | O |

TABLE 8-continued

| | | | | | | | | | | |
|---|---|---|---|---|---|---|---|---|---|---|
| ATOM | 188 | CB | PHE | A | 22 | −8.825 | 5.046 | 22.600 | 1.00 | 24.43 | C |
| ATOM | 189 | CG | PHE | A | 22 | −8.263 | 6.215 | 23.365 | 1.00 | 25.19 | C |
| ATOM | 190 | CD1 | PHE | A | 22 | −9.104 | 7.088 | 24.056 | 1.00 | 26.14 | C |
| ATOM | 191 | CD2 | PHE | A | 22 | −6.884 | 6.415 | 23.439 | 1.00 | 27.65 | C |
| ATOM | 192 | CE1 | PHE | A | 22 | −8.576 | 8.162 | 24.784 | 1.00 | 33.61 | C |
| ATOM | 193 | CE2 | PHE | A | 22 | −6.358 | 7.464 | 24.179 | 1.00 | 27.48 | C |
| ATOM | 194 | CZ | PHE | A | 22 | −7.216 | 8.347 | 24.849 | 1.00 | 25.53 | C |
| ATOM | 195 | N | ILE | A | 23 | −8.741 | 7.522 | 20.224 | 1.00 | 24.76 | N |
| ATOM | 196 | CA | ILE | A | 23 | −7.874 | 8.410 | 19.454 | 1.00 | 27.39 | C |
| ATOM | 197 | C | ILE | A | 23 | −7.701 | 9.701 | 20.239 | 1.00 | 26.96 | C |
| ATOM | 198 | O | ILE | A | 23 | −8.692 | 10.312 | 20.654 | 1.00 | 26.83 | O |
| ATOM | 199 | CB | ILE | A | 23 | −8.452 | 8.698 | 18.052 | 1.00 | 29.52 | C |
| ATOM | 200 | CG1 | ILE | A | 23 | −8.604 | 7.386 | 17.262 | 1.00 | 30.14 | C |
| ATOM | 201 | CG2 | ILE | A | 23 | −7.556 | 9.665 | 17.288 | 1.00 | 26.13 | C |
| ATOM | 202 | CD1 | ILE | A | 23 | −9.466 | 7.506 | 16.022 | 1.00 | 31.60 | C |
| ATOM | 203 | N | ALA | A | 24 | −6.453 | 10.114 | 20.438 | 1.00 | 22.73 | N |
| ATOM | 204 | CA | ALA | A | 24 | −6.123 | 11.373 | 21.100 | 1.00 | 23.35 | C |
| ATOM | 205 | C | ALA | A | 24 | −5.306 | 12.234 | 20.147 | 1.00 | 25.69 | C |
| ATOM | 206 | O | ALA | A | 24 | −4.438 | 11.724 | 19.438 | 1.00 | 26.91 | O |
| ATOM | 207 | CB | ALA | A | 24 | −5.335 | 11.137 | 22.384 | 1.00 | 26.08 | C |
| ATOM | 208 | N | VAL | A | 25 | −5.582 | 13.545 | 20.119 | 1.00 | 23.57 | N |
| ATOM | 209 | CA | VAL | A | 25 | −4.825 | 14.468 | 19.282 | 1.00 | 22.95 | C |
| ATOM | 210 | C | VAL | A | 25 | −4.579 | 15.730 | 20.098 | 1.00 | 25.75 | C |
| ATOM | 211 | O | VAL | A | 25 | −5.412 | 16.115 | 20.932 | 1.00 | 24.03 | O |
| ATOM | 212 | CB | VAL | A | 25 | −5.542 | 14.790 | 17.948 | 1.00 | 28.81 | C |
| ATOM | 213 | CG1 | VAL | A | 25 | −5.671 | 13.544 | 17.079 | 1.00 | 34.83 | C |
| ATOM | 214 | CG2 | VAL | A | 25 | −6.921 | 15.377 | 18.191 | 1.00 | 31.72 | C |
| ATOM | 215 | N | GLY | A | 26 | −3.403 | 16.319 | 19.911 | 1.00 | 22.30 | N |
| ATOM | 216 | CA | GLY | A | 26 | −3.047 | 17.580 | 20.551 | 1.00 | 22.91 | C |
| ATOM | 217 | C | GLY | A | 26 | −2.758 | 18.648 | 19.514 | 1.00 | 26.43 | C |
| ATOM | 218 | O | GLY | A | 26 | −2.117 | 18.376 | 18.494 | 1.00 | 26.68 | O |
| ATOM | 219 | N | TYR | A | 27 | −3.210 | 19.870 | 19.796 | 1.00 | 27.78 | N |
| ATOM | 220 | CA | TYR | A | 27 | −3.010 | 21.023 | 18.929 | 1.00 | 26.19 | C |
| ATOM | 221 | C | TYR | A | 27 | −2.417 | 22.182 | 19.714 | 1.00 | 25.09 | C |
| ATOM | 222 | O | TYR | A | 27 | −2.762 | 22.394 | 20.878 | 1.00 | 26.89 | O |
| ATOM | 223 | CB | TYR | A | 27 | −4.320 | 21.539 | 18.314 | 1.00 | 26.10 | C |
| ATOM | 224 | CG | TYR | A | 27 | −4.915 | 20.694 | 17.223 | 1.00 | 30.36 | C |
| ATOM | 225 | CD1 | TYR | A | 27 | −5.636 | 19.550 | 17.526 | 1.00 | 32.48 | C |
| ATOM | 226 | CD2 | TYR | A | 27 | −4.778 | 21.062 | 15.891 | 1.00 | 30.74 | C |
| ATOM | 227 | CE1 | TYR | A | 27 | −6.201 | 18.783 | 16.520 | 1.00 | 36.37 | C |
| ATOM | 228 | CE2 | TYR | A | 27 | −5.337 | 20.301 | 14.877 | 1.00 | 39.57 | C |
| ATOM | 229 | CZ | TYR | A | 27 | −6.047 | 19.166 | 15.200 | 1.00 | 43.10 | C |
| ATOM | 230 | OH | TYR | A | 27 | −6.607 | 18.407 | 14.200 | 1.00 | 46.98 | O |
| ATOM | 231 | N | VAL | A | 28 | −1.521 | 22.916 | 19.067 | 1.00 | 27.98 | N |
| ATOM | 232 | CA | VAL | A | 28 | −1.224 | 24.299 | 19.425 | 1.00 | 28.52 | C |
| ATOM | 233 | C | VAL | A | 28 | −1.772 | 25.154 | 18.292 | 1.00 | 30.52 | C |
| ATOM | 234 | O | VAL | A | 28 | −1.376 | 24.983 | 17.132 | 1.00 | 29.80 | O |
| ATOM | 235 | CB | VAL | A | 28 | 0.280 | 24.549 | 19.635 | 1.00 | 31.35 | C |
| ATOM | 236 | CG1 | VAL | A | 28 | 0.524 | 26.049 | 19.879 | 1.00 | 27.98 | C |
| ATOM | 237 | CG2 | VAL | A | 28 | 0.787 | 23.746 | 20.810 | 1.00 | 30.27 | C |
| ATOM | 238 | N | ASP | A | 29 | −2.699 | 26.055 | 18.621 | 1.00 | 30.27 | N |
| ATOM | 239 | CA | ASP | A | 29 | −3.428 | 26.854 | 17.626 | 1.00 | 27.47 | C |
| ATOM | 240 | C | ASP | A | 29 | −4.043 | 25.881 | 16.618 | 1.00 | 29.26 | C |
| ATOM | 241 | O | ASP | A | 29 | −4.738 | 24.940 | 17.031 | 1.00 | 28.13 | O |
| ATOM | 242 | CB | ASP | A | 29 | −2.498 | 27.896 | 17.034 | 1.00 | 34.03 | C |
| ATOM | 243 | CG | ASP | A | 29 | −1.920 | 28.831 | 18.088 | 1.00 | 40.08 | C |
| ATOM | 244 | OD1 | ASP | A | 29 | −2.595 | 29.041 | 19.125 | 1.00 | 36.50 | O |
| ATOM | 245 | OD2 | ASP | A | 29 | −0.794 | 29.345 | 17.874 | 1.00 | 43.27 | O |
| ATOM | 246 | N | ASP | A | 30 | −3.799 | 26.052 | 15.319 | 1.00 | 31.53 | N |
| ATOM | 247 | CA | ASP | A | 30 | −4.361 | 25.207 | 14.275 | 1.00 | 32.86 | C |
| ATOM | 248 | C | ASP | A | 30 | −3.386 | 24.127 | 13.799 | 1.00 | 38.18 | C |
| ATOM | 249 | O | ASP | A | 30 | −3.603 | 23.531 | 12.736 | 1.00 | 35.18 | O |
| ATOM | 250 | CB | ASP | A | 30 | −4.808 | 26.080 | 13.095 | 1.00 | 35.70 | C |
| ATOM | 251 | CG | ASP | A | 30 | −5.928 | 27.045 | 13.471 | 1.00 | 39.33 | C |
| ATOM | 252 | OD1 | ASP | A | 30 | −6.776 | 26.665 | 14.300 | 1.00 | 39.00 | O |
| ATOM | 253 | OD2 | ASP | A | 30 | −5.948 | 28.186 | 12.952 | 1.00 | 39.18 | O |
| ATOM | 254 | N | THR | A | 31 | −2.320 | 23.861 | 14.563 | 1.00 | 33.33 | N |
| ATOM | 255 | CA | THR | A | 31 | −1.269 | 22.924 | 14.180 | 1.00 | 33.97 | C |
| ATOM | 256 | C | THR | A | 31 | −1.328 | 21.709 | 15.095 | 1.00 | 35.30 | C |
| ATOM | 257 | O | THR | A | 31 | −1.085 | 21.824 | 16.298 | 1.00 | 28.51 | O |
| ATOM | 258 | CB | THR | A | 31 | 0.107 | 23.586 | 14.273 | 1.00 | 34.23 | C |
| ATOM | 259 | OG1 | THR | A | 31 | 0.155 | 24.701 | 13.380 | 1.00 | 34.83 | O |
| ATOM | 260 | CG2 | THR | A | 31 | 1.210 | 22.587 | 13.931 | 1.00 | 35.74 | C |
| ATOM | 261 | N | GLN | A | 32 | −1.625 | 20.542 | 14.530 | 1.00 | 28.74 | N |
| ATOM | 262 | CA | GLN | A | 32 | −1.547 | 19.321 | 15.321 | 1.00 | 24.69 | C |
| ATOM | 263 | C | GLN | A | 32 | −0.089 | 18.982 | 15.609 | 1.00 | 31.92 | C |
| ATOM | 264 | O | GLN | A | 32 | 0.788 | 19.169 | 14.755 | 1.00 | 33.83 | O |
| ATOM | 265 | CB | GLN | A | 32 | −2.217 | 18.160 | 14.574 | 1.00 | 33.39 | C |
| ATOM | 266 | CG | GLN | A | 32 | −2.225 | 16.871 | 15.376 | 1.00 | 34.46 | C |
| ATOM | 267 | CD | GLN | A | 32 | −2.586 | 15.646 | 14.547 | 1.00 | 37.54 | C |

TABLE 8-continued

| | | | | | | | | | | | |
|---|---|---|---|---|---|---|---|---|---|---|---|
| ATOM | 268 | OE1 | GLN | A | 32 | −2.991 | 15.758 | 13.393 | 1.00 | 39.90 | O |
| ATOM | 269 | NE2 | GLN | A | 32 | −2.448 | 14.473 | 15.143 | 1.00 | 34.74 | N |
| ATOM | 270 | N | PHE | A | 33 | 0.192 | 18.502 | 16.830 | 1.00 | 27.06 | N |
| ATOM | 271 | CA | PHE | A | 33 | 1.565 | 18.164 | 17.168 | 1.00 | 26.79 | C |
| ATOM | 272 | C | PHE | A | 33 | 1.768 | 16.781 | 17.782 | 1.00 | 28.42 | C |
| ATOM | 273 | O | PHE | A | 33 | 2.912 | 16.317 | 17.799 | 1.00 | 29.24 | C |
| ATOM | 274 | CB | PHE | A | 33 | 2.191 | 19.235 | 18.090 | 1.00 | 28.71 | C |
| ATOM | 275 | CG | PHE | A | 33 | 1.645 | 19.269 | 19.503 | 1.00 | 28.53 | C |
| ATOM | 276 | CD1 | PHE | A | 33 | 0.449 | 19.922 | 19.791 | 1.00 | 26.52 | C |
| ATOM | 277 | CD2 | PHE | A | 33 | 2.365 | 18.716 | 20.552 | 1.00 | 25.74 | C |
| ATOM | 278 | CE1 | PHE | A | 33 | −0.038 | 19.976 | 21.086 | 1.00 | 24.14 | C |
| ATOM | 279 | CE2 | PHE | A | 33 | 1.880 | 18.765 | 21.861 | 1.00 | 27.10 | C |
| ATOM | 280 | CZ | PHE | A | 33 | 0.674 | 19.392 | 22.128 | 1.00 | 25.48 | C |
| ATOM | 281 | N | VAL | A | 34 | 0.722 | 16.093 | 18.254 | 1.00 | 27.48 | N |
| ATOM | 282 | CA | VAL | A | 34 | 0.862 | 14.736 | 18.786 | 1.00 | 23.60 | C |
| ATOM | 283 | C | VAL | A | 34 | −0.394 | 13.940 | 18.469 | 1.00 | 30.75 | C |
| ATOM | 284 | O | VAL | A | 34 | −1.476 | 14.493 | 18.238 | 1.00 | 27.81 | C |
| ATOM | 285 | CB | VAL | A | 34 | 1.110 | 14.674 | 20.317 | 1.00 | 25.20 | C |
| ATOM | 286 | CG1 | VAL | A | 34 | 2.521 | 15.103 | 20.681 | 1.00 | 31.09 | C |
| ATOM | 287 | CG2 | VAL | A | 34 | 0.041 | 15.496 | 21.086 | 1.00 | 26.99 | C |
| ATOM | 288 | N | ARG | A | 35 | −0.256 | 12.615 | 18.485 | 1.00 | 23.85 | N |
| ATOM | 289 | CA | ARG | A | 35 | −1.443 | 11.781 | 18.345 | 1.00 | 22.69 | C |
| ATOM | 290 | C | ARG | A | 35 | −1.211 | 10.476 | 19.089 | 1.00 | 27.54 | C |
| ATOM | 291 | O | ARG | A | 35 | −0.070 | 10.040 | 19.248 | 1.00 | 27.81 | O |
| ATOM | 292 | CB | ARG | A | 35 | −1.780 | 11.517 | 16.869 | 1.00 | 24.95 | C |
| ATOM | 293 | CG | ARG | A | 35 | −0.891 | 10.492 | 16.168 | 1.00 | 36.79 | C |
| ATOM | 294 | CD | ARG | A | 35 | −1.621 | 9.148 | 16.109 | 1.00 | 43.03 | C |
| ATOM | 295 | NE | ARG | A | 35 | −0.861 | 8.083 | 15.469 | 1.00 | 53.93 | N |
| ATOM | 296 | CZ | ARG | A | 35 | −1.272 | 7.406 | 14.403 | 1.00 | 56.31 | C |
| ATOM | 297 | NH1 | ARG | A | 35 | −2.443 | 7.679 | 13.834 | 1.00 | 50.24 | N |
| ATOM | 298 | NH2 | ARG | A | 35 | −0.509 | 6.447 | 13.907 | 1.00 | 57.31 | N |
| ATOM | 299 | N | PHE | A | 36 | −2.301 | 9.880 | 19.568 | 1.00 | 26.26 | N |
| ATOM | 300 | CA | PHE | A | 36 | −2.322 | 8.484 | 19.994 | 1.00 | 25.78 | C |
| ATOM | 301 | C | PHE | A | 36 | −3.503 | 7.803 | 19.318 | 1.00 | 29.55 | C |
| ATOM | 302 | O | PHE | A | 36 | −4.614 | 8.347 | 19.301 | 1.00 | 27.76 | O |
| ATOM | 303 | CB | PHE | A | 36 | −2.433 | 8.343 | 21.520 | 1.00 | 23.21 | C |
| ATOM | 304 | CG | PHE | A | 36 | −2.404 | 6.906 | 22.007 | 1.00 | 27.32 | C |
| ATOM | 305 | CD1 | PHE | A | 36 | −3.561 | 6.120 | 22.004 | 1.00 | 28.75 | C |
| ATOM | 306 | CD2 | PHE | A | 36 | −1.207 | 6.331 | 22.439 | 1.00 | 27.31 | C |
| ATOM | 307 | CE1 | PHE | A | 36 | −3.524 | 4.794 | 22.438 | 1.00 | 30.03 | C |
| ATOM | 308 | CE2 | PHE | A | 36 | −1.156 | 5.000 | 22.871 | 1.00 | 29.93 | C |
| ATOM | 309 | CZ | PHE | A | 36 | −2.322 | 4.237 | 22.871 | 1.00 | 31.75 | C |
| ATOM | 310 | N | ASP | A | 37 | −3.277 | 6.608 | 18.778 | 1.00 | 22.56 | N |
| ATOM | 311 | CA | ASP | A | 37 | −4.351 | 5.842 | 18.142 | 1.00 | 25.14 | C |
| ATOM | 312 | C | ASP | A | 37 | −4.233 | 4.412 | 18.635 | 1.00 | 27.50 | C |
| ATOM | 313 | O | ASP | A | 37 | −3.213 | 3.759 | 18.393 | 1.00 | 31.16 | O |
| ATOM | 314 | CB | ASP | A | 37 | −4.260 | 5.924 | 16.614 | 1.00 | 31.08 | C |
| ATOM | 315 | CG | ASP | A | 37 | −5.442 | 5.253 | 15.896 | 1.00 | 36.04 | C |
| ATOM | 316 | OD1 | ASP | A | 37 | −6.093 | 4.361 | 16.486 | 1.00 | 32.34 | O |
| ATOM | 317 | OD2 | ASP | A | 37 | −5.715 | 5.634 | 14.732 | 1.00 | 34.89 | O |
| ATOM | 318 | N | SER | A | 38 | −5.265 | 3.934 | 19.331 | 1.00 | 28.04 | N |
| ATOM | 319 | CA | SER | A | 38 | −5.216 | 2.589 | 19.895 | 1.00 | 27.82 | C |
| ATOM | 320 | C | SER | A | 38 | −5.060 | 1.508 | 18.827 | 1.00 | 31.90 | C |
| ATOM | 321 | O | SER | A | 38 | −4.635 | 0.393 | 19.154 | 1.00 | 33.07 | O |
| ATOM | 322 | CB | SER | A | 38 | −6.476 | 2.321 | 20.722 | 1.00 | 29.14 | C |
| ATOM | 323 | OG | SER | A | 38 | −7.633 | 2.326 | 19.886 | 1.00 | 29.87 | O |
| ATOM | 324 | N | ASP | A | 39 | −5.399 | 1.793 | 17.569 | 1.00 | 31.85 | N |
| ATOM | 325 | CA | ASP | A | 39 | −5.230 | 0.805 | 16.503 | 1.00 | 36.52 | C |
| ATOM | 326 | C | ASP | A | 39 | −3.838 | 0.807 | 15.877 | 1.00 | 38.24 | C |
| ATOM | 327 | O | ASP | A | 39 | −3.529 | −0.108 | 15.108 | 1.00 | 35.04 | O |
| ATOM | 328 | CB | ASP | A | 39 | −6.270 | 1.019 | 15.390 | 1.00 | 38.46 | C |
| ATOM | 329 | CG | ASP | A | 39 | −7.554 | 0.242 | 15.631 | 1.00 | 47.86 | C |
| ATOM | 330 | OD1 | ASP | A | 39 | −7.638 | −0.481 | 16.650 | 1.00 | 48.55 | O |
| ATOM | 331 | OD2 | ASP | A | 39 | −8.479 | 0.348 | 14.798 | 1.00 | 52.96 | O |
| ATOM | 332 | N | ALA | A | 40 | −3.002 | 1.804 | 16.162 | 1.00 | 36.43 | N |
| ATOM | 333 | CA | ALA | A | 40 | −1.688 | 1.867 | 15.538 | 1.00 | 40.33 | C |
| ATOM | 334 | C | ALA | A | 40 | −0.724 | 0.879 | 16.196 | 1.00 | 37.62 | C |
| ATOM | 335 | O | ALA | A | 40 | −0.921 | 0.431 | 17.326 | 1.00 | 38.62 | O |
| ATOM | 336 | CB | ALA | A | 40 | −1.116 | 3.284 | 15.608 | 1.00 | 41.86 | C |
| ATOM | 337 | N | ALA | A | 41 | 0.350 | 0.555 | 15.473 | 1.00 | 37.33 | N |
| ATOM | 338 | CA | ALA | A | 41 | 1.243 | −0.502 | 15.936 | 1.00 | 40.09 | C |
| ATOM | 339 | C | ALA | A | 41 | 2.084 | −0.082 | 17.139 | 1.00 | 39.65 | C |
| ATOM | 340 | O | ALA | A | 41 | 2.331 | −0.907 | 18.026 | 1.00 | 38.56 | O |
| ATOM | 341 | CB | ALA | A | 41 | 2.151 | −0.958 | 14.792 | 1.00 | 39.00 | C |
| ATOM | 342 | N | SER | A | 42 | 2.520 | 1.186 | 17.204 | 1.00 | 35.59 | N |
| ATOM | 343 | CA | SER | A | 42 | 3.493 | 1.581 | 18.226 | 1.00 | 36.92 | C |
| ATOM | 344 | C | SER | A | 42 | 2.929 | 1.527 | 19.644 | 1.00 | 35.44 | C |
| ATOM | 345 | O | SER | A | 42 | 3.677 | 1.259 | 20.591 | 1.00 | 36.21 | O |
| ATOM | 346 | CB | SER | A | 42 | 4.014 | 2.990 | 17.945 | 1.00 | 42.68 | C |
| ATOM | 347 | OG | SER | A | 42 | 3.034 | 3.961 | 18.279 | 1.00 | 39.71 | O |

TABLE 8-continued

| | | | | | | | | | | |
|---|---|---|---|---|---|---|---|---|---|---|
| ATOM | 348 | N | GLN | A | 43 | 1.636 | 1.801 | 19.822 | 1.00 | 35.73 | N |
| ATOM | 349 | CA | GLN | A | 43 | 1.040 | 1.974 | 21.154 | 1.00 | 36.84 | C |
| ATOM | 350 | C | GLN | A | 43 | 1.744 | 3.071 | 21.956 | 1.00 | 25.93 | C |
| ATOM | 351 | O | GLN | A | 43 | 1.877 | 2.976 | 23.175 | 1.00 | 29.04 | O |
| ATOM | 352 | CB | GLN | A | 43 | 1.030 | 0.665 | 21.949 | 1.00 | 35.37 | C |
| ATOM | 353 | CG | GLN | A | 43 | 0.245 | −0.444 | 21.276 | 1.00 | 31.27 | C |
| ATOM | 354 | CD | GLN | A | 43 | −1.237 | −0.125 | 21.164 | 1.00 | 39.07 | C |
| ATOM | 355 | OE1 | GLN | A | 43 | −1.904 | 0.140 | 22.162 | 1.00 | 41.47 | O |
| ATOM | 356 | NE2 | GLN | A | 43 | −1.756 | −0.143 | 19.937 | 1.00 | 40.69 | N |
| ATOM | 357 | N | ARG | A | 44 | 2.191 | 4.116 | 21.277 | 1.00 | 29.29 | N |
| ATOM | 358 | CA | ARG | A | 44 | 2.838 | 5.245 | 21.921 | 1.00 | 27.56 | C |
| ATOM | 359 | C | ARG | A | 44 | 2.181 | 6.532 | 21.459 | 1.00 | 25.69 | C |
| ATOM | 360 | O | ARG | A | 44 | 1.623 | 6.603 | 20.363 | 1.00 | 28.26 | O |
| ATOM | 361 | CB | ARG | A | 44 | 4.329 | 5.324 | 21.567 | 1.00 | 36.75 | C |
| ATOM | 362 | CG | ARG | A | 44 | 5.055 | 4.007 | 21.637 | 1.00 | 42.57 | C |
| ATOM | 363 | CD | ARG | A | 44 | 5.731 | 3.865 | 22.964 | 1.00 | 49.93 | C |
| ATOM | 364 | NE | ARG | A | 44 | 6.764 | 4.881 | 23.154 | 1.00 | 49.37 | N |
| ATOM | 365 | CZ | ARG | A | 44 | 7.262 | 5.208 | 24.342 | 1.00 | 42.78 | C |
| ATOM | 366 | NH1 | ARG | A | 44 | 6.806 | 4.609 | 25.437 | 1.00 | 42.10 | N |
| ATOM | 367 | NH2 | ARG | A | 44 | 8.198 | 6.142 | 24.436 | 1.00 | 44.58 | N |
| ATOM | 368 | N | MET | A | 45 | 2.284 | 7.559 | 22.290 | 1.00 | 27.40 | N |
| ATOM | 369 | CA | MET | A | 45 | 2.072 | 8.905 | 21.784 | 1.00 | 26.23 | C |
| ATOM | 370 | C | MET | A | 45 | 3.135 | 9.199 | 20.736 | 1.00 | 24.02 | C |
| ATOM | 371 | O | MET | A | 45 | 4.317 | 8.905 | 20.943 | 1.00 | 29.06 | O |
| ATOM | 372 | CB | MET | A | 45 | 2.137 | 9.917 | 22.923 | 1.00 | 27.23 | C |
| ATOM | 373 | CG | MET | A | 45 | 1.733 | 11.315 | 22.477 | 1.00 | 30.54 | C |
| ATOM | 374 | SD | MET | A | 45 | −0.079 | 11.460 | 22.370 | 1.00 | 28.66 | S |
| ATOM | 375 | CE | MET | A | 45 | −0.331 | 12.400 | 23.877 | 1.00 | 27.49 | C |
| ATOM | 376 | N | GLU | A | 46 | 2.724 | 9.758 | 19.598 | 1.00 | 24.52 | N |
| ATOM | 377 | CA | GLU | A | 46 | 3.630 | 9.935 | 18.476 | 1.00 | 29.40 | C |
| ATOM | 378 | C | GLU | A | 46 | 3.707 | 11.401 | 18.053 | 1.00 | 32.47 | C |
| ATOM | 379 | O | GLU | A | 46 | 2.718 | 12.135 | 18.140 | 1.00 | 29.26 | O |
| ATOM | 380 | CB | GLU | A | 46 | 3.193 | 9.066 | 17.281 | 1.00 | 32.36 | C |
| ATOM | 381 | CG | GLU | A | 46 | 3.089 | 7.590 | 17.644 | 1.00 | 34.41 | C |
| ATOM | 382 | CD | GLU | A | 46 | 2.759 | 6.655 | 16.474 | 1.00 | 46.98 | C |
| ATOM | 383 | OE1 | GLU | A | 46 | 3.587 | 5.772 | 16.179 | 1.00 | 53.84 | O |
| ATOM | 384 | OE2 | GLU | A | 46 | 1.679 | 6.775 | 15.866 | 1.00 | 48.91 | O |
| ATOM | 385 | N | PRO | A | 47 | 4.866 | 11.851 | 17.589 | 1.00 | 30.54 | N |
| ATOM | 386 | CA | PRO | A | 47 | 4.989 | 13.239 | 17.126 | 1.00 | 31.79 | C |
| ATOM | 387 | C | PRO | A | 47 | 4.279 | 13.463 | 15.798 | 1.00 | 32.71 | C |
| ATOM | 388 | O | PRO | A | 47 | 4.239 | 12.585 | 14.932 | 1.00 | 34.62 | O |
| ATOM | 389 | CB | PRO | A | 47 | 6.501 | 13.420 | 16.973 | 1.00 | 32.64 | C |
| ATOM | 390 | CG | PRO | A | 47 | 6.995 | 12.010 | 16.669 | 1.00 | 33.39 | C |
| ATOM | 391 | CD | PRO | A | 47 | 6.159 | 11.135 | 17.552 | 1.00 | 31.55 | C |
| ATOM | 392 | N | ARG | A | 48 | 3.740 | 14.675 | 15.629 | 1.00 | 30.72 | N |
| ATOM | 393 | CA | ARG | A | 48 | 3.129 | 15.066 | 14.363 | 1.00 | 31.02 | C |
| ATOM | 394 | C | ARG | A | 48 | 3.535 | 16.467 | 13.913 | 1.00 | 36.85 | C |
| ATOM | 395 | O | ARG | A | 48 | 2.992 | 16.971 | 12.924 | 1.00 | 39.01 | O |
| ATOM | 396 | CB | ARG | A | 48 | 1.602 | 14.965 | 14.457 | 1.00 | 35.06 | C |
| ATOM | 397 | CG | ARG | A | 48 | 1.070 | 13.541 | 14.402 | 1.00 | 38.46 | C |
| ATOM | 398 | CD | ARG | A | 48 | 1.328 | 12.938 | 13.028 | 1.00 | 41.78 | C |
| ATOM | 399 | NE | ARG | A | 48 | 0.859 | 11.560 | 12.918 | 1.00 | 49.45 | N |
| ATOM | 400 | CZ | ARG | A | 48 | 1.611 | 10.496 | 13.194 | 1.00 | 55.54 | C |
| ATOM | 401 | NH1 | ARG | A | 48 | 1.116 | 9.271 | 13.071 | 1.00 | 56.08 | N |
| ATOM | 402 | NH2 | ARG | A | 48 | 2.864 | 10.657 | 13.594 | 1.00 | 59.41 | N |
| ATOM | 403 | N | ALA | A | 49 | 4.475 | 17.099 | 14.603 | 1.00 | 32.90 | N |
| ATOM | 404 | CA | ALA | A | 49 | 5.035 | 18.385 | 14.218 | 1.00 | 40.96 | C |
| ATOM | 405 | C | ALA | A | 49 | 6.535 | 18.318 | 14.447 | 1.00 | 38.46 | C |
| ATOM | 406 | O | ALA | A | 49 | 6.994 | 17.570 | 15.316 | 1.00 | 40.23 | O |
| ATOM | 407 | CB | ALA | A | 49 | 4.435 | 19.550 | 15.021 | 1.00 | 40.23 | C |
| ATOM | 408 | N | PRO | A | 50 | 7.323 | 19.079 | 13.680 | 1.00 | 39.61 | N |
| ATOM | 409 | CA | PRO | A | 50 | 8.788 | 18.928 | 13.775 | 1.00 | 43.17 | C |
| ATOM | 410 | C | PRO | A | 50 | 9.358 | 19.345 | 15.119 | 1.00 | 41.61 | C |
| ATOM | 411 | O | PRO | A | 50 | 10.310 | 18.728 | 15.609 | 1.00 | 43.04 | O |
| ATOM | 412 | CB | PRO | A | 50 | 9.306 | 19.832 | 12.649 | 1.00 | 46.19 | C |
| ATOM | 413 | CG | PRO | A | 50 | 8.129 | 20.065 | 11.751 | 1.00 | 49.94 | C |
| ATOM | 414 | CD | PRO | A | 50 | 6.919 | 20.008 | 12.610 | 1.00 | 39.44 | C |
| ATOM | 415 | N | TRP | A | 51 | 8.798 | 20.383 | 15.734 | 1.00 | 39.52 | N |
| ATOM | 416 | CA | TRP | A | 51 | 9.390 | 20.937 | 16.940 | 1.00 | 41.20 | C |
| ATOM | 417 | C | TRP | A | 51 | 9.123 | 20.097 | 18.181 | 1.00 | 39.39 | C |
| ATOM | 418 | O | TRP | A | 51 | 9.753 | 20.336 | 19.217 | 1.00 | 41.05 | O |
| ATOM | 419 | CB | TRP | A | 51 | 8.875 | 22.355 | 17.150 | 1.00 | 43.28 | C |
| ATOM | 420 | CG | TRP | A | 51 | 7.408 | 22.500 | 16.902 | 1.00 | 44.45 | C |
| ATOM | 421 | CD1 | TRP | A | 51 | 6.807 | 22.885 | 15.740 | 1.00 | 46.08 | C |
| ATOM | 422 | CD2 | TRP | A | 51 | 6.354 | 22.261 | 17.840 | 1.00 | 38.61 | C |
| ATOM | 423 | NE1 | TRP | A | 51 | 5.441 | 22.911 | 15.898 | 1.00 | 45.95 | N |
| ATOM | 424 | CE2 | TRP | A | 51 | 5.136 | 22.533 | 17.179 | 1.00 | 39.37 | C |
| ATOM | 425 | CE3 | TRP | A | 51 | 6.323 | 21.861 | 19.176 | 1.00 | 33.80 | C |
| ATOM | 426 | CZ2 | TRP | A | 51 | 3.897 | 22.402 | 17.806 | 1.00 | 35.85 | C |
| ATOM | 427 | CZ3 | TRP | A | 51 | 5.090 | 21.740 | 19.799 | 1.00 | 31.22 | C |

TABLE 8-continued

| | | | | | | | | | | |
|---|---|---|---|---|---|---|---|---|---|---|
| ATOM | 428 | CH2 | TRP | A | 51 | 3.896 | 22.010 | 19.116 | 1.00 | 30.39 | C |
| ATOM | 429 | N | ILE | A | 52 | 8.189 | 19.144 | 18.126 | 1.00 | 31.93 | N |
| ATOM | 430 | CA | ILE | A | 52 | 7.994 | 18.267 | 19.270 | 1.00 | 32.53 | C |
| ATOM | 431 | C | ILE | A | 52 | 8.921 | 17.057 | 19.214 | 1.00 | 31.34 | C |
| ATOM | 432 | O | ILE | A | 52 | 9.123 | 16.397 | 20.242 | 1.00 | 29.61 | O |
| ATOM | 433 | CB | ILE | A | 52 | 6.532 | 17.794 | 19.381 | 1.00 | 32.27 | C |
| ATOM | 434 | CG1 | ILE | A | 52 | 6.213 | 17.368 | 20.817 | 1.00 | 28.16 | C |
| ATOM | 435 | CG2 | ILE | A | 52 | 6.272 | 16.647 | 18.430 | 1.00 | 34.79 | C |
| ATOM | 436 | CD1 | ILE | A | 52 | 6.061 | 18.519 | 21.775 | 1.00 | 30.63 | C |
| ATOM | 437 | N | GLU | A | 53 | 9.489 | 16.747 | 18.046 | 1.00 | 40.29 | N |
| ATOM | 438 | CA | GLU | A | 53 | 10.346 | 15.568 | 17.946 | 1.00 | 46.76 | C |
| ATOM | 439 | C | GLU | A | 53 | 11.591 | 15.687 | 18.816 | 1.00 | 44.06 | C |
| ATOM | 440 | O | GLU | A | 53 | 12.195 | 14.663 | 19.155 | 1.00 | 46.57 | O |
| ATOM | 441 | CB | GLU | A | 53 | 10.726 | 15.317 | 16.486 | 1.00 | 54.42 | C |
| ATOM | 442 | CG | GLU | A | 53 | 9.687 | 14.498 | 15.732 | 1.00 | 61.50 | C |
| ATOM | 443 | CD | GLU | A | 53 | 9.699 | 14.745 | 14.235 | 1.00 | 75.70 | C |
| ATOM | 444 | OE1 | GLU | A | 53 | 10.364 | 15.705 | 13.796 | 1.00 | 82.59 | O |
| ATOM | 445 | OE2 | GLU | A | 53 | 9.037 | 13.984 | 13.498 | 1.00 | 80.48 | O |
| ATOM | 446 | N | GLN | A | 54 | 11.956 | 16.905 | 19.223 | 1.00 | 39.29 | N |
| ATOM | 447 | CA | GLN | A | 54 | 13.125 | 17.130 | 20.066 | 1.00 | 44.00 | C |
| ATOM | 448 | C | GLN | A | 54 | 12.904 | 16.747 | 21.523 | 1.00 | 40.91 | C |
| ATOM | 449 | O | GLN | A | 54 | 13.882 | 16.656 | 22.269 | 1.00 | 38.39 | O |
| ATOM | 450 | CB | GLN | A | 54 | 13.565 | 18.601 | 19.991 | 1.00 | 49.00 | C |
| ATOM | 451 | CG | GLN | A | 54 | 12.630 | 19.586 | 20.709 | 1.00 | 57.17 | C |
| ATOM | 452 | CD | GLN | A | 54 | 13.060 | 21.046 | 20.543 | 1.00 | 66.05 | C |
| ATOM | 453 | OE1 | GLN | A | 54 | 12.622 | 21.737 | 19.618 | 1.00 | 65.07 | O |
| ATOM | 454 | NE2 | GLN | A | 54 | 13.916 | 21.519 | 21.447 | 1.00 | 64.86 | N |
| ATOM | 455 | N | GLU | A | 55 | 11.665 | 16.539 | 21.969 | 1.00 | 32.14 | N |
| ATOM | 456 | CA | GLU | A | 55 | 11.485 | 16.135 | 23.355 | 1.00 | 31.04 | C |
| ATOM | 457 | C | GLU | A | 55 | 12.150 | 14.780 | 23.596 | 1.00 | 31.18 | C |
| ATOM | 458 | O | GLU | A | 55 | 12.179 | 13.912 | 22.715 | 1.00 | 32.93 | O |
| ATOM | 459 | CB | GLU | A | 55 | 10.003 | 16.066 | 23.720 | 1.00 | 27.85 | C |
| ATOM | 460 | CG | GLU | A | 55 | 9.266 | 17.393 | 23.586 | 1.00 | 34.35 | C |
| ATOM | 461 | CD | GLU | A | 55 | 9.648 | 18.422 | 24.648 | 1.00 | 39.04 | C |
| ATOM | 462 | OE1 | GLU | A | 55 | 10.280 | 18.062 | 25.666 | 1.00 | 39.55 | O |
| ATOM | 463 | OE2 | GLU | A | 55 | 9.305 | 19.604 | 24.457 | 1.00 | 40.56 | O |
| ATOM | 464 | N | GLY | A | 56 | 12.668 | 14.602 | 24.814 | 1.00 | 28.76 | N |
| ATOM | 465 | CA | GLY | A | 56 | 13.414 | 13.419 | 25.166 | 1.00 | 31.57 | C |
| ATOM | 466 | C | GLY | A | 56 | 12.556 | 12.246 | 25.584 | 1.00 | 32.54 | C |
| ATOM | 467 | O | GLY | A | 56 | 11.314 | 12.289 | 25.588 | 1.00 | 33.29 | O |
| ATOM | 468 | N | PRO | A | 57 | 13.238 | 11.167 | 25.988 | 1.00 | 30.18 | N |
| ATOM | 469 | CA | PRO | A | 57 | 12.524 | 9.917 | 26.307 | 1.00 | 31.22 | C |
| ATOM | 470 | C | PRO | A | 57 | 11.528 | 10.033 | 27.444 | 1.00 | 29.30 | C |
| ATOM | 471 | O | PRO | A | 57 | 10.492 | 9.362 | 27.398 | 1.00 | 27.94 | O |
| ATOM | 472 | CB | PRO | A | 57 | 13.652 | 8.943 | 26.668 | 1.00 | 33.03 | C |
| ATOM | 473 | CG | PRO | A | 57 | 14.899 | 9.545 | 26.072 | 1.00 | 31.97 | C |
| ATOM | 474 | CD | PRO | A | 57 | 14.709 | 11.023 | 26.072 | 1.00 | 34.52 | C |
| ATOM | 475 | N | GLU | A | 58 | 11.806 | 10.840 | 28.473 | 1.00 | 27.37 | N |
| ATOM | 476 | CA | GLU | A | 58 | 10.847 | 10.933 | 29.570 | 1.00 | 28.48 | C |
| ATOM | 477 | C | GLU | A | 58 | 9.547 | 11.576 | 29.103 | 1.00 | 25.87 | C |
| ATOM | 478 | O | GLU | A | 58 | 8.467 | 11.190 | 29.559 | 1.00 | 28.19 | O |
| ATOM | 479 | CB | GLU | A | 58 | 11.433 | 11.720 | 30.740 | 1.00 | 30.09 | C |
| ATOM | 480 | CG | GLU | A | 58 | 12.588 | 11.008 | 31.437 | 1.00 | 40.14 | C |
| ATOM | 481 | CD | GLU | A | 58 | 13.153 | 11.800 | 32.604 | 0.00 | 38.15 | C |
| ATOM | 482 | OE1 | GLU | A | 58 | 12.516 | 12.787 | 33.030 | 1.00 | 35.92 | O |
| ATOM | 483 | OE2 | GLU | A | 58 | 14.242 | 11.435 | 33.093 | 0.00 | 38.42 | O |
| ATOM | 484 | N | TYR | A | 59 | 9.637 | 12.552 | 28.196 | 1.00 | 26.17 | N |
| ATOM | 485 | CA | TYR | A | 59 | 8.425 | 13.156 | 27.642 | 1.00 | 29.62 | C |
| ATOM | 486 | C | TYR | A | 59 | 7.558 | 12.110 | 26.944 | 1.00 | 26.96 | C |
| ATOM | 487 | O | TYR | A | 59 | 6.351 | 12.005 | 27.216 | 1.00 | 25.90 | O |
| ATOM | 488 | CB | TYR | A | 59 | 8.785 | 14.282 | 26.669 | 1.00 | 27.18 | C |
| ATOM | 489 | CG | TYR | A | 59 | 7.563 | 14.955 | 26.019 | 1.00 | 27.72 | C |
| ATOM | 490 | CD1 | TYR | A | 59 | 6.946 | 16.055 | 26.618 | 1.00 | 30.96 | C |
| ATOM | 491 | CD2 | TYR | A | 59 | 7.046 | 14.501 | 24.803 | 1.00 | 28.34 | C |
| ATOM | 492 | CE1 | TYR | A | 59 | 5.842 | 16.676 | 26.031 | 1.00 | 27.99 | C |
| ATOM | 493 | CE2 | TYR | A | 59 | 5.926 | 15.119 | 24.209 | 1.00 | 28.43 | C |
| ATOM | 494 | CZ | TYR | A | 59 | 5.347 | 16.212 | 24.830 | 1.00 | 28.30 | C |
| ATOM | 495 | OH | TYR | A | 59 | 4.251 | 16.823 | 24.252 | 1.00 | 27.74 | O |
| ATOM | 496 | N | TRP | A | 60 | 8.157 | 11.329 | 26.024 | 1.00 | 26.72 | N |
| ATOM | 497 | CA | TRP | A | 60 | 7.367 | 10.382 | 25.236 | 1.00 | 30.02 | C |
| ATOM | 498 | C | TRP | A | 60 | 6.840 | 9.248 | 26.101 | 1.00 | 31.84 | C |
| ATOM | 499 | O | TRP | A | 60 | 5.693 | 8.823 | 25.934 | 1.00 | 27.86 | O |
| ATOM | 500 | CB | TRP | A | 60 | 8.180 | 9.853 | 24.043 | 1.00 | 25.36 | C |
| ATOM | 501 | CG | TRP | A | 60 | 8.452 | 10.965 | 23.107 | 1.00 | 28.01 | C |
| ATOM | 502 | CD1 | TRP | A | 60 | 9.654 | 11.610 | 22.911 | 1.00 | 30.02 | C |
| ATOM | 503 | CD2 | TRP | A | 60 | 7.489 | 11.666 | 22.311 | 1.00 | 26.83 | C |
| ATOM | 504 | NE1 | TRP | A | 60 | 9.497 | 12.632 | 22.006 | 1.00 | 31.50 | N |
| ATOM | 505 | E2 | TRP | A | 60 | 8.178 | 12.691 | 21.625 | 1.00 | 31.15 | C |
| ATOM | 506 | CE3 | TRP | A | 60 | 6.112 | 11.506 | 22.085 | 1.00 | 27.59 | C |
| ATOM | 507 | CZ2 | TRP | A | 60 | 7.534 | 13.561 | 20.737 | 1.00 | 31.09 | C |

TABLE 8-continued

| | | | | | | | | | | |
|---|---|---|---|---|---|---|---|---|---|---|
| ATOM | 508 | CZ3 | TRP | A | 60 | 5.477 | 12.363 | 21.206 | 1.00 | 28.42 | C |
| ATOM | 509 | CH2 | TRP | A | 60 | 6.183 | 13.385 | 20.546 | 1.00 | 30.82 | C |
| ATOM | 510 | N | ASP | A | 61 | 7.636 | 8.780 | 27.062 | 1.00 | 26.48 | N |
| ATOM | 511 | CA | ASP | A | 61 | 7.135 | 7.771 | 27.993 | 1.00 | 27.88 | C |
| ATOM | 512 | C | ASP | A | 61 | 6.015 | 8.329 | 28.862 | 1.00 | 28.10 | C |
| ATOM | 513 | O | ASP | A | 61 | 5.016 | 7.647 | 29.112 | 1.00 | 28.62 | O |
| ATOM | 514 | CB | ASP | A | 61 | 8.263 | 7.242 | 28.880 | 1.00 | 31.33 | C |
| ATOM | 515 | CG | ASP | A | 61 | 9.206 | 6.300 | 28.142 | 1.00 | 48.36 | C |
| ATOM | 516 | OD1 | ASP | A | 61 | 9.038 | 6.118 | 26.920 | 1.00 | 53.75 | O |
| ATOM | 517 | OD2 | ASP | A | 61 | 10.117 | 5.737 | 28.786 | 1.00 | 52.08 | O |
| ATOM | 518 | N | GLY | A | 62 | 6.164 | 9.566 | 29.338 | 1.00 | 25.99 | N |
| ATOM | 519 | CA | GLY | A | 62 | 5.145 | 10.142 | 30.207 | 1.00 | 25.97 | C |
| ATOM | 520 | C | GLY | A | 62 | 3.853 | 10.458 | 29.468 | 1.00 | 26.39 | C |
| ATOM | 521 | O | GLY | A | 62 | 2.755 | 10.164 | 29.958 | 1.00 | 27.67 | O |
| ATOM | 522 | N | GLU | A | 63 | 3.959 | 11.035 | 28.268 | 1.00 | 23.52 | N |
| ATOM | 523 | CA | GLU | A | 63 | 2.748 | 11.303 | 27.494 | 1.00 | 26.89 | C |
| ATOM | 524 | C | GLU | A | 63 | 2.024 | 10.010 | 27.145 | 1.00 | 26.10 | C |
| ATOM | 525 | O | GLU | A | 63 | 0.785 | 9.954 | 27.178 | 1.00 | 22.63 | O |
| ATOM | 526 | CB | GLU | A | 63 | 3.074 | 12.090 | 26.226 | 1.00 | 26.54 | C |
| ATOM | 527 | CG | GLU | A | 63 | 3.618 | 13.494 | 26.476 | 1.00 | 26.52 | C |
| ATOM | 528 | CD | GLU | A | 63 | 2.694 | 14.361 | 27.332 | 1.00 | 28.85 | C |
| ATOM | 529 | OE1 | GLU | A | 63 | 3.102 | 14.741 | 28.444 | 1.00 | 30.70 | O |
| ATOM | 530 | OE2 | GLU | A | 63 | 1.553 | 14.638 | 26.904 | 1.00 | 26.91 | O |
| ATOM | 531 | N | THR | A | 64 | 2.780 | 8.951 | 26.838 | 1.00 | 25.05 | N |
| ATOM | 532 | CA | THR | A | 64 | 2.164 | 7.652 | 26.563 | 1.00 | 26.10 | C |
| ATOM | 533 | C | THR | A | 64 | 1.443 | 7.105 | 27.791 | 1.00 | 26.16 | C |
| ATOM | 534 | O | THR | A | 64 | 0.296 | 6.646 | 27.696 | 1.00 | 24.44 | O |
| ATOM | 535 | CB | THR | A | 64 | 3.228 | 6.666 | 26.078 | 1.00 | 25.19 | C |
| ATOM | 536 | OG1 | THR | A | 64 | 3.766 | 7.149 | 24.839 | 1.00 | 26.23 | O |
| ATOM | 537 | CG2 | THR | A | 64 | 2.610 | 5.271 | 25.868 | 1.00 | 26.79 | C |
| ATOM | 538 | N | ARG | A | 65 | 2.109 | 7.133 | 28.950 | 1.00 | 24.77 | N |
| ATOM | 539 | CA | ARG | A | 65 | 1.483 | 6.648 | 30.181 | 1.00 | 25.47 | C |
| ATOM | 540 | C | ARG | A | 65 | 0.214 | 7.427 | 30.505 | 1.00 | 26.13 | C |
| ATOM | 541 | O | ARG | A | 65 | −0.811 | 6.836 | 30.868 | 1.00 | 24.45 | O |
| ATOM | 542 | CB | ARG | A | 65 | 2.467 | 6.742 | 31.346 | 1.00 | 31.32 | C |
| ATOM | 543 | CG | ARG | A | 65 | 1.837 | 6.622 | 32.731 | 1.00 | 36.86 | C |
| ATOM | 544 | CD | ARG | A | 65 | 2.831 | 7.007 | 33.873 | 1.00 | 45.12 | C |
| ATOM | 545 | NE | ARG | A | 65 | 3.458 | 8.323 | 33.700 | 1.00 | 41.72 | N |
| ATOM | 546 | CZ | ARG | A | 65 | 2.917 | 9.484 | 34.069 | 1.00 | 45.22 | C |
| ATOM | 547 | NH1 | ARG | A | 65 | 1.715 | 9.523 | 34.636 | 1.00 | 43.48 | N |
| ATOM | 548 | NH2 | ARG | A | 65 | 3.577 | 10.616 | 33.857 | 1.00 | 49.31 | N |
| ATOM | 549 | N | LYS | A | 66 | 0.263 | 8.757 | 30.375 | 1.00 | 20.56 | N |
| ATOM | 550 | CA | LYS | A | 66 | −0.886 | 9.585 | 30.745 | 1.00 | 22.79 | C |
| ATOM | 551 | C | LYS | A | 66 | −2.067 | 9.383 | 29.792 | 1.00 | 20.71 | C |
| ATOM | 552 | O | LYS | A | 66 | −3.228 | 9.291 | 30.241 | 1.00 | 23.73 | O |
| ATOM | 553 | CB | LYS | A | 66 | −0.469 | 11.058 | 30.782 | 1.00 | 23.20 | C |
| ATOM | 554 | CG | LYS | A | 66 | 0.541 | 11.440 | 31.865 | 1.00 | 28.34 | C |
| ATOM | 555 | CD | LYS | A | 66 | 0.809 | 12.967 | 31.893 | 1.00 | 33.78 | C |
| ATOM | 556 | CE | LYS | A | 66 | 1.800 | 13.465 | 30.826 | 1.00 | 32.32 | C |
| ATOM | 557 | NZ | LYS | A | 66 | 1.942 | 15.016 | 30.775 | 1.00 | 26.95 | N |
| ATOM | 558 | N | VAL | A | 67 | −1.820 | 9.300 | 28.478 | 1.00 | 17.98 | N |
| ATOM | 559 | C | VAL | A | 67 | −3.556 | 7.730 | 27.718 | 1.00 | 26.70 | C |
| ATOM | 560 | O | VAL | A | 67 | −4.771 | 7.547 | 27.522 | 1.00 | 24.18 | O |
| ATOM | 561 | CA | AVAL | A | 67 | −2.936 | 9.112 | 27.542 | 0.57 | 21.72 | C |
| ATOM | 562 | CB | AVAL | A | 67 | −2.480 | 9.358 | 26.085 | 0.57 | 24.00 | C |
| ATOM | 563 | CG1 | AVAL | A | 67 | −1.820 | 8.136 | 25.464 | 0.57 | 23.28 | C |
| ATOM | 564 | CG2 | AVAL | A | 67 | −3.647 | 9.789 | 25.232 | 0.57 | 26.31 | C |
| ATOM | 565 | CA | BVAL | A | 67 | −2.965 | 9.119 | 27.582 | 0.43 | 22.14 | C |
| ATOM | 566 | CB | BVAL | A | 67 | −2.601 | 9.421 | 26.121 | 0.43 | 24.14 | C |
| ATOM | 567 | CG1 | BVAL | A | 67 | −2.169 | 10.829 | 26.036 | 0.43 | 26.30 | C |
| ATOM | 568 | CG2 | BVAL | A | 67 | −1.526 | 8.485 | 25.597 | 0.43 | 25.47 | C |
| ATOM | 569 | N | LYS | A | 68 | −2.742 | 6.734 | 28.065 | 1.00 | 24.92 | N |
| ATOM | 570 | CA | LYS | A | 68 | −3.306 | 5.413 | 28.323 | 1.00 | 25.56 | C |
| ATOM | 571 | C | LYS | A | 68 | −4.167 | 5.411 | 29.580 | 1.00 | 23.74 | C |
| ATOM | 572 | O | LYS | A | 68 | −5.171 | 4.699 | 29.631 | 1.00 | 25.60 | O |
| ATOM | 573 | CB | LYS | A | 68 | −2.196 | 4.379 | 28.429 | 1.00 | 25.59 | C |
| ATOM | 574 | CG | LYS | A | 68 | −1.651 | 3.963 | 27.076 | 1.00 | 26.68 | C |
| ATOM | 575 | CD | LYS | A | 68 | −0.554 | 2.911 | 27.255 | 1.00 | 33.31 | C |
| ATOM | 576 | CE | LYS | A | 68 | 0.106 | 2.563 | 25.946 | 1.00 | 36.60 | C |
| ATOM | 577 | NZ | LYS | A | 68 | 1.200 | 1.573 | 26.181 | 1.00 | 47.80 | N |
| ATOM | 578 | N | ALA | A | 69 | −3.810 | 6.214 | 30.592 | 1.00 | 20.64 | N |
| ATOM | 579 | CA | ALA | A | 69 | −4.687 | 6.361 | 31.742 | 1.00 | 23.05 | C |
| ATOM | 580 | C | ALA | A | 69 | −6.003 | 7.011 | 31.334 | 1.00 | 23.52 | C |
| ATOM | 581 | O | ALA | A | 69 | −7.073 | 6.570 | 31.769 | 1.00 | 23.60 | O |
| ATOM | 582 | CB | ALA | A | 69 | −4.001 | 7.160 | 32.845 | 1.00 | 21.92 | C |
| ATOM | 583 | N | HIS | A | 70 | −5.945 | 8.065 | 30.502 | 1.00 | 24.05 | N |
| ATOM | 584 | CA | HIS | A | 70 | −7.187 | 8.666 | 29.996 | 1.00 | 21.25 | C |
| ATOM | 585 | C | HIS | A | 70 | −8.040 | 7.618 | 29.282 | 1.00 | 23.36 | C |
| ATOM | 586 | O | HIS | A | 70 | −9.271 | 7.592 | 29.433 | 1.00 | 20.81 | O |
| ATOM | 587 | CB | HIS | A | 70 | −6.896 | 9.807 | 29.005 | 1.00 | 21.12 | C |

TABLE 8-continued

| | | | | | | | | | | |
|---|---|---|---|---|---|---|---|---|---|---|
| ATOM | 588 | CG | HIS | A | 70 | −6.435 | 11.105 | 29.613 | 1.00 | 25.03 | C |
| ATOM | 589 | ND1 | HIS | A | 70 | −5.876 | 11.212 | 30.870 | 1.00 | 30.39 | N |
| ATOM | 590 | CD2 | HIS | A | 70 | −6.452 | 12.366 | 29.104 | 1.00 | 25.43 | C |
| ATOM | 591 | CE1 | HIS | A | 70 | −5.564 | 12.475 | 31.106 | 1.00 | 35.04 | C |
| ATOM | 592 | NE2 | HIS | A | 70 | −5.902 | 13.196 | 30.051 | 1.00 | 26.79 | N |
| ATOM | 593 | N | SER | A | 71 | −7.416 | 6.781 | 28.452 | 1.00 | 20.01 | N |
| ATOM | 594 | C | SER | A | 71 | −8.908 | 4.833 | 28.603 | 1.00 | 21.65 | C |
| ATOM | 595 | O | SER | A | 71 | −10.056 | 4.448 | 28.340 | 1.00 | 23.78 | O |
| ATOM | 596 | CA | ASER | A | 71 | −8.171 | 5.796 | 27.684 | 0.51 | 21.39 | C |
| ATOM | 597 | CB | ASER | A | 71 | −7.231 | 5.035 | 26.753 | 0.51 | 24.40 | C |
| ATOM | 598 | OG | ASER | A | 71 | −7.896 | 3.958 | 26.128 | 0.51 | 20.34 | O |
| ATOM | 599 | CA | BSER | A | 71 | −8.204 | 5.824 | 27.684 | 0.49 | 21.58 | C |
| ATOM | 600 | CB | BSER | A | 71 | −7.336 | 5.100 | 26.648 | 0.49 | 24.32 | C |
| ATOM | 601 | OG | BSER | A | 71 | −6.444 | 4.167 | 27.225 | 0.49 | 22.09 | O |
| ATOM | 602 | N | GLN | A | 72 | −8.256 | 4.413 | 29.686 | 1.00 | 20.90 | N |
| ATOM | 603 | CA | GLN | A | 72 | −8.904 | 3.464 | 30.597 | 1.00 | 24.67 | C |
| ATOM | 604 | C | GLN | A | 72 | −10.086 | 4.103 | 31.309 | 1.00 | 24.07 | C |
| ATOM | 605 | O | GLN | A | 72 | −11.109 | 3.445 | 31.559 | 1.00 | 22.96 | O |
| ATOM | 606 | CB | GLN | A | 72 | −7.899 | 2.959 | 31.628 | 1.00 | 24.16 | C |
| ATOM | 607 | CG | GLN | A | 72 | −6.856 | 2.044 | 31.044 | 1.00 | 21.65 | C |
| ATOM | 608 | CD | GLN | A | 72 | −5.719 | 1.838 | 32.034 | 1.00 | 31.96 | C |
| ATOM | 609 | OE1 | GLN | A | 72 | −5.848 | 1.059 | 32.981 | 1.00 | 27.01 | O |
| ATOM | 610 | NE2 | GLN | A | 72 | −4.626 | 2.586 | 31.857 | 1.00 | 25.21 | N |
| ATOM | 611 | N | THR | A | 73 | −9.947 | 5.375 | 31.684 | 1.00 | 21.15 | N |
| ATOM | 612 | CA | THR | A | 73 | −11.076 | 6.054 | 32.301 | 1.00 | 20.00 | C |
| ATOM | 613 | C | THR | A | 73 | −12.238 | 61.53 | 31.320 | 1.00 | 23.35 | C |
| ATOM | 614 | O | THR | A | 73 | −13.390 | 5.895 | 31.694 | 1.00 | 23.92 | O |
| ATOM | 615 | CB | THR | A | 73 | −10.642 | 7.426 | 32.808 | 1.00 | 22.28 | C |
| ATOM | 616 | OG1 | THR | A | 73 | −9.661 | 7.232 | 33.823 | 1.00 | 23.21 | O |
| ATOM | 617 | CG2 | THR | A | 73 | −11.870 | 8.201 | 33.381 | 1.00 | 20.12 | C |
| ATOM | 618 | N | HIS | A | 74 | −11.955 | 6.482 | 30.048 | 1.00 | 24.71 | N |
| ATOM | 619 | CA | HIS | A | 74 | −13.031 | 6.530 | 29.057 | 1.00 | 23.20 | C |
| ATOM | 620 | C | HIS | A | 74 | −13.682 | 5.170 | 28.886 | 1.00 | 23.24 | C |
| ATOM | 621 | O | HIS | A | 74 | −14.891 | 5.080 | 28.643 | 1.00 | 24.85 | O |
| ATOM | 622 | CB | HIS | A | 74 | −12.524 | 7.011 | 27.699 | 1.00 | 25.47 | C |
| ATOM | 623 | CG | HIS | A | 74 | −12.226 | 8.469 | 27.659 | 1.00 | 38.47 | C |
| ATOM | 624 | ND1 | HIS | A | 74 | −12.063 | 9.160 | 26.479 | 1.00 | 48.71 | N |
| ATOM | 625 | CD2 | HIS | A | 74 | −12.059 | 9.370 | 28.654 | 1.00 | 46.60 | C |
| ATOM | 626 | CE1 | HIS | A | 74 | −11.803 | 10.426 | 26.751 | 1.00 | 48.37 | C |
| ATOM | 627 | NE2 | HIS | A | 74 | −11.795 | 10.580 | 28.062 | 1.00 | 49.07 | N |
| ATOM | 628 | N | ARG | A | 75 | −12.895 | 4.101 | 28.987 | 1.00 | 24.08 | N |
| ATOM | 629 | CA | ARG | A | 75 | −13.472 | 2.769 | 28.868 | 1.00 | 24.25 | C |
| ATOM | 630 | C | ARG | A | 75 | −14.451 | 2.501 | 30.004 | 1.00 | 22.48 | C |
| ATOM | 631 | O | ARG | A | 75 | −15.533 | 1.946 | 29.781 | 1.00 | 25.46 | O |
| ATOM | 632 | CB | ARG | A | 75 | −12.353 | 1.727 | 28.843 | 1.00 | 21.84 | C |
| ATOM | 633 | CG | ARG | A | 75 | −12.793 | 0.345 | 28.389 | 1.00 | 26.07 | C |
| ATOM | 634 | CD | ARG | A | 75 | −11.542 | −0.543 | 28.190 | 1.00 | 24.73 | C |
| ATOM | 635 | NE | ARG | A | 75 | −11.876 | −1.865 | 27.661 | 1.00 | 24.51 | N |
| ATOM | 636 | CZ | ARG | A | 75 | −10.961 | −2.801 | 27.399 | 1.00 | 29.76 | C |
| ATOM | 637 | NH1 | ARG | A | 75 | −9.680 | −2.563 | 27.611 | 1.00 | 26.16 | N |
| ATOM | 638 | NH2 | ARG | A | 75 | −11.314 | −3.976 | 26.911 | 1.00 | 26.80 | N |
| ATOM | 639 | N | VAL | A | 76 | −14.091 | 2.890 | 31.229 | 1.00 | 23.52 | N |
| ATOM | 640 | CA | VAL | A | 76 | −15.029 | 2.809 | 32.343 | 1.00 | 20.96 | C |
| ATOM | 641 | C | VAL | A | 76 | −16.231 | 3.712 | 32.092 | 1.00 | 24.78 | C |
| ATOM | 642 | O | VAL | A | 76 | −17.371 | 3.335 | 32.379 | 1.00 | 25.90 | O |
| ATOM | 643 | CB | VAL | A | 76 | −14.309 | 3.146 | 33.666 | 1.00 | 22.37 | C |
| ATOM | 644 | CG1 | VAL | A | 76 | −15.290 | 3.446 | 34.810 | 1.00 | 24.96 | C |
| ATOM | 645 | CG2 | VAL | A | 76 | −13.365 | 2.011 | 34.066 | 1.00 | 24.34 | C |
| ATOM | 646 | N | ASP | A | 77 | −15.999 | 4.926 | 31.569 | 1.00 | 22.52 | N |
| ATOM | 647 | CA | ASP | A | 77 | −17.117 | 5.847 | 31.331 | 1.00 | 23.69 | C |
| ATOM | 648 | C | ASP | A | 77 | −18.144 | 5.257 | 30.378 | 1.00 | 24.70 | C |
| ATOM | 649 | O | ASP | A | 77 | −19.352 | 5.431 | 30.572 | 1.00 | 24.76 | O |
| ATOM | 650 | CB | ASP | A | 77 | −16.628 | 7.175 | 30.758 | 1.00 | 22.30 | C |
| ATOM | 651 | CG | ASP | A | 77 | −15.772 | 7.973 | 31.744 | 1.00 | 29.61 | C |
| ATOM | 652 | OD1 | ASP | A | 77 | −15.808 | 7.684 | 32.965 | 1.00 | 29.04 | O |
| ATOM | 653 | OD2 | ASP | A | 77 | −15.049 | 8.878 | 31.274 | 1.00 | 28.14 | O |
| ATOM | 654 | N | LEU | A | 78 | −17.686 | 4.594 | 29.310 | 1.00 | 24.56 | N |
| ATOM | 655 | CA | LEU | A | 78 | −18.624 | 3.997 | 28.358 | 1.00 | 25.26 | C |
| ATOM | 656 | C | LEU | A | 78 | −19.560 | 3.004 | 29.046 | 1.00 | 24.06 | C |
| ATOM | 657 | O | LEU | A | 78 | −20.781 | 3.016 | 28.826 | 1.00 | 26.51 | O |
| ATOM | 658 | CB | LEU | A | 78 | −17.841 | 3.325 | 27.221 | 1.00 | 28.96 | C |
| ATOM | 659 | CG | LEU | A | 78 | −17.281 | 4.297 | 26.172 | 1.00 | 27.75 | C |
| ATOM | 660 | CD1 | LEU | A | 78 | −16.190 | 3.635 | 25.355 | 1.00 | 29.94 | C |
| ATOM | 661 | CD2 | LEU | A | 78 | −18.400 | 4.860 | 25.252 | 1.00 | 26.57 | C |
| ATOM | 662 | N | GLY | A | 79 | −19.019 | 2.169 | 29.927 | 1.00 | 26.92 | N |
| ATOM | 663 | CA | GLY | A | 79 | −19.864 | 1.231 | 30.636 | 1.00 | 32.13 | C |
| ATOM | 664 | C | GLY | A | 79 | −20.720 | 1.906 | 31.689 | 1.00 | 26.36 | C |
| ATOM | 665 | O | GLY | A | 79 | −21.864 | 1.501 | 31.920 | 1.00 | 29.04 | O |
| ATOM | 666 | N | THR | A | 80 | −20.170 | 2.917 | 32.363 | 1.00 | 27.16 | N |
| ATOM | 667 | CA | THR | A | 80 | −20.928 | 3.616 | 33.397 | 1.00 | 24.92 | C |

TABLE 8-continued

| | | | | | | | | | | |
|---|---|---|---|---|---|---|---|---|---|---|
| ATOM | 668 | C | THR | A | 80 | −22.091 | 4.395 | 32.786 | 1.00 | 25.13 | C |
| ATOM | 669 | O | THR | A | 80 | −23.209 | 4.367 | 33.318 | 1.00 | 29.96 | O |
| ATOM | 670 | CB | THR | A | 80 | −20.001 | 4.552 | 34.181 | 1.00 | 23.70 | C |
| ATOM | 671 | OG1 | THR | A | 80 | −18.878 | 3.810 | 34.682 | 1.00 | 25.58 | O |
| ATOM | 672 | CG2 | THR | A | 80 | −20.731 | 5.228 | 35.340 | 1.00 | 29.94 | C |
| ATOM | 673 | N | LEU | A | 81 | −21.855 | 5.067 | 31.654 | 1.00 | 26.02 | N |
| ATOM | 674 | CA | LEU | A | 81 | −22.930 | 5.834 | 31.015 | 1.00 | 30.64 | C |
| ATOM | 675 | C | LEU | A | 81 | −24.012 | 4.914 | 30.463 | 1.00 | 27.82 | C |
| ATOM | 676 | O | LEU | A | 81 | −25.207 | 5.236 | 30.541 | 1.00 | 28.18 | O |
| ATOM | 677 | CB | LEU | A | 81 | −22.370 | 6.721 | 29.903 | 1.00 | 24.26 | C |
| ATOM | 678 | CG | LEU | A | 81 | −21.536 | 7.906 | 30.403 | 1.00 | 26.47 | C |
| ATOM | 679 | CD1 | LEU | A | 81 | −20.539 | 8.412 | 29.371 | 1.00 | 27.84 | C |
| ATOM | 680 | CD2 | LEU | A | 81 | −22.452 | 9.037 | 30.836 | 1.00 | 28.33 | C |
| ATOM | 681 | N | ARG | A | 82 | −23.609 | 3.776 | 29.886 | 1.00 | 25.98 | N |
| ATOM | 682 | CA | ARG | A | 82 | −24.577 | 2.776 | 29.459 | 1.00 | 29.21 | C |
| ATOM | 683 | C | ARG | A | 82 | −25.502 | 2.395 | 30.606 | 1.00 | 33.48 | C |
| ATOM | 684 | O | ARG | A | 82 | −26.713 | 2.263 | 30.416 | 1.00 | 32.01 | O |
| ATOM | 685 | CB | ARG | A | 82 | −23.850 | 1.543 | 28.916 | 1.00 | 34.10 | C |
| ATOM | 686 | CG | ARG | A | 82 | −24.630 | 0.748 | 27.884 | 1.00 | 54.98 | C |
| ATOM | 687 | CD | ARG | A | 82 | −24.435 | −0.754 | 28.061 | 1.00 | 57.32 | C |
| ATOM | 688 | NE | ARG | A | 82 | −23.044 | −1.113 | 28.309 | 1.00 | 61.65 | N |
| ATOM | 689 | CZ | ARG | A | 82 | −22.671 | −2.180 | 29.011 | 1.00 | 69.81 | C |
| ATOM | 690 | NH1 | ARG | A | 82 | −23.594 | −2.978 | 29.533 | 1.00 | 64.03 | N |
| ATOM | 691 | NH2 | ARG | A | 82 | −21.380 | −2.444 | 29.203 | 1.00 | 72.32 | N |
| ATOM | 692 | N | GLY | A | 83 | −24.958 | 2.246 | 31.815 | 1.00 | 29.15 | N |
| ATOM | 693 | CA | GLY | A | 83 | −25.814 | 1.952 | 32.960 | 1.00 | 29.21 | C |
| ATOM | 694 | C | GLY | A | 83 | −26.691 | 3.122 | 33.374 | 1.00 | 30.64 | C |
| ATOM | 695 | O | GLY | A | 83 | −27.881 | 2.938 | 33.657 | 1.00 | 34.44 | O |
| ATOM | 696 | N | TYR | A | 84 | −26.124 | 4.338 | 33.431 | 1.00 | 28.65 | N |
| ATOM | 697 | CA | TYR | A | 84 | −26.916 | 5.519 | 33.790 | 1.00 | 29.22 | C |
| ATOM | 698 | C | TYR | A | 84 | −28.157 | 5.647 | 32.912 | 1.00 | 33.28 | C |
| ATOM | 699 | O | TYR | A | 84 | −29.253 | 5.970 | 33.397 | 1.00 | 32.43 | O |
| ATOM | 700 | CB | TYR | A | 84 | −26.072 | 6.795 | 33.663 | 1.00 | 25.94 | C |
| ATOM | 701 | CG | TYR | A | 84 | −25.001 | 7.048 | 34.726 | 1.00 | 29.71 | C |
| ATOM | 702 | CD1 | TYR | A | 84 | −24.912 | 6.265 | 35.874 | 1.00 | 33.13 | C |
| ATOM | 703 | CD2 | TYR | A | 84 | −24.103 | 8.106 | 34.584 | 1.00 | 27.84 | C |
| ATOM | 704 | CE1 | TYR | A | 84 | −23.933 | 6.515 | 36.849 | 1.00 | 30.14 | C |
| ATOM | 705 | CE2 | TYR | A | 84 | −23.110 | 8.357 | 35.551 | 1.00 | 27.36 | C |
| ATOM | 706 | CZ | TYR | A | 84 | −23.045 | 7.567 | 36.679 | 1.00 | 33.89 | C |
| ATOM | 707 | OH | TYR | A | 84 | −22.077 | 7.832 | 37.625 | 1.00 | 28.88 | O |
| ATOM | 708 | N | TYR | A | 85 | −28.012 | 5.377 | 31.618 | 1.00 | 34.33 | N |
| ATOM | 709 | CA | TYR | A | 85 | −29.079 | 5.578 | 30.652 | 1.00 | 33.48 | C |
| ATOM | 710 | C | TYR | A | 85 | −29.829 | 4.291 | 30.311 | 1.00 | 37.31 | C |
| ATOM | 711 | O | TYR | A | 85 | −30.693 | 4.307 | 29.427 | 1.00 | 35.73 | O |
| ATOM | 712 | CB | TYR | A | 85 | −28.506 | 6.217 | 29.392 | 1.00 | 32.55 | C |
| ATOM | 713 | CG | TYR | A | 85 | −28.034 | 7.637 | 29.571 | 1.00 | 32.65 | C |
| ATOM | 714 | CD1 | TYR | A | 85 | −28.940 | 8.658 | 29.855 | 1.00 | 37.64 | C |
| ATOM | 715 | CD2 | TYR | A | 85 | −26.687 | 7.966 | 29.454 | 1.00 | 28.73 | C |
| ATOM | 716 | CE1 | TYR | A | 85 | −28.524 | 9.965 | 30.015 | 1.00 | 38.04 | C |
| ATOM | 717 | CE2 | TYR | A | 85 | −26.260 | 9.279 | 29.611 | 1.00 | 26.83 | C |
| ATOM | 718 | CZ | TYR | A | 85 | −27.178 | 10.274 | 29.889 | 1.00 | 35.95 | C |
| ATOM | 719 | OH | TYR | A | 85 | −26.761 | 11.575 | 30.037 | 1.00 | 31.39 | O |
| ATOM | 720 | N | ASN | A | 86 | −29.550 | 3.195 | 31.014 | 1.00 | 33.68 | N |
| ATOM | 721 | CA | ASN | A | 86 | −30.238 | 1.911 | 30.814 | 1.00 | 34.76 | C |
| ATOM | 722 | C | ASN | A | 86 | −30.241 | 1.502 | 29.343 | 1.00 | 37.66 | C |
| ATOM | 723 | O | ASN | A | 86 | −31.255 | 1.057 | 28.783 | 1.00 | 37.66 | O |
| ATOM | 724 | CB | ASN | A | 86 | −31.657 | 1.954 | 31.389 | 1.00 | 40.24 | C |
| ATOM | 725 | CG | ASN | A | 86 | −31.657 | 1.971 | 32.907 | 1.00 | 54.82 | C |
| ATOM | 726 | OD1 | ASN | A | 86 | −31.891 | 3.006 | 33.530 | 1.00 | 61.25 | O |
| ATOM | 727 | ND2 | ASN | A | 86 | −31.367 | 0.823 | 33.510 | 1.00 | 65.04 | N |
| ATOM | 728 | N | GLN | A | 87 | −29.074 | 1.645 | 28.718 | 1.00 | 33.34 | N |
| ATOM | 729 | CA | GLN | A | 87 | −28.916 | 1.334 | 27.311 | 1.00 | 34.99 | C |
| ATOM | 730 | C | GLN | A | 87 | −28.401 | −0.087 | 27.140 | 1.00 | 43.53 | C |
| ATOM | 731 | O | GLN | A | 87 | −27.732 | −0.647 | 28.014 | 1.00 | 39.11 | O |
| ATOM | 732 | CB | GLN | A | 87 | −27.982 | 2.330 | 26.634 | 1.00 | 30.19 | C |
| ATOM | 733 | CG | GLN | A | 87 | −28.563 | 3.733 | 26.554 | 1.00 | 32.77 | C |
| ATOM | 734 | CD | GLN | A | 87 | −27.533 | 4.768 | 26.167 | 1.00 | 28.47 | C |
| ATOM | 735 | OE1 | GLN | A | 87 | −26.363 | 4.644 | 26.507 | 1.00 | 30.28 | O |
| ATOM | 736 | NE2 | GLN | A | 87 | −27.963 | 5.785 | 25.434 | 1.00 | 36.55 | N |
| ATOM | 737 | N | SER | A | 88 | −28.742 | −0.671 | 26.001 | 1.00 | 45.34 | N |
| ATOM | 738 | CA | SER | A | 88 | −28.393 | −2.053 | 25.730 | 1.00 | 43.58 | C |
| ATOM | 739 | C | SER | A | 88 | −26.897 | −2.211 | 25.465 | 1.00 | 44.63 | C |
| ATOM | 740 | O | SER | A | 88 | −26.191 | −1.267 | 25.093 | 1.00 | 39.43 | O |
| ATOM | 741 | CB | SER | A | 88 | −29.198 | −2.554 | 24.534 | 1.00 | 38.83 | C |
| ATOM | 742 | OG | SER | A | 88 | −28.460 | −3.502 | 23.795 | 1.00 | 53.10 | O |
| ATOM | 743 | N | GLU | A | 89 | −26.417 | −3.443 | 25.653 | 1.00 | 47.41 | N |
| ATOM | 744 | CA | GLU | A | 89 | −25.050 | −3.799 | 25.295 | 1.00 | 48.14 | C |
| ATOM | 745 | C | GLU | A | 89 | −24.833 | −3.883 | 23.788 | 1.00 | 42.78 | C |
| ATOM | 746 | O | GLU | A | 89 | −23.679 | −3.957 | 23.354 | 1.00 | 46.28 | O |
| ATOM | 747 | CB | GLU | A | 89 | −24.666 | −5.137 | 25.943 | 1.00 | 48.31 | C |

TABLE 8-continued

| | | | | | | | | | | |
|---|---|---|---|---|---|---|---|---|---|---|
| ATOM | 748 | CG | GLU | A | 89 | −24.731 | −5.122 | 27.465 | 1.00 | 55.28 | C |
| ATOM | 749 | CD | GLU | A | 89 | −23.745 | −6.082 | 28.115 | 0.00 | 62.11 | C |
| ATOM | 750 | OE1 | GLU | A | 89 | −24.000 | −7.306 | 28.113 | 1.00 | 68.23 | O |
| ATOM | 751 | OE2 | GLU | A | 89 | −22.709 | −5.607 | 28.626 | 0.54 | 64.47 | O |
| ATOM | 752 | N | ALA | A | 90 | −25.894 | −3.821 | 22.984 | 1.00 | 39.64 | N |
| ATOM | 753 | CA | ALA | A | 90 | −25.775 | −4.116 | 21.557 | 1.00 | 44.69 | C |
| ATOM | 754 | C | ALA | A | 90 | −25.255 | −2.939 | 20.735 | 1.00 | 44.59 | C |
| ATOM | 755 | O | ALA | A | 90 | −24.656 | −3.158 | 19.674 | 1.00 | 48.61 | O |
| ATOM | 756 | CB | ALA | A | 90 | −27.124 | −4.573 | 20.999 | 1.00 | 46.62 | C |
| ATOM | 757 | N | GLY | A | 91 | −25.467 | −1.701 | 21.180 | 1.00 | 41.54 | N |
| ATOM | 758 | CA | GLY | A | 91 | −25.123 | −0.551 | 20.366 | 1.00 | 38.83 | C |
| ATOM | 759 | C | GLY | A | 91 | −23.729 | 0.015 | 20.644 | 1.00 | 37.13 | C |
| ATOM | 760 | O | GLY | A | 91 | −23.191 | −0.195 | 21.727 | 1.00 | 35.28 | O |
| ATOM | 761 | N | SER | A | 92 | −23.145 | 0.644 | 19.645 | 1.00 | 28.68 | N |
| ATOM | 762 | CA | SER | A | 92 | −21.896 | 1.371 | 19.845 | 1.00 | 28.09 | C |
| ATOM | 763 | C | SER | A | 92 | −22.187 | 2.789 | 20.328 | 1.00 | 26.91 | C |
| ATOM | 764 | O | SER | A | 92 | −23.143 | 3.429 | 19.873 | 1.00 | 34.52 | O |
| ATOM | 765 | CB | SER | A | 92 | −21.086 | 1.413 | 18.544 | 1.00 | 29.52 | C |
| ATOM | 766 | OG | SER | A | 92 | −19.985 | 2.290 | 18.649 | 1.00 | 31.97 | O |
| ATOM | 767 | N | HIS | A | 93 | −21.366 | 3.273 | 21.263 | 1.00 | 25.85 | N |
| ATOM | 768 | CA | HIS | A | 93 | −21.526 | 4.606 | 21.827 | 1.00 | 29.58 | C |
| ATOM | 769 | C | HIS | A | 93 | −20.183 | 5.314 | 21.816 | 1.00 | 29.10 | C |
| ATOM | 770 | O | HIS | A | 93 | −19.124 | 4.693 | 21.666 | 1.00 | 28.27 | O |
| ATOM | 771 | CB | HIS | A | 93 | −22.103 | 4.540 | 23.244 | 1.00 | 23.92 | C |
| ATOM | 772 | CG | HIS | A | 93 | −23.467 | 3.930 | 23.284 | 1.00 | 25.09 | C |
| ATOM | 773 | ND1 | HIS | A | 93 | −24.619 | 4.666 | 23.086 | 1.00 | 32.62 | N |
| ATOM | 774 | CD2 | HIS | A | 93 | −23.862 | 2.643 | 23.429 | 1.00 | 29.28 | C |
| ATOM | 775 | CE1 | HIS | A | 93 | −25.667 | 3.863 | 23.146 | 1.00 | 36.93 | C |
| ATOM | 776 | NE2 | HIS | A | 93 | −25.237 | 2.630 | 23.348 | 1.00 | 35.34 | N |
| ATOM | 777 | N | THR | A | 94 | −20.230 | 6.634 | 22.007 | 1.00 | 27.72 | N |
| ATOM | 778 | CA | THR | A | 94 | −19.041 | 7.460 | 21.900 | 1.00 | 28.52 | C |
| ATOM | 779 | C | THR | A | 94 | −18.905 | 8.375 | 23.108 | 1.00 | 24.65 | C |
| ATOM | 780 | O | THR | A | 94 | −19.884 | 8.992 | 23.543 | 1.00 | 29.08 | O |
| ATOM | 781 | CB | THR | A | 94 | −19.099 | 8.331 | 20.624 | 1.00 | 28.74 | C |
| ATOM | 782 | OG1 | THR | A | 94 | −19.326 | 7.499 | 19.484 | 1.00 | 34.73 | O |
| ATOM | 783 | CG2 | THR | A | 94 | −17.781 | 9.104 | 20.437 | 1.00 | 27.80 | C |
| ATOM | 784 | N | VAL | A | 95 | −17.685 | 8.486 | 23.641 | 1.00 | 20.65 | N |
| ATOM | 785 | C | VAL | A | 95 | −16.300 | 10.421 | 24.016 | 1.00 | 25.57 | C |
| ATOM | 786 | O | VAL | A | 95 | −15.342 | 9.952 | 23.398 | 1.00 | 27.52 | O |
| ATOM | 787 | CA | AVAL | A | 95 | −17.376 | 9.524 | 24.612 | 0.36 | 25.76 | C |
| ATOM | 788 | CB | AVAL | A | 95 | −16.946 | 8.956 | 25.983 | 0.36 | 27.85 | C |
| ATOM | 789 | CG1 | AVAL | A | 95 | −18.121 | 8.279 | 26.664 | 0.36 | 30.33 | C |
| ATOM | 790 | CG2 | AVAL | A | 95 | −15.803 | 7.980 | 25.842 | 0.36 | 25.25 | C |
| ATOM | 791 | CA | BVAL | A | 95 | −17.336 | 9.492 | 24.637 | 0.64 | 24.97 | C |
| ATOM | 792 | CB | BVAL | A | 95 | −16.788 | 8.841 | 25.925 | 0.64 | 28.16 | C |
| ATOM | 793 | CG1 | BVAL | A | 95 | −15.953 | 9.833 | 26.737 | 0.64 | 24.84 | C |
| ATOM | 794 | CG2 | BVAL | A | 95 | −17.922 | 8.269 | 26.757 | 0.64 | 30.09 | C |
| ATOM | 795 | N | GLN | A | 96 | −16.488 | 11.732 | 24.163 | 1.00 | 24.28 | N |
| ATOM | 796 | CA | GLN | A | 96 | −15.491 | 12.693 | 23.716 | 1.00 | 23.51 | C |
| ATOM | 797 | C | GLN | A | 96 | −15.158 | 13.622 | 24.868 | 1.00 | 28.05 | C |
| ATOM | 798 | O | GLN | A | 96 | −16.018 | 13.950 | 25.692 | 1.00 | 24.68 | O |
| ATOM | 799 | CB | GLN | A | 96 | −15.970 | 13.537 | 22.532 | 1.00 | 23.96 | C |
| ATOM | 800 | CG | GLN | A | 96 | −16.222 | 12.736 | 21.246 | 1.00 | 28.41 | C |
| ATOM | 801 | CD | GLN | A | 96 | −17.160 | 13.472 | 20.306 | 1.00 | 31.84 | C |
| ATOM | 802 | OE1 | GLN | A | 96 | −18.374 | 13.273 | 20.339 | 1.00 | 31.87 | O |
| ATOM | 803 | NE2 | GLN | A | 96 | −16.598 | 14.338 | 19.467 | 1.00 | 28.54 | N |
| ATOM | 804 | N | ARG | A | 97 | −13.901 | 14.047 | 24.901 | 1.00 | 23.25 | N |
| ATOM | 805 | CA | ARG | A | 97 | −13.391 | 14.938 | 25.933 | 1.00 | 24.34 | C |
| ATOM | 806 | C | ARG | A | 97 | −12.467 | 15.945 | 25.264 | 1.00 | 23.39 | C |
| ATOM | 807 | O | ARG | A | 97 | −11.684 | 15.586 | 24.375 | 1.00 | 23.85 | O |
| ATOM | 808 | CB | ARG | A | 97 | −12.637 | 14.140 | 27.009 | 1.00 | 23.67 | C |
| ATOM | 809 | CG | ARG | A | 97 | −12.181 | 14.922 | 28.228 | 1.00 | 26.43 | C |
| ATOM | 810 | CD | ARG | A | 97 | −11.229 | 14.052 | 29.077 | 1.00 | 27.95 | C |
| ATOM | 811 | NE | ARG | A | 97 | −10.901 | 14.663 | 30.361 | 1.00 | 39.34 | N |
| ATOM | 812 | CZ | ARG | A | 97 | −10.069 | 14.129 | 31.255 | 1.00 | 45.73 | C |
| ATOM | 813 | NH1 | ARG | A | 97 | −9.834 | 14.759 | 32.400 | 1.00 | 45.55 | N |
| ATOM | 814 | NH2 | ARG | A | 97 | −9.480 | 12.963 | 31.008 | 1.00 | 35.77 | N |
| ATOM | 815 | N | MET | A | 98 | −12.566 | 17.207 | 25.682 | 1.00 | 20.65 | N |
| ATOM | 816 | CA | MET | A | 98 | −11.685 | 18.251 | 25.179 | 1.00 | 22.81 | C |
| ATOM | 817 | C | MET | A | 98 | −11.280 | 19.143 | 26.339 | 1.00 | 23.59 | C |
| ATOM | 818 | O | MET | A | 98 | −12.117 | 19.509 | 27.170 | 1.00 | 27.22 | O |
| ATOM | 819 | CB | MET | A | 98 | −12.384 | 19.098 | 24.088 | 1.00 | 26.68 | C |
| ATOM | 820 | CG | MET | A | 98 | −11.487 | 20.118 | 23.395 | 1.00 | 35.39 | C |
| ATOM | 821 | SD | MET | A | 98 | −11.382 | 21.727 | 24.250 | 1.00 | 45.43 | S |
| ATOM | 822 | CE | MET | A | 98 | −13.048 | 21.911 | 24.851 | 1.00 | 41.43 | C |
| ATOM | 823 | N | TYR | A | 99 | −9.999 | 19.488 | 26.406 | 1.00 | 22.09 | N |
| ATOM | 824 | CA | TYR | A | 99 | −9.592 | 20.457 | 27.415 | 1.00 | 20.65 | C |
| ATOM | 825 | C | TYR | A | 99 | −8.391 | 21.237 | 26.907 | 1.00 | 21.63 | C |
| ATOM | 826 | O | TYR | A | 99 | −7.752 | 20.855 | 25.923 | 1.00 | 23.53 | O |
| ATOM | 827 | CB | TYR | A | 99 | −9.303 | 19.791 | 28.778 | 1.00 | 20.80 | C |

TABLE 8-continued

| | | | | | | | | | | |
|---|---|---|---|---|---|---|---|---|---|---|
| ATOM | 828 | CG | TYR | A | 99 | −8.237 | 18.700 | 28.822 | 1.00 | 23.75 | C |
| ATOM | 829 | CD1 | TYR | A | 99 | −6.878 | 19.005 | 28.674 | 1.00 | 21.59 | C |
| ATOM | 830 | CD2 | TYR | A | 99 | −8.583 | 17.380 | 29.095 | 1.00 | 24.87 | C |
| ATOM | 831 | CE1 | TYR | A | 99 | −5.897 | 18.006 | 28.744 | 1.00 | 24.05 | C |
| ATOM | 832 | CE2 | TYR | A | 99 | −7.617 | 16.377 | 29.176 | 1.00 | 23.18 | C |
| ATOM | 833 | CZ | TYR | A | 99 | −6.278 | 16.702 | 29.001 | 1.00 | 24.07 | C |
| ATOM | 834 | OH | TYR | A | 99 | −5.312 | 15.717 | 29.096 | 1.00 | 22.34 | O |
| ATOM | 835 | N | GLY | A | 100 | −8.116 | 22.366 | 27.559 | 1.00 | 24.47 | N |
| ATOM | 836 | CA | GLY | A | 100 | −6.980 | 23.164 | 27.158 | 1.00 | 24.86 | C |
| ATOM | 837 | C | GLY | A | 100 | −7.022 | 24.556 | 27.759 | 1.00 | 23.22 | C |
| ATOM | 838 | O | GLY | A | 100 | −7.821 | 24.846 | 28.649 | 1.00 | 24.20 | O |
| ATOM | 839 | N | CYS | A | 101 | −6.138 | 25.412 | 27.250 | 1.00 | 25.25 | N |
| ATOM | 840 | CA | CYS | A | 101 | −5.989 | 26.758 | 27.794 | 1.00 | 21.27 | C |
| ATOM | 841 | C | CYS | A | 101 | −5.711 | 27.725 | 26.660 | 1.00 | 27.23 | C |
| ATOM | 842 | O | CYS | A | 101 | −5.156 | 27.340 | 25.630 | 1.00 | 27.59 | O |
| ATOM | 843 | CB | CYS | A | 101 | −4.847 | 26.834 | 28.841 | 1.00 | 25.89 | C |
| ATOM | 844 | SG | CYS | A | 101 | −3.251 | 26.050 | 28.310 | 1.00 | 30.24 | S |
| ATOM | 845 | N | ASP | A | 102 | −6.118 | 28.984 | 26.861 | 1.00 | 25.57 | N |
| ATOM | 846 | CA | ASP | A | 102 | −5.814 | 30.098 | 25.971 | 1.00 | 25.53 | C |
| ATOM | 847 | C | ASP | A | 102 | −4.863 | 31.046 | 26.689 | 1.00 | 26.68 | C |
| ATOM | 848 | O | ASP | A | 102 | −4.989 | 31.243 | 27.905 | 1.00 | 25.60 | O |
| ATOM | 849 | CB | ASP | A | 102 | −7.080 | 30.887 | 25.587 | 1.00 | 24.33 | C |
| ATOM | 850 | CG | ASP | A | 102 | −8.126 | 30.051 | 24.851 | 1.00 | 30.48 | C |
| ATOM | 851 | OD1 | ASP | A | 102 | −7.800 | 28.973 | 24.320 | 1.00 | 33.41 | O |
| ATOM | 852 | OD2 | ASP | A | 102 | −9.283 | 30.519 | 24.783 | 1.00 | 33.68 | O |
| ATOM | 853 | N | VAL | A | 103 | −3.914 | 31.637 | 25.948 | 1.00 | 25.63 | N |
| ATOM | 854 | CA | VAL | A | 103 | −3.058 | 32.703 | 26.475 | 1.00 | 27.54 | C |
| ATOM | 855 | C | VAL | A | 103 | −3.105 | 33.907 | 25.538 | 1.00 | 26.18 | C |
| ATOM | 856 | O | VAL | A | 103 | −3.394 | 33.783 | 24.344 | 1.00 | 30.59 | O |
| ATOM | 857 | CB | VAL | A | 103 | −1.596 | 32.241 | 26.683 | 1.00 | 29.80 | C |
| ATOM | 858 | CG1 | VAL | A | 103 | −1.555 | 31.048 | 27.643 | 1.00 | 24.29 | C |
| ATOM | 859 | CG2 | VAL | A | 103 | −0.935 | 31.931 | 25.330 | 1.00 | 28.23 | C |
| ATOM | 860 | N | GLY | A | 104 | −2.841 | 35.088 | 26.091 | 1.00 | 28.05 | N |
| ATOM | 861 | CA | GLY | A | 104 | −2.825 | 36.298 | 25.300 | 1.00 | 29.64 | C |
| ATOM | 862 | C | GLY | A | 104 | −1.494 | 36.503 | 24.600 | 1.00 | 29.18 | C |
| ATOM | 863 | O | GLY | A | 104 | −0.624 | 35.633 | 24.576 | 1.00 | 32.53 | O |
| ATOM | 864 | N | ASER | A | 105 | −1.334 | 37.701 | 24.033 | 0.42 | 33.80 | N |
| ATOM | 865 | CA | ASER | A | 105 | −0.117 | 38.014 | 23.289 | 0.42 | 36.13 | C |
| ATOM | 866 | C | ASER | A | 105 | 1.111 | 38.085 | 24.187 | 0.42 | 37.63 | C |
| ATOM | 867 | O | ASER | A | 105 | 2.238 | 38.030 | 23.680 | 0.42 | 38.31 | O |
| ATOM | 868 | CB | ASER | A | 105 | −0.286 | 39.329 | 22.524 | 0.42 | 36.77 | C |
| ATOM | 869 | OG | ASER | A | 105 | −0.176 | 40.448 | 23.384 | 0.42 | 32.43 | O |
| ATOM | 870 | N | BSER | A | 105 | −1.344 | 37.697 | 24.023 | 0.58 | 33.90 | N |
| ATOM | 871 | CA | BSER | A | 105 | −0.127 | 38.044 | 23.296 | 0.58 | 36.13 | C |
| ATOM | 872 | C | BSER | A | 105 | 1.104 | 38.049 | 24.191 | 0.58 | 37.80 | C |
| ATOM | 873 | O | BSER | A | 105 | 2.225 | 37.916 | 23.686 | 0.58 | 38.52 | O |
| ATOM | 874 | CB | BSER | A | 105 | −0.287 | 39.411 | 22.628 | 0.58 | 37.01 | C |
| ATOM | 875 | OG | BSER | A | 105 | −1.268 | 39.371 | 21.609 | 0.58 | 36.34 | O |
| ATOM | 876 | N | ASP | A | 106 | 0.923 | 38.210 | 25.499 | 1.00 | 34.59 | N |
| ATOM | 877 | CA | ASP | A | 106 | 2.017 | 38.159 | 26.461 | 1.00 | 32.84 | C |
| ATOM | 878 | C | ASP | A | 106 | 2.210 | 36.757 | 27.027 | 1.00 | 30.47 | C |
| ATOM | 879 | O | ASP | A | 106 | 2.998 | 36.579 | 27.961 | 1.00 | 34.12 | O |
| ATOM | 880 | CB | ASP | A | 106 | 1.760 | 39.170 | 27.593 | 1.00 | 31.64 | C |
| ATOM | 881 | CG | ASP | A | 106 | 0.370 | 39.009 | 28.207 | 1.00 | 35.86 | C |
| ATOM | 882 | OD1 | ASP | A | 106 | −0.306 | 38.001 | 27.912 | 1.00 | 33.96 | O |
| ATOM | 883 | OD2 | ASP | A | 106 | −0.050 | 39.898 | 28.971 | 1.00 | 36.93 | O |
| ATOM | 884 | N | TRP | A | 107 | 1.495 | 35.771 | 26.468 | 1.00 | 28.58 | N |
| ATOM | 885 | CA | TRP | A | 107 | 1.459 | 34.361 | 26.872 | 1.00 | 30.10 | C |
| ATOM | 886 | C | TRP | A | 107 | 0.983 | 34.157 | 28.309 | 1.00 | 30.59 | C |
| ATOM | 887 | O | TRP | A | 107 | 1.292 | 33.129 | 28.913 | 1.00 | 30.76 | O |
| ATOM | 888 | CB | TRP | A | 107 | 2.806 | 33.654 | 26.663 | 1.00 | 29.61 | C |
| ATOM | 889 | CG | TRP | A | 107 | 3.309 | 33.672 | 25.242 | 1.00 | 34.51 | C |
| ATOM | 890 | CD1 | TRP | A | 107 | 2.664 | 34.156 | 24.137 | 1.00 | 37.73 | C |
| ATOM | 891 | CD2 | TRP | A | 107 | 4.584 | 33.200 | 24.788 | 1.00 | 30.78 | C |
| ATOM | 892 | NE1 | TRP | A | 107 | 3.471 | 34.022 | 23.027 | 1.00 | 40.01 | N |
| ATOM | 893 | CE2 | TRP | A | 107 | 4.645 | 33.421 | 23.400 | 1.00 | 31.77 | C |
| ATOM | 894 | CE3 | TRP | A | 107 | 5.673 | 32.609 | 25.424 | 1.00 | 28.98 | C |
| ATOM | 895 | CZ2 | TRP | A | 107 | 5.772 | 33.084 | 22.637 | 1.00 | 34.61 | C |
| ATOM | 896 | CZ3 | TRP | A | 107 | 6.792 | 32.267 | 24.663 | 1.00 | 33.93 | C |
| ATOM | 897 | CH2 | TRP | A | 107 | 6.826 | 32.506 | 23.287 | 1.00 | 29.84 | C |
| ATOM | 898 | N | ARG | A | 108 | 0.236 | 35.112 | 28.870 | 1.00 | 31.11 | N |
| ATOM | 899 | CA | ARG | A | 108 | −0.409 | 34.932 | 30.169 | 1.00 | 30.52 | C |
| ATOM | 900 | C | ARG | A | 108 | −1.723 | 34.188 | 29.998 | 1.00 | 31.42 | C |
| ATOM | 901 | O | ARG | A | 108 | −2.434 | 34.389 | 29.014 | 1.00 | 30.18 | O |
| ATOM | 902 | CB | ARG | A | 108 | −0.686 | 36.276 | 30.861 | 1.00 | 29.79 | C |
| ATOM | 903 | CG | ARG | A | 108 | 0.530 | 36.967 | 31.447 | 1.00 | 31.35 | C |
| ATOM | 904 | CD | ARG | A | 108 | 0.083 | 38.187 | 32.275 | 1.00 | 33.61 | C |
| ATOM | 905 | NE | ARG | A | 108 | −0.735 | 39.094 | 31.465 | 1.00 | 49.34 | N |
| ATOM | 906 | CZ | ARG | A | 108 | −1.918 | 39.594 | 31.824 | 1.00 | 43.93 | C |
| ATOM | 907 | NH1 | ARG | A | 108 | −2.567 | 40.397 | 30.989 | 1.00 | 42.56 | N |

TABLE 8-continued

| | | | | | | | | | | |
|---|---|---|---|---|---|---|---|---|---|---|
| ATOM | 908 | NH2 | ARG | A | 108 | −2.450 | 39.311 | 33.008 | 1.00 | 38.40 | N |
| ATOM | 909 | N | PHE | A | 109 | −2.047 | 33.353 | 30.980 | 1.00 | 26.65 | N |
| ATOM | 910 | CA | PHE | A | 109 | −3.333 | 32.665 | 31.033 | 1.00 | 32.55 | C |
| ATOM | 911 | C | PHE | A | 109 | −4.494 | 33.625 | 30.822 | 1.00 | 26.67 | C |
| ATOM | 912 | O | PHE | A | 109 | −4.590 | 34.665 | 31.485 | 1.00 | 29.15 | O |
| ATOM | 913 | CB | PHE | A | 109 | −3.470 | 31.968 | 32.390 | 1.00 | 29.06 | C |
| ATOM | 914 | CG | PHE | A | 109 | −4.819 | 31.369 | 32.635 | 1.00 | 28.91 | C |
| ATOM | 915 | CD1 | PHE | A | 109 | −5.151 | 30.144 | 32.089 | 1.00 | 25.18 | C |
| ATOM | 916 | CD2 | PHE | A | 109 | −5.770 | 32.043 | 33.406 | 1.00 | 28.87 | C |
| ATOM | 917 | CE1 | PHE | A | 109 | −6.399 | 29.586 | 32.302 | 1.00 | 25.77 | C |
| ATOM | 918 | CE2 | PHE | A | 109 | −7.017 | 31.481 | 33.623 | 1.00 | 30.00 | C |
| ATOM | 919 | CZ | PHE | A | 109 | −7.321 | 30.262 | 33.077 | 1.00 | 28.17 | C |
| ATOM | 920 | N | LEU | A | 110 | −5.365 | 33.288 | 29.871 | 1.00 | 27.52 | N |
| ATOM | 921 | CA | LEU | A | 110 | −6.638 | 33.977 | 29.705 | 1.00 | 30.61 | C |
| ATOM | 922 | C | LEU | A | 110 | −7.814 | 33.142 | 30.181 | 1.00 | 31.23 | C |
| ATOM | 923 | O | LEU | A | 110 | −8.703 | 33.660 | 30.866 | 1.00 | 31.83 | O |
| ATOM | 924 | CB | LEU | A | 110 | −6.864 | 34.378 | 28.237 | 1.00 | 30.13 | C |
| ATOM | 925 | CG | LEU | A | 110 | −6.066 | 35.562 | 27.692 | 1.00 | 31.03 | C |
| ATOM | 926 | CD1 | LEU | A | 110 | −6.303 | 35.637 | 26.190 | 1.00 | 28.64 | C |
| ATOM | 927 | CD2 | LEU | A | 110 | −6.485 | 36.873 | 28.381 | 1.00 | 33.44 | C |
| ATOM | 928 | N | ARG | A | 111 | −7.864 | 31.866 | 29.809 | 1.00 | 26.57 | N |
| ATOM | 929 | CA | ARG | A | 111 | −8.972 | 31.040 | 30.259 | 1.00 | 29.33 | C |
| ATOM | 930 | C | ARG | A | 111 | −8.652 | 29.585 | 29.956 | 1.00 | 27.37 | C |
| ATOM | 931 | O | ARG | A | 111 | −7.730 | 29.267 | 29.187 | 1.00 | 27.28 | O |
| ATOM | 932 | CB | ARG | A | 111 | −10.293 | 31.445 | 29.605 | 1.00 | 31.24 | C |
| ATOM | 933 | CG | ARG | A | 111 | −10.375 | 31.098 | 28.170 | 1.00 | 34.29 | C |
| ATOM | 934 | CD | ARG | A | 111 | −11.352 | 31.997 | 27.444 | 1.00 | 46.00 | C |
| ATOM | 935 | NE | ARG | A | 111 | −10.714 | 32.373 | 26.198 | 1.00 | 55.60 | N |
| ATOM | 936 | CZ | ARG | A | 111 | −10.256 | 33.585 | 25.918 | 1.00 | 46.04 | C |
| ATOM | 937 | NH1 | ARG | A | 111 | −10.417 | 34.587 | 26.774 | 1.00 | 52.32 | N |
| ATOM | 938 | NH2 | ARG | A | 111 | −9.655 | 33.791 | 24.761 | 1.00 | 41.30 | N |
| ATOM | 939 | N | GLY | A | 112 | −9.400 | 28.704 | 30.619 | 1.00 | 26.50 | N |
| ATOM | 940 | CA | GLY | A | 112 | −9.274 | 27.276 | 30.411 | 1.00 | 21.57 | C |
| ATOM | 941 | C | GLY | A | 112 | −10.636 | 26.649 | 30.185 | 1.00 | 24.22 | C |
| ATOM | 942 | O | GLY | A | 112 | −11.678 | 27.286 | 30.399 | 1.00 | 27.12 | O |
| ATOM | 943 | N | AGLU | A | 113 | −10.620 | 25.396 | 29.708 | 0.71 | 21.44 | N |
| ATOM | 944 | CA | AGLU | A | 113 | −11.879 | 24.689 | 29.473 | 0.71 | 29.55 | C |
| ATOM | 945 | C | AGLU | A | 113 | −11.680 | 23.189 | 29.628 | 0.71 | 25.44 | C |
| ATOM | 946 | O | AGLU | A | 113 | −10.580 | 22.654 | 29.461 | 0.71 | 22.84 | O |
| ATOM | 947 | CB | AGLU | A | 113 | −12.491 | 24.949 | 28.084 | 0.71 | 33.38 | C |
| ATOM | 948 | CG | AGLU | A | 113 | −12.255 | 26.292 | 27.450 | 0.71 | 41.02 | C |
| ATOM | 949 | CD | AGLU | A | 113 | −10.951 | 26.319 | 26.726 | 0.71 | 39.17 | C |
| ATOM | 950 | OE1 | AGLU | A | 113 | −10.509 | 25.225 | 26.323 | 0.71 | 42.77 | O |
| ATOM | 951 | OE2 | AGLU | A | 113 | −10.367 | 27.412 | 26.561 | 0.71 | 38.93 | O |
| ATOM | 952 | N | BGLU | A | 113 | −10.621 | 25.388 | 29.762 | 0.29 | 24.70 | N |
| ATOM | 953 | CA | BGLU | A | 113 | −11.882 | 24.701 | 29.533 | 0.29 | 28.51 | C |
| ATOM | 954 | C | BGLU | A | 113 | −11.677 | 23.203 | 29.667 | 0.29 | 25.58 | C |
| ATOM | 955 | O | BGLU | A | 113 | −10.565 | 22.690 | 29.528 | 0.29 | 24.55 | O |
| ATOM | 956 | CB | BGLU | A | 113 | −12.471 | 25.036 | 28.160 | 0.29 | 33.82 | C |
| ATOM | 957 | CG | BGLU | A | 113 | −11.721 | 24.411 | 27.007 | 0.29 | 37.57 | C |
| ATOM | 958 | CD | BGLU | A | 113 | −10.544 | 25.238 | 26.578 | 0.29 | 40.55 | C |
| ATOM | 959 | OE1 | BGLU | A | 113 | −10.395 | 26.364 | 27.098 | 0.29 | 41.54 | O |
| ATOM | 960 | OE2 | BGLU | A | 113 | −9.769 | 24.764 | 25.722 | 0.29 | 39.11 | O |
| ATOM | 961 | N | HIS | A | 114 | −12.779 | 22.506 | 29.924 | 1.00 | 24.08 | N |
| ATOM | 962 | CA | HIS | A | 114 | −12.736 | 21.058 | 30.112 | 1.00 | 20.50 | C |
| ATOM | 963 | C | HIS | A | 114 | −14.170 | 20.586 | 29.953 | 1.00 | 24.70 | C |
| ATOM | 964 | O | HIS | A | 114 | −15.031 | 20.970 | 30.754 | 1.00 | 26.41 | O |
| ATOM | 965 | CB | HIS | A | 114 | −12.183 | 20.702 | 31.494 | 1.00 | 21.77 | C |
| ATOM | 966 | CG | HIS | A | 114 | −12.151 | 19.242 | 31.780 | 1.00 | 28.29 | C |
| ATOM | 967 | ND1 | HIS | A | 114 | −13.273 | 18.539 | 32.172 | 1.00 | 31.00 | N |
| ATOM | 968 | CD2 | HIS | A | 114 | −11.137 | 18.343 | 31.740 | 1.00 | 31.46 | C |
| ATOM | 969 | CE1 | HIS | A | 114 | −12.949 | 17.272 | 32.364 | 1.00 | 36.29 | C |
| ATOM | 970 | NE2 | HIS | A | 114 | −11.664 | 17.124 | 32.100 | 1.00 | 31.59 | N |
| ATOM | 971 | N | GLN | A | 115 | −14.438 | 19.807 | 28.910 | 1.00 | 24.23 | N |
| ATOM | 972 | CA | GLN | A | 115 | −15.814 | 19.400 | 28.675 | 1.00 | 25.64 | C |
| ATOM | 973 | C | GLN | A | 115 | −15.861 | 18.000 | 28.103 | 1.00 | 23.82 | C |
| ATOM | 974 | O | GLN | A | 115 | −14.914 | 17.526 | 27.469 | 1.00 | 24.81 | O |
| ATOM | 975 | CB | GLN | A | 115 | −16.542 | 20.353 | 27.749 | 1.00 | 31.76 | C |
| ATOM | 976 | CG | GLN | A | 115 | −15.833 | 20.674 | 26.493 | 1.00 | 41.21 | C |
| ATOM | 977 | CD | GLN | A | 115 | −16.267 | 22.030 | 25.979 | 1.00 | 61.62 | C |
| ATOM | 978 | OE1 | GLN | A | 115 | −16.485 | 22.955 | 26.762 | 1.00 | 64.26 | O |
| ATOM | 979 | NE2 | GLN | A | 115 | −16.410 | 22.152 | 24.666 | 1.00 | 68.39 | N |
| ATOM | 980 | N | AGLU | A | 116 | −17.026 | 17.395 | 28.254 | 0.61 | 24.31 | N |
| ATOM | 981 | CA | AGLU | A | 116 | −17.251 | 15.991 | 27.967 | 0.61 | 23.37 | C |
| ATOM | 982 | C | AGLU | A | 116 | −18.571 | 15.848 | 27.225 | 0.61 | 23.32 | C |
| ATOM | 983 | O | AGLU | A | 116 | −19.536 | 16.552 | 27.532 | 0.61 | 25.78 | O |
| ATOM | 984 | CB | AGLU | A | 116 | −17.298 | 15.206 | 29.266 | 0.61 | 26.25 | C |
| ATOM | 985 | CG | AGLU | A | 116 | −17.106 | 13.730 | 29.099 | 0.61 | 38.73 | C |
| ATOM | 986 | CD | AGLU | A | 116 | −15.853 | 13.264 | 29.783 | 0.61 | 43.95 | C |
| ATOM | 987 | OE1 | AGLU | A | 116 | −15.304 | 14.041 | 30.595 | 0.61 | 50.24 | O |

TABLE 8-continued

| | | | | | | | | | | |
|---|---|---|---|---|---|---|---|---|---|---|
| ATOM | 988 | OE2 | AGLU | A | 116 | −15.418 | 12.127 | 29.519 | 0.61 | 47.36 | O |
| ATOM | 989 | N | BGLU | A | 116 | −16.979 | 17.327 | 28.364 | 0.39 | 24.66 | N |
| ATOM | 990 | CA | BGLU | A | 116 | −17.206 | 15.949 | 27.949 | 0.39 | 23.26 | C |
| ATOM | 991 | C | BGLU | A | 116 | −18.540 | 15.855 | 27.219 | 0.39 | 23.48 | C |
| ATOM | 992 | O | BGLU | A | 116 | −19.481 | 16.588 | 27.529 | 0.39 | 24.45 | O |
| ATOM | 993 | CB | BGLU | A | 116 | −17.219 | 14.988 | 29.151 | 0.39 | 29.28 | C |
| ATOM | 994 | CG | BGLU | A | 116 | −15.940 | 14.957 | 29.967 | 0.39 | 39.00 | C |
| ATOM | 995 | CD | BGLU | A | 116 | −15.418 | 13.545 | 30.167 | 0.39 | 45.89 | C |
| ATOM | 996 | OE1 | BGLU | A | 116 | −15.825 | 12.655 | 29.392 | 0.39 | 44.55 | O |
| ATOM | 997 | OE2 | BGLU | A | 116 | −14.603 | 13.325 | 31.095 | 0.39 | 47.31 | O |
| ATOM | 998 | N | ALA | A | 117 | −18.613 | 14.941 | 26.251 | 1.00 | 21.26 | N |
| ATOM | 999 | CA | ALA | A | 117 | −19.837 | 14.669 | 25.509 | 1.00 | 25.59 | C |
| ATOM | 1000 | C | ALA | A | 117 | −20.057 | 13.167 | 25.419 | 1.00 | 28.09 | C |
| ATOM | 1001 | O | ALA | A | 117 | −19.101 | 12.384 | 25.353 | 1.00 | 28.07 | O |
| ATOM | 1002 | CB | ALA | A | 117 | −19.802 | 15.264 | 24.084 | 1.00 | 27.10 | C |
| ATOM | 1003 | N | TYR | A | 118 | −21.326 | 12.768 | 25.406 | 1.00 | 26.55 | N |
| ATOM | 1004 | CA | TYR | A | 118 | −21.707 | 11.372 | 25.223 | 1.00 | 27.29 | C |
| ATOM | 1005 | C | TYR | A | 118 | −22.620 | 11.296 | 24.014 | 1.00 | 29.68 | C |
| ATOM | 1006 | O | TYR | A | 118 | −23.626 | 12.018 | 23.949 | 1.00 | 28.17 | O |
| ATOM | 1007 | CB | TYR | A | 118 | −22.413 | 10.812 | 26.467 | 1.00 | 29.66 | C |
| ATOM | 1008 | CG | TYR | A | 118 | −22.822 | 9.346 | 26.377 | 1.00 | 23.18 | C |
| ATOM | 1009 | CD1 | TYR | A | 118 | −21.872 | 8.358 | 26.158 | 1.00 | 23.52 | C |
| ATOM | 1010 | CD2 | TYR | A | 118 | −24.145 | 8.951 | 26.558 | 1.00 | 28.12 | C |
| ATOM | 1011 | CE1 | TYR | A | 118 | −22.214 | 7.013 | 26.101 | 1.00 | 22.78 | C |
| ATOM | 1012 | CE2 | TYR | A | 118 | −24.508 | 7.591 | 26.491 | 1.00 | 25.31 | C |
| ATOM | 1013 | CZ | TYR | A | 118 | −23.529 | 6.636 | 26.272 | 1.00 | 27.93 | C |
| ATOM | 1014 | OH | TYR | A | 118 | −23.850 | 5.307 | 26.212 | 1.00 | 29.09 | O |
| ATOM | 1015 | N | ASP | A | 119 | −22.277 | 10.410 | 23.071 | 1.00 | 26.06 | N |
| ATOM | 1016 | CA | ASP | A | 119 | −22.996 | 10.265 | 21.799 | 1.00 | 25.27 | C |
| ATOM | 1017 | C | ASP | A | 119 | −23.231 | 11.614 | 21.123 | 1.00 | 27.01 | C |
| ATOM | 1018 | O | ASP | A | 119 | −24.310 | 11.892 | 20.596 | 1.00 | 29.74 | O |
| ATOM | 1019 | CB | ASP | A | 119 | −24.313 | 9.493 | 21.982 | 1.00 | 32.06 | C |
| ATOM | 1020 | CG | ASP | A | 119 | −24.081 | 8.005 | 22.262 | 1.00 | 36.38 | C |
| ATOM | 1021 | OD1 | ASP | A | 119 | −23.020 | 7.464 | 21.866 | 1.00 | 30.44 | O |
| ATOM | 1022 | OD2 | ASP | A | 119 | −24.964 | 7.368 | 22.868 | 1.00 | 32.30 | O |
| ATOM | 1023 | N | GLY | A | 120 | −22.204 | 12.463 | 21.147 | 1.00 | 29.87 | N |
| ATOM | 1024 | CA | GLY | A | 120 | −22.231 | 13.723 | 20.423 | 1.00 | 32.31 | C |
| ATOM | 1025 | C | GLY | A | 120 | −22.974 | 14.854 | 21.089 | 1.00 | 32.94 | C |
| ATOM | 1026 | O | GLY | A | 120 | −23.093 | 15.933 | 20.487 | 1.00 | 32.85 | O |
| ATOM | 1027 | N | LYS | A | 121 | −23.457 | 14.660 | 22.313 | 1.00 | 31.38 | N |
| ATOM | 1028 | CA | LYS | A | 121 | −24.205 | 15.678 | 23.040 | 1.00 | 32.98 | C |
| ATOM | 1029 | C | LYS | A | 121 | −23.460 | 16.070 | 24.309 | 1.00 | 31.20 | C |
| ATOM | 1030 | O | LYS | A | 121 | −22.896 | 15.210 | 24.993 | 1.00 | 31.19 | O |
| ATOM | 1031 | CB | LYS | A | 121 | −25.611 | 15.165 | 23.397 | 1.00 | 38.55 | C |
| ATOM | 1032 | CG | LYS | A | 121 | −26.504 | 16.214 | 24.036 | 1.00 | 46.87 | C |
| ATOM | 1033 | CD | LYS | A | 121 | −27.872 | 15.641 | 24.387 | 1.00 | 51.32 | C |
| ATOM | 1034 | CE | LYS | A | 121 | −28.716 | 16.655 | 25.164 | 1.00 | 51.35 | C |
| ATOM | 1035 | NZ | LYS | A | 121 | −28.995 | 17.898 | 24.380 | 1.00 | 54.79 | N |
| ATOM | 1036 | N | ASP | A | 122 | −23.460 | 17.370 | 24.628 | 1.00 | 29.50 | N |
| ATOM | 1037 | CA | ASP | A | 122 | −22.832 | 17.834 | 25.869 | 1.00 | 28.68 | C |
| ATOM | 1038 | C | ASP | A | 122 | −23.308 | 16.995 | 27.046 | 1.00 | 30.10 | C |
| ATOM | 1039 | O | ASP | A | 122 | −24.506 | 16.762 | 27.207 | 1.00 | 31.65 | O |
| ATOM | 1040 | CB | ASP | A | 122 | −23.171 | 19.310 | 26.133 | 1.00 | 31.03 | C |
| ATOM | 1041 | CG | ASP | A | 122 | −22.454 | 20.269 | 25.196 | 1.00 | 41.80 | C |
| ATOM | 1042 | OD1 | ASP | A | 122 | −21.217 | 20.193 | 25.067 | 1.00 | 44.35 | O |
| ATOM | 1043 | OD2 | ASP | A | 122 | −23.137 | 21.124 | 24.604 | 1.00 | 48.85 | O |
| ATOM | 1044 | N | TYR | A | 123 | −22.368 | 16.519 | 27.857 | 1.00 | 28.31 | N |
| ATOM | 1045 | CA | TYR | A | 123 | −22.702 | 15.745 | 29.047 | 1.00 | 25.28 | C |
| ATOM | 1046 | CA | TYR | A | 123 | −22.399 | 16.520 | 30.323 | 1.00 | 29.23 | C |
| ATOM | 1047 | O | TYR | A | 123 | −23.285 | 16.720 | 31.158 | 1.00 | 29.56 | O |
| ATOM | 1048 | CB | TYR | A | 123 | −21.953 | 14.387 | 29.041 | 1.00 | 25.53 | C |
| ATOM | 1049 | CG | TYR | A | 123 | −22.267 | 13.552 | 30.263 | 1.00 | 22.82 | C |
| ATOM | 1050 | CD1 | TYR | A | 123 | −23.491 | 12.910 | 30.393 | 1.00 | 25.54 | C |
| ATOM | 1051 | CD2 | TYR | A | 123 | −21.343 | 13.424 | 31.302 | 1.00 | 25.44 | C |
| ATOM | 1052 | CE1 | TYR | A | 123 | −23.790 | 12.170 | 31.517 | 1.00 | 25.17 | C |
| ATOM | 1053 | CE2 | TYR | A | 123 | −21.632 | 12.676 | 32.427 | 1.00 | 26.16 | C |
| ATOM | 1054 | CZ | TYR | A | 123 | −22.867 | 12.058 | 32.532 | 1.00 | 25.25 | C |
| ATOM | 1055 | OH | TYR | A | 123 | −23.150 | 11.302 | 33.648 | 1.00 | 29.05 | O |
| ATOM | 1056 | N | ILE | A | 124 | −21.158 | 16.964 | 30.505 | 1.00 | 24.19 | N |
| ATOM | 1057 | CA | ILE | A | 124 | −20.775 | 17.746 | 31.676 | 1.00 | 23.19 | C |
| ATOM | 1058 | C | ILE | A | 124 | −19.584 | 18.609 | 31.283 | 1.00 | 24.20 | C |
| ATOM | 1059 | O | ILE | A | 124 | −18.768 | 18.226 | 30.440 | 1.00 | 26.96 | O |
| ATOM | 1060 | CB | ILE | A | 124 | −20.461 | 16.859 | 32.912 | 1.00 | 24.28 | C |
| ATOM | 1061 | CG1 | ILE | A | 124 | −20.463 | 17.705 | 34.196 | 1.00 | 30.96 | C |
| ATOM | 1062 | CG2 | ILE | A | 124 | −19.081 | 16.090 | 32.774 | 1.00 | 19.80 | C |
| ATOM | 1063 | CD1 | ILE | A | 124 | −20.395 | 16.862 | 35.472 | 1.00 | 29.06 | C |
| ATOM | 1064 | N | ALA | A | 125 | −19.501 | 19.798 | 31.877 | 1.00 | 24.22 | N |
| ATOM | 1065 | CA | ALA | A | 125 | −18.386 | 20.687 | 31.574 | 1.00 | 25.75 | C |
| ATOM | 1066 | C | ALA | A | 125 | −18.074 | 21.568 | 32.768 | 1.00 | 27.52 | C |
| ATOM | 1067 | O | ALA | A | 125 | −18.956 | 21.904 | 33.559 | 1.00 | 24.66 | O |

TABLE 8-continued

| | | | | | | | | | | |
|---|---|---|---|---|---|---|---|---|---|---|
| ATOM | 1068 | CB | ALA | A | 125 | −18.669 | 21.585 | 30.364 | 1.00 | 25.97 | C |
| ATOM | 1069 | N | LEU | A | 126 | −16.807 | 21.957 | 32.873 | 1.00 | 25.77 | N |
| ATOM | 1070 | CA | LEU | A | 126 | −16.438 | 23.015 | 33.801 | 1.00 | 25.41 | C |
| ATOM | 1071 | C | LEU | A | 126 | −17.008 | 24.344 | 33.328 | 1.00 | 24.85 | C |
| ATOM | 1072 | O | LEU | A | 126 | −17.010 | 24.643 | 32.128 | 1.00 | 28.77 | O |
| ATOM | 1073 | CB | LEU | A | 126 | −14.920 | 23.141 | 33.889 | 1.00 | 34.98 | C |
| ATOM | 1074 | CG | LEU | A | 126 | −14.109 | 22.428 | 34.948 | 1.00 | 35.94 | C |
| ATOM | 1075 | CD1 | LEU | A | 126 | −12.692 | 22.945 | 34.814 | 1.00 | 25.24 | C |
| ATOM | 1076 | CD2 | LEU | A | 126 | −14.660 | 22.675 | 36.339 | 1.00 | 26.58 | C |
| ATOM | 1077 | N | LYS | A | 127 | −17.497 | 25.144 | 34.270 | 1.00 | 28.88 | N |
| ATOM | 1078 | CA | LYS | A | 127 | −17.910 | 26.500 | 33.930 | 1.00 | 31.04 | C |
| ATOM | 1079 | C | LYS | A | 127 | −16.689 | 27.389 | 33.709 | 1.00 | 34.89 | C |
| ATOM | 1080 | O | LYS | A | 127 | −15.543 | 26.995 | 33.947 | 1.00 | 32.90 | O |
| ATOM | 1081 | CB | LYS | A | 127 | −18.791 | 27.107 | 35.025 | 1.00 | 33.32 | C |
| ATOM | 1082 | CG | LYS | A | 127 | −20.136 | 26.430 | 35.199 | 1.00 | 38.82 | C |
| ATOM | 1083 | CD | LYS | A | 127 | −21.052 | 27.267 | 36.080 | 1.00 | 54.69 | C |
| ATOM | 1084 | CE | LYS | A | 127 | −22.049 | 26.403 | 36.833 | 1.00 | 62.05 | C |
| ATOM | 1085 | NZ | LYS | A | 127 | −23.361 | 26.333 | 36.149 | 1.00 | 68.48 | N |
| ATOM | 1086 | N | GLU | A | 128 | −16.962 | 28.624 | 33.269 | 1.00 | 33.94 | N |
| ATOM | 1087 | CA | GLU | A | 128 | −15.899 | 29.539 | 32.856 | 1.00 | 37.80 | C |
| ATOM | 1088 | C | GLU | A | 128 | −14.922 | 29.835 | 33.987 | 1.00 | 32.72 | C |
| ATOM | 1089 | O | GLU | A | 128 | −13.723 | 30.013 | 33.740 | 1.00 | 36.38 | O |
| ATOM | 1090 | CB | GLU | A | 128 | −16.511 | 30.839 | 32.332 | 1.00 | 48.82 | C |
| ATOM | 1091 | CG | GLU | A | 128 | −15.494 | 31.908 | 31.965 | 1.00 | 59.47 | C |
| ATOM | 1092 | CD | GLU | A | 128 | −15.277 | 32.029 | 30.471 | 0.00 | 70.00 | C |
| ATOM | 1093 | OE1 | GLU | A | 128 | −16.093 | 32.701 | 29.804 | 1.00 | 75.54 | O |
| ATOM | 1094 | OE2 | GLU | A | 128 | −14.291 | 31.454 | 29.963 | 1.00 | 75.13 | O |
| ATOM | 1095 | N | ASP | A | 129 | −15.400 | 29.882 | 35.229 | 1.00 | 32.00 | N |
| ATOM | 1096 | CA | ASP | A | 129 | −14.510 | 30.191 | 36.337 | 1.00 | 34.58 | C |
| ATOM | 1097 | C | ASP | A | 129 | −13.748 | 28.973 | 36.840 | 1.00 | 29.40 | C |
| ATOM | 1098 | O | ASP | A | 129 | −12.959 | 29.102 | 37.788 | 1.00 | 30.59 | O |
| ATOM | 1099 | CB | ASP | A | 129 | −15.302 | 30.845 | 37.478 | 1.00 | 35.97 | C |
| ATOM | 1100 | CG | ASP | A | 129 | −16.166 | 29.861 | 38.261 | 1.00 | 48.01 | C |
| ATOM | 1101 | OD1 | ASP | A | 129 | −16.357 | 28.692 | 37.854 | 1.00 | 46.55 | O |
| ATOM | 1102 | OD2 | ASP | A | 129 | −16.683 | 30.280 | 39.316 | 1.00 | 59.48 | O |
| ATOM | 1103 | N | LEU | A | 130 | −13.964 | 27.806 | 36.226 | 1.00 | 31.50 | N |
| ATOM | 1104 | CA | LEU | A | 130 | −13.256 | 26.562 | 36.536 | 1.00 | 35.16 | C |
| ATOM | 1105 | C | LEU | A | 130 | −13.453 | 26.114 | 37.983 | 1.00 | 33.18 | C |
| ATOM | 1106 | O | LEU | A | 130 | −12.631 | 25.368 | 38.521 | 1.00 | 29.25 | O |
| ATOM | 1107 | CB | LEU | A | 130 | −11.762 | 26.675 | 36.213 | 1.00 | 33.35 | C |
| ATOM | 1108 | CG | LEU | A | 130 | −11.439 | 27.240 | 34.825 | 1.00 | 34.95 | C |
| ATOM | 1109 | CD1 | LEU | A | 130 | −9.930 | 27.333 | 34.617 | 1.00 | 33.97 | C |
| ATOM | 1110 | CD2 | LEU | A | 130 | −12.070 | 26.410 | 33.733 | 1.00 | 30.94 | C |
| ATOM | 1111 | N | ARG | A | 131 | −14.537 | 26.547 | 38.631 | 1.00 | 30.11 | N |
| ATOM | 1112 | CA | ARG | A | 131 | −14.792 | 26.166 | 40.012 | 1.00 | 27.58 | C |
| ATOM | 1113 | C | ARG | A | 131 | −16.069 | 25.358 | 40.194 | 1.00 | 32.63 | C |
| ATOM | 1114 | O | ARG | A | 131 | −16.362 | 24.939 | 41.320 | 1.00 | 33.92 | O |
| ATOM | 1115 | CB | ARG | A | 131 | −14.847 | 27.418 | 40.899 | 1.00 | 25.92 | C |
| ATOM | 1116 | CG | ARG | A | 131 | −13.461 | 28.013 | 41.067 | 1.00 | 28.56 | C |
| ATOM | 1117 | CD | ARG | A | 131 | −13.402 | 29.316 | 41.836 | 1.00 | 32.62 | C |
| ATOM | 1118 | NE | ARG | A | 131 | −12.001 | 29.687 | 41.818 | 1.00 | 43.70 | N |
| ATOM | 1119 | CZ | ARG | A | 131 | −11.112 | 29.296 | 42.722 | 1.00 | 40.56 | C |
| ATOM | 1120 | NH1 | ARG | A | 131 | −11.496 | 28.565 | 43.765 | 1.00 | 33.68 | N |
| ATOM | 1121 | NH2 | ARG | A | 131 | −9.844 | 29.664 | 42.583 | 1.00 | 39.16 | N |
| ATOM | 1122 | N | SER | A | 132 | −16.831 | 25.127 | 39.137 | 1.00 | 30.05 | N |
| ATOM | 1123 | CA | SER | A | 132 | −18.073 | 24.377 | 39.272 | 1.00 | 31.22 | C |
| ATOM | 1124 | C | SER | A | 132 | −18.437 | 23.790 | 37.919 | 1.00 | 31.12 | C |
| ATOM | 1125 | O | SER | A | 132 | −17.802 | 24.081 | 36.904 | 1.00 | 26.48 | O |
| ATOM | 1126 | CB | SER | A | 132 | −19.184 | 25.267 | 39.820 | 1.00 | 34.64 | C |
| ATOM | 1127 | OG | SER | A | 132 | −19.399 | 26.356 | 38.942 | 1.00 | 38.48 | O |
| ATOM | 1128 | N | TRP | A | 133 | −19.490 | 22.971 | 37.914 | 1.00 | 27.98 | N |
| ATOM | 1129 | CA | TRP | A | 133 | −19.823 | 22.099 | 36.796 | 1.00 | 27.20 | C |
| ATOM | 1130 | C | TRP | A | 133 | −21.203 | 22.443 | 36.262 | 1.00 | 28.88 | C |
| ATOM | 1131 | O | TRP | A | 133 | −22.095 | 22.805 | 37.031 | 1.00 | 28.39 | O |
| ATOM | 1132 | CB | TRP | A | 133 | −19.802 | 20.614 | 37.230 | 1.00 | 26.28 | C |
| ATOM | 1133 | CG | TRP | A | 133 | −18.454 | 20.161 | 37.716 | 1.00 | 26.26 | C |
| ATOM | 1134 | CD1 | TRP | A | 133 | −18.021 | 20.110 | 39.011 | 1.00 | 28.69 | C |
| ATOM | 1135 | CD2 | TRP | A | 133 | −17.355 | 19.739 | 36.906 | 1.00 | 24.34 | C |
| ATOM | 1136 | NE1 | TRP | A | 133 | −16.716 | 19.685 | 39.055 | 1.00 | 27.14 | N |
| ATOM | 1137 | CE2 | TRP | A | 133 | −16.277 | 19.461 | 37.778 | 1.00 | 23.49 | C |
| ATOM | 1138 | CE3 | TRP | A | 133 | −17.168 | 19.583 | 35.529 | 1.00 | 25.55 | C |
| ATOM | 1139 | CZ2 | TRP | A | 133 | −15.037 | 18.997 | 37.317 | 1.00 | 23.78 | C |
| ATOM | 1140 | CZ3 | TRP | A | 133 | −15.922 | 19.134 | 35.067 | 1.00 | 24.65 | C |
| ATOM | 1141 | CH2 | TRP | A | 133 | −14.881 | 18.837 | 35.965 | 1.00 | 28.02 | C |
| ATOM | 1142 | N | THR | A | 134 | −21.376 | 22.323 | 34.945 | 1.00 | 25.17 | N |
| ATOM | 1143 | CA | THR | A | 134 | −22.697 | 22.371 | 34.324 | 1.00 | 31.58 | C |
| ATOM | 1144 | C | THR | A | 134 | −23.115 | 20.956 | 33.964 | 1.00 | 34.94 | C |
| ATOM | 1145 | O | THR | A | 134 | −22.409 | 20.282 | 33.194 | 1.00 | 33.70 | O |
| ATOM | 1146 | CB | THR | A | 134 | −22.726 | 23.241 | 33.066 | 1.00 | 44.70 | C |
| ATOM | 1147 | OG1 | THR | A | 134 | −21.787 | 22.741 | 32.112 | 1.00 | 63.68 | O |

TABLE 8-continued

| | | | | | | | | | | |
|---|---|---|---|---|---|---|---|---|---|---|
| ATOM | 1148 | CG2 | THR | A | 134 | −22.391 | 24.657 | 33.389 | 1.00 | 37.05 | C |
| ATOM | 1149 | N | ALA | A | 135 | −24.286 | 20.548 | 34.479 | 1.00 | 33.20 | N |
| ATOM | 1150 | CA | ALA | A | 135 | −24.855 | 19.203 | 34.355 | 1.00 | 33.87 | C |
| ATOM | 1151 | C | ALA | A | 135 | −26.348 | 19.322 | 34.045 | 1.00 | 36.83 | C |
| ATOM | 1152 | O | ALA | A | 135 | −27.140 | 19.720 | 34.906 | 1.00 | 45.12 | O |
| ATOM | 1153 | CB | ALA | A | 135 | −24.646 | 18.396 | 35.636 | 1.00 | 39.47 | C |
| ATOM | 1154 | N | ALA | A | 136 | −26.732 | 18.911 | 32.842 | 1.00 | 35.86 | N |
| ATOM | 1155 | CA | ALA | A | 136 | −28.057 | 19.178 | 32.294 | 1.00 | 40.57 | C |
| ATOM | 1156 | C | ALA | A | 136 | −29.065 | 18.045 | 32.467 | 1.00 | 37.01 | C |
| ATOM | 1157 | O | ALA | A | 136 | −30.246 | 18.257 | 32.168 | 1.00 | 41.13 | O |
| ATOM | 1158 | CB | ALA | A | 136 | −27.937 | 19.511 | 30.802 | 1.00 | 47.41 | C |
| ATOM | 1159 | N | ASP | A | 137 | −28.662 | 16.848 | 32.901 | 1.00 | 31.97 | N |
| ATOM | 1160 | CA | ASP | A | 137 | −29.645 | 15.792 | 33.127 | 1.00 | 33.08 | C |
| ATOM | 1161 | C | ASP | A | 137 | −29.285 | 15.038 | 34.402 | 1.00 | 31.93 | C |
| ATOM | 1162 | O | ASP | A | 137 | −28.317 | 15.378 | 35.091 | 1.00 | 33.10 | O |
| ATOM | 1163 | CB | ASP | A | 137 | −29.783 | 14.885 | 31.890 | 1.00 | 34.04 | C |
| ATOM | 1164 | CG | ASP | A | 137 | −28.563 | 13.993 | 31.633 | 1.00 | 36.13 | C |
| ATOM | 1165 | OD1 | ASP | A | 137 | −27.563 | 14.044 | 32.386 | 1.00 | 35.72 | O |
| ATOM | 1166 | OD2 | ASP | A | 137 | −28.623 | 13.224 | 30.643 | 1.00 | 34.00 | O |
| ATOM | 1167 | N | MET | A | 138 | −30.097 | 14.027 | 34.737 | 1.00 | 32.35 | N |
| ATOM | 1168 | CA | MET | A | 138 | −29.902 | 13.305 | 35.994 | 1.00 | 33.73 | C |
| ATOM | 1169 | C | MET | A | 138 | −28.567 | 12.568 | 36.022 | 1.00 | 34.13 | C |
| ATOM | 1170 | O | MET | A | 138 | −27.884 | 12.543 | 37.057 | 1.00 | 29.67 | O |
| ATOM | 1171 | CB | MET | A | 138 | −31.049 | 12.321 | 36.228 | 1.00 | 40.38 | C |
| ATOM | 1172 | CG | MET | A | 138 | −32.293 | 12.932 | 36.839 | 1.00 | 46.36 | C |
| ATOM | 1173 | SD | MET | A | 138 | −33.641 | 11.717 | 36.868 | 1.00 | 52.58 | S |
| ATOM | 1174 | CE | MET | A | 138 | −32.866 | 10.346 | 37.718 | 1.00 | 56.73 | C |
| ATOM | 1175 | N | ALA | A | 139 | −28.180 | 11.945 | 34.908 | 1.00 | 26.75 | N |
| ATOM | 1176 | CA | ALA | A | 139 | −26.895 | 11.252 | 34.891 | 1.00 | 30.71 | C |
| ATOM | 1177 | C | ALA | A | 139 | −25.765 | 12.226 | 35.163 | 1.00 | 30.80 | C |
| ATOM | 1178 | O | ALA | A | 139 | −24.902 | 11.968 | 36.002 | 1.00 | 31.11 | O |
| ATOM | 1179 | CB | ALA | A | 139 | −26.675 | 10.530 | 33.559 | 1.00 | 28.35 | C |
| ATOM | 1180 | N | ALA | A | 140 | −25.776 | 13.376 | 34.487 | 1.00 | 28.06 | N |
| ATOM | 1181 | CA | ALA | A | 140 | −24.704 | 14.343 | 34.693 | 1.00 | 29.32 | C |
| ATOM | 1182 | C | ALA | A | 140 | 24.729 | 14.903 | 36.114 | 1.00 | 31.59 | C |
| ATOM | 1183 | O | ALA | A | 140 | −23.670 | 15.240 | 36.666 | 1.00 | 29.99 | O |
| ATOM | 1184 | CB | ALA | A | 140 | −24.806 | 15.467 | 33.656 | 1.00 | 29.05 | C |
| ATOM | 1185 | N | GLN | A | 141 | −25.915 | 14.991 | 36.731 | 1.00 | 26.86 | N |
| ATOM | 1186 | CA | GLN | A | 141 | −25.989 | 15.414 | 38.131 | 1.00 | 29.23 | C |
| ATOM | 1187 | C | GLN | A | 141 | −25.295 | 14.409 | 39.044 | 1.00 | 30.86 | C |
| ATOM | 1188 | O | GLN | A | 141 | −24.631 | 14.799 | 40.014 | 1.00 | 30.04 | O |
| ATOM | 1189 | CB | GLN | A | 141 | −27.452 | 15.622 | 38.556 | 1.00 | 30.15 | C |
| ATOM | 1190 | CG | GLN | A | 141 | −28.030 | 16.923 | 38.061 | 1.00 | 45.90 | C |
| ATOM | 1191 | CD | GLN | A | 141 | −27.392 | 18.125 | 38.731 | 1.00 | 66.70 | C |
| ATOM | 1192 | OE1 | GLN | A | 141 | −26.951 | 18.050 | 39.881 | 1.00 | 69.59 | O |
| ATOM | 1193 | NE2 | GLN | A | 141 | −27.336 | 19.242 | 38.014 | 1.00 | 79.38 | N |
| ATOM | 1194 | N | THR | A | 142 | −25.416 | 13.113 | 38.735 | 1.00 | 26.30 | N |
| ATOM | 1195 | CA | THR | A | 142 | −24.735 | 12.085 | 39.511 | 1.00 | 28.78 | C |
| ATOM | 1196 | C | THR | A | 142 | −23.222 | 12.242 | 39.403 | 1.00 | 28.22 | C |
| ATOM | 1197 | O | THR | A | 142 | −22.496 | 12.205 | 40.411 | 1.00 | 25.37 | O |
| ATOM | 1198 | CB | THR | A | 142 | −25.167 | 10.703 | 39.020 | 1.00 | 28.98 | C |
| ATOM | 1199 | OG1 | THR | A | 142 | −26.573 | 10.519 | 39.269 | 1.00 | 33.77 | O |
| ATOM | 1200 | CG2 | THR | A | 142 | −24.361 | 9.598 | 39.721 | 1.00 | 29.66 | C |
| ATOM | 1201 | N | THR | A | 143 | −22.736 | 12.415 | 38.176 | 1.00 | 25.51 | N |
| ATOM | 1202 | CA | THR | A | 143 | −21.324 | 12.718 | 37.955 | 1.00 | 25.21 | C |
| ATOM | 1203 | C | THR | A | 143 | −20.904 | 13.986 | 38.695 | 1.00 | 25.32 | C |
| ATOM | 1204 | O | THR | A | 143 | −19.842 | 14.025 | 39.332 | 1.00 | 29.26 | O |
| ATOM | 1205 | CB | THR | A | 143 | −21.053 | 12.881 | 36.460 | 1.00 | 25.42 | C |
| ATOM | 1206 | OG1 | THR | A | 143 | −21.425 | 11.680 | 35.775 | 1.00 | 26.12 | O |
| ATOM | 1207 | CG2 | THR | A | 143 | −19.536 | 13.176 | 36.238 | 1.00 | 25.00 | C |
| ATOM | 1208 | N | LYS | A | 144 | −21.719 | 15.043 | 38.599 | 1.00 | 25.06 | N |
| ATOM | 1209 | CA | LYS | A | 144 | −21.379 | 16.309 | 39.250 | 1.00 | 25.53 | C |
| ATOM | 1210 | C | LYS | A | 144 | −21.159 | 16.115 | 40.746 | 1.00 | 30.01 | C |
| ATOM | 1211 | O | LYS | A | 144 | −20.166 | 16.596 | 41.305 | 1.00 | 28.38 | O |
| ATOM | 1212 | CB | LYS | A | 144 | −22.475 | 17.353 | 39.001 | 1.00 | 25.38 | C |
| ATOM | 1213 | CG | LYS | A | 144 | −22.157 | 18.732 | 39.586 | 1.00 | 24.34 | C |
| ATOM | 1214 | CD | LYS | A | 144 | −23.275 | 19.727 | 39.161 | 1.00 | 30.65 | C |
| ATOM | 1215 | CE | LYS | A | 144 | −23.074 | 21.111 | 39.724 | 1.00 | 45.85 | C |
| ATOM | 1216 | NZ | LYS | A | 144 | −23.286 | 21.115 | 41.189 | 1.00 | 55.46 | N |
| ATOM | 1217 | N | HIS | A | 145 | −22.067 | 15.394 | 41.411 | 1.00 | 29.93 | N |
| ATOM | 1218 | CA | HIS | A | 145 | −21.920 | 15.180 | 42.849 | 1.00 | 31.93 | C |
| ATOM | 1219 | C | HIS | A | 145 | −20.656 | 14.396 | 43.163 | 1.00 | 29.39 | C |
| ATOM | 1220 | O | HIS | A | 145 | −19.972 | 14.687 | 44.150 | 1.00 | 31.57 | O |
| ATOM | 1221 | CB | HIS | A | 145 | 23.141 | 14.449 | 43.407 | 1.00 | 34.65 | C |
| ATOM | 1222 | CG | HIS | A | 145 | −24.400 | 15.253 | 43.343 | 1.00 | 46.79 | C |
| ATOM | 1223 | ND1 | HIS | A | 145 | −25.646 | 14.678 | 43.223 | 1.00 | 53.35 | N |
| ATOM | 1224 | CD2 | HIS | A | 145 | −24.605 | 16.591 | 43.372 | 1.00 | 53.63 | C |
| ATOM | 1225 | CE1 | HIS | A | 145 | −26.566 | 15.626 | 43.187 | 1.00 | 53.33 | C |
| ATOM | 1226 | NE2 | HIS | A | 145 | −25.960 | 16.796 | 43.273 | 1.00 | 55.90 | N |
| ATOM | 1227 | N | LYS | A | 146 | −20.334 | 13.397 | 42.330 | 1.00 | 24.69 | N |

TABLE 8-continued

| | | | | | | | | | | |
|---|---|---|---|---|---|---|---|---|---|---|
| ATOM | 1228 | CA | LYS | A | 146 | −19.130 | 12.606 | 42.547 | 1.00 | 28.15 | C |
| ATOM | 1229 | C | LYS | A | 146 | −17.895 | 13.474 | 42.397 | 1.00 | 26.59 | C |
| ATOM | 1230 | O | LYS | A | 146 | −16.969 | 13.396 | 43.210 | 1.00 | 27.21 | O |
| ATOM | 1231 | CB | LYS | A | 146 | −19.092 | 11.432 | 41.567 | 1.00 | 26.89 | C |
| ATOM | 1232 | CG | LYS | A | 146 | −17.835 | 10.586 | 41.655 | 1.00 | 30.06 | C |
| ATOM | 1233 | CD | LYS | A | 146 | −17.778 | 9.557 | 40.524 | 1.00 | 39.50 | C |
| ATOM | 1234 | CE | LYS | A | 146 | −18.862 | 8.503 | 40.647 | 1.00 | 46.46 | C |
| ATOM | 1235 | NZ | LYS | A | 146 | −18.704 | 7.421 | 39.615 | 1.00 | 53.83 | N |
| ATOM | 1236 | N | TRP | A | 147 | −17.887 | 14.343 | 41.388 | 1.00 | 25.50 | N |
| ATOM | 1237 | CA | TRP | A | 147 | −16.708 | 15.151 | 41.100 | 1.00 | 25.62 | C |
| ATOM | 1238 | C | TRP | A | 147 | −16.579 | 16.319 | 42.068 | 1.00 | 27.04 | C |
| ATOM | 1239 | O | TRP | A | 147 | −15.461 | 16.803 | 42.317 | 1.00 | 26.33 | O |
| ATOM | 1240 | CB | TRP | A | 147 | −16.755 | 15.628 | 39.646 | 1.00 | 25.53 | C |
| ATOM | 1241 | CG | TRP | A | 147 | −16.505 | 14.509 | 38.651 | 1.00 | 25.26 | C |
| ATOM | 1242 | CD1 | TRP | A | 147 | −16.334 | 13.172 | 38.935 | 1.00 | 23.25 | C |
| ATOM | 1243 | CD2 | TRP | A | 147 | −16.379 | 14.633 | 37.227 | 1.00 | 23.85 | C |
| ATOM | 1244 | NE1 | TRP | A | 147 | −16.100 | 12.468 | 37.777 | 1.00 | 23.56 | N |
| ATOM | 1245 | CE2 | TRP | A | 147 | −16.129 | 13.332 | 36.714 | 1.00 | 25.11 | C |
| ATOM | 1246 | CE3 | TRP | A | 147 | −16.462 | 15.712 | 36.336 | 1.00 | 26.62 | C |
| ATOM | 1247 | CZ2 | TRP | A | 147 | −15.975 | 13.077 | 35.346 | 1.00 | 25.16 | C |
| ATOM | 1248 | CZ3 | TRP | A | 147 | −16.292 | 15.466 | 34.977 | 1.00 | 27.10 | C |
| ATOM | 1249 | CH2 | TRP | A | 147 | −16.043 | 14.154 | 34.497 | 1.00 | 25.96 | C |
| ATOM | 1250 | N | GLU | A | 148 | −17.696 | 16.773 | 42.632 | 1.00 | 24.73 | N |
| ATOM | 1251 | CA | GLU | A | 148 | −17.614 | 17.747 | 43.713 | 1.00 | 27.22 | C |
| ATOM | 1252 | C | GLU | A | 148 | −16.985 | 17.119 | 44.949 | 1.00 | 30.68 | C |
| ATOM | 1253 | O | GLU | A | 148 | −16.096 | 17.709 | 45.564 | 1.00 | 28.23 | O |
| ATOM | 1254 | CB | GLU | A | 148 | −19.005 | 18.302 | 44.030 | 1.00 | 28.02 | C |
| ATOM | 1255 | CG | GLU | A | 148 | −19.531 | 19.255 | 42.951 | 1.00 | 25.61 | C |
| ATOM | 1256 | CD | GLU | A | 148 | −20.981 | 19.691 | 43.167 | 1.00 | 37.53 | C |
| ATOM | 1257 | OE1 | GLU | A | 148 | −21.389 | 20.707 | 42.570 | 1.00 | 37.17 | O |
| ATOM | 1258 | OE2 | GLU | A | 148 | −21.717 | 19.018 | 43.924 | 1.00 | 42.81 | O |
| ATOM | 1259 | N | ALA | A | 149 | −17.408 | 15.902 | 45.306 | 1.00 | 26.72 | N |
| ATOM | 1260 | CA | ALA | A | 149 | −16.877 | 15.273 | 46.509 | 1.00 | 27.16 | C |
| ATOM | 1261 | C | ALA | A | 149 | −15.389 | 14.986 | 46.364 | 1.00 | 28.78 | C |
| ATOM | 1262 | O | ALA | A | 149 | −14.648 | 15.029 | 47.357 | 1.00 | 29.82 | O |
| ATOM | 1263 | CB | ALA | A | 149 | −17.633 | 13.975 | 46.807 | 1.00 | 29.27 | C |
| ATOM | 1264 | N | ALA | A | 150 | −14.937 | 14.714 | 45.142 | 1.00 | 25.31 | N |
| ATOM | 1265 | CA | ALA | A | 150 | −13.537 | 14.382 | 44.889 | 1.00 | 29.17 | C |
| ATOM | 1266 | C | ALA | A | 150 | −12.687 | 15.591 | 44.521 | 1.00 | 26.50 | C |
| ATOM | 1267 | O | ALA | A | 150 | −11.509 | 15.413 | 44.180 | 1.00 | 26.98 | O |
| ATOM | 1268 | CB | ALA | A | 150 | −13.427 | 13.332 | 43.774 | 1.00 | 26.34 | C |
| ATOM | 1269 | N | HIS | A | 151 | −13.251 | 16.806 | 44.580 | 1.00 | 27.39 | N |
| ATOM | 1270 | CA | HIS | A | 151 | −12.490 | 18.036 | 44.354 | 1.00 | 26.12 | C |
| ATOM | 1271 | C | HIS | A | 151 | −11.848 | 18.061 | 42.969 | 1.00 | 26.27 | C |
| ATOM | 1272 | O | HIS | A | 151 | −10.726 | 18.555 | 42.796 | 1.00 | 25.13 | O |
| ATOM | 1273 | CB | HIS | A | 151 | −11.429 | 18.227 | 45.443 | 1.00 | 24.63 | C |
| ATOM | 1274 | CG | HIS | A | 151 | −12.004 | 18.475 | 46.803 | 1.00 | 33.53 | C |
| ATOM | 1275 | ND1 | HIS | A | 151 | −11.222 | 18.788 | 47.894 | 1.00 | 41.70 | N |
| ATOM | 1276 | CD2 | HIS | A | 151 | −13.285 | 18.481 | 47.243 | 1.00 | 39.26 | C |
| ATOM | 1277 | CE1 | HIS | A | 151 | −11.996 | 18.964 | 48.951 | 1.00 | 41.37 | C |
| ATOM | 1278 | NE2 | HIS | A | 151 | −13.252 | 18.782 | 48.583 | 1.00 | 39.08 | N |
| ATOM | 1279 | N | VAL | A | 152 | −12.578 | 17.549 | 41.973 | 1.00 | 21.43 | N |
| ATOM | 1280 | CA | VAL | A | 152 | −12.032 | 17.415 | 40.623 | 1.00 | 22.92 | C |
| ATOM | 1281 | C | VAL | A | 152 | −11.753 | 18.781 | 40.005 | 1.00 | 22.08 | C |
| ATOM | 1282 | O | VAL | A | 152 | −10.752 | 18.958 | 39.300 | 1.00 | 24.71 | O |
| ATOM | 1283 | CB | VAL | A | 152 | −12.976 | 16.576 | 39.734 | 1.00 | 24.46 | C |
| ATOM | 1284 | CG1 | VAL | A | 152 | −12.397 | 16.451 | 38.310 | 1.00 | 26.44 | C |
| ATOM | 1285 | CG2 | VAL | A | 152 | −13.152 | 15.160 | 40.337 | 1.00 | 24.62 | C |
| ATOM | 1286 | N | ALA | A | 153 | −12.636 | 19.761 | 40.232 | 1.00 | 21.64 | N |
| ATOM | 1287 | CA | ALA | A | 153 | −12.423 | 21.079 | 39.630 | 1.00 | 25.28 | C |
| ATOM | 1288 | C | ALA | A | 153 | −11.114 | 21.691 | 40.111 | 1.00 | 23.71 | C |
| ATOM | 1289 | O | ALA | A | 153 | −10.353 | 22.259 | 39.314 | 1.00 | 24.74 | O |
| ATOM | 1290 | CB | ALA | A | 153 | −13.595 | 22.011 | 39.947 | 1.00 | 26.74 | C |
| ATOM | 1291 | N | GLU | A | 154 | −10.818 | 21.555 | 41.407 | 1.00 | 23.77 | N |
| ATOM | 1292 | CA | GLU | A | 154 | −9.571 | 22.095 | 41.954 | 1.00 | 26.12 | C |
| ATOM | 1293 | C | GLU | A | 154 | −8.353 | 21.410 | 41.336 | 1.00 | 28.75 | C |
| ATOM | 1294 | O | GLU | A | 154 | −7.365 | 22.067 | 40.984 | 1.00 | 23.52 | O |
| ATOM | 1295 | CB | GLU | A | 154 | −9.584 | 21.932 | 43.471 | 1.00 | 27.46 | C |
| ATOM | 1296 | CG | GLU | A | 154 | −8.347 | 22.440 | 44.229 | 1.00 | 27.49 | C |
| ATOM | 1297 | CD | GLU | A | 154 | −8.409 | 22.056 | 45.716 | 1.00 | 34.34 | C |
| ATOM | 1298 | OE1 | GLU | A | 154 | −9.358 | 22.482 | 46.405 | 1.00 | 36.12 | O |
| ATOM | 1299 | OE2 | GLU | A | 154 | −7.529 | 21.301 | 46.190 | 1.00 | 38.70 | O |
| ATOM | 1300 | N | GLN | A | 155 | −8.413 | 20.092 | 41.184 | 1.00 | 25.49 | N |
| ATOM | 1301 | CA | GLN | A | 155 | −7.326 | 19.355 | 40.546 | 1.00 | 24.44 | C |
| ATOM | 1302 | C | GLN | A | 155 | −7.104 | 19.812 | 39.116 | 1.00 | 25.93 | C |
| ATOM | 1303 | O | GLN | A | 155 | −5.951 | 19.968 | 38.679 | 1.00 | 25.85 | O |
| ATOM | 1304 | CB | GLN | A | 155 | −7.618 | 17.853 | 40.571 | 1.00 | 20.20 | C |
| ATOM | 1305 | CG | GLN | A | 155 | −7.682 | 17.280 | 41.996 | 1.00 | 22.20 | C |
| ATOM | 1306 | CD | GLN | A | 155 | −8.072 | 15.792 | 42.005 | 1.00 | 26.47 | C |
| ATOM | 1307 | OE1 | GLN | A | 155 | −8.712 | 15.303 | 41.075 | 1.00 | 24.04 | O |

TABLE 8-continued

| | | | | | | | | | | |
|---|---|---|---|---|---|---|---|---|---|---|
| ATOM | 1308 | NE2 | GLN | A | 155 | −7.673 | 15.074 | 43.058 | 1.00 | 26.35 | N |
| ATOM | 1309 | N | LEU | A | 156 | −8.189 | 19.987 | 38.358 | 1.00 | 23.29 | N |
| ATOM | 1310 | CA | LEU | A | 156 | −8.068 | 20.386 | 36.959 | 1.00 | 25.19 | C |
| ATOM | 1311 | C | LEU | A | 156 | −7.529 | 21.798 | 36.838 | 1.00 | 25.27 | C |
| ATOM | 1312 | O | LEU | A | 156 | −6.735 | 22.090 | 35.938 | 1.00 | 25.26 | O |
| ATOM | 1313 | CB | LEU | A | 156 | −9.421 | 20.296 | 36.251 | 1.00 | 20.32 | C |
| ATOM | 1314 | CG | LEU | A | 156 | −9.859 | 18.885 | 35.863 | 1.00 | 23.79 | C |
| ATOM | 1315 | CD1 | LEU | A | 156 | −11.360 | 18.909 | 35.447 | 1.00 | 25.59 | C |
| ATOM | 1316 | CD2 | LEU | A | 156 | −8.969 | 18.295 | 34.750 | 1.00 | 27.28 | C |
| ATOM | 1317 | N | ARG | A | 157 | −7.970 | 22.681 | 37.730 | 1.00 | 23.72 | N |
| ATOM | 1318 | CA | ARG | A | 157 | −7.580 | 24.082 | 37.668 | 1.00 | 28.35 | C |
| ATOM | 1319 | C | ARG | A | 157 | −6.071 | 24.233 | 37.802 | 1.00 | 30.06 | C |
| ATOM | 1320 | O | ARG | A | 157 | −5.466 | 25.108 | 37.170 | 1.00 | 31.91 | O |
| ATOM | 1321 | CB | ARG | A | 157 | −8.335 | 24.836 | 38.766 | 1.00 | 32.72 | C |
| ATOM | 1322 | CG | ARG | A | 157 | −8.622 | 26.260 | 38.465 | 1.00 | 34.37 | C |
| ATOM | 1323 | CD | ARG | A | 157 | −9.607 | 26.856 | 39.446 | 1.00 | 28.24 | C |
| ATOM | 1324 | NE | ARG | A | 157 | −9.316 | 26.607 | 40.865 | 1.00 | 29.11 | N |
| ATOM | 1325 | CZ | ARG | A | 157 | −10.087 | 25.872 | 41.676 | 1.00 | 27.60 | C |
| ATOM | 1326 | NH1 | ARG | A | 157 | −11.182 | 25.276 | 41.208 | 1.00 | 25.90 | N |
| ATOM | 1327 | NH2 | ARG | A | 157 | −9.779 | 25.737 | 42.966 | 1.00 | 30.31 | N |
| ATOM | 1328 | N | ALA | A | 158 | −5.442 | 23.368 | 38.603 | 1.00 | 26.52 | N |
| ATOM | 1329 | CA | ALA | A | 158 | −3.989 | 23.403 | 38.745 | 1.00 | 29.41 | C |
| ATOM | 1330 | C | ALA | A | 158 | −3.292 | 23.216 | 37.399 | 1.00 | 30.17 | C |
| ATOM | 1331 | O | ALA | A | 158 | −2.235 | 23.812 | 37.146 | 1.00 | 28.24 | O |
| ATOM | 1332 | CB | ALA | A | 158 | −3.531 | 22.330 | 39.736 | 1.00 | 28.34 | C |
| ATOM | 1333 | N | TYR | A | 159 | −3.853 | 22.376 | 36.532 | 1.00 | 25.72 | N |
| ATOM | 1334 | CA | TYR | A | 159 | −3.286 | 22.188 | 35.201 | 1.00 | 25.31 | C |
| ATOM | 1335 | C | TYR | A | 159 | −3.722 | 23.304 | 34.261 | 1.00 | 25.16 | C |
| ATOM | 1336 | O | TYR | A | 159 | −2.885 | 23.949 | 33.619 | 1.00 | 26.48 | O |
| ATOM | 1337 | CB | TYR | A | 159 | −3.695 | 20.811 | 34.668 | 1.00 | 22.60 | C |
| ATOM | 1338 | CG | TYR | A | 159 | −3.467 | 20.548 | 33.188 | 1.00 | 26.18 | C |
| ATOM | 1339 | CD1 | TYR | A | 159 | −2.230 | 20.098 | 32.719 | 1.00 | 25.76 | C |
| ATOM | 1340 | CD2 | TYR | A | 159 | −4.506 | 20.692 | 32.265 | 1.00 | 25.05 | C |
| ATOM | 1341 | CE1 | TYR | A | 159 | −2.028 | 19.834 | 31.366 | 1.00 | 24.25 | C |
| ATOM | 1342 | CE2 | TYR | A | 159 | −4.310 | 20.435 | 30.918 | 1.00 | 27.40 | C |
| ATOM | 1343 | CZ | TYR | A | 159 | −3.071 | 20.003 | 30.476 | 1.00 | 24.06 | C |
| ATOM | 1344 | OH | TYR | A | 159 | −2.885 | 19.726 | 29.145 | 1.00 | 23.97 | O |
| ATOM | 1345 | N | LEU | A | 160 | −5.025 | 23.590 | 34.212 | 1.00 | 24.93 | N |
| ATOM | 1346 | CA | LEU | A | 160 | −5.541 | 24.505 | 33.195 | 1.00 | 23.70 | C |
| ATOM | 1347 | C | LEU | A | 160 | −5.008 | 25.928 | 33.368 | 1.00 | 27.98 | C |
| ATOM | 1348 | O | LEU | A | 160 | −4.789 | 26.633 | 32.373 | 1.00 | 29.29 | O |
| ATOM | 1349 | CB | LEU | A | 160 | −7.068 | 24.493 | 33.227 | 1.00 | 20.37 | C |
| ATOM | 1350 | CG | LEU | A | 160 | −7.720 | 23.138 | 32.918 | 1.00 | 22.18 | C |
| ATOM | 1351 | CD1 | LEU | A | 160 | −9.227 | 23.211 | 33.114 | 1.00 | 29.94 | C |
| ATOM | 1352 | CD2 | LEU | A | 160 | −7.396 | 22.727 | 31.490 | 1.00 | 26.78 | C |
| ATOM | 1353 | N | GLU | A | 161 | −4.768 | 26.329 | 34.619 | 1.00 | 25.31 | N |
| ATOM | 1354 | CA | GLU | A | 161 | −4.278 | 27.701 | 34.916 | 1.00 | 27.33 | C |
| ATOM | 1355 | C | GLU | A | 161 | −2.757 | 27.713 | 35.099 | 1.00 | 33.37 | C |
| ATOM | 1356 | O | GLU | A | 161 | −2.196 | 28.818 | 35.158 | 1.00 | 35.25 | O |
| ATOM | 1357 | CB | GLU | A | 161 | −4.909 | 28.225 | 36.206 | 1.00 | 27.77 | C |
| ATOM | 1358 | CG | GLU | A | 161 | −6.412 | 28.395 | 36.134 | 1.00 | 35.62 | C |
| ATOM | 1359 | CD | GLU | A | 161 | −7.015 | 29.045 | 37.367 | 1.00 | 41.06 | C |
| ATOM | 1360 | OE1 | GLU | A | 161 | −6.275 | 29.263 | 38.340 | 1.00 | 40.21 | O |
| ATOM | 1361 | OE2 | GLU | A | 161 | −8.220 | 29.332 | 37.347 | 1.00 | 49.85 | O |
| ATOM | 1362 | N | GLY | A | 162 | −2.120 | 26.542 | 35.188 | 1.00 | 33.64 | N |
| ATOM | 1363 | CA | GLY | A | 162 | −0.663 | 26.502 | 35.421 | 1.00 | 34.95 | C |
| ATOM | 1364 | C | GLY | A | 162 | 0.099 | 25.641 | 34.428 | 1.00 | 29.98 | C |
| ATOM | 1365 | O | GLY | A | 162 | 0.610 | 26.193 | 33.443 | 1.00 | 30.33 | O |
| ATOM | 1366 | N | THR | A | 163 | 0.175 | 24.332 | 34.690 | 1.00 | 26.22 | N |
| ATOM | 1367 | CA | THR | A | 163 | 0.927 | 23.368 | 33.840 | 1.00 | 25.74 | C |
| ATOM | 1368 | C | THR | A | 163 | 0.574 | 23.534 | 32.357 | 1.00 | 26.37 | C |
| ATOM | 1369 | O | THR | A | 163 | 1.503 | 23.546 | 31.537 | 1.00 | 27.00 | O |
| ATOM | 1370 | CB | THR | A | 163 | 0.696 | 21.926 | 34.303 | 1.00 | 29.33 | C |
| ATOM | 1371 | OG1 | THR | A | 163 | 0.915 | 21.891 | 35.711 | 1.00 | 37.61 | O |
| ATOM | 1372 | CG2 | THR | A | 163 | 1.609 | 20.935 | 33.617 | 1.00 | 33.67 | C |
| ATOM | 1373 | N | CYS | A | 164 | −0.718 | 23.612 | 32.033 | 1.00 | 23.98 | N |
| ATOM | 1374 | CA | CYS | A | 164 | −1.162 | 23.775 | 30.625 | 1.00 | 26.70 | C |
| ATOM | 1375 | C | CYS | A | 164 | −0.418 | 24.954 | 29.994 | 1.00 | 25.84 | C |
| ATOM | 1376 | O | CYS | A | 164 | 0.107 | 24.797 | 28.883 | 1.00 | 26.85 | O |
| ATOM | 1377 | CB | CYS | A | 164 | −2.660 | 24.060 | 30.571 | 1.00 | 33.14 | C |
| ATOM | 1378 | SG | CYS | A | 164 | −3.365 | 24.090 | 28.901 | 1.00 | 33.21 | S |
| ATOM | 1379 | N | VAL | A | 165 | −0.423 | 26.102 | 30.672 | 1.00 | 21.57 | N |
| ATOM | 1380 | CA | VAL | A | 165 | 0.185 | 27.315 | 30.131 | 1.00 | 24.50 | C |
| ATOM | 1381 | C | VAL | A | 165 | 1.693 | 27.146 | 30.031 | 1.00 | 26.92 | C |
| ATOM | 1382 | O | VAL | A | 165 | 2.320 | 27.604 | 29.070 | 1.00 | 26.80 | O |
| ATOM | 1383 | CB | VAL | A | 165 | −0.197 | 28.531 | 30.992 | 1.00 | 29.29 | C |
| ATOM | 1384 | CG1 | VAL | A | 165 | 0.603 | 29.757 | 30.569 | 1.00 | 34.63 | C |
| ATOM | 1385 | CG2 | VAL | A | 165 | −1.702 | 28.797 | 30.883 | 1.00 | 33.21 | C |
| ATOM | 1386 | N | GLU | A | 166 | 2.295 | 26.475 | 31.018 | 1.00 | 26.99 | N |
| ATOM | 1387 | CA | GLU | A | 166 | 3.735 | 26.232 | 30.968 | 1.00 | 29.27 | C |

TABLE 8-continued

| | | | | | | | | | | |
|---|---|---|---|---|---|---|---|---|---|---|
| ATOM | 1388 | C | GLU | A | 166 | 4.105 | 25.394 | 29.752 | 1.00 | 26.98 | C |
| ATOM | 1389 | O | GLU | A | 166 | 5.058 | 25.727 | 29.038 | 1.00 | 27.31 | O |
| ATOM | 1390 | CB | GLU | A | 166 | 4.203 | 25.552 | 32.256 | 1.00 | 36.51 | C |
| ATOM | 1391 | CG | GLU | A | 166 | 4.134 | 26.457 | 33.497 | 1.00 | 39.57 | C |
| ATOM | 1392 | CD | GLU | A | 166 | 4.407 | 25.712 | 34.800 | 1.00 | 53.52 | C |
| ATOM | 1393 | OE1 | GLU | A | 166 | 4.470 | 24.463 | 34.793 | 1.00 | 55.83 | O |
| ATOM | 1394 | OE2 | GLU | A | 166 | 4.558 | 26.385 | 35.842 | 1.00 | 63.82 | O |
| ATOM | 1395 | N | TRP | A | 167 | 3.345 | 24.324 | 29.477 | 1.00 | 26.44 | N |
| ATOM | 1396 | CA | TRP | A | 167 | 3.569 | 23.551 | 28.254 | 1.00 | 23.27 | C |
| ATOM | 1397 | C | TRP | A | 167 | 3.421 | 24.437 | 27.024 | 1.00 | 29.32 | C |
| ATOM | 1398 | O | TRP | A | 167 | 4.276 | 24.443 | 26.136 | 1.00 | 26.71 | O |
| ATOM | 1399 | CB | TRP | A | 167 | 2.582 | 22.383 | 28.161 | 1.00 | 22.73 | C |
| ATOM | 1400 | CG | TRP | A | 167 | 2.898 | 21.202 | 29.015 | 1.00 | 23.19 | C |
| ATOM | 1401 | CD1 | TRP | A | 167 | 2.112 | 20.662 | 29.997 | 1.00 | 28.34 | C |
| ATOM | 1402 | CD2 | TRP | A | 167 | 4.085 | 20.394 | 28.962 | 1.00 | 24.08 | C |
| ATOM | 1403 | NE1 | TRP | A | 167 | 2.738 | 19.571 | 30.560 | 1.00 | 29.58 | N |
| ATOM | 1404 | CE2 | TRP | A | 167 | 3.949 | 19.387 | 29.948 | 1.00 | 27.24 | C |
| ATOM | 1405 | CE3 | TRP | A | 167 | 5.247 | 20.422 | 28.177 | 1.00 | 28.13 | C |
| ATOM | 1406 | CZ2 | TRP | A | 167 | 4.935 | 18.407 | 30.167 | 1.00 | 28.29 | C |
| ATOM | 1407 | CZ3 | TRP | A | 167 | 6.232 | 19.451 | 28.402 | 1.00 | 33.81 | C |
| ATOM | 1408 | CH2 | TRP | A | 167 | 6.060 | 18.459 | 29.386 | 1.00 | 30.57 | C |
| ATOM | 1409 | N | LEU | A | 168 | 2.319 | 25.179 | 26.945 | 1.00 | 24.45 | N |
| ATOM | 1410 | CA | LEU | A | 168 | 2.079 | 26.007 | 25.769 | 1.00 | 26.17 | C |
| ATOM | 1411 | C | LEU | A | 168 | 3.236 | 26.975 | 25.518 | 1.00 | 28.37 | C |
| ATOM | 1412 | O | LEU | A | 168 | 3.700 | 27.115 | 24.380 | 1.00 | 28.65 | O |
| ATOM | 1413 | CB | LEU | A | 168 | 0.739 | 26.739 | 25.915 | 1.00 | 25.14 | C |
| ATOM | 1414 | CG | LEU | A | 168 | 0.339 | 27.681 | 24.784 | 1.00 | 29.28 | C |
| ATOM | 1415 | CD1 | LEU | A | 168 | 0.405 | 27.002 | 23.397 | 1.00 | 28.51 | C |
| ATOM | 1416 | CD2 | LEU | A | 168 | −1.056 | 28.229 | 25.076 | 1.00 | 24.93 | C |
| ATOM | 1417 | N | ARG | A | 169 | 3.727 | 27.644 | 26.569 | 1.00 | 26.75 | N |
| ATOM | 1418 | CA | ARG | A | 169 | 4.849 | 28.567 | 26.399 | 1.00 | 28.78 | C |
| ATOM | 1419 | C | ARG | A | 169 | 6.095 | 27.840 | 25.909 | 1.00 | 31.28 | C |
| ATOM | 1420 | O | ARG | A | 169 | 6.880 | 28.385 | 25.117 | 1.00 | 31.00 | O |
| ATOM | 1421 | CB | ARG | A | 169 | 5.132 | 29.295 | 27.717 | 1.00 | 31.27 | C |
| ATOM | 1422 | CG | ARG | A | 169 | 4.024 | 30.272 | 28.095 | 1.00 | 31.52 | C |
| ATOM | 1423 | CD | ARG | A | 169 | 4.461 | 31.336 | 29.106 | 1.00 | 41.24 | C |
| ATOM | 1424 | NE | ARG | A | 169 | 4.321 | 30.879 | 30.480 | 1.00 | 54.40 | N |
| ATOM | 1425 | CZ | ARG | A | 169 | 3.579 | 31.477 | 31.410 | 1.00 | 62.28 | C |
| ATOM | 1426 | NH1 | ARG | A | 169 | 2.900 | 32.583 | 31.133 | 1.00 | 55.16 | N |
| ATOM | 1427 | NH2 | ARG | A | 169 | 3.526 | 30.963 | 32.633 | 1.00 | 72.02 | N |
| ATOM | 1428 | N | ARG | A | 170 | 6.303 | 26.615 | 26.387 | 1.00 | 30.13 | N |
| ATOM | 1429 | CA | ARG | A | 170 | 7.448 | 25.829 | 25.941 | 1.00 | 30.29 | C |
| ATOM | 1430 | C | ARG | A | 170 | 7.334 | 25.524 | 24.452 | 1.00 | 25.81 | C |
| ATOM | 1431 | O | ARG | A | 170 | 8.285 | 25.740 | 23.686 | 1.00 | 31.33 | O |
| ATOM | 1432 | CB | ARG | A | 170 | 7.529 | 24.548 | 26.767 | 1.00 | 29.60 | C |
| ATOM | 1433 | CG | ARG | A | 170 | 8.577 | 23.556 | 26.311 | 1.00 | 31.74 | C |
| ATOM | 1434 | CD | ARG | A | 170 | 8.437 | 22.259 | 27.108 | 1.00 | 38.35 | C |
| ATOM | 1435 | NE | ARG | A | 170 | 9.459 | 21.279 | 26.745 | 1.00 | 46.89 | N |
| ATOM | 1436 | CZ | ARG | A | 170 | 10.695 | 21.267 | 27.235 | 1.00 | 59.13 | C |
| ATOM | 1437 | NH1 | ARG | A | 170 | 11.075 | 22.194 | 28.109 | 1.00 | 68.29 | N |
| ATOM | 1438 | NH2 | ARG | A | 170 | 11.557 | 20.331 | 26.847 | 1.00 | 49.91 | N |
| ATOM | 1439 | N | TYR | A | 171 | 6.147 | 25.079 | 24.017 | 1.00 | 27.89 | N |
| ATOM | 1440 | CA | TYR | A | 171 | 5.938 | 24.756 | 22.608 | 1.00 | 26.71 | C |
| ATOM | 1441 | C | TYR | A | 171 | 6.039 | 25.988 | 21.712 | 1.00 | 30.33 | C |
| ATOM | 1442 | O | TYR | A | 171 | 6.629 | 25.918 | 20.627 | 1.00 | 35.50 | O |
| ATOM | 1443 | CB | TYR | A | 171 | 4.584 | 24.066 | 22.425 | 1.00 | 25.36 | C |
| ATOM | 1444 | CG | TYR | A | 171 | 4.421 | 22.781 | 23.197 | 1.00 | 27.49 | C |
| ATOM | 1445 | CD1 | TYR | A | 171 | 5.517 | 21.964 | 23.501 | 1.00 | 27.56 | C |
| ATOM | 1446 | CD2 | TYR | A | 171 | 3.154 | 22.378 | 23.623 | 1.00 | 23.80 | C |
| ATOM | 1447 | CE1 | TYR | A | 171 | 5.349 | 20.776 | 24.223 | 1.00 | 26.23 | C |
| ATOM | 1448 | CE2 | TYR | A | 171 | 2.974 | 21.195 | 24.324 | 1.00 | 27.25 | C |
| ATOM | 1449 | CZ | TYR | A | 171 | 4.062 | 20.396 | 24.611 | 1.00 | 28.66 | C |
| ATOM | 1450 | OH | TYR | A | 171 | 3.843 | 19.238 | 25.311 | 1.00 | 25.81 | O |
| ATOM | 1451 | N | LEU | A | 172 | 5.497 | 27.132 | 22.154 | 1.00 | 28.35 | N |
| ATOM | 1452 | CA | LEU | A | 172 | 5.560 | 28.342 | 21.339 | 1.00 | 28.91 | C |
| ATOM | 1453 | C | LEU | A | 172 | 6.996 | 28.788 | 21.128 | 1.00 | 32.49 | C |
| ATOM | 1454 | O | LEU | A | 172 | 7.326 | 29.361 | 20.085 | 1.00 | 37.00 | O |
| ATOM | 1455 | CB | LEU | A | 172 | 4.758 | 29.469 | 21.992 | 1.00 | 31.54 | C |
| ATOM | 1456 | CG | LEU | A | 172 | 3.236 | 29.275 | 22.039 | 1.00 | 32.58 | C |
| ATOM | 1457 | CD1 | LEU | A | 172 | 2.572 | 30.274 | 22.999 | 1.00 | 28.92 | C |
| ATOM | 1458 | CD2 | LEU | A | 172 | 2.648 | 29.403 | 20.634 | 1.00 | 31.69 | C |
| ATOM | 1459 | N | GLU | A | 173 | 7.855 | 28.559 | 22.115 | 1.00 | 29.46 | N |
| ATOM | 1460 | CA | GLU | A | 173 | 9.260 | 28.907 | 21.956 | 1.00 | 36.90 | C |
| ATOM | 1461 | C | GLU | A | 173 | 9.955 | 27.920 | 21.027 | 1.00 | 35.85 | C |
| ATOM | 1462 | O | GLU | A | 173 | 10.611 | 28.319 | 20.056 | 1.00 | 37.10 | O |
| ATOM | 1463 | CB | GLU | A | 173 | 9.946 | 28.945 | 23.325 | 1.00 | 38.68 | C |
| ATOM | 1464 | CG | GLU | A | 173 | 11.362 | 29.522 | 23.297 | 1.00 | 48.44 | C |
| ATOM | 1465 | CD | GLU | A | 173 | 11.395 | 30.984 | 22.876 | 0.00 | 60.46 | C |
| ATOM | 1466 | OE1 | GLU | A | 173 | 10.618 | 31.808 | 23.410 | 1.00 | 68.78 | O |
| ATOM | 1467 | OE2 | GLU | A | 173 | 12.209 | 31.315 | 21.999 | 0.85 | 64.90 | O |

TABLE 8-continued

| | | | | | | | | | | |
|---|---|---|---|---|---|---|---|---|---|---|
| ATOM | 1468 | N | ASN | A | 174 | 9.786 | 26.620 | 21.291 | 1.00 | 36.92 | N |
| ATOM | 1469 | CA | ASN | A | 174 | 10.475 | 25.594 | 20.512 | 1.00 | 37.25 | C |
| ATOM | 1470 | C | ASN | A | 174 | 9.983 | 25.551 | 19.069 | 1.00 | 39.99 | C |
| ATOM | 1471 | O | ASN | A | 174 | 10.775 | 25.316 | 18.151 | 1.00 | 41.07 | O |
| ATOM | 1472 | CB | ASN | A | 174 | 10.303 | 24.232 | 21.179 | 1.00 | 35.43 | C |
| ATOM | 1473 | CG | ASN | A | 174 | 11.070 | 24.127 | 22.479 | 1.00 | 40.49 | C |
| ATOM | 1474 | OD1 | ASN | A | 174 | 11.902 | 24.986 | 22.789 | 1.00 | 51.64 | O |
| ATOM | 1475 | ND2 | ASN | A | 174 | 10.816 | 23.068 | 23.237 | 1.00 | 38.30 | N |
| ATOM | 1476 | N | GLY | A | 175 | 8.689 | 25.769 | 18.846 | 1.00 | 34.16 | N |
| ATOM | 1477 | CA | GLY | A | 175 | 8.161 | 25.798 | 17.496 | 1.00 | 35.88 | C |
| ATOM | 1478 | C | GLY | A | 175 | 7.972 | 27.190 | 16.927 | 1.00 | 44.39 | C |
| ATOM | 1479 | O | GLY | A | 175 | 7.140 | 27.388 | 16.033 | 1.00 | 45.11 | O |
| ATOM | 1480 | N | LYS | A | 176 | 8.748 | 28.160 | 17.424 | 1.00 | 42.82 | N |
| ATOM | 1481 | CA | LYS | A | 176 | 8.498 | 29.560 | 17.085 | 1.00 | 47.01 | C |
| ATOM | 1482 | C | LYS | A | 176 | 8.486 | 29.797 | 15.578 | 1.00 | 53.55 | C |
| ATOM | 1483 | O | LYS | A | 176 | 7.760 | 30.675 | 15.099 | 1.00 | 53.69 | O |
| ATOM | 1484 | CB | LYS | A | 176 | 9.543 | 30.460 | 17.749 | 1.00 | 46.85 | C |
| ATOM | 1485 | CG | LYS | A | 176 | 10.937 | 30.336 | 17.140 | 1.00 | 51.10 | C |
| ATOM | 1486 | CD | LYS | A | 176 | 11.892 | 31.420 | 17.631 | 1.00 | 55.88 | C |
| ATOM | 1487 | CE | LYS | A | 176 | 12.431 | 31.105 | 19.007 | 0.00 | 58.78 | C |
| ATOM | 1488 | NZ | LYS | A | 176 | 13.107 | 29.782 | 19.077 | 1.00 | 64.24 | N |
| ATOM | 1489 | N | GLU | A | 177 | 9.265 | 29.025 | 14.813 | 1.00 | 55.26 | N |
| ATOM | 1490 | CA | GLU | A | 177 | 9.306 | 29.226 | 13.367 | 1.00 | 63.01 | C |
| ATOM | 1491 | C | GLU | A | 177 | 8.056 | 28.686 | 12.684 | 1.00 | 67.90 | C |
| ATOM | 1492 | O | GLU | A | 177 | 7.670 | 29.189 | 11.623 | 1.00 | 76.93 | O |
| ATOM | 1493 | CB | GLU | A | 177 | 10.560 | 28.577 | 12.781 | 1.00 | 67.96 | C |
| ATOM | 1494 | CG | GLU | A | 177 | 11.837 | 28.960 | 13.504 | 1.00 | 72.34 | C |
| ATOM | 1495 | CD | GLU | A | 177 | 13.077 | 28.715 | 12.672 | 0.00 | 79.31 | C |
| ATOM | 1496 | OE1 | GLU | A | 177 | 12.968 | 28.728 | 11.428 | 1.00 | 83.40 | O |
| ATOM | 1497 | OE2 | GLU | A | 177 | 14.159 | 28.509 | 13.261 | 1.00 | 82.53 | O |
| ATOM | 1498 | N | THR | A | 178 | 7.414 | 27.678 | 13.271 | 1.00 | 64.34 | N |
| ATOM | 1499 | CA | THR | A | 178 | 6.147 | 27.158 | 12.771 | 1.00 | 65.44 | C |
| ATOM | 1500 | C | THR | A | 178 | 4.955 | 27.913 | 13.351 | 1.00 | 60.04 | C |
| ATOM | 1501 | O | THR | A | 178 | 4.108 | 28.418 | 12.610 | 1.00 | 62.79 | O |
| ATOM | 1502 | CB | THR | A | 178 | 6.020 | 25.668 | 13.109 | 1.00 | 68.19 | C |
| ATOM | 1503 | OG1 | THR | A | 178 | 7.011 | 24.921 | 12.395 | 1.00 | 73.71 | O |
| ATOM | 1504 | CG2 | THR | A | 178 | 4.623 | 25.142 | 12.759 | 1.00 | 69.74 | C |
| ATOM | 1505 | N | LEU | A | 179 | 4.904 | 28.023 | 14.676 | 1.00 | 44.68 | N |
| ATOM | 1506 | CA | LEU | A | 179 | 3.682 | 28.408 | 15.368 | 1.00 | 41.14 | C |
| ATOM | 1507 | C | LEU | A | 179 | 3.429 | 29.905 | 15.349 | 1.00 | 46.23 | C |
| ATOM | 1508 | O | LEU | A | 179 | 2.268 | 30.329 | 15.366 | 1.00 | 45.40 | O |
| ATOM | 1509 | CB | LEU | A | 179 | 3.743 | 27.909 | 16.806 | 1.00 | 37.13 | C |
| ATOM | 1510 | CG | LEU | A | 179 | 3.780 | 26.386 | 16.875 | 1.00 | 38.57 | C |
| ATOM | 1511 | CD1 | LEU | A | 179 | 3.964 | 25.905 | 18.304 | 1.00 | 37.79 | C |
| ATOM | 1512 | CD2 | LEU | A | 179 | 2.491 | 25.859 | 16.288 | 1.00 | 32.32 | C |
| ATOM | 1513 | N | GLN | A | 180 | 4.479 | 30.721 | 15.332 | 1.00 | 47.67 | N |
| ATOM | 1514 | CA | GLN | A | 180 | 4.316 | 32.162 | 15.417 | 1.00 | 52.13 | C |
| ATOM | 1515 | C | GLN | A | 180 | 4.372 | 32.830 | 14.051 | 1.00 | 59.35 | C |
| ATOM | 1516 | O | GLN | A | 180 | 4.541 | 34.051 | 13.969 | 1.00 | 69.31 | O |
| ATOM | 1517 | CB | GLN | A | 180 | 5.361 | 32.743 | 16.364 | 1.00 | 48.65 | C |
| ATOM | 1518 | CG | GLN | A | 180 | 5.341 | 32.091 | 17.749 | 1.00 | 49.64 | C |
| ATOM | 1519 | CD | GLN | A | 180 | 6.194 | 32.845 | 18.750 | 1.00 | 54.26 | C |
| ATOM | 1520 | OE1 | GLN | A | 180 | 6.052 | 34.060 | 18.903 | 1.00 | 60.85 | O |
| ATOM | 1521 | NE2 | GLN | A | 180 | 7.096 | 32.133 | 19.429 | 1.00 | 40.44 | N |
| ATOM | 1522 | N | ARG | A | 181 | 4.220 | 32.052 | 12.985 | 1.00 | 60.53 | N |
| ATOM | 1523 | CA | ARG | A | 181 | 4.164 | 32.560 | 11.623 | 1.00 | 62.47 | C |
| ATOM | 1524 | C | ARG | A | 181 | 2.734 | 32.931 | 11.257 | 1.00 | 63.24 | C |
| ATOM | 1525 | O | ARG | A | 181 | 1.770 | 32.410 | 11.823 | 1.00 | 57.78 | O |
| ATOM | 1526 | CB | ARG | A | 181 | 4.678 | 31.510 | 10.635 | 1.00 | 65.02 | C |
| ATOM | 1527 | CG | ARG | A | 181 | 3.601 | 30.513 | 10.189 | 1.00 | 61.60 | C |
| ATOM | 1528 | CD | ARG | A | 181 | 4.179 | 29.314 | 9.455 | 1.00 | 61.89 | C |
| ATOM | 1529 | NE | ARG | A | 181 | 3.148 | 28.577 | 8.722 | 1.00 | 65.73 | N |
| ATOM | 1530 | CZ | ARG | A | 181 | 2.504 | 27.507 | 9.185 | 1.00 | 65.91 | C |
| ATOM | 1531 | NH1 | ARG | A | 181 | 1.586 | 26.910 | 8.437 | 1.00 | 69.41 | N |
| ATOM | 1532 | NH2 | ARG | A | 181 | 2.775 | 27.028 | 10.391 | 1.00 | 57.39 | N |
| ATOM | 1533 | N | THR | A | 182 | 2.606 | 33.848 | 10.301 | 1.00 | 65.50 | N |
| ATOM | 1534 | CA | THR | A | 182 | 1.328 | 34.159 | 9.671 | 1.00 | 66.28 | C |
| ATOM | 1535 | C | THR | A | 182 | 1.536 | 34.151 | 8.164 | 1.00 | 69.96 | C |
| ATOM | 1536 | O | THR | A | 182 | 2.338 | 34.934 | 7.645 | 1.00 | 75.59 | O |
| ATOM | 1537 | CB | THR | A | 182 | 0.777 | 35.514 | 10.132 | 1.00 | 67.27 | C |
| ATOM | 1538 | OG1 | THR | A | 182 | 1.788 | 36.520 | 9.991 | 1.00 | 73.34 | O |
| ATOM | 1539 | CG2 | THR | A | 182 | 0.324 | 35.449 | 11.584 | 1.00 | 62.76 | C |
| ATOM | 1540 | N | ASP | A | 183 | 0.836 | 33.258 | 7.470 | 1.00 | 65.38 | N |
| ATOM | 1541 | CA | ASP | A | 183 | 0.866 | 33.186 | 6.014 | 1.00 | 63.64 | C |
| ATOM | 1542 | C | ASP | A | 183 | −0.378 | 33.869 | 5.462 | 1.00 | 59.49 | C |
| ATOM | 1543 | O | ASP | A | 183 | −1.503 | 33.426 | 5.726 | 1.00 | 59.72 | O |
| ATOM | 1544 | CB | ASP | A | 183 | 0.937 | 31.739 | 5.530 | 1.00 | 67.20 | C |
| ATOM | 1545 | CG | ASP | A | 183 | 2.173 | 31.021 | 6.015 | 1.00 | 72.05 | C |
| ATOM | 1546 | OD1 | ASP | A | 183 | 3.161 | 31.699 | 6.371 | 1.00 | 75.73 | O |
| ATOM | 1547 | OD2 | ASP | A | 183 | 2.157 | 29.773 | 6.035 | 1.00 | 74.48 | O |

TABLE 8-continued

| | | | | | | | | | | |
|---|---|---|---|---|---|---|---|---|---|---|
| ATOM | 1548 | N | ALA | A | 184 | −0.176 | 34.940 | 4.697 | 1.00 | 60.59 N |
| ATOM | 1549 | CA | ALA | A | 184 | −1.300 | 35.693 | 4.168 | 1.00 | 61.48 C |
| ATOM | 1550 | C | ALA | A | 184 | −1.972 | 34.923 | 3.030 | 1.00 | 59.97 C |
| ATOM | 1551 | O | ALA | A | 184 | −1.325 | 34.130 | 2.337 | 1.00 | 60.53 O |
| ATOM | 1552 | CB | ALA | A | 184 | −0.843 | 37.065 | 3.678 | 1.00 | 61.93 C |
| ATOM | 1553 | N | PRO | A | 185 | −3.286 | 35.132 | 2.824 | 1.00 | 61.99 N |
| ATOM | 1554 | CA | PRO | A | 185 | −3.999 | 34.394 | 1.769 | 1.00 | 69.55 C |
| ATOM | 1555 | C | PRO | A | 185 | −3.570 | 34.793 | 0.365 | 1.00 | 83.54 C |
| ATOM | 1556 | O | PRO | A | 185 | −2.597 | 35.532 | 0.181 | 1.00 | 86.59 O |
| ATOM | 1557 | CB | PRO | A | 185 | −5.471 | 34.754 | 2.014 | 1.00 | 67.94 C |
| ATOM | 1558 | CG | PRO | A | 185 | −5.520 | 35.364 | 3.386 | 1.00 | 68.49 C |
| ATOM | 1559 | CD | PRO | A | 185 | −4.189 | 36.004 | 3.594 | 1.00 | 64.15 C |
| ATOM | 1560 | N | LYS | A | 186 | −4.308 | 34.321 | −0.638 | 1.00 | 91.55 N |
| ATOM | 1561 | CA | LYS | A | 186 | −4.005 | 34.550 | −2.043 | 1.00 | 90.82 C |
| ATOM | 1562 | C | LYS | A | 186 | −5.130 | 35.357 | −2.699 | 1.00 | 92.76 C |
| ATOM | 1563 | O | LYS | A | 186 | −5.842 | 36.106 | −2.012 | 1.00 | 90.69 O |
| ATOM | 1564 | CB | LYS | A | 186 | −3.745 | 33.200 | −2.712 | 1.00 | 85.29 C |
| ATOM | 1565 | CG | LYS | A | 186 | −2.285 | 32.932 | −2.969 | 1.00 | 83.88 C |
| ATOM | 1566 | CD | LYS | A | 186 | −1.446 | 33.169 | −1.723 | 1.00 | 81.98 C |
| ATOM | 1567 | CE | LYS | A | 186 | 0.029 | 33.012 | −2.024 | 1.00 | 82.47 C |
| ATOM | 1568 | NZ | LYS | A | 186 | 0.285 | 31.699 | −2.667 | 1.00 | 82.97 N |
| ATOM | 1569 | N | THR | A | 187 | −5.275 | 35.222 | −4.012 | 1.00 | 96.61 N |
| ATOM | 1570 | CA | THR | A | 187 | −6.304 | 35.940 | −4.746 | 1.00 | 106.81 C |
| ATOM | 1571 | C | THR | A | 187 | −6.738 | 35.076 | −5.922 | 1.00 | 108.48 C |
| ATOM | 1572 | O | THR | A | 187 | −5.903 | 34.439 | −6.572 | 1.00 | 109.56 O |
| ATOM | 1573 | CB | THR | A | 187 | −5.802 | 37.318 | −5.222 | 1.00 | 117.09 C |
| ATOM | 1574 | OG1 | THR | A | 187 | −6.574 | 38.352 | −4.598 | 1.00 | 122.61 O |
| ATOM | 1575 | CG2 | THR | A | 187 | −5.904 | 37.476 | −6.742 | 1.00 | 118.48 C |
| ATOM | 1576 | N | HIS | A | 188 | −8.048 | 35.042 | −6.171 | 1.00 | 108.84 N |
| ATOM | 1577 | CA | HIS | A | 188 | −8.663 | 34.280 | −7.251 | 1.00 | 109.29 C |
| ATOM | 1578 | C | HIS | A | 188 | −10.113 | 34.721 | −7.373 | 1.00 | 105.65 C |
| ATOM | 1579 | O | HIS | A | 188 | −10.793 | 34.905 | −6.358 | 1.00 | 104.01 O |
| ATOM | 1580 | CB | HIS | A | 188 | −8.644 | 32.768 | −6.984 | 1.00 | 114.40 C |
| ATOM | 1581 | CG | HIS | A | 188 | −7.435 | 32.044 | −7.484 | 1.00 | 120.69 C |
| ATOM | 1582 | ND1 | HIS | A | 188 | −7.303 | 31.628 | −8.791 | 1.00 | 124.15 N |
| ATOM | 1583 | CD2 | HIS | A | 188 | −6.339 | 31.585 | −6.833 | 1.00 | 121.32 C |
| ATOM | 1584 | CE1 | HIS | A | 188 | −6.158 | 30.984 | −8.934 | 1.00 | 124.88 C |
| ATOM | 1585 | NE2 | HIS | A | 188 | −5.553 | 30.945 | −7.760 | 1.00 | 122.75 N |
| ATOM | 1586 | N | MET | A | 189 | −10.588 | 34.853 | −8.606 | 1.00 | 104.17 N |
| ATOM | 1587 | CA | MET | A | 189 | −12.007 | 35.090 | −8.856 | 1.00 | 100.24 C |
| ATOM | 1588 | C | MET | A | 189 | −12.495 | 34.233 | −10.020 | 1.00 | 95.77 C |
| ATOM | 1589 | O | MET | A | 189 | −11.692 | 33.735 | −10.811 | 1.00 | 93.09 O |
| ATOM | 1590 | CB | MET | A | 189 | −12.282 | 36.569 | −9.135 | 1.00 | 103.95 C |
| ATOM | 1591 | CG | MET | A | 189 | −12.336 | 37.443 | −7.891 | 1.00 | 105.12 C |
| ATOM | 1592 | SD | MET | A | 189 | −13.622 | 38.707 | −7.993 | 1.00 | 106.80 S |
| ATOM | 1593 | CE | MET | A | 189 | −15.042 | 37.816 | −7.359 | 1.00 | 106.02 C |
| ATOM | 1594 | N | CYS | A | 203 | −14.635 | 34.030 | −5.235 | 1.00 | 83.08 N |
| ATOM | 1595 | CA | CYS | A | 203 | −13.519 | 34.551 | −4.451 | 1.00 | 85.96 C |
| ATOM | 1596 | C | CYS | A | 203 | −12.805 | 33.394 | −3.746 | 1.00 | 83.27 C |
| ATOM | 1597 | O | CYS | A | 203 | −13.424 | 32.669 | −2.974 | 1.00 | 75.37 O |
| ATOM | 1598 | CB | CYS | A | 203 | −14.019 | 35.591 | −3.437 | 1.00 | 93.75 C |
| ATOM | 1599 | SG | CYS | A | 203 | −12.814 | 36.871 | −2.975 | 1.00 | 106.34 S |
| ATOM | 1600 | N | TRP | A | 204 | −11.511 | 33.222 | −4.020 | 1.00 | 85.52 N |
| ATOM | 1601 | CA | TRP | A | 204 | −10.714 | 32.141 | −3.449 | 1.00 | 87.89 C |
| ATOM | 1602 | C | TRP | A | 204 | −9.617 | 32.694 | −2.549 | 1.00 | 87.21 C |
| ATOM | 1603 | O | TRP | A | 204 | −8.943 | 33.666 | −2.906 | 1.00 | 96.49 O |
| ATOM | 1604 | CB | TRP | A | 204 | −10.045 | 31.300 | −4.531 | 1.00 | 89.13 C |
| ATOM | 1605 | CG | TRP | A | 204 | −10.878 | 30.331 | −5.268 | 1.00 | 91.27 C |
| ATOM | 1606 | CD1 | TRP | A | 204 | −11.746 | 30.590 | −6.287 | 1.00 | 90.90 C |
| ATOM | 1607 | CD2 | TRP | A | 204 | −10.871 | 28.914 | −5.094 | 1.00 | 95.14 C |
| ATOM | 1608 | NE1 | TRP | A | 204 | −12.304 | 29.417 | −6.739 | 1.00 | 94.03 N |
| ATOM | 1609 | CE2 | TRP | A | 204 | −11.781 | 28.374 | −6.020 | 1.00 | 96.64 C |
| ATOM | 1610 | CE3 | TRP | A | 204 | −10.195 | 28.048 | −4.228 | 1.00 | 91.85 C |
| ATOM | 1611 | CZ2 | TRP | A | 204 | −12.031 | 27.006 | −6.106 | 1.00 | 96.77 C |
| ATOM | 1612 | CZ3 | TRP | A | 204 | −10.443 | 26.695 | −4.316 | 1.00 | 90.54 C |
| ATOM | 1613 | CH2 | TRP | A | 204 | −11.353 | 26.186 | −5.247 | 1.00 | 94.01 C |
| ATOM | 1614 | N | ALA | A | 205 | −9.407 | 32.041 | −1.409 | 1.00 | 76.66 N |
| ATOM | 1615 | CA | ALA | A | 205 | −8.265 | 32.303 | −0.541 | 1.00 | 66.53 C |
| ATOM | 1616 | C | ALA | A | 205 | −7.544 | 30.983 | −0.298 | 1.00 | 62.50 C |
| ATOM | 1617 | O | ALA | A | 205 | −8.140 | 30.035 | 0.225 | 1.00 | 58.27 O |
| ATOM | 1618 | CB | ALA | A | 205 | −8.703 | 32.936 | 0.781 | 1.00 | 63.14 C |
| ATOM | 1619 | N | LEU | A | 206 | −6.271 | 30.918 | −0.682 | 1.00 | 61.11 N |
| ATOM | 1620 | CA | LEU | A | 206 | −5.494 | 29.691 | −0.604 | 1.00 | 63.16 C |
| ATOM | 1621 | C | LEU | A | 206 | −4.254 | 29.882 | 0.260 | 1.00 | 63.21 C |
| ATOM | 1622 | O | LEU | A | 206 | −3.740 | 30.996 | 0.409 | 1.00 | 60.34 O |
| ATOM | 1623 | CB | LEU | A | 206 | −5.058 | 29.207 | −1.996 | 1.00 | 66.13 C |
| ATOM | 1624 | CG | LEU | A | 206 | −6.126 | 28.736 | −2.987 | 1.00 | 71.42 C |
| ATOM | 1625 | CD1 | LEU | A | 206 | −5.496 | 28.408 | −4.336 | 1.00 | 73.87 C |
| ATOM | 1626 | CD2 | LEU | A | 206 | −6.869 | 27.531 | −2.441 | 1.00 | 67.57 C |
| ATOM | 1627 | N | SER | A | 207 | −3.798 | 28.771 | 0.845 | 1.00 | 57.82 N |

TABLE 8-continued

| | | | | | | | | | | |
|---|---|---|---|---|---|---|---|---|---|---|
| ATOM | 1628 | CA | SER | A | 207 | −2.451 | 28.657 | 1.404 | 1.00 | 58.91 | C |
| ATOM | 1629 | C | SER | A | 207 | −2.211 | 29.620 | 2.569 | 1.00 | 58.11 | C |
| ATOM | 1630 | O | SER | A | 207 | −1.132 | 30.201 | 2.699 | 1.00 | 63.65 | O |
| ATOM | 1631 | CB | SER | A | 207 | −1.402 | 28.867 | 0.308 | 1.00 | 66.60 | C |
| ATOM | 1632 | OG | SER | A | 207 | −0.111 | 29.044 | 0.860 | 1.00 | 73.32 | O |
| ATOM | 1633 | N | PHE | A | 208 | −3.205 | 29.792 | 3.432 | 1.00 | 53.00 | N |
| ATOM | 1634 | CA | PHE | A | 208 | −3.064 | 30.723 | 4.540 | 1.00 | 52.17 | C |
| ATOM | 1635 | C | PHE | A | 208 | −3.000 | 29.991 | 5.879 | 1.00 | 49.81 | C |
| ATOM | 1636 | O | PHE | A | 208 | −3.379 | 28.819 | 6.001 | 1.00 | 42.00 | O |
| ATOM | 1637 | CB | PHE | A | 208 | −4.198 | 31.759 | 4.542 | 1.00 | 54.27 | C |
| ATOM | 1638 | CG | PHE | A | 208 | −5.582 | 31.173 | 4.603 | 1.00 | 55.22 | C |
| ATOM | 1639 | CD1 | PHE | A | 208 | −6.264 | 30.843 | 3.440 | 1.00 | 56.95 | C |
| ATOM | 1640 | CD2 | PHE | A | 208 | −6.224 | 31.004 | 5.820 | 1.00 | 51.62 | C |
| ATOM | 1641 | CE1 | PHE | A | 208 | −7.548 | 30.324 | 3.497 | 1.00 | 57.18 | C |
| ATOM | 1642 | CE2 | PHE | A | 208 | −7.509 | 30.487 | 5.880 | 1.00 | 49.44 | C |
| ATOM | 1643 | CZ | PHE | A | 208 | −8.169 | 30.145 | 4.721 | 1.00 | 55.47 | C |
| ATOM | 1644 | N | TYR | A | 209 | −2.479 | 30.703 | 6.884 | 1.00 | 48.07 | N |
| ATOM | 1645 | CA | TYR | A | 209 | −2.357 | 30.236 | 8.266 | 1.00 | 44.09 | C |
| ATOM | 1646 | C | TYR | A | 209 | −2.312 | 31.485 | 9.142 | 1.00 | 47.39 | C |
| ATOM | 1647 | O | TYR | A | 209 | −1.560 | 32.419 | 8.821 | 1.00 | 51.50 | O |
| ATOM | 1648 | CB | TYR | A | 209 | −1.113 | 29.376 | 8.513 | 1.00 | 41.03 | C |
| ATOM | 1649 | CG | TYR | A | 209 | −1.037 | 28.831 | 9.928 | 1.00 | 41.30 | C |
| ATOM | 1650 | CD1 | TYR | A | 209 | −1.616 | 27.606 | 10.255 | 1.00 | 42.75 | C |
| ATOM | 1651 | CD2 | TYR | A | 209 | −0.405 | 29.551 | 10.938 | 1.00 | 37.51 | C |
| ATOM | 1652 | CE1 | TYR | A | 209 | −1.566 | 27.112 | 11.546 | 1.00 | 43.00 | C |
| ATOM | 1653 | CE2 | TYR | A | 209 | −0.345 | 29.065 | 12.239 | 1.00 | 34.34 | C |
| ATOM | 1654 | CZ | TYR | A | 209 | −0.925 | 27.845 | 12.535 | 1.00 | 40.37 | C |
| ATOM | 1655 | OH | TYR | A | 209 | −0.869 | 27.359 | 13.819 | 1.00 | 38.25 | O |
| ATOM | 1656 | N | PRO | A | 210 | −3.075 | 31.536 | 10.248 | 1.00 | 46.62 | N |
| ATOM | 1657 | CA | PRO | A | 210 | −3.959 | 30.475 | 10.752 | 1.00 | 44.54 | C |
| ATOM | 1658 | C | PRO | A | 210 | −5.282 | 30.373 | 9.986 | 1.00 | 42.39 | C |
| ATOM | 1659 | O | PRO | A | 210 | −5.454 | 31.030 | 8.956 | 1.00 | 46.66 | O |
| ATOM | 1660 | CB | PRO | A | 210 | −4.193 | 30.880 | 12.213 | 1.00 | 46.05 | C |
| ATOM | 1661 | CG | PRO | A | 210 | −4.055 | 32.365 | 12.210 | 1.00 | 52.06 | C |
| ATOM | 1662 | CD | PRO | A | 210 | −3.029 | 32.697 | 11.155 | 1.00 | 51.49 | C |
| ATOM | 1663 | N | ALA | A | 211 | −6.205 | 29.554 | 10.490 | 1.00 | 37.79 | N |
| ATOM | 1664 | CA | ALA | A | 211 | −7.410 | 29.226 | 9.737 | 1.00 | 45.49 | C |
| ATOM | 1665 | C | ALA | A | 211 | −8.464 | 30.320 | 9.792 | 1.00 | 51.59 | C |
| ATOM | 1666 | O | ALA | A | 211 | −9.326 | 30.369 | 8.907 | 1.00 | 54.60 | O |
| ATOM | 1667 | CB | ALA | A | 211 | −8.019 | 27.916 | 10.249 | 1.00 | 42.87 | C |
| ATOM | 1668 | N | GLU | A | 212 | −8.424 | 31.177 | 10.810 | 1.00 | 54.87 | N |
| ATOM | 1669 | CA | GLU | A | 212 | −9.404 | 32.249 | 10.933 | 1.00 | 57.80 | C |
| ATOM | 1670 | C | GLU | A | 212 | −9.386 | 33.124 | 9.689 | 1.00 | 55.32 | C |
| ATOM | 1671 | O | GLU | A | 212 | −8.332 | 33.616 | 9.273 | 1.00 | 53.43 | O |
| ATOM | 1672 | CB | GLU | A | 212 | −9.116 | 33.089 | 12.176 | 1.00 | 61.74 | C |
| ATOM | 1673 | CG | GLU | A | 212 | −10.109 | 34.216 | 12.428 | 1.00 | 75.22 | C |
| ATOM | 1674 | CD | GLU | A | 212 | −11.474 | 33.715 | 12.866 | 1.00 | 87.98 | C |
| ATOM | 1675 | OE1 | GLU | A | 212 | −12.292 | 33.358 | 11.990 | 1.00 | 93.41 | O |
| ATOM | 1676 | OE2 | GLU | A | 212 | −11.727 | 33.677 | 14.091 | 1.00 | 92.29 | O |
| ATOM | 1677 | N | ILE | A | 213 | −10.559 | 33.288 | 9.078 | 1.00 | 57.99 | N |
| ATOM | 1678 | CA | ILE | A | 213 | −10.704 | 34.111 | 7.886 | 1.00 | 64.81 | C |
| ATOM | 1679 | C | ILE | A | 213 | −12.184 | 34.422 | 7.728 | 1.00 | 75.14 | C |
| ATOM | 1680 | O | ILE | A | 213 | −13.044 | 33.626 | 8.112 | 1.00 | 81.84 | O |
| ATOM | 1681 | CB | ILE | A | 213 | −10.108 | 33.404 | 6.640 | 1.00 | 62.48 | C |
| ATOM | 1682 | CG1 | ILE | A | 213 | −9.806 | 34.421 | 5.541 | 1.00 | 58.79 | C |
| ATOM | 1683 | CG2 | ILE | A | 213 | −11.032 | 32.300 | 6.132 | 1.00 | 63.00 | C |
| ATOM | 1684 | CD1 | ILE | A | 213 | −9.025 | 33.852 | 4.371 | 1.00 | 53.99 | C |
| ATOM | 1685 | N | THR | A | 214 | −12.481 | 35.605 | 7.199 | 1.00 | 82.88 | N |
| ATOM | 1686 | CA | THR | A | 214 | −13.862 | 36.062 | 7.081 | 1.00 | 90.25 | C |
| ATOM | 1687 | C | THR | A | 214 | −14.051 | 36.696 | 5.713 | 1.00 | 91.51 | C |
| ATOM | 1688 | O | THR | A | 214 | −13.381 | 37.679 | 5.385 | 1.00 | 88.08 | O |
| ATOM | 1689 | CB | THR | A | 214 | −14.218 | 37.051 | 8.198 | 1.00 | 94.29 | C |
| ATOM | 1690 | OG1 | THR | A | 214 | −13.108 | 37.924 | 8.442 | 1.00 | 97.54 | O |
| ATOM | 1691 | CG2 | THR | A | 214 | −14.564 | 36.302 | 9.484 | 1.00 | 91.77 | C |
| ATOM | 1692 | N | LEU | A | 215 | −14.959 | 36.131 | 4.921 | 1.00 | 96.02 | N |
| ATOM | 1693 | CA | LEU | A | 215 | −15.212 | 36.569 | 3.557 | 1.00 | 102.34 | C |
| ATOM | 1694 | C | LEU | A | 215 | −16.666 | 36.999 | 3.416 | 1.00 | 105.85 | C |
| ATOM | 1695 | O | LEU | A | 215 | −17.562 | 36.395 | 4.014 | 1.00 | 108.36 | O |
| ATOM | 1696 | CB | LEU | A | 215 | −14.904 | 35.455 | 2.544 | 1.00 | 102.33 | C |
| ATOM | 1697 | CG | LEU | A | 215 | −13.456 | 35.006 | 2.319 | 1.00 | 100.22 | C |
| ATOM | 1698 | CD1 | LEU | A | 215 | −12.899 | 34.245 | 3.513 | 1.00 | 101.03 | C |
| ATOM | 1699 | CD2 | LEU | A | 215 | −13.360 | 34.154 | 1.066 | 1.00 | 96.48 | C |
| ATOM | 1700 | N | THR | A | 216 | −16.893 | 38.041 | 2.619 | 1.00 | 104.22 | N |
| ATOM | 1701 | CA | THR | A | 216 | −18.241 | 38.555 | 2.393 | 1.00 | 98.38 | C |
| ATOM | 1702 | C | THR | A | 216 | −18.533 | 38.706 | 0.901 | 1.00 | 95.08 | C |
| ATOM | 1703 | O | THR | A | 216 | −17.749 | 39.303 | 0.160 | 1.00 | 91.30 | O |
| ATOM | 1704 | CB | THR | A | 216 | −18.454 | 39.916 | 3.085 | 1.00 | 94.48 | C |
| ATOM | 1705 | OG1 | THR | A | 216 | −17.879 | 39.884 | 4.397 | 1.00 | 89.97 | O |
| ATOM | 1706 | CG2 | THR | A | 216 | −19.942 | 40.227 | 3.196 | 1.00 | 94.17 | C |
| ATOM | 1707 | N | VAL | A | 231 | −18.561 | 28.372 | 2.228 | 1.00 | 83.65 | N |

TABLE 8-continued

| | | | | | | | | | | |
|---|---|---|---|---|---|---|---|---|---|---|
| ATOM | 1708 | CA | VAL | A | 231 | −18.006 | 27.024 | 2.320 | 1.00 | 82.83 | C |
| ATOM | 1709 | C | VAL | A | 231 | −17.198 | 26.859 | 3.605 | 1.00 | 81.93 | C |
| ATOM | 1710 | O | VAL | A | 231 | −16.757 | 27.839 | 4.206 | 1.00 | 89.59 | O |
| ATOM | 1711 | CB | VAL | A | 231 | −17.139 | 26.693 | 1.085 | 1.00 | 80.66 | C |
| ATOM | 1712 | CG1 | VAL | A | 231 | −15.699 | 27.136 | 1.303 | 1.00 | 80.70 | C |
| ATOM | 1713 | CG2 | VAL | A | 231 | −17.205 | 25.210 | 0.766 | 1.00 | 76.33 | C |
| ATOM | 1714 | N | GLU | A | 232 | −17.014 | 25.611 | 4.025 | 1.00 | 74.94 | N |
| ATOM | 1715 | CA | GLU | A | 232 | −16.232 | 25.326 | 5.219 | 1.00 | 68.81 | C |
| ATOM | 1716 | C | GLU | A | 232 | −14.748 | 25.510 | 4.917 | 1.00 | 67.00 | C |
| ATOM | 1717 | O | GLU | A | 232 | −14.240 | 24.980 | 3.924 | 1.00 | 69.67 | O |
| ATOM | 1718 | CB | GLU | A | 232 | −16.508 | 23.899 | 5.697 | 1.00 | 68.94 | C |
| ATOM | 1719 | CG | GLU | A | 232 | −16.251 | 23.647 | 7.172 | 1.00 | 72.70 | C |
| ATOM | 1720 | CD | GLU | A | 232 | −17.429 | 24.041 | 8.045 | 0.00 | 73.72 | C |
| ATOM | 1721 | OE1 | GLU | A | 232 | −17.424 | 25.160 | 8.601 | 1.00 | 74.60 | O |
| ATOM | 1722 | OE2 | GLU | A | 232 | −18.367 | 23.229 | 8.170 | 1.00 | 75.10 | O |
| ATOM | 1723 | N | THR | A | 233 | −14.056 | 26.278 | 5.759 | 1.00 | 58.39 | N |
| ATOM | 1724 | CA | THR | A | 233 | −12.606 | 26.375 | 5.648 | 1.00 | 52.51 | C |
| ATOM | 1725 | C | THR | A | 233 | −11.996 | 24.981 | 5.754 | 1.00 | 45.95 | C |
| ATOM | 1726 | O | THR | A | 233 | −12.365 | 24.199 | 6.633 | 1.00 | 46.31 | O |
| ATOM | 1727 | CB | THR | A | 233 | −12.056 | 27.295 | 6.741 | 1.00 | 49.59 | C |
| ATOM | 1728 | OG1 | THR | A | 233 | −12.617 | 28.602 | 6.579 | 1.00 | 51.01 | O |
| ATOM | 1729 | CG2 | THR | A | 233 | −10.541 | 27.396 | 6.659 | 1.00 | 48.60 | C |
| ATOM | 1730 | N | ARG | A | 234 | −11.071 | 24.667 | 4.853 | 1.00 | 48.02 | N |
| ATOM | 1731 | CA | ARG | A | 234 | −10.617 | 23.292 | 4.718 | 1.00 | 45.51 | C |
| ATOM | 1732 | C | ARG | A | 234 | −9.099 | 23.207 | 4.738 | 1.00 | 42.49 | C |
| ATOM | 1733 | O | ARG | A | 234 | −8.410 | 24.128 | 4.279 | 1.00 | 45.50 | O |
| ATOM | 1734 | CB | ARG | A | 234 | −11.148 | 22.672 | 3.417 | 1.00 | 40.62 | C |
| ATOM | 1735 | CG | ARG | A | 234 | −10.509 | 23.223 | 2.145 | 1.00 | 43.26 | C |
| ATOM | 1736 | CD | ARG | A | 234 | −11.400 | 22.979 | 0.933 | 1.00 | 45.26 | C |
| ATOM | 1737 | NE | ARG | A | 234 | −10.730 | 23.330 | −0.315 | 1.00 | 51.50 | N |
| ATOM | 1738 | CZ | ARG | A | 234 | −11.332 | 23.404 | −1.501 | 1.00 | 53.44 | C |
| ATOM | 1739 | NH1 | ARG | A | 234 | −12.630 | 23.156 | −1.615 | 1.00 | 53.09 | N |
| ATOM | 1740 | NH2 | ARG | A | 234 | −10.632 | 23.733 | −2.575 | 1.00 | 53.80 | N |
| ATOM | 1741 | N | PRO | A | 235 | −8.551 | 22.114 | 5.268 | 1.00 | 43.30 | N |
| ATOM | 1742 | CA | PRO | A | 235 | −7.089 | 21.969 | 5.309 | 1.00 | 42.60 | C |
| ATOM | 1743 | C | PRO | A | 235 | −6.504 | 21.665 | 3.938 | 1.00 | 45.51 | C |
| ATOM | 1744 | O | PRO | A | 235 | −7.019 | 20.831 | 3.190 | 1.00 | 43.52 | O |
| ATOM | 1745 | CB | PRO | A | 235 | −6.877 | 20.794 | 6.273 | 1.00 | 39.43 | C |
| ATOM | 1746 | CG | PRO | A | 235 | −8.139 | 20.004 | 6.177 | 1.00 | 43.20 | C |
| ATOM | 1747 | CD | PRO | A | 235 | −9.231 | 21.028 | 5.998 | 1.00 | 37.43 | C |
| ATOM | 1748 | N | ALA | A | 236 | −5.399 | 22.344 | 3.621 | 1.00 | 43.13 | N |
| ATOM | 1749 | CA | ALA | A | 236 | −4.687 | 22.048 | 2.383 | 1.00 | 48.11 | C |
| ATOM | 1750 | C | ALA | A | 236 | −3.927 | 20.730 | 2.471 | 1.00 | 49.34 | C |
| ATOM | 1751 | O | ALA | A | 236 | −3.779 | 20.033 | 1.459 | 1.00 | 56.15 | O |
| ATOM | 1752 | CB | ALA | A | 236 | −3.732 | 23.193 | 2.043 | 1.00 | 49.23 | C |
| ATOM | 1753 | N | GLY | A | 237 | −3.449 | 20.368 | 3.661 | 1.00 | 46.35 | N |
| ATOM | 1754 | CA | GLY | A | 237 | −2.645 | 19.177 | 3.856 | 1.00 | 48.53 | C |
| ATOM | 1755 | C | GLY | A | 237 | −1.181 | 19.449 | 4.129 | 1.00 | 50.62 | C |
| ATOM | 1756 | O | GLY | A | 237 | −0.441 | 18.510 | 4.457 | 1.00 | 53.98 | O |
| ATOM | 1757 | N | ASP | A | 238 | −0.736 | 20.699 | 3.994 | 1.00 | 52.00 | N |
| ATOM | 1758 | CA | ASP | A | 238 | 0.643 | 21.084 | 4.267 | 1.00 | 54.53 | C |
| ATOM | 1759 | C | ASP | A | 238 | 0.756 | 22.054 | 5.437 | 1.00 | 56.02 | C |
| ATOM | 1760 | O | ASP | A | 238 | 1.793 | 22.709 | 5.588 | 1.00 | 56.72 | O |
| ATOM | 1761 | CB | ASP | A | 238 | 1.278 | 21.703 | 3.018 | 1.00 | 53.55 | C |
| ATOM | 1762 | CG | ASP | A | 238 | 0.543 | 22.943 | 2.537 | 1.00 | 52.91 | C |
| ATOM | 1763 | OD1 | ASP | A | 238 | −0.433 | 23.371 | 3.195 | 1.00 | 54.19 | O |
| ATOM | 1764 | OD2 | ASP | A | 238 | 0.944 | 23.492 | 1.490 | 1.00 | 58.11 | O |
| ATOM | 1765 | N | GLY | A | 239 | −0.289 | 22.180 | 6.255 | 1.00 | 51.19 | N |
| ATOM | 1766 | CA | GLY | A | 239 | −0.294 | 23.116 | 7.357 | 1.00 | 52.05 | C |
| ATOM | 1767 | C | GLY | A | 239 | −0.985 | 24.436 | 7.087 | 1.00 | 56.17 | C |
| ATOM | 1768 | O | GLY | A | 239 | −1.110 | 25.245 | 8.015 | 1.00 | 63.81 | O |
| ATOM | 1769 | N | THR | A | 240 | −1.432 | 24.689 | 5.857 | 1.00 | 48.70 | N |
| ATOM | 1770 | CA | THR | A | 240 | −2.168 | 25.904 | 5.523 | 1.00 | 44.65 | C |
| ATOM | 1771 | C | THR | A | 240 | −3.619 | 25.545 | 5.204 | 1.00 | 47.36 | C |
| ATOM | 1772 | O | THR | A | 240 | −4.018 | 24.377 | 5.254 | 1.00 | 51.03 | O |
| ATOM | 1773 | CB | THR | A | 240 | −1.500 | 26.655 | 4.364 | 1.00 | 53.85 | C |
| ATOM | 1774 | OG1 | THR | A | 240 | −1.529 | 25.856 | 3.171 | 1.00 | 56.31 | O |
| ATOM | 1775 | CG2 | THR | A | 240 | −0.049 | 27.009 | 4.716 | 1.00 | 53.58 | C |
| ATOM | 1776 | N | PHE | A | 241 | −4.419 | 26.560 | 4.880 | 1.00 | 47.19 | N |
| ATOM | 1777 | CA | PHE | A | 241 | −5.858 | 26.384 | 4.743 | 1.00 | 47.65 | C |
| ATOM | 1778 | C | PHE | A | 241 | −6.372 | 27.042 | 3.468 | 1.00 | 46.90 | C |
| ATOM | 1779 | O | PHE | A | 241 | −5.659 | 27.783 | 2.785 | 1.00 | 47.70 | O |
| ATOM | 1780 | CB | PHE | A | 241 | −6.590 | 26.933 | 5.973 | 1.00 | 43.46 | C |
| ATOM | 1781 | CG | PHE | A | 241 | −6.272 | 26.182 | 7.236 | 1.00 | 36.43 | C |
| ATOM | 1782 | CD1 | PHE | A | 241 | −5.161 | 26.510 | 7.994 | 1.00 | 37.86 | C |
| ATOM | 1783 | CD2 | PHE | A | 241 | −7.072 | 25.126 | 7.647 | 1.00 | 33.81 | C |
| ATOM | 1784 | CE1 | PHE | A | 241 | −4.855 | 25.806 | 9.155 | 1.00 | 41.89 | C |
| ATOM | 1785 | CE2 | PHE | A | 241 | −6.774 | 24.413 | 8.806 | 1.00 | 37.86 | C |
| ATOM | 1786 | CZ | PHE | A | 241 | −5.665 | 24.755 | 9.565 | 1.00 | 39.78 | C |
| ATOM | 1787 | N | GLN | A | 242 | −7.634 | 26.743 | 3.149 | 1.00 | 49.97 | N |

TABLE 8-continued

| | | | | | | | | | | |
|---|---|---|---|---|---|---|---|---|---|---|
| ATOM | 1788 | CA | GLN | A | 242 | −8.291 | 27.218 | 1.937 | 1.00 | 52.71 | C |
| ATOM | 1789 | C | GLN | A | 242 | −9.748 | 27.542 | 2.248 | 1.00 | 53.75 | C |
| ATOM | 1790 | O | GLN | A | 242 | −10.355 | 26.944 | 3.139 | 1.00 | 49.19 | O |
| ATOM | 1791 | CB | GLN | A | 242 | −8.229 | 26.176 | 0.801 | 1.00 | 52.61 | C |
| ATOM | 1792 | CG | GLN | A | 242 | −6.845 | 25.581 | 0.520 | 1.00 | 49.62 | C |
| ATOM | 1793 | CD | GLN | A | 242 | −6.872 | 24.480 | −0.529 | 1.00 | 55.57 | C |
| ATOM | 1794 | OE1 | GLN | A | 242 | −7.938 | 24.038 | −0.953 | 1.00 | 55.58 | O |
| ATOM | 1795 | NE2 | GLN | A | 242 | −5.694 | 24.031 | −0.952 | 1.00 | 55.50 | N |
| ATOM | 1796 | N | LYS | A | 243 | −10.309 | 28.489 | 1.497 | 1.00 | 59.34 | N |
| ATOM | 1797 | CA | LYS | A | 243 | −11.719 | 28.843 | 1.604 | 1.00 | 61.05 | C |
| ATOM | 1798 | C | LYS | A | 243 | −12.137 | 29.534 | 0.313 | 1.00 | 67.19 | C |
| ATOM | 1799 | O | LYS | A | 243 | −11.302 | 30.068 | −0.422 | 1.00 | 70.67 | O |
| ATOM | 1800 | CB | LYS | A | 243 | −11.992 | 29.754 | 2.811 | 1.00 | 60.69 | C |
| ATOM | 1801 | CG | LYS | A | 243 | −13.354 | 29.536 | 3.475 | 1.00 | 65.00 | C |
| ATOM | 1802 | CD | LYS | A | 243 | −13.919 | 30.829 | 4.062 | 1.00 | 66.77 | C |
| ATOM | 1803 | CE | LYS | A | 243 | −14.628 | 30.610 | 5.393 | 1.00 | 71.02 | C |
| ATOM | 1804 | NZ | LYS | A | 243 | −15.521 | 29.421 | 5.396 | 1.00 | 75.21 | N |
| ATOM | 1805 | N | TRP | A | 244 | −13.440 | 29.508 | 0.035 | 1.00 | 66.57 | N |
| ATOM | 1806 | CA | TRP | A | 244 | −13.977 | 30.309 | −1.057 | 1.00 | 68.46 | C |
| ATOM | 1807 | C | TRP | A | 244 | −15.438 | 30.628 | −0.775 | 1.00 | 66.60 | C |
| ATOM | 1808 | O | TRP | A | 244 | −16.120 | 29.906 | −0.043 | 1.00 | 64.17 | O |
| ATOM | 1809 | CB | TRP | A | 244 | −13.824 | 29.622 | −2.429 | 1.00 | 74.71 | C |
| ATOM | 1810 | CG | TRP | A | 244 | −14.529 | 28.301 | −2.619 | 1.00 | 85.36 | C |
| ATOM | 1811 | CD1 | TRP | A | 244 | −13.949 | 27.067 | −2.666 | 1.00 | 90.09 | C |
| ATOM | 1812 | CD2 | TRP | A | 244 | −15.935 | 28.087 | −2.827 | 1.00 | 94.00 | C |
| ATOM | 1813 | NE1 | TRP | A | 244 | −14.902 | 26.100 | −2.873 | 1.00 | 92.91 | N |
| ATOM | 1814 | CE2 | TRP | A | 244 | −16.129 | 26.700 | −2.975 | 1.00 | 95.65 | C |
| ATOM | 1815 | CE3 | TRP | A | 244 | −17.049 | 28.933 | −2.897 | 1.00 | 97.56 | C |
| ATOM | 1816 | CZ2 | TRP | A | 244 | −17.389 | 26.140 | −3.185 | 1.00 | 97.17 | C |
| ATOM | 1817 | CZ3 | TRP | A | 244 | −18.298 | 28.374 | −3.102 | 1.00 | 96.00 | C |
| ATOM | 1818 | CH2 | TRP | A | 244 | −18.457 | 26.993 | −3.245 | 1.00 | 95.40 | C |
| ATOM | 1819 | N | ALA | A | 245 | −15.911 | 31.725 | −1.366 | 1.00 | 77.34 | N |
| ATOM | 1820 | CA | ALA | A | 245 | −17.287 | 32.169 | −1.207 | 1.00 | 84.14 | C |
| ATOM | 1821 | C | ALA | A | 245 | −17.825 | 32.629 | −2.555 | 1.00 | 93.73 | C |
| ATOM | 1822 | O | ALA | A | 245 | −17.067 | 32.912 | −3.487 | 1.00 | 94.27 | O |
| ATOM | 1823 | CB | ALA | A | 245 | −17.409 | 33.296 | −0.170 | 1.00 | 82.05 | C |
| ATOM | 1824 | N | ALA | A | 246 | −19.151 | 32.697 | −2.647 | 1.00 | 99.77 | N |
| ATOM | 1825 | CA | ALA | A | 246 | −19.818 | 33.138 | −3.870 | 1.00 | 101.57 | C |
| ATOM | 1826 | C | ALA | A | 246 | −21.242 | 33.616 | −3.590 | 1.00 | 99.72 | C |
| ATOM | 1827 | O | ALA | A | 246 | −21.763 | 33.449 | −2.486 | 1.00 | 96.37 | O |
| ATOM | 1828 | CB | ALA | A | 246 | −19.828 | 32.021 | −4.899 | 1.00 | 100.98 | C |
| ATOM | 1829 | N | CYS | A | 259 | −14.945 | 41.881 | −3.848 | 1.00 | 106.57 | N |
| ATOM | 1830 | CA | CYS | A | 259 | −14.762 | 40.930 | −2.756 | 1.00 | 110.33 | C |
| ATOM | 1831 | C | CYS | A | 259 | −13.962 | 41.570 | −1.619 | 1.00 | 110.11 | C |
| ATOM | 1832 | O | CYS | A | 259 | −13.263 | 42.565 | −1.821 | 1.00 | 112.29 | O |
| ATOM | 1833 | CB | CYS | A | 259 | −14.070 | 39.656 | −3.261 | 1.00 | 113.34 | C |
| ATOM | 1834 | SG | CYS | A | 259 | −13.894 | 38.324 | −2.033 | 1.00 | 113.84 | S |
| ATOM | 1835 | N | HIS | A | 260 | −14.073 | 40.996 | −0.424 | 1.00 | 108.97 | N |
| ATOM | 1836 | CA | HIS | A | 260 | −13.467 | 41.574 | 0.769 | 1.00 | 115.09 | C |
| ATOM | 1837 | C | HIS | A | 260 | −13.225 | 40.453 | 1.768 | 1.00 | 116.78 | C |
| ATOM | 1838 | O | HIS | A | 260 | −14.125 | 39.646 | 2.020 | 1.00 | 118.40 | O |
| ATOM | 1839 | CB | HIS | A | 260 | −14.380 | 42.656 | 1.363 | 1.00 | 121.21 | C |
| ATOM | 1840 | CG | HIS | A | 260 | −13.695 | 43.580 | 2.325 | 1.00 | 127.28 | C |
| ATOM | 1841 | ND1 | HIS | A | 260 | −14.146 | 44.860 | 2.569 | 1.00 | 129.49 | N |
| ATOM | 1842 | CD2 | HIS | A | 260 | −12.605 | 43.410 | 3.109 | 1.00 | 127.49 | C |
| ATOM | 1843 | CE1 | HIS | A | 260 | −13.360 | 45.440 | 3.458 | 1.00 | 128.68 | C |
| ATOM | 1844 | NE2 | HIS | A | 260 | −12.417 | 44.582 | 3.802 | 1.00 | 127.34 | N |
| ATOM | 1845 | N | VAL | A | 261 | −12.018 | 40.399 | 2.330 | 1.00 | 114.47 | N |
| ATOM | 1846 | CA | VAL | A | 261 | −11.628 | 39.283 | 3.188 | 1.00 | 110.47 | C |
| ATOM | 1847 | C | VAL | A | 261 | −10.639 | 39.772 | 4.241 | 1.00 | 106.54 | C |
| ATOM | 1848 | O | VAL | A | 261 | −9.663 | 40.459 | 3.923 | 1.00 | 106.79 | O |
| ATOM | 1849 | CB | VAL | A | 261 | −11.034 | 38.123 | 2.361 | 1.00 | 108.32 | C |
| ATOM | 1850 | CG1 | VAL | A | 261 | −9.933 | 38.625 | 1.434 | 1.00 | 103.49 | C |
| ATOM | 1851 | CG2 | VAL | A | 261 | −10.516 | 37.033 | 3.274 | 1.00 | 108.20 | C |
| ATOM | 1852 | N | GLN | A | 262 | −10.896 | 39.411 | 5.496 | 1.00 | 101.20 | N |
| ATOM | 1853 | CA | GLN | A | 262 | −10.034 | 39.753 | 6.618 | 1.00 | 95.74 | C |
| ATOM | 1854 | C | GLN | A | 262 | −9.176 | 38.552 | 6.998 | 1.00 | 87.45 | C |
| ATOM | 1855 | O | GLN | A | 262 | −9.665 | 37.419 | 7.045 | 1.00 | 85.78 | O |
| ATOM | 1856 | CB | GLN | A | 262 | −10.863 | 40.201 | 7.827 | 1.00 | 100.25 | C |
| ATOM | 1857 | CG | GLN | A | 262 | −11.751 | 41.419 | 7.576 | 1.00 | 106.69 | C |
| ATOM | 1858 | CD | GLN | A | 262 | −13.224 | 41.146 | 7.850 | 1.00 | 108.50 | C |
| ATOM | 1859 | OE1 | GLN | A | 262 | −13.903 | 40.492 | 7.058 | 1.00 | 111.86 | O |
| ATOM | 1860 | NE2 | GLN | A | 262 | −13.722 | 41.652 | 8.974 | 1.00 | 105.47 | N |
| ATOM | 1861 | N | HIS | A | 263 | −7.894 | 38.806 | 7.263 | 1.00 | 79.03 | N |
| ATOM | 1862 | CA | HIS | A | 263 | −6.993 | 37.766 | 7.744 | 1.00 | 71.30 | C |
| ATOM | 1863 | C | HIS | A | 263 | −5.856 | 38.409 | 8.527 | 1.00 | 68.66 | C |
| ATOM | 1864 | O | HIS | A | 263 | −5.337 | 39.457 | 8.129 | 1.00 | 71.83 | O |
| ATOM | 1865 | CB | HIS | A | 263 | −6.432 | 36.918 | 6.594 | 1.00 | 63.45 | C |
| ATOM | 1866 | CG | HIS | A | 263 | −5.640 | 35.732 | 7.055 | 1.00 | 63.73 | C |
| ATOM | 1867 | ND1 | HIS | A | 263 | −4.261 | 35.710 | 7.053 | 1.00 | 63.60 | N |

TABLE 8-continued

| | | | | | | | | | | | |
|---|---|---|---|---|---|---|---|---|---|---|---|
| ATOM | 1868 | CD2 | HIS | A | 263 | −6.034 | 34.534 | 7.549 | 1.00 | 61.03 | C |
| ATOM | 1869 | CE1 | HIS | A | 263 | −3.841 | 34.546 | 7.518 | 1.00 | 62.78 | C |
| ATOM | 1870 | NE2 | HIS | A | 263 | −4.897 | 33.816 | 7.829 | 1.00 | 59.89 | N |
| ATOM | 1871 | N | GLU | A | 264 | −5.471 | 37.759 | 9.632 | 1.00 | 61.10 | N |
| ATOM | 1872 | CA | GLU | A | 264 | −4.443 | 38.296 | 10.520 | 1.00 | 63.67 | C |
| ATOM | 1873 | C | GLU | A | 264 | −3.132 | 38.563 | 9.790 | 1.00 | 70.01 | C |
| ATOM | 1874 | O | GLU | A | 264 | −2.394 | 39.483 | 10.159 | 1.00 | 79.70 | O |
| ATOM | 1875 | CB | GLU | A | 264 | −4.213 | 37.330 | 11.686 | 1.00 | 64.61 | C |
| ATOM | 1876 | CG | GLU | A | 264 | −3.042 | 37.691 | 12.591 | 1.00 | 71.40 | C |
| ATOM | 1877 | CD | GLU | A | 264 | −2.774 | 36.638 | 13.649 | 0.00 | 71.26 | C |
| ATOM | 1878 | OE1 | GLU | A | 264 | −2.417 | 37.009 | 14.788 | 1.00 | 71.33 | O |
| ATOM | 1879 | OE2 | GLU | A | 264 | −2.924 | 35.438 | 13.341 | 1.00 | 71.13 | O |
| ATOM | 1880 | N | GLY | A | 265 | −2.824 | 37.782 | 8.760 | 1.00 | 67.57 | N |
| ATOM | 1881 | CA | GLY | A | 265 | −1.586 | 37.946 | 8.026 | 1.00 | 67.82 | C |
| ATOM | 1882 | C | GLY | A | 265 | −1.580 | 39.035 | 6.977 | 1.00 | 81.53 | C |
| ATOM | 1883 | O | GLY | A | 265 | −0.593 | 39.178 | 6.249 | 1.00 | 81.67 | O |
| ATOM | 1884 | N | LEU | A | 266 | −2.668 | 39.812 | 6.867 | 1.00 | 84.59 | N |
| ATOM | 1885 | CA | LEU | A | 266 | −2.751 | 40.927 | 5.930 | 1.00 | 87.22 | C |
| ATOM | 1886 | C | LEU | A | 266 | −2.560 | 42.239 | 6.671 | 1.00 | 87.51 | C |
| ATOM | 1887 | O | LEU | A | 266 | −3.166 | 42.431 | 7.736 | 1.00 | 87.48 | O |
| ATOM | 1888 | CB | LEU | A | 266 | −4.103 | 40.933 | 5.221 | 1.00 | 84.80 | C |
| ATOM | 1889 | CG | LEU | A | 266 | −4.477 | 39.752 | 4.326 | 1.00 | 80.17 | C |
| ATOM | 1890 | CD1 | LEU | A | 266 | −5.981 | 39.719 | 4.104 | 1.00 | 84.16 | C |
| ATOM | 1891 | CD2 | LEU | A | 266 | −3.745 | 39.831 | 2.999 | 1.00 | 71.86 | C |
| ATOM | 1892 | N | PRO | A | 267 | −1.732 | 43.155 | 6.160 | 1.00 | 88.29 | N |
| ATOM | 1893 | CA | PRO | A | 267 | −1.650 | 44.488 | 6.787 | 1.00 | 88.08 | C |
| ATOM | 1894 | C | PRO | A | 267 | −2.984 | 45.209 | 6.813 | 1.00 | 86.26 | C |
| ATOM | 1895 | O | PRO | A | 267 | −3.350 | 45.802 | 7.836 | 1.00 | 80.78 | O |
| ATOM | 1896 | CB | PRO | A | 267 | −0.625 | 45.224 | 5.912 | 1.00 | 87.97 | C |
| ATOM | 1897 | CG | PRO | A | 267 | 0.169 | 44.145 | 5.254 | 1.00 | 89.82 | C |
| ATOM | 1898 | CD | PRO | A | 267 | −0.789 | 43.009 | 5.039 | 1.00 | 89.48 | C |
| ATOM | 1899 | N | LYS | A | 268 | −3.727 | 45.162 | 5.707 | 1.00 | 90.84 | N |
| ATOM | 1900 | CA | LYS | A | 268 | −5.056 | 45.737 | 5.603 | 1.00 | 93.16 | C |
| ATOM | 1901 | C | LYS | A | 268 | −5.903 | 44.820 | 4.729 | 1.00 | 89.28 | C |
| ATOM | 1902 | O | LYS | A | 268 | −5.390 | 44.238 | 3.758 | 1.00 | 81.30 | O |
| ATOM | 1903 | CB | LYS | A | 268 | −5.035 | 47.161 | 5.018 | 1.00 | 96.08 | C |
| ATOM | 1904 | CG | LYS | A | 268 | −4.459 | 47.278 | 3.614 | 1.00 | 98.81 | C |
| ATOM | 1905 | CD | LYS | A | 268 | −2.943 | 47.380 | 3.628 | 1.00 | 98.53 | C |
| ATOM | 1906 | CE | LYS | A | 268 | −2.380 | 47.266 | 2.224 | 1.00 | 100.36 | C |
| ATOM | 1907 | NZ | LYS | A | 268 | −0.894 | 47.268 | 2.226 | 1.00 | 100.80 | N |
| ATOM | 1908 | N | PRO | A | 269 | −7.200 | 44.662 | 5.053 | 1.00 | 92.01 | N |
| ATOM | 1909 | CA | PRO | A | 269 | −8.133 | 43.744 | 4.387 | 1.00 | 91.96 | C |
| ATOM | 1910 | C | PRO | A | 269 | −8.166 | 43.869 | 2.865 | 1.00 | 94.89 | C |
| ATOM | 1911 | O | PRO | A | 269 | −7.897 | 44.945 | 2.337 | 1.00 | 99.32 | O |
| ATOM | 1912 | CB | PRO | A | 269 | −9.484 | 44.138 | 4.986 | 1.00 | 92.61 | C |
| ATOM | 1913 | CG | PRO | A | 269 | −9.149 | 44.650 | 6.339 | 1.00 | 91.97 | C |
| ATOM | 1914 | CD | PRO | A | 269 | −7.844 | 45.372 | 6.175 | 1.00 | 92.65 | C |
| TER | 1915 | | PRO | A | 269 | | | | | | |
| HETATM | 1916 | C1 | GOL | A | 301 | 5.139 | 21.654 | 32.553 | 1.00 | 47.63 | C |
| HETATM | 1917 | C2 | GOL | A | 301 | 6.577 | 22.197 | 32.388 | 1.00 | 47.31 | C |
| HETATM | 1918 | C3 | GOL | A | 301 | 6.735 | 22.400 | 30.864 | 1.00 | 37.68 | C |
| HETATM | 1919 | O1 | GOL | A | 301 | 5.133 | 20.872 | 33.704 | 1.00 | 55.97 | O |
| HETATM | 1920 | O2 | GOL | A | 301 | 7.519 | 21.326 | 32.919 | 1.00 | 53.94 | O |
| HETATM | 1921 | O3 | GOL | A | 301 | 8.041 | 22.835 | 30.627 | 1.00 | 48.68 | O |
| ATOM | 1922 | N | GLY | P | 1 | 1.666 | 19.111 | 26.812 | 1.00 | 25.12 | N |
| ATOM | 1923 | CA | GLY | P | 1 | 1.566 | 17.958 | 27.693 | 1.00 | 25.06 | C |
| ATOM | 1924 | C | GLY | P | 1 | 0.154 | 17.715 | 28.221 | 1.00 | 25.44 | C |
| ATOM | 1925 | O | GLY | P | 1 | −0.560 | 18.650 | 28.602 | 1.00 | 28.21 | O |
| ATOM | 1926 | N | VAL | P | 2 | −0.226 | 16.436 | 28.225 | 1.00 | 23.05 | N |
| ATOM | 1927 | C | VAL | P | 2 | −1.647 | 16.188 | 30.209 | 1.00 | 23.01 | C |
| ATOM | 1928 | O | VAL | P | 2 | −0.654 | 16.241 | 30.944 | 1.00 | 23.26 | O |
| ATOM | 1929 | CA | AVAL | P | 2 | −1.560 | 16.078 | 28.687 | 0.44 | 25.45 | C |
| ATOM | 1930 | CB | AVAL | P | 2 | −1.972 | 14.676 | 28.205 | 0.44 | 25.93 | C |
| ATOM | 1931 | CG1 | AVAL | P | 2 | −2.053 | 14.621 | 26.684 | 0.44 | 27.72 | C |
| ATOM | 1932 | CG2 | AVAL | P | 2 | −1.013 | 13.658 | 28.704 | 0.44 | 24.49 | C |
| ATOM | 1933 | CA | BVAL | P | 2 | −1.519 | 15.952 | 28.704 | 0.56 | 25.18 | C |
| ATOM | 1934 | CB | BVAL | P | 2 | −1.632 | 14.456 | 28.339 | 0.56 | 25.91 | C |
| ATOM | 1935 | CG1 | BVAL | P | 2 | −2.709 | 13.716 | 29.117 | 0.56 | 26.58 | C |
| ATOM | 1936 | CG2 | BVAL | P | 2 | −1.829 | 14.274 | 26.815 | 0.56 | 26.13 | C |
| ATOM | 1937 | N | TYR | P | 3 | −2.880 | 16.299 | 30.677 | 1.00 | 23.59 | N |
| ATOM | 1938 | CA | TYR | P | 3 | −3.172 | 16.424 | 32.101 | 1.00 | 25.22 | C |
| ATOM | 1939 | C | TYR | P | 3 | −2.632 | 15.224 | 32.875 | 1.00 | 23.43 | C |
| ATOM | 1940 | O | TYR | P | 3 | −2.747 | 14.079 | 32.429 | 1.00 | 24.58 | O |
| ATOM | 1941 | CB | TYR | P | 3 | −4.687 | 16.535 | 32.271 | 1.00 | 24.77 | C |
| ATOM | 1942 | CG | TYR | P | 3 | −5.165 | 16.601 | 33.693 | 1.00 | 25.09 | C |
| ATOM | 1943 | CD1 | TYR | P | 3 | −4.737 | 17.623 | 34.528 | 1.00 | 22.51 | C |
| ATOM | 1944 | CD2 | TYR | P | 3 | −6.046 | 15.652 | 34.200 | 1.00 | 26.08 | C |
| ATOM | 1945 | CE1 | TYR | P | 3 | −5.177 | 17.724 | 35.822 | 1.00 | 28.17 | C |
| ATOM | 1947 | CZ | TYR | P | 3 | −6.053 | 16.793 | 36.308 | 1.00 | 25.63 | C |
| ATOM | 1948 | OH | TYR | P | 3 | −6.474 | 16.915 | 37.606 | 1.00 | 27.32 | O |

TABLE 8-continued

| | | | | | | | | | | |
|---|---|---|---|---|---|---|---|---|---|---|
| ATOM | 1949 | N | ASP | P | 4 | −1.998 | 15.489 | 34.026 | 1.00 | 25.15 | N |
| ATOM | 1950 | CA | ASP | P | 4 | −1.390 | 14.415 | 34.816 | 1.00 | 26.09 | C |
| ATOM | 1951 | C | ASP | P | 4 | −1.981 | 14.300 | 36.223 | 1.00 | 29.57 | C |
| ATOM | 1952 | O | ASP | P | 4 | −1.346 | 13.727 | 37.108 | 1.00 | 30.69 | O |
| ATOM | 1953 | CB | ASP | P | 4 | 0.128 | 14.601 | 34.910 | 1.00 | 36.45 | C |
| ATOM | 1954 | CG | ASP | P | 4 | 0.861 | 13.300 | 35.274 | 1.00 | 45.54 | C |
| ATOM | 1955 | OD1 | ASP | P | 4 | 0.199 | 12.236 | 35.354 | 1.00 | 42.18 | O |
| ATOM | 1956 | OD2 | ASP | P | 4 | 2.093 | 13.335 | 35.478 | 1.00 | 52.60 | O |
| ATOM | 1957 | N | GLY | P | 5 | −3.185 | 14.825 | 36.463 | 1.00 | 25.47 | N |
| ATOM | 1958 | CA | GLY | P | 5 | −3.815 | 14.720 | 37.764 | 1.00 | 22.63 | C |
| ATOM | 1959 | C | GLY | P | 5 | −4.589 | 13.415 | 37.938 | 1.00 | 27.45 | C |
| ATOM | 1960 | O | GLY | P | 5 | −4.547 | 12.509 | 37.106 | 1.00 | 24.60 | O |
| ATOM | 1961 | N | GLU | P | 6 | −5.266 | 13.311 | 39.082 | 1.00 | 22.11 | N |
| ATOM | 1962 | CA | GLU | P | 6 | −6.010 | 12.101 | 39.410 | 1.00 | 25.31 | C |
| ATOM | 1963 | C | GLU | P | 6 | −7.071 | 11.819 | 38.342 | 1.00 | 23.54 | C |
| ATOM | 1964 | O | GLU | P | 6 | −7.690 | 12.744 | 37.803 | 1.00 | 23.74 | O |
| ATOM | 1965 | CB | GLU | P | 6 | −6.676 | 12.245 | 40.791 | 1.00 | 21.95 | C |
| ATOM | 1966 | CG | GLU | P | 6 | −7.454 | 10.999 | 41.233 | 1.00 | 27.58 | C |
| ATOM | 1967 | CD | GLU | P | 6 | −8.162 | 11.169 | 42.572 | 1.00 | 27.98 | C |
| ATOM | 1968 | OE1 | GLU | P | 6 | −8.646 | 10.136 | 43.083 | 1.00 | 25.66 | O |
| ATOM | 1969 | OE2 | GLU | P | 6 | −8.224 | 12.304 | 43.112 | 1.00 | 28.11 | O |
| ATOM | 1970 | N | GLU | P | 7 | −7.277 | 10.532 | 38.035 | 1.00 | 20.23 | N |
| ATOM | 1971 | CA | GLU | P | 7 | −8.267 | 10.112 | 37.050 | 1.00 | 23.58 | C |
| ATOM | 1972 | C | GLU | P | 7 | −9.606 | 9.883 | 37.737 | 1.00 | 22.76 | C |
| ATOM | 1973 | O | GLU | P | 7 | −9.658 | 9.299 | 38.821 | 1.00 | 23.14 | O |
| ATOM | 1974 | CB | GLU | P | 7 | −7.837 | 8.820 | 36.356 | 1.00 | 24.52 | C |
| ATOM | 1975 | CG | GLU | P | 7 | −6.582 | 8.890 | 35.472 | 1.00 | 27.60 | C |
| ATOM | 1976 | CD | GLU | P | 7 | −6.873 | 9.435 | 34.083 | 1.00 | 31.74 | C |
| ATOM | 1977 | OE1 | GLU | P | 7 | −5.927 | 9.936 | 33.437 | 1.00 | 39.07 | O |
| ATOM | 1978 | OE2 | GLU | P | 7 | −8.045 | 9.376 | 33.636 | 1.00 | 33.89 | O |
| ATOM | 1979 | N | HIS | P | 8 | −10.696 | 10.307 | 37.083 | 1.00 | 20.87 | N |
| ATOM | 1980 | CA | HIS | P | 8 | −12.043 | 10.201 | 37.655 | 1.00 | 22.24 | C |
| ATOM | 1981 | C | HIS | P | 8 | −13.005 | 9.730 | 36.585 | 1.00 | 24.21 | C |
| ATOM | 1982 | O | HIS | P | 8 | −13.124 | 10.366 | 35.531 | 1.00 | 23.90 | O |
| ATOM | 1983 | CB | HIS | P | 8 | −12.545 | 11.539 | 38.220 | 1.00 | 19.38 | C |
| ATOM | 1984 | CG | HIS | P | 8 | −11.707 | 12.054 | 39.338 | 1.00 | 20.73 | C |
| ATOM | 1985 | ND1 | HIS | P | 8 | −11.825 | 11.590 | 40.631 | 1.00 | 23.63 | N |
| ATOM | 1986 | CD2 | HIS | P | 8 | −10.721 | 12.980 | 39.356 | 1.00 | 19.15 | C |
| ATOM | 1987 | CE1 | HIS | P | 8 | −10.932 | 12.198 | 41.394 | 1.00 | 25.67 | C |
| ATOM | 1988 | NE2 | HIS | P | 8 | −10.254 | 13.050 | 40.643 | 1.00 | 21.67 | N |
| ATOM | 1989 | N | SER | P | 9 | −13.689 | 8.630 | 36.857 | 1.00 | 24.74 | N |
| ATOM | 1990 | CA | SER | P | 9 | −14.762 | 8.236 | 35.968 | 1.00 | 22.14 | C |
| ATOM | 1991 | C | SER | P | 9 | −16.011 | 9.074 | 36.223 | 1.00 | 22.98 | C |
| ATOM | 1992 | O | SER | P | 9 | −16.188 | 9.687 | 37.285 | 1.00 | 25.23 | O |
| ATOM | 1993 | CB | SER | P | 9 | −15.078 | 6.750 | 36.134 | 1.00 | 30.85 | C |
| ATOM | 1994 | OG | SER | P | 9 | −16.110 | 6.531 | 37.073 | 1.00 | 36.65 | O |
| ATOM | 1995 | N | VAL | P | 10 | −16.893 | 9.077 | 35.237 | 1.00 | 26.72 | N |
| ATOM | 1996 | CA | VAL | P | 10 | −18.183 | 9.733 | 35.408 | 1.00 | 28.22 | C |
| ATOM | 1997 | C | VAL | P | 10 | −19.046 | 8.970 | 36.407 | 0.78 | 26.91 | C |
| ATOM | 1998 | O | VAL | P | 10 | −18.703 | 7.852 | 36.848 | 1.00 | 29.65 | O |
| ATOM | 1999 | CB | VAL | P | 10 | −18.916 | 9.880 | 34.070 | 1.00 | 28.42 | C |
| ATOM | 2000 | CG1 | VAL | P | 10 | −18.073 | 10.732 | 33.093 | 1.00 | 29.11 | C |
| ATOM | 2001 | CG2 | VAL | P | 10 | −19.216 | 8.522 | 33.503 | 1.00 | 29.48 | C |
| ATOM | 2002 | OXT | VAL | P | 10 | −20.127 | 9.447 | 36.783 | 1.00 | 28.46 | O |
| TER | 2003 | | VAL | P | 10 | | | | | | |
| END | | | | | | | | | | | |

TABLE 11

| | | | | | | | | | | | |
|---|---|---|---|---|---|---|---|---|---|---|---|
| ATOM | 1 | N | GLY | A | 1 | 21.990 | 37.432 | 19.092 | 1.00 | 52.41 | | N |
| ANISOU | 1 | N | GLY | A | 1 | 7533 | 5079 | 7303 | −275 | −192 | 830 | N |
| ATOM | 2 | CA | GLY | A | 1 | 20.576 | 37.127 | 19.246 | 1.00 | 53.37 | | C |
| ANISOU | 2 | CA | GLY | A | 1 | 7670 | 5235 | 7372 | −164 | −307 | 774 | C |
| ATOM | 3 | C | GLY | A | 1 | 20.286 | 36.089 | 20.318 | 1.00 | 41.14 | | C |
| ANISOU | 3 | C | GLY | A | 1 | 6011 | 3788 | 5830 | −152 | −357 | 624 | C |
| ATOM | 4 | O | GLY | A | 1 | 21.200 | 35.604 | 20.991 | 1.00 | 48.77 | | O |
| ANISOU | 4 | O | GLY | A | 1 | 6892 | 4800 | 6840 | −229 | −312 | 561 | O |
| ATOM | 5 | N | SER | A | 2 | 19.007 | 35.757 | 20.484 | 1.00 | 41.43 | | N |
| ANISOU | 5 | N | SER | A | 2 | 6048 | 3860 | 5834 | −56 | −452 | 572 | N |
| ATOM | 6 | CA | SER | A | 2 | 18.616 | 34.773 | 21.481 | 1.00 | 44.07 | | C |
| ANISOU | 6 | CA | SER | A | 2 | 6286 | 4286 | 6173 | −40 | −495 | 438 | C |
| ATOM | 7 | C | SER | A | 2 | 18.881 | 33.359 | 20.976 | 1.00 | 45.05 | | C |
| ANISOU | 7 | C | SER | A | 2 | 6381 | 4560 | 6176 | −38 | −473 | 424 | C |
| ATOM | 8 | O | SER | A | 2 | 18.971 | 33.108 | 19.772 | 1.00 | 44.28 | | O |
| ANISOU | 8 | O | SER | A | 2 | 6352 | 4501 | 5971 | −19 | −449 | 510 | O |
| ATOM | 9 | CB | SER | A | 2 | 17.140 | 34.932 | 21.836 | 1.00 | 49.95 | | C |
| ANISOU | 9 | CB | SER | A | 2 | 7031 | 5007 | 6941 | 61 | −592 | 391 | C |

TABLE 11-continued

| | | | | | | | | | | | |
|---|---|---|---|---|---|---|---|---|---|---|---|
| ATOM | 10 | OG | SER | A | 2 | 16.922 | 36.184 | 22.465 | 1.00 | 54.08 | O |
| ANISOU | 10 | OG | SER | A | 2 | 7574 | 5387 | 7585 | 62 | −604 | 384 | O |
| ATOM | 11 | N | HIS | A | 3 | 19.002 | 32.426 | 21.919 | 1.00 | 35.64 | N |
| ANISOU | 11 | N | HIS | A | 3 | 5094 | 3448 | 4998 | −56 | −479 | 313 | N |
| ATOM | 12 | CA | HIS | A | 3 | 19.308 | 31.043 | 21.598 | 1.00 | 37.87 | C |
| ANISOU | 12 | CA | HIS | A | 3 | 5341 | 3864 | 5185 | −58 | −454 | 287 | C |
| ATOM | 13 | C | HIS | A | 3 | 18.508 | 30.119 | 22.508 | 1.00 | 35.57 | C |
| ANISOU | 13 | C | HIS | A | 3 | 4975 | 3643 | 4897 | −17 | −516 | 171 | C |
| ATOM | 14 | O | HIS | A | 3 | 17.961 | 30.531 | 23.537 | 1.00 | 35.23 | O |
| ANISOU | 14 | O | HIS | A | 3 | 4898 | 3551 | 4936 | −3 | −557 | 104 | O |
| ATOM | 15 | CB | HIS | A | 3 | 20.813 | 30.770 | 21.733 | 1.00 | 38.09 | C |
| ANISOU | 15 | CB | HIS | A | 3 | 5319 | 3916 | 5236 | −152 | −358 | 295 | C |
| ATOM | 16 | CG | HIS | A | 3 | 21.654 | 31.573 | 20.792 | 1.00 | 38.20 | C |
| ANISOU | 16 | CG | HIS | A | 3 | 5398 | 3867 | 5249 | −198 | −276 | 415 | C |
| ATOM | 17 | ND1 | HIS | A | 3 | 21.839 | 31.220 | 19.471 | 1.00 | 37.41 | N |
| ANISOU | 17 | ND1 | HIS | A | 3 | 5372 | 3813 | 5030 | −178 | −222 | 502 | N |
| ATOM | 18 | CD2 | HIS | A | 3 | 22.353 | 32.719 | 20.976 | 1.00 | 43.01 | C |
| ANISOU | 18 | CD2 | HIS | A | 3 | 6013 | 4365 | 5962 | −266 | −234 | 464 | C |
| ATOM | 19 | CE1 | HIS | A | 3 | 22.623 | 32.110 | 18.885 | 1.00 | 44.56 | C |
| ANISOU | 19 | CE1 | HIS | A | 3 | 6326 | 4640 | 5964 | −230 | −140 | 606 | C |
| ATOM | 20 | NE2 | HIS | A | 3 | 22.943 | 33.034 | 19.775 | 1.00 | 45.32 | N |
| ANISOU | 20 | NE2 | HIS | A | 3 | 6378 | 4638 | 6203 | −286 | −148 | 586 | N |
| ATOM | 21 | N | SER | A | 4 | 18.452 | 28.846 | 22.126 | 1.00 | 33.41 | N |
| ANISOU | 21 | N | SER | A | 4 | 4681 | 3482 | 4532 | 2 | −514 | 146 | N |
| ATOM | 22 | CA | SER | A | 4 | 17.712 | 27.873 | 22.903 | 1.00 | 34.85 | C |
| ANISOU | 22 | CA | SER | A | 4 | 4795 | 3732 | 4715 | 38 | −564 | 45 | C |
| ATOM | 23 | C | SER | A | 4 | 18.413 | 26.527 | 22.788 | 1.00 | 34.16 | C |
| ANISOU | 23 | C | SER | A | 4 | 4666 | 3751 | 4563 | 10 | −517 | 14 | C |
| ATOM | 24 | O | SER | A | 4 | 19.138 | 26.272 | 21.824 | 1.00 | 36.63 | O |
| ANISOU | 24 | O | SER | A | 4 | 5018 | 4093 | 4804 | −10 | −459 | 74 | O |
| ATOM | 25 | CB | SER | A | 4 | 16.268 | 27.764 | 22.405 | 1.00 | 39.60 | C |
| ANISOU | 25 | CB | SER | A | 4 | 5425 | 4342 | 5280 | 125 | −651 | 47 | C |
| ATOM | 26 | OG | SER | A | 4 | 16.249 | 27.134 | 21.136 | 1.00 | 42.10 | O |
| ANISOU | 26 | OG | SER | A | 4 | 5800 | 4720 | 5477 | 147 | −656 | 98 | O |
| ATOM | 27 | N | MET | A | 5 | 18.229 | 25.692 | 23.803 | 1.00 | 33.49 | N |
| ANISOU | 27 | N | MET | A | 5 | 4503 | 3716 | 4505 | 10 | −533 | −79 | N |
| ATOM | 28 | CA | MET | A | 5 | 18.590 | 24.281 | 23.727 | 1.00 | 32.91 | C |
| ANISOU | 28 | CA | MET | A | 5 | 4390 | 3742 | 4372 | 4 | −506 | −117 | C |
| ATOM | 29 | C | MET | A | 5 | 17.335 | 23.495 | 24.039 | 1.00 | 34.10 | C |
| ANISOU | 29 | C | MET | A | 5 | 4513 | 3935 | 4508 | 62 | −574 | −184 | C |
| ATOM | 30 | O | MET | A | 5 | 16.649 | 23.794 | 25.021 | 1.00 | 33.89 | O |
| ANISOU | 30 | O | MET | A | 5 | 4449 | 3876 | 4550 | 79 | −611 | −235 | O |
| ATOM | 31 | CB | MET | A | 5 | 19.695 | 23.895 | 24.707 | 1.00 | 32.69 | C |
| ANISOU | 31 | CB | MET | A | 5 | 4287 | 3736 | 4398 | −57 | −457 | −159 | C |
| ATOM | 32 | CG | MET | A | 5 | 20.116 | 22.408 | 24.545 | 1.00 | 26.41 | C |
| ANISOU | 32 | CG | MET | A | 5 | 3453 | 3037 | 3546 | −57 | −422 | −190 | C |
| ATOM | 33 | SD | MET | A | 5 | 21.521 | 21.979 | 25.540 | 1.00 | 34.66 | S |
| ANISOU | 33 | SD | MET | A | 5 | 4408 | 4106 | 4656 | −123 | −371 | −219 | S |
| ATOM | 34 | CE | MET | A | 5 | 20.789 | 21.814 | 27.172 | 1.00 | 34.33 | C |
| ANISOU | 34 | CE | MET | A | 5 | 4318 | 4059 | 4668 | −112 | −439 | −315 | C |
| ATOM | 35 | N | ARG | A | 6 | 17.018 | 22.518 | 23.202 | 1.00 | 31.19 | N |
| ANISOU | 35 | N | ARG | A | 6 | 4166 | 3632 | 4054 | 91 | −587 | −184 | N |
| ATOM | 36 | CA | ARG | A | 6 | 15.804 | 21.745 | 23.403 | 1.00 | 30.98 | C |
| ANISOU | 36 | CA | ARG | A | 6 | 4108 | 3641 | 4024 | 140 | −655 | −243 | C |
| ATOM | 37 | C | ARG | A | 6 | 16.099 | 20.280 | 23.166 | 1.00 | 33.42 | C |
| ANISOU | 37 | C | ARG | A | 6 | 4397 | 4031 | 4269 | 133 | −631 | −282 | C |
| ATOM | 38 | O | ARG | A | 6 | 16.790 | 19.931 | 22.205 | 1.00 | 32.47 | O |
| ANISOU | 38 | O | ARG | A | 6 | 4329 | 3941 | 4067 | 121 | −589 | −245 | O |
| ATOM | 39 | CB | ARG | A | 6 | 14.689 | 22.174 | 22.450 | 1.00 | 37.15 | C |
| ANISOU | 39 | CB | ARG | A | 6 | 4944 | 4399 | 4770 | 197 | −737 | −203 | C |
| ATOM | 40 | CG | ARG | A | 6 | 14.418 | 23.672 | 22.440 | 1.00 | 49.60 | C |
| ANISOU | 40 | CG | ARG | A | 6 | 6556 | 5885 | 6403 | 213 | −760 | −148 | C |
| ATOM | 41 | CD | ARG | A | 6 | 13.048 | 23.969 | 22.982 | 1.00 | 57.16 | C |
| ANISOU | 41 | CD | ARG | A | 6 | 7469 | 6810 | 7440 | 269 | −836 | −183 | C |
| ATOM | 42 | NE | ARG | A | 6 | 12.701 | 25.376 | 22.828 | 1.00 | 57.71 | N |
| ANISOU | 42 | NE | ARG | A | 6 | 7580 | 6787 | 7562 | 298 | −864 | −125 | N |
| ATOM | 43 | CZ | ARG | A | 6 | 13.023 | 26.326 | 23.702 | 1.00 | 58.98 | C |
| ANISOU | 43 | CZ | ARG | A | 6 | 7730 | 6872 | 7808 | 277 | −825 | −133 | C |
| ATOM | 44 | NH1 | ARG | A | 6 | 12.644 | 27.579 | 23.476 | 1.00 | 62.72 | N |
| ANISOU | 44 | NH1 | ARG | A | 6 | 8247 | 7252 | 8330 | 309 | −853 | −79 | N |
| ATOM | 45 | NH2 | ARG | A | 6 | 13.726 | 26.026 | 24.795 | 1.00 | 39.81 | N |
| ANISOU | 45 | NH2 | ARG | A | 6 | 5254 | 4458 | 5414 | 226 | −765 | −196 | N |
| ATOM | 46 | N | TYR | A | 7 | 15.563 | 19.435 | 24.032 | 1.00 | 28.03 | N |
| ANISOU | 46 | N | TYR | A | 7 | 3645 | 3379 | 3624 | 142 | −650 | −356 | N |
| ATOM | 47 | CA | TYR | A | 7 | 15.568 | 17.996 | 23.815 | 1.00 | 31.05 | C |
| ANISOU | 47 | CA | TYR | A | 7 | 4012 | 3828 | 3958 | 145 | −642 | −399 | C |
| ATOM | 48 | C | TYR | A | 7 | 14.141 | 17.514 | 23.593 | 1.00 | 36.98 | C |
| ANISOU | 48 | C | TYR | A | 7 | 4751 | 4590 | 4711 | 189 | −728 | −434 | C |
| ATOM | 49 | O | TYR | A | 7 | 13.207 | 17.971 | 24.260 | 1.00 | 32.40 | O |
| ANISOU | 49 | O | TYR | A | 7 | 4126 | 3978 | 4207 | 212 | −771 | −454 | O |

TABLE 11-continued

| | | | | | | | | | | | |
|---|---|---|---|---|---|---|---|---|---|---|---|
| ATOM | 50 | CB | TYR | A | 7 | 16.194 | 17.263 | 24.996 | 1.00 | 29.34 | C |
| ANISOU | 50 | CB | TYR | A | 7 | 3723 | 3637 | 3787 | 114 | −591 | −449 | C |
| ATOM | 51 | CG | TYR | A | 7 | 17.695 | 17.382 | 25.070 | 1.00 | 30.42 | C |
| ANISOU | 51 | CG | TYR | A | 7 | 3858 | 3780 | 3921 | 69 | −514 | −419 | C |
| ATOM | 52 | CD1 | TYR | A | 7 | 18.510 | 16.501 | 24.366 | 1.00 | 26.79 | C |
| ANISOU | 52 | CD1 | TYR | A | 7 | 3413 | 3365 | 3403 | 60 | −459 | −409 | C |
| ATOM | 53 | CD2 | TYR | A | 7 | 18.305 | 18.372 | 25.844 | 1.00 | 33.35 | C |
| ANISOU | 53 | CD2 | TYR | A | 7 | 4208 | 4107 | 4357 | 35 | −495 | −403 | C |
| ATOM | 54 | CE1 | TYR | A | 7 | 19.907 | 16.606 | 24.412 | 1.00 | 32.23 | C |
| ANISOU | 54 | CE1 | TYR | A | 7 | 4082 | 4057 | 4106 | 21 | −381 | −376 | C |
| ATOM | 55 | CE2 | TYR | A | 7 | 19.699 | 18.482 | 25.908 | 1.00 | 32.98 | C |
| ANISOU | 55 | CE2 | TYR | A | 7 | 4142 | 4063 | 4325 | −12 | −432 | −373 | C |
| ATOM | 56 | CZ | TYR | A | 7 | 20.492 | 17.583 | 25.196 | 1.00 | 33.47 | C |
| ANISOU | 56 | CZ | TYR | A | 7 | 4205 | 4174 | 4339 | −18 | −373 | −357 | C |
| ATOM | 57 | OH | TYR | A | 7 | 21.868 | 17.660 | 25.252 | 1.00 | 32.67 | O |
| ANISOU | 57 | OH | TYR | A | 7 | 4068 | 4076 | 4270 | −61 | −305 | −325 | O |
| ATOM | 58 | N | PHE | A | 8 | 13.986 | 16.604 | 22.638 | 1.00 | 31.95 | N |
| ANISOU | 58 | N | PHE | A | 8 | 4151 | 3994 | 3994 | 199 | −750 | −443 | N |
| ATOM | 59 | CA | PHE | A | 8 | 12.709 | 15.999 | 22.286 | 1.00 | 33.37 | C |
| ANISOU | 59 | CA | PHE | A | 8 | 4318 | 4188 | 4173 | 232 | −841 | −480 | C |
| ATOM | 60 | C | PHE | A | 8 | 12.846 | 14.494 | 22.411 | 1.00 | 34.83 | C |
| ANISOU | 60 | C | PHE | A | 8 | 4476 | 4419 | 4338 | 216 | −818 | −542 | C |
| ATOM | 61 | O | PHE | A | 8 | 13.834 | 13.924 | 21.937 | 1.00 | 33.97 | O |
| ANISOU | 61 | O | PHE | A | 8 | 4413 | 4338 | 4157 | 198 | −756 | −538 | O |
| ATOM | 62 | CB | PHE | A | 8 | 12.303 | 16.360 | 20.855 | 1.00 | 31.30 | C |
| ANISOU | 62 | CB | PHE | A | 8 | 4150 | 3923 | 3821 | 260 | −915 | −434 | C |
| ATOM | 63 | CG | PHE | A | 8 | 12.283 | 17.839 | 20.593 | 1.00 | 34.15 | C |
| ANISOU | 63 | CG | PHE | A | 8 | 4553 | 4230 | 4191 | 277 | −933 | −359 | C |
| ATOM | 64 | CD1 | PHE | A | 8 | 13.455 | 18.520 | 20.307 | 1.00 | 41.28 | C |
| ANISOU | 64 | CD1 | PHE | A | 8 | 5517 | 5117 | 5051 | 251 | −851 | −298 | C |
| ATOM | 65 | CD2 | PHE | A | 8 | 11.097 | 18.542 | 20.624 | 1.00 | 36.25 | C |
| ANISOU | 65 | CD2 | PHE | A | 8 | 4795 | 4458 | 4520 | 319 | −1027 | −346 | C |
| ATOM | 66 | CE1 | PHE | A | 8 | 13.435 | 19.884 | 20.057 | 1.00 | 43.03 | C |
| ANISOU | 66 | CE1 | PHE | A | 8 | 5782 | 5280 | 5288 | 264 | −864 | −226 | C |
| ATOM | 67 | CE2 | PHE | A | 8 | 11.076 | 19.909 | 20.380 | 1.00 | 39.09 | C |
| ANISOU | 67 | CE2 | PHE | A | 8 | 5198 | 4759 | 4894 | 340 | −1042 | −274 | C |
| ATOM | 68 | CZ | PHE | A | 8 | 12.240 | 20.570 | 20.090 | 1.00 | 39.97 | C |
| ANISOU | 68 | CZ | PHE | A | 8 | 5379 | 4850 | 4958 | 310 | −961 | −214 | C |
| ATOM | 69 | N | PHE | A | 9 | 11.863 | 13.862 | 23.054 | 1.00 | 31.95 | N |
| ANISOU | 69 | N | PHE | A | 9 | 4038 | 4058 | 4046 | 225 | −859 | −596 | N |
| ATOM | 70 | CA | PHE | A | 9 | 11.865 | 12.428 | 23.334 | 1.00 | 31.83 | C |
| ANISOU | 70 | CA | PHE | A | 9 | 3988 | 4073 | 4034 | 208 | −838 | −656 | C |
| ATOM | 71 | C | PHE | A | 9 | 10.533 | 11.851 | 22.899 | 1.00 | 35.40 | C |
| ANISOU | 71 | C | PHE | A | 9 | 4416 | 4525 | 4509 | 225 | −938 | −694 | C |
| ATOM | 72 | O | PHE | A | 9 | 9.490 | 12.408 | 23.237 | 1.00 | 32.78 | O |
| ANISOU | 72 | O | PHE | A | 9 | 4028 | 4169 | 4259 | 246 | −996 | −692 | O |
| ATOM | 73 | CB | PHE | A | 9 | 12.070 | 12.158 | 24.831 | 1.00 | 25.79 | C |
| ANISOU | 73 | CB | PHE | A | 9 | 3140 | 3304 | 3354 | 191 | −773 | −684 | C |
| ATOM | 74 | CG | PHE | A | 9 | 13.305 | 12.824 | 25.408 | 1.00 | 31.52 | C |
| ANISOU | 74 | CG | PHE | A | 9 | 3876 | 4025 | 4077 | 171 | −695 | −651 | C |
| ATOM | 75 | CD1 | PHE | A | 9 | 13.238 | 14.108 | 25.929 | 1.00 | 30.95 | C |
| ANISOU | 75 | CD1 | PHE | A | 9 | 3796 | 3915 | 4049 | 175 | −697 | −622 | C |
| ATOM | 76 | CD2 | PHE | A | 9 | 14.521 | 12.164 | 25.423 | 1.00 | 29.43 | C |
| ANISOU | 76 | CD2 | PHE | A | 9 | 3623 | 3786 | 3773 | 148 | −625 | −650 | C |
| ATOM | 77 | CE1 | PHE | A | 9 | 14.371 | 14.713 | 26.451 | 1.00 | 27.93 | C |
| ANISOU | 77 | CE1 | PHE | A | 9 | 3420 | 3522 | 3671 | 148 | −638 | −597 | C |
| ATOM | 78 | CE2 | PHE | A | 9 | 15.649 | 12.760 | 25.941 | 1.00 | 33.45 | C |
| ANISOU | 78 | CE2 | PHE | A | 9 | 4127 | 4289 | 4293 | 125 | −566 | −619 | C |
| ATOM | 79 | CZ | PHE | A | 9 | 15.576 | 14.040 | 26.459 | 1.00 | 34.68 | C |
| ANISOU | 79 | CZ | PHE | A | 9 | 4277 | 4408 | 4492 | 121 | −577 | −594 | C |
| ATOM | 80 | N | THR | A | 10 | 10.567 | 10.755 | 22.142 | 1.00 | 29.89 | N |
| ANISOU | 80 | N | THR | A | 10 | 3759 | 3852 | 3747 | 216 | −958 | −730 | N |
| ATOM | 81 | CA | THR | A | 10 | 9.357 | 10.050 | 21.727 | 1.00 | 28.68 | C |
| ANISOU | 81 | CA | THR | A | 10 | 3580 | 3697 | 3621 | 220 | −1061 | −776 | C |
| ATOM | 82 | C | THR | A | 10 | 9.525 | 8.580 | 22.085 | 1.00 | 34.14 | C |
| ANISOU | 82 | C | THR | A | 10 | 4244 | 4399 | 4328 | 193 | −1017 | −838 | C |
| ATOM | 83 | O | THR | A | 10 | 10.557 | 7.989 | 21.765 | 1.00 | 33.56 | O |
| ANISOU | 83 | O | THR | A | 10 | 4233 | 4342 | 4176 | 182 | −949 | −846 | O |
| ATOM | 84 | CB | THR | A | 10 | 9.113 | 10.175 | 20.220 | 1.00 | 34.31 | C |
| ANISOU | 84 | CB | THR | A | 10 | 4397 | 4419 | 4222 | 236 | −1158 | −763 | C |
| ATOM | 85 | OG1 | THR | A | 10 | 9.070 | 11.558 | 19.835 | 1.00 | 35.97 | O |
| ANISOU | 85 | OG1 | THR | A | 10 | 4646 | 4613 | 4408 | 264 | −1191 | −693 | O |
| ATOM | 86 | CG2 | THR | A | 10 | 7.803 | 9.496 | 19.831 | 1.00 | 31.80 | C |
| ANISOU | 86 | CG2 | THR | A | 10 | 4041 | 4095 | 3947 | 236 | −1286 | −814 | C |
| ATOM | 87 | N | SER | A | 11 | 8.526 | 7.995 | 22.751 | 1.00 | 33.81 | N |
| ANISOU | 87 | N | SER | A | 11 | 4108 | 4343 | 4396 | 183 | −1049 | −879 | N |
| ATOM | 88 | CA | SER | A | 11 | 8.487 | 6.554 | 22.970 | 1.00 | 34.75 | C |
| ANISOU | 88 | CA | SER | A | 11 | 4204 | 4460 | 4539 | 156 | −1025 | −938 | C |
| ATOM | 89 | C | SER | A | 11 | 7.165 | 6.025 | 22.450 | 1.00 | 34.57 | C |
| ANISOU | 89 | C | SER | A | 11 | 4144 | 4422 | 4569 | 147 | −1145 | −981 | C |

TABLE 11-continued

| | | | | | | | | | | | |
|---|---|---|---|---|---|---|---|---|---|---|---|
| ATOM | 90 | O | SER | A | 11 | 6.104 | 6.598 | 22.740 | 1.00 | 30.47 | O |
| ANISOU | 90 | O | SER | A | 11 | 3543 | 3889 | 4147 | 159 | −1207 | −970 | O |
| ATOM | 91 | CB | SER | A | 11 | 8.654 | 6.171 | 24.443 | 1.00 | 31.28 | C |
| ANISOU | 91 | CB | SER | A | 11 | 3681 | 4012 | 4193 | 143 | −928 | −943 | C |
| ATOM | 92 | OG | SER | A | 11 | 9.930 | 6.513 | 24.937 | 1.00 | 42.30 | O |
| ANISOU | 92 | OG | SER | A | 11 | 5108 | 5422 | 5543 | 145 | −830 | −910 | O |
| ATOM | 93 | N | VAL | A | 12 | 7.227 | 4.933 | 21.691 | 1.00 | 32.22 | N |
| ANISOU | 93 | N | VAL | A | 12 | 3903 | 4124 | 4216 | 127 | −1178 | −1033 | N |
| ATOM | 94 | CA | VAL | A | 12 | 6.059 | 4.362 | 21.025 | 1.00 | 29.89 | C |
| ANISOU | 94 | CA | VAL | A | 12 | 3587 | 3811 | 3957 | 110 | −1311 | −1083 | C |
| ATOM | 95 | C | VAL | A | 12 | 5.965 | 2.904 | 21.452 | 1.00 | 37.26 | C |
| ANISOU | 95 | C | VAL | A | 12 | 4484 | 4720 | 4953 | 71 | −1273 | −1146 | C |
| ATOM | 96 | O | VAL | A | 12 | 6.894 | 2.128 | 21.197 | 1.00 | 36.48 | O |
| ANISOU | 96 | O | VAL | A | 12 | 4465 | 4622 | 4772 | 63 | −1206 | −1171 | O |
| ATOM | 97 | CB | VAL | A | 12 | 6.164 | 4.463 | 19.496 | 1.00 | 36.29 | C |
| ANISOU | 97 | CB | VAL | A | 12 | 4531 | 4637 | 4621 | 121 | −1411 | −1093 | C |
| ATOM | 98 | CG1 | VAL | A | 12 | 4.961 | 3.819 | 18.844 | 1.00 | 36.23 | C |
| ANISOU | 98 | CG1 | VAL | A | 12 | 4501 | 4609 | 4654 | 98 | −1566 | −1152 | C |
| ATOM | 99 | CG2 | VAL | A | 12 | 6.322 | 5.910 | 19.040 | 1.00 | 38.69 | C |
| ANISOU | 99 | CG2 | VAL | A | 12 | 4884 | 4959 | 4857 | 161 | −1441 | −1020 | C |
| ATOM | 100 | N | SER | A | 13 | 4.856 | 2.523 | 22.082 | 1.00 | 34.20 | N |
| ANISOU | 100 | N | SER | A | 13 | 3974 | 4305 | 4715 | 48 | −1308 | −1168 | N |
| ATOM | 101 | CA | SER | A | 13 | 4.781 | 1.153 | 22.579 | 1.00 | 39.29 | C |
| ANISOU | 101 | CA | SER | A | 13 | 4582 | 4917 | 5429 | 7 | −1258 | −1218 | C |
| ATOM | 102 | C | SER | A | 13 | 4.522 | 0.166 | 21.442 | 1.00 | 38.98 | C |
| ANISOU | 102 | C | SER | A | 13 | 4615 | 4857 | 5341 | −23 | −1359 | −1291 | C |
| ATOM | 103 | O | SER | A | 13 | 3.955 | 0.496 | 20.396 | 1.00 | 38.11 | O |
| ANISOU | 103 | O | SER | A | 13 | 4543 | 4753 | 5183 | −20 | −1498 | −1308 | O |
| ATOM | 104 | CB | SER | A | 13 | 3.692 | 0.996 | 23.636 | 1.00 | 31.13 | C |
| ANISOU | 104 | CB | SER | A | 13 | 3397 | 3854 | 4578 | −13 | −1246 | −1216 | C |
| ATOM | 105 | OG | SER | A | 13 | 2.425 | 1.166 | 23.031 | 1.00 | 41.18 | O |
| ANISOU | 105 | OG | SER | A | 13 | 4606 | 5115 | 5927 | −25 | −1391 | −1237 | O |
| ATOM | 106 | N | ARG | A | 14 | 4.939 | −1.080 | 21.676 | 1.00 | 39.28 | N |
| ANISOU | 106 | N | ARG | A | 14 | 4673 | 4863 | 5389 | −51 | −1291 | −1336 | N |
| ATOM | 107 | C | ARG | A | 14 | 4.146 | −3.339 | 21.351 | 1.00 | 39.78 | C |
| ANISOU | 107 | C | ARG | A | 14 | 4725 | 4834 | 5556 | −135 | −1353 | −1460 | C |
| ATOM | 108 | O | ARG | A | 14 | 4.804 | −4.239 | 21.901 | 1.00 | 42.37 | O |
| ANISOU | 108 | O | ARG | A | 14 | 5069 | 5132 | 5896 | −144 | −1241 | −1472 | O |
| ATOM | 109 | CA | AARG | A | 14 | 4.840 | −2.157 | 20.691 | 0.63 | 38.15 | C |
| ANISOU | 109 | CA | AARG | A | 14 | 4612 | 4687 | 5195 | −82 | −1364 | −1416 | C |
| ATOM | 110 | CB | AARG | A | 14 | 6.219 | −2.554 | 20.167 | 0.63 | 40.93 | C |
| ANISOU | 110 | CB | AARG | A | 14 | 5109 | 5050 | 5394 | −59 | −1277 | −1430 | C |
| ATOM | 111 | CG | AARG | A | 14 | 6.984 | −1.447 | 19.473 | 0.63 | 41.64 | C |
| ANISOU | 111 | CG | AARG | A | 14 | 5297 | 5194 | 5332 | −12 | −1270 | −1382 | C |
| ATOM | 112 | CD | AARG | A | 14 | 8.468 | −1.727 | 19.532 | 0.63 | 43.67 | C |
| ANISOU | 112 | CD | AARG | A | 14 | 5635 | 5460 | 5495 | 15 | −1124 | −1368 | C |
| ATOM | 113 | NE | AARG | A | 14 | 9.178 | −1.256 | 18.351 | 0.63 | 40.25 | N |
| ANISOU | 113 | NE | AARG | A | 14 | 5344 | 5058 | 4890 | 46 | −1129 | −1362 | N |
| ATOM | 114 | CZ | AARG | A | 14 | 10.475 | −0.975 | 18.333 | 0.63 | 39.20 | C |
| ANISOU | 114 | CZ | AARG | A | 14 | 5269 | 4951 | 4676 | 78 | −1003 | −1322 | C |
| ATOM | 115 | NH1 | AARG | A | 14 | 11.213 | −1.088 | 19.447 | 0.63 | 26.46 | N |
| ANISOU | 115 | NH1 | AARG | A | 14 | 3579 | 3337 | 3137 | 85 | −880 | −1283 | N |
| ATOM | 116 | NH2 | AARG | A | 14 | 11.025 | −0.561 | 17.199 | 0.63 | 40.88 | N |
| ANISOU | 116 | NH2 | AARG | A | 14 | 5613 | 5186 | 4732 | 104 | −1004 | −1315 | N |
| ATOM | 117 | CA | BARG | A | 14 | 4.844 | −2.158 | 20.693 | 0.37 | 38.97 | C |
| ANISOU | 117 | CA | BARG | A | 14 | 4716 | 4791 | 5299 | −82 | −1364 | −1416 | C |
| ATOM | 118 | CB | BARG | A | 14 | 6.226 | −2.556 | 20.172 | 0.37 | 40.59 | C |
| ANISOU | 118 | CB | BARG | A | 14 | 5066 | 5006 | 5350 | −58 | −1276 | −1430 | C |
| ATOM | 119 | CG | BARG | A | 14 | 6.997 | −1.431 | 19.501 | 0.37 | 41.38 | C |
| ANISOU | 119 | CG | BARG | A | 14 | 5262 | 5161 | 5300 | −11 | −1267 | −1380 | C |
| ATOM | 120 | CD | BARG | A | 14 | 6.263 | −0.945 | 18.266 | 0.37 | 42.42 | C |
| ANISOU | 120 | CD | BARG | A | 14 | 5459 | 5305 | 5353 | −10 | −1431 | −1401 | C |
| ATOM | 121 | NE | BARG | A | 14 | 6.922 | 0.193 | 17.634 | 0.37 | 42.23 | N |
| ANISOU | 121 | NE | BARG | A | 14 | 5528 | 5328 | 5189 | 35 | −1421 | −1342 | N |
| ATOM | 122 | CZ | BARG | A | 14 | 6.339 | 0.969 | 16.726 | 0.37 | 41.59 | C |
| ANISOU | 122 | CZ | BARG | A | 14 | 5498 | 5265 | 5039 | 50 | −1555 | −1327 | C |
| ATOM | 123 | NH1 | BARG | A | 14 | 5.089 | 0.725 | 16.357 | 0.37 | 32.68 | N |
| ANISOU | 123 | NH1 | BARG | A | 14 | 4326 | 4117 | 3974 | 24 | −1717 | −1371 | N |
| ATOM | 124 | NH2 | BARG | A | 14 | 7.006 | 1.984 | 16.193 | 0.37 | 37.36 | N |
| ANISOU | 124 | NH2 | BARG | A | 14 | 5053 | 4766 | 4378 | 89 | −1528 | −1265 | N |
| ATOM | 125 | N | PRO | A | 15 | 2.817 | −3.375 | 21.313 | 1.00 | 41.56 | N |
| ANISOU | 125 | N | PRO | A | 15 | 4847 | 5036 | 5909 | −170 | −1467 | −1482 | N |
| ATOM | 126 | CA | PRO | A | 15 | 2.057 | −4.423 | 22.005 | 1.00 | 48.30 | C |
| ANISOU | 126 | CA | PRO | A | 15 | 5592 | 5826 | 6933 | −227 | −1450 | −1514 | C |
| ATOM | 127 | C | PRO | A | 15 | 2.536 | −5.831 | 21.677 | 1.00 | 46.74 | C |
| ANISOU | 127 | C | PRO | A | 15 | 5481 | 5574 | 6705 | −261 | −1423 | −1585 | C |
| ATOM | 128 | O | PRO | A | 15 | 2.658 | −6.213 | 20.511 | 1.00 | 43.90 | O |
| ANISOU | 128 | O | PRO | A | 15 | 5235 | 5203 | 6242 | −271 | −1518 | −1652 | O |
| ATOM | 129 | CB | PRO | A | 15 | 0.629 | −4.192 | 21.501 | 1.00 | 51.08 | C |
| ANISOU | 129 | CB | PRO | A | 15 | 5848 | 6166 | 7394 | −259 | −1621 | −1540 | C |

TABLE 11-continued

| | | | | | | | | | | | | |
|---|---|---|---|---|---|---|---|---|---|---|---|---|
| ATOM | 130 | CG | PRO | A | 15 | 0.580 | −2.712 | 21.241 | 1.00 | 57.57 | | C |
| ANISOU | 130 | CG | PRO | A | 15 | 6671 | 7051 | 8153 | −202 | −1670 | −1480 | C |
| ATOM | 131 | CD | PRO | A | 15 | 1.945 | −2.328 | 20.744 | 1.00 | 46.90 | | C |
| ANISOU | 131 | CD | PRO | A | 15 | 5483 | 5741 | 6595 | −155 | −1609 | −1462 | C |
| ATOM | 132 | N | GLY | A | 16 | 2.797 | −6.609 | 22.728 | 1.00 | 52.05 | | N |
| ANISOU | 132 | N | GLY | A | 16 | 6105 | 6204 | 7465 | −278 | −1291 | −1570 | N |
| ATOM | 133 | CA | GLY | A | 16 | 3.234 | −7.984 | 22.579 | 1.00 | 53.49 | | C |
| ANISOU | 133 | CA | GLY | A | 16 | 6358 | 6321 | 7645 | −307 | −1249 | −1629 | C |
| ATOM | 134 | C | GLY | A | 16 | 4.678 | −8.191 | 22.167 | 1.00 | 47.16 | | C |
| ANISOU | 134 | C | GLY | A | 16 | 5706 | 5535 | 6677 | −260 | −1166 | −1636 | C |
| ATOM | 135 | O | GLY | A | 16 | 5.066 | −9.346 | 21.962 | 1.00 | 51.45 | | O |
| ANISOU | 135 | O | GLY | A | 16 | 6316 | 6017 | 7215 | −277 | −1131 | −1691 | O |
| ATOM | 136 | N | ARG | A | 17 | 5.503 | −7.131 | 22.059 | 1.00 | 40.39 | | N |
| ANISOU | 136 | N | ARG | A | 17 | 4899 | 4752 | 5696 | −201 | −1126 | −1581 | N |
| ATOM | 137 | CA | ARG | A | 17 | 6.822 | −7.234 | 21.423 | 1.00 | 44.62 | | C |
| ANISOU | 137 | CA | ARG | A | 17 | 5575 | 5307 | 6072 | −156 | −1062 | −1592 | C |
| ATOM | 138 | C | ARG | A | 17 | 7.970 | −6.586 | 22.204 | 1.00 | 52.25 | | C |
| ANISOU | 138 | C | ARG | A | 17 | 6535 | 6323 | 6995 | −103 | −926 | −1508 | C |
| ATOM | 139 | O | ARG | A | 17 | 8.930 | −6.118 | 21.591 | 1.00 | 62.10 | | O |
| ANISOU | 139 | O | ARG | A | 17 | 7875 | 7611 | 8110 | −61 | −893 | −1495 | O |
| ATOM | 140 | CB | ARG | A | 17 | 6.800 | −6.607 | 20.031 | 1.00 | 48.42 | | C |
| ANISOU | 140 | CB | ARG | A | 17 | 6165 | 5826 | 6407 | −140 | −1173 | −1624 | C |
| ATOM | 141 | CG | ARG | A | 17 | 5.988 | −7.331 | 18.998 | 1.00 | 59.91 | | C |
| ANISOU | 141 | CG | ARG | A | 17 | 7678 | 7234 | 7852 | −185 | −1315 | −1723 | C |
| ATOM | 142 | CD | ARG | A | 17 | 6.157 | −6.646 | 17.651 | 1.00 | 75.10 | | C |
| ANISOU | 142 | CD | ARG | A | 17 | 9736 | 9203 | 9595 | −157 | −1409 | −1742 | C |
| ATOM | 143 | NE | ARG | A | 17 | 5.767 | −5.237 | 17.699 | 1.00 | 87.19 | | N |
| ANISOU | 143 | NE | ARG | A | 17 | 11211 | 10800 | 11118 | −133 | −1468 | −1668 | N |
| ATOM | 144 | CZ | ARG | A | 17 | 4.548 | −4.786 | 17.410 | 1.00 | 93.10 | | C |
| ANISOU | 144 | CZ | ARG | A | 17 | 11894 | 11553 | 11927 | −158 | −1627 | −1674 | C |
| ATOM | 145 | NH1 | ARG | A | 17 | 3.595 | −5.635 | 17.040 | 1.00 | 99.87 | | N |
| ANISOU | 145 | NH1 | ARG | A | 17 | 12731 | 12356 | 12860 | −215 | −1752 | −1755 | N |
| ATOM | 146 | NH2 | ARG | A | 17 | 4.278 | −3.488 | 17.484 | 1.00 | 80.64 | | N |
| ANISOU | 146 | NH2 | ARG | A | 17 | 10268 | 10027 | 10343 | −127 | −1667 | −1601 | N |
| ATOM | 147 | N | GLY | A | 18 | 7.944 | −6.526 | 23.518 | 1.00 | 53.20 | | N |
| ANISOU | 147 | N | GLY | A | 18 | 6555 | 6442 | 7218 | −104 | −845 | −1449 | N |
| ATOM | 148 | CA | GLY | A | 18 | 9.110 | −5.943 | 24.178 | 1.00 | 47.54 | | C |
| ANISOU | 148 | CA | GLY | A | 18 | 5845 | 5770 | 6449 | −56 | −734 | −1378 | C |
| ATOM | 149 | C | GLY | A | 18 | 9.207 | −4.419 | 24.123 | 1.00 | 42.46 | | C |
| ANISOU | 149 | C | GLY | A | 18 | 5190 | 5197 | 5747 | −28 | −758 | −1323 | C |
| ATOM | 150 | O | GLY | A | 18 | 8.206 | −3.716 | 24.112 | 1.00 | 39.74 | | O |
| ANISOU | 150 | O | GLY | A | 18 | 4787 | 4866 | 5447 | −42 | −838 | −1315 | O |
| ATOM | 151 | N | GLU | A | 19 | 10.455 | −3.909 | 24.093 | 1.00 | 32.94 | | N |
| ANISOU | 151 | N | GLU | A | 19 | 4035 | 4031 | 4450 | 13 | −684 | −1281 | N |
| ATOM | 152 | CA | GLU | A | 19 | 10.726 | −2.515 | 24.428 | 1.00 | 35.75 | | C |
| ANISOU | 152 | CA | GLU | A | 19 | 4365 | 4442 | 4776 | 36 | −675 | −1215 | C |
| ATOM | 153 | C | GLU | A | 19 | 10.130 | −1.544 | 23.408 | 1.00 | 30.57 | | C |
| ANISOU | 153 | C | GLU | A | 19 | 3743 | 3813 | 4058 | 39 | −780 | −1220 | C |
| ATOM | 154 | O | GLU | A | 19 | 9.977 | −1.876 | 22.234 | 1.00 | 33.45 | | O |
| ANISOU | 154 | O | GLU | A | 19 | 4190 | 4170 | 4350 | 35 | −844 | −1269 | O |
| ATOM | 155 | CB | GLU | A | 19 | 12.236 | −2.262 | 24.524 | 1.00 | 43.85 | | C |
| ANISOU | 155 | CB | GLU | A | 19 | 5435 | 5497 | 5729 | 71 | −577 | −1173 | C |
| ATOM | 156 | CG | GLU | A | 19 | 12.928 | −2.225 | 23.173 | 1.00 | 48.98 | | C |
| ANISOU | 156 | CG | GLU | A | 19 | 6194 | 6161 | 6254 | 92 | −578 | −1196 | C |
| ATOM | 157 | CD | GLU | A | 19 | 14.427 | −1.984 | 23.289 | 1.00 | 58.19 | | C |
| ANISOU | 157 | CD | GLU | A | 19 | 7383 | 7354 | 7372 | 125 | −471 | −1150 | C |
| ATOM | 158 | OE1 | GLU | A | 19 | 14.922 | −1.813 | 24.421 | 1.00 | 63.54 | | O |
| ANISOU | 158 | OE1 | GLU | A | 19 | 7992 | 8041 | 8110 | 130 | −415 | −1102 | O |
| ATOM | 159 | OE2 | GLU | A | 19 | 15.104 | −1.966 | 22.243 | 1.00 | 60.47 | | O |
| ANISOU | 159 | OE2 | GLU | A | 19 | 7760 | 7653 | 7562 | 145 | −444 | −1161 | O |
| ATOM | 160 | N | PRO | A | 20 | 9.764 | −0.338 | 23.850 | 1.00 | 35.49 | | N |
| ANISOU | 160 | N | PRO | A | 20 | 4312 | 4465 | 4707 | 48 | −802 | −1170 | N |
| ATOM | 161 | CA | PRO | A | 20 | 9.221 | 0.669 | 22.925 | 1.00 | 34.31 | | C |
| ANISOU | 161 | CA | PRO | A | 20 | 4194 | 4338 | 4503 | 58 | −903 | −1162 | C |
| ATOM | 162 | C | PRO | A | 20 | 10.271 | 1.164 | 21.939 | 1.00 | 32.97 | | C |
| ANISOU | 162 | C | PRO | A | 20 | 4140 | 4199 | 4188 | 85 | −881 | −1142 | C |
| ATOM | 163 | O | PRO | A | 20 | 11.476 | 1.096 | 22.177 | 1.00 | 30.39 | | O |
| ANISOU | 163 | O | PRO | A | 20 | 3841 | 3885 | 3822 | 100 | −777 | −1117 | O |
| ATOM | 164 | CB | PRO | A | 20 | 8.784 | 1.818 | 23.844 | 1.00 | 39.72 | | C |
| ANISOU | 164 | CB | PRO | A | 20 | 4792 | 5038 | 5263 | 69 | −899 | −1107 | C |
| ATOM | 165 | CG | PRO | A | 20 | 8.869 | 1.310 | 25.235 | 1.00 | 43.81 | | C |
| ANISOU | 165 | CG | PRO | A | 20 | 5232 | 5539 | 5875 | 58 | −809 | −1098 | C |
| ATOM | 166 | CD | PRO | A | 20 | 9.745 | 0.101 | 25.256 | 1.00 | 31.00 | | C |
| ANISOU | 166 | CD | PRO | A | 20 | 3654 | 3901 | 4223 | 51 | −738 | −1123 | C |
| ATOM | 167 | N | ARG | A | 21 | 9.799 | 1.696 | 20.821 | 1.00 | 31.15 | | N |
| ANISOU | 167 | N | ARG | A | 21 | 3974 | 3979 | 3882 | 92 | −981 | −1148 | N |
| ATOM | 168 | CA | ARG | A | 21 | 10.682 | 2.487 | 19.972 | 1.00 | 32.60 | | C |
| ANISOU | 168 | CA | ARG | A | 21 | 4262 | 4193 | 3932 | 120 | −955 | −1108 | C |
| ATOM | 169 | C | ARG | A | 21 | 10.929 | 3.817 | 20.671 | 1.00 | 34.86 | | C |
| ANISOU | 169 | C | ARG | A | 21 | 4493 | 4499 | 4253 | 135 | −920 | −1031 | C |

TABLE 11-continued

| | | | | | | | | | | | | |
|---|---|---|---|---|---|---|---|---|---|---|---|---|
| ATOM | 170 | O | ARG | A | 21 | 9.973 | 4.522 | 21.018 | 1.00 | 35.99 | | O |
| ANISOU | 170 | O | ARG | A | 21 | 4569 | 4637 | 4469 | 136 | −992 | −1013 | O |
| ATOM | 171 | CB | ARG | A | 21 | 10.060 | 2.709 | 18.592 | 1.00 | 34.79 | | C |
| ANISOU | 171 | CB | ARG | A | 21 | 4638 | 4475 | 4107 | 126 | −1080 | −1129 | C |
| ATOM | 172 | CG | ARG | A | 21 | 10.936 | 3.564 | 17.665 | 1.00 | 38.07 | | C |
| ANISOU | 172 | CG | ARG | A | 21 | 5173 | 4919 | 4374 | 155 | −1045 | −1078 | C |
| ATOM | 173 | CD | ARG | A | 21 | 12.228 | 2.822 | 17.324 | 1.00 | 42.86 | | C |
| ANISOU | 173 | CD | ARG | A | 21 | 5863 | 5528 | 4895 | 163 | −916 | −1097 | C |
| ATOM | 174 | NE | ARG | A | 21 | 13.104 | 3.559 | 16.410 | 1.00 | 43.55 | | N |
| ANISOU | 174 | NE | ARG | A | 21 | 6065 | 5639 | 4842 | 189 | −861 | −1046 | N |
| ATOM | 175 | CZ | ARG | A | 21 | 12.919 | 3.639 | 15.094 | 1.00 | 46.99 | | C |
| ANISOU | 175 | CZ | ARG | A | 21 | 6641 | 6080 | 5131 | 202 | −923 | −1060 | C |
| ATOM | 176 | NH1 | ARG | A | 21 | 11.868 | 3.051 | 14.527 | 1.00 | 44.27 | | N |
| ANISOU | 176 | NH1 | ARG | A | 21 | 6336 | 5721 | 4763 | 189 | −1061 | −1128 | N |
| ATOM | 177 | NH2 | ARG | A | 21 | 13.776 | 4.317 | 14.344 | 1.00 | 41.05 | | N |
| ANISOU | 177 | NH2 | ARG | A | 21 | 5993 | 5348 | 4256 | 225 | −850 | −1005 | N |
| ATOM | 178 | N | PHE | A | 22 | 12.194 | 4.140 | 20.933 | 1.00 | 31.71 | | N |
| ANISOU | 178 | N | PHE | A | 22 | 4114 | 4116 | 3818 | 146 | −808 | −989 | N |
| ATOM | 179 | CA | PHE | A | 22 | 12.556 | 5.337 | 21.692 | 1.00 | 30.90 | | C |
| ANISOU | 179 | CA | PHE | A | 22 | 3962 | 4024 | 3755 | 153 | −769 | −923 | C |
| ATOM | 180 | C | PHE | A | 22 | 13.544 | 6.167 | 20.885 | 1.00 | 34.96 | | C |
| ANISOU | 180 | C | PHE | A | 22 | 4562 | 4556 | 4165 | 168 | −724 | −870 | C |
| ATOM | 181 | O | PHE | A | 22 | 14.592 | 5.662 | 20.471 | 1.00 | 38.02 | | O |
| ANISOU | 181 | O | PHE | A | 22 | 5003 | 4954 | 4489 | 171 | −640 | −872 | O |
| ATOM | 182 | CB | PHE | A | 22 | 13.154 | 4.984 | 23.053 | 1.00 | 29.81 | | C |
| ANISOU | 182 | CB | PHE | A | 22 | 3742 | 3883 | 3701 | 143 | −678 | −917 | C |
| ATOM | 183 | CG | PHE | A | 22 | 13.722 | 6.176 | 23.797 | 1.00 | 33.29 | | C |
| ANISOU | 183 | CG | PHE | A | 22 | 4149 | 4332 | 4169 | 146 | −636 | −857 | C |
| ATOM | 184 | CD1 | PHE | A | 22 | 12.880 | 7.101 | 24.405 | 1.00 | 34.59 | | C |
| ANISOU | 184 | CD1 | PHE | A | 22 | 4260 | 4484 | 4398 | 148 | −683 | −839 | C |
| ATOM | 185 | CD2 | PHE | A | 22 | 15.094 | 6.372 | 23.884 | 1.00 | 32.23 | | C |
| ANISOU | 185 | CD2 | PHE | A | 22 | 4032 | 4212 | 4003 | 145 | −548 | −822 | C |
| ATOM | 186 | CE1 | PHE | A | 22 | 13.392 | 8.190 | 25.096 | 1.00 | 36.09 | | C |
| ANISOU | 186 | CE1 | PHE | A | 22 | 4428 | 4672 | 4611 | 148 | −647 | −794 | C |
| ATOM | 187 | CE2 | PHE | A | 22 | 15.618 | 7.467 | 24.564 | 1.00 | 33.22 | | C |
| ANISOU | 187 | CE2 | PHE | A | 22 | 4125 | 4338 | 4159 | 140 | −520 | −773 | C |
| ATOM | 188 | CZ | PHE | A | 22 | 14.754 | 8.384 | 25.178 | 1.00 | 30.88 | | C |
| ANISOU | 188 | CZ | PHE | A | 22 | 3789 | 4025 | 3918 | 140 | −572 | −762 | C |
| ATOM | 189 | N | ILE | A | 23 | 13.204 | 7.431 | 20.645 | 1.00 | 29.69 | | N |
| ANISOU | 189 | N | ILE | A | 23 | 3908 | 3888 | 3486 | 178 | −774 | −820 | N |
| ATOM | 190 | CA | ILE | A | 23 | 14.051 | 8.311 | 19.853 | 1.00 | 36.74 | | C |
| ANISOU | 190 | CA | ILE | A | 23 | 4885 | 4791 | 4285 | 188 | −732 | −760 | C |
| ATOM | 191 | C | ILE | A | 23 | 14.192 | 9.627 | 20.598 | 1.00 | 33.68 | | C |
| ANISOU | 191 | C | ILE | A | 23 | 4445 | 4391 | 3963 | 186 | −717 | −700 | C |
| ATOM | 192 | O | ILE | A | 23 | 13.188 | 10.227 | 20.989 | 1.00 | 32.64 | | O |
| ANISOU | 192 | O | ILE | A | 23 | 4266 | 4241 | 3896 | 194 | −795 | −696 | O |
| ATOM | 193 | CB | ILE | A | 23 | 13.477 | 8.532 | 18.442 | 1.00 | 39.61 | | C |
| ANISOU | 193 | CB | ILE | A | 23 | 5362 | 5157 | 4532 | 206 | −821 | −756 | C |
| ATOM | 194 | CG1 | ILE | A | 23 | 13.470 | 7.206 | 17.660 | 1.00 | 39.70 | | C |
| ANISOU | 194 | CG1 | ILE | A | 23 | 5446 | 5175 | 4463 | 206 | −829 | −826 | C |
| ATOM | 195 | CG2 | ILE | A | 23 | 14.288 | 9.573 | 17.700 | 1.00 | 33.35 | | C |
| ANISOU | 195 | CG2 | ILE | A | 23 | 4658 | 4367 | 3647 | 217 | −770 | −680 | C |
| ATOM | 196 | CD1 | ILE | A | 23 | 12.500 | 7.189 | 16.508 | 1.00 | 47.24 | | C |
| ANISOU | 196 | CD1 | ILE | A | 23 | 6492 | 6128 | 5327 | 218 | −963 | −848 | C |
| ATOM | 197 | N | ALA | A | 24 | 15.436 | 10.052 | 20.819 | 1.00 | 32.17 | | N |
| ANISOU | 197 | N | ALA | A | 24 | 4255 | 4203 | 3765 | 175 | −617 | −657 | N |
| ATOM | 198 | CA | ALA | A | 24 | 15.758 | 11.312 | 21.473 | 1.00 | 33.22 | | C |
| ANISOU | 198 | CA | ALA | A | 24 | 4350 | 4317 | 3955 | 166 | −597 | −602 | C |
| ATOM | 199 | C | ALA | A | 24 | 16.572 | 12.168 | 20.519 | 1.00 | 35.36 | | C |
| ANISOU | 199 | C | ALA | A | 24 | 4704 | 4584 | 4147 | 165 | −550 | −533 | C |
| ATOM | 200 | O | ALA | A | 24 | 17.448 | 11.650 | 19.823 | 1.00 | 32.23 | | O |
| ANISOU | 200 | O | ALA | A | 24 | 4361 | 4207 | 3678 | 164 | −475 | −527 | O |
| ATOM | 201 | CB | ALA | A | 24 | 16.564 | 11.085 | 22.753 | 1.00 | 26.98 | | C |
| ANISOU | 201 | CB | ALA | A | 24 | 3473 | 3529 | 3248 | 143 | −524 | −610 | C |
| ATOM | 202 | N | VAL | A | 25 | 16.287 | 13.474 | 20.482 | 1.00 | 31.58 | | N |
| ANISOU | 202 | N | VAL | A | 25 | 4239 | 4075 | 3685 | 168 | −586 | −480 | N |
| ATOM | 203 | CA | VAL | A | 25 | 17.030 | 14.400 | 19.634 | 1.00 | 30.38 | | C |
| ANISOU | 203 | CA | VAL | A | 25 | 4166 | 3909 | 3469 | 164 | −537 | −403 | C |
| ATOM | 204 | C | VAL | A | 25 | 17.311 | 15.660 | 20.447 | 1.00 | 34.13 | | C |
| ANISOU | 204 | C | VAL | A | 25 | 4592 | 4342 | 4035 | 143 | −523 | −359 | C |
| ATOM | 205 | O | VAL | A | 25 | 16.478 | 16.089 | 21.252 | 1.00 | 34.36 | | O |
| ANISOU | 205 | O | VAL | A | 25 | 4567 | 4347 | 4144 | 152 | −588 | −379 | O |
| ATOM | 206 | CB | VAL | A | 25 | 16.291 | 14.743 | 18.320 | 1.00 | 30.63 | | C |
| ANISOU | 206 | CB | VAL | A | 25 | 4312 | 3935 | 3390 | 196 | −613 | −372 | C |
| ATOM | 207 | CG1 | VAL | A | 25 | 16.142 | 13.522 | 17.425 | 1.00 | 35.95 | | C |
| ANISOU | 207 | CG1 | VAL | A | 25 | 5057 | 4646 | 3956 | 211 | −625 | −421 | C |
| ATOM | 208 | CG2 | VAL | A | 25 | 14.926 | 15.347 | 18.591 | 1.00 | 36.23 | | C |
| ANISOU | 208 | CG2 | VAL | A | 25 | 4993 | 4617 | 4156 | 221 | −740 | −376 | C |
| ATOM | 209 | N | GLY | A | 26 | 18.499 | 16.219 | 20.269 | 1.00 | 30.51 | | N |
| ANISOU | 209 | N | GLY | A | 26 | 4148 | 3872 | 3573 | 115 | −432 | −302 | N |

TABLE 11-continued

| | | | | | | | | | | | | |
|---|---|---|---|---|---|---|---|---|---|---|---|---|
| ATOM | 210 | CA | GLY | A | 26 | 18.877 | 17.470 | 20.916 | 1.00 | 31.00 | | C |
| ANISOU | 210 | CA | GLY | A | 26 | 4175 | 3884 | 3719 | 87 | −417 | −258 | C |
| ATOM | 211 | C | GLY | A | 26 | 19.140 | 18.537 | 19.874 | 1.00 | 32.40 | | C |
| ANISOU | 211 | C | GLY | A | 26 | 4446 | 4025 | 3840 | 86 | −395 | −169 | C |
| ATOM | 212 | O | GLY | A | 26 | 19.742 | 18.258 | 18.837 | 1.00 | 32.81 | | O |
| ANISOU | 212 | O | GLY | A | 26 | 4569 | 4098 | 3798 | 88 | −328 | −132 | O |
| ATOM | 213 | N | TYR | A | 27 | 18.682 | 19.757 | 20.153 | 1.00 | 32.68 | | N |
| ANISOU | 213 | N | TYR | A | 27 | 4485 | 4000 | 3930 | 87 | −443 | −134 | N |
| ATOM | 214 | CA | TYR | A | 27 | 18.850 | 20.897 | 19.261 | 1.00 | 34.49 | | C |
| ANISOU | 214 | CA | TYR | A | 27 | 4805 | 4181 | 4120 | 88 | −428 | −40 | C |
| ATOM | 215 | C | TYR | A | 27 | 19.437 | 22.068 | 20.026 | 1.00 | 34.52 | | C |
| ANISOU | 215 | C | TYR | A | 27 | 4765 | 4115 | 4234 | 44 | −395 | −6 | C |
| ATOM | 216 | O | TYR | A | 27 | 19.079 | 22.300 | 21.181 | 1.00 | 34.90 | | O |
| ANISOU | 216 | O | TYR | A | 27 | 4740 | 4140 | 4379 | 37 | −438 | −57 | O |
| ATOM | 217 | CB | TYR | A | 27 | 17.519 | 21.377 | 18.652 | 1.00 | 36.23 | | C |
| ANISOU | 217 | CB | TYR | A | 27 | 5094 | 4375 | 4295 | 143 | −541 | −19 | C |
| ATOM | 218 | CG | TYR | A | 27 | 16.977 | 20.515 | 17.532 | 1.00 | 37.03 | | C |
| ANISOU | 218 | CG | TYR | A | 27 | 5279 | 4530 | 4263 | 183 | −587 | −28 | C |
| ATOM | 219 | CD1 | TYR | A | 27 | 16.274 | 19.348 | 17.807 | 1.00 | 37.63 | | C |
| ANISOU | 219 | CD1 | TYR | A | 27 | 5308 | 4656 | 4334 | 203 | −647 | −116 | C |
| ATOM | 220 | CD2 | TYR | A | 27 | 17.162 | 20.877 | 16.207 | 1.00 | 39.28 | | C |
| ANISOU | 220 | CD2 | TYR | A | 27 | 5695 | 4808 | 4422 | 199 | −571 | 51 | C |
| ATOM | 221 | CE1 | TYR | A | 27 | 15.765 | 18.560 | 16.772 | 1.00 | 41.14 | | C |
| ANISOU | 221 | CE1 | TYR | A | 27 | 5833 | 5141 | 4657 | 234 | −701 | −132 | C |
| ATOM | 222 | CE2 | TYR | A | 27 | 16.663 | 20.100 | 15.174 | 1.00 | 46.77 | | C |
| ANISOU | 222 | CE2 | TYR | A | 27 | 6735 | 5802 | 5233 | 235 | −623 | 36 | C |
| ATOM | 223 | CZ | TYR | A | 27 | 15.973 | 18.939 | 15.467 | 1.00 | 43.58 | | C |
| ANISOU | 223 | CZ | TYR | A | 27 | 6279 | 5445 | 4833 | 250 | −692 | −60 | C |
| ATOM | 224 | OH | TYR | A | 27 | 15.478 | 18.182 | 14.436 | 1.00 | 46.42 | | O |
| ANISOU | 224 | OH | TYR | A | 27 | 6734 | 5843 | 5058 | 280 | −754 | −82 | O |
| ATOM | 225 | N | VAL | A | 28 | 20.326 | 22.803 | 19.368 | 1.00 | 34.59 | | N |
| ANISOU | 225 | N | VAL | A | 28 | 4825 | 4089 | 4228 | 12 | −316 | 79 | N |
| ATOM | 226 | CA | VAL | A | 28 | 20.612 | 24.193 | 19.693 | 1.00 | 37.33 | | C |
| ANISOU | 226 | CA | VAL | A | 28 | 5174 | 4348 | 4663 | −22 | −306 | 134 | C |
| ATOM | 227 | C | VAL | A | 28 | 20.023 | 25.035 | 18.569 | 1.00 | 43.07 | | C |
| ANISOU | 227 | C | VAL | A | 28 | 6022 | 5028 | 5315 | 16 | −336 | 222 | C |
| ATOM | 228 | O | VAL | A | 28 | 20.404 | 24.872 | 17.400 | 1.00 | 40.20 | | O |
| ANISOU | 228 | O | VAL | A | 28 | 5747 | 4685 | 4841 | 23 | −279 | 287 | O |
| ATOM | 229 | CB | VAL | A | 28 | 22.116 | 24.459 | 19.849 | 1.00 | 35.86 | | C |
| ANISOU | 229 | CB | VAL | A | 28 | 4942 | 4145 | 4538 | −96 | −191 | 173 | C |
| ATOM | 230 | CG1 | VAL | A | 28 | 22.355 | 25.970 | 20.002 | 1.00 | 37.81 | | C |
| ANISOU | 230 | CG1 | VAL | A | 28 | 5209 | 4287 | 4871 | −135 | −184 | 238 | C |
| ATOM | 231 | CG2 | VAL | A | 28 | 22.678 | 23.676 | 21.032 | 1.00 | 32.91 | | C |
| ANISOU | 231 | CG2 | VAL | A | 28 | 4445 | 3814 | 4244 | −130 | −181 | 89 | C |
| ATOM | 232 | N | ASP | A | 29 | 19.092 | 25.927 | 18.916 | 1.00 | 37.33 | | N |
| ANISOU | 232 | N | ASP | A | 29 | 5305 | 4234 | 4645 | 46 | −424 | 227 | N |
| ATOM | 233 | CA | ASP | A | 29 | 18.358 | 26.729 | 17.918 | 1.00 | 42.35 | | C |
| ANISOU | 233 | CA | ASP | A | 29 | 6053 | 4821 | 5218 | 95 | −479 | 311 | C |
| ATOM | 234 | C | ASP | A | 29 | 17.754 | 25.746 | 16.916 | 1.00 | 41.55 | | C |
| ANISOU | 234 | C | ASP | A | 29 | 6018 | 4798 | 4970 | 148 | −527 | 304 | C |
| ATOM | 235 | O | ASP | A | 29 | 17.104 | 24.783 | 17.341 | 1.00 | 37.46 | | O |
| ANISOU | 235 | O | ASP | A | 29 | 5440 | 4340 | 4453 | 173 | −588 | 215 | O |
| ATOM | 236 | CB | ASP | A | 29 | 19.260 | 27.790 | 17.312 | 1.00 | 47.31 | | C |
| ANISOU | 236 | CB | ASP | A | 29 | 6751 | 5376 | 5848 | 53 | −391 | 423 | C |
| ATOM | 237 | CG | ASP | A | 29 | 19.835 | 28.714 | 18.347 | 1.00 | 48.28 | | C |
| ANISOU | 237 | CG | ASP | A | 29 | 6804 | 5416 | 6124 | −6 | −357 | 416 | C |
| ATOM | 238 | OD1 | ASP | A | 29 | 19.184 | 28.885 | 19.401 | 1.00 | 45.93 | | O |
| ANISOU | 238 | OD1 | ASP | A | 29 | 6440 | 5093 | 5918 | 8 | −428 | 342 | O |
| ATOM | 239 | OD2 | ASP | A | 29 | 20.930 | 29.265 | 18.108 | 1.00 | 47.16 | | O |
| ANISOU | 239 | OD2 | ASP | A | 29 | 6675 | 5232 | 6012 | −69 | −257 | 484 | O |
| ATOM | 240 | N | ASP | A | 30 | 17.962 | 25.927 | 15.613 | 1.00 | 42.84 | | N |
| ANISOU | 240 | N | ASP | A | 30 | 6308 | 4962 | 5006 | 163 | −499 | 393 | N |
| ATOM | 241 | CA | ASP | A | 30 | 17.417 | 25.031 | 14.605 | 1.00 | 45.00 | | C |
| ANISOU | 241 | CA | ASP | A | 30 | 6666 | 5305 | 5125 | 210 | −552 | 383 | C |
| ATOM | 242 | C | ASP | A | 30 | 18.422 | 23.975 | 14.153 | 1.00 | 46.06 | | C |
| ANISOU | 242 | C | ASP | A | 30 | 6820 | 5513 | 5168 | 180 | −436 | 362 | C |
| ATOM | 243 | O | ASP | A | 30 | 18.252 | 23.388 | 13.081 | 1.00 | 46.75 | | O |
| ANISOU | 243 | O | ASP | A | 30 | 7017 | 5645 | 5101 | 212 | −447 | 374 | O |
| ATOM | 244 | CB | ASP | A | 30 | 16.922 | 25.839 | 13.403 | 1.00 | 47.80 | | C |
| ANISOU | 244 | CB | ASP | A | 30 | 7171 | 5618 | 5373 | 256 | −607 | 491 | C |
| ATOM | 245 | CG | ASP | A | 30 | 15.834 | 26.836 | 13.780 | 1.00 | 44.79 | | C |
| ANISOU | 245 | CG | ASP | A | 30 | 6770 | 5162 | 5087 | 301 | −731 | 513 | C |
| ATOM | 246 | OD1 | ASP | A | 30 | 14.975 | 26.470 | 14.603 | 1.00 | 45.84 | | O |
| ANISOU | 246 | OD1 | ASP | A | 30 | 6799 | 5310 | 5308 | 325 | −820 | 425 | O |
| ATOM | 247 | OD2 | ASP | A | 30 | 15.846 | 27.978 | 13.271 | 1.00 | 49.06 | | O |
| ANISOU | 247 | OD2 | ASP | A | 30 | 7396 | 5624 | 5621 | 313 | −731 | 620 | O |
| ATOM | 248 | N | THR | A | 31 | 19.465 | 23.718 | 14.942 | 1.00 | 44.00 | | N |
| ANISOU | 248 | N | THR | A | 31 | 6458 | 5261 | 4999 | 123 | −328 | 329 | N |
| ATOM | 249 | CA | THR | A | 31 | 20.543 | 22.816 | 14.543 | 1.00 | 41.74 | | C |
| ANISOU | 249 | CA | THR | A | 31 | 6178 | 5033 | 4650 | 96 | −200 | 320 | C |

TABLE 11-continued

| | | | | | | | | | | | | |
|---|---|---|---|---|---|---|---|---|---|---|---|---|
| ATOM | 250 | C | THR | A | 31 | 20.545 | 21.597 | 15.453 | 1.00 | 41.56 | | C |
| ANISOU | 250 | C | THR | A | 31 | 6036 | 5071 | 4684 | 90 | −213 | 203 | C |
| ATOM | 251 | O | THR | A | 31 | 20.786 | 21.722 | 16.659 | 1.00 | 38.75 | | O |
| ANISOU | 251 | O | THR | A | 31 | 5557 | 4699 | 4465 | 56 | −213 | 162 | O |
| ATOM | 252 | CB | THR | A | 31 | 21.896 | 23.530 | 14.597 | 1.00 | 39.41 | | C |
| ANISOU | 252 | CB | THR | A | 31 | 5858 | 4694 | 4423 | 33 | −53 | 395 | C |
| ATOM | 253 | OG1 | THR | A | 31 | 21.870 | 24.658 | 13.711 | 1.00 | 40.75 | | O |
| ANISOU | 253 | OG1 | THR | A | 31 | 6147 | 4799 | 4536 | 38 | −35 | 511 | O |
| ATOM | 254 | CG2 | THR | A | 31 | 23.021 | 22.586 | 14.190 | 1.00 | 42.59 | | C |
| ANISOU | 254 | CG2 | THR | A | 31 | 6251 | 5154 | 4776 | 12 | 90 | 387 | C |
| ATOM | 255 | N | GLN | A | 32 | 20.273 | 20.418 | 14.884 | 1.00 | 35.88 | | N |
| ANISOU | 255 | N | GLN | A | 32 | 5362 | 4417 | 3854 | 122 | −226 | 151 | N |
| ATOM | 256 | CA | GLN | A | 32 | 20.342 | 19.195 | 15.676 | 1.00 | 39.32 | | C |
| ANISOU | 256 | CA | GLN | A | 32 | 5695 | 4904 | 4340 | 117 | −226 | 48 | C |
| ATOM | 257 | C | GLN | A | 32 | 21.799 | 18.875 | 15.973 | 1.00 | 43.76 | | C |
| ANISOU | 257 | C | GLN | A | 32 | 6189 | 5481 | 4957 | 72 | −76 | 56 | C |
| ATOM | 258 | O | GLN | A | 32 | 22.677 | 19.092 | 15.130 | 1.00 | 43.34 | | O |
| ANISOU | 258 | O | GLN | A | 32 | 6201 | 5423 | 4843 | 60 | 41 | 124 | O |
| ATOM | 259 | CB | GLN | A | 32 | 19.692 | 18.023 | 14.937 | 1.00 | 38.80 | | C |
| ANISOU | 259 | CB | GLN | A | 32 | 5702 | 4892 | 4147 | 160 | −278 | −11 | C |
| ATOM | 260 | CG | GLN | A | 32 | 19.609 | 16.747 | 15.767 | 1.00 | 38.25 | | C |
| ANISOU | 260 | CG | GLN | A | 32 | 5531 | 4866 | 4137 | 157 | −289 | −116 | C |
| ATOM | 261 | CD | GLN | A | 32 | 19.346 | 15.504 | 14.912 | 1.00 | 42.98 | | C |
| ANISOU | 261 | CD | GLN | A | 32 | 6212 | 5511 | 4607 | 187 | −299 | −173 | C |
| ATOM | 262 | OE1 | GLN | A | 32 | 19.057 | 15.610 | 13.722 | 1.00 | 47.02 | | O |
| ANISOU | 262 | OE1 | GLN | A | 32 | 6864 | 6027 | 4977 | 214 | −321 | −142 | O |
| ATOM | 263 | NE2 | GLN | A | 32 | 19.449 | 14.330 | 15.522 | 1.00 | 43.00 | | N |
| ANISOU | 263 | NE2 | GLN | A | 32 | 6139 | 5544 | 4656 | 184 | −285 | −256 | N |
| ATOM | 264 | N | PHE | A | 33 | 22.075 | 18.374 | 17.178 | 1.00 | 35.06 | | N |
| ANISOU | 264 | N | PHE | A | 33 | 4954 | 4393 | 3973 | 49 | −77 | −9 | N |
| ATOM | 265 | CA | PHE | A | 33 | 23.456 | 18.019 | 17.497 | 1.00 | 33.99 | | C |
| ANISOU | 265 | CA | PHE | A | 33 | 4739 | 4273 | 3903 | 10 | 50 | −1 | C |
| ATOM | 266 | C | PHE | A | 33 | 23.653 | 16.658 | 18.142 | 1.00 | 37.58 | | C |
| ANISOU | 266 | C | PHE | A | 33 | 5110 | 4779 | 4390 | 19 | 58 | −87 | C |
| ATOM | 267 | O | PHE | A | 33 | 24.800 | 16.189 | 18.166 | 1.00 | 36.36 | | O |
| ANISOU | 267 | O | PHE | A | 33 | 4902 | 4643 | 4271 | 1 | 169 | −78 | O |
| ATOM | 268 | CB | PHE | A | 33 | 24.113 | 19.085 | 18.389 | 1.00 | 36.05 | | C |
| ANISOU | 268 | CB | PHE | A | 33 | 4908 | 4482 | 4305 | −47 | 68 | 38 | C |
| ATOM | 269 | CG | PHE | A | 33 | 23.583 | 19.144 | 19.803 | 1.00 | 36.39 | | C |
| ANISOU | 269 | CG | PHE | A | 33 | 4855 | 4515 | 4456 | −58 | −33 | −29 | C |
| ATOM | 270 | CD1 | PHE | A | 33 | 22.400 | 19.810 | 20.095 | 1.00 | 34.27 | | C |
| ANISOU | 270 | CD1 | PHE | A | 33 | 4616 | 4211 | 4195 | −36 | −144 | −41 | C |
| ATOM | 271 | CD2 | PHE | A | 33 | 24.313 | 18.600 | 20.848 | 1.00 | 32.56 | | C |
| ANISOU | 271 | CD2 | PHE | A | 33 | 4252 | 4051 | 4069 | −87 | −11 | −72 | C |
| ATOM | 272 | CE1 | PHE | A | 33 | 21.928 | 19.882 | 21.399 | 1.00 | 33.24 | | C |
| ANISOU | 272 | CE1 | PHE | A | 33 | 4405 | 4068 | 4157 | −43 | −219 | −102 | C |
| ATOM | 273 | CE2 | PHE | A | 33 | 23.853 | 18.674 | 22.157 | 1.00 | 33.95 | | C |
| ANISOU | 273 | CE2 | PHE | A | 33 | 4357 | 4217 | 4327 | −96 | −97 | −131 | C |
| ATOM | 274 | CZ | PHE | A | 33 | 22.660 | 19.316 | 22.435 | 1.00 | 34.00 | | C |
| ANISOU | 274 | CZ | PHE | A | 33 | 4400 | 4188 | 4332 | −75 | −193 | −148 | C |
| ATOM | 275 | N | VAL | A | 34 | 22.607 | 16.009 | 18.669 | 1.00 | 34.94 | | N |
| ANISOU | 275 | N | VAL | A | 34 | 4757 | 4463 | 4055 | 46 | −49 | −164 | N |
| ATOM | 276 | CA | VAL | A | 34 | 22.718 | 14.639 | 19.159 | 1.00 | 33.14 | | C |
| ANISOU | 276 | CA | VAL | A | 34 | 4469 | 4278 | 3846 | 59 | −40 | −240 | C |
| ATOM | 277 | C | VAL | A | 34 | 21.462 | 13.867 | 18.802 | 1.00 | 36.66 | | C |
| ANISOU | 277 | C | VAL | A | 34 | 4974 | 4743 | 4212 | 100 | −134 | −302 | C |
| ATOM | 278 | O | VAL | A | 34 | 20.398 | 14.434 | 18.534 | 1.00 | 33.60 | | O |
| ANISOU | 278 | O | VAL | A | 34 | 4638 | 4337 | 3790 | 116 | −232 | −296 | O |
| ATOM | 279 | CB | VAL | A | 34 | 22.937 | 14.535 | 20.690 | 1.00 | 36.05 | | C |
| ANISOU | 279 | CB | VAL | A | 34 | 4704 | 4643 | 4349 | 32 | −68 | −277 | C |
| ATOM | 280 | CG1 | VAL | A | 34 | 24.352 | 14.917 | 21.074 | 1.00 | 34.42 | | C |
| ANISOU | 280 | CG1 | VAL | A | 34 | 4421 | 4428 | 4231 | −11 | 24 | −231 | C |
| ATOM | 281 | CG2 | VAL | A | 34 | 21.911 | 15.383 | 21.436 | 1.00 | 31.99 | | C |
| ANISOU | 281 | CG2 | VAL | A | 34 | 4176 | 4096 | 3884 | 28 | −178 | −288 | C |
| ATOM | 282 | N | ARG | A | 35 | 21.586 | 12.546 | 18.848 | 1.00 | 33.69 | | N |
| ANISOU | 282 | N | ARG | A | 35 | 4581 | 4399 | 3820 | 115 | −109 | −364 | N |
| ATOM | 283 | CA | ARG | A | 35 | 20.399 | 11.714 | 18.782 | 1.00 | 30.75 | | C |
| ANISOU | 283 | CA | ARG | A | 35 | 4236 | 4039 | 3410 | 142 | −206 | −435 | C |
| ATOM | 284 | C | ARG | A | 35 | 20.665 | 10.408 | 19.509 | 1.00 | 33.69 | | C |
| ANISOU | 284 | C | ARG | A | 35 | 4532 | 4430 | 3837 | 144 | −179 | −501 | C |
| ATOM | 285 | O | ARG | A | 35 | 21.815 | 9.994 | 19.663 | 1.00 | 33.21 | | O |
| ANISOU | 285 | O | ARG | A | 35 | 4431 | 4380 | 3807 | 138 | −75 | −491 | O |
| ATOM | 286 | CB | ARG | A | 35 | 19.997 | 11.422 | 17.353 | 1.00 | 29.50 | | C |
| ANISOU | 286 | CB | ARG | A | 35 | 4216 | 3890 | 3102 | 171 | −221 | −439 | C |
| ATOM | 287 | CG | ARG | A | 35 | 21.027 | 10.566 | 16.618 | 1.00 | 46.47 | | C |
| ANISOU | 287 | CG | ARG | A | 35 | 6417 | 6059 | 5179 | 183 | −94 | −448 | C |
| ATOM | 288 | CD | ARG | A | 35 | 20.314 | 9.496 | 15.827 | 1.00 | 56.88 | | C |
| ANISOU | 288 | CD | ARG | A | 35 | 7832 | 7390 | 6389 | 212 | −144 | −520 | C |
| ATOM | 289 | NE | ARG | A | 35 | 21.092 | 8.285 | 15.648 | 1.00 | 61.82 | | N |
| ANISOU | 289 | NE | ARG | A | 35 | 8464 | 8028 | 6998 | 225 | −40 | −567 | N |

TABLE 11-continued

| | | | | | | | | | | | |
|---|---|---|---|---|---|---|---|---|---|---|---|
| ATOM | 290 | CZ | ARG | A | 35 | 20.734 | 7.294 | 14.841 | 1.00 | 64.37 | C |
| ANISOU | 290 | CZ | ARG | A | 35 | 8887 | 8354 | 7216 | 250 | −54 | −633 | C |
| ATOM | 291 | NH1 | ARG | A | 35 | 19.614 | 7.381 | 14.135 | 1.00 | 61.09 | N |
| ANISOU | 291 | NH1 | ARG | A | 35 | 8571 | 7937 | 6703 | 259 | −179 | −658 | N |
| ATOM | 292 | NH2 | ARG | A | 35 | 21.498 | 6.220 | 14.736 | 1.00 | 65.57 | N |
| ANISOU | 292 | NH2 | ARG | A | 35 | 9041 | 8508 | 7365 | 266 | 52 | −676 | N |
| ATOM | 293 | N | PHE | A | 36 | 19.583 | 9.780 | 19.970 | 1.00 | 32.77 | N |
| ANISOU | 293 | N | PHE | A | 36 | 4392 | 4314 | 3744 | 153 | −271 | −563 | N |
| ATOM | 294 | CA | PHE | A | 36 | 19.590 | 8.387 | 20.408 | 1.00 | 30.48 | C |
| ANISOU | 294 | CA | PHE | A | 36 | 4062 | 4035 | 3484 | 161 | −256 | −629 | C |
| ATOM | 295 | C | PHE | A | 36 | 18.405 | 7.697 | 19.744 | 1.00 | 37.52 | C |
| ANISOU | 295 | C | PHE | A | 36 | 5019 | 4924 | 4311 | 178 | −345 | −688 | C |
| ATOM | 296 | O | PHE | A | 36 | 17.290 | 8.224 | 19.750 | 1.00 | 34.41 | O |
| ANISOU | 296 | O | PHE | A | 36 | 4629 | 4521 | 3924 | 178 | −449 | −691 | O |
| ATOM | 297 | CB | PHE | A | 36 | 19.502 | 8.260 | 21.939 | 1.00 | 32.40 | C |
| ANISOU | 297 | CB | PHE | A | 36 | 4188 | 4273 | 3850 | 144 | −276 | −645 | C |
| ATOM | 298 | CG | PHE | A | 36 | 19.527 | 6.828 | 22.431 | 1.00 | 30.12 | C |
| ANISOU | 298 | CG | PHE | A | 36 | 3861 | 3988 | 3596 | 153 | −258 | −702 | C |
| ATOM | 299 | CD1 | PHE | A | 36 | 18.361 | 6.057 | 22.448 | 1.00 | 32.05 | C |
| ANISOU | 299 | CD1 | PHE | A | 36 | 4114 | 4223 | 3839 | 159 | −331 | −761 | C |
| ATOM | 300 | CD2 | PHE | A | 36 | 20.713 | 6.249 | 22.848 | 1.00 | 33.70 | C |
| ANISOU | 300 | CD2 | PHE | A | 36 | 4266 | 4449 | 4090 | 155 | −169 | −692 | C |
| ATOM | 301 | CE1 | PHE | A | 36 | 18.379 | 4.732 | 22.882 | 1.00 | 30.93 | C |
| ANISOU | 301 | CE1 | PHE | A | 36 | 3943 | 4075 | 3735 | 165 | −310 | −809 | C |
| ATOM | 302 | CE2 | PHE | A | 36 | 20.750 | 4.916 | 23.282 | 1.00 | 33.61 | C |
| ANISOU | 302 | CE2 | PHE | A | 36 | 4225 | 4433 | 4112 | 168 | −151 | −739 | C |
| ATOM | 303 | CZ | PHE | A | 36 | 19.582 | 4.157 | 23.292 | 1.00 | 33.79 | C |
| ANISOU | 303 | CZ | PHE | A | 36 | 4267 | 4441 | 4129 | 172 | −218 | −797 | C |
| ATOM | 304 | N | ASP | A | 37 | 18.642 | 6.528 | 19.162 | 1.00 | 30.82 | N |
| ANISOU | 304 | N | ASP | A | 37 | 4222 | 4082 | 3408 | 192 | −306 | −737 | N |
| ATOM | 305 | CA | ASP | A | 37 | 17.570 | 5.739 | 18.557 | 1.00 | 31.17 | C |
| ANISOU | 305 | CA | ASP | A | 37 | 4327 | 4118 | 3398 | 201 | −395 | −805 | C |
| ATOM | 306 | C | ASP | A | 37 | 17.698 | 4.316 | 19.075 | 1.00 | 36.25 | C |
| ANISOU | 306 | C | ASP | A | 37 | 4927 | 4750 | 4095 | 201 | −361 | −870 | C |
| ATOM | 307 | O | ASP | A | 37 | 18.720 | 3.661 | 18.836 | 1.00 | 36.76 | O |
| ANISOU | 307 | O | ASP | A | 37 | 5014 | 4816 | 4138 | 216 | −255 | −877 | O |
| ATOM | 308 | CB | ASP | A | 37 | 17.651 | 5.790 | 17.026 | 1.00 | 33.62 | C |
| ANISOU | 308 | CB | ASP | A | 37 | 4789 | 4435 | 3552 | 220 | −392 | −805 | C |
| ATOM | 309 | CG | ASP | A | 37 | 16.462 | 5.079 | 16.328 | 1.00 | 45.81 | C |
| ANISOU | 309 | CG | ASP | A | 37 | 6406 | 5969 | 5032 | 224 | −514 | −879 | C |
| ATOM | 310 | OD1 | ASP | A | 37 | 15.812 | 4.199 | 16.937 | 1.00 | 40.75 | O |
| ANISOU | 310 | OD1 | ASP | A | 37 | 5699 | 5313 | 4471 | 211 | −566 | −941 | O |
| ATOM | 311 | OD2 | ASP | A | 37 | 16.178 | 5.417 | 15.160 | 1.00 | 47.47 | O |
| ANISOU | 311 | OD2 | ASP | A | 37 | 6741 | 6184 | 5111 | 237 | −563 | −872 | O |
| ATOM | 312 | N | SER | A | 38 | 16.667 | 3.842 | 19.779 | 1.00 | 34.59 | N |
| ANISOU | 312 | N | SER | A | 38 | 4654 | 4525 | 3963 | 188 | −445 | −913 | N |
| ATOM | 313 | CA | SER | A | 38 | 16.721 | 2.509 | 20.369 | 1.00 | 34.68 | C |
| ANISOU | 313 | CA | SER | A | 38 | 4623 | 4517 | 4039 | 185 | −414 | −967 | C |
| ATOM | 314 | C | SER | A | 38 | 16.865 | 1.407 | 19.327 | 1.00 | 37.25 | C |
| ANISOU | 314 | C | SER | A | 38 | 5049 | 4826 | 4279 | 199 | −393 | −1030 | C |
| ATOM | 315 | O | SER | A | 38 | 17.298 | 0.301 | 19.674 | 1.00 | 40.11 | O |
| ANISOU | 315 | O | SER | A | 38 | 5391 | 5167 | 4683 | 206 | −332 | −1066 | O |
| ATOM | 316 | CB | SER | A | 38 | 15.476 | 2.242 | 21.198 | 1.00 | 36.19 | C |
| ANISOU | 316 | CB | SER | A | 38 | 4737 | 4690 | 4325 | 164 | −505 | −998 | C |
| ATOM | 317 | OG | SER | A | 38 | 14.326 | 2.207 | 20.367 | 1.00 | 36.79 | O |
| ANISOU | 317 | OG | SER | A | 38 | 4864 | 4757 | 4359 | 157 | −618 | −1038 | O |
| ATOM | 318 | N | ASP | A | 39 | 16.485 | 1.664 | 18.074 | 1.00 | 37.03 | N |
| ANISOU | 318 | N | ASP | A | 39 | 5136 | 4803 | 4129 | 206 | −446 | −1047 | N |
| ATOM | 319 | CA | ASP | A | 39 | 16.648 | 0.677 | 17.010 | 1.00 | 44.52 | C |
| ANISOU | 319 | CA | ASP | A | 39 | 6205 | 5734 | 4976 | 220 | −425 | −1114 | C |
| ATOM | 320 | C | ASP | A | 39 | 18.048 | 0.679 | 16.397 | 1.00 | 48.19 | C |
| ANISOU | 320 | C | ASP | A | 39 | 6739 | 6211 | 5360 | 252 | −275 | −1087 | C |
| ATOM | 321 | O | ASP | A | 39 | 18.384 | −0.257 | 15.665 | 1.00 | 41.30 | O |
| ANISOU | 321 | O | ASP | A | 39 | 5960 | 5318 | 4414 | 272 | −223 | −1146 | O |
| ATOM | 322 | CB | ASP | A | 39 | 15.613 | 0.911 | 15.895 | 1.00 | 48.54 | C |
| ANISOU | 322 | CB | ASP | A | 39 | 6824 | 6244 | 5375 | 215 | −557 | −1149 | C |
| ATOM | 323 | CG | ASP | A | 39 | 14.265 | 0.213 | 16.154 | 1.00 | 48.99 | C |
| ANISOU | 323 | CG | ASP | A | 39 | 6839 | 6272 | 5505 | 185 | −694 | −1219 | C |
| ATOM | 324 | OD1 | ASP | A | 39 | 14.057 | −0.388 | 17.230 | 1.00 | 47.46 | O |
| ANISOU | 324 | OD1 | ASP | A | 39 | 6531 | 6056 | 5446 | 167 | −681 | −1235 | O |
| ATOM | 325 | OD2 | ASP | A | 39 | 13.399 | 0.271 | 15.259 | 1.00 | 58.36 | O |
| ANISOU | 325 | OD2 | ASP | A | 39 | 8106 | 7455 | 6612 | 178 | −819 | −1255 | O |
| ATOM | 326 | N | ALA | A | 40 | 18.865 | 1.696 | 16.657 | 1.00 | 40.82 | N |
| ANISOU | 326 | N | ALA | A | 40 | 5763 | 5304 | 4442 | 257 | −202 | −1002 | N |
| ATOM | 327 | CA | ALA | A | 40 | 20.175 | 1.773 | 16.029 | 1.00 | 43.41 | C |
| ANISOU | 327 | CA | ALA | A | 40 | 6146 | 5643 | 4705 | 284 | −54 | −969 | C |
| ATOM | 328 | C | ALA | A | 40 | 21.147 | 0.799 | 16.699 | 1.00 | 45.13 | C |
| ANISOU | 328 | C | ALA | A | 40 | 6284 | 5845 | 5017 | 302 | 62 | −984 | C |
| ATOM | 329 | O | ALA | A | 40 | 20.942 | 0.350 | 17.831 | 1.00 | 45.92 | O |
| ANISOU | 329 | O | ALA | A | 40 | 6275 | 5933 | 5241 | 289 | 30 | −994 | O |

TABLE 11-continued

| | | | | | | | | | | | |
|---|---|---|---|---|---|---|---|---|---|---|---|
| ATOM | 330 | CB | ALA | A | 40 | 20.722 | 3.201 | 16.089 | 1.00 | 42.79 | C |
| ANISOU | 330 | CB | ALA | A | 40 | 6039 | 5592 | 4629 | 276 | −16 | −870 | C |
| ATOM | 331 | N | ALA | A | 41 | 22.232 | 0.493 | 15.984 | 1.00 | 48.29 | N |
| ANISOU | 331 | N | ALA | A | 41 | 6743 | 6243 | 5359 | 335 | 202 | −979 | N |
| ATOM | 332 | CA | ALA | A | 41 | 23.142 | −0.564 | 16.428 | 1.00 | 48.57 | C |
| ANISOU | 332 | CA | ALA | A | 41 | 6719 | 6257 | 5479 | 364 | 313 | −1000 | C |
| ATOM | 333 | C | ALA | A | 41 | 23.960 | −0.139 | 17.643 | 1.00 | 49.49 | C |
| ANISOU | 333 | C | ALA | A | 41 | 6671 | 6389 | 5743 | 356 | 356 | −927 | C |
| ATOM | 334 | O | ALA | A | 41 | 24.208 | −0.949 | 18.545 | 1.00 | 44.75 | O |
| ANISOU | 334 | O | ALA | A | 41 | 5981 | 5769 | 5253 | 365 | 367 | −941 | O |
| ATOM | 335 | CB | ALA | A | 41 | 24.065 | −0.965 | 15.276 | 1.00 | 42.64 | C |
| ANISOU | 335 | CB | ALA | A | 41 | 6077 | 5498 | 4628 | 408 | 462 | −1015 | C |
| ATOM | 336 | N | SER | A | 42 | 24.373 | 1.131 | 17.697 | 1.00 | 45.32 | N |
| ANISOU | 336 | N | SER | A | 42 | 6107 | 5892 | 5221 | 336 | 372 | −847 | N |
| ATOM | 337 | CA | SER | A | 42 | 25.325 | 1.562 | 18.716 | 1.00 | 45.31 | C |
| ANISOU | 337 | CA | SER | A | 42 | 5960 | 5903 | 5352 | 326 | 419 | −779 | C |
| ATOM | 338 | C | SER | A | 42 | 24.758 | 1.479 | 20.128 | 1.00 | 43.83 | C |
| ANISOU | 338 | C | SER | A | 42 | 5665 | 5713 | 5275 | 301 | 312 | −783 | C |
| ATOM | 339 | O | SER | A | 42 | 25.505 | 1.204 | 21.072 | 1.00 | 42.84 | O |
| ANISOU | 339 | O | SER | A | 42 | 5429 | 5586 | 5260 | 306 | 344 | −757 | O |
| ATOM | 340 | CB | SER | A | 42 | 25.783 | 2.992 | 18.431 | 1.00 | 47.67 | C |
| ANISOU | 340 | CB | SER | A | 42 | 6252 | 6226 | 5634 | 302 | 448 | −698 | C |
| ATOM | 341 | OG | SER | A | 42 | 24.747 | 3.923 | 18.713 | 1.00 | 47.95 | O |
| ANISOU | 341 | OG | SER | A | 42 | 6298 | 6268 | 5652 | 266 | 319 | −685 | O |
| ATOM | 342 | N | GLN | A | 43 | 23.464 | 1.739 | 20.311 | 1.00 | 33.76 | N |
| ANISOU | 342 | N | GLN | A | 43 | 4419 | 4435 | 3972 | 276 | 187 | −811 | N |
| ATOM | 343 | CA | GLN | A | 43 | 22.901 | 1.915 | 21.657 | 1.00 | 37.20 | C |
| ANISOU | 343 | CA | GLN | A | 43 | 4760 | 4871 | 4504 | 250 | 98 | −804 | C |
| ATOM | 344 | C | GLN | A | 43 | 23.617 | 3.032 | 22.423 | 1.00 | 34.69 | C |
| ANISOU | 344 | C | GLN | A | 43 | 4352 | 4573 | 4255 | 227 | 108 | −730 | C |
| ATOM | 345 | O | GLN | A | 43 | 23.762 | 2.979 | 23.647 | 1.00 | 32.41 | O |
| ANISOU | 345 | O | GLN | A | 43 | 3972 | 4285 | 4058 | 216 | 80 | −716 | O |
| ATOM | 346 | CB | GLN | A | 43 | 22.932 | 0.606 | 22.457 | 1.00 | 43.63 | C |
| ANISOU | 346 | CB | GLN | A | 43 | 5522 | 5661 | 5395 | 266 | 104 | −842 | C |
| ATOM | 347 | CG | GLN | A | 43 | 22.033 | −0.502 | 21.880 | 1.00 | 44.55 | C |
| ANISOU | 347 | CG | GLN | A | 43 | 5719 | 5745 | 5464 | 276 | 72 | −922 | C |
| ATOM | 348 | CD | GLN | A | 43 | 20.558 | −0.097 | 21.842 | 1.00 | 47.89 | C |
| ANISOU | 348 | CD | GLN | A | 43 | 6171 | 6166 | 5858 | 245 | −53 | −951 | C |
| ATOM | 349 | OE1 | GLN | A | 43 | 19.915 | 0.076 | 22.880 | 1.00 | 49.14 | O |
| ANISOU | 349 | OE1 | GLN | A | 43 | 6259 | 6323 | 6088 | 223 | −116 | −942 | O |
| ATOM | 350 | NE2 | GLN | A | 43 | 20.029 | 0.071 | 20.637 | 1.00 | 45.34 | N |
| ANISOU | 350 | NE2 | GLN | A | 43 | 5954 | 5844 | 5428 | 245 | −86 | −982 | N |
| ATOM | 351 | N | ARG | A | 44 | 24.074 | 4.056 | 21.717 | 1.00 | 33.89 | N |
| ANISOU | 351 | N | ARG | A | 44 | 4282 | 4485 | 4109 | 217 | 147 | −682 | N |
| ATOM | 352 | CA | ARG | A | 44 | 24.750 | 5.188 | 22.339 | 1.00 | 30.94 | C |
| ANISOU | 352 | CA | ARG | A | 44 | 3831 | 4122 | 3804 | 188 | 154 | −615 | C |
| ATOM | 353 | C | ARG | A | 44 | 24.103 | 6.489 | 21.882 | 1.00 | 33.56 | C |
| ANISOU | 353 | C | ARG | A | 44 | 4220 | 4452 | 4078 | 163 | 99 | −586 | C |
| ATOM | 354 | O | ARG | A | 44 | 23.548 | 6.566 | 20.789 | 1.00 | 32.89 | O |
| ANISOU | 354 | O | ARG | A | 44 | 4241 | 4366 | 3889 | 176 | 92 | −598 | O |
| ATOM | 355 | CB | ARG | A | 44 | 26.244 | 5.223 | 21.965 | 1.00 | 36.35 | C |
| ANISOU | 355 | CB | ARG | A | 44 | 4475 | 4814 | 4523 | 197 | 282 | −567 | C |
| ATOM | 356 | CG | ARG | A | 44 | 27.000 | 3.911 | 22.159 | 1.00 | 49.73 | C |
| ANISOU | 356 | CG | ARG | A | 44 | 6121 | 6504 | 6270 | 235 | 355 | −591 | C |
| ATOM | 357 | CD | ARG | A | 44 | 27.638 | 3.845 | 23.526 | 1.00 | 50.46 | C |
| ANISOU | 357 | CD | ARG | A | 44 | 6080 | 6600 | 6493 | 223 | 328 | −564 | C |
| ATOM | 358 | NE | ARG | A | 44 | 28.694 | 4.844 | 23.693 | 1.00 | 47.20 | N |
| ANISOU | 358 | NE | ARG | A | 44 | 5587 | 6197 | 6150 | 193 | 368 | −495 | N |
| ATOM | 359 | CZ | ARG | A | 44 | 29.206 | 5.182 | 24.872 | 1.00 | 49.57 | C |
| ANISOU | 359 | CZ | ARG | A | 44 | 5778 | 6502 | 6555 | 168 | 317 | −465 | C |
| ATOM | 360 | NH1 | ARG | A | 44 | 28.752 | 4.599 | 25.982 | 1.00 | 41.75 | N |
| ANISOU | 360 | NH1 | ARG | A | 44 | 4757 | 5509 | 5598 | 173 | 233 | −494 | N |
| ATOM | 361 | NH2 | ARG | A | 44 | 30.161 | 6.107 | 24.944 | 1.00 | 49.15 | N |
| ANISOU | 361 | NH2 | ARG | A | 44 | 5652 | 6453 | 6571 | 133 | 348 | −406 | N |
| ATOM | 362 | N | MET | A | 45 | 24.199 | 7.525 | 22.710 | 1.00 | 29.75 | N |
| ANISOU | 362 | N | MET | A | 45 | 3674 | 3967 | 3664 | 130 | 58 | −547 | N |
| ATOM | 363 | CA | MET | A | 45 | 23.985 | 8.855 | 22.167 | 1.00 | 33.48 | C |
| ANISOU | 363 | CA | MET | A | 45 | 4196 | 4430 | 4097 | 109 | 41 | −500 | C |
| ATOM | 364 | C | MET | A | 45 | 25.032 | 9.114 | 21.088 | 1.00 | 33.27 | C |
| ANISOU | 364 | C | MET | A | 45 | 4208 | 4406 | 4028 | 112 | 159 | −449 | C |
| ATOM | 365 | O | MET | A | 45 | 26.203 | 8.755 | 21.238 | 1.00 | 38.49 | O |
| ANISOU | 365 | O | MET | A | 45 | 4801 | 5075 | 4750 | 112 | 250 | −428 | O |
| ATOM | 366 | CB | MET | A | 45 | 24.061 | 9.906 | 23.269 | 1.00 | 32.24 | C |
| ANISOU | 366 | CB | MET | A | 45 | 3963 | 4258 | 4028 | 71 | −11 | −471 | C |
| ATOM | 367 | CG | MET | A | 45 | 23.599 | 11.289 | 22.798 | 1.00 | 35.51 | C |
| ANISOU | 367 | CG | MET | A | 45 | 4434 | 4649 | 4409 | 53 | −46 | −429 | C |
| ATOM | 368 | SD | MET | A | 45 | 21.796 | 11.423 | 22.783 | 1.00 | 32.10 | S |
| ANISOU | 368 | SD | MET | A | 45 | 4061 | 4206 | 3929 | 74 | −170 | −473 | S |
| ATOM | 369 | CE | MET | A | 45 | 21.534 | 12.439 | 24.224 | 1.00 | 34.39 | C |
| ANISOU | 369 | CE | MET | A | 45 | 4278 | 4469 | 4322 | 44 | −235 | −468 | C |

TABLE 11-continued

| | | | | | | | | | | | | |
|---|---|---|---|---|---|---|---|---|---|---|---|---|
| ATOM | 370 | N | GLU | A | 46 | 24.606 | 9.700 | 19.979 | 1.00 | 33.42 | | N |
| ANISOU | 370 | N | GLU | A | 46 | 4337 | 4420 | 3943 | 118 | 160 | −426 | N |
| ATOM | 371 | CA | GLU | A | 46 | 25.516 | 9.884 | 18.868 | 1.00 | 31.59 | | C |
| ANISOU | 371 | CA | GLU | A | 46 | 4163 | 4190 | 3651 | 125 | 286 | −377 | C |
| ATOM | 372 | C | GLU | A | 46 | 25.601 | 11.348 | 18.454 | 1.00 | 39.44 | | C |
| ANISOU | 372 | C | GLU | A | 46 | 5194 | 5162 | 4628 | 95 | 291 | −298 | C |
| ATOM | 373 | O | GLU | A | 46 | 24.616 | 12.087 | 18.569 | 1.00 | 33.54 | | O |
| ANISOU | 373 | O | GLU | A | 46 | 4484 | 4399 | 3861 | 88 | 184 | −294 | O |
| ATOM | 374 | CB | GLU | A | 46 | 25.068 | 9.049 | 17.670 | 1.00 | 35.08 | | C |
| ANISOU | 374 | CB | GLU | A | 46 | 4738 | 4642 | 3949 | 167 | 308 | −419 | C |
| ATOM | 375 | CG | GLU | A | 46 | 25.177 | 7.553 | 17.887 | 1.00 | 44.40 | | C |
| ANISOU | 375 | CG | GLU | A | 46 | 5894 | 5832 | 5145 | 197 | 332 | −493 | C |
| ATOM | 376 | CD | GLU | A | 46 | 24.656 | 6.770 | 16.691 | 1.00 | 51.97 | | C |
| ANISOU | 376 | CD | GLU | A | 46 | 7000 | 6793 | 5955 | 234 | 340 | −547 | C |
| ATOM | 377 | OE1 | GLU | A | 46 | 23.865 | 5.832 | 16.885 | 1.00 | 58.85 | | O |
| ANISOU | 377 | OE1 | GLU | A | 46 | 7884 | 7659 | 6816 | 248 | 264 | −623 | O |
| ATOM | 378 | OE2 | GLU | A | 46 | 25.018 | 7.113 | 15.552 | 1.00 | 62.70 | | O |
| ANISOU | 378 | OE2 | GLU | A | 46 | 8466 | 8153 | 7205 | 247 | 421 | −513 | O |
| ATOM | 379 | N | PRO | A | 47 | 26.753 | 11.786 | 17.945 | 1.00 | 39.64 | | N |
| ANISOU | 379 | N | PRO | A | 47 | 5211 | 5181 | 4667 | 80 | 420 | −231 | N |
| ATOM | 380 | CA | PRO | A | 47 | 26.880 | 13.170 | 17.476 | 1.00 | 40.14 | | C |
| ANISOU | 380 | CA | PRO | A | 47 | 5319 | 5215 | 4716 | 49 | 439 | −148 | C |
| ATOM | 381 | C | PRO | A | 47 | 26.163 | 13.386 | 16.156 | 1.00 | 44.71 | | C |
| ANISOU | 381 | C | PRO | A | 47 | 6070 | 5792 | 5124 | 80 | 432 | −130 | C |
| ATOM | 382 | O | PRO | A | 47 | 26.133 | 12.509 | 15.289 | 1.00 | 37.42 | | O |
| ANISOU | 382 | O | PRO | A | 47 | 5238 | 4891 | 4087 | 119 | 483 | −162 | O |
| ATOM | 383 | CB | PRO | A | 47 | 28.392 | 13.343 | 17.302 | 1.00 | 42.07 | | C |
| ANISOU | 383 | CB | PRO | A | 47 | 5493 | 5456 | 5037 | 25 | 597 | −85 | C |
| ATOM | 384 | CG | PRO | A | 47 | 28.880 | 11.913 | 16.970 | 1.00 | 35.78 | | C |
| ANISOU | 384 | CG | PRO | A | 47 | 4692 | 4692 | 4210 | 70 | 688 | −135 | C |
| ATOM | 385 | CD | PRO | A | 47 | 28.042 | 11.055 | 17.887 | 1.00 | 34.60 | | C |
| ANISOU | 385 | CD | PRO | A | 47 | 4503 | 4558 | 4086 | 88 | 559 | −223 | C |
| ATOM | 386 | N | ARG | A | 48 | 25.592 | 14.581 | 16.002 | 1.00 | 40.05 | | N |
| ANISOU | 386 | N | ARG | A | 48 | 5531 | 5170 | 4515 | 63 | 364 | −78 | N |
| ATOM | 387 | CA | ARG | A | 48 | 24.922 | 14.968 | 14.764 | 1.00 | 40.35 | | C |
| ANISOU | 387 | CA | ARG | A | 48 | 5737 | 5201 | 4393 | 92 | 342 | −44 | C |
| ATOM | 388 | C | ARG | A | 48 | 25.335 | 16.351 | 14.276 | 1.00 | 44.00 | | C |
| ANISOU | 388 | C | ARG | A | 48 | 6246 | 5620 | 4851 | 63 | 398 | 67 | C |
| ATOM | 389 | O | ARG | A | 48 | 24.744 | 16.860 | 13.315 | 1.00 | 41.84 | | O |
| ANISOU | 389 | O | ARG | A | 48 | 6115 | 5332 | 4449 | 86 | 366 | 111 | O |
| ATOM | 390 | CB | ARG | A | 48 | 23.403 | 14.916 | 14.936 | 1.00 | 43.52 | | C |
| ANISOU | 390 | CB | ARG | A | 48 | 6178 | 5603 | 4753 | 117 | 164 | −97 | C |
| ATOM | 391 | CG | ARG | A | 48 | 22.840 | 13.518 | 14.814 | 1.00 | 48.38 | | C |
| ANISOU | 391 | CG | ARG | A | 48 | 6818 | 6257 | 5308 | 152 | 118 | −195 | C |
| ATOM | 392 | CD | ARG | A | 48 | 22.906 | 13.077 | 13.359 | 1.00 | 58.92 | | C |
| ANISOU | 392 | CD | ARG | A | 48 | 8319 | 7608 | 6461 | 187 | 175 | −190 | C |
| ATOM | 393 | NE | ARG | A | 48 | 22.452 | 11.710 | 13.171 | 1.00 | 63.82 | | N |
| ANISOU | 393 | NE | ARG | A | 48 | 8973 | 8255 | 7021 | 217 | 138 | −288 | N |
| ATOM | 394 | CZ | ARG | A | 48 | 23.216 | 10.645 | 13.381 | 1.00 | 75.71 | | C |
| ANISOU | 394 | CZ | ARG | A | 48 | 10428 | 9777 | 8560 | 223 | 239 | −337 | C |
| ATOM | 395 | NH1 | ARG | A | 48 | 22.735 | 9.424 | 13.184 | 1.00 | 81.45 | | N |
| ANISOU | 395 | NH1 | ARG | A | 48 | 11196 | 10518 | 9234 | 249 | 200 | −429 | N |
| ATOM | 396 | NH2 | ARG | A | 48 | 24.463 | 10.801 | 13.799 | 1.00 | 73.43 | | N |
| ANISOU | 396 | NH2 | ARG | A | 48 | 10044 | 9486 | 8370 | 204 | 376 | −294 | N |
| ATOM | 397 | N | ALA | A | 49 | 26.322 | 16.969 | 14.907 | 1.00 | 39.97 | | N |
| ANISOU | 397 | N | ALA | A | 49 | 5622 | 5083 | 4481 | 12 | 473 | 114 | N |
| ATOM | 398 | CA | ALA | A | 49 | 26.892 | 18.229 | 14.464 | 1.00 | 46.58 | | C |
| ANISOU | 398 | CA | ALA | A | 49 | 6491 | 5871 | 5337 | −25 | 550 | 223 | C |
| ATOM | 399 | C | ALA | A | 49 | 28.389 | 18.171 | 14.717 | 1.00 | 46.30 | | C |
| ANISOU | 399 | C | ALA | A | 49 | 6337 | 5833 | 5421 | −69 | 705 | 259 | C |
| ATOM | 400 | O | ALA | A | 49 | 28.836 | 17.464 | 15.626 | 1.00 | 44.08 | | O |
| ANISOU | 400 | O | ALA | A | 49 | 5922 | 5578 | 5250 | −79 | 701 | 200 | O |
| ATOM | 401 | CB | ALA | A | 49 | 26.277 | 19.427 | 15.201 | 1.00 | 45.10 | | C |
| ANISOU | 401 | CB | ALA | A | 49 | 6270 | 5627 | 5238 | −55 | 430 | 246 | C |
| ATOM | 402 | N | PRO | A | 50 | 29.190 | 18.892 | 13.925 | 1.00 | 53.04 | | N |
| ANISOU | 402 | N | PRO | A | 50 | 7236 | 6655 | 6262 | −95 | 843 | 360 | N |
| ATOM | 403 | CA | PRO | A | 50 | 30.650 | 18.785 | 14.091 | 1.00 | 55.13 | | C |
| ANISOU | 403 | CA | PRO | A | 50 | 7374 | 6918 | 6654 | −136 | 1002 | 397 | C |
| ATOM | 404 | C | PRO | A | 50 | 31.159 | 19.229 | 15.452 | 1.00 | 52.25 | | C |
| ANISOU | 404 | C | PRO | A | 50 | 6825 | 6528 | 6501 | −200 | 945 | 386 | C |
| ATOM | 405 | O | PRO | A | 50 | 32.081 | 18.607 | 15.990 | 1.00 | 50.31 | | O |
| ANISOU | 405 | O | PRO | A | 50 | 6438 | 6305 | 6370 | −216 | 1005 | 362 | O |
| ATOM | 406 | CB | PRO | A | 50 | 31.191 | 19.680 | 12.966 | 1.00 | 55.61 | | C |
| ANISOU | 406 | CB | PRO | A | 50 | 7536 | 6938 | 6656 | −156 | 1147 | 518 | C |
| ATOM | 407 | CG | PRO | A | 50 | 30.121 | 19.664 | 11.935 | 1.00 | 56.73 | | C |
| ANISOU | 407 | CG | PRO | A | 50 | 7886 | 7089 | 6579 | −97 | 1095 | 523 | C |
| ATOM | 408 | CD | PRO | A | 50 | 28.829 | 19.633 | 12.703 | 1.00 | 52.69 | | C |
| ANISOU | 408 | CD | PRO | A | 50 | 7369 | 6582 | 6069 | −78 | 877 | 444 | C |
| ATOM | 409 | N | TRP | A | 51 | 30.597 | 20.291 | 16.028 | 1.00 | 48.10 | | N |
| ANISOU | 409 | N | TRP | A | 51 | 6296 | 5949 | 6029 | −236 | 828 | 400 | N |

TABLE 11-continued

| | | | | | | | | | | | |
|---|---|---|---|---|---|---|---|---|---|---|---|
| ATOM | 410 | CA | TRP | A | 51 | 31.202 | 20.857 | 17.226 | 1.00 | 50.77 | C |
| ANISOU | 410 | CA | TRP | A | 51 | 6476 | 6252 | 6561 | −307 | 786 | 396 | C |
| ATOM | 411 | C | TRP | A | 51 | 30.972 | 20.012 | 18.471 | 1.00 | 49.18 | C |
| ANISOU | 411 | C | TRP | A | 51 | 6166 | 6092 | 6427 | −295 | 672 | 290 | C |
| ATOM | 412 | O | TRP | A | 51 | 31.670 | 20.214 | 19.471 | 1.00 | 50.98 | O |
| ANISOU | 412 | O | TRP | A | 51 | 6256 | 6306 | 6810 | −348 | 647 | 279 | O |
| ATOM | 413 | CB | TRP | A | 51 | 30.684 | 22.275 | 17.449 | 1.00 | 55.19 | C |
| ANISOU | 413 | CB | TRP | A | 51 | 7080 | 6732 | 7156 | −346 | 703 | 439 | C |
| ATOM | 414 | CG | TRP | A | 51 | 29.231 | 22.414 | 17.184 | 1.00 | 54.98 | C |
| ANISOU | 414 | CG | TRP | A | 51 | 7189 | 6704 | 6998 | −289 | 584 | 412 | C |
| ATOM | 415 | CD1 | TRP | A | 51 | 28.642 | 22.795 | 16.014 | 1.00 | 56.91 | C |
| ANISOU | 415 | CD1 | TRP | A | 51 | 7593 | 6932 | 7097 | −251 | 603 | 473 | C |
| ATOM | 416 | CD2 | TRP | A | 51 | 28.169 | 22.158 | 18.104 | 1.00 | 48.29 | C |
| ANISOU | 416 | CD2 | TRP | A | 51 | 6324 | 5871 | 6154 | −261 | 424 | 320 | C |
| ATOM | 417 | NE1 | TRP | A | 51 | 27.275 | 22.802 | 16.153 | 1.00 | 51.51 | N |
| ANISOU | 417 | NE1 | TRP | A | 51 | 6981 | 6251 | 6338 | −201 | 454 | 423 | N |
| ATOM | 418 | CE2 | TRP | A | 51 | 26.959 | 22.413 | 17.427 | 1.00 | 42.84 | C |
| ANISOU | 418 | CE2 | TRP | A | 51 | 5773 | 5171 | 5334 | −206 | 351 | 329 | C |
| ATOM | 419 | CE3 | TRP | A | 51 | 28.123 | 21.747 | 19.435 | 1.00 | 47.04 | C |
| ANISOU | 419 | CE3 | TRP | A | 51 | 6048 | 5731 | 6096 | −275 | 337 | 234 | C |
| ATOM | 420 | CZ2 | TRP | A | 51 | 25.722 | 22.267 | 18.036 | 1.00 | 42.76 | C |
| ANISOU | 420 | CZ2 | TRP | A | 51 | 5771 | 5168 | 5308 | −168 | 204 | 256 | C |
| ATOM | 421 | CZ3 | TRP | A | 51 | 26.892 | 21.604 | 20.035 | 1.00 | 34.34 | C |
| ANISOU | 421 | CZ3 | TRP | A | 51 | 4464 | 4129 | 4456 | −236 | 202 | 163 | C |
| ATOM | 422 | CH2 | TRP | A | 51 | 25.712 | 21.864 | 19.337 | 1.00 | 36.13 | C |
| ANISOU | 422 | CH2 | TRP | A | 51 | 4814 | 4345 | 4570 | −184 | 141 | 174 | C |
| ATOM | 423 | N | ILE | A | 52 | 30.031 | 19.070 | 18.441 | 1.00 | 41.19 | N |
| ANISOU | 423 | N | ILE | A | 52 | 5216 | 5129 | 5304 | −229 | 600 | 216 | N |
| ATOM | 424 | CA | ILE | A | 52 | 29.842 | 18.187 | 19.584 | 1.00 | 34.89 | C |
| ANISOU | 424 | CA | ILE | A | 52 | 4322 | 4369 | 4564 | −216 | 510 | 124 | C |
| ATOM | 425 | C | ILE | A | 52 | 30.776 | 16.975 | 19.545 | 1.00 | 39.86 | C |
| ANISOU | 425 | C | ILE | A | 52 | 4869 | 5049 | 5226 | −196 | 607 | 104 | C |
| ATOM | 426 | O | ILE | A | 52 | 31.030 | 16.371 | 20.596 | 1.00 | 39.56 | O |
| ANISOU | 426 | O | ILE | A | 52 | 4720 | 5033 | 5279 | −201 | 553 | 52 | O |
| ATOM | 427 | CB | ILE | A | 52 | 28.377 | 17.723 | 19.682 | 1.00 | 40.76 | C |
| ANISOU | 427 | CB | ILE | A | 52 | 5152 | 5134 | 5200 | −161 | 386 | 53 | C |
| ATOM | 428 | CG1 | ILE | A | 52 | 28.045 | 17.292 | 21.115 | 1.00 | 35.00 | C |
| ANISOU | 428 | CG1 | ILE | A | 52 | 4326 | 4419 | 4553 | −165 | 273 | −26 | C |
| ATOM | 429 | CG2 | ILE | A | 52 | 28.098 | 16.589 | 18.697 | 1.00 | 37.87 | C |
| ANISOU | 429 | CG2 | ILE | A | 52 | 4875 | 4818 | 4698 | −98 | 438 | 26 | C |
| ATOM | 430 | CD1 | ILE | A | 52 | 28.091 | 18.457 | 22.108 | 1.00 | 34.85 | C |
| ANISOU | 430 | CD1 | ILE | A | 52 | 4252 | 4346 | 4644 | −222 | 199 | −17 | C |
| ATOM | 431 | N | GLU | A | 53 | 31.308 | 16.614 | 18.372 | 1.00 | 44.34 | N |
| ANISOU | 431 | N | GLU | A | 53 | 5494 | 5632 | 5722 | −171 | 753 | 146 | N |
| ATOM | 432 | CA | GLU | A | 53 | 32.198 | 15.454 | 18.282 | 1.00 | 51.98 | C |
| ANISOU | 432 | CA | GLU | A | 53 | 6385 | 6640 | 6725 | −142 | 859 | 126 | C |
| ATOM | 433 | C | GLU | A | 53 | 33.407 | 15.581 | 19.204 | 1.00 | 51.64 | C |
| ANISOU | 433 | C | GLU | A | 53 | 6153 | 6589 | 6880 | −194 | 883 | 148 | C |
| ATOM | 434 | O | GLU | A | 53 | 33.970 | 14.565 | 19.632 | 1.00 | 57.76 | O |
| ANISOU | 434 | O | GLU | A | 53 | 6830 | 7396 | 7720 | −169 | 907 | 113 | O |
| ATOM | 435 | CB | GLU | A | 53 | 32.666 | 15.266 | 16.835 | 1.00 | 55.71 | C |
| ANISOU | 435 | CB | GLU | A | 53 | 6955 | 7118 | 7093 | −112 | 1035 | 178 | C |
| ATOM | 436 | CG | GLU | A | 53 | 31.601 | 14.692 | 15.927 | 1.00 | 66.94 | C |
| ANISOU | 436 | CG | GLU | A | 53 | 8559 | 8564 | 8312 | −47 | 1010 | 135 | C |
| ATOM | 437 | CD | GLU | A | 53 | 31.881 | 14.942 | 14.460 | 1.00 | 76.17 | C |
| ANISOU | 437 | CD | GLU | A | 53 | 9869 | 9725 | 9347 | −28 | 1161 | 202 | C |
| ATOM | 438 | OE1 | GLU | A | 53 | 32.877 | 15.624 | 14.146 | 1.00 | 80.37 | O |
| ANISOU | 438 | OE1 | GLU | A | 53 | 10355 | 10230 | 9950 | −67 | 1295 | 289 | O |
| ATOM | 439 | OE2 | GLU | A | 53 | 31.098 | 14.460 | 13.617 | 1.00 | 80.05 | O |
| ANISOU | 439 | OE2 | GLU | A | 53 | 10521 | 10235 | 9660 | 24 | 1144 | 167 | O |
| ATOM | 440 | N | GLN | A | 54 | 33.812 | 16.813 | 19.530 | 1.00 | 41.35 | N |
| ANISOU | 440 | N | GLN | A | 54 | 4795 | 5237 | 5679 | −267 | 868 | 206 | N |
| ATOM | 441 | CA | GLN | A | 54 | 34.999 | 17.054 | 20.342 | 1.00 | 48.91 | C |
| ANISOU | 441 | CA | GLN | A | 54 | 5572 | 6181 | 6832 | −327 | 881 | 231 | C |
| ATOM | 442 | C | GLN | A | 54 | 34.831 | 16.632 | 21.799 | 1.00 | 46.03 | C |
| ANISOU | 442 | C | GLN | A | 54 | 5108 | 5833 | 6547 | −333 | 725 | 157 | C |
| ATOM | 443 | O | GLN | A | 54 | 35.842 | 16.519 | 22.506 | 1.00 | 49.04 | O |
| ANISOU | 443 | O | GLN | A | 54 | 5335 | 6217 | 7083 | −369 | 722 | 167 | O |
| ATOM | 444 | CB | GLN | A | 54 | 35.384 | 18.536 | 20.287 | 1.00 | 53.26 | C |
| ANISOU | 444 | CB | GLN | A | 54 | 6105 | 6664 | 7468 | −410 | 895 | 308 | C |
| ATOM | 445 | CG | GLN | A | 54 | 34.487 | 19.441 | 21.125 | 1.00 | 63.65 | C |
| ANISOU | 445 | CG | GLN | A | 54 | 7461 | 7939 | 8786 | −445 | 725 | 275 | C |
| ATOM | 446 | CD | GLN | A | 54 | 34.884 | 20.911 | 21.050 | 1.00 | 71.56 | C |
| ANISOU | 446 | CD | GLN | A | 54 | 8451 | 8859 | 9878 | −529 | 742 | 348 | C |
| ATOM | 447 | OE1 | GLN | A | 54 | 34.383 | 21.660 | 20.204 | 1.00 | 69.19 | O |
| ANISOU | 447 | OE1 | GLN | A | 54 | 8279 | 8520 | 9490 | −527 | 781 | 401 | O |
| ATOM | 448 | NE2 | GLN | A | 54 | 35.780 | 21.334 | 21.946 | 1.00 | 66.56 | N |
| ANISOU | 448 | NE2 | GLN | A | 54 | 7669 | 8197 | 9424 | −604 | 704 | 353 | N |
| ATOM | 449 | N | GLU | A | 55 | 33.603 | 16.398 | 22.261 | 1.00 | 36.68 | N |
| ANISOU | 449 | N | GLU | A | 55 | 4009 | 4661 | 5266 | −300 | 596 | 88 | N |

TABLE 11-continued

| | | | | | | | | | | | |
|---|---|---|---|---|---|---|---|---|---|---|---|
| ATOM | 450 | CA | GLU | A | 55 | 33.384 | 16.027 | 23.657 | 1.00 | 35.50 | C |
| ANISOU | 450 | CA | GLU | A | 55 | 3786 | 4526 | 5177 | −304 | 456 | 21 | C |
| ATOM | 451 | C | GLU | A | 55 | 34.023 | 14.670 | 23.967 | 1.00 | 37.40 | C |
| ANISOU | 451 | C | GLU | A | 55 | 3932 | 4815 | 5463 | −261 | 489 | −6 | C |
| ATOM | 452 | O | GLU | A | 55 | 34.089 | 13.780 | 23.116 | 1.00 | 38.78 | O |
| ANISOU | 452 | O | GLU | A | 55 | 4146 | 5018 | 5571 | −204 | 592 | −8 | O |
| ATOM | 453 | CB | GLU | A | 55 | 31.885 | 15.991 | 23.969 | 1.00 | 35.57 | C |
| ANISOU | 453 | CB | GLU | A | 55 | 3909 | 4537 | 5069 | −270 | 339 | −42 | C |
| ATOM | 454 | CG | GLU | A | 55 | 31.156 | 17.349 | 23.761 | 1.00 | 38.34 | C |
| ANISOU | 454 | CG | GLU | A | 55 | 4351 | 4833 | 5383 | −303 | 292 | −18 | C |
| ATOM | 455 | CD | GLU | A | 55 | 31.484 | 18.396 | 24.820 | 1.00 | 44.81 | C |
| ANISOU | 455 | CD | GLU | A | 55 | 5101 | 5603 | 6321 | −375 | 208 | −16 | C |
| ATOM | 456 | OE1 | GLU | A | 55 | 32.025 | 18.034 | 25.887 | 1.00 | 46.43 | O |
| ANISOU | 456 | OE1 | GLU | A | 55 | 5202 | 5824 | 6616 | −396 | 149 | −49 | O |
| ATOM | 457 | OE2 | GLU | A | 55 | 31.184 | 19.586 | 24.587 | 1.00 | 43.28 | O |
| ANISOU | 457 | OE2 | GLU | A | 55 | 4965 | 5351 | 6129 | −410 | 194 | 17 | O |
| ATOM | 458 | N | GLY | A | 56 | 34.476 | 14.514 | 25.212 | 1.00 | 41.34 | N |
| ANISOU | 458 | N | GLY | A | 56 | 4315 | 5319 | 6072 | −287 | 394 | −30 | N |
| ATOM | 459 | CA | GLY | A | 56 | 35.268 | 13.365 | 25.603 | 1.00 | 42.41 | C |
| ANISOU | 459 | CA | GLY | A | 56 | 4338 | 5491 | 6283 | −252 | 417 | −40 | C |
| ATOM | 460 | C | GLY | A | 56 | 34.424 | 12.166 | 25.998 | 1.00 | 42.09 | C |
| ANISOU | 460 | C | GLY | A | 56 | 4354 | 5484 | 6153 | −183 | 359 | −109 | C |
| ATOM | 461 | O | GLY | A | 56 | 33.195 | 12.217 | 26.002 | 1.00 | 37.35 | O |
| ANISOU | 461 | O | GLY | A | 56 | 3872 | 4883 | 5438 | −166 | 298 | −153 | O |
| ATOM | 462 | N | PRO | A | 57 | 35.084 | 11.057 | 26.348 | 1.00 | 36.44 | N |
| ANISOU | 462 | N | PRO | A | 57 | 3548 | 4796 | 5503 | −143 | 379 | −117 | N |
| ATOM | 463 | CA | PRO | A | 57 | 34.341 | 9.824 | 26.668 | 1.00 | 32.72 | C |
| ANISOU | 463 | CA | PRO | A | 57 | 3129 | 4349 | 4955 | −77 | 339 | −177 | C |
| ATOM | 464 | C | PRO | A | 57 | 33.359 | 9.972 | 27.813 | 1.00 | 34.28 | C |
| ANISOU | 464 | C | PRO | A | 57 | 3371 | 4544 | 5109 | −91 | 186 | −227 | C |
| ATOM | 465 | O | PRO | A | 57 | 32.320 | 9.301 | 27.799 | 1.00 | 34.70 | O |
| ANISOU | 465 | O | PRO | A | 57 | 3514 | 4606 | 5064 | −48 | 160 | −276 | O |
| ATOM | 466 | CB | PRO | A | 57 | 35.450 | 8.817 | 27.016 | 1.00 | 40.76 | C |
| ANISOU | 466 | CB | PRO | A | 57 | 4016 | 5384 | 6088 | −42 | 377 | −161 | C |
| ATOM | 467 | CG | PRO | A | 57 | 36.694 | 9.357 | 26.353 | 1.00 | 40.97 | C |
| ANISOU | 467 | CG | PRO | A | 57 | 3942 | 5401 | 6225 | −71 | 493 | −92 | C |
| ATOM | 468 | CD | PRO | A | 57 | 36.548 | 10.854 | 26.310 | 1.00 | 35.61 | C |
| ANISOU | 468 | CD | PRO | A | 57 | 3287 | 4694 | 5548 | −152 | 457 | −64 | C |
| ATOM | 469 | N | GLU | A | 58 | 33.652 | 10.797 | 28.822 | 1.00 | 36.36 | N |
| ANISOU | 469 | N | GLU | A | 58 | 3576 | 4794 | 5446 | −148 | 85 | −219 | N |
| ATOM | 470 | CA | GLU | A | 58 | 32.692 | 10.939 | 29.918 | 1.00 | 38.92 | C |
| ANISOU | 470 | CA | GLU | A | 58 | 3955 | 5114 | 5717 | −156 | −46 | −269 | C |
| ATOM | 471 | C | GLU | A | 58 | 31.404 | 11.588 | 29.442 | 1.00 | 34.41 | C |
| ANISOU | 471 | C | GLU | A | 58 | 3514 | 4524 | 5035 | −158 | −55 | −296 | C |
| ATOM | 472 | O | GLU | A | 58 | 30.317 | 11.247 | 29.931 | 1.00 | 33.01 | O |
| ANISOU | 472 | O | GLU | A | 58 | 3406 | 4351 | 4784 | −132 | −116 | −345 | O |
| ATOM | 473 | CB | GLU | A | 58 | 33.300 | 11.742 | 31.075 | 1.00 | 41.95 | C |
| ANISOU | 473 | CB | GLU | A | 58 | 4264 | 5482 | 6192 | −218 | −154 | −261 | C |
| ATOM | 474 | CG | GLU | A | 58 | 34.472 | 11.022 | 31.751 | 1.00 | 44.84 | C |
| ANISOU | 474 | CG | GLU | A | 58 | 4498 | 5869 | 6668 | −211 | −182 | −239 | C |
| ATOM | 475 | CD | GLU | A | 58 | 35.100 | 11.815 | 32.886 | 0.00 | 45.30 | C |
| ANISOU | 475 | CD | GLU | A | 58 | 4486 | 5913 | 6814 | −277 | −307 | −235 | C |
| ATOM | 476 | OE1 | GLU | A | 58 | 34.535 | 12.852 | 33.289 | 1.00 | 44.43 | O |
| ANISOU | 476 | OE1 | GLU | A | 58 | 4444 | 5773 | 6667 | −325 | −375 | −261 | O |
| ATOM | 477 | OE2 | GLU | A | 58 | 36.171 | 11.397 | 33.377 | 0.00 | 45.07 | O |
| ANISOU | 477 | OE2 | GLU | A | 58 | 4334 | 5898 | 6894 | −280 | −342 | −207 | O |
| ATOM | 478 | N | TYR | A | 59 | 31.501 | 12.537 | 28.510 | 1.00 | 34.06 | N |
| ANISOU | 478 | N | TYR | A | 59 | 3501 | 4456 | 4984 | −188 | 4 | −259 | N |
| ATOM | 479 | CA | TYR | A | 59 | 30.290 | 13.122 | 27.937 | 1.00 | 38.31 | C |
| ANISOU | 479 | CA | TYR | A | 59 | 4162 | 4975 | 5419 | −180 | −5 | −275 | C |
| ATOM | 480 | C | TYR | A | 59 | 29.435 | 12.060 | 27.254 | 1.00 | 35.24 | C |
| ANISOU | 480 | C | TYR | A | 59 | 3851 | 4612 | 4925 | −115 | 30 | −309 | C |
| ATOM | 481 | O | TYR | A | 59 | 28.234 | 11.948 | 27.528 | 1.00 | 32.97 | O |
| ANISOU | 481 | O | TYR | A | 59 | 3632 | 4323 | 4570 | −95 | −35 | −355 | O |
| ATOM | 482 | CB | TYR | A | 59 | 30.646 | 14.234 | 26.948 | 1.00 | 32.66 | C |
| ANISOU | 482 | CB | TYR | A | 59 | 3470 | 4227 | 4711 | −218 | 64 | −217 | C |
| ATOM | 483 | CG | TYR | A | 59 | 29.413 | 14.888 | 26.310 | 1.00 | 33.46 | C |
| ANISOU | 483 | CG | TYR | A | 59 | 3699 | 4305 | 4709 | −205 | 46 | −224 | C |
| ATOM | 484 | CD1 | TYR | A | 59 | 28.774 | 15.968 | 26.917 | 1.00 | 33.82 | C |
| ANISOU | 484 | CD1 | TYR | A | 59 | 3779 | 4309 | 4763 | −237 | −41 | −236 | C |
| ATOM | 485 | CD2 | TYR | A | 59 | 28.898 | 14.425 | 25.102 | 1.00 | 31.93 | C |
| ANISOU | 485 | CD2 | TYR | A | 59 | 3595 | 4128 | 4410 | −158 | 111 | −219 | C |
| ATOM | 486 | CE1 | TYR | A | 59 | 27.650 | 16.579 | 26.338 | 1.00 | 32.86 | C |
| ANISOU | 486 | CE1 | TYR | A | 59 | 3763 | 4162 | 4561 | −218 | −62 | −237 | C |
| ATOM | 487 | CE2 | TYR | A | 59 | 27.778 | 15.027 | 24.517 | 1.00 | 31.90 | C |
| ANISOU | 487 | CE2 | TYR | A | 59 | 3701 | 4102 | 4315 | −144 | 77 | −220 | C |
| ATOM | 488 | CZ | TYR | A | 59 | 27.170 | 16.108 | 25.140 | 1.00 | 34.25 | C |
| ANISOU | 488 | CZ | TYR | A | 59 | 4017 | 4358 | 4637 | −173 | −8 | −225 | C |
| ATOM | 489 | OH | TYR | A | 59 | 26.062 | 16.693 | 24.565 | 1.00 | 31.57 | O |
| ANISOU | 489 | OH | TYR | A | 59 | 3777 | 3994 | 4222 | −151 | −45 | −222 | O |

TABLE 11-continued

| | | | | | | | | | | | | |
|---|---|---|---|---|---|---|---|---|---|---|---|---|
| ATOM | 490 | N | TRP | A | 60 | 30.031 | 11.268 | 26.355 | 1.00 | 34.64 | | N |
| ANISOU | 490 | N | TRP | A | 60 | 3766 | 4557 | 4840 | −82 | 135 | −291 | N |
| ATOM | 491 | CA | TRP | A | 60 | 29.216 | 10.322 | 25.588 | 1.00 | 37.03 | | C |
| ANISOU | 491 | CA | TRP | A | 60 | 4159 | 4876 | 5037 | −26 | 166 | −329 | C |
| ATOM | 492 | C | TRP | A | 60 | 28.706 | 9.181 | 26.461 | 1.00 | 36.74 | | C |
| ANISOU | 492 | C | TRP | A | 60 | 4107 | 4854 | 5000 | 8 | 105 | −385 | C |
| ATOM | 493 | O | TRP | A | 60 | 27.577 | 8.707 | 26.261 | 1.00 | 32.07 | | O |
| ANISOU | 493 | O | TRP | A | 60 | 3593 | 4264 | 4328 | 36 | 72 | −431 | O |
| ATOM | 494 | CB | TRP | A | 60 | 29.993 | 9.793 | 24.379 | 1.00 | 35.30 | | C |
| ANISOU | 494 | CB | TRP | A | 60 | 3949 | 4666 | 4797 | 3 | 304 | −302 | C |
| ATOM | 495 | CG | TRP | A | 60 | 30.262 | 10.919 | 23.446 | 1.00 | 40.83 | | C |
| ANISOU | 495 | CG | TRP | A | 60 | 4693 | 5348 | 5473 | −28 | 367 | −244 | C |
| ATOM | 496 | CD1 | TRP | A | 60 | 31.460 | 11.567 | 23.246 | 1.00 | 40.60 | | C |
| ANISOU | 496 | CD1 | TRP | A | 60 | 4587 | 5307 | 5533 | −65 | 449 | −178 | C |
| ATOM | 497 | CD2 | TRP | A | 60 | 29.295 | 11.600 | 22.635 | 1.00 | 35.08 | | C |
| ANISOU | 497 | CD2 | TRP | A | 60 | 4091 | 4605 | 4632 | −27 | 348 | −240 | C |
| ATOM | 498 | NE1 | TRP | A | 60 | 31.290 | 12.585 | 22.338 | 1.00 | 41.96 | | N |
| ANISOU | 498 | NE1 | TRP | A | 60 | 4841 | 5456 | 5647 | −89 | 492 | −131 | N |
| ATOM | 499 | CE2 | TRP | A | 60 | 29.974 | 12.637 | 21.959 | 1.00 | 39.22 | | C |
| ANISOU | 499 | CE2 | TRP | A | 60 | 4622 | 5107 | 5173 | −63 | 427 | −166 | C |
| ATOM | 500 | CE3 | TRP | A | 60 | 27.917 | 11.421 | 22.400 | 1.00 | 28.50 | | C |
| ANISOU | 500 | CE3 | TRP | A | 60 | 3364 | 3774 | 3693 | 0 | 270 | −287 | C |
| ATOM | 501 | CZ2 | TRP | A | 60 | 29.326 | 13.501 | 21.070 | 1.00 | 36.38 | | C |
| ANISOU | 501 | CZ2 | TRP | A | 60 | 4381 | 4725 | 4717 | −68 | 427 | −135 | C |
| ATOM | 502 | CZ3 | TRP | A | 60 | 27.280 | 12.278 | 21.522 | 1.00 | 31.63 | | C |
| ANISOU | 502 | CZ3 | TRP | A | 60 | 3866 | 4151 | 4001 | −3 | 261 | −259 | C |
| ATOM | 503 | CH2 | TRP | A | 60 | 27.985 | 13.308 | 20.864 | 1.00 | 34.57 | | C |
| ANISOU | 503 | CH2 | TRP | A | 60 | 4254 | 4501 | 4381 | −34 | 339 | −182 | C |
| ATOM | 504 | N | ASP | A | 61 | 29.523 | 8.722 | 27.421 | 1.00 | 32.95 | | N |
| ANISOU | 504 | N | ASP | A | 61 | 3525 | 4383 | 4611 | 5 | 87 | −379 | N |
| ATOM | 505 | CA | ASP | A | 61 | 29.049 | 7.750 | 28.406 | 1.00 | 34.72 | | C |
| ANISOU | 505 | CA | ASP | A | 61 | 3739 | 4615 | 4837 | 33 | 23 | −421 | C |
| ATOM | 506 | C | ASP | A | 61 | 27.921 | 8.327 | 29.251 | 1.00 | 34.93 | | C |
| ANISOU | 506 | C | ASP | A | 61 | 3813 | 4632 | 4828 | 12 | −80 | −453 | C |
| ATOM | 507 | O | ASP | A | 61 | 26.901 | 7.665 | 29.483 | 1.00 | 33.42 | | O |
| ANISOU | 507 | O | ASP | A | 61 | 3671 | 4441 | 4587 | 38 | −111 | −496 | O |
| ATOM | 508 | CB | ASP | A | 61 | 30.189 | 7.306 | 29.325 | 1.00 | 38.83 | | C |
| ANISOU | 508 | CB | ASP | A | 61 | 4145 | 5145 | 5462 | 33 | 8 | −396 | C |
| ATOM | 509 | CG | ASP | Z | 61 | 31.128 | 6.306 | 28.671 | 1.00 | 51.36 | | C |
| ANISOU | 509 | CG | ASP | A | 61 | 5680 | 6742 | 7093 | 77 | 111 | −377 | C |
| ATOM | 510 | OD1 | ASP | A | 61 | 31.011 | 6.067 | 27.451 | 1.00 | 51.45 | | O |
| ANISOU | 510 | OD1 | ASP | A | 61 | 5751 | 6751 | 7049 | 102 | 206 | −383 | O |
| ATOM | 511 | OD2 | ASP | A | 61 | 31.989 | 5.759 | 29.392 | 1.00 | 59.96 | | O |
| ANISOU | 511 | OD2 | ASP | A | 61 | 6673 | 7838 | 8272 | 90 | 96 | −357 | O |
| ATOM | 512 | N | GLY | A | 62 | 28.107 | 9.547 | 29.752 | 1.00 | 32.34 | | N |
| ANISOU | 512 | N | GLY | A | 62 | 3466 | 4289 | 4534 | −37 | −130 | −434 | N |
| ATOM | 513 | CA | GLY | A | 62 | 27.078 | 10.171 | 30.575 | 1.00 | 32.32 | | C |
| ANISOU | 513 | CA | GLY | A | 62 | 3510 | 4270 | 4501 | −53 | −216 | −467 | C |
| ATOM | 514 | C | GLY | A | 62 | 25.783 | 10.417 | 29.819 | 1.00 | 32.88 | | C |
| ANISOU | 514 | C | GLY | A | 62 | 3672 | 4329 | 4493 | −35 | −214 | −491 | C |
| ATOM | 515 | O | GLY | A | 62 | 24.695 | 10.120 | 30.320 | 1.00 | 36.27 | | O |
| ANISOU | 515 | O | GLY | A | 62 | 4137 | 4755 | 4889 | −17 | −259 | −531 | O |
| ATOM | 516 | N | GLU | A | 63 | 25.878 | 10.979 | 28.613 | 1.00 | 32.00 | | N |
| ANISOU | 516 | N | GLU | A | 63 | 3597 | 4210 | 4353 | −40 | −164 | −462 | N |
| ATOM | 517 | CA | GLU | A | 63 | 24.669 | 11.249 | 27.843 | 1.00 | 31.16 | | C |
| ANISOU | 517 | CA | GLU | A | 63 | 3576 | 4091 | 4170 | −22 | −178 | −478 | C |
| ATOM | 518 | C | GLU | A | 63 | 23.955 | 9.952 | 27.496 | 1.00 | 31.81 | | C |
| ANISOU | 518 | C | GLU | A | 63 | 3692 | 4194 | 4202 | 22 | −171 | −521 | C |
| ATOM | 519 | O | GLU | A | 63 | 22.724 | 9.891 | 27.506 | 1.00 | 27.79 | | O |
| ANISOU | 519 | O | GLU | A | 63 | 3226 | 3678 | 3657 | 37 | −221 | −555 | O |
| ATOM | 520 | CB | GLU | A | 63 | 25.006 | 12.034 | 26.569 | 1.00 | 29.93 | | C |
| ANISOU | 520 | CB | GLU | A | 63 | 3466 | 3924 | 3982 | −32 | −124 | −430 | C |
| ATOM | 521 | CG | GLU | A | 63 | 25.558 | 13.445 | 26.850 | 1.00 | 30.97 | | C |
| ANISOU | 521 | CG | GLU | A | 63 | 3574 | 4021 | 4171 | −82 | −134 | −386 | C |
| ATOM | 522 | CD | GLU | A | 63 | 24.606 | 14.255 | 27.689 | 1.00 | 34.94 | | C |
| ANISOU | 522 | CD | GLU | A | 63 | 4099 | 4493 | 4684 | −93 | −222 | −413 | C |
| ATOM | 523 | OE1 | GLU | A | 63 | 24.952 | 14.576 | 28.842 | 1.00 | 37.65 | | O |
| ANISOU | 523 | OE1 | GLU | A | 63 | 4393 | 4823 | 5087 | −122 | −264 | −427 | O |
| ATOM | 524 | OE2 | GLU | A | 63 | 23.500 | 14.552 | 27.191 | 1.00 | 33.94 | | O |
| ANISOU | 524 | OE2 | GLU | A | 63 | 4040 | 4352 | 4502 | −69 | −251 | −423 | O |
| ATOM | 525 | N | THR | A | 64 | 24.715 | 8.901 | 27.182 | 1.00 | 27.69 | | N |
| ANISOU | 525 | N | THR | A | 64 | 3144 | 3691 | 3686 | 43 | −109 | −520 | N |
| ATOM | 526 | CA | THR | A | 64 | 24.084 | 7.603 | 26.920 | 1.00 | 24.93 | | C |
| ANISOU | 526 | CA | THR | A | 64 | 2826 | 3349 | 3296 | 81 | −103 | −566 | C |
| ATOM | 527 | C | THR | A | 64 | 23.354 | 7.097 | 28.153 | 1.00 | 30.16 | | C |
| ANISOU | 527 | C | THR | A | 64 | 3463 | 4008 | 3989 | 84 | −166 | −602 | C |
| ATOM | 528 | O | THR | A | 64 | 22.184 | 6.686 | 28.073 | 1.00 | 31.30 | | O |
| ANISOU | 528 | O | THR | A | 64 | 3646 | 4145 | 4101 | 97 | −202 | −642 | O |
| ATOM | 529 | CB | THR | A | 64 | 25.132 | 6.583 | 26.458 | 1.00 | 27.43 | | C |
| ANISOU | 529 | CB | THR | A | 64 | 3117 | 3677 | 3626 | 106 | −16 | −559 | C |

TABLE 11-continued

| | | | | | | | | | | | | |
|---|---|---|---|---|---|---|---|---|---|---|---|---|
| ATOM | 530 | OG1 | THR | A | 64 | 25.719 | 7.041 | 25.235 | 1.00 | 31.76 | | O |
| ANISOU | 530 | OG1 | THR | A | 64 | 3703 | 4229 | 4136 | 106 | 59 | −526 | O |
| ATOM | 531 | CG2 | THR | A | 64 | 24.449 | 5.188 | 26.238 | 1.00 | 31.96 | | C |
| ANISOU | 531 | CG2 | THR | A | 64 | 3731 | 4248 | 4166 | 143 | −14 | −615 | C |
| ATOM | 532 | N | ARG | A | 65 | 24.032 | 7.114 | 29.306 | 1.00 | 29.58 | | N |
| ANISOU | 532 | N | ARG | A | 65 | 3324 | 3938 | 3976 | 71 | −182 | −587 | N |
| ATOM | 533 | CA | ARG | A | 65 | 23.420 | 6.624 | 30.547 | 1.00 | 34.12 | | C |
| ANISOU | 533 | CA | ARG | A | 65 | 3885 | 4509 | 4569 | 76 | −231 | −614 | C |
| ATOM | 534 | C | ARG | A | 65 | 22.139 | 7.381 | 30.879 | 1.00 | 31.83 | | C |
| ANISOU | 534 | C | ARG | A | 65 | 3634 | 4203 | 4256 | 65 | −286 | −638 | C |
| ATOM | 535 | O | ARG | A | 65 | 21.119 | 6.788 | 31.272 | 1.00 | 29.35 | | O |
| ANISOU | 535 | O | ARG | A | 65 | 3335 | 3882 | 3934 | 79 | −304 | −671 | O |
| ATOM | 536 | CB | ARG | A | 65 | 24.416 | 6.760 | 31.705 | 1.00 | 35.20 | | C |
| ANISOU | 536 | CB | ARG | A | 65 | 3961 | 4653 | 4762 | 60 | −253 | −587 | C |
| ATOM | 537 | CG | ARG | A | 65 | 23.794 | 6.656 | 33.081 | 1.00 | 44.45 | | C |
| ANISOU | 537 | CG | ARG | A | 65 | 5137 | 5818 | 5932 | 58 | −309 | −607 | C |
| ATOM | 538 | CD | ARG | A | 65 | 24.793 | 6.957 | 34.223 | 1.00 | 56.06 | | C |
| ANISOU | 538 | CD | ARG | A | 65 | 6562 | 7295 | 7443 | 38 | −352 | −582 | C |
| ATOM | 539 | NE | ARG | A | 65 | 25.484 | 8.239 | 34.073 | 1.00 | 60.37 | | N |
| ANISOU | 539 | NE | ARG | A | 65 | 7086 | 7836 | 8016 | −3 | −371 | −561 | N |
| ATOM | 540 | CZ | ARG | A | 65 | 25.005 | 9.409 | 34.490 | 1.00 | 61.71 | | C |
| ANISOU | 540 | CZ | ARG | A | 65 | 7290 | 7986 | 8172 | −33 | −414 | −575 | C |
| ATOM | 541 | NH1 | ARG | A | 65 | 23.823 | 9.475 | 35.089 | 1.00 | 60.30 | | N |
| ANISOU | 541 | NH1 | ARG | A | 65 | 7165 | 7795 | 7953 | −22 | −436 | −611 | N |
| ATOM | 542 | NH2 | ARG | A | 65 | 25.708 | 10.518 | 34.301 | 1.00 | 65.18 | | N |
| ANISOU | 542 | NH2 | ARG | A | 65 | 7708 | 8411 | 8646 | −74 | −427 | −553 | N |
| ATOM | 543 | N | LYS | A | 66 | 22.189 | 8.705 | 30.765 | 1.00 | 29.30 | | N |
| ANISOU | 543 | N | LYS | A | 66 | 3325 | 3873 | 3937 | 40 | −306 | −619 | N |
| ATOM | 544 | CA | LYS | A | 66 | 21.048 | 9.528 | 31.154 | 1.00 | 29.85 | | C |
| ANISOU | 544 | CA | LYS | A | 66 | 3424 | 3920 | 3998 | 35 | −353 | −640 | C |
| ATOM | 545 | C | LYS | A | 66 | 19.881 | 9.359 | 30.190 | 1.00 | 31.65 | | C |
| ANISOU | 545 | C | LYS | A | 66 | 3694 | 4142 | 4189 | 57 | −362 | −661 | C |
| ATOM | 546 | O | LYS | A | 66 | 18.716 | 9.323 | 30.612 | 1.00 | 27.99 | | O |
| ANISOU | 546 | O | LYS | A | 66 | 3237 | 3666 | 3732 | 68 | −393 | −690 | O |
| ATOM | 547 | CB | LYS | A | 66 | 21.473 | 10.991 | 31.212 | 1.00 | 31.29 | | C |
| ANISOU | 547 | CB | LYS | A | 66 | 3611 | 4081 | 4197 | 4 | −371 | −613 | C |
| ATOM | 548 | CG | LYS | A | 66 | 22.368 | 11.387 | 32.388 | 1.00 | 34.64 | | C |
| ANISOU | 548 | CG | LYS | A | 66 | 3998 | 4501 | 4661 | −27 | −393 | −605 | C |
| ATOM | 549 | CD | LYS | A | 66 | 22.689 | 12.911 | 32.323 | 1.00 | 37.00 | | C |
| ANISOU | 549 | CD | LYS | A | 66 | 4309 | 4766 | 4984 | −64 | −413 | −584 | C |
| ATOM | 550 | CE | LYS | A | 66 | 23.643 | 13.311 | 31.200 | 1.00 | 41.44 | | C |
| ANISOU | 550 | CE | LYS | A | 66 | 4857 | 5328 | 5561 | −84 | −369 | −534 | C |
| ATOM | 551 | NZ | LYS | A | 66 | 23.913 | 14.824 | 31.064 | 1.00 | 34.06 | | N |
| ANISOU | 551 | NZ | LYS | A | 66 | 3938 | 4348 | 4657 | −125 | −384 | −507 | N |
| ATOM | 552 | N | VAL | A | 67 | 20.151 | 9.275 | 28.887 | 1.00 | 27.07 | | N |
| ANISOU | 552 | N | VAL | A | 67 | 3145 | 3571 | 3571 | 64 | −336 | −645 | N |
| ATOM | 553 | C | VAL | A | 67 | 18.433 | 7.715 | 28.102 | 1.00 | 29.83 | | C |
| ANISOU | 553 | C | VAL | A | 67 | 3533 | 3921 | 3882 | 100 | −366 | −712 | C |
| ATOM | 554 | O | VAL | A | 67 | 17.231 | 7.527 | 27.888 | 1.00 | 30.02 | | O |
| ANISOU | 554 | O | VAL | A | 67 | 3569 | 3935 | 3904 | 110 | −410 | −742 | O |
| ATOM | 555 | CA | AVAL | A | 67 | 19.048 | 9.099 | 27.942 | 0.68 | 30.16 | | C |
| ANISOU | 555 | CA | AVAL | A | 67 | 3583 | 3956 | 3919 | 84 | −363 | −667 | C |
| ATOM | 556 | CB | AVAL | A | 67 | 19.510 | 9.356 | 26.491 | 0.68 | 30.36 | | C |
| ANISOU | 556 | CB | AVAL | A | 67 | 3665 | 3989 | 3883 | 88 | −335 | −638 | C |
| ATOM | 557 | CG1 | AVAL | A | 67 | 20.184 | 8.137 | 25.879 | 0.68 | 27.16 | | C |
| ANISOU | 557 | CG1 | AVAL | A | 67 | 3271 | 3603 | 3447 | 103 | −276 | −651 | C |
| ATOM | 558 | CG2 | AVAL | A | 67 | 18.335 | 9.749 | 25.632 | 0.68 | 29.42 | | C |
| ANISOU | 558 | CG2 | AVAL | A | 67 | 3602 | 3859 | 3719 | 103 | −394 | −647 | C |
| ATOM | 559 | CA | BVAL | A | 67 | 19.013 | 9.110 | 27.988 | 0.32 | 29.73 | | C |
| ANISOU | 559 | CA | BVAL | A | 67 | 3528 | 3902 | 3867 | 84 | −365 | −668 | C |
| ATOM | 560 | CB | BVAL | A | 67 | 19.379 | 9.448 | 26.536 | 0.32 | 30.03 | | C |
| ANISOU | 560 | CB | BVAL | A | 67 | 3623 | 3944 | 3842 | 88 | −343 | −639 | C |
| ATOM | 561 | CG1 | BVAL | A | 67 | 19.857 | 10.846 | 26.494 | 0.32 | 28.93 | | C |
| ANISOU | 561 | CG1 | BVAL | A | 67 | 3490 | 3789 | 3713 | 67 | −341 | −591 | C |
| ATOM | 562 | CG2 | BVAL | A | 67 | 20.405 | 8.472 | 25.973 | 0.32 | 30.22 | | C |
| ANISOU | 562 | CG2 | BVAL | A | 67 | 3652 | 3989 | 3843 | 96 | −271 | −637 | C |
| ATOM | 563 | N | LYS | A | 68 | 19.243 | 6.716 | 28.474 | 1.00 | 29.06 | | N |
| ANISOU | 563 | N | LYS | A | 68 | 3408 | 3834 | 3799 | 104 | −321 | −715 | N |
| ATOM | 564 | CA | LYS | A | 68 | 18.642 | 5.400 | 28.686 | 1.00 | 25.93 | | C |
| ANISOU | 564 | CA | LYS | A | 68 | 3006 | 3432 | 3416 | 117 | −321 | −756 | C |
| ATOM | 565 | C | LYS | A | 68 | 17.780 | 5.399 | 29.944 | 1.00 | 28.07 | | C |
| ANISOU | 565 | C | LYS | A | 68 | 3243 | 3689 | 3733 | 112 | −350 | −770 | C |
| ATOM | 566 | O | LYS | A | 68 | 16.806 | 4.646 | 30.025 | 1.00 | 32.79 | | O |
| ANISOU | 566 | O | LYS | A | 68 | 3837 | 4273 | 4349 | 116 | −364 | −803 | O |
| ATOM | 567 | CB | LYS | A | 68 | 19.719 | 4.320 | 28.759 | 1.00 | 24.04 | | C |
| ANISOU | 567 | CB | LYS | A | 68 | 2749 | 3198 | 3187 | 130 | −263 | −751 | C |
| ATOM | 568 | CG | LYS | A | 68 | 20.297 | 3.961 | 27.376 | 1.00 | 29.86 | | C |
| ANISOU | 568 | CG | LYS | A | 68 | 3532 | 3941 | 3873 | 145 | −217 | −754 | C |
| ATOM | 569 | CD | LYS | A | 68 | 21.447 | 2.956 | 27.543 | 1.00 | 40.61 | | C |
| ANISOU | 569 | CD | LYS | A | 68 | 4864 | 5303 | 5264 | 165 | −149 | −746 | C |

TABLE 11-continued

| | | | | | | | | | | | |
|---|---|---|---|---|---|---|---|---|---|---|---|
| ATOM | 570 | CE | LYS | A | 68 | 21.814 | 2.286 | 26.240 | 1.00 | 50.34 | C |
| ANISOU | 570 | CE | LYS | A | 68 | 6151 | 6530 | 6444 | 189 | -92 | -766 C |
| ATOM | 571 | NZ | LYS | A | 68 | 22.938 | 1.334 | 26.445 | 1.00 | 63.80 | N |
| ANISOU | 571 | NZ | LYS | A | 68 | 7818 | 8230 | 8193 | 216 | -19 | -756 N |
| ATOM | 572 | N | ALA | A | 69 | 18.145 | 6.208 | 30.937 | 1.00 | 25.39 | N |
| ANISOU | 572 | N | ALA | A | 69 | 2881 | 3351 | 3414 | 100 | -354 | -747 N |
| ATOM | 573 | CA | ALA | A | 69 | 17.282 | 6.396 | 32.090 | 1.00 | 27.32 | C |
| ANISOU | 573 | CA | ALA | A | 69 | 3110 | 3581 | 3688 | 98 | -372 | -761 C |
| ATOM | 574 | C | ALA | A | 69 | 15.988 | 7.069 | 31.672 | 1.00 | 28.12 | C |
| ANISOU | 574 | C | ALA | A | 69 | 3220 | 3666 | 3797 | 102 | -408 | -780 C |
| ATOM | 575 | O | ALA | A | 69 | 14.913 | 6.656 | 32.103 | 1.00 | 26.77 | O |
| ANISOU | 575 | O | ALA | A | 69 | 3031 | 3481 | 3660 | 108 | -413 | -805 O |
| ATOM | 576 | CB | ALA | A | 69 | 17.989 | 7.209 | 33.173 | 1.00 | 29.28 | C |
| ANISOU | 576 | CB | ALA | A | 69 | 3350 | 3832 | 3943 | 84 | -375 | -740 C |
| ATOM | 577 | N | HIS | A | 70 | 16.070 | 8.109 | 30.828 | 1.00 | 29.26 | N |
| ANISOU | 577 | N | HIS | A | 70 | 3389 | 3809 | 3920 | 101 | -433 | -763 N |
| ATOM | 578 | CA | HIS | A | 70 | 14.852 | 8.724 | 30.300 | 1.00 | 28.79 | C |
| ANISOU | 578 | CA | HIS | A | 70 | 3335 | 3732 | 3871 | 113 | -479 | -774 C |
| ATOM | 579 | C | HIS | A | 70 | 13.984 | 7.678 | 29.617 | 1.00 | 29.65 | C |
| ANISOU | 579 | C | HIS | A | 70 | 3439 | 3841 | 3984 | 121 | -502 | -806 C |
| ATOM | 580 | O | HIS | A | 70 | 12.763 | 7.637 | 29.802 | 1.00 | 27.12 | O |
| ANISOU | 580 | O | HIS | A | 70 | 3089 | 3505 | 3711 | 128 | -532 | -828 O |
| ATOM | 581 | CB | HIS | A | 70 | 15.187 | 9.824 | 29.287 | 1.00 | 30.26 | C |
| ANISOU | 581 | CB | HIS | A | 70 | 3563 | 3915 | 4021 | 113 | -502 | -742 C |
| ATOM | 582 | CG | HIS | A | 70 | 15.577 | 11.137 | 29.899 | 1.00 | 34.14 | C |
| ANISOU | 582 | CG | HIS | A | 70 | 4056 | 4386 | 4529 | 103 | -500 | -717 C |
| ATOM | 583 | ND1 | HIS | A | 70 | 16.316 | 11.230 | 31.056 | 1.00 | 36.88 | N |
| ANISOU | 583 | ND1 | HIS | A | 70 | 4385 | 4734 | 4895 | 85 | -472 | -716 N |
| ATOM | 584 | CD2 | HIS | A | 70 | 15.353 | 12.409 | 29.492 | 1.00 | 37.71 | C |
| ANISOU | 584 | CD2 | HIS | A | 70 | 4533 | 4812 | 4983 | 107 | -528 | -692 C |
| ATOM | 585 | CE1 | HIS | A | 70 | 16.515 | 12.505 | 31.348 | 1.00 | 44.58 | C |
| ANISOU | 585 | CE1 | HIS | A | 70 | 5374 | 5681 | 5882 | 74 | -483 | -700 C |
| ATOM | 586 | NE2 | HIS | A | 70 | 15.945 | 13.241 | 30.411 | 1.00 | 36.62 | N |
| ANISOU | 586 | NE2 | HIS | A | 70 | 4392 | 4654 | 4869 | 88 | -512 | -683 N |
| ATOM | 587 | N | SER | A | 71 | 14.602 | 6.860 | 28.770 | 1.00 | 26.70 | N |
| ANISOU | 587 | N | SER | A | 71 | 3096 | 3483 | 3567 | 119 | -488 | -811 N |
| ATOM | 588 | C | SER | A | 71 | 13.126 | 4.897 | 28.973 | 1.00 | 28.52 | C |
| ANISOU | 588 | C | SER | A | 71 | 3283 | 3690 | 3863 | 115 | -505 | -878 C |
| ATOM | 589 | O | SER | A | 71 | 11.982 | 4.511 | 28.724 | 1.00 | 29.88 | O |
| ANISOU | 589 | O | SER | A | 71 | 3432 | 3846 | 4074 | 112 | -548 | -909 O |
| ATOM | 590 | CA | ASER | A | 71 | 13.847 | 5.857 | 28.032 | 0.70 | 30.55 | C |
| ANISOU | 590 | CA | ASER | A | 71 | 3591 | 3965 | 4051 | 122 | -518 | -849 C |
| ATOM | 591 | CB | ASER | A | 71 | 14.795 | 5.101 | 27.105 | 0.70 | 31.62 | C |
| ANISOU | 591 | CB | ASER | A | 71 | 3778 | 4114 | 4124 | 125 | -486 | -854 C |
| ATOM | 592 | OG | ASER | A | 71 | 14.128 | 4.015 | 26.511 | 0.70 | 31.12 | O |
| ANISOU | 592 | OG | ASER | A | 71 | 3729 | 4037 | 4058 | 123 | -514 | -901 O |
| ATOM | 593 | CA | BSER | A | 71 | 13.834 | 5.865 | 28.032 | 0.30 | 29.88 | C |
| ANISOU | 593 | CA | BSER | A | 71 | 3506 | 3879 | 3966 | 122 | -519 | -849 C |
| ATOM | 594 | CB | BSER | A | 71 | 14.737 | 5.110 | 27.053 | 0.30 | 31.17 | C |
| ANISOU | 594 | CB | BSER | A | 71 | 3723 | 4056 | 4066 | 125 | -490 | -855 C |
| ATOM | 595 | OG | BSER | A | 71 | 15.605 | 4.207 | 27.712 | 0.30 | 32.19 | O |
| ANISOU | 595 | OG | BSER | A | 71 | 3831 | 4187 | 4211 | 124 | -426 | -855 O |
| ATOM | 596 | N | GLN | A | 72 | 13.786 | 4.483 | 30.056 | 1.00 | 29.43 | N |
| ANISOU | 596 | N | GLN | A | 72 | 3378 | 3807 | 3996 | 112 | -447 | -866 N |
| ATOM | 597 | CA | GLN | A | 72 | 13.135 | 3.560 | 30.996 | 1.00 | 28.83 | C |
| ANISOU | 597 | CA | GLN | A | 72 | 3264 | 3711 | 3980 | 106 | -423 | -884 C |
| ATOM | 598 | C | GLN | A | 72 | 11.976 | 4.225 | 31.724 | 1.00 | 32.43 | C |
| ANISOU | 598 | C | GLN | A | 72 | 3678 | 4151 | 4491 | 107 | -434 | -886 C |
| ATOM | 599 | O | GLN | A | 72 | 10.982 | 3.577 | 32.082 | 1.00 | 29.63 | O |
| ANISOU | 599 | O | GLN | A | 72 | 3285 | 3775 | 4200 | 99 | -427 | -907 O |
| ATOM | 600 | CB | GLN | A | 72 | 14.166 | 3.057 | 32.012 | 1.00 | 26.59 | C |
| ANISOU | 600 | CB | GLN | A | 72 | 2980 | 3433 | 3690 | 108 | -365 | -859 C |
| ATOM | 601 | CG | GLN | A | 72 | 15.186 | 2.132 | 31.413 | 1.00 | 27.75 | C |
| ANISOU | 601 | CG | GLN | A | 72 | 3151 | 3584 | 3809 | 114 | -341 | -859 C |
| ATOM | 602 | CD | GLN | A | 72 | 16.317 | 1.886 | 32.387 | 1.00 | 37.79 | C |
| ANISOU | 602 | CD | GLN | A | 72 | 4414 | 4865 | 5079 | 122 | -300 | -824 C |
| ATOM | 603 | OE1 | GLN | A | 72 | 16.198 | 1.065 | 33.296 | 1.00 | 32.33 | O |
| ANISOU | 603 | OE1 | GLN | A | 72 | 3711 | 4157 | 4417 | 124 | -274 | -819 O |
| ATOM | 604 | NE2 | GLN | A | 72 | 17.397 | 2.642 | 32.240 | 1.00 | 29.47 | N |
| ANISOU | 604 | NE2 | GLN | A | 72 | 3365 | 3837 | 3996 | 124 | -299 | -796 N |
| ATOM | 605 | N | THR | A | 73 | 12.103 | 5.510 | 32.008 | 1.00 | 27.85 | N |
| ANISOU | 605 | N | THR | A | 73 | 3105 | 3579 | 3898 | 115 | -442 | -866 N |
| ATOM | 606 | CA | THR | A | 73 | 10.977 | 6.199 | 32.629 | 1.00 | 24.73 | C |
| ANISOU | 606 | CA | THR | A | 73 | 2673 | 3164 | 3560 | 124 | -445 | -872 C |
| ATOM | 607 | C | THR | A | 73 | 9.796 | 6.251 | 31.676 | 1.00 | 29.35 | C |
| ANISOU | 607 | C | THR | A | 73 | 3226 | 3736 | 4189 | 129 | -507 | -892 C |
| ATOM | 608 | O | THR | A | 73 | 8.650 | 6.042 | 32.089 | 1.00 | 32.69 | O |
| ANISOU | 608 | O | THR | A | 73 | 3591 | 4138 | 4692 | 131 | -502 | -908 O |
| ATOM | 609 | CB | THR | A | 73 | 11.416 | 7.594 | 33.042 | 1.00 | 29.56 | C |
| ANISOU | 609 | CB | THR | A | 73 | 3308 | 3775 | 4147 | 133 | -444 | -851 C |

TABLE 11-continued

| | | | | | | | | | | | | |
|---|---|---|---|---|---|---|---|---|---|---|---|---|
| ATOM | 610 | OG1 | THR | A | 73 | 12.404 | 7.464 | 34.058 | 1.00 | 29.95 | | O |
| ANISOU | 610 | OG1 | THR | A | 73 | 3380 | 3835 | 4164 | 125 | −400 | −838 | O |
| ATOM | 611 | CG2 | THR | A | 73 | 10.221 | 8.435 | 33.545 | 1.00 | 30.63 | | C |
| ANISOU | 611 | CG2 | THR | A | 73 | 3411 | 3884 | 4345 | 152 | −444 | −861 | C |
| ATOM | 612 | N | HIS | A | 74 | 10.059 | 6.500 | 30.387 | 1.00 | 27.72 | | N |
| ANISOU | 612 | N | HIS | A | 74 | 3057 | 3542 | 3935 | 131 | −567 | −890 | N |
| ATOM | 613 | CA | HIS | A | 74 | 8.955 | 6.538 | 29.437 | 1.00 | 24.15 | | C |
| ANISOU | 613 | CA | HIS | A | 74 | 2581 | 3079 | 3516 | 136 | −646 | −908 | C |
| ATOM | 614 | C | HIS | A | 74 | 8.317 | 5.173 | 29.297 | 1.00 | 29.78 | | C |
| ANISOU | 614 | C | HIS | A | 74 | 3259 | 3780 | 4277 | 116 | −657 | −946 | C |
| ATOM | 615 | O | HIS | A | 74 | 7.122 | 5.076 | 29.042 | 1.00 | 30.96 | | O |
| ANISOU | 615 | O | HIS | A | 74 | 3352 | 3911 | 4500 | 113 | −711 | −965 | O |
| ATOM | 616 | CB | HIS | A | 74 | 9.433 | 7.017 | 28.071 | 1.00 | 31.59 | | C |
| ANISOU | 616 | CB | HIS | A | 74 | 3592 | 4038 | 4374 | 144 | −706 | −894 | C |
| ATOM | 617 | CG | HIS | A | 74 | 9.666 | 8.484 | 28.007 | 1.00 | 48.11 | | C |
| ANISOU | 617 | CG | HIS | A | 74 | 5707 | 6127 | 6444 | 163 | −718 | −854 | C |
| ATOM | 618 | ND1 | HIS | A | 74 | 9.912 | 9.145 | 26.825 | 1.00 | 54.48 | | N |
| ANISOU | 618 | ND1 | HIS | A | 74 | 6576 | 6941 | 7184 | 174 | −771 | −829 | N |
| ATOM | 619 | CD2 | HIS | A | 74 | 9.668 | 9.426 | 28.979 | 1.00 | 52.15 | | C |
| ANISOU | 619 | CD2 | HIS | A | 74 | 6197 | 6624 | 6993 | 174 | −681 | −836 | C |
| ATOM | 620 | CE1 | HIS | A | 74 | 10.072 | 10.433 | 27.075 | 1.00 | 54.30 | | C |
| ANISOU | 620 | CE1 | HIS | A | 74 | 6563 | 6904 | 7166 | 189 | −766 | −793 | C |
| ATOM | 621 | NE2 | HIS | A | 74 | 9.933 | 10.628 | 28.374 | 1.00 | 53.35 | | N |
| ANISOU | 621 | NE2 | HIS | A | 74 | 6393 | 6769 | 7110 | 188 | −714 | −801 | N |
| ATOM | 622 | N | ARG | A | 75 | 9.111 | 4.109 | 29.430 | 1.00 | 27.91 | | N |
| ANISOU | 622 | N | ARG | A | 75 | 3052 | 3547 | 4007 | 100 | −609 | −956 | N |
| ATOM | 623 | CA | ARG | A | 75 | 8.531 | 2.773 | 29.374 | 1.00 | 28.74 | | C |
| ANISOU | 623 | CA | ARG | A | 75 | 3127 | 3627 | 4165 | 76 | −612 | −993 | C |
| ATOM | 624 | C | ARG | A | 75 | 7.578 | 2.551 | 30.546 | 1.00 | 30.77 | | C |
| ANISOU | 624 | C | ARG | A | 75 | 3304 | 3859 | 4530 | 68 | −566 | −992 | C |
| ATOM | 625 | O | ARG | A | 75 | 6.508 | 1.960 | 30.384 | 1.00 | 31.26 | | O |
| ANISOU | 625 | O | ARG | A | 75 | 3306 | 3893 | 4677 | 48 | −598 | −1019 | O |
| ATOM | 626 | CB | ARG | A | 75 | 9.663 | 1.736 | 29.350 | 1.00 | 24.72 | | C |
| ANISOU | 626 | CB | ARG | A | 75 | 2670 | 3119 | 3601 | 69 | −559 | −998 | C |
| ATOM | 627 | CG | ARG | A | 75 | 9.228 | 0.330 | 28.976 | 1.00 | 31.46 | | C |
| ANISOU | 627 | CG | ARG | A | 75 | 3519 | 3940 | 4495 | 44 | −571 | −1042 | C |
| ATOM | 628 | CD | ARG | A | 75 | 10.486 | −0.576 | 28.919 | 1.00 | 27.76 | | C |
| ANISOU | 628 | CD | ARG | A | 75 | 3109 | 3469 | 3970 | 50 | −512 | −1043 | C |
| ATOM | 629 | NE | ARG | A | 75 | 10.171 | −1.882 | 28.361 | 1.00 | 32.37 | | N |
| ANISOU | 629 | NE | ARG | A | 75 | 3707 | 4013 | 4580 | 29 | −528 | −1092 | N |
| ATOM | 630 | CZ | ARG | A | 75 | 11.092 | −2.791 | 28.045 | 1.00 | 34.35 | | C |
| ANISOU | 630 | CZ | ARG | A | 75 | 4012 | 4249 | 4789 | 37 | −487 | −1107 | C |
| ATOM | 631 | NH1 | ARG | A | 75 | 12.380 | −2.527 | 28.229 | 1.00 | 32.93 | | N |
| ANISOU | 631 | NH1 | ARG | A | 75 | 3865 | 4097 | 4549 | 66 | −429 | −1070 | N |
| ATOM | 632 | NH2 | ARG | A | 75 | 10.725 | −3.953 | 27.529 | 1.00 | 30.41 | | N |
| ANISOU | 632 | NH2 | ARG | A | 75 | 3533 | 3703 | 4319 | 16 | −505 | −1159 | N |
| ATOM | 633 | N | VAL | A | 76 | 7.938 | 3.035 | 31.732 | 1.00 | 29.43 | | N |
| ANISOU | 633 | N | VAL | A | 76 | 3130 | 3694 | 4357 | 81 | −492 | −961 | N |
| ATOM | 634 | CA | VAL | A | 76 | 7.017 | 2.982 | 32.864 | 1.00 | 30.87 | | C |
| ANISOU | 634 | CA | VAL | A | 76 | 3248 | 3853 | 4629 | 79 | −434 | −957 | C |
| ATOM | 635 | C | VAL | A | 76 | 5.809 | 3.884 | 32.606 | 1.00 | 32.90 | | C |
| ANISOU | 635 | C | VAL | A | 76 | 3440 | 4099 | 4962 | 93 | −481 | −963 | C |
| ATOM | 636 | O | VAL | A | 76 | 4.666 | 3.502 | 32.879 | 1.00 | 36.11 | | O |
| ANISOU | 636 | O | VAL | A | 76 | 3764 | 4478 | 5477 | 83 | −470 | −975 | O |
| ATOM | 637 | CB | VAL | A | 76 | 7.749 | 3.363 | 34.178 | 1.00 | 30.96 | | C |
| ANISOU | 637 | CB | VAL | A | 76 | 3294 | 3873 | 4596 | 93 | −350 | −926 | C |
| ATOM | 638 | CG1 | VAL | A | 76 | 6.749 | 3.606 | 35.323 | 1.00 | 31.03 | | C |
| ANISOU | 638 | CG1 | VAL | A | 76 | 3252 | 3859 | 4680 | 101 | −281 | −921 | C |
| ATOM | 639 | CG2 | VAL | A | 76 | 8.752 | 2.273 | 34.584 | 1.00 | 27.81 | | C |
| ANISOU | 639 | CG2 | VAL | A | 76 | 2939 | 3477 | 4150 | 81 | −304 | −914 | C |
| ATOM | 640 | N | ASP | A | 77 | 6.034 | 5.089 | 32.073 | 1.00 | 30.61 | | N |
| ANISOU | 640 | N | ASP | A | 77 | 3177 | 3825 | 4626 | 119 | −533 | −951 | N |
| ATOM | 641 | CA | ASP | A | 77 | 4.903 | 5.982 | 31.779 | 1.00 | 29.26 | | C |
| ANISOU | 641 | CA | ASP | A | 77 | 2943 | 3640 | 4533 | 141 | −585 | −951 | C |
| ATOM | 642 | C | ASP | A | 77 | 3.895 | 5.315 | 30.849 | 1.00 | 31.05 | | C |
| ANISOU | 642 | C | ASP | A | 77 | 3108 | 3853 | 4836 | 123 | −673 | −978 | C |
| ATOM | 643 | O | ASP | A | 77 | 2.682 | 5.406 | 31.061 | 1.00 | 30.27 | | O |
| ANISOU | 643 | O | ASP | A | 77 | 2912 | 3731 | 4860 | 128 | −683 | −985 | O |
| ATOM | 644 | CB | ASP | A | 77 | 5.396 | 7.273 | 31.133 | 1.00 | 28.26 | | C |
| ANISOU | 644 | CB | ASP | A | 77 | 2872 | 3528 | 4338 | 169 | −639 | −929 | C |
| ATOM | 645 | CG | ASP | A | 77 | 6.278 | 8.089 | 32.037 | 1.00 | 31.22 | | C |
| ANISOU | 645 | CG | ASP | A | 77 | 3298 | 3907 | 4657 | 183 | −568 | −907 | C |
| ATOM | 646 | OD1 | ASP | A | 77 | 6.212 | 7.908 | 33.271 | 1.00 | 30.73 | | O |
| ANISOU | 646 | OD1 | ASP | A | 77 | 3222 | 3835 | 4621 | 182 | −481 | −910 | O |
| ATOM | 647 | OD2 | ASP | A | 77 | 7.025 | 8.941 | 31.500 | 1.00 | 30.88 | | O |
| ANISOU | 647 | OD2 | ASP | A | 77 | 3315 | 3874 | 4543 | 192 | −601 | −887 | O |
| ATOM | 648 | N | LEU | A | 78 | 4.379 | 4.659 | 29.789 | 1.00 | 33.34 | | N |
| ANISOU | 648 | N | LEU | A | 78 | 3453 | 4156 | 5057 | 102 | −740 | −997 | N |
| ATOM | 649 | CA | LEU | A | 78 | 3.451 | 4.024 | 28.852 | 1.00 | 37.02 | | C |
| ANISOU | 649 | CA | LEU | A | 78 | 3874 | 4607 | 5584 | 80 | −842 | −1031 | C |

TABLE 11-continued

| | | | | | | | | | | | |
|---|---|---|---|---|---|---|---|---|---|---|---|
| ATOM | 650 | C | LEU | A | 78 | 2.552 | 3.029 | 29.567 | 1.00 | 32.74 | C |
| ANISOU | 650 | C | LEU | A | 78 | 3234 | 4030 | 5175 | 48 | −796 | −1052 | C |
| ATOM | 651 | O | LEU | A | 78 | 1.346 | 2.973 | 29.308 | 1.00 | 32.23 | O |
| ANISOU | 651 | O | LEU | A | 78 | 3073 | 3944 | 5230 | 38 | −860 | −1067 | O |
| ATOM | 652 | CB | LEU | A | 78 | 4.218 | 3.343 | 27.714 | 1.00 | 35.00 | C |
| ANISOU | 652 | CB | LEU | A | 78 | 3714 | 4366 | 5217 | 62 | −900 | −1057 | C |
| ATOM | 653 | CG | LEU | A | 78 | 4.671 | 4.304 | 26.604 | 1.00 | 35.17 | C |
| ANISOU | 653 | CG | LEU | A | 78 | 3818 | 4416 | 5130 | 90 | −980 | −1039 | C |
| ATOM | 654 | CD1 | LEU | A | 78 | 5.875 | 3.725 | 25.807 | 1.00 | 34.09 | C |
| ANISOU | 654 | CD1 | LEU | A | 78 | 3799 | 4298 | 4855 | 81 | −972 | −1053 | C |
| ATOM | 655 | CD2 | LEU | A | 78 | 3.535 | 4.711 | 25.673 | 1.00 | 32.47 | C |
| ANISOU | 655 | CD2 | LEU | A | 78 | 3438 | 4067 | 4835 | 98 | −1120 | −1049 | C |
| ATOM | 656 | N | GLY | A | 79 | 3.113 | 2.251 | 30.490 | 1.00 | 36.55 | N |
| ANISOU | 656 | N | GLY | A | 79 | 3737 | 4504 | 5647 | 30 | −686 | −1047 | N |
| ATOM | 657 | CA | GLY | A | 79 | 2.291 | 1.324 | 31.242 | 1.00 | 36.98 | C |
| ANISOU | 657 | CA | GLY | A | 79 | 3706 | 4519 | 5827 | −2 | −626 | −1056 | C |
| ATOM | 658 | C | GLY | A | 79 | 1.390 | 2.041 | 32.225 | 1.00 | 30.23 | C |
| ANISOU | 658 | C | GLY | A | 79 | 2759 | 3652 | 5077 | 20 | −557 | −1032 | C |
| ATOM | 659 | O | GLY | A | 79 | 0.226 | 1.670 | 32.402 | 1.00 | 35.28 | O |
| ANISOU | 659 | O | GLY | A | 79 | 3287 | 4257 | 5860 | −0 | −554 | −1041 | O |
| ATOM | 660 | N | THR | A | 80 | 1.914 | 3.070 | 32.886 | 1.00 | 33.27 | N |
| ANISOU | 660 | N | THR | A | 80 | 3188 | 4058 | 5396 | 61 | −498 | −1002 | N |
| ATOM | 661 | CA | THR | A | 80 | 1.123 | 3.768 | 33.886 | 1.00 | 35.37 | C |
| ANISOU | 661 | CA | THR | A | 80 | 3384 | 4307 | 5749 | 89 | −416 | −984 | C |
| ATOM | 662 | C | THR | A | 80 | −0.067 | 4.477 | 33.251 | 1.00 | 32.09 | C |
| ANISOU | 662 | C | THR | A | 80 | 2865 | 3878 | 5450 | 109 | −499 | −991 | C |
| ATOM | 663 | O | THR | A | 80 | −1.186 | 4.413 | 33.771 | 1.00 | 35.48 | O |
| ANISOU | 663 | O | THR | A | 80 | 3181 | 4277 | 6023 | 110 | −450 | −989 | O |
| ATOM | 664 | CB | THR | A | 80 | 2.003 | 4.767 | 34.623 | 1.00 | 33.48 | C |
| ANISOU | 664 | CB | THR | A | 80 | 3230 | 4088 | 5402 | 126 | −352 | −961 | C |
| ATOM | 665 | OG1 | THR | A | 80 | 3.099 | 4.063 | 35.218 | 1.00 | 37.37 | O |
| ANISOU | 665 | OG1 | THR | A | 80 | 3808 | 4593 | 5797 | 108 | −289 | −951 | O |
| ATOM | 666 | CG2 | THR | A | 80 | 1.200 | 5.533 | 35.688 | 1.00 | 35.52 | C |
| ANISOU | 666 | CG2 | THR | A | 80 | 3434 | 4324 | 5740 | 161 | −256 | −950 | C |
| ATOM | 667 | N | LEU | A | 81 | 0.165 | 5.143 | 32.118 | 1.00 | 34.79 | N |
| ANISOU | 667 | N | LEU | A | 81 | 3245 | 4242 | 5734 | 127 | −624 | −994 | N |
| ATOM | 668 | CA | LEU | A | 81 | −0.876 | 5.901 | 31.430 | 1.00 | 36.81 | C |
| ANISOU | 668 | CA | LEU | A | 81 | 3414 | 4486 | 6087 | 154 | −725 | −992 | C |
| ATOM | 669 | C | LEU | A | 81 | −1.956 | 4.990 | 30.858 | 1.00 | 36.99 | C |
| ANISOU | 669 | C | LEU | A | 81 | 3325 | 4486 | 6244 | 115 | −806 | −1019 | C |
| ATOM | 670 | O | LEU | A | 81 | −3.146 | 5.349 | 30.842 | 1.00 | 34.12 | O |
| ANISOU | 670 | O | LEU | A | 81 | 2833 | 4100 | 6032 | 132 | −839 | −1015 | O |
| ATOM | 671 | CB | LEU | A | 81 | −0.232 | 6.729 | 30.320 | 1.00 | 34.61 | C |
| ANISOU | 671 | CB | LEU | A | 81 | 3226 | 4234 | 5689 | 180 | −840 | −982 | C |
| ATOM | 672 | CG | LEU | A | 81 | 0.603 | 7.906 | 30.810 | 1.00 | 35.80 | C |
| ANISOU | 672 | CG | LEU | A | 81 | 3460 | 4395 | 5747 | 221 | −778 | −953 | C |
| ATOM | 673 | CD1 | LEU | A | 81 | 1.580 | 8.351 | 29.760 | 1.00 | 33.46 | C |
| ANISOU | 673 | CD1 | LEU | A | 81 | 3279 | 4126 | 5310 | 225 | −861 | −940 | C |
| ATOM | 674 | CD2 | LEU | A | 81 | −0.349 | 9.038 | 31.165 | 1.00 | 33.36 | C |
| ANISOU | 674 | CD2 | LEU | A | 81 | 3070 | 4057 | 5549 | 273 | −770 | −935 | C |
| ATOM | 675 | N | ARG | A | 82 | −1.556 | 3.837 | 30.324 | 1.00 | 29.53 | N |
| ANISOU | 675 | N | ARG | A | 82 | 2425 | 3544 | 5250 | 63 | −848 | −1048 | N |
| ATOM | 676 | CA | ARG | A | 82 | −2.544 | 2.861 | 29.863 | 1.00 | 35.39 | C |
| ANISOU | 676 | CA | ARG | A | 82 | 3066 | 4256 | 6125 | 14 | −922 | −1081 | C |
| ATOM | 677 | C | ARG | A | 82 | −3.493 | 2.500 | 30.997 | 1.00 | 37.45 | C |
| ANISOU | 677 | C | ARG | A | 82 | 3192 | 4478 | 6560 | −1 | −802 | −1070 | C |
| ATOM | 678 | O | ARG | A | 82 | −4.702 | 2.373 | 30.790 | 1.00 | 41.61 | O |
| ANISOU | 678 | O | ARG | A | 82 | 3576 | 4977 | 7257 | −16 | −858 | −1079 | O |
| ATOM | 679 | CB | ARG | A | 82 | −1.827 | 1.606 | 29.333 | 1.00 | 38.48 | C |
| ANISOU | 679 | CB | ARG | A | 82 | 3546 | 4644 | 6430 | −39 | −951 | −1119 | C |
| ATOM | 680 | CG | ARG | A | 82 | −2.711 | 0.574 | 28.667 | 1.00 | 61.09 | C |
| ANISOU | 680 | CG | ARG | A | 82 | 6331 | 7471 | 9408 | −98 | −1053 | −1165 | C |
| ATOM | 681 | CD | ARG | A | 82 | −2.376 | −0.846 | 29.132 | 1.00 | 60.93 | C |
| ANISOU | 681 | CD | ARG | A | 82 | 6334 | 7416 | 9401 | −155 | −967 | −1187 | C |
| ATOM | 682 | NE | ARG | A | 82 | −0.939 | −1.068 | 29.248 | 1.00 | 67.18 | N |
| ANISOU | 682 | NE | ARG | A | 82 | 7277 | 8231 | 10017 | −141 | −899 | −1180 | N |
| ATOM | 683 | CZ | ARG | A | 82 | −0.395 | −2.064 | 29.944 | 1.00 | 68.84 | C |
| ANISOU | 683 | CZ | ARG | A | 82 | 7525 | 8416 | 10216 | −167 | −788 | −1178 | C |
| ATOM | 684 | NH1 | ARG | A | 82 | −1.181 | −2.925 | 30.583 | 1.00 | 71.94 | N |
| ANISOU | 684 | NH1 | ARG | A | 82 | 7822 | 8755 | 10756 | −212 | −728 | −1180 | N |
| ATOM | 685 | NH2 | ARG | A | 82 | 0.931 | −2.199 | 30.010 | 1.00 | 57.55 | N |
| ANISOU | 685 | NH2 | ARG | A | 82 | 6222 | 7009 | 8636 | −147 | −737 | −1169 | N |
| ATOM | 686 | N | GLY | A | 83 | −2.958 | 2.363 | 32.214 | 1.00 | 39.73 | N |
| ANISOU | 686 | N | GLY | A | 83 | 3523 | 4764 | 6809 | 5 | −636 | −1047 | N |
| ATOM | 687 | CA | GLY | A | 83 | −3.809 | 2.063 | 33.353 | 1.00 | 39.61 | C |
| ANISOU | 687 | CA | GLY | A | 83 | 3398 | 4712 | 6941 | −4 | −498 | −1030 | C |
| ATOM | 688 | C | GLY | A | 83 | −4.649 | 3.244 | 33.804 | 1.00 | 37.16 | C |
| ANISOU | 688 | C | GLY | A | 83 | 2992 | 4395 | 6731 | 53 | −458 | −1007 | C |
| ATOM | 689 | O | GLY | A | 83 | −5.819 | 3.072 | 34.153 | 1.00 | 40.75 | O |
| ANISOU | 689 | O | GLY | A | 83 | 3298 | 4815 | 7370 | 44 | −415 | −1002 | O |

TABLE 11-continued

| | | | | | | | | | | | |
|---|---|---|---|---|---|---|---|---|---|---|---|
| ATOM | 690 | N | TYR | A | 84 | −4.064 | 4.454 | 33.826 | 1.00 | 41.09 | N |
| ANISOU | 690 | N | TYR | A | 84 | 3572 | 4921 | 7120 | 113 | −462 | −993 | N |
| ATOM | 691 | CA | TYR | A | 84 | −4.834 | 5.644 | 34.191 | 1.00 | 42.63 | C |
| ANISOU | 691 | CA | TYR | A | 84 | 3687 | 5102 | 7409 | 175 | −428 | −975 | C |
| ATOM | 692 | C | TYR | A | 84 | −6.085 | 5.777 | 33.334 | 1.00 | 45.45 | C |
| ANISOU | 692 | C | TYR | A | 84 | 3887 | 5439 | 7942 | 179 | −556 | −981 | C |
| ATOM | 693 | O | TYR | A | 84 | −7.154 | 6.168 | 33.823 | 1.00 | 45.39 | O |
| ANISOU | 693 | O | TYR | A | 84 | 3741 | 5401 | 8104 | 209 | −495 | −968 | O |
| ATOM | 694 | CB | TYR | A | 84 | −3.989 | 6.912 | 34.028 | 1.00 | 35.00 | C |
| ANISOU | 694 | CB | TYR | A | 84 | 2838 | 4160 | 6300 | 231 | −457 | −963 | C |
| ATOM | 695 | CG | TYR | A | 84 | −2.931 | 7.190 | 35.088 | 1.00 | 37.42 | C |
| ANISOU | 695 | CG | TYR | A | 84 | 3275 | 4479 | 6463 | 245 | −324 | −954 | C |
| ATOM | 696 | CD1 | TYR | A | 84 | −2.846 | 6.442 | 36.265 | 1.00 | 34.75 | C |
| ANISOU | 696 | CD1 | TYR | A | 84 | 2949 | 4129 | 6123 | 222 | −173 | −950 | C |
| ATOM | 697 | CD2 | TYR | A | 84 | −2.007 | 8.211 | 34.898 | 1.00 | 38.89 | C |
| ANISOU | 697 | CD2 | TYR | A | 84 | 3577 | 4686 | 6516 | 279 | −358 | −947 | C |
| ATOM | 698 | CE1 | TYR | A | 84 | −1.877 | 6.731 | 37.222 | 1.00 | 41.62 | C |
| ANISOU | 698 | CE1 | TYR | A | 84 | 3945 | 5012 | 6855 | 236 | −72 | −942 | C |
| ATOM | 699 | CE2 | TYR | A | 84 | −1.033 | 8.490 | 35.839 | 1.00 | 38.06 | C |
| ANISOU | 699 | CE2 | TYR | A | 84 | 3586 | 4590 | 6286 | 287 | −257 | −942 | C |
| ATOM | 700 | CZ | TYR | A | 84 | −0.983 | 7.761 | 37.004 | 1.00 | 35.42 | C |
| ANISOU | 700 | CZ | TYR | A | 84 | 3264 | 4248 | 5947 | 267 | −120 | −942 | C |
| ATOM | 701 | OH | TYR | A | 84 | 0.000 | 8.050 | 37.923 | 1.00 | 37.45 | O |
| ANISOU | 701 | OH | TYR | A | 84 | 3642 | 4516 | 6072 | 275 | −39 | −938 | O |
| ATOM | 702 | N | TYR | A | 85 | −5.964 | 5.484 | 32.043 | 1.00 | 39.61 | N |
| ANISOU | 702 | N | TYR | A | 85 | 3168 | 4717 | 7165 | 151 | −736 | −1000 | N |
| ATOM | 703 | CA | TYR | A | 85 | −7.053 | 5.676 | 31.101 | 1.00 | 44.87 | C |
| ANISOU | 703 | CA | TYR | A | 85 | 3703 | 5370 | 7975 | 156 | −895 | −1006 | C |
| ATOM | 704 | C | TYR | A | 85 | −7.789 | 4.381 | 30.787 | 1.00 | 45.44 | C |
| ANISOU | 704 | C | TYR | A | 85 | 3666 | 5416 | 8181 | 80 | −951 | −1036 | C |
| ATOM | 705 | O | TYR | A | 85 | −8.600 | 4.358 | 29.865 | 1.00 | 45.85 | O |
| ANISOU | 705 | O | TYR | A | 85 | 3621 | 5461 | 8340 | 69 | −1116 | −1049 | O |
| ATOM | 706 | CB | TYR | A | 85 | −6.514 | 6.303 | 29.822 | 1.00 | 47.16 | C |
| ANISOU | 706 | CB | TYR | A | 85 | 4097 | 5692 | 8129 | 180 | −1072 | −1006 | C |
| ATOM | 707 | CG | TYR | A | 85 | −5.996 | 7.709 | 30.016 | 1.00 | 44.83 | C |
| ANISOU | 707 | CG | TYR | A | 85 | 3882 | 5409 | 7743 | 256 | −1038 | −972 | C |
| ATOM | 708 | CD1 | TYR | A | 85 | −6.868 | 8.735 | 30.367 | 1.00 | 45.01 | C |
| ANISOU | 708 | CD1 | TYR | A | 85 | 3796 | 5404 | 7901 | 321 | −1015 | −945 | C |
| ATOM | 709 | CD2 | TYR | A | 85 | −4.663 | 8.012 | 29.830 | 1.00 | 40.64 | C |
| ANISOU | 709 | CD2 | TYR | A | 85 | 3527 | 4909 | 7004 | 261 | −1028 | −966 | C |
| ATOM | 710 | CE1 | TYR | A | 85 | −6.419 | 10.026 | 30.538 | 1.00 | 36.48 | C |
| ANISOU | 710 | CE1 | TYR | A | 85 | 2793 | 4323 | 6747 | 389 | −984 | −918 | C |
| ATOM | 711 | CE2 | TYR | A | 85 | −4.188 | 9.320 | 30.003 | 1.00 | 42.03 | C |
| ANISOU | 711 | CE2 | TYR | A | 85 | 3775 | 5087 | 7107 | 322 | −999 | −936 | C |
| ATOM | 712 | CZ | TYR | A | 85 | −5.086 | 10.320 | 30.351 | 1.00 | 41.82 | C |
| ANISOU | 712 | CZ | TYR | A | 85 | 3647 | 5027 | 7215 | 385 | −980 | −913 | C |
| ATOM | 713 | OH | TYR | A | 85 | −4.672 | 11.616 | 30.524 | 1.00 | 38.61 | O |
| ANISOU | 713 | OH | TYR | A | 85 | 3311 | 4609 | 6749 | 446 | −953 | −886 | O |
| ATOM | 714 | N | ASN | A | 86 | −7.507 | 3.306 | 31.524 | 1.00 | 45.81 | N |
| ANISOU | 714 | N | ASN | A | 86 | 3732 | 5448 | 8226 | 25 | −825 | −1046 | N |
| ATOM | 715 | CA | ASN | A | 86 | −8.197 | 2.023 | 31.344 | 1.00 | 45.87 | C |
| ANISOU | 715 | CA | ASN | A | 86 | 3637 | 5418 | 8375 | −55 | −857 | −1074 | C |
| ATOM | 716 | C | ASN | A | 86 | −8.193 | 1.577 | 29.882 | 1.00 | 49.28 | C |
| ANISOU | 716 | C | ASN | A | 86 | 4097 | 5857 | 8769 | −95 | −1082 | −1118 | C |
| ATOM | 717 | O | ASN | A | 86 | −9.208 | 1.127 | 29.339 | 1.00 | 48.16 | O |
| ANISOU | 717 | O | ASN | A | 86 | 3860 | 5685 | 8755 | −131 | −1178 | −1126 | O |
| ATOM | 718 | CB | ASN | A | 86 | −9.623 | 2.091 | 31.893 | 1.00 | 55.74 | C |
| ANISOU | 718 | CB | ASN | A | 86 | 4669 | 6625 | 9884 | −55 | −799 | −1056 | C |
| ATOM | 719 | CG | ASN | A | 86 | −9.679 | 1.842 | 33.387 | 1.00 | 69.49 | C |
| ANISOU | 719 | CG | ASN | A | 86 | 6389 | 8342 | 11674 | −54 | −551 | −1025 | C |
| ATOM | 720 | OD1 | ASN | A | 86 | −9.637 | 2.777 | 34.185 | 1.00 | 74.62 | O |
| ANISOU | 720 | OD1 | ASN | A | 86 | 7050 | 8999 | 12302 | 14 | −427 | −995 | O |
| ATOM | 721 | ND2 | ASN | A | 86 | −9.769 | 0.572 | 33.773 | 1.00 | 78.89 | N |
| ANISOU | 721 | ND2 | ASN | A | 86 | 7556 | 9496 | 12923 | −129 | −477 | −1032 | N |
| ATOM | 722 | N | GLN | A | 87 | −7.033 | 1.692 | 29.248 | 1.00 | 42.50 | N |
| ANISOU | 722 | N | GLN | A | 87 | 3419 | 5037 | 7692 | −83 | −1142 | −1131 | N |
| ATOM | 723 | CA | GLN | A | 87 | −6.868 | 1.349 | 27.848 | 1.00 | 49.09 | C |
| ANISOU | 723 | CA | GLN | A | 87 | 4321 | 5884 | 8445 | −112 | −1341 | −1174 | C |
| ATOM | 724 | C | GLN | A | 87 | −6.358 | −0.078 | 27.714 | 1.00 | 48.47 | C |
| ANISOU | 724 | C | GLN | A | 87 | 4316 | 5783 | 8318 | −186 | −1327 | −1220 | C |
| ATOM | 725 | O | GLN | A | 87 | −5.643 | −0.588 | 28.580 | 1.00 | 46.55 | O |
| ANISOU | 725 | O | GLN | A | 87 | 4136 | 5533 | 8019 | −197 | −1167 | −1208 | O |
| ATOM | 726 | CB | GLN | A | 87 | −5.899 | 2.322 | 27.165 | 1.00 | 40.83 | C |
| ANISOU | 726 | CB | GLN | A | 87 | 3435 | 4890 | 7190 | −53 | −1405 | −1158 | C |
| ATOM | 727 | CG | GLN | A | 87 | −6.551 | 3.683 | 26.863 | 1.00 | 46.70 | C |
| ANISOU | 727 | CG | GLN | A | 87 | 4109 | 5645 | 7990 | 16 | −1489 | −1120 | C |
| ATOM | 728 | CD | GLN | A | 87 | −5.523 | 4.772 | 26.599 | 1.00 | 39.73 | C |
| ANISOU | 728 | CD | GLN | A | 87 | 3379 | 4802 | 6915 | 78 | −1483 | −1087 | C |
| ATOM | 729 | OE1 | GLN | A | 87 | −4.383 | 4.672 | 27.034 | 1.00 | 39.68 | O |
| ANISOU | 729 | OE1 | GLN | A | 87 | 3496 | 4814 | 6765 | 78 | −1369 | −1083 | O |

TABLE 11-continued

| | | | | | | | | | | | |
|---|---|---|---|---|---|---|---|---|---|---|---|
| ATOM | 730 | NE2 | GLN | A | 87 | −5.927 | 5.808 | 25.879 | 1.00 | 43.23 | N |
| ANISOU | 730 | NE2 | GLN | A | 87 | 3808 | 5254 | 7362 | 131 | −1611 | −1061 | N |
| ATOM | 731 | N | SER | A | 88 | −6.741 | −0.717 | 26.617 | 1.00 | 51.50 | N |
| ANISOU | 731 | N | SER | A | 88 | 4716 | 6150 | 8703 | −230 | −1486 | −1262 | N |
| ATOM | 732 | CA | SER | A | 88 | −6.359 | −2.100 | 26.383 | 1.00 | 51.01 | C |
| ANISOU | 732 | CA | SER | A | 88 | 4722 | 6053 | 8606 | −301 | −1485 | −1313 | C |
| ATOM | 733 | C | SER | A | 88 | −4.854 | −2.236 | 26.175 | 1.00 | 55.67 | C |
| ANISOU | 733 | C | SER | A | 88 | 5499 | 6675 | 8980 | −286 | −1450 | −1334 | C |
| ATOM | 734 | O | SER | A | 88 | −4.176 | −1.312 | 25.715 | 1.00 | 47.94 | O |
| ANISOU | 734 | O | SER | A | 88 | 4623 | 5747 | 7844 | −228 | −1484 | −1313 | O |
| ATOM | 735 | CB | SER | A | 88 | −7.109 | −2.643 | 25.166 | 1.00 | 48.07 | C |
| ANISOU | 735 | CB | SER | A | 88 | 4368 | 5658 | 8237 | −336 | −1650 | −1339 | C |
| ATOM | 736 | OG | SER | A | 88 | −6.427 | −3.749 | 24.623 | 1.00 | 65.97 | O |
| ANISOU | 736 | OG | SER | A | 88 | 6761 | 7905 | 10400 | −385 | −1676 | −1397 | O |
| ATOM | 737 | N | GLU | A | 89 | −4.331 | −3.416 | 26.521 | 1.00 | 59.75 | N |
| ANISOU | 737 | N | GLU | A | 89 | 6070 | 7154 | 9479 | −333 | −1362 | −1359 | N |
| ATOM | 738 | CA | GLU | A | 89 | −2.944 | −3.751 | 26.225 | 1.00 | 54.70 | C |
| ANISOU | 738 | CA | GLU | A | 89 | 5614 | 6535 | 8636 | −317 | −1322 | −1374 | C |
| ATOM | 739 | C | GLU | A | 89 | −2.679 | −3.889 | 24.733 | 1.00 | 50.01 | C |
| ANISOU | 739 | C | GLU | A | 89 | 5134 | 5952 | 7915 | −325 | −1493 | −1434 | C |
| ATOM | 740 | O | GLU | A | 89 | −1.512 | −3.948 | 24.334 | 1.00 | 56.96 | O |
| ANISOU | 740 | O | GLU | A | 89 | 6169 | 6858 | 8614 | −299 | −1465 | −1443 | O |
| ATOM | 741 | CB | GLU | A | 89 | −2.546 | −5.064 | 26.905 | 1.00 | 52.18 | C |
| ANISOU | 741 | CB | GLU | A | 89 | 5318 | 6161 | 8348 | −364 | −1198 | −1387 | C |
| ATOM | 742 | CG | GLU | A | 89 | −2.338 | −4.981 | 28.394 | 1.00 | 67.13 | C |
| ANISOU | 742 | CG | GLU | A | 89 | 7169 | 8051 | 10286 | −344 | −1004 | −1321 | C |
| ATOM | 743 | CD | GLU | A | 89 | −1.922 | −6.314 | 28.989 | 0.85 | 79.35 | C |
| ANISOU | 743 | CD | GLU | A | 89 | 8752 | 9540 | 11857 | −387 | −894 | −1327 | C |
| ATOM | 744 | OE1 | GLU | A | 89 | −1.748 | −7.282 | 28.218 | 1.00 | 84.09 | O |
| ANISOU | 744 | OE1 | GLU | A | 89 | 9412 | 10100 | 12439 | −429 | −966 | −1387 | O |
| ATOM | 745 | OE2 | GLU | A | 89 | −1.771 | −6.394 | 30.226 | 0.83 | 84.78 | O |
| ANISOU | 745 | OE2 | GLU | A | 89 | 9417 | 10219 | 12577 | −376 | −737 | −1271 | O |
| ATOM | 746 | N | ALA | A | 90 | −3.726 | −3.948 | 23.908 | 1.00 | 48.94 | N |
| ANISOU | 746 | N | ALA | A | 90 | 4939 | 5801 | 7855 | −353 | −1652 | −1462 | N |
| ATOM | 747 | CA | ALA | A | 90 | −3.547 | −4.317 | 22.512 | 1.00 | 53.62 | C |
| ANISOU | 747 | CA | ALA | A | 90 | 5671 | 6398 | 8304 | −362 | −1785 | −1505 | C |
| ATOM | 748 | C | ALA | A | 90 | −3.084 | −3.159 | 21.637 | 1.00 | 50.60 | C |
| ANISOU | 748 | C | ALA | A | 90 | 5395 | 6081 | 7751 | −298 | −1873 | −1483 | C |
| ATOM | 749 | O | ALA | A | 90 | −2.497 | −3.400 | 20.579 | 1.00 | 49.09 | O |
| ANISOU | 749 | O | ALA | A | 90 | 5360 | 5902 | 7390 | −295 | −1941 | −1519 | O |
| ATOM | 750 | CB | ALA | A | 90 | −4.846 | −4.901 | 21.953 | 1.00 | 55.82 | C |
| ANISOU | 750 | CB | ALA | A | 90 | 5875 | 6635 | 8698 | −411 | −1896 | −1519 | C |
| ATOM | 751 | N | GLY | A | 91 | −3.326 | −1.920 | 22.044 | 1.00 | 52.25 | N |
| ANISOU | 751 | N | GLY | A | 91 | 5528 | 6327 | 7998 | −247 | −1867 | −1425 | N |
| ATOM | 752 | CA | GLY | A | 91 | −3.044 | −0.788 | 21.189 | 1.00 | 47.66 | C |
| ANISOU | 752 | CA | GLY | A | 91 | 5037 | 5797 | 7274 | −188 | −1960 | −1395 | C |
| ATOM | 753 | C | GLY | A | 91 | −1.681 | −0.166 | 21.441 | 1.00 | 44.44 | C |
| ANISOU | 753 | C | GLY | A | 91 | 4739 | 5431 | 6714 | −141 | −1861 | −1375 | C |
| ATOM | 754 | O | GLY | A | 91 | −1.117 | −0.263 | 22.529 | 1.00 | 44.09 | O |
| ANISOU | 754 | O | GLY | A | 91 | 4676 | 5385 | 6692 | −135 | −1689 | −1345 | O |
| ATOM | 755 | N | SER | A | 92 | −1.148 | 0.463 | 20.395 | 1.00 | 43.26 | N |
| ANISOU | 755 | N | SER | A | 92 | 4727 | 5319 | 6389 | −105 | −1944 | −1367 | N |
| ATOM | 756 | CA | SER | A | 92 | 0.107 | 1.197 | 20.481 | 1.00 | 42.57 | C |
| ANISOU | 756 | CA | SER | A | 92 | 4758 | 5272 | 6143 | −54 | −1832 | −1316 | C |
| ATOM | 757 | C | SER | A | 92 | −0.183 | 2.637 | 20.894 | 1.00 | 38.03 | C |
| ANISOU | 757 | C | SER | A | 92 | 4117 | 4720 | 5612 | 1 | −1824 | −1239 | C |
| ATOM | 758 | O | SER | A | 92 | −1.128 | 3.255 | 20.395 | 1.00 | 37.92 | O |
| ANISOU | 758 | O | SER | A | 92 | 4045 | 4706 | 5657 | 19 | −1964 | −1225 | O |
| ATOM | 759 | CB | SER | A | 92 | 0.828 | 1.161 | 19.129 | 1.00 | 45.20 | C |
| ANISOU | 759 | CB | SER | A | 92 | 5278 | 5629 | 6266 | −43 | −1909 | −1341 | C |
| ATOM | 760 | OG | SER | A | 92 | 1.970 | 2.007 | 19.132 | 1.00 | 41.16 | O |
| ANISOU | 760 | OG | SER | A | 92 | 4868 | 5155 | 5617 | 5 | −1808 | −1282 | O |
| ATOM | 761 | N | HIS | A | 93 | 0.622 | 3.161 | 21.816 | 1.00 | 36.22 | N |
| ANISOU | 761 | N | HIS | A | 93 | 3895 | 4505 | 5360 | 29 | −1665 | −1191 | N |
| ATOM | 762 | CA | HIS | A | 93 | 0.455 | 4.508 | 22.336 | 1.00 | 41.22 | C |
| ANISOU | 762 | CA | HIS | A | 93 | 4477 | 5151 | 6035 | 80 | −1634 | −1124 | C |
| ATOM | 763 | C | HIS | A | 93 | 1.794 | 5.231 | 22.335 | 1.00 | 44.61 | C |
| ANISOU | 763 | C | HIS | A | 93 | 5031 | 5610 | 6310 | 113 | −1541 | −1080 | C |
| ATOM | 764 | O | HIS | A | 93 | 2.863 | 4.617 | 22.219 | 1.00 | 37.04 | O |
| ANISOU | 764 | O | HIS | A | 93 | 4170 | 4663 | 5240 | 96 | −1467 | −1098 | O |
| ATOM | 765 | CB | HIS | A | 93 | −0.157 | 4.482 | 23.744 | 1.00 | 33.36 | C |
| ANISOU | 765 | CB | HIS | A | 93 | 3329 | 4129 | 5215 | 76 | −1527 | −1112 | C |
| ATOM | 766 | CG | HIS | A | 93 | −1.533 | 3.888 | 23.761 | 1.00 | 37.70 | C |
| ANISOU | 766 | CG | HIS | A | 93 | 3736 | 4647 | 5942 | 44 | −1612 | −1146 | C |
| ATOM | 767 | ND1 | HIS | A | 93 | −2.663 | 4.636 | 23.514 | 1.00 | 38.60 | N |
| ANISOU | 767 | ND1 | HIS | A | 93 | 3742 | 4752 | 6173 | 72 | −1721 | −1125 | N |
| ATOM | 768 | CD2 | HIS | A | 93 | −1.955 | 2.614 | 23.943 | 1.00 | 38.85 | C |
| ANISOU | 768 | CD2 | HIS | A | 93 | 3823 | 4762 | 6177 | −16 | −1608 | −1197 | C |
| ATOM | 769 | CE1 | HIS | A | 93 | −3.727 | 3.849 | 23.560 | 1.00 | 44.00 | C |
| ANISOU | 769 | CE1 | HIS | A | 93 | 4297 | 5404 | 7017 | 28 | −1782 | −1162 | C |

TABLE 11-continued

| | | | | | | | | | | | |
|---|---|---|---|---|---|---|---|---|---|---|---|
| ATOM | 770 | NE2 | HIS | A | 93 | −3.325 | 2.617 | 23.819 | 1.00 | 41.04 | N |
| ANISOU | 770 | NE2 | HIS | A | 93 | 3953 | 5014 | 6628 | −29 | −1714 | −1207 | N |
| ATOM | 771 | N | THR | A | 94 | 1.727 | 6.554 | 22.462 | 1.00 | 37.04 | N |
| ANISOU | 771 | N | THR | A | 94 | 4062 | 4657 | 5356 | 160 | −1543 | −1022 | N |
| ATOM | 772 | CA | THR | A | 94 | 2.903 | 7.392 | 22.308 | 1.00 | 30.86 | C |
| ANISOU | 772 | CA | THR | A | 94 | 3393 | 3896 | 4437 | 188 | −1478 | −975 | C |
| ATOM | 773 | C | THR | A | 94 | 3.052 | 8.343 | 23.486 | 1.00 | 37.67 | C |
| ANISOU | 773 | C | THR | A | 94 | 4198 | 4748 | 5368 | 215 | −1370 | −932 | C |
| ATOM | 774 | O | THR | A | 94 | 2.094 | 9.018 | 23.882 | 1.00 | 37.29 | O |
| ANISOU | 774 | O | THR | A | 94 | 4053 | 4677 | 5439 | 243 | −1400 | −913 | O |
| ATOM | 775 | CB | THR | A | 94 | 2.824 | 8.202 | 21.019 | 1.00 | 35.02 | C |
| ANISOU | 775 | CB | THR | A | 94 | 4010 | 4433 | 4862 | 220 | −1604 | −941 | C |
| ATOM | 776 | OG1 | THR | A | 94 | 2.642 | 7.313 | 19.916 | 1.00 | 41.38 | O |
| ANISOU | 776 | OG1 | THR | A | 94 | 4883 | 5247 | 5591 | 194 | −1713 | −989 | O |
| ATOM | 777 | CG2 | THR | A | 94 | 4.116 | 9.015 | 20.805 | 1.00 | 31.07 | C |
| ANISOU | 777 | CG2 | THR | A | 94 | 3632 | 3951 | 4223 | 240 | −1523 | −888 | C |
| ATOM | 778 | N | VAL | A | 95 | 4.253 | 8.412 | 24.030 | 1.00 | 32.81 | N |
| ANISOU | 778 | N | VAL | A | 95 | 3642 | 4145 | 4679 | 209 | −1248 | −917 | N |
| ATOM | 779 | C | VAL | A | 95 | 5.656 | 10.335 | 24.383 | 1.00 | 34.59 | C |
| ANISOU | 779 | C | VAL | A | 95 | 3962 | 4372 | 4809 | 249 | −1150 | −831 | C |
| ATOM | 780 | O | VAL | A | 95 | 6.608 | 9.859 | 23.750 | 1.00 | 33.81 | O |
| ANISOU | 780 | O | VAL | A | 95 | 3954 | 4298 | 4595 | 230 | −1132 | −834 | O |
| ATOM | 781 | CA | AVAL | A | 95 | 4.591 | 9.442 | 24.998 | 0.49 | 30.39 | C |
| ANISOU | 781 | CA | AVAL | A | 95 | 3316 | 3827 | 4402 | 234 | −1159 | −878 | C |
| ATOM | 782 | CB | AVAL | A | 95 | 5.046 | 8.872 | 26.359 | 0.49 | 30.49 | C |
| ANISOU | 782 | CB | AVAL | A | 95 | 3290 | 3838 | 4455 | 212 | −1026 | −896 | C |
| ATOM | 783 | CG1 | AVAL | A | 95 | 3.919 | 8.082 | 27.001 | 0.49 | 33.46 | C |
| ANISOU | 783 | CG1 | AVAL | A | 95 | 3552 | 4195 | 4965 | 197 | −1020 | −931 | C |
| ATOM | 784 | CG2 | AVAL | A | 95 | 6.301 | 8.013 | 26.233 | 0.49 | 25.98 | C |
| ANISOU | 784 | CG2 | AVAL | A | 95 | 2799 | 3292 | 3780 | 182 | −966 | −909 | C |
| ATOM | 785 | CA | BVAL | A | 95 | 4.624 | 9.416 | 25.015 | 0.51 | 30.01 | C |
| ANISOU | 785 | CA | BVAL | A | 95 | 3270 | 3781 | 4353 | 233 | −1155 | −878 | C |
| ATOM | 786 | CB | BVAL | A | 95 | 5.176 | 8.769 | 26.293 | 0.51 | 31.18 | C |
| ANISOU | 786 | CB | BVAL | A | 95 | 3389 | 3930 | 4529 | 208 | −1023 | −898 | C |
| ATOM | 787 | CG1 | BVAL | A | 95 | 6.171 | 9.700 | 26.973 | 0.51 | 26.51 | C |
| ANISOU | 787 | CG1 | BVAL | A | 95 | 2842 | 3339 | 3891 | 220 | −936 | −861 | C |
| ATOM | 788 | CG2 | BVAL | A | 95 | 4.040 | 8.407 | 27.224 | 0.51 | 33.35 | C |
| ANISOU | 788 | CG2 | BVAL | A | 95 | 3542 | 4180 | 4950 | 206 | −999 | −920 | C |
| ATOM | 789 | N | GLN | A | 96 | 5.473 | 11.645 | 24.557 | 1.00 | 32.13 | N |
| ANISOU | 789 | N | GLN | A | 96 | 3644 | 4038 | 4527 | 284 | −1157 | −787 | N |
| ATOM | 790 | CA | GLN | A | 96 | 6.428 | 12.637 | 24.094 | 1.00 | 30.07 | C |
| ANISOU | 790 | CA | GLN | A | 96 | 3480 | 3776 | 4168 | 296 | −1139 | −734 | C |
| ATOM | 791 | C | GLN | A | 96 | 6.782 | 13.576 | 25.236 | 1.00 | 35.43 | C |
| ANISOU | 791 | C | GLN | A | 96 | 4134 | 4427 | 4899 | 305 | −1051 | −714 | C |
| ATOM | 792 | O | GLN | A | 96 | 5.937 | 13.923 | 26.065 | 1.00 | 31.19 | O |
| ANISOU | 792 | O | GLN | A | 96 | 3516 | 3862 | 4474 | 327 | −1040 | −726 | O |
| ATOM | 793 | CB | GLN | A | 96 | 5.881 | 13.460 | 22.938 | 1.00 | 32.29 | C |
| ANISOU | 793 | CB | GLN | A | 96 | 3806 | 4044 | 4419 | 331 | −1257 | −691 | C |
| ATOM | 794 | CG | GLN | A | 96 | 5.787 | 12.696 | 21.627 | 1.00 | 34.68 | C |
| ANISOU | 794 | CG | GLN | A | 96 | 4179 | 4376 | 4623 | 321 | −1351 | −705 | C |
| ATOM | 795 | CD | GLN | A | 96 | 4.790 | 13.354 | 20.694 | 1.00 | 38.66 | C |
| ANISOU | 795 | CD | GLN | A | 96 | 4691 | 4864 | 5135 | 361 | −1499 | −672 | C |
| ATOM | 796 | OE1 | GLN | A | 96 | 3.589 | 13.106 | 20.789 | 1.00 | 43.12 | O |
| ANISOU | 796 | OE1 | GLN | A | 96 | 5158 | 5417 | 5808 | 373 | −1586 | −697 | O |
| ATOM | 797 | NE2 | GLN | A | 96 | 5.278 | 14.206 | 19.803 | 1.00 | 39.86 | N |
| ANISOU | 797 | NE2 | GLN | A | 96 | 4955 | 5011 | 5178 | 383 | −1528 | −610 | N |
| ATOM | 798 | N | ARG | A | 97 | 8.038 | 13.994 | 25.258 | 1.00 | 32.14 | N |
| ANISOU | 798 | N | ARG | A | 97 | 3791 | 4016 | 4405 | 288 | −986 | −687 | N |
| ATOM | 799 | CA | ARG | A | 97 | 8.532 | 14.888 | 26.293 | 1.00 | 34.46 | C |
| ANISOU | 799 | CA | ARG | A | 97 | 4078 | 4281 | 4735 | 288 | −911 | −673 | C |
| ATOM | 800 | C | ARG | A | 97 | 9.452 | 15.898 | 25.631 | 0.95 | 35.51 | C |
| ANISOU | 800 | C | ARG | A | 97 | 4297 | 4399 | 4795 | 285 | −907 | −615 | C |
| ATOM | 801 | O | ARG | A | 97 | 10.217 | 15.547 | 24.732 | 1.00 | 31.86 | O |
| ANISOU | 801 | O | ARG | A | 97 | 3902 | 3965 | 4237 | 267 | −906 | −595 | O |
| ATOM | 802 | CB | ARG | A | 97 | 9.259 | 14.091 | 27.384 | 1.00 | 29.86 | C |
| ANISOU | 802 | CB | ARG | A | 97 | 3472 | 3719 | 4152 | 253 | −818 | −709 | C |
| ATOM | 803 | CG | ARG | A | 97 | 9.916 | 14.892 | 28.525 | 1.00 | 35.99 | C |
| ANISOU | 803 | CG | ARG | A | 97 | 4254 | 4471 | 4950 | 244 | −747 | −704 | C |
| ATOM | 804 | CD | ARG | A | 97 | 10.688 | 13.929 | 29.443 | 1.00 | 41.31 | C |
| ANISOU | 804 | CD | ARG | A | 97 | 4915 | 5175 | 5607 | 211 | −676 | −733 | C |
| ATOM | 805 | NE | ARG | A | 97 | 11.157 | 14.594 | 30.657 | 1.00 | 56.99 | N |
| ANISOU | 805 | NE | ARG | A | 97 | 6905 | 7137 | 7613 | 202 | −623 | −740 | N |
| ATOM | 806 | CZ | ARG | A | 97 | 12.097 | 14.120 | 31.479 | 1.00 | 62.36 | C |
| ANISOU | 806 | CZ | ARG | A | 97 | 7591 | 7837 | 8266 | 172 | −572 | −751 | C |
| ATOM | 807 | NH1 | ARG | A | 97 | 12.434 | 14.824 | 32.557 | 1.00 | 51.16 | N |
| ANISOU | 807 | NH1 | ARG | A | 97 | 6186 | 6392 | 6860 | 165 | −542 | −761 | N |
| ATOM | 808 | NH2 | ARG | A | 97 | 12.706 | 12.959 | 31.231 | 1.00 | 54.18 | N |
| ANISOU | 808 | NH2 | ARG | A | 97 | 6552 | 6841 | 7191 | 153 | −557 | −754 | N |
| ATOM | 809 | N | MET | A | 98 | 9.356 | 17.152 | 26.053 | 1.00 | 31.19 | N |
| ANISOU | 809 | N | MET | A | 98 | 3753 | 3802 | 4296 | 304 | −899 | −588 | N |

TABLE 11-continued

| | | | | | | | | | | | | |
|---|---|---|---|---|---|---|---|---|---|---|---|---|
| ATOM | 810 | CA | MET | A | 98 | 10.208 | 18.207 | 25.529 | 1.00 | 31.54 | | C |
| ANISOU | 810 | CA | MET | A | 98 | 3875 | 3818 | 4290 | 297 | −887 | −529 | C |
| ATOM | 811 | C | MET | A | 98 | 10.638 | 19.093 | 26.690 | 1.00 | 32.25 | | C |
| ANISOU | 811 | C | MET | A | 98 | 3954 | 3862 | 4439 | 285 | −825 | −535 | C |
| ATOM | 812 | O | MET | A | 98 | 9.813 | 19.453 | 27.540 | 1.00 | 34.89 | | O |
| ANISOU | 812 | O | MET | A | 98 | 4238 | 4162 | 4858 | 313 | −824 | −565 | O |
| ATOM | 813 | CB | MET | A | 98 | 9.458 | 19.026 | 24.461 | 1.00 | 32.81 | | C |
| ANISOU | 813 | CB | MET | A | 98 | 4074 | 3947 | 4446 | 341 | −977 | −476 | C |
| ATOM | 814 | CG | MET | A | 98 | 10.283 | 20.123 | 23.796 | 1.00 | 44.62 | | C |
| ANISOU | 814 | CG | MET | A | 98 | 5661 | 5407 | 5887 | 334 | −964 | −402 | C |
| ATOM | 815 | SD | MET | A | 98 | 10.383 | 21.664 | 24.754 | 1.00 | 50.23 | | S |
| ANISOU | 815 | SD | MET | A | 98 | 6365 | 6028 | 6693 | 342 | −925 | −384 | S |
| ATOM | 816 | CE | MET | A | 98 | 8.685 | 22.217 | 24.677 | 1.00 | 50.87 | | C |
| ANISOU | 816 | CE | MET | A | 98 | 6396 | 6062 | 6870 | 421 | −1017 | −380 | C |
| ATOM | 817 | N | TYR | A | 99 | 11.916 | 19.438 | 26.740 | 1.00 | 29.24 | | N |
| ANISOU | 817 | N | TYR | A | 99 | 3617 | 3477 | 4015 | 244 | −772 | −511 | N |
| ATOM | 818 | CA | TYR | A | 99 | 12.333 | 20.407 | 27.741 | 1.00 | 32.35 | | C |
| ANISOU | 818 | CA | TYR | A | 99 | 4012 | 3817 | 4461 | 228 | −732 | −517 | C |
| ATOM | 819 | C | TYR | A | 99 | 13.521 | 21.192 | 27.207 | 1.00 | 38.09 | | C |
| ANISOU | 819 | C | TYR | A | 99 | 4801 | 4518 | 5152 | 190 | −707 | −459 | C |
| ATOM | 820 | O | TYR | A | 99 | 14.167 | 20.795 | 26.227 | 1.00 | 32.83 | | O |
| ANISOU | 820 | O | TYR | A | 99 | 4170 | 3889 | 4415 | 172 | −698 | −420 | O |
| ATOM | 821 | CB | TYR | A | 99 | 12.636 | 19.736 | 29.101 | 1.00 | 28.69 | | C |
| ANISOU | 821 | CB | TYR | A | 99 | 3504 | 3378 | 4020 | 203 | −680 | −580 | C |
| ATOM | 822 | CG | TYR | A | 99 | 13.724 | 18.667 | 29.134 | 1.00 | 31.76 | | C |
| ANISOU | 822 | CG | TYR | A | 99 | 3887 | 3828 | 4353 | 158 | −642 | −588 | C |
| ATOM | 823 | CD1 | TYR | A | 99 | 15.065 | 18.993 | 28.963 | 1.00 | 30.63 | | C |
| ANISOU | 823 | CD1 | TYR | A | 99 | 3773 | 3685 | 4182 | 113 | −610 | −555 | C |
| ATOM | 824 | CD2 | TYR | A | 99 | 13.407 | 17.343 | 29.418 | 1.00 | 30.64 | | C |
| ANISOU | 824 | CD2 | TYR | A | 99 | 3703 | 3738 | 4201 | 162 | −633 | −628 | C |
| ATOM | 825 | CE1 | TYR | A | 99 | 16.056 | 18.010 | 29.030 | 1.00 | 31.13 | | C |
| ANISOU | 825 | CE1 | TYR | A | 99 | 3818 | 3801 | 4210 | 80 | −573 | −561 | C |
| ATOM | 826 | CE2 | TYR | A | 99 | 14.392 | 16.362 | 29.482 | 1.00 | 30.92 | | C |
| ANISOU | 826 | CE2 | TYR | A | 99 | 3732 | 3822 | 4195 | 130 | −597 | −634 | C |
| ATOM | 827 | CZ | TYR | A | 99 | 15.698 | 16.696 | 29.283 | 1.00 | 30.15 | | C |
| ANISOU | 827 | CZ | TYR | A | 99 | 3658 | 3726 | 4072 | 93 | −568 | −600 | C |
| ATOM | 828 | OH | TYR | A | 99 | 16.645 | 15.709 | 29.357 | 1.00 | 31.38 | | O |
| ANISOU | 828 | OH | TYR | A | 99 | 3795 | 3927 | 4201 | 68 | −531 | −604 | O |
| ATOM | 829 | N | GLY | A | 100 | 13.798 | 22.322 | 27.849 | 1.00 | 29.19 | | N |
| ANISOU | 829 | N | GLY | A | 100 | 3689 | 3323 | 4078 | 177 | −690 | −455 | N |
| ATOM | 830 | CA | GLY | A | 100 | 14.945 | 23.114 | 27.462 | 1.00 | 30.23 | | C |
| ANISOU | 830 | CA | GLY | A | 100 | 3869 | 3420 | 4196 | 131 | −661 | −401 | C |
| ATOM | 831 | C | GLY | A | 100 | 14.868 | 24.526 | 28.019 | 1.00 | 30.17 | | C |
| ANISOU | 831 | C | GLY | A | 100 | 3887 | 3316 | 4261 | 130 | −663 | −396 | C |
| ATOM | 832 | O | GLY | A | 100 | 14.004 | 24.851 | 28.833 | 1.00 | 33.92 | | O |
| ANISOU | 832 | O | GLY | A | 100 | 4344 | 3753 | 4792 | 166 | −677 | −443 | O |
| ATOM | 833 | N | CYS | A | 101 | 15.774 | 25.364 | 27.526 | 1.00 | 32.75 | | N |
| ANISOU | 833 | N | CYS | A | 101 | 4260 | 3596 | 4589 | 89 | −642 | −337 | N |
| ATOM | 834 | CA | CYS | A | 101 | 15.954 | 26.707 | 28.066 | 1.00 | 30.77 | | C |
| ANISOU | 834 | CA | CYS | A | 101 | 4039 | 3243 | 4410 | 71 | −638 | −333 | C |
| ATOM | 835 | C | CYS | A | 101 | 16.214 | 27.692 | 26.938 | 1.00 | 32.67 | | C |
| ANISOU | 835 | C | CYS | A | 101 | 4344 | 3420 | 4647 | 67 | −638 | −237 | C |
| ATOM | 836 | O | CYS | A | 101 | 16.801 | 27.343 | 25.910 | 1.00 | 35.87 | | O |
| ANISOU | 836 | O | CYS | A | 101 | 4773 | 3867 | 4989 | 48 | −616 | −174 | O |
| ATOM | 837 | CB | CYS | A | 101 | 17.116 | 26.735 | 29.098 | 1.00 | 39.21 | | C |
| ANISOU | 837 | CB | CYS | A | 101 | 5085 | 4307 | 5507 | −5 | −605 | −376 | C |
| ATOM | 838 | SG | CYS | A | 101 | 18.655 | 25.900 | 28.549 | 1.00 | 42.12 | | S |
| ANISOU | 838 | SG | CYS | A | 101 | 5423 | 4752 | 5827 | −76 | −558 | −335 | S |
| ATOM | 839 | N | ASP | A | 102 | 15.751 | 28.927 | 27.135 | 1.00 | 29.78 | | N |
| ANISOU | 839 | N | ASP | A | 102 | 4017 | 2949 | 4350 | 89 | −657 | −224 | N |
| ATOM | 840 | CA | ASP | A | 102 | 16.049 | 30.040 | 26.253 | 1.00 | 34.25 | | C |
| ANISOU | 840 | CA | ASP | A | 102 | 4652 | 3432 | 4930 | 80 | −652 | −131 | C |
| ATOM | 841 | C | ASP | A | 102 | 17.022 | 30.969 | 26.965 | 1.00 | 35.44 | | C |
| ANISOU | 841 | C | ASP | A | 102 | 4815 | 3496 | 5156 | 5 | −617 | −142 | C |
| ATOM | 842 | O | ASP | A | 102 | 16.921 | 31.172 | 28.183 | 1.00 | 36.53 | | O |
| ANISOU | 842 | O | ASP | A | 102 | 4931 | 3600 | 5348 | −5 | −622 | −227 | O |
| ATOM | 843 | CB | ASP | A | 102 | 14.798 | 30.850 | 25.886 | 1.00 | 35.17 | | C |
| ANISOU | 843 | CB | ASP | A | 102 | 4806 | 3473 | 5083 | 164 | −705 | −99 | C |
| ATOM | 844 | CG | ASP | A | 102 | 13.754 | 30.056 | 25.093 | 1.00 | 42.12 | | C |
| ANISOU | 844 | CG | ASP | A | 102 | 5674 | 4428 | 5903 | 238 | −761 | −82 | C |
| ATOM | 845 | OD1 | ASP | A | 102 | 14.074 | 29.029 | 24.459 | 1.00 | 38.95 | | O |
| ANISOU | 845 | OD1 | ASP | A | 102 | 5265 | 4123 | 5410 | 223 | −757 | −70 | O |
| ATOM | 846 | OD2 | ASP | A | 102 | 12.594 | 30.505 | 25.089 | 1.00 | 43.02 | | O |
| ANISOU | 846 | OD2 | ASP | A | 102 | 5784 | 4495 | 6066 | 314 | −814 | −81 | O |
| ATOM | 847 | N | VAL | A | 103 | 17.947 | 31.550 | 26.208 | 1.00 | 36.08 | | N |
| ANISOU | 847 | N | VAL | A | 103 | 4936 | 3536 | 5238 | −49 | −580 | −57 | N |
| ATOM | 848 | CA | VAL | A | 103 | 18.802 | 32.620 | 26.711 | 1.00 | 37.69 | | C |
| ANISOU | 848 | CA | VAL | A | 103 | 5156 | 3635 | 5530 | −123 | −555 | −53 | C |
| ATOM | 849 | C | VAL | A | 103 | 18.717 | 33.795 | 25.749 | 1.00 | 36.18 | | C |
| ANISOU | 849 | C | VAL | A | 103 | 5045 | 3336 | 5364 | −113 | −546 | 54 | C |

TABLE 11-continued

| | | | | | | | | | | | | |
|---|---|---|---|---|---|---|---|---|---|---|---|---|
| ATOM | 850 | O | VAL | A | 103 | 18.374 | 33.631 | 24.575 | 1.00 | 37.46 | | O |
| ANISOU | 850 | O | VAL | A | 103 | 5250 | 3528 | 5454 | −68 | −547 | 138 | O |
| ATOM | 851 | CB | VAL | A | 103 | 20.269 | 32.162 | 26.895 | 1.00 | 36.39 | | C |
| ANISOU | 851 | CB | VAL | A | 103 | 4939 | 3517 | 5370 | −222 | −507 | −54 | C |
| ATOM | 852 | CG1 | VAL | A | 103 | 20.330 | 30.995 | 27.848 | 1.00 | 33.45 | | C |
| ANISOU | 852 | CG1 | VAL | A | 103 | 4494 | 3246 | 4970 | −225 | −522 | −152 | C |
| ATOM | 853 | CG2 | VAL | A | 103 | 20.915 | 31.788 | 25.544 | 1.00 | 34.96 | | C |
| ANISOU | 853 | CG2 | VAL | A | 103 | 4772 | 3388 | 5124 | −239 | −449 | 50 | C |
| ATOM | 854 | N | GLY | A | 104 | 19.020 | 34.990 | 26.253 | 1.00 | 38.20 | | N |
| ANISOU | 854 | N | GLY | A | 104 | 5332 | 3462 | 5719 | −155 | −541 | 50 | N |
| ATOM | 855 | CA | GLY | A | 104 | 19.046 | 36.178 | 25.426 | 1.00 | 37.41 | | C |
| ANISOU | 855 | CA | GLY | A | 104 | 5312 | 3244 | 5659 | −154 | −526 | 156 | C |
| ATOM | 856 | C | GLY | A | 104 | 20.392 | 36.353 | 24.735 | 1.00 | 37.97 | | C |
| ANISOU | 856 | C | GLY | A | 104 | 5389 | 3306 | 5733 | −250 | −455 | 245 | C |
| ATOM | 857 | O | GLY | A | 104 | 21.244 | 35.465 | 24.722 | 1.00 | 38.18 | | O |
| ANISOU | 857 | O | GLY | A | 104 | 5354 | 3431 | 5722 | −303 | −416 | 233 | O |
| ATOM | 858 | N | ASER | A | 105 | 20.579 | 37.543 | 24.161 | 0.45 | 38.71 | | N |
| ANISOU | 858 | N | ASER | A | 105 | 5556 | 3271 | 5882 | −269 | −430 | 338 | N |
| ATOM | 859 | CA | ASER | A | 105 | 21.797 | 37.831 | 23.407 | 0.45 | 43.97 | | C |
| ANISOU | 859 | CA | ASER | A | 105 | 6233 | 3913 | 6561 | −358 | −347 | 440 | C |
| ATOM | 860 | C | ASER | A | 105 | 23.033 | 37.916 | 24.293 | 0.45 | 45.48 | | C |
| ANISOU | 860 | C | ASER | A | 105 | 6344 | 4083 | 6852 | −478 | −318 | 382 | C |
| ATOM | 861 | O | ASER | A | 105 | 24.156 | 37.869 | 23.777 | 0.45 | 47.23 | | O |
| ANISOU | 861 | O | ASER | A | 105 | 6538 | 4315 | 7092 | −559 | −241 | 452 | O |
| ATOM | 862 | CB | ASER | A | 105 | 21.626 | 39.134 | 22.627 | 0.45 | 43.99 | | C |
| ANISOU | 862 | CB | ASER | A | 105 | 6339 | 3770 | 6605 | −348 | −328 | 558 | C |
| ATOM | 863 | OG | ASER | A | 105 | 21.365 | 40.209 | 23.508 | 0.45 | 43.49 | | O |
| ANISOU | 863 | OG | ASER | A | 105 | 6294 | 3562 | 6666 | −360 | −366 | 505 | O |
| ATOM | 864 | N | BSER | A | 105 | 20.577 | 37.544 | 24.162 | 0.55 | 38.58 | | N |
| ANISOU | 864 | N | BSER | A | 105 | 5539 | 3254 | 5865 | −269 | −430 | 338 | N |
| ATOM | 865 | CA | BSER | A | 105 | 21.795 | 37.842 | 23.413 | 0.55 | 44.15 | | C |
| ANISOU | 865 | CA | BSER | A | 105 | 6256 | 3935 | 6585 | −358 | −347 | 440 | C |
| ATOM | 866 | C | BSER | A | 105 | 23.032 | 37.897 | 24.297 | 0.55 | 45.50 | | C |
| ANISOU | 866 | C | BSER | A | 105 | 6346 | 4088 | 6853 | −478 | −318 | 381 | C |
| ATOM | 867 | O | BSER | A | 105 | 24.153 | 37.812 | 23.783 | 0.55 | 47.47 | | O |
| ANISOU | 867 | O | BSER | A | 105 | 6566 | 4352 | 7119 | −557 | −242 | 450 | O |
| ATOM | 868 | CB | BSER | A | 105 | 21.634 | 39.168 | 22.667 | 0.55 | 44.14 | | C |
| ANISOU | 868 | CB | BSER | A | 105 | 6358 | 3785 | 6630 | −350 | −329 | 556 | C |
| ATOM | 869 | OG | BSER | A | 105 | 20.556 | 39.103 | 21.754 | 0.55 | 41.75 | | O |
| ANISOU | 869 | OG | BSER | A | 105 | 6130 | 3501 | 6231 | −240 | −366 | 623 | O |
| ATOM | 870 | N | ASP | A | 106 | 22.853 | 38.056 | 25.605 | 1.00 | 44.58 | | N |
| ANISOU | 870 | N | ASP | A | 106 | 6195 | 3938 | 6805 | −492 | −377 | 259 | N |
| ATOM | 871 | CA | ASP | A | 106 | 23.941 | 38.007 | 26.570 | 1.00 | 42.13 | | C |
| ANISOU | 871 | CA | ASP | A | 106 | 5808 | 3623 | 6578 | −600 | −379 | 187 | C |
| ATOM | 872 | C | ASP | A | 106 | 24.118 | 36.602 | 27.129 | 1.00 | 42.49 | | C |
| ANISOU | 872 | C | ASP | A | 106 | 5763 | 3826 | 6554 | −593 | −397 | 104 | C |
| ATOM | 873 | O | ASP | A | 106 | 24.894 | 36.404 | 28.070 | 1.00 | 38.43 | | O |
| ANISOU | 873 | O | ASP | A | 106 | 5182 | 3325 | 6096 | −667 | −421 | 30 | O |
| ATOM | 874 | CB | ASP | A | 106 | 23.671 | 39.007 | 27.699 | 1.00 | 44.01 | | C |
| ANISOU | 874 | CB | ASP | A | 106 | 6079 | 3727 | 6916 | −620 | −437 | 96 | C |
| ATOM | 875 | CG | ASP | A | 106 | 22.274 | 38.849 | 28.287 | 1.00 | 44.36 | | C |
| ANISOU | 875 | CG | ASP | A | 106 | 6161 | 3784 | 6911 | −507 | −495 | 10 | C |
| ATOM | 876 | OD1 | ASP | A | 106 | 21.638 | 37.809 | 28.025 | 1.00 | 37.66 | | O |
| ANISOU | 876 | OD1 | ASP | A | 106 | 5286 | 3062 | 5960 | −430 | −502 | 3 | O |
| ATOM | 877 | OD2 | ASP | A | 106 | 21.802 | 39.765 | 28.991 | 1.00 | 45.76 | | O |
| ANISOU | 877 | OD2 | ASP | A | 106 | 6391 | 3838 | 7157 | −494 | −529 | −49 | O |
| ATOM | 878 | N | TRP | A | 107 | 23.384 | 35.638 | 26.574 | 1.00 | 38.90 | | N |
| ANISOU | 878 | N | TRP | A | 107 | 5313 | 3485 | 5982 | −504 | −396 | 116 | N |
| ATOM | 879 | CA | TRP | A | 107 | 23.375 | 34.230 | 26.974 | 1.00 | 38.35 | | C |
| ANISOU | 879 | CA | TRP | A | 107 | 5171 | 3563 | 5838 | −480 | −410 | 48 | C |
| ATOM | 880 | C | TRP | A | 107 | 22.892 | 34.028 | 28.406 | 1.00 | 38.88 | | C |
| ANISOU | 880 | C | TRP | A | 107 | 5215 | 3636 | 5922 | −464 | −479 | −85 | C |
| ATOM | 881 | O | TRP | A | 107 | 23.173 | 32.993 | 29.018 | 1.00 | 36.15 | | O |
| ANISOU | 881 | O | TRP | A | 107 | 4803 | 3391 | 5541 | −473 | −493 | −149 | O |
| ATOM | 882 | CB | TRP | A | 107 | 24.744 | 33.574 | 26.783 | 1.00 | 40.82 | | C |
| ANISOU | 882 | CB | TRP | A | 107 | 5400 | 3946 | 6163 | −562 | −353 | 76 | C |
| ATOM | 883 | CG | TRP | A | 107 | 25.251 | 33.576 | 25.366 | 1.00 | 45.44 | | C |
| ANISOU | 883 | CG | TRP | A | 107 | 6007 | 4544 | 6713 | −572 | −263 | 203 | C |
| ATOM | 884 | CD1 | TRP | A | 107 | 24.608 | 34.049 | 24.256 | 1.00 | 44.53 | | C |
| ANISOU | 884 | CD1 | TRP | A | 107 | 5989 | 4391 | 6540 | −516 | −238 | 295 | C |
| ATOM | 885 | CD2 | TRP | A | 107 | 26.520 | 33.079 | 24.914 | 1.00 | 42.37 | | C |
| ANISOU | 885 | CD2 | TRP | A | 107 | 5547 | 4209 | 6342 | −639 | −180 | 255 | C |
| ATOM | 886 | NE1 | TRP | A | 107 | 25.404 | 33.886 | 23.144 | 1.00 | 42.86 | | N |
| ANISOU | 886 | NE1 | TRP | A | 107 | 5784 | 4206 | 6295 | −546 | −140 | 401 | N |
| ATOM | 887 | CE2 | TRP | A | 107 | 26.580 | 33.290 | 23.519 | 1.00 | 41.43 | | C |
| ANISOU | 887 | CE2 | TRP | A | 107 | 5495 | 4080 | 6165 | −621 | −96 | 377 | C |
| ATOM | 888 | CE3 | TRP | A | 107 | 27.613 | 32.488 | 25.557 | 1.00 | 38.09 | | C |
| ANISOU | 888 | CE3 | TRP | A | 107 | 4890 | 3720 | 5864 | −710 | −170 | 214 | C |
| ATOM | 889 | CZ2 | TRP | A | 107 | 27.698 | 32.931 | 22.751 | 1.00 | 39.74 | | C |
| ANISOU | 889 | CZ2 | TRP | A | 107 | 5239 | 3906 | 5953 | −671 | 16 | 455 | C |

TABLE 11-continued

| | | | | | | | | | | | |
|---|---|---|---|---|---|---|---|---|---|---|---|
| ATOM | 890 | CZ3 | TRP | A | 107 | 28.723 | 32.121 | 24.791 | 1.00 | 40.21 | C |
| ANISOU | 890 | CZ3 | TRP | A | 107 | 5100 | 4028 | 6150 | −758 | −66 | 293 | C |
| ATOM | 891 | CH2 | TRP | A | 107 | 28.748 | 32.340 | 23.402 | 1.00 | 41.37 | C |
| ANISOU | 891 | CH2 | TRP | A | 107 | 5318 | 4163 | 6236 | −737 | 33 | 410 | C |
| ATOM | 892 | N | ARG | A | 108 | 22.143 | 34.982 | 28.950 | 1.00 | 37.60 | N |
| ANISOU | 892 | N | ARG | A | 108 | 5113 | 3365 | 5807 | −435 | −518 | −127 | N |
| ATOM | 893 | CA | ARG | A | 108 | 21.555 | 34.831 | 30.274 | 1.00 | 35.44 | C |
| ANISOU | 893 | CA | ARG | A | 108 | 4837 | 3092 | 5536 | −407 | −570 | −252 | C |
| ATOM | 894 | C | ARG | A | 108 | 20.228 | 34.110 | 30.154 | 1.00 | 34.80 | C |
| ANISOU | 894 | C | ARG | A | 108 | 4762 | 3085 | 5377 | −293 | −583 | −275 | C |
| ATOM | 895 | O | ARG | A | 108 | 19.479 | 34.332 | 29.199 | 1.00 | 34.78 | O |
| ANISOU | 895 | O | ARG | A | 108 | 4796 | 3066 | 5353 | −227 | −577 | −204 | O |
| ATOM | 896 | CB | ARG | A | 108 | 21.321 | 36.190 | 30.946 | 1.00 | 36.46 | C |
| ANISOU | 896 | CB | ARG | A | 108 | 5034 | 3063 | 5756 | −422 | −595 | −296 | C |
| ATOM | 897 | CG | ARG | A | 108 | 22.542 | 36.827 | 31.573 | 1.00 | 41.37 | C |
| ANISOU | 897 | CG | ARG | A | 108 | 5644 | 3608 | 6465 | −543 | −609 | −325 | C |
| ATOM | 898 | CD | ARG | A | 108 | 22.128 | 38.088 | 32.370 | 1.00 | 41.89 | C |
| ANISOU | 898 | CD | ARG | A | 108 | 5793 | 3515 | 6607 | −544 | −640 | −394 | C |
| ATOM | 899 | NE | ARG | A | 108 | 21.302 | 39.007 | 31.576 | 1.00 | 47.40 | N |
| ANISOU | 899 | NE | ARG | A | 108 | 6563 | 4107 | 7338 | −478 | −616 | −322 | N |
| ATOM | 900 | CZ | ARG | A | 108 | 20.132 | 39.520 | 31.972 | 1.00 | 53.23 | C |
| ANISOU | 900 | CZ | ARG | A | 108 | 7364 | 4774 | 8087 | −387 | −629 | −372 | C |
| ATOM | 901 | NH1 | ARG | A | 108 | 19.462 | 40.347 | 31.168 | 1.00 | 46.89 | N |
| ANISOU | 901 | NH1 | ARG | A | 108 | 6619 | 3874 | 7323 | −326 | −613 | −292 | N |
| ATOM | 902 | NH2 | ARG | A | 108 | 19.631 | 39.223 | 33.171 | 1.00 | 41.43 | N |
| ANISOU | 902 | NH2 | ARG | A | 108 | 5876 | 3299 | 6566 | −354 | −654 | −498 | N |
| ATOM | 903 | N | PHE | A | 109 | 19.925 | 33.282 | 31.150 | 1.00 | 37.57 | N |
| ANISOU | 903 | N | PHE | A | 109 | 5077 | 3509 | 5691 | −273 | −606 | −371 | N |
| ATOM | 904 | CA | PHE | A | 109 | 18.642 | 32.588 | 31.209 | 1.00 | 34.66 | C |
| ANISOU | 904 | CA | PHE | A | 109 | 4700 | 3202 | 5265 | −172 | −616 | −404 | C |
| ATOM | 905 | C | PHE | A | 109 | 17.485 | 33.555 | 31.014 | 1.00 | 37.15 | C |
| ANISOU | 905 | C | PHE | A | 109 | 5073 | 3416 | 5625 | −94 | −626 | −392 | C |
| ATOM | 906 | O | PHE | A | 109 | 17.431 | 34.613 | 31.648 | 1.00 | 37.32 | O |
| ANISOU | 906 | O | PHE | A | 109 | 5143 | 3319 | 5716 | −105 | −631 | −431 | O |
| ATOM | 907 | CB | PHE | A | 109 | 18.506 | 31.866 | 32.560 | 1.00 | 35.49 | C |
| ANISOU | 907 | CB | PHE | A | 109 | 4777 | 3363 | 5344 | −170 | −630 | −516 | C |
| ATOM | 908 | CG | PHE | A | 109 | 17.126 | 31.300 | 32.820 | 1.00 | 36.18 | C |
| ANISOU | 908 | CG | PHE | A | 109 | 4856 | 3493 | 5399 | −72 | −630 | −559 | C |
| ATOM | 909 | CD1 | PHE | A | 109 | 16.772 | 30.052 | 32.331 | 1.00 | 36.36 | C |
| ANISOU | 909 | CD1 | PHE | A | 109 | 4825 | 3634 | 5357 | −35 | −626 | −540 | C |
| ATOM | 910 | CD2 | PHE | A | 109 | 16.196 | 32.014 | 33.564 | 1.00 | 37.62 | C |
| ANISOU | 910 | CD2 | PHE | A | 109 | 5080 | 3592 | 5624 | −18 | −630 | −620 | C |
| ATOM | 911 | CE1 | PHE | A | 109 | 15.522 | 29.524 | 32.573 | 1.00 | 35.70 | C |
| ANISOU | 911 | CE1 | PHE | A | 109 | 4721 | 3584 | 5259 | 46 | −626 | −577 | C |
| ATOM | 912 | CE2 | PHE | A | 109 | 14.933 | 31.501 | 33.803 | 1.00 | 41.56 | C |
| ANISOU | 912 | CE2 | PHE | A | 109 | 5555 | 4127 | 6109 | 71 | −620 | −654 | C |
| ATOM | 913 | CZ | PHE | A | 109 | 14.595 | 30.252 | 33.304 | 1.00 | 37.47 | C |
| ANISOU | 913 | CZ | PHE | A | 109 | 4975 | 3728 | 5534 | 99 | −621 | −631 | C |
| ATOM | 914 | N | LEU | A | 110 | 16.564 | 33.189 | 30.116 | 1.00 | 34.61 | N |
| ANISOU | 914 | N | LEU | A | 110 | 4746 | 3137 | 5266 | −14 | −634 | −338 | N |
| ATOM | 915 | CA | LEU | A | 110 | 15.296 | 33.889 | 29.929 | 1.00 | 39.21 | C |
| ANISOU | 915 | CA | LEU | A | 110 | 5362 | 3644 | 5893 | 80 | −654 | −327 | C |
| ATOM | 916 | C | LEU | A | 110 | 14.100 | 33.076 | 30.404 | 1.00 | 40.36 | C |
| ANISOU | 916 | C | LEU | A | 110 | 5458 | 3857 | 6020 | 162 | −666 | −390 | C |
| ATOM | 917 | O | LEU | A | 110 | 13.222 | 33.602 | 31.093 | 1.00 | 41.26 | O |
| ANISOU | 917 | O | LEU | A | 110 | 5582 | 3903 | 6193 | 221 | −664 | −444 | O |
| ATOM | 918 | CB | LEU | A | 110 | 15.091 | 34.243 | 28.448 | 1.00 | 38.29 | C |
| ANISOU | 918 | CB | LEU | A | 110 | 5280 | 3509 | 5760 | 113 | −669 | −203 | C |
| ATOM | 919 | CG | LEU | A | 110 | 15.821 | 35.466 | 27.921 | 1.00 | 43.33 | C |
| ANISOU | 919 | CG | LEU | A | 110 | 5987 | 4028 | 6449 | 63 | −652 | −123 | C |
| ATOM | 920 | CD1 | LEU | A | 110 | 15.536 | 35.621 | 26.430 | 1.00 | 40.25 | C |
| ANISOU | 920 | CD1 | LEU | A | 110 | 5639 | 3639 | 6013 | 105 | −667 | 4 | C |
| ATOM | 921 | CD2 | LEU | A | 110 | 15.373 | 36.695 | 28.701 | 1.00 | 37.58 | C |
| ANISOU | 921 | CD2 | LEU | A | 110 | 5302 | 3151 | 5824 | 86 | −657 | −168 | C |
| ATOM | 922 | N | ARG | A | 111 | 14.039 | 31.799 | 30.035 | 1.00 | 32.81 | N |
| ANISOU | 922 | N | ARG | A | 111 | 4447 | 3030 | 4989 | 168 | −672 | −385 | N |
| ATOM | 923 | CA | ARG | A | 111 | 12.854 | 30.972 | 30.255 | 1.00 | 32.67 | C |
| ANISOU | 923 | CA | ARG | A | 111 | 4375 | 3077 | 4962 | 243 | −686 | −427 | C |
| ATOM | 924 | C | ARG | A | 111 | 13.274 | 29.519 | 30.199 | 1.00 | 35.46 | C |
| ANISOU | 924 | C | ARG | A | 111 | 4676 | 3565 | 5234 | 210 | −679 | −444 | C |
| ATOM | 925 | O | ARG | A | 111 | 14.243 | 29.176 | 29.519 | 1.00 | 39.22 | O |
| ANISOU | 925 | O | ARG | A | 111 | 5160 | 4086 | 5657 | 155 | −673 | −394 | O |
| ATOM | 926 | CB | ARG | A | 111 | 11.776 | 31.193 | 29.182 | 1.00 | 35.14 | C |
| ANISOU | 926 | CB | ARG | A | 111 | 4685 | 3374 | 5290 | 327 | −733 | −357 | C |
| ATOM | 927 | CG | ARG | A | 111 | 10.901 | 32.406 | 29.364 | 1.00 | 62.90 | C |
| ANISOU | 927 | CG | ARG | A | 111 | 8229 | 6767 | 8904 | 397 | −744 | −353 | C |
| ATOM | 928 | CD | ARG | A | 111 | 10.100 | 32.627 | 28.095 | 1.00 | 69.86 | C |
| ANISOU | 928 | CD | ARG | A | 111 | 9115 | 7639 | 9791 | 468 | −807 | −260 | C |
| ATOM | 929 | NE | ARG | A | 111 | 10.962 | 32.523 | 26.924 | 1.00 | 68.64 | N |
| ANISOU | 929 | NE | ARG | A | 111 | 9009 | 7517 | 9552 | 419 | −823 | −168 | N |

TABLE 11-continued

| | | | | | | | | | | | | |
|---|---|---|---|---|---|---|---|---|---|---|---|---|
| ATOM | 930 | CZ | ARG | A | 111 | 11.579 | 33.550 | 26.345 | 1.00 | 60.20 | | C |
| ANISOU | 930 | CZ | ARG | A | 111 | 8019 | 6361 | 8493 | 392 | −816 | −90 | C |
| ATOM | 931 | NH1 | ARG | A | 111 | 11.426 | 34.790 | 26.819 | 1.00 | 48.21 | | N |
| ANISOU | 931 | NH1 | ARG | A | 111 | 6539 | 4708 | 7071 | 410 | −804 | −93 | N |
| ATOM | 932 | NH2 | ARG | A | 111 | 12.350 | 33.334 | 25.283 | 1.00 | 48.70 | | N |
| ANISOU | 932 | NH2 | ARG | A | 111 | 6606 | 4946 | 6952 | 349 | −815 | −6 | N |
| ATOM | 933 | N | GLY | A | 112 | 12.504 | 28.666 | 30.879 | 1.00 | 33.39 | | N |
| ANISOU | 933 | N | GLY | A | 112 | 4360 | 3359 | 4968 | 248 | −673 | −510 | N |
| ATOM | 934 | CA | GLY | A | 112 | 12.663 | 27.233 | 30.753 | 1.00 | 32.87 | | C |
| ANISOU | 934 | CA | GLY | A | 112 | 4243 | 3412 | 4834 | 232 | −671 | −523 | C |
| ATOM | 935 | C | GLY | A | 112 | 11.330 | 26.580 | 30.448 | 1.00 | 32.88 | | C |
| ANISOU | 935 | C | GLY | A | 112 | 4191 | 3453 | 4848 | 305 | −698 | −529 | C |
| ATOM | 936 | O | GLY | A | 112 | 10.263 | 27.190 | 30.585 | 1.00 | 32.87 | | O |
| ANISOU | 936 | O | GLY | A | 112 | 4179 | 3393 | 4917 | 370 | −710 | −536 | O |
| ATOM | 937 | N | GLU | A | 113 | 11.397 | 25.323 | 30.009 | 1.00 | 32.34 | | N |
| ANISOU | 937 | N | GLU | A | 113 | 4086 | 3483 | 4720 | 293 | −708 | −526 | N |
| ATOM | 938 | CA | GLU | A | 113 | 10.190 | 24.630 | 29.578 | 1.00 | 33.21 | | C |
| ANISOU | 938 | CA | GLU | A | 113 | 4141 | 3633 | 4845 | 351 | −746 | −529 | C |
| ATOM | 939 | C | GLU | A | 113 | 10.303 | 23.149 | 29.903 | 1.00 | 31.22 | | C |
| ANISOU | 939 | C | GLU | A | 113 | 3840 | 3474 | 4549 | 326 | −726 | −572 | C |
| ATOM | 940 | O | GLU | A | 113 | 11.372 | 22.559 | 29.780 | 1.00 | 32.04 | | O |
| ANISOU | 940 | O | GLU | A | 113 | 3960 | 3626 | 4585 | 271 | −705 | −567 | O |
| ATOM | 941 | CB | GLU | A | 113 | 9.951 | 24.746 | 28.061 | 1.00 | 48.91 | | C |
| ANISOU | 941 | CB | GLU | A | 113 | 6156 | 5630 | 6800 | 375 | −815 | −452 | C |
| ATOM | 942 | CG | GLU | A | 113 | 9.827 | 26.131 | 27.503 | 1.00 | 62.80 | | C |
| ANISOU | 942 | CG | GLU | A | 113 | 7971 | 7298 | 8593 | 404 | −844 | −388 | C |
| ATOM | 943 | CD | GLU | A | 113 | 11.112 | 26.607 | 26.861 | 1.00 | 67.23 | | C |
| ANISOU | 943 | CD | GLU | A | 113 | 8609 | 7844 | 9091 | 347 | −824 | −326 | C |
| ATOM | 944 | OE1 | GLU | A | 113 | 12.045 | 25.793 | 26.726 | 1.00 | 73.95 | | O |
| ANISOU | 944 | OE1 | GLU | A | 113 | 9462 | 8763 | 9871 | 291 | −792 | −331 | O |
| ATOM | 945 | OE2 | GLU | A | 113 | 11.183 | 27.788 | 26.467 | 1.00 | 76.04 | | O |
| ANISOU | 945 | OE2 | GLU | A | 113 | 9781 | 8875 | 10236 | 359 | −835 | −269 | O |
| ATOM | 946 | N | HIS | A | 114 | 9.179 | 22.529 | 30.251 | 1.00 | 30.88 | | N |
| ANISOU | 946 | N | HIS | A | 114 | 3729 | 3451 | 4551 | 367 | −731 | −610 | N |
| ATOM | 947 | CA | HIS | A | 114 | 9.197 | 21.073 | 30.419 | 1.00 | 32.84 | | C |
| ANISOU | 947 | CA | HIS | A | 114 | 3933 | 3781 | 4763 | 345 | −717 | −643 | C |
| ATOM | 948 | C | HIS | A | 114 | 7.774 | 20.577 | 30.237 | 1.00 | 37.37 | | C |
| ANISOU | 948 | C | HIS | A | 114 | 4431 | 4365 | 5403 | 395 | −751 | −657 | C |
| ATOM | 949 | O | HIS | A | 114 | 6.872 | 20.989 | 30.975 | 1.00 | 33.82 | | O |
| ANISOU | 949 | O | HIS | A | 114 | 3939 | 3873 | 5040 | 438 | −726 | −685 | O |
| ATOM | 950 | CB | HIS | A | 114 | 9.759 | 20.695 | 31.793 | 1.00 | 29.93 | | C |
| ANISOU | 950 | CB | HIS | A | 114 | 3564 | 3425 | 4384 | 310 | −644 | −698 | C |
| ATOM | 951 | CG | HIS | A | 114 | 9.813 | 19.222 | 32.054 | 1.00 | 43.24 | | C |
| ANISOU | 951 | CG | HIS | A | 114 | 5209 | 5183 | 6038 | 289 | −623 | −726 | C |
| ATOM | 952 | ND1 | HIS | A | 114 | 8.691 | 18.476 | 32.366 | 1.00 | 42.78 | | N |
| ANISOU | 952 | ND1 | HIS | A | 114 | 5083 | 5140 | 6030 | 319 | −613 | −756 | N |
| ATOM | 953 | CD2 | HIS | A | 114 | 10.857 | 18.358 | 32.077 | 1.00 | 38.05 | | C |
| ANISOU | 953 | CD2 | HIS | A | 114 | 4565 | 4579 | 5313 | 242 | −605 | −727 | C |
| ATOM | 954 | CE1 | HIS | A | 114 | 9.046 | 17.220 | 32.576 | 1.00 | 42.86 | | C |
| ANISOU | 954 | CE1 | HIS | A | 114 | 5076 | 5207 | 6001 | 288 | −591 | −774 | C |
| ATOM | 955 | NE2 | HIS | A | 114 | 10.352 | 17.119 | 32.396 | 1.00 | 37.98 | | N |
| ANISOU | 955 | NE2 | HIS | A | 114 | 4506 | 4613 | 5310 | 245 | −588 | −757 | N |
| ATOM | 956 | N | GLN | A | 115 | 7.544 | 19.745 | 29.228 | 1.00 | 35.74 | | N |
| ANISOU | 956 | N | GLN | A | 115 | 4208 | 4209 | 5163 | 393 | −810 | −639 | N |
| ATOM | 957 | CA | GLN | A | 115 | 6.170 | 19.372 | 28.961 | 1.00 | 34.69 | | C |
| ANISOU | 957 | CA | GLN | A | 115 | 3994 | 4078 | 5106 | 437 | −862 | −649 | C |
| ATOM | 958 | C | GLN | A | 115 | 6.100 | 17.997 | 28.326 | 1.00 | 33.25 | | C |
| ANISOU | 958 | C | GLN | A | 115 | 3789 | 3963 | 4880 | 410 | −901 | −662 | C |
| ATOM | 959 | O | GLN | A | 115 | 7.067 | 17.477 | 27.760 | 1.00 | 34.60 | | O |
| ANISOU | 959 | O | GLN | A | 115 | 4021 | 4175 | 4952 | 370 | −902 | −651 | O |
| ATOM | 960 | CB | GLN | A | 115 | 5.461 | 20.399 | 28.086 | 1.00 | 40.17 | | C |
| ANISOU | 960 | CB | GLN | A | 115 | 4695 | 4725 | 5845 | 491 | −946 | −598 | C |
| ATOM | 961 | CG | GLN | A | 115 | 6.140 | 20.731 | 26.788 | 1.00 | 47.39 | | C |
| ANISOU | 961 | CG | GLN | A | 115 | 5699 | 5647 | 6661 | 479 | −1010 | −536 | C |
| ATOM | 962 | CD | GLN | A | 115 | 5.644 | 22.066 | 26.245 | 1.00 | 60.24 | | C |
| ANISOU | 962 | CD | GLN | A | 115 | 7352 | 7204 | 8333 | 534 | −1069 | −478 | C |
| ATOM | 963 | OE1 | GLN | A | 115 | 5.569 | 23.053 | 26.978 | 1.00 | 64.10 | | O |
| ANISOU | 963 | OE1 | GLN | A | 115 | 7840 | 7625 | 8890 | 558 | −1023 | −480 | O |
| ATOM | 964 | NE2 | GLN | A | 115 | 5.274 | 22.092 | 24.969 | 1.00 | 63.74 | | N |
| ANISOU | 964 | NE2 | GLN | A | 115 | 7823 | 7658 | 8736 | 558 | −1174 | −426 | N |
| ATOM | 965 | N | TYR | A | 116 | 4.908 | 17.449 | 28.411 | 1.00 | 36.70 | | N |
| ANISOU | 965 | N | TYR | A | 116 | 4137 | 4405 | 5404 | 434 | −931 | −687 | N |
| ATOM | 966 | CA | TYR | A | 116 | 4.660 | 16.032 | 28.291 | 1.00 | 37.72 | | C |
| ANISOU | 966 | CA | TYR | A | 116 | 4220 | 4583 | 5527 | 405 | −942 | −721 | C |
| ATOM | 967 | C | TYR | A | 116 | 3.358 | 15.854 | 27.533 | 1.00 | 38.74 | | C |
| ANISOU | 967 | C | TYR | A | 116 | 4275 | 4708 | 5737 | 436 | −1048 | −718 | C |
| ATOM | 968 | O | TYR | A | 116 | 2.390 | 16.563 | 27.812 | 1.00 | 35.26 | | O |
| ANISOU | 968 | O | TYR | A | 116 | 3765 | 4225 | 5408 | 485 | −1063 | −710 | O |
| ATOM | 969 | CB | TYR | A | 116 | 4.57 | 15.440 | 29.692 | 1.00 | 40.91 | | C |
| ANISOU | 969 | CB | TYR | A | 116 | 4572 | 4989 | 5982 | 389 | −835 | −767 | C |

TABLE 11-continued

| | | | | | | | | | | | |
|---|---|---|---|---|---|---|---|---|---|---|---|
| ATOM | 970 | CG | TYR | A | 116 | 4.860 | 13.994 | 29.745 | 1.00 | 46.40 | C |
| ANISOU | 970 | CG | TYR | A | 116 | 5257 | 5731 | 6641 | 344 | −815 | −797 | C |
| ATOM | 971 | CD1 | TYR | A | 116 | 3.852 | 13.074 | 29.515 | 1.00 | 57.78 | C |
| ANISOU | 971 | CD1 | TYR | A | 116 | 6615 | 7181 | 8156 | 341 | −854 | −820 | C |
| ATOM | 972 | CD2 | TYR | A | 116 | 6.137 | 13.536 | 30.017 | 1.00 | 47.77 | C |
| ANISOU | 972 | CD2 | TYR | A | 116 | 5498 | 5934 | 6718 | 304 | −760 | −800 | C |
| ATOM | 973 | CE1 | TYR | A | 116 | 4.099 | 11.742 | 29.559 | 1.00 | 63.66 | C |
| ANISOU | 973 | CE1 | TYR | A | 116 | 7355 | 7957 | 8875 | 299 | −834 | −848 | C |
| ATOM | 974 | CE2 | TYR | A | 116 | 6.399 | 12.197 | 30.066 | 1.00 | 49.41 | C |
| ANISOU | 974 | CE2 | TYR | A | 116 | 5697 | 6176 | 6900 | 269 | −740 | −825 | C |
| ATOM | 975 | CZ | TYR | A | 116 | 5.368 | 11.304 | 29.838 | 1.00 | 62.75 | C |
| ANISOU | 975 | CZ | TYR | A | 116 | 7313 | 7868 | 8660 | 266 | −775 | −850 | C |
| ATOM | 976 | OH | TYR | A | 116 | 5.583 | 9.958 | 29.875 | 1.00 | 69.76 | O |
| ANISOU | 976 | OH | TYR | A | 116 | 8195 | 8778 | 9531 | 230 | −754 | −876 | O |
| ATOM | 977 | N | ALA | A | 117 | 3.335 | 14.933 | 26.568 | 1.00 | 35.15 | N |
| ANISOU | 977 | N | ALA | A | 117 | 3835 | 4293 | 5229 | 411 | −1126 | −725 | N |
| ATOM | 978 | CA | ALA | A | 117 | 2.129 | 14.626 | 25.819 | 1.00 | 36.11 | C |
| ANISOU | 978 | CA | ALA | A | 117 | 3884 | 4413 | 5423 | 431 | −1247 | −728 | C |
| ATOM | 979 | C | ALA | A | 117 | 1.906 | 13.124 | 25.778 | 1.00 | 34.90 | C |
| ANISOU | 979 | C | ALA | A | 117 | 3688 | 4294 | 5278 | 384 | −1256 | −779 | C |
| ATOM | 980 | O | ALA | A | 117 | 2.852 | 12.331 | 25.730 | 1.00 | 35.82 | O |
| ANISOU | 980 | O | ALA | A | 117 | 3873 | 4442 | 5295 | 341 | −1209 | −799 | O |
| ATOM | 981 | CB | ALA | A | 117 | 2.180 | 15.159 | 24.379 | 1.00 | 39.23 | C |
| ANISOU | 981 | CB | ALA | A | 117 | 4360 | 4812 | 5733 | 452 | −1377 | −681 | C |
| ATOM | 982 | N | TYR | A | 118 | 0.644 | 12.736 | 25.780 | 1.00 | 35.83 | N |
| ANISOU | 982 | N | TYR | A | 118 | 3687 | 4399 | 5526 | 393 | −1317 | −799 | N |
| ATOM | 983 | CA | TYR | A | 118 | 0.271 | 11.335 | 25.634 | 1.00 | 35.38 | C |
| ANISOU | 983 | CA | TYR | A | 118 | 3583 | 4363 | 5499 | 346 | −1345 | −848 | C |
| ATOM | 984 | C | TYR | A | 118 | −0.624 | 11.213 | 24.416 | 1.00 | 40.61 | C |
| ANISOU | 984 | C | TYR | A | 118 | 4215 | 5026 | 6189 | 354 | −1522 | −848 | C |
| ATOM | 985 | O | TYR | A | 118 | −1.631 | 11.917 | 24.316 | 1.00 | 39.32 | O |
| ANISOU | 985 | O | TYR | A | 118 | 3963 | 4836 | 6141 | 398 | −1595 | −824 | O |
| ATOM | 986 | CB | TYR | A | 118 | −0.441 | 10.814 | 26.884 | 1.00 | 33.70 | C |
| ANISOU | 986 | CB | TYR | A | 118 | 3240 | 4129 | 5434 | 335 | −1245 | −877 | C |
| ATOM | 987 | CG | TYR | A | 118 | −0.812 | 9.334 | 26.830 | 1.00 | 40.33 | C |
| ANISOU | 987 | CG | TYR | A | 118 | 4027 | 4978 | 6319 | 279 | −1259 | −925 | C |
| ATOM | 988 | CD1 | TYR | A | 118 | 0.146 | 8.367 | 26.548 | 1.00 | 33.00 | C |
| ANISOU | 988 | CD1 | TYR | A | 118 | 3194 | 4076 | 5270 | 232 | −1239 | −951 | C |
| ATOM | 989 | CD2 | TYR | A | 118 | −2.107 | 8.914 | 27.086 | 1.00 | 39.25 | C |
| ANISOU | 989 | CD2 | TYR | A | 118 | 3739 | 4816 | 6357 | 273 | −1286 | −943 | C |
| ATOM | 990 | CE1 | TYR | A | 118 | −0.182 | 7.014 | 26.517 | 1.00 | 35.49 | C |
| ANISOU | 990 | CE1 | TYR | A | 118 | 3466 | 4387 | 5631 | 180 | −1249 | −996 | C |
| ATOM | 991 | CE2 | TYR | A | 118 | −2.444 | 7.562 | 27.063 | 1.00 | 42.85 | C |
| ANISOU | 991 | CE2 | TYR | A | 118 | 4145 | 5270 | 6866 | 214 | −1296 | −986 | C |
| ATOM | 992 | CZ | TYR | A | 118 | −1.470 | 6.617 | 26.786 | 1.00 | 39.21 | C |
| ANISOU | 992 | CZ | TYR | A | 118 | 3792 | 4830 | 6276 | 168 | −1278 | −1013 | C |
| ATOM | 993 | OH | TYR | A | 118 | −1.800 | 5.269 | 26.755 | 1.00 | 39.38 | O |
| ANISOU | 993 | OH | TYR | A | 118 | 3771 | 4838 | 6354 | 109 | −1287 | −1058 | C |
| ATOM | 994 | N | ASP | A | 119 | −0.250 | 10.327 | 23.489 | 1.00 | 34.33 | N |
| ANISOU | 994 | N | ASP | A | 119 | 3498 | 4258 | 5287 | 314 | −1596 | −876 | N |
| ATOM | 995 | CA | ASP | A | 119 | −0.966 | 10.174 | 22.221 | 1.00 | 32.28 | C |
| ANISOU | 995 | CA | ASP | A | 119 | 3244 | 4004 | 5018 | 317 | −1782 | −881 | C |
| ATOM | 996 | C | ASP | A | 119 | −1.193 | 11.525 | 21.547 | 1.00 | 39.08 | C |
| ANISOU | 996 | C | ASP | A | 119 | 4142 | 4854 | 5853 | 380 | −1878 | −816 | C |
| ATOM | 997 | O | ASP | A | 119 | −2.257 | 11.804 | 20.988 | 1.00 | 37.34 | O |
| ANISOU | 997 | O | ASP | A | 119 | 3851 | 4620 | 5718 | 408 | −2025 | −803 | O |
| ATOM | 998 | CB | ASP | A | 119 | −2.281 | 9.416 | 22.414 | 1.00 | 38.56 | C |
| ANISOU | 998 | CB | ASP | A | 119 | 3880 | 4780 | 5993 | 294 | −1851 | −922 | C |
| ATOM | 999 | CG | ASP | A | 119 | −2.049 | 7.944 | 22.714 | 1.00 | 44.38 | C |
| ANISOU | 999 | CG | ASP | A | 119 | 4610 | 5522 | 6730 | 225 | −1794 | −986 | C |
| ATOM | 1000 | OD1 | ASP | A | 119 | −1.013 | 7.410 | 22.263 | 1.00 | 37.54 | O |
| ANISOU | 1000 | OD1 | ASP | A | 119 | 3880 | 4678 | 5704 | 198 | −1769 | −1006 | O |
| ATOM | 1001 | OD2 | ASP | A | 119 | −2.877 | 7.329 | 23.414 | 1.00 | 41.66 | O |
| ANISOU | 1001 | OD2 | ASP | A | 119 | 4125 | 5153 | 6549 | 199 | −1763 | −1013 | O |
| ATOM | 1002 | N | GLY | A | 120 | −0.177 | 12.377 | 21.601 | 1.00 | 39.07 | N |
| ANISOU | 1002 | N | GLY | A | 120 | 4250 | 4855 | 5741 | 402 | −1798 | −771 | N |
| ATOM | 1003 | CA | GLY | A | 120 | −0.205 | 13.610 | 20.854 | 1.00 | 41.72 | C |
| ANISOU | 1003 | CA | GLY | A | 120 | 4651 | 5175 | 6024 | 456 | −1881 | −702 | C |
| ATOM | 1004 | C | GLY | A | 120 | −0.953 | 14.744 | 21.508 | 1.00 | 43.22 | C |
| ANISOU | 1004 | C | GLY | A | 120 | 4738 | 5318 | 6363 | 516 | −1869 | −662 | C |
| ATOM | 1005 | O | GLY | A | 120 | −1.085 | 15.802 | 20.887 | 1.00 | 40.14 | O |
| ANISOU | 1005 | O | GLY | A | 120 | 4396 | 4907 | 5950 | 568 | −1947 | −600 | O |
| ATOM | 1006 | N | LYS | A | 121 | −1.446 | 14.563 | 22.733 | 1.00 | 42.20 | N |
| ANISOU | 1006 | N | LYS | A | 121 | 4477 | 5170 | 6386 | 515 | −1768 | −693 | N |
| ATOM | 1007 | CA | LYS | A | 121 | −2.215 | 15.586 | 23.428 | 1.00 | 43.43 | C |
| ANISOU | 1007 | CA | LYS | A | 121 | 4530 | 5276 | 6696 | 576 | −1739 | −664 | C |
| ATOM | 1008 | C | LYS | A | 121 | −1.492 | 16.004 | 24.699 | 1.00 | 41.41 | C |
| ANISOU | 1008 | C | LYS | A | 121 | 4293 | 5002 | 6440 | 575 | −1551 | −672 | C |
| ATOM | 1009 | O | LYS | A | 121 | −0.935 | 15.161 | 25.409 | 1.00 | 37.87 | O |
| ANISOU | 1009 | O | LYS | A | 121 | 3853 | 4578 | 5959 | 524 | −1442 | −716 | O |

TABLE 11-continued

| | | | | | | | | | | | |
|---|---|---|---|---|---|---|---|---|---|---|---|
| ATOM | 1010 | CB | LYS | A | 121 | -3.620 | 15.097 | 23.782 | 1.00 | 47.19 | C |
| ANISOU | 1010 | CB | LYS | A | 121 | 4820 | 5737 | 7373 | 586 | -1782 | -694 | C |
| ATOM | 1011 | CG | LYS | A | 121 | -4.532 | 16.211 | 24.326 | 1.00 | 61.39 | C |
| ANISOU | 1011 | CG | LYS | A | 121 | 6504 | 7479 | 9342 | 664 | -1766 | -659 | C |
| ATOM | 1012 | CD | LYS | A | 121 | -5.953 | 15.723 | 24.588 | 1.00 | 64.58 | C |
| ANISOU | 1012 | CD | LYS | A | 121 | 6707 | 7867 | 9962 | 674 | -1811 | -682 | C |
| ATOM | 1013 | CE | LYS | A | 121 | -6.788 | 16.791 | 25.285 | 1.00 | 65.55 | C |
| ANISOU | 1013 | CE | LYS | A | 121 | 6712 | 7930 | 10263 | 756 | -1756 | -653 | C |
| ATOM | 1014 | NZ | LYS | A | 121 | -6.995 | 17.982 | 24.418 | 1.00 | 67.18 | N |
| ANISOU | 1014 | NZ | LYS | A | 121 | 6958 | 8105 | 10463 | 831 | -1888 | -586 | N |
| ATOM | 1015 | N | ASP | A | 122 | -1.508 | 17.309 | 24.983 | 1.00 | 40.16 | N |
| ANISOU | 1015 | N | ASP | A | 122 | 4147 | 4794 | 6316 | 632 | -1521 | -630 | N |
| ATOM | 1016 | CA | ASP | A | 122 | -0.916 | 17.831 | 26.210 | 1.00 | 39.29 | C |
| ANISOU | 1016 | CA | ASP | A | 122 | 4059 | 4657 | 6212 | 634 | -1357 | -642 | C |
| ATOM | 1017 | C | ASP | A | 122 | -1.369 | 16.996 | 27.402 | 1.00 | 39.12 | C |
| ANISOU | 1017 | C | ASP | A | 122 | 3930 | 4641 | 6291 | 611 | -1245 | -699 | C |
| ATOM | 1018 | O | ASP | A | 122 | -2.559 | 16.732 | 27.575 | 1.00 | 40.33 | O |
| ANISOU | 1018 | O | ASP | A | 122 | 3946 | 4781 | 6596 | 634 | -1270 | -712 | O |
| ATOM | 1019 | CB | ASP | A | 122 | -1.323 | 19.306 | 26.393 | 1.00 | 38.07 | C |
| ANISOU | 1019 | CB | ASP | A | 122 | 3893 | 4432 | 6139 | 709 | -1355 | -599 | C |
| ATOM | 1020 | CG | ASP | A | 122 | -0.507 | 20.255 | 25.507 | 1.00 | 44.02 | C |
| ANISOU | 1020 | CG | ASP | A | 122 | 4786 | 5168 | 6770 | 722 | -1412 | -537 | C |
| ATOM | 1021 | OD1 | ASP | A | 122 | 0.726 | 20.056 | 25.374 | 1.00 | 50.32 | O |
| ANISOU | 1021 | OD1 | ASP | A | 122 | 5701 | 5997 | 7423 | 669 | -1366 | -536 | O |
| ATOM | 1022 | OD2 | ASP | A | 122 | -1.083 | 21.212 | 24.966 | 1.00 | 55.38 | O |
| ANISOU | 1022 | OD2 | ASP | A | 122 | 6217 | 6559 | 8264 | 785 | -1496 | -484 | O |
| ATOM | 1023 | N | TYR | A | 123 | -0.412 | 16.519 | 28.187 | 1.00 | 37.15 | N |
| ANISOU | 1023 | N | TYR | A | 123 | 3743 | 4415 | 5958 | 563 | -1124 | -730 | N |
| ATOM | 1024 | CA | TYR | A | 123 | -0.734 | 15.760 | 29.389 | 1.00 | 31.55 | C |
| ANISOU | 1024 | CA | TYR | A | 123 | 2956 | 3709 | 5323 | 543 | -1004 | -776 | C |
| ATOM | 1025 | C | TYR | A | 123 | -0.406 | 16.558 | 30.644 | 1.00 | 36.48 | C |
| ANISOU | 1025 | C | TYR | A | 123 | 3610 | 4295 | 5955 | 566 | -865 | -785 | C |
| ATOM | 1026 | O | TYR | A | 123 | -1.293 | 16.836 | 31.453 | 1.00 | 39.27 | O |
| ANISOU | 1026 | O | TYR | A | 123 | 3876 | 4611 | 6435 | 606 | -793 | -800 | O |
| ATOM | 1027 | CB | TYR | A | 123 | 0.005 | 14.404 | 29.391 | 1.00 | 34.47 | C |
| ANISOU | 1027 | CB | TYR | A | 123 | 3368 | 4131 | 5597 | 470 | -979 | -806 | C |
| ATOM | 1028 | CG | TYR | A | 123 | -0.301 | 13.575 | 30.627 | 1.00 | 34.16 | C |
| ANISOU | 1028 | CG | TYR | A | 123 | 3261 | 4093 | 5627 | 447 | -854 | -844 | C |
| ATOM | 1029 | CD1 | TYR | A | 123 | -1.517 | 12.908 | 30.763 | 1.00 | 31.37 | C |
| ANISOU | 1029 | CD1 | TYR | A | 123 | 2770 | 3730 | 5419 | 447 | -861 | -861 | C |
| ATOM | 1030 | CD2 | TYR | A | 123 | 0.610 | 13.499 | 31.670 | 1.00 | 34.40 | C |
| ANISOU | 1030 | CD2 | TYR | A | 123 | 3363 | 4129 | 5579 | 427 | -729 | -858 | C |
| ATOM | 1031 | CE1 | TYR | A | 123 | -1.799 | 12.172 | 31.913 | 1.00 | 34.88 | C |
| ANISOU | 1031 | CE1 | TYR | A | 123 | 3159 | 4169 | 5926 | 426 | -731 | -888 | C |
| ATOM | 1032 | CE2 | TYR | A | 123 | 0.330 | 12.776 | 32.816 | 1.00 | 34.13 | C |
| ANISOU | 1032 | CE2 | TYR | A | 123 | 3282 | 4093 | 5594 | 410 | -612 | -885 | C |
| ATOM | 1033 | CZ | TYR | A | 123 | -0.869 | 12.102 | 32.928 | 1.00 | 32.93 | C |
| ANISOU | 1033 | CZ | TYR | A | 123 | 3001 | 3929 | 5581 | 409 | -606 | -897 | C |
| ATOM | 1034 | OH | TYR | A | 123 | -1.129 | 11.368 | 34.070 | 1.00 | 34.17 | O |
| ANISOU | 1034 | OH | TYR | A | 123 | 3119 | 4080 | 5783 | 391 | -476 | -916 | O |
| ATOM | 1035 | N | ILE | A | 124 | 0.853 | 16.947 | 30.824 | 1.00 | 34.81 | N |
| ANISOU | 1035 | N | ILE | A | 124 | 3523 | 4089 | 5613 | 543 | -824 | -780 | N |
| ATOM | 1036 | CA | ILE | A | 124 | 1.239 | 17.759 | 31.972 | 1.00 | 38.23 | C |
| ANISOU | 1036 | CA | ILE | A | 124 | 4002 | 4483 | 6041 | 560 | -710 | -795 | C |
| ATOM | 1037 | C | ILE | A | 124 | 2.417 | 18.627 | 31.561 | 1.00 | 38.12 | C |
| ANISOU | 1037 | C | ILE | A | 124 | 4113 | 4458 | 5915 | 548 | -737 | -766 | C |
| ATOM | 1038 | O | ILE | A | 124 | 3.256 | 18.228 | 30.743 | 1.00 | 31.93 | O |
| ANISOU | 1038 | O | ILE | A | 124 | 3390 | 3715 | 5027 | 506 | -792 | -746 | O |
| ATOM | 1039 | CB | ILE | A | 124 | 1.558 | 16.891 | 33.215 | 1.00 | 38.65 | C |
| ANISOU | 1039 | CB | ILE | A | 124 | 4059 | 4560 | 6068 | 522 | -587 | -838 | C |
| ATOM | 1040 | CG1 | ILE | A | 124 | 1.409 | 17.730 | 34.497 | 1.00 | 40.07 | C |
| ANISOU | 1040 | CG1 | ILE | A | 124 | 4256 | 4686 | 6281 | 558 | -470 | -864 | C |
| ATOM | 1041 | CG2 | ILE | A | 124 | 2.936 | 16.254 | 33.116 | 1.00 | 27.52 | C |
| ANISOU | 1041 | CG2 | ILE | A | 124 | 2744 | 3199 | 4513 | 459 | -587 | -839 | C |
| ATOM | 1042 | CD1 | ILE | A | 124 | 1.666 | 16.958 | 35.790 | 1.00 | 33.19 | C |
| ANISOU | 1042 | CD1 | ILE | A | 124 | 3404 | 3834 | 5372 | 529 | -347 | -902 | C |
| ATOM | 1043 | N | ALA | A | 125 | 2.454 | 19.835 | 32.107 | 1.00 | 35.04 | N |
| ANISOU | 1043 | N | ALA | A | 125 | 3757 | 4005 | 5552 | 584 | -692 | -765 | N |
| ATOM | 1044 | CA | ALA | A | 125 | 3.497 | 20.781 | 31.770 | 1.00 | 30.78 | C |
| ANISOU | 1044 | CA | ALA | A | 125 | 3326 | 3439 | 4929 | 571 | -712 | -736 | C |
| ATOM | 1045 | C | ALA | A | 125 | 3.840 | 21.603 | 32.996 | 1.00 | 35.62 | C |
| ANISOU | 1045 | C | ALA | A | 125 | 3990 | 3997 | 5548 | 578 | -614 | -770 | C |
| ATOM | 1046 | O | ALA | A | 125 | 2.971 | 21.960 | 33.802 | 1.00 | 34.82 | O |
| ANISOU | 1046 | O | ALA | A | 125 | 3842 | 3851 | 5539 | 627 | -550 | -801 | O |
| ATOM | 1047 | CB | ALA | A | 125 | 3.070 | 21.733 | 30.640 | 1.00 | 35.97 | C |
| ANISOU | 1047 | CB | ALA | A | 125 | 3990 | 4054 | 5624 | 618 | -813 | -677 | C |
| ATOM | 1048 | N | LEU | A | 126 | 5.107 | 21.941 | 33.081 | 1.00 | 34.07 | N |
| ANISOU | 1048 | N | LEU | A | 126 | 3889 | 3799 | 5255 | 531 | -605 | -765 | N |
| ATOM | 1049 | CA | LEU | A | 126 | 5.562 | 22.919 | 34.049 | 1.00 | 40.50 | C |
| ANISOU | 1049 | CA | LEU | A | 126 | 4773 | 4551 | 6066 | 531 | -541 | -795 | C |

TABLE 11-continued

| | | | | | | | | | | | |
|---|---|---|---|---|---|---|---|---|---|---|---|
| ATOM | 1050 | C | LEU | A | 126 | 5.040 | 24.287 | 33.629 | 1.00 | 41.46 | C |
| ANISOU | 1050 | C | LEU | A | 126 | 4906 | 4582 | 6264 | 590 | −572 | −766 | C |
| ATOM | 1051 | O | LEU | A | 126 | 5.070 | 24.629 | 32.443 | 1.00 | 39.37 | O |
| ANISOU | 1051 | O | LEU | A | 126 | 4649 | 4312 | 5998 | 599 | −656 | −705 | O |
| ATOM | 1052 | CB | LEU | A | 126 | 7.088 | 22.887 | 34.087 | 1.00 | 45.83 | C |
| ANISOU | 1052 | CB | LEU | A | 126 | 5532 | 5249 | 6631 | 458 | −544 | −790 | C |
| ATOM | 1053 | CG | LEU | A | 126 | 7.938 | 23.206 | 35.307 | 1.00 | 44.94 | C |
| ANISOU | 1053 | CG | LEU | A | 126 | 5490 | 5114 | 6472 | 420 | −483 | −839 | C |
| ATOM | 1054 | CD1 | LEU | A | 126 | 7.411 | 22.546 | 36.569 | 1.00 | 36.28 | C |
| ANISOU | 1054 | CD1 | LEU | A | 126 | 4371 | 4035 | 5379 | 434 | −402 | −899 | C |
| ATOM | 1055 | CD2 | LEU | A | 126 | 9.362 | 22.737 | 34.981 | 1.00 | 30.94 | C |
| ANISOU | 1055 | CD2 | LEU | A | 126 | 3756 | 3394 | 4605 | 345 | −512 | −817 | C |
| ATOM | 1056 | N | LYS | A | 127 | 4.507 | 25.046 | 34.581 | 1.00 | 41.90 | N |
| ANISOU | 1056 | N | LYS | A | 127 | 4967 | 4566 | 6388 | 636 | −502 | −808 | N |
| ATOM | 1057 | CA | LYS | A | 127 | 4.089 | 26.402 | 34.258 | 1.00 | 39.68 | C |
| ANISOU | 1057 | CA | LYS | A | 127 | 4707 | 4186 | 6185 | 694 | −524 | −782 | C |
| ATOM | 1058 | C | LYS | A | 127 | 5.316 | 27.298 | 34.091 | 1.00 | 39.09 | C |
| ANISOU | 1058 | C | LYS | A | 127 | 4745 | 4063 | 6044 | 646 | −544 | −763 | C |
| ATOM | 1059 | O | LYS | A | 127 | 6.442 | 26.918 | 34.408 | 1.00 | 34.00 | O |
| ANISOU | 1059 | O | LYS | A | 127 | 4155 | 3460 | 5305 | 570 | −531 | −781 | O |
| ATOM | 1060 | CB | LYS | A | 127 | 3.153 | 26.956 | 35.334 | 1.00 | 42.00 | C |
| ANISOU | 1060 | CB | LYS | A | 127 | 4976 | 4407 | 6576 | 763 | −431 | −838 | C |
| ATOM | 1061 | CG | LYS | A | 127 | 1.782 | 26.271 | 35.363 | 1.00 | 39.84 | C |
| ANISOU | 1061 | CG | LYS | A | 127 | 4569 | 4162 | 6407 | 822 | −410 | −843 | C |
| ATOM | 1062 | CD | LYS | A | 127 | 0.826 | 26.990 | 36.305 | 1.00 | 54.46 | C |
| ANISOU | 1062 | CD | LYS | A | 127 | 6394 | 5929 | 8371 | 903 | −308 | −889 | C |
| ATOM | 1063 | CE | LYS | A | 127 | −0.454 | 26.194 | 36.482 | 1.00 | 58.06 | C |
| ANISOU | 1063 | CE | LYS | A | 127 | 6705 | 6417 | 8937 | 950 | −266 | −896 | C |
| ATOM | 1064 | NZ | LYS | A | 127 | −1.474 | 26.939 | 37.274 | 1.00 | 63.24 | N |
| ANISOU | 1064 | NZ | LYS | A | 127 | 7319 | 6986 | 9723 | 1041 | −159 | −933 | N |
| ATOM | 1065 | N | GLU | A | 128 | 5.064 | 28.521 | 33.617 | 1.00 | 40.29 | N |
| ANISOU | 1065 | N | GLU | A | 128 | 4926 | 4121 | 6260 | 691 | −575 | −726 | N |
| ATOM | 1066 | CA | GLU | A | 128 | 6.120 | 29.440 | 33.203 | 1.00 | 40.45 | C |
| ANISOU | 1066 | CA | GLU | A | 128 | 5045 | 4086 | 6240 | 646 | −605 | −688 | C |
| ATOM | 1067 | C | GLU | A | 128 | 7.062 | 29.805 | 34.348 | 1.00 | 44.36 | C |
| ANISOU | 1067 | C | GLU | A | 128 | 5621 | 4544 | 6690 | 588 | −541 | −756 | C |
| ATOM | 1068 | O | GLU | A | 128 | 8.252 | 30.072 | 34.116 | 1.00 | 42.80 | O |
| ANISOU | 1068 | O | GLU | A | 128 | 5488 | 4342 | 6433 | 515 | −563 | −734 | O |
| ATOM | 1069 | CB | GLU | A | 128 | 5.471 | 30.695 | 32.607 | 1.00 | 50.04 | C |
| ANISOU | 1069 | CB | GLU | A | 128 | 6273 | 5191 | 7550 | 720 | −641 | −637 | C |
| ATOM | 1070 | CG | GLU | A | 128 | 6.350 | 31.940 | 32.560 | 1.00 | 60.59 | C |
| ANISOU | 1070 | CG | GLU | A | 128 | 7716 | 6424 | 8883 | 687 | −640 | −616 | C |
| ATOM | 1071 | CD | GLU | A | 128 | 7.294 | 31.952 | 31.377 | 0.19 | 73.77 | C |
| ANISOU | 1071 | CD | GLU | A | 128 | 9430 | 8121 | 10477 | 627 | −705 | −528 | C |
| ATOM | 1072 | OE1 | GLU | A | 128 | 7.044 | 31.196 | 30.413 | 1.00 | 81.88 | O |
| ANISOU | 1072 | OE1 | GLU | A | 128 | 10414 | 9230 | 11466 | 636 | −763 | −474 | O |
| ATOM | 1073 | OE2 | GLU | A | 128 | 8.284 | 32.719 | 31.411 | 1.00 | 76.24 | O |
| ANISOU | 1073 | OE2 | GLU | A | 128 | 9825 | 8371 | 10773 | 571 | −694 | −515 | O |
| ATOM | 1074 | N | ASP | A | 129 | 6.563 | 29.829 | 35.583 | 1.00 | 39.56 | N |
| ANISOU | 1074 | N | ASP | A | 129 | 5012 | 3909 | 6109 | 618 | −463 | −838 | N |
| ATOM | 1075 | CA | ASP | A | 129 | 7.435 | 30.127 | 36.713 | 1.00 | 41.03 | C |
| ANISOU | 1075 | CA | ASP | A | 129 | 5286 | 4064 | 6238 | 562 | −415 | −909 | C |
| ATOM | 1076 | C | ASP | A | 129 | 8.244 | 28.920 | 37.165 | 1.00 | 37.24 | C |
| ANISOU | 1076 | C | ASP | A | 129 | 4803 | 3695 | 5653 | 488 | −409 | −934 | C |
| ATOM | 1077 | O | ASP | A | 129 | 9.009 | 29.030 | 38.129 | 1.00 | 38.38 | O |
| ANISOU | 1077 | O | ASP | A | 129 | 5016 | 3826 | 5739 | 438 | −384 | −992 | O |
| ATOM | 1078 | CB | ASP | A | 129 | 6.626 | 30.690 | 37.890 | 1.00 | 47.56 | C |
| ANISOU | 1078 | CB | ASP | A | 129 | 6140 | 4812 | 7120 | 626 | −327 | −991 | C |
| ATOM | 1079 | CG | ASP | A | 129 | 5.636 | 29.690 | 38.477 | 1.00 | 59.50 | C |
| ANISOU | 1079 | CG | ASP | A | 129 | 7572 | 6390 | 8644 | 674 | −258 | −1026 | C |
| ATOM | 1080 | OD1 | ASP | A | 129 | 5.606 | 28.510 | 38.072 | 1.00 | 59.72 | O |
| ANISOU | 1080 | OD1 | ASP | A | 129 | 7528 | 6525 | 8638 | 651 | −283 | −995 | O |
| ATOM | 1081 | OD2 | ASP | A | 129 | 4.862 | 30.100 | 39.363 | 1.00 | 69.53 | O |
| ANISOU | 1081 | OD2 | ASP | A | 129 | 8854 | 7598 | 9965 | 736 | −171 | −1086 | O |
| ATOM | 1082 | N | LEU | A | 130 | 8.070 | 27.770 | 36.521 | 1.00 | 34.26 | N |
| ANISOU | 1082 | N | LEU | A | 130 | 4348 | 3419 | 5250 | 483 | −436 | −894 | N |
| ATOM | 1083 | CA | LEU | A | 130 | 8.831 | 26.557 | 36.836 | 1.00 | 35.04 | C |
| ANISOU | 1083 | CA | LEU | A | 130 | 4438 | 3620 | 5257 | 419 | −433 | −908 | C |
| ATOM | 1084 | C | LEU | A | 130 | 8.659 | 26.120 | 38.293 | 1.00 | 36.57 | C |
| ANISOU | 1084 | C | LEU | A | 130 | 4654 | 3825 | 5416 | 422 | −357 | −988 | C |
| ATOM | 1085 | O | LEU | A | 130 | 9.503 | 25.391 | 38.842 | 1.00 | 32.58 | O |
| ANISOU | 1085 | O | LEU | A | 130 | 4172 | 3379 | 4827 | 364 | −355 | −1008 | O |
| ATOM | 1086 | CB | LEU | A | 130 | 10.319 | 26.726 | 36.500 | 1.00 | 41.15 | C |
| ANISOU | 1086 | CB | LEU | A | 130 | 5264 | 4404 | 5968 | 334 | −479 | −881 | C |
| ATOM | 1087 | CG | LEU | A | 130 | 10.653 | 27.325 | 35.123 | 1.00 | 41.49 | C |
| ANISOU | 1087 | CG | LEU | A | 130 | 5311 | 4422 | 6032 | 325 | −539 | −798 | C |
| ATOM | 1088 | CD1 | LEU | A | 130 | 12.150 | 27.458 | 34.917 | 1.00 | 41.13 | C |
| ANISOU | 1088 | CD1 | LEU | A | 130 | 5306 | 4385 | 5936 | 237 | −563 | −773 | C |
| ATOM | 1089 | CD2 | LEU | A | 130 | 10.051 | 26.482 | 34.007 | 1.00 | 39.33 | C |
| ANISOU | 1089 | CD2 | LEU | A | 130 | 4968 | 4220 | 5757 | 356 | −574 | −742 | C |

TABLE 11-continued

| | | | | | | | | | | | | |
|---|---|---|---|---|---|---|---|---|---|---|---|---|
| ATOM | 1090 | N | ARG | A | 131 | 7.561 | 26.526 | 38.932 | 1.00 | 35.31 | | N |
| ANISOU | 1090 | N | ARG | A | 131 | 4487 | 3610 | 5320 | 492 | −290 | −1030 | N |
| ATOM | 1091 | CA | ARG | A | 131 | 7.281 | 26.146 | 40.308 | 1.00 | 42.10 | | C |
| ANISOU | 1091 | CA | ARG | A | 131 | 5379 | 4476 | 6141 | 504 | −200 | −1103 | C |
| ATOM | 1092 | C | ARG | A | 131 | 6.007 | 25.334 | 40.477 | 1.00 | 42.89 | | C |
| ANISOU | 1092 | C | ARG | A | 131 | 5386 | 4613 | 6297 | 564 | −133 | −1105 | C |
| ATOM | 1093 | O | ARG | A | 131 | 5.718 | 24.905 | 41.601 | 1.00 | 38.41 | | O |
| ANISOU | 1093 | O | ARG | A | 131 | 4844 | 4057 | 5695 | 575 | −44 | −1157 | O |
| ATOM | 1094 | CB | ARG | A | 131 | 7.199 | 27.400 | 41.190 | 1.00 | 44.57 | | C |
| ANISOU | 1094 | CB | ARG | A | 131 | 5788 | 4677 | 6467 | 531 | −151 | −1168 | C |
| ATOM | 1095 | CG | ARG | A | 131 | 8.520 | 28.113 | 41.218 | 1.00 | 44.57 | | C |
| ANISOU | 1095 | CG | ARG | A | 131 | 5882 | 4640 | 6412 | 457 | −216 | −1177 | C |
| ATOM | 1096 | CD | ARG | A | 131 | 8.579 | 29.358 | 42.081 | 1.00 | 36.94 | | C |
| ANISOU | 1096 | CD | ARG | A | 131 | 5027 | 3556 | 5453 | 470 | −181 | −1250 | C |
| ATOM | 1097 | NE | ARG | A | 131 | 9.995 | 29.687 | 42.096 | 1.00 | 48.54 | | N |
| ANISOU | 1097 | NE | ARG | A | 131 | 6565 | 5017 | 6862 | 376 | −259 | −1252 | N |
| ATOM | 1098 | CZ | ARG | A | 131 | 10.842 | 29.322 | 43.050 | 1.00 | 42.47 | | C |
| ANISOU | 1098 | CZ | ARG | A | 131 | 5864 | 4280 | 5991 | 315 | −270 | −1304 | C |
| ATOM | 1099 | NH1 | ARG | A | 131 | 10.399 | 28.687 | 44.127 | 1.00 | 33.88 | | N |
| ANISOU | 1099 | NH1 | ARG | A | 131 | 4808 | 3228 | 4837 | 342 | −200 | −1361 | N |
| ATOM | 1100 | NH2 | ARG | A | 131 | 12.125 | 29.639 | 42.943 | 0.67 | 41.34 | | N |
| ANISOU | 1100 | NH2 | ARG | A | 131 | 5760 | 4128 | 5818 | 228 | −351 | −1298 | N |
| ATOM | 1101 | N | SER | A | 132 | 5.232 | 25.128 | 39.414 | 1.00 | 39.76 | | N |
| ANISOU | 1101 | N | SER | A | 132 | 4887 | 4234 | 5989 | 601 | −173 | −1050 | N |
| ATOM | 1102 | CA | SER | A | 132 | 3.951 | 24.443 | 39.530 | 1.00 | 36.70 | | C |
| ANISOU | 1102 | CA | SER | A | 132 | 4392 | 3869 | 5682 | 656 | −115 | −1051 | C |
| ATOM | 1103 | C | SER | A | 132 | 3.588 | 23.837 | 38.181 | 1.00 | 39.76 | | C |
| ANISOU | 1103 | C | SER | A | 132 | 4677 | 4310 | 6119 | 656 | −207 | −984 | C |
| ATOM | 1104 | O | SER | A | 132 | 4.206 | 24.139 | 37.156 | 1.00 | 35.37 | | O |
| ANISOU | 1104 | O | SER | A | 132 | 4143 | 3759 | 5538 | 630 | −303 | −937 | O |
| ATOM | 1105 | CB | SER | A | 132 | 2.854 | 25.387 | 40.022 | 1.00 | 37.46 | | C |
| ANISOU | 1105 | CB | SER | A | 132 | 4473 | 3873 | 5888 | 744 | −36 | −1083 | C |
| ATOM | 1106 | OG | SER | A | 132 | 2.638 | 26.429 | 39.089 | 1.00 | 45.84 | | O |
| ANISOU | 1106 | OG | SER | A | 132 | 5520 | 4867 | 7029 | 783 | −108 | −1042 | O |
| ATOM | 1107 | N | TRP | A | 133 | 2.562 | 22.978 | 38.200 | 1.00 | 37.54 | | N |
| ANISOU | 1107 | N | TRP | A | 133 | 4289 | 4066 | 5911 | 685 | −174 | −982 | N |
| ATOM | 1108 | CA | TRP | A | 133 | 2.211 | 22.109 | 37.083 | 1.00 | 33.05 | | C |
| ANISOU | 1108 | CA | TRP | A | 133 | 3624 | 3558 | 5375 | 672 | −260 | −934 | C |
| ATOM | 1109 | C | TRP | A | 133 | 0.824 | 22.443 | 36.564 | 1.00 | 41.27 | | C |
| ANISOU | 1109 | C | TRP | A | 133 | 4549 | 4562 | 6571 | 748 | −281 | −911 | C |
| ATOM | 1110 | O | TRP | A | 133 | −0.082 | 22.755 | 37.343 | 1.00 | 42.62 | | O |
| ANISOU | 1110 | O | TRP | A | 133 | 4671 | 4685 | 6836 | 806 | −186 | −942 | O |
| ATOM | 1111 | CB | TRP | A | 133 | 2.236 | 20.619 | 37.498 | 1.00 | 35.27 | | C |
| ANISOU | 1111 | CB | TRP | A | 133 | 3867 | 3917 | 5616 | 627 | −218 | −949 | C |
| ATOM | 1112 | CG | TRP | A | 133 | 3.579 | 20.192 | 37.986 | 1.00 | 35.16 | | C |
| ANISOU | 1112 | CG | TRP | A | 133 | 3955 | 3944 | 5459 | 559 | −208 | −964 | C |
| ATOM | 1113 | CD1 | TRP | A | 133 | 4.002 | 20.152 | 39.276 | 1.00 | 34.72 | | C |
| ANISOU | 1113 | CD1 | TRP | A | 133 | 3974 | 3882 | 5335 | 544 | −118 | −1008 | C |
| ATOM | 1114 | CD2 | TRP | A | 133 | 4.684 | 19.768 | 37.182 | 1.00 | 34.54 | | C |
| ANISOU | 1114 | CD2 | TRP | A | 133 | 3915 | 3918 | 5291 | 499 | −294 | −932 | C |
| ATOM | 1115 | NE1 | TRP | A | 133 | 5.310 | 19.726 | 39.332 | 1.00 | 36.41 | | N |
| ANISOU | 1115 | NE1 | TRP | A | 133 | 4261 | 4141 | 5431 | 479 | −154 | −1004 | N |
| ATOM | 1116 | CE2 | TRP | A | 133 | 5.749 | 19.483 | 38.055 | 1.00 | 30.34 | | C |
| ANISOU | 1116 | CE2 | TRP | A | 133 | 3466 | 3407 | 4653 | 451 | −255 | −958 | C |
| ATOM | 1117 | CE3 | TRP | A | 133 | 4.871 | 19.600 | 35.804 | 1.00 | 33.83 | | C |
| ANISOU | 1117 | CE3 | TRP | A | 133 | 3801 | 3856 | 5197 | 485 | −398 | −885 | C |
| ATOM | 1118 | CZ2 | TRP | A | 133 | 6.988 | 19.030 | 37.603 | 1.00 | 30.05 | | C |
| ANISOU | 1118 | CZ2 | TRP | A | 133 | 3470 | 3419 | 4526 | 391 | −311 | −935 | C |
| ATOM | 1119 | CZ3 | TRP | A | 133 | 6.095 | 19.158 | 35.352 | 1.00 | 30.98 | | C |
| ANISOU | 1119 | CZ3 | TRP | A | 133 | 3494 | 3543 | 4735 | 426 | −440 | −866 | C |
| ATOM | 1120 | CH2 | TRP | A | 133 | 7.146 | 18.879 | 36.252 | 1.00 | 32.86 | | C |
| ANISOU | 1120 | CH2 | TRP | A | 133 | 3797 | 3800 | 4887 | 381 | −395 | −890 | C |
| ATOM | 1121 | N | THR | A | 134 | 0.659 | 22.342 | 35.250 | 1.00 | 35.86 | | N |
| ANISOU | 1121 | N | THR | A | 134 | 3816 | 3899 | 5909 | 749 | −405 | −858 | N |
| ATOM | 1122 | CA | THR | A | 134 | −0.654 | 22.385 | 34.616 | 1.00 | 44.90 | | C |
| ANISOU | 1122 | CA | THR | A | 134 | 4832 | 5027 | 7202 | 810 | −458 | −830 | C |
| ATOM | 1123 | C | THR | A | 134 | −1.085 | 20.959 | 34.336 | 1.00 | 49.99 | | C |
| ANISOU | 1123 | C | THR | A | 134 | 5382 | 5747 | 7865 | 773 | −485 | −831 | C |
| ATOM | 1124 | O | THR | A | 134 | −0.411 | 20.256 | 33.571 | 1.00 | 49.24 | | O |
| ANISOU | 1124 | O | THR | A | 134 | 5321 | 5711 | 7675 | 715 | −566 | −812 | O |
| ATOM | 1125 | CB | THR | A | 134 | −0.632 | 23.164 | 33.303 | 1.00 | 52.57 | | C |
| ANISOU | 1125 | CB | THR | A | 134 | 5819 | 5973 | 8182 | 837 | −596 | −768 | C |
| ATOM | 1126 | OG1 | THR | A | 134 | −0.095 | 24.465 | 33.524 | 1.00 | 57.77 | | O |
| ANISOU | 1126 | OG1 | THR | A | 134 | 6578 | 6555 | 8817 | 860 | −573 | −763 | O |
| ATOM | 1127 | CG2 | THR | A | 134 | −2.053 | 23.279 | 32.732 | 1.00 | 53.77 | | C |
| ANISOU | 1127 | CG2 | THR | A | 134 | 5830 | 6101 | 8499 | 909 | −661 | −738 | C |
| ATOM | 1128 | N | ALA | A | 135 | −2.214 | 20.553 | 34.933 | 1.00 | 47.31 | | N |
| ANISOU | 1128 | N | ALA | A | 135 | 4922 | 5397 | 7655 | 807 | −411 | −852 | N |
| ATOM | 1129 | CA | ALA | A | 135 | −2.782 | 19.212 | 34.796 | 1.00 | 56.51 | | C |
| ANISOU | 1129 | CA | ALA | A | 135 | 5982 | 6619 | 8872 | 771 | −421 | −857 | C |

TABLE 11-continued

| | | | | | | | | | | | |
|---|---|---|---|---|---|---|---|---|---|---|---|
| ATOM | 1130 | C | ALA | A | 135 | −4.240 | 19.359 | 34.382 | 1.00 | 56.87 | C |
| ANISOU | 1130 | C | ALA | A | 135 | 5862 | 6633 | 9112 | 832 | −464 | −838 | C |
| ATOM | 1131 | O | ALA | A | 135 | −5.075 | 19.780 | 35.186 | 1.00 | 65.96 | O |
| ANISOU | 1131 | O | ALA | A | 135 | 6939 | 7735 | 10388 | 890 | −355 | −855 | O |
| ATOM | 1132 | CB | ALA | A | 135 | −2.671 | 18.419 | 36.099 | 1.00 | 58.09 | C |
| ANISOU | 1132 | CB | ALA | A | 135 | 6192 | 6837 | 9044 | 739 | −266 | −900 | C |
| ATOM | 1133 | N | ALA | A | 136 | −4.552 | 18.984 | 33.142 | 1.00 | 56.00 | N |
| ANISOU | 1133 | N | ALA | A | 136 | 5693 | 6554 | 9031 | 820 | −623 | −804 | N |
| ATOM | 1134 | CA | ALA | A | 136 | −5.877 | 19.235 | 32.587 | 1.00 | 57.64 | C |
| ANISOU | 1134 | CA | ALA | A | 136 | 5744 | 6731 | 9425 | 881 | −704 | −778 | C |
| ATOM | 1135 | C | ALA | A | 136 | −6.886 | 18.139 | 32.895 | 1.00 | 50.79 | C |
| ANISOU | 1135 | C | ALA | A | 136 | 4714 | 5884 | 8701 | 860 | −667 | −798 | C |
| ATOM | 1136 | O | ALA | A | 136 | −8.080 | 18.431 | 32.978 | 1.00 | 57.12 | O |
| ANISOU | 1136 | O | ALA | A | 136 | 5363 | 6646 | 9695 | 919 | −661 | −788 | O |
| ATOM | 1137 | CB | ALA | A | 136 | −5.794 | 19.428 | 31.070 | 1.00 | 59.80 | C |
| ANISOU | 1137 | CB | ALA | A | 136 | 6039 | 7024 | 9660 | 882 | −910 | −730 | C |
| ATOM | 1138 | N | ASP | A | 137 | −6.479 | 16.890 | 33.066 | 1.00 | 42.22 | N |
| ANISOU | 1138 | N | ASP | A | 137 | 3646 | 4852 | 7542 | 779 | −641 | −823 | N |
| ATOM | 1139 | CA | ASP | A | 137 | −7.502 | 15.892 | 33.374 | 1.00 | 52.08 | C |
| ANISOU | 1139 | CA | ASP | A | 137 | 4733 | 6108 | 8948 | 757 | −600 | −837 | C |
| ATOM | 1140 | C | ASP | A | 137 | −7.175 | 15.192 | 34.692 | 1.00 | 48.03 | C |
| ANISOU | 1140 | C | ASP | A | 137 | 4256 | 5603 | 8390 | 718 | −406 | −871 | C |
| ATOM | 1141 | O | ASP | A | 137 | −6.203 | 15.528 | 35.373 | 1.00 | 36.75 | O |
| ANISOU | 1141 | O | ASP | A | 137 | 2974 | 4176 | 6814 | 713 | −315 | −885 | O |
| ATOM | 1142 | CB | ASP | A | 137 | −7.680 | 14.909 | 32.206 | 1.00 | 44.93 | C |
| ANISOU | 1142 | CB | ASP | A | 137 | 3776 | 5246 | 8048 | 698 | −774 | −831 | C |
| ATOM | 1143 | CG | ASP | A | 137 | −6.437 | 14.069 | 31.915 | 1.00 | 44.52 | C |
| ANISOU | 1143 | CG | ASP | A | 137 | 3873 | 5250 | 7794 | 618 | −800 | −848 | C |
| ATOM | 1144 | OD1 | ASP | A | 137 | −5.431 | 14.137 | 32.660 | 1.00 | 41.59 | O |
| ANISOU | 1144 | OD1 | ASP | A | 137 | 3630 | 4887 | 7286 | 601 | −686 | −861 | O |
| ATOM | 1145 | OD2 | ASP | A | 137 | −6.479 | 13.310 | 30.912 | 1.00 | 41.84 | O |
| ANISOU | 1145 | OD2 | ASP | A | 137 | 3520 | 4942 | 7436 | 572 | −942 | −850 | O |
| ATOM | 1146 | N | MET | A | 138 | −8.001 | 14.205 | 35.043 | 1.00 | 42.20 | N |
| ANISOU | 1146 | N | MET | A | 138 | 3383 | 4867 | 7783 | 687 | −348 | −880 | N |
| ATOM | 1147 | CA | MET | A | 138 | −7.818 | 13.502 | 36.313 | 1.00 | 45.00 | C |
| ANISOU | 1147 | CA | MET | A | 138 | 3767 | 5225 | 8107 | 654 | −156 | −903 | C |
| ATOM | 1148 | C | MET | A | 138 | −6.506 | 12.731 | 36.347 | 1.00 | 44.94 | C |
| ANISOU | 1148 | C | MET | A | 138 | 3917 | 5267 | 7892 | 581 | −165 | −914 | C |
| ATOM | 1149 | O | MET | A | 138 | −5.783 | 12.765 | 37.354 | 1.00 | 43.24 | O |
| ANISOU | 1149 | O | MET | A | 138 | 3818 | 5053 | 7557 | 576 | −35 | −928 | O |
| ATOM | 1150 | CB | MET | A | 138 | −9.015 | 12.574 | 36.578 | 1.00 | 43.65 | C |
| ANISOU | 1150 | CB | MET | A | 138 | 3409 | 5040 | 8135 | 631 | −97 | −901 | C |
| ATOM | 1151 | CG | MET | A | 138 | −10.223 | 13.310 | 37.127 | 1.00 | 58.56 | C |
| ANISOU | 1151 | CG | MET | A | 138 | 5149 | 6872 | 10227 | 711 | 9 | −893 | C |
| ATOM | 1152 | SD | MET | A | 138 | −11.734 | 12.317 | 37.077 | 1.00 | 77.57 | S |
| ANISOU | 1152 | SD | MET | A | 138 | 7303 | 9262 | 12909 | 679 | 28 | −880 | S |
| ATOM | 1153 | CE | MET | A | 138 | −11.227 | 10.827 | 37.936 | 1.00 | 76.26 | C |
| ANISOU | 1153 | CE | MET | A | 138 | 7197 | 9120 | 12657 | 584 | 171 | −895 | C |
| ATOM | 1154 | N | ALA | A | 139 | −6.166 | 12.032 | 35.264 | 1.00 | 44.24 | N |
| ANISOU | 1154 | N | ALA | A | 139 | 3840 | 5216 | 7755 | 527 | −319 | −911 | N |
| ATOM | 1155 | CA | ALA | A | 139 | −4.888 | 11.330 | 35.240 | 1.00 | 45.12 | C |
| ANISOU | 1155 | CA | ALA | A | 139 | 4096 | 5370 | 7678 | 466 | −326 | −921 | C |
| ATOM | 1156 | C | ALA | A | 139 | −3.739 | 12.284 | 35.554 | 1.00 | 43.37 | C |
| ANISOU | 1156 | C | ALA | A | 139 | 4035 | 5153 | 7292 | 491 | −297 | −919 | C |
| ATOM | 1157 | O | ALA | A | 139 | −2.919 | 12.027 | 36.444 | 1.00 | 41.26 | O |
| ANISOU | 1157 | O | ALA | A | 139 | 3870 | 4898 | 6910 | 469 | −194 | −930 | O |
| ATOM | 1158 | CB | ALA | A | 139 | −4.686 | 10.660 | 33.882 | 1.00 | 43.89 | C |
| ANISOU | 1158 | CB | ALA | A | 139 | 3941 | 5247 | 7489 | 419 | −503 | −921 | C |
| ATOM | 1159 | N | ALA | A | 140 | −3.681 | 13.414 | 34.847 | 1.00 | 40.41 | N |
| ANISOU | 1159 | N | ALA | A | 140 | 3684 | 4764 | 6907 | 537 | −393 | −904 | N |
| ATOM | 1160 | CA | ALA | A | 140 | −2.588 | 14.353 | 35.077 | 1.00 | 41.72 | C |
| ANISOU | 1160 | CA | ALA | A | 140 | 3996 | 4925 | 6929 | 554 | −374 | −902 | C |
| ATOM | 1161 | C | ALA | A | 140 | −2.636 | 14.929 | 36.492 | 1.00 | 39.56 | C |
| ANISOU | 1161 | C | ALA | A | 140 | 3756 | 4614 | 6660 | 589 | −207 | −922 | C |
| ATOM | 1162 | O | ALA | A | 140 | −1.593 | 15.279 | 37.054 | 1.00 | 38.18 | O |
| ANISOU | 1162 | O | ALA | A | 140 | 3714 | 4444 | 6350 | 577 | −161 | −934 | O |
| ATOM | 1163 | CB | ALA | A | 140 | −2.639 | 15.471 | 34.032 | 1.00 | 40.60 | C |
| ANISOU | 1163 | CB | ALA | A | 140 | 3867 | 4764 | 6796 | 598 | −503 | −873 | C |
| ATOM | 1164 | N | GLN | A | 141 | −3.832 | 15.038 | 37.078 | 1.00 | 39.34 | N |
| ANISOU | 1164 | N | GLN | A | 141 | 3612 | 4549 | 6788 | 632 | −117 | −929 | N |
| ATOM | 1165 | CA | GLN | A | 141 | −3.941 | 15.491 | 38.462 | 1.00 | 38.94 | C |
| ANISOU | 1165 | CA | GLN | A | 141 | 3602 | 4462 | 6734 | 668 | 59 | −953 | C |
| ATOM | 1166 | C | GLN | A | 141 | −3.263 | 14.506 | 39.407 | 1.00 | 42.81 | C |
| ANISOU | 1166 | C | GLN | A | 141 | 4175 | 4985 | 7107 | 612 | 162 | −969 | C |
| ATOM | 1167 | O | GLN | A | 141 | −2.572 | 14.910 | 40.351 | 1.00 | 38.59 | O |
| ANISOU | 1167 | O | GLN | A | 141 | 3766 | 4441 | 6456 | 618 | 250 | −990 | O |
| ATOM | 1168 | CB | GLN | A | 141 | −5.415 | 15.685 | 38.830 | 1.00 | 38.43 | C |
| ANISOU | 1168 | CB | GLN | A | 141 | 3379 | 4350 | 6873 | 727 | 147 | −954 | C |
| ATOM | 1169 | CG | GLN | A | 141 | −5.639 | 16.656 | 39.944 | 1.00 | 64.51 | C |
| ANISOU | 1169 | CG | GLN | A | 141 | 6729 | 7596 | 10187 | 793 | 302 | −979 | C |

TABLE 11-continued

| | | | | | | | | | | | |
|---|---|---|---|---|---|---|---|---|---|---|---|
| ATOM | 1170 | CD | GLN | A | 141 | −5.354 | 18.072 | 39.509 | 1.00 | 81.28 | C |
| ANISOU | 1170 | CD | GLN | A | 141 | 8916 | 9677 | 12291 | 849 | 229 | −979 | C |
| ATOM | 1171 | OE1 | GLN | A | 141 | −5.656 | 18.454 | 38.377 | 1.00 | 90.87 | O |
| ANISOU | 1171 | OE1 | GLN | A | 141 | 10062 | 10885 | 13579 | 869 | 84 | −948 | O |
| ATOM | 1172 | NE2 | GLN | A | 141 | −4.758 | 18.859 | 40.398 | 1.00 | 83.15 | N |
| ANISOU | 1172 | NE2 | GLN | A | 141 | 9291 | 9879 | 12425 | 872 | 323 | −1012 | N |
| ATOM | 1173 | N | THR | A | 142 | −3.422 | 13.203 | 39.151 | 1.00 | 35.94 | N |
| ANISOU | 1173 | N | THR | A | 142 | 3243 | 4151 | 6264 | 556 | 143 | −958 | N |
| ATOM | 1174 | CA | THR | A | 142 | −2.700 | 12.199 | 39.929 | 1.00 | 36.73 | C |
| ANISOU | 1174 | CA | THR | A | 142 | 3427 | 4281 | 6249 | 503 | 222 | −963 | C |
| ATOM | 1175 | C | THR | A | 142 | −1.186 | 12.344 | 39.772 | 1.00 | 37.28 | C |
| ANISOU | 1175 | C | THR | A | 142 | 3651 | 4384 | 6129 | 472 | 153 | −965 | C |
| ATOM | 1176 | O | THR | A | 142 | −0.438 | 12.320 | 40.762 | 1.00 | 35.99 | O |
| ANISOU | 1176 | O | THR | A | 142 | 3601 | 4226 | 5845 | 463 | 235 | −976 | O |
| ATOM | 1177 | CB | THR | A | 142 | −3.150 | 10.806 | 39.507 | 1.00 | 39.36 | C |
| ANISOU | 1177 | CB | THR | A | 142 | 3661 | 4635 | 6659 | 448 | 196 | −950 | C |
| ATOM | 1178 | OG1 | THR | A | 142 | −4.533 | 10.653 | 39.825 | 1.00 | 46.32 | O |
| ANISOU | 1178 | OG1 | THR | A | 142 | 4392 | 5481 | 7728 | 471 | 281 | −946 | O |
| ATOM | 1179 | CG2 | THR | A | 142 | −2.350 | 9.767 | 40.249 | 1.00 | 39.57 | C |
| ANISOU | 1179 | CG2 | THR | A | 142 | 3782 | 4687 | 6567 | 397 | 269 | −947 | C |
| ATOM | 1180 | N | THR | A | 143 | −0.714 | 12.491 | 38.531 | 1.00 | 38.85 | N |
| ANISOU | 1180 | N | THR | A | 143 | 3857 | 4606 | 6298 | 456 | 2 | −953 | N |
| ATOM | 1181 | CA | THR | A | 143 | 0.696 | 12.797 | 38.301 | 1.00 | 32.48 | C |
| ANISOU | 1181 | CA | THR | A | 143 | 3182 | 3825 | 5333 | 432 | −60 | −951 | C |
| ATOM | 1182 | C | THR | A | 143 | 1.123 | 14.062 | 39.041 | 1.00 | 32.14 | C |
| ANISOU | 1182 | C | THR | A | 143 | 3232 | 3749 | 5230 | 469 | −8 | −967 | C |
| ATOM | 1183 | O | THR | A | 143 | 2.219 | 14.124 | 39.621 | 1.00 | 33.84 | O |
| ANISOU | 1183 | O | THR | A | 143 | 3562 | 3980 | 5318 | 444 | 13 | −976 | O |
| ATOM | 1184 | CB | THR | A | 143 | 0.947 | 12.988 | 36.804 | 1.00 | 37.24 | C |
| ANISOU | 1184 | CB | THR | A | 143 | 3773 | 4446 | 5929 | 423 | −215 | −932 | C |
| ATOM | 1185 | OG1 | THR | A | 143 | 0.616 | 11.782 | 36.108 | 1.00 | 34.04 | O |
| ANISOU | 1185 | OG1 | THR | A | 143 | 3300 | 4070 | 5566 | 384 | −271 | −928 | O |
| ATOM | 1186 | CG2 | THR | A | 143 | 2.412 | 13.375 | 36.552 | 1.00 | 29.78 | C |
| ANISOU | 1186 | CG2 | THR | A | 143 | 2955 | 3524 | 4834 | 398 | −263 | −925 | C |
| ATOM | 1187 | N | LYS | A | 144 | 0.301 | 15.104 | 38.968 | 1.00 | 31.75 | N |
| ANISOU | 1187 | N | LYS | A | 144 | 3134 | 3651 | 5278 | 527 | 1 | −971 | N |
| ATOM | 1188 | CA | LYS | A | 144 | 0.653 | 16.374 | 39.592 | 1.00 | 31.38 | C |
| ANISOU | 1188 | CA | LYS | A | 144 | 3180 | 3559 | 5185 | 564 | 45 | −992 | C |
| ATOM | 1189 | C | LYS | A | 144 | 0.879 | 16.210 | 41.089 | 1.00 | 34.15 | C |
| ANISOU | 1189 | C | LYS | A | 144 | 3611 | 3901 | 5462 | 562 | 185 | −1025 | C |
| ATOM | 1190 | O | LYS | A | 144 | 1.872 | 16.704 | 41.637 | 1.00 | 32.71 | O |
| ANISOU | 1190 | O | LYS | A | 144 | 3555 | 3715 | 5159 | 547 | 190 | −1045 | O |
| ATOM | 1191 | CB | LYS | A | 144 | −0.447 | 17.399 | 39.314 | 1.00 | 29.10 | C |
| ANISOU | 1191 | CB | LYS | A | 144 | 2809 | 3209 | 5037 | 636 | 46 | −991 | C |
| ATOM | 1192 | CG | LYS | A | 144 | −0.188 | 18.776 | 39.886 | 1.00 | 34.56 | C |
| ANISOU | 1192 | CG | LYS | A | 144 | 3594 | 3839 | 5699 | 680 | 91 | −1017 | C |
| ATOM | 1193 | CD | LYS | A | 144 | −1.297 | 19.736 | 39.415 | 1.00 | 36.52 | C |
| ANISOU | 1193 | CD | LYS | A | 144 | 3748 | 4023 | 6103 | 759 | 75 | −1006 | C |
| ATOM | 1194 | CE | LYS | A | 144 | −1.082 | 21.137 | 39.935 | 1.00 | 47.80 | C |
| ANISOU | 1194 | CE | LYS | A | 144 | 5271 | 5375 | 7515 | 806 | 120 | −1034 | C |
| ATOM | 1195 | NZ | LYS | A | 144 | −1.805 | 21.312 | 41.199 | 1.00 | 55.72 | N |
| ANISOU | 1195 | NZ | LYS | A | 144 | 6271 | 6334 | 8566 | 856 | 288 | −1079 | N |
| ATOM | 1196 | N | HIS | A | 145 | −0.041 | 15.527 | 41.776 | 1.00 | 36.45 | N |
| ANISOU | 1196 | N | HIS | A | 145 | 3834 | 4189 | 5827 | 575 | 300 | −1030 | N |
| ATOM | 1197 | CA | HIS | A | 145 | 0.117 | 15.333 | 43.212 | 1.00 | 37.41 | C |
| ANISOU | 1197 | CA | HIS | A | 145 | 4044 | 4302 | 5866 | 577 | 441 | −1056 | C |
| ATOM | 1198 | C | HIS | A | 145 | 1.363 | 14.514 | 43.517 | 1.00 | 36.11 | C |
| ANISOU | 1198 | C | HIS | A | 145 | 3984 | 4190 | 5546 | 513 | 410 | −1048 | C |
| ATOM | 1199 | O | HIS | A | 145 | 2.091 | 14.811 | 44.472 | 1.00 | 34.68 | O |
| ANISOU | 1199 | O | HIS | A | 145 | 3933 | 4005 | 5239 | 509 | 454 | −1072 | O |
| ATOM | 1200 | CB | HIS | A | 145 | −1.128 | 14.666 | 43.796 | 1.00 | 45.41 | C |
| ANISOU | 1200 | CB | HIS | A | 145 | 4956 | 5301 | 6996 | 599 | 579 | −1051 | C |
| ATOM | 1201 | CG | HIS | A | 145 | −2.358 | 15.513 | 43.713 | 1.00 | 62.90 | C |
| ANISOU | 1201 | CG | HIS | A | 145 | 7067 | 7459 | 9373 | 670 | 633 | −1061 | C |
| ATOM | 1202 | ND1 | HIS | A | 145 | −3.622 | 14.979 | 43.578 | 1.00 | 67.98 | N |
| ANISOU | 1202 | ND1 | HIS | A | 145 | 7547 | 8091 | 10190 | 688 | 692 | −1042 | N |
| ATOM | 1203 | CD2 | HIS | A | 145 | −2.518 | 16.858 | 43.743 | 1.00 | 69.27 | C |
| ANISOU | 1203 | CD2 | HIS | A | 145 | 7902 | 8211 | 10205 | 731 | 638 | −1086 | C |
| ATOM | 1204 | CE1 | HIS | A | 145 | −4.508 | 15.958 | 43.531 | 1.00 | 70.93 | C |
| ANISOU | 1204 | CE1 | HIS | A | 145 | 7848 | 8410 | 10694 | 760 | 730 | −1053 | C |
| ATOM | 1205 | NE2 | HIS | A | 145 | −3.864 | 17.108 | 43.627 | 1.00 | 72.40 | N |
| ANISOU | 1205 | NE2 | HIS | A | 145 | 8152 | 8566 | 10790 | 790 | 700 | −1080 | N |
| ATOM | 1206 | N | LYS | A | 146 | 1.632 | 13.485 | 42.711 | 1.00 | 29.77 | N |
| ANISOU | 1206 | N | LYS | A | 146 | 3127 | 3434 | 4751 | 466 | 329 | −1017 | N |
| ATOM | 1207 | CA | LYS | A | 146 | 2.850 | 12.700 | 42.894 | 1.00 | 28.40 | C |
| ANISOU | 1207 | CA | LYS | A | 146 | 3041 | 3307 | 4444 | 413 | 292 | −1005 | C |
| ATOM | 1208 | C | LYS | A | 146 | 4.096 | 13.568 | 42.746 | 1.00 | 35.21 | C |
| ANISOU | 1208 | C | LYS | A | 146 | 4007 | 4174 | 5196 | 400 | 207 | −1015 | C |
| ATOM | 1209 | O | LYS | A | 146 | 5.011 | 13.496 | 43.572 | 1.00 | 35.41 | O |
| ANISOU | 1209 | O | LYS | A | 146 | 4140 | 4213 | 5101 | 380 | 223 | −1025 | O |

TABLE 11-continued

| | | | | | | | | | | | |
|---|---|---|---|---|---|---|---|---|---|---|---|
| ATOM | 1210 | CB | LYS | A | 146 | 2.883 | 11.535 | 41.893 | 1.00 | 31.91 | C |
| ANISOU | 1210 | CB | LYS | A | 146 | 3406 | 3790 | 4930 | 371 | 215 | −975 | C |
| ATOM | 1211 | CG | LYS | A | 146 | 4.175 | 10.714 | 41.894 | 1.00 | 34.42 | C |
| ANISOU | 1211 | CG | LYS | A | 146 | 3798 | 4151 | 5127 | 323 | 167 | −959 | C |
| ATOM | 1212 | CD | LYS | A | 146 | 4.132 | 9.568 | 40.865 | 1.00 | 41.38 | C |
| ANISOU | 1212 | CD | LYS | A | 146 | 4607 | 5061 | 6056 | 287 | 100 | −938 | C |
| ATOM | 1213 | CE | LYS | A | 146 | 5.453 | 8.802 | 40.803 | 1.00 | 35.49 | C |
| ANISOU | 1213 | CE | LYS | A | 146 | 3932 | 4353 | 5201 | 249 | 56 | −922 | C |
| ATOM | 1214 | NZ | LYS | A | 146 | 5.563 | 7.900 | 39.606 | 1.00 | 33.98 | N |
| ANISOU | 1214 | NZ | LYS | A | 146 | 3687 | 4182 | 5042 | 220 | −23 | −911 | N |
| ATOM | 1215 | N | TRP | A | 147 | 4.133 | 14.422 | 41.716 | 1.00 | 34.49 | N |
| ANISOU | 1215 | N | TRP | A | 147 | 3888 | 4069 | 5148 | 412 | 114 | −1012 | N |
| ATOM | 1216 | CA | TRP | A | 147 | 5.315 | 15.232 | 41.445 | 1.00 | 30.83 | C |
| ANISOU | 1216 | CA | TRP | A | 147 | 3510 | 3605 | 4598 | 392 | 33 | −1014 | C |
| ATOM | 1217 | C | TRP | A | 147 | 5.429 | 16.428 | 42.388 | 1.00 | 31.29 | C |
| ANISOU | 1217 | C | TRP | A | 147 | 3660 | 3611 | 4618 | 419 | 84 | −1054 | C |
| ATOM | 1218 | O | TRP | A | 147 | 6.536 | 16.936 | 42.616 | 1.00 | 34.14 | O |
| ANISOU | 1218 | O | TRP | A | 147 | 4113 | 3970 | 4888 | 391 | 38 | −1065 | O |
| ATOM | 1219 | CB | TRP | A | 147 | 5.305 | 15.699 | 39.989 | 1.00 | 37.08 | C |
| ANISOU | 1219 | CB | TRP | A | 147 | 4250 | 4395 | 5445 | 394 | −76 | −988 | C |
| ATOM | 1220 | CG | TRP | A | 147 | 5.541 | 14.599 | 39.006 | 1.00 | 35.96 | C |
| ANISOU | 1220 | CG | TRP | A | 147 | 4055 | 4305 | 5301 | 358 | −144 | −957 | C |
| ATOM | 1221 | CD1 | TRP | A | 147 | 5.685 | 13.276 | 39.286 | 1.00 | 34.71 | C |
| ANISOU | 1221 | CD1 | TRP | A | 147 | 3884 | 4187 | 5119 | 328 | −115 | −952 | C |
| ATOM | 1222 | CD2 | TRP | A | 147 | 5.654 | 14.723 | 37.578 | 1.00 | 28.94 | C |
| ANISOU | 1222 | CD2 | TRP | A | 147 | 3134 | 3430 | 4433 | 352 | −248 | −930 | C |
| ATOM | 1223 | NE1 | TRP | A | 147 | 5.899 | 12.569 | 38.131 | 1.00 | 32.56 | N |
| ANISOU | 1223 | NE1 | TRP | A | 147 | 3571 | 3947 | 4852 | 302 | −194 | −930 | N |
| ATOM | 1224 | CE2 | TRP | A | 147 | 5.861 | 13.429 | 37.066 | 1.00 | 28.50 | C |
| ANISOU | 1224 | CE2 | TRP | A | 147 | 3048 | 3421 | 4360 | 317 | −276 | −917 | C |
| ATOM | 1225 | CE3 | TRP | A | 147 | 5.580 | 15.798 | 36.688 | 1.00 | 30.28 | C |
| ANISOU | 1225 | CE3 | TRP | A | 147 | 3305 | 3571 | 4629 | 374 | −319 | −912 | C |
| ATOM | 1226 | CZ2 | TRP | A | 147 | 6.007 | 13.176 | 35.698 | 1.00 | 31.19 | C |
| ANISOU | 1226 | CZ2 | TRP | A | 147 | 3368 | 3785 | 4699 | 304 | −370 | −895 | C |
| ATOM | 1227 | CZ3 | TRP | A | 147 | 5.715 | 15.542 | 35.331 | 1.00 | 35.95 | C |
| ANISOU | 1227 | CZ3 | TRP | A | 147 | 4002 | 4315 | 5343 | 361 | −414 | −882 | C |
| ATOM | 1228 | CH2 | TRP | A | 147 | 5.933 | 14.243 | 34.851 | 1.00 | 34.49 | C |
| ANISOU | 1228 | CH2 | TRP | A | 147 | 3794 | 4180 | 5130 | 326 | −438 | −877 | C |
| ATOM | 1229 | N | GLU | A | 148 | 4.315 | 16.908 | 42.926 | 1.00 | 32.33 | N |
| ANISOU | 1229 | N | GLU | A | 148 | 3766 | 3694 | 4824 | 474 | 177 | −1078 | N |
| ATOM | 1230 | CA | GLU | A | 148 | 4.399 | 17.875 | 44.015 | 1.00 | 36.12 | C |
| ANISOU | 1230 | CA | GLU | A | 148 | 4351 | 4121 | 5251 | 501 | 247 | −1127 | C |
| ATOM | 1231 | C | GLU | A | 148 | 5.038 | 17.241 | 45.243 | 1.00 | 36.78 | C |
| ANISOU | 1231 | C | GLU | A | 148 | 4540 | 4232 | 5202 | 472 | 304 | −1145 | C |
| ATOM | 1232 | O | GLU | A | 148 | 5.960 | 17.812 | 45.836 | 1.00 | 31.48 | O |
| ANISOU | 1232 | O | GLU | A | 148 | 3988 | 3548 | 4425 | 452 | 277 | −1175 | O |
| ATOM | 1233 | CB | GLU | A | 148 | 3.011 | 18.439 | 44.339 | 1.00 | 36.12 | C |
| ANISOU | 1233 | CB | GLU | A | 148 | 4295 | 4062 | 5367 | 574 | 354 | −1149 | C |
| ATOM | 1234 | CG | GLU | A | 148 | 2.492 | 19.311 | 43.223 | 1.00 | 40.56 | C |
| ANISOU | 1234 | CG | GLU | A | 148 | 4777 | 4585 | 6051 | 610 | 282 | −1131 | C |
| ATOM | 1235 | CD | GLU | A | 148 | 1.050 | 19.753 | 43.410 | 1.00 | 41.08 | C |
| ANISOU | 1235 | CD | GLU | A | 148 | 4753 | 4594 | 6260 | 688 | 379 | −1143 | C |
| ATOM | 1236 | OE1 | GLU | A | 148 | 0.682 | 20.762 | 42.787 | 1.00 | 39.40 | O |
| ANISOU | 1236 | OE1 | GLU | A | 148 | 4508 | 4329 | 6134 | 732 | 333 | −1139 | O |
| ATOM | 1237 | OE2 | GLU | A | 148 | 0.290 | 19.090 | 44.157 | 1.00 | 43.30 | O |
| ANISOU | 1237 | OE2 | GLU | A | 148 | 4993 | 4882 | 6576 | 706 | 501 | −1152 | O |
| ATOM | 1238 | N | ALA | A | 149 | 4.595 | 16.033 | 45.614 | 1.00 | 33.62 | N |
| ANISOU | 1238 | N | ALA | A | 149 | 4099 | 3869 | 4806 | 466 | 375 | −1124 | N |
| ATOM | 1239 | CA | ALA | A | 149 | 5.157 | 15.369 | 46.787 | 1.00 | 39.15 | C |
| ANISOU | 1239 | CA | ALA | A | 149 | 4905 | 4594 | 5376 | 443 | 429 | −1131 | C |
| ATOM | 1240 | C | ALA | A | 149 | 6.648 | 15.100 | 46.617 | 1.00 | 39.75 | C |
| ANISOU | 1240 | C | ALA | A | 149 | 5045 | 4714 | 5343 | 386 | 309 | −1116 | C |
| ATOM | 1241 | O | ALA | A | 149 | 7.411 | 15.183 | 47.587 | 1.00 | 36.49 | O |
| ANISOU | 1241 | O | ALA | A | 149 | 4753 | 4305 | 4805 | 370 | 309 | −1137 | O |
| ATOM | 1242 | CB | ALA | A | 149 | 4.404 | 14.062 | 47.066 | 1.00 | 40.36 | C |
| ANISOU | 1242 | CB | ALA | A | 149 | 4992 | 4774 | 5570 | 444 | 522 | −1098 | C |
| ATOM | 1243 | N | ALA | A | 150 | 7.089 | 14.792 | 45.395 | 1.00 | 33.44 | N |
| ANISOU | 1243 | N | ALA | A | 150 | 4168 | 3948 | 4591 | 356 | 204 | −1080 | N |
| ATOM | 1244 | CA | ALA | A | 150 | 8.487 | 14.441 | 45.158 | 1.00 | 32.86 | C |
| ANISOU | 1244 | CA | ALA | A | 150 | 4134 | 3917 | 4435 | 305 | 103 | −1060 | C |
| ATOM | 1245 | C | ALA | A | 150 | 9.372 | 15.639 | 44.777 | 1.00 | 28.67 | C |
| ANISOU | 1245 | C | ALA | A | 150 | 3648 | 3362 | 3882 | 286 | 11 | −1077 | C |
| ATOM | 1246 | O | ALA | A | 150 | 10.538 | 15.436 | 44.431 | 1.00 | 33.54 | O |
| ANISOU | 1246 | O | ALA | A | 150 | 4277 | 4012 | 4454 | 243 | −75 | −1056 | O |
| ATOM | 1247 | CB | ALA | A | 150 | 8.590 | 13.365 | 44.071 | 1.00 | 29.14 | C |
| ANISOU | 1247 | CB | ALA | A | 150 | 3565 | 3491 | 4015 | 281 | 52 | −1013 | C |
| ATOM | 1248 | N | HIS | A | 151 | 8.837 | 16.861 | 44.825 | 1.00 | 32.12 | N |
| ANISOU | 1248 | N | HIS | A | 151 | 4106 | 3740 | 4360 | 318 | 33 | −1112 | N |
| ATOM | 1249 | CA | HIS | A | 151 | 9.605 | 18.087 | 44.580 | 1.00 | 32.41 | C |
| ANISOU | 1249 | CA | HIS | A | 151 | 4195 | 3737 | 4382 | 300 | −42 | −1131 | C |

TABLE 11-continued

| | | | | | | | | | | | | |
|---|---|---|---|---|---|---|---|---|---|---|---|---|
| ATOM | 1250 | C | HIS | A | 151 | 10.220 | 18.094 | 43.184 | 1.00 | 32.75 | | C |
| ANISOU | 1250 | C | HIS | A | 151 | 4169 | 3804 | 4469 | 268 | −141 | −1084 | C |
| ATOM | 1251 | O | HIS | A | 151 | 11.327 | 18.593 | 42.973 | 1.00 | 32.65 | | O |
| ANISOU | 1251 | O | HIS | A | 151 | 4194 | 3788 | 4423 | 226 | −215 | −1079 | O |
| ATOM | 1252 | CB | HIS | A | 151 | 10.678 | 18.284 | 45.656 | 1.00 | 29.31 | | C |
| ANISOU | 1252 | CB | HIS | A | 151 | 3922 | 3344 | 3870 | 263 | −71 | −1164 | C |
| ATOM | 1253 | CG | HIS | A | 151 | 10.122 | 18.531 | 47.022 | 1.00 | 36.98 | | C |
| ANISOU | 1253 | CG | HIS | A | 151 | 4992 | 4281 | 4779 | 297 | 24 | −1218 | C |
| ATOM | 1254 | ND1 | HIS | A | 151 | 10.906 | 18.932 | 48.083 | 1.00 | 42.78 | | N |
| ANISOU | 1254 | ND1 | HIS | A | 151 | 5857 | 5000 | 5399 | 272 | −2 | −1263 | N |
| ATOM | 1255 | CD2 | HIS | A | 151 | 8.858 | 18.440 | 47.501 | 1.00 | 41.17 | | C |
| ANISOU | 1255 | CD2 | HIS | A | 151 | 5513 | 4786 | 5342 | 353 | 148 | −1236 | C |
| ATOM | 1256 | CE1 | HIS | A | 151 | 10.147 | 19.090 | 49.154 | 1.00 | 45.03 | | C |
| ANISOU | 1256 | CE1 | HIS | A | 151 | 6223 | 5252 | 5635 | 315 | 106 | −1309 | C |
| ATOM | 1257 | NE2 | HIS | A | 151 | 8.900 | 18.798 | 48.827 | 1.00 | 42.39 | | N |
| ANISOU | 1257 | NE2 | HIS | A | 151 | 5802 | 4911 | 5394 | 366 | 206 | −1292 | N |
| ATOM | 1258 | N | VAL | A | 152 | 9.492 | 17.538 | 42.217 | 1.00 | 27.70 | | N |
| ANISOU | 1258 | N | VAL | A | 152 | 3432 | 3187 | 3907 | 287 | −139 | −1049 | N |
| ATOM | 1259 | CA | VAL | A | 152 | 10.025 | 17.405 | 40.862 | 1.00 | 30.05 | | C |
| ANISOU | 1259 | CA | VAL | A | 152 | 3676 | 3512 | 4228 | 261 | −223 | −1003 | C |
| ATOM | 1260 | C | VAL | A | 152 | 10.279 | 18.780 | 40.246 | 1.00 | 31.05 | | C |
| ANISOU | 1260 | C | VAL | A | 152 | 3827 | 3585 | 4386 | 262 | −274 | −1000 | C |
| ATOM | 1261 | O | VAL | A | 152 | 11.301 | 18.995 | 39.583 | 1.00 | 35.06 | | O |
| ANISOU | 1261 | O | VAL | A | 152 | 4346 | 4105 | 4872 | 221 | −339 | −971 | O |
| ATOM | 1262 | CB | VAL | A | 152 | 9.063 | 16.563 | 39.998 | 1.00 | 31.89 | | C |
| ANISOU | 1262 | CB | VAL | A | 152 | 3811 | 3773 | 4533 | 284 | −218 | −976 | C |
| ATOM | 1263 | CG1 | VAL | A | 152 | 9.598 | 16.429 | 38.568 | 1.00 | 34.26 | | C |
| ANISOU | 1263 | CG1 | VAL | A | 152 | 4077 | 4100 | 4840 | 260 | −302 | −934 | C |
| ATOM | 1264 | CG2 | VAL | A | 152 | 8.852 | 15.173 | 40.636 | 1.00 | 30.83 | | C |
| ANISOU | 1264 | CG2 | VAL | A | 152 | 3656 | 3681 | 4375 | 276 | −163 | −977 | C |
| ATOM | 1265 | N | ALA | A | 153 | 9.354 | 19.729 | 40.450 | 1.00 | 29.05 | | N |
| ANISOU | 1265 | N | ALA | A | 153 | 3580 | 3267 | 4192 | 310 | −237 | −1025 | N |
| ATOM | 1266 | CA | ALA | A | 153 | 9.536 | 21.066 | 39.889 | 1.00 | 29.13 | | C |
| ANISOU | 1266 | CA | ALA | A | 153 | 3618 | 3212 | 4239 | 316 | −281 | −1018 | C |
| ATOM | 1267 | C | ALA | A | 153 | 10.845 | 21.676 | 40.371 | 1.00 | 31.46 | | C |
| ANISOU | 1267 | C | ALA | A | 153 | 3999 | 3487 | 4468 | 260 | −317 | −1035 | C |
| ATOM | 1268 | O | ALA | A | 153 | 11.610 | 22.247 | 39.584 | 1.00 | 35.34 | | O |
| ANISOU | 1268 | O | ALA | A | 153 | 4498 | 3963 | 4967 | 227 | −379 | −1002 | O |
| ATOM | 1269 | CB | ALA | A | 153 | 8.354 | 21.973 | 40.268 | 1.00 | 27.50 | | C |
| ANISOU | 1269 | CB | ALA | A | 153 | 3412 | 2929 | 4108 | 383 | −224 | −1050 | C |
| ATOM | 1270 | N | GLU | A | 154 | 11.117 | 21.564 | 41.673 | 1.00 | 33.35 | | N |
| ANISOU | 1270 | N | GLU | A | 154 | 4307 | 3723 | 4641 | 248 | −281 | −1087 | N |
| ATOM | 1271 | CA | GLU | A | 154 | 12.360 | 22.109 | 42.222 | 1.00 | 29.33 | | C |
| ANISOU | 1271 | CA | GLU | A | 154 | 3878 | 3194 | 4071 | 191 | −330 | −1110 | C |
| ATOM | 1272 | C | GLU | A | 154 | 13.585 | 21.460 | 41.585 | 1.00 | 38.80 | | C |
| ANISOU | 1272 | C | GLU | A | 154 | 5040 | 4458 | 5243 | 130 | −400 | −1061 | C |
| ATOM | 1273 | O | GLU | A | 154 | 14.563 | 22.147 | 41.259 | 1.00 | 29.65 | | O |
| ANISOU | 1273 | O | GLU | A | 154 | 3901 | 3274 | 4092 | 81 | −459 | −1048 | O |
| ATOM | 1274 | CB | GLU | A | 154 | 12.369 | 21.913 | 43.731 | 1.00 | 30.69 | | C |
| ANISOU | 1274 | CB | GLU | A | 154 | 4134 | 3364 | 4161 | 193 | −286 | −1172 | C |
| ATOM | 1275 | CG | GLU | A | 154 | 13.648 | 22.338 | 44.432 | 1.00 | 31.20 | | C |
| ANISOU | 1275 | CG | GLU | A | 154 | 4284 | 3415 | 4155 | 130 | −353 | −1203 | C |
| ATOM | 1276 | CD | GLU | A | 154 | 13.579 | 22.058 | 45.918 | 1.00 | 43.06 | | C |
| ANISOU | 1276 | CD | GLU | A | 154 | 5885 | 4921 | 5557 | 138 | −314 | −1262 | C |
| ATOM | 1277 | OE1 | GLU | A | 154 | 12.687 | 22.618 | 46.578 | 1.00 | 38.85 | | O |
| ANISOU | 1277 | OE1 | GLU | A | 154 | 5412 | 4330 | 5019 | 187 | −238 | −1315 | O |
| ATOM | 1278 | OE2 | GLU | A | 154 | 14.393 | 21.260 | 46.422 | 1.00 | 43.52 | | O |
| ANISOU | 1278 | OE2 | GLU | A | 154 | 5960 | 5037 | 5538 | 101 | −356 | −1253 | O |
| ATOM | 1279 | N | GLN | A | 155 | 13.549 | 20.133 | 41.401 | 1.00 | 29.43 | | N |
| ANISOU | 1279 | N | GLN | A | 155 | 3798 | 3349 | 4035 | 131 | −389 | −1032 | N |
| ATOM | 1280 | CA | GLN | A | 155 | 14.678 | 19.435 | 40.790 | 1.00 | 28.94 | | C |
| ANISOU | 1280 | CA | GLN | A | 155 | 3697 | 3346 | 3954 | 83 | −442 | −986 | C |
| ATOM | 1281 | C | GLN | A | 155 | 14.874 | 19.861 | 39.339 | 1.00 | 30.59 | | C |
| ANISOU | 1281 | C | GLN | A | 155 | 3860 | 3546 | 4215 | 74 | −475 | −935 | C |
| ATOM | 1282 | O | GLN | A | 155 | 16.008 | 20.071 | 38.895 | 1.00 | 36.10 | | O |
| ANISOU | 1282 | O | GLN | A | 155 | 4553 | 4252 | 4912 | 26 | −519 | −906 | O |
| ATOM | 1283 | CB | GLN | A | 155 | 14.459 | 17.917 | 40.868 | 1.00 | 28.21 | | C |
| ANISOU | 1283 | CB | GLN | A | 155 | 3559 | 3325 | 3833 | 96 | −413 | −969 | C |
| ATOM | 1284 | CG | GLN | A | 155 | 14.337 | 17.369 | 42.296 | 1.00 | 29.38 | | C |
| ANISOU | 1284 | CG | GLN | A | 155 | 3760 | 3485 | 3916 | 104 | −375 | −1005 | C |
| ATOM | 1285 | CD | GLN | A | 155 | 14.003 | 15.876 | 42.296 | 1.00 | 30.87 | | C |
| ANISOU | 1285 | CD | GLN | A | 155 | 3903 | 3733 | 4094 | 119 | −339 | −980 | C |
| ATOM | 1286 | OE1 | GLN | A | 155 | 13.342 | 15.382 | 41.384 | 1.00 | 31.82 | | O |
| ANISOU | 1286 | OE1 | GLN | A | 155 | 3955 | 3869 | 4268 | 138 | −322 | −956 | O |
| ATOM | 1287 | NE2 | GLN | A | 155 | 14.457 | 15.160 | 43.324 | 1.00 | 32.42 | | N |
| ANISOU | 1287 | NE2 | GLN | A | 155 | 4142 | 3957 | 4220 | 108 | −332 | −986 | N |
| ATOM | 1288 | N | LEU | A | 156 | 13.783 | 19.978 | 38.584 | 1.00 | 30.11 | | N |
| ANISOU | 1288 | N | LEU | A | 156 | 3764 | 3471 | 4204 | 121 | −456 | −920 | N |
| ATOM | 1289 | CA | LEU | A | 156 | 13.871 | 20.377 | 37.180 | 1.00 | 32.57 | | C |
| ANISOU | 1289 | CA | LEU | A | 156 | 4048 | 3775 | 4551 | 120 | −490 | −867 | C |

TABLE 11-continued

| | | | | | | | | | | | |
|---|---|---|---|---|---|---|---|---|---|---|---|
| ATOM | 1290 | C | LEU | A | 156 | 14.374 | 21.799 | 37.037 | 1.00 | 36.71 | C |
| ANISOU | 1290 | C | LEU | A | 156 | 4620 | 4225 | 5102 | 97 | −516 | −860 | C |
| ATOM | 1291 | O | LEU | A | 156 | 15.146 | 22.108 | 36.125 | 1.00 | 34.28 | O |
| ANISOU | 1291 | O | LEU | A | 156 | 4308 | 3916 | 4800 | 64 | −546 | −811 | O |
| ATOM | 1292 | CB | LEU | A | 156 | 12.503 | 20.272 | 36.517 | 1.00 | 32.27 | C |
| ANISOU | 1292 | CB | LEU | A | 156 | 3968 | 3732 | 4563 | 179 | −479 | −856 | C |
| ATOM | 1293 | CG | LEU | A | 156 | 12.104 | 18.866 | 36.107 | 1.00 | 37.84 | C |
| ANISOU | 1293 | CG | LEU | A | 156 | 4614 | 4507 | 5257 | 189 | −472 | −844 | C |
| ATOM | 1294 | CD1 | LEU | A | 156 | 10.625 | 18.855 | 35.637 | 1.00 | 35.92 | C |
| ANISOU | 1294 | CD1 | LEU | A | 156 | 4320 | 4248 | 5079 | 247 | −470 | −843 | C |
| ATOM | 1295 | CD2 | LEU | A | 156 | 13.069 | 18.406 | 35.011 | 1.00 | 36.00 | C |
| ANISOU | 1295 | CD2 | LEU | A | 156 | 4373 | 4319 | 4988 | 153 | −509 | −797 | C |
| ATOM | 1296 | N | ARG | A | 157 | 13.886 | 22.686 | 37.897 | 1.00 | 34.11 | N |
| ANISOU | 1296 | N | ARG | A | 157 | 4340 | 3827 | 4793 | 118 | −497 | −909 | N |
| ATOM | 1297 | CA | ARG | A | 157 | 14.283 | 24.084 | 37.861 | 1.00 | 36.03 | C |
| ANISOU | 1297 | CA | ARG | A | 157 | 4636 | 3982 | 5070 | 97 | −519 | −911 | C |
| ATOM | 1298 | C | ARG | A | 157 | 15.789 | 24.243 | 38.045 | 1.00 | 36.12 | C |
| ANISOU | 1298 | C | ARG | A | 157 | 4669 | 4000 | 5056 | 16 | −560 | −904 | C |
| ATOM | 1299 | O | ARG | A | 157 | 16.404 | 25.107 | 37.410 | 1.00 | 38.83 | O |
| ANISOU | 1299 | O | ARG | A | 157 | 5024 | 4293 | 5435 | −19 | −586 | −869 | O |
| ATOM | 1300 | CB | ARG | A | 157 | 13.482 | 24.844 | 38.928 | 1.00 | 40.92 | C |
| ANISOU | 1300 | CB | ARG | A | 157 | 5313 | 4529 | 5708 | 138 | −481 | −979 | C |
| ATOM | 1301 | CG | ARG | A | 157 | 13.477 | 26.348 | 38.766 | 1.00 | 46.53 | C |
| ANISOU | 1301 | CG | ARG | A | 157 | 6077 | 5129 | 6475 | 140 | −494 | −984 | C |
| ATOM | 1302 | CD | ARG | A | 157 | 12.500 | 27.044 | 39.726 | 1.00 | 37.75 | C |
| ANISOU | 1302 | CD | ARG | A | 157 | 5017 | 3938 | 5388 | 198 | −441 | −1054 | C |
| ATOM | 1303 | NE | ARG | A | 157 | 12.767 | 26.711 | 41.122 | 1.00 | 35.86 | N |
| ANISOU | 1303 | NE | ARG | A | 157 | 4837 | 3714 | 5076 | 179 | −416 | −1129 | N |
| ATOM | 1304 | CZ | ARG | A | 157 | 11.994 | 25.926 | 41.870 | 1.00 | 36.69 | C |
| ANISOU | 1304 | CZ | ARG | A | 157 | 4934 | 3861 | 5147 | 223 | −352 | −1163 | C |
| ATOM | 1305 | NH1 | ARG | A | 157 | 10.895 | 25.390 | 41.356 | 1.00 | 34.06 | N |
| ANISOU | 1305 | NH1 | ARG | A | 157 | 4522 | 3558 | 4862 | 285 | −311 | −1134 | N |
| ATOM | 1306 | NH2 | ARG | A | 157 | 12.312 | 25.691 | 43.142 | 1.00 | 40.54 | N |
| ANISOU | 1306 | NH2 | ARG | A | 157 | 5495 | 4356 | 5551 | 204 | −332 | −1227 | N |
| ATOM | 1307 | N | ALA | A | 158 | 16.417 | 23.395 | 38.870 | 1.00 | 43.14 | N |
| ANISOU | 1307 | N | ALA | A | 158 | 5555 | 4946 | 5890 | −14 | −566 | −931 | N |
| ATOM | 1308 | CA | ALA | A | 158 | 17.869 | 23.458 | 39.016 | 1.00 | 43.05 | C |
| ANISOU | 1308 | CA | ALA | A | 158 | 5543 | 4946 | 5869 | −90 | −615 | −920 | C |
| ATOM | 1309 | C | ALA | A | 158 | 18.566 | 23.276 | 37.672 | 1.00 | 41.97 | C |
| ANISOU | 1309 | C | ALA | A | 158 | 5347 | 4839 | 5761 | −118 | −624 | −842 | C |
| ATOM | 1310 | O | ALA | A | 158 | 19.536 | 23.978 | 37.364 | 1.00 | 39.86 | O |
| ANISOU | 1310 | O | ALA | A | 158 | 5079 | 4536 | 5530 | −176 | −652 | −816 | O |
| ATOM | 1311 | CB | ALA | A | 158 | 18.357 | 22.399 | 40.006 | 1.00 | 41.97 | C |
| ANISOU | 1311 | CB | ALA | A | 158 | 5403 | 4876 | 5668 | −106 | −627 | −948 | C |
| ATOM | 1312 | N | TYR | A | 159 | 18.081 | 22.337 | 36.857 | 1.00 | 31.62 | N |
| ANISOU | 1312 | N | TYR | A | 159 | 3989 | 3591 | 4435 | −80 | −598 | −805 | N |
| ATOM | 1313 | CA | TYR | A | 159 | 18.663 | 22.131 | 35.534 | 1.00 | 31.02 | C |
| ANISOU | 1313 | CA | TYR | A | 159 | 3873 | 3544 | 4370 | −98 | −596 | −734 | C |
| ATOM | 1314 | C | TYR | A | 159 | 18.262 | 23.245 | 34.573 | 1.00 | 33.19 | C |
| ANISOU | 1314 | C | TYR | A | 159 | 4174 | 3751 | 4684 | −85 | −595 | −693 | C |
| ATOM | 1315 | O | TYR | A | 159 | 19.116 | 23.840 | 33.909 | 1.00 | 35.15 | O |
| ANISOU | 1315 | O | TYR | A | 159 | 4425 | 3973 | 4958 | −129 | −598 | −644 | O |
| ATOM | 1316 | CB | TYR | A | 159 | 18.213 | 20.770 | 34.997 | 1.00 | 32.37 | C |
| ANISOU | 1316 | CB | TYR | A | 159 | 4000 | 3795 | 4505 | −60 | −573 | −719 | C |
| ATOM | 1317 | CG | TYR | A | 159 | 18.460 | 20.501 | 33.528 | 1.00 | 29.29 | C |
| ANISOU | 1317 | CG | TYR | A | 159 | 3588 | 3432 | 4107 | −58 | −561 | −655 | C |
| ATOM | 1318 | CD1 | TYR | A | 159 | 19.699 | 20.040 | 33.074 | 1.00 | 33.39 | C |
| ANISOU | 1318 | CD1 | TYR | A | 159 | 4075 | 3991 | 4620 | −100 | −549 | −617 | C |
| ATOM | 1319 | CD2 | TYR | A | 159 | 17.443 | 20.675 | 32.596 | 1.00 | 30.71 | C |
| ANISOU | 1319 | CD2 | TYR | A | 159 | 3781 | 3601 | 4286 | −12 | −563 | −632 | C |
| ATOM | 1320 | CE1 | TYR | A | 159 | 19.902 | 19.761 | 31.713 | 1.00 | 28.45 | C |
| ANISOU | 1320 | CE1 | TYR | A | 159 | 3444 | 3391 | 3974 | −94 | −524 | −561 | C |
| ATOM | 1321 | CE2 | TYR | A | 159 | 17.631 | 20.412 | 31.261 | 1.00 | 32.25 | C |
| ANISOU | 1321 | CE2 | TYR | A | 159 | 3976 | 3822 | 4455 | −7 | −556 | −577 | C |
| ATOM | 1322 | CZ | TYR | A | 159 | 18.857 | 19.949 | 30.825 | 1.00 | 31.02 | C |
| ANISOU | 1322 | CZ | TYR | A | 159 | 3801 | 3704 | 4280 | −48 | −530 | −544 | C |
| ATOM | 1323 | OH | TYR | A | 159 | 19.020 | 19.691 | 29.483 | 1.00 | 33.55 | O |
| ANISOU | 1323 | OH | TYR | A | 159 | 4137 | 4049 | 4563 | −40 | −511 | −492 | O |
| ATOM | 1324 | N | LEU | A | 160 | 16.962 | 23.544 | 34.497 | 1.00 | 30.50 | N |
| ANISOU | 1324 | N | LEU | A | 160 | 3854 | 3380 | 4356 | −23 | −588 | −708 | N |
| ATOM | 1325 | CA | LEU | A | 160 | 16.441 | 24.440 | 33.465 | 1.00 | 31.62 | C |
| ANISOU | 1325 | CA | LEU | A | 160 | 4019 | 3466 | 4531 | 5 | −595 | −659 | C |
| ATOM | 1326 | C | LEU | A | 160 | 16.964 | 25.865 | 33.616 | 1.00 | 38.53 | C |
| ANISOU | 1326 | C | LEU | A | 160 | 4942 | 4241 | 5455 | −32 | −605 | −651 | C |
| ATOM | 1327 | O | LEU | A | 160 | 17.195 | 26.545 | 32.610 | 1.00 | 40.84 | O |
| ANISOU | 1327 | O | LEU | A | 160 | 5254 | 4494 | 5769 | −42 | −609 | −584 | O |
| ATOM | 1328 | CB | LEU | A | 160 | 14.910 | 24.433 | 33.491 | 1.00 | 31.84 | C |
| ANISOU | 1328 | CB | LEU | A | 160 | 4041 | 3479 | 4578 | 84 | −593 | −680 | C |
| ATOM | 1329 | CG | LEU | A | 160 | 14.216 | 23.130 | 33.076 | 1.00 | 33.81 | C |
| ANISOU | 1329 | CG | LEU | A | 160 | 4239 | 3812 | 4796 | 122 | −591 | −678 | C |

TABLE 11-continued

| | | | | | | | | | | | | |
|---|---|---|---|---|---|---|---|---|---|---|---|---|
| ATOM | 1330 | CD1 | LEU | A | 160 | 12.720 | 23.229 | 33.361 | 1.00 | 35.78 | | C |
| ANISOU | 1330 | CD1 | LEU | A | 160 | 4469 | 4036 | 5091 | 193 | −587 | −708 | C |
| ATOM | 1331 | CD2 | LEU | A | 160 | 14.456 | 22.821 | 31.598 | 1.00 | 32.62 | | C |
| ANISOU | 1331 | CD2 | LEU | A | 160 | 4084 | 3698 | 4614 | 119 | −612 | −609 | C |
| ATOM | 1332 | N | GLU | A | 161 | 17.161 | 26.327 | 34.846 | 1.00 | 36.68 | | N |
| ANISOU | 1332 | N | GLU | A | 161 | 4738 | 3962 | 5237 | −55 | −611 | −717 | N |
| ATOM | 1333 | CA | GLU | A | 161 | 17.688 | 27.658 | 35.101 | 1.00 | 34.41 | | C |
| ANISOU | 1333 | CA | GLU | A | 161 | 4503 | 3571 | 5002 | −99 | −626 | −723 | C |
| ATOM | 1334 | C | GLU | A | 161 | 19.201 | 27.675 | 35.211 | 1.00 | 38.87 | | C |
| ANISOU | 1334 | C | GLU | A | 161 | 5049 | 4145 | 5574 | −192 | −646 | −708 | C |
| ATOM | 1335 | O | GLU | A | 161 | 19.792 | 28.753 | 35.152 | 1.00 | 42.39 | | O |
| ANISOU | 1335 | O | GLU | A | 161 | 5525 | 4505 | 6075 | −243 | −660 | −694 | O |
| ATOM | 1336 | CB | GLU | A | 161 | 17.104 | 28.232 | 36.392 | 1.00 | 36.00 | | C |
| ANISOU | 1336 | CB | GLU | A | 161 | 4758 | 3706 | 5213 | −77 | −625 | −812 | C |
| ATOM | 1337 | CG | GLU | A | 161 | 15.603 | 28.439 | 36.322 | 1.00 | 43.31 | | C |
| ANISOU | 1337 | CG | GLU | A | 161 | 5695 | 4602 | 6161 | 17 | −596 | −825 | C |
| ATOM | 1338 | CD | GLU | A | 161 | 15.031 | 29.116 | 37.553 | 1.00 | 46.70 | | C |
| ANISOU | 1338 | CD | GLU | A | 161 | 6187 | 4953 | 6605 | 45 | −575 | −914 | C |
| ATOM | 1339 | OE1 | GLU | A | 161 | 15.747 | 29.252 | 38.564 | 1.00 | 47.50 | | O |
| ANISOU | 1339 | OE1 | GLU | A | 161 | 6332 | 5039 | 6678 | −8 | −590 | −974 | O |
| ATOM | 1340 | OE2 | GLU | A | 161 | 13.853 | 29.515 | 37.493 | 1.00 | 54.20 | | O |
| ANISOU | 1340 | OE2 | GLU | A | 161 | 7142 | 5856 | 7596 | 123 | −546 | −923 | O |
| ATOM | 1341 | N | GLY | A | 162 | 19.839 | 26.518 | 35.384 | 1.00 | 34.21 | | N |
| ANISOU | 1341 | N | GLY | A | 162 | 4404 | 3651 | 4941 | −216 | −648 | −709 | N |
| ATOM | 1342 | CA | GLY | A | 162 | 21.275 | 26.510 | 35.624 | 1.00 | 38.28 | | C |
| ANISOU | 1342 | CA | GLY | A | 162 | 4888 | 4176 | 5480 | −301 | −674 | −699 | C |
| ATOM | 1343 | C | GLY | A | 162 | 22.044 | 25.655 | 34.634 | 1.00 | 33.18 | | C |
| ANISOU | 1343 | C | GLY | A | 162 | 4172 | 3609 | 4826 | −319 | −647 | −627 | C |
| ATOM | 1344 | O | GLY | A | 162 | 22.582 | 26.166 | 33.654 | 1.00 | 37.52 | | O |
| ANISOU | 1344 | O | GLY | A | 162 | 4711 | 4131 | 5414 | −350 | −624 | −558 | O |
| ATOM | 1345 | N | THR | A | 163 | 22.068 | 24.339 | 34.875 | 1.00 | 31.56 | | N |
| ANISOU | 1345 | N | THR | A | 163 | 3923 | 3498 | 4569 | −296 | −642 | −642 | N |
| ATOM | 1346 | CA | THR | A | 163 | 22.855 | 23.424 | 34.045 | 1.00 | 32.79 | | C |
| ANISOU | 1346 | CA | THR | A | 163 | 4013 | 3728 | 4717 | −309 | −611 | −584 | C |
| ATOM | 1347 | C | THR | A | 163 | 22.507 | 23.531 | 32.561 | 1.00 | 34.14 | | C |
| ANISOU | 1347 | C | THR | A | 163 | 4196 | 3900 | 4876 | −280 | −563 | −514 | C |
| ATOM | 1348 | O | THR | A | 163 | 23.402 | 23.475 | 31.704 | 1.00 | 31.95 | | O |
| ANISOU | 1348 | O | THR | A | 163 | 3887 | 3637 | 4616 | −313 | −526 | −452 | O |
| ATOM | 1349 | CB | THR | A | 163 | 22.633 | 21.985 | 34.519 | 1.00 | 36.06 | | C |
| ANISOU | 1349 | CB | THR | A | 163 | 4395 | 4230 | 5075 | −272 | −609 | −615 | C |
| ATOM | 1350 | OG1 | THR | A | 163 | 22.723 | 21.946 | 35.947 | 1.00 | 43.34 | | O |
| ANISOU | 1350 | OG1 | THR | A | 163 | 5331 | 5146 | 5988 | −286 | −656 | −680 | O |
| ATOM | 1351 | CG2 | THR | A | 163 | 23.684 | 21.055 | 33.902 | 1.00 | 39.70 | | C |
| ANISOU | 1351 | CG2 | THR | A | 163 | 4784 | 4758 | 5541 | −292 | −580 | −567 | C |
| ATOM | 1352 | N | CYS | A | 164 | 21.210 | 23.633 | 32.236 | 1.00 | 31.59 | | N |
| ANISOU | 1352 | N | CYS | A | 164 | 3918 | 3565 | 4522 | −215 | −562 | −522 | N |
| ATOM | 1353 | CA | CYS | A | 164 | 20.783 | 23.708 | 30.838 | 1.00 | 32.60 | | C |
| ANISOU | 1353 | CA | CYS | A | 164 | 4069 | 3695 | 4623 | −182 | −535 | −458 | C |
| ATOM | 1354 | C | CYS | A | 164 | 21.430 | 24.893 | 30.148 | 1.00 | 33.11 | | C |
| ANISOU | 1354 | C | CYS | A | 164 | 4162 | 3687 | 4733 | −226 | −517 | −392 | C |
| ATOM | 1355 | O | CYS | A | 164 | 21.910 | 24.783 | 29.012 | 1.00 | 35.57 | | O |
| ANISOU | 1355 | O | CYS | A | 164 | 4476 | 4017 | 5023 | −235 | −475 | −322 | O |
| ATOM | 1356 | CB | CYS | A | 164 | 19.250 | 23.811 | 30.763 | 1.00 | 39.20 | | C |
| ANISOU | 1356 | CB | CYS | A | 164 | 4941 | 4514 | 5440 | −108 | −557 | −481 | C |
| ATOM | 1357 | SG | CYS | A | 164 | 18.480 | 23.893 | 29.109 | 1.00 | 38.33 | | S |
| ANISOU | 1357 | SG | CYS | A | 164 | 4870 | 4407 | 5286 | −54 | −556 | −408 | S |
| ATOM | 1358 | N | VAL | A | 165 | 21.463 | 26.035 | 30.832 | 1.00 | 31.57 | | N |
| ANISOU | 1358 | N | VAL | A | 165 | 3995 | 3403 | 4598 | −255 | −544 | −414 | N |
| ATOM | 1359 | CA | VAL | A | 165 | 22.084 | 27.228 | 30.269 | 1.00 | 31.78 | | C |
| ANISOU | 1359 | CA | VAL | A | 165 | 4048 | 3344 | 4681 | −305 | −527 | −352 | C |
| ATOM | 1360 | C | VAL | A | 165 | 23.594 | 27.040 | 30.158 | 1.00 | 32.14 | | C |
| ANISOU | 1360 | C | VAL | A | 165 | 4033 | 3412 | 4767 | −386 | −496 | −317 | C |
| ATOM | 1361 | O | VAL | A | 165 | 24.220 | 27.485 | 29.185 | 1.00 | 35.38 | | O |
| ANISOU | 1361 | O | VAL | A | 165 | 4447 | 3796 | 5200 | −418 | −446 | −236 | O |
| ATOM | 1362 | CB | VAL | A | 165 | 21.720 | 28.464 | 31.112 | 1.00 | 39.14 | | C |
| ANISOU | 1362 | CB | VAL | A | 165 | 5029 | 4166 | 5676 | −316 | −565 | −397 | C |
| ATOM | 1363 | CG1 | VAL | A | 165 | 22.503 | 29.668 | 30.632 | 1.00 | 48.06 | | C |
| ANISOU | 1363 | CG1 | VAL | A | 165 | 6182 | 5199 | 6880 | −382 | −548 | −334 | C |
| ATOM | 1364 | CG2 | VAL | A | 165 | 20.216 | 28.733 | 31.028 | 1.00 | 40.36 | | C |
| ANISOU | 1364 | CG2 | VAL | A | 165 | 5236 | 4291 | 5809 | −228 | −582 | −415 | C |
| ATOM | 1365 | N | GLU | A | 166 | 24.210 | 26.403 | 31.161 | 1.00 | 34.16 | | N |
| ANISOU | 1365 | N | GLU | A | 166 | 4230 | 3713 | 5037 | −418 | −523 | −374 | N |
| ATOM | 1366 | CA | GLU | A | 166 | 25.657 | 26.190 | 31.101 | 1.00 | 40.39 | | C |
| ANISOU | 1366 | CA | GLU | A | 166 | 4941 | 4525 | 5882 | −492 | −501 | −341 | C |
| ATOM | 1367 | C | GLU | A | 166 | 26.035 | 25.341 | 29.895 | 1.00 | 36.78 | | C |
| ANISOU | 1367 | C | GLU | A | 166 | 4451 | 4139 | 5384 | −471 | −423 | −271 | C |
| ATOM | 1368 | O | GLU | A | 166 | 27.037 | 25.616 | 29.225 | 1.00 | 33.90 | | O |
| ANISOU | 1368 | O | GLU | A | 166 | 4049 | 3760 | 5070 | −522 | −367 | −203 | O |
| ATOM | 1369 | CB | GLU | A | 166 | 26.158 | 25.539 | 32.391 | 1.00 | 36.48 | | C |
| ANISOU | 1369 | CB | GLU | A | 166 | 4389 | 4072 | 5399 | −517 | −559 | −412 | C |

TABLE 11-continued

| | | | | | | | | | | | | |
|---|---|---|---|---|---|---|---|---|---|---|---|---|
| ATOM | 1370 | CG | GLU | A | 166 | 25.971 | 26.401 | 33.630 | 1.00 | 41.45 | | C |
| ANISOU | 1370 | CG | GLU | A | 166 | 5061 | 4627 | 6060 | −547 | −635 | −486 | C |
| ATOM | 1371 | CD | GLU | A | 166 | 26.107 | 25.606 | 34.921 | 1.00 | 63.27 | | C |
| ANISOU | 1371 | CD | GLU | A | 166 | 7802 | 7446 | 8793 | −546 | −696 | −561 | C |
| ATOM | 1372 | OE1 | GLU | A | 166 | 25.738 | 26.142 | 35.987 | 1.00 | 74.88 | | O |
| ANISOU | 1372 | OE1 | GLU | A | 166 | 9329 | 8866 | 10255 | −552 | −754 | −634 | O |
| ATOM | 1373 | OE2 | GLU | A | 166 | 26.570 | 24.445 | 34.869 | 1.00 | 71.52 | | O |
| ANISOU | 1373 | OE2 | GLU | A | 166 | 8780 | 8578 | 9815 | −534 | −684 | −547 | O |
| ATOM | 1374 | N | TRP | A | 167 | 25.246 | 24.304 | 29.604 | 1.00 | 33.09 | | N |
| ANISOU | 1374 | N | TRP | A | 167 | 3999 | 3746 | 4828 | −398 | −415 | −289 | N |
| ATOM | 1375 | CA | TRP | A | 167 | 25.479 | 23.502 | 28.403 | 1.00 | 34.90 | | C |
| ANISOU | 1375 | CA | TRP | A | 167 | 4221 | 4037 | 5002 | −371 | −342 | −232 | C |
| ATOM | 1376 | C | TRP | A | 167 | 25.297 | 24.351 | 27.156 | 1.00 | 35.03 | | C |
| ANISOU | 1376 | C | TRP | A | 167 | 4307 | 4002 | 4999 | −367 | −294 | −152 | C |
| ATOM | 1377 | O | TRP | A | 167 | 26.121 | 24.323 | 26.237 | 1.00 | 35.10 | | O |
| ANISOU | 1377 | O | TRP | A | 167 | 4306 | 4021 | 5010 | −391 | −215 | −82 | O |
| ATOM | 1378 | CB | TRP | A | 167 | 24.512 | 22.312 | 28.349 | 1.00 | 33.54 | | C |
| ANISOU | 1378 | CB | TRP | A | 167 | 4065 | 3938 | 4741 | −296 | −356 | −276 | C |
| ATOM | 1379 | CG | TRP | A | 167 | 24.849 | 21.148 | 29.243 | 1.00 | 36.39 | | C |
| ANISOU | 1379 | CG | TRP | A | 167 | 4359 | 4365 | 5104 | −293 | −373 | −331 | C |
| ATOM | 1380 | CD1 | TRP | A | 167 | 24.084 | 20.646 | 30.251 | 1.00 | 35.66 | | C |
| ANISOU | 1380 | CD1 | TRP | A | 167 | 4268 | 4292 | 4990 | −261 | −428 | −401 | C |
| ATOM | 1381 | CD2 | TRP | A | 167 | 26.020 | 20.329 | 29.182 | 1.00 | 30.25 | | C |
| ANISOU | 1381 | CD2 | TRP | A | 167 | 3503 | 3637 | 4352 | −317 | −330 | −312 | C |
| ATOM | 1382 | NE1 | TRP | A | 167 | 24.709 | 19.570 | 30.827 | 1.00 | 32.36 | | N |
| ANISOU | 1382 | NE1 | TRP | A | 167 | 3787 | 3933 | 4577 | −265 | −427 | −424 | N |
| ATOM | 1383 | CE2 | TRP | A | 167 | 25.900 | 19.352 | 30.191 | 1.00 | 33.61 | | C |
| ANISOU | 1383 | CE2 | TRP | A | 167 | 3892 | 4111 | 4769 | −297 | −372 | −372 | C |
| ATOM | 1384 | CE3 | TRP | A | 167 | 27.157 | 20.324 | 28.373 | 1.00 | 30.03 | | C |
| ANISOU | 1384 | CE3 | TRP | A | 167 | 3433 | 3618 | 4361 | −350 | −253 | −248 | C |
| ATOM | 1385 | CZ2 | TRP | A | 167 | 26.880 | 18.379 | 30.418 | 1.00 | 39.99 | | C |
| ANISOU | 1385 | CZ2 | TRP | A | 167 | 4620 | 4970 | 5605 | −305 | −351 | −368 | C |
| ATOM | 1386 | CZ3 | TRP | A | 167 | 28.136 | 19.351 | 28.601 | 1.00 | 36.54 | | C |
| ANISOU | 1386 | CZ3 | TRP | A | 167 | 4168 | 4495 | 5221 | −358 | −224 | −248 | C |
| ATOM | 1387 | CH2 | TRP | A | 167 | 27.988 | 18.397 | 29.619 | 1.00 | 37.82 | | C |
| ANISOU | 1387 | CH2 | TRP | A | 167 | 4293 | 4701 | 5375 | −334 | −279 | −307 | C |
| ATOM | 1388 | N | LEU | A | 168 | 24.192 | 25.096 | 27.095 | 1.00 | 30.16 | | N |
| ANISOU | 1388 | N | LEU | A | 168 | 3766 | 3331 | 4362 | −330 | −338 | −158 | N |
| ATOM | 1389 | CA | LEU | A | 168 | 23.939 | 25.913 | 25.919 | 1.00 | 33.10 | | C |
| ANISOU | 1389 | CA | LEU | A | 168 | 4216 | 3652 | 4708 | −317 | −305 | −76 | C |
| ATOM | 1390 | C | LEU | A | 168 | 25.101 | 26.867 | 25.653 | 1.00 | 33.80 | | C |
| ANISOU | 1390 | C | LEU | A | 168 | 4292 | 3673 | 4880 | −397 | −250 | −6 | C |
| ATOM | 1391 | O | LEU | A | 168 | 25.557 | 26.993 | 24.511 | 1.00 | 37.11 | | O |
| ANISOU | 1391 | O | LEU | A | 168 | 4741 | 4090 | 5269 | −405 | −172 | 80 | O |
| ATOM | 1392 | CB | LEU | A | 168 | 22.626 | 26.667 | 26.097 | 1.00 | 34.31 | | C |
| ANISOU | 1392 | CB | LEU | A | 168 | 4437 | 3744 | 4856 | −266 | −372 | −95 | C |
| ATOM | 1393 | CG | LEU | A | 168 | 22.245 | 27.647 | 24.992 | 1.00 | 38.23 | | C |
| ANISOU | 1393 | CG | LEU | A | 168 | 5021 | 4171 | 5332 | −246 | −358 | −7 | C |
| ATOM | 1394 | CD1 | LEU | A | 168 | 22.231 | 26.945 | 23.620 | 1.00 | 31.59 | | C |
| ANISOU | 1394 | CD1 | LEU | A | 168 | 4225 | 3397 | 4381 | −210 | −312 | 56 | C |
| ATOM | 1395 | CD2 | LEU | A | 168 | 20.888 | 28.200 | 25.339 | 1.00 | 31.64 | | C |
| ANISOU | 1395 | CD2 | LEU | A | 168 | 4231 | 3286 | 4505 | −183 | −434 | −41 | C |
| ATOM | 1396 | N | ARG | A | 169 | 25.621 | 27.514 | 26.700 | 1.00 | 37.10 | | N |
| ANISOU | 1396 | N | ARG | A | 169 | 4664 | 4033 | 5400 | −460 | −286 | −44 | N |
| ATOM | 1397 | CA | ARG | A | 169 | 26.733 | 28.441 | 26.502 | 1.00 | 37.83 | | C |
| ANISOU | 1397 | CA | ARG | A | 169 | 4731 | 4050 | 5591 | −547 | −239 | 19 | C |
| ATOM | 1398 | C | ARG | A | 169 | 27.991 | 27.714 | 26.035 | 1.00 | 40.13 | | C |
| ANISOU | 1398 | C | ARG | A | 169 | 4938 | 4406 | 5904 | −589 | −154 | 64 | C |
| ATOM | 1399 | O | ARG | A | 169 | 28.751 | 28.241 | 25.211 | 1.00 | 36.55 | | O |
| ANISOU | 1399 | O | ARG | A | 169 | 4483 | 3913 | 5491 | −634 | −69 | 153 | O |
| ATOM | 1400 | CB | ARG | A | 169 | 27.009 | 29.216 | 27.787 | 1.00 | 38.67 | | C |
| ANISOU | 1400 | CB | ARG | A | 169 | 4808 | 4082 | 5803 | −609 | −312 | −45 | C |
| ATOM | 1401 | CG | ARG | A | 169 | 25.881 | 30.164 | 28.136 | 1.00 | 35.74 | | C |
| ANISOU | 1401 | CG | ARG | A | 169 | 4527 | 3623 | 5429 | −573 | −371 | −78 | C |
| ATOM | 1402 | CD | ARG | A | 169 | 26.324 | 31.201 | 29.122 | 1.00 | 41.18 | | C |
| ANISOU | 1402 | CD | ARG | A | 169 | 5211 | 4208 | 6228 | −648 | −422 | −122 | C |
| ATOM | 1403 | NE | ARG | A | 169 | 26.151 | 30.775 | 30.496 | 1.00 | 49.15 | | N |
| ANISOU | 1403 | NE | ARG | A | 169 | 6194 | 5247 | 7233 | −645 | −500 | −235 | N |
| ATOM | 1404 | CZ | ARG | A | 169 | 25.381 | 31.390 | 31.388 | 1.00 | 61.44 | | C |
| ANISOU | 1404 | CZ | ARG | A | 169 | 7812 | 6736 | 8796 | −624 | −560 | −312 | C |
| ATOM | 1405 | NH1 | ARG | A | 169 | 24.694 | 32.470 | 31.055 | 1.00 | 63.98 | | N |
| ANISOU | 1405 | NH1 | ARG | A | 169 | 8215 | 6953 | 9141 | −600 | −556 | −289 | N |
| ATOM | 1406 | NH2 | ARG | A | 169 | 25.295 | 30.913 | 32.624 | 1.00 | 67.58 | | N |
| ANISOU | 1406 | NH2 | ARG | A | 169 | 8574 | 7550 | 9553 | −622 | −621 | −410 | N |
| ATOM | 1407 | N | ARG | A | 170 | 28.239 | 26.518 | 26.567 | 1.00 | 36.15 | | N |
| ANISOU | 1407 | N | ARG | A | 170 | 4361 | 3994 | 5382 | −572 | −170 | 8 | N |
| ATOM | 1408 | CA | ARG | A | 170 | 29.383 | 25.734 | 26.115 | 1.00 | 36.84 | | C |
| ANISOU | 1408 | CA | ARG | A | 170 | 4361 | 4142 | 5493 | −597 | −84 | 48 | C |
| ATOM | 1409 | C | ARG | A | 170 | 29.246 | 25.401 | 24.639 | 1.00 | 35.38 | | C |
| ANISOU | 1409 | C | ARG | A | 170 | 4242 | 3989 | 5211 | −550 | 20 | 123 | C |

TABLE 11-continued

| | | | | | | | | | | | | |
|---|---|---|---|---|---|---|---|---|---|---|---|---|
| ATOM | 1410 | O | ARG | A | 170 | 30.195 | 25.559 | 23.861 | 1.00 | 36.28 | | O |
| ANISOU | 1410 | O | ARG | A | 170 | 4329 | 4095 | 5362 | −588 | 128 | 202 | O |
| ATOM | 1411 | CB | ARG | A | 170 | 29.487 | 24.457 | 26.943 | 1.00 | 40.49 | | C |
| ANISOU | 1411 | CB | ARG | A | 170 | 4750 | 4694 | 5941 | −570 | −128 | −28 | C |
| ATOM | 1412 | CG | ARG | A | 170 | 30.472 | 23.425 | 26.424 | 1.00 | 44.33 | | C |
| ANISOU | 1412 | CG | ARG | A | 170 | 5154 | 5253 | 6438 | −568 | −38 | 6 | C |
| ATOM | 1413 | CD | ARG | A | 170 | 30.336 | 22.166 | 27.277 | 1.00 | 39.27 | | C |
| ANISOU | 1413 | CD | ARG | A | 170 | 4460 | 4689 | 5770 | −527 | −94 | −70 | C |
| ATOM | 1414 | NE | ARG | A | 170 | 31.344 | 21.153 | 26.983 | 1.00 | 50.46 | | N |
| ANISOU | 1414 | NE | ARG | A | 170 | 5784 | 6168 | 7220 | −523 | −19 | −46 | N |
| ATOM | 1415 | CZ | ARG | A | 170 | 32.582 | 21.171 | 27.465 | 1.00 | 60.24 | | C |
| ANISOU | 1415 | CZ | ARG | A | 170 | 6899 | 7405 | 8587 | −582 | −15 | −30 | C |
| ATOM | 1416 | NH1 | ARG | A | 170 | 32.972 | 22.173 | 28.250 | 1.00 | 64.02 | | N |
| ANISOU | 1416 | NH1 | ARG | A | 170 | 7338 | 7820 | 9165 | −658 | −89 | −37 | N |
| ATOM | 1417 | NH2 | ARG | A | 170 | 33.431 | 20.193 | 27.155 | 1.00 | 52.84 | | N |
| ANISOU | 1417 | NH2 | ARG | A | 170 | 5873 | 6523 | 7681 | −564 | 60 | −7 | N |
| ATOM | 1418 | N | TYR | A | 171 | 28.050 | 24.954 | 24.235 | 1.00 | 36.34 | | N |
| ANISOU | 1418 | N | TYR | A | 171 | 4455 | 4147 | 5208 | −468 | −10 | 100 | N |
| ATOM | 1419 | CA | TYR | A | 171 | 27.808 | 24.597 | 22.839 | 1.00 | 37.22 | | C |
| ANISOU | 1419 | CA | TYR | A | 171 | 4648 | 4290 | 5204 | −419 | 70 | 161 | C |
| ATOM | 1420 | C | TYR | A | 171 | 27.913 | 25.806 | 21.918 | 1.00 | 39.79 | | C |
| ANISOU | 1420 | C | TYR | A | 171 | 5055 | 4534 | 5529 | −444 | 126 | 261 | C |
| ATOM | 1421 | O | TYR | A | 171 | 28.456 | 25.698 | 20.812 | 1.00 | 42.09 | | O |
| ANISOU | 1421 | O | TYR | A | 171 | 5382 | 4839 | 5772 | −444 | 238 | 339 | O |
| ATOM | 1422 | CB | TYR | A | 171 | 26.430 | 23.955 | 22.692 | 1.00 | 36.85 | | C |
| ANISOU | 1422 | CB | TYR | A | 171 | 4677 | 4288 | 5038 | −333 | −2 | 108 | C |
| ATOM | 1423 | CG | TYR | A | 171 | 26.254 | 22.658 | 23.453 | 1.00 | 35.89 | | C |
| ANISOU | 1423 | CG | TYR | A | 171 | 4489 | 4244 | 4902 | −304 | −43 | 19 | C |
| ATOM | 1424 | CD1 | TYR | A | 171 | 27.347 | 21.842 | 23.758 | 1.00 | 34.19 | | C |
| ANISOU | 1424 | CD1 | TYR | A | 171 | 4176 | 4078 | 4737 | −330 | 12 | 7 | C |
| ATOM | 1425 | CD2 | TYR | A | 171 | 24.992 | 22.253 | 23.874 | 1.00 | 34.60 | | C |
| ANISOU | 1425 | CD2 | TYR | A | 171 | 4358 | 4103 | 4687 | −247 | −133 | −48 | C |
| ATOM | 1426 | CE1 | TYR | A | 171 | 27.177 | 20.657 | 24.460 | 1.00 | 35.43 | | C |
| ANISOU | 1426 | CE1 | TYR | A | 171 | 4280 | 4299 | 4882 | −300 | −27 | −67 | C |
| ATOM | 1427 | CE2 | TYR | A | 171 | 24.815 | 21.066 | 24.582 | 1.00 | 35.59 | | C |
| ANISOU | 1427 | CE2 | TYR | A | 171 | 4428 | 4292 | 4803 | −223 | −164 | −124 | C |
| ATOM | 1428 | CZ | TYR | A | 171 | 25.907 | 20.274 | 24.860 | 1.00 | 32.98 | | C |
| ANISOU | 1428 | CZ | TYR | A | 171 | 4012 | 4005 | 4512 | −248 | −111 | −131 | C |
| ATOM | 1429 | OH | TYR | A | 171 | 25.730 | 19.093 | 25.549 | 1.00 | 31.45 | | O |
| ANISOU | 1429 | OH | TYR | A | 171 | 3772 | 3868 | 4309 | −221 | −141 | −197 | O |
| ATOM | 1430 | N | LEU | A | 172 | 27.382 | 26.959 | 22.339 | 1.00 | 36.59 | | N |
| ANISOU | 1430 | N | LEU | A | 172 | 4688 | 4040 | 5173 | −460 | 56 | 263 | N |
| ATOM | 1431 | CA | LEU | A | 172 | 27.429 | 28.139 | 21.479 | 1.00 | 36.86 | | C |
| ANISOU | 1431 | CA | LEU | A | 172 | 4808 | 3987 | 5212 | −481 | 105 | 365 | C |
| ATOM | 1432 | C | LEU | A | 172 | 28.849 | 28.623 | 21.279 | 1.00 | 40.36 | | C |
| ANISOU | 1432 | C | LEU | A | 172 | 5184 | 4387 | 5762 | −572 | 212 | 437 | C |
| ATOM | 1433 | O | LEU | A | 172 | 29.169 | 29.173 | 20.221 | 1.00 | 42.92 | | O |
| ANISOU | 1433 | O | LEU | A | 172 | 5575 | 4671 | 6061 | −585 | 309 | 542 | O |
| ATOM | 1434 | CB | LEU | A | 172 | 26.586 | 29.276 | 22.056 | 1.00 | 36.61 | | C |
| ANISOU | 1434 | CB | LEU | A | 172 | 4825 | 3857 | 5229 | −478 | 8 | 347 | C |
| ATOM | 1435 | CG | LEU | A | 172 | 25.073 | 29.120 | 22.045 | 1.00 | 42.35 | | C |
| ANISOU | 1435 | CG | LEU | A | 172 | 5628 | 4599 | 5865 | −385 | −88 | 303 | C |
| ATOM | 1436 | CD1 | LEU | A | 172 | 24.458 | 30.089 | 23.066 | 1.00 | 34.92 | | C |
| ANISOU | 1436 | CD1 | LEU | A | 172 | 4689 | 3565 | 5013 | −391 | −178 | 252 | C |
| ATOM | 1437 | CD2 | LEU | A | 172 | 24.533 | 29.376 | 20.630 | 1.00 | 41.82 | | C |
| ANISOU | 1437 | CD2 | LEU | A | 172 | 5685 | 4522 | 5683 | −331 | −59 | 399 | C |
| ATOM | 1438 | N | GLU | A | 173 | 29.704 | 28.464 | 22.288 | 1.00 | 40.18 | | N |
| ANISOU | 1438 | N | GLU | A | 173 | 5031 | 4370 | 5865 | −637 | 196 | 386 | N |
| ATOM | 1439 | CA | GLU | A | 173 | 31.103 | 28.834 | 22.113 | 1.00 | 44.96 | | C |
| ANISOU | 1439 | CA | GLU | A | 173 | 5548 | 4940 | 6593 | −727 | 296 | 453 | C |
| ATOM | 1440 | C | GLU | A | 173 | 31.833 | 27.803 | 21.261 | 1.00 | 49.25 | | C |
| ANISOU | 1440 | C | GLU | A | 173 | 6055 | 5572 | 7087 | −706 | 427 | 496 | C |
| ATOM | 1441 | O | GLU | A | 173 | 32.589 | 28.163 | 20.348 | 1.00 | 48.82 | | O |
| ANISOU | 1441 | O | GLU | A | 173 | 6007 | 5489 | 7054 | −741 | 561 | 596 | O |
| ATOM | 1442 | CB | GLU | A | 173 | 31.785 | 28.998 | 23.477 | 1.00 | 46.41 | | C |
| ANISOU | 1442 | CB | GLU | A | 173 | 5601 | 5101 | 6932 | −804 | 217 | 383 | C |
| ATOM | 1443 | CG | GLU | A | 173 | 33.316 | 29.141 | 23.422 | 1.00 | 54.52 | | C |
| ANISOU | 1443 | CG | GLU | A | 173 | 6496 | 6111 | 8110 | −899 | 307 | 439 | C |
| ATOM | 1444 | CD | GLU | A | 173 | 33.792 | 30.450 | 22.807 | 0.00 | 61.76 | | C |
| ANISOU | 1444 | CD | GLU | A | 173 | 7441 | 6911 | 9114 | −974 | 384 | 542 | C |
| ATOM | 1445 | OE1 | GLU | A | 173 | 32.979 | 31.387 | 22.640 | 1.00 | 61.95 | | O |
| ANISOU | 1445 | OE1 | GLU | A | 173 | 7584 | 6852 | 9102 | −961 | 345 | 561 | O |
| ATOM | 1446 | OE2 | GLU | A | 173 | 34.997 | 30.542 | 22.484 | 0.73 | 67.08 | | O |
| ANISOU | 1446 | OE2 | GLU | A | 173 | 8014 | 7571 | 9903 | −1045 | 490 | 609 | O |
| ATOM | 1447 | N | ASN | A | 174 | 31.619 | 26.511 | 21.541 | 1.00 | 47.47 | | N |
| ANISOU | 1447 | N | ASN | A | 174 | 5794 | 5448 | 6795 | −648 | 398 | 422 | N |
| ATOM | 1448 | CA | ASN | A | 174 | 32.322 | 25.479 | 20.783 | 1.00 | 45.50 | | C |
| ANISOU | 1448 | CA | ASN | A | 174 | 5509 | 5275 | 6503 | −623 | 525 | 451 | C |
| ATOM | 1449 | C | ASN | A | 174 | 31.846 | 25.420 | 19.339 | 1.00 | 47.05 | | C |
| ANISOU | 1449 | C | ASN | A | 174 | 5856 | 5484 | 6539 | −564 | 618 | 521 | C |

TABLE 11-continued

| | | | | | | | | | | | | |
|---|---|---|---|---|---|---|---|---|---|---|---|---|
| ATOM | 1450 | O | ASN | A | 174 | 32.643 | 25.130 | 18.438 | 1.00 | 52.51 | | O |
| ANISOU | 1450 | O | ASN | A | 174 | 6545 | 6196 | 7211 | −567 | 769 | 588 | O |
| ATOM | 1451 | CB | ASN | A | 174 | 32.159 | 24.117 | 21.460 | 1.00 | 40.43 | | C |
| ANISOU | 1451 | CB | ASN | A | 174 | 4803 | 4727 | 5832 | −573 | 467 | 354 | C |
| ATOM | 1452 | CG | ASN | A | 174 | 32.946 | 24.025 | 22.748 | 1.00 | 45.85 | | C |
| ANISOU | 1452 | CG | ASN | A | 174 | 5333 | 5413 | 6676 | −633 | 402 | 304 | C |
| ATOM | 1453 | OD1 | ASN | A | 174 | 33.803 | 24.865 | 23.015 | 1.00 | 49.56 | | O |
| ANISOU | 1453 | OD1 | ASN | A | 174 | 5725 | 5820 | 7285 | −717 | 419 | 345 | O |
| ATOM | 1454 | ND2 | ASN | A | 174 | 32.665 | 23.015 | 23.550 | 1.00 | 43.51 | | N |
| ANISOU | 1454 | ND2 | ASN | A | 174 | 4992 | 5182 | 6358 | −593 | 322 | 218 | N |
| ATOM | 1455 | N | GLY | A | 175 | 30.565 | 25.682 | 19.103 | 1.00 | 47.03 | | N |
| ANISOU | 1455 | N | GLY | A | 175 | 5983 | 5469 | 6418 | −507 | 530 | 505 | N |
| ATOM | 1456 | CA | GLY | A | 175 | 30.016 | 25.681 | 17.765 | 1.00 | 43.71 | | C |
| ANISOU | 1456 | CA | GLY | A | 175 | 5718 | 5056 | 5833 | −449 | 587 | 569 | C |
| ATOM | 1457 | C | GLY | A | 175 | 29.794 | 27.072 | 17.218 | 1.00 | 50.24 | | C |
| ANISOU | 1457 | C | GLY | A | 175 | 6644 | 5784 | 6661 | −474 | 599 | 666 | C |
| ATOM | 1458 | O | GLY | A | 175 | 28.902 | 27.278 | 16.392 | 1.00 | 52.38 | | O |
| ANISOU | 1458 | O | GLY | A | 175 | 7062 | 6048 | 6794 | −415 | 573 | 702 | O |
| ATOM | 1459 | N | LYS | A | 176 | 30.615 | 28.032 | 17.658 | 1.00 | 46.95 | | N |
| ANISOU | 1459 | N | LYS | A | 176 | 6150 | 5286 | 6404 | −563 | 634 | 711 | N |
| ATOM | 1460 | CA | LYS | A | 176 | 30.375 | 29.427 | 17.305 | 1.00 | 56.02 | | C |
| ANISOU | 1460 | CA | LYS | A | 176 | 7387 | 6322 | 7578 | −592 | 632 | 797 | C |
| ATOM | 1461 | C | LYS | A | 176 | 30.352 | 29.631 | 15.794 | 1.00 | 66.30 | | C |
| ANISOU | 1461 | C | LYS | A | 176 | 8837 | 7615 | 8739 | −558 | 751 | 916 | C |
| ATOM | 1462 | O | LYS | A | 176 | 29.539 | 30.409 | 15.282 | 1.00 | 64.19 | | O |
| ANISOU | 1462 | O | LYS | A | 176 | 8704 | 7288 | 8398 | −525 | 704 | 972 | O |
| ATOM | 1463 | CB | LYS | A | 176 | 31.433 | 30.323 | 17.948 | 1.00 | 60.35 | | C |
| ANISOU | 1463 | CB | LYS | A | 176 | 7819 | 6782 | 8330 | −704 | 669 | 828 | C |
| ATOM | 1464 | CG | LYS | A | 176 | 32.863 | 29.988 | 17.555 | 1.00 | 66.36 | | C |
| ANISOU | 1464 | CG | LYS | A | 176 | 8478 | 7567 | 9170 | −764 | 834 | 887 | C |
| ATOM | 1465 | CD | LYS | A | 176 | 33.842 | 31.045 | 18.027 | 1.00 | 67.52 | | C |
| ANISOU | 1465 | CD | LYS | A | 176 | 8522 | 7609 | 9524 | −882 | 868 | 934 | C |
| ATOM | 1466 | CE | LYS | A | 176 | 33.862 | 31.148 | 19.534 | 0.00 | 71.40 | | C |
| ANISOU | 1466 | CE | LYS | A | 176 | 8895 | 8083 | 10153 | −929 | 716 | 823 | C |
| ATOM | 1467 | NZ | LYS | A | 176 | 35.036 | 31.924 | 20.017 | 1.00 | 78.87 | | N |
| ANISOU | 1467 | NZ | LYS | A | 176 | 9709 | 8944 | 11313 | −1053 | 749 | 856 | N |
| ATOM | 1468 | N | GLU | A | 177 | 31.217 | 28.922 | 15.061 | 1.00 | 72.24 | | N |
| ANISOU | 1468 | N | GLU | A | 177 | 9575 | 8427 | 9447 | −560 | 904 | 956 | N |
| ATOM | 1469 | CA | GLU | A | 177 | 31.354 | 29.172 | 13.630 | 1.00 | 77.05 | | C |
| ANISOU | 1469 | CA | GLU | A | 177 | 10332 | 9022 | 9921 | −537 | 1041 | 1077 | C |
| ATOM | 1470 | C | GLU | A | 177 | 30.139 | 28.722 | 12.832 | 1.00 | 74.67 | | C |
| ANISOU | 1470 | C | GLU | A | 177 | 10206 | 8771 | 9394 | −433 | 967 | 1065 | C |
| ATOM | 1471 | O | GLU | A | 177 | 29.985 | 29.136 | 11.679 | 1.00 | 78.33 | | O |
| ANISOU | 1471 | O | GLU | A | 177 | 10829 | 9209 | 9725 | −406 | 1038 | 1168 | O |
| ATOM | 1472 | CB | GLU | A | 177 | 32.618 | 28.497 | 13.093 | 1.00 | 79.32 | | C |
| ANISOU | 1472 | CB | GLU | A | 177 | 10554 | 9358 | 10224 | −563 | 1239 | 1116 | C |
| ATOM | 1473 | CG | GLU | A | 177 | 33.887 | 29.287 | 13.374 | 1.00 | 81.28 | | C |
| ANISOU | 1473 | CG | GLU | A | 177 | 10672 | 9530 | 10681 | −673 | 1355 | 1190 | C |
| ATOM | 1474 | CD | GLU | A | 177 | 33.716 | 30.772 | 13.088 | 0.00 | 86.60 | | C |
| ANISOU | 1474 | CD | GLU | A | 177 | 11433 | 10077 | 11395 | −720 | 1356 | 1297 | C |
| ATOM | 1475 | OE1 | GLU | A | 177 | 33.821 | 31.583 | 14.036 | 1.00 | 87.56 | | O |
| ANISOU | 1475 | OE1 | GLU | A | 177 | 11461 | 10118 | 11689 | −791 | 1268 | 1276 | O |
| ATOM | 1476 | OE2 | GLU | A | 177 | 33.460 | 31.127 | 11.917 | 1.00 | 91.25 | | O |
| ANISOU | 1476 | OE2 | GLU | A | 177 | 12193 | 10643 | 11837 | −684 | 1441 | 1401 | O |
| ATOM | 1477 | N | THR | A | 178 | 29.271 | 27.906 | 13.414 | 1.00 | 67.83 | | N |
| ANISOU | 1477 | N | THR | A | 178 | 9317 | 7971 | 8483 | −377 | 825 | 946 | N |
| ATOM | 1478 | CA | THR | A | 178 | 28.045 | 27.482 | 12.751 | 1.00 | 71.00 | | C |
| ANISOU | 1478 | CA | THR | A | 178 | 9867 | 8417 | 8693 | −284 | 728 | 925 | C |
| ATOM | 1479 | C | THR | A | 178 | 26.784 | 27.932 | 13.475 | 1.00 | 66.74 | | C |
| ANISOU | 1479 | C | THR | A | 178 | 9331 | 7844 | 8182 | −252 | 533 | 868 | C |
| ATOM | 1480 | O | THR | A | 178 | 25.816 | 28.329 | 12.825 | 1.00 | 69.92 | | O |
| ANISOU | 1480 | O | THR | A | 178 | 9870 | 8225 | 8472 | −195 | 455 | 909 | O |
| ATOM | 1481 | CB | THR | A | 178 | 28.029 | 25.951 | 12.593 | 1.00 | 72.12 | | C |
| ANISOU | 1481 | CB | THR | A | 178 | 9995 | 8673 | 8734 | −234 | 743 | 834 | C |
| ATOM | 1482 | OG1 | THR | A | 178 | 27.958 | 25.334 | 13.879 | 1.00 | 71.80 | | O |
| ANISOU | 1482 | OG1 | THR | A | 178 | 9798 | 8668 | 8813 | −247 | 654 | 716 | O |
| ATOM | 1483 | CG2 | THR | A | 178 | 29.293 | 25.477 | 11.897 | 1.00 | 79.84 | | C |
| ANISOU | 1483 | CG2 | THR | A | 178 | 10963 | 9680 | 9690 | −258 | 950 | 885 | C |
| ATOM | 1484 | N | LEU | A | 179 | 26.776 | 27.900 | 14.809 | 1.00 | 54.34 | | N |
| ANISOU | 1484 | N | LEU | A | 179 | 7617 | 6267 | 6764 | −285 | 454 | 778 | N |
| ATOM | 1485 | CA | LEU | A | 179 | 25.564 | 28.235 | 15.554 | 1.00 | 46.95 | | C |
| ANISOU | 1485 | CA | LEU | A | 179 | 6678 | 5303 | 5858 | −248 | 284 | 714 | C |
| ATOM | 1486 | C | LEU | A | 179 | 25.288 | 29.730 | 15.543 | 1.00 | 54.46 | | C |
| ANISOU | 1486 | C | LEU | A | 179 | 7685 | 6132 | 6875 | −267 | 252 | 793 | C |
| ATOM | 1487 | O | LEU | A | 179 | 24.126 | 30.153 | 15.531 | 1.00 | 52.20 | | O |
| ANISOU | 1487 | O | LEU | A | 179 | 7466 | 5814 | 6555 | −209 | 133 | 788 | O |
| ATOM | 1488 | CB | LEU | A | 179 | 25.684 | 27.735 | 16.991 | 1.00 | 43.18 | | C |
| ANISOU | 1488 | CB | LEU | A | 179 | 6044 | 4854 | 5507 | −276 | 223 | 595 | C |
| ATOM | 1489 | CG | LEU | A | 179 | 25.657 | 26.221 | 17.133 | 1.00 | 44.21 | | C |
| ANISOU | 1489 | CG | LEU | A | 179 | 6125 | 5097 | 5574 | −242 | 220 | 506 | C |

TABLE 11-continued

| | | | | | | | | | | | |
|---|---|---|---|---|---|---|---|---|---|---|---|
| ATOM | 1490 | CD1 | LEU | A | 179 | 25.936 | 25.795 | 18.575 | 1.00 | 43.29 | C |
| ANISOU | 1490 | CD1 | LEU | A | 179 | 5858 | 5002 | 5588 | −276 | 172 | 405 | C |
| ATOM | 1491 | CD2 | LEU | A | 179 | 24.296 | 25.733 | 16.684 | 1.00 | 40.04 | C |
| ANISOU | 1491 | CD2 | LEU | A | 179 | 5690 | 4610 | 4913 | −156 | 112 | 470 | C |
| ATOM | 1492 | N | GLN | A | 180 | 26.339 | 30.546 | 15.566 | 1.00 | 52.03 | N |
| ANISOU | 1492 | N | GLN | A | 180 | 7344 | 5749 | 6675 | −348 | 356 | 866 | N |
| ATOM | 1493 | CA | GLN | A | 180 | 26.194 | 31.989 | 15.651 | 1.00 | 62.20 | C |
| ANISOU | 1493 | CA | GLN | A | 180 | 8676 | 6906 | 8052 | −378 | 334 | 938 | C |
| ATOM | 1494 | C | GLN | A | 180 | 26.206 | 32.658 | 14.286 | 1.00 | 70.85 | C |
| ANISOU | 1494 | C | GLN | A | 180 | 9929 | 7949 | 9041 | −360 | 413 | 1085 | C |
| ATOM | 1495 | O | GLN | A | 180 | 26.395 | 33.876 | 14.204 | 1.00 | 80.51 | O |
| ANISOU | 1495 | O | GLN | A | 180 | 11190 | 9053 | 10346 | −400 | 438 | 1171 | O |
| ATOM | 1496 | CB | GLN | A | 180 | 27.288 | 32.567 | 16.545 | 1.00 | 57.28 | C |
| ANISOU | 1496 | CB | GLN | A | 180 | 7925 | 6215 | 7624 | −486 | 387 | 929 | C |
| ATOM | 1497 | CG | GLN | A | 180 | 27.358 | 31.875 | 17.898 | 1.00 | 56.44 | C |
| ANISOU | 1497 | CG | GLN | A | 180 | 7674 | 6164 | 7608 | −505 | 309 | 788 | C |
| ATOM | 1498 | CD | GLN | A | 180 | 28.179 | 32.647 | 18.900 | 1.00 | 57.04 | C |
| ANISOU | 1498 | CD | GLN | A | 180 | 7642 | 6154 | 7876 | −606 | 310 | 768 | C |
| ATOM | 1499 | OE1 | GLN | A | 180 | 28.051 | 33.869 | 19.008 | 1.00 | 60.28 | O |
| ANISOU | 1499 | OE1 | GLN | A | 180 | 8095 | 6442 | 8366 | −638 | 289 | 812 | O |
| ATOM | 1500 | NE2 | GLN | A | 180 | 29.029 | 31.941 | 19.645 | 1.00 | 51.03 | N |
| ANISOU | 1500 | NE2 | GLN | A | 180 | 6742 | 5452 | 7195 | −656 | 327 | 701 | N |
| ATOM | 1501 | N | ARG | A | 181 | 26.000 | 31.894 | 13.221 | 1.00 | 75.59 | N |
| ANISOU | 1501 | N | ARG | A | 181 | 10631 | 8632 | 9457 | −300 | 450 | 1116 | N |
| ATOM | 1502 | CA | ARG | A | 181 | 25.895 | 32.430 | 11.874 | 1.00 | 77.93 | C |
| ANISOU | 1502 | CA | ARG | A | 181 | 11103 | 8891 | 9615 | −269 | 512 | 1254 | C |
| ATOM | 1503 | C | ARG | A | 181 | 24.455 | 32.828 | 11.571 | 1.00 | 74.51 | C |
| ANISOU | 1503 | C | ARG | A | 181 | 10788 | 8431 | 9092 | −179 | 350 | 1266 | C |
| ATOM | 1504 | O | ARG | A | 181 | 23.500 | 32.326 | 12.170 | 1.00 | 72.16 | O |
| ANISOU | 1504 | O | ARG | A | 181 | 10443 | 8179 | 8794 | −126 | 206 | 1160 | O |
| ATOM | 1505 | CB | ARG | A | 181 | 26.362 | 31.399 | 10.844 | 1.00 | 81.30 | C |
| ANISOU | 1505 | CB | ARG | A | 181 | 11601 | 9419 | 9871 | −244 | 629 | 1275 | C |
| ATOM | 1506 | CG | ARG | A | 181 | 25.281 | 30.386 | 10.453 | 1.00 | 79.14 | C |
| ANISOU | 1506 | CG | ARG | A | 181 | 11404 | 9244 | 9420 | −147 | 508 | 1201 | C |
| ATOM | 1507 | CD | ARG | A | 181 | 25.822 | 29.281 | 9.556 | 1.00 | 82.28 | C |
| ANISOU | 1507 | CD | ARG | A | 181 | 11865 | 9739 | 9658 | −127 | 629 | 1199 | C |
| ATOM | 1508 | NE | ARG | A | 181 | 24.759 | 28.417 | 9.048 | 1.00 | 81.74 | N |
| ANISOU | 1508 | NE | ARG | A | 181 | 11897 | 9750 | 9412 | −40 | 506 | 1137 | N |
| ATOM | 1509 | CZ | ARG | A | 181 | 24.253 | 27.381 | 9.710 | 1.00 | 79.26 | C |
| ANISOU | 1509 | CZ | ARG | A | 181 | 11491 | 9512 | 9112 | −14 | 407 | 1001 | C |
| ATOM | 1510 | NH1 | ARG | A | 181 | 23.287 | 26.651 | 9.169 | 1.00 | 81.47 | N |
| ANISOU | 1510 | NH1 | ARG | A | 181 | 11866 | 9854 | 9236 | 59 | 294 | 952 | N |
| ATOM | 1511 | NH2 | ARG | A | 181 | 24.711 | 27.075 | 10.914 | 1.00 | 78.09 | N |
| ANISOU | 1511 | NH2 | ARG | A | 181 | 11159 | 9375 | 9136 | −62 | 414 | 916 | N |
| ATOM | 1512 | N | THR | A | 182 | 24.312 | 33.749 | 10.626 | 1.00 | 73.09 | N |
| ANISOU | 1512 | N | THR | A | 182 | 10758 | 8172 | 8840 | −161 | 377 | 1405 | N |
| ATOM | 1513 | CA | THR | A | 182 | 23.041 | 34.025 | 9.980 | 1.00 | 75.60 | C |
| ANISOU | 1513 | CA | THR | A | 182 | 11217 | 8477 | 9032 | −64 | 238 | 1446 | C |
| ATOM | 1514 | C | THR | A | 182 | 23.233 | 33.882 | 8.480 | 1.00 | 80.76 | C |
| ANISOU | 1514 | C | THR | A | 182 | 12057 | 9159 | 9469 | −31 | 323 | 1564 | C |
| ATOM | 1515 | O | THR | A | 182 | 24.241 | 34.336 | 7.928 | 1.00 | 86.62 | O |
| ANISOU | 1515 | O | THR | A | 182 | 12850 | 9856 | 10207 | −88 | 493 | 1672 | O |
| ATOM | 1516 | CB | THR | A | 182 | 22.515 | 35.430 | 10.308 | 1.00 | 74.70 | C |
| ANISOU | 1516 | CB | THR | A | 182 | 11126 | 8220 | 9038 | −59 | 162 | 1509 | C |
| ATOM | 1517 | OG1 | THR | A | 182 | 23.540 | 36.394 | 10.052 | 1.00 | 79.10 | O |
| ANISOU | 1517 | OG1 | THR | A | 182 | 11711 | 8671 | 9671 | −138 | 311 | 1628 | O |
| ATOM | 1518 | CG2 | THR | A | 182 | 22.077 | 35.521 | 11.762 | 1.00 | 71.37 | C |
| ANISOU | 1518 | CG2 | THR | A | 182 | 10546 | 7774 | 8798 | −70 | 56 | 1379 | C |
| ATOM | 1519 | N | ASP | A | 183 | 22.278 | 33.227 | 7.827 | 1.00 | 78.18 | N |
| ANISOU | 1519 | N | ASP | A | 183 | 11834 | 8907 | 8963 | 57 | 207 | 1540 | N |
| ATOM | 1520 | CA | ASP | A | 183 | 22.252 | 33.107 | 6.375 | 1.00 | 79.00 | C |
| ANISOU | 1520 | CA | ASP | A | 183 | 12146 | 9038 | 8831 | 104 | 252 | 1646 | C |
| ATOM | 1521 | C | ASP | A | 183 | 20.982 | 33.772 | 5.868 | 1.00 | 77.01 | C |
| ANISOU | 1521 | C | ASP | A | 183 | 12024 | 8736 | 8499 | 191 | 72 | 1712 | C |
| ATOM | 1522 | O | ASP | A | 183 | 19.877 | 33.392 | 6.272 | 1.00 | 71.36 | O |
| ANISOU | 1522 | O | ASP | A | 183 | 11259 | 8058 | 7795 | 250 | −112 | 1620 | O |
| ATOM | 1523 | CB | ASP | A | 183 | 22.315 | 31.644 | 5.936 | 1.00 | 79.23 | C |
| ANISOU | 1523 | CB | ASP | A | 183 | 12201 | 9206 | 8699 | 131 | 271 | 1555 | C |
| ATOM | 1524 | CG | ASP | A | 183 | 23.600 | 30.967 | 6.360 | 1.00 | 80.18 | C |
| ANISOU | 1524 | CG | ASP | A | 183 | 12194 | 9373 | 8897 | 55 | 455 | 1500 | C |
| ATOM | 1525 | OD1 | ASP | A | 183 | 24.608 | 31.680 | 6.551 | 1.00 | 83.43 | O |
| ANISOU | 1525 | OD1 | ASP | A | 183 | 12554 | 9713 | 9431 | −20 | 605 | 1575 | O |
| ATOM | 1526 | OD2 | ASP | A | 183 | 23.603 | 29.725 | 6.502 | 1.00 | 77.52 | O |
| ANISOU | 1526 | OD2 | ASP | A | 183 | 11807 | 9140 | 8509 | 70 | 447 | 1385 | O |
| ATOM | 1527 | N | ALA | A | 184 | 21.143 | 34.773 | 4.998 | 1.00 | 78.99 | N |
| ANISOU | 1527 | N | ALA | A | 184 | 12435 | 8899 | 8679 | 198 | 127 | 1877 | N |
| ATOM | 1528 | CA | ALA | A | 184 | 20.013 | 35.513 | 4.464 | 1.00 | 77.07 | C |
| ANISOU | 1528 | CA | ALA | A | 184 | 12323 | 8595 | 8366 | 283 | −40 | 1963 | C |
| ATOM | 1529 | C | ALA | A | 184 | 19.330 | 34.724 | 3.346 | 1.00 | 77.13 | C |
| ANISOU | 1529 | C | ALA | A | 184 | 12498 | 8699 | 8107 | 367 | −139 | 1968 | C |

TABLE 11-continued

| | | | | | | | | | | | |
|---|---|---|---|---|---|---|---|---|---|---|---|
| ATOM | 1530 | O | ALA | A | 184 | 19.969 | 33.914 | 2.666 | 1.00 | 76.39 | O |
| ANISOU | 1530 | O | ALA | A | 184 | 12486 | 8688 | 7849 | 352 | −21 | 1961 | O |
| ATOM | 1531 | CB | ALA | A | 184 | 20.471 | 36.870 | 3.936 | 1.00 | 77.27 | C |
| ANISOU | 1531 | CB | ALA | A | 184 | 12467 | 8482 | 8411 | 260 | 59 | 2146 | C |
| ATOM | 1532 | N | PRO | A | 185 | 18.019 | 34.937 | 3.143 | 1.00 | 80.48 | N |
| ANISOU | 1532 | N | PRO | A | 185 | 12977 | 9114 | 8489 | 457 | −361 | 1975 | N |
| ATOM | 1533 | CA | PRO | A | 185 | 17.304 | 34.208 | 2.082 | 1.00 | 84.92 | C |
| ANISOU | 1533 | CA | PRO | A | 185 | 13701 | 9765 | 8800 | 534 | −486 | 1975 | C |
| ATOM | 1534 | C | PRO | A | 185 | 17.771 | 34.583 | 0.684 | 1.00 | 91.60 | C |
| ANISOU | 1534 | C | PRO | A | 185 | 14804 | 10591 | 9410 | 550 | −388 | 2139 | C |
| ATOM | 1535 | O | PRO | A | 185 | 18.812 | 35.223 | 0.514 | 1.00 | 94.39 | O |
| ANISOU | 1535 | O | PRO | A | 185 | 15198 | 10876 | 9790 | 489 | −184 | 2244 | O |
| ATOM | 1536 | CB | PRO | A | 185 | 15.837 | 34.611 | 2.300 | 1.00 | 83.28 | C |
| ANISOU | 1536 | CB | PRO | A | 185 | 13464 | 9523 | 8654 | 621 | −745 | 1966 | C |
| ATOM | 1537 | CG | PRO | A | 185 | 15.773 | 35.146 | 3.699 | 1.00 | 79.35 | C |
| ANISOU | 1537 | CG | PRO | A | 185 | 12749 | 8954 | 8447 | 586 | −746 | 1901 | C |
| ATOM | 1538 | CD | PRO | A | 185 | 17.110 | 35.756 | 3.965 | 1.00 | 79.55 | C |
| ANISOU | 1538 | CD | PRO | A | 185 | 12753 | 8907 | 8565 | 492 | −515 | 1964 | C |
| ATOM | 1539 | N | LYS | A | 186 | 16.999 | 34.195 | −0.329 | 1.00 | 97.26 | N |
| ANISOU | 1539 | N | LYS | A | 186 | 15699 | 11364 | 9894 | 629 | −533 | 2164 | N |
| ATOM | 1540 | CA | LYS | A | 186 | 17.324 | 34.493 | −1.716 | 1.00 | 99.94 | C |
| ANISOU | 1540 | CA | LYS | A | 186 | 16310 | 11690 | 9971 | 656 | −460 | 2318 | C |
| ATOM | 1541 | C | LYS | A | 186 | 16.099 | 35.044 | −2.428 | 1.00 | 104.10 | C |
| ANISOU | 1541 | C | LYS | A | 186 | 16991 | 12183 | 10381 | 758 | −703 | 2411 | C |
| ATOM | 1542 | O | LYS | A | 186 | 14.973 | 34.602 | −2.181 | 1.00 | 105.67 | O |
| ANISOU | 1542 | O | LYS | A | 186 | 17118 | 12428 | 10603 | 816 | −938 | 2315 | O |
| ATOM | 1543 | CB | LYS | A | 186 | 17.827 | 33.245 | −2.454 | 1.00 | 94.70 | C |
| ANISOU | 1543 | CB | LYS | A | 186 | 15761 | 11150 | 9072 | 648 | −365 | 2249 | C |
| ATOM | 1544 | CG | LYS | A | 186 | 19.056 | 32.608 | −1.838 | 1.00 | 91.30 | C |
| ANISOU | 1544 | CG | LYS | A | 186 | 15183 | 10759 | 8748 | 558 | −125 | 2160 | C |
| ATOM | 1545 | CD | LYS | A | 186 | 20.204 | 33.595 | −1.758 | 1.00 | 91.41 | C |
| ANISOU | 1545 | CD | LYS | A | 186 | 15189 | 10673 | 8871 | 486 | 115 | 2293 | C |
| ATOM | 1546 | CE | LYS | A | 186 | 21.432 | 32.966 | −1.123 | 1.00 | 94.03 | C |
| ANISOU | 1546 | CE | LYS | A | 186 | 15355 | 11044 | 9327 | 397 | 341 | 2207 | C |
| ATOM | 1547 | NZ | LYS | A | 186 | 22.006 | 31.890 | −1.980 | 1.00 | 95.53 | N |
| ANISOU | 1547 | NZ | LYS | A | 186 | 15674 | 11334 | 9288 | 404 | 476 | 2172 | N |
| ATOM | 1548 | N | THR | A | 187 | 16.319 | 36.010 | −3.311 | 1.00 | 109.24 | N |
| ANISOU | 1548 | N | THR | A | 187 | 17846 | 12749 | 10910 | 780 | −647 | 2602 | N |
| ATOM | 1549 | CA | THR | A | 187 | 15.257 | 36.416 | −4.217 | 1.00 | 121.95 | C |
| ANISOU | 1549 | CA | THR | A | 187 | 19647 | 14340 | 12350 | 883 | −872 | 2705 | C |
| ATOM | 1550 | C | THR | A | 187 | 14.993 | 35.305 | −5.224 | 1.00 | 120.95 | C |
| ANISOU | 1550 | C | THR | A | 187 | 19648 | 14355 | 11953 | 914 | −941 | 2627 | C |
| ATOM | 1551 | O | THR | A | 187 | 15.920 | 34.631 | −5.684 | 1.00 | 119.61 | O |
| ANISOU | 1551 | O | THR | A | 187 | 19561 | 14251 | 11635 | 867 | −746 | 2600 | O |
| ATOM | 1552 | CB | THR | A | 187 | 15.624 | 37.708 | −4.950 | 1.00 | 135.46 | C |
| ANISOU | 1552 | CB | THR | A | 187 | 21496 | 15943 | 14028 | 885 | −770 | 2907 | C |
| ATOM | 1553 | OG1 | THR | A | 187 | 16.821 | 37.506 | −5.713 | 1.00 | 139.83 | O |
| ANISOU | 1553 | OG1 | THR | A | 187 | 22174 | 16531 | 14424 | 823 | −507 | 2960 | O |
| ATOM | 1554 | CG2 | THR | A | 187 | 15.835 | 38.848 | −3.964 | 1.00 | 137.34 | C |
| ANISOU | 1554 | CG2 | THR | A | 187 | 21621 | 16022 | 14540 | 855 | −713 | 2983 | C |
| ATOM | 1555 | N | HIS | A | 188 | 13.715 | 35.113 | −5.555 | 1.00 | 121.97 | N |
| ANISOU | 1555 | N | HIS | A | 188 | 19764 | 14534 | 12046 | 987 | −1215 | 2577 | N |
| ATOM | 1556 | CA | HIS | A | 188 | 13.303 | 34.135 | −6.556 | 1.00 | 122.96 | C |
| ANISOU | 1556 | CA | HIS | A | 188 | 19989 | 14786 | 11942 | 1013 | −1314 | 2491 | C |
| ATOM | 1557 | C | HIS | A | 188 | 11.811 | 34.286 | −6.830 | 1.00 | 118.24 | C |
| ANISOU | 1557 | C | HIS | A | 188 | 19349 | 14207 | 11370 | 1092 | −1626 | 2473 | C |
| ATOM | 1558 | O | HIS | A | 188 | 10.987 | 34.126 | −5.924 | 1.00 | 113.62 | O |
| ANISOU | 1558 | O | HIS | A | 188 | 18587 | 13615 | 10968 | 1117 | −1798 | 2387 | O |
| ATOM | 1559 | CB | HIS | A | 188 | 13.632 | 32.714 | −6.094 | 1.00 | 127.29 | C |
| ANISOU | 1559 | CB | HIS | A | 188 | 20475 | 15434 | 12455 | 973 | −1266 | 2314 | C |
| ATOM | 1560 | CG | HIS | A | 188 | 13.546 | 31.687 | −7.178 | 1.00 | 132.05 | C |
| ANISOU | 1560 | CG | HIS | A | 188 | 21207 | 16154 | 12812 | 981 | −1293 | 2228 | C |
| ATOM | 1561 | ND1 | HIS | A | 188 | 14.126 | 31.862 | −8.416 | 1.00 | 135.27 | N |
| ANISOU | 1561 | ND1 | HIS | A | 188 | 21814 | 16579 | 13005 | 977 | −1158 | 2314 | N |
| ATOM | 1562 | CD2 | HIS | A | 188 | 12.957 | 30.468 | −7.208 | 1.00 | 132.01 | C |
| ANISOU | 1562 | CD2 | HIS | A | 188 | 21160 | 16247 | 12749 | 990 | −1436 | 2060 | C |
| ATOM | 1563 | CE1 | HIS | A | 188 | 13.892 | 30.798 | −9.164 | 1.00 | 136.81 | C |
| ANISOU | 1563 | CE1 | HIS | A | 188 | 22092 | 16875 | 13015 | 987 | −1220 | 2200 | C |
| ATOM | 1564 | NE2 | HIS | A | 188 | 13.185 | 29.937 | −8.454 | 1.00 | 134.52 | N |
| ANISOU | 1564 | NE2 | HIS | A | 188 | 21657 | 16634 | 12820 | 992 | −1388 | 2045 | N |
| ATOM | 1565 | N | MET | A | 189 | 11.455 | 34.603 | −8.070 | 1.00 | 119.38 | N |
| ANISOU | 1565 | N | MET | A | 189 | 19648 | 14372 | 11339 | 1132 | −1697 | 2554 | N |
| ATOM | 1566 | CA | MET | A | 189 | 10.078 | 34.886 | −8.443 | 1.00 | 123.81 | C |
| ANISOU | 1566 | CA | MET | A | 189 | 20178 | 14942 | 11923 | 1208 | −1982 | 2563 | C |
| ATOM | 1567 | C | MET | A | 189 | 9.508 | 33.751 | −9.281 | 1.00 | 129.05 | C |
| ANISOU | 1567 | C | MET | A | 189 | 20908 | 15730 | 12394 | 1222 | −2126 | 2441 | C |
| ATOM | 1568 | O | MET | A | 189 | 10.194 | 33.199 | −10.148 | 1.00 | 129.91 | O |
| ANISOU | 1568 | O | MET | A | 189 | 21186 | 15899 | 12276 | 1193 | −1997 | 2429 | O |
| ATOM | 1569 | CB | MET | A | 189 | 9.981 | 36.202 | −9.216 | 1.00 | 124.68 | C |
| ANISOU | 1569 | CB | MET | A | 189 | 20409 | 14971 | 11994 | 1250 | −1984 | 2758 | C |

TABLE 11-continued

| | | | | | | | | | | | | |
|---|---|---|---|---|---|---|---|---|---|---|---|---|
| ATOM | 1570 | CG | MET | A | 189 | 9.476 | 37.364 | −8.382 | 1.00 | 124.78 | | C |
| ANISOU | 1570 | CG | MET | A | 189 | 20281 | 14859 | 12268 | 1288 | −2059 | 2845 | C |
| ATOM | 1571 | SD | MET | A | 189 | 7.789 | 37.098 | −7.804 | 1.00 | 125.60 | | S |
| ANISOU | 1571 | SD | MET | A | 189 | 20174 | 14991 | 12557 | 1362 | −2396 | 2734 | S |
| ATOM | 1572 | CE | MET | A | 189 | 6.900 | 37.080 | −9.361 | 1.00 | 127.97 | | C |
| ANISOU | 1572 | CE | MET | A | 189 | 20628 | 15362 | 12631 | 1426 | −2597 | 2786 | C |
| ATOM | 1573 | N | THR | A | 190 | 8.247 | 33.412 | −9.018 | 1.00 | 131.14 | | N |
| ANISOU | 1573 | N | THR | A | 190 | 21036 | 16027 | 12762 | 1264 | −2389 | 2351 | N |
| ATOM | 1574 | CA | THR | A | 190 | 7.548 | 32.378 | −9.767 | 1.00 | 131.21 | | C |
| ANISOU | 1574 | CA | THR | A | 190 | 21088 | 16143 | 12624 | 1274 | −2558 | 2232 | C |
| ATOM | 1575 | C | THR | A | 190 | 6.141 | 32.866 | −10.080 | 1.00 | 130.07 | | C |
| ANISOU | 1575 | C | THR | A | 190 | 20880 | 15988 | 12553 | 1346 | −2840 | 2269 | C |
| ATOM | 1576 | O | THR | A | 190 | 5.447 | 33.386 | −9.200 | 1.00 | 129.44 | | O |
| ANISOU | 1576 | O | THR | A | 190 | 20611 | 15852 | 12717 | 1379 | −2950 | 2277 | O |
| ATOM | 1577 | CB | THR | A | 190 | 7.519 | 31.050 | −8.990 | 1.00 | 130.11 | | C |
| ANISOU | 1577 | CB | THR | A | 190 | 20811 | 16074 | 12553 | 1229 | −2572 | 2033 | C |
| ATOM | 1578 | OG1 | THR | A | 190 | 6.791 | 30.065 | −9.734 | 1.00 | 133.35 | | O |
| ANISOU | 1578 | OG1 | THR | A | 190 | 21259 | 16574 | 12835 | 1235 | −2743 | 1918 | O |
| ATOM | 1579 | CG2 | THR | A | 190 | 6.888 | 31.223 | −7.607 | 1.00 | 125.72 | | C |
| ANISOU | 1579 | CG2 | THR | A | 190 | 19996 | 15473 | 12298 | 1241 | −2674 | 1982 | C |
| ATOM | 1580 | N | HIS | A | 191 | 5.735 | 32.721 | −11.338 | 1.00 | 127.36 | | N |
| ANISOU | 1580 | N | HIS | A | 191 | 20695 | 15695 | 11999 | 1373 | −2951 | 2293 | N |
| ATOM | 1581 | CA | HIS | A | 191 | 4.420 | 33.174 | −11.776 | 1.00 | 123.53 | | C |
| ANISOU | 1581 | CA | HIS | A | 191 | 20168 | 15207 | 11562 | 1443 | −3220 | 2337 | C |
| ATOM | 1582 | C | HIS | A | 191 | 3.350 | 32.139 | −11.445 | 1.00 | 122.52 | | C |
| ANISOU | 1582 | C | HIS | A | 191 | 19871 | 15148 | 11534 | 1440 | −3440 | 2163 | C |
| ATOM | 1583 | O | HIS | A | 191 | 2.155 | 32.405 | −11.567 | 1.00 | 125.67 | | O |
| ANISOU | 1583 | O | HIS | A | 191 | 20173 | 15543 | 12031 | 1493 | −3673 | 2175 | O |
| ATOM | 1584 | CB | HIS | A | 191 | 4.426 | 33.471 | −13.278 | 1.00 | 124.24 | | C |
| ANISOU | 1584 | CB | HIS | A | 191 | 20506 | 15319 | 11379 | 1472 | −3254 | 2442 | C |
| ATOM | 1585 | CG | HIS | A | 191 | 4.706 | 32.274 | −14.133 | 1.00 | 123.80 | | C |
| ANISOU | 1585 | CG | HIS | A | 191 | 20604 | 15362 | 11074 | 1433 | −3238 | 2326 | C |
| ATOM | 1586 | ND1 | HIS | A | 191 | 3.779 | 31.276 | −14.344 | 1.00 | 123.52 | | N |
| ANISOU | 1586 | ND1 | HIS | A | 191 | 20507 | 15401 | 11023 | 1432 | −3453 | 2180 | N |
| ATOM | 1587 | CD2 | HIS | A | 191 | 5.808 | 31.919 | −14.836 | 1.00 | 123.80 | | C |
| ANISOU | 1587 | CD2 | HIS | A | 191 | 20813 | 15392 | 10835 | 1394 | −3026 | 2334 | C |
| ATOM | 1588 | CE1 | HIS | A | 191 | 4.299 | 30.356 | −15.138 | 1.00 | 124.14 | | C |
| ANISOU | 1588 | CE1 | HIS | A | 191 | 20758 | 15547 | 10862 | 1395 | −3378 | 2100 | C |
| ATOM | 1589 | NE2 | HIS | A | 191 | 5.529 | 30.722 | −15.451 | 1.00 | 124.39 | | N |
| ANISOU | 1589 | NE2 | HIS | A | 191 | 20955 | 15555 | 10754 | 1374 | −3117 | 2190 | N |
| ATOM | 1590 | N | CYS | A | 203 | 7.206 | 33.606 | −5.365 | 1.00 | 90.51 | | N |
| ANISOU | 1590 | N | CYS | A | 203 | 15282 | 10763 | 8346 | 1271 | −2542 | 2182 | N |
| ATOM | 1591 | CA | CYS | A | 203 | 8.099 | 34.258 | −4.412 | 1.00 | 89.61 | | C |
| ANISOU | 1591 | CA | CYS | A | 203 | 15124 | 10549 | 8373 | 1238 | −2352 | 2241 | C |
| ATOM | 1592 | C | CYS | A | 203 | 8.783 | 33.227 | −3.513 | 1.00 | 94.82 | | C |
| ANISOU | 1592 | C | CYS | A | 203 | 15704 | 11256 | 9068 | 1173 | −2235 | 2104 | C |
| ATOM | 1593 | O | CYS | A | 203 | 8.205 | 32.771 | −2.525 | 1.00 | 85.46 | | O |
| ANISOU | 1593 | O | CYS | A | 203 | 14328 | 10082 | 8059 | 1179 | −2342 | 1989 | O |
| ATOM | 1594 | CB | CYS | A | 203 | 7.327 | 35.282 | −3.568 | 1.00 | 93.54 | | C |
| ANISOU | 1594 | CB | CYS | A | 203 | 15458 | 10939 | 9143 | 1292 | −2463 | 2293 | C |
| ATOM | 1595 | SG | CYS | A | 203 | 8.347 | 36.220 | −2.387 | 1.00 | 101.84 | | S |
| ANISOU | 1595 | SG | CYS | A | 203 | 16460 | 11842 | 10392 | 1251 | −2246 | 2370 | S |
| ATOM | 1596 | N | TRP | A | 204 | 10.016 | 32.867 | −3.860 | 1.00 | 99.46 | | N |
| ANISOU | 1596 | N | TRP | A | 204 | 16430 | 11869 | 9491 | 1114 | −2008 | 2119 | N |
| ATOM | 1597 | CA | TRP | A | 204 | 10.780 | 31.861 | −3.136 | 1.00 | 101.95 | | C |
| ANISOU | 1597 | CA | TRP | A | 204 | 16670 | 12239 | 9829 | 1046 | −1864 | 1990 | C |
| ATOM | 1598 | C | TRP | A | 204 | 11.798 | 32.509 | −2.201 | 1.00 | 96.62 | | C |
| ANISOU | 1598 | C | TRP | A | 204 | 15856 | 11490 | 9366 | 974 | −1614 | 2015 | C |
| ATOM | 1599 | O | TRP | A | 204 | 12.324 | 33.591 | −2.473 | 1.00 | 98.44 | | O |
| ANISOU | 1599 | O | TRP | A | 204 | 16183 | 11626 | 9595 | 971 | −1500 | 2170 | O |
| ATOM | 1600 | CB | TRP | A | 204 | 11.512 | 30.928 | −4.104 | 1.00 | 110.31 | | C |
| ANISOU | 1600 | CB | TRP | A | 204 | 17914 | 13389 | 10608 | 1015 | −1741 | 1954 | C |
| ATOM | 1601 | CG | TRP | A | 204 | 10.662 | 29.881 | −4.761 | 1.00 | 119.94 | | C |
| ANISOU | 1601 | CG | TRP | A | 204 | 19145 | 14718 | 11709 | 1037 | −1925 | 1826 | C |
| ATOM | 1602 | CD1 | TRP | A | 204 | 9.571 | 30.084 | −5.557 | 1.00 | 123.39 | | C |
| ANISOU | 1602 | CD1 | TRP | A | 204 | 19611 | 15174 | 12096 | 1091 | −2142 | 1844 | C |
| ATOM | 1603 | CD2 | TRP | A | 204 | 10.859 | 28.462 | −4.703 | 1.00 | 121.96 | | C |
| ANISOU | 1603 | CD2 | TRP | A | 204 | 19383 | 15071 | 11884 | 1001 | −1901 | 1660 | C |
| ATOM | 1604 | NE1 | TRP | A | 204 | 9.067 | 28.876 | −5.984 | 1.00 | 124.48 | | N |
| ANISOU | 1604 | NE1 | TRP | A | 204 | 19750 | 15412 | 12135 | 1084 | −2258 | 1698 | N |
| ATOM | 1605 | CE2 | TRP | A | 204 | 9.842 | 27.866 | −5.474 | 1.00 | 123.80 | | C |
| ANISOU | 1605 | CE2 | TRP | A | 204 | 19636 | 15373 | 12029 | 1030 | −2112 | 1582 | C |
| ATOM | 1606 | CE3 | TRP | A | 204 | 11.793 | 27.636 | −4.066 | 1.00 | 118.55 | | C |
| ANISOU | 1606 | CE3 | TRP | A | 204 | 18917 | 14672 | 11454 | 946 | −1721 | 1571 | C |
| ATOM | 1607 | CZ2 | TRP | A | 204 | 9.732 | 26.482 | −5.624 | 1.00 | 122.78 | | C |
| ANISOU | 1607 | CZ2 | TRP | A | 204 | 19496 | 15334 | 11820 | 1002 | −2146 | 1415 | C |
| ATOM | 1608 | CZ3 | TRP | A | 204 | 11.683 | 26.262 | −4.219 | 1.00 | 116.51 | | C |
| ANISOU | 1608 | CZ3 | TRP | A | 204 | 18649 | 14509 | 11111 | 926 | −1755 | 1406 | C |
| ATOM | 1609 | CH2 | TRP | A | 204 | 10.661 | 25.700 | −4.990 | 1.00 | 118.31 | | C |
| ANISOU | 1609 | CH2 | TRP | A | 204 | 18899 | 14794 | 11259 | 952 | −1964 | 1329 | C |

TABLE 11-continued

| | | | | | | | | | | | | |
|---|---|---|---|---|---|---|---|---|---|---|---|---|
| ATOM | 1610 | N | ALA | A | 205 | 12.079 | 31.820 | -1.096 | 1.00 | 87.87 | | N |
| ANISOU | 1610 | N | ALA | A | 205 | 14523 | 10423 | 8440 | 914 | -1535 | 1861 | N |
| ATOM | 1611 | CA | ALA | A | 205 | 13.121 | 32.206 | -0.148 | 1.00 | 78.70 | | C |
| ANISOU | 1611 | CA | ALA | A | 205 | 13218 | 9211 | 7473 | 834 | -1304 | 1854 | C |
| ATOM | 1612 | C | ALA | A | 205 | 13.924 | 30.954 | 0.179 | 1.00 | 76.08 | | C |
| ANISOU | 1612 | C | ALA | A | 205 | 12812 | 8977 | 7118 | 765 | -1154 | 1712 | C |
| ATOM | 1613 | O | ALA | A | 205 | 13.396 | 30.016 | 0.781 | 1.00 | 64.38 | | O |
| ANISOU | 1613 | O | ALA | A | 205 | 11187 | 7565 | 5710 | 764 | -1253 | 1561 | O |
| ATOM | 1614 | CB | ALA | A | 205 | 12.523 | 32.822 | 1.117 | 1.00 | 76.00 | | C |
| ANISOU | 1614 | CB | ALA | A | 205 | 12647 | 8799 | 7431 | 839 | -1383 | 1813 | C |
| ATOM | 1615 | N | LEU | A | 206 | 15.192 | 30.930 | -0.219 | 1.00 | 80.48 | | N |
| ANISOU | 1615 | N | LEU | A | 206 | 13461 | 9536 | 7582 | 710 | -914 | 1765 | N |
| ATOM | 1616 | CA | LEU | A | 206 | 15.988 | 29.717 | -0.156 | 1.00 | 79.07 | | C |
| ANISOU | 1616 | CA | LEU | A | 206 | 13251 | 9450 | 7341 | 659 | -768 | 1649 | C |
| ATOM | 1617 | C | LEU | A | 206 | 17.232 | 29.908 | 0.703 | 1.00 | 78.54 | | C |
| ANISOU | 1617 | C | LEU | A | 206 | 13032 | 9351 | 7458 | 571 | -527 | 1640 | C |
| ATOM | 1618 | O | LEU | A | 206 | 17.724 | 31.025 | 0.894 | 1.00 | 80.74 | | O |
| ANISOU | 1618 | O | LEU | A | 206 | 13299 | 9534 | 7844 | 542 | -427 | 1754 | O |
| ATOM | 1619 | CB | LEU | A | 206 | 16.411 | 29.261 | -1.559 | 1.00 | 83.69 | | C |
| ANISOU | 1619 | CB | LEU | A | 206 | 14101 | 10086 | 7612 | 679 | -691 | 1703 | C |
| ATOM | 1620 | CG | LEU | A | 206 | 15.305 | 28.824 | -2.519 | 1.00 | 89.92 | | C |
| ANISOU | 1620 | CG | LEU | A | 206 | 15065 | 10925 | 8174 | 758 | -928 | 1691 | C |
| ATOM | 1621 | CD1 | LEU | A | 206 | 15.888 | 28.419 | -3.866 | 1.00 | 88.95 | | C |
| ANISOU | 1621 | CD1 | LEU | A | 206 | 15221 | 10846 | 7731 | 772 | -817 | 1745 | C |
| ATOM | 1622 | CD2 | LEU | A | 206 | 14.514 | 27.682 | -1.909 | 1.00 | 90.66 | | C |
| ANISOU | 1622 | CD2 | LEU | A | 206 | 15006 | 11098 | 8344 | 764 | -1095 | 1505 | C |
| ATOM | 1623 | N | SER | A | 207 | 17.720 | 28.785 | 1.232 | 1.00 | 74.69 | | N |
| ANISOU | 1623 | N | SER | A | 207 | 12425 | 8943 | 7013 | 530 | -444 | 1500 | N |
| ATOM | 1624 | CA | SER | A | 207 | 19.084 | 28.677 | 1.749 | 1.00 | 79.18 | | C |
| ANISOU | 1624 | CA | SER | A | 207 | 12888 | 9507 | 7692 | 449 | -196 | 1489 | C |
| ATOM | 1625 | C | SER | A | 207 | 19.340 | 29.630 | 2.917 | 1.00 | 74.50 | | C |
| ANISOU | 1625 | C | SER | A | 207 | 12107 | 8825 | 7374 | 398 | -162 | 1511 | C |
| ATOM | 1626 | O | SER | A | 207 | 20.413 | 30.228 | 3.027 | 1.00 | 75.42 | | O |
| ANISOU | 1626 | O | SER | A | 207 | 12201 | 8886 | 7569 | 337 | 28 | 1589 | O |
| ATOM | 1627 | CB | SER | A | 207 | 20.098 | 28.909 | 0.625 | 1.00 | 85.52 | | C |
| ANISOU | 1627 | CB | SER | A | 207 | 13886 | 10297 | 8310 | 435 | 14 | 1614 | C |
| ATOM | 1628 | OG | SER | A | 207 | 21.418 | 28.642 | 1.056 | 1.00 | 90.46 | | O |
| ANISOU | 1628 | OG | SER | A | 207 | 14401 | 10930 | 9040 | 360 | 253 | 1594 | O |
| ATOM | 1629 | N | PHE | A | 208 | 18.362 | 29.773 | 3.806 | 1.00 | 66.05 | | N |
| ANISOU | 1629 | N | PHE | A | 208 | 10901 | 7739 | 6458 | 422 | -343 | 1440 | N |
| ATOM | 1630 | CA | PHE | A | 208 | 18.501 | 30.681 | 4.932 | 1.00 | 64.49 | | C |
| ANISOU | 1630 | CA | PHE | A | 208 | 10540 | 7453 | 6510 | 380 | -327 | 1448 | C |
| ATOM | 1631 | C | PHE | A | 208 | 18.575 | 29.923 | 6.256 | 1.00 | 65.22 | | C |
| ANISOU | 1631 | C | PHE | A | 208 | 10408 | 7593 | 6781 | 341 | -333 | 1290 | C |
| ATOM | 1632 | O | PHE | A | 208 | 18.207 | 28.749 | 6.359 | 1.00 | 58.69 | | O |
| ANISOU | 1632 | O | PHE | A | 208 | 9540 | 6859 | 5900 | 360 | -396 | 1172 | O |
| ATOM | 1633 | CB | PHE | A | 208 | 17.358 | 31.707 | 4.964 | 1.00 | 66.96 | | C |
| ANISOU | 1633 | CB | PHE | A | 208 | 10880 | 7682 | 6878 | 442 | -509 | 1513 | C |
| ATOM | 1634 | CG | PHE | A | 208 | 15.973 | 31.106 | 4.979 | 1.00 | 71.05 | | C |
| ANISOU | 1634 | CG | PHE | A | 208 | 11378 | 8257 | 7361 | 518 | -740 | 1428 | C |
| ATOM | 1635 | CD1 | PHE | A | 208 | 15.302 | 30.842 | 3.793 | 1.00 | 76.41 | | C |
| ANISOU | 1635 | CD1 | PHE | A | 208 | 12237 | 8976 | 7821 | 586 | -861 | 1474 | C |
| ATOM | 1636 | CD2 | PHE | A | 208 | 15.323 | 30.854 | 6.178 | 1.00 | 65.48 | | C |
| ANISOU | 1636 | CD2 | PHE | A | 208 | 10476 | 7559 | 6843 | 520 | -839 | 1306 | C |
| ATOM | 1637 | CE1 | PHE | A | 208 | 14.020 | 30.312 | 3.805 | 1.00 | 74.13 | | C |
| ANISOU | 1637 | CE1 | PHE | A | 208 | 11915 | 8734 | 7516 | 650 | -1084 | 1396 | C |
| ATOM | 1638 | CE2 | PHE | A | 208 | 14.043 | 30.319 | 6.195 | 1.00 | 66.21 | | C |
| ANISOU | 1638 | CE2 | PHE | A | 208 | 10536 | 7699 | 6922 | 586 | -1043 | 1233 | C |
| ATOM | 1639 | CZ | PHE | A | 208 | 13.392 | 30.050 | 5.007 | 1.00 | 71.51 | | C |
| ANISOU | 1639 | CZ | PHE | A | 208 | 11372 | 8409 | 7391 | 649 | -1171 | 1277 | C |
| ATOM | 1640 | N | TYR | A | 209 | 19.088 | 30.623 | 7.274 | 1.00 | 62.96 | | N |
| ANISOU | 1640 | N | TYR | A | 209 | 9983 | 7236 | 6705 | 283 | -264 | 1290 | N |
| ATOM | 1641 | CA | TYR | A | 209 | 19.195 | 30.121 | 8.638 | 1.00 | 59.35 | | C |
| ANISOU | 1641 | CA | TYR | A | 209 | 9318 | 6804 | 6427 | 243 | -269 | 1155 | C |
| ATOM | 1642 | C | TYR | A | 209 | 19.270 | 31.332 | 9.552 | 1.00 | 58.70 | | C |
| ANISOU | 1642 | C | TYR | A | 209 | 9145 | 6609 | 6550 | 208 | -269 | 1185 | C |
| ATOM | 1643 | O | TYR | A | 209 | 20.009 | 32.273 | 9.232 | 1.00 | 60.73 | | O |
| ANISOU | 1643 | O | TYR | A | 209 | 9460 | 6783 | 6834 | 167 | -158 | 1299 | O |
| ATOM | 1644 | CB | TYR | A | 209 | 20.431 | 29.226 | 8.825 | 1.00 | 54.83 | | C |
| ANISOU | 1644 | CB | TYR | A | 209 | 8677 | 6299 | 5857 | 177 | -99 | 1100 | C |
| ATOM | 1645 | CG | TYR | A | 209 | 20.564 | 28.674 | 10.234 | 1.00 | 53.11 | | C |
| ANISOU | 1645 | CG | TYR | A | 209 | 8254 | 6110 | 5814 | 139 | -113 | 967 | C |
| ATOM | 1646 | CD1 | TYR | A | 209 | 19.992 | 27.454 | 10.580 | 1.00 | 54.97 | | C |
| ANISOU | 1646 | CD1 | TYR | A | 209 | 8428 | 6437 | 6021 | 169 | -197 | 840 | C |
| ATOM | 1647 | CD2 | TYR | A | 209 | 21.243 | 29.385 | 11.224 | 1.00 | 49.87 | | C |
| ANISOU | 1647 | CD2 | TYR | A | 209 | 7722 | 5631 | 5595 | 70 | -47 | 968 | C |
| ATOM | 1648 | CE1 | TYR | A | 209 | 20.093 | 26.950 | 11.870 | 1.00 | 51.43 | | C |
| ANISOU | 1648 | CE1 | TYR | A | 209 | 7806 | 6013 | 5723 | 137 | -208 | 727 | C |
| ATOM | 1649 | CE2 | TYR | A | 209 | 21.349 | 28.890 | 12.522 | 1.00 | 48.91 | | C |
| ANISOU | 1649 | CE2 | TYR | A | 209 | 7430 | 5537 | 5617 | 38 | -69 | 849 | C |

TABLE 11-continued

| | | | | | | | | | | | | |
|---|---|---|---|---|---|---|---|---|---|---|---|---|
| ATOM | 1650 | CZ | TYR | A | 209 | 20.770 | 27.676 | 12.836 | 1.00 | 50.11 | | C |
| ANISOU | 1650 | CZ | TYR | A | 209 | 7529 | 5782 | 5730 | 74 | −146 | 733 | C |
| ATOM | 1651 | OH | TYR | A | 209 | 20.868 | 27.169 | 14.111 | 1.00 | 44.44 | | O |
| ANISOU | 1651 | OH | TYR | A | 209 | 6654 | 5089 | 5141 | 45 | −164 | 623 | O |
| ATOM | 1652 | N | PRO | A | 210 | 18.546 | 31.356 | 10.687 | 1.00 | 57.94 | | N |
| ANISOU | 1652 | N | PRO | A | 210 | 8913 | 6499 | 6602 | 221 | −381 | 1088 | N |
| ATOM | 1653 | CA | PRO | A | 210 | 17.676 | 30.302 | 11.232 | 1.00 | 59.14 | | C |
| ANISOU | 1653 | CA | PRO | A | 210 | 8974 | 6737 | 6759 | 261 | −501 | 953 | C |
| ATOM | 1654 | C | PRO | A | 210 | 16.353 | 30.171 | 10.476 | 1.00 | 56.04 | | C |
| ANISOU | 1654 | C | PRO | A | 210 | 8674 | 6366 | 6254 | 353 | −672 | 969 | C |
| ATOM | 1655 | O | PRO | A | 210 | 16.157 | 30.867 | 9.479 | 1.00 | 57.48 | | O |
| ANISOU | 1655 | O | PRO | A | 210 | 9003 | 6502 | 6335 | 390 | −698 | 1089 | O |
| ATOM | 1656 | CB | PRO | A | 210 | 17.447 | 30.753 | 12.682 | 1.00 | 56.22 | | C |
| ANISOU | 1656 | CB | PRO | A | 210 | 8448 | 6312 | 6600 | 239 | −536 | 878 | C |
| ATOM | 1657 | CG | PRO | A | 210 | 17.551 | 32.243 | 12.628 | 1.00 | 57.38 | | C |
| ANISOU | 1657 | CG | PRO | A | 210 | 8647 | 6327 | 6828 | 232 | −518 | 985 | C |
| ATOM | 1658 | CD | PRO | A | 210 | 18.590 | 32.543 | 11.564 | 1.00 | 59.91 | | C |
| ANISOU | 1658 | CD | PRO | A | 210 | 9091 | 6630 | 7041 | 192 | −381 | 1109 | C |
| ATOM | 1659 | N | ALA | A | 211 | 15.463 | 29.287 | 10.940 | 1.00 | 53.51 | | N |
| ANISOU | 1659 | N | ALA | A | 211 | 8266 | 6113 | 5953 | 388 | −790 | 855 | N |
| ATOM | 1660 | CA | ALA | A | 211 | 14.239 | 28.983 | 10.201 | 1.00 | 53.25 | | C |
| ANISOU | 1660 | CA | ALA | A | 211 | 8304 | 6113 | 5816 | 468 | −961 | 858 | C |
| ATOM | 1661 | C | ALA | A | 211 | 13.185 | 30.082 | 10.276 | 1.00 | 58.29 | | C |
| ANISOU | 1661 | C | ALA | A | 211 | 8945 | 6662 | 6542 | 533 | −1095 | 918 | C |
| ATOM | 1662 | O | ALA | A | 211 | 12.260 | 30.083 | 9.455 | 1.00 | 60.41 | | O |
| ANISOU | 1662 | O | ALA | A | 211 | 9297 | 6941 | 6715 | 602 | −1240 | 959 | O |
| ATOM | 1663 | CB | ALA | A | 211 | 13.623 | 27.675 | 10.702 | 1.00 | 49.45 | | C |
| ANISOU | 1663 | CB | ALA | A | 211 | 7715 | 5724 | 5349 | 478 | −1040 | 716 | C |
| ATOM | 1664 | N | GLU | A | 212 | 13.281 | 30.995 | 11.240 | 1.00 | 59.35 | | N |
| ANISOU | 1664 | N | GLU | A | 212 | 8988 | 6706 | 6855 | 515 | −1058 | 922 | N |
| ATOM | 1665 | CA | GLU | A | 212 | 12.285 | 32.054 | 11.362 | 1.00 | 68.24 | | C |
| ANISOU | 1665 | CA | GLU | A | 212 | 10110 | 7737 | 8080 | 583 | −1175 | 975 | C |
| ATOM | 1666 | C | GLU | A | 212 | 12.303 | 32.940 | 10.125 | 1.00 | 65.00 | | C |
| ANISOU | 1666 | C | GLU | A | 212 | 9880 | 7263 | 7552 | 620 | −1197 | 1135 | C |
| ATOM | 1667 | O | GLU | A | 212 | 13.360 | 33.430 | 9.716 | 1.00 | 63.57 | | O |
| ANISOU | 1667 | O | GLU | A | 212 | 9790 | 7042 | 7320 | 569 | −1061 | 1221 | O |
| ATOM | 1668 | CB | GLU | A | 212 | 12.543 | 32.892 | 12.616 | 1.00 | 75.43 | | C |
| ANISOU | 1668 | CB | GLU | A | 212 | 10910 | 8553 | 9195 | 549 | −1107 | 945 | C |
| ATOM | 1669 | CG | GLU | A | 212 | 11.460 | 32.777 | 13.689 | 1.00 | 82.43 | | C |
| ANISOU | 1669 | CG | GLU | A | 212 | 11649 | 9433 | 10236 | 595 | −1203 | 841 | C |
| ATOM | 1670 | CD | GLU | A | 212 | 10.077 | 33.166 | 13.187 | 1.00 | 89.62 | | C |
| ANISOU | 1670 | CD | GLU | A | 212 | 12581 | 10312 | 11158 | 700 | −1374 | 888 | C |
| ATOM | 1671 | OE1 | GLU | A | 212 | 9.082 | 32.579 | 13.670 | 1.00 | 90.32 | | O |
| ANISOU | 1671 | OE1 | GLU | A | 212 | 12558 | 10445 | 11313 | 743 | −1472 | 800 | O |
| ATOM | 1672 | OE2 | GLU | A | 212 | 9.981 | 34.056 | 12.313 | 1.00 | 92.26 | | O |
| ANISOU | 1672 | OE2 | GLU | A | 212 | 13039 | 10575 | 11439 | 739 | −1412 | 1017 | O |
| ATOM | 1673 | N | ILE | A | 213 | 11.131 | 33.130 | 9.518 | 1.00 | 68.94 | | N |
| ANISOU | 1673 | N | ILE | A | 213 | 10430 | 7754 | 8011 | 710 | −1371 | 1179 | N |
| ATOM | 1674 | CA | ILE | A | 213 | 10.997 | 33.979 | 8.337 | 1.00 | 75.17 | | C |
| ANISOU | 1674 | CA | ILE | A | 213 | 11399 | 8481 | 8682 | 760 | −1420 | 1337 | C |
| ATOM | 1675 | C | ILE | A | 213 | 9.534 | 34.382 | 8.206 | 1.00 | 81.92 | | C |
| ANISOU | 1675 | C | ILE | A | 213 | 12232 | 9299 | 9596 | 865 | −1630 | 1362 | C |
| ATOM | 1676 | O | ILE | A | 213 | 8.640 | 33.727 | 8.746 | 1.00 | 81.37 | | O |
| ANISOU | 1676 | O | ILE | A | 213 | 12029 | 9283 | 9607 | 897 | −1740 | 1254 | O |
| ATOM | 1677 | CB | ILE | A | 213 | 11.511 | 33.262 | 7.061 | 1.00 | 74.03 | | C |
| ANISOU | 1677 | CB | ILE | A | 213 | 11425 | 8424 | 8281 | 747 | −1390 | 1384 | C |
| ATOM | 1678 | CG1 | ILE | A | 213 | 11.782 | 34.277 | 5.943 | 1.00 | 76.42 | | C |
| ANISOU | 1678 | CG1 | ILE | A | 213 | 11931 | 8647 | 8458 | 773 | −1371 | 1565 | C |
| ATOM | 1679 | CG2 | ILE | A | 213 | 10.518 | 32.198 | 6.603 | 1.00 | 69.28 | | C |
| ANISOU | 1679 | CG2 | ILE | A | 213 | 10824 | 7925 | 7574 | 800 | −1567 | 1310 | C |
| ATOM | 1680 | CD1 | ILE | A | 213 | 12.393 | 33.677 | 4.693 | 1.00 | 74.55 | | C |
| ANISOU | 1680 | CD1 | ILE | A | 213 | 11883 | 8484 | 7957 | 759 | −1311 | 1619 | C |
| ATOM | 1681 | N | THR | A | 214 | 9.289 | 35.480 | 7.491 | 1.00 | 82.65 | | N |
| ANISOU | 1681 | N | THR | A | 214 | 12451 | 9295 | 9659 | 921 | −1683 | 1510 | N |
| ATOM | 1682 | CA | THR | A | 214 | 7.938 | 35.978 | 7.263 | 1.00 | 86.74 | | C |
| ANISOU | 1682 | CA | THR | A | 214 | 12955 | 9766 | 10235 | 1030 | −1887 | 1556 | C |
| ATOM | 1683 | C | THR | A | 214 | 7.803 | 36.401 | 5.807 | 1.00 | 87.13 | | C |
| ANISOU | 1683 | C | THR | A | 214 | 13223 | 9797 | 10085 | 1085 | −1976 | 1715 | C |
| ATOM | 1684 | O | THR | A | 214 | 8.620 | 37.180 | 5.309 | 1.00 | 83.06 | | O |
| ANISOU | 1684 | O | THR | A | 214 | 12849 | 9208 | 9500 | 1059 | −1860 | 1839 | O |
| ATOM | 1685 | CB | THR | A | 214 | 7.615 | 37.152 | 8.200 | 1.00 | 87.20 | | C |
| ANISOU | 1685 | CB | THR | A | 214 | 12914 | 9686 | 10533 | 1060 | −1872 | 1573 | C |
| ATOM | 1686 | OG1 | THR | A | 214 | 7.598 | 36.692 | 9.559 | 1.00 | 83.96 | | O |
| ANISOU | 1686 | OG1 | THR | A | 214 | 12309 | 9299 | 10292 | 1019 | −1810 | 1417 | O |
| ATOM | 1687 | CG2 | THR | A | 214 | 6.260 | 37.763 | 7.856 | 1.00 | 88.63 | | C |
| ANISOU | 1687 | CG2 | THR | A | 214 | 13091 | 9806 | 10779 | 1184 | −2077 | 1642 | C |
| ATOM | 1688 | N | LEU | A | 215 | 6.783 | 35.874 | 5.128 | 1.00 | 93.97 | | N |
| ANISOU | 1688 | N | LEU | A | 215 | 14118 | 10729 | 10857 | 1158 | −2181 | 1712 | N |
| ATOM | 1689 | CA | LEU | A | 215 | 6.495 | 36.196 | 3.736 | 1.00 | 101.88 | | C |
| ANISOU | 1689 | CA | LEU | A | 215 | 15331 | 11723 | 11655 | 1221 | −2304 | 1856 | C |

TABLE 11-continued

| | | | | | | | | | | | |
|---|---|---|---|---|---|---|---|---|---|---|---|
| ATOM | 1690 | C | LEU | A | 215 | 5.071 | 36.721 | 3.615 | 1.00 | 105.28 | | C |
| ANISOU | 1690 | C | LEU | A | 215 | 15712 | 12103 | 12188 | 1339 | -2545 | 1903 | C |
| ATOM | 1691 | O | LEU | A | 215 | 4.168 | 36.253 | 4.317 | 1.00 | 102.63 | | O |
| ANISOU | 1691 | O | LEU | A | 215 | 15186 | 11800 | 12008 | 1368 | -2655 | 1790 | O |
| ATOM | 1692 | CB | LEU | A | 215 | 6.671 | 34.970 | 2.831 | 1.00 | 101.98 | | C |
| ANISOU | 1692 | CB | LEU | A | 215 | 15461 | 11873 | 11413 | 1197 | -2344 | 1810 | C |
| ATOM | 1693 | CG | LEU | A | 215 | 8.043 | 34.293 | 2.788 | 1.00 | 96.66 | | C |
| ANISOU | 1693 | CG | LEU | A | 215 | 14847 | 11264 | 10615 | 1093 | -2114 | 1763 | C |
| ATOM | 1694 | CD1 | LEU | A | 215 | 8.005 | 33.058 | 1.895 | 1.00 | 91.14 | | C |
| ANISOU | 1694 | CD1 | LEU | A | 215 | 14262 | 10694 | 9675 | 1087 | -2182 | 1705 | C |
| ATOM | 1695 | CD2 | LEU | A | 215 | 9.104 | 35.269 | 2.311 | 1.00 | 97.58 | | C |
| ANISOU | 1695 | CD2 | LEU | A | 215 | 15124 | 11293 | 10658 | 1061 | -1936 | 1914 | C |
| ATOM | 1696 | N | THR | A | 216 | 4.873 | 37.687 | 2.718 | 1.00 | 110.82 | | N |
| ANISOU | 1696 | N | THR | A | 216 | 16580 | 12719 | 12805 | 1407 | -2623 | 2075 | N |
| ATOM | 1697 | CA | THR | A | 216 | 3.555 | 38.284 | 2.492 | 1.00 | 110.81 | | C |
| ANISOU | 1697 | CA | THR | A | 216 | 16540 | 12662 | 12901 | 1527 | -2855 | 2142 | C |
| ATOM | 1698 | C | THR | A | 216 | 3.373 | 38.780 | 1.055 | 1.00 | 106.60 | | C |
| ANISOU | 1698 | C | THR | A | 216 | 16182 | 12145 | 12177 | 1562 | -2912 | 2278 | C |
| ATOM | 1699 | O | THR | A | 216 | 4.301 | 39.309 | 0.442 | 1.00 | 103.28 | | O |
| ANISOU | 1699 | O | THR | A | 216 | 15952 | 11678 | 11610 | 1531 | -2780 | 2398 | O |
| ATOM | 1700 | CB | THR | A | 216 | 3.296 | 39.460 | 3.456 | 1.00 | 110.24 | | C |
| ANISOU | 1700 | CB | THR | A | 216 | 16343 | 12438 | 13107 | 1568 | -2811 | 2174 | C |
| ATOM | 1701 | OG1 | THR | A | 216 | 4.542 | 40.067 | 3.823 | 1.00 | 110.35 | | O |
| ANISOU | 1701 | OG1 | THR | A | 216 | 16413 | 12375 | 13140 | 1485 | -2565 | 2210 | O |
| ATOM | 1702 | CG2 | THR | A | 216 | 2.567 | 38.984 | 4.708 | 1.00 | 105.56 | | C |
| ANISOU | 1702 | CG2 | THR | A | 216 | 15480 | 11872 | 12757 | 1575 | -2842 | 2008 | C |
| ATOM | 1703 | N | VAL | A | 231 | 2.978 | 28.120 | 2.678 | 1.00 | 99.46 | | N |
| ANISOU | 1703 | N | VAL | A | 231 | 14723 | 12122 | 10943 | 1174 | -3096 | 1085 | N |
| ATOM | 1704 | CA | VAL | A | 231 | 3.436 | 26.744 | 2.861 | 1.00 | 100.63 | | C |
| ANISOU | 1704 | CA | VAL | A | 231 | 14846 | 12362 | 11025 | 1097 | -3014 | 939 | C |
| ATOM | 1705 | C | VAL | A | 231 | 4.381 | 26.660 | 4.065 | 1.00 | 100.33 | | C |
| ANISOU | 1705 | C | VAL | A | 231 | 14677 | 12314 | 11131 | 1027 | -2757 | 876 | C |
| ATOM | 1706 | O | VAL | A | 231 | 4.956 | 27.668 | 4.476 | 1.00 | 110.10 | | O |
| ANISOU | 1706 | O | VAL | A | 231 | 15910 | 13478 | 12445 | 1027 | -2620 | 957 | O |
| ATOM | 1707 | CB | VAL | A | 231 | 4.113 | 26.211 | 1.581 | 1.00 | 97.78 | | C |
| ANISOU | 1707 | CB | VAL | A | 231 | 14749 | 12058 | 10344 | 1077 | -2995 | 961 | C |
| ATOM | 1708 | CG1 | VAL | A | 231 | 5.529 | 26.749 | 1.456 | 1.00 | 95.76 | | C |
| ANISOU | 1708 | CG1 | VAL | A | 231 | 14626 | 11773 | 9986 | 1039 | -2734 | 1043 | C |
| ATOM | 1709 | CG2 | VAL | A | 231 | 4.096 | 24.690 | 1.551 | 1.00 | 95.85 | | C |
| ANISOU | 1709 | CG2 | VAL | A | 231 | 14481 | 11905 | 10031 | 1024 | -3016 | 803 | C |
| ATOM | 1710 | N | GLU | A | 232 | 4.536 | 25.464 | 4.632 | 1.00 | 90.40 | | N |
| ANISOU | 1710 | N | GLU | A | 232 | 13312 | 11123 | 9911 | 968 | -2700 | 732 | N |
| ATOM | 1711 | CA | GLU | A | 232 | 5.354 | 25.300 | 5.828 | 1.00 | 80.69 | | C |
| ANISOU | 1711 | CA | GLU | A | 232 | 11947 | 9888 | 8822 | 904 | -2481 | 665 | C |
| ATOM | 1712 | C | GLU | A | 232 | 6.841 | 25.390 | 5.501 | 1.00 | 73.72 | | C |
| ANISOU | 1712 | C | GLU | A | 232 | 11210 | 9010 | 7789 | 853 | -2259 | 710 | C |
| ATOM | 1713 | O | GLU | A | 232 | 7.300 | 24.903 | 4.464 | 1.00 | 69.85 | | O |
| ANISOU | 1713 | O | GLU | A | 232 | 10903 | 8565 | 7071 | 844 | -2247 | 724 | O |
| ATOM | 1714 | CB | GLU | A | 232 | 5.054 | 23.965 | 6.508 | 1.00 | 77.35 | | C |
| ANISOU | 1714 | CB | GLU | A | 232 | 11374 | 9533 | 8482 | 860 | -2492 | 506 | C |
| ATOM | 1715 | CG | GLU | A | 232 | 4.170 | 24.088 | 7.736 | 1.00 | 81.85 | | C |
| ANISOU | 1715 | CG | GLU | A | 232 | 11703 | 10074 | 9323 | 875 | -2538 | 449 | C |
| ATOM | 1716 | CD | GLU | A | 232 | 4.156 | 22.823 | 8.566 | 0.00 | 84.33 | | C |
| ANISOU | 1716 | CD | GLU | A | 232 | 11874 | 10445 | 9723 | 818 | -2485 | 303 | C |
| ATOM | 1717 | OE1 | GLU | A | 232 | 4.543 | 21.763 | 8.032 | 1.00 | 86.75 | | O |
| ANISOU | 1717 | OE1 | GLU | A | 232 | 12265 | 10815 | 9881 | 779 | -2474 | 240 | O |
| ATOM | 1718 | OE2 | GLU | A | 232 | 3.767 | 22.888 | 9.752 | 1.00 | 87.22 | | O |
| ANISOU | 1718 | OE2 | GLU | A | 232 | 12050 | 10787 | 10301 | 815 | -2448 | 253 | O |
| ATOM | 1719 | N | THR | A | 233 | 7.595 | 26.018 | 6.403 | 1.00 | 69.36 | | N |
| ANISOU | 1719 | N | THR | A | 233 | 10574 | 8406 | 7371 | 819 | -2082 | 730 | N |
| ATOM | 1720 | CA | THR | A | 233 | 9.041 | 26.123 | 6.243 | 1.00 | 65.34 | | C |
| ANISOU | 1720 | CA | THR | A | 233 | 10164 | 7896 | 6765 | 763 | -1860 | 769 | C |
| ATOM | 1721 | C | THR | A | 233 | 9.671 | 24.736 | 6.308 | 1.00 | 59.74 | | C |
| ANISOU | 1721 | C | THR | A | 233 | 9445 | 7274 | 5979 | 706 | -1765 | 652 | C |
| ATOM | 1722 | O | THR | A | 233 | 9.386 | 23.953 | 7.216 | 1.00 | 56.64 | | O |
| ANISOU | 1722 | O | THR | A | 233 | 8889 | 6916 | 5716 | 682 | -1773 | 533 | O |
| ATOM | 1723 | CB | THR | A | 233 | 9.623 | 27.037 | 7.325 | 1.00 | 61.78 | | C |
| ANISOU | 1723 | CB | THR | A | 233 | 9598 | 7370 | 6505 | 732 | -1715 | 798 | C |
| ATOM | 1724 | OG1 | THR | A | 233 | 9.088 | 28.357 | 7.169 | 1.00 | 63.70 | | O |
| ANISOU | 1724 | OG1 | THR | A | 233 | 9872 | 7520 | 6810 | 789 | -1795 | 914 | O |
| ATOM | 1725 | CG2 | THR | A | 233 | 11.143 | 27.105 | 7.230 | 1.00 | 63.27 | | C |
| ANISOU | 1725 | CG2 | THR | A | 233 | 9859 | 7557 | 6622 | 666 | -1487 | 834 | C |
| ATOM | 1726 | N | ARG | A | 234 | 10.521 | 24.431 | 5.332 | 1.00 | 61.41 | | N |
| ANISOU | 1726 | N | ARG | A | 234 | 9837 | 7518 | 5977 | 689 | -1669 | 688 | N |
| ATOM | 1727 | CA | ARG | A | 234 | 11.022 | 23.078 | 5.177 | 1.00 | 57.84 | | C |
| ANISOU | 1727 | CA | ARG | A | 234 | 9406 | 7145 | 5426 | 650 | -1597 | 580 | C |
| ATOM | 1728 | C | ARG | A | 234 | 12.544 | 23.052 | 5.216 | 1.00 | 57.27 | | C |
| ANISOU | 1728 | C | ARG | A | 234 | 9375 | 7075 | 5312 | 596 | -1343 | 605 | C |
| ATOM | 1729 | O | ARG | A | 234 | 13.202 | 24.003 | 4.782 | 1.00 | 55.68 | | O |
| ANISOU | 1729 | O | ARG | A | 234 | 9274 | 6824 | 5056 | 594 | -1240 | 727 | O |

TABLE 11-continued

| | | | | | | | | | | | | |
|---|---|---|---|---|---|---|---|---|---|---|---|---|
| ATOM | 1730 | CB | ARG | A | 234 | 10.535 | 22.468 | 3.856 | 1.00 | 56.13 | | C |
| ANISOU | 1730 | CB | ARG | A | 234 | 9380 | 6976 | 4971 | 686 | −1732 | 573 | C |
| ATOM | 1731 | CG | ARG | A | 234 | 11.013 | 23.217 | 2.630 | 1.00 | 53.93 | | C |
| ANISOU | 1731 | CG | ARG | A | 234 | 9341 | 6673 | 4477 | 713 | −1690 | 711 | C |
| ATOM | 1732 | CD | ARG | A | 234 | 10.152 | 22.896 | 1.418 | 1.00 | 57.60 | | C |
| ANISOU | 1732 | CD | ARG | A | 234 | 9986 | 7170 | 4731 | 765 | −1897 | 718 | C |
| ATOM | 1733 | NE | ARG | A | 234 | 10.786 | 23.302 | 0.167 | 1.00 | 59.59 | | N |
| ANISOU | 1733 | NE | ARG | A | 234 | 10501 | 7416 | 4726 | 784 | −1822 | 831 | N |
| ATOM | 1734 | CZ | ARG | A | 234 | 10.179 | 23.277 | −1.018 | 1.00 | 65.23 | | C |
| ANISOU | 1734 | CZ | ARG | A | 234 | 11419 | 8146 | 5217 | 834 | −1989 | 872 | C |
| ATOM | 1735 | NH1 | ARG | A | 234 | 8.921 | 22.866 | −1.109 | 1.00 | 65.91 | | N |
| ANISOU | 1735 | NH1 | ARG | A | 234 | 11462 | 8256 | 5324 | 867 | −2252 | 806 | N |
| ATOM | 1736 | NH2 | ARG | A | 234 | 10.825 | 23.665 | −2.110 | 1.00 | 59.96 | | N |
| ANISOU | 1736 | NH2 | ARG | A | 234 | 11001 | 7472 | 4310 | 850 | −1896 | 980 | N |
| ATOM | 1737 | N | PRO | A | 235 | 13.129 | 21.974 | 5.734 | 1.00 | 51.88 | | N |
| ANISOU | 1737 | N | PRO | A | 235 | 8608 | 6444 | 4662 | 551 | −1236 | 495 | N |
| ATOM | 1738 | CA | PRO | A | 235 | 14.590 | 21.863 | 5.742 | 1.00 | 52.49 | | C |
| ANISOU | 1738 | CA | PRO | A | 235 | 8710 | 6526 | 4707 | 503 | −996 | 516 | C |
| ATOM | 1739 | C | PRO | A | 235 | 15.135 | 21.548 | 4.358 | 1.00 | 58.50 | | C |
| ANISOU | 1739 | C | PRO | A | 235 | 9701 | 7316 | 5209 | 517 | −924 | 560 | C |
| ATOM | 1740 | O | PRO | A | 235 | 14.567 | 20.748 | 3.609 | 1.00 | 60.05 | | O |
| ANISOU | 1740 | O | PRO | A | 235 | 10008 | 7559 | 5250 | 546 | −1035 | 502 | O |
| ATOM | 1741 | CB | PRO | A | 235 | 14.852 | 20.710 | 6.719 | 1.00 | 44.65 | | C |
| ANISOU | 1741 | CB | PRO | A | 235 | 7555 | 5580 | 3832 | 464 | −941 | 379 | C |
| ATOM | 1742 | CG | PRO | A | 235 | 13.617 | 19.897 | 6.659 | 1.00 | 51.01 | | C |
| ANISOU | 1742 | CG | PRO | A | 235 | 8337 | 6421 | 4622 | 493 | −1139 | 284 | C |
| ATOM | 1743 | CD | PRO | A | 235 | 12.487 | 20.865 | 6.457 | 1.00 | 49.05 | | C |
| ANISOU | 1743 | CD | PRO | A | 235 | 8105 | 6130 | 4401 | 541 | −1323 | 353 | C |
| ATOM | 1744 | N | ALA | A | 236 | 16.256 | 22.191 | 4.025 | 1.00 | 57.02 | | N |
| ANISOU | 1744 | N | ALA | A | 236 | 9588 | 7099 | 4979 | 494 | −732 | 662 | N |
| ATOM | 1745 | CA | ALA | A | 236 | 16.932 | 21.913 | 2.765 | 1.00 | 60.78 | | C |
| ANISOU | 1745 | CA | ALA | A | 236 | 10282 | 7600 | 5212 | 505 | −616 | 708 | C |
| ATOM | 1746 | C | ALA | A | 236 | 17.790 | 20.656 | 2.842 | 1.00 | 60.64 | | C |
| ANISOU | 1746 | C | ALA | A | 236 | 10238 | 7639 | 5162 | 476 | −462 | 605 | C |
| ATOM | 1747 | O | ALA | A | 236 | 18.006 | 19.995 | 1.819 | 1.00 | 63.76 | | O |
| ANISOU | 1747 | O | ALA | A | 236 | 10812 | 8072 | 5341 | 498 | −418 | 586 | O |
| ATOM | 1748 | CB | ALA | A | 236 | 17.789 | 23.111 | 2.350 | 1.00 | 52.87 | | C |
| ANISOU | 1748 | CB | ALA | A | 236 | 9368 | 6537 | 4185 | 490 | −457 | 868 | C |
| ATOM | 1749 | N | GLY | A | 237 | 18.284 | 20.309 | 4.028 | 1.00 | 55.22 | | N |
| ANISOU | 1749 | N | GLY | A | 237 | 9341 | 6957 | 4683 | 431 | −379 | 536 | N |
| ATOM | 1750 | CA | GLY | A | 237 | 19.105 | 19.129 | 4.208 | 1.00 | 60.60 | | C |
| ANISOU | 1750 | CA | GLY | A | 237 | 9976 | 7686 | 5364 | 408 | −236 | 441 | C |
| ATOM | 1751 | C | GLY | A | 237 | 20.581 | 19.410 | 4.377 | 1.00 | 62.47 | | C |
| ANISOU | 1751 | C | GLY | A | 237 | 10166 | 7906 | 5665 | 366 | 17 | 503 | C |
| ATOM | 1752 | O | GLY | A | 237 | 21.345 | 18.483 | 4.681 | 1.00 | 63.21 | | O |
| ANISOU | 1752 | O | GLY | A | 237 | 10186 | 8033 | 5798 | 348 | 145 | 429 | O |
| ATOM | 1753 | N | ASP | A | 238 | 21.002 | 20.656 | 4.177 | 1.00 | 63.77 | | N |
| ANISOU | 1753 | N | ASP | A | 238 | 10367 | 8015 | 5848 | 351 | 92 | 638 | N |
| ATOM | 1754 | CA | ASP | A | 238 | 22.370 | 21.085 | 4.428 | 1.00 | 68.58 | | C |
| ANISOU | 1754 | CA | ASP | A | 238 | 10905 | 8597 | 6558 | 300 | 321 | 707 | C |
| ATOM | 1755 | C | ASP | A | 238 | 22.449 | 22.088 | 5.576 | 1.00 | 67.72 | | C |
| ANISOU | 1755 | C | ASP | A | 238 | 10615 | 8428 | 6689 | 254 | 297 | 747 | C |
| ATOM | 1756 | O | ASP | A | 238 | 23.416 | 22.850 | 5.664 | 1.00 | 61.53 | | O |
| ANISOU | 1756 | O | ASP | A | 238 | 9795 | 7597 | 5987 | 208 | 451 | 838 | O |
| ATOM | 1757 | CB | ASP | A | 238 | 22.977 | 21.684 | 3.159 | 1.00 | 68.90 | | C |
| ANISOU | 1757 | CB | ASP | A | 238 | 11151 | 8613 | 6416 | 311 | 468 | 838 | C |
| ATOM | 1758 | CG | ASP | A | 238 | 22.236 | 22.922 | 2.686 | 1.00 | 72.64 | | C |
| ANISOU | 1758 | CG | ASP | A | 238 | 11743 | 9028 | 6829 | 333 | 348 | 957 | C |
| ATOM | 1759 | OD1 | ASP | A | 238 | 21.218 | 23.293 | 3.314 | 1.00 | 72.82 | | O |
| ANISOU | 1759 | OD1 | ASP | A | 238 | 11685 | 9031 | 6953 | 346 | 148 | 931 | O |
| ATOM | 1760 | OD2 | ASP | A | 238 | 22.668 | 23.527 | 1.677 | 1.00 | 78.26 | | O |
| ANISOU | 1760 | OD2 | ASP | A | 238 | 12631 | 9711 | 7393 | 342 | 459 | 1080 | O |
| ATOM | 1761 | N | GLY | A | 239 | 21.432 | 22.121 | 6.438 | 1.00 | 68.58 | | N |
| ANISOU | 1761 | N | GLY | A | 239 | 10615 | 8533 | 6912 | 263 | 107 | 680 | N |
| ATOM | 1762 | CA | GLY | A | 239 | 21.394 | 23.042 | 7.553 | 1.00 | 65.61 | | C |
| ANISOU | 1762 | CA | GLY | A | 239 | 10082 | 8097 | 6751 | 226 | 72 | 702 | C |
| ATOM | 1763 | C | GLY | A | 239 | 20.641 | 24.331 | 7.304 | 1.00 | 63.94 | | C |
| ANISOU | 1763 | C | GLY | A | 239 | 9944 | 7813 | 6538 | 248 | −39 | 801 | C |
| ATOM | 1764 | O | GLY | A | 239 | 20.473 | 25.118 | 8.244 | 1.00 | 68.56 | | O |
| ANISOU | 1764 | O | GLY | A | 239 | 10408 | 8341 | 7300 | 224 | −84 | 810 | O |
| ATOM | 1765 | N | THR | A | 240 | 20.188 | 24.579 | 6.078 | 1.00 | 56.96 | | N |
| ANISOU | 1765 | N | THR | A | 240 | 9259 | 6926 | 5457 | 297 | −86 | 876 | N |
| ATOM | 1766 | CA | THR | A | 240 | 19.420 | 25.769 | 5.742 | 1.00 | 56.87 | | C |
| ANISOU | 1766 | CA | THR | A | 240 | 9332 | 6844 | 5432 | 330 | −203 | 979 | C |
| ATOM | 1767 | C | THR | A | 240 | 17.954 | 25.395 | 5.545 | 1.00 | 57.09 | | C |
| ANISOU | 1767 | C | THR | A | 240 | 9397 | 6903 | 5392 | 397 | −440 | 920 | C |
| ATOM | 1768 | O | THR | A | 240 | 17.569 | 24.224 | 5.630 | 1.00 | 66.25 | | O |
| ANISOU | 1768 | O | THR | A | 240 | 10525 | 8136 | 6510 | 411 | −506 | 802 | O |
| ATOM | 1769 | CB | THR | A | 240 | 19.995 | 26.452 | 4.496 | 1.00 | 67.12 | | C |
| ANISOU | 1769 | CB | THR | A | 240 | 10835 | 8106 | 6561 | 336 | −86 | 1128 | C |

TABLE 11-continued

| | | | | | | | | | | |
|---|---|---|---|---|---|---|---|---|---|---|
| ATOM | 1770 | OG1 | THR | A | 240 | 19.900 | 25.564 | 3.372 | 1.00 | 66.18 | | O |
| ANISOU | 1770 | OG1 | THR | A | 240 | 10890 | 8057 | 6197 | 377 | −84 | 1107 | O |
| ATOM | 1771 | CG2 | THR | A | 240 | 21.457 | 26.829 | 4.723 | 1.00 | 65.65 | | C |
| ANISOU | 1771 | CG2 | THR | A | 240 | 10588 | 7884 | 6470 | 263 | 156 | 1188 | C |
| ATOM | 1772 | N | PHE | A | 241 | 17.126 | 26.405 | 5.282 | 1.00 | 55.35 | | N |
| ANISOU | 1772 | N | PHE | A | 241 | 9239 | 6621 | 5171 | 439 | −573 | 1006 | N |
| ATOM | 1773 | CA | PHE | A | 241 | 15.686 | 26.216 | 5.192 | 1.00 | 54.90 | | C |
| ANISOU | 1773 | CA | PHE | A | 241 | 9187 | 6581 | 5092 | 503 | −811 | 961 | C |
| ATOM | 1774 | C | PHE | A | 241 | 15.133 | 26.920 | 3.962 | 1.00 | 57.72 | | C |
| ANISOU | 1774 | C | PHE | A | 241 | 9753 | 6906 | 5273 | 564 | −912 | 1086 | C |
| ATOM | 1775 | O | PHE | A | 241 | 15.822 | 27.692 | 3.292 | 1.00 | 57.36 | | O |
| ANISOU | 1775 | O | PHE | A | 241 | 9841 | 6811 | 5141 | 555 | −794 | 1216 | O |
| ATOM | 1776 | CB | PHE | A | 241 | 14.993 | 26.707 | 6.465 | 1.00 | 57.84 | | C |
| ANISOU | 1776 | CB | PHE | A | 241 | 9364 | 6907 | 5707 | 504 | −909 | 917 | C |
| ATOM | 1777 | CG | PHE | A | 241 | 15.423 | 25.959 | 7.698 | 1.00 | 55.87 | | C |
| ANISOU | 1777 | CG | PHE | A | 241 | 8921 | 6693 | 5614 | 451 | −833 | 791 | C |
| ATOM | 1778 | CD1 | PHE | A | 241 | 16.519 | 26.381 | 8.433 | 1.00 | 54.49 | | C |
| ANISOU | 1778 | CD1 | PHE | A | 241 | 8657 | 6481 | 5567 | 386 | −665 | 807 | C |
| ATOM | 1779 | CD2 | PHE | A | 241 | 14.750 | 24.815 | 8.102 | 1.00 | 52.98 | | C |
| ANISOU | 1779 | CD2 | PHE | A | 241 | 8467 | 6397 | 5268 | 463 | −932 | 660 | C |
| ATOM | 1780 | CE1 | PHE | A | 241 | 16.928 | 25.683 | 9.560 | 1.00 | 49.00 | | C |
| ANISOU | 1780 | CE1 | PHE | A | 241 | 7792 | 5820 | 5005 | 341 | −607 | 696 | C |
| ATOM | 1781 | CE2 | PHE | A | 241 | 15.156 | 24.111 | 9.230 | 1.00 | 51.38 | | C |
| ANISOU | 1781 | CE2 | PHE | A | 241 | 8098 | 6225 | 5200 | 417 | −861 | 553 | C |
| ATOM | 1782 | CZ | PHE | A | 241 | 16.240 | 24.545 | 9.957 | 1.00 | 48.59 | | C |
| ANISOU | 1782 | CZ | PHE | A | 241 | 7663 | 5838 | 4962 | 359 | −703 | 572 | C |
| ATOM | 1783 | N | GLN | A | 242 | 13.869 | 26.621 | 3.663 | 1.00 | 58.50 | | N |
| ANISOU | 1783 | N | GLN | A | 242 | 9876 | 7031 | 5320 | 624 | −1136 | 1048 | N |
| ATOM | 1784 | CA | GLN | A | 242 | 13.208 | 27.092 | 2.457 | 1.00 | 64.62 | | C |
| ANISOU | 1784 | CA | GLN | A | 242 | 10854 | 7790 | 5910 | 690 | −1275 | 1151 | C |
| ATOM | 1785 | C | GLN | A | 242 | 11.744 | 27.368 | 2.765 | 1.00 | 62.15 | | C |
| ANISOU | 1785 | C | GLN | A | 242 | 10453 | 7456 | 5704 | 751 | −1528 | 1132 | C |
| ATOM | 1786 | O | GLN | A | 242 | 11.148 | 26.735 | 3.641 | 1.00 | 62.31 | | O |
| ANISOU | 1786 | O | GLN | A | 242 | 10293 | 7509 | 5873 | 744 | −1610 | 1008 | O |
| ATOM | 1787 | CB | GLN | A | 242 | 13.303 | 26.076 | 1.310 | 1.00 | 68.02 | | C |
| ANISOU | 1787 | CB | GLN | A | 242 | 11472 | 8302 | 6070 | 704 | −1288 | 1116 | C |
| ATOM | 1788 | CG | GLN | A | 242 | 14.700 | 25.570 | 0.992 | 1.00 | 68.85 | | C |
| ANISOU | 1788 | CG | GLN | A | 242 | 11653 | 8439 | 6066 | 652 | −1032 | 1112 | C |
| ATOM | 1789 | CD | GLN | A | 242 | 14.687 | 24.532 | −0.107 | 1.00 | 70.80 | | C |
| ANISOU | 1789 | CD | GLN | A | 242 | 12092 | 8763 | 6047 | 674 | −1055 | 1061 | C |
| ATOM | 1790 | OE1 | GLN | A | 242 | 13.624 | 24.130 | −0.579 | 1.00 | 73.71 | | O |
| ANISOU | 1790 | OE1 | GLN | A | 242 | 12526 | 9162 | 6317 | 721 | −1276 | 1017 | O |
| ATOM | 1791 | NE2 | GLN | A | 242 | 15.868 | 24.093 | −0.527 | 1.00 | 72.97 | | N |
| ANISOU | 1791 | NE2 | GLN | A | 242 | 12456 | 9062 | 6205 | 641 | −827 | 1064 | N |
| ATOM | 1792 | N | LYS | A | 243 | 11.174 | 28.320 | 2.028 | 1.00 | 60.95 | | N |
| ANISOU | 1792 | N | LYS | A | 243 | 10431 | 7247 | 5480 | 812 | −1648 | 1262 | N |
| ATOM | 1793 | CA | LYS | A | 243 | 9.771 | 28.697 | 2.129 | 1.00 | 72.58 | | C |
| ANISOU | 1793 | CA | LYS | A | 243 | 11841 | 8693 | 7043 | 883 | −1897 | 1269 | C |
| ATOM | 1794 | C | LYS | A | 243 | 9.429 | 29.573 | 0.933 | 1.00 | 82.16 | | C |
| ANISOU | 1794 | C | LYS | A | 243 | 13272 | 9858 | 8086 | 951 | −2002 | 1431 | C |
| ATOM | 1795 | O | LYS | A | 243 | 10.198 | 30.471 | 0.586 | 1.00 | 88.24 | | O |
| ANISOU | 1795 | O | LYS | A | 243 | 14158 | 10562 | 8806 | 940 | −1861 | 1562 | O |
| ATOM | 1796 | CB | LYS | A | 243 | 9.483 | 29.450 | 3.438 | 1.00 | 72.09 | | C |
| ANISOU | 1796 | CB | LYS | A | 243 | 11561 | 8555 | 7275 | 880 | −1886 | 1257 | C |
| ATOM | 1797 | CG | LYS | A | 243 | 8.002 | 29.513 | 3.812 | 1.00 | 74.64 | | C |
| ANISOU | 1797 | CG | LYS | A | 243 | 11754 | 8867 | 7738 | 948 | −2124 | 1216 | C |
| ATOM | 1798 | CD | LYS | A | 243 | 7.743 | 30.501 | 4.939 | 1.00 | 73.06 | | C |
| ANISOU | 1798 | CD | LYS | A | 243 | 11385 | 8572 | 7803 | 960 | −2099 | 1233 | C |
| ATOM | 1799 | CE | LYS | A | 243 | 6.409 | 30.236 | 5.625 | 1.00 | 73.41 | | C |
| ANISOU | 1799 | CE | LYS | A | 243 | 11241 | 8624 | 8026 | 1008 | −2279 | 1145 | C |
| ATOM | 1800 | NZ | LYS | A | 243 | 6.447 | 29.003 | 6.471 | 1.00 | 69.98 | | N |
| ANISOU | 1800 | NZ | LYS | A | 243 | 10649 | 8273 | 7668 | 952 | −2234 | 979 | N |
| ATOM | 1801 | N | TRP | A | 244 | 8.293 | 29.301 | 0.297 | 1.00 | 86.91 | | N |
| ANISOU | 1801 | N | TRP | A | 244 | 13931 | 10492 | 8600 | 1017 | −2251 | 1425 | N |
| ATOM | 1802 | CA | TRP | A | 244 | 7.793 | 30.164 | −0.763 | 1.00 | 93.67 | | C |
| ANISOU | 1802 | CA | TRP | A | 244 | 14979 | 11298 | 9312 | 1093 | −2394 | 1580 | C |
| ATOM | 1803 | C | TRP | A | 244 | 6.393 | 30.656 | −0.419 | 1.00 | 93.75 | | C |
| ANISOU | 1803 | C | TRP | A | 244 | 14857 | 11266 | 9499 | 1169 | −2644 | 1591 | C |
| ATOM | 1804 | O | TRP | A | 244 | 5.765 | 30.208 | 0.546 | 1.00 | 87.40 | | O |
| ANISOU | 1804 | O | TRP | A | 244 | 13823 | 10481 | 8904 | 1162 | −2711 | 1470 | O |
| ATOM | 1805 | CB | TRP | A | 244 | 7.801 | 29.464 | −2.137 | 1.00 | 99.50 | | C |
| ANISOU | 1805 | CB | TRP | A | 244 | 15955 | 12114 | 9735 | 1106 | −2461 | 1585 | C |
| ATOM | 1806 | CG | TRP | A | 244 | 7.078 | 28.135 | −2.239 | 1.00 | 103.06 | | C |
| ANISOU | 1806 | CG | TRP | A | 244 | 16325 | 12670 | 10164 | 1093 | −2605 | 1413 | C |
| ATOM | 1807 | CD1 | TRP | A | 244 | 7.653 | 26.907 | −2.413 | 1.00 | 101.12 | | C |
| ANISOU | 1807 | CD1 | TRP | A | 244 | 16134 | 12506 | 9782 | 1041 | −2516 | 1295 | C |
| ATOM | 1808 | CD2 | TRP | A | 244 | 5.657 | 27.908 | −2.215 | 1.00 | 108.94 | | C |
| ANISOU | 1808 | CD2 | TRP | A | 244 | 16919 | 13439 | 11032 | 1128 | −2850 | 1345 | C |
| ATOM | 1809 | NE1 | TRP | A | 244 | 6.686 | 25.934 | −2.482 | 1.00 | 102.09 | | N |
| ANISOU | 1809 | NE1 | TRP | A | 244 | 16153 | 12696 | 9939 | 1038 | −2694 | 1157 | N |

TABLE 11-continued

| | | | | | | | | | | | |
|---|---|---|---|---|---|---|---|---|---|---|---|
| ATOM | 1810 | CE2 | TRP | A | 244 | 5.453 | 26.521 | −2.362 | 1.00 | 108.58 | C |
| ANISOU | 1810 | CE2 | TRP | A | 244 | 16846 | 13487 | 10923 | 1088 | −2898 | 1186 | C |
| ATOM | 1811 | CE3 | TRP | A | 244 | 4.539 | 28.742 | −2.078 | 1.00 | 112.04 | C |
| ANISOU | 1811 | CE3 | TRP | A | 244 | 17194 | 13781 | 11597 | 1189 | −3023 | 1402 | C |
| ATOM | 1812 | CZ2 | TRP | A | 244 | 4.179 | 25.950 | −2.371 | 1.00 | 112.13 | C |
| ANISOU | 1812 | CZ2 | TRP | A | 244 | 17151 | 13975 | 11477 | 1100 | −3112 | 1088 | C |
| ATOM | 1813 | CZ3 | TRP | A | 244 | 3.275 | 28.171 | −2.086 | 1.00 | 112.53 | C |
| ANISOU | 1813 | CZ3 | TRP | A | 244 | 17108 | 13889 | 11760 | 1205 | −3231 | 1305 | C |
| ATOM | 1814 | CH2 | TRP | A | 244 | 3.107 | 26.790 | −2.233 | 1.00 | 113.18 | C |
| ANISOU | 1814 | CH2 | TRP | A | 244 | 17165 | 14060 | 11778 | 1157 | −3274 | 1151 | C |
| ATOM | 1815 | N | ALA | A | 245 | 5.909 | 31.594 | −1.233 | 1.00 | 98.53 | N |
| ANISOU | 1815 | N | ALA | A | 245 | 15569 | 11821 | 10049 | 1231 | −2744 | 1727 | N |
| ATOM | 1816 | CA | ALA | A | 245 | 4.587 | 32.176 | −1.054 | 1.00 | 100.47 | C |
| ANISOU | 1816 | CA | ALA | A | 245 | 15663 | 12029 | 10481 | 1300 | −2944 | 1742 | C |
| ATOM | 1817 | C | ALA | A | 245 | 4.010 | 32.529 | −2.416 | 1.00 | 109.57 | C |
| ANISOU | 1817 | C | ALA | A | 245 | 16950 | 13204 | 11478 | 1343 | −3063 | 1827 | C |
| ATOM | 1818 | O | ALA | A | 245 | 4.745 | 32.846 | −3.357 | 1.00 | 112.73 | O |
| ANISOU | 1818 | O | ALA | A | 245 | 17566 | 13602 | 11667 | 1332 | −2958 | 1928 | O |
| ATOM | 1819 | CB | ALA | A | 245 | 4.632 | 33.417 | −0.157 | 1.00 | 94.42 | C |
| ANISOU | 1819 | CB | ALA | A | 245 | 14808 | 11128 | 9938 | 1334 | −2893 | 1834 | C |
| ATOM | 1820 | N | ALA | A | 246 | 2.685 | 32.469 | −2.510 | 1.00 | 112.40 | N |
| ANISOU | 1820 | N | ALA | A | 246 | 17177 | 13585 | 11947 | 1392 | −3278 | 1788 | N |
| ATOM | 1821 | CA | ALA | A | 246 | 1.989 | 32.793 | −3.751 | 1.00 | 115.14 | C |
| ANISOU | 1821 | CA | ALA | A | 246 | 17629 | 13953 | 12165 | 1439 | −3424 | 1865 | C |
| ATOM | 1822 | C | ALA | A | 246 | 0.534 | 33.174 | −3.480 | 1.00 | 113.33 | C |
| ANISOU | 1822 | C | ALA | A | 246 | 17203 | 13701 | 12155 | 1507 | −3636 | 1859 | C |
| ATOM | 1823 | O | ALA | A | 246 | −0.021 | 32.846 | −2.429 | 1.00 | 109.07 | O |
| ANISOU | 1823 | O | ALA | A | 246 | 16440 | 13159 | 11844 | 1507 | −3680 | 1758 | O |
| ATOM | 1824 | CB | ALA | A | 246 | 2.063 | 31.622 | −4.720 | 1.00 | 114.99 | C |
| ANISOU | 1824 | CB | ALA | A | 246 | 17737 | 14048 | 11906 | 1397 | −3465 | 1777 | C |
| ATOM | 1825 | N | CYS | A | 259 | 6.953 | 41.464 | −3.383 | 1.00 | 118.28 | N |
| ANISOU | 1825 | N | CYS | A | 259 | 18644 | 13475 | 12823 | 1467 | −2372 | 2952 | N |
| ATOM | 1826 | CA | CYS | A | 259 | 6.960 | 40.516 | −2.271 | 1.00 | 120.65 | C |
| ANISOU | 1826 | CA | CYS | A | 259 | 18784 | 13822 | 13237 | 1430 | −2378 | 2779 | C |
| ATOM | 1827 | C | CYS | A | 259 | 7.692 | 41.126 | −1.072 | 1.00 | 120.49 | C |
| ANISOU | 1827 | C | CYS | A | 259 | 18688 | 13666 | 13428 | 1384 | −2217 | 2786 | C |
| ATOM | 1828 | O | CYS | A | 259 | 8.576 | 41.970 | −1.240 | 1.00 | 126.97 | O |
| ANISOU | 1828 | O | CYS | A | 259 | 19618 | 14384 | 14241 | 1343 | −2043 | 2910 | O |
| ATOM | 1829 | CB | CYS | A | 259 | 7.610 | 39.190 | −2.696 | 1.00 | 117.88 | C |
| ANISOU | 1829 | CB | CYS | A | 259 | 18520 | 13611 | 12656 | 1364 | −2308 | 2684 | C |
| ATOM | 1830 | SG | CYS | A | 259 | 7.167 | 37.732 | −1.686 | 1.00 | 114.07 | S |
| ANISOU | 1830 | SG | CYS | A | 259 | 17841 | 13238 | 12262 | 1344 | −2409 | 2455 | S |
| ATOM | 1831 | N | HIS | A | 260 | 7.311 | 40.708 | 0.135 | 1.00 | 113.73 | N |
| ANISOU | 1831 | N | HIS | A | 260 | 17641 | 12805 | 12768 | 1386 | −2275 | 2651 | N |
| ATOM | 1832 | CA | HIS | A | 260 | 7.885 | 41.227 | 1.373 | 1.00 | 111.33 | C |
| ANISOU | 1832 | CA | HIS | A | 260 | 17183 | 12406 | 12710 | 1323 | −2107 | 2598 | C |
| ATOM | 1833 | C | HIS | A | 260 | 8.433 | 40.058 | 2.181 | 1.00 | 109.72 | C |
| ANISOU | 1833 | C | HIS | A | 260 | 16823 | 12323 | 12542 | 1227 | −1991 | 2405 | C |
| ATOM | 1834 | O | HIS | A | 260 | 7.697 | 39.115 | 2.489 | 1.00 | 107.06 | O |
| ANISOU | 1834 | O | HIS | A | 260 | 16362 | 12089 | 12226 | 1250 | −2120 | 2271 | O |
| ATOM | 1835 | CB | HIS | A | 260 | 6.840 | 42.005 | 2.184 | 1.00 | 112.72 | C |
| ANISOU | 1835 | CB | HIS | A | 260 | 17200 | 12475 | 13153 | 1406 | −2237 | 2586 | C |
| ATOM | 1836 | CG | HIS | A | 260 | 6.120 | 43.063 | 1.398 | 1.00 | 122.27 | C |
| ANISOU | 1836 | CG | HIS | A | 260 | 18508 | 13594 | 14355 | 1507 | −2361 | 2748 | C |
| ATOM | 1837 | ND1 | HIS | A | 260 | 6.671 | 44.298 | 1.126 | 1.00 | 123.98 | N |
| ANISOU | 1837 | ND1 | HIS | A | 260 | 18835 | 13670 | 14601 | 1498 | −2240 | 2901 | N |
| ATOM | 1838 | CD2 | HIS | A | 260 | 4.887 | 43.072 | 0.835 | 1.00 | 123.55 | C |
| ANISOU | 1838 | CD2 | HIS | A | 260 | 18618 | 13814 | 14510 | 1599 | −2559 | 2755 | C |
| ATOM | 1839 | CE1 | HIS | A | 260 | 5.812 | 45.019 | 0.426 | 1.00 | 124.64 | C |
| ANISOU | 1839 | CE1 | HIS | A | 260 | 18940 | 13730 | 14688 | 1588 | −2362 | 2999 | C |
| ATOM | 1840 | NE2 | HIS | A | 260 | 4.721 | 44.299 | 0.236 | 1.00 | 124.77 | N |
| ANISOU | 1840 | NE2 | HIS | A | 260 | 18859 | 13865 | 14682 | 1651 | −2558 | 2914 | N |
| ATOM | 1841 | N | VAL | A | 261 | 9.719 | 40.120 | 2.527 | 1.00 | 109.86 | N |
| ANISOU | 1841 | N | VAL | A | 261 | 16842 | 12324 | 12577 | 1119 | −1750 | 2394 | N |
| ATOM | 1842 | CA | VAL | A | 261 | 10.408 | 39.027 | 3.207 | 1.00 | 108.83 | C |
| ANISOU | 1842 | CA | VAL | A | 261 | 16584 | 12304 | 12463 | 1025 | −1623 | 2230 | C |
| ATOM | 1843 | C | VAL | A | 261 | 11.208 | 39.589 | 4.377 | 1.00 | 105.87 | C |
| ANISOU | 1843 | C | VAL | A | 261 | 16071 | 11842 | 12312 | 941 | −1444 | 2184 | C |
| ATOM | 1844 | O | VAL | A | 261 | 11.967 | 40.551 | 4.215 | 1.00 | 109.27 | O |
| ANISOU | 1844 | O | VAL | A | 261 | 16587 | 12161 | 12770 | 901 | −1310 | 2302 | O |
| ATOM | 1845 | CB | VAL | A | 261 | 11.323 | 38.244 | 2.243 | 1.00 | 106.77 | C |
| ANISOU | 1845 | CB | VAL | A | 261 | 16484 | 12144 | 11941 | 970 | −1505 | 2254 | C |
| ATOM | 1846 | CG1 | VAL | A | 261 | 12.083 | 39.193 | 1.336 | 1.00 | 105.14 | C |
| ANISOU | 1846 | CG1 | VAL | A | 261 | 16489 | 11844 | 11617 | 957 | −1380 | 2448 | C |
| ATOM | 1847 | CG2 | VAL | A | 261 | 12.284 | 37.353 | 3.019 | 1.00 | 104.92 | C |
| ANISOU | 1847 | CG2 | VAL | A | 261 | 16116 | 11990 | 11760 | 865 | −1328 | 2110 | C |
| ATOM | 1848 | N | GLN | A | 262 | 11.041 | 38.981 | 5.552 | 1.00 | 96.95 | N |
| ANISOU | 1848 | N | GLN | A | 262 | 14734 | 10762 | 11340 | 911 | −1444 | 2014 | N |
| ATOM | 1849 | CA | GLN | A | 262 | 11.670 | 39.442 | 6.782 | 1.00 | 92.26 | C |
| ANISOU | 1849 | CA | GLN | A | 262 | 13999 | 10094 | 10962 | 837 | −1306 | 1948 | C |

TABLE 11-continued

| | | | | | | | | | | | |
|---|---|---|---|---|---|---|---|---|---|---|---|
| ATOM | 1850 | C | GLN | A | 262 | 12.461 | 38.297 | 7.399 | 1.00 | 89.72 | C |
| ANISOU | 1850 | C | GLN | A | 262 | 13566 | 9890 | 10633 | 744 | −1188 | 1802 C |
| ATOM | 1851 | O | GLN | A | 262 | 11.912 | 37.212 | 7.623 | 1.00 | 83.95 | O |
| ANISOU | 1851 | O | GLN | A | 262 | 12750 | 9275 | 9872 | 764 | −1275 | 1682 O |
| ATOM | 1852 | CB | GLN | A | 262 | 10.613 | 39.965 | 7.763 | 1.00 | 94.28 | C |
| ANISOU | 1852 | CB | GLN | A | 262 | 14108 | 10273 | 11439 | 903 | −1425 | 1885 C |
| ATOM | 1853 | CG | GLN | A | 262 | 9.599 | 40.907 | 7.109 | 1.00 | 99.86 | C |
| ANISOU | 1853 | CG | GLN | A | 262 | 14908 | 10881 | 12153 | 1019 | −1582 | 2018 C |
| ATOM | 1854 | CD | GLN | A | 262 | 8.551 | 41.422 | 8.077 | 1.00 | 101.49 | C |
| ANISOU | 1854 | CD | GLN | A | 262 | 14963 | 11009 | 12591 | 1092 | −1685 | 1954 C |
| ATOM | 1855 | OE1 | GLN | A | 262 | 7.549 | 40.755 | 8.341 | 1.00 | 100.69 | O |
| ANISOU | 1855 | OE1 | GLN | A | 262 | 14749 | 10983 | 12525 | 1152 | −1824 | 1862 O |
| ATOM | 1856 | NE2 | GLN | A | 262 | 8.775 | 42.619 | 8.608 | 1.00 | 101.14 | N |
| ANISOU | 1856 | NE2 | GLN | A | 262 | 14914 | 10805 | 12711 | 1086 | −1613 | 2003 N |
| ATOM | 1857 | N | HIS | A | 263 | 13.745 | 38.541 | 7.668 | 1.00 | 91.62 | N |
| ANISOU | 1857 | N | HIS | A | 263 | 13805 | 10096 | 10911 | 642 | −993 | 1818 N |
| ATOM | 1858 | CA | HIS | A | 263 | 14.644 | 37.532 | 8.219 | 1.00 | 85.65 | C |
| ANISOU | 1858 | CA | HIS | A | 263 | 12948 | 9441 | 10155 | 552 | −868 | 1698 C |
| ATOM | 1859 | C | HIS | A | 263 | 15.786 | 38.230 | 8.948 | 1.00 | 83.83 | C |
| ANISOU | 1859 | C | HIS | A | 263 | 12656 | 9119 | 10078 | 451 | −698 | 1707 C |
| ATOM | 1860 | O | HIS | A | 263 | 16.217 | 39.319 | 8.555 | 1.00 | 80.50 | O |
| ANISOU | 1860 | O | HIS | A | 263 | 12330 | 8576 | 9680 | 432 | −628 | 1839 O |
| ATOM | 1861 | CB | HIS | A | 263 | 15.192 | 36.607 | 7.121 | 1.00 | 78.06 | C |
| ANISOU | 1861 | CB | HIS | A | 263 | 12109 | 8594 | 8956 | 537 | −807 | 1728 C |
| ATOM | 1862 | CG | HIS | A | 263 | 16.003 | 35.458 | 7.641 | 1.00 | 76.35 | C |
| ANISOU | 1862 | CG | HIS | A | 263 | 11784 | 8487 | 8739 | 461 | −695 | 1601 C |
| ATOM | 1863 | ND1 | HIS | A | 263 | 17.358 | 35.548 | 7.879 | 1.00 | 73.97 | N |
| ANISOU | 1863 | ND1 | HIS | A | 263 | 11453 | 8168 | 8484 | 362 | −497 | 1614 N |
| ATOM | 1864 | CD2 | HIS | A | 263 | 15.650 | 34.190 | 7.962 | 1.00 | 72.23 | C |
| ANISOU | 1864 | CD2 | HIS | A | 263 | 11174 | 8087 | 8182 | 471 | −755 | 1462 C |
| ATOM | 1865 | CE1 | HIS | A | 263 | 17.803 | 34.387 | 8.329 | 1.00 | 72.58 | C |
| ANISOU | 1865 | CE1 | HIS | A | 263 | 11174 | 8101 | 8301 | 321 | −444 | 1490 C |
| ATOM | 1866 | NE2 | HIS | A | 263 | 16.786 | 33.547 | 8.389 | 1.00 | 71.95 | N |
| ANISOU | 1866 | NE2 | HIS | A | 263 | 11063 | 8106 | 8170 | 385 | −595 | 1397 N |
| ATOM | 1867 | N | GLU | A | 264 | 16.281 | 37.575 | 10.004 | 1.00 | 75.08 | N |
| ANISOU | 1867 | N | GLU | A | 264 | 11389 | 8066 | 9071 | 384 | −636 | 1567 N |
| ATOM | 1868 | CA | GLU | A | 264 | 17.285 | 38.184 | 10.872 | 1.00 | 74.52 | C |
| ANISOU | 1868 | CA | GLU | A | 264 | 11235 | 7912 | 9167 | 286 | −504 | 1551 C |
| ATOM | 1869 | C | GLU | A | 264 | 18.576 | 38.487 | 10.125 | 1.00 | 73.68 | C |
| ANISOU | 1869 | C | GLU | A | 264 | 11221 | 7777 | 8997 | 206 | −329 | 1668 C |
| ATOM | 1870 | O | GLU | A | 264 | 19.281 | 39.442 | 10.470 | 1.00 | 78.74 | O |
| ANISOU | 1870 | O | GLU | A | 264 | 11848 | 8299 | 9770 | 137 | −236 | 1720 O |
| ATOM | 1871 | CB | GLU | A | 264 | 17.574 | 37.272 | 12.067 | 1.00 | 81.66 | C |
| ANISOU | 1871 | CB | GLU | A | 264 | 11964 | 8901 | 10162 | 234 | −484 | 1380 C |
| ATOM | 1872 | CG | GLU | A | 264 | 16.428 | 37.149 | 13.072 | 1.00 | 90.19 | C |
| ANISOU | 1872 | CG | GLU | A | 264 | 12933 | 9984 | 11352 | 295 | −622 | 1261 C |
| ATOM | 1873 | CD | GLU | A | 264 | 15.218 | 36.424 | 12.508 | 0.00 | 93.52 | C |
| ANISOU | 1873 | CD | GLU | A | 264 | 13383 | 10494 | 11658 | 396 | −769 | 1241 C |
| ATOM | 1874 | OE1 | GLU | A | 264 | 15.392 | 35.334 | 11.921 | 1.00 | 95.65 | O |
| ANISOU | 1874 | OE1 | GLU | A | 264 | 13678 | 10885 | 11778 | 393 | −759 | 1218 O |
| ATOM | 1875 | OE2 | GLU | A | 264 | 14.093 | 36.954 | 12.636 | 0.84 | 96.99 | O |
| ANISOU | 1875 | OE2 | GLU | A | 264 | 13817 | 10874 | 12159 | 479 | −894 | 1249 O |
| ATOM | 1876 | N | GLY | A | 265 | 18.906 | 37.690 | 9.114 | 1.00 | 66.38 | N |
| ANISOU | 1876 | N | GLY | A | 265 | 10389 | 6954 | 7877 | 213 | −276 | 1708 N |
| ATOM | 1877 | CA | GLY | A | 265 | 20.107 | 37.851 | 8.325 | 1.00 | 66.96 | C |
| ANISOU | 1877 | CA | GLY | A | 265 | 10554 | 7015 | 7874 | 145 | −93 | 1819 C |
| ATOM | 1878 | C | GLY | A | 265 | 20.004 | 38.877 | 7.221 | 1.00 | 84.41 | C |
| ANISOU | 1878 | C | GLY | A | 265 | 12955 | 9123 | 9992 | 179 | −75 | 2006 C |
| ATOM | 1879 | O | GLY | A | 265 | 20.951 | 39.042 | 6.445 | 1.00 | 84.49 | O |
| ANISOU | 1879 | O | GLY | A | 265 | 13062 | 9119 | 9922 | 129 | 88 | 2116 O |
| ATOM | 1880 | N | LEU | A | 266 | 18.871 | 39.570 | 7.119 | 1.00 | 92.43 | N |
| ANISOU | 1880 | N | LEU | A | 266 | 14031 | 10067 | 11023 | 266 | −233 | 2050 N |
| ATOM | 1881 | CA | LEU | A | 266 | 18.694 | 40.630 | 6.139 | 1.00 | 101.54 | C |
| ANISOU | 1881 | CA | LEU | A | 266 | 15368 | 11108 | 12102 | 306 | −234 | 2235 C |
| ATOM | 1882 | C | LEU | A | 266 | 18.940 | 41.978 | 6.789 | 1.00 | 104.92 | C |
| ANISOU | 1882 | C | LEU | A | 266 | 15757 | 11359 | 12751 | 261 | −193 | 2289 C |
| ATOM | 1883 | O | LEU | A | 266 | 18.329 | 42.274 | 7.828 | 1.00 | 106.31 | O |
| ANISOU | 1883 | O | LEU | A | 266 | 15809 | 11485 | 13098 | 280 | −295 | 2192 O |
| ATOM | 1884 | CB | LEU | A | 266 | 17.285 | 40.595 | 5.553 | 1.00 | 102.10 | C |
| ANISOU | 1884 | CB | LEU | A | 266 | 15536 | 11201 | 12056 | 437 | −446 | 2263 C |
| ATOM | 1885 | CG | LEU | A | 266 | 16.965 | 39.496 | 4.542 | 1.00 | 100.44 | C |
| ANISOU | 1885 | CG | LEU | A | 266 | 15438 | 11138 | 11587 | 492 | −503 | 2257 C |
| ATOM | 1886 | CD1 | LEU | A | 266 | 15.526 | 39.624 | 4.068 | 1.00 | 103.21 | C |
| ANISOU | 1886 | CD1 | LEU | A | 266 | 15864 | 11489 | 11861 | 618 | −738 | 2288 C |
| ATOM | 1887 | CD2 | LEU | A | 266 | 17.933 | 39.554 | 3.369 | 1.00 | 97.26 | C |
| ANISOU | 1887 | CD2 | LEU | A | 266 | 15219 | 10739 | 10995 | 454 | −333 | 2396 C |
| ATOM | 1888 | N | PRO | A | 267 | 19.824 | 42.810 | 6.229 | 1.00 | 107.41 | N |
| ANISOU | 1888 | N | PRO | A | 267 | 16172 | 11570 | 13069 | 199 | −41 | 2438 N |
| ATOM | 1889 | CA | PRO | A | 267 | 19.972 | 44.176 | 6.761 | 1.00 | 106.30 | C |
| ANISOU | 1889 | CA | PRO | A | 267 | 16014 | 11240 | 13136 | 161 | −15 | 2500 C |

TABLE 11-continued

| | | | | | | | | | | | |
|---|---|---|---|---|---|---|---|---|---|---|---|
| ATOM | 1890 | C | PRO | A | 267 | 18.650 | 44.921 | 6.810 | 1.00 | 103.32 | C |
| ANISOU | 1890 | C | PRO | A | 267 | 15686 | 10770 | 12802 | 276 | −201 | 2532 | C |
| ATOM | 1891 | O | PRO | A | 267 | 18.287 | 45.492 | 7.848 | 1.00 | 92.90 | O |
| ANISOU | 1891 | O | PRO | A | 267 | 14256 | 9356 | 11684 | 276 | −262 | 2454 | O |
| ATOM | 1892 | CB | PRO | A | 267 | 20.968 | 44.820 | 5.785 | 1.00 | 109.71 | C |
| ANISOU | 1892 | CB | PRO | A | 267 | 16591 | 11591 | 13503 | 98 | 168 | 2687 | C |
| ATOM | 1893 | CG | PRO | A | 267 | 21.716 | 43.673 | 5.184 | 1.00 | 110.42 | C |
| ANISOU | 1893 | CG | PRO | A | 267 | 16698 | 11838 | 13419 | 62 | 290 | 2670 | C |
| ATOM | 1894 | CD | PRO | A | 267 | 20.732 | 42.545 | 5.099 | 1.00 | 109.91 | C |
| ANISOU | 1894 | CD | PRO | A | 267 | 16624 | 11930 | 13206 | 160 | 126 | 2556 | C |
| ATOM | 1895 | N | LYS | A | 268 | 17.905 | 44.908 | 5.705 | 1.00 | 109.28 | N |
| ANISOU | 1895 | N | LYS | A | 268 | 16605 | 11549 | 13368 | 379 | −298 | 2643 | N |
| ATOM | 1896 | CA | LYS | A | 268 | 16.607 | 45.543 | 5.601 | 1.00 | 113.80 | C |
| ANISOU | 1896 | CA | LYS | A | 268 | 17228 | 12045 | 13966 | 503 | −487 | 2688 | C |
| ATOM | 1897 | C | LYS | A | 268 | 15.675 | 44.614 | 4.833 | 1.00 | 110.30 | C |
| ANISOU | 1897 | C | LYS | A | 268 | 16853 | 11747 | 13308 | 609 | −645 | 2676 | C |
| ATOM | 1898 | O | LYS | A | 268 | 16.124 | 43.903 | 3.920 | 1.00 | 109.67 | O |
| ANISOU | 1898 | O | LYS | A | 268 | 16883 | 11775 | 13011 | 595 | −583 | 2718 | O |
| ATOM | 1899 | CB | LYS | A | 268 | 16.705 | 46.907 | 4.898 | 1.00 | 114.44 | C |
| ANISOU | 1899 | CB | LYS | A | 268 | 17478 | 11945 | 14060 | 520 | −448 | 2896 | C |
| ATOM | 1900 | CG | LYS | A | 268 | 17.666 | 46.928 | 3.715 | 1.00 | 113.44 | C |
| ANISOU | 1900 | CG | LYS | A | 268 | 17527 | 11827 | 13746 | 467 | −283 | 3056 | C |
| ATOM | 1901 | CD | LYS | A | 268 | 17.963 | 48.348 | 3.256 | 1.00 | 111.99 | C |
| ANISOU | 1901 | CD | LYS | A | 268 | 17482 | 11442 | 13626 | 454 | −206 | 3253 | C |
| ATOM | 1902 | CE | LYS | A | 268 | 18.750 | 49.124 | 4.302 | 1.00 | 107.92 | C |
| ANISOU | 1902 | CE | LYS | A | 268 | 16835 | 10785 | 13384 | 337 | −82 | 3210 | C |
| ATOM | 1903 | NZ | LYS | A | 268 | 19.087 | 50.504 | 3.839 | 1.00 | 108.38 | N |
| ANISOU | 1903 | NZ | LYS | A | 268 | 17031 | 10635 | 13514 | 315 | 4 | 3404 | N |
| ATOM | 1904 | N | PRO | A | 269 | 14.390 | 44.579 | 5.196 | 1.00 | 104.14 | N |
| ANISOU | 1904 | N | PRO | A | 269 | 16007 | 10973 | 12588 | 714 | −846 | 2611 | N |
| ATOM | 1905 | CA | PRO | A | 269 | 13.446 | 43.694 | 4.501 | 1.00 | 103.50 | C |
| ANISOU | 1905 | CA | PRO | A | 269 | 15977 | 11026 | 12321 | 810 | −1018 | 2591 | C |
| ATOM | 1906 | C | PRO | A | 269 | 13.402 | 43.967 | 3.004 | 1.00 | 111.99 | C |
| ANISOU | 1906 | C | PRO | A | 269 | 17298 | 12093 | 13160 | 863 | −1043 | 2780 | C |
| ATOM | 1907 | O | PRO | A | 269 | 13.518 | 45.110 | 2.556 | 1.00 | 118.92 | O |
| ANISOU | 1907 | O | PRO | A | 269 | 18302 | 12826 | 14058 | 880 | −1011 | 2944 | O |
| ATOM | 1908 | CB | PRO | A | 269 | 12.105 | 44.017 | 5.170 | 1.00 | 98.62 | C |
| ANISOU | 1908 | CB | PRO | A | 269 | 15246 | 10361 | 11866 | 913 | −1213 | 2529 | C |
| ATOM | 1909 | CG | PRO | A | 269 | 12.482 | 44.488 | 6.535 | 1.00 | 95.35 | C |
| ANISOU | 1909 | CG | PRO | A | 269 | 14666 | 9857 | 11706 | 846 | −1119 | 2427 | C |
| ATOM | 1910 | CD | PRO | A | 269 | 13.778 | 45.233 | 6.365 | 1.00 | 99.05 | C |
| ANISOU | 1910 | CD | PRO | A | 269 | 15217 | 10222 | 12195 | 740 | −917 | 2529 | C |
| ATOM | 1911 | N | LEU | A | 270 | 13.234 | 42.897 | 2.232 | 1.00 | 113.73 | N |
| ANISOU | 1911 | N | LEU | A | 270 | 17596 | 12467 | 13151 | 889 | −1101 | 2754 | N |
| ATOM | 1912 | CA | LEU | A | 270 | 13.215 | 42.988 | 0.774 | 1.00 | 116.98 | C |
| ANISOU | 1912 | CA | LEU | A | 270 | 18259 | 12892 | 13297 | 939 | −1126 | 2918 | C |
| ATOM | 1913 | C | LEU | A | 270 | 11.796 | 42.855 | 0.220 | 1.00 | 120.74 | C |
| ANISOU | 1913 | C | LEU | A | 270 | 18794 | 13403 | 13679 | 1074 | −1402 | 2941 | C |
| ATOM | 1914 | O | LEU | A | 270 | 10.814 | 43.066 | 0.933 | 1.00 | 121.25 | O |
| ANISOU | 1914 | O | LEU | A | 270 | 18712 | 13433 | 13924 | 1137 | −1560 | 2873 | O |
| ATOM | 1915 | CB | LEU | A | 270 | 14.119 | 41.914 | 0.158 | 1.00 | 113.62 | C |
| ANISOU | 1915 | CB | LEU | A | 270 | 17914 | 12605 | 12651 | 872 | −984 | 2885 | C |
| ATOM | 1916 | CG | LEU | A | 270 | 15.629 | 42.022 | 0.390 | 1.00 | 109.84 | C |
| ANISOU | 1916 | CG | LEU | A | 270 | 17414 | 12098 | 12221 | 742 | −699 | 2900 | C |
| ATOM | 1917 | CD1 | LEU | A | 270 | 16.330 | 40.729 | −0.010 | 1.00 | 103.43 | C |
| ANISOU | 1917 | CD1 | LEU | A | 270 | 16628 | 11446 | 11226 | 692 | −586 | 2818 | C |
| ATOM | 1918 | CD2 | LEU | A | 270 | 16.207 | 43.207 | −0.377 | 1.00 | 110.61 | C |
| ANISOU | 1918 | CD2 | LEU | A | 270 | 17699 | 12055 | 12272 | 728 | −573 | 3118 | C |
| TER | | | | | | | | | | | |
| ATOM | 1919 | N | GLY | P | 1 | 23.643 | 19.078 | 27.227 | −1.00 | 31.13 | N |
| ANISOU | 1919 | N | GLY | P | 1 | 3756 | 3813 | 4257 | −172 | −305 | −317 | N |
| ATOM | 1920 | CA | GLY | P | 1 | 23.534 | 17.804 | 27.916 | 1.00 | 32.95 | C |
| ANISOU | 1920 | CA | GLY | P | 1 | 3942 | 4099 | 4477 | −149 | −319 | −372 | C |
| ATOM | 1921 | C | GLY | P | 1 | 22.141 | 17.616 | 28.494 | 1.00 | 32.63 | C |
| ANISOU | 1921 | C | GLY | P | 1 | 3929 | 4058 | 4412 | −107 | −381 | −429 | C |
| ATOM | 1922 | O | GLY | P | 1 | 21.467 | 18.581 | 28.881 | 1.00 | 32.85 | O |
| ANISOU | 1922 | O | GLY | P | 1 | 3986 | 4035 | 4460 | −106 | −423 | −439 | O |
| ATOM | 1923 | N | VAL | P | 2 | 21.717 | 16.351 | 28.540 | 1.00 | 30.63 | N |
| ANISOU | 1923 | N | VAL | P | 2 | 3663 | 3853 | 4122 | −72 | −380 | −465 | N |
| ATOM | 1924 | C | VAL | P | 2 | 20.259 | 16.179 | 30.513 | 1.00 | 32.94 | C |
| ANISOU | 1924 | C | VAL | P | 2 | 3941 | 4132 | 4442 | −46 | −457 | −558 | C |
| ATOM | 1925 | O | VAL | P | 2 | 21.249 | 16.218 | 31.248 | 1.00 | 31.46 | O |
| ANISOU | 1925 | O | VAL | P | 2 | 3720 | 3946 | 4286 | −82 | −454 | −558 | O |
| ATOM | 1926 | CA | AVAL | P | 2 | 20.364 | 16.040 | 28.994 | 0.66 | 34.93 | C |
| ANISOU | 1926 | CA | AVAL | P | 2 | 4223 | 4398 | 4652 | −34 | −428 | −514 | C |
| ATOM | 1927 | CB | AVAL | P | 2 | 19.952 | 14.631 | 28.543 | 0.66 | 34.16 | C |
| ANISOU | 1927 | CB | AVAL | P | 2 | 4121 | 4348 | 4508 | −0 | −416 | −539 | C |
| ATOM | 1928 | CG1 | AVAL | P | 2 | 20.223 | 14.417 | 27.044 | 0.66 | 33.03 | C |
| ANISOU | 1928 | CG1 | AVAL | P | 2 | 4022 | 4221 | 4305 | 10 | −381 | −502 | C |
| ATOM | 1929 | CG2 | AVAL | P | 2 | 20.675 | 13.624 | 29.353 | 0.66 | 30.18 | C |

TABLE 11-continued

| | | | | | | | | | | | |
|---|---|---|---|---|---|---|---|---|---|---|---|
| ANISOU | 1929 | CG2 | AVAL | P | 2 | 3565 | 3877 | 4025 | −10 | −393 | −560 | C |
| ATOM | 1930 | CA | BVAL | P | 2 | 20.382 | 15.978 | 29.000 | 0.34 | 33.90 | | C |
| ANISOU | 1930 | CA | BVAL | P | 2 | 4090 | 4270 | 4520 | −34 | −426 | −515 | C |
| ATOM | 1931 | CB | BVAL | P | 2 | 20.120 | 14.520 | 28.574 | 0.34 | 33.14 | | C |
| ANISOU | 1931 | CB | BVAL | P | 2 | 3987 | 4224 | 4381 | −3 | −409 | −538 | C |
| ATOM | 1932 | CG1 | BVAL | P | 2 | 19.163 | 13.773 | 29.496 | 0.34 | 29.55 | | C |
| ANISOU | 1932 | CG1 | BVAL | P | 2 | 3511 | 3780 | 3938 | 20 | −439 | −594 | C |
| ATOM | 1933 | CG2 | BVAL | P | 2 | 19.617 | 14.480 | 27.127 | 0.34 | 32.40 | | C |
| ANISOU | 1933 | CG2 | BVAL | P | 2 | 3951 | 4136 | 4225 | 23 | −408 | −516 | C |
| ATOM | 1934 | N | TYR | P | 3 | 19.021 | 16.288 | 30.981 | 1.00 | 33.13 | | N |
| ANISOU | 1934 | N | TYR | P | 3 | 3981 | 4139 | 4468 | −15 | −488 | −595 | N |
| ATOM | 1935 | CA | TYR | P | 3 | 18.733 | 16.399 | 32.411 | 1.00 | 33.17 | | C |
| ANISOU | 1935 | CA | TYR | P | 3 | 3977 | 4128 | 4497 | −18 | −505 | −641 | C |
| ATOM | 1936 | C | TYR | P | 3 | 19.307 | 15.223 | 33.193 | 1.00 | 32.47 | | C |
| ANISOU | 1936 | C | TYR | P | 3 | 3853 | 4085 | 4398 | −25 | −493 | −660 | C |
| ATOM | 1937 | O | TYR | P | 3 | 19.190 | 14.068 | 32.775 | 1.00 | 30.54 | | O |
| ANISOU | 1937 | O | TYR | P | 3 | 3591 | 3880 | 4133 | −6 | −473 | −661 | O |
| ATOM | 1938 | CB | TYR | P | 3 | 17.224 | 16.459 | 32.613 | 1.00 | 28.84 | | C |
| ANISOU | 1938 | CB | TYR | P | 3 | 3442 | 3562 | 3956 | 27 | −519 | −673 | C |
| ATOM | 1939 | CG | TYR | P | 3 | 16.774 | 16.563 | 34.040 | 1.00 | 31.19 | | C |
| ANISOU | 1939 | CG | TYR | P | 3 | 3742 | 3841 | 4268 | 33 | −518 | −721 | C |
| ATOM | 1940 | CD1 | TYR | P | 3 | 17.200 | 17.614 | 34.838 | 1.00 | 33.79 | | C |
| ANISOU | 1940 | CD1 | TYR | P | 3 | 4100 | 4125 | 4614 | 8 | −530 | −735 | C |
| ATOM | 1941 | CD2 | TYR | P | 3 | 15.880 | 15.637 | 34.579 | 1.00 | 27.80 | | C |
| ANISOU | 1941 | CD2 | TYR | P | 3 | 3293 | 3433 | 3836 | 63 | −501 | −754 | C |
| ATOM | 1942 | CE1 | TYR | P | 3 | 16.773 | 17.748 | 36.141 | 1.00 | 35.38 | | C |
| ANISOU | 1942 | CE1 | TYR | P | 3 | 4324 | 4307 | 4813 | 17 | −524 | −784 | C |
| ATOM | 1943 | CE2 | TYR | P | 3 | 15.439 | 15.764 | 35.889 | 1.00 | 35.01 | | C |
| ANISOU | 1943 | CE2 | TYR | P | 3 | 4222 | 4328 | 4754 | 72 | −485 | −794 | C |
| ATOM | 1944 | CZ | TYR | P | 3 | 15.889 | 16.831 | 36.656 | 1.00 | 35.09 | | C |
| ANISOU | 1944 | CZ | TYR | P | 3 | 4273 | 4295 | 4765 | 52 | −497 | −811 | C |
| ATOM | 1945 | OH | TYR | P | 3 | 15.486 | 16.988 | 37.950 | 1.00 | 37.45 | | O |
| ANISOU | 1945 | OH | TYR | P | 3 | 4604 | 4573 | 5051 | 62 | −477 | −855 | O |
| ATOM | 1946 | N | ASP | P | 4 | 19.922 | 15.524 | 34.348 | 1.00 | 32.31 | | N |
| ANISOU | 1946 | N | ASP | P | 4 | 3830 | 4054 | 4393 | −53 | −510 | −677 | N |
| ATOM | 1947 | CA | ASP | P | 4 | 20.566 | 14.506 | 35.174 | 1.00 | 33.66 | | C |
| ANISOU | 1947 | CA | ASP | P | 4 | 3972 | 4263 | 4554 | −60 | −511 | −687 | C |
| ATOM | 1948 | C | ASP | P | 4 | 20.005 | 14.459 | 36.589 | 1.00 | 37.31 | | C |
| ANISOU | 1948 | C | ASP | P | 4 | 4464 | 4715 | 4998 | −50 | −527 | −731 | C |
| ATOM | 1949 | O | ASP | P | 4 | 20.631 | 13.862 | 37.471 | 1.00 | 34.81 | | O |
| ANISOU | 1949 | O | ASP | P | 4 | 4139 | 4421 | 4667 | −60 | −542 | −736 | O |
| ATOM | 1950 | CB | ASP | P | 4 | 22.087 | 14.715 | 35.236 | 1.00 | 36.73 | | C |
| ANISOU | 1950 | CB | ASP | P | 4 | 4325 | 4660 | 4972 | −105 | −526 | −656 | C |
| ATOM | 1951 | CG | ASP | P | 4 | 22.860 | 13.410 | 35.568 | 1.00 | 55.62 | | C |
| ANISOU | 1951 | CG | ASP | P | 4 | 6670 | 7100 | 7363 | −99 | −520 | −646 | C |
| ATOM | 1952 | OD1 | ASP | P | 4 | 22.227 | 12.331 | 35.699 | 1.00 | 55.34 | | O |
| ANISOU | 1952 | OD1 | ASP | P | 4 | 6639 | 7089 | 7300 | −62 | −499 | −661 | O |
| ATOM | 1953 | OD2 | ASP | P | 4 | 24.105 | 13.461 | 35.685 | 1.00 | 66.36 | | O |
| ANISOU | 1953 | OD2 | ASP | P | 4 | 7984 | 8470 | 8761 | −131 | −535 | −620 | O |
| ATOM | 1954 | N | GLY | P | 5 | 18.850 | 15.073 | 36.835 | 1.00 | 30.31 | | N |
| ANISOU | 1954 | N | GLY | P | 5 | 3614 | 3793 | 4110 | −26 | −521 | −761 | N |
| ATOM | 1955 | CA | GLY | P | 5 | 18.228 | 14.978 | 38.134 | 1.00 | 30.41 | | C |
| ANISOU | 1955 | CA | GLY | P | 5 | 3662 | 3795 | 4099 | −10 | −515 | −804 | C |
| ATOM | 1956 | C | GLY | P | 5 | 17.508 | 13.653 | 38.305 | 1.00 | 30.00 | | C |
| ANISOU | 1956 | C | GLY | P | 5 | 3591 | 3777 | 4031 | 23 | −477 | −809 | C |
| ATOM | 1957 | O | GLY | P | 5 | 17.561 | 12.759 | 37.456 | 1.00 | 31.96 | | O |
| ANISOU | 1957 | O | GLY | P | 5 | 3800 | 4056 | 4287 | 31 | −465 | −786 | O |
| ATOM | 1958 | N | GLU | P | 6 | 16.803 | 13.545 | 39.429 | 1.00 | 30.30 | | N |
| ANISOU | 1958 | N | GLU | P | 6 | 3664 | 3802 | 4046 | 42 | −453 | −842 | N |
| ATOM | 1959 | CA | GLU | P | 6 | 16.041 | 12.336 | 39.732 | 1.00 | 32.63 | | C |
| ANISOU | 1959 | CA | GLU | P | 6 | 3944 | 4120 | 4335 | 69 | −408 | −845 | C |
| ATOM | 1960 | C | GLU | P | 6 | 14.978 | 12.066 | 38.665 | 1.00 | 33.26 | | C |
| ANISOU | 1960 | C | GLU | P | 6 | 3977 | 4196 | 4462 | 94 | −386 | −841 | C |
| ATOM | 1961 | O | GLU | P | 6 | 14.305 | 12.980 | 38.187 | 1.00 | 31.95 | | O |
| ANISOU | 1961 | O | GLU | P | 6 | 3810 | 4000 | 4330 | 107 | −392 | −850 | O |
| ATOM | 1962 | CB | GLU | P | 6 | 15.376 | 12.467 | 41.111 | 1.00 | 29.67 | | C |
| ANISOU | 1962 | CB | GLU | P | 6 | 3623 | 3724 | 3927 | 87 | −369 | −878 | C |
| ATOM | 1963 | CG | GLU | P | 6 | 14.490 | 11.275 | 41.471 | 1.00 | 29.24 | | C |
| ANISOU | 1963 | CG | GLU | P | 6 | 3551 | 3682 | 3876 | 112 | −307 | −876 | C |
| ATOM | 1964 | CD | GLU | P | 6 | 13.866 | 11.379 | 42.849 | 1.00 | 35.69 | | C |
| ANISOU | 1964 | CD | GLU | P | 6 | 4431 | 4479 | 4652 | 131 | −251 | −903 | C |
| ATOM | 1965 | OE1 | GLU | P | 6 | 13.399 | 10.325 | 43.347 | 1.00 | 31.57 | | O |
| ANISOU | 1965 | OE1 | GLU | P | 6 | 3906 | 3969 | 4121 | 144 | −197 | −892 | O |
| ATOM | 1966 | OE2 | GLU | P | 6 | 13.825 | 12.497 | 43.428 | 1.00 | 34.09 | | O |
| ANISOU | 1966 | OE2 | GLU | P | 6 | 4284 | 4244 | 4425 | 133 | −254 | −936 | O |
| ATOM | 1967 | N | GLU | P | 7 | 14.823 | 10.791 | 38.298 | 1.00 | 28.61 | | N |
| ANISOU | 1967 | N | GLU | P | 7 | 3353 | 3635 | 3880 | 100 | −369 | −829 | N |
| ATOM | 1968 | CA | GLU | P | 7 | 13.807 | 10.385 | 37.331 | 1.00 | 33.48 | | C |
| ANISOU | 1968 | CA | GLU | P | 7 | 3929 | 4251 | 4543 | 118 | −362 | −831 | C |
| ATOM | 1969 | C | GLU | P | 7 | 12.461 | 10.164 | 38.010 | 1.00 | 30.47 | | C |

TABLE 11-continued

| | | | | | | | | | | | |
|---|---|---|---|---|---|---|---|---|---|---|---|
| ANISOU | 1969 | C | GLU | P | 7 | 3532 | 3849 | 4198 | 141 | −314 | −854 | C |
| ATOM | 1970 | O | GLU | P | 7 | 12.385 | 9.558 | 39.082 | 1.00 | 30.32 | | O |
| ANISOU | 1970 | O | GLU | P | 7 | 3530 | 3831 | 4160 | 143 | −268 | −859 | O |
| ATOM | 1971 | CB | GLU | P | 7 | 14.240 | 9.095 | 36.631 | 1.00 | 25.02 | | C |
| ANISOU | 1971 | CB | GLU | P | 7 | 2831 | 3209 | 3466 | 110 | −364 | −815 | C |
| ATOM | 1972 | CG | GLU | P | 7 | 15.459 | 9.267 | 35.764 | 1.00 | 34.41 | | C |
| ANISOU | 1972 | CG | GLU | P | 7 | 4024 | 4418 | 4631 | 93 | −394 | −790 | C |
| ATOM | 1973 | CD | GLU | P | 7 | 15.102 | 9.720 | 34.363 | 1.00 | 46.51 | | C |
| ANISOU | 1973 | CD | GLU | P | 7 | 5553 | 5947 | 6173 | 98 | −421 | −785 | C |
| ATOM | 1974 | OE1 | GLU | P | 7 | 15.979 | 10.314 | 33.694 | 1.00 | 55.18 | | O |
| ANISOU | 1974 | OE1 | GLU | P | 7 | 6664 | 7050 | 7251 | 85 | −437 | −761 | O |
| ATOM | 1975 | OE2 | GLU | P | 7 | 13.944 | 9.482 | 33.938 | 1.00 | 44.46 | | O |
| ANISOU | 1975 | OE2 | GLU | P | 7 | 5274 | 5676 | 5941 | 115 | −428 | −802 | O |
| ATOM | 1976 | N | HIS | P | 8 | 11.385 | 10.640 | 37.373 | 1.00 | 30.12 | | N |
| ANISOU | 1976 | N | HIS | P | 8 | 3452 | 3782 | 4209 | 161 | −322 | −864 | N |
| ATOM | 1977 | CA | HIS | P | 8 | 10.040 | 10.452 | 37.906 | 1.00 | 32.32 | | C |
| ANISOU | 1977 | CA | HIS | P | 8 | 3694 | 4038 | 4547 | 185 | −271 | −884 | C |
| ATOM | 1978 | C | HIS | P | 8 | 9.108 | 9.978 | 36.805 | 1.00 | 33.56 | | C |
| ANISOU | 1978 | C | HIS | P | 8 | 3783 | 4195 | 4773 | 191 | −303 | −883 | C |
| ATOM | 1979 | O | HIS | P | 8 | 9.043 | 10.596 | 35.738 | 1.00 | 30.44 | | O |
| ANISOU | 1979 | O | HIS | P | 8 | 3380 | 3797 | 4389 | 198 | −365 | −876 | O |
| ATOM | 1980 | CB | HIS | P | 8 | 9.519 | 11.751 | 38.513 | 1.00 | 32.23 | | C |
| ANISOU | 1980 | CB | HIS | P | 8 | 3704 | 3987 | 4554 | 211 | −248 | −902 | C |
| ATOM | 1981 | CG | HIS | P | 8 | 10.362 | 12.242 | 39.642 | 1.00 | 33.87 | | C |
| ANISOU | 1981 | CG | HIS | P | 8 | 3990 | 4190 | 4690 | 201 | −227 | −913 | C |
| ATOM | 1982 | ND1 | HIS | P | 8 | 10.211 | 11.779 | 40.932 | 1.00 | 31.32 | | N |
| ANISOU | 1982 | ND1 | HIS | P | 8 | 3702 | 3865 | 4333 | 205 | −159 | −926 | N |
| ATOM | 1983 | CD2 | HIS | P | 8 | 11.411 | 13.097 | 39.664 | 1.00 | 29.97 | | C |
| ANISOU | 1983 | CD2 | HIS | P | 8 | 3548 | 3690 | 4148 | 182 | −271 | −911 | C |
| ATOM | 1984 | CE1 | HIS | P | 8 | 11.113 | 12.356 | 41.709 | 1.00 | 33.98 | | C |
| ANISOU | 1984 | CE1 | HIS | P | 8 | 4116 | 4198 | 4596 | 192 | −172 | −936 | C |
| ATOM | 1985 | NE2 | HIS | P | 8 | 11.850 | 13.164 | 40.965 | 1.00 | 32.38 | | N |
| ANISOU | 1985 | NE2 | HIS | P | 8 | 3920 | 3992 | 4393 | 175 | −241 | −930 | N |
| ATOM | 1986 | N | SER | P | 9 | 8.391 | 8.882 | 37.059 | 1.00 | 32.34 | | N |
| ANISOU | 1986 | N | SER | P | 9 | 3583 | 4040 | 4664 | 188 | −264 | −890 | N |
| ATOM | 1987 | CA | SER | P | 9 | 7.345 | 8.510 | 36.125 | 1.00 | 31.18 | | C |
| ANISOU | 1987 | CA | SER | P | 9 | 3364 | 3885 | 4599 | 191 | −302 | −898 | C |
| ATOM | 1988 | C | SER | P | 9 | 6.074 | 9.282 | 36.440 | 1.00 | 32.17 | | C |
| ANISOU | 1988 | C | SER | P | 9 | 3433 | 3976 | 4813 | 224 | −277 | −909 | C |
| ATOM | 1989 | O | SER | P | 9 | 5.906 | 9.821 | 37.533 | 1.00 | 32.25 | | O |
| ANISOU | 1989 | O | SER | P | 9 | 3464 | 3967 | 4824 | 242 | −205 | −915 | O |
| ATOM | 1990 | CB | SER | P | 9 | 7.063 | 7.001 | 36.178 | 1.00 | 34.84 | | C |
| ANISOU | 1990 | CB | SER | P | 9 | 3792 | 4352 | 5093 | 167 | −276 | −902 | C |
| ATOM | 1991 | OG | SER | P | 9 | 6.453 | 6.621 | 37.403 | 1.00 | 40.22 | | O |
| ANISOU | 1991 | OG | SER | P | 9 | 4454 | 5014 | 5814 | 171 | −181 | −903 | O |
| ATOM | 1992 | N | VAL | P | 10 | 5.168 | 9.326 | 35.471 | 1.00 | 34.67 | | N |
| ANISOU | 1992 | N | VAL | P | 10 | 3681 | 4284 | 5208 | 233 | −340 | −912 | N |
| ATOM | 1993 | CA | VAL | P | 10 | 3.871 | 9.960 | 35.700 | 1.00 | 32.17 | | C |
| ANISOU | 1993 | CA | VAL | P | 10 | 3288 | 3932 | 5003 | 268 | −321 | −919 | C |
| ATOM | 1994 | C | VAL | P | 10 | 3.022 | 9.135 | 36.667 | 0.85 | 34.76 | | C |
| ANISOU | 1994 | C | VAL | P | 10 | 3552 | 4243 | 5410 | 263 | −221 | −928 | C |
| ATOM | 1995 | O | VAL | P | 10 | 3.381 | 8.018 | 37.085 | 1.00 | 36.29 | | O |
| ANISOU | 1995 | O | VAL | P | 10 | 3763 | 4450 | 5574 | 230 | −177 | −927 | O |
| ATOM | 1996 | CB | VAL | P | 10 | 3.096 | 10.162 | 34.391 | 0.96 | 35.16 | | C |
| ANISOU | 1996 | CB | VAL | P | 10 | 3601 | 4306 | 5452 | 280 | −431 | −915 | C |
| ATOM | 1997 | CG1 | VAL | P | 10 | 3.932 | 10.976 | 33.414 | 1.00 | 30.04 | | C |
| ANISOU | 1997 | CG1 | VAL | P | 10 | 3027 | 3671 | 4716 | 286 | −518 | −897 | C |
| ATOM | 1998 | CG2 | VAL | P | 10 | 2.712 | 8.791 | 33.808 | 1.00 | 32.72 | | C |
| ANISOU | 1998 | CG2 | VAL | P | 10 | 3238 | 4010 | 5183 | 242 | −470 | −927 | C |
| ATOM | 1999 | OXT | VAL | P | 10 | 1.939 | 9.586 | 37.038 | 1.00 | 35.99 | | O |
| ANISOU | 1999 | OXT | VAL | P | 10 | 3636 | 4369 | 5671 | 294 | −177 | −934 | O |
| TER | | | | | | | | | | | | |
| ATOM | 2000 | N | GLU | H | 1 | 33.901 | 6.232 | 44.621 | 1.00 | 54.33 | | N |
| ANISOU | 2000 | N | GLU | H | 1 | 5966 | 7181 | 7496 | −49 | −1282 | −338 | N |
| ATOM | 2001 | CA | GLU | H | 1 | 33.053 | 5.093 | 44.315 | 1.00 | 60.75 | | C |
| ANISOU | 2001 | CA | GLU | H | 1 | 6832 | 7993 | 8258 | 18 | −1172 | −328 | C |
| ATOM | 2002 | C | GLU | H | 1 | 31.865 | 5.086 | 45.271 | 1.00 | 48.64 | | C |
| ANISOU | 2002 | C | GLU | H | 1 | 5460 | 6450 | 6571 | 26 | −1183 | −365 | C |
| ATOM | 2003 | O | GLU | H | 1 | 31.939 | 5.655 | 46.359 | 1.00 | 47.90 | | O |
| ANISOU | 2003 | O | GLU | H | 1 | 5435 | 6358 | 6408 | −3 | −1293 | −383 | O |
| ATOM | 2004 | CB | GLU | H | 1 | 33.854 | 3.781 | 44.399 | 1.00 | 70.77 | | C |
| ANISOU | 2004 | CB | GLU | H | 1 | 8019 | 9273 | 9598 | 83 | −1184 | −262 | C |
| ATOM | 2005 | CG | GLU | H | 1 | 33.802 | 3.053 | 45.744 | 1.00 | 78.00 | | C |
| ANISOU | 2005 | CG | GLU | H | 1 | 9012 | 10193 | 10432 | 120 | −1282 | −233 | C |
| ATOM | 2006 | CD | GLU | H | 1 | 34.758 | 3.623 | 46.786 | 1.00 | 85.96 | | C |
| ANISOU | 2006 | CD | GLU | H | 1 | 9996 | 11216 | 11449 | 85 | −1463 | −218 | C |
| ATOM | 2007 | OE1 | GLU | H | 1 | 35.162 | 4.800 | 46.660 | 1.00 | 87.14 | | O |
| ANISOU | 2007 | OE1 | GLU | H | 1 | 10105 | 11367 | 11639 | 16 | −1517 | −250 | O |
| ATOM | 2008 | OE2 | GLU | H | 1 | 35.107 | 2.884 | 47.736 | 1.00 | 85.89 | | O |
| ANISOU | 2008 | OE2 | GLU | H | 1 | 10011 | 11215 | 11408 | 126 | −1558 | −172 | O |

TABLE 11-continued

| | | | | | | | | | | | | |
|---|---|---|---|---|---|---|---|---|---|---|---|---|
| ATOM | 2009 | N | VAL | H | 2 | 30.756 | 4.475 | 44.848 | 1.00 | 46.04 | | N |
| ANISOU | 2009 | N | VAL | H | 2 | 5192 | 6110 | 6191 | 62 | −1065 | −379 | N |
| ATOM | 2010 | CA | VAL | H | 2 | 29.559 | 4.440 | 45.675 | 1.00 | 42.38 | | C |
| ANISOU | 2010 | CA | VAL | H | 2 | 4869 | 5635 | 5598 | 70 | −1050 | −410 | C |
| ATOM | 2011 | C | VAL | H | 2 | 29.789 | 3.530 | 46.875 | 1.00 | 44.88 | | C |
| ANISOU | 2011 | C | VAL | H | 2 | 5239 | 5957 | 5855 | 110 | −1120 | −366 | C |
| ATOM | 2012 | O | VAL | H | 2 | 30.327 | 2.423 | 46.748 | 1.00 | 45.83 | | O |
| ANISOU | 2012 | O | VAL | H | 2 | 5301 | 6081 | 6032 | 158 | −1115 | −310 | O |
| ATOM | 2013 | CB | VAL | H | 2 | 28.350 | 3.980 | 44.840 | 1.00 | 45.88 | | C |
| ANISOU | 2013 | CB | VAL | H | 2 | 5343 | 6062 | 6028 | 94 | −909 | −432 | C |
| ATOM | 2014 | CG1 | VAL | H | 2 | 27.140 | 3.687 | 45.733 | 1.00 | 37.90 | | C |
| ANISOU | 2014 | CG1 | VAL | H | 2 | 4459 | 5037 | 4903 | 112 | −877 | −450 | C |
| ATOM | 2015 | CG2 | VAL | H | 2 | 27.988 | 5.038 | 43.780 | 1.00 | 44.93 | | C |
| ANISOU | 2015 | CG2 | VAL | H | 2 | 5198 | 5934 | 5939 | 55 | −856 | −476 | C |
| ATOM | 2016 | N | GLN | H | 3 | 29.389 | 3.993 | 48.053 | 1.00 | 42.55 | | N |
| ANISOU | 2016 | N | GLN | H | 3 | 5064 | 5661 | 5442 | 95 | −1183 | −389 | N |
| ATOM | 2017 | CA | GLN | H | 3 | 29.391 | 3.146 | 49.236 | 1.00 | 48.61 | | C |
| ANISOU | 2017 | CA | GLN | H | 3 | 5916 | 6432 | 6122 | 135 | −1236 | −346 | C |
| ATOM | 2018 | C | GLN | H | 3 | 28.070 | 3.291 | 49.966 | 1.00 | 43.93 | | C |
| ANISOU | 2018 | C | GLN | H | 3 | 5478 | 5823 | 5391 | 138 | −1172 | −383 | C |
| ATOM | 2019 | O | GLN | H | 3 | 27.573 | 4.403 | 50.150 | 1.00 | 41.26 | | O |
| ANISOU | 2019 | O | GLN | H | 3 | 5202 | 5477 | 4999 | 98 | −1171 | −446 | O |
| ATOM | 2020 | CB | GLN | H | 3 | 30.543 | 3.492 | 50.185 | 1.00 | 54.06 | | C |
| ANISOU | 2020 | CB | GLN | H | 3 | 6603 | 7140 | 6796 | 117 | −1413 | −324 | C |
| ATOM | 2021 | CG | GLN | H | 3 | 31.917 | 3.178 | 49.638 | 1.00 | 61.15 | | C |
| ANISOU | 2021 | CG | GLN | H | 3 | 7335 | 8054 | 7843 | 124 | −1482 | −274 | C |
| ATOM | 2022 | CD | GLN | H | 3 | 32.993 | 3.382 | 50.681 | 1.00 | 78.47 | | C |
| ANISOU | 2022 | CD | GLN | H | 3 | 9525 | 10266 | 10023 | 111 | −1673 | −245 | C |
| ATOM | 2023 | OE1 | GLN | H | 3 | 32.890 | 2.878 | 51.803 | 1.00 | 81.62 | | O |
| ANISOU | 2023 | OE1 | GLN | H | 3 | 10034 | 10668 | 10309 | 142 | −1744 | −216 | O |
| ATOM | 2024 | NE2 | GLN | H | 3 | 34.028 | 4.137 | 50.324 | 1.00 | 83.14 | | N |
| ANISOU | 2024 | NE2 | GLN | H | 3 | 9994 | 10867 | 10729 | 63 | −1760 | −252 | N |
| ATOM | 2025 | N | LEU | H | 4 | 27.507 | 2.157 | 50.376 | 1.00 | 37.41 | | N |
| ANISOU | 2025 | N | LEU | H | 4 | 4713 | 4985 | 4516 | 186 | −1110 | −341 | N |
| ATOM | 2026 | CA | LEU | H | 4 | 26.295 | 2.110 | 51.182 | 1.00 | 37.15 | | C |
| ANISOU | 2026 | CA | LEU | H | 4 | 4824 | 4934 | 4355 | 196 | −1037 | −360 | C |
| ATOM | 2027 | C | LEU | H | 4 | 26.564 | 1.206 | 52.372 | 1.00 | 41.59 | | C |
| ANISOU | 2027 | C | LEU | H | 4 | 5478 | 5498 | 4826 | 237 | −1093 | −292 | C |
| ATOM | 2028 | O | LEU | H | 4 | 26.835 | 0.016 | 52.188 | 1.00 | 44.94 | | O |
| ANISOU | 2028 | O | LEU | H | 4 | 5858 | 5913 | 5304 | 280 | −1073 | −226 | O |
| ATOM | 2029 | CB | LEU | H | 4 | 25.113 | 1.581 | 50.365 | 1.00 | 33.54 | | C |
| ANISOU | 2029 | CB | LEU | H | 4 | 4349 | 4453 | 3942 | 210 | −876 | −372 | C |
| ATOM | 2030 | CG | LEU | H | 4 | 24.717 | 2.343 | 49.100 | 1.00 | 31.47 | | C |
| ANISOU | 2030 | CG | LEU | H | 4 | 4004 | 4187 | 3765 | 178 | −815 | −430 | C |
| ATOM | 2031 | CD1 | LEU | H | 4 | 23.730 | 1.521 | 48.256 | 1.00 | 38.23 | | C |
| ANISOU | 2031 | CD1 | LEU | H | 4 | 4829 | 5020 | 4677 | 198 | −682 | −429 | C |
| ATOM | 2032 | CD2 | LEU | H | 4 | 24.115 | 3.681 | 49.497 | 1.00 | 32.38 | | C |
| ANISOU | 2032 | CD2 | LEU | H | 4 | 4194 | 4298 | 3810 | 142 | −817 | −498 | C |
| ATOM | 2033 | N | LEU | H | 5 | 26.503 | 1.765 | 53.587 | 1.00 | 45.32 | | N |
| ANISOU | 2033 | N | LEU | H | 5 | 6087 | 5977 | 5157 | 226 | −1163 | −309 | N |
| ATOM | 2034 | CA | LEU | H | 5 | 26.841 | 1.047 | 54.818 | 1.00 | 46.29 | | C |
| ANISOU | 2034 | CA | LEU | H | 5 | 6319 | 6103 | 5166 | 263 | −1239 | −243 | C |
| ATOM | 2035 | C | LEU | H | 5 | 25.613 | 0.989 | 55.720 | 1.00 | 46.44 | | C |
| ANISOU | 2035 | C | LEU | H | 5 | 6511 | 6102 | 5032 | 276 | −1133 | −254 | C |
| ATOM | 2036 | O | LEU | H | 5 | 25.195 | 2.016 | 56.278 | 1.00 | 45.45 | | O |
| ANISOU | 2036 | O | LEU | H | 5 | 6488 | 5977 | 4803 | 247 | −1138 | −321 | O |
| ATOM | 2037 | CB | LEU | H | 5 | 28.005 | 1.719 | 55.548 | 1.00 | 56.38 | | C |
| ANISOU | 2037 | CB | LEU | H | 5 | 7617 | 7408 | 6396 | 240 | −1438 | −247 | C |
| ATOM | 2038 | CG | LEU | H | 5 | 29.208 | 2.233 | 54.747 | 1.00 | 67.90 | | C |
| ANISOU | 2038 | CG | LEU | H | 5 | 8905 | 8887 | 8006 | 207 | −1549 | −257 | C |
| ATOM | 2039 | CD1 | LEU | H | 5 | 30.194 | 2.926 | 55.670 | 1.00 | 69.65 | | C |
| ANISOU | 2039 | CD1 | LEU | H | 5 | 9169 | 9129 | 8164 | 177 | −1752 | −267 | C |
| ATOM | 2040 | CD2 | LEU | H | 5 | 29.894 | 1.112 | 53.975 | 1.00 | 70.32 | | C |
| ANISOU | 2040 | CD2 | LEU | H | 5 | 9061 | 9195 | 8461 | 250 | −1538 | −181 | C |
| ATOM | 2041 | N | GLU | H | 6 | 25.043 | −0.209 | 55.868 | 1.00 | 40.55 | | N |
| ANISOU | 2041 | N | GLU | H | 6 | 5798 | 5332 | 4276 | 319 | −1031 | −189 | N |
| ATOM | 2042 | CA | GLU | H | 6 | 23.910 | −0.419 | 56.759 | 1.00 | 40.21 | | C |
| ANISOU | 2042 | CA | GLU | H | 6 | 5915 | 5266 | 4096 | 335 | −915 | −183 | C |
| ATOM | 2043 | C | GLU | H | 6 | 24.380 | −0.642 | 58.187 | 1.00 | 44.71 | | C |
| ANISOU | 2043 | C | GLU | H | 6 | 6647 | 5846 | 4495 | 361 | −1017 | −130 | C |
| ATOM | 2044 | O | GLU | H | 6 | 25.470 | −1.167 | 58.423 | 1.00 | 48.43 | | O |
| ANISOU | 2044 | O | GLU | H | 6 | 7091 | 6332 | 4977 | 384 | −1156 | −66 | O |
| ATOM | 2045 | CB | GLU | H | 6 | 23.086 | −1.644 | 56.351 | 1.00 | 46.19 | | C |
| ANISOU | 2045 | CB | GLU | H | 6 | 6642 | 5985 | 4921 | 364 | −759 | −130 | C |
| ATOM | 2046 | CG | GLU | H | 6 | 22.457 | −1.623 | 54.983 | 1.00 | 46.97 | | C |
| ANISOU | 2046 | CG | GLU | H | 6 | 6601 | 6069 | 5175 | 343 | −650 | −176 | C |
| ATOM | 2047 | CD | GLU | H | 6 | 23.320 | −2.303 | 53.956 | 1.00 | 44.69 | | C |
| ANISOU | 2047 | CD | GLU | H | 6 | 6162 | 5781 | 5036 | 356 | −698 | −143 | C |
| ATOM | 2048 | OE1 | GLU | H | 6 | 24.549 | −2.327 | 54.147 | 1.00 | 48.73 | | O |
| ANISOU | 2048 | OE1 | GLU | H | 6 | 6643 | 6317 | 5555 | 368 | −839 | −110 | O |

TABLE 11-continued

| | | | | | | | | | | | |
|---|---|---|---|---|---|---|---|---|---|---|---|
| ATOM | 2049 | OE2 | GLU | H | 6 | 22.772 | −2.805 | 52.958 | 1.00 | 44.02 | O |
| ANISOU | 2049 | OE2 | GLU | H | 6 | 5989 | 5672 | 5064 | 354 | −597 | −154 | O |
| ATOM | 2050 | N | SER | H | 7 | 23.527 | −0.277 | 59.143 | 1.00 | 45.32 | N |
| ANISOU | 2050 | N | SER | H | 7 | 6896 | 5913 | 4410 | 361 | −943 | −155 | N |
| ATOM | 2051 | CA | SER | H | 7 | 23.787 | −0.562 | 60.549 | 1.00 | 47.51 | C |
| ANISOU | 2051 | CA | SER | H | 7 | 7361 | 6195 | 4495 | 391 | −1015 | −101 | C |
| ATOM | 2052 | C | SER | H | 7 | 22.460 | −0.581 | 61.292 | 1.00 | 53.38 | C |
| ANISOU | 2052 | C | SER | H | 7 | 8268 | 6911 | 5104 | 403 | −834 | −109 | C |
| ATOM | 2053 | O | SER | H | 7 | 21.408 | −0.242 | 60.742 | 1.00 | 52.50 | O |
| ANISOU | 2053 | O | SER | H | 7 | 8112 | 6779 | 5057 | 385 | −674 | −165 | O |
| ATOM | 2054 | CB | SER | H | 7 | 24.736 | 0.465 | 61.172 | 1.00 | 50.01 | C |
| ANISOU | 2054 | CB | SER | H | 7 | 7742 | 6545 | 4713 | 364 | −1215 | −151 | C |
| ATOM | 2055 | OG | SER | H | 7 | 24.158 | 1.759 | 61.148 | 1.00 | 50.69 | O |
| ANISOU | 2055 | OG | SER | H | 7 | 7873 | 6628 | 4759 | 322 | −1169 | −264 | O |
| ATOM | 2056 | N | GLY | H | 8 | 22.528 | −0.974 | 62.562 | 1.00 | 49.17 | N |
| ANISOU | 2056 | N | GLY | H | 8 | 7925 | 6376 | 4381 | 435 | −862 | −50 | N |
| ATOM | 2057 | CA | GLY | H | 8 | 21.365 | −1.029 | 63.415 | 1.00 | 46.19 | C |
| ANISOU | 2057 | CA | GLY | H | 8 | 7724 | 5972 | 3855 | 451 | −688 | −46 | C |
| ATOM | 2058 | C | GLY | H | 8 | 20.708 | −2.390 | 63.514 | 1.00 | 52.75 | C |
| ANISOU | 2058 | C | GLY | H | 8 | 8569 | 6763 | 4709 | 487 | −533 | 60 | C |
| ATOM | 2059 | O | GLY | H | 8 | 19.754 | −2.539 | 64.283 | 1.00 | 55.12 | O |
| ANISOU | 2059 | O | GLY | H | 8 | 9019 | 7038 | 4887 | 502 | −376 | 79 | O |
| ATOM | 2060 | N | GLY | H | 9 | 21.176 | −3.379 | 62.761 | 1.00 | 51.63 | N |
| ANISOU | 2060 | N | GLY | H | 9 | 8281 | 6610 | 4726 | 501 | −564 | 129 | N |
| ATOM | 2061 | CA | GLY | H | 9 | 20.626 | −4.711 | 62.889 | 1.00 | 55.65 | C |
| ANISOU | 2061 | CA | GLY | H | 9 | 8812 | 7070 | 5261 | 533 | −430 | 234 | C |
| ATOM | 2062 | C | GLY | H | 9 | 20.979 | −5.357 | 64.217 | 1.00 | 60.37 | C |
| ANISOU | 2062 | C | GLY | H | 9 | 9613 | 7663 | 5664 | 579 | −481 | 340 | C |
| ATOM | 2063 | O | GLY | H | 9 | 21.938 | −4.983 | 64.894 | 1.00 | 64.47 | O |
| ANISOU | 2063 | O | GLY | H | 9 | 10221 | 8218 | 6055 | 592 | −670 | 347 | O |
| ATOM | 2064 | N | GLY | H | 10 | 20.174 | −6.340 | 64.600 | 1.00 | 54.53 | N |
| ANISOU | 2064 | N | GLY | H | 10 | 8948 | 6871 | 4901 | 601 | −313 | 426 | N |
| ATOM | 2065 | CA | GLY | H | 10 | 20.400 | −7.039 | 65.850 | 1.00 | 56.25 | C |
| ANISOU | 2065 | CA | GLY | H | 10 | 9370 | 7074 | 4928 | 648 | −337 | 541 | C |
| ATOM | 2066 | C | GLY | H | 10 | 19.186 | −7.871 | 66.226 | 1.00 | 52.23 | C |
| ANISOU | 2066 | C | GLY | H | 10 | 8945 | 6500 | 4398 | 658 | −91 | 614 | C |
| ATOM | 2067 | O | GLY | H | 10 | 18.301 | −8.113 | 65.407 | 1.00 | 52.19 | O |
| ANISOU | 2067 | O | GLY | H | 10 | 8807 | 6459 | 4564 | 629 | 74 | 587 | O |
| ATOM | 2068 | N | LEU | H | 11 | 19.178 | −8.291 | 67.485 | 1.00 | 55.47 | N |
| ANISOU | 2068 | N | LEU | H | 11 | 9581 | 6898 | 4597 | 696 | −76 | 708 | N |
| ATOM | 2069 | CA | LEU | H | 11 | 18.157 | −9.168 | 68.041 | 1.00 | 61.13 | C |
| ANISOU | 2069 | CA | LEU | H | 11 | 10409 | 7550 | 5267 | 710 | 151 | 803 | C |
| ATOM | 2070 | C | LEU | H | 11 | 17.082 | −8.340 | 68.737 | 1.00 | 64.82 | C |
| ANISOU | 2070 | C | LEU | H | 11 | 11023 | 8023 | 5583 | 693 | 330 | 740 | C |
| ATOM | 2071 | O | LEU | H | 11 | 17.384 | −7.331 | 69.378 | 1.00 | 65.12 | O |
| ANISOU | 2071 | O | LEU | H | 11 | 11194 | 8111 | 5439 | 697 | 238 | 671 | O |
| ATOM | 2072 | CB | LEU | H | 11 | 18.796 | −10.156 | 69.024 | 1.00 | 58.35 | C |
| ANISOU | 2072 | CB | LEU | H | 11 | 10231 | 7175 | 4765 | 768 | 70 | 958 | C |
| ATOM | 2073 | CG | LEU | H | 11 | 17.954 | −11.269 | 69.646 | 1.00 | 60.81 | C |
| ANISOU | 2073 | CG | LEU | H | 11 | 10667 | 7408 | 5029 | 789 | 282 | 1091 | C |
| ATOM | 2074 | CD1 | LEU | H | 11 | 17.159 | −12.010 | 68.585 | 1.00 | 60.28 | C |
| ANISOU | 2074 | CD1 | LEU | H | 11 | 10398 | 7274 | 5232 | 755 | 458 | 1095 | C |
| ATOM | 2075 | CD2 | LEU | H | 11 | 18.859 | −12.238 | 70.399 | 1.00 | 69.23 | C |
| ANISOU | 2075 | CD2 | LEU | H | 11 | 11868 | 8454 | 5982 | 852 | 144 | 1245 | C |
| ATOM | 2076 | N | VAL | H | 12 | 15.828 | −8.780 | 68.619 | 1.00 | 64.39 | N |
| ANISOU | 2076 | N | VAL | H | 12 | 10944 | 7912 | 5611 | 676 | 587 | 763 | N |
| ATOM | 2077 | CA | VAL | H | 12 | 14.693 | −8.027 | 69.145 | 1.00 | 70.07 | C |
| ANISOU | 2077 | CA | VAL | H | 12 | 11765 | 8628 | 6231 | 662 | 791 | 701 | C |
| ATOM | 2078 | C | VAL | H | 12 | 13.526 | −8.988 | 69.337 | 1.00 | 77.79 | C |
| ANISOU | 2078 | C | VAL | H | 12 | 12757 | 9529 | 7271 | 657 | 1062 | 794 | C |
| ATOM | 2079 | O | VAL | H | 12 | 13.355 | −9.941 | 68.573 | 1.00 | 77.35 | O |
| ANISOU | 2079 | O | VAL | H | 12 | 12543 | 9422 | 7423 | 640 | 1106 | 848 | O |
| ATOM | 2080 | CB | VAL | H | 12 | 14.333 | −6.847 | 68.204 | 1.00 | 66.66 | C |
| ANISOU | 2080 | CB | VAL | H | 12 | 11160 | 8230 | 5940 | 619 | 794 | 541 | C |
| ATOM | 2081 | CG1 | VAL | H | 12 | 14.063 | −7.349 | 66.801 | 1.00 | 64.60 | C |
| ANISOU | 2081 | CG1 | VAL | H | 12 | 10628 | 7940 | 5977 | 584 | 825 | 526 | C |
| ATOM | 2082 | CG2 | VAL | H | 12 | 13.144 | −6.059 | 68.736 | 1.00 | 64.62 | C |
| ANISOU | 2082 | CG2 | VAL | H | 12 | 10997 | 7962 | 5595 | 613 | 1011 | 475 | C |
| ATOM | 2083 | N | GLN | H | 13 | 12.718 | −8.736 | 70.380 | 1.00 | 81.31 | N |
| ANISOU | 2083 | N | GLN | H | 13 | 13400 | 9961 | 7535 | 671 | 1250 | 812 | N |
| ATOM | 2084 | CA | GLN | H | 13 | 11.569 | −9.572 | 70.702 | 1.00 | 86.99 | C |
| ANISOU | 2084 | CA | GLN | H | 13 | 14149 | 10604 | 8298 | 664 | 1528 | 905 | C |
| ATOM | 2085 | C | GLN | H | 13 | 10.386 | −9.261 | 69.781 | 1.00 | 83.70 | C |
| ANISOU | 2085 | C | GLN | H | 13 | 13515 | 10162 | 8127 | 614 | 1713 | 819 | C |
| ATOM | 2086 | O | GLN | H | 13 | 10.292 | −8.159 | 69.234 | 1.00 | 86.08 | O |
| ANISOU | 2086 | O | GLN | H | 13 | 13714 | 10508 | 8483 | 597 | 1665 | 683 | O |
| ATOM | 2087 | CB | GLN | H | 13 | 11.159 | −9.368 | 72.159 | 1.00 | 91.47 | C |
| ANISOU | 2087 | CB | GLN | H | 13 | 15012 | 11168 | 8574 | 701 | 1671 | 954 | C |
| ATOM | 2088 | CG | GLN | H | 13 | 11.573 | −10.515 | 73.074 | 1.00 | 100.77 | C |
| ANISOU | 2088 | CG | GLN | H | 13 | 16387 | 12308 | 9594 | 742 | 1666 | 1129 | C |

TABLE 11-continued

| | | | | | | | | | | | |
|---|---|---|---|---|---|---|---|---|---|---|---|
| ATOM | 2089 | CD | GLN | H | 13 | 13.028 | −10.914 | 72.887 | 1.00 | 105.85 | | C |
| ANISOU | 2089 | CD | GLN | H | 13 | 17019 | 12981 | 10219 | 768 | 1358 | 1174 | C |
| ATOM | 2090 | OE1 | GLN | H | 13 | 13.935 | −10.253 | 73.395 | 1.00 | 107.65 | | O |
| ANISOU | 2090 | OE1 | GLN | H | 13 | 17378 | 13273 | 10252 | 796 | 1150 | 1135 | O |
| ATOM | 2091 | NE2 | GLN | H | 13 | 13.256 | −11.998 | 72.149 | 1.00 | 106.53 | | N |
| ANISOU | 2091 | NE2 | GLN | H | 13 | 16943 | 13016 | 10516 | 759 | 1326 | 1252 | N |
| ATOM | 2092 | N | PRO | H | 14 | 9.475 | −10.221 | 69.587 | 1.00 | 75.92 | | N |
| ANISOU | 2092 | N | PRO | H | 14 | 12449 | 9099 | 7297 | 590 | 1918 | 899 | N |
| ATOM | 2093 | CA | PRO | H | 14 | 8.299 | −9.952 | 68.749 | 1.00 | 69.28 | | C |
| ANISOU | 2093 | CA | PRO | H | 14 | 11397 | 8231 | 6695 | 541 | 2089 | 822 | C |
| ATOM | 2094 | C | PRO | H | 14 | 7.465 | −8.818 | 69.324 | 1.00 | 75.88 | | C |
| ANISOU | 2094 | C | PRO | H | 14 | 12316 | 9091 | 7425 | 550 | 2250 | 738 | C |
| ATOM | 2095 | O | PRO | H | 14 | 7.389 | −8.624 | 70.540 | 1.00 | 79.17 | | O |
| ANISOU | 2095 | O | PRO | H | 14 | 12976 | 9512 | 7594 | 588 | 2341 | 779 | O |
| ATOM | 2096 | CB | PRO | H | 14 | 7.531 | −11.280 | 68.765 | 1.00 | 69.20 | | C |
| ANISOU | 2096 | CB | PRO | H | 14 | 11343 | 8125 | 6823 | 516 | 2285 | 947 | C |
| ATOM | 2097 | CG | PRO | H | 14 | 8.545 | −12.310 | 69.172 | 1.00 | 73.92 | | C |
| ANISOU | 2097 | CG | PRO | H | 14 | 12063 | 8702 | 7321 | 548 | 2152 | 1076 | C |
| ATOM | 2098 | CD | PRO | H | 14 | 9.478 | −11.600 | 70.106 | 1.00 | 75.96 | | C |
| ANISOU | 2098 | CD | PRO | H | 14 | 12548 | 9033 | 7280 | 603 | 1997 | 1066 | C |
| ATOM | 2099 | N | GLY | H | 15 | 6.837 | −8.059 | 68.431 | 1.00 | 76.02 | | N |
| ANISOU | 2099 | N | GLY | H | 15 | 12135 | 9121 | 7629 | 519 | 2285 | 620 | N |
| ATOM | 2100 | CA | GLY | H | 15 | 6.176 | −6.840 | 68.836 | 1.00 | 71.80 | | C |
| ANISOU | 2100 | CA | GLY | H | 15 | 11656 | 8611 | 7012 | 534 | 2402 | 520 | C |
| ATOM | 2101 | C | GLY | H | 15 | 7.111 | −5.708 | 69.192 | 1.00 | 73.09 | | C |
| ANISOU | 2101 | C | GLY | H | 15 | 11957 | 8847 | 6967 | 566 | 2207 | 428 | C |
| ATOM | 2102 | O | GLY | H | 15 | 6.637 | −4.613 | 69.516 | 1.00 | 68.81 | | O |
| ANISOU | 2102 | O | GLY | H | 15 | 11472 | 8322 | 6350 | 582 | 2289 | 333 | O |
| ATOM | 2103 | N | GLY | H | 16 | 8.424 | −5.934 | 69.151 | 1.00 | 69.57 | | N |
| ANISOU | 2103 | N | GLY | H | 16 | 11562 | 8438 | 6433 | 576 | 1953 | 452 | N |
| ATOM | 2104 | CA | GLY | H | 16 | 9.384 | −4.884 | 69.400 | 1.00 | 69.23 | | C |
| ANISOU | 2104 | CA | GLY | H | 16 | 11623 | 8461 | 6220 | 595 | 1742 | 363 | C |
| ATOM | 2105 | C | GLY | H | 16 | 9.618 | −4.024 | 68.173 | 1.00 | 69.46 | | C |
| ANISOU | 2105 | C | GLY | H | 16 | 11433 | 8524 | 6435 | 564 | 1602 | 236 | C |
| ATOM | 2106 | O | GLY | H | 16 | 8.977 | −4.168 | 67.130 | 1.00 | 66.56 | | O |
| ANISOU | 2106 | O | GLY | H | 16 | 10840 | 8133 | 6315 | 531 | 1671 | 210 | O |
| ATOM | 2107 | N | SER | H | 17 | 10.570 | −3.106 | 68.308 | 1.00 | 68.28 | | N |
| ANISOU | 2107 | N | SER | H | 17 | 11357 | 8428 | 6157 | 573 | 1395 | 158 | N |
| ATOM | 2108 | CA | SER | H | 17 | 10.893 | −2.188 | 67.229 | 1.00 | 69.25 | | C |
| ANISOU | 2108 | CA | SER | H | 17 | 11299 | 8583 | 6430 | 545 | 1255 | 40 | C |
| ATOM | 2109 | C | SER | H | 17 | 12.404 | −2.058 | 67.092 | 1.00 | 67.56 | | C |
| ANISOU | 2109 | C | SER | H | 17 | 11099 | 8418 | 6152 | 542 | 962 | 34 | C |
| ATOM | 2110 | O | SER | H | 17 | 13.166 | −2.349 | 68.017 | 1.00 | 65.46 | | O |
| ANISOU | 2110 | O | SER | H | 17 | 11019 | 8169 | 5685 | 568 | 858 | 93 | O |
| ATOM | 2111 | CB | SER | H | 17 | 10.264 | −0.804 | 67.451 | 1.00 | 68.57 | | C |
| ANISOU | 2111 | CB | SER | H | 17 | 11262 | 8501 | 6290 | 551 | 1342 | −85 | C |
| ATOM | 2112 | OG | SER | H | 17 | 10.875 | −0.144 | 68.538 | 1.00 | 75.09 | | O |
| ANISOU | 2112 | OG | SER | H | 17 | 12331 | 9352 | 6847 | 577 | 1254 | −119 | O |
| ATOM | 2113 | N | LEU | H | 18 | 12.825 | −1.600 | 65.915 | 1.00 | 60.22 | | N |
| ANISOU | 2113 | N | LEU | H | 18 | 9969 | 7511 | 5400 | 511 | 830 | −37 | N |
| ATOM | 2114 | CA | LEU | H | 18 | 14.235 | −1.401 | 65.621 | 1.00 | 58.49 | | C |
| ANISOU | 2114 | CA | LEU | H | 18 | 9722 | 7337 | 5166 | 503 | 562 | −51 | C |
| ATOM | 2115 | C | LEU | H | 18 | 14.333 | −0.384 | 64.499 | 1.00 | 56.50 | | C |
| ANISOU | 2115 | C | LEU | H | 18 | 9291 | 7104 | 5073 | 469 | 485 | −165 | C |
| ATOM | 2116 | O | LEU | H | 18 | 13.417 | −0.246 | 63.682 | 1.00 | 57.37 | | O |
| ANISOU | 2116 | O | LEU | H | 18 | 9252 | 7192 | 5355 | 452 | 615 | −203 | O |
| ATOM | 2117 | CB | LEU | H | 18 | 14.913 | −2.721 | 65.229 | 1.00 | 67.33 | | C |
| ANISOU | 2117 | CB | LEU | H | 18 | 10756 | 8450 | 6375 | 508 | 475 | 61 | C |
| ATOM | 2118 | CG | LEU | H | 18 | 16.427 | −2.751 | 65.009 | 1.00 | 67.96 | | C |
| ANISOU | 2118 | CG | LEU | H | 18 | 10802 | 8572 | 6448 | 509 | 207 | 74 | C |
| ATOM | 2119 | CD1 | LEU | H | 18 | 17.155 | −2.492 | 66.321 | 1.00 | 67.32 | | C |
| ANISOU | 2119 | CD1 | LEU | H | 18 | 10955 | 8516 | 6105 | 537 | 82 | 96 | C |
| ATOM | 2120 | CD2 | LEU | H | 18 | 16.857 | −4.084 | 64.400 | 1.00 | 63.79 | | C |
| ANISOU | 2120 | CD2 | LEU | H | 18 | 10151 | 8023 | 6064 | 518 | 171 | 176 | C |
| ATOM | 2121 | N | ARG | H | 19 | 15.460 | 0.317 | 64.457 | 1.00 | 54.12 | | N |
| ANISOU | 2121 | N | ARG | H | 19 | 9003 | 6843 | 4719 | 457 | 268 | −216 | N |
| ATOM | 2122 | CA | ARG | H | 19 | 15.703 | 1.326 | 63.431 | 1.00 | 54.51 | | C |
| ANISOU | 2122 | CA | ARG | H | 19 | 8897 | 6909 | 4907 | 423 | 179 | −317 | C |
| ATOM | 2123 | C | ARG | H | 19 | 16.989 | 0.991 | 62.688 | 1.00 | 47.02 | | C |
| ANISOU | 2123 | C | ARG | H | 19 | 7817 | 5991 | 4056 | 406 | −31 | −288 | C |
| ATOM | 2124 | O | ARG | H | 19 | 18.073 | 1.001 | 63.280 | 1.00 | 53.68 | | O |
| ANISOU | 2124 | O | ARG | H | 19 | 8750 | 6863 | 4785 | 412 | −207 | −266 | O |
| ATOM | 2125 | CB | ARG | H | 19 | 15.783 | 2.714 | 64.049 | 1.00 | 55.33 | | C |
| ANISOU | 2125 | CB | ARG | H | 19 | 9134 | 7020 | 4869 | 418 | 133 | −423 | C |
| ATOM | 2126 | CG | ARG | H | 19 | 15.912 | 3.820 | 63.044 | 1.00 | 64.12 | | C |
| ANISOU | 2126 | CG | ARG | H | 19 | 10101 | 8138 | 6122 | 383 | 65 | −525 | C |
| ATOM | 2127 | CD | ARG | H | 19 | 16.620 | 4.988 | 63.688 | 1.00 | 68.68 | | C |
| ANISOU | 2127 | CD | ARG | H | 19 | 10815 | 8727 | 6553 | 369 | −80 | −609 | C |
| ATOM | 2128 | NE | ARG | H | 19 | 16.284 | 6.258 | 63.069 | 1.00 | 67.73 | | N |
| ANISOU | 2128 | NE | ARG | H | 19 | 10623 | 8590 | 6523 | 346 | −65 | −720 | N |

TABLE 11-continued

| | | | | | | | | | | | |
|---|---|---|---|---|---|---|---|---|---|---|---|
| ATOM | 2129 | CZ | ARG | H | 19 | 16.980 | 7.373 | 63.259 | 1.00 | 76.18 | C |
| ANISOU | 2129 | CZ | ARG | H | 19 | 11752 | 9661 | 7531 | 319 | −211 | −805 | C |
| ATOM | 2130 | NH1 | ARG | H | 19 | 18.057 | 7.360 | 64.038 | 1.00 | 70.23 | N |
| ANISOU | 2130 | NH1 | ARG | H | 19 | 11122 | 8932 | 6630 | 309 | −393 | −794 | N |
| ATOM | 2131 | NH2 | ARG | H | 19 | 16.606 | 8.497 | 62.662 | 1.00 | 81.51 | N |
| ANISOU | 2131 | NH2 | ARG | H | 19 | 12361 | 10310 | 8301 | 301 | −182 | −898 | N |
| ATOM | 2132 | N | LEU | H | 20 | 16.872 | 0.709 | 61.394 | 1.00 | 45.12 | N |
| ANISOU | 2132 | N | LEU | H | 20 | 7367 | 5746 | 4031 | 387 | −15 | −291 | N |
| ATOM | 2133 | CA | LEU | H | 20 | 18.034 | 0.496 | 60.543 | 1.00 | 41.60 | C |
| ANISOU | 2133 | CA | LEU | H | 20 | 6780 | 5328 | 3700 | 371 | −190 | −275 | C |
| ATOM | 2134 | C | LEU | H | 20 | 18.475 | 1.816 | 59.928 | 1.00 | 46.16 | C |
| ANISOU | 2134 | C | LEU | H | 20 | 7282 | 5926 | 4330 | 336 | −296 | −377 | C |
| ATOM | 2135 | O | LEU | H | 20 | 17.643 | 2.669 | 59.590 | 1.00 | 45.74 | O |
| ANISOU | 2135 | O | LEU | H | 20 | 7204 | 5858 | 4318 | 321 | −200 | −454 | O |
| ATOM | 2136 | CB | LEU | H | 20 | 17.723 | −0.510 | 59.436 | 1.00 | 43.94 | C |
| ANISOU | 2136 | CB | LEU | H | 20 | 6901 | 5603 | 4190 | 369 | −117 | −229 | C |
| ATOM | 2137 | CG | LEU | H | 20 | 17.149 | −1.854 | 59.876 | 1.00 | 46.40 | C |
| ANISOU | 2137 | CG | LEU | H | 20 | 7263 | 5878 | 4490 | 397 | 10 | −130 | C |
| ATOM | 2138 | CD1 | LEU | H | 20 | 16.948 | −2.798 | 58.681 | 1.00 | 46.31 | C |
| ANISOU | 2138 | CD1 | LEU | H | 20 | 7074 | 5841 | 4683 | 388 | 58 | −98 | C |
| ATOM | 2139 | CD2 | LEU | H | 20 | 18.039 | −2.486 | 60.933 | 1.00 | 46.91 | C |
| ANISOU | 2139 | CD2 | LEU | H | 20 | 7469 | 5952 | 4403 | 430 | −95 | −42 | C |
| ATOM | 2140 | N | SER | H | 21 | 19.787 | 1.978 | 59.790 | 1.00 | 40.82 | N |
| ANISOU | 2140 | N | SER | H | 21 | 6567 | 5282 | 3661 | 323 | −492 | −372 | N |
| ATOM | 2141 | CA | SER | H | 21 | 20.382 | 3.119 | 59.111 | 1.00 | 39.88 | C |
| ANISOU | 2141 | CA | SER | H | 21 | 6357 | 5179 | 3616 | 283 | −604 | −453 | C |
| ATOM | 2142 | C | SER | H | 21 | 21.212 | 2.645 | 57.933 | 1.00 | 45.72 | C |
| ANISOU | 2142 | C | SER | H | 21 | 6904 | 5936 | 4533 | 271 | −688 | −419 | C |
| ATOM | 2143 | O | SER | H | 21 | 21.710 | 1.517 | 57.914 | 1.00 | 42.54 | O |
| ANISOU | 2143 | O | SER | H | 21 | 6465 | 5538 | 4159 | 297 | −720 | −334 | O |
| ATOM | 2144 | CB | SER | H | 21 | 21.276 | 3.943 | 60.064 | 1.00 | 37.60 | C |
| ANISOU | 2144 | CB | SER | H | 21 | 6198 | 4909 | 3178 | 268 | −774 | −491 | C |
| ATOM | 2145 | OG | SER | H | 21 | 20.502 | 4.493 | 61.103 | 1.00 | 53.10 | O |
| ANISOU | 2145 | OG | SER | H | 21 | 8352 | 6853 | 4971 | 279 | −690 | −537 | O |
| ATOM | 2146 | N | CYS | H | 22 | 21.368 | 3.522 | 56.949 | 1.00 | 42.35 | N |
| ANISOU | 2146 | N | CYS | H | 22 | 6357 | 5514 | 4222 | 235 | −716 | −484 | N |
| ATOM | 2147 | CA | CYS | H | 22 | 22.210 | 3.238 | 55.795 | 1.00 | 37.59 | C |
| ANISOU | 2147 | CA | CYS | H | 22 | 5576 | 4927 | 3778 | 222 | −790 | −462 | C |
| ATOM | 2148 | C | CYS | H | 22 | 22.917 | 4.534 | 55.437 | 1.00 | 48.36 | C |
| ANISOU | 2148 | C | CYS | H | 22 | 6893 | 6303 | 5178 | 176 | −905 | −531 | C |
| ATOM | 2149 | O | CYS | H | 22 | 22.272 | 5.478 | 54.972 | 1.00 | 50.24 | O |
| ANISOU | 2149 | O | CYS | H | 22 | 7117 | 6525 | 5450 | 153 | −842 | −601 | O |
| ATOM | 2150 | CB | CYS | H | 22 | 21.393 | 2.704 | 54.610 | 1.00 | 40.57 | C |
| ANISOU | 2150 | CB | CYS | H | 22 | 5831 | 5287 | 4298 | 228 | −652 | −456 | C |
| ATOM | 2151 | SG | CYS | H | 22 | 22.306 | 2.768 | 53.055 | 1.00 | 50.29 | S |
| ANISOU | 2151 | SG | CYS | H | 22 | 6862 | 6535 | 5711 | 205 | −722 | −460 | S |
| ATOM | 2152 | N | ALA | H | 23 | 24.227 | 4.594 | 55.681 | 1.00 | 45.60 | N |
| ANISOU | 2152 | N | ALA | H | 23 | 6520 | 5978 | 4827 | 163 | −1075 | −508 | N |
| ATOM | 2153 | CA | ALA | H | 23 | 25.026 | 5.768 | 55.343 | 1.00 | 44.05 | C |
| ANISOU | 2153 | CA | ALA | H | 23 | 6266 | 5788 | 4683 | 111 | −1194 | −565 | C |
| ATOM | 2154 | C | ALA | H | 23 | 25.487 | 5.657 | 53.896 | 1.00 | 48.72 | C |
| ANISOU | 2154 | C | ALA | H | 23 | 6664 | 6388 | 5461 | 97 | −1183 | −550 | C |
| ATOM | 2155 | O | ALA | H | 23 | 26.048 | 4.635 | 53.500 | 1.00 | 47.76 | O |
| ANISOU | 2155 | O | ALA | H | 23 | 6450 | 6281 | 5415 | 123 | −1197 | −481 | O |
| ATOM | 2156 | CB | ALA | H | 23 | 26.235 | 5.900 | 56.273 | 1.00 | 40.29 | C |
| ANISOU | 2156 | CB | ALA | H | 23 | 5843 | 5333 | 4133 | 98 | −1389 | −548 | C |
| ATOM | 2157 | N | ALA | H | 24 | 25.264 | 6.711 | 53.117 | 1.00 | 44.59 | N |
| ANISOU | 2157 | N | ALA | H | 24 | 6085 | 5850 | 5008 | 58 | −1155 | −613 | N |
| ATOM | 2158 | CA | ALA | H | 24 | 25.571 | 6.703 | 51.694 | 1.00 | 41.82 | C |
| ANISOU | 2158 | CA | ALA | H | 24 | 5570 | 5504 | 4817 | 44 | −1124 | −603 | C |
| ATOM | 2159 | C | ALA | H | 24 | 26.661 | 7.717 | 51.369 | 1.00 | 43.89 | C |
| ANISOU | 2159 | C | ALA | H | 24 | 5757 | 5768 | 5150 | −10 | −1245 | −628 | C |
| ATOM | 2160 | O | ALA | H | 24 | 26.754 | 8.775 | 52.005 | 1.00 | 45.45 | O |
| ANISOU | 2160 | O | ALA | H | 24 | 6034 | 5950 | 5286 | −48 | −1317 | −685 | O |
| ATOM | 2161 | CB | ALA | H | 24 | 24.317 | 7.022 | 50.864 | 1.00 | 35.98 | C |
| ANISOU | 2161 | CB | ALA | H | 24 | 4816 | 4740 | 4115 | 47 | −976 | −643 | C |
| ATOM | 2162 | N | SER | H | 25 | 27.462 | 7.408 | 50.347 | 1.00 | 40.12 | N |
| ANISOU | 2162 | N | SER | H | 25 | 5128 | 5307 | 4810 | −16 | −1259 | −589 | N |
| ATOM | 2163 | CA | SER | H | 25 | 28.512 | 8.324 | 49.910 | 1.00 | 38.55 | C |
| ANISOU | 2163 | CA | SER | H | 25 | 4836 | 5107 | 4704 | −72 | −1354 | −603 | C |
| ATOM | 2164 | C | SER | H | 25 | 28.919 | 7.985 | 48.481 | 1.00 | 41.37 | C |
| ANISOU | 2164 | C | SER | H | 25 | 5036 | 5473 | 5208 | −68 | −1289 | −567 | C |
| ATOM | 2165 | O | SER | H | 25 | 28.660 | 6.884 | 47.982 | 1.00 | 37.53 | O |
| ANISOU | 2165 | O | SER | H | 25 | 4511 | 4998 | 4750 | −20 | −1206 | −526 | O |
| ATOM | 2166 | CB | SER | H | 25 | 29.728 | 8.269 | 50.850 | 1.00 | 42.75 | C |
| ANISOU | 2166 | CB | SER | H | 25 | 5366 | 5658 | 5220 | −89 | −1528 | −578 | C |
| ATOM | 2167 | OG | SER | H | 25 | 30.362 | 6.994 | 50.785 | 1.00 | 49.12 | O |
| ANISOU | 2167 | OG | SER | H | 25 | 6095 | 6492 | 6077 | −41 | −1547 | −498 | O |
| ATOM | 2168 | N | GLY | H | 26 | 29.550 | 8.956 | 47.823 | 1.00 | 43.52 | N |
| ANISOU | 2168 | N | GLY | H | 26 | 5226 | 5735 | 5572 | −122 | −1322 | −585 | N |

TABLE 11-continued

| | | | | | | | | | | | |
|---|---|---|---|---|---|---|---|---|---|---|---|
| ATOM | 2169 | CA | GLY | H | 26 | 30.055 | 8.769 | 46.478 | 1.00 | 43.19 | C |
| ANISOU | 2169 | CA | GLY | H | 26 | 5044 | 5702 | 5664 | −123 | −1260 | −551 | C |
| ATOM | 2170 | C | GLY | H | 26 | 29.064 | 9.005 | 45.361 | 1.00 | 43.30 | C |
| ANISOU | 2170 | C | GLY | H | 26 | 5061 | 5699 | 5692 | −116 | −1123 | −574 | C |
| ATOM | 2171 | O | GLY | H | 26 | 29.349 | 8.635 | 44.216 | 1.00 | 42.95 | O |
| ANISOU | 2171 | O | GLY | H | 26 | 4922 | 5663 | 5734 | −104 | −1054 | −544 | O |
| ATOM | 2172 | N | PHE | H | 27 | 27.908 | 9.591 | 45.649 | 1.00 | 44.11 | N |
| ANISOU | 2172 | N | PHE | H | 27 | 5272 | 5778 | 5712 | −118 | −1081 | −626 | N |
| ATOM | 2173 | CA | PHE | H | 27 | 26.961 | 9.964 | 44.606 | 1.00 | 40.53 | C |
| ANISOU | 2173 | CA | PHE | H | 27 | 4818 | 5305 | 5276 | −113 | −971 | −649 | C |
| ATOM | 2174 | C | PHE | H | 27 | 26.065 | 11.053 | 45.168 | 1.00 | 39.07 | C |
| ANISOU | 2174 | C | PHE | H | 27 | 4740 | 5084 | 5021 | −132 | −970 | −711 | C |
| ATOM | 2175 | O | PHE | H | 27 | 26.074 | 11.334 | 46.365 | 1.00 | 42.67 | O |
| ANISOU | 2175 | O | PHE | H | 27 | 5283 | 5531 | 5399 | −141 | −1036 | −739 | O |
| ATOM | 2176 | CB | PHE | H | 27 | 26.138 | 8.767 | 44.114 | 1.00 | 44.76 | C |
| ANISOU | 2176 | CB | PHE | H | 27 | 5353 | 5854 | 5801 | −57 | −869 | −629 | C |
| ATOM | 2177 | CG | PHE | H | 27 | 25.285 | 8.142 | 45.176 | 1.00 | 40.88 | C |
| ANISOU | 2177 | CG | PHE | H | 27 | 4959 | 5361 | 5213 | −23 | −852 | −639 | C |
| ATOM | 2178 | CD1 | PHE | H | 27 | 25.829 | 7.241 | 46.086 | 1.00 | 40.42 | C |
| ANISOU | 2178 | CD1 | PHE | H | 27 | 4919 | 5322 | 5119 | 0 | −905 | −602 | C |
| ATOM | 2179 | CD2 | PHE | H | 27 | 23.940 | 8.458 | 45.275 | 1.00 | 39.23 | C |
| ANISOU | 2179 | CD2 | PHE | H | 27 | 4823 | 5129 | 4953 | −11 | −779 | −680 | C |
| ATOM | 2180 | CE1 | PHE | H | 27 | 25.034 | 6.654 | 47.073 | 1.00 | 38.23 | C |
| ANISOU | 2180 | CE1 | PHE | H | 27 | 4741 | 5039 | 4744 | 32 | −878 | −602 | C |
| ATOM | 2181 | CE2 | PHE | H | 27 | 23.140 | 7.877 | 46.256 | 1.00 | 44.19 | C |
| ANISOU | 2181 | CE2 | PHE | H | 27 | 5539 | 5753 | 5497 | 19 | −745 | −684 | C |
| ATOM | 2182 | CZ | PHE | H | 27 | 23.689 | 6.967 | 47.153 | 1.00 | 41.46 | C |
| ANISOU | 2182 | CZ | PHE | H | 27 | 5221 | 5426 | 5105 | 40 | −790 | −644 | C |
| ATOM | 2183 | N | THR | H | 28 | 25.298 | 11.671 | 44.280 | 1.00 | 40.68 | N |
| ANISOU | 2183 | N | THR | H | 28 | 4942 | 5263 | 5251 | −134 | −896 | −733 | N |
| ATOM | 2184 | CA | THR | H | 28 | 24.398 | 12.754 | 44.665 | 1.00 | 40.37 | C |
| ANISOU | 2184 | CA | THR | H | 28 | 4992 | 5180 | 5165 | −144 | −882 | −791 | C |
| ATOM | 2185 | C | THR | H | 28 | 23.181 | 12.125 | 45.325 | 1.00 | 41.52 | C |
| ANISOU | 2185 | C | THR | H | 28 | 5218 | 5328 | 5229 | −95 | −815 | −809 | C |
| ATOM | 2186 | O | THR | H | 28 | 22.222 | 11.723 | 44.660 | 1.00 | 38.97 | O |
| ANISOU | 2186 | O | THR | H | 28 | 4879 | 5005 | 4923 | −62 | −726 | −805 | O |
| ATOM | 2187 | CB | THR | H | 28 | 24.027 | 13.588 | 43.449 | 1.00 | 47.22 | C |
| ANISOU | 2187 | CB | THR | H | 28 | 5824 | 6020 | 6099 | −158 | −830 | −795 | C |
| ATOM | 2188 | OG1 | THR | H | 28 | 25.229 | 14.080 | 42.844 | 1.00 | 49.77 | O |
| ANISOU | 2188 | OG1 | THR | H | 28 | 6068 | 6341 | 6501 | −206 | −879 | −768 | O |
| ATOM | 2189 | CG2 | THR | H | 28 | 23.137 | 14.755 | 43.853 | 1.00 | 46.73 | C |
| ANISOU | 2189 | CG2 | THR | H | 28 | 5850 | 5905 | 6002 | −162 | −818 | −854 | C |
| ATOM | 2190 | N | PHE | H | 29 | 23.237 | 12.040 | 46.658 | 1.00 | 35.00 | N |
| ANISOU | 2190 | N | PHE | H | 29 | 4482 | 4503 | 4313 | −92 | −860 | −829 | N |
| ATOM | 2191 | CA | PHE | H | 29 | 22.227 | 11.319 | 47.426 | 1.00 | 38.13 | C |
| ANISOU | 2191 | CA | PHE | H | 29 | 4958 | 4903 | 4626 | −46 | −791 | −835 | C |
| ATOM | 2192 | C | PHE | H | 29 | 20.820 | 11.836 | 47.140 | 1.00 | 42.03 | C |
| ANISOU | 2192 | C | PHE | H | 29 | 5483 | 5362 | 5123 | −23 | −688 | −874 | C |
| ATOM | 2193 | O | PHE | H | 29 | 19.889 | 11.051 | 46.925 | 1.00 | 40.68 | O |
| ANISOU | 2193 | O | PHE | H | 29 | 5300 | 5199 | 4958 | 14 | −599 | −859 | O |
| ATOM | 2194 | CB | PHE | H | 29 | 22.565 | 11.438 | 48.915 | 1.00 | 32.52 | C |
| ANISOU | 2194 | CB | PHE | H | 29 | 4362 | 4190 | 3803 | −51 | −862 | −856 | C |
| ATOM | 2195 | CG | PHE | H | 29 | 21.675 | 10.636 | 49.828 | 1.00 | 36.11 | C |
| ANISOU | 2195 | CG | PHE | H | 29 | 4909 | 4650 | 4160 | −5 | −788 | −851 | C |
| ATOM | 2196 | CD1 | PHE | H | 29 | 21.763 | 9.252 | 49.876 | 1.00 | 39.97 | C |
| ANISOU | 2196 | CD1 | PHE | H | 29 | 5370 | 5170 | 4647 | 26 | −765 | −789 | C |
| ATOM | 2197 | CD2 | PHE | H | 29 | 20.803 | 11.276 | 50.695 | 1.00 | 36.24 | C |
| ANISOU | 2197 | CD2 | PHE | H | 29 | 5050 | 4634 | 4088 | 7 | −739 | −906 | C |
| ATOM | 2198 | CE1 | PHE | H | 29 | 20.966 | 8.528 | 50.757 | 1.00 | 33.16 | C |
| ANISOU | 2198 | CE1 | PHE | H | 29 | 4599 | 4306 | 3696 | 63 | −691 | −777 | C |
| ATOM | 2199 | CE2 | PHE | H | 29 | 20.003 | 10.560 | 51.562 | 1.00 | 42.01 | C |
| ANISOU | 2199 | CE2 | PHE | H | 29 | 5868 | 5366 | 4727 | 48 | −657 | −896 | C |
| ATOM | 2200 | CZ | PHE | H | 29 | 20.081 | 9.191 | 51.598 | 1.00 | 38.73 | C |
| ANISOU | 2200 | CZ | PHE | H | 29 | 5423 | 4982 | 4311 | 73 | −634 | −829 | C |
| ATOM | 2201 | N | SER | H | 30 | 20.649 | 13.165 | 47.121 | 1.00 | 38.42 | N |
| ANISOU | 2201 | N | SER | H | 30 | 5061 | 4863 | 4673 | −46 | −702 | −924 | N |
| ATOM | 2202 | CA | SER | H | 30 | 19.309 | 13.744 | 47.078 | 1.00 | 33.69 | C |
| ANISOU | 2202 | CA | SER | H | 30 | 4503 | 4224 | 4074 | −17 | −611 | −965 | C |
| ATOM | 2203 | C | SER | H | 30 | 18.617 | 13.553 | 45.734 | 1.00 | 35.71 | C |
| ANISOU | 2203 | C | SER | H | 30 | 4665 | 4482 | 4423 | 2 | −546 | −941 | C |
| ATOM | 2204 | O | SER | H | 30 | 17.404 | 13.778 | 45.646 | 1.00 | 37.10 | O |
| ANISOU | 2204 | O | SER | H | 30 | 4852 | 4631 | 4612 | 35 | −468 | −964 | O |
| ATOM | 2205 | CB | SER | H | 30 | 19.360 | 15.245 | 47.392 | 1.00 | 42.32 | C |
| ANISOU | 2205 | CB | SER | H | 30 | 5662 | 5261 | 5158 | −42 | −646 | −1025 | C |
| ATOM | 2206 | OG | SER | H | 30 | 20.060 | 15.920 | 46.358 | 1.00 | 48.23 | O |
| ANISOU | 2206 | OG | SER | H | 30 | 6334 | 5996 | 5994 | −82 | −698 | −1010 | O |
| ATOM | 2207 | N | SER | H | 31 | 19.353 | 13.187 | 44.681 | 1.00 | 34.26 | N |
| ANISOU | 2207 | N | SER | H | 31 | 4389 | 4326 | 4302 | −16 | −579 | −898 | N |
| ATOM | 2208 | CA | SER | H | 31 | 18.740 | 12.929 | 43.386 | 1.00 | 36.86 | C |
| ANISOU | 2208 | CA | SER | H | 31 | 4644 | 4660 | 4701 | 1 | −528 | −876 | C |

TABLE 11-continued

| | | | | | | | | | | | |
|---|---|---|---|---|---|---|---|---|---|---|---|
| ATOM | 2209 | C | SER | H | 31 | 18.499 | 11.450 | 43.148 | 1.00 | 32.70 | C |
| ANISOU | 2209 | C | SER | H | 31 | 4074 | 4170 | 4179 | 27 | −487 | −842 | C |
| ATOM | 2210 | O | SER | H | 31 | 18.122 | 11.070 | 42.041 | 1.00 | 31.03 | O |
| ANISOU | 2210 | O | SER | H | 31 | 3803 | 3967 | 4019 | 38 | −458 | −825 | O |
| ATOM | 2211 | CB | SER | H | 31 | 19.596 | 13.498 | 42.245 | 1.00 | 36.95 | C |
| ANISOU | 2211 | CB | SER | H | 31 | 4595 | 4671 | 4775 | −32 | −572 | −852 | C |
| ATOM | 2212 | OG | SER | H | 31 | 20.801 | 12.759 | 42.069 | 1.00 | 42.91 | O |
| ANISOU | 2212 | OG | SER | H | 31 | 5298 | 5465 | 5542 | −51 | −612 | −812 | O |
| ATOM | 2213 | N | HIS | H | 32 | 18.710 | 10.608 | 44.152 | 1.00 | 28.90 | N |
| ANISOU | 2213 | N | HIS | H | 32 | 3631 | 3709 | 3642 | 37 | −487 | −831 | N |
| ATOM | 2214 | CA | HIS | H | 32 | 18.569 | 9.170 | 43.991 | 1.00 | 31.20 | C |
| ANISOU | 2214 | CA | HIS | H | 32 | 3887 | 4026 | 3943 | 59 | −449 | −795 | C |
| ATOM | 2215 | C | HIS | H | 32 | 17.456 | 8.658 | 44.883 | 1.00 | 31.81 | C |
| ANISOU | 2215 | C | HIS | H | 32 | 4019 | 4090 | 3979 | 88 | −374 | −805 | C |
| ATOM | 2216 | O | HIS | H | 32 | 17.286 | 9.127 | 46.009 | 1.00 | 31.18 | O |
| ANISOU | 2216 | O | HIS | H | 32 | 4024 | 3996 | 3829 | 91 | −369 | −828 | O |
| ATOM | 2217 | CB | HIS | H | 32 | 19.898 | 8.442 | 44.314 | 1.00 | 32.64 | C |
| ANISOU | 2217 | CB | HIS | H | 32 | 4054 | 4238 | 4109 | 50 | −512 | −754 | C |
| ATOM | 2218 | CG | HIS | H | 32 | 20.917 | 8.568 | 43.225 | 1.00 | 35.51 | C |
| ANISOU | 2218 | CG | HIS | H | 32 | 4338 | 4618 | 4538 | 29 | −554 | −731 | C |
| ATOM | 2219 | ND1 | HIS | H | 32 | 21.468 | 9.778 | 42.868 | 1.00 | 37.75 | N |
| ANISOU | 2219 | ND1 | HIS | H | 32 | 4607 | 4889 | 4845 | −5 | −600 | −746 | N |
| ATOM | 2220 | CD2 | HIS | H | 32 | 21.453 | 7.647 | 42.388 | 1.00 | 35.23 | C |
| ANISOU | 2220 | CD2 | HIS | H | 32 | 4233 | 4604 | 4551 | 39 | −543 | −695 | C |
| ATOM | 2221 | CE1 | HIS | H | 32 | 22.310 | 9.597 | 41.865 | 1.00 | 32.92 | C |
| ANISOU | 2221 | CE1 | HIS | H | 32 | 3920 | 4295 | 4294 | −17 | −612 | −715 | C |
| ATOM | 2222 | NE2 | HIS | H | 32 | 22.312 | 8.314 | 41.550 | 1.00 | 38.82 | N |
| ANISOU | 2222 | NE2 | HIS | H | 32 | 4633 | 5062 | 5053 | 12 | −576 | −687 | N |
| ATOM | 2223 | N | ALA | H | 33 | 16.685 | 7.705 | 44.357 | 1.00 | 32.81 | N |
| ANISOU | 2223 | N | ALA | H | 33 | 4099 | 4217 | 4150 | 106 | −312 | −789 | N |
| ATOM | 2224 | CA | ALA | H | 33 | 15.733 | 6.968 | 45.169 | 1.00 | 29.35 | C |
| ANISOU | 2224 | CA | ALA | H | 33 | 3697 | 3766 | 3688 | 129 | −231 | −785 | C |
| ATOM | 2225 | C | ALA | H | 33 | 16.484 | 5.948 | 46.007 | 1.00 | 33.73 | C |
| ANISOU | 2225 | C | ALA | H | 33 | 4292 | 4337 | 4184 | 134 | −248 | −742 | C |
| ATOM | 2226 | O | ALA | H | 33 | 17.506 | 5.411 | 45.578 | 1.00 | 37.04 | O |
| ANISOU | 2226 | O | ALA | H | 33 | 4673 | 4779 | 4622 | 128 | −305 | −711 | O |
| ATOM | 2227 | CB | ALA | H | 33 | 14.703 | 6.258 | 44.276 | 1.00 | 28.03 | C |
| ANISOU | 2227 | CB | ALA | H | 33 | 3457 | 3588 | 3605 | 138 | −170 | −782 | C |
| ATOM | 2228 | N | MET | H | 34 | 15.999 | 5.695 | 47.214 | 1.00 | 32.10 | N |
| ANISOU | 2228 | N | MET | H | 34 | 4168 | 4120 | 3909 | 150 | −195 | −737 | N |
| ATOM | 2229 | CA | MET | H | 34 | 16.662 | 4.751 | 48.107 | 1.00 | 32.39 | C |
| ANISOU | 2229 | CA | MET | H | 34 | 4260 | 4169 | 3877 | 160 | −215 | −689 | C |
| ATOM | 2230 | C | MET | H | 34 | 15.684 | 3.651 | 48.489 | 1.00 | 37.43 | C |
| ANISOU | 2230 | C | MET | H | 34 | 4912 | 4786 | 4524 | 180 | −107 | −659 | C |
| ATOM | 2231 | O | MET | H | 34 | 14.489 | 3.909 | 48.668 | 1.00 | 33.63 | O |
| ANISOU | 2231 | O | MET | H | 34 | 4439 | 4280 | 4058 | 186 | −13 | −683 | O |
| ATOM | 2232 | CB | MET | H | 34 | 17.207 | 5.458 | 49.362 | 1.00 | 35.40 | C |
| ANISOU | 2232 | CB | MET | H | 34 | 4755 | 4556 | 4139 | 158 | −267 | −702 | C |
| ATOM | 2233 | CG | MET | H | 34 | 18.271 | 6.514 | 49.066 | 1.00 | 38.09 | C |
| ANISOU | 2233 | CG | MET | H | 34 | 5080 | 4910 | 4481 | 130 | −384 | −729 | C |
| ATOM | 2234 | SD | MET | H | 34 | 19.803 | 5.814 | 48.372 | 1.00 | 38.01 | S |
| ANISOU | 2234 | SD | MET | H | 34 | 4977 | 4934 | 4529 | 118 | −489 | −677 | S |
| ATOM | 2235 | CE | MET | H | 34 | 20.227 | 4.588 | 49.628 | 1.00 | 39.19 | C |
| ANISOU | 2235 | CE | MET | H | 34 | 5206 | 5094 | 4590 | 147 | −508 | −614 | C |
| ATOM | 2236 | N | SER | H | 35 | 16.185 | 2.419 | 48.599 | 1.00 | 33.56 | N |
| ANISOU | 2236 | N | SER | H | 35 | 4417 | 4298 | 4035 | 189 | −115 | −603 | N |
| ATOM | 2237 | CA | SER | H | 35 | 15.304 | 1.288 | 48.831 | 1.00 | 31.39 | C |
| ANISOU | 2237 | CA | SER | H | 35 | 4144 | 3994 | 3788 | 201 | −13 | −569 | C |
| ATOM | 2238 | C | SER | H | 35 | 15.883 | 0.363 | 49.891 | 1.00 | 34.47 | C |
| ANISOU | 2238 | C | SER | H | 35 | 4619 | 4382 | 4096 | 221 | −20 | −503 | C |
| ATOM | 2239 | O | SER | H | 35 | 17.095 | 0.330 | 50.135 | 1.00 | 35.17 | O |
| ANISOU | 2239 | O | SER | H | 35 | 4729 | 4495 | 4138 | 227 | −122 | −478 | O |
| ATOM | 2240 | CB | SER | H | 35 | 15.064 | 0.477 | 47.552 | 1.00 | 31.81 | C |
| ANISOU | 2240 | CB | SER | H | 35 | 4089 | 4033 | 3964 | 192 | 2 | −566 | C |
| ATOM | 2241 | OG | SER | H | 35 | 14.496 | 1.261 | 46.526 | 1.00 | 32.15 | O |
| ANISOU | 2241 | OG | SER | H | 35 | 4060 | 4079 | 4078 | 177 | 1 | −619 | O |
| ATOM | 2242 | N | TRP | H | 36 | 14.986 | −0.418 | 50.490 | 1.00 | 37.94 | N |
| ANISOU | 2242 | N | TRP | H | 36 | 5099 | 4789 | 4529 | 230 | 90 | −470 | N |
| ATOM | 2243 | CA | TRP | H | 36 | 15.326 | −1.523 | 51.372 | 1.00 | 31.52 | C |
| ANISOU | 2243 | CA | TRP | H | 36 | 4361 | 3960 | 3655 | 251 | 106 | −394 | C |
| ATOM | 2244 | C | TRP | H | 36 | 14.822 | −2.809 | 50.739 | 1.00 | 34.61 | C |
| ANISOU | 2244 | C | TRP | H | 36 | 4680 | 4309 | 4161 | 247 | 176 | −360 | C |
| ATOM | 2245 | O | TRP | H | 36 | 13.658 | −2.890 | 50.331 | 1.00 | 31.88 | O |
| ANISOU | 2245 | O | TRP | H | 36 | 4281 | 3934 | 3896 | 230 | 271 | −385 | O |
| ATOM | 2246 | CB | TRP | H | 36 | 14.708 | −1.331 | 52.757 | 1.00 | 33.42 | C |
| ANISOU | 2246 | CB | TRP | H | 36 | 4735 | 4189 | 3774 | 265 | 190 | −377 | C |
| ATOM | 2247 | CG | TRP | H | 36 | 15.345 | −0.221 | 53.567 | 1.00 | 34.56 | C |
| ANISOU | 2247 | CG | TRP | H | 36 | 4981 | 4367 | 3782 | 271 | 108 | −407 | C |
| ATOM | 2248 | CD1 | TRP | H | 36 | 14.870 | 1.052 | 53.731 | 1.00 | 37.24 | C |
| ANISOU | 2248 | CD1 | TRP | H | 36 | 5351 | 4713 | 4086 | 263 | 128 | −477 | C |

TABLE 11-continued

| | | | | | | | | | | | | |
|---|---|---|---|---|---|---|---|---|---|---|---|---|
| ATOM | 2249 | CD2 | TRP | H | 36 | 16.568 | −0.290 | 54.320 | 1.00 | 36.71 | | C |
| ANISOU | 2249 | CD2 | TRP | H | 36 | 5340 | 4666 | 3942 | 285 | −14 | −369 | C |
| ATOM | 2250 | NE1 | TRP | H | 36 | 15.714 | 1.775 | 54.543 | 1.00 | 41.03 | | N |
| ANISOU | 2250 | NE1 | TRP | H | 36 | 5938 | 5218 | 4433 | 267 | 29 | −492 | N |
| ATOM | 2251 | CE2 | TRP | H | 36 | 16.768 | 0.979 | 54.914 | 1.00 | 38.00 | | C |
| ANISOU | 2251 | CE2 | TRP | H | 36 | 5587 | 4850 | 4001 | 278 | −67 | −427 | C |
| ATOM | 2252 | CE3 | TRP | H | 36 | 17.507 | −1.301 | 54.561 | 1.00 | 37.36 | | C |
| ANISOU | 2252 | CE3 | TRP | H | 36 | 5437 | 4752 | 4008 | 305 | −89 | −293 | C |
| ATOM | 2253 | CZ2 | TRP | H | 36 | 17.865 | 1.259 | 55.738 | 1.00 | 37.14 | | C |
| ANISOU | 2253 | CZ2 | TRP | H | 36 | 5575 | 4768 | 3768 | 284 | −201 | −414 | C |
| ATOM | 2254 | CZ3 | TRP | H | 36 | 18.606 | −1.019 | 55.378 | 1.00 | 36.80 | | C |
| ANISOU | 2254 | CZ3 | TRP | H | 36 | 5454 | 4711 | 3819 | 317 | −223 | −273 | C |
| ATOM | 2255 | CH2 | TRP | H | 36 | 18.775 | 0.250 | 55.951 | 1.00 | 41.90 | | C |
| ANISOU | 2255 | CH2 | TRP | H | 36 | 6181 | 5380 | 4360 | 303 | −282 | −335 | C |
| ATOM | 2256 | N | VAL | H | 37 | 15.699 | −3.803 | 50.636 | 1.00 | 31.12 | | N |
| ANISOU | 2256 | N | VAL | H | 37 | 4232 | 3859 | 3735 | 263 | 123 | −306 | N |
| ATOM | 2257 | CA | VAL | H | 37 | 15.330 | −5.139 | 50.169 | 1.00 | 32.14 | | C |
| ANISOU | 2257 | CA | VAL | H | 37 | 4314 | 3936 | 3963 | 262 | 186 | −269 | C |
| ATOM | 2258 | C | VAL | H | 37 | 15.807 | −6.122 | 51.225 | 1.00 | 33.93 | | C |
| ANISOU | 2258 | C | VAL | H | 37 | 4636 | 4137 | 4119 | 293 | 193 | −178 | C |
| ATOM | 2259 | O | VAL | H | 37 | 16.891 | −5.941 | 51.782 | 1.00 | 35.63 | | O |
| ANISOU | 2259 | O | VAL | H | 37 | 4905 | 4385 | 4247 | 319 | 94 | −147 | O |
| ATOM | 2260 | CB | VAL | H | 37 | 15.971 | −5.450 | 48.804 | 1.00 | 31.51 | | C |
| ANISOU | 2260 | CB | VAL | H | 37 | 4126 | 3858 | 3987 | 258 | 118 | −296 | C |
| ATOM | 2261 | CG1 | VAL | H | 37 | 15.626 | −6.893 | 48.345 | 1.00 | 31.69 | | C |
| ANISOU | 2261 | CG1 | VAL | H | 37 | 4114 | 3816 | 4111 | 257 | 180 | −265 | C |
| ATOM | 2262 | CG2 | VAL | H | 37 | 15.545 | −4.413 | 47.768 | 1.00 | 36.77 | | C |
| ANISOU | 2262 | CG2 | VAL | H | 37 | 4713 | 4552 | 4705 | 231 | 103 | −379 | C |
| ATOM | 2263 | N | ARG | H | 38 | 15.006 | −7.152 | 51.523 | 1.00 | 33.86 | | N |
| ANISOU | 2263 | N | ARG | H | 38 | 4647 | 4068 | 4149 | 289 | 304 | −131 | N |
| ATOM | 2264 | CA | ARG | H | 38 | 15.404 | −8.111 | 52.543 | 1.00 | 34.90 | | C |
| ANISOU | 2264 | CA | ARG | H | 38 | 4881 | 4168 | 4212 | 321 | 318 | −33 | C |
| ATOM | 2265 | C | ARG | H | 38 | 15.432 | −9.515 | 51.970 | 1.00 | 40.47 | | C |
| ANISOU | 2265 | C | ARG | H | 38 | 5535 | 4806 | 5037 | 324 | 349 | 9 | C |
| ATOM | 2266 | O | ARG | H | 38 | 14.751 | −9.824 | 50.985 | 1.00 | 38.48 | | O |
| ANISOU | 2266 | O | ARG | H | 38 | 5188 | 4519 | 4914 | 292 | 399 | −37 | O |
| ATOM | 2267 | CB | ARG | H | 38 | 14.477 | −8.076 | 53.765 | 1.00 | 37.45 | | C |
| ANISOU | 2267 | CB | ARG | H | 38 | 5318 | 4471 | 4442 | 319 | 440 | 6 | C |
| ATOM | 2268 | CG | ARG | H | 38 | 13.080 | −8.605 | 53.505 | 1.00 | 37.38 | | C |
| ANISOU | 2268 | CG | ARG | H | 38 | 5258 | 4401 | 4544 | 284 | 595 | 2 | C |
| ATOM | 2269 | CD | ARG | H | 38 | 12.195 | −8.397 | 54.721 | 1.00 | 39.35 | | C |
| ANISOU | 2269 | CD | ARG | H | 38 | 5617 | 4637 | 4697 | 285 | 728 | 36 | C |
| ATOM | 2270 | NE | ARG | H | 38 | 10.828 | −8.857 | 54.481 | 1.00 | 43.65 | | N |
| ANISOU | 2270 | NE | ARG | H | 38 | 6094 | 5122 | 5367 | 247 | 883 | 33 | N |
| ATOM | 2271 | CZ | ARG | H | 38 | 9.833 | −8.734 | 55.351 | 1.00 | 46.04 | | C |
| ANISOU | 2271 | CZ | ARG | H | 38 | 6459 | 5403 | 5632 | 241 | 1034 | 58 | C |
| ATOM | 2272 | NH1 | ARG | H | 38 | 10.041 | −8.161 | 56.526 | 1.00 | 43.37 | | N |
| ANISOU | 2272 | NH1 | ARG | H | 38 | 6268 | 5097 | 5113 | 273 | 1054 | 83 | N |
| ATOM | 2273 | NH2 | ARG | H | 38 | 8.629 | −9.191 | 55.047 | 1.00 | 45.64 | | N |
| ANISOU | 2273 | NH2 | ARG | H | 38 | 6321 | 5295 | 5724 | 202 | 1167 | 57 | N |
| ATOM | 2274 | N | GLN | H | 39 | 16.239 | −10.364 | 52.599 | 1.00 | 39.22 | | N |
| ANISOU | 2274 | N | GLN | H | 39 | 5444 | 4623 | 4834 | 365 | 311 | 97 | N |
| ATOM | 2275 | CA | GLN | H | 39 | 16.298 | −11.777 | 52.259 | 1.00 | 38.90 | | C |
| ANISOU | 2275 | CA | GLN | H | 39 | 5379 | 4503 | 4896 | 376 | 349 | 150 | C |
| ATOM | 2276 | C | GLN | H | 39 | 16.116 | −12.561 | 53.548 | 1.00 | 38.35 | | C |
| ANISOU | 2276 | C | GLN | H | 39 | 5440 | 4385 | 4746 | 399 | 416 | 261 | C |
| ATOM | 2277 | O | GLN | H | 39 | 17.005 | −12.557 | 54.406 | 1.00 | 40.06 | | O |
| ANISOU | 2277 | O | GLN | H | 39 | 5747 | 4627 | 4846 | 445 | 335 | 326 | O |
| ATOM | 2278 | CB | GLN | H | 39 | 17.620 | −12.131 | 51.582 | 1.00 | 37.07 | | C |
| ANISOU | 2278 | CB | GLN | H | 39 | 5089 | 4281 | 4715 | 414 | 230 | 155 | C |
| ATOM | 2279 | CG | GLN | H | 39 | 17.672 | −13.578 | 51.062 | 1.00 | 42.10 | | C |
| ANISOU | 2279 | CG | GLN | H | 39 | 5694 | 4826 | 5476 | 427 | 272 | 193 | C |
| ATOM | 2280 | CD | GLN | H | 39 | 18.597 | −13.716 | 49.867 | 1.00 | 51.41 | | C |
| ANISOU | 2280 | CD | GLN | H | 39 | 6772 | 6012 | 6748 | 447 | 193 | 147 | C |
| ATOM | 2281 | OE1 | GLN | H | 39 | 19.659 | −13.077 | 49.801 | 1.00 | 42.63 | | O |
| ANISOU | 2281 | OE1 | GLN | H | 39 | 5636 | 4966 | 5595 | 476 | 85 | 139 | O |
| ATOM | 2282 | NE2 | GLN | H | 39 | 18.186 | −14.529 | 48.900 | 1.00 | 59.84 | | N |
| ANISOU | 2282 | NE2 | GLN | H | 39 | 7781 | 7012 | 7945 | 429 | 249 | 111 | N |
| ATOM | 2283 | N | ALA | H | 40 | 14.958 | −13.196 | 53.699 | 1.00 | 34.35 | | N |
| ANISOU | 2283 | N | ALA | H | 40 | 4944 | 3809 | 4298 | 367 | 560 | 283 | N |
| ATOM | 2284 | CA | ALA | H | 40 | 14.698 | −14.035 | 54.862 | 1.00 | 34.01 | | C |
| ANISOU | 2284 | CA | ALA | H | 40 | 5026 | 3708 | 4189 | 385 | 647 | 397 | C |
| ATOM | 2285 | C | ALA | H | 40 | 15.380 | −15.388 | 54.691 | 1.00 | 36.55 | | C |
| ANISOU | 2285 | C | ALA | H | 40 | 5350 | 3953 | 4585 | 419 | 618 | 474 | C |
| ATOM | 2286 | O | ALA | H | 40 | 15.648 | −15.814 | 53.564 | 1.00 | 40.86 | | O |
| ANISOU | 2286 | O | ALA | H | 40 | 5788 | 4471 | 5267 | 413 | 581 | 426 | O |
| ATOM | 2287 | CB | ALA | H | 40 | 13.197 | −14.217 | 55.056 | 1.00 | 34.26 | | C |
| ANISOU | 2287 | CB | ALA | H | 40 | 5054 | 3686 | 4276 | 333 | 824 | 396 | C |
| ATOM | 2288 | N | PRO | H | 41 | 15.699 | −16.071 | 55.794 | 1.00 | 37.87 | | N |
| ANISOU | 2288 | N | PRO | H | 41 | 5647 | 4083 | 4659 | 461 | 633 | 594 | N |

TABLE 11-continued

| | | | | | | | | | | | | |
|---|---|---|---|---|---|---|---|---|---|---|---|---|
| ATOM | 2289 | CA | PRO | H | 41 | 16.473 | −17.318 | 55.693 | 1.00 | 43.91 | | C |
| ANISOU | 2289 | CA | PRO | H | 41 | 6420 | 4773 | 5491 | 506 | 591 | 676 | C |
| ATOM | 2290 | C | PRO | H | 41 | 15.776 | −18.331 | 54.799 | 1.00 | 41.29 | | C |
| ANISOU | 2290 | C | PRO | H | 41 | 6001 | 4336 | 5350 | 466 | 690 | 656 | C |
| ATOM | 2291 | O | PRO | H | 41 | 14.640 | −18.732 | 55.052 | 1.00 | 50.24 | | O |
| ANISOU | 2291 | O | PRO | H | 41 | 7155 | 5406 | 6528 | 419 | 834 | 677 | O |
| ATOM | 2292 | CB | PRO | H | 41 | 16.561 | −17.791 | 57.146 | 1.00 | 45.21 | | C |
| ANISOU | 2292 | CB | PRO | H | 41 | 6757 | 4909 | 5511 | 546 | 624 | 813 | C |
| ATOM | 2293 | CG | PRO | H | 41 | 16.532 | −16.523 | 57.931 | 1.00 | 47.61 | | C |
| ANISOU | 2293 | CG | PRO | H | 41 | 7141 | 5314 | 5633 | 545 | 590 | 786 | C |
| ATOM | 2294 | CD | PRO | H | 41 | 15.532 | −15.654 | 57.197 | 1.00 | 46.24 | | C |
| ANISOU | 2294 | CD | PRO | H | 41 | 6864 | 5174 | 5531 | 478 | 667 | 661 | C |
| ATOM | 2295 | N | GLY | H | 42 | 16.461 | −18.711 | 53.721 | 1.00 | 45.91 | | N |
| ANISOU | 2295 | N | GLY | H | 42 | 6487 | 4903 | 6052 | 483 | 613 | 608 | N |
| ATOM | 2296 | CA | GLY | H | 42 | 15.937 | −19.659 | 52.764 | 1.00 | 56.08 | | C |
| ANISOU | 2296 | CA | GLY | H | 42 | 7698 | 6091 | 7519 | 448 | 682 | 573 | C |
| ATOM | 2297 | C | GLY | H | 42 | 14.922 | −19.112 | 51.784 | 1.00 | 61.70 | | C |
| ANISOU | 2297 | C | GLY | H | 42 | 8302 | 6818 | 8322 | 371 | 731 | 449 | C |
| ATOM | 2298 | O | GLY | H | 42 | 14.466 | −19.867 | 50.916 | 1.00 | 67.48 | | O |
| ANISOU | 2298 | O | GLY | H | 42 | 8969 | 7468 | 9203 | 335 | 774 | 406 | O |
| ATOM | 2299 | N | LYS | H | 43 | 14.563 | −17.832 | 51.875 | 1.00 | 54.67 | | N |
| ANISOU | 2299 | N | LYS | H | 43 | 7393 | 6026 | 7351 | 347 | 717 | 388 | N |
| ATOM | 2300 | CA | LYS | H | 43 | 13.490 | −17.260 | 51.075 | 1.00 | 52.29 | | C |
| ANISOU | 2300 | CA | LYS | H | 43 | 6996 | 5741 | 7132 | 278 | 765 | 283 | C |
| ATOM | 2301 | C | LYS | H | 43 | 14.028 | −16.454 | 49.892 | 1.00 | 52.27 | | C |
| ANISOU | 2301 | C | LYS | H | 43 | 6897 | 5812 | 7152 | 279 | 653 | 173 | C |
| ATOM | 2302 | O | LYS | H | 43 | 15.235 | −16.244 | 49.729 | 1.00 | 52.11 | | O |
| ANISOU | 2302 | O | LYS | H | 43 | 6879 | 5839 | 7083 | 331 | 547 | 175 | O |
| ATOM | 2303 | CB | LYS | H | 43 | 12.594 | −16.375 | 51.944 | 1.00 | 56.55 | | C |
| ANISOU | 2303 | CB | LYS | H | 43 | 7576 | 6328 | 7581 | 251 | 844 | 289 | C |
| ATOM | 2304 | CG | LYS | H | 43 | 11.959 | −17.095 | 53.125 | 1.00 | 63.32 | | C |
| ANISOU | 2304 | CG | LYS | H | 43 | 8535 | 7114 | 8408 | 245 | 979 | 399 | C |
| ATOM | 2305 | CD | LYS | H | 43 | 10.589 | −17.639 | 52.770 | 1.00 | 66.23 | | C |
| ANISOU | 2305 | CD | LYS | H | 43 | 8832 | 7399 | 8933 | 172 | 1114 | 380 | C |
| ATOM | 2306 | CE | LYS | H | 43 | 10.028 | −18.523 | 53.882 | 1.00 | 67.65 | | C |
| ANISOU | 2306 | CE | LYS | H | 43 | 9110 | 7491 | 9102 | 164 | 1260 | 502 | C |
| ATOM | 2307 | NZ | LYS | H | 43 | 10.265 | −19.984 | 53.649 | 1.00 | 68.38 | | N |
| ANISOU | 2307 | NZ | LYS | H | 43 | 9211 | 7462 | 9307 | 164 | 1277 | 563 | N |
| ATOM | 2308 | N | CYS | H | 44 | 13.088 | −16.003 | 49.058 | 1.00 | 53.71 | | N |
| ANISOU | 2308 | N | CYS | H | 44 | 6990 | 6002 | 7414 | 221 | 681 | 79 | N |
| ATOM | 2309 | CA | CYS | H | 44 | 13.377 | −15.147 | 47.914 | 1.00 | 52.60 | | C |
| ANISOU | 2309 | CA | CYS | H | 44 | 6765 | 5931 | 7291 | 214 | 591 | −25 | C |
| ATOM | 2310 | C | CYS | H | 44 | 13.706 | −13.728 | 48.398 | 1.00 | 47.36 | | C |
| ANISOU | 2310 | C | CYS | H | 44 | 6123 | 5377 | 6495 | 232 | 536 | −40 | C |
| ATOM | 2311 | O | CYS | H | 44 | 13.265 | −13.303 | 49.467 | 1.00 | 55.61 | | O |
| ANISOU | 2311 | O | CYS | H | 44 | 7232 | 6442 | 7455 | 231 | 591 | 2 | O |
| ATOM | 2312 | CB | CYS | H | 44 | 12.157 | −15.136 | 46.955 | 1.00 | 43.00 | | C |
| ANISOU | 2312 | CB | CYS | H | 44 | 5457 | 4684 | 6199 | 145 | 633 | −111 | C |
| ATOM | 2313 | SG | CYS | H | 44 | 11.330 | −16.788 | 46.721 | 1.00 | 72.46 | | S |
| ANISOU | 2313 | SG | CYS | H | 44 | 9173 | 8265 | 10095 | 98 | 727 | −89 | S |
| ATOM | 2314 | N | LEU | H | 45 | 14.493 | −12.994 | 47.606 | 1.00 | 39.08 | | N |
| ANISOU | 2314 | N | LEU | H | 45 | 5025 | 4395 | 5427 | 249 | 434 | −101 | N |
| ATOM | 2315 | CA | LEU | H | 45 | 14.607 | −11.550 | 47.808 | 1.00 | 38.58 | | C |
| ANISOU | 2315 | CA | LEU | H | 45 | 4963 | 4426 | 5270 | 249 | 385 | −138 | C |
| ATOM | 2316 | C | LEU | H | 45 | 13.222 | −10.930 | 47.822 | 1.00 | 35.48 | | C |
| ANISOU | 2316 | C | LEU | H | 45 | 4541 | 4036 | 4903 | 201 | 461 | −183 | C |
| ATOM | 2317 | O | LEU | H | 45 | 12.394 | −11.237 | 46.966 | 1.00 | 34.64 | | O |
| ANISOU | 2317 | O | LEU | H | 45 | 4360 | 3891 | 4910 | 161 | 495 | −234 | O |
| ATOM | 2318 | CB | LEU | H | 45 | 15.431 | −10.897 | 46.692 | 1.00 | 44.58 | | C |
| ANISOU | 2318 | CB | LEU | H | 45 | 5655 | 5241 | 6042 | 259 | 284 | −206 | C |
| ATOM | 2319 | CG | LEU | H | 45 | 16.945 | −11.067 | 46.633 | 1.00 | 48.96 | | C |
| ANISOU | 2319 | CG | LEU | H | 45 | 6215 | 5819 | 6567 | 310 | 194 | −174 | C |
| ATOM | 2320 | CD1 | LEU | H | 45 | 17.510 | −10.234 | 45.472 | 1.00 | 40.23 | | C |
| ANISOU | 2320 | CD1 | LEU | H | 45 | 5035 | 4771 | 5479 | 307 | 122 | −248 | C |
| ATOM | 2321 | CD2 | LEU | H | 45 | 17.570 | −10.679 | 47.976 | 1.00 | 42.08 | | C |
| ANISOU | 2321 | CD2 | LEU | H | 45 | 5428 | 4988 | 5573 | 343 | 154 | −104 | C |
| ATOM | 2322 | N | GLU | H | 46 | 12.968 | −10.058 | 48.798 | 1.00 | 43.31 | | N |
| ANISOU | 2322 | N | GLU | H | 46 | 5591 | 5072 | 5792 | 207 | 487 | −168 | N |
| ATOM | 2323 | CA | GLU | H | 46 | 11.685 | −9.373 | 48.908 | 1.00 | 36.54 | | C |
| ANISOU | 2323 | CA | GLU | H | 46 | 4704 | 4219 | 4959 | 171 | 567 | −208 | C |
| ATOM | 2324 | C | GLU | H | 46 | 11.925 | −7.874 | 49.046 | 1.00 | 37.39 | | C |
| ANISOU | 2324 | C | GLU | H | 46 | 4825 | 4408 | 4974 | 183 | 510 | −255 | C |
| ATOM | 2325 | O | GLU | H | 46 | 12.556 | −7.432 | 50.011 | 1.00 | 33.31 | | O |
| ANISOU | 2325 | O | GLU | H | 46 | 4402 | 3926 | 4328 | 213 | 484 | −221 | O |
| ATOM | 2326 | CB | GLU | H | 46 | 10.866 | −9.906 | 50.097 | 1.00 | 40.13 | | C |
| ANISOU | 2326 | CB | GLU | H | 46 | 5230 | 4626 | 5394 | 165 | 702 | −137 | C |
| ATOM | 2327 | CG | GLU | H | 46 | 9.513 | −9.205 | 50.274 | 1.00 | 39.36 | | C |
| ANISOU | 2327 | CG | GLU | H | 46 | 5092 | 4528 | 5333 | 134 | 804 | −174 | C |
| ATOM | 2328 | CD | GLU | H | 46 | 8.710 | −9.710 | 51.473 | 1.00 | 48.05 | | C |
| ANISOU | 2328 | CD | GLU | H | 46 | 6264 | 5580 | 6412 | 129 | 959 | −100 | C |

TABLE 11-continued

| | | | | | | | | | | | | |
|---|---|---|---|---|---|---|---|---|---|---|---|---|
| ATOM | 2329 | OE1 | GLU | H | 46 | 7.457 | −9.693 | 51.403 | 1.00 | 48.11 | | O |
| ANISOU | 2329 | OE1 | GLU | H | 46 | 6203 | 5553 | 6522 | 93 | 1068 | −117 | O |
| ATOM | 2330 | OE2 | GLU | H | 46 | 9.321 | −10.102 | 52.489 | 1.00 | 45.60 | | O |
| ANISOU | 2330 | OE2 | GLU | H | 46 | 6079 | 5264 | 5982 | 162 | 972 | −22 | O |
| ATOM | 2331 | N | TRP | H | 47 | 11.433 | −7.098 | 48.078 | 1.00 | 33.79 | | N |
| ANISOU | 2331 | N | TRP | H | 47 | 4280 | 3976 | 4584 | 159 | 484 | −334 | N |
| ATOM | 2332 | CA | TRP | H | 47 | 11.461 | −5.646 | 48.213 | 1.00 | 31.42 | | C |
| ANISOU | 2332 | CA | TRP | H | 47 | 3990 | 3737 | 4213 | 167 | 448 | −380 | C |
| ATOM | 2333 | C | TRP | H | 47 | 10.626 | −5.236 | 49.416 | 1.00 | 37.42 | | C |
| ANISOU | 2333 | C | TRP | H | 47 | 4817 | 4490 | 4912 | 171 | 556 | −359 | C |
| ATOM | 2334 | O | TRP | H | 47 | 9.524 | −5.749 | 49.626 | 1.00 | 33.26 | | O |
| ANISOU | 2334 | O | TRP | H | 47 | 4264 | 3915 | 4459 | 151 | 671 | −343 | O |
| ATOM | 2335 | CB | TRP | H | 47 | 10.939 | −4.967 | 46.940 | 1.00 | 30.58 | | C |
| ANISOU | 2335 | CB | TRP | H | 47 | 3776 | 3645 | 4198 | 143 | 410 | −458 | C |
| ATOM | 2336 | CG | TRP | H | 47 | 10.616 | −3.490 | 47.103 | 1.00 | 31.32 | | C |
| ANISOU | 2336 | CG | TRP | H | 47 | 3874 | 3782 | 4247 | 148 | 402 | −504 | C |
| ATOM | 2337 | CD1 | TRP | H | 47 | 11.502 | −2.445 | 47.175 | 1.00 | 34.57 | | C |
| ANISOU | 2337 | CD1 | TRP | H | 47 | 4323 | 4244 | 4569 | 165 | 318 | −525 | C |
| ATOM | 2338 | CD2 | TRP | H | 47 | 9.307 | −2.912 | 47.186 | 1.00 | 32.85 | | C |
| ANISOU | 2338 | CD2 | TRP | H | 47 | 4024 | 3961 | 4496 | 136 | 482 | −535 | C |
| ATOM | 2339 | NE1 | TRP | H | 47 | 10.813 | −1.255 | 47.303 | 1.00 | 33.57 | | N |
| ANISOU | 2339 | NE1 | TRP | H | 47 | 4190 | 4130 | 4434 | 165 | 342 | −569 | N |
| ATOM | 2340 | CE2 | TRP | H | 47 | 9.469 | −1.517 | 47.314 | 1.00 | 35.37 | | C |
| ANISOU | 2340 | CE2 | TRP | H | 47 | 4366 | 4321 | 4751 | 152 | 444 | −575 | C |
| ATOM | 2341 | CE3 | TRP | H | 47 | 8.012 | −3.443 | 47.166 | 1.00 | 35.00 | | C |
| ANISOU | 2341 | CE3 | TRP | H | 47 | 4233 | 4185 | 4880 | 112 | 582 | −532 | C |
| ATOM | 2342 | CZ2 | TRP | H | 47 | 8.384 | −0.644 | 47.431 | 1.00 | 35.21 | | C |
| ANISOU | 2342 | CZ2 | TRP | H | 47 | 4314 | 4295 | 4771 | 154 | 507 | −611 | C |
| ATOM | 2343 | CZ3 | TRP | H | 47 | 6.927 | −2.568 | 47.280 | 1.00 | 38.04 | | C |
| ANISOU | 2343 | CZ3 | TRP | H | 47 | 4573 | 4569 | 5312 | 112 | 645 | −566 | C |
| ATOM | 2344 | CH2 | TRP | H | 47 | 7.127 | −1.188 | 47.406 | 1.00 | 38.96 | | C |
| ANISOU | 2344 | CH2 | TRP | H | 47 | 4718 | 4726 | 5358 | 137 | 608 | −605 | C |
| ATOM | 2345 | N | VAL | H | 48 | 11.162 | −4.323 | 50.220 | 1.00 | 37.00 | | N |
| ANISOU | 2345 | N | VAL | H | 48 | 4853 | 4481 | 4726 | 195 | 523 | −360 | N |
| ATOM | 2346 | CA | VAL | H | 48 | 10.469 | −3.844 | 51.413 | 1.00 | 37.97 | | C |
| ANISOU | 2346 | CA | VAL | H | 48 | 5063 | 4599 | 4766 | 206 | 628 | −348 | C |
| ATOM | 2347 | C | VAL | H | 48 | 9.870 | −2.462 | 51.197 | 1.00 | 36.85 | | C |
| ANISOU | 2347 | C | VAL | H | 48 | 4888 | 4483 | 4632 | 204 | 637 | −423 | C |
| ATOM | 2348 | O | VAL | H | 48 | 8.685 | −2.252 | 51.455 | 1.00 | 35.60 | | O |
| ANISOU | 2348 | O | VAL | H | 48 | 4706 | 4298 | 4523 | 199 | 756 | −435 | O |
| ATOM | 2349 | CB | VAL | H | 48 | 11.414 | −3.850 | 52.635 | 1.00 | 37.89 | | C |
| ANISOU | 2349 | CB | VAL | H | 48 | 5203 | 4610 | 4583 | 238 | 591 | −296 | C |
| ATOM | 2350 | CG1 | VAL | H | 48 | 10.696 | −3.291 | 53.837 | 1.00 | 37.19 | | C |
| ANISOU | 2350 | CG1 | VAL | H | 48 | 5223 | 4518 | 4391 | 252 | 704 | −292 | C |
| ATOM | 2351 | CG2 | VAL | H | 48 | 11.913 | −5.268 | 52.922 | 1.00 | 37.29 | | C |
| ANISOU | 2351 | CG2 | VAL | H | 48 | 5163 | 4499 | 4505 | 248 | 592 | −209 | C |
| ATOM | 2352 | N | SER | H | 49 | 10.680 | −1.500 | 50.744 | 1.00 | 36.97 | | N |
| ANISOU | 2352 | N | SER | H | 49 | 4897 | 4543 | 4607 | 209 | 516 | −470 | N |
| ATOM | 2353 | CA | SER | H | 49 | 10.211 | −0.120 | 50.684 | 1.00 | 36.65 | | C |
| ANISOU | 2353 | CA | SER | H | 49 | 4848 | 4519 | 4559 | 213 | 521 | −535 | C |
| ATOM | 2354 | C | SER | H | 49 | 11.156 | 0.709 | 49.826 | 1.00 | 36.68 | | C |
| ANISOU | 2354 | C | SER | H | 49 | 4814 | 4561 | 4561 | 208 | 378 | −579 | C |
| ATOM | 2355 | O | SER | H | 49 | 12.335 | 0.381 | 49.702 | 1.00 | 34.90 | | O |
| ANISOU | 2355 | O | SER | H | 49 | 4607 | 4359 | 4295 | 208 | 280 | −555 | O |
| ATOM | 2356 | CB | SER | H | 49 | 10.108 | 0.485 | 52.086 | 1.00 | 36.21 | | C |
| ANISOU | 2356 | CB | SER | H | 49 | 4932 | 4466 | 4362 | 237 | 584 | −533 | C |
| ATOM | 2357 | OG | SER | H | 49 | 9.690 | 1.835 | 52.004 | 1.00 | 42.61 | | O |
| ANISOU | 2357 | OG | SER | H | 49 | 5736 | 5283 | 5171 | 245 | 590 | −601 | O |
| ATOM | 2358 | N | THR | H | 50 | 10.629 | 1.804 | 49.255 | 1.00 | 35.47 | | N |
| ANISOU | 2358 | N | THR | H | 50 | 4607 | 4413 | 4458 | 205 | 373 | −639 | N |
| ATOM | 2359 | CA | THR | H | 50 | 11.402 | 2.715 | 48.413 | 1.00 | 31.68 | | C |
| ANISOU | 2359 | CA | THR | H | 50 | 4093 | 3962 | 3982 | 197 | 253 | −678 | C |
| ATOM | 2360 | C | THR | H | 50 | 10.971 | 4.145 | 48.714 | 1.00 | 32.70 | | C |
| ANISOU | 2360 | C | THR | H | 50 | 4254 | 4088 | 4083 | 208 | 269 | −732 | C |
| ATOM | 2361 | O | THR | H | 50 | 9.798 | 4.401 | 49.016 | 1.00 | 33.49 | | O |
| ANISOU | 2361 | O | THR | H | 50 | 4343 | 4160 | 4222 | 221 | 374 | −749 | O |
| ATOM | 2362 | CB | THR | H | 50 | 11.205 | 2.433 | 46.907 | 1.00 | 37.25 | | C |
| ANISOU | 2362 | CB | THR | H | 50 | 4674 | 4667 | 4813 | 179 | 212 | −693 | C |
| ATOM | 2363 | OG1 | THR | H | 50 | 11.792 | 1.176 | 46.552 | 1.00 | 35.26 | | O |
| ANISOU | 2363 | OG1 | THR | H | 50 | 4400 | 4414 | 4583 | 171 | 186 | −652 | O |
| ATOM | 2364 | CG2 | THR | H | 50 | 11.844 | 3.538 | 46.032 | 1.00 | 32.59 | | C |
| ANISOU | 2364 | CG2 | THR | H | 50 | 4054 | 4101 | 4226 | 173 | 111 | −731 | C |
| ATOM | 2365 | N | ILE | H | 51 | 11.920 | 5.079 | 48.642 | 1.00 | 34.63 | | N |
| ANISOU | 2365 | N | ILE | H | 51 | 4535 | 4354 | 4271 | 203 | 169 | −758 | N |
| ATOM | 2366 | CA | ILE | H | 51 | 11.629 | 6.481 | 48.934 | 1.00 | 30.50 | | C |
| ANISOU | 2366 | CA | ILE | H | 51 | 4052 | 3817 | 3718 | 213 | 174 | −812 | C |
| ATOM | 2367 | C | ILE | H | 51 | 12.294 | 7.352 | 47.875 | 1.00 | 32.28 | | C |
| ANISOU | 2367 | C | ILE | H | 51 | 4224 | 4056 | 3987 | 195 | 65 | −839 | C |
| ATOM | 2368 | O | ILE | H | 51 | 13.433 | 7.102 | 47.472 | 1.00 | 32.12 | | O |
| ANISOU | 2368 | O | ILE | H | 51 | 4189 | 4063 | 3953 | 175 | −30 | −818 | O |

TABLE 11-continued

| | | | | | | | | | | | |
|---|---|---|---|---|---|---|---|---|---|---|---|
| ATOM | 2369 | CB | ILE | H | 51 | 12.080 | 6.862 | 50.358 | 1.00 | 37.53 | C |
| ANISOU | 2369 | CB | ILE | H | 51 | 5092 | 4708 | 4461 | 223 | 178 | −820 | C |
| ATOM | 2370 | CG1 | ILE | H | 51 | 11.697 | 8.300 | 50.691 | 1.00 | 36.64 | C |
| ANISOU | 2370 | CG1 | ILE | H | 51 | 5031 | 4569 | 4321 | 235 | 197 | −886 | C |
| ATOM | 2371 | CG2 | ILE | H | 51 | 13.584 | 6.681 | 50.560 | 1.00 | 31.88 | C |
| ANISOU | 2371 | CG2 | ILE | H | 51 | 4421 | 4025 | 3667 | 205 | 48 | −797 | C |
| ATOM | 2372 | CD1 | ILE | H | 51 | 11.823 | 8.567 | 52.150 | 1.00 | 33.32 | C |
| ANISOU | 2372 | CD1 | ILE | H | 51 | 4769 | 4139 | 3751 | 251 | 232 | −901 | C |
| ATOM | 2373 | N | SER | H | 52 | 11.574 | 8.379 | 47.424 | 1.00 | 31.54 | N |
| ANISOU | 2373 | N | SER | H | 52 | 4096 | 3938 | 3951 | 204 | 85 | −881 | N |
| ATOM | 2374 | CA | SER | H | 52 | 12.077 | 9.240 | 46.373 | 1.00 | 30.88 | C |
| ANISOU | 2374 | CA | SER | H | 52 | 3963 | 3858 | 3912 | 188 | −6 | −900 | C |
| ATOM | 2375 | C | SER | H | 52 | 13.168 | 10.159 | 46.923 | 1.00 | 34.05 | C |
| ANISOU | 2375 | C | SER | H | 52 | 4448 | 4261 | 4227 | 172 | −84 | −921 | C |
| ATOM | 2376 | O | SER | H | 52 | 13.339 | 10.313 | 48.137 | 1.00 | 35.17 | O |
| ANISOU | 2376 | O | SER | H | 52 | 4694 | 4396 | 4272 | 178 | −67 | −935 | O |
| ATOM | 2377 | CB | SER | H | 52 | 10.939 | 10.070 | 45.778 | 1.00 | 37.14 | C |
| ANISOU | 2377 | CB | SER | H | 52 | 4699 | 4617 | 4794 | 209 | 35 | −931 | C |
| ATOM | 2378 | OG | SER | H | 52 | 10.540 | 11.064 | 46.704 | 1.00 | 35.04 | O |
| ANISOU | 2378 | OG | SER | H | 52 | 4512 | 4317 | 4484 | 231 | 85 | −973 | O |
| ATOM | 2379 | N | GLY | H | 53 | 13.870 | 10.812 | 45.997 | 1.00 | 32.45 | N |
| ANISOU | 2379 | N | GLY | H | 53 | 4203 | 4063 | 4063 | 149 | −169 | −925 | N |
| ATOM | 2380 | CA | GLY | H | 53 | 15.005 | 11.653 | 46.366 | 1.00 | 32.36 | C |
| ANISOU | 2380 | CA | GLY | H | 53 | 4250 | 4050 | 3994 | 121 | −256 | −942 | C |
| ATOM | 2381 | C | GLY | H | 53 | 14.709 | 12.654 | 47.471 | 1.00 | 36.56 | C |
| ANISOU | 2381 | C | GLY | H | 53 | 4890 | 4543 | 4457 | 131 | −234 | −995 | C |
| ATOM | 2382 | O | GLY | H | 53 | 15.517 | 12.836 | 48.390 | 1.00 | 38.73 | O |
| ANISOU | 2382 | O | GLY | H | 53 | 5252 | 4822 | 4641 | 113 | −289 | −1008 | O |
| ATOM | 2383 | N | SER | H | 54 | 13.573 | 13.345 | 47.384 | 1.00 | 33.81 | N |
| ANISOU | 2383 | N | SER | H | 54 | 4541 | 4154 | 4153 | 161 | −159 | −1030 | N |
| ATOM | 2384 | CA | SER | H | 54 | 13.224 | 14.344 | 48.394 | 1.00 | 38.68 | C |
| ANISOU | 2384 | CA | SER | H | 54 | 5265 | 4723 | 4708 | 177 | −122 | −1088 | C |
| ATOM | 2385 | C | SER | H | 54 | 12.675 | 13.748 | 49.679 | 1.00 | 43.19 | C |
| ANISOU | 2385 | C | SER | H | 54 | 5927 | 5296 | 5188 | 206 | −28 | −1096 | C |
| ATOM | 2386 | O | SER | H | 54 | 12.509 | 14.478 | 50.660 | 1.00 | 39.52 | O |
| ANISOU | 2386 | O | SER | H | 54 | 5577 | 4795 | 4644 | 220 | 4 | −1147 | O |
| ATOM | 2387 | CB | SER | H | 54 | 12.168 | 15.308 | 47.856 | 1.00 | 38.53 | C |
| ANISOU | 2387 | CB | SER | H | 54 | 5209 | 4652 | 4779 | 209 | −65 | −1120 | C |
| ATOM | 2388 | OG | SER | H | 54 | 10.908 | 14.646 | 47.823 | 1.00 | 37.17 | O |
| ANISOU | 2388 | OG | SER | H | 54 | 4981 | 4481 | 4662 | 249 | 46 | −1105 | O |
| ATOM | 2389 | N | GLY | H | 55 | 12.334 | 12.470 | 49.695 | 1.00 | 38.80 | N |
| ANISOU | 2389 | N | GLY | H | 55 | 5328 | 4772 | 4640 | 216 | 25 | −1047 | N |
| ATOM | 2390 | CA | GLY | H | 55 | 11.618 | 11.916 | 50.823 | 1.00 | 36.19 | C |
| ANISOU | 2390 | CA | GLY | H | 55 | 5077 | 4436 | 4239 | 246 | 141 | −1045 | C |
| ATOM | 2391 | C | GLY | H | 55 | 10.111 | 11.970 | 50.709 | 1.00 | 42.27 | C |
| ANISOU | 2391 | C | GLY | H | 55 | 5792 | 5173 | 5097 | 287 | 282 | −1056 | C |
| ATOM | 2392 | O | GLY | H | 55 | 9.426 | 11.376 | 51.549 | 1.00 | 43.77 | O |
| ANISOU | 2392 | O | GLY | H | 55 | 6027 | 5356 | 5247 | 311 | 400 | −1044 | O |
| ATOM | 2393 | N | GLY | H | 56 | 9.572 | 12.632 | 49.678 | 1.00 | 38.71 | N |
| ANISOU | 2393 | N | GLY | H | 56 | 5239 | 4699 | 4769 | 295 | 274 | −1072 | N |
| ATOM | 2394 | CA | GLY | H | 56 | 8.134 | 12.848 | 49.609 | 1.00 | 37.85 | C |
| ANISOU | 2394 | CA | GLY | H | 56 | 5070 | 4552 | 4757 | 338 | 398 | −1087 | C |
| ATOM | 2395 | C | GLY | H | 56 | 7.324 | 11.679 | 49.083 | 1.00 | 33.61 | C |
| ANISOU | 2395 | C | GLY | H | 56 | 4414 | 4034 | 4323 | 340 | 457 | −1038 | C |
| ATOM | 2396 | O | GLY | H | 56 | 6.156 | 11.524 | 49.452 | 1.00 | 41.99 | O |
| ANISOU | 2396 | O | GLY | H | 56 | 5443 | 5070 | 5443 | 372 | 586 | −1041 | O |
| ATOM | 2397 | N | GLY | H | 57 | 7.903 | 10.846 | 48.224 | 1.00 | 34.54 | N |
| ANISOU | 2397 | N | GLY | H | 57 | 4462 | 4192 | 4472 | 305 | 369 | −997 | N |
| ATOM | 2398 | CA | GLY | H | 57 | 7.218 | 9.682 | 47.711 | 1.00 | 35.24 | C |
| ANISOU | 2398 | CA | GLY | H | 57 | 4445 | 4291 | 4655 | 299 | 412 | −957 | C |
| ATOM | 2399 | C | GLY | H | 57 | 7.728 | 8.445 | 48.421 | 1.00 | 39.30 | C |
| ANISOU | 2399 | C | GLY | H | 57 | 5015 | 4829 | 5087 | 281 | 435 | −915 | C |
| ATOM | 2400 | O | GLY | H | 57 | 8.925 | 8.169 | 48.408 | 1.00 | 38.19 | O |
| ANISOU | 2400 | O | GLY | H | 57 | 4923 | 4720 | 4869 | 257 | 342 | −897 | O |
| ATOM | 2401 | N | THR | H | 58 | 6.815 | 7.715 | 49.063 | 1.00 | 33.73 | N |
| ANISOU | 2401 | N | THR | H | 58 | 4304 | 4107 | 4406 | 293 | 565 | −893 | N |
| ATOM | 2402 | CA | THR | H | 58 | 7.173 | 6.498 | 49.772 | 1.00 | 37.32 | C |
| ANISOU | 2402 | CA | THR | H | 58 | 4816 | 4575 | 4790 | 280 | 601 | −843 | C |
| ATOM | 2403 | C | THR | H | 58 | 6.311 | 5.349 | 49.271 | 1.00 | 40.45 | C |
| ANISOU | 2403 | C | THR | H | 58 | 5098 | 4957 | 5315 | 265 | 664 | −806 | C |
| ATOM | 2404 | O | THR | H | 58 | 5.134 | 5.533 | 48.955 | 1.00 | 34.83 | O |
| ANISOU | 2404 | O | THR | H | 58 | 4291 | 4219 | 4726 | 276 | 737 | −820 | O |
| ATOM | 2405 | CB | THR | H | 58 | 7.016 | 6.655 | 51.297 | 1.00 | 39.51 | C |
| ANISOU | 2405 | CB | THR | H | 58 | 5236 | 4837 | 4940 | 306 | 711 | −844 | C |
| ATOM | 2406 | OG1 | THR | H | 58 | 5.661 | 6.981 | 51.603 | 1.00 | 43.87 | O |
| ANISOU | 2406 | OG1 | THR | H | 58 | 5750 | 5350 | 5568 | 335 | 860 | −862 | O |
| ATOM | 2407 | CG2 | THR | H | 58 | 7.947 | 7.768 | 51.834 | 1.00 | 38.80 | C |
| ANISOU | 2407 | CG2 | THR | H | 58 | 5272 | 4756 | 4714 | 313 | 631 | −888 | C |
| ATOM | 2408 | N | TYR | H | 59 | 6.914 | 4.167 | 49.197 | 1.00 | 40.81 | N |
| ANISOU | 2408 | N | TYR | H | 59 | 5150 | 5017 | 5340 | 241 | 631 | −759 | N |

TABLE 11-continued

| | | | | | | | | | | | | |
|---|---|---|---|---|---|---|---|---|---|---|---|---|
| ATOM | 2409 | CA | TYR | H | 59 | 6.316 | 2.971 | 48.618 | 1.00 | 39.55 | | C |
| ANISOU | 2409 | CA | TYR | H | 59 | 4889 | 4839 | 5299 | 217 | 664 | −726 | C |
| ATOM | 2410 | C | TYR | H | 59 | 6.666 | 1.809 | 49.530 | 1.00 | 35.80 | | C |
| ANISOU | 2410 | C | TYR | H | 59 | 4496 | 4357 | 4751 | 211 | 723 | −666 | C |
| ATOM | 2411 | O | TYR | H | 59 | 7.795 | 1.737 | 50.021 | 1.00 | 35.19 | | O |
| ANISOU | 2411 | O | TYR | H | 59 | 4520 | 4304 | 4545 | 217 | 658 | −647 | O |
| ATOM | 2412 | CB | TYR | H | 59 | 6.848 | 2.725 | 47.192 | 1.00 | 35.44 | | C |
| ANISOU | 2412 | CB | TYR | H | 59 | 4282 | 4339 | 4846 | 192 | 531 | −737 | C |
| ATOM | 2413 | CG | TYR | H | 59 | 6.605 | 3.919 | 46.294 | 1.00 | 38.04 | | C |
| ANISOU | 2413 | CG | TYR | H | 59 | 4549 | 4676 | 5229 | 201 | 464 | −787 | C |
| ATOM | 2414 | CD1 | TYR | H | 59 | 7.448 | 5.037 | 46.336 | 1.00 | 35.68 | | C |
| ANISOU | 2414 | CD1 | TYR | H | 59 | 4316 | 4399 | 4842 | 213 | 389 | −813 | C |
| ATOM | 2415 | CD2 | TYR | H | 59 | 5.516 | 3.949 | 45.440 | 1.00 | 39.57 | | C |
| ANISOU | 2415 | CD2 | TYR | H | 59 | 4620 | 4849 | 5565 | 196 | 472 | −805 | C |
| ATOM | 2416 | CE1 | TYR | H | 59 | 7.214 | 6.142 | 45.541 | 1.00 | 32.42 | | C |
| ANISOU | 2416 | CE1 | TYR | H | 59 | 3854 | 3985 | 4480 | 223 | 334 | −851 | C |
| ATOM | 2417 | CE2 | TYR | H | 59 | 5.266 | 5.058 | 44.632 | 1.00 | 38.68 | | C |
| ANISOU | 2417 | CE2 | TYR | H | 59 | 4456 | 4740 | 5499 | 210 | 407 | −843 | C |
| ATOM | 2418 | CZ | TYR | H | 59 | 6.120 | 6.145 | 44.687 | 1.00 | 39.53 | | C |
| ANISOU | 2418 | CZ | TYR | H | 59 | 4638 | 4866 | 5515 | 224 | 343 | −863 | C |
| ATOM | 2419 | OH | TYR | H | 59 | 5.868 | 7.243 | 43.898 | 1.00 | 38.22 | | O |
| ANISOU | 2419 | OH | TYR | H | 59 | 4429 | 4696 | 5398 | 239 | 284 | −893 | O |
| ATOM | 2420 | N | TYR | H | 60 | 5.695 | 0.928 | 49.784 | 1.00 | 36.81 | | N |
| ANISOU | 2420 | N | TYR | H | 60 | 4578 | 4447 | 4963 | 200 | 843 | −632 | N |
| ATOM | 2421 | CA | TYR | H | 60 | 5.848 | −0.147 | 50.758 | 1.00 | 39.13 | | C |
| ANISOU | 2421 | CA | TYR | H | 60 | 4957 | 4721 | 5190 | 198 | 925 | −566 | C |
| ATOM | 2422 | C | TYR | H | 60 | 5.265 | −1.448 | 50.223 | 1.00 | 43.41 | | C |
| ANISOU | 2422 | C | TYR | H | 60 | 5400 | 5222 | 5873 | 162 | 966 | −530 | C |
| ATOM | 2423 | O | TYR | H | 60 | 4.205 | −1.452 | 49.590 | 1.00 | 40.19 | | O |
| ANISOU | 2423 | O | TYR | H | 60 | 4864 | 4788 | 5617 | 144 | 1005 | −553 | O |
| ATOM | 2424 | CB | TYR | H | 60 | 5.141 | 0.175 | 52.085 | 1.00 | 42.67 | | C |
| ANISOU | 2424 | CB | TYR | H | 60 | 5495 | 5148 | 5568 | 224 | 1086 | −551 | C |
| ATOM | 2425 | CG | TYR | H | 60 | 5.683 | 1.366 | 52.817 | 1.00 | 42.89 | | C |
| ANISOU | 2425 | CG | TYR | H | 60 | 5651 | 5206 | 5441 | 259 | 1061 | −588 | C |
| ATOM | 2426 | CD1 | TYR | H | 60 | 6.770 | 1.242 | 53.667 | 1.00 | 41.21 | | C |
| ANISOU | 2426 | CD1 | TYR | H | 60 | 5592 | 5016 | 5050 | 271 | 1008 | −560 | C |
| ATOM | 2427 | CD2 | TYR | H | 60 | 5.099 | 2.621 | 52.664 | 1.00 | 41.37 | | C |
| ANISOU | 2427 | CD2 | TYR | H | 60 | 5425 | 5011 | 5283 | 280 | 1083 | −653 | C |
| ATOM | 2428 | CE1 | TYR | H | 60 | 7.274 | 2.343 | 54.344 | 1.00 | 40.32 | | C |
| ANISOU | 2428 | CE1 | TYR | H | 60 | 5601 | 4925 | 4795 | 296 | 972 | −602 | C |
| ATOM | 2429 | CE2 | TYR | H | 60 | 5.588 | 3.723 | 53.332 | 1.00 | 40.88 | | C |
| ANISOU | 2429 | CE2 | TYR | H | 60 | 5486 | 4964 | 5082 | 308 | 1059 | −695 | C |
| ATOM | 2430 | CZ | TYR | H | 60 | 6.671 | 3.581 | 54.171 | 1.00 | 42.63 | | C |
| ANISOU | 2430 | CZ | TYR | H | 60 | 5863 | 5209 | 5125 | 313 | 1001 | −673 | C |
| ATOM | 2431 | OH | TYR | H | 60 | 7.155 | 4.679 | 54.841 | 1.00 | 39.65 | | O |
| ANISOU | 2431 | OH | TYR | H | 60 | 5613 | 4843 | 4610 | 334 | 966 | −722 | O |
| ATOM | 2432 | N | ALA | H | 61 | 5.943 | −2.554 | 50.518 | 1.00 | 39.82 | | N |
| ANISOU | 2432 | N | ALA | H | 61 | 5004 | 4755 | 5369 | 154 | 954 | −472 | N |
| ATOM | 2433 | CA | ALA | H | 61 | 5.333 | −3.867 | 50.340 | 1.00 | 38.72 | | C |
| ANISOU | 2433 | CA | ALA | H | 61 | 4802 | 4560 | 5349 | 120 | 1025 | −428 | C |
| ATOM | 2434 | C | ALA | H | 61 | 4.108 | −4.006 | 51.246 | 1.00 | 41.07 | | C |
| ANISOU | 2434 | C | ALA | H | 61 | 5099 | 4815 | 5691 | 117 | 1213 | −396 | C |
| ATOM | 2435 | O | ALA | H | 61 | 4.079 | −3.493 | 52.371 | 1.00 | 43.28 | | O |
| ANISOU | 2435 | O | ALA | H | 61 | 5491 | 5105 | 5847 | 150 | 1300 | −379 | O |
| ATOM | 2436 | CB | ALA | H | 61 | 6.365 | −4.966 | 50.639 | 1.00 | 38.23 | | C |
| ANISOU | 2436 | CB | ALA | H | 61 | 4825 | 4487 | 5213 | 122 | 984 | −365 | C |
| ATOM | 2437 | N | ALA | H | 62 | 3.077 | −4.688 | 50.748 | 1.00 | 42.38 | | N |
| ANISOU | 2437 | N | ALA | H | 62 | 5138 | 4930 | 6035 | 77 | 1279 | −391 | N |
| ATOM | 2438 | CA | ALA | H | 62 | 1.871 | −4.858 | 51.558 | 1.00 | 50.63 | | C |
| ANISOU | 2438 | CA | ALA | H | 62 | 6161 | 5929 | 7148 | 71 | 1471 | −356 | C |
| ATOM | 2439 | C | ALA | H | 62 | 2.169 | −5.572 | 52.874 | 1.00 | 51.41 | | C |
| ANISOU | 2439 | C | ALA | H | 62 | 6411 | 6003 | 7118 | 84 | 1588 | −269 | C |
| ATOM | 2440 | O | ALA | H | 62 | 1.501 | −5.320 | 53.880 | 1.00 | 53.88 | | O |
| ANISOU | 2440 | O | ALA | H | 62 | 6777 | 6300 | 7394 | 102 | 1752 | −241 | O |
| ATOM | 2441 | CB | ALA | H | 62 | 0.806 | −5.615 | 50.767 | 1.00 | 50.23 | | C |
| ANISOU | 2441 | CB | ALA | H | 62 | 5939 | 5822 | 7326 | 15 | 1505 | −360 | C |
| ATOM | 2442 | N | SER | H | 63 | 3.200 | −6.416 | 52.905 | 1.00 | 52.62 | | N |
| ANISOU | 2442 | N | SER | H | 63 | 6647 | 6154 | 7194 | 82 | 1507 | −224 | N |
| ATOM | 2443 | CA | SER | H | 63 | 3.520 | −7.164 | 54.117 | 1.00 | 56.81 | | C |
| ANISOU | 2443 | CA | SER | H | 63 | 7327 | 6656 | 7601 | 98 | 1604 | −131 | C |
| ATOM | 2444 | C | SER | H | 63 | 4.153 | −6.311 | 55.211 | 1.00 | 55.09 | | C |
| ANISOU | 2444 | C | SER | H | 63 | 7284 | 6491 | 7158 | 152 | 1607 | −125 | C |
| ATOM | 2445 | O | SER | H | 63 | 4.243 | −6.779 | 56.352 | 1.00 | 51.50 | | O |
| ANISOU | 2445 | O | SER | H | 63 | 6970 | 6015 | 6583 | 170 | 1707 | −47 | O |
| ATOM | 2446 | CB | SER | H | 63 | 4.456 | −8.325 | 53.787 | 1.00 | 55.83 | | C |
| ANISOU | 2446 | CB | SER | H | 63 | 7232 | 6508 | 7473 | 87 | 1506 | −83 | C |
| ATOM | 2447 | OG | SER | H | 63 | 5.704 | −7.836 | 53.328 | 1.00 | 61.81 | | O |
| ANISOU | 2447 | OG | SER | H | 63 | 8024 | 7327 | 8133 | 114 | 1325 | −122 | O |
| ATOM | 2448 | N | VAL | H | 64 | 4.606 | −5.095 | 54.909 | 1.00 | 48.18 | | N |
| ANISOU | 2448 | N | VAL | H | 64 | 6413 | 5677 | 6217 | 177 | 1498 | −201 | N |

TABLE 11-continued

| | | | | | | | | | | | |
|---|---|---|---|---|---|---|---|---|---|---|---|
| ATOM | 2449 | CA | VAL | H | 64 | 5.136 | −4.204 | 55.937 | 1.00 | 42.46 | C |
| ANISOU | 2449 | CA | VAL | H | 64 | 5852 | 4994 | 5285 | 222 | 1496 | −209 | C |
| ATOM | 2450 | C | VAL | H | 64 | 4.339 | −2.914 | 56.086 | 1.00 | 43.92 | C |
| ANISOU | 2450 | C | VAL | H | 64 | 6015 | 5193 | 5478 | 241 | 1572 | −281 | C |
| ATOM | 2451 | O | VAL | H | 64 | 4.617 | −2.146 | 57.020 | 1.00 | 46.12 | O |
| ANISOU | 2451 | O | VAL | H | 64 | 6441 | 5496 | 5586 | 278 | 1595 | −295 | O |
| ATOM | 2452 | CB | VAL | H | 64 | 6.628 | −3.880 | 55.706 | 1.00 | 46.62 | C |
| ANISOU | 2452 | CB | VAL | H | 64 | 6445 | 5577 | 5692 | 239 | 1292 | −228 | C |
| ATOM | 2453 | CG1 | VAL | H | 64 | 7.434 | −5.158 | 55.531 | 1.00 | 40.49 | C |
| ANISOU | 2453 | CG1 | VAL | H | 64 | 5681 | 4782 | 4922 | 230 | 1219 | −157 | C |
| ATOM | 2454 | CG2 | VAL | H | 64 | 6.820 | −2.948 | 54.513 | 1.00 | 45.58 | C |
| ANISOU | 2454 | CG2 | VAL | H | 64 | 6193 | 5483 | 5645 | 230 | 1162 | −319 | C |
| ATOM | 2455 | N | LYS | H | 65 | 3.356 | −2.650 | 55.220 | 1.00 | 46.67 | N |
| ANISOU | 2455 | N | LYS | H | 65 | 6191 | 5524 | 6017 | 220 | 1607 | −327 | N |
| ATOM | 2456 | CA | LYS | H | 65 | 2.541 | −1.444 | 55.337 | 1.00 | 55.47 | C |
| ANISOU | 2456 | CA | LYS | H | 65 | 7272 | 6643 | 7160 | 245 | 1685 | −390 | C |
| ATOM | 2457 | C | LYS | H | 65 | 1.963 | −1.327 | 56.737 | 1.00 | 59.19 | C |
| ANISOU | 2457 | C | LYS | H | 65 | 7874 | 7092 | 7525 | 276 | 1887 | −356 | C |
| ATOM | 2458 | O | LYS | H | 65 | 1.530 | −2.317 | 57.330 | 1.00 | 58.11 | O |
| ANISOU | 2458 | O | LYS | H | 65 | 7765 | 6914 | 7402 | 263 | 2024 | −279 | O |
| ATOM | 2459 | CB | LYS | H | 65 | 1.401 | −1.456 | 54.315 | 1.00 | 63.41 | C |
| ANISOU | 2459 | CB | LYS | H | 65 | 8063 | 7620 | 8409 | 217 | 1717 | −421 | C |
| ATOM | 2460 | CG | LYS | H | 65 | 1.644 | −0.616 | 53.065 | 1.00 | 79.75 | C |
| ANISOU | 2460 | CG | LYS | H | 65 | 10024 | 9724 | 10553 | 214 | 1548 | −498 | C |
| ATOM | 2461 | CD | LYS | H | 65 | 0.519 | −0.802 | 52.046 | 1.00 | 86.80 | C |
| ANISOU | 2461 | CD | LYS | H | 65 | 10709 | 10586 | 11684 | 184 | 1562 | −519 | C |
| ATOM | 2462 | CE | LYS | H | 65 | 1.070 | −1.096 | 50.651 | 1.00 | 84.52 | C |
| ANISOU | 2462 | CE | LYS | H | 65 | 10330 | 10317 | 11467 | 150 | 1370 | −546 | C |
| ATOM | 2463 | NZ | LYS | H | 65 | 0.020 | −1.585 | 49.713 | 1.00 | 82.98 | N |
| ANISOU | 2463 | NZ | LYS | H | 65 | 9948 | 10085 | 11495 | 110 | 1373 | −556 | N |
| ATOM | 2464 | N | GLY | H | 66 | 1.972 | −0.106 | 57.266 | 1.00 | 59.80 | N |
| ANISOU | 2464 | N | GLY | H | 66 | 8039 | 7189 | 7491 | 319 | 1910 | −414 | N |
| ATOM | 2465 | CA | GLY | H | 66 | 1.467 | 0.159 | 58.590 | 1.00 | 57.01 | C |
| ANISOU | 2465 | CA | GLY | H | 66 | 7831 | 6816 | 7014 | 357 | 2102 | −396 | C |
| ATOM | 2466 | C | GLY | H | 66 | 2.431 | −0.133 | 59.713 | 1.00 | 57.11 | C |
| ANISOU | 2466 | C | GLY | H | 66 | 8078 | 6847 | 6773 | 376 | 2081 | −350 | C |
| ATOM | 2467 | O | GLY | H | 66 | 2.250 | 0.400 | 60.811 | 1.00 | 61.37 | O |
| ANISOU | 2467 | O | GLY | H | 66 | 8779 | 7383 | 7156 | 416 | 2200 | −359 | O |
| ATOM | 2468 | N | ARG | H | 67 | 3.455 | −0.954 | 59.484 | 1.00 | 50.82 | N |
| ANISOU | 2468 | N | ARG | H | 67 | 7312 | 6070 | 5928 | 353 | 1933 | −300 | N |
| ATOM | 2469 | CA | ARG | H | 67 | 4.411 | −1.300 | 60.530 | 1.00 | 52.43 | C |
| ANISOU | 2469 | CA | ARG | H | 67 | 7732 | 6291 | 5898 | 374 | 1892 | −246 | C |
| ATOM | 2470 | C | ARG | H | 67 | 5.787 | −0.690 | 60.319 | 1.00 | 47.12 | C |
| ANISOU | 2470 | C | ARG | H | 67 | 7124 | 5673 | 5104 | 380 | 1656 | −293 | C |
| ATOM | 2471 | O | ARG | H | 67 | 6.424 | −0.280 | 61.291 | 1.00 | 50.02 | O |
| ANISOU | 2471 | O | ARG | H | 67 | 7685 | 6064 | 5258 | 409 | 1620 | −296 | O |
| ATOM | 2472 | CB | ARG | H | 67 | 4.548 | −2.826 | 60.644 | 1.00 | 52.83 | C |
| ANISOU | 2472 | CB | ARG | H | 67 | 7787 | 6311 | 5977 | 350 | 1921 | −135 | C |
| ATOM | 2473 | CG | ARG | H | 67 | 3.221 | −3.543 | 60.833 | 1.00 | 53.70 | C |
| ANISOU | 2473 | CG | ARG | H | 67 | 7821 | 6357 | 6225 | 332 | 2154 | −79 | C |
| ATOM | 2474 | CD | ARG | H | 67 | 3.396 | −5.048 | 61.044 | 1.00 | 59.73 | C |
| ANISOU | 2474 | CD | ARG | H | 67 | 8612 | 7079 | 7005 | 308 | 2187 | 37 | C |
| ATOM | 2475 | NE | ARG | H | 67 | 4.004 | −5.722 | 59.896 | 1.00 | 58.77 | N |
| ANISOU | 2475 | NE | ARG | H | 67 | 8357 | 6957 | 7017 | 273 | 2015 | 38 | N |
| ATOM | 2476 | CZ | ARG | H | 67 | 5.203 | −6.300 | 59.915 | 1.00 | 53.45 | C |
| ANISOU | 2476 | CZ | ARG | H | 67 | 7761 | 6300 | 6248 | 281 | 1862 | 83 | C |
| ATOM | 2477 | NH1 | ARG | H | 67 | 5.931 | −6.286 | 61.027 | 1.00 | 49.08 | N |
| ANISOU | 2477 | NH1 | ARG | H | 67 | 7416 | 5767 | 5465 | 320 | 1842 | 132 | N |
| ATOM | 2478 | NH2 | ARG | H | 67 | 5.671 | −6.893 | 58.825 | 1.00 | 50.33 | N |
| ANISOU | 2478 | NH2 | ARG | H | 67 | 7237 | 5898 | 5987 | 252 | 1728 | 77 | N |
| ATOM | 2479 | N | PHE | H | 68 | 6.264 | −0.612 | 59.077 | 1.00 | 45.14 | N |
| ANISOU | 2479 | N | PHE | H | 68 | 6721 | 5445 | 4985 | 354 | 1494 | −329 | N |
| ATOM | 2480 | CA | PHE | H | 68 | 7.568 | −0.045 | 58.760 | 1.00 | 46.44 | C |
| ANISOU | 2480 | CA | PHE | H | 68 | 6919 | 5659 | 5067 | 354 | 1276 | −369 | C |
| ATOM | 2481 | C | PHE | H | 68 | 7.407 | 1.352 | 58.177 | 1.00 | 47.71 | C |
| ANISOU | 2481 | C | PHE | H | 68 | 7015 | 5836 | 5278 | 357 | 1226 | −474 | C |
| ATOM | 2482 | O | PHE | H | 68 | 6.439 | 1.634 | 57.467 | 1.00 | 51.24 | O |
| ANISOU | 2482 | O | PHE | H | 68 | 7319 | 6262 | 5889 | 350 | 1301 | −509 | O |
| ATOM | 2483 | CB | PHE | H | 68 | 8.339 | −0.904 | 57.751 | 1.00 | 44.51 | C |
| ANISOU | 2483 | CB | PHE | H | 68 | 6560 | 5425 | 4927 | 326 | 1132 | −335 | C |
| ATOM | 2484 | CG | PHE | H | 68 | 8.725 | −2.275 | 58.258 | 1.00 | 55.34 | C |
| ANISOU | 2484 | CG | PHE | H | 68 | 7999 | 6777 | 6251 | 327 | 1147 | −230 | C |
| ATOM | 2485 | CD1 | PHE | H | 68 | 8.3 | −2.732 | 59.500 | 1.00 | 49.22 | C |
| ANISOU | 2485 | CD1 | PHE | H | 68 | 7373 | 5975 | 5354 | 347 | 1291 | −164 | C |
| ATOM | 2486 | CD2 | PHE | H | 68 | 9.527 | −3.101 | 57.481 | 1.00 | 48.63 | C |
| ANISOU | 2486 | CD2 | PHE | H | 68 | 7069 | 5931 | 5477 | 311 | 1020 | −196 | C |
| ATOM | 2487 | CE1 | PHE | H | 68 | 8.662 | −3.989 | 59.949 | 1.00 | 51.15 | C |
| ANISOU | 2487 | CE1 | PHE | H | 68 | 7684 | 6195 | 5558 | 351 | 1302 | −60 | C |
| ATOM | 2488 | CE2 | PHE | H | 68 | 9.891 | −4.363 | 57.924 | 1.00 | 47.53 | C |
| ANISOU | 2488 | CE2 | PHE | H | 68 | 6990 | 5765 | 5306 | 317 | 1032 | −97 | C |

TABLE 11-continued

| | | | | | | | | | | | |
|---|---|---|---|---|---|---|---|---|---|---|---|
| ATOM | 2489 | CZ | PHE | H | 68 | 9.459 | −4.807 | 59.158 | 1.00 | 54.91 | C |
| ANISOU | 2489 | CZ | PHE | H | 68 | 8072 | 6670 | 6121 | 336 | 1168 | −26 C |
| ATOM | 2490 | N | THR | H | 69 | 8.372 | 2.225 | 58.463 | 1.00 | 43.76 | N |
| ANISOU | 2490 | N | THR | H | 69 | 6616 | 5369 | 4641 | 366 | 1090 | −521 N |
| ATOM | 2491 | CA | THR | H | 69 | 8.387 | 3.575 | 57.910 | 1.00 | 44.40 | C |
| ANISOU | 2491 | CA | THR | H | 69 | 6648 | 5460 | 4763 | 367 | 1023 | −617 C |
| ATOM | 2492 | C | THR | H | 69 | 9.762 | 3.861 | 57.327 | 1.00 | 40.13 | C |
| ANISOU | 2492 | C | THR | H | 69 | 6088 | 4958 | 4199 | 345 | 801 | −635 C |
| ATOM | 2493 | O | THR | H | 69 | 10.770 | 3.789 | 58.034 | 1.00 | 42.83 | O |
| ANISOU | 2493 | O | THR | H | 69 | 6560 | 5324 | 4390 | 347 | 700 | −616 O |
| ATOM | 2494 | CB | THR | H | 69 | 8.0 | 4.626 | 58.969 | 1.00 | 46.74 | C |
| ANISOU | 2494 | CB | THR | H | 69 | 7101 | 5741 | 4918 | 400 | 1110 | −675 C |
| ATOM | 2495 | OG1 | THR | H | 69 | 6.692 | 4.406 | 59.429 | 1.00 | 50.25 | O |
| ANISOU | 2495 | OG1 | THR | H | 69 | 7541 | 6145 | 5406 | 424 | 1337 | −659 O |
| ATOM | 2496 | CG2 | THR | H | 69 | 8.109 | 6.005 | 58.375 | 1.00 | 45.76 | C |
| ANISOU | 2496 | CG2 | THR | H | 69 | 6928 | 5616 | 4842 | 400 | 1033 | −771 C |
| ATOM | 2497 | N | ILE | H | 70 | 9.805 | 4.185 | 56.058 | 1.00 | 39.24 | N |
| ANISOU | 2497 | N | ILE | H | 70 | 5818 | 4853 | 4238 | 324 | 725 | −668 N |
| ATOM | 2498 | CA | ILE | H | 70 | 11.056 | 4.564 | 55.420 | 1.00 | 40.48 | C |
| ANISOU | 2498 | CA | ILE | H | 70 | 5944 | 5045 | 4392 | 302 | 533 | −688 C |
| ATOM | 2499 | C | ILE | H | 70 | 11.191 | 6.079 | 55.507 | 1.00 | 41.61 | C |
| ANISOU | 2499 | C | ILE | H | 70 | 6133 | 5184 | 4490 | 304 | 485 | −773 C |
| ATOM | 2500 | O | ILE | H | 70 | 10.190 | 6.810 | 55.501 | 1.00 | 42.70 | O |
| ANISOU | 2500 | O | ILE | H | 70 | 6257 | 5292 | 4675 | 322 | 591 | −822 O |
| ATOM | 2501 | CB | ILE | H | 70 | 11.098 | 4.041 | 53.969 | 1.00 | 35.62 | C |
| ANISOU | 2501 | CB | ILE | H | 70 | 5146 | 4436 | 3950 | 277 | 480 | −672 C |
| ATOM | 2502 | CG1 | ILE | H | 70 | 12.514 | 4.128 | 53.389 | 1.00 | 33.79 | C |
| ANISOU | 2502 | CG1 | ILE | H | 70 | 4888 | 4242 | 3710 | 257 | 299 | −670 C |
| ATOM | 2503 | CG2 | ILE | H | 70 | 10.090 | 4.766 | 53.090 | 1.00 | 36.96 | C |
| ANISOU | 2503 | CG2 | ILE | H | 70 | 5199 | 4586 | 4258 | 276 | 535 | −726 C |
| ATOM | 2504 | CD1 | ILE | H | 70 | 12.659 | 3.354 | 52.052 | 1.00 | 30.18 | C |
| ANISOU | 2504 | CD1 | ILE | H | 70 | 4278 | 3791 | 3400 | 238 | 258 | −645 C |
| ATOM | 2505 | N | SER | H | 71 | 12.427 | 6.561 | 55.629 | 1.00 | 36.68 | N |
| ANISOU | 2505 | N | SER | H | 71 | 5567 | 4586 | 3785 | 288 | 327 | −791 N |
| ATOM | 2506 | CA | SER | H | 71 | 12.658 | 7.997 | 55.749 | 1.00 | 39.98 | C |
| ANISOU | 2506 | CA | SER | H | 71 | 6039 | 4993 | 4161 | 283 | 269 | −874 C |
| ATOM | 2507 | C | SER | H | 71 | 14.111 | 8.277 | 55.401 | 1.00 | 45.21 | C |
| ANISOU | 2507 | C | SER | H | 71 | 6687 | 5686 | 4807 | 248 | 74 | −877 C |
| ATOM | 2508 | O | SER | H | 71 | 14.937 | 7.367 | 55.298 | 1.00 | 37.81 | O |
| ANISOU | 2508 | O | SER | H | 71 | 5722 | 4780 | 3865 | 237 | −8 | −815 O |
| ATOM | 2509 | CB | SER | H | 71 | 12.304 | 8.511 | 57.150 | 1.00 | 43.09 | C |
| ANISOU | 2509 | CB | SER | H | 71 | 6622 | 5362 | 4387 | 310 | 349 | −911 C |
| ATOM | 2510 | OG | SER | H | 71 | 13.245 | 8.077 | 58.126 | 1.00 | 44.88 | O |
| ANISOU | 2510 | OG | SER | H | 71 | 6991 | 5614 | 4448 | 306 | 260 | −879 O |
| ATOM | 2511 | N | ARG | H | 72 | 14.426 | 9.553 | 55.207 | 1.00 | 37.34 | N |
| ANISOU | 2511 | N | ARG | H | 72 | 5700 | 4673 | 3813 | 231 | 2 | −947 N |
| ATOM | 2512 | CA | ARG | H | 72 | 15.793 | 9.877 | 54.831 | 1.00 | 40.05 | C |
| ANISOU | 2512 | CA | ARG | H | 72 | 6014 | 5041 | 4163 | 191 | −177 | −949 C |
| ATOM | 2513 | C | ARG | H | 72 | 16.151 | 11.248 | 55.369 | 1.00 | 41.24 | C |
| ANISOU | 2513 | C | ARG | H | 72 | 6269 | 5163 | 4237 | 174 | −245 | −1030 C |
| ATOM | 2514 | O | ARG | H | 72 | 15.289 | 12.116 | 55.525 | 1.00 | 40.52 | O |
| ANISOU | 2514 | O | ARG | H | 72 | 6222 | 5028 | 4146 | 192 | −154 | −1092 O |
| ATOM | 2515 | CB | ARG | H | 72 | 16.009 | 9.839 | 53.313 | 1.00 | 39.80 | C |
| ANISOU | 2515 | CB | ARG | H | 72 | 5802 | 5020 | 4299 | 169 | −218 | −931 C |
| ATOM | 2516 | CG | ARG | H | 72 | 15.223 | 10.876 | 52.512 | 1.00 | 39.56 | C |
| ANISOU | 2516 | CG | ARG | H | 72 | 5707 | 4954 | 4369 | 171 | −165 | −985 C |
| ATOM | 2517 | CD | ARG | H | 72 | 15.184 | 10.485 | 51.020 | 1.00 | 35.41 | C |
| ANISOU | 2517 | CD | ARG | H | 72 | 5014 | 4444 | 3995 | 160 | −176 | −951 C |
| ATOM | 2518 | NE | ARG | H | 72 | 16.496 | 10.633 | 50.400 | 1.00 | 35.66 | N |
| ANISOU | 2518 | NE | ARG | H | 72 | 4992 | 4501 | 4057 | 122 | −312 | −935 N |
| ATOM | 2519 | CZ | ARG | H | 72 | 16.878 | 10.036 | 49.277 | 1.00 | 36.28 | C |
| ANISOU | 2519 | CZ | ARG | H | 72 | 4951 | 4605 | 4231 | 111 | −342 | −893 C |
| ATOM | 2520 | NH1 | ARG | H | 72 | 16.051 | 9.230 | 48.623 | 1.00 | 35.42 | N |
| ANISOU | 2520 | NH1 | ARG | H | 72 | 4767 | 4498 | 4193 | 131 | −260 | −867 N |
| ATOM | 2521 | NH2 | ARG | H | 72 | 18.097 | 10.253 | 48.803 | 1.00 | 34.37 | N |
| ANISOU | 2521 | NH2 | ARG | H | 72 | 4662 | 4381 | 4014 | 78 | −453 | −880 N |
| ATOM | 2522 | N | ASP | H | 73 | 17.436 | 11.426 | 55.658 | 1.00 | 39.43 | N |
| ANISOU | 2522 | N | ASP | H | 73 | 6076 | 4954 | 3952 | 139 | −408 | −1030 N |
| ATOM | 2523 | CA | ASP | H | 73 | 17.973 | 12.719 | 56.076 | 1.00 | 41.14 | C |
| ANISOU | 2523 | CA | ASP | H | 73 | 6380 | 5140 | 4111 | 107 | −505 | −1109 C |
| ATOM | 2524 | C | ASP | H | 73 | 19.000 | 13.105 | 55.017 | 1.00 | 40.72 | C |
| ANISOU | 2524 | C | ASP | H | 73 | 6188 | 5098 | 4186 | 57 | −638 | −1100 C |
| ATOM | 2525 | O | ASP | H | 73 | 20.159 | 12.683 | 55.075 | 1.00 | 45.76 | O |
| ANISOU | 2525 | O | ASP | H | 73 | 6797 | 5772 | 4818 | 29 | −772 | −1061 O |
| ATOM | 2526 | CB | ASP | H | 73 | 18.578 | 12.653 | 57.479 | 1.00 | 41.47 | C |
| ANISOU | 2526 | CB | ASP | H | 73 | 6601 | 5191 | 3966 | 105 | −589 | −1123 C |
| ATOM | 2527 | CG | ASP | H | 73 | 18.927 | 14.033 | 58.028 | 1.00 | 52.44 | C |
| ANISOU | 2527 | CG | ASP | H | 73 | 8107 | 6535 | 5283 | 74 | −673 | −1222 C |
| ATOM | 2528 | OD1 | ASP | H | 73 | 19.053 | 14.975 | 57.221 | 1.00 | 53.57 | O |
| ANISOU | 2528 | OD1 | ASP | H | 73 | 8166 | 6646 | 5542 | 42 | −704 | −1264 O |

TABLE 11-continued

| | | | | | | | | | | | |
|---|---|---|---|---|---|---|---|---|---|---|---|
| ATOM | 2529 | OD2 | ASP | H | 73 | 19.074 | 14.174 | 59.262 | 1.00 | 54.61 | O |
| ANISOU | 2529 | OD2 | ASP | H | 73 | 8566 | 6802 | 5383 | 80 | −708 | −1257 | O |
| ATOM | 2530 | N | ASN | H | 74 | 18.571 | 13.898 | 54.034 | 1.00 | 38.51 | N |
| ANISOU | 2530 | N | ASN | H | 74 | 5819 | 4785 | 4026 | 49 | −597 | −1131 | N |
| ATOM | 2531 | CA | ASN | H | 74 | 19.488 | 14.298 | 52.975 | 1.00 | 40.20 | C |
| ANISOU | 2531 | CA | ASN | H | 74 | 5906 | 5006 | 4362 | 1 | −701 | −1117 | C |
| ATOM | 2532 | C | ASN | H | 74 | 20.631 | 15.171 | 53.495 | 1.00 | 38.97 | C |
| ANISOU | 2532 | C | ASN | H | 74 | 5811 | 4833 | 4163 | −54 | −857 | −1161 | C |
| ATOM | 2533 | O | ASN | H | 74 | 21.706 | 15.182 | 52.890 | 1.00 | 46.94 | O |
| ANISOU | 2533 | O | ASN | H | 74 | 6719 | 5861 | 5253 | −98 | −965 | −1130 | O |
| ATOM | 2534 | CB | ASN | H | 74 | 18.707 | 14.996 | 51.862 | 1.00 | 44.45 | C |
| ANISOU | 2534 | CB | ASN | H | 74 | 6357 | 5508 | 5024 | 8 | −621 | −1136 | C |
| ATOM | 2535 | CG | ASN | H | 74 | 17.728 | 14.052 | 51.179 | 1.00 | 49.54 | C |
| ANISOU | 2535 | CG | ASN | H | 74 | 6913 | 6175 | 5734 | 52 | −499 | −1087 | C |
| ATOM | 2536 | OD1 | ASN | H | 74 | 17.823 | 12.832 | 51.358 | 1.00 | 41.16 | O |
| ANISOU | 2536 | OD1 | ASN | H | 74 | 5835 | 5157 | 4649 | 67 | −484 | −1033 | O |
| ATOM | 2537 | ND2 | ASN | H | 74 | 16.784 | 14.603 | 50.399 | 1.00 | 40.17 | N |
| ANISOU | 2537 | ND2 | ASN | H | 74 | 5671 | 4956 | 4638 | 71 | −418 | −1106 | N |
| ATOM | 2538 | N | SER | H | 75 | 20.449 | 15.863 | 54.616 | 1.00 | 43.31 | N |
| ANISOU | 2538 | N | SER | H | 75 | 6523 | 5344 | 4588 | −54 | −870 | −1232 | N |
| ATOM | 2539 | CA | SER | H | 75 | 21.582 | 16.608 | 55.157 | 1.00 | 45.23 | C |
| ANISOU | 2539 | CA | SER | H | 75 | 6826 | 5570 | 4788 | −113 | −1037 | −1277 | C |
| ATOM | 2540 | C | SER | H | 75 | 22.647 | 15.690 | 55.736 | 1.00 | 48.55 | C |
| ANISOU | 2540 | C | SER | H | 75 | 7252 | 6049 | 5145 | −128 | −1168 | −1222 | C |
| ATOM | 2541 | O | SER | H | 75 | 23.765 | 16.149 | 55.986 | 1.00 | 46.99 | O |
| ANISOU | 2541 | O | SER | H | 75 | 7056 | 5848 | 4950 | −184 | −1331 | −1241 | O |
| ATOM | 2542 | CB | SER | H | 75 | 21.124 | 17.594 | 56.232 | 1.00 | 49.14 | C |
| ANISOU | 2542 | CB | SER | H | 75 | 7513 | 6004 | 5154 | −109 | −1023 | −1377 | C |
| ATOM | 2543 | OG | SER | H | 75 | 20.935 | 16.939 | 57.470 | 1.00 | 56.12 | O |
| ANISOU | 2543 | OG | SER | H | 75 | 8550 | 6913 | 5862 | −74 | −1010 | −1377 | O |
| ATOM | 2544 | N | LYS | H | 76 | 22.332 | 14.412 | 55.940 | 1.00 | 44.21 | N |
| ANISOU | 2544 | N | LYS | H | 76 | 6698 | 5548 | 4550 | −79 | −1104 | −1153 | N |
| ATOM | 2545 | CA | LYS | H | 76 | 23.279 | 13.447 | 56.479 | 1.00 | 50.60 | C |
| ANISOU | 2545 | CA | LYS | H | 76 | 7511 | 6409 | 5304 | −81 | −1221 | −1090 | C |
| ATOM | 2546 | C | LYS | H | 76 | 23.567 | 12.302 | 55.525 | 1.00 | 47.81 | C |
| ANISOU | 2546 | C | LYS | H | 76 | 6987 | 6103 | 5074 | −63 | −1197 | −994 | C |
| ATOM | 2547 | O | LYS | H | 76 | 24.310 | 11.385 | 55.892 | 1.00 | 44.58 | O |
| ANISOU | 2547 | O | LYS | H | 76 | 6566 | 5735 | 4637 | −54 | −1282 | −931 | O |
| ATOM | 2548 | CB | LYS | H | 76 | 22.766 | 12.882 | 57.809 | 1.00 | 54.11 | C |
| ANISOU | 2548 | CB | LYS | H | 76 | 8141 | 6863 | 5556 | −35 | −1180 | −1088 | C |
| ATOM | 2549 | CG | LYS | H | 76 | 22.694 | 13.914 | 58.925 | 1.00 | 63.81 | C |
| ANISOU | 2549 | CG | LYS | H | 76 | 9566 | 8048 | 6630 | −51 | −1229 | −1185 | C |
| ATOM | 2550 | CD | LYS | H | 76 | 22.278 | 13.281 | 60.247 | 1.00 | 68.54 | C |
| ANISOU | 2550 | CD | LYS | H | 76 | 10360 | 8660 | 7021 | −4 | −1188 | −1174 | C |
| ATOM | 2551 | CE | LYS | H | 76 | 22.501 | 14.239 | 61.409 | 1.00 | 76.13 | C |
| ANISOU | 2551 | CE | LYS | H | 76 | 11531 | 9585 | 7810 | −26 | −1280 | −1270 | C |
| ATOM | 2552 | NZ | LYS | H | 76 | 22.385 | 13.553 | 62.727 | 1.00 | 78.18 | N |
| ANISOU | 2552 | NZ | LYS | H | 76 | 11990 | 9867 | 7849 | 14 | −1281 | −1247 | N |
| ATOM | 2553 | N | ASN | H | 77 | 22.999 | 12.320 | 54.320 | 1.00 | 48.86 | N |
| ANISOU | 2553 | N | ASN | H | 77 | 6997 | 6229 | 5340 | −56 | −1089 | −983 | N |
| ATOM | 2554 | CA | ASN | H | 77 | 23.163 | 11.233 | 53.354 | 1.00 | 44.99 | C |
| ANISOU | 2554 | CA | ASN | H | 77 | 6359 | 5777 | 4960 | −37 | −1051 | −903 | C |
| ATOM | 2555 | C | ASN | H | 77 | 22.851 | 9.879 | 53.984 | 1.00 | 43.15 | C |
| ANISOU | 2555 | C | ASN | H | 77 | 6175 | 5571 | 4648 | 14 | −1001 | −841 | C |
| ATOM | 2556 | O | ASN | H | 77 | 23.582 | 8.904 | 53.796 | 1.00 | 45.94 | O |
| ANISOU | 2556 | O | ASN | H | 77 | 6455 | 5958 | 5042 | 24 | −1053 | −771 | O |
| ATOM | 2557 | CB | ASN | H | 77 | 24.566 | 11.251 | 52.744 | 1.00 | 47.36 | C |
| ANISOU | 2557 | CB | ASN | H | 77 | 6529 | 6099 | 5366 | −79 | −1184 | −869 | C |
| ATOM | 2558 | CG | ASN | H | 77 | 24.702 | 12.289 | 51.653 | 1.00 | 55.78 | C |
| ANISOU | 2558 | CG | ASN | H | 77 | 7499 | 7138 | 6556 | −121 | −1179 | −901 | C |
| ATOM | 2559 | OD1 | ASN | H | 77 | 23.812 | 13.112 | 51.457 | 1.00 | 54.85 | O |
| ANISOU | 2559 | OD1 | ASN | H | 77 | 7424 | 6980 | 6436 | −121 | −1100 | −955 | O |
| ATOM | 2560 | ND2 | ASN | H | 77 | 25.808 | 12.248 | 50.927 | 1.00 | 68.89 | N |
| ANISOU | 2560 | ND2 | ASN | H | 77 | 9028 | 8817 | 8330 | −155 | −1257 | −863 | N |
| ATOM | 2561 | N | THR | H | 78 | 21.761 | 9.817 | 54.744 | 1.00 | 44.13 | N |
| ANISOU | 2561 | N | THR | H | 78 | 6426 | 5676 | 4664 | 48 | −891 | −864 | N |
| ATOM | 2562 | CA | THR | H | 78 | 21.425 | 8.623 | 55.505 | 1.00 | 43.04 | C |
| ANISOU | 2562 | CA | THR | H | 78 | 6364 | 5556 | 4435 | 92 | −837 | −805 | C |
| ATOM | 2563 | C | THR | H | 78 | 19.985 | 8.214 | 55.230 | 1.00 | 48.36 | C |
| ANISOU | 2563 | C | THR | H | 78 | 7031 | 6210 | 5135 | 128 | −645 | −801 | C |
| ATOM | 2564 | O | THR | H | 78 | 19.066 | 9.040 | 55.292 | 1.00 | 40.80 | O |
| ANISOU | 2564 | O | THR | H | 78 | 6119 | 5218 | 4165 | 132 | −554 | −864 | O |
| ATOM | 2565 | CB | THR | H | 78 | 21.640 | 8.843 | 57.012 | 1.00 | 46.89 | C |
| ANISOU | 2565 | CB | THR | H | 78 | 7044 | 6040 | 4732 | 98 | −902 | −826 | C |
| ATOM | 2566 | OG1 | THR | H | 78 | 22.995 | 9.241 | 57.243 | 1.00 | 43.74 | O |
| ANISOU | 2566 | OG1 | THR | H | 78 | 6638 | 5659 | 4323 | 58 | −1100 | −832 | O |
| ATOM | 2567 | CG2 | THR | H | 78 | 21.371 | 7.566 | 57.793 | 1.00 | 44.23 | C |
| ANISOU | 2567 | CG2 | THR | H | 78 | 6790 | 5720 | 4296 | 145 | −848 | −750 | C |
| ATOM | 2568 | N | LEU | H | 79 | 19.806 | 6.940 | 54.913 | 1.00 | 37.54 | N |
| ANISOU | 2568 | N | LEU | H | 79 | 5597 | 4854 | 3812 | 154 | −587 | −728 | N |

TABLE 11-continued

| | | | | | | | | | | | |
|---|---|---|---|---|---|---|---|---|---|---|---|
| ATOM | 2569 | CA | LEU | H | 79 | 18.503 | 6.316 | 54.777 | 1.00 | 36.84 | C |
| ANISOU | 2569 | CA | LEU | H | 79 | 5501 | 4745 | 3750 | 185 | −415 | −711 | C |
| ATOM | 2570 | C | LEU | H | 79 | 18.141 | 5.625 | 56.084 | 1.00 | 44.06 | C |
| ANISOU | 2570 | C | LEU | H | 79 | 6566 | 5655 | 4518 | 217 | −355 | −672 | C |
| ATOM | 2571 | O | LEU | H | 79 | 19.009 | 5.091 | 56.774 | 1.00 | 42.47 | O |
| ANISOU | 2571 | O | LEU | H | 79 | 6431 | 5475 | 4230 | 224 | −453 | −624 | O |
| ATOM | 2572 | CB | LEU | H | 79 | 18.539 | 5.293 | 53.639 | 1.00 | 36.37 | C |
| ANISOU | 2572 | CB | LEU | H | 79 | 5289 | 4696 | 3832 | 189 | −389 | −656 | C |
| ATOM | 2573 | CG | LEU | H | 79 | 17.361 | 4.353 | 53.436 | 1.00 | 39.70 | C |
| ANISOU | 2573 | CG | LEU | H | 79 | 5683 | 5097 | 4303 | 213 | −235 | −624 | C |
| ATOM | 2574 | CD1 | LEU | H | 79 | 16.157 | 5.139 | 52.919 | 1.00 | 34.69 | C |
| ANISOU | 2574 | CD1 | LEU | H | 79 | 5009 | 4437 | 3735 | 209 | −129 | −685 | C |
| ATOM | 2575 | CD2 | LEU | H | 79 | 17.748 | 3.227 | 52.469 | 1.00 | 36.29 | C |
| ANISOU | 2575 | CD2 | LEU | H | 79 | 5127 | 4674 | 3987 | 214 | −250 | −568 | C |
| ATOM | 2576 | N | TYR | H | 80 | 16.853 | 5.630 | 56.420 | 1.00 | 39.80 | N |
| ANISOU | 2576 | N | TYR | H | 80 | 6080 | 5088 | 3955 | 240 | −190 | −688 | N |
| ATOM | 2577 | CA | TYR | H | 80 | 16.390 | 4.912 | 57.598 | 1.00 | 41.02 | C |
| ANISOU | 2577 | CA | TYR | H | 80 | 6377 | 5233 | 3977 | 271 | −101 | −642 | C |
| ATOM | 2578 | C | TYR | H | 80 | 15.258 | 3.964 | 57.234 | 1.00 | 43.04 | C |
| ANISOU | 2578 | C | TYR | H | 80 | 6562 | 5466 | 4326 | 289 | 70 | −596 | C |
| ATOM | 2579 | O | TYR | H | 80 | 14.546 | 4.155 | 56.245 | 1.00 | 42.33 | O |
| ANISOU | 2579 | O | TYR | H | 80 | 6341 | 5361 | 4381 | 279 | 138 | −625 | O |
| ATOM | 2580 | CB | TYR | H | 80 | 15.915 | 5.864 | 58.707 | 1.00 | 44.29 | C |
| ANISOU | 2580 | CB | TYR | H | 80 | 6966 | 5627 | 4236 | 284 | −48 | −706 | C |
| ATOM | 2581 | CG | TYR | H | 80 | 16.947 | 6.887 | 59.098 | 1.00 | 46.78 | C |
| ANISOU | 2581 | CG | TYR | H | 80 | 7359 | 5954 | 4460 | 259 | −218 | −765 | C |
| ATOM | 2582 | CD1 | TYR | H | 80 | 17.969 | 6.568 | 59.984 | 1.00 | 44.10 | C |
| ANISOU | 2582 | CD1 | TYR | H | 80 | 7135 | 5640 | 3981 | 259 | −356 | −730 | C |
| ATOM | 2583 | CD2 | TYR | H | 80 | 16.906 | 8.172 | 58.573 | 1.00 | 44.85 | C |
| ANISOU | 2583 | CD2 | TYR | H | 80 | 7071 | 5692 | 4277 | 234 | −248 | −853 | C |
| ATOM | 2584 | CE1 | TYR | H | 80 | 18.925 | 7.506 | 60.341 | 1.00 | 48.88 | C |
| ANISOU | 2584 | CE1 | TYR | H | 80 | 7805 | 6254 | 4514 | 229 | −527 | −788 | C |
| ATOM | 2585 | CE2 | TYR | H | 80 | 17.851 | 9.116 | 58.926 | 1.00 | 48.22 | C |
| ANISOU | 2585 | CE2 | TYR | H | 80 | 7567 | 6121 | 4633 | 204 | −406 | −910 | C |
| ATOM | 2586 | CZ | TYR | H | 80 | 18.855 | 8.779 | 59.813 | 1.00 | 54.74 | C |
| ANISOU | 2586 | CZ | TYR | H | 80 | 8502 | 6974 | 5325 | 198 | −547 | −880 | C |
| ATOM | 2587 | OH | TYR | H | 80 | 19.797 | 9.719 | 60.156 | 1.00 | 56.08 | O |
| ANISOU | 2587 | OH | TYR | H | 80 | 8732 | 7142 | 5435 | 160 | −716 | −940 | O |
| ATOM | 2588 | N | LEU | H | 81 | 15.109 | 2.924 | 58.054 | 1.00 | 41.73 | N |
| ANISOU | 2588 | N | LEU | H | 81 | 6486 | 5292 | 4077 | 313 | 132 | −521 | N |
| ATOM | 2589 | CA | LEU | H | 81 | 13.911 | 2.092 | 58.064 | 1.00 | 42.39 | C |
| ANISOU | 2589 | CA | LEU | H | 81 | 6544 | 5342 | 4219 | 327 | 318 | −478 | C |
| ATOM | 2590 | C | LEU | H | 81 | 13.493 | 1.914 | 59.515 | 1.00 | 44.60 | C |
| ANISOU | 2590 | C | LEU | H | 81 | 7020 | 5607 | 4319 | 356 | 420 | −448 | C |
| ATOM | 2591 | O | LEU | H | 81 | 14.208 | 1.275 | 60.294 | 1.00 | 45.72 | O |
| ANISOU | 2591 | O | LEU | H | 81 | 7275 | 5761 | 4336 | 371 | 354 | −382 | O |
| ATOM | 2592 | CB | LEU | H | 81 | 14.150 | 0.737 | 57.394 | 1.00 | 40.49 | C |
| ANISOU | 2592 | CB | LEU | H | 81 | 6195 | 5097 | 4093 | 323 | 306 | −399 | C |
| ATOM | 2593 | CG | LEU | H | 81 | 12.929 | −0.192 | 57.296 | 1.00 | 42.19 | C |
| ANISOU | 2593 | CG | LEU | H | 81 | 6364 | 5269 | 4397 | 326 | 489 | −355 | C |
| ATOM | 2594 | CD1 | LEU | H | 81 | 11.840 | 0.415 | 56.401 | 1.00 | 45.36 | C |
| ANISOU | 2594 | CD1 | LEU | H | 81 | 6635 | 5654 | 4947 | 309 | 580 | −422 | C |
| ATOM | 2595 | CD2 | LEU | H | 81 | 13.301 | −1.602 | 56.795 | 1.00 | 39.00 | C |
| ANISOU | 2595 | CD2 | LEU | H | 81 | 5884 | 4849 | 4083 | 323 | 465 | −275 | C |
| ATOM | 2596 | N | GLN | H | 82 | 12.348 | 2.493 | 59.876 | 1.00 | 45.13 | N |
| ANISOU | 2596 | N | GLN | H | 82 | 7130 | 5647 | 4371 | 368 | 583 | −493 | N |
| ATOM | 2597 | CA | GLN | H | 82 | 11.782 | 2.358 | 61.210 | 1.00 | 41.28 | C |
| ANISOU | 2597 | CA | GLN | H | 82 | 6830 | 5139 | 3716 | 398 | 720 | −467 | C |
| ATOM | 2598 | C | GLN | H | 82 | 10.858 | 1.145 | 61.207 | 1.00 | 45.78 | C |
| ANISOU | 2598 | C | GLN | H | 82 | 7351 | 5675 | 4370 | 404 | 895 | −383 | C |
| ATOM | 2599 | O | GLN | H | 82 | 9.829 | 1.140 | 60.525 | 1.00 | 53.22 | O |
| ANISOU | 2599 | O | GLN | H | 82 | 8154 | 6590 | 5477 | 394 | 1020 | −402 | O |
| ATOM | 2600 | CB | GLN | H | 82 | 11.033 | 3.631 | 61.607 | 1.00 | 48.19 | C |
| ANISOU | 2600 | CB | GLN | H | 82 | 7775 | 5996 | 4540 | 413 | 819 | −563 | C |
| ATOM | 2601 | CG | GLN | H | 82 | 10.333 | 3.542 | 62.953 | 1.00 | 53.12 | C |
| ANISOU | 2601 | CG | GLN | H | 82 | 8596 | 6595 | 4993 | 449 | 994 | −543 | C |
| ATOM | 2602 | CD | GLN | H | 82 | 11.300 | 3.283 | 64.087 | 1.00 | 58.93 | C |
| ANISOU | 2602 | CD | GLN | H | 82 | 9547 | 7354 | 5489 | 463 | 887 | −503 | C |
| ATOM | 2603 | OE1 | GLN | H | 82 | 12.290 | 4.001 | 64.256 | 1.00 | 58.49 | O |
| ANISOU | 2603 | OE1 | GLN | H | 82 | 9562 | 7325 | 5337 | 452 | 703 | −556 | O |
| ATOM | 2604 | NE2 | GLN | H | 82 | 11.022 | 2.246 | 64.873 | 1.00 | 58.26 | N |
| ANISOU | 2604 | NE2 | GLN | H | 82 | 9568 | 7255 | 5311 | 484 | 997 | −406 | N |
| ATOM | 2605 | N | MET | H | 83 | 11.220 | 0.117 | 61.962 | 1.00 | 45.24 | N |
| ANISOU | 2605 | N | MET | H | 83 | 7392 | 5602 | 4195 | 418 | 900 | −287 | N |
| ATOM | 2606 | CA | MET | H | 83 | 10.494 | −1.144 | 61.960 | 1.00 | 50.22 | C |
| ANISOU | 2606 | CA | MET | H | 83 | 7979 | 6193 | 4909 | 418 | 1050 | −195 | C |
| ATOM | 2607 | C | MET | H | 83 | 9.785 | −1.292 | 63.296 | 1.00 | 51.99 | C |
| ANISOU | 2607 | C | MET | H | 83 | 8394 | 6390 | 4971 | 447 | 1235 | −153 | C |
| ATOM | 2608 | O | MET | H | 83 | 10.440 | −1.364 | 64.338 | 1.00 | 53.54 | O |
| ANISOU | 2608 | O | MET | H | 83 | 8788 | 6602 | 4954 | 472 | 1178 | −115 | O |

TABLE 11-continued

| | | | | | | | | | | | |
|---|---|---|---|---|---|---|---|---|---|---|---|
| ATOM | 2609 | CB | MET | H | 83 | 11.444 | −2.317 | 61.714 | 1.00 | 50.64 | | C |
| ANISOU | 2609 | CB | MET | H | 83 | 8005 | 6251 | 4986 | 414 | 926 | −106 | C |
| ATOM | 2610 | CG | MET | H | 83 | 12.426 | −2.075 | 60.574 | 1.00 | 57.96 | | C |
| ANISOU | 2610 | CG | MET | H | 83 | 8785 | 7212 | 6024 | 393 | 725 | −148 | C |
| ATOM | 2611 | SD | MET | H | 83 | 13.708 | −3.353 | 60.444 | 1.00 | 56.65 | | S |
| ANISOU | 2611 | SD | MET | H | 83 | 8608 | 7051 | 5865 | 404 | 570 | −46 | S |
| ATOM | 2612 | CE | MET | H | 83 | 12.711 | −4.798 | 60.102 | 1.00 | 53.14 | | C |
| ANISOU | 2612 | CE | MET | H | 83 | 8081 | 6537 | 5571 | 394 | 749 | 37 | C |
| ATOM | 2613 | N | ASN | H | 84 | 8.456 | −1.325 | 63.264 | 1.00 | 53.66 | | N |
| ANISOU | 2613 | N | ASN | H | 84 | 8546 | 6560 | 5282 | 445 | 1453 | −157 | N |
| ATOM | 2614 | CA | ASN | H | 84 | 7.639 | −1.514 | 64.450 | 1.00 | 54.77 | | C |
| ANISOU | 2614 | CA | ASN | H | 84 | 8848 | 6668 | 5294 | 473 | 1669 | −112 | C |
| ATOM | 2615 | C | ASN | H | 84 | 6.830 | −2.790 | 64.299 | 1.00 | 64.00 | | C |
| ANISOU | 2615 | C | ASN | H | 84 | 9928 | 7784 | 6604 | 455 | 1834 | −13 | C |
| ATOM | 2616 | O | ASN | H | 84 | 6.687 | −3.332 | 63.196 | 1.00 | 63.60 | | O |
| ANISOU | 2616 | O | ASN | H | 84 | 9676 | 7719 | 6771 | 420 | 1796 | −6 | O |
| ATOM | 2617 | CB | ASN | H | 84 | 6.687 | −0.331 | 64.682 | 1.00 | 59.01 | | C |
| ANISOU | 2617 | CB | ASN | H | 84 | 9399 | 7195 | 5828 | 491 | 1816 | −207 | C |
| ATOM | 2618 | CG | ASN | H | 84 | 7.422 | 0.973 | 64.912 | 1.00 | 59.87 | | C |
| ANISOU | 2618 | CG | ASN | H | 84 | 9612 | 7341 | 5793 | 506 | 1667 | −310 | C |
| ATOM | 2619 | OD1 | ASN | H | 84 | 8.512 | 0.987 | 65.472 | 1.00 | 65.04 | | O |
| ANISOU | 2619 | OD1 | ASN | H | 84 | 10418 | 8028 | 6266 | 514 | 1508 | −297 | O |
| ATOM | 2620 | ND2 | ASN | H | 84 | 6.827 | 2.078 | 64.477 | 1.00 | 58.39 | | N |
| ANISOU | 2620 | ND2 | ASN | H | 84 | 9344 | 7147 | 5696 | 510 | 1713 | −412 | N |
| ATOM | 2621 | N | SER | H | 85 | 6.302 | −3.267 | 65.427 | 1.00 | 62.04 | | N |
| ANISOU | 2621 | N | SER | H | 85 | 9842 | 7504 | 6229 | 477 | 2019 | 63 | N |
| ATOM | 2622 | CA | SER | H | 85 | 5.370 | −4.390 | 65.430 | 1.00 | 65.75 | | C |
| ANISOU | 2622 | CA | SER | H | 85 | 10240 | 7911 | 6832 | 457 | 2216 | 158 | C |
| ATOM | 2623 | C | SER | H | 85 | 6.013 | −5.625 | 64.796 | 1.00 | 64.35 | | C |
| ANISOU | 2623 | C | SER | H | 85 | 9972 | 7717 | 6760 | 429 | 2093 | 239 | C |
| ATOM | 2624 | O | SER | H | 85 | 5.406 | −6.323 | 63.978 | 1.00 | 60.58 | | O |
| ANISOU | 2624 | O | SER | H | 85 | 9311 | 7196 | 6510 | 390 | 2154 | 260 | O |
| ATOM | 2625 | CB | SER | H | 85 | 4.070 | −4.006 | 64.719 | 1.00 | 68.32 | | C |
| ANISOU | 2625 | CB | SER | H | 85 | 10360 | 8206 | 7391 | 433 | 2373 | 98 | C |
| ATOM | 2626 | OG | SER | H | 85 | 2.996 | −4.840 | 65.100 | 1.00 | 78.96 | | O |
| ANISOU | 2626 | OG | SER | H | 85 | 11685 | 9490 | 8826 | 420 | 2617 | 182 | O |
| ATOM | 2627 | N | LEU | H | 86 | 7.259 | −5.891 | 65.176 | 1.00 | 58.86 | | N |
| ANISOU | 2627 | N | LEU | H | 86 | 9409 | 7052 | 5903 | 451 | 1912 | 281 | N |
| ATOM | 2628 | CA | LEU | H | 86 | 8.059 | −6.897 | 64.493 | 1.00 | 58.68 | | C |
| ANISOU | 2628 | CA | LEU | H | 86 | 9296 | 7019 | 5979 | 435 | 1762 | 340 | C |
| ATOM | 2629 | C | LEU | H | 86 | 7.531 | −8.304 | 64.743 | 1.00 | 63.31 | | C |
| ANISOU | 2629 | C | LEU | H | 86 | 9888 | 7530 | 6638 | 422 | 1913 | 467 | C |
| ATOM | 2630 | O | LEU | H | 86 | 7.199 | −8.673 | 65.873 | 1.00 | 67.22 | | O |
| ANISOU | 2630 | O | LEU | H | 86 | 10560 | 7996 | 6986 | 444 | 2059 | 552 | O |
| ATOM | 2631 | CB | LEU | H | 86 | 9.514 | −6.793 | 64.943 | 1.00 | 61.99 | | C |
| ANISOU | 2631 | CB | LEU | H | 86 | 9856 | 7489 | 6208 | 468 | 1536 | 359 | C |
| ATOM | 2632 | CG | LEU | H | 86 | 10.268 | −5.624 | 64.313 | 1.00 | 57.71 | | C |
| ANISOU | 2632 | CG | LEU | H | 86 | 9246 | 7014 | 5668 | 465 | 1337 | 239 | C |
| ATOM | 2633 | CD1 | LEU | H | 86 | 11.582 | −5.383 | 65.020 | 1.00 | 57.64 | | C |
| ANISOU | 2633 | CD1 | LEU | H | 86 | 9401 | 7052 | 5447 | 497 | 1137 | 256 | C |
| ATOM | 2634 | CD2 | LEU | H | 86 | 10.490 | −5.909 | 62.837 | 1.00 | 60.78 | | C |
| ANISOU | 2634 | CD2 | LEU | H | 86 | 9395 | 7401 | 6297 | 430 | 1237 | 205 | C |
| ATOM | 2635 | N | ARG | H | 87 | 7.467 | −9.091 | 63.674 | 1.00 | 63.80 | | N |
| ANISOU | 2635 | N | ARG | H | 87 | 9761 | 7554 | 6924 | 384 | 1878 | 478 | N |
| ATOM | 2636 | CA | ARG | H | 87 | 7.032 | −10.478 | 63.706 | 1.00 | 69.95 | | C |
| ANISOU | 2636 | CA | ARG | H | 87 | 10516 | 8250 | 7813 | 362 | 1996 | 590 | C |
| ATOM | 2637 | C | ARG | H | 87 | 8.199 | −11.386 | 63.336 | 1.00 | 67.79 | | C |
| ANISOU | 2637 | C | ARG | H | 87 | 10238 | 7966 | 7554 | 374 | 1813 | 649 | C |
| ATOM | 2638 | O | ARG | H | 87 | 9.244 | −10.935 | 62.856 | 1.00 | 69.82 | | O |
| ANISOU | 2638 | O | ARG | H | 87 | 10467 | 8282 | 7781 | 391 | 1602 | 594 | O |
| ATOM | 2639 | CB | ARG | H | 87 | 5.861 | −10.709 | 62.740 | 1.00 | 74.35 | | C |
| ANISOU | 2639 | CB | ARG | H | 87 | 10850 | 8757 | 8644 | 303 | 2120 | 549 | C |
| ATOM | 2640 | CG | ARG | H | 87 | 4.765 | −9.655 | 62.765 | 1.00 | 76.29 | | C |
| ANISOU | 2640 | CG | ARG | H | 87 | 11034 | 9020 | 8932 | 293 | 2261 | 464 | C |
| ATOM | 2641 | CD | ARG | H | 87 | 3.953 | −9.729 | 61.476 | 1.00 | 83.37 | | C |
| ANISOU | 2641 | CD | ARG | H | 87 | 11674 | 9889 | 10114 | 238 | 2278 | 398 | C |
| ATOM | 2642 | NE | ARG | H | 87 | 2.857 | −8.765 | 61.415 | 1.00 | 88.43 | | N |
| ANISOU | 2642 | NE | ARG | H | 87 | 12230 | 10541 | 10830 | 231 | 2408 | 322 | N |
| ATOM | 2643 | CZ | ARG | H | 87 | 2.121 | −8.549 | 60.328 | 1.00 | 95.62 | | C |
| ANISOU | 2643 | CZ | ARG | H | 87 | 12920 | 11440 | 11970 | 191 | 2405 | 250 | C |
| ATOM | 2644 | NH1 | ARG | H | 87 | 2.373 | −9.224 | 59.212 | 1.00 | 96.88 | | N |
| ANISOU | 2644 | NH1 | ARG | H | 87 | 12938 | 11578 | 12292 | 150 | 2279 | 238 | N |
| ATOM | 2645 | NH2 | ARG | H | 87 | 1.139 | −7.658 | 60.349 | 1.00 | 99.16 | | N |
| ANISOU | 2645 | NH2 | ARG | H | 87 | 13295 | 11895 | 12485 | 194 | 2524 | 189 | N |
| ATOM | 2646 | N | ALA | H | 88 | 8.006 | −12.690 | 63.548 | 1.00 | 61.34 | | N |
| ANISOU | 2646 | N | ALA | H | 88 | 9444 | 7066 | 6796 | 364 | 1903 | 765 | N |
| ATOM | 2647 | CA | ALA | H | 88 | 9.045 | −13.647 | 63.176 | 1.00 | 59.13 | | C |
| ANISOU | 2647 | CA | ALA | H | 88 | 9153 | 6761 | 6554 | 380 | 1747 | 827 | C |
| ATOM | 2648 | C | ALA | H | 88 | 9.338 | −13.603 | 61.680 | 1.00 | 55.75 | | C |
| ANISOU | 2648 | C | ALA | H | 88 | 8507 | 6343 | 6332 | 350 | 1613 | 731 | C |

TABLE 11-continued

| | | | | | | | | | | | | |
|---|---|---|---|---|---|---|---|---|---|---|---|---|
| ATOM | 2649 | O | ALA | H | 88 | 10.488 | −13.802 | 61.265 | 1.00 | 50.37 | | O |
| ANISOU | 2649 | O | ALA | H | 88 | 7809 | 5686 | 5644 | 377 | 1427 | 731 | O |
| ATOM | 2650 | CB | ALA | H | 88 | 8.642 | −15.058 | 63.606 | 1.00 | 56.03 | | C |
| ANISOU | 2650 | CB | ALA | H | 88 | 8813 | 6260 | 6215 | 370 | 1889 | 965 | C |
| ATOM | 2651 | N | GLU | H | 89 | 8.319 | −13.322 | 60.861 | 1.00 | 54.42 | | N |
| ANISOU | 2651 | N | GLU | H | 89 | 8172 | 6160 | 6345 | 297 | 1703 | 649 | N |
| ATOM | 2652 | CA | GLU | H | 89 | 8.475 | −13.213 | 59.415 | 1.00 | 59.72 | | C |
| ANISOU | 2652 | CA | GLU | H | 89 | 8646 | 6842 | 7201 | 266 | 1586 | 552 | C |
| ATOM | 2653 | C | GLU | H | 89 | 9.411 | −12.086 | 58.997 | 1.00 | 59.41 | | C |
| ANISOU | 2653 | C | GLU | H | 89 | 8591 | 6903 | 7081 | 293 | 1396 | 459 | C |
| ATOM | 2654 | O | GLU | H | 89 | 9.810 | −12.041 | 57.828 | 1.00 | 58.89 | | O |
| ANISOU | 2654 | O | GLU | H | 89 | 8387 | 6850 | 7137 | 278 | 1277 | 391 | O |
| ATOM | 2655 | CB | GLU | H | 89 | 7.111 | −12.993 | 58.756 | 1.00 | 78.79 | | C |
| ANISOU | 2655 | CB | GLU | H | 89 | 10903 | 9228 | 9804 | 206 | 1718 | 485 | C |
| ATOM | 2656 | CG | GLU | H | 89 | 6.054 | −14.030 | 59.114 | 1.00 | 101.12 | | C |
| ANISOU | 2656 | CG | GLU | H | 89 | 13721 | 11954 | 12745 | 165 | 1920 | 569 | C |
| ATOM | 2657 | CD | GLU | H | 89 | 4.696 | −13.721 | 58.495 | 1.00 | 115.96 | | C |
| ANISOU | 2657 | CD | GLU | H | 89 | 15430 | 13810 | 14821 | 106 | 2040 | 499 | C |
| ATOM | 2658 | OE1 | GLU | H | 89 | 4.346 | −12.525 | 58.387 | 1.00 | 117.30 | | O |
| ANISOU | 2658 | OE1 | GLU | H | 89 | 15558 | 14046 | 14966 | 113 | 2038 | 413 | O |
| ATOM | 2659 | OE2 | GLU | H | 89 | 3.984 | −14.675 | 58.109 | 1.00 | 119.48 | | O |
| ANISOU | 2659 | OE2 | GLU | H | 89 | 15778 | 14167 | 15452 | 52 | 2129 | 530 | O |
| ATOM | 2660 | N | ASP | H | 90 | 9.764 | −11.175 | 59.905 | 1.00 | 53.75 | | N |
| ANISOU | 2660 | N | ASP | H | 90 | 8012 | 6249 | 6162 | 329 | 1367 | 452 | N |
| ATOM | 2661 | CA | ASP | H | 90 | 10.635 | −10.059 | 59.564 | 1.00 | 53.13 | | C |
| ANISOU | 2661 | CA | ASP | H | 90 | 7918 | 6257 | 6011 | 348 | 1191 | 364 | C |
| ATOM | 2662 | C | ASP | H | 90 | 12.120 | −10.369 | 59.740 | 1.00 | 50.32 | | C |
| ANISOU | 2662 | C | ASP | H | 90 | 7631 | 5929 | 5559 | 390 | 1002 | 411 | C |
| ATOM | 2663 | O | ASP | H | 90 | 12.956 | −9.563 | 59.313 | 1.00 | 47.46 | | O |
| ANISOU | 2663 | O | ASP | H | 90 | 7231 | 5632 | 5171 | 399 | 843 | 342 | O |
| ATOM | 2664 | CB | ASP | H | 90 | 10.265 | −8.828 | 60.402 | 1.00 | 54.09 | | C |
| ANISOU | 2664 | CB | ASP | H | 90 | 8149 | 6428 | 5974 | 362 | 1245 | 315 | C |
| ATOM | 2665 | CG | ASP | H | 90 | 8.852 | −8.332 | 60.124 | 1.00 | 55.54 | | C |
| ANISOU | 2665 | CG | ASP | H | 90 | 8239 | 6593 | 6272 | 328 | 1416 | 255 | C |
| ATOM | 2666 | OD1 | ASP | H | 90 | 8.449 | −8.276 | 58.938 | 1.00 | 50.11 | | O |
| ANISOU | 2666 | OD1 | ASP | H | 90 | 7368 | 5897 | 5777 | 292 | 1399 | 191 | O |
| ATOM | 2667 | OD2 | ASP | H | 90 | 8.145 | −8.004 | 61.098 | 1.00 | 54.68 | | O |
| ANISOU | 2667 | OD2 | ASP | H | 90 | 8242 | 6474 | 6058 | 340 | 1569 | 273 | O |
| ATOM | 2668 | N | THR | H | 91 | 12.468 | −11.500 | 60.362 | 1.00 | 47.03 | | N |
| ANISOU | 2668 | N | THR | H | 91 | 7311 | 5462 | 5098 | 416 | 1017 | 529 | N |
| ATOM | 2669 | CA | THR | H | 91 | 13.857 | −11.941 | 60.410 | 1.00 | 44.87 | | C |
| ANISOU | 2669 | CA | THR | H | 91 | 7072 | 5204 | 4773 | 460 | 836 | 582 | C |
| ATOM | 2670 | C | THR | H | 91 | 14.408 | −12.049 | 58.992 | 1.00 | 43.52 | | C |
| ANISOU | 2670 | C | THR | H | 91 | 6715 | 5039 | 4782 | 446 | 722 | 516 | C |
| ATOM | 2671 | O | THR | H | 91 | 13.828 | −12.736 | 58.145 | 1.00 | 45.16 | | O |
| ANISOU | 2671 | O | THR | H | 91 | 6804 | 5187 | 5166 | 413 | 798 | 505 | O |
| ATOM | 2672 | CB | THR | H | 91 | 13.959 | −13.291 | 61.127 | 1.00 | 50.39 | | C |
| ANISOU | 2672 | CB | THR | H | 91 | 7879 | 5827 | 5441 | 489 | 893 | 726 | C |
| ATOM | 2673 | OG1 | THR | H | 91 | 13.551 | −13.143 | 62.494 | 1.00 | 54.19 | | O |
| ANISOU | 2673 | OG1 | THR | H | 91 | 8557 | 6308 | 5725 | 507 | 992 | 792 | O |
| ATOM | 2674 | CG2 | THR | H | 91 | 15.395 | −13.826 | 61.078 | 1.00 | 46.74 | | C |
| ANISOU | 2674 | CG2 | THR | H | 91 | 7428 | 5372 | 4959 | 540 | 701 | 783 | C |
| ATOM | 2675 | N | ALA | H | 92 | 15.523 | −11.373 | 58.733 | 1.00 | 41.47 | | N |
| ANISOU | 2675 | N | ALA | H | 92 | 6430 | 4849 | 4478 | 467 | 542 | 472 | N |
| ATOM | 2676 | CA | ALA | H | 92 | 16.075 | −11.348 | 57.386 | 1.00 | 39.84 | | C |
| ANISOU | 2676 | CA | ALA | H | 92 | 6053 | 4655 | 4428 | 456 | 444 | 405 | C |
| ATOM | 2677 | C | ALA | H | 92 | 17.344 | −10.515 | 57.390 | 1.00 | 45.69 | | C |
| ANISOU | 2677 | C | ALA | H | 92 | 6794 | 5474 | 5091 | 481 | 255 | 372 | C |
| ATOM | 2678 | O | ALA | H | 92 | 17.602 | −9.741 | 58.314 | 1.00 | 44.98 | | O |
| ANISOU | 2678 | O | ALA | H | 92 | 6820 | 5434 | 4837 | 494 | 202 | 372 | O |
| ATOM | 2679 | CB | ALA | H | 92 | 15.094 | −10.757 | 56.361 | 1.00 | 38.03 | | C |
| ANISOU | 2679 | CB | ALA | H | 92 | 5693 | 4431 | 4328 | 402 | 523 | 297 | C |
| ATOM | 2680 | N | VAL | H | 93 | 18.126 | −10.683 | 56.331 | 1.00 | 42.51 | | N |
| ANISOU | 2680 | N | VAL | H | 93 | 6259 | 5080 | 4813 | 486 | 157 | 342 | N |
| ATOM | 2681 | CA | VAL | H | 93 | 19.186 | −9.740 | 56.011 | 1.00 | 42.16 | | C |
| ANISOU | 2681 | CA | VAL | H | 93 | 6163 | 5109 | 4746 | 493 | −3 | 287 | C |
| ATOM | 2682 | C | VAL | H | 93 | 18.555 | −8.580 | 55.255 | 1.00 | 40.08 | | C |
| ANISOU | 2682 | C | VAL | H | 93 | 5819 | 4884 | 4526 | 444 | 29 | 170 | C |
| ATOM | 2683 | O | VAL | H | 93 | 17.855 | −8.786 | 54.257 | 1.00 | 40.31 | | O |
| ANISOU | 2683 | O | VAL | H | 93 | 5745 | 4884 | 4687 | 415 | 110 | 123 | O |
| ATOM | 2684 | CB | VAL | H | 93 | 20.292 | −10.413 | 55.181 | 1.00 | 41.02 | | C |
| ANISOU | 2684 | CB | VAL | H | 93 | 5908 | 4953 | 4723 | 523 | −103 | 309 | C |
| ATOM | 2685 | CG1 | VAL | H | 93 | 21.342 | −9.373 | 54.756 | 1.00 | 40.84 | | C |
| ANISOU | 2685 | CG1 | VAL | H | 93 | 5812 | 5006 | 4700 | 521 | −253 | 249 | C |
| ATOM | 2686 | CG2 | VAL | H | 93 | 20.931 | −11.556 | 55.965 | 1.00 | 40.96 | | C |
| ANISOU | 2686 | CG2 | VAL | H | 93 | 5981 | 4903 | 4679 | 580 | −141 | 432 | C |
| ATOM | 2687 | N | TYR | H | 94 | 18.780 | −7.363 | 55.736 | 1.00 | 36.90 | | N |
| ANISOU | 2687 | N | TYR | H | 94 | 5469 | 4541 | 4011 | 435 | −38 | 122 | N |
| ATOM | 2688 | CA | TYR | H | 94 | 18.190 | −6.174 | 55.138 | 1.00 | 32.02 | | C |
| ANISOU | 2688 | CA | TYR | H | 94 | 4790 | 3954 | 3421 | 395 | −11 | 17 | C |

TABLE 11-continued

| | | | | | | | | | | |
|---|---|---|---|---|---|---|---|---|---|---|
| ATOM | 2689 | C | TYR | H | 94 | 19.256 | −5.410 | 54.373 | 1.00 | 33.81 | C |
| ANISOU | 2689 | C | TYR | H | 94 | 4921 | 4231 | 3693 | 388 | −156 | −36 | C |
| ATOM | 2690 | O | TYR | H | 94 | 20.299 | −5.062 | 54.930 | 1.00 | 37.56 | O |
| ANISOU | 2690 | O | TYR | H | 94 | 5441 | 4742 | 4087 | 404 | −288 | −17 | O |
| ATOM | 2691 | CB | TYR | H | 94 | 17.543 | −5.283 | 56.203 | 1.00 | 35.31 | C |
| ANISOU | 2691 | CB | TYR | H | 94 | 5340 | 4388 | 3687 | 388 | 41 | −8 | C |
| ATOM | 2692 | CG | TYR | H | 94 | 16.209 | −5.808 | 56.683 | 1.00 | 40.15 | C |
| ANISOU | 2692 | CG | TYR | H | 94 | 6011 | 4951 | 4293 | 383 | 227 | 22 | C |
| ATOM | 2693 | CD1 | TYR | H | 94 | 16.139 | −6.900 | 57.540 | 1.00 | 40.90 | C |
| ANISOU | 2693 | CD1 | TYR | H | 94 | 6209 | 5003 | 4327 | 410 | 285 | 125 | C |
| ATOM | 2694 | CD2 | TYR | H | 94 | 15.016 | −5.225 | 56.264 | 1.00 | 40.47 | C |
| ANISOU | 2694 | CD2 | TYR | H | 94 | 5997 | 4981 | 4398 | 352 | 347 | −47 | C |
| ATOM | 2695 | CE1 | TYR | H | 94 | 14.930 | −7.386 | 57.973 | 1.00 | 43.08 | C |
| ANISOU | 2695 | CE1 | TYR | H | 94 | 6532 | 5229 | 4607 | 400 | 466 | 157 | C |
| ATOM | 2696 | CE2 | TYR | H | 94 | 13.799 | −5.707 | 56.694 | 1.00 | 39.26 | C |
| ANISOU | 2696 | CE2 | TYR | H | 94 | 5879 | 4780 | 4259 | 345 | 523 | −17 | C |
| ATOM | 2697 | CZ | TYR | H | 94 | 13.764 | −6.789 | 57.553 | 1.00 | 41.03 | C |
| ANISOU | 2697 | CZ | TYR | H | 94 | 6206 | 4962 | 4422 | 367 | 586 | 85 | C |
| ATOM | 2698 | OH | TYR | H | 94 | 12.561 | −7.282 | 57.996 | 1.00 | 40.72 | O |
| ANISOU | 2698 | OH | TYR | H | 94 | 6199 | 4871 | 4404 | 356 | 773 | 122 | O |
| ATOM | 2699 | N | TYR | H | 95 | 18.985 | −5.169 | 53.094 | 1.00 | 34.32 | N |
| ANISOU | 2699 | N | TYR | H | 95 | 4856 | 4296 | 3889 | 361 | −132 | −100 | N |
| ATOM | 2700 | CA | TYR | H | 95 | 19.893 | −4.495 | 52.186 | 1.00 | 33.09 | C |
| ANISOU | 2700 | CA | TYR | H | 95 | 4598 | 4180 | 3796 | 350 | −240 | −148 | C |
| ATOM | 2701 | C | TYR | H | 95 | 19.383 | −3.101 | 51.873 | 1.00 | 34.15 | C |
| ANISOU | 2701 | C | TYR | H | 95 | 4716 | 4344 | 3917 | 314 | −232 | −237 | C |
| ATOM | 2702 | O | TYR | H | 95 | 18.196 | −2.913 | 51.599 | 1.00 | 35.07 | O |
| ANISOU | 2702 | O | TYR | H | 95 | 4821 | 4439 | 4065 | 295 | −124 | −276 | O |
| ATOM | 2703 | CB | TYR | H | 95 | 20.034 | −5.264 | 50.873 | 1.00 | 31.97 | C |
| ANISOU | 2703 | CB | TYR | H | 95 | 4330 | 4013 | 3805 | 352 | −219 | −153 | C |
| ATOM | 2704 | CG | TYR | H | 95 | 20.729 | −6.603 | 51.012 | 1.00 | 34.61 | C |
| ANISOU | 2704 | CG | TYR | H | 95 | 4663 | 4313 | 4176 | 394 | −239 | −71 | C |
| ATOM | 2705 | CD1 | TYR | H | 95 | 22.109 | −6.683 | 51.141 | 1.00 | 36.23 | C |
| ANISOU | 2705 | CD1 | TYR | H | 95 | 4843 | 4544 | 4379 | 425 | −363 | −31 | C |
| ATOM | 2706 | CD2 | TYR | H | 95 | 20.004 | −7.783 | 50.995 | 1.00 | 37.12 | C |
| ANISOU | 2706 | CD2 | TYR | H | 95 | 4995 | 4565 | 4542 | 402 | −135 | −31 | C |
| ATOM | 2707 | CE1 | TYR | H | 95 | 22.746 | −7.916 | 51.263 | 1.00 | 40.22 | C |
| ANISOU | 2707 | CE1 | TYR | H | 95 | 5342 | 5011 | 4929 | 473 | −381 | 48 | C |
| ATOM | 2708 | CE2 | TYR | H | 95 | 20.635 | −9.018 | 51.111 | 1.00 | 32.65 | C |
| ANISOU | 2708 | CE2 | TYR | H | 95 | 4431 | 3956 | 4017 | 444 | −150 | 46 | C |
| ATOM | 2709 | CZ | TYR | H | 95 | 21.997 | −9.070 | 51.245 | 1.00 | 36.29 | C |
| ANISOU | 2709 | CZ | TYR | H | 95 | 4871 | 4445 | 4474 | 483 | −272 | 85 | C |
| ATOM | 2710 | OH | TYR | H | 95 | 22.614 | −10.292 | 51.357 | 1.00 | 41.39 | O |
| ANISOU | 2710 | OH | TYR | H | 95 | 5515 | 5042 | 5170 | 533 | −287 | 164 | O |
| ATOM | 2711 | N | CYS | H | 96 | 20.310 | −2.149 | 51.903 | 1.00 | 33.13 | N |
| ANISOU | 2711 | N | CYS | H | 96 | 4577 | 4256 | 3753 | 305 | −352 | −265 | N |
| ATOM | 2712 | CA | CYS | H | 96 | 20.155 | −0.797 | 51.387 | 1.00 | 36.06 | C |
| ANISOU | 2712 | CA | CYS | H | 96 | 4911 | 4651 | 4137 | 270 | −372 | −347 | C |
| ATOM | 2713 | C | CYS | H | 96 | 20.493 | −0.806 | 49.897 | 1.00 | 37.82 | C |
| ANISOU | 2713 | C | CYS | H | 96 | 4994 | 4880 | 4497 | 257 | −386 | −372 | C |
| ATOM | 2714 | O | CYS | H | 96 | 21.459 | −1.453 | 49.490 | 1.00 | 38.62 | O |
| ANISOU | 2714 | O | CYS | H | 96 | 5033 | 4987 | 4655 | 274 | −442 | −334 | O |
| ATOM | 2715 | CB | CYS | H | 96 | 21.126 | 0.125 | 52.153 | 1.00 | 40.44 | C |
| ANISOU | 2715 | CB | CYS | H | 96 | 5527 | 5241 | 4599 | 262 | −504 | −358 | C |
| ATOM | 2716 | SG | CYS | H | 96 | 21.132 | 1.835 | 51.669 | 1.00 | 71.04 | S |
| ANISOU | 2716 | SG | CYS | H | 96 | 9372 | 9136 | 8486 | 219 | −547 | −451 | S |
| ATOM | 2717 | N | ALA | H | 97 | 19.719 | −0.086 | 49.080 | 1.00 | 32.92 | N |
| ANISOU | 2717 | N | ALA | H | 97 | 4325 | 4257 | 3928 | 232 | −333 | −435 | N |
| ATOM | 2718 | CA | ALA | H | 97 | 20.074 | 0.025 | 47.664 | 1.00 | 30.89 | C |
| ANISOU | 2718 | CA | ALA | H | 97 | 3953 | 4008 | 3778 | 220 | −351 | −460 | C |
| ATOM | 2719 | C | ALA | H | 97 | 19.649 | 1.376 | 47.115 | 1.00 | 35.58 | C |
| ANISOU | 2719 | C | ALA | H | 97 | 4524 | 4612 | 4382 | 190 | −353 | −526 | C |
| ATOM | 2720 | O | ALA | H | 97 | 18.804 | 2.062 | 47.689 | 1.00 | 39.64 | O |
| ANISOU | 2720 | O | ALA | H | 97 | 5099 | 5118 | 4845 | 182 | −313 | −558 | O |
| ATOM | 2721 | CB | ALA | H | 97 | 19.453 | −1.081 | 46.811 | 1.00 | 27.61 | C |
| ANISOU | 2721 | CB | ALA | H | 97 | 3481 | 3560 | 3449 | 228 | −270 | −451 | C |
| ATOM | 2722 | N | THR | H | 98 | 20.235 | 1.753 | 45.980 | 1.00 | 32.50 | N |
| ANISOU | 2722 | N | THR | H | 98 | 4050 | 4237 | 4062 | 176 | −391 | −544 | N |
| ATOM | 2723 | CA | THR | H | 98 | 19.942 | 3.061 | 45.401 | 1.00 | 29.68 | C |
| ANISOU | 2723 | CA | THR | H | 98 | 3674 | 3886 | 3719 | 149 | −400 | −598 | C |
| ATOM | 2724 | C | THR | H | 98 | 19.725 | 2.926 | 43.901 | 1.00 | 33.36 | C |
| ANISOU | 2724 | C | THR | H | 98 | 4056 | 4349 | 4271 | 143 | −370 | −614 | C |
| ATOM | 2725 | O | THR | H | 98 | 20.223 | 1.993 | 43.264 | 1.00 | 31.95 | O |
| ANISOU | 2725 | O | THR | H | 98 | 3829 | 4171 | 4141 | 157 | −365 | −589 | O |
| ATOM | 2726 | CB | THR | H | 98 | 21.063 | 4.074 | 45.673 | 1.00 | 43.27 | C |
| ANISOU | 2726 | CB | THR | H | 98 | 5397 | 5628 | 5414 | 127 | −499 | −604 | C |
| ATOM | 2727 | OG1 | THR | H | 98 | 20.580 | 5.398 | 45.408 | 1.00 | 41.07 | O |
| ANISOU | 2727 | OG1 | THR | H | 98 | 5130 | 5341 | 5135 | 102 | −497 | −656 | O |
| ATOM | 2728 | CG2 | THR | H | 98 | 22.283 | 3.795 | 44.802 | 1.00 | 41.34 | C |
| ANISOU | 2728 | CG2 | THR | H | 98 | 5062 | 5403 | 5242 | 124 | −548 | −576 | C |

TABLE 11-continued

| | | | | | | | | | | | | |
|---|---|---|---|---|---|---|---|---|---|---|---|---|
| ATOM | 2729 | N | GLY | H | 99 | 18.946 | 3.856 | 43.344 | 1.00 | 28.06 | | N |
| ANISOU | 2729 | N | GLY | H | 99 | 3376 | 3670 | 3616 | 128 | −349 | −657 | N |
| ATOM | 2730 | CA | GLY | H | 99 | 18.707 | 3.887 | 41.918 | 1.00 | 27.78 | | C |
| ANISOU | 2730 | CA | GLY | H | 99 | 3278 | 3633 | 3645 | 122 | −333 | −675 | C |
| ATOM | 2731 | C | GLY | H | 99 | 18.355 | 5.305 | 41.515 | 1.00 | 32.34 | | C |
| ANISOU | 2731 | C | GLY | H | 99 | 3856 | 4207 | 4224 | 104 | −350 | −710 | C |
| ATOM | 2732 | O | GLY | H | 99 | 18.249 | 6.192 | 42.361 | 1.00 | 31.62 | | O |
| ANISOU | 2732 | O | GLY | H | 99 | 3814 | 4110 | 4091 | 97 | −366 | −727 | O |
| ATOM | 2733 | N | LYS | H | 100 | 18.148 | 5.515 | 40.211 | 1.00 | 28.37 | | N |
| ANISOU | 2733 | N | LYS | H | 100 | 3309 | 3704 | 3766 | 99 | −346 | −723 | N |
| ATOM | 2734 | CA | LYS | H | 100 | 17.981 | 6.885 | 39.722 | 1.00 | 28.84 | | C |
| ANISOU | 2734 | CA | LYS | H | 100 | 3370 | 3758 | 3832 | 84 | −369 | −745 | C |
| ATOM | 2735 | C | LYS | H | 100 | 16.543 | 7.390 | 39.822 | 1.00 | 33.17 | | C |
| ANISOU | 2735 | C | LYS | H | 100 | 3933 | 4280 | 4391 | 94 | −335 | −777 | C |
| ATOM | 2736 | O | LYS | H | 100 | 16.291 | 8.571 | 39.555 | 1.00 | 34.87 | | O |
| ANISOU | 2736 | O | LYS | H | 100 | 4156 | 4480 | 4613 | 88 | −352 | −794 | O |
| ATOM | 2737 | CB | LYS | H | 100 | 18.470 | 6.987 | 38.282 | 1.00 | 36.29 | | C |
| ANISOU | 2737 | CB | LYS | H | 100 | 4272 | 4712 | 4806 | 77 | −381 | −736 | C |
| ATOM | 2738 | CG | LYS | H | 100 | 18.919 | 8.385 | 37.906 | 1.00 | 50.33 | | C |
| ANISOU | 2738 | CG | LYS | H | 100 | 6053 | 6484 | 6586 | 55 | −416 | −737 | C |
| ATOM | 2739 | CD | LYS | H | 100 | 19.944 | 8.897 | 38.919 | 1.00 | 65.37 | | C |
| ANISOU | 2739 | CD | LYS | H | 100 | 7973 | 8392 | 8471 | 34 | −459 | −728 | C |
| ATOM | 2740 | CE | LYS | H | 100 | 19.883 | 10.409 | 39.058 | 1.00 | 66.80 | | C |
| ANISOU | 2740 | CE | LYS | H | 100 | 8183 | 8547 | 8651 | 11 | −488 | −747 | C |
| ATOM | 2741 | NZ | LYS | H | 100 | 20.041 | 11.054 | 37.725 | 1.00 | 70.01 | | N |
| ANISOU | 2741 | NZ | LYS | H | 100 | 8564 | 8947 | 9091 | −1 | −486 | −733 | N |
| ATOM | 2742 | N | GLY | H | 101 | 15.601 | 6.523 | 40.172 | 1.00 | 29.59 | | N |
| ANISOU | 2742 | N | GLY | H | 101 | 3477 | 3816 | 3951 | 109 | −285 | −781 | N |
| ATOM | 2743 | CA | GLY | H | 101 | 14.231 | 6.922 | 40.459 | 1.00 | 26.76 | | C |
| ANISOU | 2743 | CA | GLY | H | 101 | 3119 | 3431 | 3617 | 121 | −242 | −808 | C |
| ATOM | 2744 | C | GLY | H | 101 | 13.546 | 5.761 | 41.143 | 1.00 | 31.73 | | C |
| ANISOU | 2744 | C | GLY | H | 101 | 3749 | 4050 | 4256 | 131 | −179 | −799 | C |
| ATOM | 2745 | O | GLY | H | 101 | 14.081 | 4.645 | 41.173 | 1.00 | 28.69 | | O |
| ANISOU | 2745 | O | GLY | H | 101 | 3361 | 3674 | 3865 | 129 | −176 | −773 | O |
| ATOM | 2746 | N | VAL | H | 102 | 12.392 | 6.048 | 41.756 | 1.00 | 27.90 | | N |
| ANISOU | 2746 | N | VAL | H | 102 | 3269 | 3541 | 3791 | 144 | −120 | −816 | N |
| ATOM | 2747 | CA | VAL | H | 102 | 11.711 | 4.999 | 42.524 | 1.00 | 28.52 | | C |
| ANISOU | 2747 | CA | VAL | H | 102 | 3352 | 3604 | 3881 | 149 | −44 | −802 | C |
| ATOM | 2748 | C | VAL | H | 102 | 11.395 | 3.799 | 41.630 | 1.00 | 34.65 | | C |
| ANISOU | 2748 | C | VAL | H | 102 | 4065 | 4374 | 4727 | 139 | −42 | −793 | C |
| ATOM | 2749 | O | VAL | H | 102 | 11.382 | 2.656 | 42.098 | 1.00 | 34.46 | | O |
| ANISOU | 2749 | O | VAL | H | 102 | 4049 | 4338 | 4705 | 136 | 0 | −767 | O |
| ATOM | 2750 | CB | VAL | H | 102 | 10.431 | 5.530 | 43.220 | 1.00 | 36.07 | | C |
| ANISOU | 2750 | CB | VAL | H | 102 | 4310 | 4532 | 4865 | 166 | 36 | −822 | C |
| ATOM | 2751 | CG1 | VAL | H | 102 | 10.756 | 6.632 | 44.244 | 1.00 | 36.06 | | C |
| ANISOU | 2751 | CG1 | VAL | H | 102 | 4393 | 4528 | 4782 | 179 | 43 | −839 | C |
| ATOM | 2752 | CG2 | VAL | H | 102 | 9.392 | 6.015 | 42.217 | 1.00 | 42.32 | | C |
| ANISOU | 2752 | CG2 | VAL | H | 102 | 5018 | 5307 | 5755 | 171 | 28 | −848 | C |
| ATOM | 2753 | N | HIS | H | 103 | 11.197 | 4.033 | 40.330 | 1.00 | 31.94 | | N |
| ANISOU | 2753 | N | HIS | H | 103 | 3668 | 4034 | 4433 | 132 | −92 | −812 | N |
| ATOM | 2754 | CA | HIS | H | 103 | 10.724 | 3.047 | 39.372 | 1.00 | 30.49 | | C |
| ANISOU | 2754 | CA | HIS | H | 103 | 3430 | 3838 | 4315 | 119 | −101 | −819 | C |
| ATOM | 2755 | C | HIS | H | 103 | 11.852 | 2.451 | 38.537 | 1.00 | 32.86 | | C |
| ANISOU | 2755 | C | HIS | H | 103 | 3742 | 4158 | 4587 | 113 | −149 | −810 | C |
| ATOM | 2756 | O | HIS | H | 103 | 11.577 | 1.756 | 37.552 | 1.00 | 31.28 | | O |
| ANISOU | 2756 | O | HIS | H | 103 | 3509 | 3946 | 4428 | 103 | −169 | −826 | O |
| ATOM | 2757 | CB | HIS | H | 103 | 9.713 | 3.711 | 38.437 | 1.00 | 32.48 | | C |
| ANISOU | 2757 | CB | HIS | H | 103 | 3626 | 4082 | 4633 | 120 | −133 | −849 | C |
| ATOM | 2758 | CG | HIS | H | 103 | 10.310 | 4.867 | 37.703 | 1.00 | 35.24 | | C |
| ANISOU | 2758 | CG | HIS | H | 103 | 3994 | 4453 | 4944 | 127 | −200 | −855 | C |
| ATOM | 2759 | ND1 | HIS | H | 103 | 10.550 | 6.081 | 38.311 | 1.00 | 29.32 | | N |
| ANISOU | 2759 | ND1 | HIS | H | 103 | 3278 | 3705 | 4156 | 139 | −197 | −854 | N |
| ATOM | 2760 | CD2 | HIS | H | 103 | 10.804 | 4.971 | 36.447 | 1.00 | 31.67 | | C |
| ANISOU | 2760 | CD2 | HIS | H | 103 | 3541 | 4017 | 4477 | 121 | −264 | −859 | C |
| ATOM | 2761 | CE1 | HIS | H | 103 | 11.128 | 6.896 | 37.450 | 1.00 | 32.02 | | C |
| ANISOU | 2761 | CE1 | HIS | H | 103 | 3631 | 4060 | 4475 | 138 | −258 | −854 | C |
| ATOM | 2762 | NE2 | HIS | H | 103 | 11.300 | 6.248 | 36.313 | 1.00 | 28.12 | | N |
| ANISOU | 2762 | NE2 | HIS | H | 103 | 3117 | 3577 | 3989 | 129 | −295 | −853 | N |
| ATOM | 2763 | N | LEU | H | 104 | 13.103 | 2.742 | 38.876 | 1.00 | 29.56 | | N |
| ANISOU | 2763 | N | LEU | H | 104 | 3364 | 3764 | 4103 | 118 | −171 | −789 | N |
| ATOM | 2764 | CA | LEU | H | 104 | 14.266 | 2.291 | 38.122 | 1.00 | 27.47 | | C |
| ANISOU | 2764 | CA | LEU | H | 104 | 3101 | 3517 | 3819 | 118 | −206 | −778 | C |
| ATOM | 2765 | C | LEU | H | 104 | 15.078 | 1.311 | 38.965 | 1.00 | 27.27 | | C |
| ANISOU | 2765 | C | LEU | H | 104 | 3100 | 3489 | 3771 | 127 | −183 | −742 | C |
| ATOM | 2766 | O | LEU | H | 104 | 14.905 | 1.205 | 40.184 | 1.00 | 30.54 | | O |
| ANISOU | 2766 | O | LEU | H | 104 | 3546 | 3897 | 4163 | 132 | −153 | −723 | O |
| ATOM | 2767 | CB | LEU | H | 104 | 15.118 | 3.497 | 37.684 | 1.00 | 26.76 | | C |
| ANISOU | 2767 | CB | LEU | H | 104 | 3021 | 3454 | 3692 | 116 | −254 | −776 | C |
| ATOM | 2768 | CG | LEU | H | 104 | 14.354 | 4.508 | 36.787 | 1.00 | 30.83 | | C |
| ANISOU | 2768 | CG | LEU | H | 104 | 3520 | 3966 | 4227 | 112 | −281 | −802 | C |

TABLE 11-continued

| | | | | | | | | | | | |
|---|---|---|---|---|---|---|---|---|---|---|---|
| ATOM | 2769 | CD1 | LEU | H | 104 | 15.227 | 5.729 | 36.415 | 1.00 | 26.43 | C |
| ANISOU | 2769 | CD1 | LEU | H | 104 | 2980 | 3427 | 3638 | 107 | −320 | −792 | C |
| ATOM | 2770 | CD2 | LEU | H | 104 | 13.888 | 3.849 | 35.523 | 1.00 | 34.63 | C |
| ANISOU | 2770 | CD2 | LEU | H | 104 | 3979 | 4441 | 4738 | 110 | −296 | −820 | C |
| ATOM | 2771 | N | GLY | H | 105 | 15.983 | 0.596 | 38.292 | 1.00 | 29.53 | N |
| ANISOU | 2771 | N | GLY | H | 105 | 3377 | 3781 | 4062 | 134 | −197 | −732 | N |
| ATOM | 2772 | CA | GLY | H | 105 | 16.688 | −0.494 | 38.933 | 1.00 | 31.03 | C |
| ANISOU | 2772 | CA | GLY | H | 105 | 3581 | 3960 | 4249 | 149 | −178 | −695 | C |
| ATOM | 2773 | C | GLY | H | 105 | 17.649 | −0.040 | 40.016 | 1.00 | 34.46 | C |
| ANISOU | 2773 | C | GLY | H | 105 | 4043 | 4419 | 4632 | 159 | −205 | −659 | C |
| ATOM | 2774 | O | GLY | H | 105 | 18.053 | 1.124 | 40.101 | 1.00 | 30.66 | O |
| ANISOU | 2774 | O | GLY | H | 105 | 3566 | 3964 | 4121 | 149 | −244 | −665 | O |
| ATOM | 2775 | N | PHE | H | 106 | 18.035 | −1.006 | 40.846 | 1.00 | 31.83 | N |
| ANISOU | 2775 | N | PHE | H | 106 | 3731 | 4071 | 4291 | 176 | −190 | −618 | N |
| ATOM | 2776 | CA | PHE | H | 106 | 18.859 | −0.775 | 42.031 | 1.00 | 32.08 | C |
| ANISOU | 2776 | CA | PHE | H | 106 | 3799 | 4121 | 4268 | 187 | −226 | −579 | C |
| ATOM | 2777 | C | PHE | H | 106 | 20.309 | −0.918 | 41.590 | 1.00 | 34.24 | C |
| ANISOU | 2777 | C | PHE | H | 106 | 4033 | 4415 | 4559 | 202 | −275 | −554 | C |
| ATOM | 2778 | O | PHE | H | 106 | 20.860 | −2.020 | 41.518 | 1.00 | 29.85 | O |
| ANISOU | 2778 | O | PHE | H | 106 | 3464 | 3843 | 4035 | 228 | −264 | −523 | O |
| ATOM | 2779 | CB | PHE | H | 106 | 18.475 | −1.749 | 43.145 | 1.00 | 32.21 | C |
| ANISOU | 2779 | CB | PHE | H | 106 | 3865 | 4109 | 4263 | 203 | −185 | −540 | C |
| ATOM | 2780 | CG | PHE | H | 106 | 17.018 | −1.657 | 43.573 | 1.00 | 31.83 | C |
| ANISOU | 2780 | CG | PHE | H | 106 | 3844 | 4036 | 4212 | 188 | −117 | −559 | C |
| ATOM | 2781 | CD1 | PHE | H | 106 | 16.230 | −0.562 | 43.222 | 1.00 | 32.72 | C |
| ANISOU | 2781 | CD1 | PHE | H | 106 | 3942 | 4159 | 4329 | 169 | −111 | −608 | C |
| ATOM | 2782 | CD2 | PHE | H | 106 | 16.440 | −2.660 | 44.337 | 1.00 | 32.88 | C |
| ANISOU | 2782 | CD2 | PHE | H | 106 | 4015 | 4133 | 4347 | 196 | −54 | −525 | C |
| ATOM | 2783 | CE1 | PHE | H | 106 | 14.896 | −0.490 | 43.606 | 1.00 | 35.75 | C |
| ANISOU | 2783 | CE1 | PHE | H | 106 | 4336 | 4519 | 4729 | 161 | −43 | −624 | C |
| ATOM | 2784 | CE2 | PHE | H | 106 | 15.110 | −2.585 | 44.728 | 1.00 | 34.39 | C |
| ANISOU | 2784 | CE2 | PHE | H | 106 | 4217 | 4298 | 4549 | 182 | 22 | −539 | C |
| ATOM | 2785 | CZ | PHE | H | 106 | 14.340 | −1.495 | 44.362 | 1.00 | 31.83 | C |
| ANISOU | 2785 | CZ | PHE | H | 106 | 3867 | 3988 | 4239 | 165 | 28 | −590 | C |
| ATOM | 2786 | N | ASP | H | 107 | 20.924 | 0.219 | 41.247 | 1.00 | 32.50 | N |
| ANISOU | 2786 | N | ASP | H | 107 | 3791 | 4227 | 4331 | 185 | −322 | −568 | N |
| ATOM | 2787 | CA | ASP | H | 107 | 22.260 | 0.199 | 40.653 | 1.00 | 30.68 | C |
| ANISOU | 2787 | CA | ASP | H | 107 | 3505 | 4016 | 4136 | 194 | −356 | −548 | C |
| ATOM | 2788 | C | ASP | H | 107 | 23.312 | −0.293 | 41.627 | 1.00 | 31.24 | C |
| ANISOU | 2788 | C | ASP | H | 107 | 3574 | 4095 | 4203 | 216 | −404 | −495 | C |
| ATOM | 2789 | O | ASP | H | 107 | 24.299 | −0.905 | 41.212 | 1.00 | 34.03 | O |
| ANISOU | 2789 | O | ASP | H | 107 | 3874 | 4450 | 4608 | 241 | −410 | −466 | O |
| ATOM | 2790 | CB | ASP | H | 107 | 22.649 | 1.601 | 40.175 | 1.00 | 36.33 | C |
| ANISOU | 2790 | CB | ASP | H | 107 | 4198 | 4757 | 4849 | 163 | −393 | −568 | C |
| ATOM | 2791 | CG | ASP | H | 107 | 21.721 | 2.108 | 39.098 | 1.00 | 40.30 | C |
| ANISOU | 2791 | CG | ASP | H | 107 | 4701 | 5253 | 5358 | 147 | −356 | −612 | C |
| ATOM | 2792 | OD1 | ASP | H | 107 | 21.459 | 1.338 | 38.146 | 1.00 | 36.26 | O |
| ANISOU | 2792 | OD1 | ASP | H | 107 | 4175 | 4728 | 4875 | 161 | −313 | −623 | O |
| ATOM | 2793 | OD2 | ASP | H | 107 | 21.228 | 3.243 | 39.232 | 1.00 | 36.40 | O |
| ANISOU | 2793 | OD2 | ASP | H | 107 | 4229 | 4762 | 4840 | 124 | −374 | −635 | O |
| ATOM | 2794 | N | TYR | H | 108 | 23.158 | 0.028 | 42.908 | 1.00 | 28.41 | N |
| ANISOU | 2794 | N | TYR | H | 108 | 3274 | 3742 | 3781 | 211 | −443 | −481 | N |
| ATOM | 2795 | CA | TYR | H | 108 | 24.176 | −0.283 | 43.909 | 1.00 | 33.76 | C |
| ANISOU | 2795 | CA | TYR | H | 108 | 3958 | 4430 | 4439 | 230 | −515 | −430 | C |
| ATOM | 2796 | C | TYR | H | 108 | 23.480 | −0.759 | 45.170 | 1.00 | 35.79 | C |
| ANISOU | 2796 | C | TYR | H | 108 | 4309 | 4670 | 4619 | 243 | −503 | −408 | C |
| ATOM | 2797 | O | TYR | H | 108 | 22.416 | −0.252 | 45.519 | 1.00 | 33.80 | O |
| ANISOU | 2797 | O | TYR | H | 108 | 4117 | 4411 | 4316 | 224 | −464 | −442 | O |
| ATOM | 2798 | CB | TYR | H | 108 | 25.050 | 0.940 | 44.249 | 1.00 | 37.73 | C |
| ANISOU | 2798 | CB | TYR | H | 108 | 4445 | 4965 | 4927 | 200 | −608 | −435 | C |
| ATOM | 2799 | CG | TYR | H | 108 | 25.725 | 1.586 | 43.056 | 1.00 | 48.46 | C |
| ANISOU | 2799 | CG | TYR | H | 108 | 5714 | 6338 | 6359 | 179 | −610 | −452 | C |
| ATOM | 2800 | CD1 | TYR | H | 108 | 26.974 | 1.142 | 42.607 | 1.00 | 54.48 | C |
| ANISOU | 2800 | CD1 | TYR | H | 108 | 6388 | 7111 | 7201 | 198 | −633 | −413 | C |
| ATOM | 2801 | CD2 | TYR | H | 108 | 25.123 | 2.645 | 42.380 | 1.00 | 45.90 | C |
| ANISOU | 2801 | CD2 | TYR | H | 108 | 5396 | 6014 | 6030 | 144 | −584 | −500 | C |
| ATOM | 2802 | CE1 | TYR | H | 108 | 27.598 | 1.734 | 41.510 | 1.00 | 52.75 | C |
| ANISOU | 2802 | CE1 | TYR | H | 108 | 6090 | 6903 | 7049 | 178 | −617 | −423 | C |
| ATOM | 2803 | CE2 | TYR | H | 108 | 25.732 | 3.235 | 41.282 | 1.00 | 49.34 | C |
| ANISOU | 2803 | CE2 | TYR | H | 108 | 5762 | 6460 | 6526 | 125 | −577 | −506 | C |
| ATOM | 2804 | CZ | TYR | H | 108 | 26.967 | 2.776 | 40.850 | 1.00 | 54.80 | C |
| ANISOU | 2804 | CZ | TYR | H | 108 | 6368 | 7162 | 7289 | 140 | −588 | −468 | C |
| ATOM | 2805 | OH | TYR | H | 108 | 27.567 | 3.369 | 39.761 | 1.00 | 59.05 | O |
| ANISOU | 2805 | OH | TYR | H | 108 | 6842 | 7710 | 7886 | 121 | −565 | −470 | O |
| ATOM | 2806 | N | TRP | H | 109 | 24.078 | −1.732 | 45.849 | 1.00 | 32.26 | N |
| ANISOU | 2806 | N | TRP | H | 109 | 3875 | 4213 | 4167 | 279 | −532 | −348 | N |
| ATOM | 2807 | CA | TRP | H | 109 | 23.509 | −2.305 | 47.061 | 1.00 | 32.65 | C |
| ANISOU | 2807 | CA | TRP | H | 109 | 4024 | 4244 | 4138 | 296 | −515 | −313 | C |
| ATOM | 2808 | C | TRP | H | 109 | 24.547 | −2.270 | 48.173 | 1.00 | 34.83 | C |
| ANISOU | 2808 | C | TRP | H | 109 | 4336 | 4540 | 4356 | 314 | −627 | −261 | C |

TABLE 11-continued

| | | | | | | | | | | | | |
|---|---|---|---|---|---|---|---|---|---|---|---|---|
| ATOM | 2809 | O | TRP | H | 109 | 25.742 | −2.390 | 47.917 | 1.00 | 36.28 | | O |
| ANISOU | 2809 | O | TRP | H | 109 | 4445 | 4741 | 4600 | 328 | −702 | −233 | O |
| ATOM | 2810 | CB | TRP | H | 109 | 23.088 | −3.762 | 46.868 | 1.00 | 37.04 | | C |
| ANISOU | 2810 | CB | TRP | H | 109 | 4581 | 4752 | 4739 | 328 | −436 | −276 | C |
| ATOM | 2811 | CG | TRP | H | 109 | 22.072 | −4.040 | 45.791 | 1.00 | 35.30 | | C |
| ANISOU | 2811 | CG | TRP | H | 109 | 4327 | 4504 | 4583 | 312 | −338 | −324 | C |
| ATOM | 2812 | CD1 | TRP | H | 109 | 22.122 | −3.658 | 44.483 | 1.00 | 32.02 | | C |
| ANISOU | 2812 | CD1 | TRP | H | 109 | 3836 | 4097 | 4231 | 295 | −325 | −373 | C |
| ATOM | 2813 | CD2 | TRP | H | 109 | 20.890 | −4.819 | 45.937 | 1.00 | 31.20 | | C |
| ANISOU | 2813 | CD2 | TRP | H | 109 | 3847 | 3937 | 4069 | 310 | −245 | −321 | C |
| ATOM | 2814 | NE1 | TRP | H | 109 | 21.028 | −4.143 | 43.804 | 1.00 | 31.47 | | N |
| ANISOU | 2814 | NE1 | TRP | H | 109 | 3763 | 3992 | 4201 | 284 | −243 | −407 | N |
| ATOM | 2815 | CE2 | TRP | H | 109 | 20.251 | −4.855 | 44.680 | 1.00 | 31.06 | | C |
| ANISOU | 2815 | CE2 | TRP | H | 109 | 3772 | 3904 | 4124 | 289 | −193 | −377 | C |
| ATOM | 2816 | CE3 | TRP | H | 109 | 20.301 | −5.483 | 47.014 | 1.00 | 35.45 | | C |
| ANISOU | 2816 | CE3 | TRP | H | 109 | 4467 | 4443 | 4559 | 321 | −199 | −275 | C |
| ATOM | 2817 | CZ2 | TRP | H | 109 | 19.059 | −5.544 | 44.465 | 1.00 | 34.90 | | C |
| ANISOU | 2817 | CZ2 | TRP | H | 109 | 4267 | 4343 | 4649 | 276 | −109 | −392 | C |
| ATOM | 2818 | CZ3 | TRP | H | 109 | 19.118 | −6.167 | 46.804 | 1.00 | 29.80 | | C |
| ANISOU | 2818 | CZ3 | TRP | H | 109 | 3758 | 3679 | 3887 | 307 | −98 | −285 | C |
| ATOM | 2819 | CH2 | TRP | H | 109 | 18.502 | −6.188 | 45.540 | 1.00 | 29.09 | | C |
| ANISOU | 2819 | CH2 | TRP | H | 109 | 3598 | 3573 | 3882 | 283 | −59 | −345 | C |
| ATOM | 2820 | N | GLY | H | 110 | 24.076 | −2.147 | 49.410 | 1.00 | 36.61 | | N |
| ANISOU | 2820 | N | GLY | H | 110 | 4679 | 4764 | 4467 | 314 | −636 | −247 | N |
| ATOM | 2821 | CA | GLY | H | 110 | 24.946 | −2.248 | 50.564 | 1.00 | 37.39 | | C |
| ANISOU | 2821 | CA | GLY | H | 110 | 4836 | 4879 | 4491 | 335 | −749 | −193 | C |
| ATOM | 2822 | C | GLY | H | 110 | 25.218 | −3.695 | 50.901 | 1.00 | 40.37 | | C |
| ANISOU | 2822 | C | GLY | H | 110 | 5225 | 5226 | 4886 | 388 | −739 | −109 | C |
| ATOM | 2823 | O | GLY | H | 110 | 24.782 | −4.614 | 50.216 | 1.00 | 40.21 | | O |
| ANISOU | 2823 | O | GLY | H | 110 | 5166 | 5169 | 4944 | 405 | −643 | −97 | O |
| ATOM | 2824 | N | GLN | H | 111 | 25.947 | −3.908 | 51.985 | 1.00 | 39.92 | | N |
| ANISOU | 2824 | N | GLN | H | 111 | 5231 | 5180 | 4755 | 414 | −845 | −49 | N |
| ATOM | 2825 | CA | GLN | H | 111 | 26.363 | −5.269 | 52.297 | 1.00 | 39.56 | | C |
| ANISOU | 2825 | CA | GLN | H | 111 | 5192 | 5102 | 4737 | 472 | −852 | 42 | C |
| ATOM | 2826 | C | GLN | H | 111 | 25.386 | −6.002 | 53.198 | 1.00 | 41.82 | | C |
| ANISOU | 2826 | C | GLN | H | 111 | 5617 | 5349 | 4923 | 490 | −765 | 88 | C |
| ATOM | 2827 | O | GLN | H | 111 | 25.531 | −7.215 | 53.385 | 1.00 | 43.77 | | O |
| ANISOU | 2827 | O | GLN | H | 111 | 5877 | 5555 | 5200 | 537 | −744 | 165 | O |
| ATOM | 2828 | CB | GLN | H | 111 | 27.766 | −5.265 | 52.917 | 1.00 | 52.69 | | C |
| ANISOU | 2828 | CB | GLN | H | 111 | 6833 | 6793 | 6393 | 500 | −1023 | 99 | C |
| ATOM | 2829 | CG | GLN | H | 111 | 28.840 | −4.849 | 51.909 | 1.00 | 67.20 | | C |
| ANISOU | 2829 | CG | GLN | H | 111 | 8504 | 8658 | 8372 | 491 | −1087 | 75 | C |
| ATOM | 2830 | CD | GLN | H | 111 | 28.625 | −5.476 | 50.530 | 1.00 | 81.23 | | C |
| ANISOU | 2830 | CD | GLN | H | 111 | 10173 | 10404 | 10288 | 503 | −962 | 56 | C |
| ATOM | 2831 | OE1 | GLN | H | 111 | 28.497 | −6.698 | 50.403 | 1.00 | 80.61 | | O |
| ANISOU | 2831 | OE1 | GLN | H | 111 | 10094 | 10278 | 10255 | 550 | −899 | 106 | O |
| ATOM | 2832 | NE2 | GLN | H | 111 | 28.570 | −4.637 | 49.492 | 1.00 | 85.49 | | N |
| ANISOU | 2832 | NE2 | GLN | H | 111 | 10629 | 10963 | 10889 | 460 | −927 | −18 | N |
| ATOM | 2833 | N | GLY | H | 112 | 24.395 | −5.315 | 53.730 | 1.00 | 41.33 | | N |
| ANISOU | 2833 | N | GLY | H | 112 | 5657 | 5294 | 4754 | 457 | −705 | 44 | N |
| ATOM | 2834 | CA | GLY | H | 112 | 23.310 | −5.964 | 54.451 | 1.00 | 40.94 | | C |
| ANISOU | 2834 | CA | GLY | H | 112 | 5726 | 5203 | 4626 | 468 | −586 | 81 | C |
| ATOM | 2835 | C | GLY | H | 112 | 23.545 | −5.988 | 55.946 | 1.00 | 45.12 | | C |
| ANISOU | 2835 | C | GLY | H | 112 | 6415 | 5741 | 4985 | 492 | −654 | 142 | C |
| ATOM | 2836 | O | GLY | H | 112 | 24.668 | −6.082 | 56.429 | 1.00 | 48.15 | | O |
| ANISOU | 2836 | O | GLY | H | 112 | 6809 | 6148 | 5337 | 520 | −802 | 191 | O |
| ATOM | 2837 | N | THR | H | 113 | 22.456 | −5.890 | 56.696 | 1.00 | 39.94 | | N |
| ANISOU | 2837 | N | THR | H | 113 | 5889 | 5068 | 4217 | 482 | −544 | 140 | N |
| ATOM | 2838 | CA | THR | H | 113 | 22.514 | −6.022 | 58.144 | 1.00 | 46.36 | | C |
| ANISOU | 2838 | CA | THR | H | 113 | 6884 | 5884 | 4849 | 509 | −579 | 202 | C |
| ATOM | 2839 | C | THR | H | 113 | 21.443 | −7.015 | 58.580 | 1.00 | 40.12 | | C |
| ANISOU | 2839 | C | THR | H | 113 | 6180 | 5034 | 4030 | 525 | −409 | 266 | C |
| ATOM | 2840 | O | THR | H | 113 | 20.346 | −7.039 | 58.020 | 1.00 | 40.19 | | O |
| ANISOU | 2840 | O | THR | H | 113 | 6142 | 5014 | 4115 | 496 | −255 | 224 | O |
| ATOM | 2841 | CB | THR | H | 113 | 22.343 | −4.655 | 58.841 | 1.00 | 52.25 | | C |
| ANISOU | 2841 | CB | THR | H | 113 | 7735 | 6672 | 5447 | 479 | −620 | 127 | C |
| ATOM | 2842 | OG1 | THR | H | 113 | 22.531 | −4.805 | 60.251 | 1.00 | 57.79 | | O |
| ANISOU | 2842 | OG1 | THR | H | 113 | 8626 | 7378 | 5954 | 508 | −673 | 188 | O |
| ATOM | 2843 | CG2 | THR | H | 113 | 20.964 | −4.054 | 58.565 | 1.00 | 49.47 | | C |
| ANISOU | 2843 | CG2 | THR | H | 113 | 7389 | 6304 | 5102 | 444 | −448 | 50 | C |
| ATOM | 2844 | N | LEU | H | 114 | 21.776 | −7.859 | 59.546 | 1.00 | 43.26 | | N |
| ANISOU | 2844 | N | LEU | H | 114 | 6696 | 5409 | 4331 | 569 | −439 | 373 | N |
| ATOM | 2845 | CA | LEU | H | 114 | 20.878 | −8.921 | 59.985 | 1.00 | 43.70 | | C |
| ANISOU | 2845 | CA | LEU | H | 114 | 6836 | 5399 | 4370 | 586 | −279 | 452 | C |
| ATOM | 2846 | C | LEU | H | 114 | 19.931 | −8.408 | 61.070 | 1.00 | 46.18 | | C |
| ANISOU | 2846 | C | LEU | H | 114 | 7327 | 5715 | 4504 | 574 | −171 | 445 | C |
| ATOM | 2847 | O | LEU | H | 114 | 20.372 | −7.809 | 62.053 | 1.00 | 50.60 | | O |
| ANISOU | 2847 | O | LEU | H | 114 | 8027 | 6315 | 4884 | 588 | −268 | 449 | O |
| ATOM | 2848 | CB | LEU | H | 114 | 21.678 | −10.119 | 60.510 | 1.00 | 45.74 | | C |
| ANISOU | 2848 | CB | LEU | H | 114 | 7147 | 5623 | 4611 | 645 | −356 | 582 | C |

TABLE 11-continued

| | | | | | | | | | | | |
|---|---|---|---|---|---|---|---|---|---|---|---|
| ATOM | 2849 | CG | LEU | H | 114 | 20.874 | −11.328 | 61.006 | 1.00 | 47.86 | C |
| ANISOU | 2849 | CG | LEU | H | 114 | 7508 | 5810 | 4865 | 664 | −198 | 684 | C |
| ATOM | 2850 | CD1 | LEU | H | 114 | 20.091 | −11.959 | 59.852 | 1.00 | 45.32 | C |
| ANISOU | 2850 | CD1 | LEU | H | 114 | 7043 | 5429 | 4749 | 634 | −51 | 654 | C |
| ATOM | 2851 | CD2 | LEU | H | 114 | 21.779 | −12.379 | 61.682 | 1.00 | 44.82 | C |
| ANISOU | 2851 | CD2 | LEU | H | 114 | 7200 | 5394 | 4434 | 731 | −300 | 821 | C |
| ATOM | 2852 | N | VAL | H | 115 | 18.636 | −8.657 | 60.888 | 1.00 | 39.40 | N |
| ANISOU | 2852 | N | VAL | H | 115 | 6461 | 4813 | 3698 | 549 | 30 | 434 | N |
| ATOM | 2853 | CA | VAL | H | 115 | 17.615 | −8.431 | 61.905 | 1.00 | 48.62 | C |
| ANISOU | 2853 | CA | VAL | H | 115 | 7790 | 5965 | 4718 | 545 | 180 | 446 | C |
| ATOM | 2854 | C | VAL | H | 115 | 17.022 | −9.778 | 62.287 | 1.00 | 52.35 | C |
| ANISOU | 2854 | C | VAL | H | 115 | 8319 | 6360 | 5210 | 562 | 324 | 562 | C |
| ATOM | 2855 | O | VAL | H | 115 | 16.567 | −10.525 | 61.415 | 1.00 | 53.99 | O |
| ANISOU | 2855 | O | VAL | H | 115 | 8395 | 6516 | 5603 | 542 | 410 | 569 | O |
| ATOM | 2856 | CB | VAL | H | 115 | 16.499 | −7.494 | 61.404 | 1.00 | 50.99 | C |
| ANISOU | 2856 | CB | VAL | H | 115 | 8022 | 6273 | 5078 | 499 | 311 | 335 | C |
| ATOM | 2857 | CG1 | VAL | H | 115 | 15.352 | −7.477 | 62.410 | 1.00 | 48.46 | C |
| ANISOU | 2857 | CG1 | VAL | H | 115 | 7852 | 5923 | 4637 | 501 | 504 | 361 | C |
| ATOM | 2858 | CG2 | VAL | H | 115 | 17.045 | −6.093 | 61.144 | 1.00 | 48.71 | C |
| ANISOU | 2858 | CG2 | VAL | H | 115 | 7701 | 6051 | 4754 | 483 | 177 | 225 | C |
| ATOM | 2859 | N | THR | H | 116 | 16.997 | −10.071 | 63.587 | 1.00 | 50.64 | N |
| ANISOU | 2859 | N | THR | H | 116 | 8307 | 6132 | 4802 | 595 | 354 | 650 | N |
| ATOM | 2860 | CA | THR | H | 116 | 16.516 | −11.345 | 64.106 | 1.00 | 53.37 | C |
| ANISOU | 2860 | CA | THR | H | 116 | 8735 | 6401 | 5143 | 614 | 488 | 778 | C |
| ATOM | 2861 | C | THR | H | 116 | 15.409 | −11.092 | 65.122 | 1.00 | 58.17 | C |
| ANISOU | 2861 | C | THR | H | 116 | 9509 | 6992 | 5601 | 607 | 683 | 796 | C |
| ATOM | 2862 | O | THR | H | 116 | 15.645 | −10.444 | 66.146 | 1.00 | 62.36 | O |
| ANISOU | 2862 | O | THR | H | 116 | 10220 | 7565 | 5908 | 630 | 638 | 795 | O |
| ATOM | 2863 | CB | THR | H | 116 | 17.658 | −12.130 | 64.760 | 1.00 | 55.82 | C |
| ANISOU | 2863 | CB | THR | H | 116 | 9149 | 6703 | 5357 | 673 | 336 | 899 | C |
| ATOM | 2864 | OG1 | THR | H | 116 | 18.738 | −12.283 | 63.826 | 1.00 | 51.77 | O |
| ANISOU | 2864 | OG1 | THR | H | 116 | 8473 | 6208 | 4988 | 685 | 158 | 877 | O |
| ATOM | 2865 | CG2 | THR | H | 116 | 17.171 | −13.504 | 65.215 | 1.00 | 55.26 | C |
| ANISOU | 2865 | CG2 | THR | H | 116 | 9158 | 6539 | 5300 | 693 | 478 | 1038 | C |
| ATOM | 2866 | N | VAL | H | 117 | 14.217 | −11.628 | 64.855 | 1.00 | 60.02 | N |
| ANISOU | 2866 | N | VAL | H | 117 | 9686 | 7161 | 5959 | 575 | 899 | 813 | N |
| ATOM | 2867 | CA | VAL | H | 117 | 13.054 | −11.468 | 65.724 | 1.00 | 61.10 | C |
| ANISOU | 2867 | CA | VAL | H | 117 | 9952 | 7272 | 5991 | 566 | 1121 | 834 | C |
| ATOM | 2868 | C | VAL | H | 117 | 12.773 | −12.786 | 66.435 | 1.00 | 69.71 | C |
| ANISOU | 2868 | C | VAL | H | 117 | 11159 | 8280 | 7048 | 585 | 1246 | 990 | C |
| ATOM | 2869 | O | VAL | H | 117 | 12.925 | −13.861 | 65.846 | 1.00 | 70.44 | O |
| ANISOU | 2869 | O | VAL | H | 117 | 11151 | 8310 | 7303 | 579 | 1239 | 1053 | O |
| ATOM | 2870 | CB | VAL | H | 117 | 11.815 | −11.014 | 64.928 | 1.00 | 57.67 | C |
| ANISOU | 2870 | CB | VAL | H | 117 | 9354 | 6821 | 5736 | 511 | 1287 | 738 | C |
| ATOM | 2871 | CG1 | VAL | H | 117 | 10.652 | −10.704 | 65.874 | 1.00 | 59.80 | C |
| ANISOU | 2871 | CG1 | VAL | H | 117 | 9754 | 7071 | 5897 | 508 | 1520 | 752 | C |
| ATOM | 2872 | CG2 | VAL | H | 117 | 12.153 | −9.813 | 64.051 | 1.00 | 55.22 | C |
| ANISOU | 2872 | CG2 | VAL | H | 117 | 8910 | 6582 | 5488 | 493 | 1151 | 593 | C |
| ATOM | 2873 | N | SER | H | 118 | 12.341 | −12.690 | 67.696 | 1.00 | 81.25 | N |
| ANISOU | 2873 | N | SER | H | 118 | 12839 | 9736 | 8297 | 607 | 1370 | 1053 | N |
| ATOM | 2874 | CA | SER | H | 118 | 12.005 | −13.832 | 68.556 | 1.00 | 87.75 | C |
| ANISOU | 2874 | CA | SER | H | 118 | 13812 | 10480 | 9048 | 628 | 1512 | 1212 | C |
| ATOM | 2875 | C | SER | H | 118 | 13.248 | −14.636 | 68.902 | 1.00 | 96.10 | C |
| ANISOU | 2875 | C | SER | H | 118 | 14963 | 11529 | 10022 | 682 | 1320 | 1325 | C |
| ATOM | 2876 | O | SER | H | 118 | 13.895 | −14.373 | 69.915 | 1.00 | 103.44 | O |
| ANISOU | 2876 | O | SER | H | 118 | 16099 | 12500 | 10703 | 730 | 1217 | 1371 | O |
| ATOM | 2877 | CB | SER | H | 118 | 10.951 | −14.739 | 67.907 | 1.00 | 84.53 | C |
| ANISOU | 2877 | CB | SER | H | 118 | 13253 | 9977 | 8888 | 577 | 1716 | 1247 | C |
| ATOM | 2878 | OG | SER | H | 118 | 10.688 | −15.877 | 68.714 | 1.00 | 91.73 | O |
| ANISOU | 2878 | OG | SER | H | 118 | 14309 | 10804 | 9742 | 593 | 1851 | 1408 | O |
| TER | | | | | | | | | | | |
| ATOM | 2879 | N | SER | L | 1 | −0.984 | −10.179 | 42.927 | 1.00 | 78.14 | N |
| ANISOU | 2879 | N | SER | L | 1 | 8777 | 9115 | 11799 | −335 | 849 | −625 | N |
| ATOM | 2880 | CA | SER | L | 1 | 0.162 | −9.432 | 42.424 | 1.00 | 78.19 | C |
| ANISOU | 2880 | CA | SER | L | 1 | 8872 | 9200 | 11637 | −280 | 729 | −659 | C |
| ATOM | 2881 | C | SER | L | 1 | 0.713 | −10.029 | 41.135 | 1.00 | 73.48 | C |
| ANISOU | 2881 | C | SER | L | 1 | 8284 | 8590 | 11044 | −303 | 583 | −719 | C |
| ATOM | 2882 | O | SER | L | 1 | 0.227 | −11.051 | 40.638 | 1.00 | 70.82 | O |
| ANISOU | 2882 | O | SER | L | 1 | 7895 | 8179 | 10834 | −362 | 566 | −739 | O |
| ATOM | 2883 | CB | SER | L | 1 | 1.281 | −9.373 | 43.469 | 1.00 | 73.73 | C |
| ANISOU | 2883 | CB | SER | L | 1 | 8456 | 8665 | 10892 | −225 | 794 | −597 | C |
| ATOM | 2884 | OG | SER | L | 1 | 1.017 | −8.396 | 44.454 | 1.00 | 68.42 | O |
| ANISOU | 2884 | OG | SER | L | 1 | 7804 | 8034 | 10158 | −186 | 888 | −567 | O |
| ATOM | 2885 | N | TYR | L | 2 | 1.741 | −9.370 | 40.610 | 1.00 | 61.67 | N |
| ANISOU | 2885 | N | TYR | L | 2 | 6861 | 7163 | 9408 | −256 | 484 | −747 | N |
| ATOM | 2886 | CA | TYR | L | 2 | 2.416 | −9.790 | 39.393 | 1.00 | 56.15 | C |
| ANISOU | 2886 | CA | TYR | L | 2 | 6193 | 6462 | 8680 | −263 | 357 | −803 | C |
| ATOM | 2887 | C | TYR | L | 2 | 3.495 | −10.811 | 39.741 | 1.00 | 48.94 | C |
| ANISOU | 2887 | C | TYR | L | 2 | 5385 | 5513 | 7695 | −249 | 391 | −766 | C |
| ATOM | 2888 | O | TYR | L | 2 | 4.230 | −10.650 | 40.720 | 1.00 | 46.86 | O |

TABLE 11-continued

| | | | | | | | | | | | |
|---|---|---|---|---|---|---|---|---|---|---|---|
| ANISOU | 2888 | O | TYR | L | 2 | 5202 | 5277 | 7327 | −205 | 457 | −704 | O |
| ATOM | 2889 | CB | TYR | L | 2 | 3.018 | −8.569 | 38.691 | 1.00 | 46.24 | | C |
| ANISOU | 2889 | CB | TYR | L | 2 | 4963 | 5294 | 7311 | −218 | 252 | −842 | C |
| ATOM | 2890 | CG | TYR | L | 2 | 3.493 | −8.808 | 37.275 | 1.00 | 45.68 | | C |
| ANISOU | 2890 | CG | TYR | L | 2 | 4912 | 5227 | 7216 | −226 | 121 | −909 | C |
| ATOM | 2891 | CD1 | TYR | L | 2 | 2.593 | −8.880 | 36.214 | 1.00 | 50.31 | | C |
| ANISOU | 2891 | CD1 | TYR | L | 2 | 5419 | 5792 | 7904 | −270 | 27 | −973 | C |
| ATOM | 2892 | CD2 | TYR | L | 2 | 4.845 | −8.951 | 36.996 | 1.00 | 37.00 | | C |
| ANISOU | 2892 | CD2 | TYR | L | 2 | 3913 | 4153 | 5991 | −189 | 90 | −908 | C |
| ATOM | 2893 | CE1 | TYR | L | 2 | 3.038 | −9.094 | 34.912 | 1.00 | 48.58 | | C |
| ANISOU | 2893 | CE1 | TYR | L | 2 | 5240 | 5578 | 7642 | −275 | −91 | −1036 | C |
| ATOM | 2894 | CE2 | TYR | L | 2 | 5.290 | −9.158 | 35.705 | 1.00 | 36.55 | | C |
| ANISOU | 2894 | CE2 | TYR | L | 2 | 3884 | 4099 | 5903 | −192 | −12 | −969 | C |
| ATOM | 2895 | CZ | TYR | L | 2 | 4.397 | −9.226 | 34.669 | 1.00 | 39.67 | | C |
| ANISOU | 2895 | CZ | TYR | L | 2 | 4219 | 4473 | 6379 | −234 | −100 | −1034 | C |
| ATOM | 2896 | OH | TYR | L | 2 | 4.862 | −9.436 | 33.382 | 1.00 | 36.91 | | O |
| ANISOU | 2896 | OH | TYR | L | 2 | 3920 | 4127 | 5978 | −235 | −199 | −1098 | O |
| ATOM | 2897 | N | VAL | L | 3 | 3.578 | −11.873 | 38.951 | 1.00 | 44.93 | | N |
| ANISOU | 2897 | N | VAL | L | 3 | 4880 | 4941 | 7249 | −284 | 343 | −804 | N |
| ATOM | 2898 | CA | VAL | L | 3 | 4.429 | −13.011 | 39.273 | 1.00 | 46.75 | | C |
| ANISOU | 2898 | CA | VAL | L | 3 | 5196 | 5115 | 7450 | −274 | 385 | −767 | C |
| ATOM | 2899 | C | VAL | L | 3 | 5.532 | −13.118 | 38.229 | 1.00 | 42.48 | | C |
| ANISOU | 2899 | C | VAL | L | 3 | 4719 | 4597 | 6824 | −243 | 285 | −818 | C |
| ATOM | 2900 | O | VAL | L | 3 | 5.254 | −13.188 | 37.026 | 1.00 | 46.22 | | O |
| ANISOU | 2900 | O | VAL | L | 3 | 5165 | 5061 | 7336 | −271 | 191 | −898 | O |
| ATOM | 2901 | CB | VAL | L | 3 | 3.621 | −14.316 | 39.346 | 1.00 | 43.25 | | C |
| ANISOU | 2901 | CB | VAL | L | 3 | 4713 | 4556 | 7165 | −341 | 439 | −762 | C |
| ATOM | 2902 | CG1 | VAL | L | 3 | 4.550 | −15.494 | 39.562 | 1.00 | 40.56 | | C |
| ANISOU | 2902 | CG1 | VAL | L | 3 | 4466 | 4147 | 6796 | −324 | 473 | −727 | C |
| ATOM | 2903 | CG2 | VAL | L | 3 | 2.584 | −14.226 | 40.463 | 1.00 | 55.10 | | C |
| ANISOU | 2903 | CG2 | VAL | L | 3 | 6152 | 6034 | 8751 | −369 | 564 | −698 | C |
| ATOM | 2904 | N | LEU | L | 4 | 6.780 | −13.139 | 38.687 | 1.00 | 36.96 | | N |
| ANISOU | 2904 | N | LEU | L | 4 | 4107 | 3926 | 6010 | −184 | 304 | −772 | N |
| ATOM | 2905 | CA | LEU | L | 4 | 7.921 | −13.450 | 37.838 | 1.00 | 37.47 | | C |
| ANISOU | 2905 | CA | LEU | L | 4 | 4232 | 3996 | 6008 | −149 | 240 | −807 | C |
| ATOM | 2906 | C | LEU | L | 4 | 8.356 | −14.875 | 38.134 | 1.00 | 37.67 | | C |
| ANISOU | 2906 | C | LEU | L | 4 | 4308 | 3926 | 6078 | −147 | 294 | −775 | C |
| ATOM | 2907 | O | LEU | L | 4 | 8.561 | −15.232 | 39.300 | 1.00 | 44.20 | | O |
| ANISOU | 2907 | O | LEU | L | 4 | 5168 | 4730 | 6895 | −128 | 376 | −689 | O |
| ATOM | 2908 | CB | LEU | L | 4 | 9.087 | −12.497 | 38.082 | 1.00 | 33.88 | | C |
| ANISOU | 2908 | CB | LEU | L | 4 | 3825 | 3636 | 5414 | −83 | 218 | −778 | C |
| ATOM | 2909 | CG | LEU | L | 4 | 8.815 | −11.017 | 37.834 | 1.00 | 34.59 | | C |
| ANISOU | 2909 | CG | LEU | L | 4 | 3877 | 3816 | 5449 | −78 | 168 | −804 | C |
| ATOM | 2910 | CD1 | LEU | L | 4 | 10.064 | −10.231 | 38.168 | 1.00 | 35.62 | | C |
| ANISOU | 2910 | CD1 | LEU | L | 4 | 4058 | 4022 | 5454 | −20 | 152 | −769 | C |
| ATOM | 2911 | CD2 | LEU | L | 4 | 8.412 | −10.808 | 36.391 | 1.00 | 34.36 | | C |
| ANISOU | 2911 | CD2 | LEU | L | 4 | 3816 | 3793 | 5447 | −104 | 76 | −891 | C |
| ATOM | 2912 | N | THR | L | 5 | 8.512 | −15.679 | 37.088 | 1.00 | 37.75 | | N |
| ANISOU | 2912 | N | THR | L | 5 | 4335 | 3876 | 6131 | −163 | 249 | −841 | N |
| ATOM | 2913 | CA | THR | L | 5 | 8.817 | −17.092 | 37.255 | 1.00 | 34.29 | | C |
| ANISOU | 2913 | CA | THR | L | 5 | 3944 | 3329 | 5756 | −165 | 299 | −821 | C |
| ATOM | 2914 | C | THR | L | 5 | 10.182 | −17.389 | 36.665 | 1.00 | 35.32 | | C |
| ANISOU | 2914 | C | THR | L | 5 | 4144 | 3465 | 5812 | −100 | 271 | −839 | C |
| ATOM | 2915 | O | THR | L | 5 | 10.397 | −17.201 | 35.463 | 1.00 | 40.70 | | O |
| ANISOU | 2915 | O | THR | L | 5 | 4835 | 4166 | 6465 | −99 | 202 | −924 | O |
| ATOM | 2916 | CB | THR | L | 5 | 7.751 | −17.972 | 36.599 | 1.00 | 38.81 | | C |
| ANISOU | 2916 | CB | THR | L | 5 | 4479 | 3799 | 6469 | −244 | 283 | −888 | C |
| ATOM | 2917 | OG1 | THR | L | 5 | 6.477 | −17.695 | 37.192 | 1.00 | 47.27 | | O |
| ANISOU | 2917 | OG1 | THR | L | 5 | 5468 | 4864 | 7630 | −303 | 320 | −863 | O |
| ATOM | 2918 | CG2 | THR | L | 5 | 8.089 | −19.433 | 36.806 | 1.00 | 47.17 | | C |
| ANISOU | 2918 | CG2 | THR | L | 5 | 5592 | 4732 | 7598 | −245 | 341 | −864 | C |
| ATOM | 2919 | N | GLN | L | 6 | 11.092 | −17.891 | 37.506 | 1.00 | 34.39 | | N |
| ANISOU | 2919 | N | GLN | L | 6 | 4076 | 3326 | 5666 | −46 | 327 | −756 | N |
| ATOM | 2920 | CA | GLN | L | 6 | 12.412 | −18.322 | 37.090 | 1.00 | 37.39 | | C |
| ANISOU | 2920 | CA | GLN | L | 6 | 4509 | 3695 | 6000 | 22 | 317 | −759 | C |
| ATOM | 2921 | C | GLN | L | 6 | 12.570 | −19.814 | 37.354 | 1.00 | 36.92 | | C |
| ANISOU | 2921 | C | GLN | L | 6 | 4494 | 3503 | 6029 | 28 | 375 | −729 | C |
| ATOM | 2922 | O | GLN | L | 6 | 12.062 | −20.316 | 38.356 | 1.00 | 40.86 | | O |
| ANISOU | 2922 | O | GLN | L | 6 | 4996 | 3947 | 6583 | 6 | 437 | −656 | O |
| ATOM | 2923 | CB | GLN | L | 6 | 13.512 | −17.574 | 37.854 | 1.00 | 33.36 | | C |
| ANISOU | 2923 | CB | GLN | L | 6 | 4013 | 3277 | 5384 | 93 | 317 | −681 | C |
| ATOM | 2924 | CG | GLN | L | 6 | 13.549 | −16.069 | 37.636 | 1.00 | 33.24 | | C |
| ANISOU | 2924 | CG | GLN | L | 6 | 3964 | 3388 | 5279 | 95 | 262 | −704 | C |
| ATOM | 2925 | CD | GLN | L | 6 | 14.734 | −15.430 | 38.342 | 1.00 | 33.42 | | C |
| ANISOU | 2925 | CD | GLN | L | 6 | 4002 | 3488 | 5210 | 160 | 253 | −633 | C |
| ATOM | 2926 | OE1 | GLN | L | 6 | 14.564 | −14.603 | 39.233 | 1.00 | 36.99 | | O |
| ANISOU | 2926 | OE1 | GLN | L | 6 | 4446 | 4000 | 5608 | 158 | 254 | −585 | O |
| ATOM | 2927 | NE2 | GLN | L | 6 | 15.935 | −15.817 | 37.945 | 1.00 | 32.73 | | N |
| ANISOU | 2927 | NE2 | GLN | L | 6 | 3934 | 3392 | 5108 | 218 | 245 | −629 | N |
| ATOM | 2928 | N | PRO | L | 7 | 13.307 | −20.541 | 36.506 | 1.00 | 43.47 | | N |

TABLE 11-continued

| | | | | | | | | | | | |
|---|---|---|---|---|---|---|---|---|---|---|---|
| ANISOU | 2928 | N | PRO | L | 7 | 5366 | 4277 | 6874 | 63 | 366 | −780 | N |
| ATOM | 2929 | CA | PRO | L | 7 | 13.631 | −21.926 | 36.843 | 1.00 | 38.49 | | C |
| ANISOU | 2929 | CA | PRO | L | 7 | 4784 | 3517 | 6325 | 86 | 425 | −741 | C |
| ATOM | 2930 | C | PRO | L | 7 | 14.616 | −21.961 | 37.993 | 1.00 | 42.93 | | C |
| ANISOU | 2930 | C | PRO | L | 7 | 5368 | 4102 | 6841 | 163 | 461 | −617 | C |
| ATOM | 2931 | O | PRO | L | 7 | 15.444 | −21.046 | 38.148 | 1.00 | 40.28 | | O |
| ANISOU | 2931 | O | PRO | L | 7 | 5019 | 3876 | 6408 | 216 | 428 | −590 | O |
| ATOM | 2932 | CB | PRO | L | 7 | 14.254 | −22.471 | 35.543 | 1.00 | 38.82 | | C |
| ANISOU | 2932 | CB | PRO | L | 7 | 4865 | 3510 | 6374 | 115 | 403 | −839 | C |
| ATOM | 2933 | CG | PRO | L | 7 | 14.856 | −21.258 | 34.902 | 1.00 | 43.03 | | C |
| ANISOU | 2933 | CG | PRO | L | 7 | 5380 | 4177 | 6793 | 148 | 349 | −877 | C |
| ATOM | 2934 | CD | PRO | L | 7 | 13.983 | −20.088 | 35.280 | 1.00 | 37.30 | | C |
| ANISOU | 2934 | CD | PRO | L | 7 | 4597 | 3550 | 6027 | 95 | 312 | −865 | C |
| ATOM | 2935 | N | PRO | L | 8 | 14.540 | −22.972 | 38.858 | 1.00 | 46.06 | | N |
| ANISOU | 2935 | N | PRO | L | 8 | 5799 | 4396 | 7305 | 169 | 523 | −535 | N |
| ATOM | 2936 | CA | PRO | L | 8 | 15.454 | −23.014 | 40.013 | 1.00 | 46.65 | | C |
| ANISOU | 2936 | CA | PRO | L | 8 | 5903 | 4493 | 7328 | 245 | 544 | −409 | C |
| ATOM | 2937 | C | PRO | L | 8 | 16.923 | −23.092 | 39.634 | 1.00 | 42.72 | | C |
| ANISOU | 2937 | C | PRO | L | 8 | 5416 | 4018 | 6797 | 341 | 515 | −404 | C |
| ATOM | 2938 | O | PRO | L | 8 | 17.772 | −22.590 | 40.383 | 1.00 | 41.68 | | O |
| ANISOU | 2938 | O | PRO | L | 8 | 5283 | 3962 | 6593 | 402 | 492 | −322 | O |
| ATOM | 2939 | CB | PRO | L | 8 | 15.007 | −24.277 | 40.771 | 1.00 | 49.77 | | C |
| ANISOU | 2939 | CB | PRO | L | 8 | 6343 | 4747 | 7820 | 229 | 620 | −333 | C |
| ATOM | 2940 | CG | PRO | L | 8 | 13.645 | −24.566 | 40.295 | 1.00 | 53.22 | | C |
| ANISOU | 2940 | CG | PRO | L | 8 | 6755 | 5118 | 8350 | 126 | 642 | −406 | C |
| ATOM | 2941 | CD | PRO | L | 8 | 13.557 | −24.069 | 38.885 | 1.00 | 53.41 | | C |
| ANISOU | 2941 | CD | PRO | L | 8 | 6744 | 5187 | 8364 | 102 | 574 | −546 | C |
| ATOM | 2942 | N | SER | L | 9 | 17.276 | −23.720 | 38.515 | 1.00 | 36.81 | | N |
| ANISOU | 2942 | N | SER | L | 9 | 4681 | 3204 | 6103 | 359 | 518 | −489 | N |
| ATOM | 2943 | CA | SER | L | 9 | 18.697 | −23.850 | 38.240 | 1.00 | 38.91 | | C |
| ANISOU | 2943 | CA | SER | L | 9 | 4949 | 3483 | 6351 | 458 | 509 | −473 | C |
| ATOM | 2944 | C | SER | L | 9 | 18.966 | −23.978 | 36.754 | 1.00 | 44.94 | | C |
| ANISOU | 2944 | C | SER | L | 9 | 5718 | 4228 | 7128 | 466 | 506 | −600 | C |
| ATOM | 2945 | O | SER | L | 9 | 18.140 | −24.478 | 35.987 | 1.00 | 48.94 | | O |
| ANISOU | 2945 | O | SER | L | 9 | 6251 | 4658 | 7685 | 405 | 515 | −693 | O |
| ATOM | 2946 | CB | SER | L | 9 | 19.292 | −25.068 | 38.956 | 1.00 | 52.06 | | C |
| ANISOU | 2946 | CB | SER | L | 9 | 6656 | 5033 | 8091 | 524 | 555 | −378 | C |
| ATOM | 2947 | OG | SER | L | 9 | 18.589 | −26.219 | 38.557 | 1.00 | 57.78 | | O |
| ANISOU | 2947 | OG | SER | L | 9 | 7425 | 5608 | 8922 | 482 | 604 | −425 | O |
| ATOM | 2948 | N | VAL | L | 10 | 20.158 | −23.550 | 36.367 | 1.00 | 41.00 | | N |
| ANISOU | 2948 | N | VAL | L | 10 | 5196 | 3796 | 6585 | 542 | 493 | −600 | N |
| ATOM | 2949 | CA | VAL | L | 10 | 20.652 | −23.727 | 35.012 | 1.00 | 44.06 | | C |
| ANISOU | 2949 | CA | VAL | L | 10 | 5600 | 4164 | 6977 | 571 | 510 | −706 | C |
| ATOM | 2950 | C | VAL | L | 10 | 22.086 | −24.191 | 35.136 | 1.00 | 43.01 | | C |
| ANISOU | 2950 | C | VAL | L | 10 | 5455 | 4007 | 6879 | 684 | 544 | −649 | C |
| ATOM | 2951 | O | VAL | L | 10 | 22.848 | −23.642 | 35.938 | 1.00 | 42.02 | | O |
| ANISOU | 2951 | O | VAL | L | 10 | 5279 | 3961 | 6724 | 732 | 517 | −552 | O |
| ATOM | 2952 | CB | VAL | L | 10 | 20.552 | −22.427 | 34.185 | 1.00 | 43.77 | | C |
| ANISOU | 2952 | CB | VAL | L | 10 | 5535 | 4257 | 6840 | 537 | 464 | −780 | C |
| ATOM | 2953 | CG1 | VAL | L | 10 | 21.157 | −22.623 | 32.806 | 1.00 | 43.10 | | C |
| ANISOU | 2953 | CG1 | VAL | L | 10 | 5481 | 4153 | 6744 | 576 | 494 | −881 | C |
| ATOM | 2954 | CG2 | VAL | L | 10 | 19.089 | −21.990 | 34.063 | 1.00 | 46.07 | | C |
| ANISOU | 2954 | CG2 | VAL | L | 10 | 5827 | 4565 | 7111 | 430 | 424 | −834 | C |
| ATOM | 2955 | N | SER | L | 11 | 22.440 | −25.221 | 34.381 | 1.00 | 39.92 | | N |
| ANISOU | 2955 | N | SER | L | 11 | 5109 | 3502 | 6558 | 727 | 601 | −708 | N |
| ATOM | 2956 | CA | SER | L | 11 | 23.793 | −25.738 | 34.347 | 1.00 | 43.57 | | C |
| ANISOU | 2956 | CA | SER | L | 11 | 5553 | 3927 | 7072 | 843 | 646 | −665 | C |
| ATOM | 2957 | C | SER | L | 11 | 24.407 | −25.456 | 32.980 | 1.00 | 45.65 | | C |
| ANISOU | 2957 | C | SER | L | 11 | 5821 | 4220 | 7303 | 877 | 682 | −771 | C |
| ATOM | 2958 | O | SER | L | 11 | 23.731 | −25.577 | 31.956 | 1.00 | 44.85 | | O |
| ANISOU | 2958 | O | SER | L | 11 | 5781 | 4084 | 7174 | 824 | 693 | −893 | O |
| ATOM | 2959 | CB | SER | L | 11 | 23.784 | −27.241 | 34.648 | 1.00 | 43.81 | | C |
| ANISOU | 2959 | CB | SER | L | 11 | 5639 | 3783 | 7222 | 880 | 700 | −638 | C |
| ATOM | 2960 | OG | SER | L | 11 | 24.952 | −27.839 | 34.172 | 1.00 | 45.20 | | O |
| ANISOU | 2960 | OG | SER | L | 11 | 5812 | 3902 | 7460 | 989 | 758 | −644 | O |
| ATOM | 2961 | N | VAL | L | 12 | 25.685 | −25.069 | 32.962 | 1.00 | 39.34 | | N |
| ANISOU | 2961 | N | VAL | L | 12 | 4958 | 3485 | 6505 | 965 | 699 | −723 | N |
| ATOM | 2962 | CA | VAL | L | 12 | 26.393 | −24.792 | 31.711 | 1.00 | 43.95 | | C |
| ANISOU | 2962 | CA | VAL | L | 12 | 5541 | 4099 | 7060 | 1008 | 755 | −809 | C |
| ATOM | 2963 | C | VAL | L | 12 | 27.844 | −25.208 | 31.843 | 1.00 | 48.33 | | C |
| ANISOU | 2963 | C | VAL | L | 12 | 6035 | 4628 | 7700 | 1133 | 813 | −744 | C |
| ATOM | 2964 | O | VAL | L | 12 | 28.432 | −25.157 | 32.925 | 1.00 | 49.69 | | O |
| ANISOU | 2964 | O | VAL | L | 12 | 6135 | 4826 | 7919 | 1178 | 774 | −621 | O |
| ATOM | 2965 | CB | VAL | L | 12 | 26.346 | −23.304 | 31.302 | 1.00 | 44.07 | | C |
| ANISOU | 2965 | CB | VAL | L | 12 | 5514 | 4271 | 6959 | 959 | 710 | −834 | C |
| ATOM | 2966 | CG1 | VAL | L | 12 | 24.959 | −22.920 | 30.848 | 1.00 | 51.76 | | C |
| ANISOU | 2966 | CG1 | VAL | L | 12 | 6551 | 5262 | 7854 | 847 | 662 | −921 | C |
| ATOM | 2967 | CG2 | VAL | L | 12 | 26.805 | −22.438 | 32.455 | 1.00 | 42.83 | | C |
| ANISOU | 2967 | CG2 | VAL | L | 12 | 5262 | 4222 | 6790 | 966 | 643 | −710 | C |
| ATOM | 2968 | N | ALA | L | 13 | 28.431 | −25.561 | 30.717 | 1.00 | 45.18 | | N |

TABLE 11-continued

| | | | | | | | | | | | |
|---|---|---|---|---|---|---|---|---|---|---|---|
| ANISOU | 2968 | N | ALA | L | 13 | 5663 | 4184 | 7317 | 1190 | 904 | −828 | N |
| ATOM | 2969 | CA | ALA | L | 13 | 29.842 | −25.865 | 30.660 | 1.00 | 48.83 | | C |
| ANISOU | 2969 | CA | ALA | L | 13 | 6055 | 4629 | 7868 | 1313 | 974 | −778 | C |
| ATOM | 2970 | C | ALA | L | 13 | 30.639 | −24.574 | 30.492 | 1.00 | 50.87 | | C |
| ANISOU | 2970 | C | ALA | L | 13 | 6211 | 5041 | 8075 | 1324 | 962 | −745 | C |
| ATOM | 2971 | O | ALA | L | 13 | 30.124 | −23.587 | 29.955 | 1.00 | 45.79 | | O |
| ANISOU | 2971 | O | ALA | L | 13 | 5587 | 4493 | 7317 | 1246 | 934 | −802 | O |
| ATOM | 2972 | CB | ALA | L | 13 | 30.133 | −26.822 | 29.506 | 1.00 | 49.79 | | C |
| ANISOU | 2972 | CB | ALA | L | 13 | 6257 | 4629 | 8032 | 1375 | 1096 | −887 | C |
| ATOM | 2973 | N | PRO | L | 14 | 31.888 | −24.547 | 30.959 | 1.00 | 51.54 | | N |
| ANISOU | 2973 | N | PRO | L | 14 | 6183 | 5150 | 8252 | 1417 | 977 | −649 | N |
| ATOM | 2974 | CA | PRO | L | 14 | 32.691 | −23.327 | 30.818 | 1.00 | 52.64 | | C |
| ANISOU | 2974 | CA | PRO | L | 14 | 6213 | 5427 | 8361 | 1422 | 966 | −614 | C |
| ATOM | 2975 | C | PRO | L | 14 | 32.856 | −22.954 | 29.351 | 1.00 | 49.58 | | C |
| ANISOU | 2975 | C | PRO | L | 14 | 5866 | 5062 | 7909 | 1421 | 1071 | −726 | C |
| ATOM | 2976 | O | PRO | L | 14 | 33.031 | −23.815 | 28.490 | 1.00 | 46.61 | | O |
| ANISOU | 2976 | O | PRO | L | 14 | 5558 | 4586 | 7564 | 1477 | 1182 | −804 | O |
| ATOM | 2977 | CB | PRO | L | 14 | 34.035 | −23.702 | 31.454 | 1.00 | 52.11 | | C |
| ANISOU | 2977 | CB | PRO | L | 14 | 6019 | 5342 | 8437 | 1537 | 978 | −503 | C |
| ATOM | 2978 | CG | PRO | L | 14 | 33.779 | −24.931 | 32.242 | 1.00 | 59.96 | | C |
| ANISOU | 2978 | CG | PRO | L | 14 | 7058 | 6211 | 9514 | 1578 | 958 | −453 | C |
| ATOM | 2979 | CD | PRO | L | 14 | 32.668 | −25.647 | 31.551 | 1.00 | 56.76 | | C |
| ANISOU | 2979 | CD | PRO | L | 14 | 6804 | 5703 | 9058 | 1527 | 1008 | −570 | C |
| ATOM | 2980 | N | GLY | L | 15 | 32.793 | −21.652 | 29.072 | 1.00 | 52.41 | | N |
| ANISOU | 2980 | N | GLY | L | 15 | 6192 | 5550 | 8172 | 1357 | 1036 | −733 | N |
| ATOM | 2981 | CA | GLY | L | 15 | 32.907 | −21.160 | 27.720 | 1.00 | 53.24 | | C |
| ANISOU | 2981 | CA | GLY | L | 15 | 6345 | 5690 | 8196 | 1349 | 1128 | −826 | C |
| ATOM | 2982 | C | GLY | L | 15 | 31.618 | −21.145 | 26.931 | 1.00 | 51.85 | | C |
| ANISOU | 2982 | C | GLY | L | 15 | 6319 | 5495 | 7888 | 1263 | 1114 | −945 | C |
| ATOM | 2983 | O | GLY | L | 15 | 31.553 | −20.471 | 25.900 | 1.00 | 52.99 | | O |
| ANISOU | 2983 | O | GLY | L | 15 | 6511 | 5693 | 7930 | 1236 | 1157 | −1013 | O |
| ATOM | 2984 | N | GLN | L | 16 | 30.589 | −21.856 | 27.380 | 1.00 | 47.81 | | N |
| ANISOU | 2984 | N | GLN | L | 16 | 5883 | 4907 | 7377 | 1218 | 1051 | −969 | N |
| ATOM | 2985 | CA | GLN | L | 16 | 29.300 | −21.863 | 26.708 | 1.00 | 42.59 | | C |
| ANISOU | 2985 | CA | GLN | L | 16 | 5350 | 4225 | 6608 | 1130 | 1017 | −1078 | C |
| ATOM | 2986 | C | GLN | L | 16 | 28.440 | −20.692 | 27.180 | 1.00 | 42.76 | | C |
| ANISOU | 2986 | C | GLN | L | 16 | 5346 | 4358 | 6541 | 1027 | 896 | −1050 | C |
| ATOM | 2987 | O | GLN | L | 16 | 28.837 | −19.890 | 28.028 | 1.00 | 43.00 | | O |
| ANISOU | 2987 | O | GLN | L | 16 | 5273 | 4478 | 6587 | 1022 | 842 | −952 | O |
| ATOM | 2988 | CB | GLN | L | 16 | 28.587 | −23.191 | 26.944 | 1.00 | 44.10 | | C |
| ANISOU | 2988 | CB | GLN | L | 16 | 5623 | 4272 | 6860 | 1124 | 1012 | −1119 | C |
| ATOM | 2989 | CG | GLN | L | 16 | 29.346 | −24.365 | 26.343 | 1.00 | 50.19 | | C |
| ANISOU | 2989 | CG | GLN | L | 16 | 6441 | 4918 | 7713 | 1226 | 1138 | −1166 | C |
| ATOM | 2990 | CD | GLN | L | 16 | 29.712 | −24.112 | 24.884 | 1.00 | 63.67 | | C |
| ANISOU | 2990 | CD | GLN | L | 16 | 8221 | 6641 | 9330 | 1250 | 1237 | −1273 | C |
| ATOM | 2991 | OE1 | GLN | L | 16 | 28.843 | −23.826 | 24.056 | 1.00 | 64.86 | | O |
| ANISOU | 2991 | OE1 | GLN | L | 16 | 8478 | 6805 | 9360 | 1177 | 1208 | −1375 | O |
| ATOM | 2992 | NE2 | GLN | L | 16 | 31.004 | −24.206 | 24.566 | 1.00 | 62.40 | | N |
| ANISOU | 2992 | NE2 | GLN | L | 16 | 8002 | 6478 | 9228 | 1356 | 1356 | −1246 | N |
| ATOM | 2993 | N | THR | L | 17 | 27.235 | −20.603 | 26.629 | 1.00 | 42.95 | | N |
| ANISOU | 2993 | N | THR | L | 17 | 5468 | 4373 | 6478 | 944 | 849 | −1140 | N |
| ATOM | 2994 | CA | THR | L | 17 | 26.309 | −19.531 | 26.950 | 1.00 | 39.01 | | C |
| ANISOU | 2994 | CA | THR | L | 17 | 4954 | 3969 | 5900 | 849 | 741 | −1126 | C |
| ATOM | 2995 | C | THR | L | 17 | 25.211 | −20.049 | 27.864 | 1.00 | 38.72 | | C |
| ANISOU | 2995 | C | THR | L | 17 | 4929 | 3878 | 5907 | 790 | 665 | −1109 | C |
| ATOM | 2996 | O | THR | L | 17 | 24.609 | −21.092 | 27.587 | 1.00 | 43.40 | | O |
| ANISOU | 2996 | O | THR | L | 17 | 5598 | 4358 | 6533 | 776 | 678 | −1175 | O |
| ATOM | 2997 | CB | THR | L | 17 | 25.709 | −18.939 | 25.673 | 1.00 | 40.68 | | C |
| ANISOU | 2997 | CB | THR | L | 17 | 5255 | 4218 | 5984 | 798 | 733 | −1230 | C |
| ATOM | 2998 | OG1 | THR | L | 17 | 26.771 | −18.459 | 24.840 | 1.00 | 47.54 | | O |
| ANISOU | 2998 | OG1 | THR | L | 17 | 6117 | 5136 | 6810 | 856 | 822 | −1236 | O |
| ATOM | 2999 | CG2 | THR | L | 17 | 24.769 | −17.780 | 26.012 | 1.00 | 35.28 | | C |
| ANISOU | 2999 | CG2 | THR | L | 17 | 4545 | 3631 | 5230 | 709 | 622 | −1209 | C |
| ATOM | 3000 | N | ALA | L | 18 | 24.951 | −19.313 | 28.945 | 1.00 | 37.43 | | N |
| ANISOU | 3000 | N | ALA | L | 18 | 4692 | 3789 | 5743 | 752 | 590 | −1022 | N |
| ATOM | 3001 | CA | ALA | L | 18 | 23.847 | −19.589 | 29.855 | 1.00 | 36.73 | | C |
| ANISOU | 3001 | CA | ALA | L | 18 | 4609 | 3666 | 5681 | 688 | 525 | −997 | C |
| ATOM | 3002 | C | ALA | L | 18 | 22.666 | −18.705 | 29.496 | 1.00 | 38.10 | | C |
| ANISOU | 3002 | C | ALA | L | 18 | 4803 | 3901 | 5771 | 595 | 453 | −1050 | C |
| ATOM | 3003 | O | ALA | L | 18 | 22.823 | −17.493 | 29.321 | 1.00 | 40.73 | | O |
| ANISOU | 3003 | O | ALA | L | 18 | 5102 | 4343 | 6030 | 580 | 422 | −1037 | O |
| ATOM | 3004 | CB | ALA | L | 18 | 24.239 | −19.331 | 31.312 | 1.00 | 35.32 | | C |
| ANISOU | 3004 | CB | ALA | L | 18 | 4350 | 3528 | 5544 | 708 | 491 | −869 | C |
| ATOM | 3005 | N | ARG | L | 19 | 21.485 | −19.305 | 29.419 | 1.00 | 41.42 | | N |
| ANISOU | 3005 | N | ARG | L | 19 | 5274 | 4249 | 6213 | 533 | 424 | −1106 | N |
| ATOM | 3006 | CA | ARG | L | 19 | 20.246 | −18.564 | 29.240 | 1.00 | 38.99 | | C |
| ANISOU | 3006 | CA | ARG | L | 19 | 4970 | 3990 | 5853 | 444 | 346 | −1146 | C |
| ATOM | 3007 | C | ARG | L | 19 | 19.387 | −18.800 | 30.474 | 1.00 | 38.05 | | C |
| ANISOU | 3007 | C | ARG | L | 19 | 1814 | 3843 | 5800 | 396 | 316 | −1084 | C |
| ATOM | 3008 | O | ARG | L | 19 | 19.081 | −19.951 | 30.817 | 1.00 | 37.86 | | O |

TABLE 11-continued

| | | | | | | | | | | | | |
|---|---|---|---|---|---|---|---|---|---|---|---|---|
| ANISOU | 3008 | O | ARG | L | 19 | 4816 | 3708 | 5861 | 391 | 344 | −1083 | O |
| ATOM | 3009 | CB | ARG | L | 19 | 19.540 | −18.996 | 27.952 | 1.00 | 43.45 | | C |
| ANISOU | 3009 | CB | ARG | L | 19 | 5622 | 4498 | 6389 | 404 | 330 | −1274 | C |
| ATOM | 3010 | CG | ARG | L | 19 | 20.408 | −18.782 | 26.709 | 1.00 | 44.73 | | C |
| ANISOU | 3010 | CG | ARG | L | 19 | 5840 | 4686 | 6469 | 456 | 375 | −1336 | C |
| ATOM | 3011 | CD | ARG | L | 19 | 19.726 | −19.271 | 25.440 | 1.00 | 50.86 | | C |
| ANISOU | 3011 | CD | ARG | L | 19 | 6725 | 5400 | 7200 | 419 | 352 | −1468 | C |
| ATOM | 3012 | NE | ARG | L | 19 | 18.448 | −18.591 | 25.251 | 1.00 | 59.62 | | N |
| ANISOU | 3012 | NE | ARG | L | 19 | 7830 | 6554 | 8269 | 331 | 244 | −1503 | N |
| ATOM | 3013 | CZ | ARG | L | 19 | 18.305 | −17.421 | 24.630 | 1.00 | 61.01 | | C |
| ANISOU | 3013 | CZ | ARG | L | 19 | 8011 | 6830 | 8338 | 314 | 195 | −1516 | C |
| ATOM | 3014 | NH1 | ARG | L | 19 | 19.361 | −16.800 | 24.118 | 1.00 | 55.79 | | N |
| ANISOU | 3014 | NH1 | ARG | L | 19 | 7364 | 6236 | 7597 | 372 | 252 | −1499 | N |
| ATOM | 3015 | NH2 | ARG | L | 19 | 17.101 | −16.879 | 24.510 | 1.00 | 54.03 | | N |
| ANISOU | 3015 | NH2 | ARG | L | 19 | 7116 | 5977 | 7437 | 238 | 93 | −1544 | N |
| ATOM | 3016 | N | ILE | L | 20 | 19.026 | −17.719 | 31.154 | 1.00 | 31.11 | | N |
| ANISOU | 3016 | N | ILE | L | 20 | 3879 | 3058 | 4882 | 364 | 269 | −1030 | N |
| ATOM | 3017 | CA | ILE | L | 20 | 18.235 | −17.774 | 32.381 | 1.00 | 31.41 | | C |
| ANISOU | 3017 | CA | ILE | L | 20 | 3883 | 3084 | 4966 | 323 | 253 | −964 | C |
| ATOM | 3018 | C | ILE | L | 20 | 16.939 | −17.019 | 32.131 | 1.00 | 32.32 | | C |
| ANISOU | 3018 | C | ILE | L | 20 | 3982 | 3241 | 5057 | 242 | 193 | −1011 | C |
| ATOM | 3019 | O | ILE | L | 20 | 16.961 | −15.804 | 31.915 | 1.00 | 35.45 | | O |
| ANISOU | 3019 | O | ILE | L | 20 | 4353 | 3737 | 5379 | 235 | 153 | −1012 | O |
| ATOM | 3020 | CB | ILE | L | 20 | 18.990 | −17.161 | 33.570 | 1.00 | 35.65 | | C |
| ANISOU | 3020 | CB | ILE | L | 20 | 4372 | 3692 | 5481 | 364 | 255 | −852 | C |
| ATOM | 3021 | CG1 | ILE | L | 20 | 20.256 | −17.971 | 33.875 | 1.00 | 38.43 | | C |
| ANISOU | 3021 | CG1 | ILE | L | 20 | 4727 | 3998 | 5876 | 448 | 303 | −797 | C |
| ATOM | 3022 | CG2 | ILE | L | 20 | 18.080 | −17.084 | 34.793 | 1.00 | 35.11 | | C |
| ANISOU | 3022 | CG2 | ILE | L | 20 | 4284 | 3619 | 5435 | 318 | 245 | −791 | C |
| ATOM | 3023 | CD1 | ILE | L | 20 | 21.036 | −17.406 | 35.041 | 1.00 | 38.06 | | C |
| ANISOU | 3023 | CD1 | ILE | L | 20 | 4635 | 4019 | 5808 | 488 | 286 | −689 | C |
| ATOM | 3024 | N | THR | L | 21 | 15.811 | −17.727 | 32.175 | 1.00 | 37.53 | | N |
| ANISOU | 3024 | N | THR | L | 21 | 4650 | 3819 | 5789 | 181 | 186 | −1045 | N |
| ATOM | 3025 | CA | THR | L | 21 | 14.562 | −17.099 | 31.777 | 1.00 | 36.75 | | C |
| ANISOU | 3025 | CA | THR | L | 21 | 4527 | 3751 | 5685 | 107 | 123 | −1099 | C |
| ATOM | 3026 | C | THR | L | 21 | 13.808 | −16.501 | 32.964 | 1.00 | 43.52 | | C |
| ANISOU | 3026 | C | THR | L | 21 | 5322 | 4647 | 6566 | 72 | 122 | −1026 | C |
| ATOM | 3027 | O | THR | L | 21 | 13.997 | −16.877 | 34.123 | 1.00 | 38.29 | | O |
| ANISOU | 3027 | O | THR | L | 21 | 4651 | 3961 | 5937 | 89 | 174 | −942 | O |
| ATOM | 3028 | CB | THR | L | 21 | 13.670 | −18.086 | 31.023 | 1.00 | 37.83 | | C |
| ANISOU | 3028 | CB | THR | L | 21 | 4697 | 3782 | 5895 | 50 | 101 | −1190 | C |
| ATOM | 3029 | OG1 | THR | L | 21 | 13.480 | −19.279 | 31.799 | 1.00 | 39.98 | | O |
| ANISOU | 3029 | OG1 | THR | L | 21 | 4973 | 3943 | 6273 | 39 | 159 | −1150 | O |
| ATOM | 3030 | CG2 | THR | L | 21 | 14.307 | −18.444 | 29.687 | 1.00 | 39.77 | | C |
| ANISOU | 3030 | CG2 | THR | L | 21 | 5019 | 4003 | 6088 | 81 | 93 | −1281 | C |
| ATOM | 3031 | N | CYS | L | 22 | 12.953 | −15.531 | 32.643 | 1.00 | 31.01 | | N |
| ANISOU | 3031 | N | CYS | L | 22 | 3700 | 3125 | 4957 | 28 | 64 | −1059 | N |
| ATOM | 3032 | CA | CYS | L | 22 | 12.153 | −14.807 | 33.626 | 1.00 | 34.70 | | C |
| ANISOU | 3032 | CA | CYS | L | 22 | 4107 | 3635 | 5443 | −3 | 66 | −1004 | C |
| ATOM | 3033 | C | CYS | I | 22 | 10.807 | −14.612 | 32.948 | 1.00 | 37.69 | | C |
| ANISOU | 3033 | C | CYS | I | 22 | 4446 | 4001 | 5873 | −73 | 5 | −1076 | C |
| ATOM | 3034 | O | CYS | L | 22 | 10.678 | −13.759 | 32.062 | 1.00 | 37.15 | | O |
| ANISOU | 3034 | O | CYS | L | 22 | 4375 | 3994 | 5747 | −77 | −65 | −1126 | O |
| ATOM | 3035 | CB | CYS | L | 22 | 12.787 | −13.467 | 33.994 | 1.00 | 32.88 | | C |
| ANISOU | 3035 | CB | CYS | L | 22 | 3861 | 3518 | 5115 | 36 | 53 | −958 | C |
| ATOM | 3036 | SG | CYS | L | 22 | 11.857 | −12.459 | 35.163 | 1.00 | 37.35 | | S |
| ANISOU | 3036 | SG | CYS | L | 22 | 4368 | 4137 | 5687 | 8 | 63 | −902 | S |
| ATOM | 3037 | N | GLY | L | 23 | 9.826 | −15.416 | 33.343 | 1.00 | 36.75 | | N |
| ANISOU | 3037 | N | GLY | L | 23 | 4295 | 3798 | 5868 | −128 | 29 | −1076 | N |
| ATOM | 3038 | CA | GLY | L | 23 | 8.535 | −15.411 | 32.688 | 1.00 | 38.39 | | C |
| ANISOU | 3038 | CA | GLY | L | 23 | 4453 | 3979 | 6153 | −200 | −37 | −1146 | C |
| ATOM | 3039 | C | GLY | L | 23 | 7.554 | −14.508 | 33.414 | 1.00 | 38.53 | | C |
| ANISOU | 3039 | C | GLY | L | 23 | 4383 | 4046 | 6210 | −228 | −32 | −1105 | C |
| ATOM | 3040 | O | GLY | L | 23 | 7.545 | −14.430 | 34.640 | 1.00 | 42.89 | | O |
| ANISOU | 3040 | O | GLY | L | 23 | 4916 | 4603 | 6775 | −216 | 50 | −1022 | O |
| ATOM | 3041 | N | GLY | L | 24 | 6.741 | −13.808 | 32.632 | 1.00 | 37.71 | | N |
| ANISOU | 3041 | N | GLY | L | 24 | 4231 | 3978 | 6117 | −261 | −121 | −1162 | N |
| ATOM | 3042 | CA | GLY | L | 24 | 5.681 | −13.006 | 33.209 | 1.00 | 36.77 | | C |
| ANISOU | 3042 | CA | GLY | L | 24 | 4017 | 3894 | 6060 | −288 | −118 | −1133 | C |
| ATOM | 3043 | C | GLY | L | 24 | 4.672 | −12.599 | 32.160 | 1.00 | 39.97 | | C |
| ANISOU | 3043 | C | GLY | L | 24 | 4364 | 4307 | 6514 | −332 | −235 | −1208 | C |
| ATOM | 3044 | O | GLY | L | 24 | 5.027 | −12.420 | 30.990 | 1.00 | 41.22 | | O |
| ANISOU | 3044 | O | GLY | L | 24 | 4576 | 4489 | 6596 | −321 | −328 | −1273 | O |
| ATOM | 3045 | N | ASN | L | 25 | 3.410 | −12.461 | 32.550 | 1.00 | 40.73 | | N |
| ANISOU | 3045 | N | ASN | L | 25 | 4352 | 4384 | 6740 | −381 | −233 | −1199 | N |
| ATOM | 3046 | CA | ASN | L | 25 | 2.390 | −12.097 | 31.575 | 1.00 | 42.78 | | C |
| ANISOU | 3046 | CA | ASN | L | 25 | 4543 | 4649 | 7064 | −424 | −359 | −1267 | C |
| ATOM | 3047 | C | ASN | L | 25 | 2.723 | −10.741 | 30.976 | 1.00 | 37.83 | | C |
| ANISOU | 3047 | C | ASN | L | 25 | 3938 | 4123 | 6313 | −373 | −436 | −1275 | C |
| ATOM | 3048 | O | ASN | L | 25 | 2.809 | −9.747 | 31.702 | 1.00 | 38.11 | | O |

TABLE 11-continued

| | | | | | | | | | | | |
|---|---|---|---|---|---|---|---|---|---|---|---|
| ANISOU | 3048 | O | ASN | L | 25 | 3947 | 4220 | 6313 | −333 | −384 | −1217 | O |
| ATOM | 3049 | CB | ASN | L | 25 | 1.012 | −12.071 | 32.224 | 1.00 | 51.88 | | C |
| ANISOU | 3049 | CB | ASN | L | 25 | 5554 | 5767 | 8390 | −476 | −328 | −1242 | C |
| ATOM | 3050 | CG | ASN | L | 25 | −0.067 | −11.593 | 31.266 | 1.00 | 62.47 | | C |
| ANISOU | 3050 | CG | ASN | L | 25 | 6806 | 7119 | 9811 | −515 | −471 | −1304 | C |
| ATOM | 3051 | OD1 | ASN | L | 25 | −0.334 | −12.227 | 30.243 | 1.00 | 68.85 | | O |
| ANISOU | 3051 | OD1 | ASN | L | 25 | 7628 | 7881 | 10650 | −561 | −584 | −1382 | O |
| ATOM | 3052 | ND2 | ASN | L | 25 | −0.682 | −10.467 | 31.587 | 1.00 | 66.80 | | N |
| ANISOU | 3052 | ND2 | ASN | L | 25 | 7267 | 7727 | 10389 | −493 | −473 | −1271 | N |
| ATOM | 3053 | N | ASN | L | 26 | 2.949 | −10.711 | 29.658 | 1.00 | 37.44 | | N |
| ANISOU | 3053 | N | ASN | L | 26 | 3949 | 4085 | 6190 | −373 | −554 | −1347 | N |
| ATOM | 3054 | CA | ASN | L | 26 | 3.256 | −9.467 | 28.950 | 1.00 | 41.42 | | C |
| ANISOU | 3054 | CA | ASN | L | 26 | 4486 | 4677 | 6574 | −328 | −633 | −1354 | C |
| ATOM | 3055 | C | ASN | L | 26 | 4.484 | −8.777 | 29.551 | 1.00 | 42.81 | | C |
| ANISOU | 3055 | C | ASN | L | 26 | 4725 | 4917 | 6622 | −259 | −544 | −1290 | C |
| ATOM | 3056 | O | ASN | L | 26 | 4.545 | −7.547 | 29.667 | 1.00 | 39.01 | | O |
| ANISOU | 3056 | O | ASN | L | 26 | 4229 | 4506 | 6088 | −223 | −556 | −1257 | O |
| ATOM | 3057 | CB | ASN | L | 26 | 2.038 | −8.532 | 28.958 | 1.00 | 41.50 | | C |
| ANISOU | 3057 | CB | ASN | L | 26 | 4379 | 4716 | 6673 | −343 | −700 | −1346 | C |
| ATOM | 3058 | CG | ASN | L | 26 | 2.163 | −7.389 | 27.969 | 1.00 | 53.86 | | C |
| ANISOU | 3058 | CG | ASN | L | 26 | 5981 | 6353 | 8130 | −306 | −813 | −1364 | C |
| ATOM | 3059 | OD1 | ASN | L | 26 | 2.942 | −7.453 | 27.020 | 1.00 | 64.24 | | O |
| ANISOU | 3059 | OD1 | ASN | L | 26 | 7407 | 7685 | 9315 | −287 | −864 | −1401 | O |
| ATOM | 3060 | ND2 | ASN | L | 26 | 1.380 | −6.336 | 28.183 | 1.00 | 61.22 | | N |
| ANISOU | 3060 | ND2 | ASN | L | 26 | 6821 | 7321 | 9117 | −294 | −845 | −1334 | N |
| ATOM | 3061 | N | ILE | L | 27 | 5.486 | −9.573 | 29.932 | 1.00 | 37.06 | | N |
| ANISOU | 3061 | N | ILE | L | 27 | 4068 | 4162 | 5852 | −240 | −460 | −1273 | N |
| ATOM | 3062 | CA | ILE | L | 27 | 6.657 | −8.987 | 30.573 | 1.00 | 33.87 | | C |
| ANISOU | 3062 | CA | ILE | L | 27 | 3710 | 3814 | 5343 | −180 | −384 | −1211 | C |
| ATOM | 3063 | C | ILE | L | 27 | 7.426 | −8.101 | 29.598 | 1.00 | 33.85 | | C |
| ANISOU | 3063 | C | ILE | L | 27 | 3775 | 3880 | 5208 | −140 | −444 | −1229 | C |
| ATOM | 3064 | O | ILE | L | 27 | 8.184 | −7.223 | 30.025 | 1.00 | 33.43 | | O |
| ANISOU | 3064 | O | ILE | L | 27 | 3737 | 3886 | 5079 | −97 | −408 | −1180 | O |
| ATOM | 3065 | CB | ILE | L | 27 | 7.543 | −10.091 | 31.178 | 1.00 | 34.13 | | C |
| ANISOU | 3065 | CB | ILE | L | 27 | 3795 | 3798 | 5374 | −165 | −291 | −1184 | C |
| ATOM | 3066 | CG1 | ILE | L | 27 | 8.616 | −9.484 | 32.097 | 1.00 | 35.35 | | C |
| ANISOU | 3066 | CG1 | ILE | L | 27 | 3976 | 4009 | 5446 | −109 | −218 | −1109 | C |
| ATOM | 3067 | CG2 | ILE | L | 27 | 8.194 | −10.924 | 30.071 | 1.00 | 31.68 | | C |
| ANISOU | 3067 | CG2 | ILE | L | 27 | 3570 | 3451 | 5017 | −160 | −324 | −1248 | C |
| ATOM | 3068 | CD1 | ILE | L | 27 | 9.486 | −10.540 | 32.766 | 1.00 | 35.07 | | C |
| ANISOU | 3068 | CD1 | ILE | L | 27 | 3985 | 3926 | 5414 | −87 | −136 | −1070 | C |
| ATOM | 3069 | N | GLY | L | 28 | 7.219 | −8.288 | 28.290 | 1.00 | 33.71 | | N |
| ANISOU | 3069 | N | GLY | L | 28 | 3799 | 3852 | 5158 | −156 | −538 | −1300 | N |
| ATOM | 3070 | CA | GLY | L | 28 | 7.795 | −7.380 | 27.311 | 1.00 | 37.89 | | C |
| ANISOU | 3070 | CA | GLY | L | 28 | 4393 | 4444 | 5559 | −121 | −594 | −1312 | C |
| ATOM | 3071 | C | GLY | L | 28 | 7.414 | −5.922 | 27.509 | 1.00 | 37.28 | | C |
| ANISOU | 3071 | C | GLY | L | 28 | 4266 | 4431 | 5467 | −104 | −628 | −1271 | C |
| ATOM | 3072 | O | GLY | L | 28 | 8.138 | −5.033 | 27.043 | 1.00 | 42.94 | | O |
| ANISOU | 3072 | O | GLY | L | 28 | 5035 | 5203 | 6076 | −68 | −638 | −1253 | O |
| ATOM | 3073 | N | SER | L | 29 | 6.307 | −5.654 | 28.204 | 1.00 | 38.88 | | N |
| ANISOU | 3073 | N | SER | L | 29 | 4368 | 4624 | 5782 | −129 | −635 | −1252 | N |
| ATOM | 3074 | CA | SER | L | 29 | 5.870 | −4.293 | 28.509 | 1.00 | 42.10 | | C |
| ANISOU | 3074 | CA | SER | L | 29 | 4721 | 5081 | 6193 | −108 | −656 | −1213 | C |
| ATOM | 3075 | C | SER | L | 29 | 6.626 | −3.662 | 29.673 | 1.00 | 38.72 | | C |
| ANISOU | 3075 | C | SER | L | 29 | 4295 | 4688 | 5730 | −72 | −553 | −1147 | C |
| ATOM | 3076 | O | SER | L | 29 | 6.283 | −2.542 | 30.073 | 1.00 | 41.41 | | O |
| ANISOU | 3076 | O | SER | L | 29 | 4594 | 5060 | 6078 | −54 | −555 | −1115 | O |
| ATOM | 3077 | CB | SER | L | 29 | 4.371 | −4.272 | 28.822 | 1.00 | 43.93 | | C |
| ANISOU | 3077 | CB | SER | L | 29 | 4835 | 5283 | 6571 | −144 | −692 | −1221 | C |
| ATOM | 3078 | OG | SER | L | 29 | 4.103 | −4.800 | 30.114 | 1.00 | 41.99 | | O |
| ANISOU | 3078 | OG | SER | L | 29 | 4531 | 5004 | 6420 | −159 | −583 | −1187 | O |
| ATOM | 3079 | N | LYS | L | 30 | 7.622 | −4.346 | 30.240 | 1.00 | 34.06 | | N |
| ANISOU | 3079 | N | LYS | L | 30 | 3750 | 4087 | 5105 | −60 | −469 | −1125 | N |
| ATOM | 3080 | CA | LYS | L | 30 | 8.348 | −3.841 | 31.401 | 1.00 | 36.34 | | C |
| ANISOU | 3080 | CA | LYS | L | 30 | 4044 | 4405 | 5360 | −30 | −385 | −1064 | C |
| ATOM | 3081 | C | LYS | L | 30 | 9.854 | −3.994 | 31.236 | 1.00 | 33.47 | | C |
| ANISOU | 3081 | C | LYS | L | 30 | 3755 | 4063 | 4898 | 1 | −354 | −1048 | C |
| ATOM | 3082 | O | LYS | L | 30 | 10.328 | −4.992 | 30.702 | 1.00 | 31.70 | | O |
| ANISOU | 3082 | O | LYS | L | 30 | 3573 | 3809 | 4663 | −1 | −348 | −1075 | O |
| ATOM | 3083 | CB | LYS | L | 30 | 7.927 | −4.577 | 32.675 | 1.00 | 37.85 | | C |
| ANISOU | 3083 | CB | LYS | L | 30 | 4193 | 4554 | 5634 | −47 | −301 | −1034 | C |
| ATOM | 3084 | CG | LYS | L | 30 | 6.440 | −4.460 | 33.017 | 1.00 | 38.44 | | C |
| ANISOU | 3084 | CG | LYS | L | 30 | 4177 | 4602 | 5826 | −77 | −304 | −1041 | C |
| ATOM | 3085 | CD | LYS | L | 30 | 6.062 | −5.432 | 34.126 | 1.00 | 46.41 | | C |
| ANISOU | 3085 | CD | LYS | L | 30 | 5158 | 5559 | 6918 | −100 | −209 | −1012 | C |
| ATOM | 3086 | CE | LYS | L | 30 | 4.687 | −5.088 | 34.751 | 1.00 | 50.60 | | C |
| ANISOU | 3086 | CE | LYS | L | 30 | 5589 | 6071 | 7564 | −121 | −176 | −1001 | C |
| ATOM | 3087 | NZ | LYS | L | 30 | 3.601 | −4.892 | 33.745 | 1.00 | 43.45 | | N |
| ANISOU | 3087 | NZ | LYS | L | 30 | 4607 | 5156 | 6746 | −150 | −275 | −1051 | N |
| ATOM | 3088 | N | SER | L | 31 | 10.611 | −3.002 | 31.696 | 1.00 | 32.89 | | N |

TABLE 11-continued

| | | | | | | | | | | |
|---|---|---|---|---|---|---|---|---|---|---|
| ANISOU | 3088 | N | SER | L | 31 | 3696 | 4037 | 4763 | 30 | −333 | −1006 | N |
| ATOM | 3089 | C | SER | L | 31 | 12.288 | −4.334 | 32.850 | 1.00 | 28.00 | | C |
| ANISOU | 3089 | C | SER | L | 31 | 3121 | 3396 | 4122 | 58 | −224 | −953 | C |
| ATOM | 3090 | O | SER | L | 31 | 11.724 | −4.348 | 33.946 | 1.00 | 31.69 | | O |
| ANISOU | 3090 | O | SER | L | 31 | 3558 | 3850 | 4632 | 49 | −188 | −925 | O |
| ATOM | 3091 | CA | ASER | L | 31 | 12.044 | −3.194 | 31.875 | 0.84 | 31.53 | | C |
| ANISOU | 3091 | CA | ASER | L | 31 | 3571 | 3883 | 4527 | 58 | −290 | −977 | C |
| ATOM | 3092 | CB | ASER | L | 31 | 12.712 | −1.934 | 32.436 | 0.84 | 26.53 | | C |
| ANISOU | 3092 | CB | ASER | L | 31 | 2940 | 3300 | 3842 | 78 | −282 | −933 | C |
| ATOM | 3093 | OG | ASER | L | 31 | 12.676 | −0.852 | 31.531 | 0.84 | 29.77 | | O |
| ANISOU | 3093 | OG | ASER | L | 31 | 3361 | 3742 | 4207 | 82 | −336 | −945 | O |
| ATOM | 3094 | CA | BSER | L | 31 | 12.039 | −3.211 | 31.849 | 0.16 | 29.36 | | C |
| ANISOU | 3094 | CA | BSER | L | 31 | 3296 | 3608 | 4253 | 57 | −291 | −978 | C |
| ATOM | 3095 | CB | BSER | L | 31 | 12.718 | −1.925 | 32.313 | 0.16 | 28.32 | | C |
| ANISOU | 3095 | CB | BSER | L | 31 | 3168 | 3528 | 4066 | 78 | −287 | −937 | C |
| ATOM | 3096 | OG | BSER | L | 31 | 12.209 | −1.515 | 33.569 | 0.16 | 27.48 | | O |
| ANISOU | 3096 | OG | BSER | L | 31 | 3030 | 3421 | 3991 | 75 | −258 | −908 | O |
| ATOM | 3097 | N | VAL | L | 32 | 13.164 | −5.255 | 32.485 | 1.00 | 28.99 | | N |
| ANISOU | 3097 | N | VAL | L | 32 | 3283 | 3500 | 4232 | 74 | −201 | −958 | N |
| ATOM | 3098 | CA | VAL | L | 32 | 13.572 | −6.332 | 33.382 | 1.00 | 29.61 | | C |
| ANISOU | 3098 | CA | VAL | L | 32 | 3367 | 3537 | 4346 | 85 | −141 | −925 | C |
| ATOM | 3099 | C | VAL | L | 32 | 15.016 | −6.081 | 33.797 | 1.00 | 27.60 | | C |
| ANISOU | 3099 | C | VAL | L | 32 | 3131 | 3319 | 4038 | 126 | −118 | −876 | C |
| ATOM | 3100 | O | VAL | L | 32 | 15.904 | −5.894 | 32.949 | 1.00 | 33.77 | | O |
| ANISOU | 3100 | O | VAL | L | 32 | 3932 | 4123 | 4777 | 147 | −126 | −888 | O |
| ATOM | 3101 | CB | VAL | L | 32 | 13.408 | −7.714 | 32.726 | 1.00 | 34.67 | | C |
| ANISOU | 3101 | CB | VAL | L | 32 | 4030 | 4109 | 5033 | 74 | −131 | −968 | C |
| ATOM | 3102 | CG1 | VAL | L | 32 | 13.985 | −8.807 | 33.630 | 1.00 | 35.21 | | C |
| ANISOU | 3102 | CG1 | VAL | L | 32 | 4111 | 4129 | 5137 | 94 | −67 | −923 | C |
| ATOM | 3103 | CG2 | VAL | L | 32 | 11.926 | −7.981 | 32.418 | 1.00 | 31.65 | | C |
| ANISOU | 3103 | CG2 | VAL | L | 32 | 3617 | 3687 | 4722 | 24 | −165 | −1014 | C |
| ATOM | 3104 | N | HIS | L | 33 | 15.245 | −6.034 | 35.100 | 1.00 | 28.75 | | N |
| ANISOU | 3104 | N | HIS | L | 33 | 3268 | 3469 | 4185 | 136 | −90 | −820 | N |
| ATOM | 3105 | CA | HIS | L | 33 | 16.569 | −5.819 | 35.653 | 1.00 | 28.88 | | C |
| ANISOU | 3105 | CA | HIS | L | 33 | 3294 | 3518 | 4163 | 171 | −83 | −770 | C |
| ATOM | 3106 | C | HIS | L | 33 | 17.066 | −7.130 | 36.255 | 1.00 | 33.09 | | C |
| ANISOU | 3106 | C | HIS | L | 33 | 3840 | 4001 | 4731 | 196 | −42 | −733 | C |
| ATOM | 3107 | O | HIS | L | 33 | 16.276 | −7.931 | 36.765 | 1.00 | 31.20 | | O |
| ANISOU | 3107 | O | HIS | L | 33 | 3609 | 3710 | 4537 | 180 | −11 | −727 | O |
| ATOM | 3108 | CB | HIS | L | 33 | 16.543 | −4.703 | 36.702 | 1.00 | 30.48 | | C |
| ANISOU | 3108 | CB | HIS | L | 33 | 3490 | 3765 | 4326 | 168 | −98 | −734 | C |
| ATOM | 3109 | CG | HIS | L | 33 | 15.833 | −3.466 | 36.242 | 1.00 | 32.27 | | C |
| ANISOU | 3109 | CG | HIS | L | 33 | 3703 | 4024 | 4534 | 145 | −132 | −767 | C |
| ATOM | 3110 | ND1 | HIS | L | 33 | 16.164 | −2.815 | 35.075 | 1.00 | 28.23 | | N |
| ANISOU | 3110 | ND1 | HIS | L | 33 | 3190 | 3540 | 3997 | 144 | −165 | −795 | N |
| ATOM | 3111 | CD2 | HIS | L | 33 | 14.808 | −2.765 | 36.788 | 1.00 | 30.39 | | C |
| ANISOU | 3111 | CD2 | HIS | L | 33 | 3455 | 3790 | 4301 | 126 | −132 | −773 | C |
| ATOM | 3112 | CE1 | HIS | L | 33 | 15.375 | −1.762 | 34.919 | 1.00 | 30.51 | | C |
| ANISOU | 3112 | CE1 | HIS | L | 33 | 3468 | 3847 | 4277 | 127 | −194 | −814 | C |
| ATOM | 3113 | NE2 | HIS | L | 33 | 14.527 | −1.723 | 35.931 | 1.00 | 27.83 | | N |
| ANISOU | 3113 | NE2 | HIS | L | 33 | 3119 | 3493 | 3962 | 117 | −174 | −804 | N |
| ATOM | 3114 | N | TRP | L | 34 | 18.370 | −7.371 | 36.152 | 1.00 | 31.28 | | N |
| ANISOU | 3114 | N | TRP | L | 34 | 3612 | 3783 | 4492 | 236 | −39 | −706 | N |
| ATOM | 3115 | CA | TRP | L | 34 | 18.954 | −8.646 | 36.555 | 1.00 | 32.01 | | C |
| ANISOU | 3115 | CA | TRP | L | 34 | 3716 | 3822 | 4626 | 270 | −5 | −671 | C |
| ATOM | 3116 | C | TRP | L | 34 | 20.066 | −8.413 | 37.556 | 1.00 | 34.50 | | C |
| ANISOU | 3116 | C | TRP | L | 34 | 4021 | 4170 | 4920 | 306 | −23 | −599 | C |
| ATOM | 3117 | O | TRP | L | 34 | 20.932 | −7.563 | 37.332 | 1.00 | 30.97 | | O |
| ANISOU | 3117 | O | TRP | L | 34 | 3546 | 3777 | 4444 | 317 | −53 | −591 | O |
| ATOM | 3118 | CB | TRP | L | 34 | 19.528 | −9.414 | 35.366 | 1.00 | 27.31 | | C |
| ANISOU | 3118 | CB | TRP | L | 34 | 3127 | 3192 | 4059 | 296 | 20 | −710 | C |
| ATOM | 3119 | CG | TRP | L | 34 | 18.507 | −9.980 | 34.437 | 1.00 | 31.10 | | C |
| ANISOU | 3119 | CG | TRP | L | 34 | 3631 | 3621 | 4565 | 263 | 30 | −783 | C |
| ATOM | 3120 | CD1 | TRP | L | 34 | 18.032 | −9.414 | 33.288 | 1.00 | 29.80 | | C |
| ANISOU | 3120 | CD1 | TRP | L | 34 | 3475 | 3478 | 4368 | 237 | 4 | −848 | C |
| ATOM | 3121 | CD2 | TRP | L | 34 | 17.864 | −11.252 | 34.555 | 1.00 | 30.29 | | C |
| ANISOU | 3121 | CD2 | TRP | L | 34 | 3550 | 3431 | 4526 | 252 | 61 | −797 | C |
| ATOM | 3122 | NE1 | TRP | L | 34 | 17.117 | −10.254 | 32.690 | 1.00 | 28.40 | | N |
| ANISOU | 3122 | NE1 | TRP | L | 34 | 3323 | 3237 | 4231 | 209 | 5 | −908 | N |
| ATOM | 3123 | CE2 | TRP | L | 34 | 17.003 | −11.392 | 33.446 | 1.00 | 32.60 | | C |
| ANISOU | 3123 | CE2 | TRP | L | 34 | 3860 | 3699 | 4828 | 214 | 44 | −879 | C |
| ATOM | 3124 | CE3 | TRP | L | 34 | 17.937 | −12.287 | 35.482 | 1.00 | 34.01 | | C |
| ANISOU | 3124 | CE3 | TRP | L | 34 | 4032 | 3840 | 5049 | 268 | 99 | −745 | C |
| ATOM | 3125 | CZ2 | TRP | L | 34 | 16.231 | −12.533 | 33.241 | 1.00 | 31.47 | | C |
| ANISOU | 3125 | CZ2 | TRP | L | 34 | 3738 | 3466 | 4752 | 187 | 60 | −918 | C |
| ATOM | 3126 | CZ3 | TRP | L | 34 | 17.165 | −13.432 | 35.271 | 1.00 | 31.03 | | C |
| ANISOU | 3126 | CZ3 | TRP | L | 34 | 3679 | 3371 | 4741 | 243 | 127 | −778 | C |
| ATOM | 3127 | CH2 | TRP | L | 34 | 16.323 | −13.536 | 34.170 | 1.00 | 32.61 | | C |
| ANISOU | 3127 | CH2 | TRP | L | 34 | 3888 | 3545 | 4956 | 200 | 107 | −866 | C |
| ATOM | 3128 | N | TYR | L | 35 | 20.056 | −9.190 | 38.635 | 1.00 | 33.82 | | N |

TABLE 11-continued

| | | | | | | | | | | | | |
|---|---|---|---|---|---|---|---|---|---|---|---|---|
| ANISOU | 3128 | N | TYR | L | 35 | 3956 | 4046 | 4849 | 322 | −7 | −543 | N |
| ATOM | 3129 | CA | TYR | L | 35 | 21.041 | −9.079 | 39.698 | 1.00 | 31.46 | | C |
| ANISOU | 3129 | CA | TYR | L | 35 | 3656 | 3772 | 4525 | 358 | −39 | −470 | C |
| ATOM | 3130 | C | TYR | L | 35 | 21.705 | −10.427 | 39.902 | 1.00 | 34.60 | | C |
| ANISOU | 3130 | C | TYR | L | 35 | 4061 | 4109 | 4978 | 408 | −14 | −423 | C |
| ATOM | 3131 | O | TYR | L | 35 | 21.061 | −11.476 | 39.799 | 1.00 | 32.09 | | O |
| ANISOU | 3131 | O | TYR | L | 35 | 3770 | 3717 | 4705 | 404 | 35 | −432 | O |
| ATOM | 3132 | CB | TYR | L | 35 | 20.402 | −8.617 | 41.008 | 1.00 | 26.53 | | C |
| ANISOU | 3132 | CB | TYR | L | 35 | 3071 | 3165 | 3845 | 336 | −51 | −433 | C |
| ATOM | 3133 | CG | TYR | L | 35 | 19.636 | −7.339 | 40.812 | 1.00 | 28.76 | | C |
| ANISOU | 3133 | CG | TYR | L | 35 | 3348 | 3495 | 4085 | 292 | −66 | −482 | C |
| ATOM | 3134 | CD1 | TYR | L | 35 | 20.277 | −6.111 | 40.903 | 1.00 | 28.72 | | C |
| ANISOU | 3134 | CD1 | TYR | L | 35 | 3327 | 3554 | 4032 | 289 | −122 | −483 | C |
| ATOM | 3135 | CD2 | TYR | L | 35 | 18.286 | −7.362 | 40.473 | 1.00 | 27.38 | | C |
| ANISOU | 3135 | CD2 | TYR | L | 35 | 3178 | 3294 | 3932 | 254 | −27 | −527 | C |
| ATOM | 3136 | CE1 | TYR | L | 35 | 19.583 | −4.922 | 40.701 | 1.00 | 33.88 | | C |
| ANISOU | 3136 | CE1 | TYR | L | 35 | 3979 | 4242 | 4654 | 253 | −134 | −526 | C |
| ATOM | 3137 | CE2 | TYR | L | 35 | 17.569 | −6.174 | 40.263 | 1.00 | 31.36 | | C |
| ANISOU | 3137 | CE2 | TYR | L | 35 | 3671 | 3838 | 4409 | 221 | −42 | −569 | C |
| ATOM | 3138 | CZ | TYR | L | 35 | 18.235 | −4.955 | 40.388 | 1.00 | 31.48 | | C |
| ANISOU | 3138 | CZ | TYR | L | 35 | 3679 | 3913 | 4370 | 223 | −93 | −567 | C |
| ATOM | 3139 | OH | TYR | L | 35 | 17.559 | −3.764 | 40.173 | 1.00 | 30.79 | | O |
| ANISOU | 3139 | OH | TYR | L | 35 | 3584 | 3855 | 4260 | 196 | −108 | −606 | O |
| ATOM | 3140 | N | GLN | L | 36 | 22.987 | −10.377 | 40.200 | 1.00 | 34.72 | | N |
| ANISOU | 3140 | N | GLN | L | 36 | 4045 | 4149 | 4999 | 453 | −52 | −374 | N |
| ATOM | 3141 | CA | GLN | L | 36 | 23.797 | −11.547 | 40.476 | 1.00 | 34.51 | | C |
| ANISOU | 3141 | CA | GLN | L | 36 | 4014 | 4069 | 5030 | 513 | −40 | −318 | C |
| ATOM | 3142 | C | GLN | L | 36 | 24.194 | −11.509 | 41.943 | 1.00 | 37.71 | | C |
| ANISOU | 3142 | C | GLN | L | 36 | 4444 | 4490 | 5394 | 535 | −96 | −230 | C |
| ATOM | 3143 | O | GLN | L | 36 | 24.619 | −10.460 | 42.443 | 1.00 | 32.63 | | O |
| ANISOU | 3143 | O | GLN | L | 36 | 3785 | 3917 | 4696 | 523 | −164 | −215 | O |
| ATOM | 3144 | CB | GLN | L | 36 | 25.021 | −11.533 | 39.565 | 1.00 | 31.73 | | C |
| ANISOU | 3144 | CB | GLN | L | 36 | 3595 | 3732 | 4730 | 556 | −40 | −329 | C |
| ATOM | 3145 | CG | GLN | L | 36 | 26.079 | −12.574 | 39.799 | 1.00 | 32.87 | | C |
| ANISOU | 3145 | CG | GLN | L | 36 | 3712 | 3829 | 4947 | 631 | −34 | −268 | C |
| ATOM | 3146 | CD | GLN | L | 36 | 27.387 | −12.107 | 39.186 | 1.00 | 39.24 | | C |
| ANISOU | 3146 | CD | GLN | L | 36 | 4433 | 4680 | 5797 | 666 | −48 | −266 | C |
| ATOM | 3147 | OE1 | GLN | L | 36 | 27.924 | −11.065 | 39.574 | 1.00 | 39.96 | | O |
| ANISOU | 3147 | OE1 | GLN | L | 36 | 4481 | 4844 | 5858 | 650 | −115 | −243 | O |
| ATOM | 3148 | NE2 | GLN | L | 36 | 27.862 | −12.825 | 38.190 | 1.00 | 36.24 | | N |
| ANISOU | 3148 | NE2 | GLN | L | 36 | 4028 | 4255 | 5488 | 709 | 21 | −295 | N |
| ATOM | 3149 | N | GLN | L | 37 | 24.032 | −12.633 | 42.641 | 1.00 | 35.94 | | N |
| ANISOU | 3149 | N | GLN | L | 37 | 4266 | 4198 | 5192 | 564 | −72 | −172 | N |
| ATOM | 3150 | CA | GLN | L | 37 | 24.397 | −12.709 | 44.052 | 1.00 | 34.10 | | C |
| ANISOU | 3150 | CA | GLN | L | 37 | 4074 | 3974 | 4907 | 590 | −127 | −81 | C |
| ATOM | 3151 | C | GLN | L | 37 | 25.313 | −13.908 | 44.269 | 1.00 | 40.18 | | C |
| ANISOU | 3151 | C | GLN | L | 37 | 4834 | 4683 | 5749 | 665 | −133 | −8 | C |
| ATOM | 3152 | O | GLN | L | 37 | 24.873 | −15.057 | 44.189 | 1.00 | 34.52 | | O |
| ANISOU | 3152 | O | GLN | L | 37 | 4154 | 3878 | 5084 | 681 | −67 | 6 | O |
| ATOM | 3153 | CB | GLN | L | 37 | 23.159 | −12.793 | 44.946 | 1.00 | 35.33 | | C |
| ANISOU | 3153 | CB | GLN | L | 37 | 4318 | 4107 | 4998 | 551 | −89 | −63 | C |
| ATOM | 3154 | CG | GLN | L | 37 | 23.554 | −12.694 | 46.403 | 1.00 | 37.23 | | C |
| ANISOU | 3154 | CG | GLN | L | 37 | 4620 | 4369 | 5154 | 577 | −151 | 26 | C |
| ATOM | 3155 | CD | GLN | L | 37 | 22.386 | −12.717 | 47.362 | 1.00 | 41.56 | | C |
| ANISOU | 3155 | CD | GLN | L | 37 | 5265 | 4899 | 5627 | 542 | −99 | 50 | C |
| ATOM | 3156 | OE1 | GLN | L | 37 | 21.339 | −13.296 | 47.075 | 1.00 | 41.92 | | O |
| ANISOU | 3156 | OE1 | GLN | L | 37 | 5328 | 4885 | 5714 | 512 | −6 | 28 | O |
| ATOM | 3157 | NE2 | GLN | L | 37 | 22.570 | −12.092 | 48.525 | 1.00 | 39.97 | | N |
| ANISOU | 3157 | NE2 | GLN | L | 37 | 5128 | 4746 | 5312 | 546 | −158 | 96 | N |
| ATOM | 3158 | N | LYS | L | 38 | 26.570 | −13.645 | 44.550 | 1.00 | 35.10 | | N |
| ANISOU | 3158 | N | LYS | L | 38 | 4138 | 4081 | 5117 | 711 | −214 | 39 | N |
| ATOM | 3159 | CA | LYS | L | 38 | 27.551 | −14.692 | 44.758 | 1.00 | 38.68 | | C |
| ANISOU | 3159 | CA | LYS | L | 38 | 4566 | 4482 | 5651 | 792 | −231 | 114 | C |
| ATOM | 3160 | C | LYS | L | 38 | 27.598 | −15.085 | 46.229 | 1.00 | 36.47 | | C |
| ANISOU | 3160 | C | LYS | L | 38 | 4362 | 4186 | 5308 | 820 | −291 | 218 | C |
| ATOM | 3161 | O | LYS | L | 38 | 27.071 | −14.368 | 47.079 | 1.00 | 34.02 | | O |
| ANISOU | 3161 | O | LYS | L | 38 | 4119 | 3923 | 4886 | 777 | −328 | 228 | O |
| ATOM | 3162 | CB | LYS | L | 38 | 28.918 | −14.210 | 44.280 | 1.00 | 43.16 | | C |
| ANISOU | 3162 | CB | LYS | L | 38 | 5018 | 5100 | 6279 | 830 | −290 | 116 | C |
| ATOM | 3163 | CG | LYS | L | 38 | 28.946 | −13.950 | 42.781 | 1.00 | 42.42 | | C |
| ANISOU | 3163 | CG | LYS | L | 38 | 4860 | 5012 | 6244 | 813 | −215 | 22 | C |
| ATOM | 3164 | CD | LYS | L | 38 | 30.332 | −13.600 | 42.297 | 1.00 | 47.46 | | C |
| ANISOU | 3164 | CD | LYS | L | 38 | 5380 | 5690 | 6961 | 856 | −249 | 34 | C |
| ATOM | 3165 | CE | LYS | L | 38 | 30.355 | −13.449 | 40.784 | 1.00 | 49.29 | | C |
| ANISOU | 3165 | CE | LYS | L | 38 | 5568 | 5920 | 7240 | 845 | −156 | −54 | C |
| ATOM | 3166 | NZ | LYS | L | 38 | 31.728 | −13.212 | 40.265 | 1.00 | 50.96 | | N |
| ANISOU | 3166 | NZ | LYS | L | 38 | 5658 | 6160 | 7543 | 892 | −163 | −37 | N |
| ATOM | 3167 | N | PRO | L | 39 | 28.218 | −16.219 | 46.569 | 1.00 | 37.68 | | N |
| ANISOU | 3167 | N | PRO | L | 39 | 4518 | 4270 | 5528 | 895 | −299 | 300 | N |
| ATOM | 3168 | CA | PRO | L | 39 | 28.249 | −16.636 | 47.977 | 1.00 | 39.46 | | C |

TABLE 11-continued

| | | | | | | | | | | | |
|---|---|---|---|---|---|---|---|---|---|---|---|
| ANISOU | 3168 | CA | PRO | L | 39 | 4833 | 4477 | 5683 | 925 | −358 | 410 | C |
| ATOM | 3169 | C | PRO | L | 39 | 28.868 | −15.570 | 48.866 | 1.00 | 43.64 | | C |
| ANISOU | 3169 | C | PRO | L | 39 | 5363 | 5104 | 6116 | 918 | −494 | 443 | C |
| ATOM | 3170 | O | PRO | L | 39 | 29.910 | −14.993 | 48.540 | 1.00 | 47.15 | | O |
| ANISOU | 3170 | O | PRO | L | 39 | 5703 | 5604 | 6607 | 936 | −574 | 432 | O |
| ATOM | 3171 | CB | PRO | L | 39 | 29.096 | −17.913 | 47.946 | 1.00 | 43.86 | | C |
| ANISOU | 3171 | CB | PRO | L | 39 | 5360 | 4949 | 6355 | 1019 | −359 | 487 | C |
| ATOM | 3172 | CG | PRO | L | 39 | 28.829 | −18.487 | 46.589 | 1.00 | 37.91 | | C |
| ANISOU | 3172 | CG | PRO | L | 39 | 4558 | 4131 | 5714 | 1017 | −241 | 404 | C |
| ATOM | 3173 | CD | PRO | L | 39 | 28.747 | −17.277 | 45.684 | 1.00 | 38.98 | | C |
| ANISOU | 3173 | CD | PRO | L | 39 | 4626 | 4355 | 5830 | 956 | −237 | 296 | C |
| ATOM | 3174 | N | GLY | L | 40 | 28.206 | −15.300 | 49.991 | 1.00 | 37.94 | | N |
| ANISOU | 3174 | N | GLY | L | 40 | 4760 | 4399 | 5258 | 889 | −517 | 480 | N |
| ATOM | 3175 | CA | GLY | L | 40 | 28.721 | −14.379 | 50.986 | 1.00 | 38.81 | | C |
| ANISOU | 3175 | CA | GLY | L | 40 | 4901 | 4590 | 5255 | 883 | −652 | 513 | C |
| ATOM | 3176 | C | GLY | L | 40 | 28.702 | −12.914 | 50.601 | 1.00 | 37.54 | | C |
| ANISOU | 3176 | C | GLY | L | 40 | 4691 | 4519 | 5054 | 817 | −689 | 419 | C |
| ATOM | 3177 | O | GLY | L | 40 | 29.325 | −12.109 | 51.296 | 1.00 | 45.94 | | O |
| ANISOU | 3177 | O | GLY | L | 40 | 5760 | 5647 | 6046 | 811 | −816 | 436 | O |
| ATOM | 3178 | N | GLN | L | 41 | 28.008 | −12.537 | 49.527 | 1.00 | 37.63 | | N |
| ANISOU | 3178 | N | GLN | L | 41 | 4658 | 4532 | 5107 | 766 | −588 | 321 | N |
| ATOM | 3179 | CA | GLN | L | 41 | 27.991 | −11.160 | 49.032 | 1.00 | 40.43 | | C |
| ANISOU | 3179 | CA | GLN | L | 41 | 4962 | 4963 | 5437 | 706 | −615 | 234 | C |
| ATOM | 3180 | C | GLN | L | 41 | 26.564 | −10.704 | 48.799 | 1.00 | 43.00 | | C |
| ANISOU | 3180 | C | GLN | L | 41 | 5349 | 5287 | 5703 | 641 | −513 | 161 | C |
| ATOM | 3181 | O | GLN | L | 41 | 25.649 | −11.519 | 48.655 | 1.00 | 37.02 | | O |
| ANISOU | 3181 | O | GLN | L | 41 | 4636 | 4467 | 4964 | 637 | −408 | 162 | O |
| ATOM | 3182 | CB | GLN | L | 41 | 28.749 | −10.996 | 47.703 | 1.00 | 34.85 | | C |
| ANISOU | 3182 | CB | GLN | L | 41 | 4113 | 4268 | 4858 | 714 | −602 | 185 | C |
| ATOM | 3183 | CG | GLN | L | 41 | 30.207 | −11.451 | 47.739 | 1.00 | 44.46 | | C |
| ANISOU | 3183 | CG | GLN | L | 41 | 5236 | 5484 | 6171 | 783 | −687 | 251 | C |
| ATOM | 3184 | CD | GLN | L | 41 | 30.939 | −11.128 | 46.444 | 1.00 | 54.19 | | C |
| ANISOU | 3184 | CD | GLN | L | 41 | 6331 | 6736 | 7523 | 786 | −658 | 199 | C |
| ATOM | 3185 | OE1 | GLN | L | 41 | 30.330 | −10.717 | 45.451 | 1.00 | 52.04 | | O |
| ANISOU | 3185 | OE1 | GLN | L | 41 | 6046 | 6470 | 7258 | 742 | −570 | 116 | O |
| ATOM | 3186 | NE2 | GLN | L | 41 | 32.253 | −11.307 | 46.454 | 1.00 | 63.05 | | N |
| ANISOU | 3186 | NE2 | GLN | L | 41 | 7349 | 7868 | 8741 | 840 | −732 | 251 | N |
| ATOM | 3187 | N | ALA | L | 42 | 26.403 | −9.376 | 48.718 | 1.00 | 35.92 | | N |
| ANISOU | 3187 | N | ALA | L | 42 | 4443 | 4455 | 4750 | 588 | −547 | 97 | N |
| ATOM | 3188 | CA | ALA | L | 42 | 25.161 | −8.736 | 48.341 | 1.00 | 40.90 | | C |
| ANISOU | 3188 | CA | ALA | L | 42 | 5103 | 5092 | 5344 | 529 | −462 | 19 | C |
| ATOM | 3189 | C | ALA | L | 42 | 24.931 | −8.867 | 46.839 | 1.00 | 39.40 | | C |
| ANISOU | 3189 | C | ALA | L | 42 | 4825 | 4884 | 5260 | 514 | −387 | −48 | C |
| ATOM | 3190 | O | ALA | L | 42 | 25.876 | −9.080 | 46.072 | 1.00 | 36.30 | | O |
| ANISOU | 3190 | O | ALA | L | 42 | 4345 | 4494 | 4954 | 542 | −408 | −48 | O |
| ATOM | 3191 | CB | ALA | L | 42 | 25.193 | −7.261 | 48.730 | 1.00 | 36.49 | | C |
| ANISOU | 3191 | CB | ALA | L | 42 | 4563 | 4602 | 4699 | 485 | −531 | −24 | C |
| ATOM | 3192 | N | PRO | L | 43 | 23.682 | −8.747 | 46.397 | 1.00 | 34.94 | | N |
| ANISOU | 3192 | N | PRO | L | 43 | 4284 | 4302 | 4691 | 472 | −298 | −105 | N |
| ATOM | 3193 | CA | PRO | L | 43 | 23.414 | −8.730 | 44.955 | 1.00 | 37.57 | | C |
| ANISOU | 3193 | CA | PRO | L | 43 | 4547 | 4624 | 5104 | 453 | −244 | −177 | C |
| ATOM | 3194 | C | PRO | L | 43 | 24.120 | −7.565 | 44.280 | 1.00 | 36.62 | | C |
| ANISOU | 3194 | C | PRO | L | 43 | 4358 | 4568 | 4989 | 436 | −299 | −220 | C |
| ATOM | 3195 | O | PRO | L | 43 | 24.338 | −6.509 | 44.876 | 1.00 | 37.67 | | O |
| ANISOU | 3195 | O | PRO | L | 43 | 4504 | 4751 | 5057 | 415 | −365 | −222 | O |
| ATOM | 3196 | CB | PRO | L | 43 | 21.890 | −8.567 | 44.874 | 1.00 | 35.40 | | C |
| ANISOU | 3196 | CB | PRO | L | 43 | 4315 | 4330 | 4807 | 405 | −166 | −224 | C |
| ATOM | 3197 | CG | PRO | L | 43 | 21.377 | −9.021 | 46.218 | 1.00 | 38.38 | | C |
| ANISOU | 3197 | CG | PRO | L | 43 | 4782 | 4680 | 5120 | 412 | −144 | −162 | C |
| ATOM | 3198 | CD | PRO | L | 43 | 22.443 | −8.613 | 47.188 | 1.00 | 37.69 | | C |
| ANISOU | 3198 | CD | PRO | L | 43 | 4722 | 4636 | 4961 | 441 | −243 | −107 | C |
| ATOM | 3199 | N | VAL | L | 44 | 24.460 | −7.783 | 43.018 | 1.00 | 34.48 | | N |
| ANISOU | 3199 | N | VAL | L | 44 | 4018 | 4286 | 4795 | 444 | −267 | −257 | N |
| ATOM | 3200 | CA | VAL | L | 44 | 25.095 | −6.808 | 42.140 | 1.00 | 33.63 | | C |
| ANISOU | 3200 | CA | VAL | L | 44 | 3842 | 4227 | 4707 | 428 | −293 | −296 | C |
| ATOM | 3201 | C | VAL | L | 44 | 24.272 | −6.755 | 40.858 | 1.00 | 31.24 | | C |
| ANISOU | 3201 | C | VAL | L | 44 | 3533 | 3909 | 4425 | 401 | −222 | −369 | C |
| ATOM | 3202 | O | VAL | L | 44 | 23.907 | −7.801 | 40.315 | 1.00 | 34.64 | | O |
| ANISOU | 3202 | O | VAL | L | 44 | 3974 | 4286 | 4901 | 418 | −162 | −384 | O |
| ATOM | 3203 | CB | VAL | L | 44 | 26.549 | −7.214 | 41.825 | 1.00 | 36.75 | | C |
| ANISOU | 3203 | CB | VAL | L | 44 | 4159 | 4625 | 5178 | 477 | −320 | −257 | C |
| ATOM | 3204 | CG1 | VAL | L | 44 | 27.093 | −6.399 | 40.679 | 1.00 | 46.19 | | C |
| ANISOU | 3204 | CG1 | VAL | L | 44 | 5284 | 5858 | 6409 | 460 | −310 | −300 | C |
| ATOM | 3205 | CG2 | VAL | L | 44 | 27.420 | −7.092 | 43.080 | 1.00 | 37.09 | | C |
| ANISOU | 3205 | CG2 | VAL | L | 44 | 4199 | 4693 | 5201 | 499 | −419 | −185 | C |
| ATOM | 3206 | N | MET | L | 45 | 23.972 | −5.554 | 40.376 | 1.00 | 29.25 | | N |
| ANISOU | 3206 | N | MET | L | 45 | 3271 | 3700 | 4142 | 360 | −235 | −416 | N |
| ATOM | 3207 | CA | MET | L | 45 | 23.262 | −5.447 | 39.103 | 1.00 | 27.13 | | C |
| ANISOU | 3207 | CA | MET | L | 45 | 3000 | 3422 | 3888 | 338 | −185 | −481 | C |
| ATOM | 3208 | C | MET | L | 45 | 24.192 | −5.826 | 37.957 | 1.00 | 32.04 | | C |

TABLE 11-continued

| | | | | | | | | | | | |
|---|---|---|---|---|---|---|---|---|---|---|---|
| ANISOU | 3208 | C | MET | L | 45 | 3572 | 4038 | 4563 | 367 | −155 | −491 | C |
| ATOM | 3209 | O | MET | L | 45 | 25.300 | −5.304 | 37.847 | 1.00 | 30.14 | | O |
| ANISOU | 3209 | O | MET | L | 45 | 3280 | 3832 | 4341 | 379 | −181 | −467 | O |
| ATOM | 3210 | CB | MET | L | 45 | 22.724 | −4.029 | 38.899 | 1.00 | 28.62 | | C |
| ANISOU | 3210 | CB | MET | L | 45 | 3193 | 3652 | 4029 | 292 | −210 | −519 | C |
| ATOM | 3211 | CG | MET | L | 45 | 22.126 | −3.800 | 37.496 | 1.00 | 31.30 | | C |
| ANISOU | 3211 | CG | MET | L | 45 | 3528 | 3988 | 4376 | 273 | −175 | −579 | C |
| ATOM | 3212 | SD | MET | L | 45 | 21.689 | −2.053 | 37.225 | 1.00 | 32.99 | | S |
| ANISOU | 3212 | SD | MET | L | 45 | 3743 | 4247 | 4543 | 229 | −212 | −610 | S |
| ATOM | 3213 | CE | MET | L | 45 | 20.192 | −1.960 | 38.199 | 1.00 | 29.08 | | C |
| ANISOU | 3213 | CE | MET | L | 45 | 3293 | 3734 | 4022 | 207 | −209 | −623 | C |
| ATOM | 3214 | N | VAL | L | 46 | 23.750 | −6.738 | 37.094 | 1.00 | 30.20 | | N |
| ANISOU | 3214 | N | VAL | L | 46 | 3358 | 3758 | 4359 | 378 | −96 | −528 | N |
| ATOM | 3215 | CA | VAL | L | 46 | 24.539 | −7.100 | 35.933 | 1.00 | 27.40 | | C |
| ANISOU | 3215 | CA | VAL | L | 46 | 2975 | 3394 | 4044 | 409 | −52 | −548 | C |
| ATOM | 3216 | C | VAL | L | 46 | 23.894 | −6.653 | 34.626 | 1.00 | 30.08 | | C |
| ANISOU | 3216 | C | VAL | L | 46 | 3340 | 3740 | 4350 | 379 | −25 | −619 | C |
| ATOM | 3217 | O | VAL | L | 46 | 24.617 | −6.369 | 33.659 | 1.00 | 35.15 | | O |
| ANISOU | 3217 | O | VAL | L | 46 | 3961 | 4400 | 4995 | 393 | 5 | −632 | O |
| ATOM | 3218 | CB | VAL | L | 46 | 24.850 | −8.621 | 35.902 | 1.00 | 28.58 | | C |
| ANISOU | 3218 | CB | VAL | L | 46 | 3131 | 3473 | 4254 | 460 | −4 | −535 | C |
| ATOM | 3219 | CG1 | VAL | L | 46 | 25.720 | −8.994 | 37.080 | 1.00 | 30.00 | | C |
| ANISOU | 3219 | CG1 | VAL | L | 46 | 3278 | 3651 | 4468 | 500 | −39 | −455 | C |
| ATOM | 3220 | CG2 | VAL | L | 46 | 23.575 | −9.468 | 35.891 | 1.00 | 32.08 | | C |
| ANISOU | 3220 | CG2 | VAL | L | 46 | 3636 | 3855 | 4698 | 439 | 22 | −572 | C |
| ATOM | 3221 | N | VAL | L | 47 | 22.571 | −6.599 | 34.553 | 1.00 | 32.60 | | N |
| ANISOU | 3221 | N | VAL | L | 47 | 3703 | 4044 | 4641 | 341 | −34 | −660 | N |
| ATOM | 3222 | CA | VAL | L | 47 | 21.870 | −6.113 | 33.368 | 1.00 | 33.19 | | C |
| ANISOU | 3222 | CA | VAL | L | 47 | 3805 | 4128 | 4680 | 312 | −31 | −723 | C |
| ATOM | 3223 | C | VAL | L | 47 | 20.686 | −5.287 | 33.842 | 1.00 | 32.65 | | C |
| ANISOU | 3223 | C | VAL | L | 47 | 3746 | 4077 | 4580 | 266 | −75 | −734 | C |
| ATOM | 3224 | O | VAL | L | 47 | 20.021 | −5.649 | 34.821 | 1.00 | 30.55 | | O |
| ANISOU | 3224 | O | VAL | L | 47 | 3487 | 3790 | 4332 | 256 | −80 | −718 | O |
| ATOM | 3225 | CB | VAL | L | 47 | 21.390 | −7.264 | 32.455 | 1.00 | 30.69 | | C |
| ANISOU | 3225 | CB | VAL | L | 47 | 3531 | 3750 | 4381 | 320 | 9 | −779 | C |
| ATOM | 3226 | CG1 | VAL | L | 47 | 20.532 | −6.711 | 31.327 | 1.00 | 36.16 | | C |
| ANISOU | 3226 | CG1 | VAL | L | 47 | 4259 | 4454 | 5024 | 286 | −12 | −843 | C |
| ATOM | 3227 | CG2 | VAL | L | 47 | 22.572 | −8.037 | 31.872 | 1.00 | 30.84 | | C |
| ANISOU | 3227 | CG2 | VAL | L | 47 | 3544 | 3744 | 4428 | 373 | 67 | −776 | C |
| ATOM | 3228 | N | TYR | L | 48 | 20.414 | −4.173 | 33.158 | 1.00 | 30.13 | | N |
| ANISOU | 3228 | N | TYR | L | 48 | 3432 | 3797 | 4221 | 242 | −100 | −758 | N |
| ATOM | 3229 | CA | TYR | L | 48 | 19.201 | −3.410 | 33.450 | 1.00 | 27.10 | | C |
| ANISOU | 3229 | CA | TYR | L | 48 | 3055 | 3423 | 3820 | 206 | −137 | −776 | C |
| ATOM | 3230 | C | TYR | L | 48 | 18.468 | −3.135 | 32.139 | 1.00 | 29.91 | | C |
| ANISOU | 3230 | C | TYR | L | 48 | 3435 | 3777 | 4151 | 188 | −154 | −830 | C |
| ATOM | 3231 | O | TYR | L | 48 | 19.065 | −3.181 | 31.060 | 1.00 | 30.99 | | O |
| ANISOU | 3231 | O | TYR | L | 48 | 3593 | 3921 | 4261 | 202 | −137 | −848 | O |
| ATOM | 3232 | CB | TYR | L | 48 | 19.525 | −2.112 | 34.211 | 1.00 | 27.95 | | C |
| ANISOU | 3232 | CB | TYR | L | 48 | 3143 | 3576 | 3901 | 195 | −170 | −741 | C |
| ATOM | 3233 | CG | TYR | L | 48 | 20.300 | −1.085 | 33.411 | 1.00 | 33.66 | | C |
| ANISOU | 3233 | CG | TYR | L | 48 | 3858 | 4336 | 4596 | 193 | −180 | −736 | C |
| ATOM | 3234 | CD1 | TYR | L | 48 | 19.631 | −0.133 | 32.641 | 1.00 | 35.73 | | C |
| ANISOU | 3234 | CD1 | TYR | L | 48 | 4137 | 4612 | 4828 | 172 | −205 | −763 | C |
| ATOM | 3235 | CD2 | TYR | L | 48 | 21.701 | −1.038 | 33.449 | 1.00 | 38.78 | | C |
| ANISOU | 3235 | CD2 | TYR | L | 48 | 4475 | 5003 | 5256 | 212 | −166 | −699 | C |
| ATOM | 3236 | CE1 | TYR | L | 48 | 20.322 | 0.821 | 31.910 | 1.00 | 32.42 | | C |
| ANISOU | 3236 | CE1 | TYR | L | 48 | 3717 | 4220 | 4381 | 168 | −207 | −751 | C |
| ATOM | 3237 | CE2 | TYR | L | 48 | 22.420 | −0.061 | 32.717 | 1.00 | 34.23 | | C |
| ANISOU | 3237 | CE2 | TYR | L | 48 | 3886 | 4457 | 4664 | 204 | −165 | −689 | C |
| ATOM | 3238 | CZ | TYR | L | 48 | 21.708 | 0.864 | 31.955 | 1.00 | 35.46 | | C |
| ANISOU | 3238 | CZ | TYR | L | 48 | 4072 | 4622 | 4781 | 181 | −182 | −714 | C |
| ATOM | 3239 | OH | TYR | L | 48 | 22.347 | 1.831 | 31.210 | 1.00 | 37.82 | | O |
| ANISOU | 3239 | OH | TYR | L | 48 | 4366 | 4943 | 5061 | 171 | −174 | −698 | O |
| ATOM | 3240 | N | ASP | L | 49 | 17.157 | −2.881 | 32.240 | 1.00 | 31.84 | | N |
| ANISOU | 3240 | N | ASP | L | 49 | 3680 | 4012 | 4407 | 160 | −185 | −856 | N |
| ATOM | 3241 | CA | ASP | L | 49 | 16.318 | −2.623 | 31.065 | 1.00 | 31.35 | | C |
| ANISOU | 3241 | CA | ASP | L | 49 | 3640 | 3947 | 4326 | 143 | −222 | −906 | C |
| ATOM | 3242 | C | ASP | L | 49 | 16.537 | −3.681 | 29.975 | 1.00 | 37.21 | | C |
| ANISOU | 3242 | C | ASP | L | 49 | 4423 | 4657 | 5059 | 153 | −205 | −950 | C |
| ATOM | 3243 | O | ASP | L | 49 | 16.814 | −3.369 | 28.816 | 1.00 | 33.93 | | O |
| ANISOU | 3243 | O | ASP | L | 49 | 4048 | 4258 | 4588 | 159 | −215 | −974 | O |
| ATOM | 3244 | CB | ASP | L | 49 | 16.571 | −1.213 | 30.512 | 1.00 | 26.09 | | C |
| ANISOU | 3244 | CB | ASP | L | 49 | 2981 | 3326 | 3606 | 141 | −252 | −894 | C |
| ATOM | 3245 | CG | ASP | L | 49 | 15.531 | −0.805 | 29.462 | 1.00 | 32.54 | | C |
| ANISOU | 3245 | CG | ASP | L | 49 | 3821 | 4142 | 4403 | 125 | −308 | −936 | C |
| ATOM | 3246 | OD1 | ASP | L | 49 | 14.342 | −1.133 | 29.653 | 1.00 | 36.76 | | O |
| ANISOU | 3246 | OD1 | ASP | L | 49 | 4334 | 4650 | 4984 | 106 | −338 | −963 | O |
| ATOM | 3247 | OD2 | ASP | L | 49 | 15.895 | −0.160 | 28.469 | 1.00 | 37.01 | | O |
| ANISOU | 3247 | OD2 | ASP | L | 49 | 4423 | 4730 | 4909 | 132 | −323 | −937 | O |
| ATOM | 3248 | N | ASP | L | 50 | 16.467 | −4.954 | 30.381 | 1.00 | 30.02 | | N |

TABLE 11-continued

| | | | | | | | | | | | |
|---|---|---|---|---|---|---|---|---|---|---|---|
| ANISOU | 3248 | N | ASP | L | 50 | 3512 | 3697 | 4199 | 156 | −173 | −959 | N |
| ATOM | 3249 | CA | ASP | L | 50 | 16.526 | −6.119 | 29.490 | 1.00 | 30.55 | | C |
| ANISOU | 3249 | CA | ASP | L | 50 | 3623 | 3714 | 4271 | 163 | −156 | −1010 | C |
| ATOM | 3250 | C | ASP | L | 50 | 17.917 | −6.458 | 28.986 | 1.00 | 32.89 | | C |
| ANISOU | 3250 | C | ASP | L | 50 | 3946 | 4014 | 4536 | 207 | −98 | −1001 | C |
| ATOM | 3251 | O | ASP | L | 50 | 18.262 | −7.640 | 28.898 | 1.00 | 31.77 | | O |
| ANISOU | 3251 | O | ASP | L | 50 | 3824 | 3819 | 4427 | 228 | −55 | −1019 | O |
| ATOM | 3252 | CB | ASP | L | 50 | 15.651 | −5.962 | 28.239 | 1.00 | 31.25 | | C |
| ANISOU | 3252 | CB | ASP | L | 50 | 3753 | 3798 | 4324 | 138 | −214 | −1077 | C |
| ATOM | 3253 | CG | ASP | L | 50 | 14.248 | −5.483 | 28.548 | 1.00 | 34.38 | | C |
| ANISOU | 3253 | CG | ASP | L | 50 | 4109 | 4194 | 4759 | 98 | −279 | −1087 | C |
| ATOM | 3254 | OD1 | ASP | L | 50 | 13.759 | −5.736 | 29.663 | 1.00 | 32.53 | | O |
| ANISOU | 3254 | OD1 | ASP | L | 50 | 3825 | 3940 | 4594 | 84 | −261 | −1060 | O |
| ATOM | 3255 | OD2 | ASP | L | 50 | 13.630 | −4.885 | 27.646 | 1.00 | 32.25 | | O |
| ANISOU | 3255 | OD2 | ASP | L | 50 | 3859 | 3942 | 4452 | 83 | −344 | −1120 | O |
| ATOM | 3256 | N | ASN | L | 51 | 18.701 | −5.448 | 28.592 | 1.00 | 33.32 | | N |
| ANISOU | 3256 | N | ASN | L | 51 | 4000 | 4123 | 4537 | 222 | −92 | −976 | N |
| ATOM | 3257 | CA | ASN | L | 51 | 19.880 | −5.735 | 27.783 | 1.00 | 35.50 | | C |
| ANISOU | 3257 | CA | ASN | L | 51 | 4305 | 4401 | 4783 | 261 | −30 | −979 | C |
| ATOM | 3258 | C | ASN | L | 51 | 20.980 | −4.690 | 27.921 | 1.00 | 34.15 | | C |
| ANISOU | 3258 | C | ASN | L | 51 | 4096 | 4286 | 4594 | 276 | −6 | −920 | C |
| ATOM | 3259 | O | ASN | L | 51 | 21.910 | −4.698 | 27.111 | 1.00 | 39.43 | | O |
| ANISOU | 3259 | O | ASN | L | 51 | 4784 | 4964 | 5235 | 305 | 52 | −920 | O |
| ATOM | 3260 | CB | ASN | L | 51 | 19.478 | −5.881 | 26.303 | 1.00 | 40.20 | | C |
| ANISOU | 3260 | CB | ASN | L | 51 | 4984 | 4983 | 5307 | 256 | −38 | −1048 | C |
| ATOM | 3261 | CG | ASN | L | 51 | 18.752 | −4.644 | 25.750 | 1.00 | 50.20 | | C |
| ANISOU | 3261 | CG | ASN | L | 51 | 6270 | 6293 | 6510 | 226 | −107 | −1054 | C |
| ATOM | 3262 | OD1 | ASN | L | 51 | 18.836 | −3.551 | 26.306 | 1.00 | 40.99 | | O |
| ANISOU | 3262 | OD1 | ASN | L | 51 | 5057 | 5170 | 5346 | 216 | −127 | −1003 | O |
| ATOM | 3263 | ND2 | ASN | L | 51 | 18.039 | −4.824 | 24.642 | 1.00 | 60.26 | | N |
| ANISOU | 3263 | ND2 | ASN | L | 51 | 7618 | 7552 | 7726 | 213 | −149 | −1116 | N |
| ATOM | 3264 | N | ASP | L | 52 | 20.924 | −3.802 | 28.895 | 1.00 | 30.66 | | N |
| ANISOU | 3264 | N | ASP | L | 52 | 3602 | 3878 | 4169 | 257 | −43 | −873 | N |
| ATOM | 3265 | CA | ASP | L | 52 | 21.986 | −2.826 | 29.084 | 1.00 | 30.97 | | C |
| ANISOU | 3265 | CA | ASP | L | 52 | 3600 | 3962 | 4204 | 264 | −29 | −819 | C |
| ATOM | 3266 | C | ASP | L | 52 | 22.854 | −3.211 | 30.268 | 1.00 | 36.53 | | C |
| ANISOU | 3266 | C | ASP | L | 52 | 4241 | 4665 | 4972 | 285 | −17 | −767 | C |
| ATOM | 3267 | O | ASP | L | 52 | 22.394 | −3.832 | 31.228 | 1.00 | 34.05 | | O |
| ANISOU | 3267 | O | ASP | L | 52 | 3919 | 4327 | 4691 | 284 | −37 | −761 | O |
| ATOM | 3268 | CB | ASP | L | 52 | 21.411 | −1.433 | 29.285 | 1.00 | 30.95 | | C |
| ANISOU | 3268 | CB | ASP | L | 52 | 3592 | 3995 | 4172 | 228 | −87 | −806 | C |
| ATOM | 3269 | CG | ASP | L | 52 | 20.636 | −0.970 | 28.069 | 1.00 | 42.66 | | C |
| ANISOU | 3269 | CG | ASP | L | 52 | 5136 | 5482 | 5591 | 213 | −110 | −845 | C |
| ATOM | 3270 | OD1 | ASP | L | 52 | 21.239 | −0.944 | 26.985 | 1.00 | 40.14 | | O |
| ANISOU | 3270 | OD1 | ASP | L | 52 | 4854 | 5169 | 5227 | 229 | −67 | −852 | O |
| ATOM | 3271 | OD2 | ASP | L | 52 | 19.430 | −0.677 | 28.187 | 1.00 | 44.15 | | O |
| ANISOU | 3271 | OD2 | ASP | L | 52 | 5335 | 5664 | 5774 | 189 | −169 | −869 | O |
| ATOM | 3272 | N | ARG | L | 53 | 24.124 | −2.841 | 30.181 | 1.00 | 30.50 | | N |
| ANISOU | 3272 | N | ARG | L | 53 | 3434 | 3927 | 4228 | 303 | 16 | −727 | N |
| ATOM | 3273 | CA | ARG | L | 53 | 25.107 | −3.182 | 31.198 | 1.00 | 37.29 | | C |
| ANISOU | 3273 | CA | ARG | L | 53 | 4226 | 4788 | 5153 | 327 | 16 | −674 | C |
| ATOM | 3274 | C | ARG | L | 53 | 25.507 | −1.964 | 31.998 | 1.00 | 39.82 | | C |
| ANISOU | 3274 | C | ARG | L | 53 | 4500 | 5151 | 5479 | 298 | −39 | −629 | C |
| ATOM | 3275 | O | ARG | L | 53 | 25.828 | −0.930 | 31.399 | 1.00 | 35.16 | | O |
| ANISOU | 3275 | O | ARG | L | 53 | 3901 | 4589 | 4870 | 277 | −34 | −623 | O |
| ATOM | 3276 | CB | ARG | L | 53 | 26.352 | −3.779 | 30.545 | 1.00 | 35.74 | | C |
| ANISOU | 3276 | CB | ARG | L | 53 | 3997 | 4582 | 5000 | 375 | 94 | −659 | C |
| ATOM | 3277 | CG | ARG | L | 53 | 26.151 | −5.178 | 30.066 | 1.00 | 37.98 | | C |
| ANISOU | 3277 | CG | ARG | L | 53 | 4324 | 4811 | 5296 | 413 | 148 | −699 | C |
| ATOM | 3278 | CD | ARG | L | 53 | 27.369 | −5.647 | 29.290 | 1.00 | 38.52 | | C |
| ANISOU | 3278 | CD | ARG | L | 53 | 4363 | 4868 | 5403 | 465 | 241 | −690 | C |
| ATOM | 3279 | NE | ARG | L | 53 | 27.533 | −4.849 | 28.084 | 1.00 | 52.88 | | N |
| ANISOU | 3279 | NE | ARG | L | 53 | 6213 | 6715 | 7162 | 452 | 288 | −710 | N |
| ATOM | 3280 | CZ | ARG | L | 53 | 26.867 | −5.067 | 26.956 | 1.00 | 69.46 | | C |
| ANISOU | 3280 | CZ | ARG | L | 53 | 8410 | 8797 | 9185 | 449 | 319 | −774 | C |
| ATOM | 3281 | NH1 | ARG | L | 53 | 26.000 | −6.070 | 26.879 | 1.00 | 63.60 | | N |
| ANISOU | 3281 | NH1 | ARG | L | 53 | 7731 | 8006 | 8429 | 453 | 305 | −829 | N |
| ATOM | 3282 | NH2 | ARG | L | 53 | 27.073 | −4.286 | 25.904 | 1.00 | 79.88 | | N |
| ANISOU | 3282 | NH2 | ARG | L | 53 | 9766 | 10145 | 10440 | 439 | 361 | −780 | N |
| ATOM | 3283 | N | PRO | L | 54 | 25.550 | −2.051 | 33.331 | 1.00 | 35.97 | | N |
| ANISOU | 3283 | N | PRO | L | 54 | 3987 | 4665 | 5015 | 296 | −92 | −597 | N |
| ATOM | 3284 | CA | PRO | L | 54 | 26.269 | −1.035 | 34.103 | 1.00 | 41.78 | | C |
| ANISOU | 3284 | CA | PRO | L | 54 | 4674 | 5435 | 5766 | 274 | −146 | −555 | C |
| ATOM | 3285 | C | PRO | L | 54 | 27.717 | −0.983 | 33.655 | 1.00 | 39.46 | | C |
| ANISOU | 3285 | C | PRO | L | 54 | 4304 | 5156 | 5534 | 294 | −112 | −519 | C |
| ATOM | 3286 | O | PRO | L | 54 | 28.258 | −1.957 | 33.137 | 1.00 | 36.48 | | O |
| ANISOU | 3286 | O | PRO | L | 54 | 3907 | 4758 | 5197 | 339 | −50 | −515 | O |
| ATOM | 3287 | CB | PRO | L | 54 | 26.158 | −1.531 | 35.552 | 1.00 | 38.06 | | C |
| ANISOU | 3287 | CB | PRO | L | 54 | 4205 | 4956 | 5302 | 283 | −199 | −528 | C |
| ATOM | 3288 | CG | PRO | L | 54 | 25.011 | −2.482 | 35.555 | 1.00 | 32.69 | | C |

TABLE 11-continued

| | | | | | | | | | | | | |
|---|---|---|---|---|---|---|---|---|---|---|---|---|
| ANISOU | 3288 | CG | PRO | L | 54 | 3583 | 4237 | 4600 | 293 | −172 | −559 | C |
| ATOM | 3289 | CD | PRO | L | 54 | 25.017 | −3.117 | 34.193 | 1.00 | 31.97 | | C |
| ANISOU | 3289 | CD | PRO | L | 54 | 3503 | 4124 | 4521 | 314 | −102 | −594 | C |
| ATOM | 3290 | N | SER | L | 55 | 28.346 | 0.173 | 33.847 | 1.00 | 41.43 | | N |
| ANISOU | 3290 | N | SER | L | 55 | 4508 | 5435 | 5800 | 260 | −149 | −493 | N |
| ATOM | 3291 | CA | SER | L | 55 | 29.765 | 0.251 | 33.552 | 1.00 | 51.42 | | C |
| ANISOU | 3291 | CA | SER | L | 55 | 5681 | 6713 | 7145 | 274 | −120 | −450 | C |
| ATOM | 3292 | C | SER | L | 55 | 30.512 | −0.705 | 34.475 | 1.00 | 49.61 | | C |
| ANISOU | 3292 | C | SER | L | 55 | 5392 | 6475 | 6984 | 317 | −151 | −410 | C |
| ATOM | 3293 | O | SER | L | 55 | 30.166 | −0.864 | 35.650 | 1.00 | 49.61 | | O |
| ANISOU | 3293 | O | SER | L | 55 | 5415 | 6473 | 6963 | 313 | −230 | −400 | O |
| ATOM | 3294 | CB | SER | L | 55 | 30.275 | 1.683 | 33.717 | 1.00 | 60.38 | | C |
| ANISOU | 3294 | CB | SER | L | 55 | 6772 | 7873 | 8298 | 220 | −166 | −428 | C |
| ATOM | 3295 | OG | SER | L | 55 | 30.530 | 1.977 | 35.075 | 1.00 | 62.71 | | O |
| ANISOU | 3295 | OG | SER | L | 55 | 7039 | 8177 | 8610 | 201 | −270 | −405 | O |
| ATOM | 3296 | N | GLY | L | 56 | 31.508 | −1.379 | 33.931 | 1.00 | 48.46 | | N |
| ANISOU | 3296 | N | GLY | L | 56 | 5177 | 6320 | 6916 | 363 | −85 | −386 | N |
| ATOM | 3297 | CA | GLY | L | 56 | 32.273 | −2.332 | 34.687 | 1.00 | 47.87 | | C |
| ANISOU | 3297 | CA | GLY | L | 56 | 5039 | 6232 | 6919 | 414 | −111 | −342 | C |
| ATOM | 3298 | C | GLY | L | 56 | 31.795 | −3.764 | 34.556 | 1.00 | 47.36 | | C |
| ANISOU | 3298 | C | GLY | L | 56 | 5028 | 6121 | 6847 | 471 | −58 | −360 | C |
| ATOM | 3299 | O | GLY | L | 56 | 32.546 | −4.677 | 34.904 | 1.00 | 51.59 | | O |
| ANISOU | 3299 | O | GLY | L | 56 | 5506 | 6634 | 7460 | 528 | −54 | −321 | O |
| ATOM | 3300 | N | ILE | L | 57 | 30.576 | −3.982 | 34.063 | 1.00 | 41.78 | | N |
| ANISOU | 3300 | N | ILE | L | 57 | 4424 | 5394 | 6057 | 457 | −24 | −417 | N |
| ATOM | 3301 | CA | ILE | L | 57 | 30.098 | −5.347 | 33.830 | 1.00 | 38.16 | | C |
| ANISOU | 3301 | CA | ILE | L | 57 | 4019 | 4881 | 5599 | 503 | 29 | −443 | C |
| ATOM | 3302 | C | ILE | L | 57 | 30.635 | −5.826 | 32.484 | 1.00 | 42.95 | | C |
| ANISOU | 3302 | C | ILE | L | 57 | 4616 | 5467 | 6237 | 544 | 145 | −469 | C |
| ATOM | 3303 | O | ILE | L | 57 | 30.494 | −5.104 | 31.480 | 1.00 | 42.19 | | O |
| ANISOU | 3303 | O | ILE | L | 57 | 4545 | 5392 | 6094 | 516 | 190 | −502 | O |
| ATOM | 3304 | CB | ILE | L | 57 | 28.568 | −5.411 | 33.865 | 1.00 | 35.78 | | C |
| ANISOU | 3304 | CB | ILE | L | 57 | 3821 | 4563 | 5211 | 467 | 13 | −495 | C |
| ATOM | 3305 | CG1 | ILE | L | 57 | 28.051 | −5.091 | 35.267 | 1.00 | 37.86 | | C |
| ANISOU | 3305 | CG1 | ILE | L | 57 | 4100 | 4840 | 5445 | 439 | −80 | −467 | C |
| ATOM | 3306 | CG2 | ILE | L | 57 | 28.098 | −6.787 | 33.459 | 1.00 | 33.46 | | C |
| ANISOU | 3306 | CG2 | ILE | L | 57 | 3580 | 4206 | 4928 | 505 | 72 | −528 | C |
| ATOM | 3307 | CD1 | ILE | L | 57 | 28.600 | −6.011 | 36.360 | 1.00 | 40.02 | | C |
| ANISOU | 3307 | CD1 | ILE | L | 57 | 4348 | 5089 | 5769 | 484 | −114 | −409 | C |
| ATOM | 3308 | N | PRO | L | 58 | 31.226 | −7.020 | 32.418 | 1.00 | 37.35 | | N |
| ANISOU | 3308 | N | PRO | L | 58 | 3880 | 4711 | 5599 | 611 | 199 | −456 | N |
| ATOM | 3309 | CA | PRO | L | 58 | 31.731 | −7.527 | 31.138 | 1.00 | 47.30 | | C |
| ANISOU | 3309 | CA | PRO | L | 58 | 5144 | 5944 | 6883 | 657 | 324 | −488 | C |
| ATOM | 3310 | C | PRO | L | 58 | 30.660 | −7.551 | 30.054 | 1.00 | 44.82 | | C |
| ANISOU | 3310 | C | PRO | L | 58 | 4950 | 5614 | 6466 | 630 | 371 | −570 | C |
| ATOM | 3311 | O | PRO | L | 58 | 29.473 | −7.778 | 30.311 | 1.00 | 37.17 | | O |
| ANISOU | 3311 | O | PRO | L | 58 | 4059 | 4625 | 5437 | 598 | 321 | −608 | O |
| ATOM | 3312 | CB | PRO | L | 58 | 32.199 | −8.950 | 31.478 | 1.00 | 47.23 | | C |
| ANISOU | 3312 | CB | PRO | L | 58 | 5113 | 5871 | 6961 | 734 | 357 | −468 | C |
| ATOM | 3313 | CG | PRO | L | 58 | 32.434 | −8.945 | 32.934 | 1.00 | 46.20 | | C |
| ANISOU | 3313 | CG | PRO | L | 58 | 4925 | 5754 | 6876 | 734 | 246 | −397 | C |
| ATOM | 3314 | CD | PRO | L | 58 | 31.469 | −7.964 | 33.524 | 1.00 | 38.93 | | C |
| ANISOU | 3314 | CD | PRO | L | 58 | 4055 | 4878 | 5860 | 655 | 152 | −408 | C |
| ATOM | 3315 | N | GLU | L | 59 | 31.124 | −7.356 | 28.822 | 1.00 | 46.27 | | N |
| ANISOU | 3315 | N | GLU | L | 59 | 5146 | 5803 | 6633 | 646 | 470 | −597 | N |
| ATOM | 3316 | CA | GLU | L | 59 | 30.277 | −7.317 | 27.639 | 1.00 | 48.46 | | C |
| ANISOU | 3316 | CA | GLU | L | 59 | 5541 | 6068 | 6802 | 625 | 514 | −673 | C |
| ATOM | 3317 | C | GLU | L | 59 | 29.535 | −8.626 | 27.399 | 1.00 | 45.56 | | C |
| ANISOU | 3317 | C | GLU | L | 59 | 5264 | 5628 | 6417 | 651 | 533 | −738 | C |
| ATOM | 3318 | O | GLU | L | 59 | 28.490 | −8.628 | 26.738 | 1.00 | 49.88 | | O |
| ANISOU | 3318 | O | GLU | L | 59 | 5914 | 6164 | 6873 | 618 | 518 | −805 | O |
| ATOM | 3319 | CB | GLU | L | 59 | 31.155 | −6.974 | 26.431 | 1.00 | 67.14 | | C |
| ANISOU | 3319 | CB | GLU | L | 59 | 7903 | 8449 | 9160 | 651 | 634 | −677 | C |
| ATOM | 3320 | CG | GLU | L | 59 | 30.417 | −6.602 | 25.167 | 1.00 | 89.66 | | C |
| ANISOU | 3320 | CG | GLU | L | 59 | 10881 | 11307 | 11881 | 624 | 669 | −742 | C |
| ATOM | 3321 | CD | GLU | L | 59 | 31.342 | −5.991 | 24.128 | 1.00 | 104.78 | | C |
| ANISOU | 3321 | CD | GLU | L | 59 | 12786 | 13248 | 13779 | 640 | 787 | −724 | C |
| ATOM | 3322 | OE1 | GLU | L | 59 | 32.565 | −5.922 | 24.387 | 1.00 | 108.12 | | O |
| ANISOU | 3322 | OE1 | GLU | L | 59 | 13090 | 13680 | 14309 | 672 | 847 | −664 | O |
| ATOM | 3323 | OE2 | GLU | L | 59 | 30.846 | −5.573 | 23.060 | 1.00 | 109.07 | | O |
| ANISOU | 3323 | OE2 | GLU | L | 59 | 13437 | 13800 | 14203 | 620 | 818 | −766 | O |
| ATOM | 3324 | N | ARG | L | 60 | 30.048 | −9.743 | 27.910 | 1.00 | 38.92 | | N |
| ANISOU | 3324 | N | ARG | L | 60 | 4385 | 4734 | 5668 | 709 | 560 | −718 | N |
| ATOM | 3325 | CA | ARG | L | 60 | 29.373 | −11.022 | 27.712 | 1.00 | 39.01 | | C |
| ANISOU | 3325 | CA | ARG | L | 60 | 4483 | 4664 | 5676 | 731 | 581 | −778 | C |
| ATOM | 3326 | C | ARG | L | 60 | 28.057 | −11.148 | 28.479 | 1.00 | 32.96 | | C |
| ANISOU | 3326 | C | ARG | L | 60 | 3762 | 3883 | 4879 | 675 | 478 | −792 | C |
| ATOM | 3327 | O | ARG | L | 60 | 27.351 | −12.143 | 28.275 | 1.00 | 37.93 | | O |
| ANISOU | 3327 | O | ARG | L | 60 | 4465 | 4442 | 5506 | 678 | 488 | −847 | O |
| ATOM | 3328 | CB | ARG | L | 60 | 30.311 | −12.172 | 28.094 | 1.00 | 45.35 | | C |

TABLE 11-continued

| | | | | | | | | | | | |
|---|---|---|---|---|---|---|---|---|---|---|---|
| ANISOU | 3328 | CB | ARG | L | 60 | 5230 | 5405 | 6596 | 814 | 640 | −744 | C |
| ATOM | 3329 | CG | ARG | L | 60 | 30.960 | −12.031 | 29.452 | 1.00 | 45.39 | | C |
| ANISOU | 3329 | CG | ARG | L | 60 | 5119 | 5434 | 6691 | 830 | 571 | −646 | C |
| ATOM | 3330 | CD | ARG | L | 60 | 32.120 | −13.024 | 29.654 | 1.00 | 43.78 | | C |
| ANISOU | 3330 | CD | ARG | L | 60 | 4843 | 5177 | 6616 | 924 | 636 | −602 | C |
| ATOM | 3331 | NE | ARG | L | 60 | 32.490 | −13.001 | 31.066 | 1.00 | 47.54 | | N |
| ANISOU | 3331 | NE | ARG | L | 60 | 5232 | 5669 | 7161 | 933 | 538 | −510 | N |
| ATOM | 3332 | CZ | ARG | L | 60 | 31.878 | −13.723 | 31.997 | 1.00 | 44.80 | | C |
| ANISOU | 3332 | CZ | ARG | L | 60 | 4924 | 5276 | 6823 | 933 | 475 | −489 | C |
| ATOM | 3333 | NH1 | ARG | L | 60 | 30.886 | −14.541 | 31.656 | 1.00 | 47.16 | | N |
| ANISOU | 3333 | NH1 | ARG | L | 60 | 5330 | 5504 | 7084 | 921 | 503 | −554 | N |
| ATOM | 3334 | NH2 | ARG | L | 60 | 32.247 | −13.624 | 33.267 | 1.00 | 40.03 | | N |
| ANISOU | 3334 | NH2 | ARG | L | 60 | 4253 | 4693 | 6263 | 941 | 383 | −402 | N |
| ATOM | 3335 | N | PHE | L | 61 | 27.707 | −10.202 | 29.351 | 1.00 | 39.35 | | N |
| ANISOU | 3335 | N | PHE | L | 61 | 4531 | 4752 | 5671 | 625 | 388 | −747 | N |
| ATOM | 3336 | CA | PHE | L | 61 | 26.386 | −10.196 | 29.985 | 1.00 | 42.18 | | C |
| ANISOU | 3336 | CA | PHE | L | 61 | 4932 | 5100 | 5994 | 570 | 307 | −763 | C |
| ATOM | 3337 | C | PHE | L | 61 | 25.413 | −9.418 | 29.108 | 1.00 | 44.74 | | C |
| ANISOU | 3337 | C | PHE | L | 61 | 5322 | 5454 | 6223 | 514 | 282 | −826 | C |
| ATOM | 3338 | O | PHE | L | 61 | 25.632 | −8.230 | 28.842 | 1.00 | 46.84 | | O |
| ANISOU | 3338 | O | PHE | L | 61 | 5566 | 5784 | 6445 | 490 | 267 | −810 | O |
| ATOM | 3339 | CB | PHE | L | 61 | 26.421 | −9.572 | 31.383 | 1.00 | 35.48 | | C |
| ANISOU | 3339 | CB | PHE | L | 61 | 4022 | 4295 | 5165 | 548 | 227 | −689 | C |
| ATOM | 3340 | CG | PHE | L | 61 | 27.087 | −10.438 | 32.426 | 1.00 | 36.11 | | C |
| ANISOU | 3340 | CG | PHE | L | 61 | 4055 | 4338 | 5326 | 597 | 223 | −625 | C |
| ATOM | 3341 | CD1 | PHE | L | 61 | 28.462 | −10.453 | 32.553 | 1.00 | 36.63 | | C |
| ANISOU | 3341 | CD1 | PHE | L | 61 | 4039 | 4419 | 5458 | 651 | 246 | −570 | C |
| ATOM | 3342 | CD2 | PHE | L | 61 | 26.328 | −11.232 | 33.275 | 1.00 | 33.52 | | C |
| ANISOU | 3342 | CD2 | PHE | L | 61 | 3764 | 3959 | 5014 | 591 | 195 | −613 | C |
| ATOM | 3343 | CE1 | PHE | L | 61 | 29.084 | −11.249 | 33.496 | 1.00 | 40.81 | | C |
| ANISOU | 3343 | CE1 | PHE | L | 61 | 4526 | 4915 | 6066 | 703 | 229 | −505 | C |
| ATOM | 3344 | CE2 | PHE | L | 61 | 26.942 | −12.026 | 34.227 | 1.00 | 37.15 | | C |
| ANISOU | 3344 | CE2 | PHE | L | 61 | 4192 | 4383 | 5541 | 640 | 188 | −544 | C |
| ATOM | 3345 | CZ | PHE | L | 61 | 28.331 | −12.039 | 34.329 | 1.00 | 36.68 | | C |
| ANISOU | 3345 | CZ | PHE | L | 61 | 4053 | 4340 | 5545 | 699 | 199 | −491 | C |
| ATOM | 3346 | N | SER | L | 62 | 24.330 | −10.071 | 28.688 | 1.00 | 38.94 | | N |
| ANISOU | 3346 | N | SER | L | 62 | 4664 | 4669 | 5465 | 490 | 271 | −893 | N |
| ATOM | 3347 | CA | SER | L | 62 | 23.305 | −9.414 | 27.882 | 1.00 | 37.15 | | C |
| ANISOU | 3347 | CA | SER | L | 62 | 4496 | 4464 | 5153 | 438 | 228 | −952 | C |
| ATOM | 3348 | C | SER | L | 62 | 21.946 | −10.042 | 28.193 | 1.00 | 39.27 | | C |
| ANISOU | 3348 | C | SER | L | 62 | 4800 | 4682 | 5438 | 396 | 175 | −993 | C |
| ATOM | 3349 | O | SER | L | 62 | 21.798 | −10.829 | 29.131 | 1.00 | 35.07 | | O |
| ANISOU | 3349 | O | SER | L | 62 | 4245 | 4104 | 4975 | 402 | 175 | −966 | O |
| ATOM | 3350 | CB | SER | L | 62 | 23.642 | −9.508 | 26.390 | 1.00 | 43.31 | | C |
| ANISOU | 3350 | CB | SER | L | 62 | 5349 | 5238 | 5869 | 460 | 289 | −1012 | C |
| ATOM | 3351 | OG | SER | L | 62 | 22.704 | −8.753 | 25.642 | 1.00 | 53.95 | | O |
| ANISOU | 3351 | OG | SER | L | 62 | 6754 | 6615 | 7128 | 412 | 232 | −1057 | O |
| ATOM | 3352 | N | GLY | L | 63 | 20.939 | −9.688 | 27.408 | 1.00 | 35.22 | | N |
| ANISOU | 3352 | N | GLY | L | 63 | 4340 | 4176 | 4866 | 353 | 128 | −1054 | N |
| ATOM | 3353 | CA | GLY | L | 63 | 19.631 | −10.269 | 27.636 | 1.00 | 34.60 | | C |
| ANISOU | 3353 | CA | GLY | L | 63 | 4280 | 4047 | 4819 | 307 | 76 | −1095 | C |
| ATOM | 3354 | C | GLY | L | 63 | 18.659 | −9.875 | 26.550 | 1.00 | 39.64 | | C |
| ANISOU | 3354 | C | GLY | L | 63 | 4976 | 4694 | 5390 | 266 | 15 | −1168 | C |
| ATOM | 3355 | O | GLY | L | 63 | 18.981 | −9.103 | 25.640 | 1.00 | 38.29 | | O |
| ANISOU | 3355 | O | GLY | L | 63 | 4843 | 4571 | 5137 | 275 | 14 | −1181 | O |
| ATOM | 3356 | N | SER | L | 64 | 17.457 | −10.430 | 26.666 | 1.00 | 34.60 | | N |
| ANISOU | 3356 | N | SER | L | 64 | 4345 | 4006 | 4795 | 221 | −37 | −1210 | N |
| ATOM | 3357 | CA | SER | L | 64 | 16.363 | −10.162 | 25.740 | 1.00 | 36.94 | | C |
| ANISOU | 3357 | CA | SER | L | 64 | 4685 | 4302 | 5048 | 176 | −118 | −1280 | C |
| ATOM | 3358 | C | SER | L | 64 | 15.065 | −10.100 | 26.533 | 1.00 | 37.01 | | C |
| ANISOU | 3358 | C | SER | L | 64 | 4630 | 4298 | 5135 | 122 | −181 | −1271 | C |
| ATOM | 3359 | O | SER | L | 64 | 15.003 | −10.526 | 27.688 | 1.00 | 40.46 | | O |
| ANISOU | 3359 | O | SER | L | 64 | 5013 | 4708 | 5652 | 119 | −147 | −1224 | O |
| ATOM | 3360 | CB | SER | L | 64 | 16.285 | −11.230 | 24.641 | 1.00 | 43.42 | | C |
| ANISOU | 3360 | CB | SER | L | 64 | 5600 | 5052 | 5844 | 178 | −114 | −1373 | C |
| ATOM | 3361 | OG | SER | L | 64 | 15.883 | −12.482 | 25.165 | 1.00 | 48.46 | | O |
| ANISOU | 3361 | OG | SER | L | 64 | 6230 | 5601 | 6583 | 160 | −100 | −1394 | O |
| ATOM | 3362 | N | ASN | L | 65 | 14.029 | −9.534 | 25.915 | 1.00 | 36.21 | | N |
| ANISOU | 3362 | N | ASN | L | 65 | 4534 | 4215 | 5009 | 82 | −270 | −1311 | N |
| ATOM | 3363 | CA | ASN | L | 65 | 12.725 | −9.416 | 26.576 | 1.00 | 37.89 | | C |
| ANISOU | 3363 | CA | ASN | L | 65 | 4674 | 4415 | 5308 | 31 | −327 | −1306 | C |
| ATOM | 3364 | C | ASN | L | 65 | 11.668 | −9.211 | 25.501 | 1.00 | 42.25 | | C |
| ANISOU | 3364 | C | ASN | L | 65 | 5251 | 4962 | 5838 | −9 | −436 | −1377 | C |
| ATOM | 3365 | O | ASN | L | 65 | 11.632 | −8.156 | 24.861 | 1.00 | 37.93 | | O |
| ANISOU | 3365 | O | ASN | L | 65 | 4724 | 4476 | 5211 | −0 | −488 | −1374 | O |
| ATOM | 3366 | CB | ASN | L | 65 | 12.693 | −8.275 | 27.591 | 1.00 | 27.04 | | C |
| ANISOU | 3366 | CB | ASN | L | 65 | 3226 | 3105 | 3944 | 37 | −317 | −1227 | C |
| ATOM | 3367 | CG | ASN | L | 65 | 11.352 | −8.177 | 28.291 | 1.00 | 30.40 | | C |
| ANISOU | 3367 | CG | ASN | L | 65 | 3574 | 3513 | 4464 | −9 | −354 | −1220 | C |
| ATOM | 3368 | OD1 | ASN | L | 65 | 10.538 | −9.100 | 28.218 | 1.00 | 37.06 | | O |

TABLE 11-continued

| | | | | | | | | | | | |
|---|---|---|---|---|---|---|---|---|---|---|---|
| ANISOU | 3368 | OD1 | ASN | L | 65 | 4405 | 4290 | 5386 | −48 | −374 | −1262 | O |
| ATOM | 3369 | ND2 | ASN | L | 65 | 11.102 | −7.055 | 28.958 | 1.00 | 32.46 | | N |
| ANISOU | 3369 | ND2 | ASN | L | 65 | 3782 | 3827 | 4725 | −5 | −360 | −1170 | N |
| ATOM | 3370 | N | PHE | L | 66 | 10.797 | −10.199 | 25.341 | 1.00 | 39.94 | | N |
| ANISOU | 3370 | N | PHE | L | 66 | 4956 | 4596 | 5624 | −55 | −476 | −1435 | N |
| ATOM | 3371 | C | PHE | L | 66 | 8.613 | −11.001 | 24.761 | 1.00 | 49.17 | | C |
| ANISOU | 3371 | C | PHE | L | 66 | 6078 | 5676 | 6928 | −161 | −633 | −1539 | C |
| ATOM | 3372 | O | PHE | L | 66 | 8.785 | −12.088 | 25.325 | 1.00 | 44.31 | | O |
| ANISOU | 3372 | O | PHE | L | 66 | 5458 | 4988 | 6388 | −171 | −563 | −1540 | O |
| ATOM | 3373 | CA | APHE | L | 66 | 9.808 | −10.199 | 24.276 | 0.65 | 42.61 | | C |
| ANISOU | 3373 | CA | APHE | L | 66 | 5322 | 4920 | 5950 | −97 | −596 | −1513 | C |
| ATOM | 3374 | CB | APHE | L | 66 | 10.412 | −10.812 | 22.999 | 0.65 | 47.47 | | C |
| ANISOU | 3374 | CB | APHE | L | 66 | 6070 | 5506 | 6460 | −79 | −605 | −1592 | C |
| ATOM | 3375 | CG | APHE | L | 66 | 9.513 | −10.751 | 21.796 | 0.65 | 53.74 | | C |
| ANISOU | 3375 | CG | APHE | L | 66 | 6918 | 6291 | 7208 | −117 | −744 | −1675 | C |
| ATOM | 3376 | CD1 | APHE | L | 66 | 8.530 | −11.706 | 21.596 | 0.65 | 51.42 | | C |
| ANISOU | 3376 | CD1 | APHE | L | 66 | 6614 | 5917 | 7006 | −179 | −820 | −1749 | C |
| ATOM | 3377 | CD2 | APHE | L | 66 | 9.674 | −9.754 | 20.843 | 0.65 | 59.96 | | C |
| ANISOU | 3377 | CD2 | APHE | L | 66 | 7775 | 7148 | 7861 | −93 | −802 | −1678 | C |
| ATOM | 3378 | CE1 | APHE | L | 66 | 7.707 | −11.655 | 20.483 | 0.65 | 56.14 | | C |
| ANISOU | 3378 | CE1 | APHE | L | 66 | 7263 | 6507 | 7560 | 216 | −966 | −1829 | C |
| ATOM | 3379 | CE2 | APHE | L | 66 | 8.856 | −9.707 | 19.722 | 0.65 | 55.62 | | C |
| ANISOU | 3379 | CE2 | APHE | L | 66 | 7285 | 6590 | 7256 | −124 | −943 | −1752 | C |
| ATOM | 3380 | CZ | APHE | L | 66 | 7.876 | −10.659 | 19.546 | 0.65 | 53.69 | | C |
| ANISOU | 3380 | CZ | APHE | L | 66 | 7026 | 6269 | 7103 | −186 | −1031 | −1830 | C |
| ATOM | 3381 | CA | BPHE | L | 66 | 9.800 | −10.185 | 24.287 | 0.35 | 43.67 | | C |
| ANISOU | 3381 | CA | BPHE | L | 66 | 5454 | 5054 | 6084 | −97 | −596 | −1512 | C |
| ATOM | 3382 | CB | BPHE | L | 66 | 10.357 | −10.753 | 22.970 | 0.35 | 48.11 | | C |
| ANISOU | 3382 | CB | BPHE | L | 66 | 6149 | 5590 | 6539 | −81 | −612 | −1593 | C |
| ATOM | 3383 | CG | BPHE | L | 66 | 10.863 | −12.172 | 23.075 | 0.35 | 56.46 | | C |
| ANISOU | 3383 | CG | BPHE | L | 66 | 7253 | 6558 | 7639 | −76 | −537 | −1631 | C |
| ATOM | 3384 | CD1 | BPHE | L | 66 | 10.005 | −13.251 | 22.896 | 0.35 | 66.29 | | C |
| ANISOU | 3384 | CD1 | BPHE | L | 66 | 8504 | 7711 | 8974 | −132 | −589 | −1704 | C |
| ATOM | 3385 | CD2 | BPHE | L | 66 | 12.201 | −12.430 | 23.333 | 0.35 | 60.44 | | C |
| ANISOU | 3385 | CD2 | BPHE | L | 66 | 7793 | 7065 | 8105 | −14 | −416 | −1594 | C |
| ATOM | 3386 | CE1 | BPHE | L | 66 | 10.468 | −14.553 | 22.995 | 0.35 | 70.69 | | C |
| ANISOU | 3386 | CE1 | BPHE | L | 66 | 9108 | 8174 | 9575 | −126 | −517 | −1739 | C |
| ATOM | 3387 | CE2 | BPHE | L | 66 | 12.670 | −13.730 | 23.422 | 0.35 | 65.53 | | C |
| ANISOU | 3387 | CE2 | BPHE | L | 66 | 8480 | 7620 | 8797 | −1 | −346 | −1626 | C |
| ATOM | 3388 | CZ | BPHE | L | 66 | 11.805 | −14.792 | 23.259 | 0.35 | 70.03 | | C |
| ANISOU | 3388 | CZ | BPHE | L | 66 | 9063 | 8094 | 9451 | −57 | −393 | −1699 | C |
| ATOM | 3389 | N | GLY | L | 67 | 7.415 | −10.465 | 24.546 | 1.00 | 36.99 | | N |
| ANISOU | 3389 | N | GLY | L | 67 | 4471 | 4148 | 5434 | −203 | −739 | −1555 | N |
| ATOM | 3390 | CA | GLY | L | 67 | 6.213 | −11.226 | 24.844 | 1.00 | 48.28 | | C |
| ANISOU | 3390 | CA | GLY | L | 67 | 5822 | 5506 | 7018 | −271 | −783 | −1587 | C |
| ATOM | 3391 | C | GLY | L | 67 | 6.123 | −11.568 | 26.319 | 1.00 | 47.28 | | C |
| ANISOU | 3391 | C | GLY | L | 67 | 5605 | 5349 | 7008 | −279 | −670 | −1515 | C |
| ATOM | 3392 | O | GLY | L | 67 | 6.067 | −10.690 | 27.185 | 1.00 | 44.57 | | O |
| ANISOU | 3392 | O | GLY | L | 67 | 5194 | 5062 | 6677 | −257 | −625 | −1440 | O |
| ATOM | 3393 | N | ASN | L | 68 | 6.127 | −12.864 | 26.625 | 1.00 | 41.77 | | N |
| ANISOU | 3393 | N | ASN | L | 68 | 4919 | 4559 | 6393 | −308 | −618 | −1536 | N |
| ATOM | 3394 | CA | ASN | L | 68 | 5.954 | −13.332 | 27.990 | 1.00 | 39.66 | | C |
| ANISOU | 3394 | CA | ASN | L | 68 | 4579 | 4251 | 6238 | −320 | −511 | −1465 | C |
| ATOM | 3395 | C | ASN | L | 68 | 7.246 | −13.848 | 28.625 | 1.00 | 40.80 | | C |
| ANISOU | 3395 | C | ASN | L | 68 | 4788 | 4382 | 6332 | −265 | −391 | −1415 | C |
| ATOM | 3396 | O | ASN | L | 68 | 7.198 | −14.396 | 29.729 | 1.00 | 41.86 | | O |
| ANISOU | 3396 | O | ASN | L | 68 | 4885 | 4472 | 6547 | −271 | −302 | −1355 | O |
| ATOM | 3397 | CB | ASN | L | 68 | 4.888 | −14.424 | 28.028 | 1.00 | 41.59 | | C |
| ANISOU | 3397 | CB | ASN | L | 68 | 4772 | 4390 | 6642 | −400 | −536 | −1509 | C |
| ATOM | 3398 | CG | ASN | L | 68 | 3.541 | −13.927 | 27.561 | 1.00 | 44.04 | | C |
| ANISOU | 3398 | CG | ASN | L | 68 | 4989 | 4711 | 7034 | −458 | −657 | −1548 | C |
| ATOM | 3399 | OD1 | ASN | L | 68 | 3.158 | −12.787 | 27.840 | 1.00 | 49.23 | | O |
| ANISOU | 3399 | OD1 | ASN | L | 68 | 5576 | 5445 | 7684 | −440 | −675 | −1504 | O |
| ATOM | 3400 | ND2 | ASN | L | 68 | 2.811 | −14.779 | 26.841 | 1.00 | 46.21 | | N |
| ANISOU | 3400 | ND2 | ASN | L | 68 | 5261 | 4904 | 7394 | −526 | −746 | −1633 | N |
| ATOM | 3401 | N | THR | L | 69 | 8.392 | −13.682 | 27.973 | 1.00 | 38.62 | | N |
| ANISOU | 3401 | N | THR | L | 69 | 4604 | 4141 | 5927 | −208 | −384 | −1431 | N |
| ATOM | 3402 | CA | THR | L | 69 | 9.638 | −14.199 | 28.529 | 1.00 | 41.83 | | C |
| ANISOU | 3402 | CA | THR | L | 69 | 5059 | 4533 | 6302 | −151 | −279 | −1383 | C |
| ATOM | 3403 | C | THR | L | 69 | 10.777 | −13.207 | 28.374 | 1.00 | 39.91 | | C |
| ANISOU | 3403 | C | THR | L | 69 | 4849 | 4385 | 5929 | −84 | −259 | −1346 | C |
| ATOM | 3404 | O | THR | L | 69 | 11.046 | −12.734 | 27.267 | 1.00 | 37.22 | | O |
| ANISOU | 3404 | O | THR | L | 69 | 4563 | 4083 | 5493 | −69 | −310 | −1396 | O |
| ATOM | 3405 | CB | THR | L | 69 | 10.024 | −15.519 | 27.860 | 1.00 | 45.21 | | C |
| ANISOU | 3405 | CB | THR | L | 69 | 5571 | 4863 | 6745 | −152 | −264 | −1451 | C |
| ATOM | 3406 | OG1 | THR | L | 69 | 8.949 | −16.448 | 28.017 | 1.00 | 44.59 | | O |
| ANISOU | 3406 | OG1 | THR | L | 69 | 5458 | 4686 | 6800 | −224 | −285 | −1486 | O |
| ATOM | 3407 | CG2 | THR | L | 69 | 11.290 | −16.086 | 28.504 | 1.00 | 44.52 | | C |
| ANISOU | 3407 | CG2 | THR | L | 69 | 5519 | 4754 | 6644 | −86 | −154 | −1392 | C |
| ATOM | 3408 | N | ALA | L | 70 | 11.467 | −12.925 | 29.478 | 1.00 | 35.71 | | N |

TABLE 11-continued

| | | | | | | | | | | | |
|---|---|---|---|---|---|---|---|---|---|---|---|
| ANISOU | 3408 | N | ALA | L | 70 | 4289 | 3886 | 5392 | −44 | −184 | −1257 | N |
| ATOM | 3409 | CA | ALA | L | 70 | 12.747 | −12.240 | 29.452 | 1.00 | 35.35 | | C |
| ANISOU | 3409 | CA | ALA | L | 70 | 4272 | 3912 | 5248 | 19 | −151 | −1217 | C |
| ATOM | 3410 | C | ALA | L | 70 | 13.852 | −13.233 | 29.795 | 1.00 | 41.43 | | C |
| ANISOU | 3410 | C | ALA | L | 70 | 5078 | 4632 | 6032 | 67 | −70 | −1189 | C |
| ATOM | 3411 | O | ALA | L | 70 | 13.638 | −14.188 | 30.545 | 1.00 | 45.85 | | O |
| ANISOU | 3411 | O | ALA | L | 70 | 5627 | 5118 | 6676 | 57 | −28 | −1164 | O |
| ATOM | 3412 | CB | ALA | L | 70 | 12.773 | −11.058 | 30.433 | 1.00 | 31.90 | | C |
| ANISOU | 3412 | CB | ALA | L | 70 | 3776 | 3555 | 4791 | 30 | −144 | −1139 | C |
| ATOM | 3413 | N | THR | L | 71 | 15.033 | −13.013 | 29.231 | 1.00 | 36.71 | | N |
| ANISOU | 3413 | N | THR | L | 71 | 4521 | 4069 | 5359 | 122 | −44 | −1190 | N |
| ATOM | 3414 | CA | THR | L | 71 | 16.132 | −13.969 | 29.343 | 1.00 | 34.36 | | C |
| ANISOU | 3414 | CA | THR | L | 71 | 4254 | 3719 | 5080 | 177 | 31 | −1174 | C |
| ATOM | 3415 | C | THR | L | 71 | 17.421 | −13.230 | 29.640 | 1.00 | 37.00 | | C |
| ANISOU | 3415 | C | THR | L | 71 | 4567 | 4129 | 5362 | 236 | 66 | −1108 | C |
| ATOM | 3416 | O | THR | L | 71 | 17.793 | −12.317 | 28.897 | 1.00 | 34.22 | | O |
| ANISOU | 3416 | O | THR | L | 71 | 4226 | 3845 | 4931 | 247 | 49 | −1124 | O |
| ATOM | 3417 | CB | THR | L | 71 | 16.327 | −14.778 | 28.051 | 1.00 | 35.91 | | C |
| ANISOU | 3417 | CB | THR | L | 71 | 4534 | 3854 | 5256 | 187 | 40 | −1267 | C |
| ATOM | 3418 | OG1 | THR | L | 71 | 15.089 | −15.361 | 27.627 | 1.00 | 36.61 | | O |
| ANISOU | 3418 | OG1 | THR | L | 71 | 4645 | 3876 | 5390 | 122 | −16 | −1342 | O |
| ATOM | 3419 | CG2 | THR | L | 71 | 17.358 | −15.883 | 28.263 | 1.00 | 41.65 | | C |
| ANISOU | 3419 | CG2 | THR | L | 71 | 5287 | 4509 | 6028 | 248 | 125 | −1249 | C |
| ATOM | 3420 | N | LEU | L | 72 | 18.109 | −13.634 | 30.701 | 1.00 | 34.32 | | N |
| ANISOU | 3420 | N | LEU | L | 72 | 4197 | 3774 | 5068 | 274 | 111 | −1031 | N |
| ATOM | 3421 | CA | LEU | L | 72 | 19.490 | −13.213 | 30.905 | 1.00 | 29.55 | | C |
| ANISOU | 3421 | CA | LEU | L | 72 | 3568 | 3222 | 4436 | 335 | 144 | −974 | C |
| ATOM | 3422 | C | LEU | L | 72 | 20.407 | −14.164 | 30.138 | 1.00 | 32.88 | | C |
| ANISOU | 3422 | C | LEU | L | 72 | 4030 | 3586 | 4877 | 391 | 208 | −1007 | C |
| ATOM | 3423 | O | LEU | L | 72 | 20.282 | −15.387 | 30.259 | 1.00 | 40.43 | | O |
| ANISOU | 3423 | O | LEU | L | 72 | 5015 | 4448 | 5900 | 402 | 240 | −1022 | O |
| ATOM | 3424 | CB | LEU | L | 72 | 19.835 | −13.207 | 32.396 | 1.00 | 31.84 | | C |
| ANISOU | 3424 | CB | LEU | L | 72 | 3811 | 3524 | 4763 | 353 | 149 | −876 | C |
| ATOM | 3425 | CG | LEU | L | 72 | 21.291 | −12.894 | 32.764 | 1.00 | 38.44 | | C |
| ANISOU | 3425 | CG | LEU | L | 72 | 4607 | 4404 | 5593 | 415 | 168 | −810 | C |
| ATOM | 3426 | CD1 | LEU | L | 72 | 21.639 | −11.418 | 32.509 | 1.00 | 32.01 | | C |
| ANISOU | 3426 | CD1 | LEU | L | 72 | 3761 | 3691 | 4710 | 403 | 133 | −803 | C |
| ATOM | 3427 | CD2 | LEU | L | 72 | 21.598 | −13.275 | 34.200 | 1.00 | 37.31 | | C |
| ANISOU | 3427 | CD2 | LEU | L | 72 | 4439 | 4246 | 5490 | 438 | 165 | −719 | C |
| ATOM | 3428 | N | ILE | L | 73 | 21.319 | −13.603 | 29.343 | 1.00 | 34.93 | | N |
| ANISOU | 3428 | N | ILE | L | 73 | 4293 | 3896 | 5083 | 427 | 234 | −1018 | N |
| ATOM | 3429 | CA | ILE | L | 73 | 22.163 | −14.363 | 28.416 | 1.00 | 36.16 | | C |
| ANISOU | 3429 | CA | ILE | L | 73 | 4493 | 4002 | 5243 | 484 | 309 | −1061 | C |
| ATOM | 3430 | C | ILE | L | 73 | 23.611 | −14.072 | 28.776 | 1.00 | 35.64 | | C |
| ANISOU | 3430 | C | ILE | L | 73 | 4361 | 3979 | 5202 | 550 | 359 | −986 | C |
| ATOM | 3431 | O | ILE | L | 73 | 24.113 | −12.962 | 28.543 | 1.00 | 35.72 | | O |
| ANISOU | 3431 | O | ILE | L | 73 | 4336 | 4072 | 5162 | 550 | 353 | −962 | O |
| ATOM | 3432 | CB | ILE | L | 73 | 21.871 | −14.003 | 26.950 | 1.00 | 40.25 | | C |
| ANISOU | 3432 | CB | ILE | L | 73 | 5086 | 4536 | 5669 | 465 | 308 | −1153 | C |
| ATOM | 3433 | CG1 | ILE | L | 73 | 20.378 | −14.154 | 26.645 | 1.00 | 40.23 | | C |
| ANISOU | 3433 | CG1 | ILE | L | 73 | 5133 | 4503 | 5650 | 392 | 231 | −1223 | C |
| ATOM | 3434 | CG2 | ILE | L | 73 | 22.697 | −14.860 | 25.999 | 1.00 | 38.62 | | C |
| ANISOU | 3434 | CG2 | ILE | L | 73 | 4943 | 4271 | 5461 | 527 | 400 | −1206 | C |
| ATOM | 3435 | CD1 | ILE | L | 73 | 19.953 | −13.567 | 25.304 | 1.00 | 43.97 | | C |
| ANISOU | 3435 | CD1 | ILE | L | 73 | 5680 | 5009 | 6016 | 366 | 196 | −1301 | C |
| ATOM | 3436 | N | ILE | L | 74 | 24.283 | −15.060 | 29.353 | 1.00 | 34.85 | | N |
| ANISOU | 3436 | N | ILE | L | 74 | 4238 | 3816 | 5187 | 607 | 403 | −945 | N |
| ATOM | 3437 | CA | ILE | L | 74 | 25.670 | −14.936 | 29.776 | 1.00 | 37.52 | | C |
| ANISOU | 3437 | CA | ILE | L | 74 | 4498 | 4183 | 5574 | 675 | 441 | −868 | C |
| ATOM | 3438 | C | ILE | L | 74 | 26.494 | −15.773 | 28.812 | 1.00 | 42.06 | | C |
| ANISOU | 3438 | C | ILE | L | 74 | 5103 | 4696 | 6181 | 745 | 543 | −913 | C |
| ATOM | 3439 | O | ILE | L | 74 | 26.390 | −17.007 | 28.803 | 1.00 | 42.04 | | O |
| ANISOU | 3439 | O | ILE | L | 74 | 5145 | 4592 | 6238 | 776 | 581 | −939 | O |
| ATOM | 3440 | CB | ILE | L | 74 | 25.877 | −15.395 | 31.229 | 1.00 | 38.89 | | C |
| ANISOU | 3440 | CB | ILE | L | 74 | 4620 | 4334 | 5824 | 696 | 408 | −776 | C |
| ATOM | 3441 | CG1 | ILE | L | 74 | 24.910 | −14.682 | 32.173 | 1.00 | 39.26 | | C |
| ANISOU | 3441 | CG1 | ILE | L | 74 | 4659 | 4428 | 5829 | 626 | 322 | −743 | C |
| ATOM | 3442 | CG2 | ILE | L | 74 | 27.341 | −15.164 | 31.669 | 1.00 | 35.35 | | C |
| ANISOU | 3442 | CG2 | ILE | L | 74 | 4078 | 3924 | 5430 | 764 | 424 | −693 | C |
| ATOM | 3443 | CD1 | ILE | L | 74 | 24.892 | −15.272 | 33.613 | 1.00 | 38.28 | | C |
| ANISOU | 3443 | CD1 | ILE | L | 74 | 4517 | 4269 | 5760 | 642 | 294 | −657 | C |
| ATOM | 3444 | N | SER | L | 75 | 27.301 | −15.106 | 27.996 | 1.00 | 39.24 | | N |
| ANISOU | 3444 | N | SER | L | 75 | 4728 | 4394 | 5788 | 771 | 596 | −922 | N |
| ATOM | 3445 | CA | SER | L | 75 | 28.190 | −15.776 | 27.060 | 1.00 | 37.02 | | C |
| ANISOU | 3445 | CA | SER | L | 75 | 4471 | 4062 | 5532 | 845 | 713 | −961 | C |
| ATOM | 3446 | C | SER | L | 75 | 29.528 | −16.084 | 27 | 1.00 | 38.17 | | C |
| ANISOU | 3446 | C | SER | L | 75 | 4506 | 4202 | 5796 | 927 | 758 | −872 | C |
| ATOM | 3447 | O | SER | L | 75 | 29.924 | −15.442 | 28.706 | 1.00 | 42.82 | | O |
| ANISOU | 3447 | O | SER | L | 75 | 4997 | 4853 | 6421 | 919 | 694 | −782 | O |
| ATOM | 3448 | CB | SER | L | 75 | 28.429 | −14.912 | 25.818 | 1.00 | 45.77 | | C |

TABLE 11-continued

| | | | | | | | | | | | |
|---|---|---|---|---|---|---|---|---|---|---|---|
| ANISOU | 3448 | CB | SER | L | 75 | 5617 | 5231 | 6543 | 835 | 764 | −1008 | C |
| ATOM | 3449 | OG | SER | L | 75 | 27.205 | −14.503 | 25.235 | 1.00 | 48.42 | | O |
| ANISOU | 3449 | OG | SER | L | 75 | 6047 | 5581 | 6767 | 761 | 702 | −1080 | O |
| ATOM | 3450 | N | ARG | L | 76 | 30.225 | −17.072 | 27.160 | 1.00 | 43.02 | | N |
| ANISOU | 3450 | N | ARG | L | 76 | 5138 | 4737 | 6471 | 1007 | 866 | −901 | N |
| ATOM | 3451 | CA | ARG | L | 76 | 31.577 | −17.447 | 27.587 | 1.00 | 51.50 | | C |
| ANISOU | 3451 | CA | ARG | L | 76 | 6101 | 5795 | 7671 | 1100 | 924 | −823 | C |
| ATOM | 3452 | C | ARG | L | 76 | 31.655 | −17.592 | 29.106 | 1.00 | 51.48 | | C |
| ANISOU | 3452 | C | ARG | L | 76 | 6016 | 5795 | 7749 | 1103 | 824 | −719 | C |
| ATOM | 3453 | O | ARG | L | 76 | 32.528 | −17.023 | 29.767 | 1.00 | 44.76 | | O |
| ANISOU | 3453 | O | ARG | L | 76 | 5046 | 5007 | 6956 | 1125 | 790 | −630 | O |
| ATOM | 3454 | CB | ARG | L | 76 | 32.606 | −16.435 | 27.065 | 1.00 | 47.81 | | C |
| ANISOU | 3454 | CB | ARG | L | 76 | 5549 | 5415 | 7202 | 1118 | 983 | −793 | C |
| ATOM | 3455 | CG | ARG | L | 76 | 32.765 | −16.470 | 25.544 | 1.00 | 55.21 | | C |
| ANISOU | 3455 | CG | ARG | L | 76 | 6574 | 6336 | 8068 | 1140 | 1114 | −885 | C |
| ATOM | 3456 | CD | ARG | L | 76 | 33.697 | −15.378 | 25.025 | 1.00 | 64.74 | | C |
| ANISOU | 3456 | CD | ARG | L | 76 | 7702 | 7631 | 9267 | 1147 | 1179 | −847 | C |
| ATOM | 3457 | NE | ARG | L | 76 | 33.145 | −14.042 | 25.230 | 1.00 | 70.76 | | N |
| ANISOU | 3457 | NE | ARG | L | 76 | 8455 | 8492 | 9940 | 1053 | 1078 | −824 | N |
| ATOM | 3458 | CZ | ARG | L | 76 | 32.214 | −13.491 | 24.457 | 1.00 | 79.57 | | C |
| ANISOU | 3458 | CZ | ARG | L | 76 | 9687 | 9634 | 10913 | 988 | 1057 | −893 | C |
| ATOM | 3459 | NH1 | ARG | L | 76 | 31.720 | −14.163 | 23.421 | 1.00 | 78.80 | | N |
| ANISOU | 3459 | NH1 | ARG | L | 76 | 9729 | 9476 | 10735 | 1001 | 1122 | −994 | N |
| ATOM | 3460 | NH2 | ARG | L | 76 | 31.772 | −12.267 | 24.723 | 1.00 | 79.36 | | N |
| ANISOU | 3460 | NH2 | ARG | L | 76 | 9639 | 9690 | 10822 | 912 | 966 | −863 | N |
| ATOM | 3461 | N | VAL | L | 77 | 30.712 | −18.369 | 29.657 | 1.00 | 47.48 | | N |
| ANISOU | 3461 | N | VAL | L | 77 | 5579 | 5218 | 7243 | 1077 | 774 | −731 | N |
| ATOM | 3462 | CA | VAL | L | 77 | 30.571 | −18.498 | 31.103 | 1.00 | 40.77 | | C |
| ANISOU | 3462 | CA | VAL | L | 77 | 4683 | 4369 | 6439 | 1069 | 678 | −636 | C |
| ATOM | 3463 | C | VAL | L | 77 | 31.875 | −18.981 | 31.734 | 1.00 | 38.46 | | C |
| ANISOU | 3463 | C | VAL | L | 77 | 4286 | 4055 | 6274 | 1168 | 693 | −541 | C |
| ATOM | 3464 | O | VAL | L | 77 | 32.609 | −19.795 | 31.158 | 1.00 | 40.86 | | O |
| ANISOU | 3464 | O | VAL | L | 77 | 4580 | 4286 | 6659 | 1252 | 792 | −559 | O |
| ATOM | 3465 | CB | VAL | L | 77 | 29.396 | −19.437 | 31.442 | 1.00 | 41.65 | | C |
| ANISOU | 3465 | CB | VAL | L | 77 | 4893 | 4387 | 6546 | 1033 | 654 | −667 | C |
| ATOM | 3466 | CG1 | VAL | L | 77 | 29.455 | −19.864 | 32.895 | 1.00 | 44.67 | | C |
| ANISOU | 3466 | CG1 | VAL | L | 77 | 5239 | 4744 | 6988 | 1052 | 587 | −559 | C |
| ATOM | 3467 | CG2 | VAL | L | 77 | 28.056 | −18.744 | 31.175 | 1.00 | 33.54 | | C |
| ANISOU | 3467 | CG2 | VAL | L | 77 | 3933 | 3404 | 5406 | 926 | 600 | −733 | C |
| ATOM | 3468 | N | GLU | L | 78 | 32.193 | −18.424 | 32.908 | 1.00 | 41.44 | | N |
| ANISOU | 3468 | N | GLU | L | 78 | 4582 | 4496 | 6666 | 1159 | 592 | −441 | N |
| ATOM | 3469 | CA | GLU | L | 78 | 33.351 | −18.808 | 33.702 | 1.00 | 48.70 | | C |
| ANISOU | 3469 | CA | GLU | L | 78 | 5397 | 5403 | 7704 | 1245 | 569 | −337 | C |
| ATOM | 3470 | C | GLU | L | 78 | 32.894 | −19.389 | 35.035 | 1.00 | 46.69 | | C |
| ANISOU | 3470 | C | GLU | L | 78 | 5174 | 5106 | 7459 | 1243 | 478 | −260 | C |
| ATOM | 3471 | O | GLU | L | 78 | 31.789 | −19.110 | 35.509 | 1.00 | 41.56 | | O |
| ANISOU | 3471 | O | GLU | L | 78 | 4599 | 4473 | 6718 | 1163 | 421 | −272 | O |
| ATOM | 3472 | CB | GLU | L | 78 | 34.265 | −17.604 | 33.971 | 1.00 | 53.55 | | C |
| ANISOU | 3472 | CB | GLU | L | 78 | 5884 | 6131 | 8330 | 1237 | 512 | −279 | C |
| ATOM | 3473 | CG | GLU | L | 78 | 34.553 | −16.749 | 32.750 | 1.00 | 59.96 | | C |
| ANISOU | 3473 | CG | GLU | L | 78 | 6673 | 7002 | 9106 | 1213 | 592 | −346 | C |
| ATOM | 3474 | CD | GLU | L | 78 | 35.241 | −15.436 | 33.097 | 1.00 | 62.05 | | C |
| ANISOU | 3474 | CD | GLU | L | 78 | 5824 | 7378 | 9375 | 1179 | 523 | −291 | C |
| ATOM | 3475 | OE1 | GLU | L | 78 | 35.494 | −15.186 | 34.295 | 1.00 | 56.41 | | O |
| ANISOU | 3475 | OE1 | GLU | L | 78 | 6051 | 6697 | 8685 | 1173 | 403 | −208 | O |
| ATOM | 3476 | OE2 | GLU | L | 78 | 35.526 | −14.653 | 32.165 | 1.00 | 63.31 | | O |
| ANISOU | 3476 | OE2 | GLU | L | 78 | 6958 | 7587 | 9508 | 1156 | 588 | −331 | O |
| ATOM | 3477 | N | ALA | L | 79 | 33.781 | −20.159 | 35.672 | 1.00 | 42.52 | | N |
| ANISOU | 3477 | N | ALA | L | 79 | 4585 | 4526 | 7045 | 1336 | 466 | −172 | N |
| ATOM | 3478 | CA | ALA | L | 79 | 33.466 | −20.703 | 36.994 | 1.00 | 46.85 | | C |
| ANISOU | 3478 | CA | ALA | L | 79 | 5168 | 5036 | 7598 | 1343 | 378 | −81 | C |
| ATOM | 3479 | C | ALA | L | 79 | 33.014 | −19.608 | 37.955 | 1.00 | 45.17 | | C |
| ANISOU | 3479 | C | ALA | L | 79 | 4957 | 4928 | 7278 | 1262 | 255 | −39 | C |
| ATOM | 3480 | O | ALA | L | 79 | 32.082 | −19.803 | 38.745 | 1.00 | 40.61 | | O |
| ANISOU | 3480 | O | ALA | L | 79 | 4466 | 4329 | 6633 | 1217 | 211 | −16 | O |
| ATOM | 3481 | CB | ALA | L | 79 | 34.674 | −21.449 | 37.560 | 1.00 | 41.22 | | C |
| ANISOU | 3481 | CB | ALA | L | 79 | 4367 | 4274 | 7022 | 1460 | 359 | 22 | C |
| ATOM | 3482 | N | GLY | L | 80 | 33.650 | −18.438 | 37.888 | 1.00 | 41.91 | | N |
| ANISOU | 3482 | N | GLY | L | 80 | 4453 | 4624 | 6848 | 1240 | 207 | −32 | N |
| ATOM | 3483 | CA | GLY | L | 80 | 33.281 | −17.334 | 38.755 | 1.00 | 37.28 | | C |
| ANISOU | 3483 | CA | GLY | L | 80 | 3871 | 4133 | 6159 | 1165 | 93 | −2 | C |
| ATOM | 3484 | C | GLY | L | 80 | 31.880 | −16.809 | 38.545 | 1.00 | 41.43 | | C |
| ANISOU | 3484 | C | GLY | L | 80 | 4500 | 4681 | 6560 | 1065 | 104 | −79 | C |
| ATOM | 3485 | O | GLY | L | 80 | 31.395 | −16.049 | 39.393 | 1.00 | 43.05 | | O |
| ANISOU | 3485 | O | GLY | L | 80 | 4732 | 4947 | 6677 | 1006 | 19 | −53 | O |
| ATOM | 3486 | N | ASP | L | 81 | 31.217 | −17.178 | 37.442 | 1.00 | 39.36 | | N |
| ANISOU | 3486 | N | ASP | L | 81 | 4296 | 4370 | 6288 | 1045 | 204 | −173 | N |
| ATOM | 3487 | CA | ASP | L | 81 | 29.841 | −16.744 | 37.238 | 1.00 | 39.33 | | C |
| ANISOU | 3487 | CA | ASP | L | 81 | 4380 | 4381 | 6181 | 953 | 207 | −243 | C |
| ATOM | 3488 | C | ASP | L | 81 | 28.849 | −17.466 | 38.138 | 1.00 | 43.51 | | C |

TABLE 11-continued

| | | | | | | | | | | | |
|---|---|---|---|---|---|---|---|---|---|---|---|
| ANISOU | 3488 | C | ASP | L | 81 | 4996 | 4848 | 6688 | 930 | 188 | −212 | C |
| ATOM | 3489 | O | ASP | L | 81 | 27.674 | −17.067 | 38.169 | 1.00 | 38.46 | | O |
| ANISOU | 3489 | O | ASP | L | 81 | 4417 | 4224 | 5973 | 852 | 181 | −257 | O |
| ATOM | 3490 | CB | ASP | L | 81 | 29.439 | −16.917 | 35.769 | 1.00 | 38.53 | | C |
| ANISOU | 3490 | CB | ASP | L | 81 | 4319 | 4249 | 6074 | 937 | 303 | −355 | C |
| ATOM | 3491 | CG | ASP | L | 81 | 30.301 | −16.073 | 34.837 | 1.00 | 47.36 | | C |
| ANISOU | 3491 | CG | ASP | L | 81 | 5366 | 5436 | 7194 | 948 | 335 | −385 | C |
| ATOM | 3492 | OD1 | ASP | L | 81 | 30.817 | −15.035 | 35.304 | 1.00 | 49.47 | | O |
| ANISOU | 3492 | OD1 | ASP | L | 81 | 5562 | 5792 | 7443 | 931 | 269 | −339 | O |
| ATOM | 3493 | OD2 | ASP | L | 81 | 30.475 | −16.445 | 33.660 | 1.00 | 44.70 | | O |
| ANISOU | 3493 | OD2 | ASP | L | 81 | 5048 | 5061 | 6875 | 974 | 429 | −455 | O |
| ATOM | 3494 | N | GLU | L | 82 | 29.281 | −18.486 | 38.888 | 1.00 | 37.79 | | N |
| ANISOU | 3494 | N | GLU | L | 82 | 4277 | 4051 | 6031 | 996 | 181 | −131 | N |
| ATOM | 3495 | CA | GLU | L | 82 | 28.332 | −19.197 | 39.742 | 1.00 | 42.89 | | C |
| ANISOU | 3495 | CA | GLU | L | 82 | 5011 | 4629 | 6656 | 973 | 177 | −93 | C |
| ATOM | 3496 | C | GLU | L | 82 | 27.726 | −18.243 | 40.761 | 1.00 | 48.05 | | C |
| ANISOU | 3496 | C | GLU | L | 82 | 5691 | 5365 | 7203 | 908 | 99 | −57 | C |
| ATOM | 3497 | O | GLU | L | 82 | 28.444 | −17.554 | 41.491 | 1.00 | 48.66 | | O |
| ANISOU | 3497 | O | GLU | L | 82 | 5724 | 5517 | 7249 | 925 | 15 | 5 | O |
| ATOM | 3498 | CB | GLU | L | 82 | 28.995 | −20.377 | 40.445 | 1.00 | 42.45 | | C |
| ANISOU | 3498 | CB | GLU | L | 82 | 4958 | 4483 | 6686 | 1061 | 174 | 4 | C |
| ATOM | 3499 | CG | GLU | L | 82 | 28.991 | −21.637 | 39.606 | 1.00 | 50.60 | | C |
| ANISOU | 3499 | CG | GLU | L | 82 | 6018 | 5388 | 7818 | 1107 | 274 | −42 | C |
| ATOM | 3500 | CD | GLU | L | 82 | 29.223 | −22.903 | 40.420 | 1.00 | 51.85 | | C |
| ANISOU | 3500 | CD | GLU | L | 82 | 6213 | 5433 | 8053 | 1177 | 278 | 56 | C |
| ATOM | 3501 | OE1 | GLU | L | 82 | 29.276 | −23.996 | 39.810 | 1.00 | 45.54 | | O |
| ANISOU | 3501 | OE1 | GLU | L | 82 | 5441 | 4516 | 7347 | 1221 | 359 | 24 | O |
| ATOM | 3502 | OE2 | GLU | L | 82 | 29.361 | −22.806 | 41.661 | 1.00 | 46.61 | | O |
| ANISOU | 3502 | OE2 | GLU | L | 82 | 5560 | 4796 | 7355 | 1189 | 200 | 164 | O |
| ATOM | 3503 | N | ALA | L | 83 | 26.400 | −18.197 | 40.798 | 1.00 | 39.03 | | N |
| ANISOU | 3503 | N | ALA | L | 83 | 4618 | 4204 | 6006 | 834 | 128 | −101 | N |
| ATOM | 3504 | CA | ALA | L | 83 | 25.686 | −17.257 | 41.639 | 1.00 | 37.11 | | C |
| ANISOU | 3504 | CA | ALA | L | 83 | 4406 | 4034 | 5661 | 770 | 77 | −83 | C |
| ATOM | 3505 | C | ALA | L | 83 | 24.208 | −17.548 | 41.485 | 1.00 | 38.97 | | C |
| ANISOU | 3505 | C | ALA | L | 83 | 4706 | 4219 | 5883 | 700 | 136 | −135 | C |
| ATOM | 3506 | O | ALA | L | 83 | 23.786 | −18.282 | 40.585 | 1.00 | 43.64 | | O |
| ANISOU | 3506 | O | ALA | L | 83 | 5311 | 4735 | 6536 | 690 | 200 | −199 | O |
| ATOM | 3507 | CB | ALA | L | 83 | 25.971 | −15.794 | 41.260 | 1.00 | 37.54 | | C |
| ANISOU | 3507 | CB | ALA | L | 83 | 4404 | 4204 | 5655 | 736 | 27 | −129 | C |
| ATOM | 3508 | N | ASP | L | 84 | 23.426 | −16.963 | 42.381 | 1.00 | 32.64 | | N |
| ANISOU | 3508 | N | ASP | L | 84 | 3943 | 3456 | 5002 | 650 | 115 | −109 | N |
| ATOM | 3509 | CA | ASP | L | 84 | 21.994 | −16.856 | 42.189 | 1.00 | 33.86 | | C |
| ANISOU | 3509 | CA | ASP | L | 84 | 4131 | 3591 | 5142 | 573 | 163 | −166 | C |
| ATOM | 3510 | C | ASP | L | 84 | 21.734 | −15.609 | 41.352 | 1.00 | 39.27 | | C |
| ANISOU | 3510 | C | ASP | L | 84 | 4774 | 4365 | 5784 | 527 | 138 | −254 | C |
| ATOM | 3511 | O | ASP | L | 84 | 22.310 | −14.555 | 41.619 | 1.00 | 42.92 | | O |
| ANISOU | 3511 | O | ASP | L | 84 | 5207 | 4915 | 6184 | 532 | 79 | −241 | O |
| ATOM | 3512 | CB | ASP | L | 84 | 21.283 | −16.762 | 43.539 | 1.00 | 34.34 | | C |
| ANISOU | 3512 | CB | ASP | L | 84 | 4253 | 3654 | 5140 | 547 | 167 | −95 | C |
| ATOM | 3513 | CG | ASP | L | 84 | 21.527 | −17.999 | 44.401 | 1.00 | 49.91 | | C |
| ANISOU | 3513 | CG | ASP | L | 84 | 6280 | 5535 | 7147 | 595 | 193 | 6 | C |
| ATOM | 3514 | OD1 | ASP | L | 84 | 21.541 | −19.108 | 43.835 | 1.00 | 51.21 | | O |
| ANISOU | 3514 | OD1 | ASP | L | 84 | 6448 | 5602 | 7408 | 613 | 242 | −6 | O |
| ATOM | 3515 | OD2 | ASP | L | 84 | 21.725 | −17.862 | 45.626 | 1.00 | 54.70 | | O |
| ANISOU | 3515 | OD2 | ASP | L | 84 | 6936 | 6166 | 7682 | 615 | 162 | 96 | O |
| ATOM | 3516 | N | TYR | L | 85 | 20.876 | −15.728 | 40.346 | 1.00 | 37.07 | | N |
| ANISOU | 3516 | N | TYR | L | 85 | 4492 | 4055 | 5537 | 480 | 177 | −342 | N |
| ATOM | 3517 | CA | TYR | L | 85 | 20.508 | −14.604 | 39.488 | 1.00 | 35.18 | | C |
| ANISOU | 3517 | CA | TYR | L | 85 | 4222 | 3889 | 5258 | 436 | 153 | −423 | C |
| ATOM | 3518 | C | TYR | L | 85 | 19.023 | −14.339 | 39.642 | 1.00 | 28.57 | | C |
| ANISOU | 3518 | C | TYR | L | 85 | 3400 | 3044 | 4412 | 365 | 171 | −456 | C |
| ATOM | 3519 | O | TYR | L | 85 | 18.219 | −15.271 | 39.543 | 1.00 | 35.40 | | O |
| ANISOU | 3519 | O | TYR | L | 85 | 4287 | 3824 | 5339 | 338 | 217 | −472 | O |
| ATOM | 3520 | CB | TYR | L | 85 | 20.835 | −14.900 | 38.018 | 1.00 | 34.88 | | C |
| ANISOU | 3520 | CB | TYR | L | 85 | 4167 | 3827 | 5258 | 448 | 171 | −504 | C |
| ATOM | 3521 | CG | TYR | L | 85 | 22.303 | −14.964 | 37.756 | 1.00 | 33.47 | | C |
| ANISOU | 3521 | CG | TYR | L | 85 | 3955 | 3667 | 5094 | 518 | 164 | −478 | C |
| ATOM | 3522 | CD1 | TYR | L | 85 | 23.014 | −16.135 | 37.975 | 1.00 | 31.26 | | C |
| ANISOU | 3522 | CD1 | TYR | L | 85 | 3683 | 3312 | 4883 | 581 | 195 | −432 | C |
| ATOM | 3523 | CD2 | TYR | L | 85 | 22.994 | −13.847 | 37.306 | 1.00 | 30.10 | | C |
| ANISOU | 3523 | CD2 | TYR | L | 85 | 3483 | 3330 | 4623 | 523 | 131 | −493 | C |
| ATOM | 3524 | CE1 | TYR | L | 85 | 24.372 | −16.200 | 37.737 | 1.00 | 32.16 | | C |
| ANISOU | 3524 | CE1 | TYR | L | 85 | 3751 | 3441 | 5027 | 651 | 193 | −405 | C |
| ATOM | 3525 | CE2 | TYR | L | 85 | 24.341 | −13.902 | 37.066 | 1.00 | 33.41 | | C |
| ANISOU | 3525 | CE2 | TYR | L | 85 | 3856 | 3765 | 5072 | 585 | 133 | −465 | C |
| ATOM | 3526 | CZ | TYR | L | 85 | 25.029 | −15.089 | 37.287 | 1.00 | 36.65 | | C |
| ANISOU | 3526 | CZ | TYR | L | 85 | 4266 | 4102 | 5557 | 651 | 164 | −422 | C |
| ATOM | 3527 | OH | TYR | L | 85 | 26.375 | −15.156 | 37.050 | 1.00 | 35.12 | | O |
| ANISOU | 3527 | OH | TYR | L | 85 | 4013 | 3922 | 5411 | 718 | 170 | −391 | O |
| ATOM | 3528 | N | TYR | L | 86 | 18.658 | −13.073 | 39.892 | 1.00 | 31.63 | | N |

TABLE 11-continued

| | | | | | | | | | | | |
|---|---|---|---|---|---|---|---|---|---|---|---|
| ANISOU | 3528 | N | TYR | L | 86 | 3772 | 3513 | 4732 | 334 | 138 | −467 | N |
| ATOM | 3529 | CA | TYR | L | 86 | 17.273 | −12.672 | 40.105 | 1.00 | 30.17 | | C |
| ANISOU | 3529 | CA | TYR | L | 86 | 3589 | 3329 | 4544 | 273 | 157 | −493 | C |
| ATOM | 3530 | C | TYR | L | 86 | 16.849 | −11.674 | 39.043 | 1.00 | 32.78 | | C |
| ANISOU | 3530 | C | TYR | L | 86 | 3883 | 3713 | 4858 | 240 | 122 | −575 | C |
| ATOM | 3531 | O | TYR | L | 86 | 17.591 | −10.736 | 38.738 | 1.00 | 29.72 | | O |
| ANISOU | 3531 | O | TYR | L | 86 | 3479 | 3397 | 4418 | 257 | 78 | −584 | O |
| ATOM | 3532 | CB | TYR | L | 86 | 17.092 | −12.004 | 41.477 | 1.00 | 32.56 | | C |
| ANISOU | 3532 | CB | TYR | L | 86 | 3916 | 3675 | 4779 | 271 | 156 | −430 | C |
| ATOM | 3533 | CG | TYR | L | 86 | 17.414 | −12.897 | 42.639 | 1.00 | 39.49 | | C |
| ANISOU | 3533 | CG | TYR | L | 86 | 4846 | 4506 | 5654 | 304 | 186 | −338 | C |
| ATOM | 3534 | CD1 | TYR | L | 86 | 16.432 | −13.698 | 43.196 | 1.00 | 45.07 | | C |
| ANISOU | 3534 | CD1 | TYR | L | 86 | 5583 | 5140 | 6403 | 276 | 258 | −309 | C |
| ATOM | 3535 | CD2 | TYR | L | 86 | 18.696 | −12.948 | 43.179 | 1.00 | 40.27 | | C |
| ANISOU | 3535 | CD2 | TYR | L | 86 | 4961 | 4629 | 5712 | 361 | 141 | −275 | C |
| ATOM | 3536 | CE1 | TYR | L | 86 | 16.704 | −14.523 | 44.247 | 1.00 | 45.89 | | C |
| ANISOU | 3536 | CE1 | TYR | L | 86 | 5745 | 5194 | 6498 | 307 | 290 | −218 | C |
| ATOM | 3537 | CE2 | TYR | L | 86 | 18.975 | −13.770 | 44.246 | 1.00 | 41.74 | | C |
| ANISOU | 3537 | CE2 | TYR | L | 86 | 5201 | 4769 | 5888 | 395 | 158 | −185 | C |
| ATOM | 3538 | CZ | TYR | L | 86 | 17.965 | −14.563 | 44.769 | 1.00 | 45.16 | | C |
| ANISOU | 3538 | CZ | TYR | L | 86 | 5677 | 5128 | 6354 | 368 | 236 | −155 | C |
| ATOM | 3539 | OH | TYR | L | 86 | 18.195 | −15.402 | 45.833 | 1.00 | 55.29 | | O |
| ANISOU | 3539 | OH | TYR | L | 86 | 7026 | 6359 | 7622 | 402 | 261 | −56 | O |
| ATOM | 3540 | N | CYS | L | 87 | 15.654 | −11.850 | 38.499 | 1.00 | 33.40 | | N |
| ANISOU | 3540 | N | CYS | L | 87 | 3949 | 3757 | 4986 | 190 | 136 | −631 | N |
| ATOM | 3541 | CA | CYS | L | 87 | 15.066 | −10.799 | 37.677 | 1.00 | 31.64 | | C |
| ANISOU | 3541 | CA | CYS | L | 87 | 3695 | 3587 | 4741 | 157 | 95 | −696 | C |
| ATOM | 3542 | C | CYS | L | 87 | 14.111 | −9.955 | 38.512 | 1.00 | 31.52 | | C |
| ANISOU | 3542 | C | CYS | L | 87 | 3663 | 3603 | 4712 | 127 | 104 | −678 | C |
| ATOM | 3543 | O | CYS | L | 87 | 13.685 | −10.344 | 39.598 | 1.00 | 30.81 | | O |
| ANISOU | 3543 | O | CYS | L | 87 | 3587 | 3482 | 4636 | 121 | 155 | −627 | O |
| ATOM | 3544 | CB | CYS | L | 87 | 14.336 | −11.386 | 36.463 | 1.00 | 29.93 | | C |
| ANISOU | 3544 | CB | CYS | L | 87 | 3470 | 3318 | 4585 | 122 | 85 | −776 | C |
| ATOM | 3545 | SG | CYS | L | 87 | 13.016 | −12.524 | 36.873 | 1.00 | 35.84 | | S |
| ANISOU | 3545 | SG | CYS | L | 87 | 4208 | 3966 | 5443 | 70 | 133 | −778 | S |
| ATOM | 3546 | N | GLN | L | 88 | 13.775 | −8.783 | 37.983 | 1.00 | 29.77 | | N |
| ANISOU | 3546 | N | GLN | L | 88 | 3414 | 3439 | 4459 | 112 | 61 | −720 | N |
| ATOM | 3547 | CA | GLN | L | 88 | 13.036 | −7.800 | 38.756 | 1.00 | 28.18 | | C |
| ANISOU | 3547 | CA | GLN | L | 88 | 3197 | 3273 | 4237 | 96 | 70 | −705 | C |
| ATOM | 3548 | C | GLN | L | 88 | 12.296 | −6.878 | 37.798 | 1.00 | 29.92 | | C |
| ANISOU | 3548 | C | GLN | L | 88 | 3376 | 3523 | 4467 | 71 | 23 | −767 | C |
| ATOM | 3549 | O | GLN | L | 88 | 12.839 | −6.521 | 36.749 | 1.00 | 31.52 | | O |
| ANISOU | 3549 | O | GLN | L | 88 | 3580 | 3754 | 4640 | 80 | −29 | −802 | O |
| ATOM | 3550 | CB | GLN | L | 88 | 13.999 | −6.996 | 39.652 | 1.00 | 29.19 | | C |
| ANISOU | 3550 | CB | GLN | L | 88 | 3358 | 3459 | 4276 | 130 | 58 | −656 | C |
| ATOM | 3551 | CG | GLN | L | 88 | 13.323 | −5.867 | 40.461 | 1.00 | 34.91 | | C |
| ANISOU | 3551 | CG | GLN | L | 88 | 4082 | 4219 | 4964 | 120 | 70 | −649 | C |
| ATOM | 3552 | CD | GLN | L | 88 | 14.272 | −4.704 | 40.723 | 1.00 | 29.90 | | C |
| ANISOU | 3552 | CD | GLN | L | 88 | 3468 | 3648 | 4244 | 142 | 20 | −638 | C |
| ATOM | 3553 | OE1 | GLN | L | 88 | 14.945 | −4.233 | 39.808 | 1.00 | 29.92 | | O |
| ANISOU | 3553 | OE1 | GLN | L | 88 | 3453 | 3682 | 4234 | 148 | −32 | −664 | O |
| ATOM | 3554 | NE2 | GLN | L | 88 | 14.327 | −4.233 | 41.965 | 1.00 | 31.96 | | N |
| ANISOU | 3554 | NE2 | GLN | L | 88 | 3771 | 3926 | 4445 | 152 | 38 | −602 | N |
| ATOM | 3555 | N | VAL | L | 89 | 11.062 | −6.496 | 38.160 | 1.00 | 32.71 | | N |
| ANISOU | 3555 | N | VAL | L | 89 | 3692 | 3869 | 4866 | 43 | 44 | −775 | N |
| ATOM | 3556 | CA | VAL | L | 89 | 10.320 | −5.475 | 37.433 | 1.00 | 29.38 | | C |
| ANISOU | 3556 | CA | VAL | L | 89 | 3227 | 3478 | 4457 | 28 | −5 | −821 | C |
| ATOM | 3557 | C | VAL | L | 89 | 9.585 | −4.574 | 38.411 | 1.00 | 35.85 | | C |
| ANISOU | 3557 | C | VAL | L | 89 | 4027 | 4316 | 5279 | 28 | 34 | −799 | C |
| ATOM | 3558 | O | VAL | L | 89 | 9.252 | −4.968 | 39.536 | 1.00 | 31.51 | | O |
| ANISOU | 3558 | O | VAL | L | 89 | 3487 | 3741 | 4744 | 26 | 111 | −759 | O |
| ATOM | 3559 | CB | VAL | L | 89 | 9.311 | −6.050 | 36.404 | 1.00 | 25.95 | | C |
| ANISOU | 3559 | CB | VAL | L | 89 | 2746 | 3001 | 4114 | −11 | −39 | −876 | C |
| ATOM | 3560 | CG1 | VAL | L | 89 | 10.028 | −6.971 | 35.395 | 1.00 | 28.41 | | C |
| ANISOU | 3560 | CG1 | VAL | L | 89 | 3093 | 3286 | 4414 | −9 | −72 | −909 | C |
| ATOM | 3561 | CG2 | VAL | L | 89 | 8.150 | −6.782 | 37.097 | 1.00 | 30.50 | | C |
| ANISOU | 3561 | CG2 | VAL | L | 89 | 3275 | 3517 | 4796 | −46 | 26 | −863 | C |
| ATOM | 3562 | N | TRP | L | 90 | 9.332 | −3.352 | 37.950 | 1.00 | 30.29 | | N |
| ANISOU | 3562 | N | TRP | L | 90 | 3301 | 3653 | 4557 | 34 | −13 | −825 | N |
| ATOM | 3563 | CA | TRP | L | 90 | 8.453 | −2.404 | 38.628 | 1.00 | 30.90 | | C |
| ANISOU | 3563 | CA | TRP | L | 90 | 3349 | 3740 | 4654 | 37 | 20 | −821 | C |
| ATOM | 3564 | C | TRP | L | 90 | 7.028 | −2.638 | 38.136 | 1.00 | 32.11 | | C |
| ANISOU | 3564 | C | TRP | L | 90 | 3416 | 3857 | 4927 | 6 | 18 | −852 | C |
| ATOM | 3565 | O | TRP | L | 90 | 6.757 | −2.538 | 36.936 | 1.00 | 37.70 | | O |
| ANISOU | 3565 | O | TRP | L | 90 | 4091 | 4567 | 5665 | −6 | −63 | −893 | O |
| ATOM | 3566 | CB | TRP | L | 90 | 8.912 | −0.976 | 38.328 | 1.00 | 30.82 | | C |
| ANISOU | 3566 | CB | TRP | L | 90 | 3355 | 3780 | 4576 | 60 | −35 | −832 | C |
| ATOM | 3567 | CG | TRP | L | 90 | 8.016 | 0.136 | 38.801 | 1.00 | 30.81 | | C |
| ANISOU | 3567 | CG | TRP | L | 90 | 3323 | 3783 | 4599 | 70 | −12 | −839 | C |
| ATOM | 3568 | CD1 | TRP | L | 90 | 7.252 | 0.971 | 38.019 | 1.00 | 27.71 | | C |

TABLE 11-continued

| | | | | | | | | | | | |
|---|---|---|---|---|---|---|---|---|---|---|---|
| ANISOU | 3568 | CD1 | TRP | L | 90 | 2878 | 3396 | 4256 | 71 | −62 | −869 | C |
| ATOM | 3569 | CD2 | TRP | L | 90 | 7.822 | 0.564 | 40.153 | 1.00 | 31.29 | | C |
| ANISOU | 3569 | CD2 | TRP | L | 90 | 3413 | 3842 | 4632 | 85 | 68 | −814 | C |
| ATOM | 3570 | NE1 | TRP | L | 90 | 6.590 | 1.882 | 38.816 | 1.00 | 27.73 | | N |
| ANISOU | 3570 | NE1 | TRP | L | 90 | 2866 | 3395 | 4276 | 90 | −12 | −865 | N |
| ATOM | 3571 | CE2 | TRP | L | 90 | 6.921 | 1.651 | 40.125 | 1.00 | 32.78 | | C |
| ANISOU | 3571 | CE2 | TRP | L | 90 | 3559 | 4030 | 4864 | 98 | 73 | −836 | C |
| ATOM | 3572 | CE3 | TRP | L | 90 | 8.312 | 0.127 | 41.387 | 1.00 | 32.45 | | C |
| ANISOU | 3572 | CE3 | TRP | L | 90 | 3626 | 3985 | 4718 | 94 | 136 | −776 | C |
| ATOM | 3573 | CZ2 | TRP | L | 90 | 6.511 | 2.312 | 41.284 | 1.00 | 33.61 | | C |
| ANISOU | 3573 | CZ2 | TRP | L | 90 | 3689 | 4130 | 4953 | 119 | 153 | −827 | C |
| ATOM | 3574 | CZ3 | TRP | L | 90 | 7.902 | 0.784 | 42.538 | 1.00 | 37.41 | | C |
| ANISOU | 3574 | CZ3 | TRP | L | 90 | 4287 | 4612 | 5316 | 111 | 209 | −765 | C |
| ATOM | 3575 | CH2 | TRP | L | 90 | 7.012 | 1.868 | 42.478 | 1.00 | 35.04 | | C |
| ANISOU | 3575 | CH2 | TRP | L | 90 | 3945 | 4308 | 5059 | 124 | 223 | −794 | C |
| ATOM | 3576 | N | ASP | L | 91 | 6.122 | −2.963 | 39.048 | 1.00 | 32.46 | | N |
| ANISOU | 3576 | N | ASP | L | 91 | 3425 | 3866 | 5041 | −6 | 106 | −831 | N |
| ATOM | 3577 | CA | ASP | L | 91 | 4.712 | −3.089 | 38.676 | 1.00 | 34.68 | | C |
| ANISOU | 3577 | CA | ASP | L | 91 | 3606 | 4114 | 5459 | −36 | 107 | −856 | C |
| ATOM | 3578 | C | ASP | L | 91 | 4.108 | −1.697 | 38.704 | 1.00 | 34.49 | | C |
| ANISOU | 3578 | C | ASP | L | 91 | 3540 | 4119 | 5447 | −11 | 95 | −868 | C |
| ATOM | 3579 | O | ASP | L | 91 | 3.714 | −1.204 | 39.764 | 1.00 | 40.37 | | O |
| ANISOU | 3579 | O | ASP | L | 91 | 4284 | 4862 | 6194 | 8 | 186 | −844 | O |
| ATOM | 3580 | CB | ASP | L | 91 | 3.961 | −4.020 | 39.615 | 1.00 | 34.30 | | C |
| ANISOU | 3580 | CB | ASP | L | 91 | 3525 | 4009 | 5497 | −62 | 221 | −824 | C |
| ATOM | 3581 | CG | ASP | L | 91 | 2.537 | −4.311 | 39.125 | 1.00 | 41.24 | | C |
| ANISOU | 3581 | CG | ASP | L | 91 | 4281 | 4846 | 6543 | −103 | 214 | −851 | C |
| ATOM | 3582 | OD1 | ASP | L | 91 | 2.005 | −3.515 | 38.324 | 1.00 | 42.48 | | O |
| ANISOU | 3582 | OD1 | ASP | L | 91 | 4375 | 5024 | 6742 | −99 | 131 | −889 | O |
| ATOM | 3583 | OD2 | ASP | L | 91 | 1.954 | −5.336 | 39.528 | 1.00 | 44.79 | | O |
| ANISOU | 3583 | OD2 | ASP | L | 91 | 4692 | 5236 | 7089 | −141 | 286 | −833 | O |
| ATOM | 3584 | N | TYR | L | 92 | 4.031 | −1.048 | 37.541 | 1.00 | 36.19 | | N |
| ANISOU | 3584 | N | TYR | L | 92 | 3728 | 4357 | 5665 | −7 | −14 | −905 | N |
| ATOM | 3585 | CA | TYR | L | 92 | 3.536 | 0.323 | 37.544 | 1.00 | 35.16 | | C |
| ANISOU | 3585 | CA | TYR | L | 92 | 3564 | 4248 | 5545 | 24 | −31 | −912 | C |
| ATOM | 3586 | C | TYR | L | 92 | 2.048 | 0.400 | 37.839 | 1.00 | 39.91 | | C |
| ANISOU | 3586 | C | TYR | L | 92 | 4053 | 4816 | 6296 | 16 | 17 | −915 | C |
| ATOM | 3587 | O | TYR | L | 92 | 1.550 | 1.500 | 38.086 | 1.00 | 43.19 | | O |
| ANISOU | 3587 | O | TYR | L | 92 | 4437 | 5240 | 6734 | 50 | 32 | −915 | O |
| ATOM | 3588 | CB | TYR | L | 92 | 3.839 | 1.006 | 36.214 | 1.00 | 36.91 | | C |
| ANISOU | 3588 | CB | TYR | L | 92 | 3795 | 4500 | 5729 | 34 | −160 | −940 | C |
| ATOM | 3589 | CG | TYR | L | 92 | 3.788 | 0.080 | 35.020 | 1.00 | 37.31 | | C |
| ANISOU | 3589 | CG | TYR | L | 92 | 3832 | 4538 | 5807 | −0 | −248 | −971 | C |
| ATOM | 3590 | CD1 | TYR | L | 92 | 2.588 | −0.455 | 34.577 | 1.00 | 41.44 | | C |
| ANISOU | 3590 | CD1 | TYR | L | 92 | 4259 | 5025 | 6462 | −33 | −282 | −996 | C |
| ATOM | 3591 | CD2 | TYR | L | 92 | 4.945 | −0.248 | 34.331 | 1.00 | 48.24 | | C |
| ANISOU | 3591 | CD2 | TYR | L | 92 | 5299 | 5943 | 7087 | −1 | −296 | −980 | C |
| ATOM | 3592 | CE1 | TYR | L | 92 | 2.549 | −1.311 | 33.485 | 1.00 | 46.89 | | C |
| ANISOU | 3592 | CE1 | TYR | L | 92 | 4949 | 5698 | 7168 | −67 | −372 | −1034 | C |
| ATOM | 3593 | CE2 | TYR | L | 92 | 4.916 | −1.088 | 33.245 | 1.00 | 46.44 | | C |
| ANISOU | 3593 | CE2 | TYR | L | 92 | 5076 | 5699 | 6871 | −28 | −368 | −1016 | C |
| ATOM | 3594 | CZ | TYR | L | 92 | 3.728 | −1.614 | 32.821 | 1.00 | 48.05 | | C |
| ANISOU | 3594 | CZ | TYR | L | 92 | 5198 | 5866 | 7194 | −63 | −411 | −1046 | C |
| ATOM | 3595 | OH | TYR | L | 92 | 3.729 | −2.453 | 31.735 | 1.00 | 50.95 | | O |
| ANISOU | 3595 | OH | TYR | L | 92 | 5583 | 6212 | 7562 | −93 | −493 | −1092 | O |
| ATOM | 3596 | N | ARG | L | 93 | 1.331 | −0.730 | 37.832 | 1.00 | 39.64 | | N |
| ANISOU | 3596 | N | ARG | L | 93 | 3951 | 4738 | 6372 | −26 | 45 | −917 | N |
| ATOM | 3597 | CA | ARG | L | 93 | −0.086 | −0.697 | 38.198 | 1.00 | 41.41 | | C |
| ANISOU | 3597 | CA | ARG | L | 93 | 4051 | 4926 | 6758 | −37 | 106 | −913 | C |
| ATOM | 3598 | C | ARG | L | 93 | −0.253 | −0.491 | 39.699 | 1.00 | 40.96 | | C |
| ANISOU | 3598 | C | ARG | L | 93 | 4017 | 4858 | 6688 | −14 | 271 | −873 | C |
| ATOM | 3599 | O | ARG | L | 93 | −1.016 | 0.376 | 40.135 | 1.00 | 43.56 | | O |
| ANISOU | 3599 | O | ARG | L | 93 | 4290 | 5185 | 7077 | 17 | 327 | −871 | O |
| ATOM | 3600 | CB | ARG | L | 93 | −0.796 | −1.980 | 37.751 | 1.00 | 40.71 | | C |
| ANISOU | 3600 | CB | ARG | L | 93 | 3879 | 4786 | 6803 | −99 | 87 | −927 | C |
| ATOM | 3601 | CG | ARG | L | 93 | −2.332 | −1.887 | 37.925 | 1.00 | 55.53 | | C |
| ANISOU | 3601 | CG | ARG | L | 93 | 5597 | 6625 | 8876 | −115 | 128 | −927 | C |
| ATOM | 3602 | CD | ARG | L | 93 | −3.052 | −3.186 | 37.548 | 1.00 | 60.28 | | C |
| ANISOU | 3602 | CD | ARG | L | 93 | 6110 | 7167 | 9627 | −187 | 111 | −941 | C |
| ATOM | 3603 | NE | ARG | L | 93 | −2.728 | −4.277 | 38.462 | 1.00 | 62.30 | | N |
| ANISOU | 3603 | NE | ARG | L | 93 | 6418 | 7382 | 9869 | −216 | 239 | −904 | N |
| ATOM | 3604 | CZ | ARG | L | 93 | −3.389 | −4.543 | 39.587 | 1.00 | 60.65 | | C |
| ANISOU | 3604 | CZ | ARG | L | 93 | 6162 | 7137 | 9747 | −225 | 401 | −859 | C |
| ATOM | 3605 | NH1 | ARG | L | 93 | −4.433 | −3.800 | 39.948 | 1.00 | 54.02 | | N |
| ANISOU | 3605 | NH1 | ARG | L | 93 | 5208 | 6294 | 9023 | −206 | 463 | −850 | N |
| ATOM | 3606 | NH2 | ARG | L | 93 | −3.003 | −5.560 | 40.350 | 1.00 | 53.10 | | N |
| ANISOU | 3606 | NH2 | ARG | L | 93 | 5272 | 6142 | 8761 | −249 | 508 | −819 | N |
| ATOM | 3607 | N | THR | L | 94 | 0.491 | −1.248 | 40.510 | 1.00 | 43.05 | | N |
| ANISOU | 3607 | N | THR | L | 94 | 4375 | 5116 | 6867 | −22 | 350 | −841 | N |
| ATOM | 3608 | CA | THR | L | 94 | 0.318 | −1.198 | 41.954 | 1.00 | 46.58 | | C |

TABLE 11-continued

| | | | | | | | | | | | | |
|---|---|---|---|---|---|---|---|---|---|---|---|---|
| ANISOU | 3608 | CA | THR | L | 94 | 4862 | 5550 | 7288 | −3 | 509 | −799 | C |
| ATOM | 3609 | C | THR | L | 94 | 1.402 | −0.405 | 42.662 | 1.00 | 44.70 | | C |
| ANISOU | 3609 | C | THR | L | 94 | 4758 | 5354 | 6871 | 43 | 524 | −787 | C |
| ATOM | 3610 | O | THR | L | 94 | 1.265 | −0.151 | 43.862 | 1.00 | 45.96 | | O |
| ANISOU | 3610 | O | THR | L | 94 | 4969 | 5507 | 6987 | 66 | 647 | −761 | O |
| ATOM | 3611 | CB | THR | L | 94 | 0.272 | −2.617 | 42.542 | 1.00 | 46.55 | | C |
| ANISOU | 3611 | CB | THR | L | 94 | 4873 | 5499 | 7316 | −43 | 599 | −760 | C |
| ATOM | 3612 | OG1 | THR | L | 94 | 1.528 | −3.271 | 42.337 | 1.00 | 46.19 | | O |
| ANISOU | 3612 | OG1 | THR | L | 94 | 4930 | 5466 | 7155 | −49 | 539 | −751 | O |
| ATOM | 3613 | CG2 | THR | L | 94 | −0.846 | −3.427 | 41.891 | 1.00 | 49.69 | | C |
| ANISOU | 3613 | CG2 | THR | L | 94 | 5130 | 5843 | 7906 | −99 | 586 | −775 | C |
| ATOM | 3614 | N | LEU | L | 95 | 2.469 | −0.016 | 41.951 | 1.00 | 41.59 | | N |
| ANISOU | 3614 | N | LEU | L | 95 | 4426 | 5001 | 6376 | 53 | 404 | −807 | N |
| ATOM | 3615 | CA | LEU | L | 95 | 3.597 | 0.725 | 42.518 | 1.00 | 41.22 | | C |
| ANISOU | 3615 | CA | LEU | L | 95 | 4498 | 4992 | 6171 | 87 | 395 | −799 | C |
| ATOM | 3616 | C | LEU | L | 95 | 4.381 | −0.151 | 43.500 | 1.00 | 44.97 | | C |
| ANISOU | 3616 | C | LEU | L | 95 | 5072 | 5463 | 6552 | 83 | 459 | −754 | C |
| ATOM | 3617 | O | LEU | L | 95 | 4.657 | 0.243 | 44.633 | 1.00 | 40.24 | | O |
| ANISOU | 3617 | O | LEU | L | 95 | 4558 | 4873 | 5861 | 108 | 529 | −734 | O |
| ATOM | 3618 | CB | LEU | L | 95 | 3.146 | 2.040 | 43.172 | 1.00 | 37.75 | | C |
| ANISOU | 3618 | CB | LEU | L | 95 | 4069 | 4560 | 5716 | 128 | 450 | −811 | C |
| ATOM | 3619 | CG | LEU | L | 95 | 2.151 | 2.852 | 42.329 | 1.00 | 42.32 | | C |
| ANISOU | 3619 | CG | LEU | L | 95 | 4535 | 5130 | 6414 | 139 | 404 | −844 | C |
| ATOM | 3620 | CD1 | LEU | L | 95 | 1.748 | 4.110 | 43.048 | 1.00 | 49.22 | | C |
| ANISOU | 3620 | CD1 | LEU | L | 95 | 5426 | 5999 | 7275 | 186 | 472 | −856 | C |
| ATOM | 3621 | CD2 | LEU | L | 95 | 2.737 | 3.184 | 40.958 | 1.00 | 39.82 | | C |
| ANISOU | 3621 | CD2 | LEU | L | 95 | 4211 | 4842 | 6078 | 133 | 248 | −868 | C |
| ATOM | 3622 | N | ASP | L | 96 | 4.757 | −1.347 | 43.038 | 1.00 | 33.69 | | N |
| ANISOU | 3622 | N | ASP | L | 96 | 3639 | 4018 | 5145 | 54 | 426 | −741 | N |
| ATOM | 3623 | CA | ASP | L | 96 | 5.535 | −2.291 | 43.825 | 1.00 | 37.48 | | C |
| ANISOU | 3623 | CA | ASP | L | 96 | 4205 | 4487 | 5548 | 53 | 471 | −693 | C |
| ATOM | 3624 | C | ASP | L | 96 | 6.662 | −2.845 | 42.972 | 1.00 | 34.47 | | C |
| ANISOU | 3624 | C | ASP | L | 96 | 3850 | 4121 | 5128 | 47 | 367 | −699 | C |
| ATOM | 3625 | O | ASP | L | 96 | 6.519 | −3.014 | 41.758 | 1.00 | 33.30 | | O |
| ANISOU | 3625 | O | ASP | L | 96 | 3640 | 3968 | 5043 | 28 | 291 | −737 | O |
| ATOM | 3626 | CB | ASP | L | 96 | 4.700 | −3.487 | 44.327 | 1.00 | 45.97 | | C |
| ANISOU | 3626 | CB | ASP | L | 96 | 5247 | 5501 | 6717 | 23 | 579 | −657 | C |
| ATOM | 3627 | CG | ASP | L | 96 | 3.626 | −3.087 | 45.301 | 1.00 | 56.70 | | C |
| ANISOU | 3627 | CG | ASP | L | 96 | 6586 | 6841 | 8116 | 31 | 712 | −640 | C |
| ATOM | 3628 | OD1 | ASP | L | 96 | 3.835 | −2.126 | 46.073 | 1.00 | 62.73 | | O |
| ANISOU | 3628 | OD1 | ASP | L | 96 | 7419 | 7634 | 8780 | 68 | 746 | −639 | O |
| ATOM | 3629 | OD2 | ASP | L | 96 | 2.568 | −3.742 | 45.292 | 1.00 | 61.37 | | O |
| ANISOU | 3629 | OD2 | ASP | L | 96 | 7092 | 7383 | 8844 | −2 | 786 | −630 | O |
| ATOM | 3630 | N | TRP | L | 97 | 7.775 | −3.146 | 43.627 | 1.00 | 34.11 | | N |
| ANISOU | 3630 | N | TRP | L | 97 | 3896 | 4089 | 4976 | 66 | 366 | −660 | N |
| ATOM | 3631 | CA | TRP | L | 97 | 8.855 | −3.898 | 43.007 | 1.00 | 31.10 | | C |
| ANISOU | 3631 | CA | TRP | L | 97 | 3538 | 3710 | 4570 | 67 | 296 | −654 | C |
| ATOM | 3632 | C | TRP | L | 97 | 8.616 | −5.384 | 43.177 | 1.00 | 34.80 | | C |
| ANISOU | 3632 | C | TRP | L | 97 | 4003 | 4117 | 5102 | 46 | 352 | −621 | C |
| ATOM | 3633 | O | TRP | L | 97 | 8.244 | −5.838 | 44.263 | 1.00 | 34.89 | | O |
| ANISOU | 3633 | O | TRP | L | 97 | 4050 | 4098 | 5108 | 47 | 447 | −572 | O |
| ATOM | 3634 | CB | TRP | L | 97 | 10.194 | −3.537 | 43.633 | 1.00 | 27.61 | | C |
| ANISOU | 3634 | CB | TRP | L | 97 | 3182 | 3309 | 4000 | 99 | 260 | −623 | C |
| ATOM | 3635 | CG | TRP | L | 97 | 10.734 | −2.249 | 43.134 | 1.00 | 34.57 | | C |
| ANISOU | 3635 | CG | TRP | L | 97 | 4061 | 4243 | 4831 | 111 | 180 | −659 | C |
| ATOM | 3636 | CD1 | TRP | L | 97 | 10.766 | −1.062 | 43.792 | 1.00 | 29.99 | | C |
| ANISOU | 3636 | CD1 | TRP | L | 97 | 3519 | 3692 | 4184 | 126 | 182 | −666 | C |
| ATOM | 3637 | CD2 | TRP | L | 97 | 11.305 | −2.023 | 41.850 | 1.00 | 33.50 | | C |
| ANISOU | 3637 | CD2 | TRP | L | 97 | 3890 | 4128 | 4709 | 108 | 95 | −693 | C |
| ATOM | 3638 | NE1 | TRP | L | 97 | 11.346 | −0.092 | 42.993 | 1.00 | 31.14 | | N |
| ANISOU | 3638 | NE1 | TRP | L | 97 | 3649 | 3872 | 4309 | 129 | 97 | −699 | N |
| ATOM | 3639 | CE2 | TRP | L | 97 | 11.689 | −0.666 | 41.796 | 1.00 | 30.78 | | C |
| ANISOU | 3639 | CE2 | TRP | L | 97 | 3559 | 3826 | 4309 | 118 | 47 | −712 | C |
| ATOM | 3640 | CE3 | TRP | L | 97 | 11.545 | −2.845 | 40.735 | 1.00 | 26.93 | | C |
| ANISOU | 3640 | CE3 | TRP | L | 97 | 3025 | 3281 | 3927 | 97 | 59 | −709 | C |
| ATOM | 3641 | CZ2 | TRP | L | 97 | 12.282 | −0.108 | 40.674 | 1.00 | 33.38 | | C |
| ANISOU | 3641 | CZ2 | TRP | L | 97 | 3866 | 4182 | 4634 | 117 | −29 | −738 | C |
| ATOM | 3642 | CZ3 | TRP | L | 97 | 12.131 | −2.290 | 39.619 | 1.00 | 31.26 | | C |
| ANISOU | 3642 | CZ3 | TRP | L | 97 | 3558 | 3860 | 4459 | 100 | −15 | −740 | C |
| ATOM | 3643 | CH2 | TRP | L | 97 | 12.518 | −0.934 | 39.604 | 1.00 | 30.56 | | C |
| ANISOU | 3643 | CH2 | TRP | L | 97 | 3480 | 3815 | 4316 | 110 | −55 | −749 | C |
| ATOM | 3644 | N | VAL | L | 98 | 8.878 | −6.138 | 42.108 | 1.00 | 32.62 | | N |
| ANISOU | 3644 | N | VAL | L | 98 | 3697 | 3819 | 4880 | 31 | 297 | −647 | N |
| ATOM | 3645 | CA | VAL | L | 98 | 8.650 | −7.580 | 42.073 | 1.00 | 32.99 | | C |
| ANISOU | 3645 | CA | VAL | L | 98 | 3737 | 3794 | 5004 | 7 | 339 | −627 | C |
| ATOM | 3646 | C | VAL | L | 98 | 9.950 | −8.248 | 41.670 | 1.00 | 37.50 | | C |
| ANISOU | 3646 | C | VAL | L | 98 | 4356 | 4362 | 5529 | 32 | 287 | −616 | C |
| ATOM | 3647 | O | VAL | L | 98 | 10.602 | −7.810 | 40.715 | 1.00 | 34.73 | | O |
| ANISOU | 3647 | O | VAL | L | 98 | 3997 | 4050 | 5149 | 44 | 207 | −657 | O |
| ATOM | 3648 | CB | VAL | L | 98 | 7.522 | −7.963 | 41.095 | 1.00 | 32.69 | | C |

TABLE 11-continued

| | | | | | | | | | | | |
|---|---|---|---|---|---|---|---|---|---|---|---|
| ANISOU | 3648 | CB | VAL | L | 98 | 3609 | 3712 | 5098 | −41 | 324 | −681 | C |
| ATOM | 3649 | CG1 | VAL | L | 98 | 7.425 | −9.486 | 40.984 | 1.00 | 34.93 | | C |
| ANISOU | 3649 | CG1 | VAL | L | 98 | 3895 | 3913 | 5463 | −69 | 358 | −667 | C |
| ATOM | 3650 | CG2 | VAL | L | 98 | 6.205 | −7.390 | 41.565 | 1.00 | 35.15 | | C |
| ANISOU | 3650 | CG2 | VAL | L | 98 | 3856 | 4019 | 5480 | −62 | 386 | −683 | C |
| ATOM | 3651 | N | PHE | L | 99 | 10.335 | −9.289 | 42.404 | 1.00 | 36.71 | | N |
| ANISOU | 3651 | N | PHE | L | 99 | 4306 | 4216 | 5426 | 43 | 339 | −557 | N |
| ATOM | 3652 | CA | PHE | L | 99 | 11.481 | −10.121 | 42.072 | 1.00 | 34.21 | | C |
| ANISOU | 3652 | CA | PHE | L | 99 | 4026 | 3880 | 5094 | 71 | 304 | −541 | C |
| ATOM | 3653 | C | PHE | L | 99 | 11.026 | −11.522 | 41.688 | 1.00 | 38.32 | | C |
| ANISOU | 3653 | C | PHE | L | 99 | 4533 | 4305 | 5721 | 42 | 341 | −545 | C |
| ATOM | 3654 | O | PHE | L | 99 | 10.001 | −12.015 | 42.175 | 1.00 | 38.12 | | O |
| ANISOU | 3654 | O | PHE | L | 99 | 4490 | 4224 | 5768 | 5 | 414 | −525 | O |
| ATOM | 3655 | CB | PHE | L | 99 | 12.443 | −10.268 | 43.254 | 1.00 | 35.41 | | C |
| ANISOU | 3655 | CB | PHE | L | 99 | 4254 | 4045 | 5155 | 116 | 319 | −459 | C |
| ATOM | 3656 | CG | PHE | I | 99 | 13.228 | −9.044 | 43.573 | 1.00 | 33.50 | | C |
| ANISOU | 3656 | CG | PHE | L | 99 | 4036 | 3888 | 4806 | 146 | 261 | −457 | C |
| ATOM | 3657 | CD1 | PHE | L | 99 | 14.393 | −8.755 | 42.888 | 1.00 | 30.13 | | C |
| ANISOU | 3657 | CD1 | PHE | L | 99 | 3599 | 3501 | 4349 | 173 | 182 | −475 | C |
| ATOM | 3658 | CD2 | PHE | L | 99 | 12.837 | −8.209 | 44.616 | 1.00 | 36.34 | | C |
| ANISOU | 3658 | CD2 | PHE | L | 99 | 4430 | 4281 | 5096 | 147 | 292 | −434 | C |
| ATOM | 3659 | CE1 | PHE | L | 99 | 15.144 | −7.641 | 43.210 | 1.00 | 34.35 | | C |
| ANISOU | 3659 | CE1 | PHE | L | 99 | 4149 | 4105 | 4796 | 193 | 127 | −470 | C |
| ATOM | 3660 | CE2 | PHE | L | 99 | 13.580 | −7.090 | 44.939 | 1.00 | 35.05 | | C |
| ANISOU | 3660 | CE2 | PHE | L | 99 | 4295 | 4187 | 4836 | 170 | 232 | −437 | C |
| ATOM | 3661 | CZ | PHE | L | 99 | 14.721 | −6.796 | 44.229 | 1.00 | 38.94 | | C |
| ANISOU | 3661 | CZ | PHE | L | 99 | 4768 | 4716 | 5309 | 189 | 145 | −454 | C |
| ATOM | 3662 | N | GLY | L | 100 | 11.795 | −12.154 | 40.808 | 1.00 | 37.08 | | N |
| ANISOU | 3662 | N | GLY | L | 100 | 4383 | 4124 | 5580 | 58 | 297 | −573 | N |
| ATOM | 3663 | CA | GLY | L | 100 | 11.726 | −13.594 | 40.682 | 1.00 | 35.79 | | C |
| ANISOU | 3663 | CA | GLY | L | 100 | 4236 | 3862 | 5500 | 47 | 335 | −562 | C |
| ATOM | 3664 | C | GLY | L | 100 | 12.355 | −14.257 | 41.890 | 1.00 | 35.42 | | C |
| ANISOU | 3664 | C | GLY | L | 100 | 4253 | 3783 | 5421 | 86 | 387 | −463 | C |
| ATOM | 3665 | O | GLY | L | 100 | 13.072 | −13.629 | 42.670 | 1.00 | 36.01 | | O |
| ANISOU | 3665 | O | GLY | L | 100 | 4364 | 3920 | 5397 | 128 | 373 | −412 | O |
| ATOM | 3666 | N | CYS | L | 101 | 12.063 | −15.542 | 42.085 | 1.00 | 39.09 | | N |
| ANISOU | 3666 | N | CYS | L | 101 | 4737 | 4145 | 5968 | 71 | 445 | −433 | N |
| ATOM | 3667 | CA | CYS | L | 101 | 12.694 | −16.221 | 43.215 | 1.00 | 36.56 | | C |
| ANISOU | 3667 | CA | CYS | L | 101 | 4487 | 3789 | 5614 | 114 | 490 | −329 | C |
| ATOM | 3668 | C | CYS | L | 101 | 14.103 | −16.717 | 42.906 | 1.00 | 37.68 | | C |
| ANISOU | 3668 | C | CYS | L | 101 | 4659 | 3923 | 5733 | 180 | 441 | −313 | C |
| ATOM | 3669 | O | CYS | L | 101 | 14.730 | −17.319 | 43.784 | 1.00 | 44.72 | | O |
| ANISOU | 3669 | O | CYS | L | 101 | 5608 | 4784 | 6601 | 225 | 462 | −223 | O |
| ATOM | 3670 | CB | CYS | L | 101 | 11.819 | −17.377 | 43.720 | 1.00 | 48.57 | | C |
| ANISOU | 3670 | CB | CYS | L | 101 | 6024 | 5196 | 7234 | 74 | 584 | −284 | C |
| ATOM | 3671 | SG | CYS | L | 101 | 10.477 | −16.832 | 44.849 | 1.00 | 73.63 | | S |
| ANISOU | 3671 | SG | CYS | L | 101 | 9190 | 8384 | 10403 | 26 | 682 | −238 | S |
| ATOM | 3672 | N | GLY | L | 102 | 14.621 | −16.490 | 41.709 | 1.00 | 41.17 | | N |
| ANISOU | 3672 | N | GLY | L | 102 | 5068 | 4393 | 6183 | 191 | 381 | −391 | N |
| ATOM | 3673 | CA | GLY | L | 102 | 16.045 | −16.674 | 41.517 | 1.00 | 37.70 | | C |
| ANISOU | 3673 | CA | GLY | L | 102 | 4645 | 3969 | 5712 | 262 | 340 | −369 | C |
| ATOM | 3674 | C | GLY | L | 102 | 16.391 | −17.975 | 40.818 | 1.00 | 41.40 | | C |
| ANISOU | 3674 | C | GLY | L | 102 | 5126 | 4333 | 6269 | 282 | 363 | −390 | C |
| ATOM | 3675 | O | GLY | L | 102 | 15.678 | −18.979 | 40.913 | 1.00 | 41.63 | | O |
| ANISOU | 3675 | O | GLY | L | 102 | 5175 | 4259 | 6382 | 249 | 417 | −385 | O |
| ATOM | 3676 | N | THR | L | 103 | 17.504 | −17.953 | 40.095 | 1.00 | 33.95 | | N |
| ANISOU | 3676 | N | THR | L | 103 | 4173 | 3412 | 5315 | 335 | 327 | −417 | N |
| ATOM | 3677 | CA | THR | L | 103 | 18.028 | −19.113 | 39.380 | 1.00 | 36.36 | | C |
| ANISOU | 3677 | CA | THR | L | 103 | 4496 | 3623 | 5698 | 370 | 351 | −443 | C |
| ATOM | 3678 | C | THR | L | 103 | 19.462 | −19.338 | 39.815 | 1.00 | 41.51 | | C |
| ANISOU | 3678 | C | THR | L | 103 | 5152 | 4286 | 6335 | 460 | 337 | −368 | C |
| ATOM | 3679 | O | THR | L | 103 | 20.289 | −18.426 | 39.727 | 1.00 | 38.83 | | O |
| ANISOU | 3679 | O | THR | L | 103 | 4776 | 4042 | 5933 | 492 | 289 | −363 | O |
| ATOM | 3680 | CB | THR | L | 103 | 17.985 | −18.912 | 37.861 | 1.00 | 29.23 | | C |
| ANISOU | 3680 | CB | THR | L | 103 | 3575 | 2729 | 4802 | 352 | 331 | −562 | C |
| ATOM | 3681 | OG1 | THR | L | 103 | 16.625 | −18.735 | 37.445 | 1.00 | 36.09 | | O |
| ANISOU | 3681 | OG1 | THR | L | 103 | 4434 | 3585 | 5694 | 268 | 327 | −631 | O |
| ATOM | 3682 | CG2 | THR | L | 103 | 18.592 | −20.125 | 37.126 | 1.00 | 36.19 | | C |
| ANISOU | 3682 | CG2 | THR | L | 103 | 4487 | 3506 | 5756 | 396 | 366 | −596 | C |
| ATOM | 3683 | N | LYS | L | 104 | 19.759 | −20.538 | 40.284 | 1.00 | 40.03 | | N |
| ANISOU | 3683 | N | LYS | L | 104 | 5001 | 3997 | 6213 | 501 | 375 | −306 | N |
| ATOM | 3684 | CA | LYS | L | 104 | 21.136 | −20.879 | 40.608 | 1.00 | 34.43 | | C |
| ANISOU | 3684 | CA | LYS | L | 104 | 4285 | 3283 | 5512 | 594 | 358 | −234 | C |
| ATOM | 3685 | C | LYS | L | 104 | 21.843 | −21.294 | 39.331 | 1.00 | 38.67 | | C |
| ANISOU | 3685 | C | LYS | L | 104 | 4802 | 3785 | 6106 | 636 | 375 | −312 | C |
| ATOM | 3686 | O | LYS | L | 104 | 21.414 | −22.240 | 38.663 | 1.00 | 37.18 | | O |
| ANISOU | 3686 | O | LYS | L | 104 | 4646 | 3490 | 5991 | 622 | 425 | −370 | O |
| ATOM | 3687 | CB | LYS | L | 104 | 21.220 | −22.000 | 41.644 | 1.00 | 34.67 | | C |
| ANISOU | 3687 | CB | LYS | L | 104 | 4368 | 3214 | 5590 | 632 | 389 | −126 | C |
| ATOM | 3688 | CG | LYS | L | 104 | 22.656 | −22.376 | 41.954 | 1.00 | 39.14 | | C |

TABLE 11-continued

| | | | | | | | | | | | |
|---|---|---|---|---|---|---|---|---|---|---|---|
| ANISOU | 3688 | CG | LYS | L | 104 | 4920 | 3774 | 6178 | 736 | 359 | −49 | C |
| ATOM | 3689 | CD | LYS | L | 104 | 22.772 | −23.571 | 42.883 | 1.00 | 56.50 | | C |
| ANISOU | 3689 | CD | LYS | L | 104 | 7178 | 5860 | 8430 | 782 | 388 | 62 | C |
| ATOM | 3690 | CE | LYS | L | 104 | 24.158 | −23.629 | 43.534 | 1.00 | 70.32 | | C |
| ANISOU | 3690 | CE | LYS | L | 104 | 8906 | 7638 | 10175 | 884 | 326 | 165 | C |
| ATOM | 3691 | NZ | LYS | L | 104 | 25.280 | −23.292 | 42.608 | 1.00 | 74.64 | | N |
| ANISOU | 3691 | NZ | LYS | L | 104 | 9369 | 8233 | 10757 | 941 | 300 | 112 | N |
| ATOM | 3692 | N | LEU | L | 105 | 22.920 | −20.594 | 38.995 | 1.00 | 33.78 | | N |
| ANISOU | 3692 | N | LEU | L | 105 | 4130 | 3250 | 5453 | 686 | 340 | −314 | N |
| ATOM | 3693 | CA | LEU | L | 105 | 23.740 | −20.963 | 37.855 | 1.00 | 34.82 | | C |
| ANISOU | 3693 | CA | LEU | L | 105 | 4242 | 3353 | 5636 | 739 | 372 | −376 | C |
| ATOM | 3694 | C | LEU | L | 105 | 24.872 | −21.862 | 38.337 | 1.00 | 36.01 | | C |
| ANISOU | 3694 | C | LEU | L | 105 | 4381 | 3440 | 5862 | 840 | 386 | −290 | C |
| ATOM | 3695 | O | LEU | L | 105 | 25.691 | −21.446 | 39.164 | 1.00 | 37.22 | | O |
| ANISOU | 3695 | O | LEU | L | 105 | 4491 | 3654 | 5995 | 885 | 333 | −199 | O |
| ATOM | 3696 | CB | LEU | L | 105 | 24.301 | −19.720 | 37.162 | 1.00 | 32.67 | | C |
| ANISOU | 3696 | CB | LEU | L | 105 | 3913 | 3202 | 5300 | 738 | 341 | −421 | C |
| ATOM | 3697 | CG | LEU | L | 105 | 25.215 | −20.046 | 35.981 | 1.00 | 38.82 | | C |
| ANISOU | 3697 | CG | LEU | L | 105 | 4672 | 3955 | 6122 | 798 | 391 | −480 | C |
| ATOM | 3698 | CD1 | LEU | L | 105 | 24.407 | −20.849 | 34.946 | 1.00 | 40.73 | | C |
| ANISOU | 3698 | CD1 | LEU | L | 105 | 4984 | 4100 | 6392 | 765 | 447 | −588 | C |
| ATOM | 3699 | CD2 | LEU | L | 105 | 25.808 | −18.780 | 35.377 | 1.00 | 40.93 | | C |
| ANISOU | 3699 | CD2 | LEU | L | 105 | 4881 | 4341 | 6328 | 795 | 369 | −508 | C |
| ATOM | 3700 | N | THR | L | 106 | 24.927 | −23.091 | 37.827 | 1.00 | 34.85 | | N |
| ANISOU | 3700 | N | THR | L | 106 | 4272 | 3164 | 5805 | 875 | 451 | −319 | N |
| ATOM | 3701 | CA | THR | L | 106 | 26.032 | −23.989 | 38.139 | 1.00 | 41.92 | | C |
| ANISOU | 3701 | CA | THR | L | 106 | 5152 | 3987 | 6789 | 981 | 472 | −244 | C |
| ATOM | 3702 | C | THR | L | 106 | 26.921 | −24.159 | 36.916 | 1.00 | 42.85 | | C |
| ANISOU | 3702 | C | THR | L | 106 | 5237 | 4089 | 6956 | 1044 | 526 | −319 | C |
| ATOM | 3703 | O | THR | L | 106 | 26.432 | −24.305 | 35.794 | 1.00 | 43.36 | | O |
| ANISOU | 3703 | O | THR | L | 106 | 5342 | 4118 | 7015 | 1008 | 575 | −437 | O |
| ATOM | 3704 | CB | THR | L | 106 | 25.545 | −25.358 | 38.610 | 1.00 | 41.36 | | C |
| ANISOU | 3704 | CB | THR | L | 106 | 5153 | 3762 | 6799 | 991 | 516 | −204 | C |
| ATOM | 3705 | OG1 | THR | L | 106 | 24.583 | −25.859 | 37.683 | 1.00 | 45.78 | | O |
| ANISOU | 3705 | OG1 | THR | L | 106 | 5771 | 4240 | 7386 | 926 | 571 | −320 | O |
| ATOM | 3706 | CG2 | THR | L | 106 | 24.930 | −25.286 | 39.987 | 1.00 | 48.03 | | C |
| ANISOU | 3706 | CG2 | THR | L | 106 | 6030 | 4618 | 7601 | 953 | 476 | −98 | C |
| ATOM | 3707 | N | VAL | L | 107 | 28.228 | −24.151 | 37.139 | 1.00 | 39.53 | | N |
| ANISOU | 3707 | N | VAL | L | 107 | 4744 | 3692 | 6584 | 1139 | 516 | −250 | N |
| ATOM | 3708 | CA | VAL | L | 107 | 29.211 | −24.248 | 36.069 | 1.00 | 38.39 | | C |
| ANISOU | 3708 | CA | VAL | L | 107 | 4553 | 3541 | 6494 | 1210 | 580 | −307 | C |
| ATOM | 3709 | C | VAL | L | 107 | 29.918 | −25.585 | 36.205 | 1.00 | 40.53 | | C |
| ANISOU | 3709 | C | VAL | L | 107 | 4828 | 3676 | 6896 | 1316 | 635 | −259 | C |
| ATOM | 3710 | O | VAL | L | 107 | 30.520 | −25.879 | 37.247 | 1.00 | 43.55 | | O |
| ANISOU | 3710 | O | VAL | L | 107 | 5171 | 4046 | 7329 | 1378 | 586 | −136 | O |
| ATOM | 3711 | CB | VAL | L | 107 | 30.204 | −23.076 | 36.098 | 1.00 | 34.21 | | C |
| ANISOU | 3711 | CB | VAL | L | 107 | 3914 | 3149 | 5936 | 1234 | 535 | −271 | C |
| ATOM | 3712 | CG1 | VAL | L | 107 | 31.258 | −23.242 | 35.023 | 1.00 | 40.09 | | C |
| ANISOU | 3712 | CG1 | VAL | L | 107 | 4604 | 3879 | 6749 | 1313 | 622 | −318 | C |
| ATOM | 3713 | CG2 | VAL | L | 107 | 29.448 | −21.769 | 35.891 | 1.00 | 39.93 | | C |
| ANISOU | 3713 | CG2 | VAL | L | 107 | 4645 | 3993 | 6535 | 1129 | 488 | −324 | C |
| ATOM | 3714 | N | LEU | L | 108 | 29.882 | −26.369 | 35.130 | 1.00 | 41.00 | | N |
| ANISOU | 3714 | N | LEU | L | 108 | 4939 | 3633 | 7006 | 1342 | 733 | −358 | N |
| ATOM | 3715 | CA | LEU | L | 108 | 30.464 | −27.696 | 35.086 | 1.00 | 40.94 | | C |
| ANISOU | 3715 | CA | LEU | L | 108 | 4950 | 3477 | 7130 | 1443 | 802 | −335 | C |
| ATOM | 3716 | C | LEU | L | 108 | 31.994 | −27.634 | 35.041 | 1.00 | 46.94 | | C |
| ANISOU | 3716 | C | LEU | L | 108 | 5595 | 4265 | 7975 | 1566 | 824 | −274 | C |
| ATOM | 3717 | O | LEU | L | 108 | 32.604 | −26.569 | 34.906 | 1.00 | 48.26 | | O |
| ANISOU | 3717 | O | LEU | L | 108 | 5670 | 4564 | 8103 | 1566 | 794 | −263 | O |
| ATOM | 3718 | CB | LEU | L | 108 | 29.946 | −28.449 | 33.864 | 1.00 | 48.27 | | C |
| ANISOU | 3718 | CB | LEU | L | 108 | 5976 | 4290 | 8074 | 1428 | 901 | −478 | C |
| ATOM | 3719 | CG | LEU | L | 108 | 28.430 | −28.632 | 33.833 | 1.00 | 50.96 | | C |
| ANISOU | 3719 | CG | LEU | L | 108 | 6420 | 4585 | 8357 | 1306 | 878 | −544 | C |
| ATOM | 3720 | CD1 | LEU | L | 108 | 28.001 | −29.247 | 32.506 | 1.00 | 47.11 | | C |
| ANISOU | 3720 | CD1 | LEU | L | 108 | 6027 | 3997 | 7874 | 1287 | 958 | −701 | C |
| ATOM | 3721 | CD2 | LEU | L | 108 | 27.997 | −29.511 | 35.001 | 1.00 | 56.64 | | C |
| ANISOU | 3721 | CD2 | LEU | L | 108 | 7175 | 5201 | 9144 | 1305 | 852 | −441 | C |
| ATOM | 3722 | N | GLY | L | 109 | 32.608 | −28.808 | 35.148 | 1.00 | 46.83 | | N |
| ANISOU | 3722 | N | GLY | L | 109 | 5583 | 4117 | 8093 | 1673 | 879 | −233 | N |
| ATOM | 3723 | CA | GLY | L | 109 | 34.053 | −28.935 | 35.095 | 1.00 | 55.78 | | C |
| ANISOU | 3723 | CA | GLY | L | 109 | 6600 | 5253 | 9340 | 1802 | 910 | −173 | C |
| ATOM | 3724 | C | GLY | L | 109 | 34.713 | −28.836 | 36.459 | 1.00 | 69.39 | | C |
| ANISOU | 3724 | C | GLY | L | 109 | 8234 | 7017 | 11112 | 1855 | 796 | −6 | C |
| ATOM | 3725 | O | GLY | L | 109 | 34.481 | −29.662 | 37.351 | 1.00 | 72.27 | | O |
| ANISOU | 3725 | O | GLY | L | 109 | 8649 | 7290 | 11521 | 1882 | 759 | 82 | O |
| TER | | | | | | | | | | | | |
| ATOM | 3726 | N | ILE | B | 1 | −6.890 | 11.340 | 17.932 | 1.00 | 104.53 | | N |
| ANISOU | 3726 | N | ILE | B | 1 | 12095 | 13091 | 14532 | 429 | −2703 | −786 | N |
| ATOM | 3727 | CA | ILE | B | 1 | −6.313 | 12.578 | 17.415 | 1.00 | 107.27 | | C |
| ANISOU | 3727 | CA | ILE | B | 1 | 12559 | 13442 | 14757 | 498 | −2751 | −718 | C |

TABLE 11-continued

| | | | | | | | | | | | |
|---|---|---|---|---|---|---|---|---|---|---|---|
| ATOM | 3728 | C | ILE | B | 1 | −5.246 | 12.270 | 16.358 | 1.00 | 97.63 | C |
| ANISOU | 3728 | C | ILE | B | 1 | 11559 | 12259 | 13276 | 474 | −2805 | −728 | C |
| ATOM | 3729 | O | ILE | B | 1 | −4.085 | 12.667 | 16.498 | 1.00 | 101.47 | O |
| ANISOU | 3729 | O | ILE | B | 1 | 12156 | 12761 | 13637 | 491 | −2736 | −717 | O |
| ATOM | 3730 | CB | ILE | B | 1 | −5.727 | 13.438 | 18.559 | 1.00 | 112.43 | C |
| ANISOU | 3730 | CB | ILE | B | 1 | 13166 | 14078 | 15474 | 546 | −2612 | −696 | C |
| ATOM | 3731 | CG1 | ILE | B | 1 | −6.528 | 13.233 | 19.852 | 1.00 | 110.90 | C |
| ANISOU | 3731 | CG1 | ILE | B | 1 | 12766 | 13855 | 15517 | 543 | −2494 | −721 | C |
| ATOM | 3732 | CG2 | ILE | B | 1 | −5.716 | 14.913 | 18.167 | 1.00 | 115.51 | C |
| ANISOU | 3732 | CG2 | ILE | B | 1 | 13606 | 14444 | 15838 | 633 | −2675 | −608 | C |
| ATOM | 3733 | CD1 | ILE | B | 1 | −5.997 | 14.009 | 21.050 | 1.00 | 102.26 | C |
| ANISOU | 3733 | CD1 | ILE | B | 1 | 11650 | 12737 | 14467 | 581 | −2308 | −702 | C |
| ATOM | 3734 | N | GLN | B | 2 | −5.649 | 11.564 | 15.300 | 1.00 | 83.37 | N |
| ANISOU | 3734 | N | GLN | B | 2 | 9820 | 10467 | 11389 | 437 | −2924 | −751 | N |
| ATOM | 3735 | CA | GLN | B | 2 | −4.733 | 11.147 | 14.244 | 1.00 | 71.18 | C |
| ANISOU | 3735 | CA | GLN | B | 2 | 8491 | 8958 | 9597 | 412 | −2966 | −770 | C |
| ATOM | 3736 | C | GLN | B | 2 | −4.676 | 12.213 | 13.159 | 1.00 | 69.06 | C |
| ANISOU | 3736 | C | GLN | B | 2 | 8356 | 8693 | 9189 | 472 | −3084 | −687 | C |
| ATOM | 3737 | O | GLN | B | 2 | −5.713 | 12.687 | 12.692 | 1.00 | 69.64 | O |
| ANISOU | 3737 | O | GLN | B | 2 | 8371 | 8749 | 9338 | 503 | −3207 | −643 | O |
| ATOM | 3738 | CB | GLN | B | 2 | −5.161 | 9.807 | 13.644 | 1.00 | 70.40 | C |
| ANISOU | 3738 | CB | GLN | B | 2 | 8410 | 8866 | 9472 | 342 | −3028 | −842 | C |
| ATOM | 3739 | CG | GLN | B | 2 | −4.984 | 8.629 | 14.582 | 1.00 | 70.84 | C |
| ANISOU | 3739 | CG | GLN | B | 2 | 8380 | 8916 | 9622 | 277 | −2904 | −923 | C |
| ATOM | 3740 | CD | GLN | B | 2 | −5.251 | 7.301 | 13.908 | 1.00 | 78.69 | C |
| ANISOU | 3740 | CD | GLN | B | 2 | 9421 | 9911 | 10569 | 208 | −2964 | −995 | C |
| ATOM | 3741 | OE1 | GLN | B | 2 | −6.022 | 7.220 | 12.950 | 1.00 | 80.49 | O |
| ANISOU | 3741 | OE1 | GLN | B | 2 | 9672 | 10136 | 10775 | 203 | −3112 | −989 | O |
| ATOM | 3742 | NE2 | GLN | B | 2 | −4.607 | 6.247 | 14.404 | 1.00 | 79.05 | N |
| ANISOU | 3742 | NE2 | GLN | B | 2 | 9482 | 9954 | 10597 | 154 | −2851 | −1064 | N |
| ATOM | 3743 | N | ARG | B | 3 | −3.463 | 12.570 | 12.749 | 1.00 | 58.36 | N |
| ANISOU | 3743 | N | ARG | B | 3 | 7185 | 7360 | 7631 | 489 | −3045 | −664 | N |
| ATOM | 3744 | CA | ARG | B | 3 | −3.233 | 13.694 | 11.855 | 1.00 | 56.06 | C |
| ANISOU | 3744 | CA | ARG | B | 3 | 7034 | 7066 | 7200 | 550 | −3126 | −571 | C |
| ATOM | 3745 | C | ARG | B | 3 | −2.464 | 13.215 | 10.633 | 1.00 | 57.19 | C |
| ANISOU | 3745 | C | ARG | B | 3 | 7410 | 7244 | 7076 | 526 | −3158 | −585 | C |
| ATOM | 3746 | O | ARG | B | 3 | −1.454 | 12.515 | 10.767 | 1.00 | 51.99 | O |
| ANISOU | 3746 | O | ARG | B | 3 | 6839 | 6609 | 6307 | 487 | −3053 | −641 | O |
| ATOM | 3747 | CB | ARG | B | 3 | −2.480 | 14.808 | 12.596 | 1.00 | 57.69 | C |
| ANISOU | 3747 | CB | ARG | B | 3 | 7242 | 7254 | 7423 | 604 | −3031 | −510 | C |
| ATOM | 3748 | CG | ARG | B | 3 | −3.362 | 15.523 | 13.629 | 1.00 | 65.33 | C |
| ANISOU | 3748 | CG | ARG | B | 3 | 7998 | 8178 | 8647 | 647 | −3012 | −481 | C |
| ATOM | 3749 | CD | ARG | B | 3 | −2.606 | 16.541 | 14.480 | 1.00 | 65.31 | C |
| ANISOU | 3749 | CD | ARG | B | 3 | 8002 | 8144 | 8669 | 677 | −2823 | −425 | C |
| ATOM | 3750 | NE | ARG | B | 3 | −2.099 | 15.940 | 15.712 | 1.00 | 72.04 | N |
| ANISOU | 3750 | NE | ARG | B | 3 | 8774 | 9003 | 9597 | 627 | −2624 | −489 | N |
| ATOM | 3751 | CZ | ARG | B | 3 | −1.396 | 16.593 | 16.635 | 1.00 | 78.95 | C |
| ANISOU | 3751 | CZ | ARG | B | 3 | 9643 | 9854 | 10500 | 635 | −2444 | −464 | C |
| ATOM | 3752 | NH1 | ARG | B | 3 | −1.118 | 17.883 | 16.473 | 1.00 | 76.34 | N |
| ANISOU | 3752 | NH1 | ARG | B | 3 | 9379 | 9487 | 10141 | 688 | −2430 | −379 | N |
| ATOM | 3753 | NH2 | ARG | B | 3 | −0.968 | 15.956 | 17.722 | 1.00 | 72.45 | N |
| ANISOU | 3753 | NH2 | ARG | B | 3 | 3755 | 9041 | 9734 | 589 | −2283 | −525 | N |
| ATOM | 3754 | N | THR | B | 4 | −2.954 | 13.576 | 9.443 | 1.00 | 55.01 | N |
| ANISOU | 3754 | N | THR | B | 4 | 7233 | 6970 | 6697 | 551 | −3299 | −535 | N |
| ATOM | 3755 | CA | THR | B | 4 | −2.354 | 13.117 | 8.203 | 1.00 | 60.14 | C |
| ANISOU | 3755 | CA | THR | B | 4 | 8109 | 7651 | 7090 | 531 | −3333 | −549 | C |
| ATOM | 3756 | C | THR | B | 4 | −1.183 | 14.028 | 7.826 | 1.00 | 61.60 | C |
| ANISOU | 3756 | C | THR | B | 4 | 8484 | 7841 | 7079 | 576 | −3266 | −468 | C |
| ATOM | 3757 | O | THR | B | 4 | −1.208 | 15.230 | 8.102 | 1.00 | 61.12 | O |
| ANISOU | 3757 | O | THR | B | 4 | 8397 | 7753 | 7071 | 635 | −3271 | −376 | O |
| ATOM | 3758 | CB | THR | B | 4 | −3.404 | 13.077 | 7.082 | 1.00 | 66.38 | C |
| ANISOU | 3758 | CB | THR | B | 4 | 8930 | 8443 | 7850 | 537 | −3515 | −532 | C |
| ATOM | 3759 | OG1 | THR | B | 4 | −2.924 | 12.291 | 5.978 | 1.00 | 63.35 | O |
| ANISOU | 3759 | OG1 | THR | B | 4 | 8744 | 8088 | 7237 | 502 | −3538 | −579 | O |
| ATOM | 3760 | CG2 | THR | B | 4 | −3.769 | 14.476 | 6.597 | 1.00 | 65.57 | C |
| ANISOU | 3760 | CG2 | THR | B | 4 | 8862 | 8320 | 7731 | 614 | −3609 | −411 | C |
| ATOM | 3761 | N | PRO | B | 5 | −0.128 | 13.471 | 7.230 | 1.00 | 57.59 | N |
| ANISOU | 3761 | N | PRO | B | 5 | 8169 | 7363 | 6351 | 550 | −3191 | −501 | N |
| ATOM | 3762 | CA | PRO | B | 5 | 1.090 | 14.259 | 7.010 | 1.00 | 54.22 | C |
| ANISOU | 3762 | CA | PRO | B | 5 | 7916 | 6940 | 5746 | 585 | −3095 | −426 | C |
| ATOM | 3763 | C | PRO | B | 5 | 0.944 | 15.248 | 5.866 | 1.00 | 57.47 | C |
| ANISOU | 3763 | C | PRO | B | 5 | 8483 | 7342 | 6010 | 638 | −3189 | −314 | C |
| ATOM | 3764 | O | PRO | B | 5 | 0.318 | 14.962 | 4.843 | 1.00 | 52.61 | O |
| ANISOU | 3764 | O | PRO | B | 5 | 7938 | 6739 | 5313 | 634 | −3307 | −320 | O |
| ATOM | 3765 | CB | PRO | B | 5 | 2.144 | 13.192 | 6.682 | 1.00 | 56.67 | C |
| ANISOU | 3765 | CB | PRO | B | 5 | 8372 | 7283 | 5877 | 538 | −2978 | −507 | C |
| ATOM | 3766 | CG | PRO | B | 5 | 1.360 | 12.057 | 6.116 | 1.00 | 57.86 | C |
| ANISOU | 3766 | CG | PRO | B | 5 | 8504 | 7445 | 6036 | 492 | −3070 | −595 | C |
| ATOM | 3767 | CD | PRO | B | 5 | 0.045 | 12.058 | 6.842 | 1.00 | 56.41 | C |
| ANISOU | 3767 | CD | PRO | B | 5 | 8077 | 7238 | 6118 | 486 | −3170 | −610 | C |

TABLE 11-continued

| | | | | | | | | | | | |
|---|---|---|---|---|---|---|---|---|---|---|---|
| ATOM | 3768 | N | LYS | B | 6 | 1.508 | 16.436 | 6.064 | 1.00 | 60.79 | N |
| ANISOU | 3768 | N | LYS | B | 6 | 8957 | 7737 | 6402 | 688 | -3137 | -208 | N |
| ATOM | 3769 | CA | LYS | B | 6 | 1.757 | 17.338 | 4.951 | 1.00 | 62.68 | C |
| ANISOU | 3769 | CA | LYS | B | 6 | 9397 | 7968 | 6453 | 734 | -3174 | -92 | C |
| ATOM | 3770 | C | LYS | B | 6 | 2.995 | 16.850 | 4.218 | 1.00 | 59.40 | C |
| ANISOU | 3770 | C | LYS | B | 6 | 9215 | 7585 | 5770 | 709 | -3050 | -106 | C |
| ATOM | 3771 | O | LYS | B | 6 | 3.955 | 16.393 | 4.839 | 1.00 | 59.03 | O |
| ANISOU | 3771 | O | LYS | B | 6 | 9140 | 7549 | 5741 | 665 | -2839 | -152 | O |
| ATOM | 3772 | CB | LYS | B | 6 | 1.956 | 18.772 | 5.442 | 1.00 | 64.26 | C |
| ANISOU | 3772 | CB | LYS | B | 6 | 9561 | 8114 | 6740 | 786 | -3115 | 32 | C |
| ATOM | 3773 | CG | LYS | B | 6 | 0.721 | 19.378 | 6.075 | 1.00 | 72.75 | C |
| ANISOU | 3773 | CG | LYS | B | 6 | 10432 | 9149 | 8061 | 832 | -3256 | 56 | C |
| ATOM | 3774 | CD | LYS | B | 6 | 1.065 | 20.110 | 7.357 | 1.00 | 83.35 | C |
| ANISOU | 3774 | CD | LYS | B | 6 | 11623 | 10446 | 9602 | 833 | -3072 | 83 | C |
| ATOM | 3775 | CE | LYS | B | 6 | -0.190 | 20.456 | 8.145 | 1.00 | 88.92 | C |
| ANISOU | 3775 | CE | LYS | B | 6 | 12099 | 11115 | 10572 | 873 | -3184 | 76 | C |
| ATOM | 3776 | NZ | LYS | B | 6 | 0.121 | 20.871 | 9.545 | 1.00 | 88.10 | N |
| ANISOU | 3776 | NZ | LYS | B | 6 | 11839 | 10974 | 10662 | 862 | -2993 | 64 | N |
| ATOM | 3777 | N | ILE | B | 7 | 2.967 | 16.922 | 2.894 | 1.00 | 55.03 | N |
| ANISOU | 3777 | N | ILE | B | 7 | 8848 | 7045 | 5015 | 721 | -3103 | -64 | N |
| ATOM | 3778 | CA | ILE | B | 7 | 4.007 | 16.320 | 2.071 | 1.00 | 62.88 | C |
| ANISOU | 3778 | CA | ILE | B | 7 | 10064 | 8071 | 5756 | 697 | -2983 | -90 | C |
| ATOM | 3779 | C | ILE | B | 7 | 4.569 | 17.370 | 1.126 | 1.00 | 65.68 | C |
| ANISOU | 3779 | C | ILE | B | 7 | 10635 | 8412 | 5910 | 742 | -2943 | 50 | C |
| ATOM | 3780 | O | ILE | B | 7 | 3.812 | 18.088 | 0.465 | 1.00 | 61.34 | O |
| ANISOU | 3780 | O | ILE | B | 7 | 10114 | 7845 | 5349 | 781 | -3079 | 130 | O |
| ATOM | 3781 | CB | ILE | B | 7 | 3.471 | 15.119 | 1.272 | 1.00 | 59.58 | C |
| ANISOU | 3781 | CB | ILE | B | 7 | 9686 | 7687 | 5267 | 658 | -3067 | -198 | C |
| ATOM | 3782 | CG1 | ILE | B | 7 | 2.852 | 14.080 | 2.206 | 1.00 | 52.40 | C |
| ANISOU | 3782 | CG1 | ILE | B | 7 | 8557 | 6781 | 4571 | 609 | -3103 | -327 | C |
| ATOM | 3783 | CG2 | ILE | B | 7 | 4.578 | 14.506 | 0.436 | 1.00 | 59.81 | C |
| ANISOU | 3783 | CG2 | ILE | B | 7 | 9944 | 7744 | 5039 | 640 | -2924 | -229 | C |
| ATOM | 3784 | CD1 | ILE | B | 7 | 2.003 | 13.045 | 1.447 | 1.00 | 57.73 | C |
| ANISOU | 3784 | CD1 | ILE | B | 7 | 9238 | 7474 | 5224 | 573 | -3232 | -419 | C |
| ATOM | 3785 | N | GLN | B | 8 | 5.896 | 17.447 | 1.052 | 1.00 | 59.67 | N |
| ANISOU | 3785 | N | GLN | B | 8 | 10024 | 7655 | 4992 | 736 | -2748 | 82 | N |
| ATOM | 3786 | CA | GLN | B | 8 | 6.556 | 18.300 | 0.077 | 1.00 | 67.88 | C |
| ANISOU | 3786 | CA | GLN | B | 8 | 11288 | 8681 | 5821 | 769 | -2671 | 213 | C |
| ATOM | 3787 | C | GLN | B | 8 | 7.703 | 17.538 | -0.562 | 1.00 | 68.38 | C |
| ANISOU | 3787 | C | GLN | B | 8 | 11540 | 8779 | 5662 | 740 | -2484 | 169 | C |
| ATOM | 3788 | O | GLN | B | 8 | 8.508 | 16.920 | 0.143 | 1.00 | 68.32 | O |
| ANISOU | 3788 | O | GLN | B | 8 | 11455 | 8784 | 5719 | 699 | -2303 | 99 | O |
| ATOM | 3789 | CB | GLN | B | 8 | 7.086 | 19.580 | 0.721 | 1.00 | 68.80 | C |
| ANISOU | 3789 | CB | GLN | B | 8 | 11344 | 8745 | 6053 | 786 | -2539 | 341 | C |
| ATOM | 3790 | CG | GLN | B | 8 | 6.034 | 20.415 | 1.389 | 1.00 | 65.42 | C |
| ANISOU | 3790 | CG | GLN | B | 8 | 10734 | 8272 | 5851 | 822 | -2695 | 388 | C |
| ATOM | 3791 | CD | GLN | B | 8 | 6.565 | 21.772 | 1.757 | 1.00 | 63.71 | C |
| ANISOU | 3791 | CD | GLN | B | 8 | 10499 | 7991 | 5716 | 841 | -2562 | 524 | C |
| ATOM | 3792 | OE1 | GLN | B | 8 | 6.994 | 22.534 | 0.887 | 1.00 | 59.08 | O |
| ANISOU | 3792 | OE1 | GLN | B | 8 | 10108 | 7381 | 4960 | 870 | -2529 | 647 | O |
| ATOM | 3793 | NE2 | GLN | B | 8 | 6.566 | 22.080 | 3.054 | 1.00 | 60.48 | N |
| ANISOU | 3793 | NE2 | GLN | B | 8 | 9864 | 7549 | 5565 | 821 | -2479 | 501 | N |
| ATOM | 3794 | N | VAL | B | 9 | 7.775 | 17.591 | -1.888 | 1.00 | 68.25 | N |
| ANISOU | 3794 | N | VAL | B | 9 | 11722 | 8776 | 5435 | 754 | -2488 | 210 | N |
| ATOM | 3795 | CA | VAL | B | 9 | 8.892 | 17.052 | -2.650 | 1.00 | 73.51 | C |
| ANISOU | 3795 | CA | VAL | B | 9 | 12588 | 9467 | 5876 | 739 | -2292 | 192 | C |
| ATOM | 3796 | C | VAL | B | 9 | 9.611 | 18.217 | -3.309 | 1.00 | 73.12 | C |
| ANISOU | 3796 | C | VAL | B | 9 | 12716 | 9390 | 5676 | 772 | -2170 | 359 | C |
| ATOM | 3797 | O | VAL | B | 9 | 8.976 | 19.097 | -3.901 | 1.00 | 65.08 | O |
| ANISOU | 3797 | O | VAL | B | 9 | 11746 | 8349 | 4631 | 808 | -2298 | 461 | O |
| ATOM | 3798 | CB | VAL | B | 9 | 8.433 | 16.030 | -3.709 | 1.00 | 79.75 | C |
| ANISOU | 3798 | CB | VAL | B | 9 | 13474 | 10292 | 6534 | 724 | -2378 | 91 | C |
| ATOM | 3799 | CG1 | VAL | B | 9 | 9.602 | 15.157 | -4.145 | 1.00 | 77.04 | C |
| ANISOU | 3799 | CG1 | VAL | B | 9 | 13277 | 9974 | 6020 | 701 | -2156 | 26 | C |
| ATOM | 3800 | CG2 | VAL | B | 9 | 7.301 | 15.194 | -3.166 | 1.00 | 78.18 | C |
| ANISOU | 3800 | CG2 | VAL | B | 9 | 13081 | 10105 | 6520 | 696 | -2568 | -36 | C |
| ATOM | 3801 | N | TYR | B | 10 | 10.935 | 18.217 | -3.209 | 1.00 | 70.81 | N |
| ANISOU | 3801 | N | TYR | B | 10 | 12515 | 9096 | 5294 | 758 | -1915 | 390 | N |
| ATOM | 3802 | CA | TYR | B | 10 | 11.739 | 19.332 | -3.688 | 1.00 | 67.94 | C |
| ANISOU | 3802 | CA | TYR | B | 10 | 12299 | 8698 | 4818 | 779 | -1760 | 556 | C |
| ATOM | 3803 | C | TYR | B | 10 | 13.198 | 18.905 | -3.657 | 1.00 | 72.71 | C |
| ANISOU | 3803 | C | TYR | B | 10 | 12979 | 9314 | 5334 | 750 | -1458 | 545 | C |
| ATOM | 3804 | O | TYR | B | 10 | 13.558 | 17.892 | -3.050 | 1.00 | 72.94 | O |
| ANISOU | 3804 | O | TYR | B | 10 | 12884 | 9371 | 5459 | 713 | -1367 | 415 | O |
| ATOM | 3805 | CB | TYR | B | 10 | 11.517 | 20.591 | -2.843 | 1.00 | 59.04 | C |
| ANISOU | 3805 | CB | TYR | B | 10 | 11032 | 7510 | 3889 | 792 | -1793 | 673 | C |
| ATOM | 3806 | CG | TYR | B | 10 | 11.775 | 20.377 | -1.364 | 1.00 | 63.02 | C |
| ANISOU | 3806 | CG | TYR | B | 10 | 11240 | 8007 | 4698 | 742 | -1691 | 597 | C |
| ATOM | 3807 | CD1 | TYR | B | 10 | 10.820 | 19.777 | -0.548 | 1.00 | 67.37 | C |
| ANISOU | 3807 | CD1 | TYR | B | 10 | 11591 | 8575 | 5434 | 733 | -1860 | 479 | C |

TABLE 11-continued

| | | | | | | | | | | | |
|---|---|---|---|---|---|---|---|---|---|---|---|
| ATOM | 3808 | CD2 | TYR | B | 10 | 12.972 | 20.776 | −0.783 | 1.00 | 58.20 | C |
| ANISOU | 3808 | CD2 | TYR | B | 10 | 10552 | 7371 | 4191 | 703 | −1427 | 645 | C |
| ATOM | 3809 | CE1 | TYR | B | 10 | 11.052 | 19.574 | 0.805 | 1.00 | 61.44 | C |
| ANISOU | 3809 | CE1 | TYR | B | 10 | 10586 | 7816 | 4942 | 690 | −1764 | 413 | C |
| ATOM | 3810 | CE2 | TYR | B | 10 | 13.213 | 20.581 | 0.574 | 1.00 | 55.64 | C |
| ANISOU | 3810 | CE2 | TYR | B | 10 | 9969 | 7040 | 4130 | 658 | −1347 | 576 | C |
| ATOM | 3811 | CZ | TYR | B | 10 | 12.252 | 19.981 | 1.361 | 1.00 | 57.98 | C |
| ANISOU | 3811 | CZ | TYR | B | 10 | 10087 | 7355 | 4588 | 654 | −1513 | 461 | C |
| ATOM | 3812 | OH | TYR | B | 10 | 12.497 | 19.788 | 2.709 | 1.00 | 55.27 | O |
| ANISOU | 3812 | OH | TYR | B | 10 | 9505 | 7006 | 4491 | 612 | −1429 | 397 | O |
| ATOM | 3813 | N | SER | B | 11 | 14.031 | 19.695 | −4.323 | 1.00 | 72.22 | N |
| ANISOU | 3813 | N | SER | B | 11 | 13079 | 9226 | 5135 | 762 | −1282 | 683 | N |
| ATOM | 3814 | CA | SER | B | 11 | 15.465 | 19.466 | −4.375 | 1.00 | 71.25 | C |
| ANISOU | 3814 | CA | SER | B | 11 | 12996 | 9108 | 4969 | 731 | −963 | 696 | C |
| ATOM | 3815 | C | SER | B | 11 | 16.181 | 20.347 | −3.357 | 1.00 | 72.13 | C |
| ANISOU | 3815 | C | SER | B | 11 | 12898 | 9171 | 5338 | 691 | −793 | 780 | C |
| ATOM | 3816 | O | SER | B | 11 | 15.662 | 21.376 | −2.917 | 1.00 | 73.04 | O |
| ANISOU | 3816 | O | SER | B | 11 | 12921 | 9238 | 5593 | 699 | −899 | 868 | O |
| ATOM | 3817 | CB | SER | B | 11 | 16.005 | 19.740 | −5.781 | 1.00 | 69.25 | C |
| ANISOU | 3817 | CB | SER | B | 11 | 12993 | 8855 | 4464 | 752 | −837 | 785 | C |
| ATOM | 3818 | OG | SER | B | 11 | 15.618 | 21.027 | −6.232 | 1.00 | 78.76 | O |
| ANISOU | 3818 | OG | SER | B | 11 | 14267 | 10014 | 5645 | 779 | −919 | 943 | O |
| ATOM | 3819 | N | ARG | B | 12 | 17.394 | 19.927 | −2.987 | 1.00 | 70.28 | N |
| ANISOU | 3819 | N | ARG | B | 12 | 12589 | 8945 | 5169 | 650 | −529 | 751 | N |
| ATOM | 3820 | CA | ARG | B | 12 | 18.187 | 20.696 | −2.033 | 1.00 | 72.61 | C |
| ANISOU | 3820 | CA | ARG | B | 12 | 12687 | 9194 | 5706 | 604 | −362 | 822 | C |
| ATOM | 3821 | C | ARG | B | 12 | 18.552 | 22.066 | −2.597 | 1.00 | 76.52 | C |
| ANISOU | 3821 | C | ARG | B | 12 | 13307 | 9629 | 6138 | 612 | −278 | 1011 | C |
| ATOM | 3822 | O | ARG | B | 12 | 18.342 | 23.095 | −1.944 | 1.00 | 71.70 | O |
| ANISOU | 3822 | O | ARG | B | 12 | 12572 | 8960 | 5710 | 598 | −324 | 1090 | O |
| ATOM | 3823 | CB | ARG | B | 12 | 19.443 | 19.917 | −1.647 | 1.00 | 74.25 | C |
| ANISOU | 3823 | CB | ARG | B | 12 | 12803 | 9426 | 5981 | 562 | −103 | 756 | C |
| ATOM | 3824 | CG | ARG | B | 12 | 20.323 | 20.638 | −0.639 | 1.00 | 71.96 | C |
| ANISOU | 3824 | CG | ARG | B | 12 | 12303 | 9093 | 5945 | 507 | 62 | 820 | C |
| ATOM | 3825 | CD | ARG | B | 12 | 21.514 | 19.786 | −0.216 | 1.00 | 63.32 | C |
| ANISOU | 3825 | CD | ARG | B | 12 | 11098 | 8026 | 4935 | 471 | 293 | 748 | C |
| ATOM | 3826 | NE | ARG | B | 12 | 21.125 | 18.699 | 0.668 | 1.00 | 58.94 | N |
| ANISOU | 3826 | NE | ARG | B | 12 | 10375 | 7512 | 4508 | 462 | 197 | 589 | N |
| ATOM | 3827 | CZ | ARG | B | 12 | 21.988 | 17.879 | 1.258 | 1.00 | 67.90 | C |
| ANISOU | 3827 | CZ | ARG | B | 12 | 11375 | 8669 | 5756 | 435 | 351 | 512 | C |
| ATOM | 3828 | NH1 | ARG | B | 12 | 23.288 | 18.028 | 1.049 | 1.00 | 76.16 | N |
| ANISOU | 3828 | NH1 | ARG | B | 12 | 12424 | 9704 | 6809 | 413 | 608 | 576 | N |
| ATOM | 3829 | NH2 | ARG | B | 12 | 21.557 | 16.909 | 2.052 | 1.00 | 68.06 | N |
| ANISOU | 3829 | NH2 | ARG | B | 12 | 11254 | 8719 | 5886 | 429 | 252 | 375 | N |
| ATOM | 3830 | N | HIS | B | 13 | 19.108 | 22.096 | −3.802 | 1.00 | 78.91 | N |
| ANISOU | 3830 | N | HIS | B | 13 | 13862 | 9937 | 6182 | 634 | −145 | 1086 | N |
| ATOM | 3831 | CA | HIS | B | 13 | 19.410 | 23.310 | −4.543 | 1.00 | 85.01 | C |
| ANISOU | 3831 | CA | HIS | B | 13 | 14802 | 10652 | 6846 | 648 | −65 | 1274 | C |
| ATOM | 3832 | C | HIS | B | 13 | 18.518 | 23.389 | −5.773 | 1.00 | 83.85 | C |
| ANISOU | 3832 | C | HIS | B | 13 | 14936 | 10518 | 6403 | 716 | −254 | 1318 | C |
| ATOM | 3833 | O | HIS | B | 13 | 17.923 | 22.384 | −6.175 | 1.00 | 81.05 | O |
| ANISOU | 3833 | O | HIS | B | 13 | 14639 | 10225 | 5930 | 740 | −392 | 1189 | O |
| ATOM | 3834 | CB | HIS | B | 13 | 20.884 | 23.335 | −4.977 | 1.00 | 89.62 | C |
| ANISOU | 3834 | CB | HIS | B | 13 | 15460 | 11227 | 7363 | 617 | 275 | 1343 | C |
| ATOM | 3835 | CG | HIS | B | 13 | 21.819 | 22.715 | −3.986 | 1.00 | 92.72 | C |
| ANISOU | 3835 | CG | HIS | B | 13 | 15612 | 11638 | 7981 | 559 | 458 | 1250 | C |
| ATOM | 3836 | ND1 | HIS | B | 13 | 22.158 | 21.378 | −4.020 | 1.00 | 93.48 | N |
| ANISOU | 3836 | ND1 | HIS | B | 13 | 15699 | 11799 | 8022 | 562 | 532 | 1107 | N |
| ATOM | 3837 | CD2 | HIS | B | 13 | 22.487 | 23.245 | −2.934 | 1.00 | 93.17 | C |
| ANISOU | 3837 | CD2 | HIS | B | 13 | 15430 | 11652 | 8318 | 499 | 573 | 1280 | C |
| ATOM | 3838 | CE1 | HIS | B | 13 | 22.994 | 21.112 | −3.033 | 1.00 | 91.97 | C |
| ANISOU | 3838 | CE1 | HIS | B | 13 | 15271 | 11606 | 8069 | 510 | 684 | 1060 | C |
| ATOM | 3839 | NE2 | HIS | B | 13 | 23.209 | 22.227 | −2.357 | 1.00 | 91.84 | N |
| ANISOU | 3839 | NE2 | HIS | B | 13 | 15112 | 11529 | 8256 | 469 | 706 | 1161 | N |
| ATOM | 3840 | N | PRO | B | 14 | 18.376 | 24.568 | −6.383 | 1.00 | 88.56 | N |
| ANISOU | 3840 | N | PRO | B | 14 | 15658 | 11058 | 6931 | 738 | −275 | 1484 | N |
| ATOM | 3841 | CA | PRO | B | 14 | 17.633 | 24.657 | −7.648 | 1.00 | 92.64 | C |
| ANISOU | 3841 | CA | PRO | B | 14 | 16334 | 11599 | 7267 | 782 | −431 | 1501 | C |
| ATOM | 3842 | C | PRO | B | 14 | 18.083 | 23.595 | −8.642 | 1.00 | 95.52 | C |
| ANISOU | 3842 | C | PRO | B | 14 | 16831 | 12031 | 7431 | 784 | −320 | 1405 | C |
| ATOM | 3843 | O | PRO | B | 14 | 19.279 | 23.369 | −8.845 | 1.00 | 92.26 | O |
| ANISOU | 3843 | O | PRO | B | 14 | 16458 | 11622 | 6974 | 757 | −37 | 1420 | O |
| ATOM | 3844 | CB | PRO | B | 14 | 17.951 | 26.072 | −8.139 | 1.00 | 91.71 | C |
| ANISOU | 3844 | CB | PRO | B | 14 | 16307 | 11406 | 7133 | 787 | −343 | 1703 | C |
| ATOM | 3845 | CG | PRO | B | 14 | 18.116 | 26.853 | −6.880 | 1.00 | 89.87 | C |
| ANISOU | 3845 | CG | PRO | B | 14 | 15916 | 11097 | 7134 | 761 | −315 | 1774 | C |
| ATOM | 3846 | CD | PRO | B | 14 | 18.733 | 25.903 | −5.866 | 1.00 | 88.31 | C |
| ANISOU | 3846 | CD | PRO | B | 14 | 15544 | 10936 | 7072 | 714 | −191 | 1639 | C |
| ATOM | 3847 | N | ALA | B | 15 | 17.106 | 22.927 | −9.250 | 1.00 | 99.07 | N |
| ANISOU | 3847 | N | ALA | B | 15 | 17339 | 12530 | 7773 | 814 | −545 | 1302 | N |

TABLE 11-continued

| | | | | | | | | | | | |
|---|---|---|---|---|---|---|---|---|---|---|---|
| ATOM | 3848 | CA | ALA | B | 15 | 17.390 | 21.770 | −10.087 | 1.00 | 100.85 | C |
| ANISOU | 3848 | CA | ALA | B | 15 | 17678 | 12815 | 7825 | 815 | −476 | 1182 | C |
| ATOM | 3849 | C | ALA | B | 15 | 18.083 | 22.191 | −11.377 | 1.00 | 106.12 | C |
| ANISOU | 3849 | C | ALA | B | 15 | 18557 | 13474 | 8289 | 828 | −298 | 1287 | C |
| ATOM | 3850 | O | ALA | B | 15 | 17.677 | 23.157 | −12.032 | 1.00 | 106.60 | O |
| ANISOU | 3850 | O | ALA | B | 15 | 18723 | 13507 | 8275 | 854 | −384 | 1415 | O |
| ATOM | 3851 | CB | ALA | B | 15 | 16.100 | 21.014 | −10.397 | 1.00 | 100.85 | C |
| ANISOU | 3851 | CB | ALA | B | 15 | 17680 | 12858 | 7779 | 838 | −777 | 1051 | C |
| ATOM | 3852 | N | GLU | B | 16 | 19.129 | 21.453 | −11.741 | 1.00 | 106.43 | N |
| ANISOU | 3852 | N | GLU | B | 16 | 18656 | 13538 | 8244 | 813 | −47 | 1232 | N |
| ATOM | 3853 | CA | GLU | B | 16 | 19.909 | 21.723 | −12.943 | 1.00 | 107.50 | C |
| ANISOU | 3853 | CA | GLU | B | 16 | 18985 | 13668 | 8191 | 823 | 157 | 1319 | C |
| ATOM | 3854 | C | GLU | B | 16 | 20.237 | 20.396 | −13.607 | 1.00 | 103.04 | C |
| ANISOU | 3854 | C | GLU | B | 16 | 18514 | 13155 | 7481 | 831 | 239 | 1169 | C |
| ATOM | 3855 | O | GLU | B | 16 | 20.861 | 19.530 | −12.985 | 1.00 | 93.00 | O |
| ANISOU | 3855 | O | GLU | B | 16 | 17134 | 11901 | 6302 | 809 | 380 | 1063 | O |
| ATOM | 3856 | CB | GLU | B | 16 | 21.190 | 22.490 | −12.607 | 1.00 | 111.86 | C |
| ANISOU | 3856 | CB | GLU | B | 16 | 19489 | 14173 | 8841 | 790 | 468 | 1453 | C |
| ATOM | 3857 | CG | GLU | B | 16 | 22.187 | 22.563 | −13.745 | 1.00 | 120.21 | C |
| ANISOU | 3857 | CG | GLU | B | 16 | 20715 | 15229 | 9730 | 795 | 729 | 1520 | C |
| ATOM | 3858 | CD | GLU | B | 16 | 23.465 | 23.276 | −13.351 | 1.00 | 123.57 | C |
| ANISOU | 3858 | CD | GLU | B | 16 | 21057 | 15605 | 10289 | 753 | 1040 | 1646 | C |
| ATOM | 3859 | OE1 | GLU | B | 16 | 23.435 | 24.058 | −12.376 | 1.00 | 123.37 | O |
| ANISOU | 3859 | OE1 | GLU | B | 16 | 20885 | 15532 | 10457 | 723 | 1019 | 1726 | O |
| ATOM | 3860 | OE2 | GLU | B | 16 | 24.500 | 23.051 | −14.013 | 1.00 | 126.10 | O |
| ANISOU | 3860 | OE2 | GLU | B | 16 | 21453 | 15929 | 10530 | 747 | 1305 | 1665 | O |
| ATOM | 3861 | N | ASN | B | 17 | 19.821 | 20.239 | −14.863 | 1.00 | 103.69 | N |
| ANISOU | 3861 | N | ASN | B | 17 | 18800 | 13258 | 7340 | 864 | 150 | 1161 | N |
| ATOM | 3862 | CA | ASN | B | 17 | 20.025 | 18.976 | −15.560 | 1.00 | 98.85 | C |
| ANISOU | 3862 | CA | ASN | B | 17 | 18293 | 12687 | 6579 | 874 | 203 | 1014 | C |
| ATOM | 3863 | C | ASN | B | 17 | 21.509 | 18.647 | −15.650 | 1.00 | 95.20 | C |
| ANISOU | 3863 | C | ASN | B | 17 | 17839 | 12218 | 6115 | 861 | 571 | 1019 | C |
| ATOM | 3864 | O | ASN | B | 17 | 22.314 | 19.466 | −16.103 | 1.00 | 101.69 | O |
| ANISOU | 3864 | O | ASN | B | 17 | 18735 | 13010 | 6891 | 860 | 782 | 1162 | O |
| ATOM | 3865 | CB | ASN | B | 17 | 19.401 | 19.037 | −16.953 | 1.00 | 104.52 | C |
| ANISOU | 3865 | CB | ASN | B | 17 | 19248 | 13420 | 7044 | 911 | 62 | 1030 | C |
| ATOM | 3866 | CG | ASN | B | 17 | 17.887 | 19.031 | −16.905 | 1.00 | 107.76 | C |
| ANISOU | 3866 | CG | ASN | B | 17 | 19633 | 13846 | 7465 | 924 | −315 | 983 | C |
| ATOM | 3867 | OD1 | ASN | B | 17 | 17.290 | 18.410 | −16.024 | 1.00 | 110.93 | O |
| ANISOU | 3867 | OD1 | ASN | B | 17 | 19866 | 14261 | 8021 | 906 | −470 | 865 | O |
| ATOM | 3868 | ND2 | ASN | B | 17 | 17.257 | 19.728 | −17.845 | 1.00 | 106.51 | N |
| ANISOU | 3868 | ND2 | ASN | B | 17 | 19633 | 13684 | 7151 | 955 | −464 | 1077 | N |
| ATOM | 3869 | N | GLY | B | 18 | 21.871 | 17.449 | −15.189 | 1.00 | 90.37 | N |
| ANISOU | 3869 | N | GLY | B | 18 | 17137 | 11629 | 5570 | 849 | 650 | 865 | N |
| ATOM | 3870 | CA | GLY | B | 18 | 23.242 | 16.990 | −15.208 | 1.00 | 92.11 | C |
| ANISOU | 3870 | CA | GLY | B | 18 | 17337 | 11846 | 5817 | 841 | 989 | 850 | C |
| ATOM | 3871 | C | GLY | B | 18 | 24.042 | 17.267 | −13.951 | 1.00 | 95.59 | C |
| ANISOU | 3871 | C | GLY | B | 18 | 17550 | 12265 | 6506 | 805 | 1165 | 892 | C |
| ATOM | 3872 | O | GLY | B | 18 | 25.138 | 16.710 | −13.801 | 1.00 | 92.54 | O |
| ANISOU | 3872 | O | GLY | B | 18 | 17101 | 11878 | 6181 | 797 | 1429 | 855 | O |
| ATOM | 3873 | N | LYS | B | 19 | 23.533 | 18.095 | −13.041 | 1.00 | 99.71 | N |
| ANISOU | 3873 | N | LYS | B | 19 | 17942 | 12765 | 7177 | 783 | 1028 | 966 | N |
| ATOM | 3874 | CA | LYS | B | 19 | 24.262 | 18.497 | −11.845 | 1.00 | 104.18 | C |
| ANISOU | 3874 | CA | LYS | B | 19 | 18301 | 13305 | 7977 | 744 | 1186 | 1022 | C |
| ATOM | 3875 | C | LYS | B | 19 | 23.767 | 17.714 | −10.633 | 1.00 | 99.66 | C |
| ANISOU | 3875 | C | LYS | B | 19 | 17547 | 12754 | 7565 | 731 | 1043 | 883 | C |
| ATOM | 3876 | O | LYS | B | 19 | 22.559 | 17.656 | −10.373 | 1.00 | 94.44 | O |
| ANISOU | 3876 | O | LYS | B | 19 | 16872 | 12105 | 6906 | 739 | 748 | 830 | O |
| ATOM | 3877 | CB | LYS | B | 19 | 24.111 | 20.001 | −11.602 | 1.00 | 111.22 | C |
| ANISOU | 3877 | CB | LYS | B | 19 | 19174 | 14148 | 8938 | 727 | 1151 | 1205 | C |
| ATOM | 3878 | CG | LYS | B | 19 | 24.807 | 20.504 | −10.345 | 1.00 | 114.32 | C |
| ANISOU | 3878 | CG | LYS | B | 19 | 19355 | 14505 | 9579 | 680 | 1298 | 1270 | C |
| ATOM | 3879 | CD | LYS | B | 19 | 24.556 | 21.991 | −10.131 | 1.00 | 117.82 | C |
| ANISOU | 3879 | CD | LYS | B | 19 | 19788 | 14886 | 10091 | 663 | 1240 | 1448 | C |
| ATOM | 3880 | CE | LYS | B | 19 | 25.201 | 22.489 | −8.846 | 1.00 | 115.10 | C |
| ANISOU | 3880 | CE | LYS | B | 19 | 19234 | 14499 | 10001 | 611 | 1371 | 1508 | C |
| ATOM | 3881 | NZ | LYS | B | 19 | 26.682 | 22.317 | −8.860 | 1.00 | 114.95 | N |
| ANISOU | 3881 | NZ | LYS | B | 19 | 19142 | 14471 | 10062 | 575 | 1721 | 1537 | N |
| ATOM | 3882 | N | SER | B | 20 | 24.704 | 17.123 | −9.894 | 1.00 | 98.70 | N |
| ANISOU | 3882 | N | SER | B | 20 | 17278 | 12637 | 7588 | 709 | 1253 | 829 | N |
| ATOM | 3883 | CA | SER | B | 20 | 24.360 | 16.358 | −8.704 | 1.00 | 92.56 | C |
| ANISOU | 3883 | CA | SER | B | 20 | 16324 | 11877 | 6967 | 696 | 1148 | 701 | C |
| ATOM | 3884 | C | SER | B | 20 | 23.595 | 17.227 | −7.710 | 1.00 | 90.52 | C |
| ANISOU | 3884 | C | SER | B | 20 | 15955 | 11598 | 6842 | 676 | 953 | 766 | C |
| ATOM | 3885 | O | SER | B | 20 | 23.879 | 18.418 | −7.551 | 1.00 | 93.19 | O |
| ANISOU | 3885 | O | SER | B | 20 | 16277 | 11893 | 7236 | 658 | 1021 | 923 | O |
| ATOM | 3886 | CB | SER | B | 20 | 25.628 | 15.792 | −8.058 | 1.00 | 87.25 | C |
| ANISOU | 3886 | CB | SER | B | 20 | 15502 | 11205 | 6445 | 676 | 1435 | 666 | C |
| ATOM | 3887 | OG | SER | B | 20 | 25.409 | 14.489 | −7.541 | 1.00 | 89.30 | O |
| ANISOU | 3887 | OG | SER | B | 20 | 15678 | 11494 | 6758 | 684 | 1371 | 489 | O |

TABLE 11-continued

| | | | | | | | | | | | |
|---|---|---|---|---|---|---|---|---|---|---|---|
| ATOM | 3888 | N | ASN | B | 21 | 22.616 | 16.622 | −7.043 | 1.00 | 85.19 | N |
| ANISOU | 3888 | N | ASN | B | 21 | 15199 | 10945 | 6225 | 679 | 709 | 644 | N |
| ATOM | 3889 | CA | ASN | B | 21 | 21.698 | 17.344 | −6.173 | 1.00 | 76.97 | C |
| ANISOU | 3889 | CA | ASN | B | 21 | 14063 | 9885 | 5299 | 670 | 481 | 686 | C |
| ATOM | 3890 | C | ASN | B | 21 | 21.177 | 16.370 | −5.119 | 1.00 | 78.88 | C |
| ANISOU | 3890 | C | ASN | B | 21 | 14111 | 10152 | 5706 | 655 | 339 | 523 | C |
| ATOM | 3891 | O | ASN | B | 21 | 21.663 | 15.242 | −4.996 | 1.00 | 79.62 | O |
| ANISOU | 3891 | O | ASN | B | 21 | 14172 | 10272 | 5807 | 653 | 451 | 401 | O |
| ATOM | 3892 | CB | ASN | B | 21 | 20.570 | 17.968 | −7.006 | 1.00 | 75.70 | C |
| ANISOU | 3892 | CB | ASN | B | 21 | 14033 | 9717 | 5013 | 698 | 228 | 741 | C |
| ATOM | 3893 | CG | ASN | B | 21 | 19.907 | 19.143 | −6.316 | 1.00 | 74.33 | C |
| ANISOU | 3893 | CG | ASN | B | 21 | 13781 | 9502 | 4958 | 695 | 64 | 852 | C |
| ATOM | 3894 | OD1 | ASN | B | 21 | 19.928 | 19.253 | −5.091 | 1.00 | 78.85 | O |
| ANISOU | 3894 | OD1 | ASN | B | 21 | 14119 | 10061 | 5780 | 662 | 51 | 828 | O |
| ATOM | 3895 | ND2 | ASN | B | 21 | 19.306 | 20.028 | −7.105 | 1.00 | 74.38 | N |
| ANISOU | 3895 | ND2 | ASN | B | 21 | 13905 | 9486 | 4869 | 720 | −64 | 959 | N |
| ATOM | 3896 | N | PHE | B | 22 | 20.188 | 16.813 | −4.346 | 1.00 | 77.76 | N |
| ANISOU | 3896 | N | PHE | B | 22 | 13811 | 9999 | 5735 | 641 | 98 | 520 | N |
| ATOM | 3897 | CA | PHE | B | 22 | 19.506 | 15.969 | −3.373 | 1.00 | 69.57 | C |
| ANISOU | 3897 | CA | PHE | B | 22 | 12569 | 8983 | 4882 | 623 | −67 | 371 | C |
| ATOM | 3898 | C | PHE | B | 22 | 18.005 | 16.117 | −3.560 | 1.00 | 63.11 | C |
| ANISOU | 3898 | C | PHE | B | 22 | 11799 | 8169 | 4011 | 647 | −397 | 347 | C |
| ATOM | 3899 | O | PHE | B | 22 | 17.500 | 17.239 | −3.678 | 1.00 | 67.70 | O |
| ANISOU | 3899 | O | PHE | B | 22 | 12405 | 8721 | 4598 | 661 | −509 | 467 | O |
| ATOM | 3900 | CB | PHE | B | 22 | 19.892 | 16.341 | −1.937 | 1.00 | 73.32 | C |
| ANISOU | 3900 | CB | PHE | B | 22 | 12733 | 9436 | 5689 | 574 | −3 | 384 | C |
| ATOM | 3901 | CG | PHE | B | 22 | 21.178 | 15.722 | −1.471 | 1.00 | 72.16 | C |
| ANISOU | 3901 | CG | PHE | B | 22 | 12470 | 9297 | 5650 | 546 | 261 | 344 | C |
| ATOM | 3902 | CD1 | PHE | B | 22 | 22.391 | 16.336 | −1.729 | 1.00 | 72.96 | C |
| ANISOU | 3902 | CD1 | PHE | B | 22 | 12597 | 9377 | 5749 | 532 | 521 | 459 | C |
| ATOM | 3903 | CD2 | PHE | B | 22 | 21.172 | 14.531 | −0.765 | 1.00 | 70.60 | C |
| ANISOU | 3903 | CD2 | PHE | B | 22 | 12131 | 9125 | 5568 | 534 | 249 | 197 | C |
| ATOM | 3904 | CE1 | PHE | B | 22 | 23.575 | 15.770 | −1.294 | 1.00 | 69.61 | C |
| ANISOU | 3904 | CE1 | PHE | B | 22 | 12048 | 8958 | 5441 | 510 | 757 | 425 | C |
| ATOM | 3905 | CE2 | PHE | B | 22 | 22.351 | 13.959 | −0.329 | 1.00 | 69.52 | C |
| ANISOU | 3905 | CE2 | PHE | B | 22 | 11881 | 8993 | 5539 | 516 | 482 | 165 | C |
| ATOM | 3906 | CZ | PHE | B | 22 | 23.554 | 14.581 | −0.593 | 1.00 | 68.42 | C |
| ANISOU | 3906 | CZ | PHE | B | 22 | 11759 | 8835 | 5403 | 505 | 733 | 278 | C |
| ATOM | 3907 | N | LEU | B | 23 | 17.299 | 14.988 | −3.604 | 1.00 | 61.80 | N |
| ANISOU | 3907 | N | LEU | B | 23 | 11645 | 8035 | 3803 | 654 | −553 | 196 | N |
| ATOM | 3908 | CA | LEU | B | 23 | 15.842 | 14.977 | −3.672 | 1.00 | 65.00 | C |
| ANISOU | 3908 | CA | LEU | B | 23 | 12053 | 8445 | 4197 | 670 | −878 | 154 | C |
| ATOM | 3909 | C | LEU | B | 23 | 15.299 | 14.766 | −2.265 | 1.00 | 68.14 | C |
| ANISOU | 3909 | C | LEU | B | 23 | 12144 | 8838 | 4910 | 634 | −980 | 81 | C |
| ATOM | 3910 | O | LEU | B | 23 | 15.643 | 13.777 | −1.607 | 1.00 | 65.25 | O |
| ANISOU | 3910 | O | LEU | B | 23 | 11646 | 8485 | 4659 | 606 | −898 | −35 | O |
| ATOM | 3911 | CB | LEU | B | 23 | 15.331 | 13.881 | −4.607 | 1.00 | 63.96 | C |
| ANISOU | 3911 | CB | LEU | B | 23 | 12025 | 8342 | 3936 | 673 | −979 | 29 | C |
| ATOM | 3912 | CG | LEU | B | 23 | 13.824 | 13.949 | −4.878 | 1.00 | 66.52 | C |
| ANISOU | 3912 | CG | LEU | B | 23 | 12315 | 8669 | 4291 | 679 | −1300 | 1 | C |
| ATOM | 3913 | CD1 | LEU | B | 23 | 13.472 | 15.269 | −5.546 | 1.00 | 71.25 | C |
| ANISOU | 3913 | CD1 | LEU | B | 23 | 13015 | 9248 | 4810 | 711 | −1380 | 161 | C |
| ATOM | 3914 | CD2 | LEU | B | 23 | 13.353 | 12.782 | −5.727 | 1.00 | 69.55 | C |
| ANISOU | 3914 | CD2 | LEU | B | 23 | 12776 | 9076 | 4556 | 671 | −1389 | −130 | C |
| ATOM | 3915 | N | ASN | B | 24 | 14.456 | 15.690 | −1.811 | 1.00 | 72.43 | N |
| ANISOU | 3915 | N | ASN | B | 24 | 12576 | 9357 | 5587 | 640 | −1153 | 152 | N |
| ATOM | 3916 | CA | ASN | B | 24 | 13.905 | 15.662 | −0.463 | 1.00 | 67.65 | C |
| ANISOU | 3916 | CA | ASN | B | 24 | 11685 | 8741 | 5276 | 611 | −1240 | 100 | C |
| ATOM | 3917 | C | ASN | B | 24 | 12.419 | 15.347 | −0.495 | 1.00 | 65.58 | C |
| ANISOU | 3917 | C | ASN | B | 24 | 11391 | 8488 | 5038 | 627 | −1544 | 30 | C |
| ATOM | 3918 | O | ASN | B | 24 | 11.702 | 15.769 | −1.407 | 1.00 | 62.11 | O |
| ANISOU | 3918 | O | ASN | B | 24 | 11113 | 8047 | 4439 | 665 | −1721 | 82 | O |
| ATOM | 3919 | CB | ASN | B | 24 | 14.101 | 17.003 | 0.246 | 1.00 | 64.56 | C |
| ANISOU | 3919 | CB | ASN | B | 24 | 11162 | 8306 | 5063 | 605 | −1186 | 230 | C |
| ATOM | 3920 | CG | ASN | B | 24 | 15.548 | 17.355 | 0.434 | 1.00 | 65.30 | C |
| ANISOU | 3920 | CG | ASN | B | 24 | 11243 | 8385 | 5183 | 578 | −896 | 298 | C |
| ATOM | 3921 | OD1 | ASN | B | 24 | 16.389 | 16.484 | 0.652 | 1.00 | 64.44 | O |
| ANISOU | 3921 | OD1 | ASN | B | 24 | 11098 | 8299 | 5087 | 554 | −728 | 223 | O |
| ATOM | 3922 | ND2 | ASN | B | 24 | 15.853 | 18.642 | 0.353 | 1.00 | 69.82 | N |
| ANISOU | 3922 | ND2 | ASN | B | 24 | 11839 | 8912 | 5776 | 583 | −836 | 444 | N |
| ATOM | 3923 | N | CYS | B | 25 | 11.959 | 14.613 | 0.515 | 1.00 | 61.74 | N |
| ANISOU | 3923 | N | CYS | B | 25 | 10692 | 8010 | 4758 | 596 | −1605 | −83 | N |
| ATOM | 3924 | CA | CYS | B | 25 | 10.540 | 14.523 | 0.825 | 1.00 | 61.59 | C |
| ANISOU | 3924 | CA | CYS | B | 25 | 10561 | 7987 | 4853 | 602 | −1874 | −131 | C |
| ATOM | 3925 | C | CYS | B | 25 | 10.370 | 14.853 | 2.298 | 1.00 | 54.00 | C |
| ANISOU | 3925 | C | CYS | B | 25 | 9318 | 7005 | 4196 | 578 | −1844 | −132 | C |
| ATOM | 3926 | O | CYS | B | 25 | 10.860 | 14.120 | 3.166 | 1.00 | 50.46 | O |
| ANISOU | 3926 | O | CYS | B | 25 | 8731 | 6564 | 3877 | 540 | −1718 | −212 | O |
| ATOM | 3927 | CB | CYS | B | 25 | 9.961 | 13.145 | 0.511 | 1.00 | 66.49 | C |
| ANISOU | 3927 | CB | CYS | B | 25 | 11218 | 8635 | 5409 | 586 | −2002 | −284 | C |

TABLE 11-continued

| | | | | | | | | | | |
|---|---|---|---|---|---|---|---|---|---|---|
| ATOM | 3928 | SG | CYS | B | 25 | 8.221 | 13.028 | 0.972 | 1.00 | 69.13 | | S |
| ANISOU | 3928 | SG | CYS | B | 25 | 11377 | 8963 | 5927 | 585 | −2322 | −341 | S |
| ATOM | 3929 | N | TYR | B | 26 | 9.695 | 15.960 | 2.569 | 1.00 | 52.25 | | N |
| ANISOU | 3929 | N | TYR | B | 26 | 9021 | 6752 | 4081 | 604 | −1957 | −40 | N |
| ATOM | 3930 | CA | TYR | B | 26 | 9.468 | 16.444 | 3.923 | 1.00 | 57.40 | | C |
| ANISOU | 3930 | CA | TYR | B | 26 | 9426 | 7375 | 5008 | 589 | −1934 | −32 | C |
| ATOM | 3931 | C | TYR | B | 26 | 8.031 | 16.118 | 4.300 | 1.00 | 56.82 | | C |
| ANISOU | 3931 | C | TYR | B | 26 | 9215 | 7302 | 5071 | 598 | −2169 | −100 | C |
| ATOM | 3932 | O | TYR | B | 26 | 7.092 | 16.610 | 3.666 | 1.00 | 57.27 | | O |
| ANISOU | 3932 | O | TYR | B | 26 | 9331 | 7350 | 5081 | 640 | −2371 | −53 | O |
| ATOM | 3933 | CB | TYR | B | 26 | 9.743 | 17.943 | 4.006 | 1.00 | 54.55 | | C |
| ANISOU | 3933 | CB | TYR | B | 26 | 9073 | 6967 | 4686 | 614 | −1880 | 116 | C |
| ATOM | 3934 | CG | TYR | B | 26 | 9.615 | 18.515 | 5.393 | 1.00 | 51.42 | | C |
| ANISOU | 3934 | CG | TYR | B | 26 | 8445 | 6534 | 4558 | 600 | −1837 | 124 | C |
| ATOM | 3935 | CD1 | TYR | B | 26 | 10.355 | 17.997 | 6.444 | 1.00 | 49.60 | | C |
| ANISOU | 3935 | CD1 | TYR | B | 26 | 8073 | 6313 | 4458 | 551 | −1671 | 57 | C |
| ATOM | 3936 | CD2 | TYR | B | 26 | 8.771 | 19.594 | 5.651 | 1.00 | 55.46 | | C |
| ANISOU | 3936 | CD2 | TYR | B | 26 | 8888 | 6999 | 5187 | 639 | −1963 | 199 | C |
| ATOM | 3937 | CE1 | TYR | B | 26 | 10.251 | 18.519 | 7.716 | 1.00 | 47.44 | | C |
| ANISOU | 3937 | CE1 | TYR | B | 26 | 7608 | 6007 | 4412 | 538 | −1633 | 61 | C |
| ATOM | 3938 | CE2 | TYR | B | 26 | 8.667 | 20.129 | 6.930 | 1.00 | 50.44 | | C |
| ANISOU | 3938 | CE2 | TYR | B | 26 | 8053 | 6324 | 4786 | 628 | −1914 | 199 | C |
| ATOM | 3939 | CZ | TYR | B | 26 | 9.408 | 19.581 | 7.955 | 1.00 | 52.47 | | C |
| ANISOU | 3939 | CZ | TYR | B | 26 | 8186 | 6595 | 5154 | 576 | −1750 | 128 | C |
| ATOM | 3940 | OH | TYR | B | 26 | 9.325 | 20.086 | 9.229 | 1.00 | 53.36 | | O |
| ANISOU | 3940 | OH | TYR | B | 26 | 8120 | 6671 | 5482 | 565 | −1702 | 122 | O |
| ATOM | 3941 | N | VAL | B | 27 | 7.859 | 15.266 | 5.305 | 1.00 | 48.52 | | N |
| ANISOU | 3941 | N | VAL | B | 27 | 7982 | 6261 | 4191 | 560 | −2143 | −207 | N |
| ATOM | 3942 | CA | VAL | B | 27 | 6.544 | 14.955 | 5.853 | 1.00 | 50.79 | | C |
| ANISOU | 3942 | CA | VAL | B | 27 | 8101 | 6543 | 4652 | 560 | −2331 | −270 | C |
| ATOM | 3943 | C | VAL | B | 27 | 6.471 | 15.590 | 7.227 | 1.00 | 51.87 | | C |
| ANISOU | 3943 | C | VAL | B | 27 | 8023 | 6649 | 5037 | 556 | −2252 | −244 | C |
| ATOM | 3944 | O | VAL | B | 27 | 7.399 | 15.447 | 8.029 | 1.00 | 50.78 | | O |
| ANISOU | 3944 | O | VAL | B | 27 | 7819 | 6511 | 4965 | 523 | −2058 | −259 | O |
| ATOM | 3945 | CB | VAL | B | 27 | 6.285 | 13.440 | 5.930 | 1.00 | 50.07 | | C |
| ANISOU | 3945 | CB | VAL | B | 27 | 7976 | 6482 | 4567 | 519 | −2370 | −414 | C |
| ATOM | 3946 | CG1 | VAL | B | 27 | 6.052 | 12.884 | 4.543 | 1.00 | 47.14 | | C |
| ANISOU | 3946 | CG1 | VAL | B | 27 | 7818 | 6133 | 3960 | 528 | −2504 | −449 | C |
| ATOM | 3947 | CG2 | VAL | B | 27 | 7.443 | 12.724 | 6.621 | 1.00 | 53.35 | | C |
| ANISOU | 3947 | CG2 | VAL | B | 27 | 8350 | 6908 | 5014 | 476 | −2135 | −470 | C |
| ATOM | 3948 | N | SER | B | 28 | 5.389 | 16.309 | 7.490 | 1.00 | 48.90 | | N |
| ANISOU | 3948 | N | SER | B | 28 | 7542 | 6244 | 4795 | 592 | −2403 | −203 | N |
| ATOM | 3949 | CA | SER | B | 28 | 5.269 | 17.022 | 8.749 | 1.00 | 49.16 | | C |
| ANISOU | 3949 | CA | SER | B | 28 | 7389 | 6240 | 5051 | 596 | −2330 | −176 | C |
| ATOM | 3950 | C | SER | B | 28 | 3.806 | 17.032 | 9.162 | 1.00 | 46.03 | | C |
| ANISOU | 3950 | C | SER | B | 28 | 6828 | 5827 | 4834 | 620 | −2514 | −205 | C |
| ATOM | 3951 | O | SER | B | 28 | 2.918 | 16.671 | 8.386 | 1.00 | 48.33 | | O |
| ANISOU | 3951 | O | SER | B | 28 | 7156 | 6133 | 5076 | 637 | −2711 | −227 | O |
| ATOM | 3952 | CB | SER | B | 28 | 5.818 | 18.443 | 8.626 | 1.00 | 46.98 | | C |
| ANISOU | 3952 | CB | SER | B | 28 | 7183 | 5919 | 4748 | 628 | −2254 | −46 | C |
| ATOM | 3953 | OG | SER | B | 28 | 5.107 | 19.138 | 7.618 | 1.00 | 51.34 | | O |
| ANISOU | 3953 | OG | SER | B | 28 | 7842 | 6455 | 5212 | 684 | −2430 | 35 | O |
| ATOM | 3954 | N | GLY | B | 29 | 3.571 | 17.437 | 10.407 | 1.00 | 47.09 | | N |
| ANISOU | 3954 | N | GLY | B | 29 | 6780 | 5931 | 5183 | 621 | −2445 | −208 | N |
| ATOM | 3955 | CA | GLY | B | 29 | 2.219 | 17.584 | 10.904 | 1.00 | 48.00 | | C |
| ANISOU | 3955 | CA | GLY | B | 29 | 6721 | 6022 | 5493 | 651 | −2588 | −225 | C |
| ATOM | 3956 | C | GLY | B | 29 | 1.440 | 16.304 | 11.092 | 1.00 | 50.24 | | C |
| ANISOU | 3956 | C | GLY | B | 29 | 6898 | 6336 | 5855 | 616 | −2680 | −337 | C |
| ATOM | 3957 | O | GLY | B | 29 | 0.211 | 16.353 | 11.126 | 1.00 | 48.72 | | O |
| ANISOU | 3957 | O | GLY | B | 29 | 6587 | 6130 | 5795 | 642 | −2842 | −345 | O |
| ATOM | 3958 | N | PHE | B | 30 | 2.102 | 15.153 | 11.223 | 1.00 | 46.26 | | N |
| ANISOU | 3958 | N | PHE | B | 30 | 6423 | 5868 | 5287 | 556 | −2580 | −422 | N |
| ATOM | 3959 | CA | PHE | B | 30 | 1.373 | 13.894 | 11.286 | 1.00 | 53.17 | | C |
| ANISOU | 3959 | CA | PHE | B | 30 | 7215 | 6763 | 6226 | 518 | −2675 | −527 | C |
| ATOM | 3960 | C | PHE | B | 30 | 1.472 | 13.271 | 12.673 | 1.00 | 44.10 | | C |
| ANISOU | 3960 | C | PHE | B | 30 | 5896 | 5609 | 5250 | 476 | −2529 | −594 | C |
| ATOM | 3961 | O | PHE | B | 30 | 2.402 | 13.534 | 13.442 | 1.00 | 42.57 | | O |
| ANISOU | 3961 | O | PHE | B | 30 | 5694 | 5411 | 5068 | 466 | −2342 | −577 | O |
| ATOM | 3962 | CB | PHE | B | 30 | 1.864 | 12.896 | 10.221 | 1.00 | 45.08 | | C |
| ANISOU | 3962 | CB | PHE | B | 30 | 6368 | 5775 | 4988 | 484 | −2708 | −585 | C |
| ATOM | 3963 | CG | PHE | B | 30 | 3.329 | 12.538 | 10.339 | 1.00 | 45.84 | | C |
| ANISOU | 3963 | CG | PHE | B | 30 | 6569 | 5888 | 4959 | 454 | −2491 | −598 | C |
| ATOM | 3964 | CD1 | PHE | B | 30 | 4.305 | 13.329 | 9.737 | 1.00 | 48.07 | | C |
| ANISOU | 3964 | CD1 | PHE | B | 30 | 7013 | 6173 | 5077 | 479 | −2401 | −513 | C |
| ATOM | 3965 | CD2 | PHE | B | 30 | 3.726 | 11.407 | 11.034 | 1.00 | 42.36 | | C |
| ANISOU | 3965 | CD2 | PHE | B | 30 | 6062 | 5458 | 4575 | 403 | −2376 | −688 | C |
| ATOM | 3966 | CE1 | PHE | B | 30 | 5.645 | 12.999 | 9.831 | 1.00 | 49.25 | | C |
| ANISOU | 3966 | CE1 | PHE | B | 30 | 7243 | 6338 | 5131 | 452 | −2200 | −522 | C |
| ATOM | 3967 | CE2 | PHE | B | 30 | 5.061 | 11.069 | 11.127 | 1.00 | 42.53 | | C |
| ANISOU | 3967 | CE2 | PHE | B | 30 | 6168 | 5494 | 4496 | 381 | −2185 | −697 | C |

TABLE 11-continued

| | | | | | | | | | | | |
|---|---|---|---|---|---|---|---|---|---|---|---|
| ATOM | 3968 | CZ | PHE | B | 30 | 6.022 | 11.867 | 10.525 | 1.00 | 45.47 | C |
| ANISOU | 3968 | CZ | PHE | B | 30 | 6689 | 5872 | 4714 | 406 | −2096 | −615 | C |
| ATOM | 3969 | N | HIS | B | 31 | 0.473 | 12.437 | 12.987 | 1.00 | 42.62 | N |
| ANISOU | 3969 | N | HIS | B | 31 | 5572 | 5420 | 5201 | 451 | −2625 | −668 | N |
| ATOM | 3970 | CA | HIS | B | 31 | 0.456 | 11.686 | 14.235 | 1.00 | 37.89 | C |
| ANISOU | 3970 | CA | HIS | B | 31 | 4821 | 4816 | 4760 | 409 | −2500 | −733 | C |
| ATOM | 3971 | C | HIS | B | 31 | −0.466 | 10.500 | 14.022 | 1.00 | 43.34 | C |
| ANISOU | 3971 | C | HIS | B | 31 | 5438 | 5509 | 5521 | 367 | −2631 | −822 | C |
| ATOM | 3972 | O | HIS | B | 31 | −1.540 | 10.683 | 13.439 | 1.00 | 45.34 | O |
| ANISOU | 3972 | O | HIS | B | 31 | 5647 | 5752 | 5826 | 385 | −2812 | −810 | O |
| ATOM | 3973 | CB | HIS | B | 31 | −0.045 | 12.537 | 15.400 | 1.00 | 41.84 | C |
| ANISOU | 3973 | CB | HIS | B | 31 | 5153 | 5283 | 5461 | 441 | −2437 | −692 | C |
| ATOM | 3974 | CG | HIS | B | 31 | 0.481 | 12.107 | 16.730 | 1.00 | 44.48 | C |
| ANISOU | 3974 | CG | HIS | B | 31 | 5400 | 5614 | 5887 | 407 | −2243 | −730 | C |
| ATOM | 3975 | ND1 | HIS | B | 31 | 0.039 | 10.974 | 17.374 | 1.00 | 46.54 | N |
| ANISOU | 3975 | ND1 | HIS | B | 31 | 5547 | 5876 | 6261 | 361 | −2220 | −807 | N |
| ATOM | 3976 | CD2 | HIS | B | 31 | 1.405 | 12.669 | 17.544 | 1.00 | 44.85 | C |
| ANISOU | 3976 | CD2 | HIS | B | 31 | 5461 | 5655 | 5927 | 412 | −2070 | −698 | C |
| ATOM | 3977 | CE1 | HIS | B | 31 | 0.686 | 10.843 | 18.518 | 1.00 | 41.15 | C |
| ANISOU | 3977 | CE1 | HIS | B | 31 | 4821 | 5190 | 5625 | 343 | −2039 | −817 | C |
| ATOM | 3978 | NE2 | HIS | B | 31 | 1.512 | 11.864 | 18.651 | 1.00 | 45.87 | N |
| ANISOU | 3978 | NE2 | HIS | B | 31 | 5492 | 5785 | 6153 | 373 | −1952 | −754 | N |
| ATOM | 3979 | N | PRO | B | 32 | −0.107 | 9.289 | 14.474 | 1.00 | 48.46 | N |
| ANISOU | 3979 | N | PRO | B | 32 | 6065 | 6163 | 6184 | 309 | −2538 | −903 | N |
| ATOM | 3980 | CA | PRO | B | 32 | 1.102 | 8.887 | 15.203 | 1.00 | 44.50 | C |
| ANISOU | 3980 | CA | PRO | B | 32 | 5598 | 5670 | 5640 | 283 | −2322 | −919 | C |
| ATOM | 3981 | C | PRO | B | 32 | 2.360 | 8.884 | 14.329 | 1.00 | 42.26 | C |
| ANISOU | 3981 | C | PRO | B | 32 | 5524 | 5413 | 5122 | 286 | −2258 | −905 | C |
| ATOM | 3982 | O | PRO | B | 32 | 2.268 | 9.203 | 13.144 | 1.00 | 48.42 | O |
| ANISOU | 3982 | O | PRO | B | 32 | 6436 | 6203 | 5759 | 309 | −2380 | −882 | O |
| ATOM | 3983 | CB | PRO | B | 32 | 0.760 | 7.471 | 15.677 | 1.00 | 46.26 | C |
| ANISOU | 3983 | CB | PRO | B | 32 | 5735 | 5884 | 5960 | 223 | −2308 | −1014 | C |
| ATOM | 3984 | CG | PRO | B | 32 | −0.167 | 6.952 | 14.615 | 1.00 | 47.89 | C |
| ANISOU | 3984 | CG | PRO | B | 32 | 5967 | 6087 | 6143 | 207 | −2524 | −1062 | C |
| ATOM | 3985 | CD | PRO | B | 32 | −0.990 | 8.138 | 14.189 | 1.00 | 50.95 | C |
| ANISOU | 3985 | CD | PRO | B | 32 | 6321 | 6471 | 6568 | 260 | −2654 | −983 | C |
| ATOM | 3986 | N | SER | B | 33 | 3.515 | 8.525 | 14.902 | 1.00 | 42.52 | N |
| ANISOU | 3986 | N | SER | B | 33 | 5587 | 5454 | 5116 | 267 | −2071 | −916 | N |
| ATOM | 3987 | CA | SER | B | 33 | 4.779 | 8.698 | 14.194 | 1.00 | 44.87 | C |
| ANISOU | 3987 | CA | SER | B | 33 | 6060 | 5772 | 5216 | 276 | −1979 | −887 | C |
| ATOM | 3988 | C | SER | B | 33 | 5.066 | 7.605 | 13.167 | 1.00 | 40.25 | C |
| ANISOU | 3988 | C | SER | B | 33 | 5618 | 5200 | 4477 | 253 | −2018 | −958 | C |
| ATOM | 3989 | O | SER | B | 33 | 5.920 | 7.816 | 12.302 | 1.00 | 45.39 | O |
| ANISOU | 3989 | O | SER | B | 33 | 6434 | 5868 | 4944 | 269 | −1972 | −931 | O |
| ATOM | 3990 | CB | SER | B | 33 | 5.945 | 8.776 | 15.177 | 1.00 | 42.80 | C |
| ANISOU | 3990 | CB | SER | B | 33 | 5767 | 5513 | 4981 | 266 | −1770 | −866 | C |
| ATOM | 3991 | OG | SER | B | 33 | 6.053 | 7.596 | 15.949 | 1.00 | 43.74 | O |
| ANISOU | 3991 | OG | SER | B | 33 | 5808 | 5627 | 5183 | 227 | −1697 | −939 | O |
| ATOM | 3992 | N | ASP | B | 34 | 4.399 | 6.460 | 13.228 | 1.00 | 44.98 | N |
| ANISOU | 3992 | N | ASP | B | 34 | 6162 | 5787 | 5143 | 215 | −2092 | −1048 | N |
| ATOM | 3993 | CA | ASP | B | 34 | 4.673 | 5.405 | 12.253 | 1.00 | 49.75 | C |
| ANISOU | 3993 | CA | ASP | B | 34 | 6913 | 6393 | 5598 | 192 | −2128 | −1126 | C |
| ATOM | 3994 | C | ASP | B | 34 | 4.283 | 5.882 | 10.859 | 1.00 | 49.28 | C |
| ANISOU | 3994 | C | ASP | B | 34 | 7006 | 6346 | 5371 | 219 | −2296 | −1107 | C |
| ATOM | 3995 | O | ASP | B | 34 | 3.143 | 6.295 | 10.628 | 1.00 | 47.37 | O |
| ANISOU | 3995 | O | ASP | B | 34 | 6704 | 6098 | 5196 | 228 | −2479 | −1094 | O |
| ATOM | 3996 | CB | ASP | B | 34 | 3.928 | 4.119 | 12.613 | 1.00 | 63.02 | C |
| ANISOU | 3996 | CB | ASP | B | 34 | 8497 | 8046 | 7403 | 141 | −2190 | −1227 | C |
| ATOM | 3997 | CG | ASP | B | 34 | 4.621 | 3.325 | 13.719 | 1.00 | 71.78 | C |
| ANISOU | 3997 | CG | ASP | B | 34 | 9526 | 9141 | 8606 | 114 | −2005 | −1258 | C |
| ATOM | 3998 | OD1 | ASP | B | 34 | 5.768 | 3.668 | 14.083 | 1.00 | 75.50 | O |
| ANISOU | 3998 | OD1 | ASP | B | 34 | 10032 | 9628 | 9025 | 134 | −1836 | −1211 | O |
| ATOM | 3999 | OD2 | ASP | B | 34 | 4.013 | 2.360 | 14.230 | 1.00 | 78.84 | O |
| ANISOU | 3999 | OD2 | ASP | B | 34 | 10320 | 10004 | 9632 | 71 | −2031 | −1325 | O |
| ATOM | 4000 | N | ILE | B | 35 | 5.233 | 5.831 | 9.928 | 1.00 | 46.30 | N |
| ANISOU | 4000 | N | ILE | B | 35 | 6829 | 5987 | 4777 | 235 | −2232 | −1103 | N |
| ATOM | 4001 | CA | ILE | B | 35 | 4.998 | 6.333 | 8.583 | 1.00 | 48.90 | C |
| ANISOU | 4001 | CA | ILE | B | 35 | 7335 | 6330 | 4914 | 265 | −2372 | −1074 | C |
| ATOM | 4002 | C | ILE | B | 35 | 5.976 | 5.639 | 7.652 | 1.00 | 56.45 | C |
| ANISOU | 4002 | C | ILE | B | 35 | 8507 | 7296 | 5645 | 264 | −2285 | −1122 | C |
| ATOM | 4003 | O | ILE | B | 35 | 7.082 | 5.266 | 8.053 | 1.00 | 53.74 | O |
| ANISOU | 4003 | O | ILE | B | 35 | 8175 | 6954 | 5289 | 259 | −2079 | −1130 | O |
| ATOM | 4004 | CB | ILE | B | 35 | 5.131 | 7.878 | 8.530 | 1.00 | 46.67 | C |
| ANISOU | 4004 | CB | ILE | B | 35 | 7063 | 6057 | 4611 | 315 | −2362 | −942 | C |
| ATOM | 4005 | CG1 | ILE | B | 35 | 4.542 | 8.439 | 7.233 | 1.00 | 49.90 | C |
| ANISOU | 4005 | CG1 | ILE | B | 35 | 7627 | 6476 | 4858 | 350 | −2556 | −903 | C |
| ATOM | 4006 | CG2 | ILE | B | 35 | 6.582 | 8.313 | 8.743 | 1.00 | 44.34 | C |
| ANISOU | 4006 | CG2 | ILE | B | 35 | 6834 | 5774 | 4241 | 328 | −2126 | −881 | C |
| ATOM | 4007 | CD1 | ILE | B | 35 | 4.567 | 9.960 | 7.159 | 1.00 | 55.65 | C |
| ANISOU | 4007 | CD1 | ILE | B | 35 | 8366 | 7202 | 5578 | 401 | −2561 | −768 | C |

TABLE 11-continued

| | | | | | | | | | | | |
|---|---|---|---|---|---|---|---|---|---|---|---|
| ATOM | 4008 | N | GLU | B | 36 | 5.555 | 5.440 | 6.411 | 1.00 | 55.82 | N |
| ANISOU | 4008 | N | GLU | B | 36 | 8573 | 7221 | 5415 | 265 | −2404 | −1139 | N |
| ATOM | 4009 | CA | GLU | B | 36 | 6.408 | 4.845 | 5.394 | 1.00 | 59.77 | C |
| ANISOU | 4009 | CA | GLU | B | 36 | 9290 | 7730 | 5692 | 269 | −2313 | −1178 | C |
| ATOM | 4010 | C | GLU | B | 36 | 6.522 | 5.833 | 4.246 | 1.00 | 57.09 | C |
| ANISOU | 4010 | C | GLU | B | 36 | 9129 | 7412 | 5151 | 313 | −2359 | −1085 | C |
| ATOM | 4011 | O | GLU | B | 36 | 5.510 | 6.229 | 3.657 | 1.00 | 63.49 | O |
| ANISOU | 4011 | O | GLU | B | 36 | 9932 | 8224 | 5967 | 317 | −2528 | −1050 | O |
| ATOM | 4012 | CB | GLU | B | 36 | 5.857 | 3.499 | 4.925 | 1.00 | 60.90 | C |
| ANISOU | 4012 | CB | GLU | B | 36 | 9441 | 7851 | 5846 | 219 | −2371 | −1284 | C |
| ATOM | 4013 | CG | GLU | B | 36 | 6.890 | 2.645 | 4.199 | 1.00 | 77.10 | C |
| ANISOU | 4013 | CG | GLU | B | 36 | 11683 | 9900 | 7710 | 220 | −2230 | −1350 | C |
| ATOM | 4014 | CD | GLU | B | 36 | 6.824 | 1.179 | 4.590 | 0.24 | 79.73 | C |
| ANISOU | 4014 | CD | GLU | B | 36 | 11952 | 10197 | 8144 | 170 | −2191 | −1469 | C |
| ATOM | 4015 | OE1 | GLU | B | 36 | 7.832 | 0.644 | 5.104 | 1.00 | 80.49 | O |
| ANISOU | 4015 | OE1 | GLU | B | 36 | 12061 | 10280 | 8240 | 176 | −2019 | −1509 | O |
| ATOM | 4016 | OE2 | GLU | B | 36 | 5.758 | 0.564 | 4.391 | 1.00 | 81.46 | O |
| ANISOU | 4016 | OE2 | GLU | B | 36 | 12107 | 10396 | 8448 | 126 | −2332 | −1519 | O |
| ATOM | 4017 | N | VAL | B | 37 | 7.745 | 6.254 | 3.957 | 1.00 | 54.99 | N |
| ANISOU | 4017 | N | VAL | B | 37 | 9017 | 7160 | 4715 | 348 | −2201 | −1041 | N |
| ATOM | 4018 | CA | VAL | B | 37 | 8.016 | 7.229 | 2.910 | 1.00 | 59.06 | C |
| ANISOU | 4018 | CA | VAL | B | 37 | 9716 | 7693 | 5031 | 391 | −2207 | −939 | C |
| ATOM | 4019 | C | VAL | B | 37 | 9.018 | 6.614 | 1.948 | 1.00 | 61.75 | C |
| ANISOU | 4019 | C | VAL | B | 37 | 10273 | 8043 | 5148 | 398 | −2054 | −975 | C |
| ATOM | 4020 | O | VAL | B | 37 | 10.080 | 6.139 | 2.368 | 1.00 | 62.44 | O |
| ANISOU | 4020 | O | VAL | B | 37 | 10381 | 8127 | 5216 | 399 | −1865 | −1013 | O |
| ATOM | 4021 | CB | VAL | B | 37 | 8.553 | 8.552 | 3.492 | 1.00 | 55.38 | C |
| ANISOU | 4021 | CB | VAL | B | 37 | 9205 | 7231 | 4608 | 424 | −2116 | −813 | C |
| ATOM | 4022 | CG1 | VAL | B | 37 | 8.756 | 9.582 | 2.380 | 1.00 | 51.25 | C |
| ANISOU | 4022 | CG1 | VAL | B | 37 | 8889 | 6717 | 3868 | 470 | −2141 | −701 | C |
| ATOM | 4023 | CG2 | VAL | B | 37 | 7.608 | 9.081 | 4.561 | 1.00 | 48.06 | C |
| ANISOU | 4023 | CG2 | VAL | B | 37 | 8033 | 6288 | 3937 | 416 | −2226 | −784 | C |
| ATOM | 4024 | N | ASP | B | 38 | 8.676 | 6.611 | 0.666 | 1.00 | 60.15 | N |
| ANISOU | 4024 | N | ASP | B | 38 | 10225 | 7847 | 4781 | 407 | −2133 | −963 | N |
| ATOM | 4025 | CA | ASP | B | 38 | 9.580 | 6.176 | −0.382 | 1.00 | 64.30 | C |
| ANISOU | 4025 | CA | ASP | B | 38 | 10971 | 8381 | 5079 | 421 | −1989 | −983 | C |
| ATOM | 4026 | C | ASP | B | 38 | 9.757 | 7.303 | −1.387 | 1.00 | 64.25 | C |
| ANISOU | 4026 | C | ASP | B | 38 | 11139 | 8390 | 4883 | 465 | −1994 | −859 | C |
| ATOM | 4027 | O | ASP | B | 38 | 8.841 | 8.095 | −1.623 | 1.00 | 68.96 | O |
| ANISOU | 4027 | O | ASP | B | 38 | 11709 | 8989 | 5505 | 476 | −2173 | −789 | O |
| ATOM | 4028 | CB | ASP | B | 38 | 9.056 | 4.913 | −1.092 | 1.00 | 66.38 | C |
| ANISOU | 4028 | CB | ASP | B | 38 | 11285 | 8635 | 5303 | 386 | −2068 | −1105 | C |
| ATOM | 4029 | CG | ASP | B | 38 | 9.028 | 3.699 | −0.182 | 1.00 | 75.02 | C |
| ANISOU | 4029 | CG | ASP | B | 38 | 12231 | 9704 | 6568 | 343 | −2032 | −1226 | C |
| ATOM | 4030 | OD1 | ASP | B | 38 | 10.087 | 3.342 | 0.375 | 1.00 | 77.28 | O |
| ANISOU | 4030 | OD1 | ASP | B | 38 | 12514 | 9984 | 6865 | 350 | −1834 | −1251 | O |
| ATOM | 4031 | OD2 | ASP | B | 38 | 7.942 | 3.101 | −0.016 | 1.00 | 81.49 | O |
| ANISOU | 4031 | OD2 | ASP | B | 38 | 12937 | 10508 | 7519 | 301 | −2197 | −1291 | O |
| ATOM | 4032 | N | LEU | B | 39 | 10.949 | 7.377 | −1.964 | 1.00 | 66.22 | N |
| ANISOU | 4032 | N | LEU | B | 39 | 11563 | 8648 | 4951 | 490 | −1785 | −827 | N |
| ATOM | 4033 | CA | LEU | B | 39 | 11.212 | 8.245 | −3.100 | 1.00 | 72.30 | C |
| ANISOU | 4033 | CA | LEU | B | 39 | 12531 | 9429 | 5512 | 528 | −1759 | −718 | C |
| ATOM | 4034 | C | LEU | B | 39 | 11.185 | 7.415 | −4.375 | 1.00 | 74.24 | C |
| ANISOU | 4034 | C | LEU | B | 39 | 12953 | 9679 | 5575 | 525 | −1764 | −791 | C |
| ATOM | 4035 | O | LEU | B | 39 | 11.640 | 6.268 | −4.386 | 1.00 | 73.77 | O |
| ANISOU | 4035 | O | LEU | B | 39 | 12911 | 9614 | 5506 | 507 | −1659 | −903 | O |
| ATOM | 4036 | CB | LEU | B | 39 | 12.555 | 8.954 | −2.942 | 1.00 | 71.42 | C |
| ANISOU | 4036 | CB | LEU | B | 39 | 12495 | 9319 | 5323 | 556 | −1507 | −620 | C |
| ATOM | 4037 | CG | LEU | B | 39 | 12.527 | 9.881 | −1.727 | 1.00 | 69.44 | C |
| ANISOU | 4037 | CG | LEU | B | 39 | 12084 | 9061 | 5241 | 560 | −1522 | −542 | C |
| ATOM | 4038 | CD1 | LEU | B | 39 | 13.910 | 10.395 | −1.382 | 1.00 | 67.91 | C |
| ANISOU | 4038 | CD1 | LEU | B | 39 | 11925 | 8864 | 5015 | 574 | −1254 | −462 | C |
| ATOM | 4039 | CD2 | LEU | B | 39 | 11.573 | 11.027 | −2.009 | 1.00 | 70.38 | C |
| ANISOU | 4039 | CD2 | LEU | B | 39 | 12198 | 9173 | 5369 | 580 | −1722 | −433 | C |
| ATOM | 4040 | N | LEU | B | 40 | 10.638 | 7.997 | −5.442 | 1.00 | 71.17 | N |
| ANISOU | 4040 | N | LEU | B | 40 | 12697 | 9299 | 5044 | 546 | −1891 | −726 | N |
| ATOM | 4041 | CA | LEU | B | 40 | 10.403 | 7.291 | −6.696 | 1.00 | 76.63 | C |
| ANISOU | 4041 | CA | LEU | B | 40 | 13561 | 9996 | 5559 | 543 | −1944 | −794 | C |
| ATOM | 4042 | C | LEU | B | 40 | 11.034 | 8.038 | −7.860 | 1.00 | 79.29 | C |
| ANISOU | 4042 | C | LEU | B | 40 | 14133 | 10344 | 5651 | 587 | −1840 | −689 | C |
| ATOM | 4043 | O | LEU | B | 40 | 10.905 | 9.262 | −7.966 | 1.00 | 76.30 | O |
| ANISOU | 4043 | O | LEU | B | 40 | 13777 | 9968 | 5248 | 615 | −1880 | −553 | O |
| ATOM | 4044 | CB | LEU | B | 40 | 8.903 | 7.120 | −6.968 | 1.00 | 75.43 | C |
| ANISOU | 4044 | CB | LEU | B | 40 | 13344 | 9843 | 5471 | 521 | −2242 | −835 | C |
| ATOM | 4045 | CG | LEU | B | 40 | 8.082 | 6.377 | −5.918 | 1.00 | 71.30 | C |
| ANISOU | 4045 | CG | LEU | B | 40 | 12585 | 9306 | 5200 | 473 | −2369 | −935 | C |
| ATOM | 4046 | CD1 | LEU | B | 40 | 6.675 | 6.126 | −6.444 | 1.00 | 71.54 | C |
| ANISOU | 4046 | CD1 | LEU | B | 40 | 12584 | 9335 | 5262 | 450 | −2642 | −976 | C |
| ATOM | 4047 | CD2 | LEU | B | 40 | 8.766 | 5.083 | −5.528 | 1.00 | 64.88 | C |
| ANISOU | 4047 | CD2 | LEU | B | 40 | 11751 | 8479 | 4421 | 443 | −2212 | −1063 | C |

TABLE 11-continued

| | | | | | | | | | | | | |
|---|---|---|---|---|---|---|---|---|---|---|---|---|
| ATOM | 4048 | N | LYS | B | 41 | 11.702 | 7.290 | −8.736 | 1.00 | 82.52 | | N |
| ANISOU | 4048 | N | LYS | B | 41 | 14716 | 10755 | 5885 | 593 | −1703 | −752 | N |
| ATOM | 4049 | CA | LYS | B | 41 | 12.069 | 7.747 | −10.069 | 1.00 | 87.64 | | C |
| ANISOU | 4049 | CA | LYS | B | 41 | 15607 | 11413 | 6280 | 629 | −1643 | −680 | C |
| ATOM | 4050 | C | LYS | B | 41 | 11.387 | 6.827 | −11.068 | 1.00 | 86.65 | | C |
| ANISOU | 4050 | C | LYS | B | 41 | 15602 | 11290 | 6032 | 616 | −1793 | −793 | C |
| ATOM | 4051 | O | LYS | B | 41 | 11.599 | 5.610 | −11.033 | 1.00 | 85.23 | | O |
| ANISOU | 4051 | O | LYS | B | 41 | 15418 | 11099 | 5866 | 592 | −1735 | −928 | O |
| ATOM | 4052 | CB | LYS | B | 41 | 13.584 | 7.734 | −10.280 | 1.00 | 94.26 | | C |
| ANISOU | 4052 | CB | LYS | B | 41 | 16558 | 12249 | 7009 | 654 | −1315 | −647 | C |
| ATOM | 4053 | CG | LYS | B | 41 | 13.984 | 7.794 | −11.754 | 1.00 | 102.66 | | C |
| ANISOU | 4053 | CG | LYS | B | 41 | 17885 | 13319 | 7802 | 685 | −1234 | −617 | C |
| ATOM | 4054 | CD | LYS | B | 41 | 15.446 | 8.170 | −11.941 | 1.00 | 106.27 | | C |
| ANISOU | 4054 | CD | LYS | B | 41 | 18435 | 13773 | 8171 | 714 | −906 | −535 | C |
| ATOM | 4055 | CE | LYS | B | 41 | 16.378 | 7.090 | −11.425 | 1.00 | 106.74 | | C |
| ANISOU | 4055 | CE | LYS | B | 41 | 18427 | 13821 | 8307 | 705 | −687 | −643 | C |
| ATOM | 4056 | NZ | LYS | B | 41 | 16.397 | 5.910 | −12.327 | 1.00 | 110.94 | | N |
| ANISOU | 4056 | NZ | LYS | B | 41 | 19101 | 14349 | 8702 | 707 | −676 | −775 | N |
| ATOM | 4057 | N | ASN | B | 42 | 10.565 | 7.403 | −11.946 | 1.00 | 89.28 | | N |
| ANISOU | 4057 | N | ASN | B | 42 | 16041 | 11633 | 6250 | 631 | −1988 | −736 | N |
| ATOM | 4058 | CA | ASN | B | 42 | 9.819 | 6.628 | −12.937 | 1.00 | 89.34 | | C |
| ANISOU | 4058 | CA | ASN | B | 42 | 16168 | 11643 | 6133 | 617 | −2159 | −835 | C |
| ATOM | 4059 | C | ASN | B | 42 | 8.984 | 5.543 | −12.265 | 1.00 | 91.30 | | C |
| ANISOU | 4059 | C | ASN | B | 42 | 16238 | 11879 | 6574 | 563 | −2316 | −980 | C |
| ATOM | 4060 | O | ASN | B | 42 | 8.864 | 4.425 | −12.770 | 1.00 | 92.78 | | O |
| ANISOU | 4060 | O | ASN | B | 42 | 16501 | 12057 | 6695 | 539 | −2342 | −1109 | O |
| ATOM | 4061 | CB | ASN | B | 42 | 10.755 | 6.015 | −13.978 | 1.00 | 84.77 | | C |
| ANISOU | 4061 | CB | ASN | B | 42 | 15828 | 11064 | 5317 | 637 | −1967 | −884 | C |
| ATOM | 4062 | CG | ASN | B | 42 | 11.749 | 7.010 | −14.522 | 1.00 | 86.74 | | C |
| ANISOU | 4062 | CG | ASN | B | 42 | 16236 | 11322 | 5400 | 685 | −1758 | −741 | C |
| ATOM | 4063 | OD1 | ASN | B | 42 | 11.424 | 8.181 | −14.728 | 1.00 | 86.27 | | O |
| ANISOU | 4063 | OD1 | ASN | B | 42 | 16203 | 11270 | 5305 | 709 | −1842 | −605 | O |
| ATOM | 4064 | ND2 | ASN | B | 42 | 12.974 | 6.553 | −14.754 | 1.00 | 86.97 | | N |
| ANISOU | 4064 | ND2 | ASN | B | 42 | 16364 | 11344 | 5335 | 701 | −1478 | −768 | N |
| ATOM | 4065 | N | GLY | B | 43 | 8.426 | 5.866 | −11.100 | 1.00 | 85.67 | | N |
| ANISOU | 4065 | N | GLY | B | 43 | 15285 | 11161 | 6105 | 542 | −2411 | −957 | N |
| ATOM | 4066 | CA | GLY | B | 43 | 7.596 | 4.933 | −10.371 | 1.00 | 82.09 | | C |
| ANISOU | 4066 | CA | GLY | B | 43 | 14641 | 10693 | 5859 | 489 | −2553 | −1077 | C |
| ATOM | 4067 | C | GLY | B | 43 | 8.331 | 3.797 | −9.700 | 1.00 | 83.74 | | C |
| ANISOU | 4067 | C | GLY | B | 43 | 14782 | 10881 | 6152 | 461 | −2373 | −1194 | C |
| ATOM | 4068 | O | GLY | B | 43 | 7.688 | 2.980 | −9.030 | 1.00 | 85.63 | | O |
| ANISOU | 4068 | O | GLY | B | 43 | 14858 | 11103 | 6574 | 413 | −2474 | −1292 | O |
| ATOM | 4069 | N | GLU | B | 44 | 9.650 | 3.713 | −9.851 | 1.00 | 81.86 | | N |
| ANISOU | 4069 | N | GLU | B | 44 | 14661 | 10644 | 5799 | 489 | −2106 | −1182 | N |
| ATOM | 4070 | CA | GLU | B | 44 | 10.447 | 2.670 | −9.224 | 1.00 | 78.01 | | C |
| ANISOU | 4070 | CA | GLU | B | 44 | 14113 | 10135 | 5393 | 472 | −1917 | −1284 | C |
| ATOM | 4071 | C | GLU | B | 44 | 11.126 | 3.211 | −7.969 | 1.00 | 86.37 | | C |
| ANISOU | 4071 | C | GLU | B | 44 | 15009 | 11195 | 6614 | 481 | −1764 | −1215 | C |
| ATOM | 4072 | O | GLU | B | 44 | 11.487 | 4.389 | −7.891 | 1.00 | 83.60 | | O |
| ANISOU | 4072 | O | GLU | B | 44 | 14676 | 10860 | 6228 | 514 | −1705 | −1082 | O |
| ATOM | 4073 | CB | GLU | B | 44 | 11.494 | 2.122 | −10.198 | 1.00 | 73.54 | | C |
| ANISOU | 4073 | CB | GLU | B | 44 | 13769 | 9565 | 4608 | 501 | −1708 | −1325 | C |
| ATOM | 4074 | CG | GLU | B | 44 | 10.907 | 1.451 | −11.458 | 1.00 | 76.18 | | C |
| ANISOU | 4074 | CG | GLU | B | 44 | 14283 | 9894 | 4766 | 492 | −1846 | −1412 | C |
| ATOM | 4075 | CD | GLU | B | 44 | 10.498 | −0.001 | −11.220 | 1.00 | 84.52 | | C |
| ANISOU | 4075 | CD | GLU | B | 44 | 15271 | 10918 | 5924 | 443 | −1910 | −1581 | C |
| ATOM | 4076 | OE1 | GLU | B | 44 | 10.761 | −0.522 | −10.112 | 1.00 | 86.31 | | O |
| ANISOU | 4076 | OE1 | GLU | B | 44 | 15321 | 11124 | 6348 | 420 | −1826 | −1629 | O |
| ATOM | 4077 | OE2 | GLU | B | 44 | 9.918 | −0.623 | −12.140 | 1.00 | 91.59 | | O |
| ANISOU | 4077 | OE2 | GLU | B | 44 | 16293 | 11805 | 6702 | 426 | −2044 | −1665 | O |
| ATOM | 4078 | N | ARG | B | 45 | 11.302 | 2.328 | −6.989 | 1.00 | 91.67 | | N |
| ANISOU | 4078 | N | ARG | B | 45 | 15527 | 11844 | 7460 | 451 | −1702 | −1308 | N |
| ATOM | 4079 | CA | ARG | B | 45 | 11.803 | 2.713 | −5.676 | 1.00 | 96.91 | | C |
| ANISOU | 4079 | CA | ARG | B | 45 | 16015 | 12506 | 8301 | 452 | −1590 | −1263 | C |
| ATOM | 4080 | C | ARG | B | 45 | 13.307 | 2.952 | −5.702 | 1.00 | 90.22 | | C |
| ANISOU | 4080 | C | ARG | B | 45 | 15255 | 11663 | 7361 | 494 | −1292 | −1210 | C |
| ATOM | 4081 | O | ARG | B | 45 | 14.065 | 2.146 | −6.250 | 1.00 | 91.29 | | O |
| ANISOU | 4081 | O | ARG | B | 45 | 15506 | 11787 | 7395 | 506 | −1130 | −1278 | O |
| ATOM | 4082 | CB | ARG | B | 45 | 11.481 | 1.629 | −4.653 | 1.00 | 105.40 | | C |
| ANISOU | 4082 | CB | ARG | B | 45 | 16903 | 13553 | 9590 | 407 | −1622 | −1381 | C |
| ATOM | 4083 | CG | ARG | B | 45 | 10.074 | 1.658 | −4.090 | 1.00 | 112.19 | | C |
| ANISOU | 4083 | CG | ARG | B | 45 | 17588 | 14408 | 10632 | 363 | −1882 | −1399 | C |
| ATOM | 4084 | CD | ARG | B | 45 | 10.013 | 0.859 | −2.796 | 1.00 | 114.04 | | C |
| ANISOU | 4084 | CD | ARG | B | 45 | 17615 | 14613 | 11100 | 325 | −1854 | −1478 | C |
| ATOM | 4085 | NE | ARG | B | 45 | 11.006 | 1.333 | −1.833 | 1.00 | 114.77 | | N |
| ANISOU | 4085 | NE | ARG | B | 45 | 17633 | 14712 | 11264 | 351 | −1665 | −1420 | N |
| ATOM | 4086 | CZ | ARG | B | 45 | 12.180 | 0.748 | −1.613 | 1.00 | 116.12 | | C |
| ANISOU | 4086 | CZ | ARG | B | 45 | 17840 | 14868 | 11411 | 368 | −1435 | −1460 | C |
| ATOM | 4087 | NH1 | ARG | B | 45 | 12.517 | −0.346 | −2.288 | 1.00 | 118.50 | | N |
| ANISOU | 4087 | NH1 | ARG | B | 45 | 18254 | 15148 | 11624 | 365 | −1360 | −1559 | N |

TABLE 11-continued

| | | | | | | | | | | | |
|---|---|---|---|---|---|---|---|---|---|---|---|
| ATOM | 4088 | NH2 | ARG | B | 45 | 13.020 | 1.261 | −0.722 | 1.00 | 111.71 | N |
| ANISOU | 4088 | NH2 | ARG | B | 45 | 17206 | 14317 | 10923 | 392 | −1281 | −1401 | N |
| ATOM | 4089 | N | ILE | B | 46 | 13.737 | 4.046 | −5.085 | 1.00 | 83.36 | N |
| ANISOU | 4089 | N | ILE | B | 46 | 14324 | 10808 | 6542 | 514 | −1215 | −1091 | N |
| ATOM | 4090 | CA | ILE | B | 46 | 15.155 | 4.339 | −4.910 | 1.00 | 82.96 | C |
| ANISOU | 4090 | CA | ILE | B | 46 | 14315 | 10759 | 6448 | 546 | −927 | −1031 | C |
| ATOM | 4091 | C | ILE | B | 46 | 15.639 | 3.648 | −3.640 | 1.00 | 85.23 | C |
| ANISOU | 4091 | C | ILE | B | 46 | 14426 | 11029 | 6930 | 531 | −817 | −1102 | C |
| ATOM | 4092 | O | ILE | B | 46 | 15.029 | 3.786 | −2.574 | 1.00 | 84.11 | O |
| ANISOU | 4092 | O | ILE | B | 46 | 14105 | 10883 | 6969 | 505 | −942 | −1109 | O |
| ATOM | 4093 | CB | ILE | B | 46 | 15.398 | 5.856 | −4.851 | 1.00 | 76.65 | C |
| ANISOU | 4093 | CB | ILE | B | 46 | 13537 | 9977 | 5611 | 571 | −894 | −865 | C |
| ATOM | 4094 | CG1 | ILE | B | 46 | 14.884 | 6.514 | −6.134 | 1.00 | 79.49 | C |
| ANISOU | 4094 | CG1 | ILE | B | 46 | 14075 | 10348 | 5778 | 590 | −1010 | −793 | C |
| ATOM | 4095 | CG2 | ILE | B | 46 | 16.872 | 6.158 | −4.640 | 1.00 | 71.76 | C |
| ANISOU | 4095 | CG2 | ILE | B | 46 | 12943 | 9356 | 4966 | 597 | −585 | −799 | C |
| ATOM | 4096 | CD1 | ILE | B | 46 | 14.968 | 8.027 | −6.125 | 1.00 | 78.49 | C |
| ANISOU | 4096 | CD1 | ILE | B | 46 | 13972 | 10229 | 5622 | 613 | −1007 | −625 | C |
| ATOM | 4097 | N | GLU | B | 47 | 16.736 | 2.899 | −3.753 | 1.00 | 92.93 | N |
| ANISOU | 4097 | N | GLU | B | 47 | 15447 | 11991 | 7872 | 549 | −581 | −1152 | N |
| ATOM | 4098 | CA | GLU | B | 47 | 17.155 | 2.040 | −2.650 | 1.00 | 97.97 | C |
| ANISOU | 4098 | CA | GLU | B | 47 | 15927 | 12606 | 8691 | 537 | −486 | −1235 | C |
| ATOM | 4099 | C | GLU | B | 47 | 17.872 | 2.815 | −1.549 | 1.00 | 95.51 | C |
| ANISOU | 4099 | C | GLU | B | 47 | 15490 | 12303 | 8497 | 549 | −353 | −1148 | C |
| ATOM | 4100 | O | GLU | B | 47 | 17.671 | 2.535 | −0.362 | 1.00 | 91.70 | O |
| ANISOU | 4100 | O | GLU | B | 47 | 14834 | 11807 | 8199 | 530 | −396 | −1190 | O |
| ATOM | 4101 | CB | GLU | B | 47 | 18.052 | 0.914 | −3.174 | 1.00 | 101.58 | C |
| ANISOU | 4101 | CB | GLU | B | 47 | 16469 | 13039 | 9086 | 558 | −285 | −1322 | C |
| ATOM | 4102 | CG | GLU | B | 47 | 17.304 | −0.238 | −3.836 | 1.00 | 104.08 | C |
| ANISOU | 4102 | CG | GLU | B | 47 | 16855 | 13333 | 9359 | 534 | −424 | −1453 | C |
| ATOM | 4103 | CD | GLU | B | 47 | 16.643 | −1.168 | −2.832 | 0.00 | 104.00 | C |
| ANISOU | 4103 | CD | GLU | B | 47 | 16670 | 13291 | 9553 | 491 | −546 | −1560 | C |
| ATOM | 4104 | OE1 | GLU | B | 47 | 16.061 | −2.185 | −3.264 | 1.00 | 105.23 | O |
| ANISOU | 4104 | OE1 | GLU | B | 47 | 16865 | 13420 | 9698 | 465 | −648 | −1672 | O |
| ATOM | 4105 | OE2 | GLU | B | 47 | 16.707 | −0.891 | −1.614 | 1.00 | 104.38 | O |
| ANISOU | 4105 | OE2 | GLU | B | 47 | 16547 | 13338 | 9773 | 483 | −537 | −1532 | O |
| ATOM | 4106 | N | LYS | B | 48 | 18.703 | 3.787 | −1.914 | 1.00 | 100.72 | N |
| ANISOU | 4106 | N | LYS | B | 48 | 16233 | 12979 | 9055 | 579 | −188 | −1026 | N |
| ATOM | 4107 | CA | LYS | B | 48 | 19.595 | 4.441 | −0.954 | 1.00 | 103.75 | C |
| ANISOU | 4107 | CA | LYS | B | 48 | 16493 | 13368 | 9560 | 587 | −13 | −941 | C |
| ATOM | 4108 | C | LYS | B | 48 | 18.971 | 5.749 | −0.463 | 1.00 | 98.54 | C |
| ANISOU | 4108 | C | LYS | B | 48 | 15713 | 12723 | 9003 | 563 | −159 | −819 | C |
| ATOM | 4109 | O | LYS | B | 48 | 19.403 | 6.851 | −0.802 | 1.00 | 105.55 | O |
| ANISOU | 4109 | O | LYS | B | 48 | 16653 | 13621 | 9831 | 574 | −75 | −686 | O |
| ATOM | 4110 | CB | LYS | B | 48 | 20.969 | 4.674 | −1.585 | 1.00 | 107.61 | C |
| ANISOU | 4110 | CB | LYS | B | 48 | 17095 | 13859 | 9933 | 625 | 286 | −871 | C |
| ATOM | 4111 | CG | LYS | B | 48 | 21.736 | 3.405 | −1.979 | 1.00 | 108.22 | C |
| ANISOU | 4111 | CG | LYS | B | 48 | 17205 | 13916 | 9997 | 646 | 464 | −971 | C |
| ATOM | 4112 | CD | LYS | B | 48 | 21.364 | 2.901 | −3.378 | 1.00 | 107.98 | C |
| ANISOU | 4112 | CD | LYS | B | 48 | 17366 | 13884 | 9779 | 654 | 402 | −1023 | C |
| ATOM | 4113 | CE | LYS | B | 48 | 22.068 | 1.587 | −3.703 | 1.00 | 104.38 | C |
| ANISOU | 4113 | CE | LYS | B | 48 | 16936 | 13401 | 9325 | 676 | 566 | −1132 | C |
| ATOM | 4114 | NZ | LYS | B | 48 | 21.501 | 0.912 | −4.907 | 1.00 | 102.23 | N |
| ANISOU | 4114 | NZ | LYS | B | 48 | 16836 | 13120 | 8887 | 677 | 460 | −1215 | N |
| ATOM | 4115 | N | VAL | B | 49 | 17.938 | 5.608 | 0.367 | 1.00 | 84.11 | N |
| ANISOU | 4115 | N | VAL | B | 49 | 13720 | 10892 | 7345 | 530 | −372 | −865 | N |
| ATOM | 4116 | CA | VAL | B | 49 | 17.177 | 6.743 | 0.881 | 1.00 | 74.96 | C |
| ANISOU | 4116 | CA | VAL | B | 49 | 12442 | 9742 | 6299 | 511 | −533 | −769 | C |
| ATOM | 4117 | C | VAL | B | 49 | 17.380 | 6.828 | 2.386 | 1.00 | 65.64 | C |
| ANISOU | 4117 | C | VAL | B | 49 | 10970 | 8554 | 5415 | 478 | −487 | −754 | C |
| ATOM | 4118 | O | VAL | B | 49 | 17.185 | 5.842 | 3.107 | 1.00 | 59.20 | O |
| ANISOU | 4118 | O | VAL | B | 49 | 10031 | 7728 | 4734 | 458 | −513 | −856 | O |
| ATOM | 4119 | CB | VAL | B | 49 | 15.680 | 6.634 | 0.537 | 1.00 | 70.74 | C |
| ANISOU | 4119 | CB | VAL | B | 49 | 11963 | 9207 | 5708 | 504 | −836 | −826 | C |
| ATOM | 4120 | CG1 | VAL | B | 49 | 14.901 | 7.782 | 1.179 | 1.00 | 67.93 | C |
| ANISOU | 4120 | CG1 | VAL | B | 49 | 11456 | 8854 | 5502 | 491 | −988 | −729 | C |
| ATOM | 4121 | CG2 | VAL | B | 49 | 15.475 | 6.637 | −0.966 | 1.00 | 66.40 | C |
| ANISOU | 4121 | CG2 | VAL | B | 49 | 11699 | 8666 | 4865 | 534 | −895 | −829 | C |
| ATOM | 4122 | N | GLU | B | 50 | 17.762 | 8.004 | 2.860 | 1.00 | 63.57 | N |
| ANISOU | 4122 | N | GLU | B | 50 | 10608 | 8294 | 5251 | 471 | −422 | −628 | N |
| ATOM | 4123 | CA | GLU | B | 50 | 17.974 | 8.221 | 4.280 | 1.00 | 62.79 | C |
| ANISOU | 4123 | CA | GLU | B | 50 | 10250 | 8188 | 5417 | 440 | −385 | −607 | C |
| ATOM | 4124 | C | GLU | B | 50 | 16.923 | 9.179 | 4.821 | 1.00 | 57.49 | C |
| ANISOU | 4124 | C | GLU | B | 50 | 9476 | 7513 | 4856 | 426 | −576 | −552 | C |
| ATOM | 4125 | O | GLU | B | 50 | 16.249 | 9.884 | 4.066 | 1.00 | 59.52 | O |
| ANISOU | 4125 | O | GLU | B | 50 | 9855 | 7769 | 4989 | 444 | −706 | −500 | O |
| ATOM | 4126 | CB | GLU | B | 50 | 19.383 | 8.759 | 4.531 | 1.00 | 67.45 | C |
| ANISOU | 4126 | CB | GLU | B | 50 | 10787 | 8778 | 6065 | 437 | −139 | −516 | C |
| ATOM | 4127 | CG | GLU | B | 50 | 20.467 | 7.842 | 3.996 | 1.00 | 71.97 | C |
| ANISOU | 4127 | CG | GLU | B | 50 | 11448 | 9352 | 6544 | 459 | 69 | −564 | C |

TABLE 11-continued

| | | | | | | | | | | | |
|---|---|---|---|---|---|---|---|---|---|---|---|
| ATOM | 4128 | CD | GLU | B | 50 | 21.851 | 8.387 | 4.233 | 0.05 | 75.50 | C |
| ANISOU | 4128 | CD | GLU | B | 50 | 11823 | 9797 | 7067 | 455 | 309 | −469 | C |
| ATOM | 4129 | OE1 | GLU | B | 50 | 22.194 | 9.418 | 3.619 | 1.00 | 76.64 | O |
| ANISOU | 4129 | OE1 | GLU | B | 50 | 12060 | 9939 | 7120 | 459 | 377 | −357 | O |
| ATOM | 4130 | OE2 | GLU | B | 50 | 22.587 | 7.788 | 5.044 | 1.00 | 78.47 | O |
| ANISOU | 4130 | OE2 | GLU | B | 50 | 12044 | 10170 | 7601 | 445 | 425 | −503 | O |
| ATOM | 4131 | N | HIS | B | 51 | 16.771 | 9.187 | 6.143 | 1.00 | 58.16 | N |
| ANISOU | 4131 | N | HIS | B | 51 | 9337 | 7590 | 5172 | 398 | −594 | −565 | N |
| ATOM | 4132 | CA | HIS | B | 51 | 15.832 | 10.104 | 6.769 | 1.00 | 54.91 | C |
| ANISOU | 4132 | CA | HIS | B | 51 | 8812 | 7167 | 4885 | 389 | −751 | −515 | C |
| ATOM | 4133 | C | HIS | B | 51 | 16.431 | 10.692 | 8.038 | 1.00 | 56.51 | C |
| ANISOU | 4133 | C | HIS | B | 51 | 8819 | 7358 | 5294 | 363 | −646 | −463 | C |
| ATOM | 4134 | O | HIS | B | 51 | 17.361 | 10.138 | 8.635 | 1.00 | 51.57 | O |
| ANISOU | 4134 | O | HIS | B | 51 | 8108 | 6736 | 4749 | 348 | −496 | −489 | O |
| ATOM | 4135 | CB | HIS | B | 51 | 14.485 | 9.426 | 7.062 | 1.00 | 54.11 | C |
| ANISOU | 4135 | CB | HIS | B | 51 | 8646 | 7064 | 4848 | 380 | −961 | −611 | C |
| ATOM | 4136 | CG | HIS | B | 51 | 14.575 | 8.266 | 8.004 | 1.00 | 56.44 | C |
| ANISOU | 4136 | CG | HIS | B | 51 | 8801 | 7358 | 5286 | 355 | −920 | −711 | C |
| ATOM | 4137 | ND1 | HIS | B | 51 | 14.539 | 8.414 | 9.374 | 1.00 | 58.06 | N |
| ANISOU | 4137 | ND1 | HIS | B | 51 | 8800 | 7555 | 5707 | 331 | −899 | −705 | N |
| ATOM | 4138 | CD2 | HIS | B | 51 | 14.686 | 6.937 | 7.772 | 1.00 | 55.84 | C |
| ANISOU | 4138 | CD2 | HIS | B | 51 | 8771 | 7281 | 5164 | 350 | −897 | −819 | C |
| ATOM | 4139 | CE1 | HIS | B | 51 | 14.624 | 7.226 | 9.946 | 1.00 | 59.69 | C |
| ANISOU | 4139 | CE1 | HIS | B | 51 | 8930 | 7757 | 5991 | 314 | −866 | −797 | C |
| ATOM | 4140 | NE2 | HIS | B | 51 | 14.714 | 6.313 | 8.995 | 1.00 | 56.55 | N |
| ANISOU | 4140 | NE2 | HIS | B | 51 | 8680 | 7362 | 5446 | 324 | −863 | −867 | N |
| ATOM | 4141 | N | SER | B | 52 | 15.888 | 11.845 | 8.430 | 1.00 | 55.03 | N |
| ANISOU | 4141 | N | SER | B | 52 | 8567 | 7153 | 5189 | 362 | −734 | −388 | N |
| ATOM | 4142 | CA | SER | B | 52 | 16.296 | 12.522 | 9.648 | 1.00 | 47.80 | C |
| ANISOU | 4142 | CA | SER | B | 52 | 7478 | 6220 | 4465 | 337 | −665 | −343 | C |
| ATOM | 4143 | C | SER | B | 52 | 15.765 | 11.782 | 10.875 | 1.00 | 43.04 | C |
| ANISOU | 4143 | C | SER | B | 52 | 6700 | 5619 | 4036 | 317 | −724 | −431 | C |
| ATOM | 4144 | O | SER | B | 52 | 14.914 | 10.893 | 10.786 | 1.00 | 45.62 | O |
| ANISOU | 4144 | O | SER | B | 52 | 7026 | 5955 | 4352 | 321 | −837 | −517 | O |
| ATOM | 4145 | CB | SER | B | 52 | 15.786 | 13.966 | 9.646 | 1.00 | 49.57 | C |
| ANISOU | 4145 | CB | SER | B | 52 | 7703 | 6414 | 4720 | 347 | −747 | −243 | C |
| ATOM | 4146 | OG | SER | B | 52 | 14.364 | 13.991 | 9.644 | 1.00 | 46.86 | O |
| ANISOU | 4146 | OG | SER | B | 52 | 7340 | 6065 | 4399 | 367 | −953 | −275 | O |
| ATOM | 4147 | N | ASP | B | 53 | 16.261 | 12.177 | 12.044 | 1.00 | 37.86 | N |
| ANISOU | 4147 | N | ASP | B | 53 | 5895 | 4951 | 3541 | 293 | −648 | −408 | N |
| ATOM | 4148 | CA | ASP | B | 53 | 15.791 | 11.605 | 13.296 | 1.00 | 36.16 | C |
| ANISOU | 4148 | CA | ASP | B | 53 | 5517 | 4735 | 3487 | 276 | −691 | −477 | C |
| ATOM | 4149 | C | ASP | B | 53 | 14.441 | 12.192 | 13.675 | 1.00 | 42.32 | C |
| ANISOU | 4149 | C | ASP | B | 53 | 6237 | 5497 | 4346 | 285 | −855 | −474 | C |
| ATOM | 4150 | O | ASP | B | 53 | 14.232 | 13.404 | 13.603 | 1.00 | 40.51 | O |
| ANISOU | 4150 | O | ASP | B | 53 | 6018 | 5243 | 4129 | 296 | −890 | −397 | O |
| ATOM | 4151 | CB | ASP | B | 53 | 16.799 | 11.860 | 14.413 | 1.00 | 36.89 | C |
| ANISOU | 4151 | CB | ASP | B | 53 | 5486 | 4821 | 3710 | 248 | −562 | −452 | C |
| ATOM | 4152 | CG | ASP | B | 53 | 18.172 | 11.326 | 14.069 | 1.00 | 45.86 | C |
| ANISOU | 4152 | CG | ASP | B | 53 | 6659 | 5972 | 4792 | 242 | −395 | −446 | C |
| ATOM | 4153 | OD1 | ASP | B | 53 | 18.252 | 10.141 | 13.664 | 1.00 | 47.61 | O |
| ANISOU | 4153 | OD1 | ASP | B | 53 | 6927 | 6212 | 4951 | 253 | −373 | −516 | O |
| ATOM | 4154 | OD2 | ASP | B | 53 | 19.153 | 12.090 | 14.156 | 1.00 | 45.44 | O |
| ANISOU | 4154 | OD2 | ASP | B | 53 | 6591 | 5909 | 4764 | 227 | −285 | −373 | O |
| ATOM | 4155 | N | LEU | B | 54 | 13.533 | 11.319 | 14.105 | 1.00 | 42.08 | N |
| ANISOU | 4155 | N | LEU | B | 54 | 6135 | 5472 | 4382 | 282 | −949 | −557 | N |
| ATOM | 4156 | CA | LEU | B | 54 | 12.179 | 11.732 | 14.440 | 1.00 | 40.58 | C |
| ANISOU | 4156 | CA | LEU | B | 54 | 5874 | 5265 | 4280 | 293 | −1103 | −563 | C |
| ATOM | 4157 | C | LEU | B | 54 | 12.188 | 12.875 | 15.440 | 1.00 | 38.54 | C |
| ANISOU | 4157 | C | LEU | B | 54 | 5512 | 4979 | 4153 | 293 | −1076 | −505 | C |
| ATOM | 4158 | O | LEU | B | 54 | 12.808 | 12.785 | 16.500 | 1.00 | 32.33 | O |
| ANISOU | 4158 | O | LEU | B | 54 | 4631 | 4189 | 3462 | 269 | −977 | −516 | O |
| ATOM | 4159 | CB | LEU | B | 54 | 11.395 | 10.550 | 15.019 | 1.00 | 35.73 | C |
| ANISOU | 4159 | CB | LEU | B | 54 | 5165 | 4656 | 3755 | 278 | −1166 | −660 | C |
| ATOM | 4160 | CG | LEU | B | 54 | 9.924 | 10.857 | 15.306 | 1.00 | 40.64 | C |
| ANISOU | 4160 | CG | LEU | B | 54 | 5701 | 5261 | 4481 | 290 | −1323 | −671 | C |
| ATOM | 4161 | CD1 | LEU | B | 54 | 9.145 | 11.031 | 13.980 | 1.00 | 37.82 | C |
| ANISOU | 4161 | CD1 | LEU | B | 54 | 5458 | 4906 | 4005 | 315 | −1479 | −660 | C |
| ATOM | 4162 | CD2 | LEU | B | 54 | 9.301 | 9.774 | 16.178 | 1.00 | 40.10 | C |
| ANISOU | 4162 | CD2 | LEU | B | 54 | 5508 | 5191 | 4539 | 265 | −1342 | −755 | C |
| ATOM | 4163 | N | SER | B | 55 | 11.477 | 13.950 | 15.102 | 1.00 | 38.91 | N |
| ANISOU | 4163 | N | SER | B | 55 | 5582 | 5001 | 4203 | 320 | −1173 | −446 | N |
| ATOM | 4164 | CA | SER | B | 55 | 11.298 | 15.075 | 16.005 | 1.00 | 40.99 | C |
| ANISOU | 4164 | CA | SER | B | 55 | 5755 | 5226 | 4595 | 326 | −1165 | −399 | C |
| ATOM | 4165 | C | SER | B | 55 | 9.874 | 15.586 | 15.838 | 1.00 | 35.84 | C |
| ANISOU | 4165 | C | SER | B | 55 | 5072 | 4550 | 3996 | 364 | −1326 | −388 | C |
| ATOM | 4166 | O | SER | B | 55 | 9.114 | 15.085 | 15.008 | 1.00 | 38.05 | O |
| ANISOU | 4166 | O | SER | B | 55 | 5400 | 4847 | 4211 | 381 | −1447 | −413 | O |
| ATOM | 4167 | CB | SER | B | 55 | 12.337 | 16.167 | 15.738 | 1.00 | 44.75 | C |
| ANISOU | 4167 | CB | SER | B | 55 | 6302 | 5678 | 5023 | 322 | −1067 | −308 | C |

TABLE 11-continued

| | | | | | | | | | | | | |
|---|---|---|---|---|---|---|---|---|---|---|---|---|
| ATOM | 4168 | OG | SER | B | 55 | 12.350 | 17.089 | 16.812 | 1.00 | 55.68 | | O |
| ANISOU | 4168 | OG | SER | B | 55 | 7592 | 7022 | 6544 | 316 | −1037 | −283 | O |
| ATOM | 4169 | N | PHE | B | 56 | 9.494 | 16.585 | 16.638 | 1.00 | 37.74 | | N |
| ANISOU | 4169 | N | PHE | B | 56 | 5229 | 4749 | 4362 | 380 | −1332 | −354 | N |
| ATOM | 4170 | CA | PHE | B | 56 | 8.120 | 17.054 | 16.583 | 1.00 | 40.71 | | C |
| ANISOU | 4170 | CA | PHE | B | 56 | 5552 | 5098 | 4817 | 423 | −1476 | −345 | C |
| ATOM | 4171 | C | PHE | B | 56 | 8.048 | 18.550 | 16.866 | 1.00 | 39.81 | | C |
| ANISOU | 4171 | C | PHE | B | 56 | 5432 | 4925 | 4771 | 453 | −1470 | −267 | C |
| ATOM | 4172 | O | PHE | B | 56 | 8.934 | 19.138 | 17.496 | 1.00 | 36.76 | | O |
| ANISOU | 4172 | O | PHE | B | 56 | 5040 | 4513 | 4413 | 431 | −1351 | −242 | O |
| ATOM | 4173 | CB | PHE | B | 56 | 7.210 | 16.275 | 17.549 | 1.00 | 34.29 | | C |
| ANISOU | 4173 | CB | PHE | B | 56 | 4589 | 4293 | 4147 | 416 | −1509 | −428 | C |
| ATOM | 4174 | CG | PHE | B | 56 | 7.741 | 16.158 | 18.957 | 1.00 | 35.33 | | C |
| ANISOU | 4174 | CG | PHE | B | 56 | 4625 | 4418 | 4382 | 387 | −1376 | −462 | C |
| ATOM | 4175 | CD1 | PHE | B | 56 | 7.519 | 17.170 | 19.894 | 1.00 | 36.50 | | C |
| ANISOU | 4175 | CD1 | PHE | B | 56 | 4702 | 4519 | 4647 | 405 | −1344 | −438 | C |
| ATOM | 4176 | CD2 | PHE | B | 56 | 8.430 | 15.020 | 19.359 | 1.00 | 35.25 | | C |
| ANISOU | 4176 | CD2 | PHE | B | 56 | 4600 | 4444 | 4348 | 344 | −1290 | −521 | C |
| ATOM | 4177 | CE1 | PHE | B | 56 | 7.994 | 17.050 | 21.197 | 1.00 | 37.48 | | C |
| ANISOU | 4177 | CE1 | PHE | B | 56 | 4753 | 4638 | 4849 | 378 | −1232 | −474 | C |
| ATOM | 4178 | CE2 | PHE | B | 56 | 8.914 | 14.893 | 20.673 | 1.00 | 35.88 | | C |
| ANISOU | 4178 | CE2 | PHE | B | 56 | 4600 | 4520 | 4515 | 319 | −1180 | −549 | C |
| ATOM | 4179 | CZ | PHE | B | 56 | 8.699 | 15.906 | 21.586 | 1.00 | 38.11 | | C |
| ANISOU | 4179 | CZ | PHE | B | 56 | 4822 | 4761 | 4899 | 334 | −1154 | −526 | C |
| ATOM | 4180 | N | SER | B | 57 | 6.964 | 19.150 | 16.386 | 1.00 | 43.85 | | N |
| ANISOU | 4180 | N | SER | B | 57 | 5941 | 5408 | 5312 | 504 | −1608 | −229 | N |
| ATOM | 4181 | CA | SER | B | 57 | 6.737 | 20.584 | 16.492 | 1.00 | 43.86 | | C |
| ANISOU | 4181 | CA | SER | B | 57 | 5946 | 5342 | 5377 | 546 | −1624 | −150 | C |
| ATOM | 4182 | C | SER | B | 57 | 6.064 | 20.925 | 17.821 | 1.00 | 50.22 | | C |
| ANISOU | 4182 | C | SER | B | 57 | 6598 | 6109 | 6376 | 562 | −1604 | −187 | C |
| ATOM | 4183 | O | SER | B | 57 | 5.803 | 20.059 | 18.662 | 1.00 | 43.16 | | O |
| ANISOU | 4183 | O | SER | B | 57 | 5598 | 5242 | 5558 | 539 | −1572 | −269 | O |
| ATOM | 4184 | CB | SER | B | 57 | 5.898 | 21.067 | 15.312 | 1.00 | 42.48 | | C |
| ANISOU | 4184 | CB | SER | B | 57 | 5845 | 5152 | 5142 | 602 | −1787 | −84 | C |
| ATOM | 4185 | OG | SER | B | 57 | 6.445 | 20.596 | 14.097 | 1.00 | 47.50 | | O |
| ANISOU | 4185 | OG | SER | B | 57 | 6634 | 5830 | 5584 | 587 | −1806 | −62 | O |
| ATOM | 4186 | N | LYS | B | 58 | 5.773 | 22.216 | 18.005 | 1.00 | 53.62 | | N |
| ANISOU | 4186 | N | LYS | B | 58 | 7023 | 6467 | 6882 | 605 | −1617 | −125 | N |
| ATOM | 4187 | CA | LYS | B | 58 | 5.166 | 22.679 | 19.251 | 1.00 | 50.85 | | C |
| ANISOU | 4187 | CA | LYS | B | 58 | 6544 | 6069 | 6708 | 628 | −1583 | −159 | C |
| ATOM | 4188 | C | LYS | B | 58 | 3.830 | 21.995 | 19.512 | 1.00 | 41.17 | | C |
| ANISOU | 4188 | C | LYS | B | 58 | 5188 | 4863 | 5591 | 658 | −1676 | −216 | C |
| ATOM | 4189 | O | LYS | B | 58 | 3.488 | 21.711 | 20.663 | 1.00 | 45.90 | | O |
| ANISOU | 4189 | O | LYS | B | 58 | 5672 | 5458 | 6311 | 651 | −1612 | −279 | O |
| ATOM | 4190 | CB | LYS | B | 58 | 4.987 | 24.203 | 19.217 | 1.00 | 49.55 | | C |
| ANISOU | 4190 | CB | LYS | B | 58 | 6410 | 5813 | 6602 | 679 | −1597 | −79 | C |
| ATOM | 4191 | CG | LYS | B | 58 | 6.296 | 24.983 | 19.111 | 0.40 | 53.68 | | C |
| ANISOU | 4191 | CG | LYS | B | 58 | 7045 | 6301 | 7050 | 642 | −1493 | −22 | C |
| ATOM | 4192 | CD | LYS | B | 58 | 6.077 | 26.458 | 19.421 | 0.80 | 58.37 | | C |
| ANISOU | 4192 | CD | LYS | B | 58 | 7646 | 6790 | 7743 | 686 | −1486 | 36 | C |
| ATOM | 4193 | CE | LYS | B | 58 | 7.222 | 27.332 | 18.935 | 0.00 | 62.45 | | C |
| ANISOU | 4193 | CE | LYS | B | 58 | 8290 | 7259 | 8178 | 655 | −1418 | 119 | C |
| ATOM | 4194 | NZ | LYS | B | 58 | 6.905 | 28.783 | 19.106 | 1.00 | 68.16 | | N |
| ANISOU | 4194 | NZ | LYS | B | 58 | 9031 | 7868 | 9000 | 704 | −1428 | 182 | N |
| ATOM | 4195 | N | ASP | B | 59 | 3.062 | 21.722 | 18.462 | 1.00 | 44.09 | | N |
| ANISOU | 4195 | N | ASP | B | 59 | 5576 | 5254 | 5922 | 688 | −1828 | −194 | N |
| ATOM | 4196 | CA | ASP | B | 59 | 1.774 | 21.064 | 18.617 | 1.00 | 43.67 | | C |
| ANISOU | 4196 | CA | ASP | B | 59 | 5390 | 5218 | 5986 | 711 | −1930 | −245 | C |
| ATOM | 4197 | C | ASP | B | 59 | 1.887 | 19.546 | 18.760 | 1.00 | 44.79 | | C |
| ANISOU | 4197 | C | ASP | B | 59 | 5496 | 5428 | 6094 | 650 | −1911 | −333 | C |
| ATOM | 4198 | O | ASP | B | 59 | 0.862 | 18.859 | 18.658 | 1.00 | 51.26 | | O |
| ANISOU | 4198 | O | ASP | B | 59 | 6220 | 6266 | 6992 | 656 | −2012 | −374 | O |
| ATOM | 4199 | CB | ASP | B | 59 | 0.851 | 21.419 | 17.442 | 1.00 | 49.69 | | C |
| ANISOU | 4199 | CB | ASP | B | 59 | 6177 | 5969 | 6732 | 768 | −2124 | −186 | C |
| ATOM | 4200 | CG | ASP | B | 59 | 1.337 | 20.870 | 16.097 | 1.00 | 55.47 | | C |
| ANISOU | 4200 | CG | ASP | B | 59 | 7065 | 6754 | 7258 | 743 | −2206 | −166 | C |
| ATOM | 4201 | OD1 | ASP | B | 59 | 2.380 | 20.186 | 16.030 | 1.00 | 48.62 | | O |
| ANISOU | 4201 | OD1 | ASP | B | 59 | 6279 | 5929 | 6265 | 683 | −2106 | −199 | O |
| ATOM | 4202 | OD2 | ASP | B | 59 | 0.649 | 21.123 | 15.085 | 1.00 | 54.42 | | O |
| ANISOU | 4202 | OD2 | ASP | B | 59 | 6975 | 6617 | 7087 | 787 | −2375 | −117 | O |
| ATOM | 4203 | N | TRP | B | 60 | 3.096 | 19.021 | 18.959 | 1.00 | 48.42 | | N |
| ANISOU | 4203 | N | TRP | B | 60 | 6028 | 5922 | 6448 | 591 | −1788 | −359 | N |
| ATOM | 4204 | CA | TRP | B | 60 | 3.416 | 17.601 | 19.148 | 1.00 | 48.68 | | C |
| ANISOU | 4204 | CA | TRP | B | 60 | 6044 | 6012 | 6442 | 534 | −1745 | −438 | C |
| ATOM | 4205 | C | TRP | B | 60 | 3.355 | 16.767 | 17.865 | 1.00 | 47.39 | | C |
| ANISOU | 4205 | C | TRP | B | 60 | 5970 | 5893 | 6144 | 519 | −1856 | −450 | C |
| ATOM | 4206 | O | TRP | B | 60 | 3.655 | 15.576 | 17.919 | 1.00 | 45.92 | | O |
| ANISOU | 4206 | O | TRP | B | 60 | 5784 | 5746 | 5918 | 472 | −1823 | −516 | O |
| ATOM | 4207 | CB | TRP | B | 60 | 2.519 | 16.924 | 20.199 | 1.00 | 43.71 | | C |
| ANISOU | 4207 | CB | TRP | B | 60 | 5250 | 5382 | 5977 | 527 | −1730 | −507 | C |

TABLE 11-continued

| | | | | | | | | | | | |
|---|---|---|---|---|---|---|---|---|---|---|---|
| ATOM | 4208 | CG | TRP | B | 60 | 2.533 | 17.601 | 21.533 | 1.00 | 46.78 | C |
| ANISOU | 4208 | CG | TRP | B | 60 | 5559 | 5730 | 6488 | 541 | −1612 | −510 | C |
| ATOM | 4209 | CD1 | TRP | B | 60 | 1.553 | 18.399 | 22.067 | 1.00 | 47.32 | C |
| ANISOU | 4209 | CD1 | TRP | B | 60 | 5526 | 5746 | 6706 | 595 | −1633 | −494 | C |
| ATOM | 4210 | CD2 | TRP | B | 60 | 3.586 | 17.555 | 22.502 | 1.00 | 41.89 | C |
| ANISOU | 4210 | CD2 | TRP | B | 60 | 4959 | 5113 | 5845 | 503 | −1456 | −531 | C |
| ATOM | 4211 | NE1 | TRP | B | 60 | 1.936 | 18.835 | 23.319 | 1.00 | 49.04 | N |
| ANISOU | 4211 | NE1 | TRP | B | 60 | 5713 | 5935 | 6985 | 592 | −1493 | −511 | N |
| ATOM | 4212 | CE2 | TRP | B | 60 | 3.179 | 18.333 | 23.605 | 1.00 | 43.91 | C |
| ANISOU | 4212 | CE2 | TRP | B | 60 | 5137 | 5319 | 6229 | 534 | −1392 | −533 | C |
| ATOM | 4213 | CE3 | TRP | B | 60 | 4.826 | 16.922 | 22.548 | 1.00 | 36.83 | C |
| ANISOU | 4213 | CE3 | TRP | B | 60 | 4392 | 4510 | 5092 | 450 | −1368 | −549 | C |
| ATOM | 4214 | CZ2 | TRP | B | 60 | 3.977 | 18.495 | 24.738 | 1.00 | 39.52 | C |
| ANISOU | 4214 | CZ2 | TRP | B | 60 | 4587 | 4752 | 5676 | 507 | −1255 | −555 | C |
| ATOM | 4215 | CZ3 | TRP | B | 60 | 5.613 | 17.081 | 23.674 | 1.00 | 38.59 | C |
| ANISOU | 4215 | CZ3 | TRP | B | 60 | 4604 | 4723 | 5334 | 425 | −1237 | −565 | C |
| ATOM | 4216 | CH2 | TRP | B | 60 | 5.183 | 17.862 | 24.753 | 1.00 | 41.30 | C |
| ANISOU | 4216 | CH2 | TRP | B | 60 | 4881 | 5019 | 5792 | 452 | −1188 | −569 | C |
| ATOM | 4217 | N | SER | B | 61 | 3.000 | 17.341 | 16.721 | 1.00 | 40.70 | N |
| ANISOU | 4217 | N | SER | B | 61 | 5208 | 5037 | 5219 | 557 | −1987 | −390 | N |
| ATOM | 4218 | CA | SER | B | 61 | 2.986 | 16.566 | 15.485 | 1.00 | 45.88 | C |
| ANISOU | 4218 | CA | SER | B | 61 | 5973 | 5734 | 5725 | 543 | −2095 | −407 | C |
| ATOM | 4219 | C | SER | B | 61 | 4.407 | 16.337 | 14.974 | 1.00 | 43.21 | C |
| ANISOU | 4219 | C | SER | B | 61 | 5794 | 5424 | 5201 | 509 | −1979 | −395 | C |
| ATOM | 4220 | O | SER | B | 61 | 5.308 | 17.142 | 15.211 | 1.00 | 42.95 | O |
| ANISOU | 4220 | O | SER | B | 61 | 5809 | 5370 | 5139 | 510 | −1862 | −339 | O |
| ATOM | 4221 | CB | SER | B | 61 | 2.151 | 17.269 | 14.418 | 1.00 | 40.15 | C |
| ANISOU | 4221 | CB | SER | B | 61 | 5302 | 4991 | 4963 | 599 | −2281 | −342 | C |
| ATOM | 4222 | OG | SER | B | 61 | 2.741 | 18.499 | 14.013 | 1.00 | 43.96 | O |
| ANISOU | 4222 | OG | SER | B | 61 | 5897 | 5441 | 5366 | 634 | −2246 | −241 | O |
| ATOM | 4223 | N | PHE | B | 62 | 4.603 | 15.228 | 14.261 | 1.00 | 40.65 | N |
| ANISOU | 4223 | N | PHE | B | 62 | 5547 | 5141 | 4756 | 478 | −2011 | −450 | N |
| ATOM | 4224 | CA | PHE | B | 62 | 5.953 | 14.798 | 13.911 | 1.00 | 37.83 | C |
| ANISOU | 4224 | CA | PHE | B | 62 | 5316 | 4811 | 4245 | 445 | −1877 | −455 | C |
| ATOM | 4225 | C | PHE | B | 62 | 6.376 | 15.357 | 12.558 | 1.00 | 42.50 | C |
| ANISOU | 4225 | C | PHE | B | 62 | 6099 | 5407 | 4642 | 470 | −1917 | −382 | C |
| ATOM | 4226 | O | PHE | B | 62 | 5.552 | 15.757 | 11.736 | 1.00 | 42.56 | O |
| ANISOU | 4226 | O | PHE | B | 62 | 6158 | 5406 | 4604 | 508 | −2079 | −346 | O |
| ATOM | 4227 | CB | PHE | B | 62 | 6.049 | 13.268 | 13.889 | 1.00 | 38.32 | C |
| ANISOU | 4227 | CB | PHE | B | 62 | 5373 | 4909 | 4277 | 402 | −1865 | −557 | C |
| ATOM | 4228 | CG | PHE | B | 62 | 5.828 | 12.634 | 15.227 | 1.00 | 33.40 | C |
| ANISOU | 4228 | CG | PHE | B | 62 | 4583 | 4282 | 3827 | 373 | −1796 | −621 | C |
| ATOM | 4229 | CD1 | PHE | B | 62 | 6.833 | 12.613 | 16.163 | 1.00 | 33.47 | C |
| ANISOU | 4229 | CD1 | PHE | B | 62 | 4556 | 4290 | 3870 | 350 | −1623 | −622 | C |
| ATOM | 4230 | CD2 | PHE | B | 62 | 4.595 | 12.078 | 15.551 | 1.00 | 41.89 | C |
| ANISOU | 4230 | CD2 | PHE | B | 62 | 5535 | 5349 | 5032 | 368 | −1908 | −677 | C |
| ATOM | 4231 | CE1 | PHE | B | 62 | 6.635 | 12.039 | 17.427 | 1.00 | 37.47 | C |
| ANISOU | 4231 | CE1 | PHE | B | 62 | 4922 | 4792 | 4521 | 325 | −1559 | −674 | C |
| ATOM | 4232 | CE2 | PHE | B | 62 | 4.384 | 11.506 | 16.798 | 1.00 | 41.68 | C |
| ANISOU | 4232 | CE2 | PHE | B | 62 | 5363 | 5316 | 5160 | 341 | −1831 | −728 | C |
| ATOM | 4233 | CZ | PHE | B | 62 | 5.405 | 11.485 | 17.737 | 1.00 | 38.37 | C |
| ANISOU | 4233 | CZ | PHE | B | 62 | 4925 | 4898 | 4756 | 322 | −1657 | −726 | C |
| ATOM | 4234 | N | TYR | B | 63 | 7.687 | 15.368 | 12.326 | 1.00 | 44.61 | N |
| ANISOU | 4234 | N | TYR | B | 63 | 6470 | 5687 | 4792 | 450 | −1764 | −357 | N |
| ATOM | 4235 | CA | TYR | B | 63 | 8.194 | 15.679 | 10.998 | 1.00 | 46.92 | C |
| ANISOU | 4235 | CA | TYR | B | 63 | 6962 | 5989 | 4878 | 467 | −1772 | −295 | C |
| ATOM | 4236 | C | TYR | B | 63 | 9.470 | 14.885 | 10.740 | 1.00 | 41.31 | C |
| ANISOU | 4236 | C | TYR | B | 63 | 6339 | 5309 | 4046 | 432 | −1610 | −328 | C |
| ATOM | 4237 | O | TYR | B | 63 | 10.270 | 14.648 | 11.646 | 1.00 | 40.78 | O |
| ANISOU | 4237 | O | TYR | B | 63 | 6186 | 5244 | 4063 | 401 | −1460 | −351 | O |
| ATOM | 4238 | CB | TYR | B | 63 | 8.437 | 17.193 | 10.820 | 1.00 | 42.16 | C |
| ANISOU | 4238 | CB | TYR | B | 63 | 6409 | 5342 | 4267 | 499 | −1750 | −172 | C |
| ATOM | 4239 | CG | TYR | B | 63 | 9.410 | 17.797 | 11.790 | 1.00 | 39.41 | C |
| ANISOU | 4239 | CG | TYR | B | 63 | 5990 | 4968 | 4016 | 473 | −1572 | −139 | C |
| ATOM | 4240 | CD1 | TYR | B | 63 | 10.773 | 17.756 | 11.549 | 1.00 | 40.80 | C |
| ANISOU | 4240 | CD1 | TYR | B | 63 | 6251 | 5155 | 4095 | 444 | −1404 | −111 | C |
| ATOM | 4241 | CD2 | TYR | B | 63 | 8.970 | 18.433 | 12.946 | 1.00 | 42.66 | C |
| ANISOU | 4241 | CD2 | TYR | B | 63 | 6250 | 5341 | 4618 | 479 | −1572 | −136 | C |
| ATOM | 4242 | CE1 | TYR | B | 63 | 11.675 | 18.305 | 12.431 | 1.00 | 45.16 | C |
| ANISOU | 4242 | CE1 | TYR | B | 63 | 6732 | 5683 | 4745 | 414 | −1256 | −83 | C |
| ATOM | 4243 | CE2 | TYR | B | 63 | 9.874 | 18.997 | 13.840 | 1.00 | 40.52 | C |
| ANISOU | 4243 | CE2 | TYR | B | 63 | 5925 | 5043 | 4429 | 451 | −1422 | −113 | C |
| ATOM | 4244 | CZ | TYR | B | 63 | 11.221 | 18.926 | 13.572 | 1.00 | 45.34 | C |
| ANISOU | 4244 | CZ | TYR | B | 63 | 6614 | 5666 | 4946 | 416 | −1273 | −86 | C |
| ATOM | 4245 | OH | TYR | B | 63 | 12.127 | 19.477 | 14.439 | 1.00 | 43.75 | O |
| ANISOU | 4245 | OH | TYR | B | 63 | 6352 | 5437 | 4833 | 383 | −1139 | −64 | O |
| ATOM | 4246 | N | LEU | B | 64 | 9.644 | 14.481 | 9.488 | 1.00 | 45.38 | N |
| ANISOU | 4246 | N | LEU | B | 64 | 7032 | 5848 | 4363 | 442 | −1644 | −331 | N |
| ATOM | 4247 | CA | LEU | B | 64 | 10.796 | 13.711 | 9.051 | 1.00 | 46.50 | C |
| ANISOU | 4247 | CA | LEU | B | 64 | 7279 | 6017 | 4373 | 420 | −1492 | −362 | C |

TABLE 11-continued

| | | | | | | | | | | | | |
|---|---|---|---|---|---|---|---|---|---|---|---|---|
| ATOM | 4248 | C | LEU | B | 64 | 11.231 | 14.233 | 7.693 | 1.00 | 47.96 | | C |
| ANISOU | 4248 | C | LEU | B | 64 | 7682 | 6204 | 4336 | 447 | −1480 | −284 | C |
| ATOM | 4249 | O | LEU | B | 64 | 10.391 | 14.595 | 6.863 | 1.00 | 47.79 | | O |
| ANISOU | 4249 | O | LEU | B | 64 | 7758 | 6180 | 4221 | 480 | −1647 | −253 | O |
| ATOM | 4250 | CB | LEU | B | 64 | 10.474 | 12.208 | 8.938 | 1.00 | 48.61 | | C |
| ANISOU | 4250 | CB | LEU | B | 64 | 7545 | 6310 | 4615 | 400 | −1540 | −489 | C |
| ATOM | 4251 | CG | LEU | B | 64 | 10.278 | 11.413 | 10.234 | 1.00 | 47.34 | | C |
| ANISOU | 4251 | CG | LEU | B | 64 | 7191 | 6148 | 4649 | 366 | −1510 | −572 | C |
| ATOM | 4252 | CD1 | LEU | B | 64 | 9.702 | 10.037 | 9.936 | 1.00 | 44.34 | | C |
| ANISOU | 4252 | CD1 | LEU | B | 64 | 6826 | 5780 | 4241 | 349 | −1600 | −688 | C |
| ATOM | 4253 | CD2 | LEU | B | 64 | 11.595 | 11.283 | 10.960 | 1.00 | 42.61 | | C |
| ANISOU | 4253 | CD2 | LEU | B | 64 | 6542 | 5552 | 4096 | 344 | −1295 | −564 | C |
| ATOM | 4254 | N | LEU | B | 65 | 12.535 | 14.271 | 7.464 | 1.00 | 50.08 | | N |
| ANISOU | 4254 | N | LEU | B | 65 | 8028 | 6479 | 4522 | 435 | −1284 | −248 | N |
| ATOM | 4255 | CA | LEU | B | 65 | 13.073 | 14.592 | 6.148 | 1.00 | 47.10 | | C |
| ANISOU | 4255 | CA | LEU | B | 65 | 7872 | 6107 | 3917 | 458 | −1235 | −181 | C |
| ATOM | 4256 | C | LEU | B | 65 | 13.645 | 13.318 | 5.549 | 1.00 | 47.14 | | C |
| ANISOU | 4256 | C | LEU | B | 65 | 7986 | 6145 | 3781 | 450 | −1151 | −270 | C |
| ATOM | 4257 | O | LEU | B | 65 | 14.573 | 12.732 | 6.116 | 1.00 | 47.49 | | O |
| ANISOU | 4257 | O | LEU | B | 65 | 7956 | 6197 | 3892 | 424 | −981 | −309 | O |
| ATOM | 4258 | CB | LEU | B | 65 | 14.147 | 15.674 | 6.232 | 1.00 | 44.83 | | C |
| ANISOU | 4258 | CB | LEU | B | 65 | 7599 | 5793 | 3641 | 451 | −1058 | −62 | C |
| ATOM | 4259 | CG | LEU | B | 65 | 14.778 | 16.045 | 4.888 | 1.00 | 49.35 | | C |
| ANISOU | 4259 | CG | LEU | B | 65 | 8404 | 6367 | 3979 | 473 | −977 | 22 | C |
| ATOM | 4260 | CD1 | LEU | B | 65 | 13.736 | 16.643 | 3.942 | 1.00 | 46.23 | | C |
| ANISOU | 4260 | CD1 | LEU | B | 65 | 8153 | 5962 | 3450 | 518 | −1178 | 79 | C |
| ATOM | 4261 | CD2 | LEU | B | 65 | 15.945 | 17.003 | 5.070 | 1.00 | 50.84 | | C |
| ANISOU | 4261 | CD2 | LEU | B | 65 | 8582 | 6525 | 4210 | 454 | −777 | 133 | C |
| ATOM | 4262 | N | TYR | B | 66 | 13.075 | 12.881 | 4.429 | 1.00 | 48.84 | | N |
| ANISOU | 4262 | N | TYR | B | 66 | 8376 | 6376 | 3806 | 473 | −1276 | −304 | N |
| ATOM | 4263 | CA | TYR | B | 66 | 13.635 | 11.808 | 3.621 | 1.00 | 54.06 | | C |
| ANISOU | 4263 | CA | TYR | B | 66 | 9193 | 7059 | 4287 | 475 | −1194 | −380 | C |
| ATOM | 4264 | C | TYR | B | 66 | 14.385 | 12.419 | 2.444 | 1.00 | 60.88 | | C |
| ANISOU | 4264 | C | TYR | B | 66 | 10284 | 7925 | 4922 | 503 | −1083 | −284 | C |
| ATOM | 4265 | O | TYR | B | 66 | 13.899 | 13.359 | 1.810 | 1.00 | 67.04 | | O |
| ANISOU | 4265 | O | TYR | B | 66 | 11170 | 8695 | 5607 | 530 | −1190 | −191 | O |
| ATOM | 4266 | CB | TYR | B | 66 | 12.537 | 10.864 | 3.120 | 1.00 | 57.47 | | C |
| ANISOU | 4266 | CB | TYR | B | 66 | 9689 | 7503 | 4644 | 478 | −1405 | −493 | C |
| ATOM | 4267 | CG | TYR | B | 66 | 11.988 | 9.982 | 4.207 | 1.00 | 54.41 | | C |
| ANISOU | 4267 | CG | TYR | B | 66 | 9095 | 7113 | 4468 | 444 | −1466 | −601 | C |
| ATOM | 4268 | CD1 | TYR | B | 66 | 11.149 | 10.495 | 5.182 | 1.00 | 52.64 | | C |
| ANISOU | 4268 | CD1 | TYR | B | 66 | 8671 | 6874 | 4455 | 434 | −1580 | −580 | C |
| ATOM | 4269 | CD2 | TYR | B | 66 | 12.319 | 8.636 | 4.266 | 1.00 | 57.20 | | C |
| ANISOU | 4269 | CD2 | TYR | B | 66 | 9455 | 7470 | 4808 | 423 | −1400 | −721 | C |
| ATOM | 4270 | CE1 | TYR | B | 66 | 10.658 | 9.699 | 6.190 | 1.00 | 53.86 | | C |
| ANISOU | 4270 | CE1 | TYR | B | 66 | 8642 | 7023 | 4799 | 402 | −1619 | −671 | C |
| ATOM | 4271 | CE2 | TYR | B | 66 | 11.826 | 7.826 | 5.263 | 1.00 | 57.23 | | C |
| ANISOU | 4271 | CE2 | TYR | B | 66 | 9276 | 7464 | 5004 | 391 | −1448 | −811 | C |
| ATOM | 4272 | CZ | TYR | B | 66 | 10.994 | 8.361 | 6.223 | 1.00 | 54.28 | | C |
| ANISOU | 4272 | CZ | TYR | B | 66 | 8709 | 7081 | 4835 | 379 | −1555 | −784 | C |
| ATOM | 4273 | OH | TYR | B | 66 | 10.502 | 7.559 | 7.225 | 1.00 | 52.28 | | O |
| ANISOU | 4273 | OH | TYR | B | 66 | 8279 | 6816 | 4768 | 346 | −1590 | −866 | O |
| ATOM | 4274 | N | TYR | B | 67 | 15.575 | 11.894 | 2.160 | 1.00 | 57.71 | | N |
| ANISOU | 4274 | N | TYR | B | 67 | 9955 | 7533 | 4438 | 499 | −861 | −301 | N |
| ATOM | 4275 | CA | TYR | B | 67 | 16.411 | 12.506 | 1.138 | 1.00 | 61.70 | | C |
| ANISOU | 4275 | CA | TYR | B | 67 | 10662 | 8037 | 4746 | 523 | −712 | −200 | C |
| ATOM | 4276 | C | TYR | B | 67 | 17.281 | 11.456 | 0.469 | 1.00 | 68.12 | | C |
| ANISOU | 4276 | C | TYR | B | 67 | 11614 | 8866 | 5401 | 533 | −540 | −273 | C |
| ATOM | 4277 | O | TYR | B | 67 | 17.605 | 10.420 | 1.059 | 1.00 | 69.01 | | O |
| ANISOU | 4277 | O | TYR | B | 67 | 11619 | 8985 | 5617 | 516 | −469 | −378 | O |
| ATOM | 4278 | CB | TYR | B | 67 | 17.292 | 13.618 | 1.716 | 1.00 | 59.14 | | C |
| ANISOU | 4278 | CB | TYR | B | 67 | 10229 | 7689 | 4554 | 506 | −543 | −72 | C |
| ATOM | 4279 | CG | TYR | B | 67 | 18.106 | 13.197 | 2.918 | 1.00 | 59.17 | | C |
| ANISOU | 4279 | CG | TYR | B | 67 | 10011 | 7691 | 4779 | 469 | −389 | −114 | C |
| ATOM | 4280 | CD1 | TYR | B | 67 | 17.522 | 13.085 | 4.174 | 1.00 | 57.44 | | C |
| ANISOU | 4280 | CD1 | TYR | B | 67 | 9569 | 7467 | 4789 | 443 | −495 | −165 | C |
| ATOM | 4281 | CD2 | TYR | B | 67 | 19.461 | 12.924 | 2.800 | 1.00 | 61.82 | | C |
| ANISOU | 4281 | CD2 | TYR | B | 67 | 10360 | 8030 | 5097 | 462 | −136 | −98 | C |
| ATOM | 4282 | CE1 | TYR | B | 67 | 18.263 | 12.702 | 5.278 | 1.00 | 56.53 | | C |
| ANISOU | 4282 | CE1 | TYR | B | 67 | 9264 | 7351 | 4863 | 412 | −366 | −200 | C |
| ATOM | 4283 | CE2 | TYR | B | 67 | 20.211 | 12.542 | 3.902 | 1.00 | 67.18 | | C |
| ANISOU | 4283 | CE2 | TYR | B | 67 | 10833 | 8708 | 5982 | 431 | −11 | −132 | C |
| ATOM | 4284 | CZ | TYR | B | 67 | 19.604 | 12.435 | 5.136 | 1.00 | 64.33 | | C |
| ANISOU | 4284 | CZ | TYR | B | 67 | 10267 | 8343 | 5831 | 406 | −133 | −182 | C |
| ATOM | 4285 | OH | TYR | B | 67 | 20.341 | 12.059 | 6.232 | 1.00 | 70.13 | | O |
| ANISOU | 4285 | OH | TYR | B | 67 | 10811 | 9078 | 6757 | 377 | −21 | −212 | O |
| ATOM | 4286 | N | THR | B | 68 | 17.653 | 11.739 | −0.778 | 1.00 | 69.58 | | N |
| ANISOU | 4286 | N | THR | B | 68 | 12048 | 9055 | 5333 | 564 | −467 | −214 | N |
| ATOM | 4287 | CA | THR | B | 68 | 18.562 | 10.884 | −1.522 | 1.00 | 74.64 | | C |
| ANISOU | 4287 | CA | THR | B | 68 | 12848 | 9707 | 5805 | 582 | −272 | −270 | C |

TABLE 11-continued

| | | | | | | | | | | | | |
|---|---|---|---|---|---|---|---|---|---|---|---|---|
| ATOM | 4288 | C | THR | B | 68 | 19.281 | 11.726 | −2.565 | 1.00 | 79.61 | | C |
| ANISOU | 4288 | C | THR | B | 68 | 13688 | 10331 | 6228 | 610 | −113 | −138 | C |
| ATOM | 4289 | O | THR | B | 68 | 18.704 | 12.661 | −3.134 | 1.00 | 79.42 | | O |
| ANISOU | 4289 | O | THR | B | 68 | 13784 | 10301 | 6091 | 627 | −239 | −41 | O |
| ATOM | 4290 | CB | THR | B | 68 | 17.829 | 9.709 | −2.186 | 1.00 | 79.44 | | C |
| ANISOU | 4290 | CB | THR | B | 68 | 13608 | 10327 | 6248 | 598 | −422 | −416 | C |
| ATOM | 4291 | OG1 | THR | B | 68 | 18.787 | 8.788 | −2.720 | 1.00 | 85.03 | | O |
| ANISOU | 4291 | OG1 | THR | B | 68 | 14440 | 11038 | 6830 | 617 | −207 | −486 | O |
| ATOM | 4292 | CG2 | THR | B | 68 | 16.920 | 10.191 | −3.310 | 1.00 | 78.64 | | C |
| ANISOU | 4292 | CG2 | THR | B | 68 | 13696 | 10231 | 5953 | 620 | −619 | −375 | C |
| ATOM | 4293 | N | GLU | B | 69 | 20.550 | 11.408 | −2.789 | 1.00 | 84.10 | | N |
| ANISOU | 4293 | N | GLU | B | 69 | 14294 | 10900 | 6760 | 615 | 168 | −129 | N |
| ATOM | 4294 | CA | GLU | B | 69 | 21.321 | 12.113 | −3.801 | 1.00 | 89.22 | | C |
| ANISOU | 4294 | CA | GLU | B | 69 | 15147 | 11542 | 7212 | 640 | 355 | −6 | C |
| ATOM | 4295 | C | GLU | B | 69 | 20.857 | 11.681 | −5.185 | 1.00 | 85.47 | | C |
| ANISOU | 4295 | C | GLU | B | 69 | 14912 | 11078 | 6484 | 671 | 273 | −49 | C |
| ATOM | 4296 | O | GLU | B | 69 | 20.486 | 10.522 | −5.396 | 1.00 | 79.97 | | O |
| ANISOU | 4296 | O | GLU | B | 69 | 14224 | 10393 | 5766 | 673 | 193 | −194 | O |
| ATOM | 4297 | CB | GLU | B | 69 | 22.812 | 11.832 | −3.615 | 1.00 | 95.40 | | C |
| ANISOU | 4297 | CB | GLU | B | 69 | 15856 | 12319 | 8073 | 634 | 687 | 11 | C |
| ATOM | 4298 | CG | GLU | B | 69 | 23.739 | 12.894 | −4.183 | 1.00 | 100.88 | | C |
| ANISOU | 4298 | CG | GLU | B | 69 | 16640 | 12994 | 8695 | 636 | 909 | 178 | C |
| ATOM | 4299 | CD | GLU | B | 69 | 25.158 | 12.761 | −3.656 | 1.00 | 103.00 | | C |
| ANISOU | 4299 | CD | GLU | B | 69 | 16740 | 13253 | 9142 | 616 | 1208 | 205 | C |
| ATOM | 4300 | OE1 | GLU | B | 69 | 25.987 | 13.653 | −3.939 | 0.59 | 101.56 | | O |
| ANISOU | 4300 | OE1 | GLU | B | 69 | 16578 | 13050 | 8960 | 605 | 1402 | 346 | O |
| ATOM | 4301 | OE2 | GLU | B | 69 | 25.441 | 11.764 | −2.952 | 1.00 | 99.89 | | O |
| ANISOU | 4301 | OE2 | GLU | B | 69 | 16187 | 12869 | 8896 | 610 | 1246 | 90 | O |
| ATOM | 4302 | N | PHE | B | 70 | 20.852 | 12.624 | −6.126 | 1.00 | 86.19 | | N |
| ANISOU | 4302 | N | PHE | B | 70 | 15152 | 11162 | 6436 | 685 | 282 | 78 | N |
| ATOM | 4303 | CA | PHE | B | 70 | 20.430 | 12.315 | −7.488 | 1.00 | 87.82 | | C |
| ANISOU | 4303 | CA | PHE | B | 70 | 15549 | 11378 | 6441 | 708 | 201 | 49 | C |
| ATOM | 4304 | C | PHE | B | 70 | 20.948 | 13.388 | −8.434 | 1.00 | 95.41 | | C |
| ANISOU | 4304 | C | PHE | B | 70 | 16665 | 12325 | 7261 | 724 | 332 | 210 | C |
| ATOM | 4305 | O | PHE | B | 70 | 21.285 | 14.500 | −8.019 | 1.00 | 99.18 | | O |
| ANISOU | 4305 | O | PHE | B | 70 | 17096 | 12779 | 7808 | 715 | 406 | 351 | O |
| ATOM | 4306 | CB | PHE | B | 70 | 18.901 | 12.189 | −7.596 | 1.00 | 80.90 | | C |
| ANISOU | 4306 | CB | PHE | B | 70 | 14674 | 10512 | 5554 | 706 | −151 | −14 | C |
| ATOM | 4307 | CG | PHE | B | 70 | 18.167 | 13.509 | −7.668 | 1.00 | 76.69 | | C |
| ANISOU | 4307 | CG | PHE | B | 70 | 14159 | 9965 | 5014 | 714 | −322 | 123 | C |
| ATOM | 4308 | CD1 | PHE | B | 70 | 17.159 | 13.694 | −8.601 | 1.00 | 77.09 | | C |
| ANISOU | 4308 | CD1 | PHE | B | 70 | 14328 | 10022 | 4940 | 731 | −546 | 131 | C |
| ATOM | 4309 | CD2 | PHE | B | 70 | 18.452 | 14.545 | −6.788 | 1.00 | 78.25 | | C |
| ANISOU | 4309 | CD2 | PHE | B | 70 | 14252 | 10140 | 5340 | 705 | −267 | 243 | C |
| ATOM | 4310 | CE1 | PHE | B | 70 | 16.468 | 14.894 | −8.680 | 1.00 | 78.19 | | C |
| ANISOU | 4310 | CE1 | PHE | B | 70 | 14477 | 10145 | 5086 | 744 | −706 | 259 | C |
| ATOM | 4311 | CE2 | PHE | B | 70 | 17.766 | 15.753 | −6.866 | 1.00 | 76.70 | | C |
| ANISOU | 4311 | CE2 | PHE | B | 70 | 14072 | 9921 | 5148 | 717 | −426 | 370 | C |
| ATOM | 4312 | CZ | PHE | B | 70 | 16.771 | 15.923 | −7.813 | 1.00 | 73.66 | | C |
| ANISOU | 4312 | CZ | PHE | B | 70 | 13801 | 9543 | 4644 | 739 | −645 | 378 | C |
| ATOM | 4313 | N | THR | B | 71 | 21.007 | 13.033 | −9.716 | 1.00 | 99.19 | | N |
| ANISOU | 4313 | N | THR | B | 71 | 17332 | 12812 | 7543 | 747 | 362 | 188 | N |
| ATOM | 4314 | CA | THR | B | 71 | 21.325 | 13.989 | −10.770 | 1.00 | 99.44 | | C |
| ANISOU | 4314 | CA | THR | B | 71 | 17538 | 12832 | 7415 | 766 | 451 | 333 | C |
| ATOM | 4315 | C | THR | B | 71 | 20.110 | 14.135 | −11.675 | 1.00 | 100.45 | | C |
| ANISOU | 4315 | C | THR | B | 71 | 17811 | 12970 | 7386 | 785 | 171 | 326 | C |
| ATOM | 4316 | O | THR | B | 71 | 19.787 | 13.200 | −12.425 | 1.00 | 103.63 | | O |
| ANISOU | 4316 | O | THR | B | 71 | 18323 | 13392 | 7661 | 797 | 101 | 210 | O |
| ATOM | 4317 | CB | THR | B | 71 | 22.544 | 13.537 | −11.575 | 1.00 | 104.58 | | C |
| ANISOU | 4317 | CB | THR | B | 71 | 18299 | 13482 | 7957 | 781 | 753 | 329 | C |
| ATOM | 4318 | OG1 | THR | B | 71 | 22.257 | 12.292 | −12.221 | 1.00 | 110.56 | | O |
| ANISOU | 4318 | OG1 | THR | B | 71 | 19150 | 14258 | 8599 | 798 | 691 | 174 | O |
| ATOM | 4319 | CG2 | THR | B | 71 | 23.752 | 13.364 | −10.667 | 1.00 | 99.51 | | C |
| ANISOU | 4319 | CG2 | THR | B | 71 | 17486 | 12828 | 7494 | 763 | 1028 | 337 | C |
| ATOM | 4320 | N | PRO | B | 72 | 19.410 | 15.267 | −11.643 | 1.00 | 97.29 | | N |
| ANISOU | 4320 | N | PRO | B | 72 | 17415 | 12555 | 6995 | 789 | 4 | 445 | N |
| ATOM | 4321 | CA | PRO | B | 72 | 18.160 | 15.386 | −12.403 | 1.00 | 97.74 | | C |
| ANISOU | 4321 | CA | PRO | B | 72 | 17579 | 12624 | 6934 | 809 | −288 | 434 | C |
| ATOM | 4322 | C | PRO | B | 72 | 18.386 | 15.433 | −13.906 | 1.00 | 102.96 | | C |
| ANISOU | 4322 | C | PRO | B | 72 | 18491 | 13291 | 7339 | 837 | −222 | 472 | C |
| ATOM | 4323 | O | PRO | B | 72 | 19.390 | 15.954 | −14.399 | 1.00 | 99.47 | | O |
| ANISOU | 4323 | O | PRO | B | 72 | 18147 | 12834 | 6814 | 846 | 26 | 578 | O |
| ATOM | 4324 | CB | PRO | B | 72 | 17.565 | 16.705 | −11.896 | 1.00 | 96.53 | | C |
| ANISOU | 4324 | CB | PRO | B | 72 | 17348 | 12444 | 6883 | 811 | −432 | 575 | C |
| ATOM | 4325 | CG | PRO | B | 72 | 18.740 | 17.483 | −11.401 | 1.00 | 95.64 | | C |
| ANISOU | 4325 | CG | PRO | B | 72 | 17188 | 12301 | 6851 | 798 | −155 | 701 | C |
| ATOM | 4326 | CD | PRO | B | 72 | 19.677 | 16.461 | −10.823 | 1.00 | 93.73 | | C |
| ANISOU | 4326 | CD | PRO | B | 72 | 16852 | 12073 | 6688 | 776 | 61 | 591 | C |
| ATOM | 4327 | N | THR | B | 73 | 17.422 | 14.879 | −14.634 | 1.00 | 105.98 | | N |
| ANISOU | 4327 | N | THR | B | 73 | 18973 | 13695 | 7600 | 849 | −451 | 384 | N |

TABLE 11-continued

| | | | | | | | | | | | | |
|---|---|---|---|---|---|---|---|---|---|---|---|---|
| ATOM | 4328 | CA | THR | B | 73 | 17.442 | 14.870 | −16.094 | 1.00 | 107.23 | | C |
| ANISOU | 4328 | CA | THR | B | 73 | 19382 | 13862 | 7498 | 878 | −440 | 407 | C |
| ATOM | 4329 | C | THR | B | 73 | 16.105 | 15.420 | −16.584 | 1.00 | 108.26 | | C |
| ANISOU | 4329 | C | THR | B | 73 | 19571 | 13998 | 7565 | 894 | −764 | 448 | C |
| ATOM | 4330 | O | THR | B | 73 | 15.347 | 16.060 | −15.845 | 1.00 | 107.00 | | O |
| ANISOU | 4330 | O | THR | B | 73 | 19264 | 13828 | 7562 | 889 | −948 | 498 | O |
| ATOM | 4331 | CB | THR | B | 73 | 17.697 | 13.457 | −16.645 | 1.00 | 104.56 | | C |
| ANISOU | 4331 | CB | THR | B | 73 | 19135 | 13542 | 7051 | 878 | −376 | 239 | C |
| ATOM | 4332 | OG1 | THR | B | 73 | 16.525 | 12.653 | −16.457 | 1.00 | 100.90 | | O |
| ANISOU | 4332 | OG1 | THR | B | 73 | 18606 | 13095 | 6637 | 862 | −663 | 100 | O |
| ATOM | 4333 | CG2 | THR | B | 73 | 18.885 | 12.804 | −15.950 | 1.00 | 100.60 | | C |
| ANISOU | 4333 | CG2 | THR | B | 73 | 18523 | 13033 | 6666 | 863 | −89 | 181 | C |
| ATOM | 4334 | N | GLU | B | 74 | 15.799 | 15.171 | −17.858 | 1.00 | 113.85 | | N |
| ANISOU | 4334 | N | GLU | B | 74 | 20497 | 14721 | 8041 | 918 | −838 | 427 | N |
| ATOM | 4335 | CA | GLU | B | 74 | 14.486 | 15.454 | −18.427 | 1.00 | 115.19 | | C |
| ANISOU | 4335 | CA | GLU | B | 74 | 20728 | 14901 | 8136 | 933 | −1162 | 438 | C |
| ATOM | 4336 | C | GLU | B | 74 | 13.641 | 14.203 | −18.614 | 1.00 | 120.41 | | C |
| ANISOU | 4336 | C | GLU | B | 74 | 21383 | 15587 | 8782 | 917 | −1371 | 254 | C |
| ATOM | 4337 | O | GLU | B | 74 | 12.413 | 14.279 | −18.514 | 1.00 | 118.89 | | O |
| ANISOU | 4337 | O | GLU | B | 74 | 21117 | 15401 | 8654 | 913 | −1669 | 231 | O |
| ATOM | 4338 | CB | GLU | B | 74 | 14.629 | 16.153 | −19.783 | 1.00 | 117.26 | | C |
| ANISOU | 4338 | CB | GLU | B | 74 | 21252 | 15163 | 8139 | 972 | −1129 | 557 | C |
| ATOM | 4339 | CG | GLU | B | 74 | 15.525 | 17.371 | −19.774 | 1.00 | 116.66 | | C |
| ANISOU | 4339 | CG | GLU | B | 74 | 21210 | 15057 | 8057 | 985 | −902 | 746 | C |
| ATOM | 4340 | CD | GLU | B | 74 | 15.537 | 18.081 | −21.106 | 0.00 | 118.55 | | C |
| ANISOU | 4340 | CD | GLU | B | 74 | 21705 | 15295 | 8044 | 1023 | −897 | 868 | C |
| ATOM | 4341 | OE1 | GLU | B | 74 | 14.644 | 17.799 | −21.929 | 1.00 | 121.80 | | O |
| ANISOU | 4341 | OE1 | GLU | B | 74 | 22246 | 15729 | 8306 | 1041 | −1127 | 820 | O |
| ATOM | 4342 | OE2 | GLU | B | 74 | 16.440 | 18.913 | −21.334 | 1.00 | 118.14 | | O |
| ANISOU | 4342 | OE2 | GLU | B | 74 | 21725 | 15218 | 7945 | 1032 | −662 | 1012 | O |
| ATOM | 4343 | N | LYS | B | 75 | 14.277 | 13.056 | −18.873 | 1.00 | 123.74 | | N |
| ANISOU | 4343 | N | LYS | B | 75 | 21871 | 16016 | 9129 | 906 | −1217 | 123 | N |
| ATOM | 4344 | CA | LYS | B | 75 | 13.581 | 11.798 | −19.111 | 1.00 | 125.34 | | C |
| ANISOU | 4344 | CA | LYS | B | 75 | 22084 | 16233 | 9307 | 886 | −1388 | −57 | C |
| ATOM | 4345 | C | LYS | B | 75 | 13.149 | 11.107 | −17.826 | 1.00 | 123.26 | | C |
| ANISOU | 4345 | C | LYS | B | 75 | 21557 | 15967 | 9310 | 845 | −1483 | −171 | C |
| ATOM | 4346 | O | LYS | B | 75 | 12.381 | 10.141 | −17.891 | 1.00 | 124.00 | | O |
| ANISOU | 4346 | O | LYS | B | 75 | 21622 | 16068 | 9426 | 821 | −1665 | −313 | O |
| ATOM | 4347 | CB | LYS | B | 75 | 14.478 | 10.860 | −19.925 | 1.00 | 125.61 | | C |
| ANISOU | 4347 | CB | LYS | B | 75 | 22303 | 16268 | 9155 | 896 | −1171 | −148 | C |
| ATOM | 4348 | CG | LYS | B | 75 | 13.757 | 10.066 | −21.008 | 1.00 | 127.90 | | C |
| ANISOU | 4348 | CG | LYS | B | 75 | 22774 | 16571 | 9252 | 898 | −1357 | −261 | C |
| ATOM | 4349 | CD | LYS | B | 75 | 13.297 | 8.706 | −20.510 | 0.00 | 124.03 | | C |
| ANISOU | 4349 | CD | LYS | B | 75 | 22162 | 16079 | 8884 | 858 | −1465 | −454 | C |
| ATOM | 4350 | CE | LYS | B | 75 | 12.563 | 7.936 | −21.596 | 1.00 | 125.69 | | C |
| ANISOU | 4350 | CE | LYS | B | 75 | 22554 | 16297 | 8905 | 856 | −1657 | −566 | C |
| ATOM | 4351 | NZ | LYS | B | 75 | 12.106 | 6.606 | −21.108 | 1.00 | 122.56 | | N |
| ANISOU | 4351 | NZ | LYS | B | 75 | 22037 | 15892 | 8639 | 812 | −1760 | −753 | N |
| ATOM | 4352 | N | ASP | B | 76 | 13.613 | 11.578 | −16.671 | 1.00 | 117.00 | | N |
| ANISOU | 4352 | N | ASP | B | 76 | 20575 | 15162 | 8717 | 834 | −1364 | −113 | N |
| ATOM | 4353 | CA | ASP | B | 76 | 13.300 | 10.966 | −15.388 | 1.00 | 110.44 | | C |
| ANISOU | 4353 | CA | ASP | B | 76 | 19496 | 14328 | 8139 | 797 | −1428 | −212 | C |
| ATOM | 4354 | C | ASP | B | 76 | 12.270 | 11.809 | −14.649 | 1.00 | 100.44 | | C |
| ANISOU | 4354 | C | ASP | B | 76 | 18056 | 13057 | 7049 | 791 | −1664 | −140 | C |
| ATOM | 4355 | O | ASP | B | 76 | 12.442 | 13.024 | −14.504 | 1.00 | 99.87 | | O |
| ANISOU | 4355 | O | ASP | B | 76 | 17978 | 12973 | 6993 | 813 | −1627 | 14 | O |
| ATOM | 4356 | CB | ASP | B | 76 | 14.562 | 10.812 | −14.539 | 1.00 | 114.25 | | C |
| ANISOU | 4356 | CB | ASP | B | 76 | 19881 | 14799 | 8730 | 789 | −1128 | −209 | C |
| ATOM | 4357 | CG | ASP | B | 76 | 15.562 | 9.854 | −15.156 | 1.00 | 119.91 | | C |
| ANISOU | 4357 | CG | ASP | B | 76 | 20733 | 15515 | 9311 | 796 | −891 | −296 | C |
| ATOM | 4358 | OD1 | ASP | B | 76 | 15.174 | 8.708 | −15.462 | 1.00 | 122.32 | | O |
| ANISOU | 4358 | OD1 | ASP | B | 76 | 21071 | 15824 | 9580 | 782 | −980 | −445 | O |
| ATOM | 4359 | OD2 | ASP | B | 76 | 16.732 | 10.249 | −15.345 | 1.00 | 120.52 | | O |
| ANISOU | 4359 | OD2 | ASP | B | 76 | 20881 | 15586 | 9326 | 816 | −612 | −213 | O |
| ATOM | 4360 | N | GLU | B | 77 | 11.205 | 11.161 | −14.188 | 1.00 | 92.95 | | N |
| ANISOU | 4360 | N | GLU | B | 77 | 16964 | 12113 | 6241 | 762 | −1900 | −251 | N |
| ATOM | 4361 | CA | GLU | B | 77 | 10.176 | 11.796 | −13.377 | 1.00 | 90.18 | | C |
| ANISOU | 4361 | CA | GLU | B | 77 | 16415 | 11757 | 6094 | 755 | −2123 | −205 | C |
| ATOM | 4362 | C | GLU | B | 77 | 10.324 | 11.325 | −11.938 | 1.00 | 91.68 | | C |
| ANISOU | 4362 | C | GLU | B | 77 | 16363 | 11938 | 6535 | 720 | −2068 | −277 | C |
| ATOM | 4363 | O | GLU | B | 77 | 10.424 | 10.120 | −11.681 | 1.00 | 95.55 | | O |
| ANISOU | 4363 | O | GLU | B | 77 | 16803 | 12430 | 7071 | 688 | −2035 | −422 | O |
| ATOM | 4364 | CB | GLU | B | 77 | 8.779 | 11.466 | −13.902 | 1.00 | 91.28 | | C |
| ANISOU | 4364 | CB | GLU | B | 77 | 16550 | 11905 | 6228 | 745 | −2438 | −268 | C |
| ATOM | 4365 | CG | GLU | B | 77 | 8.492 | 11.992 | −15.301 | 1.00 | 89.49 | | C |
| ANISOU | 4365 | CG | GLU | B | 77 | 16557 | 11688 | 5756 | 782 | −2531 | −192 | C |
| ATOM | 4366 | CD | GLU | B | 77 | 7.189 | 11.461 | −15.855 | 0.00 | 94.54 | | C |
| ANISOU | 4366 | CD | GLU | B | 77 | 17200 | 12339 | 6383 | 767 | −2832 | −277 | C |
| ATOM | 4367 | OE1 | GLU | B | 77 | 6.909 | 10.259 | −15.657 | 1.00 | 94.18 | | O |
| ANISOU | 4367 | OE1 | GLU | B | 77 | 17090 | 12295 | 6401 | 725 | −2883 | −432 | O |

TABLE 11-continued

| | | | | | | | | | | | |
|---|---|---|---|---|---|---|---|---|---|---|---|
| ATOM | 4368 | OE2 | GLU | B | 77 | 6.443 | 12.247 | −16.476 | 1.00 | 100.35 | O |
| ANISOU | 4368 | OE2 | GLU | B | 77 | 17999 | 13079 | 7051 | 796 | −3017 | −185 | O |
| ATOM | 4369 | N | TYR | B | 78 | 10.339 | 12.268 | −11.005 | 1.00 | 86.08 | N |
| ANISOU | 4369 | N | TYR | B | 78 | 15507 | 11214 | 5984 | 727 | −2058 | −176 | N |
| ATOM | 4370 | CA | TYR | B | 78 | 10.553 | 11.950 | −9.604 | 1.00 | 81.85 | C |
| ANISOU | 4370 | CA | TYR | B | 78 | 14752 | 10670 | 5676 | 699 | −1994 | −229 | C |
| ATOM | 4371 | C | TYR | B | 78 | 9.291 | 12.206 | −8.796 | 1.00 | 78.02 | C |
| ANISOU | 4371 | C | TYR | B | 78 | 14052 | 10178 | 5414 | 687 | −2248 | −237 | C |
| ATOM | 4372 | O | TYR | B | 78 | 8.501 | 13.101 | −9.105 | 1.00 | 77.53 | O |
| ANISOU | 4372 | O | TYR | B | 78 | 13993 | 10111 | 5356 | 712 | −2420 | −143 | O |
| ATOM | 4373 | CB | TYR | B | 78 | 11.721 | 12.756 | −9.033 | 1.00 | 78.43 | C |
| ANISOU | 4373 | CB | TYR | B | 78 | 14312 | 10225 | 5265 | 714 | −1746 | −117 | C |
| ATOM | 4374 | CG | TYR | B | 78 | 13.038 | 12.326 | −9.621 | 1.00 | 79.53 | C |
| ANISOU | 4374 | CG | TYR | B | 78 | 14612 | 10369 | 5237 | 719 | −1462 | −128 | C |
| ATOM | 4375 | CD1 | TYR | B | 78 | 13.541 | 12.930 | −10.770 | 1.00 | 82.49 | C |
| ANISOU | 4375 | CD1 | TYR | B | 78 | 15203 | 10743 | 5395 | 751 | −1357 | −25 | C |
| ATOM | 4376 | CD2 | TYR | B | 78 | 13.761 | 11.284 | −9.052 | 1.00 | 73.63 | C |
| ANISOU | 4376 | CD2 | TYR | B | 78 | 13798 | 9625 | 4555 | 696 | −1296 | −242 | C |
| ATOM | 4377 | CE1 | TYR | B | 78 | 14.744 | 12.524 | −11.319 | 1.00 | 84.63 | C |
| ANISOU | 4377 | CE1 | TYR | B | 78 | 15612 | 11017 | 5526 | 758 | −1085 | −36 | C |
| ATOM | 4378 | CE2 | TYR | B | 78 | 14.959 | 10.870 | −9.594 | 1.00 | 77.18 | C |
| ANISOU | 4378 | CE2 | TYR | B | 78 | 14379 | 10075 | 4869 | 706 | −1029 | −253 | C |
| ATOM | 4379 | CZ | TYR | B | 78 | 15.447 | 11.491 | −10.723 | 1.00 | 83.47 | C |
| ANISOU | 4379 | CZ | TYR | B | 78 | 15383 | 10873 | 5460 | 737 | −921 | −151 | C |
| ATOM | 4380 | OH | TYR | B | 78 | 16.643 | 11.069 | −11.250 | 1.00 | 88.54 | O |
| ANISOU | 4380 | OH | TYR | B | 78 | 16143 | 11514 | 5983 | 748 | −645 | −162 | O |
| ATOM | 4381 | N | ALA | B | 79 | 9.106 | 11.399 | −7.758 | 1.00 | 73.39 | N |
| ANISOU | 4381 | N | ALA | B | 79 | 13276 | 9590 | 5020 | 649 | −2263 | −348 | N |
| ATOM | 4382 | CA | ALA | B | 79 | 7.957 | 11.553 | −6.886 | 1.00 | 74.28 | C |
| ANISOU | 4382 | CA | ALA | B | 79 | 13162 | 9694 | 5368 | 634 | −2476 | −364 | C |
| ATOM | 4383 | C | ALA | B | 79 | 8.317 | 11.024 | −5.505 | 1.00 | 80.11 | C |
| ANISOU | 4383 | C | ALA | B | 79 | 13706 | 10424 | 6308 | 603 | −2376 | −436 | C |
| ATOM | 4384 | O | ALA | B | 79 | 9.452 | 10.612 | −5.246 | 1.00 | 77.01 | O |
| ANISOU | 4384 | O | ALA | B | 79 | 13356 | 10033 | 5870 | 596 | −2151 | −465 | O |
| ATOM | 4385 | CB | ALA | B | 79 | 6.728 | 10.840 | −7.456 | 1.00 | 69.60 | C |
| ANISOU | 4385 | CB | ALA | B | 79 | 12550 | 9107 | 4786 | 613 | −2717 | −456 | C |
| ATOM | 4386 | N | CYS | B | 80 | 7.336 | 11.056 | −4.613 | 1.00 | 76.93 | N |
| ANISOU | 4386 | N | CYS | B | 80 | 13083 | 10012 | 6135 | 586 | −2542 | −461 | N |
| ATOM | 4387 | CA | CYS | B | 80 | 7.455 | 10.453 | −3.300 | 1.00 | 76.30 | C |
| ANISOU | 4387 | CA | CYS | B | 80 | 12804 | 9924 | 6261 | 552 | −2486 | −543 | C |
| ATOM | 4388 | C | CYS | B | 80 | 6.160 | 9.718 | −3.009 | 1.00 | 75.59 | C |
| ANISOU | 4388 | C | CYS | B | 80 | 12546 | 9829 | 6345 | 514 | −2694 | −640 | C |
| ATOM | 4389 | O | CYS | B | 80 | 5.087 | 10.108 | −3.477 | 1.00 | 78.55 | O |
| ANISOU | 4389 | O | CYS | B | 80 | 12898 | 10202 | 6745 | 524 | −2896 | −606 | O |
| ATOM | 4390 | CB | CYS | B | 80 | 7.715 | 11.493 | −2.216 | 1.00 | 81.09 | C |
| ANISOU | 4390 | CB | CYS | B | 80 | 13285 | 10517 | 7008 | 572 | −2434 | −447 | C |
| ATOM | 4391 | SG | CYS | B | 80 | 6.213 | 12.343 | −1.736 | 1.00 | 90.50 | S |
| ANISOU | 4391 | SG | CYS | B | 80 | 14281 | 11690 | 8414 | 587 | −2692 | −387 | S |
| ATOM | 4392 | N | ARG | B | 81 | 6.268 | 8.640 | −2.243 | 1.00 | 68.69 | N |
| ANISOU | 4392 | N | ARG | B | 81 | 11553 | 8950 | 5596 | 471 | −2638 | −758 | N |
| ATOM | 4393 | CA | ARG | B | 81 | 5.114 | 7.825 | −1.898 | 1.00 | 67.65 | C |
| ANISOU | 4393 | CA | ARG | B | 81 | 11254 | 8807 | 5642 | 426 | −2806 | −854 | C |
| ATOM | 4394 | C | ARG | B | 81 | 5.040 | 7.728 | −0.388 | 1.00 | 64.48 | C |
| ANISOU | 4394 | C | ARG | B | 81 | 10616 | 8391 | 5491 | 405 | −2766 | −878 | C |
| ATOM | 4395 | O | ARG | B | 81 | 5.980 | 7.245 | 0.256 | 1.00 | 59.68 | O |
| ANISOU | 4395 | O | ARG | B | 81 | 9996 | 7781 | 4898 | 393 | −2589 | −923 | O |
| ATOM | 4396 | CB | ARG | B | 81 | 5.201 | 6.434 | −2.522 | 1.00 | 64.49 | C |
| ANISOU | 4396 | CB | ARG | B | 81 | 10947 | 8405 | 5152 | 386 | −2788 | −984 | C |
| ATOM | 4397 | CG | ARG | B | 81 | 3.920 | 5.641 | −2.391 | 1.00 | 70.47 | C |
| ANISOU | 4397 | CG | ARG | B | 81 | 11559 | 9147 | 6069 | 338 | −2979 | −1072 | C |
| ATOM | 4398 | CD | ARG | B | 81 | 4.044 | 4.311 | −3.095 | 1.00 | 76.33 | C |
| ANISOU | 4398 | CD | ARG | B | 81 | 12416 | 9881 | 6704 | 300 | −2963 | −1197 | C |
| ATOM | 4399 | NE | ARG | B | 81 | 5.173 | 3.552 | −2.573 | 1.00 | 80.43 | N |
| ANISOU | 4399 | NE | ARG | B | 81 | 12953 | 10390 | 7215 | 288 | −2742 | −1264 | N |
| ATOM | 4400 | CZ | ARG | B | 81 | 5.683 | 2.480 | −3.166 | 1.00 | 84.92 | C |
| ANISOU | 4400 | CZ | ARG | B | 81 | 13655 | 10949 | 7661 | 270 | −2657 | −1363 | C |
| ATOM | 4401 | NH1 | ARG | B | 81 | 5.159 | 2.043 | −4.306 | 1.00 | 77.40 | N |
| ANISOU | 4401 | NH1 | ARG | B | 81 | 12836 | 9997 | 6577 | 258 | −2780 | −1411 | N |
| ATOM | 4402 | NH2 | ARG | B | 81 | 6.715 | 1.847 | −2.622 | 1.00 | 86.24 | N |
| ANISOU | 4402 | NH2 | ARG | B | 81 | 13823 | 11103 | 7841 | 266 | −2451 | −1415 | N |
| ATOM | 4403 | N | VAL | B | 82 | 3.931 | 8.187 | 0.174 | 1.00 | 67.69 | N |
| ANISOU | 4403 | N | VAL | B | 82 | 10835 | 8786 | 6096 | 403 | −2924 | −848 | N |
| ATOM | 4404 | CA | VAL | B | 82 | 3.760 | 8.272 | 1.616 | 1.00 | 66.10 | C |
| ANISOU | 4404 | CA | VAL | B | 82 | 10405 | 8571 | 6140 | 390 | −2895 | −856 | C |
| ATOM | 4405 | C | VAL | B | 82 | 2.568 | 7.417 | 2.005 | 1.00 | 64.37 | C |
| ANISOU | 4405 | C | VAL | B | 82 | 10002 | 8335 | 6121 | 340 | −3028 | −941 | C |
| ATOM | 4406 | O | VAL | B | 82 | 1.484 | 7.557 | 1.425 | 1.00 | 66.45 | O |
| ANISOU | 4406 | O | VAL | B | 82 | 10240 | 8595 | 6412 | 340 | −3207 | −928 | O |
| ATOM | 4407 | CB | VAL | B | 82 | 3.557 | 9.725 | 2.076 | 1.00 | 59.63 | C |
| ANISOU | 4407 | CB | VAL | B | 82 | 9512 | 7746 | 5400 | 439 | −2934 | −729 | C |

TABLE 11-continued

| | | | | | | | | | | | |
|---|---|---|---|---|---|---|---|---|---|---|---|
| ATOM | 4408 | CG1 | VAL | B | 82 | 3.460 | 9.781 | 3.584 | 1.00 | 52.77 | C |
| ANISOU | 4408 | CG1 | VAL | B | 82 | 8415 | 6861 | 4774 | 426 | −2887 | −746 | C |
| ATOM | 4409 | CG2 | VAL | B | 82 | 4.684 | 10.606 | 1.560 | 1.00 | 63.87 | C |
| ANISOU | 4409 | CG2 | VAL | B | 82 | 10247 | 8293 | 5728 | 484 | −2809 | −632 | C |
| ATOM | 4410 | N | ASN | B | 83 | 2.766 | 6.532 | 2.977 | 1.00 | 60.70 | N |
| ANISOU | 4410 | N | ASN | B | 83 | 9411 | 7857 | 5796 | 298 | −2937 | −1025 | N |
| ATOM | 4411 | CA | ASN | B | 83 | 1.660 | 5.809 | 3.581 | 1.00 | 66.02 | C |
| ANISOU | 4411 | CA | ASN | B | 83 | 9882 | 8508 | 6694 | 250 | −3036 | −1091 | C |
| ATOM | 4412 | C | ASN | B | 83 | 1.642 | 6.080 | 5.076 | 1.00 | 61.02 | C |
| ANISOU | 4412 | C | ASN | B | 83 | 9036 | 7862 | 6286 | 248 | −2964 | −1076 | C |
| ATOM | 4413 | O | ASN | B | 83 | 2.693 | 6.219 | 5.714 | 1.00 | 54.47 | O |
| ANISOU | 4413 | O | ASN | B | 83 | 8225 | 7038 | 5434 | 261 | −2807 | −1070 | O |
| ATOM | 4414 | CB | ASN | B | 83 | 1.732 | 4.301 | 3.326 | 1.00 | 74.40 | C |
| ANISOU | 4414 | CB | ASN | B | 83 | 10984 | 9555 | 7729 | 192 | −3008 | −1216 | C |
| ATOM | 4415 | CG | ASN | B | 83 | 0.355 | 3.647 | 3.328 | 1.00 | 81.92 | C |
| ANISOU | 4415 | CG | ASN | B | 83 | 11796 | 10485 | 8846 | 143 | −3172 | −1268 | C |
| ATOM | 4416 | OD1 | ASN | B | 83 | −0.626 | 4.224 | 3.811 | 1.00 | 77.27 | O |
| ANISOU | 4416 | OD1 | ASN | B | 83 | 11034 | 9888 | 8435 | 150 | −3277 | −1219 | O |
| ATOM | 4417 | ND2 | ASN | B | 83 | 0.275 | 2.440 | 2.779 | 1.00 | 88.59 | N |
| ANISOU | 4417 | ND2 | ASN | B | 83 | 12712 | 11315 | 9635 | 95 | −3191 | −1368 | N |
| ATOM | 4418 | N | HIS | B | 84 | 0.434 | 6.150 | 5.618 | 1.00 | 59.92 | N |
| ANISOU | 4418 | N | HIS | B | 84 | 8697 | 7704 | 6365 | 233 | −3077 | −1072 | N |
| ATOM | 4419 | CA | HIS | B | 84 | 0.214 | 6.502 | 7.008 | 1.00 | 55.92 | C |
| ANISOU | 4419 | CA | HIS | B | 84 | 7978 | 7183 | 6086 | 236 | −3023 | −1051 | C |
| ATOM | 4420 | C | HIS | B | 84 | −1.123 | 5.905 | 7.402 | 1.00 | 55.18 | C |
| ANISOU | 4420 | C | HIS | B | 84 | 7689 | 7063 | 6212 | 194 | −3126 | −1092 | C |
| ATOM | 4421 | O | HIS | B | 84 | −1.978 | 5.657 | 6.551 | 1.00 | 57.10 | O |
| ANISOU | 4421 | O | HIS | B | 84 | 7955 | 7303 | 6436 | 179 | −3273 | −1105 | O |
| ATOM | 4422 | CB | HIS | B | 84 | 0.226 | 8.023 | 7.190 | 1.00 | 47.40 | C |
| ANISOU | 4422 | CB | HIS | B | 84 | 6881 | 6111 | 5020 | 301 | −3044 | −936 | C |
| ATOM | 4423 | CG | HIS | B | 84 | 0.229 | 8.473 | 8.615 | 1.00 | 48.73 | C |
| ANISOU | 4423 | CG | HIS | B | 84 | 6860 | 6265 | 5390 | 312 | −2963 | −915 | C |
| ATOM | 4424 | ND1 | HIS | B | 84 | −0.870 | 9.048 | 9.215 | 1.00 | 51.05 | N |
| ANISOU | 4424 | ND1 | HIS | B | 84 | 6962 | 6538 | 5898 | 329 | −3041 | −875 | N |
| ATOM | 4425 | CD2 | HIS | B | 84 | 1.211 | 8.469 | 9.548 | 1.00 | 48.54 | C |
| ANISOU | 4425 | CD2 | HIS | B | 84 | 6814 | 6244 | 5383 | 311 | −2807 | −929 | C |
| ATOM | 4426 | CE1 | HIS | B | 84 | −0.569 | 9.370 | 10.462 | 1.00 | 49.11 | C |
| ANISOU | 4426 | CE1 | HIS | B | 84 | 6589 | 6283 | 5789 | 338 | −2932 | −867 | C |
| ATOM | 4427 | NE2 | HIS | B | 84 | 0.688 | 9.031 | 10.689 | 1.00 | 48.73 | N |
| ANISOU | 4427 | NE2 | HIS | B | 84 | 6641 | 6251 | 5625 | 325 | −2797 | −899 | N |
| ATOM | 4428 | N | VAL | B | 85 | −1.301 | 5.665 | 8.702 | 1.00 | 56.43 | N |
| ANISOU | 4428 | N | VAL | B | 85 | 7659 | 7203 | 6580 | 173 | −3046 | −1112 | N |
| ATOM | 4429 | CA | VAL | B | 85 | −2.565 | 5.102 | 9.156 | 1.00 | 60.82 | C |
| ANISOU | 4429 | CA | VAL | B | 85 | 8022 | 7730 | 7356 | 132 | −3122 | −1145 | C |
| ATOM | 4430 | C | VAL | B | 85 | −3.755 | 5.961 | 8.725 | 1.00 | 60.28 | C |
| ANISOU | 4430 | C | VAL | B | 85 | 7878 | 7659 | 7368 | 166 | −3287 | −1078 | C |
| ATOM | 4431 | O | VAL | B | 85 | −4.866 | 5.445 | 8.594 | 1.00 | 58.12 | O |
| ANISOU | 4431 | O | VAL | B | 85 | 7498 | 7365 | 7219 | 131 | −3394 | −1107 | O |
| ATOM | 4432 | CB | VAL | B | 85 | −2.542 | 4.896 | 10.687 | 1.00 | 61.03 | C |
| ANISOU | 4432 | CB | VAL | B | 85 | 7860 | 7737 | 7593 | 115 | −2992 | −1160 | C |
| ATOM | 4433 | CG1 | VAL | B | 85 | −2.595 | 6.237 | 11.423 | 1.00 | 56.79 | C |
| ANISOU | 4433 | CG1 | VAL | B | 85 | 7223 | 7204 | 7149 | 175 | −2964 | −1073 | C |
| ATOM | 4434 | CG2 | VAL | B | 85 | −3.677 | 3.987 | 11.123 | 1.00 | 62.81 | C |
| ANISOU | 4434 | CG2 | VAL | B | 85 | 7914 | 7928 | 8023 | 58 | −3036 | −1209 | C |
| ATOM | 4435 | N | THR | B | 86 | −3.544 | 7.257 | 8.466 | 1.00 | 55.65 | N |
| ANISOU | 4435 | N | THR | B | 86 | 7348 | 7088 | 6710 | 233 | −3314 | −986 | N |
| ATOM | 4436 | CA | THR | B | 86 | −4.622 | 8.148 | 8.046 | 1.00 | 59.69 | C |
| ANISOU | 4436 | CA | THR | B | 86 | 7793 | 7591 | 7294 | 275 | −3468 | −915 | C |
| ATOM | 4437 | C | THR | B | 86 | −4.959 | 8.048 | 6.561 | 1.00 | 64.67 | C |
| ANISOU | 4437 | C | THR | B | 86 | 8582 | 8237 | 7755 | 275 | −3627 | −913 | C |
| ATOM | 4438 | O | THR | B | 86 | −5.868 | 8.751 | 6.104 | 1.00 | 65.43 | O |
| ANISOU | 4438 | O | THR | B | 86 | 8634 | 8328 | 7900 | 311 | −3770 | −853 | O |
| ATOM | 4439 | CB | THR | B | 86 | −4.267 | 9.604 | 8.361 | 1.00 | 59.62 | C |
| ANISOU | 4439 | CB | THR | B | 86 | 7787 | 7584 | 7282 | 350 | −3433 | −812 | C |
| ATOM | 4440 | OG1 | THR | B | 86 | −3.042 | 9.945 | 7.702 | 1.00 | 61.15 | O |
| ANISOU | 4440 | OG1 | THR | B | 86 | 8207 | 7803 | 7226 | 374 | −3378 | −785 | O |
| ATOM | 4441 | CG2 | THR | B | 86 | −4.112 | 9.815 | 9.864 | 1.00 | 52.34 | C |
| ANISOU | 4441 | CG2 | THR | B | 86 | 6691 | 6645 | 6552 | 355 | −3295 | −812 | C |
| ATOM | 4442 | N | LEU | B | 87 | −4.263 | 7.217 | 5.794 | 1.00 | 67.13 | N |
| ANISOU | 4442 | N | LEU | B | 87 | 9075 | 8564 | 7867 | 241 | −3605 | −976 | N |
| ATOM | 4443 | CA | LEU | B | 87 | −4.462 | 7.136 | 4.351 | 1.00 | 71.77 | C |
| ANISOU | 4443 | CA | LEU | B | 87 | 9838 | 9168 | 8263 | 245 | −3743 | −977 | C |
| ATOM | 4444 | C | LEU | B | 87 | −5.036 | 5.776 | 3.970 | 1.00 | 74.64 | C |
| ANISOU | 4444 | C | LEU | B | 87 | 10189 | 9519 | 8652 | 172 | −3816 | −1083 | C |
| ATOM | 4445 | O | LEU | B | 87 | −4.583 | 4.742 | 4.475 | 1.00 | 71.76 | O |
| ANISOU | 4445 | O | LEU | B | 87 | 9808 | 9143 | 8316 | 121 | −3705 | −1165 | O |
| ATOM | 4446 | CB | LEU | B | 87 | −3.145 | 7.388 | 3.612 | 1.00 | 69.90 | C |
| ANISOU | 4446 | CB | LEU | B | 87 | 9855 | 8958 | 7744 | 272 | −3654 | −957 | C |
| ATOM | 4447 | CG | LEU | B | 87 | −2.537 | 8.779 | 3.821 | 1.00 | 65.66 | C |
| ANISOU | 4447 | CG | LEU | B | 87 | 9362 | 8430 | 7156 | 343 | −3592 | −844 | C |

TABLE 11-continued

| | | | | | | | | | | | |
|---|---|---|---|---|---|---|---|---|---|---|---|
| ATOM | 4448 | CD1 | LEU | B | 87 | −1.124 | 8.830 | 3.262 | 1.00 | 62.20 | C |
| ANISOU | 4448 | CD1 | LEU | B | 87 | 9161 | 8015 | 6458 | 358 | −3463 | −835 | C |
| ATOM | 4449 | CD2 | LEU | B | 87 | −3.419 | 9.839 | 3.158 | 1.00 | 67.68 | C |
| ANISOU | 4449 | CD2 | LEU | B | 87 | 9616 | 8682 | 7416 | 396 | −3761 | −749 | C |
| ATOM | 4450 | N | SER | B | 88 | −6.038 | 5.784 | 3.081 | 1.00 | 77.99 | N |
| ANISOU | 4450 | N | SER | B | 88 | 10622 | 9943 | 9069 | 169 | −4008 | −1079 | N |
| ATOM | 4451 | CA | SER | B | 88 | −6.610 | 4.533 | 2.587 | 1.00 | 77.99 | C |
| ANISOU | 4451 | CA | SER | B | 88 | 10627 | 9928 | 9078 | 99 | −4100 | −1179 | C |
| ATOM | 4452 | C | SER | B | 88 | −5.578 | 3.742 | 1.796 | 1.00 | 82.16 | C |
| ANISOU | 4452 | C | SER | B | 88 | 11393 | 10470 | 9355 | 75 | −4031 | −1251 | C |
| ATOM | 4453 | O | SER | B | 88 | −5.433 | 2.526 | 1.972 | 1.00 | 90.05 | O |
| ANISOU | 4453 | O | SER | B | 88 | 12388 | 11449 | 10378 | 13 | −3978 | −1351 | O |
| ATOM | 4454 | CB | SER | B | 88 | −7.835 | 4.819 | 1.718 | 1.00 | 83.06 | C |
| ANISOU | 4454 | CB | SER | B | 88 | 11245 | 10570 | 9745 | 107 | −4331 | −1155 | C |
| ATOM | 4455 | OG | SER | B | 88 | −8.741 | 5.689 | 2.369 | 1.00 | 88.10 | O |
| ANISOU | 4455 | OG | SER | B | 88 | 11675 | 11195 | 10603 | 143 | −4388 | −1078 | O |
| ATOM | 4456 | N | GLN | B | 89 | −4.872 | 4.416 | 0.903 | 1.00 | 79.07 | N |
| ANISOU | 4456 | N | GLN | B | 89 | 11213 | 10108 | 8723 | 126 | −4026 | −1200 | N |
| ATOM | 4457 | CA | GLN | B | 89 | −3.742 | 3.872 | 0.171 | 1.00 | 80.92 | C |
| ANISOU | 4457 | CA | GLN | B | 89 | 11687 | 10357 | 8702 | 120 | −3926 | −1252 | C |
| ATOM | 4458 | C | GLN | B | 89 | −2.716 | 4.987 | 0.047 | 1.00 | 75.90 | C |
| ANISOU | 4458 | C | GLN | B | 89 | 11183 | 9748 | 7907 | 189 | −3816 | −1155 | C |
| ATOM | 4459 | O | GLN | B | 89 | −3.035 | 6.152 | 0.303 | 1.00 | 71.60 | O |
| ANISOU | 4459 | O | GLN | B | 89 | 10565 | 9209 | 7432 | 240 | −3860 | −1053 | O |
| ATOM | 4460 | CB | GLN | B | 89 | −4.168 | 3.339 | −1.204 | 1.00 | 91.19 | C |
| ANISOU | 4460 | CB | GLN | B | 89 | 13149 | 11663 | 9836 | 100 | −4080 | −1304 | C |
| ATOM | 4461 | CG | GLN | B | 89 | −4.470 | 1.848 | −1.185 | 1.00 | 97.14 | C |
| ANISOU | 4461 | CG | GLN | B | 89 | 13871 | 12387 | 10651 | 19 | −4097 | −1436 | C |
| ATOM | 4462 | CD | GLN | B | 89 | −4.846 | 1.313 | −2.543 | 1.00 | 103.69 | C |
| ANISOU | 4462 | CD | GLN | B | 89 | 14870 | 13219 | 11307 | −2 | −4249 | −1496 | C |
| ATOM | 4463 | OE1 | GLN | B | 89 | −5.201 | 0.142 | −2.684 | 1.00 | 109.06 | O |
| ANISOU | 4463 | OE1 | GLN | B | 89 | 15538 | 13872 | 12027 | −68 | −4294 | −1603 | O |
| ATOM | 4464 | NE2 | GLN | B | 89 | −4.771 | 2.168 | −3.557 | 1.00 | 104.08 | N |
| ANISOU | 4464 | NE2 | GLN | B | 89 | 15084 | 13299 | 11161 | 53 | −4332 | −1426 | N |
| ATOM | 4465 | N | PRO | B | 90 | −1.470 | 4.662 | −0.307 | 1.00 | 79.67 | N |
| ANISOU | 4465 | N | PRO | B | 90 | 11851 | 10238 | 8182 | 194 | −3663 | −1184 | N |
| ATOM | 4466 | CA | PRO | B | 90 | −0.426 | 5.694 | −0.324 | 1.00 | 74.96 | C |
| ANISOU | 4466 | CA | PRO | B | 90 | 11371 | 9663 | 7448 | 255 | −3535 | −1091 | C |
| ATOM | 4467 | C | PRO | B | 90 | −0.805 | 6.893 | −1.185 | 1.00 | 76.65 | C |
| ANISOU | 4467 | C | PRO | B | 90 | 11679 | 9892 | 7551 | 313 | −3661 | −980 | C |
| ATOM | 4468 | O | PRO | B | 90 | −1.588 | 6.790 | −2.132 | 1.00 | 72.92 | O |
| ANISOU | 4468 | O | PRO | B | 90 | 11268 | 9424 | 7015 | 309 | −3831 | −988 | O |
| ATOM | 4469 | CB | PRO | B | 90 | 0.795 | 4.956 | −0.888 | 1.00 | 71.76 | C |
| ANISOU | 4469 | CB | PRO | B | 90 | 11179 | 9267 | 6822 | 246 | −3378 | −1154 | C |
| ATOM | 4470 | CG | PRO | B | 90 | 0.263 | 3.670 | −1.458 | 1.00 | 76.35 | C |
| ANISOU | 4470 | CG | PRO | B | 90 | 11791 | 9833 | 7387 | 189 | −3465 | −1273 | C |
| ATOM | 4471 | CD | PRO | B | 90 | −0.911 | 3.333 | −0.609 | 1.00 | 78.12 | C |
| ANISOU | 4471 | CD | PRO | B | 90 | 11761 | 10031 | 7888 | 146 | −3579 | −1303 | C |
| ATOM | 4472 | N | LYS | B | 91 | −0.253 | 8.047 | −0.821 | 1.00 | 77.01 | N |
| ANISOU | 4472 | N | LYS | B | 91 | 11734 | 9945 | 7583 | 367 | −3580 | −873 | N |
| ATOM | 4473 | CA | LYS | B | 91 | −0.497 | 9.308 | −1.511 | 1.00 | 81.17 | C |
| ANISOU | 4473 | CA | LYS | B | 91 | 12347 | 10478 | 8015 | 428 | −3674 | −750 | C |
| ATOM | 4474 | C | LYS | B | 91 | 0.786 | 9.686 | −2.241 | 1.00 | 80.33 | C |
| ANISOU | 4474 | C | LYS | B | 91 | 12495 | 10390 | 7637 | 461 | −3529 | −700 | C |
| ATOM | 4475 | O | LYS | B | 91 | 1.791 | 10.030 | −1.606 | 1.00 | 83.14 | O |
| ANISOU | 4475 | O | LYS | B | 91 | 12862 | 10746 | 7983 | 476 | −3352 | −667 | O |
| ATOM | 4476 | CB | LYS | B | 91 | −0.922 | 10.388 | −0.517 | 1.00 | 82.45 | C |
| ANISOU | 4476 | CB | LYS | B | 91 | 12317 | 10623 | 8387 | 464 | −3693 | −659 | C |
| ATOM | 4477 | CG | LYS | B | 91 | −1.411 | 11.678 | −1.147 | 1.00 | 91.93 | C |
| ANISOU | 4477 | CG | LYS | B | 91 | 13568 | 11820 | 9540 | 528 | −3817 | −532 | C |
| ATOM | 4478 | CD | LYS | B | 91 | −1.548 | 12.774 | −0.095 | 1.00 | 96.12 | C |
| ANISOU | 4478 | CD | LYS | B | 91 | 13933 | 12327 | 10262 | 570 | −3788 | −442 | C |
| ATOM | 4479 | CE | LYS | B | 91 | −1.942 | 14.104 | −0.726 | 1.00 | 103.78 | C |
| ANISOU | 4479 | CE | LYS | B | 91 | 14966 | 13285 | 11180 | 639 | −3896 | −307 | C |
| ATOM | 4480 | NZ | LYS | B | 91 | −1.979 | 15.217 | 0.266 | 1.00 | 102.15 | N |
| ANISOU | 4480 | NZ | LYS | B | 91 | 14618 | 13048 | 11148 | 686 | −3853 | −217 | N |
| ATOM | 4481 | N | ILE | B | 92 | 0.759 | 9.607 | −3.567 | 1.00 | 70.70 | N |
| ANISOU | 4481 | N | ILE | B | 92 | 11480 | 9186 | 6198 | 472 | −3598 | −696 | N |
| ATOM | 4482 | CA | ILE | B | 92 | 1.924 | 9.904 | −4.392 | 1.00 | 70.02 | C |
| ANISOU | 4482 | CA | ILE | B | 92 | 11648 | 9115 | 5840 | 503 | −3454 | −648 | C |
| ATOM | 4483 | C | ILE | B | 92 | 1.935 | 11.392 | −4.720 | 1.00 | 74.15 | C |
| ANISOU | 4483 | C | ILE | B | 92 | 12239 | 9637 | 6300 | 567 | −3486 | −491 | C |
| ATOM | 4484 | O | ILE | B | 92 | 0.953 | 11.930 | −5.243 | 1.00 | 75.07 | O |
| ANISOU | 4484 | O | ILE | B | 92 | 12340 | 9750 | 6433 | 591 | −3678 | −437 | O |
| ATOM | 4485 | CB | ILE | B | 92 | 1.920 | 9.056 | −5.674 | 1.00 | 76.58 | C |
| ANISOU | 4485 | CB | ILE | B | 92 | 12679 | 9960 | 6457 | 484 | −3501 | −724 | C |
| ATOM | 4486 | CG1 | ILE | B | 92 | 2.236 | 7.595 | −5.346 | 1.00 | 77.20 | C |
| ANISOU | 4486 | CG1 | ILE | B | 92 | 12727 | 10033 | 6573 | 425 | −3413 | −875 | C |
| ATOM | 4487 | CG2 | ILE | B | 92 | 2.905 | 9.610 | −6.692 | 1.00 | 77.54 | C |
| ANISOU | 4487 | CG2 | ILE | B | 92 | 13069 | 10096 | 6294 | 528 | −3380 | −648 | C |

TABLE 11-continued

| | | | | | | | | | | | |
|---|---|---|---|---|---|---|---|---|---|---|---|
| ATOM | 4488 | CD1 | ILE | B | 92 | 2.266 | 6.691 | −6.554 | 1.00 | 79.71 | C |
| ANISOU | 4488 | CD1 | ILE | B | 92 | 13241 | 10359 | 6688 | 405 | −3449 | −962 | C |
| ATOM | 4489 | N | VAL | B | 93 | 3.042 | 12.060 | −4.405 | 1.00 | 72.22 | N |
| ANISOU | 4489 | N | VAL | B | 93 | 12063 | 9389 | 5988 | 595 | −3298 | −414 | N |
| ATOM | 4490 | CA | VAL | B | 93 | 3.236 | 13.471 | −4.725 | 1.00 | 75.52 | C |
| ANISOU | 4490 | CA | VAL | B | 93 | 12567 | 9797 | 6329 | 654 | −3293 | −257 | C |
| ATOM | 4491 | C | VAL | B | 93 | 4.403 | 13.571 | −5.695 | 1.00 | 76.78 | C |
| ANISOU | 4491 | C | VAL | B | 93 | 12999 | 9971 | 6205 | 671 | −3124 | −214 | C |
| ATOM | 4492 | O | VAL | B | 93 | 5.528 | 13.174 | −5.365 | 1.00 | 74.58 | O |
| ANISOU | 4492 | O | VAL | B | 93 | 12769 | 9697 | 5872 | 656 | −2911 | −247 | O |
| ATOM | 4493 | CB | VAL | B | 93 | 3.493 | 14.321 | −3.471 | 1.00 | 74.14 | C |
| ANISOU | 4493 | CB | VAL | B | 93 | 12234 | 9598 | 6339 | 673 | −3215 | −184 | C |
| ATOM | 4494 | CG1 | VAL | B | 93 | 3.659 | 15.780 | −3.859 | 1.00 | 78.09 | C |
| ANISOU | 4494 | CG1 | VAL | B | 93 | 12831 | 10077 | 6762 | 733 | −3215 | −18 | C |
| ATOM | 4495 | CG2 | VAL | B | 93 | 2.360 | 14.156 | −2.473 | 1.00 | 71.97 | C |
| ANISOU | 4495 | CG2 | VAL | B | 93 | 11685 | 9308 | 6353 | 656 | −3358 | −234 | C |
| ATOM | 4496 | N | LYS | B | 94 | 4.135 | 14.098 | −6.885 | 1.00 | 79.60 | N |
| ANISOU | 4496 | N | LYS | B | 94 | 13526 | 10332 | 6385 | 705 | −3214 | −140 | N |
| ATOM | 4497 | CA | LYS | B | 94 | 5.153 | 14.218 | −7.917 | 1.00 | 84.66 | C |
| ANISOU | 4497 | CA | LYS | B | 94 | 14432 | 10985 | 6749 | 723 | −3058 | −93 | C |
| ATOM | 4498 | C | LYS | B | 94 | 6.072 | 15.399 | −7.633 | 1.00 | 83.56 | C |
| ANISOU | 4498 | C | LYS | B | 94 | 14345 | 10825 | 6577 | 759 | −2885 | 53 | C |
| ATOM | 4499 | O | LYS | B | 94 | 5.656 | 16.422 | −7.081 | 1.00 | 80.12 | O |
| ANISOU | 4499 | O | LYS | B | 94 | 13797 | 10363 | 6281 | 787 | −2956 | 153 | O |
| ATOM | 4500 | CB | LYS | B | 94 | 4.501 | 14.384 | −9.291 | 1.00 | 85.27 | C |
| ANISOU | 4500 | CB | LYS | B | 94 | 14678 | 11075 | 6647 | 747 | −3223 | −62 | C |
| ATOM | 4501 | CG | LYS | B | 94 | 3.269 | 13.520 | −9.472 | 1.00 | 88.08 | C |
| ANISOU | 4501 | CG | LYS | B | 94 | 14938 | 11441 | 7088 | 716 | −3458 | −177 | C |
| ATOM | 4502 | CD | LYS | B | 94 | 2.864 | 13.387 | −10.931 | 1.00 | 92.66 | C |
| ANISOU | 4502 | CD | LYS | B | 94 | 15726 | 12038 | 7442 | 730 | −3588 | −177 | C |
| ATOM | 4503 | CE | LYS | B | 94 | 1.751 | 12.360 | −11.074 | 1.00 | 91.71 | C |
| ANISOU | 4503 | CE | LYS | B | 94 | 15512 | 11925 | 7406 | 688 | −3801 | −309 | C |
| ATOM | 4504 | NZ | LYS | B | 94 | 2.023 | 11.160 | −10.221 | 1.00 | 82.27 | N |
| ANISOU | 4504 | NZ | LYS | B | 94 | 14188 | 10728 | 6344 | 629 | −3704 | −452 | N |
| ATOM | 4505 | N | TRP | B | 95 | 7.336 | 15.249 | −8.017 | 1.00 | 84.11 | N |
| ANISOU | 4505 | N | TRP | B | 95 | 14585 | 10903 | 6471 | 758 | −2647 | 66 | N |
| ATOM | 4506 | CA | TRP | B | 95 | 8.295 | 16.335 | −7.871 | 1.00 | 82.56 | C |
| ANISOU | 4506 | CA | TRP | B | 95 | 14459 | 10684 | 6227 | 785 | −2461 | 211 | C |
| ATOM | 4507 | C | TRP | B | 95 | 8.108 | 17.333 | −9.004 | 1.00 | 83.56 | C |
| ANISOU | 4507 | C | TRP | B | 95 | 14765 | 10801 | 6185 | 830 | −2520 | 349 | C |
| ATOM | 4508 | O | TRP | B | 95 | 8.298 | 16.993 | −10.177 | 1.00 | 81.16 | O |
| ANISOU | 4508 | O | TRP | B | 95 | 14660 | 10517 | 5661 | 836 | −2498 | 336 | O |
| ATOM | 4509 | CB | TRP | B | 95 | 9.728 | 15.814 | −7.859 | 1.00 | 82.41 | C |
| ANISOU | 4509 | CB | TRP | B | 95 | 14540 | 10674 | 6097 | 766 | −2169 | 180 | C |
| ATOM | 4510 | CG | TRP | B | 95 | 10.733 | 16.933 | −7.824 | 1.00 | 86.44 | C |
| ANISOU | 4510 | CG | TRP | B | 95 | 15134 | 11158 | 6552 | 789 | −1967 | 336 | C |
| ATOM | 4511 | CD1 | TRP | B | 95 | 10.744 | 18.003 | −6.968 | 1.00 | 84.66 | C |
| ANISOU | 4511 | CD1 | TRP | B | 95 | 14796 | 10895 | 6474 | 802 | −1963 | 447 | C |
| ATOM | 4512 | CD2 | TRP | B | 95 | 11.869 | 17.096 | −8.681 | 1.00 | 88.07 | C |
| ANISOU | 4512 | CD2 | TRP | B | 95 | 15547 | 11366 | 6548 | 798 | −1731 | 402 | C |
| ATOM | 4513 | NE1 | TRP | B | 95 | 11.814 | 18.818 | −7.241 | 1.00 | 83.25 | N |
| ANISOU | 4513 | NE1 | TRP | B | 95 | 14744 | 10693 | 6195 | 813 | −1742 | 580 | N |
| ATOM | 4514 | CE2 | TRP | B | 95 | 12.522 | 18.284 | −8.288 | 1.00 | 87.02 | C |
| ANISOU | 4514 | CE2 | TRP | B | 95 | 15412 | 11195 | 6456 | 810 | −1592 | 557 | C |
| ATOM | 4515 | CE3 | TRP | B | 95 | 12.399 | 16.354 | −9.741 | 1.00 | 91.13 | C |
| ANISOU | 4515 | CE3 | TRP | B | 95 | 16121 | 11779 | 6726 | 797 | −1618 | 346 | C |
| ATOM | 4516 | CZ2 | TRP | B | 95 | 13.676 | 18.745 | −8.920 | 1.00 | 87.82 | C |
| ANISOU | 4516 | CZ2 | TRP | B | 95 | 15677 | 11284 | 6405 | 817 | −1338 | 660 | C |
| ATOM | 4517 | CZ3 | TRP | B | 95 | 13.545 | 16.814 | −10.367 | 1.00 | 90.04 | C |
| ANISOU | 4517 | CZ3 | TRP | B | 95 | 16147 | 11632 | 6433 | 809 | −1366 | 445 | C |
| ATOM | 4518 | CH2 | TRP | B | 95 | 14.170 | 17.999 | −9.954 | 1.00 | 88.15 | C |
| ANISOU | 4518 | CH2 | TRP | B | 95 | 15890 | 11356 | 6248 | 817 | −1226 | 602 | C |
| ATOM | 4519 | N | ASP | B | 96 | 7.739 | 18.561 | −8.648 | 1.00 | 88.56 | N |
| ANISOU | 4519 | N | ASP | B | 96 | 15329 | 11399 | 6922 | 863 | −2592 | 481 | N |
| ATOM | 4520 | CA | ASP | B | 96 | 7.592 | 19.663 | −9.598 | 1.00 | 93.02 | C |
| ANISOU | 4520 | CA | ASP | B | 96 | 16048 | 11944 | 7352 | 909 | −2638 | 633 | C |
| ATOM | 4521 | C | ASP | B | 96 | 8.817 | 20.561 | −9.454 | 1.00 | 98.73 | C |
| ANISOU | 4521 | C | ASP | B | 96 | 16858 | 12633 | 8022 | 919 | −2384 | 769 | C |
| ATOM | 4522 | O | ASP | B | 96 | 8.870 | 21.420 | −8.570 | 1.00 | 98.98 | O |
| ANISOU | 4522 | O | ASP | B | 96 | 16769 | 12622 | 8218 | 929 | −2363 | 855 | O |
| ATOM | 4523 | CB | ASP | B | 96 | 6.299 | 20.431 | −9.338 | 1.00 | 90.10 | C |
| ANISOU | 4523 | CB | ASP | B | 96 | 15537 | 11549 | 7147 | 943 | −2893 | 692 | C |
| ATOM | 4524 | CG | ASP | B | 96 | 6.047 | 21.523 | −10.365 | 1.00 | 96.74 | C |
| ANISOU | 4524 | CG | ASP | B | 96 | 16537 | 12369 | 7850 | 995 | −2964 | 847 | C |
| ATOM | 4525 | OD1 | ASP | B | 96 | 6.687 | 21.503 | −11.438 | 1.00 | 98.88 | O |
| ANISOU | 4525 | OD1 | ASP | B | 96 | 17038 | 12655 | 7875 | 1001 | −2855 | 886 | O |
| ATOM | 4526 | OD2 | ASP | B | 96 | 5.206 | 22.406 | −10.098 | 1.00 | 97.52 | O |
| ANISOU | 4526 | OD2 | ASP | B | 96 | 16528 | 12435 | 8090 | 1032 | −3124 | 931 | O |
| ATOM | 4527 | N | ARG | B | 97 | 9.810 | 20.350 | −10.322 | 1.00 | 102.43 | N |
| ANISOU | 4527 | N | ARG | B | 97 | 17534 | 13116 | 8268 | 914 | −2185 | 789 | N |

TABLE 11-continued

| | | | | | | | | | | | |
|---|---|---|---|---|---|---|---|---|---|---|---|
| ATOM | 4528 | CA | ARG | B | 97 | 11.020 | 21.166 | −10.272 | 1.00 | 104.64 | C |
| ANISOU | 4528 | CA | ARG | B | 97 | 17899 | 13362 | 8497 | 916 | −1922 | 921 | C |
| ATOM | 4529 | C | ARG | B | 97 | 10.703 | 22.635 | −10.516 | 1.00 | 107.18 | C |
| ANISOU | 4529 | C | ARG | B | 97 | 18259 | 13633 | 8833 | 956 | −1988 | 1105 | C |
| ATOM | 4530 | O | ARG | B | 97 | 11.322 | 23.522 | −9.916 | 1.00 | 106.98 | O |
| ANISOU | 4530 | O | ARG | B | 97 | 18192 | 13556 | 8899 | 955 | −1847 | 1219 | O |
| ATOM | 4531 | CB | ARG | B | 97 | 12.038 | 20.656 | −11.292 | 1.00 | 104.74 | C |
| ANISOU | 4531 | CB | ARG | B | 97 | 18126 | 13401 | 8270 | 907 | −1703 | 908 | C |
| ATOM | 4532 | CG | ARG | B | 97 | 11.450 | 20.309 | −12.645 | 1.00 | 107.72 | C |
| ANISOU | 4532 | CG | ARG | B | 97 | 18683 | 13809 | 8436 | 929 | −1842 | 880 | C |
| ATOM | 4533 | CD | ARG | B | 97 | 12.381 | 19.382 | −13.412 | 1.00 | 110.76 | C |
| ANISOU | 4533 | CD | ARG | B | 97 | 19236 | 14226 | 8623 | 914 | −1637 | 802 | C |
| ATOM | 4534 | NE | ARG | B | 97 | 13.675 | 20.002 | −13.689 | 1.00 | 111.61 | N |
| ANISOU | 4534 | NE | ARG | B | 97 | 19458 | 14309 | 8638 | 916 | −1336 | 923 | N |
| ATOM | 4535 | CZ | ARG | B | 97 | 14.752 | 19.333 | −14.090 | 1.00 | 111.03 | C |
| ANISOU | 4535 | CZ | ARG | B | 97 | 19488 | 14252 | 8445 | 902 | −1085 | 874 | C |
| ATOM | 4536 | NH1 | ARG | B | 97 | 14.694 | 18.017 | −14.254 | 1.00 | 110.22 | N |
| ANISOU | 4536 | NH1 | ARG | B | 97 | 19397 | 14186 | 8295 | 888 | −1102 | 705 | N |
| ATOM | 4537 | NH2 | ARG | B | 97 | 15.890 | 19.977 | −14.320 | 1.00 | 109.15 | N |
| ANISOU | 4537 | NH2 | ARG | B | 97 | 19333 | 13989 | 8150 | 901 | −811 | 996 | N |
| ATOM | 4538 | N | ASP | B | 98 | 9.728 | 22.909 | −11.379 | 1.00 | 109.99 | N |
| ANISOU | 4538 | N | ASP | B | 98 | 18688 | 13996 | 9106 | 992 | −2205 | 1137 | N |
| ATOM | 4539 | CA | ASP | B | 98 | 9.295 | 24.262 | −11.695 | 1.00 | 112.94 | C |
| ANISOU | 4539 | CA | ASP | B | 98 | 19100 | 14321 | 9491 | 1038 | −2296 | 1308 | C |
| ATOM | 4540 | C | ASP | B | 98 | 8.336 | 24.837 | −10.656 | 1.00 | 113.90 | C |
| ANISOU | 4540 | C | ASP | B | 98 | 18993 | 14405 | 9881 | 1058 | −2485 | 1326 | C |
| ATOM | 4541 | O | ASP | B | 98 | 7.573 | 25.754 | −10.983 | 1.00 | 114.65 | O |
| ANISOU | 4541 | O | ASP | B | 98 | 19091 | 14467 | 10004 | 1105 | −2644 | 1434 | O |
| ATOM | 4542 | CB | ASP | B | 98 | 8.638 | 24.283 | −13.078 | 1.00 | 113.89 | C |
| ANISOU | 4542 | CB | ASP | B | 98 | 19398 | 14468 | 9407 | 1073 | −2455 | 1333 | C |
| ATOM | 4543 | CG | ASP | B | 98 | 9.296 | 23.321 | −14.048 | 1.00 | 115.84 | C |
| ANISOU | 4543 | CG | ASP | B | 98 | 19842 | 14765 | 9406 | 1052 | −2328 | 1251 | C |
| ATOM | 4544 | OD1 | ASP | B | 98 | 10.520 | 23.105 | −13.931 | 1.00 | 116.07 | O |
| ANISOU | 4544 | OD1 | ASP | B | 98 | 19929 | 14793 | 9379 | 1024 | −2052 | 1250 | O |
| ATOM | 4545 | OD2 | ASP | B | 98 | 8.590 | 22.773 | −14.922 | 1.00 | 115.97 | O |
| ANISOU | 4545 | OD2 | ASP | B | 98 | 19952 | 14820 | 9291 | 1063 | −2501 | 1184 | O |
| ATOM | 4546 | N | MET | B | 99 | 8.362 | 24.322 | −9.429 | 1.00 | 115.09 | N |
| ANISOU | 4546 | N | MET | B | 99 | 18945 | 14556 | 10227 | 1027 | −2467 | 1226 | N |
| ATOM | 4547 | CA | MET | B | 99 | 7.440 | 24.734 | −8.374 | 1.00 | 118.05 | C |
| ANISOU | 4547 | CA | MET | B | 99 | 19088 | 14897 | 10868 | 1044 | −2639 | 1222 | C |
| ATOM | 4548 | C | MET | B | 99 | 7.454 | 26.249 | −8.167 | 1.00 | 124.56 | C |
| ANISOU | 4548 | C | MET | B | 99 | 19906 | 15641 | 11781 | 1086 | −2623 | 1404 | C |
| ATOM | 4549 | O | MET | B | 99 | 8.459 | 26.910 | −8.433 | 1.00 | 126.27 | O |
| ANISOU | 4549 | O | MET | B | 99 | 20256 | 15821 | 11901 | 1081 | −2419 | 1522 | O |
| ATOM | 4550 | CB | MET | B | 99 | 7.791 | 24.019 | −7.065 | 1.00 | 117.45 | C |
| ANISOU | 4550 | CB | MET | B | 99 | 18831 | 14830 | 10964 | 1001 | −2555 | 1104 | C |
| ATOM | 4551 | CG | MET | B | 99 | 6.744 | 24.149 | −5.974 | 1.00 | 117.89 | C |
| ANISOU | 4551 | CG | MET | B | 99 | 18634 | 14864 | 11296 | 1014 | −2741 | 1060 | C |
| ATOM | 4552 | SD | MET | B | 99 | 5.209 | 23.322 | −6.423 | 1.00 | 122.28 | S |
| ANISOU | 4552 | SD | MET | B | 99 | 19098 | 15470 | 11892 | 1020 | −3037 | 938 | S |
| ATOM | 4553 | CE | MET | B | 99 | 4.180 | 23.733 | −5.018 | 1.00 | 117.69 | C |
| ANISOU | 4553 | CE | MET | B | 99 | 18207 | 14848 | 11663 | 1040 | −3186 | 920 | C |
| ATOM | 4554 | OXT | MET | B | 99 | 6.464 | 26.851 | −7.743 | 1.00 | 126.01 | O |
| ANISOU | 4554 | OXT | MET | B | 99 | 19947 | 15789 | 12141 | 1124 | −2807 | 1438 | O |
| TER | | | | | | | | | | | |
| HETATM | 4555 | O | HOH | S | 1 | 10.683 | −2.459 | 35.571 | 1.00 | 32.19 | O |
| ANISOU | 4555 | O | HOH | S | 1 | 3572 | 3956 | 4703 | 51 | −163 | −881 | O |
| HETATM | 4556 | O | HOH | S | 2 | 11.818 | 13.126 | 45.148 | 1.00 | 33.22 | O |
| ANISOU | 4556 | O | HOH | S | 2 | 4257 | 4068 | 4296 | 196 | −96 | −1000 | O |
| HETATM | 4557 | O | HOH | S | 3 | 18.037 | 37.139 | 30.914 | 1.00 | 33.91 | O |
| ANISOU | 4557 | O | HOH | S | 3 | 4830 | 2619 | 5435 | −164 | −622 | −327 | O |
| HETATM | 4558 | O | HOH | S | 4 | 11.435 | 1.038 | 32.957 | 1.00 | 30.21 | O |
| ANISOU | 4558 | O | HOH | S | 4 | 3355 | 3815 | 4307 | 82 | −340 | −913 | O |
| HETATM | 4559 | O | HOH | S | 5 | 15.521 | 2.734 | 42.311 | 1.00 | 32.97 | O |
| ANISOU | 4559 | O | HOH | S | 5 | 3948 | 4227 | 4350 | 139 | −171 | −705 | O |
| HETATM | 4560 | O | HOH | S | 6 | 18.553 | 3.324 | 38.495 | 1.00 | 27.54 | O |
| ANISOU | 4560 | O | HOH | S | 6 | 3136 | 3602 | 3725 | 121 | −307 | −701 | O |
| HETATM | 4561 | O | HOH | S | 7 | 8.639 | 7.666 | 39.644 | 1.00 | 33.56 | O |
| ANISOU | 4561 | O | HOH | S | 7 | 3798 | 4192 | 4763 | 180 | −108 | −884 | O |
| HETATM | 4562 | O | HOH | S | 8 | 2.422 | 11.818 | 22.659 | 1.00 | 35.49 | O |
| ANISOU | 4562 | O | HOH | S | 8 | 3955 | 4437 | 5093 | 340 | −1506 | −789 | O |
| HETATM | 4563 | O | HOH | S | 9 | 16.319 | −9.551 | 29.982 | 1.00 | 32.34 | O |
| ANISOU | 4563 | O | HOH | S | 9 | 3882 | 3760 | 4644 | 170 | −71 | −1054 | O |
| HETATM | 4564 | O | HOH | S | 10 | 11.817 | 8.839 | 41.672 | 1.00 | 32.12 | O |
| ANISOU | 4564 | O | HOH | S | 10 | 3828 | 4044 | 4332 | 160 | −149 | −870 | O |
| HETATM | 4565 | O | HOH | S | 11 | 7.572 | 9.293 | 44.138 | 1.00 | 34.12 | O |
| ANISOU | 4565 | O | HOH | S | 11 | 4057 | 4190 | 4716 | 251 | 173 | −928 | O |
| HETATM | 4566 | O | HOH | S | 12 | 12.079 | −0.090 | 35.661 | 1.00 | 27.43 | O |
| ANISOU | 4566 | O | HOH | S | 12 | 3012 | 3441 | 3968 | 88 | −210 | −853 | O |
| HETATM | 4567 | O | HOH | S | 13 | 13.625 | 15.320 | 38.633 | 1.00 | 35.21 | O |

TABLE 11-continued

| | | | | | | | | | | | | |
|---|---|---|---|---|---|---|---|---|---|---|---|---|
| ANISOU | 4567 | O | HOH | S | 13 | 4279 | 4324 | 4774 | 125 | −397 | −886 | O |
| HETATM | 4568 | O | HOH | S | 14 | 9.384 | −7.921 | 46.057 | 1.00 | 38.41 | | O |
| ANISOU | 4568 | O | HOH | S | 14 | 4655 | 4474 | 5464 | 75 | 543 | −425 | O |
| HETATM | 4569 | O | HOH | S | 15 | 23.404 | 15.562 | 24.845 | 1.00 | 35.89 | | O |
| ANISOU | 4569 | O | HOH | S | 15 | 4412 | 4574 | 4650 | −59 | −187 | −337 | O |
| HETATM | 4570 | O | HOH | S | 16 | 6.821 | 19.424 | 41.785 | 1.00 | 30.43 | | O |
| ANISOU | 4570 | O | HOH | S | 16 | 3695 | 3399 | 4470 | 419 | −51 | −1080 | O |
| HETATM | 4571 | O | HOH | S | 17 | 5.463 | −0.087 | 28.961 | 1.00 | 40.40 | | O |
| ANISOU | 4571 | O | HOH | S | 17 | 4440 | 4997 | 5914 | −14 | −705 | −1105 | O |
| HETATM | 4572 | O | HOH | S | 18 | 3.673 | 7.502 | 17.495 | 1.00 | 41.08 | | O |
| ANISOU | 4572 | O | HOH | S | 18 | 5146 | 5248 | 5216 | 213 | −1829 | −974 | O |
| HETATM | 4573 | O | HOH | S | 19 | −4.906 | 8.311 | 24.679 | 1.00 | 37.49 | | O |
| ANISOU | 4573 | O | HOH | S | 19 | 3291 | 4570 | 6381 | 258 | −1731 | −974 | O |
| HETATM | 4574 | O | HOH | S | 20 | 25.388 | −3.194 | 41.651 | 1.00 | 33.65 | | O |
| ANISOU | 4574 | O | HOH | S | 20 | 3795 | 4361 | 4630 | 323 | −398 | −381 | O |
| HETATM | 4575 | O | HOH | S | 21 | 5.717 | −4.678 | 24.420 | 1.00 | 39.43 | | O |
| ANISOU | 4575 | O | HOH | S | 21 | 4588 | 4744 | 5650 | −130 | −968 | −1381 | O |
| HETATM | 4576 | O | HOH | S | 22 | −8.341 | 12.860 | 29.104 | 1.00 | 43.54 | | O |
| ANISOU | 4576 | O | HOH | S | 22 | 3501 | 5152 | 7888 | 575 | −1255 | −834 | O |
| HETATM | 4577 | O | HOH | S | 23 | 21.020 | 17.771 | 35.560 | 1.00 | 34.95 | | O |
| ANISOU | 4577 | O | HOH | S | 23 | 4201 | 4298 | 4780 | −131 | −570 | −690 | O |
| HETATM | 4578 | O | HOH | S | 24 | 12.890 | 14.885 | 11.824 | 1.00 | 42.35 | | O |
| ANISOU | 4578 | O | HOH | S | 24 | 6450 | 5448 | 4191 | 358 | −1109 | −287 | O |
| HETATM | 4579 | O | HOH | S | 25 | 27.335 | −10.933 | 44.450 | 1.00 | 36.99 | | O |
| ANISOU | 4579 | O | HOH | S | 25 | 4290 | 4498 | 5265 | 643 | −348 | −23 | O |
| HETATM | 4580 | O | HOH | S | 26 | 20.088 | 1.061 | 35.933 | 1.00 | 35.68 | | O |
| ANISOU | 4580 | O | HOH | S | 26 | 4105 | 4633 | 4820 | 156 | −259 | −689 | O |
| HETATM | 4581 | O | HOH | S | 27 | 12.444 | 11.492 | 54.878 | 1.00 | 44.95 | | O |
| ANISOU | 4581 | O | HOH | S | 27 | 6649 | 5548 | 4880 | 270 | 195 | −1070 | O |
| HETATM | 4582 | O | HOH | S | 28 | 7.433 | −13.037 | 41.786 | 1.00 | 42.33 | | O |
| ANISOU | 4582 | O | HOH | S | 28 | 4898 | 4627 | 6560 | −114 | 506 | −570 | O |
| HETATM | 4583 | O | HOH | S | 29 | 10.979 | 4.266 | 26.119 | 1.00 | 31.95 | | O |
| ANISOU | 4583 | O | HOH | S | 29 | 3769 | 4105 | 4263 | 114 | −691 | −956 | O |
| HETATM | 4584 | O | HOH | S | 30 | 17.912 | 18.291 | 39.861 | 1.00 | 33.52 | | O |
| ANISOU | 4584 | O | HOH | S | 30 | 4201 | 4033 | 4501 | −39 | −559 | −894 | O |
| HETATM | 4585 | O | HOH | S | 31 | 6.656 | −1.416 | 23.850 | 1.00 | 35.17 | | O |
| ANISOU | 4585 | O | HOH | S | 31 | 4115 | 4346 | 4902 | −29 | −996 | −1263 | O |
| HETATM | 4586 | O | HOH | S | 32 | 11.939 | 5.857 | 59.100 | 1.00 | 47.97 | | O |
| ANISOU | 4586 | O | HOH | S | 32 | 7440 | 5995 | 4793 | 352 | 528 | −738 | O |
| HETATM | 4587 | O | HOH | S | 33 | 17.297 | 0.989 | 35.616 | 1.00 | 31.63 | | O |
| ANISOU | 4587 | O | HOH | S | 33 | 3617 | 4079 | 4323 | 135 | −246 | −756 | O |
| HETATM | 4588 | O | HOH | S | 34 | 22.122 | 4.894 | 40.819 | 1.00 | 46.84 | | O |
| ANISOU | 4588 | O | HOH | S | 34 | 5587 | 6100 | 6110 | 90 | −473 | −628 | O |
| HETATM | 4589 | O | HOH | S | 35 | 21.575 | 5.927 | 18.949 | 1.00 | 34.63 | | O |
| ANISOU | 4589 | O | HOH | S | 35 | 4681 | 4580 | 3898 | 208 | −22 | −686 | O |
| HETATM | 4590 | O | HOH | S | 36 | 9.098 | 21.352 | 43.789 | 1.00 | 35.38 | | O |
| ANISOU | 4590 | O | HOH | S | 36 | 4615 | 3938 | 4891 | 351 | −81 | −1181 | O |
| HETATM | 4591 | O | HOH | S | 37 | 3.926 | −7.820 | 50.611 | 1.00 | 47.07 | | O |
| ANISOU | 4591 | O | HOH | S | 37 | 5774 | 5418 | 6693 | 19 | 1269 | −264 | O |
| HETATM | 4592 | O | HOH | S | 38 | −4.716 | 0.330 | 23.833 | 1.00 | 44.63 | | O |
| ANISOU | 4592 | O | HOH | S | 38 | 4250 | 5385 | 7322 | −158 | −1774 | −1299 | O |
| HETATM | 4593 | O | HOH | S | 39 | 6.205 | −8.753 | 49.411 | 1.00 | 45.33 | | O |
| ANISOU | 4593 | O | HOH | S | 39 | 5605 | 5219 | 6398 | 35 | 1006 | −270 | O |
| HETATM | 4594 | O | HOH | S | 40 | 17.257 | 15.881 | 41.123 | 1.00 | 33.45 | | O |
| ANISOU | 4594 | O | HOH | S | 40 | 4184 | 4115 | 4410 | 8 | −500 | −907 | O |
| HETATM | 4595 | O | HOH | S | 41 | 10.657 | 30.151 | 32.719 | 1.00 | 36.49 | | O |
| ANISOU | 4595 | O | HOH | S | 41 | 4766 | 3581 | 5515 | 364 | −631 | −627 | O |
| HETATM | 4596 | O | HOH | S | 42 | 0.372 | 3.437 | 26.916 | 1.00 | 36.53 | | O |
| ANISOU | 4596 | O | HOH | S | 42 | 3615 | 4497 | 5767 | 42 | −1150 | −1100 | O |
| HETATM | 4597 | O | HOH | S | 43 | 29.408 | −18.535 | 24.819 | 1.00 | 48.61 | | O |
| ANISOU | 4597 | O | HOH | S | 43 | 6109 | 5289 | 7070 | 1026 | 1011 | −1133 | O |
| HETATM | 4598 | O | HOH | S | 44 | 24.070 | 0.689 | 36.997 | 1.00 | 46.75 | | O |
| ANISOU | 4598 | O | HOH | S | 44 | 5401 | 6079 | 6282 | 194 | −303 | −569 | O |
| HETATM | 4599 | O | HOH | S | 45 | 22.038 | 28.786 | 15.783 | 1.00 | 43.90 | | O |
| ANISOU | 4599 | O | HOH | S | 45 | 6427 | 4879 | 5375 | −74 | −87 | 640 | O |
| HETATM | 4600 | O | HOH | S | 46 | 20.355 | 37.493 | 35.082 | 1.00 | 48.27 | | O |
| ANISOU | 4600 | O | HOH | S | 46 | 6665 | 4356 | 7319 | −416 | −703 | −676 | O |
| HETATM | 4601 | O | HOH | S | 47 | 1.817 | 22.348 | 41.121 | 1.00 | 48.62 | | O |
| ANISOU | 4601 | O | HOH | S | 47 | 5737 | 5452 | 7285 | 716 | 113 | −1100 | O |
| HETATM | 4602 | O | HOH | S | 48 | 18.901 | 37.662 | 28.412 | 1.00 | 42.71 | | O |
| ANISOU | 4602 | O | HOH | S | 48 | 5981 | 3708 | 6540 | −206 | −576 | −78 | O |
| HETATM | 4603 | O | HOH | S | 49 | 25.491 | −12.508 | 26.054 | 1.00 | 41.57 | | O |
| ANISOU | 4603 | O | HOH | S | 49 | 5150 | 4846 | 5798 | 614 | 496 | −1043 | O |
| HETATM | 4604 | O | HOH | S | 50 | 5.878 | 11.368 | 44.950 | 1.00 | 35.92 | | O |
| ANISOU | 4604 | O | HOH | S | 50 | 4291 | 4338 | 5019 | 327 | 298 | −991 | O |
| HETATM | 4605 | O | HOH | S | 51 | 26.806 | −3.380 | 38.743 | 1.00 | 35.39 | | O |
| ANISOU | 4605 | O | HOH | S | 51 | 3868 | 4585 | 4994 | 349 | −302 | −416 | O |
| HETATM | 4606 | O | HOH | S | 52 | 27.307 | 13.942 | 29.934 | 1.00 | 43.01 | | O |
| ANISOU | 4606 | O | HOH | S | 52 | 4909 | 5533 | 5900 | −171 | −243 | −400 | O |
| HETATM | 4607 | O | HOH | S | 53 | 16.160 | 2.608 | 45.162 | 1.00 | 37.59 | | O |

TABLE 11-continued

| | | | | | | | | | | | | |
|---|---|---|---|---|---|---|---|---|---|---|---|---|
| ANISOU | 4607 | O | HOH | S | 53 | 4685 | 4817 | 4779 | 158 | −160 | −655 | O |
| HETATM | 4608 | O | HOH | S | 54 | 5.285 | 4.365 | 38.190 | 1.00 | 42.59 | | O |
| ANISOU | 4608 | O | HOH | S | 54 | 4673 | 5280 | 6230 | 135 | −71 | −899 | O |
| HETATM | 4609 | O | HOH | S | 55 | −1.693 | 2.994 | 36.244 | 1.00 | 40.71 | | O |
| ANISOU | 4609 | O | HOH | S | 55 | 3790 | 4887 | 6789 | 73 | −147 | −962 | O |
| HETATM | 4610 | O | HOH | S | 56 | 3.999 | 2.004 | 56.357 | 1.00 | 57.20 | | O |
| ANISOU | 4610 | O | HOH | S | 56 | 7781 | 6956 | 6996 | 343 | 1521 | −558 | O |
| HETATM | 4611 | O | HOH | S | 57 | 8.801 | −10.141 | 44.758 | 1.00 | 43.29 | | O |
| ANISOU | 4611 | O | HOH | S | 57 | 5186 | 4963 | 6300 | 17 | 560 | −438 | O |
| HETATM | 4612 | O | HOH | S | 58 | 11.723 | 12.212 | 19.165 | 1.00 | 38.09 | | O |
| ANISOU | 4612 | O | HOH | S | 58 | 5078 | 4901 | 4493 | 247 | −992 | −608 | O |
| HETATM | 4613 | O | HOH | S | 59 | 9.117 | −0.642 | 32.558 | 1.00 | 31.60 | | O |
| ANISOU | 4613 | O | HOH | S | 59 | 3446 | 3915 | 4644 | 36 | −363 | −976 | O |
| HETATM | 4614 | O | HOH | S | 60 | 7.729 | −7.115 | 48.148 | 1.00 | 35.20 | | O |
| ANISOU | 4614 | O | HOH | S | 60 | 4308 | 4059 | 5005 | 75 | 758 | −374 | O |
| HETATM | 4615 | O | HOH | S | 61 | 9.799 | −4.324 | 20.855 | 1.00 | 45.78 | | O |
| ANISOU | 4615 | O | HOH | S | 61 | 5884 | 5642 | 5870 | −2 | −890 | −1425 | O |
| HETATM | 4616 | O | HOH | S | 62 | 13.055 | −19.753 | 40.966 | 1.00 | 44.38 | | O |
| ANISOU | 4616 | O | HOH | S | 62 | 5496 | 4478 | 6891 | 99 | 509 | −428 | O |
| HETATM | 4617 | O | HOH | S | 63 | 18.417 | 14.071 | 11.701 | 1.00 | 47.15 | | O |
| ANISOU | 4617 | O | HOH | S | 63 | 7123 | 6096 | 4695 | 271 | −377 | −213 | O |
| HETATM | 4618 | O | HOH | S | 64 | 6.821 | 24.232 | 30.399 | 1.00 | 39.85 | | O |
| ANISOU | 4618 | O | HOH | S | 64 | 4808 | 4450 | 5883 | 508 | −770 | −603 | O |
| HETATM | 4619 | O | HOH | S | 65 | 25.592 | −0.845 | 38.873 | 1.00 | 38.73 | | O |
| ANISOU | 4619 | O | HOH | S | 65 | 4348 | 5058 | 5311 | 251 | −358 | −479 | O |
| HETATM | 4620 | O | HOH | S | 66 | 5.030 | −15.735 | 36.004 | 1.00 | 45.92 | | O |
| ANISOU | 4620 | O | HOH | S | 66 | 5156 | 4824 | 7468 | −353 | 172 | −972 | O |
| HETATM | 4621 | O | HOH | S | 67 | 8.166 | −1.614 | 34.672 | 1.00 | 34.89 | | O |
| ANISOU | 4621 | O | HOH | S | 67 | 3801 | 4278 | 5176 | 17 | −232 | −941 | O |
| HETATM | 4622 | O | HOH | S | 68 | 20.314 | −15.418 | 46.623 | 1.00 | 55.07 | | O |
| ANISOU | 4622 | O | HOH | S | 68 | 7020 | 6380 | 7526 | 507 | 139 | 48 | O |
| HETATM | 4623 | O | HOH | S | 69 | 26.880 | −10.450 | 25.245 | 1.00 | 45.71 | | O |
| ANISOU | 4623 | O | HOH | S | 69 | 5610 | 5511 | 6247 | 623 | 554 | −979 | O |
| HETATM | 4624 | O | HOH | S | 71 | 30.466 | −12.729 | 37.170 | 1.00 | 47.44 | | O |
| ANISOU | 4624 | O | HOH | S | 71 | 5269 | 5705 | 7053 | 815 | 56 | −259 | O |
| HETATM | 4625 | O | HOH | S | 72 | 21.403 | −22.300 | 29.158 | 1.00 | 44.47 | | O |
| ANISOU | 4625 | O | HOH | S | 72 | 5781 | 4337 | 6778 | 577 | 527 | −1182 | O |
| HETATM | 4626 | O | HOH | S | 73 | 18.877 | 35.256 | 33.902 | 1.00 | 41.49 | | O |
| ANISOU | 4626 | O | HOH | S | 73 | 5702 | 3760 | 6303 | −250 | −658 | −596 | O |
| HETATM | 4627 | O | HOH | S | 74 | 9.102 | 9.493 | 41.772 | 1.00 | 33.61 | | O |
| ANISOU | 4627 | O | HOH | S | 74 | 3940 | 4171 | 4658 | 209 | −39 | −909 | O |
| HETATM | 4628 | O | HOH | S | 75 | 12.045 | −14.693 | 58.547 | 1.00 | 46.20 | | O |
| ANISOU | 4628 | O | HOH | S | 75 | 6959 | 5141 | 5455 | 366 | 1115 | 636 | O |
| HETATM | 4629 | O | HOH | S | 76 | 5.003 | 9.704 | 51.805 | 1.00 | 56.55 | | O |
| ANISOU | 4629 | O | HOH | S | 76 | 7404 | 6903 | 7180 | 400 | 895 | −985 | O |
| HETATM | 4630 | O | HOH | S | 77 | 0.809 | 8.180 | 43.022 | 1.00 | 54.07 | | O |
| ANISOU | 4630 | O | HOH | S | 77 | 6027 | 6587 | 7932 | 321 | 459 | −929 | O |
| HETATM | 4631 | O | HOH | S | 78 | −0.212 | 7.631 | 19.587 | 1.00 | 45.75 | | O |
| ANISOU | 4631 | O | HOH | S | 78 | 5205 | 5762 | 6417 | 212 | −1998 | −1000 | O |
| HETATM | 4632 | O | HOH | S | 79 | 11.110 | −19.047 | 33.364 | 1.00 | 41.96 | | O |
| ANISOU | 4632 | O | HOH | S | 79 | 5101 | 4171 | 6671 | −93 | 159 | −1079 | O |
| HETATM | 4633 | O | HOH | S | 80 | 15.983 | 15.930 | 45.790 | 1.00 | 39.00 | | O |
| ANISOU | 4633 | O | HOH | S | 80 | 5167 | 4768 | 4883 | 61 | −405 | −1050 | O |
| HETATM | 4634 | O | HOH | S | 81 | 7.682 | −2.253 | 26.771 | 1.00 | 41.86 | | O |
| ANISOU | 4634 | O | HOH | S | 81 | 4862 | 5168 | 5875 | −27 | −727 | −1190 | O |
| HETATM | 4635 | O | HOH | S | 82 | 34.222 | 16.403 | 26.834 | 1.00 | 46.36 | | O |
| ANISOU | 4635 | O | HOH | S | 82 | 4922 | 5885 | 6806 | −402 | 187 | −46 | O |
| HETATM | 4636 | O | HOH | S | 83 | 21.012 | 4.285 | 32.259 | 1.00 | 41.29 | | O |
| ANISOU | 4636 | O | HOH | S | 83 | 4822 | 5390 | 5476 | 116 | −274 | −697 | O |
| HETATM | 4637 | O | HOH | S | 84 | 13.629 | −13.471 | 26.189 | 1.00 | 41.44 | | O |
| ANISOU | 4637 | O | HOH | S | 84 | 5259 | 4607 | 5879 | 49 | −189 | −1422 | O |
| HETATM | 4638 | O | HOH | S | 85 | 28.413 | −10.504 | 42.070 | 1.00 | 42.12 | | O |
| ANISOU | 4638 | O | HOH | S | 85 | 4777 | 5172 | 6054 | 654 | −284 | −115 | O |
| HETATM | 4639 | O | HOH | S | 86 | 25.144 | 13.611 | 48.385 | 1.00 | 46.34 | | O |
| ANISOU | 4639 | O | HOH | S | 86 | 6008 | 5910 | 5689 | −188 | −1111 | −885 | O |
| HETATM | 4640 | O | HOH | S | 87 | 10.090 | 21.517 | 46.284 | 1.00 | 46.52 | | O |
| ANISOU | 4640 | O | HOH | S | 87 | 6250 | 5329 | 6096 | 315 | −38 | −1283 | O |
| HETATM | 4641 | O | HOH | S | 88 | 21.906 | −21.558 | 45.128 | 1.00 | 56.03 | | O |
| ANISOU | 4641 | O | HOH | S | 88 | 7165 | 6003 | 8120 | 703 | 305 | 175 | O |
| HETATM | 4642 | O | HOH | S | 89 | 16.080 | 24.117 | 42.278 | 1.00 | 42.62 | | O |
| ANISOU | 4642 | O | HOH | S | 89 | 5677 | 4796 | 5720 | −8 | −543 | −1116 | O |
| HETATM | 4643 | O | HOH | S | 90 | 2.572 | −6.492 | 41.823 | 1.00 | 49.61 | | O |
| ANISOU | 4643 | O | HOH | S | 90 | 5431 | 5800 | 7618 | −130 | 514 | −717 | O |
| HETATM | 4644 | O | HOH | S | 91 | 27.309 | −8.986 | 52.286 | 1.00 | 52.71 | | O |
| ANISOU | 4644 | O | HOH | S | 91 | 6811 | 6638 | 6578 | 631 | −806 | 263 | O |
| HETATM | 4645 | O | HOH | S | 92 | −0.543 | 10.761 | 43.039 | 1.00 | 43.71 | | O |
| ANISOU | 4645 | O | HOH | S | 92 | 4646 | 5207 | 6754 | 432 | 500 | −973 | O |
| HETATM | 4646 | O | HOH | S | 93 | 12.851 | −12.661 | 52.016 | 1.00 | 43.34 | | O |
| ANISOU | 4646 | O | HOH | S | 93 | 5879 | 4924 | 5666 | 259 | 696 | 121 | O |
| HETATM | 4647 | O | HOH | S | 94 | 1.843 | 19.357 | 28.015 | 1.00 | 41.07 | | O |

TABLE 11-continued

| | | | | | | | | | | | |
|---|---|---|---|---|---|---|---|---|---|---|---|
| ANISOU | 4647 | O | HOH | S | 94 | 4518 | 4837 | 6251 | 596 | −1070 | −641 | O |
| HETATM | 4648 | O | HOH | S | 95 | 3.068 | 7.836 | 44.469 | 1.00 | 47.30 | | O |
| ANISOU | 4648 | O | HOH | S | 95 | 5434 | 5773 | 6767 | 296 | 478 | −916 | O |
| HETATM | 4649 | O | HOH | S | 96 | 3.322 | −5.666 | 48.159 | 1.00 | 51.40 | | O |
| ANISOU | 4649 | O | HOH | S | 96 | 6078 | 6054 | 7397 | 10 | 1045 | −458 | O |
| HETATM | 4650 | O | HOH | S | 97 | 22.665 | −24.444 | 29.541 | 1.00 | 54.16 | | O |
| ANISOU | 4650 | O | HOH | S | 97 | 7047 | 5355 | 8177 | 711 | 657 | −1141 | O |
| HETATM | 4651 | O | HOH | S | 98 | 5.870 | 6.720 | 54.618 | 1.00 | 44.82 | | O |
| ANISOU | 4651 | O | HOH | S | 98 | 6216 | 5456 | 5358 | 377 | 1061 | −837 | O |
| HETATM | 4652 | O | HOH | S | 99 | 5.993 | −10.003 | 44.853 | 1.00 | 44.32 | | O |
| ANISOU | 4652 | O | HOH | S | 99 | 5165 | 5028 | 6645 | −70 | 708 | −470 | O |
| HETATM | 4653 | O | HOH | S | 100 | 1.855 | −5.139 | 57.624 | 1.00 | 60.18 | | O |
| ANISOU | 4653 | O | HOH | S | 100 | 8060 | 7097 | 7708 | 200 | 2081 | −97 | O |
| HETATM | 4654 | O | HOH | S | 101 | 29.063 | 5.550 | 52.866 | 1.00 | 60.14 | | O |
| ANISOU | 4654 | O | HOH | S | 101 | 7773 | 7889 | 7188 | 50 | −1516 | −462 | O |
| HETATM | 4655 | O | HOH | S | 102 | 28.073 | −7.361 | 46.385 | 1.00 | 50.14 | | O |
| ANISOU | 4655 | O | HOH | S | 102 | 5979 | 6363 | 6710 | 541 | −618 | −30 | O |
| HETATM | 4656 | O | HOH | S | 103 | 13.610 | 19.109 | 47.994 | 1.00 | 41.11 | | O |
| ANISOU | 4656 | O | HOH | S | 103 | 5699 | 4828 | 5091 | 151 | −236 | −1248 | O |
| HETATM | 4657 | O | HOH | S | 104 | −0.588 | −10.190 | 35.670 | 1.00 | 55.00 | | O |
| ANISOU | 4657 | O | HOH | S | 104 | 5729 | 6230 | 8937 | −432 | −5 | −1034 | O |
| HETATM | 4658 | O | HOH | S | 105 | 10.577 | −17.270 | 40.303 | 1.00 | 49.19 | | O |
| ANISOU | 4658 | O | HOH | S | 105 | 5951 | 5246 | 7492 | −36 | 456 | −562 | O |
| HETATM | 4659 | O | HOH | S | 106 | 3.604 | 10.167 | 45.934 | 1.00 | 44.92 | | O |
| ANISOU | 4659 | O | HOH | S | 106 | 5322 | 5441 | 6306 | 362 | 538 | −975 | O |
| HETATM | 4660 | O | HOH | S | 107 | 8.718 | 10.047 | 58.293 | 1.00 | 55.34 | | O |
| ANISOU | 4660 | O | HOH | S | 107 | 8267 | 6787 | 5971 | 419 | 857 | −1033 | O |
| HETATM | 4661 | O | HOH | S | 108 | 25.375 | −10.747 | 51.841 | 1.00 | 46.83 | | O |
| ANISOU | 4661 | O | HOH | S | 108 | 6140 | 5765 | 5887 | 636 | −537 | 281 | O |
| HETATM | 4662 | O | HOH | S | 109 | 28.039 | −1.952 | 52.799 | 1.00 | 49.31 | | O |
| ANISOU | 4662 | O | HOH | S | 109 | 6385 | 6456 | 5893 | 368 | −1161 | −78 | O |
| HETATM | 4663 | O | HOH | S | 110 | 10.652 | −12.312 | 53.010 | 1.00 | 49.74 | | O |
| ANISOU | 4663 | O | HOH | S | 110 | 6716 | 5697 | 6485 | 201 | 939 | 132 | O |
| HETATM | 4664 | O | HOH | S | 111 | 13.057 | 13.967 | 53.767 | 1.00 | 52.78 | | O |
| ANISOU | 4664 | O | HOH | S | 111 | 7593 | 6483 | 5978 | 233 | 42 | −1183 | O |
| HETATM | 4665 | O | HOH | S | 112 | 22.388 | 1.348 | 13.240 | 1.00 | 66.06 | | O |
| ANISOU | 4665 | O | HOH | S | 112 | 9311 | 8515 | 7272 | 367 | 270 | −965 | O |
| HETATM | 4666 | O | HOH | S | 113 | 4.091 | 8.759 | 48.642 | 1.00 | 48.29 | | O |
| ANISOU | 4666 | O | HOH | S | 113 | 5966 | 5875 | 6505 | 354 | 746 | −939 | O |
| HETATM | 4667 | O | HOH | S | 114 | 14.837 | −17.494 | 26.294 | 1.00 | 50.55 | | O |
| ANISOU | 4667 | O | HOH | S | 114 | 6546 | 5453 | 7209 | 105 | −4 | −1498 | O |
| HETATM | 4668 | O | HOH | S | 115 | 33.889 | 14.671 | 28.779 | 1.00 | 43.34 | | O |
| ANISOU | 4668 | O | HOH | S | 115 | 4478 | 5569 | 6421 | −340 | 17 | −150 | O |
| HETATM | 4669 | O | HOH | S | 116 | −3.917 | 2.185 | 37.425 | 1.00 | 57.63 | | O |
| ANISOU | 4669 | O | HOH | S | 116 | 5696 | 6952 | 9249 | 44 | 33 | −944 | O |
| HETATM | 4670 | O | HOH | S | 117 | 31.610 | 8.123 | 43.076 | 1.00 | 58.31 | | O |
| ANISOU | 4670 | O | HOH | S | 117 | 6622 | 7637 | 7897 | −113 | −1077 | −454 | O |
| HETATM | 4671 | O | HOH | S | 118 | 26.636 | −25.827 | 28.267 | 1.00 | 48.30 | | O |
| ANISOU | 4671 | O | HOH | S | 118 | 6290 | 4499 | 7562 | 1056 | 943 | −1134 | O |
| HETATM | 4672 | O | HOH | S | 119 | 5.201 | 19.059 | 12.485 | 1.00 | 46.70 | | O |
| ANISOU | 4672 | O | HOH | S | 119 | 6610 | 5807 | 5326 | 604 | −2067 | −128 | O |
| HETATM | 4673 | O | HOH | S | 120 | 24.278 | 3.331 | 15.616 | 1.00 | 54.60 | | O |
| ANISOU | 4673 | O | HOH | S | 120 | 7489 | 7103 | 6154 | 321 | 396 | −754 | O |
| HETATM | 4674 | O | HOH | S | 121 | 15.591 | 2.768 | 24.683 | 1.00 | 39.58 | | O |
| ANISOU | 4674 | O | HOH | S | 121 | 4921 | 5117 | 5001 | 141 | −449 | −928 | O |
| HETATM | 4675 | O | HOH | S | 123 | 32.717 | 14.124 | 33.294 | 1.00 | 54.51 | | O |
| ANISOU | 4675 | O | HOH | S | 123 | 5912 | 7002 | 7797 | −346 | −413 | −320 | O |
| HETATM | 4676 | O | HOH | S | 124 | 5.581 | −16.437 | 30.865 | 1.00 | 59.58 | | O |
| ANISOU | 4676 | O | HOH | S | 124 | 7032 | 6514 | 9093 | −392 | −225 | −1342 | O |
| HETATM | 4677 | O | HOH | S | 125 | 29.080 | 26.842 | 30.325 | 1.00 | 42.93 | | O |
| ANISOU | 4677 | O | HOH | S | 125 | 5077 | 4807 | 6427 | −692 | −411 | −201 | O |
| HETATM | 4678 | O | HOH | S | 126 | 25.112 | 2.986 | 58.790 | 1.00 | 51.50 | | O |
| ANISOU | 4678 | O | HOH | S | 126 | 7605 | 6748 | 5213 | 242 | −1261 | −362 | O |
| HETATM | 4679 | O | HOH | S | 127 | 27.009 | −22.198 | 24.288 | 1.00 | 58.36 | | O |
| ANISOU | 4679 | O | HOH | S | 127 | 7664 | 6140 | 8369 | 985 | 996 | −1382 | O |
| HETATM | 4680 | O | HOH | S | 128 | 28.176 | 8.118 | 33.258 | 1.00 | 56.06 | | O |
| ANISOU | 4680 | O | HOH | S | 128 | 6392 | 7312 | 7596 | −20 | −311 | −478 | O |
| HETATM | 4681 | O | HOH | S | 129 | 24.832 | −24.008 | 27.360 | 1.00 | 55.59 | | O |
| ANISOU | 4681 | O | HOH | S | 129 | 7264 | 5596 | 8260 | 865 | 804 | −1250 | O |
| HETATM | 4682 | O | HOH | S | 130 | 21.915 | 32.624 | 33.074 | 1.00 | 38.23 | | O |
| ANISOU | 4682 | O | HOH | S | 130 | 5078 | 3648 | 5798 | −431 | −647 | −497 | O |
| HETATM | 4683 | O | HOH | S | 131 | 12.670 | −5.697 | 24.350 | 1.00 | 56.44 | | O |
| ANISOU | 4683 | O | HOH | S | 131 | 7095 | 6961 | 7388 | 56 | −490 | −1289 | O |
| HETATM | 4684 | O | HOH | S | 132 | −0.653 | 3.308 | 38.565 | 1.00 | 49.61 | | O |
| ANISOU | 4684 | O | HOH | S | 132 | 5071 | 6022 | 7756 | 111 | 100 | −920 | O |
| HETATM | 4685 | O | HOH | S | 133 | −4.228 | 11.250 | 25.199 | 1.00 | 40.96 | | O |
| ANISOU | 4685 | O | HOH | S | 133 | 3824 | 4994 | 6744 | 404 | −1632 | −862 | O |
| HETATM | 4686 | O | HOH | S | 134 | 8.864 | 9.120 | 55.747 | 1.00 | 54.02 | | O |
| ANISOU | 4686 | O | HOH | S | 134 | 7731 | 6660 | 6133 | 366 | 720 | −961 | O |
| HETATM | 4687 | O | HOH | S | 135 | 9.781 | 11.125 | 54.237 | 1.00 | 42.90 | | O |

TABLE 11-continued

| | | | | | | | | | | | | |
|---|---|---|---|---|---|---|---|---|---|---|---|---|
| ANISOU | 4687 | O | HOH | S | 135 | 6227 | 5242 | 4832 | 335 | 495 | −1058 | O |
| HETATM | 4688 | C | HOH | S | 136 | 10.849 | 32.703 | 32.898 | 1.00 | 62.61 | | O |
| ANISOU | 4688 | O | HOH | S | 136 | 8196 | 6650 | 8941 | 374 | −625 | −612 | O |
| HETATM | 4689 | O | HOH | S | 137 | 36.087 | −17.833 | 36.888 | 1.00 | 52.52 | | O |
| ANISOU | 4689 | O | HOH | S | 137 | 5544 | 6034 | 8378 | 1346 | 263 | −3 | O |
| HETATM | 4690 | O | HOH | S | 138 | 21.302 | 3.253 | 19.360 | 1.00 | 51.81 | | O |
| ANISOU | 4690 | O | HOH | S | 138 | 6838 | 6733 | 6115 | 238 | −12 | −819 | O |
| HETATM | 4691 | O | HOH | S | 139 | 9.402 | −13.397 | 55.129 | 1.00 | 53.32 | | O |
| ANISOU | 4691 | O | HOH | S | 139 | 7350 | 6047 | 6864 | 196 | 1219 | 304 | O |
| HETATM | 4692 | O | HOH | S | 140 | 15.609 | 15.031 | 54.152 | 1.00 | 59.32 | | O |
| ANISOU | 4692 | O | HOH | S | 140 | 8525 | 7320 | 6693 | 140 | −269 | −1228 | O |
| HETATM | 4693 | O | HOH | S | 141 | 5.230 | −11.768 | 43.258 | 1.00 | 52.72 | | O |
| ANISOU | 4693 | O | HOH | S | 141 | 6117 | 5968 | 7946 | −156 | 664 | −530 | O |
| HETATM | 4694 | O | HOH | S | 142 | 3.723 | 20.934 | 11.365 | 1.00 | 52.76 | | O |
| ANISOU | 4694 | C | HOH | S | 142 | 7440 | 6498 | 6110 | 724 | −2336 | 34 | O |
| HETATM | 4695 | O | HOH | S | 143 | 18.076 | 9.304 | 11.046 | 1.00 | 63.67 | | O |
| ANISOU | 4695 | O | HOH | S | 143 | 9298 | 8265 | 6629 | 302 | −383 | −555 | O |
| HETATM | 4696 | O | HOH | S | 144 | 0.943 | 1.088 | 25.483 | 1.00 | 45.18 | | O |
| ANISOU | 4696 | O | HOH | S | 144 | 4832 | 5572 | 6762 | −45 | −1245 | −1200 | O |
| HETATM | 4697 | O | HOH | S | 145 | 4.339 | 22.954 | 42.829 | 1.00 | 53.57 | | O |
| ANISOU | 4697 | O | HOH | S | 145 | 6670 | 6067 | 7618 | 613 | 125 | −1184 | O |
| HETATM | 4698 | O | HOH | S | 146 | 5.501 | −0.768 | 26.320 | 1.00 | 42.41 | | O |
| ANISOU | 4698 | O | HOH | S | 146 | 4811 | 5250 | 6054 | −35 | −895 | −1190 | O |
| HETATM | 4699 | O | HOH | S | 147 | 5.331 | −16.956 | 33.829 | 1.00 | 53.24 | | O |
| ANISOU | 4699 | O | HOH | S | 147 | 6151 | 5658 | 8421 | −390 | 25 | −1133 | O |
| HETATM | 4700 | O | HOH | S | 148 | 16.535 | −20.697 | 31.688 | 1.00 | 39.30 | | O |
| ANISOU | 4700 | O | HOH | S | 148 | 4988 | 3779 | 6167 | 235 | 293 | −1096 | O |
| HETATM | 4701 | O | HOH | S | 149 | 13.222 | 1.406 | 24.163 | 1.00 | 57.34 | | O |
| ANISOU | 4701 | O | HOH | S | 149 | 7167 | 7318 | 7303 | 115 | −588 | −1034 | O |
| HETATM | 4702 | O | HOH | S | 150 | 11.426 | 12.482 | 57.657 | 1.00 | 59.05 | | O |
| ANISOU | 4702 | O | HOH | S | 150 | 8813 | 7265 | 6360 | 340 | 402 | −1173 | O |
| HETATM | 4703 | O | HOH | S | 151 | 6.141 | 21.287 | 43.622 | 1.00 | 46.45 | | O |
| ANISOU | 4703 | O | HOH | S | 151 | 5863 | 5291 | 6494 | 492 | 88 | −1183 | O |
| HETATM | 4704 | O | HOH | S | 152 | 28.896 | −11.172 | 23.977 | 1.00 | 71.82 | | O |
| ANISOU | 4704 | O | HOH | S | 152 | 8911 | 8781 | 9595 | 744 | 780 | −986 | O |
| HETATM | 4705 | O | HOH | S | 153 | 31.016 | 21.022 | 22.478 | 1.00 | 45.42 | | O |
| ANISOU | 4705 | O | HOH | S | 153 | 5399 | 5550 | 6308 | −421 | 338 | 152 | O |
| HETATM | 4706 | O | HOH | S | 154 | −0.008 | 20.431 | 29.747 | 1.00 | 45.00 | | O |
| ANISOU | 4706 | O | HOH | S | 154 | 4844 | 5229 | 7023 | 702 | −956 | −677 | O |
| HETATM | 4707 | O | HOH | S | 155 | 0.906 | 11.346 | 45.442 | 1.00 | 54.08 | | O |
| ANISOU | 4707 | O | HOH | S | 155 | 6261 | 6518 | 7769 | 448 | 658 | −1003 | O |
| HETATM | 4708 | O | HOH | S | 156 | 18.235 | 39.215 | 24.373 | 1.00 | 53.37 | | O |
| ANISOU | 4708 | O | HOH | S | 156 | 7529 | 4925 | 7826 | −95 | −539 | 337 | O |
| HETATM | 4709 | O | HOH | S | 157 | 13.926 | 9.787 | 60.271 | 1.00 | 53.14 | | O |
| ANISOU | 4709 | O | HOH | S | 157 | 8412 | 6634 | 5146 | 315 | 175 | −1004 | O |
| HETATM | 4710 | O | HOH | S | 158 | −0.973 | 19.246 | 14.191 | 1.00 | 66.91 | | O |
| ANISOU | 4710 | O | HOH | S | 158 | 8455 | 8276 | 8691 | 767 | −2657 | −223 | O |
| HETATM | 4711 | O | HOH | S | 159 | 33.854 | −6.598 | 28.530 | 1.00 | 56.18 | | O |
| ANISOU | 4711 | O | HOH | S | 159 | 6170 | 7106 | 8068 | 700 | 585 | −486 | O |
| HETATM | 4712 | O | HOH | S | 160 | 22.024 | 13.816 | 39.861 | 1.00 | 53.05 | | O |
| ANISOU | 4712 | O | HOH | S | 160 | 6478 | 6739 | 6940 | −102 | −631 | −761 | O |
| HETATM | 4713 | O | HOH | S | 161 | 7.680 | 22.143 | 47.820 | 1.00 | 50.11 | | O |
| ANISOU | 4713 | O | HOH | S | 161 | 6766 | 5683 | 6590 | 455 | 224 | −1375 | O |
| HETATM | 4714 | O | HOH | S | 162 | 13.845 | 8.740 | 13.088 | 1.00 | 47.84 | | O |
| ANISOU | 4714 | O | HOH | S | 162 | 6990 | 6233 | 4954 | 275 | −916 | −713 | O |
| HETATM | 4715 | O | HOH | S | 163 | 17.408 | 16.860 | 55.648 | 1.00 | 62.56 | | O |
| ANISOU | 4715 | O | HOH | S | 163 | 9182 | 7675 | 6912 | 62 | −518 | −1356 | O |
| HETATM | 4716 | O | HOH | S | 164 | 17.519 | 39.687 | 27.205 | 1.00 | 54.93 | | O |
| ANISOU | 4716 | O | HOH | S | 164 | 7673 | 5024 | 8176 | −84 | −592 | 65 | O |
| HETATM | 4717 | O | HOH | S | 165 | 28.282 | −0.403 | 30.141 | 1.00 | 55.16 | | O |
| ANISOU | 4717 | O | HOH | S | 165 | 6330 | 7151 | 7477 | 303 | 82 | −562 | O |
| HETATM | 4718 | O | HOH | S | 166 | 32.936 | −24.487 | 26.040 | 1.00 | 62.76 | | O |
| ANISOU | 4718 | O | HOH | S | 166 | 7800 | 6528 | 9518 | 1512 | 1396 | −1036 | O |
| HETATM | 4719 | O | HOH | S | 167 | −0.696 | 5.151 | 18.309 | 1.00 | 51.48 | | O |
| ANISOU | 4719 | O | HOH | S | 167 | 5988 | 6479 | 7094 | 109 | −2171 | −1149 | O |
| HETATM | 4720 | O | HOH | S | 168 | 3.838 | 3.708 | 57.830 | 1.00 | 79.21 | | O |
| ANISOU | 4720 | O | HOH | S | 168 | 10789 | 9739 | 9568 | 410 | 1630 | −637 | O |
| HETATM | 4721 | O | HOH | S | 169 | 7.124 | −12.149 | 55.063 | 1.00 | 65.94 | | O |
| ANISOU | 4721 | O | HOH | S | 169 | 8823 | 7657 | 8576 | 128 | 1428 | 208 | O |
| HETATM | 4722 | O | HOH | S | 170 | 12.320 | 22.632 | 49.267 | 1.00 | 48.61 | | O |
| ANISOU | 4722 | O | HOH | S | 170 | 6885 | 5533 | 6051 | 220 | −133 | −1440 | O |
| HETATM | 4723 | O | HOH | S | 171 | 9.845 | −12.190 | 46.178 | 1.00 | 55.45 | | O |
| ANISOU | 4723 | O | HOH | S | 171 | 6869 | 6405 | 7796 | 54 | 643 | −288 | O |
| HETATM | 4724 | O | HOH | S | 172 | 7.271 | 27.150 | 30.967 | 1.00 | 51.12 | | O |
| ANISOU | 4724 | O | HOH | S | 172 | 6360 | 5669 | 7395 | 539 | −733 | −579 | O |
| HETATM | 4725 | O | HOH | S | 173 | 21.873 | −17.897 | 23.257 | 1.00 | 66.44 | | O |
| ANISOU | 4725 | O | HOH | S | 173 | 8783 | 7515 | 8945 | 542 | 484 | −1514 | O |
| HETATM | 4726 | O | HOH | S | 174 | −4.180 | 12.404 | 27.626 | 1.00 | 48.67 | | O |
| ANISOU | 4726 | O | HOH | S | 174 | 4728 | 5920 | 7844 | 466 | −1319 | −842 | O |
| HETATM | 4727 | O | HOH | S | 175 | 16.575 | 12.536 | 34.903 | 1.00 | 44.26 | | O |

TABLE 11-continued

| | | | | | | | | | | | |
|---|---|---|---|---|---|---|---|---|---|---|---|
| ANISOU | 4727 | O | HOH | S | 175 | 5320 | 5621 | 5875 | 60 | −460 | −758 | O |
| HETATM | 4728 | O | HOH | S | 176 | 20.010 | 18.238 | 38.634 | 1.00 | 47.99 | | O |
| ANISOU | 4728 | O | HOH | S | 176 | 5957 | 5900 | 6376 | −116 | −614 | −817 | O |
| HETATM | 4729 | O | HOH | S | 177 | 28.695 | 8.066 | 20.502 | 1.00 | 43.75 | | O |
| ANISOU | 4729 | O | HOH | S | 177 | 5383 | 5753 | 5488 | 133 | 505 | −368 | O |
| HETATM | 4730 | O | HOH | S | 178 | 3.695 | 30.518 | 35.949 | 1.00 | 53.26 | | O |
| ANISOU | 4730 | O | HOH | S | 178 | 6614 | 5537 | 8087 | 827 | −388 | −862 | O |
| HETATM | 4731 | O | HOH | S | 179 | −1.376 | −0.813 | 24.989 | 1.00 | 51.38 | | O |
| ANISOU | 4731 | O | HOH | S | 179 | 5417 | 6265 | 7839 | −157 | −1415 | −1300 | O |
| HETATM | 4732 | O | HOH | S | 180 | 5.874 | −7.194 | 44.925 | 1.00 | 60.02 | | O |
| ANISOU | 4732 | O | HOH | S | 180 | 7137 | 7160 | 8509 | −20 | 649 | −536 | O |
| HETATM | 4733 | O | HOH | S | 181 | 2.932 | −12.972 | 35.349 | 1.00 | 48.22 | | O |
| ANISOU | 4733 | O | HOH | S | 181 | 5236 | 5277 | 7810 | −387 | 36 | −1034 | O |
| HETATM | 4734 | O | HOH | S | 182 | −4.537 | 14.805 | 28.420 | 1.00 | 59.88 | | O |
| ANISOU | 4734 | O | HOH | S | 182 | 6128 | 7267 | 9356 | 596 | −1233 | −783 | O |
| HETATM | 4735 | O | HOH | S | 183 | 13.917 | −0.137 | 19.458 | 1.00 | 44.02 | | O |
| ANISOU | 4735 | O | HOH | S | 183 | 5870 | 5619 | 5236 | 147 | −641 | −1176 | O |
| HETATM | 4736 | O | HOH | S | 184 | 26.529 | −16.279 | 22.916 | 1.00 | 60.65 | | O |
| ANISOU | 4736 | O | HOH | S | 184 | 7865 | 6969 | 8212 | 790 | 814 | −1308 | O |
| HETATM | 4737 | O | HOH | S | 185 | 23.118 | 41.770 | 29.936 | 1.00 | 46.65 | | O |
| ANISOU | 4737 | O | HOH | S | 185 | 6554 | 3680 | 7491 | −671 | −542 | −92 | O |
| HETATM | 4738 | O | HOH | S | 186 | 29.120 | 22.358 | 31.185 | 1.00 | 52.46 | | O |
| ANISOU | 4738 | O | HOH | S | 186 | 6137 | 6332 | 7464 | −541 | −418 | −297 | O |
| HETATM | 4739 | O | HOH | S | 187 | 29.514 | 11.667 | 49.205 | 1.00 | 55.68 | | O |
| ANISOU | 4739 | O | HOH | S | 187 | 6938 | 7210 | 7007 | −237 | −1487 | −720 | O |
| HETATM | 4740 | O | HOH | S | 188 | 22.322 | 9.179 | 61.292 | 1.00 | 57.67 | | O |
| ANISOU | 4740 | O | HOH | S | 188 | 9021 | 7407 | 5486 | 124 | −1114 | −874 | O |
| HETATM | 4741 | O | HOH | S | 189 | 34.717 | −15.448 | 29.660 | 1.00 | 51.52 | | O |
| ANISOU | 4741 | O | HOH | S | 189 | 5663 | 6003 | 7909 | 1170 | 827 | −522 | O |
| HETATM | 4742 | O | HOH | S | 190 | 3.655 | 28.442 | 40.299 | 1.00 | 69.57 | | O |
| ANISOU | 4742 | O | HOH | S | 190 | 8747 | 7713 | 9974 | 778 | −52 | −1128 | O |
| HETATM | 4743 | O | HOH | S | 191 | 27.284 | 21.879 | 32.771 | 1.00 | 55.79 | | O |
| ANISOU | 4743 | O | HOH | S | 191 | 6658 | 6771 | 7769 | −462 | −531 | −427 | O |
| HETATM | 4744 | O | HOH | S | 192 | 23.212 | 17.528 | 35.383 | 1.00 | 54.57 | | O |
| ANISOU | 4744 | O | HOH | S | 192 | 6608 | 6814 | 7312 | −202 | −583 | −639 | O |
| HETATM | 4745 | O | HOH | S | 193 | −1.356 | 5.012 | 40.566 | 1.00 | 52.85 | | O |
| ANISOU | 4745 | O | HOH | S | 193 | 5495 | 6409 | 8175 | 200 | 323 | −904 | O |
| HETATM | 4746 | O | HOH | S | 194 | 0.935 | −3.498 | 25.985 | 1.00 | 56.00 | | O |
| ANISOU | 4746 | O | HOH | S | 194 | 6197 | 6794 | 8288 | −214 | −1137 | −1342 | O |
| HETATM | 4747 | O | HOH | S | 195 | 16.176 | 8.077 | 14.051 | 1.00 | 59.32 | | O |
| ANISOU | 4747 | O | HOH | S | 195 | 8361 | 7696 | 6480 | 256 | −604 | −705 | O |
| HETATM | 4748 | O | HOH | S | 196 | 18.986 | 16.457 | 60.268 | 1.00 | 70.29 | | O |
| ANISOU | 4748 | O | HOH | S | 196 | 10792 | 8681 | 7235 | 50 | −754 | −1450 | O |
| HETATM | 4749 | O | HOH | S | 197 | 11.692 | 14.966 | 36.228 | 1.00 | 40.69 | | O |
| ANISOU | 4749 | O | HOH | S | 197 | 4866 | 5022 | 5573 | 181 | −423 | −851 | O |
| HETATM | 4750 | O | HOH | S | 199 | 15.442 | 15.919 | 57.024 | 1.00 | 83.24 | | O |
| ANISOU | 4750 | O | HOH | S | 199 | 11961 | 10291 | 9376 | 170 | −231 | −1354 | O |
| HETATM | 4751 | O | HOH | S | 200 | 20.380 | −26.352 | 32.758 | 1.00 | 51.73 | | O |
| ANISOU | 4751 | O | HOH | S | 200 | 6730 | 4815 | 8109 | 578 | 615 | −937 | O |
| HETATM | 4752 | O | HOH | S | 201 | 13.668 | 1.680 | 28.129 | 1.00 | 42.56 | | O |
| ANISOU | 4752 | O | HOH | S | 201 | 5101 | 5443 | 5628 | 107 | −455 | −949 | O |
| HETATM | 4753 | O | HOH | S | 202 | 29.953 | 10.112 | 32.471 | 1.00 | 50.36 | | O |
| ANISOU | 4753 | O | HOH | S | 202 | 5572 | 6571 | 6991 | −109 | −285 | −407 | O |
| HETATM | 4754 | O | HOH | S | 203 | 35.728 | −20.013 | 31.054 | 1.00 | 66.71 | | O |
| ANISOU | 4754 | O | HOH | S | 203 | 7581 | 7568 | 10199 | 1463 | 916 | −429 | O |
| HETATM | 4755 | O | HOH | S | 204 | 14.808 | 13.377 | 57.814 | 1.00 | 65.65 | | O |
| ANISOU | 4755 | O | HOH | S | 204 | 9752 | 8147 | 7045 | 226 | −81 | −1213 | O |
| HETATM | 4756 | O | HOH | S | 205 | −0.522 | 0.513 | 34.703 | 1.00 | 50.23 | | O |
| ANISOU | 4756 | O | HOH | S | 205 | 5091 | 6090 | 7904 | −32 | −295 | −1005 | O |
| HETATM | 4757 | O | HOH | S | 206 | −8.051 | 0.908 | 24.647 | 1.00 | 57.96 | | O |
| ANISOU | 4757 | O | HOH | S | 206 | 5527 | 7003 | 9491 | −152 | −1795 | −1216 | O |
| HETATM | 4758 | O | HOH | S | 207 | 25.069 | −1.573 | 27.700 | 1.00 | 49.46 | | O |
| ANISOU | 4758 | O | HOH | S | 207 | 5882 | 6369 | 6541 | 304 | 109 | −736 | O |
| HETATM | 4759 | O | HOH | S | 208 | 18.279 | −19.207 | 43.523 | 1.00 | 57.01 | | O |
| ANISOU | 4759 | O | HOH | S | 208 | 7216 | 6257 | 8189 | 428 | 379 | −115 | O |
| HETATM | 4760 | O | HOH | S | 209 | 18.755 | 11.231 | 33.305 | 1.00 | 47.93 | | O |
| ANISOU | 4760 | O | HOH | S | 209 | 5750 | 6149 | 6311 | 34 | −438 | −699 | O |
| HETATM | 4761 | O | HOH | S | 210 | 25.931 | −3.500 | 44.355 | 1.00 | 56.40 | | O |
| ANISOU | 4761 | O | HOH | S | 210 | 6766 | 7251 | 7415 | 350 | −526 | −283 | O |
| HETATM | 4762 | O | HOH | S | 211 | 23.013 | 17.682 | 32.586 | 1.00 | 48.46 | | O |
| ANISOU | 4762 | O | HOH | S | 211 | 5835 | 6044 | 6531 | −177 | −490 | −547 | O |
| HETATM | 4763 | O | HOH | S | 212 | 3.035 | −2.374 | 25.800 | 1.00 | 68.33 | | O |
| ANISOU | 4763 | O | HOH | S | 212 | 7944 | 8439 | 9578 | −128 | −1052 | −1288 | O |
| HETATM | 4764 | O | HOH | S | 213 | 17.396 | −21.580 | 42.867 | 1.00 | 52.97 | | O |
| ANISOU | 4764 | O | HOH | S | 213 | 6743 | 5500 | 7884 | 396 | 494 | −136 | O |
| HETATM | 4765 | O | HOH | S | 214 | 33.471 | −14.436 | 36.989 | 1.00 | 62.69 | | O |
| ANISOU | 4765 | O | HOH | S | 214 | 6994 | 7554 | 9272 | 1029 | 122 | −138 | O |
| HETATM | 4766 | O | HOH | S | 215 | 8.418 | 29.284 | 29.912 | 1.00 | 63.68 | | O |
| ANISOU | 4766 | O | HOH | S | 215 | 8097 | 7115 | 8982 | 515 | −771 | −470 | O |
| HETATM | 4767 | O | HOH | S | 216 | 17.649 | 1.739 | 28.073 | 1.00 | 52.30 | | O |

TABLE 11-continued

| | | | | | | | | | | | |
|---|---|---|---|---|---|---|---|---|---|---|---|
| ANISOU | 4767 | O | HOH | S | 216 | 6373 | 6727 | 6771 | 145 | −292 | −862 | O |
| HETATM | 4768 | O | HOH | S | 217 | 9.382 | −17.451 | 22.699 | 1.00 | 75.03 | | O |
| ANISOU | 4768 | O | HOH | S | 217 | 9719 | 8458 | 10332 | −232 | −550 | −1901 | O |
| HETATM | 4769 | O | HOH | S | 218 | −2.816 | 20.802 | 30.075 | 1.00 | 71.01 | | O |
| ANISOU | 4769 | O | HOH | S | 218 | 7861 | 8451 | 10669 | 830 | −981 | −679 | O |
| HETATM | 4770 | O | HOH | S | 219 | 21.785 | 30.565 | 34.499 | 1.00 | 50.05 | | O |
| ANISOU | 4770 | O | HOH | S | 219 | 6506 | 5331 | 7180 | −398 | −679 | −615 | O |
| HETATM | 4771 | O | HOH | S | 222 | 3.887 | −5.965 | 25.675 | 1.00 | 66.67 | | O |
| ANISOU | 4771 | O | HOH | S | 222 | 7845 | 8095 | 9393 | −216 | −959 | −1402 | O |
| HETATM | 4772 | O | HOH | S | 227 | 15.214 | 17.387 | 47.924 | 1.00 | 47.27 | | O |
| ANISOU | 4772 | O | HOH | S | 227 | 6428 | 5724 | 5809 | 90 | −346 | −1169 | O |
| HETATM | 4773 | O | HOH | S | 228 | −1.846 | 9.411 | 17.736 | 1.00 | 73.42 | | O |
| ANISOU | 4773 | O | HOH | S | 228 | 8712 | 9260 | 9925 | 303 | −2365 | −914 | O |
| HETATM | 4774 | O | HOH | S | 230 | 32.717 | 26.288 | 15.661 | 1.00 | 67.28 | | O |
| ANISOU | 4774 | O | HOH | S | 230 | 8693 | 7993 | 8876 | −548 | 1025 | 820 | O |
| HETATM | 4775 | O | HOH | S | 231 | 33.169 | −9.968 | 27.975 | 1.00 | 57.43 | | O |
| ANISOU | 4775 | O | HOH | S | 231 | 6488 | 7089 | 8246 | 842 | 712 | −594 | O |
| HETATM | 4776 | O | HOH | S | 233 | −4.026 | 16.011 | 30.923 | 1.00 | 54.17 | | O |
| ANISOU | 4776 | O | HOH | S | 233 | 5448 | 6481 | 8653 | 649 | −899 | −801 | O |
| HETATM | 4777 | O | HOH | S | 234 | 20.152 | 20.263 | 12.034 | 1.00 | 51.25 | | O |
| ANISOU | 4777 | O | HOH | S | 234 | 7638 | 6391 | 5443 | 187 | −190 | 255 | O |
| HETATM | 4778 | O | HOH | S | 235 | 0.661 | 6.843 | 39.999 | 1.00 | 50.31 | | O |
| ANISOU | 4778 | O | HOH | S | 235 | 5375 | 6144 | 7596 | 246 | 174 | −922 | O |
| HETATM | 4779 | O | HOH | S | 236 | 11.706 | 12.217 | 34.928 | 1.00 | 43.63 | | O |
| ANISOU | 4779 | O | HOH | S | 236 | 5166 | 5483 | 5928 | 163 | −436 | −832 | O |
| HETATM | 4780 | O | HOH | S | 238 | 5.374 | −5.870 | 47.060 | 1.00 | 55.22 | | O |
| ANISOU | 4780 | O | HOH | S | 238 | 6629 | 6590 | 7763 | 27 | 812 | −484 | O |
| HETATM | 4781 | O | HOH | S | 241 | 2.662 | −0.770 | 28.437 | 1.00 | 44.39 | | O |
| ANISOU | 4781 | O | HOH | S | 241 | 4754 | 5434 | 6677 | −76 | −849 | −1166 | O |
| HETATM | 4782 | O | HOH | S | 242 | −2.501 | 18.890 | 31.745 | 1.00 | 61.69 | | O |
| ANISOU | 4782 | O | HOH | S | 242 | 6642 | 7340 | 9455 | 735 | −779 | −771 | O |
| HETATM | 4783 | O | HOH | S | 243 | 31.766 | −0.877 | 31.091 | 1.00 | 62.94 | | O |
| ANISOU | 4783 | O | HOH | S | 243 | 7041 | 8154 | 8721 | 365 | 126 | −428 | O |
| HETATM | 4784 | O | HOH | S | 244 | 30.058 | −2.807 | 30.307 | 1.00 | 67.43 | | O |
| ANISOU | 4784 | O | HOH | S | 244 | 7781 | 8657 | 9182 | 422 | 191 | −527 | O |
| HETATM | 4785 | O | HOH | S | 245 | 3.588 | 5.390 | 15.738 | 1.00 | 56.96 | | O |
| ANISOU | 4785 | O | HOH | S | 245 | 7330 | 7263 | 7051 | 155 | −1974 | −1113 | O |
| HETATM | 4786 | O | HOH | S | 246 | 6.596 | −15.153 | 24.778 | 1.00 | 59.01 | | O |
| ANISOU | 4786 | O | HOH | S | 246 | 7304 | 6576 | 8541 | −344 | −677 | −1723 | O |
| HETATM | 4787 | O | HOH | S | 248 | 28.209 | 14.120 | 32.211 | 1.00 | 51.03 | | O |
| ANISOU | 4787 | O | HOH | S | 248 | 5832 | 6543 | 7014 | −223 | −367 | −429 | O |
| HETATM | 4788 | O | HOH | S | 249 | 27.535 | 18.229 | 34.007 | 1.00 | 59.22 | | O |
| ANISOU | 4788 | O | HOH | S | 249 | 6984 | 7404 | 8112 | −363 | −551 | −486 | O |
| HETATM | 4789 | O | HOH | S | 250 | 31.912 | 15.875 | 30.398 | 1.00 | 64.74 | | O |
| ANISOU | 4789 | O | HOH | S | 250 | 7345 | 8231 | 9023 | −368 | −205 | −249 | O |
| HETATM | 4790 | O | HOH | S | 251 | 31.579 | 18.131 | 28.794 | 1.00 | 54.75 | | O |
| ANISOU | 4790 | O | HOH | S | 251 | 6186 | 6868 | 7747 | −433 | −117 | −173 | O |
| HETATM | 4791 | O | HOH | S | 252 | 4.622 | 32.239 | 40.275 | 1.00 | 68.60 | | O |
| ANISOU | 4791 | O | HOH | S | 252 | 8876 | 7263 | 9928 | 803 | −96 | −1167 | O |
| HETATM | 4792 | O | HOH | S | 253 | 7.120 | 32.888 | 40.758 | 1.00 | 51.24 | | O |
| ANISOU | 4792 | O | HOH | S | 253 | 6876 | 5030 | 7564 | 627 | −181 | −1212 | O |
| HETATM | 4793 | O | HOH | S | 254 | 2.368 | 28.984 | 32.907 | 1.00 | 64.47 | | O |
| ANISOU | 4793 | O | HOH | S | 254 | 7814 | 7118 | 9564 | 874 | −625 | −679 | C |
| HETATM | 4794 | O | HOH | S | 255 | 10.023 | −20.118 | 29.055 | 1.00 | 66.71 | | O |
| ANISOU | 4794 | O | HOH | S | 255 | 8369 | 7171 | 9806 | −205 | −72 | −1468 | O |
| HETATM | 4795 | O | HOH | S | 256 | 13.185 | −21.576 | 30.645 | 1.00 | 57.07 | | O |
| ANISOU | 4795 | O | HOH | S | 256 | 7245 | 5872 | 8568 | 5 | 178 | −1286 | O |
| HETATM | 4796 | O | HOH | S | 257 | 15.557 | −25.558 | 36.996 | 1.00 | 57.22 | | O |
| ANISOU | 4796 | O | HOH | S | 257 | 7313 | 5537 | 8890 | 229 | 562 | −666 | O |
| HETATM | 4797 | O | HOH | S | 258 | 16.819 | −25.009 | 33.662 | 1.00 | 52.22 | | O |
| ANISOU | 4797 | O | HOH | S | 258 | 6723 | 4973 | 8147 | 292 | 485 | −951 | O |
| HETATM | 4798 | O | HOH | S | 259 | 34.784 | −11.513 | 32.400 | 1.00 | 62.09 | | O |
| ANISOU | 4798 | O | HOH | S | 259 | 6790 | 7637 | 9163 | 953 | 430 | −336 | O |
| HETATM | 4799 | O | HOH | S | 260 | 20.926 | 40.168 | 17.322 | 1.00 | 60.97 | | O |
| ANISOU | 4799 | O | HOH | S | 260 | 8904 | 5862 | 8399 | −183 | −214 | 1118 | O |
| HETATM | 4800 | O | HOH | S | 261 | 17.609 | 36.740 | 18.382 | 1.00 | 61.43 | | O |
| ANISOU | 4800 | O | HOH | S | 261 | 8786 | 6312 | 8243 | 87 | −531 | 780 | O |
| HETATM | 4801 | O | HOH | S | 262 | 15.558 | 31.689 | 20.983 | 1.00 | 58.37 | | O |
| ANISOU | 4801 | O | HOH | S | 262 | 8021 | 6400 | 7759 | 189 | −704 | 296 | O |
| HETATM | 4802 | O | HOH | S | 263 | 14.009 | 34.471 | 23.280 | 1.00 | 52.37 | | O |
| ANISOU | 4802 | O | HOH | S | 263 | 7232 | 5333 | 7335 | 265 | −769 | 211 | O |
| HETATM | 4803 | O | HOH | S | 264 | 16.334 | 24.616 | 19.934 | 1.00 | 41.10 | | O |
| ANISOU | 4803 | O | HOH | S | 264 | 5686 | 4784 | 5147 | 164 | −650 | 54 | O |
| HETATM | 4804 | O | HOH | S | 265 | 13.988 | 23.637 | 18.468 | 1.00 | 55.32 | | O |
| ANISOU | 4804 | O | HOH | S | 265 | 7556 | 6652 | 6811 | 288 | −860 | 39 | O |
| HETATM | 4805 | O | HOH | S | 266 | 14.097 | 23.452 | 15.466 | 1.00 | 62.88 | | O |
| ANISOU | 4805 | O | HOH | S | 266 | 8786 | 7652 | 7453 | 332 | −903 | 177 | O |
| HETATM | 4806 | O | HOH | S | 267 | 10.888 | 23.111 | 12.686 | 1.00 | 70.99 | | O |
| ANISOU | 4806 | O | HOH | S | 267 | 10026 | 8718 | 8227 | 504 | −1344 | 232 | O |
| HETATM | 4807 | O | HOH | S | 268 | 7.912 | 24.204 | 16.044 | 1.00 | 54.88 | | O |

TABLE 11-continued

| | | | | | | | | | | | |
|---|---|---|---|---|---|---|---|---|---|---|---|
| ANISOU | 4807 | O | HOH | S | 268 | 7528 | 6555 | 6767 | 591 | −1524 | 102 | O |
| HETATM | 4808 | O | HOH | S | 269 | 3.438 | 23.373 | 15.312 | 1.00 | 59.99 | | O |
| ANISOU | 4808 | O | HOH | S | 269 | 7943 | 7227 | 7622 | 764 | −2043 | 40 | O |
| HETATM | 4809 | O | HOH | S | 270 | 5.768 | 26.319 | 11.469 | 1.00 | 72.44 | | O |
| ANISOU | 4809 | O | HOH | S | 270 | 10177 | 8696 | 8650 | 812 | −2035 | 458 | O |
| HETATM | 4810 | O | HOH | S | 271 | 6.514 | 26.849 | 9.074 | 1.00 | 77.20 | | O |
| ANISOU | 4810 | O | HOH | S | 271 | 11145 | 9303 | 8886 | 836 | −2083 | 640 | O |
| HETATM | 4811 | O | HOH | S | 272 | 9.567 | 29.877 | 9.316 | 1.00 | 65.36 | | O |
| ANISOU | 4811 | O | HOH | S | 272 | 9847 | 7583 | 7405 | 749 | −1619 | 911 | O |
| HETATM | 4812 | O | HOH | S | 274 | 24.462 | 37.546 | 21.028 | 1.00 | 52.07 | | O |
| ANISOU | 4812 | O | HOH | S | 274 | 7267 | 4994 | 7522 | −516 | −93 | 706 | O |
| HETATM | 4813 | O | HOH | S | 275 | 24.822 | 34.989 | 20.477 | 1.00 | 53.13 | | O |
| ANISOU | 4813 | O | HOH | S | 275 | 7313 | 5418 | 7456 | −473 | −42 | 656 | O |
| HETATM | 4814 | O | HOH | S | 276 | 31.789 | 32.811 | 21.481 | 1.00 | 60.38 | | O |
| ANISOU | 4814 | O | HOH | S | 276 | 7612 | 6527 | 8803 | −916 | 370 | 668 | O |
| HETATM | 4815 | O | HOH | S | 277 | 34.909 | 28.000 | 19.517 | 1.00 | 60.69 | | O |
| ANISOU | 4815 | O | HOH | S | 277 | 7342 | 6996 | 8721 | −840 | 825 | 725 | O |
| HETATM | 4816 | O | HOH | S | 278 | 38.702 | 27.083 | 21.428 | 1.00 | 70.02 | | O |
| ANISOU | 4816 | O | HOH | S | 278 | 7927 | 8222 | 10457 | −1043 | 891 | 697 | O |
| HETATM | 4817 | O | HOH | S | 279 | 31.236 | 23.923 | 14.088 | 1.00 | 73.07 | | O |
| ANISOU | 4817 | O | HOH | S | 279 | 9674 | 8906 | 9184 | −346 | 1022 | 726 | O |
| HETATM | 4818 | O | HOH | S | 281 | 23.014 | 19.323 | 12.589 | 1.00 | 52.89 | | O |
| ANISOU | 4818 | O | HOH | S | 281 | 7693 | 6637 | 5765 | 101 | 162 | 247 | O |
| HETATM | 4819 | O | HOH | S | 282 | 19.701 | 23.107 | 10.776 | 1.00 | 56.85 | | O |
| ANISOU | 4819 | O | HOH | S | 282 | 8557 | 6960 | 6082 | 208 | −237 | 503 | O |
| HETATM | 4820 | O | HOH | S | 283 | 22.203 | 24.274 | 10.828 | 1.00 | 56.39 | | O |
| ANISOU | 4820 | O | HOH | S | 283 | 8457 | 6826 | 6140 | 97 | 93 | 650 | O |
| HETATM | 4821 | O | HOH | S | 284 | 18.459 | 21.779 | 6.425 | 1.00 | 56.04 | | O |
| ANISOU | 4821 | O | HOH | S | 284 | 9068 | 6969 | 5254 | 362 | −367 | 571 | O |
| HETATM | 4822 | O | HOH | S | 285 | 16.262 | 17.696 | 8.908 | 1.00 | 70.51 | | O |
| ANISOU | 4822 | O | HOH | S | 285 | 10487 | 8961 | 7343 | 365 | −699 | 81 | O |
| HETATM | 4823 | O | HOH | S | 286 | 19.972 | 15.966 | 4.674 | 1.00 | 71.62 | | O |
| ANISOU | 4823 | O | HOH | S | 286 | 11266 | 9188 | 6758 | 394 | −82 | 159 | O |
| HETATM | 4824 | O | HOH | S | 287 | 18.644 | 16.878 | 1.759 | 1.00 | 66.47 | | O |
| ANISOU | 4824 | O | HOH | S | 287 | 11148 | 8531 | 5577 | 488 | −294 | 293 | O |
| HETATM | 4825 | O | HOH | S | 288 | 18.636 | 7.341 | 7.375 | 1.00 | 58.54 | | O |
| ANISOU | 4825 | O | HOH | S | 288 | 9199 | 7637 | 5408 | 379 | −271 | −675 | O |
| HETATM | 4826 | O | HOH | S | 289 | 1.633 | 4.137 | 17.478 | 1.00 | 49.33 | | O |
| ANISOU | 4826 | O | HOH | S | 289 | 6020 | 6238 | 6484 | 87 | −2018 | −1194 | O |
| HETATM | 4827 | O | HOH | S | 290 | −2.487 | 0.462 | 17.780 | 1.00 | 60.73 | | O |
| ANISOU | 4827 | O | HOH | S | 290 | 7060 | 7535 | 8480 | −115 | −2279 | −1382 | O |
| HETATM | 4828 | O | HOH | S | 291 | 0.201 | 3.855 | 12.517 | 1.00 | 57.20 | | O |
| ANISOU | 4828 | O | HOH | S | 291 | 7435 | 7257 | 7042 | 87 | −2587 | −1248 | O |
| HETATM | 4829 | O | HOH | S | 292 | 1.653 | 3.105 | 8.652 | 1.00 | 73.83 | | O |
| ANISOU | 4829 | O | HOH | S | 292 | 10173 | 9407 | 8471 | 100 | −2688 | −1309 | O |
| HETATM | 4830 | O | HOH | S | 293 | 0.734 | 5.389 | 10.557 | 1.00 | 55.81 | | O |
| ANISOU | 4830 | O | HOH | S | 293 | 7551 | 7128 | 6525 | 169 | −2713 | −1150 | O |
| HETATM | 4831 | O | HOH | S | 294 | 15.026 | −7.941 | 23.634 | 1.00 | 55.68 | | O |
| ANISOU | 4831 | O | HOH | S | 294 | 7139 | 6786 | 7232 | 128 | −299 | −1342 | O |
| HETATM | 4832 | O | HOH | S | 295 | 0.244 | 23.313 | 29.028 | 1.00 | 61.23 | | O |
| ANISOU | 4832 | O | HOH | S | 295 | 7026 | 7141 | 9096 | 802 | −1021 | −581 | O |
| HETATM | 4833 | O | HOH | S | 296 | −3.763 | 22.266 | 36.543 | 1.00 | 59.07 | | O |
| ANISOU | 4833 | O | HOH | S | 296 | 6337 | 6737 | 9371 | 959 | −199 | −896 | O |
| HETATM | 4834 | O | HOH | S | 297 | 35.685 | 5.621 | 41.656 | 1.00 | 76.85 | | O |
| ANISOU | 4834 | O | HOH | S | 297 | 8489 | 10040 | 10671 | −19 | −1059 | −252 | O |
| HETATM | 4835 | O | HOH | S | 298 | 14.091 | 7.768 | 62.410 | 1.00 | 77.16 | | O |
| ANISOU | 4835 | O | HOH | S | 298 | 11740 | 9710 | 7868 | 363 | 247 | −859 | O |
| HETATM | 4836 | O | HOH | S | 299 | 25.524 | 10.979 | 41.492 | 1.00 | 53.19 | | O |
| ANISOU | 4836 | O | HOH | S | 299 | 6360 | 6872 | 6980 | −115 | −766 | −666 | O |
| HETATM | 4837 | O | HOH | S | 300 | 27.168 | −4.868 | 46.052 | 1.00 | 51.85 | | O |
| ANISOU | 4837 | O | HOH | S | 300 | 6218 | 6657 | 6825 | 426 | −631 | −155 | O |
| HETATM | 4838 | O | HOH | S | 301 | 28.569 | −7.974 | 48.764 | 1.00 | 80.86 | | O |
| ANISOU | 4838 | O | HOH | S | 301 | 9999 | 10249 | 10475 | 592 | −764 | 103 | O |
| HETATM | 4839 | O | HOH | S | 302 | 24.587 | −7.899 | 60.519 | 1.00 | 55.27 | | O |
| ANISOU | 4839 | O | HOH | S | 302 | 8249 | 6998 | 5752 | 641 | −864 | 476 | O |
| HETATM | 4840 | O | HOH | S | 303 | −0.255 | −6.500 | 38.592 | 1.00 | 60.80 | | O |
| ANISOU | 4840 | O | HOH | S | 303 | 6499 | 7161 | 9443 | −246 | 253 | −881 | O |
| HETATM | 4841 | O | HOH | S | 304 | 1.640 | −4.621 | 35.862 | 1.00 | 58.18 | | O |
| ANISOU | 4841 | O | HOH | S | 304 | 6304 | 6975 | 8826 | −168 | −89 | −984 | O |
| HETATM | 4842 | O | HOH | S | 305 | 1.153 | −12.088 | 36.905 | 1.00 | 52.17 | | O |
| ANISOU | 4842 | O | HOH | S | 305 | 5568 | 5788 | 8466 | −416 | 171 | −952 | O |
| HETATM | 4843 | O | HOH | S | 306 | 28.142 | 0.656 | 37.834 | 1.00 | 75.09 | | O |
| ANISOU | 4843 | O | HOH | S | 306 | 8791 | 9715 | 10023 | 226 | −394 | −439 | O |
| HETATM | 4844 | O | HOH | S | 307 | 9.176 | 1.498 | 15.347 | 1.00 | 53.31 | | O |
| ANISOU | 4844 | O | HOH | S | 307 | 7289 | 6804 | 6162 | 119 | −1326 | −1270 | O |
| HETATM | 4845 | O | HOH | S | 308 | 19.451 | 3.107 | 34.222 | 1.00 | 44.58 | | O |
| ANISOU | 4845 | O | HOH | S | 308 | 5245 | 5778 | 5916 | 125 | −289 | −725 | O |
| HETATM | 4846 | O | HOH | S | 309 | 22.566 | 15.232 | 47.745 | 1.00 | 48.22 | | O |
| ANISOU | 4846 | O | HOH | S | 309 | 6349 | 6054 | 5920 | −152 | −909 | −981 | O |
| HETATM | 4847 | O | HOH | S | 310 | 17.610 | 17.556 | 49.590 | 1.00 | 52.64 | | O |

TABLE 11-continued

| | | | | | | | | | | | | |
|---|---|---|---|---|---|---|---|---|---|---|---|---|
| ANISOU | 4847 | O | HOH | S | 310 | 7260 | 6424 | 6316 | −1 | −550 | −1201 | O |
| HETATM | 4848 | O | HOH | S | 312 | 8.507 | −8.529 | 16.843 | 1.00 | 80.86 | | O |
| ANISOU | 4848 | O | HOH | S | 312 | 10735 | 9862 | 10126 | −107 | −1175 | −1841 | O |
| HETATM | 4849 | O | HOH | S | 313 | 16.577 | −14.436 | 23.415 | 1.00 | 48.68 | | O |
| ANISOU | 4849 | O | HOH | S | 313 | 6443 | 5490 | 6564 | 202 | −29 | −1548 | O |
| HETATM | 4850 | O | HOH | S | 314 | 30.680 | −9.875 | 37.263 | 1.00 | 60.64 | | O |
| ANISOU | 4850 | O | HOH | S | 314 | 6871 | 7549 | 8622 | 701 | −54 | −272 | O |
| HETATM | 4851 | O | HOH | S | 315 | 15.002 | 27.780 | 41.625 | 1.00 | 45.62 | | O |
| ANISOU | 4851 | O | HOH | S | 315 | 6172 | 4886 | 6276 | 38 | −524 | −1158 | O |
| HETATM | 4852 | O | HOH | S | 316 | 5.929 | −11.233 | 52.903 | 1.00 | 60.58 | | O |
| ANISOU | 4852 | O | HOH | S | 316 | 7841 | 6999 | 8176 | 56 | 1366 | 23 | O |
| HETATM | 4853 | O | HOH | S | 317 | 18.453 | 4.212 | 35.888 | 1.00 | 41.76 | | O |
| ANISOU | 4853 | O | HOH | S | 317 | 4906 | 5412 | 5548 | 109 | −319 | −731 | O |
| HETATM | 4854 | O | HOH | S | 318 | 17.277 | −1.072 | 25.567 | 1.00 | 58.32 | | O |
| ANISOU | 4854 | O | HOH | S | 318 | 7274 | 7428 | 7459 | 169 | −269 | −993 | O |
| HETATM | 4855 | O | HOH | S | 319 | 7.774 | 10.957 | 33.208 | 1.00 | 40.43 | | O |
| ANISOU | 4855 | O | HOH | S | 319 | 4580 | 5056 | 5726 | 221 | −508 | −864 | O |
| HETATM | 4856 | O | HOH | S | 320 | 9.465 | 14.447 | 35.257 | 1.00 | 56.66 | | O |
| ANISOU | 4856 | O | HOH | S | 320 | 6788 | 7036 | 7705 | 237 | −436 | −855 | O |
| END | | | | | | | | | | | | |

TABLE 14

| | | | | | | | | | | | | |
|---|---|---|---|---|---|---|---|---|---|---|---|---|
| ATOM | 1 | N | GLY | A | 1 | 21.833 | 37.783 | 18.688 | 1.00 | 62.66 | | N |
| ANISOU | 1 | N | GLY | A | 1 | 8134 | 7021 | 8653 | −443 | −601 | 144 | N |
| ATOM | 2 | CA | GLY | A | 1 | 20.457 | 37.338 | 18.612 | 1.00 | 65.31 | | C |
| ANISOU | 2 | CA | GLY | A | 1 | 8497 | 7375 | 8941 | −372 | −617 | 98 | C |
| ATOM | 3 | C | GLY | A | 1 | 20.197 | 36.245 | 19.622 | 1.00 | 69.16 | | C |
| ANISOU | 3 | C | GLY | A | 1 | 8962 | 7919 | 9396 | −350 | −618 | 4 | C |
| ATOM | 4 | O | GLY | A | 1 | 21.127 | 35.670 | 20.199 | 1.00 | 72.22 | | O |
| ANISOU | 4 | O | GLY | A | 1 | 9312 | 8346 | 9781 | −385 | −602 | −17 | O |
| ATOM | 5 | N | SER | A | 2 | 18.924 | 35.957 | 19.844 | 1.00 | 58.71 | | N |
| ANISOU | 5 | N | SER | A | 2 | 7658 | 6598 | 8051 | −291 | −638 | −49 | N |
| ATOM | 6 | CA | SER | A | 2 | 18.545 | 35.018 | 20.880 | 1.00 | 60.22 | | C |
| ANISOU | 6 | CA | SER | A | 2 | 7831 | 6832 | 8218 | −268 | −639 | −138 | C |
| ATOM | 7 | C | SER | A | 2 | 18.802 | 33.577 | 20.417 | 1.00 | 52.64 | | C |
| ANISOU | 7 | C | SER | A | 2 | 6845 | 5976 | 7181 | −256 | −603 | −135 | C |
| ATOM | 8 | O | SER | A | 2 | 18.970 | 33.294 | 19.229 | 1.00 | 48.57 | | O |
| ANISOU | 8 | O | SER | A | 2 | 6335 | 5498 | 6621 | −251 | −580 | −72 | O |
| ATOM | 9 | CB | SER | A | 2 | 17.079 | 35.262 | 21.264 | 1.00 | 61.95 | | C |
| ANISOU | 9 | CB | SER | A | 2 | 8074 | 7013 | 8450 | −210 | −668 | −189 | C |
| ATOM | 10 | OG | SER | A | 2 | 16.467 | 34.088 | 21.762 | 1.00 | 71.05 | | O |
| ANISOU | 10 | OG | SER | A | 2 | 9208 | 8229 | 9557 | −173 | −659 | −252 | O |
| ATOM | 11 | N | HIS | A | 3 | 18.876 | 32.662 | 21.385 | 1.00 | 47.34 | | N |
| ANISOU | 11 | N | HIS | A | 3 | 6149 | 5347 | 6491 | −252 | −597 | −203 | N |
| ATOM | 12 | CA | HIS | A | 3 | 19.246 | 31.289 | 21.075 | 1.00 | 40.91 | | C |
| ANISOU | 12 | CA | HIS | A | 3 | 5309 | 4623 | 5611 | −244 | −561 | −203 | C |
| ATOM | 13 | C | HIS | A | 3 | 18.466 | 30.358 | 21.984 | 1.00 | 41.19 | | C |
| ANISOU | 13 | C | HIS | A | 3 | 5336 | 4691 | 5624 | −208 | −567 | −284 | C |
| ATOM | 14 | O | HIS | A | 3 | 17.961 | 30.757 | 23.039 | 1.00 | 40.36 | | O |
| ANISOU | 14 | O | HIS | A | 3 | 5237 | 4545 | 5555 | −199 | −591 | −341 | O |
| ATOM | 15 | CB | HIS | A | 3 | 20.759 | 31.046 | 21.235 | 1.00 | 39.42 | | C |
| ANISOU | 15 | CB | HIS | A | 3 | 5084 | 4464 | 5429 | −296 | −533 | −176 | C |
| ATOM | 16 | CG | HIS | A | 3 | 21.589 | 31.791 | 20.242 | 1.00 | 50.83 | | C |
| ANISOU | 16 | CG | HIS | A | 3 | 6530 | 5891 | 6893 | −331 | −515 | −87 | C |
| ATOM | 17 | ND1 | HIS | A | 3 | 21.812 | 31.325 | 18.960 | 1.00 | 51.25 | | N |
| ANISOU | 17 | ND1 | HIS | A | 3 | 6589 | 5993 | 6891 | −318 | −475 | −24 | N |
| ATOM | 18 | CD2 | HIS | A | 3 | 22.237 | 32.978 | 20.332 | 1.00 | 52.11 | | C |
| ANISOU | 18 | CD2 | HIS | A | 3 | 6691 | 5987 | 7122 | −380 | −530 | −48 | C |
| ATOM | 19 | CE1 | HIS | A | 3 | 22.563 | 32.194 | 18.306 | 1.00 | 58.09 | | C |
| ANISOU | 19 | CE1 | HIS | A | 3 | 7455 | 6828 | 7788 | −356 | −461 | 54 | C |
| ATOM | 20 | NE2 | HIS | A | 3 | 22.829 | 33.207 | 19.113 | 1.00 | 53.02 | | N |
| ANISOU | 20 | NE2 | HIS | A | 3 | 6806 | 6114 | 7224 | −395 | −495 | 43 | N |
| ATOM | 21 | N | SER | A | 4 | 18.398 | 29.093 | 21.583 | 1.00 | 39.34 | | N |
| ANISOU | 21 | N | SER | A | 4 | 5089 | 4530 | 5330 | −186 | −541 | −289 | N |
| ATOM | 22 | CA | SER | A | 4 | 17.719 | 28.125 | 22.422 | 1.00 | 42.26 | | C |
| ANISOU | 22 | CA | SER | A | 4 | 5447 | 4932 | 5680 | −156 | −541 | −359 | C |
| ATOM | 23 | C | SER | A | 4 | 18.393 | 26.778 | 22.267 | 1.00 | 41.10 | | C |
| ANISOU | 23 | C | SER | A | 4 | 5275 | 4860 | 5481 | −158 | −505 | −359 | C |
| ATOM | 24 | O | SER | A | 4 | 19.080 | 26.509 | 21.281 | 1.00 | 44.26 | | O |
| ANISOU | 24 | O | SER | A | 4 | 5675 | 5292 | 5850 | −169 | −478 | −307 | O |
| ATOM | 25 | CB | SER | A | 4 | 16.225 | 27.992 | 22.065 | 1.00 | 47.03 | | C |
| ANISOU | 25 | CB | SER | A | 4 | 6068 | 5529 | 6272 | −106 | −562 | −376 | C |
| ATOM | 26 | OG | SER | A | 4 | 16.068 | 27.315 | 20.838 | 1.00 | 51.25 | | O |
| ANISOU | 26 | OG | SER | A | 4 | 6612 | 6109 | 6752 | −90 | −551 | −340 | O |
| ATOM | 27 | N | MET | A | 5 | 18.176 | 25.935 | 23.249 | 1.00 | 42.70 | | N |
| ANISOU | 27 | N | MET | A | 5 | 5460 | 5089 | 5674 | −145 | −501 | −417 | N |

TABLE 14-continued

| | | | | | | | | | | | | |
|---|---|---|---|---|---|---|---|---|---|---|---|---|
| ATOM | 28 | CA | MET | A | 5 | 18.552 | 24.538 | 23.143 | 1.00 | 43.85 | | C |
| ANISOU | 28 | CA | MET | A | 5 | 5587 | 5302 | 5773 | −137 | −469 | −426 | C |
| ATOM | 29 | C | MET | A | 5 | 17.340 | 23.708 | 23.515 | 1.00 | 37.23 | | C |
| ANISOU | 29 | C | MET | A | 5 | 4751 | 4480 | 4915 | −97 | −476 | −478 | C |
| ATOM | 30 | O | MET | A | 5 | 16.659 | 24.006 | 24.501 | 1.00 | 41.80 | | O |
| ANISOU | 30 | O | MET | A | 5 | 5329 | 5031 | 5524 | −85 | −494 | −522 | O |
| ATOM | 31 | CB | MET | A | 5 | 19.715 | 24.192 | 24.059 | 1.00 | 41.79 | | C |
| ANISOU | 31 | CB | MET | A | 5 | 5294 | 5063 | 5523 | −167 | −453 | −437 | C |
| ATOM | 32 | CG | MET | A | 5 | 20.047 | 22.719 | 24.059 | 1.00 | 43.93 | | C |
| ANISOU | 32 | CG | MET | A | 5 | 5543 | 5397 | 5749 | −151 | −419 | −448 | C |
| ATOM | 33 | SD | MET | A | 5 | 21.487 | 22.239 | 25.039 | 1.00 | 42.45 | | S |
| ANISOU | 33 | SD | MET | A | 5 | 5312 | 5242 | 5576 | −183 | −403 | −450 | S |
| ATOM | 34 | CE | MET | A | 5 | 20.860 | 22.181 | 26.690 | 1.00 | 46.27 | | C |
| ANISOU | 34 | CE | MET | A | 5 | 5796 | 5709 | 6074 | −174 | −433 | −523 | C |
| ATOM | 35 | N | ARG | A | 6 | 17.051 | 22.675 | 22.743 | 1.00 | 37.24 | | N |
| ANISOU | 35 | N | ARG | A | 6 | 4756 | 4523 | 4869 | −76 | −460 | −473 | N |
| ATOM | 36 | CA | ARG | A | 6 | 15.828 | 21.933 | 23.028 | 1.00 | 34.06 | | C |
| ANISOU | 36 | CA | ARG | A | 6 | 4352 | 4130 | 4458 | −42 | −472 | −517 | C |
| ATOM | 37 | C | ARG | A | 6 | 16.034 | 20.466 | 22.740 | 1.00 | 38.39 | | C |
| ANISOU | 37 | C | ARG | A | 6 | 4895 | 4732 | 4960 | −32 | −445 | −527 | C |
| ATOM | 38 | O | ARG | A | 6 | 16.620 | 20.114 | 21.722 | 1.00 | 40.07 | | O |
| ANISOU | 38 | O | ARG | A | 6 | 5121 | 4971 | 5134 | −36 | −426 | −493 | O |
| ATOM | 39 | CB | ARG | A | 6 | 14.638 | 22.403 | 22.186 | 1.00 | 44.23 | | C |
| ANISOU | 39 | CB | ARG | A | 6 | 5662 | 5394 | 5750 | −18 | −505 | −504 | C |
| ATOM | 40 | CG | ARG | A | 6 | 14.451 | 23.879 | 22.110 | 1.00 | 55.26 | | C |
| ANISOU | 40 | CG | ARG | A | 6 | 7073 | 6735 | 7190 | −24 | −531 | −480 | C |
| ATOM | 41 | CD | ARG | A | 6 | 12.999 | 24.229 | 22.340 | 1.00 | 71.26 | | C |
| ANISOU | 41 | CD | ARG | A | 6 | 9099 | 8729 | 9249 | 10 | −563 | −504 | C |
| ATOM | 42 | NE | ARG | A | 6 | 12.767 | 25.639 | 22.057 | 1.00 | 80.33 | | N |
| ANISOU | 42 | NE | ARG | A | 6 | 10265 | 9819 | 10436 | 11 | −588 | −474 | N |
| ATOM | 43 | CZ | ARG | A | 6 | 13.108 | 26.631 | 22.875 | 1.00 | 85.09 | | C |
| ANISOU | 43 | CZ | ARG | A | 6 | 10871 | 10373 | 11085 | −3 | −590 | −485 | C |
| ATOM | 44 | NH1 | ARG | A | 6 | 12.855 | 27.878 | 22.503 | 1.00 | 93.32 | | N |
| ANISOU | 44 | NH1 | ARG | A | 6 | 11934 | 11358 | 12165 | 0 | −614 | −454 | N |
| ATOM | 45 | NH2 | ARG | A | 6 | 13.710 | 26.390 | 24.052 | 1.00 | 70.75 | | N |
| ANISOU | 45 | NH2 | ARG | A | 6 | 9042 | 8563 | 9277 | −20 | −571 | −526 | N |
| ATOM | 46 | N | TYR | A | 7 | 15.560 | 19.627 | 23.638 | 1.00 | 34.86 | | N |
| ANISOU | 46 | N | TYR | A | 7 | 4429 | 4299 | 4516 | −18 | −440 | −573 | N |
| ATOM | 47 | CA | TYR | A | 7 | 15.487 | 18.195 | 23.405 | 1.00 | 30.94 | | C |
| ANISOU | 47 | CA | TYR | A | 7 | 3930 | 3844 | 3984 | −5 | −420 | −588 | C |
| ATOM | 48 | C | TYR | A | 7 | 14.054 | 17.742 | 23.161 | 1.00 | 33.10 | | C |
| ANISOU | 48 | C | TYR | A | 7 | 4207 | 4111 | 4257 | 20 | −445 | −613 | C |
| ATOM | 49 | O | TYR | A | 7 | 13.135 | 18.178 | 23.840 | 1.00 | 34.89 | | O |
| ANISOU | 49 | O | TYR | A | 7 | 4421 | 4312 | 4522 | 31 | −464 | −635 | O |
| ATOM | 50 | CB | TYR | A | 7 | 16.041 | 17.435 | 24.591 | 1.00 | 32.24 | | C |
| ANISOU | 50 | CB | TYR | A | 7 | 4068 | 4029 | 4153 | −9 | −394 | −616 | C |
| ATOM | 51 | CG | TYR | A | 7 | 17.542 | 17.579 | 24.683 | 1.00 | 34.83 | | C |
| ANISOU | 51 | CG | TYR | A | 7 | 4384 | 4373 | 4476 | −33 | −370 | −588 | C |
| ATOM | 52 | CD1 | TYR | A | 7 | 18.382 | 16.725 | 23.971 | 1.00 | 32.94 | | C |
| ANISOU | 52 | CD1 | TYR | A | 7 | 4144 | 4170 | 4201 | −32 | −336 | −565 | C |
| ATOM | 53 | CD2 | TYR | A | 7 | 18.116 | 18.576 | 25.461 | 1.00 | 34.91 | | C |
| ANISOU | 53 | CD2 | TYR | A | 7 | 4382 | 4360 | 4520 | −57 | −381 | −584 | C |
| ATOM | 54 | CE1 | TYR | A | 7 | 19.786 | 16.847 | 24.053 | 1.00 | 36.81 | | C |
| ANISOU | 54 | CE1 | TYR | A | 7 | 4613 | 4677 | 4696 | −53 | −310 | −533 | C |
| ATOM | 55 | CE2 | TYR | A | 7 | 19.518 | 18.703 | 25.574 | 1.00 | 33.16 | | C |
| ANISOU | 55 | CE2 | TYR | A | 7 | 4141 | 4154 | 4303 | −84 | −365 | −555 | C |
| ATOM | 56 | CZ | TYR | A | 7 | 20.334 | 17.848 | 24.847 | 1.00 | 38.47 | | C |
| ANISOU | 56 | CZ | TYR | A | 7 | 4805 | 4867 | 4947 | −81 | −328 | −526 | C |
| ATOM | 57 | OH | TYR | A | 7 | 21.701 | 17.945 | 24.950 | 1.00 | 39.02 | | O |
| ANISOU | 57 | OH | TYR | A | 7 | 4844 | 4953 | 5027 | −105 | −308 | −492 | O |
| ATOM | 58 | N | PHE | A | 8 | 13.905 | 16.815 | 22.235 | 1.00 | 33.97 | | N |
| ANISOU | 58 | N | PHE | A | 8 | 4335 | 4246 | 4328 | 29 | −443 | −610 | N |
| ATOM | 59 | CA | PHE | A | 8 | 12.637 | 16.228 | 21.832 | 1.00 | 36.84 | | C |
| ANISOU | 59 | CA | PHE | A | 8 | 4701 | 4607 | 4688 | 46 | −473 | −629 | C |
| ATOM | 60 | C | PHE | A | 8 | 12.764 | 14.721 | 21.997 | 1.00 | 42.13 | | C |
| ANISOU | 60 | C | PHE | A | 8 | 5367 | 5305 | 5334 | 50 | −449 | −656 | C |
| ATOM | 61 | O | PHE | A | 8 | 13.740 | 14.124 | 21.520 | 1.00 | 35.83 | | O |
| ANISOU | 61 | O | PHE | A | 8 | 4588 | 4532 | 4496 | 46 | −418 | −645 | O |
| ATOM | 62 | CB | PHE | A | 8 | 12.314 | 16.588 | 20.388 | 1.00 | 34.67 | | C |
| ANISOU | 62 | CB | PHE | A | 8 | 4463 | 4329 | 4380 | 50 | −504 | −599 | C |
| ATOM | 63 | CG | PHE | A | 8 | 12.270 | 18.065 | 20.126 | 1.00 | 36.65 | | C |
| ANISOU | 63 | CG | PHE | A | 8 | 4722 | 4549 | 4654 | 47 | −526 | −564 | C |
| ATOM | 64 | CD1 | PHE | A | 8 | 13.429 | 18.766 | 19.887 | 1.00 | 44.56 | | C |
| ANISOU | 64 | CD1 | PHE | A | 8 | 5737 | 5550 | 5644 | 30 | −502 | −527 | C |
| ATOM | 65 | CD2 | PHE | A | 8 | 11.065 | 18.742 | 20.107 | 1.00 | 40.89 | | C |
| ANISOU | 65 | CD2 | PHE | A | 8 | 5251 | 5056 | 5229 | 61 | −571 | −565 | C |
| ATOM | 66 | CE1 | PHE | A | 8 | 13.404 | 20.130 | 19.651 | 1.00 | 46.75 | | C |
| ANISOU | 66 | CE1 | PHE | A | 8 | 6023 | 5792 | 5947 | 24 | −521 | −493 | C |
| ATOM | 67 | CE2 | PHE | A | 8 | 11.020 | 20.116 | 19.857 | 1.00 | 44.18 | | C |
| ANISOU | 67 | CE2 | PHE | A | 8 | 5678 | 5438 | 5670 | 61 | −590 | −531 | C |

TABLE 14-continued

| | | | | | | | | | | | | |
|---|---|---|---|---|---|---|---|---|---|---|---|---|
| ATOM | 68 | CZ | PHE | A | 8 | 12.176 | 20.805 | 19.625 | 1.00 | 51.16 | | C |
| ANISOU | 68 | CZ | PHE | A | 8 | 6580 | 6318 | 6542 | 42 | −567 | −495 | C |
| ATOM | 69 | N | PHE | A | 9 | 11.821 | 14.121 | 22.721 | 1.00 | 29.61 | | N |
| ANISOU | 69 | N | PHE | A | 9 | 3756 | 3714 | 3779 | 58 | −457 | −689 | N |
| ATOM | 70 | CA | PHE | A | 9 | 11.814 | 12.685 | 22.977 | 1.00 | 33.17 | | C |
| ANISOU | 70 | CA | PHE | A | 9 | 4202 | 4184 | 4218 | 61 | −437 | −715 | C |
| ATOM | 71 | C | PHE | A | 9 | 10.474 | 12.120 | 22.541 | 1.00 | 36.35 | | C |
| ANISOU | 71 | C | PHE | A | 9 | 4602 | 4577 | 4634 | 67 | −475 | −732 | C |
| ATOM | 72 | O | PHE | A | 9 | 9.447 | 12.688 | 22.886 | 1.00 | 36.12 | | O |
| ANISOU | 72 | O | PHE | A | 9 | 4547 | 4528 | 4648 | 73 | −502 | −736 | O |
| ATOM | 73 | CB | PHE | A | 9 | 11.994 | 12.385 | 24.458 | 1.00 | 30.84 | | C |
| ANISOU | 73 | CB | PHE | A | 9 | 3873 | 3892 | 3953 | 62 | −406 | −734 | C |
| ATOM | 74 | CG | PHE | A | 9 | 13.225 | 13.072 | 25.074 | 1.00 | 33.11 | | C |
| ANISOU | 74 | CG | PHE | A | 9 | 4156 | 4186 | 4238 | 52 | −380 | −719 | C |
| ATOM | 75 | CD1 | PHE | A | 9 | 13.130 | 14.381 | 25.565 | 1.00 | 32.61 | | C |
| ANISOU | 75 | CD1 | PHE | A | 9 | 4087 | 4100 | 4203 | 48 | −394 | −714 | C |
| ATOM | 76 | CD2 | PHE | A | 9 | 14.450 | 12.443 | 25.092 | 1.00 | 36.84 | | C |
| ANISOU | 76 | CD2 | PHE | A | 9 | 4632 | 4684 | 4683 | 46 | −346 | −709 | C |
| ATOM | 77 | CE1 | PHE | A | 9 | 14.237 | 15.015 | 26.094 | 1.00 | 38.10 | | C |
| ANISOU | 77 | CE1 | PHE | A | 9 | 4779 | 4797 | 4899 | 33 | −380 | −701 | C |
| ATOM | 78 | CE2 | PHE | A | 9 | 15.564 | 13.067 | 25.624 | 1.00 | 33.48 | | C |
| ANISOU | 78 | CE2 | PHE | A | 9 | 4196 | 4264 | 4261 | 33 | −330 | −692 | C |
| ATOM | 79 | CZ | PHE | A | 9 | 15.456 | 14.364 | 26.116 | 1.00 | 36.33 | | C |
| ANISOU | 79 | CZ | PHE | A | 9 | 4552 | 4602 | 4651 | 23 | −350 | −689 | C |
| ATOM | 80 | N | THR | A | 10 | 10.491 | 10.977 | 21.853 | 1.00 | 36.06 | | N |
| ANISOU | 80 | N | THR | A | 10 | 4588 | 4551 | 4563 | 66 | −476 | −744 | N |
| ATOM | 81 | CA | THR | A | 10 | 9.277 | 10.270 | 21.447 | 1.00 | 35.60 | | C |
| ANISOU | 81 | CA | THR | A | 10 | 4526 | 4482 | 4519 | 66 | −518 | −764 | C |
| ATOM | 82 | C | THR | A | 10 | 9.461 | 8.817 | 21.796 | 1.00 | 38.11 | | C |
| ANISOU | 82 | C | THR | A | 10 | 4843 | 4804 | 4831 | 63 | −490 | −790 | C |
| ATOM | 83 | O | THR | A | 10 | 10.494 | 8.250 | 21.435 | 1.00 | 37.11 | | O |
| ANISOU | 83 | O | THR | A | 10 | 4749 | 4693 | 4659 | 65 | −458 | −790 | O |
| ATOM | 84 | CB | THR | A | 10 | 9.047 | 10.344 | 19.943 | 1.00 | 37.72 | | C |
| ANISOU | 84 | CB | THR | A | 10 | 4842 | 4750 | 4741 | 64 | −563 | −755 | C |
| ATOM | 85 | OG1 | THR | A | 10 | 9.045 | 11.716 | 19.533 | 1.00 | 37.81 | | O |
| ANISOU | 85 | OG1 | THR | A | 10 | 4860 | 4756 | 4750 | 68 | −584 | −723 | O |
| ATOM | 86 | CG2 | THR | A | 10 | 7.711 | 9.621 | 19.568 | 1.00 | 34.92 | | C |
| ANISOU | 86 | CG2 | THR | A | 10 | 4479 | 4382 | 4409 | 59 | −619 | −777 | C |
| ATOM | 87 | N | SER | A | 11 | 8.478 | 8.214 | 22.489 | 1.00 | 27.81 | | N |
| ANISOU | 87 | N | SER | A | 11 | 3501 | 3488 | 3578 | 60 | −500 | −809 | N |
| ATOM | 88 | CA | SER | A | 11 | 8.429 | 6.773 | 22.673 | 1.00 | 31.96 | | C |
| ANISOU | 88 | CA | SER | A | 11 | 4028 | 4009 | 4105 | 54 | −484 | −832 | C |
| ATOM | 89 | C | SER | A | 11 | 7.109 | 6.254 | 22.133 | 1.00 | 32.83 | | C |
| ANISOU | 89 | C | SER | A | 11 | 4130 | 4100 | 4244 | 42 | −540 | −847 | C |
| ATOM | 90 | O | SER | A | 11 | 6.051 | 6.816 | 22.447 | 1.00 | 34.65 | | O |
| ANISOU | 90 | O | SER | A | 11 | 4318 | 4321 | 4528 | 41 | −569 | −840 | O |
| ATOM | 91 | CB | SER | A | 11 | 8.549 | 6.346 | 24.133 | 1.00 | 36.89 | | C |
| ANISOU | 91 | CB | SER | A | 11 | 4613 | 4637 | 4768 | 57 | −437 | −836 | C |
| ATOM | 92 | OG | SER | A | 11 | 9.739 | 6.804 | 24.717 | 1.00 | 51.54 | | O |
| ANISOU | 92 | OG | SER | A | 11 | 6471 | 6510 | 6601 | 66 | −393 | −822 | O |
| ATOM | 93 | N | VAL | A | 12 | 7.163 | 5.157 | 21.379 | 1.00 | 39.30 | | N |
| ANISOU | 93 | N | VAL | A | 12 | 4987 | 4911 | 5033 | 33 | −555 | −868 | N |
| ATOM | 94 | CA | VAL | A | 12 | 5.954 | 4.558 | 20.794 | 1.00 | 37.50 | | C |
| ANISOU | 94 | CA | VAL | A | 12 | 4756 | 4662 | 4832 | 15 | −618 | −885 | C |
| ATOM | 95 | C | VAL | A | 12 | 5.886 | 3.110 | 21.261 | 1.00 | 38.65 | | C |
| ANISOU | 95 | C | VAL | A | 12 | 4897 | 4789 | 5001 | 4 | −596 | −909 | C |
| ATOM | 96 | O | VAL | A | 12 | 6.821 | 2.336 | 21.022 | 1.00 | 34.96 | | O |
| ANISOU | 96 | O | VAL | A | 12 | 4475 | 4321 | 4487 | 10 | −562 | −923 | O |
| ATOM | 97 | CB | VAL | A | 12 | 5.966 | 4.642 | 19.264 | 1.00 | 36.40 | | C |
| ANISOU | 97 | CB | VAL | A | 12 | 4680 | 4521 | 4628 | 12 | −672 | −892 | C |
| ATOM | 98 | CG1 | VAL | A | 12 | 4.607 | 4.170 | 18.706 | 1.00 | 34.94 | | C |
| ANISOU | 98 | CG1 | VAL | A | 12 | 4484 | 4314 | 4478 | −11 | −752 | −909 | C |
| ATOM | 99 | CG2 | VAL | A | 12 | 6.351 | 6.061 | 18.779 | 1.00 | 37.91 | | C |
| ANISOU | 99 | CG2 | VAL | A | 12 | 4888 | 4733 | 4785 | 26 | −679 | −861 | C |
| ATOM | 100 | N | SER | A | 13 | 4.830 | 2.754 | 21.979 | 1.00 | 29.06 | | N |
| ANISOU | 100 | N | SER | A | 13 | 3624 | 3557 | 3861 | −10 | −607 | −910 | N |
| ATOM | 101 | CA | SER | A | 13 | 4.769 | 1.390 | 22.473 | 1.00 | 36.20 | | C |
| ANISOU | 101 | CA | SER | A | 13 | 4522 | 4440 | 4793 | −23 | −584 | −926 | C |
| ATOM | 102 | C | SER | A | 13 | 4.552 | 0.414 | 21.313 | 1.00 | 38.43 | | C |
| ANISOU | 102 | C | SER | A | 13 | 4857 | 4695 | 5048 | −43 | −635 | −958 | C |
| ATOM | 103 | O | SER | A | 13 | 4.106 | 0.790 | 20.221 | 1.00 | 37.22 | | O |
| ANISOU | 103 | O | SER | A | 13 | 4732 | 4541 | 4869 | −51 | −701 | −965 | O |
| ATOM | 104 | CB | SER | A | 13 | 3.675 | 1.216 | 23.515 | 1.00 | 37.75 | | C |
| ANISOU | 104 | CB | SER | A | 13 | 4642 | 4624 | 5078 | −35 | −578 | −914 | C |
| ATOM | 105 | OG | SER | A | 13 | 2.406 | 1.530 | 22.949 | 1.00 | 43.76 | | O |
| ANISOU | 105 | OG | SER | A | 13 | 5371 | 5373 | 5883 | −53 | −650 | −912 | O |
| ATOM | 106 | N | ARG | A | 14 | 4.970 | −0.829 | 21.550 | 1.00 | 42.12 | | N |
| ANISOU | 106 | N | ARG | A | 14 | 5346 | 5141 | 5515 | −47 | −603 | −976 | N |
| ATOM | 107 | C | ARG | A | 14 | 4.156 | −3.063 | 21.288 | 1.00 | 46.49 | | C |
| ANISOU | 107 | C | ARG | A | 14 | 5920 | 5623 | 6122 | −90 | −640 | −1020 | C |

TABLE 14-continued

| | | | | | | | | | | | | |
|---|---|---|---|---|---|---|---|---|---|---|---|---|
| ATOM | 108 | O | ARG | A | 14 | 4.792 | −3.908 | 21.928 | 1.00 | 42.77 | | O |
| ANISOU | 108 | O | ARG | A | 14 | 5456 | 5138 | 5656 | −81 | −582 | −1021 | O |
| ATOM | 109 | CA | AARG | A | 14 | 4.879 | −1.927 | 20.589 | 0.57 | 42.20 | | C |
| ANISOU | 109 | CA | AARG | A | 14 | 5416 | 5118 | 5501 | −64 | −641 | −1013 | C |
| ATOM | 110 | CB | AARG | A | 14 | 6.254 | −2.369 | 20.120 | 0.57 | 42.88 | | C |
| ANISOU | 110 | CB | AARG | A | 14 | 5577 | 5209 | 5507 | −38 | −594 | −1029 | C |
| ATOM | 111 | CG | AARG | A | 14 | 6.898 | −1.384 | 19.254 | 0.57 | 43.60 | | C |
| ANISOU | 111 | CG | AARG | A | 14 | 5712 | 5333 | 5522 | −17 | −599 | −1021 | C |
| ATOM | 112 | CD | AARG | A | 14 | 8.374 | −1.567 | 19.335 | 0.57 | 42.59 | | C |
| ANISOU | 112 | CD | AARG | A | 14 | 5621 | 5223 | 5340 | 15 | −523 | −1016 | C |
| ATOM | 113 | NE | AARG | A | 14 | 8.989 | −1.084 | 18.127 | 0.57 | 39.23 | | N |
| ANISOU | 113 | NE | AARG | A | 14 | 5262 | 4815 | 4829 | 32 | −531 | −1020 | N |
| ATOM | 114 | CZ | AARG | A | 14 | 10.272 | −0.796 | 18.028 | 0.57 | 39.77 | | C |
| ANISOU | 114 | CZ | AARG | A | 14 | 5354 | 4910 | 4846 | 61 | −469 | −1003 | C |
| ATOM | 115 | NH1 | AARG | A | 14 | 11.078 | −0.906 | 19.101 | 0.57 | 35.63 | | N |
| ANISOU | 115 | NH1 | AARG | A | 14 | 4790 | 4399 | 4350 | 76 | −401 | −982 | N |
| ATOM | 116 | NH2 | AARG | A | 14 | 10.730 | −0.382 | 16.868 | 0.57 | 39.60 | | N |
| ANISOU | 116 | NH2 | AARG | A | 14 | 5395 | 4904 | 4747 | 75 | −475 | −1004 | N |
| ATOM | 117 | CA | BARG | A | 14 | 4.885 | −1.927 | 20.587 | 0.43 | 42.62 | | C |
| ANISOU | 117 | CA | BARG | A | 14 | 5469 | 5171 | 5553 | −63 | −641 | −1013 | C |
| ATOM | 118 | CB | BARG | A | 14 | 6.270 | −2.362 | 20.111 | 0.43 | 42.91 | | C |
| ANISOU | 118 | CB | BARG | A | 14 | 5581 | 5213 | 5509 | −37 | −594 | −1029 | C |
| ATOM | 119 | CG | BARG | A | 14 | 7.023 | −1.293 | 19.369 | 0.43 | 43.58 | | C |
| ANISOU | 119 | CG | BARG | A | 14 | 5706 | 5335 | 5519 | −14 | −589 | −1017 | C |
| ATOM | 120 | CD | BARG | A | 14 | 6.206 | −0.779 | 18.206 | 0.43 | 43.62 | | C |
| ANISOU | 120 | CD | BARG | A | 14 | 5737 | 5338 | 5498 | −29 | −674 | −1027 | C |
| ATOM | 121 | NE | BARG | A | 14 | 6.867 | 0.318 | 17.504 | 0.43 | 43.96 | | N |
| ANISOU | 121 | NE | BARG | A | 14 | 5816 | 5416 | 5472 | −7 | −670 | −1008 | N |
| ATOM | 122 | CZ | BARG | A | 14 | 6.234 | 1.127 | 16.667 | 0.43 | 43.38 | | C |
| ANISOU | 122 | CZ | BARG | A | 14 | 5755 | 5351 | 5378 | −15 | −736 | −1000 | C |
| ATOM | 123 | NH1 | BARG | A | 14 | 4.931 | 0.951 | 16.454 | 0.43 | 39.03 | | N |
| ANISOU | 123 | NH1 | BARG | A | 14 | 5179 | 4778 | 4874 | −43 | −816 | −1011 | N |
| ATOM | 124 | NH2 | BARG | A | 14 | 6.889 | 2.096 | 16.054 | 0.43 | 42.27 | | N |
| ANISOU | 124 | NH2 | BARG | A | 14 | 5648 | 5238 | 5174 | 5 | −726 | −977 | N |
| ATOM | 125 | N | PRO | A | 15 | 2.820 | −3.087 | 21.230 | 1.00 | 47.75 | | N |
| ANISOU | 125 | N | PRO | A | 15 | 6031 | 5763 | 6349 | −122 | −702 | −1019 | N |
| ATOM | 126 | CA | PRO | A | 15 | 2.036 | −4.106 | 21.939 | 1.00 | 46.79 | | C |
| ANISOU | 126 | CA | PRO | A | 15 | 5860 | 5603 | 6313 | −151 | −700 | −1017 | C |
| ATOM | 127 | C | PRO | A | 15 | 2.532 | −5.516 | 21.645 | 1.00 | 49.43 | | C |
| ANISOU | 127 | C | PRO | A | 15 | 6256 | 5894 | 6631 | −161 | −690 | −1050 | C |
| ATOM | 128 | O | PRO | A | 15 | 2.712 | −5.894 | 20.492 | 1.00 | 51.96 | | O |
| ANISOU | 128 | O | PRO | A | 15 | 6650 | 6195 | 6897 | −168 | −737 | −1088 | O |
| ATOM | 129 | CB | PRO | A | 15 | 0.619 | −3.904 | 21.391 | 1.00 | 51.47 | | C |
| ANISOU | 129 | CB | PRO | A | 15 | 6411 | 6181 | 6964 | −187 | −792 | −1018 | C |
| ATOM | 130 | CG | PRO | A | 15 | 0.592 | −2.561 | 20.790 | 1.00 | 58.16 | | C |
| ANISOU | 130 | CG | PRO | A | 15 | 7262 | 7066 | 7768 | −169 | −826 | −1007 | C |
| ATOM | 131 | CD | PRO | A | 15 | 2.003 | −2.159 | 20.434 | 1.00 | 44.15 | | C |
| ANISOU | 131 | CD | PRO | A | 15 | 5563 | 5320 | 5893 | −132 | −780 | −1015 | C |
| ATOM | 132 | N | GLY | A | 16 | 2.723 | −6.299 | 22.707 | 1.00 | 51.62 | | N |
| ANISOU | 132 | N | GLY | A | 16 | 6506 | 6155 | 6954 | −160 | −628 | −1035 | N |
| ATOM | 133 | CA | GLY | A | 16 | 3.177 | −7.669 | 22.627 | 1.00 | 58.44 | | C |
| ANISOU | 133 | CA | GLY | A | 16 | 7419 | 6971 | 7816 | −166 | −609 | −1060 | C |
| ATOM | 134 | C | GLY | A | 16 | 4.644 | −7.893 | 22.267 | 1.00 | 62.78 | | C |
| ANISOU | 134 | C | GLY | A | 16 | 8048 | 7530 | 8277 | −125 | −559 | −1077 | C |
| ATOM | 135 | O | GLY | A | 16 | 5.036 | −9.057 | 22.143 | 1.00 | 66.63 | | O |
| ANISOU | 135 | O | GLY | A | 16 | 8581 | 7972 | 8762 | −125 | −541 | −1100 | O |
| ATOM | 136 | N | ARG | A | 17 | 5.480 | −6.846 | 22.130 | 1.00 | 55.10 | | N |
| ANISOU | 136 | N | ARG | A | 17 | 7089 | 6609 | 7237 | −90 | −531 | −1065 | N |
| ATOM | 137 | CA | ARG | A | 17 | 6.817 | −6.988 | 21.517 | 1.00 | 52.07 | | C |
| ANISOU | 137 | CA | ARG | A | 17 | 6781 | 6236 | 6768 | −53 | −492 | −1082 | C |
| ATOM | 138 | C | ARG | A | 17 | 7.971 | −6.325 | 22.296 | 1.00 | 57.57 | | C |
| ANISOU | 138 | C | ARG | A | 17 | 7456 | 6981 | 7436 | −13 | −416 | −1046 | C |
| ATOM | 139 | O | ARG | A | 17 | 8.964 | −5.886 | 21.703 | 1.00 | 62.13 | | O |
| ANISOU | 139 | O | ARG | A | 17 | 8077 | 7585 | 7943 | 16 | −394 | −1048 | O |
| ATOM | 140 | CB | ARG | A | 17 | 6.833 | −6.404 | 20.108 | 1.00 | 54.39 | | C |
| ANISOU | 140 | CB | ARG | A | 17 | 7136 | 6541 | 6988 | −51 | −547 | −1109 | C |
| ATOM | 141 | CG | ARG | A | 17 | 5.798 | −6.962 | 19.155 | 1.00 | 60.88 | | C |
| ANISOU | 141 | CG | ARG | A | 17 | 7992 | 7319 | 7819 | −89 | −635 | −1150 | C |
| ATOM | 142 | CD | ARG | A | 17 | 6.185 | −6.602 | 17.743 | 1.00 | 77.67 | | C |
| ANISOU | 142 | CD | ARG | A | 17 | 10205 | 9458 | 9848 | −75 | −671 | −1179 | C |
| ATOM | 143 | NE | ARG | A | 17 | 7.637 | −6.584 | 17.601 | 1.00 | 92.26 | | N |
| ANISOU | 143 | NE | ARG | A | 17 | 12103 | 11329 | 11623 | −28 | −592 | −1176 | N |
| ATOM | 144 | CZ | ARG | A | 17 | 8.370 | −7.616 | 17.189 | 1.00 | 97.11 | | C |
| ANISOU | 144 | CZ | ARG | A | 17 | 12789 | 11911 | 12198 | −7 | −557 | −1209 | C |
| ATOM | 145 | NH1 | ARG | A | 17 | 7.789 | −8.764 | 16.859 | 1.00 | 98.58 | | N |
| ANISOU | 145 | NH1 | ARG | A | 17 | 13014 | 12035 | 12407 | −32 | −599 | −1253 | N |
| ATOM | 146 | NH2 | ARG | A | 17 | 9.688 | −7.500 | 17.106 | 1.00 | 95.27 | | N |
| ANISOU | 146 | NH2 | ARG | A | 17 | 12588 | 11704 | 11906 | 40 | −481 | −1198 | N |
| ATOM | 147 | N | GLY | A | 18 | 7.964 | −6.262 | 23.601 | 1.00 | 56.85 | | N |
| ANISOU | 147 | N | GLY | A | 18 | 7304 | 6903 | 7394 | −10 | −373 | −1011 | N |

TABLE 14-continued

| | | | | | | | | | | | | |
|---|---|---|---|---|---|---|---|---|---|---|---|---|
| ATOM | 148 | CA | GLY | A | 18 | 9.186 | −5.690 | 24.183 | 1.00 | 50.90 | | C |
| ANISOU | 148 | CA | GLY | A | 18 | 6542 | 6194 | 6603 | 26 | −311 | −983 | C |
| ATOM | 149 | C | GLY | A | 18 | 9.223 | −4.167 | 24.118 | 1.00 | 47.69 | | C |
| ANISOU | 149 | C | GLY | A | 18 | 6113 | 5836 | 6172 | 31 | −324 | −965 | C |
| ATOM | 150 | O | GLY | A | 18 | 8.185 | −3.508 | 24.133 | 1.00 | 37.97 | | O |
| ANISOU | 150 | O | GLY | A | 18 | 4846 | 4607 | 4972 | 10 | −367 | −962 | O |
| ATOM | 151 | N | GLU | A | 19 | 10.440 | −3.601 | 24.008 | 1.00 | 40.66 | | N |
| ANISOU | 151 | N | GLU | A | 19 | 5241 | 4980 | 5228 | 60 | −287 | −951 | N |
| ATOM | 152 | CA | GLU | A | 19 | 10.640 | −2.209 | 24.395 | 1.00 | 39.07 | | C |
| ANISOU | 152 | CA | GLU | A | 19 | 5006 | 4822 | 5018 | 65 | −284 | −925 | C |
| ATOM | 153 | C | GLU | A | 19 | 9.987 | −1.257 | 23.394 | 1.00 | 37.03 | | C |
| ANISOU | 153 | C | GLU | A | 19 | 4761 | 4569 | 4740 | 52 | −341 | −934 | C |
| ATOM | 154 | O | GLU | A | 19 | 9.886 | −1.563 | 22.214 | 1.00 | 37.34 | | O |
| ANISOU | 154 | O | GLU | A | 19 | 4852 | 4592 | 4742 | 48 | −373 | −958 | O |
| ATOM | 155 | CB | GLU | A | 19 | 12.148 | −1.871 | 24.520 | 1.00 | 39.34 | | C |
| ANISOU | 155 | CB | GLU | A | 19 | 5051 | 4888 | 5007 | 94 | −233 | −905 | C |
| ATOM | 156 | CG | GLU | A | 19 | 12.866 | −1.838 | 23.167 | 1.00 | 47.36 | | C |
| ANISOU | 156 | CG | GLU | A | 19 | 6127 | 5908 | 5959 | 109 | −233 | −917 | C |
| ATOM | 157 | CD | GLU | A | 19 | 14.349 | −1.446 | 23.221 | 1.00 | 62.86 | | C |
| ANISOU | 157 | CD | GLU | A | 19 | 8092 | 7906 | 7886 | 136 | −181 | −891 | C |
| ATOM | 158 | OE1 | GLU | A | 19 | 14.806 | −0.853 | 24.222 | 1.00 | 65.82 | | O |
| ANISOU | 158 | OE1 | GLU | A | 19 | 8421 | 8307 | 8281 | 138 | −160 | −862 | O |
| ATOM | 159 | OE2 | GLU | A | 19 | 15.034 | −1.691 | 22.215 | 1.00 | 65.38 | | O |
| ANISOU | 159 | OE2 | GLU | A | 19 | 8460 | 8227 | 8156 | 154 | −163 | −898 | O |
| ATOM | 160 | N | PRO | A | 20 | 9.578 | −0.066 | 23.840 | 1.00 | 37.07 | | N |
| ANISOU | 160 | N | PRO | A | 20 | 4725 | 4596 | 4764 | 48 | −355 | −914 | N |
| ATOM | 161 | CA | PRO | A | 20 | 9.162 | 0.979 | 22.899 | 1.00 | 40.83 | | C |
| ANISOU | 161 | CA | PRO | A | 20 | 5216 | 5081 | 5218 | 42 | −404 | −914 | C |
| ATOM | 162 | C | PRO | A | 20 | 10.247 | 1.376 | 21.920 | 1.00 | 40.30 | | C |
| ANISOU | 162 | C | PRO | A | 20 | 5202 | 5033 | 5077 | 58 | −392 | −910 | C |
| ATOM | 163 | O | PRO | A | 20 | 11.444 | 1.300 | 22.203 | 1.00 | 34.64 | | O |
| ANISOU | 163 | O | PRO | A | 20 | 4492 | 4333 | 4335 | 77 | −339 | −897 | O |
| ATOM | 164 | CB | PRO | A | 20 | 8.825 | 2.166 | 23.822 | 1.00 | 35.79 | | C |
| ANISOU | 164 | CB | PRO | A | 20 | 4523 | 4461 | 4616 | 43 | −400 | −890 | C |
| ATOM | 165 | CG | PRO | A | 20 | 8.484 | 1.555 | 25.080 | 1.00 | 44.41 | | C |
| ANISOU | 165 | CG | PRO | A | 20 | 5571 | 5545 | 5759 | 41 | −370 | −886 | C |
| ATOM | 166 | CD | PRO | A | 20 | 9.423 | 0.379 | 25.225 | 1.00 | 35.36 | | C |
| ANISOU | 166 | CD | PRO | A | 20 | 4451 | 4393 | 4590 | 50 | −327 | −892 | C |
| ATOM | 167 | N | ARG | A | 21 | 9.802 | 1.872 | 20.769 | 1.00 | 35.20 | | N |
| ANISOU | 167 | N | ARG | A | 21 | 4589 | 4385 | 4399 | 52 | −443 | −916 | N |
| ATOM | 168 | CA | ARG | A | 21 | 10.686 | 2.631 | 19.899 | 1.00 | 38.39 | | C |
| ANISOU | 168 | CA | ARG | A | 21 | 5035 | 4813 | 4738 | 67 | −432 | −901 | C |
| ATOM | 169 | C | ARG | A | 21 | 10.902 | 3.997 | 20.548 | 1.00 | 41.06 | | C |
| ANISOU | 169 | C | ARG | A | 21 | 5330 | 5173 | 5098 | 68 | −421 | −866 | C |
| ATOM | 170 | O | ARG | A | 21 | 9.934 | 4.669 | 20.902 | 1.00 | 39.98 | | O |
| ANISOU | 170 | O | ARG | A | 21 | 5156 | 5029 | 5004 | 58 | −458 | −861 | O |
| ATOM | 171 | CB | ARG | A | 21 | 10.075 | 2.791 | 18.500 | 1.00 | 40.36 | | C |
| ANISOU | 171 | CB | ARG | A | 21 | 5337 | 5054 | 4943 | 60 | −494 | −914 | C |
| ATOM | 172 | CG | ARG | A | 21 | 10.869 | 3.688 | 17.538 | 1.00 | 42.15 | | C |
| ANISOU | 172 | CG | ARG | A | 21 | 5609 | 5306 | 5100 | 74 | −484 | −890 | C |
| ATOM | 173 | CD | ARG | A | 21 | 12.147 | 2.949 | 17.113 | 1.00 | 46.45 | | C |
| ANISOU | 173 | CD | ARG | A | 21 | 6204 | 5860 | 5586 | 97 | −422 | −896 | C |
| ATOM | 174 | NE | ARG | A | 21 | 13.035 | 3.738 | 16.255 | 1.00 | 51.01 | | N |
| ANISOU | 174 | NE | ARG | A | 21 | 6820 | 6464 | 6099 | 113 | −396 | −866 | N |
| ATOM | 175 | CZ | ARG | A | 21 | 12.916 | 3.822 | 14.929 | 1.00 | 61.39 | | C |
| ANISOU | 175 | CZ | ARG | A | 21 | 8204 | 7781 | 7342 | 119 | −424 | −872 | C |
| ATOM | 176 | NH1 | ARG | A | 21 | 11.926 | 3.188 | 14.305 | 1.00 | 55.96 | | N |
| ANISOU | 176 | NH1 | ARG | A | 21 | 7556 | 7069 | 6638 | 108 | −487 | −910 | N |
| ATOM | 177 | NH2 | ARG | A | 21 | 13.785 | 4.544 | 14.229 | 1.00 | 56.66 | | N |
| ANISOU | 177 | NH2 | ARG | A | 21 | 7636 | 7207 | 6686 | 135 | −390 | −838 | N |
| ATOM | 178 | N | PHE | A | 22 | 12.159 | 4.396 | 20.732 | 1.00 | 35.15 | | N |
| ANISOU | 178 | N | PHE | A | 22 | 4584 | 4447 | 4323 | 82 | −371 | −844 | N |
| ATOM | 179 | CA | PHE | A | 22 | 12.509 | 5.624 | 21.446 | 1.00 | 34.70 | | C |
| ANISOU | 179 | CA | PHE | A | 22 | 4490 | 4407 | 4289 | 81 | −358 | −814 | C |
| ATOM | 180 | C | PHE | A | 22 | 13.491 | 6.434 | 20.626 | 1.00 | 40.78 | | C |
| ANISOU | 180 | C | PHE | A | 22 | 5289 | 5196 | 5010 | 87 | −342 | −786 | C |
| ATOM | 181 | O | PHE | A | 22 | 14.535 | 5.917 | 20.230 | 1.00 | 38.50 | | O |
| ANISOU | 181 | O | PHE | A | 22 | 5026 | 4921 | 4683 | 100 | −299 | −780 | O |
| ATOM | 182 | CB | PHE | A | 22 | 13.118 | 5.300 | 22.817 | 1.00 | 33.97 | | C |
| ANISOU | 182 | CB | PHE | A | 22 | 4356 | 4323 | 4229 | 85 | −312 | −810 | C |
| ATOM | 183 | CG | PHE | A | 22 | 13.601 | 6.519 | 23.569 | 1.00 | 34.94 | | C |
| ANISOU | 183 | CG | PHE | A | 22 | 4447 | 4459 | 4369 | 81 | −302 | −785 | C |
| ATOM | 184 | CD1 | PHE | A | 22 | 12.686 | 7.375 | 24.179 | 1.00 | 41.00 | | C |
| ANISOU | 184 | CD1 | PHE | A | 22 | 5185 | 5216 | 5177 | 74 | −331 | −786 | C |
| ATOM | 185 | CD2 | PHE | A | 22 | 14.971 | 6.811 | 23.670 | 1.00 | 36.62 | | C |
| ANISOU | 185 | CD2 | PHE | A | 22 | 4659 | 4694 | 4562 | 86 | −264 | −761 | C |
| ATOM | 186 | CE1 | PHE | A | 22 | 13.121 | 8.497 | 24.882 | 1.00 | 41.16 | | C |
| ANISOU | 186 | CE1 | PHE | A | 22 | 5185 | 5242 | 5212 | 71 | −324 | −770 | C |
| ATOM | 187 | CE2 | PHE | A | 22 | 15.423 | 7.957 | 24.376 | 1.00 | 30.63 | | C |
| ANISOU | 187 | CE2 | PHE | A | 22 | 3873 | 3943 | 3822 | 77 | −263 | −740 | C |

TABLE 14-continued

| | | | | | | | | | | | | |
|---|---|---|---|---|---|---|---|---|---|---|---|---|
| ATOM | 188 | CZ | PHE | A | 22 | 14.492 | 8.783 | 24.979 | 1.00 | 32.61 | | C |
| ANISOU | 188 | CZ | PHE | A | 22 | 4104 | 4178 | 4108 | 70 | −293 | −748 | C |
| ATOM | 189 | N | ILE | A | 23 | 13.172 | 7.702 | 20.376 | 1.00 | 37.44 | | N |
| ANISOU | 189 | N | ILE | A | 23 | 4861 | 4772 | 4593 | 80 | −373 | −765 | N |
| ATOM | 190 | CA | ILE | A | 23 | 14.043 | 8.550 | 19.588 | 1.00 | 34.42 | | C |
| ANISOU | 190 | CA | ILE | A | 23 | 4504 | 4404 | 4169 | 83 | −358 | −731 | C |
| ATOM | 191 | C | ILE | A | 23 | 14.143 | 9.868 | 20.315 | 1.00 | 36.68 | | C |
| ANISOU | 191 | C | ILE | A | 23 | 4753 | 4688 | 4496 | 72 | −363 | −706 | C |
| ATOM | 192 | O | ILE | A | 23 | 13.125 | 10.432 | 20.714 | 1.00 | 37.55 | | O |
| ANISOU | 192 | O | ILE | A | 23 | 4841 | 4780 | 4646 | 67 | −402 | −714 | O |
| ATOM | 193 | CB | ILE | A | 23 | 13.523 | 8.741 | 18.153 | 1.00 | 37.53 | | C |
| ANISOU | 193 | CB | ILE | A | 23 | 4953 | 4795 | 4512 | 85 | −398 | −728 | C |
| ATOM | 194 | CG1 | ILE | A | 23 | 13.585 | 7.395 | 17.393 | 1.00 | 38.34 | | C |
| ANISOU | 194 | CG1 | ILE | A | 23 | 5105 | 4898 | 4565 | 96 | −390 | −758 | C |
| ATOM | 195 | CG2 | ILE | A | 23 | 14.299 | 9.856 | 17.452 | 1.00 | 35.67 | | C |
| ANISOU | 195 | CG2 | ILE | A | 23 | 4738 | 4573 | 4243 | 86 | −383 | −683 | C |
| ATOM | 196 | CD1 | ILE | A | 23 | 12.587 | 7.289 | 16.237 | 1.00 | 55.59 | | C |
| ANISOU | 196 | CD1 | ILE | A | 23 | 7341 | 7071 | 6712 | 94 | −454 | −774 | C |
| ATOM | 197 | N | ALA | A | 24 | 15.364 | 10.306 | 20.558 | 1.00 | 33.92 | | N |
| ANISOU | 197 | N | ALA | A | 24 | 4393 | 4354 | 4142 | 70 | −322 | −679 | N |
| ATOM | 198 | CA | ALA | A | 24 | 15.662 | 11.598 | 21.161 | 1.00 | 34.17 | | C |
| ANISOU | 198 | CA | ALA | A | 24 | 4396 | 4379 | 4208 | 56 | −326 | −655 | C |
| ATOM | 199 | C | ALA | A | 24 | 16.511 | 12.377 | 20.185 | 1.00 | 33.40 | | C |
| ANISOU | 199 | C | ALA | A | 24 | 4322 | 4290 | 4078 | 52 | −312 | −611 | C |
| ATOM | 200 | O | ALA | A | 24 | 17.383 | 11.808 | 19.512 | 1.00 | 38.75 | | O |
| ANISOU | 200 | O | ALA | A | 24 | 5021 | 4989 | 4714 | 61 | −273 | −597 | O |
| ATOM | 201 | CB | ALA | A | 24 | 16.416 | 11.438 | 22.486 | 1.00 | 34.97 | | C |
| ANISOU | 201 | CB | ALA | A | 24 | 4455 | 4489 | 4341 | 51 | −296 | −658 | C |
| ATOM | 202 | N | VAL | A | 25 | 16.253 | 13.679 | 20.084 | 1.00 | 33.39 | | N |
| ANISOU | 202 | N | VAL | A | 25 | 4320 | 4271 | 4098 | 40 | −340 | −588 | N |
| ATOM | 203 | CA | VAL | A | 25 | 17.022 | 14.566 | 19.225 | 1.00 | 33.96 | | C |
| ANISOU | 203 | CA | VAL | A | 25 | 4411 | 4345 | 4147 | 32 | −327 | −539 | C |
| ATOM | 204 | C | VAL | A | 25 | 17.275 | 15.804 | 20.049 | 1.00 | 36.60 | | C |
| ANISOU | 204 | C | VAL | A | 25 | 4713 | 4657 | 4535 | 11 | −338 | −522 | C |
| ATOM | 205 | O | VAL | A | 25 | 16.438 | 16.183 | 20.873 | 1.00 | 38.96 | | O |
| ANISOU | 205 | O | VAL | A | 25 | 4995 | 4932 | 4877 | 10 | −370 | −548 | O |
| ATOM | 206 | CB | VAL | A | 25 | 16.319 | 14.919 | 17.888 | 1.00 | 38.89 | | C |
| ANISOU | 206 | CB | VAL | A | 25 | 5085 | 4963 | 4729 | 41 | −359 | −521 | C |
| ATOM | 207 | CG1 | VAL | A | 25 | 16.041 | 13.661 | 17.095 | 1.00 | 39.83 | | C |
| ANISOU | 207 | CG1 | VAL | A | 25 | 5243 | 5100 | 4790 | 60 | −356 | −546 | C |
| ATOM | 208 | CG2 | VAL | A | 25 | 14.998 | 15.663 | 18.125 | 1.00 | 44.33 | | C |
| ANISOU | 208 | CG2 | VAL | A | 25 | 5767 | 5620 | 5458 | 41 | −420 | −533 | C |
| ATOM | 209 | N | GLY | A | 26 | 18.456 | 16.374 | 19.888 | 1.00 | 33.07 | | N |
| ANISOU | 209 | N | GLY | A | 26 | 4258 | 4218 | 4091 | −5 | −307 | −480 | N |
| ATOM | 210 | CA | GLY | A | 26 | 18.807 | 17.625 | 20.530 | 1.00 | 35.03 | | C |
| ANISOU | 210 | CA | GLY | A | 26 | 4482 | 4438 | 4390 | −31 | −321 | −461 | C |
| ATOM | 211 | C | GLY | A | 26 | 19.046 | 18.674 | 19.470 | 1.00 | 36.80 | | C |
| ANISOU | 211 | C | GLY | A | 26 | 4731 | 4648 | 4604 | −41 | −324 | −406 | C |
| ATOM | 212 | O | GLY | A | 26 | 19.671 | 18.397 | 18.445 | 1.00 | 39.72 | | O |
| ANISOU | 212 | O | GLY | A | 26 | 5122 | 5043 | 4929 | −36 | −289 | −370 | O |
| ATOM | 213 | N | TYR | A | 27 | 18.560 | 19.872 | 19.732 | 1.00 | 36.11 | | N |
| ANISOU | 213 | N | TYR | A | 27 | 4644 | 4518 | 4557 | −53 | −361 | −399 | N |
| ATOM | 214 | CA | TYR | A | 27 | 18.730 | 21.009 | 18.840 | 1.00 | 36.79 | | C |
| ANISOU | 214 | CA | TYR | A | 27 | 4754 | 4581 | 4645 | −65 | −369 | −343 | C |
| ATOM | 215 | C | TYR | A | 27 | 19.395 | 22.171 | 19.555 | 1.00 | 36.44 | | C |
| ANISOU | 215 | C | TYR | A | 27 | 4684 | 4500 | 4663 | −100 | −374 | −323 | C |
| ATOM | 216 | O | TYR | A | 27 | 19.053 | 22.486 | 20.689 | 1.00 | 43.82 | | O |
| ANISOU | 216 | O | TYR | A | 27 | 5600 | 5408 | 5642 | −106 | −400 | −362 | O |
| ATOM | 217 | CB | TYR | A | 27 | 17.396 | 21.502 | 18.327 | 1.00 | 38.50 | | C |
| ANISOU | 217 | CB | TYR | A | 27 | 5001 | 4768 | 4857 | −45 | −417 | −347 | C |
| ATOM | 218 | CG | TYR | A | 27 | 16.821 | 20.656 | 17.219 | 1.00 | 42.96 | | C |
| ANISOU | 218 | CG | TYR | A | 27 | 5604 | 5363 | 5355 | −19 | −421 | −348 | C |
| ATOM | 219 | CD1 | TYR | A | 27 | 16.057 | 19.558 | 17.509 | 1.00 | 47.33 | | C |
| ANISOU | 219 | CD1 | TYR | A | 27 | 6155 | 5934 | 5895 | 1 | −434 | −401 | C |
| ATOM | 220 | CD2 | TYR | A | 27 | 17.086 | 20.950 | 15.883 | 1.00 | 43.74 | | C |
| ANISOU | 220 | CD2 | TYR | A | 27 | 5745 | 5471 | 5402 | −15 | −412 | −294 | C |
| ATOM | 221 | CE1 | TYR | A | 27 | 15.506 | 18.767 | 16.488 | 1.00 | 52.68 | | C |
| ANISOU | 221 | CE1 | TYR | A | 27 | 6871 | 6634 | 6511 | 22 | −447 | −406 | C |
| ATOM | 222 | CE2 | TYR | A | 27 | 16.547 | 20.178 | 14.863 | 1.00 | 50.15 | | C |
| ANISOU | 222 | CE2 | TYR | A | 27 | 6600 | 6309 | 6144 | 9 | −423 | −300 | C |
| ATOM | 223 | CZ | TYR | A | 27 | 15.759 | 19.085 | 15.179 | 1.00 | 53.77 | | C |
| ANISOU | 223 | CZ | TYR | A | 27 | 7055 | 6781 | 6593 | 26 | −443 | −359 | C |
| ATOM | 224 | OH | TYR | A | 27 | 15.221 | 18.307 | 14.184 | 1.00 | 55.37 | | O |
| ANISOU | 224 | OH | TYR | A | 27 | 7305 | 7006 | 6729 | 46 | −461 | −369 | O |
| ATOM | 225 | N | VAL | A | 28 | 20.266 | 22.863 | 18.850 | 1.00 | 39.59 | | N |
| ANISOU | 225 | N | VAL | A | 28 | 5086 | 4894 | 5063 | −122 | −353 | −260 | N |
| ATOM | 226 | CA | VAL | A | 28 | 20.582 | 24.247 | 19.166 | 1.00 | 45.04 | | C |
| ANISOU | 226 | CA | VAL | A | 28 | 5769 | 5532 | 5813 | −155 | −373 | −231 | C |
| ATOM | 227 | C | VAL | A | 28 | 19.979 | 25.097 | 18.057 | 1.00 | 48.61 | | C |
| ANISOU | 227 | C | VAL | A | 28 | 6263 | 5955 | 6252 | −145 | −392 | −185 | C |

TABLE 14-continued

| | | | | | | | | | | | | | |
|---|---|---|---|---|---|---|---|---|---|---|---|---|---|
| ATOM | 228 | O | VAL | A | 28 | 20.323 | 24.934 | 16.877 | 1.00 | 40.12 | | | O |
| ANISOU | 228 | O | VAL | A | 28 | 5212 | 4907 | 5127 | −139 | −362 | −134 | | O |
| ATOM | 229 | CB | VAL | A | 28 | 22.090 | 24.489 | 19.298 | 1.00 | 41.89 | | | C |
| ANISOU | 229 | CB | VAL | A | 28 | 5333 | 5143 | 5442 | −195 | −338 | −187 | | C |
| ATOM | 230 | CG1 | VAL | A | 28 | 22.329 | 25.976 | 19.427 | 1.00 | 42.63 | | | C |
| ANISOU | 230 | CG1 | VAL | A | 28 | 5426 | 5175 | 5598 | −232 | −364 | −152 | | C |
| ATOM | 231 | CG2 | VAL | A | 28 | 22.626 | 23.741 | 20.508 | 1.00 | 37.31 | | | C |
| ANISOU | 231 | CG2 | VAL | A | 28 | 4709 | 4587 | 4879 | −204 | −332 | −233 | | C |
| ATOM | 232 | N | ASP | A | 29 | 19.075 | 25.995 | 18.442 | 1.00 | 40.87 | | | N |
| ANISOU | 232 | N | ASP | A | 29 | 5295 | 4920 | 5315 | −141 | −439 | −202 | | N |
| ATOM | 233 | CA | ASP | A | 29 | 18.291 | 26.772 | 17.489 | 1.00 | 49.19 | | | C |
| ANISOU | 233 | CA | ASP | A | 29 | 6388 | 5942 | 6360 | −124 | −467 | −163 | | C |
| ATOM | 234 | C | ASP | A | 29 | 17.648 | 25.810 | 16.497 | 1.00 | 45.18 | | | C |
| ANISOU | 234 | C | ASP | A | 29 | 5910 | 5481 | 5775 | −88 | −466 | −164 | | C |
| ATOM | 235 | O | ASP | A | 29 | 16.912 | 24.906 | 16.897 | 1.00 | 46.90 | | | O |
| ANISOU | 235 | O | ASP | A | 29 | 6121 | 5722 | 5978 | −64 | −480 | −222 | | O |
| ATOM | 236 | CB | ASP | A | 29 | 19.166 | 27.818 | 16.792 | 1.00 | 51.32 | | | C |
| ANISOU | 236 | CB | ASP | A | 29 | 6668 | 6184 | 6647 | −156 | −450 | −83 | | C |
| ATOM | 237 | CG | ASP | A | 29 | 19.872 | 28.742 | 17.776 | 1.00 | 55.54 | | | C |
| ANISOU | 237 | CG | ASP | A | 29 | 7172 | 6668 | 7261 | −199 | −457 | −84 | | C |
| ATOM | 238 | OD1 | ASP | A | 29 | 19.275 | 29.045 | 18.826 | 1.00 | 53.87 | | | O |
| ANISOU | 238 | OD1 | ASP | A | 29 | 6955 | 6420 | 7095 | −195 | −492 | −141 | | O |
| ATOM | 239 | OD2 | ASP | A | 29 | 21.035 | 29.156 | 17.516 | 1.00 | 56.39 | | | O |
| ANISOU | 239 | OD2 | ASP | A | 29 | 7265 | 6774 | 7388 | −238 | −426 | −29 | | O |
| ATOM | 240 | N | ASP | A | 30 | 17.940 | 25.955 | 15.212 | 1.00 | 47.23 | | | N |
| ANISOU | 240 | N | ASP | A | 30 | 6204 | 5756 | 5984 | −85 | −449 | −102 | | N |
| ATOM | 241 | CA | ASP | A | 30 | 17.362 | 25.065 | 14.219 | 1.00 | 49.39 | | | C |
| ANISOU | 241 | CA | ASP | A | 30 | 6516 | 6073 | 6177 | −52 | −453 | −105 | | C |
| ATOM | 242 | C | ASP | A | 30 | 18.349 | 24.013 | 13.755 | 1.00 | 51.03 | | | C |
| ANISOU | 242 | C | ASP | A | 30 | 6727 | 6339 | 6322 | −53 | −392 | −98 | | C |
| ATOM | 243 | O | ASP | A | 30 | 18.149 | 23.413 | 12.703 | 1.00 | 51.98 | | | O |
| ANISOU | 243 | O | ASP | A | 30 | 6893 | 6494 | 6364 | −29 | −385 | −86 | | O |
| ATOM | 244 | CB | ASP | A | 30 | 16.827 | 25.872 | 13.028 | 1.00 | 60.03 | | | C |
| ANISOU | 244 | CB | ASP | A | 30 | 7913 | 7401 | 7495 | −39 | −483 | −45 | | C |
| ATOM | 245 | CG | ASP | A | 30 | 15.765 | 26.883 | 13.437 | 1.00 | 64.53 | | | C |
| ANISOU | 245 | CG | ASP | A | 30 | 8478 | 7910 | 8130 | −31 | −544 | −52 | | C |
| ATOM | 246 | OD1 | ASP | A | 30 | 14.943 | 26.562 | 14.320 | 1.00 | 64.24 | | | O |
| ANISOU | 246 | OD1 | ASP | A | 30 | 8416 | 7864 | 8130 | −17 | −574 | −115 | | O |
| ATOM | 247 | OD2 | ASP | A | 30 | 15.762 | 28.006 | 12.891 | 1.00 | 68.96 | | | O |
| ANISOU | 247 | OD2 | ASP | A | 30 | 9061 | 8431 | 8708 | −36 | −558 | 10 | | O |
| ATOM | 248 | N | THR | A | 31 | 19.420 | 23.777 | 14.513 | 1.00 | 45.58 | | | N |
| ANISOU | 248 | N | THR | A | 31 | 5994 | 5662 | 5664 | −77 | −349 | −105 | | N |
| ATOM | 249 | CA | THR | A | 31 | 20.485 | 22.866 | 14.098 | 1.00 | 53.25 | | | C |
| ANISOU | 249 | CA | THR | A | 31 | 6961 | 6686 | 6587 | −74 | −283 | −89 | | C |
| ATOM | 250 | C | THR | A | 31 | 20.467 | 21.654 | 15.011 | 1.00 | 45.43 | | | C |
| ANISOU | 250 | C | THR | A | 31 | 5939 | 5722 | 5600 | −64 | −275 | −159 | | C |
| ATOM | 251 | O | THR | A | 31 | 20.704 | 21.784 | 16.217 | 1.00 | 44.77 | | | O |
| ANISOU | 251 | O | THR | A | 31 | 5809 | 5623 | 5579 | −84 | −284 | −187 | | O |
| ATOM | 252 | CB | THR | A | 31 | 21.857 | 23.541 | 14.159 | 1.00 | 49.39 | | | C |
| ANISOU | 252 | CB | THR | A | 31 | 6437 | 6192 | 6137 | −110 | −235 | −28 | | C |
| ATOM | 253 | OG1 | THR | A | 31 | 21.854 | 24.701 | 13.318 | 1.00 | 49.30 | | | O |
| ANISOU | 253 | OG1 | THR | A | 31 | 6455 | 6150 | 6126 | −122 | −241 | 42 | | O |
| ATOM | 254 | CG2 | THR | A | 31 | 22.948 | 22.600 | 13.695 | 1.00 | 56.84 | | | C |
| ANISOU | 254 | CG2 | THR | A | 31 | 7371 | 7191 | 7034 | −102 | −161 | −7 | | C |
| ATOM | 255 | N | GLN | A | 32 | 20.170 | 20.490 | 14.448 | 1.00 | 43.12 | | | N |
| ANISOU | 255 | N | GLN | A | 32 | 5677 | 5466 | 5239 | −34 | −262 | −186 | | N |
| ATOM | 256 | CA | GLN | A | 32 | 20.207 | 19.280 | 15.249 | 1.00 | 42.19 | | | C |
| ANISOU | 256 | CA | GLN | A | 32 | 5533 | 5372 | 5124 | −23 | −250 | −246 | | C |
| ATOM | 257 | C | GLN | A | 32 | 21.654 | 18.971 | 15.581 | 1.00 | 44.64 | | | C |
| ANISOU | 257 | C | GLN | A | 32 | 5802 | 5710 | 5451 | −37 | −186 | −222 | | C |
| ATOM | 258 | O | GLN | A | 32 | 22.544 | 19.215 | 14.768 | 1.00 | 48.49 | | | O |
| ANISOU | 258 | O | GLN | A | 32 | 6298 | 6214 | 5913 | −40 | −138 | −164 | | O |
| ATOM | 259 | CB | GLN | A | 32 | 19.584 | 18.111 | 14.503 | 1.00 | 43.98 | | | C |
| ANISOU | 259 | CB | GLN | A | 32 | 5807 | 5626 | 5278 | 10 | −252 | −280 | | C |
| ATOM | 260 | CG | GLN | A | 32 | 19.491 | 16.881 | 15.372 | 1.00 | 51.07 | | | C |
| ANISOU | 260 | CG | GLN | A | 32 | 6678 | 6538 | 6186 | 20 | −245 | −341 | | C |
| ATOM | 261 | CD | GLN | A | 32 | 19.163 | 15.642 | 14.584 | 1.00 | 56.99 | | | C |
| ANISOU | 261 | CD | GLN | A | 32 | 7476 | 7313 | 6864 | 50 | −235 | −371 | | C |
| ATOM | 262 | OE1 | GLN | A | 32 | 18.869 | 15.714 | 13.393 | 1.00 | 62.23 | | | O |
| ANISOU | 262 | OE1 | GLN | A | 32 | 8198 | 7984 | 7464 | 64 | −243 | −352 | | O |
| ATOM | 263 | NE2 | GLN | A | 32 | 19.211 | 14.493 | 15.243 | 1.00 | 53.43 | | | N |
| ANISOU | 263 | NE2 | GLN | A | 32 | 7006 | 6874 | 6421 | 60 | −220 | −418 | | N |
| ATOM | 264 | N | PHE | A | 33 | 21.912 | 18.476 | 16.790 | 1.00 | 39.96 | | | N |
| ANISOU | 264 | N | PHE | A | 33 | 5161 | 5120 | 4902 | −44 | −185 | −261 | | N |
| ATOM | 265 | CA | PHE | A | 33 | 23.296 | 18.159 | 17.110 | 1.00 | 37.62 | | | C |
| ANISOU | 265 | CA | PHE | A | 33 | 4819 | 4851 | 4624 | −56 | −130 | −235 | | C |
| ATOM | 266 | C | PHE | A | 33 | 23.520 | 16.809 | 17.744 | 1.00 | 39.47 | | | C |
| ANISOU | 266 | C | PHE | A | 33 | 5031 | 5114 | 4851 | −36 | −108 | −279 | | C |
| ATOM | 267 | O | PHE | A | 33 | 24.667 | 16.339 | 17.705 | 1.00 | 44.28 | | | O |
| ANISOU | 267 | O | PHE | A | 33 | 5610 | 5753 | 5462 | −33 | −53 | −252 | | O |

TABLE 14-continued

| | | | | | | | | | | | | |
|---|---|---|---|---|---|---|---|---|---|---|---|---|
| ATOM | 268 | CB | PHE | A | 33 | 23.924 | 19.249 | 17.992 | 1.00 | 39.13 | | C |
| ANISOU | 268 | CB | PHE | A | 33 | 4959 | 5015 | 4893 | −99 | −147 | −210 | C |
| ATOM | 269 | CG | PHE | A | 33 | 23.425 | 19.292 | 19.425 | 1.00 | 43.06 | | C |
| ANISOU | 269 | CG | PHE | A | 33 | 5430 | 5491 | 5441 | −111 | −195 | −267 | C |
| ATOM | 270 | CD1 | PHE | A | 33 | 22.223 | 19.925 | 19.737 | 1.00 | 43.45 | | C |
| ANISOU | 270 | CD1 | PHE | A | 33 | 5504 | 5500 | 5506 | −110 | −251 | −299 | C |
| ATOM | 271 | CD2 | PHE | A | 33 | 24.195 | 18.783 | 20.460 | 1.00 | 37.76 | | C |
| ANISOU | 271 | CD2 | PHE | A | 33 | 4708 | 4837 | 4801 | −122 | −184 | −283 | C |
| ATOM | 272 | CE1 | PHE | A | 33 | 21.792 | 20.003 | 21.034 | 1.00 | 40.45 | | C |
| ANISOU | 272 | CE1 | PHE | A | 33 | 5102 | 5100 | 5166 | −117 | −287 | −349 | C |
| ATOM | 273 | CE2 | PHE | A | 33 | 23.760 | 18.861 | 21.762 | 1.00 | 41.37 | | C |
| ANISOU | 273 | CE2 | PHE | A | 33 | 5149 | 5276 | 5295 | −131 | −226 | −332 | C |
| ATOM | 274 | CZ | PHE | A | 33 | 22.551 | 19.462 | 22.044 | 1.00 | 41.32 | | C |
| ANISOU | 274 | CZ | PHE | A | 33 | 5171 | 5231 | 5298 | −128 | −274 | −366 | C |
| ATOM | 275 | N | VAL | A | 34 | 22.505 | 16.183 | 18.348 | 1.00 | 38.35 | | N |
| ANISOU | 275 | N | VAL | A | 34 | 4900 | 4964 | 4709 | −22 | −145 | −341 | N |
| ATOM | 276 | CA | VAL | A | 34 | 22.594 | 14.810 | 18.836 | 1.00 | 38.92 | | C |
| ANISOU | 276 | CA | VAL | A | 34 | 4959 | 5059 | 4768 | 1 | −124 | −382 | C |
| ATOM | 277 | C | VAL | A | 34 | 21.345 | 14.041 | 18.459 | 1.00 | 40.81 | | C |
| ANISOU | 277 | C | VAL | A | 34 | 5245 | 5292 | 4967 | 26 | −151 | −430 | C |
| ATOM | 278 | O | VAL | A | 34 | 20.258 | 14.594 | 18.254 | 1.00 | 39.48 | | O |
| ANISOU | 278 | O | VAL | A | 34 | 5102 | 5099 | 4798 | 23 | −201 | −443 | O |
| ATOM | 279 | CB | VAL | A | 34 | 22.778 | 14.664 | 20.362 | 1.00 | 38.16 | | C |
| ANISOU | 279 | CB | VAL | A | 34 | 4811 | 4959 | 4728 | −14 | −140 | −409 | C |
| ATOM | 280 | CG1 | VAL | A | 34 | 24.196 | 14.934 | 20.759 | 1.00 | 39.88 | | C |
| ANISOU | 280 | CG1 | VAL | A | 34 | 4977 | 5194 | 4982 | −34 | −108 | −367 | C |
| ATOM | 281 | CG2 | VAL | A | 34 | 21.806 | 15.578 | 21.134 | 1.00 | 35.91 | | C |
| ANISOU | 281 | CG2 | VAL | A | 34 | 4524 | 4636 | 4482 | −32 | −201 | −436 | C |
| ATOM | 282 | N | ARG | A | 35 | 21.493 | 12.752 | 18.596 | 1.00 | 35.86 | | N |
| ANISOU | 282 | N | ARG | A | 35 | 4624 | 4685 | 4316 | 50 | −122 | −458 | N |
| ATOM | 283 | CA | ARG | A | 35 | 20.336 | 11.889 | 18.434 | 1.00 | 36.33 | | C |
| ANISOU | 283 | CA | ARG | A | 35 | 4717 | 4735 | 4353 | 67 | −152 | −509 | C |
| ATOM | 284 | C | ARG | A | 35 | 20.616 | 10.581 | 19.135 | 1.00 | 40.56 | | C |
| ANISOU | 284 | C | ARG | A | 35 | 5230 | 5282 | 4900 | 82 | −126 | −540 | C |
| ATOM | 285 | O | ARG | A | 35 | 21.751 | 10.239 | 19.341 | 1.00 | 36.20 | | O |
| ANISOU | 285 | O | ARG | A | 35 | 4650 | 4751 | 4352 | 89 | −76 | −519 | O |
| ATOM | 286 | CB | ARG | A | 35 | 20.036 | 11.656 | 16.962 | 1.00 | 39.44 | | C |
| ANISOU | 286 | CB | ARG | A | 35 | 5178 | 5134 | 4675 | 87 | −150 | −506 | C |
| ATOM | 287 | CG | ARG | A | 35 | 21.001 | 10.698 | 16.297 | 1.00 | 51.58 | | C |
| ANISOU | 287 | CG | ARG | A | 35 | 6738 | 6697 | 6162 | 113 | −83 | −496 | C |
| ATOM | 288 | CD | ARG | A | 35 | 20.218 | 9.489 | 15.897 | 1.00 | 54.38 | | C |
| ANISOU | 288 | CD | ARG | A | 35 | 7140 | 7046 | 6477 | 136 | −94 | −549 | C |
| ATOM | 289 | NE | ARG | A | 35 | 21.080 | 8.404 | 15.528 | 1.00 | 62.55 | | N |
| ANISOU | 289 | NE | ARG | A | 35 | 8197 | 8100 | 7472 | 167 | −28 | −551 | N |
| ATOM | 290 | CZ | ARG | A | 35 | 20.753 | 7.475 | 14.669 | 1.00 | 69.68 | | C |
| ANISOU | 290 | CZ | ARG | A | 35 | 9165 | 8997 | 8313 | 192 | −24 | −586 | C |
| ATOM | 291 | NH1 | ARG | A | 35 | 19.588 | 7.518 | 14.063 | 1.00 | 67.78 | | N |
| ANISOU | 291 | NH1 | ARG | A | 35 | 8970 | 8737 | 8045 | 185 | −90 | −618 | N |
| ATOM | 292 | NH2 | ARG | A | 35 | 21.600 | 6.515 | 14.394 | 1.00 | 75.44 | | N |
| ANISOU | 292 | NH2 | ARG | A | 35 | 9915 | 9740 | 9009 | 224 | 43 | −589 | N |
| ATOM | 293 | N | PHE | A | 36 | 19.553 | 10.007 | 19.621 | 1.00 | 32.97 | | N |
| ANISOU | 293 | N | PHE | A | 36 | 4275 | 4304 | 3948 | 86 | −162 | −587 | N |
| ATOM | 294 | CA | PHE | A | 36 | 19.545 | 8.639 | 20.115 | 1.00 | 35.36 | | C |
| ANISOU | 294 | CA | PHE | A | 36 | 4572 | 4610 | 4253 | 103 | −142 | −620 | C |
| ATOM | 295 | C | PHE | A | 36 | 18.347 | 7.942 | 19.491 | 1.00 | 40.46 | | C |
| ANISOU | 295 | C | PHE | A | 36 | 5265 | 5238 | 4871 | 112 | −176 | −660 | C |
| ATOM | 296 | O | PHE | A | 36 | 17.243 | 8.487 | 19.490 | 1.00 | 39.95 | | O |
| ANISOU | 296 | O | PHE | A | 36 | 5204 | 5155 | 4821 | 99 | −229 | −672 | O |
| ATOM | 297 | CB | PHE | A | 36 | 19.458 | 8.580 | 21.638 | 1.00 | 34.84 | | C |
| ANISOU | 297 | CB | PHE | A | 36 | 4455 | 4540 | 4243 | 92 | −153 | −634 | C |
| ATOM | 298 | CG | PHE | A | 36 | 19.506 | 7.169 | 22.187 | 1.00 | 37.92 | | C |
| ANISOU | 298 | CG | PHE | A | 36 | 4839 | 4932 | 4638 | 110 | −130 | −660 | C |
| ATOM | 299 | CD1 | PHE | A | 36 | 18.364 | 6.405 | 22.246 | 1.00 | 39.79 | | C |
| ANISOU | 299 | CD1 | PHE | A | 36 | 5095 | 5149 | 4877 | 114 | −156 | −699 | C |
| ATOM | 300 | CD2 | PHE | A | 36 | 20.700 | 6.616 | 22.630 | 1.00 | 42.41 | | C |
| ANISOU | 300 | CD2 | PHE | A | 36 | 5379 | 5521 | 5214 | 122 | −83 | −641 | C |
| ATOM | 301 | CE1 | PHE | A | 36 | 18.393 | 5.110 | 22.724 | 1.00 | 40.82 | | C |
| ANISOU | 301 | CE1 | PHE | A | 36 | 5222 | 5274 | 5015 | 129 | −134 | −720 | C |
| ATOM | 302 | CE2 | PHE | A | 36 | 20.733 | 5.321 | 23.117 | 1.00 | 39.94 | | C |
| ANISOU | 302 | CE2 | PHE | A | 36 | 5063 | 5205 | 4907 | 141 | −63 | −662 | C |
| ATOM | 303 | CZ | PHE | A | 36 | 19.562 | 4.573 | 23.163 | 1.00 | 40.82 | | C |
| ANISOU | 303 | CZ | PHE | A | 36 | 5199 | 5292 | 5019 | 144 | −88 | −702 | C |
| ATOM | 304 | N | ASP | A | 37 | 18.546 | 6.738 | 18.980 | 1.00 | 39.52 | | N |
| ANISOU | 304 | N | ASP | A | 37 | 5178 | 5120 | 4716 | 134 | −148 | −680 | N |
| ATOM | 305 | CA | ASP | A | 37 | 17.442 | 5.968 | 18.408 | 1.00 | 39.81 | | C |
| ANISOU | 305 | CA | ASP | A | 37 | 5260 | 5135 | 4729 | 138 | −186 | −722 | C |
| ATOM | 306 | C | ASP | A | 37 | 17.598 | 4.557 | 18.934 | 1.00 | 38.88 | | C |
| ANISOU | 306 | C | ASP | A | 37 | 5139 | 5009 | 4624 | 153 | −158 | −752 | C |
| ATOM | 307 | O | ASP | A | 37 | 18.660 | 3.949 | 18.747 | 1.00 | 39.93 | | O |
| ANISOU | 307 | O | ASP | A | 37 | 5280 | 5154 | 4735 | 176 | −101 | −742 | O |

TABLE 14-continued

| | | | | | | | | | | | | |
|---|---|---|---|---|---|---|---|---|---|---|---|---|
| ATOM | 308 | CB | ASP | A | 37 | 17.481 | 6.008 | 16.872 | 1.00 | 44.39 | | C |
| ANISOU | 308 | CB | ASP | A | 37 | 5912 | 5720 | 5235 | 151 | −187 | −719 | C |
| ATOM | 309 | CG | ASP | A | 37 | 16.265 | 5.283 | 16.202 | 1.00 | 48.48 | | C |
| ANISOU | 309 | CG | ASP | A | 37 | 6482 | 6214 | 5726 | 150 | −242 | −765 | C |
| ATOM | 310 | OD1 | ASP | A | 37 | 15.685 | 4.339 | 16.780 | 1.00 | 45.64 | | O |
| ANISOU | 310 | OD1 | ASP | A | 37 | 6109 | 5833 | 5398 | 146 | −257 | −802 | O |
| ATOM | 311 | OD2 | ASP | A | 37 | 15.899 | 5.668 | 15.083 | 1.00 | 53.92 | | O |
| ANISOU | 311 | OD2 | ASP | A | 37 | 7223 | 6904 | 6361 | 151 | −273 | −762 | O |
| ATOM | 312 | N | SER | A | 38 | 16.587 | 4.067 | 19.651 | 1.00 | 34.77 | | N |
| ANISOU | 312 | N | SER | A | 38 | 4600 | 4467 | 4145 | 141 | −194 | −783 | N |
| ATOM | 313 | CA | SER | A | 38 | 16.697 | 2.752 | 20.273 | 1.00 | 38.90 | | C |
| ANISOU | 313 | CA | SER | A | 38 | 5116 | 4977 | 4689 | 152 | −168 | −805 | C |
| ATOM | 314 | C | SER | A | 38 | 16.836 | 1.628 | 19.252 | 1.00 | 40.00 | | C |
| ANISOU | 314 | C | SER | A | 38 | 5318 | 5100 | 4778 | 173 | −152 | −833 | C |
| ATOM | 315 | O | SER | A | 38 | 17.178 | 0.510 | 19.638 | 1.00 | 41.95 | | O |
| ANISOU | 315 | O | SER | A | 38 | 5567 | 5334 | 5039 | 189 | −119 | −848 | O |
| ATOM | 316 | CB | SER | A | 38 | 15.475 | 2.459 | 21.123 | 1.00 | 39.75 | | C |
| ANISOU | 316 | CB | SER | A | 38 | 5193 | 5061 | 4849 | 133 | −209 | −829 | C |
| ATOM | 317 | OG | SER | A | 38 | 14.325 | 2.507 | 20.317 | 1.00 | 40.78 | | O |
| ANISOU | 317 | OG | SER | A | 38 | 5356 | 5172 | 4968 | 120 | −266 | −853 | O |
| ATOM | 318 | N | ASP | A | 39 | 16.494 | 1.868 | 17.985 | 1.00 | 37.72 | | N |
| ANISOU | 318 | N | ASP | A | 39 | 5089 | 4809 | 4435 | 173 | −178 | −844 | N |
| ATOM | 319 | CA | ASP | A | 39 | 16.648 | 0.835 | 16.961 | 1.00 | 41.88 | | C |
| ANISOU | 319 | CA | ASP | A | 39 | 5689 | 5319 | 4905 | 195 | −163 | −876 | C |
| ATOM | 320 | C | ASP | A | 39 | 18.043 | 0.792 | 16.367 | 1.00 | 49.32 | | C |
| ANISOU | 320 | C | ASP | A | 39 | 6658 | 6286 | 5797 | 230 | −88 | −852 | C |
| ATOM | 321 | O | ASP | A | 39 | 18.403 | −0.197 | 15.722 | 1.00 | 45.14 | | O |
| ANISOU | 321 | O | ASP | A | 39 | 6185 | 5743 | 5225 | 258 | −55 | −878 | O |
| ATOM | 322 | CB | ASP | A | 39 | 15.664 | 1.051 | 15.815 | 1.00 | 49.24 | | C |
| ANISOU | 322 | CB | ASP | A | 39 | 6682 | 6239 | 5789 | 183 | −228 | −900 | C |
| ATOM | 323 | CG | ASP | A | 39 | 14.271 | 0.451 | 16.096 | 1.00 | 61.80 | | C |
| ANISOU | 323 | CG | ASP | A | 39 | 8267 | 7793 | 7422 | 155 | −298 | −940 | C |
| ATOM | 324 | OD1 | ASP | A | 39 | 14.063 | −0.226 | 17.141 | 1.00 | 54.66 | | O |
| ANISOU | 324 | OD1 | ASP | A | 39 | 7319 | 6871 | 6581 | 148 | −289 | −950 | O |
| ATOM | 325 | OD2 | ASP | A | 39 | 13.390 | 0.642 | 15.230 | 1.00 | 63.81 | | O |
| ANISOU | 325 | OD2 | ASP | A | 39 | 8563 | 8037 | 7646 | 141 | −363 | −959 | O |
| ATOM | 326 | N | ALA | A | 40 | 18.827 | 1.841 | 16.558 | 1.00 | 48.71 | | N |
| ANISOU | 326 | N | ALA | A | 40 | 6540 | 6242 | 5725 | 229 | −59 | −802 | N |
| ATOM | 327 | CA | ALA | A | 40 | 20.112 | 1.915 | 15.900 | 1.00 | 52.36 | | C |
| ANISOU | 327 | CA | ALA | A | 40 | 7021 | 6731 | 6144 | 260 | 13 | −771 | C |
| ATOM | 328 | C | ALA | A | 40 | 21.103 | 1.006 | 16.616 | 1.00 | 54.78 | | C |
| ANISOU | 328 | C | ALA | A | 40 | 7292 | 7039 | 6482 | 287 | 78 | −765 | C |
| ATOM | 329 | O | ALA | A | 40 | 20.941 | 0.671 | 17.793 | 1.00 | 60.67 | | O |
| ANISOU | 329 | O | ALA | A | 40 | 7985 | 7776 | 7290 | 276 | 66 | −769 | O |
| ATOM | 330 | CB | ALA | A | 40 | 20.605 | 3.359 | 15.861 | 1.00 | 51.17 | | C |
| ANISOU | 330 | CB | ALA | A | 40 | 6834 | 6611 | 5998 | 245 | 19 | −716 | C |
| ATOM | 331 | N | ALA | A | 41 | 22.150 | 0.612 | 15.885 | 1.00 | 52.11 | | N |
| ANISOU | 331 | N | ALA | A | 41 | 6984 | 6715 | 6101 | 326 | 149 | −751 | N |
| ATOM | 332 | CA | ALA | A | 41 | 23.055 | −0.430 | 16.378 | 1.00 | 51.92 | | C |
| ANISOU | 332 | CA | ALA | A | 41 | 6938 | 6688 | 6103 | 361 | 213 | −749 | C |
| ATOM | 333 | C | ALA | A | 41 | 23.905 | 0.040 | 17.563 | 1.00 | 51.37 | | C |
| ANISOU | 333 | C | ALA | A | 41 | 6771 | 6646 | 6102 | 353 | 234 | −698 | C |
| ATOM | 334 | O | ALA | A | 41 | 24.157 | −0.737 | 18.491 | 1.00 | 49.93 | | O |
| ANISOU | 334 | O | ALA | A | 41 | 6551 | 6454 | 5967 | 364 | 247 | −702 | O |
| ATOM | 335 | CB | ALA | A | 41 | 23.949 | −0.922 | 15.234 | 1.00 | 53.94 | | C |
| ANISOU | 335 | CB | ALA | A | 41 | 7250 | 6951 | 6292 | 411 | 290 | −745 | C |
| ATOM | 336 | N | SER | A | 42 | 24.375 | 1.293 | 17.554 | 1.00 | 45.32 | | N |
| ANISOU | 336 | N | SER | A | 42 | 5964 | 5912 | 5343 | 333 | 236 | −650 | N |
| ATOM | 337 | CA | SER | A | 42 | 25.333 | 1.709 | 18.583 | 1.00 | 46.87 | | C |
| ANISOU | 337 | CA | SER | A | 42 | 6072 | 6134 | 5601 | 326 | 256 | −602 | C |
| ATOM | 338 | C | SER | A | 42 | 24.752 | 1.691 | 19.994 | 1.00 | 51.41 | | C |
| ANISOU | 338 | C | SER | A | 42 | 6600 | 6698 | 6237 | 297 | 203 | −616 | C |
| ATOM | 339 | O | SER | A | 42 | 25.471 | 1.394 | 20.955 | 1.00 | 49.84 | | O |
| ANISOU | 339 | O | SER | A | 42 | 6342 | 6511 | 6083 | 304 | 221 | −593 | O |
| ATOM | 340 | CB | SER | A | 42 | 25.865 | 3.103 | 18.284 | 1.00 | 46.34 | | C |
| ANISOU | 340 | CB | SER | A | 42 | 5975 | 6096 | 5535 | 302 | 260 | −551 | C |
| ATOM | 341 | OG | SER | A | 42 | 24.801 | 4.019 | 18.299 | 1.00 | 55.83 | | O |
| ANISOU | 341 | OG | SER | A | 42 | 7193 | 7286 | 6735 | 263 | 190 | −565 | O |
| ATOM | 342 | N | GLN | A | 43 | 23.475 | 2.035 | 20.160 | 1.00 | 49.10 | | N |
| ANISOU | 342 | N | GLN | A | 43 | 6327 | 6384 | 5944 | 266 | 137 | −649 | N |
| ATOM | 343 | CA | GLN | A | 43 | 22.901 | 2.180 | 21.495 | 1.00 | 48.13 | | C |
| ANISOU | 343 | CA | GLN | A | 43 | 6159 | 6255 | 5875 | 240 | 91 | −657 | C |
| ATOM | 344 | C | GLN | A | 43 | 23.592 | 3.304 | 22.263 | 1.00 | 45.32 | | C |
| ANISOU | 344 | C | GLN | A | 43 | 5739 | 5925 | 5555 | 216 | 84 | −614 | C |
| ATOM | 345 | O | GLN | A | 43 | 23.801 | 3.235 | 23.477 | 1.00 | 40.72 | | O |
| ANISOU | 345 | O | GLN | A | 43 | 5109 | 5349 | 5014 | 208 | 74 | −607 | O |
| ATOM | 346 | CB | GLN | A | 43 | 22.950 | 0.861 | 22.263 | 1.00 | 52.61 | | C |
| ANISOU | 346 | CB | GLN | A | 43 | 6716 | 6806 | 6467 | 261 | 109 | −675 | C |
| ATOM | 347 | CG | GLN | A | 43 | 21.954 | −0.163 | 21.722 | 1.00 | 57.05 | | C |
| ANISOU | 347 | CG | GLN | A | 43 | 7339 | 7330 | 7007 | 270 | 95 | −726 | C |

TABLE 14-continued

| | | | | | | | | | | | | |
|---|---|---|---|---|---|---|---|---|---|---|---|---|
| ATOM | 348 | CD | GLN | A | 43 | 20.513 | 0.387 | 21.691 | 1.00 | 52.49 | | C |
| ANISOU | 348 | CD | GLN | A | 43 | 6779 | 6734 | 6432 | 235 | 27 | −754 | C |
| ATOM | 349 | OE1 | GLN | A | 43 | 19.938 | 0.730 | 22.716 | 1.00 | 61.45 | | O |
| ANISOU | 349 | OE1 | GLN | A | 43 | 7874 | 7867 | 7607 | 212 | −6 | −754 | O |
| ATOM | 350 | NE2 | GLN | A | 43 | 19.948 | 0.486 | 20.495 | 1.00 | 54.97 | | N |
| ANISOU | 350 | NE2 | GLN | A | 43 | 7151 | 7036 | 6700 | 233 | 7 | −777 | N |
| ATOM | 351 | N | ARG | A | 44 | 23.956 | 4.360 | 21.549 | 1.00 | 36.60 | | N |
| ANISOU | 351 | N | ARG | A | 44 | 4637 | 4836 | 4434 | 204 | 88 | −585 | N |
| ATOM | 352 | CA | ARG | A | 44 | 24.624 | 5.481 | 22.176 | 1.00 | 37.68 | | C |
| ANISOU | 352 | CA | ARG | A | 44 | 4718 | 4991 | 4607 | 177 | 78 | −545 | C |
| ATOM | 353 | C | ARG | A | 44 | 24.016 | 6.762 | 21.669 | 1.00 | 38.10 | | C |
| ANISOU | 353 | C | ARG | A | 44 | 4791 | 5036 | 4650 | 147 | 39 | −540 | C |
| ATOM | 354 | O | ARG | A | 44 | 23.518 | 6.816 | 20.540 | 1.00 | 38.84 | | O |
| ANISOU | 354 | O | ARG | A | 44 | 4938 | 5121 | 4698 | 155 | 39 | −549 | O |
| ATOM | 355 | CB | ARG | A | 44 | 26.138 | 5.535 | 21.843 | 1.00 | 41.27 | | C |
| ANISOU | 355 | CB | ARG | A | 44 | 5136 | 5476 | 5069 | 191 | 137 | −492 | C |
| ATOM | 356 | CG | ARG | A | 44 | 26.870 | 4.216 | 21.981 | 1.00 | 50.85 | | C |
| ANISOU | 356 | CG | ARG | A | 44 | 6337 | 6698 | 6286 | 233 | 190 | −490 | C |
| ATOM | 357 | CD | ARG | A | 44 | 27.552 | 4.113 | 23.299 | 1.00 | 52.26 | | C |
| ANISOU | 357 | CD | ARG | A | 44 | 6446 | 6893 | 6520 | 226 | 181 | −468 | C |
| ATOM | 358 | NE | ARG | A | 44 | 28.628 | 5.100 | 23.477 | 1.00 | 58.71 | | N |
| ANISOU | 358 | NE | ARG | A | 44 | 7201 | 7736 | 7370 | 202 | 187 | −414 | N |
| ATOM | 359 | CZ | ARG | A | 44 | 29.089 | 5.455 | 24.677 | 1.00 | 53.52 | | C |
| ANISOU | 359 | CZ | ARG | A | 44 | 6484 | 7091 | 6761 | 179 | 153 | −396 | C |
| ATOM | 360 | NH1 | ARG | A | 44 | 28.540 | 4.917 | 25.765 | 1.00 | 50.04 | | N |
| ANISOU | 360 | NH1 | ARG | A | 44 | 6042 | 6640 | 6331 | 179 | 118 | −426 | N |
| ATOM | 361 | NH2 | ARG | A | 44 | 30.062 | 6.362 | 24.806 | 1.00 | 48.87 | | N |
| ANISOU | 361 | NH2 | ARG | A | 44 | 5839 | 6523 | 6208 | 152 | 151 | −347 | N |
| ATOM | 362 | N | MET | A | 45 | 24.097 | 7.804 | 22.497 | 1.00 | 32.38 | | N |
| ANISOU | 362 | N | MET | A | 45 | 4026 | 4312 | 3966 | 115 | 5 | −524 | N |
| ATOM | 363 | CA | MET | A | 45 | 23.897 | 9.130 | 21.960 | 1.00 | 36.52 | | C |
| ANISOU | 363 | CA | MET | A | 45 | 4560 | 4828 | 4487 | 89 | −19 | −504 | C |
| ATOM | 364 | C | MET | A | 45 | 24.923 | 9.359 | 20.865 | 1.00 | 46.29 | | C |
| ANISOU | 364 | C | MET | A | 45 | 5802 | 6086 | 5701 | 98 | 33 | −455 | C |
| ATOM | 365 | O | MET | A | 45 | 26.101 | 9.015 | 21.027 | 1.00 | 42.95 | | O |
| ANISOU | 365 | O | MET | A | 45 | 5338 | 5686 | 5294 | 108 | 78 | −423 | O |
| ATOM | 366 | CB | MET | A | 45 | 24.025 | 10.176 | 23.067 | 1.00 | 36.06 | | C |
| ANISOU | 366 | CB | MET | A | 45 | 4457 | 4763 | 4480 | 54 | −59 | −494 | C |
| ATOM | 367 | CG | MET | A | 45 | 23.551 | 11.553 | 22.621 | 1.00 | 40.18 | | C |
| ANISOU | 367 | CG | MET | A | 45 | 4997 | 5265 | 5006 | 28 | −93 | −481 | C |
| ATOM | 368 | SD | MET | A | 45 | 21.701 | 11.598 | 22.550 | 1.00 | 42.75 | | S |
| ANISOU | 368 | SD | MET | A | 45 | 5369 | 5557 | 5316 | 33 | −146 | −533 | S |
| ATOM | 369 | CE | MET | A | 45 | 21.402 | 12.863 | 23.789 | 1.00 | 41.46 | | C |
| ANISOU | 369 | CE | MET | A | 45 | 5176 | 5370 | 5207 | 1 | −194 | −540 | C |
| ATOM | 370 | N | GLU | A | 46 | 24.486 | 9.913 | 19.737 | 1.00 | 35.93 | | N |
| ANISOU | 370 | N | GLU | A | 46 | 4538 | 4766 | 4349 | 97 | 29 | −446 | N |
| ATOM | 371 | CA | GLU | A | 46 | 25.406 | 10.080 | 18.624 | 1.00 | 38.18 | | C |
| ANISOU | 371 | CA | GLU | A | 46 | 4833 | 5071 | 4601 | 110 | 86 | −398 | C |
| ATOM | 372 | C | GLU | A | 46 | 25.411 | 11.515 | 18.141 | 1.00 | 40.54 | | C |
| ANISOU | 372 | C | GLU | A | 46 | 5135 | 5362 | 4906 | 80 | 68 | −357 | C |
| ATOM | 373 | O | GLU | A | 46 | 24.381 | 12.197 | 18.198 | 1.00 | 38.81 | | O |
| ANISOU | 373 | O | GLU | A | 46 | 4940 | 5116 | 4689 | 62 | 10 | −376 | O |
| ATOM | 374 | CB | GLU | A | 46 | 25.038 | 9.169 | 17.445 | 1.00 | 36.52 | | C |
| ANISOU | 374 | CB | GLU | A | 46 | 4696 | 4863 | 4316 | 149 | 116 | −421 | C |
| ATOM | 375 | CG | GLU | A | 46 | 25.074 | 7.682 | 17.769 | 1.00 | 49.90 | | C |
| ANISOU | 375 | CG | GLU | A | 46 | 6396 | 6559 | 6004 | 182 | 140 | −462 | C |
| ATOM | 376 | CD | GLU | A | 46 | 24.488 | 6.829 | 16.620 | 1.00 | 65.84 | | C |
| ANISOU | 376 | CD | GLU | A | 46 | 8500 | 8570 | 7948 | 214 | 153 | −498 | C |
| ATOM | 377 | OE1 | GLU | A | 46 | 24.794 | 5.620 | 16.513 | 1.00 | 71.95 | | O |
| ANISOU | 377 | OE1 | GLU | A | 46 | 9291 | 9344 | 8703 | 249 | 194 | −520 | O |
| ATOM | 378 | OE2 | GLU | A | 46 | 23.720 | 7.377 | 15.811 | 1.00 | 75.93 | | O |
| ANISOU | 378 | OE2 | GLU | A | 46 | 9829 | 9837 | 9182 | 206 | 118 | −503 | O |
| ATOM | 379 | N | PRO | A | 47 | 26.548 | 11.987 | 17.626 | 1.00 | 44.33 | | N |
| ANISOU | 379 | N | PRO | A | 47 | 5591 | 5862 | 5391 | 75 | 119 | −296 | N |
| ATOM | 380 | CA | PRO | A | 47 | 26.622 | 13.360 | 17.105 | 1.00 | 41.54 | | C |
| ANISOU | 380 | CA | PRO | A | 47 | 5242 | 5497 | 5046 | 45 | 107 | −248 | C |
| ATOM | 381 | C | PRO | A | 47 | 25.943 | 13.509 | 15.754 | 1.00 | 43.13 | | C |
| ANISOU | 381 | C | PRO | A | 47 | 5522 | 5694 | 5172 | 63 | 109 | −244 | C |
| ATOM | 382 | O | PRO | A | 47 | 25.921 | 12.588 | 14.943 | 1.00 | 39.76 | | O |
| ANISOU | 382 | O | PRO | A | 47 | 5143 | 5283 | 4680 | 102 | 148 | −258 | O |
| ATOM | 383 | CB | PRO | A | 47 | 28.137 | 13.598 | 16.977 | 1.00 | 47.75 | | C |
| ANISOU | 383 | CB | PRO | A | 47 | 5970 | 6309 | 5863 | 37 | 171 | −180 | C |
| ATOM | 384 | CG | PRO | A | 47 | 28.697 | 12.223 | 16.719 | 1.00 | 40.89 | | C |
| ANISOU | 384 | CG | PRO | A | 47 | 5104 | 5471 | 4962 | 84 | 236 | −190 | C |
| ATOM | 385 | CD | PRO | A | 47 | 27.860 | 11.287 | 17.552 | 1.00 | 43.00 | | C |
| ANISOU | 385 | CD | PRO | A | 47 | 5383 | 5725 | 5229 | 98 | 194 | −263 | C |
| ATOM | 386 | N | ARG | A | 48 | 25.379 | 14.707 | 15.515 | 1.00 | 47.27 | | N |
| ANISOU | 386 | N | ARG | A | 48 | 6062 | 6192 | 5704 | 37 | 64 | −224 | N |
| ATOM | 387 | CA | ARG | A | 48 | 24.734 | 15.052 | 14.252 | 1.00 | 48.10 | | C |
| ANISOU | 387 | CA | ARG | A | 48 | 6241 | 6292 | 5742 | 50 | 56 | −210 | C |

TABLE 14-continued

| | | | | | | | | | | | | |
|---|---|---|---|---|---|---|---|---|---|---|---|---|
| ATOM | 388 | C | ARG | A | 48 | 25.205 | 16.392 | 13.704 | 1.00 | 48.59 | | C |
| ANISOU | 388 | C | ARG | A | 48 | 6299 | 6346 | 5818 | 23 | 67 | −136 | C |
| ATOM | 389 | O | ARG | A | 48 | 24.724 | 16.820 | 12.650 | 1.00 | 56.94 | | O |
| ANISOU | 389 | O | ARG | A | 48 | 7416 | 7398 | 6820 | 33 | 59 | −113 | O |
| ATOM | 390 | CB | ARG | A | 48 | 23.198 | 15.079 | 14.406 | 1.00 | 43.12 | | C |
| ANISOU | 390 | CB | ARG | A | 48 | 5648 | 5633 | 5102 | 50 | −24 | −265 | C |
| ATOM | 391 | CG | ARG | A | 48 | 22.557 | 13.692 | 14.368 | 1.00 | 49.49 | | C |
| ANISOU | 391 | CG | ARG | A | 48 | 6489 | 6448 | 5867 | 82 | −31 | −330 | C |
| ATOM | 392 | CD | ARG | A | 48 | 22.507 | 13.142 | 12.947 | 1.00 | 60.96 | | C |
| ANISOU | 392 | CD | ARG | A | 48 | 8020 | 7919 | 7224 | 115 | −2 | −325 | C |
| ATOM | 393 | NE | ARG | A | 48 | 22.324 | 11.691 | 12.876 | 1.00 | 77.70 | | N |
| ANISOU | 393 | NE | ARG | A | 48 | 10170 | 10048 | 9306 | 145 | 13 | −381 | N |
| ATOM | 394 | CZ | ARG | A | 48 | 23.252 | 10.789 | 13.221 | 1.00 | 85.55 | | C |
| ANISOU | 394 | CZ | ARG | A | 48 | 11136 | 11060 | 10308 | 164 | 76 | −386 | C |
| ATOM | 395 | NH1 | ARG | A | 48 | 23.017 | 9.478 | 13.124 | 1.00 | 79.83 | | N |
| ANISOU | 395 | NH1 | ARG | A | 48 | 10446 | 10336 | 9551 | 193 | 87 | −438 | N |
| ATOM | 396 | NH2 | ARG | A | 48 | 24.414 | 11.189 | 13.698 | 1.00 | 95.14 | | N |
| ANISOU | 396 | NH2 | ARG | A | 48 | 12286 | 12290 | 11571 | 153 | 125 | −339 | N |
| ATOM | 397 | N | ALA | A | 49 | 26.115 | 17.063 | 14.399 | 1.00 | 49.47 | | N |
| ANISOU | 397 | N | ALA | A | 49 | 6341 | 6452 | 6004 | −11 | 80 | −97 | N |
| ATOM | 398 | CA | ALA | A | 49 | 26.769 | 18.304 | 14.041 | 1.00 | 52.49 | | C |
| ANISOU | 398 | CA | ALA | A | 49 | 6703 | 6823 | 6419 | −44 | 96 | −22 | C |
| ATOM | 399 | C | ALA | A | 49 | 28.263 | 18.155 | 14.284 | 1.00 | 58.06 | | C |
| ANISOU | 399 | C | ALA | A | 49 | 7337 | 7555 | 7166 | −55 | 163 | 26 | C |
| ATOM | 400 | O | ALA | A | 49 | 28.674 | 17.426 | 15.191 | 1.00 | 54.13 | | O |
| ANISOU | 400 | O | ALA | A | 49 | 6790 | 7072 | 6703 | −53 | 167 | −5 | O |
| ATOM | 401 | CB | ALA | A | 49 | 26.227 | 19.470 | 14.875 | 1.00 | 54.85 | | C |
| ANISOU | 401 | CB | ALA | A | 49 | 6980 | 7072 | 6788 | −86 | 21 | −30 | C |
| ATOM | 402 | N | PRO | A | 50 | 29.100 | 18.841 | 13.498 | 1.00 | 66.10 | | N |
| ANISOU | 402 | N | PRO | A | 50 | 8345 | 8582 | 8187 | −68 | 216 | 108 | N |
| ATOM | 403 | CA | PRO | A | 50 | 30.560 | 18.657 | 13.662 | 1.00 | 62.32 | | C |
| ANISOU | 403 | CA | PRO | A | 50 | 7790 | 8133 | 7755 | −78 | 286 | 161 | C |
| ATOM | 404 | C | PRO | A | 50 | 31.086 | 19.141 | 15.000 | 1.00 | 51.36 | | C |
| ANISOU | 404 | C | PRO | A | 50 | 6316 | 6726 | 6471 | −128 | 242 | 160 | C |
| ATOM | 405 | O | PRO | A | 50 | 31.854 | 18.430 | 15.654 | 1.00 | 57.98 | | O |
| ANISOU | 405 | O | PRO | A | 50 | 7093 | 7591 | 7344 | −123 | 265 | 154 | O |
| ATOM | 406 | CB | PRO | A | 50 | 31.159 | 19.467 | 12.493 | 1.00 | 65.40 | | C |
| ANISOU | 406 | CB | PRO | A | 50 | 8193 | 8529 | 8127 | −86 | 346 | 254 | C |
| ATOM | 407 | CG | PRO | A | 50 | 30.004 | 19.743 | 11.554 | 1.00 | 72.25 | | C |
| ANISOU | 407 | CG | PRO | A | 50 | 9161 | 9381 | 8912 | −65 | 317 | 241 | C |
| ATOM | 408 | CD | PRO | A | 50 | 28.767 | 19.794 | 12.426 | 1.00 | 69.74 | | C |
| ANISOU | 408 | CD | PRO | A | 50 | 8861 | 9026 | 8612 | −74 | 217 | 160 | C |
| ATOM | 409 | N | TRP | A | 51 | 30.680 | 20.327 | 15.440 | 1.00 | 50.88 | | N |
| ANISOU | 409 | N | TRP | A | 51 | 6252 | 6618 | 6461 | −174 | 176 | 164 | N |
| ATOM | 410 | CA | TRP | A | 51 | 31.222 | 20.903 | 16.664 | 1.00 | 56.09 | | C |
| ANISOU | 410 | CA | TRP | A | 51 | 6839 | 7256 | 7218 | −226 | 130 | 164 | C |
| ATOM | 411 | C | TRP | A | 51 | 30.976 | 20.064 | 17.916 | 1.00 | 58.83 | | C |
| ANISOU | 411 | C | TRP | A | 51 | 7162 | 7610 | 7580 | −217 | 88 | 88 | C |
| ATOM | 412 | O | TRP | A | 51 | 31.719 | 20.227 | 18.895 | 1.00 | 65.49 | | O |
| ANISOU | 412 | O | TRP | A | 51 | 7937 | 8452 | 8493 | −251 | 66 | 93 | O |
| ATOM | 413 | CB | TRP | A | 51 | 30.648 | 22.298 | 16.886 | 1.00 | 65.20 | | C |
| ANISOU | 413 | CB | TRP | A | 51 | 8012 | 8348 | 8414 | −271 | 63 | 169 | C |
| ATOM | 414 | CG | TRP | A | 51 | 29.184 | 22.421 | 16.608 | 1.00 | 66.94 | | C |
| ANISOU | 414 | CG | TRP | A | 51 | 8314 | 8541 | 8580 | −245 | 17 | 119 | C |
| ATOM | 415 | CD1 | TRP | A | 51 | 28.604 | 22.751 | 15.414 | 1.00 | 74.34 | | C |
| ANISOU | 415 | CD1 | TRP | A | 51 | 9315 | 9471 | 9458 | −224 | 31 | 148 | C |
| ATOM | 416 | CD2 | TRP | A | 51 | 28.108 | 22.242 | 17.542 | 1.00 | 57.95 | | C |
| ANISOU | 416 | CD2 | TRP | A | 51 | 7197 | 7379 | 7444 | −237 | −53 | 35 | C |
| ATOM | 417 | NE1 | TRP | A | 51 | 27.226 | 22.784 | 15.552 | 1.00 | 73.74 | | N |
| ANISOU | 417 | NE1 | TRP | A | 51 | 9295 | 9369 | 9354 | −205 | −30 | 88 | N |
| ATOM | 418 | CE2 | TRP | A | 51 | 26.902 | 22.471 | 16.844 | 1.00 | 58.03 | | C |
| ANISOU | 418 | CE2 | TRP | A | 51 | 7278 | 7369 | 7403 | −211 | −77 | 19 | C |
| ATOM | 419 | CE3 | TRP | A | 51 | 28.049 | 21.909 | 18.892 | 1.00 | 50.87 | | C |
| ANISOU | 419 | CE3 | TRP | A | 51 | 6266 | 6478 | 6586 | −247 | −94 | −24 | C |
| ATOM | 420 | CZ2 | TRP | A | 51 | 25.662 | 22.371 | 17.452 | 1.00 | 49.10 | | C |
| ANISOU | 420 | CZ2 | TRP | A | 51 | 6177 | 6213 | 6266 | −196 | −138 | −52 | C |
| ATOM | 421 | CZ3 | TRP | A | 51 | 26.817 | 21.812 | 19.488 | 1.00 | 48.19 | | C |
| ANISOU | 421 | CZ3 | TRP | A | 51 | 5963 | 6115 | 6234 | −230 | −149 | −95 | C |
| ATOM | 422 | CH2 | TRP | A | 51 | 25.644 | 22.054 | 18.778 | 1.00 | 43.73 | | C |
| ANISOU | 422 | CH2 | TRP | A | 51 | 5460 | 5529 | 5626 | −206 | −169 | −108 | C |
| ATOM | 423 | N | ILE | A | 52 | 29.946 | 19.210 | 17.941 | 1.00 | 50.17 | | N |
| ANISOU | 423 | N | ILE | A | 52 | 6121 | 6520 | 6423 | −174 | 72 | 20 | N |
| ATOM | 424 | CA | ILE | A | 52 | 29.750 | 18.360 | 19.117 | 1.00 | 44.67 | | C |
| ANISOU | 424 | CA | ILE | A | 52 | 5401 | 5833 | 5739 | −163 | 41 | −45 | C |
| ATOM | 425 | C | ILE | A | 52 | 30.672 | 17.145 | 19.071 | 1.00 | 44.60 | | C |
| ANISOU | 425 | C | ILE | A | 52 | 5353 | 5873 | 5719 | −131 | 105 | −32 | C |
| ATOM | 426 | O | ILE | A | 52 | 30.895 | 16.505 | 20.102 | 1.00 | 44.25 | | O |
| ANISOU | 426 | O | ILE | A | 52 | 5270 | 5841 | 5702 | −128 | 87 | −64 | O |
| ATOM | 427 | CB | ILE | A | 52 | 28.280 | 17.900 | 19.265 | 1.00 | 42.77 | | C |
| ANISOU | 427 | CB | ILE | A | 52 | 5225 | 5576 | 5449 | −133 | −2 | −120 | C |

TABLE 14-continued

| | | | | | | | | | | | | |
|---|---|---|---|---|---|---|---|---|---|---|---|---|
| ATOM | 428 | CG1 | ILE | A | 52 | 27.967 | 17.418 | 20.690 | 1.00 | 39.91 | | C |
| ANISOU | 428 | CG1 | ILE | A | 52 | 4839 | 5210 | 5116 | −136 | −48 | −182 | C |
| ATOM | 429 | CG2 | ILE | A | 52 | 27.997 | 16.744 | 18.346 | 1.00 | 41.25 | | C |
| ANISOU | 429 | CG2 | ILE | A | 52 | 5079 | 5415 | 5181 | −81 | 47 | −134 | C |
| ATOM | 430 | CD1 | ILE | A | 52 | 27.943 | 18.481 | 21.733 | 1.00 | 47.29 | | C |
| ANISOU | 430 | CD1 | ILE | A | 52 | 5748 | 6107 | 6113 | −182 | −110 | −191 | C |
| ATOM | 431 | N | GLU | A | 53 | 31.201 | 16.794 | 17.897 | 1.00 | 46.40 | | N |
| ANISOU | 431 | N | GLU | A | 53 | 5593 | 6130 | 5906 | −102 | 183 | 14 | N |
| ATOM | 432 | CA | GLU | A | 53 | 32.071 | 15.628 | 17.816 | 1.00 | 54.56 | | C |
| ANISOU | 432 | CA | GLU | A | 53 | 6592 | 7207 | 6931 | −64 | 251 | 26 | C |
| ATOM | 433 | C | GLU | A | 53 | 33.280 | 15.777 | 18.728 | 1.00 | 51.59 | | C |
| ANISOU | 433 | C | GLU | A | 53 | 6115 | 6845 | 6641 | −96 | 251 | 64 | C |
| ATOM | 434 | O | GLU | A | 53 | 33.788 | 14.778 | 19.229 | 1.00 | 52.71 | | O |
| ANISOU | 434 | O | GLU | A | 53 | 6218 | 7015 | 6795 | −69 | 273 | 52 | O |
| ATOM | 435 | CB | GLU | A | 53 | 32.520 | 15.395 | 16.374 | 1.00 | 64.62 | | C |
| ANISOU | 435 | CB | GLU | A | 53 | 7897 | 8508 | 8148 | −28 | 341 | 76 | C |
| ATOM | 436 | CG | GLU | A | 53 | 31.586 | 14.525 | 15.537 | 1.00 | 76.80 | | C |
| ANISOU | 436 | CG | GLU | A | 53 | 9535 | 10055 | 9592 | 26 | 359 | 26 | C |
| ATOM | 437 | CD | GLU | A | 53 | 31.673 | 14.842 | 14.049 | 1.00 | 92.04 | | C |
| ANISOU | 437 | CD | GLU | A | 53 | 11522 | 11996 | 11454 | 46 | 419 | 75 | C |
| ATOM | 438 | OE1 | GLU | A | 53 | 32.389 | 15.797 | 13.678 | 1.00 | 98.97 | | O |
| ANISOU | 438 | OE1 | GLU | A | 53 | 12365 | 12875 | 12365 | 17 | 448 | 150 | O |
| ATOM | 439 | OE2 | GLU | A | 53 | 31.014 | 14.144 | 13.248 | 1.00 | 97.76 | | O |
| ANISOU | 439 | OE2 | GLU | A | 53 | 12328 | 12725 | 12090 | 90 | 436 | 38 | O |
| ATOM | 440 | N | GLN | A | 54 | 33.692 | 17.012 | 19.034 | 1.00 | 45.88 | | N |
| ANISOU | 440 | N | GLN | A | 54 | 5349 | 6099 | 5983 | −155 | 215 | 105 | N |
| ATOM | 441 | CA | GLN | A | 54 | 34.893 | 17.203 | 19.844 | 1.00 | 58.62 | | C |
| ANISOU | 441 | CA | GLN | A | 54 | 6864 | 7726 | 7684 | −191 | 208 | 146 | C |
| ATOM | 442 | C | GLN | A | 54 | 34.683 | 16.831 | 21.308 | 1.00 | 55.20 | | C |
| ANISOU | 442 | C | GLN | A | 54 | 6407 | 7288 | 7280 | −202 | 135 | 86 | C |
| ATOM | 443 | O | GLN | A | 54 | 35.664 | 16.732 | 22.054 | 1.00 | 50.61 | | O |
| ANISOU | 443 | O | GLN | A | 54 | 5744 | 6724 | 6761 | −224 | 124 | 113 | O |
| ATOM | 444 | CB | GLN | A | 54 | 35.394 | 18.655 | 19.723 | 1.00 | 57.67 | | C |
| ANISOU | 444 | CB | GLN | A | 54 | 6708 | 7576 | 7628 | −257 | 187 | 207 | C |
| ATOM | 445 | CG | GLN | A | 54 | 34.598 | 19.643 | 20.577 | 1.00 | 76.14 | | C |
| ANISOU | 445 | CG | GLN | A | 54 | 9075 | 9861 | 9995 | −305 | 87 | 161 | C |
| ATOM | 446 | CD | GLN | A | 54 | 34.878 | 21.104 | 20.233 | 1.00 | 87.13 | | C |
| ANISOU | 446 | CD | GLN | A | 54 | 10454 | 11210 | 11439 | −364 | 69 | 217 | C |
| ATOM | 447 | OE1 | GLN | A | 54 | 34.342 | 21.644 | 19.258 | 1.00 | 89.27 | | O |
| ANISOU | 447 | OE1 | GLN | A | 54 | 10783 | 11462 | 11674 | −357 | 90 | 238 | O |
| ATOM | 448 | NE2 | GLN | A | 54 | 35.712 | 21.754 | 21.045 | 1.00 | 89.50 | | N |
| ANISOU | 448 | NE2 | GLN | A | 54 | 10682 | 11495 | 11828 | −424 | 25 | 243 | N |
| ATOM | 449 | N | GLU | A | 55 | 33.450 | 16.604 | 21.744 | 1.00 | 43.87 | | N |
| ANISOU | 449 | N | GLU | A | 55 | 5038 | 5830 | 5802 | −187 | 85 | 10 | N |
| ATOM | 450 | CA | GLU | A | 55 | 33.240 | 16.250 | 23.145 | 1.00 | 44.44 | | C |
| ANISOU | 450 | CA | GLU | A | 55 | 5092 | 5899 | 5895 | −195 | 22 | −43 | C |
| ATOM | 451 | C | GLU | A | 55 | 33.872 | 14.902 | 23.476 | 1.00 | 36.72 | | C |
| ANISOU | 451 | C | GLU | A | 55 | 4073 | 4965 | 4915 | −154 | 61 | −43 | C |
| ATOM | 452 | O | GLU | A | 55 | 33.955 | 14.002 | 22.641 | 1.00 | 44.44 | | O |
| ANISOU | 452 | O | GLU | A | 55 | 5069 | 5967 | 5850 | −104 | 131 | −34 | O |
| ATOM | 453 | CB | GLU | A | 55 | 31.730 | 16.201 | 23.494 | 1.00 | 41.47 | | C |
| ANISOU | 453 | CB | GLU | A | 55 | 4793 | 5492 | 5471 | −181 | −27 | −121 | C |
| ATOM | 454 | CG | GLU | A | 55 | 31.030 | 17.517 | 23.286 | 1.00 | 45.38 | | C |
| ANISOU | 454 | CG | GLU | A | 55 | 5329 | 5940 | 5974 | −217 | −71 | −126 | C |
| ATOM | 455 | CD | GLU | A | 55 | 31.358 | 18.501 | 24.376 | 1.00 | 53.23 | | C |
| ANISOU | 455 | CD | GLU | A | 55 | 6288 | 6904 | 7032 | −273 | −139 | −130 | C |
| ATOM | 456 | OE1 | GLU | A | 55 | 31.813 | 18.057 | 25.453 | 1.00 | 46.05 | | O |
| ANISOU | 456 | OE1 | GLU | A | 55 | 5338 | 6012 | 6146 | −280 | −166 | −148 | O |
| ATOM | 457 | OE2 | GLU | A | 55 | 31.157 | 19.718 | 24.160 | 1.00 | 55.63 | | O |
| ANISOU | 457 | OE2 | GLU | A | 55 | 6609 | 7166 | 7361 | −310 | −168 | −115 | O |
| ATOM | 458 | N | GLY | A | 56 | 34.230 | 14.740 | 24.733 | 1.00 | 41.04 | | N |
| ANISOU | 458 | N | GLY | A | 56 | 4574 | 5517 | 5501 | −172 | 10 | −58 | N |
| ATOM | 459 | CA | GLY | A | 56 | 35.028 | 13.610 | 25.142 | 1.00 | 47.40 | | C |
| ANISOU | 459 | CA | GLY | A | 56 | 5326 | 6363 | 6322 | −140 | 40 | −43 | C |
| ATOM | 460 | C | GLY | A | 56 | 34.218 | 12.407 | 25.563 | 1.00 | 50.15 | | C |
| ANISOU | 460 | C | GLY | A | 56 | 5720 | 6715 | 6618 | −90 | 40 | −104 | C |
| ATOM | 461 | O | GLY | A | 56 | 32.989 | 12.375 | 25.434 | 1.00 | 48.59 | | O |
| ANISOU | 461 | O | GLY | A | 56 | 5598 | 6493 | 6372 | −79 | 23 | −159 | O |
| ATOM | 462 | N | PRO | A | 57 | 34.909 | 11.373 | 26.052 | 1.00 | 50.22 | | N |
| ANISOU | 462 | N | PRO | A | 57 | 5683 | 6756 | 6644 | −60 | 61 | −91 | N |
| ATOM | 463 | CA | PRO | A | 57 | 34.202 | 10.146 | 26.435 | 1.00 | 35.87 | | C |
| ANISOU | 463 | CA | PRO | A | 57 | 3907 | 4939 | 4782 | −12 | 67 | −143 | C |
| ATOM | 464 | C | PRO | A | 57 | 33.238 | 10.326 | 27.579 | 1.00 | 40.44 | | C |
| ANISOU | 464 | C | PRO | A | 57 | 4522 | 5496 | 5348 | −32 | −10 | −203 | C |
| ATOM | 465 | O | PRO | A | 57 | 32.209 | 9.652 | 27.587 | 1.00 | 40.29 | | O |
| ANISOU | 465 | O | PRO | A | 57 | 4562 | 5463 | 5283 | −2 | −6 | −253 | O |
| ATOM | 466 | CB | PRO | A | 57 | 35.328 | 9.184 | 26.822 | 1.00 | 44.94 | | C |
| ANISOU | 466 | CB | PRO | A | 57 | 4985 | 6125 | 5967 | 19 | 98 | −104 | C |
| ATOM | 467 | CG | PRO | A | 57 | 36.576 | 9.728 | 26.076 | 1.00 | 43.13 | | C |
| ANISOU | 467 | CG | PRO | A | 57 | 4684 | 5917 | 5785 | 5 | 145 | −26 | C |

TABLE 14-continued

| | | | | | | | | | | | | | |
|---|---|---|---|---|---|---|---|---|---|---|---|---|---|
| ATOM | 468 | CD | PRO | A | 57 | 36.385 | 11.208 | 26.072 | 1.00 | 46.94 | | | C |
| ANISOU | 468 | CD | PRO | A | 57 | 5172 | 6376 | 6288 | −61 | 93 | −21 | | C |
| ATOM | 469 | N | GLU | A | 58 | 33.518 | 11.186 | 28.552 | 1.00 | 35.27 | | | N |
| ANISOU | 469 | N | GLU | A | 58 | 3836 | 4835 | 4731 | −81 | −78 | −200 | | N |
| ATOM | 470 | CA | GLU | A | 58 | 32.552 | 11.323 | 29.631 | 1.00 | 35.61 | | | C |
| ANISOU | 470 | CA | GLU | A | 58 | 3922 | 4857 | 4752 | −92 | −142 | −260 | | C |
| ATOM | 471 | C | GLU | A | 58 | 31.283 | 12.003 | 29.145 | 1.00 | 41.10 | | | C |
| ANISOU | 471 | C | GLU | A | 58 | 4689 | 5514 | 5413 | −100 | −152 | −303 | | C |
| ATOM | 472 | O | GLU | A | 58 | 30.214 | 11.723 | 29.675 | 1.00 | 35.62 | | | O |
| ANISOU | 472 | O | GLU | A | 58 | 4043 | 4804 | 4686 | −87 | −174 | −355 | | O |
| ATOM | 473 | CB | GLU | A | 58 | 33.122 | 12.080 | 30.825 | 1.00 | 46.67 | | | C |
| ANISOU | 473 | CB | GLU | A | 58 | 5283 | 6257 | 6192 | −141 | −216 | −255 | | C |
| ATOM | 474 | CG | GLU | A | 58 | 34.254 | 11.288 | 31.500 | 1.00 | 56.56 | | | C |
| ANISOU | 474 | CG | GLU | A | 58 | 6464 | 7549 | 7475 | −129 | −219 | −217 | | C |
| ATOM | 475 | CD | GLU | A | 58 | 34.988 | 12.097 | 32.536 | 0.00 | 54.57 | | | C |
| ANISOU | 475 | CD | GLU | A | 58 | 6167 | 7300 | 7266 | −183 | −298 | −204 | | C |
| ATOM | 476 | OE1 | GLU | A | 58 | 34.409 | 13.085 | 33.025 | 1.00 | 54.64 | | | O |
| ANISOU | 476 | OE1 | GLU | A | 58 | 6217 | 7277 | 7268 | −222 | −355 | −242 | | O |
| ATOM | 477 | OE2 | GLU | A | 58 | 36.147 | 11.755 | 32.851 | 0.00 | 53.79 | | | O |
| ANISOU | 477 | OE2 | GLU | A | 58 | 5993 | 7235 | 7211 | −186 | −305 | −154 | | O |
| ATOM | 478 | N | TYR | A | 59 | 31.388 | 12.916 | 28.183 | 1.00 | 37.03 | | | N |
| ANISOU | 478 | N | TYR | A | 59 | 4179 | 4984 | 4908 | −123 | −138 | −276 | | N |
| ATOM | 479 | CA | TYR | A | 59 | 30.174 | 13.466 | 27.590 | 1.00 | 40.37 | | | C |
| ANISOU | 479 | CA | TYR | A | 59 | 4670 | 5372 | 5298 | −123 | −145 | −310 | | C |
| ATOM | 480 | C | TYR | A | 59 | 29.333 | 12.370 | 26.952 | 1.00 | 42.16 | | | C |
| ANISOU | 480 | C | TYR | A | 59 | 4945 | 5604 | 5472 | −72 | −103 | −339 | | C |
| ATOM | 481 | O | TYR | A | 59 | 28.135 | 12.249 | 27.230 | 1.00 | 42.00 | | | O |
| ANISOU | 481 | O | TYR | A | 59 | 4972 | 5562 | 5425 | −61 | −127 | −390 | | O |
| ATOM | 482 | CB | TYR | A | 59 | 30.534 | 14.507 | 26.558 | 1.00 | 37.23 | | | C |
| ANISOU | 482 | CB | TYR | A | 59 | 4268 | 4960 | 4917 | −150 | −129 | −266 | | C |
| ATOM | 483 | CG | TYR | A | 59 | 29.327 | 15.155 | 25.919 | 1.00 | 33.81 | | | C |
| ANISOU | 483 | CG | TYR | A | 59 | 3902 | 4491 | 4453 | −150 | −141 | −293 | | C |
| ATOM | 484 | CD1 | TYR | A | 59 | 28.676 | 16.200 | 26.553 | 1.00 | 44.11 | | | C |
| ANISOU | 484 | CD1 | TYR | A | 59 | 5229 | 5756 | 5775 | −181 | −202 | −323 | | C |
| ATOM | 485 | CD2 | TYR | A | 59 | 28.873 | 14.758 | 24.687 | 1.00 | 34.89 | | | C |
| ANISOU | 485 | CD2 | TYR | A | 59 | 4079 | 4632 | 4545 | −117 | −95 | −288 | | C |
| ATOM | 486 | CE1 | TYR | A | 59 | 27.561 | 16.830 | 25.973 | 1.00 | 43.67 | | | C |
| ANISOU | 486 | CE1 | TYR | A | 59 | 5230 | 5666 | 5698 | −178 | −215 | −344 | | C |
| ATOM | 487 | CE2 | TYR | A | 59 | 27.728 | 15.369 | 24.088 | 1.00 | 42.17 | | | C |
| ANISOU | 487 | CE2 | TYR | A | 59 | 5061 | 5522 | 5440 | −116 | −114 | −310 | | C |
| ATOM | 488 | CZ | TYR | A | 59 | 27.088 | 16.400 | 24.754 | 1.00 | 42.01 | | | C |
| ANISOU | 488 | CZ | TYR | A | 59 | 5055 | 5463 | 5444 | −146 | −174 | −336 | | C |
| ATOM | 489 | OH | TYR | A | 59 | 26.019 | 17.044 | 24.210 | 1.00 | 39.35 | | | O |
| ANISOU | 489 | OH | TYR | A | 59 | 4768 | 5093 | 5090 | −144 | −194 | −351 | | O |
| ATOM | 490 | N | TRP | A | 60 | 29.944 | 11.561 | 26.085 | 1.00 | 37.66 | | | N |
| ANISOU | 490 | N | TRP | A | 60 | 4361 | 5058 | 4888 | −39 | −39 | −308 | | N |
| ATOM | 491 | CA | TRP | A | 60 | 29.148 | 10.614 | 25.331 | 1.00 | 39.76 | | | C |
| ANISOU | 491 | CA | TRP | A | 60 | 4682 | 5322 | 5102 | 5 | −2 | −338 | | C |
| ATOM | 492 | C | TRP | A | 60 | 28.636 | 9.497 | 26.222 | 1.00 | 43.52 | | | C |
| ANISOU | 492 | C | TRP | A | 60 | 5168 | 5800 | 5567 | 31 | −13 | −381 | | C |
| ATOM | 493 | O | TRP | A | 60 | 27.505 | 9.044 | 26.045 | 1.00 | 43.89 | | | O |
| ANISOU | 493 | O | TRP | A | 60 | 5267 | 5829 | 5581 | 49 | −19 | −424 | | O |
| ATOM | 494 | CB | TRP | A | 60 | 29.930 | 10.084 | 24.145 | 1.00 | 33.01 | | | C |
| ANISOU | 494 | CB | TRP | A | 60 | 3822 | 4489 | 4230 | 36 | 72 | −297 | | C |
| ATOM | 495 | CG | TRP | A | 60 | 30.187 | 11.181 | 23.196 | 1.00 | 41.06 | | | C |
| ANISOU | 495 | CG | TRP | A | 60 | 4847 | 5505 | 5251 | 12 | 85 | −257 | | C |
| ATOM | 496 | CD1 | TRP | A | 60 | 31.382 | 11.808 | 22.955 | 1.00 | 47.85 | | | C |
| ANISOU | 496 | CD1 | TRP | A | 60 | 5649 | 6380 | 6150 | −10 | 110 | −193 | | C |
| ATOM | 497 | CD2 | TRP | A | 60 | 29.215 | 11.840 | 22.373 | 1.00 | 42.95 | | | C |
| ANISOU | 497 | CD2 | TRP | A | 60 | 5149 | 5718 | 5453 | 5 | 71 | −273 | | C |
| ATOM | 498 | NE1 | TRP | A | 60 | 31.205 | 12.801 | 22.016 | 1.00 | 43.45 | | | N |
| ANISOU | 498 | NE1 | TRP | A | 60 | 5120 | 5808 | 5581 | −30 | 117 | −167 | | N |
| ATOM | 499 | CE2 | TRP | A | 60 | 29.880 | 12.843 | 21.657 | 1.00 | 43.19 | | | C |
| ANISOU | 499 | CE2 | TRP | A | 60 | 5162 | 5750 | 5499 | −20 | 90 | −215 | | C |
| ATOM | 500 | CE3 | TRP | A | 60 | 27.844 | 11.682 | 22.186 | 1.00 | 40.47 | | | C |
| ANISOU | 500 | CE3 | TRP | A | 60 | 4900 | 5380 | 5098 | 17 | 40 | −326 | | C |
| ATOM | 501 | CZ2 | TRP | A | 60 | 29.221 | 13.685 | 20.763 | 1.00 | 39.75 | | | C |
| ANISOU | 501 | CZ2 | TRP | A | 60 | 4778 | 5292 | 5034 | −31 | 81 | −209 | | C |
| ATOM | 502 | CZ3 | TRP | A | 60 | 27.183 | 12.523 | 21.278 | 1.00 | 37.37 | | | C |
| ANISOU | 502 | CZ3 | TRP | A | 60 | 4554 | 4967 | 4678 | 6 | 27 | −320 | | C |
| ATOM | 503 | CH2 | TRP | A | 60 | 27.870 | 13.503 | 20.587 | 1.00 | 39.93 | | | C |
| ANISOU | 503 | CH2 | TRP | A | 60 | 4865 | 5292 | 5014 | −16 | 47 | −262 | | C |
| ATOM | 504 | N | ASP | A | 61 | 29.444 | 9.055 | 27.188 | 1.00 | 39.24 | | | N |
| ANISOU | 504 | N | ASP | A | 61 | 4574 | 5279 | 5056 | 33 | −19 | −365 | | N |
| ATOM | 505 | CA | ASP | A | 61 | 28.967 | 8.104 | 28.179 | 1.00 | 38.32 | | | C |
| ANISOU | 505 | CA | ASP | A | 61 | 4465 | 5162 | 4931 | 53 | −34 | −399 | | C |
| ATOM | 506 | C | ASP | A | 61 | 27.815 | 8.706 | 28.998 | 1.00 | 39.75 | | | C |
| ANISOU | 506 | C | ASP | A | 61 | 4680 | 5318 | 5105 | 30 | −92 | −446 | | C |
| ATOM | 507 | O | ASP | A | 61 | 26.793 | 8.051 | 29.203 | 1.00 | 35.32 | | | O |
| ANISOU | 507 | O | ASP | A | 61 | 4156 | 4743 | 4520 | 50 | −93 | −486 | | O |

TABLE 14-continued

| | | | | | | | | | | | | |
|---|---|---|---|---|---|---|---|---|---|---|---|---|
| ATOM | 508 | CB | ASP | A | 61 | 30.114 | 7.681 | 29.100 | 1.00 | 44.20 | | C |
| ANISOU | 508 | CB | ASP | A | 61 | 5147 | 5936 | 5712 | 56 | −38 | −366 | C |
| ATOM | 509 | CG | ASP | A | 61 | 31.002 | 6.565 | 28.507 | 1.00 | 60.76 | | C |
| ANISOU | 509 | CG | ASP | A | 61 | 7217 | 8056 | 7814 | 100 | 28 | −331 | C |
| ATOM | 510 | OD1 | ASP | A | 61 | 30.722 | 6.031 | 27.397 | 1.00 | 57.48 | | O |
| ANISOU | 510 | OD1 | ASP | A | 61 | 6839 | 7633 | 7368 | 132 | 81 | −339 | O |
| ATOM | 511 | OD2 | ASP | A | 61 | 31.997 | 6.212 | 29.187 | 1.00 | 68.05 | | O |
| ANISOU | 511 | OD2 | ASP | A | 61 | 8080 | 9004 | 8771 | 106 | 26 | −296 | O |
| ATOM | 512 | N | GLY | A | 62 | 27.962 | 9.959 | 29.442 | 1.00 | 32.26 | | N |
| ANISOU | 512 | N | GLY | A | 62 | 3718 | 4360 | 4178 | −12 | −137 | −441 | N |
| ATOM | 513 | CA | GLY | A | 62 | 26.954 | 10.559 | 30.303 | 1.00 | 36.90 | | C |
| ANISOU | 513 | CA | GLY | A | 62 | 4337 | 4923 | 4760 | −29 | −187 | −485 | C |
| ATOM | 514 | C | GLY | A | 62 | 25.632 | 10.802 | 29.575 | 1.00 | 36.12 | | C |
| ANISOU | 514 | C | GLY | A | 62 | 4292 | 4795 | 4638 | −21 | −185 | −518 | C |
| ATOM | 515 | O | GLY | A | 62 | 24.573 | 10.496 | 30.100 | 1.00 | 34.38 | | O |
| ANISOU | 515 | O | GLY | A | 62 | 4099 | 4561 | 4402 | −9 | −198 | −558 | O |
| ATOM | 516 | N | GLU | A | 63 | 25.689 | 11.391 | 28.376 | 1.00 | 37.78 | | N |
| ANISOU | 516 | N | GLU | A | 63 | 4514 | 4996 | 4845 | −28 | −169 | −497 | N |
| ATOM | 517 | CA | GLU | A | 63 | 24.486 | 11.610 | 27.590 | 1.00 | 38.84 | | C |
| ANISOU | 517 | CA | GLU | A | 63 | 4697 | 5105 | 4955 | −19 | −172 | −522 | C |
| ATOM | 518 | C | GLU | A | 63 | 23.807 | 10.299 | 27.260 | 1.00 | 39.86 | | C |
| ANISOU | 518 | C | GLU | A | 63 | 4852 | 5239 | 5055 | 17 | −146 | −548 | C |
| ATOM | 519 | O | GLU | A | 63 | 22.579 | 10.212 | 27.263 | 1.00 | 35.44 | | O |
| ANISOU | 519 | O | GLU | A | 63 | 4324 | 4658 | 4484 | 25 | −164 | −583 | O |
| ATOM | 520 | CB | GLU | A | 63 | 24.817 | 12.361 | 26.310 | 1.00 | 34.02 | | C |
| ANISOU | 520 | CB | GLU | A | 63 | 4097 | 4490 | 4341 | −30 | −157 | −487 | C |
| ATOM | 521 | CG | GLU | A | 63 | 25.396 | 13.751 | 26.581 | 1.00 | 35.47 | | C |
| ANISOU | 521 | CG | GLU | A | 63 | 4257 | 4659 | 4562 | −72 | −187 | −461 | C |
| ATOM | 522 | CD | GLU | A | 63 | 24.505 | 14.601 | 27.408 | 1.00 | 40.49 | | C |
| ANISOU | 522 | CD | GLU | A | 63 | 4912 | 5261 | 5212 | −89 | −239 | −498 | C |
| ATOM | 523 | OE1 | GLU | A | 63 | 24.884 | 14.938 | 28.554 | 1.00 | 37.18 | | O |
| ANISOU | 523 | OE1 | GLU | A | 63 | 4470 | 4838 | 4816 | −110 | −269 | −508 | O |
| ATOM | 524 | OE2 | GLU | A | 63 | 23.395 | 14.950 | 26.917 | 1.00 | 41.73 | | O |
| ANISOU | 524 | OE2 | GLU | A | 63 | 5108 | 5392 | 5355 | −80 | −251 | −519 | O |
| ATOM | 525 | N | THR | A | 64 | 24.590 | 9.268 | 26.972 | 1.00 | 36.77 | | N |
| ANISOU | 525 | N | THR | A | 64 | 4446 | 4871 | 4655 | 41 | −103 | −529 | N |
| ATOM | 526 | CA | THR | A | 64 | 24.017 | 7.953 | 26.710 | 1.00 | 34.03 | | C |
| ANISOU | 526 | CA | THR | A | 64 | 4125 | 4521 | 4283 | 74 | −79 | −555 | C |
| ATOM | 527 | C | THR | A | 64 | 23.306 | 7.424 | 27.930 | 1.00 | 42.10 | | C |
| ANISOU | 527 | C | THR | A | 64 | 5145 | 5536 | 5316 | 78 | −101 | −587 | C |
| ATOM | 528 | O | THR | A | 64 | 22.125 | 7.024 | 27.849 | 1.00 | 33.92 | | O |
| ANISOU | 528 | O | THR | A | 64 | 4140 | 4480 | 4269 | 87 | −111 | −621 | O |
| ATOM | 529 | CB | THR | A | 64 | 25.096 | 6.981 | 26.253 | 1.00 | 35.90 | | C |
| ANISOU | 529 | CB | THR | A | 64 | 4346 | 4782 | 4514 | 102 | −25 | −527 | C |
| ATOM | 530 | OG1 | THR | A | 64 | 25.613 | 7.443 | 25.009 | 1.00 | 36.64 | | O |
| ANISOU | 530 | OG1 | THR | A | 64 | 4450 | 4881 | 4590 | 103 | 4 | −498 | O |
| ATOM | 531 | CG2 | THR | A | 64 | 24.525 | 5.571 | 26.083 | 1.00 | 38.79 | | C |
| ANISOU | 531 | CG2 | THR | A | 64 | 4744 | 5137 | 4859 | 136 | −2 | −557 | C |
| ATOM | 532 | N | ARG | A | 65 | 24.005 | 7.391 | 29.074 | 1.00 | 37.85 | | N |
| ANISOU | 532 | N | ARG | A | 65 | 4569 | 5014 | 4797 | 72 | −109 | −574 | N |
| ATOM | 533 | CA | ARG | A | 65 | 23.362 | 6.932 | 30.309 | 1.00 | 36.86 | | C |
| ANISOU | 533 | CA | ARG | A | 65 | 4445 | 4884 | 4675 | 77 | −127 | −600 | C |
| ATOM | 534 | C | ARG | A | 65 | 22.087 | 7.734 | 30.601 | 1.00 | 38.29 | | C |
| ANISOU | 534 | C | ARG | A | 65 | 4652 | 5040 | 4856 | 62 | −161 | −634 | C |
| ATOM | 535 | O | ARG | A | 65 | 21.034 | 7.164 | 30.920 | 1.00 | 33.23 | | O |
| ANISOU | 535 | O | ARG | A | 65 | 4029 | 4386 | 4212 | 74 | −161 | −662 | O |
| ATOM | 536 | CB | ARG | A | 65 | 24.347 | 7.045 | 31.476 | 1.00 | 41.22 | | C |
| ANISOU | 536 | CB | ARG | A | 65 | 4958 | 5460 | 5243 | 67 | −143 | −579 | C |
| ATOM | 537 | CG | ARG | A | 65 | 23.738 | 7.083 | 32.875 | 1.00 | 51.27 | | C |
| ANISOU | 537 | CG | ARG | A | 65 | 6237 | 6729 | 6512 | 63 | −172 | −603 | C |
| ATOM | 538 | CD | ARG | A | 65 | 24.824 | 7.368 | 33.989 | 1.00 | 62.42 | | C |
| ANISOU | 538 | CD | ARG | A | 65 | 7617 | 8168 | 7934 | 49 | −199 | −581 | C |
| ATOM | 539 | NE | ARG | A | 65 | 25.412 | 8.701 | 33.810 | 1.00 | 55.96 | | N |
| ANISOU | 539 | NE | ARG | A | 65 | 6783 | 7346 | 7132 | 13 | −231 | −570 | N |
| ATOM | 540 | CZ | ARG | A | 65 | 24.836 | 9.818 | 34.253 | 1.00 | 67.20 | | C |
| ANISOU | 540 | CZ | ARG | A | 65 | 8230 | 8748 | 8554 | −11 | −268 | −597 | C |
| ATOM | 541 | NH1 | ARG | A | 65 | 23.672 | 9.766 | 34.929 | 1.00 | 63.31 | | N |
| ANISOU | 541 | NH1 | ARG | A | 65 | 7772 | 8240 | 8044 | 1 | −274 | −636 | N |
| ATOM | 542 | NH2 | ARG | A | 65 | 25.411 | 10.987 | 34.025 | 1.00 | 63.00 | | N |
| ANISOU | 542 | NH2 | ARG | A | 65 | 7687 | 8208 | 8043 | −45 | −296 | −585 | N |
| ATOM | 543 | N | LYS | A | 66 | 22.159 | 9.054 | 30.502 | 1.00 | 27.64 | | N |
| ANISOU | 543 | N | LYS | A | 66 | 3303 | 3682 | 3516 | 36 | −189 | −631 | N |
| ATOM | 544 | CA | LYS | A | 66 | 21.017 | 9.936 | 30.841 | 1.00 | 35.19 | | C |
| ANISOU | 544 | CA | LYS | A | 66 | 4281 | 4612 | 4478 | 26 | −220 | −661 | C |
| ATOM | 545 | C | LYS | A | 66 | 19.858 | 9.729 | 29.866 | 1.00 | 39.93 | | C |
| ANISOU | 545 | C | LYS | A | 66 | 4909 | 5191 | 5070 | 38 | −216 | −679 | C |
| ATOM | 546 | O | LYS | A | 66 | 18.752 | 9.657 | 30.326 | 1.00 | 32.61 | | O |
| ANISOU | 546 | O | LYS | A | 66 | 3992 | 4249 | 4148 | 45 | −226 | −706 | O |
| ATOM | 547 | CB | LYS | A | 66 | 21.437 | 11.401 | 30.890 | 1.00 | 35.01 | | C |
| ANISOU | 547 | CB | LYS | A | 66 | 4255 | 4577 | 4471 | −4 | −251 | −652 | C |

TABLE 14-continued

| | | | | | | | | | | | | |
|---|---|---|---|---|---|---|---|---|---|---|---|---|
| ATOM | 548 | CG | LYS | A | 66 | 22.371 | 11.786 | 32.018 | 1.00 | 38.18 | | C |
| ANISOU | 548 | CG | LYS | A | 66 | 4633 | 4991 | 4883 | −23 | −272 | −644 | C |
| ATOM | 549 | CD | LYS | A | 66 | 22.750 | 13.251 | 32.039 | 1.00 | 40.95 | | C |
| ANISOU | 549 | CD | LYS | A | 66 | 4984 | 5321 | 5255 | −58 | −307 | −637 | C |
| ATOM | 550 | CE | LYS | A | 66 | 23.453 | 13.750 | 30.802 | 1.00 | 48.30 | | C |
| ANISOU | 550 | CE | LYS | A | 66 | 5903 | 6251 | 6200 | −74 | −296 | −597 | C |
| ATOM | 551 | NZ | LYS | A | 66 | 23.674 | 15.213 | 30.800 | 1.00 | 44.10 | | N |
| ANISOU | 551 | NZ | LYS | A | 66 | 5374 | 5689 | 5694 | −110 | −331 | −590 | N |
| ATOM | 552 | N | VAL | A | 67 | 20.157 | 9.632 | 28.572 | 1.00 | 33.75 | | N |
| ANISOU | 552 | N | VAL | A | 67 | 4138 | 4411 | 4274 | 41 | −201 | −661 | N |
| ATOM | 553 | C | VAL | A | 67 | 18.418 | 8.076 | 27.777 | 1.00 | 36.61 | | C |
| ANISOU | 553 | C | VAL | A | 67 | 4538 | 4754 | 4620 | 70 | −193 | −701 | C |
| ATOM | 554 | O | VAL | A | 67 | 17.198 | 7.910 | 27.578 | 1.00 | 33.41 | | O |
| ANISOU | 554 | O | VAL | A | 67 | 4146 | 4330 | 4220 | 74 | −210 | −724 | O |
| ATOM | 555 | CA | AVAL | A | 67 | 19.054 | 9.460 | 27.625 | 0.72 | 37.29 | | C |
| ANISOU | 555 | CA | AVAL | A | 67 | 4617 | 4841 | 4711 | 50 | −208 | −678 | C |
| ATOM | 556 | CB | AVAL | A | 67 | 19.515 | 9.733 | 26.180 | 0.72 | 36.94 | | C |
| ANISOU | 556 | CB | AVAL | A | 67 | 4592 | 4800 | 4643 | 50 | −197 | −653 | C |
| ATOM | 557 | CG1 | AVAL | A | 67 | 20.377 | 8.593 | 25.615 | 0.72 | 38.56 | | C |
| ANISOU | 557 | CG1 | AVAL | A | 67 | 4800 | 5026 | 4824 | 69 | −154 | −639 | C |
| ATOM | 558 | CG2 | AVAL | A | 67 | 18.289 | 9.971 | 25.263 | 0.72 | 32.51 | | C |
| ANISOU | 558 | CG2 | AVAL | A | 67 | 4065 | 4217 | 4070 | 53 | −224 | −669 | C |
| ATOM | 559 | CA | BVAL | A | 67 | 19.039 | 9.455 | 27.641 | 0.28 | 36.49 | | C |
| ANISOU | 559 | CA | BVAL | A | 67 | 4515 | 4739 | 4609 | 50 | −208 | −678 | C |
| ATOM | 560 | CB | BVAL | A | 67 | 19.452 | 9.726 | 26.189 | 0.28 | 36.37 | | C |
| ANISOU | 560 | CB | BVAL | A | 67 | 4521 | 4727 | 4572 | 50 | −199 | −654 | C |
| ATOM | 561 | CG1 | BVAL | A | 67 | 20.002 | 11.079 | 26.100 | 0.28 | 34.43 | | C |
| ANISOU | 561 | CG1 | BVAL | A | 67 | 4266 | 4477 | 4338 | 27 | −213 | −628 | C |
| ATOM | 562 | CG2 | BVAL | A | 67 | 20.431 | 8.673 | 25.656 | 0.28 | 37.41 | | C |
| ANISOU | 562 | CG2 | BVAL | A | 67 | 4652 | 4881 | 4681 | 67 | −154 | −637 | C |
| ATOM | 563 | N | LYS | A | 68 | 19.203 | 7.071 | 28.156 | 1.00 | 31.14 | | N |
| ANISOU | 563 | N | LYS | A | 68 | 3831 | 4078 | 3922 | 83 | −162 | −692 | N |
| ATOM | 564 | CA | LYS | A | 68 | 18.603 | 5.783 | 28.451 | 1.00 | 35.06 | | C |
| ANISOU | 564 | CA | LYS | A | 68 | 4334 | 4567 | 4421 | 100 | −149 | −711 | C |
| ATOM | 565 | C | LYS | A | 68 | 17.745 | 5.835 | 29.699 | 1.00 | 36.75 | | C |
| ANISOU | 565 | C | LYS | A | 68 | 4534 | 4773 | 4656 | 96 | −163 | −729 | C |
| ATOM | 566 | O | LYS | A | 68 | 16.803 | 5.052 | 29.819 | 1.00 | 35.37 | | O |
| ANISOU | 566 | O | LYS | A | 68 | 4364 | 4582 | 4491 | 103 | −161 | −747 | O |
| ATOM | 567 | CB | LYS | A | 68 | 19.670 | 4.697 | 28.607 | 1.00 | 30.13 | | C |
| ANISOU | 567 | CB | LYS | A | 68 | 3698 | 3959 | 3790 | 119 | −111 | −694 | C |
| ATOM | 568 | CG | LYS | A | 68 | 20.174 | 4.203 | 27.251 | 1.00 | 35.33 | | C |
| ANISOU | 568 | CG | LYS | A | 68 | 4382 | 4618 | 4424 | 133 | −85 | −687 | C |
| ATOM | 569 | CD | LYS | A | 68 | 21.284 | 3.128 | 27.484 | 1.00 | 41.81 | | C |
| ANISOU | 569 | CD | LYS | A | 68 | 5187 | 5453 | 5245 | 158 | −42 | −667 | C |
| ATOM | 570 | CE | LYS | A | 68 | 21.961 | 2.700 | 26.198 | 1.00 | 47.37 | | C |
| ANISOU | 570 | CE | LYS | A | 68 | 5915 | 6160 | 5922 | 179 | −5 | −658 | C |
| ATOM | 571 | NZ | LYS | A | 68 | 23.063 | 1.711 | 26.510 | 1.00 | 53.15 | | N |
| ANISOU | 571 | NZ | LYS | A | 68 | 6626 | 6906 | 6664 | 209 | 39 | −635 | N |
| ATOM | 572 | N | ALA | A | 69 | 18.090 | 6.675 | 30.669 | 1.00 | 32.72 | | N |
| ANISOU | 572 | N | ALA | A | 69 | 4006 | 4272 | 4153 | 86 | −175 | −723 | N |
| ATOM | 573 | CA | ALA | A | 69 | 17.221 | 6.796 | 31.821 | 1.00 | 38.37 | | C |
| ANISOU | 573 | CA | ALA | A | 69 | 4717 | 4981 | 4882 | 88 | −183 | −742 | C |
| ATOM | 574 | C | ALA | A | 69 | 15.900 | 7.440 | 31.412 | 1.00 | 34.97 | | C |
| ANISOU | 574 | C | ALA | A | 69 | 4295 | 4524 | 4466 | 84 | −204 | −762 | C |
| ATOM | 575 | O | ALA | A | 69 | 14.859 | 6.970 | 31.839 | 1.00 | 33.07 | | O |
| ANISOU | 575 | O | ALA | A | 69 | 4052 | 4273 | 4242 | 92 | −199 | −777 | O |
| ATOM | 576 | CB | ALA | A | 69 | 17.890 | 7.582 | 32.951 | 1.00 | 35.44 | | C |
| ANISOU | 576 | CB | ALA | A | 69 | 4335 | 4624 | 4508 | 78 | −195 | −736 | C |
| ATOM | 577 | N | HIS | A | 70 | 15.940 | 8.481 | 30.565 | 1.00 | 29.81 | | N |
| ANISOU | 577 | N | HIS | A | 70 | 3653 | 3862 | 3812 | 73 | −226 | −758 | N |
| ATOM | 578 | CA | HIS | A | 70 | 14.727 | 9.063 | 29.986 | 1.00 | 37.12 | | C |
| ANISOU | 578 | CA | HIS | A | 70 | 4586 | 4764 | 4754 | 72 | −250 | −772 | C |
| ATOM | 579 | C | HIS | A | 70 | 13.878 | 8.007 | 29.289 | 1.00 | 35.68 | | C |
| ANISOU | 579 | C | HIS | A | 70 | 4409 | 4572 | 4575 | 79 | −249 | −782 | C |
| ATOM | 580 | O | HIS | A | 70 | 12.658 | 7.995 | 29.426 | 1.00 | 36.19 | | O |
| ANISOU | 580 | O | HIS | A | 70 | 4464 | 4620 | 4665 | 83 | −262 | −796 | O |
| ATOM | 581 | CB | HIS | A | 70 | 15.074 | 10.157 | 28.971 | 1.00 | 30.49 | | C |
| ANISOU | 581 | CB | HIS | A | 70 | 3762 | 3917 | 3908 | 61 | −272 | −757 | C |
| ATOM | 582 | CG | HIS | A | 70 | 15.491 | 11.465 | 29.562 | 1.00 | 36.84 | | C |
| ANISOU | 582 | CG | HIS | A | 70 | 4563 | 4714 | 4722 | 49 | −286 | −753 | C |
| ATOM | 583 | ND1 | HIS | A | 70 | 16.189 | 11.575 | 30.744 | 1.00 | 45.24 | | N |
| ANISOU | 583 | ND1 | HIS | A | 70 | 5615 | 5788 | 5784 | 44 | −278 | −755 | N |
| ATOM | 584 | CD2 | HIS | A | 70 | 15.349 | 12.726 | 29.092 | 1.00 | 41.84 | | C |
| ANISOU | 584 | CD2 | HIS | A | 70 | 5206 | 5326 | 5365 | 39 | −311 | −745 | C |
| ATOM | 585 | CE1 | HIS | A | 70 | 16.406 | 12.851 | 31.006 | 1.00 | 45.57 | | C |
| ANISOU | 585 | CE1 | HIS | A | 70 | 5662 | 5814 | 5837 | 30 | −300 | −755 | C |
| ATOM | 586 | NE2 | HIS | A | 70 | 15.914 | 13.570 | 30.013 | 1.00 | 43.71 | | N |
| ANISOU | 586 | NE2 | HIS | A | 70 | 5440 | 5558 | 5612 | 28 | −317 | −748 | N |
| ATOM | 587 | N | SER | A | 71 | 14.506 | 7.148 | 28.480 | 1.00 | 33.67 | | N |
| ANISOU | 587 | N | SER | A | 71 | 4170 | 4326 | 4298 | 82 | −236 | −774 | N |

TABLE 14-continued

| | | | | | | | | | | | | |
|---|---|---|---|---|---|---|---|---|---|---|---|---|
| ATOM | 588 | C | SER | A | 71 | 13.040 | 5.176 | 28.692 | 1.00 | 36.81 | | C |
| ANISOU | 588 | C | SER | A | 71 | 4560 | 4701 | 4724 | 90 | −227 | −801 | C |
| ATOM | 589 | O | SER | A | 71 | 11.901 | 4.763 | 28.440 | 1.00 | 30.81 | | O |
| ANISOU | 589 | O | SER | A | 71 | 3796 | 3921 | 3988 | 86 | −245 | −815 | O |
| ATOM | 590 | CA | ASER | A | 71 | 13.753 | 6.131 | 27.745 | 0.53 | 38.33 | | C |
| ANISOU | 590 | CA | ASER | A | 71 | 4773 | 4902 | 4889 | 85 | −241 | −789 | C |
| ATOM | 591 | CB | ASER | A | 71 | 14.706 | 5.371 | 26.802 | 0.53 | 37.91 | | C |
| ANISOU | 591 | CB | ASER | A | 71 | 4747 | 4858 | 4800 | 92 | −222 | −781 | C |
| ATOM | 592 | OG | ASER | A | 71 | 14.143 | 4.156 | 26.343 | 0.53 | 35.61 | | O |
| ANISOU | 592 | OG | ASER | A | 71 | 4472 | 4549 | 4509 | 96 | −222 | −800 | O |
| ATOM | 593 | CA | BSER | A | 71 | 13.739 | 6.141 | 27.747 | 0.47 | 38.29 | | C |
| ANISOU | 593 | CA | BSER | A | 71 | 4768 | 4896 | 4884 | 85 | −242 | −789 | C |
| ATOM | 594 | CB | BSER | A | 71 | 14.662 | 5.378 | 26.786 | 0.47 | 38.25 | | C |
| ANISOU | 594 | CB | BSER | A | 71 | 4791 | 4900 | 4844 | 92 | −223 | −782 | C |
| ATOM | 595 | OG | BSER | A | 71 | 15.363 | 4.366 | 27.479 | 0.47 | 40.12 | | O |
| ANISOU | 595 | OG | BSER | A | 71 | 5017 | 5146 | 5081 | 103 | −187 | −778 | O |
| ATOM | 596 | N | GLN | A | 72 | 13.691 | 4.812 | 29.801 | 1.00 | 36.52 | | N |
| ANISOU | 596 | N | GLN | A | 72 | 4510 | 4680 | 4688 | 97 | −197 | −792 | N |
| ATOM | 597 | CA | GLN | A | 72 | 13.043 | 3.920 | 30.769 | 1.00 | 31.70 | | C |
| ANISOU | 597 | CA | GLN | A | 72 | 3882 | 4061 | 4101 | 102 | −178 | −797 | C |
| ATOM | 598 | C | GLN | A | 72 | 11.913 | 4.606 | 31.488 | 1.00 | 35.15 | | C |
| ANISOU | 598 | C | GLN | A | 72 | 4298 | 4491 | 4567 | 101 | −187 | −805 | C |
| ATOM | 599 | O | GLN | A | 72 | 10.916 | 3.972 | 31.853 | 1.00 | 35.67 | | O |
| ANISOU | 599 | O | GLN | A | 72 | 4346 | 4542 | 4663 | 101 | −179 | −809 | O |
| ATOM | 600 | CB | GLN | A | 72 | 14.067 | 3.456 | 31.804 | 1.00 | 31.49 | | C |
| ANISOU | 600 | CB | GLN | A | 72 | 3848 | 4056 | 4060 | 112 | −147 | −780 | C |
| ATOM | 601 | CG | GLN | A | 72 | 15.116 | 2.567 | 31.215 | 1.00 | 31.40 | | C |
| ANISOU | 601 | CG | GLN | A | 72 | 3850 | 4050 | 4030 | 121 | −129 | −769 | C |
| ATOM | 602 | CD | GLN | A | 72 | 16.218 | 2.331 | 32.217 | 1.00 | 33.42 | | C |
| ANISOU | 602 | CD | GLN | A | 72 | 4094 | 4331 | 4275 | 131 | −107 | −747 | C |
| ATOM | 603 | OE1 | GLN | A | 72 | 16.079 | 1.502 | 33.112 | 1.00 | 31.47 | | O |
| ANISOU | 603 | OE1 | GLN | A | 72 | 3838 | 4082 | 4037 | 141 | −88 | −740 | O |
| ATOM | 604 | NE2 | GLN | A | 72 | 17.293 | 3.121 | 32.112 | 1.00 | 33.82 | | N |
| ANISOU | 604 | NE2 | GLN | A | 72 | 4140 | 4404 | 4309 | 128 | −113 | −732 | N |
| ATOM | 605 | N | THR | A | 73 | 12.073 | 5.890 | 31.774 | 1.00 | 33.01 | | N |
| ANISOU | 605 | N | THR | A | 73 | 4027 | 4227 | 4290 | 100 | −199 | −805 | N |
| ATOM | 606 | CA | THR | A | 73 | 10.966 | 6.615 | 32.389 | 1.00 | 34.92 | | C |
| ANISOU | 606 | CA | THR | A | 73 | 4251 | 4456 | 4559 | 105 | −204 | −815 | C |
| ATOM | 607 | C | THR | A | 73 | 9.756 | 6.662 | 31.444 | 1.00 | 32.85 | | C |
| ANISOU | 607 | C | THR | A | 73 | 3978 | 4172 | 4330 | 101 | −232 | −822 | C |
| ATOM | 608 | O | THR | A | 73 | 8.629 | 6.403 | 31.867 | 1.00 | 37.75 | | O |
| ANISOU | 608 | O | THR | A | 73 | 4573 | 4781 | 4988 | 105 | −225 | −825 | O |
| ATOM | 609 | CB | THR | A | 73 | 11.444 | 8.018 | 32.749 | 1.00 | 33.93 | | C |
| ANISOU | 609 | CB | THR | A | 73 | 4135 | 4336 | 4422 | 106 | −215 | −817 | C |
| ATOM | 610 | OG1 | THR | A | 73 | 12.477 | 7.925 | 33.739 | 1.00 | 32.58 | | O |
| ANISOU | 610 | OG1 | THR | A | 73 | 3970 | 4185 | 4223 | 107 | −196 | −812 | O |
| ATOM | 611 | CG2 | THR | A | 73 | 10.301 | 8.854 | 33.310 | 1.00 | 34.39 | | C |
| ANISOU | 611 | CG2 | THR | A | 73 | 4180 | 4377 | 4508 | 117 | −216 | −830 | C |
| ATOM | 612 | N | HIS | A | 74 | 9.982 | 6.968 | 30.163 | 1.00 | 31.78 | | N |
| ANISOU | 612 | N | HIS | A | 74 | 3862 | 4031 | 4180 | 92 | −263 | −821 | N |
| ATOM | 613 | CA | HIS | A | 74 | 8.913 | 6.920 | 29.156 | 1.00 | 34.37 | | C |
| ANISOU | 613 | CA | HIS | A | 74 | 4185 | 4340 | 4532 | 86 | −300 | −826 | C |
| ATOM | 614 | C | HIS | A | 74 | 8.249 | 5.571 | 29.082 | 1.00 | 36.97 | | C |
| ANISOU | 614 | C | HIS | A | 74 | 4502 | 4659 | 4885 | 79 | −297 | −832 | C |
| ATOM | 615 | O | HIS | A | 74 | 7.029 | 5.473 | 28.835 | 1.00 | 36.70 | | O |
| ANISOU | 615 | O | HIS | A | 74 | 4443 | 4607 | 4893 | 74 | −322 | −836 | O |
| ATOM | 616 | CB | HIS | A | 74 | 9.462 | 7.246 | 27.794 | 1.00 | 35.84 | | C |
| ANISOU | 616 | CB | HIS | A | 74 | 4405 | 4527 | 4684 | 79 | −330 | −821 | C |
| ATOM | 617 | CG | HIS | A | 74 | 9.645 | 8.696 | 27.563 | 1.00 | 43.72 | | C |
| ANISOU | 617 | CG | HIS | A | 74 | 5410 | 5524 | 5676 | 81 | −348 | −811 | C |
| ATOM | 618 | ND1 | HIS | A | 74 | 9.642 | 9.247 | 26.303 | 1.00 | 48.63 | | N |
| ANISOU | 618 | ND1 | HIS | A | 74 | 6057 | 6141 | 6280 | 76 | −384 | −802 | N |
| ATOM | 619 | CD2 | HIS | A | 74 | 9.808 | 9.720 | 28.428 | 1.00 | 51.87 | | C |
| ANISOU | 619 | CD2 | HIS | A | 74 | 6433 | 6556 | 6719 | 87 | −338 | −809 | C |
| ATOM | 620 | CE1 | HIS | A | 74 | 9.811 | 10.554 | 26.401 | 1.00 | 50.64 | | C |
| ANISOU | 620 | CE1 | HIS | A | 74 | 6313 | 6391 | 6539 | 79 | −393 | −791 | C |
| ATOM | 621 | NE2 | HIS | A | 74 | 9.948 | 10.860 | 27.677 | 1.00 | 52.49 | | N |
| ANISOU | 621 | NE2 | HIS | A | 74 | 6528 | 6626 | 6791 | 84 | −366 | −797 | N |
| ATOM | 622 | N | ARG | A | 75 | 9.034 | 4.520 | 29.236 | 1.00 | 34.94 | | N |
| ANISOU | 622 | N | ARG | A | 75 | 4260 | 4408 | 4606 | 78 | −270 | −832 | N |
| ATOM | 623 | CA | ARG | A | 75 | 8.479 | 3.183 | 29.167 | 1.00 | 33.98 | | C |
| ANISOU | 623 | CA | ARG | A | 75 | 4133 | 4269 | 4510 | 70 | −267 | −838 | C |
| ATOM | 624 | C | ARG | A | 75 | 7.563 | 2.932 | 30.344 | 1.00 | 41.11 | | C |
| ANISOU | 624 | C | ARG | A | 75 | 4993 | 5166 | 5460 | 72 | −242 | −832 | C |
| ATOM | 625 | O | ARG | A | 75 | 6.480 | 2.350 | 30.186 | 1.00 | 38.03 | | O |
| ANISOU | 625 | O | ARG | A | 75 | 4578 | 4754 | 5116 | 60 | −257 | −834 | O |
| ATOM | 626 | CB | ARG | A | 75 | 9.598 | 2.166 | 29.115 | 1.00 | 34.70 | | C |
| ANISOU | 626 | CB | ARG | A | 75 | 4252 | 4365 | 4568 | 74 | −238 | −837 | C |
| ATOM | 627 | CG | ARG | A | 75 | 9.112 | 0.708 | 29.037 | 1.00 | 41.28 | | C |
| ANISOU | 627 | CG | ARG | A | 75 | 5085 | 5171 | 5428 | 65 | −234 | −845 | C |

TABLE 14-continued

| | | | | | | | | | | | | |
|---|---|---|---|---|---|---|---|---|---|---|---|---|
| ATOM | 628 | CD | ARG | A | 75 | 10.373 | −0.139 | 28.704 | 1.00 | 35.10 | | C |
| ANISOU | 628 | CD | ARG | A | 75 | 4340 | 4390 | 4606 | 76 | −208 | −845 | C |
| ATOM | 629 | NE | ARG | A | 75 | 10.051 | −1.496 | 28.288 | 1.00 | 35.20 | | N |
| ANISOU | 629 | NE | ARG | A | 75 | 4370 | 4369 | 4636 | 68 | −211 | −859 | N |
| ATOM | 630 | CZ | ARG | A | 75 | 10.977 | −2.401 | 27.991 | 1.00 | 41.30 | | C |
| ANISOU | 630 | CZ | ARG | A | 75 | 5175 | 5133 | 5383 | 81 | −186 | −862 | C |
| ATOM | 631 | NH1 | ARG | A | 75 | 12.243 | −2.067 | 28.093 | 1.00 | 35.06 | | N |
| ANISOU | 631 | NH1 | ARG | A | 75 | 4395 | 4371 | 4553 | 102 | −158 | −848 | N |
| ATOM | 632 | NH2 | ARG | A | 75 | 10.640 | −3.622 | 27.604 | 1.00 | 44.08 | | N |
| ANISOU | 632 | NH2 | ARG | A | 75 | 5548 | 5446 | 5753 | 73 | −191 | −879 | N |
| ATOM | 633 | N | VAL | A | 76 | 7.962 | 3.393 | 31.535 | 1.00 | 29.86 | | N |
| ANISOU | 633 | N | VAL | A | 76 | 3559 | 3760 | 4025 | 87 | −206 | −822 | N |
| ATOM | 634 | CA | VAL | A | 76 | 7.031 | 3.393 | 32.659 | 1.00 | 35.89 | | C |
| ANISOU | 634 | CA | VAL | A | 76 | 4286 | 4522 | 4829 | 95 | −177 | −815 | C |
| ATOM | 635 | C | VAL | A | 76 | 5.844 | 4.298 | 32.347 | 1.00 | 37.31 | | C |
| ANISOU | 635 | C | VAL | A | 76 | 4436 | 4690 | 5049 | 96 | −204 | −819 | C |
| ATOM | 636 | O | VAL | A | 76 | 4.700 | 3.954 | 32.645 | 1.00 | 38.24 | | O |
| ANISOU | 636 | O | VAL | A | 76 | 4515 | 4795 | 5220 | 94 | −196 | −812 | O |
| ATOM | 637 | CB | VAL | A | 76 | 7.735 | 3.820 | 33.960 | 1.00 | 32.71 | | C |
| ANISOU | 637 | CB | VAL | A | 76 | 3891 | 4143 | 4394 | 113 | −138 | −808 | C |
| ATOM | 638 | CG1 | VAL | A | 76 | 6.735 | 4.029 | 35.052 | 1.00 | 33.12 | | C |
| ANISOU | 638 | CG1 | VAL | A | 76 | 3912 | 4194 | 4477 | 127 | −105 | −802 | C |
| ATOM | 639 | CG2 | VAL | A | 76 | 8.761 | 2.770 | 34.393 | 1.00 | 27.09 | | C |
| ANISOU | 639 | CG2 | VAL | A | 76 | 3198 | 3443 | 3654 | 115 | −111 | −796 | C |
| ATOM | 640 | N | ASP | A | 77 | 6.091 | 5.471 | 31.760 | 1.00 | 35.04 | | N |
| ANISOU | 640 | N | ASP | A | 77 | 4166 | 4406 | 4743 | 100 | −234 | −825 | N |
| ATOM | 641 | CA | ASP | A | 77 | 4.974 | 6.372 | 31.486 | 1.00 | 36.20 | | C |
| ANISOU | 641 | CA | ASP | A | 77 | 4283 | 4539 | 4932 | 106 | −260 | −826 | C |
| ATOM | 642 | C | ASP | A | 77 | 3.922 | 5.694 | 30.618 | 1.00 | 30.69 | | C |
| ANISOU | 642 | C | ASP | A | 77 | 3558 | 3822 | 4281 | 88 | −298 | −824 | C |
| ATOM | 643 | O | ASP | A | 77 | 2.725 | 5.854 | 30.853 | 1.00 | 36.00 | | O |
| ANISOU | 643 | O | ASP | A | 77 | 4184 | 4485 | 5012 | 93 | −300 | −816 | O |
| ATOM | 644 | CB | ASP | A | 77 | 5.442 | 7.616 | 30.744 | 1.00 | 32.96 | | C |
| ANISOU | 644 | CB | ASP | A | 77 | 3900 | 4129 | 4495 | 110 | −295 | −829 | C |
| ATOM | 645 | CG | ASP | A | 77 | 6.262 | 8.570 | 31.626 | 1.00 | 41.20 | | C |
| ANISOU | 645 | CG | ASP | A | 77 | 4964 | 5184 | 5508 | 124 | −268 | −832 | C |
| ATOM | 646 | OD1 | ASP | A | 77 | 6.220 | 8.376 | 32.834 | 1.00 | 35.07 | | O |
| ANISOU | 646 | OD1 | ASP | A | 77 | 4178 | 4415 | 4733 | 136 | −225 | −834 | O |
| ATOM | 647 | OD2 | ASP | A | 77 | 6.849 | 9.545 | 31.088 | 1.00 | 41.32 | | O |
| ANISOU | 647 | OD2 | ASP | A | 77 | 5004 | 5196 | 5499 | 123 | −292 | −832 | O |
| ATOM | 648 | N | LEU | A | 78 | 4.360 | 5.036 | 29.547 | 1.00 | 34.81 | | N |
| ANISOU | 648 | N | LEU | A | 78 | 4111 | 4339 | 4776 | 69 | −331 | −831 | N |
| ATOM | 649 | CA | LEU | A | 78 | 3.423 | 1.375 | 28.648 | 1.00 | 39.38 | | C |
| ANISOU | 649 | CA | LEU | A | 78 | 4673 | 4897 | 5392 | 48 | −379 | −835 | C |
| ATOM | 650 | C | LEU | A | 78 | 2.545 | 3.413 | 29.414 | 1.00 | 41.45 | | C |
| ANISOU | 650 | C | LEU | A | 78 | 4888 | 5146 | 5715 | 39 | −353 | −827 | C |
| ATOM | 651 | O | LEU | A | 78 | 1.318 | 3.385 | 29.233 | 1.00 | 38.37 | | O |
| ANISOU | 651 | O | LEU | A | 78 | 4449 | 4741 | 5388 | 29 | −381 | −819 | O |
| ATOM | 652 | CB | LEU | A | 78 | 4.192 | 3.649 | 27.550 | 1.00 | 33.40 | | C |
| ANISOU | 652 | CB | LEU | A | 78 | 3970 | 4135 | 4585 | 33 | −406 | −849 | C |
| ATOM | 653 | CG | LEU | A | 78 | 4.706 | 4.605 | 26.474 | 1.00 | 34.33 | | C |
| ANISOU | 653 | CG | LEU | A | 78 | 4128 | 4262 | 4654 | 37 | −444 | −852 | C |
| ATOM | 654 | CD1 | LEU | A | 78 | 5.808 | 3.914 | 25.658 | 1.00 | 41.15 | | C |
| ANISOU | 654 | CD1 | LEU | A | 78 | 5052 | 5129 | 5454 | 32 | −443 | −864 | C |
| ATOM | 655 | CD2 | LEU | A | 78 | 3.543 | 5.023 | 25.571 | 1.00 | 39.67 | | C |
| ANISOU | 655 | CD2 | LEU | A | 78 | 4785 | 4924 | 5363 | 28 | −512 | −850 | C |
| ATOM | 656 | N | GLY | A | 79 | 3.161 | 2.611 | 30.289 | 1.00 | 34.72 | | N |
| ANISOU | 656 | N | GLY | A | 79 | 4044 | 4299 | 4847 | 42 | −300 | −823 | N |
| ATOM | 657 | CA | GLY | A | 79 | 2.376 | 1.732 | 31.133 | 1.00 | 33.91 | | C |
| ANISOU | 657 | CA | GLY | A | 79 | 3898 | 4185 | 4802 | 34 | −266 | −808 | C |
| ATOM | 658 | C | GLY | A | 79 | 1.455 | 2.484 | 32.074 | 1.00 | 36.89 | | C |
| ANISOU | 658 | C | GLY | A | 79 | 4221 | 4570 | 5225 | 54 | −234 | −791 | C |
| ATOM | 659 | O | GLY | A | 79 | 0.296 | 2.101 | 32.265 | 1.00 | 42.15 | | O |
| ANISOU | 659 | O | GLY | A | 79 | 4832 | 5222 | 5962 | 44 | −232 | −775 | O |
| ATOM | 660 | N | THR | A | 80 | 1.948 | 3.556 | 32.686 | 1.00 | 33.90 | | N |
| ANISOU | 660 | N | THR | A | 80 | 3859 | 4213 | 4810 | 82 | −207 | −793 | N |
| ATOM | 661 | CA | THR | A | 80 | 1.121 | 4.249 | 33.666 | 1.00 | 33.94 | | C |
| ANISOU | 661 | CA | THR | A | 80 | 3821 | 4223 | 4851 | 107 | −167 | −780 | C |
| ATOM | 662 | C | THR | A | 80 | −0.072 | 4.942 | 32.987 | 1.00 | 37.00 | | C |
| ANISOU | 662 | C | THR | A | 80 | 4161 | 4596 | 5300 | 109 | −209 | −776 | C |
| ATOM | 663 | O | THR | A | 80 | −1.189 | 4.889 | 33.496 | 1.00 | 38.36 | | O |
| ANISOU | 663 | O | THR | A | 80 | 4273 | 4762 | 5538 | 116 | −184 | −758 | O |
| ATOM | 664 | CB | THR | A | 80 | 1.973 | 5.255 | 34.437 | 1.00 | 34.45 | | C |
| ANISOU | 664 | CB | THR | A | 80 | 3924 | 4308 | 4858 | 136 | −135 | −790 | C |
| ATOM | 665 | OG1 | THR | A | 80 | 3.135 | 4.583 | 34.963 | 1.00 | 41.95 | | O |
| ANISOU | 665 | OG1 | THR | A | 80 | 4914 | 5273 | 5751 | 133 | −108 | −791 | O |
| ATOM | 666 | CG2 | THR | A | 80 | 1.158 | 5.833 | 35.590 | 1.00 | 38.41 | | C |
| ANISOU | 666 | CG2 | THR | A | 80 | 4392 | 4814 | 5389 | 167 | −81 | −781 | C |
| ATOM | 667 | N | LEU | A | 81 | 0.167 | 5.610 | 31.849 | 1.00 | 38.97 | | N |
| ANISOU | 667 | N | LEU | A | 81 | 4436 | 4841 | 5529 | 103 | −271 | −789 | N |

TABLE 14-continued

| | | | | | | | | | | | |
|---|---|---|---|---|---|---|---|---|---|---|---|
| ATOM | 668 | CA | LEU | A | 81 | −0.886 | 6.347 | 31.150 | 1.00 | 40.15 | C |
| ANISOU | 668 | CA | LEU | A | 81 | 4544 | 4978 | 5733 | 107 | −319 | −781 | C |
| ATOM | 669 | C | LEU | A | 81 | −1.983 | 5.414 | 30.655 | 1.00 | 45.51 | C |
| ANISOU | 669 | C | LEU | A | 81 | 5168 | 5640 | 6483 | 79 | −354 | −769 | C |
| ATOM | 670 | O | LEU | A | 81 | −3.170 | 5.755 | 30.709 | 1.00 | 42.74 | O |
| ANISOU | 670 | O | LEU | A | 81 | 4751 | 5281 | 6206 | 87 | −363 | −750 | O |
| ATOM | 671 | CB | LEU | A | 81 | −0.280 | 7.110 | 29.985 | 1.00 | 34.14 | C |
| ANISOU | 671 | CB | LEU | A | 81 | 3830 | 4216 | 4924 | 104 | −379 | −793 | C |
| ATOM | 672 | CG | LEU | A | 81 | 0.601 | 8.240 | 30.510 | 1.00 | 37.99 | C |
| ANISOU | 672 | CG | LEU | A | 81 | 4358 | 4714 | 5362 | 131 | −348 | −801 | C |
| ATOM | 673 | CD1 | LEU | A | 81 | 1.659 | 8.724 | 29.503 | 1.00 | 41.87 | C |
| ANISOU | 673 | CD1 | LEU | A | 81 | 4911 | 5209 | 5789 | 121 | −389 | −809 | C |
| ATOM | 674 | CD2 | LEU | A | 81 | −0.161 | 9.379 | 31.038 | 1.00 | 38.98 | C |
| ANISOU | 674 | CD2 | LEU | A | 81 | 4450 | 4832 | 5529 | 164 | −332 | −794 | C |
| ATOM | 675 | N | ARG | A | 82 | −1.593 | 4.235 | 30.159 | 1.00 | 37.54 | N |
| ANISOU | 675 | N | ARG | A | 82 | 4185 | 4622 | 5456 | 45 | −375 | −778 | N |
| ATOM | 676 | CA | ARG | A | 82 | −2.541 | 3.200 | 29.756 | 1.00 | 48.67 | C |
| ANISOU | 676 | CA | ARG | A | 82 | 5550 | 6010 | 6934 | 11 | −410 | −769 | C |
| ATOM | 677 | C | ARG | A | 82 | −3.473 | 2.837 | 30.911 | 1.00 | 43.34 | C |
| ANISOU | 677 | C | ARG | A | 82 | 4800 | 5332 | 6335 | 16 | −350 | −741 | C |
| ATOM | 678 | O | ARG | A | 82 | −4.686 | 2.668 | 30.722 | 1.00 | 44.07 | O |
| ANISOU | 678 | O | ARG | A | 82 | 4821 | 5410 | 6513 | 1 | −376 | −722 | O |
| ATOM | 679 | CB | ARG | A | 82 | −1.742 | 1.971 | 29.293 | 1.00 | 54.44 | C |
| ANISOU | 679 | CB | ARG | A | 82 | 6335 | 6728 | 7621 | −19 | −423 | −788 | C |
| ATOM | 680 | CG | ARG | A | 82 | −2.432 | 1.023 | 28.375 | 1.00 | 63.43 | C |
| ANISOU | 680 | CG | ARG | A | 82 | 7459 | 7837 | 8804 | −61 | −490 | −795 | C |
| ATOM | 681 | CD | ARG | A | 82 | −2.277 | −0.396 | 28.861 | 1.00 | 62.90 | C |
| ANISOU | 681 | CD | ARG | A | 82 | 7396 | 7750 | 8755 | −85 | −456 | −794 | C |
| ATOM | 682 | NE | ARG | A | 82 | −0.885 | −0.762 | 29.045 | 1.00 | 69.00 | N |
| ANISOU | 682 | NE | ARG | A | 82 | 8241 | 8530 | 9446 | −72 | −417 | −810 | N |
| ATOM | 683 | CZ | ARG | A | 82 | −0.483 | −1.694 | 29.906 | 1.00 | 78.88 | C |
| ANISOU | 683 | CZ | ARG | A | 82 | 9498 | 9775 | 10700 | −73 | −358 | −800 | C |
| ATOM | 684 | NH1 | ARG | A | 82 | −1.394 | −2.336 | 30.644 | 1.00 | 82.78 | N |
| ANISOU | 684 | NH1 | ARG | A | 82 | 9930 | 10252 | 11271 | −89 | −329 | −773 | N |
| ATOM | 685 | NH2 | ARG | A | 82 | 0.819 | −1.976 | 30.042 | 1.00 | 73.20 | N |
| ANISOU | 685 | NH2 | ARG | A | 82 | 8841 | 9065 | 9908 | −58 | −326 | −812 | N |
| ATOM | 686 | N | GLY | A | 83 | −2.931 | 2.752 | 32.125 | 1.00 | 43.20 | N |
| ANISOU | 686 | N | GLY | A | 83 | 4797 | 5330 | 6288 | 39 | −268 | −735 | N |
| ATOM | 687 | CA | GLY | A | 83 | −3.758 | 2.412 | 33.274 | 1.00 | 43.28 | C |
| ANISOU | 687 | CA | GLY | A | 83 | 4744 | 5340 | 6361 | 48 | −199 | −705 | C |
| ATOM | 688 | C | GLY | A | 83 | −4.605 | 3.581 | 33.743 | 1.00 | 43.02 | C |
| ANISOU | 688 | C | GLY | A | 83 | 4659 | 5317 | 6370 | 86 | −173 | −690 | C |
| ATOM | 689 | O | GLY | A | 83 | −5.777 | 3.411 | 34.120 | 1.00 | 45.24 | O |
| ANISOU | 689 | O | GLY | A | 83 | 4861 | 5592 | 6737 | 87 | −150 | −660 | O |
| ATOM | 690 | N | TYR | A | 84 | −4.063 | 4.782 | 33.652 | 1.00 | 43.34 | N |
| ANISOU | 690 | N | TYR | A | 84 | 4741 | 5370 | 6357 | 117 | −180 | −709 | N |
| ATOM | 691 | CA | TYR | A | 84 | −4.821 | 5.983 | 34.057 | 1.00 | 45.17 | C |
| ANISOU | 691 | CA | TYR | A | 84 | 4932 | 5605 | 6627 | 159 | −156 | −699 | C |
| ATOM | 692 | C | TYR | A | 84 | −6.043 | 6.148 | 33.147 | 1.00 | 42.01 | C |
| ANISOU | 692 | C | TYR | A | 84 | 4458 | 5188 | 6316 | 148 | −219 | −681 | C |
| ATOM | 693 | O | TYR | A | 84 | −7.056 | 6.570 | 33.617 | 1.00 | 39.81 | O |
| ANISOU | 693 | O | TYR | A | 84 | 4111 | 4908 | 6107 | 174 | −187 | −658 | O |
| ATOM | 694 | CB | TYR | A | 84 | −3.964 | 7.239 | 33.913 | 1.00 | 39.98 | C |
| ANISOU | 694 | CB | TYR | A | 84 | 4338 | 4954 | 5899 | 187 | −168 | −725 | C |
| ATOM | 695 | CG | TYR | A | 84 | −2.937 | 7.519 | 34.979 | 1.00 | 39.38 | C |
| ANISOU | 695 | CG | TYR | A | 84 | 4322 | 4894 | 5745 | 211 | −105 | −742 | C |
| ATOM | 696 | CD1 | TYR | A | 84 | −2.860 | 6.788 | 36.137 | 1.00 | 40.17 | C |
| ANISOU | 696 | CD1 | TYR | A | 84 | 4421 | 5008 | 5835 | 217 | −33 | −732 | C |
| ATOM | 697 | CD2 | TYR | A | 84 | −2.030 | 8.537 | 34.814 | 1.00 | 41.81 | C |
| ANISOU | 697 | CD2 | TYR | A | 84 | 4692 | 5205 | 5990 | 225 | −123 | −766 | C |
| ATOM | 698 | CE1 | TYR | A | 84 | −1.899 | 7.043 | 37.094 | 1.00 | 40.01 | C |
| ANISOU | 698 | CE1 | TYR | A | 84 | 4459 | 5004 | 5738 | 237 | 15 | −747 | C |
| ATOM | 699 | CE2 | TYR | A | 84 | −1.070 | 8.815 | 35.759 | 1.00 | 39.77 | C |
| ANISOU | 699 | CE2 | TYR | A | 84 | 4488 | 4961 | 5663 | 242 | −77 | −783 | C |
| ATOM | 700 | CZ | TYR | A | 84 | −1.006 | 8.070 | 36.906 | 1.00 | 42.02 | C |
| ANISOU | 700 | CZ | TYR | A | 84 | 4773 | 5261 | 5934 | 249 | −10 | −774 | C |
| ATOM | 701 | OH | TYR | A | 84 | −0.062 | 8.338 | 37.830 | 1.00 | 49.70 | O |
| ANISOU | 701 | OH | TYR | A | 84 | 5801 | 6248 | 6834 | 264 | 26 | −790 | O |
| ATOM | 702 | N | TYR | A | 85 | −5.913 | 5.825 | 31.867 | 1.00 | 39.73 | N |
| ANISOU | 702 | N | TYR | A | 85 | 4186 | 4887 | 6021 | 111 | −309 | −692 | N |
| ATOM | 703 | CA | TYR | A | 85 | −6.999 | 6.024 | 30.922 | 1.00 | 44.88 | C |
| ANISOU | 703 | CA | TYR | A | 85 | 4777 | 5526 | 6749 | 97 | −384 | −675 | C |
| ATOM | 704 | C | TYR | A | 85 | −7.764 | 4.745 | 30.625 | 1.00 | 45.14 | C |
| ANISOU | 704 | C | TYR | A | 85 | 4754 | 5543 | 6854 | 49 | −416 | −659 | C |
| ATOM | 705 | O | TYR | A | 85 | −8.599 | 4.741 | 29.720 | 1.00 | 45.87 | O |
| ANISOU | 705 | O | TYR | A | 85 | 4799 | 5623 | 7006 | 28 | −496 | −648 | O |
| ATOM | 706 | CB | TYR | A | 85 | −6.477 | 6.619 | 29.626 | 1.00 | 41.86 | C |
| ANISOU | 706 | CB | TYR | A | 85 | 4452 | 5141 | 6313 | 90 | −471 | −696 | C |
| ATOM | 707 | CG | TYR | A | 85 | −6.009 | 8.041 | 29.774 | 1.00 | 42.36 | C |
| ANISOU | 707 | CG | TYR | A | 85 | 4551 | 5212 | 6333 | 135 | −454 | −703 | C |

TABLE 14-continued

| | | | | | | | | | | | |
|---|---|---|---|---|---|---|---|---|---|---|---|
| ATOM | 708 | CD1 | TYR | A | 85 | −6.892 | 9.061 | 30.107 | 1.00 | 47.36 | C |
| ANISOU | 708 | CD1 | TYR | A | 85 | 5127 | 5840 | 7028 | 176 | −438 | −683 | C |
| ATOM | 709 | CD2 | TYR | A | 85 | −4.686 | 8.370 | 29.575 | 1.00 | 40.79 | C |
| ANISOU | 709 | CD2 | TYR | A | 85 | 4441 | 5020 | 6037 | 136 | −453 | −728 | C |
| ATOM | 710 | CE1 | TYR | A | 85 | −6.458 | 10.398 | 30.243 | 1.00 | 42.16 | C |
| ANISOU | 710 | CE1 | TYR | A | 85 | 4507 | 5179 | 6332 | 217 | −423 | −692 | C |
| ATOM | 711 | CE2 | TYR | A | 85 | −4.239 | 9.694 | 29.684 | 1.00 | 39.21 | C |
| ANISOU | 711 | CE2 | TYR | A | 85 | 4276 | 4821 | 5803 | 172 | −442 | −734 | C |
| ATOM | 712 | CZ | TYR | A | 85 | −5.105 | 10.684 | 30.037 | 1.00 | 42.15 | C |
| ANISOU | 712 | CZ | TYR | A | 85 | 4598 | 5183 | 6233 | 211 | −427 | −718 | C |
| ATOM | 713 | OH | TYR | A | 85 | −4.637 | 11.961 | 30.153 | 1.00 | 38.92 | O |
| ANISOU | 713 | OH | TYR | A | 85 | 4229 | 4768 | 5792 | 245 | −417 | −727 | O |
| ATOM | 714 | N | ASN | A | 86 | −7.496 | 3.679 | 31.374 | 1.00 | 42.16 | N |
| ANISOU | 714 | N | ASN | A | 86 | 4381 | 5164 | 6473 | 31 | −359 | −656 | N |
| ATOM | 715 | CA | ASN | A | 86 | −8.113 | 2.367 | 31.211 | 1.00 | 48.88 | C |
| ANISOU | 715 | CA | ASN | A | 86 | 5186 | 5993 | 7392 | −18 | −381 | −641 | C |
| ATOM | 716 | C | ASN | A | 86 | −8.134 | 1.929 | 29.757 | 1.00 | 48.94 | C |
| ANISOU | 716 | C | ASN | A | 86 | 5219 | 5980 | 7396 | −64 | −496 | −662 | C |
| ATOM | 717 | O | ASN | A | 86 | −9.158 | 1.498 | 29.225 | 1.00 | 47.55 | O |
| ANISOU | 717 | O | ASN | A | 86 | 4977 | 5785 | 7305 | −99 | −556 | −646 | O |
| ATOM | 718 | CB | ASN | A | 86 | −9.518 | 2.365 | 31.818 | 1.00 | 57.35 | C |
| ANISOU | 718 | CB | ASN | A | 86 | 6143 | 7062 | 8585 | −13 | −347 | −595 | C |
| ATOM | 719 | CG | ASN | A | 86 | −9.473 | 2.417 | 33.337 | 1.00 | 66.24 | C |
| ANISOU | 719 | CG | ASN | A | 86 | 7255 | 8206 | 9709 | 26 | −222 | −573 | C |
| ATOM | 720 | OD1 | ASN | A | 86 | −9.684 | 3.460 | 33.946 | 1.00 | 69.88 | O |
| ANISOU | 720 | OD1 | ASN | A | 86 | 7699 | 8684 | 10169 | 78 | −170 | −566 | O |
| ATOM | 721 | ND2 | ASN | A | 86 | −9.142 | 1.287 | 33.952 | 1.00 | 75.24 | N |
| ANISOU | 721 | ND2 | ASN | A | 86 | 8409 | 9338 | 10840 | 2 | −174 | −565 | N |
| ATOM | 722 | N | GLN | A | 87 | −6.980 | 2.024 | 29.112 | 1.00 | 45.04 | N |
| ANISOU | 722 | N | GLN | A | 87 | 4822 | 5492 | 6801 | −65 | −525 | −698 | N |
| ATOM | 723 | CA | GLN | A | 87 | −6.857 | 1.641 | 27.719 | 1.00 | 47.81 | C |
| ANISOU | 723 | CA | GLN | A | 87 | 5215 | 5825 | 7125 | −102 | −628 | −724 | C |
| ATOM | 724 | C | GLN | A | 87 | −6.329 | 0.223 | 27.604 | 1.00 | 49.29 | C |
| ANISOU | 724 | C | GLN | A | 87 | 5448 | 5989 | 7291 | −141 | −628 | −744 | C |
| ATOM | 725 | O | GLN | A | 87 | −5.826 | −0.359 | 28.559 | 1.00 | 46.01 | O |
| ANISOU | 725 | O | GLN | A | 87 | 5043 | 5574 | 6863 | −135 | −549 | −739 | O |
| ATOM | 726 | CB | GLN | A | 87 | −5.959 | 2.614 | 26.964 | 1.00 | 42.38 | C |
| ANISOU | 726 | CB | GLN | A | 87 | 4606 | 5155 | 6342 | −77 | −660 | −748 | C |
| ATOM | 727 | CG | GLN | A | 87 | −6.559 | 4.026 | 26.819 | 1.00 | 42.15 | C |
| ANISOU | 727 | CG | GLN | A | 87 | 4536 | 5139 | 6340 | −42 | −680 | −728 | C |
| ATOM | 728 | CD | GLN | A | 87 | −5.493 | 5.053 | 26.443 | 1.00 | 48.29 | C |
| ANISOU | 728 | CD | GLN | A | 87 | 5394 | 5934 | 7021 | −12 | −680 | −745 | C |
| ATOM | 729 | OE1 | GLN | A | 87 | −4.342 | 4.967 | 26.901 | 1.00 | 42.58 | O |
| ANISOU | 729 | OE1 | GLN | A | 87 | 4732 | 5222 | 6226 | −1 | −624 | −762 | O |
| ATOM | 730 | NE2 | GLN | A | 87 | −5.853 | 6.011 | 25.599 | 1.00 | 47.27 | N |
| ANISOU | 730 | NE2 | GLN | A | 87 | 5261 | 5805 | 6893 | 1 | −745 | −737 | N |
| ATOM | 731 | N | SER | A | 88 | −6.480 | −0.341 | 26.421 | 1.00 | 50.53 | N |
| ANISOU | 731 | N | SER | A | 88 | 5632 | 6122 | 7444 | −181 | −720 | −767 | N |
| ATOM | 732 | CA | SER | A | 88 | −6.146 | −1.739 | 26.232 | 1.00 | 54.98 | C |
| ANISOU | 732 | CA | SER | A | 88 | 6235 | 6653 | 8001 | −221 | −729 | −788 | C |
| ATOM | 733 | C | SER | A | 88 | −4.653 | −1.913 | 25.975 | 1.00 | 60.49 | C |
| ANISOU | 733 | C | SER | A | 88 | 7042 | 7358 | 8582 | −204 | −704 | −823 | C |
| ATOM | 734 | O | SER | A | 88 | −3.993 | −1.033 | 25.411 | 1.00 | 65.42 | O |
| ANISOU | 734 | O | SER | A | 88 | 7720 | 8007 | 9130 | −177 | −721 | −838 | O |
| ATOM | 735 | CB | SER | A | 88 | −6.936 | −2.305 | 25.056 | 1.00 | 52.17 | C |
| ANISOU | 735 | CB | SER | A | 88 | 5871 | 6264 | 7687 | −272 | −844 | −804 | C |
| ATOM | 736 | OG | SER | A | 88 | −6.081 | −3.113 | 24.287 | 1.00 | 62.78 | O |
| ANISOU | 736 | OG | SER | A | 88 | 7313 | 7585 | 8954 | −291 | −875 | −848 | O |
| ATOM | 737 | N | GLU | A | 89 | −4.163 | −3.104 | 26.287 | 1.00 | 62.38 | N |
| ANISOU | 737 | N | GLU | A | 89 | 7313 | 7575 | 8815 | −219 | −664 | −832 | N |
| ATOM | 738 | CA | GLU | A | 89 | −2.748 | −3.444 | 26.037 | 1.00 | 62.58 | C |
| ANISOU | 738 | CA | GLU | A | 89 | 7437 | 7600 | 8742 | −206 | −644 | −864 | C |
| ATOM | 739 | C | GLU | A | 89 | −2.540 | −3.711 | 24.549 | 1.00 | 60.59 | C |
| ANISOU | 739 | C | GLU | A | 89 | 7256 | 7331 | 8435 | −225 | −732 | −905 | C |
| ATOM | 740 | O | GLU | A | 89 | −1.411 | −3.847 | 24.155 | 1.00 | 62.09 | O |
| ANISOU | 740 | O | GLU | A | 89 | 7530 | 7527 | 8535 | −207 | −717 | −931 | O |
| ATOM | 741 | CB | GLU | A | 89 | −2.408 | −4.750 | 26.739 | 1.00 | 67.73 | C |
| ANISOU | 741 | CB | GLU | A | 89 | 8099 | 8223 | 9412 | −218 | −587 | −860 | C |
| ATOM | 742 | CG | GLU | A | 89 | −2.792 | −4.780 | 28.194 | 1.00 | 79.66 | C |
| ANISOU | 742 | CG | GLU | A | 89 | 9539 | 9746 | 10981 | −205 | −503 | −816 | C |
| ATOM | 743 | CD | GLU | A | 89 | −1.918 | −5.687 | 29.036 | 0.37 | 90.10 | C |
| ANISOU | 743 | CD | GLU | A | 89 | 10898 | 11063 | 12271 | −191 | −426 | −809 | C |
| ATOM | 744 | OE1 | GLU | A | 89 | −0.740 | −5.353 | 29.213 | 1.00 | 97.68 | O |
| ANISOU | 744 | OE1 | GLU | A | 89 | 11929 | 12039 | 13144 | −164 | −409 | −830 | O |
| ATOM | 745 | OE2 | GLU | A | 89 | −2.414 | −6.727 | 29.504 | 0.67 | 94.24 | O |
| ANISOU | 745 | OE2 | GLU | A | 89 | 11380 | 11568 | 12860 | −205 | −381 | −779 | O |
| ATOM | 746 | N | ALA | A | 90 | −3.595 | −3.739 | 23.752 | 1.00 | 52.93 | N |
| ANISOU | 746 | N | ALA | A | 90 | 6256 | 6339 | 7514 | −261 | −823 | −911 | N |
| ATOM | 747 | CA | ALA | A | 90 | −3.422 | −4.110 | 22.356 | 1.00 | 55.79 | C |
| ANISOU | 747 | CA | ALA | A | 90 | 6697 | 6681 | 7821 | −283 | −910 | −954 | C |

TABLE 14-continued

| | | | | | | | | | | | | |
|---|---|---|---|---|---|---|---|---|---|---|---|---|
| ATOM | 748 | C | ALA | A | 90 | −3.041 | −2.938 | 21.474 | 1.00 | 51.92 | | C |
| ANISOU | 748 | C | ALA | A | 90 | 6252 | 6227 | 7249 | −255 | −948 | −962 | C |
| ATOM | 749 | O | ALA | A | 90 | −2.536 | −3.151 | 20.366 | 1.00 | 50.76 | | O |
| ANISOU | 749 | O | ALA | A | 90 | 6191 | 6072 | 7023 | −259 | −996 | −998 | O |
| ATOM | 750 | CB | ALA | A | 90 | −4.713 | −4.746 | 21.820 | 1.00 | 60.67 | | C |
| ANISOU | 750 | CB | ALA | A | 90 | 7269 | 7259 | 8524 | −339 | −1004 | −959 | C |
| ATOM | 751 | N | GLY | A | 91 | −3.292 | −1.714 | 21.915 | 1.00 | 48.55 | | N |
| ANISOU | 751 | N | GLY | A | 91 | 5772 | 5836 | 6839 | −226 | −927 | −928 | N |
| ATOM | 752 | CA | GLY | A | 91 | −3.041 | −0.558 | 21.081 | 1.00 | 50.87 | | C |
| ANISOU | 752 | CA | GLY | A | 91 | 6102 | 6159 | 7067 | −202 | −968 | −929 | C |
| ATOM | 753 | C | GLY | A | 91 | −1.656 | 0.018 | 21.336 | 1.00 | 48.88 | | C |
| ANISOU | 753 | C | GLY | A | 91 | 5909 | 5936 | 6726 | −160 | −892 | −930 | C |
| ATOM | 754 | O | GLY | A | 91 | −1.107 | −0.119 | 22.413 | 1.00 | 43.68 | | O |
| ANISOU | 754 | O | GLY | A | 91 | 5235 | 5286 | 6074 | −142 | −807 | −919 | O |
| ATOM | 755 | N | SER | A | 92 | −1.125 | 0.676 | 20.314 | 1.00 | 48.18 | | N |
| ANISOU | 755 | N | SER | A | 92 | 5887 | 5865 | 6555 | −145 | −929 | −940 | N |
| ATOM | 756 | CA | SER | A | 92 | 0.128 | 1.406 | 20.380 | 1.00 | 48.66 | | C |
| ANISOU | 756 | CA | SER | A | 92 | 5998 | 5955 | 6536 | −109 | −870 | −935 | C |
| ATOM | 757 | C | SER | A | 92 | −0.151 | 2.862 | 20.730 | 1.00 | 44.07 | | C |
| ANISOU | 757 | C | SER | A | 92 | 5370 | 5399 | 5976 | −83 | −863 | −901 | C |
| ATOM | 758 | O | SER | A | 92 | −1.082 | 3.471 | 20.183 | 1.00 | 39.75 | | O |
| ANISOU | 758 | O | SER | A | 92 | 4793 | 4850 | 5460 | −88 | −932 | −887 | O |
| ATOM | 759 | CB | SER | A | 92 | 0.854 | 1.290 | 19.039 | 1.00 | 46.08 | | C |
| ANISOU | 759 | CB | SER | A | 92 | 5769 | 5630 | 6108 | −108 | −907 | −961 | C |
| ATOM | 760 | OG | SER | A | 92 | 1.889 | 2.227 | 18.919 | 1.00 | 42.28 | | O |
| ANISOU | 760 | OG | SER | A | 92 | 5326 | 5180 | 5558 | −75 | −865 | −946 | O |
| ATOM | 761 | N | HIS | A | 93 | 0.620 | 3.402 | 21.679 | 1.00 | 31.98 | | N |
| ANISOU | 761 | N | HIS | A | 93 | 3832 | 3887 | 4434 | −56 | −782 | −887 | N |
| ATOM | 762 | CA | HIS | A | 93 | 0.478 | 4.774 | 22.128 | 1.00 | 38.00 | | C |
| ANISOU | 762 | CA | HIS | A | 93 | 4558 | 4666 | 5214 | −29 | −766 | −859 | C |
| ATOM | 763 | C | HIS | A | 93 | 1.827 | 5.485 | 22.115 | 1.00 | 44.41 | | C |
| ANISOU | 763 | C | HIS | A | 93 | 5425 | 5499 | 5950 | −5 | −721 | −856 | C |
| ATOM | 764 | O | HIS | A | 93 | 2.874 | 4.848 | 22.028 | 1.00 | 36.61 | | O |
| ANISOU | 764 | O | HIS | A | 93 | 4488 | 4517 | 4906 | −6 | −686 | −871 | O |
| ATOM | 765 | CB | HIS | A | 93 | −0.115 | 4.812 | 23.512 | 1.00 | 35.12 | | C |
| ANISOU | 765 | CB | HIS | A | 93 | 4117 | 4299 | 4928 | −21 | −714 | −844 | C |
| ATOM | 766 | CG | HIS | A | 93 | −1.482 | 4.205 | 23.577 | 1.00 | 42.04 | | C |
| ANISOU | 766 | CG | HIS | A | 93 | 4926 | 5156 | 5892 | −44 | −753 | −838 | C |
| ATOM | 767 | ND1 | HIS | A | 93 | −2.622 | 4.915 | 23.261 | 1.00 | 44.11 | | N |
| ANISOU | 767 | ND1 | HIS | A | 93 | 5132 | 5414 | 6213 | −41 | −808 | −818 | N |
| ATOM | 768 | CD2 | HIS | A | 93 | −1.891 | 2.957 | 23.909 | 1.00 | 42.06 | | C |
| ANISOU | 768 | CD2 | HIS | A | 93 | 4903 | 5138 | 5938 | −71 | −746 | −846 | C |
| ATOM | 769 | CE1 | HIS | A | 93 | −3.681 | 4.130 | 23.401 | 1.00 | 46.71 | | C |
| ANISOU | 769 | CE1 | HIS | A | 93 | 5400 | 5725 | 6623 | −68 | −834 | −813 | C |
| ATOM | 770 | NE2 | HIS | A | 93 | −3.267 | 2.937 | 23.791 | 1.00 | 43.99 | | N |
| ANISOU | 770 | NE2 | HIS | A | 93 | 5074 | 5369 | 6271 | −89 | −798 | −830 | N |
| ATOM | 771 | N | THR | A | 94 | 1.779 | 6.820 | 22.208 | 1.00 | 38.57 | | N |
| ANISOU | 771 | N | THR | A | 94 | 4672 | 4769 | 5215 | 16 | −721 | −834 | N |
| ATOM | 772 | CA | THR | A | 94 | 2.940 | 7.668 | 22.016 | 1.00 | 42.89 | | C |
| ANISOU | 772 | CA | THR | A | 94 | 5267 | 5332 | 5697 | 33 | −694 | −825 | C |
| ATOM | 773 | C | THR | A | 94 | 3.076 | 8.605 | 23.204 | 1.00 | 42.60 | | C |
| ANISOU | 773 | C | THR | A | 94 | 5194 | 5299 | 5693 | 54 | −642 | −812 | C |
| ATOM | 774 | O | THR | A | 94 | 2.083 | 9.190 | 23.652 | 1.00 | 36.09 | | O |
| ANISOU | 774 | O | THR | A | 94 | 4316 | 4464 | 4931 | 65 | −653 | −800 | O |
| ATOM | 775 | CB | THR | A | 94 | 2.816 | 8.505 | 20.745 | 1.00 | 39.82 | | C |
| ANISOU | 775 | CB | THR | A | 94 | 4914 | 4945 | 5273 | 36 | −756 | −810 | C |
| ATOM | 776 | OG1 | THR | A | 94 | 2.624 | 7.630 | 19.629 | 1.00 | 44.68 | | O |
| ANISOU | 776 | OG1 | THR | A | 94 | 5570 | 5556 | 5851 | 16 | −810 | −827 | O |
| ATOM | 777 | CG2 | THR | A | 94 | 4.120 | 9.331 | 20.548 | 1.00 | 34.19 | | C |
| ANISOU | 777 | CG2 | THR | A | 94 | 4250 | 4246 | 4495 | 49 | −720 | −796 | C |
| ATOM | 778 | N | VAL | A | 95 | 4.302 | 8.742 | 23.712 | 1.00 | 37.15 | | N |
| ANISOU | 778 | N | VAL | A | 95 | 4533 | 4623 | 4962 | 61 | −587 | −813 | N |
| ATOM | 779 | C | VAL | A | 95 | 5.669 | 10.685 | 24.047 | 1.00 | 38.16 | | C |
| ANISOU | 779 | C | VAL | A | 95 | 4691 | 4759 | 5049 | 82 | −551 | −790 | C |
| ATOM | 780 | O | VAL | A | 95 | 6.618 | 10.214 | 23.405 | 1.00 | 39.80 | | O |
| ANISOU | 780 | O | VAL | A | 95 | 4942 | 4980 | 5201 | 73 | −543 | −791 | O |
| ATOM | 781 | CA | AVAL | A | 95 | 4.631 | 9.782 | 24.680 | 0.56 | 34.23 | | C |
| ANISOU | 781 | CA | AVAL | A | 95 | 4146 | 4255 | 4605 | 79 | −547 | −804 | C |
| ATOM | 782 | CB | AVAL | A | 95 | 5.121 | 9.222 | 26.027 | 0.56 | 36.56 | | C |
| ANISOU | 782 | CB | AVAL | A | 95 | 4426 | 4559 | 4907 | 83 | −483 | −814 | C |
| ATOM | 783 | CG1 | AVAL | A | 95 | 3.987 | 8.495 | 26.754 | 0.56 | 38.87 | | C |
| ANISOU | 783 | CG1 | AVAL | A | 95 | 4665 | 4842 | 5260 | 82 | −473 | −820 | C |
| ATOM | 784 | CG2 | AVAL | A | 95 | 6.345 | 8.338 | 25.852 | 0.56 | 35.48 | | C |
| ANISOU | 784 | CG2 | AVAL | A | 95 | 4329 | 4438 | 4715 | 72 | −456 | −822 | C |
| ATOM | 785 | CA | BVAL | A | 95 | 4.648 | 9.763 | 24.691 | 0.44 | 34.64 | | C |
| ANISOU | 785 | CA | BVAL | A | 95 | 4198 | 4306 | 4656 | 79 | −546 | −804 | C |
| ATOM | 786 | CB | BVAL | A | 95 | 5.181 | 9.128 | 25.984 | 0.44 | 36.32 | | C |
| ANISOU | 786 | CB | BVAL | A | 95 | 4398 | 4529 | 4873 | 81 | −483 | −815 | C |
| ATOM | 787 | CG1 | BVAL | A | 95 | 6.125 | 10.066 | 26.696 | 0.44 | 36.04 | | C |
| ANISOU | 787 | CG1 | BVAL | A | 95 | 4377 | 4502 | 4816 | 93 | −447 | −810 | C |

TABLE 14-continued

| | | | | | | | | | | | | |
|---|---|---|---|---|---|---|---|---|---|---|---|---|
| ATOM | 788 | CG2 | BVAL | A | 95 | 4.022 | 8.752 | 26.888 | 0.44 | 37.93 | | C |
| ANISOU | 788 | CG2 | BVAL | A | 95 | 4545 | 4723 | 5142 | 87 | −468 | −818 | C |
| ATOM | 789 | N | GLN | A | 96 | 5.455 | 11.978 | 24.168 | 1.00 | 33.44 | | N |
| ANISOU | 789 | N | GLN | A | 96 | 4084 | 4149 | 4472 | 95 | −560 | −775 | N |
| ATOM | 790 | CA | GLN | A | 96 | 6.365 | 12.957 | 23.612 | 1.00 | 35.42 | | C |
| ANISOU | 790 | CA | GLN | A | 96 | 4375 | 4401 | 4684 | 95 | −564 | −755 | C |
| ATOM | 791 | C | GLN | A | 96 | 6.680 | 13.915 | 24.736 | 1.00 | 36.08 | | C |
| ANISOU | 791 | C | GLN | A | 96 | 4444 | 4474 | 4792 | 106 | −530 | −756 | C |
| ATOM | 792 | O | GLN | A | 96 | 5.842 | 14.175 | 25.601 | 1.00 | 34.60 | | O |
| ANISOU | 792 | O | GLN | A | 96 | 4219 | 4272 | 4654 | 122 | −521 | −765 | O |
| ATOM | 793 | CB | GLN | A | 96 | 5.804 | 13.710 | 22.420 | 1.00 | 35.38 | | C |
| ANISOU | 793 | CB | GLN | A | 96 | 4385 | 4383 | 4675 | 99 | −622 | −732 | C |
| ATOM | 794 | CG | GLN | A | 96 | 5.668 | 12.888 | 21.132 | 1.00 | 35.70 | | C |
| ANISOU | 794 | CG | GLN | A | 96 | 4459 | 4435 | 4672 | 87 | −664 | −732 | C |
| ATOM | 795 | CD | GLN | A | 96 | 4.690 | 13.543 | 20.231 | 1.00 | 40.46 | | C |
| ANISOU | 795 | CD | GLN | A | 96 | 5060 | 5025 | 5290 | 94 | −731 | −711 | C |
| ATOM | 796 | OE1 | GLN | A | 96 | 3.491 | 13.343 | 20.385 | 1.00 | 39.70 | | O |
| ANISOU | 796 | OE1 | GLN | A | 96 | 4918 | 4917 | 5248 | 97 | −765 | −716 | O |
| ATOM | 797 | NE2 | GLN | A | 96 | 5.176 | 14.391 | 19.329 | 1.00 | 38.36 | | N |
| ANISOU | 797 | NE2 | GLN | A | 96 | 4836 | 4758 | 4981 | 96 | −750 | −682 | N |
| ATOM | 798 | N | ARG | A | 97 | 7.917 | 14.361 | 24.744 | 1.00 | 37.62 | | N |
| ANISOU | 798 | N | ARG | A | 97 | 4668 | 4674 | 4950 | 98 | −508 | −746 | N |
| ATOM | 799 | C | ARG | A | 97 | 9.397 | 16.185 | 25.133 | 1.00 | 36.57 | | C |
| ANISOU | 799 | C | ARG | A | 97 | 4564 | 4523 | 4806 | 89 | −489 | −724 | C |
| ATOM | 800 | O | ARG | A | 97 | 10.227 | 15.779 | 24.309 | 1.00 | 34.19 | | O |
| ANISOU | 800 | O | ARG | A | 97 | 4288 | 4242 | 4460 | 75 | −486 | −708 | O |
| ATOM | 801 | CA | AARG | A | 97 | 8.431 | 15.221 | 25.786 | 0.53 | 37.39 | | C |
| ANISOU | 801 | CA | AARG | A | 97 | 4635 | 4634 | 4936 | 101 | −480 | −751 | C |
| ATOM | 802 | CB | AARG | A | 97 | 9.110 | 14.369 | 26.854 | 0.53 | 38.32 | | C |
| ANISOU | 802 | CB | AARG | A | 97 | 4746 | 4774 | 5040 | 96 | −436 | −770 | C |
| ATOM | 803 | CG | AARG | A | 97 | 9.840 | 15.077 | 27.938 | 0.53 | 39.79 | | C |
| ANISOU | 803 | CG | AARG | A | 97 | 4936 | 4955 | 5229 | 94 | −411 | −778 | C |
| ATOM | 804 | CD | AARG | A | 97 | 10.572 | 13.979 | 28.701 | 0.53 | 42.86 | | C |
| ANISOU | 804 | CD | AARG | A | 97 | 5320 | 5373 | 5593 | 88 | −376 | −789 | C |
| ATOM | 805 | NE | AARG | A | 97 | 10.369 | 14.045 | 30.130 | 0.53 | 48.24 | | N |
| ANISOU | 805 | NE | AARG | A | 97 | 5988 | 6052 | 6289 | 99 | −351 | −811 | N |
| ATOM | 806 | CZ | AARG | A | 97 | 9.675 | 13.174 | 30.849 | 0.53 | 43.39 | | C |
| ANISOU | 806 | CZ | AARG | A | 97 | 5352 | 5446 | 5687 | 111 | −327 | −824 | C |
| ATOM | 807 | NH1 | AARG | A | 97 | 9.603 | 13.337 | 32.156 | 0.53 | 46.71 | | N |
| ANISOU | 807 | NH1 | AARG | A | 97 | 5769 | 5867 | 6110 | 123 | −301 | −841 | N |
| ATOM | 808 | NH2 | AARG | A | 97 | 9.090 | 12.130 | 30.286 | 0.53 | 39.54 | | N |
| ANISOU | 808 | NH2 | AARG | A | 97 | 4850 | 4967 | 5207 | 111 | −330 | −821 | N |
| ATOM | 809 | CA | BARG | A | 97 | 8.449 | 15.213 | 25.796 | 0.47 | 37.49 | | C |
| ANISOU | 809 | CA | BARG | A | 97 | 4649 | 4648 | 4948 | 101 | −480 | −751 | C |
| ATOM | 810 | CB | BARG | A | 97 | 9.189 | 14.393 | 26.867 | 0.47 | 37.88 | | C |
| ANISOU | 810 | CB | BARG | A | 97 | 4692 | 4719 | 4983 | 95 | −435 | −770 | C |
| ATOM | 811 | CG | BARG | A | 97 | 9.802 | 15.196 | 28.022 | 0.47 | 39.53 | | C |
| ANISOU | 811 | CG | BARG | A | 97 | 4903 | 4920 | 5199 | 95 | −412 | −779 | C |
| ATOM | 812 | CD | BARG | A | 97 | 10.630 | 14.266 | 28.943 | 0.47 | 42.82 | | C |
| ANISOU | 812 | CD | BARG | A | 97 | 5315 | 5363 | 5591 | 88 | −375 | −791 | C |
| ATOM | 813 | NE | BARG | A | 97 | 10.831 | 14.812 | 30.287 | 0.47 | 46.94 | | N |
| ANISOU | 813 | NE | BARG | A | 97 | 5835 | 5878 | 6121 | 94 | −356 | −809 | N |
| ATOM | 814 | CZ | BARG | A | 97 | 11.751 | 14.378 | 31.152 | 0.47 | 44.69 | | C |
| ANISOU | 814 | CZ | BARG | A | 97 | 5554 | 5615 | 5813 | 85 | −334 | −815 | C |
| ATOM | 815 | NH1 | BARG | A | 97 | 11.839 | 14.922 | 32.365 | 0.47 | 46.88 | | N |
| ANISOU | 815 | NH1 | BARG | A | 97 | 5837 | 5884 | 6092 | 91 | −324 | −835 | N |
| ATOM | 816 | NH2 | BARG | A | 97 | 12.575 | 13.397 | 30.808 | 0.47 | 34.25 | | N |
| ANISOU | 816 | NH2 | BARG | A | 97 | 4230 | 4320 | 4463 | 74 | −322 | −802 | N |
| ATOM | 817 | N | MET | A | 98 | 9.271 | 17.454 | 25.482 | 1.00 | 35.85 | | N |
| ANISOU | 817 | N | MET | A | 98 | 4474 | 4401 | 4745 | 96 | −498 | −718 | N |
| ATOM | 818 | CA | MET | A | 98 | 10.168 | 18.461 | 24.963 | 1.00 | 38.69 | | C |
| ANISOU | 818 | CA | MET | A | 98 | 4862 | 4747 | 5091 | 81 | −505 | −690 | C |
| ATOM | 819 | C | MET | A | 98 | 10.564 | 19.345 | 26.138 | 1.00 | 40.92 | | C |
| ANISOU | 819 | C | MET | A | 98 | 5143 | 5005 | 5400 | 79 | −489 | −706 | C |
| ATOM | 820 | O | MET | A | 98 | 9.737 | 19.646 | 27.004 | 1.00 | 37.04 | | O |
| ANISOU | 820 | O | MET | A | 98 | 4636 | 4493 | 4945 | 100 | −486 | −731 | O |
| ATOM | 821 | CB | MET | A | 98 | 9.525 | 19.278 | 23.835 | 1.00 | 40.64 | | C |
| ANISOU | 821 | CB | MET | A | 98 | 5123 | 4970 | 5347 | 90 | −547 | −659 | C |
| ATOM | 822 | CG | MET | A | 98 | 10.441 | 20.323 | 23.184 | 1.00 | 46.46 | | C |
| ANISOU | 822 | CG | MET | A | 98 | 5891 | 5691 | 6071 | 73 | −553 | −620 | C |
| ATOM | 823 | SD | MET | A | 98 | 10.535 | 21.902 | 24.088 | 1.00 | 56.15 | | S |
| ANISOU | 823 | SD | MET | A | 98 | 7120 | 6862 | 7351 | 74 | −555 | −623 | S |
| ATOM | 824 | CE | MET | A | 98 | 8.823 | 22.459 | 24.107 | 1.00 | 54.53 | | C |
| ANISOU | 824 | CE | MET | A | 98 | 6897 | 6621 | 7201 | 114 | −588 | −630 | C |
| ATOM | 825 | N | TYR | A | 99 | 11.827 | 19.753 | 26.168 | 1.00 | 32.14 | | N |
| ANISOU | 825 | N | TYR | A | 99 | 4047 | 3894 | 4271 | 54 | −479 | −691 | N |
| ATOM | 826 | CA | TYR | A | 99 | 12.249 | 20.746 | 27.151 | 1.00 | 28.66 | | C |
| ANISOU | 826 | CA | TYR | A | 99 | 3612 | 3422 | 3855 | 45 | −477 | −704 | C |
| ATOM | 827 | C | TYR | A | 99 | 13.469 | 21.482 | 26.620 | 1.00 | 40.65 | | C |
| ANISOU | 827 | C | TYR | A | 99 | 5148 | 4931 | 5367 | 13 | −483 | −669 | C |

TABLE 14-continued

| | | | | | | | | | | | | | |
|---|---|---|---|---|---|---|---|---|---|---|---|---|---|
| ATOM | 828 | O | TYR | A | 99 | 14.097 | 21.072 | 25.639 | 1.00 | 35.18 | | | O |
| ANISOU | 828 | O | TYR | A | 99 | 4459 | 4265 | 4644 | 0 | −477 | −635 | | O |
| ATOM | 829 | CB | TYR | A | 99 | 12.488 | 20.109 | 28.521 | 1.00 | 28.02 | | | C |
| ANISOU | 829 | CB | TYR | A | 99 | 3518 | 3360 | 3767 | 47 | −451 | −743 | | C |
| ATOM | 830 | CG | TYR | A | 99 | 13.584 | 19.034 | 28.607 | 1.00 | 31.36 | | | C |
| ANISOU | 830 | CG | TYR | A | 99 | 3933 | 3830 | 4153 | 27 | −428 | −737 | | C |
| ATOM | 831 | CD1 | TYR | A | 99 | 14.941 | 19.370 | 28.516 | 1.00 | 39.79 | | | C |
| ANISOU | 831 | CD1 | TYR | A | 99 | 5004 | 4903 | 5210 | −4 | −428 | −714 | | C |
| ATOM | 832 | CD2 | TYR | A | 99 | 13.268 | 17.716 | 28.904 | 1.00 | 35.90 | | | C |
| ANISOU | 832 | CD2 | TYR | A | 99 | 4491 | 4438 | 4710 | 40 | −407 | −753 | | C |
| ATOM | 833 | CE1 | TYR | A | 99 | 15.956 | 18.369 | 28.626 | 1.00 | 33.21 | | | C |
| ANISOU | 833 | CE1 | TYR | A | 99 | 4156 | 4113 | 4348 | −17 | −405 | −705 | | C |
| ATOM | 834 | CE2 | TYR | A | 99 | 14.233 | 16.744 | 29.034 | 1.00 | 37.91 | | | C |
| ANISOU | 834 | CE2 | TYR | A | 99 | 4737 | 4730 | 4935 | 28 | −385 | −747 | | C |
| ATOM | 835 | CZ | TYR | A | 99 | 15.575 | 17.066 | 28.868 | 1.00 | 34.05 | | | C |
| ANISOU | 835 | CZ | TYR | A | 99 | 4251 | 4251 | 4436 | 1 | −384 | −722 | | C |
| ATOM | 836 | OH | TYR | A | 99 | 16.497 | 16.070 | 29.054 | 1.00 | 37.07 | | | O |
| ANISOU | 836 | OH | TYR | A | 99 | 4619 | 4670 | 4795 | −5 | −360 | −715 | | O |
| ATOM | 837 | N | GLY | A | 100 | 13.816 | 22.568 | 27.290 | 1.00 | 40.31 | | | N |
| ANISOU | 837 | N | GLY | A | 100 | 5115 | 4848 | 5352 | 1 | −492 | −677 | | N |
| ATOM | 838 | CA | GLY | A | 100 | 14.849 | 23.434 | 26.772 | 1.00 | 43.62 | | | C |
| ANISOU | 838 | CA | GLY | A | 100 | 5548 | 5248 | 5779 | −33 | −502 | −638 | | C |
| ATOM | 839 | C | GLY | A | 100 | 14.778 | 24.810 | 27.384 | 1.00 | 39.68 | | | C |
| ANISOU | 839 | C | GLY | A | 100 | 5068 | 4686 | 5324 | −40 | −524 | −651 | | C |
| ATOM | 840 | O | GLY | A | 100 | 13.925 | 25.104 | 28.227 | 1.00 | 40.41 | | | O |
| ANISOU | 840 | O | GLY | A | 100 | 5167 | 4750 | 5437 | −13 | −527 | −693 | | O |
| ATOM | 841 | N | CYS | A | 101 | 15.707 | 25.627 | 26.932 | 1.00 | 39.50 | | | N |
| ANISOU | 841 | N | CYS | A | 101 | 5055 | 4639 | 5316 | −75 | −534 | −613 | | N |
| ATOM | 842 | CA | CYS | A | 101 | 15.864 | 26.974 | 27.481 | 1.00 | 35.73 | | | C |
| ANISOU | 842 | CA | CYS | A | 101 | 4599 | 4094 | 4883 | −91 | −558 | −623 | | C |
| ATOM | 843 | C | CYS | A | 101 | 16.187 | 27.948 | 26.361 | 1.00 | 44.59 | | | C |
| ANISOU | 843 | C | CYS | A | 101 | 5735 | 5179 | 6028 | −111 | −572 | −563 | | C |
| ATOM | 844 | O | CYS | A | 101 | 16.769 | 27.540 | 25.403 | 1.00 | 46.44 | | | O |
| ANISOU | 844 | O | CYS | A | 101 | 5958 | 5449 | 6237 | −126 | −558 | −515 | | O |
| ATOM | 845 | CB | CYS | A | 101 | 16.975 | 26.955 | 28.519 | 1.00 | 34.49 | | | C |
| ANISOU | 845 | CB | CYS | A | 101 | 4436 | 3943 | 4727 | −128 | −560 | −646 | | C |
| ATOM | 846 | SG | CYS | A | 101 | 18.497 | 26.144 | 27.979 | 1.00 | 48.24 | | | S |
| ANISOU | 846 | SG | CYS | A | 101 | 6141 | 5745 | 6441 | −170 | −541 | −598 | | S |
| ATOM | 847 | N | ASP | A | 102 | 15.660 | 29.153 | 26.472 | 1.00 | 43.97 | | | N |
| ANISOU | 847 | N | ASP | A | 102 | 5682 | 5029 | 5994 | −103 | −596 | −567 | | N |
| ATOM | 848 | CA | ASP | A | 102 | 16.032 | 30.253 | 25.597 | 1.00 | 44.48 | | | C |
| ANISOU | 848 | CA | ASP | A | 102 | 5765 | 5045 | 6091 | −127 | −612 | −510 | | C |
| ATOM | 849 | C | ASP | A | 102 | 16.967 | 31.199 | 26.342 | 1.00 | 45.00 | | | C |
| ANISOU | 849 | C | ASP | A | 102 | 5842 | 5057 | 6198 | −173 | −630 | −519 | | C |
| ATOM | 850 | O | ASP | A | 102 | 16.826 | 31.416 | 27.546 | 1.00 | 40.86 | | | O |
| ANISOU | 850 | O | ASP | A | 102 | 5330 | 4506 | 5688 | −170 | −641 | −580 | | O |
| ATOM | 851 | CB | ASP | A | 102 | 14.828 | 31.072 | 25.134 | 1.00 | 41.99 | | | C |
| ANISOU | 851 | CB | ASP | A | 102 | 5472 | 4675 | 5806 | −87 | −632 | −500 | | C |
| ATOM | 852 | CG | ASP | A | 102 | 13.727 | 30.225 | 24.500 | 1.00 | 53.77 | | | C |
| ANISOU | 852 | CG | ASP | A | 102 | 6952 | 6212 | 7266 | −40 | −627 | −496 | | C |
| ATOM | 853 | OD1 | ASP | A | 102 | 14.022 | 29.140 | 23.966 | 1.00 | 57.29 | | | O |
| ANISOU | 853 | OD1 | ASP | A | 102 | 7381 | 6726 | 7662 | −45 | −609 | −481 | | O |
| ATOM | 854 | OD2 | ASP | A | 102 | 12.558 | 30.657 | 24.555 | 1.00 | 54.15 | | | O |
| ANISOU | 854 | OD2 | ASP | A | 102 | 7007 | 6225 | 7343 | 3 | −642 | −510 | | O |
| ATOM | 855 | N | VAL | A | 103 | 17.865 | 31.827 | 25.597 | 1.00 | 48.25 | | | N |
| ANISOU | 855 | N | VAL | A | 103 | 6254 | 5449 | 6632 | −216 | −634 | −457 | | N |
| ATOM | 856 | CA | VAL | A | 103 | 18.719 | 32.873 | 26.142 | 1.00 | 48.48 | | | C |
| ANISOU | 856 | CA | VAL | A | 103 | 6293 | 5414 | 6713 | −267 | −658 | −457 | | C |
| ATOM | 857 | C | VAL | A | 103 | 18.692 | 34.041 | 25.163 | 1.00 | 48.06 | | | C |
| ANISOU | 857 | C | VAL | A | 103 | 6263 | 5297 | 6702 | −279 | −670 | −392 | | C |
| ATOM | 858 | O | VAL | A | 103 | 18.506 | 33.854 | 23.960 | 1.00 | 46.28 | | | O |
| ANISOU | 858 | O | VAL | A | 103 | 6033 | 5097 | 6453 | −265 | −654 | −332 | | O |
| ATOM | 859 | CB | VAL | A | 103 | 20.166 | 32.394 | 26.372 | 1.00 | 46.33 | | | C |
| ANISOU | 859 | CB | VAL | A | 103 | 5984 | 5186 | 6433 | −322 | −650 | −439 | | C |
| ATOM | 860 | CG1 | VAL | A | 103 | 20.227 | 31.199 | 27.313 | 1.00 | 44.10 | | | C |
| ANISOU | 860 | CG1 | VAL | A | 103 | 5681 | 4969 | 6107 | −308 | −639 | −496 | | C |
| ATOM | 861 | CG2 | VAL | A | 103 | 20.837 | 32.077 | 25.046 | 1.00 | 42.02 | | | C |
| ANISOU | 861 | CG2 | VAL | A | 103 | 5413 | 4683 | 5870 | −340 | −620 | −355 | | C |
| ATOM | 862 | N | GLY | A | 104 | 18.869 | 35.254 | 25.680 | 1.00 | 42.40 | | | N |
| ANISOU | 862 | N | GLY | A | 104 | 5573 | 4492 | 6046 | −305 | −701 | −405 | | N |
| ATOM | 863 | CA | GLY | A | 104 | 18.955 | 36.417 | 24.825 | 1.00 | 45.08 | | | C |
| ANISOU | 863 | CA | GLY | A | 104 | 5934 | 4761 | 6434 | −324 | −714 | −340 | | C |
| ATOM | 864 | C | GLY | A | 104 | 20.329 | 36.557 | 24.197 | 1.00 | 51.10 | | | C |
| ANISOU | 864 | C | GLY | A | 104 | 6668 | 5536 | 7211 | −390 | −703 | −266 | | C |
| ATOM | 865 | O | GLY | A | 104 | 21.201 | 35.695 | 24.314 | 1.00 | 43.61 | | | O |
| ANISOU | 865 | O | GLY | A | 104 | 5680 | 4658 | 6234 | −416 | −683 | −261 | | O |
| ATOM | 866 | N | ASER | A | 105 | 20.513 | 37.686 | 23.509 | 0.49 | 53.93 | | | N |
| ANISOU | 866 | N | ASER | A | 105 | 7047 | 5824 | 7621 | −414 | −714 | −202 | | N |
| ATOM | 867 | CA | ASER | A | 105 | 21.760 | 37.950 | 22.804 | 0.49 | 54.26 | | | C |
| ANISOU | 867 | CA | ASER | A | 105 | 7061 | 5870 | 7686 | −476 | −698 | −119 | | C |

TABLE 14-continued

| ATOM | 868 | C | ASER | A | 105 | 22.949 | 38.091 | 23.748 | 0.49 | 51.46 | | C |
| ANISOU | 868 | C | ASER | A | 105 | 6677 | 5502 | 7373 | −545 | −718 | −143 | C |
| ATOM | 869 | O | ASER | A | 105 | 24.091 | 38.083 | 23.281 | 0.49 | 51.79 | | O |
| ANISOU | 869 | O | ASER | A | 105 | 6679 | 5566 | 7434 | −599 | −700 | −76 | O |
| ATOM | 870 | CB | ASER | A | 105 | 21.614 | 39.211 | 21.952 | 0.49 | 54.02 | | C |
| ANISOU | 870 | CB | ASER | A | 105 | 7062 | 5755 | 7707 | −487 | −708 | −46 | C |
| ATOM | 871 | OG | ASER | A | 105 | 21.371 | 40.341 | 22.771 | 0.49 | 53.97 | | O |
| ANISOU | 871 | OG | ASER | A | 105 | 7092 | 5642 | 7772 | −501 | −752 | −90 | O |
| ATOM | 872 | N | BSER | A | 105 | 20.514 | 37.689 | 23.511 | 0.51 | 53.83 | | N |
| ANISOU | 872 | N | BSER | A | 105 | 7034 | 5811 | 7609 | −414 | −714 | −203 | N |
| ATOM | 873 | CA | BSER | A | 105 | 21.768 | 37.949 | 22.812 | 0.51 | 54.33 | | C |
| ANISOU | 873 | CA | BSER | A | 105 | 7069 | 5879 | 7695 | −477 | −698 | −119 | C |
| ATOM | 874 | C | BSER | A | 105 | 22.954 | 38.021 | 23.762 | 0.51 | 51.37 | | C |
| ANISOU | 874 | C | BSER | A | 105 | 6663 | 5495 | 7358 | −544 | −717 | −144 | C |
| ATOM | 875 | O | BSER | A | 105 | 24.097 | 37.889 | 23.320 | 0.51 | 52.69 | | O |
| ANISOU | 875 | O | BSER | A | 105 | 6788 | 5693 | 7538 | −595 | −696 | −81 | O |
| ATOM | 876 | CB | BSER | A | 105 | 21.668 | 39.249 | 22.015 | 0.51 | 54.09 | | C |
| ANISOU | 876 | CB | BSER | A | 105 | 7070 | 5761 | 7720 | −491 | −710 | −48 | C |
| ATOM | 877 | OG | BSER | A | 105 | 20.584 | 39.208 | 21.114 | 0.51 | 53.58 | | O |
| ANISOU | 877 | OG | BSER | A | 105 | 7033 | 5705 | 7620 | −429 | −700 | −20 | O |
| ATOM | 878 | N | ASP | A | 106 | 22.717 | 38.230 | 25.048 | 1.00 | 47.17 | | N |
| ANISOU | 878 | N | ASP | A | 106 | 6152 | 4924 | 6845 | −545 | −755 | −232 | N |
| ATOM | 879 | CA | ASP | A | 106 | 23.780 | 38.167 | 26.041 | 1.00 | 43.30 | | C |
| ANISOU | 879 | CA | ASP | A | 106 | 5635 | 4436 | 6380 | −605 | −782 | −266 | C |
| ATOM | 880 | C | ASP | A | 106 | 23.961 | 36.768 | 26.595 | 1.00 | 41.55 | | C |
| ANISOU | 880 | C | ASP | A | 106 | 5378 | 4317 | 6094 | −585 | −763 | −308 | C |
| ATOM | 881 | O | ASP | A | 106 | 24.711 | 36.588 | 27.561 | 1.00 | 39.13 | | O |
| ANISOU | 881 | O | ASP | A | 106 | 5051 | 4019 | 5797 | −625 | −790 | −347 | O |
| ATOM | 882 | CB | ASP | A | 106 | 23.495 | 39.142 | 27.186 | 1.00 | 51.86 | | C |
| ANISOU | 882 | CB | ASP | A | 106 | 6770 | 5422 | 7512 | −617 | −837 | −342 | C |
| ATOM | 883 | CG | ASP | A | 106 | 22.107 | 38.936 | 27.801 | 1.00 | 55.42 | | C |
| ANISOU | 883 | CG | ASP | A | 106 | 7268 | 5867 | 7924 | −539 | −836 | −425 | C |
| ATOM | 884 | OD1 | ASP | A | 106 | 21.443 | 37.921 | 27.474 | 1.00 | 46.48 | | O |
| ANISOU | 884 | OD1 | ASP | A | 106 | 6120 | 4813 | 6728 | −483 | −799 | −428 | O |
| ATOM | 885 | OD2 | ASP | A | 106 | 21.691 | 39.795 | 28.610 | 1.00 | 57.63 | | C |
| ANISOU | 885 | OD2 | ASP | A | 106 | 7599 | 6060 | 8237 | −535 | −872 | −486 | O |
| ATOM | 886 | N | TRP | A | 107 | 23.244 | 35.786 | 26.038 | 1.00 | 44.50 | | N |
| ANISOU | 886 | N | TRP | A | 107 | 5745 | 4763 | 6401 | −525 | −722 | −305 | N |
| ATOM | 887 | CA | TRP | A | 107 | 23.292 | 34.375 | 26.435 | 1.00 | 46.51 | | C |
| ANISOU | 887 | CA | TRP | A | 107 | 5968 | 5112 | 6590 | −499 | −698 | −340 | C |
| ATOM | 888 | C | TRP | A | 107 | 22.836 | 34.156 | 27.861 | 1.00 | 39.49 | | C |
| ANISOU | 888 | C | TRP | A | 107 | 5101 | 4216 | 5687 | −480 | −727 | −437 | C |
| ATOM | 889 | O | TRP | A | 107 | 23.132 | 33.130 | 28.465 | 1.00 | 40.37 | | O |
| ANISOU | 889 | O | TRP | A | 107 | 5186 | 4395 | 5759 | −474 | −718 | −468 | O |
| ATOM | 890 | CB | TRP | A | 107 | 24.681 | 33.767 | 26.234 | 1.00 | 47.62 | | C |
| ANISOU | 890 | CB | TRP | A | 107 | 6047 | 5314 | 6731 | −547 | −678 | −291 | C |
| ATOM | 891 | CG | TRP | A | 107 | 25.119 | 33.738 | 24.811 | 1.00 | 52.54 | | C |
| ANISOU | 891 | CG | TRP | A | 107 | 6648 | 5964 | 7352 | −555 | −634 | −195 | C |
| ATOM | 892 | CD1 | TRP | A | 107 | 24.432 | 34.204 | 23.730 | 1.00 | 50.31 | | C |
| ANISOU | 892 | CD1 | TRP | A | 107 | 6397 | 5655 | 7062 | −527 | −617 | −149 | C |
| ATOM | 893 | CD2 | TRP | A | 107 | 26.359 | 33.224 | 24.305 | 1.00 | 45.73 | | C |
| ANISOU | 893 | CD2 | TRP | A | 107 | 5725 | 5158 | 6490 | −590 | −598 | −130 | C |
| ATOM | 894 | NE1 | TRP | A | 107 | 25.158 | 34.009 | 22.596 | 1.00 | 48.27 | | N |
| ANISOU | 894 | NE1 | TRP | A | 107 | 6111 | 5436 | 6793 | −543 | −572 | −62 | N |
| ATOM | 895 | CE2 | TRP | A | 107 | 26.344 | 33.405 | 22.918 | 1.00 | 45.58 | | C |
| ANISOU | 895 | CE2 | TRP | A | 107 | 5712 | 5147 | 6460 | −580 | −555 | −49 | C |
| ATOM | 896 | CE3 | TRP | A | 107 | 27.479 | 32.619 | 24.898 | 1.00 | 48.51 | | C |
| ANISOU | 896 | CE3 | TRP | A | 107 | 6020 | 5558 | 6854 | −626 | −597 | −130 | C |
| ATOM | 897 | CZ2 | TRP | A | 107 | 27.418 | 33.024 | 22.101 | 1.00 | 52.06 | | C |
| ANISOU | 897 | CZ2 | TRP | A | 107 | 6484 | 6019 | 7277 | −604 | −504 | 31 | C |
| ATOM | 898 | CZ3 | TRP | A | 107 | 28.517 | 32.220 | 24.091 | 1.00 | 47.24 | | C |
| ANISOU | 898 | CZ3 | TRP | A | 107 | 5804 | 5448 | 6697 | −648 | −549 | −50 | C |
| ATOM | 899 | CH2 | TRP | A | 107 | 28.487 | 32.433 | 22.712 | 1.00 | 46.82 | | C |
| ANISOU | 899 | CH2 | TRP | A | 107 | 5759 | 5400 | 6630 | −636 | −499 | 29 | C |
| ATOM | 900 | N | ARG | A | 108 | 22.048 | 35.068 | 28.371 | 1.00 | 38.99 | | N |
| ANISOU | 900 | N | ARG | A | 108 | 5090 | 4074 | 5652 | −463 | −755 | −484 | N |
| ATOM | 901 | CA | ARG | A | 108 | 21.515 | 34.881 | 29.727 | 1.00 | 42.46 | | C |
| ANISOU | 901 | CA | ARG | A | 108 | 5559 | 4505 | 6069 | −436 | −775 | −578 | C |
| ATOM | 902 | C | ARG | A | 108 | 20.128 | 34.259 | 29.611 | 1.00 | 42.47 | | C |
| ANISOU | 902 | C | ARG | A | 108 | 5575 | 4537 | 6026 | −357 | −743 | −607 | C |
| ATOM | 903 | O | ARG | A | 108 | 19.458 | 34.517 | 28.663 | 1.00 | 38.88 | | O |
| ANISOU | 903 | O | ARG | A | 108 | 5126 | 4067 | 5579 | −328 | −728 | −568 | O |
| ATOM | 904 | CB | ARG | A | 108 | 21.456 | 36.233 | 30.429 | 1.00 | 47.76 | | C |
| ANISOU | 904 | CB | ARG | A | 108 | 6282 | 5068 | 6795 | −459 | −821 | −619 | C |
| ATOM | 905 | CG | ARG | A | 108 | 22.771 | 36.663 | 31.054 | 1.00 | 49.22 | | C |
| ANISOU | 905 | CG | ARG | A | 108 | 6457 | 5228 | 7017 | −538 | −867 | −622 | C |
| ATOM | 906 | CD | ARG | A | 108 | 22.521 | 37.534 | 32.260 | 1.00 | 65.09 | | C |
| ANISOU | 906 | CD | ARG | A | 108 | 8531 | 7154 | 9048 | −544 | −914 | −706 | C |
| ATOM | 907 | NE | ARG | A | 108 | 21.385 | 38.365 | 31.966 | 1.00 | 75.23 | | N |
| ANISOU | 907 | NE | ARG | A | 108 | 9866 | 8361 | 10355 | −495 | −905 | −719 | N |

TABLE 14-continued

| | | | | | | | | | | | | |
|---|---|---|---|---|---|---|---|---|---|---|---|---|
| ATOM | 908 | CZ | ARG | A | 108 | 20.359 | 38.524 | 32.770 | 1.00 | 82.60 | | C |
| ANISOU | 908 | CZ | ARG | A | 108 | 10853 | 9264 | 11269 | −438 | −903 | −796 | C |
| ATOM | 909 | NH1 | ARG | A | 108 | 19.355 | 39.292 | 32.398 | 1.00 | 71.61 | | N |
| ANISOU | 909 | NH1 | ARG | A | 108 | 9499 | 7803 | 9908 | −391 | −892 | −797 | N |
| ATOM | 910 | NH2 | ARG | A | 108 | 20.352 | 37.929 | 33.947 | 1.00 | 81.20 | | N |
| ANISOU | 910 | NH2 | ARG | A | 108 | 10689 | 9122 | 11039 | −426 | −910 | −869 | N |
| ATOM | 911 | N | PHE | A | 109 | 19.770 | 33.440 | 30.570 | 1.00 | 44.77 | | N |
| ANISOU | 911 | N | PHE | A | 109 | 5867 | 4872 | 6273 | −327 | −735 | −670 | N |
| ATOM | 912 | CA | PHE | A | 109 | 18.453 | 32.822 | 30.647 | 1.00 | 46.00 | | C |
| ANISOU | 912 | CA | PHE | A | 109 | 6031 | 5055 | 6392 | −256 | −706 | −703 | C |
| ATOM | 913 | C | PHE | A | 109 | 17.332 | 33.826 | 30.403 | 1.00 | 48.67 | | C |
| ANISOU | 913 | C | PHE | A | 109 | 6409 | 5316 | 6768 | −215 | −712 | −712 | C |
| ATOM | 914 | O | PHE | A | 109 | 17.291 | 34.895 | 31.014 | 1.00 | 43.86 | | O |
| ANISOU | 914 | O | PHE | A | 109 | 5842 | 4626 | 6198 | −224 | −738 | −746 | O |
| ATOM | 915 | CB | PHE | A | 109 | 18.288 | 32.175 | 32.025 | 1.00 | 46.24 | | C |
| ANISOU | 915 | CB | PHE | A | 109 | 6071 | 5115 | 6383 | −238 | −704 | −779 | C |
| ATOM | 916 | CG | PHE | A | 109 | 16.956 | 31.508 | 32.228 | 1.00 | 46.97 | | C |
| ANISOU | 916 | CG | PHE | A | 109 | 6166 | 5235 | 6444 | −168 | −671 | −812 | C |
| ATOM | 917 | CD1 | PHE | A | 109 | 16.697 | 30.249 | 31.695 | 1.00 | 48.99 | | C |
| ANISOU | 917 | CD1 | PHE | A | 109 | 6381 | 5571 | 6660 | −145 | −638 | −788 | C |
| ATOM | 918 | CD2 | PHE | A | 109 | 15.948 | 32.147 | 32.935 | 1.00 | 43.70 | | C |
| ANISOU | 918 | CD2 | PHE | A | 109 | 5795 | 4766 | 6044 | −124 | −670 | −867 | C |
| ATOM | 919 | CE1 | PHE | A | 109 | 15.421 | 29.645 | 31.889 | 1.00 | 45.53 | | C |
| ANISOU | 919 | CE1 | PHE | A | 109 | 5941 | 5155 | 6203 | −85 | −610 | −816 | C |
| ATOM | 920 | CE2 | PHE | A | 109 | 14.702 | 31.542 | 33.137 | 1.00 | 42.12 | | C |
| ANISOU | 920 | CE2 | PHE | A | 109 | 5589 | 4592 | 5823 | −60 | −635 | −892 | C |
| ATOM | 921 | CZ | PHE | A | 109 | 14.449 | 30.298 | 32.622 | 1.00 | 39.35 | | C |
| ANISOU | 921 | CZ | PHE | A | 109 | 5193 | 4320 | 5439 | −44 | −608 | −866 | C |
| ATOM | 922 | N | LEU | A | 110 | 16.441 | 33.485 | 29.479 | 1.00 | 45.13 | | N |
| ANISOU | 922 | N | LEU | A | 110 | 5947 | 4892 | 6310 | −171 | −689 | −678 | N |
| ATOM | 923 | CA | LEU | A | 110 | 15.179 | 34.189 | 29.264 | 1.00 | 51.69 | | C |
| ANISOU | 923 | CA | LEU | A | 110 | 6804 | 5665 | 7172 | −118 | −690 | −686 | C |
| ATOM | 924 | C | LEU | A | 110 | 13.998 | 33.376 | 29.735 | 1.00 | 55.30 | | C |
| ANISOU | 924 | C | LEU | A | 110 | 7250 | 6163 | 7599 | −55 | −664 | −730 | C |
| ATOM | 925 | O | LEU | A | 110 | 13.142 | 33.886 | 30.456 | 1.00 | 59.06 | | O |
| ANISOU | 925 | O | LEU | A | 110 | 7753 | 6591 | 8097 | −13 | −661 | −779 | O |
| ATOM | 926 | CB | LEU | A | 110 | 14.978 | 34.525 | 27.782 | 1.00 | 46.70 | | C |
| ANISOU | 926 | CB | LEU | A | 110 | 6162 | 5024 | 6556 | −114 | −693 | −606 | C |
| ATOM | 927 | CG | LEU | A | 110 | 15.643 | 35.768 | 27.217 | 1.00 | 50.45 | | C |
| ANISOU | 927 | CG | LEU | A | 110 | 6660 | 5424 | 7084 | −157 | −717 | −555 | C |
| ATOM | 928 | CD1 | LEU | A | 110 | 15.534 | 35.782 | 25.724 | 1.00 | 46.68 | | C |
| ANISOU | 928 | CD1 | LEU | A | 110 | 6170 | 4964 | 6601 | −153 | −712 | −470 | C |
| ATOM | 929 | CD2 | LEU | A | 110 | 15.049 | 37.036 | 27.816 | 1.00 | 45.75 | | C |
| ANISOU | 929 | CD2 | LEU | A | 110 | 6113 | 4725 | 6547 | −136 | −739 | −592 | C |
| ATOM | 930 | N | ARG | A | 111 | 13.898 | 32.145 | 29.257 | 1.00 | 53.20 | | N |
| ANISOU | 930 | N | ARG | A | 111 | 6945 | 5980 | 7289 | −46 | −642 | −710 | N |
| ATOM | 931 | CA | ARG | A | 111 | 12.798 | 31.276 | 29.726 | 1.00 | 50.36 | | C |
| ANISOU | 931 | CA | ARG | A | 111 | 6569 | 5661 | 6905 | 8 | −617 | −749 | C |
| ATOM | 932 | C | ARG | A | 111 | 13.160 | 29.812 | 29.527 | 1.00 | 49.85 | | C |
| ANISOU | 932 | C | ARG | A | 111 | 6466 | 5688 | 6787 | −3 | −596 | −739 | C |
| ATOM | 933 | O | ARG | A | 111 | 14.087 | 29.511 | 28.804 | 1.00 | 46.58 | | O |
| ANISOU | 933 | O | ARG | A | 111 | 6038 | 5305 | 6355 | −41 | −599 | −695 | O |
| ATOM | 934 | CB | ARG | A | 111 | 11.442 | 31.585 | 29.087 | 1.00 | 54.09 | | C |
| ANISOU | 934 | CB | ARG | A | 111 | 7036 | 6109 | 7408 | 63 | −617 | −732 | C |
| ATOM | 935 | CG | ARG | A | 111 | 11.261 | 31.079 | 27.677 | 1.00 | 59.62 | | C |
| ANISOU | 935 | CG | ARG | A | 111 | 7710 | 6851 | 8092 | 64 | −623 | −668 | C |
| ATOM | 936 | CD | ARG | A | 111 | 10.291 | 31.969 | 26.959 | 1.00 | 68.28 | | C |
| ANISOU | 936 | CD | ARG | A | 111 | 8815 | 7893 | 9234 | 101 | −643 | −637 | C |
| ATOM | 937 | NE | ARG | A | 111 | 11.044 | 32.325 | 25.783 | 1.00 | 81.88 | | N |
| ANISOU | 937 | NE | ARG | A | 111 | 10547 | 9612 | 10951 | 64 | −662 | −569 | N |
| ATOM | 938 | CZ | ARG | A | 111 | 11.545 | 33.513 | 25.526 | 1.00 | 80.67 | | C |
| ANISOU | 938 | CZ | ARG | A | 111 | 10424 | 9392 | 10836 | 41 | −680 | −539 | C |
| ATOM | 939 | NH1 | ARG | A | 111 | 11.322 | 34.515 | 26.353 | 1.00 | 76.64 | | N |
| ANISOU | 939 | NH1 | ARG | A | 111 | 9941 | 8804 | 10374 | 53 | −687 | −576 | N |
| ATOM | 940 | NH2 | ARG | A | 111 | 12.228 | 33.707 | 24.420 | 1.00 | 77.90 | | N |
| ANISOU | 940 | NH2 | ARG | A | 111 | 10078 | 9048 | 10474 | 7 | −689 | −470 | N |
| ATOM | 941 | N | GLY | A | 112 | 12.437 | 28.976 | 30.236 | 1.00 | 38.31 | | N |
| ANISOU | 941 | N | GLY | A | 112 | 4991 | 4262 | 5304 | 33 | −572 | −780 | N |
| ATOM | 942 | CA | GLY | A | 112 | 12.572 | 27.542 | 30.123 | 1.00 | 38.42 | | C |
| ANISOU | 942 | CA | GLY | A | 112 | 4971 | 4355 | 5272 | 31 | −551 | −775 | C |
| ATOM | 943 | C | GLY | A | 112 | 11.223 | 26.887 | 29.891 | 1.00 | 47.70 | | C |
| ANISOU | 943 | C | GLY | A | 112 | 6122 | 5553 | 6448 | 80 | −535 | −780 | C |
| ATOM | 944 | O | GLY | A | 112 | 10.166 | 27.471 | 30.122 | 1.00 | 44.52 | | O |
| ANISOU | 944 | O | GLY | A | 112 | 5724 | 5111 | 6082 | 120 | −535 | −797 | O |
| ATOM | 945 | N | GLU | A | 113 | 11.282 | 25.645 | 29.435 | 1.00 | 45.23 | | N |
| ANISOU | 945 | N | GLU | A | 113 | 5780 | 5303 | 6101 | 76 | −523 | −765 | N |
| ATOM | 946 | CA | GLU | A | 113 | 10.105 | 24.945 | 28.948 | 1.00 | 42.93 | | C |
| ANISOU | 946 | CA | GLU | A | 113 | 5463 | 5036 | 5814 | 111 | −518 | −759 | C |
| ATOM | 947 | C | GLU | A | 113 | 10.233 | 23.487 | 29.312 | 1.00 | 43.13 | | C |
| ANISOU | 947 | C | GLU | A | 113 | 5464 | 5123 | 5800 | 107 | −492 | −775 | C |

TABLE 14-continued

| | | | | | | | | | | | | |
|---|---|---|---|---|---|---|---|---|---|---|---|---|
| ATOM | 948 | O | GLU | A | 113 | 11.324 | 22.908 | 29.220 | 1.00 | 34.28 | | O |
| ANISOU | 948 | O | GLU | A | 113 | 4343 | 4036 | 4644 | 75 | −486 | −764 | O |
| ATOM | 949 | CB | GLU | A | 113 | 9.983 | 25.007 | 27.420 | 1.00 | 48.85 | | C |
| ANISOU | 949 | CB | GLU | A | 113 | 6210 | 5791 | 6562 | 105 | −544 | −706 | C |
| ATOM | 950 | CG | GLU | A | 113 | 9.930 | 26.343 | 26.856 | 1.00 | 63.59 | | C |
| ANISOU | 950 | CG | GLU | A | 113 | 8100 | 7600 | 8462 | 106 | −571 | −676 | C |
| ATOM | 951 | CD | GLU | A | 113 | 11.180 | 26.685 | 26.108 | 1.00 | 69.41 | | C |
| ANISOU | 951 | CD | GLU | A | 113 | 8856 | 8337 | 9179 | 63 | −580 | −634 | C |
| ATOM | 952 | OE1 | GLU | A | 113 | 11.896 | 25.761 | 25.630 | 1.00 | 74.78 | | O |
| ANISOU | 952 | OE1 | GLU | A | 113 | 9527 | 9070 | 9814 | 40 | −568 | −617 | O |
| ATOM | 953 | OE2 | GLU | A | 113 | 11.442 | 27.892 | 25.978 | 1.00 | 68.42 | | O |
| ANISOU | 953 | OE2 | GLU | A | 113 | 8754 | 8156 | 9085 | 52 | −596 | −615 | O |
| ATOM | 954 | N | HIS | A | 114 | 9.113 | 22.882 | 29.665 | 1.00 | 36.34 | | N |
| ANISOU | 954 | N | HIS | A | 114 | 4578 | 4275 | 4952 | 141 | −477 | −794 | N |
| ATOM | 955 | CA | HIS | A | 114 | 9.102 | 21.441 | 29.816 | 1.00 | 34.40 | | C |
| ANISOU | 955 | CA | HIS | A | 114 | 4308 | 4084 | 4677 | 137 | −455 | −801 | C |
| ATOM | 956 | C | HIS | A | 114 | 7.671 | 21.003 | 29.593 | 1.00 | 41.27 | | C |
| ANISOU | 956 | C | HIS | A | 114 | 5146 | 4958 | 5578 | 171 | −455 | −801 | C |
| ATOM | 957 | O | HIS | A | 114 | 6.813 | 21.379 | 30.382 | 1.00 | 37.24 | | O |
| ANISOU | 957 | O | HIS | A | 114 | 4624 | 4424 | 5100 | 203 | −438 | −824 | O |
| ATOM | 958 | CB | HIS | A | 114 | 9.548 | 21.037 | 31.189 | 1.00 | 36.56 | | C |
| ANISOU | 958 | CB | HIS | A | 114 | 4587 | 4373 | 4930 | 136 | −424 | −837 | C |
| ATOM | 959 | CG | HIS | A | 114 | 9.603 | 19.559 | 31.380 | 1.00 | 48.99 | | C |
| ANISOU | 959 | CG | HIS | A | 114 | 6139 | 6000 | 6477 | 132 | −400 | −840 | C |
| ATOM | 960 | ND1 | HIS | A | 114 | 8.470 | 18.793 | 31.558 | 1.00 | 51.41 | | N |
| ANISOU | 960 | ND1 | HIS | A | 114 | 6415 | 6318 | 6800 | 158 | −382 | −848 | N |
| ATOM | 961 | CD2 | HIS | A | 114 | 10.653 | 18.703 | 31.433 | 1.00 | 48.84 | | C |
| ANISOU | 961 | CD2 | HIS | A | 114 | 6120 | 6017 | 6418 | 107 | −391 | −834 | C |
| ATOM | 962 | CE1 | HIS | A | 114 | 8.817 | 17.525 | 31.696 | 1.00 | 49.52 | | C |
| ANISOU | 962 | CE1 | HIS | A | 114 | 6164 | 6120 | 6533 | 146 | −364 | −847 | C |
| ATOM | 963 | NE2 | HIS | A | 114 | 10.138 | 17.447 | 31.645 | 1.00 | 53.99 | | N |
| ANISOU | 963 | NE2 | HIS | A | 114 | 6748 | 6701 | 7063 | 118 | −368 | −840 | N |
| ATOM | 964 | N | GLN | A | 115 | 7.412 | 20.244 | 28.537 | 1.00 | 40.76 | | N |
| ANISOU | 964 | N | GLN | A | 115 | 5066 | 4919 | 5504 | 163 | −474 | −777 | N |
| ATOM | 965 | CA | GLN | A | 115 | 6.042 | 19.857 | 28.277 | 1.00 | 42.93 | | C |
| ANISOU | 965 | CA | GLN | A | 115 | 5303 | 5193 | 5814 | 189 | −484 | −774 | C |
| ATOM | 966 | C | GLN | A | 115 | 5.993 | 18.425 | 27.792 | 1.00 | 43.78 | | C |
| ANISOU | 966 | C | GLN | A | 115 | 5395 | 5344 | 5897 | 174 | −485 | −770 | C |
| ATOM | 967 | O | GLN | A | 115 | 6.979 | 17.872 | 27.295 | 1.00 | 34.87 | | O |
| ANISOU | 967 | O | GLN | A | 115 | 4289 | 4240 | 4721 | 147 | −486 | −762 | O |
| ATOM | 968 | CB | GLN | A | 115 | 5.412 | 20.798 | 27.285 | 1.00 | 42.58 | | C |
| ANISOU | 968 | CB | GLN | A | 115 | 5261 | 5118 | 5801 | 203 | −527 | −745 | C |
| ATOM | 969 | CG | GLN | A | 115 | 6.210 | 21.065 | 26.067 | 1.00 | 52.85 | | C |
| ANISOU | 969 | CG | GLN | A | 115 | 6594 | 6421 | 7065 | 177 | −559 | −711 | C |
| ATOM | 970 | CD | GLN | A | 115 | 5.655 | 22.277 | 25.379 | 1.00 | 68.89 | | C |
| ANISOU | 970 | CD | GLN | A | 115 | 8633 | 8411 | 9132 | 196 | −596 | −681 | C |
| ATOM | 971 | OE1 | GLN | A | 115 | 5.324 | 23.253 | 26.045 | 1.00 | 69.99 | | O |
| ANISOU | 971 | OE1 | GLN | A | 115 | 8772 | 8508 | 9313 | 218 | −588 | −692 | O |
| ATOM | 972 | NE2 | GLN | A | 115 | 5.503 | 22.216 | 24.053 | 1.00 | 76.86 | | N |
| ANISOU | 972 | NE2 | GLN | A | 115 | 9652 | 9428 | 10122 | 189 | −638 | −644 | N |
| ATOM | 973 | N | TYR | A | 116 | 4.815 | 17.837 | 27.964 | 1.00 | 29.70 | | N |
| ANISOU | 973 | N | TYR | A | 116 | 3570 | 3564 | 4149 | 192 | −484 | −776 | N |
| ATOM | 974 | CA | TYR | A | 116 | 4.643 | 16.411 | 27.828 | 1.00 | 33.46 | | C |
| ANISOU | 974 | CA | TYR | A | 116 | 4027 | 4073 | 4613 | 178 | −479 | −781 | C |
| ATOM | 975 | C | TYR | A | 116 | 3.306 | 16.154 | 27.130 | 1.00 | 39.31 | | C |
| ANISOU | 975 | C | TYR | A | 116 | 4729 | 4809 | 5400 | 188 | −517 | −767 | C |
| ATOM | 976 | O | TYR | A | 116 | 2.310 | 16.795 | 27.477 | 1.00 | 36.43 | | O |
| ANISOU | 976 | O | TYR | A | 116 | 4330 | 4422 | 5090 | 217 | −518 | −764 | O |
| ATOM | 977 | CB | TYR | A | 116 | 4.692 | 15.809 | 29.202 | 1.00 | 39.39 | | C |
| ANISOU | 977 | CB | TYR | A | 116 | 4763 | 4837 | 5366 | 185 | −425 | −806 | C |
| ATOM | 978 | CG | TYR | A | 116 | 4.832 | 14.334 | 29.263 | 1.00 | 48.26 | | C |
| ANISOU | 978 | CG | TYR | A | 116 | 5876 | 5990 | 6471 | 167 | −410 | −811 | C |
| ATOM | 979 | CD1 | TYR | A | 116 | 3.738 | 13.512 | 28.986 | 1.00 | 61.07 | | C |
| ANISOU | 979 | CD1 | TYR | A | 116 | 7458 | 7616 | 8131 | 168 | −422 | −806 | C |
| ATOM | 980 | CD2 | TYR | A | 116 | 6.028 | 13.749 | 29.641 | 1.00 | 49.07 | | C |
| ANISOU | 980 | CD2 | TYR | A | 116 | 6005 | 6114 | 6524 | 150 | −384 | −818 | C |
| ATOM | 981 | CE1 | TYR | A | 116 | 3.827 | 12.145 | 29.071 | 1.00 | 64.78 | | C |
| ANISOU | 981 | CE1 | TYR | A | 116 | 7919 | 8104 | 8589 | 151 | −408 | −812 | C |
| ATOM | 982 | CE2 | TYR | A | 116 | 6.134 | 12.385 | 29.733 | 1.00 | 55.72 | | C |
| ANISOU | 982 | CE2 | TYR | A | 116 | 6839 | 6979 | 7354 | 138 | −367 | −822 | C |
| ATOM | 983 | CZ | TYR | A | 116 | 5.031 | 11.593 | 29.452 | 1.00 | 66.58 | | C |
| ANISOU | 983 | CZ | TYR | A | 116 | 8178 | 8351 | 8766 | 138 | −378 | −819 | C |
| ATOM | 984 | OH | TYR | A | 116 | 5.130 | 10.231 | 29.536 | 1.00 | 64.12 | | O |
| ANISOU | 984 | OH | TYR | A | 116 | 7862 | 8054 | 8447 | 124 | −363 | −823 | O |
| ATOM | 985 | N | ALA | A | 117 | 3.314 | 15.291 | 26.110 | 1.00 | 34.20 | | N |
| ANISOU | 985 | N | ALA | A | 117 | 4088 | 4179 | 4728 | 167 | −552 | −759 | N |
| ATOM | 986 | CA | ALA | A | 117 | 2.096 | 14.923 | 25.389 | 1.00 | 38.57 | | C |
| ANISOU | 986 | CA | ALA | A | 117 | 4605 | 4729 | 5321 | 169 | −600 | −747 | C |
| ATOM | 987 | C | ALA | A | 117 | 1.928 | 13.416 | 25.378 | 1.00 | 42.19 | | C |
| ANISOU | 987 | C | ALA | A | 117 | 5049 | 5207 | 5774 | 147 | −596 | −761 | C |

TABLE 14-continued

| | | | | | | | | | | | | |
|---|---|---|---|---|---|---|---|---|---|---|---|---|
| ATOM | 988 | O | ALA | A | 117 | 2.912 | 12.650 | 25.341 | 1.00 | 34.43 | | O |
| ANISOU | 988 | O | ALA | A | 117 | 4101 | 4242 | 4738 | 128 | −575 | −773 | O |
| ATOM | 989 | CB | ALA | A | 117 | 2.111 | 15.418 | 23.958 | 1.00 | 35.43 | | C |
| ANISOU | 989 | CB | ALA | A | 117 | 4238 | 4326 | 4899 | 162 | −664 | −722 | C |
| ATOM | 990 | N | TYR | A | 118 | 0.669 | 13.003 | 25.414 | 1.00 | 35.99 | | N |
| ANISOU | 990 | N | TYR | A | 118 | 4209 | 4417 | 5051 | 151 | −617 | −757 | N |
| ATOM | 991 | CA | TYR | A | 118 | 0.266 | 11.588 | 25.311 | 1.00 | 35.73 | | C |
| ANISOU | 991 | CA | TYR | A | 118 | 4154 | 4393 | 5029 | 127 | −626 | −767 | C |
| ATOM | 992 | C | TYR | A | 118 | −0.664 | 11.467 | 24.115 | 1.00 | 41.67 | | C |
| ANISOU | 992 | C | TYR | A | 118 | 4889 | 5137 | 5805 | 115 | −708 | −753 | C |
| ATOM | 993 | O | TYR | A | 118 | −1.654 | 12.166 | 24.042 | 1.00 | 39.28 | | O |
| ANISOU | 993 | O | TYR | A | 118 | 4540 | 4822 | 5561 | 134 | −737 | −734 | O |
| ATOM | 994 | CB | TYR | A | 118 | −0.462 | 11.110 | 26.550 | 1.00 | 31.23 | | C |
| ANISOU | 994 | CB | TYR | A | 118 | 3523 | 3821 | 4520 | 136 | −575 | −771 | C |
| ATOM | 995 | CG | TYR | A | 118 | −0.821 | 9.652 | 26.539 | 1.00 | 39.46 | | C |
| ANISOU | 995 | CG | TYR | A | 118 | 4544 | 4869 | 5581 | 108 | −578 | −778 | C |
| ATOM | 996 | CD1 | TYR | A | 118 | 0.103 | 8.679 | 26.236 | 1.00 | 36.02 | | C |
| ANISOU | 996 | CD1 | TYR | A | 118 | 4157 | 4442 | 5087 | 84 | −574 | −795 | C |
| ATOM | 997 | CD2 | TYR | A | 118 | −2.095 | 9.237 | 26.838 | 1.00 | 42.89 | | C |
| ANISOU | 997 | CD2 | TYR | A | 118 | 4906 | 5294 | 6097 | 107 | −585 | −767 | C |
| ATOM | 998 | CE1 | TYR | A | 118 | −0.218 | 7.340 | 26.270 | 1.00 | 32.91 | | C |
| ANISOU | 998 | CE1 | TYR | A | 118 | 3746 | 4043 | 4713 | 58 | −575 | −803 | C |
| ATOM | 999 | CE2 | TYR | A | 118 | −2.442 | 7.907 | 26.861 | 1.00 | 36.65 | | C |
| ANISOU | 999 | CE2 | TYR | A | 118 | 4093 | 4501 | 5331 | 77 | −588 | −771 | C |
| ATOM | 1000 | CZ | TYR | A | 118 | −1.502 | 6.952 | 26.574 | 1.00 | 36.27 | | C |
| ANISOU | 1000 | CZ | TYR | A | 118 | 4101 | 4457 | 5222 | 52 | −585 | −791 | C |
| ATOM | 1001 | OH | TYR | A | 118 | −1.857 | 5.657 | 26.618 | 1.00 | 35.78 | | O |
| ANISOU | 1001 | OH | TYR | A | 118 | 4020 | 4386 | 5190 | 23 | −588 | −796 | O |
| ATOM | 1002 | N | ASP | A | 119 | −0.314 | 10.559 | 23.228 | 1.00 | 36.46 | | N |
| ANISOU | 1002 | N | ASP | A | 119 | 4269 | 4486 | 5099 | 87 | −743 | −764 | N |
| ATOM | 1003 | CA | ASP | A | 119 | −1.000 | 10.346 | 21.967 | 1.00 | 40.01 | | C |
| ANISOU | 1003 | CA | ASP | A | 119 | 4722 | 4931 | 5550 | 70 | −830 | −757 | C |
| ATOM | 1004 | C | ASP | A | 119 | −1.209 | 11.659 | 21.246 | 1.00 | 45.29 | | C |
| ANISOU | 1004 | C | ASP | A | 119 | 5401 | 5594 | 6213 | 91 | −877 | −730 | C |
| ATOM | 1005 | O | ASP | A | 119 | −2.247 | 11.901 | 20.644 | 1.00 | 44.99 | | O |
| ANISOU | 1005 | O | ASP | A | 119 | 5329 | 5547 | 6218 | 92 | −945 | −712 | O |
| ATOM | 1006 | CB | ASP | A | 119 | −2.326 | 9.593 | 22.188 | 1.00 | 42.11 | | C |
| ANISOU | 1006 | CB | ASP | A | 119 | 4914 | 5186 | 5901 | 56 | −860 | −756 | C |
| ATOM | 1007 | CG | ASP | A | 119 | −2.080 | 8.127 | 22.488 | 1.00 | 45.67 | | C |
| ANISOU | 1007 | CG | ASP | A | 119 | 5372 | 5637 | 6344 | 27 | −835 | −782 | C |
| ATOM | 1008 | OD1 | ASP | A | 119 | −1.045 | 7.622 | 21.966 | 1.00 | 38.07 | | O |
| ANISOU | 1008 | OD1 | ASP | A | 119 | 4482 | 4681 | 5301 | 14 | −830 | −801 | O |
| ATOM | 1009 | OD2 | ASP | A | 119 | −2.874 | 7.491 | 23.241 | 1.00 | 39.79 | | O |
| ANISOU | 1009 | OD2 | ASP | A | 119 | 4562 | 4885 | 5674 | 18 | −815 | −779 | O |
| ATOM | 1010 | N | GLY | A | 120 | −0.219 | 12.530 | 21.342 | 1.00 | 40.13 | | N |
| ANISOU | 1010 | N | GLY | A | 120 | 4792 | 4942 | 5513 | 106 | −841 | −723 | N |
| ATOM | 1011 | CA | GLY | A | 120 | −0.260 | 13.741 | 20.572 | 1.00 | 41.84 | | C |
| ANISOU | 1011 | CA | GLY | A | 120 | 5031 | 5151 | 5717 | 123 | −882 | −694 | C |
| ATOM | 1012 | C | GLY | A | 120 | −1.079 | 14.851 | 21.174 | 1.00 | 43.36 | | C |
| ANISOU | 1012 | C | GLY | A | 120 | 5167 | 5321 | 5985 | 156 | −878 | −674 | C |
| ATOM | 1013 | O | GLY | A | 120 | −1.250 | 15.884 | 20.531 | 1.00 | 41.79 | | O |
| ANISOU | 1013 | O | GLY | A | 120 | 4981 | 5109 | 5787 | 173 | −918 | −645 | O |
| ATOM | 1014 | N | LYS | A | 121 | −1.583 | 14.682 | 22.380 | 1.00 | 40.25 | | N |
| ANISOU | 1014 | N | LYS | A | 121 | 4716 | 4923 | 5655 | 169 | −828 | −685 | N |
| ATOM | 1015 | CA | LYS | A | 121 | −2.295 | 15.738 | 23.066 | 1.00 | 45.10 | | C |
| ANISOU | 1015 | CA | LYS | A | 121 | 5282 | 5514 | 6340 | 207 | −809 | −670 | C |
| ATOM | 1016 | C | LYS | A | 121 | −1.509 | 16.183 | 24.295 | 1.00 | 43.42 | | C |
| ANISOU | 1016 | C | LYS | A | 121 | 5087 | 5296 | 6115 | 222 | −725 | −690 | C |
| ATOM | 1017 | O | LYS | A | 121 | −1.084 | 15.341 | 25.087 | 1.00 | 39.47 | | O |
| ANISOU | 1017 | O | LYS | A | 121 | 4588 | 4812 | 5599 | 209 | −673 | −714 | O |
| ATOM | 1018 | CB | LYS | A | 121 | −3.682 | 15.252 | 23.482 | 1.00 | 41.84 | | C |
| ANISOU | 1018 | CB | LYS | A | 121 | 4781 | 5098 | 6018 | 215 | −817 | −664 | C |
| ATOM | 1019 | CG | LYS | A | 121 | −4.527 | 16.327 | 24.099 | 1.00 | 59.82 | | C |
| ANISOU | 1019 | CG | LYS | A | 121 | 7004 | 7352 | 8373 | 261 | −797 | −646 | C |
| ATOM | 1020 | CD | LYS | A | 121 | −5.939 | 15.834 | 24.391 | 1.00 | 76.47 | | C |
| ANISOU | 1020 | CD | LYS | A | 121 | 9016 | 9461 | 10579 | 269 | −808 | −632 | C |
| ATOM | 1021 | CE | LYS | A | 121 | −6.703 | 16.912 | 25.167 | 1.00 | 85.02 | | C |
| ANISOU | 1021 | CE | LYS | A | 121 | 10046 | 10520 | 11739 | 324 | −767 | −616 | C |
| ATOM | 1022 | NZ | LYS | A | 121 | −6.329 | 18.229 | 24.585 | 1.00 | 91.31 | | N |
| ANISOU | 1022 | NZ | LYS | A | 121 | 10889 | 11292 | 12511 | 349 | −797 | −601 | N |
| ATOM | 1023 | N | ASP | A | 122 | −1.389 | 17.500 | 24.477 | 1.00 | 41.71 | | N |
| ANISOU | 1023 | N | ASP | A | 122 | 4884 | 5054 | 5910 | 251 | −715 | −679 | N |
| ATOM | 1024 | CA | ASP | A | 122 | −0.822 | 18.079 | 25.693 | 1.00 | 45.97 | | C |
| ANISOU | 1024 | CA | ASP | A | 122 | 5438 | 5581 | 6447 | 270 | −645 | −700 | C |
| ATOM | 1025 | C | ASP | A | 122 | −1.298 | 17.302 | 26.893 | 1.00 | 47.80 | | C |
| ANISOU | 1025 | C | ASP | A | 122 | 5624 | 5825 | 6712 | 277 | −587 | −722 | C |
| ATOM | 1026 | O | ASP | A | 122 | −2.493 | 17.085 | 27.054 | 1.00 | 43.89 | | O |
| ANISOU | 1026 | O | ASP | A | 122 | 5064 | 5327 | 6286 | 295 | −591 | −711 | O |
| ATOM | 1027 | CB | ASP | A | 122 | −1.241 | 19.537 | 25.828 | 1.00 | 46.05 | | C |
| ANISOU | 1027 | CB | ASP | A | 122 | 5444 | 5552 | 6503 | 309 | −647 | −685 | C |

TABLE 14-continued

| | | | | | | | | | | | | |
|---|---|---|---|---|---|---|---|---|---|---|---|---|
| ATOM | 1028 | CG | ASP | A | 122 | −0.370 | 20.453 | 25.019 | 1.00 | 59.52 | | C |
| ANISOU | 1028 | CG | ASP | A | 122 | 7211 | 7241 | 8164 | 300 | −679 | −667 | C |
| ATOM | 1029 | OD1 | ASP | A | 122 | 0.882 | 20.317 | 25.065 | 1.00 | 71.13 | | O |
| ANISOU | 1029 | OD1 | ASP | A | 122 | 8733 | 8722 | 9569 | 273 | −658 | −679 | O |
| ATOM | 1030 | OD2 | ASP | A | 122 | −0.911 | 21.328 | 24.341 | 1.00 | 67.38 | | O |
| ANISOU | 1030 | OD2 | ASP | A | 122 | 8201 | 8210 | 9191 | 321 | −723 | −636 | O |
| ATOM | 1031 | N | TYR | A | 123 | −0.353 | 16.840 | 27.720 | 1.00 | 33.26 | | N |
| ANISOU | 1031 | N | TYR | A | 123 | 3814 | 3999 | 4824 | 264 | −533 | −748 | N |
| ATOM | 1032 | CA | TYR | A | 123 | −0.728 | 16.103 | 28.919 | 1.00 | 39.71 | | C |
| ANISOU | 1032 | CA | TYR | A | 123 | 4596 | 4828 | 5664 | 272 | −472 | −765 | C |
| ATOM | 1033 | C | TYR | A | 123 | −0.460 | 16.896 | 30.194 | 1.00 | 43.71 | | C |
| ANISOU | 1033 | C | TYR | A | 123 | 5120 | 5321 | 6168 | 303 | −410 | −786 | C |
| ATOM | 1034 | O | TYR | A | 123 | −1.350 | 17.038 | 31.031 | 1.00 | 37.12 | | O |
| ANISOU | 1034 | O | TYR | A | 123 | 4243 | 4477 | 5383 | 337 | −368 | −788 | O |
| ATOM | 1035 | CB | TYR | A | 123 | 0.013 | 14.762 | 28.961 | 1.00 | 30.86 | | C |
| ANISOU | 1035 | CB | TYR | A | 123 | 3494 | 3738 | 4493 | 235 | −460 | −777 | C |
| ATOM | 1036 | CG | TYR | A | 123 | −0.287 | 13.996 | 30.198 | 1.00 | 38.32 | | C |
| ANISOU | 1036 | CG | TYR | A | 123 | 4409 | 4696 | 5456 | 243 | −396 | −789 | C |
| ATOM | 1037 | CD1 | TYR | A | 123 | −1.491 | 13.318 | 30.328 | 1.00 | 36.21 | | C |
| ANISOU | 1037 | CD1 | TYR | A | 123 | 4074 | 4430 | 5254 | 246 | −392 | −776 | C |
| ATOM | 1038 | CD2 | TYR | A | 123 | 0.635 | 13.939 | 31.255 | 1.00 | 34.94 | | C |
| ANISOU | 1038 | CD2 | TYR | A | 123 | 4016 | 4277 | 4980 | 245 | −341 | −809 | C |
| ATOM | 1039 | CE1 | TYR | A | 123 | −1.777 | 12.595 | 31.461 | 1.00 | 34.41 | | C |
| ANISOU | 1039 | CE1 | TYR | A | 123 | 3818 | 4214 | 5043 | 253 | −328 | −781 | C |
| ATOM | 1040 | CE2 | TYR | A | 123 | 0.358 | 13.236 | 32.381 | 1.00 | 35.56 | | C |
| ANISOU | 1040 | CE2 | TYR | A | 123 | 4073 | 4370 | 5069 | 254 | −283 | −816 | C |
| ATOM | 1041 | CZ | TYR | A | 123 | −0.874 | 12.560 | 32.483 | 1.00 | 37.65 | | C |
| ANISOU | 1041 | CZ | TYR | A | 123 | 4270 | 4635 | 5399 | 259 | −272 | −800 | C |
| ATOM | 1042 | OH | TYR | A | 123 | −1.177 | 11.848 | 33.604 | 1.00 | 33.62 | | O |
| ANISOU | 1042 | OH | TYR | A | 123 | 3736 | 4137 | 4900 | 267 | −208 | −800 | O |
| ATOM | 1043 | N | ILE | A | 124 | 0.777 | 17.373 | 30.384 | 1.00 | 39.35 | | N |
| ANISOU | 1043 | N | ILE | A | 124 | 4629 | 4765 | 5556 | 291 | −401 | −801 | N |
| ATOM | 1044 | CA | ILE | A | 124 | 1.160 | 18.204 | 31.522 | 1.00 | 36.36 | | C |
| ANISOU | 1044 | CA | ILE | A | 124 | 4280 | 4369 | 5166 | 315 | −355 | −826 | C |
| ATOM | 1045 | C | ILE | A | 124 | 2.363 | 19.038 | 31.080 | 1.00 | 39.55 | | C |
| ANISOU | 1045 | C | ILE | A | 124 | 4744 | 4757 | 5525 | 295 | −383 | −827 | C |
| ATOM | 1046 | O | ILE | A | 124 | 3.229 | 18.552 | 30.353 | 1.00 | 40.43 | | O |
| ANISOU | 1046 | O | ILE | A | 124 | 4879 | 4890 | 5594 | 259 | −409 | −817 | O |
| ATOM | 1047 | CB | ILE | A | 124 | 1.467 | 17.333 | 32.771 | 1.00 | 38.70 | | C |
| ANISOU | 1047 | CB | ILE | A | 124 | 4579 | 4692 | 5433 | 313 | −294 | −848 | C |
| ATOM | 1048 | CG1 | ILE | A | 124 | 1.449 | 18.190 | 34.055 | 1.00 | 36.80 | | C |
| ANISOU | 1048 | CG1 | ILE | A | 124 | 4363 | 4431 | 5190 | 349 | −244 | −876 | C |
| ATOM | 1049 | CG2 | ILE | A | 124 | 2.838 | 16.541 | 32.590 | 1.00 | 36.15 | | C |
| ANISOU | 1049 | CG2 | ILE | A | 124 | 4295 | 4399 | 5041 | 270 | −303 | −852 | C |
| ATOM | 1050 | CD1 | ILE | A | 124 | 1.573 | 17.403 | 35.403 | 1.00 | 36.25 | | C |
| ANISOU | 1050 | CD1 | ILE | A | 124 | 4296 | 4388 | 5088 | 356 | −180 | −896 | C |
| ATOM | 1051 | N | ALA | A | 125 | 2.386 | 20.312 | 31.457 | 1.00 | 38.77 | | N |
| ANISOU | 1051 | N | ALA | A | 125 | 4670 | 4619 | 5441 | 319 | −377 | −838 | N |
| ATOM | 1052 | CA | ALA | A | 125 | 3.499 | 21.186 | 31.132 | 1.00 | 45.17 | | C |
| ANISOU | 1052 | CA | ALA | A | 125 | 5535 | 5409 | 6220 | 298 | −401 | −837 | C |
| ATOM | 1053 | C | ALA | A | 125 | 3.790 | 22.030 | 32.349 | 1.00 | 45.63 | | C |
| ANISOU | 1053 | C | ALA | A | 125 | 5627 | 5436 | 6272 | 317 | −366 | −873 | C |
| ATOM | 1054 | O | ALA | A | 125 | 2.921 | 22.270 | 33.170 | 1.00 | 37.66 | | O |
| ANISOU | 1054 | O | ALA | A | 125 | 4602 | 4411 | 5295 | 358 | −330 | −892 | O |
| ATOM | 1055 | CB | ALA | A | 125 | 3.265 | 22.152 | 29.939 | 1.00 | 39.61 | | C |
| ANISOU | 1055 | CB | ALA | A | 125 | 4836 | 4670 | 5543 | 302 | −453 | −805 | C |
| ATOM | 1056 | N | LEU | A | 126 | 5.023 | 22.456 | 32.433 | 1.00 | 39.57 | | N |
| ANISOU | 1056 | N | LEU | A | 126 | 4908 | 4662 | 5466 | 286 | −379 | −881 | N |
| ATOM | 1057 | CA | LEU | A | 126 | 5.428 | 23.375 | 33.487 | 1.00 | 36.49 | | C |
| ANISOU | 1057 | CA | LEU | A | 126 | 4561 | 4237 | 5068 | 297 | −360 | −917 | C |
| ATOM | 1058 | C | LEU | A | 126 | 4.840 | 24.710 | 33.067 | 1.00 | 39.59 | | C |
| ANISOU | 1058 | C | LEU | A | 126 | 4963 | 4567 | 5512 | 325 | −380 | −909 | C |
| ATOM | 1059 | O | LEU | A | 126 | 4.920 | 25.033 | 31.910 | 1.00 | 40.51 | | O |
| ANISOU | 1059 | O | LEU | A | 126 | 5075 | 4672 | 5644 | 310 | −421 | −873 | O |
| ATOM | 1060 | CB | LEU | A | 126 | 6.945 | 23.438 | 33.381 | 1.00 | 37.10 | | C |
| ANISOU | 1060 | CB | LEU | A | 126 | 4675 | 4322 | 5098 | 247 | −383 | −916 | C |
| ATOM | 1061 | CG | LEU | A | 126 | 7.746 | 23.663 | 34.646 | 1.00 | 45.23 | | C |
| ANISOU | 1061 | CG | LEU | A | 126 | 5746 | 5347 | 6092 | 237 | −366 | −957 | C |
| ATOM | 1062 | CD1 | LEU | A | 126 | 7.169 | 22.920 | 35.815 | 1.00 | 43.02 | | C |
| ANISOU | 1062 | CD1 | LEU | A | 126 | 5457 | 5095 | 5794 | 267 | −317 | −987 | C |
| ATOM | 1063 | CD2 | LEU | A | 126 | 9.179 | 23.258 | 34.422 | 1.00 | 41.02 | | C |
| ANISOU | 1063 | CD2 | LEU | A | 126 | 5225 | 4844 | 5517 | 184 | −388 | −943 | C |
| ATOM | 1064 | N | LYS | A | 127 | 4.371 | 25.514 | 34.017 | 1.00 | 41.30 | | N |
| ANISOU | 1064 | N | LYS | A | 127 | 5201 | 4742 | 5749 | 364 | −351 | −944 | N |
| ATOM | 1065 | CA | LYS | A | 127 | 3.963 | 26.875 | 33.716 | 1.00 | 49.40 | | C |
| ANISOU | 1065 | CA | LYS | A | 127 | 6245 | 5699 | 6824 | 391 | −369 | −941 | C |
| ATOM | 1066 | C | LYS | A | 127 | 5.197 | 27.737 | 33.461 | 1.00 | 54.14 | | C |
| ANISOU | 1066 | C | LYS | A | 127 | 6900 | 6263 | 7406 | 349 | −406 | −940 | C |
| ATOM | 1067 | O | LYS | A | 127 | 6.321 | 27.359 | 33.777 | 1.00 | 56.72 | | O |
| ANISOU | 1067 | O | LYS | A | 127 | 7251 | 6616 | 7684 | 305 | −412 | −952 | O |

TABLE 14-continued

| | | | | | | | | | | | | |
|---|---|---|---|---|---|---|---|---|---|---|---|---|
| ATOM | 1068 | CB | LYS | A | 127 | 3.115 | 27.452 | 34.847 | 1.00 | 48.43 | | C |
| ANISOU | 1068 | CB | LYS | A | 127 | 6135 | 5540 | 6728 | 451 | −320 | −982 | C |
| ATOM | 1069 | CG | LYS | A | 127 | 1.739 | 26.781 | 34.976 | 1.00 | 48.30 | | C |
| ANISOU | 1069 | CG | LYS | A | 127 | 6052 | 5550 | 6751 | 498 | −281 | −971 | C |
| ATOM | 1070 | CD | LYS | A | 127 | 0.787 | 27.632 | 35.814 | 1.00 | 61.56 | | C |
| ANISOU | 1070 | CD | LYS | A | 127 | 7739 | 7180 | 8472 | 567 | −233 | −1001 | C |
| ATOM | 1071 | CE | LYS | A | 127 | −0.083 | 26.800 | 36.760 | 1.00 | 70.01 | | C |
| ANISOU | 1071 | CE | LYS | A | 127 | 8769 | 8288 | 9543 | 606 | −163 | −1016 | C |
| ATOM | 1072 | NZ | LYS | A | 127 | −1.475 | 26.545 | 36.235 | 1.00 | 77.56 | | N |
| ANISOU | 1072 | NZ | LYS | A | 127 | 9642 | 9252 | 10577 | 647 | −152 | −976 | N |
| ATOM | 1073 | N | GLU | A | 128 | 4.975 | 28.914 | 32.880 | 1.00 | 59.48 | | N |
| ANISOU | 1073 | N | GLU | A | 128 | 7594 | 6877 | 8129 | 362 | −433 | −922 | N |
| ATOM | 1074 | CA | GLU | A | 128 | 6.102 | 29.718 | 32.449 | 1.00 | 56.98 | | C |
| ANISOU | 1074 | CA | GLU | A | 128 | 7321 | 6525 | 7805 | 317 | −472 | −909 | C |
| ATOM | 1075 | C | GLU | A | 128 | 6.949 | 30.195 | 33.620 | 1.00 | 52.75 | | C |
| ANISOU | 1075 | C | GLU | A | 128 | 6840 | 5960 | 7242 | 298 | −463 | −962 | C |
| ATOM | 1076 | O | GLU | A | 128 | 8.141 | 30.429 | 33.433 | 1.00 | 55.62 | | O |
| ANISOU | 1076 | O | GLU | A | 128 | 7229 | 6318 | 7586 | 244 | −492 | −954 | O |
| ATOM | 1077 | CB | GLU | A | 128 | 5.629 | 30.901 | 31.602 | 1.00 | 70.02 | | C |
| ANISOU | 1077 | CB | GLU | A | 128 | 8980 | 8108 | 9515 | 337 | −502 | −875 | C |
| ATOM | 1078 | CG | GLU | A | 128 | 6.688 | 31.327 | 30.563 | 1.00 | 77.54 | | C |
| ANISOU | 1078 | CG | GLU | A | 128 | 9953 | 9050 | 10460 | 282 | −547 | −828 | C |
| ATOM | 1079 | CD | GLU | A | 128 | 6.835 | 32.820 | 30.461 | 0.00 | 84.98 | | C |
| ANISOU | 1079 | CD | GLU | A | 128 | 10939 | 9900 | 11448 | 286 | −569 | −822 | C |
| ATOM | 1080 | OE1 | GLU | A | 128 | 7.982 | 33.327 | 30.509 | 1.00 | 86.03 | | O |
| ANISOU | 1080 | OE1 | GLU | A | 128 | 11109 | 10007 | 11571 | 235 | −588 | −822 | O |
| ATOM | 1081 | OE2 | GLU | A | 128 | 5.789 | 33.482 | 30.337 | 1.00 | 90.10 | | O |
| ANISOU | 1081 | OE2 | GLU | A | 128 | 11583 | 10502 | 12150 | 339 | −567 | −817 | O |
| ATOM | 1082 | N | ASP | A | 129 | 6.390 | 30.277 | 34.832 | 1.00 | 47.56 | | N |
| ANISOU | 1082 | N | ASP | A | 129 | 6201 | 5289 | 6581 | 340 | −423 | −1016 | N |
| ATOM | 1083 | CA | ASP | A | 129 | 7.234 | 30.574 | 35.981 | 1.00 | 50.66 | | C |
| ANISOU | 1083 | CA | ASP | A | 129 | 6651 | 5664 | 6933 | 319 | −420 | −1071 | C |
| ATOM | 1084 | C | ASP | A | 129 | 8.094 | 29.387 | 36.407 | 1.00 | 47.55 | | C |
| ANISOU | 1084 | C | ASP | A | 129 | 6246 | 5346 | 6474 | 278 | −415 | −1076 | C |
| ATOM | 1085 | O | ASP | A | 129 | 8.912 | 29.547 | 37.317 | 1.00 | 50.94 | | O |
| ANISOU | 1085 | O | ASP | A | 129 | 6720 | 5769 | 6865 | 253 | −423 | −1116 | O |
| ATOM | 1086 | CB | ASP | A | 129 | 6.396 | 31.038 | 37.176 | 1.00 | 54.49 | | C |
| ANISOU | 1086 | CB | ASP | A | 129 | 7170 | 6112 | 7422 | 380 | −374 | −1130 | C |
| ATOM | 1087 | CG | ASP | A | 129 | 5.644 | 29.892 | 37.864 | 1.00 | 69.81 | | C |
| ANISOU | 1087 | CG | ASP | A | 129 | 9074 | 8116 | 9333 | 417 | −317 | −1143 | C |
| ATOM | 1088 | OD1 | ASP | A | 129 | 5.435 | 28.805 | 37.266 | 1.00 | 71.20 | | O |
| ANISOU | 1088 | OD1 | ASP | A | 129 | 9189 | 8356 | 9506 | 406 | −313 | −1103 | O |
| ATOM | 1089 | OD2 | ASP | A | 129 | 5.233 | 30.086 | 39.026 | 1.00 | 79.99 | | O |
| ANISOU | 1089 | OD2 | ASP | A | 129 | 10399 | 9391 | 10604 | 459 | −273 | −1195 | O |
| ATOM | 1090 | N | LEU | A | 130 | 7.904 | 28.206 | 35.803 | 1.00 | 39.66 | | N |
| ANISOU | 1090 | N | LEU | A | 130 | 5192 | 4415 | 5463 | 271 | −406 | −1039 | N |
| ATOM | 1091 | CA | LEU | A | 130 | 8.644 | 26.983 | 36.132 | 1.00 | 43.85 | | C |
| ANISOU | 1091 | CA | LEU | A | 130 | 5707 | 5017 | 5938 | 239 | −399 | −1038 | C |
| ATOM | 1092 | C | LEU | A | 130 | 8.462 | 26.552 | 37.570 | 1.00 | 42.31 | | C |
| ANISOU | 1092 | C | LEU | A | 130 | 5533 | 4842 | 5701 | 263 | −358 | −1088 | C |
| ATOM | 1093 | O | LEU | A | 130 | 9.269 | 25.781 | 38.105 | 1.00 | 45.80 | | O |
| ANISOU | 1093 | O | LEU | A | 130 | 5979 | 5329 | 6092 | 234 | −358 | −1095 | O |
| ATOM | 1094 | CB | LEU | A | 130 | 10.140 | 27.136 | 35.843 | 1.00 | 41.42 | | C |
| ANISOU | 1094 | CB | LEU | A | 130 | 5417 | 4713 | 5607 | 174 | −441 | −1023 | C |
| ATOM | 1095 | CG | LEU | A | 130 | 10.521 | 27.660 | 34.464 | 1.00 | 41.23 | | C |
| ANISOU | 1095 | CG | LEU | A | 130 | 5381 | 4667 | 5617 | 144 | −478 | −970 | C |
| ATOM | 1096 | CD1 | LEU | A | 130 | 12.062 | 27.654 | 34.311 | 1.00 | 38.39 | | C |
| ANISOU | 1096 | CD1 | LEU | A | 130 | 5030 | 4322 | 5236 | 80 | −509 | −953 | C |
| ATOM | 1097 | CD2 | LEU | A | 130 | 9.903 | 26.860 | 33.332 | 1.00 | 45.12 | | C |
| ANISOU | 1097 | CD2 | LEU | A | 130 | 5825 | 5201 | 6119 | 157 | −472 | −924 | C |
| ATOM | 1098 | N | ARG | A | 131 | 7.433 | 27.031 | 38.238 | 1.00 | 39.91 | | N |
| ANISOU | 1098 | N | ARG | A | 131 | 5244 | 4505 | 5415 | 319 | −322 | −1120 | N |
| ATOM | 1099 | CA | ARG | A | 131 | 7.233 | 26.668 | 39.623 | 1.00 | 50.33 | | C |
| ANISOU | 1099 | CA | ARG | A | 131 | 6591 | 5842 | 6688 | 347 | −277 | −1167 | C |
| ATOM | 1100 | C | ARG | A | 131 | 5.991 | 25.829 | 39.837 | 1.00 | 47.15 | | C |
| ANISOU | 1100 | C | ARG | A | 131 | 6140 | 5476 | 6298 | 397 | −217 | −1157 | C |
| ATOM | 1101 | O | ARG | A | 131 | 5.806 | 25.318 | 40.942 | 1.00 | 46.36 | | O |
| ANISOU | 1101 | O | ARG | A | 131 | 6056 | 5403 | 6154 | 420 | −172 | −1185 | O |
| ATOM | 1102 | CB | ARG | A | 131 | 7.153 | 27.923 | 40.513 | 1.00 | 54.87 | | C |
| ANISOU | 1102 | CB | ARG | A | 131 | 7238 | 6348 | 7261 | 374 | −272 | −1224 | C |
| ATOM | 1103 | CG | ARG | A | 131 | 8.421 | 28.760 | 40.493 | 1.00 | 53.92 | | C |
| ANISOU | 1103 | CG | ARG | A | 131 | 7171 | 6187 | 7129 | 320 | −333 | −1240 | C |
| ATOM | 1104 | CD | ARG | A | 131 | 8.503 | 29.768 | 41.651 | 1.00 | 42.95 | | C |
| ANISOU | 1104 | CD | ARG | A | 131 | 5867 | 4737 | 5716 | 339 | −330 | −1310 | C |
| ATOM | 1105 | NE | ARG | A | 131 | 9.903 | 30.060 | 41.833 | 1.00 | 58.24 | | N |
| ANISOU | 1105 | NE | ARG | A | 131 | 7842 | 6665 | 7624 | 272 | −392 | −1322 | N |
| ATOM | 1106 | CZ | ARG | A | 131 | 10.647 | 29.501 | 42.769 | 1.00 | 50.53 | | C |
| ANISOU | 1106 | CZ | ARG | A | 131 | 6892 | 5729 | 6579 | 248 | −401 | −1349 | C |
| ATOM | 1107 | NH1 | ARG | A | 131 | 10.086 | 28.673 | 43.628 | 1.00 | 53.95 | | N |
| ANISOU | 1107 | NH1 | ARG | A | 131 | 7326 | 6211 | 6961 | 289 | −347 | −1368 | N |

TABLE 14-continued

| | | | | | | | | | | | | |
|---|---|---|---|---|---|---|---|---|---|---|---|---|
| ATOM | 1108 | NH2 | ARG | A | 131 | 11.937 | 29.800 | 42.867 | 0.58 | 55.81 | | N |
| ANISOU | 1108 | NH2 | ARG | A | 131 | 7586 | 6388 | 7230 | 184 | −464 | −1355 | N |
| ATOM | 1109 | N | SER | A | 132 | 5.137 | 25.684 | 38.822 | 1.00 | 50.86 | | N |
| ANISOU | 1109 | N | SER | A | 132 | 6551 | 5947 | 6826 | 413 | −218 | −1115 | N |
| ATOM | 1110 | CA | SER | A | 132 | 3.959 | 24.845 | 38.929 | 1.00 | 44.65 | | C |
| ANISOU | 1110 | CA | SER | A | 132 | 5707 | 5194 | 6063 | 453 | −168 | −1099 | C |
| ATOM | 1111 | C | SER | A | 132 | 3.613 | 24.268 | 37.556 | 1.00 | 47.45 | | C |
| ANISOU | 1111 | C | SER | A | 132 | 5997 | 5573 | 6460 | 434 | −200 | −1044 | C |
| ATOM | 1112 | O | SER | A | 132 | 4.199 | 24.631 | 36.530 | 1.00 | 44.94 | | O |
| ANISOU | 1112 | O | SER | A | 132 | 5683 | 5241 | 6152 | 399 | −254 | −1019 | O |
| ATOM | 1113 | CB | SER | A | 132 | 2.785 | 25.642 | 39.504 | 1.00 | 56.91 | | C |
| ANISOU | 1113 | CB | SER | A | 132 | 7263 | 6702 | 7656 | 522 | −120 | −1123 | C |
| ATOM | 1114 | OG | SER | A | 132 | 2.415 | 26.701 | 38.624 | 1.00 | 58.74 | | O |
| ANISOU | 1114 | OG | SER | A | 132 | 7490 | 6877 | 7951 | 537 | −154 | −1107 | O |
| ATOM | 1115 | N | TRP | A | 133 | 2.600 | 23.404 | 37.559 | 1.00 | 41.37 | | N |
| ANISOU | 1115 | N | TRP | A | 133 | 5166 | 4835 | 5716 | 459 | −165 | −1025 | N |
| ATOM | 1116 | CA | TRP | A | 133 | 2.216 | 22.529 | 36.460 | 1.00 | 36.97 | | C |
| ANISOU | 1116 | CA | TRP | A | 133 | 4547 | 4310 | 5188 | 439 | −191 | −979 | C |
| ATOM | 1117 | C | TRP | A | 133 | 0.798 | 22.847 | 36.036 | 1.00 | 42.98 | | C |
| ANISOU | 1117 | C | TRP | A | 133 | 5252 | 5050 | 6027 | 484 | −183 | −958 | C |
| ATOM | 1118 | O | TRP | A | 133 | −0.044 | 23.175 | 36.868 | 1.00 | 39.00 | | O |
| ANISOU | 1118 | O | TRP | A | 133 | 4739 | 4530 | 5550 | 536 | −130 | −975 | O |
| ATOM | 1119 | CB | TRP | A | 133 | 2.225 | 21.063 | 36.881 | 1.00 | 35.84 | | C |
| ANISOU | 1119 | CB | TRP | A | 133 | 4375 | 4226 | 5016 | 423 | −161 | −973 | C |
| ATOM | 1120 | CG | TRP | A | 133 | 3.573 | 20.624 | 37.381 | 1.00 | 43.54 | | C |
| ANISOU | 1120 | CG | TRP | A | 133 | 5398 | 5229 | 5918 | 384 | −166 | −990 | C |
| ATOM | 1121 | CD1 | TRP | A | 133 | 3.991 | 20.578 | 38.679 | 1.00 | 46.29 | | C |
| ANISOU | 1121 | CD1 | TRP | A | 133 | 5787 | 5585 | 6215 | 393 | −128 | −1024 | C |
| ATOM | 1122 | CD2 | TRP | A | 133 | 4.700 | 20.228 | 36.584 | 1.00 | 42.24 | | C |
| ANISOU | 1122 | CD2 | TRP | A | 133 | 5244 | 5083 | 5721 | 332 | −213 | −972 | C |
| ATOM | 1123 | NE1 | TRP | A | 133 | 5.298 | 20.162 | 38.735 | 1.00 | 37.88 | | N |
| ANISOU | 1123 | NE1 | TRP | A | 133 | 4752 | 4545 | 5094 | 348 | −155 | −1026 | N |
| ATOM | 1124 | CE2 | TRP | A | 133 | 5.747 | 19.918 | 37.468 | 1.00 | 38.45 | | C |
| ANISOU | 1124 | CE2 | TRP | A | 133 | 4803 | 4625 | 5180 | 311 | −202 | −994 | C |
| ATOM | 1125 | CE3 | TRP | A | 133 | 4.915 | 20.087 | 35.208 | 1.00 | 39.44 | | C |
| ANISOU | 1125 | CE3 | TRP | A | 133 | 4871 | 4733 | 5383 | 303 | −261 | −939 | C |
| ATOM | 1126 | CZ2 | TRP | A | 133 | 7.015 | 19.494 | 37.014 | 1.00 | 35.11 | | C |
| ANISOU | 1126 | CZ2 | TRP | A | 133 | 4394 | 4227 | 4721 | 264 | −236 | −980 | C |
| ATOM | 1127 | CZ3 | TRP | A | 133 | 6.138 | 19.661 | 34.764 | 1.00 | 39.38 | | C |
| ANISOU | 1127 | CZ3 | TRP | A | 133 | 4881 | 4748 | 5332 | 258 | −288 | −928 | C |
| ATOM | 1128 | CH2 | TRP | A | 133 | 7.186 | 19.378 | 35.658 | 1.00 | 36.44 | | C |
| ANISOU | 1128 | CH2 | TRP | A | 133 | 4541 | 4397 | 4908 | 240 | −275 | −947 | C |
| ATOM | 1129 | N | THR | A | 134 | 0.535 | 22.726 | 34.749 | 1.00 | 44.17 | | N |
| ANISOU | 1129 | N | THR | A | 134 | 5367 | 5204 | 6212 | 467 | −235 | −918 | N |
| ATOM | 1130 | CA | THR | A | 134 | −0.830 | 22.764 | 34.253 | 1.00 | 55.13 | | C |
| ANISOU | 1130 | CA | THR | A | 134 | 6688 | 6583 | 7677 | 502 | −238 | −889 | C |
| ATOM | 1131 | C | THR | A | 134 | −1.210 | 21.362 | 33.845 | 1.00 | 54.17 | | C |
| ANISOU | 1131 | C | THR | A | 134 | 6509 | 6512 | 7561 | 477 | −245 | −864 | C |
| ATOM | 1132 | O | THR | A | 134 | −0.490 | 20.744 | 33.042 | 1.00 | 54.64 | | O |
| ANISOU | 1132 | O | THR | A | 134 | 6580 | 6596 | 7584 | 429 | −289 | −850 | O |
| ATOM | 1133 | CB | THR | A | 134 | −0.968 | 23.711 | 33.069 | 1.00 | 70.04 | | C |
| ANISOU | 1133 | CB | THR | A | 134 | 8577 | 8433 | 9602 | 505 | −300 | −860 | C |
| ATOM | 1134 | OG1 | THR | A | 134 | 0.110 | 23.469 | 32.162 | 1.00 | 75.29 | | O |
| ANISOU | 1134 | OG1 | THR | A | 134 | 9275 | 9115 | 10218 | 449 | −353 | −845 | O |
| ATOM | 1135 | CG2 | THR | A | 134 | −0.881 | 25.127 | 33.537 | 1.00 | 79.94 | | C |
| ANISOU | 1135 | CG2 | THR | A | 134 | 9877 | 9626 | 10871 | 540 | −287 | −883 | C |
| ATOM | 1136 | N | ALA | A | 135 | −2.336 | 20.891 | 34.394 | 1.00 | 50.55 | | N |
| ANISOU | 1136 | N | ALA | A | 135 | 5990 | 6066 | 7152 | 510 | −199 | −857 | N |
| ATOM | 1137 | CA | ALA | A | 135 | −2.887 | 19.552 | 34.218 | 1.00 | 55.92 | | C |
| ANISOU | 1137 | CA | ALA | A | 135 | 6609 | 6787 | 7852 | 489 | −196 | −834 | C |
| ATOM | 1138 | C | ALA | A | 135 | −4.364 | 19.660 | 33.830 | 1.00 | 55.90 | | C |
| ANISOU | 1138 | C | ALA | A | 135 | 6521 | 6772 | 7945 | 523 | −202 | −802 | C |
| ATOM | 1139 | O | ALA | A | 135 | −5.201 | 20.039 | 34.655 | 1.00 | 61.41 | | O |
| ANISOU | 1139 | O | ALA | A | 135 | 7187 | 7456 | 8688 | 574 | −142 | −805 | O |
| ATOM | 1140 | CB | ALA | A | 135 | −2.750 | 18.742 | 35.500 | 1.00 | 61.37 | | C |
| ANISOU | 1140 | CB | ALA | A | 135 | 7304 | 7505 | 8509 | 493 | −122 | −855 | C |
| ATOM | 1141 | N | ALA | A | 136 | −4.686 | 19.283 | 32.595 | 1.00 | 58.16 | | N |
| ANISOU | 1141 | N | ALA | A | 136 | 6771 | 7067 | 8260 | 495 | −274 | −770 | N |
| ATOM | 1142 | CA | ALA | A | 136 | −6.025 | 19.504 | 32.071 | 1.00 | 69.44 | | C |
| ANISOU | 1142 | CA | ALA | A | 136 | 8118 | 8483 | 9782 | 523 | −299 | −734 | C |
| ATOM | 1143 | C | ALA | A | 136 | −7.042 | 18.500 | 32.618 | 1.00 | 65.44 | | C |
| ANISOU | 1143 | C | ALA | A | 136 | 7528 | 8001 | 9334 | 529 | −256 | −718 | C |
| ATOM | 1144 | O | ALA | A | 136 | −8.155 | 18.896 | 32.977 | 1.00 | 71.07 | | O |
| ANISOU | 1144 | O | ALA | A | 136 | 8175 | 8700 | 10128 | 577 | −223 | −700 | O |
| ATOM | 1145 | CB | ALA | A | 136 | −5.991 | 19.478 | 30.541 | 1.00 | 73.86 | | C |
| ANISOU | 1145 | CB | ALA | A | 136 | 8676 | 9044 | 10345 | 489 | −399 | −706 | C |
| ATOM | 1146 | N | ASP | A | 137 | −6.692 | 17.217 | 32.726 | 1.00 | 47.93 | | N |
| ANISOU | 1146 | N | ASP | A | 137 | 5310 | 5818 | 7084 | 483 | −250 | −722 | N |
| ATOM | 1147 | CA | ASP | A | 137 | −7.678 | 16.172 | 33.075 | 1.00 | 43.60 | | C |
| ANISOU | 1147 | CA | ASP | A | 137 | 4676 | 5289 | 6599 | 478 | −220 | −699 | C |

TABLE 14-continued

| | | | | | | | | | | | | |
|---|---|---|---|---|---|---|---|---|---|---|---|---|
| ATOM | 1148 | C | ASP | A | 137 | −7.292 | 15.463 | 34.371 | 1.00 | 46.32 | | C |
| ANISOU | 1148 | C | ASP | A | 137 | 5042 | 5656 | 6903 | 478 | −131 | −718 | C |
| ATOM | 1149 | O | ASP | A | 137 | −6.261 | 15.770 | 35.005 | 1.00 | 41.37 | | O |
| ANISOU | 1149 | O | ASP | A | 137 | 4495 | 5030 | 6195 | 482 | −98 | −751 | O |
| ATOM | 1150 | CB | ASP | A | 137 | −7.818 | 15.176 | 31.924 | 1.00 | 42.86 | | C |
| ANISOU | 1150 | CB | ASP | A | 137 | 4554 | 5211 | 6520 | 421 | −303 | −678 | C |
| ATOM | 1151 | CG | ASP | A | 137 | −6.495 | 14.430 | 31.614 | 1.00 | 47.75 | | C |
| ANISOU | 1151 | CG | ASP | A | 137 | 5252 | 5848 | 7043 | 369 | −326 | −703 | C |
| ATOM | 1152 | OD1 | ASP | A | 137 | −5.478 | 14.645 | 32.338 | 1.00 | 44.43 | | O |
| ANISOU | 1152 | OD1 | ASP | A | 137 | 4900 | 5431 | 6549 | 375 | −279 | −732 | O |
| ATOM | 1153 | OD2 | ASP | A | 137 | −6.502 | 13.630 | 30.647 | 1.00 | 51.94 | | O |
| ANISOU | 1153 | OD2 | ASP | A | 137 | 5774 | 6387 | 7572 | 325 | −393 | −694 | O |
| ATOM | 1154 | N | MET | A | 138 | −8.089 | 14.465 | 34.753 | 1.00 | 43.23 | | N |
| ANISOU | 1154 | N | MET | A | 138 | 4578 | 5281 | 6565 | 470 | −96 | −694 | N |
| ATOM | 1155 | CA | MET | A | 138 | −7.843 | 13.801 | 36.037 | 1.00 | 46.95 | | C |
| ANISOU | 1155 | CA | MET | A | 138 | 5064 | 5773 | 7001 | 475 | −5 | −704 | C |
| ATOM | 1156 | C | MET | A | 138 | −6.505 | 13.071 | 36.042 | 1.00 | 45.85 | | C |
| ANISOU | 1156 | C | MET | A | 138 | 5004 | 5652 | 6766 | 429 | −20 | −728 | C |
| ATOM | 1157 | O | MET | A | 138 | −5.820 | 13.019 | 37.073 | 1.00 | 42.37 | | O |
| ANISOU | 1157 | O | MET | A | 138 | 4617 | 5222 | 6258 | 441 | 41 | −749 | O |
| ATOM | 1158 | CB | MET | A | 138 | −8.960 | 12.816 | 36.377 | 1.00 | 44.51 | | C |
| ANISOU | 1158 | CB | MET | A | 138 | 4659 | 5476 | 6775 | 470 | 35 | −665 | C |
| ATOM | 1159 | CG | MET | A | 138 | −10.185 | 13.490 | 37.004 | 1.00 | 63.57 | | C |
| ANISOU | 1159 | CG | MET | A | 138 | 6999 | 7881 | 9273 | 533 | 101 | −642 | C |
| ATOM | 1160 | SD | MET | A | 138 | −11.721 | 12.584 | 36.703 | 1.00 | 76.17 | | S |
| ANISOU | 1160 | SD | MET | A | 138 | 8450 | 9483 | 11008 | 515 | 97 | −582 | S |
| ATOM | 1161 | CE | MET | A | 138 | −11.247 | 10.907 | 37.104 | 1.00 | 77.02 | | C |
| ANISOU | 1161 | CE | MET | A | 138 | 8569 | 9614 | 11080 | 453 | 120 | −576 | C |
| ATOM | 1162 | N | ALA | A | 139 | −6.162 | 12.449 | 34.927 | 1.00 | 39.74 | | N |
| ANISOU | 1162 | N | ALA | A | 139 | 4235 | 4881 | 5984 | 378 | −99 | −723 | N |
| ATOM | 1163 | CA | ALA | A | 139 | −4.905 | 11.733 | 34.830 | 1.00 | 45.53 | | C |
| ANISOU | 1163 | CA | ALA | A | 139 | 5037 | 5630 | 6633 | 337 | −114 | −742 | C |
| ATOM | 1164 | C | ALA | A | 139 | −3.741 | 12.692 | 35.090 | 1.00 | 43.14 | | C |
| ANISOU | 1164 | C | ALA | A | 139 | 4820 | 5323 | 6247 | 352 | −110 | −775 | C |
| ATOM | 1165 | O | ALA | A | 139 | −2.989 | 12.521 | 36.050 | 1.00 | 39.51 | | O |
| ANISOU | 1165 | O | ALA | A | 139 | 4407 | 4877 | 5728 | 357 | −59 | −793 | O |
| ATOM | 1166 | CB | ALA | A | 139 | −4.828 | 11.056 | 33.460 | 1.00 | 41.79 | | C |
| ANISOU | 1166 | CB | ALA | A | 139 | 4557 | 5155 | 6167 | 288 | −203 | −734 | C |
| ATOM | 1167 | N | ALA | A | 140 | −3.661 | 13.776 | 34.313 | 1.00 | 39.57 | | N |
| ANISOU | 1167 | N | ALA | A | 140 | 4386 | 4850 | 5799 | 363 | −161 | −779 | N |
| ATOM | 1168 | CA | ALA | A | 140 | −2.644 | 14.792 | 34.542 | 1.00 | 43.50 | | C |
| ANISOU | 1168 | CA | ALA | A | 140 | 4958 | 5336 | 6232 | 375 | −160 | −807 | C |
| ATOM | 1169 | C | ALA | A | 140 | −2.670 | 15.340 | 35.964 | 1.00 | 47.50 | | C |
| ANISOU | 1169 | C | ALA | A | 140 | 5486 | 5838 | 6722 | 418 | −81 | −828 | C |
| ATOM | 1170 | O | ALA | A | 140 | −1.607 | 15.647 | 36.530 | 1.00 | 43.55 | | O |
| ANISOU | 1170 | O | ALA | A | 140 | 5055 | 5341 | 6152 | 415 | −66 | −855 | O |
| ATOM | 1171 | CB | ALA | A | 140 | −2.778 | 15.916 | 33.511 | 1.00 | 39.39 | | C |
| ANISOU | 1171 | CB | ALA | A | 140 | 4445 | 4788 | 5735 | 384 | −222 | −800 | C |
| ATOM | 1172 | N | GLN | A | 141 | −3.839 | 15.407 | 36.592 | 1.00 | 43.00 | | N |
| ANISOU | 1172 | N | GLN | A | 141 | 4859 | 5264 | 6214 | 458 | −27 | −816 | N |
| ATOM | 1173 | CA | GLN | A | 141 | −3.896 | 15.891 | 37.970 | 1.00 | 38.76 | | C |
| ANISOU | 1173 | CA | GLN | A | 141 | 4350 | 4725 | 5654 | 504 | 55 | −838 | C |
| ATOM | 1174 | C | GLN | A | 141 | −3.300 | 14.888 | 38.937 | 1.00 | 36.71 | | C |
| ANISOU | 1174 | C | GLN | A | 141 | 4119 | 4498 | 5332 | 488 | 106 | −845 | C |
| ATOM | 1175 | O | GLN | A | 141 | −2.724 | 15.270 | 39.972 | 1.00 | 38.73 | | O |
| ANISOU | 1175 | O | GLN | A | 141 | 4435 | 4755 | 5524 | 509 | 150 | −874 | O |
| ATOM | 1176 | CB | GLN | A | 141 | −5.343 | 16.243 | 38.383 | 1.00 | 39.63 | | C |
| ANISOU | 1176 | CB | GLN | A | 141 | 4389 | 4822 | 5849 | 558 | 110 | −819 | C |
| ATOM | 1177 | CG | GLN | A | 141 | −5.377 | 17.144 | 39.618 | 1.00 | 64.74 | | C |
| ANISOU | 1177 | CG | GLN | A | 141 | 7614 | 7987 | 8999 | 617 | 187 | −850 | C |
| ATOM | 1178 | CD | GLN | A | 141 | −6.773 | 17.620 | 40.030 | 1.00 | 85.73 | | C |
| ANISOU | 1178 | CD | GLN | A | 141 | 10204 | 10629 | 11741 | 681 | 250 | −832 | C |
| ATOM | 1179 | OE1 | GLN | A | 141 | −7.537 | 18.136 | 39.207 | 1.00 | 94.12 | | O |
| ANISOU | 1179 | OE1 | GLN | A | 141 | 11209 | 11668 | 12883 | 696 | 211 | −810 | O |
| ATOM | 1180 | NE2 | GLN | A | 141 | −7.099 | 17.467 | 41.317 | 1.00 | 85.64 | | N |
| ANISOU | 1180 | NE2 | GLN | A | 141 | 10200 | 10631 | 11711 | 721 | 348 | −840 | N |
| ATOM | 1181 | N | THR | A | 142 | −3.422 | 13.606 | 38.642 | 1.00 | 34.46 | | N |
| ANISOU | 1181 | N | THR | A | 142 | 3794 | 4236 | 5063 | 451 | 97 | −819 | N |
| ATOM | 1182 | CA | THR | A | 142 | −2.690 | 12.620 | 39.444 | 1.00 | 39.63 | | C |
| ANISOU | 1182 | CA | THR | A | 142 | 4483 | 4919 | 5654 | 431 | 134 | −822 | C |
| ATOM | 1183 | C | THR | A | 142 | −1.173 | 12.800 | 39.299 | 1.00 | 39.68 | | C |
| ANISOU | 1183 | C | THR | A | 142 | 4570 | 4931 | 5574 | 403 | 93 | −850 | C |
| ATOM | 1184 | O | THR | A | 142 | −0.425 | 12.791 | 40.290 | 1.00 | 38.06 | | O |
| ANISOU | 1184 | O | THR | A | 142 | 4420 | 4741 | 5301 | 411 | 128 | −869 | O |
| ATOM | 1185 | CB | THR | A | 142 | −3.111 | 11.218 | 39.014 | 1.00 | 43.97 | | C |
| ANISOU | 1185 | CB | THR | A | 142 | 4975 | 5483 | 6247 | 393 | 125 | −788 | C |
| ATOM | 1186 | OG1 | THR | A | 142 | −4.531 | 11.097 | 39.185 | 1.00 | 50.04 | | O |
| ANISOU | 1186 | OG1 | THR | A | 142 | 5661 | 6247 | 7106 | 417 | 163 | −759 | O |
| ATOM | 1187 | CG2 | THR | A | 142 | −2.433 | 10.190 | 39.863 | 1.00 | 43.18 | | C |
| ANISOU | 1187 | CG2 | THR | A | 142 | 4907 | 5409 | 6090 | 378 | 167 | −785 | C |

TABLE 14-continued

| | | | | | | | | | | | | |
|---|---|---|---|---|---|---|---|---|---|---|---|---|
| ATOM | 1188 | N | THR | A | 143 | −0.705 | 12.948 | 38.065 | 1.00 | 38.19 | | N |
| ANISOU | 1188 | N | THR | A | 143 | 4389 | 4734 | 5389 | 371 | 17 | −849 | N |
| ATOM | 1189 | CA | THR | A | 143 | 0.708 | 13.230 | 37.832 | 1.00 | 36.23 | | C |
| ANISOU | 1189 | CA | THR | A | 143 | 4208 | 4488 | 5069 | 346 | −21 | −870 | C |
| ATOM | 1190 | C | THR | A | 143 | 1.132 | 14.509 | 38.538 | 1.00 | 37.09 | | C |
| ANISOU | 1190 | C | THR | A | 143 | 4371 | 4580 | 5142 | 375 | −7 | −901 | C |
| ATOM | 1191 | O | THR | A | 143 | 2.209 | 14.580 | 39.137 | 1.00 | 39.45 | | O |
| ANISOU | 1191 | O | THR | A | 143 | 4726 | 4890 | 5374 | 365 | −3 | −921 | O |
| ATOM | 1192 | CB | THR | A | 143 | 0.934 | 13.352 | 36.342 | 1.00 | 38.62 | | C |
| ANISOU | 1192 | CB | THR | A | 143 | 4505 | 4780 | 5388 | 316 | −97 | −860 | C |
| ATOM | 1193 | OG1 | THR | A | 143 | 0.593 | 12.091 | 35.743 | 1.00 | 35.55 | | O |
| ANISOU | 1193 | OG1 | THR | A | 143 | 4077 | 4406 | 5026 | 287 | −112 | −838 | O |
| ATOM | 1194 | CG2 | THR | A | 143 | 2.411 | 13.729 | 36.019 | 1.00 | 37.17 | | C |
| ANISOU | 1194 | CG2 | THR | A | 143 | 4386 | 4600 | 5138 | 290 | −133 | −875 | C |
| ATOM | 1195 | N | LYS | A | 144 | 0.288 | 15.532 | 38.489 | 1.00 | 37.33 | | N |
| ANISOU | 1195 | N | LYS | A | 144 | 4385 | 4580 | 5218 | 411 | 0 | −906 | N |
| ATOM | 1196 | CA | LYS | A | 144 | 0.627 | 16.803 | 39.112 | 1.00 | 35.19 | | C |
| ANISOU | 1196 | CA | LYS | A | 144 | 4170 | 4283 | 4919 | 440 | 12 | −940 | C |
| ATOM | 1197 | C | LYS | A | 144 | 0.797 | 16.659 | 40.615 | 1.00 | 39.34 | | C |
| ANISOU | 1197 | C | LYS | A | 144 | 4733 | 4823 | 5391 | 465 | 79 | −964 | C |
| ATOM | 1198 | O | LYS | A | 144 | 1.748 | 17.199 | 41.188 | 1.00 | 40.34 | | O |
| ANISOU | 1198 | O | LYS | A | 144 | 4928 | 4945 | 5454 | 461 | 71 | −995 | O |
| ATOM | 1199 | CB | LYS | A | 144 | −0.439 | 17.846 | 38.780 | 1.00 | 34.88 | | C |
| ANISOU | 1199 | CB | LYS | A | 144 | 4100 | 4204 | 4948 | 481 | 13 | −938 | C |
| ATOM | 1200 | CG | LYS | A | 144 | −0.229 | 19.202 | 39.411 | 1.00 | 36.91 | | C |
| ANISOU | 1200 | CG | LYS | A | 144 | 4416 | 4423 | 5185 | 516 | 28 | −975 | C |
| ATOM | 1201 | CD | LYS | A | 144 | −1.103 | 20.227 | 38.642 | 1.00 | 44.27 | | C |
| ANISOU | 1201 | CD | LYS | A | 144 | 5316 | 5311 | 6193 | 548 | 4 | −964 | C |
| ATOM | 1202 | CE | LYS | A | 144 | −1.192 | 21.577 | 39.337 | 1.00 | 51.92 | | C |
| ANISOU | 1202 | CE | LYS | A | 144 | 6335 | 6231 | 7159 | 595 | 32 | −1001 | C |
| ATOM | 1203 | NZ | LYS | A | 144 | −1.824 | 21.357 | 40.664 | 1.00 | 55.81 | | N |
| ANISOU | 1203 | NZ | LYS | A | 144 | 6828 | 6736 | 7641 | 643 | 121 | −1019 | N |
| ATOM | 1204 | N | HIS | A | 145 | −0.135 | 15.981 | 41.285 | 1.00 | 42.49 | | N |
| ANISOU | 1204 | N | HIS | A | 145 | 5091 | 5241 | 5814 | 491 | 144 | −948 | N |
| ATOM | 1205 | CA | HIS | A | 145 | 0.020 | 15.776 | 42.721 | 1.00 | 46.35 | | C |
| ANISOU | 1205 | CA | HIS | A | 145 | 5620 | 5747 | 6242 | 517 | 212 | −966 | C |
| ATOM | 1206 | C | HIS | A | 145 | 1.314 | 15.041 | 43.025 | 1.00 | 42.58 | | C |
| ANISOU | 1206 | C | HIS | A | 145 | 5189 | 5301 | 5687 | 476 | 190 | −970 | C |
| ATOM | 1207 | O | HIS | A | 145 | 1.963 | 15.297 | 44.047 | 1.00 | 37.86 | | O |
| ANISOU | 1207 | O | HIS | A | 145 | 4656 | 4711 | 5017 | 487 | 209 | −998 | O |
| ATOM | 1208 | CB | HIS | A | 145 | −1.159 | 14.996 | 43.301 | 1.00 | 51.06 | | C |
| ANISOU | 1208 | CB | HIS | A | 145 | 6157 | 6363 | 6880 | 546 | 289 | −936 | C |
| ATOM | 1209 | CG | HIS | A | 145 | −2.417 | 15.795 | 43.404 | 1.00 | 70.16 | | C |
| ANISOU | 1209 | CG | HIS | A | 145 | 8536 | 8755 | 9367 | 601 | 332 | −934 | C |
| ATOM | 1210 | ND1 | HIS | A | 145 | −3.646 | 15.305 | 43.007 | 1.00 | 75.47 | | N |
| ANISOU | 1210 | ND1 | HIS | A | 145 | 9115 | 9430 | 10131 | 611 | 355 | −893 | N |
| ATOM | 1211 | CD2 | HIS | A | 145 | −2.642 | 17.048 | 43.867 | 1.00 | 75.91 | | C |
| ANISOU | 1211 | CD2 | HIS | A | 145 | 9303 | 9450 | 10089 | 650 | 357 | −969 | C |
| ATOM | 1212 | CE1 | HIS | A | 145 | −4.570 | 16.228 | 43.210 | 1.00 | 77.57 | | C |
| ANISOU | 1212 | CE1 | HIS | A | 145 | 9359 | 9670 | 10446 | 666 | 394 | −899 | C |
| ATOM | 1213 | NE2 | HIS | A | 145 | −3.988 | 17.293 | 43.734 | 1.00 | 77.55 | | N |
| ANISOU | 1213 | NE2 | HIS | A | 145 | 9437 | 9643 | 10384 | 693 | 399 | −946 | N |
| ATOM | 1214 | N | LYS | A | 146 | 1.675 | 14.080 | 42.175 | 1.00 | 37.46 | | N |
| ANISOU | 1214 | N | LYS | A | 146 | 4509 | 4671 | 5054 | 432 | 149 | −941 | N |
| ATOM | 1215 | CA | LYS | A | 146 | 2.867 | 13.299 | 42.440 | 1.00 | 45.55 | | C |
| ANISOU | 1215 | CA | LYS | A | 146 | 5570 | 5725 | 6013 | 398 | 132 | −939 | C |
| ATOM | 1216 | C | LYS | A | 146 | 4.114 | 14.150 | 42.235 | 1.00 | 40.69 | | C |
| ANISOU | 1216 | C | LYS | A | 146 | 5013 | 5099 | 5350 | 377 | 76 | −968 | C |
| ATOM | 1217 | O | LYS | A | 146 | 5.028 | 14.107 | 43.054 | 1.00 | 38.92 | | O |
| ANISOU | 1217 | O | LYS | A | 146 | 4839 | 4891 | 5059 | 371 | 77 | −983 | O |
| ATOM | 1218 | CB | LYS | A | 146 | 2.855 | 12.039 | 41.568 | 1.00 | 37.63 | | C |
| ANISOU | 1218 | CB | LYS | A | 146 | 4518 | 4738 | 5043 | 361 | 110 | −903 | C |
| ATOM | 1219 | CG | LYS | A | 146 | 4.229 | 11.369 | 41.420 | 1.00 | 39.04 | | C |
| ANISOU | 1219 | CG | LYS | A | 146 | 4728 | 4938 | 5166 | 324 | 75 | −900 | C |
| ATOM | 1220 | CD | LYS | A | 146 | 4.187 | 10.087 | 40.572 | 1.00 | 43.14 | | C |
| ANISOU | 1220 | CD | LYS | A | 146 | 5206 | 5467 | 5718 | 292 | 58 | −869 | C |
| ATOM | 1221 | CE | LYS | A | 146 | 5.659 | 9.562 | 40.353 | 1.00 | 46.19 | | C |
| ANISOU | 1221 | CE | LYS | A | 146 | 5627 | 5872 | 6051 | 261 | 24 | −867 | C |
| ATOM | 1222 | NZ | LYS | A | 146 | 5.745 | 8.618 | 39.193 | 1.00 | 41.35 | | N |
| ANISOU | 1222 | NZ | LYS | A | 146 | 4986 | 5258 | 5468 | 231 | −7 | −847 | N |
| ATOM | 1223 | N | TRP | A | 147 | 4.128 | 14.997 | 41.203 | 1.00 | 36.36 | | N |
| ANISOU | 1223 | N | TRP | A | 147 | 4458 | 4520 | 4838 | 367 | 26 | −972 | N |
| ATOM | 1224 | CA | TRP | A | 147 | 5.301 | 15.804 | 40.935 | 1.00 | 41.09 | | C |
| ANISOU | 1224 | CA | TRP | A | 147 | 5106 | 5105 | 5401 | 342 | −27 | −992 | C |
| ATOM | 1225 | C | TRP | A | 147 | 5.395 | 16.983 | 41.886 | 1.00 | 44.06 | | C |
| ANISOU | 1225 | C | TRP | A | 147 | 5539 | 5455 | 5747 | 369 | −13 | −1034 | C |
| ATOM | 1226 | O | TRP | A | 147 | 6.497 | 17.491 | 42.116 | 1.00 | 42.24 | | O |
| ANISOU | 1226 | O | TRP | A | 147 | 5357 | 5219 | 5472 | 346 | −49 | −1054 | O |
| ATOM | 1227 | CB | TRP | A | 147 | 5.279 | 16.273 | 39.479 | 1.00 | 33.61 | | C |
| ANISOU | 1227 | CB | TRP | A | 147 | 4134 | 4134 | 4500 | 321 | −81 | −977 | C |

TABLE 14-continued

| | | | | | | | | | | | | |
|---|---|---|---|---|---|---|---|---|---|---|---|---|
| ATOM | 1228 | CG | TRP | A | 147 | 5.513 | 15.148 | 38.481 | 1.00 | 31.81 | | C |
| ANISOU | 1228 | CG | TRP | A | 147 | 3870 | 3931 | 4284 | 287 | −106 | −944 | C |
| ATOM | 1229 | CD1 | TRP | A | 147 | 5.675 | 13.827 | 38.769 | 1.00 | 31.94 | | C |
| ANISOU | 1229 | CD1 | TRP | A | 147 | 3872 | 3983 | 4283 | 276 | −83 | −928 | C |
| ATOM | 1230 | CD2 | TRP | A | 147 | 5.634 | 15.265 | 37.069 | 1.00 | 26.87 | | C |
| ANISOU | 1230 | CD2 | TRP | A | 147 | 3228 | 3295 | 3685 | 264 | −156 | −926 | C |
| ATOM | 1231 | NE1 | TRP | A | 147 | 5.903 | 13.120 | 37.625 | 1.00 | 33.21 | | N |
| ANISOU | 1231 | NE1 | TRP | A | 147 | 4009 | 4151 | 4458 | 247 | −117 | −906 | N |
| ATOM | 1232 | CE2 | TRP | A | 147 | 5.862 | 13.984 | 36.563 | 1.00 | 34.79 | | C |
| ANISOU | 1232 | CE2 | TRP | A | 147 | 4209 | 4327 | 4683 | 239 | −161 | −904 | C |
| ATOM | 1233 | CE3 | TRP | A | 147 | 5.572 | 16.325 | 36.183 | 1.00 | 35.43 | | C |
| ANISOU | 1233 | CE3 | TRP | A | 147 | 4318 | 4348 | 4795 | 262 | −196 | −924 | C |
| ATOM | 1234 | CZ2 | TRP | A | 147 | 6.026 | 13.739 | 35.216 | 1.00 | 33.25 | | C |
| ANISOU | 1234 | CZ2 | TRP | A | 147 | 4002 | 4131 | 4501 | 215 | −204 | −886 | C |
| ATOM | 1235 | CZ3 | TRP | A | 147 | 5.735 | 16.068 | 34.829 | 1.00 | 38.23 | | C |
| ANISOU | 1235 | CZ3 | TRP | A | 147 | 4659 | 4705 | 5162 | 237 | −240 | −899 | C |
| ATOM | 1236 | CH2 | TRP | A | 147 | 5.939 | 14.791 | 34.366 | 1.00 | 34.65 | | C |
| ANISOU | 1236 | CH2 | TRP | A | 147 | 4187 | 4282 | 4697 | 215 | −242 | −883 | C |
| ATOM | 1237 | N | GLU | A | 148 | 4.257 | 17.443 | 42.416 | 1.00 | 37.29 | | N |
| ANISOU | 1237 | N | GLU | A | 148 | 4675 | 4579 | 4917 | 418 | 37 | −1046 | N |
| ATOM | 1238 | CA | GLU | A | 148 | 4.287 | 18.418 | 43.499 | 1.00 | 37.19 | | C |
| ANISOU | 1238 | CA | GLU | A | 148 | 4724 | 4541 | 4864 | 451 | 62 | −1091 | C |
| ATOM | 1239 | C | GLU | A | 148 | 4.950 | 17.823 | 44.722 | 1.00 | 41.48 | | C |
| ANISOU | 1239 | C | GLU | A | 148 | 5315 | 5121 | 5326 | 449 | 86 | −1105 | C |
| ATOM | 1240 | O | GLU | A | 148 | 5.853 | 18.432 | 45.293 | 1.00 | 42.51 | | O |
| ANISOU | 1240 | O | GLU | A | 148 | 5510 | 5241 | 5399 | 438 | 58 | −1139 | O |
| ATOM | 1241 | CB | GLU | A | 148 | 2.864 | 18.915 | 43.840 | 1.00 | 36.00 | | C |
| ANISOU | 1241 | CB | GLU | A | 148 | 4552 | 4366 | 4761 | 512 | 123 | −1098 | C |
| ATOM | 1242 | CG | GLU | A | 148 | 2.449 | 19.928 | 42.844 | 1.00 | 38.64 | | C |
| ANISOU | 1242 | CG | GLU | A | 148 | 4867 | 4652 | 5161 | 519 | 87 | −1097 | C |
| ATOM | 1243 | CD | GLU | A | 148 | 0.961 | 20.296 | 42.947 | 1.00 | 47.71 | | C |
| ANISOU | 1243 | CD | GLU | A | 148 | 5972 | 5779 | 6377 | 579 | 144 | −1091 | C |
| ATOM | 1244 | OE1 | GLU | A | 148 | 0.540 | 21.155 | 42.169 | 1.00 | 49.69 | | O |
| ANISOU | 1244 | OE1 | GLU | A | 148 | 6205 | 5989 | 6686 | 591 | 116 | −1087 | O |
| ATOM | 1245 | OE2 | GLU | A | 148 | 0.245 | 19.714 | 43.787 | 1.00 | 51.11 | | O |
| ANISOU | 1245 | OE2 | GLU | A | 148 | 6383 | 6234 | 6803 | 613 | 216 | −1085 | O |
| ATOM | 1246 | N | ALA | A | 149 | 4.512 | 16.631 | 45.140 | 1.00 | 36.42 | | N |
| ANISOU | 1246 | N | ALA | A | 149 | 4640 | 4520 | 4678 | 458 | 136 | −1076 | N |
| ATOM | 1247 | CA | ALA | A | 149 | 5.087 | 15.989 | 46.316 | 1.00 | 37.57 | | C |
| ANISOU | 1247 | CA | ALA | A | 149 | 4829 | 4702 | 4743 | 459 | 161 | −1081 | C |
| ATOM | 1248 | C | ALA | A | 149 | 6.589 | 15.719 | 46.151 | 1.00 | 44.11 | | C |
| ANISOU | 1248 | C | ALA | A | 149 | 5685 | 5550 | 5524 | 408 | 94 | −1080 | C |
| ATOM | 1249 | O | ALA | A | 149 | 7.361 | 15.854 | 47.112 | 1.00 | 38.69 | | O |
| ANISOU | 1249 | O | ALA | A | 149 | 5060 | 4877 | 4764 | 406 | 84 | −1104 | O |
| ATOM | 1250 | CB | ALA | A | 149 | 4.361 | 14.679 | 46.597 | 1.00 | 41.26 | | C |
| ANISOU | 1250 | CB | ALA | A | 149 | 5247 | 5206 | 5225 | 471 | 222 | −1039 | C |
| ATOM | 1251 | N | ALA | A | 150 | 7.022 | 15.318 | 44.950 | 1.00 | 35.11 | | N |
| ANISOU | 1251 | N | ALA | A | 150 | 4501 | 4413 | 4426 | 368 | 47 | −1052 | N |
| ATOM | 1252 | CA | ALA | A | 150 | 8.426 | 14.988 | 44.712 | 1.00 | 40.43 | | C |
| ANISOU | 1252 | CA | ALA | A | 150 | 5189 | 5107 | 5066 | 323 | −10 | −1043 | C |
| ATOM | 1253 | C | ALA | A | 150 | 9.288 | 16.189 | 44.350 | 1.00 | 37.33 | | C |
| ANISOU | 1253 | C | ALA | A | 150 | 4832 | 4683 | 4668 | 297 | −72 | −1070 | C |
| ATOM | 1254 | O | ALA | A | 150 | 10.465 | 16.003 | 44.033 | 1.00 | 42.94 | | O |
| ANISOU | 1254 | O | ALA | A | 150 | 5545 | 5409 | 5363 | 258 | −120 | −1058 | O |
| ATOM | 1255 | CB | ALA | A | 150 | 8.534 | 13.933 | 43.598 | 1.00 | 36.95 | | C |
| ANISOU | 1255 | CB | ALA | A | 150 | 4690 | 4684 | 4667 | 295 | −24 | −999 | C |
| ATOM | 1256 | N | HIS | A | 151 | 8.740 | 17.403 | 44.347 | 1.00 | 36.40 | | N |
| ANISOU | 1256 | N | HIS | A | 151 | 4737 | 4521 | 4572 | 319 | −72 | −1101 | N |
| ATOM | 1257 | CA | HIS | A | 151 | 9.519 | 18.611 | 44.111 | 1.00 | 38.16 | | C |
| ANISOU | 1257 | CA | HIS | A | 151 | 5000 | 4706 | 4794 | 294 | −129 | −1128 | C |
| ATOM | 1258 | C | HIS | A | 151 | 10.126 | 18.620 | 42.724 | 1.00 | 36.52 | | C |
| ANISOU | 1258 | C | HIS | A | 151 | 4754 | 4494 | 4630 | 252 | −179 | −1096 | C |
| ATOM | 1259 | O | HIS | A | 151 | 11.242 | 19.125 | 42.520 | 1.00 | 35.93 | | O |
| ANISOU | 1259 | O | HIS | A | 151 | 4699 | 4409 | 4544 | 213 | −232 | −1099 | O |
| ATOM | 1260 | CB | HIS | A | 151 | 10.613 | 18.789 | 45.169 | 1.00 | 34.92 | | C |
| ANISOU | 1260 | CB | HIS | A | 151 | 4650 | 4308 | 4312 | 276 | −158 | −1156 | C |
| ATOM | 1261 | CG | HIS | A | 151 | 10.082 | 19.055 | 46.534 | 1.00 | 49.96 | | C |
| ANISOU | 1261 | CG | HIS | A | 151 | 6611 | 6209 | 6162 | 319 | −115 | −1197 | C |
| ATOM | 1262 | ND1 | HIS | A | 151 | 10.870 | 19.546 | 47.552 | 1.00 | 60.23 | | N |
| ANISOU | 1262 | ND1 | HIS | A | 151 | 7984 | 7507 | 7395 | 310 | −146 | −1236 | N |
| ATOM | 1263 | CD2 | HIS | A | 151 | 8.843 | 18.911 | 47.054 | 1.00 | 55.22 | | C |
| ANISOU | 1263 | CD2 | HIS | A | 151 | 7276 | 6874 | 6830 | 373 | −42 | −1204 | C |
| ATOM | 1264 | CE1 | HIS | A | 151 | 10.140 | 19.670 | 48.648 | 1.00 | 63.15 | | C |
| ANISOU | 1264 | CE1 | HIS | A | 151 | 8401 | 7875 | 7718 | 359 | −91 | −1268 | C |
| ATOM | 1265 | NE2 | HIS | A | 151 | 8.905 | 19.299 | 48.369 | 1.00 | 53.04 | | N |
| ANISOU | 1265 | NE2 | HIS | A | 151 | 7074 | 6596 | 6482 | 399 | −23 | −1247 | N |
| ATOM | 1266 | N | VAL | A | 152 | 9.365 | 18.109 | 41.747 | 1.00 | 34.29 | | N |
| ANISOU | 1266 | N | VAL | A | 152 | 4416 | 4215 | 4398 | 259 | −163 | −1064 | N |
| ATOM | 1267 | CA | VAL | A | 152 | 9.903 | 17.956 | 40.398 | 1.00 | 39.58 | | C |
| ANISOU | 1267 | CA | VAL | A | 152 | 5052 | 4887 | 5098 | 222 | −204 | −1031 | C |

TABLE 14-continued

| | | | | | | | | | | | | |
|---|---|---|---|---|---|---|---|---|---|---|---|---|
| ATOM | 1268 | C | VAL | A | 152 | 10.171 | 19.310 | 39.761 | 1.00 | 42.19 | | C |
| ANISOU | 1268 | C | VAL | A | 152 | 5403 | 5169 | 5457 | 208 | −247 | −1040 | C |
| ATOM | 1269 | O | VAL | A | 152 | 11.168 | 19.494 | 39.052 | 1.00 | 36.50 | | O |
| ANISOU | 1269 | O | VAL | A | 152 | 4681 | 4448 | 4738 | 169 | −288 | −1021 | O |
| ATOM | 1270 | CB | VAL | A | 152 | 8.945 | 17.105 | 39.539 | 1.00 | 36.92 | | C |
| ANISOU | 1270 | CB | VAL | A | 152 | 4660 | 4563 | 4804 | 234 | −183 | −999 | C |
| ATOM | 1271 | CG1 | VAL | A | 152 | 9.443 | 17.041 | 38.105 | 1.00 | 33.81 | | C |
| ANISOU | 1271 | CG1 | VAL | A | 152 | 4243 | 4168 | 4434 | 201 | −225 | −969 | C |
| ATOM | 1272 | CG2 | VAL | A | 152 | 8.837 | 15.718 | 40.117 | 1.00 | 30.96 | | C |
| ANISOU | 1272 | CG2 | VAL | A | 152 | 3885 | 3851 | 4026 | 239 | −145 | −986 | C |
| ATOM | 1273 | N | ALA | A | 153 | 9.309 | 20.289 | 40.017 | 1.00 | 38.34 | | N |
| ANISOU | 1273 | N | ALA | A | 153 | 4936 | 4638 | 4995 | 241 | −233 | −1066 | N |
| ATOM | 1274 | CA | ALA | A | 153 | 9.496 | 21.586 | 39.374 | 1.00 | 38.48 | | C |
| ANISOU | 1274 | CA | ALA | A | 153 | 4973 | 4603 | 5046 | 230 | −273 | −1071 | C |
| ATOM | 1275 | C | ALA | A | 153 | 10.799 | 22.237 | 39.824 | 1.00 | 39.26 | | C |
| ANISOU | 1275 | C | ALA | A | 153 | 5118 | 4687 | 5113 | 192 | −314 | −1091 | C |
| ATOM | 1276 | O | ALA | A | 153 | 11.502 | 22.866 | 39.022 | 1.00 | 37.57 | | O |
| ANISOU | 1276 | O | ALA | A | 153 | 4905 | 4449 | 4921 | 156 | −358 | −1073 | O |
| ATOM | 1277 | CB | ALA | A | 153 | 8.305 | 22.505 | 39.689 | 1.00 | 36.30 | | C |
| ANISOU | 1277 | CB | ALA | A | 153 | 4711 | 4278 | 4805 | 280 | −246 | −1097 | C |
| ATOM | 1278 | N | GLU | A | 154 | 11.091 | 22.148 | 41.114 | 1.00 | 42.53 | | N |
| ANISOU | 1278 | N | GLU | A | 154 | 5572 | 5112 | 5476 | 199 | −303 | −1127 | N |
| ATOM | 1279 | CA | GLU | A | 154 | 12.339 | 22.668 | 41.674 | 1.00 | 44.68 | | C |
| ANISOU | 1279 | CA | GLU | A | 154 | 5888 | 5375 | 5714 | 160 | −350 | −1148 | C |
| ATOM | 1280 | C | GLU | A | 154 | 13.559 | 22.027 | 41.014 | 1.00 | 43.13 | | C |
| ANISOU | 1280 | C | GLU | A | 154 | 5656 | 5217 | 5514 | 108 | −386 | −1105 | C |
| ATOM | 1281 | O | GLU | A | 154 | 14.490 | 22.719 | 40.600 | 1.00 | 40.86 | | O |
| ANISOU | 1281 | O | GLU | A | 154 | 5376 | 4906 | 5243 | 65 | −434 | −1097 | O |
| ATOM | 1282 | CB | GLU | A | 154 | 12.318 | 22.409 | 43.177 | 1.00 | 43.04 | | C |
| ANISOU | 1282 | CB | GLU | A | 154 | 5727 | 5185 | 5441 | 182 | −328 | −1189 | C |
| ATOM | 1283 | CG | GLU | A | 154 | 13.566 | 22.544 | 43.950 | 1.00 | 55.64 | | C |
| ANISOU | 1283 | CG | GLU | A | 154 | 7362 | 6791 | 6987 | 143 | −376 | −1209 | C |
| ATOM | 1284 | CD | GLU | A | 154 | 13.281 | 22.185 | 45.409 | 1.00 | 64.54 | | C |
| ANISOU | 1284 | CD | GLU | A | 154 | 8538 | 7941 | 8043 | 177 | −344 | −1247 | C |
| ATOM | 1285 | OE1 | GLU | A | 154 | 12.283 | 22.709 | 45.942 | 1.00 | 66.55 | | O |
| ANISOU | 1285 | OE1 | GLU | A | 154 | 8830 | 8165 | 8293 | 225 | −303 | −1284 | O |
| ATOM | 1286 | OE2 | GLU | A | 154 | 13.996 | 21.353 | 46.005 | 1.00 | 67.72 | | O |
| ANISOU | 1286 | OE2 | GLU | A | 154 | 8941 | 8394 | 8396 | 161 | −356 | −1236 | O |
| ATOM | 1287 | N | GLN | A | 155 | 13.561 | 20.698 | 40.893 | 1.00 | 39.30 | | N |
| ANISOU | 1287 | N | GLN | A | 155 | 5131 | 4788 | 5012 | 112 | −360 | −1076 | N |
| ATOM | 1288 | CA | GLN | A | 155 | 14.683 | 20.012 | 40.265 | 1.00 | 35.31 | | C |
| ANISOU | 1288 | CA | GLN | A | 155 | 4591 | 4320 | 4504 | 71 | −385 | −1035 | C |
| ATOM | 1289 | C | GLN | A | 155 | 14.817 | 20.388 | 38.802 | 1.00 | 37.11 | | C |
| ANISOU | 1289 | C | GLN | A | 155 | 4790 | 4530 | 4781 | 50 | −403 | −999 | C |
| ATOM | 1290 | O | GLN | A | 155 | 15.919 | 20.635 | 38.311 | 1.00 | 41.05 | | O |
| ANISOU | 1290 | O | GLN | A | 155 | 5279 | 5029 | 5288 | 9 | −437 | −976 | O |
| ATOM | 1291 | CB | GLN | A | 155 | 14.502 | 18.511 | 40.391 | 1.00 | 30.85 | | C |
| ANISOU | 1291 | CB | GLN | A | 155 | 3993 | 3810 | 3917 | 87 | −348 | −1012 | C |
| ATOM | 1292 | CG | GLN | A | 155 | 14.328 | 18.067 | 41.758 | 1.00 | 33.12 | | C |
| ANISOU | 1292 | CG | GLN | A | 155 | 4309 | 4121 | 4156 | 109 | −325 | −1038 | C |
| ATOM | 1293 | CD | GLN | A | 155 | 14.060 | 16.599 | 41.790 | 1.00 | 37.01 | | C |
| ANISOU | 1293 | CD | GLN | A | 155 | 4767 | 4660 | 4636 | 125 | −286 | −1010 | C |
| ATOM | 1294 | OE1 | GLN | A | 155 | 13.423 | 16.053 | 40.883 | 1.00 | 40.69 | | O |
| ANISOU | 1294 | OE1 | GLN | A | 155 | 5194 | 5128 | 5136 | 134 | −263 | −986 | O |
| ATOM | 1295 | NE2 | GLN | A | 155 | 14.534 | 15.942 | 42.817 | 1.00 | 40.88 | | N |
| ANISOU | 1295 | NE2 | GLN | A | 155 | 5272 | 5184 | 5076 | 128 | −280 | −1011 | N |
| ATOM | 1296 | N | LEU | A | 156 | 13.695 | 20.425 | 38.073 | 1.00 | 37.14 | | N |
| ANISOU | 1296 | N | LEU | A | 156 | 4776 | 4516 | 4817 | 78 | −380 | −991 | N |
| ATOM | 1297 | CA | LEU | A | 156 | 13.777 | 20.787 | 36.668 | 1.00 | 33.79 | | C |
| ANISOU | 1297 | CA | LEU | A | 156 | 4332 | 4076 | 4431 | 61 | −398 | −956 | C |
| ATOM | 1298 | C | LEU | A | 156 | 14.235 | 22.216 | 36.520 | 1.00 | 37.51 | | C |
| ANISOU | 1298 | C | LEU | A | 156 | 4832 | 4493 | 4926 | 38 | −436 | −962 | C |
| ATOM | 1299 | O | LEU | A | 156 | 14.946 | 22.571 | 35.575 | 1.00 | 38.29 | | O |
| ANISOU | 1299 | O | LEU | A | 156 | 4920 | 4584 | 5043 | 5 | −461 | −928 | O |
| ATOM | 1300 | CB | LEU | A | 156 | 12.403 | 20.622 | 36.005 | 1.00 | 33.34 | | C |
| ANISOU | 1300 | CB | LEU | A | 156 | 4254 | 4010 | 4404 | 97 | −375 | −948 | C |
| ATOM | 1301 | CG | LEU | A | 156 | 12.023 | 19.273 | 35.453 | 1.00 | 47.25 | | C |
| ANISOU | 1301 | CG | LEU | A | 156 | 5977 | 5816 | 6161 | 106 | −352 | −924 | C |
| ATOM | 1302 | CD1 | LEU | A | 156 | 10.564 | 19.391 | 34.898 | 1.00 | 45.33 | | C |
| ANISOU | 1302 | CD1 | LEU | A | 156 | 5714 | 5552 | 5956 | 139 | −341 | −920 | C |
| ATOM | 1303 | CD2 | LEU | A | 156 | 13.001 | 18.923 | 34.356 | 1.00 | 52.34 | | C |
| ANISOU | 1303 | CD2 | LEU | A | 156 | 6607 | 6481 | 6799 | 72 | −372 | −885 | C |
| ATOM | 1304 | N | ARG | A | 157 | 13.772 | 23.074 | 37.415 | 1.00 | 37.59 | | N |
| ANISOU | 1304 | N | ARG | A | 157 | 4883 | 4462 | 4938 | 57 | −437 | −1006 | N |
| ATOM | 1305 | CA | ARG | A | 157 | 14.099 | 24.484 | 37.287 | 1.00 | 42.84 | | C |
| ANISOU | 1305 | CA | ARG | A | 157 | 5581 | 5063 | 5632 | 37 | −473 | −1016 | C |
| ATOM | 1306 | C | ARG | A | 157 | 15.593 | 24.688 | 37.454 | 1.00 | 38.54 | | C |
| ANISOU | 1306 | C | ARG | A | 157 | 5042 | 4524 | 5077 | −19 | −515 | −1007 | C |
| ATOM | 1307 | O | ARG | A | 157 | 16.187 | 25.524 | 36.780 | 1.00 | 46.02 | | O |
| ANISOU | 1307 | O | ARG | A | 157 | 5991 | 5435 | 6058 | −54 | −547 | −984 | O |

TABLE 14-continued

| | | | | | | | | | | | | |
|---|---|---|---|---|---|---|---|---|---|---|---|---|
| ATOM | 1308 | CB | ARG | A | 157 | 13.296 | 25.287 | 38.327 | 1.00 | 46.26 | | C |
| ANISOU | 1308 | CB | ARG | A | 157 | 6063 | 5448 | 6064 | 75 | −461 | −1073 | C |
| ATOM | 1309 | CG | ARG | A | 157 | 13.379 | 26.777 | 38.108 | 1.00 | 50.70 | | C |
| ANISOU | 1309 | CG | ARG | A | 157 | 6663 | 5933 | 6668 | 64 | −494 | −1085 | C |
| ATOM | 1310 | CD | ARG | A | 157 | 12.385 | 27.496 | 38.964 | 1.00 | 45.30 | | C |
| ANISOU | 1310 | CD | ARG | A | 157 | 6024 | 5199 | 5987 | 114 | −471 | −1139 | C |
| ATOM | 1311 | NE | ARG | A | 157 | 12.505 | 27.219 | 40.386 | 1.00 | 45.81 | | N |
| ANISOU | 1311 | NE | ARG | A | 157 | 6129 | 5281 | 5995 | 127 | −458 | −1191 | N |
| ATOM | 1312 | CZ | ARG | A | 157 | 11.698 | 26.427 | 41.084 | 1.00 | 51.67 | | C |
| ANISOU | 1312 | CZ | ARG | A | 157 | 6866 | 6061 | 6704 | 173 | −406 | −1208 | C |
| ATOM | 1313 | NH1 | ARG | A | 157 | 10.679 | 25.780 | 40.496 | 1.00 | 48.70 | | N |
| ANISOU | 1313 | NH1 | ARG | A | 157 | 6439 | 5711 | 6353 | 209 | −364 | −1178 | N |
| ATOM | 1314 | NH2 | ARG | A | 157 | 11.901 | 26.290 | 42.391 | 1.00 | 54.55 | | N |
| ANISOU | 1314 | NH2 | ARG | A | 157 | 7278 | 6439 | 7010 | 182 | −397 | −1254 | N |
| ATOM | 1315 | N | ALA | A | 158 | 16.221 | 23.902 | 38.324 | 1.00 | 39.99 | | N |
| ANISOU | 1315 | N | ALA | A | 158 | 5224 | 4753 | 5216 | −29 | −515 | −1019 | N |
| ATOM | 1316 | CA | ALA | A | 158 | 17.668 | 23.986 | 38.482 | 1.00 | 41.32 | | C |
| ANISOU | 1316 | CA | ALA | A | 158 | 5386 | 4934 | 5379 | −83 | −557 | −1005 | C |
| ATOM | 1317 | C | ALA | A | 158 | 18.389 | 23.703 | 37.160 | 1.00 | 44.49 | | C |
| ANISOU | 1317 | C | ALA | A | 158 | 5738 | 5358 | 5809 | −115 | −561 | −941 | C |
| ATOM | 1318 | O | ALA | A | 158 | 19.391 | 24.353 | 36.828 | 1.00 | 43.76 | | O |
| ANISOU | 1318 | O | ALA | A | 158 | 5639 | 5245 | 5743 | −162 | −597 | −918 | O |
| ATOM | 1319 | CB | ALA | A | 158 | 18.108 | 23.007 | 39.574 | 1.00 | 43.32 | | C |
| ANISOU | 1319 | CB | ALA | A | 158 | 5640 | 5241 | 5578 | −81 | −554 | −1020 | C |
| ATOM | 1320 | N | TYR | A | 159 | 17.879 | 22.754 | 36.373 | 1.00 | 39.07 | | N |
| ANISOU | 1320 | N | TYR | A | 159 | 5019 | 4709 | 5119 | −89 | −523 | −912 | N |
| ATOM | 1321 | CA | TYR | A | 159 | 18.473 | 22.486 | 35.074 | 1.00 | 35.93 | | C |
| ANISOU | 1321 | CA | TYR | A | 159 | 4582 | 4330 | 4738 | −112 | −520 | −856 | C |
| ATOM | 1322 | C | TYR | A | 159 | 18.120 | 23.577 | 34.069 | 1.00 | 38.12 | | C |
| ANISOU | 1322 | C | TYR | A | 159 | 4871 | 4556 | 5058 | −117 | −531 | −835 | C |
| ATOM | 1323 | O | TYR | A | 159 | 18.997 | 24.101 | 33.389 | 1.00 | 39.64 | | O |
| ANISOU | 1323 | O | TYR | A | 159 | 5052 | 4735 | 5274 | −156 | −549 | −797 | O |
| ATOM | 1324 | CB | TYR | A | 159 | 18.021 | 21.107 | 34.593 | 1.00 | 38.98 | | C |
| ANISOU | 1324 | CB | TYR | A | 159 | 4940 | 4769 | 5103 | −82 | −479 | −838 | C |
| ATOM | 1325 | CG | TYR | A | 159 | 18.311 | 20.818 | 33.141 | 1.00 | 33.14 | | C |
| ANISOU | 1325 | CG | TYR | A | 159 | 4174 | 4045 | 4374 | −91 | −468 | −787 | C |
| ATOM | 1326 | CD1 | TYR | A | 159 | 19.551 | 20.335 | 32.726 | 1.00 | 35.93 | | C |
| ANISOU | 1326 | CD1 | TYR | A | 159 | 4498 | 4433 | 4722 | −119 | −465 | −748 | C |
| ATOM | 1327 | CD2 | TYR | A | 159 | 17.294 | 20.951 | 32.185 | 1.00 | 35.25 | | C |
| ANISOU | 1327 | CD2 | TYR | A | 159 | 4445 | 4294 | 4652 | −67 | −458 | −777 | C |
| ATOM | 1328 | CE1 | TYR | A | 159 | 19.804 | 20.071 | 31.394 | 1.00 | 30.24 | | C |
| ANISOU | 1328 | CE1 | TYR | A | 159 | 3759 | 3726 | 4003 | −123 | −448 | −703 | C |
| ATOM | 1329 | CE2 | TYR | A | 159 | 17.514 | 20.669 | 30.858 | 1.00 | 35.88 | | C |
| ANISOU | 1329 | CE2 | TYR | A | 159 | 4511 | 4390 | 4731 | −73 | −448 | −734 | C |
| ATOM | 1330 | CZ | TYR | A | 159 | 18.797 | 20.243 | 30.461 | 1.00 | 34.23 | | C |
| ANISOU | 1330 | CZ | TYR | A | 159 | 4279 | 4214 | 4512 | −100 | −440 | −697 | C |
| ATOM | 1331 | OH | TYR | A | 159 | 18.981 | 19.968 | 29.135 | 1.00 | 32.96 | | O |
| ANISOU | 1331 | OH | TYR | A | 159 | 4112 | 4068 | 4343 | −100 | −424 | −656 | O |
| ATOM | 1332 | N | LEU | A | 160 | 16.831 | 23.949 | 33.974 | 1.00 | 39.48 | | N |
| ANISOU | 1332 | N | LEU | A | 160 | 5063 | 4695 | 5241 | −79 | −520 | −857 | N |
| ATOM | 1333 | CA | LEU | A | 160 | 16.359 | 24.852 | 32.914 | 1.00 | 38.42 | | C |
| ANISOU | 1333 | CA | LEU | A | 160 | 4937 | 4515 | 5145 | −76 | −529 | −830 | C |
| ATOM | 1334 | C | LEU | A | 160 | 16.946 | 26.253 | 33.044 | 1.00 | 48.06 | | C |
| ANISOU | 1334 | C | LEU | A | 160 | 6186 | 5673 | 6402 | −110 | −566 | −831 | C |
| ATOM | 1335 | O | LEU | A | 160 | 17.173 | 26.938 | 32.037 | 1.00 | 48.83 | | O |
| ANISOU | 1335 | O | LEU | A | 160 | 6282 | 5742 | 6530 | −129 | −578 | −788 | O |
| ATOM | 1336 | CB | LEU | A | 160 | 14.812 | 24.933 | 32.947 | 1.00 | 39.99 | | C |
| ANISOU | 1336 | CB | LEU | A | 160 | 5146 | 4694 | 5354 | −22 | −511 | −854 | C |
| ATOM | 1337 | CG | LEU | A | 160 | 14.128 | 23.628 | 32.579 | 1.00 | 39.75 | | C |
| ANISOU | 1337 | CG | LEU | A | 160 | 5084 | 4718 | 5302 | 7 | −481 | −845 | C |
| ATOM | 1338 | CD1 | LEU | A | 160 | 12.584 | 23.683 | 32.868 | 1.00 | 38.16 | | C |
| ANISOU | 1338 | CD1 | LEU | A | 160 | 4884 | 4497 | 5118 | 58 | −463 | −872 | C |
| ATOM | 1339 | CD2 | LEU | A | 160 | 14.489 | 23.315 | 31.095 | 1.00 | 34.18 | | C |
| ANISOU | 1339 | CD2 | LEU | A | 160 | 4358 | 4033 | 4595 | −10 | −485 | −790 | C |
| ATOM | 1340 | N | GLU | A | 161 | 17.128 | 26.714 | 34.279 | 1.00 | 41.89 | | N |
| ANISOU | 1340 | N | GLU | A | 161 | 5436 | 4866 | 5616 | −117 | −584 | −881 | N |
| ATOM | 1341 | CA | GLU | A | 161 | 17.698 | 28.015 | 34.585 | 1.00 | 44.02 | | C |
| ANISOU | 1341 | CA | GLU | A | 161 | 5739 | 5069 | 5919 | −153 | −624 | −893 | C |
| ATOM | 1342 | C | GLU | A | 161 | 19.209 | 27.966 | 34.718 | 1.00 | 50.95 | | C |
| ANISOU | 1342 | C | GLU | A | 161 | 6596 | 5966 | 6798 | −214 | −655 | −870 | C |
| ATOM | 1343 | O | GLU | A | 161 | 19.862 | 28.991 | 34.513 | 1.00 | 53.51 | | O |
| ANISOU | 1343 | O | GLU | A | 161 | 6930 | 6238 | 7163 | −258 | −690 | −854 | O |
| ATOM | 1344 | CB | GLU | A | 161 | 17.101 | 28.559 | 35.889 | 1.00 | 47.92 | | C |
| ANISOU | 1344 | CB | GLU | A | 161 | 6285 | 5520 | 6403 | −127 | −631 | −965 | C |
| ATOM | 1345 | CG | GLU | A | 161 | 15.596 | 28.866 | 35.768 | 1.00 | 55.26 | | C |
| ANISOU | 1345 | CG | GLU | A | 161 | 7232 | 6417 | 7346 | −64 | −601 | −985 | C |
| ATOM | 1346 | CD | GLU | A | 161 | 15.010 | 29.536 | 37.009 | 1.00 | 70.14 | | C |
| ANISOU | 1346 | CD | GLU | A | 161 | 9175 | 8252 | 9224 | −33 | −600 | −1056 | C |
| ATOM | 1347 | OE1 | GLU | A | 161 | 15.620 | 29.447 | 38.098 | 1.00 | 72.61 | | O |
| ANISOU | 1347 | OE1 | GLU | A | 161 | 9515 | 8573 | 9499 | −52 | −617 | −1097 | O |

TABLE 14-continued

| ATOM | 1348 | OE2 | GLU | A | 161 | 13.925 | 30.144 | 36.889 | 1.00 | 69.76 | | O |
|---|---|---|---|---|---|---|---|---|---|---|---|---|
| ANISOU | 1348 | OE2 | GLU | A | 161 | 9145 | 8156 | 9204 | 13 | −582 | −1071 | O |
| ATOM | 1349 | N | GLY | A | 162 | 19.775 | 26.803 | 35.028 | 1.00 | 44.73 | | N |
| ANISOU | 1349 | N | GLY | A | 162 | 5775 | 5249 | 5973 | −219 | −643 | −863 | N |
| ATOM | 1350 | CA | GLY | A | 162 | 21.221 | 26.700 | 35.207 | 1.00 | 42.98 | | C |
| ANISOU | 1350 | CA | GLY | A | 162 | 5524 | 5049 | 5757 | −275 | −672 | −838 | C |
| ATOM | 1351 | C | GLY | A | 162 | 21.949 | 25.889 | 34.147 | 1.00 | 40.66 | | C |
| ANISOU | 1351 | C | GLY | A | 162 | 5173 | 4811 | 5466 | −289 | −647 | −770 | C |
| ATOM | 1352 | O | GLY | A | 162 | 22.413 | 26.435 | 33.154 | 1.00 | 42.29 | | O |
| ANISOU | 1352 | O | GLY | A | 162 | 5362 | 4998 | 5709 | −317 | −648 | −720 | O |
| ATOM | 1353 | N | THR | A | 163 | 22.066 | 24.580 | 34.380 | 1.00 | 41.73 | | N |
| ANISOU | 1353 | N | THR | A | 163 | 5280 | 5014 | 5561 | −268 | −620 | −768 | N |
| ATOM | 1354 | CA | THR | A | 163 | 22.859 | 23.691 | 33.533 | 1.00 | 46.01 | | C |
| ANISOU | 1354 | CA | THR | A | 163 | 5769 | 5611 | 6100 | −278 | −593 | −711 | C |
| ATOM | 1355 | C | THR | A | 163 | 22.481 | 23.791 | 32.065 | 1.00 | 45.31 | | C |
| ANISOU | 1355 | C | THR | A | 163 | 5675 | 5517 | 6024 | −266 | −562 | −667 | C |
| ATOM | 1356 | O | THR | A | 163 | 23.350 | 23.683 | 31.195 | 1.00 | 42.07 | | O |
| ANISOU | 1356 | O | THR | A | 163 | 5230 | 5127 | 5628 | −289 | −548 | −611 | O |
| ATOM | 1357 | CB | THR | A | 163 | 22.656 | 22.250 | 34.003 | 1.00 | 48.03 | | C |
| ANISOU | 1357 | CB | THR | A | 163 | 6010 | 5929 | 6310 | −242 | −563 | −725 | C |
| ATOM | 1358 | OG1 | THR | A | 163 | 22.742 | 22.211 | 35.419 | 1.00 | 49.42 | | O |
| ANISOU | 1358 | OG1 | THR | A | 163 | 6205 | 6107 | 6464 | −244 | −591 | −771 | O |
| ATOM | 1359 | CG2 | THR | A | 163 | 23.653 | 21.274 | 33.348 | 1.00 | 46.69 | | C |
| ANISOU | 1359 | CG2 | THR | A | 163 | 5787 | 5816 | 6137 | −251 | −536 | −672 | C |
| ATOM | 1360 | N | CYS | A | 164 | 21.166 | 23.919 | 31.767 | 1.00 | 40.40 | | N |
| ANISOU | 1360 | N | CYS | A | 164 | 5084 | 4873 | 5394 | −226 | −548 | −689 | N |
| ATOM | 1361 | CA | CYS | A | 164 | 20.724 | 23.961 | 30.377 | 1.00 | 34.50 | | C |
| ANISOU | 1361 | CA | CYS | A | 164 | 4335 | 4123 | 4649 | −211 | −525 | −648 | C |
| ATOM | 1362 | C | CYS | A | 164 | 21.338 | 25.142 | 29.662 | 1.00 | 35.39 | | C |
| ANISOU | 1362 | C | CYS | A | 164 | 4451 | 4192 | 4804 | −250 | −543 | −603 | C |
| ATOM | 1363 | O | CYS | A | 164 | 21.742 | 25.037 | 28.500 | 1.00 | 38.93 | | O |
| ANISOU | 1363 | O | CYS | A | 164 | 4883 | 4658 | 5251 | −258 | −522 | −548 | O |
| ATOM | 1364 | CB | CYS | A | 164 | 19.178 | 24.053 | 30.299 | 1.00 | 39.58 | | C |
| ANISOU | 1364 | CB | CYS | A | 164 | 5009 | 4743 | 5287 | −164 | −520 | −680 | C |
| ATOM | 1365 | SG | CYS | A | 164 | 18.513 | 24.168 | 28.626 | 1.00 | 45.58 | | S |
| ANISOU | 1365 | SG | CYS | A | 164 | 5774 | 5498 | 6047 | −145 | −506 | −633 | S |
| ATOM | 1366 | N | VAL | A | 165 | 21.371 | 26.301 | 30.330 | 1.00 | 34.41 | | N |
| ANISOU | 1366 | N | VAL | A | 165 | 4352 | 4007 | 4715 | −274 | −582 | −628 | N |
| ATOM | 1367 | CA | VAL | A | 165 | 21.969 | 27.502 | 29.738 | 1.00 | 36.04 | | C |
| ANISOU | 1367 | CA | VAL | A | 165 | 4562 | 4162 | 4971 | −316 | −603 | −585 | C |
| ATOM | 1368 | C | VAL | A | 165 | 23.497 | 27.342 | 29.642 | 1.00 | 37.13 | | C |
| ANISOU | 1368 | C | VAL | A | 165 | 4653 | 4330 | 5126 | −369 | −604 | −539 | C |
| ATOM | 1369 | O | VAL | A | 165 | 24.131 | 27.843 | 28.704 | 1.00 | 35.41 | | O |
| ANISOU | 1369 | O | VAL | A | 165 | 4417 | 4099 | 4937 | −399 | −596 | −476 | O |
| ATOM | 1370 | CB | VAL | A | 165 | 21.573 | 28.734 | 30.575 | 1.00 | 40.59 | | C |
| ANISOU | 1370 | CB | VAL | A | 165 | 5182 | 4659 | 5582 | −326 | −645 | −631 | C |
| ATOM | 1371 | CG1 | VAL | A | 165 | 22.317 | 29.979 | 30.114 | 1.00 | 51.28 | | C |
| ANISOU | 1371 | CG1 | VAL | A | 165 | 6538 | 5952 | 6993 | −379 | −672 | −588 | C |
| ATOM | 1372 | CG2 | VAL | A | 165 | 20.033 | 28.939 | 30.530 | 1.00 | 41.13 | | C |
| ANISOU | 1372 | CG2 | VAL | A | 165 | 5289 | 4698 | 5642 | −269 | −636 | −666 | C |
| ATOM | 1373 | N | GLU | A | 166 | 24.098 | 26.622 | 30.589 | 1.00 | 39.21 | | N |
| ANISOU | 1373 | N | GLU | A | 166 | 4892 | 4634 | 5373 | −378 | −613 | −564 | N |
| ATOM | 1374 | CA | GLU | A | 166 | 25.547 | 26.443 | 30.552 | 1.00 | 44.42 | | C |
| ANISOU | 1374 | CA | GLU | A | 166 | 5499 | 5324 | 6056 | −425 | −617 | −518 | C |
| ATOM | 1375 | C | GLU | A | 166 | 25.954 | 25.570 | 29.377 | 1.00 | 42.97 | | C |
| ANISOU | 1375 | C | GLU | A | 166 | 5276 | 5198 | 5854 | −410 | −561 | −457 | C |
| ATOM | 1376 | O | GLU | A | 166 | 26.969 | 25.848 | 28.720 | 1.00 | 43.69 | | O |
| ANISOU | 1376 | O | GLU | A | 166 | 5328 | 5294 | 5978 | −447 | −549 | −393 | O |
| ATOM | 1377 | CB | GLU | A | 166 | 26.038 | 25.858 | 31.876 | 1.00 | 40.65 | | C |
| ANISOU | 1377 | CB | GLU | A | 166 | 5007 | 4877 | 5563 | −434 | −645 | −559 | C |
| ATOM | 1378 | CG | GLU | A | 166 | 25.837 | 26.846 | 33.047 | 1.00 | 48.50 | | C |
| ANISOU | 1378 | CG | GLU | A | 166 | 6045 | 5809 | 6573 | −457 | −706 | −619 | C |
| ATOM | 1379 | CD | GLU | A | 166 | 25.668 | 26.145 | 34.383 | 1.00 | 72.30 | | C |
| ANISOU | 1379 | CD | GLU | A | 166 | 9074 | 8854 | 9541 | −436 | −723 | −679 | C |
| ATOM | 1380 | OE1 | GLU | A | 166 | 26.379 | 25.141 | 34.636 | 1.00 | 78.68 | | O |
| ANISOU | 1380 | OE1 | GLU | A | 166 | 9839 | 9726 | 10331 | −437 | −715 | −661 | O |
| ATOM | 1381 | OE2 | GLU | A | 166 | 24.807 | 26.589 | 35.183 | 1.00 | 85.27 | | O |
| ANISOU | 1381 | OE2 | GLU | A | 166 | 10774 | 10458 | 11166 | −415 | −742 | −742 | O |
| ATOM | 1382 | N | TRP | A | 167 | 25.178 | 24.505 | 29.104 | 1.00 | 37.75 | | N |
| ANISOU | 1382 | N | TRP | A | 167 | 4625 | 4579 | 5141 | −356 | −523 | −474 | N |
| ATOM | 1383 | CA | TRP | A | 167 | 25.391 | 23.702 | 27.896 | 1.00 | 38.62 | | C |
| ANISOU | 1383 | CA | TRP | A | 167 | 4715 | 4736 | 5225 | −335 | −469 | −425 | C |
| ATOM | 1384 | C | TRP | A | 167 | 25.246 | 24.552 | 26.660 | 1.00 | 40.32 | | C |
| ANISOU | 1384 | C | TRP | A | 167 | 4947 | 4918 | 5454 | −343 | −456 | −375 | C |
| ATOM | 1385 | O | TRP | A | 167 | 26.094 | 24.524 | 25.758 | 1.00 | 36.57 | | O |
| ANISOU | 1385 | O | TRP | A | 167 | 4444 | 4464 | 4987 | −359 | −423 | −311 | O |
| ATOM | 1386 | CB | TRP | A | 167 | 24.403 | 22.535 | 27.833 | 1.00 | 39.44 | | C |
| ANISOU | 1386 | CB | TRP | A | 167 | 4838 | 4875 | 5274 | −279 | −442 | −461 | C |
| ATOM | 1387 | CG | TRP | A | 167 | 24.757 | 21.423 | 28.738 | 1.00 | 44.56 | | C |
| ANISOU | 1387 | CG | TRP | A | 167 | 5460 | 5569 | 5901 | −266 | −435 | −487 | C |

TABLE 14-continued

| | | | | | | | | | | | | |
|---|---|---|---|---|---|---|---|---|---|---|---|---|
| ATOM | 1388 | CD1 | TRP | A | 167 | 24.045 | 20.974 | 29.802 | 1.00 | 43.36 | | C |
| ANISOU | 1388 | CD1 | TRP | A | 167 | 5326 | 5420 | 5729 | −243 | −451 | −545 | C |
| ATOM | 1389 | CD2 | TRP | A | 167 | 25.946 | 20.632 | 28.686 | 1.00 | 44.42 | | C |
| ANISOU | 1389 | CD2 | TRP | A | 167 | 5392 | 5600 | 5884 | −275 | −410 | −451 | C |
| ATOM | 1390 | NE1 | TRP | A | 167 | 24.714 | 19.940 | 30.418 | 1.00 | 41.95 | | N |
| ANISOU | 1390 | NE1 | TRP | A | 167 | 5116 | 5289 | 5536 | −238 | −440 | −546 | N |
| ATOM | 1391 | CE2 | TRP | A | 167 | 25.882 | 19.712 | 29.746 | 1.00 | 44.82 | | C |
| ANISOU | 1391 | CE2 | TRP | A | 167 | 5436 | 5681 | 5914 | −257 | −416 | −490 | C |
| ATOM | 1392 | CE3 | TRP | A | 167 | 27.053 | 20.598 | 27.829 | 1.00 | 38.66 | | C |
| ANISOU | 1392 | CE3 | TRP | A | 167 | 4622 | 4893 | 5172 | −294 | −378 | −386 | C |
| ATOM | 1393 | CZ2 | TRP | A | 167 | 26.888 | 18.789 | 29.986 | 1.00 | 41.09 | | C |
| ANISOU | 1393 | CZ2 | TRP | A | 167 | 4916 | 5256 | 5440 | −256 | −398 | −466 | C |
| ATOM | 1394 | CZ3 | TRP | A | 167 | 28.028 | 19.675 | 28.063 | 1.00 | 48.41 | | C |
| ANISOU | 1394 | CZ3 | TRP | A | 167 | 5808 | 6177 | 6407 | −291 | −355 | −364 | C |
| ATOM | 1395 | CH2 | TRP | A | 167 | 27.931 | 18.771 | 29.128 | 1.00 | 41.87 | | C |
| ANISOU | 1395 | CH2 | TRP | A | 167 | 4973 | 5375 | 5560 | −271 | −367 | −404 | C |
| ATOM | 1396 | N | LEU | A | 168 | 24.147 | 25.306 | 26.589 | 1.00 | 37.51 | | N |
| ANISOU | 1396 | N | LEU | A | 168 | 4638 | 4512 | 5102 | −328 | −480 | −401 | N |
| ATOM | 1397 | CA | LEU | A | 168 | 23.903 | 26.145 | 25.421 | 1.00 | 43.36 | | C |
| ANISOU | 1397 | CA | LEU | A | 168 | 5401 | 5218 | 5855 | −332 | −473 | −352 | C |
| ATOM | 1398 | C | LEU | A | 168 | 25.092 | 27.074 | 25.146 | 1.00 | 42.83 | | C |
| ANISOU | 1398 | C | LEU | A | 168 | 5307 | 5124 | 5841 | −390 | −478 | −291 | C |
| ATOM | 1399 | O | LEU | A | 168 | 25.590 | 27.148 | 24.018 | 1.00 | 41.40 | | O |
| ANISOU | 1399 | O | LEU | A | 168 | 5115 | 4957 | 5657 | −397 | −442 | −223 | O |
| ATOM | 1400 | CB | LEU | A | 168 | 22.599 | 26.926 | 25.630 | 1.00 | 37.42 | | C |
| ANISOU | 1400 | CB | LEU | A | 168 | 4697 | 4407 | 5113 | −309 | −506 | −391 | C |
| ATOM | 1401 | CG | LEU | A | 168 | 22.204 | 27.810 | 24.465 | 1.00 | 46.34 | | C |
| ANISOU | 1401 | CG | LEU | A | 168 | 5855 | 5498 | 6255 | −307 | −505 | −341 | C |
| ATOM | 1402 | CD1 | LEU | A | 168 | 22.353 | 27.076 | 23.131 | 1.00 | 37.42 | | C |
| ANISOU | 1402 | CD1 | LEU | A | 168 | 4721 | 4421 | 5075 | −288 | −460 | −288 | C |
| ATOM | 1403 | CD2 | LEU | A | 168 | 20.779 | 28.291 | 24.672 | 1.00 | 39.71 | | C |
| ANISOU | 1403 | CD2 | LEU | A | 168 | 5057 | 4613 | 5420 | −269 | −533 | −383 | C |
| ATOM | 1404 | N | ARG | A | 169 | 25.552 | 27.799 | 26.175 | 1.00 | 43.68 | | N |
| ANISOU | 1404 | N | ARG | A | 169 | 5407 | 5191 | 5999 | −432 | −523 | −315 | N |
| ATOM | 1405 | CA | ARG | A | 169 | 26.714 | 28.673 | 26.021 | 1.00 | 51.22 | | C |
| ANISOU | 1405 | CA | ARG | A | 169 | 6330 | 6116 | 7015 | −495 | −535 | −259 | C |
| ATOM | 1406 | C | ARG | A | 169 | 27.918 | 27.901 | 25.507 | 1.00 | 51.78 | | C |
| ANISOU | 1406 | C | ARG | A | 169 | 6338 | 6253 | 7083 | −509 | −489 | −199 | C |
| ATOM | 1407 | O | ARG | A | 169 | 28.594 | 28.326 | 24.560 | 1.00 | 57.44 | | O |
| ANISOU | 1407 | O | ARG | A | 169 | 7033 | 6967 | 7825 | −535 | −459 | −123 | O |
| ATOM | 1408 | CB | ARG | A | 169 | 27.044 | 29.358 | 27.353 | 1.00 | 39.87 | | C |
| ANISOU | 1408 | CB | ARG | A | 169 | 4893 | 4631 | 5624 | −537 | −598 | −307 | C |
| ATOM | 1409 | CG | ARG | A | 169 | 25.949 | 30.270 | 27.773 | 1.00 | 42.90 | | C |
| ANISOU | 1409 | CG | ARG | A | 169 | 5340 | 4941 | 6018 | −523 | −636 | −360 | C |
| ATOM | 1410 | CD | ARG | A | 169 | 26.364 | 31.288 | 28.743 | 1.00 | 45.82 | | C |
| ANISOU | 1410 | CD | ARG | A | 169 | 5723 | 5244 | 6443 | −574 | −696 | −390 | C |
| ATOM | 1411 | NE | ARG | A | 169 | 26.148 | 30.880 | 30.103 | 1.00 | 56.82 | | N |
| ANISOU | 1411 | NE | ARG | A | 169 | 7132 | 6648 | 7810 | −562 | −729 | −471 | N |
| ATOM | 1412 | CZ | ARG | A | 169 | 25.402 | 31.543 | 30.976 | 1.00 | 66.32 | | C |
| ANISOU | 1412 | CZ | ARG | A | 169 | 8392 | 7792 | 9016 | −551 | −767 | −540 | C |
| ATOM | 1413 | NH1 | ARG | A | 169 | 24.779 | 32.660 | 30.625 | 1.00 | 64.78 | | N |
| ANISOU | 1413 | NH1 | ARG | A | 169 | 8241 | 7516 | 8855 | −548 | −779 | −540 | N |
| ATOM | 1414 | NH2 | ARG | A | 169 | 25.287 | 31.084 | 32.214 | 1.00 | 71.41 | | N |
| ANISOU | 1414 | NH2 | ARG | A | 169 | 9051 | 8454 | 9626 | −539 | −790 | −609 | N |
| ATOM | 1415 | N | ARG | A | 170 | 28.187 | 26.750 | 26.114 | 1.00 | 50.37 | | N |
| ANISOU | 1415 | N | ARG | A | 170 | 6131 | 6134 | 6874 | −490 | −478 | −229 | N |
| ATOM | 1416 | CA | ARG | A | 170 | 29.291 | 25.915 | 25.674 | 1.00 | 44.38 | | C |
| ANISOU | 1416 | CA | ARG | A | 170 | 5311 | 5438 | 6112 | −494 | −431 | −175 | C |
| ATOM | 1417 | C | ARG | A | 170 | 29.139 | 25.529 | 24.211 | 1.00 | 43.88 | | C |
| ANISOU | 1417 | C | ARG | A | 170 | 5259 | 5405 | 6007 | −459 | −363 | −122 | C |
| ATOM | 1418 | O | ARG | A | 170 | 30.112 | 25.561 | 23.444 | 1.00 | 43.26 | | O |
| ANISOU | 1418 | O | ARG | A | 170 | 5141 | 5349 | 5949 | −478 | −319 | −49 | O |
| ATOM | 1419 | CB | ARG | A | 170 | 29.335 | 24.681 | 26.546 | 1.00 | 46.46 | | C |
| ANISOU | 1419 | CB | ARG | A | 170 | 5555 | 5755 | 6341 | −465 | −430 | −222 | C |
| ATOM | 1420 | CG | ARG | A | 170 | 30.367 | 23.692 | 26.142 | 1.00 | 48.84 | | C |
| ANISOU | 1420 | CG | ARG | A | 170 | 5797 | 6122 | 6638 | −457 | −378 | −174 | C |
| ATOM | 1421 | CD | ARG | A | 170 | 30.141 | 22.450 | 26.934 | 1.00 | 56.38 | | C |
| ANISOU | 1421 | CD | ARG | A | 170 | 6748 | 7122 | 7552 | −418 | −377 | −225 | C |
| ATOM | 1422 | NE | ARG | A | 170 | 31.138 | 21.452 | 26.622 | 1.00 | 60.63 | | N |
| ANISOU | 1422 | NE | ARG | A | 170 | 7228 | 7720 | 8088 | −404 | −326 | −181 | N |
| ATOM | 1423 | CZ | ARG | A | 170 | 32.312 | 21.397 | 27.225 | 1.00 | 67.38 | | C |
| ANISOU | 1423 | CZ | ARG | A | 170 | 8015 | 8595 | 8990 | −438 | −343 | −152 | C |
| ATOM | 1424 | NH1 | ARG | A | 170 | 32.614 | 22.310 | 28.154 | 1.00 | 67.92 | | N |
| ANISOU | 1424 | NH1 | ARG | A | 170 | 8072 | 8626 | 9108 | −492 | −414 | −167 | N |
| ATOM | 1425 | NH2 | ARG | A | 170 | 33.176 | 20.447 | 26.882 | 1.00 | 64.08 | | N |
| ANISOU | 1425 | NH2 | ARG | A | 170 | 7542 | 8232 | 8573 | −417 | −290 | −109 | N |
| ATOM | 1426 | N | TYR | A | 171 | 27.906 | 25.212 | 23.789 | 1.00 | 40.79 | | N |
| ANISOU | 1426 | N | TYR | A | 171 | 4926 | 5013 | 5561 | −410 | −355 | −157 | N |
| ATOM | 1427 | CA | TYR | A | 171 | 27.690 | 24.801 | 22.409 | 1.00 | 41.09 | | C |
| ANISOU | 1427 | CA | TYR | A | 171 | 4985 | 5079 | 5548 | −375 | −299 | −114 | C |

TABLE 14-continued

| | | | | | | | | | | | | |
|---|---|---|---|---|---|---|---|---|---|---|---|---|
| ATOM | 1428 | C | TYR | A | 171 | 27.828 | 25.984 | 21.462 | 1.00 | 43.16 | | C |
| ANISOU | 1428 | C | TYR | A | 171 | 5263 | 5299 | 5835 | −402 | −293 | −48 | C |
| ATOM | 1429 | O | TYR | A | 171 | 28.411 | 25.854 | 20.377 | 1.00 | 46.29 | | O |
| ANISOU | 1429 | O | TYR | A | 171 | 5650 | 5724 | 6213 | −398 | −237 | 19 | O |
| ATOM | 1430 | CB | TYR | A | 171 | 26.299 | 24.155 | 22.247 | 1.00 | 43.53 | | C |
| ANISOU | 1430 | CB | TYR | A | 171 | 5348 | 5396 | 5794 | −319 | −304 | −170 | C |
| ATOM | 1431 | CG | TYR | A | 171 | 26.102 | 22.865 | 23.034 | 1.00 | 45.18 | | C |
| ANISOU | 1431 | CG | TYR | A | 171 | 5545 | 5648 | 5973 | −288 | −300 | −228 | C |
| ATOM | 1432 | CD1 | TYR | A | 171 | 27.190 | 22.070 | 23.357 | 1.00 | 42.09 | | C |
| ANISOU | 1432 | CD1 | TYR | A | 171 | 5102 | 5303 | 5588 | −294 | −271 | −213 | C |
| ATOM | 1433 | CD2 | TYR | A | 171 | 24.805 | 22.432 | 23.429 | 1.00 | 40.68 | | C |
| ANISOU | 1433 | CD2 | TYR | A | 171 | 5013 | 5071 | 5371 | −251 | −324 | −293 | C |
| ATOM | 1434 | CE1 | TYR | A | 171 | 27.027 | 20.885 | 24.075 | 1.00 | 41.13 | | C |
| ANISOU | 1434 | CE1 | TYR | A | 171 | 4970 | 5217 | 5439 | −265 | −267 | −260 | C |
| ATOM | 1435 | CE2 | TYR | A | 171 | 24.631 | 21.242 | 24.169 | 1.00 | 38.24 | | C |
| ANISOU | 1435 | CE2 | TYR | A | 171 | 4692 | 4798 | 5037 | −225 | −317 | −341 | C |
| ATOM | 1436 | CZ | TYR | A | 171 | 25.752 | 20.473 | 24.474 | 1.00 | 39.03 | | C |
| ANISOU | 1436 | CZ | TYR | A | 171 | 4746 | 4942 | 5142 | −232 | −289 | −323 | C |
| ATOM | 1437 | OH | TYR | A | 171 | 25.615 | 19.299 | 25.190 | 1.00 | 37.32 | | O |
| ANISOU | 1437 | OH | TYR | A | 171 | 4519 | 4758 | 4902 | −206 | −282 | −364 | O |
| ATOM | 1438 | N | LEU | A | 172 | 27.255 | 27.134 | 21.835 | 1.00 | 45.51 | | N |
| ANISOU | 1438 | N | LEU | A | 172 | 5590 | 5528 | 6173 | −424 | −346 | −65 | N |
| ATOM | 1439 | CA | LEU | A | 172 | 27.297 | 28.305 | 20.962 | 1.00 | 46.01 | | C |
| ANISOU | 1439 | CA | LEU | A | 172 | 5675 | 5544 | 6265 | −448 | −344 | −1 | C |
| ATOM | 1440 | C | LEU | A | 172 | 28.732 | 28.726 | 20.683 | 1.00 | 50.60 | | C |
| ANISOU | 1440 | C | LEU | A | 172 | 6199 | 6128 | 6900 | −502 | −316 | 77 | C |
| ATOM | 1441 | O | LEU | A | 172 | 29.050 | 29.207 | 19.586 | 1.00 | 51.29 | | O |
| ANISOU | 1441 | O | LEU | A | 172 | 6291 | 6209 | 6987 | −511 | −278 | 155 | O |
| ATOM | 1442 | CB | LEU | A | 172 | 26.527 | 29.459 | 21.598 | 1.00 | 43.95 | | C |
| ANISOU | 1442 | CB | LEU | A | 172 | 5449 | 5199 | 6048 | −464 | −409 | −39 | C |
| ATOM | 1443 | CG | LEU | A | 172 | 24.983 | 29.314 | 21.584 | 1.00 | 43.85 | | C |
| ANISOU | 1443 | CG | LEU | A | 172 | 5495 | 5174 | 5993 | −408 | −432 | −96 | C |
| ATOM | 1444 | CD1 | LEU | A | 172 | 24.333 | 30.257 | 22.569 | 1.00 | 39.14 | | C |
| ANISOU | 1444 | CD1 | LEU | A | 172 | 4924 | 4502 | 5445 | −419 | −491 | −150 | C |
| ATOM | 1445 | CD2 | LEU | A | 172 | 24.421 | 29.529 | 20.185 | 1.00 | 46.83 | | C |
| ANISOU | 1445 | CD2 | LEU | A | 172 | 5912 | 5550 | 6332 | −380 | −408 | −42 | C |
| ATOM | 1446 | N | GLU | A | 173 | 29.601 | 28.582 | 21.674 | 1.00 | 45.05 | | N |
| ANISOU | 1446 | N | GLU | A | 173 | 5439 | 5433 | 6244 | −539 | −336 | 62 | N |
| ATOM | 1447 | CA | GLU | A | 173 | 31.003 | 28.923 | 21.454 | 1.00 | 49.76 | | C |
| ANISOU | 1447 | CA | GLU | A | 173 | 5968 | 6037 | 6901 | −593 | −311 | 139 | C |
| ATOM | 1448 | C | GLU | A | 173 | 31.682 | 27.874 | 20.588 | 1.00 | 54.14 | | C |
| ANISOU | 1448 | C | GLU | A | 173 | 6487 | 6670 | 7412 | −562 | −227 | 191 | C |
| ATOM | 1449 | O | GLU | A | 173 | 32.270 | 28.202 | 19.553 | 1.00 | 59.61 | | O |
| ANISOU | 1449 | O | GLU | A | 173 | 7166 | 7371 | 8113 | −574 | −173 | 276 | O |
| ATOM | 1450 | CB | GLU | A | 173 | 31.732 | 29.082 | 22.787 | 1.00 | 45.47 | | C |
| ANISOU | 1450 | CB | GLU | A | 173 | 5374 | 5480 | 6423 | −643 | −367 | 107 | C |
| ATOM | 1451 | CG | GLU | A | 173 | 33.037 | 29.845 | 22.683 | 1.00 | 58.34 | | C |
| ANISOU | 1451 | CG | GLU | A | 173 | 6937 | 7090 | 8141 | −715 | −367 | 185 | C |
| ATOM | 1452 | CD | GLU | A | 173 | 32.848 | 31.267 | 22.152 | 0.00 | 65.02 | | C |
| ANISOU | 1452 | CD | GLU | A | 173 | 7815 | 7853 | 9035 | −755 | −385 | 229 | C |
| ATOM | 1453 | OE1 | GLU | A | 173 | 32.328 | 32.138 | 22.888 | 1.00 | 72.32 | | O |
| ANISOU | 1453 | OE1 | GLU | A | 173 | 8779 | 8705 | 9995 | −780 | −456 | 178 | O |
| ATOM | 1454 | OE2 | GLU | A | 173 | 33.218 | 31.516 | 20.988 | 0.73 | 65.42 | | O |
| ANISOU | 1454 | OE2 | GLU | A | 173 | 7856 | 7913 | 9089 | −758 | −325 | 316 | O |
| ATOM | 1455 | N | ASN | A | 174 | 31.584 | 26.600 | 20.974 | 1.00 | 54.59 | | N |
| ANISOU | 1455 | N | ASN | A | 174 | 6536 | 6786 | 7421 | −519 | −211 | 143 | N |
| ATOM | 1456 | CA | ASN | A | 174 | 32.243 | 25.551 | 20.201 | 1.00 | 48.45 | | C |
| ANISOU | 1456 | CA | ASN | A | 174 | 5727 | 6080 | 6602 | −484 | −129 | 186 | C |
| ATOM | 1457 | C | ASN | A | 174 | 31.698 | 25.428 | 18.791 | 1.00 | 55.67 | | C |
| ANISOU | 1457 | C | ASN | A | 174 | 6700 | 7007 | 7444 | −441 | −73 | 220 | C |
| ATOM | 1458 | O | ASN | A | 174 | 32.439 | 25.039 | 17.878 | 1.00 | 55.69 | | O |
| ANISOU | 1458 | O | ASN | A | 174 | 6681 | 7053 | 7426 | −426 | 4 | 285 | O |
| ATOM | 1459 | CB | ASN | A | 174 | 32.131 | 24.218 | 20.925 | 1.00 | 49.44 | | C |
| ANISOU | 1459 | CB | ASN | A | 174 | 5840 | 6254 | 6691 | −444 | −129 | 123 | C |
| ATOM | 1460 | CG | ASN | A | 174 | 32.800 | 24.250 | 22.267 | 1.00 | 58.90 | | C |
| ANISOU | 1460 | CG | ASN | A | 174 | 6978 | 7449 | 7953 | −484 | −181 | 98 | C |
| ATOM | 1461 | OD1 | ASN | A | 174 | 33.509 | 25.213 | 22.597 | 1.00 | 55.61 | | O |
| ANISOU | 1461 | OD1 | ASN | A | 174 | 6520 | 6997 | 7611 | −546 | −214 | 134 | O |
| ATOM | 1462 | ND2 | ASN | A | 174 | 32.585 | 23.210 | 23.060 | 1.00 | 60.49 | | N |
| ANISOU | 1462 | ND2 | ASN | A | 174 | 7176 | 7684 | 8125 | −452 | −193 | 39 | N |
| ATOM | 1463 | N | GLY | A | 175 | 30.410 | 25.704 | 18.585 | 1.00 | 52.67 | | N |
| ANISOU | 1463 | N | GLY | A | 175 | 6395 | 6595 | 7022 | −416 | −108 | 178 | N |
| ATOM | 1464 | CA | GLY | A | 175 | 29.884 | 25.668 | 17.239 | 1.00 | 52.27 | | C |
| ANISOU | 1464 | CA | GLY | A | 175 | 6404 | 6555 | 6900 | −378 | −66 | 213 | C |
| ATOM | 1465 | C | GLY | A | 175 | 29.623 | 27.029 | 16.628 | 1.00 | 53.92 | | C |
| ANISOU | 1465 | C | GLY | A | 175 | 6645 | 6706 | 7135 | −406 | −84 | 266 | C |
| ATOM | 1466 | O | GLY | A | 175 | 28.736 | 27.155 | 15.782 | 1.00 | 65.07 | | O |
| ANISOU | 1466 | O | GLY | A | 175 | 8124 | 8111 | 8489 | −373 | −84 | 271 | O |
| ATOM | 1467 | N | LYS | A | 176 | 30.378 | 28.052 | 17.043 | 1.00 | 53.18 | | N |
| ANISOU | 1467 | N | LYS | A | 176 | 6506 | 6568 | 7130 | −469 | −103 | 308 | N |

TABLE 14-continued

| | | | | | | | | | | | | |
|---|---|---|---|---|---|---|---|---|---|---|---|---|
| ATOM | 1468 | CA | LYS | A | 176 | 30.081 | 29.418 | 16.605 | 1.00 | 61.71 | | C |
| ANISOU | 1468 | CA | LYS | A | 176 | 7619 | 7580 | 8247 | −499 | −129 | 354 | C |
| ATOM | 1469 | C | LYS | A | 176 | 30.074 | 29.551 | 15.079 | 1.00 | 75.23 | | C |
| ANISOU | 1469 | C | LYS | A | 176 | 9371 | 9311 | 9901 | −475 | −66 | 436 | C |
| ATOM | 1470 | O | LYS | A | 176 | 29.199 | 30.225 | 14.518 | 1.00 | 81.12 | | O |
| ANISOU | 1470 | O | LYS | A | 176 | 10180 | 10017 | 10625 | −461 | −91 | 447 | O |
| ATOM | 1471 | CB | LYS | A | 176 | 31.060 | 30.411 | 17.245 | 1.00 | 53.51 | | C |
| ANISOU | 1471 | CB | LYS | A | 176 | 6520 | 6493 | 7319 | −575 | −155 | 393 | C |
| ATOM | 1472 | CG | LYS | A | 176 | 32.510 | 30.325 | 16.792 | 1.00 | 63.33 | | C |
| ANISOU | 1472 | CG | LYS | A | 176 | 7689 | 7773 | 8599 | −609 | −87 | 482 | C |
| ATOM | 1473 | CD | LYS | A | 176 | 33.457 | 31.089 | 17.755 | 1.00 | 66.41 | | C |
| ANISOU | 1473 | CD | LYS | A | 176 | 8008 | 8119 | 9106 | −689 | −133 | 497 | C |
| ATOM | 1474 | CE | LYS | A | 176 | 33.381 | 32.614 | 17.619 | 0.00 | 66.49 | | C |
| ANISOU | 1474 | CE | LYS | A | 176 | 8037 | 8037 | 9188 | −744 | −172 | 541 | C |
| ATOM | 1475 | NZ | LYS | A | 176 | 33.962 | 33.338 | 18.810 | 1.00 | 67.09 | | N |
| ANISOU | 1475 | NZ | LYS | A | 176 | 8066 | 8057 | 9370 | −819 | −245 | 518 | N |
| ATOM | 1476 | N | GLU | A | 177 | 31.015 | 28.897 | 14.386 | 1.00 | 82.66 | | N |
| ANISOU | 1476 | N | GLU | A | 177 | 10280 | 10314 | 10813 | −464 | 17 | 493 | N |
| ATOM | 1477 | CA | GLU | A | 177 | 31.091 | 29.028 | 12.929 | 1.00 | 86.05 | | C |
| ANISOU | 1477 | CA | GLU | A | 177 | 0751 | 10764 | 11179 | −440 | 84 | 574 | C |
| ATOM | 1478 | C | GLU | A | 177 | 29.816 | 28.542 | 12.248 | 1.00 | 86.24 | | C |
| ANISOU | 1478 | C | GLU | A | 177 | 10867 | 10804 | 11097 | −376 | 71 | 531 | C |
| ATOM | 1479 | O | GLU | A | 177 | 29.462 | 29.034 | 11.170 | 1.00 | 91.49 | | O |
| ANISOU | 1479 | O | GLU | A | 177 | 11589 | 11459 | 11713 | −361 | 88 | 587 | O |
| ATOM | 1480 | CB | GLU | A | 177 | 32.300 | 28.259 | 12.392 | 1.00 | 87.91 | | C |
| ANISOU | 1480 | CB | GLU | A | 177 | 10937 | 11069 | 11395 | −429 | 183 | 631 | C |
| ATOM | 1481 | CG | GLU | A | 177 | 33.561 | 28.411 | 13.248 | 1.00 | 92.88 | | C |
| ANISOU | 1481 | CG | GLU | A | 177 | 11461 | 11698 | 12132 | −486 | 190 | 658 | C |
| ATOM | 1482 | CD | GLU | A | 177 | 34.797 | 28.679 | 12.428 | 0.00 | 98.48 | | C |
| ANISOU | 1482 | CD | GLU | A | 177 | 12118 | 12432 | 12869 | −508 | 282 | 773 | C |
| ATOM | 1483 | OE1 | GLU | A | 177 | 34.882 | 28.177 | 11.288 | 1.00 | 100.09 | | O |
| ANISOU | 1483 | OE1 | GLU | A | 177 | 12359 | 12684 | 12987 | −459 | 365 | 816 | O |
| ATOM | 1484 | OE2 | GLU | A | 177 | 35.680 | 29.404 | 12.926 | 1.00 | 101.59 | | O |
| ANISOU | 1484 | OE2 | GLU | A | 177 | 12433 | 12795 | 13370 | −574 | 270 | 821 | O |
| ATOM | 1485 | N | THR | A | 178 | 29.117 | 27.585 | 12.863 | 1.00 | 78.57 | | N |
| ANISOU | 1485 | N | THR | A | 178 | 9908 | 9855 | 10089 | −341 | 37 | 436 | N |
| ATOM | 1486 | CA | THR | A | 178 | 27.833 | 27.038 | 12.435 | 1.00 | 74.77 | | C |
| ANISOU | 1486 | CA | THR | A | 178 | 9502 | 9385 | 9521 | −286 | 8 | 382 | C |
| ATOM | 1487 | C | THR | A | 178 | 26.643 | 27.752 | 13.077 | 1.00 | 74.03 | | C |
| ANISOU | 1487 | C | THR | A | 178 | 9436 | 9229 | 9462 | −292 | −83 | 329 | C |
| ATOM | 1488 | O | THR | A | 178 | 25.726 | 28.194 | 12.376 | 1.00 | 77.20 | | O |
| ANISOU | 1488 | O | THR | A | 178 | 9899 | 9608 | 9825 | −270 | −111 | 341 | O |
| ATOM | 1489 | CB | THR | A | 178 | 27.768 | 25.549 | 12.795 | 1.00 | 76.37 | | C |
| ANISOU | 1489 | CB | THR | A | 178 | 9698 | 9645 | 9675 | −247 | 26 | 310 | C |
| ATOM | 1490 | OG1 | THR | A | 178 | 28.790 | 24.831 | 12.102 | 1.00 | 82.49 | | O |
| ANISOU | 1490 | OG1 | THR | A | 178 | 10455 | 10478 | 10409 | −229 | 116 | 356 | O |
| ATOM | 1491 | CG2 | THR | A | 178 | 26.391 | 24.948 | 12.468 | 1.00 | 74.10 | | C |
| ANISOU | 1491 | CG2 | THR | A | 178 | 9481 | 9364 | 9308 | −197 | −15 | 246 | C |
| ATOM | 1492 | N | LEU | A | 179 | 26.635 | 27.871 | 14.408 | 1.00 | 65.78 | | N |
| ANISOU | 1492 | N | LEU | A | 179 | 8348 | 8155 | 8489 | −319 | −130 | 271 | N |
| ATOM | 1493 | CA | LEU | A | 179 | 25.409 | 28.250 | 15.109 | 1.00 | 56.40 | | C |
| ANISOU | 1493 | CA | LEU | A | 179 | 7189 | 6919 | 7322 | −309 | −207 | 203 | C |
| ATOM | 1494 | C | LEU | A | 179 | 25.151 | 29.749 | 15.115 | 1.00 | 56.67 | | C |
| ANISOU | 1494 | C | LEU | A | 179 | 7238 | 6874 | 7420 | −341 | −249 | 240 | C |
| ATOM | 1495 | O | LEU | A | 179 | 23.991 | 30.172 | 15.178 | 1.00 | 62.60 | | O |
| ANISOU | 1495 | O | LEU | A | 179 | 8031 | 7585 | 8169 | −318 | −301 | 208 | O |
| ATOM | 1496 | CB | LEU | A | 179 | 25.455 | 27.744 | 16.548 | 1.00 | 55.79 | | C |
| ANISOU | 1496 | CB | LEU | A | 179 | 7068 | 6844 | 7285 | −319 | −237 | 123 | C |
| ATOM | 1497 | CG | LEU | A | 179 | 25.487 | 26.235 | 16.675 | 1.00 | 49.95 | | C |
| ANISOU | 1497 | CG | LEU | A | 179 | 6319 | 6174 | 6488 | −282 | −206 | 77 | C |
| ATOM | 1498 | CD1 | LEU | A | 179 | 25.792 | 25.816 | 18.080 | 1.00 | 46.00 | | C |
| ANISOU | 1498 | CD1 | LEU | A | 179 | 5769 | 5676 | 6031 | −298 | −229 | 17 | C |
| ATOM | 1499 | CD2 | LEU | A | 179 | 24.138 | 25.723 | 16.237 | 1.00 | 52.39 | | C |
| ANISOU | 1499 | CD2 | LEU | A | 179 | 6685 | 6491 | 6731 | −232 | −231 | 33 | C |
| ATOM | 1500 | N | GLN | A | 180 | 26.194 | 30.570 | 15.092 | 1.00 | 57.52 | | N |
| ANISOU | 1500 | N | GLN | A | 180 | 7311 | 6953 | 7590 | −393 | −229 | 305 | N |
| ATOM | 1501 | CA | GLN | A | 180 | 26.028 | 32.015 | 15.098 | 1.00 | 61.70 | | C |
| ANISOU | 1501 | CA | GLN | A | 180 | 7857 | 7399 | 8188 | −427 | −267 | 343 | C |
| ATOM | 1502 | C | GLN | A | 180 | 26.160 | 32.622 | 13.704 | 1.00 | 68.57 | | C |
| ANISOU | 1502 | C | GLN | A | 180 | 8762 | 8262 | 9029 | −425 | −230 | 444 | C |
| ATOM | 1503 | O | GLN | A | 180 | 26.423 | 33.821 | 13.573 | 1.00 | 77.68 | | O |
| ANISOU | 1503 | O | GLN | A | 180 | 9917 | 9349 | 10247 | −465 | −242 | 503 | O |
| ATOM | 1504 | CB | GLN | A | 180 | 27.021 | 32.652 | 16.067 | 1.00 | 59.49 | | C |
| ANISOU | 1504 | CB | GLN | A | 180 | 7519 | 7078 | 8008 | −494 | −283 | 347 | C |
| ATOM | 1505 | CG | GLN | A | 180 | 27.067 | 31.968 | 17.432 | 1.00 | 63.08 | | C |
| ANISOU | 1505 | CG | GLN | A | 180 | 7938 | 7550 | 8481 | −497 | −314 | 255 | C |
| ATOM | 1506 | CD | GLN | A | 180 | 28.054 | 32.640 | 18.380 | 1.00 | 70.44 | | C |
| ANISOU | 1506 | CD | GLN | A | 180 | 8816 | 8439 | 9508 | −566 | −341 | 259 | C |
| ATOM | 1507 | OE1 | GLN | A | 180 | 28.068 | 33.862 | 18.498 | 1.00 | 81.79 | | O |
| ANISOU | 1507 | OE1 | GLN | A | 180 | 10266 | 9797 | 11013 | −606 | −376 | 282 | O |

TABLE 14-continued

| | | | | | | | | | | | |
|---|---|---|---|---|---|---|---|---|---|---|---|
| ATOM | 1508 | NE2 | GLN | A | 180 | 28.881 | 31.847 | 19.055 | 1.00 | 58.87 | N |
| ANISOU | 1508 | NE2 | GLN | A | 180 | 7293 | 7023 | 8051 | −581 | −329 | 236 | N |
| ATOM | 1509 | N | ARG | A | 181 | 25.976 | 31.824 | 12.663 | 1.00 | 70.09 | N |
| ANISOU | 1509 | N | ARG | A | 181 | 8989 | 8519 | 9124 | −379 | −186 | 467 | N |
| ATOM | 1510 | CA | ARG | A | 181 | 25.897 | 32.340 | 11.308 | 1.00 | 73.18 | C |
| ANISOU | 1510 | CA | ARG | A | 181 | 9430 | 8907 | 9469 | −367 | −156 | 556 | C |
| ATOM | 1511 | C | ARG | A | 181 | 24.457 | 32.722 | 10.973 | 1.00 | 74.05 | C |
| ANISOU | 1511 | C | ARG | A | 181 | 9606 | 8982 | 9546 | −327 | −218 | 534 | C |
| ATOM | 1512 | O | ARG | A | 181 | 23.499 | 32.168 | 11.518 | 1.00 | 74.13 | O |
| ANISOU | 1512 | O | ARG | A | 181 | 9629 | 9000 | 9539 | −294 | −265 | 449 | O |
| ATOM | 1513 | CB | ARG | A | 181 | 26.395 | 31.300 | 10.307 | 1.00 | 71.21 | C |
| ANISOU | 1513 | CB | ARG | A | 181 | 9193 | 8743 | 9119 | −333 | −78 | 590 | C |
| ATOM | 1514 | CG | ARG | A | 181 | 25.301 | 30.329 | 9.891 | 1.00 | 73.38 | C |
| ANISOU | 1514 | CG | ARG | A | 181 | 9527 | 9062 | 9292 | −270 | −99 | 529 | C |
| ATOM | 1515 | CD | ARG | A | 181 | 25.842 | 29.159 | 9.121 | 1.00 | 80.49 | C |
| ANISOU | 1515 | CD | ARG | A | 181 | 10440 | 10044 | 10098 | −237 | −24 | 539 | C |
| ATOM | 1516 | NE | ARG | A | 181 | 24.768 | 28.438 | 8.448 | 1.00 | 86.17 | N |
| ANISOU | 1516 | NE | ARG | A | 181 | 11232 | 10795 | 10715 | −181 | −49 | 499 | N |
| ATOM | 1517 | CZ | ARG | A | 181 | 24.094 | 27.428 | 8.985 | 1.00 | 85.62 | C |
| ANISOU | 1517 | CZ | ARG | A | 181 | 11164 | 10749 | 10620 | −153 | −83 | 405 | C |
| ATOM | 1518 | NH1 | ARG | A | 181 | 23.137 | 26.835 | 8.286 | 1.00 | 90.66 | N |
| ANISOU | 1518 | NH1 | ARG | A | 181 | 11868 | 11412 | 11168 | −108 | −110 | 375 | N |
| ATOM | 1519 | NH2 | ARG | A | 181 | 24.378 | 27.011 | 10.214 | 1.00 | 78.27 | N |
| ANISOU | 1519 | NH2 | ARG | A | 181 | 10170 | 9816 | 9753 | −171 | −91 | 344 | N |
| ATOM | 1520 | N | THR | A | 182 | 24.320 | 33.637 | 10.033 | 1.00 | 81.26 | N |
| ANISOU | 1520 | N | THR | A | 182 | 10561 | 9861 | 10452 | −328 | −216 | 618 | N |
| ATOM | 1521 | CA | THR | A | 182 | 22.999 | 34.005 | 9.502 | 1.00 | 86.56 | C |
| ANISOU | 1521 | CA | THR | A | 182 | 11298 | 10505 | 11086 | −286 | −272 | 616 | C |
| ATOM | 1522 | C | THR | A | 182 | 23.150 | 33.940 | 7.992 | 1.00 | 86.99 | C |
| ANISOU | 1522 | C | THR | A | 182 | 11407 | 10601 | 11045 | −262 | −226 | 705 | C |
| ATOM | 1523 | O | THR | A | 182 | 24.020 | 34.613 | 7.481 | 1.00 | 90.01 | O |
| ANISOU | 1523 | O | THR | A | 182 | 11783 | 10967 | 11449 | −295 | −178 | 797 | O |
| ATOM | 1524 | CB | THR | A | 182 | 22.594 | 35.427 | 9.865 | 1.00 | 91.06 | C |
| ANISOU | 1524 | CB | THR | A | 182 | 11874 | 10974 | 11749 | −309 | −326 | 639 | C |
| ATOM | 1525 | OG1 | THR | A | 182 | 23.660 | 36.246 | 9.399 | 1.00 | 98.01 | O |
| ANISOU | 1525 | OG1 | THR | A | 182 | 12742 | 11828 | 12671 | −357 | −279 | 739 | O |
| ATOM | 1526 | CG2 | THR | A | 182 | 22.362 | 35.608 | 11.344 | 1.00 | 87.90 | C |
| ANISOU | 1526 | CG2 | THR | A | 182 | 11434 | 10527 | 11439 | −329 | −375 | 550 | C |
| ATOM | 1527 | N | ASP | A | 183 | 22.397 | 33.060 | 7.356 | 1.00 | 81.41 | N |
| ANISOU | 1527 | N | ASP | A | 183 | 10748 | 9949 | 10234 | −209 | −237 | 674 | N |
| ATOM | 1528 | CA | ASP | A | 183 | 22.423 | 32.923 | 5.888 | 1.00 | 79.15 | C |
| ANISOU | 1528 | CA | ASP | A | 183 | 10529 | 9706 | 9838 | −179 | −200 | 749 | C |
| ATOM | 1529 | C | ASP | A | 183 | 21.185 | 33.637 | 5.378 | 1.00 | 82.02 | C |
| ANISOU | 1529 | C | ASP | A | 183 | 10950 | 10027 | 10186 | −150 | −276 | 769 | C |
| ATOM | 1530 | O | ASP | A | 183 | 20.082 | 33.211 | 5.695 | 1.00 | 80.49 | O |
| ANISOU | 1530 | O | ASP | A | 183 | 10767 | 9835 | 9980 | −118 | −342 | 694 | O |
| ATOM | 1531 | CB | ASP | A | 183 | 22.438 | 31.460 | 5.462 | 1.00 | 73.21 | C |
| ANISOU | 1531 | CB | ASP | A | 183 | 9800 | 9041 | 8975 | −140 | −166 | 701 | C |
| ATOM | 1532 | CG | ASP | A | 183 | 23.739 | 30.786 | 5.796 | 1.00 | 74.55 | C |
| ANISOU | 1532 | CG | ASP | A | 183 | 9914 | 9254 | 9155 | −162 | −82 | 698 | C |
| ATOM | 1533 | OD1 | ASP | A | 183 | 24.620 | 31.485 | 6.263 | 1.00 | 79.92 | O |
| ANISOU | 1533 | OD1 | ASP | A | 183 | 10540 | 9901 | 9925 | −210 | −53 | 741 | O |
| ATOM | 1534 | OD2 | ASP | A | 183 | 23.851 | 29.583 | 5.574 | 1.00 | 74.54 | O |
| ANISOU | 1534 | OD2 | ASP | A | 183 | 9926 | 9318 | 9077 | −132 | −48 | 655 | O |
| ATOM | 1535 | N | ALA | A | 184 | 21.385 | 34.725 | 4.651 | 1.00 | 86.54 | N |
| ANISOU | 1535 | N | ALA | A | 184 | 11553 | 10559 | 10769 | −163 | −266 | 872 | N |
| ATOM | 1536 | CA | ALA | A | 184 | 20.223 | 35.462 | 4.130 | 1.00 | 85.99 | C |
| ANISOU | 1536 | CA | ALA | A | 184 | 11539 | 10446 | 10689 | −133 | −340 | 901 | C |
| ATOM | 1537 | C | ALA | A | 184 | 19.648 | 34.676 | 2.961 | 1.00 | 81.05 | C |
| ANISOU | 1537 | C | ALA | A | 184 | 10987 | 9891 | 9920 | −81 | −348 | 909 | C |
| ATOM | 1538 | O | ALA | A | 184 | 20.402 | 34.001 | 2.279 | 1.00 | 78.97 | O |
| ANISOU | 1538 | O | ALA | A | 184 | 10745 | 9692 | 9568 | −76 | −276 | 935 | O |
| ATOM | 1539 | CB | ALA | A | 184 | 20.639 | 36.848 | 3.725 | 1.00 | 88.93 | C |
| ANISOU | 1539 | CB | ALA | A | 184 | 11922 | 10750 | 11118 | −163 | −326 | 1012 | C |
| ATOM | 1540 | N | PRO | A | 185 | 18.341 | 34.791 | 2.682 | 1.00 | 83.73 | N |
| ANISOU | 1540 | N | PRO | A | 185 | 11365 | 10216 | 10233 | −42 | −434 | 890 | N |
| ATOM | 1541 | CA | PRO | A | 185 | 17.702 | 34.093 | 1.577 | 1.00 | 90.16 | C |
| ANISOU | 1541 | CA | PRO | A | 185 | 12254 | 11091 | 10912 | 5 | −460 | 894 | C |
| ATOM | 1542 | C | PRO | A | 185 | 18.043 | 34.542 | 0.148 | 1.00 | 101.50 | C |
| ANISOU | 1542 | C | PRO | A | 185 | 13768 | 12547 | 12250 | 18 | −426 | 1011 | C |
| ATOM | 1543 | O | PRO | A | 185 | 18.977 | 35.253 | −0.096 | 1.00 | 98.47 | O |
| ANISOU | 1543 | O | PRO | A | 185 | 13380 | 12143 | 11892 | −12 | −360 | 1096 | O |
| ATOM | 1544 | CB | PRO | A | 185 | 16.222 | 34.433 | 1.762 | 1.00 | 84.25 | C |
| ANISOU | 1544 | CB | PRO | A | 185 | 11512 | 10303 | 10197 | 36 | −570 | 862 | C |
| ATOM | 1545 | CG | PRO | A | 185 | 16.101 | 34.854 | 3.185 | 1.00 | 80.88 | C |
| ANISOU | 1545 | CG | PRO | A | 185 | 11007 | 9812 | 9910 | 11 | −590 | 802 | C |
| ATOM | 1546 | CD | PRO | A | 185 | 17.399 | 35.560 | 3.469 | 1.00 | 81.52 | C |
| ANISOU | 1546 | CD | PRO | A | 185 | 11058 | 9860 | 10057 | −39 | −514 | 859 | C |
| ATOM | 1547 | N | LYS | A | 186 | 17.254 | 34.085 | −0.815 | 1.00 | 113.47 | N |
| ANISOU | 1547 | N | LYS | A | 186 | 15359 | 14106 | 13648 | 62 | −473 | 1013 | N |

TABLE 14-continued

| | | | | | | | | | | | | |
|---|---|---|---|---|---|---|---|---|---|---|---|---|
| ATOM | 1548 | CA | LYS | A | 186 | 17.542 | 34.515 | −2.202 | 1.00 | 115.89 | | C |
| ANISOU | 1548 | CA | LYS | A | 186 | 15749 | 14434 | 13848 | 78 | −443 | 1126 | C |
| ATOM | 1549 | C | LYS | A | 186 | 16.267 | 35.042 | −2.854 | 1.00 | 119.79 | | C |
| ANISOU | 1549 | C | LYS | A | 186 | 16302 | 14907 | 14309 | 114 | −549 | 1159 | C |
| ATOM | 1550 | O | LYS | A | 186 | 15.200 | 34.544 | −2.518 | 1.00 | 119.82 | | O |
| ANISOU | 1550 | O | LYS | A | 186 | 16295 | 14915 | 14318 | 137 | −636 | 1078 | O |
| ATOM | 1551 | CB | LYS | A | 186 | 18.084 | 33.347 | −3.025 | 1.00 | 108.96 | | C |
| ANISOU | 1551 | CB | LYS | A | 186 | 14930 | 13647 | 12821 | 99 | −378 | 1113 | C |
| ATOM | 1552 | CG | LYS | A | 186 | 18.995 | 32.387 | −2.281 | 1.00 | 102.23 | | C |
| ANISOU | 1552 | CG | LYS | A | 186 | 14019 | 12832 | 11993 | 79 | −299 | 1040 | C |
| ATOM | 1553 | CD | LYS | A | 186 | 20.330 | 32.999 | −1.964 | 1.00 | 100.02 | | C |
| ANISOU | 1553 | CD | LYS | A | 186 | 13684 | 12530 | 11791 | 35 | −198 | 1108 | C |
| ATOM | 1554 | CE | LYS | A | 186 | 21.413 | 32.485 | −2.883 | 1.00 | 98.47 | | C |
| ANISOU | 1554 | CE | LYS | A | 186 | 13530 | 12400 | 11484 | 46 | −84 | 1163 | C |
| ATOM | 1555 | NZ | LYS | A | 186 | 22.194 | 31.387 | −2.270 | 1.00 | 97.02 | | N |
| ANISOU | 1555 | NZ | LYS | A | 186 | 13294 | 12261 | 11309 | 39 | −15 | 1089 | N |
| ATOM | 1556 | N | THR | A | 187 | 16.382 | 36.072 | −3.689 | 1.00 | 122.28 | | N |
| ANISOU | 1556 | N | THR | A | 187 | 16666 | 15193 | 14603 | 118 | −543 | 1279 | N |
| ATOM | 1557 | CA | THR | A | 187 | 15.190 | 36.500 | −4.454 | 1.00 | 127.48 | | C |
| ANISOU | 1557 | CA | THR | A | 187 | 17387 | 15839 | 15210 | 158 | −647 | 1319 | C |
| ATOM | 1558 | C | THR | A | 187 | 15.040 | 35.455 | −5.551 | 1.00 | 125.83 | | C |
| ANISOU | 1558 | C | THR | A | 187 | 17268 | 15721 | 14821 | 194 | −651 | 1306 | C |
| ATOM | 1559 | O | THR | A | 187 | 16.086 | 35.012 | −6.077 | 1.00 | 122.13 | | O |
| ANISOU | 1559 | O | THR | A | 187 | 16835 | 15304 | 14265 | 188 | −549 | 1335 | O |
| ATOM | 1560 | CB | THR | A | 187 | 15.371 | 37.872 | −5.120 | 1.00 | 136.33 | | C |
| ANISOU | 1560 | CB | THR | A | 187 | 18546 | 16905 | 16349 | 155 | −639 | 1459 | C |
| ATOM | 1561 | OG1 | THR | A | 187 | 14.166 | 38.300 | −5.762 | 1.00 | 135.38 | | O |
| ANISOU | 1561 | OG1 | THR | A | 187 | 18478 | 16770 | 16192 | 197 | −748 | 1495 | O |
| ATOM | 1562 | CG2 | THR | A | 187 | 16.469 | 37.885 | −6.159 | 1.00 | 142.38 | | C |
| ANISOU | 1562 | CG2 | THR | A | 187 | 19375 | 17717 | 17004 | 149 | −535 | 1556 | C |
| ATOM | 1563 | N | HIS | A | 188 | 13.800 | 35.069 | −5.844 | 1.00 | 128.70 | | N |
| ANISOU | 1563 | N | HIS | A | 188 | 17663 | 16101 | 15135 | 230 | −763 | 1262 | N |
| ATOM | 1564 | CA | HIS | A | 188 | 13.491 | 34.082 | −6.908 | 1.00 | 131.89 | | C |
| ANISOU | 1564 | CA | HIS | A | 188 | 18162 | 16586 | 15364 | 264 | −790 | 1242 | C |
| ATOM | 1565 | C | HIS | A | 188 | 11.997 | 34.184 | −7.200 | 1.00 | 130.24 | | C |
| ANISOU | 1565 | C | HIS | A | 188 | 17975 | 16366 | 15143 | 297 | −937 | 1229 | C |
| ATOM | 1566 | O | HIS | A | 188 | 11.203 | 34.040 | −6.255 | 1.00 | 129.19 | | O |
| ANISOU | 1566 | O | HIS | A | 188 | 17765 | 16202 | 15119 | 294 | −1005 | 1150 | O |
| ATOM | 1567 | CB | HIS | A | 188 | 13.919 | 32.689 | −6.448 | 1.00 | 135.18 | | C |
| ANISOU | 1567 | CB | HIS | A | 188 | 18557 | 17057 | 15747 | 256 | −741 | 1128 | C |
| ATOM | 1568 | CG | HIS | A | 188 | 13.799 | 31.618 | −7.467 | 1.00 | 138.58 | | C |
| ANISOU | 1568 | CG | HIS | A | 188 | 19087 | 17565 | 16001 | 287 | −750 | 1098 | C |
| ATOM | 1569 | ND1 | HIS | A | 188 | 12.780 | 31.591 | −8.381 | 1.00 | 140.15 | | N |
| ANISOU | 1569 | ND1 | HIS | A | 188 | 19366 | 17783 | 16101 | 320 | −858 | 1115 | N |
| ATOM | 1570 | CD2 | HIS | A | 188 | 14.556 | 30.524 | −7.688 | 1.00 | 138.88 | | C |
| ANISOU | 1570 | CD2 | HIS | A | 188 | 19159 | 17664 | 15947 | 290 | −669 | 1048 | C |
| ATOM | 1571 | CE1 | HIS | A | 188 | 12.914 | 30.528 | −9.134 | 1.00 | 140.62 | | C |
| ANISOU | 1571 | CE1 | HIS | A | 188 | 19509 | 17910 | 16008 | 341 | −845 | 1073 | C |
| ATOM | 1572 | NE2 | HIS | A | 188 | 13.996 | 29.857 | −8.729 | 1.00 | 140.11 | | N |
| ANISOU | 1572 | NE2 | HIS | A | 188 | 19420 | 17871 | 15945 | 325 | −727 | 1031 | N |
| ATOM | 1573 | N | MET | A | 189 | 11.651 | 34.475 | −8.455 | 1.00 | 127.19 | | N |
| ANISOU | 1573 | N | MET | A | 189 | 17688 | 16004 | 14634 | 328 | −983 | 1310 | N |
| ATOM | 1574 | CA | MET | A | 189 | 10.240 | 34.624 | −8.890 | 1.00 | 123.13 | | C |
| ANISOU | 1574 | CA | MET | A | 189 | 17200 | 15484 | 14098 | 361 | −1131 | 1314 | C |
| ATOM | 1575 | C | MET | A | 189 | 9.885 | 33.462 | −9.812 | 1.00 | 121.14 | | C |
| ANISOU | 1575 | C | MET | A | 189 | 17041 | 15313 | 13672 | 385 | −1179 | 1265 | C |
| ATOM | 1576 | O | MET | A | 189 | 10.820 | 32.992 | −10.489 | 1.00 | 120.80 | | O |
| ANISOU | 1576 | O | MET | A | 189 | 17074 | 15323 | 13502 | 387 | −1087 | 1283 | O |
| ATOM | 1577 | CB | MET | A | 189 | 10.084 | 35.927 | −9.668 | 1.00 | 126.22 | | C |
| ANISOU | 1577 | CB | MET | A | 189 | 17642 | 15837 | 14479 | 379 | −1158 | 1454 | C |
| ATOM | 1578 | CG | MET | A | 189 | 10.080 | 37.146 | −8.793 | 1.00 | 131.20 | | C |
| ANISOU | 1578 | CG | MET | A | 189 | 18186 | 16374 | 15291 | 361 | −1149 | 1498 | C |
| ATOM | 1579 | SD | MET | A | 189 | 8.398 | 37.458 | −8.255 | 1.00 | 135.32 | | S |
| ANISOU | 1579 | SD | MET | A | 189 | 18643 | 16845 | 15926 | 390 | −1308 | 1457 | S |
| ATOM | 1580 | CE | MET | A | 189 | 7.947 | 35.821 | −7.687 | 1.00 | 133.61 | | C |
| ANISOU | 1580 | CE | MET | A | 189 | 18389 | 16692 | 15684 | 385 | −1342 | 1295 | C |
| ATOM | 1581 | N | CYS | A | 203 | 6.597 | 33.381 | −4.951 | 1.00 | 109.25 | | N |
| ANISOU | 1581 | N | CYS | A | 203 | 15087 | 13627 | 12797 | 358 | −1412 | 956 | N |
| ATOM | 1582 | CA | CYS | A | 203 | 7.868 | 33.961 | −4.449 | 1.00 | 115.96 | | C |
| ANISOU | 1582 | CA | CYS | A | 203 | 15916 | 14444 | 13698 | 329 | −1286 | 988 | C |
| ATOM | 1583 | C | CYS | A | 203 | 8.709 | 32.851 | −3.829 | 1.00 | 121.17 | | C |
| ANISOU | 1583 | C | CYS | A | 203 | 16552 | 15145 | 14343 | 300 | −1198 | 895 | C |
| ATOM | 1584 | O | CYS | A | 203 | 8.183 | 32.136 | −2.970 | 1.00 | 120.62 | | O |
| ANISOU | 1584 | O | CYS | A | 203 | 16418 | 15078 | 14335 | 295 | −1227 | 798 | O |
| ATOM | 1585 | CB | CYS | A | 203 | 7.609 | 34.984 | −3.363 | 1.00 | 121.01 | | C |
| ANISOU | 1585 | CB | CYS | A | 203 | 16467 | 14998 | 14513 | 323 | −1288 | 995 | C |
| ATOM | 1586 | SG | CYS | A | 203 | 8.878 | 36.266 | −3.300 | 1.00 | 134.55 | | S |
| ANISOU | 1586 | SG | CYS | A | 203 | 18190 | 16654 | 16281 | 296 | −1181 | 1096 | S |
| ATOM | 1587 | N | TRP | A | 204 | 9.970 | 32.755 | −4.238 | 1.00 | 127.75 | | N |
| ANISOU | 1587 | N | TRP | A | 204 | 17430 | 16005 | 15102 | 283 | −1091 | 932 | N |

TABLE 14-continued

| | | | | | | | | | | | | |
|---|---|---|---|---|---|---|---|---|---|---|---|---|
| ATOM | 1588 | CA | TRP | A | 204 | 10.848 | 31.661 | −3.766 | 1.00 | 129.99 | | C |
| ANISOU | 1588 | CA | TRP | A | 204 | 17696 | 16332 | 15361 | 260 | −1003 | 852 | C |
| ATOM | 1589 | C | TRP | A | 204 | 11.972 | 32.199 | −2.885 | 1.00 | 123.27 | | C |
| ANISOU | 1589 | C | TRP | A | 204 | 16782 | 15444 | 14613 | 225 | −897 | 868 | C |
| ATOM | 1590 | O | TRP | A | 204 | 12.756 | 32.990 | −3.376 | 1.00 | 123.22 | | O |
| ANISOU | 1590 | O | TRP | A | 204 | 16805 | 15422 | 14590 | 215 | −836 | 962 | O |
| ATOM | 1591 | CB | TRP | A | 204 | 11.435 | 30.933 | −4.968 | 1.00 | 136.70 | | C |
| ANISOU | 1591 | CB | TRP | A | 204 | 18650 | 17254 | 16035 | 274 | −960 | 873 | C |
| ATOM | 1592 | CG | TRP | A | 204 | 10.525 | 29.933 | −5.599 | 1.00 | 141.86 | | C |
| ANISOU | 1592 | CG | TRP | A | 204 | 19362 | 17957 | 16582 | 299 | −1051 | 813 | C |
| ATOM | 1593 | CD1 | TRP | A | 204 | 9.313 | 30.164 | −6.175 | 1.00 | 146.50 | | C |
| ANISOU | 1593 | CD1 | TRP | A | 204 | 19982 | 18541 | 17142 | 324 | −1178 | 832 | C |
| ATOM | 1594 | CD2 | TRP | A | 204 | 10.763 | 28.524 | −5.711 | 1.00 | 142.00 | | C |
| ANISOU | 1594 | CD2 | TRP | A | 204 | 19412 | 18032 | 16512 | 300 | −1026 | 724 | C |
| ATOM | 1595 | NE1 | TRP | A | 204 | 8.782 | 28.995 | −6.644 | 1.00 | 149.57 | | N |
| ANISOU | 1595 | NE1 | TRP | A | 204 | 20419 | 18980 | 17429 | 335 | −1238 | 759 | N |
| ATOM | 1596 | CE2 | TRP | A | 204 | 9.649 | 27.972 | −6.370 | 1.00 | 146.89 | | C |
| ANISOU | 1596 | CE2 | TRP | A | 204 | 20084 | 18676 | 17051 | 322 | −1146 | 690 | C |
| ATOM | 1597 | CE3 | TRP | A | 204 | 11.810 | 27.681 | −5.331 | 1.00 | 135.45 | | C |
| ANISOU | 1597 | CE3 | TRP | A | 204 | 18570 | 17231 | 15664 | 285 | −917 | 671 | C |
| ATOM | 1598 | CZ2 | TRP | A | 204 | 9.552 | 26.610 | −6.642 | 1.00 | 143.39 | | C |
| ANISOU | 1598 | CZ2 | TRP | A | 204 | 19687 | 18282 | 16513 | 326 | −1159 | 601 | C |
| ATOM | 1599 | CZ3 | TRP | A | 204 | 11.716 | 26.337 | −5.604 | 1.00 | 132.22 | | C |
| ANISOU | 1599 | CZ3 | TRP | A | 204 | 18206 | 16871 | 15162 | 295 | −925 | 586 | C |
| ATOM | 1600 | CH2 | TRP | A | 204 | 10.601 | 25.815 | −6.250 | 1.00 | 136.52 | | C |
| ANISOU | 1600 | CH2 | TRP | A | 204 | 18809 | 17435 | 15629 | 314 | −1045 | 550 | C |
| ATOM | 1601 | N | ALA | A | 205 | 12.016 | 31.754 | −1.629 | 1.00 | 112.70 | | N |
| ANISOU | 1601 | N | ALA | A | 205 | 15358 | 14089 | 13373 | 205 | −881 | 778 | N |
| ATOM | 1602 | CA | ALA | A | 205 | 13.081 | 32.097 | −0.687 | 1.00 | 97.94 | | C |
| ANISOU | 1602 | CA | ALA | A | 205 | 13424 | 12189 | 11600 | 167 | −789 | 776 | C |
| ATOM | 1603 | C | ALA | A | 205 | 13.875 | 30.835 | −0.374 | 1.00 | 90.23 | | C |
| ANISOU | 1603 | C | ALA | A | 205 | 12436 | 11270 | 10579 | 154 | −716 | 703 | C |
| ATOM | 1604 | O | ALA | A | 205 | 13.334 | 29.892 | 0.209 | 1.00 | 91.58 | | O |
| ANISOU | 1604 | O | ALA | A | 205 | 12575 | 11460 | 10762 | 160 | −750 | 607 | O |
| ATOM | 1605 | CB | ALA | A | 205 | 12.507 | 32.702 | 0.595 | 1.00 | 89.63 | | C |
| ANISOU | 1605 | CB | ALA | A | 205 | 12284 | 11066 | 10703 | 156 | −830 | 735 | C |
| ATOM | 1606 | N | LEU | A | 206 | 15.148 | 30.813 | −0.760 | 1.00 | 81.79 | | N |
| ANISOU | 1606 | N | LEU | A | 206 | 11387 | 10226 | 9463 | 139 | −613 | 752 | N |
| ATOM | 1607 | CA | LEU | A | 206 | 15.957 | 29.606 | −0.694 | 1.00 | 79.52 | | C |
| ANISOU | 1607 | CA | LEU | A | 206 | 11100 | 9997 | 9116 | 135 | −538 | 697 | C |
| ATOM | 1608 | C | LEU | A | 206 | 17.197 | 29.799 | 0.172 | 1.00 | 85.95 | | C |
| ANISOU | 1608 | C | LEU | A | 206 | 11842 | 10797 | 10020 | 97 | −443 | 703 | C |
| ATOM | 1609 | O | LEU | A | 206 | 17.728 | 30.908 | 0.304 | 1.00 | 84.78 | | O |
| ANISOU | 1609 | O | LEU | A | 206 | 11667 | 10602 | 9942 | 71 | −413 | 778 | O |
| ATOM | 1610 | CB | LEU | A | 206 | 16.419 | 29.162 | −2.085 | 1.00 | 78.28 | | C |
| ANISOU | 1610 | CB | LEU | A | 206 | 11043 | 9901 | 8799 | 160 | −491 | 746 | C |
| ATOM | 1611 | CG | LEU | A | 206 | 15.426 | 28.637 | −3.114 | 1.00 | 75.29 | | C |
| ANISOU | 1611 | CG | LEU | A | 206 | 10756 | 9558 | 8292 | 199 | −572 | 730 | C |
| ATOM | 1612 | CD1 | LEU | A | 206 | 16.188 | 28.179 | −4.343 | 1.00 | 78.67 | | C |
| ANISOU | 1612 | CD1 | LEU | A | 206 | 11280 | 10046 | 8563 | 221 | −497 | 775 | C |
| ATOM | 1613 | CD2 | LEU | A | 206 | 14.606 | 27.507 | −2.544 | 1.00 | 72.71 | | C |
| ANISOU | 1613 | CD2 | LEU | A | 206 | 10405 | 9247 | 7974 | 207 | −638 | 611 | C |
| ATOM | 1614 | N | SER | A | 207 | 17.650 | 28.687 | 0.759 | 1.00 | 88.08 | | N |
| ANISOU | 1614 | N | SER | A | 207 | 12076 | 11102 | 10286 | 92 | −400 | 624 | N |
| ATOM | 1615 | CA | SER | A | 207 | 18.991 | 28.570 | 1.332 | 1.00 | 81.68 | | C |
| ANISOU | 1615 | CA | SER | A | 207 | 11208 | 10299 | 9525 | 62 | −299 | 632 | C |
| ATOM | 1616 | C | SER | A | 207 | 19.227 | 29.542 | 2.485 | 1.00 | 78.45 | | C |
| ANISOU | 1616 | C | SER | A | 207 | 10715 | 9824 | 9267 | 21 | −306 | 641 | C |
| ATOM | 1617 | O | SER | A | 207 | 20.318 | 30.100 | 2.628 | 1.00 | 75.84 | | O |
| ANISOU | 1617 | O | SER | A | 207 | 10350 | 9480 | 8986 | −12 | −236 | 700 | O |
| ATOM | 1618 | CB | SER | A | 207 | 20.056 | 28.763 | 0.254 | 1.00 | 82.19 | | C |
| ANISOU | 1618 | CB | SER | A | 207 | 11322 | 10398 | 9508 | 65 | −204 | 727 | C |
| ATOM | 1619 | OG | SER | A | 207 | 21.327 | 28.946 | 0.850 | 1.00 | 86.77 | | O |
| ANISOU | 1619 | OG | SER | A | 207 | 11832 | 10973 | 10164 | 29 | −115 | 754 | O |
| ATOM | 1620 | N | PHE | A | 208 | 18.214 | 29.749 | 3.324 | 1.00 | 74.49 | | N |
| ANISOU | 1620 | N | PHE | A | 208 | 10180 | 9281 | 8843 | 21 | −390 | 581 | N |
| ATOM | 1621 | CA | PHE | A | 208 | 18.377 | 30.650 | 4.455 | 1.00 | 73.53 | | C |
| ANISOU | 1621 | CA | PHE | A | 208 | 9987 | 9093 | 8858 | −15 | −400 | 579 | C |
| ATOM | 1622 | C | PHE | A | 208 | 18.569 | 29.879 | 5.760 | 1.00 | 73.17 | | C |
| ANISOU | 1622 | C | PHE | A | 208 | 9872 | 9055 | 8874 | −30 | −391 | 483 | C |
| ATOM | 1623 | O | PHE | A | 208 | 18.222 | 28.700 | 5.874 | 1.00 | 70.56 | | O |
| ANISOU | 1623 | O | PHE | A | 208 | 9545 | 8770 | 8494 | −8 | −399 | 410 | O |
| ATOM | 1624 | CB | PHE | A | 208 | 17.199 | 31.630 | 4.567 | 1.00 | 71.82 | | C |
| ANISOU | 1624 | CB | PHE | A | 208 | 9778 | 8812 | 8697 | −3 | −490 | 589 | C |
| ATOM | 1625 | CG | PHE | A | 208 | 15.837 | 30.989 | 4.593 | 1.00 | 73.47 | | C |
| ANISOU | 1625 | CG | PHE | A | 208 | 10002 | 9036 | 8877 | 35 | −572 | 520 | C |
| ATOM | 1626 | CD1 | PHE | A | 208 | 15.134 | 30.764 | 3.416 | 1.00 | 77.62 | | C |
| ANISOU | 1626 | CD1 | PHE | A | 208 | 10599 | 9593 | 9302 | 70 | −616 | 548 | C |
| ATOM | 1627 | CD2 | PHE | A | 208 | 15.230 | 30.671 | 5.795 | 1.00 | 66.91 | | C |
| ANISOU | 1627 | CD2 | PHE | A | 208 | 9114 | 8186 | 8125 | 34 | −610 | 431 | C |

TABLE 14-continued

| | | | | | | | | | | | | |
|---|---|---|---|---|---|---|---|---|---|---|---|---|
| ATOM | 1628 | CE1 | PHE | A | 208 | 13.862 | 30.198 | 3.438 | 1.00 | 73.77 | | C |
| ANISOU | 1628 | CE1 | PHE | A | 208 | 10117 | 9116 | 8796 | 100 | −699 | 487 | C |
| ATOM | 1629 | CE2 | PHE | A | 208 | 13.969 | 30.107 | 5.825 | 1.00 | 64.62 | | C |
| ANISOU | 1629 | CE2 | PHE | A | 208 | 8828 | 7907 | 7818 | 66 | −683 | 374 | C |
| ATOM | 1630 | CZ | PHE | A | 208 | 13.280 | 29.870 | 4.641 | 1.00 | 70.41 | | C |
| ANISOU | 1630 | CZ | PHE | A | 208 | 9626 | 8671 | 8457 | 97 | −731 | 402 | C |
| ATOM | 1631 | N | TYR | A | 209 | 19.179 | 30.565 | 6.740 | 1.00 | 73.26 | | N |
| ANISOU | 1631 | N | TYR | A | 209 | 9822 | 9019 | 8993 | −70 | −374 | 486 | N |
| ATOM | 1632 | CA | TYR | A | 209 | 19.351 | 30.103 | 8.135 | 1.00 | 69.76 | | C |
| ANISOU | 1632 | CA | TYR | A | 209 | 9310 | 8570 | 8624 | −89 | −375 | 402 | C |
| ATOM | 1633 | C | TYR | A | 209 | 19.431 | 31.319 | 9.054 | 1.00 | 72.50 | | C |
| ANISOU | 1633 | C | TYR | A | 209 | 9617 | 8838 | 9092 | −124 | −400 | 412 | C |
| ATOM | 1634 | O | TYR | A | 209 | 20.229 | 32.228 | 8.782 | 1.00 | 72.16 | | O |
| ANISOU | 1634 | O | TYR | A | 209 | 9570 | 8763 | 9084 | −156 | −368 | 488 | O |
| ATOM | 1635 | CB | TYR | A | 209 | 20.591 | 29.237 | 8.331 | 1.00 | 65.48 | | C |
| ANISOU | 1635 | CB | TYR | A | 209 | 8735 | 8081 | 8063 | −106 | −295 | 393 | C |
| ATOM | 1636 | CG | TYR | A | 209 | 20.658 | 28.678 | 9.733 | 1.00 | 65.24 | | C |
| ANISOU | 1636 | CG | TYR | A | 209 | 8643 | 8049 | 8098 | −120 | −305 | 306 | C |
| ATOM | 1637 | CD1 | TYR | A | 209 | 20.014 | 27.491 | 10.049 | 1.00 | 64.42 | | C |
| ANISOU | 1637 | CD1 | TYR | A | 209 | 8540 | 7983 | 7955 | −90 | −325 | 224 | C |
| ATOM | 1638 | CD2 | TYR | A | 209 | 21.333 | 29.356 | 10.752 | 1.00 | 64.85 | | C |
| ANISOU | 1638 | CD2 | TYR | A | 209 | 8535 | 7957 | 8149 | −164 | −299 | 307 | C |
| ATOM | 1639 | CE1 | TYR | A | 209 | 20.046 | 26.977 | 11.331 | 1.00 | 66.18 | | C |
| ANISOU | 1639 | CE1 | TYR | A | 209 | 8710 | 8205 | 8233 | −100 | −333 | 150 | C |
| ATOM | 1640 | CE2 | TYR | A | 209 | 21.374 | 28.851 | 12.044 | 1.00 | 62.32 | | C |
| ANISOU | 1640 | CE2 | TYR | A | 209 | 8165 | 7636 | 7878 | −174 | −312 | 228 | C |
| ATOM | 1641 | CZ | TYR | A | 209 | 20.729 | 27.656 | 12.322 | 1.00 | 64.26 | | C |
| ANISOU | 1641 | CZ | TYR | A | 209 | 8414 | 7923 | 8079 | −141 | −326 | 152 | C |
| ATOM | 1642 | OH | TYR | A | 209 | 20.742 | 27.127 | 13.581 | 1.00 | 54.80 | | O |
| ANISOU | 1642 | OH | TYR | A | 209 | 7169 | 6727 | 6924 | −148 | −336 | 79 | O |
| ATOM | 1643 | N | PRO | A | 210 | 18.652 | 31.369 | 10.150 | 1.00 | 73.22 | | N |
| ANISOU | 1643 | N | PRO | A | 210 | 9679 | 8894 | 9248 | −119 | −453 | 336 | N |
| ATOM | 1644 | CA | PRO | A | 210 | 17.736 | 30.350 | 10.670 | 1.00 | 68.74 | | C |
| ANISOU | 1644 | CA | PRO | A | 210 | 9102 | 8357 | 8659 | −87 | −488 | 245 | C |
| ATOM | 1645 | C | PRO | A | 210 | 16.436 | 30.231 | 9.900 | 1.00 | 66.89 | | C |
| ANISOU | 1645 | C | PRO | A | 210 | 8914 | 8129 | 8374 | −43 | −546 | 244 | C |
| ATOM | 1646 | O | PRO | A | 210 | 16.278 | 30.851 | 8.852 | 1.00 | 65.96 | | O |
| ANISOU | 1646 | O | PRO | A | 210 | 8842 | 8001 | 8220 | −33 | −558 | 317 | O |
| ATOM | 1647 | CB | PRO | A | 210 | 17.463 | 30.822 | 12.105 | 1.00 | 68.12 | | C |
| ANISOU | 1647 | CB | PRO | A | 210 | 8977 | 8224 | 8682 | −102 | −518 | 186 | C |
| ATOM | 1648 | CG | PRO | A | 210 | 17.645 | 32.269 | 12.061 | 1.00 | 71.59 | | C |
| ANISOU | 1648 | CG | PRO | A | 210 | 9424 | 8589 | 9189 | −125 | −531 | 245 | C |
| ATOM | 1649 | CD | PRO | A | 210 | 18.735 | 32.531 | 11.054 | 1.00 | 76.41 | | C |
| ANISOU | 1649 | CD | PRO | A | 210 | 10053 | 9218 | 9762 | −150 | −477 | 337 | C |
| ATOM | 1650 | N | ALA | A | 211 | 15.518 | 29.425 | 10.431 | 1.00 | 59.09 | | N |
| ANISOU | 1650 | N | ALA | A | 211 | 7909 | 7158 | 7383 | −18 | −584 | 166 | N |
| ATOM | 1651 | CA | ALA | A | 211 | 14.325 | 29.040 | 9.699 | 1.00 | 56.49 | | C |
| ANISOU | 1651 | CA | ALA | A | 211 | 7616 | 6848 | 7000 | 21 | −641 | 157 | C |
| ATOM | 1652 | C | ALA | A | 211 | 13.229 | 30.097 | 9.726 | 1.00 | 64.22 | | C |
| ANISOU | 1652 | C | ALA | A | 211 | 8597 | 7766 | 8038 | 41 | −709 | 177 | C |
| ATOM | 1653 | O | ALA | A | 211 | 12.312 | 30.031 | 8.903 | 1.00 | 74.73 | | O |
| ANISOU | 1653 | O | ALA | A | 211 | 9962 | 9108 | 9326 | 71 | −762 | 195 | O |
| ATOM | 1654 | CB | ALA | A | 211 | 13.787 | 27.725 | 10.253 | 1.00 | 52.04 | | C |
| ANISOU | 1654 | CB | ALA | A | 211 | 7029 | 6326 | 6419 | 35 | −653 | 70 | C |
| ATOM | 1655 | N | GLU | A | 212 | 13.305 | 31.067 | 10.631 | 1.00 | 72.49 | | N |
| ANISOU | 1655 | N | GLU | A | 212 | 9612 | 8749 | 9182 | 26 | −710 | 175 | N |
| ATOM | 1656 | CA | GLU | A | 212 | 12.244 | 32.055 | 10.766 | 1.00 | 80.17 | | C |
| ANISOU | 1656 | CA | GLU | A | 212 | 10583 | 9658 | 10220 | 50 | −769 | 187 | C |
| ATOM | 1657 | C | GLU | A | 212 | 12.210 | 32.964 | 9.545 | 1.00 | 84.26 | | C |
| ANISOU | 1657 | C | GLU | A | 212 | 11152 | 10153 | 10710 | 58 | −788 | 284 | C |
| ATOM | 1658 | O | GLU | A | 212 | 13.243 | 33.495 | 9.128 | 1.00 | 87.35 | | O |
| ANISOU | 1658 | O | GLU | A | 212 | 11563 | 10533 | 11091 | 29 | −744 | 347 | O |
| ATOM | 1659 | CB | GLU | A | 212 | 12.450 | 32.881 | 12.035 | 1.00 | 83.45 | | C |
| ANISOU | 1659 | CB | GLU | A | 212 | 10961 | 10004 | 10740 | 32 | −759 | 158 | C |
| ATOM | 1660 | CG | GLU | A | 212 | 11.193 | 33.590 | 12.474 | 1.00 | 89.78 | | C |
| ANISOU | 1660 | CG | GLU | A | 212 | 11750 | 10747 | 11615 | 69 | −814 | 140 | C |
| ATOM | 1661 | CD | GLU | A | 212 | 9.958 | 32.753 | 12.189 | 1.00 | 98.98 | | C |
| ANISOU | 1661 | CD | GLU | A | 212 | 12908 | 11955 | 12747 | 110 | −861 | 107 | C |
| ATOM | 1662 | OE1 | GLU | A | 212 | 9.738 | 31.750 | 12.910 | 1.00 | 101.40 | | O |
| ANISOU | 1662 | OE1 | GLU | A | 212 | 13180 | 12298 | 13049 | 113 | −851 | 34 | O |
| ATOM | 1663 | OE2 | GLU | A | 212 | 9.223 | 33.082 | 11.225 | 1.00 | 102.19 | | O |
| ANISOU | 1663 | OE2 | GLU | A | 212 | 13340 | 12356 | 13131 | 139 | −910 | 159 | O |
| ATOM | 1664 | N | ILE | A | 213 | 11.056 | 32.995 | 8.867 | 1.00 | 87.94 | | N |
| ANISOU | 1664 | N | ILE | A | 213 | 11640 | 10622 | 11152 | 98 | −853 | 301 | N |
| ATOM | 1665 | CA | ILE | A | 213 | 10.866 | 33.783 | 7.606 | 1.00 | 91.68 | | C |
| ANISOU | 1665 | CA | ILE | A | 213 | 12169 | 11079 | 11586 | 113 | −883 | 397 | C |
| ATOM | 1666 | C | ILE | A | 213 | 9.420 | 34.287 | 7.475 | 1.00 | 102.84 | | C |
| ANISOU | 1666 | C | ILE | A | 213 | 13577 | 12456 | 13041 | 158 | −967 | 405 | C |
| ATOM | 1667 | O | ILE | A | 213 | 8.551 | 33.758 | 8.178 | 1.00 | 92.76 | | O |
| ANISOU | 1667 | O | ILE | A | 213 | 12257 | 11185 | 11801 | 178 | −999 | 333 | O |

TABLE 14-continued

| | | | | | | | | | | | | |
|---|---|---|---|---|---|---|---|---|---|---|---|---|
| ATOM | 1668 | CB | ILE | A | 213 | 11.442 | 33.103 | 6.360 | 1.00 | 85.43 | | C |
| ANISOU | 1668 | CB | ILE | A | 213 | 11434 | 10358 | 10666 | 110 | −858 | 441 | C |
| ATOM | 1669 | CG1 | ILE | A | 213 | 11.961 | 34.159 | 5.385 | 1.00 | 82.33 | | C |
| ANISOU | 1669 | CG1 | ILE | A | 213 | 11092 | 9937 | 10251 | 103 | −844 | 552 | C |
| ATOM | 1670 | CG2 | ILE | A | 213 | 10.420 | 32.177 | 5.739 | 1.00 | 82.90 | | C |
| ANISOU | 1670 | CG2 | ILE | A | 213 | 11135 | 10090 | 10272 | 144 | −920 | 410 | C |
| ATOM | 1671 | CD1 | ILE | A | 213 | 12.874 | 33.639 | 4.324 | 1.00 | 82.15 | | C |
| ANISOU | 1671 | CD1 | ILE | A | 213 | 11124 | 9978 | 10112 | 92 | −789 | 600 | C |
| ATOM | 1672 | N | THR | A | 214 | 9.216 | 35.342 | 6.645 | 1.00 | 126.44 | | N |
| ANISOU | 1672 | N | THR | A | 214 | 16605 | 15403 | 16032 | 173 | −997 | 495 | N |
| ATOM | 1673 | CA | THR | A | 214 | 8.060 | 36.252 | 6.677 | 1.00 | 134.56 | | C |
| ANISOU | 1673 | CA | THR | A | 214 | 17623 | 16370 | 17135 | 213 | −1066 | 520 | C |
| ATOM | 1674 | C | THR | A | 214 | 7.670 | 36.621 | 5.242 | 1.00 | 134.69 | | C |
| ANISOU | 1674 | C | THR | A | 214 | 17699 | 16398 | 17079 | 238 | −1117 | 614 | C |
| ATOM | 1675 | O | THR | A | 214 | 8.206 | 37.579 | 4.690 | 1.00 | 140.91 | | O |
| ANISOU | 1675 | O | THR | A | 214 | 18526 | 17145 | 17867 | 228 | −1100 | 701 | O |
| ATOM | 1676 | CB | THR | A | 214 | 8.418 | 37.509 | 7.463 | 1.00 | 135.36 | | C |
| ANISOU | 1676 | CB | THR | A | 214 | 17708 | 16377 | 17348 | 200 | −1040 | 537 | C |
| ATOM | 1677 | OG1 | THR | A | 214 | 9.172 | 37.169 | 8.636 | 1.00 | 136.04 | | O |
| ANISOU | 1677 | OG1 | THR | A | 214 | 17756 | 16461 | 17475 | 164 | −981 | 463 | O |
| ATOM | 1678 | CG2 | THR | A | 214 | 7.168 | 38.288 | 7.851 | 1.00 | 133.37 | | C |
| ANISOU | 1678 | CG2 | THR | A | 214 | 17429 | 16057 | 17190 | 247 | −1101 | 534 | C |
| ATOM | 1679 | N | LEU | A | 215 | 6.698 | 35.909 | 4.668 | 1.00 | 124.40 | | N |
| ANISOU | 1679 | N | LEU | A | 215 | 16402 | 15144 | 15719 | 269 | −1185 | 600 | N |
| ATOM | 1680 | CA | LEU | A | 215 | 6.322 | 36.153 | 3.277 | 1.00 | 120.93 | | C |
| ANISOU | 1680 | CA | LEU | A | 215 | 16026 | 14725 | 15196 | 293 | −1242 | 686 | C |
| ATOM | 1681 | C | LEU | A | 215 | 4.875 | 36.621 | 3.147 | 1.00 | 130.80 | | C |
| ANISOU | 1681 | C | LEU | A | 215 | 17253 | 15943 | 16503 | 342 | −1340 | 704 | C |
| ATOM | 1682 | O | LEU | A | 215 | 3.974 | 36.083 | 3.799 | 1.00 | 128.29 | | O |
| ANISOU | 1682 | O | LEU | A | 215 | 16875 | 15633 | 16235 | 360 | −1379 | 634 | O |
| ATOM | 1683 | CB | LEU | A | 215 | 6.554 | 34.905 | 2.411 | 1.00 | 112.00 | | C |
| ANISOU | 1683 | CB | LEU | A | 215 | 14943 | 13688 | 13923 | 285 | −1244 | 668 | C |
| ATOM | 1684 | CG | LEU | A | 215 | 8.042 | 34.652 | 2.142 | 1.00 | 106.03 | | C |
| ANISOU | 1684 | CG | LEU | A | 215 | 14229 | 12964 | 13095 | 246 | −1145 | 687 | C |
| ATOM | 1685 | CD1 | LEU | A | 215 | 8.611 | 33.751 | 3.201 | 1.00 | 105.55 | | C |
| ANISOU | 1685 | CD1 | LEU | A | 215 | 14117 | 12927 | 13060 | 217 | −1084 | 591 | C |
| ATOM | 1686 | CD2 | LEU | A | 215 | 8.313 | 34.081 | 0.761 | 1.00 | 104.51 | | C |
| ANISOU | 1686 | CD2 | LEU | A | 215 | 14121 | 12840 | 12747 | 252 | −1150 | 732 | C |
| ATOM | 1687 | N | THR | A | 216 | 4.667 | 37.629 | 2.293 | 1.00 | 142.78 | | N |
| ANISOU | 1687 | N | THR | A | 216 | 18813 | 17423 | 18013 | 364 | −1379 | 806 | N |
| ATOM | 1688 | CA | THR | A | 216 | 3.334 | 38.163 | 1.987 | 1.00 | 144.68 | | C |
| ANISOU | 1688 | CA | THR | A | 216 | 19036 | 17633 | 18301 | 415 | −1478 | 843 | C |
| ATOM | 1689 | C | THR | A | 216 | 3.104 | 38.260 | 0.478 | 1.00 | 148.89 | | C |
| ANISOU | 1689 | C | THR | A | 216 | 19647 | 18204 | 18722 | 434 | −1542 | 935 | C |
| ATOM | 1690 | O | THR | A | 216 | 3.875 | 38.904 | −0.237 | 1.00 | 150.59 | | O |
| ANISOU | 1690 | O | THR | A | 216 | 19927 | 18405 | 18885 | 422 | −1508 | 1021 | O |
| ATOM | 1691 | CB | THR | A | 216 | 3.117 | 39.558 | 2.596 | 1.00 | 137.81 | | C |
| ANISOU | 1691 | CB | THR | A | 216 | 18137 | 16658 | 17567 | 436 | −1473 | 882 | C |
| ATOM | 1692 | OG1 | THR | A | 216 | 3.699 | 39.607 | 3.903 | 1.00 | 134.59 | | O |
| ANISOU | 1692 | OG1 | THR | A | 216 | 17684 | 16212 | 17244 | 408 | −1396 | 808 | O |
| ATOM | 1693 | CG2 | THR | A | 216 | 1.628 | 39.872 | 2.690 | 1.00 | 134.59 | | C |
| ANISOU | 1693 | CG2 | THR | A | 216 | 17679 | 16220 | 17238 | 493 | −1565 | 886 | C |
| ATOM | 1694 | N | VAL | A | 231 | 2.945 | 28.113 | 2.343 | 1.00 | 92.10 | | N |
| ANISOU | 1694 | N | VAL | A | 231 | 12346 | 11449 | 11198 | 298 | −1501 | 273 | N |
| ATOM | 1695 | CA | VAL | A | 231 | 3.553 | 26.784 | 2.440 | 1.00 | 97.96 | | C |
| ANISOU | 1695 | CA | VAL | A | 231 | 13110 | 12240 | 11871 | 272 | −1453 | 201 | C |
| ATOM | 1696 | C | VAL | A | 231 | 4.409 | 26.634 | 3.715 | 1.00 | 97.30 | | C |
| ANISOU | 1696 | C | VAL | A | 231 | 12972 | 12140 | 11857 | 250 | −1347 | 151 | C |
| ATOM | 1697 | O | VAL | A | 231 | 4.746 | 27.616 | 4.376 | 1.00 | 93.20 | | O |
| ANISOU | 1697 | O | VAL | A | 231 | 12418 | 11575 | 11418 | 251 | −1303 | 179 | O |
| ATOM | 1698 | CB | VAL | A | 231 | 4.396 | 26.468 | 1.172 | 1.00 | 98.37 | | C |
| ANISOU | 1698 | CB | VAL | A | 231 | 13273 | 12337 | 11766 | 268 | −1431 | 235 | C |
| ATOM | 1699 | CG1 | VAL | A | 231 | 5.835 | 26.958 | 1.323 | 1.00 | 98.48 | | C |
| ANISOU | 1699 | CG1 | VAL | A | 231 | 13310 | 12343 | 11764 | 253 | −1313 | 269 | C |
| ATOM | 1700 | CG2 | VAL | A | 231 | 4.361 | 24.984 | 0.859 | 1.00 | 96.63 | | C |
| ANISOU | 1700 | CG2 | VAL | A | 231 | 13087 | 12168 | 11460 | 255 | −1445 | 160 | C |
| ATOM | 1701 | N | GLU | A | 232 | 4.750 | 25.389 | 4.043 | 1.00 | 93.87 | | N |
| ANISOU | 1701 | N | GLU | A | 232 | 12535 | 11742 | 11389 | 231 | −1312 | 78 | N |
| ATOM | 1702 | CA | GLU | A | 232 | 5.509 | 25.063 | 5.246 | 1.00 | 86.47 | | C |
| ANISOU | 1702 | CA | GLU | A | 232 | 11548 | 10798 | 10510 | 211 | −1221 | 27 | C |
| ATOM | 1703 | C | GLU | A | 232 | 7.002 | 25.308 | 5.031 | 1.00 | 80.01 | | C |
| ANISOU | 1703 | C | GLU | A | 232 | 10775 | 9989 | 9636 | 196 | −1125 | 60 | C |
| ATOM | 1704 | O | GLU | A | 232 | 7.576 | 24.815 | 4.054 | 1.00 | 82.54 | | O |
| ANISOU | 1704 | O | GLU | A | 232 | 11170 | 10350 | 9842 | 195 | −1107 | 75 | O |
| ATOM | 1705 | CB | GLU | A | 232 | 5.276 | 23.594 | 5.596 | 1.00 | 81.93 | | C |
| ANISOU | 1705 | CB | GLU | A | 232 | 10956 | 10257 | 9919 | 199 | −1224 | −58 | C |
| ATOM | 1706 | CG | GLU | A | 232 | 5.163 | 23.284 | 7.061 | 1.00 | 81.53 | | C |
| ANISOU | 1706 | CG | GLU | A | 232 | 10819 | 10186 | 9972 | 190 | −1186 | −118 | C |
| ATOM | 1707 | CD | GLU | A | 232 | 3.832 | 23.700 | 7.616 | 0.00 | 82.82 | | C |
| ANISOU | 1707 | CD | GLU | A | 232 | 10912 | 10318 | 10239 | 207 | −1253 | −123 | C |

TABLE 14-continued

| | | | | | | | | | | | | |
|---|---|---|---|---|---|---|---|---|---|---|---|---|
| ATOM | 1708 | OE1 | GLU | A | 232 | 3.822 | 24.570 | 8.507 | 1.00 | 81.89 | | O |
| ANISOU | 1708 | OE1 | GLU | A | 232 | 10744 | 10158 | 10212 | 214 | −1223 | −114 | O |
| ATOM | 1709 | OE2 | GLU | A | 232 | 2.806 | 23.169 | 7.144 | 1.00 | 87.79 | | O |
| ANISOU | 1709 | OE2 | GLU | A | 232 | 11536 | 10962 | 10860 | 214 | −1335 | −137 | O |
| ATOM | 1710 | N | THR | A | 233 | 7.644 | 26.049 | 5.942 | 1.00 | 69.24 | | N |
| ANISOU | 1710 | N | THR | A | 233 | 9367 | 8588 | 8352 | 184 | −1062 | 70 | N |
| ATOM | 1711 | CA | THR | A | 233 | 9.099 | 26.161 | 5.868 | 1.00 | 67.78 | | C |
| ANISOU | 1711 | CA | THR | A | 233 | 9210 | 8414 | 8128 | 163 | −968 | 96 | C |
| ATOM | 1712 | C | THR | A | 233 | 9.710 | 24.768 | 5.901 | 1.00 | 62.05 | | C |
| ANISOU | 1712 | C | THR | A | 233 | 8499 | 7741 | 7337 | 152 | −920 | 37 | C |
| ATOM | 1713 | O | THR | A | 233 | 9.339 | 23.937 | 6.728 | 1.00 | 61.54 | | O |
| ANISOU | 1713 | O | THR | A | 233 | 8387 | 7682 | 7313 | 148 | −926 | −35 | O |
| ATOM | 1714 | CB | THR | A | 233 | 9.658 | 27.001 | 7.014 | 1.00 | 67.89 | | C |
| ANISOU | 1714 | CB | THR | A | 233 | 9167 | 8381 | 8248 | 146 | −917 | 100 | C |
| ATOM | 1715 | OG1 | THR | A | 233 | 8.984 | 28.257 | 7.061 | 1.00 | 79.50 | | O |
| ANISOU | 1715 | OG1 | THR | A | 233 | 10623 | 9795 | 9788 | 160 | −964 | 146 | O |
| ATOM | 1716 | CG2 | THR | A | 233 | 11.135 | 27.271 | 6.802 | 1.00 | 65.92 | | C |
| ANISOU | 1716 | CG2 | THR | A | 233 | 8941 | 8140 | 7964 | 122 | −830 | 143 | C |
| ATOM | 1717 | N | ARG | A | 234 | 10.629 | 24.501 | 4.987 | 1.00 | 63.44 | | N |
| ANISOU | 1717 | N | ARG | A | 234 | 8740 | 7953 | 7412 | 151 | −871 | 70 | N |
| ATOM | 1718 | CA | ARG | A | 234 | 11.100 | 23.141 | 4.801 | 1.00 | 58.97 | | C |
| ANISOU | 1718 | CA | ARG | A | 234 | 8202 | 7434 | 6770 | 149 | −833 | 16 | C |
| ATOM | 1719 | C | ARG | A | 234 | 12.616 | 23.094 | 4.802 | 1.00 | 59.22 | | C |
| ANISOU | 1719 | C | ARG | A | 234 | 8242 | 7484 | 6773 | 136 | −724 | 41 | C |
| ATOM | 1720 | O | ARG | A | 234 | 13.277 | 24.060 | 4.400 | 1.00 | 62.64 | | O |
| ANISOU | 1720 | O | ARG | A | 234 | 8693 | 7906 | 7201 | 131 | −687 | 117 | O |
| ATOM | 1721 | CB | ARG | A | 234 | 10.576 | 22.559 | 3.478 | 1.00 | 62.77 | | C |
| ANISOU | 1721 | CB | ARG | A | 234 | 8769 | 7951 | 7131 | 169 | −888 | 19 | C |
| ATOM | 1722 | CG | ARG | A | 234 | 11.163 | 23.244 | 2.235 | 1.00 | 63.64 | | C |
| ANISOU | 1722 | CG | ARG | A | 234 | 8959 | 8075 | 7145 | 180 | −865 | 105 | C |
| ATOM | 1723 | CD | ARG | A | 234 | 10.222 | 23.077 | 1.035 | 1.00 | 65.38 | | C |
| ANISOU | 1723 | CD | ARG | A | 234 | 9257 | 8315 | 7270 | 202 | −958 | 117 | C |
| ATOM | 1724 | NE | ARG | A | 234 | 10.902 | 23.278 | −0.243 | 1.00 | 69.78 | | N |
| ANISOU | 1724 | NE | ARG | A | 234 | 9912 | 8903 | 7699 | 216 | −921 | 182 | N |
| ATOM | 1725 | CZ | ARG | A | 234 | 10.304 | 23.178 | −1.431 | 1.00 | 74.02 | | C |
| ANISOU | 1725 | CZ | ARG | A | 234 | 10535 | 9461 | 8127 | 236 | −992 | 203 | C |
| ATOM | 1726 | NH1 | ARG | A | 234 | 9.000 | 22.889 | −1.514 | 1.00 | 59.42 | | N |
| ANISOU | 1726 | NH1 | ARG | A | 234 | 8680 | 7606 | 6289 | 242 | −1110 | 165 | N |
| ATOM | 1727 | NH2 | ARG | A | 234 | 11.007 | 23.374 | −2.538 | 1.00 | 78.68 | | N |
| ANISOU | 1727 | NH2 | ARG | A | 234 | 11217 | 10081 | 8596 | 251 | −946 | 264 | N |
| ATOM | 1728 | N | PRO | A | 235 | 13.198 | 21.976 | 5.240 | 1.00 | 57.71 | | N |
| ANISOU | 1728 | N | PRO | A | 235 | 8038 | 7322 | 6568 | 131 | −671 | −17 | N |
| ATOM | 1729 | CA | PRO | A | 235 | 14.659 | 21.864 | 5.242 | 1.00 | 54.22 | | C |
| ANISOU | 1729 | CA | PRO | A | 235 | 7597 | 6901 | 6104 | 122 | −566 | 9 | C |
| ATOM | 1730 | C | PRO | A | 235 | 15.205 | 21.491 | 3.874 | 1.00 | 58.57 | | C |
| ANISOU | 1730 | C | PRO | A | 235 | 8238 | 7493 | 6522 | 141 | −527 | 45 | C |
| ATOM | 1731 | O | PRO | A | 235 | 14.678 | 20.618 | 3.180 | 1.00 | 62.11 | | O |
| ANISOU | 1731 | O | PRO | A | 235 | 8747 | 7968 | 6884 | 161 | −563 | 7 | O |
| ATOM | 1732 | CB | PRO | A | 235 | 14.924 | 20.747 | 6.258 | 1.00 | 55.72 | | C |
| ANISOU | 1732 | CB | PRO | A | 235 | 7736 | 7103 | 6331 | 115 | −533 | −69 | C |
| ATOM | 1733 | CG | PRO | A | 235 | 13.695 | 19.886 | 6.157 | 1.00 | 60.01 | | C |
| ANISOU | 1733 | CG | PRO | A | 235 | 8297 | 7651 | 6853 | 128 | −612 | −134 | C |
| ATOM | 1734 | CD | PRO | A | 235 | 12.554 | 20.843 | 5.929 | 1.00 | 56.71 | | C |
| ANISOU | 1734 | CD | PRO | A | 235 | 7879 | 7202 | 6467 | 132 | −701 | −105 | C |
| ATOM | 1735 | N | ALA | A | 236 | 16.286 | 22.166 | 3.491 | 1.00 | 60.95 | | N |
| ANISOU | 1735 | N | ALA | A | 236 | 8549 | 7800 | 6808 | 135 | −452 | 119 | N |
| ATOM | 1736 | CA | ALA | A | 236 | 16.980 | 21.804 | 2.266 | 1.00 | 63.83 | | C |
| ANISOU | 1736 | CA | ALA | A | 236 | 8996 | 8208 | 7047 | 157 | −392 | 157 | C |
| ATOM | 1737 | C | ALA | A | 236 | 17.722 | 20.483 | 2.415 | 1.00 | 64.41 | | C |
| ANISOU | 1737 | C | ALA | A | 236 | 9073 | 8319 | 7081 | 168 | −320 | 100 | C |
| ATOM | 1738 | O | ALA | A | 236 | 17.938 | 19.782 | 1.422 | 1.00 | 63.34 | | O |
| ANISOU | 1738 | O | ALA | A | 236 | 9019 | 8220 | 6827 | 196 | −291 | 96 | O |
| ATOM | 1739 | CB | ALA | A | 236 | 17.949 | 22.916 | 1.867 | 1.00 | 66.50 | | C |
| ANISOU | 1739 | CB | ALA | A | 236 | 9335 | 8540 | 7391 | 145 | −324 | 259 | C |
| ATOM | 1740 | N | GLY | A | 237 | 18.123 | 20.131 | 3.638 | 1.00 | 58.97 | | N |
| ANISOU | 1740 | N | GLY | A | 237 | 8300 | 7620 | 6487 | 149 | −291 | 58 | N |
| ATOM | 1741 | CA | GLY | A | 237 | 18.955 | 18.971 | 3.889 | 1.00 | 58.02 | | C |
| ANISOU | 1741 | CA | GLY | A | 237 | 8170 | 7530 | 6346 | 160 | −215 | 14 | C |
| ATOM | 1742 | C | GLY | A | 237 | 20.419 | 19.284 | 4.097 | 1.00 | 62.42 | | C |
| ANISOU | 1742 | C | GLY | A | 237 | 8682 | 8101 | 6935 | 150 | −108 | 70 | C |
| ATOM | 1743 | O | GLY | A | 237 | 21.190 | 18.378 | 4.430 | 1.00 | 63.12 | | O |
| ANISOU | 1743 | O | GLY | A | 237 | 8747 | 8213 | 7023 | 159 | −42 | 40 | O |
| ATOM | 1744 | N | ASP | A | 238 | 20.831 | 20.532 | 3.886 | 1.00 | 65.82 | | N |
| ANISOU | 1744 | N | ASP | A | 238 | 9097 | 8515 | 7395 | 130 | −90 | 155 | N |
| ATOM | 1745 | CA | ASP | A | 238 | 22.202 | 20.951 | 4.121 | 1.00 | 66.53 | | C |
| ANISOU | 1745 | CA | ASP | A | 238 | 9133 | 8613 | 7532 | 112 | 4 | 217 | C |
| ATOM | 1746 | C | ASP | A | 238 | 22.316 | 21.882 | 5.315 | 1.00 | 68.95 | | C |
| ANISOU | 1746 | C | ASP | A | 238 | 9349 | 8875 | 7976 | 67 | −23 | 229 | C |
| ATOM | 1747 | O | ASP | A | 238 | 23.386 | 22.463 | 5.534 | 1.00 | 68.54 | | O |
| ANISOU | 1747 | O | ASP | A | 238 | 9246 | 8820 | 7977 | 42 | 39 | 289 | O |

TABLE 14-continued

| | | | | | | | | | | | | |
|---|---|---|---|---|---|---|---|---|---|---|---|---|
| ATOM | 1748 | CB | ASP | A | 238 | 22.772 | 21.629 | 2.880 | 1.00 | 74.90 | | C |
| ANISOU | 1748 | CB | ASP | A | 238 | 10250 | 9689 | 8518 | 121 | 61 | 313 | C |
| ATOM | 1749 | CG | ASP | A | 238 | 22.044 | 22.918 | 2.531 | 1.00 | 85.56 | | C |
| ANISOU | 1749 | CG | ASP | A | 238 | 11624 | 11001 | 9883 | 106 | −8 | 369 | C |
| ATOM | 1750 | OD1 | ASP | A | 238 | 20.937 | 23.172 | 3.073 | 1.00 | 87.24 | | O |
| ANISOU | 1750 | OD1 | ASP | A | 238 | 11824 | 11178 | 10145 | 97 | −105 | 326 | O |
| ATOM | 1751 | OD2 | ASP | A | 238 | 22.589 | 23.687 | 1.710 | 1.00 | 92.86 | | O |
| ANISOU | 1751 | OD2 | ASP | A | 238 | 12579 | 11930 | 10774 | 104 | 40 | 462 | O |
| ATOM | 1752 | N | GLY | A | 239 | 21.238 | 22.039 | 6.087 | 1.00 | 64.86 | | N |
| ANISOU | 1752 | N | GLY | A | 239 | 8808 | 8321 | 7515 | 57 | −113 | 174 | N |
| ATOM | 1753 | CA | GLY | A | 239 | 21.220 | 22.928 | 7.226 | 1.00 | 61.10 | | C |
| ANISOU | 1753 | CA | GLY | A | 239 | 8257 | 7798 | 7159 | 19 | −145 | 176 | C |
| ATOM | 1754 | C | GLY | A | 239 | 20.641 | 24.295 | 6.948 | 1.00 | 69.96 | | C |
| ANISOU | 1754 | C | GLY | A | 239 | 9396 | 8874 | 8313 | 5 | −198 | 231 | C |
| ATOM | 1755 | O | GLY | A | 239 | 20.641 | 25.141 | 7.848 | 1.00 | 71.71 | | O |
| ANISOU | 1755 | O | GLY | A | 239 | 9563 | 9049 | 8635 | −25 | −223 | 234 | O |
| ATOM | 1756 | N | THR | A | 240 | 20.155 | 24.542 | 5.738 | 1.00 | 67.33 | | N |
| ANISOU | 1756 | N | THR | A | 240 | 9138 | 8549 | 7896 | 28 | −217 | 272 | N |
| ATOM | 1757 | CA | THR | A | 240 | 19.425 | 25.758 | 5.425 | 1.00 | 69.56 | | C |
| ANISOU | 1757 | CA | THR | A | 240 | 9442 | 8785 | 8203 | 23 | −279 | 321 | C |
| ATOM | 1758 | C | THR | A | 240 | 17.980 | 25.397 | 5.135 | 1.00 | 66.28 | | C |
| ANISOU | 1758 | C | THR | A | 240 | 9070 | 8369 | 7746 | 53 | −370 | 273 | C |
| ATOM | 1759 | O | THR | A | 240 | 17.623 | 24.224 | 5.009 | 1.00 | 65.87 | | O |
| ANISOU | 1759 | O | THR | A | 240 | 9040 | 8353 | 7634 | 75 | −380 | 209 | O |
| ATOM | 1760 | CB | THR | A | 240 | 20.044 | 26.492 | 4.227 | 1.00 | 79.60 | | C |
| ANISOU | 1760 | CB | THR | A | 240 | 10765 | 10064 | 9415 | 24 | −231 | 427 | C |
| ATOM | 1761 | OG1 | THR | A | 240 | 19.737 | 25.774 | 3.023 | 1.00 | 89.68 | | O |
| ANISOU | 1761 | OG1 | THR | A | 240 | 12129 | 11389 | 10557 | 63 | −229 | 428 | O |
| ATOM | 1762 | CG2 | THR | A | 240 | 21.571 | 26.609 | 4.385 | 1.00 | 73.28 | | C |
| ANISOU | 1762 | CG2 | THR | A | 240 | 9920 | 9277 | 8646 | −3 | −128 | 477 | C |
| ATOM | 1763 | N | PHE | A | 241 | 17.146 | 26.420 | 5.013 | 1.00 | 65.30 | | N |
| ANISOU | 1763 | N | PHE | A | 241 | 8954 | 8200 | 7657 | 53 | −438 | 305 | N |
| ATOM | 1764 | CA | PHE | A | 241 | 15.721 | 26.215 | 4.853 | 1.00 | 65.61 | | C |
| ANISOU | 1764 | CA | PHE | A | 241 | 9017 | 8232 | 7680 | 79 | −533 | 265 | C |
| ATOM | 1765 | C | PHE | A | 241 | 15.233 | 26.938 | 3.610 | 1.00 | 66.74 | | C |
| ANISOU | 1765 | C | PHE | A | 241 | 9232 | 8370 | 7757 | 98 | −574 | 340 | C |
| ATOM | 1766 | O | PHE | A | 241 | 15.943 | 27.755 | 3.017 | 1.00 | 70.63 | | O |
| ANISOU | 1766 | O | PHE | A | 241 | 9749 | 8853 | 8233 | 89 | −530 | 426 | O |
| ATOM | 1767 | CB | PHE | A | 241 | 14.958 | 26.677 | 6.097 | 1.00 | 64.46 | | C |
| ANISOU | 1767 | CB | PHE | A | 241 | 8802 | 8034 | 7655 | 69 | −587 | 219 | C |
| ATOM | 1768 | CG | PHE | A | 241 | 15.337 | 25.920 | 7.348 | 1.00 | 63.92 | | C |
| ANISOU | 1768 | CG | PHE | A | 241 | 8670 | 7973 | 7643 | 52 | −555 | 143 | C |
| ATOM | 1769 | CD1 | PHE | A | 241 | 16.424 | 26.312 | 8.107 | 1.00 | 60.46 | | C |
| ANISOU | 1769 | CD1 | PHE | A | 241 | 8183 | 7519 | 7269 | 21 | −494 | 157 | C |
| ATOM | 1770 | CD2 | PHE | A | 241 | 14.619 | 24.810 | 7.743 | 1.00 | 58.68 | | C |
| ANISOU | 1770 | CD2 | PHE | A | 241 | 7994 | 7333 | 6969 | 67 | −587 | 62 | C |
| ATOM | 1771 | CE1 | PHE | A | 241 | 16.772 | 25.614 | 9.240 | 1.00 | 58.29 | | C |
| ANISOU | 1771 | CE1 | PHE | A | 241 | 7853 | 7254 | 7040 | 8 | −469 | 91 | C |
| ATOM | 1772 | CE2 | PHE | A | 241 | 14.963 | 24.107 | 8.880 | 1.00 | 56.77 | | C |
| ANISOU | 1772 | CE2 | PHE | A | 241 | 7697 | 7098 | 6775 | 54 | −556 | −1 | C |
| ATOM | 1773 | CZ | PHE | A | 241 | 16.025 | 24.507 | 9.629 | 1.00 | 51.30 | | C |
| ANISOU | 1773 | CZ | PHE | A | 241 | 6960 | 6392 | 6140 | 27 | −499 | 13 | C |
| ATOM | 1774 | N | GLN | A | 242 | 14.003 | 26.601 | 3.222 | 1.00 | 65.12 | | N |
| ANISOU | 1774 | N | GLN | A | 242 | 9057 | 8171 | 7515 | 123 | −661 | 309 | N |
| ATOM | 1775 | CA | GLN | A | 242 | 13.364 | 27.091 | 2.008 | 1.00 | 68.42 | | C |
| ANISOU | 1775 | CA | GLN | A | 242 | 9548 | 8591 | 7857 | 147 | −719 | 370 | C |
| ATOM | 1776 | C | GLN | A | 242 | 11.901 | 27.401 | 2.299 | 1.00 | 68.97 | | C |
| ANISOU | 1776 | C | GLN | A | 242 | 9593 | 8627 | 7986 | 162 | −829 | 345 | C |
| ATOM | 1777 | O | GLN | A | 242 | 11.289 | 26.777 | 3.171 | 1.00 | 67.49 | | O |
| ANISOU | 1777 | O | GLN | A | 242 | 9351 | 8435 | 7856 | 161 | −861 | 265 | O |
| ATOM | 1778 | CB | GLN | A | 242 | 13.438 | 26.064 | 0.869 | 1.00 | 65.19 | | C |
| ANISOU | 1778 | CB | GLN | A | 242 | 9226 | 8245 | 7299 | 169 | −713 | 358 | C |
| ATOM | 1779 | CG | GLN | A | 242 | 14.818 | 25.580 | 0.479 | 1.00 | 66.55 | | C |
| ANISOU | 1779 | CG | GLN | A | 242 | 9428 | 8458 | 7399 | 165 | −599 | 377 | C |
| ATOM | 1780 | CD | GLN | A | 242 | 14.739 | 24.392 | −0.458 | 1.00 | 64.54 | | C |
| ANISOU | 1780 | CD | GLN | A | 242 | 9259 | 8261 | 7004 | 192 | −600 | 339 | C |
| ATOM | 1781 | OE1 | GLN | A | 242 | 13.655 | 23.861 | −0.699 | 1.00 | 65.47 | | O |
| ANISOU | 1781 | OE1 | GLN | A | 242 | 9404 | 8385 | 7087 | 207 | −691 | 289 | O |
| ATOM | 1782 | NE2 | GLN | A | 242 | 15.880 | 23.961 | −0.983 | 1.00 | 63.18 | | N |
| ANISOU | 1782 | NE2 | GLN | A | 242 | 9127 | 8128 | 6753 | 199 | −498 | 361 | N |
| ATOM | 1783 | N | LYS | A | 243 | 11.340 | 28.355 | 1.549 | 1.00 | 69.83 | | N |
| ANISOU | 1783 | N | LYS | A | 243 | 9739 | 8712 | 8082 | 178 | −886 | 418 | N |
| ATOM | 1784 | CA | LYS | A | 243 | 9.928 | 28.715 | 1.659 | 1.00 | 73.71 | | C |
| ANISOU | 1784 | CA | LYS | A | 243 | 10209 | 9173 | 8626 | 198 | −994 | 409 | C |
| ATOM | 1785 | C | LYS | A | 243 | 9.495 | 29.464 | 0.400 | 1.00 | 86.11 | | C |
| ANISOU | 1785 | C | LYS | A | 243 | 11851 | 10740 | 10127 | 222 | −1050 | 499 | C |
| ATOM | 1786 | O | LYS | A | 243 | 10.287 | 30.215 | −0.175 | 1.00 | 86.92 | | O |
| ANISOU | 1786 | O | LYS | A | 243 | 11995 | 10835 | 10197 | 216 | −999 | 582 | O |
| ATOM | 1787 | CB | LYS | A | 243 | 9.664 | 29.584 | 2.894 | 1.00 | 68.41 | | C |
| ANISOU | 1787 | CB | LYS | A | 243 | 9453 | 8435 | 8106 | 189 | −997 | 399 | C |

TABLE 14-continued

| | | | | | | | | | | | | |
|---|---|---|---|---|---|---|---|---|---|---|---|---|
| ATOM | 1788 | CG | LYS | A | 243 | 8.386 | 29.246 | 3.638 | 1.00 | 70.48 | | C |
| ANISOU | 1788 | CG | LYS | A | 243 | 9655 | 8681 | 8442 | 204 | −1073 | 330 | C |
| ATOM | 1789 | CD | LYS | A | 243 | 7.768 | 30.482 | 4.278 | 1.00 | 73.04 | | C |
| ANISOU | 1789 | CD | LYS | A | 243 | 9929 | 8933 | 8889 | 215 | −1107 | 358 | C |
| ATOM | 1790 | CE | LYS | A | 243 | 6.991 | 30.168 | 5.558 | 1.00 | 74.27 | | C |
| ANISOU | 1790 | CE | LYS | A | 243 | 10002 | 9067 | 9149 | 220 | −1127 | 276 | C |
| ATOM | 1791 | NZ | LYS | A | 243 | 6.001 | 29.067 | 5.395 | 1.00 | 83.96 | | N |
| ANISOU | 1791 | NZ | LYS | A | 243 | 11219 | 10337 | 10346 | 234 | −1192 | 220 | N |
| ATOM | 1792 | N | TRP | A | 244 | 8.240 | 29.264 | −0.022 | 1.00 | 93.56 | | N |
| ANISOU | 1792 | N | TRP | A | 244 | 12807 | 11691 | 11051 | 246 | −1158 | 486 | N |
| ATOM | 1793 | CA | TRP | A | 244 | 7.691 | 30.026 | −1.141 | 1.00 | 100.47 | | C |
| ANISOU | 1793 | CA | TRP | A | 244 | 13745 | 12561 | 11870 | 272 | −1228 | 573 | C |
| ATOM | 1794 | C | TRP | A | 244 | 6.247 | 30.422 | −0.863 | 1.00 | 103.73 | | C |
| ANISOU | 1794 | C | TRP | A | 244 | 14107 | 12937 | 12369 | 294 | −1341 | 566 | C |
| ATOM | 1795 | O | TRP | A | 244 | 5.573 | 29.851 | −0.003 | 1.00 | 94.57 | | O |
| ANISOU | 1795 | O | TRP | A | 244 | 12877 | 11773 | 11284 | 292 | −1372 | 487 | O |
| ATOM | 1796 | CB | TRP | A | 244 | 7.779 | 29.278 | −2.492 | 1.00 | 104.64 | | C |
| ANISOU | 1796 | CB | TRP | A | 244 | 14378 | 13153 | 12226 | 285 | −1248 | 586 | C |
| ATOM | 1797 | CG | TRP | A | 244 | 7.056 | 27.944 | −2.630 | 1.00 | 107.19 | | C |
| ANISOU | 1797 | CG | TRP | A | 244 | 14713 | 13522 | 12493 | 289 | −1315 | 496 | C |
| ATOM | 1798 | CD1 | TRP | A | 244 | 7.642 | 26.724 | −2.817 | 1.00 | 102.81 | | C |
| ANISOU | 1798 | CD1 | TRP | A | 244 | 14199 | 13016 | 11847 | 280 | −1266 | 433 | C |
| ATOM | 1799 | CD2 | TRP | A | 244 | 5.633 | 27.708 | −2.652 | 1.00 | 116.34 | | C |
| ANISOU | 1799 | CD2 | TRP | A | 244 | 15845 | 14676 | 13682 | 303 | −1442 | 464 | C |
| ATOM | 1800 | NE1 | TRP | A | 244 | 6.685 | 25.747 | −2.929 | 1.00 | 106.37 | | N |
| ANISOU | 1800 | NE1 | TRP | A | 244 | 14653 | 13490 | 12271 | 284 | −1356 | 361 | N |
| ATOM | 1801 | CE2 | TRP | A | 244 | 5.445 | 26.322 | −2.829 | 1.00 | 116.21 | | C |
| ANISOU | 1801 | CE2 | TRP | A | 244 | 15855 | 14706 | 13593 | 296 | −1466 | 380 | C |
| ATOM | 1802 | CE3 | TRP | A | 244 | 4.503 | 28.529 | −2.534 | 1.00 | 120.82 | | C |
| ANISOU | 1802 | CE3 | TRP | A | 244 | 16365 | 15203 | 14337 | 322 | −1538 | 501 | C |
| ATOM | 1803 | CZ2 | TRP | A | 244 | 4.174 | 25.740 | −2.884 | 1.00 | 120.94 | | C |
| ANISOU | 1803 | CZ2 | TRP | A | 244 | 16432 | 15312 | 14208 | 301 | −1585 | 332 | C |
| ATOM | 1804 | CZ3 | TRP | A | 244 | 3.242 | 27.949 | −2.582 | 1.00 | 120.73 | | C |
| ANISOU | 1804 | CZ3 | TRP | A | 244 | 16326 | 15203 | 14343 | 331 | −1653 | 456 | C |
| ATOM | 1805 | CH2 | TRP | A | 244 | 3.089 | 26.569 | −2.759 | 1.00 | 121.28 | | C |
| ANISOU | 1805 | CH2 | TRP | A | 244 | 16421 | 15320 | 14341 | 318 | −1677 | 373 | C |
| ATOM | 1806 | N | ALA | A | 245 | 5.775 | 31.409 | −1.626 | 1.00 | 118.32 | | N |
| ANISOU | 1806 | N | ALA | A | 245 | 15990 | 14760 | 14205 | 318 | −1400 | 656 | N |
| ATOM | 1807 | CA | ALA | A | 245 | 4.404 | 31.883 | −1.517 | 1.00 | 126.74 | | C |
| ANISOU | 1807 | CA | ALA | A | 245 | 17011 | 15793 | 15350 | 346 | −1511 | 667 | C |
| ATOM | 1808 | C | ALA | A | 245 | 3.892 | 32.286 | −2.895 | 1.00 | 128.66 | | C |
| ANISOU | 1808 | C | ALA | A | 245 | 17335 | 16054 | 15496 | 374 | −1596 | 753 | C |
| ATOM | 1809 | O | ALA | A | 245 | 4.668 | 32.539 | −3.824 | 1.00 | 133.83 | | O |
| ANISOU | 1809 | O | ALA | A | 245 | 18077 | 16730 | 16042 | 373 | −1557 | 821 | O |
| ATOM | 1810 | CB | ALA | A | 245 | 4.291 | 33.056 | −0.539 | 1.00 | 126.90 | | C |
| ANISOU | 1810 | CB | ALA | A | 245 | 16958 | 15733 | 15526 | 351 | −1489 | 691 | C |
| ATOM | 1811 | N | ALA | A | 246 | 2.565 | 32.343 | −3.007 | 1.00 | 118.75 | | N |
| ANISOU | 1811 | N | ALA | A | 246 | 16047 | 14790 | 14281 | 400 | −1715 | 752 | N |
| ATOM | 1812 | CA | ALA | A | 246 | 1.891 | 32.749 | −4.238 | 1.00 | 108.61 | | C |
| ANISOU | 1812 | CA | ALA | A | 246 | 14828 | 13520 | 12918 | 430 | −1819 | 833 | C |
| ATOM | 1813 | C | ALA | A | 246 | 0.470 | 33.204 | −3.932 | 1.00 | 103.80 | | C |
| ANISOU | 1813 | C | ALA | A | 246 | 14141 | 12874 | 12425 | 461 | −1931 | 842 | C |
| ATOM | 1814 | O | ALA | A | 246 | 0.004 | 33.076 | −2.799 | 1.00 | 101.18 | | O |
| ANISOU | 1814 | O | ALA | A | 246 | 13709 | 12512 | 12222 | 459 | −1925 | 779 | O |
| ATOM | 1815 | CB | ALA | A | 246 | 1.882 | 31.611 | −5.241 | 1.00 | 103.77 | | C |
| ANISOU | 1815 | CB | ALA | A | 246 | 14302 | 12984 | 12141 | 424 | −1862 | 802 | C |
| ATOM | 1816 | N | CYS | A | 259 | 6.826 | 41.268 | −4.423 | 1.00 | 161.76 | | N |
| ANISOU | 1816 | N | CYS | A | 259 | 21671 | 19821 | 19968 | 391 | −1381 | 1466 | N |
| ATOM | 1817 | CA | CYS | A | 259 | 6.994 | 40.363 | −3.289 | 1.00 | 163.32 | | C |
| ANISOU | 1817 | CA | CYS | A | 259 | 21797 | 20040 | 20216 | 365 | −1344 | 1335 | C |
| ATOM | 1818 | C | CYS | A | 259 | 7.708 | 41.078 | −2.145 | 1.00 | 160.46 | | C |
| ANISOU | 1818 | C | CYS | A | 259 | 21376 | 19599 | 19994 | 330 | −1267 | 1317 | C |
| ATOM | 1819 | O | CYS | A | 259 | 8.363 | 42.105 | −2.349 | 1.00 | 160.49 | | O |
| ANISOU | 1819 | O | CYS | A | 259 | 21403 | 19542 | 20031 | 313 | −1222 | 1406 | O |
| ATOM | 1820 | CB | CYS | A | 259 | 7.773 | 39.103 | −3.704 | 1.00 | 165.63 | | C |
| ANISOU | 1820 | CB | CYS | A | 259 | 22131 | 20431 | 20371 | 341 | −1286 | 1289 | C |
| ATOM | 1821 | SG | CYS | A | 259 | 7.824 | 37.768 | −2.449 | 1.00 | 156.94 | | S |
| ANISOU | 1821 | SG | CYS | A | 259 | 20950 | 19370 | 19311 | 317 | −1256 | 1127 | S |
| ATOM | 1822 | N | HIS | A | 260 | 7.575 | 40.529 | −0.939 | 1.00 | 156.19 | | N |
| ANISOU | 1822 | N | HIS | A | 260 | 20761 | 19054 | 19532 | 318 | −1254 | 1203 | N |
| ATOM | 1823 | CA | HIS | A | 260 | 8.197 | 41.117 | 0.239 | 1.00 | 154.37 | | C |
| ANISOU | 1823 | CA | HIS | A | 260 | 20475 | 18750 | 19428 | 285 | −1190 | 1170 | C |
| ATOM | 1824 | C | HIS | A | 260 | 8.400 | 40.020 | 1.273 | 1.00 | 153.53 | | C |
| ANISOU | 1824 | C | HIS | A | 260 | 20310 | 18687 | 19338 | 262 | −1156 | 1043 | C |
| ATOM | 1825 | O | HIS | A | 260 | 7.476 | 39.243 | 1.538 | 1.00 | 151.69 | | O |
| ANISOU | 1825 | O | HIS | A | 260 | 20047 | 18491 | 19099 | 289 | −1211 | 970 | O |
| ATOM | 1826 | CB | HIS | A | 260 | 7.329 | 42.254 | 0.800 | 1.00 | 153.48 | | C |
| ANISOU | 1826 | CB | HIS | A | 260 | 20327 | 18536 | 19454 | 316 | −1244 | 1187 | C |
| ATOM | 1827 | CG | HIS | A | 260 | 8.079 | 43.220 | 1.668 | 1.00 | 151.16 | | C |
| ANISOU | 1827 | CG | HIS | A | 260 | 20007 | 18148 | 19278 | 282 | −1183 | 1192 | C |

TABLE 14-continued

| | | | | | | | | | | | | |
|---|---|---|---|---|---|---|---|---|---|---|---|---|
| ATOM | 1828 | ND1 | HIS | A | 260 | 7.712 | 44.542 | 1.796 | 1.00 | 150.69 | | N |
| ANISOU | 1828 | ND1 | HIS | A | 260 | 19950 | 17983 | 19324 | 301 | −1210 | 1252 | N |
| ATOM | 1829 | CD2 | HIS | A | 260 | 9.170 | 43.054 | 2.454 | 1.00 | 149.44 | | C |
| ANISOU | 1829 | CD2 | HIS | A | 260 | 19763 | 17924 | 19093 | 228 | −1102 | 1145 | C |
| ATOM | 1830 | CE1 | HIS | A | 260 | 8.546 | 45.150 | 2.620 | 1.00 | 150.43 | | C |
| ANISOU | 1830 | CE1 | HIS | A | 260 | 19896 | 17879 | 19380 | 258 | −1149 | 1237 | C |
| ATOM | 1831 | NE2 | HIS | A | 260 | 9.439 | 44.270 | 3.034 | 1.00 | 149.87 | | N |
| ANISOU | 1831 | NE2 | HIS | A | 260 | 19807 | 17870 | 19268 | 212 | −1086 | 1173 | N |
| ATOM | 1832 | N | VAL | A | 261 | 9.601 | 39.953 | 1.849 | 1.00 | 154.28 | | N |
| ANISOU | 1832 | N | VAL | A | 261 | 20388 | 18777 | 19454 | 213 | −1066 | 1021 | N |
| ATOM | 1833 | CA | VAL | A | 261 | 9.920 | 38.920 | 2.832 | 1.00 | 150.05 | | C |
| ANISOU | 1833 | CA | VAL | A | 261 | 19800 | 18282 | 18929 | 190 | −1028 | 908 | C |
| ATOM | 1834 | C | VAL | A | 261 | 11.007 | 39.417 | 3.782 | 1.00 | 147.67 | | C |
| ANISOU | 1834 | C | VAL | A | 261 | 19463 | 17929 | 18716 | 141 | −953 | 894 | C |
| ATOM | 1835 | O | VAL | A | 261 | 12.021 | 39.974 | 3.348 | 1.00 | 151.31 | | O |
| ANISOU | 1835 | O | VAL | A | 261 | 19951 | 18372 | 19166 | 107 | −898 | 970 | O |
| ATOM | 1836 | CB | VAL | A | 261 | 10.340 | 37.598 | 2.156 | 1.00 | 145.16 | | C |
| ANISOU | 1836 | CB | VAL | A | 261 | 19214 | 17769 | 18172 | 183 | −1001 | 884 | C |
| ATOM | 1837 | CG1 | VAL | A | 261 | 11.374 | 37.850 | 1.078 | 1.00 | 138.07 | | C |
| ANISOU | 1837 | CG1 | VAL | A | 261 | 18381 | 16895 | 17185 | 164 | −942 | 982 | C |
| ATOM | 1838 | CG2 | VAL | A | 261 | 10.870 | 36.623 | 3.190 | 1.00 | 146.64 | | C |
| ANISOU | 1838 | CG2 | VAL | A | 261 | 19348 | 17990 | 18378 | 155 | −949 | 780 | C |
| ATOM | 1839 | N | GLN | A | 262 | 10.799 | 39.191 | 5.081 | 1.00 | 139.69 | | N |
| ANISOU | 1839 | N | GLN | A | 262 | 18391 | 16895 | 17789 | 135 | −952 | 796 | N |
| ATOM | 1840 | CA | GLN | A | 262 | 11.692 | 39.653 | 6.138 | 1.00 | 136.26 | | C |
| ANISOU | 1840 | CA | GLN | A | 262 | 17919 | 16407 | 17445 | 89 | −898 | 768 | C |
| ATOM | 1841 | C | GLN | A | 262 | 12.437 | 38.472 | 6.760 | 1.00 | 130.61 | | C |
| ANISOU | 1841 | C | GLN | A | 262 | 17170 | 15760 | 16695 | 58 | −844 | 687 | C |
| ATOM | 1842 | O | GLN | A | 262 | 11.861 | 37.395 | 6.951 | 1.00 | 133.68 | | O |
| ANISOU | 1842 | O | GLN | A | 262 | 17542 | 16209 | 17041 | 81 | −864 | 615 | O |
| ATOM | 1843 | CB | GLN | A | 262 | 10.895 | 40.405 | 7.214 | 1.00 | 136.86 | | C |
| ANISOU | 1843 | CB | GLN | A | 262 | 17958 | 16395 | 17646 | 110 | −937 | 719 | C |
| ATOM | 1844 | CG | GLN | A | 262 | 9.872 | 41.405 | 6.655 | 1.00 | 135.60 | | C |
| ANISOU | 1844 | CG | GLN | A | 262 | 17824 | 16172 | 17524 | 157 | −1002 | 785 | C |
| ATOM | 1845 | CD | GLN | A | 262 | 8.671 | 41.624 | 7.575 | 1.00 | 131.26 | | C |
| ANISOU | 1845 | CD | GLN | A | 262 | 17233 | 15574 | 17066 | 202 | −1051 | 717 | C |
| ATOM | 1846 | OE1 | GLN | A | 262 | 8.636 | 41.135 | 8.706 | 1.00 | 127.54 | | O |
| ANISOU | 1846 | OE1 | GLN | A | 262 | 16717 | 15109 | 16635 | 195 | −1033 | 620 | O |
| ATOM | 1847 | NE2 | GLN | A | 262 | 7.676 | 42.359 | 7.084 | 1.00 | 131.11 | | N |
| ANISOU | 1847 | NE2 | GLN | A | 262 | 17227 | 15508 | 17079 | 251 | −1112 | 771 | N |
| ATOM | 1848 | N | HIS | A | 263 | 13.717 | 38.680 | 7.083 | 1.00 | 118.39 | | N |
| ANISOU | 1848 | N | HIS | A | 263 | 15610 | 14200 | 15172 | 6 | −778 | 702 | N |
| ATOM | 1849 | CA | HIS | A | 263 | 14.559 | 37.647 | 7.680 | 1.00 | 103.33 | | C |
| ANISOU | 1849 | CA | HIS | A | 263 | 13667 | 12354 | 13240 | −25 | −723 | 637 | C |
| ATOM | 1850 | C | HIS | A | 263 | 15.705 | 38.312 | 8.432 | 1.00 | 100.64 | | C |
| ANISOU | 1850 | C | HIS | A | 263 | 13296 | 11961 | 12983 | −83 | −676 | 646 | C |
| ATOM | 1851 | O | HIS | A | 263 | 16.127 | 39.419 | 8.088 | 1.00 | 106.80 | | O |
| ANISOU | 1851 | O | HIS | A | 263 | 14094 | 12677 | 13807 | −106 | −668 | 727 | O |
| ATOM | 1852 | CB | HIS | A | 263 | 15.096 | 36.686 | 6.608 | 1.00 | 95.78 | | C |
| ANISOU | 1852 | CB | HIS | A | 263 | 12745 | 11491 | 12157 | −24 | −682 | 670 | C |
| ATOM | 1853 | CG | HIS | A | 263 | 15.989 | 35.603 | 7.136 | 1.00 | 89.94 | | C |
| ANISOU | 1853 | CG | HIS | A | 263 | 11970 | 10813 | 11390 | −51 | −623 | 611 | C |
| ATOM | 1854 | ND1 | HIS | A | 263 | 17.359 | 35.633 | 6.991 | 1.00 | 87.20 | | N |
| ANISOU | 1854 | ND1 | HIS | A | 263 | 11613 | 10483 | 11037 | −93 | −548 | 656 | N |
| ATOM | 1855 | CD2 | HIS | A | 263 | 15.706 | 34.446 | 7.782 | 1.00 | 85.80 | | C |
| ANISOU | 1855 | CD2 | HIS | A | 263 | 11415 | 10338 | 10846 | −39 | −628 | 515 | C |
| ATOM | 1856 | CE1 | HIS | A | 263 | 17.882 | 34.548 | 7.536 | 1.00 | 83.87 | | C |
| ANISOU | 1856 | CE1 | HIS | A | 263 | 11156 | 10117 | 10594 | −104 | −510 | 589 | C |
| ATOM | 1857 | NE2 | HIS | A | 263 | 16.901 | 33.811 | 8.021 | 1.00 | 84.31 | | N |
| ANISOU | 1857 | NE2 | HIS | A | 263 | 11202 | 10193 | 10639 | −72 | −557 | 503 | N |
| ATOM | 1858 | N | GLU | A | 264 | 16.216 | 37.612 | 9.454 | 1.00 | 91.22 | | N |
| ANISOU | 1858 | N | GLU | A | 264 | 12056 | 10793 | 11810 | −107 | −649 | 565 | N |
| ATOM | 1859 | CA | GLU | A | 264 | 17.262 | 38.170 | 10.312 | 1.00 | 87.10 | | C |
| ANISOU | 1859 | CA | GLU | A | 264 | 11499 | 10224 | 11372 | −164 | −616 | 560 | C |
| ATOM | 1860 | C | GLU | A | 264 | 18.535 | 38.500 | 9.543 | 1.00 | 86.86 | | C |
| ANISOU | 1860 | C | GLU | A | 264 | 11476 | 10202 | 11326 | −209 | −557 | 657 | C |
| ATOM | 1861 | O | GLU | A | 264 | 19.242 | 39.448 | 9.897 | 1.00 | 93.75 | | O |
| ANISOU | 1861 | O | GLU | A | 264 | 12334 | 11006 | 12282 | −256 | −545 | 693 | O |
| ATOM | 1862 | CB | GLU | A | 264 | 17.588 | 37.192 | 11.435 | 1.00 | 86.10 | | C |
| ANISOU | 1862 | CB | GLU | A | 264 | 11323 | 10139 | 11251 | −178 | −599 | 461 | C |
| ATOM | 1863 | CG | GLU | A | 264 | 16.362 | 36.521 | 12.007 | 1.00 | 89.98 | | C |
| ANISOU | 1863 | CG | GLU | A | 264 | 11807 | 10650 | 11731 | −129 | −643 | 371 | C |
| ATOM | 1864 | CD | GLU | A | 264 | 16.693 | 35.380 | 12.943 | 0.00 | 88.87 | | C |
| ANISOU | 1864 | CD | GLU | A | 264 | 11624 | 10565 | 11576 | −139 | −620 | 284 | C |
| ATOM | 1865 | OE1 | GLU | A | 264 | 17.837 | 35.323 | 13.459 | 1.00 | 87.52 | | O |
| ANISOU | 1865 | OE1 | GLU | A | 264 | 11424 | 10399 | 11431 | −185 | −582 | 280 | O |
| ATOM | 1866 | OE2 | GLU | A | 264 | 15.800 | 34.533 | 13.151 | 1.00 | 89.34 | | O |
| ANISOU | 1866 | OE2 | GLU | A | 264 | 11679 | 10664 | 11603 | −100 | −643 | 222 | O |
| ATOM | 1867 | N | GLY | A | 265 | 18.862 | 37.723 | 8.517 | 1.00 | 77.48 | | N |
| ANISOU | 1867 | N | GLY | A | 265 | 10309 | 9095 | 10033 | −196 | −516 | 699 | N |

TABLE 14-continued

| | | | | | | | | | | | | |
|---|---|---|---|---|---|---|---|---|---|---|---|---|
| ATOM | 1868 | CA | GLY | A | 265 | 20.074 | 37.933 | 7.756 | 1.00 | 80.10 | | C |
| ANISOU | 1868 | CA | GLY | A | 265 | 10646 | 9446 | 10343 | −233 | −447 | 793 | C |
| ATOM | 1869 | C | GLY | A | 265 | 20.010 | 38.996 | 6.682 | 1.00 | 93.48 | | C |
| ANISOU | 1869 | C | GLY | A | 265 | 12390 | 11096 | 12031 | −231 | −448 | 909 | C |
| ATOM | 1870 | O | GLY | A | 265 | 21.039 | 39.306 | 6.076 | 1.00 | 92.72 | | O |
| ANISOU | 1870 | O | GLY | A | 265 | 12295 | 11006 | 11927 | −266 | −386 | 998 | O |
| ATOM | 1871 | N | LEU | A | 266 | 18.836 | 39.563 | 6.411 | 1.00 | 110.81 | | N |
| ANISOU | 1871 | N | LEU | A | 266 | 14625 | 13246 | 14231 | −191 | −514 | 918 | N |
| ATOM | 1872 | CA | LEU | A | 266 | 18.875 | 40.637 | 5.424 | 1.00 | 121.73 | | C |
| ANISOU | 1872 | CA | LEU | A | 266 | 16055 | 14581 | 15615 | −192 | −513 | 1037 | C |
| ATOM | 1873 | C | LEU | A | 266 | 18.970 | 41.989 | 6.116 | 1.00 | 127.55 | | C |
| ANISOU | 1873 | C | LEU | A | 266 | 16775 | 15199 | 16490 | −228 | −538 | 1058 | C |
| ATOM | 1874 | O | LEU | A | 266 | 18.260 | 42.231 | 7.102 | 1.00 | 130.48 | | O |
| ANISOU | 1874 | O | LEU | A | 266 | 17126 | 15516 | 16933 | −216 | −591 | 978 | O |
| ATOM | 1875 | CB | LEU | A | 266 | 17.630 | 40.626 | 4.534 | 1.00 | 119.63 | | C |
| ANISOU | 1875 | CB | LEU | A | 266 | 15849 | 14330 | 15276 | −129 | −572 | 1061 | C |
| ATOM | 1876 | CG | LEU | A | 266 | 17.247 | 39.367 | 3.761 | 1.00 | 114.07 | | C |
| ANISOU | 1876 | CG | LEU | A | 266 | 15178 | 13732 | 14431 | −86 | −571 | 1037 | C |
| ATOM | 1877 | CD1 | LEU | A | 266 | 15.856 | 38.954 | 4.165 | 1.00 | 109.65 | | C |
| ANISOU | 1877 | CD1 | LEU | A | 266 | 14614 | 13174 | 13872 | −37 | −654 | 951 | C |
| ATOM | 1878 | CD2 | LEU | A | 266 | 17.305 | 39.615 | 2.267 | 1.00 | 114.13 | | C |
| ANISOU | 1878 | CD2 | LEU | A | 266 | 15259 | 13768 | 14339 | −66 | −556 | 1150 | C |
| ATOM | 1879 | N | PRO | A | 267 | 19.836 | 42.879 | 5.610 | 1.00 | 126.00 | | N |
| ANISOU | 1879 | N | PRO | A | 267 | 16587 | 14957 | 16329 | −271 | −497 | 1164 | N |
| ATOM | 1880 | CA | PRO | A | 267 | 19.927 | 44.233 | 6.175 | 1.00 | 122.09 | | C |
| ANISOU | 1880 | CA | PRO | A | 267 | 16084 | 14338 | 15966 | −308 | −523 | 1190 | C |
| ATOM | 1881 | C | PRO | A | 267 | 18.562 | 44.891 | 6.280 | 1.00 | 118.59 | | C |
| ANISOU | 1881 | C | PRO | A | 267 | 15676 | 13825 | 15559 | −255 | −603 | 1172 | C |
| ATOM | 1882 | O | PRO | A | 267 | 18.118 | 45.293 | 7.361 | 1.00 | 110.43 | | O |
| ANISOU | 1882 | O | PRO | A | 267 | 14620 | 12720 | 14616 | −255 | −645 | 1094 | O |
| ATOM | 1883 | CB | PRO | A | 267 | 20.827 | 44.968 | 5.174 | 1.00 | 124.57 | | C |
| ANISOU | 1883 | CB | PRO | A | 267 | 16420 | 14631 | 16280 | −346 | −468 | 1333 | C |
| ATOM | 1884 | CG | PRO | A | 267 | 21.645 | 43.890 | 4.537 | 1.00 | 126.79 | | C |
| ANISOU | 1884 | CG | PRO | A | 267 | 16692 | 15030 | 16455 | −351 | −392 | 1355 | C |
| ATOM | 1885 | CD | PRO | A | 267 | 20.757 | 42.680 | 4.477 | 1.00 | 127.70 | | C |
| ANISOU | 1885 | CD | PRO | A | 267 | 16823 | 15232 | 16466 | −288 | −421 | 1267 | C |
| ATOM | 1886 | N | LYS | A | 268 | 17.885 | 44.977 | 5.145 | 1.00 | 126.75 | | N |
| ANISOU | 1886 | N | LYS | A | 268 | 16763 | 14880 | 16516 | −206 | −622 | 1243 | N |
| ATOM | 1887 | CA | LYS | A | 268 | 16.552 | 45.537 | 5.037 | 1.00 | 131.41 | | C |
| ANISOU | 1887 | CA | LYS | A | 268 | 17384 | 15415 | 17128 | −148 | −698 | 1242 | C |
| ATOM | 1888 | C | LYS | A | 268 | 15.684 | 44.589 | 4.224 | 1.00 | 126.01 | | C |
| ANISOU | 1888 | C | LYS | A | 268 | 16731 | 14828 | 16318 | −85 | −727 | 1233 | C |
| ATOM | 1889 | O | LYS | A | 268 | 16.190 | 43.859 | 3.363 | 1.00 | 127.07 | | O |
| ANISOU | 1889 | O | LYS | A | 268 | 16889 | 15052 | 16341 | −88 | −683 | 1272 | O |
| ATOM | 1890 | CB | LYS | A | 268 | 16.576 | 46.931 | 4.381 | 1.00 | 135.41 | | C |
| ANISOU | 1890 | CB | LYS | A | 268 | 17933 | 15825 | 17690 | −155 | −707 | 1364 | C |
| ATOM | 1891 | CG | LYS | A | 268 | 17.199 | 46.991 | 2.985 | 1.00 | 132.79 | | C |
| ANISOU | 1891 | CG | LYS | A | 268 | 17647 | 15539 | 17267 | −164 | −658 | 1497 | C |
| ATOM | 1892 | CD | LYS | A | 268 | 18.723 | 47.061 | 3.032 | 1.00 | 124.39 | | C |
| ANISOU | 1892 | CD | LYS | A | 268 | 16554 | 14481 | 16228 | −241 | −572 | 1542 | C |
| ATOM | 1893 | CE | LYS | A | 268 | 19.319 | 47.121 | 1.639 | 1.00 | 118.25 | | C |
| ANISOU | 1893 | CE | LYS | A | 268 | 15823 | 13752 | 15357 | −245 | −514 | 1678 | C |
| ATOM | 1894 | NZ | LYS | A | 268 | 20.801 | 47.056 | 1.707 | 1.00 | 113.81 | | N |
| ANISOU | 1894 | NZ | LYS | A | 268 | 15218 | 13205 | 14817 | −317 | −424 | 1719 | N |
| ATOM | 1895 | N | PRO | A | 269 | 14.380 | 44.563 | 4.491 | 1.00 | 115.13 | | N |
| ANISOU | 1895 | N | PRO | A | 269 | 15354 | 13433 | 14956 | −29 | −800 | 1179 | N |
| ATOM | 1896 | CA | PRO | A | 269 | 13.506 | 43.609 | 3.797 | 1.00 | 114.95 | | C |
| ANISOU | 1896 | CA | PRO | A | 269 | 15354 | 13502 | 14821 | 25 | −839 | 1161 | C |
| ATOM | 1897 | C | PRO | A | 269 | 13.436 | 43.887 | 2.301 | 1.00 | 118.40 | | C |
| ANISOU | 1897 | C | PRO | A | 269 | 15860 | 13964 | 15164 | 47 | −845 | 1283 | C |
| ATOM | 1898 | O | PRO | A | 269 | 13.659 | 45.011 | 1.843 | 1.00 | 121.61 | | O |
| ANISOU | 1898 | O | PRO | A | 269 | 16297 | 14299 | 15612 | 37 | −841 | 1385 | O |
| ATOM | 1899 | CB | PRO | A | 269 | 12.145 | 43.822 | 4.473 | 1.00 | 112.65 | | C |
| ANISOU | 1899 | CB | PRO | A | 269 | 15040 | 13163 | 14600 | 76 | −916 | 1095 | C |
| ATOM | 1900 | CG | PRO | A | 269 | 12.459 | 44.483 | 5.793 | 1.00 | 107.03 | | C |
| ANISOU | 1900 | CG | PRO | A | 269 | 14286 | 12361 | 14020 | 45 | −901 | 1037 | C |
| ATOM | 1901 | CD | PRO | A | 269 | 13.669 | 45.320 | 5.535 | 1.00 | 107.56 | | C |
| ANISOU | 1901 | CD | PRO | A | 269 | 14370 | 12376 | 14122 | −14 | −847 | 1122 | C |
| TER | 1902 | | PRO | A | 269 | | | | | | | |
| ATOM | 1902 | N | GLY | P | 1 | 23.534 | 19.305 | 26.694 | 1.00 | 36.79 | | N |
| ANISOU | 1902 | N | GLY | P | 1 | 4503 | 4651 | 4825 | −177 | −345 | −474 | N |
| ATOM | 1903 | CA | GLY | P | 1 | 23.378 | 18.186 | 27.614 | 1.00 | 39.11 | | C |
| ANISOU | 1903 | CA | GLY | P | 1 | 4786 | 4973 | 5099 | −155 | −339 | −512 | C |
| ATOM | 1904 | C | GLY | P | 1 | 21.959 | 17.969 | 28.169 | 1.00 | 40.76 | | C |
| ANISOU | 1904 | C | GLY | P | 1 | 5026 | 5166 | 5294 | −127 | −356 | −567 | C |
| ATOM | 1905 | O | GLY | P | 1 | 21.302 | 18.897 | 28.639 | 1.00 | 38.06 | | O |
| ANISOU | 1905 | O | GLY | P | 1 | 4705 | 4784 | 4971 | −133 | −387 | −592 | O |
| ATOM | 1906 | N | VAL | P | 2 | 21.566 | 16.694 | 28.164 | 1.00 | 36.10 | | N |
| ANISOU | 1906 | N | VAL | P | 2 | 4436 | 4605 | 4674 | −96 | −330 | −584 | N |
| ATOM | 1907 | C | VAL | P | 2 | 20.129 | 16.451 | 30.135 | 1.00 | 41.78 | | C |

TABLE 14-continued

| | | | | | | | | | | | | |
|---|---|---|---|---|---|---|---|---|---|---|---|---|
| ANISOU | 1907 | C | VAL | P | 2 | 5173 | 5308 | 5395 | −72 | −357 | −665 | C |
| ATOM | 1908 | O | VAL | P | 2 | 21.106 | 16.454 | 30.874 | 1.00 | 35.51 | | O |
| ANISOU | 1908 | O | VAL | P | 2 | 4359 | 4528 | 4605 | −91 | −364 | −659 | O |
| ATOM | 1909 | CA | AVAL | P | 2 | 20.230 | 16.337 | 28.617 | 0.54 | 37.86 | | C |
| ANISOU | 1909 | CA | AVAL | P | 2 | 4681 | 4817 | 4888 | −69 | −339 | −629 | C |
| ATOM | 1910 | CB | AVAL | P | 2 | 19.829 | 14.922 | 28.163 | 0.54 | 34.33 | | C |
| ANISOU | 1910 | CB | AVAL | P | 2 | 4235 | 4398 | 4412 | −39 | −309 | −636 | C |
| ATOM | 1911 | CG1 | AVAL | P | 2 | 19.943 | 14.759 | 26.649 | 0.54 | 30.88 | | C |
| ANISOU | 1911 | CG1 | AVAL | P | 2 | 3812 | 3968 | 3953 | −33 | −291 | −606 | C |
| ATOM | 1912 | CG2 | AVAL | P | 2 | 20.682 | 13.932 | 28.844 | 0.54 | 33.88 | | C |
| ANISOU | 1912 | CG2 | AVAL | P | 2 | 4152 | 4374 | 4347 | −36 | −287 | −633 | C |
| ATOM | 1913 | CA | BVAL | P | 2 | 20.264 | 16.233 | 28.630 | 0.46 | 37.88 | | C |
| ANISOU | 1913 | CA | BVAL | P | 2 | 4681 | 4822 | 4888 | −68 | −336 | −629 | C |
| ATOM | 1914 | CB | BVAL | P | 2 | 20.122 | 14.746 | 28.242 | 0.46 | 33.74 | | C |
| ANISOU | 1914 | CB | BVAL | P | 2 | 4154 | 4332 | 4335 | −40 | −303 | −632 | C |
| ATOM | 1915 | CG1 | BVAL | P | 2 | 19.091 | 13.994 | 29.070 | 0.46 | 30.03 | | C |
| ANISOU | 1915 | CG1 | BVAL | P | 2 | 3689 | 3861 | 3860 | −17 | −303 | −673 | C |
| ATOM | 1916 | CG2 | BVAL | P | 2 | 19.832 | 14.612 | 26.736 | 0.46 | 31.31 | | C |
| ANISOU | 1916 | CG2 | BVAL | P | 2 | 3867 | 4024 | 4006 | −30 | −290 | −611 | C |
| ATOM | 1917 | N | TYR | P | 3 | 18.895 | 16.487 | 30.587 | 1.00 | 35.42 | | N |
| ANISOU | 1917 | N | TYR | P | 3 | 4385 | 4483 | 4589 | −50 | −364 | −701 | N |
| ATOM | 1918 | CA | TYR | P | 3 | 18.558 | 16.732 | 31.997 | 1.00 | 32.98 | | C |
| ANISOU | 1918 | CA | TYR | P | 3 | 4084 | 4163 | 4283 | −47 | −377 | −739 | C |
| ATOM | 1919 | C | TYR | P | 3 | 19.269 | 15.742 | 32.920 | 1.00 | 35.32 | | C |
| ANISOU | 1919 | C | TYR | P | 3 | 4363 | 4498 | 4559 | −45 | −365 | −742 | C |
| ATOM | 1920 | O | TYR | P | 3 | 19.106 | 14.582 | 32.610 | 1.00 | 33.69 | | O |
| ANISOU | 1920 | O | TYR | P | 3 | 4146 | 4317 | 4338 | −26 | −337 | −735 | O |
| ATOM | 1921 | CB | TYR | P | 3 | 17.059 | 16.550 | 32.140 | 1.00 | 36.97 | | C |
| ANISOU | 1921 | CB | TYR | P | 3 | 4603 | 4653 | 4790 | −15 | −369 | −769 | C |
| ATOM | 1922 | CG | TYR | P | 3 | 16.616 | 16.710 | 33.552 | 1.00 | 35.54 | | C |
| ANISOU | 1922 | CG | TYR | P | 3 | 4434 | 4464 | 4605 | −3 | −370 | −807 | C |
| ATOM | 1923 | CD1 | TYR | P | 3 | 16.954 | 17.845 | 34.236 | 1.00 | 41.19 | | C |
| ANISOU | 1923 | CD1 | TYR | P | 3 | 5169 | 5151 | 5329 | −19 | −397 | −824 | C |
| ATOM | 1924 | CD2 | TYR | P | 3 | 15.921 | 15.724 | 34.199 | 1.00 | 31.39 | | C |
| ANISOU | 1924 | CD2 | TYR | P | 3 | 3903 | 3958 | 4066 | 23 | −345 | −825 | C |
| ATOM | 1925 | CE1 | TYR | P | 3 | 16.594 | 18.017 | 35.544 | 1.00 | 45.09 | | C |
| ANISOU | 1925 | CE1 | TYR | P | 3 | 5683 | 5638 | 5810 | −5 | −396 | −862 | C |
| ATOM | 1926 | CE2 | TYR | P | 3 | 15.540 | 15.881 | 35.507 | 1.00 | 35.25 | | C |
| ANISOU | 1926 | CE2 | TYR | P | 3 | 4407 | 4442 | 4544 | 37 | −340 | −857 | C |
| ATOM | 1927 | CZ | TYR | P | 3 | 15.892 | 17.029 | 36.168 | 1.00 | 44.01 | | C |
| ANISOU | 1927 | CZ | TYR | P | 3 | 5542 | 5525 | 5654 | 24 | −365 | −877 | C |
| ATOM | 1928 | OH | TYR | P | 3 | 15.496 | 17.177 | 37.444 | 1.00 | 48.33 | | O |
| ANISOU | 1928 | OH | TYR | P | 3 | 6113 | 6068 | 6183 | 42 | −358 | −912 | O |
| ATOM | 1929 | N | AASP | P | 4 | 19.855 | 15.984 | 33.927 | 0.39 | 34.55 | | N |
| ANISOU | 1929 | N | AASP | P | 4 | 4265 | 4405 | 4458 | −59 | −382 | −752 | N |
| ATOM | 1930 | CA | AASP | P | 4 | 20.513 | 14.989 | 34.775 | 0.39 | 34.47 | | C |
| ANISOU | 1930 | CA | AASP | P | 4 | 4237 | 4432 | 4426 | −54 | −374 | −749 | C |
| ATOM | 1931 | C | AASP | P | 4 | 19.927 | 14.932 | 36.177 | 0.39 | 39.15 | | C |
| ANISOU | 1931 | C | AASP | P | 4 | 4854 | 5024 | 4998 | −39 | −379 | −788 | C |
| ATOM | 1932 | O | AASP | P | 4 | 20.503 | 14.274 | 37.048 | 0.39 | 40.58 | | O |
| ANISOU | 1932 | O | AASP | P | 4 | 5027 | 5234 | 5158 | −37 | −381 | −785 | O |
| ATOM | 1933 | CB | AASP | P | 4 | 22.027 | 15.240 | 34.865 | 0.39 | 37.19 | | C |
| ANISOU | 1933 | CB | AASP | P | 4 | 4555 | 4794 | 4782 | −88 | −396 | −718 | C |
| ATOM | 1934 | CG | AASP | P | 4 | 22.816 | 13.969 | 35.186 | 0.39 | 34.94 | | C |
| ANISOU | 1934 | CG | AASP | P | 4 | 4239 | 4555 | 4482 | −77 | −378 | −695 | C |
| ATOM | 1935 | OD1 | AASP | P | 4 | 24.022 | 14.054 | 35.454 | 0.39 | 43.79 | | O |
| ANISOU | 1935 | OD1 | AASP | P | 4 | 5330 | 5694 | 5613 | −101 | −398 | −669 | O |
| ATOM | 1936 | OD2 | AASP | P | 4 | 22.233 | 12.865 | 35.138 | 0.39 | 42.01 | | O |
| ANISOU | 1936 | OD2 | AASP | P | 4 | 5137 | 5466 | 5361 | −46 | −344 | −700 | O |
| ATOM | 1937 | N | BASP | P | 4 | 19.806 | 16.027 | 33.937 | 0.61 | 35.02 | | N |
| ANISOU | 1937 | N | BASP | P | 4 | 4326 | 4463 | 4518 | −59 | −383 | −754 | N |
| ATOM | 1938 | CA | BASP | P | 4 | 20.591 | 15.169 | 34.809 | 0.61 | 34.44 | | C |
| ANISOU | 1938 | CA | BASP | P | 4 | 4234 | 4425 | 4425 | −59 | −379 | −749 | C |
| ATOM | 1939 | C | BASP | P | 4 | 19.943 | 14.958 | 36.164 | 0.61 | 39.05 | | C |
| ANISOU | 1939 | C | BASP | P | 4 | 4840 | 5010 | 4986 | −40 | −380 | −788 | C |
| ATOM | 1940 | O | BASP | P | 4 | 20.471 | 14.188 | 36.970 | 0.61 | 41.04 | | O |
| ANISOU | 1940 | O | BASP | P | 4 | 5084 | 5294 | 5217 | −35 | −377 | −783 | O |
| ATOM | 1941 | CB | BASP | P | 4 | 22.010 | 15.761 | 34.986 | 0.61 | 37.82 | | C |
| ANISOU | 1941 | CB | BASP | P | 4 | 4643 | 4860 | 4868 | −98 | −411 | −725 | C |
| ATOM | 1942 | CG | BASP | P | 4 | 22.014 | 17.307 | 35.150 | 0.61 | 42.99 | | C |
| ANISOU | 1942 | CG | BASP | P | 4 | 5320 | 5468 | 5545 | −127 | −451 | −741 | C |
| ATOM | 1943 | OD1 | BASP | P | 4 | 20.939 | 17.941 | 35.279 | 0.61 | 36.36 | | O |
| ANISOU | 1943 | OD1 | BASP | P | 4 | 4515 | 4592 | 4707 | −113 | −454 | −774 | O |
| ATOM | 1944 | OD2 | BASP | P | 4 | 23.132 | 17.896 | 35.131 | 0.61 | 44.69 | | O |
| ANISOU | 1944 | OD2 | BASP | P | 4 | 5516 | 5681 | 5782 | −166 | −480 | −717 | O |
| ATOM | 1945 | N | GLY | P | 5 | 18.789 | 15.576 | 36.418 | 1.00 | 39.83 | | N |
| ANISOU | 1945 | N | GLY | P | 5 | 4969 | 5078 | 5088 | −24 | −379 | −821 | N |
| ATOM | 1946 | CA | GLY | P | 5 | 18.145 | 15.479 | 37.703 | 1.00 | 39.32 | | C |
| ANISOU | 1946 | CA | GLY | P | 5 | 4929 | 5013 | 4999 | −2 | −372 | −857 | C |
| ATOM | 1947 | C | GLY | P | 5 | 17.470 | 14.132 | 37.892 | 1.00 | 39.50 | | C |

TABLE 14-continued

| | | | | | | | | | | | | |
|---|---|---|---|---|---|---|---|---|---|---|---|---|
| ANISOU | 1947 | C | GLY | P | 5 | 4940 | 5063 | 5007 | 29 | −331 | −853 | C |
| ATOM | 1948 | O | GLY | P | 5 | 17.523 | 13.241 | 37.051 | 1.00 | 33.22 | | O |
| ANISOU | 1948 | O | GLY | P | 5 | 4119 | 4284 | 4220 | 33 | −311 | −827 | O |
| ATOM | 1949 | N | GLU | P | 6 | 16.818 | 13.992 | 39.039 | 1.00 | 33.23 | | N |
| ANISOU | 1949 | N | GLU | P | 6 | 4167 | 4270 | 4189 | 51 | −315 | −880 | N |
| ATOM | 1950 | CA | GLU | P | 6 | 16.085 | 12.776 | 39.342 | 1.00 | 34.96 | | C |
| ANISOU | 1950 | CA | GLU | P | 6 | 4375 | 4510 | 4398 | 79 | −273 | −874 | C |
| ATOM | 1951 | C | GLU | P | 6 | 15.015 | 12.519 | 38.273 | 1.00 | 35.27 | | C |
| ANISOU | 1951 | C | GLU | P | 6 | 4395 | 4532 | 4473 | 92 | −252 | −869 | C |
| ATOM | 1952 | O | GLU | P | 6 | 14.389 | 13.451 | 37.747 | 1.00 | 30.20 | | O |
| ANISOU | 1952 | O | GLU | P | 6 | 3759 | 3858 | 3856 | 93 | −263 | −882 | O |
| ATOM | 1953 | CB | GLU | P | 6 | 15.433 | 12.903 | 40.718 | 1.00 | 34.31 | | C |
| ANISOU | 1953 | CB | GLU | P | 6 | 4323 | 4427 | 4286 | 103 | −255 | −903 | C |
| ATOM | 1954 | CG | GLU | P | 6 | 14.648 | 11.700 | 41.132 | 1.00 | 33.47 | | C |
| ANISOU | 1954 | CG | GLU | P | 6 | 4205 | 4339 | 4173 | 131 | −208 | −893 | C |
| ATOM | 1955 | CD | GLU | P | 6 | 13.846 | 11.901 | 42.444 | 1.00 | 39.08 | | C |
| ANISOU | 1955 | CD | GLU | P | 6 | 4947 | 5048 | 4853 | 160 | −178 | −919 | C |
| ATOM | 1956 | OE1 | GLU | P | 6 | 13.327 | 10.893 | 42.945 | 1.00 | 32.54 | | O |
| ANISOU | 1956 | OE1 | GLU | P | 6 | 4110 | 4239 | 4015 | 180 | −137 | −905 | O |
| ATOM | 1957 | OE2 | GLU | P | 6 | 13.768 | 13.037 | 42.998 | 1.00 | 38.51 | | O |
| ANISOU | 1957 | OE2 | GLU | P | 6 | 4912 | 4956 | 4765 | 163 | −193 | −953 | O |
| ATOM | 1958 | N | GLU | P | 7 | 14.822 | 11.259 | 37.930 | 1.00 | 32.87 | | N |
| ANISOU | 1958 | N | GLU | P | 7 | 4070 | 4247 | 4174 | 100 | −227 | −849 | N |
| ATOM | 1959 | CA | GLU | P | 7 | 13.816 | 10.931 | 36.918 | 1.00 | 33.00 | | C |
| ANISOU | 1959 | CA | GLU | P | 7 | 4069 | 4248 | 4223 | 108 | −215 | −846 | C |
| ATOM | 1960 | C | GLU | P | 7 | 12.483 | 10.709 | 37.605 | 1.00 | 33.92 | | C |
| ANISOU | 1960 | C | GLU | P | 7 | 4181 | 4355 | 4351 | 133 | −185 | −860 | C |
| ATOM | 1961 | O | GLU | P | 7 | 12.430 | 10.139 | 38.688 | 1.00 | 34.89 | | O |
| ANISOU | 1961 | O | GLU | P | 7 | 4309 | 4494 | 4452 | 146 | −158 | −861 | O |
| ATOM | 1962 | CB | GLU | P | 7 | 14.208 | 9.682 | 36.136 | 1.00 | 32.98 | | C |
| ANISOU | 1962 | CB | GLU | P | 7 | 4048 | 4261 | 4222 | 103 | −205 | −821 | C |
| ATOM | 1963 | CG | GLU | P | 7 | 15.562 | 9.836 | 35.398 | 1.00 | 40.56 | | C |
| ANISOU | 1963 | CG | GLU | P | 7 | 5007 | 5233 | 5171 | 83 | −225 | −801 | C |
| ATOM | 1964 | CD | GLU | P | 7 | 15.378 | 10.174 | 33.929 | 1.00 | 54.19 | | C |
| ANISOU | 1964 | CD | GLU | P | 7 | 6733 | 6943 | 6913 | 75 | −239 | −794 | C |
| ATOM | 1965 | OE1 | GLU | P | 7 | 16.348 | 10.658 | 33.258 | 1.00 | 58.26 | | O |
| ANISOU | 1965 | OE1 | GLU | P | 7 | 7250 | 7463 | 7424 | 58 | −253 | −777 | O |
| ATOM | 1966 | OE2 | GLU | P | 7 | 14.253 | 9.951 | 33.426 | 1.00 | 46.83 | | O |
| ANISOU | 1966 | OE2 | GLU | P | 7 | 5798 | 5995 | 5999 | 84 | −236 | −803 | O |
| ATOM | 1967 | N | HIS | P | 8 | 11.395 | 11.101 | 36.931 | 1.00 | 33.04 | | N |
| ANISOU | 1967 | N | HIS | P | 8 | 4058 | 4219 | 4277 | 141 | −187 | −867 | N |
| ATOM | 1968 | CA | HIS | P | 8 | 10.058 | 10.949 | 37.496 | 1.00 | 30.97 | | C |
| ANISOU | 1968 | CA | HIS | P | 8 | 3782 | 3948 | 4039 | 166 | −155 | −876 | C |
| ATOM | 1969 | C | HIS | P | 8 | 9.113 | 10.507 | 36.393 | 1.00 | 30.47 | | C |
| ANISOU | 1969 | C | HIS | P | 8 | 3686 | 3871 | 4020 | 164 | −162 | −865 | C |
| ATOM | 1970 | O | HIS | P | 8 | 9.048 | 11.142 | 35.344 | 1.00 | 29.29 | | O |
| ANISOU | 1970 | O | HIS | P | 8 | 3536 | 3704 | 3887 | 155 | −196 | −863 | O |
| ATOM | 1971 | CB | HIS | P | 8 | 9.551 | 12.248 | 38.082 | 1.00 | 28.24 | | C |
| ANISOU | 1971 | CB | HIS | P | 8 | 3453 | 3580 | 3698 | 184 | −154 | −900 | C |
| ATOM | 1972 | CG | HIS | P | 8 | 10.398 | 12.773 | 39.196 | 1.00 | 29.99 | | C |
| ANISOU | 1972 | CG | HIS | P | 8 | 3713 | 3808 | 3872 | 184 | −155 | −918 | C |
| ATOM | 1973 | ND1 | HIS | P | 8 | 10.273 | 12.325 | 40.486 | 1.00 | 34.96 | | N |
| ANISOU | 1973 | ND1 | HIS | P | 8 | 4356 | 4456 | 4469 | 203 | −119 | −925 | N |
| ATOM | 1974 | CD2 | HIS | P | 8 | 11.352 | 13.731 | 39.215 | 1.00 | 33.51 | | C |
| ANISOU | 1974 | CD2 | HIS | P | 8 | 4188 | 4245 | 4299 | 166 | −191 | −930 | C |
| ATOM | 1975 | CE1 | HIS | P | 8 | 11.119 | 12.982 | 41.260 | 1.00 | 34.56 | | C |
| ANISOU | 1975 | CE1 | HIS | P | 8 | 4346 | 4409 | 4376 | 198 | −137 | −944 | C |
| ATOM | 1976 | NE2 | HIS | P | 8 | 11.793 | 13.837 | 40.507 | 1.00 | 37.09 | | N |
| ANISOU | 1976 | NE2 | HIS | P | 8 | 4674 | 4711 | 4709 | 173 | −182 | −948 | N |
| ATOM | 1977 | N | SER | P | 9 | 8.429 | 9.403 | 36.621 | 1.00 | 32.53 | | N |
| ANISOU | 1977 | N | SER | P | 9 | 3923 | 4139 | 4299 | 170 | −134 | −854 | N |
| ATOM | 1978 | CA | SER | P | 9 | 7.384 | 9.021 | 35.685 | 1.00 | 31.96 | | C |
| ANISOU | 1978 | CA | SER | P | 9 | 3817 | 4050 | 4275 | 167 | −146 | −847 | C |
| ATOM | 1979 | C | SER | P | 9 | 6.080 | 9.727 | 36.050 | 1.00 | 34.41 | | C |
| ANISOU | 1979 | C | SER | P | 9 | 4103 | 4343 | 4628 | 190 | −132 | −853 | C |
| ATOM | 1980 | O | SER | P | 9 | 5.892 | 10.199 | 37.174 | 1.00 | 35.02 | | O |
| ANISOU | 1980 | O | SER | P | 9 | 4189 | 4423 | 4696 | 213 | −97 | −864 | O |
| ATOM | 1981 | CB | SER | P | 9 | 7.141 | 7.541 | 35.746 | 1.00 | 36.94 | | C |
| ANISOU | 1981 | CB | SER | P | 9 | 4429 | 4689 | 4918 | 160 | −124 | −832 | C |
| ATOM | 1982 | OG | SER | P | 9 | 6.306 | 7.261 | 36.857 | 1.00 | 49.16 | | O |
| ANISOU | 1982 | OG | SER | P | 9 | 5955 | 6238 | 6484 | 178 | −78 | −828 | O |
| ATOM | 1983 | N | VAL | P | 10 | 5.154 | 9.755 | 35.105 | 1.00 | 34.32 | | N |
| ANISOU | 1983 | N | VAL | P | 10 | 4061 | 4315 | 4665 | 187 | −158 | −847 | N |
| ATOM | 1984 | CA | VAL | P | 10 | 3.826 | 10.421 | 35.272 | 1.00 | 40.99 | | C |
| ANISOU | 1984 | CA | VAL | P | 10 | 4870 | 5141 | 5565 | 211 | −148 | −847 | C |
| ATOM | 1985 | C | VAL | P | 10 | 2.953 | 9.606 | 36.227 | 0.43 | 46.56 | | C |
| ANISOU | 1985 | C | VAL | P | 10 | 5538 | 5854 | 6300 | 225 | −94 | −836 | C |
| ATOM | 1986 | O | VAL | P | 10 | 3.182 | 8.476 | 36.329 | 1.00 | 48.47 | | O |
| ANISOU | 1986 | O | VAL | P | 10 | 5775 | 6107 | 6533 | 209 | −82 | −826 | O |
| ATOM | 1987 | CB | VAL | P | 10 | 3.116 | 10.523 | 33.922 | 0.88 | 37.28 | | C |

TABLE 14-continued

| | | | | | | | | | | | | |
|---|---|---|---|---|---|---|---|---|---|---|---|---|
| ANISOU | 1987 | CB | VAL | P | 10 | 4373 | 4654 | 5139 | 200 | −200 | −837 | C |
| ATOM | 1988 | CG1 | VAL | P | 10 | 3.935 | 11.294 | 32.924 | 1.00 | 33.34 | | C |
| ANISOU | 1988 | CG1 | VAL | P | 10 | 3911 | 4148 | 4608 | 187 | −249 | −840 | C |
| ATOM | 1989 | CG2 | VAL | P | 10 | 2.792 | 9.148 | 33.397 | 1.00 | 35.59 | | C |
| ANISOU | 1989 | CG2 | VAL | P | 10 | 4133 | 4444 | 4944 | 176 | −211 | −824 | C |
| ATOM | 1990 | OXT | VAL | P | 10 | 2.036 | 10.145 | 36.824 | 1.00 | 43.87 | | O |
| ANISOU | 1990 | OXT | VAL | P | 10 | 5172 | 5504 | 5993 | 254 | −63 | −837 | O |
| TER | 1992 | | VAL | P | 10 | | | | | | | |
| ATOM | 1991 | N | GLU | H | 1 | 33.717 | 4.451 | 43.899 | 1.00 | 66.33 | | N |
| ANISOU | 1991 | N | GLU | H | 1 | 7806 | 8966 | 8432 | 53 | −567 | −285 | N |
| ATOM | 1992 | CA | GLU | H | 1 | 33.398 | 5.781 | 44.418 | 1.00 | 61.27 | | C |
| ANISOU | 1992 | CA | GLU | H | 1 | 7206 | 8312 | 7761 | 3 | −630 | −333 | C |
| ATOM | 1993 | C | GLU | H | 1 | 32.061 | 5.826 | 45.201 | 1.00 | 53.49 | | C |
| ANISOU | 1993 | C | GLU | H | 1 | 6312 | 7309 | 6702 | 14 | −623 | −390 | C |
| ATOM | 1994 | O | GLU | H | 1 | 31.979 | 6.442 | 46.271 | 1.00 | 47.54 | | O |
| ANISOU | 1994 | O | GLU | H | 1 | 5600 | 6561 | 5902 | −7 | −686 | −417 | O |
| ATOM | 1995 | CB | GLU | H | 1 | 33.379 | 6.788 | 43.264 | 1.00 | 52.25 | | C |
| ANISOU | 1995 | CB | GLU | H | 1 | 6048 | 7142 | 6662 | −32 | −613 | −350 | C |
| ATOM | 1996 | CG | GLU | H | 1 | 33.825 | 8.164 | 43.661 | 1.00 | 65.24 | | C |
| ANISOU | 1996 | CG | GLU | H | 1 | 7692 | 8781 | 8315 | −93 | −694 | −369 | C |
| ATOM | 1997 | CD | GLU | H | 1 | 33.901 | 9.112 | 42.478 | 1.00 | 75.02 | | C |
| ANISOU | 1997 | CD | GLU | H | 1 | 8910 | 9991 | 9603 | −127 | −675 | −373 | C |
| ATOM | 1998 | OE1 | GLU | H | 1 | 32.837 | 9.657 | 42.096 | 1.00 | 80.52 | | O |
| ANISOU | 1998 | OE1 | GLU | H | 1 | 9664 | 10651 | 10277 | −130 | −647 | −422 | O |
| ATOM | 1999 | OE2 | GLU | H | 1 | 35.024 | 9.300 | 41.933 | 1.00 | 81.64 | | O |
| ANISOU | 1999 | OE2 | GLU | H | 1 | 9671 | 10844 | 10504 | −149 | −685 | −323 | O |
| ATOM | 2000 | N | VAL | H | 2 | 31.008 | 5.192 | 44.675 | 1.00 | 61.17 | | N |
| ANISOU | 2000 | N | VAL | H | 2 | 7317 | 8259 | 7664 | 48 | −546 | −408 | N |
| ATOM | 2001 | CA | VAL | H | 2 | 29.724 | 5.179 | 45.378 | 1.00 | 48.83 | | C |
| ANISOU | 2001 | CA | VAL | H | 2 | 5832 | 6681 | 6042 | 62 | −531 | −453 | C |
| ATOM | 2002 | C | VAL | H | 2 | 29.820 | 4.294 | 46.613 | 1.00 | 46.49 | | C |
| ANISOU | 2002 | C | VAL | H | 2 | 5554 | 6413 | 5698 | 91 | −546 | −428 | C |
| ATOM | 2003 | O | VAL | H | 2 | 30.245 | 3.135 | 46.533 | 1.00 | 51.87 | | O |
| ANISOU | 2003 | O | VAL | H | 2 | 6201 | 7109 | 6399 | 125 | −519 | −380 | O |
| ATOM | 2004 | CB | VAL | H | 2 | 28.599 | 4.719 | 44.437 | 1.00 | 50.69 | | C |
| ANISOU | 2004 | CB | VAL | H | 2 | 6088 | 6884 | 6289 | 86 | −450 | −474 | C |
| ATOM | 2005 | CG1 | VAL | H | 2 | 27.346 | 4.307 | 45.224 | 1.00 | 49.37 | | C |
| ANISOU | 2005 | CG1 | VAL | H | 2 | 5983 | 6707 | 6069 | 111 | −421 | −502 | C |
| ATOM | 2006 | CG2 | VAL | H | 2 | 28.235 | 5.852 | 43.492 | 1.00 | 55.15 | | C |
| ANISOU | 2006 | CG2 | VAL | H | 2 | 6658 | 7419 | 6879 | 55 | −447 | −510 | C |
| ATOM | 2007 | N | GLN | H | 3 | 29.417 | 4.830 | 47.770 | 1.00 | 45.23 | | N |
| ANISOU | 2007 | N | GLN | H | 3 | 5453 | 6259 | 5474 | 81 | −588 | −461 | N |
| ATOM | 2008 | CA | GLN | H | 3 | 29.355 | 4.034 | 48.987 | 1.00 | 48.61 | | C |
| ANISOU | 2008 | CA | GLN | H | 3 | 5912 | 6714 | 5844 | 111 | −599 | −439 | C |
| ATOM | 2009 | C | GLN | H | 3 | 28.019 | 4.183 | 49.701 | 1.00 | 48.27 | | C |
| ANISOU | 2009 | C | GLN | H | 3 | 5950 | 6656 | 5734 | 126 | −568 | −484 | C |
| ATOM | 2010 | O | GLN | H | 3 | 27.526 | 5.297 | 49.919 | 1.00 | 44.57 | | O |
| ANISOU | 2010 | O | GLN | H | 3 | 5526 | 6170 | 5238 | 102 | −588 | −539 | O |
| ATOM | 2011 | CB | GLN | H | 3 | 30.485 | 4.391 | 49.962 | 1.00 | 49.56 | | C |
| ANISOU | 2011 | CB | GLN | H | 3 | 6022 | 6871 | 5939 | 89 | −695 | −418 | C |
| ATOM | 2012 | CG | GLN | H | 3 | 31.824 | 3.947 | 49.422 | 1.00 | 65.01 | | C |
| ANISOU | 2012 | CG | GLN | H | 3 | 7887 | 8849 | 7963 | 87 | −718 | −357 | C |
| ATOM | 2013 | CD | GLN | H | 3 | 32.943 | 3.941 | 50.459 | 1.00 | 80.31 | | C |
| ANISOU | 2013 | CD | GLN | H | 3 | 9805 | 10830 | 9880 | 76 | −811 | −319 | C |
| ATOM | 2014 | OE1 | GLN | H | 3 | 32.751 | 3.551 | 51.619 | 1.00 | 83.32 | | O |
| ANISOU | 2014 | OE1 | GLN | H | 3 | 10235 | 11232 | 10190 | 95 | −837 | −314 | O |
| ATOM | 2015 | NE2 | GLN | H | 3 | 34.129 | 4.359 | 50.032 | 1.00 | 85.77 | | N |
| ANISOU | 2015 | NE2 | GLN | H | 3 | 10420 | 11534 | 10634 | 44 | −863 | −290 | N |
| ATOM | 2016 | N | LEU | H | 4 | 27.485 | 3.045 | 50.130 | 1.00 | 39.26 | | N |
| ANISOU | 2016 | N | LEU | H | 4 | 4827 | 5521 | 4569 | 166 | −518 | −458 | N |
| ATOM | 2017 | CA | LEU | H | 4 | 26.275 | 2.981 | 50.934 | 1.00 | 43.60 | | C |
| ANISOU | 2017 | CA | LEU | H | 4 | 5447 | 6063 | 5055 | 187 | −480 | −486 | C |
| ATOM | 2018 | C | LEU | H | 4 | 26.574 | 2.133 | 52.150 | 1.00 | 49.72 | | C |
| ANISOU | 2018 | C | LEU | H | 4 | 6246 | 6874 | 5772 | 215 | −496 | −442 | C |
| ATOM | 2019 | O | LEU | H | 4 | 26.901 | 0.954 | 52.007 | 1.00 | 55.59 | | O |
| ANISOU | 2019 | O | LEU | H | 4 | 6955 | 7625 | 6544 | 242 | −469 | −387 | O |
| ATOM | 2020 | CB | LEU | H | 4 | 25.125 | 2.375 | 50.134 | 1.00 | 42.98 | | C |
| ANISOU | 2020 | CB | LEU | H | 4 | 5366 | 5951 | 5013 | 207 | −391 | −492 | C |
| ATOM | 2021 | CG | LEU | H | 4 | 24.748 | 3.056 | 48.832 | 1.00 | 44.17 | | C |
| ANISOU | 2021 | CG | LEU | H | 4 | 5494 | 6067 | 5222 | 185 | −370 | −529 | C |
| ATOM | 2022 | CD1 | LEU | H | 4 | 23.719 | 2.157 | 48.125 | 1.00 | 48.68 | | C |
| ANISOU | 2022 | CD1 | LEU | H | 4 | 6058 | 6609 | 5828 | 208 | −290 | −524 | C |
| ATOM | 2023 | CD2 | LEU | H | 4 | 24.134 | 4.405 | 49.152 | 1.00 | 40.48 | | C |
| ANISOU | 2023 | CD2 | LEU | H | 4 | 5075 | 5586 | 4722 | 163 | −391 | −589 | C |
| ATOM | 2024 | N | LEU | H | 5 | 26.479 | 2.728 | 53.340 | 1.00 | 54.89 | | N |
| ANISOU | 2024 | N | LEU | H | 5 | 6964 | 7548 | 6345 | 211 | −539 | −466 | N |
| ATOM | 2025 | CA | LEU | H | 5 | 26.848 | 2.055 | 54.588 | 1.00 | 55.93 | | C |
| ANISOU | 2025 | CA | LEU | H | 5 | 7127 | 7718 | 6407 | 236 | −567 | −424 | C |
| ATOM | 2026 | C | LEU | H | 5 | 25.612 | 1.897 | 55.464 | 1.00 | 48.33 | | C |
| ANISOU | 2026 | C | LEU | H | 5 | 6241 | 6752 | 5368 | 265 | −509 | −442 | C |

TABLE 14-continued

| | | | | | | | | | | | | |
|---|---|---|---|---|---|---|---|---|---|---|---|---|
| ATOM | 2027 | O | LEU | H | 5 | 25.111 | 2.878 | 56.031 | 1.00 | 47.79 | | O |
| ANISOU | 2027 | O | LEU | H | 5 | 6236 | 6681 | 5239 | 255 | −523 | −498 | O |
| ATOM | 2028 | CB | LEU | H | 5 | 27.947 | 2.827 | 55.319 | 1.00 | 62.71 | | C |
| ANISOU | 2028 | CB | LEU | H | 5 | 7995 | 8609 | 7224 | 206 | −677 | −430 | C |
| ATOM | 2029 | CG | LEU | H | 5 | 29.171 | 3.155 | 54.445 | 1.00 | 78.24 | | C |
| ANISOU | 2029 | CG | LEU | H | 5 | 9877 | 10577 | 9272 | 172 | −735 | −413 | C |
| ATOM | 2030 | CD1 | LEU | H | 5 | 30.280 | 3.845 | 55.221 | 1.00 | 79.10 | | C |
| ANISOU | 2030 | CD1 | LEU | H | 5 | 9990 | 10717 | 9347 | 139 | −852 | −412 | C |
| ATOM | 2031 | CD2 | LEU | H | 5 | 29.724 | 1.927 | 53.705 | 1.00 | 77.99 | | C |
| ANISOU | 2031 | CD2 | LEU | H | 5 | 9767 | 10550 | 9316 | 198 | −698 | −343 | C |
| ATOM | 2032 | N | GLU | H | 6 | 25.106 | 0.677 | 55.572 | 1.00 | 45.14 | | N |
| ANISOU | 2032 | N | GLU | H | 6 | 5834 | 6347 | 4969 | 301 | −441 | −395 | N |
| ATOM | 2033 | CA | GLU | H | 6 | 23.971 | 0.486 | 56.460 | 1.00 | 48.44 | | C |
| ANISOU | 2033 | CA | GLU | H | 6 | 6321 | 6766 | 5317 | 329 | −382 | −402 | C |
| ATOM | 2034 | C | GLU | H | 6 | 24.454 | 0.380 | 57.897 | 1.00 | 48.61 | | C |
| ANISOU | 2034 | C | GLU | H | 6 | 6403 | 6834 | 5235 | 345 | −433 | −377 | C |
| ATOM | 2035 | O | GLU | H | 6 | 25.608 | 0.037 | 58.157 | 1.00 | 53.81 | | O |
| ANISOU | 2035 | O | GLU | H | 6 | 7035 | 7521 | 5890 | 343 | −502 | −334 | O |
| ATOM | 2036 | CB | GLU | H | 6 | 23.179 | −0.783 | 56.134 | 1.00 | 55.65 | | C |
| ANISOU | 2036 | CB | GLU | H | 6 | 7214 | 7659 | 6273 | 359 | −289 | −358 | C |
| ATOM | 2037 | CG | GLU | H | 6 | 22.487 | −0.820 | 54.797 | 1.00 | 61.27 | | C |
| ANISOU | 2037 | CG | GLU | H | 6 | 7879 | 8325 | 7077 | 348 | −232 | −382 | C |
| ATOM | 2038 | CD | GLU | H | 6 | 23.425 | −1.349 | 53.727 | 1.00 | 61.62 | | C |
| ANISOU | 2038 | CD | GLU | H | 6 | 7850 | 8359 | 7204 | 338 | −254 | −352 | C |
| ATOM | 2039 | OE1 | GLU | H | 6 | 24.647 | −1.250 | 53.968 | 1.00 | 58.76 | | O |
| ANISOU | 2039 | OE1 | GLU | H | 6 | 7469 | 8026 | 6832 | 332 | −324 | −330 | O |
| ATOM | 2040 | OE2 | GLU | H | 6 | 22.947 | −1.877 | 52.685 | 1.00 | 58.27 | | O |
| ANISOU | 2040 | OE2 | GLU | H | 6 | 7388 | 7898 | 6852 | 340 | −200 | −351 | O |
| ATOM | 2041 | N | SER | H | 7 | 23.552 | 0.685 | 58.831 | 1.00 | 51.80 | | N |
| ANISOU | 2041 | N | SER | H | 7 | 6886 | 7244 | 5552 | 364 | −397 | −403 | N |
| ATOM | 2042 | CA | SER | H | 7 | 23.805 | 0.419 | 60.240 | 1.00 | 53.74 | | C |
| ANISOU | 2042 | CA | SER | H | 7 | 7200 | 7532 | 5686 | 388 | −427 | −374 | C |
| ATOM | 2043 | C | SER | H | 7 | 22.495 | 0.344 | 60.998 | 1.00 | 52.50 | | C |
| ANISOU | 2043 | C | SER | H | 7 | 7116 | 7373 | 5459 | 421 | −338 | −385 | C |
| ATOM | 2044 | O | SER | H | 7 | 21.413 | 0.645 | 60.476 | 1.00 | 54.52 | | O |
| ANISOU | 2044 | O | SER | H | 7 | 7368 | 7595 | 5753 | 422 | −263 | −422 | O |
| ATOM | 2045 | CB | SER | H | 7 | 24.693 | 1.484 | 60.868 | 1.00 | 60.58 | | C |
| ANISOU | 2045 | CB | SER | H | 7 | 8108 | 8425 | 6485 | 361 | −539 | −415 | C |
| ATOM | 2046 | OG | SER | H | 7 | 24.115 | 2.751 | 60.678 | 1.00 | 64.26 | | O |
| ANISOU | 2046 | OG | SER | H | 7 | 8611 | 8864 | 6941 | 340 | −536 | −499 | O |
| ATOM | 2047 | N | GLY | H | 8 | 22.615 | −0.064 | 62.250 | 1.00 | 51.54 | | N |
| ANISOU | 2047 | N | GLY | H | 8 | 7059 | 7290 | 5233 | 449 | −349 | −349 | N |
| ATOM | 2048 | CA | GLY | H | 8 | 21.526 | −0.016 | 63.184 | 1.00 | 47.25 | | C |
| ANISOU | 2048 | CA | GLY | H | 8 | 6598 | 6755 | 4600 | 483 | −273 | −358 | C |
| ATOM | 2049 | C | GLY | H | 8 | 20.700 | −1.267 | 63.289 | 1.00 | 58.11 | | C |
| ANISOU | 2049 | C | GLY | H | 8 | 7959 | 8122 | 5996 | 518 | −167 | −289 | C |
| ATOM | 2050 | O | GLY | H | 8 | 19.647 | −1.229 | 63.930 | 1.00 | 59.67 | | O |
| ANISOU | 2050 | O | GLY | H | 8 | 8214 | 8322 | 6136 | 545 | −86 | −294 | O |
| ATOM | 2051 | N | GLY | H | 9 | 21.114 | −2.364 | 62.676 | 1.00 | 55.93 | | N |
| ANISOU | 2051 | N | GLY | H | 9 | 7611 | 7835 | 5804 | 517 | −161 | −224 | N |
| ATOM | 2052 | CA | GLY | H | 9 | 20.416 | −3.609 | 62.903 | 1.00 | 54.62 | | C |
| ANISOU | 2052 | CA | GLY | H | 9 | 7439 | 7660 | 5654 | 549 | −69 | −152 | C |
| ATOM | 2053 | C | GLY | H | 9 | 20.864 | −4.248 | 64.203 | 1.00 | 64.94 | | C |
| ANISOU | 2053 | C | GLY | H | 9 | 8806 | 9012 | 6854 | 581 | −90 | −85 | C |
| ATOM | 2054 | O | GLY | H | 9 | 21.763 | −3.769 | 64.898 | 1.00 | 68.33 | | O |
| ANISOU | 2054 | O | GLY | H | 9 | 9279 | 9482 | 7199 | 579 | −183 | −94 | O |
| ATOM | 2055 | N | GLY | H | 10 | 20.230 | −5.364 | 64.524 | 1.00 | 63.39 | | N |
| ANISOU | 2055 | N | GLY | H | 10 | 8613 | 8809 | 6665 | 610 | −5 | −14 | N |
| ATOM | 2056 | CA | GLY | H | 10 | 20.469 | −6.024 | 65.791 | 1.00 | 62.13 | | C |
| ANISOU | 2056 | CA | GLY | H | 10 | 8517 | 8690 | 6400 | 646 | −8 | 58 | C |
| ATOM | 2057 | C | GLY | H | 10 | 19.291 | −6.924 | 66.118 | 1.00 | 66.39 | | C |
| ANISOU | 2057 | C | GLY | H | 10 | 9069 | 9210 | 6946 | 674 | 119 | 116 | C |
| ATOM | 2058 | O | GLY | H | 10 | 18.460 | −7.212 | 65.259 | 1.00 | 58.11 | | O |
| ANISOU | 2058 | O | GLY | H | 10 | 7963 | 8113 | 6001 | 662 | 194 | 109 | O |
| ATOM | 2059 | N | LEU | H | 11 | 19.254 | −7.371 | 67.369 | 1.00 | 67.40 | | N |
| ANISOU | 2059 | N | LEU | H | 11 | 9271 | 9376 | 6961 | 710 | 137 | 176 | N |
| ATOM | 2060 | CA | LEU | H | 11 | 18.169 | −8.206 | 67.845 | 1.00 | 71.67 | | C |
| ANISOU | 2060 | CA | LEU | H | 11 | 9831 | 9905 | 7495 | 738 | 259 | 241 | C |
| ATOM | 2061 | C | LEU | H | 11 | 17.135 | −7.326 | 68.518 | 1.00 | 71.87 | | C |
| ANISOU | 2061 | C | LEU | H | 11 | 9930 | 9949 | 7430 | 753 | 328 | 190 | C |
| ATOM | 2062 | O | LEU | H | 11 | 17.484 | −6.350 | 69.188 | 1.00 | 73.06 | | O |
| ANISOU | 2062 | O | LEU | H | 11 | 10155 | 10139 | 7465 | 759 | 270 | 136 | O |
| ATOM | 2063 | CB | LEU | H | 11 | 18.655 | −9.284 | 68.817 | 1.00 | 76.95 | | C |
| ANISOU | 2063 | CB | LEU | H | 11 | 10539 | 10602 | 8095 | 773 | 253 | 348 | C |
| ATOM | 2064 | CG | LEU | H | 11 | 17.632 | −10.432 | 68.839 | 1.00 | 80.69 | | C |
| ANISOU | 2064 | CG | LEU | H | 11 | 10991 | 11039 | 8628 | 789 | 379 | 428 | C |
| ATOM | 2065 | CD1 | LEU | H | 11 | 18.328 | −11.774 | 68.615 | 1.00 | 81.66 | | C |
| ANISOU | 2065 | CD1 | LEU | H | 11 | 11066 | 11138 | 8822 | 796 | 358 | 522 | C |
| ATOM | 2066 | CD2 | LEU | H | 11 | 16.772 | −10.441 | 70.106 | 1.00 | 83.80 | | C |
| ANISOU | 2066 | CD2 | LEU | H | 11 | 11476 | 11468 | 8898 | 826 | 468 | 465 | C |

TABLE 14-continued

| | | | | | | | | | | | | |
|---|---|---|---|---|---|---|---|---|---|---|---|---|
| ATOM | 2067 | N | VAL | H | 12 | 15.867 | −7.677 | 68.333 | 1.00 | 64.81 | | N |
| ANISOU | 2067 | N | VAL | H | 12 | 9012 | 9023 | 6591 | 760 | 451 | 208 | N |
| ATOM | 2068 | CA | VAL | H | 12 | 14.752 | −6.891 | 68.839 | 1.00 | 70.29 | | C |
| ANISOU | 2068 | CA | VAL | H | 12 | 9759 | 9726 | 7221 | 778 | 536 | 163 | C |
| ATOM | 2069 | C | VAL | H | 12 | 13.615 | −7.851 | 69.152 | 1.00 | 71.42 | | C |
| ANISOU | 2069 | C | VAL | H | 12 | 9889 | 9852 | 7395 | 800 | 672 | 244 | C |
| ATOM | 2070 | O | VAL | H | 12 | 13.423 | −8.852 | 68.456 | 1.00 | 69.27 | | O |
| ANISOU | 2070 | O | VAL | H | 12 | 9539 | 9536 | 7245 | 783 | 704 | 299 | O |
| ATOM | 2071 | CB | VAL | H | 12 | 14.335 | −5.800 | 67.825 | 1.00 | 67.64 | | C |
| ANISOU | 2071 | CB | VAL | H | 12 | 9377 | 9359 | 6965 | 748 | 528 | 61 | C |
| ATOM | 2072 | CG1 | VAL | H | 12 | 14.246 | −6.390 | 66.455 | 1.00 | 66.29 | | C |
| ANISOU | 2072 | CG1 | VAL | H | 12 | 9094 | 9132 | 6961 | 712 | 532 | 70 | C |
| ATOM | 2073 | CG2 | VAL | H | 12 | 13.005 | −5.164 | 68.204 | 1.00 | 67.70 | | C |
| ANISOU | 2073 | CG2 | VAL | H | 12 | 9418 | 9365 | 6940 | 771 | 638 | 26 | C |
| ATOM | 2074 | N | GLN | H | 13 | 12.886 | −7.563 | 70.225 | 1.00 | 71.58 | | N |
| ANISOU | 2074 | N | GLN | H | 13 | 9990 | 9906 | 7302 | 838 | 752 | 254 | N |
| ATOM | 2075 | CA | GLN | H | 13 | 11.767 | −8.403 | 70.615 | 1.00 | 75.08 | | C |
| ANISOU | 2075 | CA | GLN | H | 13 | 10423 | 10336 | 7768 | 860 | 889 | 335 | C |
| ATOM | 2076 | C | GLN | H | 13 | 10.591 | −8.187 | 69.664 | 1.00 | 75.26 | | C |
| ANISOU | 2076 | C | GLN | H | 13 | 10360 | 10308 | 7927 | 837 | 971 | 300 | C |
| ATOM | 2077 | O | GLN | H | 13 | 10.440 | −7.103 | 69.093 | 1.00 | 77.04 | | O |
| ANISOU | 2077 | O | GLN | H | 13 | 10571 | 10524 | 8176 | 823 | 943 | 204 | O |
| ATOM | 2078 | CB | GLN | H | 13 | 11.345 | −8.080 | 72.046 | 1.00 | 80.50 | | C |
| ANISOU | 2078 | CB | GLN | H | 13 | 11225 | 11077 | 8286 | 911 | 956 | 353 | C |
| ATOM | 2079 | CG | GLN | H | 13 | 12.492 | −7.989 | 73.048 | 1.00 | 95.80 | | C |
| ANISOU | 2079 | CG | GLN | H | 13 | 13264 | 13072 | 10063 | 934 | 860 | 366 | C |
| ATOM | 2080 | CD | GLN | H | 13 | 13.064 | −6.574 | 73.202 | 1.00 | 109.42 | | C |
| ANISOU | 2080 | CD | GLN | H | 13 | 15055 | 14826 | 11693 | 931 | 764 | 251 | C |
| ATOM | 2081 | OE1 | GLN | H | 13 | 13.688 | −6.028 | 72.282 | 1.00 | 110.56 | | O |
| ANISOU | 2081 | OE1 | GLN | H | 13 | 15147 | 14948 | 11914 | 892 | 667 | 182 | O |
| ATOM | 2082 | NE2 | GLN | H | 13 | 12.860 | −5.982 | 74.381 | 1.00 | 114.61 | | N |
| ANISOU | 2082 | NE2 | GLN | H | 13 | 15833 | 15531 | 12182 | 973 | 791 | 232 | N |
| ATOM | 2083 | N | PRO | H | 14 | 9.731 | −9.193 | 69.485 | 1.00 | 76.54 | | N |
| ANISOU | 2083 | N | PRO | H | 14 | 10463 | 10435 | 8183 | 833 | 1071 | 377 | N |
| ATOM | 2084 | CA | PRO | H | 14 | 8.524 | −8.984 | 68.672 | 1.00 | 71.28 | | C |
| ANISOU | 2084 | CA | PRO | H | 14 | 9716 | 9725 | 7644 | 813 | 1150 | 349 | C |
| ATOM | 2085 | C | PRO | H | 14 | 7.676 | −7.852 | 69.242 | 1.00 | 75.86 | | C |
| ANISOU | 2085 | C | PRO | H | 14 | 10345 | 10333 | 8145 | 845 | 1220 | 292 | C |
| ATOM | 2086 | O | PRO | H | 14 | 7.639 | −7.621 | 70.452 | 1.00 | 81.69 | | O |
| ANISOU | 2086 | O | PRO | H | 14 | 11180 | 11121 | 8739 | 890 | 1261 | 310 | O |
| ATOM | 2087 | CB | PRO | H | 14 | 7.796 | −10.329 | 68.752 | 1.00 | 73.47 | | C |
| ANISOU | 2087 | CB | PRO | H | 14 | 9944 | 9969 | 8003 | 809 | 1248 | 459 | C |
| ATOM | 2088 | CG | PRO | H | 14 | 8.838 | −11.313 | 69.175 | 1.00 | 78.65 | | C |
| ANISOU | 2088 | CG | PRO | H | 14 | 10632 | 10635 | 8617 | 815 | 1192 | 534 | C |
| ATOM | 2089 | CD | PRO | H | 14 | 9.797 | −10.557 | 70.037 | 1.00 | 80.99 | | C |
| ANISOU | 2089 | CD | PRO | H | 14 | 11032 | 10996 | 8745 | 846 | 1114 | 497 | C |
| ATOM | 2090 | N | GLY | H | 15 | 6.994 | −7.138 | 68.350 | 1.00 | 74.95 | | N |
| ANISOU | 2090 | N | GLY | H | 15 | 10166 | 10186 | 8127 | 825 | 1235 | 223 | N |
| ATOM | 2091 | CA | GLY | H | 15 | 6.289 | −5.926 | 68.717 | 1.00 | 74.16 | | C |
| ANISOU | 2091 | CA | GLY | H | 15 | 10107 | 10105 | 7967 | 855 | 1287 | 154 | C |
| ATOM | 2092 | C | GLY | H | 15 | 7.179 | −4.729 | 68.969 | 1.00 | 73.83 | | C |
| ANISOU | 2092 | C | GLY | H | 15 | 10149 | 10094 | 7811 | 865 | 1187 | 59 | C |
| ATOM | 2093 | O | GLY | H | 15 | 6.661 | −3.627 | 69.189 | 1.00 | 74.04 | | O |
| ANISOU | 2093 | O | GLY | H | 15 | 10213 | 10129 | 7792 | 890 | 1219 | −11 | O |
| ATOM | 2094 | N | GLY | H | 16 | 8.496 | −4.900 | 68.921 | 1.00 | 75.50 | | N |
| ANISOU | 2094 | N | GLY | H | 16 | 10386 | 10318 | 7981 | 846 | 1066 | 55 | N |
| ATOM | 2095 | CA | GLY | H | 16 | 9.427 | −3.824 | 69.188 | 1.00 | 74.45 | | C |
| ANISOU | 2095 | CA | GLY | H | 16 | 10330 | 10213 | 7744 | 849 | 960 | −28 | C |
| ATOM | 2096 | C | GLY | H | 16 | 9.680 | −2.898 | 68.009 | 1.00 | 73.30 | | C |
| ANISOU | 2096 | C | GLY | H | 16 | 10129 | 10033 | 7688 | 810 | 881 | −122 | C |
| ATOM | 2097 | O | GLY | H | 16 | 8.920 | −2.828 | 67.037 | 1.00 | 63.11 | | O |
| ANISOU | 2097 | O | GLY | H | 16 | 8753 | 8700 | 6527 | 789 | 921 | −138 | O |
| ATOM | 2098 | N | SER | H | 17 | 10.790 | −2.177 | 68.111 | 1.00 | 75.10 | | N |
| ANISOU | 2098 | N | SER | H | 17 | 10410 | 10280 | 7844 | 798 | 763 | −180 | N |
| ATOM | 2099 | CA | SER | H | 17 | 11.050 | −1.043 | 67.243 | 1.00 | 73.71 | | C |
| ANISOU | 2099 | CA | SER | H | 17 | 10210 | 10078 | 7719 | 769 | 690 | −277 | C |
| ATOM | 2100 | C | SER | H | 17 | 12.547 | −0.941 | 66.972 | 1.00 | 71.25 | | C |
| ANISOU | 2100 | C | SER | H | 17 | 9902 | 9777 | 7393 | 734 | 545 | −295 | C |
| ATOM | 2101 | O | SER | H | 17 | 13.374 | −1.220 | 67.847 | 1.00 | 70.46 | | O |
| ANISOU | 2101 | O | SER | H | 17 | 9868 | 9718 | 7187 | 747 | 491 | −265 | O |
| ATOM | 2102 | CB | SER | H | 17 | 10.513 | 0.241 | 67.880 | 1.00 | 70.17 | | C |
| ANISOU | 2102 | CB | SER | H | 17 | 9846 | 9640 | 7178 | 802 | 722 | −356 | C |
| ATOM | 2103 | OG | SER | H | 17 | 11.150 | 1.372 | 67.336 | 1.00 | 75.95 | | O |
| ANISOU | 2103 | OG | SER | H | 17 | 10585 | 10355 | 7919 | 773 | 621 | −447 | O |
| ATOM | 2104 | N | LEU | H | 18 | 12.893 | −0.548 | 65.743 | 1.00 | 67.28 | | N |
| ANISOU | 2104 | N | LEU | H | 18 | 9325 | 9238 | 7000 | 692 | 482 | −339 | N |
| ATOM | 2105 | CA | LEU | H | 18 | 14.289 | −0.413 | 65.353 | 1.00 | 66.96 | | C |
| ANISOU | 2105 | CA | LEU | H | 18 | 9271 | 9204 | 6964 | 657 | 350 | −355 | C |
| ATOM | 2106 | C | LEU | H | 18 | 14.393 | 0.591 | 64.215 | 1.00 | 62.72 | | C |
| ANISOU | 2106 | C | LEU | H | 18 | 8686 | 8631 | 6514 | 620 | 300 | −434 | C |

TABLE 14-continued

| ATOM | 2107 | O | LEU | H | 18 | 13.528 | 0.636 | 63.338 | 1.00 | 57.94 | | O |
|---|---|---|---|---|---|---|---|---|---|---|---|---|
| ANISOU | 2107 | O | LEU | H | 18 | 8017 | 7988 | 6011 | 612 | 358 | −446 | O |
| ATOM | 2108 | CB | LEU | H | 18 | 14.867 | −1.760 | 64.926 | 1.00 | 68.48 | | C |
| ANISOU | 2108 | CB | LEU | H | 18 | 9397 | 9394 | 7227 | 643 | 332 | −271 | C |
| ATOM | 2109 | CG | LEU | H | 18 | 16.375 | −1.932 | 64.954 | 1.00 | 67.89 | | C |
| ANISOU | 2109 | CG | LEU | H | 18 | 9323 | 9343 | 7129 | 623 | 210 | −256 | C |
| ATOM | 2110 | CD1 | LEU | H | 18 | 16.927 | −1.632 | 66.344 | 1.00 | 69.75 | | C |
| ANISOU | 2110 | CD1 | LEU | H | 18 | 9664 | 9631 | 7205 | 648 | 163 | −254 | C |
| ATOM | 2111 | CD2 | LEU | H | 18 | 16.698 | −3.351 | 64.550 | 1.00 | 63.51 | | C |
| ANISOU | 2111 | CD2 | LEU | H | 18 | 8702 | 8778 | 6652 | 621 | 221 | −168 | C |
| ATOM | 2112 | N | ARG | H | 19 | 15.455 | 1.385 | 64.225 | 1.00 | 61.82 | | N |
| ANISOU | 2112 | N | ARG | H | 19 | 8602 | 8527 | 6360 | 597 | 188 | −483 | N |
| ATOM | 2113 | C | ARG | H | 19 | 16.958 | 2.049 | 62.445 | 1.00 | 59.03 | | C |
| ANISOU | 2113 | C | ARG | H | 19 | 8146 | 8140 | 6143 | 520 | 33 | −533 | C |
| ATOM | 2114 | O | ARG | H | 19 | 18.046 | 2.044 | 63.032 | 1.00 | 59.16 | | O |
| ANISOU | 2114 | O | ARG | H | 19 | 8196 | 8189 | 6093 | 512 | −53 | −522 | O |
| ATOM | 2115 | CA | AARG | H | 19 | 15.685 | 2.394 | 63.200 | 0.44 | 61.86 | | C |
| ANISOU | 2115 | CA | AARG | H | 19 | 8567 | 8497 | 6439 | 560 | 132 | −555 | C |
| ATOM | 2116 | CB | AARG | H | 19 | 15.794 | 3.791 | 63.812 | 0.44 | 64.36 | | C |
| ANISOU | 2116 | CB | AARG | H | 19 | 8972 | 8818 | 6665 | 563 | 88 | −639 | C |
| ATOM | 2117 | CG | AARG | H | 19 | 15.960 | 4.897 | 62.778 | 0.44 | 66.09 | | C |
| ANISOU | 2117 | CG | AARG | H | 19 | 9154 | 8996 | 6962 | 526 | 36 | −711 | C |
| ATOM | 2118 | CD | AARG | H | 19 | 16.246 | 6.239 | 63.430 | 0.44 | 69.31 | | C |
| ANISOU | 2118 | CD | AARG | H | 19 | 9654 | 9402 | 7279 | 525 | −23 | −793 | C |
| ATOM | 2119 | NE | AARG | H | 19 | 15.974 | 7.355 | 62.525 | 0.44 | 69.70 | | N |
| ANISOU | 2119 | NE | AARG | H | 19 | 9677 | 9402 | 7403 | 502 | −37 | −861 | N |
| ATOM | 2120 | CZ | AARG | H | 19 | 14.770 | 7.897 | 62.345 | 0.44 | 68.28 | | C |
| ANISOU | 2120 | CZ | AARG | H | 19 | 9504 | 9191 | 7249 | 528 | 49 | −898 | C |
| ATOM | 2121 | NH1 | AARG | H | 19 | 13.723 | 7.429 | 63.009 | 0.44 | 70.18 | | N |
| ANISOU | 2121 | NH1 | AARG | H | 19 | 9771 | 9445 | 7449 | 578 | 158 | −872 | N |
| ATOM | 2122 | NH2 | AARG | H | 19 | 14.612 | 8.912 | 61.505 | 0.44 | 62.50 | | N |
| ANISOU | 2122 | NH2 | AARG | H | 19 | 8748 | 8413 | 6587 | 507 | 28 | −955 | N |
| ATOM | 2123 | CA | BARG | H | 19 | 15.678 | 2.386 | 63.193 | 0.56 | 61.68 | | C |
| ANISOU | 2123 | CA | BARG | H | 19 | 8544 | 8475 | 6418 | 560 | 133 | −554 | C |
| ATOM | 2124 | CB | BARG | H | 19 | 15.752 | 3.791 | 63.786 | 0.56 | 64.17 | | C |
| ANISOU | 2124 | CB | BARG | H | 19 | 8946 | 8793 | 6644 | 564 | 91 | −639 | C |
| ATOM | 2125 | CG | BARG | H | 19 | 15.884 | 4.896 | 62.743 | 0.56 | 66.01 | | C |
| ANISOU | 2125 | CG | BARG | H | 19 | 9142 | 8984 | 6956 | 527 | 42 | −711 | C |
| ATOM | 2126 | CD | BARG | H | 19 | 15.151 | 6.144 | 63.205 | 0.56 | 68.96 | | C |
| ANISOU | 2126 | CD | BARG | H | 19 | 9591 | 9339 | 7273 | 549 | 72 | −790 | C |
| ATOM | 2127 | NE | BARG | H | 19 | 15.721 | 7.389 | 62.687 | 0.56 | 70.37 | | N |
| ANISOU | 2127 | NE | BARG | H | 19 | 9775 | 9487 | 7474 | 513 | −15 | −865 | N |
| ATOM | 2128 | CZ | BARG | H | 19 | 16.895 | 7.898 | 63.059 | 0.56 | 70.08 | | C |
| ANISOU | 2128 | CZ | BARG | H | 19 | 9781 | 9464 | 7381 | 484 | −129 | −893 | C |
| ATOM | 2129 | NH1 | BARG | H | 19 | 17.662 | 7.259 | 63.936 | 0.56 | 70.77 | | N |
| ANISOU | 2129 | NH1 | BARG | H | 19 | 9908 | 9599 | 7383 | 488 | −176 | −851 | N |
| ATOM | 2130 | NH2 | BARG | H | 19 | 17.311 | 9.049 | 62.547 | 0.56 | 68.90 | | N |
| ANISOU | 2130 | NH2 | BARG | H | 19 | 9634 | 9280 | 7264 | 448 | −200 | −958 | N |
| ATOM | 2131 | N | LEU | H | 20 | 16.828 | 1.784 | 61.150 | 1.00 | 52.16 | | N |
| ANISOU | 2131 | N | LEU | H | 20 | 7184 | 7234 | 5399 | 495 | 45 | −527 | N |
| ATOM | 2132 | CA | LEU | H | 20 | 17.985 | 1.540 | 60.307 | 1.00 | 54.65 | | C |
| ANISOU | 2132 | CA | LEU | H | 20 | 7437 | 7546 | 5783 | 460 | −37 | −511 | C |
| ATOM | 2133 | C | LEU | H | 20 | 18.420 | 2.829 | 59.632 | 1.00 | 52.47 | | C |
| ANISOU | 2133 | C | LEU | H | 20 | 7151 | 7249 | 5535 | 424 | −107 | −583 | C |
| ATOM | 2134 | O | LEU | H | 20 | 17.599 | 3.706 | 59.339 | 1.00 | 50.48 | | O |
| ANISOU | 2134 | O | LEU | H | 20 | 6911 | 6969 | 5300 | 424 | −72 | −640 | O |
| ATOM | 2135 | CB | LEU | H | 20 | 17.680 | 0.488 | 59.249 | 1.00 | 49.45 | | C |
| ANISOU | 2135 | CB | LEU | H | 20 | 6691 | 6859 | 5238 | 454 | 12 | −463 | C |
| ATOM | 2136 | CG | LEU | H | 20 | 17.053 | −0.837 | 59.653 | 1.00 | 48.14 | | C |
| ANISOU | 2136 | CG | LEU | H | 20 | 6518 | 6695 | 5076 | 483 | 94 | −390 | C |
| ATOM | 2137 | CD1 | LEU | H | 20 | 16.890 | −1.672 | 58.413 | 1.00 | 46.63 | | C |
| ANISOU | 2137 | CD1 | LEU | H | 20 | 6242 | 6466 | 5009 | 467 | 121 | −362 | C |
| ATOM | 2138 | CD2 | LEU | H | 20 | 17.904 | −1.558 | 60.686 | 1.00 | 55.08 | | C |
| ANISOU | 2138 | CD2 | LEU | H | 20 | 7435 | 7616 | 5875 | 502 | 58 | −330 | C |
| ATOM | 2139 | N | SER | H | 21 | 19.712 | 2.913 | 59.347 | 1.00 | 48.34 | | N |
| ANISOU | 2139 | N | SER | H | 21 | 6600 | 6738 | 5027 | 394 | −202 | −576 | N |
| ATOM | 2140 | CA | SER | H | 21 | 20.327 | 4.077 | 58.726 | 1.00 | 55.99 | | C |
| ANISOU | 2140 | CA | SER | H | 21 | 7555 | 7689 | 6028 | 354 | −278 | −634 | C |
| ATOM | 2141 | C | SER | H | 21 | 21.220 | 3.638 | 57.579 | 1.00 | 54.08 | | C |
| ANISOU | 2141 | C | SER | H | 21 | 7222 | 7439 | 5885 | 325 | −317 | −601 | C |
| ATOM | 2142 | O | SER | H | 21 | 21.746 | 2.525 | 57.565 | 1.00 | 54.64 | | O |
| ANISOU | 2142 | O | SER | H | 21 | 7257 | 7529 | 5975 | 335 | −318 | −536 | O |
| ATOM | 2143 | CB | SER | H | 21 | 21.185 | 4.882 | 59.718 | 1.00 | 60.69 | | C |
| ANISOU | 2143 | CB | SER | H | 21 | 8220 | 8312 | 6527 | 342 | −373 | −666 | C |
| ATOM | 2144 | OG | SER | H | 21 | 20.398 | 5.389 | 60.779 | 1.00 | 80.73 | | O |
| ANISOU | 2144 | OG | SER | H | 21 | 10854 | 10856 | 8964 | 371 | −337 | −706 | O |
| ATOM | 2145 | N | CYS | H | 22 | 21.412 | 4.530 | 56.627 | 1.00 | 49.94 | | N |
| ANISOU | 2145 | N | CYS | H | 22 | 6665 | 6886 | 5423 | 291 | −349 | −645 | N |
| ATOM | 2146 | CA | CYS | H | 22 | 22.329 | 4.229 | 55.541 | 1.00 | 48.39 | | C |
| ANISOU | 2146 | CA | CYS | H | 22 | 6387 | 6684 | 5314 | 264 | −386 | −616 | C |

TABLE 14-continued

| | | | | | | | | | | | | |
|---|---|---|---|---|---|---|---|---|---|---|---|---|
| ATOM | 2147 | C | CYS | H | 22 | 23.014 | 5.523 | 55.139 | 1.00 | 49.95 | | C |
| ANISOU | 2147 | C | CYS | H | 22 | 6580 | 6869 | 5530 | 222 | −463 | −665 | C |
| ATOM | 2148 | O | CYS | H | 22 | 22.330 | 6.471 | 54.745 | 1.00 | 55.81 | | O |
| ANISOU | 2148 | O | CYS | H | 22 | 7340 | 7577 | 6288 | 211 | −445 | −719 | O |
| ATOM | 2149 | CB | CYS | H | 22 | 21.565 | 3.597 | 54.381 | 1.00 | 55.62 | | C |
| ANISOU | 2149 | CB | CYS | H | 22 | 7247 | 7568 | 6318 | 272 | −308 | −601 | C |
| ATOM | 2150 | SG | CYS | H | 22 | 22.429 | 3.440 | 52.848 | 1.00 | 67.34 | | S |
| ANISOU | 2150 | SG | CYS | H | 22 | 8642 | 9036 | 7908 | 243 | −335 | −583 | S |
| ATOM | 2151 | N | ALA | H | 23 | 24.339 | 5.578 | 55.293 | 1.00 | 49.23 | | N |
| ANISOU | 2151 | N | ALA | H | 23 | 6465 | 6803 | 5438 | 197 | −550 | −642 | N |
| ATOM | 2152 | CA | ALA | H | 23 | 25.142 | 6.748 | 54.951 | 1.00 | 50.48 | | C |
| ANISOU | 2152 | CA | ALA | H | 23 | 6610 | 6949 | 5621 | 150 | −631 | −678 | C |
| ATOM | 2153 | C | ALA | H | 23 | 25.618 | 6.619 | 53.511 | 1.00 | 53.71 | | C |
| ANISOU | 2153 | C | ALA | H | 23 | 6930 | 7341 | 6138 | 128 | −624 | −654 | C |
| ATOM | 2154 | O | ALA | H | 23 | 26.270 | 5.625 | 53.168 | 1.00 | 52.35 | | O |
| ANISOU | 2154 | O | ALA | H | 23 | 6699 | 7189 | 6005 | 137 | −620 | −595 | O |
| ATOM | 2155 | CB | ALA | H | 23 | 26.364 | 6.883 | 55.868 | 1.00 | 45.58 | | C |
| ANISOU | 2155 | CB | ALA | H | 23 | 6004 | 6367 | 4950 | 131 | −735 | −662 | C |
| ATOM | 2156 | N | ALA | H | 24 | 25.340 | 7.635 | 52.684 | 1.00 | 47.87 | | N |
| ANISOU | 2156 | N | ALA | H | 24 | 6183 | 6563 | 5444 | 101 | −623 | −699 | N |
| ATOM | 2157 | CA | ALA | H | 24 | 25.693 | 7.584 | 51.271 | 1.00 | 44.18 | | C |
| ANISOU | 2157 | CA | ALA | H | 24 | 5639 | 6078 | 5071 | 82 | −608 | −679 | C |
| ATOM | 2158 | C | ALA | H | 24 | 26.750 | 8.622 | 50.916 | 1.00 | 47.82 | | C |
| ANISOU | 2158 | C | ALA | H | 24 | 6071 | 6532 | 5568 | 31 | −688 | −690 | C |
| ATOM | 2159 | O | ALA | H | 24 | 26.807 | 9.703 | 51.509 | 1.00 | 44.67 | | O |
| ANISOU | 2159 | O | ALA | H | 24 | 5721 | 6120 | 5133 | 5 | −743 | −736 | O |
| ATOM | 2160 | CB | ALA | H | 24 | 24.444 | 7.806 | 50.399 | 1.00 | 45.33 | | C |
| ANISOU | 2160 | CB | ALA | H | 24 | 5790 | 6183 | 5252 | 93 | −533 | −710 | C |
| ATOM | 2161 | N | SER | H | 25 | 27.557 | 8.300 | 49.903 | 1.00 | 46.23 | | N |
| ANISOU | 2161 | N | SER | H | 25 | 5790 | 6334 | 5441 | 17 | −690 | −647 | N |
| ATOM | 2162 | CA | SER | H | 25 | 28.550 | 9.224 | 49.379 | 1.00 | 40.42 | | C |
| ANISOU | 2162 | CA | SER | H | 25 | 5012 | 5589 | 4755 | −33 | −753 | −646 | C |
| ATOM | 2163 | C | SER | H | 25 | 28.950 | 8.813 | 47.969 | 1.00 | 39.55 | | C |
| ANISOU | 2163 | C | SER | H | 25 | 4823 | 5474 | 4729 | −35 | −711 | −605 | C |
| ATOM | 2164 | O | SER | H | 25 | 28.824 | 7.652 | 47.572 | 1.00 | 48.18 | | O |
| ANISOU | 2164 | O | SER | H | 25 | 5888 | 6581 | 5839 | 2 | −653 | −568 | O |
| ATOM | 2165 | CB | SER | H | 25 | 29.792 | 9.257 | 50.280 | 1.00 | 53.44 | | C |
| ANISOU | 2165 | CB | SER | H | 25 | 6646 | 7275 | 6384 | −56 | −846 | −620 | C |
| ATOM | 2166 | OG | SER | H | 25 | 30.337 | 7.958 | 50.362 | 1.00 | 60.80 | | O |
| ANISOU | 2166 | OG | SER | H | 25 | 7530 | 8245 | 7325 | −25 | −830 | −556 | O |
| ATOM | 2167 | N | GLY | H | 26 | 29.508 | 9.763 | 47.240 | 1.00 | 46.80 | | N |
| ANISOU | 2167 | N | GLY | H | 26 | 5708 | 6373 | 5699 | −77 | −742 | −609 | N |
| ATOM | 2168 | CA | GLY | H | 26 | 30.030 | 9.470 | 45.929 | 1.00 | 43.06 | | C |
| ANISOU | 2168 | CA | GLY | H | 26 | 5162 | 5899 | 5299 | −81 | −706 | −568 | C |
| ATOM | 2169 | C | GLY | H | 26 | 29.057 | 9.714 | 44.812 | 1.00 | 47.24 | | C |
| ANISOU | 2169 | C | GLY | H | 26 | 5705 | 6391 | 5852 | −72 | −640 | −592 | C |
| ATOM | 2170 | O | GLY | H | 26 | 29.364 | 9.383 | 43.669 | 1.00 | 50.87 | | O |
| ANISOU | 2170 | O | GLY | H | 26 | 6116 | 6850 | 6363 | −68 | −600 | −560 | O |
| ATOM | 2171 | N | PHE | H | 27 | 27.880 | 10.256 | 45.114 | 1.00 | 52.66 | | N |
| ANISOU | 2171 | N | PHE | H | 27 | 6458 | 7049 | 6502 | −66 | −625 | −647 | N |
| ATOM | 2172 | CA | PHE | H | 27 | 26.883 | 10.605 | 44.106 | 1.00 | 52.81 | | C |
| ANISOU | 2172 | CA | PHE | H | 27 | 6492 | 7031 | 6544 | −60 | −572 | −671 | C |
| ATOM | 2173 | C | PHE | H | 27 | 26.025 | 11.720 | 44.674 | 1.00 | 49.16 | | C |
| ANISOU | 2173 | C | PHE | H | 27 | 6096 | 6534 | 6050 | −70 | −592 | −732 | C |
| ATOM | 2174 | O | PHE | H | 27 | 26.086 | 12.035 | 45.862 | 1.00 | 49.09 | | O |
| ANISOU | 2174 | O | PHE | H | 27 | 6130 | 6532 | 5992 | −74 | −635 | −757 | O |
| ATOM | 2175 | CB | PHE | H | 27 | 26.005 | 9.403 | 43.702 | 1.00 | 48.63 | | C |
| ANISOU | 2175 | CB | PHE | H | 27 | 5964 | 6505 | 6009 | −13 | −496 | −661 | C |
| ATOM | 2176 | CG | PHE | H | 27 | 25.226 | 8.812 | 44.837 | 1.00 | 46.39 | | C |
| ANISOU | 2176 | CG | PHE | H | 27 | 5726 | 6231 | 5668 | 18 | −480 | −678 | C |
| ATOM | 2177 | CD1 | PHE | H | 27 | 25.806 | 7.921 | 45.709 | 1.00 | 43.88 | | C |
| ANISOU | 2177 | CD1 | PHE | H | 27 | 5401 | 5949 | 5322 | 35 | −493 | −646 | C |
| ATOM | 2178 | CD2 | PHE | H | 27 | 23.887 | 9.122 | 45.009 | 1.00 | 48.57 | | C |
| ANISOU | 2178 | CD2 | PHE | H | 27 | 6051 | 6481 | 5922 | 34 | −446 | −721 | C |
| ATOM | 2179 | CE1 | PHE | H | 27 | 25.076 | 7.356 | 46.766 | 1.00 | 42.73 | | C |
| ANISOU | 2179 | CE1 | PHE | H | 27 | 5301 | 5814 | 5119 | 66 | −472 | −655 | C |
| ATOM | 2180 | CE2 | PHE | H | 27 | 23.153 | 8.566 | 46.049 | 1.00 | 42.76 | | C |
| ANISOU | 2180 | CE2 | PHE | H | 27 | 5356 | 5756 | 5135 | 65 | −421 | −731 | C |
| ATOM | 2181 | CZ | PHE | H | 27 | 23.752 | 7.692 | 46.934 | 1.00 | 43.25 | | C |
| ANISOU | 2181 | CZ | PHE | H | 27 | 5416 | 5855 | 5163 | 80 | −434 | −698 | C |
| ATOM | 2182 | N | THR | H | 28 | 25.210 | 12.316 | 43.819 | 1.00 | 54.37 | | N |
| ANISOU | 2182 | N | THR | H | 28 | 6767 | 7156 | 6734 | −71 | −560 | −755 | N |
| ATOM | 2183 | CA | THR | H | 28 | 24.367 | 13.415 | 44.268 | 1.00 | 53.04 | | C |
| ANISOU | 2183 | CA | THR | H | 28 | 6660 | 6949 | 6544 | −75 | −573 | −812 | C |
| ATOM | 2184 | C | THR | H | 28 | 23.156 | 12.822 | 44.966 | 1.00 | 45.59 | | C |
| ANISOU | 2184 | C | THR | H | 28 | 5760 | 6010 | 5553 | −30 | −525 | −836 | C |
| ATOM | 2185 | O | THR | H | 28 | 22.170 | 12.420 | 44.331 | 1.00 | 44.36 | | O |
| ANISOU | 2185 | O | THR | H | 28 | 5599 | 5842 | 5413 | −3 | −467 | −837 | O |
| ATOM | 2186 | CB | THR | H | 28 | 24.018 | 14.316 | 43.094 | 1.00 | 56.33 | | C |
| ANISOU | 2186 | CB | THR | H | 28 | 7069 | 7324 | 7010 | −93 | −563 | −820 | C |

TABLE 14-continued

| | | | | | | | | | | | | |
|---|---|---|---|---|---|---|---|---|---|---|---|---|
| ATOM | 2187 | OG1 | THR | H | 28 | 25.244 | 14.827 | 42.563 | 1.00 | 49.12 | | O |
| ANISOU | 2187 | OG1 | THR | H | 28 | 6113 | 6410 | 6140 | −137 | −606 | −790 | O |
| ATOM | 2188 | CG2 | THR | H | 28 | 23.196 | 15.494 | 43.572 | 1.00 | 63.03 | | C |
| ANISOU | 2188 | CG2 | THR | H | 28 | 7979 | 8127 | 7842 | −94 | −577 | −878 | C |
| ATOM | 2189 | N | PHE | H | 29 | 23.247 | 12.743 | 46.292 | 1.00 | 39.09 | | N |
| ANISOU | 2189 | N | PHE | H | 29 | 4979 | 5205 | 4670 | −21 | −550 | −854 | N |
| ATOM | 2190 | CA | PHE | H | 29 | 22.241 | 12.038 | 47.073 | 1.00 | 41.20 | | C |
| ANISOU | 2190 | CA | PHE | H | 29 | 5283 | 5484 | 4888 | 23 | −499 | −865 | C |
| ATOM | 2191 | C | PHE | H | 29 | 20.826 | 12.489 | 46.723 | 1.00 | 45.84 | | C |
| ANISOU | 2191 | C | PHE | H | 29 | 5896 | 6034 | 5486 | 46 | −447 | −901 | C |
| ATOM | 2192 | O | PHE | H | 29 | 19.942 | 11.652 | 46.545 | 1.00 | 42.06 | | O |
| ANISOU | 2192 | O | PHE | H | 29 | 5406 | 5561 | 5012 | 78 | −385 | −888 | O |
| ATOM | 2193 | CB | PHE | H | 29 | 22.503 | 12.254 | 48.551 | 1.00 | 38.78 | | C |
| ANISOU | 2193 | CB | PHE | H | 29 | 5032 | 5194 | 4506 | 26 | −540 | −889 | C |
| ATOM | 2194 | CG | PHE | H | 29 | 21.672 | 11.412 | 49.456 | 1.00 | 38.58 | | C |
| ANISOU | 2194 | CG | PHE | H | 29 | 5043 | 5191 | 4423 | 72 | −488 | −888 | C |
| ATOM | 2195 | CD1 | PHE | H | 29 | 21.830 | 10.054 | 49.485 | 1.00 | 37.44 | | C |
| ANISOU | 2195 | CD1 | PHE | H | 29 | 4865 | 5081 | 4278 | 93 | −457 | −837 | C |
| ATOM | 2196 | CD2 | PHE | H | 29 | 20.741 | 11.999 | 50.317 | 1.00 | 38.01 | | C |
| ANISOU | 2196 | CD2 | PHE | H | 29 | 5042 | 5102 | 4298 | 95 | −467 | −937 | C |
| ATOM | 2197 | CE1 | PHE | H | 29 | 21.088 | 9.264 | 50.344 | 1.00 | 36.56 | | C |
| ANISOU | 2197 | CE1 | PHE | H | 29 | 4786 | 4989 | 4116 | 132 | −407 | −829 | C |
| ATOM | 2198 | CE2 | PHE | H | 29 | 20.007 | 11.228 | 51.162 | 1.00 | 45.68 | | C |
| ANISOU | 2198 | CE2 | PHE | H | 29 | 6045 | 6096 | 5217 | 137 | −413 | −930 | C |
| ATOM | 2199 | CZ | PHE | H | 29 | 20.174 | 9.855 | 51.189 | 1.00 | 41.57 | | C |
| ANISOU | 2199 | CZ | PHE | H | 29 | 5487 | 5611 | 4697 | 154 | −384 | −874 | C |
| ATOM | 2200 | N | SER | H | 30 | 20.597 | 13.802 | 46.621 | 1.00 | 43.21 | | N |
| ANISOU | 2200 | N | SER | H | 30 | 5594 | 5660 | 5164 | 30 | −471 | −943 | N |
| ATOM | 2201 | CA | SER | H | 30 | 19.246 | 14.349 | 46.563 | 1.00 | 49.11 | | C |
| ANISOU | 2201 | CA | SER | H | 30 | 6374 | 6372 | 5915 | 57 | −427 | −981 | C |
| ATOM | 2202 | C | SER | H | 30 | 18.595 | 14.207 | 45.196 | 1.00 | 50.48 | | C |
| ANISOU | 2202 | C | SER | H | 30 | 6502 | 6526 | 6153 | 62 | −388 | −962 | C |
| ATOM | 2203 | O | SER | H | 30 | 17.403 | 14.496 | 45.068 | 1.00 | 44.92 | | O |
| ANISOU | 2203 | O | SER | H | 30 | 5811 | 5795 | 5459 | 89 | −347 | −985 | O |
| ATOM | 2204 | CB | SER | H | 30 | 19.253 | 15.833 | 46.935 | 1.00 | 54.72 | | C |
| ANISOU | 2204 | CB | SER | H | 30 | 7137 | 7039 | 6616 | 41 | −468 | −1033 | C |
| ATOM | 2205 | OG | SER | H | 30 | 19.986 | 16.562 | 45.960 | 1.00 | 58.57 | | O |
| ANISOU | 2205 | OG | SER | H | 30 | 7593 | 7500 | 7159 | −2 | −513 | −1022 | O |
| ATOM | 2206 | N | SER | H | 31 | 19.346 | 13.822 | 44.170 | 1.00 | 43.48 | | N |
| ANISOU | 2206 | N | SER | H | 31 | 5564 | 5651 | 5308 | 38 | −401 | −923 | N |
| ATOM | 2207 | CA | SER | H | 31 | 18.779 | 13.572 | 42.861 | 1.00 | 40.97 | | C |
| ANISOU | 2207 | CA | SER | H | 31 | 5208 | 5318 | 5039 | 44 | −367 | −904 | C |
| ATOM | 2208 | C | SER | H | 31 | 18.585 | 12.079 | 42.613 | 1.00 | 40.37 | | C |
| ANISOU | 2208 | C | SER | H | 31 | 5100 | 5273 | 4965 | 65 | −324 | −870 | C |
| ATOM | 2209 | O | SER | H | 31 | 18.324 | 11.674 | 41.481 | 1.00 | 42.33 | | O |
| ANISOU | 2209 | O | SER | H | 31 | 5317 | 5516 | 5250 | 66 | −303 | −850 | O |
| ATOM | 2210 | CB | SER | H | 31 | 19.666 | 14.178 | 41.780 | 1.00 | 46.66 | | C |
| ANISOU | 2210 | CB | SER | H | 31 | 5900 | 6026 | 5801 | 6 | −403 | −884 | C |
| ATOM | 2211 | OG | SER | H | 31 | 20.823 | 13.359 | 41.631 | 1.00 | 50.71 | | O |
| ANISOU | 2211 | OG | SER | H | 31 | 6375 | 6576 | 6316 | −8 | −414 | −843 | O |
| ATOM | 2212 | N | HIS | H | 32 | 18.685 | 11.260 | 43.647 | 1.00 | 38.44 | | N |
| ANISOU | 2212 | N | HIS | H | 32 | 4866 | 5059 | 4679 | 83 | −311 | −862 | N |
| ATOM | 2213 | CA | HIS | H | 32 | 18.575 | 9.820 | 43.529 | 1.00 | 36.81 | | C |
| ANISOU | 2213 | CA | HIS | H | 32 | 4634 | 4878 | 4476 | 102 | −272 | −827 | C |
| ATOM | 2214 | C | HIS | H | 32 | 17.497 | 9.323 | 44.468 | 1.00 | 43.05 | | C |
| ANISOU | 2214 | C | HIS | H | 32 | 5450 | 5672 | 5237 | 135 | −227 | −837 | C |
| ATOM | 2215 | O | HIS | H | 32 | 17.441 | 9.752 | 45.624 | 1.00 | 40.77 | | O |
| ANISOU | 2215 | O | HIS | H | 32 | 5201 | 5389 | 4899 | 144 | −235 | −859 | O |
| ATOM | 2216 | CB | HIS | H | 32 | 19.869 | 9.120 | 43.903 | 1.00 | 37.55 | | C |
| ANISOU | 2216 | CB | HIS | H | 32 | 4708 | 5006 | 4551 | 94 | −298 | −792 | C |
| ATOM | 2217 | CG | HIS | H | 32 | 20.906 | 9.172 | 42.828 | 1.00 | 42.69 | | C |
| ANISOU | 2217 | CG | HIS | H | 32 | 5318 | 5660 | 5242 | 68 | −322 | −766 | C |
| ATOM | 2218 | ND1 | HIS | H | 32 | 21.479 | 10.353 | 42.406 | 1.00 | 44.30 | | N |
| ANISOU | 2218 | ND1 | HIS | H | 32 | 5519 | 5848 | 5465 | 36 | −364 | −777 | N |
| ATOM | 2219 | CD2 | HIS | H | 32 | 21.432 | 8.199 | 42.054 | 1.00 | 41.28 | | C |
| ANISOU | 2219 | CD2 | HIS | H | 32 | 5100 | 5496 | 5090 | 73 | −303 | −728 | C |
| ATOM | 2220 | CE1 | HIS | H | 32 | 22.351 | 10.097 | 41.444 | 1.00 | 44.57 | | C |
| ANISOU | 2220 | CE1 | HIS | H | 32 | 5510 | 5891 | 5533 | 21 | −368 | −742 | C |
| ATOM | 2221 | NE2 | HIS | H | 32 | 22.339 | 8.799 | 41.209 | 1.00 | 45.16 | | N |
| ANISOU | 2221 | NE2 | HIS | H | 32 | 5564 | 5985 | 5611 | 46 | −330 | −715 | N |
| ATOM | 2222 | N | ALA | H | 33 | 16.659 | 8.407 | 43.965 | 1.00 | 34.23 | | N |
| ANISOU | 2222 | N | ALA | H | 33 | 4308 | 4549 | 4147 | 153 | −180 | −821 | N |
| ATOM | 2223 | CA | ALA | H | 33 | 15.775 | 7.642 | 44.823 | 1.00 | 38.50 | | C |
| ANISOU | 2223 | CA | ALA | H | 33 | 4861 | 5099 | 4668 | 182 | −130 | −814 | C |
| ATOM | 2224 | C | ALA | H | 33 | 16.572 | 6.626 | 45.608 | 1.00 | 33.26 | | C |
| ANISOU | 2224 | C | ALA | H | 33 | 4200 | 4470 | 3969 | 189 | −131 | −780 | C |
| ATOM | 2225 | O | ALA | H | 33 | 17.588 | 6.119 | 45.151 | 1.00 | 37.67 | | O |
| ANISOU | 2225 | O | ALA | H | 33 | 4733 | 5041 | 4539 | 176 | −154 | −753 | O |
| ATOM | 2226 | CB | ALA | H | 33 | 14.708 | 6.899 | 44.017 | 1.00 | 33.15 | | C |
| ANISOU | 2226 | CB | ALA | H | 33 | 4151 | 4404 | 4042 | 191 | −86 | −802 | C |

TABLE 14-continued

| | | | | | | | | | | | | |
|---|---|---|---|---|---|---|---|---|---|---|---|---|
| ATOM | 2227 | N | MET | H | 34 | 16.074 | 6.313 | 46.788 | 1.00 | 35.66 | | N |
| ANISOU | 2227 | N | MET | H | 34 | 4533 | 4787 | 4228 | 213 | −100 | −778 | N |
| ATOM | 2228 | CA | MET | H | 34 | 16.724 | 5.397 | 47.695 | 1.00 | 31.21 | | C |
| ANISOU | 2228 | CA | MET | H | 34 | 3980 | 4256 | 3621 | 224 | −100 | −743 | C |
| ATOM | 2229 | C | MET | H | 34 | 15.719 | 4.337 | 48.083 | 1.00 | 39.34 | | C |
| ANISOU | 2229 | C | MET | H | 34 | 5006 | 5285 | 4656 | 251 | −33 | −717 | C |
| ATOM | 2230 | O | MET | H | 34 | 14.516 | 4.605 | 48.217 | 1.00 | 39.61 | | O |
| ANISOU | 2230 | O | MET | H | 34 | 5047 | 5303 | 4700 | 265 | 11 | −734 | O |
| ATOM | 2231 | CB | MET | H | 34 | 17.260 | 6.125 | 48.937 | 1.00 | 33.41 | | C |
| ANISOU | 2231 | CB | MET | H | 34 | 4312 | 4558 | 3827 | 227 | −136 | −762 | C |
| ATOM | 2232 | CG | MET | H | 34 | 18.248 | 7.227 | 48.664 | 1.00 | 44.11 | | C |
| ANISOU | 2232 | CG | MET | H | 34 | 5671 | 5909 | 5180 | 195 | −207 | −788 | C |
| ATOM | 2233 | SD | MET | H | 34 | 19.801 | 6.585 | 47.942 | 1.00 | 41.24 | | S |
| ANISOU | 2233 | SD | MET | H | 34 | 5253 | 5566 | 4851 | 171 | −255 | −742 | S |
| ATOM | 2234 | CE | MET | H | 34 | 20.240 | 5.360 | 49.161 | 1.00 | 36.42 | | C |
| ANISOU | 2234 | CE | MET | H | 34 | 4656 | 4996 | 4185 | 196 | −248 | −696 | C |
| ATOM | 2235 | N | SER | H | 35 | 16.210 | 3.129 | 48.242 | 1.00 | 38.07 | | N |
| ANISOU | 2235 | N | SER | H | 35 | 4830 | 5140 | 4495 | 257 | −24 | −671 | N |
| ATOM | 2236 | CA | SER | H | 35 | 15.337 | 2.026 | 48.545 | 1.00 | 35.31 | | C |
| ANISOU | 2236 | CA | SER | H | 35 | 4473 | 4784 | 4159 | 277 | 38 | −639 | C |
| ATOM | 2237 | C | SER | H | 35 | 15.963 | 1.140 | 49.604 | 1.00 | 40.23 | | C |
| ANISOU | 2237 | C | SER | H | 35 | 5116 | 5438 | 4732 | 295 | 42 | −595 | C |
| ATOM | 2238 | O | SER | H | 35 | 17.184 | 1.150 | 49.853 | 1.00 | 37.00 | | O |
| ANISOU | 2238 | O | SER | H | 35 | 4712 | 5053 | 4293 | 290 | −8 | −582 | O |
| ATOM | 2239 | CB | SER | H | 35 | 15.019 | 1.169 | 47.297 | 1.00 | 42.20 | | C |
| ANISOU | 2239 | CB | SER | H | 35 | 5299 | 5627 | 5109 | 267 | 57 | −624 | C |
| ATOM | 2240 | OG | SER | H | 35 | 14.435 | 1.930 | 46.258 | 1.00 | 39.16 | | O |
| ANISOU | 2240 | OG | SER | H | 35 | 4895 | 5215 | 4767 | 251 | 49 | −660 | O |
| ATOM | 2241 | N | TRP | H | 36 | 15.074 | 0.378 | 50.214 | 1.00 | 37.63 | | N |
| ANISOU | 2241 | N | TRP | H | 36 | 4793 | 5105 | 4398 | 316 | 103 | −567 | N |
| ATOM | 2242 | CA | TRP | H | 36 | 15.372 | −0.703 | 51.128 | 1.00 | 39.87 | | C |
| ANISOU | 2242 | CA | TRP | H | 36 | 5093 | 5410 | 4648 | 336 | 124 | −513 | C |
| ATOM | 2243 | C | TRP | H | 36 | 14.806 | −1.976 | 50.513 | 1.00 | 42.50 | | C |
| ANISOU | 2243 | C | TRP | H | 36 | 5387 | 5712 | 5051 | 336 | 171 | −476 | C |
| ATOM | 2244 | O | TRP | H | 36 | 13.642 | −1.997 | 50.054 | 1.00 | 40.03 | | O |
| ANISOU | 2244 | O | TRP | H | 36 | 5053 | 5370 | 4788 | 330 | 213 | −489 | O |
| ATOM | 2245 | CB | TRP | H | 36 | 14.739 | −0.458 | 52.508 | 1.00 | 37.93 | | C |
| ANISOU | 2245 | CB | TRP | H | 36 | 4898 | 5187 | 4328 | 362 | 163 | −510 | C |
| ATOM | 2246 | CG | TRP | H | 36 | 15.362 | 0.654 | 53.271 | 1.00 | 43.08 | | C |
| ANISOU | 2246 | CG | TRP | H | 36 | 5601 | 5868 | 4899 | 364 | 113 | −545 | C |
| ATOM | 2247 | CD1 | TRP | H | 36 | 14.896 | 1.936 | 53.392 | 1.00 | 49.00 | | C |
| ANISOU | 2247 | CD1 | TRP | H | 36 | 6380 | 6613 | 5625 | 363 | 108 | −603 | C |
| ATOM | 2248 | CD2 | TRP | H | 36 | 16.586 | 0.601 | 54.021 | 1.00 | 48.09 | | C |
| ANISOU | 2248 | CD2 | TRP | H | 36 | 6266 | 6539 | 5467 | 366 | 55 | −527 | C |
| ATOM | 2249 | NE1 | TRP | H | 36 | 15.731 | 2.672 | 54.213 | 1.00 | 52.66 | | N |
| ANISOU | 2249 | NE1 | TRP | H | 36 | 6896 | 7104 | 6008 | 363 | 52 | −625 | N |
| ATOM | 2250 | CE2 | TRP | H | 36 | 16.790 | 1.878 | 54.584 | 1.00 | 51.75 | | C |
| ANISOU | 2250 | CE2 | TRP | H | 36 | 6779 | 7016 | 5866 | 363 | 14 | −579 | C |
| ATOM | 2251 | CE3 | TRP | H | 36 | 17.521 | −0.398 | 54.268 | 1.00 | 45.89 | | C |
| ANISOU | 2251 | CE3 | TRP | H | 36 | 5977 | 6280 | 5180 | 372 | 31 | −472 | C |
| ATOM | 2252 | CZ2 | TRP | H | 36 | 17.890 | 2.171 | 55.370 | 1.00 | 50.63 | | C |
| ANISOU | 2252 | CZ2 | TRP | H | 36 | 6676 | 6909 | 5652 | 360 | −56 | −578 | C |
| ATOM | 2253 | CZ3 | TRP | H | 36 | 18.595 | −0.114 | 55.055 | 1.00 | 45.69 | | C |
| ANISOU | 2253 | CZ3 | TRP | H | 36 | 5984 | 6292 | 5085 | 373 | −35 | −466 | C |
| ATOM | 2254 | CH2 | TRP | H | 36 | 18.781 | 1.167 | 55.596 | 1.00 | 49.45 | | C |
| ANISOU | 2254 | CH2 | TRP | H | 36 | 6509 | 6783 | 5497 | 364 | −81 | −519 | C |
| ATOM | 2255 | N | VAL | H | 37 | 15.649 | −3.005 | 50.460 | 1.00 | 43.78 | | N |
| ANISOU | 2255 | N | VAL | H | 37 | 5537 | 5876 | 5223 | 341 | 158 | −432 | N |
| ATOM | 2256 | CA | VAL | H | 37 | 15.311 | −4.349 | 50.007 | 1.00 | 38.80 | | C |
| ANISOU | 2256 | CA | VAL | H | 37 | 4878 | 5211 | 4654 | 343 | 197 | −393 | C |
| ATOM | 2257 | C | VAL | H | 37 | 15.765 | −5.286 | 51.106 | 1.00 | 36.28 | | C |
| ANISOU | 2257 | C | VAL | H | 37 | 4581 | 4911 | 4292 | 368 | 213 | −331 | C |
| ATOM | 2258 | O | VAL | H | 37 | 16.792 | −5.038 | 51.736 | 1.00 | 35.88 | | O |
| ANISOU | 2258 | O | VAL | H | 37 | 4552 | 4897 | 4183 | 378 | 169 | −320 | O |
| ATOM | 2259 | CB | VAL | H | 37 | 16.025 | −4.684 | 48.684 | 1.00 | 38.51 | | C |
| ANISOU | 2259 | CB | VAL | H | 37 | 4806 | 5150 | 4675 | 328 | 165 | −402 | C |
| ATOM | 2260 | CG1 | VAL | H | 37 | 15.673 | −6.076 | 48.217 | 1.00 | 34.83 | | C |
| ANISOU | 2260 | CG1 | VAL | H | 37 | 4320 | 4642 | 4271 | 330 | 203 | −367 | C |
| ATOM | 2261 | CG2 | VAL | H | 37 | 15.658 | −3.649 | 47.633 | 1.00 | 46.24 | | C |
| ANISOU | 2261 | CG2 | VAL | H | 37 | 5771 | 6116 | 5685 | 304 | 144 | −459 | C |
| ATOM | 2262 | N | ARG | H | 38 | 14.997 | −6.329 | 51.382 | 1.00 | 37.78 | | N |
| ANISOU | 2262 | N | ARG | H | 38 | 4767 | 5077 | 4512 | 376 | 271 | −289 | N |
| ATOM | 2263 | CA | ARG | H | 38 | 15.407 | −7.238 | 52.438 | 1.00 | 39.95 | | C |
| ANISOU | 2263 | CA | ARG | H | 38 | 5065 | 5369 | 4746 | 402 | 288 | −224 | C |
| ATOM | 2264 | C | ARG | H | 38 | 15.468 | −8.662 | 51.906 | 1.00 | 49.60 | | C |
| ANISOU | 2264 | C | ARG | H | 38 | 6260 | 6545 | 6039 | 403 | 311 | −179 | C |
| ATOM | 2265 | O | ARG | H | 38 | 14.787 | −9.018 | 50.939 | 1.00 | 41.54 | | O |
| ANISOU | 2265 | O | ARG | H | 38 | 5210 | 5478 | 5096 | 383 | 333 | −196 | O |
| ATOM | 2266 | CB | ARG | H | 38 | 14.495 | −7.169 | 53.653 | 1.00 | 41.41 | | C |
| ANISOU | 2266 | CB | ARG | H | 38 | 5285 | 5573 | 4877 | 419 | 344 | −201 | C |

TABLE 14-continued

| | | | | | | | | | | | | | |
|---|---|---|---|---|---|---|---|---|---|---|---|---|---|
| ATOM | 2267 | CG | ARG | H | 38 | 13.151 | −7.831 | 53.487 | 1.00 | 35.00 | | | C |
| ANISOU | 2267 | CG | ARG | H | 38 | 4449 | 4720 | 4129 | 411 | 418 | −180 | | C |
| ATOM | 2268 | CD | ARG | H | 38 | 12.318 | −7.605 | 54.781 | 1.00 | 38.95 | | | C |
| ANISOU | 2268 | CD | ARG | H | 38 | 4985 | 5248 | 4565 | 433 | 479 | −156 | | C |
| ATOM | 2269 | NE | ARG | H | 38 | 10.905 | −7.929 | 54.557 | 1.00 | 50.71 | | | N |
| ANISOU | 2269 | NE | ARG | H | 38 | 6440 | 6702 | 6123 | 422 | 550 | −146 | | N |
| ATOM | 2270 | CZ | ARG | H | 38 | 9.928 | −7.662 | 55.416 | 1.00 | 49.94 | | | C |
| ANISOU | 2270 | CZ | ARG | H | 38 | 6359 | 6621 | 5995 | 437 | 617 | −132 | | C |
| ATOM | 2271 | NH1 | ARG | H | 38 | 10.174 | −7.034 | 56.556 | 1.00 | 48.77 | | | N |
| ANISOU | 2271 | NH1 | ARG | H | 38 | 6270 | 6523 | 5739 | 467 | 623 | −132 | | N |
| ATOM | 2272 | NH2 | ARG | H | 38 | 8.714 | −8.027 | 55.124 | 1.00 | 43.30 | | | N |
| ANISOU | 2272 | NH2 | ARG | H | 38 | 5475 | 5746 | 5232 | 424 | 678 | −117 | | N |
| ATOM | 2273 | N | GLN | H | 39 | 16.328 | −9.466 | 52.527 | 1.00 | 44.34 | | | N |
| ANISOU | 2273 | N | GLN | H | 39 | 5608 | 5892 | 5348 | 427 | 301 | −122 | | N |
| ATOM | 2274 | CA | GLN | H | 39 | 16.421 | −10.885 | 52.208 | 1.00 | 42.33 | | | C |
| ANISOU | 2274 | CA | GLN | H | 39 | 5336 | 5590 | 5156 | 435 | 328 | −72 | | C |
| ATOM | 2275 | C | GLN | H | 39 | 16.319 | −11.631 | 53.535 | 1.00 | 42.39 | | | C |
| ANISOU | 2275 | C | GLN | H | 39 | 5375 | 5612 | 5118 | 462 | 364 | 2 | | C |
| ATOM | 2276 | O | GLN | H | 39 | 17.276 | −11.664 | 54.325 | 1.00 | 44.27 | | | O |
| ANISOU | 2276 | O | GLN | H | 39 | 5637 | 5892 | 5293 | 487 | 330 | 37 | | O |
| ATOM | 2277 | CB | GLN | H | 39 | 17.721 | −11.225 | 51.452 | 1.00 | 40.99 | | | C |
| ANISOU | 2277 | CB | GLN | H | 39 | 5146 | 5414 | 5015 | 443 | 279 | −71 | | C |
| ATOM | 2278 | CG | GLN | H | 39 | 17.662 | −12.583 | 50.708 | 1.00 | 49.99 | | | C |
| ANISOU | 2278 | CG | GLN | H | 39 | 6266 | 6488 | 6240 | 447 | 309 | −44 | | C |
| ATOM | 2279 | CD | GLN | H | 39 | 18.661 | −12.682 | 49.535 | 1.00 | 59.96 | | | C |
| ANISOU | 2279 | CD | GLN | H | 39 | 7503 | 7733 | 7544 | 450 | 272 | −70 | | C |
| ATOM | 2280 | OE1 | GLN | H | 39 | 19.727 | −12.043 | 49.531 | 1.00 | 50.42 | | | O |
| ANISOU | 2280 | OE1 | GLN | H | 39 | 6287 | 6567 | 6301 | 459 | 224 | −79 | | O |
| ATOM | 2281 | NE2 | GLN | H | 39 | 18.308 | −13.471 | 48.541 | 1.00 | 69.34 | | | N |
| ANISOU | 2281 | NE2 | GLN | H | 39 | 8680 | 8859 | 8808 | 441 | 296 | −81 | | N |
| ATOM | 2282 | N | ALA | H | 40 | 15.162 | −12.208 | 53.757 | 1.00 | 40.46 | | | N |
| ANISOU | 2282 | N | ALA | H | 40 | 5129 | 5336 | 4907 | 455 | 430 | 28 | | N |
| ATOM | 2283 | CA | ALA | H | 40 | 14.816 | −13.020 | 54.907 | 1.00 | 46.93 | | | C |
| ANISOU | 2283 | CA | ALA | H | 40 | 5975 | 6158 | 5697 | 476 | 481 | 105 | | C |
| ATOM | 2284 | C | ALA | H | 40 | 15.388 | −14.418 | 54.723 | 1.00 | 48.06 | | | C |
| ANISOU | 2284 | C | ALA | H | 40 | 6110 | 6257 | 5895 | 490 | 485 | 165 | | C |
| ATOM | 2285 | O | ALA | H | 40 | 15.489 | −14.904 | 53.589 | 1.00 | 44.74 | | | O |
| ANISOU | 2285 | O | ALA | H | 40 | 5658 | 5784 | 5558 | 475 | 475 | 142 | | O |
| ATOM | 2286 | CB | ALA | H | 40 | 13.281 | −13.113 | 55.074 | 1.00 | 41.78 | | | C |
| ANISOU | 2286 | CB | ALA | H | 40 | 5313 | 5481 | 5080 | 459 | 557 | 111 | | C |
| ATOM | 2287 | N | PRO | H | 41 | 15.718 | −15.099 | 55.839 | 1.00 | 48.74 | | | N |
| ANISOU | 2287 | N | PRO | H | 41 | 6227 | 6360 | 5933 | 521 | 502 | 243 | | N |
| ATOM | 2288 | CA | PRO | H | 41 | 16.419 | −16.385 | 55.765 | 1.00 | 45.85 | | | C |
| ANISOU | 2288 | CA | PRO | H | 41 | 5855 | 5954 | 5610 | 542 | 499 | 306 | | C |
| ATOM | 2289 | C | PRO | H | 41 | 15.730 | −17.386 | 54.862 | 1.00 | 51.12 | | | C |
| ANISOU | 2289 | C | PRO | H | 41 | 6494 | 6535 | 6394 | 519 | 541 | 310 | | C |
| ATOM | 2290 | O | PRO | H | 41 | 14.567 | −17.757 | 55.077 | 1.00 | 51.02 | | | O |
| ANISOU | 2290 | O | PRO | H | 41 | 6478 | 6491 | 6415 | 500 | 602 | 332 | | O |
| ATOM | 2291 | CB | PRO | H | 41 | 16.427 | −16.854 | 57.228 | 1.00 | 48.29 | | | C |
| ANISOU | 2291 | CB | PRO | H | 41 | 6208 | 6295 | 5846 | 573 | 528 | 392 | | C |
| ATOM | 2292 | CG | PRO | H | 41 | 16.445 | −15.580 | 58.014 | 1.00 | 50.81 | | | C |
| ANISOU | 2292 | CG | PRO | H | 41 | 6561 | 6692 | 6054 | 578 | 505 | 359 | | C |
| ATOM | 2293 | CD | PRO | H | 41 | 15.510 | −14.672 | 57.232 | 1.00 | 55.41 | | | C |
| ANISOU | 2293 | CD | PRO | H | 41 | 7118 | 7263 | 6672 | 541 | 521 | 276 | | C |
| ATOM | 2294 | N | GLY | H | 42 | 16.440 | −17.785 | 53.811 | 1.00 | 53.82 | | | N |
| ANISOU | 2294 | N | GLY | H | 42 | 6814 | 6838 | 6798 | 520 | 507 | 285 | | N |
| ATOM | 2295 | CA | GLY | H | 42 | 15.945 | −18.761 | 52.864 | 1.00 | 65.93 | | | C |
| ANISOU | 2295 | CA | GLY | H | 42 | 8327 | 8285 | 8438 | 500 | 535 | 280 | | C |
| ATOM | 2296 | C | GLY | H | 42 | 14.923 | −18.264 | 51.870 | 1.00 | 76.29 | | | C |
| ANISOU | 2296 | C | GLY | H | 42 | 9615 | 9569 | 9804 | 455 | 543 | 207 | | C |
| ATOM | 2297 | O | GLY | H | 42 | 14.398 | −19.080 | 51.098 | 1.00 | 87.44 | | | O |
| ANISOU | 2297 | O | GLY | H | 42 | 11014 | 10905 | 11305 | 433 | 562 | 201 | | O |
| ATOM | 2298 | N | LYS | H | 43 | 14.610 | −16.967 | 51.846 | 1.00 | 67.43 | | | N |
| ANISOU | 2298 | N | LYS | H | 43 | 8487 | 8499 | 8633 | 439 | 525 | 152 | | N |
| ATOM | 2299 | CA | LYS | H | 43 | 13.484 | −16.500 | 51.056 | 1.00 | 59.73 | | | C |
| ANISOU | 2299 | CA | LYS | H | 43 | 7487 | 7499 | 7709 | 398 | 537 | 94 | | C |
| ATOM | 2300 | C | LYS | H | 43 | 13.938 | −15.555 | 49.955 | 1.00 | 58.75 | | | C |
| ANISOU | 2300 | C | LYS | H | 43 | 7349 | 7391 | 7582 | 386 | 482 | 13 | | C |
| ATOM | 2301 | O | LYS | H | 43 | 15.078 | −15.088 | 49.927 | 1.00 | 60.19 | | | O |
| ANISOU | 2301 | O | LYS | H | 43 | 7540 | 7614 | 7717 | 408 | 438 | 0 | | O |
| ATOM | 2302 | CB | LYS | H | 43 | 12.440 | −15.821 | 51.954 | 1.00 | 58.96 | | | C |
| ANISOU | 2302 | CB | LYS | H | 43 | 7391 | 7440 | 7571 | 390 | 578 | 104 | | C |
| ATOM | 2303 | CG | LYS | H | 43 | 12.040 | −16.700 | 53.100 | 1.00 | 63.71 | | | C |
| ANISOU | 2303 | CG | LYS | H | 43 | 8008 | 8033 | 8164 | 404 | 638 | 191 | | C |
| ATOM | 2304 | CD | LYS | H | 43 | 10.533 | −16.865 | 53.195 | 1.00 | 60.85 | | | C |
| ANISOU | 2304 | CD | LYS | H | 43 | 7621 | 7640 | 7860 | 373 | 701 | 204 | | C |
| ATOM | 2305 | CE | LYS | H | 43 | 10.189 | −17.989 | 54.145 | 1.00 | 61.84 | | | C |
| ANISOU | 2305 | CE | LYS | H | 43 | 7758 | 7739 | 7999 | 384 | 764 | 300 | | C |
| ATOM | 2306 | NZ | LYS | H | 43 | 10.238 | −19.351 | 53.484 | 1.00 | 62.25 | | | N |
| ANISOU | 2306 | NZ | LYS | H | 43 | 7797 | 7703 | 8153 | 367 | 766 | 328 | | N |

TABLE 14-continued

| | | | | | | | | | | | | |
|---|---|---|---|---|---|---|---|---|---|---|---|---|
| ATOM | 2307 | N | CYS | H | 44 | 13.002 | −15.266 | 49.051 | 1.00 | 60.23 | | N |
| ANISOU | 2307 | N | CYS | H | 44 | 7514 | 7547 | 7825 | 350 | 484 | −38 | N |
| ATOM | 2308 | CA | CYS | H | 44 | 13.273 | −14.396 | 47.920 | 1.00 | 59.98 | | C |
| ANISOU | 2308 | CA | CYS | H | 44 | 7469 | 7524 | 7795 | 335 | 436 | −113 | C |
| ATOM | 2309 | C | CYS | H | 44 | 13.515 | −12.962 | 48.384 | 1.00 | 49.35 | | C |
| ANISOU | 2309 | C | CYS | H | 44 | 6129 | 6251 | 6370 | 343 | 412 | −142 | C |
| ATOM | 2310 | O | CYS | H | 44 | 12.957 | −12.495 | 49.383 | 1.00 | 52.54 | | O |
| ANISOU | 2310 | O | CYS | H | 44 | 6543 | 6691 | 6731 | 347 | 439 | −124 | O |
| ATOM | 2311 | CB | CYS | H | 44 | 12.106 | −14.445 | 46.916 | 1.00 | 71.62 | | C |
| ANISOU | 2311 | CB | CYS | H | 44 | 8919 | 8948 | 9345 | 294 | 441 | −155 | C |
| ATOM | 2312 | SG | CYS | H | 44 | 11.457 | −16.138 | 46.602 | 1.00 | 87.25 | | S |
| ANISOU | 2312 | SG | CYS | H | 44 | 10894 | 10833 | 11425 | 275 | 476 | −117 | S |
| ATOM | 2313 | N | LEU | H | 45 | 14.384 | −12.272 | 47.655 | 1.00 | 43.14 | | N |
| ANISOU | 2313 | N | LEU | H | 45 | 5342 | 5486 | 5565 | 345 | 362 | −187 | N |
| ATOM | 2314 | CA | LEU | H | 45 | 14.539 | −10.841 | 47.796 | 1.00 | 43.32 | | C |
| ANISOU | 2314 | CA | LEU | H | 45 | 5367 | 5564 | 5529 | 342 | 331 | −229 | C |
| ATOM | 2315 | C | LEU | H | 45 | 13.188 | −10.155 | 47.761 | 1.00 | 43.33 | | C |
| ANISOU | 2315 | C | LEU | H | 45 | 5357 | 5562 | 5545 | 318 | 354 | −259 | C |
| ATOM | 2316 | O | LEU | H | 45 | 12.382 | −10.431 | 46.881 | 1.00 | 40.66 | | O |
| ANISOU | 2316 | O | LEU | H | 45 | 4997 | 5179 | 5274 | 293 | 362 | −281 | O |
| ATOM | 2317 | CB | LEU | H | 45 | 15.378 | −10.304 | 46.648 | 1.00 | 48.35 | | C |
| ANISOU | 2317 | CB | LEU | H | 45 | 5994 | 6203 | 6173 | 336 | 282 | −276 | C |
| ATOM | 2318 | CG | LEU | H | 45 | 16.876 | −10.256 | 46.867 | 1.00 | 51.38 | | C |
| ANISOU | 2318 | CG | LEU | H | 45 | 6383 | 6621 | 6516 | 362 | 248 | −257 | C |
| ATOM | 2319 | CD1 | LEU | H | 45 | 17.477 | −9.652 | 45.618 | 1.00 | 53.89 | | C |
| ANISOU | 2319 | CD1 | LEU | H | 45 | 6687 | 6939 | 6851 | 351 | 211 | −306 | C |
| ATOM | 2320 | CD2 | LEU | H | 45 | 17.188 | −9.433 | 48.104 | 1.00 | 42.76 | | C |
| ANISOU | 2320 | CD2 | LEU | H | 45 | 5310 | 5591 | 5346 | 373 | 231 | −244 | C |
| ATOM | 2321 | N | GLU | H | 46 | 12.984 | −9.201 | 48.667 | 1.00 | 41.08 | | N |
| ANISOU | 2321 | N | GLU | H | 46 | 5087 | 5325 | 5198 | 327 | 359 | −264 | N |
| ATOM | 2322 | CA | GLU | H | 46 | 11.692 | −8.547 | 48.831 | 1.00 | 40.41 | | C |
| ANISOU | 2322 | CA | GLU | H | 46 | 4991 | 5241 | 5124 | 314 | 390 | −285 | C |
| ATOM | 2323 | C | GLU | H | 46 | 11.916 | −7.057 | 48.987 | 1.00 | 35.90 | | C |
| ANISOU | 2323 | C | GLU | H | 46 | 4434 | 4713 | 4492 | 318 | 359 | −332 | C |
| ATOM | 2324 | O | GLU | H | 46 | 12.517 | −6.603 | 49.964 | 1.00 | 36.72 | | O |
| ANISOU | 2324 | O | GLU | H | 46 | 4572 | 4861 | 4520 | 339 | 350 | −323 | O |
| ATOM | 2325 | CB | GLU | H | 46 | 10.931 | −9.100 | 50.041 | 1.00 | 43.03 | | C |
| ANISOU | 2325 | CB | GLU | H | 46 | 5332 | 5577 | 5442 | 328 | 456 | −229 | C |
| ATOM | 2326 | CG | GLU | H | 46 | 9.500 | −8.542 | 50.133 | 1.00 | 52.54 | | C |
| ANISOU | 2326 | CG | GLU | H | 46 | 6513 | 6776 | 6674 | 316 | 499 | −245 | C |
| ATOM | 2327 | CD | GLU | H | 46 | 8.748 | −8.942 | 51.404 | 1.00 | 59.56 | | C |
| ANISOU | 2327 | CD | GLU | H | 46 | 7411 | 7677 | 7541 | 334 | 573 | −188 | C |
| ATOM | 2328 | OE1 | GLU | H | 46 | 7.481 | −8.799 | 51.410 | 1.00 | 66.13 | | O |
| ANISOU | 2328 | OE1 | GLU | H | 46 | 8211 | 8495 | 8420 | 323 | 620 | −187 | O |
| ATOM | 2329 | OE2 | GLU | H | 46 | 9.399 | −9.377 | 52.382 | 1.00 | 49.55 | | O |
| ANISOU | 2329 | OE2 | GLU | H | 46 | 6182 | 6436 | 6211 | 359 | 585 | −143 | O |
| ATOM | 2330 | N | TRP | H | 47 | 11.453 | −6.292 | 48.019 | 1.00 | 38.76 | | N |
| ANISOU | 2330 | N | TRP | H | 47 | 4775 | 5062 | 4890 | 297 | 337 | −384 | N |
| ATOM | 2331 | CA | TRP | H | 47 | 11.508 | −4.847 | 48.154 | 1.00 | 37.35 | | C |
| ANISOU | 2331 | CA | TRP | H | 47 | 4610 | 4915 | 4665 | 300 | 312 | −429 | C |
| ATOM | 2332 | C | TRP | H | 47 | 10.679 | −4.402 | 49.357 | 1.00 | 39.47 | | C |
| ANISOU | 2332 | C | TRP | H | 47 | 4898 | 5208 | 4892 | 319 | 361 | −419 | C |
| ATOM | 2333 | O | TRP | H | 47 | 9.584 | −4.931 | 49.603 | 1.00 | 33.73 | | O |
| ANISOU | 2333 | O | TRP | H | 47 | 4150 | 4461 | 4205 | 318 | 418 | −393 | O |
| ATOM | 2334 | CB | TRP | H | 47 | 10.989 | −4.219 | 46.879 | 1.00 | 33.35 | | C |
| ANISOU | 2334 | CB | TRP | H | 47 | 4075 | 4384 | 4213 | 276 | 287 | −477 | C |
| ATOM | 2335 | CG | TRP | H | 47 | 10.707 | −2.765 | 46.975 | 1.00 | 37.42 | | C |
| ANISOU | 2335 | CG | TRP | H | 47 | 4600 | 4919 | 4698 | 278 | 272 | −521 | C |
| ATOM | 2336 | CD1 | TRP | H | 47 | 11.594 | −1.754 | 47.013 | 1.00 | 35.93 | | C |
| ANISOU | 2336 | CD1 | TRP | H | 47 | 4436 | 4757 | 4460 | 280 | 227 | −551 | C |
| ATOM | 2337 | CD2 | TRP | H | 47 | 9.411 | −2.175 | 47.030 | 1.00 | 34.41 | | C |
| ANISOU | 2337 | CD2 | TRP | H | 47 | 4201 | 4528 | 4344 | 278 | 304 | −538 | C |
| ATOM | 2338 | NE1 | TRP | H | 47 | 10.947 | −0.546 | 47.064 | 1.00 | 37.93 | | N |
| ANISOU | 2338 | NE1 | TRP | H | 47 | 4694 | 5013 | 4705 | 282 | 227 | −589 | N |
| ATOM | 2339 | CE2 | TRP | H | 47 | 9.589 | −0.787 | 47.075 | 1.00 | 39.25 | | C |
| ANISOU | 2339 | CE2 | TRP | H | 47 | 4835 | 5160 | 4920 | 284 | 276 | −581 | C |
| ATOM | 2340 | CE3 | TRP | H | 47 | 8.119 | −2.697 | 47.041 | 1.00 | 33.59 | | C |
| ANISOU | 2340 | CE3 | TRP | H | 47 | 4062 | 4400 | 4300 | 274 | 353 | −518 | C |
| ATOM | 2341 | CZ2 | TRP | H | 47 | 8.507 | 0.104 | 47.137 | 1.00 | 39.82 | | C |
| ANISOU | 2341 | CZ2 | TRP | H | 47 | 4895 | 5226 | 5009 | 291 | 299 | −606 | C |
| ATOM | 2342 | CZ3 | TRP | H | 47 | 7.023 | −1.799 | 47.078 | 1.00 | 41.23 | | C |
| ANISOU | 2342 | CZ3 | TRP | H | 47 | 5011 | 5365 | 5288 | 279 | 376 | −541 | C |
| ATOM | 2343 | CH2 | TRP | H | 47 | 7.230 | −0.434 | 47.134 | 1.00 | 44.55 | | C |
| ANISOU | 2343 | CH2 | TRP | H | 47 | 5456 | 5805 | 5668 | 291 | 350 | −584 | C |
| ATOM | 2344 | N | VAL | H | 48 | 11.234 | −3.480 | 50.144 | 1.00 | 40.08 | | N |
| ANISOU | 2344 | N | VAL | H | 48 | 5014 | 5325 | 4888 | 336 | 341 | −437 | N |
| ATOM | 2345 | CA | VAL | H | 48 | 10.536 | −2.943 | 51.306 | 1.00 | 42.57 | | C |
| ANISOU | 2345 | CA | VAL | H | 48 | 5360 | 5665 | 5150 | 359 | 388 | −435 | C |
| ATOM | 2346 | C | VAL | H | 48 | 9.945 | −1.575 | 51.012 | 1.00 | 42.77 | | C |
| ANISOU | 2346 | C | VAL | H | 48 | 5384 | 5688 | 5177 | 357 | 381 | −493 | C |

TABLE 14-continued

| | | | | | | | | | | | | |
|---|---|---|---|---|---|---|---|---|---|---|---|---|
| ATOM | 2347 | O | VAL | H | 48 | 8.758 | −1.335 | 51.227 | 1.00 | 42.60 | | O |
| ANISOU | 2347 | O | VAL | H | 48 | 5349 | 5658 | 5179 | 367 | 435 | −496 | O |
| ATOM | 2348 | CB | VAL | H | 48 | 11.486 | −2.889 | 52.526 | 1.00 | 44.07 | | C |
| ANISOU | 2348 | CB | VAL | H | 48 | 5607 | 5899 | 5240 | 383 | 372 | −416 | C |
| ATOM | 2349 | CG1 | VAL | H | 48 | 10.715 | −2.363 | 53.759 | 1.00 | 41.64 | | C |
| ANISOU | 2349 | CG1 | VAL | H | 48 | 5340 | 5615 | 4865 | 412 | 428 | −416 | C |
| ATOM | 2350 | CG2 | VAL | H | 48 | 12.028 | −4.286 | 52.827 | 1.00 | 37.40 | | C |
| ANISOU | 2350 | CG2 | VAL | H | 48 | 4760 | 5052 | 4398 | 389 | 382 | −351 | C |
| ATOM | 2351 | N | SER | H | 49 | 10.744 | −0.678 | 50.464 | 1.00 | 35.59 | | N |
| ANISOU | 2351 | N | SER | H | 49 | 4485 | 4784 | 4252 | 345 | 315 | −537 | N |
| ATOM | 2352 | CA | SER | H | 49 | 10.337 | 0.713 | 50.456 | 1.00 | 33.17 | | C |
| ANISOU | 2352 | CA | SER | H | 49 | 4194 | 4479 | 3930 | 350 | 306 | −590 | C |
| ATOM | 2353 | C | SER | H | 49 | 11.231 | 1.509 | 49.532 | 1.00 | 37.99 | | C |
| ANISOU | 2353 | C | SER | H | 49 | 4802 | 5085 | 4549 | 326 | 232 | −630 | C |
| ATOM | 2354 | O | SER | H | 49 | 12.435 | 1.228 | 49.415 | 1.00 | 40.24 | | O |
| ANISOU | 2354 | O | SER | H | 49 | 5094 | 5383 | 4812 | 316 | 185 | −619 | O |
| ATOM | 2355 | CB | SER | H | 49 | 10.386 | 1.310 | 51.877 | 1.00 | 39.02 | | C |
| ANISOU | 2355 | CB | SER | H | 49 | 4997 | 5253 | 4576 | 380 | 327 | −598 | C |
| ATOM | 2356 | OG | SER | H | 49 | 9.910 | 2.658 | 51.823 | 1.00 | 46.80 | | O |
| ANISOU | 2356 | OG | SER | H | 49 | 5998 | 6230 | 5553 | 387 | 323 | −653 | O |
| ATOM | 2357 | N | THR | H | 50 | 10.659 | 2.542 | 48.915 | 1.00 | 34.47 | | N |
| ANISOU | 2357 | N | THR | H | 50 | 4345 | 4619 | 4132 | 320 | 222 | −672 | N |
| ATOM | 2358 | CA | THR | H | 50 | 11.446 | 3.473 | 48.127 | 1.00 | 33.37 | | |
| ANISOU | 2358 | CA | THR | H | 50 | 4209 | 4474 | 3997 | 299 | 156 | −709 | C |
| ATOM | 2359 | C | THR | H | 50 | 10.984 | 4.888 | 48.424 | 1.00 | 39.04 | | C |
| ANISOU | 2359 | C | THR | H | 50 | 4955 | 5185 | 4694 | 310 | 153 | −756 | C |
| ATOM | 2360 | O | THR | H | 50 | 9.809 | 5.124 | 48.749 | 1.00 | 38.88 | | O |
| ANISOU | 2360 | O | THR | H | 50 | 4932 | 5155 | 4688 | 332 | 206 | −763 | O |
| ATOM | 2361 | CB | THR | H | 50 | 11.315 | 3.160 | 46.627 | 1.00 | 37.59 | | C |
| ANISOU | 2361 | CB | THR | H | 50 | 4695 | 4980 | 4608 | 274 | 136 | −709 | C |
| ATOM | 2362 | OG1 | THR | H | 50 | 11.866 | 1.866 | 46.381 | 1.00 | 36.40 | | O |
| ANISOU | 2362 | OG1 | THR | H | 50 | 4527 | 4832 | 4473 | 267 | 137 | −670 | O |
| ATOM | 2363 | CG2 | THR | H | 50 | 12.024 | 4.150 | 45.792 | 1.00 | 43.41 | | C |
| ANISOU | 2363 | CG2 | THR | H | 50 | 5434 | 5710 | 5350 | 254 | 78 | −741 | C |
| ATOM | 2364 | N | ILE | H | 51 | 11.909 | 5.830 | 48.292 | 1.00 | 32.50 | | N |
| ANISOU | 2364 | N | ILE | H | 51 | 4153 | 4360 | 3837 | 296 | 94 | −787 | N |
| ATOM | 2365 | CA | ILE | H | 51 | 11.635 | 7.221 | 48.594 | 1.00 | 35.69 | | C |
| ANISOU | 2365 | CA | ILE | H | 51 | 4591 | 4750 | 4218 | 304 | 83 | −836 | C |
| ATOM | 2366 | C | ILE | H | 51 | 12.278 | 8.094 | 47.533 | 1.00 | 39.08 | | C |
| ANISOU | 2366 | C | ILE | H | 51 | 5009 | 5160 | 4679 | 274 | 20 | −861 | C |
| ATOM | 2367 | O | ILE | H | 51 | 13.409 | 7.850 | 47.105 | 1.00 | 39.63 | | O |
| ANISOU | 2367 | O | ILE | H | 51 | 5069 | 5241 | 4748 | 249 | −27 | −846 | O |
| ATOM | 2368 | CB | ILE | H | 51 | 12.102 | 7.582 | 50.012 | 1.00 | 31.39 | | C |
| ANISOU | 2368 | CB | ILE | H | 51 | 4113 | 4231 | 3581 | 322 | 79 | −850 | C |
| ATOM | 2369 | CG1 | ILE | H | 51 | 11.802 | 9.059 | 50.299 | 1.00 | 34.43 | | C |
| ANISOU | 2369 | CG1 | ILE | H | 51 | 4542 | 4594 | 3944 | 332 | 68 | −907 | C |
| ATOM | 2370 | CG2 | ILE | H | 51 | 13.622 | 7.327 | 50.206 | 1.00 | 36.33 | | C |
| ANISOU | 2370 | CG2 | ILE | H | 51 | 4753 | 4883 | 4166 | 298 | 13 | −836 | C |
| ATOM | 2371 | CD1 | ILE | H | 51 | 11.928 | 9.399 | 51.769 | 1.00 | 33.96 | | C |
| ANISOU | 2371 | CD1 | ILE | H | 51 | 4558 | 4555 | 3789 | 358 | 78 | −928 | C |
| ATOM | 2372 | N | SER | H | 52 | 11.549 | 9.106 | 47.089 | 1.00 | 34.37 | | N |
| ANISOU | 2372 | N | SER | H | 52 | 4411 | 4532 | 4114 | 279 | 23 | −893 | N |
| ATOM | 2373 | CA | SER | H | 52 | 12.070 | 9.948 | 46.038 | 1.00 | 35.27 | | C |
| ANISOU | 2373 | CA | SER | H | 52 | 4515 | 4624 | 4262 | 251 | −32 | −911 | C |
| ATOM | 2374 | C | SER | H | 52 | 13.183 | 10.849 | 46.575 | 1.00 | 38.64 | | C |
| ANISOU | 2374 | C | SER | H | 52 | 4988 | 5055 | 4639 | 235 | −87 | −937 | C |
| ATOM | 2375 | O | SER | H | 52 | 13.436 | 10.930 | 47.787 | 1.00 | 38.30 | | O |
| ANISOU | 2375 | O | SER | H | 52 | 4991 | 5029 | 4530 | 248 | −85 | −950 | O |
| ATOM | 2376 | CB | SER | H | 52 | 10.945 | 10.763 | 45.412 | 1.00 | 35.50 | | C |
| ANISOU | 2376 | CB | SER | H | 52 | 4529 | 4617 | 4343 | 263 | −16 | −933 | C |
| ATOM | 2377 | OG | SER | H | 52 | 10.612 | 11.868 | 46.227 | 1.00 | 36.97 | | O |
| ANISOU | 2377 | OG | SER | H | 52 | 4762 | 4787 | 4497 | 285 | −8 | −973 | O |
| ATOM | 2378 | N | GLY | H | 53 | 13.854 | 11.534 | 45.647 | 1.00 | 38.82 | | N |
| ANISOU | 2378 | N | GLY | H | 53 | 4999 | 5060 | 4692 | 204 | −139 | −945 | N |
| ATOM | 2379 | CA | GLY | H | 53 | 15.038 | 12.305 | 46.013 | 1.00 | 42.59 | | C |
| ANISOU | 2379 | CA | GLY | H | 53 | 5508 | 5539 | 5136 | 178 | −199 | −962 | C |
| ATOM | 2380 | C | GLY | H | 53 | 14.744 | 13.358 | 47.066 | 1.00 | 44.77 | | C |
| ANISOU | 2380 | C | GLY | H | 53 | 5847 | 5797 | 5366 | 194 | −204 | −1011 | C |
| ATOM | 2381 | O | GLY | H | 53 | 15.517 | 13.539 | 48.016 | 1.00 | 45.63 | | O |
| ANISOU | 2381 | O | GLY | H | 53 | 5999 | 5923 | 5417 | 186 | −238 | −1024 | O |
| ATOM | 2382 | N | SER | H | 54 | 13.617 | 14.057 | 46.920 | 1.00 | 38.85 | | N |
| ANISOU | 2382 | N | SER | H | 54 | 5107 | 5013 | 4641 | 219 | −170 | −1038 | N |
| ATOM | 2383 | CA | SER | H | 54 | 13.266 | 15.127 | 47.845 | 1.00 | 38.46 | | C |
| ANISOU | 2383 | CA | SER | H | 54 | 5123 | 4938 | 4552 | 240 | −168 | −1089 | C |
| ATOM | 2384 | C | SER | H | 54 | 12.731 | 14.582 | 49.151 | 1.00 | 47.51 | | C |
| ANISOU | 2384 | C | SER | H | 54 | 6307 | 6112 | 5632 | 280 | −114 | −1095 | C |
| ATOM | 2385 | O | SER | H | 54 | 12.732 | 15.300 | 50.158 | 1.00 | 50.77 | | O |
| ANISOU | 2385 | O | SER | H | 54 | 6789 | 6515 | 5986 | 297 | −118 | −1138 | O |
| ATOM | 2386 | CB | SER | H | 54 | 12.206 | 16.041 | 47.242 | 1.00 | 43.65 | | C |
| ANISOU | 2386 | CB | SER | H | 54 | 5774 | 5548 | 5263 | 260 | −144 | −1113 | C |

TABLE 14-continued

| | | | | | | | | | | | | |
|---|---|---|---|---|---|---|---|---|---|---|---|---|
| ATOM | 2387 | OG | SER | H | 54 | 10.968 | 15.357 | 47.285 | 1.00 | 43.53 | | O |
| ANISOU | 2387 | OG | SER | H | 54 | 5729 | 5542 | 5269 | 298 | −71 | −1095 | O |
| ATOM | 2388 | N | GLY | H | 55 | 12.284 | 13.334 | 49.153 | 1.00 | 42.00 | | N |
| ANISOU | 2388 | N | GLY | H | 55 | 5571 | 5446 | 4943 | 295 | −65 | −1052 | N |
| ATOM | 2389 | CA | GLY | H | 55 | 11.662 | 12.726 | 50.302 | 1.00 | 49.34 | | C |
| ANISOU | 2389 | CA | GLY | H | 55 | 6528 | 6400 | 5818 | 334 | −2 | −1046 | C |
| ATOM | 2390 | C | GLY | H | 55 | 10.159 | 12.738 | 50.225 | 1.00 | 46.67 | | C |
| ANISOU | 2390 | C | GLY | H | 55 | 6168 | 6045 | 5520 | 374 | 76 | −1046 | C |
| ATOM | 2391 | O | GLY | H | 55 | 9.494 | 12.065 | 51.024 | 1.00 | 48.58 | | O |
| ANISOU | 2391 | O | GLY | H | 55 | 6416 | 6309 | 5733 | 408 | 143 | −1028 | O |
| ATOM | 2392 | N | GLY | H | 56 | 9.610 | 13.435 | 49.237 | 1.00 | 49.10 | | N |
| ANISOU | 2392 | N | GLY | H | 56 | 6443 | 6314 | 5899 | 371 | 71 | −1059 | N |
| ATOM | 2393 | CA | GLY | H | 56 | 8.174 | 13.610 | 49.171 | 1.00 | 48.98 | | C |
| ANISOU | 2393 | CA | GLY | H | 56 | 6402 | 6279 | 5928 | 411 | 139 | −1061 | C |
| ATOM | 2394 | C | GLY | H | 56 | 7.412 | 12.401 | 48.702 | 1.00 | 43.97 | | C |
| ANISOU | 2394 | C | GLY | H | 56 | 5696 | 5661 | 5349 | 414 | 185 | −1010 | C |
| ATOM | 2395 | O | GLY | H | 56 | 6.250 | 12.225 | 49.070 | 1.00 | 47.99 | | O |
| ANISOU | 2395 | O | GLY | H | 56 | 6186 | 6169 | 5879 | 451 | 256 | −1000 | O |
| ATOM | 2396 | N | GLY | H | 57 | 8.009 | 11.566 | 47.855 | 1.00 | 44.50 | | N |
| ANISOU | 2396 | N | GLY | H | 57 | 5721 | 5741 | 5446 | 376 | 148 | −976 | N |
| ATOM | 2397 | CA | GLY | H | 57 | 7.335 | 10.384 | 47.363 | 1.00 | 45.38 | | C |
| ANISOU | 2397 | CA | GLY | H | 57 | 5768 | 5862 | 5611 | 373 | 183 | −931 | C |
| ATOM | 2398 | C | GLY | H | 57 | 7.861 | 9.160 | 48.077 | 1.00 | 46.86 | | C |
| ANISOU | 2398 | C | GLY | H | 57 | 5965 | 6087 | 5753 | 369 | 201 | −896 | C |
| ATOM | 2399 | O | GLY | H | 57 | 9.065 | 8.889 | 48.060 | 1.00 | 42.27 | | O |
| ANISOU | 2399 | O | GLY | H | 57 | 5403 | 5523 | 5136 | 344 | 153 | −891 | O |
| ATOM | 2400 | N | THR | H | 58 | 6.968 | 8.444 | 48.724 | 1.00 | 38.84 | | N |
| ANISOU | 2400 | N | THR | H | 58 | 4935 | 5083 | 4741 | 395 | 273 | −869 | N |
| ATOM | 2401 | CA | THR | H | 58 | 7.334 | 7.249 | 49.472 | 1.00 | 37.94 | | C |
| ANISOU | 2401 | CA | THR | H | 58 | 4830 | 5001 | 4586 | 395 | 299 | −830 | C |
| ATOM | 2402 | C | THR | H | 58 | 6.454 | 6.110 | 48.993 | 1.00 | 47.69 | | C |
| ANISOU | 2402 | C | THR | H | 58 | 5999 | 6229 | 5894 | 390 | 342 | −784 | C |
| ATOM | 2403 | O | THR | H | 58 | 5.285 | 6.311 | 48.628 | 1.00 | 48.21 | | O |
| ANISOU | 2403 | O | THR | H | 58 | 6020 | 6274 | 6022 | 401 | 377 | −783 | O |
| ATOM | 2404 | CB | THR | H | 58 | 7.161 | 7.428 | 50.980 | 1.00 | 45.00 | | C |
| ANISOU | 2404 | CB | THR | H | 58 | 5783 | 5917 | 5396 | 434 | 351 | −836 | C |
| ATOM | 2405 | OG1 | THR | H | 58 | 5.807 | 7.805 | 51.237 | 1.00 | 50.70 | | O |
| ANISOU | 2405 | OG1 | THR | H | 58 | 6489 | 6626 | 6150 | 470 | 423 | −841 | O |
| ATOM | 2406 | CG2 | THR | H | 58 | 8.139 | 8.499 | 51.511 | 1.00 | 46.03 | | C |
| ANISOU | 2406 | CG2 | THR | H | 58 | 5988 | 6052 | 5447 | 434 | 296 | −884 | C |
| ATOM | 2407 | N | TYR | H | 59 | 7.038 | 4.925 | 48.964 | 1.00 | 46.38 | | N |
| ANISOU | 2407 | N | TYR | H | 59 | 5822 | 6077 | 5723 | 371 | 334 | −746 | N |
| ATOM | 2408 | CA | TYR | H | 59 | 6.435 | 3.733 | 48.388 | 1.00 | 36.83 | | C |
| ANISOU | 2408 | CA | TYR | H | 59 | 4555 | 4855 | 4586 | 356 | 359 | −704 | C |
| ATOM | 2409 | C | TYR | H | 59 | 6.793 | 2.585 | 49.301 | 1.00 | 43.19 | | C |
| ANISOU | 2409 | C | TYR | H | 59 | 5377 | 5683 | 5350 | 363 | 393 | −658 | C |
| ATOM | 2410 | O | TYR | H | 59 | 7.946 | 2.481 | 49.762 | 1.00 | 38.73 | | O |
| ANISOU | 2410 | O | TYR | H | 59 | 4856 | 5141 | 4718 | 362 | 360 | −657 | O |
| ATOM | 2411 | CB | TYR | H | 59 | 6.977 | 3.468 | 46.982 | 1.00 | 34.72 | | C |
| ANISOU | 2411 | CB | TYR | H | 59 | 4256 | 4568 | 4367 | 318 | 295 | −708 | C |
| ATOM | 2412 | CG | TYR | H | 59 | 6.736 | 4.600 | 46.036 | 1.00 | 41.57 | | C |
| ANISOU | 2412 | CG | TYR | H | 59 | 5111 | 5414 | 5269 | 310 | 255 | −748 | C |
| ATOM | 2413 | CD1 | TYR | H | 59 | 7.587 | 5.702 | 46.004 | 1.00 | 36.97 | | C |
| ANISOU | 2413 | CD1 | TYR | H | 59 | 4569 | 4835 | 4642 | 309 | 207 | −785 | C |
| ATOM | 2414 | CD2 | TYR | H | 59 | 5.632 | 4.591 | 45.193 | 1.00 | 40.37 | | C |
| ANISOU | 2414 | CD2 | TYR | H | 59 | 4906 | 5236 | 5197 | 304 | 262 | −746 | C |
| ATOM | 2415 | CE1 | TYR | H | 59 | 7.359 | 6.739 | 45.139 | 1.00 | 39.09 | | C |
| ANISOU | 2415 | CE1 | TYR | H | 59 | 4827 | 5081 | 4944 | 302 | 173 | −815 | C |
| ATOM | 2416 | CE2 | TYR | H | 59 | 5.376 | 5.653 | 44.333 | 1.00 | 41.70 | | C |
| ANISOU | 2416 | CE2 | TYR | H | 59 | 5064 | 5385 | 5397 | 300 | 224 | −777 | C |
| ATOM | 2417 | CZ | TYR | H | 59 | 6.232 | 6.710 | 44.307 | 1.00 | 40.93 | | C |
| ANISOU | 2417 | CZ | TYR | H | 59 | 5010 | 5290 | 5253 | 300 | 182 | −810 | C |
| ATOM | 2418 | OH | TYR | H | 59 | 5.997 | 7.768 | 43.465 | 1.00 | 39.91 | | O |
| ANISOU | 2418 | OH | TYR | H | 59 | 4873 | 5138 | 5155 | 296 | 146 | −837 | O |
| ATOM | 2419 | N | TYR | H | 60 | 5.819 | 1.728 | 49.558 | 1.00 | 40.12 | | N |
| ANISOU | 2419 | N | TYR | H | 60 | 4953 | 5287 | 5004 | 369 | 457 | −617 | N |
| ATOM | 2420 | CA | TYR | H | 60 | 5.982 | 0.655 | 50.530 | 1.00 | 40.20 | | C |
| ANISOU | 2420 | CA | TYR | H | 60 | 4981 | 5317 | 4978 | 380 | 502 | −566 | C |
| ATOM | 2421 | C | TYR | H | 60 | 5.359 | −0.617 | 49.990 | 1.00 | 45.48 | | C |
| ANISOU | 2421 | C | TYR | H | 60 | 5590 | 5958 | 5732 | 358 | 527 | −520 | C |
| ATOM | 2422 | O | TYR | H | 60 | 4.305 | −0.591 | 49.350 | 1.00 | 45.10 | | O |
| ANISOU | 2422 | O | TYR | H | 60 | 5486 | 5883 | 5765 | 347 | 544 | −521 | O |
| ATOM | 2423 | CB | TYR | H | 60 | 5.298 | 0.947 | 51.880 | 1.00 | 42.55 | | C |
| ANISOU | 2423 | CB | TYR | H | 60 | 5309 | 5637 | 5221 | 421 | 580 | −554 | C |
| ATOM | 2424 | CG | TYR | H | 60 | 5.788 | 2.158 | 52.581 | 1.00 | 43.35 | | C |
| ANISOU | 2424 | CG | TYR | H | 60 | 5479 | 5761 | 5231 | 447 | 563 | −601 | C |
| ATOM | 2425 | CD1 | TYR | H | 60 | 6.870 | 2.089 | 53.428 | 1.00 | 41.28 | | C |
| ANISOU | 2425 | CD1 | TYR | H | 60 | 5282 | 5531 | 4872 | 456 | 537 | −599 | C |
| ATOM | 2426 | CD2 | TYR | H | 60 | 5.171 | 3.389 | 52.390 | 1.00 | 46.26 | | C |
| ANISOU | 2426 | CD2 | TYR | H | 60 | 5846 | 6116 | 5613 | 463 | 568 | −649 | C |

TABLE 14-continued

| | | | | | | | | | | | | |
|---|---|---|---|---|---|---|---|---|---|---|---|---|
| ATOM | 2427 | CE1 | TYR | H | 60 | 7.329 | 3.182 | 54.066 | 1.00 | 38.23 | | C |
| ANISOU | 2427 | CE1 | TYR | H | 60 | 4961 | 5161 | 4403 | 475 | 514 | −645 | C |
| ATOM | 2428 | CE2 | TYR | H | 60 | 5.633 | 4.513 | 53.042 | 1.00 | 44.27 | | C |
| ANISOU | 2428 | CE2 | TYR | H | 60 | 5664 | 5878 | 5279 | 485 | 550 | −697 | C |
| ATOM | 2429 | CZ | TYR | H | 60 | 6.720 | 4.397 | 53.874 | 1.00 | 44.41 | | C |
| ANISOU | 2429 | CZ | TYR | H | 60 | 5748 | 5926 | 5198 | 489 | 521 | −697 | C |
| ATOM | 2430 | OH | TYR | H | 60 | 7.198 | 5.492 | 54.553 | 1.00 | 45.34 | | O |
| ANISOU | 2430 | OH | TYR | H | 60 | 5940 | 6055 | 5232 | 507 | 495 | −747 | O |
| ATOM | 2431 | N | ALA | H | 61 | 5.998 | −1.731 | 50.314 | 1.00 | 40.54 | | N |
| ANISOU | 2431 | N | ALA | H | 61 | 4978 | 5337 | 5088 | 352 | 530 | −479 | N |
| ATOM | 2432 | CA | ALA | H | 61 | 5.405 | −3.036 | 50.108 | 1.00 | 42.42 | | C |
| ANISOU | 2432 | CA | ALA | H | 61 | 5172 | 5547 | 5398 | 335 | 565 | −428 | C |
| ATOM | 2433 | C | ALA | H | 61 | 4.201 | −3.209 | 51.050 | 1.00 | 43.15 | | C |
| ANISOU | 2433 | C | ALA | H | 61 | 5247 | 5646 | 5503 | 356 | 657 | −389 | C |
| ATOM | 2434 | O | ALA | H | 61 | 4.190 | −2.720 | 52.182 | 1.00 | 45.64 | | O |
| ANISOU | 2434 | O | ALA | H | 61 | 5605 | 5995 | 5740 | 391 | 700 | −385 | O |
| ATOM | 2435 | CB | ALA | H | 61 | 6.449 | −4.127 | 50.374 | 1.00 | 37.56 | | C |
| ANISOU | 2435 | CB | ALA | H | 61 | 4583 | 4935 | 4752 | 331 | 550 | −390 | C |
| ATOM | 2436 | N | ASP | H | 62 | 3.212 | −3.949 | 50.594 | 1.00 | 46.24 | | N |
| ANISOU | 2436 | N | ASP | H | 62 | 5575 | 6003 | 5991 | 334 | 687 | −358 | N |
| ATOM | 2437 | CA | ASP | H | 62 | 2.011 | −4.148 | 51.422 | 1.00 | 50.25 | | C |
| ANISOU | 2437 | CA | ASP | H | 62 | 6054 | 6515 | 6525 | 351 | 780 | −313 | C |
| ATOM | 2438 | C | ASP | H | 62 | 2.351 | −4.777 | 52.765 | 1.00 | 55.65 | | C |
| ANISOU | 2438 | C | ASP | H | 62 | 6786 | 7227 | 7133 | 378 | 840 | −260 | C |
| ATOM | 2439 | O | ASP | H | 62 | 1.751 | −4.421 | 53.784 | 1.00 | 51.82 | | O |
| ANISOU | 2439 | O | ASP | H | 62 | 6315 | 6768 | 6607 | 413 | 915 | −241 | O |
| ATOM | 2440 | CB | ASP | H | 62 | 1.012 | −5.034 | 50.707 | 1.00 | 49.87 | | C |
| ANISOU | 2440 | CB | ASP | H | 62 | 5926 | 6421 | 6600 | 314 | 795 | −280 | C |
| ATOM | 2441 | CG | ASP | H | 62 | 0.328 | −4.342 | 49.584 | 1.00 | 62.34 | | C |
| ANISOU | 2441 | CG | ASP | H | 62 | 7451 | 7978 | 8257 | 294 | 753 | −323 | C |
| ATOM | 2442 | OD1 | ASP | H | 62 | 0.435 | −3.107 | 49.490 | 1.00 | 64.48 | | O |
| ANISOU | 2442 | OD1 | ASP | H | 62 | 7742 | 8269 | 8488 | 316 | 731 | −373 | O |
| ATOM | 2443 | OD2 | ASP | H | 62 | −0.334 | −5.040 | 48.788 | 1.00 | 74.63 | | O |
| ANISOU | 2443 | OD2 | ASP | H | 62 | 8946 | 9494 | 9914 | 256 | 738 | −306 | O |
| ATOM | 2444 | N | SER | H | 63 | 3.338 | −5.674 | 52.789 | 1.00 | 51.51 | | N |
| ANISOU | 2444 | N | SER | H | 63 | 6291 | 6698 | 6583 | 367 | 807 | −235 | N |
| ATOM | 2445 | CA | SER | H | 63 | 3.700 | −6.422 | 53.982 | 1.00 | 51.31 | | C |
| ANISOU | 2445 | CA | SER | H | 63 | 6309 | 6695 | 6492 | 390 | 856 | −174 | C |
| ATOM | 2446 | C | SER | H | 63 | 4.253 | −5.547 | 55.096 | 1.00 | 51.13 | | C |
| ANISOU | 2446 | C | SER | H | 63 | 6363 | 6727 | 6339 | 434 | 865 | −193 | C |
| ATOM | 2447 | O | SER | H | 63 | 4.354 | −6.016 | 56.235 | 1.00 | 56.72 | | O |
| ANISOU | 2447 | O | SER | H | 63 | 7111 | 7460 | 6980 | 460 | 917 | −141 | O |
| ATOM | 2448 | CB | SER | H | 63 | 4.721 | −7.496 | 53.614 | 1.00 | 54.72 | | C |
| ANISOU | 2448 | CB | SER | H | 63 | 6753 | 7106 | 6932 | 370 | 806 | −150 | C |
| ATOM | 2449 | OG | SER | H | 63 | 5.973 | −6.898 | 53.300 | 1.00 | 62.57 | | O |
| ANISOU | 2449 | OG | SER | H | 63 | 7789 | 8121 | 7864 | 375 | 726 | −199 | O |
| ATOM | 2450 | N | VAL | H | 64 | 4.607 | −4.298 | 54.807 | 1.00 | 44.30 | | N |
| ANISOU | 2450 | N | VAL | H | 64 | 5521 | 5878 | 5434 | 441 | 815 | −263 | N |
| ATOM | 2451 | CA | VAL | H | 64 | 5.135 | −3.388 | 55.817 | 1.00 | 40.93 | | C |
| ANISOU | 2451 | CA | VAL | H | 64 | 5171 | 5497 | 4884 | 479 | 814 | −290 | C |
| ATOM | 2452 | C | VAL | H | 64 | 4.356 | −2.086 | 55.900 | 1.00 | 45.69 | | C |
| ANISOU | 2452 | C | VAL | H | 64 | 5775 | 6106 | 5478 | 501 | 841 | −343 | C |
| ATOM | 2453 | O | VAL | H | 64 | 4.685 | −1.241 | 56.747 | 1.00 | 50.26 | | O |
| ANISOU | 2453 | O | VAL | H | 64 | 6423 | 6717 | 5955 | 533 | 844 | −373 | O |
| ATOM | 2454 | CB | VAL | H | 64 | 6.625 | −3.074 | 55.565 | 1.00 | 47.72 | | C |
| ANISOU | 2454 | CB | VAL | H | 64 | 6074 | 6372 | 5685 | 469 | 715 | −326 | C |
| ATOM | 2455 | CG1 | VAL | H | 64 | 7.433 | −4.363 | 55.382 | 1.00 | 43.67 | | C |
| ANISOU | 2455 | CG1 | VAL | H | 64 | 5554 | 5849 | 5191 | 451 | 687 | −275 | C |
| ATOM | 2456 | CG2 | VAL | H | 64 | 6.762 | −2.142 | 54.371 | 1.00 | 45.63 | | C |
| ANISOU | 2456 | CG2 | VAL | H | 64 | 5783 | 6087 | 5470 | 445 | 649 | −394 | C |
| ATOM | 2457 | N | LYS | H | 65 | 3.407 | −1.857 | 55.000 | 1.00 | 52.01 | | N |
| ANISOU | 2457 | N | LYS | H | 65 | 6506 | 6874 | 6382 | 484 | 852 | −358 | N |
| ATOM | 2458 | CA | LYS | H | 65 | 2.638 | −0.627 | 55.010 | 1.00 | 59.36 | | C |
| ANISOU | 2458 | CA | LYS | H | 65 | 7432 | 7806 | 7317 | 508 | 877 | −404 | C |
| ATOM | 2459 | C | LYS | H | 65 | 2.030 | −0.432 | 56.392 | 1.00 | 62.73 | | C |
| ANISOU | 2459 | C | LYS | H | 65 | 7899 | 8262 | 7671 | 559 | 977 | −381 | C |
| ATOM | 2460 | O | LYS | H | 65 | 1.556 | −1.383 | 57.016 | 1.00 | 63.87 | | O |
| ANISOU | 2460 | O | LYS | H | 65 | 8030 | 8414 | 7824 | 566 | 1050 | −314 | O |
| ATOM | 2461 | CB | LYS | H | 65 | 1.548 | −0.694 | 53.941 | 1.00 | 62.01 | | C |
| ANISOU | 2461 | CB | LYS | H | 65 | 7673 | 8102 | 7785 | 484 | 886 | −402 | C |
| ATOM | 2462 | CG | LYS | H | 65 | 1.464 | 0.511 | 53.038 | 1.00 | 68.83 | | C |
| ANISOU | 2462 | CG | LYS | H | 65 | 8523 | 8951 | 8680 | 479 | 830 | −469 | C |
| ATOM | 2463 | CD | LYS | H | 65 | 0.432 | 0.257 | 51.940 | 1.00 | 77.82 | | C |
| ANISOU | 2463 | CD | LYS | H | 65 | 9565 | 10051 | 9950 | 450 | 827 | −457 | C |
| ATOM | 2464 | CE | LYS | H | 65 | 1.112 | −0.206 | 50.640 | 1.00 | 80.60 | | C |
| ANISOU | 2464 | CE | LYS | H | 65 | 9897 | 10378 | 10351 | 400 | 733 | −471 | C |
| ATOM | 2465 | NZ | LYS | H | 65 | 0.155 | −0.839 | 49.679 | 1.00 | 84.87 | | N |
| ANISOU | 2465 | NZ | LYS | H | 65 | 10351 | 10882 | 11015 | 366 | 729 | −448 | N |
| ATOM | 2466 | N | GLY | H | 66 | 2.123 | 0.787 | 56.902 | 1.00 | 57.45 | | N |
| ANISOU | 2466 | N | GLY | H | 66 | 7290 | 7612 | 6926 | 594 | 978 | −436 | N |

TABLE 14-continued

| | | | | | | | | | | | |
|---|---|---|---|---|---|---|---|---|---|---|---|
| ATOM | 2467 | CA | GLY | H | 66 | 1.566 | 1.097 | 58.191 | 1.00 | 60.66 | C |
| ANISOU | 2467 | CA | GLY | H | 66 | 7747 | 8047 | 7253 | 648 | 1073 | −424 | C |
| ATOM | 2468 | C | GLY | H | 66 | 2.446 | 0.786 | 59.374 | 1.00 | 62.43 | C |
| ANISOU | 2468 | C | GLY | H | 66 | 8066 | 8312 | 7342 | 669 | 1075 | −406 | C |
| ATOM | 2469 | O | GLY | H | 66 | 2.106 | 1.191 | 60.486 | 1.00 | 69.04 | O |
| ANISOU | 2469 | O | GLY | H | 66 | 8965 | 9177 | 8090 | 718 | 1146 | −408 | O |
| ATOM | 2470 | N | ARG | H | 67 | 3.548 | 0.058 | 59.188 | 1.00 | 50.40 | N |
| ANISOU | 2470 | N | ARG | H | 67 | 6558 | 6795 | 5799 | 637 | 1001 | −387 | N |
| ATOM | 2471 | CA | ARG | H | 67 | 4.483 | −0.234 | 60.266 | 1.00 | 54.56 | C |
| ANISOU | 2471 | CA | ARG | H | 67 | 7173 | 7361 | 6198 | 655 | 986 | −367 | C |
| ATOM | 2472 | C | ARG | H | 67 | 5.870 | 0.307 | 60.026 | 1.00 | 50.87 | C |
| ANISOU | 2472 | C | ARG | H | 67 | 6754 | 6903 | 5674 | 635 | 867 | −420 | C |
| ATOM | 2473 | O | ARG | H | 67 | 6.579 | 0.585 | 60.994 | 1.00 | 55.20 | O |
| ANISOU | 2473 | O | ARG | H | 67 | 7388 | 7485 | 6099 | 657 | 845 | −431 | O |
| ATOM | 2474 | CB | ARG | H | 67 | 4.622 | −1.748 | 60.494 | 1.00 | 61.03 | C |
| ANISOU | 2474 | CB | ARG | H | 67 | 7969 | 8183 | 7037 | 642 | 1012 | −278 | C |
| ATOM | 2475 | CG | ARG | H | 67 | 3.310 | −2.482 | 60.582 | 1.00 | 62.90 | C |
| ANISOU | 2475 | CG | ARG | H | 67 | 8141 | 8403 | 7355 | 648 | 1122 | −214 | C |
| ATOM | 2476 | CD | ARG | H | 67 | 3.503 | −3.964 | 60.879 | 1.00 | 63.93 | C |
| ANISOU | 2476 | CD | ARG | H | 67 | 8257 | 8531 | 7500 | 634 | 1147 | −124 | C |
| ATOM | 2477 | NE | ARG | H | 67 | 4.102 | −4.676 | 59.757 | 1.00 | 64.20 | N |
| ANISOU | 2477 | NE | ARG | H | 67 | 8239 | 8530 | 7624 | 584 | 1067 | −119 | N |
| ATOM | 2478 | CZ | ARG | H | 67 | 5.316 | −5.225 | 59.769 | 1.00 | 62.48 | C |
| ANISOU | 2478 | CZ | ARG | H | 67 | 8054 | 8320 | 7365 | 573 | 996 | −105 | C |
| ATOM | 2479 | NH1 | ARG | H | 67 | 6.077 | −5.157 | 60.857 | 1.00 | 53.82 | N |
| ANISOU | 2479 | NH1 | ARG | H | 67 | 7041 | 7267 | 6140 | 603 | 986 | −91 | N |
| ATOM | 2480 | NH2 | ARG | H | 67 | 5.768 | −5.845 | 58.679 | 1.00 | 61.22 | N |
| ANISOU | 2480 | NH2 | ARG | H | 67 | 7843 | 8124 | 7295 | 532 | 933 | −104 | N |
| ATOM | 2481 | N | PHE | H | 68 | 6.287 | 0.440 | 58.768 | 1.00 | 45.35 | N |
| ANISOU | 2481 | N | PHE | H | 68 | 5999 | 6173 | 5058 | 593 | 789 | −449 | N |
| ATOM | 2482 | CA | PHE | H | 68 | 7.603 | 0.956 | 58.427 | 1.00 | 54.48 | C |
| ANISOU | 2482 | CA | PHE | H | 68 | 7189 | 7336 | 6177 | 570 | 679 | −494 | C |
| ATOM | 2483 | C | PHE | H | 68 | 7.432 | 2.336 | 57.833 | 1.00 | 54.65 | C |
| ANISOU | 2483 | C | PHE | H | 68 | 7210 | 7336 | 6219 | 566 | 644 | −572 | C |
| ATOM | 2484 | O | PHE | H | 68 | 6.458 | 2.596 | 57.115 | 1.00 | 52.48 | O |
| ANISOU | 2484 | O | PHE | H | 68 | 6876 | 7031 | 6032 | 564 | 680 | −584 | O |
| ATOM | 2485 | CB | PHE | H | 68 | 8.343 | 0.071 | 57.411 | 1.00 | 50.11 | C |
| ANISOU | 2485 | CB | PHE | H | 68 | 6578 | 6764 | 5698 | 528 | 616 | −466 | C |
| ATOM | 2486 | CG | PHE | H | 68 | 8.776 | −1.263 | 57.948 | 1.00 | 60.29 | C |
| ANISOU | 2486 | CG | PHE | H | 68 | 7872 | 8068 | 6965 | 530 | 630 | −391 | C |
| ATOM | 2487 | CD1 | PHE | H | 68 | 8.230 | −1.782 | 59.113 | 1.00 | 57.30 | C |
| ANISOU | 2487 | CD1 | PHE | H | 68 | 7530 | 7714 | 6529 | 564 | 712 | −340 | C |
| ATOM | 2488 | CD2 | PHE | H | 68 | 9.750 | −1.995 | 57.288 | 1.00 | 55.40 | C |
| ANISOU | 2488 | CD2 | PHE | H | 68 | 7225 | 7440 | 6383 | 502 | 565 | −370 | C |
| ATOM | 2489 | CE1 | PHE | H | 68 | 8.630 | −3.009 | 59.587 | 1.00 | 63.95 | C |
| ANISOU | 2489 | CE1 | PHE | H | 68 | 8378 | 8566 | 7354 | 567 | 724 | −267 | C |
| ATOM | 2490 | CE2 | PHE | H | 68 | 10.151 | −3.233 | 57.763 | 1.00 | 49.95 | C |
| ANISOU | 2490 | CE2 | PHE | H | 68 | 6540 | 6760 | 5679 | 507 | 579 | −299 | C |
| ATOM | 2491 | CZ | PHE | H | 68 | 9.601 | −3.736 | 58.913 | 1.00 | 55.46 | C |
| ANISOU | 2491 | CZ | PHE | H | 68 | 7273 | 7478 | 6321 | 538 | 655 | −246 | C |
| ATOM | 2492 | N | THR | H | 69 | 8.366 | 3.215 | 58.151 | 1.00 | 45.67 | N |
| ANISOU | 2492 | N | THR | H | 69 | 6137 | 6212 | 5002 | 566 | 573 | −623 | N |
| ATOM | 2493 | CA | THR | H | 69 | 8.421 | 4.542 | 57.552 | 1.00 | 46.33 | C |
| ANISOU | 2493 | CA | THR | H | 69 | 6227 | 6272 | 5106 | 556 | 525 | −697 | C |
| ATOM | 2494 | C | THR | H | 69 | 9.815 | 4.767 | 56.999 | 1.00 | 50.72 | C |
| ANISOU | 2494 | C | THR | H | 69 | 6787 | 6827 | 5655 | 516 | 412 | −718 | C |
| ATOM | 2495 | O | THR | H | 69 | 10.800 | 4.666 | 57.735 | 1.00 | 50.19 | O |
| ANISOU | 2495 | O | THR | H | 69 | 6775 | 6791 | 5504 | 515 | 365 | −714 | O |
| ATOM | 2496 | CB | THR | H | 69 | 8.087 | 5.629 | 58.574 | 1.00 | 46.81 | C |
| ANISOU | 2496 | CB | THR | H | 69 | 6371 | 6340 | 5073 | 598 | 556 | −748 | C |
| ATOM | 2497 | OG1 | THR | H | 69 | 6.794 | 5.338 | 59.152 | 1.00 | 49.35 | O |
| ANISOU | 2497 | OG1 | THR | H | 69 | 6686 | 6666 | 5399 | 640 | 673 | −719 | O |
| ATOM | 2498 | CG2 | THR | H | 69 | 8.046 | 6.990 | 57.900 | 1.00 | 49.94 | C |
| ANISOU | 2498 | CG2 | THR | H | 69 | 6770 | 6701 | 5503 | 589 | 512 | −821 | C |
| ATOM | 2499 | N | ILE | H | 70 | 9.898 | 5.085 | 55.726 | 1.00 | 45.93 | N |
| ANISOU | 2499 | N | ILE | H | 70 | 6123 | 6190 | 5139 | 484 | 370 | −739 | N |
| ATOM | 2500 | CA | ILE | H | 70 | 11.175 | 5.460 | 55.128 | 1.00 | 41.61 | C |
| ANISOU | 2500 | CA | ILE | H | 70 | 5576 | 5641 | 4593 | 446 | 269 | −762 | C |
| ATOM | 2501 | C | ILE | H | 70 | 11.291 | 6.973 | 55.170 | 1.00 | 42.16 | C |
| ANISOU | 2501 | C | ILE | H | 70 | 5691 | 5694 | 4636 | 446 | 229 | −833 | C |
| ATOM | 2502 | O | ILE | H | 70 | 10.292 | 7.688 | 55.072 | 1.00 | 49.19 | O |
| ANISOU | 2502 | O | ILE | H | 70 | 6581 | 6558 | 5549 | 467 | 275 | −865 | O |
| ATOM | 2503 | CB | ILE | H | 70 | 11.255 | 4.918 | 53.689 | 1.00 | 38.97 | C |
| ANISOU | 2503 | CB | ILE | H | 70 | 5159 | 5283 | 4366 | 412 | 247 | −741 | C |
| ATOM | 2504 | CG1 | ILE | H | 70 | 12.654 | 5.044 | 53.107 | 1.00 | 38.05 | C |
| ANISOU | 2504 | CG1 | ILE | H | 70 | 5035 | 5171 | 4253 | 377 | 155 | −747 | C |
| ATOM | 2505 | CG2 | ILE | H | 70 | 10.198 | 5.599 | 52.781 | 1.00 | 43.09 | C |
| ANISOU | 2505 | CG2 | ILE | H | 70 | 5639 | 5765 | 4967 | 411 | 272 | −771 | C |
| ATOM | 2506 | CD1 | ILE | H | 70 | 12.787 | 4.183 | 51.844 | 1.00 | 37.66 | C |
| ANISOU | 2506 | CD1 | ILE | H | 70 | 4913 | 5104 | 4293 | 351 | 147 | −715 | C |

TABLE 14-continued

| | | | | | | | | | | | | | |
|---|---|---|---|---|---|---|---|---|---|---|---|---|---|
| ATOM | 2507 | N | SER | H | 71 | 12.504 | 7.472 | 55.351 | 1.00 | 43.73 | | | N |
| ANISOU | 2507 | N | SER | H | 71 | 5926 | 5902 | 4786 | 423 | 144 | −857 | | N |
| ATOM | 2508 | CA | SER | H | 71 | 12.725 | 8.909 | 55.357 | 1.00 | 42.36 | | | C |
| ANISOU | 2508 | CA | SER | H | 71 | 5797 | 5705 | 4591 | 415 | 97 | −925 | | C |
| ATOM | 2509 | C | SER | H | 71 | 14.184 | 9.154 | 55.000 | 1.00 | 49.43 | | | C |
| ANISOU | 2509 | C | SER | H | 71 | 6689 | 6607 | 5484 | 370 | −8 | −931 | | C |
| ATOM | 2510 | O | SER | H | 71 | 15.004 | 8.231 | 54.992 | 1.00 | 47.26 | | | O |
| ANISOU | 2510 | O | SER | H | 71 | 6389 | 6360 | 5206 | 355 | −38 | −884 | | O |
| ATOM | 2511 | CB | SER | H | 71 | 12.350 | 9.519 | 56.716 | 1.00 | 46.26 | | | C |
| ANISOU | 2511 | CB | SER | H | 71 | 6385 | 6210 | 4982 | 455 | 128 | −963 | | C |
| ATOM | 2512 | OG | SER | H | 71 | 13.045 | 8.873 | 57.784 | 1.00 | 54.27 | | | O |
| ANISOU | 2512 | OG | SER | H | 71 | 7449 | 7269 | 5903 | 462 | 109 | −935 | | O |
| ATOM | 2513 | N | ARG | H | 72 | 14.513 | 10.401 | 54.675 | 1.00 | 38.84 | | | N |
| ANISOU | 2513 | N | ARG | H | 72 | 5369 | 5236 | 4153 | 349 | −63 | −985 | | N |
| ATOM | 2514 | CA | ARG | H | 72 | 15.905 | 10.706 | 54.388 | 1.00 | 44.38 | | | C |
| ANISOU | 2514 | CA | ARG | H | 72 | 6064 | 5942 | 4856 | 304 | −162 | −988 | | C |
| ATOM | 2515 | C | ARG | H | 72 | 16.220 | 12.092 | 54.905 | 1.00 | 44.00 | | | C |
| ANISOU | 2515 | C | ARG | H | 72 | 6087 | 5871 | 4760 | 294 | −216 | −1055 | | C |
| ATOM | 2516 | O | ARG | H | 72 | 15.353 | 12.972 | 54.932 | 1.00 | 46.83 | | | O |
| ANISOU | 2516 | O | ARG | H | 72 | 6478 | 6193 | 5123 | 315 | −181 | −1102 | | O |
| ATOM | 2517 | CB | ARG | H | 72 | 16.217 | 10.654 | 52.881 | 1.00 | 40.74 | | | C |
| ANISOU | 2517 | CB | ARG | H | 72 | 5521 | 5460 | 4497 | 268 | −185 | −969 | | C |
| ATOM | 2518 | CG | ARG | H | 72 | 15.281 | 11.574 | 52.074 | 1.00 | 39.75 | | | C |
| ANISOU | 2518 | CG | ARG | H | 72 | 5383 | 5286 | 4433 | 272 | −157 | −1006 | | C |
| ATOM | 2519 | CD | ARG | H | 72 | 15.263 | 11.260 | 50.576 | 1.00 | 34.24 | | | C |
| ANISOU | 2519 | CD | ARG | H | 72 | 4605 | 4572 | 3831 | 249 | −158 | −977 | | C |
| ATOM | 2520 | NE | ARG | H | 72 | 16.602 | 11.357 | 49.988 | 1.00 | 39.14 | | | N |
| ANISOU | 2520 | NE | ARG | H | 72 | 5199 | 5198 | 4472 | 205 | −232 | −963 | | N |
| ATOM | 2521 | CZ | ARG | H | 72 | 16.965 | 10.793 | 48.840 | 1.00 | 43.47 | | | C |
| ANISOU | 2521 | CZ | ARG | H | 72 | 5684 | 5749 | 5085 | 185 | −238 | −927 | | C |
| ATOM | 2522 | NH1 | ARG | H | 72 | 16.070 | 10.093 | 48.158 | 1.00 | 40.09 | | | N |
| ANISOU | 2522 | NH1 | ARG | H | 72 | 5216 | 5313 | 4703 | 201 | −182 | −906 | | N |
| ATOM | 2523 | NH2 | ARG | H | 72 | 18.226 | 10.914 | 48.387 | 1.00 | 37.00 | | | N |
| ANISOU | 2523 | NH2 | ARG | H | 72 | 4839 | 4937 | 4281 | 148 | −300 | −912 | | N |
| ATOM | 2524 | N | ASP | H | 73 | 17.474 | 12.278 | 55.288 | 1.00 | 48.96 | | | N |
| ANISOU | 2524 | N | ASP | H | 73 | 6737 | 6516 | 5349 | 261 | −305 | −1058 | | N |
| ATOM | 2525 | CA | ASP | H | 73 | 18.015 | 13.590 | 55.605 | 1.00 | 53.24 | | | C |
| ANISOU | 2525 | CA | ASP | H | 73 | 7337 | 7030 | 5862 | 235 | −379 | −1120 | | C |
| ATOM | 2526 | C | ASP | H | 73 | 18.995 | 13.959 | 54.504 | 1.00 | 51.77 | | | C |
| ANISOU | 2526 | C | ASP | H | 73 | 7087 | 6826 | 5757 | 179 | −452 | −1108 | | C |
| ATOM | 2527 | O | ASP | H | 73 | 20.162 | 13.556 | 54.542 | 1.00 | 50.42 | | | O |
| ANISOU | 2527 | O | ASP | H | 73 | 6888 | 6685 | 5584 | 146 | −518 | −1075 | | O |
| ATOM | 2528 | CB | ASP | H | 73 | 18.707 | 13.587 | 56.959 | 1.00 | 59.12 | | | C |
| ANISOU | 2528 | CB | ASP | H | 73 | 8160 | 7808 | 6496 | 236 | −434 | −1134 | | C |
| ATOM | 2529 | CG | ASP | H | 73 | 18.880 | 14.980 | 57.508 | 1.00 | 78.04 | | | C |
| ANISOU | 2529 | CG | ASP | H | 73 | 10641 | 10166 | 8845 | 223 | −491 | −1213 | | C |
| ATOM | 2530 | OD1 | ASP | H | 73 | 19.262 | 15.879 | 56.723 | 1.00 | 82.82 | | | O |
| ANISOU | 2530 | OD1 | ASP | H | 73 | 11222 | 10729 | 9517 | 182 | −542 | −1238 | | O |
| ATOM | 2531 | OD2 | ASP | H | 73 | 18.611 | 15.181 | 58.716 | 1.00 | 90.05 | | | O |
| ANISOU | 2531 | OD2 | ASP | H | 73 | 12257 | 11698 | 10261 | 254 | −483 | −1249 | | O |
| ATOM | 2532 | N | ASN | H | 74 | 18.539 | 14.756 | 53.535 | 1.00 | 45.21 | | | N |
| ANISOU | 2532 | N | ASN | H | 74 | 6232 | 5947 | 4999 | 168 | −439 | −1132 | | N |
| ATOM | 2533 | CA | ASN | H | 74 | 19.436 | 15.093 | 52.442 | 1.00 | 48.42 | | | C |
| ANISOU | 2533 | CA | ASN | H | 74 | 6577 | 6337 | 5484 | 116 | −499 | −1114 | | C |
| ATOM | 2534 | C | ASN | H | 74 | 20.644 | 15.883 | 52.922 | 1.00 | 49.90 | | | C |
| ANISOU | 2534 | C | ASN | H | 74 | 6796 | 6518 | 5643 | 70 | −602 | −1140 | | C |
| ATOM | 2535 | O | ASN | H | 74 | 21.729 | 15.761 | 52.345 | 1.00 | 53.16 | | | O |
| ANISOU | 2535 | O | ASN | H | 74 | 7152 | 6943 | 6103 | 26 | −659 | −1104 | | O |
| ATOM | 2536 | CB | ASN | H | 74 | 18.666 | 15.826 | 51.358 | 1.00 | 47.14 | | | C |
| ANISOU | 2536 | CB | ASN | H | 74 | 6390 | 6123 | 5397 | 117 | −466 | −1133 | | C |
| ATOM | 2537 | CG | ASN | H | 74 | 17.788 | 14.873 | 50.574 | 1.00 | 51.96 | | | C |
| ANISOU | 2537 | CG | ASN | H | 74 | 6941 | 6746 | 6057 | 145 | −386 | −1091 | | C |
| ATOM | 2538 | OD1 | ASN | H | 74 | 17.870 | 13.659 | 50.769 | 1.00 | 46.14 | | | O |
| ANISOU | 2538 | OD1 | ASN | H | 74 | 6176 | 6051 | 5303 | 159 | −359 | −1047 | | O |
| ATOM | 2539 | ND2 | ASN | H | 74 | 16.938 | 15.402 | 49.715 | 1.00 | 52.99 | | | N |
| ANISOU | 2539 | ND2 | ASN | H | 74 | 7052 | 6836 | 6246 | 154 | −352 | −1104 | | N |
| ATOM | 2540 | N | SER | H | 75 | 20.486 | 16.666 | 53.990 | 1.00 | 47.70 | | | N |
| ANISOU | 2540 | N | SER | H | 75 | 6611 | 6223 | 5291 | 79 | −627 | −1200 | | N |
| ATOM | 2541 | CA | SER | H | 75 | 21.597 | 17.437 | 54.523 | 1.00 | 55.06 | | | C |
| ANISOU | 2541 | CA | SER | H | 75 | 7581 | 7146 | 6195 | 32 | −734 | −1229 | | C |
| ATOM | 2542 | C | SER | H | 75 | 22.688 | 16.546 | 55.099 | 1.00 | 63.91 | | | C |
| ANISOU | 2542 | C | SER | H | 75 | 8680 | 8327 | 7275 | 14 | −791 | −1183 | | C |
| ATOM | 2543 | O | SER | H | 75 | 23.831 | 16.991 | 55.222 | 1.00 | 62.34 | | | O |
| ANISOU | 2543 | O | SER | H | 75 | 8475 | 8127 | 7083 | −38 | −889 | −1185 | | O |
| ATOM | 2544 | CB | SER | H | 75 | 21.111 | 18.378 | 55.617 | 1.00 | 52.33 | | | C |
| ANISOU | 2544 | CB | SER | H | 75 | 7350 | 6767 | 5765 | 52 | −744 | −1309 | | C |
| ATOM | 2545 | OG | SER | H | 75 | 21.107 | 17.670 | 56.849 | 1.00 | 59.31 | | | O |
| ANISOU | 2545 | OG | SER | H | 75 | 8291 | 7702 | 6543 | 84 | −738 | −1306 | | O |
| ATOM | 2546 | N | LYS | H | 76 | 22.356 | 15.314 | 55.483 | 1.00 | 61.63 | | | N |
| ANISOU | 2546 | N | LYS | H | 76 | 8380 | 8088 | 6947 | 55 | −735 | −1140 | | N |

TABLE 14-continued

| | | | | | | | | | | | | |
|---|---|---|---|---|---|---|---|---|---|---|---|---|
| ATOM | 2547 | CA | LYS | H | 76 | 23.339 | 14.378 | 56.013 | 1.00 | 60.32 | | C |
| ANISOU | 2547 | CA | LYS | H | 76 | 8192 | 7981 | 6747 | 46 | −784 | −1088 | C |
| ATOM | 2548 | C | LYS | H | 76 | 23.592 | 13.196 | 55.089 | 1.00 | 61.21 | | C |
| ANISOU | 2548 | C | LYS | H | 76 | 8202 | 8122 | 6932 | 49 | −745 | −1010 | C |
| ATOM | 2549 | O | LYS | H | 76 | 24.228 | 12.219 | 55.514 | 1.00 | 57.84 | | O |
| ANISOU | 2549 | O | LYS | H | 76 | 7753 | 7744 | 6481 | 56 | −765 | −959 | O |
| ATOM | 2550 | CB | LYS | H | 76 | 22.894 | 13.877 | 57.383 | 1.00 | 61.24 | | C |
| ANISOU | 2550 | CB | LYS | H | 76 | 8390 | 8131 | 6745 | 92 | −759 | −1097 | C |
| ATOM | 2551 | CG | LYS | H | 76 | 22.934 | 14.970 | 58.434 | 1.00 | 74.67 | | C |
| ANISOU | 2551 | CG | LYS | H | 76 | 10202 | 9811 | 8358 | 85 | −817 | −1173 | C |
| ATOM | 2552 | CD | LYS | H | 76 | 21.677 | 15.004 | 59.284 | 1.00 | 83.05 | | C |
| ANISOU | 2552 | CD | LYS | H | 76 | 11355 | 10870 | 9333 | 148 | −730 | −1213 | C |
| ATOM | 2553 | CE | LYS | H | 76 | 21.794 | 14.087 | 60.495 | 1.00 | 91.78 | | C |
| ANISOU | 2553 | CE | LYS | H | 76 | 12511 | 12035 | 10327 | 181 | −727 | −1183 | C |
| ATOM | 2554 | NZ | LYS | H | 76 | 20.536 | 14.087 | 61.319 | 1.00 | 97.46 | | N |
| ANISOU | 2554 | NZ | LYS | H | 76 | 13316 | 12753 | 10960 | 246 | −629 | −1215 | N |
| ATOM | 2555 | N | ASN | H | 77 | 23.108 | 13.252 | 53.840 | 1.00 | 55.46 | | N |
| ANISOU | 2555 | N | ASN | H | 77 | 7416 | 7365 | 6292 | 47 | −692 | −1001 | N |
| ATOM | 2556 | CA | ASN | H | 77 | 23.307 | 12.161 | 52.889 | 1.00 | 46.33 | | C |
| ANISOU | 2556 | CA | ASN | H | 77 | 6170 | 6229 | 5203 | 52 | −653 | −935 | C |
| ATOM | 2557 | C | ASN | H | 77 | 22.960 | 10.833 | 53.540 | 1.00 | 43.20 | | C |
| ANISOU | 2557 | C | ASN | H | 77 | 5780 | 5875 | 4758 | 96 | −601 | −893 | C |
| ATOM | 2558 | O | ASN | H | 77 | 23.646 | 9.834 | 53.353 | 1.00 | 46.83 | | O |
| ANISOU | 2558 | O | ASN | H | 77 | 6185 | 6367 | 5239 | 97 | −608 | −835 | O |
| ATOM | 2559 | CB | ASN | H | 77 | 24.741 | 12.136 | 52.353 | 1.00 | 46.42 | | C |
| ANISOU | 2559 | CB | ASN | H | 77 | 6114 | 6256 | 5268 | 6 | −727 | −895 | C |
| ATOM | 2560 | CG | ASN | H | 77 | 24.919 | 13.029 | 51.175 | 1.00 | 50.60 | | C |
| ANISOU | 2560 | CG | ASN | H | 77 | 6603 | 6743 | 5879 | −32 | −740 | −908 | C |
| ATOM | 2561 | OD1 | ASN | H | 77 | 24.088 | 13.896 | 50.929 | 1.00 | 63.82 | | O |
| ANISOU | 2561 | OD1 | ASN | H | 77 | 8314 | 8375 | 7561 | −29 | −716 | −955 | O |
| ATOM | 2562 | ND2 | ASN | H | 77 | 25.985 | 12.808 | 50.404 | 1.00 | 66.26 | | N |
| ANISOU | 2562 | ND2 | ASN | H | 77 | 8509 | 8740 | 7927 | −63 | −773 | −860 | N |
| ATOM | 2563 | N | THR | H | 78 | 21.876 | 10.819 | 54.312 | 1.00 | 43.59 | | N |
| ANISOU | 2563 | N | THR | H | 78 | 5895 | 5922 | 4746 | 137 | −545 | −921 | N |
| ATOM | 2564 | CA | THR | H | 78 | 21.494 | 9.632 | 55.056 | 1.00 | 49.02 | | C |
| ANISOU | 2564 | CA | THR | H | 78 | 6597 | 6647 | 5381 | 178 | −493 | −881 | C |
| ATOM | 2565 | C | THR | H | 78 | 20.052 | 9.238 | 54.781 | 1.00 | 49.16 | | C |
| ANISOU | 2565 | C | THR | H | 78 | 6614 | 6648 | 5419 | 217 | −386 | −882 | C |
| ATOM | 2566 | O | THR | H | 78 | 19.163 | 10.096 | 54.677 | 1.00 | 43.81 | | O |
| ANISOU | 2566 | O | THR | H | 78 | 5967 | 5935 | 4745 | 227 | −353 | −932 | O |
| ATOM | 2567 | CB | THR | H | 78 | 21.708 | 9.846 | 56.565 | 1.00 | 58.44 | | C |
| ANISOU | 2567 | CB | THR | H | 78 | 7880 | 7867 | 6458 | 192 | −532 | −903 | C |
| ATOM | 2568 | OG1 | THR | H | 78 | 23.092 | 10.118 | 56.789 | 1.00 | 61.83 | | O |
| ANISOU | 2568 | OG1 | THR | H | 78 | 8299 | 8315 | 6877 | 151 | −641 | −896 | O |
| ATOM | 2569 | CG2 | THR | H | 78 | 21.306 | 8.608 | 57.367 | 1.00 | 57.18 | | C |
| ANISOU | 2569 | CG2 | THR | H | 78 | 7738 | 7747 | 6241 | 237 | −475 | −854 | C |
| ATOM | 2570 | N | LEU | H | 79 | 19.836 | 7.924 | 54.684 | 1.00 | 47.26 | | N |
| ANISOU | 2570 | N | LEU | H | 79 | 6334 | 6428 | 5193 | 240 | −334 | −824 | N |
| ATOM | 2571 | CA | LEU | H | 79 | 18.526 | 7.327 | 54.472 | 1.00 | 47.77 | | C |
| ANISOU | 2571 | CA | LEU | H | 79 | 6387 | 6480 | 5282 | 274 | −235 | −811 | C |
| ATOM | 2572 | C | LEU | H | 79 | 18.167 | 6.531 | 55.714 | 1.00 | 48.90 | | C |
| ANISOU | 2572 | C | LEU | H | 79 | 6578 | 6656 | 5345 | 312 | −192 | −782 | C |
| ATOM | 2573 | O | LEU | H | 79 | 19.040 | 5.907 | 56.310 | 1.00 | 47.58 | | O |
| ANISOU | 2573 | O | LEU | H | 79 | 6418 | 6525 | 5135 | 312 | −232 | −743 | O |
| ATOM | 2574 | CB | LEU | H | 79 | 18.525 | 6.403 | 53.231 | 1.00 | 48.52 | | C |
| ANISOU | 2574 | CB | LEU | H | 79 | 6399 | 6565 | 5472 | 265 | −207 | −766 | C |
| ATOM | 2575 | CG | LEU | H | 79 | 17.326 | 5.457 | 53.073 | 1.00 | 38.59 | | C |
| ANISOU | 2575 | CG | LEU | H | 79 | 5121 | 5299 | 4244 | 295 | −114 | −738 | C |
| ATOM | 2576 | CD1 | LEU | H | 79 | 16.132 | 6.191 | 52.470 | 1.00 | 39.88 | | C |
| ANISOU | 2576 | CD1 | LEU | H | 79 | 5277 | 5424 | 4451 | 299 | −70 | −779 | C |
| ATOM | 2577 | CD2 | LEU | H | 79 | 17.723 | 4.223 | 52.245 | 1.00 | 43.69 | | C |
| ANISOU | 2577 | CD2 | LEU | H | 79 | 5701 | 5946 | 4954 | 288 | −105 | −683 | C |
| ATOM | 2578 | N | TYR | H | 80 | 16.892 | 6.550 | 56.107 | 1.00 | 44.99 | | N |
| ANISOU | 2578 | N | TYR | H | 80 | 6113 | 6151 | 4831 | 347 | −110 | −795 | N |
| ATOM | 2579 | CA | TYR | H | 80 | 16.456 | 5.833 | 57.304 | 1.00 | 46.86 | | C |
| ANISOU | 2579 | CA | TYR | H | 80 | 6397 | 6418 | 4987 | 386 | −57 | −764 | C |
| ATOM | 2580 | C | TYR | H | 80 | 15.331 | 4.865 | 56.994 | 1.00 | 49.00 | | C |
| ANISOU | 2580 | C | TYR | H | 80 | 6625 | 6680 | 5312 | 409 | 43 | −721 | C |
| ATOM | 2581 | O | TYR | H | 80 | 14.552 | 5.057 | 56.057 | 1.00 | 48.11 | | O |
| ANISOU | 2581 | O | TYR | H | 80 | 6465 | 6533 | 5281 | 404 | 80 | −736 | O |
| ATOM | 2582 | CB | TYR | H | 80 | 15.958 | 6.778 | 58.423 | 1.00 | 47.84 | | C |
| ANISOU | 2582 | CB | TYR | H | 80 | 6616 | 6546 | 5014 | 413 | −42 | −818 | C |
| ATOM | 2583 | CG | TYR | H | 80 | 16.962 | 7.835 | 58.808 | 1.00 | 54.68 | | C |
| ANISOU | 2583 | CG | TYR | H | 80 | 7537 | 7416 | 5824 | 387 | −143 | −869 | C |
| ATOM | 2584 | CD1 | TYR | H | 80 | 18.004 | 7.552 | 59.701 | 1.00 | 55.83 | | C |
| ANISOU | 2584 | CD1 | TYR | H | 80 | 7724 | 7601 | 5887 | 381 | −213 | −850 | C |
| ATOM | 2585 | CD2 | TYR | H | 80 | 16.886 | 9.107 | 58.263 | 1.00 | 53.16 | | C |
| ANISOU | 2585 | CD2 | TYR | H | 80 | 7351 | 7182 | 5665 | 366 | −174 | −935 | C |
| ATOM | 2586 | CE1 | TYR | H | 80 | 18.942 | 8.532 | 60.041 | 1.00 | 57.63 | | C |
| ANISOU | 2586 | CE1 | TYR | H | 80 | 7998 | 7830 | 6070 | 351 | −315 | −898 | C |

TABLE 14-continued

| | | | | | | | | | | | | |
|---|---|---|---|---|---|---|---|---|---|---|---|---|
| ATOM | 2587 | CE2 | TYR | H | 80 | 17.804 | 10.074 | 58.587 | 1.00 | 57.69 | | C |
| ANISOU | 2587 | CE2 | TYR | H | 80 | 7972 | 7752 | 6197 | 337 | −269 | −981 | C |
| ATOM | 2588 | CZ | TYR | H | 80 | 18.827 | 9.787 | 59.479 | 1.00 | 58.41 | | C |
| ANISOU | 2588 | CZ | TYR | H | 80 | 8103 | 7883 | 6208 | 327 | −342 | −964 | C |
| ATOM | 2589 | OH | TYR | H | 80 | 19.714 | 10.777 | 59.784 | 1.00 | 59.02 | | O |
| ANISOU | 2589 | OH | TYR | H | 80 | 8224 | 7952 | 6249 | 293 | −443 | −1013 | O |
| ATOM | 2590 | N | LEU | H | 81 | 15.224 | 3.839 | 57.836 | 1.00 | 49.04 | | N |
| ANISOU | 2590 | N | LEU | H | 81 | 6650 | 6715 | 5270 | 436 | 83 | −667 | N |
| ATOM | 2591 | CA | LEU | H | 81 | 14.040 | 2.997 | 57.890 | 1.00 | 52.73 | | C |
| ANISOU | 2591 | CA | LEU | H | 81 | 7093 | 7173 | 5768 | 462 | 186 | −626 | C |
| ATOM | 2592 | C | LEU | H | 81 | 13.635 | 2.831 | 59.350 | 1.00 | 56.46 | | C |
| ANISOU | 2592 | C | LEU | H | 81 | 7643 | 7679 | 6132 | 503 | 237 | −609 | C |
| ATOM | 2593 | O | LEU | H | 81 | 14.347 | 2.190 | 60.129 | 1.00 | 49.70 | | O |
| ANISOU | 2593 | O | LEU | H | 81 | 6819 | 6857 | 5208 | 512 | 212 | −567 | O |
| ATOM | 2594 | CB | LEU | H | 81 | 14.269 | 1.638 | 57.241 | 1.00 | 46.45 | | C |
| ANISOU | 2594 | CB | LEU | H | 81 | 6230 | 6373 | 5047 | 450 | 196 | −560 | C |
| ATOM | 2595 | CG | LEU | H | 81 | 12.965 | 0.888 | 57.048 | 1.00 | 49.17 | | C |
| ANISOU | 2595 | CG | LEU | H | 81 | 6536 | 6695 | 5449 | 465 | 295 | −526 | C |
| ATOM | 2596 | CD1 | LEU | H | 81 | 12.082 | 1.537 | 55.961 | 1.00 | 47.41 | | C |
| ANISOU | 2596 | CD1 | LEU | H | 81 | 6266 | 6433 | 5315 | 451 | 316 | −570 | C |
| ATOM | 2597 | CD2 | LEU | H | 81 | 13.265 | −0.568 | 56.730 | 1.00 | 51.61 | | C |
| ANISOU | 2597 | CD2 | LEU | H | 81 | 6800 | 7000 | 5809 | 458 | 305 | −456 | C |
| ATOM | 2598 | N | GLN | H | 82 | 12.487 | 3.392 | 59.705 | 1.00 | 54.84 | | N |
| ANISOU | 2598 | N | GLN | H | 82 | 7464 | 7462 | 5910 | 532 | 312 | −639 | N |
| ATOM | 2599 | CA | GLN | H | 82 | 11.909 | 3.246 | 61.037 | 1.00 | 55.66 | | C |
| ANISOU | 2599 | CA | GLN | H | 82 | 7640 | 7595 | 5913 | 577 | 383 | −622 | C |
| ATOM | 2600 | C | GLN | H | 82 | 10.984 | 2.045 | 60.993 | 1.00 | 53.89 | | C |
| ANISOU | 2600 | C | GLN | H | 82 | 7364 | 7367 | 5745 | 593 | 481 | −549 | C |
| ATOM | 2601 | O | GLN | H | 82 | 9.978 | 2.061 | 60.289 | 1.00 | 52.09 | | O |
| ANISOU | 2601 | O | GLN | H | 82 | 7076 | 7107 | 5608 | 591 | 540 | −552 | O |
| ATOM | 2602 | CB | GLN | H | 82 | 11.150 | 4.508 | 61.437 | 1.00 | 62.73 | | C |
| ANISOU | 2602 | CB | GLN | H | 82 | 8592 | 8478 | 6766 | 604 | 420 | −692 | C |
| ATOM | 2603 | CG | GLN | H | 82 | 10.476 | 4.416 | 62.783 | 1.00 | 63.76 | | C |
| ANISOU | 2603 | CG | GLN | H | 82 | 8800 | 8638 | 6789 | 657 | 506 | −678 | C |
| ATOM | 2604 | CD | GLN | H | 82 | 11.483 | 4.148 | 63.879 | 1.00 | 64.35 | | C |
| ANISOU | 2604 | CD | GLN | H | 82 | 8958 | 8758 | 6735 | 665 | 450 | −660 | C |
| ATOM | 2605 | OE1 | GLN | H | 82 | 12.408 | 4.920 | 64.072 | 1.00 | 60.58 | | O |
| ANISOU | 2605 | OE1 | GLN | H | 82 | 8533 | 8286 | 6199 | 648 | 354 | −712 | O |
| ATOM | 2606 | NE2 | GLN | H | 82 | 11.313 | 3.041 | 64.590 | 1.00 | 66.27 | | N |
| ANISOU | 2606 | NE2 | GLN | H | 82 | 9212 | 9031 | 6935 | 689 | 507 | −584 | N |
| ATOM | 2607 | N | MET | H | 83 | 11.330 | 0.994 | 61.704 | 1.00 | 53.31 | | N |
| ANISOU | 2607 | N | MET | H | 83 | 7310 | 7323 | 5623 | 605 | 495 | −481 | N |
| ATOM | 2608 | CA | MET | H | 83 | 10.540 | −0.229 | 61.671 | 1.00 | 57.19 | | C |
| ANISOU | 2608 | CA | MET | H | 83 | 7752 | 7806 | 6172 | 614 | 583 | −405 | C |
| ATOM | 2609 | C | MET | H | 83 | 9.829 | −0.384 | 63.012 | 1.00 | 54.52 | | C |
| ANISOU | 2609 | C | MET | H | 83 | 7481 | 7498 | 5736 | 662 | 676 | −373 | C |
| ATOM | 2610 | O | MET | H | 83 | 10.474 | −0.579 | 64.044 | 1.00 | 55.08 | | O |
| ANISOU | 2610 | O | MET | H | 83 | 7627 | 7609 | 5693 | 682 | 654 | −351 | O |
| ATOM | 2611 | CB | MET | H | 83 | 11.437 | −1.422 | 61.364 | 1.00 | 55.69 | | C |
| ANISOU | 2611 | CB | MET | H | 83 | 7525 | 7617 | 6016 | 592 | 537 | −342 | C |
| ATOM | 2612 | CG | MET | H | 83 | 12.444 | −1.128 | 60.274 | 1.00 | 58.04 | | C |
| ANISOU | 2612 | CG | MET | H | 83 | 7780 | 7898 | 6374 | 552 | 434 | −378 | C |
| ATOM | 2613 | SD | MET | H | 83 | 13.776 | −2.346 | 60.285 | 1.00 | 58.10 | | S |
| ANISOU | 2613 | SD | MET | H | 83 | 7772 | 7921 | 6382 | 541 | 370 | −308 | S |
| ATOM | 2614 | CE | MET | H | 83 | 12.858 | −3.760 | 59.741 | 1.00 | 51.12 | | C |
| ANISOU | 2614 | CE | MET | H | 83 | 6819 | 6999 | 5607 | 539 | 459 | −238 | C |
| ATOM | 2615 | N | ASN | H | 84 | 8.509 | −0.280 | 62.993 | 1.00 | 60.20 | | N |
| ANISOU | 2615 | N | ASN | H | 84 | 8173 | 8200 | 6499 | 682 | 779 | −370 | N |
| ATOM | 2616 | CA | ASN | H | 84 | 7.690 | −0.423 | 64.180 | 1.00 | 63.65 | | C |
| ANISOU | 2616 | CA | ASN | H | 84 | 8664 | 8664 | 6856 | 731 | 885 | −336 | C |
| ATOM | 2617 | C | ASN | H | 84 | 6.869 | −1.694 | 64.094 | 1.00 | 69.52 | | C |
| ANISOU | 2617 | C | ASN | H | 84 | 9341 | 9394 | 7681 | 730 | 977 | −246 | C |
| ATOM | 2618 | O | ASN | H | 84 | 6.604 | −2.219 | 63.009 | 1.00 | 68.25 | | O |
| ANISOU | 2618 | O | ASN | H | 84 | 9086 | 9194 | 7651 | 694 | 970 | −229 | O |
| ATOM | 2619 | CB | ASN | H | 84 | 6.756 | 0.773 | 64.345 | 1.00 | 68.13 | | C |
| ANISOU | 2619 | CB | ASN | H | 84 | 9255 | 9223 | 7408 | 762 | 944 | −401 | C |
| ATOM | 2620 | CG | ASN | H | 84 | 7.504 | 2.034 | 64.635 | 1.00 | 66.34 | | C |
| ANISOU | 2620 | CG | ASN | H | 84 | 9112 | 9006 | 7088 | 767 | 863 | −489 | C |
| ATOM | 2621 | OD1 | ASN | H | 84 | 8.473 | 2.032 | 65.398 | 1.00 | 62.68 | | O |
| ANISOU | 2621 | OD1 | ASN | H | 84 | 8728 | 8577 | 6511 | 772 | 801 | −491 | O |
| ATOM | 2622 | ND2 | ASN | H | 84 | 7.076 | 3.125 | 64.019 | 1.00 | 67.86 | | N |
| ANISOU | 2622 | ND2 | ASN | H | 84 | 9286 | 9167 | 7330 | 765 | 856 | −561 | N |
| ATOM | 2623 | N | SER | H | 85 | 6.457 | −2.170 | 65.261 | 1.00 | 72.43 | | N |
| ANISOU | 2623 | N | SER | H | 85 | 9761 | 9794 | 7966 | 770 | 1063 | −189 | N |
| ATOM | 2624 | CA | SER | H | 85 | 5.576 | −3.329 | 65.364 | 1.00 | 76.44 | | C |
| ANISOU | 2624 | CA | SER | H | 85 | 10212 | 10289 | 8542 | 773 | 1165 | −97 | C |
| ATOM | 2625 | C | SER | H | 85 | 6.191 | −4.525 | 64.641 | 1.00 | 69.43 | | C |
| ANISOU | 2625 | C | SER | H | 85 | 9262 | 9375 | 7742 | 729 | 1110 | −42 | C |
| ATOM | 2626 | O | SER | H | 85 | 5.537 | −5.228 | 63.864 | 1.00 | 63.28 | | O |
| ANISOU | 2626 | O | SER | H | 85 | 8393 | 8555 | 7094 | 702 | 1146 | −6 | O |

TABLE 14-continued

| | | | | | | | | | | | | |
|---|---|---|---|---|---|---|---|---|---|---|---|---|
| ATOM | 2627 | CB | SER | H | 85 | 4.178 | −2.999 | 64.834 | 1.00 | 76.43 | | C |
| ANISOU | 2627 | CB | SER | H | 85 | 10135 | 10257 | 8648 | 775 | 1254 | −109 | C |
| ATOM | 2628 | OG | SER | H | 85 | 3.371 | −4.163 | 64.767 | 1.00 | 79.11 | | O |
| ANISOU | 2628 | OG | SER | H | 85 | 10404 | 10576 | 9077 | 765 | 1339 | −20 | O |
| ATOM | 2629 | N | LEU | H | 86 | 7.478 | −4.735 | 64.910 | 1.00 | 60.02 | | N |
| ANISOU | 2629 | N | LEU | H | 86 | 8122 | 8207 | 6477 | 725 | 1019 | −38 | N |
| ATOM | 2630 | CA | LEU | H | 86 | 8.247 | −5.759 | 64.219 | 1.00 | 59.21 | | C |
| ANISOU | 2630 | CA | LEU | H | 86 | 7968 | 8079 | 6449 | 689 | 956 | 5 | C |
| ATOM | 2631 | C | LEU | H | 86 | 7.713 | −7.150 | 64.526 | 1.00 | 62.55 | | C |
| ANISOU | 2631 | C | LEU | H | 86 | 8362 | 8487 | 6918 | 693 | 1038 | 109 | C |
| ATOM | 2632 | O | LEU | H | 86 | 7.361 | −7.458 | 65.663 | 1.00 | 65.80 | | O |
| ANISOU | 2632 | O | LEU | H | 86 | 8827 | 8929 | 7246 | 728 | 1113 | 165 | O |
| ATOM | 2633 | CB | LEU | H | 86 | 9.718 | −5.664 | 64.620 | 1.00 | 51.91 | | C |
| ANISOU | 2633 | CB | LEU | H | 86 | 7107 | 7190 | 5428 | 692 | 849 | −4 | C |
| ATOM | 2634 | CG | LEU | H | 86 | 10.515 | −4.545 | 63.958 | 1.00 | 59.09 | | C |
| ANISOU | 2634 | CG | LEU | H | 86 | 8019 | 8100 | 6335 | 670 | 742 | −97 | C |
| ATOM | 2635 | CD1 | LEU | H | 86 | 11.892 | −4.341 | 64.638 | 1.00 | 59.67 | | C |
| ANISOU | 2635 | CD1 | LEU | H | 86 | 8163 | 8216 | 6293 | 677 | 642 | −103 | C |
| ATOM | 2636 | CD2 | LEU | H | 86 | 10.678 | −4.854 | 62.473 | 1.00 | 52.63 | | C |
| ANISOU | 2636 | CD2 | LEU | H | 86 | 7105 | 7232 | 5660 | 625 | 699 | −111 | C |
| ATOM | 2637 | N | ARG | H | 87 | 7.670 | −7.994 | 63.502 | 1.00 | 59.05 | | N |
| ANISOU | 2637 | N | ARG | H | 87 | 7837 | 7994 | 6608 | 654 | 1023 | 135 | N |
| ATOM | 2638 | CA | ARG | H | 87 | 7.252 | −9.383 | 63.577 | 1.00 | 59.53 | | C |
| ANISOU | 2638 | CA | ARG | H | 87 | 7858 | 8023 | 6736 | 646 | 1085 | 230 | C |
| ATOM | 2639 | C | ARG | H | 87 | 8.441 | −10.294 | 63.262 | 1.00 | 67.56 | | C |
| ANISOU | 2639 | C | ARG | H | 87 | 8873 | 9026 | 7772 | 632 | 1006 | 265 | C |
| ATOM | 2640 | O | ARG | H | 87 | 9.524 | −9.836 | 62.872 | 1.00 | 69.75 | | O |
| ANISOU | 2640 | O | ARG | H | 87 | 9165 | 9316 | 8022 | 624 | 905 | 214 | O |
| ATOM | 2641 | CB | ARG | H | 87 | 6.100 | −9.646 | 62.603 | 1.00 | 66.37 | | C |
| ANISOU | 2641 | CB | ARG | H | 87 | 8629 | 8834 | 7754 | 612 | 1137 | 228 | C |
| ATOM | 2642 | CG | ARG | H | 87 | 5.032 | −8.560 | 62.538 | 1.00 | 63.48 | | C |
| ANISOU | 2642 | CG | ARG | H | 87 | 8245 | 8476 | 7400 | 622 | 1191 | 174 | C |
| ATOM | 2643 | CD | ARG | H | 87 | 3.856 | −9.041 | 61.684 | 1.00 | 70.51 | | C |
| ANISOU | 2643 | CD | ARG | H | 87 | 9034 | 9311 | 8445 | 587 | 1244 | 194 | C |
| ATOM | 2644 | NE | ARG | H | 87 | 2.933 | −7.958 | 61.378 | 1.00 | 73.51 | | N |
| ANISOU | 2644 | NE | ARG | H | 87 | 9382 | 9693 | 8855 | 593 | 1275 | 135 | N |
| ATOM | 2645 | CZ | ARG | H | 87 | 2.573 | −7.600 | 60.148 | 1.00 | 79.95 | | C |
| ANISOU | 2645 | CZ | ARG | H | 87 | 10128 | 10471 | 9779 | 558 | 1233 | 82 | C |
| ATOM | 2646 | NH1 | ARG | H | 87 | 3.053 | −8.253 | 59.095 | 1.00 | 85.12 | | N |
| ANISOU | 2646 | NH1 | ARG | H | 87 | 10740 | 11083 | 10517 | 514 | 1160 | 78 | N |
| ATOM | 2647 | NH2 | ARG | H | 87 | 1.722 | −6.593 | 59.966 | 1.00 | 80.84 | | N |
| ANISOU | 2647 | NH2 | ARG | H | 87 | 10214 | 10588 | 9914 | 569 | 1265 | 35 | N |
| ATOM | 2648 | N | ALA | H | 88 | 8.232 | −11.604 | 63.414 | 1.00 | 63.92 | | N |
| ANISOU | 2648 | N | ALA | H | 88 | 8389 | 8533 | 7363 | 628 | 1053 | 355 | N |
| ATOM | 2649 | CA | ALA | H | 88 | 9.299 | −12.546 | 63.085 | 1.00 | 63.37 | | C |
| ANISOU | 2649 | CA | ALA | H | 88 | 8314 | 8442 | 7323 | 618 | 986 | 393 | C |
| ATOM | 2650 | C | ALA | H | 88 | 9.586 | −12.549 | 61.586 | 1.00 | 68.83 | | C |
| ANISOU | 2650 | C | ALA | H | 88 | 8937 | 9083 | 8132 | 577 | 919 | 334 | C |
| ATOM | 2651 | O | ALA | H | 88 | 10.748 | −12.597 | 61.178 | 1.00 | 64.53 | | O |
| ANISOU | 2651 | O | ALA | H | 88 | 8397 | 8541 | 7581 | 575 | 833 | 315 | O |
| ATOM | 2652 | CB | ALA | H | 88 | 8.946 | −13.950 | 63.584 | 1.00 | 61.70 | | C |
| ANISOU | 2652 | CB | ALA | H | 88 | 8096 | 8200 | 7147 | 624 | 1057 | 503 | C |
| ATOM | 2653 | N | GLU | H | 89 | 8.544 | −12.462 | 60.751 | 1.00 | 72.27 | | N |
| ANISOU | 2653 | N | GLU | H | 89 | 9309 | 9477 | 8675 | 546 | 958 | 306 | N |
| ATOM | 2654 | CA | GLU | H | 89 | 8.706 | −12.363 | 59.297 | 1.00 | 69.32 | | C |
| ANISOU | 2654 | CA | GLU | H | 89 | 8877 | 9058 | 8404 | 508 | 897 | 244 | C |
| ATOM | 2655 | C | GLU | H | 89 | 9.593 | −11.199 | 58.863 | 1.00 | 58.42 | | C |
| ANISOU | 2655 | C | GLU | H | 89 | 7515 | 7711 | 6972 | 509 | 808 | 159 | C |
| ATOM | 2656 | O | GLU | H | 89 | 10.000 | −11.151 | 57.702 | 1.00 | 60.02 | | O |
| ANISOU | 2656 | O | GLU | H | 89 | 7679 | 7882 | 7242 | 483 | 749 | 114 | O |
| ATOM | 2657 | CB | GLU | H | 89 | 7.334 | −12.199 | 58.619 | 1.00 | 77.82 | | C |
| ANISOU | 2657 | CB | GLU | H | 89 | 9889 | 10096 | 9584 | 478 | 950 | 222 | C |
| ATOM | 2658 | CG | GLU | H | 89 | 6.280 | −13.248 | 58.970 | 1.00 | 87.03 | | C |
| ANISOU | 2658 | CG | GLU | H | 89 | 11022 | 11224 | 10820 | 469 | 1043 | 303 | C |
| ATOM | 2659 | CD | GLU | H | 89 | 5.237 | −12.721 | 59.951 | 1.00 | 93.80 | | C |
| ANISOU | 2659 | CD | GLU | H | 89 | 11891 | 12119 | 11629 | 493 | 1137 | 326 | C |
| ATOM | 2660 | OE1 | GLU | H | 89 | 5.554 | −12.652 | 61.166 | 1.00 | 92.85 | | O |
| ANISOU | 2660 | OE1 | GLU | H | 89 | 11839 | 12049 | 11393 | 533 | 1169 | 365 | O |
| ATOM | 2661 | OE2 | GLU | H | 89 | 4.114 | −12.365 | 59.502 | 1.00 | 93.08 | | O |
| ANISOU | 2661 | OE2 | GLU | H | 89 | 11743 | 12008 | 11616 | 473 | 1179 | 304 | O |
| ATOM | 2662 | N | ASP | H | 90 | 9.866 | −10.243 | 59.733 | 1.00 | 59.57 | | N |
| ANISOU | 2662 | N | ASP | H | 90 | 7719 | 7915 | 7001 | 537 | 797 | 134 | N |
| ATOM | 2663 | CA | ASP | H | 90 | 10.701 | −9.123 | 59.359 | 1.00 | 53.79 | | C |
| ANISOU | 2663 | CA | ASP | H | 90 | 7004 | 7209 | 6224 | 533 | 711 | 56 | C |
| ATOM | 2664 | C | ASP | H | 90 | 12.181 | −9.408 | 59.526 | 1.00 | 53.23 | | C |
| ANISOU | 2664 | C | ASP | H | 90 | 6961 | 7160 | 6103 | 542 | 630 | 72 | C |
| ATOM | 2665 | O | ASP | H | 90 | 12.982 | −8.596 | 59.072 | 1.00 | 51.47 | | O |
| ANISOU | 2665 | O | ASP | H | 90 | 6740 | 6953 | 5862 | 533 | 552 | 13 | O |
| ATOM | 2666 | CB | ASP | H | 90 | 10.366 | −7.873 | 60.178 | 1.00 | 51.42 | | C |
| ANISOU | 2666 | CB | ASP | H | 90 | 6758 | 6956 | 5822 | 557 | 728 | 11 | C |

TABLE 14-continued

| | | | | | | | | | | | | |
|---|---|---|---|---|---|---|---|---|---|---|---|---|
| ATOM | 2667 | CG | ASP | H | 90 | 8.936 | −7.399 | 59.989 | 1.00 | 58.89 | | C |
| ANISOU | 2667 | CG | ASP | H | 90 | 7673 | 7885 | 6819 | 554 | 806 | −13 | C |
| ATOM | 2668 | OD1 | ASP | H | 90 | 8.383 | −7.484 | 58.858 | 1.00 | 55.47 | | O |
| ANISOU | 2668 | OD1 | ASP | H | 90 | 7169 | 7406 | 6499 | 522 | 807 | −35 | O |
| ATOM | 2669 | OD2 | ASP | H | 90 | 8.371 | −6.921 | 61.004 | 1.00 | 57.48 | | O |
| ANISOU | 2669 | OD2 | ASP | H | 90 | 7541 | 7739 | 6559 | 585 | 866 | −8 | O |
| ATOM | 2670 | N | THR | H | 91 | 12.555 | −10.508 | 60.179 | 1.00 | 52.46 | | N |
| ANISOU | 2670 | N | THR | H | 91 | 6883 | 7065 | 5986 | 561 | 646 | 154 | N |
| ATOM | 2671 | CA | THR | H | 91 | 13.963 | −10.887 | 60.296 | 1.00 | 50.08 | | C |
| ANISOU | 2671 | CA | THR | H | 91 | 6597 | 6781 | 5652 | 572 | 568 | 179 | C |
| ATOM | 2672 | C | THR | H | 91 | 14.569 | −11.053 | 58.914 | 1.00 | 45.63 | | C |
| ANISOU | 2672 | C | THR | H | 91 | 5974 | 6177 | 5187 | 545 | 511 | 144 | C |
| ATOM | 2673 | O | THR | H | 91 | 14.083 | −11.844 | 58.102 | 1.00 | 47.15 | | O |
| ANISOU | 2673 | O | THR | H | 91 | 6120 | 6313 | 5483 | 527 | 545 | 158 | O |
| ATOM | 2674 | CB | THR | H | 91 | 14.102 | −12.187 | 61.100 | 1.00 | 57.72 | | C |
| ANISOU | 2674 | CB | THR | H | 91 | 7584 | 7743 | 6602 | 597 | 605 | 281 | C |
| ATOM | 2675 | OG1 | THR | H | 91 | 13.999 | −11.907 | 62.505 | 1.00 | 64.30 | | O |
| ANISOU | 2675 | OG1 | THR | H | 91 | 8491 | 8632 | 7309 | 630 | 629 | 313 | O |
| ATOM | 2676 | CG2 | THR | H | 91 | 15.438 | −12.860 | 60.838 | 1.00 | 51.35 | | C |
| ANISOU | 2676 | CG2 | THR | H | 91 | 6766 | 6931 | 5813 | 605 | 532 | 313 | C |
| ATOM | 2677 | N | ALA | H | 92 | 15.640 | −10.322 | 58.646 | 1.00 | 50.82 | | N |
| ANISOU | 2677 | N | ALA | H | 92 | 6635 | 6863 | 5812 | 542 | 426 | 99 | N |
| ATOM | 2678 | CA | ALA | H | 92 | 16.169 | −10.320 | 57.294 | 1.00 | 41.04 | | C |
| ANISOU | 2678 | CA | ALA | H | 92 | 5343 | 5591 | 4661 | 518 | 380 | 59 | C |
| ATOM | 2679 | C | ALA | H | 92 | 17.442 | −9.495 | 57.274 | 1.00 | 49.51 | | C |
| ANISOU | 2679 | C | ALA | H | 92 | 6424 | 6705 | 5683 | 518 | 288 | 25 | C |
| ATOM | 2680 | O | ALA | H | 92 | 17.722 | −8.708 | 58.182 | 1.00 | 44.80 | | O |
| ANISOU | 2680 | O | ALA | H | 92 | 5874 | 6158 | 4988 | 529 | 257 | 12 | O |
| ATOM | 2681 | CB | ALA | H | 92 | 15.180 | −9.744 | 56.269 | 1.00 | 43.06 | | C |
| ANISOU | 2681 | CB | ALA | H | 92 | 5561 | 5811 | 4987 | 487 | 407 | −5 | C |
| ATOM | 2682 | N | VAL | H | 93 | 18.206 | −9.682 | 56.209 | 1.00 | 42.94 | | N |
| ANISOU | 2682 | N | VAL | H | 93 | 5546 | 5850 | 4920 | 506 | 246 | 10 | N |
| ATOM | 2683 | CA | VAL | H | 93 | 19.234 | −8.726 | 55.841 | 1.00 | 46.26 | | C |
| ANISOU | 2683 | CA | VAL | H | 93 | 5956 | 6300 | 5320 | 494 | 165 | −36 | C |
| ATOM | 2684 | C | VAL | H | 93 | 18.550 | −7.604 | 55.071 | 1.00 | 44.10 | | C |
| ANISOU | 2684 | C | VAL | H | 93 | 5671 | 6015 | 5070 | 464 | 168 | −116 | C |
| ATOM | 2685 | O | VAL | H | 93 | 17.902 | −7.848 | 54.051 | 1.00 | 45.64 | | O |
| ANISOU | 2685 | O | VAL | H | 93 | 5831 | 6165 | 5347 | 448 | 203 | −137 | O |
| ATOM | 2686 | CB | VAL | H | 93 | 20.345 | −9.391 | 55.007 | 1.00 | 42.11 | | C |
| ANISOU | 2686 | CB | VAL | H | 93 | 5383 | 5756 | 4860 | 498 | 127 | −14 | C |
| ATOM | 2687 | CG1 | VAL | H | 93 | 21.402 | −8.354 | 54.594 | 1.00 | 43.24 | | C |
| ANISOU | 2687 | CG1 | VAL | H | 93 | 5507 | 5931 | 4991 | 482 | 48 | −58 | C |
| ATOM | 2688 | CG2 | VAL | H | 93 | 21.022 | −10.516 | 55.823 | 1.00 | 37.88 | | C |
| ANISOU | 2688 | CG2 | VAL | H | 93 | 4858 | 5230 | 4303 | 533 | 123 | 72 | C |
| ATOM | 2689 | N | TYR | H | 94 | 18.695 | −6.373 | 55.552 | 1.00 | 41.54 | | N |
| ANISOU | 2689 | N | TYR | H | 94 | 5379 | 5728 | 4676 | 457 | 129 | −162 | N |
| ATOM | 2690 | CA | TYR | H | 94 | 18.116 | −5.214 | 54.899 | 1.00 | 43.50 | | C |
| ANISOU | 2690 | CA | TYR | H | 94 | 5621 | 5966 | 4943 | 432 | 127 | −236 | C |
| ATOM | 2691 | C | TYR | H | 94 | 19.225 | −4.480 | 54.179 | 1.00 | 44.12 | | C |
| ANISOU | 2691 | C | TYR | H | 94 | 5673 | 6054 | 5037 | 412 | 49 | −271 | C |
| ATOM | 2692 | O | TYR | H | 94 | 20.246 | −4.142 | 54.777 | 1.00 | 45.85 | | O |
| ANISOU | 2692 | O | TYR | H | 94 | 5910 | 6311 | 5202 | 414 | −14 | −263 | O |
| ATOM | 2693 | CB | TYR | H | 94 | 17.415 | −4.287 | 55.898 | 1.00 | 46.14 | | C |
| ANISOU | 2693 | CB | TYR | H | 94 | 6012 | 6327 | 5194 | 441 | 145 | −266 | C |
| ATOM | 2694 | CG | TYR | H | 94 | 16.114 | −4.848 | 56.414 | 1.00 | 43.73 | | C |
| ANISOU | 2694 | CG | TYR | H | 94 | 5722 | 6007 | 4888 | 458 | 237 | −238 | C |
| ATOM | 2695 | CD1 | TYR | H | 94 | 16.109 | −5.919 | 57.284 | 1.00 | 44.69 | | C |
| ANISOU | 2695 | CD1 | TYR | H | 94 | 5863 | 6138 | 4977 | 483 | 272 | −166 | C |
| ATOM | 2696 | CD2 | TYR | H | 94 | 14.887 | −4.323 | 56.014 | 1.00 | 43.39 | | C |
| ANISOU | 2696 | CD2 | TYR | H | 94 | 5667 | 5940 | 4882 | 449 | 289 | −278 | C |
| ATOM | 2697 | CE1 | TYR | H | 94 | 14.957 | −6.453 | 57.744 | 1.00 | 42.13 | | C |
| ANISOU | 2697 | CE1 | TYR | H | 94 | 5548 | 5801 | 4659 | 497 | 359 | −133 | C |
| ATOM | 2698 | CE2 | TYR | H | 94 | 13.709 | −4.857 | 56.478 | 1.00 | 44.79 | | C |
| ANISOU | 2698 | CE2 | TYR | H | 94 | 5847 | 6104 | 5067 | 464 | 375 | −246 | C |
| ATOM | 2699 | CZ | TYR | H | 94 | 13.760 | −5.927 | 57.344 | 1.00 | 44.32 | | C |
| ANISOU | 2699 | CZ | TYR | H | 94 | 5808 | 6056 | 4977 | 487 | 411 | −173 | C |
| ATOM | 2700 | OH | TYR | H | 94 | 12.612 | −6.474 | 57.817 | 1.00 | 50.08 | | O |
| ANISOU | 2700 | OH | TYR | H | 94 | 6538 | 6772 | 5718 | 499 | 501 | −134 | O |
| ATOM | 2701 | N | TYR | H | 95 | 19.015 | −4.284 | 52.899 | 1.00 | 35.91 | | N |
| ANISOU | 2701 | N | TYR | H | 95 | 4591 | 4980 | 4073 | 390 | 54 | −306 | N |
| ATOM | 2702 | CA | TYR | H | 95 | 19.992 | −3.614 | 52.035 | 1.00 | 35.58 | | C |
| ANISOU | 2702 | CA | TYR | H | 95 | 4519 | 4942 | 4059 | 368 | −8 | −336 | C |
| ATOM | 2703 | C | TYR | H | 95 | 19.443 | −2.256 | 51.633 | 1.00 | 44.76 | | C |
| ANISOU | 2703 | C | TYR | H | 95 | 5691 | 6098 | 5219 | 345 | −19 | −405 | C |
| ATOM | 2704 | O | TYR | H | 95 | 18.259 | −2.090 | 51.466 | 1.00 | 35.12 | | O |
| ANISOU | 2704 | O | TYR | H | 95 | 4476 | 4853 | 4014 | 343 | 30 | −428 | O |
| ATOM | 2705 | CB | TYR | H | 95 | 20.177 | −4.411 | 50.753 | 1.00 | 35.39 | | C |
| ANISOU | 2705 | CB | TYR | H | 95 | 4444 | 4880 | 4121 | 364 | 9 | −324 | C |
| ATOM | 2706 | CG | TYR | H | 95 | 20.850 | −5.740 | 50.902 | 1.00 | 37.23 | | C |
| ANISOU | 2706 | CG | TYR | H | 95 | 4661 | 5110 | 4374 | 389 | 17 | −260 | C |

TABLE 14-continued

| | | | | | | | | | | | | |
|---|---|---|---|---|---|---|---|---|---|---|---|---|
| ATOM | 2707 | CD1 | TYR | H | 95 | 22.208 | −5.834 | 51.095 | 1.00 | 41.65 | | C |
| ANISOU | 2707 | CD1 | TYR | H | 95 | 5205 | 5699 | 4922 | 399 | −37 | −230 | C |
| ATOM | 2708 | CD2 | TYR | H | 95 | 20.124 | −6.899 | 50.827 | 1.00 | 41.37 | | C |
| ANISOU | 2708 | CD2 | TYR | H | 95 | 5184 | 5598 | 4937 | 403 | 77 | −228 | C |
| ATOM | 2709 | CE1 | TYR | H | 95 | 22.827 | −7.057 | 51.227 | 1.00 | 37.70 | | C |
| ANISOU | 2709 | CE1 | TYR | H | 95 | 4687 | 5192 | 4445 | 427 | −28 | −169 | C |
| ATOM | 2710 | CE2 | TYR | H | 95 | 20.722 | −8.132 | 50.948 | 1.00 | 47.81 | | C |
| ANISOU | 2710 | CE2 | TYR | H | 95 | 5988 | 6402 | 5775 | 428 | 86 | −169 | C |
| ATOM | 2711 | CZ | TYR | H | 95 | 22.079 | −8.205 | 51.145 | 1.00 | 45.52 | | C |
| ANISOU | 2711 | CZ | TYR | H | 95 | 5682 | 6142 | 5470 | 442 | 35 | −139 | C |
| ATOM | 2712 | OH | TYR | H | 95 | 22.661 | −9.404 | 51.252 | 1.00 | 44.88 | | O |
| ANISOU | 2712 | OH | TYR | H | 95 | 5588 | 6048 | 5416 | 472 | 45 | −79 | O |
| ATOM | 2713 | N | CYS | H | 96 | 20.368 | −1.336 | 51.483 | 1.00 | 37.11 | | N |
| ANISOU | 2713 | N | CYS | H | 96 | 4718 | 5147 | 4235 | 326 | −85 | −430 | N |
| ATOM | 2714 | CA | CYS | H | 96 | 20.145 | 0.047 | 51.050 | 1.00 | 41.83 | | C |
| ANISOU | 2714 | CA | CYS | H | 96 | 5323 | 5737 | 4834 | 301 | −110 | −493 | C |
| ATOM | 2715 | C | CYS | H | 96 | 20.512 | 0.078 | 49.569 | 1.00 | 41.11 | | C |
| ANISOU | 2715 | C | CYS | H | 96 | 5178 | 5620 | 4820 | 281 | −120 | −502 | C |
| ATOM | 2716 | O | CYS | H | 96 | 21.510 | −0.502 | 49.245 | 1.00 | 40.40 | | O |
| ANISOU | 2716 | O | CYS | H | 96 | 5056 | 5539 | 4753 | 283 | −142 | −468 | O |
| ATOM | 2717 | CB | CYS | H | 96 | 21.131 | 0.887 | 51.842 | 1.00 | 64.47 | | C |
| ANISOU | 2717 | CB | CYS | H | 96 | 8217 | 8639 | 7639 | 290 | −185 | −504 | C |
| ATOM | 2718 | SG | CYS | H | 96 | 21.007 | 2.660 | 51.573 | 1.00 | 81.41 | | S |
| ANISOU | 2718 | SG | CYS | H | 96 | 10384 | 10772 | 9776 | 258 | −227 | −579 | S |
| ATOM | 2719 | N | ALA | H | 97 | 19.699 | 0.674 | 48.705 | 1.00 | 36.38 | | N |
| ANISOU | 2719 | N | ALA | H | 97 | 4572 | 4992 | 4259 | 266 | −99 | −543 | N |
| ATOM | 2720 | CA | ALA | H | 97 | 20.069 | 0.734 | 47.298 | 1.00 | 31.26 | | C |
| ANISOU | 2720 | CA | ALA | H | 97 | 3882 | 4323 | 3673 | 248 | −109 | −551 | C |
| ATOM | 2721 | C | ALA | H | 97 | 19.626 | 2.065 | 46.751 | 1.00 | 36.41 | | C |
| ANISOU | 2721 | C | ALA | H | 97 | 4541 | 4959 | 4335 | 226 | −126 | −603 | C |
| ATOM | 2722 | O | ALA | H | 97 | 18.812 | 2.766 | 47.353 | 1.00 | 45.25 | | O |
| ANISOU | 2722 | O | ALA | H | 97 | 5694 | 6075 | 5424 | 228 | −116 | −634 | O |
| ATOM | 2723 | CB | ALA | H | 97 | 19.485 | −0.412 | 46.466 | 1.00 | 30.43 | | C |
| ANISOU | 2723 | CB | ALA | H | 97 | 3752 | 4186 | 3623 | 259 | −58 | −532 | C |
| ATOM | 2724 | N | THR | H | 98 | 20.184 | 2.426 | 45.617 | 1.00 | 35.38 | | N |
| ANISOU | 2724 | N | THR | H | 98 | 4381 | 4819 | 4245 | 206 | −148 | −611 | N |
| ATOM | 2725 | CA | THR | H | 98 | 19.928 | 3.730 | 45.047 | 1.00 | 43.20 | | C |
| ANISOU | 2725 | CA | THR | H | 98 | 5375 | 5792 | 5246 | 183 | −170 | −653 | C |
| ATOM | 2726 | C | THR | H | 98 | 19.704 | 3.582 | 43.548 | 1.00 | 39.75 | | C |
| ANISOU | 2726 | C | THR | H | 98 | 4909 | 5328 | 4865 | 175 | −153 | −657 | C |
| ATOM | 2727 | O | THR | H | 98 | 20.176 | 2.620 | 42.922 | 1.00 | 40.64 | | O |
| ANISOU | 2727 | O | THR | H | 98 | 4996 | 5441 | 5005 | 182 | −139 | −628 | O |
| ATOM | 2728 | CB | THR | H | 98 | 21.080 | 4.694 | 45.361 | 1.00 | 50.62 | | C |
| ANISOU | 2728 | CB | THR | H | 98 | 6317 | 6751 | 6164 | 160 | −234 | −659 | C |
| ATOM | 2729 | OG1 | THR | H | 98 | 20.627 | 6.043 | 45.139 | 1.00 | 58.86 | | O |
| ANISOU | 2729 | OG1 | THR | H | 98 | 7381 | 7774 | 7210 | 141 | −252 | −704 | O |
| ATOM | 2730 | CG2 | THR | H | 98 | 22.303 | 4.420 | 44.480 | 1.00 | 40.26 | | C |
| ANISOU | 2730 | CG2 | THR | H | 98 | 4958 | 5448 | 4891 | 148 | −255 | −628 | C |
| ATOM | 2731 | N | GLY | H | 99 | 19.008 | 4.569 | 42.970 | 1.00 | 34.77 | | N |
| ANISOU | 2731 | N | GLY | H | 99 | 4285 | 4674 | 4250 | 161 | −157 | −693 | N |
| ATOM | 2732 | CA | GLY | H | 99 | 18.638 | 4.574 | 41.565 | 1.00 | 31.30 | | C |
| ANISOU | 2732 | CA | GLY | H | 99 | 3828 | 4210 | 3856 | 152 | −146 | −700 | C |
| ATOM | 2733 | C | GLY | H | 99 | 18.357 | 5.998 | 41.170 | 1.00 | 34.45 | | C |
| ANISOU | 2733 | C | GLY | H | 99 | 4237 | 4593 | 4261 | 134 | −172 | −733 | C |
| ATOM | 2734 | O | GLY | H | 99 | 18.238 | 6.873 | 42.029 | 1.00 | 35.84 | | O |
| ANISOU | 2734 | O | GLY | H | 99 | 4438 | 4770 | 4409 | 131 | −190 | −755 | O |
| ATOM | 2735 | N | LYS | H | 100 | 18.229 | 6.226 | 39.879 | 1.00 | 31.37 | | N |
| ANISOU | 2735 | N | LYS | H | 100 | 3833 | 4183 | 3903 | 123 | −173 | −738 | N |
| ATOM | 2736 | CA | LYS | H | 100 | 18.013 | 7.575 | 39.329 | 1.00 | 35.43 | | C |
| ANISOU | 2736 | CA | LYS | H | 100 | 4356 | 4678 | 4429 | 105 | −199 | −762 | C |
| ATOM | 2737 | C | LYS | H | 100 | 16.560 | 8.018 | 39.461 | 1.00 | 37.44 | | C |
| ANISOU | 2737 | C | LYS | H | 100 | 4626 | 4908 | 4694 | 116 | −183 | −791 | C |
| ATOM | 2738 | O | LYS | H | 100 | 16.289 | 9.116 | 39.115 | 1.00 | 40.26 | | O |
| ANISOU | 2738 | O | LYS | H | 100 | 4992 | 5245 | 5061 | 106 | −202 | −810 | O |
| ATOM | 2739 | CB | LYS | H | 100 | 18.432 | 7.589 | 37.869 | 1.00 | 40.19 | | C |
| ANISOU | 2739 | CB | LYS | H | 100 | 4939 | 5272 | 5058 | 92 | −204 | −749 | C |
| ATOM | 2740 | CG | LYS | H | 100 | 19.807 | 8.158 | 37.622 | 1.00 | 60.93 | | C |
| ANISOU | 2740 | CG | LYS | H | 100 | 7553 | 7913 | 7684 | 71 | −233 | −730 | C |
| ATOM | 2741 | CD | LYS | H | 100 | 20.893 | 7.133 | 37.609 | 1.00 | 68.99 | | C |
| ANISOU | 2741 | CD | LYS | H | 100 | 8549 | 8962 | 8704 | 78 | −222 | −696 | C |
| ATOM | 2742 | CE | LYS | H | 100 | 22.275 | 7.759 | 37.576 | 1.00 | 65.59 | | C |
| ANISOU | 2742 | CE | LYS | H | 100 | 8095 | 8548 | 8278 | 56 | −253 | −673 | C |
| ATOM | 2743 | NZ | LYS | H | 100 | 23.042 | 7.432 | 38.793 | 1.00 | 62.93 | | N |
| ANISOU | 2743 | NZ | LYS | H | 100 | 7749 | 8238 | 7922 | 58 | −273 | −658 | N |
| ATOM | 2744 | N | GLY | H | 101 | 15.682 | 7.160 | 39.931 | 1.00 | 36.19 | | N |
| ANISOU | 2744 | N | GLY | H | 101 | 4466 | 4749 | 4536 | 136 | −147 | −789 | N |
| ATOM | 2745 | CA | GLY | H | 101 | 14.274 | 7.511 | 40.107 | 1.00 | 27.16 | | C |
| ANISOU | 2745 | CA | GLY | H | 101 | 3327 | 3585 | 3409 | 149 | −126 | −810 | C |
| ATOM | 2746 | C | GLY | H | 101 | 13.584 | 6.395 | 40.842 | 1.00 | 30.87 | | C |
| ANISOU | 2746 | C | GLY | H | 101 | 3791 | 4061 | 3876 | 169 | −83 | −796 | C |

TABLE 14-continued

| | | | | | | | | | | | | |
|---|---|---|---|---|---|---|---|---|---|---|---|---|
| ATOM | 2747 | O | GLY | H | 101 | 14.062 | 5.258 | 40.861 | 1.00 | 25.74 | | O |
| ANISOU | 2747 | O | GLY | H | 101 | 3132 | 3425 | 3224 | 170 | −70 | −770 | O |
| ATOM | 2748 | N | VAL | H | 102 | 12.394 | 6.694 | 41.386 | 1.00 | 34.06 | | N |
| ANISOU | 2748 | N | VAL | H | 102 | 4199 | 4455 | 4290 | 185 | −55 | −810 | N |
| ATOM | 2749 | CA | VAL | H | 102 | 11.787 | 5.627 | 42.184 | 1.00 | 30.11 | | C |
| ANISOU | 2749 | CA | VAL | H | 102 | 3691 | 3963 | 3787 | 203 | −8 | −790 | C |
| ATOM | 2750 | C | VAL | H | 102 | 11.379 | 4.429 | 41.319 | 1.00 | 30.30 | | C |
| ANISOU | 2750 | C | VAL | H | 102 | 3683 | 3972 | 3856 | 195 | 5 | −769 | C |
| ATOM | 2751 | O | VAL | H | 102 | 11.308 | 3.306 | 41.828 | 1.00 | 38.07 | | O |
| ANISOU | 2751 | O | VAL | H | 102 | 4663 | 4964 | 4841 | 202 | 36 | −743 | O |
| ATOM | 2752 | CB | VAL | H | 102 | 10.569 | 6.127 | 42.994 | 1.00 | 41.05 | | C |
| ANISOU | 2752 | CB | VAL | H | 102 | 5082 | 5341 | 5175 | 226 | 30 | −805 | C |
| ATOM | 2753 | CG1 | VAL | H | 102 | 10.935 | 7.349 | 43.805 | 1.00 | 40.31 | | C |
| ANISOU | 2753 | CG1 | VAL | H | 102 | 5029 | 5253 | 5033 | 235 | 15 | −834 | C |
| ATOM | 2754 | CG2 | VAL | H | 102 | 9.385 | 6.393 | 42.085 | 1.00 | 33.10 | | C |
| ANISOU | 2754 | CG2 | VAL | H | 102 | 4041 | 4305 | 4229 | 224 | 35 | −813 | C |
| ATOM | 2755 | N | HIS | H | 103 | 11.169 | 4.638 | 40.026 | 1.00 | 34.20 | | N |
| ANISOU | 2755 | N | HIS | H | 103 | 4161 | 4446 | 4386 | 179 | −20 | −779 | N |
| ATOM | 2756 | CA | HIS | H | 103 | 10.762 | 3.604 | 39.068 | 1.00 | 29.10 | | C |
| ANISOU | 2756 | CA | HIS | H | 103 | 3493 | 3782 | 3782 | 169 | −18 | −767 | C |
| ATOM | 2757 | C | HIS | H | 103 | 11.927 | 3.016 | 38.257 | 1.00 | 35.81 | | C |
| ANISOU | 2757 | C | HIS | H | 103 | 4350 | 4636 | 4620 | 158 | −38 | −758 | C |
| ATOM | 2758 | O | HIS | H | 103 | 11.683 | 2.303 | 37.280 | 1.00 | 36.95 | | O |
| ANISOU | 2758 | O | HIS | H | 103 | 4486 | 4761 | 4792 | 149 | −44 | −757 | O |
| ATOM | 2759 | CB | HIS | H | 103 | 9.781 | 4.206 | 38.082 | 1.00 | 33.19 | | C |
| ANISOU | 2759 | CB | HIS | H | 103 | 3994 | 4276 | 4342 | 161 | −38 | −785 | C |
| ATOM | 2760 | CG | HIS | H | 103 | 10.370 | 5.368 | 37.345 | 1.00 | 31.37 | | C |
| ANISOU | 2760 | CG | HIS | H | 103 | 3778 | 4045 | 4096 | 152 | −78 | −802 | C |
| ATOM | 2761 | ND1 | HIS | H | 103 | 10.588 | 6.590 | 37.945 | 1.00 | 31.63 | | N |
| ANISOU | 2761 | ND1 | HIS | H | 103 | 3827 | 4084 | 4107 | 159 | −86 | −816 | N |
| ATOM | 2762 | CD2 | HIS | H | 103 | 10.844 | 5.478 | 36.086 | 1.00 | 29.97 | | C |
| ANISOU | 2762 | CD2 | HIS | H | 103 | 3606 | 3861 | 3922 | 137 | −111 | −804 | C |
| ATOM | 2763 | CE1 | HIS | H | 103 | 11.104 | 7.421 | 37.057 | 1.00 | 29.08 | | C |
| ANISOU | 2763 | CE1 | HIS | H | 103 | 3514 | 3755 | 3782 | 146 | −123 | −824 | C |
| ATOM | 2764 | NE2 | HIS | H | 103 | 11.292 | 6.762 | 35.929 | 1.00 | 31.02 | | N |
| ANISOU | 2764 | NE2 | HIS | H | 103 | 3753 | 3996 | 4039 | 134 | −136 | −815 | N |
| ATOM | 2765 | N | LEU | H | 104 | 13.176 | 3.315 | 38.605 | 1.00 | 33.14 | | N |
| ANISOU | 2765 | N | LEU | H | 104 | 4027 | 4321 | 4243 | 159 | −51 | −752 | N |
| ATOM | 2766 | CA | LEU | H | 104 | 14.345 | 2.874 | 37.842 | 1.00 | 33.90 | | C |
| ANISOU | 2766 | CA | LEU | H | 104 | 4125 | 4424 | 4332 | 153 | −65 | −740 | C |
| ATOM | 2767 | C | LEU | H | 104 | 15.198 | 1.900 | 38.658 | 1.00 | 31.49 | | C |
| ANISOU | 2767 | C | LEU | H | 104 | 3820 | 4137 | 4006 | 166 | −47 | −711 | C |
| ATOM | 2768 | O | LEU | H | 104 | 15.102 | 1.836 | 39.877 | 1.00 | 34.65 | | O |
| ANISOU | 2768 | O | LEU | H | 104 | 4227 | 4553 | 4386 | 177 | −33 | −702 | O |
| ATOM | 2769 | CB | LEU | H | 104 | 15.202 | 4.069 | 37.410 | 1.00 | 37.70 | | C |
| ANISOU | 2769 | CB | LEU | H | 104 | 4613 | 4916 | 4796 | 141 | −99 | −748 | C |
| ATOM | 2770 | CG | LEU | H | 104 | 14.463 | 5.083 | 36.533 | 1.00 | 38.56 | | C |
| ANISOU | 2770 | CG | LEU | H | 104 | 4723 | 5005 | 4923 | 130 | −121 | −771 | C |
| ATOM | 2771 | CD1 | LEU | H | 104 | 15.425 | 6.165 | 36.101 | 1.00 | 32.08 | | C |
| ANISOU | 2771 | CD1 | LEU | H | 104 | 3908 | 4191 | 4088 | 117 | −151 | −771 | C |
| ATOM | 2772 | CD2 | LEU | H | 104 | 13.859 | 4.371 | 35.300 | 1.00 | 33.15 | | C |
| ANISOU | 2772 | CD2 | LEU | H | 104 | 4033 | 4298 | 4265 | 127 | −119 | −773 | C |
| ATOM | 2773 | N | GLY | H | 105 | 16.057 | 1.142 | 37.967 | 1.00 | 34.65 | | N |
| ANISOU | 2773 | N | GLY | H | 105 | 4218 | 4538 | 4411 | 168 | −46 | −696 | N |
| ATOM | 2774 | CA | GLY | H | 105 | 16.733 | 0.048 | 38.624 | 1.00 | 38.22 | | C |
| ANISOU | 2774 | CA | GLY | H | 105 | 4667 | 5000 | 4855 | 185 | −26 | −665 | C |
| ATOM | 2775 | C | GLY | H | 105 | 17.695 | 0.540 | 39.695 | 1.00 | 34.18 | | C |
| ANISOU | 2775 | C | GLY | H | 105 | 4156 | 4524 | 4306 | 190 | −42 | −649 | C |
| ATOM | 2776 | O | GLY | H | 105 | 18.014 | 1.722 | 39.777 | 1.00 | 33.01 | | O |
| ANISOU | 2776 | O | GLY | H | 105 | 4011 | 4390 | 4141 | 177 | −71 | −663 | O |
| ATOM | 2777 | N | PHE | H | 106 | 18.023 | −0.373 | 40.590 | 1.00 | 31.21 | | N |
| ANISOU | 2777 | N | PHE | H | 106 | 3780 | 4159 | 3919 | 208 | −25 | −618 | N |
| ATOM | 2778 | CA | PHE | H | 106 | 18.883 | −0.136 | 41.765 | 1.00 | 33.91 | | C |
| ANISOU | 2778 | CA | PHE | H | 106 | 4125 | 4536 | 4221 | 215 | −43 | −598 | C |
| ATOM | 2779 | C | PHE | H | 106 | 20.331 | −0.269 | 41.322 | 1.00 | 33.82 | | C |
| ANISOU | 2779 | C | PHE | H | 106 | 4093 | 4542 | 4214 | 217 | −64 | −575 | C |
| ATOM | 2780 | O | PHE | H | 106 | 20.866 | −1.349 | 41.342 | 1.00 | 35.18 | | O |
| ANISOU | 2780 | O | PHE | H | 106 | 4255 | 4715 | 4398 | 237 | −46 | −543 | O |
| ATOM | 2781 | CB | PHE | H | 106 | 18.518 | −1.131 | 42.857 | 1.00 | 33.36 | | C |
| ANISOU | 2781 | CB | PHE | H | 106 | 4067 | 4469 | 4138 | 235 | −13 | −569 | C |
| ATOM | 2782 | CG | PHE | H | 106 | 17.094 | −1.045 | 43.333 | 1.00 | 37.52 | | C |
| ANISOU | 2782 | CG | PHE | H | 106 | 4608 | 4982 | 4667 | 235 | 16 | −584 | C |
| ATOM | 2783 | CD1 | PHE | H | 106 | 16.287 | 0.005 | 42.966 | 1.00 | 36.86 | | C |
| ANISOU | 2783 | CD1 | PHE | H | 106 | 4528 | 4888 | 4590 | 221 | 9 | −623 | C |
| ATOM | 2784 | CD2 | PHE | H | 106 | 16.570 | −2.004 | 44.163 | 1.00 | 33.75 | | C |
| ANISOU | 2784 | CD2 | PHE | H | 106 | 4138 | 4500 | 4186 | 251 | 54 | −555 | C |
| ATOM | 2785 | CE1 | PHE | H | 106 | 14.988 | 0.093 | 43.422 | 1.00 | 41.34 | | C |
| ANISOU | 2785 | CE1 | PHE | H | 106 | 5101 | 5442 | 5164 | 224 | 40 | −633 | C |
| ATOM | 2786 | CE2 | PHE | H | 106 | 15.268 | −1.921 | 44.606 | 1.00 | 37.66 | | C |
| ANISOU | 2786 | CE2 | PHE | H | 106 | 4639 | 4983 | 4687 | 252 | 87 | −564 | C |

TABLE 14-continued

| | | | | | | | | | | | | |
|---|---|---|---|---|---|---|---|---|---|---|---|---|
| ATOM | 2787 | CZ | PHE | H | 106 | 14.479 | −0.879 | 44.226 | 1.00 | 34.28 | | C |
| ANISOU | 2787 | CZ | PHE | H | 106 | 4210 | 4546 | 4269 | 239 | 81 | −603 | C |
| ATOM | 2788 | N | ASP | H | 107 | 20.923 | 0.850 | 40.958 | 1.00 | 35.17 | | N |
| ANISOU | 2788 | N | ASP | H | 107 | 4257 | 4727 | 4380 | 198 | −98 | −589 | N |
| ATOM | 2789 | CA | ASP | H | 107 | 22.285 | 0.811 | 40.399 | 1.00 | 36.12 | | C |
| ANISOU | 2789 | CA | ASP | H | 107 | 4348 | 4863 | 4514 | 198 | −113 | −564 | C |
| ATOM | 2790 | C | ASP | H | 107 | 23.328 | 0.386 | 41.419 | 1.00 | 34.66 | | C |
| ANISOU | 2790 | C | ASP | H | 107 | 4147 | 4710 | 4311 | 211 | −132 | −525 | C |
| ATOM | 2791 | O | ASP | H | 107 | 24.337 | −0.194 | 41.032 | 1.00 | 36.96 | | O |
| ANISOU | 2791 | O | ASP | H | 107 | 4409 | 5012 | 4623 | 225 | −127 | −492 | O |
| ATOM | 2792 | CB | ASP | H | 107 | 22.709 | 2.162 | 39.875 | 1.00 | 34.96 | | C |
| ANISOU | 2792 | CB | ASP | H | 107 | 4192 | 4722 | 4368 | 170 | −148 | −581 | C |
| ATOM | 2793 | CG | ASP | H | 107 | 21.794 | 2.665 | 38.775 | 1.00 | 41.30 | | C |
| ANISOU | 2793 | CG | ASP | H | 107 | 5009 | 5496 | 5188 | 158 | −136 | −614 | C |
| ATOM | 2794 | OD1 | ASP | H | 107 | 21.520 | 1.895 | 37.826 | 1.00 | 40.25 | | O |
| ANISOU | 2794 | OD1 | ASP | H | 107 | 4876 | 5344 | 5075 | 169 | −106 | −614 | O |
| ATOM | 2795 | OD2 | ASP | H | 107 | 21.392 | 3.840 | 38.865 | 1.00 | 44.37 | | O |
| ANISOU | 2795 | OD2 | ASP | H | 107 | 5410 | 5879 | 5568 | 137 | −161 | −641 | O |
| ATOM | 2796 | N | TYR | H | 108 | 23.143 | 0.714 | 42.686 | 1.00 | 30.49 | | N |
| ANISOU | 2796 | N | TYR | H | 108 | 3640 | 4200 | 3745 | 209 | −154 | −527 | N |
| ATOM | 2797 | CA | TYR | H | 108 | 24.154 | 0.429 | 43.717 | 1.00 | 36.28 | | C |
| ANISOU | 2797 | CA | TYR | H | 108 | 4361 | 4968 | 4454 | 219 | −184 | −489 | C |
| ATOM | 2798 | C | TYR | H | 108 | 23.455 | −0.022 | 44.968 | 1.00 | 35.06 | | C |
| ANISOU | 2798 | C | TYR | H | 108 | 4243 | 4819 | 4258 | 235 | −173 | −484 | C |
| ATOM | 2799 | O | TYR | H | 108 | 22.392 | 0.508 | 45.310 | 1.00 | 37.99 | | O |
| ANISOU | 2799 | O | TYR | H | 108 | 4649 | 5180 | 4608 | 228 | −162 | −518 | O |
| ATOM | 2800 | CB | TYR | H | 108 | 25.016 | 1.667 | 44.059 | 1.00 | 35.36 | | C |
| ANISOU | 2800 | CB | TYR | H | 108 | 4235 | 4876 | 4322 | 190 | −247 | −497 | C |
| ATOM | 2801 | CG | TYR | H | 108 | 25.721 | 2.215 | 42.851 | 1.00 | 49.16 | | C |
| ANISOU | 2801 | CG | TYR | H | 108 | 5946 | 6620 | 6113 | 170 | −256 | −497 | C |
| ATOM | 2802 | CD1 | TYR | H | 108 | 26.916 | 1.630 | 42.379 | 1.00 | 54.48 | | C |
| ANISOU | 2802 | CD1 | TYR | H | 108 | 6571 | 7310 | 6821 | 182 | −254 | −452 | C |
| ATOM | 2803 | CD2 | TYR | H | 108 | 25.206 | 3.303 | 42.172 | 1.00 | 47.83 | | C |
| ANISOU | 2803 | CD2 | TYR | H | 108 | 5790 | 6431 | 5953 | 144 | −261 | −536 | C |
| ATOM | 2804 | CE1 | TYR | H | 108 | 27.557 | 2.127 | 41.239 | 1.00 | 50.15 | | C |
| ANISOU | 2804 | CE1 | TYR | H | 108 | 5987 | 6759 | 6310 | 166 | −252 | −447 | C |
| ATOM | 2805 | CE2 | TYR | H | 108 | 25.830 | 3.803 | 41.041 | 1.00 | 52.06 | | C |
| ANISOU | 2805 | CE2 | TYR | H | 108 | 6294 | 6961 | 6524 | 126 | −264 | −530 | C |
| ATOM | 2806 | CZ | TYR | H | 108 | 27.000 | 3.219 | 40.583 | 1.00 | 59.28 | | C |
| ANISOU | 2806 | CZ | TYR | H | 108 | 7160 | 7894 | 7468 | 137 | −258 | −486 | C |
| ATOM | 2807 | OH | TYR | H | 108 | 27.576 | 3.755 | 39.464 | 1.00 | 56.65 | | O |
| ANISOU | 2807 | OH | TYR | H | 108 | 6798 | 7557 | 7168 | 121 | −253 | −478 | O |
| ATOM | 2808 | N | TRP | H | 109 | 24.049 | −0.993 | 45.640 | 1.00 | 34.72 | | N |
| ANISOU | 2808 | N | TRP | H | 109 | 4192 | 4794 | 4206 | 260 | −172 | −437 | N |
| ATOM | 2809 | CA | TRP | H | 109 | 23.517 | −1.614 | 46.841 | 1.00 | 40.06 | | C |
| ANISOU | 2809 | CA | TRP | H | 109 | 4901 | 5478 | 4840 | 280 | −156 | −418 | C |
| ATOM | 2810 | C | TRP | H | 109 | 24.572 | −1.543 | 47.939 | 1.00 | 39.68 | | C |
| ANISOU | 2810 | C | TRP | H | 109 | 4854 | 5474 | 4750 | 286 | −210 | −385 | C |
| ATOM | 2811 | O | TRP | H | 109 | 25.761 | −1.725 | 47.665 | 1.00 | 38.57 | | O |
| ANISOU | 2811 | O | TRP | H | 109 | 4671 | 5350 | 4635 | 288 | −240 | −353 | O |
| ATOM | 2812 | CB | TRP | H | 109 | 23.207 | −3.096 | 46.641 | 1.00 | 38.46 | | C |
| ANISOU | 2812 | CB | TRP | H | 109 | 4692 | 5252 | 4670 | 310 | −103 | −382 | C |
| ATOM | 2813 | CG | TRP | H | 109 | 22.141 | −3.391 | 45.619 | 1.00 | 38.19 | | C |
| ANISOU | 2813 | CG | TRP | H | 109 | 4659 | 5172 | 4678 | 304 | −54 | −411 | C |
| ATOM | 2814 | CD1 | TRP | H | 109 | 22.138 | −3.026 | 44.334 | 1.00 | 36.45 | | C |
| ANISOU | 2814 | CD1 | TRP | H | 109 | 4422 | 4933 | 4497 | 289 | −52 | −440 | C |
| ATOM | 2815 | CD2 | TRP | H | 109 | 20.950 | −4.162 | 45.829 | 1.00 | 34.47 | | C |
| ANISOU | 2815 | CD2 | TRP | H | 109 | 4208 | 4672 | 4216 | 314 | −3 | −407 | C |
| ATOM | 2816 | NE1 | TRP | H | 109 | 21.003 | −3.526 | 43.690 | 1.00 | 37.20 | | N |
| ANISOU | 2816 | NE1 | TRP | H | 109 | 4525 | 4986 | 4621 | 288 | −9 | −459 | N |
| ATOM | 2817 | CE2 | TRP | H | 109 | 20.264 | −4.227 | 44.600 | 1.00 | 35.35 | | C |
| ANISOU | 2817 | CE2 | TRP | H | 109 | 4311 | 4746 | 4376 | 301 | 20 | −439 | C |
| ATOM | 2818 | CE3 | TRP | H | 109 | 20.409 | −4.813 | 46.929 | 1.00 | 35.56 | | C |
| ANISOU | 2818 | CE3 | TRP | H | 109 | 4370 | 4814 | 4328 | 331 | 23 | −377 | C |
| ATOM | 2819 | CZ2 | TRP | H | 109 | 19.059 | −4.921 | 44.447 | 1.00 | 34.53 | | C |
| ANISOU | 2819 | CZ2 | TRP | H | 109 | 4216 | 4604 | 4300 | 301 | 64 | −442 | C |
| ATOM | 2820 | CZ3 | TRP | H | 109 | 19.211 | −5.484 | 46.786 | 1.00 | 38.26 | | C |
| ANISOU | 2820 | CZ3 | TRP | H | 109 | 4719 | 5118 | 4700 | 332 | 75 | −378 | C |
| ATOM | 2821 | CH2 | TRP | H | 109 | 18.545 | −5.533 | 45.559 | 1.00 | 38.48 | | C |
| ANISOU | 2821 | CH2 | TRP | H | 109 | 4734 | 5107 | 4782 | 315 | 92 | −411 | C |
| ATOM | 2822 | N | GLY | H | 110 | 24.130 | −1.322 | 49.173 | 1.00 | 41.75 | | N |
| ANISOU | 2822 | N | GLY | H | 110 | 5162 | 5754 | 4948 | 291 | −220 | −389 | N |
| ATOM | 2823 | CA | GLY | H | 110 | 25.005 | −1.370 | 50.321 | 1.00 | 44.93 | | C |
| ANISOU | 2823 | CA | GLY | H | 110 | 5575 | 6198 | 5299 | 299 | −273 | −355 | C |
| ATOM | 2824 | C | GLY | H | 110 | 25.212 | −2.801 | 50.743 | 1.00 | 49.86 | | C |
| ANISOU | 2824 | C | GLY | H | 110 | 6192 | 6827 | 5928 | 336 | −246 | −292 | C |
| ATOM | 2825 | O | GLY | H | 110 | 24.751 | −3.742 | 50.099 | 1.00 | 49.53 | | O |
| ANISOU | 2825 | O | GLY | H | 110 | 6135 | 6752 | 5934 | 353 | −187 | −276 | O |
| ATOM | 2826 | N | GLN | H | 111 | 25.888 | −2.972 | 51.875 | 1.00 | 45.38 | | N |
| ANISOU | 2826 | N | GLN | H | 111 | 5639 | 6297 | 5307 | 348 | −291 | −254 | N |

TABLE 14-continued

| | | | | | | | | | | | | |
|---|---|---|---|---|---|---|---|---|---|---|---|---|
| ATOM | 2827 | CA | GLN | H | 111 | 26.305 | −4.312 | 52.270 | 1.00 | 49.34 | | C |
| ANISOU | 2827 | CA | GLN | H | 111 | 6127 | 6804 | 5816 | 385 | −276 | −184 | C |
| ATOM | 2828 | C | GLN | H | 111 | 25.261 | −5.031 | 53.090 | 1.00 | 44.82 | | C |
| ANISOU | 2828 | C | GLN | H | 111 | 5605 | 6222 | 5201 | 410 | −220 | −165 | C |
| ATOM | 2829 | O | GLN | H | 111 | 25.330 | −6.257 | 53.218 | 1.00 | 44.76 | | O |
| ANISOU | 2829 | O | GLN | H | 111 | 5588 | 6202 | 5215 | 440 | −187 | −109 | O |
| ATOM | 2830 | CB | GLN | H | 111 | 27.617 | −4.250 | 53.062 | 1.00 | 69.69 | | C |
| ANISOU | 2830 | CB | GLN | H | 111 | 8688 | 9428 | 8362 | 390 | −357 | −142 | C |
| ATOM | 2831 | CG | GLN | H | 111 | 28.835 | −4.819 | 52.335 | 1.00 | 86.70 | | C |
| ANISOU | 2831 | CG | GLN | H | 111 | 10767 | 11585 | 10590 | 403 | −375 | −97 | C |
| ATOM | 2832 | CD | GLN | H | 111 | 28.650 | −4.962 | 50.824 | 1.00 | 90.86 | | C |
| ANISOU | 2832 | CD | GLN | H | 111 | 11254 | 12069 | 11199 | 398 | −320 | −121 | C |
| ATOM | 2833 | OE1 | GLN | H | 111 | 28.510 | −6.088 | 50.291 | 1.00 | 81.36 | | O |
| ANISOU | 2833 | OE1 | GLN | H | 111 | 10034 | 10834 | 10044 | 428 | −262 | −91 | O |
| ATOM | 2834 | NE2 | GLN | H | 111 | 28.668 | −3.827 | 50.121 | 1.00 | 94.57 | | N |
| ANISOU | 2834 | NE2 | GLN | H | 111 | 11711 | 12536 | 11685 | 360 | −339 | −173 | N |
| ATOM | 2835 | N | GLY | H | 112 | 24.280 | −4.314 | 53.613 | 1.00 | 50.20 | | N |
| ANISOU | 2835 | N | GLY | H | 112 | 6340 | 6906 | 5830 | 398 | −204 | −208 | N |
| ATOM | 2836 | CA | GLY | H | 112 | 23.225 | −4.958 | 54.357 | 1.00 | 47.19 | | C |
| ANISOU | 2836 | CA | GLY | H | 112 | 6002 | 6516 | 5412 | 421 | −141 | −187 | C |
| ATOM | 2837 | C | GLY | H | 112 | 23.467 | −4.883 | 55.854 | 1.00 | 55.34 | | C |
| ANISOU | 2837 | C | GLY | H | 112 | 7090 | 7593 | 6344 | 438 | −174 | −159 | C |
| ATOM | 2838 | O | GLY | H | 112 | 24.579 | −4.670 | 56.331 | 1.00 | 55.37 | | O |
| ANISOU | 2838 | O | GLY | H | 112 | 7091 | 7634 | 6315 | 437 | −250 | −140 | O |
| ATOM | 2839 | N | THR | H | 113 | 22.396 | −5.033 | 56.607 | 1.00 | 57.60 | | N |
| ANISOU | 2839 | N | THR | H | 113 | 7428 | 7878 | 6580 | 452 | −118 | −156 | N |
| ATOM | 2840 | CA | THR | H | 113 | 22.532 | −5.050 | 58.049 | 1.00 | 55.00 | | C |
| ANISOU | 2840 | CA | THR | H | 113 | 7162 | 7592 | 6145 | 474 | −139 | −127 | C |
| ATOM | 2841 | C | THR | H | 113 | 21.490 | −6.038 | 58.514 | 1.00 | 51.05 | | C |
| ANISOU | 2841 | C | THR | H | 113 | 6685 | 7073 | 5637 | 501 | −48 | −81 | C |
| ATOM | 2842 | O | THR | H | 113 | 20.424 | −6.123 | 57.911 | 1.00 | 48.19 | | O |
| ANISOU | 2842 | O | THR | H | 113 | 6308 | 6673 | 5329 | 494 | 23 | −103 | O |
| ATOM | 2843 | CB | THR | H | 113 | 22.361 | −3.641 | 58.643 | 1.00 | 52.73 | | C |
| ANISOU | 2843 | CB | THR | H | 113 | 6930 | 7329 | 5775 | 457 | −177 | −193 | C |
| ATOM | 2844 | OG1 | THR | H | 113 | 22.689 | −3.647 | 60.034 | 1.00 | 52.72 | | O |
| ANISOU | 2844 | OG1 | THR | H | 113 | 6995 | 7374 | 5661 | 478 | −213 | −166 | O |
| ATOM | 2845 | CG2 | THR | H | 113 | 20.926 | −3.124 | 58.447 | 1.00 | 51.26 | | C |
| ANISOU | 2845 | CG2 | THR | H | 113 | 6768 | 7115 | 5594 | 454 | −99 | −245 | C |
| ATOM | 2846 | N | LEU | H | 114 | 21.838 | −6.862 | 59.488 | 1.00 | 53.17 | | N |
| ANISOU | 2846 | N | LEU | H | 114 | 6982 | 7366 | 5853 | 531 | −51 | −10 | N |
| ATOM | 2847 | CA | LEU | H | 114 | 20.952 | −7.936 | 59.900 | 1.00 | 51.31 | | C |
| ANISOU | 2847 | CA | LEU | H | 114 | 6762 | 7110 | 5622 | 557 | 37 | 47 | C |
| ATOM | 2848 | C | LEU | H | 114 | 20.002 | −7.409 | 60.961 | 1.00 | 52.73 | | C |
| ANISOU | 2848 | C | LEU | H | 114 | 7016 | 7314 | 5704 | 568 | 81 | 32 | C |
| ATOM | 2849 | O | LEU | H | 114 | 20.430 | −6.700 | 61.875 | 1.00 | 53.68 | | O |
| ANISOU | 2849 | O | LEU | H | 114 | 7194 | 7482 | 5720 | 575 | 28 | 16 | O |
| ATOM | 2850 | CB | LEU | H | 114 | 21.746 | −9.131 | 60.434 | 1.00 | 58.38 | | C |
| ANISOU | 2850 | CB | LEU | H | 114 | 7655 | 8017 | 6510 | 587 | 19 | 138 | C |
| ATOM | 2851 | CG | LEU | H | 114 | 20.878 | −10.303 | 60.918 | 1.00 | 58.96 | | C |
| ANISOU | 2851 | CG | LEU | H | 114 | 7747 | 8065 | 6589 | 613 | 110 | 208 | C |
| ATOM | 2852 | CD1 | LEU | H | 114 | 20.165 | −10.945 | 59.762 | 1.00 | 61.66 | | C |
| ANISOU | 2852 | CD1 | LEU | H | 114 | 8035 | 8340 | 7054 | 598 | 176 | 202 | C |
| ATOM | 2853 | CD2 | LEU | H | 114 | 21.722 | −11.334 | 61.626 | 1.00 | 57.58 | | C |
| ANISOU | 2853 | CD2 | LEU | H | 114 | 7582 | 7906 | 6389 | 646 | 82 | 300 | C |
| ATOM | 2854 | N | VAL | H | 115 | 18.708 | −7.685 | 60.778 | 1.00 | 47.36 | | N |
| ANISOU | 2854 | N | VAL | H | 115 | 6332 | 6600 | 5060 | 569 | 177 | 31 | N |
| ATOM | 2855 | CA | VAL | H | 115 | 17.650 | −7.395 | 61.738 | 1.00 | 46.37 | | C |
| ANISOU | 2855 | CA | VAL | H | 115 | 6269 | 6492 | 4857 | 587 | 246 | 30 | C |
| ATOM | 2856 | C | VAL | H | 115 | 17.073 | −8.734 | 62.149 | 1.00 | 53.42 | | C |
| ANISOU | 2856 | C | VAL | H | 115 | 7160 | 7366 | 5770 | 610 | 327 | 117 | C |
| ATOM | 2857 | O | VAL | H | 115 | 16.644 | −9.508 | 61.288 | 1.00 | 55.84 | | O |
| ANISOU | 2857 | O | VAL | H | 115 | 7408 | 7621 | 6186 | 597 | 370 | 137 | O |
| ATOM | 2858 | CB | VAL | H | 115 | 16.569 | −6.490 | 61.126 | 1.00 | 50.99 | | C |
| ANISOU | 2858 | CB | VAL | H | 115 | 6839 | 7052 | 5481 | 568 | 292 | −44 | C |
| ATOM | 2859 | CG1 | VAL | H | 115 | 15.279 | −6.523 | 61.944 | 1.00 | 53.23 | | C |
| ANISOU | 2859 | CG1 | VAL | H | 115 | 7165 | 7341 | 5720 | 591 | 393 | −28 | C |
| ATOM | 2860 | CG2 | VAL | H | 115 | 17.109 | −5.080 | 60.969 | 1.00 | 46.00 | | C |
| ANISOU | 2860 | CG2 | VAL | H | 115 | 6227 | 6442 | 4810 | 550 | 215 | −127 | C |
| ATOM | 2861 | N | THR | H | 116 | 17.097 | −9.035 | 63.448 | 1.00 | 56.73 | | N |
| ANISOU | 2861 | N | THR | H | 116 | 7646 | 7825 | 6085 | 642 | 343 | 172 | N |
| ATOM | 2862 | CA | THR | H | 116 | 16.604 | −10.307 | 63.968 | 1.00 | 61.38 | | C |
| ANISOU | 2862 | CA | THR | H | 116 | 8240 | 8397 | 6683 | 665 | 420 | 266 | C |
| ATOM | 2863 | C | THR | H | 116 | 15.516 | −10.022 | 64.995 | 1.00 | 66.85 | | C |
| ANISOU | 2863 | C | THR | H | 116 | 8996 | 9115 | 7290 | 688 | 507 | 276 | C |
| ATOM | 2864 | O | THR | H | 116 | 15.755 | −9.314 | 65.980 | 1.00 | 70.70 | | O |
| ANISOU | 2864 | O | THR | H | 116 | 9560 | 9655 | 7647 | 708 | 480 | 258 | O |
| ATOM | 2865 | CB | THR | H | 116 | 17.724 | −11.133 | 64.603 | 1.00 | 66.10 | | C |
| ANISOU | 2865 | CB | THR | H | 116 | 8859 | 9020 | 7237 | 690 | 364 | 344 | C |
| ATOM | 2866 | OG1 | THR | H | 116 | 18.789 | −11.312 | 63.662 | 1.00 | 63.52 | | O |
| ANISOU | 2866 | OG1 | THR | H | 116 | 8471 | 8674 | 6988 | 674 | 285 | 333 | O |

TABLE 14-continued

| | | | | | | | | | | | | |
|---|---|---|---|---|---|---|---|---|---|---|---|---|
| ATOM | 2867 | CG2 | THR | H | 116 | 17.199 | −12.496 | 65.044 | 1.00 | 67.16 | | C |
| ANISOU | 2867 | CG2 | THR | H | 116 | 8995 | 9127 | 7395 | 712 | 447 | 446 | C |
| ATOM | 2868 | N | VAL | H | 117 | 14.326 | −10.554 | 64.758 | 1.00 | 60.90 | | N |
| ANISOU | 2868 | N | VAL | H | 117 | 8210 | 8321 | 6607 | 684 | 609 | 303 | N |
| ATOM | 2869 | CA | VAL | H | 117 | 13.200 | −10.389 | 65.662 | 1.00 | 64.86 | | C |
| ANISOU | 2869 | CA | VAL | H | 117 | 8759 | 8841 | 7045 | 707 | 710 | 322 | C |
| ATOM | 2870 | C | VAL | H | 117 | 12.995 | −11.704 | 66.396 | 1.00 | 82.24 | | C |
| ANISOU | 2870 | C | VAL | H | 117 | 10975 | 11036 | 9236 | 730 | 774 | 437 | C |
| ATOM | 2871 | O | VAL | H | 117 | 13.148 | −12.780 | 65.802 | 1.00 | 79.01 | | O |
| ANISOU | 2871 | O | VAL | H | 117 | 10512 | 10579 | 8931 | 716 | 777 | 488 | O |
| ATOM | 2872 | CB | VAL | H | 117 | 11.934 | −9.965 | 64.893 | 1.00 | 64.14 | | C |
| ANISOU | 2872 | CB | VAL | H | 117 | 8613 | 8711 | 7048 | 684 | 782 | 273 | C |
| ATOM | 2873 | CG1 | VAL | H | 117 | 10.757 | −9.730 | 65.847 | 1.00 | 64.37 | | C |
| ANISOU | 2873 | CG1 | VAL | H | 117 | 8685 | 8762 | 7012 | 713 | 893 | 294 | C |
| ATOM | 2874 | CG2 | VAL | H | 117 | 12.223 | −8.709 | 64.056 | 1.00 | 60.76 | | C |
| ANISOU | 2874 | CG2 | VAL | H | 117 | 8166 | 8282 | 6638 | 660 | 710 | 165 | C |
| ATOM | 2875 | N | SER | H | 118 | 12.686 | −11.612 | 67.694 | 1.00 | 100.56 | | N |
| ANISOU | 2875 | N | SER | H | 118 | 13376 | 13403 | 11430 | 767 | 825 | 476 | N |
| ATOM | 2876 | CA | SER | H | 118 | 12.286 | −12.752 | 68.532 | 1.00 | 108.87 | | C |
| ANISOU | 2876 | CA | SER | H | 118 | 14452 | 14454 | 12459 | 793 | 907 | 590 | C |
| ATOM | 2877 | C | SER | H | 118 | 13.499 | −13.578 | 68.928 | 1.00 | 109.44 | | C |
| ANISOU | 2877 | C | SER | H | 118 | 14549 | 14540 | 12494 | 809 | 832 | 661 | C |
| ATOM | 2878 | O | SER | H | 118 | 14.410 | −13.066 | 69.587 | 1.00 | 108.14 | | O |
| ANISOU | 2878 | O | SER | H | 118 | 14449 | 14431 | 12208 | 829 | 751 | 645 | O |
| ATOM | 2879 | CB | SER | H | 118 | 11.236 | −13.625 | 67.817 | 1.00 | 110.74 | | C |
| ANISOU | 2879 | CB | SER | H | 118 | 14606 | 14621 | 12848 | 767 | 1000 | 632 | C |
| ATOM | 2880 | OG | SER | H | 118 | 11.149 | −14.921 | 68.393 | 1.00 | 112.14 | | O |
| ANISOU | 2880 | OG | SER | H | 118 | 14792 | 14781 | 13033 | 783 | 1054 | 749 | O |
| TER | 2883 | | | H | 118 | | | | | | | |
| ATOM | 2881 | N | SER | L | 1 | −0.669 | −8.735 | 42.715 | 1.00 | 73.09 | | N |
| ANISOU | 2881 | N | SER | L | 1 | 8633 | 9051 | 10087 | 19 | 424 | −368 | N |
| ATOM | 2882 | CA | SER | L | 1 | 0.808 | −8.816 | 42.849 | 1.00 | 70.47 | | C |
| ANISOU | 2882 | CA | SER | L | 1 | 8378 | 8739 | 9659 | 45 | 406 | −391 | C |
| ATOM | 2883 | C | SER | L | 1 | 1.396 | −9.496 | 41.615 | 1.00 | 64.63 | | C |
| ANISOU | 2883 | C | SER | L | 1 | 7668 | 7957 | 8933 | 17 | 337 | −425 | C |
| ATOM | 2884 | O | SER | L | 1 | 1.178 | −10.678 | 41.424 | 1.00 | 68.16 | | O |
| ANISOU | 2884 | O | SER | L | 1 | 8109 | 8352 | 9438 | −13 | 334 | −406 | O |
| ATOM | 2885 | CB | SER | L | 1 | 1.211 | −9.537 | 44.083 | 1.00 | 69.70 | | C |
| ANISOU | 2885 | CB | SER | L | 1 | 8311 | 8656 | 9517 | 70 | 472 | −339 | C |
| ATOM | 2886 | OG | SER | L | 1 | 1.800 | −8.642 | 44.996 | 1.00 | 72.39 | | O |
| ANISOU | 2886 | OG | SER | L | 1 | 8680 | 9055 | 9771 | 114 | 506 | −340 | O |
| ATOM | 2887 | N | TYR | L | 2 | 2.125 | −8.732 | 40.828 | 1.00 | 53.79 | | N |
| ANISOU | 2887 | N | TYR | L | 2 | 6330 | 6604 | 7505 | 28 | 284 | −476 | N |
| ATOM | 2888 | CA | TYR | L | 2 | 2.752 | −9.228 | 39.606 | 1.00 | 55.70 | | C |
| ANISOU | 2888 | CA | TYR | L | 2 | 6605 | 6811 | 7746 | 9 | 222 | −514 | C |
| ATOM | 2889 | C | TYR | L | 2 | 3.791 | −10.307 | 39.914 | 1.00 | 50.34 | | C |
| ANISOU | 2889 | C | TYR | L | 2 | 5972 | 6113 | 7040 | 21 | 242 | −494 | C |
| ATOM | 2890 | O | TYR | L | 2 | 4.514 | −10.230 | 40.907 | 1.00 | 46.75 | | O |
| ANISOU | 2890 | O | TYR | L | 2 | 5541 | 5694 | 6528 | 54 | 283 | −467 | O |
| ATOM | 2891 | CB | TYR | L | 2 | 3.403 | −8.063 | 38.881 | 1.00 | 57.17 | | C |
| ANISOU | 2891 | CB | TYR | L | 2 | 6820 | 7031 | 7871 | 25 | 175 | −563 | C |
| ATOM | 2892 | CG | TYR | L | 2 | 3.808 | −8.345 | 37.464 | 1.00 | 55.20 | | C |
| ANISOU | 2892 | CG | TYR | L | 2 | 6601 | 6751 | 7623 | 5 | 110 | −607 | C |
| ATOM | 2893 | CD1 | TYR | L | 2 | 2.859 | −8.418 | 36.453 | 1.00 | 54.79 | | C |
| ANISOU | 2893 | CD1 | TYR | L | 2 | 6522 | 6665 | 7631 | −31 | 60 | −630 | C |
| ATOM | 2894 | CD2 | TYR | L | 2 | 5.149 | −8.487 | 37.125 | 1.00 | 42.50 | | C |
| ANISOU | 2894 | CD2 | TYR | L | 2 | 5046 | 5150 | 5951 | 25 | 99 | −624 | C |
| ATOM | 2895 | CE1 | TYR | L | 2 | 3.237 | −8.657 | 35.133 | 1.00 | 52.14 | | C |
| ANISOU | 2895 | CE1 | TYR | L | 2 | 6224 | 6302 | 7285 | −47 | 0 | −673 | C |
| ATOM | 2896 | CE2 | TYR | L | 2 | 5.527 | −8.725 | 35.827 | 1.00 | 44.33 | | C |
| ANISOU | 2896 | CE2 | TYR | L | 2 | 5311 | 5356 | 6178 | 12 | 49 | −664 | C |
| ATOM | 2897 | CZ | TYR | L | 2 | 4.591 | −8.805 | 34.838 | 1.00 | 42.22 | | C |
| ANISOU | 2897 | CZ | TYR | L | 2 | 5027 | 5054 | 5960 | −23 | −1 | −690 | C |
| ATOM | 2898 | OH | TYR | L | 2 | 4.960 | −9.034 | 33.545 | 1.00 | 42.68 | | O |
| ANISOU | 2898 | OH | TYR | L | 2 | 5127 | 5087 | 6001 | −33 | −51 | −732 | O |
| ATOM | 2899 | N | VAL | L | 3 | 3.869 | −11.323 | 39.059 | 1.00 | 44.32 | | N |
| ANISOU | 2899 | N | VAL | L | 3 | 5226 | 5295 | 6319 | −6 | 210 | −508 | N |
| ATOM | 2900 | CA | VAL | L | 3 | 4.683 | −12.497 | 39.338 | 1.00 | 48.73 | | C |
| ANISOU | 2900 | CA | VAL | L | 3 | 5823 | 5823 | 6871 | 5 | 233 | −484 | C |
| ATOM | 2901 | C | VAL | L | 3 | 5.796 | −12.599 | 38.293 | 1.00 | 47.87 | | C |
| ANISOU | 2901 | C | VAL | L | 3 | 5766 | 5703 | 6718 | 16 | 189 | −530 | C |
| ATOM | 2902 | O | VAL | L | 3 | 5.534 | −12.586 | 37.085 | 1.00 | 50.60 | | O |
| ANISOU | 2902 | O | VAL | L | 3 | 6122 | 6020 | 7085 | −8 | 137 | −576 | O |
| ATOM | 2903 | CB | VAL | L | 3 | 3.819 | −13.765 | 39.375 | 1.00 | 50.02 | | C |
| ANISOU | 2903 | CB | VAL | L | 3 | 5962 | 5917 | 7126 | −33 | 246 | −454 | C |
| ATOM | 2904 | CG1 | VAL | L | 3 | 4.692 | −15.012 | 39.584 | 1.00 | 50.81 | | C |
| ANISOU | 2904 | CG1 | VAL | L | 3 | 6106 | 5976 | 7224 | −20 | 267 | −431 | C |
| ATOM | 2905 | CG2 | VAL | L | 3 | 2.789 | −13.635 | 40.501 | 1.00 | 58.65 | | C |
| ANISOU | 2905 | CG2 | VAL | L | 3 | 6999 | 7027 | 8258 | −39 | 303 | −400 | C |
| ATOM | 2906 | N | LEU | L | 4 | 7.028 | −12.648 | 38.755 | 1.00 | 43.25 | | N |

TABLE 14-continued

| | | | | | | | | | | | | |
|---|---|---|---|---|---|---|---|---|---|---|---|---|
| ANISOU | 2906 | N | LEU | L | 4 | 5216 | 5145 | 6071 | 55 | 211 | −517 | N |
| ATOM | 2907 | CA | LEU | L | 4 | 8.173 | −12.945 | 37.904 | 1.00 | 37.81 | | C |
| ANISOU | 2907 | CA | LEU | L | 4 | 4575 | 4444 | 5349 | 73 | 185 | −547 | C |
| ATOM | 2908 | C | LEU | L | 4 | 8.611 | −14.373 | 38.182 | 1.00 | 39.42 | | C |
| ANISOU | 2908 | C | LEU | L | 4 | 4802 | 4595 | 5580 | 81 | 214 | −516 | C |
| ATOM | 2909 | O | LEU | L | 4 | 8.852 | −14.733 | 39.337 | 1.00 | 47.20 | | O |
| ANISOU | 2909 | O | LEU | L | 4 | 5781 | 5594 | 6558 | 102 | 258 | −463 | O |
| ATOM | 2910 | CB | LEU | L | 4 | 9.320 | −11.987 | 38.187 | 1.00 | 37.85 | | C |
| ANISOU | 2910 | CB | LEU | L | 4 | 4595 | 4515 | 5273 | 110 | 187 | −550 | C |
| ATOM | 2911 | CG | LEU | L | 4 | 9.004 | −10.527 | 38.001 | 1.00 | 45.17 | | C |
| ANISOU | 2911 | CG | LEU | L | 4 | 5503 | 5490 | 6168 | 106 | 162 | −578 | C |
| ATOM | 2912 | CD1 | LEU | L | 4 | 10.248 | −9.757 | 38.376 | 1.00 | 48.44 | | C |
| ANISOU | 2912 | CD1 | LEU | L | 4 | 5935 | 5961 | 6510 | 140 | 164 | −575 | C |
| ATOM | 2913 | CD2 | LEU | L | 4 | 8.571 | −10.283 | 36.550 | 1.00 | 45.18 | | C |
| ANISOU | 2913 | CD2 | LEU | L | 4 | 5511 | 5466 | 6189 | 80 | 110 | −630 | C |
| ATOM | 2914 | N | THR | L | 5 | 8.716 | −15.178 | 37.141 | 1.00 | 39.68 | | N |
| ANISOU | 2914 | N | THR | L | 5 | 4867 | 4569 | 5643 | 69 | 188 | −549 | N |
| ATOM | 2915 | CA | THR | L | 5 | 9.043 | −16.586 | 37.307 | 1.00 | 45.55 | | C |
| ANISOU | 2915 | CA | THR | L | 5 | 5635 | 5248 | 6423 | 76 | 212 | −524 | C |
| ATOM | 2916 | C | THR | L | 5 | 10.415 | −16.859 | 36.718 | 1.00 | 45.46 | | C |
| ANISOU | 2916 | C | THR | L | 5 | 5672 | 5234 | 6367 | 117 | 210 | −545 | C |
| ATOM | 2917 | O | THR | L | 5 | 10.636 | −16.633 | 35.522 | 1.00 | 50.65 | | O |
| ANISOU | 2917 | O | THR | L | 5 | 6358 | 5881 | 7006 | 114 | 174 | −601 | O |
| ATOM | 2918 | CB | THR | L | 5 | 7.977 | −17.467 | 36.648 | 1.00 | 51.12 | | C |
| ANISOU | 2918 | CB | THR | L | 5 | 6340 | 5872 | 7211 | 27 | 188 | −543 | C |
| ATOM | 2919 | OG1 | THR | L | 5 | 6.713 | −17.197 | 37.270 | 1.00 | 55.56 | | O |
| ANISOU | 2919 | OG1 | THR | L | 5 | 6846 | 6442 | 7822 | −9 | 197 | −514 | O |
| ATOM | 2920 | CG2 | THR | L | 5 | 8.297 | −18.948 | 36.863 | 1.00 | 50.93 | | C |
| ANISOU | 2920 | CG2 | THR | L | 5 | 6346 | 5774 | 7232 | 33 | 216 | −516 | C |
| ATOM | 2921 | N | GLN | L | 6 | 11.339 | −17.306 | 37.564 | 1.00 | 39.27 | | N |
| ANISOU | 2921 | N | GLN | L | 6 | 4895 | 4462 | 5562 | 157 | 249 | −497 | N |
| ATOM | 2922 | CA | GLN | L | 6 | 12.627 | −17.742 | 37.054 | 1.00 | 42.37 | | C |
| ANISOU | 2922 | CA | GLN | L | 6 | 5328 | 4844 | 5928 | 200 | 254 | −509 | C |
| ATOM | 2923 | C | GLN | L | 6 | 12.839 | −19.216 | 37.363 | 1.00 | 45.92 | | C |
| ANISOU | 2923 | C | GLN | L | 6 | 5800 | 5221 | 6426 | 214 | 285 | −474 | C |
| ATOM | 2924 | O | GLN | L | 6 | 12.452 | −19.679 | 38.441 | 1.00 | 46.42 | | O |
| ANISOU | 2924 | O | GLN | L | 6 | 5843 | 5275 | 6518 | 210 | 314 | −417 | O |
| ATOM | 2925 | CB | GLN | L | 6 | 13.790 | −16.971 | 37.692 | 1.00 | 39.98 | | C |
| ANISOU | 2925 | CB | GLN | L | 6 | 5013 | 4621 | 5558 | 243 | 267 | −481 | C |
| ATOM | 2926 | CG | GLN | L | 6 | 13.685 | −15.449 | 37.683 | 1.00 | 38.44 | | C |
| ANISOU | 2926 | CG | GLN | L | 6 | 4793 | 4501 | 5313 | 233 | 242 | −503 | C |
| ATOM | 2927 | CD | GLN | L | 6 | 14.872 | −14.837 | 38.374 | 1.00 | 41.99 | | C |
| ANISOU | 2927 | CD | GLN | L | 6 | 5232 | 5017 | 5704 | 272 | 251 | −472 | C |
| ATOM | 2928 | OE1 | GLN | L | 6 | 14.729 | −14.077 | 39.339 | 1.00 | 43.09 | | O |
| ANISOU | 2928 | OE1 | GLN | L | 6 | 5348 | 5211 | 5814 | 270 | 253 | −448 | O |
| ATOM | 2929 | NE2 | GLN | L | 6 | 16.071 | −15.203 | 37.906 | 1.00 | 40.37 | | N |
| ANISOU | 2929 | NE2 | GLN | L | 6 | 5046 | 4809 | 5485 | 308 | 256 | −473 | N |
| ATOM | 2930 | N | PRO | L | 7 | 13.568 | −19.942 | 36.512 | 1.00 | 48.62 | | N |
| ANISOU | 2930 | N | PRO | L | 7 | 6186 | 5514 | 6773 | 240 | 285 | −503 | N |
| ATOM | 2931 | CA | PRO | L | 7 | 13.976 | −21.292 | 36.875 | 1.00 | 44.25 | | C |
| ANISOU | 2931 | CA | PRO | L | 7 | 5657 | 4894 | 6263 | 265 | 318 | −465 | C |
| ATOM | 2932 | C | PRO | L | 7 | 14.941 | −21.271 | 38.052 | 1.00 | 49.77 | | C |
| ANISOU | 2932 | C | PRO | L | 7 | 6336 | 5644 | 6931 | 314 | 353 | −395 | C |
| ATOM | 2933 | O | PRO | L | 7 | 15.763 | −20.348 | 38.185 | 1.00 | 48.73 | | O |
| ANISOU | 2933 | O | PRO | L | 7 | 6187 | 5589 | 6738 | 342 | 348 | −392 | O |
| ATOM | 2934 | CB | PRO | L | 7 | 14.660 | −21.813 | 35.603 | 1.00 | 55.36 | | C |
| ANISOU | 2934 | CB | PRO | L | 7 | 7119 | 6250 | 7667 | 291 | 311 | −521 | C |
| ATOM | 2935 | CG | PRO | L | 7 | 15.202 | −20.576 | 34.931 | 1.00 | 54.28 | | C |
| ANISOU | 2935 | CG | PRO | L | 7 | 6976 | 6188 | 7459 | 303 | 290 | −561 | C |
| ATOM | 2936 | CD | PRO | L | 7 | 14.159 | −19.506 | 35.228 | 1.00 | 52.93 | | C |
| ANISOU | 2936 | CD | PRO | L | 7 | 6764 | 6068 | 7279 | 254 | 261 | −566 | C |
| ATOM | 2937 | N | PRO | L | 8 | 14.881 | −22.280 | 38.921 | 1.00 | 51.68 | | N |
| ANISOU | 2937 | N | PRO | L | 8 | 6579 | 5842 | 7215 | 324 | 385 | −334 | N |
| ATOM | 2938 | CA | PRO | L | 8 | 15.794 | −22.295 | 40.064 | 1.00 | 49.76 | | C |
| ANISOU | 2938 | CA | PRO | L | 8 | 6319 | 5648 | 6939 | 371 | 412 | −263 | C |
| ATOM | 2939 | C | PRO | L | 8 | 17.250 | −22.434 | 39.654 | 1.00 | 49.58 | | C |
| ANISOU | 2939 | C | PRO | L | 8 | 6311 | 5637 | 6889 | 431 | 417 | −266 | C |
| ATOM | 2940 | O | PRO | L | 8 | 18.124 | −21.955 | 40.385 | 1.00 | 49.02 | | O |
| ANISOU | 2940 | O | PRO | L | 8 | 6217 | 5636 | 6773 | 467 | 420 | −224 | O |
| ATOM | 2941 | CB | PRO | L | 8 | 15.322 | −23.512 | 40.878 | 1.00 | 50.85 | | C |
| ANISOU | 2941 | CB | PRO | L | 8 | 6463 | 5719 | 7137 | 367 | 445 | −200 | C |
| ATOM | 2942 | CG | PRO | L | 8 | 14.016 | −23.908 | 40.308 | 1.00 | 55.71 | | C |
| ANISOU | 2942 | CG | PRO | L | 8 | 7086 | 6264 | 7817 | 307 | 434 | −236 | C |
| ATOM | 2943 | CD | PRO | L | 8 | 14.008 | −23.461 | 38.892 | 1.00 | 52.08 | | C |
| ANISOU | 2943 | CD | PRO | L | 8 | 6648 | 5796 | 7346 | 292 | 396 | −324 | C |
| ATOM | 2944 | N | SER | L | 9 | 17.535 | −23.065 | 38.514 | 1.00 | 40.31 | | N |
| ANISOU | 2944 | N | SER | L | 9 | 5177 | 4398 | 5742 | 445 | 418 | −314 | N |
| ATOM | 2945 | CA | SER | L | 9 | 18.905 | −23.480 | 38.209 | 1.00 | 55.03 | | C |
| ANISOU | 2945 | CA | SER | L | 9 | 7055 | 6257 | 7596 | 510 | 438 | −305 | C |
| ATOM | 2946 | C | SER | L | 9 | 19.177 | −23.442 | 36.718 | 1.00 | 52.25 | | C |

TABLE 14-continued

| | | | | | | | | | | | | |
|---|---|---|---|---|---|---|---|---|---|---|---|---|
| ANISOU | 2946 | C | SER | L | 9 | 6740 | 5875 | 7236 | 518 | 430 | −383 | C |
| ATOM | 2947 | O | SER | L | 9 | 18.346 | −23.841 | 35.908 | 1.00 | 52.19 | | O |
| ANISOU | 2947 | O | SER | L | 9 | 6771 | 5800 | 7258 | 482 | 417 | −437 | O |
| ATOM | 2948 | CB | SER | L | 9 | 19.200 | −24.905 | 38.687 | 1.00 | 56.31 | | C |
| ANISOU | 2948 | CB | SER | L | 9 | 7239 | 6342 | 7816 | 545 | 472 | −252 | C |
| ATOM | 2949 | OG | SER | L | 9 | 18.792 | −25.090 | 40.023 | 1.00 | 66.24 | | O |
| ANISOU | 2949 | OG | SER | L | 9 | 8471 | 7613 | 9083 | 534 | 482 | −178 | O |
| ATOM | 2950 | N | VAL | L | 10 | 20.372 | −23.010 | 36.371 | 1.00 | 49.53 | | N |
| ANISOU | 2950 | N | VAL | L | 10 | 6387 | 5579 | 6853 | 566 | 439 | −385 | N |
| ATOM | 2951 | CA | VAL | L | 10 | 20.883 | −23.150 | 35.016 | 1.00 | 49.72 | | C |
| ANISOU | 2951 | CA | VAL | L | 10 | 6452 | 5573 | 6867 | 592 | 448 | −447 | C |
| ATOM | 2952 | C | VAL | L | 10 | 22.338 | −23.561 | 35.156 | 1.00 | 54.71 | | C |
| ANISOU | 2952 | C | VAL | L | 10 | 7072 | 6215 | 7500 | 670 | 487 | −405 | C |
| ATOM | 2953 | O | VAL | L | 10 | 23.040 | −23.081 | 36.055 | 1.00 | 47.93 | | O |
| ANISOU | 2953 | O | VAL | L | 10 | 6161 | 5429 | 6622 | 692 | 487 | −345 | O |
| ATOM | 2954 | CB | VAL | L | 10 | 20.713 | −21.850 | 34.206 | 1.00 | 52.38 | | C |
| ANISOU | 2954 | CB | VAL | L | 10 | 6782 | 5972 | 7147 | 563 | 418 | −502 | C |
| ATOM | 2955 | CG1 | VAL | L | 10 | 21.463 | −21.912 | 32.857 | 1.00 | 53.60 | | C |
| ANISOU | 2955 | CG1 | VAL | L | 10 | 6977 | 6111 | 7278 | 601 | 436 | −555 | C |
| ATOM | 2956 | CG2 | VAL | L | 10 | 19.200 | −21.538 | 33.997 | 1.00 | 60.36 | | C |
| ANISOU | 2956 | CG2 | VAL | L | 10 | 7802 | 6963 | 8167 | 489 | 378 | −544 | C |
| ATOM | 2957 | N | SER | L | 11 | 22.764 | −24.503 | 34.316 | 1.00 | 53.99 | | N |
| ANISOU | 2957 | N | SER | L | 11 | 7031 | 6049 | 7435 | 711 | 519 | −434 | N |
| ATOM | 2958 | CA | SER | L | 11 | 24.149 | −24.953 | 34.257 | 1.00 | 50.60 | | C |
| ANISOU | 2958 | CA | SER | L | 11 | 6593 | 5621 | 7013 | 792 | 562 | −401 | C |
| ATOM | 2959 | C | SER | L | 11 | 24.730 | −24.644 | 32.891 | 1.00 | 47.95 | | C |
| ANISOU | 2959 | C | SER | L | 11 | 6287 | 5290 | 6643 | 820 | 582 | −463 | C |
| ATOM | 2960 | O | SER | L | 11 | 24.064 | −24.833 | 31.879 | 1.00 | 50.64 | | O |
| ANISOU | 2960 | O | SER | L | 11 | 6690 | 5576 | 6976 | 795 | 574 | −537 | O |
| ATOM | 2961 | CB | SER | L | 11 | 24.251 | −26.450 | 34.513 | 1.00 | 56.00 | | C |
| ANISOU | 2961 | CB | SER | L | 11 | 7312 | 6203 | 7762 | 831 | 596 | −374 | C |
| ATOM | 2962 | OG | SER | L | 11 | 24.316 | −26.694 | 35.909 | 1.00 | 70.59 | | O |
| ANISOU | 2962 | OG | SER | L | 11 | 9116 | 8071 | 9633 | 835 | 593 | −287 | O |
| ATOM | 2963 | N | VAL | L | 12 | 25.974 | −24.192 | 32.858 | 1.00 | 53.51 | | N |
| ANISOU | 2963 | N | VAL | L | 12 | 6947 | 6057 | 7326 | 873 | 607 | −431 | N |
| ATOM | 2964 | CA | VAL | L | 12 | 26.673 | −23.949 | 31.602 | 1.00 | 55.40 | | C |
| ANISOU | 2964 | CA | VAL | L | 12 | 7211 | 6303 | 7534 | 912 | 639 | −479 | C |
| ATOM | 2965 | C | VAL | L | 12 | 28.120 | −24.373 | 31.734 | 1.00 | 55.73 | | C |
| ANISOU | 2965 | C | VAL | L | 12 | 7217 | 6357 | 7599 | 998 | 692 | −425 | C |
| ATOM | 2966 | O | VAL | L | 12 | 28.725 | −24.285 | 32.807 | 1.00 | 60.26 | | O |
| ANISOU | 2966 | O | VAL | L | 12 | 7725 | 6978 | 8194 | 1018 | 687 | −347 | O |
| ATOM | 2967 | CB | VAL | L | 12 | 26.642 | −22.477 | 31.164 | 1.00 | 55.44 | | C |
| ANISOU | 2967 | CB | VAL | L | 12 | 7188 | 6399 | 7478 | 873 | 611 | −503 | C |
| ATOM | 2968 | CG1 | VAL | L | 12 | 25.271 | −22.118 | 30.736 | 1.00 | 63.63 | | C |
| ANISOU | 2968 | CG1 | VAL | L | 12 | 8268 | 7416 | 8492 | 799 | 565 | −566 | C |
| ATOM | 2969 | CG2 | VAL | L | 12 | 27.093 | −21.584 | 32.331 | 1.00 | 51.78 | | C |
| ANISOU | 2969 | CG2 | VAL | L | 12 | 6636 | 6031 | 7007 | 861 | 583 | −432 | C |
| ATOM | 2970 | N | ALA | L | 13 | 28.686 | −24.772 | 30.612 | 1.00 | 54.54 | | N |
| ANISOU | 2970 | N | ALA | L | 13 | 7112 | 6169 | 7443 | 1051 | 743 | −466 | N |
| ATOM | 2971 | CA | ALA | L | 13 | 30.104 | −25.048 | 30.534 | 1.00 | 56.04 | | C |
| ANISOU | 2971 | CA | ALA | L | 13 | 7263 | 6376 | 7653 | 1137 | 802 | −420 | C |
| ATOM | 2972 | C | ALA | L | 13 | 30.875 | −23.751 | 30.313 | 1.00 | 57.76 | | C |
| ANISOU | 2972 | C | ALA | L | 13 | 7413 | 6703 | 7829 | 1137 | 801 | −401 | C |
| ATOM | 2973 | O | ALA | L | 13 | 30.397 | −22.851 | 29.615 | 1.00 | 52.63 | | O |
| ANISOU | 2973 | O | ALA | L | 13 | 6783 | 6087 | 7125 | 1089 | 779 | −452 | O |
| ATOM | 2974 | CB | ALA | L | 13 | 30.392 | −26.013 | 29.391 | 1.00 | 55.79 | | C |
| ANISOU | 2974 | CB | ALA | L | 13 | 7312 | 6257 | 7630 | 1199 | 866 | −475 | C |
| ATOM | 2975 | N | PRO | L | 14 | 32.068 | −23.635 | 30.891 | 1.00 | 57.93 | | N |
| ANISOU | 2975 | N | PRO | L | 14 | 7353 | 6779 | 7879 | 1188 | 821 | −324 | N |
| ATOM | 2976 | CA | PRO | L | 14 | 32.882 | −22.439 | 30.663 | 1.00 | 62.25 | | C |
| ANISOU | 2976 | CA | PRO | L | 14 | 7831 | 7425 | 8397 | 1187 | 822 | −302 | C |
| ATOM | 2977 | C | PRO | L | 14 | 32.977 | −22.125 | 29.173 | 1.00 | 62.93 | | C |
| ANISOU | 2977 | C | PRO | L | 14 | 7968 | 7504 | 8438 | 1201 | 867 | −368 | C |
| ATOM | 2978 | O | PRO | L | 14 | 33.048 | −23.025 | 28.332 | 1.00 | 59.97 | | O |
| ANISOU | 2978 | O | PRO | L | 14 | 7663 | 7055 | 8067 | 1251 | 924 | −411 | O |
| ATOM | 2979 | CB | PRO | L | 14 | 34.243 | −22.820 | 31.254 | 1.00 | 62.77 | | C |
| ANISOU | 2979 | CB | PRO | L | 14 | 7816 | 7517 | 8516 | 1263 | 856 | −215 | C |
| ATOM | 2980 | CG | PRO | L | 14 | 33.950 | −23.906 | 32.230 | 1.00 | 64.18 | | C |
| ANISOU | 2980 | CG | PRO | L | 14 | 8007 | 7635 | 8743 | 1278 | 843 | −178 | C |
| ATOM | 2981 | CD | PRO | L | 14 | 32.813 | −24.671 | 31.629 | 1.00 | 62.78 | | C |
| ANISOU | 2981 | CD | PRO | L | 14 | 7938 | 7359 | 8558 | 1257 | 851 | −256 | C |
| ATOM | 2982 | N | GLY | L | 15 | 32.921 | −20.830 | 28.844 | 1.00 | 58.84 | | N |
| ANISOU | 2982 | N | GLY | L | 15 | 7423 | 7062 | 7872 | 1153 | 841 | −381 | N |
| ATOM | 2983 | CA | GLY | L | 15 | 32.960 | −20.402 | 27.464 | 1.00 | 59.81 | | C |
| ANISOU | 2983 | CA | GLY | L | 15 | 7594 | 7188 | 7943 | 1158 | 878 | −438 | C |
| ATOM | 2984 | C | GLY | L | 15 | 31.639 | −20.450 | 26.729 | 1.00 | 57.52 | | C |
| ANISOU | 2984 | C | GLY | L | 15 | 7404 | 6845 | 7605 | 1106 | 849 | −527 | C |
| ATOM | 2985 | O | GLY | L | 15 | 31.509 | −19.802 | 25.688 | 1.00 | 55.97 | | O |
| ANISOU | 2985 | O | GLY | L | 15 | 7245 | 6669 | 7352 | 1092 | 858 | −572 | O |
| ATOM | 2986 | N | GLN | L | 16 | 30.654 | −21.196 | 27.223 | 1.00 | 56.49 | | N |

TABLE 14-continued

| | | | | | | | | | | | |
|---|---|---|---|---|---|---|---|---|---|---|---|
| ANISOU | 2986 | N | GLN | L | 16 | 7319 | 6648 | 7497 | 1076 | 812 | −550 | N |
| ATOM | 2987 | CA | GLN | L | 16 | 29.347 | −21.229 | 26.584 | 1.00 | 54.37 | | C |
| ANISOU | 2987 | CA | GLN | L | 16 | 7136 | 6331 | 7192 | 1020 | 773 | −630 | C |
| ATOM | 2988 | C | GLN | L | 16 | 28.480 | −20.045 | 27.049 | 1.00 | 56.54 | | C |
| ANISOU | 2988 | C | GLN | L | 16 | 7376 | 6666 | 7440 | 933 | 697 | −630 | C |
| ATOM | 2989 | O | GLN | L | 16 | 28.884 | −19.218 | 27.875 | 1.00 | 53.37 | | O |
| ANISOU | 2989 | O | GLN | L | 16 | 6892 | 6340 | 7045 | 917 | 675 | −573 | O |
| ATOM | 2990 | CB | GLN | L | 16 | 28.679 | −22.575 | 26.858 | 1.00 | 58.15 | | C |
| ANISOU | 2990 | CB | GLN | L | 16 | 7675 | 6706 | 7715 | 1024 | 769 | −652 | C |
| ATOM | 2991 | CG | GLN | L | 16 | 29.454 | −23.737 | 26.239 | 1.00 | 62.75 | | C |
| ANISOU | 2991 | CG | GLN | L | 16 | 8307 | 7216 | 8318 | 1111 | 846 | −666 | C |
| ATOM | 2992 | CD | GLN | L | 16 | 29.619 | −23.543 | 24.749 | 1.00 | 69.84 | | C |
| ANISOU | 2992 | CD | GLN | L | 16 | 9278 | 8106 | 9153 | 1135 | 885 | −735 | C |
| ATOM | 2993 | OE1 | GLN | L | 16 | 28.624 | −23.475 | 24.010 | 1.00 | 76.30 | | O |
| ANISOU | 2993 | OE1 | GLN | L | 16 | 10174 | 8888 | 9928 | 1087 | 848 | −810 | O |
| ATOM | 2994 | NE2 | GLN | L | 16 | 30.864 | −23.417 | 24.296 | 1.00 | 63.43 | | N |
| ANISOU | 2994 | NE2 | GLN | L | 16 | 8438 | 7330 | 8331 | 1209 | 958 | −708 | N |
| ATOM | 2995 | N | THR | L | 17 | 27.274 | −19.957 | 26.504 | 1.00 | 51.56 | | N |
| ANISOU | 2995 | N | THR | L | 17 | 6810 | 6000 | 6781 | 878 | 655 | −696 | N |
| ATOM | 2996 | CA | THR | L | 17 | 26.363 | −18.848 | 26.761 | 1.00 | 50.46 | | C |
| ANISOU | 2996 | CA | THR | L | 17 | 6647 | 5910 | 6616 | 800 | 588 | −705 | C |
| ATOM | 2997 | C | THR | L | 17 | 25.254 | −19.321 | 27.676 | 1.00 | 52.11 | | C |
| ANISOU | 2997 | C | THR | L | 17 | 6857 | 6077 | 6865 | 752 | 540 | −702 | C |
| ATOM | 2998 | O | THR | L | 17 | 24.568 | −20.294 | 27.357 | 1.00 | 54.35 | | O |
| ANISOU | 2998 | O | THR | L | 17 | 1205 | 6277 | 7168 | 746 | 537 | −744 | O |
| ATOM | 2999 | CB | THR | L | 17 | 25.762 | −18.322 | 25.464 | 1.00 | 55.06 | | C |
| ANISOU | 2999 | CB | THR | L | 17 | 7294 | 6488 | 7137 | 772 | 570 | −775 | C |
| ATOM | 3000 | OG1 | THR | L | 17 | 26.808 | −17.835 | 24.637 | 1.00 | 57.23 | | O |
| ANISOU | 3000 | OG1 | THR | L | 17 | 7568 | 6807 | 7372 | 817 | 621 | −770 | O |
| ATOM | 3001 | CG2 | THR | L | 17 | 24.793 | −17.183 | 25.758 | 1.00 | 48.41 | | C |
| ANISOU | 3001 | CG2 | THR | L | 17 | 6425 | 5693 | 6276 | 696 | 500 | −781 | C |
| ATOM | 3002 | N | ALA | L | 18 | 25.074 | −18.636 | 28.803 | 1.00 | 44.12 | | N |
| ANISOU | 3002 | N | ALA | L | 18 | 5776 | 5121 | 5865 | 717 | 505 | −654 | N |
| ATOM | 3003 | CA | ALA | L | 18 | 23.988 | −18.970 | 29.711 | 1.00 | 44.51 | | C |
| ANISOU | 3003 | CA | ALA | L | 18 | 5822 | 5141 | 5949 | 670 | 465 | −646 | C |
| ATOM | 3004 | C | ALA | L | 18 | 22.785 | −18.078 | 29.430 | 1.00 | 49.91 | | C |
| ANISOU | 3004 | C | ALA | L | 18 | 6515 | 5843 | 6606 | 599 | 410 | −688 | C |
| ATOM | 3005 | O | ALA | L | 18 | 22.926 | −16.875 | 29.185 | 1.00 | 48.20 | | O |
| ANISOU | 3005 | O | ALA | L | 18 | 6272 | 5694 | 6349 | 582 | 392 | −690 | O |
| ATOM | 3006 | CB | ALA | L | 18 | 24.428 | −18.831 | 31.170 | 1.00 | 48.84 | | C |
| ANISOU | 3006 | CB | ALA | L | 18 | 6298 | 5735 | 6522 | 677 | 462 | −568 | C |
| ATOM | 3007 | N | ARG | L | 19 | 21.603 | −18.679 | 29.454 | 1.00 | 48.26 | | N |
| ANISOU | 3007 | N | ARG | L | 19 | 6341 | 5572 | 6425 | 559 | 382 | −717 | N |
| ATOM | 3008 | CA | ARG | L | 19 | 20.353 | −17.969 | 29.231 | 1.00 | 44.84 | | C |
| ANISOU | 3008 | CA | ARG | L | 19 | 5911 | 5146 | 5978 | 493 | 328 | −754 | C |
| ATOM | 3009 | C | ARG | L | 19 | 19.488 | −18.206 | 30.450 | 1.00 | 46.02 | | C |
| ANISOU | 3009 | C | ARG | L | 19 | 6025 | 5285 | 6175 | 456 | 308 | −718 | C |
| ATOM | 3010 | O | ARG | L | 19 | 19.214 | −19.352 | 30.806 | 1.00 | 47.18 | | O |
| ANISOU | 3010 | O | ARG | L | 19 | 6192 | 5365 | 6371 | 460 | 321 | −707 | O |
| ATOM | 3011 | CB | ARG | L | 19 | 19.678 | −18.437 | 27.940 | 1.00 | 43.54 | | C |
| ANISOU | 3011 | CB | ARG | L | 19 | 5824 | 4917 | 5803 | 476 | 309 | −828 | C |
| ATOM | 3012 | CG | ARG | L | 19 | 20.515 | −18.039 | 26.705 | 1.00 | 40.85 | | C |
| ANISOU | 3012 | CG | ARG | L | 19 | 5522 | 4599 | 5401 | 513 | 332 | −862 | C |
| ATOM | 3013 | CD | ARG | L | 19 | 19.869 | −18.498 | 25.417 | 1.00 | 52.62 | | C |
| ANISOU | 3013 | CD | ARG | L | 19 | 7100 | 6026 | 6869 | 498 | 310 | −939 | C |
| ATOM | 3014 | NE | ARG | L | 19 | 18.538 | −17.922 | 25.253 | 1.00 | 62.76 | | N |
| ANISOU | 3014 | NE | ARG | L | 19 | 8383 | 7313 | 8152 | 428 | 240 | −968 | N |
| ATOM | 3015 | CZ | ARG | L | 19 | 18.292 | −16.801 | 24.575 | 1.00 | 73.39 | | C |
| ANISOU | 3015 | CZ | ARG | L | 19 | 9730 | 8710 | 9445 | 406 | 207 | −990 | C |
| ATOM | 3016 | NH1 | ARG | L | 19 | 19.292 | −16.141 | 24.013 | 1.00 | 74.55 | | N |
| ANISOU | 3016 | NH1 | ARG | L | 19 | 9880 | 8909 | 9537 | 444 | 241 | −984 | N |
| ATOM | 3017 | NH2 | ARG | L | 19 | 17.047 | −16.341 | 24.448 | 1.00 | 76.72 | | N |
| ANISOU | 3017 | NH2 | ARG | L | 19 | 10146 | 9129 | 9874 | 345 | 142 | −1013 | N |
| ATOM | 3018 | N | ILE | L | 20 | 19.134 | −17.126 | 31.135 | 1.00 | 38.52 | | N |
| ANISOU | 3018 | N | ILE | L | 20 | 5023 | 4401 | 5209 | 424 | 281 | −694 | N |
| ATOM | 3019 | CA | ILE | L | 20 | 18.356 | −17.182 | 32.361 | 1.00 | 34.56 | | C |
| ANISOU | 3019 | CA | ILE | L | 20 | 4485 | 3903 | 4742 | 393 | 270 | −655 | C |
| ATOM | 3020 | C | ILE | L | 20 | 17.079 | −16.413 | 32.084 | 1.00 | 41.65 | | C |
| ANISOU | 3020 | C | ILE | L | 20 | 5376 | 4810 | 5637 | 335 | 224 | −690 | C |
| ATOM | 3021 | O | ILE | L | 20 | 17.131 | −15.219 | 31.762 | 1.00 | 42.60 | | O |
| ANISOU | 3021 | O | ILE | L | 20 | 5481 | 4988 | 5716 | 324 | 202 | −705 | O |
| ATOM | 3022 | CB | ILE | L | 20 | 19.126 | −16.576 | 33.541 | 1.00 | 40.41 | | C |
| ANISOU | 3022 | CB | ILE | L | 20 | 5171 | 4717 | 5465 | 415 | 282 | −594 | C |
| ATOM | 3023 | CG1 | ILE | L | 20 | 20.390 | −17.400 | 33.836 | 1.00 | 44.63 | | C |
| ANISOU | 3023 | CG1 | ILE | L | 20 | 5704 | 5241 | 6011 | 475 | 323 | −553 | C |
| ATOM | 3024 | CG2 | ILE | L | 20 | 18.231 | −16.478 | 34.776 | 1.00 | 39.86 | | C |
| ANISOU | 3024 | CG2 | ILE | L | 20 | 5070 | 4659 | 5418 | 382 | 271 | −558 | C |
| ATOM | 3025 | CD1 | ILE | L | 20 | 21.228 | −16.791 | 34.872 | 1.00 | 40.45 | | C |
| ANISOU | 3025 | CD1 | ILE | L | 20 | 5123 | 4784 | 5461 | 496 | 325 | −495 | C |
| ATOM | 3026 | N | THR | L | 21 | 15.949 | −17.098 | 32.168 | 1.00 | 40.84 | | N |

TABLE 14-continued

| | | | | | | | | | | | | |
|---|---|---|---|---|---|---|---|---|---|---|---|---|
| ANISOU | 3026 | N | THR | L | 21 | 5286 | 4649 | 5584 | 298 | 209 | −701 | N |
| ATOM | 3027 | CA | THR | L | 21 | 14.679 | −16.556 | 31.742 | 1.00 | 45.69 | | C |
| ANISOU | 3027 | CA | THR | L | 21 | 5895 | 5259 | 6207 | 243 | 163 | −737 | C |
| ATOM | 3028 | C | THR | L | 21 | 13.930 | −15.975 | 32.934 | 1.00 | 46.60 | | C |
| ANISOU | 3028 | C | THR | L | 21 | 5952 | 5413 | 6340 | 215 | 160 | −696 | C |
| ATOM | 3029 | O | THR | L | 21 | 14.145 | −16.350 | 34.086 | 1.00 | 39.87 | | O |
| ANISOU | 3029 | O | THR | L | 21 | 5077 | 4569 | 5505 | 230 | 191 | −642 | O |
| ATOM | 3030 | CB | THR | L | 21 | 13.823 | −17.637 | 31.080 | 1.00 | 47.42 | | C |
| ANISOU | 3030 | CB | THR | L | 21 | 6156 | 5387 | 6475 | 213 | 143 | −775 | C |
| ATOM | 3031 | OG1 | THR | L | 21 | 13.629 | −18.696 | 32.021 | 1.00 | 49.15 | | O |
| ANISOU | 3031 | OG1 | THR | L | 21 | 6365 | 5559 | 6753 | 213 | 172 | −731 | O |
| ATOM | 3032 | CG2 | THR | L | 21 | 14.529 | −18.197 | 29.852 | 1.00 | 43.31 | | C |
| ANISOU | 3032 | CG2 | THR | L | 21 | 5704 | 4824 | 5927 | 243 | 148 | −824 | C |
| ATOM | 3033 | N | CYS | L | 22 | 13.034 | −15.047 | 32.630 | 1.00 | 43.90 | | N |
| ANISOU | 3033 | N | CYS | L | 22 | 5592 | 5097 | 5993 | 178 | 122 | −720 | N |
| ATOM | 3034 | CA | CYS | L | 22 | 12.278 | −14.337 | 33.643 | 1.00 | 41.97 | | C |
| ANISOU | 3034 | CA | CYS | L | 22 | 5294 | 4891 | 5760 | 155 | 121 | −689 | C |
| ATOM | 3035 | C | CYS | L | 22 | 10.923 | −14.206 | 32.977 | 1.00 | 47.43 | | C |
| ANISOU | 3035 | C | CYS | L | 22 | 5979 | 5552 | 6488 | 106 | 77 | −724 | C |
| ATOM | 3036 | O | CYS | I | 22 | 10.779 | −13.454 | 32.011 | 1.00 | 50.85 | | O |
| ANISOU | 3036 | O | CYS | L | 22 | 6425 | 6002 | 6894 | 95 | 39 | −766 | O |
| ATOM | 3037 | CB | CYS | L | 22 | 12.890 | −12.980 | 33.974 | 1.00 | 42.35 | | C |
| ANISOU | 3037 | CB | CYS | L | 22 | 5319 | 5021 | 5750 | 173 | 120 | −679 | C |
| ATOM | 3038 | SG | CYS | L | 22 | 12.017 | −11.993 | 35.199 | 1.00 | 49.25 | | S |
| ANISOU | 3038 | SG | CYS | L | 22 | 6139 | 5945 | 6628 | 154 | 122 | −648 | S |
| ATOM | 3039 | N | GLY | L | 23 | 9.969 | −15.001 | 33.436 | 1.00 | 49.44 | | N |
| ANISOU | 3039 | N | GLY | L | 23 | 6216 | 5758 | 6809 | 75 | 82 | −706 | N |
| ATOM | 3040 | CA | GLY | L | 23 | 8.667 | −15.048 | 32.807 | 1.00 | 38.50 | | C |
| ANISOU | 3040 | CA | GLY | L | 23 | 4819 | 4336 | 5474 | 25 | 36 | −735 | C |
| ATOM | 3041 | C | GLY | L | 23 | 7.742 | −14.120 | 33.565 | 1.00 | 38.43 | | C |
| ANISOU | 3041 | C | GLY | L | 23 | 4747 | 4372 | 5482 | 5 | 37 | −709 | C |
| ATOM | 3042 | O | GLY | L | 23 | 7.789 | −14.043 | 34.787 | 1.00 | 41.91 | | O |
| ANISOU | 3042 | O | GLY | L | 23 | 5157 | 4842 | 5926 | 19 | 82 | −659 | O |
| ATOM | 3043 | N | GLY | L | 24 | 6.914 | −13.406 | 32.821 | 1.00 | 45.45 | | N |
| ANISOU | 3043 | N | GLY | L | 24 | 5621 | 5268 | 6380 | −25 | −13 | −742 | N |
| ATOM | 3044 | CA | GLY | L | 24 | 5.787 | −12.733 | 33.430 | 1.00 | 41.51 | | C |
| ANISOU | 3044 | CA | GLY | L | 24 | 5058 | 4795 | 5920 | −49 | −15 | −718 | C |
| ATOM | 3045 | C | GLY | L | 24 | 4.834 | −12.289 | 32.356 | 1.00 | 43.24 | | C |
| ANISOU | 3045 | C | GLY | L | 24 | 5266 | 5000 | 6164 | −86 | −82 | −759 | C |
| ATOM | 3046 | O | GLY | L | 24 | 5.214 | −12.106 | 31.194 | 1.00 | 47.94 | | O |
| ANISOU | 3046 | O | GLY | L | 24 | 5907 | 5590 | 6720 | −84 | −126 | −805 | O |
| ATOM | 3047 | N | ASN | L | 25 | 3.587 | −12.097 | 32.759 | 1.00 | 45.42 | | N |
| ANISOU | 3047 | N | ASN | L | 25 | 5478 | 5272 | 6505 | −116 | −88 | −737 | N |
| ATOM | 3048 | CA | ASN | L | 25 | 2.582 | −11.750 | 31.776 | 1.00 | 44.61 | | C |
| ANISOU | 3048 | CA | ASN | L | 25 | 5357 | 5155 | 6440 | −154 | −158 | −769 | C |
| ATOM | 3049 | C | ASN | L | 25 | 2.868 | −10.373 | 31.185 | 1.00 | 38.02 | | C |
| ANISOU | 3049 | C | ASN | L | 25 | 4531 | 4375 | 5539 | −134 | −189 | −795 | C |
| ATOM | 3050 | O | ASN | L | 25 | 2.894 | −9.375 | 31.906 | 1.00 | 42.74 | | O |
| ANISOU | 3050 | O | ASN | L | 25 | 5097 | 5025 | 6116 | −110 | −158 | −772 | O |
| ATOM | 3051 | CB | ASN | L | 25 | 1.198 | −11.788 | 32.416 | 1.00 | 51.37 | | C |
| ANISOU | 3051 | CB | ASN | L | 25 | 6131 | 6001 | 7388 | −188 | −152 | −731 | C |
| ATOM | 3052 | CG | ASN | L | 25 | 0.167 | −11.152 | 31.529 | 1.00 | 60.50 | | C |
| ANISOU | 3052 | CG | ASN | L | 25 | 7253 | 7156 | 8579 | −220 | −225 | −756 | C |
| ATOM | 3053 | OD1 | ASN | L | 25 | −0.089 | −11.636 | 30.426 | 1.00 | 61.16 | | O |
| ANISOU | 3053 | OD1 | ASN | L | 25 | 7364 | 7196 | 8678 | −253 | −294 | −795 | O |
| ATOM | 3054 | ND2 | ASN | L | 25 | −0.384 | −10.027 | 31.971 | 1.00 | 64.70 | | N |
| ANISOU | 3054 | ND2 | ASN | L | 25 | 7729 | 7737 | 9118 | −207 | −213 | −735 | N |
| ATOM | 3055 | N | ASN | L | 26 | 3.031 | −10.317 | 29.870 | 1.00 | 36.17 | | N |
| ANISOU | 3055 | N | ASN | L | 26 | 4344 | 4125 | 5274 | −143 | −251 | −843 | N |
| ATOM | 3056 | CA | ASN | L | 26 | 3.305 | −9.077 | 29.155 | 1.00 | 40.80 | | C |
| ANISOU | 3056 | CA | ASN | L | 26 | 4946 | 4756 | 5798 | −127 | −285 | −867 | C |
| ATOM | 3057 | C | ASN | L | 26 | 4.547 | −8.365 | 29.710 | 1.00 | 46.94 | | C |
| ANISOU | 3057 | C | ASN | L | 26 | 5745 | 5588 | 6503 | −79 | −232 | −853 | C |
| ATOM | 3058 | O | ASN | L | 26 | 4.592 | −7.130 | 29.806 | 1.00 | 43.41 | | O |
| ANISOU | 3058 | O | ASN | L | 26 | 5280 | 5188 | 6026 | −63 | −234 | −849 | O |
| ATOM | 3059 | CB | ASN | L | 26 | 2.110 | −8.135 | 29.201 | 1.00 | 47.51 | | C |
| ANISOU | 3059 | CB | ASN | L | 26 | 5730 | 5627 | 6693 | −145 | −318 | −855 | C |
| ATOM | 3060 | CG | ASN | L | 26 | 2.223 | −7.062 | 28.175 | 1.00 | 59.52 | | C |
| ANISOU | 3060 | CG | ASN | L | 26 | 7276 | 7177 | 8163 | −137 | −371 | −883 | C |
| ATOM | 3061 | OD1 | ASN | L | 26 | 2.859 | −7.266 | 27.148 | 1.00 | 56.69 | | O |
| ANISOU | 3061 | OD1 | ASN | L | 26 | 6984 | 6807 | 7749 | −134 | −403 | −918 | O |
| ATOM | 3062 | ND2 | ASN | L | 26 | 1.648 | −5.890 | 28.452 | 1.00 | 68.11 | | N |
| ANISOU | 3062 | ND2 | ASN | L | 26 | 8314 | 8302 | 9264 | −129 | −377 | −866 | N |
| ATOM | 3063 | N | ILE | L | 27 | 5.556 | −9.146 | 30.100 | 1.00 | 44.04 | | N |
| ANISOU | 3063 | N | ILE | L | 27 | 5413 | 5211 | 6111 | −56 | −186 | −845 | N |
| ATOM | 3064 | CA | ILE | L | 27 | 6.746 | −8.531 | 30.684 | 1.00 | 45.67 | | C |
| ANISOU | 3064 | CA | ILE | L | 27 | 5631 | 5467 | 6254 | −14 | −140 | −828 | C |
| ATOM | 3065 | C | ILE | L | 27 | 7.494 | −7.711 | 29.651 | 1.00 | 41.53 | | C |
| ANISOU | 3065 | C | ILE | L | 27 | 5148 | 4971 | 5662 | 2 | −168 | −858 | C |
| ATOM | 3066 | O | ILE | L | 27 | 8.283 | −6.825 | 30.019 | 1.00 | 42.83 | | O |

TABLE 14-continued

| | | | | | | | | | | | | |
|---|---|---|---|---|---|---|---|---|---|---|---|---|
| ANISOU | 3066 | O | ILE | L | 27 | 5309 | 5182 | 5780 | 28 | −146 | −845 | O |
| ATOM | 3067 | CB | ILE | L | 27 | 7.610 | −9.614 | 31.336 | 1.00 | 41.21 | | C |
| ANISOU | 3067 | CB | ILE | L | 27 | 5087 | 4884 | 5686 | 7 | −89 | −807 | C |
| ATOM | 3068 | CG1 | ILE | L | 27 | 8.656 | −8.988 | 32.280 | 1.00 | 42.19 | | C |
| ANISOU | 3068 | CG1 | ILE | L | 27 | 5206 | 5064 | 5761 | 45 | −43 | −777 | C |
| ATOM | 3069 | CG2 | ILE | L | 27 | 8.268 | −10.469 | 30.270 | 1.00 | 40.07 | | C |
| ANISOU | 3069 | CG2 | ILE | L | 27 | 5006 | 4699 | 5520 | 12 | −104 | −841 | C |
| ATOM | 3070 | CD1 | ILE | L | 27 | 9.504 | −10.068 | 33.010 | 1.00 | 39.57 | | C |
| ANISOU | 3070 | CD1 | ILE | L | 27 | 4890 | 4716 | 5429 | 69 | 5 | −747 | C |
| ATOM | 3071 | N | GLY | L | 28 | 7.236 | −7.972 | 28.363 | 1.00 | 34.20 | | N |
| ANISOU | 3071 | N | GLY | L | 28 | 4257 | 4011 | 4725 | −16 | −219 | −896 | N |
| ATOM | 3072 | CA | GLY | L | 28 | 7.712 | −7.123 | 27.294 | 1.00 | 37.99 | | C |
| ANISOU | 3072 | CA | GLY | L | 28 | 4774 | 4517 | 5143 | −5 | −250 | −922 | C |
| ATOM | 3073 | C | GLY | L | 28 | 7.381 | −5.656 | 27.454 | 1.00 | 43.07 | | C |
| ANISOU | 3073 | C | GLY | L | 28 | 5381 | 5207 | 5777 | −4 | −266 | −909 | C |
| ATOM | 3074 | O | GLY | L | 28 | 8.050 | −4.810 | 26.863 | 1.00 | 43.11 | | O |
| ANISOU | 3074 | O | GLY | L | 28 | 5412 | 5242 | 5726 | 13 | −273 | −916 | O |
| ATOM | 3075 | N | SER | L | 29 | 6.315 | −5.330 | 28.210 | 1.00 | 45.61 | | N |
| ANISOU | 3075 | N | SER | L | 29 | 5642 | 5531 | 6156 | −20 | −270 | −889 | N |
| ATOM | 3076 | CA | SER | L | 29 | 5.914 | −3.948 | 28.466 | 1.00 | 37.03 | | C |
| ANISOU | 3076 | CA | SER | L | 29 | 4519 | 4482 | 5068 | −15 | −280 | −877 | C |
| ATOM | 3077 | C | SER | L | 29 | 6.703 | −3.278 | 29.608 | 1.00 | 41.61 | | C |
| ANISOU | 3077 | C | SER | L | 29 | 5084 | 5103 | 5621 | 15 | −225 | −851 | C |
| ATOM | 3078 | O | SER | L | 29 | 6.455 | −2.102 | 29.900 | 1.00 | 47.75 | | O |
| ANISOU | 3078 | O | SER | L | 29 | 5838 | 5909 | 6396 | 22 | −229 | −843 | O |
| ATOM | 3079 | CB | SER | L | 29 | 4.406 | −3.869 | 28.776 | 1.00 | 44.89 | | C |
| ANISOU | 3079 | CB | SER | L | 29 | 5454 | 5463 | 6141 | −40 | −303 | −866 | C |
| ATOM | 3080 | OG | SER | L | 29 | 4.087 | −4.399 | 30.064 | 1.00 | 48.86 | | O |
| ANISOU | 3080 | OG | SER | L | 29 | 5914 | 5961 | 6689 | −39 | −251 | −836 | O |
| ATOM | 3081 | N | LYS | L | 30 | 7.639 | −3.987 | 30.202 | 1.00 | 37.32 | | N |
| ANISOU | 3081 | N | LYS | L | 30 | 4558 | 4562 | 5059 | 31 | −179 | −839 | N |
| ATOM | 3082 | CA | LYS | L | 30 | 8.377 | −3.409 | 31.336 | 1.00 | 38.63 | | C |
| ANISOU | 3082 | CA | LYS | L | 30 | 4712 | 4767 | 5199 | 56 | −135 | −814 | C |
| ATOM | 3083 | C | LYS | L | 30 | 9.894 | −3.608 | 31.227 | 1.00 | 39.74 | | C |
| ANISOU | 3083 | C | LYS | L | 30 | 4889 | 4924 | 5285 | 79 | −113 | −811 | C |
| ATOM | 3084 | O | LYS | L | 30 | 10.312 | −4.639 | 30.802 | 1.00 | 32.62 | | O |
| ANISOU | 3084 | O | LYS | L | 30 | 4015 | 3997 | 4382 | 82 | −105 | −817 | O |
| ATOM | 3085 | CB | LYS | L | 30 | 7.960 | −4.153 | 32.597 | 1.00 | 37.88 | | C |
| ANISOU | 3085 | CB | LYS | L | 30 | 4587 | 4663 | 5142 | 57 | −93 | −786 | C |
| ATOM | 3086 | CG | LYS | L | 30 | 6.491 | −4.079 | 32.966 | 1.00 | 38.38 | | C |
| ANISOU | 3086 | CG | LYS | L | 30 | 4602 | 4712 | 5268 | 37 | −98 | −778 | C |
| ATOM | 3087 | CD | LYS | L | 30 | 6.178 | −4.878 | 34.183 | 1.00 | 38.45 | | C |
| ANISOU | 3087 | CD | LYS | L | 30 | 4586 | 4713 | 5310 | 39 | −48 | −745 | C |
| ATOM | 3088 | CE | LYS | L | 30 | 4.781 | −4.680 | 34.715 | 1.00 | 48.65 | | C |
| ANISOU | 3088 | CE | LYS | L | 30 | 5822 | 5998 | 6663 | 26 | −38 | −728 | C |
| ATOM | 3089 | NZ | LYS | L | 30 | 3.805 | −4.567 | 33.622 | 1.00 | 48.28 | | N |
| ANISOU | 3089 | NZ | LYS | L | 30 | 5756 | 5926 | 6663 | −3 | −95 | −750 | N |
| ATOM | 3090 | N | SER | L | 31 | 10.656 | −2.584 | 31.580 | 1.00 | 35.15 | | N |
| ANISOU | 3090 | N | SER | L | 31 | 4306 | 4382 | 4667 | 95 | −105 | −801 | N |
| ATOM | 3091 | CA | SER | L | 31 | 12.093 | −2.759 | 31.769 | 1.00 | 36.25 | | C |
| ANISOU | 3091 | CA | SER | L | 31 | 4464 | 4543 | 4767 | 117 | −78 | −788 | C |
| ATOM | 3092 | C | SER | L | 31 | 12.349 | −3.879 | 32.762 | 1.00 | 36.50 | | C |
| ANISOU | 3092 | C | SER | L | 31 | 4489 | 4566 | 4815 | 129 | −40 | −764 | C |
| ATOM | 3093 | O | SER | L | 31 | 11.807 | −3.865 | 33.872 | 1.00 | 36.49 | | O |
| ANISOU | 3093 | O | SER | L | 31 | 4462 | 4570 | 4832 | 128 | −23 | −746 | O |
| ATOM | 3094 | CB | SER | L | 31 | 12.724 | −1.476 | 32.300 | 1.00 | 36.41 | | C |
| ANISOU | 3094 | CB | SER | L | 31 | 4473 | 4605 | 4757 | 125 | −79 | −777 | C |
| ATOM | 3095 | OG | SER | L | 31 | 12.623 | −0.448 | 31.348 | 1.00 | 40.83 | | O |
| ANISOU | 3095 | OG | SER | L | 31 | 5042 | 5170 | 5302 | 116 | −111 | −793 | O |
| ATOM | 3096 | N | VAL | L | 32 | 13.213 | −4.819 | 32.388 | 1.00 | 37.55 | | N |
| ANISOU | 3096 | N | VAL | L | 32 | 4646 | 4685 | 4937 | 144 | −23 | −761 | N |
| ATOM | 3097 | CA | VAL | L | 32 | 13.660 | −5.886 | 33.288 | 1.00 | 34.60 | | C |
| ANISOU | 3097 | CA | VAL | L | 32 | 4269 | 4303 | 4576 | 161 | 14 | −732 | C |
| ATOM | 3098 | C | VAL | L | 32 | 15.111 | −5.611 | 33.670 | 1.00 | 32.36 | | C |
| ANISOU | 3098 | C | VAL | L | 32 | 3983 | 4056 | 4254 | 188 | 31 | −709 | C |
| ATOM | 3099 | O | VAL | L | 32 | 15.974 | −5.428 | 32.805 | 1.00 | 33.80 | | O |
| ANISOU | 3099 | O | VAL | L | 32 | 4182 | 4247 | 4413 | 199 | 28 | −717 | O |
| ATOM | 3100 | CB | VAL | L | 32 | 13.498 | −7.278 | 32.643 | 1.00 | 35.10 | | C |
| ANISOU | 3100 | CB | VAL | L | 32 | 4359 | 4312 | 4666 | 161 | 21 | −744 | C |
| ATOM | 3101 | CG1 | VAL | L | 32 | 14.069 | −8.382 | 33.517 | 1.00 | 35.86 | | C |
| ANISOU | 3101 | CG1 | VAL | L | 32 | 4454 | 4395 | 4776 | 183 | 61 | −709 | C |
| ATOM | 3102 | CG2 | VAL | L | 32 | 11.945 | −7.573 | 32.369 | 1.00 | 31.41 | | C |
| ANISOU | 3102 | CG2 | VAL | L | 32 | 3884 | 3804 | 4247 | 126 | −3 | −763 | C |
| ATOM | 3103 | N | HIS | L | 33 | 15.369 | −5.567 | 34.970 | 1.00 | 29.67 | | N |
| ANISOU | 3103 | N | HIS | L | 33 | 3623 | 3740 | 3909 | 198 | 48 | −677 | N |
| ATOM | 3104 | CA | HIS | L | 33 | 16.694 | −5.312 | 35.488 | 1.00 | 37.75 | | C |
| ANISOU | 3104 | CA | HIS | L | 33 | 4639 | 4802 | 4902 | 220 | 56 | −651 | C |
| ATOM | 3105 | C | HIS | L | 33 | 17.154 | −6.587 | 36.145 | 1.00 | 39.00 | | C |
| ANISOU | 3105 | C | HIS | L | 33 | 4798 | 4946 | 5074 | 243 | 86 | −618 | C |
| ATOM | 3106 | O | HIS | L | 33 | 16.352 | −7.305 | 36.753 | 1.00 | 35.98 | | O |

TABLE 14-continued

| | | | | | | | | | | | | |
|---|---|---|---|---|---|---|---|---|---|---|---|---|
| ANISOU | 3106 | O | HIS | L | 33 | 4415 | 4538 | 4717 | 239 | 102 | −606 | O |
| ATOM | 3107 | CB | HIS | L | 33 | 16.700 | −4.164 | 36.504 | 1.00 | 32.12 | | C |
| ANISOU | 3107 | CB | HIS | L | 33 | 3909 | 4131 | 4165 | 214 | 42 | −642 | C |
| ATOM | 3108 | CG | HIS | L | 33 | 15.918 | −2.970 | 36.062 | 1.00 | 32.88 | | C |
| ANISOU | 3108 | CG | HIS | L | 33 | 4003 | 4230 | 4259 | 191 | 16 | −673 | C |
| ATOM | 3109 | ND1 | HIS | L | 33 | 16.228 | −2.246 | 34.932 | 1.00 | 34.58 | | N |
| ANISOU | 3109 | ND1 | HIS | L | 33 | 4226 | 4449 | 4463 | 182 | −6 | −693 | N |
| ATOM | 3110 | CD2 | HIS | L | 33 | 14.844 | −2.357 | 36.619 | 1.00 | 28.91 | | C |
| ANISOU | 3110 | CD2 | HIS | L | 33 | 3492 | 3729 | 3764 | 178 | 11 | −683 | C |
| ATOM | 3111 | CE1 | HIS | L | 33 | 15.373 | −1.246 | 34.798 | 1.00 | 30.60 | | C |
| ANISOU | 3111 | CE1 | HIS | L | 33 | 3719 | 3946 | 3963 | 165 | −28 | −714 | C |
| ATOM | 3112 | NE2 | HIS | L | 33 | 14.504 | −1.306 | 35.798 | 1.00 | 32.14 | | N |
| ANISOU | 3112 | NE2 | HIS | L | 33 | 3903 | 4138 | 4171 | 163 | −18 | −710 | N |
| ATOM | 3113 | N | TRP | L | 34 | 18.432 | −6.874 | 35.991 | 1.00 | 30.81 | | N |
| ANISOU | 3113 | N | TRP | L | 34 | 3759 | 3922 | 4024 | 269 | 96 | −598 | N |
| ATOM | 3114 | CA | TRP | L | 34 | 19.026 | −8.125 | 36.498 | 1.00 | 35.88 | | C |
| ANISOU | 3114 | CA | TRP | L | 34 | 4403 | 4548 | 4682 | 299 | 125 | −563 | C |
| ATOM | 3115 | C | TRP | L | 34 | 20.153 | −7.827 | 37.477 | 1.00 | 42.56 | | C |
| ANISOU | 3115 | C | TRP | L | 34 | 5224 | 5442 | 5505 | 319 | 122 | −521 | C |
| ATOM | 3116 | O | TRP | L | 34 | 20.957 | −6.985 | 37.178 | 1.00 | 37.77 | | O |
| ANISOU | 3116 | O | TRP | L | 34 | 4603 | 4870 | 4879 | 319 | 105 | −523 | O |
| ATOM | 3117 | CB | TRP | L | 34 | 19.557 | −8.921 | 35.325 | 1.00 | 35.45 | | C |
| ANISOU | 3117 | CB | TRP | L | 34 | 4370 | 4459 | 4642 | 319 | 143 | −576 | C |
| ATOM | 3118 | CG | TRP | L | 34 | 18.530 | −9.467 | 34.393 | 1.00 | 34.62 | | C |
| ANISOU | 3118 | CG | TRP | L | 34 | 4296 | 4299 | 4559 | 301 | 142 | −616 | C |
| ATOM | 3119 | CD1 | TRP | L | 34 | 18.089 | −8.923 | 33.235 | 1.00 | 33.03 | | C |
| ANISOU | 3119 | CD1 | TRP | L | 34 | 4113 | 4089 | 4346 | 282 | 122 | −659 | C |
| ATOM | 3120 | CD2 | TRP | L | 34 | 17.889 | −10.735 | 34.504 | 1.00 | 36.32 | | C |
| ANISOU | 3120 | CD2 | TRP | L | 34 | 4530 | 4457 | 4813 | 301 | 159 | −615 | C |
| ATOM | 3121 | NE1 | TRP | L | 34 | 17.193 | −9.750 | 32.638 | 1.00 | 36.29 | | N |
| ANISOU | 3121 | NE1 | TRP | L | 34 | 4555 | 4445 | 4786 | 268 | 119 | −688 | N |
| ATOM | 3122 | CE2 | TRP | L | 34 | 17.056 | −10.870 | 33.390 | 1.00 | 33.33 | | C |
| ANISOU | 3122 | CE2 | TRP | L | 34 | 4180 | 4038 | 4446 | 277 | 142 | −662 | C |
| ATOM | 3123 | CE3 | TRP | L | 34 | 17.935 | −11.759 | 35.442 | 1.00 | 39.51 | | C |
| ANISOU | 3123 | CE3 | TRP | L | 34 | 4929 | 4838 | 5243 | 317 | 184 | −576 | C |
| ATOM | 3124 | CZ2 | TRP | L | 34 | 16.280 | −11.995 | 33.184 | 1.00 | 33.44 | | C |
| ANISOU | 3124 | CZ2 | TRP | L | 34 | 4217 | 3987 | 4501 | 266 | 147 | −675 | C |
| ATOM | 3125 | CZ3 | TRP | L | 34 | 17.163 | −12.868 | 35.233 | 1.00 | 34.81 | | C |
| ANISOU | 3125 | CZ3 | TRP | L | 34 | 4357 | 4178 | 4691 | 307 | 195 | −586 | C |
| ATOM | 3126 | CH2 | TRP | L | 34 | 16.349 | −12.982 | 34.123 | 1.00 | 34.85 | | C |
| ANISOU | 3126 | CH2 | TRP | L | 34 | 4389 | 4141 | 4712 | 280 | 175 | −636 | C |
| ATOM | 3127 | N | TYR | L | 35 | 20.180 | −8.600 | 38.547 | 1.00 | 37.22 | | N |
| ANISOU | 3127 | N | TYR | L | 35 | 4545 | 4763 | 4835 | 335 | 137 | −483 | N |
| ATOM | 3128 | CA | TYR | L | 35 | 21.154 | −8.468 | 39.636 | 1.00 | 32.13 | | C |
| ANISOU | 3128 | CA | TYR | L | 35 | 3880 | 4162 | 4167 | 355 | 128 | −438 | C |
| ATOM | 3129 | C | TYR | L | 35 | 21.837 | −9.806 | 39.866 | 1.00 | 41.06 | | C |
| ANISOU | 3129 | C | TYR | L | 35 | 5009 | 5270 | 5321 | 393 | 155 | −395 | C |
| ATOM | 3130 | O | TYR | L | 35 | 21.230 | −10.830 | 39.777 | 1.00 | 40.68 | | O |
| ANISOU | 3130 | O | TYR | L | 35 | 4980 | 5173 | 5303 | 398 | 182 | −393 | O |
| ATOM | 3131 | CB | TYR | L | 35 | 20.450 | −7.973 | 40.888 | 1.00 | 29.78 | | C |
| ANISOU | 3131 | CB | TYR | L | 35 | 3584 | 3888 | 3841 | 339 | 117 | −429 | C |
| ATOM | 3132 | CG | TYR | L | 35 | 19.709 | −6.692 | 40.667 | 1.00 | 33.56 | | C |
| ANISOU | 3132 | CG | TYR | L | 35 | 4066 | 4381 | 4303 | 307 | 95 | −472 | C |
| ATOM | 3133 | CD1 | TYR | L | 35 | 20.332 | −5.476 | 40.828 | 1.00 | 38.62 | | C |
| ANISOU | 3133 | CD1 | TYR | L | 35 | 4696 | 5065 | 4912 | 297 | 61 | −480 | C |
| ATOM | 3134 | CD2 | TYR | L | 35 | 18.399 | −6.700 | 40.265 | 1.00 | 32.61 | | C |
| ANISOU | 3134 | CD2 | TYR | L | 35 | 3957 | 4228 | 4204 | 286 | 106 | −502 | C |
| ATOM | 3135 | CE1 | TYR | L | 35 | 19.664 | −4.288 | 40.622 | 1.00 | 33.49 | | C |
| ANISOU | 3135 | CE1 | TYR | L | 35 | 4051 | 4423 | 4250 | 271 | 41 | −518 | C |
| ATOM | 3136 | CE2 | TYR | L | 35 | 17.714 | −5.524 | 40.051 | 1.00 | 37.53 | | C |
| ANISOU | 3136 | CE2 | TYR | L | 35 | 4581 | 4863 | 4817 | 261 | 86 | −538 | C |
| ATOM | 3137 | CZ | TYR | L | 35 | 18.351 | −4.319 | 40.218 | 1.00 | 35.11 | | C |
| ANISOU | 3137 | CZ | TYR | L | 35 | 4267 | 4596 | 4476 | 255 | 56 | −547 | C |
| ATOM | 3138 | OH | TYR | L | 35 | 17.680 | −3.182 | 39.984 | 1.00 | 32.88 | | O |
| ANISOU | 3138 | OH | TYR | L | 35 | 3988 | 4319 | 4188 | 234 | 38 | −581 | O |
| ATOM | 3139 | N | GLN | L | 36 | 23.126 | −9.731 | 40.093 | 1.00 | 40.27 | | N |
| ANISOU | 3139 | N | GLN | L | 36 | 4884 | 5204 | 5212 | 418 | 145 | −362 | N |
| ATOM | 3140 | CA | GLN | L | 36 | 23.953 | −10.883 | 40.383 | 1.00 | 37.20 | | C |
| ANISOU | 3140 | CA | GLN | L | 36 | 4486 | 4802 | 4846 | 460 | 167 | −314 | C |
| ATOM | 3141 | C | GLN | L | 36 | 24.316 | −10.851 | 41.858 | 1.00 | 37.68 | | C |
| ANISOU | 3141 | C | GLN | L | 36 | 4533 | 4902 | 4881 | 470 | 145 | −263 | C |
| ATOM | 3142 | O | GLN | L | 36 | 24.678 | −9.806 | 42.389 | 1.00 | 38.69 | | O |
| ANISOU | 3142 | O | GLN | L | 36 | 4645 | 5082 | 4972 | 454 | 106 | −262 | O |
| ATOM | 3143 | CB | GLN | L | 36 | 25.217 | −10.829 | 39.503 | 1.00 | 38.23 | | C |
| ANISOU | 3143 | CB | GLN | L | 36 | 4591 | 4944 | 4991 | 486 | 172 | −309 | C |
| ATOM | 3144 | CG | GLN | L | 36 | 26.337 | −11.731 | 39.849 | 1.00 | 42.67 | | C |
| ANISOU | 3144 | CG | GLN | L | 36 | 5128 | 5507 | 5576 | 535 | 188 | −253 | C |
| ATOM | 3145 | CD | GLN | L | 36 | 27.595 | −11.318 | 39.087 | 1.00 | 42.83 | | C |
| ANISOU | 3145 | CD | GLN | L | 36 | 5110 | 5556 | 5607 | 554 | 189 | −246 | C |
| ATOM | 3146 | OE1 | GLN | L | 36 | 28.214 | −10.298 | 39.399 | 1.00 | 41.98 | | O |

TABLE 14-continued

| | | | | | | | | | | | | |
|---|---|---|---|---|---|---|---|---|---|---|---|---|
| ANISOU | 3146 | OE1 | GLN | L | 36 | 4966 | 5503 | 5480 | 538 | 152 | −234 | O |
| ATOM | 3147 | NE2 | GLN | L | 36 | 27.892 | −12.026 | 38.019 | 1.00 | 41.04 | | N |
| ANISOU | 3147 | NE2 | GLN | L | 36 | 4895 | 5290 | 5410 | 585 | 233 | −258 | N |
| ATOM | 3148 | N | GLN | L | 37 | 24.241 | −11.994 | 42.526 | 1.00 | 41.39 | | N |
| ANISOU | 3148 | N | GLN | L | 37 | 5014 | 5346 | 5366 | 496 | 168 | −220 | N |
| ATOM | 3149 | CA | GLN | L | 37 | 24.591 | −12.049 | 43.933 | 1.00 | 40.55 | | C |
| ANISOU | 3149 | CA | GLN | L | 37 | 4901 | 5278 | 5228 | 509 | 147 | −167 | C |
| ATOM | 3150 | C | GLN | L | 37 | 25.501 | −13.247 | 44.149 | 1.00 | 41.84 | | C |
| ANISOU | 3150 | C | GLN | L | 37 | 5051 | 5424 | 5423 | 558 | 164 | −107 | C |
| ATOM | 3151 | O | GLN | L | 37 | 25.079 | −14.395 | 43.976 | 1.00 | 41.45 | | O |
| ANISOU | 3151 | O | GLN | L | 37 | 5023 | 5317 | 5411 | 576 | 204 | −95 | O |
| ATOM | 3152 | CB | GLN | L | 37 | 23.356 | −12.142 | 44.833 | 1.00 | 34.72 | | C |
| ANISOU | 3152 | CB | GLN | L | 37 | 4194 | 4531 | 4467 | 489 | 159 | −164 | C |
| ATOM | 3153 | CG | GLN | L | 37 | 23.791 | −11.859 | 46.263 | 1.00 | 34.07 | | C |
| ANISOU | 3153 | CG | GLN | L | 37 | 4111 | 4503 | 4331 | 499 | 128 | −117 | C |
| ATOM | 3154 | CD | GLN | L | 37 | 22.612 | −11.854 | 47.224 | 1.00 | 46.25 | | C |
| ANISOU | 3154 | CD | GLN | L | 37 | 5687 | 6044 | 5841 | 484 | 146 | −112 | C |
| ATOM | 3155 | OE1 | GLN | L | 37 | 21.551 | −12.336 | 46.889 | 1.00 | 44.64 | | O |
| ANISOU | 3155 | OE1 | GLN | L | 37 | 5498 | 5793 | 5669 | 471 | 186 | −127 | O |
| ATOM | 3156 | NE2 | GLN | L | 37 | 22.799 | −11.281 | 48.406 | 1.00 | 44.49 | | N |
| ANISOU | 3156 | NE2 | GLN | L | 37 | 5476 | 5874 | 5554 | 485 | 117 | −90 | N |
| ATOM | 3157 | N | LYS | L | 38 | 26.730 | −12.968 | 44.492 | 1.00 | 40.56 | | N |
| ANISOU | 3157 | N | LYS | L | 38 | 4853 | 5309 | 5251 | 579 | 132 | −71 | N |
| ATOM | 3158 | CA | LYS | L | 38 | 27.755 | −13.943 | 44.806 | 1.00 | 43.65 | | C |
| ANISOU | 3158 | CA | LYS | I | 38 | 5220 | 5696 | 5671 | 630 | 138 | −7 | C |
| ATOM | 3159 | C | LYS | L | 38 | 27.814 | −14.170 | 46.302 | 1.00 | 45.04 | | C |
| ANISOU | 3159 | C | LYS | L | 38 | 5403 | 5902 | 5808 | 641 | 111 | 52 | C |
| ATOM | 3160 | O | LYS | L | 38 | 27.277 | −13.375 | 47.086 | 1.00 | 46.03 | | O |
| ANISOU | 3160 | O | LYS | L | 38 | 5547 | 6065 | 5878 | 609 | 82 | 39 | O |
| ATOM | 3161 | CB | LYS | L | 38 | 29.099 | −13.448 | 44.279 | 1.00 | 41.22 | | C |
| ANISOU | 3161 | CB | LYS | L | 38 | 4858 | 5426 | 5379 | 646 | 115 | 3 | C |
| ATOM | 3162 | CG | LYS | L | 38 | 29.136 | −13.487 | 42.774 | 1.00 | 43.17 | | C |
| ANISOU | 3162 | CG | LYS | L | 38 | 5103 | 5636 | 5663 | 650 | 155 | −44 | C |
| ATOM | 3163 | CD | LYS | L | 38 | 30.390 | −12.798 | 42.295 | 1.00 | 45.60 | | C |
| ANISOU | 3163 | CD | LYS | L | 38 | 5354 | 5989 | 5982 | 658 | 135 | −33 | C |
| ATOM | 3164 | CE | LYS | L | 38 | 30.465 | −12.867 | 40.802 | 1.00 | 52.61 | | C |
| ANISOU | 3164 | CE | LYS | L | 38 | 6245 | 6843 | 6900 | 667 | 182 | −75 | C |
| ATOM | 3165 | NZ | LYS | L | 38 | 31.870 | −12.634 | 40.348 | 1.00 | 52.24 | | N |
| ANISOU | 3165 | NZ | LYS | L | 38 | 6136 | 6831 | 6882 | 696 | 183 | −43 | N |
| ATOM | 3166 | N | PRO | L | 39 | 28.447 | −15.272 | 46.740 | 1.00 | 47.77 | | N |
| ANISOU | 3166 | N | PRO | L | 39 | 5738 | 6231 | 6180 | 689 | 122 | 118 | N |
| ATOM | 3167 | CA | PRO | L | 39 | 28.399 | −15.635 | 48.160 | 1.00 | 46.19 | | C |
| ANISOU | 3167 | CA | PRO | L | 39 | 5555 | 6055 | 5941 | 702 | 102 | 180 | C |
| ATOM | 3168 | C | PRO | L | 39 | 28.932 | −14.545 | 49.067 | 1.00 | 52.62 | | C |
| ANISOU | 3168 | C | PRO | L | 39 | 6354 | 6949 | 6690 | 684 | 32 | 191 | C |
| ATOM | 3169 | O | PRO | L | 39 | 29.935 | −13.902 | 48.779 | 1.00 | 55.34 | | O |
| ANISOU | 3169 | O | PRO | L | 39 | 6653 | 7333 | 7041 | 684 | −9 | 189 | O |
| ATOM | 3170 | CB | PRO | L | 39 | 29.251 | −16.901 | 48.222 | 1.00 | 51.63 | | C |
| ANISOU | 3170 | CB | PRO | L | 39 | 6224 | 6714 | 6681 | 762 | 120 | 249 | C |
| ATOM | 3171 | CG | PRO | L | 39 | 28.949 | −17.564 | 46.907 | 1.00 | 52.22 | | C |
| ANISOU | 3171 | CG | PRO | L | 39 | 6307 | 6714 | 6822 | 772 | 180 | 209 | C |
| ATOM | 3172 | CD | PRO | L | 39 | 28.881 | −16.423 | 45.913 | 1.00 | 44.33 | | C |
| ANISOU | 3172 | CD | PRO | L | 39 | 5294 | 5736 | 5813 | 734 | 170 | 134 | C |
| ATOM | 3173 | N | GLY | L | 40 | 28.212 | −14.307 | 50.158 | 1.00 | 47.38 | | N |
| ANISOU | 3173 | N | GLY | L | 40 | 5732 | 6307 | 5963 | 667 | 19 | 200 | N |
| ATOM | 3174 | CA | GLY | L | 40 | 28.628 | −13.316 | 51.120 | 1.00 | 50.61 | | C |
| ANISOU | 3174 | CA | GLY | L | 40 | 6141 | 6788 | 6300 | 650 | −50 | 206 | C |
| ATOM | 3175 | C | GLY | L | 40 | 28.606 | −11.885 | 50.639 | 1.00 | 53.44 | | C |
| ANISOU | 3175 | C | GLY | L | 40 | 6489 | 7177 | 6638 | 604 | −84 | 136 | C |
| ATOM | 3176 | O | GLY | L | 40 | 29.143 | −11.019 | 51.339 | 1.00 | 53.27 | | O |
| ANISOU | 3176 | O | GLY | L | 40 | 6464 | 7213 | 6565 | 589 | −150 | 138 | O |
| ATOM | 3177 | N | GLN | L | 41 | 27.993 | −11.591 | 49.484 | 1.00 | 42.88 | | N |
| ANISOU | 3177 | N | GLN | L | 41 | 5151 | 5804 | 5338 | 581 | −46 | 74 | N |
| ATOM | 3178 | CA | GLN | L | 41 | 27.987 | −10.241 | 48.944 | 1.00 | 42.65 | | C |
| ANISOU | 3178 | CA | GLN | L | 41 | 5111 | 5798 | 5295 | 539 | −76 | 12 | C |
| ATOM | 3179 | C | GLN | L | 41 | 26.564 | −9.780 | 48.655 | 1.00 | 48.00 | | C |
| ANISOU | 3179 | C | GLN | L | 41 | 5830 | 6449 | 5958 | 506 | −40 | −49 | C |
| ATOM | 3180 | O | GLN | L | 41 | 25.662 | −10.585 | 48.444 | 1.00 | 41.92 | | O |
| ANISOU | 3180 | O | GLN | L | 41 | 5083 | 5632 | 5212 | 513 | 14 | −50 | O |
| ATOM | 3181 | CB | GLN | L | 41 | 28.816 | −10.157 | 47.658 | 1.00 | 44.02 | | C |
| ANISOU | 3181 | CB | GLN | L | 41 | 5234 | 5961 | 5531 | 544 | −70 | −1 | C |
| ATOM | 3182 | CG | GLN | L | 41 | 30.321 | −10.425 | 47.895 | 1.00 | 54.98 | | C |
| ANISOU | 3182 | CG | GLN | L | 41 | 6566 | 7384 | 6942 | 575 | −109 | 60 | C |
| ATOM | 3183 | CD | GLN | L | 41 | 31.114 | −10.257 | 46.624 | 1.00 | 59.83 | | C |
| ANISOU | 3183 | CD | GLN | L | 41 | 7128 | 7991 | 7616 | 581 | −95 | 48 | C |
| ATOM | 3184 | OE1 | GLN | L | 41 | 30.544 | −10.073 | 45.543 | 1.00 | 61.41 | | O |
| ANISOU | 3184 | OE1 | GLN | L | 41 | 7341 | 8157 | 7837 | 565 | −53 | −4 | O |
| ATOM | 3185 | NE2 | GLN | L | 41 | 32.420 | −10.328 | 46.734 | 1.00 | 71.44 | | N |
| ANISOU | 3185 | NE2 | GLN | L | 41 | 8538 | 9493 | 9113 | 603 | −128 | 98 | N |
| ATOM | 3186 | N | ALA | L | 42 | 26.400 | −8.460 | 48.619 | 1.00 | 48.17 | | N |

TABLE 14-continued

| | | | | | | | | | | | |
|---|---|---|---|---|---|---|---|---|---|---|---|
| ANISOU | 3186 | N | ALA | L | 42 | 5857 | 6498 | 5946 | 469 | −75 | −99 | N |
| ATOM | 3187 | CA | ALA | L | 42 | 25.143 | −7.854 | 48.241 | 1.00 | 45.79 | | C |
| ANISOU | 3187 | CA | ALA | L | 42 | 5586 | 6175 | 5638 | 439 | −48 | −159 | C |
| ATOM | 3188 | C | ALA | L | 42 | 24.907 | −8.047 | 46.754 | 1.00 | 45.29 | | C |
| ANISOU | 3188 | C | ALA | L | 42 | 5503 | 6067 | 5636 | 432 | −12 | −193 | C |
| ATOM | 3189 | O | ALA | L | 42 | 25.850 | −8.286 | 45.996 | 1.00 | 41.11 | | O |
| ANISOU | 3189 | O | ALA | L | 42 | 4938 | 5535 | 5146 | 446 | −15 | −180 | O |
| ATOM | 3190 | CB | ALA | L | 42 | 25.158 | −6.365 | 48.570 | 1.00 | 44.88 | | C |
| ANISOU | 3190 | CB | ALA | L | 42 | 5481 | 6097 | 5474 | 405 | −98 | −201 | C |
| ATOM | 3191 | N | PRO | L | 43 | 23.652 | −7.924 | 46.304 | 1.00 | 43.52 | | N |
| ANISOU | 3191 | N | PRO | L | 43 | 5304 | 5809 | 5423 | 412 | 23 | −235 | N |
| ATOM | 3192 | CA | PRO | L | 43 | 23.391 | −7.944 | 44.869 | 1.00 | 39.37 | | C |
| ANISOU | 3192 | CA | PRO | L | 43 | 4768 | 5246 | 4946 | 402 | 46 | −274 | C |
| ATOM | 3193 | C | PRO | L | 43 | 24.141 | −6.832 | 44.163 | 1.00 | 40.91 | | C |
| ANISOU | 3193 | C | PRO | L | 43 | 4937 | 5467 | 5139 | 383 | 9 | −302 | C |
| ATOM | 3194 | O | PRO | L | 43 | 24.341 | −5.744 | 44.701 | 1.00 | 39.83 | | O |
| ANISOU | 3194 | O | PRO | L | 43 | 4800 | 5367 | 4965 | 363 | −32 | −315 | O |
| ATOM | 3195 | CB | PRO | L | 43 | 21.869 | −7.732 | 44.792 | 1.00 | 40.11 | | C |
| ANISOU | 3195 | CB | PRO | L | 43 | 4889 | 5312 | 5039 | 377 | 72 | −313 | C |
| ATOM | 3196 | CG | PRO | L | 43 | 21.397 | −8.386 | 46.056 | 1.00 | 38.23 | | C |
| ANISOU | 3196 | CG | PRO | L | 43 | 4673 | 5077 | 4777 | 392 | 92 | −272 | C |
| ATOM | 3197 | CD | PRO | L | 43 | 22.396 | −7.928 | 47.073 | 1.00 | 38.75 | | C |
| ANISOU | 3197 | CD | PRO | L | 43 | 4736 | 5197 | 4789 | 403 | 48 | −242 | C |
| ATOM | 3198 | N | VAL | L | 44 | 24.506 | −7.105 | 42.918 | 1.00 | 36.88 | | N |
| ANISOU | 3198 | N | VAL | L | 44 | 4409 | 4932 | 4671 | 390 | 28 | −314 | N |
| ATOM | 3199 | CA | VAL | L | 44 | 25.104 | −6.144 | 42.018 | 1.00 | 34.71 | | C |
| ANISOU | 3199 | CA | VAL | L | 44 | 4112 | 4675 | 4403 | 372 | 7 | −339 | C |
| ATOM | 3200 | C | VAL | L | 44 | 24.309 | −6.122 | 40.722 | 1.00 | 32.53 | | C |
| ANISOU | 3200 | C | VAL | L | 44 | 3852 | 4357 | 4149 | 359 | 36 | −385 | C |
| ATOM | 3201 | O | VAL | L | 44 | 23.952 | −7.176 | 40.194 | 1.00 | 39.27 | | O |
| ANISOU | 3201 | O | VAL | L | 44 | 4721 | 5169 | 5031 | 377 | 74 | −385 | O |
| ATOM | 3202 | CB | VAL | L | 44 | 26.583 | −6.511 | 41.743 | 1.00 | 39.84 | | C |
| ANISOU | 3202 | CB | VAL | L | 44 | 4718 | 5343 | 5077 | 400 | 3 | −297 | C |
| ATOM | 3203 | CG1 | VAL | L | 44 | 27.102 | −5.737 | 40.558 | 1.00 | 40.52 | | C |
| ANISOU | 3203 | CG1 | VAL | L | 44 | 4781 | 5435 | 5180 | 386 | 1 | −320 | C |
| ATOM | 3204 | CG2 | VAL | L | 44 | 27.418 | −6.219 | 43.013 | 1.00 | 38.20 | | C |
| ANISOU | 3204 | CG2 | VAL | L | 44 | 4487 | 5183 | 4842 | 403 | −46 | −255 | C |
| ATOM | 3205 | N | MET | L | 45 | 24.056 | −4.931 | 40.187 | 1.00 | 40.09 | | N |
| ANISOU | 3205 | N | MET | L | 45 | 4811 | 5325 | 5095 | 329 | 15 | −423 | N |
| ATOM | 3206 | CA | MET | L | 45 | 23.356 | −4.821 | 38.903 | 1.00 | 33.99 | | C |
| ANISOU | 3206 | CA | MET | L | 45 | 4055 | 4518 | 4340 | 316 | 34 | −464 | C |
| ATOM | 3207 | C | MET | L | 45 | 24.277 | −5.163 | 37.750 | 1.00 | 41.71 | | C |
| ANISOU | 3207 | C | MET | L | 45 | 5019 | 5490 | 5340 | 335 | 55 | −457 | C |
| ATOM | 3208 | O | MET | L | 45 | 25.345 | −4.552 | 37.608 | 1.00 | 45.80 | | O |
| ANISOU | 3208 | O | MET | L | 45 | 5505 | 6041 | 5857 | 335 | 39 | −439 | O |
| ATOM | 3209 | CB | MET | L | 45 | 22.816 | −3.403 | 38.703 | 1.00 | 35.72 | | C |
| ANISOU | 3209 | CB | MET | L | 45 | 4281 | 4750 | 4540 | 280 | 5 | −501 | C |
| ATOM | 3210 | CG | MET | L | 45 | 22.083 | −3.245 | 37.383 | 1.00 | 41.90 | | C |
| ANISOU | 3210 | CG | MET | L | 45 | 5082 | 5501 | 5337 | 268 | 17 | −540 | C |
| ATOM | 3211 | SD | MET | L | 45 | 21.735 | −1.508 | 37.055 | 1.00 | 51.59 | | S |
| ANISOU | 3211 | SD | MET | L | 45 | 6311 | 6743 | 6548 | 231 | −20 | −573 | S |
| ATOM | 3212 | CE | MET | L | 45 | 20.119 | −1.443 | 37.878 | 1.00 | 39.66 | | C |
| ANISOU | 3212 | CE | MET | L | 45 | 4823 | 5214 | 5032 | 220 | −19 | −597 | C |
| ATOM | 3213 | N | VAL | L | 46 | 23.864 | −6.114 | 36.916 | 1.00 | 34.09 | | N |
| ANISOU | 3213 | N | VAL | L | 46 | 4076 | 4480 | 4394 | 351 | 90 | −472 | N |
| ATOM | 3214 | CA | VAL | L | 46 | 24.632 | −6.482 | 35.731 | 1.00 | 37.65 | | C |
| ANISOU | 3214 | CA | VAL | L | 46 | 4526 | 4921 | 4860 | 374 | 119 | −472 | C |
| ATOM | 3215 | C | VAL | L | 46 | 23.967 | −6.040 | 34.422 | 1.00 | 37.56 | | C |
| ANISOU | 3215 | C | VAL | L | 46 | 4544 | 4887 | 4840 | 355 | 122 | −520 | C |
| ATOM | 3216 | O | VAL | L | 46 | 24.675 | −5.704 | 33.460 | 1.00 | 38.65 | | O |
| ANISOU | 3216 | O | VAL | L | 46 | 4676 | 5034 | 4973 | 363 | 135 | −521 | O |
| ATOM | 3217 | CB | VAL | L | 46 | 24.937 | −8.005 | 35.719 | 1.00 | 37.49 | | C |
| ANISOU | 3217 | CB | VAL | L | 46 | 4514 | 4865 | 4866 | 416 | 158 | −450 | C |
| ATOM | 3218 | CG1 | VAL | L | 46 | 25.755 | −8.366 | 36.962 | 1.00 | 38.47 | | C |
| ANISOU | 3218 | CG1 | VAL | L | 46 | 4603 | 5017 | 4996 | 439 | 150 | −395 | C |
| ATOM | 3219 | CG2 | VAL | L | 46 | 23.690 | −8.867 | 35.684 | 1.00 | 40.19 | | C |
| ANISOU | 3219 | CG2 | VAL | L | 46 | 4897 | 5153 | 5220 | 410 | 172 | −476 | C |
| ATOM | 3220 | N | VAL | L | 47 | 22.640 | −5.988 | 34.364 | 1.00 | 35.08 | | N |
| ANISOU | 3220 | N | VAL | L | 47 | 4259 | 4545 | 4524 | 330 | 110 | −555 | N |
| ATOM | 3221 | CA | VAL | L | 47 | 21.912 | −5.558 | 33.176 | 1.00 | 36.46 | | C |
| ANISOU | 3221 | CA | VAL | L | 47 | 4463 | 4699 | 4690 | 310 | 104 | −598 | C |
| ATOM | 3222 | C | VAL | L | 47 | 20.723 | −4.737 | 33.657 | 1.00 | 37.59 | | C |
| ANISOU | 3222 | C | VAL | L | 47 | 4609 | 4846 | 4829 | 274 | 70 | −620 | C |
| ATOM | 3223 | O | VAL | L | 47 | 20.068 | −5.103 | 34.637 | 1.00 | 33.67 | | O |
| ANISOU | 3223 | O | VAL | L | 47 | 4109 | 4341 | 4343 | 270 | 69 | −612 | O |
| ATOM | 3224 | CB | VAL | L | 47 | 21.448 | −6.763 | 32.306 | 1.00 | 36.11 | | C |
| ANISOU | 3224 | CB | VAL | L | 47 | 4460 | 4602 | 4660 | 325 | 129 | −623 | C |
| ATOM | 3225 | CG1 | VAL | L | 47 | 20.581 | −6.302 | 31.143 | 1.00 | 34.46 | | C |
| ANISOU | 3225 | CG1 | VAL | L | 47 | 4284 | 4373 | 4436 | 301 | 110 | −669 | C |
| ATOM | 3226 | CG2 | VAL | L | 47 | 22.658 | −7.497 | 31.687 | 1.00 | 38.88 | | C |

TABLE 14-continued

| | | | | | | | | | | | |
|---|---|---|---|---|---|---|---|---|---|---|---|
| ANISOU | 3226 | CG2 | VAL | L | 47 | 4813 | 4947 | 5012 | 368 | 169 | −607 | C |
| ATOM | 3227 | N | TYR | L | 48 | 20.453 | −3.617 | 32.997 | 1.00 | 36.46 | | N |
| ANISOU | 3227 | N | TYR | L | 48 | 4469 | 4713 | 4670 | 251 | 47 | −642 | N |
| ATOM | 3228 | CA | TYR | L | 48 | 19.229 | −2.883 | 33.281 | 1.00 | 40.54 | | C |
| ANISOU | 3228 | CA | TYR | L | 48 | 4990 | 5226 | 5189 | 223 | 19 | −665 | C |
| ATOM | 3229 | C | TYR | L | 48 | 18.497 | −2.657 | 31.979 | 1.00 | 37.88 | | C |
| ANISOU | 3229 | C | TYR | L | 48 | 4680 | 4864 | 4849 | 209 | 6 | −700 | C |
| ATOM | 3230 | O | TYR | L | 48 | 19.105 | −2.665 | 30.915 | 1.00 | 30.86 | | O |
| ANISOU | 3230 | O | TYR | L | 48 | 3807 | 3975 | 3945 | 218 | 15 | −704 | O |
| ATOM | 3231 | CB | TYR | L | 48 | 19.521 | −1.550 | 33.995 | 1.00 | 33.27 | | C |
| ANISOU | 3231 | CB | TYR | L | 48 | 4047 | 4342 | 4252 | 207 | −6 | −657 | C |
| ATOM | 3232 | CG | TYR | L | 48 | 20.285 | −0.539 | 33.167 | 1.00 | 38.24 | | C |
| ANISOU | 3232 | CG | TYR | L | 48 | 4671 | 4990 | 4866 | 199 | −19 | −656 | C |
| ATOM | 3233 | CD1 | TYR | L | 48 | 19.597 | 0.371 | 32.350 | 1.00 | 37.83 | | C |
| ANISOU | 3233 | CD1 | TYR | L | 48 | 4634 | 4929 | 4809 | 179 | −41 | −681 | C |
| ATOM | 3234 | CD2 | TYR | L | 48 | 21.705 | −0.454 | 33.227 | 1.00 | 39.79 | | C |
| ANISOU | 3234 | CD2 | TYR | L | 48 | 4844 | 5215 | 5059 | 211 | −11 | −624 | C |
| ATOM | 3235 | CE1 | TYR | L | 48 | 20.283 | 1.331 | 31.604 | 1.00 | 37.84 | | C |
| ANISOU | 3235 | CE1 | TYR | L | 48 | 4633 | 4946 | 4799 | 170 | −50 | −675 | C |
| ATOM | 3236 | CE2 | TYR | L | 48 | 22.404 | 0.521 | 32.481 | 1.00 | 39.33 | | C |
| ANISOU | 3236 | CE2 | TYR | L | 48 | 4777 | 5175 | 4993 | 200 | −20 | −617 | C |
| ATOM | 3237 | CZ | TYR | L | 48 | 21.674 | 1.406 | 31.684 | 1.00 | 42.06 | | C |
| ANISOU | 3237 | CZ | TYR | L | 48 | 5142 | 5507 | 5330 | 179 | −38 | −643 | C |
| ATOM | 3238 | OH | TYR | L | 48 | 22.301 | 2.364 | 30.942 | 1.00 | 40.64 | | O |
| ANISOU | 3238 | OH | TYR | L | 48 | 4957 | 5341 | 5144 | 166 | −44 | −632 | O |
| ATOM | 3239 | N | ASP | L | 49 | 17.199 | −2.421 | 32.087 | 1.00 | 36.09 | | N |
| ANISOU | 3239 | N | ASP | L | 49 | 4457 | 4620 | 4637 | 188 | −14 | −721 | N |
| ATOM | 3240 | CA | ASP | L | 49 | 16.325 | −2.157 | 30.926 | 1.00 | 32.54 | | C |
| ANISOU | 3240 | CA | ASP | L | 49 | 4029 | 4147 | 4187 | 171 | −38 | −753 | C |
| ATOM | 3241 | C | ASP | L | 49 | 16.539 | −3.212 | 29.846 | 1.00 | 33.54 | | C |
| ANISOU | 3241 | C | ASP | L | 49 | 4191 | 4244 | 4310 | 184 | −25 | −768 | C |
| ATOM | 3242 | O | ASP | L | 49 | 16.811 | −2.834 | 28.749 | 1.00 | 39.07 | | O |
| ANISOU | 3242 | O | ASP | L | 49 | 4915 | 4947 | 4984 | 184 | −33 | −780 | O |
| ATOM | 3243 | CB | ASP | L | 49 | 16.536 | −0.766 | 30.351 | 1.00 | 35.88 | | C |
| ANISOU | 3243 | CB | ASP | L | 49 | 4453 | 4593 | 4589 | 160 | −62 | −757 | C |
| ATOM | 3244 | CG | ASP | L | 49 | 15.496 | −0.370 | 29.328 | 1.00 | 41.27 | | C |
| ANISOU | 3244 | CG | ASP | L | 49 | 5155 | 5255 | 5272 | 143 | −95 | −784 | C |
| ATOM | 3245 | OD1 | ASP | L | 49 | 14.349 | −0.653 | 29.544 | 1.00 | 38.83 | | O |
| ANISOU | 3245 | OD1 | ASP | L | 49 | 4840 | 4924 | 4991 | 131 | −109 | −798 | O |
| ATOM | 3246 | OD2 | ASP | L | 49 | 15.862 | 0.226 | 28.358 | 1.00 | 42.34 | | O |
| ANISOU | 3246 | OD2 | ASP | L | 49 | 5307 | 5397 | 5381 | 142 | −105 | −787 | O |
| ATOM | 3247 | N | ASP | L | 50 | 16.434 | −4.486 | 30.207 | 1.00 | 26.17 | | N |
| ANISOU | 3247 | N | ASP | L | 50 | 3263 | 3281 | 3398 | 194 | −3 | −765 | N |
| ATOM | 3248 | CA | ASP | L | 50 | 16.518 | −5.695 | 29.343 | 1.00 | 34.08 | | C |
| ANISOU | 3248 | CA | ASP | L | 50 | 4305 | 4242 | 4402 | 207 | 11 | −784 | C |
| ATOM | 3249 | C | ASP | L | 50 | 17.916 | −6.017 | 28.803 | 1.00 | 38.99 | | C |
| ANISOU | 3249 | C | ASP | L | 50 | 4943 | 4875 | 4997 | 242 | 47 | −773 | C |
| ATOM | 3250 | O | ASP | L | 50 | 18.275 | −7.153 | 28.874 | 1.00 | 35.15 | | O |
| ANISOU | 3250 | O | ASP | L | 50 | 4470 | 4361 | 4523 | 265 | 75 | −769 | O |
| ATOM | 3251 | CB | ASP | L | 50 | 15.567 | −5.699 | 28.146 | 1.00 | 34.92 | | C |
| ANISOU | 3251 | CB | ASP | L | 50 | 4446 | 4317 | 4503 | 186 | −24 | −825 | C |
| ATOM | 3252 | CG | ASP | L | 50 | 14.192 | −5.127 | 28.385 | 1.00 | 43.85 | | C |
| ANISOU | 3252 | CG | ASP | L | 50 | 5556 | 5443 | 5661 | 152 | −65 | −836 | C |
| ATOM | 3253 | OD1 | ASP | L | 50 | 13.684 | −5.325 | 29.442 | 1.00 | 38.94 | | O |
| ANISOU | 3253 | OD1 | ASP | L | 50 | 4902 | 4819 | 5074 | 144 | −57 | −819 | O |
| ATOM | 3254 | OD2 | ASP | L | 50 | 13.702 | −4.482 | 27.513 | 1.00 | 39.84 | | O |
| ANISOU | 3254 | OD2 | ASP | L | 50 | 5063 | 4936 | 5138 | 137 | −100 | −856 | O |
| ATOM | 3255 | N | ASN | L | 51 | 18.655 | −5.048 | 28.272 | 1.00 | 37.98 | | N |
| ANISOU | 3255 | N | ASN | L | 51 | 4811 | 4783 | 4836 | 247 | 47 | −765 | N |
| ATOM | 3256 | CA | ASN | L | 51 | 19.924 | −5.379 | 27.594 | 1.00 | 39.05 | | C |
| ANISOU | 3256 | CA | ASN | L | 51 | 4962 | 4928 | 4949 | 282 | 87 | −754 | C |
| ATOM | 3257 | C | ASN | L | 51 | 20.990 | −4.294 | 27.748 | 1.00 | 43.61 | | C |
| ANISOU | 3257 | C | ASN | L | 51 | 5502 | 5557 | 5511 | 286 | 95 | −720 | C |
| ATOM | 3258 | O | ASN | L | 51 | 21.892 | −4.310 | 26.953 | 1.00 | 43.37 | | O |
| ANISOU | 3258 | O | ASN | L | 51 | 5482 | 5537 | 5460 | 309 | 126 | −711 | O |
| ATOM | 3259 | CB | ASN | L | 51 | 19.641 | −5.505 | 26.107 | 1.00 | 43.17 | | C |
| ANISOU | 3259 | CB | ASN | L | 51 | 5540 | 5426 | 5437 | 284 | 83 | −791 | C |
| ATOM | 3260 | CG | ASN | L | 51 | 18.785 | −4.371 | 25.596 | 1.00 | 46.84 | | C |
| ANISOU | 3260 | CG | ASN | I | 51 | 6012 | 5901 | 5884 | 250 | 35 | −809 | C |
| ATOM | 3261 | OD1 | ASN | L | 51 | 18.774 | −3.302 | 26.163 | 1.00 | 48.49 | | O |
| ANISOU | 3261 | OD1 | ASN | L | 51 | 6182 | 6142 | 6098 | 232 | 18 | −789 | O |
| ATOM | 3262 | ND2 | ASN | L | 51 | 18.054 | −4.599 | 24.531 | 1.00 | 55.72 | | N |
| ANISOU | 3262 | ND2 | ASN | L | 51 | 7187 | 6997 | 6986 | 241 | 11 | −846 | N |
| ATOM | 3263 | N | ASP | L | 52 | 20.875 | −3.391 | 28.709 | 1.00 | 36.44 | | N |
| ANISOU | 3263 | N | ASP | L | 52 | 4553 | 4677 | 4614 | 264 | 70 | −702 | N |
| ATOM | 3264 | CA | ASP | L | 52 | 21.907 | −2.344 | 28.870 | 1.00 | 38.36 | | C |
| ANISOU | 3264 | CA | ASP | L | 52 | 4761 | 4964 | 4849 | 262 | 70 | −670 | C |
| ATOM | 3265 | C | ASP | L | 52 | 22.828 | −2.713 | 30.023 | 1.00 | 42.65 | | C |
| ANISOU | 3265 | C | ASP | L | 52 | 5263 | 5530 | 5413 | 279 | 85 | −632 | C |
| ATOM | 3266 | O | ASP | L | 52 | 22.410 | −3.432 | 30.883 | 1.00 | 40.73 | | O |

TABLE 14-continued

| | | | | | | | | | | | |
|---|---|---|---|---|---|---|---|---|---|---|---|
| ANISOU | 3266 | O | ASP | L | 52 | 5017 | 5273 | 5187 | 283 | 84 | −630 | O |
| ATOM | 3267 | CB | ASP | L | 52 | 21.301 | −0.969 | 29.063 | 1.00 | 33.85 | | C |
| ANISOU | 3267 | CB | ASP | L | 52 | 4180 | 4408 | 4273 | 226 | 28 | −677 | C |
| ATOM | 3268 | CG | ASP | L | 52 | 20.530 | −0.558 | 27.841 | 1.00 | 55.09 | | C |
| ANISOU | 3268 | CG | ASP | L | 52 | 6909 | 7080 | 6942 | 213 | 11 | −706 | C |
| ATOM | 3269 | OD1 | ASP | L | 52 | 21.125 | −0.498 | 26.805 | 1.00 | 56.53 | | O |
| ANISOU | 3269 | OD1 | ASP | L | 52 | 7111 | 7268 | 7101 | 226 | 31 | −702 | O |
| ATOM | 3270 | OD2 | ASP | L | 52 | 19.354 | −0.355 | 27.956 | 1.00 | 58.15 | | O |
| ANISOU | 3270 | OD2 | ASP | L | 52 | 7307 | 7451 | 7338 | 194 | −20 | −730 | O |
| ATOM | 3271 | N | ARG | L | 53 | 24.032 | −2.175 | 30.030 | 1.00 | 37.60 | | N |
| ANISOU | 3271 | N | ARG | L | 53 | 4588 | 4925 | 4773 | 286 | 95 | −598 | N |
| ATOM | 3272 | CA | ARG | L | 53 | 24.951 | −2.555 | 31.089 | 1.00 | 38.55 | | C |
| ANISOU | 3272 | CA | ARG | L | 53 | 4665 | 5067 | 4913 | 303 | 102 | −558 | C |
| ATOM | 3273 | C | ARG | L | 53 | 25.426 | −1.338 | 31.857 | 1.00 | 36.35 | | C |
| ANISOU | 3273 | C | ARG | L | 53 | 4346 | 4827 | 4638 | 275 | 65 | −536 | C |
| ATOM | 3274 | O | ARG | L | 53 | 25.810 | −0.336 | 31.244 | 1.00 | 38.31 | | O |
| ANISOU | 3274 | O | ARG | L | 53 | 4584 | 5091 | 4880 | 257 | 58 | −531 | O |
| ATOM | 3275 | CB | ARG | L | 53 | 26.165 | −3.262 | 30.482 | 1.00 | 45.04 | | C |
| ANISOU | 3275 | CB | ARG | L | 53 | 5472 | 5895 | 5744 | 343 | 151 | −530 | C |
| ATOM | 3276 | CG | ARG | L | 53 | 25.893 | −4.657 | 30.035 | 1.00 | 48.97 | | C |
| ANISOU | 3276 | CG | ARG | L | 53 | 6009 | 6352 | 6245 | 378 | 189 | −547 | C |
| ATOM | 3277 | CD | ARG | L | 53 | 27.154 | −5.167 | 29.376 | 1.00 | 48.63 | | C |
| ANISOU | 3277 | CD | ARG | L | 53 | 5950 | 6317 | 6209 | 423 | 242 | −519 | C |
| ATOM | 3278 | NE | ARG | L | 53 | 27.410 | −4.370 | 28.185 | 1.00 | 56.95 | | N |
| ANISOU | 3278 | NE | ARG | L | 53 | 7017 | 7385 | 7237 | 416 | 257 | −526 | N |
| ATOM | 3279 | CZ | ARG | L | 53 | 26.772 | −4.538 | 27.034 | 1.00 | 62.37 | | C |
| ANISOU | 3279 | CZ | ARG | L | 53 | 7765 | 8043 | 7891 | 419 | 270 | −567 | C |
| ATOM | 3280 | NH1 | ARG | L | 53 | 25.839 | −5.490 | 26.913 | 1.00 | 59.35 | | N |
| ANISOU | 3280 | NH1 | ARG | L | 53 | 7433 | 7613 | 7504 | 425 | 267 | −607 | N |
| ATOM | 3281 | NH2 | ARG | L | 53 | 27.066 | −3.745 | 26.017 | 1.00 | 62.96 | | N |
| ANISOU | 3281 | NH2 | ARG | L | 53 | 7850 | 8135 | 7938 | 413 | 283 | −566 | N |
| ATOM | 3282 | N | PRO | L | 54 | 25.497 | −1.418 | 33.174 | 1.00 | 41.51 | | N |
| ANISOU | 3282 | N | PRO | L | 54 | 4978 | 5495 | 5299 | 271 | 42 | −520 | N |
| ATOM | 3283 | CA | PRO | L | 54 | 26.236 | −0.406 | 33.921 | 1.00 | 41.46 | | C |
| ANISOU | 3283 | CA | PRO | L | 54 | 4932 | 5525 | 5296 | 249 | 6 | −496 | C |
| ATOM | 3284 | C | PRO | L | 54 | 27.683 | −0.325 | 33.448 | 1.00 | 39.80 | | C |
| ANISOU | 3284 | C | PRO | L | 54 | 4676 | 5341 | 5104 | 262 | 24 | −454 | C |
| ATOM | 3285 | O | PRO | L | 54 | 28.243 | −1.277 | 32.904 | 1.00 | 36.71 | | O |
| ANISOU | 3285 | O | PRO | L | 54 | 4278 | 4944 | 4725 | 299 | 69 | −436 | O |
| ATOM | 3286 | CB | PRO | L | 54 | 26.162 | −0.903 | 35.366 | 1.00 | 42.10 | | C |
| ANISOU | 3286 | CB | PRO | L | 54 | 5006 | 5615 | 5376 | 256 | −13 | −482 | C |
| ATOM | 3287 | CG | PRO | L | 54 | 25.028 | −1.841 | 35.404 | 1.00 | 42.15 | | C |
| ANISOU | 3287 | CG | PRO | L | 54 | 5050 | 5586 | 5377 | 269 | 9 | −507 | C |
| ATOM | 3288 | CD | PRO | L | 54 | 25.022 | −2.497 | 34.055 | 1.00 | 43.86 | | C |
| ANISOU | 3288 | CD | PRO | L | 54 | 5286 | 5776 | 5602 | 289 | 49 | −519 | C |
| ATOM | 3289 | N | SER | L | 55 | 28.272 | 0.839 | 33.634 | 1.00 | 41.26 | | N |
| ANISOU | 3289 | N | SER | L | 55 | 4830 | 5552 | 5296 | 231 | −10 | −439 | N |
| ATOM | 3290 | CA | SER | L | 55 | 29.691 | 0.975 | 33.341 | 1.00 | 54.78 | | C |
| ANISOU | 3290 | CA | SER | L | 55 | 6486 | 7293 | 7036 | 238 | 3 | −391 | C |
| ATOM | 3291 | C | SER | L | 55 | 30.451 | −0.038 | 34.174 | 1.00 | 47.11 | | C |
| ANISOU | 3291 | C | SER | L | 55 | 5478 | 6337 | 6083 | 271 | 9 | −354 | C |
| ATOM | 3292 | O | SER | L | 55 | 30.124 | −0.281 | 35.338 | 1.00 | 50.28 | | O |
| ANISOU | 3292 | O | SER | L | 55 | 5886 | 6742 | 6475 | 268 | −25 | −357 | O |
| ATOM | 3293 | CB | SER | L | 55 | 30.170 | 2.388 | 33.652 | 1.00 | 61.76 | | C |
| ANISOU | 3293 | CB | SER | L | 55 | 7339 | 8198 | 7931 | 192 | −46 | −379 | C |
| ATOM | 3294 | OG | SER | L | 55 | 30.485 | 2.495 | 35.029 | 1.00 | 68.49 | | O |
| ANISOU | 3294 | OG | SER | L | 55 | 8168 | 9070 | 8787 | 179 | −97 | −366 | O |
| ATOM | 3295 | N | GLY | L | 56 | 31.394 | −0.707 | 33.554 | 1.00 | 50.08 | | N |
| ANISOU | 3295 | N | GLY | L | 56 | 5822 | 6722 | 6485 | 308 | 56 | −318 | N |
| ATOM | 3296 | CA | GLY | L | 56 | 32.219 | −1.615 | 34.304 | 1.00 | 51.44 | | C |
| ANISOU | 3296 | CA | GLY | L | 56 | 5952 | 6910 | 6682 | 342 | 60 | −275 | C |
| ATOM | 3297 | C | GLY | L | 56 | 31.728 | −3.036 | 34.313 | 1.00 | 52.99 | | C |
| ANISOU | 3297 | C | GLY | L | 56 | 6185 | 7074 | 6873 | 388 | 100 | −286 | C |
| ATOM | 3298 | O | GLY | L | 56 | 32.416 | −3.901 | 34.859 | 1.00 | 53.51 | | O |
| ANISOU | 3298 | O | GLY | L | 56 | 6219 | 7148 | 6963 | 424 | 110 | −246 | O |
| ATOM | 3299 | N | ILE | L | 57 | 30.558 | −3.311 | 33.735 | 1.00 | 43.16 | | N |
| ANISOU | 3299 | N | ILE | L | 57 | 5006 | 5791 | 5601 | 387 | 121 | −336 | N |
| ATOM | 3300 | CA | ILE | L | 57 | 30.125 | −4.689 | 33.601 | 1.00 | 40.06 | | C |
| ANISOU | 3300 | CA | ILE | L | 57 | 4650 | 5360 | 5211 | 428 | 161 | −347 | C |
| ATOM | 3301 | C | ILE | L | 57 | 30.642 | −5.170 | 32.249 | 1.00 | 40.94 | | C |
| ANISOU | 3301 | C | ILE | L | 57 | 4769 | 5456 | 5329 | 465 | 225 | −347 | C |
| ATOM | 3302 | O | ILE | L | 57 | 30.517 | −4.440 | 31.257 | 1.00 | 40.60 | | O |
| ANISOU | 3302 | O | ILE | L | 57 | 4743 | 5416 | 5269 | 448 | 235 | −368 | O |
| ATOM | 3303 | CB | ILE | L | 57 | 28.587 | −4.822 | 33.708 | 1.00 | 42.50 | | C |
| ANISOU | 3303 | CB | ILE | L | 57 | 5022 | 5632 | 5493 | 406 | 147 | −400 | C |
| ATOM | 3304 | CG1 | ILE | L | 57 | 28.101 | −4.462 | 35.111 | 1.00 | 43.69 | | C |
| ANISOU | 3304 | CG1 | ILE | L | 57 | 5168 | 5798 | 5633 | 379 | 96 | −396 | C |
| ATOM | 3305 | CG2 | ILE | L | 57 | 28.175 | −6.188 | 33.348 | 1.00 | 38.12 | | C |
| ANISOU | 3305 | CG2 | ILE | L | 57 | 4506 | 5031 | 4946 | 443 | 189 | −414 | C |
| ATOM | 3306 | CD1 | ILE | L | 57 | 28.654 | −5.355 | 36.218 | 1.00 | 48.31 | | C |

TABLE 14-continued

| | | | | | | | | | | | | |
|---|---|---|---|---|---|---|---|---|---|---|---|---|
| ANISOU | 3306 | CD1 | ILE | L | 57 | 5728 | 6392 | 6233 | 409 | 93 | −352 | C |
| ATOM | 3307 | N | PRO | L | 58 | 31.197 | −6.382 | 32.167 | 1.00 | 40.66 | | N |
| ANISOU | 3307 | N | PRO | L | 58 | 4728 | 5403 | 5317 | 519 | 271 | −325 | N |
| ATOM | 3308 | CA | PRO | L | 58 | 31.688 | −6.917 | 30.892 | 1.00 | 50.21 | | C |
| ANISOU | 3308 | CA | PRO | L | 58 | 5953 | 6595 | 6529 | 562 | 340 | −329 | C |
| ATOM | 3309 | C | PRO | L | 58 | 30.645 | −6.890 | 29.784 | 1.00 | 54.19 | | C |
| ANISOU | 3309 | C | PRO | L | 58 | 6536 | 7062 | 6994 | 550 | 355 | −391 | C |
| ATOM | 3310 | O | PRO | L | 58 | 29.472 | −7.199 | 30.006 | 1.00 | 46.66 | | O |
| ANISOU | 3310 | O | PRO | L | 58 | 5631 | 6074 | 6024 | 530 | 330 | −432 | O |
| ATOM | 3311 | CB | PRO | L | 58 | 32.058 | −8.361 | 31.249 | 1.00 | 50.31 | | C |
| ANISOU | 3311 | CB | PRO | L | 58 | 5965 | 6579 | 6571 | 620 | 376 | −307 | C |
| ATOM | 3312 | CG | PRO | L | 58 | 32.464 | −8.295 | 32.666 | 1.00 | 54.19 | | C |
| ANISOU | 3312 | CG | PRO | L | 58 | 6400 | 7101 | 7087 | 611 | 329 | −260 | C |
| ATOM | 3313 | CD | PRO | L | 58 | 31.516 | −7.272 | 33.292 | 1.00 | 47.98 | | C |
| ANISOU | 3313 | CD | PRO | L | 58 | 5630 | 6330 | 6270 | 546 | 262 | −289 | C |
| ATOM | 3314 | N | GLU | L | 59 | 31.103 | −6.574 | 28.563 | 1.00 | 51.72 | | N |
| ANISOU | 3314 | N | GLU | L | 59 | 6231 | 6755 | 6663 | 564 | 398 | −395 | N |
| ATOM | 3315 | CA | GLU | L | 59 | 30.234 | −6.579 | 27.382 | 1.00 | 58.60 | | C |
| ANISOU | 3315 | CA | GLU | L | 59 | 7181 | 7593 | 7491 | 558 | 413 | −451 | C |
| ATOM | 3316 | C | GLU | L | 59 | 29.518 | −7.906 | 27.182 | 1.00 | 52.18 | | C |
| ANISOU | 3316 | C | GLU | L | 59 | 6434 | 6720 | 6672 | 586 | 432 | −492 | C |
| ATOM | 3317 | O | GLU | L | 59 | 28.474 | −7.946 | 26.507 | 1.00 | 50.10 | | O |
| ANISOU | 3317 | O | GLU | L | 59 | 6238 | 6424 | 6375 | 566 | 418 | −546 | O |
| ATOM | 3318 | CB | GLU | L | 59 | 31.040 | −6.264 | 26.115 | 1.00 | 63.56 | | C |
| ANISOU | 3318 | CB | GLU | L | 59 | 7813 | 8239 | 8100 | 584 | 471 | −439 | C |
| ATOM | 3319 | CG | GLU | L | 59 | 32.093 | −5.170 | 26.288 | 1.00 | 76.47 | | C |
| ANISOU | 3319 | CG | GLU | L | 59 | 9367 | 9930 | 9758 | 568 | 469 | −382 | C |
| ATOM | 3320 | CD | GLU | L | 59 | 32.876 | −4.892 | 24.998 | 1.00 | 90.52 | | C |
| ANISOU | 3320 | CD | GLU | L | 59 | 11148 | 11726 | 11519 | 595 | 538 | −364 | C |
| ATOM | 3321 | OE1 | GLU | L | 59 | 34.099 | −5.162 | 24.967 | 1.00 | 90.33 | | O |
| ANISOU | 3321 | OE1 | GLU | L | 59 | 11066 | 11726 | 11531 | 636 | 590 | −313 | O |
| ATOM | 3322 | OE2 | GLU | L | 59 | 32.263 | −4.410 | 24.016 | 1.00 | 96.77 | | O |
| ANISOU | 3322 | OE2 | GLU | L | 59 | 11999 | 12508 | 12260 | 579 | 541 | −399 | O |
| ATOM | 3323 | N | ARG | L | 60 | 30.024 | −8.990 | 27.774 | 1.00 | 43.54 | | N |
| ANISOU | 3323 | N | ARG | L | 60 | 5321 | 5608 | 5613 | 629 | 458 | −468 | N |
| ATOM | 3324 | CA | ARG | L | 60 | 29.361 | −10.272 | 27.555 | 1.00 | 52.83 | | C |
| ANISOU | 3324 | CA | ARG | L | 60 | 6563 | 6719 | 6790 | 654 | 477 | −507 | C |
| ATOM | 3325 | C | ARG | L | 60 | 28.037 | −10.430 | 28.313 | 1.00 | 44.74 | | C |
| ANISOU | 3325 | C | ARG | L | 60 | 5564 | 5665 | 5769 | 609 | 420 | −536 | C |
| ATOM | 3326 | O | ARG | L | 60 | 27.337 | −11.424 | 28.095 | 1.00 | 44.74 | | O |
| ANISOU | 3326 | O | ARG | L | 60 | 5620 | 5606 | 5772 | 618 | 428 | −571 | O |
| ATOM | 3327 | CB | ARG | L | 60 | 30.311 | −11.407 | 27.920 | 1.00 | 52.36 | | C |
| ANISOU | 3327 | CB | ARG | L | 60 | 6478 | 6642 | 6772 | 717 | 526 | −468 | C |
| ATOM | 3328 | CG | ARG | L | 60 | 30.728 | −11.410 | 29.346 | 1.00 | 55.17 | | C |
| ANISOU | 3328 | CG | ARG | L | 60 | 6764 | 7028 | 7169 | 713 | 495 | −412 | C |
| ATOM | 3329 | CD | ARG | L | 60 | 32.069 | −12.165 | 29.558 | 1.00 | 51.56 | | C |
| ANISOU | 3329 | CD | ARG | L | 60 | 6256 | 6577 | 6756 | 781 | 546 | −355 | C |
| ATOM | 3330 | NE | ARG | L | 60 | 32.407 | −12.070 | 30.972 | 1.00 | 50.71 | | N |
| ANISOU | 3330 | NE | ARG | L | 60 | 6084 | 6504 | 6681 | 771 | 501 | −301 | N |
| ATOM | 3331 | CZ | ARG | L | 60 | 31.936 | −12.902 | 31.879 | 1.00 | 49.30 | | C |
| ANISOU | 3331 | CZ | ARG | L | 60 | 5920 | 6293 | 6520 | 776 | 483 | −293 | C |
| ATOM | 3332 | NH1 | ARG | L | 60 | 31.142 | −13.885 | 31.491 | 1.00 | 46.17 | | N |
| ANISOU | 3332 | NH1 | ARG | L | 60 | 5594 | 5827 | 6121 | 789 | 506 | −335 | N |
| ATOM | 3333 | NH2 | ARG | L | 60 | 32.254 | −12.751 | 33.157 | 1.00 | 49.14 | | N |
| ANISOU | 3333 | NH2 | ARG | L | 60 | 5845 | 6307 | 6518 | 767 | 440 | −242 | N |
| ATOM | 3334 | N | PHE | L | 61 | 27.660 | −9.495 | 29.175 | 1.00 | 38.93 | | N |
| ANISOU | 3334 | N | PHE | L | 61 | 4791 | 4966 | 5033 | 562 | 366 | −522 | N |
| ATOM | 3335 | CA | PHE | L | 61 | 26.347 | −9.543 | 29.817 | 1.00 | 43.19 | | C |
| ANISOU | 3335 | CA | PHE | L | 61 | 5355 | 5482 | 5574 | 520 | 320 | −549 | C |
| ATOM | 3336 | C | PHE | L | 61 | 25.340 | −8.798 | 28.939 | 1.00 | 50.11 | | C |
| ANISOU | 3336 | C | PHE | L | 61 | 6274 | 6351 | 6416 | 480 | 293 | −600 | C |
| ATOM | 3337 | O | PHE | L | 61 | 25.541 | −7.621 | 28.621 | 1.00 | 50.76 | | O |
| ANISOU | 3337 | O | PHE | L | 61 | 6337 | 6472 | 6476 | 458 | 276 | −596 | O |
| ATOM | 3338 | CB | PHE | L | 61 | 26.395 | −8.926 | 31.216 | 1.00 | 36.79 | | C |
| ANISOU | 3338 | CB | PHE | L | 61 | 4489 | 4712 | 4776 | 495 | 279 | −511 | C |
| ATOM | 3339 | CG | PHE | L | 61 | 27.035 | −9.801 | 32.242 | 1.00 | 43.39 | | C |
| ANISOU | 3339 | CG | PHE | L | 61 | 5294 | 5548 | 5644 | 529 | 292 | −464 | C |
| ATOM | 3340 | CD1 | PHE | L | 61 | 28.405 | −9.764 | 32.432 | 1.00 | 45.54 | | C |
| ANISOU | 3340 | CD1 | PHE | L | 61 | 5513 | 5857 | 5933 | 562 | 311 | −414 | C |
| ATOM | 3341 | CD2 | PHE | L | 61 | 26.284 | −10.661 | 33.015 | 1.00 | 40.25 | | C |
| ANISOU | 3341 | CD2 | PHE | L | 61 | 4916 | 5114 | 5263 | 527 | 286 | −464 | C |
| ATOM | 3342 | CE1 | PHE | L | 61 | 29.022 | −10.573 | 33.377 | 1.00 | 45.44 | | C |
| ANISOU | 3342 | CE1 | PHE | L | 61 | 5470 | 5845 | 5951 | 597 | 318 | −365 | C |
| ATOM | 3343 | CE2 | PHE | L | 61 | 26.895 | −11.470 | 33.948 | 1.00 | 43.11 | | C |
| ANISOU | 3343 | CE2 | PHE | L | 61 | 5252 | 5652 | 5652 | 561 | 297 | −415 | C |
| ATOM | 3344 | CZ | PHE | L | 61 | 28.286 | −11.424 | 34.121 | 1.00 | 48.27 | | C |
| ANISOU | 3344 | CZ | PHE | L | 61 | 5854 | 6166 | 6320 | 598 | 312 | −365 | C |
| ATOM | 3345 | N | SER | L | 62 | 24.292 | −9.485 | 28.507 | 1.00 | 39.98 | | N |
| ANISOU | 3345 | N | SER | L | 62 | 5047 | 5013 | 5130 | 470 | 285 | −645 | N |
| ATOM | 3346 | CA | SER | L | 62 | 23.251 | −8.824 | 27.737 | 1.00 | 39.84 | | C |

TABLE 14-continued

| | | | | | | | | | | | | |
|---|---|---|---|---|---|---|---|---|---|---|---|---|
| ANISOU | 3346 | CA | SER | L | 62 | 5067 | 4988 | 5084 | 431 | 250 | −690 | C |
| ATOM | 3347 | C | SER | L | 62 | 21.934 | −9.488 | 28.108 | 1.00 | 43.04 | | C |
| ANISOU | 3347 | C | SER | L | 62 | 5498 | 5344 | 5512 | 404 | 221 | −719 | C |
| ATOM | 3348 | O | SER | L | 62 | 21.838 | −10.220 | 29.098 | 1.00 | 40.54 | | O |
| ANISOU | 3348 | O | SER | L | 62 | 5163 | 5011 | 5230 | 410 | 226 | −697 | O |
| ATOM | 3349 | CB | SER | L | 62 | 23.545 | −8.884 | 26.229 | 1.00 | 48.91 | | C |
| ANISOU | 3349 | CB | SER | L | 62 | 6268 | 6124 | 6193 | 452 | 277 | −721 | C |
| ATOM | 3350 | OG | SER | L | 62 | 22.539 | −8.141 | 25.511 | 1.00 | 55.62 | | O |
| ANISOU | 3350 | OG | SER | L | 62 | 7150 | 6971 | 7011 | 412 | 233 | −759 | O |
| ATOM | 3351 | N | GLY | L | 63 | 20.918 | −9.263 | 27.295 | 1.00 | 35.56 | | N |
| ANISOU | 3351 | N | GLY | L | 63 | 4592 | 4374 | 4547 | 374 | 189 | −764 | N |
| ATOM | 3352 | CA | GLY | L | 63 | 19.640 | −9.873 | 27.562 | 1.00 | 41.52 | | C |
| ANISOU | 3352 | CA | GLY | L | 63 | 5364 | 5081 | 5330 | 345 | 159 | −790 | C |
| ATOM | 3353 | C | GLY | L | 63 | 18.636 | −9.485 | 26.502 | 1.00 | 39.21 | | C |
| ANISOU | 3353 | C | GLY | L | 63 | 5113 | 4771 | 5015 | 312 | 117 | −838 | C |
| ATOM | 3354 | O | GLY | L | 63 | 18.922 | −8.695 | 25.603 | 1.00 | 39.61 | | O |
| ANISOU | 3354 | O | GLY | L | 63 | 5181 | 4848 | 5022 | 314 | 112 | −850 | O |
| ATOM | 3355 | N | SER | L | 64 | 17.448 | −10.059 | 26.622 | 1.00 | 43.28 | | N |
| ANISOU | 3355 | N | SER | L | 64 | 5642 | 5240 | 5562 | 282 | 86 | −863 | N |
| ATOM | 3356 | CA | SER | L | 64 | 16.337 | −9.718 | 25.739 | 1.00 | 40.26 | | C |
| ANISOU | 3356 | CA | SER | L | 64 | 5290 | 4840 | 5167 | 246 | 33 | −905 | C |
| ATOM | 3357 | C | SER | L | 64 | 15.061 | −9.683 | 26.552 | 1.00 | 40.20 | | C |
| ANISOU | 3357 | C | SER | L | 64 | 5245 | 4819 | 5212 | 204 | −3 | −901 | C |
| ATOM | 3358 | O | SER | L | 64 | 15.010 | −10.173 | 27.682 | 1.00 | 44.37 | | O |
| ANISOU | 3358 | O | SER | L | 64 | 5738 | 5339 | 5780 | 206 | 18 | −870 | O |
| ATOM | 3359 | CB | SER | L | 64 | 16.191 | −10.726 | 24.603 | 1.00 | 45.41 | | C |
| ANISOU | 3359 | CB | SER | L | 64 | 6016 | 5433 | 5803 | 254 | 30 | −954 | C |
| ATOM | 3360 | OG | SER | L | 64 | 15.731 | −11.943 | 25.141 | 1.00 | 52.05 | | O |
| ANISOU | 3360 | OG | SER | L | 64 | 6863 | 6217 | 6699 | 247 | 34 | −957 | O |
| ATOM | 3361 | N | ASN | L | 65 | 14.000 | −9.128 | 25.953 | 1.00 | 39.20 | | N |
| ANISOU | 3361 | N | ASN | L | 65 | 5125 | 4688 | 5083 | 168 | −56 | −928 | N |
| ATOM | 3362 | CA | ASN | L | 65 | 12.713 | −9.043 | 26.624 | 1.00 | 38.82 | | C |
| ANISOU | 3362 | CA | ASN | L | 65 | 5036 | 4627 | 5088 | 130 | −90 | −923 | C |
| ATOM | 3363 | C | ASN | L | 65 | 11.655 | −8.850 | 25.540 | 1.00 | 43.90 | | C |
| ANISOU | 3363 | C | ASN | L | 65 | 5705 | 5246 | 5729 | 96 | −153 | −963 | C |
| ATOM | 3364 | O | ASN | L | 65 | 11.656 | −7.826 | 24.845 | 1.00 | 38.92 | | O |
| ANISOU | 3364 | O | ASN | L | 65 | 5083 | 4648 | 5056 | 94 | −180 | −972 | O |
| ATOM | 3365 | CB | ASN | L | 65 | 12.699 | −7.903 | 27.636 | 1.00 | 38.70 | | C |
| ANISOU | 3365 | CB | ASN | L | 65 | 4960 | 4666 | 5078 | 127 | −83 | −886 | C |
| ATOM | 3366 | CG | ASN | L | 65 | 11.352 | −7.718 | 28.263 | 1.00 | 46.68 | | C |
| ANISOU | 3366 | CG | ASN | L | 65 | 5928 | 5668 | 6141 | 93 | −110 | −880 | C |
| ATOM | 3367 | OD1 | ASN | L | 65 | 10.523 | −8.630 | 28.244 | 1.00 | 39.86 | | O |
| ANISOU | 3367 | OD1 | ASN | L | 65 | 5066 | 4756 | 5324 | 70 | −124 | −891 | O |
| ATOM | 3368 | ND2 | ASN | L | 65 | 11.126 | −6.543 | 28.867 | 1.00 | 45.45 | | N |
| ANISOU | 3368 | ND2 | ASN | L | 65 | 5730 | 5555 | 5982 | 89 | −115 | −861 | N |
| ATOM | 3369 | N | PHE | L | 66 | 10.759 | −9.824 | 25.407 | 1.00 | 41.26 | | N |
| ANISOU | 3369 | N | PHE | L | 66 | 5382 | 4854 | 5439 | 68 | −180 | −985 | N |
| ATOM | 3370 | CA | PHE | L | 66 | 9.740 | −9.828 | 24.358 | 1.00 | 43.15 | | C |
| ANISOU | 3370 | CA | PHE | L | 66 | 5649 | 5064 | 5681 | 33 | −250 | −1026 | C |
| ATOM | 3371 | C | PHE | L | 66 | 8.570 | −10.636 | 24.882 | 1.00 | 46.51 | | C |
| ANISOU | 3371 | C | PHE | L | 66 | 6043 | 5440 | 6190 | −7 | −274 | −1024 | C |
| ATOM | 3372 | O | PHE | L | 66 | 8.773 | −11.693 | 25.483 | 1.00 | 43.23 | | O |
| ANISOU | 3372 | O | PHE | L | 66 | 5629 | 4986 | 5811 | −2 | −238 | −1013 | O |
| ATOM | 3373 | CB | PHE | L | 66 | 10.279 | −10.464 | 23.065 | 1.00 | 54.14 | | C |
| ANISOU | 3373 | CB | PHE | L | 66 | 7130 | 6423 | 7017 | 49 | −258 | −1073 | C |
| ATOM | 3374 | CG | PHE | L | 66 | 9.282 | −10.526 | 21.924 | 1.00 | 80.28 | | C |
| ANISOU | 3374 | CG | PHE | L | 66 | 10481 | 9702 | 10320 | 13 | −339 | −1119 | C |
| ATOM | 3375 | CD1 | PHE | L | 66 | 8.199 | −11.416 | 21.948 | 1.00 | 92.76 | | C |
| ANISOU | 3375 | CD1 | PHE | L | 66 | 12057 | 11221 | 11966 | −30 | −385 | −1139 | C |
| ATOM | 3376 | CD2 | PHE | L | 66 | 9.444 | −9.721 | 20.799 | 1.00 | 83.88 | | C |
| ANISOU | 3376 | CD2 | PHE | L | 66 | 10981 | 10187 | 10702 | 21 | −371 | −1140 | C |
| ATOM | 3377 | CE1 | PHE | L | 66 | 7.284 | −11.467 | 20.896 | 1.00 | 91.13 | | C |
| ANISOU | 3377 | CE1 | PHE | L | 66 | 11886 | 10987 | 11754 | −67 | −469 | −1182 | C |
| ATOM | 3378 | CE2 | PHE | L | 66 | 8.539 | −9.779 | 19.740 | 1.00 | 82.05 | | C |
| ANISOU | 3378 | CE2 | PHE | L | 66 | 10791 | 9928 | 10457 | −12 | −452 | −1182 | C |
| ATOM | 3379 | CZ | PHE | L | 66 | 7.459 | −10.650 | 19.789 | 1.00 | 83.34 | | C |
| ANISOU | 3379 | CZ | PHE | L | 66 | 10947 | 10033 | 10687 | −56 | −505 | −1204 | C |
| ATOM | 3380 | N | GLY | L | 67 | 7.353 | −10.147 | 24.650 | 1.00 | 43.79 | | N |
| ANISOU | 3380 | N | GLY | L | 67 | 5665 | 5094 | 5878 | −46 | −335 | −1031 | N |
| ATOM | 3381 | CA | GLY | L | 67 | 6.196 | −10.939 | 24.990 | 1.00 | 47.29 | | C |
| ANISOU | 3381 | CA | GLY | L | 67 | 6075 | 5487 | 6406 | −89 | −363 | −1029 | C |
| ATOM | 3382 | C | GLY | L | 67 | 6.114 | −11.253 | 26.463 | 1.00 | 45.20 | | C |
| ANISOU | 3382 | C | GLY | L | 67 | 5749 | 5225 | 6200 | −86 | −305 | −979 | C |
| ATOM | 3383 | O | GLY | L | 67 | 6.027 | −10.372 | 27.320 | 1.00 | 42.91 | | O |
| ANISOU | 3383 | O | GLY | L | 67 | 5403 | 4985 | 5916 | −76 | −279 | −943 | O |
| ATOM | 3384 | N | ASN | L | 68 | 6.129 | −12.535 | 26.786 | 1.00 | 43.75 | | N |
| ANISOU | 3384 | N | ASN | L | 68 | 5580 | 4984 | 6059 | −94 | −283 | −977 | N |
| ATOM | 3385 | CA | ASN | L | 68 | 5.996 | −12.963 | 28.159 | 1.00 | 40.11 | | C |
| ANISOU | 3385 | CA | ASN | L | 68 | 5067 | 4521 | 5654 | −93 | −229 | −926 | C |
| ATOM | 3386 | C | ASN | L | 68 | 7.318 | −13.447 | 28.757 | 1.00 | 43.17 | | C |

TABLE 14-continued

| | | | | | | | | | | | | |
|---|---|---|---|---|---|---|---|---|---|---|---|---|
| ANISOU | 3386 | C | ASN | L | 68 | 5482 | 4915 | 6006 | −46 | −159 | −905 | C |
| ATOM | 3387 | O | ASN | L | 68 | 7.321 | −14.021 | 29.846 | 1.00 | 44.59 | | O |
| ANISOU | 3387 | O | ASN | L | 68 | 5632 | 5083 | 6226 | −41 | −114 | −862 | O |
| ATOM | 3388 | CB | ASN | L | 68 | 4.925 | −14.043 | 28.258 | 1.00 | 45.60 | | C |
| ANISOU | 3388 | CB | ASN | L | 68 | 5742 | 5144 | 6439 | −142 | −253 | −925 | C |
| ATOM | 3389 | CG | ASN | L | 68 | 3.579 | −13.567 | 27.713 | 1.00 | 53.80 | | C |
| ANISOU | 3389 | CG | ASN | L | 68 | 6741 | 6178 | 7523 | −191 | −326 | −940 | C |
| ATOM | 3390 | OD1 | ASN | L | 68 | 3.217 | −12.399 | 27.846 | 1.00 | 50.93 | | O |
| ANISOU | 3390 | OD1 | ASN | L | 68 | 6333 | 5871 | 7149 | −187 | −337 | −926 | O |
| ATOM | 3391 | ND2 | ASN | L | 68 | 2.842 | −14.469 | 27.087 | 1.00 | 55.49 | | N |
| ANISOU | 3391 | ND2 | ASN | L | 68 | 6971 | 6323 | 7791 | −236 | −380 | −968 | N |
| ATOM | 3392 | N | THR | L | 69 | 8.447 | −13.192 | 28.103 | 1.00 | 43.41 | | N |
| ANISOU | 3392 | N | THR | L | 69 | 5564 | 4967 | 5963 | −8 | −149 | −927 | N |
| ATOM | 3393 | CA | THR | L | 69 | 9.700 | −13.707 | 28.630 | 1.00 | 45.54 | | C |
| ANISOU | 3393 | CA | THR | L | 69 | 5854 | 5241 | 6208 | 38 | −87 | −904 | C |
| ATOM | 3394 | C | THR | L | 69 | 10.825 | −12.709 | 28.407 | 1.00 | 44.01 | | C |
| ANISOU | 3394 | C | THR | L | 69 | 5670 | 5113 | 5938 | 79 | −68 | −902 | C |
| ATOM | 3395 | O | THR | L | 69 | 11.012 | −12.188 | 27.300 | 1.00 | 45.66 | | O |
| ANISOU | 3395 | O | THR | L | 69 | 5916 | 5335 | 6100 | 81 | −97 | −938 | O |
| ATOM | 3396 | CB | THR | L | 69 | 10.038 | −15.065 | 27.988 | 1.00 | 53.97 | | C |
| ANISOU | 3396 | CB | THR | L | 69 | 6986 | 6233 | 7286 | 46 | −83 | −935 | C |
| ATOM | 3397 | OG1 | THR | L | 69 | 8.924 | −15.951 | 28.162 | 1.00 | 54.24 | | O |
| ANISOU | 3397 | OG1 | THR | L | 69 | 7008 | 6200 | 7398 | 0 | −108 | −937 | O |
| ATOM | 3398 | CG2 | THR | L | 69 | 11.266 | −15.700 | 28.666 | 1.00 | 53.05 | | C |
| ANISOU | 3398 | CG2 | THR | L | 69 | 6880 | 6116 | 7159 | 97 | −15 | −901 | C |
| ATOM | 3399 | N | ALA | L | 70 | 11.564 | −12.451 | 29.472 | 1.00 | 41.54 | | N |
| ANISOU | 3399 | N | ALA | L | 70 | 5324 | 4842 | 5616 | 108 | −21 | −856 | N |
| ATOM | 3400 | CA | ALA | L | 70 | 12.822 | −11.734 | 29.413 | 1.00 | 47.47 | | C |
| ANISOU | 3400 | CA | ALA | L | 70 | 6081 | 5648 | 6307 | 147 | 5 | −846 | C |
| ATOM | 3401 | C | ALA | L | 70 | 13.966 | −12.717 | 29.657 | 1.00 | 43.94 | | C |
| ANISOU | 3401 | C | ALA | L | 70 | 5657 | 5182 | 5857 | 190 | 54 | −828 | C |
| ATOM | 3402 | O | ALA | L | 70 | 13.826 | −13.701 | 30.388 | 1.00 | 40.87 | | O |
| ANISOU | 3402 | O | ALA | L | 70 | 5262 | 4756 | 5513 | 192 | 77 | −803 | O |
| ATOM | 3403 | CB | ALA | L | 70 | 12.855 | −10.604 | 30.451 | 1.00 | 41.28 | | C |
| ANISOU | 3403 | CB | ALA | L | 70 | 5241 | 4929 | 5513 | 148 | 13 | −809 | C |
| ATOM | 3404 | N | THR | L | 71 | 15.105 | −12.459 | 29.054 | 1.00 | 37.83 | | N |
| ANISOU | 3404 | N | THR | L | 71 | 4907 | 4432 | 5033 | 226 | 73 | −834 | N |
| ATOM | 3405 | CA | THR | L | 71 | 16.213 | −13.396 | 29.201 | 1.00 | 41.82 | | C |
| ANISOU | 3405 | CA | THR | L | 71 | 5432 | 4918 | 5540 | 272 | 121 | −816 | C |
| ATOM | 3406 | C | THR | L | 71 | 17.469 | −12.630 | 29.542 | 1.00 | 38.72 | | C |
| ANISOU | 3406 | C | THR | L | 71 | 5009 | 4592 | 5111 | 307 | 149 | −782 | C |
| ATOM | 3407 | O | THR | L | 71 | 17.787 | −11.640 | 28.875 | 1.00 | 42.11 | | O |
| ANISOU | 3407 | O | THR | L | 71 | 5440 | 5062 | 5497 | 307 | 137 | −795 | O |
| ATOM | 3408 | CB | THR | L | 71 | 16.421 | −14.207 | 27.918 | 1.00 | 44.19 | | C |
| ANISOU | 3408 | CB | THR | L | 71 | 5802 | 5163 | 5825 | 288 | 125 | −865 | C |
| ATOM | 3409 | OG1 | THR | L | 71 | 15.170 | −14.804 | 27.559 | 1.00 | 42.41 | | O |
| ANISOU | 3409 | OG1 | THR | L | 71 | 5603 | 4875 | 5635 | 245 | 85 | −901 | O |
| ATOM | 3410 | CG2 | THR | L | 71 | 17.440 | −15.286 | 28.147 | 1.00 | 46.82 | | C |
| ANISOU | 3410 | CG2 | THR | L | 71 | 6153 | 5465 | 6173 | 338 | 179 | −845 | C |
| ATOM | 3411 | N | LEU | L | 72 | 18.143 | −13.062 | 30.597 | 1.00 | 36.97 | | N |
| ANISOU | 3411 | N | LEU | L | 72 | 4758 | 4381 | 4908 | 334 | 182 | −733 | N |
| ATOM | 3412 | CA | LEU | L | 72 | 19.519 | −12.644 | 30.869 | 1.00 | 35.61 | | C |
| ANISOU | 3412 | CA | LEU | L | 72 | 4559 | 4261 | 4709 | 373 | 209 | −698 | C |
| ATOM | 3413 | C | LEU | L | 72 | 20.445 | −13.547 | 30.062 | 1.00 | 37.36 | | C |
| ANISOU | 3413 | C | LEU | L | 72 | 4818 | 4448 | 4928 | 421 | 249 | −707 | C |
| ATOM | 3414 | O | LEU | L | 72 | 20.378 | −14.770 | 30.198 | 1.00 | 48.64 | | O |
| ANISOU | 3414 | O | LEU | L | 72 | 6272 | 5819 | 6391 | 438 | 270 | −706 | O |
| ATOM | 3415 | CB | LEU | L | 72 | 19.828 | −12.755 | 32.360 | 1.00 | 35.08 | | C |
| ANISOU | 3415 | CB | LEU | L | 72 | 4446 | 4220 | 4662 | 383 | 221 | −640 | C |
| ATOM | 3416 | CG | LEU | L | 72 | 21.300 | −12.429 | 32.729 | 1.00 | 39.26 | | C |
| ANISOU | 3416 | CG | LEU | L | 72 | 4941 | 4801 | 5173 | 423 | 242 | −598 | C |
| ATOM | 3417 | CD1 | LEU | L | 72 | 21.671 | −11.021 | 32.309 | 1.00 | 40.84 | | C |
| ANISOU | 3417 | CD1 | LEU | L | 72 | 5122 | 5060 | 5335 | 409 | 222 | −607 | C |
| ATOM | 3418 | CD2 | LEU | L | 72 | 21.516 | −12.561 | 34.181 | 1.00 | 37.48 | | C |
| ANISOU | 3418 | CD2 | LEU | L | 72 | 4679 | 4601 | 4962 | 430 | 243 | −544 | C |
| ATOM | 3419 | N | ILE | L | 73 | 21.256 | −12.969 | 29.187 | 1.00 | 40.76 | | N |
| ANISOU | 3419 | N | ILE | L | 73 | 5257 | 4910 | 5320 | 442 | 263 | −718 | N |
| ATOM | 3420 | CA | ILE | L | 73 | 22.162 | −13.734 | 28.314 | 1.00 | 46.39 | | C |
| ANISOU | 3420 | CA | ILE | L | 73 | 6009 | 5595 | 6024 | 493 | 310 | −730 | C |
| ATOM | 3421 | C | ILE | L | 73 | 23.617 | −13.438 | 28.695 | 1.00 | 42.54 | | C |
| ANISOU | 3421 | C | ILE | L | 73 | 5470 | 5160 | 5533 | 537 | 347 | −677 | C |
| ATOM | 3422 | O | ILE | L | 73 | 24.152 | −12.351 | 28.433 | 1.00 | 41.77 | | O |
| ANISOU | 3422 | O | ILE | L | 73 | 5344 | 5120 | 5406 | 533 | 344 | −665 | O |
| ATOM | 3423 | CB | ILE | L | 73 | 21.912 | −13.422 | 26.834 | 1.00 | 44.52 | | C |
| ANISOU | 3423 | CB | ILE | L | 73 | 5830 | 5346 | 5741 | 487 | 303 | −786 | C |
| ATOM | 3424 | CG1 | ILE | L | 73 | 20.454 | −13.693 | 26.489 | 1.00 | 43.38 | | C |
| ANISOU | 3424 | CG1 | ILE | L | 73 | 5727 | 5150 | 5603 | 439 | 254 | −835 | C |
| ATOM | 3425 | CG2 | ILE | L | 73 | 22.842 | −14.243 | 25.928 | 1.00 | 43.30 | | C |
| ANISOU | 3425 | CG2 | ILE | L | 73 | 5722 | 5160 | 5571 | 545 | 359 | −801 | C |
| ATOM | 3426 | CD1 | ILE | L | 73 | 20.000 | −12.934 | 25.276 | 1.00 | 45.03 | | C |

TABLE 14-continued

| | | | | | | | | | | | |
|---|---|---|---|---|---|---|---|---|---|---|---|
| ANISOU | 3426 | CD1 | ILE | L | 73 | 5977 | 5371 | 5762 | 416 | 223 | −881 | C |
| ATOM | 3427 | N | ILE | L | 74 | 24.280 | −14.414 | 29.288 | 1.00 | 41.04 | | N |
| ANISOU | 3427 | N | ILE | L | 74 | 5267 | 4947 | 5378 | 580 | 382 | −641 | N |
| ATOM | 3428 | CA | ILE | L | 74 | 25.670 | −14.271 | 29.697 | 1.00 | 39.85 | | C |
| ANISOU | 3428 | CA | ILE | L | 74 | 5062 | 4843 | 5235 | 624 | 415 | −585 | C |
| ATOM | 3429 | C | ILE | L | 74 | 26.494 | −15.082 | 28.706 | 1.00 | 46.53 | | C |
| ANISOU | 3429 | C | ILE | L | 74 | 5945 | 5655 | 6081 | 685 | 475 | −598 | C |
| ATOM | 3430 | O | ILE | L | 74 | 26.406 | −16.319 | 28.677 | 1.00 | 45.94 | | O |
| ANISOU | 3430 | O | ILE | L | 74 | 5908 | 5514 | 6035 | 715 | 501 | −608 | O |
| ATOM | 3431 | CB | ILE | I | 74 | 25.910 | −14.752 | 31.133 | 1.00 | 39.76 | | C |
| ANISOU | 3431 | CB | ILE | L | 74 | 5006 | 4839 | 5263 | 635 | 409 | −528 | C |
| ATOM | 3432 | CG1 | ILE | L | 74 | 25.048 | −13.974 | 32.125 | 1.00 | 38.84 | | C |
| ANISOU | 3432 | CG1 | ILE | L | 74 | 4862 | 4754 | 5140 | 579 | 356 | −519 | C |
| ATOM | 3433 | CG2 | ILE | L | 74 | 27.402 | −14.586 | 31.518 | 1.00 | 41.30 | | C |
| ANISOU | 3433 | CG2 | ILE | L | 74 | 5138 | 5084 | 5469 | 681 | 435 | −467 | C |
| ATOM | 3434 | CD1 | ILE | L | 74 | 25.033 | −14.624 | 33.518 | 1.00 | 41.89 | | C |
| ANISOU | 3434 | CD1 | ILE | L | 74 | 5223 | 5135 | 5558 | 588 | 352 | −468 | C |
| ATOM | 3435 | N | SER | L | 75 | 27.247 | −14.379 | 27.866 | 1.00 | 48.12 | | N |
| ANISOU | 3435 | N | SER | L | 75 | 6137 | 5896 | 6250 | 702 | 500 | −600 | N |
| ATOM | 3436 | CA | SER | L | 75 | 28.121 | −14.979 | 26.865 | 1.00 | 47.00 | | C |
| ANISOU | 3436 | CA | SER | L | 75 | 6027 | 5733 | 6100 | 765 | 567 | −609 | C |
| ATOM | 3437 | C | SER | L | 75 | 29.472 | −15.333 | 27.472 | 1.00 | 53.46 | | C |
| ANISOU | 3437 | C | SER | L | 75 | 6778 | 6576 | 6959 | 823 | 611 | −541 | C |
| ATOM | 3438 | O | SER | L | 75 | 29.924 | −14.700 | 28.430 | 1.00 | 48.42 | | O |
| ANISOU | 3438 | O | SER | L | 75 | 6063 | 5994 | 6339 | 808 | 584 | −486 | O |
| ATOM | 3439 | CB | SER | L | 75 | 28.333 | −14.004 | 25.705 | 1.00 | 45.99 | | C |
| ANISOU | 3439 | CB | SER | L | 75 | 5915 | 5642 | 5917 | 757 | 579 | −633 | C |
| ATOM | 3440 | OG | SER | L | 75 | 27.232 | −13.997 | 24.837 | 1.00 | 53.85 | | O |
| ANISOU | 3440 | OG | SER | L | 75 | 6990 | 6599 | 6871 | 724 | 551 | −701 | O |
| ATOM | 3441 | N | ARG | L | 76 | 30.127 | −16.339 | 26.888 | 1.00 | 56.32 | | N |
| ANISOU | 3441 | N | ARG | L | 76 | 7171 | 6894 | 7334 | 890 | 677 | −545 | N |
| ATOM | 3442 | CA | ARG | L | 76 | 31.485 | −16.730 | 27.273 | 1.00 | 58.70 | | C |
| ANISOU | 3442 | CA | ARG | L | 76 | 7409 | 7217 | 7679 | 957 | 727 | −480 | C |
| ATOM | 3443 | C | ARG | L | 76 | 31.605 | −16.803 | 28.788 | 1.00 | 54.16 | | C |
| ANISOU | 3443 | C | ARG | L | 76 | 6764 | 6665 | 7150 | 944 | 685 | −418 | C |
| ATOM | 3444 | O | ARG | L | 76 | 32.413 | −16.116 | 29.414 | 1.00 | 55.25 | | O |
| ANISOU | 3444 | O | ARG | L | 76 | 6819 | 6871 | 7304 | 943 | 672 | −359 | O |
| ATOM | 3445 | CB | ARG | L | 76 | 32.517 | −15.771 | 26.676 | 1.00 | 49.78 | | C |
| ANISOU | 3445 | CB | ARG | L | 76 | 6228 | 6157 | 6531 | 973 | 761 | −451 | C |
| ATOM | 3446 | CG | ARG | L | 76 | 32.488 | −15.782 | 25.151 | 1.00 | 51.77 | | C |
| ANISOU | 3446 | CG | ARG | L | 76 | 6555 | 6386 | 6730 | 997 | 814 | −507 | C |
| ATOM | 3447 | CD | ARG | L | 76 | 33.389 | −14.730 | 24.567 | 1.00 | 61.99 | | C |
| ANISOU | 3447 | CD | ARG | L | 76 | 7798 | 7751 | 8004 | 1004 | 847 | −475 | C |
| ATOM | 3448 | NE | ARG | L | 76 | 32.857 | −13.381 | 24.723 | 1.00 | 69.02 | | N |
| ANISOU | 3448 | NE | ARG | L | 76 | 8665 | 8694 | 8866 | 927 | 781 | −476 | N |
| ATOM | 3449 | CZ | ARG | L | 76 | 31.921 | −12.849 | 23.942 | 1.00 | 78.61 | | C |
| ANISOU | 3449 | CZ | ARG | L | 76 | 9947 | 9899 | 10022 | 884 | 754 | −533 | C |
| ATOM | 3450 | NH1 | ARG | L | 76 | 31.401 | −13.554 | 22.946 | 1.00 | 84.40 | | N |
| ANISOU | 3450 | NH1 | ARG | L | 76 | 10779 | 10575 | 10714 | 906 | 781 | −597 | N |
| ATOM | 3451 | NH2 | ARG | L | 76 | 31.495 | −11.610 | 24.156 | 1.00 | 77.87 | | N |
| ANISOU | 3451 | NH2 | ARG | L | 76 | 9826 | 9852 | 9911 | 819 | 696 | −528 | N |
| ATOM | 3452 | N | VAL | L | 77 | 30.739 | −17.638 | 29.365 | 1.00 | 51.92 | | N |
| ANISOU | 3452 | N | VAL | L | 77 | 6519 | 6322 | 6885 | 929 | 661 | −433 | N |
| ATOM | 3453 | CA | VAL | L | 77 | 30.632 | −17.744 | 30.810 | 1.00 | 51.44 | | C |
| ANISOU | 3453 | CA | VAL | L | 77 | 6410 | 6279 | 6858 | 912 | 619 | −380 | C |
| ATOM | 3454 | C | VAL | L | 77 | 31.962 | −18.151 | 31.426 | 1.00 | 56.33 | | C |
| ANISOU | 3454 | C | VAL | L | 77 | 6959 | 6922 | 7522 | 975 | 648 | −303 | C |
| ATOM | 3455 | O | VAL | L | 77 | 32.694 | −18.993 | 30.889 | 1.00 | 48.94 | | O |
| ANISOU | 3455 | O | VAL | L | 77 | 6033 | 5949 | 6612 | 1044 | 711 | −296 | O |
| ATOM | 3456 | CB | VAL | L | 77 | 29.532 | −18.753 | 31.173 | 1.00 | 50.12 | | C |
| ANISOU | 3456 | CB | VAL | L | 77 | 6303 | 6033 | 6709 | 895 | 605 | −406 | C |
| ATOM | 3457 | CG1 | VAL | L | 77 | 29.620 | −19.121 | 32.610 | 1.00 | 47.18 | | C |
| ANISOU | 3457 | CG1 | VAL | L | 77 | 5885 | 5669 | 6372 | 897 | 580 | −341 | C |
| ATOM | 3458 | CG2 | VAL | L | 77 | 28.144 | −18.171 | 30.850 | 1.00 | 51.15 | | C |
| ANISOU | 3458 | CG2 | VAL | L | 77 | 6478 | 6153 | 6803 | 821 | 558 | −468 | C |
| ATOM | 3459 | N | GLU | L | 78 | 32.272 | −17.550 | 32.567 | 1.00 | 52.21 | | N |
| ANISOU | 3459 | N | GLU | L | 78 | 6366 | 6462 | 7008 | 952 | 601 | −247 | N |
| ATOM | 3460 | CA | GLU | L | 78 | 33.432 | −17.903 | 33.359 | 1.00 | 53.61 | | C |
| ANISOU | 3460 | CA | GLU | L | 78 | 6471 | 6668 | 7230 | 1003 | 609 | −167 | C |
| ATOM | 3461 | C | GLU | L | 78 | 32.983 | −18.525 | 34.672 | 1.00 | 54.22 | | C |
| ANISOU | 3461 | C | GLU | L | 78 | 6549 | 6727 | 7327 | 995 | 572 | −129 | C |
| ATOM | 3462 | O | GLU | L | 78 | 31.853 | −18.325 | 35.122 | 1.00 | 58.06 | | O |
| ANISOU | 3462 | O | GLU | L | 78 | 7071 | 7202 | 7787 | 938 | 531 | −157 | O |
| ATOM | 3463 | CB | GLU | L | 78 | 34.289 | −16.668 | 33.634 | 1.00 | 60.09 | | C |
| ANISOU | 3463 | CB | GLU | L | 78 | 7206 | 7580 | 8043 | 983 | 578 | −125 | C |
| ATOM | 3464 | CG | GLU | L | 78 | 34.837 | −16.041 | 32.370 | 1.00 | 62.53 | | C |
| ANISOU | 3464 | CG | GLU | L | 78 | 7508 | 7913 | 8339 | 994 | 622 | −149 | C |
| ATOM | 3465 | CD | GLU | L | 78 | 35.305 | −14.632 | 32.604 | 1.00 | 71.55 | | C |
| ANISOU | 3465 | CD | GLU | L | 78 | 8580 | 9137 | 9467 | 948 | 578 | −124 | C |
| ATOM | 3466 | OE1 | GLU | L | 78 | 35.372 | −14.231 | 33.795 | 1.00 | 71.61 | | O |

TABLE 14-continued

| | | | | | | | | | | | |
|---|---|---|---|---|---|---|---|---|---|---|---|
| ANISOU | 3466 | OE1 | GLU | L | 78 | 8542 | 9186 | 9481 | 918 | 514 | −84 | O |
| ATOM | 3467 | OE2 | GLU | L | 78 | 35.603 | −13.934 | 31.602 | 1.00 | 72.57 | | O |
| ANISOU | 3467 | OE2 | GLU | L | 78 | 8706 | 9289 | 9578 | 943 | 607 | −143 | O |
| ATOM | 3468 | N | ALA | L | 79 | 33.880 | −19.308 | 35.269 | 1.00 | 50.82 | | N |
| ANISOU | 3468 | N | ALA | L | 79 | 6076 | 6291 | 6943 | 1055 | 589 | −62 | N |
| ATOM | 3469 | CA | ALA | L | 79 | 33.696 | −19.748 | 36.646 | 1.00 | 52.42 | | C |
| ANISOU | 3469 | CA | ALA | L | 79 | 6264 | 6494 | 7159 | 1051 | 548 | −7 | C |
| ATOM | 3470 | C | ALA | L | 79 | 33.251 | −18.597 | 37.543 | 1.00 | 45.72 | | C |
| ANISOU | 3470 | C | ALA | L | 79 | 5390 | 5716 | 6267 | 981 | 474 | −1 | C |
| ATOM | 3471 | O | ALA | L | 79 | 32.445 | −18.787 | 38.460 | 1.00 | 48.34 | | O |
| ANISOU | 3471 | O | ALA | L | 79 | 5748 | 6037 | 6584 | 951 | 442 | 8 | O |
| ATOM | 3472 | CB | ALA | L | 79 | 35.005 | −20.347 | 37.187 | 1.00 | 51.51 | | C |
| ANISOU | 3472 | CB | ALA | L | 79 | 6082 | 6395 | 7096 | 1124 | 563 | 77 | C |
| ATOM | 3473 | N | GLY | L | 80 | 33.817 | −17.412 | 37.336 | 1.00 | 40.20 | | N |
| ANISOU | 3473 | N | GLY | L | 80 | 4640 | 5088 | 5547 | 957 | 450 | 0 | N |
| ATOM | 3474 | CA | GLY | L | 80 | 33.544 | −16.318 | 38.233 | 1.00 | 44.35 | | C |
| ANISOU | 3474 | CA | GLY | L | 80 | 5140 | 5677 | 6033 | 897 | 379 | 9 | C |
| ATOM | 3475 | C | GLY | L | 80 | 32.103 | −15.830 | 38.194 | 1.00 | 56.18 | | C |
| ANISOU | 3475 | C | GLY | L | 80 | 6700 | 7159 | 7486 | 832 | 357 | −56 | C |
| ATOM | 3476 | O | GLY | L | 80 | 31.695 | −15.096 | 39.101 | 1.00 | 54.37 | | O |
| ANISOU | 3476 | O | GLY | L | 80 | 6464 | 6971 | 7223 | 787 | 303 | −49 | O |
| ATOM | 3477 | N | ASP | L | 81 | 31.334 | −16.228 | 37.171 | 1.00 | 52.26 | | N |
| ANISOU | 3477 | N | ASP | L | 81 | 6265 | 6602 | 6989 | 828 | 397 | −117 | N |
| ATOM | 3478 | CA | ASP | L | 81 | 29.945 | −15.819 | 37.015 | 1.00 | 60.06 | | C |
| ANISOU | 3478 | CA | ASP | L | 81 | 7307 | 7570 | 7944 | 769 | 378 | −177 | C |
| ATOM | 3479 | C | ASP | L | 81 | 28.994 | −16.653 | 37.848 | 1.00 | 55.12 | | C |
| ANISOU | 3479 | C | ASP | L | 81 | 6719 | 6899 | 7326 | 759 | 372 | −168 | C |
| ATOM | 3480 | O | ASP | L | 81 | 27.789 | −16.378 | 37.810 | 1.00 | 52.02 | | O |
| ANISOU | 3480 | O | ASP | L | 81 | 6364 | 6489 | 6914 | 710 | 357 | −211 | O |
| ATOM | 3481 | CB | ASP | L | 81 | 29.495 | −15.915 | 35.549 | 1.00 | 51.82 | | C |
| ANISOU | 3481 | CB | ASP | L | 81 | 6314 | 6481 | 6895 | 766 | 415 | −245 | C |
| ATOM | 3482 | CG | ASP | L | 81 | 30.344 | −15.090 | 34.601 | 1.00 | 57.06 | | C |
| ANISOU | 3482 | CG | ASP | L | 81 | 6949 | 7186 | 7546 | 775 | 430 | −256 | C |
| ATOM | 3483 | OD1 | ASP | L | 81 | 30.970 | −14.061 | 35.007 | 1.00 | 51.83 | | O |
| ANISOU | 3483 | OD1 | ASP | L | 81 | 6228 | 6593 | 6872 | 757 | 397 | −226 | O |
| ATOM | 3484 | OD2 | ASP | L | 81 | 30.360 | −15.465 | 33.408 | 1.00 | 54.86 | | O |
| ANISOU | 3484 | OD2 | ASP | L | 81 | 6710 | 6868 | 7268 | 798 | 475 | −295 | O |
| ATOM | 3485 | N | GLU | L | 82 | 29.494 | −17.661 | 38.569 | 1.00 | 42.68 | | N |
| ANISOU | 3485 | N | GLU | L | 82 | 5131 | 5302 | 5783 | 805 | 386 | −109 | N |
| ATOM | 3486 | CA | GLU | L | 82 | 28.634 | −18.514 | 39.380 | 1.00 | 45.58 | | C |
| ANISOU | 3486 | CA | GLU | L | 82 | 5533 | 5622 | 6161 | 798 | 386 | −90 | C |
| ATOM | 3487 | C | GLU | L | 82 | 28.012 | −17.678 | 40.469 | 1.00 | 52.91 | | C |
| ANISOU | 3487 | C | GLU | L | 82 | 6452 | 6604 | 7046 | 748 | 338 | −78 | C |
| ATOM | 3488 | O | GLU | L | 82 | 28.734 | −17.039 | 41.244 | 1.00 | 58.04 | | O |
| ANISOU | 3488 | O | GLU | L | 82 | 7058 | 7321 | 7672 | 751 | 301 | −37 | O |
| ATOM | 3489 | CB | GLU | L | 82 | 29.421 | −19.659 | 40.016 | 1.00 | 60.85 | | C |
| ANISOU | 3489 | CB | GLU | L | 82 | 7452 | 7531 | 8137 | 860 | 407 | −19 | C |
| ATOM | 3490 | CG | GLU | L | 82 | 29.173 | −21.029 | 39.410 | 1.00 | 73.44 | | C |
| ANISOU | 3490 | CG | GLU | L | 82 | 9095 | 9027 | 9781 | 896 | 460 | −32 | C |
| ATOM | 3491 | CD | GLU | L | 82 | 29.486 | −22.164 | 40.383 | 1.00 | 70.84 | | C |
| ANISOU | 3491 | CD | GLU | L | 82 | 8763 | 8664 | 9490 | 941 | 471 | 44 | C |
| ATOM | 3492 | OE1 | GLU | L | 82 | 29.594 | −23.322 | 39.941 | 1.00 | 64.04 | | O |
| ANISOU | 3492 | OE1 | GLU | L | 82 | 7932 | 7721 | 8677 | 984 | 515 | 46 | O |
| ATOM | 3493 | OE2 | GLU | L | 82 | 29.613 | −21.886 | 41.594 | 1.00 | 71.34 | | O |
| ANISOU | 3493 | OE2 | GLU | L | 82 | 8796 | 8780 | 9530 | 933 | 434 | 102 | O |
| ATOM | 3494 | N | ALA | L | 83 | 26.681 | −17.680 | 40.529 | 1.00 | 47.63 | | N |
| ANISOU | 3494 | N | ALA | L | 83 | 5825 | 5904 | 6368 | 703 | 336 | −115 | N |
| ATOM | 3495 | CA | ALA | L | 83 | 26.004 | −16.697 | 41.354 | 1.00 | 43.02 | | C |
| ANISOU | 3495 | CA | ALA | L | 83 | 5236 | 5371 | 5737 | 655 | 297 | −119 | C |
| ATOM | 3496 | C | ALA | L | 83 | 24.509 | −16.922 | 41.225 | 1.00 | 47.14 | | C |
| ANISOU | 3496 | C | ALA | L | 83 | 5800 | 5844 | 6266 | 613 | 309 | −158 | C |
| ATOM | 3497 | O | ALA | L | 83 | 24.035 | −17.728 | 40.420 | 1.00 | 44.29 | | O |
| ANISOU | 3497 | O | ALA | L | 83 | 5472 | 5412 | 5944 | 615 | 338 | −187 | O |
| ATOM | 3498 | CB | ALA | L | 83 | 26.348 | −15.246 | 40.953 | 1.00 | 41.91 | | C |
| ANISOU | 3498 | CB | ALA | L | 83 | 5068 | 5295 | 5559 | 627 | 263 | −153 | C |
| ATOM | 3499 | N | ASP | L | 84 | 23.774 | −16.212 | 42.063 | 1.00 | 44.41 | | N |
| ANISOU | 3499 | N | ASP | L | 84 | 5454 | 5535 | 5885 | 576 | 286 | −156 | N |
| ATOM | 3500 | CA | ASP | L | 84 | 22.337 | −16.105 | 41.947 | 1.00 | 36.41 | | C |
| ANISOU | 3500 | CA | ASP | L | 84 | 4466 | 4491 | 4875 | 531 | 292 | −194 | C |
| ATOM | 3501 | C | ASP | L | 84 | 22.042 | −14.843 | 41.149 | 1.00 | 42.13 | | C |
| ANISOU | 3501 | C | ASP | L | 84 | 5186 | 5247 | 5575 | 496 | 267 | −257 | C |
| ATOM | 3502 | O | ASP | L | 84 | 22.677 | −13.811 | 41.362 | 1.00 | 45.77 | | O |
| ANISOU | 3502 | O | ASP | L | 84 | 5623 | 5771 | 5998 | 494 | 237 | −256 | O |
| ATOM | 3503 | CB | ASP | L | 84 | 21.730 | −16.063 | 43.340 | 1.00 | 37.85 | | C |
| ANISOU | 3503 | CB | ASP | L | 84 | 4651 | 4697 | 5033 | 519 | 289 | −151 | C |
| ATOM | 3504 | CG | ASP | L | 84 | 22.062 | −17.322 | 44.142 | 1.00 | 52.44 | | C |
| ANISOU | 3504 | CG | ASP | L | 84 | 6506 | 6514 | 6905 | 556 | 314 | −81 | C |
| ATOM | 3505 | OD1 | ASP | L | 84 | 21.913 | −18.438 | 43.594 | 1.00 | 48.61 | | O |
| ANISOU | 3505 | OD1 | ASP | L | 84 | 6039 | 5955 | 6474 | 569 | 344 | −80 | O |
| ATOM | 3506 | OD2 | ASP | L | 84 | 22.499 | −17.199 | 45.307 | 1.00 | 61.94 | | O |

TABLE 14-continued

| | | | | | | | | | | | | |
|---|---|---|---|---|---|---|---|---|---|---|---|---|
| ANISOU | 3506 | OD2 | ASP | L | 84 | 7700 | 7764 | 8069 | 573 | 300 | −27 | O |
| ATOM | 3507 | N | TYR | L | 85 | 21.152 | −14.948 | 40.189 | 1.00 | 38.27 | | N |
| ANISOU | 3507 | N | TYR | L | 85 | 4720 | 4712 | 5110 | 469 | 275 | −309 | N |
| ATOM | 3508 | CA | TYR | L | 85 | 20.756 | −13.827 | 39.348 | 1.00 | 37.81 | | C |
| ANISOU | 3508 | CA | TYR | L | 85 | 4661 | 4675 | 5030 | 436 | 251 | −366 | C |
| ATOM | 3509 | C | TYR | L | 85 | 19.272 | −13.600 | 39.559 | 1.00 | 37.16 | | C |
| ANISOU | 3509 | C | TYR | L | 85 | 4588 | 4576 | 4956 | 392 | 247 | −389 | C |
| ATOM | 3510 | O | TYR | L | 85 | 18.517 | −14.564 | 39.587 | 1.00 | 38.90 | | O |
| ANISOU | 3510 | O | TYR | L | 85 | 4824 | 4739 | 5217 | 384 | 267 | −384 | O |
| ATOM | 3511 | CB | TYR | L | 85 | 21.035 | −14.130 | 37.878 | 1.00 | 35.09 | | C |
| ANISOU | 3511 | CB | TYR | L | 85 | 4337 | 4292 | 4704 | 445 | 261 | −410 | C |
| ATOM | 3512 | CG | TYR | L | 85 | 22.518 | −14.195 | 37.594 | 1.00 | 36.79 | | C |
| ANISOU | 3512 | CG | TYR | L | 85 | 4535 | 4532 | 4913 | 490 | 272 | −388 | C |
| ATOM | 3513 | CD1 | TYR | L | 85 | 23.255 | −15.363 | 37.820 | 1.00 | 41.32 | | C |
| ANISOU | 3513 | CD1 | TYR | L | 85 | 5110 | 5073 | 5516 | 537 | 302 | −347 | C |
| ATOM | 3514 | CD2 | TYR | L | 85 | 23.177 | −13.104 | 37.108 | 1.00 | 36.14 | | C |
| ANISOU | 3514 | CD2 | TYR | L | 85 | 4431 | 4499 | 4800 | 487 | 254 | −403 | C |
| ATOM | 3515 | CE1 | TYR | L | 85 | 24.618 | −15.418 | 37.551 | 1.00 | 36.59 | | C |
| ANISOU | 3515 | CE1 | TYR | L | 85 | 4487 | 4497 | 4918 | 582 | 314 | −323 | C |
| ATOM | 3516 | CE2 | TYR | L | 85 | 24.558 | −13.138 | 36.864 | 1.00 | 37.09 | | C |
| ANISOU | 3516 | CE2 | TYR | L | 85 | 4526 | 4645 | 4922 | 527 | 267 | −376 | C |
| ATOM | 3517 | CZ | TYR | L | 85 | 25.253 | −14.307 | 37.077 | 1.00 | 34.37 | | C |
| ANISOU | 3517 | CZ | TYR | L | 85 | 4179 | 4271 | 4608 | 576 | 298 | −337 | C |
| ATOM | 3518 | OH | TYR | L | 85 | 26.621 | −14.296 | 36.825 | 1.00 | 42.15 | | O |
| ANISOU | 3518 | OH | TYR | L | 85 | 5131 | 5285 | 5600 | 618 | 312 | −307 | O |
| ATOM | 3519 | N | TYR | L | 86 | 18.869 | −12.342 | 39.744 | 1.00 | 36.15 | | N |
| ANISOU | 3519 | N | TYR | L | 86 | 4447 | 4495 | 4795 | 366 | 221 | −410 | N |
| ATOM | 3520 | CA | TYR | L | 86 | 17.473 | −11.983 | 39.981 | 1.00 | 37.64 | | C |
| ANISOU | 3520 | CA | TYR | L | 86 | 4635 | 4674 | 4991 | 328 | 219 | −429 | C |
| ATOM | 3521 | C | TYR | L | 86 | 17.024 | −11.017 | 38.913 | 1.00 | 38.83 | | C |
| ANISOU | 3521 | C | TYR | L | 86 | 4787 | 4830 | 5136 | 301 | 192 | −486 | C |
| ATOM | 3522 | O | TYR | L | 86 | 17.760 | −10.090 | 38.554 | 1.00 | 35.29 | | O |
| ANISOU | 3522 | O | TYR | L | 86 | 4332 | 4422 | 4655 | 306 | 171 | −501 | O |
| ATOM | 3523 | CB | TYR | L | 86 | 17.274 | −11.321 | 41.355 | 1.00 | 37.69 | | C |
| ANISOU | 3523 | CB | TYR | L | 86 | 4629 | 4731 | 4960 | 326 | 217 | −399 | C |
| ATOM | 3524 | CG | TYR | L | 86 | 17.784 | −12.162 | 42.506 | 1.00 | 45.99 | | C |
| ANISOU | 3524 | CG | TYR | L | 86 | 5682 | 5787 | 6004 | 356 | 239 | −336 | C |
| ATOM | 3525 | CD1 | TYR | L | 86 | 16.935 | −13.000 | 43.206 | 1.00 | 47.06 | | C |
| ANISOU | 3525 | CD1 | TYR | L | 86 | 5824 | 5890 | 6165 | 351 | 271 | −303 | C |
| ATOM | 3526 | CD2 | TYR | L | 86 | 19.121 | −12.123 | 42.868 | 1.00 | 49.75 | | C |
| ANISOU | 3526 | CD2 | TYR | L | 86 | 6151 | 6300 | 6451 | 388 | 225 | −306 | C |
| ATOM | 3527 | CE1 | TYR | L | 86 | 17.414 | −13.781 | 44.279 | 1.00 | 53.31 | | C |
| ANISOU | 3527 | CE1 | TYR | L | 86 | 6622 | 6686 | 6946 | 380 | 291 | −239 | C |
| ATOM | 3528 | CE2 | TYR | L | 86 | 19.609 | −12.885 | 43.916 | 1.00 | 49.10 | | C |
| ANISOU | 3528 | CE2 | TYR | L | 86 | 6071 | 6224 | 6360 | 417 | 239 | −244 | C |
| ATOM | 3529 | CZ | TYR | L | 86 | 18.764 | −13.719 | 44.611 | 1.00 | 59.38 | | C |
| ANISOU | 3529 | CZ | TYR | L | 86 | 7386 | 7493 | 7681 | 414 | 272 | −211 | C |
| ATOM | 3530 | OH | TYR | L | 86 | 19.299 | −14.462 | 45.644 | 1.00 | 66.73 | | O |
| ANISOU | 3530 | OH | TYR | L | 86 | 8322 | 8432 | 8601 | 446 | 284 | −144 | O |
| ATOM | 3531 | N | CYS | L | 87 | 15.811 | −11.211 | 38.432 | 1.00 | 32.04 | | N |
| ANISOU | 3531 | N | CYS | L | 87 | 3932 | 3930 | 4311 | 271 | 190 | −514 | N |
| ATOM | 3532 | CA | CYS | L | 87 | 15.189 | −10.193 | 37.608 | 1.00 | 34.67 | | C |
| ANISOU | 3532 | CA | CYS | L | 87 | 4263 | 4273 | 4638 | 243 | 161 | −561 | C |
| ATOM | 3533 | C | CYS | L | 87 | 14.231 | −9.345 | 38.440 | 1.00 | 36.12 | | C |
| ANISOU | 3533 | C | CYS | L | 87 | 4425 | 4485 | 4815 | 223 | 158 | −557 | C |
| ATOM | 3534 | O | CYS | L | 87 | 13.773 | −9.722 | 39.539 | 1.00 | 36.45 | | O |
| ANISOU | 3534 | O | CYS | L | 87 | 4457 | 4527 | 4866 | 225 | 184 | −522 | O |
| ATOM | 3535 | CB | CYS | L | 87 | 14.455 | −10.814 | 36.423 | 1.00 | 43.73 | | C |
| ANISOU | 3535 | CB | CYS | L | 87 | 5429 | 5361 | 5825 | 222 | 150 | −598 | C |
| ATOM | 3536 | SG | CYS | L | 87 | 13.207 | −12.004 | 36.898 | 1.00 | 45.29 | | S |
| ANISOU | 3536 | SG | CYS | L | 87 | 5622 | 5498 | 6088 | 199 | 170 | −580 | S |
| ATOM | 3537 | N | GLN | L | 88 | 13.912 | −8.185 | 37.895 | 1.00 | 32.53 | | N |
| ANISOU | 3537 | N | GLN | L | 88 | 3964 | 4051 | 4345 | 207 | 129 | −592 | N |
| ATOM | 3538 | CA | GLN | L | 88 | 13.221 | −7.188 | 38.696 | 1.00 | 32.52 | | C |
| ANISOU | 3538 | CA | GLN | L | 88 | 3944 | 4082 | 4329 | 197 | 128 | −590 | C |
| ATOM | 3539 | C | GLN | L | 88 | 12.401 | −6.295 | 37.786 | 1.00 | 32.81 | | C |
| ANISOU | 3539 | C | GLN | L | 88 | 3973 | 4113 | 4379 | 173 | 98 | −632 | C |
| ATOM | 3540 | O | GLN | L | 88 | 12.894 | −5.898 | 36.734 | 1.00 | 36.30 | | O |
| ANISOU | 3540 | O | GLN | L | 88 | 4428 | 4556 | 4807 | 171 | 71 | −658 | O |
| ATOM | 3541 | CB | GLN | L | 88 | 14.237 | −6.365 | 39.472 | 1.00 | 28.43 | | C |
| ANISOU | 3541 | CB | GLN | L | 88 | 3427 | 3617 | 3756 | 217 | 122 | −576 | C |
| ATOM | 3542 | CG | GLN | L | 88 | 13.571 | −5.290 | 40.327 | 1.00 | 32.43 | | C |
| ANISOU | 3542 | CG | GLN | L | 88 | 3925 | 4155 | 4241 | 211 | 122 | −581 | C |
| ATOM | 3543 | CD | GLN | L | 88 | 14.462 | −4.096 | 40.595 | 1.00 | 31.97 | | C |
| ANISOU | 3543 | CD | GLN | L | 88 | 3873 | 4141 | 4132 | 217 | 95 | −590 | C |
| ATOM | 3544 | OE1 | GLN | L | 88 | 15.069 | −3.528 | 39.684 | 1.00 | 34.32 | | O |
| ANISOU | 3544 | OE1 | GLN | L | 88 | 4172 | 4444 | 4424 | 211 | 67 | −612 | O |
| ATOM | 3545 | NE2 | GLN | L | 88 | 14.486 | −3.663 | 41.838 | 1.00 | 35.42 | | N |
| ANISOU | 3545 | NE2 | GLN | L | 88 | 4315 | 4609 | 4532 | 228 | 104 | −575 | N |
| ATOM | 3546 | N | VAL | L | 89 | 11.136 | −6.006 | 38.143 | 1.00 | 33.73 | | N |

TABLE 14-continued

| | | | | | | | | | | | | |
|---|---|---|---|---|---|---|---|---|---|---|---|---|
| ANISOU | 3546 | N | VAL | L | 89 | 4068 | 4223 | 4523 | 157 | 104 | −633 | N |
| ATOM | 3547 | CA | VAL | L | 89 | 10.405 | −5.016 | 37.363 | 1.00 | 31.33 | | C |
| ANISOU | 3547 | CA | VAL | L | 89 | 3754 | 3920 | 4231 | 138 | 71 | −668 | C |
| ATOM | 3548 | C | VAL | L | 89 | 9.710 | −4.061 | 38.313 | 1.00 | 31.26 | | C |
| ANISOU | 3548 | C | VAL | L | 89 | 3724 | 3938 | 4216 | 142 | 85 | −662 | C |
| ATOM | 3549 | O | VAL | L | 89 | 9.347 | −4.421 | 39.431 | 1.00 | 31.77 | | O |
| ANISOU | 3549 | O | VAL | L | 89 | 3779 | 4009 | 4285 | 151 | 124 | −633 | O |
| ATOM | 3550 | CB | VAL | L | 89 | 9.373 | −5.628 | 36.389 | 1.00 | 34.20 | | C |
| ANISOU | 3550 | CB | VAL | L | 89 | 4108 | 4236 | 4651 | 111 | 52 | −686 | C |
| ATOM | 3551 | CG1 | VAL | L | 89 | 10.013 | −6.592 | 35.445 | 1.00 | 34.55 | | C |
| ANISOU | 3551 | CG1 | VAL | L | 89 | 4183 | 4248 | 4697 | 110 | 40 | −698 | C |
| ATOM | 3552 | CG2 | VAL | L | 89 | 8.182 | −6.246 | 37.159 | 1.00 | 32.05 | | C |
| ANISOU | 3552 | CG2 | VAL | L | 89 | 3803 | 3941 | 4433 | 98 | 82 | −660 | C |
| ATOM | 3553 | N | TRP | L | 90 | 9.479 | −2.849 | 37.829 | 1.00 | 30.85 | | N |
| ANISOU | 3553 | N | TRP | L | 90 | 3668 | 3900 | 4154 | 137 | 56 | −689 | N |
| ATOM | 3554 | CA | TRP | L | 90 | 8.613 | −1.900 | 38.513 | 1.00 | 31.99 | | C |
| ANISOU | 3554 | CA | TRP | L | 90 | 3792 | 4058 | 4303 | 142 | 68 | −692 | C |
| ATOM | 3555 | C | TRP | L | 90 | 7.177 | −2.165 | 38.059 | 1.00 | 32.38 | | C |
| ANISOU | 3555 | C | TRP | L | 90 | 3806 | 4077 | 4421 | 123 | 66 | −694 | C |
| ATOM | 3556 | O | TRP | L | 90 | 6.884 | −2.064 | 36.881 | 1.00 | 34.83 | | O |
| ANISOU | 3556 | O | TRP | L | 90 | 4112 | 4367 | 4754 | 105 | 25 | −716 | O |
| ATOM | 3557 | CB | TRP | L | 90 | 9.033 | −0.477 | 38.152 | 1.00 | 28.69 | | C |
| ANISOU | 3557 | CB | TRP | L | 90 | 3387 | 3663 | 3852 | 146 | 36 | −718 | C |
| ATOM | 3558 | CG | TRP | L | 90 | 8.140 | 0.645 | 38.617 | 1.00 | 30.73 | | C |
| ANISOU | 3558 | CG | TRP | L | 90 | 3629 | 3929 | 4119 | 153 | 42 | −729 | C |
| ATOM | 3559 | CD1 | TRP | L | 90 | 7.417 | 1.500 | 37.834 | 1.00 | 31.11 | | C |
| ANISOU | 3559 | CD1 | TRP | L | 90 | 3661 | 3964 | 4194 | 146 | 13 | −750 | C |
| ATOM | 3560 | CD2 | TRP | L | 90 | 7.916 | 1.046 | 39.966 | 1.00 | 35.34 | | C |
| ANISOU | 3560 | CD2 | TRP | L | 90 | 4215 | 4533 | 4680 | 174 | 81 | −719 | C |
| ATOM | 3561 | NE1 | TRP | L | 90 | 6.745 | 2.420 | 38.619 | 1.00 | 30.48 | | N |
| ANISOU | 3561 | NE1 | TRP | L | 90 | 3571 | 3894 | 4117 | 163 | 34 | −754 | N |
| ATOM | 3562 | CE2 | TRP | L | 90 | 7.022 | 2.148 | 39.935 | 1.00 | 35.26 | | C |
| ANISOU | 3562 | CE2 | TRP | L | 90 | 4189 | 4519 | 4689 | 181 | 78 | −737 | C |
| ATOM | 3563 | CE3 | TRP | L | 90 | 8.377 | 0.570 | 41.214 | 1.00 | 35.58 | | C |
| ANISOU | 3563 | CE3 | TRP | L | 90 | 4263 | 4585 | 4672 | 191 | 119 | −695 | C |
| ATOM | 3564 | CZ2 | TRP | L | 90 | 6.605 | 2.809 | 41.104 | 1.00 | 36.22 | | C |
| ANISOU | 3564 | CZ2 | TRP | L | 90 | 4316 | 4657 | 4791 | 206 | 116 | −737 | C |
| ATOM | 3565 | CZ3 | TRP | L | 90 | 7.942 | 1.217 | 42.383 | 1.00 | 36.75 | | C |
| ANISOU | 3565 | CZ3 | TRP | L | 90 | 4418 | 4751 | 4794 | 213 | 153 | −694 | C |
| ATOM | 3566 | CH2 | TRP | L | 90 | 7.084 | 2.330 | 42.319 | 1.00 | 35.19 | | C |
| ANISOU | 3566 | CH2 | TRP | L | 90 | 4209 | 4548 | 4614 | 221 | 154 | −718 | C |
| ATOM | 3567 | N | ASP | L | 91 | 6.299 | −2.497 | 38.970 | 1.00 | 37.03 | | N |
| ANISOU | 3567 | N | ASP | L | 91 | 4368 | 4663 | 5040 | 126 | 108 | −669 | N |
| ATOM | 3568 | CA | ASP | L | 91 | 4.883 | −2.660 | 38.588 | 1.00 | 36.42 | | C |
| ANISOU | 3568 | CA | ASP | L | 91 | 4244 | 4558 | 5037 | 107 | 105 | −667 | C |
| ATOM | 3569 | C | ASP | L | 91 | 4.254 | −1.278 | 38.661 | 1.00 | 32.91 | | C |
| ANISOU | 3569 | C | ASP | L | 91 | 3780 | 4130 | 4593 | 119 | 99 | −683 | C |
| ATOM | 3570 | O | ASP | L | 91 | 3.959 | −0.784 | 39.741 | 1.00 | 35.14 | | O |
| ANISOU | 3570 | O | ASP | L | 91 | 4055 | 4434 | 4862 | 142 | 143 | −671 | O |
| ATOM | 3571 | CB | ASP | L | 91 | 4.208 | −3.649 | 39.514 | 1.00 | 36.30 | | C |
| ANISOU | 3571 | CB | ASP | L | 91 | 4202 | 4530 | 5062 | 104 | 159 | −627 | C |
| ATOM | 3572 | CG | ASP | L | 91 | 2.751 | −3.911 | 39.123 | 1.00 | 50.24 | | C |
| ANISOU | 3572 | CG | ASP | L | 91 | 5910 | 6264 | 6915 | 79 | 155 | −619 | C |
| ATOM | 3573 | OD1 | ASP | L | 91 | 2.221 | −3.193 | 38.248 | 1.00 | 45.11 | | O |
| ANISOU | 3573 | OD1 | ASP | L | 91 | 5241 | 5609 | 6291 | 68 | 110 | −644 | O |
| ATOM | 3574 | OD2 | ASP | L | 91 | 2.174 | −4.821 | 39.730 | 1.00 | 69.72 | | O |
| ANISOU | 3574 | OD2 | ASP | L | 91 | 8350 | 8713 | 9426 | 70 | 197 | −582 | O |
| ATOM | 3575 | N | TYR | L | 92 | 4.178 | −0.591 | 37.525 | 1.00 | 31.05 | | N |
| ANISOU | 3575 | N | TYR | L | 92 | 3545 | 3888 | 4366 | 108 | 44 | −712 | N |
| ATOM | 3576 | CA | TYR | L | 92 | 3.673 | 0.766 | 37.552 | 1.00 | 36.08 | | C |
| ANISOU | 3576 | CA | TYR | L | 92 | 4167 | 4536 | 5003 | 123 | 36 | −726 | C |
| ATOM | 3577 | C | TYR | L | 92 | 2.175 | 0.815 | 37.851 | 1.00 | 48.02 | | C |
| ANISOU | 3577 | C | TYR | L | 92 | 5620 | 6037 | 6588 | 124 | 60 | −710 | C |
| ATOM | 3578 | O | TYR | L | 92 | 1.636 | 1.899 | 38.092 | 1.00 | 46.03 | | O |
| ANISOU | 3578 | O | TYR | L | 92 | 5351 | 5794 | 6344 | 145 | 67 | −716 | O |
| ATOM | 3579 | CB | TYR | L | 92 | 3.970 | 1.438 | 36.209 | 1.00 | 34.55 | | C |
| ANISOU | 3579 | CB | TYR | L | 92 | 3991 | 4337 | 4801 | 112 | −29 | −754 | C |
| ATOM | 3580 | CG | TYR | L | 92 | 3.899 | 0.509 | 35.011 | 1.00 | 41.33 | | C |
| ANISOU | 3580 | CG | TYR | L | 92 | 4850 | 5167 | 5684 | 82 | −72 | −761 | C |
| ATOM | 3581 | CD1 | TYR | L | 92 | 2.672 | −0.002 | 34.568 | 1.00 | 43.48 | | C |
| ANISOU | 3581 | CD1 | TYR | L | 92 | 5078 | 5413 | 6028 | 60 | −91 | −754 | C |
| ATOM | 3582 | CD2 | TYR | L | 92 | 5.058 | 0.158 | 34.304 | 1.00 | 51.31 | | C |
| ANISOU | 3582 | CD2 | TYR | L | 92 | 6162 | 6432 | 6901 | 76 | −96 | −774 | C |
| ATOM | 3583 | CE1 | TYR | L | 92 | 2.598 | −0.857 | 33.480 | 1.00 | 48.08 | | C |
| ANISOU | 3583 | CE1 | TYR | L | 92 | 5671 | 5967 | 6631 | 30 | −137 | −766 | C |
| ATOM | 3584 | CE2 | TYR | L | 92 | 5.001 | −0.694 | 33.201 | 1.00 | 56.45 | | C |
| ANISOU | 3584 | CE2 | TYR | L | 92 | 6824 | 7055 | 7567 | 52 | −133 | −785 | C |
| ATOM | 3585 | CZ | TYR | L | 92 | 3.765 | −1.200 | 32.792 | 1.00 | 49.52 | | C |
| ANISOU | 3585 | CZ | TYR | L | 92 | 5910 | 6149 | 6757 | 28 | −157 | −784 | C |
| ATOM | 3586 | OH | TYR | L | 92 | 3.697 | −2.044 | 31.705 | 1.00 | 47.39 | | O |

TABLE 14-continued

| | | | | | | | | | | | | |
|---|---|---|---|---|---|---|---|---|---|---|---|---|
| ANISOU | 3586 | OH | TYR | L | 92 | 5659 | 5848 | 6498 | 3 | −200 | −801 | O |
| ATOM | 3587 | N | ARG | L | 93 | 1.500 | −0.329 | 37.861 | 1.00 | 46.07 | | N |
| ANISOU | 3587 | N | ARG | L | 93 | 5339 | 5768 | 6399 | 103 | 73 | −686 | N |
| ATOM | 3588 | CA | ARG | L | 93 | 0.076 | −0.330 | 38.181 | 1.00 | 42.05 | | C |
| ANISOU | 3588 | CA | ARG | L | 93 | 4762 | 5248 | 5967 | 101 | 100 | −663 | C |
| ATOM | 3589 | C | ARG | L | 93 | −0.131 | −0.086 | 39.662 | 1.00 | 46.34 | | C |
| ANISOU | 3589 | C | ARG | L | 93 | 5299 | 5815 | 6492 | 136 | 181 | −639 | C |
| ATOM | 3590 | O | ARG | L | 93 | −0.811 | 0.872 | 40.051 | 1.00 | 49.32 | | O |
| ANISOU | 3590 | O | ARG | L | 93 | 5651 | 6204 | 6884 | 162 | 206 | −640 | O |
| ATOM | 3591 | CB | ARG | L | 93 | −0.563 | −1.653 | 37.767 | 1.00 | 38.62 | | C |
| ANISOU | 3591 | CB | ARG | L | 93 | 4291 | 4778 | 5604 | 62 | 88 | −642 | C |
| ATOM | 3592 | CG | ARG | L | 93 | −2.110 | −1.530 | 37.658 | 1.00 | 54.87 | | C |
| ANISOU | 3592 | CG | ARG | L | 93 | 6266 | 6821 | 7760 | 51 | 89 | −621 | C |
| ATOM | 3593 | CD | ARG | L | 93 | −2.764 | −2.835 | 37.273 | 1.00 | 58.48 | | C |
| ANISOU | 3593 | CD | ARG | L | 93 | 6685 | 7240 | 8297 | 6 | 72 | −600 | C |
| ATOM | 3594 | NE | ARG | L | 93 | −2.498 | −3.875 | 38.263 | 1.00 | 68.09 | | N |
| ANISOU | 3594 | NE | ARG | L | 93 | 7910 | 8452 | 9509 | 5 | 138 | −567 | N |
| ATOM | 3595 | CZ | ARG | L | 93 | −3.152 | −3.999 | 39.411 | 1.00 | 66.17 | | C |
| ANISOU | 3595 | CZ | ARG | L | 93 | 7625 | 8219 | 9298 | 21 | 216 | −524 | C |
| ATOM | 3596 | NH1 | ARG | L | 93 | −4.126 | −3.143 | 39.717 | 1.00 | 63.48 | | N |
| ANISOU | 3596 | NH1 | ARG | L | 93 | 7228 | 7895 | 8999 | 41 | 242 | −511 | N |
| ATOM | 3597 | NH2 | ARG | L | 93 | −2.828 | −4.977 | 40.255 | 1.00 | 65.83 | | N |
| ANISOU | 3597 | NH2 | ARG | L | 93 | 7598 | 8170 | 9243 | 20 | 272 | −490 | N |
| ATOM | 3598 | N | THR | L | 94 | 0.508 | −0.908 | 40.496 | 1.00 | 45.08 | | N |
| ANISOU | 3598 | N | THR | L | 94 | 5170 | 5665 | 6295 | 140 | 224 | −618 | N |
| ATOM | 3599 | CA | THR | L | 94 | 0.430 | −0.848 | 41.947 | 1.00 | 46.23 | | C |
| ANISOU | 3599 | CA | THR | L | 94 | 5322 | 5836 | 6408 | 172 | 303 | −592 | C |
| ATOM | 3600 | C | THR | L | 94 | 1.568 | −0.055 | 42.582 | 1.00 | 47.19 | | C |
| ANISOU | 3600 | C | THR | L | 94 | 5511 | 5991 | 6430 | 202 | 307 | −614 | C |
| ATOM | 3601 | O | THR | L | 94 | 1.587 | 0.097 | 43.802 | 1.00 | 50.11 | | O |
| ANISOU | 3601 | O | THR | L | 94 | 5898 | 6384 | 6757 | 232 | 367 | −599 | O |
| ATOM | 3602 | CB | THR | L | 94 | 0.437 | −2.272 | 42.534 | 1.00 | 46.32 | | C |
| ANISOU | 3602 | CB | THR | L | 94 | 5328 | 5835 | 6436 | 158 | 345 | −548 | C |
| ATOM | 3603 | OG1 | THR | L | 94 | 1.695 | −2.909 | 42.259 | 1.00 | 53.61 | | O |
| ANISOU | 3603 | OG1 | THR | L | 94 | 6304 | 6756 | 7309 | 148 | 314 | −556 | O |
| ATOM | 3604 | CG2 | THR | L | 94 | −0.659 | −3.113 | 41.908 | 1.00 | 61.11 | | C |
| ANISOU | 3604 | CG2 | THR | L | 94 | 7135 | 7669 | 8414 | 121 | 335 | −526 | C |
| ATOM | 3605 | N | LEU | L | 95 | 2.560 | 0.379 | 41.803 | 1.00 | 47.67 | | N |
| ANISOU | 3605 | N | LEU | L | 95 | 5609 | 6053 | 6450 | 194 | 246 | −648 | N |
| ATOM | 3606 | CA | LEU | L | 95 | 3.679 | 1.156 | 42.325 | 1.00 | 46.76 | | C |
| ANISOU | 3606 | CA | LEU | L | 95 | 5552 | 5967 | 6249 | 216 | 240 | −669 | C |
| ATOM | 3607 | C | LEU | L | 95 | 4.494 | 0.332 | 43.328 | 1.00 | 42.30 | | C |
| ANISOU | 3607 | C | LEU | L | 95 | 5022 | 5421 | 5630 | 225 | 274 | −643 | C |
| ATOM | 3608 | O | LEU | L | 95 | 4.815 | 0.784 | 44.422 | 1.00 | 39.63 | | O |
| ANISOU | 3608 | O | LEU | L | 95 | 4717 | 5110 | 5231 | 252 | 306 | −642 | O |
| ATOM | 3609 | CB | LEU | L | 95 | 3.201 | 2.475 | 42.941 | 1.00 | 47.63 | | C |
| ANISOU | 3609 | CB | LEU | L | 95 | 5666 | 6089 | 6341 | 247 | 264 | −688 | C |
| ATOM | 3610 | CG | LEU | L | 95 | 2.291 | 3.412 | 42.127 | 1.00 | 49.70 | | C |
| ANISOU | 3610 | CG | LEU | L | 95 | 5891 | 6333 | 6659 | 248 | 238 | −708 | C |
| ATOM | 3611 | CD1 | LEU | L | 95 | 1.944 | 4.632 | 42.948 | 1.00 | 53.05 | | C |
| ANISOU | 3611 | CD1 | LEU | L | 95 | 6330 | 6768 | 7058 | 288 | 272 | −726 | C |
| ATOM | 3612 | CD2 | LEU | L | 95 | 2.913 | 3.846 | 40.793 | 1.00 | 48.25 | | C |
| ANISOU | 3612 | CD2 | LEU | L | 95 | 5720 | 6137 | 6474 | 225 | 160 | −736 | C |
| ATOM | 3613 | N | ASP | L | 96 | 4.841 | −0.893 | 42.925 | 1.00 | 42.23 | | N |
| ANISOU | 3613 | N | ASP | L | 96 | 5008 | 5395 | 5641 | 203 | 264 | −622 | N |
| ATOM | 3614 | CA | ASP | L | 96 | 5.599 | −1.856 | 43.712 | 1.00 | 35.57 | | C |
| ANISOU | 3614 | CA | ASP | L | 96 | 4193 | 4563 | 4759 | 210 | 291 | −590 | C |
| ATOM | 3615 | C | ASP | L | 96 | 6.774 | −2.337 | 42.872 | 1.00 | 33.64 | | C |
| ANISOU | 3615 | C | ASP | L | 96 | 3972 | 4311 | 4500 | 195 | 242 | −601 | C |
| ATOM | 3616 | O | ASP | L | 96 | 6.631 | −2.519 | 41.661 | 1.00 | 31.51 | | O |
| ANISOU | 3616 | O | ASP | L | 96 | 3686 | 4013 | 4272 | 172 | 203 | −619 | O |
| ATOM | 3617 | CB | ASP | L | 96 | 4.772 | −3.122 | 44.063 | 1.00 | 44.76 | | C |
| ANISOU | 3617 | CB | ASP | L | 96 | 5323 | 5703 | 5980 | 200 | 339 | −545 | C |
| ATOM | 3618 | CG | ASP | L | 96 | 3.691 | −2.868 | 45.071 | 1.00 | 60.09 | | C |
| ANISOU | 3618 | CG | ASP | L | 96 | 7240 | 7656 | 7934 | 219 | 406 | −521 | C |
| ATOM | 3619 | OD1 | ASP | L | 96 | 3.890 | −2.086 | 46.023 | 1.00 | 68.07 | | O |
| ANISOU | 3619 | OD1 | ASP | L | 96 | 8282 | 8700 | 8880 | 251 | 433 | −526 | O |
| ATOM | 3620 | OD2 | ASP | L | 96 | 2.622 | −3.459 | 44.903 | 1.00 | 71.16 | | O |
| ANISOU | 3620 | OD2 | ASP | L | 96 | 8592 | 9032 | 9414 | 202 | 431 | −496 | O |
| ATOM | 3621 | N | TRP | L | 97 | 7.901 | −2.597 | 43.523 | 1.00 | 36.75 | | N |
| ANISOU | 3621 | N | TRP | L | 97 | 4402 | 4728 | 4834 | 210 | 245 | −586 | N |
| ATOM | 3622 | CA | TRP | L | 97 | 9.025 | −3.305 | 42.901 | 1.00 | 31.40 | | C |
| ANISOU | 3622 | CA | TRP | L | 97 | 3741 | 4042 | 4147 | 202 | 213 | −583 | C |
| ATOM | 3623 | C | TRP | L | 97 | 8.808 | −4.798 | 43.089 | 1.00 | 32.76 | | C |
| ANISOU | 3623 | C | TRP | L | 97 | 3903 | 4186 | 4357 | 197 | 245 | −544 | C |
| ATOM | 3624 | O | TRP | L | 97 | 8.503 | −5.237 | 44.193 | 1.00 | 37.89 | | O |
| ANISOU | 3624 | O | TRP | L | 97 | 4555 | 4845 | 4997 | 211 | 292 | −506 | O |
| ATOM | 3625 | CB | TRP | L | 97 | 10.354 | −2.903 | 43.533 | 1.00 | 33.05 | | C |
| ANISOU | 3625 | CB | TRP | L | 97 | 3985 | 4289 | 4283 | 221 | 198 | −581 | C |
| ATOM | 3626 | CG | TRP | L | 97 | 10.917 | −1.665 | 42.959 | 1.00 | 34.83 | | C |

TABLE 14-continued

| | | | | | | | | | | | | |
|---|---|---|---|---|---|---|---|---|---|---|---|---|
| ANISOU | 3626 | CG | TRP | L | 97 | 4221 | 4531 | 4484 | 216 | 152 | −620 | C |
| ATOM | 3627 | CD1 | TRP | L | 97 | 10.975 | −0.449 | 43.548 | 1.00 | 32.32 | | C |
| ANISOU | 3627 | CD1 | TRP | L | 97 | 3919 | 4237 | 4123 | 226 | 144 | −640 | C |
| ATOM | 3628 | CD2 | TRP | L | 97 | 11.444 | −1.503 | 41.635 | 1.00 | 33.58 | | C |
| ANISOU | 3628 | CD2 | TRP | L | 97 | 4059 | 4358 | 4342 | 200 | 110 | −643 | C |
| ATOM | 3629 | NE1 | TRP | L | 97 | 11.501 | 0.474 | 42.679 | 1.00 | 32.89 | | N |
| ANISOU | 3629 | NE1 | TRP | L | 97 | 3994 | 4310 | 4191 | 214 | 98 | −672 | N |
| ATOM | 3630 | CE2 | TRP | L | 97 | 11.802 | −0.148 | 41.492 | 1.00 | 29.20 | | C |
| ANISOU | 3630 | CE2 | TRP | L | 97 | 3515 | 3823 | 3759 | 199 | 79 | −672 | C |
| ATOM | 3631 | CE3 | TRP | L | 97 | 11.662 | −2.377 | 40.564 | 1.00 | 29.87 | | C |
| ANISOU | 3631 | CE3 | TRP | L | 97 | 3582 | 3861 | 3906 | 189 | 98 | −642 | C |
| ATOM | 3632 | CZ2 | TRP | L | 97 | 12.422 | 0.351 | 40.335 | 1.00 | 34.81 | | C |
| ANISOU | 3632 | CZ2 | TRP | L | 97 | 4226 | 4528 | 4472 | 185 | 38 | −692 | C |
| ATOM | 3633 | CZ3 | TRP | L | 97 | 12.272 | −1.878 | 39.405 | 1.00 | 30.22 | | C |
| ANISOU | 3633 | CZ3 | TRP | L | 97 | 3632 | 3903 | 3947 | 179 | 60 | −667 | C |
| ATOM | 3634 | CH2 | TRP | L | 97 | 12.654 | −0.538 | 39.307 | 1.00 | 31.91 | | C |
| ANISOU | 3634 | CH2 | TRP | L | 97 | 3853 | 4140 | 4132 | 177 | 32 | −688 | C |
| ATOM | 3635 | N | VAL | L | 98 | 8.934 | −5.573 | 42.015 | 1.00 | 34.25 | | N |
| ANISOU | 3635 | N | VAL | L | 98 | 4087 | 4338 | 4589 | 178 | 221 | −551 | N |
| ATOM | 3636 | CA | VAL | L | 98 | 8.835 | −7.031 | 42.093 | 1.00 | 38.12 | | C |
| ANISOU | 3636 | CA | VAL | L | 98 | 4574 | 4791 | 5118 | 172 | 246 | −517 | C |
| ATOM | 3637 | C | VAL | L | 98 | 10.169 | −7.650 | 41.707 | 1.00 | 41.17 | | C |
| ANISOU | 3637 | C | VAL | L | 98 | 4989 | 5173 | 5481 | 184 | 227 | −514 | C |
| ATOM | 3638 | O | VAL | L | 98 | 10.802 | −7.210 | 40.744 | 1.00 | 44.12 | | O |
| ANISOU | 3638 | O | VAL | L | 98 | 5374 | 5550 | 5841 | 181 | 188 | −548 | O |
| ATOM | 3639 | CB | VAL | L | 98 | 7.741 | −7.562 | 41.143 | 1.00 | 43.31 | | C |
| ANISOU | 3639 | CB | VAL | L | 98 | 5203 | 5398 | 5855 | 139 | 234 | −530 | C |
| ATOM | 3640 | CG1 | VAL | L | 98 | 7.448 | −9.022 | 41.403 | 1.00 | 45.32 | | C |
| ANISOU | 3640 | CG1 | VAL | L | 98 | 5452 | 5608 | 6159 | 129 | 265 | −491 | C |
| ATOM | 3641 | CG2 | VAL | L | 98 | 6.511 | −6.681 | 41.187 | 1.00 | 41.05 | | C |
| ANISOU | 3641 | CG2 | VAL | L | 98 | 4881 | 5120 | 5598 | 128 | 238 | −542 | C |
| ATOM | 3642 | N | PHE | L | 99 | 10.568 | −8.697 | 42.419 | 1.00 | 38.39 | | N |
| ANISOU | 3642 | N | PHE | L | 99 | 4648 | 4812 | 5128 | 198 | 257 | −470 | N |
| ATOM | 3643 | CA | PHE | L | 99 | 11.752 | −9.491 | 42.108 | 1.00 | 35.81 | | C |
| ANISOU | 3643 | CA | PHE | L | 99 | 4343 | 4473 | 4791 | 214 | 248 | −459 | C |
| ATOM | 3644 | C | PHE | L | 99 | 11.350 | −10.916 | 41.746 | 1.00 | 43.16 | | C |
| ANISOU | 3644 | C | PHE | L | 99 | 5274 | 5340 | 5786 | 203 | 266 | −441 | C |
| ATOM | 3645 | O | PHE | L | 99 | 10.394 | −11.464 | 42.300 | 1.00 | 39.47 | | O |
| ANISOU | 3645 | O | PHE | L | 99 | 4790 | 4848 | 5358 | 189 | 298 | −412 | O |
| ATOM | 3646 | CB | PHE | L | 99 | 12.727 | −9.571 | 43.304 | 1.00 | 33.97 | | C |
| ANISOU | 3646 | CB | PHE | L | 99 | 4126 | 4280 | 4502 | 247 | 263 | −416 | C |
| ATOM | 3647 | CG | PHE | L | 99 | 13.474 | −8.322 | 43.581 | 1.00 | 36.44 | | C |
| ANISOU | 3647 | CG | PHE | L | 99 | 4446 | 4650 | 4751 | 258 | 234 | −435 | C |
| ATOM | 3648 | CD1 | PHE | L | 99 | 14.683 | −8.041 | 42.915 | 1.00 | 37.03 | | C |
| ANISOU | 3648 | CD1 | PHE | L | 99 | 4526 | 4738 | 4805 | 267 | 199 | −451 | C |
| ATOM | 3649 | CD2 | PHE | L | 99 | 13.035 | −7.449 | 44.556 | 1.00 | 37.26 | | C |
| ANISOU | 3649 | CD2 | PHE | L | 99 | 4553 | 4791 | 4815 | 262 | 245 | −433 | C |
| ATOM | 3650 | CE1 | PHE | L | 99 | 15.383 | −6.890 | 43.184 | 1.00 | 37.31 | | C |
| ANISOU | 3650 | CE1 | PHE | L | 99 | 4565 | 4822 | 4790 | 272 | 169 | −465 | C |
| ATOM | 3651 | CE2 | PHE | L | 99 | 13.726 | −6.285 | 44.822 | 1.00 | 40.22 | | C |
| ANISOU | 3651 | CE2 | PHE | L | 99 | 4938 | 5211 | 5132 | 269 | 213 | −454 | C |
| ATOM | 3652 | CZ | PHE | L | 99 | 14.901 | −6.004 | 44.153 | 1.00 | 39.01 | | C |
| ANISOU | 3652 | CZ | PHE | L | 99 | 4786 | 5070 | 4966 | 271 | 173 | −468 | C |
| ATOM | 3653 | N | GLY | L | 100 | 12.103 | −11.531 | 40.834 | 1.00 | 41.87 | | N |
| ANISOU | 3653 | N | GLY | L | 100 | 5129 | 5146 | 5633 | 208 | 248 | −457 | N |
| ATOM | 3654 | CA | GLY | L | 100 | 12.009 | −12.967 | 40.675 | 1.00 | 36.94 | | C |
| ANISOU | 3654 | CA | GLY | L | 100 | 4516 | 4460 | 5062 | 206 | 267 | −435 | C |
| ATOM | 3655 | C | GLY | L | 100 | 12.662 | −13.635 | 41.865 | 1.00 | 41.68 | | C |
| ANISOU | 3655 | C | GLY | L | 100 | 5123 | 5071 | 5642 | 238 | 302 | −373 | C |
| ATOM | 3656 | O | GLY | L | 100 | 13.352 | −12.997 | 42.661 | 1.00 | 47.22 | | O |
| ANISOU | 3656 | O | GLY | L | 100 | 5826 | 5830 | 6285 | 262 | 302 | −354 | O |
| ATOM | 3657 | N | CYS | L | 101 | 12.451 | −14.938 | 42.022 | 1.00 | 44.51 | | N |
| ANISOU | 3657 | N | CYS | L | 101 | 5490 | 5372 | 6051 | 237 | 328 | −340 | N |
| ATOM | 3658 | CA | CYS | L | 101 | 13.041 | −15.618 | 43.177 | 1.00 | 45.10 | | C |
| ANISOU | 3658 | CA | CYS | L | 101 | 5573 | 5455 | 6108 | 269 | 361 | −273 | C |
| ATOM | 3659 | C | CYS | L | 101 | 14.452 | −16.105 | 42.900 | 1.00 | 43.00 | | C |
| ANISOU | 3659 | C | CYS | L | 101 | 5328 | 5186 | 5825 | 307 | 351 | −265 | C |
| ATOM | 3660 | O | CYS | L | 101 | 15.057 | −16.776 | 43.743 | 1.00 | 45.31 | | O |
| ANISOU | 3660 | O | CYS | L | 101 | 5628 | 5480 | 6108 | 338 | 373 | −208 | O |
| ATOM | 3661 | CB | CYS | L | 101 | 12.158 | −16.780 | 43.630 | 1.00 | 69.59 | | C |
| ANISOU | 3661 | CB | CYS | L | 101 | 8672 | 8496 | 9274 | 252 | 399 | −229 | C |
| ATOM | 3662 | SG | CYS | L | 101 | 10.739 | −16.192 | 44.675 | 1.00 | 94.82 | | S |
| ANISOU | 3662 | SG | CYS | L | 101 | 11835 | 11722 | 12470 | 226 | 435 | −201 | S |
| ATOM | 3663 | N | GLY | L | 102 | 14.994 | −15.772 | 41.746 | 1.00 | 40.36 | | N |
| ANISOU | 3663 | N | GLY | L | 102 | 5001 | 4849 | 5486 | 310 | 322 | −317 | N |
| ATOM | 3664 | CA | GLY | L | 102 | 16.398 | −16.035 | 41.550 | 1.00 | 48.54 | | C |
| ANISOU | 3664 | CA | GLY | L | 102 | 6047 | 5895 | 6501 | 351 | 318 | −306 | C |
| ATOM | 3665 | C | GLY | L | 102 | 16.654 | −17.344 | 40.834 | 1.00 | 47.00 | | C |
| ANISOU | 3665 | C | GLY | L | 102 | 5876 | 5622 | 6358 | 366 | 333 | −307 | C |
| ATOM | 3666 | O | GLY | L | 102 | 15.845 | −18.278 | 40.836 | 1.00 | 46.50 | | O |

TABLE 14-continued

| | | | | | | | | | | | | |
|---|---|---|---|---|---|---|---|---|---|---|---|---|
| ANISOU | 3666 | O | GLY | L | 102 | 5825 | 5494 | 6350 | 347 | 351 | −298 | O |
| ATOM | 3667 | N | THR | L | 103 | 17.805 | −17.376 | 40.179 | 1.00 | 39.17 | | N |
| ANISOU | 3667 | N | THR | L | 103 | 4893 | 4636 | 5352 | 400 | 327 | −321 | N |
| ATOM | 3668 | CA | THR | L | 103 | 18.257 | −18.514 | 39.396 | 1.00 | 42.81 | | C |
| ANISOU | 3668 | CA | THR | L | 103 | 5383 | 5028 | 5855 | 425 | 344 | −330 | C |
| ATOM | 3669 | C | THR | L | 103 | 19.712 | −18.713 | 39.764 | 1.00 | 41.12 | | C |
| ANISOU | 3669 | C | THR | L | 103 | 5159 | 4844 | 5621 | 481 | 356 | −287 | C |
| ATOM | 3670 | O | THR | L | 103 | 20.505 | −17.774 | 39.634 | 1.00 | 39.09 | | O |
| ANISOU | 3670 | O | THR | L | 103 | 4880 | 4651 | 5320 | 494 | 338 | −295 | O |
| ATOM | 3671 | CB | THR | L | 103 | 18.159 | −18.248 | 37.895 | 1.00 | 42.81 | | C |
| ANISOU | 3671 | CB | THR | L | 103 | 5405 | 5004 | 5855 | 411 | 327 | −404 | C |
| ATOM | 3672 | OG1 | THR | L | 103 | 16.794 | −18.162 | 37.477 | 1.00 | 46.83 | | O |
| ANISOU | 3672 | OG1 | THR | L | 103 | 5923 | 5479 | 6391 | 358 | 309 | −444 | O |
| ATOM | 3673 | CG2 | THR | L | 103 | 18.895 | −19.371 | 37.092 | 1.00 | 39.71 | | C |
| ANISOU | 3673 | CG2 | THR | L | 103 | 5049 | 4545 | 5492 | 451 | 350 | −416 | C |
| ATOM | 3674 | N | LYS | L | 104 | 20.057 | −19.893 | 40.263 | 1.00 | 42.99 | | N |
| ANISOU | 3674 | N | LYS | L | 104 | 5407 | 5036 | 5893 | 514 | 383 | −237 | N |
| ATOM | 3675 | CA | LYS | L | 104 | 21.456 | −20.159 | 40.550 | 1.00 | 48.37 | | C |
| ANISOU | 3675 | CA | LYS | L | 104 | 6073 | 5740 | 6564 | 572 | 393 | −193 | C |
| ATOM | 3676 | C | LYS | L | 104 | 22.138 | −20.555 | 39.258 | 1.00 | 46.62 | | C |
| ANISOU | 3676 | C | LYS | L | 104 | 5871 | 5478 | 6362 | 603 | 407 | −234 | C |
| ATOM | 3677 | O | LYS | L | 104 | 21.665 | −21.443 | 38.546 | 1.00 | 46.20 | | O |
| ANISOU | 3677 | O | LYS | L | 104 | 5859 | 5344 | 6353 | 599 | 425 | −266 | O |
| ATOM | 3678 | CB | LYS | L | 104 | 21.625 | −21.272 | 41.586 | 1.00 | 53.50 | | C |
| ANISOU | 3678 | CB | LYS | L | 104 | 6726 | 6357 | 7243 | 602 | 417 | −117 | C |
| ATOM | 3679 | CG | LYS | L | 104 | 23.025 | −21.271 | 42.166 | 1.00 | 61.87 | | C |
| ANISOU | 3679 | CG | LYS | L | 104 | 7759 | 7466 | 8284 | 658 | 413 | −59 | C |
| ATOM | 3680 | CD | LYS | L | 104 | 23.550 | −22.633 | 42.572 | 1.00 | 71.66 | | C |
| ANISOU | 3680 | CD | LYS | L | 104 | 9010 | 8648 | 9570 | 709 | 444 | 2 | C |
| ATOM | 3681 | CE | LYS | L | 104 | 25.050 | −22.513 | 42.947 | 1.00 | 76.74 | | C |
| ANISOU | 3681 | CE | LYS | L | 104 | 9615 | 9346 | 10196 | 768 | 434 | 54 | C |
| ATOM | 3682 | NZ | LYS | L | 104 | 25.841 | −21.664 | 41.989 | 1.00 | 75.33 | | N |
| ANISOU | 3682 | NZ | LYS | L | 104 | 9411 | 9211 | 9998 | 777 | 421 | 7 | N |
| ATOM | 3683 | N | LEU | L | 105 | 23.226 | −19.890 | 38.931 | 1.00 | 44.84 | | N |
| ANISOU | 3683 | N | LEU | L | 105 | 5620 | 5309 | 6106 | 632 | 400 | −236 | N |
| ATOM | 3684 | CA | LEU | L | 105 | 24.010 | −20.260 | 37.767 | 1.00 | 46.34 | | C |
| ANISOU | 3684 | CA | LEU | L | 105 | 5828 | 5469 | 6311 | 671 | 424 | −267 | C |
| ATOM | 3685 | C | LEU | L | 105 | 25.214 | −21.070 | 38.239 | 1.00 | 53.97 | | C |
| ANISOU | 3685 | C | LEU | L | 105 | 6774 | 6428 | 7303 | 739 | 451 | −203 | C |
| ATOM | 3686 | O | LEU | L | 105 | 26.059 | −20.552 | 38.978 | 1.00 | 54.07 | | O |
| ANISOU | 3686 | O | LEU | L | 105 | 6738 | 6510 | 7294 | 759 | 435 | −153 | O |
| ATOM | 3687 | CB | LEU | L | 105 | 24.463 | −19.024 | 36.998 | 1.00 | 42.61 | | C |
| ANISOU | 3687 | CB | LEU | L | 105 | 5336 | 5060 | 5795 | 662 | 407 | −307 | C |
| ATOM | 3688 | CG | LEU | L | 105 | 25.402 | −19.318 | 35.813 | 1.00 | 50.66 | | C |
| ANISOU | 3688 | CG | LEU | L | 105 | 6369 | 6059 | 6822 | 709 | 440 | −332 | C |
| ATOM | 3689 | CD1 | LEU | L | 105 | 24.596 | −20.016 | 34.725 | 1.00 | 55.30 | | C |
| ANISOU | 3689 | CD1 | LEU | L | 105 | 7023 | 6562 | 7427 | 696 | 456 | −398 | C |
| ATOM | 3690 | CD2 | LEU | L | 105 | 26.051 | −18.057 | 35.284 | 1.00 | 51.14 | | C |
| ANISOU | 3690 | CD2 | LEU | L | 105 | 6397 | 6194 | 6841 | 704 | 427 | −347 | C |
| ATOM | 3691 | N | THR | L | 106 | 25.277 | −22.341 | 37.839 | 1.00 | 57.82 | | N |
| ANISOU | 3691 | N | THR | L | 106 | 7300 | 6829 | 7840 | 773 | 487 | −204 | N |
| ATOM | 3692 | CA | THR | L | 106 | 26.442 | −23.182 | 38.099 | 1.00 | 59.43 | | C |
| ANISOU | 3692 | CA | THR | L | 106 | 7488 | 7015 | 8076 | 846 | 519 | −148 | C |
| ATOM | 3693 | C | THR | L | 106 | 27.267 | −23.300 | 36.825 | 1.00 | 57.87 | | C |
| ANISOU | 3693 | C | THR | L | 106 | 7303 | 6799 | 7885 | 892 | 553 | −189 | C |
| ATOM | 3694 | O | THR | L | 106 | 26.728 | −23.567 | 35.746 | 1.00 | 53.94 | | O |
| ANISOU | 3694 | O | THR | L | 106 | 6861 | 6243 | 7390 | 879 | 568 | −259 | O |
| ATOM | 3695 | CB | THR | L | 106 | 26.040 | −24.576 | 38.585 | 1.00 | 63.33 | | C |
| ANISOU | 3695 | CB | THR | L | 106 | 8017 | 7419 | 8625 | 863 | 543 | −114 | C |
| ATOM | 3696 | OG1 | THR | L | 106 | 24.994 | −25.079 | 37.748 | 1.00 | 67.09 | | O |
| ANISOU | 3696 | OG1 | THR | L | 106 | 8554 | 7811 | 9125 | 827 | 551 | −181 | O |
| ATOM | 3697 | CG2 | THR | L | 106 | 25.561 | −24.533 | 40.009 | 1.00 | 55.79 | | C |
| ANISOU | 3697 | CG2 | THR | L | 106 | 7041 | 6494 | 7664 | 838 | 520 | −49 | C |
| ATOM | 3698 | N | VAL | L | 107 | 28.565 | −23.062 | 36.943 | 1.00 | 53.84 | | N |
| ANISOU | 3698 | N | VAL | L | 107 | 6742 | 6342 | 7374 | 944 | 564 | −145 | N |
| ATOM | 3699 | CA | VAL | L | 107 | 29.477 | −23.200 | 35.825 | 1.00 | 51.66 | | C |
| ANISOU | 3699 | CA | VAL | L | 107 | 6469 | 6053 | 7105 | 998 | 608 | −170 | C |
| ATOM | 3700 | C | VAL | L | 107 | 30.174 | −24.539 | 35.993 | 1.00 | 55.99 | | C |
| ANISOU | 3700 | C | VAL | L | 107 | 7026 | 6536 | 7713 | 1074 | 654 | −125 | C |
| ATOM | 3701 | O | VAL | L | 107 | 30.849 | −24.775 | 37.001 | 1.00 | 53.66 | | O |
| ANISOU | 3701 | O | VAL | L | 107 | 6680 | 6269 | 7440 | 1108 | 646 | −45 | O |
| ATOM | 3702 | CB | VAL | L | 107 | 30.477 | −22.038 | 35.779 | 1.00 | 49.85 | | C |
| ANISOU | 3702 | CB | VAL | L | 107 | 6170 | 5925 | 6846 | 1006 | 595 | −148 | C |
| ATOM | 3703 | CG1 | VAL | L | 107 | 31.437 | −22.183 | 34.610 | 1.00 | 51.16 | | C |
| ANISOU | 3703 | CG1 | VAL | L | 107 | 6336 | 6082 | 7023 | 1064 | 651 | −168 | C |
| ATOM | 3704 | CG2 | VAL | L | 107 | 29.731 | −20.736 | 35.707 | 1.00 | 53.85 | | C |
| ANISOU | 3704 | CG2 | VAL | L | 107 | 6672 | 6489 | 7299 | 930 | 548 | −189 | C |
| ATOM | 3705 | N | LEU | L | 108 | 29.983 | −25.419 | 35.025 | 1.00 | 52.36 | | N |
| ANISOU | 3705 | N | LEU | L | 108 | 6632 | 5985 | 7277 | 1101 | 698 | −177 | N |
| ATOM | 3706 | CA | LEU | L | 108 | 30.590 | −26.737 | 35.070 | 1.00 | 57.96 | | C |

TABLE 14-continued

| | | | | | | | | | | | | |
|---|---|---|---|---|---|---|---|---|---|---|---|---|
| ANISOU | 3706 | CA | LEU | L | 108 | 7359 | 6617 | 8046 | 1177 | 747 | −143 | C |
| ATOM | 3707 | C | LEU | L | 108 | 32.120 | −26.635 | 34.987 | 1.00 | 62.02 | | C |
| ANISOU | 3707 | C | LEU | L | 108 | 7808 | 7180 | 8576 | 1256 | 782 | −92 | C |
| ATOM | 3708 | O | LEU | L | 108 | 32.707 | −25.553 | 34.854 | 1.00 | 54.92 | | O |
| ANISOU | 3708 | O | LEU | L | 108 | 6851 | 6373 | 7642 | 1248 | 769 | −84 | O |
| ATOM | 3709 | CB | LEU | L | 108 | 30.014 | −27.600 | 33.943 | 1.00 | 60.26 | | C |
| ANISOU | 3709 | CB | LEU | L | 108 | 7746 | 6798 | 8353 | 1184 | 783 | −224 | C |
| ATOM | 3710 | CG | LEU | L | 108 | 28.476 | −27.619 | 34.029 | 1.00 | 53.20 | | C |
| ANISOU | 3710 | CG | LEU | L | 108 | 6903 | 5861 | 7449 | 1097 | 740 | −271 | C |
| ATOM | 3711 | CD1 | LEU | L | 108 | 27.830 | −28.069 | 32.753 | 1.00 | 51.75 | | C |
| ANISOU | 3711 | CD1 | LEU | L | 108 | 6810 | 5592 | 7262 | 1083 | 755 | −368 | C |
| ATOM | 3712 | CD2 | LEU | L | 108 | 28.056 | −28.533 | 35.166 | 1.00 | 58.05 | | C |
| ANISOU | 3712 | CD2 | LEU | L | 108 | 7518 | 6421 | 8116 | 1093 | 731 | −210 | C |
| ATOM | 3713 | N | GLY | L | 109 | 32.774 | −27.788 | 35.102 | 1.00 | 69.74 | | N |
| ANISOU | 3713 | N | GLY | L | 109 | 8792 | 8094 | 9613 | 1334 | 828 | −51 | N |
| ATOM | 3714 | CA | GLY | L | 109 | 34.224 | −27.829 | 35.136 | 1.00 | 75.69 | | C |
| ANISOU | 3714 | CA | GLY | L | 109 | 9475 | 8889 | 10396 | 1416 | 863 | 10 | C |
| ATOM | 3715 | C | GLY | L | 109 | 34.711 | −28.014 | 36.559 | 1.00 | 88.24 | | C |
| ANISOU | 3715 | C | GLY | L | 109 | 10995 | 10516 | 12015 | 1435 | 827 | 115 | C |
| ATOM | 3716 | O | GLY | L | 109 | 35.622 | −27.315 | 37.008 | 1.00 | 99.48 | | O |
| ANISOU | 3716 | O | GLY | L | 109 | 12332 | 12032 | 13435 | 1449 | 805 | 173 | O |
| TER | 3720 | | GLY | L | 109 | | | | | | | |
| ATOM | 3717 | N | ILE | B | 1 | −6.392 | 14.193 | 17.233 | 1.00 | 106.07 | | N |
| ANISOU | 3717 | N | ILE | B | 1 | 12940 | 13254 | 14110 | 127 | −1311 | −581 | N |
| ATOM | 3718 | CA | ILE | B | 1 | −5.952 | 12.804 | 17.154 | 1.00 | 99.33 | | C |
| ANISOU | 3718 | CA | ILE | B | 1 | 12121 | 12411 | 13209 | 84 | −1304 | −622 | C |
| ATOM | 3719 | C | ILE | B | 1 | −5.236 | 12.650 | 15.788 | 1.00 | 95.08 | | C |
| ANISOU | 3719 | C | ILE | B | 1 | 11687 | 11885 | 12553 | 66 | −1363 | −629 | C |
| ATOM | 3720 | O | ILE | B | 1 | −4.456 | 13.538 | 15.423 | 1.00 | 94.50 | | O |
| ANISOU | 3720 | O | ILE | B | 1 | 11674 | 11815 | 12417 | 87 | −1345 | −611 | O |
| ATOM | 3721 | CB | ILE | B | 1 | −7.161 | 11.827 | 17.420 | 1.00 | 89.67 | | C |
| ANISOU | 3721 | CB | ILE | B | 1 | 10809 | 11182 | 12079 | 58 | −1343 | −628 | C |
| ATOM | 3722 | CG1 | ILE | B | 1 | −6.687 | 10.396 | 17.751 | 1.00 | 82.04 | | C |
| ANISOU | 3722 | CG1 | ILE | B | 1 | 9867 | 10218 | 11086 | 19 | −1307 | −672 | C |
| ATOM | 3723 | CG2 | ILE | B | 1 | −8.234 | 11.916 | 16.310 | 1.00 | 84.74 | | C |
| ANISOU | 3723 | CG2 | ILE | B | 1 | 10158 | 10557 | 11485 | 46 | −1473 | −602 | C |
| ATOM | 3724 | CD1 | ILE | B | 1 | −5.749 | 10.289 | 18.989 | 1.00 | 80.01 | | C |
| ANISOU | 3724 | CD1 | ILE | B | 1 | 9622 | 9964 | 10814 | 32 | −1183 | −692 | C |
| ATOM | 3725 | N | GLN | B | 2 | −5.478 | 11.570 | 15.037 | 1.00 | 85.29 | | N |
| ANISOU | 3725 | N | GLN | B | 2 | 10473 | 10650 | 11282 | 29 | −1430 | −653 | N |
| ATOM | 3726 | CA | GLN | B | 2 | −4.643 | 11.258 | 13.875 | 1.00 | 68.15 | | C |
| ANISOU | 3726 | CA | GLN | B | 2 | 8415 | 8492 | 8988 | 14 | −1464 | −669 | C |
| ATOM | 3727 | C | GLN | B | 2 | −4.632 | 12.392 | 12.854 | 1.00 | 68.21 | | C |
| ANISOU | 3727 | C | GLN | B | 2 | 8467 | 8506 | 8944 | 37 | −1523 | −627 | C |
| ATOM | 3728 | O | GLN | B | 2 | −5.680 | 12.936 | 12.489 | 1.00 | 65.75 | | O |
| ANISOU | 3728 | O | GLN | B | 2 | 8105 | 8189 | 8688 | 46 | −1603 | −593 | O |
| ATOM | 3729 | CB | GLN | B | 2 | −5.120 | 9.970 | 13.219 | 1.00 | 63.82 | | C |
| ANISOU | 3729 | CB | GLN | B | 2 | 7884 | 7941 | 8424 | −28 | −1540 | −703 | C |
| ATOM | 3730 | CG | GLN | B | 2 | −5.132 | 8.807 | 14.161 | 1.00 | 69.12 | | C |
| ANISOU | 3730 | CG | GLN | B | 2 | 8516 | 8601 | 9146 | −53 | −1485 | −740 | C |
| ATOM | 3731 | CD | GLN | B | 2 | −5.287 | 7.497 | 13.445 | 1.00 | 75.51 | | C |
| ANISOU | 3731 | CD | GLN | B | 2 | 9370 | 9400 | 9919 | −96 | −1550 | −782 | C |
| ATOM | 3732 | OE1 | GLN | B | 2 | −6.012 | 7.407 | 12.454 | 1.00 | 81.79 | | O |
| ANISOU | 3732 | OE1 | GLN | B | 2 | 10178 | 10194 | 10705 | −115 | −1662 | −779 | O |
| ATOM | 3733 | NE2 | GLN | B | 2 | −4.600 | 6.468 | 13.933 | 1.00 | 72.91 | | N |
| ANISOU | 3733 | NE2 | GLN | B | 2 | 9070 | 9064 | 9569 | −112 | −1483 | −822 | N |
| ATOM | 3734 | N | ARG | B | 3 | −3.434 | 12.750 | 12.404 | 1.00 | 58.72 | | N |
| ANISOU | 3734 | N | ARG | B | 3 | 7356 | 7316 | 7640 | 48 | −1481 | −625 | N |
| ATOM | 3735 | CA | ARG | B | 3 | −3.221 | 13.841 | 11.464 | 1.00 | 59.15 | | C |
| ANISOU | 3735 | CA | ARG | B | 3 | 7463 | 7376 | 7634 | 70 | −1520 | −581 | C |
| ATOM | 3736 | C | ARG | B | 3 | −2.447 | 13.316 | 10.273 | 1.00 | 62.30 | | C |
| ANISOU | 3736 | C | ARG | B | 3 | 7978 | 7795 | 7901 | 55 | −1544 | −597 | C |
| ATOM | 3737 | O | ARG | B | 3 | −1.422 | 12.640 | 10.437 | 1.00 | 51.07 | | O |
| ANISOU | 3737 | O | ARG | B | 3 | 6605 | 6380 | 6418 | 46 | −1472 | −631 | O |
| ATOM | 3738 | CB | ARG | B | 3 | −2.463 | 15.003 | 12.106 | 1.00 | 59.62 | | C |
| ANISOU | 3738 | CB | ARG | B | 3 | 7520 | 7427 | 7704 | 101 | −1434 | −552 | C |
| ATOM | 3739 | CG | ARG | B | 3 | −3.232 | 15.710 | 13.212 | 1.00 | 64.45 | | C |
| ANISOU | 3739 | CG | ARG | B | 3 | 8031 | 8018 | 8440 | 124 | −1409 | −535 | C |
| ATOM | 3740 | CD | ARG | B | 3 | −2.325 | 16.639 | 14.027 | 1.00 | 61.13 | | C |
| ANISOU | 3740 | CD | ARG | B | 3 | 7618 | 7586 | 8025 | 147 | −1313 | −524 | C |
| ATOM | 3741 | NE | ARG | B | 3 | −2.097 | 16.073 | 15.351 | 1.00 | 67.03 | | N |
| ANISOU | 3741 | NE | ARG | B | 3 | 8320 | 8330 | 8818 | 141 | −1230 | −562 | N |
| ATOM | 3742 | CZ | ARG | B | 3 | −1.326 | 16.621 | 16.286 | 1.00 | 74.40 | | C |
| ANISOU | 3742 | CZ | ARG | B | 3 | 9253 | 9254 | 9760 | 155 | −1145 | −566 | C |
| ATOM | 3743 | NH1 | ARG | B | 3 | −0.698 | 17.770 | 16.044 | 1.00 | 74.20 | | N |
| ANISOU | 3743 | NH1 | ARG | B | 3 | 9266 | 9217 | 9708 | 172 | −1129 | −535 | N |
| ATOM | 3744 | NH2 | ARG | B | 3 | −1.176 | 16.008 | 17.461 | 1.00 | 70.28 | | N |
| ANISOU | 3744 | NH2 | ARG | B | 3 | 8694 | 8734 | 9274 | 149 | −1077 | −600 | N |
| ATOM | 3745 | N | THR | B | 4 | −2.946 | 13.616 | 9.074 | 1.00 | 59.71 | | N |
| ANISOU | 3745 | N | THR | B | 4 | 7690 | 7473 | 7523 | 57 | −1644 | −571 | N |

TABLE 14-continued

| | | | | | | | | | | | | |
|---|---|---|---|---|---|---|---|---|---|---|---|---|
| ATOM | 3746 | CA | THR | B | 4 | −2.333 | 13.089 | 7.873 | 1.00 | 56.86 | | C |
| ANISOU | 3746 | CA | THR | B | 4 | 7445 | 7131 | 7028 | 46 | −1674 | −587 | C |
| ATOM | 3747 | C | THR | B | 4 | −1.140 | 13.962 | 7.481 | 1.00 | 56.90 | | C |
| ANISOU | 3747 | C | THR | B | 4 | 7524 | 7148 | 6945 | 71 | −1607 | −552 | C |
| ATOM | 3748 | O | THR | B | 4 | −1.132 | 15.168 | 7.743 | 1.00 | 52.12 | | O |
| ANISOU | 3748 | O | THR | B | 4 | 6888 | 6535 | 6381 | 95 | −1588 | −502 | O |
| ATOM | 3749 | CB | THR | B | 4 | −3.369 | 13.014 | 6.734 | 1.00 | 64.54 | | C |
| ANISOU | 3749 | CB | THR | B | 4 | 8439 | 8108 | 7976 | 35 | −1816 | −575 | C |
| ATOM | 3750 | OG1 | THR | B | 4 | −2.891 | 12.149 | 5.693 | 1.00 | 63.03 | | O |
| ANISOU | 3750 | OG1 | THR | B | 4 | 8360 | 7931 | 7656 | 18 | −1847 | −612 | O |
| ATOM | 3751 | CG2 | THR | B | 4 | −3.656 | 14.386 | 6.152 | 1.00 | 57.98 | | C |
| ANISOU | 3751 | CG2 | THR | B | 4 | 7612 | 7281 | 7138 | 66 | −1863 | −504 | C |
| ATOM | 3752 | N | PRO | B | 5 | −0.096 | 13.367 | 6.901 | 1.00 | 56.02 | | N |
| ANISOU | 3752 | N | PRO | B | 5 | 7510 | 7055 | 6721 | 66 | −1564 | −577 | N |
| ATOM | 3753 | CA | PRO | B | 5 | 1.092 | 14.152 | 6.546 | 1.00 | 57.31 | | C |
| ANISOU | 3753 | CA | PRO | B | 5 | 7737 | 7232 | 6807 | 87 | −1492 | −539 | C |
| ATOM | 3754 | C | PRO | B | 5 | 0.837 | 15.146 | 5.431 | 1.00 | 61.73 | | C |
| ANISOU | 3754 | C | PRO | B | 5 | 8348 | 7799 | 7308 | 105 | −1560 | −478 | C |
| ATOM | 3755 | O | PRO | B | 5 | 0.122 | 14.857 | 4.468 | 1.00 | 60.72 | | O |
| ANISOU | 3755 | O | PRO | B | 5 | 8262 | 7680 | 7131 | 99 | −1663 | −480 | O |
| ATOM | 3756 | CB | PRO | B | 5 | 2.105 | 13.088 | 6.096 | 1.00 | 57.24 | | C |
| ANISOU | 3756 | CB | PRO | B | 5 | 7816 | 7240 | 6691 | 79 | −1439 | −583 | C |
| ATOM | 3757 | CG | PRO | B | 5 | 1.270 | 11.881 | 5.781 | 1.00 | 58.02 | | C |
| ANISOU | 3757 | CG | PRO | B | 5 | 7925 | 7334 | 6786 | 54 | −1520 | −638 | C |
| ATOM | 3758 | CD | PRO | B | 5 | 0.133 | 11.921 | 6.740 | 1.00 | 50.41 | | C |
| ANISOU | 3758 | CD | PRO | B | 5 | 6844 | 6349 | 5962 | 42 | −1560 | −642 | C |
| ATOM | 3759 | N | LYS | B | 6 | 1.423 | 16.328 | 5.580 | 1.00 | 52.84 | | N |
| ANISOU | 3759 | N | LYS | B | 6 | 7218 | 6668 | 6190 | 126 | −1506 | −423 | N |
| ATOM | 3760 | CA | LYS | B | 6 | 1.640 | 17.213 | 4.453 | 1.00 | 56.34 | | C |
| ANISOU | 3760 | CA | LYS | B | 6 | 7735 | 7121 | 6549 | 144 | −1537 | −361 | C |
| ATOM | 3761 | C | LYS | B | 6 | 2.955 | 16.821 | 3.804 | 1.00 | 59.20 | | C |
| ANISOU | 3761 | C | LYS | B | 6 | 8198 | 7511 | 6785 | 145 | −1462 | −366 | C |
| ATOM | 3762 | O | LYS | B | 6 | 3.911 | 16.472 | 4.498 | 1.00 | 52.55 | | O |
| ANISOU | 3762 | O | LYS | B | 6 | 7344 | 6670 | 5951 | 140 | −1360 | −391 | O |
| ATOM | 3763 | CB | LYS | B | 6 | 1.695 | 18.669 | 4.916 | 1.00 | 62.92 | | C |
| ANISOU | 3763 | CB | LYS | B | 6 | 8520 | 7931 | 7455 | 164 | −1509 | −297 | C |
| ATOM | 3764 | CG | LYS | B | 6 | 0.520 | 19.090 | 5.773 | 1.00 | 73.94 | | C |
| ANISOU | 3764 | CG | LYS | B | 6 | 9808 | 9297 | 8989 | 170 | −1555 | −294 | C |
| ATOM | 3765 | CD | LYS | B | 6 | 0.908 | 20.219 | 6.723 | 1.00 | 82.70 | | C |
| ANISOU | 3765 | CD | LYS | B | 6 | 10864 | 10375 | 10183 | 186 | −1482 | −262 | C |
| ATOM | 3766 | CE | LYS | B | 6 | 0.018 | 20.196 | 7.968 | 1.00 | 86.14 | | C |
| ANISOU | 3766 | CE | LYS | B | 6 | 11188 | 10785 | 10754 | 189 | −1483 | −290 | C |
| ATOM | 3767 | NZ | LYS | B | 6 | 0.552 | 21.024 | 9.096 | 1.00 | 85.78 | | N |
| ANISOU | 3767 | NZ | LYS | B | 6 | 11100 | 10711 | 10784 | 200 | −1396 | −282 | N |
| ATOM | 3768 | N | ILE | B | 7 | 3.016 | 16.887 | 2.475 | 1.00 | 51.71 | | N |
| ANISOU | 3768 | N | ILE | B | 7 | 7348 | 6583 | 5716 | 154 | −1510 | −340 | N |
| ATOM | 3769 | CA | ILE | B | 7 | 4.120 | 16.298 | 1.735 | 1.00 | 56.96 | | C |
| ANISOU | 3769 | CA | ILE | B | 7 | 8116 | 7276 | 6249 | 158 | −1446 | −354 | C |
| ATOM | 3770 | C | ILE | B | 7 | 4.701 | 17.338 | 0.791 | 1.00 | 61.78 | | C |
| ANISOU | 3770 | C | ILE | B | 7 | 8800 | 7901 | 6773 | 180 | −1428 | −274 | C |
| ATOM | 3771 | O | ILE | B | 7 | 3.965 | 18.105 | 0.166 | 1.00 | 56.68 | | O |
| ANISOU | 3771 | O | ILE | B | 7 | 8167 | 7252 | 6118 | 190 | −1514 | −223 | O |
| ATOM | 3772 | CB | ILE | B | 7 | 3.677 | 15.053 | 0.945 | 1.00 | 57.09 | | C |
| ANISOU | 3772 | CB | ILE | B | 7 | 8206 | 7309 | 6178 | 148 | −1517 | −415 | C |
| ATOM | 3773 | CG1 | ILE | B | 7 | 2.993 | 14.047 | 1.853 | 1.00 | 52.84 | | C |
| ANISOU | 3773 | CG1 | ILE | B | 7 | 7592 | 6751 | 5735 | 122 | −1544 | −487 | C |
| ATOM | 3774 | CG2 | ILE | B | 7 | 4.884 | 14.412 | 0.243 | 1.00 | 57.09 | | C |
| ANISOU | 3774 | CG2 | ILE | B | 7 | 8316 | 7335 | 6042 | 159 | −1435 | −434 | C |
| ATOM | 3775 | CD1 | ILE | B | 7 | 2.205 | 12.983 | 1.063 | 1.00 | 53.80 | | C |
| ANISOU | 3775 | CD1 | ILE | B | 7 | 7770 | 6875 | 5794 | 105 | −1651 | −541 | C |
| ATOM | 3776 | N | GLN | B | 8 | 6.025 | 17.376 | 0.694 | 1.00 | 56.87 | | N |
| ANISOU | 3776 | N | GLN | B | 8 | 8221 | 7295 | 6092 | 187 | −1315 | −259 | N |
| ATOM | 3777 | CA | GLN | B | 8 | 6.676 | 18.229 | −0.286 | 1.00 | 59.88 | | C |
| ANISOU | 3777 | CA | GLN | B | 8 | 8680 | 7692 | 6379 | 206 | −1286 | −182 | C |
| ATOM | 3778 | C | GLN | B | 8 | 7.828 | 17.451 | −0.875 | 1.00 | 72.76 | | C |
| ANISOU | 3778 | C | GLN | B | 8 | 10400 | 9357 | 7889 | 215 | −1196 | −203 | C |
| ATOM | 3779 | O | GLN | B | 8 | 8.739 | 17.047 | −0.142 | 1.00 | 76.24 | | O |
| ANISOU | 3779 | O | GLN | B | 8 | 10806 | 9798 | 8364 | 210 | −1094 | −228 | O |
| ATOM | 3780 | CB | GLN | B | 8 | 7.189 | 19.533 | 0.320 | 1.00 | 59.82 | | C |
| ANISOU | 3780 | CB | GLN | B | 8 | 8612 | 7662 | 6455 | 208 | −1224 | −112 | C |
| ATOM | 3781 | CG | GLN | B | 8 | 6.175 | 20.328 | 1.098 | 1.00 | 61.60 | | C |
| ANISOU | 3781 | CG | GLN | B | 8 | 8742 | 7849 | 6815 | 204 | −1289 | −97 | C |
| ATOM | 3782 | CD | GLN | B | 8 | 6.678 | 21.716 | 1.375 | 1.00 | 59.81 | | C |
| ANISOU | 3782 | CD | GLN | B | 8 | 8487 | 7596 | 6644 | 210 | −1240 | −20 | C |
| ATOM | 3783 | OE1 | GLN | B | 8 | 6.950 | 22.486 | 0.448 | 1.00 | 53.75 | | O |
| ANISOU | 3783 | OE1 | GLN | B | 8 | 7782 | 6833 | 5808 | 223 | −1243 | 54 | O |
| ATOM | 3784 | NE2 | GLN | B | 8 | 6.835 | 22.045 | 2.654 | 1.00 | 64.28 | | N |
| ANISOU | 3784 | NE2 | GLN | B | 8 | 8961 | 8130 | 7332 | 199 | −1193 | −36 | N |
| ATOM | 3785 | N | VAL | B | 9 | 7.784 | 17.243 | −2.185 | 1.00 | 72.60 | | N |
| ANISOU | 3785 | N | VAL | B | 9 | 10494 | 9363 | 7727 | 232 | −1234 | −190 | N |

TABLE 14-continued

| | | | | | | | | | | | | |
|---|---|---|---|---|---|---|---|---|---|---|---|---|
| ATOM | 3786 | CA | VAL | B | 9 | 8.944 | 16.790 | −2.936 | 1.00 | 72.02 | | C |
| ANISOU | 3786 | CA | VAL | B | 9 | 10519 | 9323 | 7523 | 250 | −1138 | −188 | C |
| ATOM | 3787 | C | VAL | B | 9 | 9.600 | 18.017 | −3.530 | 1.00 | 68.62 | | C |
| ANISOU | 3787 | C | VAL | B | 9 | 10121 | 8902 | 7048 | 267 | −1087 | −84 | C |
| ATOM | 3788 | O | VAL | B | 9 | 8.918 | 18.930 | −4.007 | 1.00 | 70.10 | | O |
| ANISOU | 3788 | O | VAL | B | 9 | 10320 | 9082 | 7232 | 271 | −1166 | −24 | O |
| ATOM | 3789 | CB | VAL | B | 9 | 8.564 | 15.777 | −4.030 | 1.00 | 75.13 | | C |
| ANISOU | 3789 | CB | VAL | B | 9 | 11032 | 9740 | 7776 | 261 | −1202 | −241 | C |
| ATOM | 3790 | CG1 | VAL | B | 9 | 9.751 | 14.870 | −4.354 | 1.00 | 71.84 | | C |
| ANISOU | 3790 | CG1 | VAL | B | 9 | 10689 | 9348 | 7261 | 280 | −1085 | −277 | C |
| ATOM | 3791 | CG2 | VAL | B | 9 | 7.407 | 14.977 | −3.580 | 1.00 | 75.28 | | C |
| ANISOU | 3791 | CG2 | VAL | B | 9 | 11006 | 9737 | 7859 | 238 | −1310 | −318 | C |
| ATOM | 3792 | N | TYR | B | 10 | 10.922 | 18.043 | −3.488 | 1.00 | 60.38 | | N |
| ANISOU | 3792 | N | TYR | B | 10 | 9090 | 7875 | 5978 | 275 | −954 | −59 | N |
| ATOM | 3793 | CA | TYR | B | 10 | 11.708 | 19.167 | −3.970 | 1.00 | 63.24 | | C |
| ANISOU | 3793 | CA | TYR | B | 10 | 9475 | 8244 | 6309 | 286 | −885 | 43 | C |
| ATOM | 3794 | C | TYR | B | 10 | 13.169 | 18.759 | −3.901 | 1.00 | 63.48 | | C |
| ANISOU | 3794 | C | TYR | B | 10 | 9516 | 8298 | 6306 | 295 | −737 | 46 | C |
| ATOM | 3795 | O | TYR | B | 10 | 13.522 | 17.742 | −3.300 | 1.00 | 61.98 | | O |
| ANISOU | 3795 | O | TYR | B | 10 | 9298 | 8111 | 6140 | 291 | −691 | −27 | O |
| ATOM | 3796 | CB | TYR | B | 10 | 11.455 | 20.433 | −3.160 | 1.00 | 64.10 | | C |
| ANISOU | 3796 | CB | TYR | B | 10 | 9482 | 8313 | 6558 | 267 | −903 | 100 | C |
| ATOM | 3797 | CG | TYR | B | 10 | 11.716 | 20.262 | −1.683 | 1.00 | 72.59 | | C |
| ANISOU | 3797 | CG | TYR | B | 10 | 10440 | 9363 | 7780 | 243 | −857 | 55 | C |
| ATOM | 3798 | CD1 | TYR | B | 10 | 10.694 | 19.857 | −0.824 | 1.00 | 76.36 | | C |
| ANISOU | 3798 | CD1 | TYR | B | 10 | 10847 | 9815 | 8351 | 229 | −937 | −12 | C |
| ATOM | 3799 | CD2 | TYR | B | 10 | 12.978 | 20.486 | −1.143 | 1.00 | 65.54 | | C |
| ANISOU | 3799 | CD2 | TYR | B | 10 | 9505 | 8470 | 6927 | 235 | −736 | 81 | C |
| ATOM | 3800 | CE1 | TYR | B | 10 | 10.911 | 19.690 | 0.527 | 1.00 | 69.16 | | C |
| ANISOU | 3800 | CE1 | TYR | B | 10 | 9834 | 8882 | 7563 | 209 | −895 | −52 | C |
| ATOM | 3801 | CE2 | TYR | B | 10 | 13.209 | 20.317 | 0.223 | 1.00 | 65.51 | | C |
| ANISOU | 3801 | CE2 | TYR | B | 10 | 9398 | 8444 | 7050 | 213 | −702 | 39 | C |
| ATOM | 3802 | CZ | TYR | B | 10 | 12.167 | 19.916 | 1.046 | 1.00 | 66.76 | | C |
| ANISOU | 3802 | CZ | TYR | B | 10 | 9496 | 8579 | 7291 | 202 | −781 | −29 | C |
| ATOM | 3803 | OH | TYR | B | 10 | 12.359 | 19.746 | 2.400 | 1.00 | 62.59 | | O |
| ANISOU | 3803 | OH | TYR | B | 10 | 8872 | 8030 | 6879 | 183 | −748 | −69 | O |
| ATOM | 3804 | N | SER | B | 11 | 14.011 | 19.562 | −4.528 | 1.00 | 67.39 | | N |
| ANISOU | 3804 | N | SER | B | 11 | 10048 | 8808 | 6747 | 307 | −660 | 136 | N |
| ATOM | 3805 | CA | SER | B | 11 | 15.436 | 19.297 | −4.595 | 1.00 | 67.36 | | C |
| ANISOU | 3805 | CA | SER | B | 11 | 10054 | 8830 | 6709 | 318 | −514 | 157 | C |
| ATOM | 3806 | C | SER | B | 11 | 16.159 | 20.169 | −3.582 | 1.00 | 70.16 | | C |
| ANISOU | 3806 | C | SER | B | 11 | 10294 | 9159 | 7205 | 291 | −445 | 208 | C |
| ATOM | 3807 | O | SER | B | 11 | 15.608 | 21.146 | −3.076 | 1.00 | 71.94 | | O |
| ANISOU | 3807 | O | SER | B | 11 | 10459 | 9348 | 7529 | 269 | −505 | 243 | O |
| ATOM | 3808 | CB | SER | B | 11 | 15.967 | 19.566 | −6.008 | 1.00 | 69.35 | | C |
| ANISOU | 3808 | CB | SER | B | 11 | 10427 | 9119 | 6803 | 350 | −463 | 228 | C |
| ATOM | 3809 | OG | SER | B | 11 | 15.680 | 20.897 | −6.418 | 1.00 | 68.25 | | O |
| ANISOU | 3809 | OG | SER | B | 11 | 10293 | 8966 | 6672 | 344 | −501 | 327 | O |
| ATOM | 3810 | N | ARG | B | 12 | 17.413 | 19.816 | −3.291 | 1.00 | 72.51 | | N |
| ANISOU | 3810 | N | ARG | B | 12 | 10564 | 9474 | 7513 | 293 | −320 | 213 | N |
| ATOM | 3811 | CA | ARG | B | 12 | 18.192 | 20.655 | −2.388 | 1.00 | 70.28 | | C |
| ANISOU | 3811 | CA | ARG | B | 12 | 10177 | 9168 | 7360 | 263 | −256 | 266 | C |
| ATOM | 3812 | C | ARG | B | 12 | 18.542 | 21.990 | −3.037 | 1.00 | 77.28 | | C |
| ANISOU | 3812 | C | ARG | B | 12 | 11083 | 10047 | 8231 | 259 | −231 | 384 | C |
| ATOM | 3813 | O | ARG | B | 12 | 18.263 | 23.050 | −2.471 | 1.00 | 80.17 | | O |
| ANISOU | 3813 | O | ARG | B | 12 | 11386 | 10371 | 8704 | 231 | −270 | 425 | O |
| ATOM | 3814 | CB | ARG | B | 12 | 19.450 | 19.935 | −1.933 | 1.00 | 71.20 | | C |
| ANISOU | 3814 | CB | ARG | B | 12 | 10252 | 9306 | 7494 | 266 | −134 | 247 | C |
| ATOM | 3815 | CG | ARG | B | 12 | 20.191 | 20.739 | −0.885 | 1.00 | 70.85 | | C |
| ANISOU | 3815 | CG | ARG | B | 12 | 10092 | 9236 | 7592 | 230 | −86 | 291 | C |
| ATOM | 3816 | CD | ARG | B | 12 | 21.415 | 20.016 | −0.351 | 1.00 | 74.39 | | C |
| ANISOU | 3816 | CD | ARG | B | 12 | 10487 | 9706 | 8072 | 231 | 25 | 273 | C |
| ATOM | 3817 | NE | ARG | B | 12 | 21.070 | 18.750 | 0.281 | 1.00 | 69.17 | | N |
| ANISOU | 3817 | NE | ARG | B | 12 | 9811 | 9048 | 7421 | 241 | 0 | 167 | N |
| ATOM | 3818 | CZ | ARG | B | 12 | 21.964 | 17.877 | 0.719 | 1.00 | 69.57 | | C |
| ANISOU | 3818 | CZ | ARG | B | 12 | 9826 | 9119 | 7489 | 251 | 83 | 136 | C |
| ATOM | 3819 | NH1 | ARG | B | 12 | 23.264 | 18.134 | 0.582 | 1.00 | 70.85 | | N |
| ANISOU | 3819 | NH1 | ARG | B | 12 | 9958 | 9301 | 7658 | 253 | 197 | 203 | N |
| ATOM | 3820 | NH2 | ARG | B | 12 | 21.561 | 16.744 | 1.274 | 1.00 | 67.47 | | N |
| ANISOU | 3820 | NH2 | ARG | B | 12 | 9551 | 8850 | 7233 | 259 | 54 | 42 | N |
| ATOM | 3821 | N | HIS | B | 13 | 19.162 | 21.961 | −4.216 | 1.00 | 82.32 | | N |
| ANISOU | 3821 | N | HIS | B | 13 | 11813 | 10724 | 8740 | 287 | −160 | 440 | N |
| ATOM | 3822 | CA | HIS | B | 13 | 19.464 | 23.160 | −4.996 | 1.00 | 82.88 | | C |
| ANISOU | 3822 | CA | HIS | B | 13 | 11920 | 10793 | 8779 | 287 | −134 | 559 | C |
| ATOM | 3823 | C | HIS | B | 13 | 18.617 | 23.185 | −6.260 | 1.00 | 88.41 | | C |
| ANISOU | 3823 | C | HIS | B | 13 | 12745 | 11512 | 9333 | 318 | −209 | 576 | C |
| ATOM | 3824 | O | HIS | B | 13 | 18.072 | 22.151 | −6.665 | 1.00 | 84.15 | | O |
| ANISOU | 3824 | O | HIS | B | 13 | 12276 | 10998 | 8699 | 343 | −255 | 497 | O |
| ATOM | 3825 | CB | HIS | B | 13 | 20.950 | 23.216 | −5.380 | 1.00 | 80.36 | | C |
| ANISOU | 3825 | CB | HIS | B | 13 | 11603 | 10505 | 8426 | 295 | 20 | 629 | C |

TABLE 14-continued

| | | | | | | | | | | | | |
|---|---|---|---|---|---|---|---|---|---|---|---|---|
| ATOM | 3826 | CG | HIS | B | 13 | 21.867 | 22.644 | −4.349 | 1.00 | 77.60 | | C |
| ANISOU | 3826 | CG | HIS | B | 13 | 11154 | 10157 | 8174 | 278 | 101 | 587 | C |
| ATOM | 3827 | ND1 | HIS | B | 13 | 22.184 | 21.302 | −4.300 | 1.00 | 78.49 | | N |
| ANISOU | 3827 | ND1 | HIS | B | 13 | 11285 | 10302 | 8233 | 305 | 147 | 506 | N |
| ATOM | 3828 | CD2 | HIS | B | 13 | 22.538 | 23.227 | −3.328 | 1.00 | 76.87 | | C |
| ANISOU | 3828 | CD2 | HIS | B | 13 | 10945 | 10035 | 8226 | 238 | 141 | 616 | C |
| ATOM | 3829 | CE1 | HIS | B | 13 | 23.013 | 21.084 | −3.295 | 1.00 | 78.16 | | C |
| ANISOU | 3829 | CE1 | HIS | B | 13 | 11140 | 10255 | 8302 | 285 | 212 | 491 | C |
| ATOM | 3830 | NE2 | HIS | B | 13 | 23.243 | 22.235 | −2.687 | 1.00 | 78.11 | | N |
| ANISOU | 3830 | NE2 | HIS | B | 13 | 11051 | 10213 | 8416 | 242 | 207 | 556 | N |
| ATOM | 3831 | N | PRO | B | 14 | 18.467 | 24.350 | −6.903 | 1.00 | 98.84 | | N |
| ANISOU | 3831 | N | PRO | B | 14 | 14100 | 12820 | 10633 | 317 | −228 | 679 | N |
| ATOM | 3832 | CA | PRO | B | 14 | 17.674 | 24.414 | −8.142 | 1.00 | 98.35 | | C |
| ANISOU | 3832 | CA | PRO | B | 14 | 14162 | 12779 | 10425 | 349 | −305 | 703 | C |
| ATOM | 3833 | C | PRO | B | 14 | 18.126 | 23.369 | −9.151 | 1.00 | 100.62 | | C |
| ANISOU | 3833 | C | PRO | B | 14 | 14567 | 13127 | 10537 | 390 | −242 | 674 | C |
| ATOM | 3834 | O | PRO | B | 14 | 19.324 | 23.191 | −9.406 | 1.00 | 98.28 | | O |
| ANISOU | 3834 | O | PRO | B | 14 | 14282 | 12860 | 10201 | 403 | −104 | 711 | O |
| ATOM | 3835 | CB | PRO | B | 14 | 17.922 | 25.837 | −8.646 | 1.00 | 94.89 | | C |
| ANISOU | 3835 | CB | PRO | B | 14 | 13735 | 12322 | 9996 | 342 | −285 | 838 | C |
| ATOM | 3836 | CG | PRO | B | 14 | 18.173 | 26.614 | −7.416 | 1.00 | 96.61 | | C |
| ANISOU | 3836 | CG | PRO | B | 14 | 13819 | 12485 | 10403 | 298 | −272 | 855 | C |
| ATOM | 3837 | CD | PRO | B | 14 | 18.913 | 25.691 | −6.479 | 1.00 | 98.75 | | C |
| ANISOU | 3837 | CD | PRO | B | 14 | 14015 | 12768 | 10739 | 285 | −197 | 775 | C |
| ATOM | 3838 | N | ALA | B | 15 | 17.148 | 22.652 | −9.700 | 1.00 | 103.71 | | N |
| ANISOU | 3838 | N | ALA | B | 15 | 15045 | 13535 | 10827 | 412 | −345 | 605 | N |
| ATOM | 3839 | CA | ALA | B | 15 | 17.436 | 21.491 | −10.529 | 1.00 | 105.80 | | C |
| ANISOU | 3839 | CA | ALA | B | 15 | 15423 | 13847 | 10928 | 450 | −303 | 549 | C |
| ATOM | 3840 | C | ALA | B | 15 | 18.189 | 21.899 | −11.793 | 1.00 | 111.50 | | C |
| ANISOU | 3840 | C | ALA | B | 15 | 16256 | 14610 | 11499 | 485 | −209 | 648 | C |
| ATOM | 3841 | O | ALA | B | 15 | 17.768 | 22.803 | −12.523 | 1.00 | 107.80 | | O |
| ANISOU | 3841 | O | ALA | B | 15 | 15843 | 14141 | 10974 | 491 | −260 | 732 | O |
| ATOM | 3842 | CB | ALA | B | 15 | 16.134 | 20.770 | −10.880 | 1.00 | 101.07 | | C |
| ANISOU | 3842 | CB | ALA | B | 15 | 14894 | 13250 | 10258 | 459 | −453 | 461 | C |
| ATOM | 3843 | N | GLU | B | 16 | 19.321 | 21.237 | −12.034 | 1.00 | 114.03 | | N |
| ANISOU | 3843 | N | GLU | B | 16 | 16605 | 14966 | 11755 | 511 | −65 | 640 | N |
| ATOM | 3844 | CA | GLU | B | 16 | 20.146 | 21.481 | −13.212 | 1.00 | 114.32 | | C |
| ANISOU | 3844 | CA | GLU | B | 16 | 16747 | 15048 | 11642 | 550 | 48 | 729 | C |
| ATOM | 3845 | C | GLU | B | 16 | 20.427 | 20.146 | −13.885 | 1.00 | 114.52 | | C |
| ANISOU | 3845 | C | GLU | B | 16 | 16888 | 15116 | 11510 | 599 | 101 | 645 | C |
| ATOM | 3846 | O | GLU | B | 16 | 21.204 | 19.339 | −13.364 | 1.00 | 108.00 | | O |
| ANISOU | 3846 | O | GLU | B | 16 | 16015 | 14296 | 10724 | 607 | 199 | 591 | O |
| ATOM | 3847 | CB | GLU | B | 16 | 21.445 | 22.191 | −12.845 | 1.00 | 113.31 | | C |
| ANISOU | 3847 | CB | GLU | B | 16 | 16528 | 14918 | 11608 | 535 | 200 | 828 | C |
| ATOM | 3848 | CG | GLU | B | 16 | 21.383 | 23.691 | −13.042 | 1.00 | 120.01 | | C |
| ANISOU | 3848 | CG | GLU | B | 16 | 17351 | 15742 | 12505 | 511 | 183 | 959 | C |
| ATOM | 3849 | CD | GLU | B | 16 | 22.752 | 24.336 | −12.989 | 1.00 | 127.24 | | C |
| ANISOU | 3849 | CD | GLU | B | 16 | 18205 | 16664 | 13476 | 501 | 345 | 1069 | C |
| ATOM | 3850 | OE1 | GLU | B | 16 | 22.832 | 25.537 | −12.648 | 1.00 | 126.52 | | O |
| ANISOU | 3850 | OE1 | GLU | B | 16 | 18040 | 16534 | 13498 | 463 | 337 | 1160 | O |
| ATOM | 3851 | OE2 | GLU | B | 16 | 23.748 | 23.636 | −13.285 | 1.00 | 131.87 | | O |
| ANISOU | 3851 | OE2 | GLU | B | 16 | 18815 | 17293 | 13997 | 532 | 481 | 1063 | O |
| ATOM | 3852 | N | ASN | B | 17 | 19.790 | 19.921 | −15.036 | 1.00 | 118.07 | | N |
| ANISOU | 3852 | N | ASN | B | 17 | 17491 | 15592 | 11779 | 632 | 32 | 635 | N |
| ATOM | 3853 | CA | ASN | B | 17 | 19.940 | 18.675 | −15.771 | 1.00 | 116.78 | | C |
| ANISOU | 3853 | CA | ASN | B | 17 | 17458 | 15463 | 11448 | 681 | 66 | 549 | C |
| ATOM | 3854 | C | ASN | B | 17 | 21.409 | 18.354 | −15.975 | 1.00 | 117.68 | | C |
| ANISOU | 3854 | C | ASN | B | 17 | 17579 | 15611 | 11522 | 717 | 270 | 584 | C |
| ATOM | 3855 | O | ASN | B | 17 | 22.148 | 19.141 | −16.571 | 1.00 | 124.49 | | O |
| ANISOU | 3855 | O | ASN | B | 17 | 18464 | 16499 | 12336 | 734 | 375 | 703 | O |
| ATOM | 3856 | CB | ASN | B | 17 | 19.223 | 18.780 | −17.113 | 1.00 | 118.41 | | C |
| ANISOU | 3856 | CB | ASN | B | 17 | 17837 | 15698 | 11455 | 712 | −20 | 567 | C |
| ATOM | 3857 | CG | ASN | B | 17 | 17.727 | 18.861 | −16.957 | 1.00 | 118.53 | | C |
| ANISOU | 3857 | CG | ASN | B | 17 | 17852 | 15684 | 11501 | 680 | −229 | 516 | C |
| ATOM | 3858 | OD1 | ASN | B | 17 | 17.102 | 19.863 | −17.307 | 1.00 | 120.84 | | O |
| ANISOU | 3858 | OD1 | ASN | B | 17 | 18155 | 15970 | 11789 | 668 | −318 | 596 | O |
| ATOM | 3859 | ND2 | ASN | B | 17 | 17.141 | 17.805 | −16.420 | 1.00 | 117.70 | | N |
| ANISOU | 3859 | ND2 | ASN | B | 17 | 17728 | 15558 | 11434 | 668 | −309 | 385 | N |
| ATOM | 3860 | N | GLY | B | 18 | 21.836 | 17.209 | −15.448 | 1.00 | 111.33 | | N |
| ANISOU | 3860 | N | GLY | B | 18 | 16747 | 14806 | 10749 | 730 | 328 | 485 | N |
| ATOM | 3861 | CA | GLY | B | 18 | 23.230 | 16.821 | −15.516 | 1.00 | 108.63 | | C |
| ANISOU | 3861 | CA | GLY | B | 18 | 16391 | 14492 | 10390 | 767 | 521 | 511 | C |
| ATOM | 3862 | C | GLY | B | 18 | 23.971 | 16.932 | −14.195 | 1.00 | 109.71 | | C |
| ANISOU | 3862 | C | GLY | B | 18 | 16344 | 14604 | 10736 | 731 | 593 | 522 | C |
| ATOM | 3863 | O | GLY | B | 18 | 24.782 | 16.059 | −13.867 | 1.00 | 104.62 | | O |
| ANISOU | 3863 | O | GLY | B | 18 | 15669 | 13969 | 10111 | 757 | 701 | 474 | O |
| ATOM | 3864 | N | LYS | B | 19 | 23.693 | 17.984 | −13.424 | 1.00 | 115.40 | | N |
| ANISOU | 3864 | N | LYS | B | 19 | 16943 | 15292 | 11613 | 674 | 531 | 581 | N |
| ATOM | 3865 | CA | LYS | B | 19 | 24.442 | 18.286 | −12.208 | 1.00 | 116.90 | | C |
| ANISOU | 3865 | CA | LYS | B | 19 | 16961 | 15459 | 11998 | 635 | 596 | 607 | C |

TABLE 14-continued

| | | | | | | | | | | | | |
|---|---|---|---|---|---|---|---|---|---|---|---|---|
| ATOM | 3866 | C | LYS | B | 19 | 23.848 | 17.567 | −10.999 | 1.00 | 115.41 | | C |
| ANISOU | 3866 | C | LYS | B | 19 | 16684 | 15233 | 11935 | 604 | 503 | 489 | C |
| ATOM | 3867 | O | LYS | B | 19 | 22.625 | 17.527 | −10.822 | 1.00 | 116.24 | | O |
| ANISOU | 3867 | O | LYS | B | 19 | 16805 | 15310 | 12049 | 583 | 351 | 430 | O |
| ATOM | 3868 | CB | LYS | B | 19 | 24.468 | 19.799 | −11.960 | 1.00 | 113.70 | | C |
| ANISOU | 3868 | CB | LYS | B | 19 | 16473 | 15030 | 11697 | 588 | 578 | 727 | C |
| ATOM | 3869 | CG | LYS | B | 19 | 24.829 | 20.632 | −13.194 | 1.00 | 113.05 | | C |
| ANISOU | 3869 | CG | LYS | B | 19 | 16486 | 14980 | 11489 | 613 | 644 | 852 | C |
| ATOM | 3870 | CD | LYS | B | 19 | 26.207 | 20.274 | −13.755 | 1.00 | 111.75 | | C |
| ANISOU | 3870 | CD | LYS | B | 19 | 16347 | 14862 | 11252 | 658 | 839 | 903 | C |
| ATOM | 3871 | CE | LYS | B | 19 | 26.497 | 21.021 | −15.055 | 1.00 | 111.75 | | C |
| ANISOU | 3871 | CE | LYS | B | 19 | 16457 | 14897 | 11107 | 688 | 907 | 1025 | C |
| ATOM | 3872 | NZ | LYS | B | 19 | 26.441 | 22.501 | −14.888 | 1.00 | 111.01 | | N |
| ANISOU | 3872 | NZ | LYS | B | 19 | 16293 | 14773 | 11115 | 638 | 878 | 1148 | N |
| ATOM | 3873 | N | SER | B | 20 | 24.723 | 17.006 | −10.161 | 1.00 | 108.49 | | N |
| ANISOU | 3873 | N | SER | B | 20 | 15709 | 14355 | 11159 | 603 | 596 | 461 | N |
| ATOM | 3874 | CA | SER | B | 20 | 24.265 | 16.201 | −9.033 | 1.00 | 101.26 | | C |
| ANISOU | 3874 | CA | SER | B | 20 | 14716 | 13406 | 10352 | 580 | 525 | 351 | C |
| ATOM | 3875 | C | SER | B | 20 | 23.554 | 17.059 | −7.993 | 1.00 | 98.66 | | C |
| ANISOU | 3875 | C | SER | B | 20 | 14272 | 13032 | 10182 | 517 | 411 | 362 | C |
| ATOM | 3876 | O | SER | B | 20 | 23.855 | 18.241 | −7.808 | 1.00 | 101.33 | | O |
| ANISOU | 3876 | O | SER | B | 20 | 14545 | 13360 | 10597 | 486 | 428 | 458 | O |
| ATOM | 3877 | CB | SER | B | 20 | 25.428 | 15.460 | −8.379 | 1.00 | 96.50 | | C |
| ANISOU | 3877 | CB | SER | B | 20 | 14033 | 12814 | 9820 | 596 | 654 | 330 | C |
| ATOM | 3878 | OG | SER | B | 20 | 24.946 | 14.416 | −7.547 | 1.00 | 91.49 | | O |
| ANISOU | 3878 | OG | SER | B | 20 | 13364 | 12153 | 9243 | 589 | 590 | 213 | O |
| ATOM | 3879 | N | ASN | B | 21 | 22.595 | 16.447 | −7.313 | 1.00 | 91.47 | | N |
| ANISOU | 3879 | N | ASN | B | 21 | 13339 | 12092 | 9323 | 498 | 296 | 261 | N |
| ATOM | 3880 | CA | ASN | B | 21 | 21.708 | 17.183 | −6.427 | 1.00 | 82.11 | | C |
| ANISOU | 3880 | CA | ASN | B | 21 | 12066 | 10865 | 8269 | 447 | 176 | 259 | C |
| ATOM | 3881 | C | ASN | B | 21 | 21.171 | 16.217 | −5.379 | 1.00 | 74.50 | | C |
| ANISOU | 3881 | C | ASN | B | 21 | 11042 | 9875 | 7390 | 431 | 113 | 146 | C |
| ATOM | 3882 | O | ASN | B | 21 | 21.651 | 15.086 | −5.242 | 1.00 | 71.29 | | O |
| ANISOU | 3882 | O | ASN | B | 21 | 10646 | 9481 | 6961 | 456 | 174 | 82 | O |
| ATOM | 3883 | CB | ASN | B | 21 | 20.587 | 17.849 | −7.230 | 1.00 | 78.15 | | C |
| ANISOU | 3883 | CB | ASN | B | 21 | 11647 | 10357 | 7690 | 444 | 57 | 286 | C |
| ATOM | 3884 | CG | ASN | B | 21 | 20.011 | 19.045 | −6.529 | 1.00 | 77.05 | | C |
| ANISOU | 3884 | CG | ASN | B | 21 | 11415 | 10177 | 7683 | 398 | −24 | 334 | C |
| ATOM | 3885 | OD1 | ASN | B | 21 | 20.015 | 19.110 | −5.302 | 1.00 | 75.45 | | O |
| ANISOU | 3885 | OD1 | ASN | B | 21 | 11095 | 9944 | 7628 | 365 | −37 | 305 | O |
| ATOM | 3886 | ND2 | ASN | B | 21 | 19.515 | 20.008 | −7.301 | 1.00 | 77.35 | | N |
| ANISOU | 3886 | ND2 | ASN | B | 21 | 11509 | 10213 | 7667 | 399 | −78 | 409 | N |
| ATOM | 3887 | N | PHE | B | 22 | 20.171 | 16.663 | −4.637 | 1.00 | 69.70 | | N |
| ANISOU | 3887 | N | PHE | B | 22 | 10371 | 9230 | 6882 | 392 | −5 | 125 | N |
| ATOM | 3888 | CA | PHE | B | 22 | 19.515 | 15.827 | −3.648 | 1.00 | 66.56 | | C |
| ANISOU | 3888 | CA | PHE | B | 22 | 9917 | 8806 | 6567 | 375 | −75 | 24 | C |
| ATOM | 3889 | C | PHE | B | 22 | 18.013 | 15.951 | −3.825 | 1.00 | 63.08 | | C |
| ANISOU | 3889 | C | PHE | B | 22 | 9510 | 8344 | 6114 | 361 | −228 | −12 | C |
| ATOM | 3890 | O | PHE | B | 22 | 17.491 | 17.061 | −3.962 | 1.00 | 65.21 | | O |
| ANISOU | 3890 | O | PHE | B | 22 | 9768 | 8600 | 6410 | 344 | −290 | 49 | O |
| ATOM | 3891 | CB | PHE | B | 22 | 19.926 | 16.226 | −2.233 | 1.00 | 70.88 | | C |
| ANISOU | 3891 | CB | PHE | B | 22 | 10320 | 9329 | 7284 | 338 | −50 | 34 | C |
| ATOM | 3892 | CG | PHE | B | 22 | 21.248 | 15.668 | −1.807 | 1.00 | 73.71 | | C |
| ANISOU | 3892 | CG | PHE | B | 22 | 10630 | 9706 | 7672 | 351 | 80 | 35 | C |
| ATOM | 3893 | CD1 | PHE | B | 22 | 22.424 | 16.334 | −2.099 | 1.00 | 79.40 | | C |
| ANISOU | 3893 | CD1 | PHE | B | 22 | 11329 | 10446 | 8392 | 355 | 191 | 127 | C |
| ATOM | 3894 | CD2 | PHE | B | 22 | 21.310 | 14.478 | −1.102 | 1.00 | 73.59 | | C |
| ANISOU | 3894 | CD2 | PHE | B | 22 | 10585 | 9685 | 7692 | 357 | 90 | −52 | C |
| ATOM | 3895 | CE1 | PHE | B | 22 | 23.651 | 15.819 | −1.689 | 1.00 | 83.75 | | C |
| ANISOU | 3895 | CE1 | PHE | B | 22 | 11826 | 11016 | 8980 | 367 | 309 | 132 | C |
| ATOM | 3896 | CE2 | PHE | B | 22 | 22.525 | 13.954 | −0.692 | 1.00 | 77.54 | | C |
| ANISOU | 3896 | CE2 | PHE | B | 22 | 11035 | 10201 | 8224 | 372 | 206 | −47 | C |
| ATOM | 3897 | CZ | PHE | B | 22 | 23.700 | 14.624 | −0.982 | 1.00 | 80.71 | | C |
| ANISOU | 3897 | CZ | PHE | B | 22 | 11411 | 10627 | 8628 | 378 | 315 | 44 | C |
| ATOM | 3898 | N | LEU | B | 23 | 17.325 | 14.820 | −3.832 | 1.00 | 59.57 | | N |
| ANISOU | 3898 | N | LEU | B | 23 | 9105 | 7894 | 5634 | 368 | −291 | −109 | N |
| ATOM | 3899 | CA | LEU | B | 23 | 15.872 | 14.794 | −3.906 | 1.00 | 64.21 | | C |
| ANISOU | 3899 | CA | LEU | B | 23 | 9711 | 8460 | 6225 | 351 | −441 | −151 | C |
| ATOM | 3900 | C | LEU | B | 23 | 15.319 | 14.613 | −2.502 | 1.00 | 70.63 | | C |
| ANISOU | 3900 | C | LEU | B | 23 | 10403 | 9238 | 7196 | 317 | −491 | −202 | C |
| ATOM | 3901 | O | LEU | B | 23 | 15.630 | 13.620 | −1.834 | 1.00 | 63.63 | | O |
| ANISOU | 3901 | O | LEU | B | 23 | 9483 | 8346 | 6349 | 317 | −451 | −268 | O |
| ATOM | 3902 | CB | LEU | B | 23 | 15.379 | 13.670 | −4.817 | 1.00 | 65.12 | | C |
| ANISOU | 3902 | CB | LEU | B | 23 | 9950 | 8588 | 6206 | 375 | −491 | −226 | C |
| ATOM | 3903 | CG | LEU | B | 23 | 13.855 | 13.600 | −4.957 | 1.00 | 67.19 | | C |
| ANISOU | 3903 | CG | LEU | B | 23 | 10228 | 8829 | 6472 | 355 | −655 | −268 | C |
| ATOM | 3904 | CD1 | LEU | B | 23 | 13.282 | 14.942 | −5.389 | 1.00 | 64.14 | | C |
| ANISOU | 3904 | CD1 | LEU | B | 23 | 9842 | 8443 | 6087 | 347 | −726 | −182 | C |
| ATOM | 3905 | CD2 | LEU | B | 23 | 13.466 | 12.512 | −5.922 | 1.00 | 68.10 | | C |
| ANISOU | 3905 | CD2 | LEU | B | 23 | 10473 | 8956 | 6447 | 375 | −704 | −341 | C |

TABLE 14-continued

| | | | | | | | | | | | | |
|---|---|---|---|---|---|---|---|---|---|---|---|---|
| ATOM | 3906 | N | ASN | B | 24 | 14.494 | 15.564 | −2.067 | 1.00 | 79.55 | | N |
| ANISOU | 3906 | N | ASN | B | 24 | 11470 | 10342 | 8413 | 291 | −575 | −170 | N |
| ATOM | 3907 | CA | ASN | B | 24 | 13.926 | 15.580 | −0.728 | 1.00 | 73.44 | | C |
| ANISOU | 3907 | CA | ASN | E | 24 | 10580 | 9534 | 7789 | 261 | −620 | −207 | C |
| ATOM | 3908 | C | ASN | B | 24 | 12.445 | 15.254 | −0.766 | 1.00 | 70.92 | | C |
| ANISOU | 3908 | C | ASN | B | 24 | 10267 | 9197 | 7483 | 249 | −758 | −259 | C |
| ATOM | 3909 | O | ASN | B | 24 | 11.726 | 15.697 | −1.664 | 1.00 | 73.78 | | O |
| ANISOU | 3909 | O | ASN | B | 24 | 10690 | 9563 | 7779 | 256 | −840 | −231 | O |
| ATOM | 3910 | CB | ASN | B | 24 | 14.104 | 16.946 | −0.067 | 1.00 | 67.78 | | C |
| ANISOU | 3910 | CB | ASN | B | 24 | 9777 | 8796 | 7180 | 241 | −606 | −134 | C |
| ATOM | 3911 | CG | ASN | B | 24 | 15.531 | 17.273 | 0.180 | 1.00 | 66.25 | | C |
| ANISOU | 3911 | CG | ASN | B | 24 | 9554 | 8616 | 7004 | 242 | −478 | −85 | C |
| ATOM | 3912 | OD1 | ASN | B | 24 | 16.367 | 16.382 | 0.331 | 1.00 | 62.36 | | O |
| ANISOU | 3912 | OD1 | ASN | B | 24 | 9064 | 8141 | 6489 | 253 | −396 | −119 | O |
| ATOM | 3913 | ND2 | ASN | B | 24 | 15.840 | 18.558 | 0.212 | 1.00 | 72.20 | | N |
| ANISOU | 3913 | ND2 | ASN | B | 24 | 10275 | 9355 | 7801 | 230 | −460 | −2 | N |
| ATOM | 3914 | N | CYS | B | 25 | 11.997 | 14.487 | 0.222 | 1.00 | 61.38 | | N |
| ANISOU | 3914 | N | CYS | B | 25 | 8991 | 7968 | 6362 | 232 | −783 | −330 | N |
| ATOM | 3915 | CA | CYS | B | 25 | 10.586 | 14.352 | 0.525 | 1.00 | 58.07 | | C |
| ANISOU | 3915 | CA | CYS | B | 25 | 8536 | 7525 | 6004 | 213 | −906 | −369 | C |
| ATOM | 3916 | C | CYS | B | 25 | 10.412 | 14.735 | 1.987 | 1.00 | 55.32 | | C |
| ANISOU | 3916 | C | CYS | B | 25 | 8060 | 7149 | 5812 | 191 | −895 | −372 | C |
| ATOM | 3917 | O | CYS | B | 25 | 10.849 | 14.003 | 2.877 | 1.00 | 53.97 | | O |
| ANISOU | 3917 | O | CYS | B | 25 | 7840 | 6972 | 5694 | 184 | −839 | −418 | O |
| ATOM | 3918 | CB | CYS | B | 25 | 10.095 | 12.937 | 0.266 | 1.00 | 64.31 | | C |
| ANISOU | 3918 | CB | CYS | B | 25 | 9376 | 8314 | 6744 | 212 | −953 | −457 | C |
| ATOM | 3919 | SG | CYS | B | 25 | 8.323 | 12.764 | 0.536 | 1.00 | 65.52 | | S |
| ANISOU | 3919 | SG | CYS | B | 25 | 9482 | 8440 | 6974 | 185 | −1110 | −497 | S |
| ATOM | 3920 | N | TYR | B | 26 | 9.790 | 15.879 | 2.226 | 1.00 | 53.70 | | N |
| ANISOU | 3920 | N | TYR | B | 26 | 7804 | 6924 | 5676 | 184 | −948 | −323 | N |
| ATOM | 3921 | CA | TYR | B | 26 | 9.540 | 16.382 | 3.566 | 1.00 | 57.53 | | C |
| ANISOU | 3921 | CA | TYR | B | 26 | 8176 | 7379 | 6303 | 167 | −942 | −324 | C |
| ATOM | 3922 | C | TYR | B | 26 | 8.081 | 16.105 | 3.925 | 1.00 | 58.11 | | C |
| ANISOU | 3922 | C | TYR | B | 26 | 8203 | 7432 | 6443 | 157 | −1050 | −364 | C |
| ATOM | 3923 | O | TYR | B | 26 | 7.167 | 16.670 | 3.317 | 1.00 | 51.76 | | O |
| ANISOU | 3923 | O | TYR | B | 26 | 7414 | 6621 | 5629 | 162 | −1141 | −335 | O |
| ATOM | 3924 | CB | TYR | B | 26 | 9.857 | 17.873 | 3.628 | 1.00 | 57.72 | | C |
| ANISOU | 3924 | CB | TYR | B | 26 | 8175 | 7389 | 6366 | 169 | −921 | −243 | C |
| ATOM | 3925 | CG | TYR | B | 26 | 9.682 | 18.498 | 4.997 | 1.00 | 63.52 | | C |
| ANISOU | 3925 | CG | TYR | B | 26 | 8804 | 8090 | 7240 | 155 | −910 | −243 | C |
| ATOM | 3926 | CD1 | TYR | B | 26 | 10.433 | 18.050 | 6.087 | 1.00 | 63.36 | | C |
| ANISOU | 3926 | CD1 | TYR | B | 26 | 8728 | 8068 | 7277 | 143 | −832 | −278 | C |
| ATOM | 3927 | CD2 | TYR | B | 26 | 8.776 | 19.537 | 5.201 | 1.00 | 61.20 | | C |
| ANISOU | 3927 | CD2 | TYR | B | 26 | 8469 | 7765 | 7019 | 156 | −977 | −209 | C |
| ATOM | 3928 | CE1 | TYR | B | 26 | 10.275 | 18.611 | 7.330 | 1.00 | 64.17 | | C |
| ANISOU | 3928 | CE1 | TYR | B | 26 | 8746 | 8141 | 7496 | 131 | −824 | −282 | C |
| ATOM | 3929 | CE2 | TYR | B | 26 | 8.616 | 20.113 | 6.445 | 1.00 | 56.83 | | C |
| ANISOU | 3929 | CE2 | TYR | B | 26 | 7828 | 7178 | 6586 | 148 | −963 | −214 | C |
| ATOM | 3930 | CZ | TYR | B | 26 | 9.371 | 19.641 | 7.508 | 1.00 | 63.52 | | C |
| ANISOU | 3930 | CZ | TYR | B | 26 | 8629 | 8027 | 7480 | 134 | −887 | −253 | C |
| ATOM | 3931 | OH | TYR | B | 26 | 9.242 | 20.198 | 8.751 | 1.00 | 63.12 | | O |
| ANISOU | 3931 | OH | TYR | B | 26 | 8501 | 7944 | 7538 | 126 | −872 | −262 | O |
| ATOM | 3932 | N | VAL | B | 27 | 7.866 | 15.224 | 4.893 | 1.00 | 50.56 | | N |
| ANISOU | 3932 | N | VAL | B | 27 | 7190 | 6466 | 5556 | 143 | −1040 | −427 | N |
| ATOM | 3933 | CA | VAL | B | 27 | 6.550 | 14.992 | 5.471 | 1.00 | 51.48 | | C |
| ANISOU | 3933 | CA | VAL | B | 27 | 7240 | 6560 | 5760 | 131 | −1124 | −461 | C |
| ATOM | 3934 | C | VAL | B | 27 | 6.517 | 15.641 | 6.840 | 1.00 | 57.68 | | C |
| ANISOU | 3934 | C | VAL | B | 27 | 7923 | 7321 | 6672 | 125 | −1086 | −452 | C |
| ATOM | 3935 | O | VAL | B | 27 | 7.505 | 15.601 | 7.588 | 1.00 | 57.08 | | O |
| ANISOU | 3935 | O | VAL | B | 27 | 7823 | 7247 | 6619 | 122 | −995 | −456 | O |
| ATOM | 3936 | CB | VAL | B | 27 | 6.219 | 13.495 | 5.594 | 1.00 | 56.22 | | C |
| ANISOU | 3936 | CB | VAL | B | 27 | 7849 | 7162 | 6350 | 117 | −1143 | −538 | C |
| ATOM | 3937 | CG1 | VAL | B | 27 | 5.905 | 12.904 | 4.239 | 1.00 | 54.30 | | C |
| ANISOU | 3937 | CG1 | VAL | B | 27 | 7707 | 6934 | 5991 | 121 | −1212 | −555 | C |
| ATOM | 3938 | CG2 | VAL | B | 27 | 7.396 | 12.765 | 6.259 | 1.00 | 52.31 | | C |
| ANISOU | 3938 | CG2 | VAL | B | 27 | 7348 | 6673 | 5852 | 117 | −1032 | −569 | C |
| ATOM | 3939 | N | SER | B | 28 | 5.371 | 16.198 | 7.184 | 1.00 | 48.88 | | N |
| ANISOU | 3939 | N | SER | B | 28 | 6748 | 6184 | 5639 | 125 | −1157 | −440 | N |
| ATOM | 3940 | CA | SER | B | 28 | 5.266 | 16.993 | 8.394 | 1.00 | 48.93 | | C |
| ANISOU | 3940 | CA | SER | B | 28 | 6668 | 6164 | 5758 | 126 | −1125 | −427 | C |
| ATOM | 3941 | C | SER | B | 28 | 3.796 | 17.094 | 8.745 | 1.00 | 48.80 | | C |
| ANISOU | 3941 | C | SER | B | 28 | 6585 | 6127 | 5828 | 128 | −1209 | −436 | C |
| ATOM | 3942 | O | SER | B | 28 | 2.924 | 16.730 | 7.952 | 1.00 | 49.91 | | O |
| ANISOU | 3942 | O | SER | B | 28 | 6747 | 6274 | 5941 | 126 | −1298 | −441 | O |
| ATOM | 3943 | CB | SER | B | 28 | 5.889 | 18.371 | 8.190 | 1.00 | 46.15 | | C |
| ANISOU | 3943 | CB | SER | B | 28 | 6332 | 5802 | 5403 | 138 | −1094 | −360 | C |
| ATOM | 3944 | OG | SER | B | 28 | 5.104 | 19.145 | 7.297 | 1.00 | 56.93 | | O |
| ANISOU | 3944 | OG | SER | B | 28 | 7720 | 7159 | 6751 | 151 | −1176 | −312 | O |
| ATOM | 3945 | N | GLY | B | 29 | 3.531 | 17.566 | 9.958 | 1.00 | 49.62 | | N |
| ANISOU | 3945 | N | GLY | B | 29 | 6607 | 6206 | 6038 | 131 | −1180 | −440 | N |

TABLE 14-continued

| | | | | | | | | | | | | |
|---|---|---|---|---|---|---|---|---|---|---|---|---|
| ATOM | 3946 | CA | GLY | B | 29 | 2.166 | 17.697 | 10.432 | 1.00 | 51.34 | | C |
| ANISOU | 3946 | CA | GLY | B | 29 | 6751 | 6405 | 6352 | 137 | −1243 | −445 | C |
| ATOM | 3947 | C | GLY | B | 29 | 1.443 | 16.405 | 10.708 | 1.00 | 53.36 | | C |
| ANISOU | 3947 | C | GLY | B | 29 | 6973 | 6667 | 6633 | 120 | −1275 | −499 | C |
| ATOM | 3948 | O | GLY | B | 29 | 0.216 | 16.431 | 10.884 | 1.00 | 48.48 | | O |
| ANISOU | 3948 | O | GLY | B | 29 | 6294 | 6037 | 6090 | 123 | −1339 | −499 | O |
| ATOM | 3949 | N | PHE | B | 30 | 2.151 | 15.284 | 10.777 | 1.00 | 50.27 | | N |
| ANISOU | 3949 | N | PHE | B | 30 | 6616 | 6294 | 6191 | 102 | −1230 | −544 | N |
| ATOM | 3950 | CA | PHE | B | 30 | 1.432 | 14.002 | 10.968 | 1.00 | 46.05 | | C |
| ANISOU | 3950 | CA | PHE | B | 30 | 6055 | 5760 | 5683 | 82 | −1265 | −594 | C |
| ATOM | 3951 | C | PHE | B | 30 | 1.538 | 13.427 | 12.373 | 1.00 | 50.07 | | C |
| ANISOU | 3951 | C | PHE | B | 30 | 6497 | 6260 | 6266 | 74 | −1195 | −630 | C |
| ATOM | 3952 | O | PHE | B | 30 | 2.439 | 13.745 | 13.109 | 1.00 | 44.22 | | O |
| ANISOU | 3952 | O | PHE | B | 30 | 5751 | 5520 | 5530 | 81 | −1113 | −627 | O |
| ATOM | 3953 | CB | PHE | B | 30 | 1.901 | 12.946 | 9.980 | 1.00 | 46.28 | | C |
| ANISOU | 3953 | CB | PHE | B | 30 | 6171 | 5808 | 5605 | 67 | −1281 | −625 | C |
| ATOM | 3954 | CG | PHE | B | 30 | 3.343 | 12.545 | 10.086 | 1.00 | 46.19 | | C |
| ANISOU | 3954 | CG | PHE | B | 30 | 6213 | 5812 | 5526 | 69 | −1184 | −641 | C |
| ATOM | 3955 | CD1 | PHE | B | 30 | 4.328 | 13.290 | 9.477 | 1.00 | 46.03 | | C |
| ANISOU | 3955 | CD1 | PHE | B | 30 | 6252 | 5805 | 5431 | 84 | −1144 | −602 | C |
| ATOM | 3956 | CD2 | PHE | B | 30 | 3.706 | 11.401 | 10.753 | 1.00 | 42.13 | | C |
| ANISOU | 3956 | CD2 | PHE | B | 30 | 5687 | 5296 | 5024 | 56 | −1133 | −690 | C |
| ATOM | 3957 | CE1 | PHE | B | 30 | 5.651 | 12.908 | 9.551 | 1.00 | 47.22 | | C |
| ANISOU | 3957 | CE1 | PHE | B | 30 | 6444 | 5971 | 5527 | 87 | −1054 | −612 | C |
| ATOM | 3958 | CE2 | PHE | B | 30 | 5.028 | 11.021 | 10.821 | 1.00 | 39.12 | | C |
| ANISOU | 3958 | CE2 | PHE | B | 30 | 5350 | 4929 | 4585 | 62 | −1046 | −700 | C |
| ATOM | 3959 | CZ | PHE | B | 30 | 5.993 | 11.771 | 10.220 | 1.00 | 42.18 | | C |
| ANISOU | 3959 | CZ | PHE | B | 30 | 5791 | 5333 | 4904 | 77 | −1007 | −661 | C |
| ATOM | 3960 | N | HIS | B | 31 | 0.615 | 12.518 | 12.657 | 1.00 | 45.45 | | N |
| ANISOU | 3960 | N | HIS | B | 31 | 5867 | 5669 | 5735 | 57 | −1235 | −662 | N |
| ATOM | 3961 | CA | HIS | B | 31 | 0.505 | 11.795 | 13.939 | 1.00 | 48.66 | | C |
| ANISOU | 3961 | CA | HIS | B | 31 | 6208 | 6066 | 6213 | 48 | −1180 | −694 | C |
| ATOM | 3962 | C | HIS | B | 31 | −0.421 | 10.605 | 13.711 | 1.00 | 53.97 | | C |
| ANISOU | 3962 | C | HIS | B | 31 | 6862 | 6732 | 6913 | 21 | −1243 | −727 | C |
| ATOM | 3963 | O | HIS | B | 31 | −1.460 | 10.824 | 13.145 | 1.00 | 55.34 | | O |
| ANISOU | 3963 | O | HIS | B | 31 | 7012 | 6900 | 7115 | 17 | −1332 | −711 | O |
| ATOM | 3964 | CB | HIS | B | 31 | −0.079 | 12.733 | 14.980 | 1.00 | 48.24 | | C |
| ANISOU | 3964 | CB | HIS | B | 31 | 6070 | 5997 | 6260 | 67 | −1157 | −670 | C |
| ATOM | 3965 | CG | HIS | B | 31 | 0.658 | 12.786 | 16.266 | 1.00 | 68.67 | | C |
| ANISOU | 3965 | CG | HIS | B | 31 | 8633 | 8584 | 8875 | 75 | −1058 | −683 | C |
| ATOM | 3966 | ND1 | HIS | B | 31 | 1.036 | 11.695 | 16.942 | 1.00 | 72.59 | | N |
| ANISOU | 3966 | ND1 | HIS | B | 31 | 9123 | 9085 | 9373 | 59 | −1008 | −718 | N |
| ATOM | 3967 | CD2 | HIS | B | 31 | 1.150 | 13.813 | 16.965 | 1.00 | 73.05 | | C |
| ANISOU | 3967 | CD2 | HIS | B | 31 | 9175 | 9131 | 9449 | 95 | −1004 | −664 | C |
| ATOM | 3968 | CE1 | HIS | B | 31 | 1.617 | 12.007 | 18.050 | 1.00 | 70.06 | | C |
| ANISOU | 3968 | CE1 | HIS | B | 31 | 8780 | 8764 | 9076 | 70 | −932 | −720 | C |
| ATOM | 3969 | NE2 | HIS | B | 31 | 1.744 | 13.293 | 18.060 | 1.00 | 72.86 | | N |
| ANISOU | 3969 | NE2 | HIS | B | 31 | 9134 | 9111 | 9438 | 90 | −928 | −690 | N |
| ATOM | 3970 | N | PRO | B | 32 | −0.094 | 9.359 | 14.092 | 1.00 | 49.14 | | N |
| ANISOU | 3970 | N | PRO | B | 32 | 6260 | 6118 | 6295 | 1 | −1207 | −769 | N |
| ATOM | 3971 | CA | PRO | B | 32 | 1.116 | 9.006 | 14.808 | 1.00 | 48.56 | | C |
| ANISOU | 3971 | CA | PRO | B | 32 | 6207 | 6052 | 6193 | 6 | −1106 | −786 | C |
| ATOM | 3972 | C | PRO | B | 32 | 2.395 | 8.980 | 13.969 | 1.00 | 47.33 | | C |
| ANISOU | 3972 | C | PRO | B | 32 | 6148 | 5913 | 5923 | 15 | −1075 | −789 | C |
| ATOM | 3973 | O | PRO | B | 32 | 2.340 | 9.233 | 12.835 | 1.00 | 42.12 | | O |
| ANISOU | 3973 | O | PRO | B | 32 | 5545 | 5260 | 5200 | 16 | −1128 | −778 | O |
| ATOM | 3974 | CB | PRO | B | 32 | 0.804 | 7.651 | 15.421 | 1.00 | 49.42 | | C |
| ANISOU | 3974 | CB | PRO | B | 32 | 6286 | 6146 | 6344 | −17 | −1093 | −825 | C |
| ATOM | 3975 | CG | PRO | B | 32 | −0.147 | 7.042 | 14.458 | 1.00 | 49.06 | | C |
| ANISOU | 3975 | CG | PRO | B | 32 | 6256 | 6090 | 6296 | −42 | −1195 | −841 | C |
| ATOM | 3976 | CD | PRO | B | 32 | −0.932 | 8.202 | 13.905 | 1.00 | 52.68 | | C |
| ANISOU | 3976 | CD | PRO | B | 32 | 6691 | 6553 | 6774 | −30 | −1267 | −801 | C |
| ATOM | 3977 | N | SER | B | 33 | 3.510 | 8.626 | 14.583 | 1.00 | 41.30 | | N |
| ANISOU | 3977 | N | SER | B | 33 | 5398 | 5156 | 5138 | 20 | −986 | −801 | N |
| ATOM | 3978 | CA | SER | B | 33 | 4.769 | 8.817 | 13.881 | 1.00 | 42.71 | | C |
| ANISOU | 3978 | CA | SER | B | 33 | 5653 | 5353 | 5220 | 33 | −944 | −792 | C |
| ATOM | 3979 | C | SER | B | 33 | 5.051 | 7.743 | 12.843 | 1.00 | 43.66 | | C |
| ANISOU | 3979 | C | SER | B | 33 | 5857 | 5477 | 5256 | 27 | −964 | −825 | C |
| ATOM | 3980 | O | SER | B | 33 | 5.859 | 7.984 | 11.940 | 1.00 | 50.23 | | O |
| ANISOU | 3980 | O | SER | B | 33 | 6762 | 6325 | 5998 | 40 | −948 | −813 | O |
| ATOM | 3981 | CB | SER | B | 33 | 5.953 | 8.844 | 14.873 | 1.00 | 38.39 | | C |
| ANISOU | 3981 | CB | SER | B | 33 | 5089 | 4815 | 4680 | 43 | −844 | −789 | C |
| ATOM | 3982 | OG | SER | B | 33 | 5.904 | 7.697 | 15.723 | 1.00 | 44.01 | | O |
| ANISOU | 3982 | OG | SER | B | 33 | 5772 | 5518 | 5433 | 33 | −813 | −824 | O |
| ATOM | 3983 | N | ASP | B | 34 | 4.486 | 6.558 | 12.977 | 1.00 | 47.40 | | N |
| ANISOU | 3983 | N | ASP | B | 34 | 6324 | 5932 | 5755 | 7 | −991 | −867 | N |
| ATOM | 3984 | CA | ASP | B | 34 | 4.859 | 5.505 | 12.037 | 1.00 | 59.71 | | C |
| ANISOU | 3984 | CA | ASP | B | 34 | 7970 | 7487 | 7230 | 4 | −1003 | −906 | C |
| ATOM | 3985 | C | ASP | B | 34 | 4.430 | 5.909 | 10.629 | 1.00 | 57.93 | | C |
| ANISOU | 3985 | C | ASP | B | 34 | 7813 | 7269 | 6930 | 4 | −1087 | −898 | C |

TABLE 14-continued

| ATOM | 3986 | O | ASP | B | 34 | 3.274 | 6.278 | 10.390 | 1.00 | 49.16 | | O |
|---|---|---|---|---|---|---|---|---|---|---|---|---|
| ANISOU | 3986 | O | ASP | B | 34 | 6670 | 6151 | 5858 | −10 | −1176 | −887 | O |
| ATOM | 3987 | CB | ASP | B | 34 | 4.251 | 4.160 | 12.434 | 1.00 | 72.26 | | C |
| ANISOU | 3987 | CB | ASP | B | 34 | 9540 | 9047 | 8869 | −21 | −1024 | −953 | C |
| ATOM | 3988 | CG | ASP | B | 34 | 4.857 | 3.588 | 13.739 | 1.00 | 90.41 | | C |
| ANISOU | 3988 | CG | ASP | B | 34 | 11790 | 11339 | 11222 | −18 | −933 | −961 | C |
| ATOM | 3989 | OD1 | ASP | B | 34 | 4.152 | 2.827 | 14.446 | 1.00 | 95.79 | | O |
| ANISOU | 3989 | OD1 | ASP | B | 34 | 12420 | 11996 | 11979 | −39 | −946 | −981 | O |
| ATOM | 3990 | OD2 | ASP | B | 34 | 6.024 | 3.911 | 14.080 | 1.00 | 93.86 | | O |
| ANISOU | 3990 | OD2 | ASP | B | 34 | 12237 | 11796 | 11629 | 5 | −851 | −944 | O |
| ATOM | 3991 | N | ILE | B | 35 | 5.385 | 5.914 | 9.712 | 1.00 | 58.78 | | N |
| ANISOU | 3991 | N | ILE | B | 35 | 8012 | 7394 | 6927 | 23 | −1055 | −897 | N |
| ATOM | 3992 | CA | ILE | B | 35 | 5.111 | 6.375 | 8.366 | 1.00 | 58.11 | | C |
| ANISOU | 3992 | CA | ILE | B | 35 | 8002 | 7321 | 6755 | 29 | −1126 | −883 | C |
| ATOM | 3993 | C | ILE | B | 35 | 6.055 | 5.647 | 7.428 | 1.00 | 61.59 | | C |
| ANISOU | 3993 | C | ILE | B | 35 | 8555 | 7771 | 7074 | 45 | −1087 | −912 | C |
| ATOM | 3994 | O | ILE | B | 35 | 7.157 | 5.242 | 7.810 | 1.00 | 58.64 | | O |
| ANISOU | 3994 | O | ILE | B | 35 | 8193 | 7403 | 6684 | 62 | −988 | −920 | O |
| ATOM | 3995 | CB | ILE | B | 35 | 5.240 | 7.916 | 8.270 | 1.00 | 50.75 | | C |
| ANISOU | 3995 | CB | ILE | B | 35 | 7048 | 6409 | 5825 | 45 | −1121 | −816 | C |
| ATOM | 3996 | CG1 | ILE | B | 35 | 4.424 | 8.465 | 7.095 | 1.00 | 51.78 | | C |
| ANISOU | 3996 | CG1 | ILE | B | 35 | 7225 | 6546 | 5905 | 44 | −1226 | −795 | C |
| ATOM | 3997 | CG2 | ILE | B | 35 | 6.700 | 8.362 | 8.189 | 1.00 | 57.03 | | C |
| ANISOU | 3997 | CG2 | ILE | B | 35 | 7881 | 7229 | 6561 | 71 | −1016 | −787 | C |
| ATOM | 3998 | CD1 | ILE | B | 35 | 4.487 | 9.961 | 7.002 | 1.00 | 49.68 | | C |
| ANISOU | 3998 | CD1 | ILE | B | 35 | 6937 | 6292 | 5647 | 61 | −1225 | −726 | C |
| ATOM | 3999 | N | GLU | B | 36 | 5.596 | 5.434 | 6.201 | 1.00 | 64.53 | | N |
| ANISOU | 3999 | N | GLU | B | 36 | 9013 | 8144 | 7362 | 42 | −1167 | −930 | N |
| ATOM | 4000 | CA | GLU | B | 36 | 6.437 | 4.877 | 5.157 | 1.00 | 65.40 | | C |
| ANISOU | 4000 | CA | GLU | B | 36 | 9244 | 8264 | 7340 | 64 | −1134 | −955 | C |
| ATOM | 4001 | C | GLU | B | 36 | 6.530 | 5.891 | 4.034 | 1.00 | 62.48 | | C |
| ANISOU | 4001 | C | GLU | B | 36 | 8941 | 7924 | 6874 | 83 | −1164 | −907 | C |
| ATOM | 4002 | O | GLU | B | 36 | 5.508 | 6.391 | 3.551 | 1.00 | 61.84 | | O |
| ANISOU | 4002 | O | GLU | B | 36 | 8858 | 7842 | 6796 | 68 | −1271 | −891 | O |
| ATOM | 4003 | CB | GLU | B | 36 | 5.905 | 3.543 | 4.644 | 1.00 | 73.77 | | C |
| ANISOU | 4003 | CB | GLU | B | 36 | 10370 | 9294 | 8366 | 46 | −1198 | −1028 | C |
| ATOM | 4004 | CG | GLU | B | 36 | 6.977 | 2.745 | 3.905 | 1.00 | 82.59 | | C |
| ANISOU | 4004 | CG | GLU | B | 36 | 11603 | 10414 | 9364 | 75 | −1128 | −1066 | C |
| ATOM | 4005 | CD | GLU | B | 36 | 7.063 | 1.307 | 4.384 | 0.00 | 91.94 | | C |
| ANISOU | 4005 | CD | GLU | B | 36 | 12794 | 11559 | 10582 | 65 | −1104 | −1134 | C |
| ATOM | 4006 | OE1 | GLU | B | 36 | 8.139 | 0.911 | 4.889 | 1.00 | 94.31 | | O |
| ANISOU | 4006 | OE1 | GLU | B | 36 | 13089 | 11860 | 10884 | 91 | −991 | −1136 | O |
| ATOM | 4007 | OE2 | GLU | B | 36 | 6.052 | 0.580 | 4.262 | 1.00 | 100.13 | | O |
| ANISOU | 4007 | OE2 | GLU | B | 36 | 13837 | 12561 | 11647 | 31 | −1200 | −1181 | O |
| ATOM | 4008 | N | VAL | B | 37 | 7.758 | 6.207 | 3.649 | 1.00 | 63.13 | | N |
| ANISOU | 4008 | N | VAL | B | 37 | 9078 | 8033 | 6878 | 115 | −1068 | −879 | N |
| ATOM | 4009 | CA | VAL | B | 37 | 8.065 | 7.236 | 2.674 | 1.00 | 63.86 | | C |
| ANISOU | 4009 | CA | VAL | B | 37 | 9230 | 8156 | 6880 | 136 | −1070 | −822 | C |
| ATOM | 4010 | C | VAL | B | 37 | 9.078 | 6.643 | 1.709 | 1.00 | 65.67 | | C |
| ANISOU | 4010 | C | VAL | B | 37 | 9579 | 8401 | 6970 | 168 | −1002 | −842 | C |
| ATOM | 4011 | O | VAL | B | 37 | 10.140 | 6.173 | 2.133 | 1.00 | 69.79 | | O |
| ANISOU | 4011 | O | VAL | B | 37 | 10097 | 8927 | 7494 | 186 | −892 | −852 | O |
| ATOM | 4012 | CB | VAL | B | 37 | 8.614 | 8.512 | 3.340 | 1.00 | 59.95 | | C |
| ANISOU | 4012 | CB | VAL | B | 37 | 8656 | 7675 | 6447 | 144 | −1005 | −748 | C |
| ATOM | 4013 | CG1 | VAL | B | 37 | 9.004 | 9.564 | 2.298 | 1.00 | 56.09 | | C |
| ANISOU | 4013 | CG1 | VAL | B | 37 | 8233 | 7214 | 5864 | 165 | −999 | −682 | C |
| ATOM | 4014 | CG2 | VAL | B | 37 | 7.591 | 9.084 | 4.317 | 1.00 | 61.95 | | C |
| ANISOU | 4014 | CG2 | VAL | B | 37 | 8796 | 7908 | 6835 | 118 | −1066 | −734 | C |
| ATOM | 4015 | N | ASP | B | 38 | 8.741 | 6.637 | 0.425 | 1.00 | 65.38 | | N |
| ANISOU | 4015 | N | ASP | B | 38 | 9651 | 8375 | 6813 | 176 | −1068 | −847 | N |
| ATOM | 4016 | CA | ASP | B | 38 | 9.637 | 6.174 | −0.619 | 1.00 | 68.16 | | C |
| ANISOU | 4016 | CA | ASP | B | 38 | 10132 | 8746 | 7018 | 212 | −1005 | −863 | C |
| ATOM | 4017 | C | ASP | B | 38 | 9.837 | 7.275 | −1.645 | 1.00 | 68.79 | | C |
| ANISOU | 4017 | C | ASP | B | 38 | 10277 | 8863 | 6999 | 233 | −1010 | −792 | C |
| ATOM | 4018 | O | ASP | B | 38 | 8.952 | 8.102 | −1.875 | 1.00 | 69.48 | | O |
| ANISOU | 4018 | O | ASP | B | 38 | 10344 | 8952 | 7103 | 217 | −1108 | −754 | O |
| ATOM | 4019 | CB | ASP | B | 38 | 9.097 | 4.929 | −1.312 | 1.00 | 78.35 | | C |
| ANISOU | 4019 | CB | ASP | B | 38 | 11522 | 10014 | 8234 | 206 | −1077 | −949 | C |
| ATOM | 4020 | CG | ASP | B | 38 | 9.012 | 3.747 | −0.385 | 1.00 | 88.56 | | C |
| ANISOU | 4020 | CG | ASP | B | 38 | 12765 | 11267 | 9616 | 188 | −1061 | −1017 | C |
| ATOM | 4021 | OD1 | ASP | B | 38 | 10.052 | 3.364 | 0.195 | 1.00 | 96.58 | | O |
| ANISOU | 4021 | OD1 | ASP | B | 38 | 13757 | 12284 | 10656 | 210 | −940 | −1021 | O |
| ATOM | 4022 | OD2 | ASP | B | 38 | 7.900 | 3.212 | −0.228 | 1.00 | 92.73 | | O |
| ANISOU | 4022 | OD2 | ASP | B | 38 | 13273 | 11764 | 10196 | 151 | −1170 | −1063 | O |
| ATOM | 4023 | N | LEU | B | 39 | 11.013 | 7.277 | −2.254 | 1.00 | 73.74 | | N |
| ANISOU | 4023 | N | LEU | B | 39 | 10979 | 9516 | 7524 | 272 | −901 | −770 | N |
| ATOM | 4024 | CA | LEU | B | 39 | 11.330 | 8.184 | −3.344 | 1.00 | 83.18 | | C |
| ANISOU | 4024 | CA | LEU | B | 39 | 12255 | 10747 | 8604 | 297 | −890 | −703 | C |
| ATOM | 4025 | C | LEU | B | 39 | 11.363 | 7.393 | −4.647 | 1.00 | 90.38 | | C |
| ANISOU | 4025 | C | LEU | B | 39 | 13328 | 11668 | 9346 | 324 | −909 | −752 | C |

TABLE 14-continued

| | | | | | | | | | | | | |
|---|---|---|---|---|---|---|---|---|---|---|---|---|
| ATOM | 4026 | O | LEU | B | 39 | 12.045 | 6.366 | −4.734 | 1.00 | 97.16 | | O |
| ANISOU | 4026 | O | LEU | B | 39 | 14240 | 12521 | 10156 | 347 | −833 | −809 | O |
| ATOM | 4027 | CB | LEU | B | 39 | 12.657 | 8.891 | −3.085 | 1.00 | 78.80 | | C |
| ANISOU | 4027 | CB | LEU | B | 39 | 11662 | 10217 | 8061 | 321 | −745 | −630 | C |
| ATOM | 4028 | CG | LEU | B | 39 | 12.594 | 9.867 | −1.907 | 1.00 | 75.29 | | C |
| ANISOU | 4028 | CG | LEU | B | 39 | 11072 | 9762 | 7771 | 294 | −738 | −576 | C |
| ATOM | 4029 | CD1 | LEU | B | 39 | 13.986 | 10.373 | −1.525 | 1.00 | 69.00 | | C |
| ANISOU | 4029 | CD1 | LEU | B | 39 | 10231 | 8985 | 7001 | 311 | −595 | −516 | C |
| ATOM | 4030 | CD2 | LEU | B | 39 | 11.685 | 11.025 | −2.256 | 1.00 | 69.50 | | C |
| ANISOU | 4030 | CD2 | LEU | B | 39 | 10329 | 9030 | 7048 | 278 | −840 | −519 | C |
| ATOM | 4031 | N | LEU | B | 40 | 10.617 | 7.869 | −5.645 | 1.00 | 87.66 | | N |
| ANISOU | 4031 | N | LEU | B | 40 | 13061 | 11337 | 8910 | 322 | −1014 | −732 | N |
| ATOM | 4032 | CA | LEU | B | 40 | 10.325 | 7.125 | −6.865 | 1.00 | 85.55 | | C |
| ANISOU | 4032 | CA | LEU | B | 40 | 12949 | 11073 | 8482 | 338 | −1074 | −789 | C |
| ATOM | 4033 | C | LEU | B | 40 | 10.998 | 7.763 | −8.070 | 1.00 | 86.76 | | C |
| ANISOU | 4033 | C | LEU | B | 40 | 13220 | 11271 | 8475 | 381 | −1018 | −727 | C |
| ATOM | 4034 | O | LEU | B | 40 | 10.808 | 8.956 | −8.335 | 1.00 | 89.68 | | O |
| ANISOU | 4034 | O | LEU | B | 40 | 13571 | 11662 | 8842 | 379 | −1046 | −640 | O |
| ATOM | 4035 | CB | LEU | B | 40 | 8.818 | 7.063 | −7.111 | 1.00 | 85.38 | | C |
| ANISOU | 4035 | CB | LEU | B | 40 | 12933 | 11032 | 8477 | 299 | −1260 | −820 | C |
| ATOM | 4036 | CG | LEU | B | 40 | 8.013 | 6.368 | −6.020 | 1.00 | 84.30 | | C |
| ANISOU | 4036 | CG | LEU | B | 40 | 12687 | 10851 | 8493 | 254 | −1326 | −882 | C |
| ATOM | 4037 | CD1 | LEU | B | 40 | 6.617 | 6.051 | −6.512 | 1.00 | 84.11 | | C |
| ANISOU | 4037 | CD1 | LEU | B | 40 | 12695 | 10808 | 8455 | 219 | −1506 | −925 | C |
| ATOM | 4038 | CD2 | LEU | B | 40 | 8.737 | 5.111 | −5.560 | 1.00 | 84.25 | | C |
| ANISOU | 4038 | CD2 | LEU | B | 40 | 12694 | 10820 | 8497 | 265 | −1231 | −958 | C |
| ATOM | 4039 | N | LYS | B | 41 | 11.758 | 6.961 | −8.811 | 1.00 | 86.20 | | N |
| ANISOU | 4039 | N | LYS | B | 41 | 13274 | 11211 | 8267 | 422 | −939 | −770 | N |
| ATOM | 4040 | CA | LYS | B | 41 | 12.271 | 7.340 | −10.122 | 1.00 | 87.66 | | C |
| ANISOU | 4040 | CA | LYS | B | 41 | 13600 | 11436 | 8269 | 466 | −896 | −727 | C |
| ATOM | 4041 | C | LYS | B | 11 | 11.524 | 6.515 | −11.160 | 1.00 | 86.04 | | C |
| ANISOU | 4041 | C | LYS | B | 41 | 13549 | 11223 | 7920 | 469 | −1012 | −809 | C |
| ATOM | 4042 | O | LYS | B | 41 | 11.656 | 5.285 | −11.192 | 1.00 | 78.84 | | O |
| ANISOU | 4042 | O | LYS | B | 41 | 12698 | 10284 | 6973 | 478 | −996 | −905 | O |
| ATOM | 4043 | CB | LYS | B | 41 | 13.776 | 7.113 | −10.226 | 1.00 | 87.08 | | C |
| ANISOU | 4043 | CB | LYS | B | 41 | 13558 | 11386 | 8144 | 517 | −705 | −707 | C |
| ATOM | 4044 | CG | LYS | B | 41 | 14.368 | 7.595 | −11.540 | 1.00 | 91.37 | | C |
| ANISOU | 4044 | CG | LYS | B | 41 | 14239 | 11976 | 8502 | 565 | −642 | −649 | C |
| ATOM | 4045 | CD | LYS | B | 41 | 15.893 | 7.536 | −11.529 | 1.00 | 93.76 | | C |
| ANISOU | 4045 | CD | LYS | B | 41 | 14541 | 12303 | 8779 | 614 | −441 | −611 | C |
| ATOM | 4046 | CE | LYS | B | 11 | 16.395 | 6.121 | −11.795 | 1.00 | 92.13 | | C |
| ANISOU | 4046 | CE | LYS | B | 41 | 14430 | 12083 | 8493 | 654 | −372 | −711 | C |
| ATOM | 4047 | NZ | LYS | B | 41 | 17.590 | 5.780 | −10.976 | 1.00 | 90.22 | | N |
| ANISOU | 4047 | NZ | LYS | B | 41 | 14096 | 11839 | 8346 | 676 | −210 | −702 | N |
| ATOM | 4048 | N | ASN | B | 42 | 10.737 | 7.192 | −12.000 | 1.00 | 86.47 | | N |
| ANISOU | 4048 | N | ASN | B | 42 | 13666 | 11296 | 7891 | 461 | −1132 | −770 | N |
| ATOM | 4049 | CA | ASN | B | 42 | 9.956 | 6.539 | −13.051 | 1.00 | 86.86 | | C |
| ANISOU | 4049 | CA | ASN | B | 42 | 13866 | 11341 | 7795 | 460 | −1262 | −841 | C |
| ATOM | 4050 | C | ASN | B | 42 | 9.015 | 5.488 | −12.475 | 1.00 | 92.84 | | C |
| ANISOU | 4050 | C | ASN | B | 42 | 14584 | 12046 | 8646 | 413 | −1380 | −947 | C |
| ATOM | 4051 | O | ASN | B | 42 | 8.713 | 4.485 | −13.127 | 1.00 | 97.81 | | O |
| ANISOU | 4051 | O | ASN | B | 42 | 15338 | 12656 | 9170 | 415 | −1443 | −1039 | O |
| ATOM | 4052 | CB | ASN | B | 42 | 10.861 | 5.914 | −14.114 | 1.00 | 82.20 | | C |
| ANISOU | 4052 | CB | ASN | B | 42 | 13455 | 10773 | 7005 | 519 | −1161 | −876 | C |
| ATOM | 4053 | CG | ASN | B | 42 | 11.942 | 6.861 | −14.581 | 1.00 | 82.49 | | C |
| ANISOU | 4053 | CG | ASN | B | 42 | 13518 | 10861 | 6964 | 568 | −1016 | −768 | C |
| ATOM | 4054 | OD1 | ASN | B | 42 | 11.691 | 8.051 | −14.779 | 1.00 | 81.08 | | O |
| ANISOU | 4054 | OD1 | ASN | B | 42 | 13307 | 10708 | 6792 | 560 | −1052 | −670 | O |
| ATOM | 4055 | ND2 | ASN | B | 42 | 13.160 | 6.347 | −14.736 | 1.00 | 81.94 | | N |
| ANISOU | 4055 | ND2 | ASN | B | 42 | 13503 | 10803 | 6829 | 618 | −846 | −782 | N |
| ATOM | 4056 | N | GLY | B | 43 | 8.548 | 5.706 | −11.247 | 1.00 | 89.54 | | N |
| ANISOU | 4056 | N | GLY | B | 43 | 13993 | 11601 | 8426 | 370 | −1409 | −934 | N |
| ATOM | 4057 | CA | GLY | B | 43 | 7.674 | 4.767 | −10.581 | 1.00 | 88.13 | | C |
| ANISOU | 4057 | CA | GLY | B | 43 | 13756 | 11372 | 8356 | 322 | −1509 | −1022 | C |
| ATOM | 4058 | C | GLY | B | 43 | 8.381 | 3.663 | −9.828 | 1.00 | 88.77 | | C |
| ANISOU | 4058 | C | GLY | B | 43 | 13811 | 11420 | 8497 | 329 | −1398 | −1093 | C |
| ATOM | 4059 | O | GLY | B | 43 | 7.738 | 2.979 | −9.021 | 1.00 | 85.88 | | O |
| ANISOU | 4059 | O | GLY | B | 43 | 13365 | 11010 | 8257 | 287 | −1459 | −1151 | O |
| ATOM | 4060 | N | GLU | B | 44 | 9.676 | 3.463 | −10.067 | 1.00 | 96.18 | | N |
| ANISOU | 4060 | N | GLU | B | 44 | 14813 | 12377 | 9354 | 383 | −1236 | −1087 | N |
| ATOM | 4061 | CA | GLU | B | 44 | 10.466 | 2.478 | −9.341 | 1.00 | 100.31 | | C |
| ANISOU | 4061 | CA | GLU | B | 44 | 15305 | 12871 | 9936 | 398 | −1117 | −1143 | C |
| ATOM | 4062 | C | GLU | B | 44 | 11.180 | 3.156 | −8.178 | 1.00 | 104.06 | | C |
| ANISOU | 4062 | C | GLU | B | 44 | 15620 | 13359 | 10559 | 399 | −1000 | −1069 | C |
| ATOM | 4063 | O | GLU | B | 44 | 11.666 | 4.285 | −8.303 | 1.00 | 109.17 | | O |
| ANISOU | 4063 | O | GLU | B | 44 | 16238 | 14048 | 11194 | 416 | −941 | −974 | O |
| ATOM | 4064 | CB | GLU | B | 44 | 11.476 | 1.806 | −10.271 | 1.00 | 103.16 | | C |
| ANISOU | 4064 | CB | GLU | B | 44 | 15826 | 13243 | 10127 | 460 | −1006 | −1183 | C |
| ATOM | 4065 | CG | GLU | B | 44 | 10.841 | 1.070 | −11.450 | 1.00 | 110.91 | | C |
| ANISOU | 4065 | CG | GLU | B | 44 | 16985 | 14208 | 10947 | 462 | −1118 | −1267 | C |

TABLE 14-continued

| | | | | | | | | | | | | |
|---|---|---|---|---|---|---|---|---|---|---|---|---|
| ATOM | 4066 | CD | GLU | B | 44 | 11.873 | 0.532 | −12.430 | 1.00 | 125.38 | | C |
| ANISOU | 4066 | CD | GLU | B | 44 | 18985 | 16056 | 12597 | 533 | −997 | −1300 | C |
| ATOM | 4067 | OE1 | GLU | B | 44 | 13.072 | 0.859 | −12.274 | 1.00 | 129.48 | | O |
| ANISOU | 4067 | OE1 | GLU | B | 44 | 19478 | 16607 | 13112 | 581 | −826 | −1242 | O |
| ATOM | 4068 | OE2 | GLU | B | 44 | 11.481 | −0.215 | −13.357 | 1.00 | 133.40 | | O |
| ANISOU | 4068 | OE2 | GLU | B | 44 | 20160 | 17053 | 13474 | 541 | −1073 | −1383 | O |
| ATOM | 4069 | N | ARG | B | 45 | 11.244 | 2.476 | −7.039 | 1.00 | 98.54 | | N |
| ANISOU | 4069 | N | ARG | B | 45 | 14819 | 12623 | 9998 | 378 | −969 | −1109 | N |
| ATOM | 4070 | CA | ARG | B | 45 | 11.781 | 3.077 | −5.791 | 1.00 | 98.32 | | C |
| ANISOU | 4070 | CA | ARG | B | 45 | 14631 | 12603 | 10124 | 371 | −879 | −1046 | C |
| ATOM | 4071 | C | ARG | B | 45 | 13.304 | 3.019 | −5.674 | 1.00 | 92.73 | | C |
| ANISOU | 4071 | C | ARG | B | 45 | 13924 | 11918 | 9391 | 422 | −696 | −1016 | C |
| ATOM | 4072 | O | ARG | B | 45 | 13.877 | 1.942 | −5.782 | 1.00 | 93.97 | | O |
| ANISOU | 4072 | O | ARG | B | 45 | 14143 | 12055 | 9505 | 452 | −627 | −1079 | O |
| ATOM | 4073 | CB | ARG | B | 45 | 11.159 | 2.380 | −4.583 | 1.00 | 101.26 | | C |
| ANISOU | 4073 | CB | ARG | B | 45 | 14892 | 12928 | 10655 | 327 | −927 | −1098 | C |
| ATOM | 4074 | CG | ARG | B | 45 | 11.905 | 1.140 | −4.117 | 1.00 | 105.91 | | C |
| ANISOU | 4074 | CG | ARG | B | 45 | 15491 | 13486 | 11265 | 348 | −830 | −1163 | C |
| ATOM | 4075 | CD | ARG | B | 45 | 11.230 | 0.543 | −2.897 | 1.00 | 108.42 | | C |
| ANISOU | 4075 | CD | ARG | B | 45 | 15694 | 13758 | 11742 | 302 | −881 | −1203 | C |
| ATOM | 4076 | NE | ARG | B | 45 | 11.198 | 1.559 | −1.872 | 1.00 | 112.52 | | N |
| ANISOU | 4076 | NE | ARG | B | 45 | 16064 | 14296 | 12391 | 281 | −864 | −1127 | N |
| ATOM | 4077 | CZ | ARG | B | 45 | 12.235 | 1.868 | −1.116 | 1.00 | 114.37 | | C |
| ANISOU | 4077 | CZ | ARG | B | 45 | 16222 | 14549 | 12686 | 302 | −739 | −1081 | C |
| ATOM | 4078 | NH1 | ARG | B | 45 | 13.361 | 1.197 | −1.254 | 1.00 | 118.50 | | N |
| ANISOU | 4078 | NH1 | ARG | B | 45 | 16793 | 15073 | 13157 | 346 | −619 | −1100 | N |
| ATOM | 4079 | NH2 | ARG | B | 45 | 12.141 | 2.826 | −0.212 | 1.00 | 105.97 | | N |
| ANISOU | 4079 | NH2 | ARG | B | 45 | 15031 | 13498 | 11733 | 281 | −735 | −1018 | N |
| ATOM | 4080 | N | ILE | B | 46 | 13.907 | 4.164 | −5.372 | 1.00 | 81.95 | | N |
| ANISOU | 4080 | N | ILE | B | 46 | 12481 | 10588 | 8069 | 429 | −624 | −920 | N |
| ATOM | 4081 | CA | ILE | B | 46 | 15.372 | 4.287 | −5.159 | 1.00 | 75.58 | | C |
| ANISOU | 4081 | CA | ILE | B | 46 | 11649 | 9807 | 7263 | 471 | −452 | −873 | C |
| ATOM | 4082 | C | ILE | B | 46 | 15.683 | 3.540 | −3.867 | 1.00 | 82.21 | | C |
| ANISOU | 4082 | C | ILE | B | 46 | 12379 | 10615 | 8241 | 459 | −403 | −911 | C |
| ATOM | 4083 | O | ILE | B | 46 | 14.885 | 3.653 | −2.954 | 1.00 | 85.88 | | O |
| ANISOU | 4083 | O | ILE | B | 46 | 12745 | 11055 | 8830 | 413 | −484 | −920 | O |
| ATOM | 4084 | CB | ILE | B | 46 | 15.722 | 5.777 | −5.078 | 1.00 | 70.04 | | C |
| ANISOU | 4084 | CB | ILE | B | 46 | 10877 | 9142 | 6593 | 465 | −417 | −760 | C |
| ATOM | 4085 | CG1 | ILE | B | 46 | 15.155 | 6.513 | −6.288 | 1.00 | 67.46 | | C |
| ANISOU | 4085 | CG1 | ILE | B | 46 | 10652 | 8840 | 6140 | 469 | −494 | −723 | C |
| ATOM | 4086 | CG2 | ILE | B | 46 | 17.215 | 5.986 | −4.939 | 1.00 | 70.55 | | C |
| ANISOU | 4086 | CG2 | ILE | B | 46 | 10912 | 9236 | 6659 | 504 | −247 | −703 | C |
| ATOM | 4087 | CD1 | ILE | B | 46 | 15.034 | 7.991 | −6.120 | 1.00 | 67.76 | | C |
| ANISOU | 4087 | CD1 | ILE | B | 46 | 10614 | 8898 | 6234 | 449 | −513 | −621 | C |
| ATOM | 4088 | N | GLU | B | 47 | 16.788 | 2.799 | −3.797 | 1.00 | 89.19 | | N |
| ANISOU | 4088 | N | GLU | B | 47 | 13283 | 11499 | 9105 | 502 | −274 | −930 | N |
| ATOM | 4089 | CA | GLU | B | 47 | 17.045 | 2.005 | −2.566 | 1.00 | 100.99 | | C |
| ANISOU | 4089 | CA | GLU | B | 47 | 14680 | 12961 | 10730 | 493 | −235 | −968 | C |
| ATOM | 4090 | C | GLU | B | 47 | 17.856 | 2.798 | −1.542 | 1.00 | 119.11 | | C |
| ANISOU | 4090 | C | GLU | B | 47 | 16833 | 15280 | 13144 | 486 | −150 | −888 | C |
| ATOM | 4091 | O | GLU | B | 47 | 17.447 | 2.838 | −0.391 | 1.00 | 129.85 | | O |
| ANISOU | 4091 | O | GLU | B | 47 | 18081 | 16619 | 14637 | 448 | −191 | −891 | O |
| ATOM | 4092 | CB | GLU | B | 47 | 17.743 | 0.681 | −2.866 | 1.00 | 98.10 | | C |
| ANISOU | 4092 | CB | GLU | B | 47 | 14396 | 12574 | 10302 | 541 | −150 | −1036 | C |
| ATOM | 4093 | CG | GLU | m | 47 | 17.051 | −0.526 | −2.244 | 1.00 | 106.79 | | C |
| ANISOU | 4093 | CG | GLU | B | 47 | 15488 | 13616 | 11473 | 516 | −218 | −1127 | C |
| ATOM | 4094 | CD | GLU | B | 47 | 17.094 | −0.674 | −0.726 | 0.00 | 125.87 | | C |
| ANISOU | 4094 | CD | GLU | B | 47 | 17752 | 16012 | 14060 | 487 | −205 | −1117 | C |
| ATOM | 4095 | OE1 | GLU | E | 47 | 17.052 | 0.353 | −0.035 | 1.00 | 130.45 | | O |
| ANISOU | 4095 | OE1 | GLU | E | 47 | 18221 | 16616 | 14727 | 459 | −213 | −1049 | O |
| ATOM | 4096 | OE2 | GLU | B | 47 | 17.149 | −1.823 | −0.226 | 1.00 | 130.06 | | O |
| ANISOU | 4096 | OE2 | GLU | B | 47 | 18280 | 16500 | 14636 | 493 | −189 | −1179 | O |
| ATOM | 4097 | N | LYS | B | 48 | 18.970 | 3.391 | −1.943 | 1.00 | 113.03 | | N |
| ANISOU | 4097 | N | LYS | B | 48 | 16069 | 14551 | 12328 | 522 | −35 | −818 | N |
| ATOM | 4098 | CA | LYS | B | 48 | 19.800 | 4.113 | −0.950 | 1.00 | 110.28 | | C |
| ANISOU | 4098 | CA | LYS | B | 48 | 15584 | 14221 | 12098 | 513 | 43 | −744 | C |
| ATOM | 4099 | C | LYS | B | 48 | 19.121 | 5.434 | −0.593 | 1.00 | 107.80 | | C |
| ANISOU | 4099 | C | LYS | B | 48 | 15195 | 13914 | 11849 | 464 | −40 | −685 | C |
| ATOM | 4100 | O | LYS | B | 48 | 19.489 | 6.441 | −1.202 | 1.00 | 115.00 | | O |
| ANISOU | 4100 | O | LYS | B | 48 | 16124 | 14857 | 12712 | 471 | −9 | −610 | O |
| ATOM | 4101 | CB | LYS | B | 48 | 21.191 | 4.365 | −1.533 | 1.00 | 112.18 | | C |
| ANISOU | 4101 | CB | LYS | B | 48 | 15848 | 14502 | 12274 | 563 | 190 | −682 | C |
| ATOM | 4102 | CG | LYS | B | 48 | 22.050 | 3.123 | −1.724 | 1.00 | 112.86 | | C |
| ANISOU | 4102 | CG | LYS | B | 48 | 15984 | 14580 | 12315 | 619 | 296 | −730 | C |
| ATOM | 4103 | CD | LYS | B | 48 | 22.927 | 3.209 | −2.952 | 1.00 | 113.55 | | C |
| ANISOU | 4103 | CD | LYS | B | 48 | 16174 | 14705 | 12265 | 678 | 405 | −695 | C |
| ATOM | 4104 | CE | LYS | B | 48 | 23.470 | 1.869 | −3.396 | 1.00 | 110.85 | | C |
| ANISOU | 4104 | CE | LYS | B | 48 | 15923 | 14348 | 11849 | 739 | 487 | −765 | C |
| ATOM | 4105 | NZ | LYS | B | 48 | 24.886 | 1.691 | −2.990 | 1.00 | 107.74 | | N |
| ANISOU | 4105 | NZ | LYS | B | 48 | 15455 | 13975 | 11509 | 782 | 641 | −717 | N |

TABLE 14-continued

| | | | | | | | | | | | | |
|---|---|---|---|---|---|---|---|---|---|---|---|---|
| ATOM | 4106 | N | VAL | B | 49 | 18.184 | 5.411 | 0.359 | 1.00 | 91.58 | | N |
| ANISOU | 4106 | N | VAL | B | 49 | 13063 | 11829 | 9903 | 419 | −135 | −715 | N |
| ATOM | 4107 | CA | VAL | B | 49 | 17.430 | 6.633 | 0.760 | 1.00 | 77.25 | | C |
| ANISOU | 4107 | CA | VAL | B | 49 | 11177 | 10015 | 8160 | 376 | −219 | −665 | C |
| ATOM | 4108 | C | VAL | B | 49 | 17.541 | 6.817 | 2.272 | 1.00 | 68.48 | | C |
| ANISOU | 4108 | C | VAL | B | 49 | 9926 | 8889 | 7203 | 346 | −208 | −656 | C |
| ATOM | 4109 | O | VAL | B | 49 | 17.176 | 5.909 | 2.999 | 1.00 | 62.22 | | O |
| ANISOU | 4109 | O | VAL | B | 49 | 9101 | 8069 | 6469 | 336 | −233 | −716 | O |
| ATOM | 4110 | CB | VAL | B | 49 | 15.957 | 6.566 | 0.329 | 1.00 | 72.07 | | C |
| ANISOU | 4110 | CB | VAL | B | 49 | 10570 | 9338 | 7476 | 350 | −363 | −708 | C |
| ATOM | 4111 | CG1 | VAL | B | 49 | 15.162 | 7.710 | 0.913 | 1.00 | 68.55 | | C |
| ANISOU | 4111 | CG1 | VAL | B | 49 | 10036 | 8886 | 7124 | 310 | −444 | −663 | C |
| ATOM | 4112 | CG2 | VAL | B | 49 | 15.819 | 6.563 | −1.174 | 1.00 | 71.64 | | C |
| ANISOU | 4112 | CG2 | VAL | B | 49 | 10657 | 9302 | 7263 | 376 | −386 | −709 | C |
| ATOM | 4113 | N | GLU | B | 50 | 17.998 | 7.985 | 2.700 | 1.00 | 60.26 | | N |
| ANISOU | 4113 | N | GLU | B | 50 | 8810 | 7865 | 6223 | 332 | −177 | −581 | N |
| ATOM | 4114 | CA | GLU | B | 50 | 18.171 | 8.213 | 4.148 | 1.00 | 65.43 | | C |
| ANISOU | 4114 | CA | GLU | B | 50 | 9338 | 8506 | 7016 | 305 | −166 | −571 | C |
| ATOM | 4115 | C | GLU | B | 50 | 17.148 | 9.234 | 4.625 | 1.00 | 68.63 | | C |
| ANISOU | 4115 | C | GLU | B | 50 | 9688 | 8896 | 7494 | 266 | −262 | −550 | C |
| ATOM | 4116 | O | GLU | B | 50 | 16.644 | 9.993 | 3.810 | 1.00 | 66.52 | | O |
| ANISOU | 4116 | O | GLU | B | 50 | 9468 | 8634 | 7174 | 264 | −312 | −518 | O |
| ATOM | 4117 | CB | GLU | B | 50 | 19.587 | 8.683 | 4.432 | 1.00 | 68.50 | | C |
| ANISOU | 4117 | CB | GLU | B | 50 | 9674 | 8921 | 7433 | 317 | −51 | −508 | C |
| ATOM | 4118 | CG | GLU | B | 50 | 20.625 | 7.811 | 3.776 | 1.00 | 73.08 | | C |
| ANISOU | 4118 | CG | GLU | B | 50 | 10314 | 9520 | 7933 | 364 | 52 | −516 | C |
| ATOM | 4119 | CD | GLU | B | 50 | 22.038 | 8.024 | 4.278 | 0.13 | 73.89 | | C |
| ANISOU | 4119 | CD | GLU | B | 50 | 10341 | 9645 | 8088 | 375 | 166 | −461 | C |
| ATOM | 4120 | OE1 | GLU | B | 50 | 22.637 | 9.046 | 3.913 | 1.00 | 77.65 | | O |
| ANISOU | 4120 | OE1 | GLU | B | 50 | 10804 | 10144 | 8555 | 372 | 208 | −384 | O |
| ATOM | 4121 | OE2 | GLU | B | 50 | 22.528 | 7.167 | 5.031 | 1.00 | 72.61 | | O |
| ANISOU | 4121 | OE2 | GLU | B | 50 | 10133 | 9476 | 7978 | 387 | 209 | −492 | O |
| ATOM | 4122 | N | HIS | B | 51 | 16.889 | 9.228 | 5.922 | 1.00 | 67.76 | | N |
| ANISOU | 4122 | N | HIS | B | 51 | 9481 | 8766 | 7499 | 241 | −281 | −566 | N |
| ATOM | 4123 | CA | HIS | B | 51 | 15.920 | 10.133 | 6.517 | 1.00 | 60.35 | | C |
| ANISOU | 4123 | CA | HIS | B | 51 | 8483 | 7808 | 6639 | 209 | −363 | −552 | C |
| ATOM | 4124 | C | HIS | B | 51 | 16.460 | 10.708 | 7.824 | 1.00 | 59.11 | | C |
| ANISOU | 4124 | C | HIS | B | 51 | 8221 | 7647 | 6593 | 191 | −323 | −525 | C |
| ATOM | 4125 | O | HIS | B | 51 | 17.378 | 10.163 | 8.450 | 1.00 | 53.83 | | O |
| ANISOU | 4125 | C | HIS | B | 51 | 7515 | 6985 | 5952 | 198 | −251 | −532 | O |
| ATOM | 4126 | CB | HIS | B | 51 | 14.581 | 9.437 | 6.730 | 1.00 | 63.03 | | C |
| ANISOU | 4126 | CB | HIS | B | 51 | 8825 | 8121 | 7002 | 195 | −459 | −616 | C |
| ATOM | 4127 | CG | HIS | B | 51 | 14.615 | 8.323 | 7.732 | 1.00 | 68.56 | | C |
| ANISOU | 4127 | CG | HIS | B | 51 | 9480 | 8806 | 7765 | 190 | −438 | −672 | C |
| ATOM | 4128 | ND1 | HIS | B | 51 | 14.330 | 8.516 | 9.067 | 1.00 | 67.56 | | N |
| ANISOU | 4128 | ND1 | HIS | B | 51 | 9256 | 8663 | 7748 | 168 | −448 | −676 | N |
| ATOM | 4129 | CD2 | HIS | B | 51 | 14.850 | 6.997 | 7.586 | 1.00 | 68.20 | | C |
| ANISOU | 4129 | CD2 | HIS | B | 51 | 9476 | 8754 | 7683 | 206 | −411 | −726 | C |
| ATOM | 4130 | CE1 | HIS | B | 51 | 14.399 | 7.361 | 9.702 | 1.00 | 69.27 | | C |
| ANISOU | 4130 | CE1 | HIS | B | 51 | 9456 | 8868 | 7995 | 170 | −427 | −725 | C |
| ATOM | 4131 | NE2 | HIS | B | 51 | 14.717 | 6.423 | 8.828 | 1.00 | 69.95 | | N |
| ANISOU | 4131 | NE2 | HIS | B | 51 | 9624 | 8958 | 7998 | 192 | −405 | −756 | N |
| ATOM | 4132 | N | SER | B | 52 | 15.891 | 11.848 | 8.205 | 1.00 | 49.54 | | N |
| ANISOU | 4132 | N | SER | B | 52 | 6963 | 6420 | 5440 | 168 | −374 | −492 | N |
| ATOM | 4133 | CA | SER | B | 52 | 16.287 | 12.539 | 9.418 | 1.00 | 53.73 | | C |
| ANISOU | 4133 | CA | SER | B | 52 | 7403 | 6941 | 6071 | 149 | −350 | −469 | C |
| ATOM | 4134 | C | SER | B | 52 | 15.721 | 11.828 | 10.641 | 1.00 | 46.57 | | C |
| ANISOU | 4134 | C | SER | B | 52 | 6437 | 6015 | 5241 | 137 | −375 | −525 | C |
| ATOM | 4135 | O | SER | B | 52 | 14.913 | 10.906 | 10.550 | 1.00 | 43.83 | | O |
| ANISOU | 4135 | C | SER | B | 52 | 6112 | 5659 | 4881 | 140 | −418 | −578 | O |
| ATOM | 4136 | CB | SER | B | 52 | 15.803 | 13.986 | 9.392 | 1.00 | 54.55 | | C |
| ANISOU | 4136 | CB | SER | B | 52 | 7488 | 7028 | 6211 | 132 | −397 | −420 | C |
| ATOM | 4137 | OG | SER | B | 52 | 14.375 | 13.996 | 9.326 | 1.00 | 49.80 | | O |
| ANISOU | 4137 | OG | SER | B | 52 | 6893 | 6407 | 5624 | 128 | −491 | −449 | O |
| ATOM | 4138 | N | ASP | B | 53 | 16.162 | 12.278 | 11.804 | 1.00 | 42.53 | | N |
| ANISOU | 4138 | N | ASP | B | 53 | 5852 | 5498 | 4811 | 122 | −348 | −513 | N |
| ATOM | 4139 | CA | ASP | B | 53 | 15.707 | 11.703 | 13.057 | 1.00 | 40.16 | | C |
| ANISOU | 4139 | CA | ASP | B | 53 | 5494 | 5183 | 4583 | 112 | −364 | −559 | C |
| ATOM | 4140 | C | ASP | B | 53 | 14.359 | 12.287 | 13.425 | 1.00 | 42.65 | | C |
| ANISOU | 4140 | C | ASP | B | 53 | 5783 | 5472 | 4950 | 99 | −443 | −570 | C |
| ATOM | 4141 | O | ASP | B | 53 | 14.145 | 13.491 | 13.303 | 1.00 | 47.79 | | O |
| ANISOU | 4141 | O | ASP | B | 53 | 6425 | 6111 | 5620 | 92 | −468 | −532 | O |
| ATOM | 4142 | CB | ASP | B | 53 | 16.730 | 11.982 | 14.146 | 1.00 | 39.96 | | C |
| ANISOU | 4142 | CB | ASP | B | 53 | 5404 | 5163 | 4616 | 103 | −307 | −540 | C |
| ATOM | 4143 | CG | ASP | B | 53 | 18.018 | 11.276 | 13.878 | 1.00 | 47.31 | | C |
| ANISOU | 4143 | CG | ASP | B | 53 | 6347 | 6120 | 5509 | 119 | −229 | −529 | C |
| ATOM | 4144 | OD1 | ASP | B | 53 | 17.949 | 10.047 | 13.653 | 1.00 | 49.78 | | O |
| ANISOU | 4144 | OD1 | ASP | B | 53 | 6690 | 6437 | 5787 | 137 | −216 | −569 | O |
| ATOM | 4145 | OD2 | ASP | B | 53 | 19.061 | 11.952 | 13.846 | 1.00 | 51.69 | | O |
| ANISOU | 4145 | OD2 | ASP | B | 53 | 6882 | 6689 | 6070 | 114 | −182 | −480 | O |

TABLE 14-continued

| | | | | | | | | | | | | |
|---|---|---|---|---|---|---|---|---|---|---|---|---|
| ATOM | 4146 | N | LEU | B | 54 | 13.443 | 11.426 | 13.838 | 1.00 | 45.84 | | N |
| ANISOU | 4146 | N | LEU | B | 54 | 6175 | 5864 | 5379 | 97 | −480 | −620 | N |
| ATOM | 4147 | CA | LEU | B | 54 | 12.084 | 11.869 | 14.113 | 1.00 | 41.27 | | C |
| ANISOU | 4147 | CA | LEU | B | 54 | 5569 | 5263 | 4851 | 89 | −554 | −630 | C |
| ATOM | 4148 | C | LEU | B | 54 | 12.097 | 13.016 | 15.118 | 1.00 | 46.04 | | C |
| ANISOU | 4148 | C | LEU | B | 54 | 6112 | 5851 | 5529 | 80 | −548 | −606 | C |
| ATOM | 4149 | O | LEU | B | 54 | 12.664 | 12.905 | 16.211 | 1.00 | 40.31 | | O |
| ANISOU | 4149 | O | LEU | B | 54 | 5344 | 5127 | 4846 | 74 | −505 | −615 | O |
| ATOM | 4150 | CB | LEU | B | 54 | 11.262 | 10.699 | 14.644 | 1.00 | 42.16 | | C |
| ANISOU | 4150 | CB | LEU | B | 54 | 5660 | 5364 | 4994 | 84 | −579 | −683 | C |
| ATOM | 4151 | CG | LEU | B | 54 | 9.774 | 10.974 | 14.860 | 1.00 | 48.93 | | C |
| ANISOU | 4151 | CG | LEU | B | 54 | 6484 | 6200 | 5907 | 77 | −654 | −695 | C |
| ATOM | 4152 | CD1 | LEU | B | 54 | 9.037 | 11.099 | 13.504 | 1.00 | 44.33 | | C |
| ANISOU | 4152 | CD1 | LEU | B | 54 | 5957 | 5617 | 5272 | 79 | −726 | −688 | C |
| ATOM | 4153 | CD2 | LEU | B | 54 | 9.155 | 9.918 | 15.729 | 1.00 | 41.50 | | C |
| ANISOU | 4153 | CD2 | LEU | B | 54 | 5502 | 5247 | 5018 | 69 | −658 | −738 | C |
| ATOM | 4154 | N | SER | B | 55 | 11.520 | 14.143 | 14.727 | 1.00 | 46.21 | | N |
| ANISOU | 4154 | N | SER | B | 55 | 6137 | 5858 | 5563 | 79 | −593 | −574 | N |
| ATOM | 4155 | CA | SER | B | 55 | 11.280 | 15.234 | 15.655 | 1.00 | 40.63 | | C |
| ANISOU | 4155 | CA | SER | B | 55 | 5380 | 5128 | 4931 | 74 | −599 | −559 | C |
| ATOM | 4156 | C | SER | B | 55 | 9.829 | 15.690 | 15.489 | 1.00 | 44.59 | | C |
| ANISOU | 4156 | C | SER | B | 55 | 5868 | 5607 | 5469 | 81 | −673 | −561 | C |
| ATOM | 4157 | O | SER | B | 55 | 9.063 | 15.108 | 14.721 | 1.00 | 42.83 | | O |
| ANISOU | 4157 | O | SER | B | 55 | 5669 | 5388 | 5215 | 85 | −722 | −574 | O |
| ATOM | 4158 | CB | SER | B | 55 | 12.263 | 16.376 | 15.418 | 1.00 | 39.95 | | C |
| ANISOU | 4158 | CB | SER | B | 55 | 5304 | 5038 | 4836 | 68 | −568 | −508 | C |
| ATOM | 4159 | OG | SER | B | 55 | 12.231 | 17.257 | 16.528 | 1.00 | 46.72 | | O |
| ANISOU | 4159 | OG | SER | B | 55 | 6115 | 5870 | 5768 | 61 | −564 | −505 | O |
| ATOM | 4160 | N | PHE | B | 56 | 9.449 | 16.750 | 16.202 | 1.00 | 41.49 | | N |
| ANISOU | 4160 | N | PHE | B | 56 | 5436 | 5187 | 5143 | 83 | −683 | −547 | N |
| ATOM | 4161 | CA | PHE | B | 56 | 8.062 | 17.202 | 16.139 | 1.00 | 43.07 | | C |
| ANISOU | 4161 | CA | PHE | B | 56 | 5613 | 5364 | 5389 | 94 | −748 | −546 | C |
| ATOM | 4162 | C | PHE | B | 56 | 7.964 | 18.679 | 16.472 | 1.00 | 43.11 | | C |
| ANISOU | 4162 | C | PHE | B | 56 | 5600 | 5335 | 5444 | 102 | −754 | −513 | C |
| ATOM | 4163 | O | PHE | B | 56 | 8.844 | 19.265 | 17.119 | 1.00 | 38.54 | | O |
| ANISOU | 4163 | O | PHE | B | 56 | 5015 | 4747 | 4883 | 93 | −708 | −505 | O |
| ATOM | 4164 | CB | PHE | B | 56 | 7.152 | 16.403 | 17.071 | 1.00 | 38.12 | | C |
| ANISOU | 4164 | CB | PHE | B | 56 | 4933 | 4733 | 4818 | 96 | −756 | −591 | C |
| ATOM | 4165 | CG | PHE | B | 56 | 7.657 | 16.313 | 18.486 | 1.00 | 43.52 | | C |
| ANISOU | 4165 | CG | PHE | B | 56 | 5579 | 5414 | 5544 | 93 | −697 | −615 | C |
| ATOM | 4166 | CD1 | PHE | B | 56 | 7.416 | 17.353 | 19.391 | 1.00 | 43.87 | | C |
| ANISOU | 4166 | CD1 | PHE | B | 56 | 5588 | 5430 | 5650 | 102 | −689 | −610 | C |
| ATOM | 4167 | CD2 | PHE | B | 56 | 8.365 | 15.195 | 18.916 | 1.00 | 33.01 | | C |
| ANISOU | 4167 | CD2 | PHE | B | 56 | 4249 | 4106 | 4189 | 83 | −652 | −643 | C |
| ATOM | 4168 | CE1 | PHE | B | 56 | 7.852 | 17.265 | 20.717 | 1.00 | 39.64 | | C |
| ANISOU | 4168 | CE1 | PHE | B | 56 | 5024 | 4892 | 5145 | 99 | −640 | −635 | C |
| ATOM | 4169 | CE2 | PHE | B | 56 | 8.809 | 15.089 | 20.229 | 1.00 | 39.55 | | C |
| ANISOU | 4169 | CE2 | PHE | B | 56 | 5043 | 4933 | 5051 | 80 | −604 | −663 | C |
| ATOM | 4170 | CZ | PHE | B | 56 | 8.586 | 16.127 | 21.128 | 1.00 | 40.54 | | C |
| ANISOU | 4170 | CZ | PHE | B | 56 | 5140 | 5034 | 5230 | 87 | −599 | −659 | C |
| ATOM | 4171 | N | SER | B | 57 | 6.841 | 19.251 | 16.058 | 1.00 | 47.36 | | N |
| ANISOU | 4171 | N | SER | B | 57 | 6129 | 5853 | 6012 | 117 | −815 | −495 | N |
| ATOM | 4172 | CA | SER | B | 57 | 6.575 | 20.671 | 16.167 | 1.00 | 54.76 | | C |
| ANISOU | 4172 | CA | SER | B | 57 | 7057 | 6752 | 6998 | 130 | −831 | −459 | C |
| ATOM | 4173 | C | SER | B | 57 | 5.875 | 20.992 | 17.485 | 1.00 | 49.16 | | C |
| ANISOU | 4173 | C | SER | B | 57 | 6288 | 6014 | 6377 | 144 | −821 | −488 | C |
| ATOM | 4174 | O | SER | B | 57 | 5.572 | 20.125 | 18.306 | 1.00 | 41.81 | | O |
| ANISOU | 4174 | O | SER | B | 57 | 5321 | 5096 | 5469 | 143 | −801 | −531 | O |
| ATOM | 4175 | CB | SER | B | 57 | 5.733 | 21.132 | 14.979 | 1.00 | 51.84 | | C |
| ANISOU | 4175 | CB | SER | B | 57 | 6710 | 6375 | 6612 | 145 | −903 | −420 | C |
| ATOM | 4176 | OG | SER | B | 57 | 6.392 | 20.783 | 13.776 | 1.00 | 60.20 | | O |
| ANISOU | 4176 | OG | SER | B | 57 | 7833 | 7464 | 7578 | 135 | −907 | −396 | O |
| ATOM | 4177 | N | LYS | B | 58 | 5.632 | 22.279 | 17.687 | 1.00 | 51.36 | | N |
| ANISOU | 4177 | N | LYS | B | 58 | 6559 | 6251 | 6704 | 159 | −830 | −462 | N |
| ATOM | 4178 | CA | LYS | B | 58 | 5.014 | 22.764 | 18.910 | 1.00 | 56.70 | | C |
| ANISOU | 4178 | CA | LYS | B | 58 | 7188 | 6895 | 7461 | 179 | −815 | −488 | C |
| ATOM | 4179 | C | LYS | B | 58 | 3.610 | 22.213 | 19.099 | 1.00 | 47.08 | | C |
| ANISOU | 4179 | C | LYS | B | 58 | 5918 | 5680 | 6288 | 200 | −848 | −507 | C |
| ATOM | 4180 | O | LYS | B | 58 | 3.168 | 22.067 | 20.243 | 1.00 | 50.79 | | O |
| ANISOU | 4180 | O | LYS | B | 58 | 6345 | 6142 | 6811 | 213 | −818 | −541 | O |
| ATOM | 4181 | CB | LYS | B | 58 | 4.993 | 24.297 | 18.905 | 1.00 | 59.67 | | C |
| ANISOU | 4181 | CB | LYS | B | 58 | 7575 | 7218 | 7879 | 194 | −825 | −453 | C |
| ATOM | 4182 | CG | LYS | B | 58 | 6.354 | 24.980 | 19.127 | 0.81 | 58.73 | | C |
| ANISOU | 4182 | CG | LYS | B | 58 | 7491 | 7081 | 7741 | 170 | −784 | −441 | C |
| ATOM | 4183 | CD | LYS | B | 58 | 7.453 | 24.567 | 18.120 | 0.76 | 63.01 | | C |
| ANISOU | 4183 | CD | LYS | B | 58 | 8079 | 7660 | 8203 | 140 | −774 | −410 | C |
| ATOM | 4184 | CE | LYS | B | 58 | 7.109 | 24.894 | 16.675 | 0.00 | 62.06 | | C |
| ANISOU | 4184 | CE | LYS | B | 58 | 7992 | 7542 | 8046 | 149 | −824 | −356 | C |
| ATOM | 4185 | NZ | LYS | B | 58 | 7.966 | 24.106 | 15.745 | 1.00 | 60.63 | | N |
| ANISOU | 4185 | NZ | LYS | B | 58 | 7852 | 7408 | 7776 | 127 | −809 | −340 | N |

TABLE 14-continued

| | | | | | | | | | | | | |
|---|---|---|---|---|---|---|---|---|---|---|---|---|
| ATOM | 4186 | N | ASP | B | 59 | 2.921 | 21.847 | 18.019 | 1.00 | 50.87 | | N |
| ANISOU | 4186 | N | ASP | B | 59 | 6402 | 6176 | 6748 | 203 | −909 | −486 | N |
| ATOM | 4187 | CA | ASP | B | 59 | 1.612 | 21.215 | 18.128 | 1.00 | 51.09 | | C |
| ANISOU | 4187 | CA | ASP | B | 59 | 6376 | 6212 | 6824 | 216 | −947 | −501 | C |
| ATOM | 4188 | C | ASP | B | 59 | 1.709 | 19.705 | 18.276 | 1.00 | 53.13 | | C |
| ANISOU | 4188 | C | ASP | B | 59 | 6627 | 6508 | 7051 | 192 | −934 | −541 | C |
| ATOM | 4189 | O | ASP | B | 59 | 0.691 | 19.010 | 18.143 | 1.00 | 52.73 | | O |
| ANISOU | 4189 | O | ASP | B | 59 | 6538 | 6467 | 7031 | 193 | −974 | −550 | O |
| ATOM | 4190 | CB | ASP | B | 59 | 0.753 | 21.562 | 16.911 | 1.00 | 59.97 | | C |
| ANISOU | 4190 | CB | ASP | B | 59 | 7506 | 7333 | 7948 | 229 | −1032 | −459 | C |
| ATOM | 4191 | CG | ASP | B | 59 | 1.307 | 20.996 | 15.601 | 1.00 | 69.41 | | C |
| ANISOU | 4191 | CG | ASP | B | 59 | 8766 | 8561 | 9046 | 205 | −1067 | −443 | C |
| ATOM | 4192 | OD1 | ASP | B | 59 | 2.367 | 20.310 | 15.613 | 1.00 | 63.30 | | O |
| ANISOU | 4192 | OD1 | ASP | B | 59 | 8031 | 7811 | 8207 | 181 | −1021 | −466 | O |
| ATOM | 4193 | OD2 | ASP | B | 59 | 0.679 | 21.256 | 14.543 | 1.00 | 72.94 | | O |
| ANISOU | 4193 | OD2 | ASP | B | 59 | 9228 | 9009 | 9478 | 214 | −1141 | −408 | O |
| ATOM | 4194 | N | TRP | B | 60 | 2.922 | 19.187 | 18.480 | 1.00 | 49.95 | | N |
| ANISOU | 4194 | N | TRP | B | 60 | 6262 | 6126 | 6592 | 169 | −882 | −560 | N |
| ATOM | 4195 | CA | TRP | B | 60 | 3.267 | 17.784 | 18.692 | 1.00 | 47.88 | | C |
| ANISOU | 4195 | CA | TRP | B | 60 | 6002 | 5895 | 6296 | 148 | −857 | −597 | C |
| ATOM | 4196 | C | TRP | B | 60 | 3.229 | 16.926 | 17.431 | 1.00 | 48.24 | | C |
| ANISOU | 4196 | C | TRP | B | 60 | 6088 | 5965 | 6276 | 132 | −904 | −595 | C |
| ATOM | 4197 | O | TRP | B | 60 | 3.477 | 15.712 | 17.520 | 1.00 | 48.98 | | O |
| ANISOU | 4197 | O | TRP | B | 60 | 6189 | 6080 | 6343 | 115 | −887 | −627 | O |
| ATOM | 4198 | CB | TRP | B | 60 | 2.378 | 17.111 | 19.736 | 1.00 | 45.55 | | C |
| ANISOU | 4198 | CB | TRP | B | 60 | 5641 | 5598 | 6068 | 153 | −842 | −629 | C |
| ATOM | 4199 | CG | TRP | B | 60 | 2.379 | 17.803 | 21.047 | 1.00 | 46.03 | | C |
| ANISOU | 4199 | CG | TRP | B | 60 | 5669 | 5638 | 6184 | 172 | −790 | −639 | C |
| ATOM | 4200 | CD1 | TRP | B | 60 | 1.388 | 18.594 | 21.557 | 1.00 | 48.48 | | C |
| ANISOU | 4200 | CD1 | TRP | B | 60 | 5932 | 5920 | 6568 | 201 | −798 | −631 | C |
| ATOM | 4201 | CD2 | TRP | B | 60 | 3.415 | 17.770 | 22.029 | 1.00 | 40.03 | | C |
| ANISOU | 4201 | CD2 | TRP | B | 60 | 4922 | 4882 | 5406 | 164 | −723 | −661 | C |
| ATOM | 4202 | NE1 | TRP | B | 60 | 1.747 | 19.056 | 22.797 | 1.00 | 45.85 | | N |
| ANISOU | 4202 | NE1 | TRP | B | 60 | 5590 | 5571 | 6258 | 214 | −737 | −650 | N |
| ATOM | 4203 | CE2 | TRP | B | 60 | 2.982 | 18.560 | 23.117 | 1.00 | 41.70 | | C |
| ANISOU | 4203 | CE2 | TRP | B | 60 | 5101 | 5067 | 5677 | 189 | −695 | −669 | C |
| ATOM | 4204 | CE3 | TRP | B | 60 | 4.659 | 17.134 | 22.105 | 1.00 | 39.96 | | C |
| ANISOU | 4204 | CE3 | TRP | B | 60 | 4949 | 4898 | 5338 | 141 | −685 | −673 | C |
| ATOM | 4205 | CZ2 | TRP | B | 60 | 3.749 | 18.748 | 24.256 | 1.00 | 43.47 | | C |
| ANISOU | 4205 | CZ2 | TRP | B | 60 | 5332 | 5287 | 5896 | 188 | −637 | −692 | C |
| ATOM | 4206 | CZ3 | TRP | B | 60 | 5.433 | 17.315 | 23.255 | 1.00 | 40.62 | | C |
| ANISOU | 4206 | CZ3 | TRP | B | 60 | 5030 | 4979 | 5424 | 140 | −629 | −691 | C |
| ATOM | 4207 | CH2 | TRP | B | 60 | 4.978 | 18.119 | 24.305 | 1.00 | 45.25 | | C |
| ANISOU | 4207 | CH2 | TRP | B | 60 | 5590 | 5538 | 6064 | 161 | −609 | −701 | C |
| ATOM | 4208 | N | SER | B | 61 | 2.979 | 17.496 | 16.263 | 1.00 | 41.86 | | N |
| ANISOU | 4208 | N | SER | B | 61 | 5314 | 5154 | 5437 | 137 | −962 | −559 | N |
| ATOM | 4209 | CA | SER | B | 61 | 2.953 | 16.670 | 15.071 | 1.00 | 46.21 | | C |
| ANISOU | 4209 | CA | SER | B | 61 | 5913 | 5728 | 5915 | 123 | −1009 | −562 | C |
| ATOM | 4210 | C | SER | B | 61 | 4.383 | 16.432 | 14.580 | 1.00 | 42.93 | | C |
| ANISOU | 4210 | C | SER | B | 61 | 5568 | 5334 | 5409 | 112 | −960 | −559 | C |
| ATOM | 4211 | O | SER | B | 61 | 5.250 | 17.295 | 14.686 | 1.00 | 42.98 | | O |
| ANISOU | 4211 | O | SER | B | 61 | 5592 | 5335 | 5404 | 116 | −918 | −532 | O |
| ATOM | 4212 | CB | SER | B | 61 | 2.083 | 17.334 | 14.001 | 1.00 | 42.44 | | C |
| ANISOU | 4212 | CB | SER | B | 61 | 5447 | 5243 | 5434 | 136 | −1096 | −522 | C |
| ATOM | 4213 | OG | SER | B | 61 | 2.692 | 18.541 | 13.565 | 1.00 | 45.02 | | O |
| ANISOU | 4213 | OG | SER | B | 61 | 5812 | 5558 | 5734 | 148 | −1086 | −475 | O |
| ATOM | 4214 | N | PHE | B | 62 | 4.615 | 15.258 | 14.009 | 1.00 | 40.80 | | N |
| ANISOU | 4214 | N | PHE | B | 62 | 5337 | 5087 | 5077 | 99 | −965 | −586 | N |
| ATOM | 4215 | CA | PHE | B | 62 | 5.951 | 14.847 | 13.620 | 1.00 | 37.79 | | C |
| ANISOU | 4215 | CA | PHE | B | 62 | 5015 | 4727 | 4614 | 92 | −908 | −589 | C |
| ATOM | 4216 | C | PHE | B | 62 | 6.370 | 15.420 | 12.261 | 1.00 | 43.15 | | C |
| ANISOU | 4216 | C | PHE | B | 62 | 5769 | 5418 | 5210 | 99 | −930 | −547 | C |
| ATOM | 4217 | O | PHE | B | 62 | 5.553 | 15.883 | 11.464 | 1.00 | 47.49 | | O |
| ANISOU | 4217 | O | PHE | B | 62 | 6333 | 5962 | 5749 | 106 | −1003 | −522 | O |
| ATOM | 4218 | CB | PHE | B | 62 | 6.024 | 13.323 | 13.606 | 1.00 | 39.99 | | C |
| ANISOU | 4218 | CB | PHE | B | 62 | 5310 | 5020 | 4864 | 80 | −899 | −638 | C |
| ATOM | 4219 | CG | PHE | B | 62 | 5.745 | 12.717 | 14.934 | 1.00 | 41.71 | | C |
| ANISOU | 4219 | CG | PHE | B | 62 | 5461 | 5228 | 5157 | 74 | −867 | −673 | C |
| ATOM | 4220 | CD1 | PHE | B | 62 | 6.734 | 12.666 | 15.911 | 1.00 | 39.72 | | C |
| ANISOU | 4220 | CD1 | PHE | B | 62 | 5191 | 4982 | 4918 | 74 | −788 | −679 | C |
| ATOM | 4221 | CD2 | PHE | B | 62 | 4.514 | 12.195 | 15.226 | 1.00 | 39.99 | | C |
| ANISOU | 4221 | CD2 | PHE | B | 62 | 5197 | 4998 | 4998 | 67 | −917 | −695 | C |
| ATOM | 4222 | CE1 | PHE | B | 62 | 6.472 | 12.133 | 17.160 | 1.00 | 38.67 | | C |
| ANISOU | 4222 | CE1 | PHE | B | 62 | 5001 | 4842 | 4848 | 70 | −758 | −707 | C |
| ATOM | 4223 | CE2 | PHE | B | 62 | 4.263 | 11.632 | 16.459 | 1.00 | 39.49 | | C |
| ANISOU | 4223 | CE2 | PHE | B | 62 | 5075 | 4928 | 5003 | 62 | −881 | −721 | C |
| ATOM | 4224 | CZ | PHE | B | 62 | 5.260 | 11.614 | 17.440 | 1.00 | 38.76 | | C |
| ANISOU | 4224 | CZ | PHE | B | 62 | 4972 | 4842 | 4915 | 65 | −800 | −727 | C |
| ATOM | 4225 | N | TYR | B | 63 | 7.677 | 15.414 | 12.017 | 1.00 | 44.49 | | N |
| ANISOU | 4225 | N | TYR | B | 63 | 5981 | 5604 | 5319 | 98 | −864 | −533 | N |

TABLE 14-continued

| | | | | | | | | | | | | |
|---|---|---|---|---|---|---|---|---|---|---|---|---|
| ATOM | 4226 | CA | TYR | B | 63 | 8.191 | 15.723 | 10.694 | 1.00 | 43.05 | | C |
| ANISOU | 4226 | CA | TYR | B | 63 | 5876 | 5438 | 5042 | 105 | −870 | −496 | C |
| ATOM | 4227 | C | TYR | B | 63 | 9.456 | 14.918 | 10.456 | 1.00 | 52.46 | | C |
| ANISOU | 4227 | C | TYR | B | 63 | 7112 | 6657 | 6165 | 104 | −794 | −509 | C |
| ATOM | 4228 | O | TYR | B | 63 | 10.240 | 14.672 | 11.382 | 1.00 | 49.32 | | O |
| ANISOU | 4228 | O | TYR | B | 63 | 6677 | 6261 | 5800 | 99 | −726 | −523 | O |
| ATOM | 4229 | CB | TYR | B | 63 | 8.457 | 17.224 | 10.501 | 1.00 | 40.00 | | C |
| ANISOU | 4229 | CB | TYR | B | 63 | 5490 | 5037 | 4670 | 111 | −866 | −431 | C |
| ATOM | 4230 | CG | TYR | B | 63 | 9.456 | 17.829 | 11.469 | 1.00 | 45.60 | | C |
| ANISOU | 4230 | CG | TYR | B | 63 | 6161 | 5737 | 5428 | 103 | −790 | −417 | C |
| ATOM | 4231 | CD1 | TYR | B | 63 | 10.820 | 17.759 | 11.223 | 1.00 | 48.93 | | C |
| ANISOU | 4231 | CD1 | TYR | B | 63 | 6614 | 6179 | 5799 | 98 | −717 | −396 | C |
| ATOM | 4232 | CD2 | TYR | B | 63 | 9.030 | 18.492 | 12.620 | 1.00 | 48.33 | | C |
| ANISOU | 4232 | CD2 | TYR | B | 63 | 6441 | 6052 | 5872 | 102 | −793 | −423 | C |
| ATOM | 4233 | CE1 | TYR | B | 63 | 11.740 | 18.317 | 12.097 | 1.00 | 55.72 | | C |
| ANISOU | 4233 | CE1 | TYR | B | 63 | 7435 | 7029 | 6708 | 86 | −657 | −382 | C |
| ATOM | 4234 | CE2 | TYR | B | 63 | 9.947 | 19.051 | 13.515 | 1.00 | 52.09 | | C |
| ANISOU | 4234 | CE2 | TYR | B | 63 | 6887 | 6516 | 6388 | 91 | −732 | −414 | C |
| ATOM | 4235 | CZ | TYR | B | 63 | 11.297 | 18.946 | 13.260 | 1.00 | 55.12 | | C |
| ANISOU | 4235 | CZ | TYR | B | 63 | 7298 | 6921 | 6725 | 81 | −668 | −394 | C |
| ATOM | 4236 | OH | TYR | B | 63 | 12.217 | 19.511 | 14.139 | 1.00 | 51.70 | | O |
| ANISOU | 4236 | OH | TYR | B | 63 | 6832 | 6476 | 6337 | 66 | −617 | −383 | O |
| ATOM | 4237 | N | LEU | B | 64 | 9.627 | 14.489 | 9.215 | 1.00 | 48.96 | | N |
| ANISOU | 4237 | N | LEU | B | 64 | 6748 | 6233 | 5620 | 113 | −808 | −505 | N |
| ATOM | 4238 | CA | LEU | B | 64 | 10.819 | 13.779 | 8.775 | 1.00 | 52.76 | | C |
| ANISOU | 4238 | CA | LEU | B | 64 | 7283 | 6740 | 6024 | 120 | −733 | −512 | C |
| ATOM | 4239 | C | LEU | B | 64 | 11.199 | 14.300 | 7.405 | 1.00 | 54.47 | | C |
| ANISOU | 4239 | C | LEU | B | 64 | 7581 | 6974 | 6139 | 134 | −734 | −464 | C |
| ATOM | 4240 | O | LEU | B | 64 | 10.336 | 14.692 | 6.608 | 1.00 | 52.90 | | O |
| ANISOU | 4240 | O | LEU | B | 64 | 7419 | 6773 | 5909 | 138 | −813 | −447 | O |
| ATOM | 4241 | CB | LEU | B | 64 | 10.605 | 12.254 | 8.674 | 1.00 | 47.01 | | C |
| ANISOU | 4241 | CB | LEU | B | 64 | 6583 | 6017 | 5263 | 121 | −741 | −579 | C |
| ATOM | 4242 | CG | LEU | B | 64 | 10.291 | 11.480 | 9.950 | 1.00 | 46.25 | | C |
| ANISOU | 4242 | CG | LEU | B | 64 | 6415 | 5905 | 5254 | 108 | −732 | −628 | C |
| ATOM | 4243 | CD1 | LEU | B | 64 | 9.551 | 10.211 | 9.621 | 1.00 | 43.99 | | C |
| ANISOU | 4243 | CD1 | LEU | B | 64 | 6159 | 5611 | 4943 | 103 | −782 | −686 | C |
| ATOM | 4244 | CD2 | LEU | B | 64 | 11.589 | 11.121 | 10.642 | 1.00 | 46.40 | | C |
| ANISOU | 4244 | CD2 | LEU | B | 64 | 6413 | 5935 | 5281 | 113 | −632 | −630 | C |
| ATOM | 4245 | N | LEU | B | 65 | 12.495 | 14.287 | 7.138 | 1.00 | 52.73 | | N |
| ANISOU | 4245 | N | LEU | B | 65 | 7389 | 6775 | 5870 | 143 | −645 | −439 | N |
| ATOM | 4246 | CA | LEU | B | 65 | 13.017 | 14.575 | 5.821 | 1.00 | 51.49 | | C |
| ANISOU | 4246 | CA | LEU | B | 65 | 7318 | 6641 | 5604 | 160 | −625 | −395 | C |
| ATOM | 4247 | C | LEU | B | 65 | 13.610 | 13.290 | 5.271 | 1.00 | 52.18 | | C |
| ANISOU | 4247 | C | LEU | B | 65 | 7471 | 6752 | 5604 | 178 | −577 | −437 | C |
| ATOM | 4248 | O | LEU | B | 65 | 14.494 | 12.702 | 5.897 | 1.00 | 53.78 | | O |
| ANISOU | 4248 | O | LEU | B | 65 | 7642 | 6961 | 5830 | 181 | −498 | −455 | O |
| ATOM | 4249 | CB | LEU | B | 65 | 14.054 | 15.683 | 5.881 | 1.00 | 55.08 | | C |
| ANISOU | 4249 | CB | LEU | B | 65 | 7752 | 7100 | 6075 | 158 | −555 | −321 | C |
| ATOM | 4250 | CG | LEU | B | 65 | 14.674 | 16.066 | 4.542 | 1.00 | 60.39 | | C |
| ANISOU | 4250 | CG | LEU | B | 65 | 8510 | 7798 | 6638 | 176 | −520 | −263 | C |
| ATOM | 4251 | CD1 | LEU | B | 65 | 13.651 | 16.796 | 3.680 | 1.00 | 62.96 | | C |
| ANISOU | 4251 | CD1 | LEU | B | 65 | 8882 | 8114 | 6924 | 180 | −613 | −231 | C |
| ATOM | 4252 | CD2 | LEU | B | 65 | 15.900 | 16.908 | 4.784 | 1.00 | 57.59 | | C |
| ANISOU | 4252 | CD2 | LEU | B | 65 | 8120 | 7448 | 6315 | 169 | −432 | −197 | C |
| ATOM | 4253 | N | TYR | B | 66 | 13.092 | 12.832 | 4.130 | 1.00 | 53.78 | | N |
| ANISOU | 4253 | N | TYR | B | 66 | 7764 | 6964 | 5705 | 192 | −628 | −455 | N |
| ATOM | 4254 | CA | TYR | B | 66 | 13.688 | 11.731 | 3.382 | 1.00 | 60.04 | | C |
| ANISOU | 4254 | CA | TYR | B | 66 | 8641 | 7776 | 6394 | 215 | −579 | −492 | C |
| ATOM | 4255 | C | TYR | B | 66 | 14.455 | 12.302 | 2.198 | 1.00 | 60.38 | | C |
| ANISOU | 4255 | C | TYR | B | 66 | 8766 | 7849 | 6327 | 239 | −528 | −430 | C |
| ATOM | 4256 | O | TYR | B | 66 | 13.980 | 13.223 | 1.534 | 1.00 | 61.71 | | O |
| ANISOU | 4256 | O | TYR | B | 66 | 8964 | 8020 | 6462 | 238 | −581 | −381 | O |
| ATOM | 4257 | CB | TYR | B | 66 | 12.612 | 10.753 | 2.902 | 1.00 | 56.73 | | C |
| ANISOU | 4257 | CB | TYR | B | 66 | 8279 | 7346 | 5931 | 213 | −672 | −561 | C |
| ATOM | 4258 | CG | TYR | B | 66 | 12.030 | 9.896 | 3.998 | 1.00 | 55.19 | | C |
| ANISOU | 4258 | CG | TYR | B | 66 | 8014 | 7124 | 5832 | 192 | −701 | −626 | C |
| ATOM | 4259 | CD1 | TYR | B | 66 | 11.187 | 10.432 | 4.958 | 1.00 | 55.96 | | C |
| ANISOU | 4259 | CD1 | TYR | B | 66 | 8017 | 7200 | 6046 | 167 | −757 | −620 | C |
| ATOM | 4260 | CD2 | TYR | B | 66 | 12.309 | 8.553 | 4.062 | 1.00 | 55.30 | | C |
| ANISOU | 4260 | CD2 | TYR | B | 66 | 8059 | 7132 | 5821 | 200 | −670 | −690 | C |
| ATOM | 4261 | CE1 | TYR | B | 66 | 10.662 | 9.657 | 5.947 | 1.00 | 51.92 | | C |
| ANISOU | 4261 | CE1 | TYR | B | 66 | 7442 | 6665 | 5619 | 149 | −777 | −673 | C |
| ATOM | 4262 | CE2 | TYR | B | 66 | 11.768 | 7.763 | 5.043 | 1.00 | 54.40 | | C |
| ANISOU | 4262 | CE2 | TYR | B | 66 | 7883 | 6991 | 5796 | 180 | −695 | −743 | C |
| ATOM | 4263 | CZ | TYR | B | 66 | 10.965 | 8.321 | 5.993 | 1.00 | 52.88 | | C |
| ANISOU | 4263 | CZ | TYR | B | 66 | 7595 | 6781 | 5715 | 154 | −746 | −732 | C |
| ATOM | 4264 | OH | TYR | B | 66 | 10.435 | 7.521 | 6.981 | 1.00 | 52.67 | | O |
| ANISOU | 4264 | OH | TYR | B | 66 | 7508 | 6730 | 5775 | 136 | −764 | −780 | O |
| ATOM | 4265 | N | TYR | B | 67 | 15.646 | 11.769 | 1.932 | 1.00 | 66.20 | | N |
| ANISOU | 4265 | N | TYR | B | 67 | 9536 | 8608 | 7009 | 264 | −420 | −428 | N |

TABLE 14-continued

| | | | | | | | | | | | | |
|---|---|---|---|---|---|---|---|---|---|---|---|---|
| ATOM | 4266 | CA | TYR | B | 67 | 16.471 | 12.385 | 0.901 | 1.00 | 70.98 | | C |
| ANISOU | 4266 | CA | TYR | B | 67 | 10206 | 9243 | 7519 | 287 | −354 | −359 | C |
| ATOM | 4267 | C | TYR | B | 67 | 17.424 | 11.370 | 0.285 | 1.00 | 74.61 | | C |
| ANISOU | 4267 | C | TYR | B | 67 | 10740 | 9727 | 7882 | 325 | −258 | −385 | C |
| ATOM | 4268 | O | TYR | B | 67 | 17.816 | 10.383 | 0.922 | 1.00 | 71.01 | | O |
| ANISOU | 4268 | O | TYR | B | 67 | 10253 | 9264 | 7463 | 331 | −213 | −438 | O |
| ATOM | 4269 | CB | TYR | B | 67 | 17.258 | 13.585 | 1.449 | 1.00 | 68.37 | | C |
| ANISOU | 4269 | CB | TYR | B | 67 | 9795 | 8915 | 7269 | 272 | −292 | −277 | C |
| ATOM | 4270 | CG | TYR | B | 67 | 18.169 | 13.234 | 2.594 | 1.00 | 68.43 | | C |
| ANISOU | 4270 | CG | TYR | B | 67 | 9711 | 8920 | 7371 | 264 | −212 | −288 | C |
| ATOM | 4271 | CD1 | TYR | B | 67 | 17.674 | 13.112 | 3.888 | 1.00 | 71.55 | | C |
| ANISOU | 4271 | CD1 | TYR | B | 67 | 10015 | 9288 | 7883 | 237 | −255 | −328 | C |
| ATOM | 4272 | CD2 | TYR | B | 67 | 19.525 | 13.024 | 2.387 | 1.00 | 71.88 | | C |
| ANISOU | 4272 | CD2 | TYR | B | 67 | 10151 | 9384 | 7778 | 286 | −91 | −256 | C |
| ATOM | 4273 | CE1 | TYR | B | 67 | 18.512 | 12.783 | 4.945 | 1.00 | 76.34 | | C |
| ANISOU | 4273 | CE1 | TYR | B | 67 | 10541 | 9894 | 8570 | 231 | −187 | −337 | C |
| ATOM | 4274 | CE2 | TYR | B | 67 | 20.368 | 12.690 | 3.436 | 1.00 | 75.71 | | C |
| ANISOU | 4274 | CE2 | TYR | B | 67 | 10548 | 9868 | 8351 | 280 | −24 | −263 | C |
| ATOM | 4275 | CZ | TYR | B | 67 | 19.855 | 12.570 | 4.711 | 1.00 | 78.75 | | C |
| ANISOU | 4275 | CZ | TYR | B | 67 | 10849 | 10226 | 8846 | 251 | −76 | −305 | C |
| ATOM | 4276 | OH | TYR | B | 67 | 20.696 | 12.238 | 5.752 | 1.00 | 82.58 | | O |
| ANISOU | 4276 | OH | TYR | B | 67 | 11252 | 10712 | 9412 | 245 | −15 | −310 | O |
| ATOM | 4277 | N | THR | B | 68 | 17.809 | 11.648 | −0.963 | 1.00 | 74.38 | | N |
| ANISOU | 4277 | N | THR | B | 68 | 10808 | 9725 | 7727 | 353 | −222 | −342 | N |
| ATOM | 4278 | CA | THR | B | 68 | 18.669 | 10.767 | −1.741 | 1.00 | 76.98 | | C |
| ANISOU | 4278 | CA | THR | B | 68 | 11225 | 10080 | 7944 | 398 | −127 | −362 | C |
| ATOM | 4279 | C | THR | B | 68 | 19.430 | 11.581 | −2.783 | 1.00 | 78.45 | | C |
| ANISOU | 4279 | C | THR | B | 68 | 11472 | 10301 | 8035 | 423 | −52 | −273 | C |
| ATOM | 4280 | O | THR | B | 68 | 18.889 | 12.521 | −3.380 | 1.00 | 71.14 | | O |
| ANISOU | 4280 | O | THR | B | 68 | 10581 | 9379 | 7071 | 413 | −112 | −221 | O |
| ATOM | 4281 | CB | THR | B | 68 | 17.854 | 9.637 | −2.402 | 1.00 | 79.58 | | C |
| ANISOU | 4281 | CB | THR | B | 68 | 11662 | 10398 | 8176 | 413 | −200 | −452 | C |
| ATOM | 4282 | OG1 | THR | B | 68 | 18.735 | 8.625 | −2.898 | 1.00 | 82.15 | | O |
| ANISOU | 4282 | OG1 | THR | B | 68 | 12060 | 10737 | 8415 | 458 | −99 | −487 | O |
| ATOM | 4283 | CG2 | THR | B | 68 | 16.988 | 10.157 | −3.544 | 1.00 | 81.90 | | C |
| ANISOU | 4283 | CG2 | THR | B | 68 | 12056 | 10701 | 8361 | 414 | −295 | −434 | C |
| ATOM | 4284 | N | GLU | B | 69 | 20.704 | 11.233 | −2.967 | 1.00 | 90.69 | | N |
| ANISOU | 4284 | N | GLU | B | 69 | 13029 | 11876 | 9553 | 456 | 85 | −251 | N |
| ATOM | 4285 | CA | GLU | B | 69 | 21.528 | 11.870 | −3.989 | 1.00 | 96.43 | | C |
| ANISOU | 4285 | CA | GLU | B | 69 | 13816 | 12639 | 10184 | 486 | 177 | −165 | C |
| ATOM | 4286 | C | GLU | B | 69 | 21.040 | 11.459 | −5.377 | 1.00 | 88.32 | | C |
| ANISOU | 4286 | C | GLU | B | 69 | 12950 | 11628 | 8978 | 522 | 144 | −193 | C |
| ATOM | 4287 | O | GLU | B | 69 | 20.759 | 10.281 | −5.625 | 1.00 | 87.47 | | O |
| ANISOU | 4287 | O | GLU | B | 69 | 12916 | 11513 | 8806 | 545 | 126 | −283 | O |
| ATOM | 4288 | CB | GLU | B | 69 | 22.996 | 11.484 | −3.792 | 1.00 | 103.52 | | C |
| ANISOU | 4288 | CB | GLU | B | 69 | 14673 | 13559 | 11100 | 515 | 334 | −139 | C |
| ATOM | 4289 | CG | GLU | B | 69 | 24.014 | 12.312 | −4.595 | 1.00 | 108.43 | | C |
| ANISOU | 4289 | CG | GLU | B | 69 | 15316 | 14219 | 11664 | 537 | 448 | −30 | C |
| ATOM | 4290 | CD | GLU | B | 69 | 25.227 | 12.739 | −3.756 | 1.00 | 108.38 | | C |
| ANISOU | 4290 | CD | GLU | B | 69 | 15176 | 14219 | 11783 | 523 | 553 | 36 | C |
| ATOM | 4291 | OE1 | GLU | B | 69 | 25.393 | 13.955 | −3.526 | 0.48 | 107.32 | | O |
| ANISOU | 4291 | OE1 | GLU | B | 69 | 14976 | 14082 | 11720 | 486 | 548 | 121 | O |
| ATOM | 4292 | OE2 | GLU | B | 69 | 26.007 | 11.862 | −3.319 | 1.00 | 107.47 | | O |
| ANISOU | 4292 | OE2 | GLU | B | 69 | 15022 | 14111 | 11701 | 547 | 636 | 4 | O |
| ATOM | 4293 | N | PHE | B | 70 | 20.906 | 12.432 | −6.275 | 1.00 | 81.60 | | N |
| ANISOU | 4293 | N | PHE | B | 70 | 12159 | 10797 | 8048 | 525 | 130 | −116 | N |
| ATOM | 4294 | CA | PHE | B | 70 | 20.409 | 12.141 | −7.612 | 1.00 | 80.15 | | C |
| ANISOU | 4294 | CA | PHE | B | 70 | 12135 | 10631 | 7688 | 558 | 89 | −136 | C |
| ATOM | 4295 | C | PHE | B | 70 | 20.907 | 13.199 | −8.585 | 1.00 | 93.01 | | C |
| ANISOU | 4295 | C | PHE | B | 70 | 13819 | 12295 | 9227 | 576 | 149 | −23 | C |
| ATOM | 4296 | O | PHE | B | 70 | 21.234 | 14.327 | −8.199 | 1.00 | 95.15 | | O |
| ANISOU | 4296 | O | PHE | B | 70 | 14000 | 12562 | 9588 | 548 | 174 | 68 | O |
| ATOM | 4297 | CB | PHE | B | 70 | 18.875 | 12.058 | −7.641 | 1.00 | 75.79 | | C |
| ANISOU | 4297 | CB | PHE | B | 70 | 11613 | 10052 | 7132 | 528 | −89 | −195 | C |
| ATOM | 4298 | CG | PHE | B | 70 | 18.180 | 13.389 | −7.781 | 1.00 | 79.49 | | C |
| ANISOU | 4298 | CG | PHE | B | 70 | 12057 | 10516 | 7629 | 498 | −178 | −117 | C |
| ATOM | 4299 | CD1 | PHE | B | 70 | 17.126 | 13.534 | −8.674 | 1.00 | 81.55 | | C |
| ANISOU | 4299 | CD1 | PHE | B | 70 | 12419 | 10779 | 7786 | 500 | −301 | −126 | C |
| ATOM | 4300 | CD2 | PHE | B | 70 | 18.538 | 14.481 | −7.005 | 1.00 | 80.06 | | C |
| ANISOU | 4300 | CD2 | PHE | B | 70 | 12008 | 10578 | 7834 | 468 | −148 | −38 | C |
| ATOM | 4301 | CE1 | PHE | B | 70 | 16.467 | 14.748 | −8.810 | 1.00 | 77.98 | | C |
| ANISOU | 4301 | CE1 | PHE | B | 70 | 11944 | 10321 | 7364 | 477 | −385 | −51 | C |
| ATOM | 4302 | CE2 | PHE | B | 70 | 17.885 | 15.698 | −7.146 | 1.00 | 76.56 | | C |
| ANISOU | 4302 | CE2 | PHE | B | 70 | 11547 | 10124 | 7419 | 444 | −229 | 33 | C |
| ATOM | 4303 | CZ | PHE | B | 70 | 16.850 | 15.829 | −8.046 | 1.00 | 74.45 | | C |
| ANISOU | 4303 | CZ | PHE | B | 70 | 11377 | 9859 | 7050 | 451 | −346 | 28 | C |
| ATOM | 4304 | N | THR | B | 71 | 20.964 | 12.811 | −9.856 | 1.00 | 100.53 | | N |
| ANISOU | 4304 | N | THR | B | 71 | 14923 | 13275 | 9997 | 622 | 173 | −31 | N |
| ATOM | 4305 | CA | THR | B | 71 | 21.313 | 13.714 | −10.952 | 1.00 | 99.31 | | C |
| ANISOU | 4305 | CA | THR | B | 71 | 14850 | 13157 | 9728 | 645 | 223 | 72 | C |

TABLE 14-continued

| | | | | | | | | | | | | |
|---|---|---|---|---|---|---|---|---|---|---|---|---|
| ATOM | 4306 | C | THR | B | 71 | 20.109 | 13.794 | −11.881 | 1.00 | 93.91 | | C |
| ANISOU | 4306 | C | THR | B | 71 | 14292 | 12474 | 8916 | 647 | 80 | 49 | C |
| ATOM | 4307 | O | THR | B | 71 | 19.763 | 12.786 | −12.527 | 1.00 | 93.24 | | O |
| ANISOU | 4307 | O | THR | B | 71 | 14330 | 12395 | 8703 | 677 | 47 | −37 | O |
| ATOM | 4308 | CB | THR | B | 71 | 22.558 | 13.219 | −11.694 | 1.00 | 103.76 | | C |
| ANISOU | 4308 | CB | THR | B | 71 | 15488 | 13760 | 10177 | 706 | 395 | 94 | C |
| ATOM | 4309 | OG1 | THR | B | 71 | 22.324 | 11.896 | −12.195 | 1.00 | 114.13 | | O |
| ANISOU | 4309 | OG1 | THR | B | 71 | 16921 | 15074 | 11369 | 746 | 383 | −17 | O |
| ATOM | 4310 | CG2 | THR | B | 71 | 23.771 | 13.172 | −10.765 | 1.00 | 92.59 | | C |
| ANISOU | 4310 | CG2 | THR | B | 71 | 13935 | 12345 | 8898 | 703 | 532 | 125 | C |
| ATOM | 4311 | N | PRO | B | 72 | 19.423 | 14.931 | −11.966 | 1.00 | 90.10 | | N |
| ANISOU | 4311 | N | PRO | B | 72 | 13786 | 11982 | 8464 | 616 | −14 | 120 | N |
| ATOM | 4312 | CA | PRO | B | 72 | 18.173 | 14.991 | −12.733 | 1.00 | 95.03 | | C |
| ANISOU | 4312 | CA | PRO | B | 72 | 14515 | 12605 | 8986 | 613 | −170 | 95 | C |
| ATOM | 4313 | C | PRO | B | 72 | 18.392 | 15.104 | −14.238 | 1.00 | 109.51 | | C |
| ANISOU | 4313 | C | PRO | B | 72 | 16520 | 14483 | 10606 | 662 | −136 | 141 | C |
| ATOM | 4314 | O | PRO | B | 72 | 19.390 | 15.652 | −14.716 | 1.00 | 108.41 | | O |
| ANISOU | 4314 | O | PRO | B | 72 | 16401 | 14375 | 10415 | 689 | −2 | 234 | O |
| ATOM | 4315 | CB | PRO | B | 72 | 17.491 | 16.251 | −12.187 | 1.00 | 89.87 | | C |
| ANISOU | 4315 | CB | PRO | B | 72 | 13759 | 11925 | 8462 | 567 | −265 | 167 | C |
| ATOM | 4316 | CG | PRO | B | 72 | 18.620 | 17.120 | −11.747 | 1.00 | 88.70 | | C |
| ANISOU | 4316 | CG | PRO | B | 72 | 13516 | 11781 | 8405 | 560 | −129 | 267 | C |
| ATOM | 4317 | CD | PRO | B | 72 | 19.690 | 16.183 | −11.236 | 1.00 | 86.27 | | C |
| ANISOU | 4317 | CD | PRO | B | 72 | 13169 | 11482 | 8130 | 577 | 6 | 217 | C |
| ATOM | 4318 | N | THR | B | 73 | 17.424 | 14.568 | −14.987 | 1.00 | 122.99 | | N |
| ANISOU | 4318 | N | THR | B | 73 | 18352 | 16194 | 12187 | 672 | −262 | 74 | N |
| ATOM | 4319 | CA | THR | B | 73 | 17.431 | 14.564 | −16.447 | 1.00 | 126.13 | | C |
| ANISOU | 4319 | CA | THR | B | 73 | 18931 | 16632 | 12361 | 717 | −259 | 100 | C |
| ATOM | 4320 | C | THR | B | 73 | 16.071 | 15.023 | −16.967 | 1.00 | 127.07 | | C |
| ANISOU | 4320 | C | THR | B | 73 | 19107 | 16744 | 12430 | 696 | −453 | 106 | C |
| ATOM | 4321 | O | THR | B | 73 | 15.131 | 15.262 | −16.201 | 1.00 | 130.52 | | O |
| ANISOU | 4321 | O | THR | B | 73 | 19441 | 17145 | 13005 | 649 | −582 | 84 | O |
| ATOM | 4322 | CB | THR | B | 73 | 17.741 | 13.171 | −17.010 | 1.00 | 123.59 | | C |
| ANISOU | 4322 | CB | THR | B | 73 | 18740 | 16323 | 11896 | 763 | −211 | −8 | C |
| ATOM | 4323 | OG1 | THR | B | 73 | 16.540 | 12.388 | −17.003 | 1.00 | 125.80 | | O |
| ANISOU | 4323 | OG1 | THR | B | 73 | 19065 | 16575 | 12159 | 740 | −382 | −122 | O |
| ATOM | 4324 | CG2 | THR | B | 73 | 18.804 | 12.464 | −16.180 | 1.00 | 118.59 | | C |
| ANISOU | 4324 | CG2 | THR | B | 73 | 18019 | 15680 | 11360 | 774 | −60 | −47 | C |
| ATOM | 4325 | N | GLU | B | 74 | 15.976 | 15.143 | −18.297 | 1.00 | 124.07 | | N |
| ANISOU | 4325 | N | GLU | B | 74 | 18894 | 16402 | 11845 | 734 | −470 | 138 | N |
| ATOM | 4326 | CA | GLU | B | 74 | 14.686 | 15.357 | −18.948 | 1.00 | 120.50 | | C |
| ANISOU | 4326 | CA | GLU | B | 74 | 18523 | 15949 | 11313 | 722 | −662 | 129 | C |
| ATOM | 4327 | C | GLU | B | 74 | 13.761 | 14.165 | −18.763 | 1.00 | 117.90 | | C |
| ANISOU | 4327 | C | GLU | B | 74 | 18222 | 15592 | 10981 | 702 | −797 | −16 | C |
| ATOM | 4328 | O | GLU | B | 74 | 12.534 | 14.324 | −18.699 | 1.00 | 113.40 | | O |
| ANISOU | 4328 | O | GLU | B | 74 | 17633 | 15003 | 10451 | 667 | −978 | −36 | O |
| ATOM | 4329 | CB | GLU | B | 74 | 14.881 | 15.590 | −20.449 | 1.00 | 121.24 | | C |
| ANISOU | 4329 | CB | GLU | B | 74 | 18808 | 16093 | 11167 | 772 | −641 | 186 | C |
| ATOM | 4330 | CG | GLU | B | 74 | 15.047 | 17.028 | −20.872 | 1.00 | 118.49 | | C |
| ANISOU | 4330 | CG | GLU | B | 74 | 18451 | 15764 | 10806 | 776 | −617 | 343 | C |
| ATOM | 4331 | CD | GLU | B | 74 | 16.453 | 17.545 | −20.660 | 0.00 | 114.70 | | C |
| ANISOU | 4331 | CD | GLU | B | 74 | 17912 | 15300 | 10371 | 795 | −404 | 436 | C |
| ATOM | 4332 | OE1 | GLU | B | 74 | 17.316 | 16.786 | −20.154 | 1.00 | 113.99 | | O |
| ANISOU | 4332 | OE1 | GLU | B | 74 | 17780 | 15208 | 10324 | 807 | −274 | 380 | O |
| ATOM | 4333 | OE2 | GLU | B | 74 | 16.686 | 18.721 | −21.010 | 1.00 | 112.35 | | O |
| ANISOU | 4333 | OE2 | GLU | B | 74 | 17606 | 15014 | 10066 | 798 | −370 | 570 | O |
| ATOM | 4334 | N | LYS | B | 75 | 14.333 | 12.967 | −18.686 | 1.00 | 119.57 | | N |
| ANISOU | 4334 | N | LYS | B | 75 | 18479 | 15801 | 11150 | 725 | −713 | −115 | N |
| ATOM | 4335 | CA | LYS | B | 75 | 13.617 | 11.744 | −18.999 | 1.00 | 121.10 | | C |
| ANISOU | 4335 | CA | LYS | B | 75 | 18772 | 15977 | 11261 | 722 | −825 | −249 | C |
| ATOM | 4336 | C | LYS | B | 75 | 13.187 | 10.953 | −17.778 | 1.00 | 121.77 | | C |
| ANISOU | 4336 | C | LYS | B | 75 | 18729 | 16012 | 11527 | 678 | −876 | −349 | C |
| ATOM | 4337 | O | LYS | B | 75 | 12.401 | 10.006 | −17.918 | 1.00 | 122.09 | | O |
| ANISOU | 4337 | O | LYS | B | 75 | 18830 | 16028 | 11532 | 662 | −996 | −458 | O |
| ATOM | 4338 | CB | LYS | B | 75 | 14.488 | 10.874 | −19.908 | 1.00 | 119.34 | | C |
| ANISOU | 4338 | CB | LYS | B | 75 | 18719 | 15783 | 10842 | 785 | −702 | −298 | C |
| ATOM | 4339 | CG | LYS | B | 75 | 14.554 | 11.441 | −21.304 | 1.00 | 116.56 | | C |
| ANISOU | 4339 | CG | LYS | B | 75 | 18536 | 15481 | 10272 | 828 | −702 | −226 | C |
| ATOM | 4340 | CD | LYS | B | 75 | 13.133 | 11.650 | −21.797 | 0.00 | 111.51 | | C |
| ANISOU | 4340 | CD | LYS | B | 75 | 17953 | 14835 | 9581 | 795 | −932 | −243 | C |
| ATOM | 4341 | CE | LYS | B | 75 | 12.843 | 13.073 | −22.247 | 1.00 | 105.54 | | C |
| ANISOU | 4341 | CE | LYS | B | 75 | 17188 | 14106 | 8805 | 792 | −979 | −101 | C |
| ATOM | 4342 | NZ | LYS | B | 75 | 11.411 | 13.434 | −21.988 | 1.00 | 98.53 | | N |
| ANISOU | 4342 | NZ | LYS | B | 75 | 16236 | 13192 | 8008 | 738 | −1200 | −107 | N |
| ATOM | 4343 | N | ASP | B | 76 | 13.666 | 11.320 | −16.596 | 1.00 | 117.09 | | N |
| ANISOU | 4343 | N | ASP | B | 76 | 17964 | 15401 | 11125 | 655 | −792 | −313 | N |
| ATOM | 4344 | CA | ASP | B | 76 | 13.289 | 10.656 | −15.361 | 1.00 | 109.10 | | C |
| ANISOU | 4344 | CA | ASP | B | 76 | 16822 | 14342 | 10291 | 614 | −832 | −395 | C |
| ATOM | 4345 | C | ASP | B | 76 | 12.240 | 11.498 | −14.649 | 1.00 | 100.35 | | C |
| ANISOU | 4345 | C | ASP | B | 76 | 15580 | 13210 | 9339 | 560 | −968 | −354 | C |

TABLE 14-continued

| | | | | | | | | | | | |
|---|---|---|---|---|---|---|---|---|---|---|---|
| ATOM | 4346 | O | ASP | B | 76 | 12.485 | 12.669 | −14.336 | 1.00 | 96.15 | O |
| ANISOU | 4346 | O | ASP | B | 76 | 14961 | 12686 | 8886 | 553 | −929 | −249 | O |
| ATOM | 4347 | CB | ASP | B | 76 | 14.516 | 10.434 | −14.482 | 1.00 | 109.39 | C |
| ANISOU | 4347 | CB | ASP | B | 76 | 16759 | 14375 | 10431 | 627 | −652 | −388 | C |
| ATOM | 4348 | CG | ASP | B | 76 | 15.553 | 9.554 | −15.156 | 1.00 | 109.77 | C |
| ANISOU | 4348 | CG | ASP | B | 76 | 16931 | 14443 | 10333 | 686 | −511 | −429 | C |
| ATOM | 4349 | OD1 | ASP | B | 76 | 15.248 | 8.372 | −15.429 | 1.00 | 108.29 | O |
| ANISOU | 4349 | OD1 | ASP | B | 76 | 16837 | 14237 | 10074 | 696 | −555 | −542 | O |
| ATOM | 4350 | OD2 | ASP | B | 76 | 16.662 | 10.054 | −15.434 | 1.00 | 109.55 | O |
| ANISOU | 4350 | OD2 | ASP | B | 76 | 16911 | 14450 | 10264 | 723 | −357 | −347 | O |
| ATOM | 4351 | N | GLU | B | 77 | 11.066 | 10.911 | −14.437 | 1.00 | 101.01 | N |
| ANISOU | 4351 | N | GLU | B | 77 | 15651 | 13262 | 9465 | 524 | −1127 | −436 | N |
| ATOM | 4352 | CA | GLU | B | 77 | 10.043 | 11.494 | −13.582 | 1.00 | 101.15 | C |
| ANISOU | 4352 | CA | GLU | B | 77 | 15526 | 13251 | 9655 | 474 | −1248 | −416 | C |
| ATOM | 4353 | C | GLU | B | 77 | 10.294 | 11.041 | −12.151 | 1.00 | 103.21 | C |
| ANISOU | 4353 | C | GLU | B | 77 | 15636 | 13477 | 10103 | 447 | −1186 | −461 | C |
| ATOM | 4354 | O | GLU | B | 77 | 10.345 | 9.834 | −11.870 | 1.00 | 102.90 | O |
| ANISOU | 4354 | O | GLU | B | 77 | 15613 | 13415 | 10068 | 443 | −1176 | −562 | O |
| ATOM | 4355 | CB | GLU | B | 77 | 8.647 | 11.075 | −14.023 | 1.00 | 100.88 | C |
| ANISOU | 4355 | CB | GLU | B | 77 | 15541 | 13202 | 9586 | 446 | −1449 | −476 | C |
| ATOM | 4356 | CG | GLU | B | 77 | 8.017 | 11.944 | −15.079 | 1.00 | 99.67 | C |
| ANISOU | 4356 | CG | GLU | B | 77 | 15471 | 13077 | 9321 | 455 | −1560 | −403 | C |
| ATOM | 4357 | CD | GLU | B | 77 | 6.622 | 11.486 | −15.368 | 0.00 | 98.39 | C |
| ANISOU | 4357 | CD | GLU | B | 77 | 15334 | 12897 | 9152 | 421 | −1765 | −465 | C |
| ATOM | 4358 | OE1 | GLU | B | 77 | 5.686 | 12.300 | −15.247 | 1.00 | 97.44 | O |
| ANISOU | 4358 | OE1 | GLU | B | 77 | 15141 | 12772 | 9111 | 398 | −1887 | −409 | O |
| ATOM | 4359 | OE2 | GLU | B | 77 | 6.469 | 10.289 | −15.675 | 1.00 | 98.86 | O |
| ANISOU | 4359 | OE2 | GLU | B | 77 | 15481 | 12944 | 9136 | 417 | −1804 | −572 | O |
| ATOM | 4360 | N | TYR | B | 78 | 10.465 | 12.002 | −11.253 | 1.00 | 97.86 | N |
| ANISOU | 4360 | N | TYR | B | 78 | 14816 | 12791 | 9574 | 430 | −1144 | −387 | N |
| ATOM | 4361 | CA | TYR | B | 78 | 10.649 | 11.703 | −9.845 | 1.00 | 88.08 | C |
| ANISOU | 4361 | CA | TYR | B | 78 | 13430 | 11520 | 8514 | 404 | −1094 | −421 | C |
| ATOM | 4362 | C | TYR | B | 78 | 9.360 | 11.972 | −9.092 | 1.00 | 85.50 | C |
| ANISOU | 4362 | C | TYR | B | 78 | 12991 | 11161 | 8332 | 359 | −1235 | −433 | C |
| ATOM | 4363 | O | TYR | B | 78 | 8.565 | 12.841 | −9.460 | 1.00 | 87.77 | O |
| ANISOU | 4363 | O | TYR | B | 78 | 13276 | 11453 | 8621 | 350 | −1339 | −377 | O |
| ATOM | 4364 | CB | TYR | B | 78 | 11.796 | 12.514 | −9.254 | 1.00 | 81.49 | C |
| ANISOU | 4364 | CB | TYR | B | 78 | 12512 | 10697 | 7755 | 414 | −943 | −340 | C |
| ATOM | 4365 | CG | TYR | B | 78 | 13.119 | 12.065 | −9.809 | 1.00 | 84.57 | C |
| ANISOU | 4365 | CG | TYR | B | 78 | 12988 | 11116 | 8028 | 458 | −788 | −337 | C |
| ATOM | 4366 | CD1 | TYR | B | 78 | 13.727 | 12.745 | −10.857 | 1.00 | 85.75 | C |
| ANISOU | 4366 | CD1 | TYR | B | 78 | 13233 | 11303 | 8045 | 493 | −725 | −254 | C |
| ATOM | 4367 | CD2 | TYR | B | 78 | 13.736 | 10.926 | −9.322 | 1.00 | 84.99 | C |
| ANISOU | 4367 | CD2 | TYR | B | 78 | 13032 | 11158 | 8101 | 468 | −705 | −415 | C |
| ATOM | 4368 | CE1 | TYR | B | 78 | 14.929 | 12.314 | −11.382 | 1.00 | 85.34 | C |
| ANISOU | 4368 | CE1 | TYR | B | 78 | 13258 | 11280 | 7887 | 537 | −576 | −250 | C |
| ATOM | 4369 | CE2 | TYR | B | 78 | 14.934 | 10.491 | −9.836 | 1.00 | 87.49 | C |
| ANISOU | 4369 | CE2 | TYR | B | 78 | 13425 | 11501 | 8316 | 514 | −561 | −412 | C |
| ATOM | 4370 | CZ | TYR | B | 78 | 15.528 | 11.185 | −10.868 | 1.00 | 86.48 | C |
| ANISOU | 4370 | CZ | TYR | B | 78 | 13386 | 11412 | 8058 | 549 | −494 | −330 | C |
| ATOM | 4371 | OH | TYR | B | 78 | 16.723 | 10.738 | −11.372 | 1.00 | 86.19 | O |
| ANISOU | 4371 | OH | TYR | B | 78 | 13421 | 11403 | 7924 | 598 | −342 | −325 | O |
| ATOM | 4372 | N | ALA | B | 79 | 9.143 | 11.185 | −8.050 | 1.00 | 83.75 | N |
| ANISOU | 4372 | N | ALA | B | 79 | 12680 | 10907 | 8232 | 332 | −1238 | −506 | N |
| ATOM | 4373 | CA | ALA | B | 79 | 7.953 | 11.330 | −7.238 | 1.00 | 82.86 | C |
| ANISOU | 4373 | CA | ALA | B | 79 | 12453 | 10763 | 8266 | 291 | −1357 | −522 | C |
| ATOM | 4374 | C | ALA | B | 79 | 8.296 | 10.903 | −5.819 | 1.00 | 84.97 | C |
| ANISOU | 4374 | C | ALA | B | 79 | 12593 | 11004 | 8687 | 273 | −1280 | −558 | C |
| ATOM | 4375 | O | ALA | B | 79 | 9.457 | 10.625 | −5.494 | 1.00 | 78.64 | O |
| ANISOU | 4375 | O | ALA | B | 79 | 11788 | 10209 | 7881 | 291 | −1142 | −561 | O |
| ATOM | 4376 | CB | ALA | B | 79 | 6.796 | 10.516 | −7.825 | 1.00 | 76.36 | C |
| ANISOU | 4376 | CB | ALA | B | 79 | 11696 | 9928 | 7390 | 272 | −1512 | −595 | C |
| ATOM | 4377 | N | CYS | B | 80 | 7.278 | 10.850 | −4.976 | 1.00 | 84.35 | N |
| ANISOU | 4377 | N | CYS | B | 80 | 12410 | 10896 | 8745 | 237 | −1370 | −583 | N |
| ATOM | 4378 | CA | CYS | B | 80 | 7.428 | 10.332 | −3.630 | 1.00 | 86.15 | C |
| ANISOU | 4378 | CA | CYS | B | 80 | 12523 | 11097 | 9113 | 217 | −1315 | −624 | C |
| ATOM | 4379 | C | CYS | B | 80 | 6.151 | 9.604 | −3.266 | 1.00 | 78.42 | C |
| ANISOU | 4379 | C | CYS | B | 80 | 11500 | 10087 | 8210 | 181 | −1440 | −690 | C |
| ATOM | 4380 | O | CYS | B | 80 | 5.059 | 10.018 | −3.661 | 1.00 | 79.37 | O |
| ANISOU | 4380 | O | CYS | B | 80 | 11615 | 10204 | 8338 | 166 | −1569 | −672 | O |
| ATOM | 4381 | CB | CYS | B | 80 | 7.695 | 11.445 | −2.622 | 1.00 | 97.18 | C |
| ANISOU | 4381 | CB | CYS | B | 80 | 13796 | 12489 | 10640 | 213 | −1257 | −555 | C |
| ATOM | 4382 | SG | CYS | B | 80 | 6.184 | 12.268 | −2.117 | 1.00 | 105.01 | S |
| ANISOU | 4382 | SG | CYS | B | 80 | 14681 | 13457 | 11762 | 185 | −1394 | −526 | S |
| ATOM | 4383 | N | ARG | B | 81 | 6.291 | 8.516 | −2.525 | 1.00 | 70.89 | N |
| ANISOU | 4383 | N | ARG | B | 81 | 10512 | 9109 | 7313 | 167 | −1403 | −761 | N |
| ATOM | 4384 | CA | ARG | B | 81 | 5.153 | 7.715 | −2.108 | 1.00 | 70.86 | C |
| ANISOU | 4384 | CA | ARG | B | 81 | 10461 | 9072 | 7390 | 129 | −1510 | −824 | C |
| ATOM | 4385 | C | ARG | B | 81 | 5.124 | 7.667 | −0.588 | 1.00 | 74.47 | C |
| ANISOU | 4385 | C | ARG | B | 81 | 10774 | 9506 | 8014 | 111 | −1457 | −827 | C |

TABLE 14-continued

| | | | | | | | | | | | | |
|---|---|---|---|---|---|---|---|---|---|---|---|---|
| ATOM | 4386 | O | ARG | B | 81 | 6.121 | 7.310 | 0.053 | 1.00 | 66.84 | | O |
| ANISOU | 4386 | O | ARG | B | 81 | 9789 | 8540 | 7069 | 123 | −1336 | −839 | O |
| ATOM | 4387 | CB | ARG | B | 81 | 5.226 | 6.313 | −2.706 | 1.00 | 66.71 | | C |
| ANISOU | 4387 | CB | ARG | B | 81 | 10043 | 8532 | 6773 | 126 | −1528 | −913 | C |
| ATOM | 4388 | CG | ARG | B | 81 | 3.957 | 5.508 | −2.579 | 1.00 | 72.21 | | C |
| ANISOU | 4388 | CG | ARG | B | 81 | 10713 | 9193 | 7532 | 82 | −1663 | −975 | C |
| ATOM | 4389 | CD | ARG | B | 81 | 4.035 | 4.295 | −3.482 | 1.00 | 80.66 | | C |
| ANISOU | 4389 | CD | ARG | B | 81 | 11921 | 10247 | 8477 | 82 | −1697 | −1058 | C |
| ATOM | 4390 | NE | ARG | B | 81 | 5.331 | 3.640 | −3.361 | 1.00 | 87.71 | | N |
| ANISOU | 4390 | NE | ARG | B | 81 | 12868 | 11140 | 9317 | 115 | −1551 | −1089 | N |
| ATOM | 4391 | CZ | ARG | B | 81 | 5.519 | 2.438 | −2.829 | 1.00 | 92.21 | | C |
| ANISOU | 4391 | CZ | ARG | B | 81 | 13434 | 11672 | 9929 | 105 | −1514 | −1161 | C |
| ATOM | 4392 | NH1 | ARG | B | 81 | 4.487 | 1.739 | −2.383 | 1.00 | 97.58 | | N |
| ANISOU | 4392 | NH1 | ARG | B | 81 | 14061 | 12312 | 10703 | 58 | −1613 | −1210 | N |
| ATOM | 4393 | NH2 | ARG | B | 81 | 6.741 | 1.929 | −2.755 | 1.00 | 90.16 | | N |
| ANISOU | 4393 | NH2 | ARG | B | 81 | 13221 | 11414 | 9620 | 142 | −1378 | −1180 | N |
| ATOM | 4394 | N | VAL | B | 82 | 3.984 | 8.039 | −0.026 | 1.00 | 74.87 | | N |
| ANISOU | 4394 | N | VAL | B | 82 | 10725 | 9540 | 8180 | 83 | −1547 | −814 | N |
| ATOM | 4395 | CA | VAL | B | 82 | 3.799 | 8.169 | 1.411 | 1.00 | 69.14 | | C |
| ANISOU | 4395 | CA | VAL | B | 82 | 9861 | 8795 | 7612 | 68 | −1506 | −808 | C |
| ATOM | 4396 | C | VAL | B | 82 | 2.617 | 7.304 | 1.789 | 1.00 | 67.95 | | C |
| ANISOU | 4396 | C | VAL | B | 82 | 9659 | 8614 | 7546 | 30 | −1603 | −861 | C |
| ATOM | 4397 | O | VAL | B | 82 | 1.532 | 7.458 | 1.215 | 1.00 | 68.17 | | O |
| ANISOU | 4397 | O | VAL | B | 82 | 9689 | 8638 | 7574 | 12 | −1730 | −857 | O |
| ATOM | 4398 | CB | VAL | B | 82 | 3.546 | 9.630 | 1.817 | 1.00 | 62.17 | | C |
| ANISOU | 4398 | CB | VAL | B | 82 | 8897 | 7921 | 6804 | 76 | −1508 | −728 | C |
| ATOM | 4399 | CG1 | VAL | B | 82 | 3.050 | 9.716 | 3.257 | 1.00 | 60.67 | | C |
| ANISOU | 4399 | CG1 | VAL | B | 82 | 8567 | 7707 | 6775 | 59 | −1492 | −731 | C |
| ATOM | 4400 | CG2 | VAL | B | 82 | 4.794 | 10.450 | 1.618 | 1.00 | 56.92 | | C |
| ANISOU | 4400 | CG2 | VAL | B | 82 | 8269 | 7281 | 6077 | 108 | −1401 | −674 | C |
| ATOM | 4401 | N | ASN | B | 83 | 2.818 | 6.390 | 2.733 | 1.00 | 62.20 | | N |
| ANISOU | 4401 | N | ASN | B | 83 | 8882 | 7863 | 6889 | 15 | −1546 | −908 | N |
| ATOM | 4402 | CA | ASN | B | 83 | 1.704 | 5.701 | 3.363 | 1.00 | 64.76 | | C |
| ANISOU | 4402 | CA | ASN | B | 83 | 9127 | 8155 | 7325 | −23 | −1620 | −945 | C |
| ATOM | 4403 | C | ASN | B | 83 | 1.709 | 5.983 | 4.859 | 1.00 | 64.02 | | C |
| ANISOU | 4403 | C | ASN | B | 83 | 8902 | 8052 | 7371 | −26 | −1547 | −924 | C |
| ATOM | 4404 | O | ASN | B | 83 | 2.767 | 6.094 | 5.482 | 1.00 | 59.30 | | O |
| ANISOU | 4404 | O | ASN | B | 83 | 8293 | 7462 | 6774 | −6 | −1429 | −914 | O |
| ATOM | 4405 | CB | ASN | B | 83 | 1.716 | 4.188 | 3.115 | 1.00 | 67.39 | | C |
| ANISOU | 4405 | CB | ASN | B | 83 | 9525 | 8460 | 7623 | −44 | −1637 | −1026 | C |
| ATOM | 4406 | CG | ASN | B | 83 | 0.297 | 3.584 | 3.142 | 1.00 | 77.21 | | C |
| ANISOU | 4406 | CG | ASN | B | 83 | 10719 | 9671 | 8944 | −91 | −1769 | −1058 | C |
| ATOM | 4407 | OD1 | ASN | B | 83 | −0.670 | 4.252 | 3.531 | 1.00 | 76.21 | | O |
| ANISOU | 4407 | OD1 | ASN | B | 83 | 10494 | 9546 | 8916 | −106 | −1833 | −1018 | O |
| ATOM | 4408 | ND2 | ASN | B | 83 | 0.177 | 2.320 | 2.734 | 1.00 | 80.22 | | N |
| ANISOU | 4408 | ND2 | ASN | B | 83 | 11170 | 10022 | 9287 | −115 | −1809 | −1130 | N |
| ATOM | 4409 | N | HIS | B | 84 | 0.511 | 6.098 | 5.417 | 1.00 | 59.51 | | N |
| ANISOU | 4409 | N | HIS | B | 84 | 8231 | 7464 | 6916 | −52 | −1620 | −915 | N |
| ATOM | 4410 | CA | HIS | B | 84 | 0.305 | 6.506 | 6.791 | 1.00 | 58.23 | | C |
| ANISOU | 4410 | CA | HIS | B | 84 | 7943 | 7294 | 6886 | −52 | −1565 | −890 | C |
| ATOM | 4411 | C | HIS | B | 84 | −1.093 | 6.038 | 7.140 | 1.00 | 65.06 | | C |
| ANISOU | 4411 | C | HIS | B | 84 | 8726 | 8135 | 7861 | −88 | −1658 | −905 | C |
| ATOM | 4412 | O | HIS | B | 84 | −1.955 | 5.972 | 6.262 | 1.00 | 66.75 | | O |
| ANISOU | 4412 | O | HIS | B | 84 | 8963 | 8345 | 8053 | −106 | −1778 | −909 | O |
| ATOM | 4413 | CB | HIS | B | 84 | 0.474 | 8.027 | 6.934 | 1.00 | 56.71 | | C |
| ANISOU | 4413 | CB | HIS | B | 84 | 7715 | 7122 | 6709 | −23 | −1539 | −821 | C |
| ATOM | 4414 | CG | HIS | B | 84 | 0.333 | 8.536 | 8.339 | 1.00 | 56.61 | | C |
| ANISOU | 4414 | CG | HIS | B | 84 | 7588 | 7102 | 6822 | −18 | −1476 | −797 | C |
| ATOM | 4415 | ND1 | HIS | B | 84 | −0.809 | 9.160 | 8.788 | 1.00 | 53.33 | | N |
| ANISOU | 4415 | ND1 | HIS | B | 84 | 7076 | 6675 | 6511 | −21 | −1533 | −767 | N |
| ATOM | 4416 | CD2 | HIS | B | 84 | 1.202 | 8.536 | 9.385 | 1.00 | 52.97 | | C |
| ANISOU | 4416 | CD2 | HIS | B | 84 | 7094 | 6641 | 6392 | −7 | −1363 | −799 | C |
| ATOM | 4417 | CE1 | HIS | B | 84 | −0.649 | 9.500 | 10.057 | 1.00 | 54.36 | | C |
| ANISOU | 4417 | CE1 | HIS | B | 84 | 7126 | 6799 | 6728 | −12 | −1453 | −756 | C |
| ATOM | 4418 | NE2 | HIS | B | 84 | 0.561 | 9.128 | 10.445 | 1.00 | 47.64 | | N |
| ANISOU | 4418 | NE2 | HIS | B | 84 | 6313 | 5956 | 5833 | −5 | −1353 | −775 | N |
| ATOM | 4419 | N | VAL | B | 85 | −1.304 | 5.679 | 8.409 | 1.00 | 61.90 | | N |
| ANISOU | 4419 | N | VAL | B | 85 | 8230 | 7717 | 7573 | −99 | −1605 | −913 | N |
| ATOM | 4420 | CA | VAL | B | 85 | −2.562 | 5.067 | 8.841 | 1.00 | 61.60 | | C |
| ANISOU | 4420 | CA | VAL | B | 85 | 8107 | 7653 | 7647 | −136 | −1677 | −927 | C |
| ATOM | 4421 | C | VAL | B | 85 | −3.773 | 5.875 | 8.380 | 1.00 | 63.15 | | C |
| ANISOU | 4421 | C | VAL | B | 85 | 8249 | 7853 | 7890 | −141 | −1791 | −886 | C |
| ATOM | 4422 | O | VAL | B | 85 | −4.878 | 5.342 | 8.265 | 1.00 | 66.56 | | O |
| ANISOU | 4422 | O | VAL | B | 85 | 8634 | 8267 | 8389 | −176 | −1886 | −899 | O |
| ATOM | 4423 | CB | VAL | B | 85 | −2.593 | 4.878 | 10.374 | 1.00 | 59.99 | | C |
| ANISOU | 4423 | CB | VAL | B | 85 | 7798 | 7436 | 7558 | −137 | −1588 | −923 | C |
| ATOM | 4424 | CG1 | VAL | B | 85 | −2.470 | 6.232 | 11.103 | 1.00 | 50.98 | | C |
| ANISOU | 4424 | CG1 | VAL | B | 85 | 6591 | 6314 | 6465 | −102 | −1529 | −867 | C |
| ATOM | 4425 | CG2 | VAL | B | 85 | −3.877 | 4.108 | 10.809 | 1.00 | 58.79 | | C |
| ANISOU | 4425 | CG2 | VAL | B | 85 | 7558 | 7256 | 7524 | −179 | −1654 | −936 | C |

TABLE 14-continued

| | | | | | | | | | | |
|---|---|---|---|---|---|---|---|---|---|---|
| ATOM | 4426 | N | THR | B | 86 | −3.584 | 7.165 | 8.123 | 1.00 | 64.11 | N |
| ANISOU | 4426 | N | THR | B | 86 | 8375 | 7999 | 7985 | −106 | −1785 | −834 | N |
| ATOM | 4427 | CA | THR | B | 86 | −4.682 | 8.041 | 7.737 | 1.00 | 65.04 | C |
| ANISOU | 4427 | CA | THR | B | 86 | 8439 | 8122 | 8154 | −103 | −1885 | −787 | C |
| ATOM | 4428 | C | THR | B | 86 | −4.937 | 8.045 | 6.231 | 1.00 | 73.41 | C |
| ANISOU | 4428 | C | THR | B | 86 | 9593 | 9192 | 9109 | −110 | −2004 | −788 | C |
| ATOM | 4429 | O | THR | B | 86 | −5.765 | 8.838 | 5.752 | 1.00 | 69.59 | O |
| ANISOU | 4429 | O | THR | B | 86 | 9077 | 8716 | 8650 | −103 | −2096 | −743 | O |
| ATOM | 4430 | CB | THR | B | 86 | −4.415 | 9.473 | 8.204 | 1.00 | 63.45 | C |
| ANISOU | 4430 | CB | THR | B | 86 | 8195 | 7932 | 7980 | −60 | −1825 | −727 | C |
| ATOM | 4431 | OG1 | THR | B | 86 | −3.238 | 9.970 | 7.558 | 1.00 | 67.20 | O |
| ANISOU | 4431 | OG1 | THR | B | 86 | 8774 | 8426 | 8331 | −35 | −1776 | −716 | O |
| ATOM | 4432 | CG2 | THR | B | 86 | −4.227 | 9.529 | 9.699 | 1.00 | 61.63 | C |
| ANISOU | 4432 | CG2 | THR | B | 86 | 7876 | 7692 | 7849 | −51 | −1716 | −727 | C |
| ATOM | 4433 | N | LEU | B | 87 | −4.243 | 7.188 | 5.478 | 1.00 | 73.58 | N |
| ANISOU | 4433 | N | LEU | B | 87 | 9732 | 9214 | 9010 | −122 | −2005 | −838 | N |
| ATOM | 4434 | CA | LEU | B | 87 | −4.395 | 7.075 | 4.034 | 1.00 | 72.98 | C |
| ANISOU | 4434 | CA | LEU | B | 87 | 9765 | 9149 | 8815 | −128 | −2112 | −849 | C |
| ATOM | 4435 | C | LEU | B | 87 | −4.923 | 5.689 | 3.689 | 1.00 | 76.78 | C |
| ANISOU | 4435 | C | LEU | B | 87 | 10276 | 9603 | 9293 | −176 | −2194 | −917 | C |
| ATOM | 4436 | O | LEU | B | 87 | −4.439 | 4.686 | 4.222 | 1.00 | 72.92 | O |
| ANISOU | 4436 | O | LEU | B | 87 | 9799 | 9094 | 8815 | −190 | −2124 | −968 | O |
| ATOM | 4437 | CB | LEU | B | 87 | −3.066 | 7.331 | 3.333 | 1.00 | 65.05 | C |
| ANISOU | 4437 | CB | LEU | B | 87 | 8889 | 8168 | 7658 | −95 | −2038 | −848 | C |
| ATOM | 4438 | CG | LEU | B | 87 | −2.531 | 8.731 | 3.608 | 1.00 | 63.62 | C |
| ANISOU | 4438 | CG | LEU | B | 87 | 8682 | 8009 | 7482 | −53 | −1964 | −778 | C |
| ATOM | 4439 | CD1 | LEU | B | 87 | −1.113 | 8.879 | 3.084 | 1.00 | 61.27 | C |
| ANISOU | 4439 | CD1 | LEU | B | 87 | 8498 | 7733 | 7049 | −24 | −1869 | −776 | C |
| ATOM | 4440 | CD2 | LEU | B | 87 | −3.447 | 9.782 | 2.991 | 1.00 | 61.65 | C |
| ANISOU | 4440 | CD2 | LEU | B | 87 | 8409 | 7770 | 7247 | −43 | −2073 | −717 | C |
| ATOM | 4441 | N | SER | B | 88 | −5.928 | 5.634 | 2.807 | 1.00 | 81.68 | N |
| ANISOU | 4441 | N | SER | B | 88 | 10909 | 10223 | 9904 | −201 | −2345 | −916 | N |
| ATOM | 4442 | CA | SER | B | 88 | −6.465 | 4.339 | 2.400 | 1.00 | 80.96 | C |
| ANISOU | 4442 | CA | SER | B | 88 | 10853 | 10101 | 9808 | −251 | −2438 | −983 | C |
| ATOM | 4443 | C | SER | B | 88 | −5.466 | 3.599 | 1.521 | 1.00 | 82.22 | C |
| ANISOU | 4443 | C | SER | B | 88 | 11180 | 10260 | 9802 | −245 | −2413 | −1044 | C |
| ATOM | 4444 | O | SER | B | 88 | −5.238 | 2.392 | 1.689 | 1.00 | 80.80 | O |
| ANISOU | 4444 | O | SER | B | 88 | 11036 | 10047 | 9618 | −271 | −2392 | −1111 | O |
| ATOM | 4445 | CB | SER | B | 88 | −7.792 | 4.534 | 1.667 | 1.00 | 84.47 | C |
| ANISOU | 4445 | CB | SER | B | 88 | 11265 | 10545 | 10283 | −281 | −2616 | −963 | C |
| ATOM | 4446 | OG | SER | B | 88 | −8.504 | 5.650 | 2.179 | 1.00 | 85.31 | O |
| ANISOU | 4446 | OG | SER | B | 88 | 11244 | 10666 | 10503 | −262 | −2630 | −887 | O |
| ATOM | 4447 | N | GLN | B | 89 | −4.847 | 4.322 | 0.599 | 1.00 | 82.81 | N |
| ANISOU | 4447 | N | GLN | B | 89 | 11357 | 10368 | 9738 | −207 | −2408 | −1018 | N |
| ATOM | 4448 | CA | GLN | B | 89 | −3.814 | 3.868 | −0.308 | 1.00 | 84.17 | C |
| ANISOU | 4448 | CA | GLN | B | 89 | 11694 | 10549 | 9739 | −186 | −2368 | −1062 | C |
| ATOM | 4449 | C | GLN | B | 89 | −2.711 | 4.917 | −0.320 | 1.00 | 74.89 | C |
| ANISOU | 4449 | C | GLN | B | 89 | 10549 | 9411 | 8494 | −131 | −2247 | −1006 | C |
| ATOM | 4450 | O | GLN | B | 89 | −2.963 | 6.090 | −0.026 | 1.00 | 71.45 | O |
| ANISOU | 4450 | O | GLN | B | 89 | 10036 | 8996 | 8116 | −112 | −2244 | −933 | O |
| ATOM | 4451 | CB | GLN | B | 89 | −4.383 | 3.658 | −1.723 | 1.00 | 95.13 | C |
| ANISOU | 4451 | CB | GLN | B | 89 | 13193 | 11941 | 11010 | −203 | −2522 | −1086 | C |
| ATOM | 4452 | CG | GLN | B | 89 | −3.841 | 2.422 | −2.470 | 1.00 | 110.09 | C |
| ANISOU | 4452 | CG | GLN | B | 89 | 15240 | 13813 | 12775 | −213 | −2527 | −1176 | C |
| ATOM | 4453 | CD | GLN | B | 89 | −3.982 | 1.118 | −1.674 | 1.00 | 117.57 | C |
| ANISOU | 4453 | CD | GLN | B | 89 | 16143 | 14708 | 13819 | −254 | −2504 | −1245 | C |
| ATOM | 4454 | OE1 | GLN | B | 89 | −5.092 | 0.721 | −1.297 | 1.00 | 121.60 | O |
| ANISOU | 4454 | OE1 | GLN | B | 89 | 16560 | 15189 | 14453 | −305 | −2603 | −1255 | O |
| ATOM | 4455 | NE2 | GLN | B | 89 | −2.851 | 0.446 | −1.422 | 1.00 | 115.29 | N |
| ANISOU | 4455 | NE2 | GLN | B | 89 | 15920 | 14407 | 13479 | −231 | −2372 | −1289 | N |
| ATOM | 4456 | N | PRO | B | 90 | −1.480 | 4.524 | −0.616 | 1.00 | 75.81 | N |
| ANISOU | 4456 | N | PRO | B | 90 | 10773 | 9535 | 8496 | −103 | −2143 | −1036 | N |
| ATOM | 4457 | CA | PRO | B | 90 | −0.378 | 5.490 | −0.593 | 1.00 | 72.10 | C |
| ANISOU | 4457 | CA | PRO | B | 90 | 10326 | 9100 | 7970 | −55 | −2021 | −980 | C |
| ATOM | 4458 | C | PRO | B | 90 | −0.683 | 6.713 | −1.446 | 1.00 | 77.60 | C |
| ANISOU | 4458 | C | PRO | B | 90 | 11051 | 9829 | 8605 | −34 | −2090 | −909 | C |
| ATOM | 4459 | O | PRO | B | 90 | −1.359 | 6.630 | −2.473 | 1.00 | 79.99 | O |
| ANISOU | 4459 | O | PRO | B | 90 | 11423 | 10136 | 8833 | −46 | −2218 | −918 | O |
| ATOM | 4460 | CB | PRO | B | 90 | 0.807 | 4.695 | −1.150 | 1.00 | 68.78 | C |
| ANISOU | 4460 | CB | PRO | B | 90 | 10039 | 8682 | 7412 | −32 | −1934 | −1031 | C |
| ATOM | 4461 | CG | PRO | B | 90 | 0.336 | 3.277 | −1.305 | 1.00 | 73.79 | C |
| ANISOU | 4461 | CG | PRO | B | 90 | 10715 | 9276 | 8045 | −68 | −2001 | −1120 | C |
| ATOM | 4462 | CD | PRO | B | 90 | −0.989 | 3.139 | −0.653 | 1.00 | 78.01 | C |
| ANISOU | 4462 | CD | PRO | B | 90 | 11125 | 9783 | 8730 | −116 | −2105 | −1120 | C |
| ATOM | 4463 | N | LYS | B | 91 | −0.212 | 7.866 | −0.984 | 1.00 | 73.44 | N |
| ANISOU | 4463 | N | LYS | B | 91 | 10468 | 9321 | 8114 | −4 | −2009 | −838 | N |
| ATOM | 4464 | CA | LYS | B | 91 | −0.344 | 9.104 | −1.731 | 1.00 | 74.22 | C |
| ANISOU | 4464 | CA | LYS | B | 91 | 10595 | 9447 | 8157 | 20 | −2053 | −762 | C |
| ATOM | 4465 | C | LYS | B | 91 | 0.971 | 9.348 | −2.451 | 1.00 | 83.13 | C |
| ANISOU | 4465 | C | LYS | B | 91 | 11844 | 10604 | 9136 | 58 | −1952 | −744 | C |

TABLE 14-continued

| | | | | | | | | | | | | |
|---|---|---|---|---|---|---|---|---|---|---|---|---|
| ATOM | 4466 | O | LYS | B | 91 | 2.032 | 9.407 | −1.817 | 1.00 | 83.03 | | O |
| ANISOU | 4466 | O | LYS | B | 91 | 11813 | 10595 | 9139 | 76 | −1813 | −738 | O |
| ATOM | 4467 | CB | LYS | B | 91 | −0.704 | 10.280 | −0.824 | 1.00 | 68.91 | | C |
| ANISOU | 4467 | CB | LYS | B | 91 | 9788 | 8772 | 7622 | 29 | −2032 | −692 | C |
| ATOM | 4468 | CG | LYS | B | 91 | −1.034 | 11.527 | −1.610 | 1.00 | 75.87 | | C |
| ANISOU | 4468 | CG | LYS | B | 91 | 10694 | 9674 | 8461 | 52 | −2098 | −612 | C |
| ATOM | 4469 | CD | LYS | B | 91 | −1.104 | 12.776 | −0.737 | 1.00 | 76.45 | | C |
| ANISOU | 4469 | CD | LYS | B | 91 | 10654 | 9739 | 8654 | 70 | −2049 | −541 | C |
| ATOM | 4470 | CE | LYS | B | 91 | −2.369 | 12.836 | 0.116 | 1.00 | 77.08 | | C |
| ANISOU | 4470 | CE | LYS | B | 91 | 10594 | 9795 | 8899 | 50 | −2121 | −541 | C |
| ATOM | 4471 | NZ | LYS | B | 91 | −2.522 | 14.181 | 0.752 | 1.00 | 79.02 | | N |
| ANISOU | 4471 | NZ | LYS | B | 91 | 10750 | 10032 | 9244 | 76 | −2089 | −468 | N |
| ATOM | 4472 | N | ILE | B | 92 | 0.907 | 9.447 | −3.773 | 1.00 | 85.99 | | N |
| ANISOU | 4472 | N | ILE | B | 92 | 12330 | 10988 | 9354 | 71 | −2022 | −735 | N |
| ATOM | 4473 | CA | ILE | B | 92 | 2.074 | 9.714 | −4.599 | 1.00 | 81.49 | | C |
| ANISOU | 4473 | CA | ILE | B | 92 | 11883 | 10449 | 8630 | 109 | −1932 | −711 | C |
| ATOM | 4474 | C | ILE | B | 92 | 2.080 | 11.190 | −4.935 | 1.00 | 77.42 | | C |
| ANISOU | 4474 | C | ILE | B | 92 | 11356 | 9957 | 8105 | 134 | −1938 | −609 | C |
| ATOM | 4475 | O | ILE | B | 92 | 1.053 | 11.742 | −5.342 | 1.00 | 83.35 | | O |
| ANISOU | 4475 | O | ILE | B | 92 | 12089 | 10708 | 8871 | 126 | −2066 | −573 | O |
| ATOM | 4476 | CB | ILE | B | 92 | 2.066 | 8.863 | −5.877 | 1.00 | 86.91 | | C |
| ANISOU | 4476 | CB | ILE | B | 92 | 12729 | 11145 | 9147 | 112 | −1997 | −767 | C |
| ATOM | 4477 | CG1 | ILE | B | 92 | 2.322 | 7.396 | −5.533 | 1.00 | 87.61 | | C |
| ANISOU | 4477 | CG1 | ILE | B | 92 | 12842 | 11205 | 9239 | 94 | −1962 | −868 | C |
| ATOM | 4478 | CG2 | ILE | B | 92 | 3.098 | 9.388 | −6.860 | 1.00 | 86.77 | | C |
| ANISOU | 4478 | CG2 | ILE | B | 92 | 12838 | 11166 | 8966 | 157 | −1917 | −721 | C |
| ATOM | 4479 | CD1 | ILE | B | 92 | 2.588 | 6.520 | −6.745 | 1.00 | 90.97 | | C |
| ANISOU | 4479 | CD1 | ILE | B | 92 | 13442 | 11637 | 9487 | 106 | −1991 | −931 | C |
| ATOM | 4480 | N | VAL | B | 93 | 3.223 | 11.837 | −4.757 | 1.00 | 71.28 | | N |
| ANISOU | 4480 | N | VAL | B | 93 | 10582 | 9194 | 7306 | 162 | −1802 | −559 | N |
| ATOM | 4481 | CA | VAL | B | 93 | 3.364 | 13.245 | −5.091 | 1.00 | 72.13 | | C |
| ANISOU | 4481 | CA | VAL | B | 93 | 10687 | 9318 | 7401 | 185 | −1793 | −458 | C |
| ATOM | 4482 | C | VAL | B | 93 | 4.519 | 13.391 | −6.061 | 1.00 | 81.22 | | C |
| ANISOU | 4482 | C | VAL | B | 93 | 11968 | 10502 | 8388 | 219 | −1703 | −428 | C |
| ATOM | 4483 | O | VAL | B | 93 | 5.657 | 13.011 | −5.751 | 1.00 | 79.33 | | O |
| ANISOU | 4483 | O | VAL | B | 93 | 11743 | 10269 | 8131 | 231 | −1567 | −446 | O |
| ATOM | 4484 | CB | VAL | B | 93 | 3.566 | 14.120 | −3.852 | 1.00 | 69.30 | | C |
| ANISOU | 4484 | CB | VAL | B | 93 | 10192 | 8941 | 7200 | 184 | −1718 | −411 | C |
| ATOM | 4485 | CG1 | VAL | B | 93 | 4.027 | 15.498 | −4.286 | 1.00 | 66.52 | | C |
| ANISOU | 4485 | CG1 | VAL | B | 93 | 9860 | 8602 | 6814 | 210 | −1681 | −310 | C |
| ATOM | 4486 | CG2 | VAL | B | 93 | 2.248 | 14.221 | −3.079 | 1.00 | 69.23 | | C |
| ANISOU | 4486 | CG2 | VAL | B | 93 | 10060 | 8903 | 7341 | 159 | −1822 | −422 | C |
| ATOM | 4487 | N | LYS | B | 94 | 4.222 | 13.933 | −7.235 | 1.00 | 83.61 | | N |
| ANISOU | 4487 | N | LYS | B | 94 | 12366 | 10828 | 8574 | 236 | −1777 | −379 | N |
| ATOM | 4488 | CA | LYS | B | 94 | 5.207 | 14.051 | −8.291 | 1.00 | 85.92 | | C |
| ANISOU | 4488 | CA | LYS | B | 94 | 12795 | 11156 | 8896 | 271 | −1701 | −347 | C |
| ATOM | 4489 | C | LYS | B | 94 | 6.124 | 15.240 | −8.030 | 1.00 | 80.77 | | C |
| ANISOU | 4489 | C | LYS | B | 94 | 12102 | 10510 | 8075 | 291 | −1581 | −250 | C |
| ATOM | 4490 | O | LYS | B | 94 | 5.714 | 16.270 | −7.482 | 1.00 | 73.54 | | O |
| ANISOU | 4490 | O | LYS | B | 94 | 11089 | 9577 | 7276 | 283 | −1607 | −188 | O |
| ATOM | 4491 | CB | LYS | B | 94 | 4.509 | 14.183 | −9.652 | 1.00 | 90.80 | | C |
| ANISOU | 4491 | CB | LYS | B | 94 | 13535 | 11797 | 9169 | 281 | −1832 | −328 | C |
| ATOM | 4492 | CG | LYS | B | 94 | 3.953 | 12.859 | −10.184 | 1.00 | 91.80 | | C |
| ANISOU | 4492 | CG | LYS | B | 94 | 13748 | 11920 | 9211 | 266 | −1927 | −431 | C |
| ATOM | 4493 | CD | LYS | B | 94 | 2.564 | 12.992 | −10.806 | 1.00 | 91.73 | | C |
| ANISOU | 4493 | CD | LYS | E | 94 | 13757 | 11910 | 9186 | 247 | −2125 | −427 | C |
| ATOM | 4494 | CE | LYS | B | 94 | 1.847 | 11.644 | −10.812 | 1.00 | 87.30 | | C |
| ANISOU | 4494 | CE | LYS | B | 94 | 13218 | 11328 | 8625 | 213 | −2226 | −540 | C |
| ATOM | 4495 | NZ | LYS | B | 94 | 1.655 | 11.124 | −9.418 | 1.00 | 84.61 | | N |
| ANISOU | 4495 | NZ | LYS | B | 94 | 12729 | 10949 | 8470 | 180 | −2191 | −591 | N |
| ATOM | 4496 | N | TRP | B | 95 | 7.382 | 15.079 | −8.423 | 1.00 | 81.31 | | N |
| ANISOU | 4496 | N | TRP | B | 95 | 12246 | 10603 | 8044 | 316 | −1447 | −238 | N |
| ATOM | 4497 | CA | TRP | B | 95 | 8.385 | 16.122 | −8.249 | 1.00 | 81.80 | | C |
| ANISOU | 4497 | CA | TRP | B | 95 | 12278 | 10673 | 8129 | 332 | −1324 | −147 | C |
| ATOM | 4498 | C | TRP | B | 95 | 8.228 | 17.165 | −9.350 | 1.00 | 87.88 | | C |
| ANISOU | 4498 | C | TRP | B | 95 | 13129 | 11465 | 8798 | 354 | −1367 | −49 | C |
| ATOM | 4499 | O | TRP | B | 95 | 8.635 | 16.950 | −10.495 | 1.00 | 82.34 | | O |
| ANISOU | 4499 | O | TRP | B | 95 | 12564 | 10797 | 7925 | 381 | −1346 | −37 | O |
| ATOM | 4500 | CB | TRP | B | 95 | 9.785 | 15.523 | −8.261 | 1.00 | 79.70 | | C |
| ANISOU | 4500 | CB | TRP | B | 95 | 12055 | 10427 | 7802 | 352 | −1163 | −166 | C |
| ATOM | 4501 | CG | TRP | B | 95 | 10.815 | 16.585 | −8.227 | 1.00 | 81.87 | | C |
| ANISOU | 4501 | CG | TRP | B | 95 | 12306 | 10713 | 8090 | 365 | −1043 | −66 | C |
| ATOM | 4502 | CD1 | TRP | B | 95 | 10.814 | 17.704 | −7.437 | 1.00 | 80.41 | | C |
| ANISOU | 4502 | CD1 | TRP | B | 95 | 12007 | 10503 | 8043 | 348 | −1030 | 1 | C |
| ATOM | 4503 | CD2 | TRP | B | 95 | 11.973 | 16.678 | −9.052 | 1.00 | 84.27 | | C |
| ANISOU | 4503 | CD2 | TRP | B | 95 | 12702 | 11051 | 8265 | 399 | −922 | −18 | C |
| ATOM | 4504 | NE1 | TRP | B | 95 | 11.917 | 18.471 | −7.701 | 1.00 | 79.77 | | N |
| ANISOU | 4504 | NE1 | TRP | B | 95 | 11940 | 10436 | 7934 | 363 | −912 | 87 | N |
| ATOM | 4505 | CE2 | TRP | B | 95 | 12.647 | 17.867 | −8.691 | 1.00 | 84.51 | | C |
| ANISOU | 4505 | CE2 | TRP | B | 95 | 12662 | 11076 | 8373 | 394 | −840 | 81 | C |

TABLE 14-continued

| | | | | | | | | | | | | |
|---|---|---|---|---|---|---|---|---|---|---|---|---|
| ATOM | 4506 | CE3 | TRP | B | 95 | 12.517 | 15.869 | −10.054 | 1.00 | 84.77 | | C |
| ANISOU | 4506 | CE3 | TRP | B | 95 | 12902 | 11149 | 8157 | 433 | −869 | −49 | C |
| ATOM | 4507 | CZ2 | TRP | B | 95 | 13.832 | 18.265 | −9.297 | 1.00 | 85.77 | | C |
| ANISOU | 4507 | CZ2 | TRP | B | 95 | 12876 | 11265 | 8450 | 419 | −710 | 156 | C |
| ATOM | 4508 | CZ3 | TRP | B | 95 | 13.697 | 16.262 | −10.649 | 1.00 | 85.89 | | C |
| ANISOU | 4508 | CZ3 | TRP | B | 95 | 13099 | 11322 | 8212 | 463 | −733 | 24 | C |
| ATOM | 4509 | CH2 | TRP | B | 95 | 14.343 | 17.451 | −10.270 | 1.00 | 86.65 | | C |
| ANISOU | 4509 | CH2 | TRP | B | 95 | 13115 | 11413 | 8394 | 455 | −654 | 128 | C |
| ATOM | 4510 | N | ASP | B | 96 | 7.641 | 18.307 | −9.004 | 1.00 | 94.51 | | N |
| ANISOU | 4510 | N | ASP | B | 96 | 13886 | 12282 | 9740 | 344 | −1424 | 22 | N |
| ATOM | 4511 | CA | ASP | B | 96 | 7.499 | 19.423 | −9.937 | 1.00 | 101.27 | | C |
| ANISOU | 4511 | CA | ASP | B | 96 | 14806 | 13152 | 10522 | 365 | −1462 | 127 | C |
| ATOM | 4512 | C | ASP | B | 96 | 8.770 | 20.259 | −9.847 | 1.00 | 103.44 | | C |
| ANISOU | 4512 | C | ASP | B | 96 | 15069 | 13430 | 10803 | 377 | −1309 | 212 | C |
| ATOM | 4513 | O | ASP | B | 96 | 8.951 | 21.041 | −8.911 | 1.00 | 101.67 | | O |
| ANISOU | 4513 | O | ASP | B | 96 | 14732 | 13173 | 10725 | 361 | −1268 | 251 | O |
| ATOM | 4514 | CB | ASP | B | 96 | 6.255 | 20.247 | −9.620 | 1.00 | 105.28 | | C |
| ANISOU | 4514 | CB | ASP | B | 96 | 15229 | 13628 | 11144 | 352 | −1596 | 165 | C |
| ATOM | 4515 | CG | ASP | B | 96 | 5.866 | 21.192 | −10.753 | 1.00 | 110.64 | | C |
| ANISOU | 4515 | CG | ASP | B | 96 | 15990 | 14322 | 11725 | 376 | −1672 | 263 | C |
| ATOM | 4516 | OD1 | ASP | B | 96 | 6.720 | 21.500 | −11.617 | 1.00 | 111.88 | | O |
| ANISOU | 4516 | OD1 | ASP | B | 96 | 16250 | 14508 | 11750 | 400 | −1593 | 323 | O |
| ATOM | 4517 | OD2 | ASP | B | 96 | 4.698 | 21.636 | −10.773 | 1.00 | 111.95 | | O |
| ANISOU | 4517 | OD2 | ASP | B | 96 | 16116 | 14471 | 11950 | 371 | −1809 | 283 | O |
| ATOM | 4518 | N | ARG | B | 97 | 9.658 | 20.084 | −10.827 | 1.00 | 108.88 | | N |
| ANISOU J | 4518 | N | ARG | B | 97 | 15879 | 14158 | 11332 | 404 | −1225 | 240 | N |
| ATOM | 4519 | CA | ARG | B | 97 | 10.918 | 20.819 | −10.833 | 1.00 | 109.05 | | C |
| ANISOU | 4519 | CA | ARG | B | 97 | 15894 | 14187 | 11353 | 415 | −1074 | 326 | C |
| ATOM | 4520 | C | ARG | B | 97 | 10.677 | 22.322 | −10.890 | 1.00 | 116.96 | | C |
| ANISOU | 4520 | C | ARG | B | 97 | 16857 | 15165 | 12417 | 412 | −1103 | 443 | C |
| ATOM | 4521 | O | ARG | B | 97 | 11.269 | 23.092 | −10.123 | 1.00 | 112.85 | | O |
| ANISOU | 4521 | O | ARG | B | 97 | 16243 | 14617 | 12020 | 397 | −1023 | 493 | O |
| ATOM | 4522 | CB | ARG | B | 97 | 11.771 | 20.366 | −12.017 | 1.00 | 106.44 | | C |
| ANISOU | 4522 | CB | ARG | B | 97 | 15711 | 13906 | 10826 | 451 | −988 | 341 | C |
| ATOM | 4523 | CG | ARG | B | 97 | 11.808 | 18.852 | −12.218 | 1.00 | 104.84 | | C |
| ANISOU | 4523 | CG | ARG | B | 97 | 15579 | 13724 | 10533 | 461 | −986 | 221 | C |
| ATOM | 4524 | CD | ARG | B | 97 | 12.270 | 18.502 | −13.628 | 1.00 | 105.00 | | C |
| ANISOU | 4524 | CD | ARG | B | 97 | 15773 | 13792 | 10331 | 504 | −945 | 237 | C |
| ATOM | 4525 | NE | ARG | B | 97 | 13.404 | 19.325 | −14.044 | 1.00 | 103.43 | | N |
| ANISOU | 4525 | NE | ARG | B | 97 | 15597 | 13615 | 10086 | 526 | −803 | 347 | N |
| ATOM | 4526 | CZ | ARG | B | 97 | 14.604 | 18.847 | −14.364 | 1.00 | 106.34 | | C |
| ANISOU | 4526 | CZ | ARG | B | 97 | 16019 | 14014 | 10371 | 555 | −648 | 348 | C |
| ATOM | 4527 | NH1 | ARG | B | 97 | 14.838 | 17.538 | −14.333 | 1.00 | 104.94 | | N |
| ANISOU | 4527 | NH1 | ARG | B | 97 | 15885 | 13846 | 10140 | 569 | −615 | 240 | N |
| ATOM | 4528 | NH2 | ARG | B | 97 | 15.572 | 19.682 | −14.724 | 1.00 | 108.46 | | N |
| ANISOU | 4528 | NH2 | ARG | B | 97 | 16296 | 14300 | 10613 | 571 | −524 | 459 | N |
| ATOM | 4529 | N | ASP | B | 98 | 9.796 | 22.756 | −11.788 | 1.00 | 131.99 | | N |
| ANISOU | 4529 | N | ASP | B | 98 | 18834 | 17077 | 14241 | 427 | −1223 | 487 | N |
| ATOM | 4530 | CA | ASP | B | 98 | 9.540 | 24.176 | −12.028 | 1.00 | 142.25 | | C |
| ANISOU | 4530 | CA | ASP | B | 98 | 20116 | 18354 | 15579 | 431 | −1257 | 606 | C |
| ATOM | 4531 | C | ASP | B | 98 | 8.416 | 24.720 | −11.159 | 1.00 | 145.26 | | C |
| ANISOU | 4531 | C | ASP | B | 98 | 20377 | 18685 | 16129 | 411 | −1372 | 599 | C |
| ATOM | 4532 | O | ASP | B | 98 | 7.579 | 25.499 | −11.630 | 1.00 | 144.94 | | O |
| ANISOU | 4532 | O | ASP | B | 98 | 20351 | 18632 | 16086 | 422 | −1479 | 664 | O |
| ATOM | 4533 | CB | ASP | B | 98 | 9.237 | 24.385 | −13.507 | 1.00 | 146.62 | | C |
| ANISOU | 4533 | CB | ASP | B | 98 | 20817 | 18944 | 15946 | 463 | −1321 | 667 | C |
| ATOM | 4534 | CG | ASP | B | 98 | 10.190 | 23.615 | −14.409 | 1.00 | 149.10 | | C |
| ANISOU | 4534 | CG | ASP | B | 98 | 21265 | 19313 | 16074 | 489 | −1219 | 651 | C |
| ATOM | 4535 | OD1 | ASP | B | 98 | 11.365 | 24.024 | −14.536 | 1.00 | 149.65 | | O |
| ANISOU | 4535 | OD1 | ASP | B | 98 | 21347 | 19393 | 16121 | 498 | −1070 | 718 | O |
| ATOM | 4536 | OD2 | ASP | B | 98 | 9.768 | 22.580 | −14.971 | 1.00 | 150.13 | | O |
| ANISOU | 4536 | OD2 | ASP | B | 98 | 21485 | 19472 | 16084 | 500 | −1285 | 569 | O |
| ATOM | 4537 | N | MET | B | 99 | 8.379 | 24.331 | −9.886 | 1.00 | 146.92 | | N |
| ANISOU | 4537 | N | MET | B | 99 | 20468 | 18866 | 16488 | 385 | −1349 | 525 | N |
| ATOM | 4538 | CA | MET | B | 99 | 7.338 | 24.770 | −8.962 | 1.00 | 144.48 | | C |
| ANISOU | 4538 | CA | MET | B | 99 | 20040 | 18510 | 16345 | 369 | −1444 | 510 | C |
| ATOM | 4539 | C | MET | B | 99 | 7.417 | 26.288 | −8.738 | 1.00 | 144.34 | | C |
| ANISOU | 4539 | C | MET | B | 99 | 19971 | 18449 | 16423 | 372 | −1427 | 619 | C |
| ATOM | 4540 | O | MET | B | 99 | 8.438 | 26.914 | −9.034 | 1.00 | 143.24 | | O |
| ANISOU | 4540 | O | MET | B | 99 | 19865 | 18312 | 16249 | 376 | −1322 | 695 | O |
| ATOM | 4541 | CB | MET | B | 99 | 7.463 | 24.012 | −7.635 | 1.00 | 140.18 | | C |
| ANISOU | 4541 | CB | MET | B | 99 | 19389 | 17946 | 15926 | 343 | −1399 | 411 | C |
| ATOM | 4542 | CG | MET | B | 99 | 6.254 | 24.109 | −6.721 | 1.00 | 139.96 | | C |
| ANISOU | 4542 | CG | MET | B | 99 | 19249 | 17879 | 16049 | 329 | −1503 | 371 | C |
| ATOM | 4543 | SD | MET | B | 99 | 4.816 | 23.241 | −7.373 | 1.00 | 143.77 | | S |
| ANISOU | 4543 | SD | MET | B | 99 | 19774 | 18384 | 16469 | 332 | −1677 | 311 | S |
| ATOM | 4544 | CE | MET | B | 99 | 3.571 | 23.656 | −6.151 | 1.00 | 142.44 | | C |
| ANISOU | 4544 | CE | MET | B | 99 | 19448 | 18164 | 16510 | 320 | −1764 | 292 | C |
| ATOM | 4545 | OXT | MET | B | 99 | 6.473 | 26.939 | −8.275 | 1.00 | 143.95 | | O |
| ANISOU | 4545 | OXT | MET | B | 99 | 19846 | 18358 | 16488 | 371 | −1515 | 637 | O |

TABLE 14-continued

| | | | | | | | | | | | | |
|---|---|---|---|---|---|---|---|---|---|---|---|---|
| TER | 4550 | | MET | B | 99 | | | | | | | |
| HETATM | 4546 | O | HOH | S | 1 | 17.892 | 37.368 | 30.353 | 1.00 | 40.07 | | O |
| ANISOU | 4546 | O | HOH | S | 1 | 5415 | 3973 | 5835 | −285 | −794 | −694 | O |
| HETATM | 4547 | O | HOH | S | 2 | 11.507 | 1.498 | 32.739 | 1.00 | 36.15 | | O |
| ANISOU | 4547 | O | HOH | S | 2 | 4408 | 4600 | 4727 | 111 | −123 | −791 | O |
| HETATM | 4548 | O | HOH | S | 3 | 12.155 | 0.458 | 35.489 | 1.00 | 33.70 | | O |
| ANISOU | 4548 | O | HOH | S | 3 | 4081 | 4318 | 4404 | 137 | −51 | −751 | O |
| HETATM | 4549 | O | HOH | S | 4 | 11.881 | 13.903 | 44.664 | 1.00 | 35.26 | | O |
| ANISOU | 4549 | O | HOH | S | 4 | 4557 | 4517 | 4323 | 229 | −124 | −1009 | O |
| HETATM | 4550 | O | HOH | S | 5 | 11.742 | 9.505 | 41.303 | 1.00 | 36.06 | | O |
| ANISOU | 4550 | O | HOH | S | 5 | 4483 | 4669 | 4549 | 188 | −91 | −871 | O |
| HETATM | 4551 | O | HOH | S | 6 | 2.308 | 12.003 | 22.199 | 1.00 | 38.83 | | O |
| ANISOU | 4551 | O | HOH | S | 6 | 4710 | 4802 | 5240 | 95 | −721 | −753 | O |
| HETATM | 4552 | O | HOH | S | 7 | 10.632 | −1.991 | 35.395 | 1.00 | 33.53 | | O |
| ANISOU | 4552 | O | HOH | S | 7 | 4043 | 4236 | 4460 | 125 | −20 | −739 | O |
| HETATM | 4553 | O | HOH | S | 8 | 16.350 | −9.052 | 29.923 | 1.00 | 39.58 | | O |
| ANISOU | 4553 | O | HOH | S | 8 | 5036 | 4832 | 5169 | 236 | 66 | −780 | O |
| HETATM | 4554 | O | HOH | S | 10 | 18.563 | 3.779 | 38.339 | 1.00 | 33.05 | | O |
| ANISOU | 4554 | O | HOH | S | 10 | 4013 | 4392 | 4155 | 143 | −123 | −694 | O |
| HETATM | 4555 | O | HOH | S | 11 | 7.610 | 9.920 | 43.592 | 1.00 | 35.51 | | O |
| ANISOU | 4555 | O | HOH | S | 11 | 4400 | 4572 | 4519 | 291 | 70 | −897 | O |
| HETATM | 4556 | O | HOH | S | 12 | 8.532 | 8.208 | 39.374 | 1.00 | 39.65 | | O |
| ANISOU | 4556 | O | HOH | S | 12 | 4838 | 5079 | 5148 | 200 | −45 | −847 | O |
| HETATM | 4557 | O | HOH | S | 13 | 13.734 | 15.870 | 38.182 | 1.00 | 43.60 | | O |
| ANISOU | 4557 | O | HOH | S | 13 | 5503 | 5490 | 5574 | 98 | −293 | −929 | O |
| HETATM | 4558 | O | HOH | S | 14 | 17.162 | 16.496 | 40.676 | 1.00 | 41.05 | | O |
| ANISOU | 4558 | O | HOH | S | 14 | 5237 | 5205 | 5154 | 31 | −380 | −949 | O |
| HETATM | 4559 | O | HOH | S | 15 | 22.038 | 28.652 | 15.405 | 1.00 | 51.63 | | O |
| ANISOU | 4559 | O | HOH | S | 15 | 6685 | 6242 | 6689 | −233 | −345 | 86 | O |
| HETATM | 4560 | O | HOH | S | 16 | 27.380 | −10.138 | 44.583 | 1.00 | 43.41 | | O |
| ANISOU | 4560 | O | HOH | S | 16 | 5174 | 5778 | 5540 | 514 | 36 | −124 | O |
| HETATM | 4561 | O | HOH | S | 17 | 6.793 | 19.833 | 41.322 | 1.00 | 35.53 | | O |
| ANISOU | 4561 | O | HOH | S | 17 | 4555 | 4285 | 4661 | 342 | −116 | −1088 | O |
| HETATM | 4562 | O | HOH | S | 18 | −4.876 | 8.578 | 24.310 | 1.00 | 39.66 | | O |
| ANISOU | 4562 | O | HOH | S | 18 | 4394 | 4857 | 5818 | 56 | −802 | −734 | O |
| HETATM | 4563 | O | HOH | S | 19 | 15.583 | 3.451 | 42.074 | 1.00 | 44.98 | | O |
| ANISOU | 4563 | O | HOH | S | 19 | 5572 | 5904 | 5616 | 185 | −54 | −715 | O |
| HETATM | 4564 | O | HOH | S | 20 | 12.178 | 12.344 | 54.376 | 1.00 | 43.84 | | O |
| ANISOU | 4564 | O | HOH | S | 20 | 6033 | 5786 | 4837 | 404 | 38 | −1077 | O |
| HETATM | 4565 | O | HOH | S | 21 | 16.360 | 3.357 | 44.727 | 1.00 | 38.21 | | O |
| ANISOU | 4565 | O | HOH | S | 21 | 4760 | 5098 | 4659 | 210 | −54 | −693 | O |
| HETATM | 4566 | O | HOH | S | 22 | 15.703 | 3.220 | 24.570 | 1.00 | 43.92 | | O |
| ANISOU | 4566 | O | HOH | S | 22 | 5586 | 5611 | 5489 | 118 | −184 | −794 | O |
| HETATM | 4567 | O | HOH | S | 23 | 23.355 | 15.676 | 24.472 | 1.00 | 38.55 | | O |
| ANISOU | 4567 | O | HOH | S | 23 | 4745 | 4979 | 4923 | −79 | −221 | −461 | O |
| HETATM | 4568 | O | HOH | S | 24 | 21.258 | −11.219 | 51.676 | 1.00 | 48.56 | | O |
| ANISOU | 4568 | O | HOH | S | 24 | 6080 | 6448 | 5922 | 493 | 147 | −19 | O |
| HETATM | 4569 | O | HOH | S | 25 | 20.968 | 4.897 | 32.077 | 1.00 | 40.90 | | O |
| ANISOU | 4569 | O | HOH | S | 25 | 4992 | 5368 | 5182 | 112 | −123 | −664 | O |
| HETATM | 4570 | O | HOH | S | 26 | 7.857 | −6.402 | 47.941 | 1.00 | 37.49 | | O |
| ANISOU | 4570 | O | HOH | S | 26 | 4536 | 4843 | 4865 | 268 | 449 | −376 | O |
| HETATM | 4571 | O | HOH | S | 27 | 17.795 | 18.827 | 39.274 | 1.00 | 41.74 | | O |
| ANISOU | 4571 | O | HOH | S | 27 | 5334 | 5213 | 5311 | −23 | −446 | −947 | O |
| HETATM | 4572 | O | HOH | S | 28 | 11.759 | 12.559 | 18.801 | 1.00 | 38.78 | | O |
| ANISOU | 4572 | O | HOH | S | 28 | 5042 | 4909 | 4783 | 66 | −503 | −668 | O |
| HETATM | 4573 | O | HOH | S | 29 | 20.060 | 1.739 | 35.661 | 1.00 | 41.28 | | O |
| ANISOU | 4573 | O | HOH | S | 29 | 5031 | 5421 | 5231 | 164 | −80 | −655 | O |
| HETATM | 4574 | O | HOH | S | 30 | 5.701 | −4.275 | 24.499 | 1.00 | 46.26 | | O |
| ANISOU | 4574 | O | HOH | S | 30 | 5823 | 5601 | 6151 | −49 | −439 | −968 | O |
| HETATM | 4575 | O | HOH | S | 31 | 5.453 | 0.192 | 28.803 | 1.00 | 35.51 | | O |
| ANISOU | 4575 | O | HOH | S | 31 | 4267 | 4380 | 4845 | 19 | −307 | −854 | O |
| HETATM | 4576 | O | HOH | S | 32 | 25.444 | −12.003 | 26.008 | 1.00 | 39.43 | | O |
| ANISOU | 4576 | O | HOH | S | 32 | 5106 | 4838 | 5038 | 590 | 414 | −700 | O |
| HETATM | 4577 | O | HOH | S | 33 | −4.341 | 11.346 | 24.951 | 1.00 | 38.22 | | O |
| ANISOU | 4577 | O | HOH | S | 33 | 4233 | 4674 | 5615 | 139 | −744 | −712 | O |
| HETATM | 4578 | O | HOH | S | 34 | 17.377 | 1.633 | 35.462 | 1.00 | 37.13 | | O |
| ANISOU | 4578 | O | HOH | S | 34 | 4533 | 4847 | 4730 | 155 | −75 | −703 | O |
| HETATM | 4579 | O | HOH | S | 35 | 25.403 | −2.566 | 41.603 | 1.00 | 39.90 | | O |
| ANISOU | 4579 | O | HOH | S | 35 | 4753 | 5391 | 5017 | 287 | −89 | −412 | O |
| HETATM | 4580 | O | HOH | S | 36 | 35.163 | −31.421 | 38.048 | 1.00 | 44.38 | | O |
| ANISOU | 4580 | O | HOH | S | 36 | 5487 | 4747 | 6629 | 1587 | 888 | 266 | O |
| HETATM | 4581 | O | HOH | S | 37 | 0.415 | 3.653 | 26.840 | 1.00 | 41.68 | | O |
| ANISOU | 4581 | O | HOH | S | 37 | 4881 | 5139 | 5818 | −2 | −521 | −833 | O |
| HETATM | 4582 | O | HOH | S | 38 | 30.633 | −11.860 | 36.758 | 1.00 | 48.53 | | O |
| ANISOU | 4582 | O | HOH | S | 38 | 5751 | 6287 | 6401 | 658 | 275 | −204 | O |
| HETATM | 4583 | O | HOH | S | 39 | 6.017 | 7.609 | 54.358 | 1.00 | 50.90 | | O |
| ANISOU | 4583 | O | HOH | S | 39 | 6661 | 6716 | 5962 | 544 | 522 | −835 | O |
| HETATM | 4584 | O | HOH | S | 40 | 7.726 | −12.563 | 41.839 | 1.00 | 53.18 | | O |
| ANISOU | 4584 | O | HOH | S | 40 | 6469 | 6487 | 7249 | 119 | 323 | −402 | O |
| HETATM | 4585 | O | HOH | S | 41 | 3.927 | −6.987 | 50.147 | 1.00 | 49.52 | | O |

TABLE 14-continued

| | | | | | | | | | | | | |
|---|---|---|---|---|---|---|---|---|---|---|---|---|
| ANISOU | 4585 | O | HOH | S | 41 | 5972 | 6355 | 6488 | 283 | 678 | −262 | O |
| HETATM | 4586 | O | HOH | S | 42 | −1.543 | 3.452 | 36.081 | 1.00 | 38.89 | | O |
| ANISOU | 4586 | O | HOH | S | 42 | 4302 | 4845 | 5629 | 134 | −29 | −717 | O |
| HETATM | 4587 | O | HOH | S | 43 | 9.676 | 11.855 | 53.580 | 1.00 | 49.20 | | O |
| ANISOU | 4587 | O | HOH | S | 43 | 6620 | 6437 | 5637 | 459 | 194 | −1045 | O |
| HETATM | 4588 | O | HOH | S | 44 | 21.465 | 6.159 | 18.741 | 1.00 | 35.46 | | O |
| ANISOU | 4588 | O | HOH | S | 44 | 4639 | 4656 | 4178 | 172 | −10 | −618 | O |
| HETATM | 4589 | O | HOH | S | 45 | 8.262 | −1.162 | 34.472 | 1.00 | 39.64 | | O |
| ANISOU | 4589 | O | HOH | S | 45 | 4776 | 4979 | 5308 | 95 | −63 | −767 | O |
| HETATM | 4590 | O | HOH | S | 46 | 9.526 | −7.288 | 46.023 | 1.00 | 41.93 | | O |
| ANISOU | 4590 | O | HOH | S | 46 | 5104 | 5364 | 5465 | 244 | 356 | −404 | O |
| HETATM | 4591 | O | HOH | S | 47 | 13.336 | −19.346 | 41.044 | 1.00 | 54.37 | | O |
| ANISOU | 4591 | O | HOH | S | 47 | 6814 | 6387 | 7459 | 267 | 374 | −288 | O |
| HETATM | 4592 | O | HOH | S | 48 | 12.830 | 15.038 | 11.468 | 1.00 | 43.54 | | O |
| ANISOU | 4592 | O | HOH | S | 48 | 5960 | 5558 | 5025 | 98 | −575 | −472 | O |
| HETATM | 4593 | O | HOH | S | 49 | 5.865 | 11.873 | 44.541 | 1.00 | 33.59 | | O |
| ANISOU | 4593 | O | HOH | S | 49 | 4180 | 4290 | 4295 | 359 | 129 | −947 | O |
| HETATM | 4594 | O | HOH | S | 50 | 6.744 | −1.032 | 23.675 | 1.00 | 38.70 | | O |
| ANISOU | 4594 | O | HOH | S | 50 | 4883 | 4739 | 5082 | −6 | −452 | −943 | O |
| HETATM | 4595 | O | HOH | S | 51 | 5.507 | 5.105 | 38.236 | 1.00 | 38.63 | | O |
| ANISOU | 4595 | O | HOH | S | 51 | 4586 | 4916 | 5177 | 184 | 3 | −792 | O |
| HETATM | 4596 | O | HOH | S | 52 | 10.947 | 4.438 | 25.850 | 1.00 | 37.79 | | O |
| ANISOU | 4596 | O | HOH | S | 52 | 4731 | 4777 | 4850 | 73 | −312 | −835 | O |
| HETATM | 4597 | O | HOH | S | 53 | 11.971 | 12.782 | 34.444 | 1.00 | 45.91 | | O |
| ANISOU | 4597 | O | HOH | S | 53 | 5696 | 5812 | 5933 | 108 | −260 | −852 | O |
| HETATM | 4598 | O | HOH | S | 54 | 13.030 | −11.634 | 51.889 | 1.00 | 56.28 | | O |
| ANISOU | 4598 | O | HOH | S | 54 | 7070 | 7266 | 7050 | 390 | 471 | −69 | O |
| HETATM | 4599 | O | HOH | S | 55 | 8.933 | −9.333 | 44.785 | 1.00 | 37.95 | | O |
| ANISOU | 4599 | O | HOH | S | 55 | 4569 | 4764 | 5087 | 207 | 362 | −382 | O |
| HETATM | 4600 | O | HOH | S | 56 | 13.817 | 0.041 | 19.419 | 1.00 | 55.24 | | O |
| ANISOU | 4600 | O | HOH | S | 56 | 7267 | 6949 | 6772 | 129 | −273 | −921 | O |
| HETATM | 4601 | O | HOH | S | 57 | −0.595 | 11.535 | 42.321 | 1.00 | 50.22 | | O |
| ANISOU | 4601 | O | HOH | S | 57 | 5968 | 6322 | 6790 | 435 | 248 | −853 | O |
| HETATM | 4602 | O | HOH | S | 58 | −8.449 | 13.376 | 28.823 | 1.00 | 45.41 | | O |
| ANISOU | 4602 | O | HOH | S | 58 | 4824 | 5550 | 6881 | 302 | −537 | −638 | O |
| HETATM | 4603 | O | HOH | S | 59 | −0.191 | 7.840 | 19.381 | 1.00 | 51.77 | | O |
| ANISOU | 4603 | O | HOH | S | 59 | 6355 | 6426 | 6890 | 1 | −937 | −809 | O |
| HETATM | 4604 | O | HOH | S | 60 | 25.046 | −1.311 | 27.506 | 1.00 | 54.61 | | O |
| ANISOU | 4604 | O | HOH | S | 60 | 6769 | 7094 | 6886 | 298 | 139 | −593 | O |
| HETATM | 4605 | O | HOH | S | 61 | 15.147 | −2.581 | 25.890 | 1.00 | 48.79 | | O |
| ANISOU | 4605 | O | HOH | S | 61 | 6230 | 6129 | 6178 | 154 | −106 | −852 | O |
| HETATM | 4606 | O | HOH | S | 62 | 18.327 | 13.972 | 11.486 | 1.00 | 50.90 | | O |
| ANISOU | 4606 | O | HOH | S | 62 | 6886 | 6581 | 5871 | 113 | −240 | −393 | O |
| HETATM | 4607 | O | HOH | S | 63 | 12.528 | −5.376 | 24.415 | 1.00 | 49.01 | | O |
| ANISOU | 4607 | O | HOH | S | 63 | 6343 | 6023 | 6257 | 112 | −182 | −945 | O |
| HETATM | 4608 | O | HOH | S | 64 | 3.801 | 7.697 | 17.079 | 1.00 | 48.57 | | O |
| ANISOU | 4608 | O | HOH | S | 64 | 6216 | 6066 | 6172 | 16 | −867 | −829 | O |
| HETATM | 4609 | O | HOH | S | 65 | 1.905 | 22.638 | 40.451 | 1.00 | 51.60 | | O |
| ANISOU | 4609 | O | HOH | S | 65 | 6493 | 6168 | 6944 | 530 | −22 | −1089 | O |
| HETATM | 4610 | O | HOH | S | 66 | 13.657 | 2.084 | 27.734 | 1.00 | 49.77 | | O |
| ANISOU | 4610 | O | HOH | S | 66 | 6243 | 6324 | 6345 | 105 | −186 | −814 | O |
| HETATM | 4611 | O | HOH | S | 67 | 28.090 | −6.602 | 46.492 | 1.00 | 53.30 | | O |
| ANISOU | 4611 | O | HOH | S | 67 | 6415 | 7175 | 6660 | 426 | −133 | −158 | O |
| HETATM | 4612 | O | HOH | S | 68 | 6.374 | −8.065 | 49.318 | 1.00 | 45.82 | | O |
| ANISOU | 4612 | O | HOH | S | 68 | 5563 | 5871 | 5976 | 272 | 571 | −270 | O |
| HETATM | 4613 | O | HOH | S | 69 | 9.851 | −4.026 | 20.863 | 1.00 | 45.61 | | O |
| ANISOU | 4613 | O | HOH | S | 69 | 6006 | 5564 | 5759 | 44 | −391 | −1027 | O |
| HETATM | 4614 | O | HOH | S | 70 | 11.791 | 6.724 | 58.657 | 1.00 | 49.09 | | O |
| ANISOU | 4614 | O | HOH | S | 70 | 6766 | 6658 | 5229 | 518 | 265 | −824 | O |
| HETATM | 4615 | O | HOH | S | 71 | 2.623 | −6.142 | 41.801 | 1.00 | 47.81 | | O |
| ANISOU | 4615 | O | HOH | S | 71 | 5594 | 5950 | 6620 | 95 | 306 | −507 | O |
| HETATM | 4616 | O | HOH | S | 72 | 30.204 | −8.674 | 37.927 | 1.00 | 59.94 | | O |
| ANISOU | 4616 | O | HOH | S | 72 | 7156 | 7846 | 7771 | 534 | 143 | −227 | O |
| HETATM | 4617 | O | HOH | S | 73 | 17.748 | 1.818 | 28.286 | 1.00 | 47.32 | | O |
| ANISOU | 4617 | O | HOH | S | 73 | 5920 | 6081 | 5978 | 145 | −93 | −748 | O |
| HETATM | 4618 | O | HOH | S | 74 | −4.589 | 0.573 | 23.688 | 1.00 | 48.82 | | O |
| ANISOU | 4618 | O | HOH | S | 74 | 5628 | 5924 | 6997 | −168 | −853 | −842 | O |
| HETATM | 4619 | O | HOH | S | 75 | 24.020 | 1.257 | 36.836 | 1.00 | 46.40 | | O |
| ANISOU | 4619 | O | HOH | S | 75 | 5599 | 6154 | 5877 | 187 | −93 | −552 | O |
| HETATM | 4620 | C | HOH | S | 76 | 28.456 | −9.698 | 42.024 | 1.00 | 47.18 | | O |
| ANISOU | 4620 | O | HOH | S | 76 | 5602 | 6238 | 6086 | 520 | 68 | −169 | O |
| HETATM | 4621 | O | HOH | S | 77 | 22.804 | 16.125 | 47.265 | 1.00 | 48.16 | | O |
| ANISOU | 4621 | O | HOH | S | 77 | 6257 | 6251 | 5790 | −70 | −647 | −985 | O |
| HETATM | 4622 | O | HOH | S | 78 | 10.627 | −11.545 | 52.818 | 1.00 | 52.91 | | O |
| ANISOU | 4622 | O | HOH | S | 78 | 6629 | 6829 | 6647 | 376 | 587 | −40 | O |
| HETATM | 4623 | O | HOH | S | 79 | 15.925 | −24.823 | 36.892 | 1.00 | 64.65 | | O |
| ANISOU | 4623 | O | HOH | S | 79 | 8341 | 7280 | 8943 | 378 | 404 | −403 | O |
| HETATM | 4624 | O | HOH | S | 80 | 16.432 | −14.189 | 23.317 | 1.00 | 61.24 | | O |
| ANISOU | 4624 | O | HOH | S | 80 | 8181 | 7260 | 7828 | 301 | 72 | −1040 | O |
| HETATM | 4625 | O | HOH | S | 81 | 10.867 | −16.626 | 40.387 | 1.00 | 47.62 | | O |

TABLE 14-continued

| | | | | | | | | | | | | |
|---|---|---|---|---|---|---|---|---|---|---|---|---|
| ANISOU | 4625 | O | HOH | S | 81 | 5889 | 5614 | 6589 | 172 | 317 | −381 | O |
| HETATM | 4626 | O | HOH | S | 82 | 25.612 | −0.077 | 38.701 | 1.00 | 46.40 | | O |
| ANISOU | 4626 | O | HOH | S | 82 | 5557 | 6200 | 5875 | 224 | −103 | −480 | O |
| HETATM | 4627 | O | HOH | S | 83 | 5.474 | 18.760 | 4.405 | 1.00 | 56.36 | | O |
| ANISOU | 4627 | O | HOH | S | 83 | 7848 | 7143 | 6425 | 164 | −1243 | −264 | O |
| HETATM | 4628 | O | HOH | S | 84 | 3.915 | 2.810 | 56.057 | 1.00 | 60.63 | | O |
| ANISOU | 4628 | O | HOH | S | 84 | 7776 | 8010 | 7252 | 575 | 797 | −575 | O |
| HETATM | 4629 | O | HOH | S | 85 | 24.487 | −7.135 | 60.248 | 1.00 | 55.88 | | O |
| ANISOU | 4629 | O | HOH | S | 85 | 7305 | 7781 | 6146 | 546 | −223 | 64 | O |
| HETATM | 4630 | O | HOH | S | 86 | 26.682 | −2.678 | 38.803 | 1.00 | 44.10 | | O |
| ANISOU | 4630 | O | HOH | S | 86 | 5236 | 5903 | 5617 | 299 | −42 | −409 | O |
| HETATM | 4631 | O | HOH | S | 87 | −2.639 | 20.424 | 29.653 | 1.00 | 53.21 | | O |
| ANISOU | 4631 | O | HOH | S | 87 | 6271 | 6415 | 7530 | 418 | −455 | −745 | O |
| HETATM | 4632 | O | HOH | S | 88 | −1.435 | −0.698 | 24.969 | 1.00 | 52.96 | | O |
| ANISOU | 4632 | O | HOH | S | 88 | 6302 | 6460 | 7360 | −132 | −669 | −878 | O |
| HETATM | 4633 | O | HOH | S | 89 | 11.689 | 15.238 | 35.753 | 1.00 | 44.41 | | O |
| ANISOU | 4633 | O | HOH | S | 89 | 5547 | 5573 | 5753 | 121 | −277 | −894 | O |
| HETATM | 4634 | O | HOH | S | 90 | 33.703 | 15.192 | 28.279 | 1.00 | 46.30 | | O |
| ANISOU | 4634 | O | HOH | S | 90 | 5226 | 6153 | 6214 | −238 | −189 | −164 | O |
| HETATM | 4635 | O | HOH | S | 91 | 16.280 | 24.733 | 19.461 | 1.00 | 47.76 | | O |
| ANISOU | 4635 | O | HOH | S | 91 | 6171 | 5799 | 6178 | −65 | −503 | −335 | O |
| HETATM | 4636 | O | HOH | S | 92 | 34.109 | 16.642 | 26.567 | 1.00 | 42.42 | | O |
| ANISOU | 4636 | O | HOH | S | 92 | 4730 | 5635 | 5754 | −278 | −144 | −90 | O |
| HETATM | 4637 | O | HOH | S | 93 | 26.584 | −9.873 | 24.878 | 1.00 | 53.09 | | O |
| ANISOU | 4637 | O | HOH | S | 93 | 6796 | 6671 | 6705 | 584 | 432 | −672 | O |
| HETATM | 4638 | O | HOH | S | 94 | 28.961 | 6.083 | 52.748 | 1.00 | 56.96 | | O |
| ANISOU | 4638 | O | HOH | S | 94 | 7170 | 7807 | 6663 | 73 | −773 | −541 | O |
| HETATM | 4639 | O | HOH | S | 95 | 6.236 | −10.571 | 52.887 | 1.00 | 57.54 | | O |
| ANISOU | 4639 | O | HOH | S | 95 | 7108 | 7380 | 7373 | 331 | 755 | −54 | O |
| HETATM | 4640 | O | HOH | S | 96 | −0.689 | 0.925 | 34.563 | 1.00 | 50.03 | | O |
| ANISOU | 4640 | O | HOH | S | 96 | 5755 | 6220 | 7036 | 54 | −106 | −725 | O |
| HETATM | 4641 | O | HOH | S | 97 | 14.716 | −17.109 | 26.352 | 1.00 | 54.64 | | O |
| ANISOU | 4641 | O | HOH | S | 97 | 7268 | 6268 | 7226 | 244 | 77 | −975 | O |
| HETATM | 4642 | O | HOH | S | 98 | 29.923 | 10.660 | 32.068 | 1.00 | 47.17 | | O |
| ANISOU | 4642 | O | HOH | S | 98 | 5504 | 6285 | 6135 | −70 | −234 | −404 | O |
| HETATM | 4643 | O | HOH | S | 99 | 9.297 | −0.008 | 32.367 | 1.00 | 39.62 | | O |
| ANISOU | 4643 | O | HOH | S | 99 | 4820 | 4985 | 5250 | 89 | −131 | −802 | O |
| HETATM | 4644 | O | HOH | S | 100 | 21.476 | 33.096 | 32.405 | 1.00 | 48.20 | | O |
| ANISOU | 4644 | O | HOH | S | 100 | 6289 | 5333 | 6694 | −404 | −785 | −730 | O |
| HETATM | 4645 | O | HOH | S | 101 | 29.567 | −18.012 | 24.840 | 1.00 | 55.13 | | O |
| ANISOU | 4645 | O | HOH | S | 101 | 7201 | 6605 | 7142 | 949 | 749 | −665 | O |
| HETATM | 4646 | O | HOH | S | 102 | 5.023 | 19.142 | 11.990 | 1.00 | 50.70 | | O |
| ANISOU | 4646 | O | HOH | S | 102 | 6677 | 6306 | 6281 | 137 | −1025 | −416 | O |
| HETATM | 4647 | O | HOH | S | 103 | 8.651 | 10.069 | 55.057 | 1.00 | 52.30 | | O |
| ANISOU | 4647 | O | HOH | S | 103 | 7017 | 6889 | 5966 | 516 | 331 | −971 | O |
| HETATM | 4648 | O | HOH | S | 104 | 5.414 | −0.343 | 26.414 | 1.00 | 44.82 | | O |
| ANISOU | 4648 | O | HOH | S | 104 | 5515 | 5530 | 5986 | −6 | −397 | −893 | O |
| HETATM | 4649 | O | HOH | S | 105 | 18.108 | 39.553 | 24.004 | 1.00 | 70.06 | | O |
| ANISOU | 4649 | O | HOH | S | 105 | 9187 | 7690 | 9741 | −321 | −767 | −268 | O |
| HETATM | 4650 | O | HOH | S | 106 | −4.289 | 12.564 | 27.433 | 1.00 | 51.54 | | O |
| ANISOU | 4650 | O | HOH | S | 106 | 5885 | 6355 | 7344 | 210 | −586 | −716 | O |
| HETATM | 4651 | O | HOH | S | 107 | −7.942 | 1.030 | 24.533 | 1.00 | 54.83 | | O |
| ANISOU | 4651 | O | HOH | S | 107 | 6125 | 6671 | 8036 | −191 | −901 | −758 | O |
| HETATM | 4652 | O | HOH | S | 108 | 27.204 | −7.829 | 51.903 | 1.00 | 64.65 | | O |
| ANISOU | 4652 | O | HOH | S | 108 | 7999 | 8700 | 7866 | 480 | −193 | −27 | O |
| HETATM | 4653 | O | HOH | S | 109 | 36.215 | −20.159 | 33.887 | 1.00 | 57.11 | | O |
| ANISOU | 4653 | O | HOH | S | 109 | 6808 | 7077 | 7814 | 1206 | 718 | −13 | O |
| HETATM | 4654 | O | HOH | S | 110 | 10.592 | 30.289 | 32.067 | 1.00 | 44.96 | | O |
| ANISOU | 4654 | O | HOH | S | 110 | 5880 | 5001 | 6200 | 121 | −553 | −879 | O |
| HETATM | 4655 | O | HOH | S | 111 | 1.756 | 19.719 | 27.347 | 1.00 | 53.89 | | O |
| ANISOU | 4655 | O | HOH | S | 111 | 6556 | 6555 | 7365 | 271 | −545 | −741 | O |
| HETATM | 4656 | O | HOH | S | 112 | 21.039 | 3.300 | 19.231 | 1.00 | 60.09 | | O |
| ANISOU | 4656 | O | HOH | S | 112 | 7790 | 7744 | 7297 | 215 | 16 | −696 | O |
| HETATM | 4657 | O | HOH | S | 113 | 30.804 | 21.255 | 22.200 | 1.00 | 53.11 | | O |
| ANISOU | 4657 | O | HOH | S | 113 | 6345 | 6802 | 7034 | −328 | −133 | −40 | O |
| HETATM | 4658 | O | HOH | S | 114 | 5.335 | −15.323 | 36.092 | 1.00 | 46.52 | | O |
| ANISOU | 4658 | O | HOH | S | 114 | 5651 | 5348 | 6677 | −55 | 116 | −585 | O |
| HETATM | 4659 | O | HOH | S | 115 | 32.562 | 14.562 | 32.952 | 1.00 | 62.02 | | O |
| ANISOU | 4659 | O | HOH | S | 115 | 7268 | 8138 | 8160 | −251 | −394 | −326 | O |
| HETATM | 4660 | O | HOH | S | 116 | 30.723 | −6.536 | 39.189 | 1.00 | 57.18 | | O |
| ANISOU | 4660 | O | HOH | S | 116 | 6756 | 7586 | 7385 | 464 | 36 | −213 | O |
| HETATM | 4661 | O | HOH | S | 117 | 22.393 | 1.823 | 13.257 | 1.00 | 57.47 | | O |
| ANISOU | 4661 | O | HOH | S | 117 | 7785 | 7426 | 6625 | 345 | 173 | −722 | O |
| HETATM | 4662 | O | HOH | S | 118 | 24.480 | 35.304 | 20.002 | 1.00 | 57.41 | | O |
| ANISOU | 4662 | O | HOH | S | 118 | 7330 | 6539 | 7943 | −519 | −534 | 92 | O |
| HETATM | 4663 | O | HOH | S | 119 | 4.124 | 9.641 | 48.079 | 1.00 | 49.26 | | O |
| ANISOU | 4663 | O | HOH | S | 119 | 6173 | 6347 | 6197 | 448 | 359 | −886 | O |
| HETATM | 4664 | O | HOH | S | 120 | 3.046 | 6.522 | 50.727 | 1.00 | 62.17 | | O |
| ANISOU | 4664 | O | HOH | S | 120 | 7792 | 8057 | 7772 | 492 | 562 | −761 | O |
| HETATM | 4665 | O | HOH | S | 121 | 21.164 | 20.753 | 36.804 | 1.00 | 56.16 | | O |

TABLE 14-continued

| | | | | | | | | | | | | |
|---|---|---|---|---|---|---|---|---|---|---|---|---|
| ANISOU | 4665 | O | HOH | S | 121 | 7094 | 7002 | 7243 | −164 | −548 | −840 | O |
| HETATM | 4666 | O | HOH | S | 122 | 4.942 | 10.363 | 51.398 | 1.00 | 61.98 | | O |
| ANISOU | 4666 | O | HOH | S | 122 | 7968 | 8006 | 7575 | 521 | 434 | −936 | O |
| HETATM | 4667 | O | HOH | S | 123 | 25.562 | −2.940 | 44.151 | 1.00 | 44.73 | | O |
| ANISOU | 4667 | O | HOH | S | 123 | 5385 | 6046 | 5563 | 303 | −130 | −366 | O |
| HETATM | 4668 | O | HOH | S | 124 | 24.366 | 3.316 | 15.566 | 1.00 | 62.05 | | O |
| ANISOU | 4668 | O | HOH | S | 124 | 8145 | 8062 | 7368 | 314 | 232 | −601 | O |
| HETATM | 4669 | O | HOH | S | 125 | −3.923 | 3.171 | 19.991 | 1.00 | 58.67 | | O |
| ANISOU | 4669 | O | HOH | S | 125 | 7042 | 7213 | 8037 | −135 | −1066 | −863 | O |
| HETATM | 4670 | O | HOH | S | 126 | 13.116 | 14.661 | 53.255 | 1.00 | 49.53 | | O |
| ANISOU | 4670 | O | HOH | S | 126 | 6776 | 6428 | 5617 | 346 | −90 | −1163 | O |
| HETATM | 4671 | O | HOH | S | 127 | 17.149 | 37.209 | 18.194 | 1.00 | 72.50 | | O |
| ANISOU | 4671 | O | HOH | S | 127 | 9471 | 8269 | 9805 | −219 | −675 | 36 | O |
| HETATM | 4672 | O | HOH | S | 128 | 5.510 | −10.961 | 43.227 | 1.00 | 51.69 | | O |
| ANISOU | 4672 | O | HOH | S | 128 | 6203 | 6360 | 7078 | 108 | 382 | −376 | O |
| HETATM | 4673 | O | HOH | S | 129 | 18.877 | 38.045 | 27.757 | 1.00 | 52.97 | | O |
| ANISOU | 4673 | O | HOH | S | 129 | 7008 | 5596 | 7524 | −349 | −788 | −508 | O |
| HETATM | 4674 | O | HOH | S | 130 | −2.648 | 19.261 | 22.490 | 1.00 | 60.51 | | O |
| ANISOU | 4674 | O | HOH | S | 130 | 7252 | 7396 | 8343 | 286 | −851 | −605 | O |
| HETATM | 4675 | O | HOH | S | 131 | 6.782 | 24.543 | 29.680 | 1.00 | 46.76 | | O |
| ANISOU | 4675 | O | HOH | S | 131 | 5886 | 5508 | 6374 | 220 | −492 | −799 | O |
| HETATM | 4676 | O | HOH | S | 132 | 25.290 | −9.651 | 51.814 | 1.00 | 51.26 | | O |
| ANISOU | 4676 | O | HOH | S | 132 | 6350 | 6920 | 6208 | 509 | −56 | −1 | O |
| HETATM | 4677 | O | HOH | S | 133 | 5.638 | −5.451 | 47.197 | 1.00 | 53.53 | | O |
| ANISOU | 4677 | O | HOH | S | 133 | 6494 | 6847 | 6997 | 244 | 474 | −412 | O |
| HETATM | 4678 | O | HOH | S | 134 | 22.105 | 5.554 | 40.601 | 1.00 | 53.53 | | O |
| ANISOU | 4678 | O | HOH | S | 134 | 6585 | 7066 | 6686 | 108 | −233 | −654 | O |
| HETATM | 4679 | O | HOH | S | 135 | 3.603 | 5.704 | 15.350 | 1.00 | 60.76 | | O |
| ANISOU | 4679 | O | HOH | S | 135 | 7866 | 7596 | 7626 | −14 | −944 | −888 | O |
| HETATM | 4680 | O | HOH | S | 136 | 2.716 | −0.274 | 28.172 | 1.00 | 59.89 | | O |
| ANISOU | 4680 | O | HOH | S | 136 | 7274 | 7420 | 8063 | −27 | −389 | −856 | O |
| HETATM | 4681 | O | HOH | S | 137 | 9.253 | 10.092 | 41.337 | 1.00 | 36.34 | | O |
| ANISOU | 4681 | O | HOH | S | 137 | 4492 | 4667 | 4648 | 227 | −39 | −890 | O |
| HETATM | 4682 | O | HOH | S | 138 | 12.883 | −17.615 | 57.079 | 1.00 | 57.18 | | O |
| ANISOU | 4682 | O | HOH | S | 138 | 7296 | 7316 | 7114 | 506 | 717 | 414 | O |
| HETATM | 4683 | O | HOH | S | 139 | 28.684 | 8.239 | 20.388 | 1.00 | 44.47 | | O |
| ANISOU | 4683 | O | HOH | S | 139 | 5462 | 5935 | 5499 | 149 | 209 | −336 | O |
| HETATM | 4684 | O | HOH | S | 140 | 3.153 | −4.735 | 47.990 | 1.00 | 59.98 | | O |
| ANISOU | 4684 | O | HOH | S | 140 | 7239 | 7666 | 7883 | 257 | 577 | −391 | O |
| HETATM | 4685 | O | HOH | S | 141 | 15.775 | 17.914 | 47.554 | 1.00 | 51.93 | | O |
| ANISOU | 4685 | O | HOH | S | 141 | 6900 | 6573 | 6260 | 139 | −356 | −1156 | O |
| HETATM | 4686 | O | HOH | S | 142 | 31.257 | 3.616 | 42.036 | 1.00 | 55.19 | | O |
| ANISOU | 4686 | O | HOH | S | 142 | 6485 | 7482 | 7004 | 106 | −399 | −354 | O |
| HETATM | 4687 | O | HOH | S | 143 | 16.011 | 16.867 | 45.114 | 1.00 | 48.80 | | O |
| ANISOU | 4687 | O | HOH | S | 143 | 6373 | 6194 | 5975 | 107 | −347 | −1067 | O |
| HETATM | 4688 | O | HOH | S | 144 | −0.180 | 20.744 | 29.353 | 1.00 | 54.12 | | O |
| ANISOU | 4688 | O | HOH | S | 144 | 6512 | 6535 | 7516 | 360 | −469 | −767 | O |
| HETATM | 4689 | O | HOH | S | 145 | 3.599 | 10.716 | 45.641 | 1.00 | 47.47 | | O |
| ANISOU | 4689 | O | HOH | S | 145 | 5871 | 6062 | 6104 | 416 | 269 | −904 | O |
| HETATM | 4690 | O | HOH | S | 146 | 25.206 | 14.735 | 47.688 | 1.00 | 56.16 | | O |
| ANISOU | 4690 | O | HOH | S | 146 | 7184 | 7354 | 6801 | −108 | −727 | −895 | O |
| HETATM | 4691 | O | HOH | S | 147 | 13.818 | 10.499 | 59.987 | 1.00 | 64.46 | | O |
| ANISOU | 4691 | O | HOH | S | 147 | 8944 | 8577 | 6971 | 487 | 35 | −1038 | O |
| HETATM | 4692 | O | HOH | S | 148 | 17.382 | −1.468 | 26.942 | 1.00 | 40.74 | | O |
| ANISOU | 4692 | O | HOH | S | 148 | 5159 | 5182 | 5139 | 181 | −51 | −789 | O |
| HETATM | 4693 | O | HOH | S | 149 | 27.781 | 0.675 | 46.729 | 1.00 | 62.88 | | O |
| ANISOU | 4693 | O | HOH | S | 149 | 7679 | 8462 | 7752 | 216 | −361 | −382 | O |
| HETATM | 4694 | O | HOH | S | 150 | 22.871 | −23.569 | 29.611 | 1.00 | 59.78 | | O |
| ANISOU | 4694 | O | HOH | S | 150 | 7928 | 6744 | 8041 | 717 | 521 | −692 | O |
| HETATM | 4695 | O | HOH | S | 151 | 21.640 | −21.489 | 29.107 | 1.00 | 56.51 | | O |
| ANISOU | 4695 | O | HOH | S | 151 | 7487 | 6433 | 7551 | 615 | 437 | −742 | O |
| HETATM | 4696 | O | HOH | S | 152 | −6.842 | 9.133 | 37.202 | 1.00 | 61.61 | | O |
| ANISOU | 4696 | O | HOH | S | 152 | 6922 | 769 | 8790 | 340 | 70 | −675 | O |
| HETATM | 4697 | O | HOH | S | 153 | −0.277 | 3.809 | 38.254 | 1.00 | 52.93 | | O |
| ANISOU | 4697 | O | HOH | S | 153 | 6151 | 6664 | 7295 | 184 | 81 | −719 | O |
| HETATM | 4698 | O | HOH | S | 154 | 6.225 | −9.107 | 45.049 | 1.00 | 49.06 | | O |
| ANISOU | 4698 | O | HOH | S | 154 | 5902 | 6144 | 6596 | 172 | 422 | −368 | O |
| HETATM | 4699 | O | HOH | S | 155 | 28.915 | 0.154 | 48.953 | 1.00 | 58.37 | | O |
| ANISOU | 4699 | O | HOH | S | 155 | 7118 | 7955 | 7105 | 234 | −448 | −319 | O |
| HETATM | 4700 | O | HOH | S | 156 | −6.705 | 8.220 | 39.500 | 1.00 | 69.21 | | O |
| ANISOU | 4700 | O | HOH | S | 156 | 7901 | 8691 | 9704 | 369 | 234 | −659 | O |
| HETATM | 4701 | O | HOH | S | 157 | 0.901 | 1.431 | 25.463 | 1.00 | 47.26 | | O |
| ANISOU | 4701 | O | HOH | S | 157 | 5661 | 5810 | 6484 | −52 | −574 | −871 | O |
| HETATM | 4702 | O | HOH | S | 158 | 7.775 | 11.491 | 32.772 | 1.00 | 41.66 | | O |
| ANISOU | 4702 | O | HOH | S | 158 | 5076 | 5238 | 5515 | 144 | −261 | −847 | O |
| HETATM | 4703 | O | HOH | S | 159 | 25.798 | −15.835 | 22.936 | 1.00 | 63.42 | | O |
| ANISOU | 4703 | O | HOH | S | 159 | 8405 | 7656 | 8035 | 738 | 558 | −844 | O |
| HETATM | 4704 | O | HOH | S | 160 | 11.211 | −18.638 | 33.474 | 1.00 | 56.57 | | O |
| ANISOU | 4704 | O | HOH | S | 160 | 7217 | 6484 | 7794 | 120 | 150 | −679 | O |
| HETATM | 4705 | O | HOH | S | 161 | 28.531 | −1.572 | 51.691 | 1.00 | 61.09 | | O |

TABLE 14-continued

| | | | | | | | | | | | | |
|---|---|---|---|---|---|---|---|---|---|---|---|---|
| ANISOU | 4705 | O | HOH | S | 161 | 7547 | 8345 | 7321 | 302 | −453 | −244 | O |
| HETATM | 4706 | O | HOH | S | 162 | 1.456 | −4.326 | 35.566 | 1.00 | 63.57 | | O |
| ANISOU | 4706 | O | HOH | S | 162 | 7565 | 7868 | 8721 | −6 | −18 | −685 | O |
| HETATM | 4707 | O | HOH | S | 163 | 3.223 | −12.443 | 35.290 | 1.00 | 51.77 | | O |
| ANISOU | 4707 | O | HOH | S | 163 | 6212 | 6104 | 7356 | −97 | 33 | −633 | O |
| HETATM | 4708 | O | HOH | S | 164 | 29.093 | −2.837 | 27.771 | 1.00 | 74.03 | | O |
| ANISOU | 4708 | O | HOH | S | 164 | 9103 | 9616 | 9410 | 406 | 272 | −462 | O |
| HETATM | 4709 | O | HOH | S | 165 | 20.972 | −25.879 | 32.995 | 1.00 | 62.14 | | O |
| ANISOU | 4709 | O | HOH | S | 165 | 8181 | 6904 | 8527 | 646 | 500 | −543 | O |
| HETATM | 4710 | O | HOH | S | 166 | −0.861 | 5.120 | 18.389 | 1.00 | 59.51 | | O |
| ANISOU | 4710 | O | HOH | S | 166 | 7369 | 7376 | 7865 | −66 | −1021 | −869 | O |
| HETATM | 4711 | O | HOH | S | 167 | 5.633 | −10.219 | 47.042 | 1.00 | 57.95 | | O |
| ANISOU | 4711 | O | HOH | S | 167 | 7027 | 7275 | 7718 | 193 | 531 | −264 | O |
| HETATM | 4712 | O | HOH | S | 168 | 21.176 | 19.239 | −10.066 | 1.00 | 70.86 | | O |
| ANISOU | 4712 | O | HOH | S | 168 | 10955 | 9501 | 6467 | 506 | 150 | 489 | O |
| HETATM | 4713 | O | HOH | S | 169 | 29.081 | 26.912 | 29.820 | 1.00 | 54.53 | | O |
| ANISOU | 4713 | O | HOH | S | 169 | 6631 | 6637 | 7451 | −560 | −626 | −362 | O |
| HETATM | 4714 | O | HOH | S | 170 | 34.689 | −14.332 | 29.274 | 1.00 | 50.43 | | O |
| ANISOU | 4714 | O | HOH | S | 170 | 6045 | 6407 | 6711 | 962 | 696 | −259 | O |
| HETATM | 4715 | O | HOH | S | 171 | 6.753 | −8.646 | 57.122 | 1.00 | 60.40 | | O |
| ANISOU | 4715 | O | HOH | S | 171 | 7653 | 7929 | 7366 | 462 | 863 | −11 | O |
| HETATM | 4716 | O | HOH | S | 172 | 16.508 | −19.466 | 26.207 | 1.00 | 60.56 | | O |
| ANISOU | 4716 | O | HOH | S | 172 | 8106 | 6908 | 7997 | 347 | 182 | −976 | O |
| HETATM | 4717 | O | HOH | S | 173 | 34.955 | 11.491 | 22.773 | 1.00 | 54.41 | | O |
| ANISOU | 4717 | O | HOH | S | 173 | 6283 | 7293 | 7098 | −7 | 228 | −30 | O |
| HETATM | 4718 | O | HOH | S | 174 | 3.704 | 31.023 | 35.075 | 1.00 | 51.73 | | O |
| ANISOU | 4718 | O | HOH | S | 174 | 6689 | 5757 | 7211 | 476 | −363 | −1026 | O |
| HETATM | 4719 | O | HOH | S | 175 | −0.635 | −8.911 | 34.553 | 1.00 | 61.86 | | O |
| ANISOU | 4719 | O | HOH | S | 175 | 7284 | 7463 | 8756 | −148 | −67 | −648 | O |
| HETATM | 4720 | O | HOH | S | 176 | 9.435 | −18.258 | 31.751 | 1.00 | 69.81 | | O |
| ANISOU | 4720 | O | HOH | S | 176 | 8906 | 8114 | 9505 | 35 | 50 | −772 | O |
| HETATM | 4721 | O | HOH | S | 177 | −3.210 | 11.468 | 43.732 | 1.00 | 68.09 | | O |
| ANISOU | 4721 | O | HOH | S | 177 | 8128 | 8586 | 9158 | 521 | 409 | −812 | O |
| HETATM | 4722 | O | HOH | S | 178 | 0.780 | 5.472 | 10.566 | 1.00 | 62.01 | | O |
| ANISOU | 4722 | O | HOH | S | 178 | 8199 | 7737 | 7625 | −64 | −1340 | −916 | O |
| HETATM | 4723 | O | HOH | S | 179 | 6.069 | −6.678 | 44.667 | 1.00 | 49.68 | | O |
| ANISOU | 4723 | O | HOH | S | 179 | 5978 | 6280 | 6618 | 185 | 379 | −445 | O |
| HETATM | 4724 | O | HOH | S | 180 | 17.545 | 39.884 | 26.590 | 1.00 | 59.58 | | O |
| ANISOU | 4724 | O | HOH | S | 180 | 7905 | 6291 | 8443 | −298 | −802 | −448 | O |
| HETATM | 4725 | O | HOH | S | 181 | 3.045 | 8.379 | 44.157 | 1.00 | 61.22 | | O |
| ANISOU | 4725 | O | HOH | S | 181 | 7500 | 7811 | 7951 | 360 | 255 | −829 | O |
| HETATM | 4726 | O | HOH | S | 182 | 0.749 | 11.329 | 44.848 | 1.00 | 60.39 | | O |
| ANISOU | 4726 | O | HOH | S | 182 | 7383 | 7655 | 7910 | 466 | 333 | −882 | O |
| HETATM | 4727 | O | HOH | S | 183 | 2.112 | −4.017 | 57.561 | 1.00 | 65.89 | | O |
| ANISOU | 4727 | O | HOH | S | 183 | 8277 | 8665 | 8093 | 534 | 1080 | −175 | O |
| HETATM | 4728 | O | HOH | S | 184 | 27.137 | 14.368 | 29.751 | 1.00 | 48.96 | | O |
| ANISOU | 4728 | O | HOH | S | 184 | 5873 | 6383 | 6347 | −134 | −271 | −462 | O |
| HETATM | 4729 | O | HOH | S | 185 | 27.920 | 14.325 | 31.696 | 1.00 | 51.59 | | O |
| ANISOU | 4729 | O | HOH | S | 185 | 6168 | 6732 | 6701 | −158 | −328 | −475 | O |
| HETATM | 4730 | O | HOH | S | 186 | 3.325 | 7.463 | 38.568 | 1.00 | 45.14 | | O |
| ANISOU | 4730 | O | HOH | S | 186 | 5363 | 5715 | 6074 | 232 | 21 | −813 | O |
| HETATM | 4731 | O | HOH | S | 187 | 10.085 | −14.813 | 70.574 | 1.00 | 99.80 | | O |
| ANISOU | 4731 | O | HOH | S | 187 | 13354 | 13296 | 11269 | 849 | 1207 | 841 | O |
| HETATM | 4732 | O | HOH | S | 188 | 11.054 | −0.791 | 70.830 | 1.00 | 80.16 | | O |
| ANISOU | 4732 | O | HOH | S | 188 | 11323 | 11015 | 8118 | 885 | 764 | −243 | O |
| HETATM | 4733 | O | HOH | S | 189 | 17.047 | 3.923 | 66.958 | 1.00 | 75.51 | | O |
| ANISOU | 4733 | O | HOH | S | 189 | 10626 | 10336 | 7729 | 613 | −13 | −633 | O |
| HETATM | 4734 | O | HOH | S | 190 | 19.618 | 3.881 | 62.882 | 1.00 | 71.28 | | O |
| ANISOU | 4734 | O | HOH | S | 190 | 9762 | 9723 | 7596 | 454 | −239 | −623 | O |
| HETATM | 4735 | O | HOH | S | 191 | 8.281 | −11.757 | 48.259 | 1.00 | 61.31 | | O |
| ANISOU | 4735 | O | HOH | S | 191 | 7546 | 7719 | 8031 | 248 | 529 | −187 | O |
| HETATM | 4736 | O | HOH | S | 192 | 18.580 | 13.303 | 60.336 | 1.00 | 62.68 | | O |
| ANISOU | 4736 | O | HOH | S | 192 | 8834 | 8331 | 6650 | 310 | −431 | −1174 | O |
| HETATM | 4737 | O | HOH | S | 193 | 1.672 | −0.549 | 46.611 | 1.00 | 59.61 | | O |
| ANISOU | 4737 | O | HOH | S | 193 | 7150 | 7636 | 7865 | 287 | 511 | −536 | O |
| HETATM | 4738 | O | HOH | S | 194 | 2.963 | 2.730 | 48.862 | 1.00 | 57.04 | | O |
| ANISOU | 4738 | O | HOH | S | 194 | 6990 | 7387 | 7296 | 389 | 533 | −631 | O |
| HETATM | 4739 | O | HOH | S | 195 | 27.868 | 15.185 | 53.046 | 1.00 | 71.10 | | O |
| ANISOU | 4739 | O | HOH | S | 195 | 9255 | 9341 | 8419 | −164 | −1041 | −958 | O |
| HETATM | 4740 | O | HOH | S | 196 | 17.842 | −20.770 | 43.046 | 1.00 | 67.16 | | O |
| ANISOU | 4740 | O | HOH | S | 196 | 8459 | 8072 | 8988 | 460 | 421 | −115 | O |
| HETATM | 4741 | O | HOH | S | 197 | 17.815 | −18.079 | 47.271 | 1.00 | 67.50 | | O |
| ANISOU | 4741 | O | HOH | S | 197 | 8461 | 8381 | 8807 | 468 | 403 | 13 | O |
| HETATM | 4742 | O | HOH | S | 198 | 13.555 | −12.809 | 26.163 | 1.00 | 48.28 | | O |
| ANISOU | 4742 | O | HOH | S | 198 | 6345 | 5668 | 6330 | 172 | −24 | −960 | O |
| HETATM | 4743 | O | HOH | S | 199 | 18.005 | 9.022 | 10.643 | 1.00 | 67.96 | | O |
| ANISOU | 4743 | O | HOH | S | 199 | 9182 | 8762 | 7876 | 189 | −196 | −581 | O |
| HETATM | 4744 | O | HOH | S | 200 | 16.017 | 7.984 | 13.940 | 1.00 | 61.59 | | O |
| ANISOU | 4744 | O | HOH | S | 200 | 8216 | 7897 | 7288 | 141 | −299 | −684 | O |
| HETATM | 4745 | O | HOH | S | 201 | 13.878 | 8.692 | 12.930 | 1.00 | 57.02 | | O |

TABLE 14-continued

| | | | | | | | | | | | | |
|---|---|---|---|---|---|---|---|---|---|---|---|---|
| ANISOU | | 4745 | O | HOH | S | 201 | 7681 | 7294 | 6691 | 123 | −439 | −697 | O |
| HETATM | | 4746 | O | HOH | S | 202 | −4.192 | 3.180 | 6.109 | 1.00 | 74.15 | | O |
| ANISOU | | 4746 | O | HOH | S | 202 | 9853 | 9202 | 9119 | −222 | −1992 | −1024 | O |
| HETATM | | 4747 | O | HOH | S | 203 | 13.461 | 17.989 | 50.396 | 1.00 | 63.52 | | O |
| ANISOU | | 4747 | O | HOH | S | 203 | 8508 | 8043 | 7586 | 268 | −217 | −1241 | O |
| HETATM | | 4748 | O | HOH | S | 204 | 17.496 | 18.259 | 49.144 | 1.00 | 55.72 | | O |
| ANISOU | | 4748 | O | HOH | S | 204 | 7454 | 7075 | 6642 | 98 | −455 | −1188 | O |
| HETATM | | 4749 | O | HOH | S | 205 | 16.632 | 20.921 | 45.019 | 1.00 | 65.08 | | O |
| ANISOU | | 4749 | O | HOH | S | 205 | 8542 | 8100 | 8083 | 49 | −470 | −1169 | O |
| HETATM | | 4750 | O | HOH | S | 206 | 18.239 | 20.191 | 41.969 | 1.00 | 57.01 | | O |
| ANISOU | | 4750 | O | HOH | S | 206 | 7372 | 7112 | 7178 | −32 | −505 | −1040 | O |
| HETATM | | 4751 | O | HOH | S | 207 | 19.935 | −19.801 | 46.983 | 1.00 | 63.52 | | O |
| ANISOU | | 4751 | O | HOH | S | 207 | 7962 | 7825 | 8349 | 552 | 402 | 81 | O |
| HETATM | | 4752 | O | HOH | S | 208 | 12.908 | 2.005 | 24.258 | 1.00 | 65.40 | | O |
| ANISOU | | 4752 | O | HOH | S | 208 | 8319 | 8271 | 8258 | 94 | −258 | −851 | O |
| HETATM | | 4753 | O | HOH | S | 209 | 3.612 | 4.462 | 57.688 | 1.00 | 68.77 | | O |
| ANISOU | | 4753 | O | HOH | S | 209 | 8929 | 9068 | 8134 | 652 | 859 | −641 | O |
| HETATM | | 4754 | O | HOH | S | 210 | −1.297 | 9.960 | 17.309 | 1.00 | 81.03 | | O |
| ANISOU | | 4754 | O | HOH | S | 210 | 10078 | 10133 | 10576 | 23 | −1096 | −750 | O |
| HETATM | | 4755 | O | HOH | S | 211 | 28.159 | 0.074 | 30.050 | 1.00 | 58.76 | | O |
| ANISOU | | 4755 | O | HOH | S | 211 | 7111 | 7489 | 7489 | 280 | 111 | −463 | O |
| HETATM | | 4756 | O | HOH | S | 212 | 28.871 | 22.446 | 31.068 | 1.00 | 64.36 | | O |
| ANISOU | | 4756 | O | HOH | S | 212 | 7825 | 8091 | 8537 | −422 | −542 | −427 | O |
| HETATM | | 4757 | O | HOH | S | 213 | 27.670 | 21.933 | 32.813 | 1.00 | 70.89 | | O |
| ANISOU | | 4757 | O | HOH | S | 213 | 8713 | 8916 | 9306 | −383 | −580 | −532 | O |
| HETATM | | 4758 | O | HOH | S | 214 | 27.099 | 17.721 | 33.855 | 1.00 | 59.89 | | O |
| ANISOU | | 4758 | O | HOH | S | 214 | 7295 | 7675 | 7788 | −252 | −488 | −566 | O |
| HETATM | | 4759 | O | HOH | S | 215 | 14.202 | 23.638 | 17.331 | 1.00 | 71.47 | | O |
| ANISOU | | 4759 | O | HOH | S | 215 | 9229 | 8843 | 9082 | 0 | −555 | −325 | O |
| HETATM | | 4760 | O | HOH | S | 216 | 10.626 | 23.243 | 10.812 | 1.00 | 76.76 | | O |
| ANISOU | | 4760 | O | HOH | S | 216 | 10125 | 9575 | 9464 | 100 | −774 | −180 | O |
| HETATM | | 4761 | O | HOH | S | 217 | 34.719 | 27.744 | 18.838 | 1.00 | 65.51 | | O |
| ANISOU | | 4761 | O | HOH | S | 217 | 7771 | 8196 | 8924 | −612 | −59 | 420 | O |
| HETATM | | 4762 | O | HOH | S | 218 | 30.931 | 29.133 | 26.374 | 1.00 | 54.70 | | O |
| ANISOU | | 4762 | O | HOH | S | 218 | 6577 | 6592 | 7613 | −666 | −545 | −109 | O |
| HETATM | | 4763 | O | HOH | S | 219 | 19.839 | 20.027 | 11.724 | 1.00 | 64.76 | | O |
| ANISOU | | 4763 | O | HOH | S | 219 | 8544 | 8250 | 7812 | 13 | −242 | −131 | O |
| HETATM | | 4764 | O | HOH | S | 220 | 25.724 | 11.425 | 40.693 | 1.00 | 63.09 | | O |
| ANISOU | | 4764 | O | HOH | S | 220 | 7765 | 8261 | 7946 | −67 | −474 | −675 | O |
| HETATM | | 4765 | O | HOH | S | 221 | 28.083 | 8.498 | 32.989 | 1.00 | 62.48 | | O |
| ANISOU | | 4765 | O | HOH | S | 221 | 7515 | 8221 | 8006 | 5 | −205 | −476 | O |
| END | | | | | | | | | | | | | |

TABLE 17

| | | | | | | | | | | | |
|---|---|---|---|---|---|---|---|---|---|---|---|
| ATOM | 1 | N | GLY | A | 1 | 0.130 | 37.741 | 19.027 | 1.00 | 49.27 | N |
| ATOM | 2 | CA | GLY | A | 1 | −1.266 | 37.350 | 19.127 | 1.00 | 46.92 | C |
| ATOM | 3 | C | GLY | A | 1 | −1.550 | 36.300 | 20.193 | 1.00 | 37.59 | C |
| ATOM | 4 | O | GLY | A | 1 | −0.642 | 35.842 | 20.890 | 1.00 | 39.64 | O |
| ATOM | 5 | N | SER | A | 2 | −2.822 | 35.936 | 20.315 | 1.00 | 34.68 | N |
| ATOM | 6 | CA | SER | A | 2 | −3.277 | 34.966 | 21.299 | 1.00 | 31.34 | C |
| ATOM | 7 | C | SER | A | 2 | −3.011 | 33.547 | 20.794 | 1.00 | 33.02 | C |
| ATOM | 8 | O | SER | A | 2 | −2.872 | 33.305 | 19.592 | 1.00 | 32.26 | O |
| ATOM | 9 | CB | SER | A | 2 | −4.762 | 35.204 | 21.594 | 1.00 | 39.46 | C |
| ATOM | 10 | OG | SER | A | 2 | −5.427 | 34.027 | 21.993 | 1.00 | 54.90 | O |
| ATOM | 11 | N | HIS | A | 3 | −2.915 | 32.602 | 21.729 | 1.00 | 29.59 | N |
| ATOM | 12 | CA | HIS | A | 3 | −2.580 | 31.230 | 21.375 | 1.00 | 29.79 | C |
| ATOM | 13 | C | HIS | A | 3 | −3.376 | 30.271 | 22.246 | 1.00 | 28.23 | C |
| ATOM | 14 | O | HIS | A | 3 | −3.904 | 30.643 | 23.295 | 1.00 | 27.30 | O |
| ATOM | 15 | CB | HIS | A | 3 | −1.080 | 30.956 | 21.544 | 1.00 | 30.88 | C |
| ATOM | 16 | CG | HIS | A | 3 | −0.211 | 31.772 | 20.639 | 1.00 | 31.63 | C |
| ATOM | 17 | ND1 | HIS | A | 3 | −0.005 | 31.446 | 19.315 | 1.00 | 31.63 | N |
| ATOM | 18 | CD2 | HIS | A | 3 | 0.499 | 32.901 | 20.866 | 1.00 | 34.99 | C |
| ATOM | 19 | CE1 | HIS | A | 3 | 0.802 | 32.337 | 18.767 | 1.00 | 35.23 | C |
| ATOM | 20 | NE2 | HIS | A | 3 | 1.114 | 33.237 | 19.685 | 1.00 | 37.29 | N |
| ATOM | 21 | N | SER | A | 4 | −3.422 | 29.011 | 21.828 | 1.00 | 29.94 | N |
| ATOM | 22 | CA | SER | A | 4 | −4.136 | 28.018 | 22.613 | 1.00 | 26.23 | C |
| ATOM | 23 | C | SER | A | 4 | −3.440 | 26.667 | 22.495 | 1.00 | 25.67 | C |
| ATOM | 24 | O | SER | A | 4 | −2.748 | 26.396 | 21.511 | 1.00 | 28.76 | O |
| ATOM | 25 | CB | SER | A | 4 | −5.592 | 27.888 | 22.159 | 1.00 | 32.69 | C |
| ATOM | 26 | OG | SER | A | 4 | −5.658 | 27.459 | 20.809 | 1.00 | 34.22 | O |
| ATOM | 27 | N | MET | A | 5 | −3.595 | 25.845 | 23.532 | 1.00 | 22.94 | N |
| ATOM | 28 | CA | MET | A | 5 | −3.290 | 24.422 | 23.455 | 1.00 | 25.20 | C |
| ATOM | 29 | C | MET | A | 5 | −4.567 | 23.656 | 23.760 | 1.00 | 28.11 | C |
| ATOM | 30 | O | MET | A | 5 | −5.298 | 23.994 | 24.702 | 1.00 | 26.06 | O |
| ATOM | 31 | CB | MET | A | 5 | −2.186 | 24.005 | 24.429 | 1.00 | 26.76 | C |
| ATOM | 32 | CG | MET | A | 5 | −1.813 | 22.517 | 24.310 | 1.00 | 25.71 | C |

TABLE 17-continued

| | | | | | | | | | | |
|---|---|---|---|---|---|---|---|---|---|---|
| ATOM | 33 | SD | MET | A | 5 | −0.370 | 22.056 | 25.302 | 1.00 | 29.87 S |
| ATOM | 34 | CE | MET | A | 5 | −1.000 | 22.064 | 26.988 | 1.00 | 27.01 C |
| ATOM | 35 | N | ARG | A | 6 | −4.843 | 22.636 | 22.964 | 1.00 | 24.83 N |
| ATOM | 36 | CA | ARG | A | 6 | −6.065 | 21.863 | 23.120 | 1.00 | 22.66 C |
| ATOM | 37 | C | ARG | A | 6 | −5.777 | 20.397 | 22.872 | 1.00 | 25.38 C |
| ATOM | 38 | O | ARG | A | 6 | −5.100 | 20.061 | 21.901 | 1.00 | 27.14 O |
| ATOM | 39 | CB | ARG | A | 6 | −7.146 | 22.305 | 22.128 | 1.00 | 28.31 C |
| ATOM | 40 | CG | ARG | A | 6 | −7.465 | 23.773 | 22.139 | 1.00 | 38.75 C |
| ATOM | 41 | CD | ARG | A | 6 | −8.736 | 24.036 | 22.895 | 1.00 | 56.66 C |
| ATOM | 42 | NE | ARG | A | 6 | −9.232 | 25.382 | 22.636 | 1.00 | 55.29 N |
| ATOM | 43 | CZ | ARG | A | 6 | −8.932 | 26.445 | 23.375 | 1.00 | 54.76 C |
| ATOM | 44 | NH1 | ARG | A | 6 | −9.441 | 27.625 | 23.055 | 1.00 | 67.98 N |
| ATOM | 45 | NH2 | ARG | A | 6 | −8.129 | 26.332 | 24.433 | 1.00 | 35.14 N |
| ATOM | 46 | N | TYR | A | 7 | −6.351 | 19.533 | 23.707 | 1.00 | 23.20 N |
| ATOM | 47 | CA | TYR | A | 7 | −6.334 | 18.091 | 23.488 | 1.00 | 21.68 C |
| ATOM | 48 | C | TYR | A | 7 | −7.753 | 17.593 | 23.241 | 1.00 | 24.91 C |
| ATOM | 49 | O | TYR | A | 7 | −8.703 | 18.054 | 23.883 | 1.00 | 24.41 O |
| ATOM | 50 | CB | TYR | A | 7 | −5.738 | 17.371 | 24.685 | 1.00 | 24.00 C |
| ATOM | 51 | CG | TYR | A | 7 | −4.233 | 17.470 | 24.755 | 1.00 | 21.61 C |
| ATOM | 52 | CD1 | TYR | A | 7 | −3.439 | 16.613 | 24.001 | 1.00 | 24.74 C |
| ATOM | 53 | CD2 | TYR | A | 7 | −3.604 | 18.424 | 25.564 | 1.00 | 24.09 C |
| ATOM | 54 | CE1 | TYR | A | 7 | −2.052 | 16.686 | 24.060 | 1.00 | 22.80 C |
| ATOM | 55 | CE2 | TYR | A | 7 | −2.222 | 18.511 | 25.627 | 1.00 | 24.23 C |
| ATOM | 56 | CZ | TYR | A | 7 | −1.453 | 17.634 | 24.869 | 1.00 | 26.94 C |
| ATOM | 57 | OH | TYR | A | 7 | −0.091 | 17.695 | 24.933 | 1.00 | 25.99 O |
| ATOM | 58 | N | PHE | A | 8 | −7.884 | 16.663 | 22.298 | 1.00 | 21.88 N |
| ATOM | 59 | CA | PHE | A | 8 | −9.167 | 16.088 | 21.908 | 1.00 | 21.69 C |
| ATOM | 60 | C | PHE | A | 8 | −9.053 | 14.576 | 22.045 | 1.00 | 26.69 C |
| ATOM | 61 | O | PHE | A | 8 | −8.081 | 13.985 | 21.553 | 1.00 | 27.68 O |
| ATOM | 62 | CB | PHE | A | 8 | −9.520 | 16.451 | 20.468 | 1.00 | 22.48 C |
| ATOM | 63 | CG | PHE | A | 8 | −9.573 | 17.941 | 20.212 | 1.00 | 23.95 C |
| ATOM | 64 | CD1 | PHE | A | 8 | −8.400 | 18.666 | 20.022 | 1.00 | 27.35 C |
| ATOM | 65 | CD2 | PHE | A | 8 | −10.780 | 18.600 | 20.161 | 1.00 | 31.65 C |
| ATOM | 66 | CE1 | PHE | A | 8 | −8.453 | 20.038 | 19.790 | 1.00 | 32.65 C |
| ATOM | 67 | CE2 | PHE | A | 8 | −10.837 | 19.968 | 19.924 | 1.00 | 29.75 C |
| ATOM | 68 | CZ | PHE | A | 8 | −9.678 | 20.681 | 19.741 | 1.00 | 29.13 C |
| ATOM | 69 | N | PHE | A | 9 | −10.043 | 13.959 | 22.696 | 1.00 | 23.26 N |
| ATOM | 70 | CA | PHE | A | 9 | −10.039 | 12.523 | 22.982 | 1.00 | 22.60 C |
| ATOM | 71 | C | PHE | A | 9 | −11.377 | 11.929 | 22.565 | 1.00 | 26.22 C |
| ATOM | 72 | O | PHE | A | 9 | −12.423 | 12.444 | 22.959 | 1.00 | 25.43 O |
| ATOM | 73 | CB | PHE | A | 9 | −9.834 | 12.248 | 24.479 | 1.00 | 19.94 C |
| ATOM | 74 | CG | PHE | A | 9 | −8.619 | 12.894 | 25.063 | 1.00 | 21.08 C |
| ATOM | 75 | CD1 | PHE | A | 9 | −8.678 | 14.187 | 25.587 | 1.00 | 27.47 C |
| ATOM | 76 | CD2 | PHE | A | 9 | −7.402 | 12.227 | 25.070 | 1.00 | 23.74 C |
| ATOM | 77 | CE1 | PHE | A | 9 | −7.555 | 14.791 | 26.115 | 1.00 | 27.18 C |
| ATOM | 78 | CE2 | PHE | A | 9 | −6.267 | 12.828 | 25.606 | 1.00 | 24.64 C |
| ATOM | 79 | CZ | PHE | A | 9 | −6.345 | 14.109 | 26.135 | 1.00 | 26.34 C |
| ATOM | 80 | N | THR | A | 10 | −11.350 | 10.830 | 21.813 | 1.00 | 23.11 N |
| ATOM | 81 | CA | THR | A | 10 | −12.569 | 10.156 | 21.368 | 1.00 | 22.84 C |
| ATOM | 82 | C | THR | A | 10 | −12.428 | 8.674 | 21.669 | 1.00 | 29.08 C |
| ATOM | 83 | O | THR | A | 10 | −11.410 | 8.072 | 21.317 | 1.00 | 26.11 O |
| ATOM | 84 | CB | THR | A | 10 | −12.809 | 10.324 | 19.861 | 1.00 | 25.25 C |
| ATOM | 85 | OG1 | THR | A | 10 | −12.810 | 11.711 | 19.501 | 1.00 | 27.84 O |
| ATOM | 86 | CG2 | THR | A | 10 | −14.132 | 9.673 | 19.430 | 1.00 | 27.92 C |
| ATOM | 87 | N | ASER | A | 11 | −13.428 | 8.089 | 22.330 | 0.63 | 22.86 N |
| ATOM | 88 | CA | ASER | A | 11 | −13.486 | 6.640 | 22.527 | 0.63 | 24.01 C |
| ATOM | 89 | C | ASER | A | 11 | −14.806 | 6.113 | 21.982 | 0.63 | 25.58 C |
| ATOM | 90 | O | ASER | A | 11 | −15.871 | 6.629 | 22.327 | 0.63 | 24.32 O |
| ATOM | 91 | CB | ASER | A | 11 | −13.339 | 6.250 | 24.006 | 0.63 | 24.14 C |
| ATOM | 92 | OG | ASER | A | 11 | −12.078 | 6.611 | 24.556 | 0.63 | 25.08 O |
| ATOM | 93 | N | BSER | A | 11 | −13.457 | 8.089 | 22.277 | 0.37 | 24.26 N |
| ATOM | 94 | CA | BSER | A | 11 | −13.500 | 6.653 | 22.519 | 0.37 | 24.50 C |
| ATOM | 95 | C | BSER | A | 11 | −14.818 | 6.100 | 21.997 | 0.37 | 25.24 C |
| ATOM | 96 | O | BSER | A | 11 | −15.889 | 6.591 | 22.366 | 0.37 | 24.64 O |
| ATOM | 97 | CB | BSER | A | 11 | −13.344 | 6.348 | 24.009 | 0.37 | 24.57 C |
| ATOM | 98 | OG | BSER | A | 11 | −13.219 | 4.959 | 24.228 | 0.37 | 23.53 O |
| ATOM | 99 | N | VAL | A | 12 | −14.741 | 5.067 | 21.161 | 1.00 | 23.50 N |
| ATOM | 100 | CA | VAL | A | 12 | −15.913 | 4.503 | 20.493 | 1.00 | 25.62 C |
| ATOM | 101 | C | VAL | A | 12 | −16.015 | 3.029 | 20.872 | 1.00 | 25.71 C |
| ATOM | 102 | O | VAL | A | 12 | −15.083 | 2.259 | 20.614 | 1.00 | 27.88 O |
| ATOM | 103 | CB | VAL | A | 12 | −15.827 | 4.666 | 18.965 | 1.00 | 25.72 C |
| ATOM | 104 | CG1 | VAL | A | 12 | −17.038 | 3.997 | 18.277 | 1.00 | 25.47 C |
| ATOM | 105 | CG2 | VAL | A | 12 | −15.662 | 6.158 | 18.568 | 1.00 | 31.47 C |
| ATOM | 106 | N | SER | A | 13 | −17.140 | 2.629 | 21.467 | 1.00 | 26.26 N |
| ATOM | 107 | CA | SER | A | 13 | −17.257 | 1.249 | 21.941 | 1.00 | 28.51 C |
| ATOM | 108 | C | SER | A | 13 | −17.491 | 0.274 | 20.788 | 1.00 | 31.92 C |
| ATOM | 109 | O | SER | A | 13 | −17.999 | 0.629 | 19.721 | 1.00 | 28.14 O |
| ATOM | 110 | CB | SER | A | 13 | −18.371 | 1.113 | 22.987 | 1.00 | 28.15 C |
| ATOM | 111 | OG | SER | A | 13 | −19.659 | 1.288 | 22.402 | 1.00 | 26.71 O |
| ATOM | 112 | N | ARG | A | 14 | −17.085 | −0.977 | 21.008 | 1.00 | 30.70 N |

TABLE 17-continued

| | | | | | | | | | |
|---|---|---|---|---|---|---|---|---|---|
| ATOM | 113 | C | ARG | A | 14 | −17.893 | −3.218 | 20.609 | 1.00 | 33.69 | C |
| ATOM | 114 | O | ARG | A | 14 | −17.268 | −4.111 | 21.198 | 1.00 | 34.65 | O |
| ATOM | 115 | CA | AARG | A | 14 | −17.162 | −2.031 | 19.997 | 0.54 | 30.81 | C |
| ATOM | 116 | CB | AARG | A | 14 | −15.770 | −2.418 | 19.500 | 0.54 | 33.54 | C |
| ATOM | 117 | CG | AARG | A | 14 | −15.076 | −1.361 | 18.629 | 0.54 | 34.17 | C |
| ATOM | 118 | CD | AARG | A | 14 | −13.573 | −1.522 | 18.773 | 0.54 | 38.19 | C |
| ATOM | 119 | NE | AARG | A | 14 | −12.797 | −1.056 | 17.630 | 0.54 | 38.89 | N |
| ATOM | 120 | CZ | AARG | A | 14 | −11.485 | −0.850 | 17.672 | 0.54 | 40.25 | C |
| ATOM | 121 | NH1 | AARG | A | 14 | −10.802 | −1.053 | 18.813 | 0.54 | 22.18 | N |
| ATOM | 122 | NH2 | AARG | A | 14 | −10.861 | −0.428 | 16.584 | 0.54 | 36.32 | N |
| ATOM | 123 | CA | BARG | A | 14 | −17.163 | −2.033 | 19.997 | 0.46 | 31.10 | C |
| ATOM | 124 | CB | BARG | A | 14 | −15.773 | −2.425 | 19.496 | 0.46 | 33.45 | C |
| ATOM | 125 | CG | BARG | A | 14 | −15.002 | −1.285 | 18.826 | 0.46 | 33.39 | C |
| ATOM | 126 | CD | BARG | A | 14 | −15.702 | −0.791 | 17.572 | 0.46 | 31.29 | C |
| ATOM | 127 | NE | BARG | A | 14 | −14.938 | 0.265 | 16.913 | 0.46 | 37.48 | N |
| ATOM | 128 | CZ | BARG | A | 14 | −15.453 | 1.133 | 16.046 | 0.46 | 37.13 | C |
| ATOM | 129 | NH1 | BARG | A | 14 | −16.747 | 1.078 | 15.728 | 0.46 | 27.91 | N |
| ATOM | 130 | NH2 | BARG | A | 14 | −14.675 | 2.060 | 15.501 | 0.46 | 29.96 | N |
| ATOM | 131 | N | PRO | A | 15 | −19.217 | −3.255 | 20.496 | 1.00 | 36.39 | N |
| ATOM | 132 | CA | PRO | A | 15 | −20.005 | −4.298 | 21.167 | 1.00 | 36.04 | C |
| ATOM | 133 | C | PRO | A | 15 | −19.515 | −5.700 | 20.838 | 1.00 | 37.13 | C |
| ATOM | 134 | O | PRO | A | 15 | −19.367 | −6.071 | 19.670 | 1.00 | 35.03 | O |
| ATOM | 135 | CB | PRO | A | 15 | −21.424 | −4.066 | 20.635 | 1.00 | 37.17 | C |
| ATOM | 136 | CG | PRO | A | 15 | −21.447 | −2.632 | 20.248 | 1.00 | 49.20 | C |
| ATOM | 137 | CD | PRO | A | 15 | −20.063 | −2.299 | 19.761 | 1.00 | 42.13 | C |
| ATOM | 138 | N | GLY | A | 16 | −19.209 | −6.459 | 21.889 | 1.00 | 41.68 | N |
| ATOM | 139 | CA | GLY | A | 16 | −18.868 | −7.860 | 21.763 | 1.00 | 49.76 | C |
| ATOM | 140 | C | GLY | A | 16 | −17.473 | −8.155 | 21.271 | 1.00 | 47.36 | C |
| ATOM | 141 | O | GLY | A | 16 | −17.187 | −9.318 | 20.971 | 1.00 | 49.99 | O |
| ATOM | 142 | N | ARG | A | 17 | −16.577 | −7.148 | 21.212 | 1.00 | 40.00 | N |
| ATOM | 143 | CA | ARG | A | 17 | −15.316 | −7.302 | 20.491 | 1.00 | 41.70 | C |
| ATOM | 144 | C | ARG | A | 17 | −14.092 | −6.682 | 21.167 | 1.00 | 53.85 | C |
| ATOM | 145 | O | ARG | A | 17 | −13.094 | −6.435 | 20.485 | 1.00 | 73.33 | O |
| ATOM | 146 | CB | ARG | A | 17 | −15.410 | −6.687 | 19.101 | 1.00 | 43.76 | C |
| ATOM | 147 | CG | ARG | A | 17 | −16.445 | −7.303 | 18.205 | 1.00 | 55.62 | C |
| ATOM | 148 | CD | ARG | A | 17 | −16.663 | −6.428 | 16.986 | 1.00 | 69.05 | C |
| ATOM | 149 | NE | ARG | A | 17 | −15.894 | −6.874 | 15.828 | 1.00 | 76.82 | N |
| ATOM | 150 | CZ | ARG | A | 17 | −16.437 | −7.287 | 14.685 | 1.00 | 78.53 | C |
| ATOM | 151 | NH1 | ARG | A | 17 | −17.757 | −7.299 | 14.538 | 1.00 | 75.13 | N |
| ATOM | 152 | NH2 | ARG | A | 17 | −15.658 | −7.678 | 13.686 | 1.00 | 79.62 | N |
| ATOM | 153 | N | GLY | A | 18 | −14.117 | −6.409 | 22.459 | 1.00 | 40.16 | N |
| ATOM | 154 | CA | GLY | A | 18 | −12.915 | −5.889 | 23.101 | 1.00 | 30.25 | C |
| ATOM | 155 | C | GLY | A | 18 | −12.795 | −4.385 | 23.303 | 1.00 | 32.22 | C |
| ATOM | 156 | O | GLY | A | 18 | −13.806 | −3.705 | 23.487 | 1.00 | 31.42 | O |
| ATOM | 157 | N | GLU | A | 19 | −11.562 | −3.868 | 23.281 | 1.00 | 27.72 | N |
| ATOM | 158 | CA | GLU | A | 19 | −11.305 | −2.487 | 23.687 | 1.00 | 26.44 | C |
| ATOM | 159 | C | GLU | A | 19 | −11.954 | −1.499 | 22.723 | 1.00 | 24.50 | C |
| ATOM | 160 | O | GLU | A | 19 | −12.097 | −1.772 | 21.530 | 1.00 | 28.01 | O |
| ATOM | 161 | CB | GLU | A | 19 | −9.802 | −2.194 | 23.761 | 1.00 | 29.62 | C |
| ATOM | 162 | CG | GLU | A | 19 | −9.088 | −2.295 | 22.416 | 1.00 | 38.35 | C |
| ATOM | 163 | CD | GLU | A | 19 | −7.618 | −1.895 | 22.482 | 1.00 | 51.98 | C |
| ATOM | 164 | OE1 | GLU | A | 19 | −7.111 | −1.645 | 23.592 | 1.00 | 54.65 | O |
| ATOM | 165 | OE2 | GLU | A | 19 | −6.975 | −1.818 | 21.413 | 1.00 | 54.08 | O |
| ATOM | 166 | N | PRO | A | 20 | −12.335 | −0.330 | 23.227 | 1.00 | 25.73 | N |
| ATOM | 167 | CA | PRO | A | 20 | −12.847 | 0.729 | 22.347 | 1.00 | 29.54 | C |
| ATOM | 168 | C | PRO | A | 20 | −11.772 | 1.231 | 21.392 | 1.00 | 28.32 | C |
| ATOM | 169 | O | PRO | A | 20 | −10.571 | 1.129 | 21.654 | 1.00 | 28.28 | O |
| ATOM | 170 | CB | PRO | A | 20 | −13.264 | 1.837 | 23.328 | 1.00 | 33.63 | C |
| ATOM | 171 | CG | PRO | A | 20 | −13.220 | 1.236 | 24.713 | 1.00 | 35.29 | C |
| ATOM | 172 | CD | PRO | A | 20 | −12.320 | 0.047 | 24.655 | 1.00 | 29.13 | C |
| ATOM | 173 | N | ARG | A | 21 | −12.204 | 1.790 | 20.274 | 1.00 | 26.58 | N |
| ATOM | 174 | CA | ARG | A | 21 | −11.276 | 2.575 | 19.468 | 1.00 | 26.07 | C |
| ATOM | 175 | C | ARG | A | 21 | −11.033 | 3.908 | 20.171 | 1.00 | 30.37 | C |
| ATOM | 176 | O | ARG | A | 21 | −11.982 | 4.650 | 20.453 | 1.00 | 25.42 | O |
| ATOM | 177 | CB | ARG | A | 21 | −11.827 | 2.781 | 18.060 | 1.00 | 26.16 | C |
| ATOM | 178 | CG | ARG | A | 21 | −10.959 | 3.658 | 17.160 | 1.00 | 29.60 | C |
| ATOM | 179 | CD | ARG | A | 21 | −9.683 | 2.944 | 16.743 | 1.00 | 32.86 | C |
| ATOM | 180 | NE | ARG | A | 21 | −8.885 | 3.684 | 15.761 | 1.00 | 30.58 | N |
| ATOM | 181 | CZ | ARG | A | 21 | −9.141 | 3.748 | 14.455 | 1.00 | 36.43 | C |
| ATOM | 182 | NH1 | ARG | A | 21 | −10.198 | 3.125 | 13.925 | 1.00 | 36.87 | N |
| ATOM | 183 | NH2 | ARG | A | 21 | −8.327 | 4.438 | 13.673 | 1.00 | 37.23 | N |
| ATOM | 184 | N | PHE | A | 22 | −9.776 | 4.203 | 20.487 | 1.00 | 24.37 | N |
| ATOM | 185 | CA | PHE | A | 22 | −9.417 | 5.410 | 21.237 | 1.00 | 24.04 | C |
| ATOM | 186 | C | PHE | A | 22 | −8.423 | 6.242 | 20.440 | 1.00 | 27.86 | C |
| ATOM | 187 | O | PHE | A | 22 | −7.384 | 5.727 | 20.012 | 1.00 | 26.44 | O |
| ATOM | 188 | CB | PHE | A | 22 | −8.825 | 5.046 | 22.600 | 1.00 | 24.43 | C |
| ATOM | 189 | CG | PHE | A | 22 | −8.263 | 6.215 | 23.365 | 1.00 | 25.19 | C |
| ATOM | 190 | CD1 | PHE | A | 22 | −9.104 | 7.088 | 24.056 | 1.00 | 26.14 | C |
| ATOM | 191 | CD2 | PHE | A | 22 | −6.884 | 6.415 | 23.439 | 1.00 | 27.65 | C |
| ATOM | 192 | CE1 | PHE | A | 22 | −8.576 | 8.162 | 24.784 | 1.00 | 33.61 | C |

TABLE 17-continued

| ATOM | 193 | CE2 | PHE | A | 22 | −6.358 | 7.464 | 24.179 | 1.00 | 27.48 | C |
|---|---|---|---|---|---|---|---|---|---|---|---|
| ATOM | 194 | CZ | PHE | A | 22 | −7.216 | 8.347 | 24.849 | 1.00 | 25.53 | C |
| ATOM | 195 | N | ILE | A | 23 | −8.741 | 7.522 | 20.224 | 1.00 | 24.76 | N |
| ATOM | 196 | CA | ILE | A | 23 | −7.874 | 8.410 | 19.454 | 1.00 | 27.39 | C |
| ATOM | 197 | C | ILE | A | 23 | −7.701 | 9.701 | 20.239 | 1.00 | 26.96 | C |
| ATOM | 198 | O | ILE | A | 23 | −8.692 | 10.312 | 20.654 | 1.00 | 26.83 | O |
| ATOM | 199 | CB | ILE | A | 23 | −8.452 | 8.698 | 18.052 | 1.00 | 29.52 | C |
| ATOM | 200 | CG1 | ILE | A | 23 | −8.604 | 7.386 | 17.262 | 1.00 | 30.14 | C |
| ATOM | 201 | CG2 | ILE | A | 23 | −7.556 | 9.665 | 17.288 | 1.00 | 26.13 | C |
| ATOM | 202 | CD1 | ILE | A | 23 | −9.466 | 7.506 | 16.022 | 1.00 | 31.60 | C |
| ATOM | 203 | N | ALA | A | 24 | −6.453 | 10.114 | 20.438 | 1.00 | 22.73 | N |
| ATOM | 204 | CA | ALA | A | 24 | −6.123 | 11.373 | 21.100 | 1.00 | 23.35 | C |
| ATOM | 205 | C | ALA | A | 24 | −5.306 | 12.234 | 20.147 | 1.00 | 25.69 | C |
| ATOM | 206 | O | ALA | A | 24 | −4.438 | 11.724 | 19.438 | 1.00 | 26.91 | O |
| ATOM | 207 | CB | ALA | A | 24 | −5.335 | 11.137 | 22.384 | 1.00 | 26.08 | C |
| ATOM | 208 | N | VAL | A | 25 | −5.582 | 13.545 | 20.119 | 1.00 | 23.57 | N |
| ATOM | 209 | CA | VAL | A | 25 | −4.825 | 14.468 | 19.282 | 1.00 | 22.95 | C |
| ATOM | 210 | C | VAL | A | 25 | −4.579 | 15.730 | 20.098 | 1.00 | 25.75 | C |
| ATOM | 211 | O | VAL | A | 25 | −5.412 | 16.115 | 20.932 | 1.00 | 24.03 | O |
| ATOM | 212 | CB | VAL | A | 25 | −5.542 | 14.790 | 17.948 | 1.00 | 28.81 | C |
| ATOM | 213 | CG1 | VAL | A | 25 | −5.671 | 13.544 | 17.079 | 1.00 | 34.83 | C |
| ATOM | 214 | CG2 | VAL | A | 25 | −6.921 | 15.377 | 18.191 | 1.00 | 31.72 | C |
| ATOM | 215 | N | GLY | A | 26 | −3.403 | 16.319 | 19.911 | 1.00 | 22.30 | N |
| ATOM | 216 | CA | GLY | A | 26 | −3.047 | 17.580 | 20.551 | 1.00 | 22.91 | C |
| ATOM | 217 | O | GLY | A | 26 | −2.758 | 18.648 | 19.514 | 1.00 | 26.43 | C |
| ATOM | 218 | O | GLY | A | 26 | −2.117 | 18.376 | 18.494 | 1.00 | 26.68 | O |
| ATOM | 219 | N | TYR | A | 27 | −3.210 | 19.870 | 19.796 | 1.00 | 27.78 | N |
| ATOM | 220 | CA | TYR | A | 27 | −3.010 | 21.023 | 18.929 | 1.00 | 26.19 | C |
| ATOM | 221 | C | TYR | A | 27 | −2.417 | 22.182 | 19.714 | 1.00 | 25.09 | C |
| ATOM | 222 | O | TYR | A | 27 | −2.762 | 22.394 | 20.878 | 1.00 | 26.89 | O |
| ATOM | 223 | CB | TYR | A | 27 | −4.320 | 21.539 | 18.314 | 1.00 | 26.10 | C |
| ATOM | 224 | CG | TYR | A | 27 | −4.915 | 20.694 | 17.223 | 1.00 | 30.36 | C |
| ATOM | 225 | CD1 | TYR | A | 27 | −5.636 | 19.550 | 17.526 | 1.00 | 32.48 | C |
| ATOM | 226 | CD2 | TYR | A | 27 | −4.778 | 21.062 | 15.891 | 1.00 | 30.74 | C |
| ATOM | 227 | CE1 | TYR | A | 27 | −6.201 | 18.783 | 16.520 | 1.00 | 36.37 | C |
| ATOM | 228 | CE2 | TYR | A | 27 | −5.337 | 20.301 | 14.877 | 1.00 | 39.57 | C |
| ATOM | 229 | CZ | TYR | A | 27 | −6.047 | 19.166 | 15.200 | 1.00 | 43.10 | C |
| ATOM | 230 | OH | TYR | A | 27 | −6.607 | 18.407 | 14.200 | 1.00 | 46.98 | O |
| ATOM | 231 | N | VAL | A | 28 | −1.521 | 22.916 | 19.067 | 1.00 | 27.98 | N |
| ATOM | 232 | CA | VAL | A | 28 | −1.224 | 24.299 | 19.425 | 1.00 | 28.52 | C |
| ATOM | 233 | C | VAL | A | 28 | −1.772 | 25.154 | 18.292 | 1.00 | 30.52 | C |
| ATOM | 234 | O | VAL | A | 28 | −1.376 | 24.983 | 17.132 | 1.00 | 29.80 | O |
| ATOM | 235 | CB | VAL | A | 28 | 0.280 | 24.549 | 19.635 | 1.00 | 31.35 | C |
| ATOM | 236 | CG1 | VAL | A | 28 | 0.524 | 26.049 | 19.879 | 1.00 | 27.98 | C |
| ATOM | 237 | CG2 | VAL | A | 28 | 0.787 | 23.746 | 20.810 | 1.00 | 30.27 | C |
| ATOM | 238 | N | ASP | A | 29 | −2.699 | 26.055 | 18.621 | 1.00 | 30.27 | N |
| ATOM | 239 | CA | ASP | A | 29 | −3.428 | 26.854 | 17.626 | 1.00 | 27.47 | C |
| ATOM | 240 | C | ASP | A | 29 | −4.043 | 25.881 | 16.618 | 1.00 | 29.26 | C |
| ATOM | 241 | O | ASP | A | 29 | −4.738 | 24.940 | 17.031 | 1.00 | 28.13 | O |
| ATOM | 242 | CB | ASP | A | 29 | −2.498 | 27.896 | 17.034 | 1.00 | 34.03 | C |
| ATOM | 243 | CG | ASP | A | 29 | −1.920 | 28.831 | 18.088 | 1.00 | 40.08 | C |
| ATOM | 244 | OD1 | ASP | A | 29 | −2.595 | 29.041 | 19.125 | 1.00 | 36.50 | O |
| ATOM | 245 | OD2 | ASP | A | 29 | −0.794 | 29.345 | 17.874 | 1.00 | 43.27 | O |
| ATOM | 246 | N | ASP | A | 30 | −3.799 | 26.052 | 15.319 | 1.00 | 31.53 | N |
| ATOM | 247 | CA | ASP | A | 30 | −4.361 | 25.207 | 14.275 | 1.00 | 32.86 | C |
| ATOM | 248 | C | ASP | A | 30 | −3.386 | 24.127 | 13.799 | 1.00 | 38.18 | C |
| ATOM | 249 | O | ASP | A | 30 | −3.603 | 23.531 | 12.736 | 1.00 | 35.18 | O |
| ATOM | 250 | CB | ASP | A | 30 | −4.808 | 26.080 | 13.095 | 1.00 | 35.70 | C |
| ATOM | 251 | CG | ASP | A | 30 | −5.928 | 27.045 | 13.471 | 1.00 | 39.33 | C |
| ATOM | 252 | OD1 | ASP | A | 30 | −6.776 | 26.665 | 14.300 | 1.00 | 39.00 | O |
| ATOM | 253 | OD2 | ASP | A | 30 | −5.948 | 28.186 | 12.952 | 1.00 | 39.18 | O |
| ATOM | 254 | N | THR | A | 31 | −2.320 | 23.861 | 14.563 | 1.00 | 33.33 | N |
| ATOM | 255 | CA | THR | A | 31 | −1.269 | 22.924 | 14.180 | 1.00 | 33.97 | C |
| ATOM | 256 | C | THR | A | 31 | −1.328 | 21.709 | 15.095 | 1.00 | 35.30 | C |
| ATOM | 257 | O | THR | A | 31 | −1.085 | 21.824 | 16.298 | 1.00 | 28.51 | O |
| ATOM | 258 | CB | THR | A | 31 | 0.107 | 23.586 | 14.273 | 1.00 | 34.23 | C |
| ATOM | 259 | OG1 | THR | A | 31 | 0.155 | 24.701 | 13.380 | 1.00 | 34.83 | O |
| ATOM | 260 | CG2 | THR | A | 31 | 1.210 | 22.587 | 13.931 | 1.00 | 35.74 | C |
| ATOM | 261 | N | GLN | A | 32 | −1.625 | 20.542 | 14.530 | 1.00 | 28.74 | N |
| ATOM | 262 | CA | GLN | A | 32 | −1.547 | 19.321 | 15.321 | 1.00 | 24.69 | C |
| ATOM | 263 | C | GLN | A | 32 | −0.089 | 18.982 | 15.609 | 1.00 | 31.92 | C |
| ATOM | 264 | O | GLN | A | 32 | 0.788 | 19.169 | 14.755 | 1.00 | 33.83 | O |
| ATOM | 265 | CB | GLN | A | 32 | −2.217 | 18.160 | 14.574 | 1.00 | 33.39 | C |
| ATOM | 266 | CG | GLN | A | 32 | −2.225 | 16.871 | 15.376 | 1.00 | 34.46 | C |
| ATOM | 267 | CD | GLN | A | 32 | −2.586 | 15.646 | 14.547 | 1.00 | 37.54 | C |
| ATOM | 268 | OE1 | GLN | A | 32 | −2.991 | 15.758 | 13.393 | 1.00 | 39.90 | O |
| ATOM | 269 | NE2 | GLN | A | 32 | −2.448 | 14.473 | 15.143 | 1.00 | 34.74 | N |
| ATOM | 270 | N | PHE | A | 33 | 0.192 | 18.502 | 16.830 | 1.00 | 27.06 | N |
| ATOM | 271 | CA | PHE | A | 33 | 1.565 | 18.164 | 17.168 | 1.00 | 26.79 | C |
| ATOM | 272 | C | PHE | A | 33 | 1.768 | 16.781 | 17.782 | 1.00 | 28.42 | C |

TABLE 17-continued

| | | | | | | | | | | | |
|---|---|---|---|---|---|---|---|---|---|---|---|
| ATOM | 273 | O | PHE | A | 33 | 2.912 | 16.317 | 17.799 | 1.00 | 29.24 | O |
| ATOM | 274 | CB | PHE | A | 33 | 2.191 | 19.235 | 18.090 | 1.00 | 28.71 | C |
| ATOM | 275 | CG | PHE | A | 33 | 1.645 | 19.269 | 19.503 | 1.00 | 28.53 | C |
| ATOM | 276 | CD1 | PHE | A | 33 | 0.449 | 19.922 | 19.791 | 1.00 | 26.52 | C |
| ATOM | 277 | CD2 | PHE | A | 33 | 2.365 | 18.716 | 20.552 | 1.00 | 25.74 | C |
| ATOM | 278 | CE1 | PHE | A | 33 | −0.038 | 19.976 | 21.086 | 1.00 | 24.14 | C |
| ATOM | 279 | CE2 | PHE | A | 33 | 1.880 | 18.765 | 21.861 | 1.00 | 27.10 | C |
| ATOM | 280 | CZ | PHE | A | 33 | 0.674 | 19.392 | 22.128 | 1.00 | 25.48 | C |
| ATOM | 281 | N | VAL | A | 34 | 0.722 | 16.093 | 18.254 | 1.00 | 27.48 | N |
| ATOM | 282 | CA | VAL | A | 34 | 0.862 | 14.736 | 18.786 | 1.00 | 23.60 | C |
| ATOM | 283 | C | VAL | A | 34 | −0.394 | 13.940 | 18.469 | 1.00 | 30.75 | C |
| ATOM | 284 | O | VAL | A | 34 | −1.476 | 14.493 | 18.238 | 1.00 | 27.81 | O |
| ATOM | 285 | CB | VAL | A | 34 | 1.110 | 14.674 | 20.317 | 1.00 | 25.20 | C |
| ATOM | 286 | CG1 | VAL | A | 34 | 2.521 | 15.103 | 20.681 | 1.00 | 31.09 | C |
| ATOM | 287 | CG2 | VAL | A | 34 | 0.041 | 15.496 | 21.086 | 1.00 | 26.99 | C |
| ATOM | 288 | N | ARG | A | 35 | −0.256 | 12.615 | 18.485 | 1.00 | 23.85 | N |
| ATOM | 289 | CA | ARG | A | 35 | −1.443 | 11.781 | 18.345 | 1.00 | 22.69 | C |
| ATOM | 290 | C | ARG | A | 35 | −1.211 | 10.476 | 19.089 | 1.00 | 27.54 | C |
| ATOM | 291 | O | ARG | A | 35 | −0.070 | 10.040 | 19.248 | 1.00 | 27.81 | O |
| ATOM | 292 | CB | ARG | A | 35 | −1.780 | 11.517 | 16.869 | 1.00 | 24.95 | C |
| ATOM | 293 | CG | ARG | A | 35 | −0.891 | 10.492 | 16.168 | 1.00 | 36.79 | C |
| ATOM | 294 | CD | ARG | A | 35 | −1.621 | 9.148 | 16.109 | 1.00 | 43.03 | C |
| ATOM | 295 | NE | ARG | A | 35 | −0.861 | 8.083 | 15.469 | 1.00 | 53.93 | N |
| ATOM | 296 | CZ | ARG | A | 35 | −1.272 | 7.406 | 14.403 | 1.00 | 56.31 | C |
| ATOM | 297 | NH1 | ARG | A | 35 | −2.443 | 7.679 | 13.834 | 1.00 | 50.24 | N |
| ATOM | 298 | NH2 | ARG | A | 35 | −0.509 | 6.447 | 13.907 | 1.00 | 57.31 | N |
| ATOM | 299 | N | PHE | A | 36 | −2.301 | 9.880 | 19.568 | 1.00 | 26.26 | N |
| ATOM | 300 | CA | PHE | A | 36 | −2.322 | 8.484 | 19.994 | 1.00 | 25.78 | C |
| ATOM | 301 | C | PHE | A | 36 | −3.503 | 7.803 | 19.318 | 1.00 | 29.55 | C |
| ATOM | 302 | O | PHE | A | 36 | −4.614 | 8.347 | 19.301 | 1.00 | 27.76 | O |
| ATOM | 303 | CB | PHE | A | 36 | −2.433 | 8.343 | 21.520 | 1.00 | 23.21 | C |
| ATOM | 304 | CG | PHE | A | 36 | −2.404 | 6.906 | 22.007 | 1.00 | 27.32 | C |
| ATOM | 305 | CD1 | PHE | A | 36 | −3.561 | 6.120 | 22.004 | 1.00 | 28.75 | C |
| ATOM | 306 | CD2 | PHE | A | 36 | −1.207 | 6.331 | 22.439 | 1.00 | 27.31 | C |
| ATOM | 307 | CE1 | PHE | A | 36 | −3.524 | 4.794 | 22.438 | 1.00 | 30.03 | C |
| ATOM | 308 | CE2 | PHE | A | 36 | −1.156 | 5.000 | 22.871 | 1.00 | 29.93 | C |
| ATOM | 309 | CZ | PHE | A | 36 | −2.322 | 4.237 | 22.871 | 1.00 | 31.75 | C |
| ATOM | 310 | N | ASP | A | 37 | −3.277 | 6.608 | 18.778 | 1.00 | 22.56 | N |
| ATOM | 311 | CA | ASP | A | 37 | −4.351 | 5.842 | 18.142 | 1.00 | 25.14 | C |
| ATOM | 312 | C | ASP | A | 37 | −4.233 | 4.412 | 18.635 | 1.00 | 27.50 | C |
| ATOM | 313 | O | ASP | A | 37 | −3.213 | 3.759 | 18.393 | 1.00 | 31.16 | O |
| ATOM | 314 | CB | ASP | A | 37 | −4.260 | 5.924 | 16.614 | 1.00 | 31.08 | C |
| ATOM | 315 | CG | ASP | A | 37 | −5.442 | 5.253 | 15.896 | 1.00 | 36.04 | C |
| ATOM | 316 | OD1 | ASP | A | 37 | −6.093 | 4.361 | 16.486 | 1.00 | 32.34 | O |
| ATOM | 317 | OD2 | ASP | A | 37 | −5.715 | 5.634 | 14.732 | 1.00 | 34.89 | O |
| ATOM | 318 | N | SER | A | 38 | −5.265 | 3.934 | 19.331 | 1.00 | 28.04 | N |
| ATOM | 319 | CA | SER | A | 38 | −5.216 | 2.589 | 19.895 | 1.00 | 27.82 | C |
| ATOM | 320 | C | SER | A | 38 | −5.060 | 1.508 | 18.827 | 1.00 | 31.90 | C |
| ATOM | 321 | O | SER | A | 38 | −4.635 | 0.393 | 19.154 | 1.00 | 33.07 | O |
| ATOM | 322 | CB | SER | A | 38 | −6.476 | 2.321 | 20.722 | 1.00 | 29.14 | C |
| ATOM | 323 | OG | SER | A | 38 | −7.633 | 2.326 | 19.886 | 1.00 | 29.87 | O |
| ATOM | 324 | N | ASP | A | 39 | −5.399 | 1.793 | 17.569 | 1.00 | 31.85 | N |
| ATOM | 325 | CA | ASP | A | 39 | −5.230 | 0.805 | 16.503 | 1.00 | 36.52 | C |
| ATOM | 326 | C | ASP | A | 39 | −3.838 | 0.807 | 15.877 | 1.00 | 38.24 | C |
| ATOM | 327 | O | ASP | A | 39 | −3.529 | −0.108 | 15.108 | 1.00 | 35.04 | O |
| ATOM | 328 | CB | ASP | A | 39 | −6.270 | 1.019 | 15.390 | 1.00 | 38.46 | C |
| ATOM | 329 | CG | ASP | A | 39 | −7.554 | 0.242 | 15.631 | 1.00 | 47.86 | C |
| ATOM | 330 | OD1 | ASP | A | 39 | −7.638 | −0.481 | 16.650 | 1.00 | 48.55 | O |
| ATOM | 331 | OD2 | ASP | A | 39 | −8.479 | 0.348 | 14.798 | 1.00 | 52.96 | O |
| ATOM | 332 | N | ALA | A | 40 | −3.002 | 1.804 | 16.162 | 1.00 | 36.43 | N |
| ATOM | 333 | CA | ALA | A | 40 | −1.688 | 1.867 | 15.538 | 1.00 | 40.33 | C |
| ATOM | 334 | C | ALA | A | 40 | −0.724 | 0.879 | 16.196 | 1.00 | 37.62 | C |
| ATOM | 335 | O | ALA | A | 40 | −0.921 | 0.431 | 17.326 | 1.00 | 38.62 | O |
| ATOM | 336 | CB | ALA | A | 40 | −1.116 | 3.284 | 15.608 | 1.00 | 41.86 | C |
| ATOM | 337 | N | ALA | A | 41 | 0.350 | 0.555 | 15.473 | 1.00 | 37.33 | N |
| ATOM | 338 | CA | ALA | A | 41 | 1.243 | −0.502 | 15.936 | 1.00 | 40.09 | C |
| ATOM | 339 | C | ALA | A | 41 | 2.084 | −0.082 | 17.139 | 1.00 | 39.65 | C |
| ATOM | 340 | O | ALA | A | 41 | 2.331 | −0.907 | 18.026 | 1.00 | 38.56 | O |
| ATOM | 341 | CB | ALA | A | 41 | 2.151 | −0.958 | 14.792 | 1.00 | 39.00 | C |
| ATOM | 342 | N | SER | A | 42 | 2.520 | 1.186 | 17.204 | 1.00 | 35.59 | N |
| ATOM | 343 | CA | SER | A | 42 | 3.493 | 1.581 | 18.226 | 1.00 | 36.92 | C |
| ATOM | 344 | C | SER | A | 42 | 2.929 | 1.527 | 19.644 | 1.00 | 35.44 | C |
| ATOM | 345 | O | SER | A | 42 | 3.677 | 1.259 | 20.591 | 1.00 | 36.21 | O |
| ATOM | 346 | CB | SER | A | 42 | 4.014 | 2.990 | 17.945 | 1.00 | 42.68 | C |
| ATOM | 347 | OG | SER | A | 42 | 3.034 | 3.961 | 18.279 | 1.00 | 39.71 | O |
| ATOM | 348 | N | GLN | A | 43 | 1.636 | 1.801 | 19.822 | 1.00 | 35.73 | N |
| ATOM | 349 | CA | GLN | A | 43 | 1.040 | 1.974 | 21.154 | 1.00 | 36.84 | C |
| ATOM | 350 | C | GLN | A | 43 | 1.744 | 3.071 | 21.956 | 1.00 | 25.93 | C |
| ATOM | 351 | O | GLN | A | 43 | 1.877 | 2.976 | 23.175 | 1.00 | 29.04 | O |
| ATOM | 352 | CB | GLN | A | 43 | 1.030 | 0.665 | 21.949 | 1.00 | 35.37 | C |

TABLE 17-continued

| | | | | | | | | | | |
|---|---|---|---|---|---|---|---|---|---|---|
| ATOM | 353 | CG | GLN | A | 43 | 0.245 | −0.444 | 21.276 | 1.00 | 31.27 C |
| ATOM | 354 | CD | GLN | A | 43 | −1.237 | −0.125 | 21.164 | 1.00 | 39.07 C |
| ATOM | 355 | OE1 | GLN | A | 43 | −1.904 | 0.140 | 22.162 | 1.00 | 41.47 O |
| ATOM | 356 | NE2 | GLN | A | 43 | −1.756 | −0.143 | 19.937 | 1.00 | 40.69 N |
| ATOM | 357 | N | ARG | A | 44 | 2.191 | 4.116 | 21.277 | 1.00 | 29.29 N |
| ATOM | 358 | CA | ARG | A | 44 | 2.838 | 5.245 | 21.921 | 1.00 | 27.56 C |
| ATOM | 359 | C | ARG | A | 44 | 2.181 | 6.532 | 21.459 | 1.00 | 25.69 C |
| ATOM | 360 | O | ARG | A | 44 | 1.623 | 6.603 | 20.363 | 1.00 | 28.26 O |
| ATOM | 361 | CB | ARG | A | 44 | 4.329 | 5.324 | 21.567 | 1.00 | 36.75 C |
| ATOM | 362 | CG | ARG | A | 44 | 5.055 | 4.007 | 21.637 | 1.00 | 42.57 C |
| ATOM | 363 | CD | ARG | A | 44 | 5.731 | 3.865 | 22.964 | 1.00 | 49.93 C |
| ATOM | 364 | NE | ARG | A | 44 | 6.764 | 4.881 | 23.154 | 1.00 | 49.37 N |
| ATOM | 365 | CZ | ARG | A | 44 | 7.262 | 5.208 | 24.342 | 1.00 | 42.78 C |
| ATOM | 366 | NH1 | ARG | A | 44 | 6.806 | 4.609 | 25.437 | 1.00 | 42.10 N |
| ATOM | 367 | NH2 | ARG | A | 44 | 8.198 | 6.142 | 24.436 | 1.00 | 44.58 N |
| ATOM | 368 | N | MET | A | 45 | 2.284 | 7.559 | 22.290 | 1.00 | 27.40 N |
| ATOM | 369 | CA | MET | A | 45 | 2.072 | 8.905 | 21.784 | 1.00 | 26.23 C |
| ATOM | 370 | C | MET | A | 45 | 3.135 | 9.199 | 20.736 | 1.00 | 24.02 C |
| ATOM | 371 | O | MET | A | 45 | 4.317 | 8.905 | 20.943 | 1.00 | 29.06 O |
| ATOM | 372 | CB | MET | A | 45 | 2.137 | 9.917 | 22.923 | 1.00 | 27.23 C |
| ATOM | 373 | CG | MET | A | 45 | 1.733 | 11.315 | 22.477 | 1.00 | 30.54 C |
| ATOM | 374 | SD | MET | A | 45 | −0.079 | 11.460 | 22.370 | 1.00 | 28.66 S |
| ATOM | 375 | CE | MET | A | 45 | −0.331 | 12.400 | 23.877 | 1.00 | 27.49 C |
| ATOM | 376 | N | GLU | A | 46 | 2.724 | 9.758 | 19.598 | 1.00 | 24.52 N |
| ATOM | 377 | CA | GLU | A | 46 | 3.630 | 9.935 | 18.476 | 1.00 | 29.40 C |
| ATOM | 378 | C | GLU | A | 46 | 3.707 | 11.401 | 18.053 | 1.00 | 32.47 C |
| ATOM | 379 | O | GLU | A | 46 | 2.718 | 12.135 | 18.140 | 1.00 | 29.26 O |
| ATOM | 380 | CB | GLU | A | 46 | 3.193 | 9.066 | 17.281 | 1.00 | 32.36 C |
| ATOM | 381 | CG | GLU | A | 46 | 3.089 | 7.590 | 17.644 | 1.00 | 34.41 C |
| ATOM | 382 | CD | GLU | A | 46 | 2.759 | 6.655 | 16.474 | 1.00 | 46.98 C |
| ATOM | 383 | OE1 | GLU | A | 46 | 3.587 | 5.772 | 16.179 | 1.00 | 53.84 O |
| ATOM | 384 | OE2 | GLU | A | 46 | 1.679 | 6.775 | 15.866 | 1.00 | 48.91 O |
| ATOM | 385 | N | PRO | A | 47 | 4.866 | 11.851 | 17.589 | 1.00 | 30.54 N |
| ATOM | 386 | CA | PRO | A | 47 | 4.989 | 13.239 | 17.126 | 1.00 | 31.79 C |
| ATOM | 387 | C | PRO | A | 47 | 4.279 | 13.463 | 15.798 | 1.00 | 32.71 C |
| ATOM | 388 | O | PRO | A | 47 | 4.239 | 12.585 | 14.932 | 1.00 | 34.62 O |
| ATOM | 389 | CB | PRO | A | 47 | 6.501 | 13.420 | 16.973 | 1.00 | 32.64 C |
| ATOM | 390 | CG | PRO | A | 47 | 6.995 | 12.010 | 16.669 | 1.00 | 33.39 C |
| ATOM | 391 | CD | PRO | A | 47 | 6.159 | 11.135 | 17.552 | 1.00 | 31.55 C |
| ATOM | 392 | N | ARG | A | 48 | 3.740 | 14.675 | 15.629 | 1.00 | 30.72 N |
| ATOM | 393 | CA | ARG | A | 48 | 3.129 | 15.066 | 14.363 | 1.00 | 31.02 C |
| ATOM | 394 | C | ARG | A | 48 | 3.535 | 16.467 | 13.913 | 1.00 | 36.85 C |
| ATOM | 395 | O | ARG | A | 48 | 2.992 | 16.971 | 12.924 | 1.00 | 39.01 O |
| ATOM | 396 | CB | ARG | A | 48 | 1.602 | 14.965 | 14.457 | 1.00 | 35.06 C |
| ATOM | 397 | CG | ARG | A | 48 | 1.070 | 13.541 | 14.402 | 1.00 | 38.46 C |
| ATOM | 398 | CD | ARG | A | 48 | 1.328 | 12.938 | 13.028 | 1.00 | 41.78 C |
| ATOM | 399 | NE | ARG | A | 48 | 0.859 | 11.560 | 12.918 | 1.00 | 49.45 N |
| ATOM | 400 | CZ | ARG | A | 48 | 1.611 | 10.496 | 13.194 | 1.00 | 55.54 C |
| ATOM | 401 | NH1 | ARG | A | 48 | 1.116 | 9.271 | 13.071 | 1.00 | 56.08 N |
| ATOM | 402 | NH2 | ARG | A | 48 | 2.864 | 10.657 | 13.594 | 1.00 | 59.41 N |
| ATOM | 403 | N | ALA | A | 49 | 4.475 | 17.099 | 14.603 | 1.00 | 32.90 N |
| ATOM | 404 | CA | ALA | A | 49 | 5.035 | 18.385 | 14.218 | 1.00 | 40.96 C |
| ATOM | 405 | C | ALA | A | 49 | 6.535 | 18.318 | 14.447 | 1.00 | 38.46 C |
| ATOM | 406 | O | ALA | A | 49 | 6.994 | 17.570 | 15.316 | 1.00 | 40.23 O |
| ATOM | 407 | CB | ALA | A | 49 | 4.435 | 19.550 | 15.021 | 1.00 | 40.23 C |
| ATOM | 408 | N | PRO | A | 50 | 7.323 | 19.079 | 13.680 | 1.00 | 39.61 N |
| ATOM | 409 | CA | PRO | A | 50 | 8.788 | 18.928 | 13.775 | 1.00 | 43.17 C |
| ATOM | 410 | C | PRO | A | 50 | 9.358 | 19.345 | 15.119 | 1.00 | 41.61 C |
| ATOM | 411 | O | PRO | A | 50 | 10.310 | 18.728 | 15.609 | 1.00 | 43.04 O |
| ATOM | 412 | CB | PRO | A | 50 | 9.306 | 19.832 | 12.649 | 1.00 | 46.19 C |
| ATOM | 413 | CG | PRO | A | 50 | 8.129 | 20.065 | 11.751 | 1.00 | 49.94 C |
| ATOM | 414 | CD | PRO | A | 50 | 6.919 | 20.008 | 12.610 | 1.00 | 39.44 C |
| ATOM | 415 | N | TRP | A | 51 | 8.798 | 20.383 | 15.734 | 1.00 | 39.52 N |
| ATOM | 416 | CA | TRP | A | 51 | 9.390 | 20.937 | 16.940 | 1.00 | 41.20 C |
| ATOM | 417 | C | TRP | A | 51 | 9.123 | 20.097 | 18.181 | 1.00 | 39.39 C |
| ATOM | 418 | O | TRP | A | 51 | 9.753 | 20.336 | 19.217 | 1.00 | 41.05 O |
| ATOM | 419 | CB | TRP | A | 51 | 8.875 | 22.355 | 17.150 | 1.00 | 43.28 C |
| ATOM | 420 | CG | TRP | A | 51 | 7.408 | 22.500 | 16.902 | 1.00 | 44.45 C |
| ATOM | 421 | CD1 | TRP | A | 51 | 6.807 | 22.885 | 15.740 | 1.00 | 46.08 C |
| ATOM | 422 | CD2 | TRP | A | 51 | 6.354 | 22.261 | 17.840 | 1.00 | 38.61 C |
| ATOM | 423 | NE1 | TRP | A | 51 | 5.441 | 22.911 | 15.898 | 1.00 | 45.95 N |
| ATOM | 424 | CE2 | TRP | A | 51 | 5.136 | 22.533 | 17.179 | 1.00 | 39.37 C |
| ATOM | 425 | CE3 | TRP | A | 51 | 6.323 | 21.861 | 19.176 | 1.00 | 33.80 C |
| ATOM | 426 | CZ2 | TRP | A | 51 | 3.897 | 22.402 | 17.806 | 1.00 | 35.85 C |
| ATOM | 427 | CZ3 | TRP | A | 51 | 5.090 | 21.740 | 19.799 | 1.00 | 31.22 C |
| ATOM | 428 | CH2 | TRP | A | 51 | 3.896 | 22.010 | 19.116 | 1.00 | 30.39 C |
| ATOM | 429 | N | ILE | A | 52 | 8.189 | 19.144 | 18.126 | 1.00 | 31.93 N |
| ATOM | 430 | CA | ILE | A | 52 | 7.994 | 18.267 | 19.270 | 1.00 | 32.53 C |
| ATOM | 431 | C | ILE | A | 52 | 8.921 | 17.057 | 19.214 | 1.00 | 31.34 C |
| ATOM | 432 | O | ILE | A | 52 | 9.123 | 16.397 | 20.242 | 1.00 | 29.61 O |

TABLE 17-continued

| ATOM | 433 | CB | ILE | A | 52 | 6.532 | 17.794 | 19.381 | 1.00 | 32.27 | C |
|---|---|---|---|---|---|---|---|---|---|---|---|
| ATOM | 434 | CG1 | ILE | A | 52 | 6.213 | 17.368 | 20.817 | 1.00 | 28.16 | C |
| ATOM | 435 | CG2 | ILE | A | 52 | 6.272 | 16.647 | 18.430 | 1.00 | 34.79 | C |
| ATOM | 436 | CD1 | ILE | A | 52 | 6.061 | 18.519 | 21.775 | 1.00 | 30.63 | C |
| ATOM | 437 | N | GLU | A | 53 | 9.489 | 16.747 | 18.046 | 1.00 | 40.29 | N |
| ATOM | 438 | CA | GLU | A | 53 | 10.346 | 15.568 | 17.946 | 1.00 | 46.76 | C |
| ATOM | 439 | C | GLU | A | 53 | 11.591 | 15.687 | 18.816 | 1.00 | 44.06 | C |
| ATOM | 440 | O | GLU | A | 53 | 12.195 | 14.663 | 19.155 | 1.00 | 46.57 | O |
| ATOM | 441 | CB | GLU | A | 53 | 10.726 | 15.317 | 16.486 | 1.00 | 54.42 | C |
| ATOM | 442 | CG | GLU | A | 53 | 9.687 | 14.498 | 15.732 | 1.00 | 61.50 | C |
| ATOM | 443 | CD | GLU | A | 53 | 9.699 | 14.745 | 14.235 | 1.00 | 75.70 | C |
| ATOM | 444 | OE1 | GLU | A | 53 | 10.364 | 15.705 | 13.796 | 1.00 | 82.59 | O |
| ATOM | 445 | OE2 | GLU | A | 53 | 9.037 | 13.984 | 13.498 | 1.00 | 80.48 | O |
| ATOM | 446 | N | GLN | A | 54 | 11.956 | 16.905 | 19.223 | 1.00 | 39.29 | N |
| ATOM | 447 | CA | GLN | A | 54 | 13.125 | 17.130 | 20.066 | 1.00 | 44.00 | C |
| ATOM | 448 | C | GLN | A | 54 | 12.904 | 16.747 | 21.523 | 1.00 | 40.91 | C |
| ATOM | 449 | O | GLN | A | 54 | 13.882 | 16.656 | 22.269 | 1.00 | 38.39 | O |
| ATOM | 450 | CB | GLN | A | 54 | 13.565 | 18.601 | 19.991 | 1.00 | 49.00 | C |
| ATOM | 451 | CG | GLN | A | 54 | 12.630 | 19.586 | 20.709 | 1.00 | 57.17 | C |
| ATOM | 452 | CD | GLN | A | 54 | 13.060 | 21.046 | 20.543 | 1.00 | 66.05 | C |
| ATOM | 453 | OE1 | GLN | A | 54 | 12.622 | 21.737 | 19.618 | 1.00 | 65.07 | O |
| ATOM | 454 | NE2 | GLN | A | 54 | 13.916 | 21.519 | 21.447 | 1.00 | 64.86 | N |
| ATOM | 455 | N | GLU | A | 55 | 11.665 | 16.539 | 21.969 | 1.00 | 32.14 | N |
| ATOM | 456 | CA | GLU | A | 55 | 11.485 | 16.135 | 23.355 | 1.00 | 31.04 | C |
| ATOM | 457 | C | GLU | A | 55 | 12.150 | 14.780 | 23.596 | 1.00 | 31.18 | C |
| ATOM | 458 | O | GLU | A | 55 | 12.179 | 13.912 | 22.715 | 1.00 | 32.93 | O |
| ATOM | 459 | CB | GLU | A | 55 | 10.003 | 16.066 | 23.720 | 1.00 | 27.85 | C |
| ATOM | 460 | CG | GLU | A | 55 | 9.266 | 17.393 | 23.586 | 1.00 | 34.35 | C |
| ATOM | 461 | CD | GLU | A | 55 | 9.648 | 18.422 | 24.648 | 1.00 | 39.04 | C |
| ATOM | 462 | OE1 | GLU | A | 55 | 10.280 | 18.062 | 25.666 | 1.00 | 39.55 | O |
| ATOM | 463 | OE2 | GLU | A | 55 | 9.305 | 19.604 | 24.457 | 1.00 | 40.56 | O |
| ATOM | 464 | N | GLY | A | 56 | 12.668 | 14.602 | 24.814 | 1.00 | 28.76 | N |
| ATOM | 465 | CA | GLY | A | 56 | 13.414 | 13.419 | 25.166 | 1.00 | 31.57 | C |
| ATOM | 466 | C | GLY | A | 56 | 12.556 | 12.246 | 25.584 | 1.00 | 32.54 | C |
| ATOM | 467 | O | GLY | A | 56 | 11.314 | 12.289 | 25.588 | 1.00 | 33.29 | O |
| ATOM | 468 | N | PRO | A | 57 | 13.238 | 11.167 | 25.988 | 1.00 | 30.18 | N |
| ATOM | 469 | CA | PRO | A | 57 | 12.524 | 9.917 | 26.307 | 1.00 | 31.22 | C |
| ATOM | 470 | C | PRO | A | 57 | 11.528 | 10.033 | 27.444 | 1.00 | 29.30 | C |
| ATOM | 471 | O | PRO | A | 57 | 10.492 | 9.362 | 27.398 | 1.00 | 27.94 | O |
| ATOM | 472 | CB | PRO | A | 57 | 13.652 | 8.943 | 26.668 | 1.00 | 33.03 | C |
| ATOM | 473 | CG | PRO | A | 57 | 14.899 | 9.545 | 26.072 | 1.00 | 31.97 | C |
| ATOM | 474 | CD | PRO | A | 57 | 14.709 | 11.023 | 26.072 | 1.00 | 34.52 | C |
| ATOM | 475 | N | GLU | A | 58 | 11.806 | 10.840 | 28.473 | 1.00 | 27.37 | N |
| ATOM | 476 | CA | GLU | A | 58 | 10.847 | 10.933 | 29.570 | 1.00 | 28.48 | C |
| ATOM | 477 | C | GLU | A | 58 | 9.547 | 11.576 | 29.103 | 1.00 | 25.87 | C |
| ATOM | 478 | O | GLU | A | 58 | 8.467 | 11.190 | 29.559 | 1.00 | 28.19 | O |
| ATOM | 479 | CB | GLU | A | 58 | 11.433 | 11.720 | 30.740 | 1.00 | 30.09 | C |
| ATOM | 480 | CG | GLU | A | 58 | 12.588 | 11.008 | 31.437 | 1.00 | 40.14 | C |
| ATOM | 481 | CD | GLU | A | 58 | 13.153 | 11.800 | 32.604 | 0.00 | 38.15 | C |
| ATOM | 482 | OE1 | GLU | A | 58 | 12.516 | 12.787 | 33.030 | 1.00 | 35.92 | O |
| ATOM | 483 | OE2 | GLU | A | 58 | 14.242 | 11.435 | 33.093 | 0.00 | 38.42 | O |
| ATOM | 484 | N | TYR | A | 59 | 9.637 | 12.552 | 28.196 | 1.00 | 26.17 | N |
| ATOM | 485 | CA | TYR | A | 59 | 8.425 | 13.156 | 27.642 | 1.00 | 29.62 | C |
| ATOM | 486 | C | TYR | A | 59 | 7.558 | 12.110 | 26.944 | 1.00 | 26.96 | C |
| ATOM | 487 | O | TYR | A | 59 | 6.351 | 12.005 | 27.216 | 1.00 | 25.90 | O |
| ATOM | 488 | CB | TYR | A | 59 | 8.785 | 14.282 | 26.669 | 1.00 | 27.18 | C |
| ATOM | 489 | CG | TYR | A | 59 | 7.563 | 14.955 | 26.019 | 1.00 | 27.72 | C |
| ATOM | 490 | CD1 | TYR | A | 59 | 6.946 | 16.055 | 26.618 | 1.00 | 30.96 | C |
| ATOM | 491 | CD2 | TYR | A | 59 | 7.046 | 14.501 | 24.803 | 1.00 | 28.34 | C |
| ATOM | 492 | CE1 | TYR | A | 59 | 5.842 | 16.676 | 26.031 | 1.00 | 27.99 | C |
| ATOM | 493 | CE2 | TYR | A | 59 | 5.926 | 15.119 | 24.209 | 1.00 | 28.43 | C |
| ATOM | 494 | CZ | TYR | A | 59 | 5.347 | 16.212 | 24.830 | 1.00 | 28.30 | C |
| ATOM | 495 | OH | TYR | A | 59 | 4.251 | 16.823 | 24.252 | 1.00 | 27.74 | O |
| ATOM | 496 | N | TRP | A | 60 | 8.157 | 11.329 | 26.024 | 1.00 | 26.72 | N |
| ATOM | 497 | CA | TRP | A | 60 | 7.367 | 10.382 | 25.236 | 1.00 | 30.02 | C |
| ATOM | 498 | C | TRP | A | 60 | 6.840 | 9.248 | 26.101 | 1.00 | 31.84 | C |
| ATOM | 499 | O | TRP | A | 60 | 5.693 | 8.823 | 25.934 | 1.00 | 27.86 | O |
| ATOM | 500 | CB | TRP | A | 60 | 8.180 | 9.853 | 24.043 | 1.00 | 25.36 | C |
| ATOM | 501 | CG | TRP | A | 60 | 8.452 | 10.965 | 23.107 | 1.00 | 28.01 | C |
| ATOM | 502 | CD1 | TRP | A | 60 | 9.654 | 11.610 | 22.911 | 1.00 | 30.02 | C |
| ATOM | 503 | CD2 | TRP | A | 60 | 7.489 | 11.666 | 22.311 | 1.00 | 26.83 | C |
| ATOM | 504 | NE1 | TRP | A | 60 | 9.497 | 12.632 | 22.006 | 1.00 | 31.50 | N |
| ATOM | 505 | CE2 | TRP | A | 60 | 8.178 | 12.691 | 21.625 | 1.00 | 31.15 | C |
| ATOM | 506 | CE3 | TRP | A | 60 | 6.112 | 11.506 | 22.085 | 1.00 | 27.59 | C |
| ATOM | 507 | CZ2 | TRP | A | 60 | 7.534 | 13.561 | 20.737 | 1.00 | 31.09 | C |
| ATOM | 508 | CZ3 | TRP | A | 60 | 5.477 | 12.363 | 21.206 | 1.00 | 28.42 | C |
| ATOM | 509 | CH2 | TRP | A | 60 | 6.183 | 13.385 | 20.546 | 1.00 | 30.82 | C |
| ATOM | 510 | N | ASP | A | 61 | 7.636 | 8.780 | 27.062 | 1.00 | 26.48 | N |
| ATOM | 511 | CA | ASP | A | 61 | 7.135 | 7.771 | 27.993 | 1.00 | 27.88 | C |
| ATOM | 512 | C | ASP | A | 61 | 6.015 | 8.329 | 28.862 | 1.00 | 28.10 | C |

TABLE 17-continued

| | | | | | | | | | | |
|---|---|---|---|---|---|---|---|---|---|---|
| ATOM | 513 | O | ASP | A | 61 | 5.016 | 7.647 | 29.112 | 1.00 | 28.62 | O |
| ATOM | 514 | CB | ASP | A | 61 | 8.263 | 7.242 | 28.880 | 1.00 | 31.33 | C |
| ATOM | 515 | CG | ASP | A | 61 | 9.206 | 6.300 | 28.142 | 1.00 | 48.36 | C |
| ATOM | 516 | OD1 | ASP | A | 61 | 9.038 | 6.118 | 26.920 | 1.00 | 53.75 | O |
| ATOM | 517 | OD2 | ASP | A | 61 | 10.117 | 5.737 | 28.786 | 1.00 | 52.08 | O |
| ATOM | 518 | N | GLY | A | 62 | 6.164 | 9.566 | 29.338 | 1.00 | 25.99 | N |
| ATOM | 519 | CA | GLY | A | 62 | 5.145 | 10.142 | 30.207 | 1.00 | 25.97 | C |
| ATOM | 520 | C | GLY | A | 62 | 3.853 | 10.458 | 29.468 | 1.00 | 26.39 | C |
| ATOM | 521 | O | GLY | A | 62 | 2.755 | 10.164 | 29.958 | 1.00 | 27.67 | O |
| ATOM | 522 | N | GLU | A | 63 | 3.959 | 11.035 | 28.268 | 1.00 | 23.52 | N |
| ATOM | 523 | CA | GLU | A | 63 | 2.748 | 11.303 | 27.494 | 1.00 | 26.89 | C |
| ATOM | 524 | C | GLU | A | 63 | 2.024 | 10.010 | 27.145 | 1.00 | 26.10 | C |
| ATOM | 525 | O | GLU | A | 63 | 0.785 | 9.954 | 27.178 | 1.00 | 22.63 | O |
| ATOM | 526 | CB | GLU | A | 63 | 3.074 | 12.090 | 26.226 | 1.00 | 26.54 | C |
| ATOM | 527 | CG | GLU | A | 63 | 3.618 | 13.494 | 26.476 | 1.00 | 26.52 | C |
| ATOM | 528 | CD | GLU | A | 63 | 2.694 | 14.361 | 27.332 | 1.00 | 28.85 | C |
| ATOM | 529 | OE1 | GLU | A | 63 | 3.102 | 14.741 | 28.444 | 1.00 | 30.70 | O |
| ATOM | 530 | OE2 | GLU | A | 63 | 1.553 | 14.638 | 26.904 | 1.00 | 26.91 | O |
| ATOM | 531 | N | THR | A | 64 | 2.780 | 8.951 | 26.838 | 1.00 | 25.05 | N |
| ATOM | 532 | CA | THR | A | 64 | 2.164 | 7.652 | 26.563 | 1.00 | 26.10 | C |
| ATOM | 533 | C | THR | A | 64 | 1.443 | 7.105 | 27.791 | 1.00 | 26.16 | C |
| ATOM | 534 | O | THR | A | 64 | 0.296 | 6.646 | 27.696 | 1.00 | 24.44 | O |
| ATOM | 535 | CB | THR | A | 64 | 3.228 | 6.666 | 26.078 | 1.00 | 25.19 | C |
| ATOM | 536 | OG1 | THR | A | 64 | 3.766 | 7.149 | 24.839 | 1.00 | 26.23 | O |
| ATOM | 537 | CG2 | THR | A | 64 | 2.610 | 5.271 | 25.868 | 1.00 | 26.79 | C |
| ATOM | 538 | N | ARG | A | 65 | 2.109 | 7.133 | 28.950 | 1.00 | 24.77 | N |
| ATOM | 539 | CA | ARG | A | 65 | 1.483 | 6.648 | 30.181 | 1.00 | 25.47 | C |
| ATOM | 540 | C | ARG | A | 65 | 0.214 | 7.427 | 30.505 | 1.00 | 26.13 | C |
| ATOM | 541 | O | ARG | A | 65 | −0.811 | 6.836 | 30.868 | 1.00 | 24.45 | O |
| ATOM | 542 | CB | ARG | A | 65 | 2.467 | 6.742 | 31.346 | 1.00 | 31.32 | C |
| ATOM | 543 | CG | ARG | A | 65 | 1.837 | 6.622 | 32.731 | 1.00 | 36.86 | C |
| ATOM | 544 | CD | ARG | A | 65 | 2.831 | 7.007 | 33.873 | 1.00 | 45.12 | C |
| ATOM | 545 | NE | ARG | A | 65 | 3.458 | 8.323 | 33.700 | 1.00 | 41.72 | N |
| ATOM | 546 | CZ | ARG | A | 65 | 2.917 | 9.484 | 34.069 | 1.00 | 45.22 | C |
| ATOM | 547 | NH1 | ARG | A | 65 | 1.715 | 9.523 | 34.636 | 1.00 | 43.48 | N |
| ATOM | 548 | NH2 | ARG | A | 65 | 3.577 | 10.616 | 33.857 | 1.00 | 49.31 | N |
| ATOM | 549 | N | LYS | A | 66 | 0.263 | 8.757 | 30.375 | 1.00 | 20.56 | N |
| ATOM | 550 | CA | LYS | A | 66 | −0.886 | 9.585 | 30.745 | 1.00 | 22.79 | C |
| ATOM | 551 | C | LYS | A | 66 | −2.067 | 9.383 | 29.792 | 1.00 | 20.71 | C |
| ATOM | 552 | O | LYS | A | 66 | −3.228 | 9.291 | 30.241 | 1.00 | 23.73 | O |
| ATOM | 553 | CB | LYS | A | 66 | −0.469 | 11.058 | 30.782 | 1.00 | 23.20 | C |
| ATOM | 554 | CG | LYS | A | 66 | 0.541 | 11.440 | 31.865 | 1.00 | 28.34 | C |
| ATOM | 555 | CD | LYS | A | 66 | 0.809 | 12.967 | 31.893 | 1.00 | 33.78 | C |
| ATOM | 556 | CE | LYS | A | 66 | 1.800 | 13.465 | 30.826 | 1.00 | 32.32 | C |
| ATOM | 557 | NZ | LYS | A | 66 | 1.942 | 15.016 | 30.775 | 1.00 | 26.95 | N |
| ATOM | 558 | N | VAL | A | 67 | −1.820 | 9.300 | 28.478 | 1.00 | 17.98 | N |
| ATOM | 559 | C | VAL | A | 67 | −3.556 | 7.730 | 27.718 | 1.00 | 26.70 | C |
| ATOM | 560 | O | VAL | A | 67 | −4.771 | 7.547 | 27.522 | 1.00 | 24.18 | O |
| ATOM | 561 | CA | AVAL | A | 67 | −2.936 | 9.112 | 27.542 | 0.57 | 21.72 | C |
| ATOM | 562 | CB | AVAL | A | 67 | −2.480 | 9.358 | 26.085 | 0.57 | 24.00 | C |
| ATOM | 563 | CG1 | AVAL | A | 67 | −1.820 | 8.136 | 25.464 | 0.57 | 23.28 | C |
| ATOM | 564 | CG2 | AVAL | A | 67 | −3.647 | 9.789 | 25.232 | 0.57 | 26.31 | C |
| ATOM | 565 | CA | BVAL | A | 67 | −2.965 | 9.119 | 27.582 | 0.43 | 22.14 | C |
| ATOM | 566 | CB | BVAL | A | 67 | −2.601 | 9.421 | 26.121 | 0.43 | 24.14 | C |
| ATOM | 567 | CG1 | BVAL | A | 67 | −2.169 | 10.829 | 26.036 | 0.43 | 26.30 | C |
| ATOM | 568 | CG2 | BVAL | A | 67 | −1.526 | 8.485 | 25.597 | 0.43 | 25.47 | C |
| ATOM | 569 | N | LYS | A | 68 | −2.742 | 6.734 | 28.065 | 1.00 | 24.92 | N |
| ATOM | 570 | CA | LYS | A | 68 | −3.306 | 5.413 | 28.323 | 1.00 | 25.56 | C |
| ATOM | 571 | C | LYS | A | 68 | −4.167 | 5.411 | 29.580 | 1.00 | 23.74 | C |
| ATOM | 572 | O | LYS | A | 68 | −5.171 | 4.699 | 29.631 | 1.00 | 25.60 | O |
| ATOM | 573 | CB | LYS | A | 68 | −2.196 | 4.379 | 28.429 | 1.00 | 25.59 | C |
| ATOM | 574 | CG | LYS | A | 68 | −1.651 | 3.963 | 27.076 | 1.00 | 26.68 | C |
| ATOM | 575 | CD | LYS | A | 68 | −0.554 | 2.911 | 27.255 | 1.00 | 33.31 | C |
| ATOM | 576 | CE | LYS | A | 68 | 0.106 | 2.563 | 25.946 | 1.00 | 36.60 | C |
| ATOM | 577 | NZ | LYS | A | 68 | 1.200 | 1.573 | 26.181 | 1.00 | 47.80 | N |
| ATOM | 578 | N | ALA | A | 69 | −3.810 | 6.214 | 30.592 | 1.00 | 20.64 | N |
| ATOM | 579 | CA | ALA | A | 69 | −4.687 | 6.361 | 31.742 | 1.00 | 23.05 | C |
| ATOM | 580 | C | ALA | A | 69 | −6.003 | 7.011 | 31.334 | 1.00 | 23.52 | C |
| ATOM | 581 | O | ALA | A | 69 | −7.073 | 6.570 | 31.769 | 1.00 | 23.60 | O |
| ATOM | 582 | CB | ALA | A | 69 | −4.001 | 7.160 | 32.845 | 1.00 | 21.92 | C |
| ATOM | 583 | N | HIS | A | 70 | −5.945 | 8.065 | 30.502 | 1.00 | 24.05 | N |
| ATOM | 584 | CA | HIS | A | 70 | −7.187 | 8.666 | 29.996 | 1.00 | 21.25 | C |
| ATOM | 585 | C | HIS | A | 70 | −8.040 | 7.618 | 29.282 | 1.00 | 23.36 | C |
| ATOM | 586 | O | HIS | A | 70 | −9.271 | 7.592 | 29.433 | 1.00 | 20.81 | O |
| ATOM | 587 | CB | HIS | A | 70 | −6.896 | 9.807 | 29.005 | 1.00 | 21.12 | C |
| ATOM | 588 | CG | HIS | A | 70 | −6.435 | 11.105 | 29.613 | 1.00 | 25.03 | C |
| ATOM | 589 | ND1 | HIS | A | 70 | −5.876 | 11.212 | 30.870 | 1.00 | 30.39 | N |
| ATOM | 590 | CD2 | HIS | A | 70 | −6.452 | 12.366 | 29.104 | 1.00 | 25.43 | C |
| ATOM | 591 | CE1 | HIS | A | 70 | −5.564 | 12.475 | 31.106 | 1.00 | 35.04 | C |
| ATOM | 592 | NE2 | HIS | A | 70 | −5.902 | 13.196 | 30.051 | 1.00 | 26.79 | N |

TABLE 17-continued

| | | | | | | | | | | |
|---|---|---|---|---|---|---|---|---|---|---|
| ATOM | 593 | N | SER | A | 71 | −7.416 | 6.781 | 28.452 | 1.00 | 20.01 N |
| ATOM | 594 | C | SER | A | 71 | −8.908 | 4.833 | 28.603 | 1.00 | 21.65 C |
| ATOM | 595 | O | SER | A | 71 | −10.056 | 4.448 | 28.340 | 1.00 | 23.78 O |
| ATOM | 596 | CA | ASER | A | 71 | −8.171 | 5.796 | 27.684 | 0.51 | 21.39 C |
| ATOM | 597 | CB | ASER | A | 71 | −7.231 | 5.035 | 26.753 | 0.51 | 24.40 C |
| ATOM | 598 | OG | ASER | A | 71 | −7.896 | 3.958 | 26.128 | 0.51 | 20.34 O |
| ATOM | 599 | CA | BSER | A | 71 | −8.204 | 5.824 | 27.684 | 0.49 | 21.58 C |
| ATOM | 600 | CB | BSER | A | 71 | −7.336 | 5.100 | 26.648 | 0.49 | 24.32 C |
| ATOM | 601 | OG | BSER | A | 71 | −6.444 | 4.167 | 27.225 | 0.49 | 22.09 O |
| ATOM | 602 | N | GLN | A | 72 | −8.256 | 4.413 | 29.686 | 1.00 | 20.90 N |
| ATOM | 603 | CA | GLN | A | 72 | −8.904 | 3.464 | 30.597 | 1.00 | 24.67 C |
| ATOM | 604 | C | GLN | A | 72 | −10.086 | 4.103 | 31.309 | 1.00 | 24.07 C |
| ATOM | 605 | O | GLN | A | 72 | −11.109 | 3.445 | 31.559 | 1.00 | 22.96 O |
| ATOM | 606 | CB | GLN | A | 72 | −7.899 | 2.959 | 31.628 | 1.00 | 24.16 C |
| ATOM | 607 | CG | GLN | A | 72 | −6.856 | 2.044 | 31.044 | 1.00 | 21.65 C |
| ATOM | 608 | CD | GLN | A | 72 | −5.719 | 1.838 | 32.034 | 1.00 | 31.96 C |
| ATOM | 609 | OE1 | GLN | A | 72 | −5.848 | 1.059 | 32.981 | 1.00 | 27.01 O |
| ATOM | 610 | NE2 | GLN | A | 72 | −4.626 | 2.586 | 31.857 | 1.00 | 25.21 N |
| ATOM | 611 | N | THR | A | 73 | −9.947 | 5.375 | 31.684 | 1.00 | 21.15 N |
| ATOM | 612 | CA | THR | A | 73 | −11.076 | 6.054 | 32.301 | 1.00 | 20.00 C |
| ATOM | 613 | C | THR | A | 73 | −12.238 | 6.153 | 31.320 | 1.00 | 23.35 C |
| ATOM | 614 | O | THR | A | 73 | −13.390 | 5.895 | 31.694 | 1.00 | 23.92 O |
| ATOM | 615 | CB | THR | A | 73 | −10.642 | 7.426 | 32.808 | 1.00 | 22.28 C |
| ATOM | 616 | OG1 | THR | A | 73 | −9.661 | 7.232 | 33.823 | 1.00 | 23.21 O |
| ATOM | 617 | CG2 | THR | A | 73 | −11.870 | 8.201 | 33.381 | 1.00 | 20.12 C |
| ATOM | 618 | N | HIS | A | 74 | −11.955 | 6.482 | 30.048 | 1.00 | 24.71 N |
| ATOM | 619 | CA | HIS | A | 74 | −13.031 | 6.530 | 29.057 | 1.00 | 23.20 C |
| ATOM | 620 | C | HIS | A | 74 | −13.682 | 5.170 | 28.886 | 1.00 | 23.24 C |
| ATOM | 621 | O | HIS | A | 74 | −14.891 | 5.080 | 28.643 | 1.00 | 24.85 O |
| ATOM | 622 | CB | HIS | A | 74 | −12.524 | 7.011 | 27.699 | 1.00 | 25.47 C |
| ATOM | 623 | CG | HIS | A | 74 | −12.226 | 8.469 | 27.659 | 1.00 | 38.47 C |
| ATOM | 624 | ND1 | HIS | A | 74 | −12.063 | 9.160 | 26.479 | 1.00 | 48.71 N |
| ATOM | 625 | CD2 | HIS | A | 74 | −12.059 | 9.370 | 28.654 | 1.00 | 46.60 C |
| ATOM | 626 | CE1 | HIS | A | 74 | −11.803 | 10.426 | 26.751 | 1.00 | 48.37 C |
| ATOM | 627 | NE2 | HIS | A | 74 | −11.795 | 10.580 | 28.062 | 1.00 | 49.07 N |
| ATOM | 628 | N | ARG | A | 75 | −12.895 | 4.101 | 28.987 | 1.00 | 24.08 N |
| ATOM | 629 | CA | ARG | A | 75 | −13.472 | 2.769 | 28.868 | 1.00 | 24.25 C |
| ATOM | 630 | C | ARG | A | 75 | −14.451 | 2.501 | 30.004 | 1.00 | 22.48 C |
| ATOM | 631 | O | ARG | A | 75 | −15.533 | 1.946 | 29.781 | 1.00 | 25.46 O |
| ATOM | 632 | CB | ARG | A | 75 | −12.353 | 1.727 | 28.843 | 1.00 | 21.84 C |
| ATOM | 633 | CG | ARG | A | 75 | −12.793 | 0.345 | 28.389 | 1.00 | 26.07 C |
| ATOM | 634 | CD | ARG | A | 75 | −11.542 | −0.543 | 28.190 | 1.00 | 24.73 C |
| ATOM | 635 | NE | ARG | A | 75 | −11.876 | −1.865 | 27.661 | 1.00 | 24.51 N |
| ATOM | 636 | CZ | ARG | A | 75 | −10.961 | −2.801 | 27.399 | 1.00 | 29.76 C |
| ATOM | 637 | NH1 | ARG | A | 75 | −9.680 | −2.563 | 27.611 | 1.00 | 26.16 N |
| ATOM | 638 | NH2 | ARG | A | 75 | −11.314 | −3.976 | 26.911 | 1.00 | 26.80 N |
| ATOM | 639 | N | VAL | A | 76 | −14.091 | 2.890 | 31.229 | 1.00 | 23.52 N |
| ATOM | 640 | CA | VAL | A | 76 | −15.029 | 2.809 | 32.343 | 1.00 | 20.96 C |
| ATOM | 641 | C | VAL | A | 76 | −16.231 | 3.712 | 32.092 | 1.00 | 24.78 C |
| ATOM | 642 | O | VAL | A | 76 | −17.371 | 3.335 | 32.379 | 1.00 | 25.90 O |
| ATOM | 643 | CB | VAL | A | 76 | −14.309 | 3.146 | 33.666 | 1.00 | 22.37 C |
| ATOM | 644 | CG1 | VAL | A | 76 | −15.290 | 3.446 | 34.810 | 1.00 | 24.96 C |
| ATOM | 645 | CG2 | VAL | A | 76 | −13.365 | 2.011 | 34.066 | 1.00 | 24.34 C |
| ATOM | 646 | N | ASP | A | 77 | −15.999 | 4.926 | 31.569 | 1.00 | 22.52 N |
| ATOM | 647 | CA | ASP | A | 77 | −17.117 | 5.847 | 31.331 | 1.00 | 23.69 C |
| ATOM | 648 | C | ASP | A | 77 | −18.144 | 5.257 | 30.378 | 1.00 | 24.70 C |
| ATOM | 649 | O | ASP | A | 77 | −19.352 | 5.431 | 30.572 | 1.00 | 24.76 O |
| ATOM | 650 | CB | ASP | A | 77 | −16.628 | 7.175 | 30.758 | 1.00 | 22.30 C |
| ATOM | 651 | CG | ASP | A | 77 | −15.772 | 7.973 | 31.744 | 1.00 | 29.61 C |
| ATOM | 652 | OD1 | ASP | A | 77 | −15.808 | 7.684 | 32.965 | 1.00 | 29.04 O |
| ATOM | 653 | OD2 | ASP | A | 77 | −15.049 | 8.878 | 31.274 | 1.00 | 28.14 O |
| ATOM | 654 | N | LEU | A | 78 | −17.686 | 4.594 | 29.310 | 1.00 | 24.56 N |
| ATOM | 655 | CA | LEU | A | 78 | −18.624 | 3.997 | 28.358 | 1.00 | 25.26 C |
| ATOM | 656 | C | LEU | A | 78 | −19.560 | 3.004 | 29.046 | 1.00 | 24.06 C |
| ATOM | 657 | O | LEU | A | 78 | −20.781 | 3.016 | 28.826 | 1.00 | 26.51 O |
| ATOM | 658 | CB | LEU | A | 78 | −17.841 | 3.325 | 27.221 | 1.00 | 28.96 C |
| ATOM | 659 | CG | LEU | A | 78 | −17.281 | 4.297 | 26.172 | 1.00 | 27.75 C |
| ATOM | 660 | CD1 | LEU | A | 78 | −16.190 | 3.635 | 25.355 | 1.00 | 29.94 C |
| ATOM | 661 | CD2 | LEU | A | 78 | −18.400 | 4.860 | 25.252 | 1.00 | 26.57 C |
| ATOM | 662 | N | GLY | A | 79 | −19.019 | 2.169 | 29.927 | 1.00 | 26.92 N |
| ATOM | 663 | CA | GLY | A | 79 | −19.864 | 1.231 | 30.636 | 1.00 | 32.13 C |
| ATOM | 664 | C | GLY | A | 79 | −20.720 | 1.906 | 31.689 | 1.00 | 26.36 C |
| ATOM | 665 | O | GLY | A | 79 | −21.864 | 1.501 | 31.920 | 1.00 | 29.04 O |
| ATOM | 666 | N | THR | A | 80 | −20.170 | 2.917 | 32.363 | 1.00 | 27.16 N |
| ATOM | 667 | CA | THR | A | 80 | −20.928 | 3.616 | 33.397 | 1.00 | 24.92 C |
| ATOM | 668 | C | THR | A | 80 | −22.091 | 4.395 | 32.786 | 1.00 | 25.13 C |
| ATOM | 669 | O | THR | A | 80 | −23.209 | 4.367 | 33.318 | 1.00 | 29.96 O |
| ATOM | 670 | CB | THR | A | 80 | −20.001 | 4.552 | 34.181 | 1.00 | 23.70 C |
| ATOM | 671 | OG1 | THR | A | 80 | −18.878 | 3.810 | 34.682 | 1.00 | 25.58 O |
| ATOM | 672 | CG2 | THR | A | 80 | −20.731 | 5.228 | 35.340 | 1.00 | 29.94 C |

TABLE 17-continued

| | | | | | | | | | | | |
|---|---|---|---|---|---|---|---|---|---|---|---|
| ATOM | 673 | N | LEU | A | 81 | −21.855 | 5.067 | 31.654 | 1.00 | 26.02 | N |
| ATOM | 674 | CA | LEU | A | 81 | −22.930 | 5.834 | 31.015 | 1.00 | 30.64 | C |
| ATOM | 675 | C | LEU | A | 81 | −24.012 | 4.914 | 30.463 | 1.00 | 27.82 | C |
| ATOM | 676 | O | LEU | A | 81 | −25.207 | 5.236 | 30.541 | 1.00 | 28.18 | O |
| ATOM | 677 | CB | LEU | A | 81 | −22.370 | 6.721 | 29.903 | 1.00 | 24.26 | C |
| ATOM | 678 | CG | LEU | A | 81 | −21.536 | 7.906 | 30.403 | 1.00 | 26.47 | C |
| ATOM | 679 | CD1 | LEU | A | 81 | −20.539 | 8.412 | 29.371 | 1.00 | 27.84 | C |
| ATOM | 680 | CD2 | LEU | A | 31 | −22.452 | 9.037 | 30.836 | 1.00 | 28.33 | C |
| ATOM | 681 | N | ARG | A | 82 | −23.609 | 3.776 | 29.886 | 1.00 | 25.98 | N |
| ATOM | 682 | CA | ARG | A | 82 | −24.577 | 2.776 | 29.459 | 1.00 | 29.21 | C |
| ATOM | 683 | C | ARG | A | 82 | −25.502 | 2.395 | 30.606 | 1.00 | 33.48 | C |
| ATOM | 684 | O | ARG | A | 82 | −26.713 | 2.263 | 30.416 | 1.00 | 32.01 | O |
| ATOM | 685 | CB | ARG | A | 82 | −23.850 | 1.543 | 28.916 | 1.00 | 34.10 | C |
| ATOM | 686 | CG | ARG | A | 82 | −24.630 | 0.748 | 27.884 | 1.00 | 54.98 | C |
| ATOM | 687 | CD | ARG | A | 82 | −24.435 | −0.754 | 28.061 | 1.00 | 57.32 | C |
| ATOM | 688 | NE | ARG | A | 82 | −23.044 | −1.113 | 28.309 | 1.00 | 61.65 | N |
| ATOM | 689 | CZ | ARG | A | 82 | −22.671 | −2.180 | 29.011 | 1.00 | 69.81 | C |
| ATOM | 690 | NH1 | ARG | A | 82 | −23.594 | −2.978 | 29.533 | 1.00 | 64.03 | N |
| ATOM | 691 | NH2 | ARG | A | 82 | −21.380 | −2.444 | 29.203 | 1.00 | 72.32 | N |
| ATOM | 692 | N | GLY | A | 83 | −24.958 | 2.246 | 31.815 | 1.00 | 29.15 | N |
| ATOM | 693 | CA | GLY | A | 83 | −25.814 | 1.952 | 32.960 | 1.00 | 29.21 | C |
| ATOM | 694 | C | GLY | A | 83 | −26.691 | 3.122 | 33.374 | 1.00 | 30.64 | C |
| ATOM | 695 | O | GLY | A | 83 | −27.881 | 2.938 | 33.657 | 1.00 | 34.44 | O |
| ATOM | 696 | N | TYR | A | 84 | −26.124 | 4.338 | 33.431 | 1.00 | 28.65 | N |
| ATOM | 697 | CA | TYR | A | 84 | −26.916 | 5.519 | 33.790 | 1.00 | 29.22 | C |
| ATOM | 698 | C | TYR | A | 84 | −28.157 | 5.647 | 32.912 | 1.00 | 33.28 | C |
| ATOM | 699 | O | TYR | A | 84 | −29.253 | 5.970 | 33.397 | 1.00 | 32.43 | O |
| ATOM | 700 | CB | TYR | A | 84 | −26.072 | 6.795 | 33.663 | 1.00 | 25.94 | C |
| ATOM | 701 | CG | TYR | A | 84 | −25.001 | 7.048 | 34.726 | 1.00 | 29.71 | C |
| ATOM | 702 | CD1 | TYR | A | 84 | −24.912 | 6.265 | 35.874 | 1.00 | 33.13 | C |
| ATOM | 703 | CD2 | TYR | A | 84 | −24.103 | 8.106 | 34.584 | 1.00 | 27.84 | C |
| ATOM | 704 | CE1 | TYR | A | 84 | −23.933 | 6.515 | 36.849 | 1.00 | 30.14 | C |
| ATOM | 705 | CE2 | TYR | A | 84 | −23.110 | 8.357 | 35.551 | 1.00 | 27.36 | C |
| ATOM | 706 | CZ | TYR | A | 84 | −23.045 | 7.567 | 36.679 | 1.00 | 33.89 | C |
| ATOM | 707 | OH | TYR | A | 84 | −22.077 | 7.832 | 37.625 | 1.00 | 28.88 | O |
| ATOM | 708 | N | TYR | A | 85 | −28.012 | 5.377 | 31.618 | 1.00 | 34.33 | N |
| ATOM | 709 | CA | TYR | A | 85 | −29.079 | 5.578 | 30.652 | 1.00 | 33.48 | C |
| ATOM | 710 | C | TYR | A | 85 | −29.829 | 4.291 | 30.311 | 1.00 | 37.31 | C |
| ATOM | 711 | O | TYR | A | 85 | −30.693 | 4.307 | 29.427 | 1.00 | 35.73 | O |
| ATOM | 712 | CB | TYR | A | 85 | −28.506 | 6.217 | 29.392 | 1.00 | 32.55 | C |
| ATOM | 713 | CG | TYR | A | 85 | −28.034 | 7.637 | 29.571 | 1.00 | 32.65 | C |
| ATOM | 714 | CD1 | TYR | A | 85 | −28.940 | 8.658 | 29.855 | 1.00 | 37.64 | C |
| ATOM | 715 | CD2 | TYR | A | 85 | −26.687 | 7.966 | 29.454 | 1.00 | 28.73 | C |
| ATOM | 716 | CE1 | TYR | A | 85 | −28.524 | 9.965 | 30.015 | 1.00 | 38.04 | C |
| ATOM | 717 | CE2 | TYR | A | 85 | −26.260 | 9.279 | 29.611 | 1.00 | 26.83 | C |
| ATOM | 718 | CZ | TYR | A | 85 | −27.178 | 10.274 | 29.889 | 1.00 | 35.95 | C |
| ATOM | 719 | OH | TYR | A | 85 | −26.761 | 11.575 | 30.037 | 1.00 | 31.39 | O |
| ATOM | 720 | N | ASN | A | 86 | −29.550 | 3.195 | 31.014 | 1.00 | 33.68 | N |
| ATOM | 721 | CA | ASN | A | 86 | −30.238 | 1.911 | 30.814 | 1.00 | 34.76 | C |
| ATOM | 722 | C | ASN | A | 86 | −30.241 | 1.502 | 29.343 | 1.00 | 37.66 | C |
| ATOM | 723 | O | ASN | A | 86 | −31.255 | 1.057 | 28.783 | 1.00 | 37.66 | O |
| ATOM | 724 | CB | ASN | A | 86 | −31.657 | 1.954 | 31.389 | 1.00 | 40.24 | C |
| ATOM | 725 | CG | ASN | A | 86 | −31.657 | 1.971 | 32.907 | 1.00 | 54.82 | C |
| ATOM | 726 | OD1 | ASN | A | 86 | −31.891 | 3.006 | 33.530 | 1.00 | 61.25 | O |
| ATOM | 727 | ND2 | ASN | A | 86 | −31.367 | 0.823 | 33.510 | 1.00 | 65.04 | N |
| ATOM | 728 | N | GLN | A | 87 | −29.074 | 1.645 | 28.718 | 1.00 | 33.34 | N |
| ATOM | 729 | CA | GLN | A | 87 | −28.916 | 1.334 | 27.311 | 1.00 | 34.99 | C |
| ATOM | 730 | C | GLN | A | 87 | −28.401 | −0.087 | 27.140 | 1.00 | 43.53 | C |
| ATOM | 731 | O | GLN | A | 87 | −27.732 | −0.647 | 28.014 | 1.00 | 39.11 | O |
| ATOM | 732 | CB | GLN | A | 87 | −27.982 | 2.330 | 26.634 | 1.00 | 30.19 | C |
| ATOM | 733 | CG | GLN | A | 87 | −28.563 | 3.733 | 26.554 | 1.00 | 32.77 | C |
| ATOM | 734 | CD | GLN | A | 87 | −27.533 | 4.768 | 26.167 | 1.00 | 28.47 | C |
| ATOM | 735 | OE1 | GLN | A | 87 | −26.363 | 4.644 | 26.507 | 1.00 | 30.28 | O |
| ATOM | 736 | NE2 | GLN | A | 87 | −27.963 | 5.785 | 25.434 | 1.00 | 36.55 | N |
| ATOM | 737 | N | SER | A | 88 | −28.742 | −0.671 | 26.001 | 1.00 | 45.34 | N |
| ATOM | 738 | CA | SER | A | 88 | −28.393 | −2.053 | 25.730 | 1.00 | 43.58 | C |
| ATOM | 739 | C | SER | A | 88 | −26.897 | −2.211 | 25.465 | 1.00 | 44.63 | C |
| ATOM | 740 | O | SER | A | 88 | −26.191 | −1.267 | 25.093 | 1.00 | 39.43 | O |
| ATOM | 741 | CB | SER | A | 88 | −29.198 | −2.554 | 24.534 | 1.00 | 38.83 | C |
| ATOM | 742 | OG | SER | A | 88 | −28.460 | −3.502 | 23.795 | 1.00 | 53.10 | O |
| ATOM | 743 | N | GLU | A | 89 | −26.417 | −3.443 | 25.653 | 1.00 | 47.41 | N |
| ATOM | 744 | CA | GLU | A | 89 | −25.050 | −3.799 | 25.295 | 1.00 | 48.14 | C |
| ATOM | 745 | C | GLU | A | 89 | −24.833 | −3.883 | 23.788 | 1.00 | 42.78 | C |
| ATOM | 746 | O | GLU | A | 89 | −23.679 | −3.957 | 23.354 | 1.00 | 46.28 | O |
| ATOM | 747 | CB | GLU | A | 89 | −24.666 | −5.137 | 25.943 | 1.00 | 48.31 | C |
| ATOM | 748 | CG | GLU | A | 89 | −24.731 | −5.122 | 27.465 | 1.00 | 55.28 | C |
| ATOM | 749 | CD | GLU | A | 89 | −23.745 | −6.082 | 28.115 | 0.00 | 62.11 | C |
| ATOM | 750 | OE1 | GLU | A | 89 | −24.000 | −7.306 | 28.113 | 1.00 | 68.23 | O |
| ATOM | 751 | OE2 | GLU | A | 89 | −22.709 | −5.607 | 28.626 | 0.54 | 64.47 | O |
| ATOM | 752 | N | ALA | A | 90 | −25.894 | −3.821 | 22.984 | 1.00 | 39.64 | N |

TABLE 17-continued

| | | | | | | | | | | |
|---|---|---|---|---|---|---|---|---|---|---|
| ATOM | 753 | CA | ALA | A | 90 | −25.775 | −4.116 | 21.557 | 1.00 | 44.69 | C |
| ATOM | 754 | C | ALA | A | 90 | −25.255 | −2.939 | 20.735 | 1.00 | 44.59 | C |
| ATOM | 755 | O | ALA | A | 90 | −24.656 | −3.158 | 19.674 | 1.00 | 48.61 | O |
| ATOM | 756 | CB | ALA | A | 90 | −27.124 | −4.573 | 20.999 | 1.00 | 46.62 | C |
| ATOM | 757 | Z | GLY | A | 91 | −25.467 | −1.701 | 21.180 | 1.00 | 41.54 | N |
| ATOM | 758 | CA | GLY | A | 91 | −25.123 | −0.551 | 20.366 | 1.00 | 38.83 | C |
| ATOM | 759 | C | GLY | A | 91 | −23.729 | −0.015 | 20.644 | 1.00 | 37.13 | C |
| ATOM | 760 | O | GLY | A | 91 | −23.191 | −0.195 | 21.727 | 1.00 | 35.28 | O |
| ATOM | 761 | N | SER | A | 92 | −23.145 | 0.644 | 19.645 | 1.00 | 28.68 | N |
| ATOM | 762 | CA | SER | A | 92 | −21.896 | 1.371 | 19.845 | 1.00 | 28.09 | C |
| ATOM | 763 | C | SER | A | 92 | −22.187 | 2.789 | 20.328 | 1.00 | 26.91 | C |
| ATOM | 764 | O | SER | A | 92 | −23.143 | 3.429 | 19.873 | 1.00 | 34.52 | O |
| ATOM | 765 | CB | SER | A | 92 | −21.086 | 1.413 | 18.544 | 1.00 | 29.52 | C |
| ATOM | 766 | OG | SER | A | 92 | −19.985 | 2.290 | 18.649 | 1.00 | 31.97 | O |
| ATOM | 767 | N | HIS | A | 93 | −21.366 | 3.273 | 21.263 | 1.00 | 25.85 | N |
| ATOM | 768 | CA | HIS | A | 93 | −21.526 | 4.606 | 21.827 | 1.00 | 29.58 | C |
| ATOM | 769 | C | HIS | A | 93 | −20.183 | 5.314 | 21.816 | 1.00 | 29.10 | C |
| ATOM | 770 | O | HIS | A | 93 | −19.124 | 4.693 | 21.666 | 1.00 | 28.27 | O |
| ATOM | 771 | CB | HIS | A | 93 | −22.103 | 4.540 | 23.244 | 1.00 | 23.92 | C |
| ATOM | 772 | CG | HIS | A | 93 | −23.467 | 3.930 | 23.284 | 1.00 | 25.09 | C |
| ATOM | 773 | ND1 | HIS | A | 93 | −24.619 | 4.666 | 23.086 | 1.00 | 32.62 | N |
| ATOM | 774 | CD2 | HIS | A | 93 | −23.862 | 2.643 | 23.429 | 1.00 | 29.28 | C |
| ATOM | 775 | CE1 | HIS | A | 93 | −25.667 | 3.863 | 23.146 | 1.00 | 36.93 | C |
| ATOM | 776 | NE2 | HIS | A | 93 | −25.237 | 2.630 | 23.348 | 1.00 | 35.34 | N |
| ATOM | 777 | N | THR | A | 94 | −20.230 | 6.634 | 22.007 | 1.00 | 27.72 | N |
| ATOM | 778 | CA | THR | A | 94 | −19.041 | 7.460 | 21.900 | 1.00 | 28.52 | C |
| ATOM | 779 | C | THR | A | 94 | −18.905 | 8.375 | 23.108 | 1.00 | 24.65 | C |
| ATOM | 780 | O | THR | A | 94 | −19.884 | 8.992 | 23.543 | 1.00 | 29.08 | O |
| ATOM | 781 | CB | THR | A | 94 | −19.099 | 8.331 | 20.624 | 1.00 | 28.74 | C |
| ATOM | 782 | OG1 | THR | A | 94 | −19.326 | 7.499 | 19.484 | 1.00 | 34.73 | O |
| ATOM | 783 | CG2 | THR | A | 94 | −17.781 | 9.104 | 20.437 | 1.00 | 27.80 | C |
| ATOM | 784 | N | VAL | A | 95 | −17.685 | 8.486 | 23.641 | 1.00 | 20.65 | N |
| ATOM | 785 | C | VAL | A | 95 | −16.300 | 10.421 | 24.016 | 1.00 | 25.57 | C |
| ATOM | 786 | O | VAL | A | 95 | −15.342 | 9.952 | 23.398 | 1.00 | 27.52 | O |
| ATOM | 787 | CA | AVAL | A | 95 | −17.376 | 9.524 | 24.612 | 0.36 | 25.76 | C |
| ATOM | 788 | CB | AVAL | A | 95 | −16.946 | 8.956 | 25.983 | 0.36 | 27.85 | C |
| ATOM | 789 | CG1 | AVAL | A | 95 | −18.121 | 8.279 | 26.664 | 0.36 | 30.33 | C |
| ATOM | 790 | CG2 | AVAL | A | 95 | −15.803 | 7.980 | 25.842 | 0.36 | 25.25 | C |
| ATOM | 791 | CA | BVAL | A | 95 | −17.336 | 9.492 | 24.637 | 0.64 | 24.97 | C |
| ATOM | 792 | CB | BVAL | A | 95 | −16.788 | 8.841 | 25.925 | 0.64 | 28.16 | C |
| ATOM | 793 | CG1 | BVAL | A | 95 | −15.953 | 9.833 | 26.737 | 0.64 | 24.84 | C |
| ATOM | 794 | CG2 | BVAL | A | 95 | −17.922 | 8.269 | 26.757 | 0.64 | 30.09 | C |
| ATOM | 795 | N | GLN | A | 96 | −16.488 | 11.732 | 24.163 | 1.00 | 24.28 | N |
| ATOM | 796 | CA | GLN | A | 96 | −15.491 | 12.693 | 23.716 | 1.00 | 23.51 | C |
| ATOM | 797 | C | GLN | A | 96 | −15.158 | 13.622 | 24.868 | 1.00 | 28.05 | C |
| ATOM | 798 | O | GLN | A | 96 | −16.018 | 13.950 | 25.692 | 1.00 | 24.68 | O |
| ATOM | 799 | CB | GLN | A | 96 | −15.970 | 13.537 | 22.532 | 1.00 | 23.96 | C |
| ATOM | 800 | CG | GLN | A | 96 | −16.222 | 12.736 | 21.246 | 1.00 | 28.41 | C |
| ATOM | 801 | CD | GLN | A | 96 | −17.160 | 13.472 | 20.306 | 1.00 | 31.84 | C |
| ATOM | 802 | OE1 | GLN | A | 96 | −18.374 | 13.273 | 20.339 | 1.00 | 31.87 | O |
| ATOM | 803 | NE2 | GLN | A | 96 | −16.598 | 14.338 | 19.467 | 1.00 | 28.54 | N |
| ATOM | 804 | N | ARG | A | 97 | −13.901 | 14.047 | 24.901 | 1.00 | 23.25 | N |
| ATOM | 805 | CA | ARG | A | 97 | −13.391 | 14.938 | 25.933 | 1.00 | 24.34 | C |
| ATOM | 806 | C | ARG | A | 97 | −12.467 | 15.945 | 25.264 | 1.00 | 23.39 | C |
| ATOM | 807 | O | ARG | A | 97 | −11.684 | 15.586 | 24.375 | 1.00 | 23.85 | O |
| ATOM | 808 | CB | ARG | A | 97 | −12.637 | 14.140 | 27.009 | 1.00 | 23.67 | C |
| ATOM | 809 | CG | ARG | A | 97 | −12.181 | 14.922 | 28.228 | 1.00 | 26.43 | C |
| ATOM | 810 | CD | ARG | A | 97 | −11.229 | 14.052 | 29.077 | 1.00 | 27.95 | C |
| ATOM | 811 | NE | ARG | A | 97 | −10.901 | 14.663 | 30.361 | 1.00 | 39.34 | N |
| ATOM | 812 | CZ | ARG | A | 97 | −10.069 | 14.129 | 31.255 | 1.00 | 45.73 | C |
| ATOM | 813 | NH1 | ARG | A | 97 | −9.834 | 14.759 | 32.400 | 1.00 | 45.55 | N |
| ATOM | 814 | NH2 | ARG | A | 97 | −9.480 | 12.963 | 31.008 | 1.00 | 35.77 | N |
| ATOM | 815 | N | MET | A | 98 | −12.566 | 17.207 | 25.682 | 1.00 | 20.65 | N |
| ATOM | 816 | CA | MET | A | 98 | −11.685 | 18.251 | 25.179 | 1.00 | 22.81 | C |
| ATOM | 817 | C | MET | A | 98 | −11.280 | 19.143 | 26.339 | 1.00 | 23.59 | C |
| ATOM | 818 | O | MET | A | 98 | −12.117 | 19.509 | 27.170 | 1.00 | 27.22 | O |
| ATOM | 819 | CB | MET | A | 98 | −12.384 | 19.098 | 24.088 | 1.00 | 26.68 | C |
| ATOM | 820 | CG | MET | A | 98 | −11.487 | 20.118 | 23.395 | 1.00 | 35.39 | C |
| ATOM | 821 | SD | MET | A | 98 | −11.382 | 21.727 | 24.250 | 1.00 | 45.43 | S |
| ATOM | 822 | CE | MET | A | 98 | −13.048 | 21.911 | 24.851 | 1.00 | 41.43 | C |
| ATOM | 823 | N | TYR | A | 99 | −9.999 | 19.488 | 26.406 | 1.00 | 22.09 | N |
| ATOM | 824 | CA | TYR | A | 99 | −9.592 | 20.457 | 27.415 | 1.00 | 20.65 | C |
| ATOM | 825 | C | TYR | A | 99 | −8.391 | 21.237 | 26.907 | 1.00 | 21.63 | C |
| ATOM | 826 | O | TYR | A | 99 | −7.752 | 20.855 | 25.923 | 1.00 | 23.53 | O |
| ATOM | 827 | CB | TYR | A | 99 | −9.303 | 19.791 | 28.778 | 1.00 | 20.80 | C |
| ATOM | 828 | CG | TYR | A | 99 | −8.237 | 18.700 | 28.822 | 1.00 | 23.75 | C |
| ATOM | 829 | CD1 | TYR | A | 99 | −6.878 | 19.005 | 28.674 | 1.00 | 21.59 | C |
| ATOM | 830 | CD2 | TYR | A | 99 | −8.583 | 17.380 | 29.095 | 1.00 | 24.87 | C |
| ATOM | 831 | CE1 | TYR | A | 99 | −5.897 | 18.006 | 28.744 | 1.00 | 24.05 | C |
| ATOM | 832 | CE2 | TYR | A | 99 | −7.617 | 16.377 | 29.176 | 1.00 | 23.18 | C |

TABLE 17-continued

| ATOM | 833 | CZ | TYR | A | 99 | −6.278 | 16.702 | 29.001 | 1.00 | 24.07 | C |
|---|---|---|---|---|---|---|---|---|---|---|---|
| ATOM | 834 | OH | TYR | A | 99 | −5.312 | 15.717 | 29.096 | 1.00 | 22.34 | O |
| ATOM | 835 | N | GLY | A | 100 | −8.116 | 22.366 | 27.559 | 1.00 | 24.47 | N |
| ATOM | 836 | CA | GLY | A | 100 | −6.980 | 23.164 | 27.158 | 1.00 | 24.86 | C |
| ATOM | 837 | C | GLY | A | 100 | −7.022 | 24.556 | 27.759 | 1.00 | 23.22 | C |
| ATOM | 838 | O | GLY | A | 100 | −7.821 | 24.846 | 28.649 | 1.00 | 24.20 | O |
| ATOM | 839 | N | CYS | A | 101 | −6.138 | 25.412 | 27.250 | 1.00 | 25.25 | N |
| ATOM | 840 | CA | CYS | A | 101 | −5.989 | 26.758 | 27.794 | 1.00 | 21.27 | C |
| ATOM | 841 | C | CYS | A | 101 | −5.711 | 27.725 | 26.660 | 1.00 | 27.23 | C |
| ATOM | 842 | O | CYS | A | 101 | −5.156 | 27.340 | 25.630 | 1.00 | 27.59 | O |
| ATOM | 843 | CB | CYS | A | 101 | −4.847 | 26.834 | 28.841 | 1.00 | 25.89 | C |
| ATOM | 844 | SG | CYS | A | 101 | −3.251 | 26.050 | 28.310 | 1.00 | 30.24 | S |
| ATOM | 845 | N | ASP | A | 102 | −6.118 | 28.984 | 26.861 | 1.00 | 25.57 | N |
| ATOM | 846 | CA | ASP | A | 102 | −5.814 | 30.098 | 25.971 | 1.00 | 25.53 | C |
| ATOM | 847 | C | ASP | A | 102 | −4.863 | 31.046 | 26.689 | 1.00 | 26.68 | C |
| ATOM | 848 | O | ASP | A | 102 | −4.989 | 31.243 | 27.905 | 1.00 | 25.60 | O |
| ATOM | 849 | CB | ASP | A | 102 | −7.080 | 30.887 | 25.587 | 1.00 | 24.33 | C |
| ATOM | 850 | CG | ASP | A | 102 | −8.126 | 30.051 | 24.851 | 1.00 | 30.48 | C |
| ATOM | 851 | OD1 | ASP | A | 102 | −7.800 | 28.973 | 24.320 | 1.00 | 33.41 | O |
| ATOM | 852 | OD2 | ASP | A | 102 | −9.283 | 30.519 | 24.783 | 1.00 | 33.68 | O |
| ATOM | 853 | N | VAL | A | 103 | −3.914 | 31.637 | 25.948 | 1.00 | 25.63 | N |
| ATOM | 854 | CA | VAL | A | 103 | −3.058 | 32.703 | 26.475 | 1.00 | 27.54 | C |
| ATOM | 855 | C | VAL | A | 103 | −3.105 | 33.907 | 25.538 | 1.00 | 26.18 | C |
| ATOM | 856 | O | VAL | A | 103 | −3.394 | 33.783 | 24.344 | 1.00 | 30.59 | O |
| ATOM | 857 | CB | VAL | A | 103 | −1.596 | 32.241 | 26.683 | 1.00 | 29.80 | C |
| ATOM | 858 | CG1 | VAL | A | 103 | −1.555 | 31.048 | 27.643 | 1.00 | 24.29 | C |
| ATOM | 859 | CG2 | VAL | A | 103 | −0.935 | 31.931 | 25.330 | 1.00 | 28.23 | C |
| ATOM | 860 | N | GLY | A | 104 | −2.841 | 35.088 | 26.091 | 1.00 | 28.05 | N |
| ATOM | 861 | CA | GLY | A | 104 | −2.825 | 36.298 | 25.300 | 1.00 | 29.64 | C |
| ATOM | 862 | C | GLY | A | 104 | −1.494 | 36.503 | 24.600 | 1.00 | 29.18 | C |
| ATOM | 863 | O | GLY | A | 104 | −0.624 | 35.633 | 24.576 | 1.00 | 32.53 | O |
| ATOM | 864 | N | ASER | A | 105 | −1.334 | 37.701 | 24.033 | 0.42 | 33.80 | N |
| ATOM | 865 | CA | ASER | A | 105 | −0.117 | 38.014 | 23.289 | 0.42 | 36.13 | C |
| ATOM | 866 | C | ASER | A | 105 | 1.111 | 38.085 | 24.187 | 0.42 | 37.63 | C |
| ATOM | 867 | O | ASER | A | 105 | 2.238 | 38.030 | 23.680 | 0.42 | 38.31 | O |
| ATOM | 868 | CB | ASER | A | 105 | −0.286 | 39.329 | 22.524 | 0.42 | 36.77 | C |
| ATOM | 869 | OG | ASER | A | 105 | −0.176 | 40.448 | 23.384 | 0.42 | 32.43 | O |
| ATOM | 870 | N | BSER | A | 105 | −1.344 | 37.697 | 24.023 | 0.58 | 33.90 | N |
| ATOM | 871 | CA | BSER | A | 105 | −0.127 | 38.044 | 23.296 | 0.58 | 36.13 | C |
| ATOM | 872 | C | BSER | A | 105 | 1.104 | 38.049 | 24.191 | 0.58 | 37.80 | C |
| ATOM | 873 | O | BSER | A | 105 | 2.225 | 37.916 | 23.686 | 0.58 | 38.52 | O |
| ATOM | 874 | CB | BSER | A | 105 | −0.287 | 39.411 | 22.628 | 0.58 | 37.01 | C |
| ATOM | 875 | OG | BSER | A | 105 | −1.268 | 39.371 | 21.609 | 0.58 | 36.34 | O |
| ATOM | 876 | N | ASP | A | 106 | 0.923 | 38.210 | 25.499 | 1.00 | 34.59 | N |
| ATOM | 877 | CA | ASP | A | 106 | 2.017 | 38.159 | 26.461 | 1.00 | 32.84 | C |
| ATOM | 878 | C | ASP | A | 106 | 2.210 | 36.757 | 27.027 | 1.00 | 30.47 | C |
| ATOM | 879 | O | ASP | A | 106 | 2.998 | 36.579 | 27.961 | 1.00 | 34.12 | O |
| ATOM | 880 | CB | ASP | A | 106 | 1.760 | 39.170 | 27.593 | 1.00 | 31.64 | C |
| ATOM | 881 | CG | ASP | A | 106 | 0.370 | 39.009 | 28.207 | 1.00 | 35.86 | C |
| ATOM | 882 | OD1 | ASP | A | 106 | −0.306 | 38.001 | 27.912 | 1.00 | 33.96 | O |
| ATOM | 883 | OD2 | ASP | A | 106 | −0.050 | 39.898 | 28.971 | 1.00 | 36.93 | O |
| ATOM | 884 | N | TRP | A | 107 | 1.495 | 35.771 | 26.468 | 1.00 | 28.58 | N |
| ATOM | 885 | CA | TRP | A | 107 | 1.459 | 34.361 | 26.872 | 1.00 | 30.10 | C |
| ATOM | 886 | C | TRP | A | 107 | 0.983 | 34.157 | 28.309 | 1.00 | 30.59 | C |
| ATOM | 887 | O | TRP | A | 107 | 1.292 | 33.129 | 28.913 | 1.00 | 30.76 | O |
| ATOM | 888 | CB | TRP | A | 107 | 2.806 | 33.654 | 26.663 | 1.00 | 29.61 | C |
| ATOM | 889 | CG | TRP | A | 107 | 3.309 | 33.672 | 25.242 | 1.00 | 34.51 | C |
| ATOM | 890 | CD1 | TRP | A | 107 | 2.664 | 34.156 | 24.137 | 1.00 | 37.73 | C |
| ATOM | 891 | CD2 | TRP | A | 107 | 4.584 | 33.200 | 24.788 | 1.00 | 30.78 | C |
| ATOM | 892 | NE1 | TRP | A | 107 | 3.471 | 34.022 | 23.027 | 1.00 | 40.01 | N |
| ATOM | 893 | CE2 | TRP | A | 107 | 4.645 | 33.421 | 23.400 | 1.00 | 31.77 | C |
| ATOM | 894 | CE3 | TRP | A | 107 | 5.673 | 32.609 | 25.424 | 1.00 | 28.98 | C |
| ATOM | 895 | CZ2 | TRP | A | 107 | 5.772 | 33.084 | 22.637 | 1.00 | 34.61 | C |
| ATOM | 896 | CZ3 | TRP | A | 107 | 6.792 | 32.267 | 24.663 | 1.00 | 33.93 | C |
| ATOM | 897 | CH2 | TRP | A | 107 | 6.826 | 32.506 | 23.287 | 1.00 | 29.84 | C |
| ATOM | 898 | N | ARG | A | 108 | 0.236 | 35.112 | 28.870 | 1.00 | 31.11 | N |
| ATOM | 899 | CA | ARG | A | 108 | −0.409 | 34.932 | 30.169 | 1.00 | 30.52 | C |
| ATOM | 900 | C | ARG | A | 108 | −1.723 | 34.188 | 29.998 | 1.00 | 31.42 | C |
| ATOM | 901 | O | ARG | A | 108 | −2.434 | 34.389 | 29.014 | 1.00 | 30.18 | O |
| ATOM | 902 | CB | ARG | A | 108 | −0.686 | 36.276 | 30.861 | 1.00 | 29.79 | C |
| ATOM | 903 | CG | ARG | A | 108 | 0.530 | 36.967 | 31.447 | 1.00 | 31.35 | C |
| ATOM | 904 | CD | ARG | A | 108 | 0.083 | 38.187 | 32.275 | 1.00 | 33.61 | C |
| ATOM | 905 | NE | ARG | A | 108 | −0.735 | 39.094 | 31.465 | 1.00 | 49.34 | N |
| ATOM | 906 | CZ | ARG | A | 108 | −1.918 | 39.594 | 31.824 | 1.00 | 43.93 | C |
| ATOM | 907 | NH1 | ARG | A | 108 | −2.567 | 40.397 | 30.989 | 1.00 | 42.56 | N |
| ATOM | 908 | NH2 | ARG | A | 108 | −2.450 | 39.311 | 33.008 | 1.00 | 38.40 | N |
| ATOM | 909 | N | PHE | A | 109 | −2.047 | 33.353 | 30.980 | 1.00 | 26.65 | N |
| ATOM | 910 | CA | PHE | A | 109 | −3.333 | 32.665 | 31.033 | 1.00 | 32.55 | C |
| ATOM | 911 | C | PHE | A | 109 | −4.494 | 33.625 | 30.822 | 1.00 | 26.67 | C |
| ATOM | 912 | O | PHE | A | 109 | −4.590 | 34.665 | 31.485 | 1.00 | 29.15 | O |

TABLE 17-continued

| | | | | | | | | | | |
|---|---|---|---|---|---|---|---|---|---|---|
| ATOM | 913 | CB | PHE | A | 109 | −3.470 | 31.968 | 32.390 | 1.00 | 29.06 | C |
| ATOM | 914 | CG | PHE | A | 109 | −4.819 | 31.369 | 32.635 | 1.00 | 28.91 | C |
| ATOM | 915 | CD1 | PHE | A | 109 | −5.151 | 30.144 | 32.089 | 1.00 | 25.18 | C |
| ATOM | 916 | CD2 | PHE | A | 109 | −5.770 | 32.043 | 33.406 | 1.00 | 28.87 | C |
| ATOM | 917 | CE1 | PHE | A | 109 | −6.399 | 29.586 | 32.302 | 1.00 | 25.77 | C |
| ATOM | 918 | CE2 | PHE | A | 109 | −7.017 | 31.481 | 33.623 | 1.00 | 30.00 | C |
| ATOM | 919 | CZ | PHE | A | 109 | −7.321 | 30.262 | 33.077 | 1.00 | 28.17 | C |
| ATOM | 920 | N | LEU | A | 110 | −5.365 | 33.288 | 29.871 | 1.00 | 27.52 | N |
| ATOM | 921 | CA | LEU | A | 110 | −6.638 | 33.977 | 29.705 | 1.00 | 30.61 | C |
| ATOM | 922 | C | LEU | A | 110 | −7.814 | 33.142 | 30.181 | 1.00 | 31.23 | C |
| ATOM | 923 | O | LEU | A | 110 | −8.703 | 33.660 | 30.866 | 1.00 | 31.83 | O |
| ATOM | 924 | CB | LEU | A | 110 | −6.864 | 34.378 | 28.237 | 1.00 | 30.13 | C |
| ATOM | 925 | CG | LEU | A | 110 | −6.066 | 35.562 | 27.692 | 1.00 | 31.03 | C |
| ATOM | 926 | CD1 | LEU | A | 110 | −6.303 | 35.637 | 26.190 | 1.00 | 28.64 | C |
| ATOM | 927 | CD2 | LEU | A | 110 | −6.485 | 36.873 | 28.381 | 1.00 | 33.44 | C |
| ATOM | 928 | N | ARG | A | 111 | −7.864 | 31.866 | 29.809 | 1.00 | 26.57 | N |
| ATOM | 929 | CA | ARG | A | 111 | −8.972 | 31.040 | 30.259 | 1.00 | 29.33 | C |
| ATOM | 930 | C | ARG | A | 111 | −8.652 | 29.585 | 29.956 | 1.00 | 27.37 | C |
| ATOM | 931 | O | ARG | A | 111 | −7.730 | 29.267 | 29.187 | 1.00 | 27.28 | O |
| ATOM | 932 | CB | ARG | A | 111 | −10.293 | 31.445 | 29.605 | 1.00 | 31.24 | C |
| ATOM | 933 | CG | ARG | A | 111 | −10.375 | 31.098 | 28.170 | 1.00 | 34.29 | C |
| ATOM | 934 | CD | ARG | A | 111 | −11.352 | 31.997 | 27.444 | 1.00 | 46.00 | C |
| ATOM | 935 | NE | ARG | A | 111 | −10.714 | 32.373 | 26.198 | 1.00 | 55.60 | N |
| ATOM | 936 | CZ | ARG | A | 111 | −10.256 | 33.585 | 25.918 | 1.00 | 46.04 | C |
| ATOM | 937 | NH1 | ARG | A | 111 | −10.417 | 34.587 | 26.774 | 1.00 | 52.32 | N |
| ATOM | 938 | NH2 | ARG | A | 111 | −9.655 | 33.791 | 24.761 | 1.00 | 41.30 | N |
| ATOM | 939 | N | GLY | A | 112 | −9.400 | 28.704 | 30.619 | 1.00 | 26.50 | N |
| ATOM | 940 | CA | GLY | A | 112 | −9.274 | 27.276 | 30.411 | 1.00 | 21.57 | C |
| ATOM | 941 | C | GLY | A | 112 | −10.636 | 26.649 | 30.185 | 1.00 | 24.22 | C |
| ATOM | 942 | O | GLY | A | 112 | −11.678 | 27.286 | 30.399 | 1.00 | 27.12 | O |
| ATOM | 943 | N | AGLU | A | 113 | −10.620 | 25.396 | 29.708 | 0.71 | 21.44 | N |
| ATOM | 944 | CA | AGLU | A | 113 | −11.879 | 24.689 | 29.473 | 0.71 | 29.55 | C |
| ATOM | 945 | C | AGLU | A | 113 | −11.680 | 23.189 | 29.628 | 0.71 | 25.44 | C |
| ATOM | 946 | O | AGLU | A | 113 | −10.580 | 22.654 | 29.461 | 0.71 | 22.84 | O |
| ATOM | 947 | CB | AGLU | A | 113 | −12.491 | 24.949 | 28.084 | 0.71 | 33.38 | C |
| ATOM | 948 | CG | AGLU | A | 113 | −12.255 | 26.292 | 27.450 | 0.71 | 41.02 | C |
| ATOM | 949 | CD | AGLU | A | 113 | −10.951 | 26.319 | 26.726 | 0.71 | 39.17 | C |
| ATOM | 950 | OE1 | AGLU | A | 113 | −10.509 | 25.225 | 26.323 | 0.71 | 42.77 | O |
| ATOM | 951 | OE2 | AGLU | A | 113 | −10.367 | 27.412 | 26.561 | 0.71 | 38.93 | O |
| ATOM | 952 | N | BGLU | A | 113 | −10.621 | 25.388 | 29.762 | 0.29 | 24.70 | N |
| ATOM | 953 | CA | BGLU | A | 113 | −11.882 | 24.701 | 29.533 | 0.29 | 28.51 | C |
| ATOM | 954 | C | BGLU | A | 113 | −11.677 | 23.203 | 29.667 | 0.29 | 25.58 | C |
| ATOM | 955 | O | BGLU | A | 113 | −10.565 | 22.690 | 29.528 | 0.29 | 24.55 | O |
| ATOM | 956 | CB | BGLU | A | 113 | −12.471 | 25.036 | 28.160 | 0.29 | 33.82 | C |
| ATOM | 957 | CG | BGLU | A | 113 | −11.721 | 24.411 | 27.007 | 0.29 | 37.57 | C |
| ATOM | 958 | CD | BGLU | A | 113 | −10.544 | 25.238 | 26.578 | 0.29 | 40.55 | C |
| ATOM | 959 | OE1 | BGLU | A | 113 | −10.395 | 26.364 | 27.098 | 0.29 | 41.54 | O |
| ATOM | 960 | OE2 | BGLU | A | 113 | −9.769 | 24.764 | 25.722 | 0.29 | 39.11 | O |
| ATOM | 961 | N | HIS | A | 114 | −12.779 | 22.506 | 29.924 | 1.00 | 24.08 | N |
| ATOM | 962 | CA | HIS | A | 114 | −12.736 | 21.058 | 30.112 | 1.00 | 20.50 | C |
| ATOM | 963 | C | HIS | A | 114 | −14.170 | 20.586 | 29.953 | 1.00 | 24.70 | C |
| ATOM | 964 | O | HIS | A | 114 | −15.031 | 20.970 | 30.754 | 1.00 | 26.41 | O |
| ATOM | 965 | CB | HIS | A | 114 | −12.183 | 20.702 | 31.494 | 1.00 | 21.77 | C |
| ATOM | 966 | CG | HIS | A | 114 | −12.151 | 19.242 | 31.780 | 1.00 | 28.29 | C |
| ATOM | 967 | ND1 | HIS | A | 114 | −13.273 | 18.539 | 32.172 | 1.00 | 31.00 | N |
| ATOM | 968 | CD2 | HIS | A | 114 | −11.137 | 18.343 | 31.740 | 1.00 | 31.46 | C |
| ATOM | 969 | CE1 | HIS | A | 114 | −12.949 | 17.272 | 32.364 | 1.00 | 36.29 | C |
| ATOM | 970 | NE2 | HIS | A | 114 | −11.664 | 17.124 | 32.100 | 1.00 | 31.59 | N |
| ATOM | 971 | N | GLN | A | 115 | −14.438 | 19.807 | 28.910 | 1.00 | 24.23 | N |
| ATOM | 972 | CA | GLN | A | 115 | −15.814 | 19.400 | 28.675 | 1.00 | 25.64 | C |
| ATOM | 973 | C | GLN | A | 115 | −15.861 | 18.000 | 28.103 | 1.00 | 23.82 | C |
| ATOM | 974 | O | GLN | A | 115 | −14.914 | 17.526 | 27.469 | 1.00 | 24.81 | O |
| ATOM | 975 | CB | GLN | A | 115 | −16.542 | 20.353 | 27.749 | 1.00 | 31.76 | C |
| ATOM | 976 | CG | GLN | A | 115 | −15.833 | 20.674 | 26.493 | 1.00 | 41.21 | C |
| ATOM | 977 | CD | GLN | A | 115 | −16.267 | 22.030 | 25.979 | 1.00 | 61.62 | C |
| ATOM | 978 | OE1 | GLN | A | 115 | −16.485 | 22.955 | 26.762 | 1.00 | 64.26 | O |
| ATOM | 979 | NE2 | GLN | A | 115 | −16.410 | 22.152 | 24.666 | 1.00 | 68.39 | N |
| ATOM | 980 | N | AGLU | A | 116 | −17.026 | 17.395 | 28.254 | 0.61 | 24.31 | N |
| ATOM | 981 | CA | AGLU | A | 116 | −17.251 | 15.991 | 27.967 | 0.61 | 23.37 | C |
| ATOM | 982 | C | AGLU | A | 116 | −18.571 | 15.848 | 27.225 | 0.61 | 23.32 | C |
| ATOM | 983 | O | AGLU | A | 116 | −19.536 | 16.552 | 27.532 | 0.61 | 25.78 | O |
| ATOM | 984 | CB | AGLU | A | 116 | −17.298 | 15.206 | 29.266 | 0.61 | 26.25 | C |
| ATOM | 985 | CG | AGLU | A | 116 | −17.106 | 13.730 | 29.099 | 0.61 | 38.73 | C |
| ATOM | 986 | CD | AGLU | A | 116 | −15.853 | 13.264 | 29.783 | 0.61 | 43.95 | C |
| ATOM | 987 | OE1 | AGLU | A | 116 | −15.304 | 14.041 | 30.595 | 0.61 | 50.24 | O |
| ATOM | 988 | OE2 | AGLU | A | 116 | −15.418 | 12.127 | 29.519 | 0.61 | 47.36 | O |
| ATOM | 989 | N | BGLU | A | 116 | −16.979 | 17.327 | 28.364 | 0.39 | 24.66 | N |
| ATOM | 990 | CA | BGLU | A | 116 | −17.206 | 15.949 | 27.949 | 0.39 | 23.26 | C |
| ATOM | 991 | C | BGLU | A | 116 | −18.540 | 15.855 | 27.219 | 0.39 | 23.48 | C |
| ATOM | 992 | O | BGLU | A | 116 | −19.481 | 16.588 | 27.529 | 0.39 | 24.45 | O |

TABLE 17-continued

| ATOM | 993 | CB | BGLU | A | 116 | −17.219 | 14.988 | 29.151 | 0.39 | 29.28 | C |
|------|-----|-----|------|---|-----|---------|--------|--------|------|-------|---|
| ATOM | 994 | CG | BGLU | A | 116 | −15.940 | 14.957 | 29.967 | 0.39 | 39.00 | C |
| ATOM | 995 | CD | BGLU | A | 116 | −15.418 | 13.545 | 30.167 | 0.39 | 45.89 | C |
| ATOM | 996 | OE1 | BGLU | A | 116 | −15.825 | 12.655 | 29.392 | 0.39 | 44.55 | O |
| ATOM | 997 | OE2 | BGLU | A | 116 | −14.603 | 13.325 | 31.095 | 0.39 | 47.31 | O |
| ATOM | 998 | N | ALA | A | 117 | −18.613 | 14.941 | 26.251 | 1.00 | 21.26 | N |
| ATOM | 999 | CA | ALA | A | 117 | −19.837 | 14.669 | 25.509 | 1.00 | 25.59 | C |
| ATOM | 1000 | C | ALA | A | 117 | −20.057 | 13.167 | 25.419 | 1.00 | 28.09 | C |
| ATOM | 1001 | O | ALA | A | 117 | −19.101 | 12.384 | 25.353 | 1.00 | 28.07 | O |
| ATOM | 1002 | CB | ALA | A | 117 | −19.802 | 15.264 | 24.084 | 1.00 | 27.10 | C |
| ATOM | 1003 | N | TYR | A | 118 | −21.326 | 12.768 | 25.406 | 1.00 | 26.55 | N |
| ATOM | 1004 | CA | TYR | A | 118 | −21.707 | 11.372 | 25.223 | 1.00 | 27.29 | C |
| ATOM | 1005 | C | TYR | A | 118 | −22.620 | 11.296 | 24.014 | 1.00 | 29.68 | C |
| ATOM | 1006 | O | TYR | A | 118 | −23.626 | 12.018 | 23.949 | 1.00 | 28.17 | O |
| ATOM | 1007 | CB | TYR | A | 118 | −22.413 | 10.812 | 26.467 | 1.00 | 29.66 | C |
| ATOM | 1008 | CG | TYR | A | 118 | −22.822 | 9.346 | 26.377 | 1.00 | 23.18 | C |
| ATOM | 1009 | CD1 | TYR | A | 118 | −21.872 | 8.358 | 26.158 | 1.00 | 23.52 | C |
| ATOM | 1010 | CD2 | TYR | A | 118 | −24.145 | 8.951 | 26.558 | 1.00 | 28.12 | C |
| ATOM | 1011 | CE1 | TYR | A | 118 | −22.214 | 7.013 | 26.101 | 1.00 | 22.78 | C |
| ATOM | 1012 | CE2 | TYR | A | 118 | −24.508 | 7.591 | 26.491 | 1.00 | 25.31 | C |
| ATOM | 1013 | CZ | TYR | A | 118 | −23.529 | 6.636 | 26.272 | 1.00 | 27.93 | C |
| ATOM | 1014 | OH | TYR | A | 118 | −23.850 | 5.307 | 26.212 | 1.00 | 29.09 | O |
| ATOM | 1015 | N | ASP | A | 119 | −22.277 | 10.410 | 23.071 | 1.00 | 26.06 | N |
| ATOM | 1016 | CA | ASP | A | 119 | −22.996 | 10.265 | 21.799 | 1.00 | 25.27 | C |
| ATOM | 1017 | C | ASP | A | 119 | −23.231 | 11.614 | 21.123 | 1.00 | 27.01 | C |
| ATOM | 1018 | O | ASP | A | 119 | −24.310 | 11.892 | 20.596 | 1.00 | 29.74 | O |
| ATOM | 1019 | CB | ASP | A | 119 | −24.313 | 9.493 | 21.982 | 1.00 | 32.06 | C |
| ATOM | 1020 | CG | ASP | A | 119 | −24.081 | 8.005 | 22.262 | 1.00 | 36.38 | C |
| ATOM | 1021 | OD1 | ASP | A | 119 | −23.020 | 7.464 | 21.866 | 1.00 | 30.44 | O |
| ATOM | 1022 | OD2 | ASP | A | 119 | −24.964 | 7.368 | 22.868 | 1.00 | 32.30 | O |
| ATOM | 1023 | N | GLY | A | 120 | −22.204 | 12.463 | 21.147 | 1.00 | 29.87 | N |
| ATOM | 1024 | CA | GLY | A | 120 | −22.231 | 13.723 | 20.423 | 1.00 | 32.31 | C |
| ATOM | 1025 | C | GLY | A | 120 | −22.974 | 14.854 | 21.089 | 1.00 | 32.94 | C |
| ATOM | 1026 | O | GLY | A | 120 | −23.093 | 15.933 | 20.487 | 1.00 | 32.85 | O |
| ATOM | 1027 | N | LYS | A | 121 | −23.457 | 14.660 | 22.313 | 1.00 | 31.38 | N |
| ATOM | 1028 | CA | LYS | A | 121 | −24.205 | 15.678 | 23.040 | 1.00 | 32.98 | C |
| ATOM | 1029 | C | LYS | A | 121 | −23.460 | 16.070 | 24.309 | 1.00 | 31.20 | C |
| ATOM | 1030 | O | LYS | A | 121 | −22.896 | 15.210 | 24.993 | 1.00 | 31.19 | O |
| ATOM | 1031 | CB | LYS | A | 121 | −25.611 | 15.165 | 23.397 | 1.00 | 38.55 | C |
| ATOM | 1032 | CG | LYS | A | 121 | −26.504 | 16.214 | 24.036 | 1.00 | 46.87 | C |
| ATOM | 1033 | CD | LYS | A | 121 | −27.872 | 15.641 | 24.387 | 1.00 | 51.32 | C |
| ATOM | 1034 | CE | LYS | A | 121 | −28.716 | 16.655 | 25.164 | 1.00 | 51.35 | C |
| ATOM | 1035 | NZ | LYS | A | 121 | −28.995 | 17.898 | 24.380 | 1.00 | 54.79 | N |
| ATOM | 1036 | N | ASP | A | 122 | −23.460 | 17.370 | 24.628 | 1.00 | 29.50 | N |
| ATOM | 1037 | CA | ASP | A | 122 | −22.832 | 17.834 | 25.869 | 1.00 | 28.68 | C |
| ATOM | 1038 | C | ASP | A | 122 | −23.308 | 16.995 | 27.046 | 1.00 | 30.10 | C |
| ATOM | 1039 | O | ASP | A | 122 | −24.506 | 16.762 | 27.207 | 1.00 | 31.65 | O |
| ATOM | 1040 | CB | ASP | A | 122 | −23.171 | 19.310 | 26.133 | 1.00 | 31.03 | C |
| ATOM | 1041 | CG | ASP | A | 122 | −22.454 | 20.269 | 25.196 | 1.00 | 41.80 | C |
| ATOM | 1042 | OD1 | ASP | A | 122 | −21.217 | 20.193 | 25.067 | 1.00 | 44.35 | O |
| ATOM | 1043 | OD2 | ASP | A | 122 | −23.137 | 21.124 | 24.604 | 1.00 | 48.85 | O |
| ATOM | 1044 | N | TYR | A | 123 | −22.368 | 16.519 | 27.857 | 1.00 | 28.31 | N |
| ATOM | 1045 | CA | TYR | A | 123 | −22.702 | 15.745 | 29.047 | 1.00 | 25.28 | C |
| ATOM | 1046 | C | TYR | A | 123 | −22.399 | 16.520 | 30.323 | 1.00 | 29.23 | C |
| ATOM | 1047 | O | TYR | A | 123 | −23.285 | 16.720 | 31.158 | 1.00 | 29.56 | O |
| ATOM | 1048 | CB | TYR | A | 123 | −21.953 | 14.387 | 29.041 | 1.00 | 25.53 | C |
| ATOM | 1049 | CG | TYR | A | 123 | −22.267 | 13.552 | 30.263 | 1.00 | 22.82 | C |
| ATOM | 1050 | CD1 | TYR | A | 123 | −23.491 | 12.910 | 30.393 | 1.00 | 25.54 | C |
| ATOM | 1051 | CD2 | TYR | A | 123 | −21.343 | 13.424 | 31.302 | 1.00 | 25.44 | C |
| ATOM | 1052 | CE1 | TYR | A | 123 | −23.790 | 12.170 | 31.517 | 1.00 | 25.17 | C |
| ATOM | 1053 | CE2 | TYR | A | 123 | −21.632 | 12.676 | 32.427 | 1.00 | 26.16 | C |
| ATOM | 1054 | CZ | TYR | A | 123 | −22.867 | 12.058 | 32.532 | 1.00 | 25.25 | C |
| ATOM | 1055 | OH | TYR | A | 123 | −23.150 | 11.302 | 33.648 | 1.00 | 29.05 | O |
| ATOM | 1056 | N | ILE | A | 124 | −21.158 | 16.964 | 30.505 | 1.00 | 24.19 | N |
| ATOM | 1057 | CA | ILE | A | 124 | −20.775 | 17.746 | 31.676 | 1.00 | 23.19 | C |
| ATOM | 1058 | C | ILE | A | 124 | −19.584 | 18.609 | 31.283 | 1.00 | 24.20 | C |
| ATOM | 1059 | O | ILE | A | 124 | −18.768 | 18.226 | 30.440 | 1.00 | 26.96 | O |
| ATOM | 1060 | CB | ILE | A | 124 | −20.461 | 16.859 | 32.912 | 1.00 | 24.28 | C |
| ATOM | 1061 | CG1 | ILE | A | 124 | −20.463 | 17.705 | 34.196 | 1.00 | 30.96 | C |
| ATOM | 1062 | CG2 | ILE | A | 124 | −19.081 | 16.090 | 32.774 | 1.00 | 19.80 | C |
| ATOM | 1063 | CD1 | ILE | A | 124 | −20.395 | 16.862 | 35.472 | 1.00 | 29.06 | C |
| ATOM | 1064 | N | ALA | A | 125 | −19.501 | 19.798 | 31.877 | 1.00 | 24.22 | N |
| ATOM | 1065 | CA | ALA | A | 125 | −18.386 | 20.687 | 31.574 | 1.00 | 25.75 | C |
| ATOM | 1066 | C | ALA | A | 125 | −18.074 | 21.568 | 32.768 | 1.00 | 27.52 | C |
| ATOM | 1067 | O | ALA | A | 125 | −18.956 | 21.904 | 33.559 | 1.00 | 24.66 | O |
| ATOM | 1068 | CB | ALA | A | 125 | −18.669 | 21.585 | 30.364 | 1.00 | 25.97 | C |
| ATOM | 1069 | N | LEU | A | 126 | −16.807 | 21.957 | 32.873 | 1.00 | 25.77 | N |
| ATOM | 1070 | CA | LEU | A | 126 | −16.438 | 23.015 | 33.801 | 1.00 | 25.41 | C |
| ATOM | 1071 | C | LEU | A | 126 | −17.008 | 24.344 | 33.328 | 1.00 | 24.85 | C |
| ATOM | 1072 | O | LEU | A | 126 | −17.010 | 24.643 | 32.128 | 1.00 | 28.77 | O |

TABLE 17-continued

| | | | | | | | | | | |
|---|---|---|---|---|---|---|---|---|---|---|
| ATOM | 1073 | CB | LEU | A | 126 | −14.920 | 23.141 | 33.889 | 1.00 | 34.98 | C |
| ATOM | 1074 | CG | LEU | A | 126 | −14.109 | 22.428 | 34.948 | 1.00 | 35.94 | C |
| ATOM | 1075 | CD1 | LEU | A | 126 | −12.692 | 22.945 | 34.814 | 1.00 | 25.24 | C |
| ATOM | 1076 | CD2 | LEU | A | 126 | −14.660 | 22.675 | 36.339 | 1.00 | 26.58 | C |
| ATOM | 1077 | N | LYS | A | 127 | −17.497 | 25.144 | 34.270 | 1.00 | 28.88 | N |
| ATOM | 1078 | CA | LYS | A | 127 | −17.910 | 26.500 | 33.930 | 1.00 | 31.04 | C |
| ATOM | 1079 | C | LYS | A | 127 | −16.689 | 27.389 | 33.709 | 1.00 | 34.89 | C |
| ATOM | 1080 | O | LYS | A | 127 | −15.543 | 26.995 | 33.947 | 1.00 | 32.90 | O |
| ATOM | 1081 | CB | LYS | A | 127 | −18.791 | 27.107 | 35.025 | 1.00 | 33.32 | C |
| ATOM | 1082 | CG | LYS | A | 127 | −20.136 | 26.430 | 35.199 | 1.00 | 38.82 | C |
| ATOM | 1083 | CD | LYS | A | 127 | −21.052 | 27.267 | 36.080 | 1.00 | 54.69 | C |
| ATOM | 1084 | CE | LYS | A | 127 | −22.049 | 26.403 | 36.833 | 1.00 | 62.05 | C |
| ATOM | 1085 | NZ | LYS | A | 127 | −23.361 | 26.333 | 36.149 | 1.00 | 68.48 | N |
| ATOM | 1086 | N | GLU | A | 128 | −16.962 | 28.624 | 33.269 | 1.00 | 33.94 | N |
| ATOM | 1087 | CA | GLU | A | 128 | −15.899 | 29.539 | 32.856 | 1.00 | 37.80 | C |
| ATOM | 1088 | C | GLU | A | 128 | −14.922 | 29.835 | 33.987 | 1.00 | 32.72 | C |
| ATOM | 1089 | O | GLU | A | 128 | −13.723 | 30.013 | 33.740 | 1.00 | 36.38 | O |
| ATOM | 1090 | CB | GLU | A | 128 | −16.511 | 30.839 | 32.332 | 1.00 | 48.82 | C |
| ATOM | 1091 | CG | GLU | A | 128 | −15.494 | 31.908 | 31.965 | 1.00 | 59.47 | C |
| ATOM | 1092 | CD | GLU | A | 128 | −15.277 | 32.029 | 30.471 | 0.00 | 70.00 | C |
| ATOM | 1093 | OE1 | GLU | A | 128 | −16.093 | 32.701 | 29.804 | 1.00 | 75.54 | O |
| ATOM | 1094 | OE2 | GLU | A | 128 | −14.291 | 31.454 | 29.963 | 1.00 | 75.13 | O |
| ATOM | 1095 | N | ASP | A | 129 | −15.400 | 29.882 | 35.229 | 1.00 | 32.00 | N |
| ATOM | 1096 | CA | ASP | A | 129 | −14.510 | 30.191 | 36.337 | 1.00 | 34.58 | C |
| ATOM | 1097 | C | ASP | A | 129 | −13.748 | 28.973 | 36.840 | 1.00 | 29.40 | C |
| ATOM | 1098 | O | ASP | A | 129 | −12.959 | 29.102 | 37.788 | 1.00 | 30.59 | O |
| ATOM | 1099 | CB | ASP | A | 129 | −15.302 | 30.845 | 37.478 | 1.00 | 35.97 | C |
| ATOM | 1100 | CG | ASP | A | 129 | −16.166 | 29.861 | 38.261 | 1.00 | 48.01 | C |
| ATOM | 1101 | OD1 | ASP | A | 129 | −16.357 | 28.692 | 37.854 | 1.00 | 46.55 | O |
| ATOM | 1102 | OD2 | ASP | A | 129 | −16.683 | 30.280 | 39.316 | 1.00 | 59.48 | O |
| ATOM | 1103 | N | LEU | A | 130 | −13.964 | 27.806 | 36.226 | 1.00 | 31.50 | N |
| ATOM | 1104 | CA | LEU | A | 130 | −13.256 | 26.562 | 36.536 | 1.00 | 35.16 | C |
| ATOM | 1105 | C | LEU | A | 130 | −13.453 | 26.114 | 37.983 | 1.00 | 33.18 | C |
| ATOM | 1106 | O | LEU | A | 130 | −12.631 | 25.368 | 38.521 | 1.00 | 29.25 | O |
| ATOM | 1107 | CB | LEU | A | 130 | −11.762 | 26.675 | 36.213 | 1.00 | 33.35 | C |
| ATOM | 1108 | CG | LEU | A | 130 | −11.439 | 27.240 | 34.825 | 1.00 | 34.95 | C |
| ATOM | 1109 | CD1 | LEU | A | 130 | −9.930 | 27.333 | 34.617 | 1.00 | 33.97 | C |
| ATOM | 1110 | CD2 | LEU | A | 130 | −12.070 | 26.410 | 33.733 | 1.00 | 30.94 | C |
| ATOM | 1111 | N | ARG | A | 131 | −14.537 | 26.547 | 38.631 | 1.00 | 30.11 | N |
| ATOM | 1112 | CA | ARG | A | 131 | −14.792 | 26.166 | 40.012 | 1.00 | 27.58 | C |
| ATOM | 1113 | C | ARG | A | 131 | −16.069 | 25.358 | 40.194 | 1.00 | 32.63 | C |
| ATOM | 1114 | O | ARG | A | 131 | −16.362 | 24.939 | 41.320 | 1.00 | 33.92 | O |
| ATOM | 1115 | CB | ARG | A | 131 | −14.847 | 27.418 | 40.899 | 1.00 | 25.92 | C |
| ATOM | 1116 | CG | ARG | A | 131 | −13.461 | 28.013 | 41.067 | 1.00 | 28.56 | C |
| ATOM | 1117 | CD | ARG | A | 131 | −13.402 | 29.316 | 41.836 | 1.00 | 32.62 | C |
| ATOM | 1118 | NE | ARG | A | 131 | −12.001 | 29.687 | 41.818 | 1.00 | 43.70 | N |
| ATOM | 1119 | CZ | ARG | A | 131 | −11.112 | 29.296 | 42.722 | 1.00 | 40.56 | C |
| ATOM | 1120 | NH1 | ARG | A | 131 | −11.496 | 28.565 | 43.765 | 1.00 | 33.68 | N |
| ATOM | 1121 | NH2 | ARG | A | 131 | −9.844 | 29.664 | 42.583 | 1.00 | 39.16 | N |
| ATOM | 1122 | N | SER | A | 132 | −16.831 | 25.127 | 39.137 | 1.00 | 30.05 | N |
| ATOM | 1123 | CA | SER | A | 132 | −18.073 | 24.377 | 39.272 | 1.00 | 31.22 | C |
| ATOM | 1124 | C | SER | A | 132 | −18.437 | 23.790 | 37.919 | 1.00 | 31.12 | C |
| ATOM | 1125 | O | SER | A | 132 | −17.802 | 24.081 | 36.904 | 1.00 | 26.48 | O |
| ATOM | 1126 | CB | SER | A | 132 | −19.184 | 25.267 | 39.820 | 1.00 | 34.64 | C |
| ATOM | 1127 | OG | SER | A | 132 | −19.399 | 26.356 | 38.942 | 1.00 | 38.48 | O |
| ATOM | 1128 | N | TRP | A | 133 | −19.490 | 22.971 | 37.914 | 1.00 | 27.98 | N |
| ATOM | 1129 | CA | TRP | A | 133 | −19.823 | 22.099 | 36.796 | 1.00 | 27.20 | C |
| ATOM | 1130 | C | TRP | A | 133 | −21.203 | 22.443 | 36.262 | 1.00 | 28.88 | C |
| ATOM | 1131 | O | TRP | A | 133 | −22.095 | 22.805 | 37.031 | 1.00 | 28.39 | O |
| ATOM | 1132 | CB | TRP | A | 133 | −19.802 | 20.614 | 37.230 | 1.00 | 26.28 | C |
| ATOM | 1133 | CG | TRP | A | 133 | −18.454 | 20.161 | 37.716 | 1.00 | 26.26 | C |
| ATOM | 1134 | CD1 | TRP | A | 133 | −18.021 | 20.110 | 39.011 | 1.00 | 28.69 | C |
| ATOM | 1135 | CD2 | TRP | A | 133 | −17.355 | 19.739 | 36.906 | 1.00 | 24.34 | C |
| ATOM | 1136 | NE1 | TRP | A | 133 | −16.716 | 19.685 | 39.055 | 1.00 | 27.14 | N |
| ATOM | 1137 | CE2 | TRP | A | 133 | −16.277 | 19.461 | 37.778 | 1.00 | 23.49 | C |
| ATOM | 1138 | CE3 | TRP | A | 133 | −17.168 | 19.583 | 35.529 | 1.00 | 25.55 | C |
| ATOM | 1139 | CZ2 | TRP | A | 133 | −15.037 | 18.997 | 37.317 | 1.00 | 23.78 | C |
| ATOM | 1140 | CZ3 | TRP | A | 133 | −15.922 | 19.134 | 35.067 | 1.00 | 24.65 | C |
| ATOM | 1141 | CH2 | TRP | A | 133 | −14.881 | 18.837 | 35.965 | 1.00 | 28.02 | C |
| ATOM | 1142 | N | THR | A | 134 | −21.376 | 22.323 | 34.945 | 1.00 | 25.17 | N |
| ATOM | 1143 | CA | THR | A | 134 | −22.697 | 22.371 | 34.324 | 1.00 | 31.58 | C |
| ATOM | 1144 | C | THR | A | 134 | −23.115 | 20.956 | 33.964 | 1.00 | 34.94 | C |
| ATOM | 1145 | O | THR | A | 134 | −22.409 | 20.282 | 33.194 | 1.00 | 33.70 | O |
| ATOM | 1146 | CB | THR | A | 134 | −22.726 | 23.241 | 33.066 | 1.00 | 44.70 | C |
| ATOM | 1147 | OG1 | THR | A | 134 | −21.787 | 22.741 | 32.112 | 1.00 | 63.68 | O |
| ATOM | 1148 | CG2 | THR | A | 134 | −22.391 | 24.657 | 33.389 | 1.00 | 37.05 | C |
| ATOM | 1149 | N | ALA | A | 135 | −24.286 | 20.548 | 34.479 | 1.00 | 33.20 | N |
| ATOM | 1150 | CA | ALA | A | 135 | −24.855 | 19.203 | 34.355 | 1.00 | 33.87 | C |
| ATOM | 1151 | C | ALA | A | 135 | −26.348 | 19.322 | 34.045 | 1.00 | 36.83 | C |
| ATOM | 1152 | O | ALA | A | 135 | −27.140 | 19.720 | 34.906 | 1.00 | 45.12 | O |

TABLE 17-continued

| | | | | | | | | | | |
|---|---|---|---|---|---|---|---|---|---|---|
| ATOM | 1153 | CB | ALA | A | 135 | −24.646 | 18.396 | 35.636 | 1.00 | 39.47 | C |
| ATOM | 1154 | N | ALA | A | 136 | −26.732 | 18.911 | 32.842 | 1.00 | 35.86 | N |
| ATOM | 1155 | CA | ALA | A | 136 | −28.057 | 19.178 | 32.294 | 1.00 | 40.57 | C |
| ATOM | 1156 | C | ALA | A | 136 | −29.065 | 18.045 | 32.467 | 1.00 | 37.01 | C |
| ATOM | 1157 | O | ALA | A | 136 | −30.246 | 18.257 | 32.168 | 1.00 | 41.13 | O |
| ATOM | 1158 | CB | ALA | A | 136 | −27.937 | 19.511 | 30.802 | 1.00 | 47.41 | C |
| ATOM | 1159 | N | ASP | A | 137 | −28.662 | 16.848 | 32.901 | 1.00 | 31.97 | N |
| ATOM | 1160 | CA | ASP | A | 137 | −29.645 | 15.792 | 33.127 | 1.00 | 33.08 | C |
| ATOM | 1161 | C | ASP | A | 137 | −29.285 | 15.038 | 34.402 | 1.00 | 31.93 | C |
| ATOM | 1162 | O | ASP | A | 137 | −28.317 | 15.378 | 35.091 | 1.00 | 33.10 | O |
| ATOM | 1163 | CB | ASP | A | 137 | −29.783 | 14.885 | 31.890 | 1.00 | 34.04 | C |
| ATOM | 1164 | CG | ASP | A | 137 | −28.563 | 13.993 | 31.633 | 1.00 | 36.13 | C |
| ATOM | 1165 | OD1 | ASP | A | 137 | −27.563 | 14.044 | 32.386 | 1.00 | 35.72 | O |
| ATOM | 1166 | OD2 | ASP | A | 137 | −28.623 | 13.224 | 30.643 | 1.00 | 34.00 | O |
| ATOM | 1167 | N | MET | A | 138 | −30.097 | 14.027 | 34.737 | 1.00 | 32.35 | N |
| ATOM | 1168 | CA | MET | A | 138 | −29.902 | 13.305 | 35.994 | 1.00 | 33.73 | C |
| ATOM | 1169 | C | MET | A | 138 | −28.567 | 12.568 | 36.022 | 1.00 | 34.13 | C |
| ATOM | 1170 | O | MET | A | 138 | −27.884 | 12.543 | 37.057 | 1.00 | 29.67 | O |
| ATOM | 1171 | CB | MET | A | 138 | −31.049 | 12.321 | 36.228 | 1.00 | 40.38 | C |
| ATOM | 1172 | CG | MET | A | 138 | −32.293 | 12.932 | 36.839 | 1.00 | 46.36 | C |
| ATOM | 1173 | SD | MET | A | 138 | −33.641 | 11.717 | 36.868 | 1.00 | 52.58 | S |
| ATOM | 1174 | CE | MET | A | 138 | −32.866 | 10.346 | 37.718 | 1.00 | 56.73 | C |
| ATOM | 1175 | N | ALA | A | 139 | −28.180 | 11.945 | 34.908 | 1.00 | 26.75 | N |
| ATOM | 1176 | CA | ALA | A | 139 | −26.895 | 11.252 | 34.891 | 1.00 | 30.71 | C |
| ATOM | 1177 | C | ALA | A | 139 | −25.765 | 12.226 | 35.163 | 1.00 | 30.80 | C |
| ATOM | 1178 | O | ALA | A | 139 | −24.902 | 11.968 | 36.002 | 1.00 | 31.11 | O |
| ATOM | 1179 | CB | ALA | A | 139 | −26.675 | 10.530 | 33.559 | 1.00 | 28.35 | C |
| ATOM | 1180 | N | ALA | A | 140 | −25.776 | 13.376 | 34.487 | 1.00 | 28.06 | N |
| ATOM | 1181 | CA | ALA | A | 140 | −24.704 | 14.343 | 34.693 | 1.00 | 29.32 | C |
| ATOM | 1182 | C | ALA | A | 140 | −24.729 | 14.903 | 36.114 | 1.00 | 31.59 | C |
| ATOM | 1183 | O | ALA | A | 140 | −23.670 | 15.240 | 36.666 | 1.00 | 29.99 | O |
| ATOM | 1184 | CB | ALA | A | 140 | −24.806 | 15.467 | 33.656 | 1.00 | 29.05 | C |
| ATOM | 1185 | N | GLN | A | 141 | −25.915 | 14.991 | 36.731 | 1.00 | 26.86 | N |
| ATOM | 1186 | CA | GLN | A | 141 | −25.989 | 15.414 | 38.131 | 1.00 | 29.23 | C |
| ATOM | 1187 | C | GLN | A | 141 | −25.295 | 14.409 | 39.044 | 1.00 | 30.86 | C |
| ATOM | 1188 | O | GLN | A | 141 | −24.631 | 14.799 | 40.014 | 1.00 | 30.04 | O |
| ATOM | 1189 | CB | GLN | A | 141 | −27.452 | 15.622 | 38.556 | 1.00 | 30.15 | C |
| ATOM | 1190 | CG | GLN | A | 141 | −28.030 | 16.923 | 38.061 | 1.00 | 45.90 | C |
| ATOM | 1191 | CD | GLN | A | 141 | −27.392 | 18.125 | 38.731 | 1.00 | 66.70 | C |
| ATOM | 1192 | OE1 | GLN | A | 141 | −26.951 | 18.050 | 39.881 | 1.00 | 69.59 | O |
| ATOM | 1193 | NE2 | GLN | A | 141 | −27.336 | 19.242 | 38.014 | 1.00 | 79.38 | N |
| ATOM | 1194 | N | THR | A | 142 | −25.416 | 13.113 | 38.735 | 1.00 | 26.30 | N |
| ATOM | 1195 | CA | THR | A | 142 | −24.735 | 12.085 | 39.511 | 1.00 | 28.78 | C |
| ATOM | 1196 | C | THR | A | 142 | −23.222 | 12.242 | 39.403 | 1.00 | 28.22 | C |
| ATOM | 1197 | O | THR | A | 142 | −22.496 | 12.205 | 40.411 | 1.00 | 25.37 | O |
| ATOM | 1198 | CB | THR | A | 142 | −25.167 | 10.703 | 39.020 | 1.00 | 28.98 | C |
| ATOM | 1199 | OG1 | THR | A | 142 | −26.573 | 10.519 | 39.269 | 1.00 | 33.77 | O |
| ATOM | 1200 | CG2 | THR | A | 142 | −24.361 | 9.598 | 39.721 | 1.00 | 29.66 | C |
| ATOM | 1201 | N | THR | A | 143 | −22.736 | 12.415 | 38.176 | 1.00 | 25.51 | N |
| ATOM | 1202 | CA | THR | A | 143 | −21.324 | 12.718 | 37.955 | 1.00 | 25.21 | C |
| ATOM | 1203 | C | THR | A | 143 | −20.904 | 13.986 | 38.695 | 1.00 | 25.32 | C |
| ATOM | 1204 | O | THR | A | 143 | −19.842 | 14.025 | 39.332 | 1.00 | 29.26 | O |
| ATOM | 1205 | CB | THR | A | 143 | −21.053 | 12.881 | 36.460 | 1.00 | 25.42 | C |
| ATOM | 1206 | OG1 | THR | A | 143 | −21.425 | 11.680 | 35.775 | 1.00 | 26.12 | O |
| ATOM | 1207 | CG2 | THR | A | 143 | −19.536 | 13.176 | 36.238 | 1.00 | 25.00 | C |
| ATOM | 1208 | N | LYS | A | 144 | −21.719 | 15.043 | 38.599 | 1.00 | 25.06 | N |
| ATOM | 1209 | CA | LYS | A | 144 | −21.379 | 16.309 | 39.250 | 1.00 | 25.53 | C |
| ATOM | 1210 | C | LYS | A | 144 | −21.159 | 16.115 | 40.746 | 1.00 | 30.01 | C |
| ATOM | 1211 | O | LYS | A | 144 | −20.166 | 16.596 | 41.305 | 1.00 | 28.38 | O |
| ATOM | 1212 | CB | LYS | A | 144 | −22.475 | 17.353 | 39.001 | 1.00 | 25.38 | C |
| ATOM | 1213 | CG | LYS | A | 144 | −22.157 | 18.732 | 39.586 | 1.00 | 24.34 | C |
| ATOM | 1214 | CD | LYS | A | 144 | −23.275 | 19.727 | 39.161 | 1.00 | 30.65 | C |
| ATOM | 1215 | CE | LYS | A | 144 | −23.074 | 21.111 | 39.724 | 1.00 | 45.85 | C |
| ATOM | 1216 | NZ | LYS | A | 144 | −23.286 | 21.115 | 41.189 | 1.00 | 55.46 | N |
| ATOM | 1217 | N | HIS | A | 145 | −22.067 | 15.394 | 41.411 | 1.00 | 29.93 | N |
| ATOM | 1218 | CA | HIS | A | 145 | −21.920 | 15.180 | 42.849 | 1.00 | 31.93 | C |
| ATOM | 1219 | C | HIS | A | 145 | −20.656 | 14.396 | 43.163 | 1.00 | 29.39 | C |
| ATOM | 1220 | O | HIS | A | 145 | −19.972 | 14.687 | 44.150 | 1.00 | 31.57 | O |
| ATOM | 1221 | CB | HIS | A | 145 | −23.141 | 14.449 | 43.407 | 1.00 | 34.65 | C |
| ATOM | 1222 | CG | HIS | A | 145 | −24.400 | 15.253 | 43.343 | 1.00 | 46.79 | C |
| ATOM | 1223 | ND1 | HIS | A | 145 | −25.646 | 14.678 | 43.223 | 1.00 | 53.35 | N |
| ATOM | 1224 | CD2 | HIS | A | 145 | −24.605 | 16.591 | 43.372 | 1.00 | 53.63 | C |
| ATOM | 1225 | CE1 | HIS | A | 145 | −26.566 | 15.626 | 43.187 | 1.00 | 53.33 | C |
| ATOM | 1226 | NE2 | HIS | A | 145 | −25.960 | 16.796 | 43.273 | 1.00 | 55.90 | N |
| ATOM | 1227 | N | LYS | A | 146 | −20.334 | 13.397 | 42.330 | 1.00 | 24.69 | N |
| ATOM | 1228 | CA | LYS | A | 146 | −19.130 | 12.606 | 42.547 | 1.00 | 28.15 | C |
| ATOM | 1229 | C | LYS | A | 146 | −17.895 | 13.474 | 42.397 | 1.00 | 26.59 | C |
| ATOM | 1230 | O | LYS | A | 146 | −16.969 | 13.396 | 43.210 | 1.00 | 27.21 | O |
| ATOM | 1231 | CB | LYS | A | 146 | −19.092 | 11.432 | 41.567 | 1.00 | 26.89 | C |
| ATOM | 1232 | CG | LYS | A | 146 | −17.835 | 10.586 | 41.655 | 1.00 | 30.06 | C |

TABLE 17-continued

| ATOM | 1233 | CD | LYS | A | 146 | −17.778 | 9.557 | 40.524 | 1.00 | 39.50 | C |
|---|---|---|---|---|---|---|---|---|---|---|---|
| ATOM | 1234 | CE | LYS | A | 146 | −18.862 | 8.503 | 40.647 | 1.00 | 46.46 | C |
| ATOM | 1235 | NZ | LYS | A | 146 | −18.704 | 7.421 | 39.615 | 1.00 | 53.83 | N |
| ATOM | 1236 | N | TRP | A | 147 | −17.887 | 14.343 | 41.388 | 1.00 | 25.50 | N |
| ATOM | 1237 | CA | TRP | A | 147 | −16.708 | 15.151 | 41.100 | 1.00 | 25.62 | C |
| ATOM | 1238 | C | TRP | A | 147 | −16.579 | 16.319 | 42.068 | 1.00 | 27.04 | C |
| ATOM | 1239 | O | TRP | A | 147 | −15.461 | 16.803 | 42.317 | 1.00 | 26.33 | O |
| ATOM | 1240 | CB | TRP | A | 147 | −16.755 | 15.628 | 39.646 | 1.00 | 25.53 | C |
| ATOM | 1241 | CG | TRP | A | 147 | −16.505 | 14.509 | 38.651 | 1.00 | 25.26 | C |
| ATOM | 1242 | CD1 | TRP | A | 147 | −16.334 | 13.172 | 38.935 | 1.00 | 23.25 | C |
| ATOM | 1243 | CD2 | TRP | A | 147 | −16.379 | 14.633 | 37.227 | 1.00 | 23.85 | C |
| ATOM | 1244 | NE1 | TRP | A | 147 | −16.100 | 12.468 | 37.777 | 1.00 | 23.56 | N |
| ATOM | 1245 | CE2 | TRP | A | 147 | −16.129 | 13.332 | 36.714 | 1.00 | 25.11 | C |
| ATOM | 1246 | CE3 | TRP | A | 147 | −16.462 | 15.712 | 36.336 | 1.00 | 26.62 | C |
| ATOM | 1247 | CZ2 | TRP | A | 147 | −15.975 | 13.077 | 35.346 | 1.00 | 25.16 | C |
| ATOM | 1248 | CZ3 | TRP | A | 147 | −16.292 | 15.466 | 34.977 | 1.00 | 27.10 | C |
| ATOM | 1249 | CH2 | TRP | A | 147 | −16.043 | 14.154 | 34.497 | 1.00 | 25.96 | C |
| ATOM | 1250 | N | GLU | A | 148 | −17.696 | 16.773 | 42.632 | 1.00 | 24.73 | N |
| ATOM | 1251 | CA | GLU | A | 148 | −17.614 | 17.747 | 43.713 | 1.00 | 27.22 | C |
| ATOM | 1252 | C | GLU | A | 148 | −16.985 | 17.119 | 44.949 | 1.00 | 30.68 | C |
| ATOM | 1253 | O | GLU | A | 148 | −16.096 | 17.709 | 45.564 | 1.00 | 28.23 | O |
| ATOM | 1254 | CB | GLU | A | 148 | −19.005 | 18.302 | 44.030 | 1.00 | 28.02 | C |
| ATOM | 1255 | CG | GLU | A | 148 | −19.531 | 19.255 | 42.951 | 1.00 | 25.61 | C |
| ATOM | 1256 | CD | GLU | A | 148 | −20.981 | 19.691 | 43.167 | 1.00 | 37.53 | C |
| ATOM | 1257 | OE1 | GLU | A | 148 | −21.389 | 20.707 | 42.570 | 1.00 | 37.17 | O |
| ATOM | 1258 | OE2 | GLU | A | 148 | −21.717 | 19.018 | 43.924 | 1.00 | 42.81 | O |
| ATOM | 1259 | N | ALA | A | 149 | −17.408 | 15.902 | 45.306 | 1.00 | 26.72 | N |
| ATOM | 1260 | CA | ALA | A | 149 | −16.877 | 15.273 | 46.509 | 1.00 | 27.16 | C |
| ATOM | 1261 | C | ALA | A | 149 | −15.389 | 14.986 | 46.364 | 1.00 | 28.78 | C |
| ATOM | 1262 | O | ALA | A | 149 | −14.648 | 15.029 | 47.357 | 1.00 | 29.82 | O |
| ATOM | 1263 | CB | ALA | A | 149 | −17.633 | 13.975 | 46.807 | 1.00 | 29.27 | C |
| ATOM | 1264 | N | ALA | A | 150 | −14.937 | 14.714 | 45.142 | 1.00 | 25.31 | N |
| ATOM | 1265 | CA | ALA | A | 150 | −13.537 | 14.382 | 44.889 | 1.00 | 29.17 | C |
| ATOM | 1266 | C | ALA | A | 150 | −12.687 | 15.591 | 44.521 | 1.00 | 26.50 | C |
| ATOM | 1267 | O | ALA | A | 150 | −11.509 | 15.413 | 44.180 | 1.00 | 26.98 | O |
| ATOM | 1268 | CB | ALA | A | 150 | −13.427 | 13.332 | 43.774 | 1.00 | 26.34 | C |
| ATOM | 1269 | N | HIS | A | 151 | −13.251 | 16.806 | 44.580 | 1.00 | 27.39 | N |
| ATOM | 1270 | CA | HIS | A | 151 | −12.490 | 18.036 | 44.354 | 1.00 | 26.12 | C |
| ATOM | 1271 | C | HIS | A | 151 | −11.848 | 18.061 | 42.969 | 1.00 | 26.27 | C |
| ATOM | 1272 | O | HIS | A | 151 | −10.726 | 18.555 | 42.796 | 1.00 | 25.13 | O |
| ATOM | 1273 | CB | HIS | A | 151 | −11.429 | 18.227 | 45.443 | 1.00 | 24.63 | C |
| ATOM | 1274 | CG | HIS | A | 151 | −12.004 | 18.475 | 46.803 | 1.00 | 33.53 | C |
| ATOM | 1275 | ND1 | HIS | A | 151 | −11.222 | 18.788 | 47.894 | 1.00 | 41.70 | N |
| ATOM | 1276 | CD2 | HIS | A | 151 | −13.285 | 18.481 | 47.243 | 1.00 | 39.26 | C |
| ATOM | 1277 | CE1 | HIS | A | 151 | −11.996 | 18.964 | 48.951 | 1.00 | 41.37 | C |
| ATOM | 1278 | NE2 | HIS | A | 151 | −13.252 | 18.782 | 48.583 | 1.00 | 39.08 | N |
| ATOM | 1279 | N | VAL | A | 152 | −12.578 | 17.549 | 41.973 | 1.00 | 21.43 | N |
| ATOM | 1280 | CA | VAL | A | 152 | −12.032 | 17.415 | 40.623 | 1.00 | 22.92 | C |
| ATOM | 1281 | C | VAL | A | 152 | −11.753 | 18.781 | 40.005 | 1.00 | 22.08 | C |
| ATOM | 1282 | O | VAL | A | 152 | −10.752 | 18.958 | 39.300 | 1.00 | 24.71 | O |
| ATOM | 1283 | CB | VAL | A | 152 | −12.976 | 16.576 | 39.734 | 1.00 | 24.46 | C |
| ATOM | 1284 | CG1 | VAL | A | 152 | −12.397 | 16.451 | 38.310 | 1.00 | 26.44 | C |
| ATOM | 1285 | CG2 | VAL | A | 152 | −13.152 | 15.160 | 40.337 | 1.00 | 24.62 | C |
| ATOM | 1286 | N | ALA | A | 153 | −12.636 | 19.761 | 40.232 | 1.00 | 21.64 | N |
| ATOM | 1287 | CA | ALA | A | 153 | −12.423 | 21.079 | 39.630 | 1.00 | 25.28 | C |
| ATOM | 1288 | C | ALA | A | 153 | −11.114 | 21.691 | 40.111 | 1.00 | 23.71 | C |
| ATOM | 1289 | O | ALA | A | 153 | −10.353 | 22.259 | 39.314 | 1.00 | 24.74 | O |
| ATOM | 1290 | CB | ALA | A | 153 | −13.595 | 22.011 | 39.947 | 1.00 | 26.74 | C |
| ATOM | 1291 | N | GLU | A | 154 | −10.818 | 21.555 | 41.407 | 1.00 | 23.77 | N |
| ATOM | 1292 | CA | GLU | A | 154 | −9.571 | 22.095 | 41.954 | 1.00 | 26.12 | C |
| ATOM | 1293 | C | GLU | A | 154 | −8.353 | 21.410 | 41.336 | 1.00 | 28.75 | C |
| ATOM | 1294 | O | GLU | A | 154 | −7.365 | 22.067 | 40.984 | 1.00 | 23.52 | O |
| ATOM | 1295 | CB | GLU | A | 154 | −9.584 | 21.932 | 43.471 | 1.00 | 27.46 | C |
| ATOM | 1296 | CG | GLU | A | 154 | −8.347 | 22.440 | 44.229 | 1.00 | 27.49 | C |
| ATOM | 1297 | CD | GLU | A | 154 | −8.409 | 22.056 | 45.716 | 1.00 | 34.34 | C |
| ATOM | 1298 | OE1 | GLU | A | 154 | −9.358 | 22.482 | 46.405 | 1.00 | 36.12 | O |
| ATOM | 1299 | OE2 | GLU | A | 154 | −7.529 | 21.301 | 46.190 | 1.00 | 38.70 | O |
| ATOM | 1300 | N | GLN | A | 155 | −8.413 | 20.092 | 41.184 | 1.00 | 25.49 | N |
| ATOM | 1301 | CA | GLN | A | 155 | −7.326 | 19.355 | 40.546 | 1.00 | 24.44 | C |
| ATOM | 1302 | C | GLN | A | 155 | −7.104 | 19.812 | 39.116 | 1.00 | 25.93 | C |
| ATOM | 1303 | O | GLN | A | 155 | −5.951 | 19.968 | 38.679 | 1.00 | 25.85 | O |
| ATOM | 1304 | CB | GLN | A | 155 | −7.618 | 17.853 | 40.571 | 1.00 | 20.20 | C |
| ATOM | 1305 | CG | GLN | A | 155 | −7.682 | 17.280 | 41.996 | 1.00 | 22.20 | C |
| ATOM | 1306 | CD | GLN | A | 155 | −8.072 | 15.792 | 42.005 | 1.00 | 26.47 | C |
| ATOM | 1307 | OE1 | GLN | A | 155 | −8.712 | 15.303 | 41.075 | 1.00 | 24.04 | O |
| ATOM | 1308 | NE2 | GLN | A | 155 | −7.673 | 15.074 | 43.058 | 1.00 | 26.35 | N |
| ATOM | 1309 | N | LEU | A | 156 | −8.189 | 19.987 | 38.358 | 1.00 | 23.29 | N |
| ATOM | 1310 | CA | LEU | A | 156 | −8.068 | 20.386 | 36.959 | 1.00 | 25.19 | C |
| ATOM | 1311 | C | LEU | A | 156 | −7.529 | 21.798 | 36.838 | 1.00 | 25.27 | C |
| ATOM | 1312 | O | LEU | A | 156 | −6.735 | 22.090 | 35.938 | 1.00 | 25.26 | O |

TABLE 17-continued

| | | | | | | | | | | |
|---|---|---|---|---|---|---|---|---|---|---|
| ATOM | 1313 | CB | LEU | A | 156 | −9.421 | 20.296 | 36.251 | 1.00 | 20.32 | C |
| ATOM | 1314 | CG | LEU | A | 156 | −9.859 | 18.885 | 35.863 | 1.00 | 23.79 | C |
| ATOM | 1315 | CD1 | LEU | A | 156 | −11.360 | 18.909 | 35.447 | 1.00 | 25.59 | C |
| ATOM | 1316 | CD2 | LEU | A | 156 | −8.969 | 18.295 | 34.750 | 1.00 | 27.28 | C |
| ATOM | 1317 | N | ARG | A | 157 | −7.970 | 22.681 | 37.730 | 1.00 | 23.72 | N |
| ATOM | 1318 | CA | ARG | A | 157 | −7.580 | 24.082 | 37.668 | 1.00 | 28.35 | C |
| ATOM | 1319 | C | ARG | A | 157 | −6.071 | 24.233 | 37.802 | 1.00 | 30.06 | C |
| ATOM | 1320 | O | ARG | A | 157 | −5.466 | 25.108 | 37.170 | 1.00 | 31.91 | O |
| ATOM | 1321 | CB | ARG | A | 157 | −8.335 | 24.836 | 38.766 | 1.00 | 32.72 | C |
| ATOM | 1322 | CG | ARG | A | 157 | −8.622 | 26.260 | 38.465 | 1.00 | 34.37 | C |
| ATOM | 1323 | CD | ARG | A | 157 | −9.607 | 26.856 | 39.446 | 1.00 | 28.24 | C |
| ATOM | 1324 | NE | ARG | A | 157 | −9.316 | 26.607 | 40.865 | 1.00 | 29.11 | N |
| ATOM | 1325 | CZ | ARG | A | 157 | −10.087 | 25.872 | 41.676 | 1.00 | 27.60 | C |
| ATOM | 1326 | NH1 | ARG | A | 157 | −11.182 | 25.276 | 41.208 | 1.00 | 25.90 | N |
| ATOM | 1327 | NH2 | ARG | A | 157 | −9.779 | 25.737 | 42.966 | 1.00 | 30.31 | N |
| ATOM | 1328 | N | ALA | A | 158 | −5.442 | 23.368 | 38.603 | 1.00 | 26.52 | N |
| ATOM | 1329 | CA | ALA | A | 158 | −3.989 | 23.403 | 38.745 | 1.00 | 29.41 | C |
| ATOM | 1330 | C | ALA | A | 158 | −3.292 | 23.216 | 37.399 | 1.00 | 30.17 | C |
| ATOM | 1331 | O | ALA | A | 158 | −2.235 | 23.812 | 37.146 | 1.00 | 28.24 | O |
| ATOM | 1332 | CB | ALA | A | 158 | −3.531 | 22.330 | 39.736 | 1.00 | 28.34 | C |
| ATOM | 1333 | N | TYR | A | 159 | −3.853 | 22.376 | 36.532 | 1.00 | 25.72 | N |
| ATOM | 1334 | CA | TYR | A | 159 | −3.286 | 22.188 | 35.201 | 1.00 | 25.31 | C |
| ATOM | 1335 | C | TYR | A | 159 | −3.722 | 23.304 | 34.261 | 1.00 | 25.16 | C |
| ATOM | 1336 | O | TYR | A | 159 | −2.885 | 23.949 | 33.619 | 1.00 | 26.48 | O |
| ATOM | 1337 | CB | TYR | A | 159 | −3.695 | 20.811 | 34.668 | 1.00 | 22.60 | C |
| ATOM | 1338 | CG | TYR | A | 159 | −3.467 | 20.548 | 33.188 | 1.00 | 26.18 | C |
| ATOM | 1339 | CD1 | TYR | A | 159 | −2.230 | 20.098 | 32.719 | 1.00 | 25.76 | C |
| ATOM | 1340 | CD2 | TYR | A | 159 | −4.506 | 20.692 | 32.265 | 1.00 | 25.05 | C |
| ATOM | 1341 | CE1 | TYR | A | 159 | −2.028 | 19.834 | 31.366 | 1.00 | 24.25 | C |
| ATOM | 1342 | CE2 | TYR | A | 159 | −4.310 | 20.435 | 30.918 | 1.00 | 27.40 | C |
| ATOM | 1343 | CZ | TYR | A | 159 | −3.071 | 20.003 | 30.476 | 1.00 | 24.06 | C |
| ATOM | 1344 | OH | TYR | A | 159 | −2.885 | 19.726 | 29.145 | 1.00 | 23.97 | O |
| ATOM | 1345 | N | LEU | A | 160 | −5.025 | 23.590 | 34.212 | 1.00 | 24.93 | N |
| ATOM | 1346 | CA | LEU | A | 160 | −5.541 | 24.505 | 33.195 | 1.00 | 23.70 | C |
| ATOM | 1347 | C | LEU | A | 160 | −5.008 | 25.928 | 33.368 | 1.00 | 27.98 | C |
| ATOM | 1348 | O | LEU | A | 160 | −4.789 | 26.633 | 32.373 | 1.00 | 29.29 | O |
| ATOM | 1349 | CB | LEU | A | 160 | −7.068 | 24.493 | 33.227 | 1.00 | 20.37 | C |
| ATOM | 1350 | CG | LEU | A | 160 | −7.720 | 23.138 | 32.918 | 1.00 | 22.18 | C |
| ATOM | 1351 | CD1 | LEU | A | 160 | −9.227 | 23.211 | 33.114 | 1.00 | 29.94 | C |
| ATOM | 1352 | CD2 | LEU | A | 160 | −7.396 | 22.727 | 31.490 | 1.00 | 26.78 | C |
| ATOM | 1353 | N | GLU | A | 161 | −4.768 | 26.329 | 34.619 | 1.00 | 25.31 | N |
| ATOM | 1354 | CA | GLU | A | 161 | −4.278 | 27.701 | 34.916 | 1.00 | 27.33 | C |
| ATOM | 1355 | C | GLU | A | 161 | −2.757 | 27.713 | 35.099 | 1.00 | 33.37 | C |
| ATOM | 1356 | O | GLU | A | 161 | −2.196 | 28.818 | 35.158 | 1.00 | 35.25 | O |
| ATOM | 1357 | CB | GLU | A | 161 | −4.909 | 28.225 | 36.206 | 1.00 | 27.77 | C |
| ATOM | 1358 | CG | GLU | A | 161 | −6.412 | 28.395 | 36.134 | 1.00 | 35.62 | C |
| ATOM | 1359 | CD | GLU | A | 161 | −7.015 | 29.045 | 37.367 | 1.00 | 41.06 | C |
| ATOM | 1360 | OE1 | GLU | A | 161 | −6.275 | 29.263 | 38.340 | 1.00 | 40.21 | O |
| ATOM | 1361 | OE2 | GLU | A | 161 | −8.220 | 29.332 | 37.347 | 1.00 | 49.85 | O |
| ATOM | 1362 | N | GLY | A | 162 | −2.120 | 26.542 | 35.188 | 1.00 | 33.64 | N |
| ATOM | 1363 | CA | GLY | A | 162 | −0.663 | 26.502 | 35.421 | 1.00 | 34.95 | C |
| ATOM | 1364 | C | GLY | A | 162 | 0.099 | 25.641 | 34.428 | 1.00 | 29.98 | C |
| ATOM | 1365 | C | GLY | A | 162 | 0.610 | 26.193 | 33.443 | 1.00 | 30.33 | O |
| ATOM | 1366 | N | THR | A | 163 | 0.175 | 24.332 | 34.690 | 1.00 | 26.22 | N |
| ATOM | 1367 | CA | THR | A | 163 | 0.927 | 23.368 | 33.840 | 1.00 | 25.74 | C |
| ATOM | 1368 | C | THR | A | 163 | 0.574 | 23.534 | 32.357 | 1.00 | 26.37 | C |
| ATOM | 1369 | O | THR | A | 163 | 1.503 | 23.546 | 31.537 | 1.00 | 27.00 | O |
| ATOM | 1370 | CB | THR | A | 163 | 0.696 | 21.926 | 34.303 | 1.00 | 29.33 | C |
| ATOM | 1371 | OG1 | THR | A | 163 | 0.915 | 21.891 | 35.711 | 1.00 | 37.61 | O |
| ATOM | 1372 | CG2 | THR | A | 163 | 1.609 | 20.935 | 33.617 | 1.00 | 33.67 | C |
| ATOM | 1373 | N | CYS | A | 164 | −0.718 | 23.612 | 32.033 | 1.00 | 23.98 | N |
| ATOM | 1374 | CA | CYS | A | 164 | −1.162 | 23.775 | 30.625 | 1.00 | 26.70 | C |
| ATOM | 1375 | C | CYS | A | 164 | −0.418 | 24.954 | 29.994 | 1.00 | 25.84 | C |
| ATOM | 1376 | O | CYS | A | 164 | 0.107 | 24.797 | 28.883 | 1.00 | 26.85 | O |
| ATOM | 1377 | CB | CYS | A | 164 | −2.660 | 24.060 | 30.571 | 1.00 | 33.14 | C |
| ATOM | 1378 | SG | CYS | A | 164 | −3.365 | 24.090 | 28.901 | 1.00 | 33.21 | S |
| ATOM | 1379 | N | VAL | A | 165 | −0.423 | 26.102 | 30.672 | 1.00 | 21.57 | N |
| ATOM | 1380 | CA | VAL | A | 165 | 0.185 | 27.315 | 30.131 | 1.00 | 24.50 | C |
| ATOM | 1381 | C | VAL | A | 165 | 1.693 | 27.146 | 30.031 | 1.00 | 26.92 | C |
| ATOM | 1382 | O | VAL | A | 165 | 2.320 | 27.604 | 29.070 | 1.00 | 26.80 | O |
| ATOM | 1383 | CB | VAL | A | 165 | −0.197 | 28.531 | 30.992 | 1.00 | 29.29 | C |
| ATOM | 1384 | CG1 | VAL | A | 165 | 0.603 | 29.757 | 30.569 | 1.00 | 34.63 | C |
| ATOM | 1385 | CG2 | VAL | A | 165 | −1.702 | 28.797 | 30.883 | 1.00 | 33.21 | C |
| ATOM | 1386 | N | GLU | A | 166 | 2.295 | 26.475 | 31.018 | 1.00 | 26.99 | N |
| ATOM | 1387 | CA | GLU | A | 166 | 3.735 | 26.232 | 30.968 | 1.00 | 29.27 | C |
| ATOM | 1388 | C | GLU | A | 166 | 4.105 | 25.394 | 29.752 | 1.00 | 26.98 | C |
| ATOM | 1389 | O | GLU | A | 166 | 5.058 | 25.727 | 29.038 | 1.00 | 27.31 | O |
| ATOM | 1390 | CB | GLU | A | 166 | 4.203 | 25.552 | 32.256 | 1.00 | 36.51 | C |
| ATOM | 1391 | CG | GLU | A | 166 | 4.134 | 26.457 | 33.497 | 1.00 | 39.57 | C |
| ATOM | 1392 | CD | GLU | A | 166 | 4.407 | 25.712 | 34.800 | 1.00 | 53.52 | C |

TABLE 17-continued

| | | | | | | | | | | |
|---|---|---|---|---|---|---|---|---|---|---|
| ATOM | 1393 | OE1 | GLU | A | 166 | 4.470 | 24.463 | 34.793 | 1.00 | 55.83 | O |
| ATOM | 1394 | OE2 | GLU | A | 166 | 4.558 | 26.385 | 35.842 | 1.00 | 63.82 | O |
| ATOM | 1395 | N | TRP | A | 167 | 3.345 | 24.324 | 29.477 | 1.00 | 26.44 | N |
| ATOM | 1396 | CA | TRP | A | 167 | 3.569 | 23.551 | 28.254 | 1.00 | 23.27 | C |
| ATOM | 1397 | C | TRP | A | 167 | 3.421 | 24.437 | 27.024 | 1.00 | 29.32 | C |
| ATOM | 1398 | O | TRP | A | 167 | 4.276 | 24.443 | 26.136 | 1.00 | 26.71 | O |
| ATOM | 1399 | CB | TRP | A | 167 | 2.582 | 22.383 | 28.161 | 1.00 | 22.73 | C |
| ATOM | 1400 | CG | TRP | A | 167 | 2.898 | 21.202 | 29.015 | 1.00 | 23.19 | C |
| ATOM | 1401 | CD1 | TRP | A | 167 | 2.112 | 20.662 | 29.997 | 1.00 | 28.34 | C |
| ATOM | 1402 | CD2 | TRP | A | 167 | 4.085 | 20.394 | 28.962 | 1.00 | 24.08 | C |
| ATOM | 1403 | NE1 | TRP | A | 167 | 2.738 | 19.571 | 30.560 | 1.00 | 29.58 | N |
| ATOM | 1404 | CE2 | TRP | A | 167 | 3.949 | 19.387 | 29.948 | 1.00 | 27.24 | C |
| ATOM | 1405 | CE3 | TRP | A | 167 | 5.247 | 20.422 | 28.177 | 1.00 | 28.13 | C |
| ATOM | 1406 | CZ2 | TRP | A | 167 | 4.935 | 18.407 | 30.167 | 1.00 | 28.29 | C |
| ATOM | 1407 | CZ3 | TRP | A | 167 | 6.232 | 19.451 | 28.402 | 1.00 | 33.81 | C |
| ATOM | 1408 | CH2 | TRP | A | 167 | 6.060 | 18.459 | 29.386 | 1.00 | 30.57 | C |
| ATOM | 1409 | N | LEU | A | 168 | 2.319 | 25.179 | 26.945 | 1.00 | 24.45 | N |
| ATOM | 1410 | CA | LEU | A | 168 | 2.079 | 26.007 | 25.769 | 1.00 | 26.17 | C |
| ATOM | 1411 | C | LEU | A | 168 | 3.236 | 26.975 | 25.518 | 1.00 | 28.37 | C |
| ATOM | 1412 | O | LEU | A | 168 | 3.700 | 27.115 | 24.380 | 1.00 | 28.65 | O |
| ATOM | 1413 | CB | LEU | A | 168 | 0.739 | 26.739 | 25.915 | 1.00 | 25.14 | C |
| ATOM | 1414 | CG | LEU | A | 168 | 0.339 | 27.681 | 24.784 | 1.00 | 29.28 | C |
| ATOM | 1415 | CD1 | LEU | A | 168 | 0.405 | 27.002 | 23.397 | 1.00 | 28.51 | C |
| ATOM | 1416 | CD2 | LEU | A | 168 | −1.056 | 28.229 | 25.076 | 1.00 | 24.93 | C |
| ATOM | 1417 | N | ARG | A | 169 | 3.727 | 27.644 | 26.569 | 1.00 | 26.75 | N |
| ATOM | 1418 | CA | ARG | A | 169 | 4.849 | 28.567 | 26.399 | 1.00 | 28.78 | C |
| ATOM | 1419 | C | ARG | A | 169 | 6.095 | 27.840 | 25.909 | 1.00 | 31.28 | C |
| ATOM | 1420 | O | ARG | A | 169 | 6.880 | 28.385 | 25.117 | 1.00 | 31.00 | O |
| ATOM | 1421 | CB | ARG | A | 169 | 5.132 | 29.295 | 27.717 | 1.00 | 31.27 | C |
| ATOM | 1422 | CG | ARG | A | 169 | 4.024 | 30.272 | 28.095 | 1.00 | 31.52 | C |
| ATOM | 1423 | CD | ARG | A | 169 | 4.461 | 31.336 | 29.106 | 1.00 | 41.24 | C |
| ATOM | 1424 | NE | ARG | A | 169 | 4.321 | 30.879 | 30.480 | 1.00 | 54.40 | N |
| ATOM | 1425 | CZ | ARG | A | 169 | 3.579 | 31.477 | 31.410 | 1.00 | 62.28 | C |
| ATOM | 1426 | NH1 | ARG | A | 169 | 2.900 | 32.583 | 31.133 | 1.00 | 55.16 | N |
| ATOM | 1427 | NH2 | ARG | A | 169 | 3.52€ | 30.963 | 32.633 | 1.00 | 72.02 | N |
| ATOM | 1428 | N | ARG | A | 170 | 6.303 | 26.615 | 26.387 | 1.00 | 30.13 | N |
| ATOM | 1429 | CA | ARG | A | 170 | 7.448 | 25.829 | 25.941 | 1.00 | 30.29 | C |
| ATOM | 1430 | C | ARG | A | 170 | 7.334 | 25.524 | 24.452 | 1.00 | 25.81 | C |
| ATOM | 1431 | O | ARG | A | 170 | 8.285 | 25.740 | 23.686 | 1.00 | 31.33 | O |
| ATOM | 1432 | CB | ARG | A | 170 | 7.529 | 24.548 | 26.767 | 1.00 | 29.60 | C |
| ATOM | 1433 | CG | ARG | A | 170 | 8.577 | 23.556 | 26.311 | 1.00 | 31.74 | C |
| ATOM | 1434 | CD | ARG | A | 170 | 8.437 | 22.259 | 27.108 | 1.00 | 38.35 | C |
| ATOM | 1435 | NE | ARG | A | 170 | 9.459 | 21.279 | 26.745 | 1.00 | 46.89 | N |
| ATOM | 1436 | CZ | ARG | A | 170 | 10.695 | 21.267 | 27.235 | 1.00 | 59.13 | C |
| ATOM | 1437 | NH1 | ARG | A | 170 | 11.075 | 22.194 | 28.109 | 1.00 | 68.29 | N |
| ATOM | 1438 | NH2 | ARG | A | 170 | 11.557 | 20.331 | 26.847 | 1.00 | 49.91 | N |
| ATOM | 1439 | N | TYR | A | 171 | 6.147 | 25.079 | 24.017 | 1.00 | 27.89 | N |
| ATOM | 1440 | CA | TYR | A | 171 | 5.938 | 24.756 | 22.608 | 1.00 | 26.71 | C |
| ATOM | 1441 | C | TYR | A | 171 | 6.039 | 25.988 | 21.712 | 1.00 | 30.33 | C |
| ATOM | 1442 | O | TYR | A | 171 | 6.629 | 25.918 | 20.627 | 1.00 | 35.50 | O |
| ATOM | 1443 | CB | TYR | A | 171 | 4.584 | 24.066 | 22.425 | 1.00 | 25.36 | C |
| ATOM | 1444 | CG | TYR | A | 171 | 4.421 | 22.781 | 23.197 | 1.00 | 27.49 | C |
| ATOM | 1445 | CD1 | TYR | A | 171 | 5.517 | 21.964 | 23.501 | 1.00 | 27.56 | C |
| ATOM | 1446 | CD2 | TYR | A | 171 | 3.154 | 22.378 | 23.623 | 1.00 | 23.80 | C |
| ATOM | 1447 | CE1 | TYR | A | 171 | 5.349 | 20.776 | 24.223 | 1.00 | 26.23 | C |
| ATOM | 1448 | CE2 | TYR | A | 171 | 2.974 | 21.195 | 24.324 | 1.00 | 27.25 | C |
| ATOM | 1449 | CZ | TYR | A | 171 | 4.062 | 20.396 | 24.611 | 1.00 | 28.66 | C |
| ATOM | 1450 | OH | TYR | A | 171 | 3.843 | 19.238 | 25.311 | 1.00 | 25.81 | O |
| ATOM | 1451 | N | LEU | A | 172 | 5.497 | 27.132 | 22.154 | 1.00 | 28.35 | N |
| ATOM | 1452 | CA | LEU | A | 172 | 5.560 | 28.342 | 21.339 | 1.00 | 28.91 | C |
| ATOM | 1453 | C | LEU | A | 172 | 6.996 | 28.788 | 21.128 | 1.00 | 32.49 | C |
| ATOM | 1454 | O | LEU | A | 172 | 7.326 | 29.361 | 20.085 | 1.00 | 37.00 | O |
| ATOM | 1455 | CB | LEU | A | 172 | 4.758 | 29.469 | 21.992 | 1.00 | 31.54 | C |
| ATOM | 1456 | CG | LEU | A | 172 | 3.236 | 29.275 | 22.039 | 1.00 | 32.58 | C |
| ATOM | 1457 | CD1 | LEU | A | 172 | 2.572 | 30.274 | 22.999 | 1.00 | 28.92 | C |
| ATOM | 1458 | CD2 | LEU | A | 172 | 2.648 | 29.403 | 20.634 | 1.00 | 31.69 | C |
| ATOM | 1459 | N | GLU | A | 173 | 7.855 | 28.559 | 22.115 | 1.00 | 29.46 | N |
| ATOM | 1460 | CA | GLU | A | 173 | 9.260 | 28.907 | 21.956 | 1.00 | 36.90 | C |
| ATOM | 1461 | C | GLU | A | 173 | 9.955 | 27.920 | 21.027 | 1.00 | 35.85 | C |
| ATOM | 1462 | O | GLU | A | 173 | 10.611 | 28.319 | 20.056 | 1.00 | 37.10 | O |
| ATOM | 1463 | CB | GLU | A | 173 | 9.946 | 28.945 | 23.325 | 1.00 | 38.68 | C |
| ATOM | 1464 | CG | GLU | A | 173 | 11.362 | 29.522 | 23.297 | 1.00 | 48.44 | C |
| ATOM | 1465 | CD | GLU | A | 173 | 11.395 | 30.984 | 22.876 | 0.00 | 60.46 | C |
| ATOM | 1466 | OE1 | GLU | A | 173 | 10.61 | 31.808 | 23.410 | 1.00 | 68.78 | O |
| ATOM | 1467 | OE2 | GLU | A | 173 | 12.209 | 31.315 | 21.999 | 0.85 | 64.90 | O |
| ATOM | 1468 | N | ASN | A | 174 | 9.786 | 26.620 | 21.291 | 1.00 | 36.92 | N |
| ATOM | 1469 | CA | ASN | A | 174 | 10.475 | 25.594 | 20.512 | 1.00 | 37.25 | C |
| ATOM | 1470 | C | ASN | A | 174 | 9.983 | 25.551 | 19.069 | 1.00 | 39.99 | C |
| ATOM | 1471 | O | ASN | A | 174 | 10.775 | 25.316 | 18.151 | 1.00 | 41.07 | O |
| ATOM | 1472 | CB | ASN | A | 174 | 10.303 | 24.232 | 21.179 | 1.00 | 35.43 | C |

TABLE 17-continued

| | | | | | | | | | | |
|---|---|---|---|---|---|---|---|---|---|---|
| ATOM | 1473 | CG | ASN | A | 174 | 11.070 | 24.127 | 22.479 | 1.00 | 40.49 | C |
| ATOM | 1474 | OD1 | ASN | A | 174 | 11.902 | 24.986 | 22.789 | 1.00 | 51.64 | O |
| ATOM | 1475 | ND2 | ASN | A | 174 | 10.816 | 23.068 | 23.237 | 1.00 | 38.30 | N |
| ATOM | 1476 | N | GLY | A | 175 | 8.689 | 25.769 | 18.846 | 1.00 | 34.16 | N |
| ATOM | 1477 | CA | GLY | A | 175 | 8.161 | 25.798 | 17.496 | 1.00 | 35.88 | C |
| ATOM | 1478 | C | GLY | A | 175 | 7.972 | 27.190 | 16.927 | 1.00 | 44.39 | C |
| ATOM | 1479 | O | GLY | A | 175 | 7.140 | 27.388 | 16.033 | 1.00 | 45.11 | O |
| ATOM | 1480 | N | LYS | A | 176 | 8.748 | 28.160 | 17.424 | 1.00 | 42.82 | N |
| ATOM | 1481 | CA | LYS | A | 176 | 8.498 | 29.560 | 17.085 | 1.00 | 47.01 | C |
| ATOM | 1482 | C | LYS | A | 176 | 8.486 | 29.797 | 15.578 | 1.00 | 53.55 | C |
| ATOM | 1483 | O | LYS | A | 176 | 7.760 | 30.675 | 15.099 | 1.00 | 53.69 | O |
| ATOM | 1484 | CB | LYS | A | 176 | 9.543 | 30.460 | 17.749 | 1.00 | 46.85 | C |
| ATOM | 1485 | CG | LYS | A | 176 | 10.937 | 30.336 | 17.140 | 1.00 | 51.10 | C |
| ATOM | 1486 | CD | LYS | A | 176 | 11.892 | 31.420 | 17.631 | 1.00 | 55.88 | C |
| ATOM | 1487 | CE | LYS | A | 176 | 12.431 | 31.105 | 19.007 | 0.00 | 58.78 | C |
| ATOM | 1488 | NZ | LYS | A | 176 | 13.107 | 29.782 | 19.077 | 1.00 | 64.24 | N |
| ATOM | 1489 | N | GLU | A | 177 | 9.265 | 29.025 | 14.813 | 1.00 | 55.26 | N |
| ATOM | 1490 | CA | GLU | A | 177 | 9.306 | 29.226 | 13.367 | 1.00 | 63.01 | C |
| ATOM | 1491 | C | GLU | A | 177 | 8.056 | 28.686 | 12.684 | 1.00 | 67.90 | C |
| ATOM | 1492 | O | GLU | A | 177 | 7.670 | 29.189 | 11.623 | 1.00 | 76.93 | O |
| ATOM | 1493 | CB | GLU | A | 177 | 10.560 | 28.577 | 12.781 | 1.00 | 67.96 | C |
| ATOM | 1494 | CG | GLU | A | 177 | 11.837 | 28.960 | 13.504 | 1.00 | 72.34 | C |
| ATOM | 1495 | CD | GLU | A | 177 | 13.077 | 28.715 | 12.672 | 0.00 | 79.31 | C |
| ATOM | 1496 | OE1 | GLU | A | 177 | 12.968 | 28.728 | 11.428 | 1.00 | 83.40 | O |
| ATOM | 1497 | OE2 | GLU | A | 177 | 14.159 | 28.509 | 13.261 | 1.00 | 82.53 | O |
| ATOM | 1498 | N | THR | A | 178 | 7.414 | 27.678 | 13.271 | 1.00 | 64.34 | N |
| ATOM | 1499 | CA | THR | A | 178 | 6.147 | 27.158 | 12.771 | 1.00 | 65.44 | C |
| ATOM | 1500 | C | THR | A | 178 | 4.955 | 27.913 | 13.351 | 1.00 | 60.04 | C |
| ATOM | 1501 | O | THR | A | 178 | 4.108 | 28.418 | 12.610 | 1.00 | 62.79 | O |
| ATOM | 1502 | CB | THR | A | 178 | 6.020 | 25.668 | 13.109 | 1.00 | 68.19 | C |
| ATOM | 1503 | OG1 | THR | A | 178 | 7.011 | 24.921 | 12.395 | 1.00 | 73.71 | O |
| ATOM | 1504 | CG2 | THR | A | 178 | 4.623 | 25.142 | 12.759 | 1.00 | 69.74 | C |
| ATOM | 1505 | N | LEU | A | 179 | 4.904 | 28.023 | 14.676 | 1.00 | 44.68 | N |
| ATOM | 1506 | CA | LEU | A | 179 | 3.682 | 28.408 | 15.368 | 1.00 | 41.14 | C |
| ATOM | 1507 | C | LEU | A | 179 | 3.429 | 29.905 | 15.349 | 1.00 | 46.23 | C |
| ATOM | 1508 | O | LEU | A | 179 | 2.268 | 30.329 | 15.366 | 1.00 | 45.40 | O |
| ATOM | 1509 | CB | LEU | A | 179 | 3.743 | 27.909 | 16.806 | 1.00 | 37.13 | C |
| ATOM | 1510 | CG | LEU | A | 179 | 3.780 | 26.386 | 16.875 | 1.00 | 38.57 | C |
| ATOM | 1511 | CD1 | LEU | A | 179 | 3.964 | 25.905 | 18.304 | 1.00 | 37.79 | C |
| ATOM | 1512 | CD2 | LEU | A | 179 | 2.491 | 25.859 | 16.288 | 1.00 | 32.32 | C |
| ATOM | 1513 | N | GLN | A | 180 | 4.479 | 30.721 | 15.332 | 1.00 | 47.67 | N |
| ATOM | 1514 | CA | GLN | A | 180 | 4.316 | 32.162 | 15.417 | 1.00 | 52.13 | C |
| ATOM | 1515 | C | GLN | A | 180 | 4.372 | 32.830 | 14.051 | 1.00 | 59.35 | C |
| ATOM | 1516 | O | GLN | A | 180 | 4.541 | 34.051 | 13.969 | 1.00 | 69.31 | O |
| ATOM | 1517 | CB | GLN | A | 180 | 5.361 | 32.743 | 16.364 | 1.00 | 48.65 | C |
| ATOM | 1518 | CG | GLN | A | 180 | 5.341 | 32.091 | 17.749 | 1.00 | 49.64 | C |
| ATOM | 1519 | CD | GLN | A | 180 | 6.194 | 32.845 | 18.750 | 1.00 | 54.26 | C |
| ATOM | 1520 | OE1 | GLN | A | 180 | 6.052 | 34.060 | 18.903 | 1.00 | 60.85 | O |
| ATOM | 1521 | NE2 | GLN | A | 180 | 7.096 | 32.133 | 19.429 | 1.00 | 40.44 | N |
| ATOM | 1522 | N | ARG | A | 181 | 4.220 | 32.052 | 12.985 | 1.00 | 60.53 | N |
| ATOM | 1523 | CA | ARG | A | 181 | 4.164 | 32.560 | 11.623 | 1.00 | 62.47 | C |
| ATOM | 1524 | C | ARG | A | 181 | 2.734 | 32.931 | 11.257 | 1.00 | 63.24 | C |
| ATOM | 1525 | O | ARG | A | 181 | 1.770 | 32.410 | 11.823 | 1.00 | 57.78 | O |
| ATOM | 1526 | CB | ARG | A | 181 | 4.678 | 31.510 | 10.635 | 1.00 | 65.02 | C |
| ATOM | 1527 | CG | ARG | A | 181 | 3.601 | 30.513 | 10.189 | 1.00 | 61.60 | C |
| ATOM | 1528 | CD | ARG | A | 181 | 4.179 | 29.314 | 9.455 | 1.00 | 61.89 | C |
| ATOM | 1529 | NE | ARG | A | 181 | 3.148 | 28.577 | 8.722 | 1.00 | 65.73 | N |
| ATOM | 1530 | CZ | ARG | A | 181 | 2.504 | 27.507 | 9.185 | 1.00 | 65.91 | C |
| ATOM | 1531 | NH1 | ARG | A | 181 | 1.586 | 26.910 | 8.437 | 1.00 | 69.41 | N |
| ATOM | 1532 | NH2 | ARG | A | 181 | 2.775 | 27.028 | 10.391 | 1.00 | 57.39 | N |
| ATOM | 1533 | N | THR | A | 182 | 2.606 | 33.848 | 10.301 | 1.00 | 65.50 | N |
| ATOM | 1534 | CA | THR | A | 182 | 1.328 | 34.159 | 9.671 | 1.00 | 66.28 | C |
| ATOM | 1535 | C | THR | A | 182 | 1.536 | 34.151 | 8.164 | 1.00 | 69.96 | C |
| ATOM | 1536 | O | THR | A | 182 | 2.338 | 34.934 | 7.645 | 1.00 | 75.59 | O |
| ATOM | 1537 | CB | THR | A | 182 | 0.777 | 35.514 | 10.132 | 1.00 | 67.27 | C |
| ATOM | 1538 | OG1 | THR | A | 182 | 1.788 | 36.520 | 9.991 | 1.00 | 73.34 | O |
| ATOM | 1539 | CG2 | THR | A | 182 | 0.324 | 35.449 | 11.584 | 1.00 | 62.76 | C |
| ATOM | 1540 | N | ASP | A | 183 | 0.836 | 33.258 | 7.470 | 1.00 | 65.38 | N |
| ATOM | 1541 | CA | ASP | A | 183 | 0.866 | 33.186 | 6.014 | 1.00 | 63.64 | C |
| ATOM | 1542 | C | ASP | A | 183 | −0.378 | 33.869 | 5.462 | 1.00 | 59.49 | C |
| ATOM | 1543 | O | ASP | A | 183 | −1.503 | 33.426 | 5.726 | 1.00 | 59.72 | O |
| ATOM | 1544 | CB | ASP | A | 183 | 0.937 | 31.739 | 5.530 | 1.00 | 67.20 | C |
| ATOM | 1545 | CG | ASP | A | 183 | 2.173 | 31.021 | 6.015 | 1.00 | 72.05 | C |
| ATOM | 1546 | OD1 | ASP | A | 183 | 3.161 | 31.699 | 6.371 | 1.00 | 75.73 | O |
| ATOM | 1547 | OD2 | ASP | A | 183 | 2.157 | 29.773 | 6.035 | 1.00 | 74.48 | O |
| ATOM | 1548 | N | ALA | A | 184 | −0.176 | 34.940 | 4.697 | 1.00 | 60.59 | N |
| ATOM | 1549 | CA | ALA | A | 184 | −1.300 | 35.693 | 4.168 | 1.00 | 61.48 | C |
| ATOM | 1550 | C | ALA | A | 184 | −1.972 | 34.923 | 3.030 | 1.00 | 59.97 | C |
| ATOM | 1551 | O | ALA | A | 184 | −1.325 | 34.130 | 2.337 | 1.00 | 60.53 | O |
| ATOM | 1552 | CB | ALA | A | 184 | −0.843 | 37.065 | 3.678 | 1.00 | 61.93 | C |

TABLE 17-continued

| | | | | | | | | | | |
|---|---|---|---|---|---|---|---|---|---|---|
| ATOM | 1553 | N | PRO | A | 185 | −3.286 | 35.132 | 2.824 | 1.00 | 61.99 N |
| ATOM | 1554 | CA | PRO | A | 185 | −3.999 | 34.394 | 1.769 | 1.00 | 69.55 C |
| ATOM | 1555 | C | PRO | A | 185 | −3.570 | 34.793 | 0.365 | 1.00 | 83.54 C |
| ATOM | 1556 | O | PRO | A | 185 | −2.597 | 35.532 | 0.181 | 1.00 | 86.59 O |
| ATOM | 1557 | CB | PRO | A | 185 | −5.471 | 34.754 | 2.014 | 1.00 | 67.94 C |
| ATOM | 1558 | CG | PRO | A | 185 | −5.520 | 35.364 | 3.386 | 1.00 | 68.49 C |
| ATOM | 1559 | CD | PRO | A | 185 | −4.189 | 36.004 | 3.594 | 1.00 | 64.15 C |
| ATOM | 1560 | N | LYS | A | 186 | −4.308 | 34.321 | −0.638 | 1.00 | 91.55 N |
| ATOM | 1561 | CA | LYS | A | 186 | −4.005 | 34.550 | −2.043 | 1.00 | 90.82 C |
| ATOM | 1562 | C | LYS | A | 186 | −5.130 | 35.357 | −2.699 | 1.00 | 92.76 C |
| ATOM | 1563 | O | LYS | A | 186 | −5.842 | 36.106 | −2.012 | 1.00 | 90.69 O |
| ATOM | 1564 | CB | LYS | A | 186 | −3.745 | 33.200 | −2.712 | 1.00 | 85.29 C |
| ATOM | 1565 | CG | LYS | A | 186 | −2.285 | 32.932 | −2.969 | 1.00 | 83.88 C |
| ATOM | 1566 | CD | LYS | A | 186 | −1.446 | 33.169 | −1.723 | 1.00 | 81.98 C |
| ATOM | 1567 | CE | LYS | A | 186 | 0.029 | 33.012 | −2.024 | 1.00 | 82.47 C |
| ATOM | 1568 | NZ | LYS | A | 186 | 0.285 | 31.699 | −2.667 | 1.00 | 82.97 N |
| ATOM | 1569 | N | THR | A | 187 | −5.275 | 35.222 | −4.012 | 1.00 | 96.61 N |
| ATOM | 1570 | CA | THR | A | 187 | −6.304 | 35.940 | −4.746 | 1.00 | 106.81 C |
| ATOM | 1571 | C | THR | A | 187 | −6.738 | 35.076 | −5.922 | 1.00 | 108.48 C |
| ATOM | 1572 | O | THR | A | 187 | −5.903 | 34.439 | −6.572 | 1.00 | 109.56 O |
| ATOM | 1573 | CB | THR | A | 187 | −5.802 | 37.318 | −5.222 | 1.00 | 117.09 C |
| ATOM | 1574 | OG1 | THR | A | 187 | −6.574 | 38.352 | −4.598 | 1.00 | 122.61 O |
| ATOM | 1575 | CG2 | THR | A | 187 | −5.904 | 37.476 | −6.742 | 1.00 | 118.48 C |
| ATOM | 1576 | N | HIS | A | 188 | −8.048 | 35.042 | −6.171 | 1.00 | 108.84 N |
| ATOM | 1577 | CA | HIS | A | 188 | −8.663 | 34.280 | −7.251 | 1.00 | 109.29 C |
| ATOM | 1578 | C | HIS | A | 188 | −10.113 | 34.721 | −7.373 | 1.00 | 105.65 C |
| ATOM | 1579 | O | HIS | A | 188 | −10.793 | 34.905 | −6.358 | 1.00 | 104.01 O |
| ATOM | 1580 | CB | HIS | A | 188 | −8.644 | 32.768 | −6.984 | 1.00 | 114.40 C |
| ATOM | 1581 | CG | HIS | A | 188 | −7.435 | 32.044 | −7.484 | 1.00 | 120.69 C |
| ATOM | 1582 | ND1 | HIS | A | 188 | −7.303 | 31.628 | −8.791 | 1.00 | 124.15 N |
| ATOM | 1583 | CD2 | HIS | A | 188 | −6.339 | 31.585 | −6.833 | 1.00 | 121.32 C |
| ATOM | 1584 | CE1 | HIS | A | 188 | −6.158 | 30.984 | −8.934 | 1.00 | 124.88 C |
| ATOM | 1585 | NE2 | HIS | A | 188 | −5.553 | 30.945 | −7.760 | 1.00 | 122.75 N |
| ATOM | 1586 | N | MET | A | 189 | −10.588 | 34.853 | −8.606 | 1.00 | 104.17 N |
| ATOM | 1587 | CA | MET | A | 189 | −12.007 | 35.090 | −8.856 | 1.00 | 100.24 C |
| ATOM | 1588 | C | MET | A | 189 | −12.495 | 34.233 | −10.020 | 1.00 | 95.77 C |
| ATOM | 1589 | O | MET | A | 189 | −11.692 | 33.735 | −10.811 | 1.00 | 93.09 O |
| ATOM | 1590 | CB | MET | A | 189 | −12.282 | 36.569 | −9.135 | 1.00 | 103.95 C |
| ATOM | 1591 | CG | MET | A | 189 | −12.336 | 37.443 | −7.891 | 1.00 | 105.12 C |
| ATOM | 1592 | SD | MET | A | 189 | −13.622 | 38.707 | −7.993 | 1.00 | 106.80 S |
| ATOM | 1593 | CE | MET | A | 189 | −15.042 | 37.816 | −7.359 | 1.00 | 106.02 C |
| ATOM | 1594 | N | CYS | A | 203 | −14.635 | 34.030 | −5.235 | 1.00 | 83.08 N |
| ATOM | 1595 | CA | CYS | A | 203 | −13.519 | 34.551 | −4.451 | 1.00 | 85.96 C |
| ATOM | 1596 | C | CYS | A | 203 | −12.805 | 33.394 | −3.746 | 1.00 | 83.27 C |
| ATOM | 1597 | O | CYS | A | 203 | −13.424 | 32.669 | −2.974 | 1.00 | 75.37 O |
| ATOM | 1598 | CB | CYS | A | 203 | −14.019 | 35.591 | −3.437 | 1.00 | 93.75 C |
| ATOM | 1599 | SG | CYS | A | 203 | −12.814 | 36.871 | −2.975 | 1.00 | 106.34 S |
| ATOM | 1600 | N | TRP | A | 204 | −11.511 | 33.222 | −4.020 | 1.00 | 85.52 N |
| ATOM | 1601 | CA | TRP | A | 204 | −10.714 | 32.141 | −3.449 | 1.00 | 87.89 C |
| ATOM | 1602 | C | TRP | A | 204 | −9.617 | 32.694 | −2.549 | 1.00 | 87.21 C |
| ATOM | 1603 | O | TRP | A | 204 | −8.943 | 33.666 | −2.906 | 1.00 | 96.49 O |
| ATOM | 1604 | CB | TRP | A | 204 | −10.045 | 31.300 | −4.531 | 1.00 | 89.13 C |
| ATOM | 1605 | CG | TRP | A | 204 | −10.878 | 30.331 | −5.268 | 1.00 | 91.27 C |
| ATOM | 1606 | CD1 | TRP | A | 204 | −11.746 | 30.590 | −6.287 | 1.00 | 90.90 C |
| ATOM | 1607 | CD2 | TRP | A | 204 | −10.871 | 28.914 | −5.094 | 1.00 | 95.14 C |
| ATOM | 1608 | NE1 | TRP | A | 204 | −12.304 | 29.417 | −6.739 | 1.00 | 94.03 N |
| ATOM | 1609 | CE2 | TRP | A | 204 | −11.781 | 28.374 | −6.020 | 1.00 | 96.64 C |
| ATOM | 1610 | CE3 | TRP | A | 204 | −10.195 | 28.048 | −4.228 | 1.00 | 91.85 C |
| ATOM | 1611 | CZ2 | TRP | A | 204 | −12.031 | 27.006 | −6.106 | 1.00 | 96.77 C |
| ATOM | 1612 | CZ3 | TRP | A | 204 | −10.443 | 26.695 | −4.316 | 1.00 | 90.54 C |
| ATOM | 1613 | CH2 | TRP | A | 204 | −11.353 | 26.186 | −5.247 | 1.00 | 94.01 C |
| ATOM | 1614 | N | ALA | A | 205 | −9.407 | 32.041 | −1.409 | 1.00 | 76.66 N |
| ATOM | 1615 | CA | ALA | A | 205 | −8.265 | 32.303 | −0.541 | 1.00 | 66.53 C |
| ATOM | 1616 | C | ALA | A | 205 | −7.544 | 30.983 | −0.298 | 1.00 | 62.50 C |
| ATOM | 1617 | O | ALA | A | 205 | −8.140 | 30.035 | 0.225 | 1.00 | 58.27 O |
| ATOM | 1618 | CB | ALA | A | 205 | −8.703 | 32.936 | 0.781 | 1.00 | 63.14 C |
| ATOM | 1619 | N | LEU | A | 206 | −6.271 | 30.918 | −0.682 | 1.00 | 61.11 N |
| ATOM | 1620 | CA | LEU | A | 206 | −5.494 | 29.691 | −0.604 | 1.00 | 63.16 C |
| ATOM | 1621 | C | LEU | A | 206 | −4.254 | 29.882 | 0.260 | 1.00 | 63.21 C |
| ATOM | 1622 | O | LEU | A | 206 | −3.740 | 30.996 | 0.409 | 1.00 | 60.34 O |
| ATOM | 1623 | CB | LEU | A | 206 | −5.058 | 29.207 | −1.996 | 1.00 | 66.13 C |
| ATOM | 1624 | CG | LEU | A | 206 | −6.126 | 28.736 | −2.987 | 1.00 | 71.42 C |
| ATOM | 1625 | CD1 | LEU | A | 206 | −5.496 | 28.408 | −4.336 | 1.00 | 73.87 C |
| ATOM | 1626 | CD2 | LEU | A | 206 | −6.869 | 27.531 | −2.441 | 1.00 | 67.57 C |
| ATOM | 1627 | N | SER | A | 207 | −3.798 | 28.771 | 0.845 | 1.00 | 57.82 N |
| ATOM | 1628 | CA | SER | A | 207 | −2.451 | 28.657 | 1.404 | 1.00 | 58.91 C |
| ATOM | 1629 | C | SER | A | 207 | −2.211 | 29.620 | 2.569 | 1.00 | 58.11 C |
| ATOM | 1630 | O | SER | A | 207 | −1.132 | 30.201 | 2.699 | 1.00 | 63.65 O |
| ATOM | 1631 | CB | SER | A | 207 | −1.402 | 28.867 | 0.308 | 1.00 | 66.60 C |
| ATOM | 1632 | OG | SER | A | 207 | −0.111 | 29.044 | 0.860 | 1.00 | 73.32 O |

TABLE 17-continued

| | | | | | | | | | | |
|---|---|---|---|---|---|---|---|---|---|---|
| ATOM | 1633 | N | PHE | A | 208 | −3.205 | 29.792 | 3.432 | 1.00 | 53.00 N |
| ATOM | 1634 | CA | PHE | A | 208 | −3.064 | 30.723 | 4.540 | 1.00 | 52.17 C |
| ATOM | 1635 | C | PHE | A | 208 | −3.000 | 29.991 | 5.879 | 1.00 | 49.81 C |
| ATOM | 1636 | O | PHE | A | 208 | −3.379 | 28.819 | 6.001 | 1.00 | 42.00 O |
| ATOM | 1637 | CB | PHE | A | 208 | −4.198 | 31.759 | 4.542 | 1.00 | 54.27 C |
| ATOM | 1638 | CG | PHE | A | 208 | −5.582 | 31.173 | 4.603 | 1.00 | 55.22 C |
| ATOM | 1639 | CD1 | PHE | A | 208 | −6.264 | 30.843 | 3.440 | 1.00 | 56.95 C |
| ATOM | 1640 | CD2 | PHE | A | 208 | −6.224 | 31.004 | 5.820 | 1.00 | 51.62 C |
| ATOM | 1641 | CE1 | PHE | A | 208 | −7.548 | 30.324 | 3.497 | 1.00 | 57.18 C |
| ATOM | 1642 | CE2 | PHE | A | 208 | −7.509 | 30.487 | 5.880 | 1.00 | 49.44 C |
| ATOM | 1643 | CZ | PHE | A | 208 | −8.169 | 30.145 | 4.721 | 1.00 | 55.47 C |
| ATOM | 1644 | N | TYR | A | 209 | −2.479 | 30.703 | 6.884 | 1.00 | 48.07 N |
| ATOM | 1645 | CA | TYR | A | 209 | −2.357 | 30.236 | 8.266 | 1.00 | 44.09 C |
| ATOM | 1646 | C | TYR | A | 209 | −2.312 | 31.485 | 9.142 | 1.00 | 47.39 C |
| ATOM | 1647 | O | TYR | A | 209 | −1.560 | 32.419 | 8.821 | 1.00 | 51.50 O |
| ATOM | 1648 | CB | TYR | A | 209 | −1.113 | 29.376 | 8.513 | 1.00 | 41.03 C |
| ATOM | 1649 | CG | TYR | A | 209 | −1.037 | 28.831 | 9.928 | 1.00 | 41.30 C |
| ATOM | 1650 | CD1 | TYR | A | 209 | −1.616 | 27.606 | 10.255 | 1.00 | 42.75 C |
| ATOM | 1651 | CD2 | TYR | A | 209 | −0.405 | 29.551 | 10.938 | 1.00 | 37.51 C |
| ATOM | 1652 | CE1 | TYR | A | 209 | −1.566 | 27.112 | 11.546 | 1.00 | 43.00 C |
| ATOM | 1653 | CE2 | TYR | A | 209 | −0.345 | 29.065 | 12.239 | 1.00 | 34.34 C |
| ATOM | 1654 | CZ | TYR | A | 209 | −0.925 | 27.845 | 12.535 | 1.00 | 40.37 C |
| ATOM | 1655 | OH | TYR | A | 209 | −0.869 | 27.359 | 13.819 | 1.00 | 38.25 O |
| ATOM | 1656 | N | PRO | A | 210 | −3.075 | 31.536 | 10.248 | 1.00 | 46.62 N |
| ATOM | 1657 | CA | PRO | A | 210 | −3.959 | 30.475 | 10.752 | 1.00 | 44.54 C |
| ATOM | 1658 | C | PRO | A | 210 | −5.282 | 30.373 | 9.986 | 1.00 | 42.39 C |
| ATOM | 1659 | O | PRO | A | 210 | −5.454 | 31.030 | 8.956 | 1.00 | 46.66 O |
| ATOM | 1660 | CB | PRO | A | 210 | −4.193 | 30.880 | 12.213 | 1.00 | 46.05 C |
| ATOM | 1661 | CG | PRO | A | 210 | −4.055 | 32.365 | 12.210 | 1.00 | 52.06 C |
| ATOM | 1662 | CD | PRO | A | 210 | −3.029 | 32.697 | 11.155 | 1.00 | 51.49 C |
| ATOM | 1663 | N | ALA | A | 211 | −6.205 | 29.554 | 10.490 | 1.00 | 37.79 N |
| ATOM | 1664 | CA | ALA | A | 211 | −7.410 | 29.226 | 9.737 | 1.00 | 45.49 C |
| ATOM | 1665 | C | ALA | A | 211 | −8.464 | 30.320 | 9.792 | 1.00 | 51.59 C |
| ATOM | 1666 | O | ALA | A | 211 | −9.326 | 30.369 | 8.907 | 1.00 | 54.60 O |
| ATOM | 1667 | CB | ALA | A | 211 | −8.019 | 27.916 | 10.249 | 1.00 | 42.87 C |
| ATOM | 1668 | N | GLU | A | 212 | −8.424 | 31.177 | 10.810 | 1.00 | 54.87 N |
| ATOM | 1669 | CA | GLU | A | 212 | −9.404 | 32.249 | 10.933 | 1.00 | 57.80 C |
| ATOM | 1670 | C | GLU | A | 212 | −9.386 | 33.124 | 9.689 | 1.00 | 55.32 C |
| ATOM | 1671 | O | GLU | A | 212 | −8.332 | 33.616 | 9.273 | 1.00 | 53.43 O |
| ATOM | 1672 | CB | GLU | A | 212 | −9.116 | 33.089 | 12.176 | 1.00 | 61.74 C |
| ATOM | 1673 | CG | GLU | A | 212 | −10.109 | 34.216 | 12.428 | 1.00 | 75.22 C |
| ATOM | 1674 | CD | GLU | A | 212 | −11.474 | 33.715 | 12.866 | 1.00 | 87.98 C |
| ATOM | 1675 | OE1 | GLU | A | 212 | −12.292 | 33.358 | 11.990 | 1.00 | 93.41 O |
| ATOM | 1676 | OE2 | GLU | A | 212 | −11.727 | 33.677 | 14.091 | 1.00 | 92.29 O |
| ATOM | 1677 | N | ILE | A | 213 | −10.559 | 33.288 | 9.078 | 1.00 | 57.99 N |
| ATOM | 1678 | CA | ILE | A | 213 | −10.704 | 34.111 | 7.886 | 1.00 | 64.81 C |
| ATOM | 1679 | C | ILE | A | 213 | −12.184 | 34.422 | 7.728 | 1.00 | 75.14 C |
| ATOM | 1680 | O | ILE | A | 213 | −13.044 | 33.626 | 8.112 | 1.00 | 81.84 O |
| ATOM | 1681 | CB | ILE | A | 213 | −10.108 | 33.404 | 6.640 | 1.00 | 62.48 C |
| ATOM | 1682 | CG1 | ILE | A | 213 | −9.806 | 34.421 | 5.541 | 1.00 | 58.79 C |
| ATOM | 1683 | CG2 | ILE | A | 213 | −11.032 | 32.300 | 6.132 | 1.00 | 63.00 C |
| ATOM | 1684 | CD1 | ILE | A | 213 | −9.025 | 33.852 | 4.371 | 1.00 | 53.99 C |
| ATOM | 1685 | N | THR | A | 214 | −12.481 | 35.605 | 7.199 | 1.00 | 82.88 N |
| ATOM | 1686 | CA | THR | A | 214 | −13.862 | 36.062 | 7.081 | 1.00 | 90.25 C |
| ATOM | 1687 | C | THR | A | 214 | −14.051 | 36.696 | 5.713 | 1.00 | 91.51 C |
| ATOM | 1688 | O | THR | A | 214 | −13.381 | 37.679 | 5.385 | 1.00 | 88.08 O |
| ATOM | 1689 | CB | THR | A | 214 | −14.218 | 37.051 | 8.198 | 1.00 | 94.29 C |
| ATOM | 1690 | OG1 | THR | A | 214 | −13.108 | 37.924 | 8.442 | 1.00 | 97.54 O |
| ATOM | 1691 | CG2 | THR | A | 214 | −14.564 | 36.302 | 9.484 | 1.00 | 91.77 C |
| ATOM | 1692 | N | LEU | A | 215 | −14.959 | 36.131 | 4.921 | 1.00 | 96.02 N |
| ATOM | 1693 | CA | LEU | A | 215 | −15.212 | 36.569 | 3.557 | 1.00 | 102.34 C |
| ATOM | 1694 | C | LEU | A | 215 | −16.666 | 36.999 | 3.416 | 1.00 | 105.85 C |
| ATOM | 1695 | O | LEU | A | 215 | −17.562 | 36.395 | 4.014 | 1.00 | 108.36 O |
| ATOM | 1696 | CB | LEU | A | 215 | −14.904 | 35.455 | 2.544 | 1.00 | 102.33 C |
| ATOM | 1697 | CG | LEU | A | 215 | −13.456 | 35.006 | 2.319 | 1.00 | 100.22 C |
| ATOM | 1698 | CD1 | LEU | A | 215 | −12.899 | 34.245 | 3.513 | 1.00 | 101.03 C |
| ATOM | 1699 | CD2 | LEU | A | 215 | −13.360 | 34.154 | 1.066 | 1.00 | 96.48 C |
| ATOM | 1700 | N | THR | A | 216 | −16.893 | 38.041 | 2.619 | 1.00 | 104.22 N |
| ATOM | 1701 | CA | THR | A | 216 | −18.241 | 38.555 | 2.393 | 1.00 | 98.38 C |
| ATOM | 1702 | C | THR | A | 216 | −18.533 | 38.706 | 0.901 | 1.00 | 95.08 C |
| ATOM | 1703 | O | THR | A | 216 | −17.749 | 39.303 | 0.160 | 1.00 | 91.30 O |
| ATOM | 1704 | CB | THR | A | 216 | −18.454 | 39.916 | 3.085 | 1.00 | 94.48 C |
| ATOM | 1705 | OG1 | THR | A | 216 | −17.879 | 39.884 | 4.397 | 1.00 | 89.97 O |
| ATOM | 1706 | CG2 | THR | A | 216 | −19.942 | 40.227 | 3.196 | 1.00 | 94.17 C |
| ATOM | 1707 | N | VAL | A | 231 | −18.561 | 28.372 | 2.228 | 1.00 | 83.65 N |
| ATOM | 1708 | CA | VAL | A | 231 | −18.006 | 27.024 | 2.320 | 1.00 | 82.83 C |
| ATOM | 1709 | C | VAL | A | 231 | −17.198 | 26.859 | 3.605 | 1.00 | 81.93 C |
| ATOM | 1710 | O | VAL | A | 231 | −16.757 | 27.839 | 4.206 | 1.00 | 89.59 O |
| ATOM | 1711 | CB | VAL | A | 231 | −17.139 | 26.693 | 1.085 | 1.00 | 80.66 C |
| ATOM | 1712 | CG1 | VAL | A | 231 | −15.699 | 27.136 | 1.303 | 1.00 | 80.70 C |

TABLE 17-continued

| | | | | | | | | | | |
|---|---|---|---|---|---|---|---|---|---|---|
| ATOM | 1713 | CG2 | VAL | A | 231 | −17.205 | 25.210 | 0.766 | 1.00 | 76.33 C |
| ATOM | 1714 | N | GLU | A | 232 | −17.014 | 25.611 | 4.025 | 1.00 | 74.94 N |
| ATOM | 1715 | CA | GLU | A | 232 | −16.232 | 25.326 | 5.219 | 1.00 | 68.81 C |
| ATOM | 1716 | C | GLU | A | 232 | −14.748 | 25.510 | 4.917 | 1.00 | 67.00 C |
| ATOM | 1717 | O | GLU | A | 232 | −14.240 | 24.980 | 3.924 | 1.00 | 69.67 O |
| ATOM | 1718 | CB | GLU | A | 232 | −16.508 | 23.899 | 5.697 | 1.00 | 68.94 C |
| ATOM | 1719 | CG | GLU | A | 232 | −16.251 | 23.647 | 7.172 | 1.00 | 72.70 C |
| ATOM | 1720 | CD | GLU | A | 232 | −17.429 | 24.041 | 8.045 | 0.00 | 73.72 C |
| ATOM | 1721 | OE1 | GLU | A | 232 | −17.424 | 25.160 | 8.601 | 1.00 | 74.60 O |
| ATOM | 1722 | OE2 | GLU | A | 232 | −18.367 | 23.229 | 8.170 | 1.00 | 75.10 O |
| ATOM | 1723 | N | THR | A | 233 | −14.056 | 26.278 | 5.759 | 1.00 | 58.39 N |
| ATOM | 1724 | CA | THR | A | 233 | −12.606 | 26.375 | 5.648 | 1.00 | 52.51 C |
| ATOM | 1725 | C | THR | A | 233 | −11.996 | 24.981 | 5.754 | 1.00 | 45.95 C |
| ATOM | 1726 | O | THR | A | 233 | −12.365 | 24.199 | 6.633 | 1.00 | 46.31 O |
| ATOM | 1727 | CB | THR | A | 233 | −12.056 | 27.295 | 6.741 | 1.00 | 49.59 C |
| ATOM | 1728 | OG1 | THR | A | 233 | −12.617 | 28.602 | 6.579 | 1.00 | 51.01 O |
| ATOM | 1729 | CG2 | THR | A | 233 | −10.541 | 27.396 | 6.659 | 1.00 | 48.60 C |
| ATOM | 1730 | N | ARG | A | 234 | −11.071 | 24.667 | 4.853 | 1.00 | 48.02 N |
| ATOM | 1731 | CA | ARG | A | 234 | −10.617 | 23.292 | 4.718 | 1.00 | 45.51 C |
| ATOM | 1732 | C | ARG | A | 234 | −9.099 | 23.207 | 4.738 | 1.00 | 42.49 C |
| ATOM | 1733 | O | ARG | A | 234 | −8.410 | 24.128 | 4.279 | 1.00 | 45.50 O |
| ATOM | 1734 | CB | ARG | A | 234 | −11.148 | 22.672 | 3.417 | 1.00 | 40.62 C |
| ATOM | 1735 | CG | ARG | A | 234 | −10.509 | 23.223 | 2.145 | 1.00 | 43.26 C |
| ATOM | 1736 | CD | ARG | A | 234 | −11.400 | 22.979 | 0.933 | 1.00 | 45.26 C |
| ATOM | 1737 | NE | ARG | A | 234 | −10.730 | 23.330 | −0.315 | 1.00 | 51.50 N |
| ATOM | 1738 | CZ | ARG | A | 234 | −11.332 | 23.404 | −1.501 | 1.00 | 53.44 C |
| ATOM | 1739 | NH1 | ARG | A | 234 | −12.630 | 23.156 | −1.615 | 1.00 | 53.09 N |
| ATOM | 1740 | NH2 | ARG | A | 234 | −10.632 | 23.733 | −2.575 | 1.00 | 53.80 N |
| ATOM | 1741 | N | PRO | A | 235 | −8.551 | 22.114 | 5.268 | 1.00 | 43.30 N |
| ATOM | 1742 | CA | PRO | A | 235 | −7.089 | 21.969 | 5.309 | 1.00 | 42.60 C |
| ATOM | 1743 | C | PRO | A | 235 | −6.504 | 21.665 | 3.938 | 1.00 | 45.51 C |
| ATOM | 1744 | O | PRO | A | 235 | −7.019 | 20.831 | 3.190 | 1.00 | 43.52 O |
| ATOM | 1745 | CB | PRO | A | 235 | −6.877 | 20.794 | 6.273 | 1.00 | 39.43 C |
| ATOM | 1746 | CG | PRO | A | 235 | −8.139 | 20.004 | 6.177 | 1.00 | 43.20 C |
| ATOM | 1747 | CD | PRO | A | 235 | −9.231 | 21.028 | 5.998 | 1.00 | 37.43 C |
| ATOM | 1748 | N | ALA | A | 236 | −5.399 | 22.344 | 3.621 | 1.00 | 43.13 N |
| ATOM | 1749 | CA | ALA | A | 236 | −4.687 | 22.048 | 2.383 | 1.00 | 48.11 C |
| ATOM | 1750 | C | ALA | A | 236 | −3.927 | 20.730 | 2.471 | 1.00 | 49.34 C |
| ATOM | 1751 | O | ALA | A | 236 | −3.779 | 20.033 | 1.459 | 1.00 | 56.15 O |
| ATOM | 1752 | CB | ALA | A | 236 | −3.732 | 23.193 | 2.043 | 1.00 | 49.23 C |
| ATOM | 1753 | N | GLY | A | 237 | −3.449 | 20.368 | 3.661 | 1.00 | 46.35 N |
| ATOM | 1754 | CA | GLY | A | 237 | −2.645 | 19.177 | 3.856 | 1.00 | 48.53 C |
| ATOM | 1755 | C | GLY | A | 237 | −1.181 | 19.449 | 4.129 | 1.00 | 50.62 C |
| ATOM | 1756 | O | GLY | A | 237 | −0.441 | 18.510 | 4.457 | 1.00 | 53.98 O |
| ATOM | 1757 | N | ASP | A | 238 | −0.736 | 20.699 | 3.994 | 1.00 | 52.00 N |
| ATOM | 1758 | CA | ASP | A | 238 | 0.643 | 21.084 | 4.267 | 1.00 | 54.53 C |
| ATOM | 1759 | C | ASP | A | 238 | 0.756 | 22.054 | 5.437 | 1.00 | 56.02 C |
| ATOM | 1760 | O | ASP | A | 238 | 1.793 | 22.709 | 5.588 | 1.00 | 56.72 O |
| ATOM | 1761 | CB | ASP | A | 238 | 1.278 | 21.703 | 3.018 | 1.00 | 53.55 C |
| ATOM | 1762 | CG | ASP | A | 238 | 0.543 | 22.943 | 2.537 | 1.00 | 52.91 C |
| ATOM | 1763 | OD1 | ASP | A | 238 | −0.433 | 23.371 | 3.195 | 1.00 | 54.19 O |
| ATOM | 1764 | OD2 | ASP | A | 238 | 0.944 | 23.492 | 1.490 | 1.00 | 58.11 O |
| ATOM | 1765 | N | GLY | A | 239 | −0.289 | 22.180 | 6.255 | 1.00 | 51.19 N |
| ATOM | 1766 | CA | GLY | A | 239 | −0.294 | 23.116 | 7.357 | 1.00 | 52.05 C |
| ATOM | 1767 | C | GLY | A | 239 | −0.985 | 24.436 | 7.087 | 1.00 | 56.17 C |
| ATOM | 1768 | O | GLY | A | 239 | −1.110 | 25.245 | 8.015 | 1.00 | 63.81 O |
| ATOM | 1769 | N | THR | A | 240 | −1.432 | 24.689 | 5.857 | 1.00 | 48.70 N |
| ATOM | 1770 | CA | THR | A | 240 | −2.168 | 25.904 | 5.523 | 1.00 | 44.65 C |
| ATOM | 1771 | C | THR | A | 240 | −3.619 | 25.545 | 5.204 | 1.00 | 47.36 C |
| ATOM | 1772 | O | THR | A | 240 | −4.018 | 24.377 | 5.254 | 1.00 | 51.03 O |
| ATOM | 1773 | CB | THR | A | 240 | −1.500 | 26.655 | 4.364 | 1.00 | 53.85 C |
| ATOM | 1774 | OG1 | THR | A | 240 | −1.529 | 25.856 | 3.171 | 1.00 | 56.31 O |
| ATOM | 1775 | CG2 | THR | A | 240 | −0.049 | 27.009 | 4.716 | 1.00 | 53.58 C |
| ATOM | 1776 | N | PHE | A | 241 | −4.419 | 26.560 | 4.880 | 1.00 | 47.19 N |
| ATOM | 1777 | CA | PHE | A | 241 | −5.858 | 26.384 | 4.743 | 1.00 | 47.65 C |
| ATOM | 1778 | C | PHE | A | 241 | −6.372 | 27.042 | 3.468 | 1.00 | 46.90 C |
| ATOM | 1779 | O | PHE | A | 241 | −5.659 | 27.783 | 2.785 | 1.00 | 47.70 O |
| ATOM | 1780 | CB | PHE | A | 241 | −6.590 | 26.933 | 5.973 | 1.00 | 43.46 C |
| ATOM | 1781 | CG | PHE | A | 241 | −6.272 | 26.182 | 7.236 | 1.00 | 36.43 C |
| ATOM | 1782 | CD1 | PHE | A | 241 | −5.161 | 26.510 | 7.994 | 1.00 | 37.86 C |
| ATOM | 1783 | CD2 | PHE | A | 241 | −7.072 | 25.126 | 7.647 | 1.00 | 33.81 C |
| ATOM | 1784 | CE1 | PHE | A | 241 | −4.855 | 25.806 | 9.155 | 1.00 | 41.89 C |
| ATOM | 1785 | CE2 | PHE | A | 241 | −6.774 | 24.413 | 8.806 | 1.00 | 37.86 C |
| ATOM | 1786 | CZ | PHE | A | 241 | −5.665 | 24.755 | 9.565 | 1.00 | 39.78 C |
| ATOM | 1787 | N | GLN | A | 242 | −7.634 | 26.743 | 3.149 | 1.00 | 49.97 N |
| ATOM | 1788 | CA | GLN | A | 242 | −8.291 | 27.218 | 1.937 | 1.00 | 52.71 C |
| ATOM | 1789 | C | GLN | A | 242 | −9.748 | 27.542 | 2.248 | 1.00 | 53.75 C |
| ATOM | 1790 | O | GLN | A | 242 | −10.355 | 26.944 | 3.139 | 1.00 | 49.19 O |
| ATOM | 1791 | CB | GLN | A | 242 | −8.229 | 26.176 | 0.801 | 1.00 | 52.61 C |
| ATOM | 1792 | CG | GLN | A | 242 | −6.845 | 25.581 | 0.520 | 1.00 | 49.62 C |

TABLE 17-continued

| | | | | | | | | | | |
|---|---|---|---|---|---|---|---|---|---|---|
| ATOM | 1793 | CD | GLN | A | 242 | −6.872 | 24.480 | −0.529 | 1.00 | 55.57 C |
| ATOM | 1794 | OE1 | GLN | A | 242 | −7.938 | 24.038 | −0.953 | 1.00 | 55.58 O |
| ATOM | 1795 | NE2 | GLN | A | 242 | −5.694 | 24.031 | −0.952 | 1.00 | 55.50 N |
| ATOM | 1796 | N | LYS | A | 243 | −10.309 | 28.489 | 1.497 | 1.00 | 59.34 N |
| ATOM | 1797 | CA | LYS | A | 243 | −11.719 | 28.843 | 1.604 | 1.00 | 61.05 C |
| ATOM | 1798 | C | LYS | A | 243 | −12.137 | 29.534 | 0.313 | 1.00 | 67.19 C |
| ATOM | 1799 | O | LYS | A | 243 | −11.302 | 30.068 | −0.422 | 1.00 | 70.67 O |
| ATOM | 1800 | CB | LYS | A | 243 | −11.992 | 29.754 | 2.811 | 1.00 | 60.69 C |
| ATOM | 1801 | CG | LYS | A | 243 | −13.354 | 29.536 | 3.475 | 1.00 | 65.00 C |
| ATOM | 1802 | CD | LYS | A | 243 | −13.919 | 30.829 | 4.062 | 1.00 | 66.77 C |
| ATOM | 1803 | CE | LYS | A | 243 | −14.628 | 30.610 | 5.393 | 1.00 | 71.02 C |
| ATOM | 1804 | NZ | LYS | A | 243 | −15.521 | 29.421 | 5.396 | 1.00 | 75.21 N |
| ATOM | 1805 | N | TRP | A | 244 | −13.440 | 29.508 | 0.035 | 1.00 | 66.57 N |
| ATOM | 1806 | CA | TRP | A | 244 | −13.977 | 30.309 | −1.057 | 1.00 | 68.46 C |
| ATOM | 1807 | C | TRP | A | 244 | −15.438 | 30.628 | −0.775 | 1.00 | 66.60 C |
| ATOM | 1808 | O | TRP | A | 244 | −16.120 | 29.906 | −0.043 | 1.00 | 64.17 O |
| ATOM | 1809 | CB | TRP | A | 244 | −13.824 | 29.622 | −2.429 | 1.00 | 74.71 C |
| ATOM | 1810 | CG | TRP | A | 244 | −14.529 | 28.301 | −2.619 | 1.00 | 85.36 C |
| ATOM | 1811 | CD1 | TRP | A | 244 | −13.949 | 27.067 | −2.666 | 1.00 | 90.09 C |
| ATOM | 1812 | CD2 | TRP | A | 244 | −15.935 | 28.087 | −2.827 | 1.00 | 94.00 C |
| ATOM | 1813 | NE1 | TRP | A | 244 | −14.902 | 26.100 | −2.873 | 1.00 | 92.91 N |
| ATOM | 1814 | CE2 | TRP | A | 244 | −16.129 | 26.700 | −2.975 | 1.00 | 95.65 C |
| ATOM | 1815 | CE3 | TRP | A | 244 | −17.049 | 28.933 | −2.897 | 1.00 | 97.56 C |
| ATOM | 1816 | CZ2 | TRP | A | 244 | −17.389 | 26.140 | −3.185 | 1.00 | 97.17 C |
| ATOM | 1817 | CZ3 | TRP | A | 244 | −18.298 | 28.374 | −3.102 | 1.00 | 96.00 C |
| ATOM | 1818 | CH2 | TRP | A | 244 | −18.457 | 26.993 | −3.245 | 1.00 | 95.40 C |
| ATOM | 1819 | N | ALA | A | 245 | −15.911 | 31.725 | −1.366 | 1.00 | 77.34 N |
| ATOM | 1820 | CA | ALA | A | 245 | −17.287 | 32.169 | −1.207 | 1.00 | 84.14 C |
| ATOM | 1821 | C | ALA | A | 245 | −17.825 | 32.629 | −2.555 | 1.00 | 93.73 C |
| ATOM | 1822 | O | ALA | A | 245 | −17.067 | 32.912 | −3.487 | 1.00 | 94.27 O |
| ATOM | 1823 | CB | ALA | A | 245 | −17.409 | 33.296 | −0.170 | 1.00 | 82.05 C |
| ATOM | 1824 | N | ALA | A | 246 | −19.151 | 32.697 | −2.647 | 1.00 | 99.77 N |
| ATOM | 1825 | CA | ALA | A | 246 | −19.818 | 33.138 | −3.870 | 1.00 | 101.57 C |
| ATOM | 1826 | C | ALA | A | 246 | −21.242 | 33.616 | −3.590 | 1.00 | 99.72 C |
| ATOM | 1827 | O | ALA | A | 246 | −21.763 | 33.449 | −2.486 | 1.00 | 96.37 O |
| ATOM | 1828 | CB | ALA | A | 246 | −19.828 | 32.021 | −4.899 | 1.00 | 100.98 C |
| ATOM | 1829 | N | CYS | A | 259 | −14.945 | 41.881 | −3.848 | 1.00 | 106.57 N |
| ATOM | 1830 | CA | CYS | A | 259 | −14.762 | 40.930 | −2.756 | 1.00 | 110.33 C |
| ATOM | 1831 | C | CYS | A | 259 | −13.962 | 41.570 | −1.619 | 1.00 | 110.11 C |
| ATOM | 1832 | O | CYS | A | 259 | −13.263 | 42.565 | −1.821 | 1.00 | 112.29 O |
| ATOM | 1833 | CB | CYS | A | 259 | −14.070 | 39.656 | −3.261 | 1.00 | 113.34 C |
| ATOM | 1834 | SG | CYS | A | 259 | −13.894 | 38.324 | −2.033 | 1.00 | 113.84 S |
| ATOM | 1835 | N | HIS | A | 260 | −14.073 | 40.996 | −0.424 | 1.00 | 108.97 N |
| ATOM | 1836 | CA | HIS | A | 260 | −13.467 | 41.574 | 0.769 | 1.00 | 115.09 C |
| ATOM | 1837 | C | HIS | A | 260 | −13.225 | 40.453 | 1.768 | 1.00 | 116.78 C |
| ATOM | 1838 | O | HIS | A | 260 | −14.125 | 39.646 | 2.020 | 1.00 | 118.40 O |
| ATOM | 1839 | CB | HIS | A | 260 | −14.380 | 42.656 | 1.363 | 1.00 | 121.21 C |
| ATOM | 1840 | CG | HIS | A | 260 | −13.695 | 43.580 | 2.325 | 1.00 | 127.28 C |
| ATOM | 1841 | ND1 | HIS | A | 260 | −14.146 | 44.860 | 2.569 | 1.00 | 129.49 N |
| ATOM | 1842 | CD2 | HIS | A | 260 | −12.605 | 43.410 | 3.109 | 1.00 | 127.49 C |
| ATOM | 1843 | CE1 | HIS | A | 260 | −13.360 | 45.440 | 3.458 | 1.00 | 128.68 C |
| ATOM | 1844 | NE2 | HIS | A | 260 | −12.417 | 44.582 | 3.802 | 1.00 | 127.34 N |
| ATOM | 1845 | N | VAL | A | 261 | −12.018 | 40.399 | 2.330 | 1.00 | 114.47 N |
| ATOM | 1846 | CA | VAL | A | 261 | −11.628 | 39.283 | 3.188 | 1.00 | 110.47 C |
| ATOM | 1847 | C | VAL | A | 261 | −10.639 | 39.772 | 4.241 | 1.00 | 106.54 C |
| ATOM | 1848 | O | VAL | A | 261 | −9.663 | 40.459 | 3.923 | 1.00 | 106.79 O |
| ATOM | 1849 | CB | VAL | A | 261 | −11.034 | 38.123 | 2.361 | 1.00 | 108.32 C |
| ATOM | 1850 | CG1 | VAL | A | 261 | −9.933 | 38.625 | 1.434 | 1.00 | 103.49 C |
| ATOM | 1851 | CG2 | VAL | A | 261 | −10.516 | 37.033 | 3.274 | 1.00 | 108.20 C |
| ATOM | 1852 | N | GLN | A | 262 | −10.896 | 39.411 | 5.496 | 1.00 | 101.20 N |
| ATOM | 1853 | CA | GLN | A | 262 | −10.034 | 39.753 | 6.618 | 1.00 | 95.74 C |
| ATOM | 1854 | C | GLN | A | 262 | −9.176 | 38.552 | 6.998 | 1.00 | 87.45 C |
| ATOM | 1855 | O | GLN | A | 262 | −9.665 | 37.419 | 7.045 | 1.00 | 85.78 O |
| ATOM | 1856 | CB | GLN | A | 262 | −10.863 | 40.201 | 7.827 | 1.00 | 100.25 C |
| ATOM | 1857 | CG | GLN | A | 262 | −11.751 | 41.419 | 7.576 | 1.00 | 106.69 C |
| ATOM | 1858 | CD | GLN | A | 262 | −13.224 | 41.146 | 7.850 | 1.00 | 108.50 C |
| ATOM | 1859 | OE1 | GLN | A | 262 | −13.903 | 40.492 | 7.058 | 1.00 | 111.86 O |
| ATOM | 1860 | NE2 | GLN | A | 262 | −13.722 | 41.652 | 8.974 | 1.00 | 105.47 N |
| ATOM | 1861 | N | HIS | A | 263 | −7.894 | 38.806 | 7.263 | 1.00 | 79.03 N |
| ATOM | 1862 | CA | HIS | A | 263 | −6.993 | 37.766 | 7.744 | 1.00 | 71.30 C |
| ATOM | 1863 | C | HIS | A | 263 | −5.856 | 38.409 | 8.527 | 1.00 | 68.66 C |
| ATOM | 1864 | O | HIS | A | 263 | −5.337 | 39.457 | 8.129 | 1.00 | 71.83 O |
| ATOM | 1865 | CB | HIS | A | 263 | −6.432 | 36.918 | 6.594 | 1.00 | 63.45 C |
| ATOM | 1866 | CG | HIS | A | 263 | −5.640 | 35.732 | 7.055 | 1.00 | 63.73 C |
| ATOM | 1867 | ND1 | HIS | A | 263 | −4.261 | 35.710 | 7.053 | 1.00 | 63.60 N |
| ATOM | 1868 | CD2 | HIS | A | 263 | −6.034 | 34.534 | 7.549 | 1.00 | 61.03 C |
| ATOM | 1869 | CE1 | HIS | A | 263 | −3.841 | 34.546 | 7.518 | 1.00 | 62.78 C |
| ATOM | 1870 | NE2 | HIS | A | 263 | −4.897 | 33.816 | 7.829 | 1.00 | 59.89 N |
| ATOM | 1871 | N | GLU | A | 264 | −5.471 | 37.759 | 9.632 | 1.00 | 61.10 N |
| ATOM | 1872 | CA | GLU | A | 264 | −4.443 | 38.296 | 10.520 | 1.00 | 63.67 C |

TABLE 17-continued

| | | | | | | | | | |
|---|---|---|---|---|---|---|---|---|---|
| ATOM | 1873 | C | GLU | A | 264 | −3.132 | 38.563 | 9.790 | 1.00 70.01 C |
| ATOM | 1874 | O | GLU | A | 264 | −2.394 | 39.483 | 10.159 | 1.00 79.70 O |
| ATOM | 1875 | CB | GLU | A | 264 | −4.213 | 37.330 | 11.686 | 1.00 64.61 C |
| ATOM | 1876 | CG | GLU | A | 264 | −3.042 | 37.691 | 12.591 | 1.00 71.40 C |
| ATOM | 1877 | CD | GLU | A | 264 | −2.774 | 36.638 | 13.649 | 0.00 71.26 C |
| ATOM | 1878 | OE1 | GLU | A | 264 | −2.417 | 37.009 | 14.788 | 1.00 71.33 O |
| ATOM | 1879 | OE2 | GLU | A | 264 | −2.924 | 35.438 | 13.341 | 1.00 71.13 O |
| ATOM | 1880 | N | GLY | A | 265 | −2.824 | 37.782 | 8.760 | 1.00 67.57 N |
| ATOM | 1881 | CA | GLY | A | 265 | −1.586 | 37.946 | 8.026 | 1.00 67.82 C |
| ATOM | 1882 | C | GLY | A | 265 | −1.580 | 39.035 | 6.977 | 1.00 81.53 C |
| ATOM | 1883 | O | GLY | A | 265 | −0.593 | 39.178 | 6.249 | 1.00 81.67 O |
| ATOM | 1884 | N | LEU | A | 266 | −2.668 | 39.812 | 6.867 | 1.00 84.59 N |
| ATOM | 1885 | CA | LEU | A | 266 | −2.751 | 40.927 | 5.930 | 1.00 87.22 C |
| ATOM | 1886 | C | LEU | A | 266 | −2.560 | 42.239 | 6.671 | 1.00 87.51 C |
| ATOM | 1887 | O | LEU | A | 266 | −3.166 | 42.431 | 7.736 | 1.00 87.48 O |
| ATOM | 1888 | CB | LEU | A | 266 | −4.103 | 40.933 | 5.221 | 1.00 84.80 C |
| ATOM | 1889 | CG | LEU | A | 266 | −4.477 | 39.752 | 4.326 | 1.00 80.17 C |
| ATOM | 1890 | CD1 | LEU | A | 266 | −5.981 | 39.719 | 4.104 | 1.00 84.16 C |
| ATOM | 1891 | CD2 | LEU | A | 266 | −3.745 | 39.831 | 2.999 | 1.00 71.86 C |
| ATOM | 1892 | N | PRO | A | 267 | −1.732 | 43.155 | 6.160 | 1.00 88.29 N |
| ATOM | 1893 | CA | PRO | A | 267 | −1.650 | 44.488 | 6.787 | 1.00 88.08 C |
| ATOM | 1894 | C | PRO | A | 267 | −2.984 | 45.209 | 6.813 | 1.00 86.26 C |
| ATOM | 1895 | O | PRO | A | 267 | −3.350 | 45.802 | 7.836 | 1.00 80.78 O |
| ATOM | 1896 | CB | PRO | A | 267 | −0.625 | 45.224 | 5.912 | 1.00 87.97 C |
| ATOM | 1897 | CG | PRO | A | 267 | 0.169 | 44.145 | 5.254 | 1.00 89.82 C |
| ATOM | 1898 | CD | PRO | A | 267 | −0.789 | 43.009 | 5.039 | 1.00 89.48 C |
| ATOM | 1899 | N | LYS | A | 268 | −3.727 | 45.162 | 5.707 | 1.00 90.84 N |
| ATOM | 1900 | CA | LYS | A | 268 | −5.056 | 45.737 | 5.603 | 1.00 93.16 C |
| ATOM | 1901 | C | LYS | A | 268 | −5.903 | 44.820 | 4.729 | 1.00 89.28 C |
| ATOM | 1902 | O | LYS | A | 268 | −5.390 | 44.238 | 3.758 | 1.00 81.30 O |
| ATOM | 1903 | CB | LYS | A | 268 | −5.035 | 47.161 | 5.018 | 1.00 96.08 C |
| ATOM | 1904 | CG | LYS | A | 268 | −4.459 | 47.278 | 3.614 | 1.00 98.81 C |
| ATOM | 1905 | CD | LYS | A | 268 | −2.943 | 47.380 | 3.628 | 1.00 98.53 C |
| ATOM | 1906 | CE | LYS | A | 268 | −2.380 | 47.266 | 2.224 | 1.00 100.36 C |
| ATOM | 1907 | NZ | LYS | A | 268 | −0.894 | 47.268 | 2.226 | 1.00 100.80 N |
| ATOM | 1908 | N | PRO | A | 269 | −7.200 | 44.662 | 5.053 | 1.00 92.01 N |
| ATOM | 1909 | CA | PRO | A | 269 | −8.133 | 43.744 | 4.387 | 1.00 91.96 C |
| ATOM | 1910 | C | PRO | A | 269 | −8.166 | 43.869 | 2.865 | 1.00 94.89 C |
| ATOM | 1911 | O | PRO | A | 269 | −7.897 | 44.945 | 2.337 | 1.00 99.32 O |
| ATOM | 1912 | CB | PRO | A | 269 | −9.484 | 44.138 | 4.986 | 1.00 92.61 C |
| ATOM | 1913 | CG | PRO | A | 269 | −9.149 | 44.650 | 6.339 | 1.00 91.97 C |
| ATOM | 1914 | CD | PRO | A | 269 | −7.844 | 45.372 | 6.175 | 1.00 92.65 C |
| TER | 1915 | | PRO | A | 269 | | | | |
| HETATM | 1916 | C1 | GOL | A | 301 | 5.139 | 21.654 | 32.553 | 1.00 47.63 C |
| HETATM | 1917 | C2 | GOL | A | 301 | 6.577 | 22.197 | 32.388 | 1.00 47.31 C |
| HETATM | 1918 | C3 | GOL | A | 301 | 6.735 | 22.400 | 30.864 | 1.00 37.68 C |
| HETATM | 1919 | O1 | GOL | A | 301 | 5.133 | 20.872 | 33.704 | 1.00 55.97 O |
| HETATM | 1920 | O2 | GOL | A | 301 | 7.519 | 21.326 | 32.919 | 1.00 53.94 O |
| HETATM | 1921 | O3 | GOL | A | 301 | 8.041 | 22.835 | 30.627 | 1.00 48.68 O |
| ATOM | 1922 | N | GLY | P | 1 | 1.666 | 19.111 | 26.812 | 1.00 25.12 N |
| ATOM | 1923 | CA | GLY | P | 1 | 1.566 | 17.958 | 27.693 | 1.00 25.06 C |
| ATOM | 1924 | C | GLY | P | 1 | 0.154 | 17.715 | 28.221 | 1.00 25.44 C |
| ATOM | 1925 | O | GLY | P | 1 | −0.560 | 18.650 | 28.602 | 1.00 28.21 O |
| ATOM | 1926 | N | VAL | P | 2 | −0.226 | 16.436 | 28.225 | 1.00 23.05 N |
| ATOM | 1927 | C | VAL | P | 2 | −1.647 | 16.188 | 30.209 | 1.00 23.01 C |
| ATOM | 1928 | O | VAL | P | 2 | −0.654 | 16.241 | 30.944 | 1.00 23.26 O |
| ATOM | 1929 | CA | AVAL | P | 2 | −1.560 | 16.078 | 28.687 | 0.44 25.45 C |
| ATOM | 1930 | CB | AVAL | P | 2 | −1.972 | 14.676 | 28.205 | 0.44 25.93 C |
| ATOM | 1931 | CG1 | AVAL | P | 2 | −2.053 | 14.621 | 26.684 | 0.44 27.72 C |
| ATOM | 1932 | CG2 | AVAL | P | 2 | −1.013 | 13.658 | 28.704 | 0.44 24.49 C |
| ATOM | 1933 | CA | BVAL | P | 2 | −1.519 | 15.952 | 28.704 | 0.56 25.18 C |
| ATOM | 1934 | CB | BVAL | P | 2 | −1.632 | 14.456 | 28.339 | 0.56 25.91 C |
| ATOM | 1935 | CG1 | BVAL | P | 2 | −2.709 | 13.716 | 29.117 | 0.56 26.58 C |
| ATOM | 1936 | CG2 | BVAL | P | 2 | −1.829 | 14.274 | 26.815 | 0.56 26.13 C |
| ATOM | 1937 | N | TYR | P | 3 | −2.880 | 16.299 | 30.677 | 1.00 23.59 N |
| ATOM | 1938 | CA | TYR | P | 3 | −3.172 | 16.424 | 32.101 | 1.00 25.22 C |
| ATOM | 1939 | C | TYR | P | 3 | −2.632 | 15.224 | 32.875 | 1.00 23.43 C |
| ATOM | 1940 | O | TYR | P | 3 | −2.747 | 14.079 | 32.429 | 1.00 24.58 O |
| ATOM | 1941 | CB | TYR | P | 3 | −4.687 | 16.535 | 32.271 | 1.00 24.77 C |
| ATOM | 1942 | CG | TYR | P | 3 | −5.165 | 16.601 | 33.693 | 1.00 25.09 C |
| ATOM | 1943 | CD1 | TYR | P | 3 | −4.737 | 17.623 | 34.528 | 1.00 22.51 C |
| ATOM | 1944 | CD2 | TYR | P | 3 | −6.046 | 15.652 | 34.200 | 1.00 26.08 C |
| ATOM | 1945 | CE1 | TYR | P | 3 | −5.177 | 17.724 | 35.822 | 1.00 28.17 C |
| ATOM | 1946 | CE2 | TYR | P | 3 | −6.485 | 15.733 | 35.514 | 1.00 24.48 C |
| ATOM | 1947 | CZ | TYR | P | 3 | −6.053 | 16.793 | 36.308 | 1.00 25.63 C |
| ATOM | 1948 | OH | TYR | P | 3 | −6.474 | 16.915 | 37.606 | 1.00 27.32 O |
| ATOM | 1949 | N | ASP | P | 4 | −1.998 | 15.489 | 34.026 | 1.00 25.15 N |
| ATOM | 1950 | CA | ASP | P | 4 | −1.390 | 14.415 | 34.816 | 1.00 26.09 C |
| ATOM | 1951 | C | ASP | P | 4 | −1.981 | 14.300 | 36.223 | 1.00 29.57 C |
| ATOM | 1952 | O | ASP | P | 4 | −1.346 | 13.727 | 37.108 | 1.00 30.69 O |

TABLE 17-continued

| | | | | | | | | | | |
|---|---|---|---|---|---|---|---|---|---|---|
| ATOM | 1953 | CB | ASP | P | 4 | 0.128 | 14.601 | 34.910 | 1.00 | 36.45 C |
| ATOM | 1954 | CG | ASP | P | 4 | 0.861 | 13.300 | 35.274 | 1.00 | 45.54 C |
| ATOM | 1955 | OD1 | ASP | P | 4 | 0.199 | 12.236 | 35.354 | 1.00 | 42.18 O |
| ATOM | 1956 | OD2 | ASP | P | 4 | 2.093 | 13.335 | 35.478 | 1.00 | 52.60 O |
| ATOM | 1957 | N | GLY | P | 5 | −3.185 | 14.825 | 36.463 | 1.00 | 25.47 N |
| ATOM | 1958 | CA | GLY | P | 5 | −3.815 | 14.720 | 37.764 | 1.00 | 22.63 C |
| ATOM | 1959 | C | GLY | P | 5 | −4.589 | 13.415 | 37.938 | 1.00 | 27.45 C |
| ATOM | 1960 | O | GLY | P | 5 | −4.547 | 12.509 | 37.106 | 1.00 | 24.60 O |
| ATOM | 1961 | N | GLU | P | 6 | −5.266 | 13.311 | 39.082 | 1.00 | 22.11 N |
| ATOM | 1962 | CA | GLU | P | 6 | −6.010 | 12.101 | 39.410 | 1.00 | 25.31 C |
| ATOM | 1963 | C | GLU | P | 6 | −7.071 | 11.819 | 38.342 | 1.00 | 23.54 C |
| ATOM | 1964 | O | GLU | P | 6 | −7.690 | 12.744 | 37.803 | 1.00 | 23.74 O |
| ATOM | 1965 | CB | GLU | P | 6 | −6.676 | 12.245 | 40.791 | 1.00 | 21.95 C |
| ATOM | 1966 | CG | GLU | P | 6 | −7.454 | 10.999 | 41.233 | 1.00 | 27.58 C |
| ATOM | 1967 | CD | GLU | P | 6 | −8.162 | 11.169 | 42.572 | 1.00 | 27.98 C |
| ATOM | 1968 | OE1 | GLU | P | 6 | −8.646 | 10.136 | 43.083 | 1.00 | 25.66 O |
| ATOM | 1969 | OE2 | GLU | P | 6 | −8.224 | 12.304 | 43.112 | 1.00 | 28.11 O |
| ATOM | 1970 | N | GLU | P | 7 | −7.277 | 10.532 | 38.035 | 1.00 | 20.23 N |
| ATOM | 1971 | CA | GLU | P | 7 | −8.267 | 10.112 | 37.050 | 1.00 | 23.58 C |
| ATOM | 1972 | C | GLU | P | 7 | −9.606 | 9.883 | 37.737 | 1.00 | 22.76 C |
| ATOM | 1973 | O | GLU | P | 7 | −9.658 | 9.299 | 38.821 | 1.00 | 23.14 O |
| ATOM | 1974 | CB | GLU | P | 7 | −7.837 | 8.820 | 36.356 | 1.00 | 24.52 C |
| ATOM | 1975 | CG | GLU | P | 7 | −6.582 | 8.890 | 35.472 | 1.00 | 27.60 C |
| ATOM | 1976 | CD | GLU | P | 7 | −6.873 | 9.435 | 34.083 | 1.00 | 31.74 C |
| ATOM | 1977 | OE1 | GLU | P | 7 | −5.927 | 9.936 | 33.437 | 1.00 | 39.07 O |
| ATOM | 1978 | OE2 | GLU | P | 7 | −8.045 | 9.376 | 33.636 | 1.00 | 33.89 O |
| ATOM | 1979 | N | HIS | P | 8 | −10.696 | 10.307 | 37.083 | 1.00 | 20.87 N |
| ATOM | 1980 | CA | HIS | P | 8 | −12.043 | 10.201 | 37.655 | 1.00 | 22.24 C |
| ATOM | 1981 | C | HIS | P | 8 | −13.005 | 9.730 | 36.585 | 1.00 | 24.21 C |
| ATOM | 1982 | O | HIS | P | 8 | −13.124 | 10.366 | 35.531 | 1.00 | 23.90 O |
| ATOM | 1983 | CB | HIS | P | 8 | −12.545 | 11.539 | 38.220 | 1.00 | 19.38 C |
| ATOM | 1984 | CG | HIS | P | 8 | −11.707 | 12.054 | 39.338 | 1.00 | 20.73 C |
| ATOM | 1985 | ND1 | HIS | P | 8 | −11.825 | 11.590 | 40.631 | 1.00 | 23.63 N |
| ATOM | 1986 | CD2 | HIS | P | 8 | −10.721 | 12.980 | 39.356 | 1.00 | 19.15 C |
| ATOM | 1987 | CE1 | HIS | P | 8 | −10.932 | 12.198 | 41.394 | 1.00 | 25.67 C |
| ATOM | 1988 | NE2 | HIS | P | 8 | −10.254 | 13.050 | 40.643 | 1.00 | 21.67 N |
| ATOM | 1989 | N | SER | P | 9 | −13.689 | 8.630 | 36.857 | 1.00 | 24.74 N |
| ATOM | 1990 | CA | SER | P | 9 | −14.762 | 8.236 | 35.968 | 1.00 | 22.14 C |
| ATOM | 1991 | C | SER | P | 9 | −16.011 | 9.074 | 36.223 | 1.00 | 22.98 C |
| ATOM | 1992 | O | SER | P | 9 | −16.188 | 9.687 | 37.285 | 1.00 | 25.23 O |
| ATOM | 1993 | CB | SER | P | 9 | −15.078 | 6.750 | 36.134 | 1.00 | 30.85 C |
| ATOM | 1994 | OG | SER | P | 9 | −16.110 | 6.531 | 37.073 | 1.00 | 36.65 O |
| ATOM | 1995 | N | VAL | P | 10 | −16.893 | 9.077 | 35.237 | 1.00 | 26.72 N |
| ATOM | 1996 | CA | VAL | P | 10 | −18.183 | 9.733 | 35.408 | 1.00 | 28.22 C |
| ATOM | 1997 | C | VAL | P | 10 | −19.046 | 8.970 | 36.407 | 0.78 | 26.91 C |
| ATOM | 1998 | O | VAL | P | 10 | −18.703 | 7.852 | 36.848 | 1.00 | 29.65 O |
| ATOM | 1999 | CB | VAL | P | 10 | −18.916 | 9.880 | 34.070 | 1.00 | 28.42 C |
| ATOM | 2000 | CG1 | VAL | P | 10 | −18.073 | 10.732 | 33.093 | 1.00 | 29.11 C |
| ATOM | 2001 | CG2 | VAL | P | 10 | −19.216 | 8.522 | 33.503 | 1.00 | 29.48 C |
| ATOM | 2002 | OXT | VAL | P | 10 | −20.127 | 9.447 | 36.783 | 1.00 | 28.46 O |
| TER | 2003 | | VAL | P | 10 | | | | | |
| ATOM | 2004 | N | GLU | H | 1 | 11.553 | 3.264 | 43.727 | 1.00 | 65.77 N |
| ATOM | 2005 | CA | GLU | H | 1 | 11.397 | 4.598 | 44.301 | 1.00 | 59.31 C |
| ATOM | 2006 | C | GLU | H | 1 | 10.100 | 4.733 | 45.111 | 1.00 | 45.12 C |
| ATOM | 2007 | O | GLU | H | 1 | 10.106 | 5.315 | 46.192 | 1.00 | 49.01 O |
| ATOM | 2008 | CB | GLU | H | 1 | 11.443 | 5.660 | 43.201 | 1.00 | 63.69 C |
| ATOM | 2009 | CG | GLU | H | 1 | 12.071 | 6.967 | 43.652 | 1.00 | 68.86 C |
| ATOM | 2010 | CD | GLU | H | 1 | 12.118 | 8.003 | 42.547 | 1.00 | 77.95 C |
| ATOM | 2011 | OE1 | GLU | H | 1 | 11.060 | 8.601 | 42.251 | 1.00 | 81.03 O |
| ATOM | 2012 | OE2 | GLU | H | 1 | 13.212 | 8.213 | 41.973 | 1.00 | 79.67 O |
| ATOM | 2013 | N | VAL | H | 2 | 8.992 | 4.192 | 44.602 | 1.00 | 43.49 N |
| ATOM | 2014 | CA | VAL | H | 2 | 7.753 | 4.189 | 45.374 | 1.00 | 37.51 C |
| ATOM | 2015 | C | VAL | H | 2 | 7.895 | 3.245 | 46.559 | 1.00 | 37.43 C |
| ATOM | 2016 | O | VAL | H | 2 | 8.370 | 2.110 | 46.416 | 1.00 | 40.51 O |
| ATOM | 2017 | CB | VAL | H | 2 | 6.562 | 3.783 | 44.492 | 1.00 | 33.11 C |
| ATOM | 2018 | CG1 | VAL | H | 2 | 5.317 | 3.554 | 45.352 | 1.00 | 34.55 C |
| ATOM | 2019 | CG2 | VAL | H | 2 | 6.289 | 4.850 | 43.424 | 1.00 | 39.40 C |
| ATOM | 2020 | N | GLN | H | 3 | 7.465 | 3.699 | 47.735 | 1.00 | 34.78 N |
| ATOM | 2021 | CA | GLN | H | 3 | 7.373 | 2.845 | 48.911 | 1.00 | 38.68 C |
| ATOM | 2022 | C | GLN | H | 3 | 6.016 | 3.011 | 49.578 | 1.00 | 42.05 C |
| ATOM | 2023 | O | GLN | H | 3 | 5.523 | 4.133 | 49.732 | 1.00 | 40.32 O |
| ATOM | 2024 | CB | GLN | H | 3 | 8.478 | 3.159 | 49.930 | 1.00 | 47.31 C |
| ATOM | 2025 | CG | GLN | H | 3 | 9.883 | 2.953 | 49.398 | 1.00 | 59.48 C |
| ATOM | 2026 | CD | GLN | H | 3 | 10.916 | 2.837 | 50.506 | 1.00 | 76.41 C |
| ATOM | 2027 | OE1 | GLN | H | 3 | 10.593 | 2.476 | 51.641 | 1.00 | 79.27 O |
| ATOM | 2028 | NE2 | GLN | H | 3 | 12.166 | 3.144 | 50.181 | 1.00 | 82.14 N |
| ATOM | 2029 | N | LEU | H | 4 | 5.428 | 1.884 | 49.978 | 1.00 | 32.92 N |
| ATOM | 2030 | CA | LEU | H | 4 | 4.226 | 1.847 | 50.802 | 1.00 | 33.76 C |
| ATOM | 2031 | C | LEU | H | 4 | 4.518 | 0.961 | 52.003 | 1.00 | 37.14 C |
| ATOM | 2032 | O | LEU | H | 4 | 4.816 | −0.226 | 51.834 | 1.00 | 38.04 O |

TABLE 17-continued

| | | | | | | | | | | |
|---|---|---|---|---|---|---|---|---|---|---|
| ATOM | 2033 | CB | LEU | H | 4 | 3.036 | 1.297 | 50.005 | 1.00 | 30.79 | C |
| ATOM | 2034 | CG | LEU | H | 4 | 2.647 | 2.074 | 48.752 | 1.00 | 27.27 | C |
| ATOM | 2035 | CD1 | LEU | H | 4 | 1.659 | 1.289 | 47.876 | 1.00 | 27.78 | C |
| ATOM | 2036 | CD2 | LEU | H | 4 | 2.067 | 3.423 | 49.187 | 1.00 | 29.78 | C |
| ATOM | 2037 | N | LEU | H | 5 | 4.449 | 1.526 | 53.209 | 1.00 | 36.62 | N |
| ATOM | 2038 | CA | LEU | H | 5 | 4.846 | 0.814 | 54.424 | 1.00 | 36.28 | C |
| ATOM | 2039 | C | LEU | H | 5 | 3.667 | 0.761 | 55.391 | 1.00 | 42.14 | C |
| ATOM | 2040 | O | LEU | H | 5 | 3.299 | 1.781 | 55.989 | 1.00 | 38.50 | O |
| ATOM | 2041 | CB | LEU | H | 5 | 6.058 | 1.481 | 55.071 | 1.00 | 48.01 | C |
| ATOM | 2042 | CG | LEU | H | 5 | 7.277 | 1.622 | 54.153 | 1.00 | 60.87 | C |
| ATOM | 2043 | CD1 | LEU | H | 5 | 8.216 | 2.735 | 54.625 | 1.00 | 61.47 | C |
| ATOM | 2044 | CD2 | LEU | H | 5 | 8.023 | 0.302 | 54.059 | 1.00 | 68.40 | C |
| ATOM | 2045 | N | GLU | H | 6 | 3.088 | −0.429 | 55.544 | 1.00 | 38.98 | N |
| ATOM | 2046 | CA | GLU | H | 6 | 1.957 | −0.638 | 56.434 | 1.00 | 37.49 | C |
| ATOM | 2047 | C | GLU | H | 6 | 2.426 | −0.832 | 57.866 | 1.00 | 41.93 | C |
| ATOM | 2048 | O | GLU | H | 6 | 3.528 | −1.321 | 58.122 | 1.00 | 49.80 | O |
| ATOM | 2049 | CB | GLU | H | 6 | 1.144 | −1.877 | 56.044 | 1.00 | 36.72 | C |
| ATOM | 2050 | CG | GLU | H | 6 | 0.462 | −1.858 | 54.685 | 1.00 | 39.54 | C |
| ATOM | 2051 | CD | GLU | H | 6 | 1.259 | −2.601 | 53.647 | 1.00 | 40.22 | C |
| ATOM | 2052 | OE1 | GLU | H | 6 | 2.482 | −2.748 | 53.859 | 1.00 | 45.62 | O |
| ATOM | 2053 | OE2 | GLU | H | 6 | 0.675 | −3.037 | 52.632 | 1.00 | 34.18 | O |
| ATOM | 2054 | N | SER | H | 7 | 1.556 | −0.474 | 58.804 | 1.00 | 37.29 | N |
| ATOM | 2055 | CA | SER | H | 7 | 1.786 | −0.760 | 60.213 | 1.00 | 40.33 | C |
| ATOM | 2056 | C | SER | H | 7 | 0.438 | −0.867 | 60.908 | 1.00 | 45.83 | C |
| ATOM | 2057 | O | SER | H | 7 | −0.600 | −0.475 | 60.364 | 1.00 | 43.96 | O |
| ATOM | 2058 | CB | SER | H | 7 | 2.664 | 0.309 | 60.876 | 1.00 | 47.85 | C |
| ATOM | 2059 | OG | SER | H | 7 | 2.047 | 1.584 | 60.832 | 1.00 | 52.79 | O |
| ATOM | 2060 | N | GLY | H | 8 | 0.462 | −1.415 | 62.123 | 1.00 | 40.72 | N |
| ATOM | 2061 | CA | GLY | H | 8 | −0.713 | −1.455 | 62.964 | 1.00 | 39.23 | C |
| ATOM | 2062 | C | GLY | H | 8 | −1.380 | −2.806 | 63.085 | 1.00 | 42.26 | C |
| ATOM | 2063 | O | GLY | H | 8 | −2.318 | −2.942 | 63.881 | 1.00 | 45.72 | O |
| ATOM | 2064 | N | GLY | H | 9 | −0.934 | −3.799 | 62.325 | 1.00 | 44.71 | N |
| ATOM | 2065 | CA | GLY | H | 9 | −1.485 | −5.132 | 62.464 | 1.00 | 47.81 | C |
| ATOM | 2066 | C | GLY | H | 9 | −1.186 | −5.747 | 63.819 | 1.00 | 54.28 | C |
| ATOM | 2067 | O | GLY | H | 9 | −0.287 | −5.329 | 64.551 | 1.00 | 61.38 | O |
| ATOM | 2068 | N | GLY | H | 10 | −1.969 | −6.760 | 64.155 | 1.00 | 47.63 | N |
| ATOM | 2069 | CA | GLY | H | 10 | −1.794 | −7.451 | 65.414 | 1.00 | 46.40 | C |
| ATOM | 2070 | C | GLY | H | 10 | −3.038 | −8.247 | 65.753 | 1.00 | 42.27 | C |
| ATOM | 2071 | O | GLY | H | 10 | −3.943 | −8.408 | 64.935 | 1.00 | 50.21 | O |
| ATOM | 2072 | N | LEU | H | 11 | −3.063 | −8.728 | 66.986 | 1.00 | 52.83 | N |
| ATOM | 2073 | CA | LEU | H | 11 | −4.157 | −9.556 | 67.465 | 1.00 | 57.86 | C |
| ATOM | 2074 | C | LEU | H | 11 | −5.205 | −8.695 | 68.158 | 1.00 | 60.18 | C |
| ATOM | 2075 | O | LEU | H | 11 | −4.873 | −7.771 | 68.906 | 1.00 | 67.53 | O |
| ATOM | 2076 | CB | LEU | H | 11 | −3.634 | −10.630 | 68.422 | 1.00 | 57.12 | C |
| ATOM | 2077 | CG | LEU | H | 11 | −4.680 | −11.525 | 69.083 | 1.00 | 55.64 | C |
| ATOM | 2078 | CD1 | LEU | H | 11 | −5.401 | −12.385 | 68.056 | 1.00 | 52.79 | C |
| ATOM | 2079 | CD2 | LEU | H | 11 | −4.030 | −12.381 | 70.160 | 1.00 | 60.74 | C |
| ATOM | 2080 | N | VAL | H | 12 | −6.475 | −9.009 | 67.908 | 1.00 | 54.00 | N |
| ATOM | 2081 | CA | VAL | H | 12 | −7.589 | −8.257 | 68.471 | 1.00 | 57.46 | C |
| ATOM | 2082 | C | VAL | H | 12 | −8.715 | −9.232 | 68.793 | 1.00 | 61.49 | C |
| ATOM | 2083 | O | VAL | H | 12 | −8.899 | −10.244 | 68.111 | 1.00 | 60.56 | O |
| ATOM | 2084 | CB | VAL | H | 12 | −8.038 | −7.139 | 67.495 | 1.00 | 52.27 | C |
| ATOM | 2085 | CG1 | VAL | H | 12 | −8.207 | −7.694 | 66.106 | 1.00 | 50.50 | C |
| ATOM | 2086 | CG2 | VAL | H | 12 | −9.320 | −6.465 | 67.965 | 1.00 | 54.97 | C |
| ATOM | 2087 | N | GLN | H | 13 | −9.455 | −8.936 | 69.872 | 1.00 | 65.07 | N |
| ATOM | 2088 | CA | GLN | H | 13 | −10.601 | −9.742 | 70.263 | 1.00 | 72.40 | C |
| ATOM | 2089 | C | GLN | H | 13 | −11.780 | −9.479 | 69.328 | 1.00 | 73.80 | C |
| ATOM | 2090 | O | GLN | H | 13 | −11.909 | −8.380 | 68.780 | 1.00 | 72.64 | O |
| ATOM | 2091 | CB | GLN | H | 13 | −11.006 | −9.427 | 71.699 | 1.00 | 73.31 | C |
| ATOM | 2092 | CG | GLN | H | 13 | −9.844 | −9.447 | 72.680 | 1.00 | 81.35 | C |
| ATOM | 2093 | CD | GLN | H | 13 | −9.048 | −10.736 | 72.619 | 1.00 | 88.30 | C |
| ATOM | 2094 | OE1 | GLN | H | 13 | −7.837 | −10.721 | 72.384 | 1.00 | 92.12 | O |
| ATOM | 2095 | NE2 | GLN | H | 13 | −9.726 | −11.861 | 72.827 | 1.00 | 88.52 | N |
| ATOM | 2096 | N | PRO | H | 14 | −12.652 | −10.470 | 69.126 | 1.00 | 74.98 | N |
| ATOM | 2097 | CA | PRO | H | 14 | −13.820 | −10.252 | 68.262 | 1.00 | 68.38 | C |
| ATOM | 2098 | C | PRO | H | 14 | −14.693 | −9.124 | 68.791 | 1.00 | 68.63 | C |
| ATOM | 2099 | O | PRO | H | 14 | −14.840 | −8.930 | 70.001 | 1.00 | 67.46 | O |
| ATOM | 2100 | CB | PRO | H | 14 | −14.559 | −11.596 | 68.303 | 1.00 | 71.35 | C |
| ATOM | 2101 | CG | PRO | H | 14 | −13.543 | −12.583 | 68.750 | 1.00 | 75.89 | C |
| ATOM | 2102 | CD | PRO | H | 14 | −12.606 | −11.844 | 69.656 | 1.00 | 78.07 | C |
| ATOM | 2103 | N | GLY | H | 15 | −15.275 | −8.372 | 67.861 | 1.00 | 67.68 | N |
| ATOM | 2104 | CA | GLY | H | 15 | −16.000 | −7.173 | 68.213 | 1.00 | 68.08 | C |
| ATOM | 2105 | C | GLY | H | 15 | −15.127 | −6.001 | 68.595 | 1.00 | 68.42 | C |
| ATOM | 2106 | O | GLY | H | 15 | −15.657 | −4.910 | 68.837 | 1.00 | 69.70 | O |
| ATOM | 2107 | N | GLY | H | 16 | −13.810 | −6.191 | 68.670 | 1.00 | 64.65 | N |
| ATOM | 2108 | CA | GLY | H | 16 | −12.890 | −5.119 | 68.976 | 1.00 | 62.02 | C |
| ATOM | 2109 | C | GLY | H | 16 | −12.604 | −4.264 | 67.758 | 1.00 | 55.90 | C |
| ATOM | 2110 | O | GLY | H | 16 | −13.257 | −4.363 | 66.717 | 1.00 | 54.21 | O |
| ATOM | 2111 | N | SER | H | 17 | −11.587 | −3.414 | 67.892 | 1.00 | 55.54 | N |
| ATOM | 2112 | CA | SER | H | 17 | −11.267 | −2.457 | 66.843 | 1.00 | 59.62 | C |

TABLE 17-continued

| | | | | | | | | | | |
|---|---|---|---|---|---|---|---|---|---|---|
| ATOM | 2113 | C | SER | H | 17 | −9.755 | −2.299 | 66.720 | 1.00 | 57.94 C |
| ATOM | 2114 | O | SER | H | 17 | −8.998 | −2.590 | 67.650 | 1.00 | 57.42 O |
| ATOM | 2115 | CB | SER | H | 17 | −11.937 | −1.097 | 67.105 | 1.00 | 65.87 C |
| ATOM | 2116 | OG | SER | H | 17 | −11.114 | −0.251 | 67.884 | 1.00 | 71.51 O |
| ATOM | 2117 | N | LEU | H | 18 | −9.329 | −1.827 | 65.548 | 1.00 | 49.49 N |
| ATOM | 2118 | CA | LEU | H | 18 | −7.918 | −1.680 | 65.215 | 1.00 | 51.59 C |
| ATOM | 2119 | C | LEU | H | 18 | −7.803 | −0.674 | 64.078 | 1.00 | 45.66 C |
| ATOM | 2120 | O | LEU | H | 18 | −8.722 | −0.537 | 63.268 | 1.00 | 46.10 O |
| ATOM | 2121 | CB | LEU | H | 18 | −7.306 | −3.031 | 64.816 | 1.00 | 56.53 C |
| ATOM | 2122 | CG | LEU | H | 18 | −5.801 | −3.157 | 64.576 | 1.00 | 61.57 C |
| ATOM | 2123 | CD1 | LEU | H | 18 | −5.037 | −3.004 | 65.883 | 1.00 | 65.68 C |
| ATOM | 2124 | CD2 | LEU | H | 18 | −5.483 | −4.496 | 63.916 | 1.00 | 57.86 C |
| ATOM | 2125 | N | ARG | H | 19 | −6.668 | 0.020 | 64.015 | 1.00 | 46.06 N |
| ATOM | 2126 | C | ARG | H | 19 | −5.120 | 0.676 | 62.258 | 1.00 | 42.35 C |
| ATOM | 2127 | O | ARG | H | 19 | −4.059 | 0.581 | 62.885 | 1.00 | 42.63 O |
| ATOM | 2128 | CA | AARG | H | 19 | −6.408 | 1.027 | 62.990 | 0.55 | 45.63 C |
| ATOM | 2129 | CB | AARG | H | 19 | −6.305 | 2.423 | 63.608 | 0.55 | 49.44 C |
| ATOM | 2130 | CG | AARG | H | 19 | −6.050 | 3.556 | 62.618 | 0.55 | 50.62 C |
| ATOM | 2131 | CD | AARG | H | 19 | −5.771 | 4.855 | 63.374 | 0.55 | 55.01 C |
| ATOM | 2132 | NE | AARG | H | 19 | −5.973 | 6.056 | 62.564 | 0.55 | 57.26 N |
| ATOM | 2133 | CZ | AARG | H | 19 | −7.149 | 6.656 | 62.392 | 0.55 | 56.19 C |
| ATOM | 2134 | NH1 | AARG | H | 19 | −8.242 | 6.164 | 62.961 | 0.55 | 59.04 N |
| ATOM | 2135 | NH2 | AARG | H | 19 | −7.235 | 7.748 | 61.649 | 0.55 | 51.48 N |
| ATOM | 2136 | CA | BARG | H | 19 | −6.416 | 1.013 | 62.979 | 0.45 | 45.77 C |
| ATOM | 2137 | CB | BARG | H | 19 | −6.354 | 2.421 | 63.564 | 0.45 | 49.44 C |
| ATOM | 2138 | CG | BARG | H | 19 | −6.254 | 3.518 | 62.520 | 0.45 | 50.42 C |
| ATOM | 2139 | CD | BARG | H | 19 | −6.830 | 4.804 | 63.081 | 0.45 | 55.98 C |
| ATOM | 2140 | NE | BARG | H | 19 | −6.058 | 5.990 | 62.721 | 0.45 | 57.24 N |
| ATOM | 2141 | CZ | BARG | H | 19 | −4.893 | 6.316 | 63.270 | 0.45 | 55.47 C |
| ATOM | 2142 | NH1 | BARG | H | 19 | −4.347 | 5.533 | 64.187 | 0.45 | 54.78 N |
| ATOM | 2143 | NH2 | BARG | H | 19 | −4.268 | 7.421 | 62.896 | 0.45 | 54.33 N |
| ATOM | 2144 | N | LEU | H | 20 | −5.213 | 0.498 | 60.942 | 1.00 | 35.18 N |
| ATOM | 2145 | CA | LEU | H | 20 | −4.064 | 0.248 | 60.088 | 1.00 | 38.58 C |
| ATOM | 2146 | C | LEU | H | 20 | −3.577 | 1.551 | 59.479 | 1.00 | 42.38 C |
| ATOM | 2147 | O | LEU | H | 20 | −4.368 | 2.458 | 59.199 | 1.00 | 41.42 O |
| ATOM | 2148 | CB | LEU | H | 20 | −4.408 | −0.737 | 58.975 | 1.00 | 35.97 C |
| ATOM | 2149 | CG | LEU | H | 20 | −4.978 | −2.083 | 59.427 | 1.00 | 42.69 C |
| ATOM | 2150 | CD1 | LEU | H | 20 | −5.234 | −2.972 | 58.226 | 1.00 | 39.91 C |
| ATOM | 2151 | CD2 | LEU | H | 20 | −4.054 | −2.767 | 60.422 | 1.00 | 41.49 C |
| ATOM | 2152 | N | SER | H | 21 | −2.265 | 1.633 | 59.272 | 1.00 | 40.65 N |
| ATOM | 2153 | CA | SER | H | 21 | −1.630 | 2.807 | 58.685 | 1.00 | 40.06 C |
| ATOM | 2154 | C | SER | H | 21 | −0.753 | 2.396 | 57.516 | 1.00 | 41.79 C |
| ATOM | 2155 | O | SER | H | 21 | −0.145 | 1.324 | 57.524 | 1.00 | 40.08 O |
| ATOM | 2156 | CB | SER | H | 21 | −0.767 | 3.566 | 59.703 | 1.00 | 46.49 C |
| ATOM | 2157 | OG | SER | H | 21 | −1.584 | 4.234 | 60.641 | 1.00 | 55.68 O |
| ATOM | 2158 | N | CYS | H | 22 | −0.660 | 3.278 | 56.524 | 1.00 | 37.51 N |
| ATOM | 2159 | CA | CYS | H | 22 | 0.213 | 3.048 | 55.382 | 1.00 | 36.49 C |
| ATOM | 2160 | C | CYS | H | 22 | 0.919 | 4.359 | 55.065 | 1.00 | 43.72 C |
| ATOM | 2161 | O | CYS | H | 22 | 0.276 | 5.334 | 54.659 | 1.00 | 40.45 O |
| ATOM | 2162 | CB | CYS | H | 22 | −0.583 | 2.522 | 54.183 | 1.00 | 43.55 C |
| ATOM | 2163 | SG | CYS | H | 22 | 0.316 | 2.369 | 52.613 | 1.00 | 48.51 S |
| ATOM | 2164 | N | ALA | H | 23 | 2.233 | 4.389 | 55.274 | 1.00 | 38.87 N |
| ATOM | 2165 | CA | ALA | H | 23 | 3.038 | 5.563 | 54.958 | 1.00 | 39.29 C |
| ATOM | 2166 | C | ALA | H | 23 | 3.581 | 5.441 | 53.538 | 1.00 | 40.36 C |
| ATOM | 2167 | O | ALA | H | 23 | 4.260 | 4.463 | 53.210 | 1.00 | 45.00 O |
| ATOM | 2168 | CB | ALA | H | 23 | 4.187 | 5.721 | 55.955 | 1.00 | 38.55 C |
| ATOM | 2169 | N | ALA | H | 24 | 3.290 | 6.441 | 52.706 | 1.00 | 35.70 N |
| ATOM | 2170 | CA | ALA | H | 24 | 3.641 | 6.435 | 51.295 | 1.00 | 32.28 C |
| ATOM | 2171 | C | ALA | H | 24 | 4.736 | 7.452 | 50.996 | 1.00 | 35.63 C |
| ATOM | 2172 | O | ALA | H | 24 | 4.801 | 8.519 | 51.619 | 1.00 | 36.81 O |
| ATOM | 2173 | CB | ALA | H | 24 | 2.413 | 6.761 | 50.435 | 1.00 | 30.94 C |
| ATOM | 2174 | N | SER | H | 25 | 5.568 | 7.127 | 50.006 | 1.00 | 37.61 N |
| ATOM | 2175 | CA | SER | H | 25 | 6.595 | 8.034 | 49.515 | 1.00 | 38.40 C |
| ATOM | 2176 | C | SER | H | 25 | 6.918 | 7.671 | 48.073 | 1.00 | 38.52 C |
| ATOM | 2177 | O | SER | H | 25 | 6.686 | 6.544 | 47.627 | 1.00 | 37.08 O |
| ATOM | 2178 | CB | SER | H | 25 | 7.855 | 7.981 | 50.388 | 1.00 | 41.53 C |
| ATOM | 2179 | OG | SER | H | 25 | 8.358 | 6.658 | 50.453 | 1.00 | 42.05 O |
| ATOM | 2180 | N | GLY | H | 26 | 7.451 | 8.649 | 47.341 | 1.00 | 38.12 N |
| ATOM | 2181 | CA | GLY | H | 26 | 7.923 | 8.426 | 45.991 | 1.00 | 35.40 C |
| ATOM | 2182 | C | GLY | H | 26 | 6.959 | 8.772 | 44.879 | 1.00 | 39.55 C |
| ATOM | 2183 | O | GLY | H | 26 | 7.264 | 8.491 | 43.714 | 1.00 | 38.48 O |
| ATOM | 2184 | N | PHE | H | 27 | 5.801 | 9.343 | 45.193 | 1.00 | 37.10 N |
| ATOM | 2185 | CA | PHE | H | 27 | 4.871 | 9.784 | 44.167 | 1.00 | 37.63 C |
| ATOM | 2186 | C | PHE | H | 27 | 4.055 | 10.931 | 44.742 | 1.00 | 36.21 C |
| ATOM | 2187 | O | PHE | H | 27 | 4.115 | 11.224 | 45.934 | 1.00 | 37.00 O |
| ATOM | 2188 | CB | PHE | H | 27 | 3.966 | 8.638 | 43.677 | 1.00 | 36.50 C |
| ATOM | 2189 | CG | PHE | H | 27 | 3.159 | 7.985 | 44.768 | 1.00 | 35.87 C |
| ATOM | 2190 | CD1 | PHE | H | 27 | 3.732 | 7.026 | 45.596 | 1.00 | 33.59 C |
| ATOM | 2191 | CD2 | PHE | H | 27 | 1.823 | 8.319 | 44.961 | 1.00 | 33.22 C |
| ATOM | 2192 | CE1 | PHE | H | 27 | 2.999 | 6.428 | 46.606 | 1.00 | 32.50 C |

TABLE 17-continued

| ATOM | 2193 | CE2 | PHE | H | 27 | 1.080 | 7.723 | 45.973 | 1.00 | 35.44 | C |
|---|---|---|---|---|---|---|---|---|---|---|---|
| ATOM | 2194 | CZ | PHE | H | 27 | 1.660 | 6.772 | 46.789 | 1.00 | 34.21 | C |
| ATOM | 2195 | N | THR | H | 28 | 3.280 | 11.583 | 43.883 | 1.00 | 34.50 | N |
| ATOM | 2196 | CA | THR | H | 28 | 2.458 | 12.703 | 44.328 | 1.00 | 33.27 | C |
| ATOM | 2197 | C | THR | H | 28 | 1.202 | 12.144 | 44.986 | 1.00 | 32.91 | C |
| ATOM | 2198 | O | THR | H | 28 | 0.226 | 11.809 | 44.310 | 1.00 | 33.03 | O |
| ATOM | 2199 | CB | THR | H | 28 | 2.124 | 13.615 | 43.157 | 1.00 | 35.08 | C |
| ATOM | 2200 | OG1 | THR | H | 28 | 3.351 | 14.074 | 42.576 | 1.00 | 39.07 | O |
| ATOM | 2201 | CG2 | THR | H | 28 | 1.301 | 14.794 | 43.639 | 1.00 | 32.14 | C |
| ATOM | 2202 | N | PHE | H | 29 | 1.241 | 12.056 | 46.316 | 1.00 | 31.83 | N |
| ATOM | 2203 | CA | PHE | H | 29 | 0.260 | 11.286 | 47.077 | 1.00 | 30.19 | C |
| ATOM | 2204 | C | PHE | H | 29 | −1.160 | 11.747 | 46.784 | 1.00 | 37.46 | C |
| ATOM | 2205 | O | PHE | H | 29 | −2.051 | 10.927 | 46.524 | 1.00 | 28.22 | O |
| ATOM | 2206 | CB | PHE | H | 29 | 0.574 | 11.417 | 48.568 | 1.00 | 26.43 | C |
| ATOM | 2207 | CG | PHE | H | 29 | −0.274 | 10.569 | 49.457 | 1.00 | 29.90 | C |
| ATOM | 2208 | CD1 | PHE | H | 29 | −0.155 | 9.189 | 49.449 | 1.00 | 32.70 | C |
| ATOM | 2209 | CD2 | PHE | H | 29 | −1.166 | 11.153 | 50.335 | 1.00 | 28.17 | C |
| ATOM | 2210 | CE1 | PHE | H | 29 | −0.930 | 8.414 | 50.299 | 1.00 | 32.65 | C |
| ATOM | 2211 | CE2 | PHE | H | 29 | −1.927 | 10.394 | 51.194 | 1.00 | 29.48 | C |
| ATOM | 2212 | CZ | PHE | H | 29 | −1.816 | 9.019 | 51.166 | 1.00 | 30.39 | C |
| ATOM | 2213 | N | SER | H | 30 | −1.386 | 13.064 | 46.814 | 1.00 | 33.55 | N |
| ATOM | 2214 | CA | SER | H | 30 | −2.734 | 13.612 | 46.720 | 1.00 | 36.41 | C |
| ATOM | 2215 | C | SER | H | 30 | −3.352 | 13.457 | 45.332 | 1.00 | 32.98 | C |
| ATOM | 2216 | O | SER | H | 30 | −4.550 | 13.716 | 45.188 | 1.00 | 31.37 | C |
| ATOM | 2217 | CB | SER | H | 30 | −2.725 | 15.092 | 47.138 | 1.00 | 38.09 | C |
| ATOM | 2218 | OG | SER | H | 30 | −1.816 | 15.829 | 46.339 | 1.00 | 39.09 | O |
| ATOM | 2219 | N | ASER | H | 31 | −2.581 | 13.058 | 44.319 | 0.26 | 28.18 | N |
| ATOM | 2220 | CA | ASER | H | 31 | −3.118 | 12.813 | 42.987 | 0.26 | 28.82 | C |
| ATOM | 2221 | C | ASER | H | 31 | −3.350 | 11.332 | 42.717 | 0.26 | 27.65 | C |
| ATOM | 2222 | O | ASER | H | 31 | −3.656 | 10.958 | 41.580 | 0.26 | 28.12 | O |
| ATOM | 2223 | CB | ASER | H | 31 | −2.192 | 13.397 | 41.916 | 0.26 | 30.67 | C |
| ATOM | 2224 | OG | ASER | H | 31 | −1.010 | 12.629 | 41.784 | 0.26 | 32.54 | O |
| ATOM | 2225 | N | BSER | H | 31 | −2.576 | 13.062 | 44.320 | 0.74 | 26.72 | N |
| ATOM | 2226 | CA | BSER | H | 31 | −3.105 | 12.816 | 42.984 | 0.74 | 29.36 | C |
| ATOM | 2227 | C | BSER | H | 31 | −3.386 | 11.339 | 42.728 | 0.74 | 27.37 | C |
| ATOM | 2228 | O | BSER | H | 31 | −3.773 | 10.977 | 41.614 | 0.74 | 29.59 | O |
| ATOM | 2229 | CB | BSER | H | 31 | −2.145 | 13.355 | 41.916 | 0.74 | 29.80 | C |
| ATOM | 2230 | OG | BSER | H | 31 | −2.151 | 14.780 | 41.900 | 0.74 | 34.19 | O |
| ATOM | 2231 | N | TYR | H | 32 | −3.203 | 10.483 | 43.731 | 1.00 | 25.35 | N |
| ATOM | 2232 | CA | TYR | H | 32 | −3.404 | 9.045 | 43.588 | 1.00 | 23.95 | C |
| ATOM | 2233 | C | TYR | H | 32 | −4.534 | 8.559 | 44.482 | 1.00 | 24.30 | C |
| ATOM | 2234 | O | TYR | H | 32 | −4.674 | 9.003 | 45.625 | 1.00 | 25.40 | O |
| ATOM | 2235 | CB | TYR | H | 32 | −2.133 | 8.289 | 43.950 | 1.00 | 28.07 | C |
| ATOM | 2236 | CG | TYR | H | 32 | −1.178 | 8.165 | 42.784 | 1.00 | 32.56 | C |
| ATOM | 2237 | CD1 | TYR | H | 32 | −0.486 | 9.267 | 42.301 | 1.00 | 29.03 | C |
| ATOM | 2238 | CD2 | TYR | H | 32 | −0.962 | 6.933 | 42.177 | 1.00 | 32.99 | C |
| ATOM | 2239 | CE1 | TYR | H | 32 | 0.392 | 9.145 | 41.219 | 1.00 | 31.85 | C |
| ATOM | 2240 | CE2 | TYR | H | 32 | −0.108 | 6.800 | 41.109 | 1.00 | 40.47 | C |
| ATOM | 2241 | CZ | TYR | H | 32 | 0.574 | 7.899 | 40.636 | 1.00 | 41.90 | C |
| ATOM | 2242 | OH | TYR | H | 32 | 1.426 | 7.727 | 39.568 | 1.00 | 45.56 | O |
| ATOM | 2243 | N | ALA | H | 33 | −5.319 | 7.620 | 43.959 | 1.00 | 22.65 | N |
| ATOM | 2244 | CA | ALA | H | 33 | −6.291 | 6.913 | 44.777 | 1.00 | 24.83 | C |
| ATOM | 2245 | C | ALA | H | 33 | −5.566 | 5.863 | 45.598 | 1.00 | 28.15 | C |
| ATOM | 2246 | O | ALA | H | 33 | −4.550 | 5.308 | 45.165 | 1.00 | 26.99 | O |
| ATOM | 2247 | CB | ALA | H | 33 | −7.361 | 6.252 | 43.898 | 1.00 | 25.14 | C |
| ATOM | 2248 | N | MET | H | 34 | −6.056 | 5.626 | 46.804 | 1.00 | 24.24 | N |
| ATOM | 2249 | CA | MET | H | 34 | −5.444 | 4.662 | 47.706 | 1.00 | 29.09 | C |
| ATOM | 2250 | C | MET | H | 34 | −6.463 | 3.590 | 48.063 | 1.00 | 33.24 | C |
| ATOM | 2251 | O | MET | H | 34 | −7.647 | 3.881 | 48.277 | 1.00 | 28.78 | O |
| ATOM | 2252 | CB | MET | H | 34 | −4.903 | 5.338 | 48.985 | 1.00 | 32.35 | C |
| ATOM | 2253 | CG | MET | H | 34 | −3.800 | 6.374 | 48.753 | 1.00 | 34.34 | C |
| ATOM | 2254 | SD | MET | H | 34 | −2.285 | 5.676 | 48.029 | 1.00 | 34.98 | S |
| ATOM | 2255 | CE | MET | H | 34 | −1.794 | 4.543 | 49.330 | 1.00 | 32.73 | C |
| ATOM | 2256 | N | SER | H | 35 | −5.999 | 2.350 | 48.157 | 1.00 | 29.52 | N |
| ATOM | 2257 | CA | SER | H | 35 | −6.912 | 1.244 | 48.396 | 1.00 | 26.36 | C |
| ATOM | 2258 | C | SER | H | 35 | −6.334 | 0.289 | 49.429 | 1.00 | 30.25 | C |
| ATOM | 2259 | O | SER | H | 35 | −5.121 | 0.252 | 49.672 | 1.00 | 28.70 | O |
| ATOM | 2260 | CB | SER | H | 35 | −7.189 | 0.458 | 47.106 | 1.00 | 28.97 | C |
| ATOM | 2261 | OG | SER | H | 35 | −7.906 | 1.233 | 46.171 | 1.00 | 32.65 | O |
| ATOM | 2262 | N | TRP | H | 36 | −7.229 | −0.500 | 50.016 | 1.00 | 26.45 | N |
| ATOM | 2263 | CA | TRP | H | 36 | −6.872 | −1.627 | 50.869 | 1.00 | 28.53 | C |
| ATOM | 2264 | C | TRP | H | 36 | −7.412 | −2.901 | 50.230 | 1.00 | 28.53 | C |
| ATOM | 2265 | O | TRP | H | 36 | −8.583 | −2.961 | 49.825 | 1.00 | 26.56 | O |
| ATOM | 2266 | CB | TRP | H | 36 | −7.424 | −1.474 | 52.294 | 1.00 | 29.35 | C |
| ATOM | 2267 | CG | TRP | H | 36 | −6.813 | −0.349 | 53.118 | 1.00 | 28.34 | C |
| ATOM | 2268 | CD1 | TRP | H | 36 | −7.329 | 0.909 | 53.311 | 1.00 | 31.20 | C |
| ATOM | 2269 | CD2 | TRP | H | 36 | −5.586 | −0.399 | 53.872 | 1.00 | 32.81 | C |
| ATOM | 2270 | NE1 | TRP | H | 36 | −6.494 | 1.642 | 54.130 | 1.00 | 31.37 | N |
| ATOM | 2271 | CE2 | TRP | H | 36 | −5.424 | 0.860 | 54.495 | 1.00 | 32.64 | C |
| ATOM | 2272 | CE3 | TRP | H | 36 | −4.620 | −1.392 | 54.093 | 1.00 | 33.31 | C |

TABLE 17-continued

| | | | | | | | | | | |
|---|---|---|---|---|---|---|---|---|---|---|
| ATOM | 2273 | CZ2 | TRP | H | 36 | −4.327 | 1.158 | 55.312 | 1.00 | 34.46 C |
| ATOM | 2274 | CZ3 | TRP | H | 36 | −3.526 | −1.094 | 54.911 | 1.00 | 31.86 C |
| ATOM | 2275 | CH2 | TRP | H | 36 | −3.386 | 0.172 | 55.502 | 1.00 | 34.44 C |
| ATOM | 2276 | N | VAL | H | 37 | −6.555 | −3.910 | 50.145 | 1.00 | 27.75 N |
| ATOM | 2277 | CA | VAL | H | 37 | −6.874 | −5.230 | 49.606 | 1.00 | 28.33 C |
| ATOM | 2278 | C | VAL | H | 37 | −6.401 | −6.238 | 50.643 | 1.00 | 28.14 C |
| ATOM | 2279 | O | VAL | H | 37 | −5.318 | −6.068 | 51.214 | 1.00 | 31.44 O |
| ATOM | 2280 | CB | VAL | H | 37 | −6.175 | −5.474 | 48.248 | 1.00 | 25.70 C |
| ATOM | 2281 | CG1 | VAL | H | 37 | −6.427 | −6.876 | 47.747 | 1.00 | 26.32 C |
| ATOM | 2282 | CG2 | VAL | H | 37 | −6.623 | −4.455 | 47.196 | 1.00 | 30.43 C |
| ATOM | 2283 | N | ARG | H | 38 | −7.204 | −7.277 | 50.903 | 1.00 | 27.75 N |
| ATOM | 2284 | CA | ARG | H | 38 | −6.844 | −8.248 | 51.930 | 1.00 | 25.57 C |
| ATOM | 2285 | C | ARG | H | 38 | −6.802 | −9.665 | 51.369 | 1.00 | 30.43 C |
| ATOM | 2286 | O | ARG | H | 38 | −7.448 | −9.981 | 50.366 | 1.00 | 27.88 O |
| ATOM | 2287 | CB | ARG | H | 38 | −7.807 | −8.195 | 53.138 | 1.00 | 26.51 C |
| ATOM | 2288 | CG | ARG | H | 38 | −9.220 | −8.748 | 52.879 | 1.00 | 28.54 C |
| ATOM | 2289 | CD | ARG | H | 38 | −10.106 | −8.577 | 54.121 | 1.00 | 30.28 C |
| ATOM | 2290 | NE | ARG | H | 38 | −11.481 | −9.036 | 53.915 | 1.00 | 34.05 N |
| ATOM | 2291 | CZ | ARG | H | 38 | −12.469 | −8.826 | 54.782 | 1.00 | 36.56 C |
| ATOM | 2292 | NH1 | ARG | H | 38 | −12.236 | −8.152 | 55.904 | 1.00 | 36.27 N |
| ATOM | 2293 | NH2 | ARG | H | 38 | −13.690 | −9.278 | 54.527 | 1.00 | 35.20 N |
| ATOM | 2294 | N | GLN | H | 39 | −5.988 | −10.505 | 52.002 | 1.00 | 29.87 N |
| ATOM | 2295 | CA | GLN | H | 39 | −5.910 | −11.923 | 51.653 | 1.00 | 27.67 C |
| ATOM | 2296 | C | GLN | H | 39 | −6.097 | −12.721 | 52.940 | 1.00 | 28.10 C |
| ATOM | 2297 | O | GLN | H | 39 | −5.189 | −12.802 | 53.773 | 1.00 | 32.31 O |
| ATOM | 2298 | CB | GLN | H | 39 | −4.592 | −12.261 | 50.962 | 1.00 | 31.99 C |
| ATOM | 2299 | CG | GLN | H | 39 | −4.496 | −13.720 | 50.478 | 1.00 | 37.93 C |
| ATOM | 2300 | CD | GLN | H | 39 | −3.635 | −13.872 | 49.227 | 1.00 | 44.47 C |
| ATOM | 2301 | OE1 | GLN | H | 39 | −2.561 | −13.264 | 49.109 | 1.00 | 37.97 O |
| ATOM | 2302 | NE2 | GLN | H | 39 | −4.115 | −14.669 | 48.278 | 1.00 | 48.72 N |
| ATOM | 2303 | N | ALA | H | 40 | −7.285 | −13.309 | 53.098 | 1.00 | 31.16 N |
| ATOM | 2304 | CA | ALA | H | 40 | −7.597 | −14.155 | 54.241 | 1.00 | 35.72 C |
| ATOM | 2305 | C | ALA | H | 40 | −6.949 | −15.525 | 54.063 | 1.00 | 31.49 C |
| ATOM | 2306 | O | ALA | H | 40 | −6.669 | −15.940 | 52.937 | 1.00 | 35.76 O |
| ATOM | 2307 | CB | ALA | H | 40 | −9.110 | −14.292 | 54.394 | 1.00 | 36.73 C |
| ATOM | 2308 | N | PRO | H | 41 | −6.694 | −16.245 | 55.157 | 1.00 | 32.63 N |
| ATOM | 2309 | CA | PRO | H | 41 | −5.920 | −17.497 | 55.047 | 1.00 | 35.93 C |
| ATOM | 2310 | C | PRO | H | 41 | −6.593 | −18.517 | 54.139 | 1.00 | 37.33 C |
| ATOM | 2311 | O | PRO | H | 41 | −7.752 | −18.894 | 54.340 | 1.00 | 38.99 O |
| ATOM | 2312 | CB | PRO | H | 41 | −5.835 | −17.988 | 56.497 | 1.00 | 36.41 C |
| ATOM | 2313 | CG | PRO | H | 41 | −5.963 | −16.749 | 57.315 | 1.00 | 38.31 C |
| ATOM | 2314 | CD | PRO | H | 41 | −6.934 | −15.875 | 56.563 | 1.00 | 35.22 C |
| ATOM | 2315 | N | GLY | H | 42 | −5.841 | −18.965 | 53.134 | 1.00 | 35.84 N |
| ATOM | 2316 | CA | GLY | H | 42 | −6.338 | −19.857 | 52.112 | 1.00 | 34.24 C |
| ATOM | 2317 | C | GLY | H | 42 | −7.408 | −19.286 | 51.211 | 1.00 | 41.63 C |
| ATOM | 2318 | O | GLY | H | 42 | −8.073 | −20.048 | 50.507 | 1.00 | 43.27 O |
| ATOM | 2319 | N | LYS | H | 43 | −7.593 | −17.967 | 51.192 | 1.00 | 38.15 N |
| ATOM | 2320 | CA | LYS | H | 43 | −8.679 | −17.363 | 50.429 | 1.00 | 40.92 C |
| ATOM | 2321 | C | LYS | H | 43 | −8.130 | −16.547 | 49.266 | 1.00 | 42.52 C |
| ATOM | 2322 | O | LYS | H | 43 | −6.920 | −16.360 | 49.120 | 1.00 | 44.30 O |
| ATOM | 2323 | CB | LYS | H | 43 | −9.562 | −16.485 | 51.327 | 1.00 | 43.79 C |
| ATOM | 2324 | CG | LYS | H | 43 | −10.206 | −17.224 | 52.501 | 1.00 | 46.03 C |
| ATOM | 2325 | CD | LYS | H | 43 | −11.435 | −18.012 | 52.068 | 1.00 | 46.58 C |
| ATOM | 2326 | CE | LYS | H | 43 | −12.016 | −18.805 | 53.227 | 1.00 | 48.26 C |
| ATOM | 2327 | NZ | LYS | H | 43 | −12.089 | −20.267 | 52.890 | 1.00 | 48.08 N |
| ATOM | 2328 | N | CYS | H | 44 | −9.052 | −16.063 | 48.434 | 1.00 | 46.48 N |
| ATOM | 2329 | CA | CYS | H | 44 | −8.715 | −15.228 | 47.292 | 1.00 | 42.60 C |
| ATOM | 2330 | C | CYS | H | 44 | −8.456 | −13.795 | 47.759 | 1.00 | 36.28 C |
| ATOM | 2331 | O | CYS | H | 44 | −8.984 | −13.353 | 48.780 | 1.00 | 43.23 O |
| ATOM | 2332 | CB | CYS | H | 44 | −9.847 | −15.260 | 46.246 | 1.00 | 51.38 C |
| ATOM | 2333 | SG | CYS | H | 44 | −10.568 | −16.940 | 45.922 | 1.00 | 69.01 S |
| ATOM | 2334 | N | LEU | H | 45 | −7.610 | −13.084 | 47.019 | 1.00 | 33.07 N |
| ATOM | 2335 | CA | LEU | H | 45 | −7.515 | −11.632 | 47.163 | 1.00 | 36.10 C |
| ATOM | 2336 | C | LEU | H | 45 | −8.897 | −10.987 | 47.142 | 1.00 | 32.88 C |
| ATOM | 2337 | O | LEU | H | 45 | −9.737 | −11.309 | 46.297 | 1.00 | 32.09 O |
| ATOM | 2338 | CB | LEU | H | 45 | −6.670 | −11.042 | 46.031 | 1.00 | 34.13 C |
| ATOM | 2339 | CG | LEU | H | 45 | −5.151 | −11.188 | 46.115 | 1.00 | 35.76 C |
| ATOM | 2340 | CD1 | LEU | H | 45 | −4.505 | −10.547 | 44.895 | 1.00 | 32.59 C |
| ATOM | 2341 | CD2 | LEU | H | 45 | −4.652 | −10.534 | 47.401 | 1.00 | 34.31 C |
| ATOM | 2342 | N | GLU | H | 46 | −9.123 | −10.045 | 48.059 | 1.00 | 34.93 N |
| ATOM | 2343 | CA | GLU | H | 46 | −10.417 | −9.378 | 48.184 | 1.00 | 30.67 C |
| ATOM | 2344 | C | GLU | H | 46 | −10.207 | −7.886 | 48.417 | 1.00 | 30.59 C |
| ATOM | 2345 | O | GLU | H | 46 | −9.578 | −7.493 | 49.401 | 1.00 | 31.57 O |
| ATOM | 2346 | CB | GLU | H | 46 | −11.240 | −9.992 | 49.325 | 1.00 | 33.23 C |
| ATOM | 2347 | CG | GLU | H | 46 | −12.569 | −9.284 | 49.606 | 1.00 | 39.20 C |
| ATOM | 2348 | CD | GLU | H | 46 | −13.358 | −9.912 | 50.745 | 1.00 | 48.36 C |
| ATOM | 2349 | OE1 | GLU | H | 46 | −14.586 | −10.097 | 50.582 | 1.00 | 49.49 O |
| ATOM | 2350 | OE2 | GLU | H | 46 | −12.763 | −10.207 | 51.802 | 1.00 | 44.94 O |
| ATOM | 2351 | N | TRP | H | 47 | −10.754 | −7.061 | 47.528 | 1.00 | 30.68 N |
| ATOM | 2352 | CA | TRP | H | 47 | −10.680 | −5.610 | 47.692 | 1.00 | 28.70 C |

TABLE 17-continued

| ATOM | 2353 | C | TRP | H | 47 | −11.552 | −5.181 | 48.864 | 1.00 | 28.46 | C |
| --- | --- | --- | --- | --- | --- | --- | --- | --- | --- | --- | --- |
| ATOM | 2354 | O | TRP | H | 47 | −12.688 | −5.643 | 49.011 | 1.00 | 29.73 | O |
| ATOM | 2355 | CB | TRP | H | 47 | −11.113 | −4.926 | 46.397 | 1.00 | 28.02 | C |
| ATOM | 2356 | CG | TRP | H | 47 | −11.337 | −3.430 | 46.412 | 1.00 | 24.87 | C |
| ATOM | 2357 | CD1 | TRP | H | 47 | −10.398 | −2.445 | 46.241 | 1.00 | 30.17 | C |
| ATOM | 2358 | CD2 | TRP | H | 47 | −12.596 | −2.770 | 46.532 | 1.00 | 30.08 | C |
| ATOM | 2359 | NE1 | TRP | H | 47 | −11.006 | −1.203 | 46.272 | 1.00 | 32.64 | N |
| ATOM | 2360 | CE2 | TRP | H | 47 | −12.357 | −1.380 | 46.447 | 1.00 | 33.85 | C |
| ATOM | 2361 | CE3 | TRP | H | 47 | −13.911 | −3.219 | 46.719 | 1.00 | 28.81 | C |
| ATOM | 2362 | CZ2 | TRP | H | 47 | −13.390 | −0.439 | 46.538 | 1.00 | 33.18 | C |
| ATOM | 2363 | CZ3 | TRP | H | 47 | −14.933 | −2.284 | 46.806 | 1.00 | 28.47 | C |
| ATOM | 2364 | CH2 | TRP | H | 47 | −14.670 | −0.916 | 46.720 | 1.00 | 30.49 | C |
| ATOM | 2365 | N | VAL | H | 48 | −11.015 | −4.310 | 49.709 | 1.00 | 25.69 | N |
| ATOM | 2366 | CA | VAL | H | 48 | −11.702 | −3.878 | 50.924 | 1.00 | 29.44 | C |
| ATOM | 2367 | C | VAL | H | 48 | −12.309 | −2.491 | 50.765 | 1.00 | 30.70 | C |
| ATOM | 2368 | O | VAL | H | 48 | −13.480 | −2.280 | 51.085 | 1.00 | 32.07 | O |
| ATOM | 2369 | CB | VAL | H | 48 | −10.731 | −3.926 | 52.123 | 1.00 | 31.62 | C |
| ATOM | 2370 | CG1 | VAL | H | 48 | −11.420 | −3.444 | 53.392 | 1.00 | 32.06 | C |
| ATOM | 2371 | CG2 | VAL | H | 48 | −10.175 | −5.347 | 52.279 | 1.00 | 33.94 | C |
| ATOM | 2372 | N | SER | H | 49 | −11.522 | −1.533 | 50.279 | 1.00 | 30.07 | N |
| ATOM | 2373 | CA | SER | H | 49 | −11.920 | −0.130 | 50.365 | 1.00 | 27.11 | C |
| ATOM | 2374 | C | SER | H | 49 | −11.029 | 0.702 | 49.457 | 1.00 | 30.04 | C |
| ATOM | 2375 | O | SER | H | 49 | −9.879 | 0.340 | 49.209 | 1.00 | 25.41 | O |
| ATOM | 2376 | CB | SER | H | 49 | −11.822 | 0.373 | 51.808 | 1.00 | 27.28 | C |
| ATOM | 2377 | OG | SER | H | 49 | −12.447 | 1.635 | 51.920 | 1.00 | 33.88 | O |
| ATOM | 2378 | N | ALA | H | 50 | −11.553 | 1.850 | 49.007 | 1.00 | 26.06 | N |
| ATOM | 2379 | CA | ALA | H | 50 | −10.765 | 2.775 | 48.197 | 1.00 | 23.84 | C |
| ATOM | 2380 | C | ALA | H | 50 | −11.157 | 4.203 | 48.546 | 1.00 | 26.04 | C |
| ATOM | 2381 | O | ALA | H | 50 | −12.284 | 4.463 | 48.986 | 1.00 | 27.09 | O |
| ATOM | 2382 | CB | ALA | H | 50 | −10.950 | 2.536 | 46.696 | 1.00 | 25.00 | C |
| ATOM | 2383 | N | ILE | H | 51 | −10.211 | 5.123 | 48.345 | 1.00 | 24.86 | N |
| ATOM | 2384 | CA | ILE | H | 51 | −10.412 | 6.536 | 48.663 | 1.00 | 24.43 | C |
| ATOM | 2385 | C | ILE | H | 51 | −9.740 | 7.387 | 47.589 | 1.00 | 27.80 | C |
| ATOM | 2386 | O | ILE | H | 51 | −8.599 | 7.131 | 47.177 | 1.00 | 27.64 | O |
| ATOM | 2387 | CB | ILE | H | 51 | −9.911 | 6.882 | 50.082 | 1.00 | 26.86 | C |
| ATOM | 2388 | CG1 | ILE | H | 51 | −10.275 | 8.324 | 50.469 | 1.00 | 24.82 | C |
| ATOM | 2389 | CG2 | ILE | H | 51 | −8.394 | 6.625 | 50.252 | 1.00 | 27.29 | C |
| ATOM | 2390 | CD1 | ILE | H | 51 | −10.102 | 8.579 | 51.969 | 1.00 | 26.70 | C |
| ATOM | 2391 | N | SER | H | 52 | −10.471 | 8.386 | 47.110 | 1.00 | 25.84 | N |
| ATOM | 2392 | CA | SER | H | 52 | −9.967 | 9.276 | 46.088 | 1.00 | 24.06 | C |
| ATOM | 2393 | C | SER | H | 52 | −8.859 | 10.165 | 46.660 | 1.00 | 25.61 | C |
| ATOM | 2394 | O | SER | H | 52 | −8.669 | 10.271 | 47.877 | 1.00 | 28.39 | O |
| ATOM | 2395 | CB | SER | H | 52 | −11.120 | 10.118 | 45.520 | 1.00 | 22.50 | C |
| ATOM | 2396 | OG | SER | H | 52 | −11.463 | 11.157 | 46.424 | 1.00 | 27.00 | O |
| ATOM | 2397 | N | GLY | H | 53 | −8.127 | 10.813 | 45.747 | 1.00 | 23.84 | N |
| ATOM | 2398 | CA | GLY | H | 53 | −6.967 | 11.607 | 46.136 | 1.00 | 28.08 | C |
| ATOM | 2399 | C | GLY | H | 53 | −7.258 | 12.656 | 47.191 | 1.00 | 32.70 | C |
| ATOM | 2400 | O | GLY | H | 53 | −6.425 | 12.903 | 48.074 | 1.00 | 32.24 | O |
| ATOM | 2401 | N | SER | H | 54 | −8.436 | 13.275 | 47.130 | 1.00 | 28.72 | N |
| ATOM | 2402 | CA | SER | H | 54 | −8.791 | 14.324 | 48.078 | 1.00 | 31.29 | C |
| ATOM | 2403 | C | SER | H | 54 | −9.284 | 13.792 | 49.414 | 1.00 | 37.19 | C |
| ATOM | 2404 | O | SER | H | 54 | −9.353 | 14.564 | 50.377 | 1.00 | 37.47 | O |
| ATOM | 2405 | CB | SER | H | 54 | −9.882 | 15.219 | 47.490 | 1.00 | 33.39 | C |
| ATOM | 2406 | OG | SER | H | 54 | −11.161 | 14.617 | 47.645 | 1.00 | 31.77 | O |
| ATOM | 2407 | N | GLY | H | 55 | −9.636 | 12.511 | 49.490 | 1.00 | 30.05 | N |
| ATOM | 2408 | CA | GLY | H | 55 | −10.358 | 11.965 | 50.616 | 1.00 | 29.86 | C |
| ATOM | 2409 | C | GLY | H | 55 | −11.866 | 11.986 | 50.478 | 1.00 | 30.26 | C |
| ATOM | 2410 | O | GLY | H | 55 | −12.559 | 11.398 | 51.321 | 1.00 | 35.44 | O |
| ATOM | 2411 | N | GLY | H | 56 | −12.404 | 12.646 | 49.451 | 1.00 | 33.90 | N |
| ATOM | 2412 | CA | GLY | H | 56 | −13.836 | 12.891 | 49.420 | 1.00 | 35.26 | C |
| ATOM | 2413 | C | GLY | H | 56 | −14.674 | 11.730 | 48.930 | 1.00 | 37.53 | C |
| ATOM | 2414 | O | GLY | H | 56 | −15.819 | 11.567 | 49.362 | 1.00 | 35.66 | O |
| ATOM | 2415 | N | GLY | H | 57 | −14.140 | 10.924 | 48.006 | 1.00 | 28.92 | N |
| ATOM | 2416 | CA | GLY | H | 57 | −14.840 | 9.769 | 47.491 | 1.00 | 31.25 | C |
| ATOM | 2417 | C | GLY | H | 57 | −14.353 | 8.507 | 48.175 | 1.00 | 30.22 | C |
| ATOM | 2418 | O | GLY | H | 57 | −13.163 | 8.195 | 48.139 | 1.00 | 29.98 | O |
| ATOM | 2419 | N | THR | H | 58 | −15.265 | 7.814 | 48.850 | 1.00 | 26.97 | N |
| ATOM | 2420 | CA | THR | H | 58 | −14.906 | 6.577 | 49.536 | 1.00 | 28.64 | C |
| ATOM | 2421 | C | THR | H | 58 | −15.790 | 5.439 | 49.042 | 1.00 | 32.78 | C |
| ATOM | 2422 | O | THR | H | 58 | −16.969 | 5.635 | 48.732 | 1.00 | 34.02 | O |
| ATOM | 2423 | CB | THR | H | 58 | −15.035 | 6.690 | 51.069 | 1.00 | 33.12 | C |
| ATOM | 2424 | OG1 | THR | H | 58 | −16.388 | 7.021 | 51.411 | 1.00 | 35.44 | O |
| ATOM | 2425 | CG2 | THR | H | 58 | −14.093 | 7.741 | 51.636 | 1.00 | 29.41 | C |
| ATOM | 2426 | N | TYR | H | 59 | −15.206 | 4.241 | 49.003 | 1.00 | 28.06 | N |
| ATOM | 2427 | CA | TYR | H | 59 | −15.810 | 3.041 | 48.439 | 1.00 | 30.19 | C |
| ATOM | 2428 | C | TYR | H | 59 | −15.502 | 1.881 | 49.372 | 1.00 | 33.02 | C |
| ATOM | 2429 | O | TYR | H | 59 | −14.433 | 1.842 | 49.993 | 1.00 | 29.48 | O |
| ATOM | 2430 | CB | TYR | H | 59 | −15.271 | 2.738 | 47.026 | 1.00 | 30.43 | C |
| ATOM | 2431 | CG | TYR | H | 59 | −15.438 | 3.888 | 46.048 | 1.00 | 29.60 | C |
| ATOM | 2432 | CD1 | TYR | H | 59 | −14.612 | 5.016 | 46.107 | 1.00 | 29.03 | C |

TABLE 17-continued

| | | | | | | | | | | |
|---|---|---|---|---|---|---|---|---|---|---|
| ATOM | 2433 | CD2 | TYR | H | 59 | −16.433 | 3.853 | 45.084 | 1.00 | 31.44 | C |
| ATOM | 2434 | CE1 | TYR | H | 59 | −14.773 | 6.070 | 45.219 | 1.00 | 28.81 | C |
| ATOM | 2435 | CE2 | TYR | H | 59 | −16.612 | 4.903 | 44.200 | 1.00 | 31.70 | C |
| ATOM | 2436 | CZ | TYR | H | 59 | −15.785 | 6.007 | 44.272 | 1.00 | 29.45 | C |
| ATOM | 2437 | OH | TYR | H | 59 | −15.963 | 7.038 | 43.383 | 1.00 | 30.11 | O |
| ATOM | 2438 | N | TYR | H | 60 | −16.453 | 0.951 | 49.492 | 1.00 | 33.12 | N |
| ATOM | 2439 | CA | TYR | H | 60 | −16.313 | −0.173 | 50.413 | 1.00 | 32.69 | C |
| ATOM | 2440 | C | TYR | H | 60 | −16.892 | −1.439 | 49.803 | 1.00 | 33.57 | C |
| ATOM | 2441 | O | TYR | H | 60 | −17.912 | −1.391 | 49.115 | 1.00 | 36.77 | O |
| ATOM | 2442 | CB | TYR | H | 60 | −17.024 | 0.090 | 51.751 | 1.00 | 32.21 | C |
| ATOM | 2443 | CG | TYR | H | 60 | −16.498 | 1.273 | 52.520 | 1.00 | 33.29 | C |
| ATOM | 2444 | CD1 | TYR | H | 60 | −15.426 | 1.136 | 53.399 | 1.00 | 34.40 | C |
| ATOM | 2445 | CD2 | TYR | H | 60 | −17.058 | 2.534 | 52.355 | 1.00 | 35.23 | C |
| ATOM | 2446 | CE1 | TYR | H | 60 | −14.937 | 2.213 | 54.097 | 1.00 | 33.37 | C |
| ATOM | 2447 | CE2 | TYR | H | 60 | −16.576 | 3.615 | 53.049 | 1.00 | 34.74 | C |
| ATOM | 2448 | CZ | TYR | H | 60 | −15.518 | 3.455 | 53.918 | 1.00 | 34.47 | C |
| ATOM | 2449 | OH | TYR | H | 60 | −15.045 | 4.546 | 54.611 | 1.00 | 32.00 | O |
| ATOM | 2450 | N | ALA | H | 61 | −16.242 | −2.568 | 50.070 | 1.00 | 31.65 | N |
| ATOM | 2451 | CA | ALA | H | 61 | −16.863 | −3.860 | 49.803 | 1.00 | 31.03 | C |
| ATOM | 2452 | C | ALA | H | 61 | −18.076 | −4.044 | 50.709 | 1.00 | 29.78 | C |
| ATOM | 2453 | O | ALA | H | 61 | −18.101 | −3.574 | 51.849 | 1.00 | 33.02 | O |
| ATOM | 2454 | CB | ALA | H | 61 | −15.854 | −4.996 | 50.023 | 1.00 | 31.55 | C |
| ATOM | 2455 | N | ALA | H | 62 | −19.101 | −4.716 | 50.193 | 1.00 | 34.30 | N |
| ATOM | 2456 | CA | ALA | H | 62 | −20.331 | −4.861 | 50.967 | 1.00 | 40.73 | C |
| ATOM | 2457 | C | ALA | H | 62 | −20.080 | −5.521 | 52.320 | 1.00 | 40.48 | C |
| ATOM | 2458 | O | ALA | H | 62 | −20.724 | −5.167 | 53.314 | 1.00 | 45.89 | O |
| ATOM | 2459 | CB | ALA | H | 62 | −21.361 | −5.656 | 50.167 | 1.00 | 41.10 | C |
| ATOM | 2460 | N | SER | H | 63 | −19.126 | −6.446 | 52.394 | 1.00 | 41.97 | N |
| ATOM | 2461 | CA | SER | H | 63 | −18.920 | −7.176 | 53.640 | 1.00 | 46.50 | C |
| ATOM | 2462 | C | SER | H | 63 | −18.266 | −6.339 | 54.733 | 1.00 | 47.60 | C |
| ATOM | 2463 | O | SER | H | 63 | −18.188 | −6.805 | 55.873 | 1.00 | 48.57 | O |
| ATOM | 2464 | CB | SER | H | 63 | −18.083 | −8.423 | 53.384 | 1.00 | 41.69 | C |
| ATOM | 2465 | OG | SER | H | 63 | −16.817 | −8.072 | 52.873 | 1.00 | 49.77 | O |
| ATOM | 2466 | N | VAL | H | 64 | −17.794 | −5.129 | 54.435 | 1.00 | 37.48 | N |
| ATOM | 2467 | CA | VAL | H | 64 | −17.235 | −4.258 | 55.459 | 1.00 | 39.24 | C |
| ATOM | 2468 | C | VAL | H | 64 | −17.979 | −2.941 | 55.579 | 1.00 | 39.11 | C |
| ATOM | 2469 | O | VAL | H | 64 | −17.653 | −2.144 | 56.465 | 1.00 | 38.45 | O |
| ATOM | 2470 | CB | VAL | H | 64 | −15.728 | −4.003 | 55.235 | 1.00 | 35.97 | C |
| ATOM | 2471 | CG1 | VAL | H | 64 | −14.981 | −5.320 | 55.165 | 1.00 | 34.31 | C |
| ATOM | 2472 | CG2 | VAL | H | 64 | −15.468 | −3.152 | 53.979 | 1.00 | 35.75 | C |
| ATOM | 2473 | N | LYS | H | 65 | −18.965 | −2.684 | 54.716 | 1.00 | 39.38 | N |
| ATOM | 2474 | CA | LYS | H | 65 | −19.701 | −1.425 | 54.779 | 1.00 | 47.38 | C |
| ATOM | 2475 | C | LYS | H | 65 | −20.401 | −1.295 | 56.124 | 1.00 | 51.03 | C |
| ATOM | 2476 | O | LYS | H | 65 | −21.128 | −2.195 | 56.549 | 1.00 | 53.46 | O |
| ATOM | 2477 | CB | LYS | H | 65 | −20.723 | −1.339 | 53.646 | 1.00 | 54.33 | C |
| ATOM | 2478 | CG | LYS | H | 65 | −21.136 | 0.091 | 53.301 | 1.00 | 60.67 | C |
| ATOM | 2479 | CD | LYS | H | 65 | −22.638 | 0.296 | 53.408 | 1.00 | 69.06 | C |
| ATOM | 2480 | CE | LYS | H | 65 | −23.383 | −0.396 | 52.276 | 1.00 | 73.54 | C |
| ATOM | 2481 | NZ | LYS | H | 65 | −24.861 | −0.369 | 52.483 | 1.00 | 76.96 | N |
| ATOM | 2482 | N | GLY | H | 66 | −20.162 | −0.175 | 56.802 | 1.00 | 48.28 | N |
| ATOM | 2483 | CA | GLY | H | 66 | −20.705 | 0.074 | 58.114 | 1.00 | 48.36 | C |
| ATOM | 2484 | C | GLY | H | 66 | −19.765 | −0.252 | 59.256 | 1.00 | 54.98 | C |
| ATOM | 2485 | O | GLY | H | 66 | −19.978 | 0.241 | 60.369 | 1.00 | 58.96 | O |
| ATOM | 2486 | N | ARG | H | 67 | −18.733 | −1.062 | 59.014 | 1.00 | 45.05 | N |
| ATOM | 2487 | CA | ARG | H | 67 | −17.772 | −1.439 | 60.049 | 1.00 | 46.45 | C |
| ATOM | 2488 | C | ARG | H | 67 | −16.397 | −0.812 | 59.863 | 1.00 | 42.32 | C |
| ATOM | 2489 | O | ARG | H | 67 | −15.759 | −0.430 | 60.848 | 1.00 | 44.42 | O |
| ATOM | 2490 | CB | ARG | H | 67 | −17.623 | −2.965 | 60.105 | 1.00 | 44.81 | C |
| ATOM | 2491 | CG | ARG | H | 67 | −18.917 | −3.694 | 60.444 | 1.00 | 47.40 | C |
| ATOM | 2492 | CD | ARG | H | 67 | −18.718 | −5.199 | 60.566 | 1.00 | 50.84 | C |
| ATOM | 2493 | NE | ARG | H | 67 | −18.141 | −5.790 | 59.358 | 1.00 | 48.47 | N |
| ATOM | 2494 | CZ | ARG | H | 67 | −16.969 | −6.420 | 59.320 | 1.00 | 47.05 | C |
| ATOM | 2495 | NH1 | ARG | H | 67 | −16.250 | −6.556 | 60.427 | 1.00 | 45.38 | N |
| ATOM | 2496 | NH2 | ARG | H | 67 | −16.518 | −6.923 | 58.180 | 1.00 | 43.94 | N |
| ATOM | 2497 | N | PHE | H | 68 | −15.917 | −0.706 | 58.627 | 1.00 | 37.42 | N |
| ATOM | 2498 | CA | PHE | H | 68 | −14.606 | −0.145 | 58.342 | 1.00 | 36.77 | C |
| ATOM | 2499 | C | PHE | H | 68 | −14.768 | 1.269 | 57.804 | 1.00 | 36.66 | C |
| ATOM | 2500 | O | PHE | H | 68 | −15.732 | 1.573 | 57.099 | 1.00 | 40.54 | O |
| ATOM | 2501 | CB | PHE | H | 68 | −13.838 | −0.976 | 57.309 | 1.00 | 37.54 | C |
| ATOM | 2502 | CG | PHE | H | 68 | −13.448 | −2.360 | 57.768 | 1.00 | 41.64 | C |
| ATOM | 2503 | CD1 | PHE | H | 68 | −13.855 | −2.864 | 58.990 | 1.00 | 43.21 | C |
| ATOM | 2504 | CD2 | PHE | H | 68 | −12.656 | −3.158 | 56.948 | 1.00 | 39.95 | C |
| ATOM | 2505 | CE1 | PHE | H | 68 | −13.490 | −4.152 | 59.383 | 1.00 | 45.98 | C |
| ATOM | 2506 | CE2 | PHE | H | 68 | −12.284 | −4.435 | 57.333 | 1.00 | 42.52 | C |
| ATOM | 2507 | CZ | PHE | H | 68 | −12.703 | −4.932 | 58.551 | 1.00 | 43.76 | C |
| ATOM | 2508 | N | THR | H | 69 | −13.810 | 2.128 | 58.136 | 1.00 | 39.78 | N |
| ATOM | 2509 | CA | THR | H | 69 | −13.753 | 3.488 | 57.610 | 1.00 | 37.15 | C |
| ATOM | 2510 | C | THR | H | 69 | −12.354 | 3.749 | 57.076 | 1.00 | 35.98 | C |
| ATOM | 2511 | O | THR | H | 69 | −11.371 | 3.585 | 57.808 | 1.00 | 38.48 | O |
| ATOM | 2512 | CB | THR | H | 69 | −14.097 | 4.519 | 58.682 | 1.00 | 41.38 | C |

TABLE 17-continued

| | | | | | | | | | | |
|---|---|---|---|---|---|---|---|---|---|---|
| ATOM | 2513 | OG1 | THR | H | 69 | −15.415 | 4.274 | 59.179 | 1.00 | 42.46 | O |
| ATOM | 2514 | CG2 | THR | H | 69 | −14.025 | 5.922 | 58.090 | 1.00 | 41.20 | C |
| ATOM | 2515 | N | ILE | H | 70 | −12.273 | 4.173 | 55.816 | 1.00 | 33.32 | N |
| ATOM | 2516 | CA | ILE | H | 70 | −11.020 | 4.540 | 55.169 | 1.00 | 30.85 | C |
| ATOM | 2517 | C | ILE | H | 70 | −10.892 | 6.053 | 55.224 | 1.00 | 33.74 | C |
| ATOM | 2518 | O | ILE | H | 70 | −11.891 | 6.784 | 55.187 | 1.00 | 35.79 | O |
| ATOM | 2519 | CB | ILE | H | 70 | −10.964 | 4.001 | 53.720 | 1.00 | 27.23 | C |
| ATOM | 2520 | CG1 | ILE | H | 70 | −9.557 | 4.099 | 53.113 | 1.00 | 26.19 | C |
| ATOM | 2521 | CG2 | ILE | H | 70 | −11.968 | 4.678 | 52.808 | 1.00 | 31.51 | C |
| ATOM | 2522 | CD1 | ILE | H | 70 | −9.445 | 3.349 | 51.780 | 1.00 | 25.64 | C |
| ATOM | 2523 | N | SER | H | 71 | −9.657 | 6.530 | 55.356 | 1.00 | 29.70 | N |
| ATOM | 2524 | CA | SER | H | 71 | −9.406 | 7.964 | 55.448 | 1.00 | 33.09 | C |
| ATOM | 2525 | C | SER | H | 71 | −7.946 | 8.198 | 55.096 | 1.00 | 38.31 | C |
| ATOM | 2526 | O | SER | H | 71 | −7.160 | 7.257 | 54.981 | 1.00 | 33.58 | O |
| ATOM | 2527 | CB | SER | H | 71 | −9.753 | 8.512 | 56.839 | 1.00 | 33.68 | C |
| ATOM | 2528 | OG | SER | H | 71 | −8.802 | 8.103 | 57.816 | 1.00 | 39.34 | O |
| ATOM | 2529 | N | ARG | H | 72 | −7.591 | 9.462 | 54.896 | 1.00 | 33.92 | N |
| ATOM | 2530 | CA | ARG | H | 72 | −6.213 | 9.759 | 54.536 | 1.00 | 34.62 | C |
| ATOM | 2531 | C | ARG | H | 72 | −5.842 | 11.130 | 55.066 | 1.00 | 35.98 | C |
| ATOM | 2532 | O | ARG | H | 72 | −6.691 | 12.015 | 55.185 | 1.00 | 39.66 | O |
| ATOM | 2533 | CB | ARG | H | 72 | −5.985 | 9.704 | 53.018 | 1.00 | 31.86 | C |
| ATOM | 2534 | CG | ARG | H | 72 | −6.829 | 10.699 | 52.227 | 1.00 | 29.25 | C |
| ATOM | 2535 | CD | ARG | H | 72 | −6.849 | 10.354 | 50.735 | 1.00 | 29.53 | C |
| ATOM | 2536 | NE | ARG | H | 72 | −5.534 | 10.505 | 50.117 | 1.00 | 29.34 | N |
| ATOM | 2537 | CZ | ARG | H | 72 | −5.171 | 9.947 | 48.967 | 1.00 | 27.53 | C |
| ATOM | 2538 | NH1 | ARG | H | 72 | −6.022 | 9.185 | 48.294 | 1.00 | 24.96 | N |
| ATOM | 2539 | NH2 | ARG | H | 72 | −3.946 | 10.146 | 48.484 | 1.00 | 30.67 | N |
| ATOM | 2540 | N | ASP | H | 73 | −4.562 | 11.282 | 55.387 | 1.00 | 34.01 | N |
| ATOM | 2541 | CA | ASP | H | 73 | −3.975 | 12.541 | 55.827 | 1.00 | 39.45 | C |
| ATOM | 2542 | C | ASP | H | 73 | −2.936 | 12.931 | 54.780 | 1.00 | 38.43 | C |
| ATOM | 2543 | O | ASP | H | 73 | −1.801 | 12.446 | 54.810 | 1.00 | 39.29 | O |
| ATOM | 2544 | CB | ASP | H | 73 | −3.365 | 12.389 | 57.213 | 1.00 | 35.93 | C |
| ATOM | 2545 | CG | ASP | H | 73 | −2.924 | 13.706 | 57.803 | 1.00 | 50.19 | C |
| ATOM | 2546 | OD1 | ASP | H | 73 | −2.683 | 14.655 | 57.032 | 1.00 | 48.24 | O |
| ATOM | 2547 | OD2 | ASP | H | 73 | −2.815 | 13.792 | 59.042 | 1.00 | 55.99 | O |
| ATOM | 2548 | N | ASN | H | 74 | −3.328 | 13.803 | 53.846 | 1.00 | 36.50 | N |
| ATOM | 2549 | CA | ASN | H | 74 | −2.433 | 14.171 | 52.756 | 1.00 | 34.21 | C |
| ATOM | 2550 | C | ASN | H | 74 | −1.237 | 14.996 | 53.231 | 1.00 | 37.17 | C |
| ATOM | 2551 | O | ASN | H | 74 | −0.194 | 14.983 | 52.570 | 1.00 | 40.56 | O |
| ATOM | 2552 | CB | ASN | H | 74 | −3.211 | 14.913 | 51.664 | 1.00 | 29.34 | C |
| ATOM | 2553 | CG | ASN | H | 74 | −4.120 | 13.984 | 50.865 | 1.00 | 36.61 | C |
| ATOM | 2554 | OD1 | ASN | H | 74 | −4.022 | 12.752 | 50.966 | 1.00 | 35.50 | O |
| ATOM | 2555 | ND2 | ASN | H | 74 | −5.001 | 14.567 | 50.063 | 1.00 | 36.01 | N |
| ATOM | 2556 | N | SER | H | 75 | −1.352 | 15.692 | 54.362 | 1.00 | 36.05 | N |
| ATOM | 2557 | CA | SER | H | 75 | −0.198 | 16.418 | 54.879 | 1.00 | 41.27 | C |
| ATOM | 2558 | C | SER | H | 75 | 0.885 | 15.477 | 55.388 | 1.00 | 47.73 | C |
| ATOM | 2559 | O | SER | H | 75 | 2.041 | 15.894 | 55.508 | 1.00 | 53.75 | O |
| ATOM | 2560 | CB | SER | H | 75 | −0.622 | 17.376 | 55.994 | 1.00 | 45.00 | C |
| ATOM | 2561 | OG | SER | H | 75 | −0.871 | 16.677 | 57.204 | 1.00 | 50.29 | O |
| ATOM | 2562 | N | LYS | H | 76 | 0.542 | 14.224 | 55.690 | 1.00 | 43.86 | N |
| ATOM | 2563 | CA | LYS | H | 76 | 1.507 | 13.239 | 56.168 | 1.00 | 44.09 | C |
| ATOM | 2564 | C | LYS | H | 76 | 1.702 | 12.081 | 55.198 | 1.00 | 41.12 | C |
| ATOM | 2565 | O | LYS | H | 76 | 2.424 | 11.132 | 55.522 | 1.00 | 38.41 | O |
| ATOM | 2566 | CB | LYS | H | 76 | 1.083 | 12.710 | 57.540 | 1.00 | 47.36 | C |
| ATOM | 2567 | CG | LYS | H | 76 | 1.391 | 13.679 | 58.668 | 1.00 | 58.88 | C |
| ATOM | 2568 | CD | LYS | H | 76 | 0.357 | 13.619 | 59.780 | 1.00 | 68.57 | C |
| ATOM | 2569 | CE | LYS | H | 76 | 0.563 | 14.772 | 60.760 | 1.00 | 75.16 | C |
| ATOM | 2570 | NZ | LYS | H | 76 | 0.629 | 16.097 | 60.057 | 1.00 | 74.34 | N |
| ATOM | 2571 | N | ASN | H | 77 | 1.093 | 12.142 | 54.013 | 1.00 | 37.75 | N |
| ATOM | 2572 | CA | ASN | H | 77 | 1.189 | 11.068 | 53.021 | 1.00 | 37.06 | C |
| ATOM | 2573 | C | ASN | H | 77 | 0.853 | 9.714 | 53.636 | 1.00 | 38.62 | C |
| ATOM | 2574 | O | ASN | H | 77 | 1.549 | 8.724 | 53.411 | 1.00 | 36.49 | O |
| ATOM | 2575 | CB | ASN | H | 77 | 2.573 | 11.032 | 52.371 | 1.00 | 41.83 | C |
| ATOM | 2576 | CG | ASN | H | 77 | 2.724 | 12.061 | 51.283 | 1.00 | 45.75 | C |
| ATOM | 2577 | OD1 | ASN | H | 77 | 2.024 | 13.074 | 51.272 | 1.00 | 47.09 | O |
| ATOM | 2578 | ND2 | ASN | H | 77 | 3.627 | 11.801 | 50.343 | 1.00 | 50.40 | N |
| ATOM | 2579 | N | THR | H | 78 | −0.222 | 9.671 | 54.424 | 1.00 | 34.21 | N |
| ATOM | 2580 | CA | THR | H | 78 | −0.573 | 8.469 | 55.163 | 1.00 | 37.63 | C |
| ATOM | 2581 | C | THR | H | 78 | −2.015 | 8.056 | 54.898 | 1.00 | 36.72 | C |
| ATOM | 2582 | O | THR | H | 78 | −2.930 | 8.888 | 54.917 | 1.00 | 34.27 | O |
| ATOM | 2583 | CB | THR | H | 78 | −0.337 | 8.671 | 56.661 | 1.00 | 40.59 | C |
| ATOM | 2584 | OG1 | THR | H | 78 | 1.031 | 9.050 | 56.873 | 1.00 | 41.23 | O |
| ATOM | 2585 | CG2 | THR | H | 78 | −0.622 | 7.389 | 57.422 | 1.00 | 43.77 | C |
| ATOM | 2586 | N | LEU | H | 79 | −2.205 | 6.766 | 54.638 | 1.00 | 32.09 | N |
| ATOM | 2587 | CA | LEU | H | 79 | −3.514 | 6.160 | 54.447 | 1.00 | 30.53 | C |
| ATOM | 2588 | C | LEU | H | 79 | −3.890 | 5.383 | 55.701 | 1.00 | 36.22 | C |
| ATOM | 2589 | O | LEU | H | 79 | −3.033 | 4.759 | 56.329 | 1.00 | 37.52 | O |
| ATOM | 2590 | CB | LEU | H | 79 | −3.504 | 5.219 | 53.242 | 1.00 | 31.30 | C |
| ATOM | 2591 | CG | LEU | H | 79 | −4.690 | 4.271 | 53.074 | 1.00 | 31.48 | C |
| ATOM | 2592 | CD1 | LEU | H | 79 | −5.915 | 5.000 | 52.508 | 1.00 | 31.72 | C |

TABLE 17-continued

| | | | | | | | | | | |
|---|---|---|---|---|---|---|---|---|---|---|
| ATOM | 2593 | CD2 | LEU | H | 79 | −4.295 | 3.088 | 52.181 | 1.00 | 31.87 | C |
| ATOM | 2594 | N | TYR | H | 80 | −5.169 | 5.415 | 56.073 | 1.00 | 29.73 | N |
| ATOM | 2595 | CA | TYR | H | 80 | −5.617 | 4.697 | 57.259 | 1.00 | 31.17 | C |
| ATOM | 2596 | C | TYR | H | 80 | −6.778 | 3.774 | 56.926 | 1.00 | 33.09 | C |
| ATOM | 2597 | O | TYR | H | 80 | −7.536 | 4.016 | 55.984 | 1.00 | 32.48 | O |
| ATOM | 2598 | CB | TYR | H | 80 | −6.066 | 5.638 | 58.378 | 1.00 | 38.33 | C |
| ATOM | 2599 | CG | TYR | H | 80 | −5.026 | 6.636 | 58.811 | 1.00 | 38.84 | C |
| ATOM | 2600 | CD1 | TYR | H | 80 | −3.985 | 6.264 | 59.650 | 1.00 | 44.90 | C |
| ATOM | 2601 | CD2 | TYR | H | 80 | −5.093 | 7.954 | 58.386 | 1.00 | 36.75 | C |
| ATOM | 2602 | CE1 | TYR | H | 80 | −3.031 | 7.176 | 60.049 | 1.00 | 49.77 | C |
| ATOM | 2603 | CE2 | TYR | H | 80 | −4.147 | 8.872 | 58.782 | 1.00 | 42.37 | C |
| ATOM | 2604 | CZ | TYR | H | 80 | −3.121 | 8.482 | 59.614 | 1.00 | 50.17 | C |
| ATOM | 2605 | OH | TYR | H | 80 | −2.180 | 9.405 | 60.008 | 1.00 | 51.29 | O |
| ATOM | 2606 | N | LEU | H | 81 | −6.931 | 2.729 | 57.739 | 1.00 | 36.96 | N |
| ATOM | 2607 | CA | LEU | H | 81 | −8.125 | 1.892 | 57.712 | 1.00 | 36.12 | C |
| ATOM | 2608 | C | LEU | H | 81 | −8.564 | 1.669 | 59.150 | 1.00 | 40.27 | C |
| ATOM | 2609 | O | LEU | H | 81 | −7.879 | 0.980 | 59.913 | 1.00 | 41.39 | O |
| ATOM | 2610 | CB | LEU | H | 81 | −7.879 | 0.562 | 57.003 | 1.00 | 31.95 | C |
| ATOM | 2611 | CG | LEU | H | 81 | −9.163 | −0.268 | 56.923 | 1.00 | 32.74 | C |
| ATOM | 2612 | CD1 | LEU | H | 81 | −10.186 | 0.380 | 55.974 | 1.00 | 31.56 | C |
| ATOM | 2613 | CD2 | LEU | H | 81 | −8.883 | −1.717 | 56.516 | 1.00 | 36.50 | C |
| ATOM | 2614 | N | GLN | H | 82 | −9.698 | 2.260 | 59.522 | 1.00 | 37.58 | N |
| ATOM | 2615 | CA | GLN | H | 82 | −10.266 | 2.099 | 60.855 | 1.00 | 40.99 | C |
| ATOM | 2616 | C | GLN | H | 82 | −11.194 | 0.893 | 60.831 | 1.00 | 41.61 | C |
| ATOM | 2617 | O | GLN | H | 82 | −12.207 | 0.894 | 60.128 | 1.00 | 44.34 | O |
| ATOM | 2618 | CB | GLN | H | 82 | −11.015 | 3.360 | 61.288 | 1.00 | 43.08 | C |
| ATOM | 2619 | CG | GLN | H | 82 | −11.742 | 3.211 | 62.618 | 1.00 | 46.01 | C |
| ATOM | 2620 | CD | GLN | H | 82 | −10.796 | 2.906 | 63.758 | 1.00 | 49.16 | C |
| ATOM | 2621 | OE1 | GLN | H | 82 | −9.792 | 3.593 | 63.947 | 1.00 | 51.57 | O |
| ATOM | 2622 | NE2 | GLN | H | 82 | −11.108 | 1.868 | 64.523 | 1.00 | 51.71 | N |
| ATOM | 2623 | N | MET | H | 83 | −10.849 | −0.141 | 61.587 | 1.00 | 40.17 | N |
| ATOM | 2624 | CA | MET | H | 83 | −11.622 | −1.371 | 61.608 | 1.00 | 45.01 | C |
| ATOM | 2625 | C | MET | H | 83 | −12.345 | −1.471 | 62.939 | 1.00 | 48.29 | C |
| ATOM | 2626 | O | MET | H | 83 | −11.726 | −1.325 | 63.994 | 1.00 | 51.76 | O |
| ATOM | 2627 | CB | MET | H | 83 | −10.724 | −2.592 | 61.401 | 1.00 | 42.56 | C |
| ATOM | 2628 | CG | MET | H | 83 | −9.851 | −2.528 | 60.153 | 1.00 | 49.82 | C |
| ATOM | 2629 | SD | MET | H | 83 | −8.524 | −3.765 | 60.168 | 1.00 | 54.83 | S |
| ATOM | 2630 | CE | MET | H | 83 | −9.431 | −5.248 | 59.733 | 1.00 | 59.15 | C |
| ATOM | 2631 | N | ASER | H | 84 | −13.652 | −1.708 | 62.881 | 0.59 | 47.24 | N |
| ATOM | 2632 | CA | ASER | H | 84 | −14.476 | −1.877 | 64.066 | 0.59 | 48.80 | C |
| ATOM | 2633 | C | ASER | H | 84 | −15.309 | −3.140 | 63.915 | 0.59 | 50.31 | C |
| ATOM | 2634 | O | ASER | H | 84 | −15.418 | −3.709 | 62.824 | 0.59 | 48.96 | O |
| ATOM | 2635 | CB | ASER | H | 84 | −15.401 | −0.676 | 64.289 | 0.59 | 48.80 | C |
| ATOM | 2636 | OG | ASER | H | 84 | −16.554 | −0.792 | 63.471 | 0.59 | 45.61 | O |
| ATOM | 2637 | N | BSER | H | 84 | −13.650 | −1.712 | 62.888 | 0.41 | 47.70 | N |
| ATOM | 2638 | CA | BSER | H | 84 | −14.446 | −1.894 | 64.090 | 0.41 | 48.93 | C |
| ATOM | 2639 | C | BSER | H | 84 | −15.363 | −3.093 | 63.908 | 0.41 | 50.19 | C |
| ATOM | 2640 | O | BSER | H | 84 | −15.566 | −3.581 | 62.792 | 0.41 | 49.44 | O |
| ATOM | 2641 | CB | BSER | H | 84 | −15.267 | −0.639 | 64.423 | 0.41 | 48.63 | C |
| ATOM | 2642 | OG | BSER | H | 84 | −14.422 | 0.437 | 64.790 | 0.41 | 48.50 | O |
| ATOM | 2643 | N | SER | H | 85 | −15.907 | −3.568 | 65.028 | 1.00 | 52.51 | N |
| ATOM | 2644 | CA | SER | H | 85 | −16.844 | −4.693 | 65.041 | 1.00 | 55.54 | C |
| ATOM | 2645 | C | SER | H | 85 | −16.256 | −5.908 | 64.322 | 1.00 | 51.15 | C |
| ATOM | 2646 | O | SER | H | 85 | −16.883 | −6.512 | 63.449 | 1.00 | 48.95 | O |
| ATOM | 2647 | CB | SER | H | 85 | −18.184 | −4.282 | 64.429 | 1.00 | 62.44 | C |
| ATOM | 2648 | OG | SER | H | 85 | −19.071 | −5.381 | 64.353 | 1.00 | 69.53 | O |
| ATOM | 2649 | N | LEU | H | 86 | −15.027 | −6.253 | 64.698 | 1.00 | 48.67 | N |
| ATOM | 2650 | CA | LEU | H | 86 | −14.248 | −7.225 | 63.943 | 1.00 | 49.98 | C |
| ATOM | 2651 | C | LEU | H | 86 | −14.780 | −8.641 | 64.129 | 1.00 | 55.92 | C |
| ATOM | 2652 | O | LEU | H | 86 | −15.153 | −9.048 | 65.235 | 1.00 | 61.31 | O |
| ATOM | 2653 | CB | LEU | H | 86 | −12.782 | −7.154 | 64.368 | 1.00 | 52.77 | C |
| ATOM | 2654 | CG | LEU | H | 86 | −12.066 | −5.906 | 63.851 | 1.00 | 54.99 | C |
| ATOM | 2655 | CD1 | LEU | H | 86 | −10.765 | −5.677 | 64.594 | 1.00 | 55.05 | C |
| ATOM | 2656 | CD2 | LEU | H | 86 | −11.810 | −6.057 | 62.362 | 1.00 | 54.06 | C |
| ATOM | 2657 | N | ARG | H | 87 | −14.806 | −9.395 | 63.032 | 1.00 | 52.93 | N |
| ATOM | 2658 | CA | ARG | H | 87 | −15.206 | −10.793 | 63.021 | 1.00 | 57.24 | C |
| ATOM | 2659 | C | ARG | H | 87 | −14.026 | −11.656 | 62.595 | 1.00 | 55.13 | C |
| ATOM | 2660 | O | ARG | H | 87 | −13.040 | −11.165 | 62.037 | 1.00 | 50.32 | O |
| ATOM | 2661 | CB | ARG | H | 87 | −16.383 | −11.044 | 62.063 | 1.00 | 62.20 | C |
| ATOM | 2662 | CG | ARG | H | 87 | −17.313 | −9.863 | 61.838 | 1.00 | 69.11 | C |
| ATOM | 2663 | CD | ARG | H | 87 | −18.432 | −10.262 | 60.883 | 1.00 | 74.98 | C |
| ATOM | 2664 | NE | ARG | H | 87 | −19.415 | −9.201 | 60.673 | 1.00 | 78.49 | N |
| ATOM | 2665 | CZ | ARG | H | 87 | −19.819 | −8.776 | 59.478 | 1.00 | 80.84 | C |
| ATOM | 2666 | NH1 | ARG | H | 87 | −19.330 | −9.322 | 58.373 | 1.00 | 85.14 | N |
| ATOM | 2667 | NH2 | ARG | H | 87 | −20.722 | −7.810 | 59.386 | 1.00 | 80.95 | N |
| ATOM | 2668 | N | ALA | H | 88 | −14.148 | −12.963 | 62.839 | 1.00 | 54.72 | N |
| ATOM | 2669 | CA | ALA | H | 88 | −13.094 | −13.889 | 62.431 | 1.00 | 52.20 | C |
| ATOM | 2670 | C | ALA | H | 88 | −12.861 | −13.862 | 60.922 | 1.00 | 47.39 | C |
| ATOM | 2671 | O | ALA | H | 88 | −11.732 | −14.080 | 60.465 | 1.00 | 45.43 | O |
| ATOM | 2672 | CB | ALA | H | 88 | −13.433 | −15.306 | 62.897 | 1.00 | 57.09 | C |

TABLE 17-continued

| | | | | | | | | | | |
|---|---|---|---|---|---|---|---|---|---|---|
| ATOM | 2673 | N | GLU | H | 89 | −13.907 | −13.598 | 60.135 | 1.00 | 42.10 | N |
| ATOM | 2674 | CA | GLU | H | 89 | −13.749 | −13.455 | 58.692 | 1.00 | 47.01 | C |
| ATOM | 2675 | C | GLU | H | 89 | −12.794 | −12.329 | 58.311 | 1.00 | 45.16 | C |
| ATOM | 2676 | O | GLU | H | 89 | −12.309 | −12.310 | 57.175 | 1.00 | 44.68 | O |
| ATOM | 2677 | CB | GLU | H | 89 | −15.104 | −13.194 | 58.027 | 1.00 | 62.47 | C |
| ATOM | 2678 | CG | GLU | H | 89 | −15.539 | −11.731 | 58.089 | 1.00 | 75.07 | C |
| ATOM | 2679 | CD | GLU | H | 89 | −17.010 | −11.520 | 57.757 | 1.00 | 86.81 | C |
| ATOM | 2680 | OE1 | GLU | H | 89 | −17.346 | −10.458 | 57.187 | 1.00 | 88.64 | O |
| ATOM | 2681 | OE2 | GLU | H | 89 | −17.830 | −12.410 | 58.072 | 1.00 | 90.90 | O |
| ATOM | 2682 | N | ASP | H | 90 | −12.532 | −11.381 | 59.218 | 1.00 | 45.13 | N |
| ATOM | 2683 | CA | ASP | H | 90 | −11.627 | −10.275 | 58.926 | 1.00 | 42.12 | C |
| ATOM | 2684 | C | ASP | H | 90 | −10.159 | −10.633 | 59.116 | 1.00 | 44.18 | C |
| ATOM | 2685 | O | ASP | H | 90 | −9.297 | −9.810 | 58.791 | 1.00 | 42.31 | O |
| ATOM | 2686 | CB | ASP | H | 90 | −11.957 | −9.060 | 59.804 | 1.00 | 43.06 | C |
| ATOM | 2687 | CG | ASP | H | 90 | −13.364 | −8.525 | 59.567 | 1.00 | 48.62 | C |
| ATOM | 2688 | OD1 | ASP | H | 90 | −13.791 | −8.436 | 58.394 | 1.00 | 47.64 | O |
| ATOM | 2689 | OD2 | ASP | H | 90 | −14.040 | −8.192 | 60.564 | 1.00 | 54.62 | O |
| ATOM | 2690 | N | THR | H | 91 | −9.847 | −11.807 | 59.666 | 1.00 | 37.40 | N |
| ATOM | 2691 | CA | THR | H | 91 | −8.452 | −12.216 | 59.766 | 1.00 | 35.74 | C |
| ATOM | 2692 | C | THR | H | 91 | −7.867 | −12.335 | 58.366 | 1.00 | 32.65 | C |
| ATOM | 2693 | O | THR | H | 91 | −8.370 | −13.099 | 57.536 | 1.00 | 37.54 | O |
| ATOM | 2694 | CB | THR | H | 91 | −8.331 | −13.547 | 60.512 | 1.00 | 41.77 | C |
| ATOM | 2695 | OG1 | THR | H | 91 | −8.665 | −13.363 | 61.893 | 1.00 | 42.49 | O |
| ATOM | 2696 | CG2 | THR | H | 91 | −6.914 | −14.086 | 60.406 | 1.00 | 44.10 | C |
| ATOM | 2697 | N | ALA | H | 92 | −6.817 | −11.567 | 58.097 | 1.00 | 33.96 | N |
| ATOM | 2698 | CA | ALA | H | 92 | −6.232 | −11.537 | 56.767 | 1.00 | 33.74 | C |
| ATOM | 2699 | C | ALA | H | 92 | −4.951 | −10.725 | 56.813 | 1.00 | 34.41 | C |
| ATOM | 2700 | O | ALA | H | 92 | −4.717 | −9.961 | 57.751 | 1.00 | 34.70 | O |
| ATOM | 2701 | CB | ALA | H | 92 | −7.195 | −10.932 | 55.742 | 1.00 | 32.18 | C |
| ATOM | 2702 | N | VAL | H | 93 | −4.122 | −10.912 | 55.791 | 1.00 | 32.25 | N |
| ATOM | 2703 | CA | VAL | H | 93 | −3.049 | −9.972 | 55.495 | 1.00 | 33.50 | C |
| ATOM | 2704 | C | VAL | H | 93 | −3.663 | −8.798 | 54.740 | 1.00 | 31.78 | C |
| ATOM | 2705 | O | VAL | H | 93 | −4.366 | −8.994 | 53.743 | 1.00 | 31.44 | O |
| ATOM | 2706 | CB | VAL | H | 93 | −1.937 | −10.649 | 54.675 | 1.00 | 31.34 | C |
| ATOM | 2707 | CG1 | VAL | H | 93 | −0.893 | −9.613 | 54.237 | 1.00 | 30.27 | C |
| ATOM | 2708 | CG2 | VAL | H | 93 | −1.270 | −11.761 | 55.496 | 1.00 | 32.13 | C |
| ATOM | 2709 | N | TYR | H | 94 | −3.429 | −7.582 | 55.230 | 1.00 | 32.46 | N |
| ATOM | 2710 | CA | TYR | H | 94 | −3.988 | −6.364 | 54.646 | 1.00 | 29.81 | C |
| ATOM | 2711 | C | TYR | H | 94 | −2.898 | −5.612 | 53.905 | 1.00 | 30.15 | C |
| ATOM | 2712 | O | TYR | H | 94 | −1.854 | −5.291 | 54.486 | 1.00 | 31.92 | O |
| ATOM | 2713 | CB | TYR | H | 94 | −4.611 | −5.471 | 55.723 | 1.00 | 29.72 | C |
| ATOM | 2714 | CG | TYR | H | 94 | −5.959 | −5.970 | 56.173 | 1.00 | 32.82 | C |
| ATOM | 2715 | CD1 | TYR | H | 94 | −6.058 | −7.079 | 57.000 | 1.00 | 32.14 | C |
| ATOM | 2716 | CD2 | TYR | H | 94 | −7.132 | −5.360 | 55.745 | 1.00 | 31.39 | C |
| ATOM | 2717 | CE1 | TYR | H | 94 | −7.284 | −7.570 | 57.403 | 1.00 | 34.53 | C |
| ATOM | 2718 | CE2 | TYR | H | 94 | −8.369 | −5.844 | 56.147 | 1.00 | 31.00 | C |
| ATOM | 2719 | CZ | TYR | H | 94 | −8.433 | −6.958 | 56.975 | 1.00 | 34.77 | C |
| ATOM | 2720 | OH | TYR | H | 94 | −9.639 | −7.460 | 57.395 | 1.00 | 33.41 | O |
| ATOM | 2721 | N | TYR | H | 95 | −3.145 | −5.331 | 52.628 | 1.00 | 26.92 | N |
| ATOM | 2722 | CA | TYR | H | 95 | −2.198 | −4.651 | 51.760 | 1.00 | 27.65 | C |
| ATOM | 2723 | C | TYR | H | 95 | −2.704 | −3.254 | 51.452 | 1.00 | 32.15 | C |
| ATOM | 2724 | O | TYR | H | 95 | −3.888 | −3.067 | 51.159 | 1.00 | 29.71 | O |
| ATOM | 2725 | CB | TYR | H | 95 | −2.021 | −5.391 | 50.434 | 1.00 | 24.85 | C |
| ATOM | 2726 | CG | TYR | H | 95 | −1.336 | −6.733 | 50.535 | 1.00 | 30.00 | C |
| ATOM | 2727 | CD1 | TYR | H | 95 | 0.046 | −6.815 | 50.614 | 1.00 | 27.62 | C |
| ATOM | 2728 | CD2 | TYR | H | 95 | −2.063 | −7.911 | 50.525 | 1.00 | 30.85 | C |
| ATOM | 2729 | CE1 | TYR | H | 95 | 0.689 | −8.044 | 50.698 | 1.00 | 32.52 | C |
| ATOM | 2730 | CE2 | TYR | H | 95 | −1.430 | −9.150 | 50.603 | 1.00 | 32.02 | C |
| ATOM | 2731 | CZ | TYR | H | 95 | −0.051 | −9.203 | 50.693 | 1.00 | 31.38 | C |
| ATOM | 2732 | OH | TYR | H | 95 | 0.593 | −10.419 | 50.780 | 1.00 | 34.53 | O |
| ATOM | 2733 | N | ACYS | H | 96 | −1.772 | −2.313 | 51.476 | 0.42 | 31.31 | N |
| ATOM | 2734 | CA | ACYS | H | 96 | −1.964 | −0.982 | 50.929 | 0.42 | 31.82 | C |
| ATOM | 2735 | C | ACYS | H | 96 | −1.639 | −0.992 | 49.438 | 0.42 | 30.04 | C |
| ATOM | 2736 | O | ACYS | H | 96 | −0.703 | −1.672 | 49.005 | 0.42 | 31.02 | O |
| ATOM | 2737 | CB | ACYS | H | 96 | −1.047 | −0.024 | 51.684 | 0.42 | 33.43 | C |
| ATOM | 2738 | SG | ACYS | H | 96 | −1.068 | 1.705 | 51.285 | 0.42 | 38.11 | S |
| ATOM | 2739 | N | BCYS | H | 96 | −1.835 | −2.256 | 51.537 | 0.58 | 30.59 | N |
| ATOM | 2740 | CA | BCYS | H | 96 | −2.213 | −0.992 | 50.926 | 0.58 | 31.62 | C |
| ATOM | 2741 | C | BCYS | H | 96 | −1.694 | −0.971 | 49.496 | 0.58 | 29.99 | C |
| ATOM | 2742 | O | BCYS | H | 96 | −0.681 | −1.598 | 49.167 | 0.58 | 31.73 | O |
| ATOM | 2743 | CB | BCYS | H | 96 | −1.714 | 0.227 | 51.719 | 0.58 | 35.14 | C |
| ATOM | 2744 | SG | BCYS | H | 96 | 0.059 | 0.413 | 51.988 | 0.58 | 38.76 | S |
| ATOM | 2745 | N | ALA | H | 97 | −2.424 | −0.264 | 48.638 | 1.00 | 24.99 | N |
| ATOM | 2746 | CA | ALA | H | 97 | −2.127 | −0.199 | 47.217 | 1.00 | 23.02 | C |
| ATOM | 2747 | C | ALA | H | 97 | −2.530 | 1.166 | 46.705 | 1.00 | 30.21 | C |
| ATOM | 2748 | O | ALA | H | 97 | −3.337 | 1.866 | 47.321 | 1.00 | 33.18 | O |
| ATOM | 2749 | CB | ALA | H | 97 | −2.854 | −1.283 | 46.416 | 1.00 | 24.98 | C |
| ATOM | 2750 | N | THR | H | 98 | −1.981 | 1.528 | 45.560 | 1.00 | 24.85 | N |
| ATOM | 2751 | CA | THR | H | 98 | −2.274 | 2.830 | 44.989 | 1.00 | 31.37 | C |
| ATOM | 2752 | C | THR | H | 98 | −2.440 | 2.683 | 43.487 | 1.00 | 30.27 | C |

TABLE 17-continued

| | | | | | | | | | | |
|---|---|---|---|---|---|---|---|---|---|---|
| ATOM | 2753 | O | THR | H | 98 | −1.888 | 1.767 | 42.871 | 1.00 | 27.99 | O |
| ATOM | 2754 | CB | THR | H | 98 | −1.173 | 3.849 | 45.326 | 1.00 | 37.77 | C |
| ATOM | 2755 | OG1 | THR | H | 98 | −1.628 | 5.173 | 44.996 | 1.00 | 42.46 | O |
| ATOM | 2756 | CG2 | THR | H | 98 | 0.098 | 3.548 | 44.562 | 1.00 | 35.06 | C |
| ATOM | 2757 | N | GLY | H | 99 | −3.210 | 3.605 | 42.908 | 1.00 | 25.25 | N |
| ATOM | 2758 | CA | GLY | H | 99 | −3.463 | 3.663 | 41.480 | 1.00 | 23.04 | C |
| ATOM | 2759 | C | GLY | H | 99 | −3.872 | 5.078 | 41.140 | 1.00 | 27.35 | C |
| ATOM | 2760 | O | GLY | H | 99 | −4.115 | 5.898 | 42.029 | 1.00 | 23.79 | O |
| ATOM | 2761 | N | LYS | H | 100 | −3.941 | 5.366 | 39.836 | 1.00 | 24.93 | N |
| ATOM | 2762 | CA | LYS | H | 100 | −4.155 | 6.752 | 39.427 | 1.00 | 24.87 | C |
| ATOM | 2763 | C | LYS | H | 100 | −5.617 | 7.187 | 39.554 | 1.00 | 25.48 | C |
| ATOM | 2764 | O | LYS | H | 100 | −5.899 | 8.389 | 39.486 | 1.00 | 25.56 | O |
| ATOM | 2765 | CB | LYS | H | 100 | −3.643 | 6.966 | 37.996 | 1.00 | 29.49 | C |
| ATOM | 2766 | CG | LYS | H | 100 | −3.288 | 8.427 | 37.678 | 1.00 | 42.01 | C |
| ATOM | 2767 | CD | LYS | H | 100 | −2.275 | 8.977 | 38.703 | 1.00 | 46.70 | C |
| ATOM | 2768 | CE | LYS | H | 100 | −2.114 | 10.495 | 38.616 | 1.00 | 49.84 | C |
| ATOM | 2769 | NZ | LYS | H | 100 | −1.694 | 10.935 | 37.248 | 1.00 | 51.42 | N |
| ATOM | 2770 | N | GLY | H | 101 | −6.534 | 6.253 | 39.796 | 1.00 | 22.71 | N |
| ATOM | 2771 | CA | GLY | H | 101 | −7.922 | 6.561 | 40.097 | 1.00 | 25.88 | C |
| ATOM | 2772 | C | GLY | H | 101 | −8.535 | 5.380 | 40.816 | 1.00 | 25.77 | C |
| ATOM | 2773 | O | GLY | H | 101 | −8.012 | 4.263 | 40.753 | 1.00 | 23.30 | O |
| ATOM | 2774 | N | VAL | H | 102 | −9.642 | 5.633 | 41.518 | 1.00 | 23.79 | N |
| ATOM | 2775 | CA | VAL | H | 102 | −10.274 | 4.541 | 42.271 | 1.00 | 23.49 | C |
| ATOM | 2776 | C | VAL | H | 102 | −10.668 | 3.394 | 41.347 | 1.00 | 26.84 | C |
| ATOM | 2777 | O | VAL | H | 102 | −10.713 | 2.232 | 41.775 | 1.00 | 26.12 | O |
| ATOM | 2778 | CB | VAL | H | 102 | −11.494 | 5.040 | 43.085 | 1.00 | 25.85 | C |
| ATOM | 2779 | CG1 | VAL | H | 102 | −11.081 | 6.111 | 44.137 | 1.00 | 26.51 | C |
| ATOM | 2780 | CG2 | VAL | H | 102 | −12.588 | 5.541 | 42.163 | 1.00 | 34.01 | C |
| ATOM | 2781 | N | HIS | H | 103 | −10.933 | 3.688 | 40.071 | 1.00 | 24.34 | N |
| ATOM | 2782 | CA | HIS | H | 103 | −11.463 | 2.727 | 39.110 | 1.00 | 22.95 | C |
| ATOM | 2783 | C | HIS | H | 103 | −10.375 | 2.060 | 38.274 | 1.00 | 22.51 | C |
| ATOM | 2784 | O | HIS | H | 103 | −10.703 | 1.317 | 37.339 | 1.00 | 25.11 | O |
| ATOM | 2785 | CB | HIS | H | 103 | −12.428 | 3.443 | 38.156 | 1.00 | 24.36 | C |
| ATOM | 2786 | CG | HIS | H | 103 | −11.779 | 4.595 | 37.450 | 1.00 | 27.23 | C |
| ATOM | 2787 | ND1 | HIS | H | 103 | −11.489 | 5.775 | 38.095 | 1.00 | 25.05 | N |
| ATOM | 2788 | CD2 | HIS | H | 103 | −11.278 | 4.719 | 36.196 | 1.00 | 22.77 | C |
| ATOM | 2789 | CE1 | HIS | H | 103 | −10.901 | 6.603 | 37.251 | 1.00 | 22.92 | C |
| ATOM | 2790 | NE2 | HIS | H | 103 | −10.768 | 5.992 | 36.089 | 1.00 | 24.10 | N |
| ATOM | 2791 | N | LEU | H | 104 | −9.101 | 2.360 | 38.537 | 1.00 | 22.55 | N |
| ATOM | 2792 | CA | LEU | H | 104 | −7.979 | 1.860 | 37.754 | 1.00 | 23.50 | C |
| ATOM | 2793 | C | LEU | H | 104 | −7.185 | 0.841 | 38.563 | 1.00 | 26.21 | C |
| ATOM | 2794 | O | LEU | H | 104 | −7.446 | 0.594 | 39.740 | 1.00 | 28.13 | O |
| ATOM | 2795 | CB | LEU | H | 104 | −7.062 | 3.008 | 37.301 | 1.00 | 25.50 | C |
| ATOM | 2796 | CG | LEU | H | 104 | −7.742 | 4.058 | 36.393 | 1.00 | 23.34 | C |
| ATOM | 2797 | CD1 | LEU | H | 104 | −6.796 | 5.224 | 36.074 | 1.00 | 26.22 | C |
| ATOM | 2798 | CD2 | LEU | H | 104 | −8.215 | 3.445 | 35.111 | 1.00 | 26.47 | C |
| ATOM | 2799 | N | GLY | H | 105 | −6.211 | 0.244 | 37.911 | 1.00 | 23.76 | N |
| ATOM | 2800 | CA | GLY | H | 105 | −5.473 | −0.844 | 38.519 | 1.00 | 24.45 | C |
| ATOM | 2801 | C | GLY | H | 105 | −4.525 | −0.387 | 39.622 | 1.00 | 26.04 | C |
| ATOM | 2802 | O | GLY | H | 105 | −4.265 | 0.804 | 39.825 | 1.00 | 27.66 | O |
| ATOM | 2803 | N | PHE | H | 106 | −3.992 | −1.376 | 40.356 | 1.00 | 25.23 | N |
| ATOM | 2804 | CA | PHE | H | 106 | −3.136 | −1.127 | 41.515 | 1.00 | 24.65 | C |
| ATOM | 2805 | C | PHE | H | 106 | −1.679 | −1.171 | 41.078 | 1.00 | 26.49 | C |
| ATOM | 2806 | O | PHE | H | 106 | −1.082 | −2.245 | 40.988 | 1.00 | 25.57 | O |
| ATOM | 2807 | CB | PHE | H | 106 | −3.407 | −2.154 | 42.609 | 1.00 | 26.05 | C |
| ATOM | 2808 | CG | PHE | H | 106 | −4.844 | −2.222 | 43.030 | 1.00 | 27.83 | C |
| ATOM | 2809 | CD1 | PHE | H | 106 | −5.443 | −1.156 | 43.687 | 1.00 | 32.36 | C |
| ATOM | 2810 | CD2 | PHE | H | 106 | −5.601 | −3.348 | 42.758 | 1.00 | 27.90 | C |
| ATOM | 2811 | CE1 | PHE | H | 106 | −6.789 | −1.216 | 44.070 | 1.00 | 31.87 | C |
| ATOM | 2812 | CE2 | PHE | H | 106 | −6.958 | −3.413 | 43.143 | 1.00 | 34.01 | C |
| ATOM | 2813 | CZ | PHE | H | 106 | −7.541 | −2.332 | 43.799 | 1.00 | 33.85 | C |
| ATOM | 2814 | N | ASP | H | 107 | −1.088 | 0.008 | 40.867 | 1.00 | 26.10 | N |
| ATOM | 2815 | CA | ASP | H | 107 | 0.257 | 0.096 | 40.307 | 1.00 | 24.84 | C |
| ATOM | 2816 | C | ASP | H | 107 | 1.300 | −0.356 | 41.310 | 1.00 | 22.19 | C |
| ATOM | 2817 | O | ASP | H | 107 | 2.326 | −0.926 | 40.929 | 1.00 | 28.48 | O |
| ATOM | 2818 | CB | ASP | H | 107 | 0.563 | 1.537 | 39.873 | 1.00 | 26.56 | C |
| ATOM | 2819 | CG | ASP | H | 107 | −0.364 | 2.026 | 38.763 | 1.00 | 34.38 | C |
| ATOM | 2820 | OD1 | ASP | H | 107 | −0.541 | 1.313 | 37.753 | 1.00 | 31.45 | O |
| ATOM | 2821 | OD2 | ASP | H | 107 | −0.915 | 3.132 | 38.908 | 1.00 | 31.75 | O |
| ATOM | 2822 | N | TYR | H | 108 | 1.081 | −0.063 | 42.586 | 1.00 | 23.40 | N |
| ATOM | 2823 | CA | TYR | H | 108 | 2.063 | −0.358 | 43.617 | 1.00 | 28.27 | C |
| ATOM | 2824 | C | TYR | H | 108 | 1.352 | −0.886 | 44.848 | 1.00 | 25.99 | C |
| ATOM | 2825 | O | TYR | H | 108 | 0.263 | −0.424 | 45.200 | 1.00 | 27.47 | O |
| ATOM | 2826 | CB | TYR | H | 108 | 2.887 | 0.889 | 43.988 | 1.00 | 30.65 | C |
| ATOM | 2827 | CG | TYR | H | 108 | 3.553 | 1.548 | 42.803 | 1.00 | 36.11 | C |
| ATOM | 2828 | CD1 | TYR | H | 108 | 4.764 | 1.068 | 42.305 | 1.00 | 41.25 | C |
| ATOM | 2829 | CD2 | TYR | H | 108 | 2.976 | 2.653 | 42.178 | 1.00 | 39.69 | C |
| ATOM | 2830 | CE1 | TYR | H | 108 | 5.384 | 1.670 | 41.216 | 1.00 | 45.75 | C |
| ATOM | 2831 | CE2 | TYR | H | 108 | 3.591 | 3.262 | 41.083 | 1.00 | 41.86 | C |
| ATOM | 2832 | CZ | TYR | H | 108 | 4.789 | 2.763 | 40.611 | 1.00 | 49.45 | C |

TABLE 17-continued

| | | | | | | | | | | | |
|---|---|---|---|---|---|---|---|---|---|---|---|
| ATOM | 2833 | OH | TYR | H | 108 | 5.398 | 3.368 | 39.534 | 1.00 | 57.67 | O |
| ATOM | 2834 | N | TRP | H | 109 | 1.997 | −1.841 | 45.513 | 1.00 | 23.78 | N |
| ATOM | 2835 | CA | TRP | H | 109 | 1.451 | −2.521 | 46.674 | 1.00 | 26.11 | C |
| ATOM | 2836 | C | TRP | H | 109 | 2.453 | −2.429 | 47.811 | 1.00 | 30.86 | C |
| ATOM | 2837 | O | TRP | H | 109 | 3.661 | −2.485 | 47.582 | 1.00 | 31.32 | O |
| ATOM | 2838 | CB | TRP | H | 109 | 1.194 | −4.008 | 46.397 | 1.00 | 25.66 | C |
| ATOM | 2839 | CG | TRP | H | 109 | 0.188 | −4.321 | 45.292 | 1.00 | 23.70 | C |
| ATOM | 2840 | CD1 | TRP | H | 109 | 0.283 | −4.001 | 43.958 | 1.00 | 25.41 | C |
| ATOM | 2841 | CD2 | TRP | H | 109 | −1.030 | −5.065 | 45.443 | 1.00 | 26.91 | C |
| ATOM | 2842 | NE1 | TRP | H | 109 | −0.818 | −4.499 | 43.275 | 1.00 | 25.42 | N |
| ATOM | 2843 | CE2 | TRP | H | 109 | −1.636 | −5.148 | 44.167 | 1.00 | 26.22 | C |
| ATOM | 2844 | CE3 | TRP | H | 109 | −1.663 | −5.678 | 46.536 | 1.00 | 29.52 | C |
| ATOM | 2845 | CZ2 | TRP | H | 109 | −2.836 | −5.829 | 43.953 | 1.00 | 27.69 | C |
| ATOM | 2846 | CZ3 | TRP | H | 109 | −2.860 | −6.356 | 46.327 | 1.00 | 29.26 | C |
| ATOM | 2847 | CH2 | TRP | H | 109 | −3.440 | −6.418 | 45.044 | 1.00 | 28.27 | C |
| ATOM | 2848 | N | GLY | H | 110 | 1.947 | −2.325 | 49.037 | 1.00 | 27.38 | N |
| ATOM | 2849 | CA | GLY | H | 110 | 2.795 | −2.446 | 50.207 | 1.00 | 33.44 | C |
| ATOM | 2850 | C | GLY | H | 110 | 3.082 | −3.902 | 50.502 | 1.00 | 32.33 | C |
| ATOM | 2851 | O | GLY | H | 110 | 2.684 | −4.804 | 49.770 | 1.00 | 37.97 | O |
| ATOM | 2852 | N | GLN | H | 111 | 3.779 | −4.145 | 51.606 | 1.00 | 31.56 | N |
| ATOM | 2853 | CA | GLN | H | 111 | 4.185 | −5.518 | 51.883 | 1.00 | 29.07 | C |
| ATOM | 2854 | C | GLN | H | 111 | 3.218 | −6.266 | 52.790 | 1.00 | 32.32 | C |
| ATOM | 2855 | O | GLN | H | 111 | 3.426 | −7.455 | 53.045 | 1.00 | 36.48 | O |
| ATOM | 2856 | CB | GLN | H | 111 | 5.603 | −5.551 | 52.467 | 1.00 | 39.66 | C |
| ATOM | 2857 | CG | GLN | H | 111 | 6.651 | −5.762 | 51.371 | 1.00 | 54.76 | C |
| ATOM | 2858 | CD | GLN | H | 111 | 6.324 | −6.951 | 50.457 | 1.00 | 67.92 | C |
| ATOM | 2859 | OE1 | GLN | H | 111 | 6.418 | −6.858 | 49.228 | 1.00 | 67.54 | O |
| ATOM | 2860 | NE2 | GLN | H | 111 | 5.948 | −8.074 | 51.061 | 1.00 | 70.13 | N |
| ATOM | 2861 | N | GLY | H | 112 | 2.155 | −5.624 | 53.256 | 1.00 | 32.95 | N |
| ATOM | 2862 | CA | GLY | H | 112 | 1.145 | −6.351 | 53.998 | 1.00 | 30.80 | C |
| ATOM | 2863 | C | GLY | H | 112 | 1.341 | −6.339 | 55.496 | 1.00 | 34.67 | C |
| ATOM | 2864 | O | GLY | H | 112 | 2.474 | −6.388 | 55.979 | 1.00 | 41.22 | O |
| ATOM | 2865 | N | THR | H | 113 | 0.246 | −6.280 | 56.246 | 1.00 | 40.04 | N |
| ATOM | 2866 | CA | THR | H | 113 | 0.303 | −6.418 | 57.693 | 1.00 | 40.61 | C |
| ATOM | 2867 | C | THR | H | 113 | −0.827 | −7.338 | 58.135 | 1.00 | 36.91 | C |
| ATOM | 2868 | O | THR | H | 113 | −1.944 | −7.259 | 57.617 | 1.00 | 35.55 | O |
| ATOM | 2869 | CB | THR | H | 113 | 0.225 | −5.050 | 58.402 | 1.00 | 46.55 | C |
| ATOM | 2870 | OG1 | THR | H | 113 | 0.410 | −5.226 | 59.812 | 1.00 | 58.17 | O |
| ATOM | 2871 | CG2 | THR | H | 113 | −1.113 | −4.352 | 58.145 | 1.00 | 44.64 | C |
| ATOM | 2872 | N | LEU | H | 114 | −0.521 | −8.229 | 59.074 | 1.00 | 40.84 | N |
| ATOM | 2873 | CA | LEU | H | 114 | −1.440 | −9.285 | 59.484 | 1.00 | 35.82 | C |
| ATOM | 2874 | C | LEU | H | 114 | −2.383 | −8.796 | 60.582 | 1.00 | 35.25 | C |
| ATOM | 2875 | O | LEU | H | 114 | −1.937 | −8.295 | 61.620 | 1.00 | 37.43 | O |
| ATOM | 2876 | CB | LEU | H | 114 | −0.659 | −10.507 | 59.975 | 1.00 | 40.80 | C |
| ATOM | 2877 | CG | LEU | H | 114 | −1.477 | −11.701 | 60.491 | 1.00 | 40.29 | C |
| ATOM | 2878 | CD1 | LEU | H | 114 | −2.338 | −12.291 | 59.374 | 1.00 | 38.00 | C |
| ATOM | 2879 | CD2 | LEU | H | 114 | −0.583 | −12.775 | 61.127 | 1.00 | 39.51 | C |
| ATOM | 2880 | N | VAL | H | 115 | −3.683 | −8.953 | 60.355 | 1.00 | 33.38 | N |
| ATOM | 2881 | CA | VAL | H | 115 | −4.699 | −8.742 | 61.381 | 1.00 | 36.46 | C |
| ATOM | 2882 | C | VAL | H | 115 | −5.282 | −10.098 | 61.751 | 1.00 | 35.63 | C |
| ATOM | 2883 | O | VAL | H | 115 | −5.813 | −10.806 | 60.887 | 1.00 | 42.87 | O |
| ATOM | 2884 | CB | VAL | H | 115 | −5.806 | −7.796 | 60.896 | 1.00 | 39.25 | C |
| ATOM | 2885 | CG1 | VAL | H | 115 | −6.886 | −7.685 | 61.962 | 1.00 | 43.84 | C |
| ATOM | 2886 | CG2 | VAL | H | 115 | −5.222 | −6.442 | 60.546 | 1.00 | 38.57 | C |
| ATOM | 2887 | N | THR | H | 116 | −5.203 | −10.455 | 63.033 | 1.00 | 38.53 | N |
| ATOM | 2888 | CA | THR | H | 116 | −5.774 | −11.694 | 63.542 | 1.00 | 40.03 | C |
| ATOM | 2889 | C | THR | H | 116 | −6.885 | −11.367 | 64.531 | 1.00 | 47.36 | C |
| ATOM | 2890 | O | THR | H | 116 | −6.664 | −10.624 | 65.492 | 1.00 | 52.14 | O |
| ATOM | 2891 | CB | THR | H | 116 | −4.703 | −12.558 | 64.221 | 1.00 | 49.72 | C |
| ATOM | 2892 | OG1 | THR | H | 116 | −3.632 | −12.806 | 63.302 | 1.00 | 51.08 | O |
| ATOM | 2893 | CG2 | THR | H | 116 | −5.295 | −13.893 | 64.686 | 1.00 | 50.88 | C |
| ATOM | 2894 | N | VAL | H | 117 | −8.071 | −11.925 | 64.295 | 1.00 | 43.84 | N |
| ATOM | 2895 | CA | VAL | H | 117 | −9.226 | −11.754 | 65.169 | 1.00 | 50.05 | C |
| ATOM | 2896 | C | VAL | H | 117 | −9.520 | −13.086 | 65.845 | 1.00 | 61.23 | C |
| ATOM | 2897 | O | VAL | H | 117 | −9.488 | −14.137 | 65.195 | 1.00 | 62.26 | O |
| ATOM | 2898 | CB | VAL | H | 117 | −10.460 | −11.262 | 64.392 | 1.00 | 48.87 | C |
| ATOM | 2899 | CG1 | VAL | H | 117 | −11.579 | −10.889 | 65.356 | 1.00 | 50.89 | C |
| ATOM | 2900 | CG2 | VAL | H | 117 | −10.101 | −10.090 | 63.495 | 1.00 | 47.67 | C |
| ATOM | 2901 | N | SER | H | 118 | −9.822 | −13.035 | 67.143 | 1.00 | 70.10 | N |
| ATOM | 2902 | CA | SER | H | 118 | −10.142 | −14.225 | 67.941 | 1.00 | 75.07 | C |
| ATOM | 2903 | C | SER | H | 118 | −8.965 | −15.196 | 67.993 | 1.00 | 85.07 | C |
| ATOM | 2904 | O | SER | H | 118 | −8.251 | −15.271 | 68.994 | 1.00 | 92.24 | O |
| ATOM | 2905 | CB | SER | H | 118 | −11.384 | −14.939 | 67.395 | 1.00 | 70.41 | C |
| ATOM | 2906 | OG | SER | H | 118 | −11.672 | −16.103 | 68.149 | 1.00 | 74.50 | O |
| TER | 2907 | | SER | H | 118 | | | | | | |
| ATOM | 2908 | N | SER | L | 0 | −24.237 | −9.585 | 44.496 | 1.00 | 71.24 | N |
| ATOM | 2909 | CA | SER | L | 0 | −24.493 | −9.264 | 43.096 | 1.00 | 73.66 | C |
| ATOM | 2910 | C | SER | L | 0 | −23.270 | −8.626 | 42.440 | 1.00 | 67.69 | C |
| ATOM | 2911 | O | SER | L | 0 | −23.395 | −7.702 | 41.637 | 1.00 | 70.08 | O |
| ATOM | 2912 | CB | SER | L | 0 | −25.700 | −8.330 | 42.974 | 1.00 | 76.85 | C |

TABLE 17-continued

| ATOM | 2913 | OG | SER | L | 0 | −25.963 | −8.002 | 41.619 | 1.00 | 77.40 | O |
|---|---|---|---|---|---|---|---|---|---|---|---|
| ATOM | 2914 | N | SER | L | 1 | −22.087 | −9.116 | 42.792 | 1.00 | 57.57 | N |
| ATOM | 2915 | CA | SER | L | 1 | −20.861 | −8.606 | 42.202 | 1.00 | 51.67 | C |
| ATOM | 2916 | C | SER | L | 1 | −20.601 | −9.266 | 40.854 | 1.00 | 42.48 | C |
| ATOM | 2917 | O | SER | L | 1 | −21.008 | −10.404 | 40.603 | 1.00 | 44.27 | O |
| ATOM | 2918 | CB | SER | L | 1 | −19.670 | −8.841 | 43.133 | 1.00 | 54.23 | C |
| ATOM | 2919 | OG | SER | L | 1 | −19.683 | −7.942 | 44.231 | 1.00 | 57.58 | O |
| ATOM | 2920 | N | TYR | L | 2 | −19.942 | −8.522 | 39.973 | 1.00 | 32.77 | N |
| ATOM | 2921 | CA | TYR | L | 2 | −19.420 | −9.106 | 38.747 | 1.00 | 33.89 | C |
| ATOM | 2922 | C | TYR | L | 2 | −18.425 | −10.216 | 39.092 | 1.00 | 39.36 | C |
| ATOM | 2923 | O | TYR | L | 2 | −17.676 | −10.118 | 40.070 | 1.00 | 39.32 | O |
| ATOM | 2924 | CB | TYR | L | 2 | −18.763 | −8.016 | 37.915 | 1.00 | 31.35 | C |
| ATOM | 2925 | CG | TYR | L | 2 | −18.343 | −8.407 | 36.531 | 1.00 | 32.32 | C |
| ATOM | 2926 | CD1 | TYR | L | 2 | −19.270 | −8.494 | 35.493 | 1.00 | 33.49 | C |
| ATOM | 2927 | CD2 | TYR | L | 2 | −17.005 | −8.648 | 36.243 | 1.00 | 31.72 | C |
| ATOM | 2928 | CE1 | TYR | L | 2 | −18.871 | −8.835 | 34.212 | 1.00 | 33.37 | C |
| ATOM | 2929 | CE2 | TYR | L | 2 | −16.599 | −8.990 | 34.965 | 1.00 | 31.15 | C |
| ATOM | 2930 | CZ | TYR | L | 2 | −17.529 | −9.072 | 33.955 | 1.00 | 33.95 | C |
| ATOM | 2931 | OH | TYR | L | 2 | −17.124 | −9.409 | 32.686 | 1.00 | 34.33 | O |
| ATOM | 2932 | N | VAL | L | 3 | −18.422 | −11.280 | 38.290 | 1.00 | 37.36 | N |
| ATOM | 2933 | CA | VAL | L | 3 | −17.702 | −12.507 | 38.616 | 1.00 | 37.94 | C |
| ATOM | 2934 | C | VAL | L | 3 | −16.599 | −12.757 | 37.588 | 1.00 | 34.11 | C |
| ATOM | 2935 | O | VAL | L | 3 | −16.863 | −12.794 | 36.381 | 1.00 | 32.68 | O |
| ATOM | 2936 | CB | VAL | I | 3 | −18.665 | −13.707 | 38.692 | 1.00 | 37.90 | C |
| ATOM | 2937 | CG1 | VAL | L | 3 | −17.896 | −15.017 | 38.714 | 1.00 | 34.81 | C |
| ATOM | 2938 | CG2 | VAL | L | 3 | −19.530 | −13.586 | 39.925 | 1.00 | 39.32 | C |
| ATOM | 2939 | N | LEU | L | 4 | −15.368 | −12.940 | 38.070 | 1.00 | 31.87 | N |
| ATOM | 2940 | CA | LEU | L | 4 | −14.231 | −13.306 | 37.238 | 1.00 | 26.99 | C |
| ATOM | 2941 | C | LEU | L | 4 | −13.865 | −14.755 | 37.548 | 1.00 | 28.68 | C |
| ATOM | 2942 | O | LEU | L | 4 | −13.749 | −15.130 | 38.720 | 1.00 | 36.57 | O |
| ATOM | 2943 | CB | LEU | L | 4 | −13.024 | −12.394 | 37.482 | 1.00 | 26.26 | C |
| ATOM | 2944 | CG | LEU | L | 4 | −13.202 | −10.900 | 37.163 | 1.00 | 29.79 | C |
| ATOM | 2945 | CD1 | LEU | L | 4 | −11.948 | −10.158 | 37.580 | 1.00 | 32.19 | C |
| ATOM | 2946 | CD2 | LEU | L | 4 | −13.447 | −10.716 | 35.675 | 1.00 | 28.70 | C |
| ATOM | 2947 | N | THR | L | 5 | −13.704 | −15.565 | 36.510 | 1.00 | 29.62 | N |
| ATOM | 2948 | CA | THR | L | 5 | −13.398 | −16.978 | 36.683 | 1.00 | 29.58 | C |
| ATOM | 2949 | C | THR | L | 5 | −12.058 | −17.311 | 36.038 | 1.00 | 31.19 | C |
| ATOM | 2950 | O | THR | L | 5 | −11.882 | −17.109 | 34.832 | 1.00 | 32.03 | O |
| ATOM | 2951 | CB | THR | L | 5 | −14.497 | −17.856 | 36.085 | 1.00 | 35.92 | C |
| ATOM | 2952 | OG1 | THR | L | 5 | −15.754 | −17.490 | 36.667 | 1.00 | 39.87 | O |
| ATOM | 2953 | CG2 | THR | L | 5 | −14.199 | −19.307 | 36.374 | 1.00 | 40.77 | C |
| ATOM | 2954 | N | GLN | L | 6 | −11.129 | −17.859 | 36.835 | 1.00 | 30.16 | N |
| ATOM | 2955 | CA | GLN | L | 6 | −9.829 | −18.313 | 36.345 | 1.00 | 26.37 | C |
| ATOM | 2956 | C | GLN | L | 6 | −9.665 | −19.807 | 36.586 | 1.00 | 32.98 | C |
| ATOM | 2957 | O | GLN | L | 6 | −10.193 | −20.338 | 37.569 | 1.00 | 35.53 | O |
| ATOM | 2958 | CB | GLN | L | 6 | −8.650 | −17.611 | 37.035 | 1.00 | 28.80 | C |
| ATOM | 2959 | CG | GLN | L | 6 | −8.604 | −16.104 | 36.886 | 1.00 | 27.36 | C |
| ATOM | 2960 | CD | GLN | L | 6 | −7.401 | −15.518 | 37.620 | 1.00 | 27.33 | C |
| ATOM | 2961 | OE1 | GLN | L | 6 | −7.559 | −14.769 | 38.576 | 1.00 | 29.36 | O |
| ATOM | 2962 | NE2 | GLN | L | 6 | −6.200 | −15.891 | 37.195 | 1.00 | 30.66 | N |
| ATOM | 2963 | N | PRO | L | 7 | −8.921 | −20.498 | 35.717 | 1.00 | 36.21 | N |
| ATOM | 2964 | CA | PRO | L | 7 | −8.580 | −21.892 | 35.994 | 1.00 | 35.60 | C |
| ATOM | 2965 | C | PRO | L | 7 | −7.607 | −21.987 | 37.150 | 1.00 | 35.15 | C |
| ATOM | 2966 | O | PRO | L | 7 | −6.777 | −21.083 | 37.368 | 1.00 | 31.90 | O |
| ATOM | 2967 | CB | PRO | L | 7 | −7.934 | −22.364 | 34.678 | 1.00 | 37.07 | C |
| ATOM | 2968 | CG | PRO | L | 7 | −7.412 | −21.097 | 34.051 | 1.00 | 43.76 | C |
| ATOM | 2969 | CD | PRO | L | 7 | −8.408 | −20.048 | 34.411 | 1.00 | 42.74 | C |
| ATOM | 2970 | N | PRO | L | 8 | −7.678 | −23.054 | 37.937 | 1.00 | 28.97 | N |
| ATOM | 2971 | CA | PRO | L | 8 | −6.822 | −23.144 | 39.124 | 1.00 | 37.53 | C |
| ATOM | 2972 | C | PRO | L | 8 | −5.342 | −23.217 | 38.803 | 1.00 | 33.74 | C |
| ATOM | 2973 | O | PRO | L | 8 | −4.524 | −22.699 | 39.576 | 1.00 | 33.27 | O |
| ATOM | 2974 | CB | PRO | L | 8 | −7.299 | −24.434 | 39.807 | 1.00 | 41.92 | C |
| ATOM | 2975 | CG | PRO | L | 8 | −8.641 | −24.729 | 39.232 | 1.00 | 46.67 | C |
| ATOM | 2976 | CD | PRO | L | 8 | −8.644 | −24.166 | 37.850 | 1.00 | 43.34 | C |
| ATOM | 2977 | N | ASER | L | 9 | −4.961 | −23.859 | 37.699 | 0.25 | 32.81 | N |
| ATOM | 2978 | CA | ASER | L | 9 | −3.553 | −24.148 | 37.467 | 0.25 | 34.71 | C |
| ATOM | 2979 | C | ASER | L | 9 | −3.252 | −24.194 | 35.976 | 0.25 | 34.03 | C |
| ATOM | 2980 | O | ASER | L | 9 | −4.093 | −24.594 | 35.166 | 0.25 | 35.64 | O |
| ATOM | 2981 | CB | ASER | L | 9 | −3.144 | −25.480 | 38.110 | 0.25 | 38.97 | C |
| ATOM | 2982 | OG | ASER | L | 9 | −3.669 | −25.599 | 39.421 | 0.25 | 40.80 | O |
| ATOM | 2983 | N | BSER | L | 9 | −4.967 | −23.828 | 37.684 | 0.75 | 31.86 | N |
| ATOM | 2984 | CA | BSER | L | 9 | −3.551 | −24.059 | 37.455 | 0.75 | 34.34 | C |
| ATOM | 2985 | C | BSER | L | 9 | −3.252 | −24.167 | 35.972 | 0.75 | 33.74 | C |
| ATOM | 2986 | O | BSER | L | 9 | −4.085 | −24.607 | 35.175 | 0.75 | 36.73 | O |
| ATOM | 2987 | CB | BSER | L | 9 | −3.083 | −25.336 | 38.151 | 0.75 | 39.32 | C |
| ATOM | 2988 | OG | BSER | L | 9 | −3.865 | −26.421 | 37.704 | 0.75 | 42.63 | O |
| ATOM | 2989 | N | VAL | L | 10 | −2.030 | −23.793 | 35.627 | 1.00 | 30.69 | N |
| ATOM | 2990 | CA | VAL | L | 10 | −1.493 | −23.955 | 34.285 | 1.00 | 30.87 | C |
| ATOM | 2991 | C | VAL | L | 10 | −0.069 | −24.445 | 34.456 | 1.00 | 33.29 | C |
| ATOM | 2992 | O | VAL | L | 10 | 0.673 | −23.911 | 35.287 | 1.00 | 31.82 | O |

TABLE 17-continued

| | | | | | | | | | | |
|---|---|---|---|---|---|---|---|---|---|---|
| ATOM | 2993 | CB | VAL | L | 10 | −1.512 | −22.642 | 33.473 | 1.00 | 32.17 C |
| ATOM | 2994 | CG1 | VAL | L | 10 | −0.793 | −22.842 | 32.146 | 1.00 | 31.22 C |
| ATOM | 2995 | CG2 | VAL | L | 10 | −2.956 | −22.164 | 33.238 | 1.00 | 38.02 C |
| ATOM | 2996 | N | ASER | L | 11 | 0.307 | −25.472 | 33.694 | 0.36 | 33.07 N |
| ATOM | 2997 | CA | ASER | L | 11 | 1.658 | −26.015 | 33.691 | 0.36 | 34.73 C |
| ATOM | 2998 | C | ASER | L | 11 | 2.327 | −25.740 | 32.351 | 0.36 | 36.41 C |
| ATOM | 2999 | O | ASER | L | 11 | 1.698 | −25.869 | 31.296 | 0.36 | 40.21 O |
| ATOM | 3000 | CB | ASER | L | 11 | 1.643 | −27.523 | 33.958 | 0.36 | 36.10 C |
| ATOM | 3001 | OG | ASER | L | 11 | 1.092 | −27.805 | 35.230 | 0.36 | 38.15 O |
| ATOM | 3002 | N | BSER | L | 11 | 0.314 | −25.446 | 33.671 | 0.64 | 32.29 N |
| ATOM | 3003 | CA | BSER | L | 11 | 1.651 | −26.011 | 33.695 | 0.64 | 34.67 C |
| ATOM | 3004 | C | BSER | L | 11 | 2.335 | −25.770 | 32.355 | 0.64 | 36.61 C |
| ATOM | 3005 | O | BSER | L | 11 | 1.722 | −25.950 | 31.298 | 0.64 | 41.89 O |
| ATOM | 3006 | CB | BSER | L | 11 | 1.583 | −27.510 | 33.993 | 0.64 | 35.60 C |
| ATOM | 3007 | OG | BSER | L | 11 | 2.814 | −28.122 | 33.694 | 0.64 | 32.09 O |
| ATOM | 3008 | N | VAL | L | 12 | 3.609 | −25.379 | 32.393 | 1.00 | 32.11 N |
| ATOM | 3009 | CA | VAL | L | 12 | 4.358 | −25.051 | 31.181 | 1.00 | 36.31 C |
| ATOM | 3010 | C | VAL | L | 12 | 5.809 | −25.500 | 31.317 | 1.00 | 39.41 C |
| ATOM | 3011 | O | VAL | L | 12 | 6.394 | −25.449 | 32.402 | 1.00 | 39.36 O |
| ATOM | 3012 | CB | VAL | L | 12 | 4.283 | −23.529 | 30.891 | 1.00 | 37.66 C |
| ATOM | 3013 | CG1 | VAL | L | 12 | 4.867 | −22.752 | 32.046 | 1.00 | 36.89 C |
| ATOM | 3014 | CG2 | VAL | L | 12 | 5.026 | −23.174 | 29.620 | 1.00 | 45.63 C |
| ATOM | 3015 | N | ALA | L | 13 | 6.401 | −25.941 | 30.190 | 1.00 | 36.29 N |
| ATOM | 3016 | CA | ALA | L | 13 | 7.816 | −26.270 | 30.144 | 1.00 | 38.07 C |
| ATOM | 3017 | C | ALA | L | 13 | 8.658 | −25.007 | 29.925 | 1.00 | 40.53 C |
| ATOM | 3018 | O | ALA | L | 13 | 8.196 | −24.044 | 29.302 | 1.00 | 36.26 O |
| ATOM | 3019 | CB | ALA | L | 13 | 8.100 | −27.279 | 29.028 | 1.00 | 41.07 C |
| ATOM | 3020 | N | PRO | L | 14 | 9.892 | −24.982 | 30.434 | 1.00 | 37.36 N |
| ATOM | 3021 | CA | PRO | L | 14 | 10.704 | −23.766 | 30.305 | 1.00 | 43.15 C |
| ATOM | 3022 | C | PRO | L | 14 | 10.949 | −23.439 | 28.841 | 1.00 | 42.96 C |
| ATOM | 3023 | O | PRO | L | 14 | 11.231 | −24.321 | 28.026 | 1.00 | 41.05 O |
| ATOM | 3024 | CB | PRO | L | 14 | 12.008 | −24.121 | 31.033 | 1.00 | 41.08 C |
| ATOM | 3025 | CG | PRO | L | 14 | 11.716 | −25.377 | 31.801 | 1.00 | 47.01 C |
| ATOM | 3026 | CD | PRO | L | 14 | 10.663 | −26.092 | 31.022 | 1.00 | 44.21 C |
| ATOM | 3027 | N | GLY | L | 15 | 10.810 | −22.156 | 28.509 | 1.00 | 45.78 N |
| ATOM | 3028 | CA | GLY | L | 15 | 10.960 | −21.689 | 27.153 | 1.00 | 48.03 C |
| ATOM | 3029 | C | GLY | L | 15 | 9.679 | −21.639 | 26.353 | 1.00 | 43.54 C |
| ATOM | 3030 | O | GLY | L | 15 | 9.655 | −21.012 | 25.288 | 1.00 | 45.82 O |
| ATOM | 3031 | N | GLN | L | 16 | 8.614 | −22.269 | 26.833 | 1.00 | 40.85 N |
| ATOM | 3032 | CA | GLN | L | 16 | 7.337 | −22.244 | 26.143 | 1.00 | 37.25 C |
| ATOM | 3033 | C | GLN | L | 16 | 6.503 | −21.053 | 26.605 | 1.00 | 42.97 C |
| ATOM | 3034 | O | GLN | L | 16 | 6.910 | −20.256 | 27.454 | 1.00 | 40.54 O |
| ATOM | 3035 | CB | GLN | L | 16 | 6.594 | −23.563 | 26.357 | 1.00 | 43.68 C |
| ATOM | 3036 | CG | GLN | L | 16 | 7.313 | −24.750 | 25.736 | 1.00 | 52.86 C |
| ATOM | 3037 | CD | GLN | L | 16 | 7.591 | −24.530 | 24.259 | 1.00 | 64.32 C |
| ATOM | 3038 | OE1 | GLN | L | 16 | 6.666 | −24.413 | 23.452 | 1.00 | 66.63 O |
| ATOM | 3039 | NE2 | GLN | L | 16 | 8.869 | −24.452 | 23.901 | 1.00 | 66.28 N |
| ATOM | 3040 | N | THR | L | 17 | 5.317 | −20.923 | 26.031 | 1.00 | 41.72 N |
| ATOM | 3041 | CA | THR | L | 17 | 4.423 | −19.824 | 26.333 | 1.00 | 40.84 C |
| ATOM | 3042 | C | THR | L | 17 | 3.303 | −20.311 | 27.240 | 1.00 | 35.33 C |
| ATOM | 3043 | O | THR | L | 17 | 2.668 | −21.331 | 26.954 | 1.00 | 40.79 O |
| ATOM | 3044 | CB | THR | L | 17 | 3.851 | −19.234 | 25.044 | 1.00 | 47.46 C |
| ATOM | 3045 | OG1 | THR | L | 17 | 4.925 | −18.710 | 24.256 | 1.00 | 50.59 O |
| ATOM | 3046 | CG2 | THR | L | 17 | 2.863 | −18.127 | 25.353 | 1.00 | 40.40 C |
| ATOM | 3047 | N | ALA | L | 18 | 3.069 | −19.584 | 28.328 | 1.00 | 34.70 N |
| ATOM | 3048 | CA | ALA | L | 18 | 1.959 | −19.861 | 29.225 | 1.00 | 37.01 C |
| ATOM | 3049 | C | ALA | L | 18 | 0.773 | −18.981 | 28.859 | 1.00 | 28.63 C |
| ATOM | 3050 | O | ALA | L | 18 | 0.933 | −17.786 | 28.603 | 1.00 | 36.44 O |
| ATOM | 3051 | CB | ALA | L | 18 | 2.356 | −19.608 | 30.677 | 1.00 | 36.75 C |
| ATOM | 3052 | N | ARG | L | 19 | −0.422 | −19.566 | 28.849 | 1.00 | 30.31 N |
| ATOM | 3053 | CA | ARG | L | 19 | −1.639 | −18.789 | 28.640 | 1.00 | 31.02 C |
| ATOM | 3054 | C | ARG | L | 19 | −2.569 | −18.972 | 29.824 | 1.00 | 30.53 C |
| ATOM | 3055 | O | ARG | L | 19 | −2.992 | −20.094 | 30.119 | 1.00 | 35.52 O |
| ATOM | 3056 | CB | ARG | L | 19 | −2.342 | −19.181 | 27.340 | 1.00 | 35.51 C |
| ATOM | 3057 | CG | ARG | L | 19 | −1.520 | −18.812 | 26.121 | 1.00 | 44.80 C |
| ATOM | 3058 | CD | ARG | L | 19 | −2.140 | −19.275 | 24.822 | 1.00 | 57.48 C |
| ATOM | 3059 | NE | ARG | L | 19 | −1.131 | −19.266 | 23.767 | 1.00 | 67.15 N |
| ATOM | 3060 | CZ | ARG | L | 19 | −0.262 | −20.253 | 23.559 | 1.00 | 74.26 C |
| ATOM | 3061 | NH1 | ARG | L | 19 | −0.284 | −21.335 | 24.328 | 1.00 | 75.12 N |
| ATOM | 3062 | NH2 | ARG | L | 19 | 0.626 | −20.161 | 22.581 | 1.00 | 75.79 N |
| ATOM | 3063 | N | ILE | L | 20 | −2.899 | −17.864 | 30.483 | 1.00 | 29.46 N |
| ATOM | 3064 | CA | ILE | L | 20 | −3.760 | −17.856 | 31.656 | 1.00 | 29.95 C |
| ATOM | 3065 | C | ILE | L | 20 | −5.014 | −17.071 | 31.304 | 1.00 | 28.81 C |
| ATOM | 3066 | O | ILE | L | 20 | −4.928 | −15.899 | 30.907 | 1.00 | 30.65 O |
| ATOM | 3067 | CB | ILE | L | 20 | −3.044 | −17.248 | 32.872 | 1.00 | 30.01 C |
| ATOM | 3068 | CG1 | ILE | L | 20 | −1.878 | −18.166 | 33.292 | 1.00 | 33.36 C |
| ATOM | 3069 | CG2 | ILE | L | 20 | −4.035 | −17.022 | 33.997 | 1.00 | 29.93 C |
| ATOM | 3070 | CD1 | ILE | L | 20 | −1.025 | −17.582 | 34.399 | 1.00 | 32.58 C |
| ATOM | 3071 | N | THR | L | 21 | −6.169 | −17.704 | 31.446 | 1.00 | 31.57 N |
| ATOM | 3072 | CA | THR | L | 21 | −7.425 | −17.092 | 31.034 | 1.00 | 30.93 C |

TABLE 17-continued

| | | | | | | | | | | |
|---|---|---|---|---|---|---|---|---|---|---|
| ATOM | 3073 | C | THR | L | 21 | −8.235 | −16.584 | 32.225 | 1.00 | 33.07 C |
| ATOM | 3074 | O | THR | L | 21 | −8.103 | −17.043 | 33.362 | 1.00 | 30.72 O |
| ATOM | 3075 | CB | THR | L | 21 | −8.277 | −18.066 | 30.219 | 1.00 | 33.15 C |
| ATOM | 3076 | OG1 | THR | L | 21 | −8.577 | −19.214 | 31.012 | 1.00 | 37.74 O |
| ATOM | 3077 | CG2 | THR | L | 21 | −7.559 | −18.501 | 28.957 | 1.00 | 37.17 C |
| ATOM | 3078 | N | CYS | L | 22 | −9.076 | −15.600 | 31.933 | 1.00 | 28.58 N |
| ATOM | 3079 | CA | CYS | L | 22 | −9.898 | −14.910 | 32.920 | 1.00 | 28.69 C |
| ATOM | 3080 | C | CYS | L | 22 | −11.242 | −14.697 | 32.244 | 1.00 | 35.18 C |
| ATOM | 3081 | O | CYS | L | 22 | −11.331 | −13.920 | 31.286 | 1.00 | 34.35 O |
| ATOM | 3082 | CB | CYS | L | 22 | −9.262 | −13.568 | 33.316 | 1.00 | 30.22 C |
| ATOM | 3083 | SG | CYS | L | 22 | −10.179 | −12.557 | 34.500 | 1.00 | 35.51 S |
| ATOM | 3084 | N | GLY | L | 23 | −12.271 | −15.381 | 32.727 | 1.00 | 31.01 N |
| ATOM | 3085 | CA | GLY | L | 23 | −13.585 | −15.332 | 32.114 | 1.00 | 30.61 C |
| ATOM | 3086 | C | GLY | L | 23 | −14.529 | −14.381 | 32.826 | 1.00 | 31.30 C |
| ATOM | 3087 | O | GLY | L | 23 | −14.505 | −14.251 | 34.049 | 1.00 | 35.00 O |
| ATOM | 3088 | N | GLY | L | 24 | −15.360 | −13.711 | 32.036 | 1.00 | 32.85 N |
| ATOM | 3089 | CA | GLY | L | 24 | −16.424 | −12.887 | 32.585 | 1.00 | 30.95 C |
| ATOM | 3090 | C | GLY | L | 24 | −17.423 | −12.525 | 31.509 | 1.00 | 34.04 C |
| ATOM | 3091 | O | GLY | L | 24 | −17.057 | −12.417 | 30.334 | 1.00 | 33.80 O |
| ATOM | 3092 | N | ASN | L | 25 | −18.683 | −12.329 | 31.887 | 1.00 | 38.61 N |
| ATOM | 3093 | CA | ASN | L | 25 | −19.693 | −11.980 | 30.896 | 1.00 | 37.91 C |
| ATOM | 3094 | C | ASN | L | 25 | −19.349 | −10.635 | 30.273 | 1.00 | 32.66 C |
| ATOM | 3095 | O | ASN | L | 25 | −19.265 | −9.621 | 30.971 | 1.00 | 30.88 O |
| ATOM | 3096 | CB | ASN | L | 25 | −21.080 | −11.944 | 31.534 | 1.00 | 46.67 C |
| ATOM | 3097 | CG | ASN | L | 25 | −22.152 | −11.455 | 30.573 | 1.00 | 58.45 C |
| ATOM | 3098 | OD1 | ASN | L | 25 | −22.450 | −12.105 | 29.570 | 1.00 | 63.53 O |
| ATOM | 3099 | ND2 | ASN | L | 25 | −22.738 | −10.305 | 30.880 | 1.00 | 67.61 N |
| ATOM | 3100 | N | ASN | L | 26 | −19.098 | −10.641 | 28.968 | 1.00 | 36.20 N |
| ATOM | 3101 | CA | ASN | L | 26 | −18.732 | −9.426 | 28.255 | 1.00 | 34.56 C |
| ATOM | 3102 | C | ASN | L | 26 | −17.505 | −8.761 | 28.894 | 1.00 | 32.93 C |
| ATOM | 3103 | O | ASN | L | 26 | −17.436 | −7.535 | 29.020 | 1.00 | 33.03 O |
| ATOM | 3104 | CB | ASN | L | 26 | −19.921 | −8.462 | 28.200 | 1.00 | 45.44 C |
| ATOM | 3105 | CG | ASN | L | 26 | −19.761 | −7.391 | 27.149 | 1.00 | 61.05 C |
| ATOM | 3106 | OD1 | ASN | L | 26 | −19.095 | −7.594 | 26.135 | 1.00 | 73.69 O |
| ATOM | 3107 | ND2 | ASN | L | 26 | −20.378 | −6.239 | 27.383 | 1.00 | 67.46 N |
| ATOM | 3108 | N | ILE | L | 27 | −16.534 | −9.576 | 29.321 | 1.00 | 29.22 N |
| ATOM | 3109 | CA | ILE | L | 27 | −15.330 | −9.011 | 29.929 | 1.00 | 31.68 C |
| ATOM | 3110 | C | ILE | L | 27 | −14.553 | −8.180 | 28.913 | 1.00 | 26.99 C |
| ATOM | 3111 | O | ILE | L | 27 | −13.726 | −7.348 | 29.294 | 1.00 | 26.93 O |
| ATOM | 3112 | CB | ILE | L | 27 | −14.442 | −10.123 | 30.561 | 1.00 | 28.45 C |
| ATOM | 3113 | CG1 | ILE | L | 27 | −13.354 | −9.514 | 31.464 | 1.00 | 30.11 C |
| ATOM | 3114 | CG2 | ILE | L | 27 | −13.810 | −11.052 | 29.499 | 1.00 | 28.02 C |
| ATOM | 3115 | CD1 | ILE | L | 27 | −12.393 | −10.573 | 32.033 | 1.00 | 35.21 C |
| ATOM | 3116 | N | GLY | L | 28 | −14.818 | −8.363 | 27.618 | 1.00 | 30.45 N |
| ATOM | 3117 | CA | GLY | L | 28 | −14.172 | −7.530 | 26.617 | 1.00 | 30.89 C |
| ATOM | 3118 | C | GLY | L | 28 | −14.492 | −6.049 | 26.732 | 1.00 | 29.00 C |
| ATOM | 3119 | O | GLY | L | 28 | −13.726 | −5.220 | 26.232 | 1.00 | 31.56 O |
| ATOM | 3120 | N | SER | L | 29 | −15.586 | −5.695 | 27.407 | 1.00 | 30.16 N |
| ATOM | 3121 | CA | SER | L | 29 | −15.920 | −4.290 | 27.619 | 1.00 | 35.60 C |
| ATOM | 3122 | C | SER | L | 29 | −15.173 | −3.661 | 28.792 | 1.00 | 34.54 C |
| ATOM | 3123 | O | SER | L | 29 | −15.472 | −2.515 | 29.136 | 1.00 | 39.05 O |
| ATOM | 3124 | CB | SER | L | 29 | −17.423 | −4.133 | 27.857 | 1.00 | 39.38 C |
| ATOM | 3125 | OG | SER | L | 29 | −17.775 | −4.632 | 29.139 | 1.00 | 41.65 O |
| ATOM | 3126 | N | LYS | L | 30 | −14.240 | −4.373 | 29.425 | 1.00 | 30.30 N |
| ATOM | 3127 | CA | LYS | L | 30 | −13.580 | −3.906 | 30.641 | 1.00 | 28.36 C |
| ATOM | 3128 | C | LYS | L | 30 | −12.072 | −4.038 | 30.514 | 1.00 | 27.07 C |
| ATOM | 3129 | O | LYS | L | 30 | −11.585 | −4.998 | 29.923 | 1.00 | 27.40 O |
| ATOM | 3130 | CB | LYS | L | 30 | −14.020 | −4.710 | 31.876 | 1.00 | 26.82 C |
| ATOM | 3131 | CG | LYS | L | 30 | −15.502 | −4.609 | 32.239 | 1.00 | 28.29 C |
| ATOM | 3132 | CD | LYS | L | 30 | −15.811 | −5.533 | 33.417 | 1.00 | 31.61 C |
| ATOM | 3133 | CE | LYS | L | 30 | −17.211 | −5.308 | 34.005 | 1.00 | 35.49 C |
| ATOM | 3134 | NZ | LYS | L | 30 | −18.219 | −5.057 | 32.949 | 1.00 | 38.66 N |
| ATOM | 3135 | N | SER | L | 31 | −11.338 | −3.072 | 31.082 | 1.00 | 25.59 N |
| ATOM | 3136 | CA | SER | L | 31 | −9.895 | −3.214 | 31.225 | 1.00 | 22.38 C |
| ATOM | 3137 | C | SER | L | 31 | −9.610 | −4.350 | 32.189 | 1.00 | 22.90 C |
| ATOM | 3138 | O | SER | L | 31 | −10.131 | −4.366 | 33.306 | 1.00 | 27.05 O |
| ATOM | 3139 | CB | SER | L | 31 | −9.247 | −1.927 | 31.772 | 1.00 | 25.07 C |
| ATOM | 3140 | OG | SER | L | 31 | −9.296 | −0.868 | 30.823 | 1.00 | 25.89 O |
| ATOM | 3141 | N | VAL | L | 32 | −8.746 | −5.274 | 31.783 | 1.00 | 25.71 N |
| ATOM | 3142 | CA | VAL | L | 32 | −8.340 | −6.364 | 32.653 | 1.00 | 20.75 C |
| ATOM | 3143 | C | VAL | L | 32 | −6.893 | −6.144 | 33.074 | 1.00 | 20.66 C |
| ATOM | 3144 | O | VAL | L | 32 | −6.011 | −5.927 | 32.231 | 1.00 | 24.86 O |
| ATOM | 3145 | CB | VAL | L | 32 | −8.536 | −7.725 | 31.970 | 1.00 | 23.62 C |
| ATOM | 3146 | CG1 | VAL | L | 32 | −7.960 | −8.831 | 32.856 | 1.00 | 27.87 C |
| ATOM | 3147 | CG2 | VAL | L | 32 | −10.023 | −7.945 | 31.684 | 1.00 | 25.65 C |
| ATOM | 3148 | N | HIS | L | 33 | −6.691 | −6.165 | 34.392 | 1.00 | 20.67 N |
| ATOM | 3149 | CA | HIS | L | 33 | −5.364 | −5.966 | 35.025 | 1.00 | 21.13 C |
| ATOM | 3150 | C | HIS | L | 33 | −4.874 | −7.312 | 35.561 | 1.00 | 27.04 C |
| ATOM | 3151 | O | HIS | L | 33 | −5.711 | −8.115 | 35.994 | 1.00 | 24.76 O |
| ATOM | 3152 | CB | HIS | L | 33 | −5.455 | −4.862 | 36.080 | 1.00 | 22.84 C |

TABLE 17-continued

| | | | | | | | | | | |
|---|---|---|---|---|---|---|---|---|---|---|
| ATOM | 3153 | CG | HIS | L | 33 | −6.099 | −3.630 | 35.547 | 1.00 | 24.89 | C |
| ATOM | 3154 | ND1 | HIS | L | 33 | −7.192 | −3.046 | 36.146 | 1.00 | 26.16 | N |
| ATOM | 3155 | CD2 | HIS | L | 33 | −5.817 | −2.882 | 34.461 | 1.00 | 23.13 | C |
| ATOM | 3156 | CE1 | HIS | L | 33 | −7.551 | −1.985 | 35.458 | 1.00 | 25.75 | C |
| ATOM | 3157 | NE2 | HIS | L | 33 | −6.723 | −1.862 | 34.422 | 1.00 | 23.44 | N |
| ATOM | 3158 | N | TRP | L | 34 | −3.561 | −7.522 | 35.544 | 1.00 | 23.75 | N |
| ATOM | 3159 | CA | TRP | L | 34 | −2.997 | −8.804 | 35.951 | 1.00 | 24.17 | C |
| ATOM | 3160 | C | TRP | L | 34 | −1.893 | −8.593 | 36.974 | 1.00 | 25.15 | C |
| ATOM | 3161 | O | TRP | L | 34 | −1.045 | −7.709 | 36.803 | 1.00 | 25.73 | O |
| ATOM | 3162 | CB | TRP | L | 34 | −2.412 | −9.562 | 34.766 | 1.00 | 21.23 | C |
| ATOM | 3163 | CG | TRP | L | 34 | −3.422 | −10.079 | 33.778 | 1.00 | 23.66 | C |
| ATOM | 3164 | CD1 | TRP | L | 34 | −3.815 | −9.479 | 32.620 | 1.00 | 23.72 | C |
| ATOM | 3165 | CD2 | TRP | L | 34 | −4.145 | −11.324 | 33.853 | 1.00 | 23.81 | C |
| ATOM | 3166 | NE1 | TRP | L | 34 | −4.752 | −10.266 | 31.973 | 1.00 | 25.36 | N |
| ATOM | 3167 | CE2 | TRP | L | 34 | −4.958 | −11.406 | 32.706 | 1.00 | 26.86 | C |
| ATOM | 3168 | CE3 | TRP | L | 34 | −4.163 | −12.382 | 34.768 | 1.00 | 28.24 | C |
| ATOM | 3169 | CZ2 | TRP | L | 34 | −5.794 | −12.499 | 32.459 | 1.00 | 31.43 | C |
| ATOM | 3170 | CZ3 | TRP | L | 34 | −4.979 | −13.466 | 34.515 | 1.00 | 32.32 | C |
| ATOM | 3171 | CH2 | TRP | L | 34 | −5.787 | −13.515 | 33.373 | 1.00 | 31.40 | C |
| ATOM | 3172 | N | TYR | L | 35 | −1.901 | −9.411 | 38.031 | 1.00 | 23.92 | N |
| ATOM | 3173 | CA | TYR | L | 35 | −0.930 | −9.311 | 39.114 | 1.00 | 26.95 | C |
| ATOM | 3174 | C | TYR | L | 35 | −0.245 | −10.652 | 39.289 | 1.00 | 25.84 | C |
| ATOM | 3175 | O | TYR | L | 35 | −0.873 | −11.704 | 39.163 | 1.00 | 27.28 | O |
| ATOM | 3176 | CB | TYR | L | 35 | −1.577 | −8.879 | 40.442 | 1.00 | 20.44 | C |
| ATOM | 3177 | CG | TYR | L | 35 | −2.346 | −7.621 | 40.270 | 1.00 | 22.54 | C |
| ATOM | 3178 | CD1 | TYR | L | 35 | −1.710 | −6.392 | 40.328 | 1.00 | 24.57 | C |
| ATOM | 3179 | CD2 | TYR | L | 35 | −3.700 | −7.665 | 39.961 | 1.00 | 23.97 | C |
| ATOM | 3180 | CE1 | TYR | L | 35 | −2.423 | −5.219 | 40.130 | 1.00 | 25.43 | C |
| ATOM | 3181 | CE2 | TYR | L | 35 | −4.429 | −6.503 | 39.761 | 1.00 | 27.18 | C |
| ATOM | 3182 | CZ | TYR | L | 35 | −3.778 | −5.286 | 39.841 | 1.00 | 27.85 | C |
| ATOM | 3183 | OH | TYR | L | 35 | −4.478 | −4.142 | 39.621 | 1.00 | 25.46 | O |
| ATOM | 3184 | N | GLN | L | 36 | 1.051 | −10.592 | 39.564 | 1.00 | 27.44 | N |
| ATOM | 3185 | CA | GLN | L | 36 | 1.877 | −11.761 | 39.825 | 1.00 | 23.54 | C |
| ATOM | 3186 | C | GLN | L | 36 | 2.253 | −11.762 | 41.301 | 1.00 | 28.33 | C |
| ATOM | 3187 | O | GLN | L | 36 | 2.736 | −10.752 | 41.816 | 1.00 | 27.67 | O |
| ATOM | 3188 | CB | GLN | L | 36 | 3.133 | −11.692 | 38.953 | 1.00 | 24.11 | C |
| ATOM | 3189 | CG | GLN | L | 36 | 4.144 | −12.790 | 39.142 | 1.00 | 25.94 | C |
| ATOM | 3190 | CD | GLN | L | 36 | 5.488 | −12.402 | 38.533 | 1.00 | 30.75 | C |
| ATOM | 3191 | OE1 | GLN | L | 36 | 6.068 | −11.372 | 38.891 | 1.00 | 33.04 | O |
| ATOM | 3192 | NE2 | GLN | L | 36 | 5.968 | −13.199 | 37.597 | 1.00 | 29.94 | N |
| ATOM | 3193 | N | GLN | L | 37 | 2.018 | −12.874 | 41.995 | 1.00 | 25.31 | N |
| ATOM | 3194 | CA | GLN | L | 37 | 2.338 | −12.939 | 43.417 | 1.00 | 26.24 | C |
| ATOM | 3195 | C | GLN | L | 37 | 3.211 | −14.159 | 43.658 | 1.00 | 31.72 | C |
| ATOM | 3196 | O | GLN | L | 37 | 2.736 | −15.296 | 43.587 | 1.00 | 30.82 | O |
| ATOM | 3197 | CB | GLN | L | 37 | 1.083 | −12.968 | 44.299 | 1.00 | 30.78 | C |
| ATOM | 3198 | CG | GLN | L | 37 | 1.462 | −12.790 | 45.767 | 1.00 | 32.61 | C |
| ATOM | 3199 | CD | GLN | L | 37 | 0.292 | −12.875 | 46.722 | 1.00 | 35.54 | C |
| ATOM | 3200 | OE1 | GLN | L | 37 | −0.748 | −13.448 | 46.405 | 1.00 | 36.09 | O |
| ATOM | 3201 | NE2 | GLN | L | 37 | 0.476 | −12.323 | 47.923 | 1.00 | 36.96 | N |
| ATOM | 3202 | N | LYS | L | 38 | 4.485 | −13.917 | 43.941 | 1.00 | 25.87 | N |
| ATOM | 3203 | CA | LYS | L | 38 | 5.458 | −14.964 | 44.194 | 1.00 | 26.73 | C |
| ATOM | 3204 | C | LYS | L | 38 | 5.499 | −15.328 | 45.671 | 1.00 | 30.07 | C |
| ATOM | 3205 | O | LYS | L | 38 | 5.018 | −14.573 | 46.516 | 1.00 | 29.88 | O |
| ATOM | 3206 | CB | LYS | L | 38 | 6.838 | −14.507 | 43.732 | 1.00 | 27.96 | C |
| ATOM | 3207 | CG | LYS | L | 38 | 6.887 | −14.157 | 42.261 | 1.00 | 29.34 | C |
| ATOM | 3208 | CD | LYS | L | 38 | 8.323 | −14.081 | 41.773 | 1.00 | 33.65 | C |
| ATOM | 3209 | CE | LYS | L | 38 | 8.395 | −13.764 | 40.285 | 1.00 | 35.22 | C |
| ATOM | 3210 | NZ | LYS | L | 38 | 9.819 | −13.759 | 39.846 | 1.00 | 41.49 | N |
| ATOM | 3211 | N | PRO | L | 39 | 6.062 | −16.492 | 46.014 | 1.00 | 29.59 | N |
| ATOM | 3212 | CA | PRO | L | 39 | 6.129 | −16.900 | 47.424 | 1.00 | 33.79 | C |
| ATOM | 3213 | C | PRO | L | 39 | 6.794 | −15.858 | 48.314 | 1.00 | 38.66 | C |
| ATOM | 3214 | O | PRO | L | 39 | 7.849 | −15.304 | 47.984 | 1.00 | 34.30 | O |
| ATOM | 3215 | CB | PRO | L | 39 | 6.937 | −18.202 | 47.372 | 1.00 | 37.39 | C |
| ATOM | 3216 | CG | PRO | L | 39 | 6.623 | −18.765 | 46.020 | 1.00 | 38.44 | C |
| ATOM | 3217 | CD | PRO | L | 39 | 6.528 | −17.569 | 45.114 | 1.00 | 33.22 | C |
| ATOM | 3218 | N | GLY | L | 40 | 6.141 | −15.570 | 49.439 | 1.00 | 32.33 | N |
| ATOM | 3219 | CA | GLY | L | 40 | 6.643 | −14.658 | 50.441 | 1.00 | 34.34 | C |
| ATOM | 3220 | C | GLY | L | 40 | 6.572 | −13.189 | 50.079 | 1.00 | 30.07 | C |
| ATOM | 3221 | O | GLY | L | 40 | 7.099 | −12.367 | 50.837 | 1.00 | 40.46 | O |
| ATOM | 3222 | N | GLN | L | 41 | 5.946 | −12.830 | 48.955 | 1.00 | 27.54 | N |
| ATOM | 3223 | CA | GLN | L | 41 | 5.944 | −11.463 | 48.432 | 1.00 | 35.23 | C |
| ATOM | 3224 | C | GLN | L | 41 | 4.530 | −10.932 | 48.240 | 1.00 | 35.81 | C |
| ATOM | 3225 | O | GLN | L | 41 | 3.574 | −11.693 | 48.113 | 1.00 | 30.95 | O |
| ATOM | 3226 | CB | GLN | L | 41 | 6.658 | −11.384 | 47.085 | 1.00 | 28.51 | C |
| ATOM | 3227 | CG | GLN | L | 41 | 8.114 | −11.803 | 47.122 | 1.00 | 33.39 | C |
| ATOM | 3228 | CD | GLN | L | 41 | 8.782 | −11.608 | 45.780 | 1.00 | 41.25 | C |
| ATOM | 3229 | OE1 | GLN | L | 41 | 8.187 | −11.060 | 44.842 | 1.00 | 42.53 | O |
| ATOM | 3230 | NE2 | GLN | L | 41 | 10.023 | −12.052 | 45.675 | 1.00 | 50.59 | N |
| ATOM | 3231 | N | ALA | L | 42 | 4.416 | −9.599 | 48.174 | 1.00 | 29.23 | N |
| ATOM | 3232 | CA | ALA | L | 42 | 3.167 | −8.960 | 47.787 | 1.00 | 32.20 | C |

TABLE 17-continued

| ATOM | 3233 | C | ALA | L | 42 | 2.948 | −9.109 | 46.285 | 1.00 | 30.28 | C |
|---|---|---|---|---|---|---|---|---|---|---|---|
| ATOM | 3234 | O | ALA | L | 42 | 3.899 | −9.329 | 45.533 | 1.00 | 30.20 | O |
| ATOM | 3235 | CB | ALA | L | 42 | 3.201 | −7.477 | 48.166 | 1.00 | 29.54 | C |
| ATOM | 3236 | N | PRO | L | 43 | 1.709 | −8.970 | 45.814 | 1.00 | 29.38 | N |
| ATOM | 3237 | CA | PRO | L | 43 | 1.476 | −8.966 | 44.364 | 1.00 | 28.64 | C |
| ATOM | 3238 | C | PRO | L | 43 | 2.186 | −7.801 | 43.686 | 1.00 | 28.11 | C |
| ATOM | 3239 | O | PRO | L | 43 | 2.482 | −6.774 | 44.299 | 1.00 | 30.13 | O |
| ATOM | 3240 | CB | PRO | L | 43 | −0.049 | −8.813 | 44.246 | 1.00 | 27.89 | C |
| ATOM | 3241 | CG | PRO | L | 43 | −0.592 | −9.168 | 45.619 | 1.00 | 27.26 | C |
| ATOM | 3242 | CD | PRO | L | 43 | 0.466 | −8.709 | 46.567 | 1.00 | 25.00 | C |
| ATOM | 3243 | N | VAL | L | 44 | 2.458 | −7.985 | 42.396 | 1.00 | 26.69 | N |
| ATOM | 3244 | CA | VAL | L | 44 | 3.087 | −6.992 | 41.531 | 1.00 | 24.29 | C |
| ATOM | 3245 | C | VAL | L | 44 | 2.282 | −6.919 | 40.242 | 1.00 | 26.43 | C |
| ATOM | 3246 | O | VAL | L | 44 | 1.973 | −7.952 | 39.648 | 1.00 | 27.86 | O |
| ATOM | 3247 | CB | VAL | L | 44 | 4.554 | −7.373 | 41.233 | 1.00 | 30.20 | C |
| ATOM | 3248 | CG1 | VAL | L | 44 | 5.132 | −6.491 | 40.140 | 1.00 | 35.35 | C |
| ATOM | 3249 | CG2 | VAL | L | 44 | 5.364 | −7.256 | 42.511 | 1.00 | 28.06 | C |
| ATOM | 3250 | N | MET | L | 45 | 1.978 | −5.707 | 39.779 | 1.00 | 24.91 | N |
| ATOM | 3251 | CA | MET | L | 45 | 1.284 | −5.576 | 38.495 | 1.00 | 19.43 | C |
| ATOM | 3252 | C | MET | L | 45 | 2.226 | −5.940 | 37.352 | 1.00 | 23.64 | C |
| ATOM | 3253 | O | MET | L | 45 | 3.297 | −5.335 | 37.213 | 1.00 | 26.85 | O |
| ATOM | 3254 | CB | MET | L | 45 | 0.755 | −4.154 | 38.307 | 1.00 | 23.28 | C |
| ATOM | 3255 | CG | MET | L | 45 | 0.063 | −3.919 | 36.947 | 1.00 | 26.01 | C |
| ATOM | 3256 | SD | MET | L | 45 | −0.327 | −2.147 | 36.770 | 1.00 | 29.31 | S |
| ATOM | 3257 | CE | MET | L | 45 | −1.912 | −2.110 | 37.624 | 1.00 | 27.01 | C |
| ATOM | 3258 | N | VAL | L | 46 | 1.826 | −6.901 | 36.509 | 1.00 | 21.14 | N |
| ATOM | 3259 | CA | VAL | L | 46 | 2.599 | −7.218 | 35.318 | 1.00 | 23.52 | C |
| ATOM | 3260 | C | VAL | L | 46 | 1.933 | −6.756 | 34.019 | 1.00 | 27.89 | C |
| ATOM | 3261 | O | VAL | L | 46 | 2.646 | −6.438 | 33.057 | 1.00 | 27.29 | O |
| ATOM | 3262 | CB | VAL | L | 46 | 2.955 | −8.721 | 35.255 | 1.00 | 27.66 | C |
| ATOM | 3263 | CG1 | VAL | L | 46 | 3.774 | −9.069 | 36.474 | 1.00 | 25.67 | C |
| ATOM | 3264 | CG2 | VAL | L | 46 | 1.706 | −9.594 | 35.158 | 1.00 | 29.78 | C |
| ATOM | 3265 | N | VAL | L | 47 | 0.602 | −6.685 | 33.961 | 1.00 | 27.74 | N |
| ATOM | 3266 | CA | VAL | L | 47 | −0.113 | −6.195 | 32.781 | 1.00 | 26.81 | C |
| ATOM | 3267 | C | VAL | L | 47 | −1.305 | −5.364 | 33.253 | 1.00 | 24.54 | C |
| ATOM | 3268 | O | VAL | L | 47 | −1.916 | −5.670 | 34.284 | 1.00 | 24.07 | O |
| ATOM | 3269 | CB | VAL | L | 47 | −0.570 | −7.352 | 31.864 | 1.00 | 25.35 | C |
| ATOM | 3270 | CG1 | VAL | L | 47 | −1.533 | −6.858 | 30.795 | 1.00 | 25.86 | C |
| ATOM | 3271 | CG2 | VAL | L | 47 | 0.631 | −8.032 | 31.204 | 1.00 | 30.30 | C |
| ATOM | 3272 | N | TYR | L | 48 | −1.533 | −4.213 | 32.611 | 1.00 | 25.04 | N |
| ATOM | 3273 | CA | TYR | L | 48 | −2.723 | −3.388 | 32.930 | 1.00 | 22.85 | C |
| ATOM | 3274 | C | TYR | L | 48 | −3.494 | −3.127 | 31.632 | 1.00 | 26.56 | C |
| ATOM | 3275 | O | TYR | L | 48 | −2.875 | −3.124 | 30.553 | 1.00 | 25.70 | O |
| ATOM | 3276 | CB | TYR | L | 48 | −2.341 | −2.120 | 33.693 | 1.00 | 25.48 | C |
| ATOM | 3277 | CG | TYR | L | 48 | −1.617 | −1.071 | 32.891 | 1.00 | 28.69 | C |
| ATOM | 3278 | CD1 | TYR | L | 48 | −2.310 | −0.114 | 32.171 | 1.00 | 26.01 | C |
| ATOM | 3279 | CD2 | TYR | L | 48 | −0.235 | −1.018 | 32.873 | 1.00 | 29.29 | C |
| ATOM | 3280 | CE1 | TYR | L | 48 | −1.650 | 0.861 | 31.444 | 1.00 | 30.07 | C |
| ATOM | 3281 | CE2 | TYR | L | 48 | 0.442 | −0.051 | 32.152 | 1.00 | 32.73 | C |
| ATOM | 3282 | CZ | TYR | L | 48 | −0.268 | 0.894 | 31.435 | 1.00 | 33.08 | C |
| ATOM | 3283 | OH | TYR | L | 48 | 0.394 | 1.848 | 30.724 | 1.00 | 36.98 | O |
| ATOM | 3284 | N | ASP | L | 49 | −4.812 | −2.959 | 31.750 | 1.00 | 25.93 | N |
| ATOM | 3285 | CA | ASP | L | 49 | −5.687 | −2.682 | 30.583 | 1.00 | 22.00 | C |
| ATOM | 3286 | C | ASP | L | 49 | −5.447 | −3.728 | 29.491 | 1.00 | 28.80 | C |
| ATOM | 3287 | O | ASP | L | 49 | −5.091 | −3.326 | 28.413 | 1.00 | 27.18 | O |
| ATOM | 3288 | CB | ASP | L | 49 | −5.451 | −1.271 | 30.033 | 1.00 | 26.77 | C |
| ATOM | 3289 | CG | ASP | L | 49 | −6.464 | −0.835 | 28.987 | 1.00 | 33.59 | C |
| ATOM | 3290 | OD1 | ASP | L | 49 | −7.644 | −1.174 | 29.145 | 1.00 | 33.01 | O |
| ATOM | 3291 | OD2 | ASP | L | 49 | −6.062 | −0.152 | 28.031 | 1.00 | 32.45 | O |
| ATOM | 3292 | N | ASP | L | 50 | −5.583 | −5.024 | 29.787 | 1.00 | 22.89 | N |
| ATOM | 3293 | CA | ASP | L | 50 | −5.453 | −6.157 | 28.817 | 1.00 | 26.51 | C |
| ATOM | 3294 | C | ASP | L | 50 | −4.041 | −6.410 | 28.252 | 1.00 | 29.08 | C |
| ATOM | 3295 | O | ASP | L | 50 | −3.648 | −7.587 | 28.261 | 1.00 | 26.62 | O |
| ATOM | 3296 | CB | ASP | L | 50 | −6.442 | −6.122 | 27.640 | 1.00 | 30.27 | C |
| ATOM | 3297 | CG | ASP | I | 50 | −7.824 | −5.559 | 27.926 | 1.00 | 29.78 | C |
| ATOM | 3298 | OD1 | ASP | L | 50 | −8.293 | −5.705 | 29.061 | 1.00 | 27.61 | O |
| ATOM | 3299 | OD2 | ASP | L | 50 | −8.409 | −4.974 | 26.999 | 1.00 | 28.69 | O |
| ATOM | 3300 | N | ASN | L | 51 | −3.316 | −5.401 | 27.745 | 1.00 | 25.39 | N |
| ATOM | 3301 | CA | ASN | L | 51 | −2.026 | −5.697 | 27.062 | 1.00 | 31.51 | C |
| ATOM | 3302 | C | ASN | L | 51 | −0.934 | −4.636 | 27.274 | 1.00 | 28.77 | C |
| ATOM | 3303 | O | ASN | L | 51 | −0.006 | −4.617 | 26.454 | 1.00 | 31.33 | O |
| ATOM | 3304 | CB | ASN | L | 51 | −2.264 | −5.801 | 25.556 | 1.00 | 37.47 | C |
| ATOM | 3305 | CG | ASN | L | 51 | −3.068 | −4.633 | 25.028 | 1.00 | 44.43 | C |
| ATOM | 3306 | OD1 | ASN | L | 51 | −3.050 | −3.551 | 25.608 | 1.00 | 33.98 | O |
| ATOM | 3307 | ND2 | ASN | L | 51 | −3.784 | −4.840 | 23.936 | 1.00 | 54.01 | N |
| ATOM | 3308 | N | ASP | L | 52 | −1.020 | −3.794 | 28.306 | 1.00 | 25.67 | N |
| ATOM | 3309 | CA | ASP | L | 52 | 0.016 | −2.799 | 28.534 | 1.00 | 29.75 | C |
| ATOM | 3310 | C | ASP | L | 52 | 0.893 | −3.211 | 29.707 | 1.00 | 27.84 | C |
| ATOM | 3311 | O | ASP | L | 52 | 0.455 | −3.932 | 30.605 | 1.00 | 32.07 | O |
| ATOM | 3312 | CB | ASP | L | 52 | −0.606 | −1.428 | 28.786 | 1.00 | 28.74 | C |

TABLE 17-continued

| ATOM | 3313 | CG | ASP | L | 52 | −1.369 | −0.939 | 27.584 | 1.00 | 33.45 | C |
|------|------|-----|-----|---|----|--------|--------|--------|------|-------|---|
| ATOM | 3314 | OD1 | ASP | L | 52 | −0.726 | −0.790 | 26.521 | 1.00 | 33.26 | O |
| ATOM | 3315 | OD2 | ASP | L | 52 | −2.605 | −0.768 | 27.688 | 1.00 | 35.86 | O |
| ATOM | 3316 | N   | ARG | L | 53 | 2.138  | −2.748 | 29.687 | 1.00 | 27.92 | N |
| ATOM | 3317 | CA  | ARG | L | 53 | 3.090  | −3.148 | 30.710 | 1.00 | 31.40 | C |
| ATOM | 3318 | C   | ARG | L | 53 | 3.540  | −1.955 | 31.539 | 1.00 | 30.36 | C |
| ATOM | 3319 | O   | ARG | L | 53 | 3.838  | −0.886 | 30.985 | 1.00 | 30.94 | O |
| ATOM | 3320 | CB  | ARG | L | 53 | 4.325  | −3.822 | 30.095 | 1.00 | 32.55 | C |
| ATOM | 3321 | CG  | ARG | L | 53 | 4.072  | −5.265 | 29.702 | 1.00 | 31.86 | C |
| ATOM | 3322 | CD  | ARG | L | 53 | 5.310  | −5.915 | 29.115 | 1.00 | 40.40 | C |
| ATOM | 3323 | NE  | ARG | L | 53 | 5.772  | −5.186 | 27.945 | 1.00 | 50.06 | N |
| ATOM | 3324 | CZ  | ARG | L | 53 | 5.227  | −5.294 | 26.740 | 1.00 | 58.70 | C |
| ATOM | 3325 | NH1 | ARG | L | 53 | 4.202  | −6.120 | 26.536 | 1.00 | 55.88 | N |
| ATOM | 3326 | NH2 | ARG | L | 53 | 5.715  | −4.577 | 25.738 | 1.00 | 65.72 | N |
| ATOM | 3327 | N   | PRO | L | 54 | 3.632  | −2.113 | 32.856 | 1.00 | 29.01 | N |
| ATOM | 3328 | CA  | PRO | L | 54 | 4.330  | −1.119 | 33.660 | 1.00 | 28.77 | C |
| ATOM | 3329 | C   | PRO | L | 54 | 5.790  | −1.083 | 33.240 | 1.00 | 26.96 | C |
| ATOM | 3330 | O   | PRO | L | 54 | 6.329  | −2.051 | 32.700 | 1.00 | 29.19 | O |
| ATOM | 3331 | CB  | PRO | L | 54 | 4.161  | −1.635 | 35.093 | 1.00 | 30.95 | C |
| ATOM | 3332 | CG  | PRO | L | 54 | 3.051  | −2.635 | 35.013 | 1.00 | 30.43 | C |
| ATOM | 3333 | CD  | PRO | L | 54 | 3.202  | −3.260 | 33.673 | 1.00 | 29.51 | C |
| ATOM | 3334 | N   | SER | L | 55 | 6.429  | 0.063  | 33.462 | 1.00 | 34.02 | N |
| ATOM | 3335 | CA  | SER | L | 55 | 7.835  | 0.159  | 33.103 | 1.00 | 41.35 | C |
| ATOM | 3336 | C   | SER | L | 55 | 8.630  | −0.825 | 33.952 | 1.00 | 42.41 | C |
| ATOM | 3337 | O   | SER | L | 55 | 8.352  | −1.014 | 35.141 | 1.00 | 40.41 | O |
| ATOM | 3338 | CB  | SER | L | 55 | 8.354  | 1.590  | 33.283 | 1.00 | 50.98 | C |
| ATOM | 3339 | OG  | SER | L | 55 | 8.795  | 1.808  | 34.606 | 1.00 | 59.03 | O |
| ATOM | 3340 | N   | GLY | L | 56 | 9.584  | −1.498 | 33.325 | 1.00 | 41.71 | N |
| ATOM | 3341 | CA  | GLY | L | 56 | 10.385 | −2.481 | 34.017 | 1.00 | 46.50 | C |
| ATOM | 3342 | C   | GLY | L | 56 | 9.879  | −3.904 | 33.934 | 1.00 | 40.84 | C |
| ATOM | 3343 | O   | GLY | L | 56 | 10.612 | −4.824 | 34.307 | 1.00 | 43.81 | O |
| ATOM | 3344 | N   | ILE | L | 57 | 8.652  | −4.119 | 33.475 | 1.00 | 33.97 | N |
| ATOM | 3345 | CA  | ILE | L | 57 | 8.165  | −5.482 | 33.260 | 1.00 | 31.02 | C |
| ATOM | 3346 | C   | ILE | L | 57 | 8.659  | −5.967 | 31.901 | 1.00 | 36.26 | C |
| ATOM | 3347 | O   | ILE | L | 57 | 8.531  | −5.228 | 30.907 | 1.00 | 36.32 | O |
| ATOM | 3348 | CB  | ILE | L | 57 | 6.639  | −5.531 | 33.336 | 1.00 | 28.13 | C |
| ATOM | 3349 | CG1 | ILE | L | 57 | 6.154  | −5.086 | 34.723 | 1.00 | 28.66 | C |
| ATOM | 3350 | CG2 | ILE | L | 57 | 6.148  | −6.915 | 32.967 | 1.00 | 27.22 | C |
| ATOM | 3351 | CD1 | ILE | L | 57 | 6.579  | −5.995 | 35.872 | 1.00 | 28.95 | C |
| ATOM | 3352 | N   | PRO | L | 58 | 9.202  | −7.182 | 31.811 | 1.00 | 34.89 | N |
| ATOM | 3353 | CA  | PRO | L | 58 | 9.753  | −7.658 | 30.535 | 1.00 | 42.05 | C |
| ATOM | 3354 | C   | PRO | L | 58 | 8.688  | −7.745 | 29.454 | 1.00 | 37.63 | C |
| ATOM | 3355 | O   | PRO | L | 58 | 7.519  | −8.013 | 29.727 | 1.00 | 32.59 | O |
| ATOM | 3356 | CB  | PRO | L | 58 | 10.304 | −9.050 | 30.878 | 1.00 | 38.47 | C |
| ATOM | 3357 | CG  | PRO | L | 58 | 10.478 | −9.047 | 32.365 | 1.00 | 44.24 | C |
| ATOM | 3358 | CD  | PRO | L | 58 | 9.416  | −8.139 | 32.908 | 1.00 | 37.12 | C |
| ATOM | 3359 | N   | GLU | L | 59 | 9.128  | −7.570 | 28.205 | 1.00 | 36.51 | N |
| ATOM | 3360 | CA  | GLU | L | 59 | 8.225  | −7.560 | 27.061 | 1.00 | 39.45 | C |
| ATOM | 3361 | C   | GLU | L | 59 | 7.535  | −8.902 | 26.844 | 1.00 | 44.98 | C |
| ATOM | 3362 | O   | GLU | L | 59 | 6.490  | −8.949 | 26.186 | 1.00 | 44.21 | O |
| ATOM | 3363 | CB  | GLU | L | 59 | 9.002  | −7.155 | 25.805 | 1.00 | 51.60 | C |
| ATOM | 3364 | CG  | GLU | L | 59 | 9.965  | −5.995 | 26.039 | 1.00 | 65.64 | C |
| ATOM | 3365 | CD  | GLU | L | 59 | 10.857 | −5.714 | 24.843 | 1.00 | 79.15 | C |
| ATOM | 3366 | OE1 | GLU | L | 59 | 12.101 | −5.723 | 24.999 | 1.00 | 81.02 | O |
| ATOM | 3367 | OE2 | GLU | L | 59 | 10.308 | −5.485 | 23.746 | 1.00 | 84.91 | O |
| ATOM | 3368 | N   | ARG | L | 60 | 8.078  | −9.992 | 27.392 | 1.00 | 36.22 | N |
| ATOM | 3369 | CA  | ARG | L | 60 | 7.426  | −11.288| 27.208 | 1.00 | 33.91 | C |
| ATOM | 3370 | C   | ARG | L | 60 | 6.128  | −11.440| 28.012 | 1.00 | 28.18 | C |
| ATOM | 3371 | O   | ARG | L | 60 | 5.466  | −12.472| 27.863 | 1.00 | 34.60 | O |
| ATOM | 3372 | CB  | ARG | L | 60 | 8.403  | −12.430| 27.540 | 1.00 | 42.00 | C |
| ATOM | 3373 | CG  | ARG | L | 60 | 9.187  | −12.227| 28.822 | 1.00 | 38.77 | C |
| ATOM | 3374 | CD  | ARG | L | 60 | 10.281 | −13.295| 29.079 | 1.00 | 38.13 | C |
| ATOM | 3375 | NE  | ARG | L | 60 | 10.608 | −13.225| 30.494 | 1.00 | 40.62 | N |
| ATOM | 3376 | CZ  | ARG | L | 60 | 10.037 | −13.976| 31.428 | 1.00 | 36.40 | C |
| ATOM | 3377 | NH1 | ARG | L | 60 | 9.137  | −14.901| 31.094 | 1.00 | 34.11 | N |
| ATOM | 3378 | NH2 | ARG | L | 60 | 10.367 | −13.803| 32.696 | 1.00 | 34.63 | N |
| ATOM | 3379 | N   | PHE | L | 61 | 5.736  | −10.466| 28.833 | 1.00 | 29.06 | N |
| ATOM | 3380 | CA  | PHE | L | 61 | 4.400  | −10.446| 29.428 | 1.00 | 31.35 | C |
| ATOM | 3381 | C   | PHE | L | 61 | 3.467  | −9.647 | 28.522 | 1.00 | 36.71 | C |
| ATOM | 3382 | O   | PHE | L | 61 | 3.729  | −8.472 | 28.242 | 1.00 | 37.27 | O |
| ATOM | 3383 | CB  | PHE | L | 61 | 4.417  | −9.830 | 30.829 | 1.00 | 32.73 | C |
| ATOM | 3384 | CG  | PHE | L | 61 | 5.059  | −10.703| 31.862 | 1.00 | 34.25 | C |
| ATOM | 3385 | CD1 | PHE | L | 61 | 6.417  | −10.641| 32.082 | 1.00 | 33.91 | C |
| ATOM | 3386 | CD2 | PHE | L | 61 | 4.302  | −11.577| 32.618 | 1.00 | 30.92 | C |
| ATOM | 3387 | CE1 | PHE | L | 61 | 7.025  | −11.450| 33.016 | 1.00 | 37.36 | C |
| ATOM | 3388 | CE2 | PHE | L | 61 | 4.910  | −12.395| 33.557 | 1.00 | 36.11 | C |
| ATOM | 3389 | CZ  | PHE | L | 61 | 6.275  | −12.321| 33.759 | 1.00 | 35.60 | C |
| ATOM | 3390 | N   | SER | L | 62 | 2.386  | −10.273| 28.065 | 1.00 | 30.27 | N |
| ATOM | 3391 | CA  | SER | L | 62 | 1.398  | −9.547 | 27.269 | 1.00 | 29.92 | C |
| ATOM | 3392 | C   | SER | L | 62 | 0.018  | −10.117| 27.564 | 1.00 | 30.48 | C |

TABLE 17-continued

| | | | | | | | | | | |
|---|---|---|---|---|---|---|---|---|---|---|
| ATOM | 3393 | O | SER | L | 62 | −0.170 | −10.884 | 28.512 | 1.00 | 34.40 | O |
| ATOM | 3394 | CB | SER | L | 62 | 1.733 | −9.600 | 25.775 | 1.00 | 38.55 | C |
| ATOM | 3395 | OG | SER | L | 62 | 0.925 | −8.654 | 25.085 | 1.00 | 52.05 | O |
| ATOM | 3396 | N | GLY | L | 63 | −0.966 | −9.717 | 26.768 | 1.00 | 29.99 | N |
| ATOM | 3397 | CA | GLY | L | 63 | −2.316 | −10.171 | 27.031 | 1.00 | 27.10 | C |
| ATOM | 3398 | C | GLY | L | 63 | −3.236 | −9.792 | 25.898 | 1.00 | 31.03 | C |
| ATOM | 3399 | O | GLY | L | 63 | −2.858 | −9.052 | 24.983 | 1.00 | 30.75 | O |
| ATOM | 3400 | N | SER | L | 64 | −4.461 | −10.306 | 25.988 | 1.00 | 31.23 | N |
| ATOM | 3401 | CA | SER | L | 64 | −5.514 | −9.986 | 25.034 | 1.00 | 31.55 | C |
| ATOM | 3402 | C | SER | L | 64 | −6.861 | −10.092 | 25.737 | 1.00 | 32.98 | C |
| ATOM | 3403 | O | SER | L | 64 | −6.993 | −10.742 | 26.774 | 1.00 | 34.58 | O |
| ATOM | 3404 | CB | SER | L | 64 | −5.455 | −10.907 | 23.810 | 1.00 | 36.76 | C |
| ATOM | 3405 | OG | SER | L | 64 | −5.751 | −12.252 | 24.161 | 1.00 | 37.35 | O |
| ATOM | 3406 | N | ASN | L | 65 | −7.872 | −9.441 | 25.168 | 1.00 | 28.74 | N |
| ATOM | 3407 | CA | ASN | L | 65 | −9.182 | −9.430 | 25.814 | 1.00 | 25.13 | C |
| ATOM | 3408 | C | ASN | L | 65 | −10.240 | −9.178 | 24.754 | 1.00 | 37.00 | C |
| ATOM | 3409 | O | ASN | L | 65 | −10.192 | −8.149 | 24.068 | 1.00 | 32.99 | O |
| ATOM | 3410 | CB | ASN | L | 65 | −9.233 | −8.338 | 26.912 | 1.00 | 24.01 | C |
| ATOM | 3411 | CG | ASN | L | 65 | −10.596 | −8.233 | 27.596 | 1.00 | 25.61 | C |
| ATOM | 3412 | OD1 | ASN | L | 65 | −11.418 | −9.132 | 27.504 | 1.00 | 29.45 | O |
| ATOM | 3413 | ND2 | ASN | L | 65 | −10.821 | −7.137 | 28.314 | 1.00 | 26.75 | N |
| ATOM | 3414 | N | ASER | L | 66 | −11.185 | −10.104 | 24.608 | 0.49 | 30.30 | N |
| ATOM | 3415 | CA | ASER | L | 66 | −12.317 | −9.869 | 23.722 | 0.49 | 35.26 | C |
| ATOM | 3416 | C | ASER | L | 66 | −13.418 | −10.860 | 24.059 | 0.49 | 38.32 | C |
| ATOM | 3417 | O | ASER | L | 66 | −13.146 | −11.981 | 24.492 | 0.49 | 37.42 | O |
| ATOM | 3418 | CB | ASER | L | 66 | −11.924 | −9.989 | 22.242 | 0.49 | 35.01 | C |
| ATOM | 3419 | OG | ASER | L | 66 | −13.046 | −9.785 | 21.396 | 0.49 | 32.79 | O |
| ATOM | 3420 | N | BSER | L | 66 | −11.191 | −10.097 | 24.632 | 0.51 | 30.10 | N |
| ATOM | 3421 | CA | BSER | L | 66 | −12.319 | −9.873 | 23.745 | 0.51 | 35.28 | C |
| ATOM | 3422 | C | BSER | L | 66 | −13.427 | −10.837 | 24.128 | 0.51 | 38.27 | C |
| ATOM | 3423 | O | BSER | L | 66 | −13.166 | −11.917 | 24.660 | 0.51 | 38.08 | O |
| ATOM | 3424 | CB | BSER | L | 66 | −11.925 | −10.059 | 22.277 | 0.51 | 35.10 | C |
| ATOM | 3425 | OG | BSER | L | 66 | −11.928 | −11.431 | 21.936 | 0.51 | 33.17 | O |
| ATOM | 3426 | N | GLY | L | 67 | −14.663 | −10.433 | 23.854 | 1.00 | 37.52 | N |
| ATOM | 3427 | CA | GLY | L | 67 | −15.794 | −11.301 | 24.118 | 1.00 | 37.41 | C |
| ATOM | 3428 | C | GLY | L | 67 | −15.942 | −11.618 | 25.590 | 1.00 | 38.05 | C |
| ATOM | 3429 | O | GLY | L | 67 | −16.078 | −10.705 | 26.409 | 1.00 | 35.28 | O |
| ATOM | 3430 | N | ASN | L | 68 | −15.903 | −12.906 | 25.946 | 1.00 | 38.85 | N |
| ATOM | 3431 | CA | ASN | L | 68 | −16.076 | −13.325 | 27.329 | 1.00 | 39.55 | C |
| ATOM | 3432 | C | ASN | L | 68 | −14.783 | −13.849 | 27.952 | 1.00 | 34.44 | C |
| ATOM | 3433 | O | ASN | L | 68 | −14.836 | −14.452 | 29.026 | 1.00 | 33.59 | O |
| ATOM | 3434 | CB | ASN | L | 68 | −17.174 | −14.387 | 27.433 | 1.00 | 40.96 | C |
| ATOM | 3435 | CG | ASN | L | 68 | −18.530 | −13.878 | 26.967 | 1.00 | 42.92 | C |
| ATOM | 3436 | OD1 | ASN | L | 68 | −18.910 | −12.737 | 27.232 | 1.00 | 43.85 | O |
| ATOM | 3437 | ND2 | ASN | L | 68 | −19.264 | −14.728 | 26.263 | 1.00 | 43.35 | N |
| ATOM | 3438 | N | THR | L | 69 | −13.629 | −13.616 | 27.327 | 1.00 | 31.97 | N |
| ATOM | 3439 | CA | THR | L | 69 | −12.372 | −14.152 | 27.847 | 1.00 | 36.12 | C |
| ATOM | 3440 | C | THR | L | 69 | −11.231 | −13.175 | 27.626 | 1.00 | 36.65 | C |
| ATOM | 3441 | O | THR | L | 69 | −11.039 | −12.688 | 26.509 | 1.00 | 32.74 | O |
| ATOM | 3442 | CB | THR | L | 69 | −12.010 | −15.483 | 27.177 | 1.00 | 39.30 | C |
| ATOM | 3443 | OG1 | THR | L | 69 | −13.130 | −16.368 | 27.223 | 1.00 | 46.81 | O |
| ATOM | 3444 | CG2 | THR | L | 69 | −10.837 | −16.138 | 27.888 | 1.00 | 39.79 | C |
| ATOM | 3445 | N | ALA | L | 70 | −10.456 | −12.924 | 28.683 | 1.00 | 30.82 | N |
| ATOM | 3446 | CA | ALA | L | 70 | −9.166 | −12.263 | 28.585 | 1.00 | 26.46 | C |
| ATOM | 3447 | C | ALA | L | 70 | −8.062 | −13.268 | 28.894 | 1.00 | 31.00 | C |
| ATOM | 3448 | O | ALA | L | 70 | −8.275 | −14.231 | 29.627 | 1.00 | 37.40 | O |
| ATOM | 3449 | CB | ALA | L | 70 | −9.071 | −11.071 | 29.542 | 1.00 | 24.46 | C |
| ATOM | 3450 | N | THR | L | 71 | −6.877 | −13.033 | 28.337 | 1.00 | 31.46 | N |
| ATOM | 3451 | CA | THR | L | 71 | −5.764 | −13.974 | 28.412 | 1.00 | 29.97 | C |
| ATOM | 3452 | C | THR | L | 71 | −4.495 | −13.225 | 28.765 | 1.00 | 33.75 | C |
| ATOM | 3453 | O | THR | L | 71 | −4.166 | −12.239 | 28.112 | 1.00 | 31.29 | O |
| ATOM | 3454 | CB | THR | L | 71 | −5.530 | −14.695 | 27.081 | 1.00 | 34.48 | C |
| ATOM | 3455 | OG1 | THR | L | 71 | −6.726 | −15.359 | 26.666 | 1.00 | 33.08 | O |
| ATOM | 3456 | CG2 | THR | L | 71 | −4.401 | −15.734 | 27.221 | 1.00 | 36.15 | C |
| ATOM | 3457 | N | LEU | L | 72 | −3.790 | −13.693 | 29.785 | 1.00 | 29.03 | N |
| ATOM | 3458 | CA | LEU | L | 72 | −2.422 | −13.274 | 30.051 | 1.00 | 32.31 | C |
| ATOM | 3459 | C | LEU | L | 72 | −1.479 | −14.266 | 29.375 | 1.00 | 32.07 | C |
| ATOM | 3460 | O | LEU | L | 72 | −1.658 | −15.478 | 29.508 | 1.00 | 32.20 | O |
| ATOM | 3461 | CB | LEU | L | 72 | −2.188 | −13.231 | 31.560 | 1.00 | 27.58 | C |
| ATOM | 3462 | CG | LEU | L | 72 | −0.769 | −13.012 | 32.063 | 1.00 | 26.41 | C |
| ATOM | 3463 | CD1 | LEU | L | 72 | −0.347 | −11.558 | 31.772 | 1.00 | 28.29 | C |
| ATOM | 3464 | CD2 | LEU | L | 72 | −0.684 | −13.321 | 33.551 | 1.00 | 31.67 | C |
| ATOM | 3465 | N | THR | L | 73 | −0.511 | −13.758 | 28.609 | 1.00 | 28.93 | N |
| ATOM | 3466 | CA | THR | L | 73 | 0.487 | −14.595 | 27.950 | 1.00 | 29.30 | C |
| ATOM | 3467 | C | THR | L | 73 | 1.868 | −14.252 | 28.477 | 1.00 | 30.40 | C |
| ATOM | 3468 | O | THR | L | 73 | 2.233 | −13.073 | 28.581 | 1.00 | 36.83 | O |
| ATOM | 3469 | CB | THR | L | 73 | 0.486 | −14.436 | 26.421 | 1.00 | 35.33 | C |
| ATOM | 3470 | OG1 | THR | L | 73 | 0.709 | −13.057 | 26.085 | 1.00 | 44.29 | O |
| ATOM | 3471 | CG2 | THR | L | 73 | −0.821 | −14.900 | 25.823 | 1.00 | 30.66 | C |
| ATOM | 3472 | N | ILE | L | 74 | 2.633 | −15.284 | 28.804 | 1.00 | 27.43 | N |

TABLE 17-continued

| ATOM | 3473 | CA | ILE | L | 74 | 4.007 | −15.144 | 29.256 | 1.00 | 28.27 | C |
|---|---|---|---|---|---|---|---|---|---|---|---|
| ATOM | 3474 | C | ILE | L | 74 | 4.839 | −15.980 | 28.305 | 1.00 | 32.93 | C |
| ATOM | 3475 | O | ILE | L | 74 | 4.774 | −17.218 | 28.339 | 1.00 | 33.37 | O |
| ATOM | 3476 | CB | ILE | L | 74 | 4.196 | −15.618 | 30.704 | 1.00 | 30.03 | C |
| ATOM | 3477 | CG1 | ILE | L | 74 | 3.063 | −15.093 | 31.581 | 1.00 | 30.47 | C |
| ATOM | 3478 | CG2 | ILE | L | 74 | 5.589 | −15.239 | 31.221 | 1.00 | 30.98 | C |
| ATOM | 3479 | CD1 | ILE | L | 74 | 3.032 | −15.668 | 32.987 | 1.00 | 36.00 | C |
| ATOM | 3480 | N | SER | L | 75 | 5.624 | −15.318 | 27.463 | 1.00 | 33.61 | N |
| ATOM | 3481 | CA | SER | L | 75 | 6.483 | −16.024 | 26.530 | 1.00 | 36.20 | C |
| ATOM | 3482 | C | SER | L | 75 | 7.815 | −16.376 | 27.189 | 1.00 | 33.51 | C |
| ATOM | 3483 | O | SER | L | 75 | 8.246 | −15.743 | 28.159 | 1.00 | 34.38 | O |
| ATOM | 3484 | CB | SER | L | 75 | 6.719 | −15.175 | 25.280 | 1.00 | 47.32 | C |
| ATOM | 3485 | OG | SER | L | 75 | 5.490 | −14.663 | 24.799 | 1.00 | 62.64 | O |
| ATOM | 3486 | N | ARG | L | 76 | 8.461 | −17.404 | 26.642 | 1.00 | 37.15 | N |
| ATOM | 3487 | CA | ARG | L | 76 | 9.798 | −17.805 | 27.067 | 1.00 | 43.35 | C |
| ATOM | 3488 | C | ARG | L | 76 | 9.851 | −17.971 | 28.584 | 1.00 | 43.07 | C |
| ATOM | 3489 | O | ARG | L | 76 | 10.675 | −17.376 | 29.274 | 1.00 | 34.73 | O |
| ATOM | 3490 | CB | ARG | L | 76 | 10.842 | −16.805 | 26.564 | 1.00 | 37.44 | C |
| ATOM | 3491 | CG | ARG | L | 76 | 10.968 | −16.799 | 25.041 | 1.00 | 43.86 | C |
| ATOM | 3492 | CD | ARG | L | 76 | 11.883 | −15.682 | 24.530 | 1.00 | 52.14 | C |
| ATOM | 3493 | NE | ARG | L | 76 | 11.285 | −14.352 | 24.663 | 1.00 | 63.73 | N |
| ATOM | 3494 | CZ | ARG | L | 76 | 10.414 | −13.829 | 23.802 | 1.00 | 68.49 | C |
| ATOM | 3495 | NH1 | ARG | L | 76 | 10.023 | −14.517 | 22.735 | 1.00 | 70.39 | N |
| ATOM | 3496 | NH2 | ARG | L | 76 | 9.929 | −12.614 | 24.011 | 1.00 | 69.88 | N |
| ATOM | 3497 | N | VAL | L | 77 | 8.940 | −18.799 | 29.101 | 1.00 | 43.03 | N |
| ATOM | 3498 | CA | VAL | L | 77 | 8.762 | −18.914 | 30.542 | 1.00 | 35.75 | C |
| ATOM | 3499 | C | VAL | L | 77 | 10.041 | −19.400 | 31.206 | 1.00 | 33.50 | C |
| ATOM | 3500 | O | VAL | L | 77 | 10.773 | −20.233 | 30.660 | 1.00 | 36.24 | O |
| ATOM | 3501 | CB | VAL | L | 77 | 7.576 | −19.844 | 30.842 | 1.00 | 42.55 | C |
| ATOM | 3502 | CG1 | VAL | L | 77 | 7.593 | −20.292 | 32.285 | 1.00 | 50.02 | C |
| ATOM | 3503 | CG2 | VAL | L | 77 | 6.285 | −19.121 | 30.556 | 1.00 | 34.93 | C |
| ATOM | 3504 | N | GLU | L | 78 | 10.335 | −18.840 | 32.379 | 1.00 | 36.64 | N |
| ATOM | 3505 | CA | GLU | L | 78 | 11.448 | −19.252 | 33.216 | 1.00 | 39.67 | C |
| ATOM | 3506 | C | GLU | L | 78 | 10.910 | −19.785 | 34.539 | 1.00 | 36.29 | C |
| ATOM | 3507 | O | GLU | L | 78 | 9.815 | −19.426 | 34.968 | 1.00 | 36.04 | O |
| ATOM | 3508 | CB | GLU | L | 78 | 12.404 | −18.083 | 33.477 | 1.00 | 47.49 | C |
| ATOM | 3509 | CG | GLU | L | 78 | 12.771 | −17.304 | 32.230 | 1.00 | 59.32 | C |
| ATOM | 3510 | CD | GLU | L | 78 | 13.296 | −15.911 | 32.537 | 1.00 | 62.27 | C |
| ATOM | 3511 | OE1 | GLU | L | 78 | 13.445 | −15.572 | 33.731 | 1.00 | 61.81 | O |
| ATOM | 3512 | OE2 | GLU | L | 78 | 13.555 | −15.153 | 31.579 | 1.00 | 63.88 | O |
| ATOM | 3513 | N | ALA | L | 79 | 11.717 | −20.618 | 35.206 | 1.00 | 37.65 | N |
| ATOM | 3514 | CA | ALA | L | 79 | 11.310 | −21.147 | 36.508 | 1.00 | 35.88 | C |
| ATOM | 3515 | C | ALA | L | 79 | 10.964 | −20.034 | 37.491 | 1.00 | 37.54 | C |
| ATOM | 3516 | O | ALA | L | 79 | 10.064 | −20.201 | 38.323 | 1.00 | 36.56 | O |
| ATOM | 3517 | CB | ALA | L | 79 | 12.407 | −22.042 | 37.085 | 1.00 | 34.00 | C |
| ATOM | 3518 | N | GLY | L | 80 | 11.642 | −18.885 | 37.394 | 1.00 | 35.75 | N |
| ATOM | 3519 | CA | GLY | L | 80 | 11.336 | −17.748 | 38.245 | 1.00 | 29.68 | C |
| ATOM | 3520 | C | GLY | L | 80 | 9.947 | −17.187 | 38.046 | 1.00 | 35.89 | C |
| ATOM | 3521 | O | GLY | L | 80 | 9.469 | −16.437 | 38.901 | 1.00 | 35.62 | O |
| ATOM | 3522 | N | ASP | L | 81 | 9.285 | −17.520 | 36.936 | 1.00 | 29.39 | N |
| ATOM | 3523 | CA | ASP | L | 81 | 7.927 | −17.026 | 36.731 | 1.00 | 28.61 | C |
| ATOM | 3524 | C | ASP | L | 81 | 6.880 | −17.767 | 37.570 | 1.00 | 31.56 | C |
| ATOM | 3525 | O | ASP | L | 81 | 5.712 | −17.354 | 37.563 | 1.00 | 29.99 | O |
| ATOM | 3526 | CB | ASP | L | 81 | 7.534 | −17.115 | 35.247 | 1.00 | 33.07 | C |
| ATOM | 3527 | CG | ASP | L | 81 | 8.450 | −16.294 | 34.331 | 1.00 | 38.77 | C |
| ATOM | 3528 | OD1 | ASP | L | 81 | 9.082 | −15.304 | 34.791 | 1.00 | 35.68 | O |
| ATOM | 3529 | OD2 | ASP | L | 81 | 8.521 | −16.639 | 33.130 | 1.00 | 35.09 | O |
| ATOM | 3530 | N | GLU | L | 82 | 7.242 | −18.856 | 38.265 | 1.00 | 28.89 | N |
| ATOM | 3531 | CA | GLU | L | 82 | 6.266 | −19.553 | 39.112 | 1.00 | 29.19 | C |
| ATOM | 3532 | C | GLU | L | 82 | 5.647 | −18.605 | 40.132 | 1.00 | 33.84 | C |
| ATOM | 3533 | O | GLU | L | 82 | 6.352 | −17.946 | 40.906 | 1.00 | 34.42 | O |
| ATOM | 3534 | CB | GLU | L | 82 | 6.910 | −20.745 | 39.832 | 1.00 | 35.40 | C |
| ATOM | 3535 | CG | GLU | L | 82 | 7.082 | −21.975 | 38.969 | 1.00 | 45.73 | C |
| ATOM | 3536 | CD | GLU | L | 82 | 7.237 | −23.263 | 39.781 | 1.00 | 48.07 | C |
| ATOM | 3537 | OE1 | GLU | L | 82 | 7.200 | −24.353 | 39.173 | 1.00 | 46.44 | O |
| ATOM | 3538 | OE2 | GLU | L | 82 | 7.394 | −23.186 | 41.023 | 1.00 | 49.18 | O |
| ATOM | 3539 | N | ALA | L | 83 | 4.320 | −18.534 | 40.126 | 1.00 | 29.18 | N |
| ATOM | 3540 | CA | ALA | L | 83 | 3.623 | −17.542 | 40.928 | 1.00 | 28.75 | C |
| ATOM | 3541 | C | ALA | L | 83 | 2.138 | −17.823 | 40.793 | 1.00 | 25.42 | C |
| ATOM | 3542 | O | ALA | L | 83 | 1.716 | −18.569 | 39.906 | 1.00 | 29.10 | O |
| ATOM | 3543 | CB | ALA | L | 83 | 3.915 | −16.101 | 40.467 | 1.00 | 25.64 | C |
| ATOM | 3544 | N | ASP | L | 84 | 1.353 | −17.220 | 41.681 | 1.00 | 25.15 | N |
| ATOM | 3545 | CA | ASP | L | 84 | −0.080 | −17.079 | 41.445 | 1.00 | 28.18 | C |
| ATOM | 3546 | C | ASP | L | 84 | −0.323 | −15.812 | 40.634 | 1.00 | 34.11 | C |
| ATOM | 3547 | O | ASP | L | 84 | 0.250 | −14.758 | 40.925 | 1.00 | 31.37 | O |
| ATOM | 3548 | CB | ASP | L | 84 | −0.850 | −17.026 | 42.764 | 1.00 | 26.40 | C |
| ATOM | 3549 | CG | ASP | L | 84 | −0.651 | −18.293 | 43.599 | 1.00 | 46.69 | C |
| ATOM | 3550 | OD1 | ASP | L | 84 | −0.727 | −19.410 | 43.031 | 1.00 | 45.11 | O |
| ATOM | 3551 | OD2 | ASP | L | 84 | −0.408 | −18.164 | 44.819 | 1.00 | 48.42 | O |
| ATOM | 3552 | N | TYR | L | 85 | −1.171 | −15.912 | 39.623 | 1.00 | 26.74 | N |

TABLE 17-continued

| ATOM | 3553 | CA | TYR | L | 85 | −1.492 | −14.781 | 38.763 | 1.00 | 25.25 | C |
|---|---|---|---|---|---|---|---|---|---|---|---|
| ATOM | 3554 | C | TYR | L | 85 | −2.976 | −14.487 | 38.901 | 1.00 | 26.48 | C |
| ATOM | 3555 | O | TYR | L | 85 | −3.794 | −15.397 | 38.750 | 1.00 | 28.35 | O |
| ATOM | 3556 | CB | TYR | L | 85 | −1.160 | −15.085 | 37.303 | 1.00 | 23.12 | C |
| ATOM | 3557 | CG | TYR | L | 85 | 0.307 | −15.168 | 37.040 | 1.00 | 25.29 | C |
| ATOM | 3558 | CD1 | TYR | L | 85 | 0.995 | −16.350 | 37.246 | 1.00 | 23.69 | C |
| ATOM | 3559 | CD2 | TYR | L | 85 | 1.014 | −14.048 | 36.610 | 1.00 | 27.99 | C |
| ATOM | 3560 | CE1 | TYR | L | 85 | 2.378 | −16.412 | 37.024 | 1.00 | 23.99 | C |
| ATOM | 3561 | CE2 | TYR | L | 85 | 2.372 | −14.104 | 36.388 | 1.00 | 29.12 | C |
| ATOM | 3562 | CZ | TYR | L | 85 | 3.046 | −15.289 | 36.594 | 1.00 | 29.41 | C |
| ATOM | 3563 | OH | TYR | L | 85 | 4.400 | −15.365 | 36.377 | 1.00 | 30.82 | O |
| ATOM | 3564 | N | TYR | L | 86 | −3.313 | −13.229 | 39.171 | 1.00 | 23.43 | N |
| ATOM | 3565 | CA | TYR | L | 86 | −4.700 | −12.816 | 39.378 | 1.00 | 23.43 | C |
| ATOM | 3566 | C | TYR | L | 86 | −5.118 | −11.798 | 38.335 | 1.00 | 27.61 | C |
| ATOM | 3567 | O | TYR | L | 86 | −4.368 | −10.859 | 38.041 | 1.00 | 25.56 | O |
| ATOM | 3568 | CB | TYR | L | 86 | −4.894 | −12.185 | 40.747 | 1.00 | 21.73 | C |
| ATOM | 3569 | CG | TYR | L | 86 | −4.584 | −13.078 | 41.918 | 1.00 | 25.67 | C |
| ATOM | 3570 | CD1 | TYR | L | 86 | −3.301 | −13.133 | 42.448 | 1.00 | 30.31 | C |
| ATOM | 3571 | CD2 | TYR | L | 86 | −5.582 | −13.839 | 42.524 | 1.00 | 37.61 | C |
| ATOM | 3572 | CE1 | TYR | L | 86 | −3.018 | −13.938 | 43.530 | 1.00 | 35.05 | C |
| ATOM | 3573 | CE2 | TYR | L | 86 | −5.300 | −14.648 | 43.600 | 1.00 | 37.78 | C |
| ATOM | 3574 | CZ | TYR | L | 86 | −4.020 | −14.693 | 44.099 | 1.00 | 40.81 | C |
| ATOM | 3575 | OH | TYR | L | 86 | −3.728 | −15.498 | 45.178 | 1.00 | 55.68 | O |
| ATOM | 3576 | N | CYS | L | 87 | −6.326 | −11.965 | 37.799 | 1.00 | 25.50 | N |
| ATOM | 3577 | CA | CYS | L | 87 | −6.924 | −10.930 | 36.977 | 1.00 | 25.89 | C |
| ATOM | 3578 | C | CYS | L | 87 | −7.865 | −10.086 | 37.822 | 1.00 | 23.42 | C |
| ATOM | 3579 | O | CYS | L | 87 | −8.339 | −10.514 | 38.882 | 1.00 | 26.89 | O |
| ATOM | 3580 | CB | CYS | L | 87 | −7.661 | −11.533 | 35.776 | 1.00 | 26.66 | C |
| ATOM | 3581 | SG | CYS | L | 87 | −9.013 | −12.662 | 36.202 | 1.00 | 30.59 | S |
| ATOM | 3582 | N | GLN | L | 88 | −8.100 | −8.853 | 37.362 | 1.00 | 24.98 | N |
| ATOM | 3583 | CA | GLN | L | 88 | −8.845 | −7.879 | 38.147 | 1.00 | 26.74 | C |
| ATOM | 3584 | C | GLN | L | 88 | −9.518 | −6.864 | 37.226 | 1.00 | 27.84 | C |
| ATOM | 3585 | O | GLN | L | 88 | −8.948 | −6.482 | 36.200 | 1.00 | 24.31 | O |
| ATOM | 3586 | CB | GLN | L | 88 | −7.911 | −7.168 | 39.138 | 1.00 | 22.20 | C |
| ATOM | 3587 | CG | GLN | L | 88 | −8.584 | −6.106 | 39.984 | 1.00 | 27.75 | C |
| ATOM | 3588 | CD | GLN | L | 88 | −8.230 | −4.703 | 39.543 | 1.00 | 30.83 | C |
| ATOM | 3589 | OE1 | GLN | L | 88 | −7.066 | −4.402 | 39.254 | 1.00 | 27.14 | O |
| ATOM | 3590 | NE2 | GLN | L | 88 | −9.232 | −3.830 | 39.484 | 1.00 | 36.34 | N |
| ATOM | 3591 | N | VAL | L | 89 | −10.744 | −6.451 | 37.585 | 1.00 | 24.50 | N |
| ATOM | 3592 | CA | VAL | L | 89 | −11.487 | −5.432 | 36.845 | 1.00 | 26.58 | C |
| ATOM | 3593 | C | VAL | L | 89 | −12.199 | −4.494 | 37.815 | 1.00 | 23.96 | C |
| ATOM | 3594 | O | VAL | L | 89 | −12.457 | −4.822 | 38.978 | 1.00 | 25.08 | O |
| ATOM | 3595 | CB | VAL | L | 89 | −12.528 | −6.027 | 35.844 | 1.00 | 22.99 | C |
| ATOM | 3596 | CG1 | VAL | L | 89 | −11.864 | −6.955 | 34.826 | 1.00 | 21.39 | C |
| ATOM | 3597 | CG2 | VAL | L | 89 | −13.680 | −6.741 | 36.565 | 1.00 | 22.36 | C |
| ATOM | 3598 | N | TRP | L | 90 | −12.524 | −3.301 | 37.306 | 1.00 | 25.08 | N |
| ATOM | 3599 | CA | TRP | L | 90 | −13.477 | −2.412 | 37.956 | 1.00 | 24.43 | C |
| ATOM | 3600 | C | TRP | L | 90 | −14.878 | −2.804 | 37.512 | 1.00 | 25.50 | C |
| ATOM | 3601 | O | TRP | L | 90 | −15.135 | −2.944 | 36.312 | 1.00 | 25.41 | O |
| ATOM | 3602 | CB | TRP | L | 90 | −13.200 | −0.959 | 37.588 | 1.00 | 23.23 | C |
| ATOM | 3603 | CG | TRP | L | 90 | −14.202 | 0.067 | 38.102 | 1.00 | 24.40 | C |
| ATOM | 3604 | CD1 | TRP | L | 90 | −15.079 | 0.795 | 37.347 | 1.00 | 22.78 | C |
| ATOM | 3605 | CD2 | TRP | L | 90 | −14.382 | 0.509 | 39.459 | 1.00 | 29.81 | C |
| ATOM | 3606 | NE1 | TRP | L | 90 | −15.774 | 1.678 | 38.143 | 1.00 | 23.56 | N |
| ATOM | 3607 | CE2 | TRP | L | 90 | −15.378 | 1.514 | 39.442 | 1.00 | 24.90 | C |
| ATOM | 3608 | CE3 | TRP | L | 90 | −13.792 | 0.166 | 40.683 | 1.00 | 25.88 | C |
| ATOM | 3609 | CZ2 | TRP | L | 90 | −15.805 | 2.166 | 40.601 | 1.00 | 25.41 | C |
| ATOM | 3610 | CZ3 | TRP | L | 90 | −14.218 | 0.821 | 41.838 | 1.00 | 28.18 | C |
| ATOM | 3611 | CH2 | TRP | L | 90 | −15.222 | 1.814 | 41.786 | 1.00 | 27.30 | C |
| ATOM | 3612 | N | ASP | L | 91 | −15.754 | −3.012 | 38.475 | 1.00 | 23.52 | N |
| ATOM | 3613 | CA | ASP | L | 91 | −17.166 | −3.325 | 38.234 | 1.00 | 22.69 | C |
| ATOM | 3614 | C | ASP | L | 91 | −17.921 | −2.010 | 38.371 | 1.00 | 28.19 | C |
| ATOM | 3615 | O | ASP | L | 91 | −18.269 | −1.591 | 39.472 | 1.00 | 29.34 | O |
| ATOM | 3616 | CB | ASP | L | 91 | −17.624 | −4.381 | 39.236 | 1.00 | 30.11 | C |
| ATOM | 3617 | CG | ASP | L | 91 | −19.120 | −4.591 | 39.244 | 1.00 | 37.98 | C |
| ATOM | 3618 | OD1 | ASP | L | 91 | −19.826 | −4.055 | 38.361 | 1.00 | 30.87 | O |
| ATOM | 3619 | OD2 | ASP | L | 91 | −19.583 | −5.304 | 40.161 | 1.00 | 37.43 | O |
| ATOM | 3620 | N | TYR | L | 92 | −18.160 | −1.336 | 37.243 | 1.00 | 25.59 | N |
| ATOM | 3621 | CA | TYR | L | 92 | −18.749 | −0.008 | 37.343 | 1.00 | 28.60 | C |
| ATOM | 3622 | C | TYR | L | 92 | −20.198 | −0.072 | 37.797 | 1.00 | 31.91 | C |
| ATOM | 3623 | O | TYR | L | 92 | −20.700 | 0.885 | 38.397 | 1.00 | 32.18 | O |
| ATOM | 3624 | CB | TYR | L | 92 | −18.637 | 0.736 | 36.014 | 1.00 | 31.78 | C |
| ATOM | 3625 | CG | TYR | L | 92 | −18.660 | −0.147 | 34.779 | 1.00 | 39.09 | C |
| ATOM | 3626 | CD1 | TYR | L | 92 | −19.857 | −0.608 | 34.255 | 1.00 | 41.37 | C |
| ATOM | 3627 | CD2 | TYR | L | 92 | −17.479 | −0.501 | 34.129 | 1.00 | 55.29 | C |
| ATOM | 3628 | CE1 | TYR | L | 92 | −19.884 | −1.406 | 33.127 | 1.00 | 50.68 | C |
| ATOM | 3629 | CE2 | TYR | L | 92 | −17.493 | −1.296 | 32.999 | 1.00 | 64.33 | C |
| ATOM | 3630 | CZ | TYR | L | 92 | −18.695 | −1.746 | 32.498 | 1.00 | 63.91 | C |
| ATOM | 3631 | OH | TYR | L | 92 | −18.697 | −2.544 | 31.369 | 1.00 | 71.46 | O |
| ATOM | 3632 | N | ASER | L | 93 | −20.884 | −1.181 | 37.530 | 0.53 | 33.75 | N |

TABLE 17-continued

| | | | | | | | | | | |
|---|---|---|---|---|---|---|---|---|---|---|
| ATOM | 3633 | CA | ASER | L | 93 | −22.262 | −1.294 | 37.994 | 0.53 | 34.93 C |
| ATOM | 3634 | C | ASER | L | 93 | −22.321 | −1.352 | 39.513 | 0.53 | 36.02 C |
| ATOM | 3635 | O | ASER | L | 93 | −23.144 | −0.670 | 40.134 | 0.53 | 38.36 O |
| ATOM | 3636 | CB | ASER | L | 93 | −22.928 | −2.522 | 37.384 | 0.53 | 36.32 C |
| ATOM | 3637 | OG | ASER | L | 93 | −24.168 | −2.774 | 38.010 | 0.53 | 38.93 O |
| ATOM | 3638 | N | BSER | L | 93 | −20.885 | −1.186 | 37.539 | 0.47 | 33.70 N |
| ATOM | 3639 | CA | BSER | L | 93 | −22.268 | −1.295 | 37.994 | 0.47 | 34.98 C |
| ATOM | 3640 | C | BSER | L | 93 | −22.337 | −1.369 | 39.514 | 0.47 | 36.13 C |
| ATOM | 3641 | O | BSER | L | 93 | −23.185 | −0.718 | 40.135 | 0.47 | 38.82 O |
| ATOM | 3642 | CB | BSER | L | 93 | −22.943 | −2.514 | 37.366 | 0.47 | 36.33 C |
| ATOM | 3643 | OG | BSER | L | 93 | −22.818 | −2.499 | 35.955 | 0.47 | 39.06 O |
| ATOM | 3644 | N | GLY | L | 94 | −21.439 | −2.142 | 40.130 | 1.00 | 34.07 N |
| ATOM | 3645 | CA | GLY | L | 94 | −21.379 | −2.256 | 41.570 | 1.00 | 35.14 C |
| ATOM | 3646 | C | GLY | L | 94 | −20.442 | −1.287 | 42.253 | 1.00 | 33.41 C |
| ATOM | 3647 | O | GLY | L | 94 | −20.386 | −1.269 | 43.486 | 1.00 | 34.02 O |
| ATOM | 3648 | N | GLN | L | 95 | −19.709 | −0.483 | 41.483 | 1.00 | 33.02 N |
| ATOM | 3649 | CA | GLN | L | 95 | −18.747 | 0.482 | 42.013 | 1.00 | 27.47 C |
| ATOM | 3650 | C | GLN | L | 95 | −17.749 | −0.185 | 42.965 | 1.00 | 30.49 C |
| ATOM | 3651 | O | GLN | L | 95 | −17.537 | 0.257 | 44.102 | 1.00 | 29.90 O |
| ATOM | 3652 | CB | GLN | L | 95 | −19.474 | 1.644 | 42.698 | 1.00 | 31.47 C |
| ATOM | 3653 | CG | GLN | L | 95 | −20.292 | 2.518 | 41.730 | 1.00 | 34.36 C |
| ATOM | 3654 | CD | GLN | L | 95 | −19.414 | 3.398 | 40.855 | 1.00 | 37.08 C |
| ATOM | 3655 | OE1 | GLN | L | 95 | −19.212 | 3.118 | 39.665 | 1.00 | 42.89 O |
| ATOM | 3656 | NE2 | GLN | L | 95 | −18.874 | 4.471 | 41.446 | 1.00 | 32.43 N |
| ATOM | 3657 | N | ARG | L | 96 | −17.113 | −1.251 | 42.480 | 1.00 | 25.08 N |
| ATOM | 3658 | CA | ARG | L | 96 | −16.221 | −2.056 | 43.306 | 1.00 | 28.14 C |
| ATOM | 3659 | C | ARG | L | 96 | −15.167 | −2.708 | 42.420 | 1.00 | 29.36 C |
| ATOM | 3660 | O | ARG | L | 96 | −15.388 | −2.919 | 41.226 | 1.00 | 27.58 O |
| ATOM | 3661 | CB | ARG | L | 96 | −16.996 | −3.134 | 44.078 | 1.00 | 32.91 C |
| ATOM | 3662 | CG | ARG | L | 96 | −17.705 | −4.124 | 43.164 | 1.00 | 35.57 C |
| ATOM | 3663 | CD | ARG | L | 96 | −18.802 | −4.911 | 43.882 | 1.00 | 46.11 C |
| ATOM | 3664 | NE | ARG | L | 96 | −19.872 | −4.038 | 44.362 | 1.00 | 47.87 N |
| ATOM | 3665 | CZ | ARG | L | 96 | −21.073 | −4.458 | 44.750 | 1.00 | 49.83 C |
| ATOM | 3666 | NH1 | ARG | L | 96 | −21.374 | −5.747 | 44.711 | 1.00 | 46.79 N |
| ATOM | 3667 | NH2 | ARG | L | 96 | −21.973 | −3.583 | 45.178 | 1.00 | 47.80 N |
| ATOM | 3668 | N | GLN | L | 97 | −14.017 | −3.021 | 43.019 | 1.00 | 27.61 N |
| ATOM | 3669 | CA | GLN | L | 97 | −12.959 | −3.775 | 42.343 | 1.00 | 23.36 C |
| ATOM | 3670 | C | GLN | L | 97 | −13.181 | −5.269 | 42.559 | 1.00 | 23.20 C |
| ATOM | 3671 | O | GLN | L | 97 | −13.520 | −5.703 | 43.665 | 1.00 | 28.41 O |
| ATOM | 3672 | CB | GLN | L | 97 | −11.576 | −3.383 | 42.873 | 1.00 | 24.63 C |
| ATOM | 3673 | CG | GLN | L | 97 | −11.203 | −1.904 | 42.738 | 1.00 | 27.97 C |
| ATOM | 3674 | CD | GLN | L | 97 | −10.689 | −1.534 | 41.351 | 1.00 | 30.81 C |
| ATOM | 3675 | OE1 | GLN | L | 97 | −11.131 | −2.077 | 40.345 | 1.00 | 29.45 O |
| ATOM | 3676 | NE2 | GLN | L | 97 | −9.737 | −0.609 | 41.299 | 1.00 | 31.70 N |
| ATOM | 3677 | N | VAL | L | 98 | −12.997 | −6.052 | 41.497 | 1.00 | 22.93 N |
| ATOM | 3678 | CA | VAL | L | 98 | −13.236 | −7.497 | 41.528 | 1.00 | 26.14 C |
| ATOM | 3679 | C | VAL | L | 98 | −11.964 | −8.211 | 41.109 | 1.00 | 25.65 C |
| ATOM | 3680 | O | VAL | L | 98 | −11.312 | −7.812 | 40.137 | 1.00 | 26.35 O |
| ATOM | 3681 | CB | VAL | L | 98 | −14.408 | −7.904 | 40.608 | 1.00 | 29.87 C |
| ATOM | 3682 | CG1 | VAL | L | 98 | −14.588 | −9.431 | 40.579 | 1.00 | 29.63 C |
| ATOM | 3683 | CG2 | VAL | L | 98 | −15.690 | −7.221 | 41.054 | 1.00 | 30.57 C |
| ATOM | 3684 | N | PHE | L | 99 | −11.623 | −9.279 | 41.830 | 1.00 | 29.91 N |
| ATOM | 3685 | CA | PHE | L | 99 | −10.509 | −10.150 | 41.483 | 1.00 | 22.82 C |
| ATOM | 3686 | C | PHE | L | 99 | −11.010 | −11.533 | 41.073 | 1.00 | 28.93 C |
| ATOM | 3687 | O | PHE | L | 99 | −12.045 | −12.011 | 41.560 | 1.00 | 31.83 O |
| ATOM | 3688 | CB | PHE | L | 99 | −9.538 | −10.347 | 42.666 | 1.00 | 26.93 C |
| ATOM | 3689 | CG | PHE | L | 99 | −8.690 | −9.155 | 43.006 | 1.00 | 28.07 C |
| ATOM | 3690 | CD1 | PHE | L | 99 | −7.418 | −9.009 | 42.458 | 1.00 | 25.90 C |
| ATOM | 3691 | CD2 | PHE | L | 99 | −9.131 | −8.216 | 43.937 | 1.00 | 29.51 C |
| ATOM | 3692 | CE1 | PHE | L | 99 | −6.621 | −7.925 | 42.794 | 1.00 | 28.49 C |
| ATOM | 3693 | CE2 | PHE | L | 99 | −8.321 | −7.130 | 44.287 | 1.00 | 29.18 C |
| ATOM | 3694 | CZ | PHE | L | 99 | −7.079 | −6.987 | 43.710 | 1.00 | 27.54 C |
| ATOM | 3695 | N | GLY | L | 100 | −10.262 | −12.174 | 40.181 | 1.00 | 25.98 N |
| ATOM | 3696 | CA | GLY | L | 100 | −10.379 | −13.606 | 40.007 | 1.00 | 29.41 C |
| ATOM | 3697 | C | GLY | L | 100 | −9.695 | −14.326 | 41.151 | 1.00 | 33.09 C |
| ATOM | 3698 | O | GLY | L | 100 | −8.916 | −13.752 | 41.910 | 1.00 | 32.67 O |
| ATOM | 3699 | N | CYS | L | 101 | −9.979 | −15.615 | 41.290 | 1.00 | 30.97 N |
| ATOM | 3700 | CA | CYS | L | 101 | −9.384 | −16.310 | 42.428 | 1.00 | 34.88 C |
| ATOM | 3701 | C | CYS | L | 101 | −7.974 | −16.822 | 42.160 | 1.00 | 28.19 C |
| ATOM | 3702 | O | CYS | L | 101 | −7.403 | −17.477 | 43.036 | 1.00 | 35.94 O |
| ATOM | 3703 | CB | CYS | L | 101 | −10.287 | −17.457 | 42.890 | 1.00 | 48.85 C |
| ATOM | 3704 | SG | CYS | L | 101 | −11.531 | −16.910 | 44.111 | 1.00 | 71.48 S |
| ATOM | 3705 | N | GLY | L | 102 | −7.398 | −16.547 | 40.999 | 1.00 | 29.43 N |
| ATOM | 3706 | CA | GLY | L | 102 | −5.983 | −16.812 | 40.805 | 1.00 | 29.90 C |
| ATOM | 3707 | C | GLY | L | 102 | −5.701 | −18.111 | 40.067 | 1.00 | 29.56 C |
| ATOM | 3708 | O | GLY | L | 102 | −6.448 | −19.092 | 40.155 | 1.00 | 34.22 O |
| ATOM | 3709 | N | THR | L | 103 | −4.591 | −18.118 | 39.328 | 1.00 | 27.87 N |
| ATOM | 3710 | CA | THR | L | 103 | −4.122 | −19.283 | 38.588 | 1.00 | 28.09 C |
| ATOM | 3711 | C | THR | L | 103 | −2.677 | −19.531 | 38.996 | 1.00 | 30.86 C |
| ATOM | 3712 | O | THR | L | 103 | −1.836 | −18.629 | 38.864 | 1.00 | 26.97 O |

TABLE 17-continued

| | | | | | | | | | |
|---|---|---|---|---|---|---|---|---|---|
| ATOM | 3713 | CB | THR | L | 103 | −4.211 | −19.064 | 37.070 | 1.00 | 28.44 C |
| ATOM | 3714 | OG1 | THR | L | 103 | −5.575 | −18.838 | 36.688 | 1.00 | 32.78 O |
| ATOM | 3715 | CG2 | THR | L | 103 | −3.655 | −20.268 | 36.314 | 1.00 | 29.36 C |
| ATOM | 3716 | N | LYS | L | 104 | −2.386 | −20.731 | 39.503 | 1.00 | 28.38 N |
| ATOM | 3717 | CA | LYS | L | 104 | −1.009 | −21.057 | 39.844 | 1.00 | 26.72 C |
| ATOM | 3718 | C | LYS | L | 104 | −0.289 | −21.562 | 38.601 | 1.00 | 29.71 C |
| ATOM | 3719 | O | LYS | L | 104 | −0.744 | −22.504 | 37.953 | 1.00 | 29.51 O |
| ATOM | 3720 | CB | LYS | L | 104 | −0.910 | −22.095 | 40.967 | 1.00 | 28.15 C |
| ATOM | 3721 | CG | LYS | L | 104 | 0.528 | −22.588 | 41.102 | 1.00 | 37.86 C |
| ATOM | 3722 | CD | LYS | L | 104 | 0.820 | −23.378 | 42.366 | 1.00 | 54.80 C |
| ATOM | 3723 | CE | LYS | L | 104 | 2.284 | −23.862 | 42.357 | 1.00 | 65.25 C |
| ATOM | 3724 | NZ | LYS | L | 104 | 3.258 | −22.798 | 41.919 | 1.00 | 69.00 N |
| ATOM | 3725 | N | LEU | L | 105 | 0.820 | −20.917 | 38.267 | 1.00 | 27.38 N |
| ATOM | 3726 | CA | LEU | L | 105 | 1.656 | −21.298 | 37.142 | 1.00 | 26.83 C |
| ATOM | 3727 | C | LEU | L | 105 | 2.780 | −22.171 | 37.673 | 1.00 | 28.02 C |
| ATOM | 3728 | O | LEU | L | 105 | 3.580 | −21.726 | 38.501 | 1.00 | 33.40 O |
| ATOM | 3729 | CB | LEU | L | 105 | 2.229 | −20.064 | 36.440 | 1.00 | 30.42 C |
| ATOM | 3730 | CG | LEU | L | 105 | 3.206 | −20.390 | 35.307 | 1.00 | 35.87 C |
| ATOM | 3731 | CD1 | LEU | L | 105 | 2.486 | −21.186 | 34.211 | 1.00 | 39.44 C |
| ATOM | 3732 | CD2 | LEU | L | 105 | 3.865 | −19.129 | 34.743 | 1.00 | 40.66 C |
| ATOM | 3733 | N | THR | L | 106 | 2.812 | −23.414 | 37.231 | 1.00 | 28.54 N |
| ATOM | 3734 | CA | THR | L | 106 | 3.918 | −24.304 | 37.535 | 1.00 | 29.50 C |
| ATOM | 3735 | C | THR | L | 106 | 4.793 | −24.448 | 36.302 | 1.00 | 33.46 C |
| ATOM | 3736 | O | THR | L | 106 | 4.292 | −24.601 | 35.184 | 1.00 | 36.64 O |
| ATOM | 3737 | CB | THR | L | 106 | 3.405 | −25.670 | 37.984 | 1.00 | 34.97 C |
| ATOM | 3738 | OG1 | THR | L | 106 | 2.473 | −26.149 | 37.021 | 1.00 | 38.84 O |
| ATOM | 3739 | CG2 | THR | L | 106 | 2.690 | −25.571 | 39.306 | 1.00 | 36.27 C |
| ATOM | 3740 | N | VAL | L | 107 | 6.102 | −24.422 | 36.518 | 1.00 | 31.72 N |
| ATOM | 3741 | CA | VAL | L | 107 | 7.082 | −24.566 | 35.454 | 1.00 | 34.47 C |
| ATOM | 3742 | C | VAL | L | 107 | 7.757 | −25.920 | 35.598 | 1.00 | 33.61 C |
| ATOM | 3743 | O | VAL | L | 107 | 8.329 | −26.235 | 36.653 | 1.00 | 32.57 O |
| ATOM | 3744 | CB | VAL | L | 107 | 8.107 | −23.423 | 35.482 | 1.00 | 30.12 C |
| ATOM | 3745 | CG1 | VAL | L | 107 | 9.181 | −23.658 | 34.408 | 1.00 | 32.36 C |
| ATOM | 3746 | CG2 | VAL | L | 107 | 7.398 | −22.080 | 35.323 | 1.00 | 32.20 C |
| ATOM | 3747 | N | LEU | L | 108 | 7.736 | −26.696 | 34.518 | 1.00 | 34.40 N |
| ATOM | 3748 | CA | LEU | L | 108 | 8.266 | −28.045 | 34.493 | 1.00 | 36.48 C |
| ATOM | 3749 | C | LEU | L | 108 | 9.796 | −28.044 | 34.435 | 1.00 | 36.49 C |
| ATOM | 3750 | O | LEU | L | 108 | 10.456 | −27.000 | 34.386 | 1.00 | 37.69 O |
| ATOM | 3751 | CB | LEU | L | 108 | 7.699 | −28.806 | 33.296 | 1.00 | 37.58 C |
| ATOM | 3752 | CG | LEU | L | 108 | 6.183 | −29.019 | 33.229 | 1.00 | 38.93 C |
| ATOM | 3753 | CD1 | LEU | L | 108 | 5.788 | −29.561 | 31.867 | 1.00 | 44.76 C |
| ATOM | 3754 | CD2 | LEU | L | 108 | 5.758 | −29.990 | 34.330 | 1.00 | 42.73 C |
| ATOM | 3755 | N | GLY | L | 109 | 10.358 | −29.240 | 34.443 | 1.00 | 40.12 N |
| ATOM | 3756 | CA | GLY | L | 109 | 11.783 | −29.402 | 34.232 | 1.00 | 46.33 C |
| ATOM | 3757 | C | GLY | L | 109 | 12.488 | −29.904 | 35.463 | 1.00 | 65.16 C |
| ATOM | 3758 | O | GLY | L | 109 | 12.909 | −29.115 | 36.311 | 1.00 | 75.12 O |
| TER | 3759 | | GLY | L | 109 | | | | | |
| ATOM | 3760 | N | ILE | B | 1 | −28.658 | 14.213 | 16.716 | 1.00 | 104.37 N |
| ATOM | 3761 | CA | ILE | B | 1 | −28.007 | 12.934 | 16.975 | 1.00 | 98.35 C |
| ATOM | 3762 | C | ILE | B | 1 | −27.089 | 12.589 | 15.780 | 1.00 | 93.57 C |
| ATOM | 3763 | O | ILE | B | 1 | −25.960 | 13.079 | 15.721 | 1.00 | 101.37 O |
| ATOM | 3764 | CB | ILE | B | 1 | −29.074 | 11.830 | 17.308 | 1.00 | 96.06 C |
| ATOM | 3765 | CG1 | ILE | B | 1 | −28.434 | 10.450 | 17.509 | 1.00 | 89.64 C |
| ATOM | 3766 | CG2 | ILE | B | 1 | −30.237 | 11.830 | 16.300 | 1.00 | 100.47 C |
| ATOM | 3767 | CD1 | ILE | B | 1 | −27.675 | 10.304 | 18.812 | 1.00 | 84.22 C |
| ATOM | 3768 | N | GLN | B | 2 | −27.560 | 11.789 | 14.823 | 1.00 | 75.47 N |
| ATOM | 3769 | CA | GLN | B | 2 | −26.719 | 11.368 | 13.709 | 1.00 | 60.23 C |
| ATOM | 3770 | C | GLN | B | 2 | −26.636 | 12.471 | 12.662 | 1.00 | 54.88 C |
| ATOM | 3771 | O | GLN | B | 2 | −27.660 | 12.984 | 12.205 | 1.00 | 55.61 O |
| ATOM | 3772 | CB | GLN | B | 2 | −27.255 | 10.078 | 13.086 | 1.00 | 63.16 C |
| ATOM | 3773 | CG | GLN | B | 2 | −27.031 | 8.841 | 13.944 | 1.00 | 63.65 C |
| ATOM | 3774 | CD | GLN | B | 2 | −27.309 | 7.547 | 13.198 | 1.00 | 69.01 C |
| ATOM | 3775 | OE1 | GLN | B | 2 | −28.163 | 7.498 | 12.312 | 1.00 | 69.37 O |
| ATOM | 3776 | NE2 | GLN | B | 2 | −26.581 | 6.494 | 13.550 | 1.00 | 69.67 N |
| ATOM | 3777 | N | ARG | B | 3 | −25.409 | 12.829 | 12.281 | 1.00 | 53.75 N |
| ATOM | 3778 | CA | ARG | B | 3 | −25.137 | 13.960 | 11.402 | 1.00 | 46.74 C |
| ATOM | 3779 | C | ARG | B | 3 | −24.403 | 13.473 | 10.161 | 1.00 | 44.24 C |
| ATOM | 3780 | O | ARG | B | 3 | −23.440 | 12.705 | 10.266 | 1.00 | 46.17 O |
| ATOM | 3781 | CB | ARG | B | 3 | −24.313 | 15.033 | 12.132 | 1.00 | 46.53 C |
| ATOM | 3782 | CG | ARG | B | 3 | −25.109 | 15.832 | 13.157 | 1.00 | 50.67 C |
| ATOM | 3783 | CD | ARG | B | 3 | −24.241 | 16.771 | 14.001 | 1.00 | 51.03 C |
| ATOM | 3784 | NE | ARG | B | 3 | −23.748 | 16.114 | 15.212 | 1.00 | 61.52 N |
| ATOM | 3785 | CZ | ARG | B | 3 | −23.023 | 16.711 | 16.158 | 1.00 | 62.56 C |
| ATOM | 3786 | NH1 | ARG | B | 3 | −22.698 | 17.994 | 16.042 | 1.00 | 58.90 N |
| ATOM | 3787 | NH2 | ARG | B | 3 | −22.620 | 16.020 | 17.222 | 1.00 | 49.55 N |
| ATOM | 3788 | N | THR | B | 4 | −24.868 | 13.938 | 8.958 | 1.00 | 46.02 N |
| ATOM | 3789 | CA | THR | B | 4 | −24.273 | 13.406 | 7.743 | 1.00 | 45.01 C |
| ATOM | 3790 | C | THR | B | 4 | −23.054 | 14.239 | 7.343 | 1.00 | 47.74 C |
| ATOM | 3791 | O | THR | B | 4 | −22.978 | 15.434 | 7.656 | 1.00 | 44.03 O |
| ATOM | 3792 | CB | THR | B | 4 | −25.312 | 13.372 | 6.609 | 1.00 | 46.97 C |

TABLE 17-continued

| | | | | | | | | | | |
|---|---|---|---|---|---|---|---|---|---|---|
| ATOM | 3793 | OG1 | THR | B | 4 | −24.962 | 12.358 | 5.656 | 1.00 | 49.07 | O |
| ATOM | 3794 | CG2 | THR | B | 4 | −25.433 | 14.715 | 5.903 | 1.00 | 48.43 | C |
| ATOM | 3795 | N | PRO | B | 5 | −22.052 | 13.632 | 6.707 | 1.00 | 48.91 | N |
| ATOM | 3796 | CA | PRO | B | 5 | −20.816 | 14.374 | 6.427 | 1.00 | 44.03 | C |
| ATOM | 3797 | C | PRO | B | 5 | −20.979 | 15.369 | 5.289 | 1.00 | 45.66 | C |
| ATOM | 3798 | O | PRO | B | 5 | −21.663 | 15.110 | 4.294 | 1.00 | 46.10 | O |
| ATOM | 3799 | CB | PRO | B | 5 | −19.810 | 13.272 | 6.065 | 1.00 | 43.86 | C |
| ATOM | 3800 | CG | PRO | B | 5 | −20.642 | 12.137 | 5.606 | 1.00 | 47.45 | C |
| ATOM | 3801 | CD | PRO | B | 5 | −21.910 | 12.194 | 6.411 | 1.00 | 48.18 | C |
| ATOM | 3802 | N | LYS | B | 6 | −20.342 | 16.523 | 5.453 | 1.00 | 45.88 | N |
| ATOM | 3803 | CA | LYS | B | 6 | −20.093 | 17.426 | 4.342 | 1.00 | 47.18 | C |
| ATOM | 3804 | C | LYS | B | 6 | −18.796 | 17.005 | 3.663 | 1.00 | 45.49 | C |
| ATOM | 3805 | O | LYS | B | 6 | −17.850 | 16.574 | 4.325 | 1.00 | 46.35 | O |
| ATOM | 3806 | CB | LYS | B | 6 | −20.013 | 18.870 | 4.834 | 1.00 | 52.43 | C |
| ATOM | 3807 | CG | LYS | B | 6 | −21.228 | 19.284 | 5.650 | 1.00 | 61.35 | C |
| ATOM | 3808 | CD | LYS | B | 6 | −21.220 | 20.769 | 5.945 | 1.00 | 66.89 | C |
| ATOM | 3809 | CE | LYS | B | 6 | −19.889 | 21.203 | 6.524 | 1.00 | 65.03 | C |
| ATOM | 3810 | NZ | LYS | B | 6 | −19.616 | 20.656 | 7.894 | 1.00 | 69.70 | N |
| ATOM | 3811 | N | ILE | B | 7 | −18.768 | 17.104 | 2.337 | 1.00 | 43.75 | N |
| ATOM | 3812 | CA | ILE | B | 7 | −17.710 | 16.510 | 1.530 | 1.00 | 46.70 | C |
| ATOM | 3813 | C | ILE | B | 7 | −17.145 | 17.563 | 0.590 | 1.00 | 46.20 | C |
| ATOM | 3814 | O | ILE | B | 7 | −17.898 | 18.226 | −0.130 | 1.00 | 49.75 | O |
| ATOM | 3815 | CB | ILE | B | 7 | −18.228 | 15.309 | 0.720 | 1.00 | 52.40 | C |
| ATOM | 3816 | CG1 | ILE | B | 7 | −18.901 | 14.292 | 1.639 | 1.00 | 54.28 | C |
| ATOM | 3817 | CG2 | ILE | B | 7 | −17.101 | 14.674 | −0.075 | 1.00 | 48.86 | C |
| ATOM | 3818 | CD1 | ILE | B | 7 | −20.252 | 13.862 | 1.145 | 1.00 | 61.67 | C |
| ATOM | 3819 | N | GLN | B | 8 | −15.822 | 17.698 | 0.583 | 1.00 | 44.36 | N |
| ATOM | 3820 | CA | GLN | B | 8 | −15.120 | 18.530 | −0.382 | 1.00 | 48.74 | C |
| ATOM | 3821 | C | GLN | B | 8 | −13.992 | 17.720 | −1.003 | 1.00 | 49.17 | C |
| ATOM | 3822 | C | GLN | B | 8 | −13.204 | 17.099 | −0.281 | 1.00 | 54.41 | O |
| ATOM | 3823 | CB | GLN | B | 8 | −14.549 | 19.791 | 0.273 | 1.00 | 49.72 | C |
| ATOM | 3824 | CG | GLN | B | 8 | −15.566 | 20.721 | 0.907 | 1.00 | 50.02 | C |
| ATOM | 3825 | CD | GLN | B | 8 | −14.965 | 22.084 | 1.209 | 1.00 | 47.87 | C |
| ATOM | 3826 | OE1 | GLN | B | 8 | −14.527 | 22.788 | 0.302 | 1.00 | 51.86 | O |
| ATOM | 3827 | NE2 | GLN | B | 8 | −14.923 | 22.452 | 2.486 | 1.00 | 47.33 | N |
| ATOM | 3828 | N | VAL | B | 9 | −13.914 | 17.730 | −2.333 | 1.00 | 47.45 | N |
| ATOM | 3829 | CA | VAL | B | 9 | −12.815 | 17.121 | −3.079 | 1.00 | 55.97 | C |
| ATOM | 3830 | C | VAL | B | 9 | −12.029 | 18.243 | −3.735 | 1.00 | 57.09 | C |
| ATOM | 3831 | O | VAL | B | 9 | −12.613 | 19.095 | −4.415 | 1.00 | 53.80 | O |
| ATOM | 3832 | CB | VAL | B | 9 | −13.322 | 16.135 | −4.147 | 1.00 | 63.50 | C |
| ATOM | 3833 | CG1 | VAL | B | 9 | −12.180 | 15.260 | −4.657 | 1.00 | 58.14 | C |
| ATOM | 3834 | CG2 | VAL | B | 9 | −14.451 | 15.305 | −3.600 | 1.00 | 70.25 | C |
| ATOM | 3835 | N | TYR | B | 10 | −10.712 | 18.232 | −3.556 | 1.00 | 54.34 | N |
| ATOM | 3836 | CA | TYR | B | 10 | −9.877 | 19.319 | −4.054 | 1.00 | 55.44 | C |
| ATOM | 3837 | C | TYR | B | 10 | −8.423 | 18.872 | −4.015 | 1.00 | 56.57 | C |
| ATOM | 3838 | O | TYR | B | 10 | −8.097 | 17.797 | −3.505 | 1.00 | 53.77 | O |
| ATOM | 3839 | CB | TYR | B | 10 | −10.081 | 20.598 | −3.239 | 1.00 | 54.63 | C |
| ATOM | 3840 | CG | TYR | B | 10 | −9.830 | 20.409 | −1.756 | 1.00 | 53.40 | C |
| ATOM | 3841 | CD1 | TYR | B | 10 | −10.759 | 19.753 | −0.955 | 1.00 | 49.88 | C |
| ATOM | 3842 | CD2 | TYR | B | 10 | −8.670 | 20.887 | −1.157 | 1.00 | 48.83 | C |
| ATOM | 3843 | CE1 | TYR | B | 10 | −10.538 | 19.571 | 0.407 | 1.00 | 49.48 | C |
| ATOM | 3844 | CE2 | TYR | B | 10 | −8.442 | 20.712 | 0.212 | 1.00 | 45.24 | C |
| ATOM | 3845 | CZ | TYR | B | 10 | −9.383 | 20.051 | 0.981 | 1.00 | 43.49 | C |
| ATOM | 3846 | OH | TYR | B | 10 | −9.180 | 19.863 | 2.331 | 1.00 | 41.14 | O |
| ATOM | 3847 | N | SER | B | 11 | −7.554 | 19.710 | −4.573 | 1.00 | 60.41 | N |
| ATOM | 3848 | CA | SER | B | 11 | −6.121 | 19.459 | −4.595 | 1.00 | 58.08 | C |
| ATOM | 3849 | C | SER | B | 11 | −5.418 | 20.392 | −3.619 | 1.00 | 53.23 | C |
| ATOM | 3850 | O | SER | B | 11 | −5.921 | 21.469 | −3.289 | 1.00 | 60.02 | O |
| ATOM | 3851 | CB | SER | B | 11 | −5.542 | 19.641 | −6.005 | 1.00 | 55.76 | C |
| ATOM | 3852 | OG | SER | B | 11 | −5.735 | 20.962 | −6.478 | 1.00 | 53.34 | O |
| ATOM | 3853 | N | ARG | B | 12 | −4.236 | 19.965 | −3.164 | 1.00 | 52.35 | N |
| ATOM | 3854 | CA | ARG | B | 12 | −3.468 | 20.775 | −2.221 | 1.00 | 57.14 | C |
| ATOM | 3855 | C | ARG | B | 12 | −3.043 | 22.096 | −2.849 | 1.00 | 63.55 | C |
| ATOM | 3856 | O | ARG | B | 12 | −3.240 | 23.168 | −2.264 | 1.00 | 65.82 | O |
| ATOM | 3857 | CB | ARG | B | 12 | −2.250 | 19.995 | −1.727 | 1.00 | 60.86 | C |
| ATOM | 3858 | CG | ARG | B | 12 | −1.398 | 20.773 | −0.724 | 1.00 | 60.08 | C |
| ATOM | 3859 | CD | ARG | B | 12 | −0.202 | 19.963 | −0.233 | 1.00 | 54.53 | C |
| ATOM | 3860 | NE | ARG | B | 12 | −0.599 | 18.751 | 0.470 | 1.00 | 53.88 | N |
| ATOM | 3861 | CZ | ARG | B | 12 | 0.256 | 17.843 | 0.929 | 1.00 | 56.63 | C |
| ATOM | 3862 | NH1 | ARG | B | 12 | 1.562 | 18.009 | 0.756 | 1.00 | 58.34 | N |
| ATOM | 3863 | NH2 | ARG | B | 12 | −0.192 | 16.765 | 1.557 | 1.00 | 54.49 | N |
| ATOM | 3864 | N | HIS | B | 13 | −2.455 | 22.039 | −4.040 | 1.00 | 66.95 | N |
| ATOM | 3865 | CA | HIS | B | 13 | −2.072 | 23.209 | −4.815 | 1.00 | 72.49 | C |
| ATOM | 3866 | C | HIS | B | 13 | −2.933 | 23.308 | −6.066 | 1.00 | 74.44 | C |
| ATOM | 3867 | O | HIS | B | 13 | −3.524 | 22.312 | −6.498 | 1.00 | 72.30 | O |
| ATOM | 3868 | CB | HIS | B | 13 | −0.592 | 23.138 | −5.217 | 1.00 | 72.78 | C |
| ATOM | 3869 | CG | HIS | B | 13 | 0.313 | 22.691 | −4.112 | 1.00 | 71.23 | C |
| ATOM | 3870 | ND1 | HIS | B | 13 | 0.762 | 21.392 | −3.999 | 1.00 | 70.47 | N |
| ATOM | 3871 | CD2 | HIS | B | 13 | 0.847 | 23.366 | −3.067 | 1.00 | 68.92 | C |
| ATOM | 3872 | CE1 | HIS | B | 13 | 1.536 | 21.288 | −2.932 | 1.00 | 69.97 | C |

TABLE 17-continued

| | | | | | | | | | |
|---|---|---|---|---|---|---|---|---|---|
| ATOM | 3873 | NE2 | HIS | B | 13 | 1.605 | 22.472 | −2.350 | 1.00 | 68.56 N |
| ATOM | 3874 | N | PRO | B | 14 | −3.049 | 24.495 | −6.662 | 1.00 | 75.28 N |
| ATOM | 3875 | CA | PRO | B | 14 | −3.783 | 24.614 | −7.929 | 1.00 | 79.16 C |
| ATOM | 3876 | C | PRO | B | 14 | −3.275 | 23.614 | −8.958 | 1.00 | 76.75 C |
| ATOM | 3877 | O | PRO | B | 14 | −2.071 | 23.498 | −9.199 | 1.00 | 74.44 O |
| ATOM | 3878 | CB | PRO | B | 14 | −3.517 | 26.060 | −8.355 | 1.00 | 81.76 C |
| ATOM | 3879 | CG | PRO | B | 14 | −3.320 | 26.784 | −7.070 | 1.00 | 79.76 C |
| ATOM | 3880 | CD | PRO | B | 14 | −2.621 | 25.809 | −6.150 | 1.00 | 76.60 C |
| ATOM | 3881 | N | ALA | B | 15 | −4.206 | 22.870 | −9.548 | 1.00 | 78.49 N |
| ATOM | 3882 | CA | ALA | B | 15 | −3.845 | 21.730 | −10.379 | 1.00 | 78.24 C |
| ATOM | 3883 | C | ALA | B | 15 | −3.184 | 22.189 | −11.673 | 1.00 | 79.51 C |
| ATOM | 3884 | O | ALA | B | 15 | −3.677 | 23.094 | −12.352 | 1.00 | 84.64 O |
| ATOM | 3885 | CB | ALA | B | 15 | −5.081 | 20.886 | −10.685 | 1.00 | 78.46 C |
| ATOM | 3886 | N | GLU | B | 16 | −2.058 | 21.563 | −12.006 | 1.00 | 75.12 N |
| ATOM | 3887 | CA | GLU | B | 16 | −1.350 | 21.807 | −13.256 | 1.00 | 79.80 C |
| ATOM | 3888 | C | GLU | B | 16 | −1.066 | 20.461 | −13.899 | 1.00 | 80.88 C |
| ATOM | 3889 | O | GLU | B | 16 | −0.388 | 19.618 | −13.301 | 1.00 | 78.09 O |
| ATOM | 3890 | CB | GLU | B | 16 | −0.052 | 22.583 | −13.022 | 1.00 | 84.93 C |
| ATOM | 3891 | CG | GLU | B | 16 | −0.264 | 24.039 | −12.633 | 1.00 | 96.16 C |
| ATOM | 3892 | CD | GLU | B | 16 | 0.984 | 24.675 | −12.049 | 1.00 | 107.57 C |
| ATOM | 3893 | OE1 | GLU | B | 16 | 1.663 | 24.015 | −11.233 | 1.00 | 111.40 O |
| ATOM | 3894 | OE2 | GLU | B | 16 | 1.288 | 25.833 | −12.407 | 1.00 | 112.60 O |
| ATOM | 3895 | N | ASN | B | 17 | −1.593 | 20.256 | −15.104 | 1.00 | 84.09 N |
| ATOM | 3896 | CA | ASN | B | 17 | −1.473 | 18.964 | −15.765 | 1.00 | 86.84 C |
| ATOM | 3897 | C | ASN | B | 17 | −0.006 | 18.581 | −15.907 | 1.00 | 84.45 C |
| ATOM | 3898 | O | ASN | B | 17 | 0.796 | 19.344 | −16.455 | 1.00 | 89.09 O |
| ATOM | 3899 | CB | ASN | B | 17 | −2.160 | 19.006 | −17.130 | 1.00 | 96.72 C |
| ATOM | 3900 | CG | ASN | B | 17 | −3.645 | 19.287 | −17.021 | 1.00 | 103.00 C |
| ATOM | 3901 | OD1 | ASN | B | 17 | −4.423 | 18.414 | −16.642 | 1.00 | 106.15 O |
| ATOM | 3902 | ND2 | ASN | B | 17 | −4.047 | 20.510 | −17.352 | 1.00 | 104.39 N |
| ATOM | 3903 | N | GLY | B | 18 | 0.348 | 17.407 | −15.386 | 1.00 | 77.96 N |
| ATOM | 3904 | CA | GLY | B | 18 | 1.700 | 16.901 | −15.434 | 1.00 | 77.76 C |
| ATOM | 3905 | C | GLY | B | 18 | 2.513 | 17.128 | −14.174 | 1.00 | 85.08 C |
| ATOM | 3906 | O | GLY | B | 18 | 3.529 | 16.448 | −13.985 | 1.00 | 88.06 O |
| ATOM | 3907 | N | LYS | B | 19 | 2.096 | 18.051 | −13.307 | 1.00 | 84.66 N |
| ATOM | 3908 | CA | LYS | B | 19 | 2.846 | 18.400 | −12.105 | 1.00 | 82.17 C |
| ATOM | 3909 | C | LYS | B | 19 | 2.269 | 17.668 | −10.898 | 1.00 | 80.21 C |
| ATOM | 3910 | O | LYS | B | 19 | 1.055 | 17.704 | −10.663 | 1.00 | 75.51 O |
| ATOM | 3911 | CB | LYS | B | 19 | 2.825 | 19.912 | −11.864 | 1.00 | 80.21 C |
| ATOM | 3912 | CG | LYS | B | 19 | 3.201 | 20.746 | −13.083 | 1.00 | 80.74 C |
| ATOM | 3913 | CD | LYS | B | 19 | 4.589 | 20.396 | −13.597 | 1.00 | 80.60 C |
| ATOM | 3914 | CE | LYS | B | 19 | 4.899 | 21.125 | −14.900 | 1.00 | 85.16 C |
| ATOM | 3915 | NZ | LYS | B | 19 | 4.840 | 22.607 | −14.753 | 1.00 | 87.08 N |
| ATOM | 3916 | N | SER | B | 20 | 3.143 | 17.016 | −10.133 | 1.00 | 81.42 N |
| ATOM | 3917 | CA | SER | B | 20 | 2.699 | 16.217 | −8.999 | 1.00 | 78.34 C |
| ATOM | 3918 | C | SER | B | 20 | 1.993 | 17.089 | −7.966 | 1.00 | 73.62 C |
| ATOM | 3919 | O | SER | B | 20 | 2.319 | 18.265 | −7.777 | 1.00 | 70.44 O |
| ATOM | 3920 | CB | SER | B | 20 | 3.883 | 15.493 | −8.360 | 1.00 | 75.59 C |
| ATOM | 3921 | OG | SER | B | 20 | 3.439 | 14.415 | −7.556 | 1.00 | 76.15 O |
| ATOM | 3922 | N | ASN | B | 21 | 1.016 | 16.494 | −7.292 | 1.00 | 69.33 N |
| ATOM | 3923 | CA | ASN | B | 21 | 0.127 | 17.224 | −6.401 | 1.00 | 64.17 C |
| ATOM | 3924 | C | ASN | B | 21 | −0.484 | 16.221 | −5.429 | 1.00 | 62.49 C |
| ATOM | 3925 | O | ASN | B | 21 | −0.110 | 15.043 | −5.407 | 1.00 | 62.42 O |
| ATOM | 3926 | CB | ASN | B | 21 | −0.929 | 17.984 | −7.214 | 1.00 | 62.51 C |
| ATOM | 3927 | CG | ASN | B | 21 | −1.538 | 19.141 | −6.449 | 1.00 | 67.34 C |
| ATOM | 3928 | OD1 | ASN | B | 21 | −1.545 | 19.150 | −5.220 | 1.00 | 66.57 O |
| ATOM | 3929 | ND2 | ASN | B | 21 | −2.059 | 20.124 | −7.175 | 1.00 | 70.51 N |
| ATOM | 3930 | N | PHE | B | 22 | −1.426 | 16.688 | −4.616 | 1.00 | 59.74 N |
| ATOM | 3931 | CA | PHE | B | 22 | −2.152 | 15.836 | −3.685 | 1.00 | 57.53 C |
| ATOM | 3932 | C | PHE | B | 22 | −3.646 | 16.025 | −3.897 | 1.00 | 54.98 C |
| ATOM | 3933 | O | PHE | B | 22 | −4.119 | 17.156 | −4.036 | 1.00 | 55.84 O |
| ATOM | 3934 | CB | PHE | B | 22 | −1.789 | 16.155 | −2.228 | 1.00 | 57.84 C |
| ATOM | 3935 | CG | PHE | B | 22 | −0.468 | 15.590 | −1.792 | 1.00 | 57.97 C |
| ATOM | 3936 | CD1 | PHE | B | 22 | 0.699 | 16.318 | −1.955 | 1.00 | 61.56 C |
| ATOM | 3937 | CD2 | PHE | B | 22 | −0.395 | 14.331 | −1.214 | 1.00 | 59.01 C |
| ATOM | 3938 | CE1 | PHE | B | 22 | 1.916 | 15.802 | −1.551 | 1.00 | 62.14 C |
| ATOM | 3939 | CE2 | PHE | B | 22 | 0.821 | 13.808 | −0.807 | 1.00 | 62.84 C |
| ATOM | 3940 | CZ | PHE | B | 22 | 1.978 | 14.547 | −0.976 | 1.00 | 62.40 C |
| ATOM | 3941 | N | LEU | B | 23 | −4.382 | 14.918 | −3.935 | 1.00 | 52.89 N |
| ATOM | 3942 | CA | LEU | B | 23 | −5.835 | 14.945 | −4.049 | 1.00 | 55.49 C |
| ATOM | 3943 | C | LEU | B | 23 | −6.433 | 14.744 | −2.662 | 1.00 | 52.80 C |
| ATOM | 3944 | O | LEU | B | 23 | −6.114 | 13.758 | −1.985 | 1.00 | 49.56 O |
| ATOM | 3945 | CB | LEU | B | 23 | −6.337 | 13.868 | −5.006 | 1.00 | 55.40 C |
| ATOM | 3946 | CG | LEU | B | 23 | −7.855 | 13.799 | −5.189 | 1.00 | 56.63 C |
| ATOM | 3947 | CD1 | LEU | B | 23 | −8.378 | 15.033 | −5.915 | 1.00 | 58.73 C |
| ATOM | 3948 | CD2 | LEU | B | 23 | −8.250 | 12.528 | −5.924 | 1.00 | 60.13 C |
| ATOM | 3949 | N | ASN | B | 24 | −7.293 | 15.671 | −2.245 | 1.00 | 52.13 N |
| ATOM | 3950 | CA | ASN | B | 24 | −7.864 | 15.670 | −0.904 | 1.00 | 51.80 C |
| ATOM | 3951 | C | ASN | B | 24 | −9.357 | 15.377 | −0.939 | 1.00 | 52.31 C |
| ATOM | 3952 | O | ASN | B | 24 | −10.070 | 15.842 | −1.834 | 1.00 | 50.83 O |

TABLE 17-continued

| | | | | | | | | | | |
|---|---|---|---|---|---|---|---|---|---|---|
| ATOM | 3953 | CB | ASN | B | 24 | −7.654 | 17.020 | −0.213 | 1.00 | 50.65 C |
| ATOM | 3954 | CG | ASN | B | 24 | −6.208 | 17.307 | 0.072 | 1.00 | 54.08 C |
| ATOM | 3955 | OD1 | ASN | B | 24 | −5.410 | 16.393 | 0.288 | 1.00 | 57.87 O |
| ATOM | 3956 | ND2 | ASN | B | 24 | −5.852 | 18.583 | 0.072 | 1.00 | 54.44 N |
| ATOM | 3957 | N | CYS | B | 25 | −9.830 | 14.630 | 0.060 | 1.00 | 50.32 N |
| ATOM | 3958 | CA | CYS | B | 25 | −11.248 | 14.577 | 0.394 | 1.00 | 49.36 C |
| ATOM | 3959 | C | CYS | B | 25 | −11.397 | 14.944 | 1.860 | 1.00 | 46.24 C |
| ATOM | 3960 | O | CYS | B | 25 | −10.924 | 14.214 | 2.739 | 1.00 | 42.87 O |
| ATOM | 3961 | CB | CYS | B | 25 | −11.858 | 13.207 | 0.128 | 1.00 | 52.23 C |
| ATOM | 3962 | SG | CYS | B | 25 | −13.623 | 13.190 | 0.520 | 1.00 | 52.90 S |
| ATOM | 3963 | N | TYR | B | 26 | −12.060 | 16.062 | 2.126 | 1.00 | 40.10 N |
| ATOM | 3964 | CA | TYR | B | 26 | −12.274 | 16.533 | 3.487 | 1.00 | 39.71 C |
| ATOM | 3965 | C | TYR | B | 26 | −13.724 | 16.266 | 3.867 | 1.00 | 44.46 C |
| ATOM | 3966 | O | TYR | B | 26 | −14.644 | 16.765 | 3.208 | 1.00 | 43.95 O |
| ATOM | 3967 | CB | TYR | B | 26 | −11.937 | 18.018 | 3.597 | 1.00 | 40.08 C |
| ATOM | 3968 | CG | TYR | B | 26 | −12.101 | 18.604 | 4.982 | 1.00 | 40.65 C |
| ATOM | 3969 | CD1 | TYR | B | 26 | −11.341 | 18.139 | 6.045 | 1.00 | 44.26 C |
| ATOM | 3970 | CD2 | TYR | B | 26 | −12.995 | 19.649 | 5.218 | 1.00 | 44.11 C |
| ATOM | 3971 | CE1 | TYR | B | 26 | −11.476 | 18.687 | 7.310 | 1.00 | 46.12 C |
| ATOM | 3972 | CE2 | TYR | B | 26 | −13.136 | 20.202 | 6.483 | 1.00 | 41.62 C |
| ATOM | 3973 | CZ | TYR | B | 26 | −12.375 | 19.713 | 7.523 | 1.00 | 46.18 C |
| ATOM | 3974 | OH | TYR | B | 26 | −12.494 | 20.254 | 8.785 | 1.00 | 44.36 O |
| ATOM | 3975 | N | VAL | B | 27 | −13.925 | 15.446 | 4.895 | 1.00 | 40.07 N |
| ATOM | 3976 | CA | VAL | B | 27 | −15.252 | 15.119 | 5.405 | 1.00 | 40.92 C |
| ATOM | 3977 | C | VAL | B | 27 | −15.390 | 15.745 | 6.782 | 1.00 | 38.54 C |
| ATOM | 3978 | O | VAL | B | 27 | −14.513 | 15.580 | 7.636 | 1.00 | 34.70 O |
| ATOM | 3979 | CB | VAL | B | 27 | −15.485 | 13.598 | 5.462 | 1.00 | 40.05 C |
| ATOM | 3980 | CG1 | VAL | B | 27 | −15.756 | 13.057 | 4.078 | 1.00 | 43.52 C |
| ATOM | 3981 | CG2 | VAL | B | 27 | −14.276 | 12.892 | 6.075 | 1.00 | 44.24 C |
| ATOM | 3982 | N | SER | B | 28 | −16.485 | 16.461 | 7.007 | 1.00 | 36.87 N |
| ATOM | 3983 | CA | SER | B | 28 | −16.618 | 17.173 | 8.270 | 1.00 | 39.12 C |
| ATOM | 3984 | C | SER | B | 28 | −18.080 | 17.196 | 8.694 | 1.00 | 37.79 C |
| ATOM | 3985 | O | SER | B | 28 | −18.980 | 16.843 | 7.929 | 1.00 | 37.97 O |
| ATOM | 3986 | CB | SER | B | 28 | −16.053 | 18.593 | 8.169 | 1.00 | 35.94 C |
| ATOM | 3987 | OG | SER | B | 28 | −16.712 | 19.311 | 7.144 | 1.00 | 37.40 O |
| ATOM | 3988 | N | GLY | B | 29 | −18.295 | 17.605 | 9.943 | 1.00 | 38.77 N |
| ATOM | 3989 | CA | GLY | B | 29 | −19.629 | 17.780 | 10.481 | 1.00 | 40.42 C |
| ATOM | 3990 | C | GLY | B | 29 | −20.434 | 16.520 | 10.728 | 1.00 | 42.45 C |
| ATOM | 3991 | O | GLY | B | 29 | −21.655 | 16.611 | 10.871 | 1.00 | 37.83 O |
| ATOM | 3992 | N | PHE | B | 30 | −19.805 | 15.349 | 10.809 | 1.00 | 35.15 N |
| ATOM | 3993 | CA | PHE | B | 30 | −20.561 | 14.106 | 10.875 | 1.00 | 38.69 C |
| ATOM | 3994 | C | PHE | B | 30 | −20.488 | 13.496 | 12.269 | 1.00 | 33.54 C |
| ATOM | 3995 | O | PHE | B | 30 | −19.589 | 13.792 | 13.058 | 1.00 | 34.10 O |
| ATOM | 3996 | CB | PHE | B | 30 | −20.081 | 13.091 | 9.820 | 1.00 | 40.10 C |
| ATOM | 3997 | CG | PHE | B | 30 | −18.614 | 12.725 | 9.918 | 1.00 | 38.82 C |
| ATOM | 3998 | CD1 | PHE | B | 30 | −17.639 | 13.512 | 9.309 | 1.00 | 33.93 C |
| ATOM | 3999 | CD2 | PHE | B | 30 | −18.215 | 11.567 | 10.565 | 1.00 | 33.17 C |
| ATOM | 4000 | CE1 | PHE | B | 30 | −16.297 | 13.173 | 9.381 | 1.00 | 35.27 C |
| ATOM | 4001 | CE2 | PHE | B | 30 | −16.869 | 11.219 | 10.642 | 1.00 | 35.19 C |
| ATOM | 4002 | CZ | PHE | B | 30 | −15.912 | 12.020 | 10.044 | 1.00 | 32.24 C |
| ATOM | 4003 | N | HIS | B | 31 | −21.471 | 12.636 | 12.568 | 1.00 | 33.28 N |
| ATOM | 4004 | CA | HIS | B | 31 | −21.538 | 11.859 | 13.807 | 1.00 | 32.88 C |
| ATOM | 4005 | C | HIS | B | 31 | −22.443 | 10.668 | 13.543 | 1.00 | 32.13 C |
| ATOM | 4006 | O | HIS | B | 31 | −23.509 | 10.851 | 12.947 | 1.00 | 37.02 O |
| ATOM | 4007 | CB | HIS | B | 31 | −22.079 | 12.689 | 14.982 | 1.00 | 32.52 C |
| ATOM | 4008 | CG | HIS | B | 31 | −21.467 | 12.344 | 16.307 | 1.00 | 39.20 C |
| ATOM | 4009 | ND1 | HIS | B | 31 | −21.820 | 11.216 | 17.013 | 1.00 | 43.13 N |
| ATOM | 4010 | CD2 | HIS | B | 31 | −20.552 | 12.995 | 17.069 | 1.00 | 42.54 C |
| ATOM | 4011 | CE1 | HIS | B | 31 | −21.134 | 11.170 | 18.141 | 1.00 | 39.57 C |
| ATOM | 4012 | NE2 | HIS | B | 31 | −20.358 | 12.238 | 18.201 | 1.00 | 43.04 N |
| ATOM | 4013 | N | PRO | B | 32 | −22.073 | 9.446 | 13.968 | 1.00 | 36.51 N |
| ATOM | 4014 | CA | PRO | B | 32 | −20.860 | 9.017 | 14.683 | 1.00 | 36.47 C |
| ATOM | 4015 | C | PRO | B | 32 | −19.604 | 9.034 | 13.809 | 1.00 | 35.13 C |
| ATOM | 4016 | O | PRO | B | 32 | −19.698 | 9.366 | 12.636 | 1.00 | 36.77 O |
| ATOM | 4017 | CB | PRO | B | 32 | −21.198 | 7.579 | 15.105 | 1.00 | 34.46 C |
| ATOM | 4018 | CG | PRO | B | 32 | −22.108 | 7.109 | 14.025 | 1.00 | 39.05 C |
| ATOM | 4019 | CD | PRO | B | 32 | −22.966 | 8.302 | 13.696 | 1.00 | 38.27 C |
| ATOM | 4020 | N | SER | B | 33 | −18.455 | 8.669 | 14.383 | 1.00 | 32.73 N |
| ATOM | 4021 | CA | SER | B | 33 | −17.167 | 8.856 | 13.721 | 1.00 | 36.68 C |
| ATOM | 4022 | C | SER | B | 33 | −16.840 | 7.779 | 12.688 | 1.00 | 38.07 C |
| ATOM | 4023 | O | SER | B | 33 | −15.930 | 7.981 | 11.878 | 1.00 | 35.62 O |
| ATOM | 4024 | CB | SER | B | 33 | −16.051 | 8.909 | 14.766 | 1.00 | 34.43 C |
| ATOM | 4025 | OG | SER | B | 33 | −15.992 | 7.686 | 15.473 | 1.00 | 37.30 O |
| ATOM | 4026 | N | ASP | B | 34 | −17.540 | 6.654 | 12.683 | 1.00 | 36.18 N |
| ATOM | 4027 | CA | ASP | B | 34 | −17.257 | 5.627 | 11.683 | 1.00 | 44.27 C |
| ATOM | 4028 | C | ASP | B | 34 | −17.676 | 6.110 | 10.295 | 1.00 | 41.96 C |
| ATOM | 4029 | O | ASP | B | 34 | −18.806 | 6.568 | 10.092 | 1.00 | 39.50 O |
| ATOM | 4030 | CB | ASP | B | 34 | −17.968 | 4.318 | 12.033 | 1.00 | 53.45 C |
| ATOM | 4031 | CG | ASP | B | 34 | −17.426 | 3.674 | 13.305 | 1.00 | 63.59 C |
| ATOM | 4032 | OD1 | ASP | B | 34 | −16.217 | 3.823 | 13.597 | 1.00 | 67.11 O |

TABLE 17-continued

| ATOM | 4033 | OD2 | ASP | B | 34 | −18.216 | 3.021 | 14.019 | 1.00 | 69.11 | O |
| --- | --- | --- | --- | --- | --- | --- | --- | --- | --- | --- | --- |
| ATOM | 4034 | N | ILE | B | 35 | −16.758 | 6.010 | 9.334 | 1.00 | 39.51 | N |
| ATOM | 4035 | CA | ILE | B | 35 | −16.987 | 6.556 | 8.003 | 1.00 | 40.49 | C |
| ATOM | 4036 | C | ILE | B | 35 | −16.046 | 5.855 | 7.038 | 1.00 | 44.28 | C |
| ATOM | 4037 | O | ILE | B | 35 | −14.934 | 5.462 | 7.406 | 1.00 | 44.36 | O |
| ATOM | 4038 | CB | ILE | B | 35 | −16.789 | 8.094 | 8.002 | 1.00 | 38.43 | C |
| ATOM | 4039 | CG1 | ILE | B | 35 | −17.334 | 8.710 | 6.716 | 1.00 | 37.24 | C |
| ATOM | 4040 | CG2 | ILE | B | 35 | −15.319 | 8.455 | 8.225 | 1.00 | 38.30 | C |
| ATOM | 4041 | CD1 | ILE | B | 35 | −17.441 | 10.230 | 6.773 | 1.00 | 38.70 | C |
| ATOM | 4042 | N | GLU | B | 36 | −16.503 | 5.687 | 5.801 | 1.00 | 47.89 | N |
| ATOM | 4043 | CA | GLU | B | 36 | −15.735 | 5.036 | 4.749 | 1.00 | 54.25 | C |
| ATOM | 4044 | C | GLU | B | 36 | −15.527 | 6.040 | 3.625 | 1.00 | 48.90 | C |
| ATOM | 4045 | O | GLU | B | 36 | −16.497 | 6.529 | 3.036 | 1.00 | 49.73 | O |
| ATOM | 4046 | CB | GLU | B | 36 | −16.453 | 3.782 | 4.242 | 1.00 | 61.47 | C |
| ATOM | 4047 | CG | GLU | B | 36 | −15.800 | 3.136 | 3.028 | 1.00 | 72.90 | C |
| ATOM | 4048 | CD | GLU | B | 36 | −14.773 | 2.079 | 3.395 | 0.00 | 81.50 | C |
| ATOM | 4049 | OE1 | GLU | B | 36 | −15.059 | 1.256 | 4.293 | 1.00 | 85.94 | O |
| ATOM | 4050 | OE2 | GLU | B | 36 | −13.681 | 2.072 | 2.783 | 1.00 | 87.01 | O |
| ATOM | 4051 | N | VAL | B | 37 | −14.268 | 6.354 | 3.334 | 1.00 | 47.38 | N |
| ATOM | 4052 | CA | VAL | B | 37 | −13.925 | 7.354 | 2.330 | 1.00 | 45.71 | C |
| ATOM | 4053 | C | VAL | B | 37 | −12.908 | 6.745 | 1.380 | 1.00 | 49.32 | C |
| ATOM | 4054 | O | VAI | B | 37 | −11.865 | 6.246 | 1.816 | 1.00 | 51.96 | O |
| ATOM | 4055 | CB | VAL | B | 37 | −13.365 | 8.644 | 2.971 | 1.00 | 43.41 | C |
| ATOM | 4056 | CG1 | VAL | B | 37 | −13.111 | 9.699 | 1.908 | 1.00 | 46.37 | C |
| ATOM | 4057 | CG2 | VAL | B | 37 | −14.319 | 9.168 | 4.030 | 1.00 | 45.45 | C |
| ATOM | 4058 | N | ASP | B | 38 | −13.211 | 6.787 | 0.086 | 1.00 | 51.22 | N |
| ATOM | 4059 | CA | ASP | B | 38 | −12.320 | 6.293 | −0.947 | 1.00 | 52.75 | C |
| ATOM | 4060 | C | ASP | B | 38 | −12.042 | 7.397 | −1.953 | 1.00 | 56.26 | C |
| ATOM | 4061 | O | ASP | B | 38 | −12.905 | 8.231 | −2.240 | 1.00 | 60.80 | O |
| ATOM | 4062 | CB | ASP | B | 38 | −12.918 | 5.077 | −1.663 | 1.00 | 55.02 | C |
| ATOM | 4063 | CG | ASP | B | 38 | −13.010 | 3.865 | −0.762 | 1.00 | 64.86 | C |
| ATOM | 4064 | OD1 | ASP | B | 38 | −12.064 | 3.645 | 0.021 | 1.00 | 71.49 | O |
| ATOM | 4065 | OD2 | ASP | B | 38 | −14.024 | 3.140 | −0.824 | 1.00 | 72.59 | O |
| ATOM | 4066 | N | LEU | B | 39 | −10.824 | 7.404 | −2.477 | 1.00 | 56.50 | N |
| ATOM | 4067 | CA | LEU | B | 39 | −10.459 | 8.279 | −3.581 | 1.00 | 58.09 | C |
| ATOM | 4068 | C | LEU | B | 39 | −10.452 | 7.461 | −4.866 | 1.00 | 58.41 | C |
| ATOM | 4069 | O | LEU | B | 39 | −9.809 | 6.408 | −4.929 | 1.00 | 59.56 | O |
| ATOM | 4070 | CB | LEU | B | 39 | −9.099 | 8.929 | −3.330 | 1.00 | 60.71 | C |
| ATOM | 4071 | CG | LEU | B | 39 | −9.098 | 9.890 | −2.138 | 1.00 | 64.42 | C |
| ATOM | 4072 | CD1 | LEU | B | 39 | −7.725 | 10.495 | −1.919 | 1.00 | 62.73 | C |
| ATOM | 4073 | CD2 | LEU | B | 39 | −10.138 | 10.985 | −2.349 | 1.00 | 67.26 | C |
| ATOM | 4074 | N | LEU | B | 40 | −11.179 | 7.936 | −5.877 | 1.00 | 58.85 | N |
| ATOM | 4075 | CA | LEU | B | 40 | −11.400 | 7.194 | −7.112 | 1.00 | 59.24 | C |
| ATOM | 4076 | C | LEU | B | 40 | −10.670 | 7.837 | −8.286 | 1.00 | 62.23 | C |
| ATOM | 4077 | O | LEU | B | 40 | −10.696 | 9.062 | −8.458 | 1.00 | 61.32 | O |
| ATOM | 4078 | CB | LEU | B | 40 | −12.895 | 7.100 | −7.442 | 1.00 | 58.25 | C |
| ATOM | 4079 | CG | LEU | B | 40 | −13.839 | 6.526 | −6.381 | 1.00 | 57.42 | C |
| ATOM | 4080 | CD1 | LEU | B | 40 | −15.247 | 6.381 | −6.948 | 1.00 | 61.19 | C |
| ATOM | 4081 | CD2 | LEU | B | 40 | −13.330 | 5.199 | −5.840 | 1.00 | 55.58 | C |
| ATOM | 4082 | N | LYS | B | 41 | −10.046 | 6.996 | −9.108 | 1.00 | 65.00 | N |
| ATOM | 4083 | CA | LYS | B | 41 | −9.428 | 7.410 | −10.363 | 1.00 | 66.37 | C |
| ATOM | 4084 | C | LYS | B | 41 | −10.147 | 6.677 | −11.488 | 1.00 | 68.90 | C |
| ATOM | 4085 | O | LYS | B | 41 | −10.036 | 5.451 | −11.603 | 1.00 | 65.62 | O |
| ATOM | 4086 | CB | LYS | B | 41 | −7.931 | 7.105 | −10.364 | 1.00 | 68.03 | C |
| ATOM | 4087 | CG | LYS | B | 41 | −7.240 | 7.313 | −11.700 | 1.00 | 69.73 | C |
| ATOM | 4088 | CD | LYS | B | 41 | −5.735 | 7.126 | −11.560 | 1.00 | 72.16 | C |
| ATOM | 4089 | CE | LYS | B | 41 | −5.077 | 6.817 | −12.897 | 1.00 | 75.88 | C |
| ATOM | 4090 | NZ | LYS | B | 41 | −4.087 | 7.860 | −13.282 | 1.00 | 77.41 | N |
| ATOM | 4091 | N | ASN | B | 42 | −10.895 | 7.426 | −12.300 | 1.00 | 64.77 | N |
| ATOM | 4092 | CA | ASN | B | 42 | −11.713 | 6.849 | −13.367 | 1.00 | 73.17 | C |
| ATOM | 4093 | C | ASN | B | 42 | −12.648 | 5.777 | −12.816 | 1.00 | 77.52 | C |
| ATOM | 4094 | O | ASN | B | 42 | −12.840 | 4.718 | −13.417 | 1.00 | 81.41 | O |
| ATOM | 4095 | CB | ASN | B | 42 | −10.840 | 6.284 | −14.484 | 1.00 | 74.27 | C |
| ATOM | 4096 | CG | ASN | B | 42 | −9.838 | 7.286 | −14.991 | 1.00 | 72.57 | C |
| ATOM | 4097 | OD1 | ASN | B | 42 | −10.176 | 8.441 | −15.252 | 1.00 | 71.38 | O |
| ATOM | 4098 | ND2 | ASN | B | 42 | −8.588 | 6.858 | −15.117 | 1.00 | 72.23 | N |
| ATOM | 4099 | N | GLY | B | 43 | −13.222 | 6.051 | −11.646 | 1.00 | 67.53 | N |
| ATOM | 4100 | CA | GLY | B | 43 | −14.146 | 5.134 | −11.018 | 1.00 | 68.22 | C |
| ATOM | 4101 | C | GLY | B | 43 | −13.510 | 3.985 | −10.271 | 1.00 | 69.64 | C |
| ATOM | 4102 | O | GLY | B | 43 | −14.238 | 3.191 | −9.662 | 1.00 | 77.31 | O |
| ATOM | 4103 | N | GLU | B | 44 | −12.186 | 3.865 | −10.290 | 1.00 | 68.78 | N |
| ATOM | 4104 | CA | GLU | B | 44 | −11.481 | 2.808 | −9.581 | 1.00 | 70.45 | C |
| ATOM | 4105 | C | GLU | B | 44 | −10.803 | 3.374 | −8.338 | 1.00 | 68.72 | C |
| ATOM | 4106 | O | GLU | B | 44 | −10.348 | 4.521 | −8.327 | 1.00 | 67.27 | O |
| ATOM | 4107 | CB | GLU | B | 44 | −10.445 | 2.132 | −10.486 | 1.00 | 71.16 | C |
| ATOM | 4108 | CG | GLU | B | 44 | −11.051 | 1.351 | −11.659 | 1.00 | 81.17 | C |
| ATOM | 4109 | CD | GLU | B | 44 | −11.351 | −0.105 | −11.314 | 1.00 | 87.20 | C |
| ATOM | 4110 | OE1 | GLU | B | 44 | −10.512 | −0.746 | −10.642 | 1.00 | 87.03 | O |
| ATOM | 4111 | OE2 | GLU | B | 44 | −12.424 | −0.606 | −11.718 | 1.00 | 89.22 | O |
| ATOM | 4112 | N | ARG | B | 45 | −10.728 | 2.547 | −7.295 | 1.00 | 67.60 | N |

TABLE 17-continued

| | | | | | | | | | | |
|---|---|---|---|---|---|---|---|---|---|---|
| ATOM | 4113 | CA | ARG | B | 45 | −10.248 | 2.986 | −5.990 | 1.00 | 73.77 C |
| ATOM | 4114 | C | ARG | B | 45 | −8.725 | 3.060 | −5.971 | 1.00 | 76.65 C |
| ATOM | 4115 | O | ARG | B | 45 | −8.044 | 2.110 | −6.374 | 1.00 | 82.38 O |
| ATOM | 4116 | CB | ARG | B | 45 | −10.748 | 2.033 | −4.900 | 1.00 | 78.00 C |
| ATOM | 4117 | CG | ARG | B | 45 | −10.492 | 2.505 | −3.475 | 1.00 | 82.16 C |
| ATOM | 4118 | CD | ARG | B | 45 | −10.548 | 1.347 | −2.477 | 1.00 | 87.42 C |
| ATOM | 4119 | NE | ARG | B | 45 | −9.629 | 1.554 | −1.355 | 1.00 | 90.81 N |
| ATOM | 4120 | CZ | ARG | B | 45 | −9.992 | 1.643 | −0.077 | 1.00 | 92.99 C |
| ATOM | 4121 | NH1 | ARG | B | 45 | −11.268 | 1.530 | 0.270 | 1.00 | 96.15 N |
| ATOM | 4122 | NH2 | ARG | B | 45 | −9.076 | 1.837 | 0.862 | 1.00 | 90.99 N |
| ATOM | 4123 | N | ILE | B | 46 | −8.190 | 4.189 | −5.494 | 1.00 | 67.23 N |
| ATOM | 4124 | CA | ILE | B | 46 | −6.747 | 4.345 | −5.337 | 1.00 | 65.74 C |
| ATOM | 4125 | C | ILE | B | 46 | −6.299 | 3.588 | −4.093 | 1.00 | 71.95 C |
| ATOM | 4126 | O | ILE | B | 46 | −6.991 | 3.585 | −3.069 | 1.00 | 72.40 O |
| ATOM | 4127 | CB | ILE | B | 46 | −6.376 | 5.837 | −5.262 | 1.00 | 62.09 C |
| ATOM | 4128 | CG1 | ILE | B | 46 | −6.892 | 6.581 | −6.496 | 1.00 | 61.14 C |
| ATOM | 4129 | CG2 | ILE | B | 46 | −4.866 | 6.015 | −5.119 | 1.00 | 60.35 C |
| ATOM | 4130 | CD1 | ILE | B | 46 | −6.589 | 8.073 | −6.480 | 1.00 | 61.00 C |
| ATOM | 4131 | N | GLU | B | 47 | −5.138 | 2.937 | −4.176 | 1.00 | 77.67 N |
| ATOM | 4132 | CA | GLU | B | 47 | −4.689 | 2.054 | −3.097 | 1.00 | 83.59 C |
| ATOM | 4133 | C | GLU | B | 47 | −4.094 | 2.841 | −1.931 | 1.00 | 88.14 C |
| ATOM | 4134 | O | GLU | B | 47 | −4.686 | 2.913 | −0.849 | 1.00 | 92.71 O |
| ATOM | 4135 | CB | GLU | B | 47 | −3.682 | 1.036 | −3.643 | 1.00 | 85.10 C |
| ATOM | 4136 | CG | GLU | B | 47 | −4.241 | 0.150 | −4.752 | 1.00 | 91.24 C |
| ATOM | 4137 | CD | GLU | B | 47 | −4.740 | −1.192 | −4.247 | 0.00 | 93.51 C |
| ATOM | 4138 | OE1 | GLU | B | 47 | −3.903 | −2.029 | −3.845 | 1.00 | 94.34 O |
| ATOM | 4139 | OE2 | GLU | B | 47 | −5.969 | −1.412 | −4.252 | 1.00 | 95.17 O |
| ATOM | 4140 | N | LYS | B | 48 | −2.913 | 3.426 | −2.129 | 1.00 | 90.47 N |
| ATOM | 4141 | CA | LYS | B | 48 | −2.234 | 4.153 | −1.055 | 1.00 | 92.41 C |
| ATOM | 4142 | C | LYS | B | 48 | −2.949 | 5.474 | −0.775 | 1.00 | 87.09 C |
| ATOM | 4143 | O | LYS | B | 48 | −2.651 | 6.505 | −1.389 | 1.00 | 95.26 O |
| ATOM | 4144 | CB | LYS | B | 48 | −0.761 | 4.384 | −1.419 | 1.00 | 99.70 C |
| ATOM | 4145 | CG | LYS | B | 48 | 0.014 | 5.336 | −0.498 | 1.00 | 103.53 C |
| ATOM | 4146 | CD | LYS | B | 48 | −0.018 | 4.919 | 0.973 | 1.00 | 101.58 C |
| ATOM | 4147 | CE | LYS | B | 48 | 0.662 | 3.576 | 1.200 | 1.00 | 98.92 C |
| ATOM | 4148 | NZ | LYS | B | 48 | 2.020 | 3.526 | 0.589 | 1.00 | 97.91 N |
| ATOM | 4149 | N | VAL | B | 49 | −3.922 | 5.446 | 0.130 | 1.00 | 69.15 N |
| ATOM | 4150 | CA | VAL | B | 49 | −4.640 | 6.639 | 0.567 | 1.00 | 57.70 C |
| ATOM | 4151 | C | VAL | B | 49 | −4.462 | 6.765 | 2.075 | 1.00 | 56.90 C |
| ATOM | 4152 | O | VAL | B | 49 | −4.747 | 5.821 | 2.822 | 1.00 | 54.80 O |
| ATOM | 4153 | CB | VAL | B | 49 | −6.137 | 6.599 | 0.197 | 1.00 | 50.43 C |
| ATOM | 4154 | CG1 | VAL | B | 49 | −6.881 | 7.796 | 0.802 | 1.00 | 45.66 C |
| ATOM | 4155 | CG2 | VAL | B | 49 | −6.313 | 6.576 | −1.325 | 1.00 | 54.39 C |
| ATOM | 4156 | N | GLU | B | 50 | −3.992 | 7.925 | 2.518 | 1.00 | 58.47 N |
| ATOM | 4157 | CA | GLU | B | 50 | −3.775 | 8.179 | 3.933 | 1.00 | 60.75 C |
| ATOM | 4158 | C | GLU | B | 50 | −4.827 | 9.151 | 4.457 | 1.00 | 55.06 C |
| ATOM | 4159 | O | GLU | B | 50 | −5.523 | 9.823 | 3.689 | 1.00 | 46.28 O |
| ATOM | 4160 | CB | GLU | B | 50 | −2.362 | 8.723 | 4.170 | 1.00 | 66.21 C |
| ATOM | 4161 | CG | GLU | B | 50 | −1.266 | 7.734 | 3.786 | 1.00 | 67.14 C |
| ATOM | 4162 | CD | GLU | B | 50 | 0.127 | 8.270 | 4.037 | 0.23 | 70.37 C |
| ATOM | 4163 | OE1 | GLU | B | 50 | 0.476 | 9.323 | 3.461 | 1.00 | 74.27 O |
| ATOM | 4164 | OE2 | GLU | B | 50 | 0.869 | 7.637 | 4.817 | 1.00 | 71.51 O |
| ATOM | 4165 | N | HIS | B | 51 | −4.951 | 9.207 | 5.782 | 1.00 | 53.37 N |
| ATOM | 4166 | CA | HIS | B | 51 | −5.937 | 10.079 | 6.399 | 1.00 | 48.47 C |
| ATOM | 4167 | C | HIS | B | 51 | −5.412 | 10.624 | 7.720 | 1.00 | 46.73 C |
| ATOM | 4168 | O | HIS | B | 51 | −4.559 | 10.024 | 8.383 | 1.00 | 45.06 O |
| ATOM | 4169 | CB | HIS | B | 51 | −7.281 | 9.367 | 6.607 | 1.00 | 45.12 C |
| ATOM | 4170 | CG | HIS | B | 51 | −7.219 | 8.203 | 7.545 | 1.00 | 50.59 C |
| ATOM | 4171 | ND1 | HIS | B | 51 | −7.181 | 8.351 | 8.914 | 1.00 | 51.97 N |
| ATOM | 4172 | CD2 | HIS | B | 51 | −7.199 | 6.870 | 7.308 | 1.00 | 50.86 C |
| ATOM | 4173 | CE1 | HIS | B | 51 | −7.140 | 7.157 | 9.481 | 1.00 | 53.83 C |
| ATOM | 4174 | NE2 | HIS | B | 51 | −7.148 | 6.242 | 8.528 | 1.00 | 52.23 N |
| ATOM | 4175 | N | SER | B | 52 | −5.941 | 11.787 | 8.088 | 1.00 | 45.71 N |
| ATOM | 4176 | CA | SER | B | 52 | −5.540 | 12.477 | 9.300 | 1.00 | 37.71 C |
| ATOM | 4177 | C | SER | B | 52 | −6.090 | 11.762 | 10.533 | 1.00 | 35.79 C |
| ATOM | 4178 | O | SER | B | 52 | −6.862 | 10.802 | 10.448 | 1.00 | 39.93 O |
| ATOM | 4179 | CB | SER | B | 52 | −6.041 | 13.918 | 9.269 | 1.00 | 36.25 C |
| ATOM | 4180 | OG | SER | B | 52 | −7.452 | 13.912 | 9.236 | 1.00 | 35.37 O |
| ATOM | 4181 | N | ASP | B | 53 | −5.688 | 12.250 | 11.700 | 1.00 | 30.97 N |
| ATOM | 4182 | CA | ASP | B | 53 | −6.147 | 11.682 | 12.959 | 1.00 | 33.43 C |
| ATOM | 4183 | C | ASP | B | 53 | −7.488 | 12.293 | 13.341 | 1.00 | 34.98 C |
| ATOM | 4184 | O | ASP | B | 53 | −7.659 | 13.514 | 13.295 | 1.00 | 35.16 O |
| ATOM | 4185 | CB | ASP | B | 53 | −5.121 | 11.930 | 14.067 | 1.00 | 33.91 C |
| ATOM | 4186 | CG | ASP | B | 53 | −3.784 | 11.260 | 13.793 | 1.00 | 42.82 C |
| ATOM | 4187 | OD1 | ASP | B | 53 | −3.771 | 10.029 | 13.558 | 1.00 | 44.00 O |
| ATOM | 4188 | OD2 | ASP | B | 53 | −2.750 | 11.968 | 13.798 | 1.00 | 44.57 O |
| ATOM | 4189 | N | LEU | B | 54 | −8.429 | 11.441 | 13.736 | 1.00 | 34.25 N |
| ATOM | 4190 | CA | LEU | B | 54 | −9.774 | 11.891 | 14.067 | 1.00 | 33.15 C |
| ATOM | 4191 | C | LEU | B | 54 | −9.751 | 13.018 | 15.092 | 1.00 | 29.59 C |
| ATOM | 4192 | O | LEU | B | 54 | −9.119 | 12.911 | 16.147 | 1.00 | 29.74 O |

TABLE 17-continued

| | | | | | | | | | | |
|---|---|---|---|---|---|---|---|---|---|---|
| ATOM | 4193 | CB | LEU | B | 54 | −10.585 | 10.713 | 14.602 | 1.00 | 35.78 C |
| ATOM | 4194 | CG | LEU | B | 54 | −12.070 | 10.962 | 14.867 | 1.00 | 33.95 C |
| ATOM | 4195 | CD1 | LEU | B | 54 | −12.838 | 11.153 | 13.547 | 1.00 | 26.94 C |
| ATOM | 4196 | CD2 | LEU | B | 54 | −12.650 | 9.804 | 15.684 | 1.00 | 35.19 C |
| ATOM | 4197 | N | SER | B | 55 | −10.428 | 14.115 | 14.761 | 1.00 | 31.73 N |
| ATOM | 4198 | CA | SER | B | 55 | −10.623 | 15.211 | 15.698 | 1.00 | 30.93 C |
| ATOM | 4199 | C | SER | B | 55 | −12.050 | 15.713 | 15.532 | 1.00 | 28.39 C |
| ATOM | 4200 | O | SER | B | 55 | −12.805 | 15.202 | 14.698 | 1.00 | 28.95 O |
| ATOM | 4201 | CB | SER | B | 55 | −9.593 | 16.327 | 15.480 | 1.00 | 33.02 C |
| ATOM | 4202 | OG | SER | B | 55 | −9.621 | 17.209 | 16.593 | 1.00 | 42.23 O |
| ATOM | 4203 | N | PHE | B | 56 | −12.433 | 16.719 | 16.321 | 1.00 | 30.00 N |
| ATOM | 4204 | CA | PHE | B | 56 | −13.806 | 17.205 | 16.253 | 1.00 | 27.56 C |
| ATOM | 4205 | C | PHE | B | 56 | −13.861 | 18.692 | 16.566 | 1.00 | 28.53 C |
| ATOM | 4206 | O | PHE | B | 56 | −12.947 | 19.262 | 17.176 | 1.00 | 28.71 O |
| ATOM | 4207 | CB | PHE | B | 56 | −14.742 | 16.428 | 17.197 | 1.00 | 27.59 C |
| ATOM | 4208 | CG | PHE | B | 56 | −14.212 | 16.269 | 18.599 | 1.00 | 27.73 C |
| ATOM | 4209 | CD1 | PHE | B | 56 | −14.460 | 17.236 | 19.565 | 1.00 | 29.17 C |
| ATOM | 4210 | CD2 | PHE | B | 56 | −13.484 | 15.136 | 18.962 | 1.00 | 29.18 C |
| ATOM | 4211 | CE1 | PHE | B | 56 | −13.986 | 17.082 | 20.865 | 1.00 | 29.02 C |
| ATOM | 4212 | CE2 | PHE | B | 56 | −13.008 | 14.977 | 20.260 | 1.00 | 27.63 C |
| ATOM | 4213 | CZ | PHE | B | 56 | −13.265 | 15.946 | 21.212 | 1.00 | 29.43 C |
| ATOM | 4214 | N | SER | B | 57 | −14.961 | 19.303 | 16.128 | 1.00 | 30.87 N |
| ATOM | 4215 | CA | SER | B | 57 | −15.203 | 20.734 | 16.228 | 1.00 | 33.43 C |
| ATOM | 4216 | C | SER | B | 57 | −15.885 | 21.084 | 17.549 | 1.00 | 37.84 C |
| ATOM | 4217 | O | SER | B | 57 | −16.221 | 20.223 | 18.363 | 1.00 | 34.75 O |
| ATOM | 4218 | CB | SER | B | 57 | −16.059 | 21.202 | 15.054 | 1.00 | 33.45 C |
| ATOM | 4219 | OG | SER | B | 57 | −15.507 | 20.781 | 13.821 | 1.00 | 41.84 O |
| ATOM | 4220 | N | LYS | B | 58 | −16.114 | 22.383 | 17.756 | 1.00 | 41.02 N |
| ATOM | 4221 | CA | LYS | B | 58 | −16.741 | 22.827 | 18.996 | 1.00 | 44.65 C |
| ATOM | 4222 | C | LYS | B | 58 | −18.112 | 22.192 | 19.209 | 1.00 | 38.42 C |
| ATOM | 4223 | O | LYS | B | 58 | −18.519 | 21.983 | 20.356 | 1.00 | 47.37 O |
| ATOM | 4224 | CB | LYS | B | 58 | −16.852 | 24.354 | 19.011 | 1.00 | 45.27 C |
| ATOM | 4225 | CG | LYS | B | 58 | −17.027 | 24.923 | 20.407 | 0.65 | 49.65 C |
| ATOM | 4226 | CD | LYS | B | 58 | −15.835 | 24.580 | 21.294 | 0.64 | 53.80 C |
| ATOM | 4227 | CE | LYS | B | 58 | −16.105 | 24.973 | 22.734 | 0.00 | 55.93 C |
| ATOM | 4228 | NZ | LYS | B | 58 | −14.855 | 25.133 | 23.522 | 1.00 | 58.92 N |
| ATOM | 4229 | N | ASP | B | 59 | −18.836 | 21.853 | 18.138 | 1.00 | 38.18 N |
| ATOM | 4230 | CA | ASP | B | 59 | −20.156 | 21.249 | 18.295 | 1.00 | 35.79 C |
| ATOM | 4231 | C | ASP | B | 59 | −20.102 | 19.727 | 18.436 | 1.00 | 32.24 C |
| ATOM | 4232 | O | ASP | B | 59 | −21.151 | 19.073 | 18.374 | 1.00 | 37.57 O |
| ATOM | 4233 | CB | ASP | B | 59 | −21.082 | 21.648 | 17.130 | 1.00 | 35.69 C |
| ATOM | 4234 | CG | ASP | B | 59 | −20.629 | 21.102 | 15.782 | 1.00 | 43.30 C |
| ATOM | 4235 | OD1 | ASP | B | 59 | −19.595 | 20.409 | 15.711 | 1.00 | 39.72 O |
| ATOM | 4236 | OD2 | ASP | B | 59 | −21.323 | 21.366 | 14.775 | 1.00 | 46.69 O |
| ATOM | 4237 | N | TRP | B | 60 | −18.901 | 19.169 | 18.606 | 1.00 | 34.91 N |
| ATOM | 4238 | CA | TRP | B | 60 | −18.543 | 17.759 | 18.771 | 1.00 | 35.96 C |
| ATOM | 4239 | C | TRP | B | 60 | −18.579 | 16.946 | 17.471 | 1.00 | 36.55 C |
| ATOM | 4240 | O | TRP | B | 60 | −18.226 | 15.765 | 17.511 | 1.00 | 33.06 O |
| ATOM | 4241 | CB | TRP | B | 60 | −19.414 | 17.034 | 19.812 | 1.00 | 32.91 C |
| ATOM | 4242 | CG | TRP | B | 60 | −19.437 | 17.693 | 21.169 | 1.00 | 32.96 C |
| ATOM | 4243 | CD1 | TRP | B | 60 | −20.443 | 18.467 | 21.682 | 1.00 | 31.38 C |
| ATOM | 4244 | CD2 | TRP | B | 60 | −18.422 | 17.631 | 22.184 | 1.00 | 30.45 C |
| ATOM | 4245 | NE1 | TRP | B | 60 | −20.121 | 18.890 | 22.950 | 1.00 | 34.78 N |
| ATOM | 4246 | CE2 | TRP | B | 60 | −18.882 | 18.406 | 23.281 | 1.00 | 30.41 C |
| ATOM | 4247 | CE3 | TRP | B | 60 | −17.160 | 17.018 | 22.271 | 1.00 | 30.16 C |
| ATOM | 4248 | CZ2 | TRP | B | 60 | −18.145 | 18.556 | 24.454 | 1.00 | 31.28 C |
| ATOM | 4249 | CZ3 | TRP | B | 60 | −16.427 | 17.166 | 23.439 | 1.00 | 31.68 C |
| ATOM | 4250 | CH2 | TRP | B | 60 | −16.923 | 17.933 | 24.518 | 1.00 | 32.17 C |
| ATOM | 4251 | N | SER | B | 61 | −18.974 | 17.509 | 16.334 | 1.00 | 31.96 N |
| ATOM | 4252 | CA | SER | B | 61 | −18.961 | 16.718 | 15.109 | 1.00 | 32.85 C |
| ATOM | 4253 | C | SER | B | 61 | −17.525 | 16.510 | 14.623 | 1.00 | 32.30 C |
| ATOM | 4254 | O | SER | B | 61 | −16.635 | 17.332 | 14.861 | 1.00 | 31.40 O |
| ATOM | 4255 | CB | SER | B | 61 | −19.811 | 17.382 | 14.027 | 1.00 | 32.20 C |
| ATOM | 4256 | OG | SER | B | 61 | −19.240 | 18.609 | 13.624 | 1.00 | 34.78 O |
| ATOM | 4257 | N | PHE | B | 62 | −17.306 | 15.396 | 13.930 | 1.00 | 31.85 N |
| ATOM | 4258 | CA | PHE | B | 62 | −15.970 | 14.952 | 13.555 | 1.00 | 29.70 C |
| ATOM | 4259 | C | PHE | B | 62 | −15.533 | 15.496 | 12.193 | 1.00 | 28.87 C |
| ATOM | 4260 | O | PHE | B | 62 | −16.347 | 15.868 | 11.351 | 1.00 | 31.87 O |
| ATOM | 4261 | CB | PHE | B | 62 | −15.930 | 13.426 | 13.527 | 1.00 | 28.46 C |
| ATOM | 4262 | CG | PHE | B | 62 | −16.175 | 12.803 | 14.864 | 1.00 | 29.24 C |
| ATOM | 4263 | CD1 | PHE | B | 62 | −15.168 | 12.777 | 15.821 | 1.00 | 26.46 C |
| ATOM | 4264 | CD2 | PHE | B | 62 | −17.416 | 12.245 | 15.171 | 1.00 | 31.71 C |
| ATOM | 4265 | CE1 | PHE | B | 62 | −15.379 | 12.198 | 17.067 | 1.00 | 28.38 C |
| ATOM | 4266 | CE2 | PHE | B | 62 | −17.639 | 11.666 | 16.415 | 1.00 | 31.81 C |
| ATOM | 4267 | CZ | PHE | B | 62 | −16.621 | 11.651 | 17.366 | 1.00 | 28.88 C |
| ATOM | 4268 | N | TYR | B | 63 | −14.218 | 15.501 | 11.973 | 1.00 | 32.84 N |
| ATOM | 4269 | CA | TYR | B | 63 | −13.691 | 15.807 | 10.652 | 1.00 | 29.69 C |
| ATOM | 4270 | C | TYR | B | 63 | −12.422 | 15.001 | 10.395 | 1.00 | 29.02 C |
| ATOM | 4271 | O | TYR | B | 63 | −11.664 | 14.683 | 11.319 | 1.00 | 33.01 O |
| ATOM | 4272 | CB | TYR | B | 63 | −13.415 | 17.311 | 10.488 | 1.00 | 32.75 C |

TABLE 17-continued

| | | | | | | | | | | |
|---|---|---|---|---|---|---|---|---|---|---|
| ATOM | 4273 | CG | TYR | B | 63 | −12.441 | 17.898 | 11.488 | 1.00 | 35.08 C |
| ATOM | 4274 | CD1 | TYR | B | 63 | −11.065 | 17.843 | 11.270 | 1.00 | 37.58 C |
| ATOM | 4275 | CD2 | TYR | B | 63 | −12.897 | 18.543 | 12.639 | 1.00 | 38.49 C |
| ATOM | 4276 | CE1 | TYR | B | 63 | −10.176 | 18.386 | 12.177 | 1.00 | 38.41 C |
| ATOM | 4277 | CE2 | TYR | B | 63 | −12.019 | 19.087 | 13.551 | 1.00 | 33.60 C |
| ATOM | 4278 | CZ | TYR | B | 63 | −10.661 | 19.010 | 13.315 | 1.00 | 39.36 C |
| ATOM | 4279 | OH | TYR | B | 63 | −9.788 | 19.558 | 14.213 | 1.00 | 43.03 O |
| ATOM | 4280 | N | LEU | B | 64 | −12.208 | 14.684 | 9.119 | 1.00 | 32.91 N |
| ATOM | 4281 | CA | LEU | B | 64 | −11.071 | 13.896 | 8.675 | 1.00 | 36.03 C |
| ATOM | 4282 | C | LEU | B | 64 | −10.633 | 14.396 | 7.311 | 1.00 | 34.23 C |
| ATOM | 4283 | O | LEU | B | 64 | −11.464 | 14.784 | 6.486 | 1.00 | 36.37 O |
| ATOM | 4284 | CB | LEU | B | 64 | −11.415 | 12.411 | 8.557 | 1.00 | 40.16 C |
| ATOM | 4285 | CG | LEU | B | 64 | −11.627 | 11.582 | 9.819 | 1.00 | 38.09 C |
| ATOM | 4286 | CD1 | LEU | B | 64 | −12.209 | 10.217 | 9.429 | 1.00 | 35.40 C |
| ATOM | 4287 | CD2 | LEU | B | 64 | −10.310 | 11.429 | 10.526 | 1.00 | 34.01 C |
| ATOM | 4288 | N | LEU | B | 65 | −9.327 | 14.337 | 7.065 | 1.00 | 36.29 N |
| ATOM | 4289 | CA | LEU | B | 65 | −8.751 | 14.617 | 5.756 | 1.00 | 36.84 C |
| ATOM | 4290 | C | LEU | B | 65 | −8.185 | 13.323 | 5.191 | 1.00 | 41.34 C |
| ATOM | 4291 | O | LEU | B | 65 | −7.362 | 12.678 | 5.846 | 1.00 | 38.96 O |
| ATOM | 4292 | CB | LEU | B | 65 | −7.650 | 15.673 | 5.851 | 1.00 | 40.24 C |
| ATOM | 4293 | CG | LEU | B | 65 | −7.024 | 16.048 | 4.504 | 1.00 | 43.81 C |
| ATOM | 4294 | CD1 | LEU | B | 65 | −8.084 | 16.593 | 3.566 | 1.00 | 44.51 C |
| ATOM | 4295 | CD2 | LEU | B | 65 | −5.912 | 17.068 | 4.690 | 1.00 | 44.36 C |
| ATOM | 4296 | N | TYR | B | 66 | −8.645 | 12.936 | 4.000 | 1.00 | 41.10 N |
| ATOM | 4297 | CA | TYR | B | 66 | −8.088 | 11.820 | 3.241 | 1.00 | 44.13 C |
| ATOM | 4298 | C | TYR | B | 66 | −7.302 | 12.381 | 2.064 | 1.00 | 47.66 C |
| ATOM | 4299 | O | TYR | B | 66 | −7.712 | 13.374 | 1.453 | 1.00 | 49.68 O |
| ATOM | 4300 | CB | TYR | B | 66 | −9.189 | 10.873 | 2.728 | 1.00 | 44.21 C |
| ATOM | 4301 | CG | TYR | B | 66 | −9.829 | 10.015 | 3.798 | 1.00 | 42.50 C |
| ATOM | 4302 | CD1 | TYR | B | 66 | −10.743 | 10.559 | 4.690 | 1.00 | 44.65 C |
| ATOM | 4303 | CD2 | TYR | B | 66 | −9.525 | 8.661 | 3.912 | 1.00 | 48.33 C |
| ATOM | 4304 | CE1 | TYR | B | 66 | −11.328 | 9.788 | 5.684 | 1.00 | 41.58 C |
| ATOM | 4305 | CE2 | TYR | B | 66 | −10.115 | 7.874 | 4.897 | 1.00 | 50.97 C |
| ATOM | 4306 | CZ | TYR | B | 66 | −11.018 | 8.449 | 5.781 | 1.00 | 45.43 C |
| ATOM | 4307 | OH | TYR | B | 66 | −11.612 | 7.689 | 6.762 | 1.00 | 46.25 O |
| ATOM | 4308 | N | TYR | B | 67 | −6.175 | 11.753 | 1.736 | 1.00 | 48.96 N |
| ATOM | 4309 | CA | TYR | B | 67 | −5.338 | 12.339 | 0.698 | 1.00 | 47.37 C |
| ATOM | 4310 | C | TYR | B | 67 | −4.456 | 11.277 | 0.057 | 1.00 | 51.87 C |
| ATOM | 4311 | O | TYR | B | 67 | −4.128 | 10.257 | 0.670 | 1.00 | 53.07 O |
| ATOM | 4312 | CB | TYR | B | 67 | −4.479 | 13.481 | 1.256 | 1.00 | 39.75 C |
| ATOM | 4313 | CG | TYR | B | 67 | −3.672 | 13.119 | 2.484 | 1.00 | 44.19 C |
| ATOM | 4314 | CD1 | TYR | B | 67 | −4.258 | 13.099 | 3.751 | 1.00 | 45.36 C |
| ATOM | 4315 | CD2 | TYR | B | 67 | −2.321 | 12.820 | 2.386 | 1.00 | 50.30 C |
| ATOM | 4316 | CE1 | TYR | B | 67 | −3.524 | 12.782 | 4.874 | 1.00 | 47.12 C |
| ATOM | 4317 | CE2 | TYR | B | 67 | −1.579 | 12.498 | 3.508 | 1.00 | 56.86 C |
| ATOM | 4318 | CZ | TYR | B | 67 | −2.187 | 12.484 | 4.749 | 1.00 | 57.68 C |
| ATOM | 4319 | OH | TYR | B | 67 | −1.453 | 12.165 | 5.869 | 1.00 | 64.33 O |
| ATOM | 4320 | N | THR | B | 68 | −4.082 | 11.539 | −1.190 | 1.00 | 54.55 N |
| ATOM | 4321 | CA | THR | B | 68 | −3.127 | 10.699 | −1.893 | 1.00 | 61.09 C |
| ATOM | 4322 | C | THR | B | 68 | −2.363 | 11.566 | −2.879 | 1.00 | 62.53 C |
| ATOM | 4323 | O | THR | B | 68 | −2.903 | 12.530 | −3.433 | 1.00 | 60.11 O |
| ATOM | 4324 | CB | THR | B | 68 | −3.812 | 9.527 | −2.615 | 1.00 | 73.70 C |
| ATOM | 4325 | OG1 | THR | B | 68 | −2.818 | 8.634 | −3.132 | 1.00 | 79.33 O |
| ATOM | 4326 | CG2 | THR | B | 68 | −4.678 | 10.026 | −3.760 | 1.00 | 76.88 C |
| ATOM | 4327 | N | GLU | B | 69 | −1.091 | 11.235 | −3.068 | 1.00 | 69.25 N |
| ATOM | 4328 | CA | GLU | B | 69 | −0.300 | 11.942 | −4.062 | 1.00 | 79.12 C |
| ATOM | 4329 | C | GLU | B | 69 | −0.735 | 11.497 | −5.450 | 1.00 | 74.97 C |
| ATOM | 4330 | O | GLU | B | 69 | −0.893 | 10.299 | −5.707 | 1.00 | 73.83 O |
| ATOM | 4331 | CB | GLU | B | 69 | 1.189 | 11.685 | −3.844 | 1.00 | 88.68 C |
| ATOM | 4332 | CG | GLU | B | 69 | 2.099 | 12.608 | −4.641 | 1.00 | 97.04 C |
| ATOM | 4333 | CD | GLU | B | 69 | 3.412 | 12.887 | −3.932 | 1.00 | 100.53 C |
| ATOM | 4334 | OE1 | GLU | B | 69 | 3.826 | 14.066 | −3.885 | 1.00 | 101.62 O |
| ATOM | 4335 | OE2 | GLU | B | 69 | 4.025 | 11.930 | −3.413 | 1.00 | 100.34 O |
| ATOM | 4336 | N | PHE | B | 70 | −0.965 | 12.464 | −6.335 | 1.00 | 70.37 N |
| ATOM | 4337 | CA | PHE | B | 70 | −1.408 | 12.164 | −7.688 | 1.00 | 69.43 C |
| ATOM | 4338 | C | PHE | B | 70 | −0.837 | 13.211 | −8.632 | 1.00 | 72.49 C |
| ATOM | 4339 | O | PHE | B | 70 | −0.353 | 14.264 | −8.209 | 1.00 | 74.91 O |
| ATOM | 4340 | CB | PHE | B | 70 | −2.946 | 12.105 | −7.783 | 1.00 | 66.82 C |
| ATOM | 4341 | CG | PHE | B | 70 | −3.617 | 13.454 | −7.911 | 1.00 | 66.25 C |
| ATOM | 4342 | CD1 | PHE | B | 70 | −3.251 | 14.523 | −7.102 | 1.00 | 65.04 C |
| ATOM | 4343 | CD2 | PHE | B | 70 | −4.626 | 13.645 | −8.842 | 1.00 | 64.73 C |
| ATOM | 4344 | CE1 | PHE | B | 70 | −3.867 | 15.757 | −7.234 | 1.00 | 62.40 C |
| ATOM | 4345 | CE2 | PHE | B | 70 | −5.246 | 14.873 | −8.971 | 1.00 | 63.28 C |
| ATOM | 4346 | CZ | PHE | B | 70 | −4.866 | 15.929 | −8.163 | 1.00 | 64.17 C |
| ATOM | 4347 | N | THR | B | 71 | −0.899 | 12.913 | −9.920 | 1.00 | 73.74 N |
| ATOM | 4348 | CA | THR | B | 71 | −0.444 | 13.850 | −10.942 | 1.00 | 76.31 C |
| ATOM | 4349 | C | THR | B | 71 | −1.596 | 14.114 | −11.900 | 1.00 | 78.67 C |
| ATOM | 4350 | O | THR | B | 71 | −1.988 | 13.206 | −12.659 | 1.00 | 77.86 O |
| ATOM | 4351 | CB | THR | B | 71 | 0.775 | 13.296 | −11.678 | 1.00 | 80.84 C |
| ATOM | 4352 | OG1 | THR | B | 71 | 1.674 | 12.717 | −10.723 | 1.00 | 81.55 O |

TABLE 17-continued

| | | | | | | | | | | |
|---|---|---|---|---|---|---|---|---|---|---|
| ATOM | 4353 | CG2 | THR | B | 71 | 1.501 | 14.409 | −12.410 | 1.00 | 82.74 | C |
| ATOM | 4354 | N | PRO | B | 72 | −2.180 | 15.311 | −11.893 | 1.00 | 78.44 | N |
| ATOM | 4355 | CA | PRO | B | 72 | −3.394 | 15.542 | −12.685 | 1.00 | 79.53 | C |
| ATOM | 4356 | C | PRO | B | 72 | −3.116 | 15.575 | −14.182 | 1.00 | 83.26 | C |
| ATOM | 4357 | O | PRO | B | 72 | −2.076 | 16.062 | −14.634 | 1.00 | 83.28 | O |
| ATOM | 4358 | CB | PRO | B | 72 | −3.895 | 16.900 | −12.179 | 1.00 | 81.31 | C |
| ATOM | 4359 | CG | PRO | B | 72 | −2.684 | 17.568 | −11.610 | 1.00 | 80.24 | C |
| ATOM | 4360 | CD | PRO | B | 72 | −1.828 | 16.471 | −11.054 | 1.00 | 75.42 | C |
| ATOM | 4361 | N | THR | B | 73 | −4.064 | 15.037 | −14.948 | 1.00 | 79.39 | N |
| ATOM | 4362 | CA | THR | B | 73 | −4.049 | 15.074 | −16.404 | 1.00 | 78.86 | C |
| ATOM | 4363 | C | THR | B | 73 | −5.392 | 15.604 | −16.892 | 1.00 | 77.01 | C |
| ATOM | 4364 | O | THR | B | 73 | −6.334 | 15.772 | −16.116 | 1.00 | 82.81 | O |
| ATOM | 4365 | CB | THR | B | 73 | −3.784 | 13.687 | −17.010 | 1.00 | 79.56 | C |
| ATOM | 4366 | OG1 | THR | B | 73 | −4.936 | 12.852 | −16.825 | 1.00 | 81.16 | O |
| ATOM | 4367 | CG2 | THR | B | 73 | −2.577 | 13.027 | −16.358 | 1.00 | 76.46 | C |
| ATOM | 4368 | N | GLU | B | 74 | −5.482 | 15.872 | −18.195 | 1.00 | 79.21 | N |
| ATOM | 4369 | CA | GLU | B | 74 | −6.758 | 16.288 | −18.766 | 1.00 | 77.11 | C |
| ATOM | 4370 | C | GLU | B | 74 | −7.697 | 15.117 | −19.023 | 1.00 | 85.43 | C |
| ATOM | 4371 | O | GLU | B | 74 | −8.875 | 15.344 | −19.320 | 1.00 | 92.07 | O |
| ATOM | 4372 | CB | GLU | B | 74 | −6.533 | 17.061 | −20.070 | 1.00 | 80.54 | C |
| ATOM | 4373 | CG | GLU | B | 74 | −5.986 | 16.217 | −21.202 | 1.00 | 76.52 | C |
| ATOM | 4374 | CD | GLU | B | 74 | −6.990 | 16.017 | −22.318 | 0.00 | 83.17 | C |
| ATOM | 4375 | OE1 | GLU | B | 74 | −8.057 | 16.667 | −22.286 | 1.00 | 87.14 | O |
| ATOM | 4376 | OE2 | GLU | B | 74 | −6.706 | 15.211 | −23.228 | 1.00 | 88.62 | O |
| ATOM | 4377 | N | LYS | B | 75 | −7.210 | 13.882 | −18.905 | 1.00 | 88.05 | N |
| ATOM | 4378 | CA | LYS | B | 75 | −7.979 | 12.681 | −19.208 | 1.00 | 88.53 | C |
| ATOM | 4379 | C | LYS | B | 75 | −8.678 | 12.112 | −17.980 | 1.00 | 88.67 | C |
| ATOM | 4380 | O | LYS | B | 75 | −9.878 | 11.821 | −18.023 | 1.00 | 89.97 | O |
| ATOM | 4381 | CB | LYS | B | 75 | −7.059 | 11.615 | −19.806 | 1.00 | 87.71 | C |
| ATOM | 4382 | CG | LYS | B | 75 | −6.035 | 12.184 | −20.750 | 1.00 | 86.46 | C |
| ATOM | 4383 | CD | LYS | B | 75 | −4.667 | 12.311 | −20.114 | 0.00 | 82.96 | C |
| ATOM | 4384 | CE | LYS | B | 75 | −3.802 | 13.280 | −20.902 | 1.00 | 84.74 | C |
| ATOM | 4385 | NZ | LYS | B | 75 | −2.456 | 13.440 | −20.296 | 1.00 | 84.92 | N |
| ATOM | 4386 | N | ASP | B | 76 | −7.938 | 11.955 | −16.888 | 1.00 | 86.62 | N |
| ATOM | 4387 | CA | ASP | B | 76 | −8.424 | 11.198 | −15.744 | 1.00 | 84.56 | C |
| ATOM | 4388 | C | ASP | B | 76 | −9.488 | 11.975 | −14.979 | 1.00 | 76.48 | C |
| ATOM | 4389 | O | ASP | B | 76 | −9.341 | 13.177 | −14.728 | 1.00 | 69.84 | O |
| ATOM | 4390 | CB | ASP | B | 76 | −7.253 | 10.842 | −14.833 | 1.00 | 90.31 | C |
| ATOM | 4391 | CG | ASP | B | 76 | −6.240 | 9.944 | −15.522 | 1.00 | 95.54 | C |
| ATOM | 4392 | OD1 | ASP | B | 76 | −6.555 | 8.755 | −15.741 | 1.00 | 96.39 | O |
| ATOM | 4393 | OD2 | ASP | B | 76 | −5.143 | 10.432 | −15.872 | 1.00 | 94.54 | O |
| ATOM | 4394 | N | GLU | B | 77 | −10.570 | 11.281 | −14.629 | 1.00 | 75.66 | N |
| ATOM | 4395 | CA | GLU | B | 77 | −11.598 | 11.810 | −13.747 | 1.00 | 72.65 | C |
| ATOM | 4396 | C | GLU | B | 77 | −11.289 | 11.372 | −12.323 | 1.00 | 68.36 | C |
| ATOM | 4397 | O | GLU | B | 77 | −11.046 | 10.187 | −12.070 | 1.00 | 72.69 | O |
| ATOM | 4398 | CB | GLU | B | 77 | −12.984 | 11.313 | −14.164 | 1.00 | 76.09 | C |
| ATOM | 4399 | CG | GLU | B | 77 | −13.345 | 11.587 | −15.621 | 1.00 | 82.22 | C |
| ATOM | 4400 | CD | GLU | B | 77 | −14.622 | 10.883 | −16.050 | 0.00 | 87.87 | C |
| ATOM | 4401 | OE1 | GLU | B | 77 | −15.134 | 10.051 | −15.274 | 1.00 | 88.84 | O |
| ATOM | 4402 | OE2 | GLU | B | 77 | −15.115 | 11.159 | −17.165 | 1.00 | 93.25 | O |
| ATOM | 4403 | N | TYR | B | 78 | −11.277 | 12.325 | −11.400 | 1.00 | 63.90 | N |
| ATOM | 4404 | CA | TYR | B | 78 | −11.057 | 12.035 | −9.991 | 1.00 | 64.65 | C |
| ATOM | 4405 | C | TYR | B | 78 | −12.324 | 12.323 | −9.203 | 1.00 | 63.11 | C |
| ATOM | 4406 | O | TYR | B | 78 | −13.053 | 13.271 | −9.508 | 1.00 | 64.08 | O |
| ATOM | 4407 | CB | TYR | B | 78 | −9.881 | 12.842 | −9.431 | 1.00 | 62.98 | C |
| ATOM | 4408 | CG | TYR | B | 78 | −8.558 | 12.335 | −9.948 | 1.00 | 65.69 | C |
| ATOM | 4409 | CD1 | TYR | B | 78 | −7.970 | 11.202 | −9.397 | 1.00 | 64.24 | C |
| ATOM | 4410 | CD2 | TYR | B | 78 | −7.912 | 12.961 | −11.011 | 1.00 | 68.38 | C |
| ATOM | 4411 | CE1 | TYR | B | 78 | −6.768 | 10.714 | −9.877 | 1.00 | 65.08 | C |
| ATOM | 4412 | CE2 | TYR | B | 78 | −6.705 | 12.481 | −11.499 | 1.00 | 67.53 | C |
| ATOM | 4413 | CZ | TYR | B | 78 | −6.140 | 11.354 | −10.925 | 1.00 | 68.55 | C |
| ATOM | 4414 | OH | TYR | B | 78 | −4.942 | 10.863 | −11.392 | 1.00 | 69.90 | O |
| ATOM | 4415 | N | ALA | B | 79 | −12.594 | 11.485 | −8.208 | 1.00 | 62.75 | N |
| ATOM | 4416 | CA | ALA | B | 79 | −13.759 | 11.662 | −7.358 | 1.00 | 60.84 | C |
| ATOM | 4417 | C | ALA | B | 79 | −13.452 | 11.083 | −5.984 | 1.00 | 61.66 | C |
| ATOM | 4418 | O | ALA | B | 79 | −12.363 | 10.556 | −5.732 | 1.00 | 57.91 | O |
| ATOM | 4419 | CB | ALA | B | 79 | −15.002 | 11.015 | −7.975 | 1.00 | 62.83 | C |
| ATOM | 4420 | N | CYS | B | 80 | −14.417 | 11.207 | −5.083 | 1.00 | 60.10 | N |
| ATOM | 4421 | CA | CYS | B | 80 | −14.360 | 10.536 | −3.799 | 1.00 | 63.67 | C |
| ATOM | 4422 | C | CYS | B | 80 | −15.692 | 9.848 | −3.555 | 1.00 | 61.91 | C |
| ATOM | 4423 | O | CYS | B | 80 | −16.740 | 10.298 | −4.030 | 1.00 | 64.43 | O |
| ATOM | 4424 | CB | CYS | B | 80 | −14.066 | 11.504 | −2.662 | 1.00 | 74.00 | C |
| ATOM | 4425 | SG | CYS | B | 80 | −15.518 | 12.434 | −2.187 | 1.00 | 84.54 | S |
| ATOM | 4426 | N | ARG | B | 81 | −15.638 | 8.740 | −2.828 | 1.00 | 54.95 | N |
| ATOM | 4427 | CA | ARG | B | 81 | −16.822 | 7.981 | −2.460 | 1.00 | 54.10 | C |
| ATOM | 4428 | C | ARG | B | 81 | −16.875 | 7.901 | −0.944 | 1.00 | 49.22 | C |
| ATOM | 4429 | O | ARG | B | 81 | −15.897 | 7.501 | −0.305 | 1.00 | 48.38 | O |
| ATOM | 4430 | CB | ARG | B | 81 | −16.792 | 6.584 | −3.082 | 1.00 | 51.84 | C |
| ATOM | 4431 | CG | ARG | B | 81 | −18.052 | 5.772 | −2.879 | 1.00 | 61.45 | C |
| ATOM | 4432 | CD | ARG | B | 81 | −18.069 | 4.573 | −3.810 | 1.00 | 72.76 | C |

TABLE 17-continued

| | | | | | | | | | | |
|---|---|---|---|---|---|---|---|---|---|---|
| ATOM | 4433 | NE | ARG | B | 81 | −16.783 | 3.883 | −3.816 | 1.00 | 81.57 | N |
| ATOM | 4434 | CZ | ARG | B | 81 | −16.533 | 2.755 | −3.160 | 1.00 | 87.19 | C |
| ATOM | 4435 | NH1 | ARG | B | 81 | −17.488 | 2.174 | −2.448 | 1.00 | 87.40 | N |
| ATOM | 4436 | NH2 | ARG | B | 81 | −15.329 | 2.202 | −3.224 | 1.00 | 89.43 | N |
| ATOM | 4437 | N | VAL | B | 82 | −18.002 | 8.308 | −0.367 | 1.00 | 50.95 | N |
| ATOM | 4438 | CA | VAL | B | 82 | −18.154 | 8.344 | 1.082 | 1.00 | 49.65 | C |
| ATOM | 4439 | C | VAL | B | 82 | −19.398 | 7.555 | 1.464 | 1.00 | 47.38 | C |
| ATOM | 4440 | O | VAL | B | 82 | −20.471 | 7.746 | 0.878 | 1.00 | 50.66 | O |
| ATOM | 4441 | CB | VAL | B | 82 | −18.232 | 9.791 | 1.616 | 1.00 | 57.05 | C |
| ATOM | 4442 | CG1 | VAL | B | 82 | −16.966 | 10.558 | 1.267 | 1.00 | 54.90 | C |
| ATOM | 4443 | CG2 | VAL | B | 82 | −19.433 | 10.513 | 1.048 | 1.00 | 62.38 | C |
| ATOM | 4444 | N | ASN | B | 83 | −19.255 | 6.657 | 2.434 | 1.00 | 48.81 | N |
| ATOM | 4445 | CA | ASN | B | 83 | −20.412 | 6.018 | 3.035 | 1.00 | 56.44 | C |
| ATOM | 4446 | C | ASN | B | 83 | −20.376 | 6.237 | 4.538 | 1.00 | 50.07 | C |
| ATOM | 4447 | O | ASN | B | 83 | −19.309 | 6.328 | 5.156 | 1.00 | 47.68 | O |
| ATOM | 4448 | CB | ASN | B | 83 | −20.497 | 4.515 | 2.716 | 1.00 | 59.83 | C |
| ATOM | 4449 | CG | ASN | B | 83 | −21.930 | 3.986 | 2.780 | 1.00 | 65.50 | C |
| ATOM | 4450 | OD1 | ASN | B | 83 | −22.879 | 4.740 | 3.007 | 1.00 | 62.27 | O |
| ATOM | 4451 | ND2 | ASN | B | 83 | −22.089 | 2.685 | 2.569 | 1.00 | 71.41 | N |
| ATOM | 4452 | N | HIS | B | 84 | −21.567 | 6.327 | 5.108 | 1.00 | 51.20 | N |
| ATOM | 4453 | CA | HIS | B | 84 | −21.759 | 6.667 | 6.504 | 1.00 | 50.88 | C |
| ATOM | 4454 | C | HIS | B | 84 | −23.145 | 6.164 | 6.852 | 1.00 | 52.92 | C |
| ATOM | 4455 | O | HIS | B | 84 | −23.984 | 5.986 | 5.966 | 1.00 | 52.94 | O |
| ATOM | 4456 | CB | HIS | B | 84 | −21.609 | 8.179 | 6.709 | 1.00 | 46.88 | C |
| ATOM | 4457 | CG | HIS | B | 84 | −21.693 | 8.627 | 8.134 | 1.00 | 43.55 | C |
| ATOM | 4458 | ND1 | HIS | B | 84 | −22.837 | 9.180 | 8.670 | 1.00 | 41.23 | N |
| ATOM | 4459 | CD2 | HIS | B | 84 | −20.760 | 8.661 | 9.116 | 1.00 | 40.18 | C |
| ATOM | 4460 | CE1 | HIS | B | 84 | −22.614 | 9.506 | 9.933 | 1.00 | 39.90 | C |
| ATOM | 4461 | NE2 | HIS | B | 84 | −21.360 | 9.210 | 10.226 | 1.00 | 39.52 | N |
| ATOM | 4462 | N | VAL | B | 85 | −23.375 | 5.907 | 8.140 | 1.00 | 51.47 | N |
| ATOM | 4463 | CA | VAL | B | 85 | −24.639 | 5.290 | 8.539 | 1.00 | 54.21 | C |
| ATOM | 4464 | C | VAL | B | 85 | −25.832 | 6.131 | 8.086 | 1.00 | 52.67 | C |
| ATOM | 4465 | O | VAL | B | 85 | −26.923 | 5.596 | 7.852 | 1.00 | 55.06 | O |
| ATOM | 4466 | CB | VAL | B | 85 | −24.647 | 5.036 | 10.064 | 1.00 | 52.52 | C |
| ATOM | 4467 | CG1 | VAL | B | 85 | −24.464 | 6.340 | 10.828 | 1.00 | 50.08 | C |
| ATOM | 4468 | CG2 | VAL | B | 85 | −25.927 | 4.319 | 10.491 | 1.00 | 53.89 | C |
| ATOM | 4469 | N | THR | B | 86 | −25.636 | 7.438 | 7.903 | 1.00 | 47.60 | N |
| ATOM | 4470 | CA | THR | B | 86 | −26.698 | 8.335 | 7.464 | 1.00 | 49.03 | C |
| ATOM | 4471 | C | THR | B | 86 | −26.961 | 8.273 | 5.965 | 1.00 | 51.55 | C |
| ATOM | 4472 | O | THR | B | 86 | −27.885 | 8.945 | 5.492 | 1.00 | 53.29 | O |
| ATOM | 4473 | CB | THR | B | 86 | −26.369 | 9.782 | 7.856 | 1.00 | 53.91 | C |
| ATOM | 4474 | OG1 | THR | B | 86 | −25.124 | 10.174 | 7.264 | 1.00 | 52.06 | O |
| ATOM | 4475 | CG2 | THR | B | 86 | −26.259 | 9.922 | 9.370 | 1.00 | 51.22 | C |
| ATOM | 4476 | N | LEU | B | 87 | −26.191 | 7.494 | 5.210 | 1.00 | 53.44 | N |
| ATOM | 4477 | CA | LEU | B | 87 | −26.350 | 7.387 | 3.763 | 1.00 | 57.35 | C |
| ATOM | 4478 | C | LEU | B | 87 | −26.807 | 5.982 | 3.386 | 1.00 | 60.33 | C |
| ATOM | 4479 | O | LEU | B | 87 | −26.186 | 4.992 | 3.791 | 1.00 | 62.36 | O |
| ATOM | 4480 | CB | LEU | B | 87 | −25.039 | 7.729 | 3.051 | 1.00 | 56.63 | C |
| ATOM | 4481 | CG | LEU | B | 87 | −24.465 | 9.118 | 3.358 | 1.00 | 56.29 | C |
| ATOM | 4482 | CD1 | LEU | B | 87 | −23.022 | 9.211 | 2.898 | 1.00 | 50.65 | C |
| ATOM | 4483 | CD2 | LEU | B | 87 | −25.312 | 10.199 | 2.698 | 1.00 | 59.73 | C |
| ATOM | 4484 | N | SER | B | 88 | −27.890 | 5.900 | 2.603 | 1.00 | 63.86 | N |
| ATOM | 4485 | CA | SER | B | 88 | −28.410 | 4.604 | 2.175 | 1.00 | 65.70 | C |
| ATOM | 4486 | C | SER | B | 88 | −27.428 | 3.902 | 1.246 | 1.00 | 70.11 | C |
| ATOM | 4487 | O | SER | B | 88 | −27.132 | 2.713 | 1.417 | 1.00 | 75.07 | O |
| ATOM | 4488 | CB | SER | B | 88 | −29.761 | 4.783 | 1.487 | 1.00 | 71.02 | C |
| ATOM | 4489 | OG | SER | B | 88 | −30.550 | 5.750 | 2.155 | 1.00 | 75.06 | O |
| ATOM | 4490 | N | GLN | B | 89 | −26.932 | 4.616 | 0.248 | 1.00 | 67.34 | N |
| ATOM | 4491 | CA | GLN | B | 89 | −25.855 | 4.157 | −0.612 | 1.00 | 68.03 | C |
| ATOM | 4492 | C | GLN | B | 89 | −24.776 | 5.225 | −0.620 | 1.00 | 65.02 | C |
| ATOM | 4493 | O | GLN | B | 89 | −25.046 | 6.392 | −0.317 | 1.00 | 64.19 | O |
| ATOM | 4494 | CB | GLN | B | 89 | −26.351 | 3.882 | −2.042 | 1.00 | 69.22 | C |
| ATOM | 4495 | CG | GLN | B | 89 | −26.886 | 5.100 | −2.766 | 1.00 | 73.02 | C |
| ATOM | 4496 | CD | GLN | B | 89 | −28.367 | 4.989 | −3.071 | 1.00 | 83.25 | C |
| ATOM | 4497 | OE1 | GLN | B | 89 | −29.126 | 4.401 | −2.301 | 1.00 | 86.99 | O |
| ATOM | 4498 | NE2 | GLN | B | 89 | −28.786 | 5.549 | −4.205 | 1.00 | 85.58 | N |
| ATOM | 4499 | N | PRO | B | 90 | −23.535 | 4.853 | −0.928 | 1.00 | 64.25 | N |
| ATOM | 4500 | CA | PRO | B | 90 | −22.447 | 5.836 | −0.892 | 1.00 | 61.96 | C |
| ATOM | 4501 | C | PRO | B | 90 | −22.708 | 7.032 | −1.798 | 1.00 | 59.27 | C |
| ATOM | 4502 | O | PRO | B | 90 | −23.432 | 6.951 | −2.793 | 1.00 | 57.15 | O |
| ATOM | 4503 | CB | PRO | B | 90 | −21.221 | 5.032 | −1.354 | 1.00 | 60.72 | C |
| ATOM | 4504 | CG | PRO | B | 90 | −21.738 | 3.696 | −1.795 | 1.00 | 67.12 | C |
| ATOM | 4505 | CD | PRO | B | 90 | −23.024 | 3.484 | −1.073 | 1.00 | 67.69 | C |
| ATOM | 4506 | N | LYS | B | 91 | −22.126 | 8.164 | −1.415 | 1.00 | 58.10 | N |
| ATOM | 4507 | CA | LYS | B | 91 | −22.226 | 9.409 | −2.162 | 1.00 | 55.99 | C |
| ATOM | 4508 | C | LYS | B | 91 | −20.905 | 9.650 | −2.877 | 1.00 | 58.49 | C |
| ATOM | 4509 | O | LYS | B | 91 | −19.837 | 9.581 | −2.259 | 1.00 | 60.85 | O |
| ATOM | 4510 | CB | LYS | B | 91 | −22.554 | 10.580 | −1.232 | 1.00 | 59.11 | C |
| ATOM | 4511 | CG | LYS | B | 91 | −22.767 | 11.904 | −1.945 | 1.00 | 70.81 | C |
| ATOM | 4512 | CD | LYS | B | 91 | −22.980 | 13.042 | −0.954 | 1.00 | 74.40 | C |

TABLE 17-continued

| | | | | | | | | | | |
|---|---|---|---|---|---|---|---|---|---|---|
| ATOM | 4513 | CE | LYS | B | 91 | −24.158 | 12.776 | −0.025 | 1.00 | 75.71 C |
| ATOM | 4514 | NZ | LYS | B | 91 | −24.418 | 13.921 | 0.898 | 1.00 | 72.78 N |
| ATOM | 4515 | N | ILE | B | 92 | −20.975 | 9.926 | −4.174 | 1.00 | 57.92 N |
| ATOM | 4516 | CA | ILE | B | 92 | −19.792 | 10.148 | −4.995 | 1.00 | 56.87 C |
| ATOM | 4517 | C | ILE | B | 92 | −19.749 | 11.617 | −5.387 | 1.00 | 53.88 C |
| ATOM | 4518 | O | ILE | B | 92 | −20.684 | 12.128 | −6.014 | 1.00 | 54.96 O |
| ATOM | 4519 | CB | ILE | B | 92 | −19.782 | 9.239 | −6.232 | 1.00 | 58.15 C |
| ATOM | 4520 | CG1 | ILE | B | 92 | −19.505 | 7.795 | −5.808 | 1.00 | 59.52 C |
| ATOM | 4521 | CG2 | ILE | B | 92 | −18.755 | 9.729 | −7.233 | 1.00 | 60.48 C |
| ATOM | 4522 | CD1 | ILE | B | 92 | −19.244 | 6.853 | −6.952 | 1.00 | 64.01 C |
| ATOM | 4523 | N | VAL | B | 93 | −18.668 | 12.297 | −5.010 | 1.00 | 54.56 N |
| ATOM | 4524 | CA | VAL | B | 93 | −18.447 | 13.702 | −5.340 | 1.00 | 55.50 C |
| ATOM | 4525 | C | VAL | B | 93 | −17.240 | 13.776 | −6.264 | 1.00 | 56.72 C |
| ATOM | 4526 | O | VAL | B | 93 | −16.140 | 13.346 | −5.895 | 1.00 | 59.66 O |
| ATOM | 4527 | CB | VAL | B | 93 | −18.224 | 14.558 | −4.084 | 1.00 | 56.28 C |
| ATOM | 4528 | CG1 | VAL | B | 93 | −18.025 | 16.018 | −4.473 | 1.00 | 63.08 C |
| ATOM | 4529 | CG2 | VAL | B | 93 | −19.385 | 14.404 | −3.119 | 1.00 | 53.44 C |
| ATOM | 4530 | N | LYS | B | 94 | −17.442 | 14.321 | −7.461 | 1.00 | 61.29 N |
| ATOM | 4531 | CA | LYS | B | 94 | −16.373 | 14.384 | −8.447 | 1.00 | 60.39 C |
| ATOM | 4532 | C | LYS | B | 94 | −15.479 | 15.595 | −8.204 | 1.00 | 62.54 C |
| ATOM | 4533 | O | LYS | B | 94 | −15.906 | 16.612 | −7.650 | 1.00 | 63.98 O |
| ATOM | 4534 | CB | LYS | B | 94 | −16.951 | 14.428 | −9.863 | 1.00 | 65.57 C |
| ATOM | 4535 | CG | LYS | B | 94 | −17.692 | 13.157 | −10.256 | 1.00 | 65.04 C |
| ATOM | 4536 | CD | LYS | B | 94 | −17.955 | 13.112 | −11.752 | 1.00 | 68.71 C |
| ATOM | 4537 | CE | LYS | B | 94 | −19.437 | 13.030 | −12.052 | 1.00 | 68.19 C |
| ATOM | 4538 | NZ | LYS | B | 94 | −19.689 | 12.983 | −13.520 | 1.00 | 68.73 N |
| ATOM | 4539 | N | TRP | B | 95 | −14.221 | 15.471 | −8.617 | 1.00 | 61.11 N |
| ATOM | 4540 | CA | TRP | B | 95 | −13.255 | 16.549 | −8.446 | 1.00 | 56.37 C |
| ATOM | 4541 | C | TRP | B | 95 | −13.452 | 17.579 | −9.551 | 1.00 | 61.92 C |
| ATOM | 4542 | O | TRP | B | 95 | −13.219 | 17.291 | −10.729 | 1.00 | 63.07 O |
| ATOM | 4543 | CB | TRP | B | 95 | −11.831 | 16.007 | −8.456 | 1.00 | 54.02 C |
| ATOM | 4544 | CG | TRP | B | 95 | −10.799 | 17.086 | −8.389 | 1.00 | 64.86 C |
| ATOM | 4545 | CD1 | TRP | B | 95 | −10.820 | 18.203 | −7.592 | 1.00 | 62.53 C |
| ATOM | 4546 | CD2 | TRP | B | 95 | −9.599 | 17.170 | −9.164 | 1.00 | 68.77 C |
| ATOM | 4547 | NE1 | TRP | B | 95 | −9.700 | 18.964 | −7.819 | 1.00 | 63.14 N |
| ATOM | 4548 | CE2 | TRP | B | 95 | −8.937 | 18.356 | −8.783 | 1.00 | 66.02 C |
| ATOM | 4549 | CE3 | TRP | B | 95 | −9.018 | 16.356 | −10.142 | 1.00 | 74.46 C |
| ATOM | 4550 | CZ2 | TRP | B | 95 | −7.722 | 18.744 | −9.345 | 1.00 | 67.54 C |
| ATOM | 4551 | CZ3 | TRP | B | 95 | −7.815 | 16.744 | −10.700 | 1.00 | 75.45 C |
| ATOM | 4552 | CH2 | TRP | B | 95 | −7.178 | 17.927 | −10.299 | 1.00 | 74.51 C |
| ATOM | 4553 | N | ASP | B | 96 | −13.887 | 18.777 | −9.171 | 1.00 | 68.39 N |
| ATOM | 4554 | CA | ASP | E | 96 | −14.083 | 19.886 | −10.104 | 1.00 | 79.82 C |
| ATOM | 4555 | C | ASP | B | 96 | −12.836 | 20.759 | −10.010 | 1.00 | 86.51 C |
| ATOM | 4556 | O | ASP | B | 96 | −12.722 | 21.620 | −9.135 | 1.00 | 85.58 O |
| ATOM | 4557 | CB | ASP | B | 96 | −15.357 | 20.661 | −9.776 | 1.00 | 80.34 C |
| ATOM | 4558 | CG | ASP | B | 96 | −15.837 | 21.519 | −10.933 | 1.00 | 87.67 C |
| ATOM | 4559 | OD1 | ASP | B | 96 | −15.005 | 21.897 | −11.786 | 1.00 | 88.63 O |
| ATOM | 4560 | OD2 | ASP | B | 96 | −17.051 | 21.816 | −10.991 | 1.00 | 89.16 O |
| ATOM | 4561 | N | ARG | B | 97 | −11.887 | 20.511 | −10.918 | 1.00 | 91.86 N |
| ATOM | 4562 | CA | ARG | B | 97 | −10.628 | 21.251 | −10.932 | 1.00 | 94.65 C |
| ATOM | 4563 | C | ARG | B | 97 | −10.868 | 22.755 | −10.887 | 1.00 | 99.57 C |
| ATOM | 4564 | O | ARG | B | 97 | −10.281 | 23.472 | −10.069 | 1.00 | 92.70 O |
| ATOM | 4565 | CB | ARG | B | 97 | −9.828 | 20.889 | −12.185 | 1.00 | 96.46 C |
| ATOM | 4566 | CG | ARG | B | 97 | −9.744 | 19.403 | −12.498 | 1.00 | 96.27 C |
| ATOM | 4567 | CD | ARG | B | 97 | −9.235 | 19.202 | −13.920 | 1.00 | 97.31 C |
| ATOM | 4568 | NE | ARG | B | 97 | −8.063 | 20.031 | −14.195 | 1.00 | 93.05 N |
| ATOM | 4569 | CZ | ARG | B | 97 | −6.844 | 19.557 | −14.431 | 1.00 | 87.49 C |
| ATOM | 4570 | NH1 | ARG | B | 97 | −6.628 | 18.248 | −14.446 | 1.00 | 86.18 N |
| ATOM | 4571 | NH2 | ARG | B | 97 | −5.840 | 20.392 | −14.664 | 1.00 | 84.48 N |
| ATOM | 4572 | N | ASP | B | 98 | −11.743 | 23.243 | −11.761 | 1.00 | 111.82 N |
| ATOM | 4573 | CA | ASP | B | 98 | −12.009 | 24.669 | −11.935 | 1.00 | 120.37 C |
| ATOM | 4574 | C | ASP | B | 98 | −13.101 | 25.173 | −11.007 | 1.00 | 120.78 C |
| ATOM | 4575 | O | ASP | B | 98 | −13.956 | 25.961 | −11.422 | 1.00 | 121.70 O |
| ATOM | 4576 | CB | ASP | B | 98 | −12.374 | 24.932 | −13.392 | 1.00 | 125.87 C |
| ATOM | 4577 | CG | ASP | B | 98 | −11.487 | 24.174 | −14.358 | 1.00 | 130.38 C |
| ATOM | 4578 | OD1 | ASP | B | 98 | −10.286 | 24.506 | −14.453 | 1.00 | 131.44 O |
| ATOM | 4579 | OD2 | ASP | B | 98 | −11.987 | 23.230 | −15.007 | 1.00 | 132.64 O |
| ATOM | 4580 | N | MET | B | 99 | −13.096 | 24.739 | −9.750 | 1.00 | 118.52 N |
| ATOM | 4581 | CA | MET | B | 99 | −14.141 | 25.106 | −8.801 | 1.00 | 116.82 C |
| ATOM | 4582 | C | MET | B | 99 | −14.205 | 26.623 | −8.606 | 1.00 | 118.80 C |
| ATOM | 4583 | O | MET | B | 99 | −13.251 | 27.341 | −8.911 | 1.00 | 119.29 O |
| ATOM | 4584 | CB | MET | B | 99 | −13.909 | 24.398 | −7.463 | 1.00 | 112.94 C |
| ATOM | 4585 | CG | MET | B | 99 | −15.118 | 24.392 | −6.549 | 1.00 | 113.55 C |
| ATOM | 4586 | SD | MET | B | 99 | −16.581 | 23.775 | −7.398 | 1.00 | 119.93 S |
| ATOM | 4587 | CE | MET | B | 99 | −17.811 | 23.925 | −6.104 | 1.00 | 120.02 C |
| ATOM | 4588 | OXT | MET | B | 99 | −15.213 | 27.174 | −8.159 | 1.00 | 119.48 O |
| TER | 4589 | | MET | B | 99 | | | | | |
| HETATM | 4590 | O | HOH | S | 1 | −8.520 | 15.267 | 38.319 | 1.00 | 22.66 O |
| HETATM | 4591 | O | HOH | S | 2 | −10.044 | 13.166 | 44.788 | 1.00 | 26.08 O |
| HETATM | 4592 | O | HOH | S | 3 | −10.944 | 4.253 | 25.642 | 1.00 | 27.32 O |

TABLE 17-continued

| | | | | | | | | | | |
|---|---|---|---|---|---|---|---|---|---|---|
| HETATM | 4593 | O | HOH | S | 4 | −10.654 | 0.926 | 32.360 | 1.00 | 28.23 | O |
| HETATM | 4594 | O | HOH | S | 5 | −13.504 | 7.308 | 39.493 | 1.00 | 28.31 | O |
| HETATM | 4595 | O | HOH | S | 6 | −10.172 | 8.453 | 41.487 | 1.00 | 24.98 | O |
| HETATM | 4596 | O | HOH | S | 7 | −11.416 | −2.579 | 34.747 | 1.00 | 25.57 | O |
| HETATM | 4597 | O | HOH | S | 8 | −4.604 | −1.768 | 26.531 | 1.00 | 28.79 | O |
| HETATM | 4598 | O | HOH | S | 9 | −21.676 | 3.465 | 26.360 | 1.00 | 27.63 | O |
| HETATM | 4599 | O | HOH | S | 10 | −19.504 | 11.796 | 22.286 | 1.00 | 29.41 | O |
| HETATM | 4600 | O | HOH | S | 11 | 1.539 | 15.660 | 24.437 | 1.00 | 28.36 | O |
| HETATM | 4601 | O | HOH | S | 12 | −14.466 | 9.187 | 43.764 | 1.00 | 29.42 | O |
| HETATM | 4602 | O | HOH | S | 13 | 3.952 | −17.123 | 50.333 | 1.00 | 29.77 | O |
| HETATM | 4603 | O | HOH | S | 14 | −15.209 | 19.427 | 41.545 | 1.00 | 27.04 | O |
| HETATM | 4604 | O | HOH | S | 15 | 0.130 | 29.026 | 15.465 | 1.00 | 37.04 | O |
| HETATM | 4605 | O | HOH | S | 16 | −8.979 | 14.957 | 11.335 | 1.00 | 40.70 | O |
| HETATM | 4606 | O | HOH | S | 17 | −26.995 | 8.340 | 24.180 | 1.00 | 29.10 | O |
| HETATM | 4607 | O | HOH | S | 18 | −5.568 | −9.538 | 29.292 | 1.00 | 28.08 | O |
| HETATM | 4608 | O | HOH | S | 19 | −0.834 | 4.351 | 31.883 | 1.00 | 29.58 | O |
| HETATM | 4609 | O | HOH | S | 20 | −3.034 | 37.782 | 28.217 | 1.00 | 36.05 | O |
| HETATM | 4610 | O | HOH | S | 21 | −14.443 | −7.082 | 47.515 | 1.00 | 32.39 | O |
| HETATM | 4611 | O | HOH | S | 22 | 5.324 | −11.161 | 43.943 | 1.00 | 27.87 | O |
| HETATM | 4612 | O | HOH | S | 23 | −3.533 | 3.130 | 38.136 | 1.00 | 27.73 | O |
| HETATM | 4613 | O | HOH | S | 24 | −18.279 | 7.710 | 16.984 | 1.00 | 36.50 | O |
| HETATM | 4614 | O | HOH | S | 25 | −6.529 | 2.253 | 42.047 | 1.00 | 32.21 | O |
| HETATM | 4615 | O | HOH | S | 26 | −16.218 | 11.194 | 44.587 | 1.00 | 27.88 | O |
| HETATM | 4616 | O | HOH | S | 27 | −13.039 | 21.339 | 43.445 | 1.00 | 28.46 | O |
| HETATM | 4617 | O | HOH | S | 28 | −23.676 | 2.808 | 35.694 | 1.00 | 34.92 | O |
| HETATM | 4618 | O | HOH | S | 29 | −30.485 | 12.985 | 28.809 | 1.00 | 31.77 | O |
| HETATM | 4619 | O | HOH | S | 30 | −5.900 | 2.532 | 44.651 | 1.00 | 31.44 | O |
| HETATM | 4620 | O | HOH | S | 31 | −12.654 | −7.808 | 45.501 | 1.00 | 30.45 | O |
| HETATM | 4621 | O | HOH | S | 32 | −9.951 | −0.195 | 35.109 | 1.00 | 26.57 | O |
| HETATM | 4622 | O | HOH | S | 33 | −3.988 | 18.235 | 39.574 | 1.00 | 26.44 | O |
| HETATM | 4623 | O | HOH | S | 34 | −4.733 | 15.733 | 40.815 | 1.00 | 24.80 | O |
| HETATM | 4624 | O | HOH | S | 35 | −16.600 | −0.200 | 28.306 | 1.00 | 33.29 | O |
| HETATM | 4625 | O | HOH | S | 36 | −9.648 | 0.864 | 44.071 | 1.00 | 28.61 | O |
| HETATM | 4626 | O | HOH | S | 37 | 3.270 | −3.449 | 41.188 | 1.00 | 31.66 | O |
| HETATM | 4627 | O | HOH | S | 38 | −12.808 | 9.242 | 41.552 | 1.00 | 27.16 | O |
| HETATM | 4628 | O | HOH | S | 39 | 6.791 | −26.861 | 39.476 | 1.00 | 41.98 | O |
| HETATM | 4629 | O | HOH | S | 40 | −1.889 | 1.052 | 35.509 | 1.00 | 30.48 | O |
| HETATM | 4630 | O | HOH | S | 41 | −15.075 | 24.357 | 30.033 | 1.00 | 31.67 | O |
| HETATM | 4631 | O | HOH | S | 42 | 4.673 | −3.349 | 38.487 | 1.00 | 34.42 | O |
| HETATM | 4632 | O | HOH | S | 43 | −20.192 | 19.478 | 27.725 | 1.00 | 31.81 | O |
| HETATM | 4633 | O | HOH | S | 44 | −0.913 | 17.708 | 35.305 | 1.00 | 31.29 | O |
| HETATM | 4634 | O | HOH | S | 45 | −8.099 | −0.242 | 19.085 | 1.00 | 33.59 | O |
| HETATM | 4635 | O | HOH | S | 46 | −16.421 | −4.553 | 23.692 | 1.00 | 39.57 | O |
| HETATM | 4636 | O | HOH | S | 47 | −17.520 | 4.072 | 37.258 | 1.00 | 31.65 | O |
| HETATM | 4637 | O | HOH | S | 48 | −13.172 | −10.131 | 44.186 | 1.00 | 29.31 | O |
| HETATM | 4638 | O | HOH | S | 49 | 9.049 | 21.115 | 22.277 | 1.00 | 34.99 | O |
| HETATM | 4639 | O | HOH | S | 50 | −14.260 | 10.795 | 33.005 | 1.00 | 28.84 | O |
| HETATM | 4640 | O | HOH | S | 51 | −15.433 | −1.312 | 23.236 | 1.00 | 31.61 | O |
| HETATM | 4641 | O | HOH | S | 52 | −6.412 | 2.797 | 24.191 | 1.00 | 33.92 | O |
| HETATM | 4642 | O | HOH | S | 53 | −10.218 | 12.449 | 18.901 | 1.00 | 30.98 | O |
| HETATM | 4643 | O | HOH | S | 54 | 8.997 | −10.831 | 35.874 | 1.00 | 45.79 | O |
| HETATM | 4644 | O | HOH | S | 55 | 3.530 | −0.825 | 38.447 | 1.00 | 31.71 | O |
| HETATM | 4645 | O | HOH | S | 56 | −5.584 | 12.403 | 34.627 | 1.00 | 41.01 | O |
| HETATM | 4646 | O | HOH | S | 57 | −12.286 | 1.407 | 14.663 | 1.00 | 38.47 | O |
| HETATM | 4647 | O | HOH | S | 58 | −16.000 | −9.871 | 44.325 | 1.00 | 37.15 | O |
| HETATM | 4648 | O | HOH | S | 59 | −10.495 | 11.984 | 34.782 | 1.00 | 34.67 | O |
| HETATM | 4649 | O | HOH | S | 60 | −14.451 | 5.940 | 14.226 | 1.00 | 47.87 | O |
| HETATM | 4650 | O | HOH | S | 61 | −15.960 | −8.868 | 48.896 | 1.00 | 41.26 | O |
| HETATM | 4651 | O | HOH | S | 62 | −5.852 | 24.055 | 42.059 | 1.00 | 33.46 | O |
| HETATM | 4652 | O | HOH | S | 63 | −12.729 | −1.003 | 32.365 | 1.00 | 32.00 | O |
| HETATM | 4653 | O | HOH | S | 64 | 0.571 | −24.676 | 29.056 | 1.00 | 46.79 | O |
| HETATM | 4654 | O | HOH | S | 65 | −6.207 | 14.822 | 53.852 | 1.00 | 45.78 | O |
| HETATM | 4655 | O | HOH | S | 66 | −26.378 | 11.205 | 24.857 | 1.00 | 32.37 | O |
| HETATM | 4656 | O | HOH | S | 67 | −8.595 | 1.403 | 23.459 | 1.00 | 45.12 | O |
| HETATM | 4657 | O | HOH | S | 68 | −4.788 | 0.805 | 35.455 | 1.00 | 29.41 | O |
| HETATM | 4658 | O | HOH | S | 69 | 8.615 | −13.034 | 36.610 | 1.00 | 35.60 | O |
| HETATM | 4659 | O | HOH | S | 70 | −0.589 | 3.246 | 18.720 | 1.00 | 45.26 | O |
| HETATM | 4660 | O | HOH | S | 71 | −16.794 | 19.196 | 12.142 | 1.00 | 37.20 | O |
| HETATM | 4661 | O | HOH | S | 72 | −1.205 | −12.484 | 51.008 | 1.00 | 43.44 | O |
| HETATM | 4662 | O | HOH | S | 73 | −0.069 | 32.763 | 32.989 | 1.00 | 30.32 | O |
| HETATM | 4663 | O | HOH | S | 74 | −3.718 | 39.428 | 24.112 | 1.00 | 40.29 | O |
| HETATM | 4664 | O | HOH | S | 75 | −26.835 | 0.467 | 23.183 | 1.00 | 42.54 | O |
| HETATM | 4665 | O | HOH | S | 76 | −14.670 | −12.864 | 40.973 | 1.00 | 35.64 | O |
| HETATM | 4666 | O | HOH | S | 77 | −22.848 | 10.729 | 42.725 | 1.00 | 39.00 | O |
| HETATM | 4667 | O | HOH | S | 78 | −22.068 | 7.732 | 19.122 | 1.00 | 35.62 | O |
| HETATM | 4668 | O | HOH | S | 79 | −9.109 | −19.969 | 40.230 | 1.00 | 44.59 | O |
| HETATM | 4669 | O | HOH | S | 80 | −11.183 | 30.201 | 32.537 | 1.00 | 33.07 | O |
| HETATM | 4670 | O | HOH | S | 81 | −10.149 | 5.756 | 58.870 | 1.00 | 44.24 | O |
| HETATM | 4671 | O | HOH | S | 82 | −20.117 | 22.258 | 40.837 | 1.00 | 43.07 | O |
| HETATM | 4672 | O | HOH | S | 83 | −9.306 | −12.704 | 51.342 | 1.00 | 37.72 | O |

TABLE 17-continued

| | | | | | | | | | | |
|---|---|---|---|---|---|---|---|---|---|---|
| HETATM | 4673 | O | HOH | S | 84 | 6.542 | −10.717 | 41.562 | 1.00 | 36.27 | O |
| HETATM | 4674 | O | HOH | S | 85 | −12.401 | −4.131 | 20.043 | 1.00 | 40.18 | O |
| HETATM | 4675 | O | HOH | S | 86 | 1.946 | 0.497 | 36.672 | 1.00 | 43.15 | O |
| HETATM | 4676 | O | HOH | S | 87 | −0.330 | 5.954 | 18.493 | 1.00 | 33.97 | O |
| HETATM | 4677 | O | HOH | S | 88 | −10.333 | 14.933 | 35.829 | 1.00 | 34.94 | O |
| HETATM | 4678 | O | HOH | S | 89 | −22.068 | 20.445 | 29.593 | 1.00 | 40.44 | O |
| HETATM | 4679 | O | HOH | S | 90 | −8.212 | 1.735 | 27.662 | 1.00 | 33.93 | O |
| HETATM | 4680 | O | HOH | S | 91 | −10.391 | −14.735 | 57.878 | 1.00 | 42.24 | O |
| HETATM | 4681 | O | HOH | S | 92 | −12.436 | 11.099 | 53.987 | 1.00 | 41.68 | O |
| HETATM | 4682 | O | HOH | S | 93 | 3.072 | −1.320 | 27.454 | 1.00 | 43.55 | O |
| HETATM | 4683 | O | HOH | S | 94 | 3.651 | 11.035 | 41.000 | 1.00 | 39.57 | O |
| HETATM | 4684 | O | HOH | S | 95 | −3.258 | 35.352 | 33.865 | 1.00 | 33.35 | O |
| HETATM | 4685 | O | HOH | S | 96 | −9.844 | 11.338 | 54.787 | 1.00 | 37.75 | O |
| HETATM | 4686 | O | HOH | S | 97 | 8.437 | −9.752 | 37.758 | 1.00 | 54.54 | O |
| HETATM | 4687 | O | HOH | S | 98 | −11.858 | 21.660 | 46.146 | 1.00 | 37.98 | O |
| HETATM | 4688 | O | HOH | S | 99 | 6.442 | −7.797 | 45.811 | 1.00 | 43.10 | O |
| HETATM | 4689 | O | HOH | S | 100 | −5.524 | 24.747 | 19.738 | 1.00 | 35.42 | O |
| HETATM | 4690 | O | HOH | S | 101 | −0.152 | 30.669 | 34.286 | 1.00 | 37.74 | O |
| HETATM | 4691 | O | HOH | S | 102 | −17.094 | −15.594 | 35.262 | 1.00 | 45.05 | O |
| HETATM | 4692 | O | HOH | S | 103 | 7.993 | −18.793 | 24.266 | 1.00 | 47.40 | O |
| HETATM | 4693 | O | HOH | S | 104 | −26.296 | 12.281 | 27.331 | 1.00 | 40.80 | O |
| HETATM | 4694 | O | HOH | S | 105 | 10.726 | 13.949 | 33.043 | 1.00 | 45.74 | O |
| HETATM | 4695 | O | HOH | S | 106 | 3.538 | −12.723 | 25.801 | 1.00 | 38.63 | O |
| HETATM | 4696 | O | HOH | S | 107 | −1.713 | 20.096 | 11.724 | 1.00 | 41.13 | O |
| HETATM | 4697 | O | HOH | S | 108 | −16.332 | 6.644 | 54.324 | 1.00 | 35.55 | O |
| HETATM | 4698 | O | HOH | S | 109 | 11.976 | 14.676 | 28.498 | 1.00 | 36.97 | O |
| HETATM | 4699 | O | HOH | S | 110 | −0.480 | −22.542 | 28.501 | 1.00 | 43.69 | O |
| HETATM | 4700 | O | HOH | S | 111 | −15.729 | 9.145 | 55.046 | 1.00 | 47.55 | O |
| HETATM | 4701 | O | HOH | S | 112 | −8.053 | 9.697 | 59.948 | 1.00 | 49.06 | O |
| HETATM | 4702 | O | HOH | S | 113 | 6.426 | −28.253 | 37.372 | 1.00 | 42.45 | O |
| HETATM | 4703 | O | HOH | S | 114 | −3.493 | 14.175 | 11.437 | 1.00 | 47.18 | O |
| HETATM | 4704 | O | HOH | S | 115 | 4.879 | −26.214 | 27.808 | 1.00 | 50.31 | O |
| HETATM | 4705 | O | HOH | S | 116 | −15.855 | 21.086 | 43.588 | 1.00 | 36.66 | O |
| HETATM | 4706 | O | HOH | S | 117 | −26.159 | 16.060 | 30.418 | 1.00 | 49.80 | O |
| HETATM | 4707 | O | HOH | S | 118 | −18.136 | 1.818 | 55.783 | 1.00 | 44.87 | O |
| HETATM | 4708 | O | HOH | S | 119 | −6.630 | −25.667 | 36.070 | 1.00 | 41.38 | O |
| HETATM | 4709 | O | HOH | S | 120 | −15.370 | 16.482 | 49.899 | 1.00 | 42.83 | O |
| HETATM | 4710 | O | HOH | S | 121 | −16.776 | −11.380 | 42.247 | 1.00 | 40.29 | O |
| HETATM | 4711 | O | HOH | S | 122 | 12.387 | 16.435 | 26.670 | 1.00 | 35.79 | O |
| HETATM | 4712 | O | HOH | S | 123 | 6.328 | 7.970 | 32.747 | 1.00 | 41.33 | O |
| HETATM | 4713 | O | HOH | S | 124 | −11.311 | 32.791 | 32.493 | 1.00 | 49.87 | O |
| HETATM | 4714 | O | HOH | S | 125 | −18.314 | −8.086 | 49.895 | 1.00 | 41.31 | O |
| HETATM | 4715 | O | HOH | S | 126 | −9.639 | −1.374 | 37.972 | 1.00 | 33.31 | O |
| HETATM | 4716 | O | HOH | S | 127 | −4.958 | −21.521 | 42.134 | 1.00 | 44.02 | O |
| HETATM | 4717 | O | HOH | S | 128 | −11.720 | −12.321 | 52.354 | 1.00 | 42.80 | O |
| HETATM | 4718 | O | HOH | S | 129 | 11.593 | −15.179 | 35.968 | 1.00 | 50.33 | O |
| HETATM | 4719 | O | HOH | S | 130 | −17.719 | 23.004 | 42.531 | 1.00 | 37.84 | O |
| HETATM | 4720 | O | HOH | S | 131 | −8.860 | 13.927 | 53.574 | 1.00 | 47.22 | O |
| HETATM | 4721 | O | HOH | S | 132 | 10.401 | −21.885 | 40.614 | 1.00 | 51.03 | O |
| HETATM | 4722 | O | HOH | S | 133 | 5.128 | −22.485 | 23.700 | 1.00 | 52.77 | O |
| HETATM | 4723 | O | HOH | S | 134 | 12.921 | −15.949 | 29.339 | 1.00 | 54.15 | O |
| HETATM | 4724 | O | HOH | S | 135 | −19.044 | −12.569 | 34.818 | 1.00 | 36.72 | O |
| HETATM | 4725 | O | HOH | S | 136 | 7.400 | 26.858 | 30.131 | 1.00 | 37.59 | O |
| HETATM | 4726 | O | HOH | S | 137 | 8.241 | 9.969 | 31.923 | 1.00 | 38.79 | O |
| HETATM | 4727 | O | HOH | S | 138 | −8.039 | 34.042 | 23.049 | 1.00 | 54.37 | O |
| HETATM | 4728 | O | HOH | S | 139 | −11.527 | −17.116 | 39.511 | 1.00 | 46.07 | O |
| HETATM | 4729 | O | HOH | S | 140 | −3.372 | 11.836 | 60.693 | 1.00 | 51.53 | O |
| HETATM | 4730 | O | HOH | S | 141 | −1.799 | 17.993 | 38.325 | 1.00 | 39.49 | O |
| HETATM | 4731 | O | HOH | S | 142 | −2.535 | 3.232 | 33.675 | 1.00 | 36.13 | O |
| HETATM | 4732 | O | HOH | S | 143 | 6.843 | 8.157 | 20.147 | 1.00 | 40.34 | O |
| HETATM | 4733 | O | HOH | S | 144 | −20.928 | −11.473 | 36.319 | 1.00 | 38.23 | O |
| HETATM | 4734 | O | HOH | S | 145 | −18.196 | 30.741 | 35.717 | 1.00 | 42.57 | O |
| HETATM | 4735 | O | HOH | S | 146 | 2.745 | −24.105 | 26.579 | 1.00 | 57.39 | O |
| HETATM | 4736 | O | HOH | S | 147 | 2.666 | 37.667 | 20.811 | 1.00 | 45.46 | O |
| HETATM | 4737 | O | HOH | S | 148 | −0.481 | 39.894 | 17.089 | 1.00 | 58.52 | O |
| HETATM | 4738 | O | HOH | S | 149 | −16.325 | 20.465 | 46.111 | 1.00 | 40.61 | O |
| HETATM | 4739 | O | HOH | S | 150 | −2.529 | 26.586 | 38.609 | 1.00 | 47.22 | O |
| HETATM | 4740 | O | HOH | S | 151 | −3.484 | 19.319 | 42.052 | 1.00 | 40.41 | O |
| HETATM | 4741 | O | HOH | S | 152 | −16.553 | −0.566 | 25.594 | 1.00 | 39.20 | O |
| HETATM | 4742 | O | HOH | S | 153 | −8.449 | 19.008 | 47.962 | 1.00 | 43.55 | O |
| HETATM | 4743 | O | HOH | S | 154 | −3.109 | 21.686 | 6.096 | 1.00 | 47.51 | O |
| HETATM | 4744 | O | HOH | S | 155 | 5.491 | 13.945 | 29.508 | 1.00 | 34.94 | O |
| HETATM | 4745 | O | HOH | S | 156 | 9.513 | 33.368 | 20.969 | 1.00 | 51.65 | O |
| HETATM | 4746 | O | HOH | S | 157 | −16.917 | 9.923 | 51.475 | 1.00 | 51.58 | O |
| HETATM | 4747 | O | HOH | S | 158 | −23.535 | −0.808 | 24.158 | 1.00 | 42.61 | O |
| HETATM | 4748 | O | HOH | S | 159 | 0.304 | 1.809 | 12.570 | 1.00 | 54.86 | O |
| HETATM | 4749 | O | HOH | S | 160 | −8.196 | −13.595 | 25.205 | 1.00 | 44.47 | O |
| HETATM | 4750 | O | HOH | S | 162 | −22.657 | 2.926 | 38.140 | 1.00 | 41.04 | O |
| HETATM | 4751 | O | HOH | S | 163 | −7.297 | 30.337 | 13.155 | 1.00 | 51.90 | O |
| HETATM | 4752 | O | HOH | S | 164 | 0.669 | 24.246 | 10.655 | 1.00 | 47.50 | O |

TABLE 17-continued

| | | | | | | | | | | |
|---|---|---|---|---|---|---|---|---|---|---|
| HETATM | 4753 | O | HOH | S | 165 | 2.382 | −8.213 | 59.954 | 1.00 | 53.89 O |
| HETATM | 4754 | O | HOH | S | 166 | 8.984 | −17.642 | 41.583 | 1.00 | 44.28 O |
| HETATM | 4755 | O | HOH | S | 167 | 6.364 | −2.317 | 51.923 | 1.00 | 51.89 O |
| HETATM | 4756 | O | HOH | S | 168 | 6.421 | 13.978 | 31.636 | 1.00 | 51.29 O |
| HETATM | 4757 | O | HOH | S | 169 | −19.022 | 5.961 | 50.798 | 1.00 | 44.57 O |
| HETATM | 4758 | O | HOH | S | 170 | −22.629 | 5.068 | 17.786 | 1.00 | 41.72 O |
| HETATM | 4759 | O | HOH | S | 171 | −2.957 | 16.630 | 1.503 | 1.00 | 54.65 O |
| HETATM | 4760 | O | HOH | S | 172 | −14.092 | −1.808 | 34.076 | 1.00 | 37.28 O |
| HETATM | 4761 | O | HOH | S | 173 | −18.973 | 1.738 | 48.257 | 1.00 | 46.09 O |
| HETATM | 4762 | O | HOH | S | 174 | −8.083 | 8.774 | 12.690 | 1.00 | 42.50 O |
| HETATM | 4763 | O | HOH | S | 175 | −6.769 | −2.384 | 25.729 | 1.00 | 45.10 O |
| HETATM | 4764 | O | HOH | S | 176 | −5.232 | 20.618 | 45.583 | 1.00 | 43.54 O |
| HETATM | 4765 | O | HOH | S | 177 | 0.702 | 15.167 | 47.410 | 1.00 | 45.83 O |
| HETATM | 4766 | O | HOH | S | 178 | −25.704 | 3.011 | 19.346 | 1.00 | 51.17 O |
| HETATM | 4767 | O | HOH | S | 179 | 3.434 | 13.678 | 48.047 | 1.00 | 50.89 O |
| HETATM | 4768 | O | HOH | S | 180 | −5.985 | 16.096 | 45.348 | 1.00 | 32.15 O |
| HETATM | 4769 | O | HOH | S | 181 | −7.911 | 23.503 | −4.434 | 1.00 | 65.63 O |
| HETATM | 4770 | O | HOH | S | 182 | 6.420 | 29.133 | 31.748 | 1.00 | 52.22 O |
| HETATM | 4771 | O | HOH | S | 183 | 6.032 | 0.888 | 37.392 | 1.00 | 54.53 O |
| HETATM | 4772 | O | HOH | S | 184 | −6.793 | −7.444 | 23.115 | 1.00 | 43.77 O |
| HETATM | 4773 | O | HOH | S | 185 | −9.702 | 22.530 | 49.025 | 1.00 | 45.73 O |
| HETATM | 4774 | O | HOH | S | 186 | −1.984 | 16.458 | 43.923 | 1.00 | 41.40 O |
| HETATM | 4775 | O | HOH | S | 187 | 3.252 | −11.043 | 51.259 | 1.00 | 42.59 O |
| HETATM | 4776 | O | HOH | S | 188 | −10.231 | 30.612 | 35.434 | 1.00 | 51.58 O |
| HETATM | 4777 | O | HOH | S | 189 | −16.518 | −5.766 | 46.605 | 1.00 | 39.56 O |
| HETATM | 4778 | O | HOH | S | 190 | 9.695 | 17.976 | 28.373 | 1.00 | 50.73 O |
| HETATM | 4779 | O | HOH | S | 191 | 6.484 | 11.149 | 33.331 | 1.00 | 58.09 O |
| HETATM | 4780 | O | HOH | S | 192 | 3.404 | 11.742 | 37.534 | 1.00 | 65.62 O |
| HETATM | 4781 | O | HOH | S | 194 | 14.167 | −21.512 | 33.906 | 1.00 | 44.60 O |
| HETATM | 4782 | O | HOH | S | 195 | 3.285 | 2.639 | 58.492 | 1.00 | 48.69 O |
| HETATM | 4783 | O | HOH | S | 196 | −3.904 | −19.307 | 42.658 | 1.00 | 48.66 O |
| HETATM | 4784 | O | HOH | S | 197 | −5.231 | −24.941 | 32.876 | 1.00 | 57.69 O |
| HETATM | 4785 | O | HOH | S | 198 | −19.863 | −3.840 | 36.083 | 1.00 | 40.31 O |
| HETATM | 4786 | O | HOH | S | 199 | 3.755 | 9.113 | 48.196 | 1.00 | 41.54 O |
| HETATM | 4787 | O | HOH | S | 200 | 5.111 | −9.858 | 51.839 | 1.00 | 65.37 O |
| HETATM | 4788 | O | HOH | S | 201 | −6.400 | 31.589 | 20.776 | 1.00 | 55.36 O |
| HETATM | 4789 | O | HOH | S | 202 | −5.683 | 29.743 | 19.019 | 1.00 | 52.26 O |
| HETATM | 4790 | O | HOH | S | 203 | −19.585 | 29.186 | 32.617 | 1.00 | 52.97 O |
| HETATM | 4791 | O | HOH | S | 204 | −24.271 | 19.451 | 22.663 | 1.00 | 43.48 O |
| HETATM | 4792 | O | HOH | S | 205 | 2.051 | −1.272 | 25.158 | 1.00 | 59.79 O |
| HETATM | 4793 | O | HOH | S | 206 | 0.903 | 17.865 | 32.237 | 1.00 | 39.41 O |
| HETATM | 4794 | O | HOH | S | 207 | −9.846 | 36.317 | 30.549 | 1.00 | 53.98 O |
| HETATM | 4795 | O | HOH | S | 208 | −15.873 | 19.107 | −3.678 | 1.00 | 54.81 O |
| HETATM | 4796 | O | HOH | S | 209 | −4.748 | 37.253 | 18.575 | 1.00 | 59.22 O |
| HETATM | 4797 | O | HOH | S | 210 | 4.714 | −28.175 | 40.532 | 1.00 | 38.29 O |
| HETATM | 4798 | O | HOH | S | 211 | −3.379 | −22.608 | 29.002 | 1.00 | 52.39 O |
| HETATM | 4799 | O | HOH | S | 212 | −0.350 | 8.756 | −1.804 | 1.00 | 59.77 O |
| HETATM | 4800 | O | HOH | S | 213 | −18.516 | 20.861 | 10.983 | 1.00 | 56.66 O |
| HETATM | 4801 | O | HOH | S | 214 | −4.532 | −0.476 | 24.521 | 1.00 | 48.83 O |
| HETATM | 4802 | O | HOH | S | 215 | −0.029 | 14.897 | 49.792 | 1.00 | 48.86 O |
| HETATM | 4803 | O | HOH | S | 216 | −16.831 | −10.545 | 46.736 | 1.00 | 62.49 O |
| HETATM | 4804 | O | HOH | S | 217 | −20.954 | 15.831 | 46.555 | 1.00 | 41.98 O |
| HETATM | 4805 | O | HOH | S | 218 | 3.735 | −28.280 | 36.291 | 1.00 | 50.24 O |
| HETATM | 4806 | O | HOH | S | 219 | 10.239 | 6.743 | 48.437 | 1.00 | 46.87 O |
| HETATM | 4807 | O | HOH | S | 220 | −19.384 | 0.055 | 46.230 | 1.00 | 51.49 O |
| HETATM | 4808 | O | HOH | S | 221 | −8.948 | 21.717 | −6.562 | 1.00 | 61.46 O |
| HETATM | 4809 | O | HOH | S | 222 | 1.011 | 19.246 | 12.233 | 1.00 | 44.83 O |
| HETATM | 4810 | O | HOH | S | 223 | −28.072 | 7.114 | 38.150 | 1.00 | 72.88 O |
| HETATM | 4811 | O | HOH | S | 224 | −11.170 | −19.122 | 32.653 | 1.00 | 46.32 O |
| HETATM | 4812 | O | HOH | S | 225 | −6.902 | 17.148 | 47.817 | 1.00 | 45.42 O |
| HETATM | 4813 | O | HOH | S | 226 | −18.479 | 5.723 | 15.356 | 1.00 | 50.30 O |
| HETATM | 4814 | O | HOH | S | 227 | −18.525 | 10.116 | 45.697 | 1.00 | 40.98 O |
| HETATM | 4815 | O | HOH | S | 228 | −0.514 | −2.347 | 24.055 | 1.00 | 57.69 O |
| HETATM | 4816 | O | HOH | S | 229 | 9.807 | −15.810 | 45.968 | 1.00 | 48.74 O |
| HETATM | 4817 | O | HOH | S | 230 | 9.114 | 28.968 | 26.533 | 1.00 | 45.28 O |
| HETATM | 4818 | O | HOH | S | 231 | −5.928 | 8.089 | 13.672 | 1.00 | 44.86 O |
| HETATM | 4819 | O | HOH | S | 232 | −12.622 | −13.134 | 54.881 | 1.00 | 50.04 O |
| HETATM | 4820 | O | HOH | S | 233 | 0.141 | 8.765 | 61.178 | 1.00 | 56.99 O |
| HETATM | 4821 | O | HOH | S | 234 | 9.211 | 24.936 | 13.911 | 1.00 | 66.52 O |
| HETATM | 4822 | O | HOH | S | 235 | −18.461 | 28.429 | 39.260 | 1.00 | 55.68 O |
| HETATM | 4823 | O | HOH | S | 236 | 5.359 | 2.049 | 34.932 | 1.00 | 44.66 O |
| HETATM | 4824 | O | HOH | S | 237 | 14.988 | −29.488 | 37.040 | 1.00 | 57.23 O |
| HETATM | 4825 | O | HOH | S | 238 | −28.947 | 1.377 | 36.063 | 1.00 | 60.67 O |
| HETATM | 4826 | O | HOH | S | 239 | −18.533 | 25.641 | 30.275 | 1.00 | 48.33 O |
| HETATM | 4827 | O | HOH | S | 240 | 6.463 | 36.071 | 20.262 | 1.00 | 56.34 O |
| HETATM | 4828 | O | HOH | S | 241 | −30.695 | 5.782 | 24.428 | 1.00 | 47.57 O |
| HETATM | 4829 | O | HOH | S | 242 | −21.632 | 23.245 | 28.613 | 1.00 | 48.53 O |
| HETATM | 4830 | O | HOH | S | 243 | 10.169 | 11.218 | 42.967 | 1.00 | 66.73 O |
| HETATM | 4831 | O | HOH | S | 244 | −22.087 | 17.763 | 45.929 | 1.00 | 56.24 O |
| HETATM | 4832 | O | HOH | S | 245 | 1.948 | −5.409 | 63.499 | 1.00 | 76.36 O |

TABLE 17-continued

| | | | | | | | | | | |
|---|---|---|---|---|---|---|---|---|---|---|
| HETATM | 4833 | O | HOH | S | 246 | 7.673 | 6.851 | 54.494 | 1.00 | 67.46 | O |
| HETATM | 4834 | O | HOH | S | 247 | −15.596 | −14.982 | 24.114 | 1.00 | 47.99 | O |
| HETATM | 4835 | O | HOH | S | 248 | 7.044 | 5.248 | 52.766 | 1.00 | 53.81 | O |
| HETATM | 4836 | O | HOH | S | 249 | −4.337 | 39.774 | 26.791 | 1.00 | 45.69 | O |
| HETATM | 4837 | O | HOH | S | 250 | −13.250 | 9.124 | 55.546 | 1.00 | 40.89 | O |
| HETATM | 4838 | O | HOH | S | 251 | −20.350 | 4.277 | 16.814 | 1.00 | 46.14 | O |
| HETATM | 4839 | O | HOH | S | 252 | −24.756 | 20.055 | 30.016 | 1.00 | 44.66 | O |
| HETATM | 4840 | O | HOH | S | 253 | −3.156 | 11.278 | 32.801 | 1.00 | 36.66 | O |
| HETATM | 4841 | O | HOH | S | 254 | −4.269 | 1.954 | 25.030 | 1.00 | 54.35 | O |
| HETATM | 4842 | O | HOH | S | 255 | −18.833 | 7.906 | 44.490 | 1.00 | 55.67 | O |
| HETATM | 4843 | O | HOH | S | 256 | 2.348 | 3.507 | 15.043 | 1.00 | 46.43 | O |
| HETATM | 4844 | O | HOH | S | 257 | −19.041 | −5.372 | 47.684 | 1.00 | 44.66 | O |
| HETATM | 4845 | O | HOH | S | 258 | −2.267 | 2.419 | 62.735 | 1.00 | 49.68 | O |
| HETATM | 4846 | O | HOH | S | 259 | −3.844 | −7.508 | 22.742 | 1.00 | 49.64 | O |
| HETATM | 4847 | O | HOH | S | 260 | −7.672 | 23.669 | 18.255 | 1.00 | 46.26 | O |
| HETATM | 4848 | O | HOH | S | 261 | −18.194 | −2.667 | 24.777 | 1.00 | 53.91 | O |
| HETATM | 4849 | O | HOH | S | 262 | 14.097 | 17.705 | 28.187 | 1.00 | 53.27 | O |
| HETATM | 4850 | O | HOH | S | 263 | −18.103 | 8.637 | 48.217 | 1.00 | 44.96 | O |
| HETATM | 4851 | O | HOH | S | 264 | −7.421 | −4.885 | 24.289 | 1.00 | 52.85 | O |
| HETATM | 4852 | O | HOH | S | 265 | 3.096 | 35.159 | 20.398 | 1.00 | 40.69 | O |
| HETATM | 4853 | O | HOH | S | 266 | 9.109 | 27.711 | 28.772 | 1.00 | 46.48 | O |
| HETATM | 4854 | O | HOH | S | 267 | −22.198 | −5.577 | 39.739 | 1.00 | 49.25 | O |
| HETATM | 4855 | O | HOH | S | 268 | −23.214 | 18.793 | 11.846 | 1.00 | 56.18 | O |
| HETATM | 4856 | O | HOH | S | 269 | −8.458 | −12.847 | 70.170 | 1.00 | 65.16 | O |
| HETATM | 4857 | O | HOH | S | 270 | −15.911 | −9.115 | 56.013 | 1.00 | 53.30 | O |
| HETATM | 4858 | O | HOH | S | 271 | −21.261 | 5.481 | 10.143 | 1.00 | 51.60 | O |
| HETATM | 4859 | O | HOH | S | 272 | −9.460 | −5.799 | 23.340 | 1.00 | 48.33 | O |
| HETATM | 4860 | O | HOH | S | 273 | −21.323 | 5.906 | 39.345 | 1.00 | 44.03 | O |
| HETATM | 4861 | O | HOH | S | 274 | −0.934 | 20.102 | 36.999 | 1.00 | 50.54 | O |
| HETATM | 4862 | O | HOH | S | 275 | −20.976 | 1.114 | 25.256 | 1.00 | 43.15 | O |
| HETATM | 4863 | O | HOH | S | 276 | 1.490 | 17.595 | 35.172 | 1.00 | 46.75 | O |
| HETATM | 4864 | O | HOH | S | 277 | −12.154 | −11.941 | 45.391 | 1.00 | 43.07 | O |
| HETATM | 4865 | O | HOH | S | 278 | −1.935 | 23.176 | 10.404 | 1.00 | 52.02 | O |
| HETATM | 4866 | O | HOH | S | 279 | −22.126 | 3.986 | 12.301 | 1.00 | 53.71 | O |
| HETATM | 4867 | O | HOH | S | 280 | −7.209 | 25.151 | −5.721 | 1.00 | 75.52 | O |
| HETATM | 4868 | O | HOH | S | 281 | 6.640 | 14.893 | 13.290 | 1.00 | 54.06 | O |
| HETATM | 4869 | O | HOH | S | 282 | −13.070 | 9.587 | 58.356 | 1.00 | 53.53 | O |
| HETATM | 4870 | O | HOH | S | 283 | −12.223 | −21.503 | 38.498 | 1.00 | 53.34 | O |
| HETATM | 4871 | O | HOH | S | 284 | −2.655 | 22.484 | −16.640 | 1.00 | 81.38 | O |
| HETATM | 4872 | O | HOH | S | 285 | −16.304 | −16.492 | 30.110 | 1.00 | 47.57 | O |
| HETATM | 4873 | O | HOH | S | 286 | 1.706 | 12.144 | 39.517 | 1.00 | 53.15 | O |
| HETATM | 4874 | O | HOH | S | 287 | −8.496 | 17.223 | 50.683 | 1.00 | 50.08 | O |
| HETATM | 4875 | O | HOH | S | 288 | −28.810 | 12.650 | 39.762 | 1.00 | 52.36 | O |
| HETATM | 4876 | O | HOH | S | 289 | −19.740 | −15.415 | 34.729 | 1.00 | 54.13 | O |
| HETATM | 4877 | O | HOH | S | 290 | −16.235 | 18.934 | 4.367 | 1.00 | 50.73 | O |
| HETATM | 4878 | O | HOH | S | 291 | 5.018 | −5.266 | 45.435 | 1.00 | 47.28 | O |
| HETATM | 4879 | O | HOH | S | 292 | −4.499 | 18.096 | 44.266 | 1.00 | 45.85 | O |
| HETATM | 4880 | O | HOH | S | 293 | −11.382 | −16.320 | 56.413 | 1.00 | 51.18 | O |
| HETATM | 4881 | O | HOH | S | 294 | −17.296 | −7.803 | 24.576 | 1.00 | 70.10 | O |
| HETATM | 4882 | O | HOH | S | 295 | 5.482 | −4.310 | 48.021 | 1.00 | 47.68 | O |
| HETATM | 4883 | O | HOH | S | 296 | −30.178 | 0.823 | 23.928 | 1.00 | 52.40 | O |
| HETATM | 4884 | O | HOH | S | 297 | −8.987 | 24.283 | 50.757 | 1.00 | 66.06 | O |
| HETATM | 4885 | O | HOH | S | 298 | −9.307 | −18.655 | 56.403 | 1.00 | 51.22 | O |
| HETATM | 4886 | O | HOH | S | 299 | 10.296 | −24.040 | 41.936 | 1.00 | 50.68 | O |
| HETATM | 4887 | O | HOH | S | 300 | 5.306 | 2.048 | 25.610 | 1.00 | 52.15 | O |
| HETATM | 4888 | O | HOH | S | 301 | −18.589 | 19.281 | −2.583 | 1.00 | 63.31 | O |
| HETATM | 4889 | O | HOH | S | 302 | −9.378 | 32.999 | 36.034 | 1.00 | 60.63 | O |
| HETATM | 4890 | O | HOH | S | 303 | 3.159 | 33.366 | 34.953 | 1.00 | 69.84 | O |
| HETATM | 4891 | O | HOH | S | 305 | −20.048 | 5.727 | 43.180 | 1.00 | 46.57 | O |
| HETATM | 4892 | O | HOH | S | 307 | −13.897 | 13.040 | 54.796 | 1.00 | 54.29 | O |
| HETATM | 4893 | O | HOH | S | 308 | 6.717 | 36.053 | 14.588 | 1.00 | 63.75 | O |
| HETATM | 4894 | O | HOH | S | 309 | 14.178 | −18.401 | 36.356 | 1.00 | 47.74 | O |
| HETATM | 4895 | O | HOH | S | 310 | −28.409 | −0.269 | 20.445 | 1.00 | 63.81 | O |
| HETATM | 4896 | O | HOH | S | 311 | −5.539 | −20.837 | 30.952 | 1.00 | 54.95 | O |
| HETATM | 4897 | O | HOH | S | 312 | −20.931 | −3.278 | 25.347 | 1.00 | 58.45 | O |
| HETATM | 4898 | O | HOH | S | 313 | 3.559 | 2.313 | 27.875 | 1.00 | 60.98 | O |
| HETATM | 4899 | O | HOH | S | 314 | −14.448 | 27.000 | 30.900 | 1.00 | 40.51 | O |
| HETATM | 4900 | O | HOH | S | 315 | −25.394 | 0.569 | 39.101 | 1.00 | 51.43 | O |
| HETATM | 4901 | O | HOH | S | 316 | −20.034 | 3.610 | 8.110 | 1.00 | 68.31 | O |
| HETATM | 4902 | O | HOH | S | 317 | −19.387 | −0.692 | 27.680 | 1.00 | 50.27 | O |
| HETATM | 4903 | O | HOH | S | 318 | −4.028 | 16.454 | 55.247 | 1.00 | 60.83 | O |
| HETATM | 4904 | O | HOH | S | 319 | −6.359 | 28.815 | 16.934 | 1.00 | 66.26 | O |
| HETATM | 4905 | O | HOH | S | 320 | 13.923 | 8.697 | 33.306 | 1.00 | 51.80 | O |
| HETATM | 4906 | O | HOH | S | 321 | 5.193 | 9.454 | 54.127 | 1.00 | 54.23 | O |
| HETATM | 4907 | O | HOH | S | 322 | 5.552 | −0.799 | 27.411 | 1.00 | 57.24 | O |
| HETATM | 4908 | O | HOH | S | 323 | −22.107 | 21.952 | 21.972 | 1.00 | 62.64 | O |
| HETATM | 4909 | O | HOH | S | 324 | −19.601 | 38.087 | −2.616 | 1.00 | 69.80 | O |
| HETATM | 4910 | O | HOH | S | 325 | 8.823 | 0.574 | 43.504 | 1.00 | 64.81 | O |
| HETATM | 4911 | O | HOH | S | 326 | −20.584 | 21.607 | 12.317 | 1.00 | 66.05 | O |
| HETATM | 4912 | O | HOH | S | 327 | −8.943 | 26.737 | 19.648 | 1.00 | 68.17 | O |

TABLE 17-continued

| | | | | | | | | | |
|---|---|---|---|---|---|---|---|---|---|
| HETATM | 4913 | O | HOH | S | 328 | −3.823 | −15.430 | 62.188 | 1.00 | 54.91 | O |
| HETATM | 4914 | O | HOH | S | 329 | −19.737 | 15.369 | −8.301 | 1.00 | 72.85 | O |
| HETATM | 4915 | O | HOH | S | 330 | −15.206 | −15.473 | 41.672 | 1.00 | 48.13 | O |
| HETATM | 4916 | O | HOH | S | 331 | −19.459 | −2.746 | 47.129 | 1.00 | 46.44 | O |
| HETATM | 4917 | O | HOH | S | 332 | −28.238 | 2.115 | 20.214 | 1.00 | 65.47 | O |
| HETATM | 4918 | O | HOH | S | 333 | 6.706 | −0.523 | 49.261 | 1.00 | 70.21 | O |
| HETATM | 4919 | O | HOH | S | 334 | −23.674 | 19.425 | 19.380 | 1.00 | 57.78 | O |
| HETATM | 4920 | O | HOH | S | 335 | −25.859 | 9.378 | −1.108 | 1.00 | 65.62 | O |
| HETATM | 4921 | O | HOH | S | 336 | −1.638 | −26.691 | 32.096 | 1.00 | 43.49 | O |
| HETATM | 4922 | O | HOH | S | 337 | −10.060 | 21.301 | 9.626 | 1.00 | 60.17 | O |
| HETATM | 4923 | O | HOH | S | 338 | 9.265 | 2.533 | 42.222 | 1.00 | 63.66 | O |
| HETATM | 4924 | O | HOH | S | 339 | −28.923 | 3.673 | 22.722 | 1.00 | 57.71 | O |
| HETATM | 4925 | O | HOH | S | 341 | 6.635 | −21.509 | 43.726 | 1.00 | 54.12 | O |
| HETATM | 4926 | O | HOH | S | 342 | −21.396 | 11.387 | 45.020 | 1.00 | 54.00 | O |
| HETATM | 4927 | O | HOH | S | 343 | −22.662 | −9.827 | 34.765 | 1.00 | 49.64 | O |
| HETATM | 4928 | O | HOH | S | 344 | −6.082 | 15.679 | 56.379 | 1.00 | 74.09 | O |
| HETATM | 4929 | O | HOH | S | 345 | 7.979 | −18.045 | 21.546 | 1.00 | 68.64 | O |
| HETATM | 4930 | O | HOH | S | 346 | −8.236 | 13.056 | 34.064 | 1.00 | 48.31 | O |
| HETATM | 4931 | O | HOH | S | 347 | 2.607 | −22.790 | 45.213 | 1.00 | 50.06 | O |
| HETATM | 4932 | O | HOH | S | 348 | −12.233 | 6.599 | 13.106 | 1.00 | 59.12 | O |
| HETATM | 4933 | O | HOH | S | 349 | −28.827 | 8.788 | 36.894 | 1.00 | 55.78 | O |
| HETATM | 4934 | O | HOH | S | 350 | 9.193 | 9.916 | 19.488 | 1.00 | 48.32 | O |
| HETATM | 4935 | O | HOH | S | 351 | −1.571 | 5.429 | 35.828 | 1.00 | 62.47 | O |
| HETATM | 4936 | O | HOH | S | 352 | −16.079 | 6.758 | 40.372 | 1.00 | 52.48 | O |
| HETATM | 4937 | O | HOH | S | 353 | −15.807 | 20.477 | 22.078 | 1.00 | 57.70 | O |
| HETATM | 4938 | O | HOH | S | 354 | 0.004 | 14.305 | 39.393 | 1.00 | 50.37 | O |
| HETATM | 4939 | O | HOH | S | 355 | −16.972 | 10.462 | 29.663 | 1.00 | 46.60 | O |
| HETATM | 4940 | O | HOH | S | 356 | −12.687 | 14.428 | 35.077 | 1.00 | 46.67 | O |
| HETATM | 4941 | O | HOH | S | 357 | −22.962 | 24.121 | 41.046 | 1.00 | 58.00 | O |
| HETATM | 4942 | O | HOH | S | 358 | −25.212 | 23.205 | 37.592 | 1.00 | 84.00 | O |
| HETATM | 4943 | O | HOH | S | 359 | −26.631 | 20.566 | 40.387 | 1.00 | 57.42 | O |
| HETATM | 4944 | O | HOH | S | 360 | −26.558 | 19.753 | 43.554 | 1.00 | 61.05 | O |
| HETATM | 4945 | O | HOH | S | 361 | −13.008 | 23.978 | 42.934 | 1.00 | 40.73 | O |
| HETATM | 4946 | O | HOH | S | 362 | −1.401 | −15.333 | 45.800 | 1.00 | 48.37 | O |
| HETATM | 4947 | O | HOH | S | 363 | 11.034 | 26.927 | 15.752 | 1.00 | 51.80 | O |
| HETATM | 4948 | O | HOH | S | 364 | −1.574 | 37.737 | 34.903 | 1.00 | 38.86 | O |
| HETATM | 4949 | O | HOH | S | 365 | −3.943 | 4.328 | 12.477 | 1.00 | 61.95 | O |
| HETATM | 4950 | O | HOH | S | 366 | −18.031 | −3.526 | 17.015 | 1.00 | 52.98 | O |
| HETATM | 4951 | O | HOH | S | 367 | −8.243 | 22.613 | 16.346 | 1.00 | 66.07 | O |
| HETATM | 4952 | O | HOH | S | 369 | −22.803 | −7.717 | 21.291 | 1.00 | 61.45 | O |
| HETATM | 4953 | O | HOH | S | 370 | −19.313 | −10.529 | 24.471 | 1.00 | 61.27 | O |
| HETATM | 4954 | O | HOH | S | 371 | −25.779 | 3.688 | 5.500 | 1.00 | 60.75 | O |
| HETATM | 4955 | O | HOH | S | 372 | −16.732 | −14.004 | 60.515 | 1.00 | 54.06 | O |
| HETATM | 4956 | O | HOH | S | 373 | 4.289 | −8.703 | 55.646 | 1.00 | 60.11 | O |
| HETATM | 4957 | O | HOH | S | 374 | 2.477 | −10.568 | 56.462 | 1.00 | 62.90 | O |
| END | | | | | | | | | | | |

TABLE 22

BiTE-scFc Full Sequences

| Ab | Type | BITE scFc |
|---|---|---|
| MA_03-C7_AS_CC_x_I2C0_x_scFc_(G2H)_translation | NA AA | (SEQ ID NO: 34)<br>MDMRVPAQLLGLLLLWLRGARCEVQLLESGGGLVQPGGSLRLSCAASGFTFSSHAMSWVRQAPGKCLEWVSAISG SGGGTYYAASVKGRFTISRDNSKNTLYLQMNSLRAEDTAVYYCATGKGVHLGFDYWGQGTLVTVSSGGGGSGGGG SGGGGSSYVLTQPPSVSVAPGQTARITCGGNNIGSKSVHWYQQKPGQAPVMVVYDDNDRPSGIPERFSGSNSGNT ATLTISRVEAGDEADYYCQVWDYERPAMVFGCGTKLTVLSGGGGSEVQLVESGGGLVQPGGSLKLSCAASGFTEN KYAMNWVRQAPGKGLEWVARIRSKYNNYATYYADSVKDRFTISRDDSKNTAYLQMNNLKTEDTAVYYCVRHGNFG NSYISYWAYWGQGTLVTVSSGGGGSGGGGSGGGGSQTVVTQEPSLTVSPGGTVTLTCGSSTGAVTSGNYPNWVQQ KPGQAPRGLIGGTKFLAPGTPARFSGSLLGKAALTLSGVQPEDEAEYYCVLWYSNRWVFGGGTKLTVLGGGGDK THTCPPCPAPELLGGPSVFLFPPKPKDTLMISRTPEVTCVVVDVSHEDPEVKFNWYVDGVEVHNAKTKPCEEQYG STYRCVSVLTVLHQDWLNGKEYKCKVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVFSCSVMHEALHNHYTQKSLSLSPGK GGGGSGGGGSGGGGSGGGGSGGGGSGGGGSDKTHTCPPCPAPELLGGPSVFLFPPKPKDTLMISRTPEVTCVVVD VSHEDPEVKFNWYVDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK<br>(SEQ ID NO: 35) |
| MA_03-D8_AS_CC_x_I2C0_x_scFc_(L7E)_translation | NA AA | (SEQ ID NO: 36)<br>MDMRVPAQLLGLLLLWLRGARCEVQLLESGGGLVQPGGSLRLSCAASGFTFSSHAMSWVRQAPGKCLEWVSTISG SGGGTYYAASVKGRFTISRDNSKNTLYLQMNSLRAEDTAVYYCATGKGVHLGFDYWGQGTLVTVSSGGGGSGGGG SGGGGSSYVLTQPPSVSVAPGQTARITCGGNNIGSKSVHWYQQKPGQAPVMVVYDDNDRPSGIPERFSGSNFGNT ATLIISRVEAGDEADYYCQVWDYRTLDWVFGCGTKLTVLSGGGGSEVQLVESGGGLVQPGGSLKLSCAASGFTEN KYAMNWVRQAPGKGLEWVARIRSKYNNYATYYADSVKDRFTISRDDSKNTAYLQMNNLKTEDTAVYYCVRHGNFG NSYISYWAYWGQGTLVTVSSGGGGSGGGGSGGGGSQTVVTQEPSLTVSPGGTVTLTCGSSTGAVTSGNYPNWVQQ |

TABLE 22-continued

BiTE-scFc Full Sequences

| Ab | Type | BITE scFc |
|---|---|---|
| | | KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 37) |
| MA_03-<br>D8_CC_x_I2C0_<br>x_scFc_(H6N)_<br>translation | NA<br>AA | (SEQ ID NO: 38)<br>MDMRVPAQLLGLLLLWLRGARCEVQLLESGGGLVQPGGSLRLSCAASGFTFSSHAMSWVRQAPGKCLEWVSTISG<br>SGGGTYYADSVKGRFTISRDNSKNTLYLQMNSLRAEDTAVYYCATGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNFGNT<br>ATLIISRVEAGDEADYYCQVWDYRTLDWVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 39) |
| MA_03-<br>D12_AS_CC_x_<br>I2C0_x_scFc_<br>(L6A)_<br>translation | NA<br>AA | (SEQ ID NO: 40)<br>MDMRVPAQLLGLLLLWLRGARCEVQLLESGGGLVQPGGSLRLSCAASGFTFSSHAMSWVRQAPGKCLEWVSAISG<br>SGGGTYYAASVKARFTISRDNSKNTLYLQMNSLRAEDTAVYYCATGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNSGNT<br>ATLTISRVEAGDEADYYCQVWDYLRQQQVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 41) |
| MA_03-<br>E7_AS_CC_x_<br>I2C0_x_scFc_<br>(L6M)_<br>translation | NA<br>AA | (SEQ ID NO: 42)<br>MDMRVPAQLLGLLLLWLRGARCEVQLLESGGGLVQPGRSLRLSCAASGFTFSSHAMSWVRQAPGKCLEWVSAISG<br>SGGGTYYAASGKGRFTISRDNSKNTLYLQMNSLRAEDTAAYYCVTGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNSGNT<br>ATLTISRVEAGDEADYYCQVWDYNMNVWVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 43) |
| MA_03-<br>E11_AS_CC_x_<br>I2C0_x_scFc_<br>(G2B)_<br>translation | NA<br>AA | (SEQ ID NO: 44)<br>MDMRVPAQLLGLLLLWLRGARCEVQLLESGGGLVQPGGSLRLSCAASGFTFSSHAMSWVRQAPGKCLEWVSAISG<br>SGGGTYNAASVKGRFTISRDNSKNTLYLQMNSLRAEDTAAYYCVTGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNSGNT<br>ATLTISRVEAGDEADYYCQVWDYYSNRAVFGCGTKLTVLSGGGGSEVQLVESGGGLVQPGGSLKLSCAASGETEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK |

TABLE 22-continued

BiTE-scFc Full Sequences

| Ab | Type | BITE scFc |
|---|---|---|
| | | GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 45) |
| MA_03-<br>G10_AS_CC_x_<br>I2C0_x_scFc_<br>(N3H)_<br>translation | NA<br>AA | (SEQ ID NO: 46)<br>MDMRVPAQLLGLLLLWLRGARCEVQLLESGGGLVQPGGSLRLSCAASGFTFSSYAMSWVRQAPGKCLEWVSAISG<br>SGGGTYYAASVKGRFTISRDNSKNTLYLQMSSLRAEDTAVYYCATGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNSGNT<br>ATLTISRVEAGDEADYYCQVWDYSGQRQVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 47) |
| MA_03-<br>G11_AS_CC_x_<br>I2C0_x_scFc_<br>(O4R)_<br>translation | NA<br>AA | (SEQ ID NO: 48)<br>MDMRVPAQLLGLLLLWLRGARCEVQLLESGGGLVKPGGSLRLSCAASGFTFSSHAMSWVRQAPGKCLEWVSAISG<br>SGGGTYYAASVKGRFTISRDNSKNTLYLQMNSLRAEDTAVYYCATGKGVHLNFDYWGQGTLVTVSSGGGGSGGGG<br>SGGGGSSYVLTQPPSVSVAPGQTARITCGGNNIGSKSVHWYQQKPGQAPVLVVYDDNDRPSGIPERFSGSNFGNT<br>ATLIISRVEAGDEADYYCQVWDYLLPGQVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKENWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 49) |
| MA_03-<br>H12_AS_CC_x_<br>I2C0_x_scFc_<br>(K5A)_<br>translation | NA<br>AA | (SEQ ID NO: 50)<br>MDMRVPAQLLGLLLLWLRGARCEVQLLESGGGLVQPGGSLRLSCAASGFTFSSHAMSWVRQAPGKCLEWVSAISG<br>SGGGTYNAASVKGRFTISRDNSKNTLYLQMNSLRAEDTAAYYCVTGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNFGNT<br>ATLTISRVEAGDEADYYCQVWDYVTPRWVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGE<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 51) |
| MA_09-<br>C7_CC_x_I2C0_<br>x_scFc_(K9T)_<br>translation | NA<br>AA | (SEQ ID NO: 52)<br>MDMRVPAQLLGLLLLWLRGARCQVTLKESGPALVKPTQTLTLTCTESGFSTTHKMGVDWIRQPPGKCLEWLAEI<br>HSEDDKRYSPSLQSRLTITKDTSKNQVVLTMTNMDPVDTATYYCAYRRYNWNYENWFDPWGQGTLVTVSSGGGGS<br>GGGGSGGGGSGGGGSDIQMTQSPSSLSASVGDRVTITCRASQSISNYFNWYQQKPGKAPKLLIYAASSLQSGVPSRFSGS<br>GSGTDFTLTISSLQPEDFATYYCQQSYITPFTFGCGTKVEIKSGGGGSEVQLVESGGGLVQPGGSLKLSCAASGF<br>TFNKYAMNWVRQAPGKGLEWVARIRSKYNNYATYYADSVKDRFTISRDDSKNTAYLQMNNLKTEDTAVYYCVRH<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 53) |

TABLE 22-continued

BiTE-scFc Full Sequences

| Ab | Type | BITE scFc |
|---|---|---|
| MA_09-E2_CC_x_I2C0_x_scFc_(V8T)_translation | NA AA | (SEQ ID NO: 54)<br>MDMRVPAQLLGLLLLWLRGARCEVQLVESGGGLVQPGGSLRLSCAASGFTFSNAWMSWVRQAPGKCLEWVGRIKS<br>KTYGGTTDYAAPVKGRFTISRDDSKNTLFLQMNSLKTEDTAVYYCTTPSYSGSYYNYFSVMDVWGQGTTVTVSSG<br>GGGSGGGGSGGGGSDIQMTQSPSSLSASVGDRVTITCRTSQSISSYLNWYQQKPGRAPKLLIFAASSLQGGVPSR<br>FSGSGSGTDFTLTISSLQPEDFATYYCQQSYSSPFTFGCGTKVEIKSGGGGSEVQLVESGGGLVQPGGSLKLSCA<br>ASGFTFNKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSDKTHTCPPCPAPELLGGPSVFLFPPKPKDTLMISRTPE<br>VTCVVVDVSHEDPEVKENWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 55) |
| MA_09-F11_CC_x_I2C0_x_scFc_(L6Q)_translation | NA AA | (SEQ ID NO: 56)<br>MDMRVPAQLLGLLLLWLRGARCQITLKESGPMLVKPTQTLTLTCTFSGFSFTTHKMGVDWIRQPPGKCLEWLALI<br>YWNDDKRYSPSLQSRLTITKDTSKNQVVLTMTNMDPVDTATYYCAYRRYNWNYENWFDPWGQGTLVTVSSGGGGS<br>GGGGSGGGGSDIQMTQSPDSLSASVGDRVTITCQASQDISNYLNWYQQKPGKAPKLLIYAASSLQSGVPSRESGS<br>GSGTDFTLTISSLQPEDFATYYCQQSYMWPTIFGCGTKVEIKSGGGGSEVQLVESGGGLVQPGGSLKLSCAASGF<br>TFNKYAMNWVRQAPGKGLEWVARIRSKYNNYATYYADSVKDRETISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 57) |
| MA_09-F12_CC_x_I2C0_x_scFc_(D1U)_translation | NA AA | (SEQ ID NO: 58)<br>MDMRVPAQLLGLLLLWLRGARCQITLKESGPALVKPTQTLTLTCTFSGFSFTTHKMGVDWIRQPPGKCLEWLALI<br>YWNDDKRYSPSLQSRLTITKDTSKNQVVLTMTNMDPVDTATYYCAYRRYNWNYENWFDPWGQGTLVTVSSGGGGS<br>GGGGSGGGGSDIQMTQSPSSLSASVGDRVTITCQASQDISNYLNWYQQKPGKAPKLLIYAASSLQSGVPSRFSGR<br>GSGTDFTLTISSLQPEDFATYYCQQSYYYPTLFGCGTKVEIKSGGGGSEVQLVESGGGLVQPGGSLKLSCAASGF<br>TENKYAMNWVRQAPGKGLEWVARIRSKYNNYATYYADSVKDRFTISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 59) |
| MA_09-G8_CC_x_I2C0_x_scFc_(I6K)_translation | NA AA | (SEQ ID NO: 60)<br>MDMRVPAQLLGLLLLWLRGARCQITLKESGPTLVKPTQTLTLTCTFSGFSFTTHKMGVDWIRQPPGKCLEWLALI<br>YWNDDKRYSPSLQSRLTITKDTSKNQVVLTMTNMDPVDTATYYCAYRRYNWNYENWFDPWGQGTLVTVSSGGGGS<br>GGGGSGGGGSDIQMTQSPSSLSASVGDRVTITCQASQDISNYLNWYQQKPGKAPKLLIYAASSLQSGVPSRESGS<br>GSGTDFTLTISSLQPEDFATYYCQQSYTLHPLFGCGTKVEIKSGGGGSEVQLVESGGGLVQPGGSLKLSCAASGF<br>TFNKYAMNWVRQAPGKGLEWVARIRSKYNNYATYYADSVKDRFTISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 61) |
| MA_09-G10_CC_x_I2C0_x_scFc_(C4K)_translation | NA AA | (SEQ ID NO: 62)<br>MDMRVPAQLLGLLLLWLRGARCQITLKESGPTLVKPTQTLTLTCTFSGFSFTTHKMGVDWIRQPPGKCLEWLAGI<br>HIYDDKRYSPSLQSRLTITKDTSKNQVVLTMTNMDPVDTATYYCAYRRYNWNYENWFDPWGQGTLVTVSSGGGGS<br>GGGGSGGGGSDIQMTQSPSSLSASVGDRVTITCQASQDISNYFNWYQQKPGKAPKLLIYAASSLQSGVPSRESGS<br>GSGTDFTLTISSLQPEDFATYYCQQSYITPFTFGCGTKVEIKSGGGGSEVQLVESGGGLVQPGGSLKLSCAASGF<br>TFNKYAMNWVRQAPGKGLEWVARIRSKYNNYATYYADSVKDRFTISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG |

TABLE 22-continued

BiTE-scFc Full Sequences

| Ab | Type | BITE scFc |
|---|---|---|
| | | GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 63) |
| MA_09-<br>G11_CC_x_I2C0_<br>x_scFc_(Y9Q)_<br>translation | NA<br>AA | (SEQ ID NO: 64)<br>MDMRVPAQLLGLLLLWLRGARCQITLKESGPMLVKPTQTLTLTCTFSGFSFTTHKMGVDWIRQPPGKCLEWLALI<br>YWNDDKRYSPSLQSRLTITKDTSKNQVVLTMTNMDPVDTATYYCAYRRYNWNYENWDPWGQGTLVTVSSGGGGS<br>GGGGSGGGGSDIQMTQSPSSLSASVGDRVTITCRASQFISSYLNWYQQKPGKAPKLLIYAASSLQSGVPSRESGR<br>GSGTDFTLTISSLQPEDFATYYCQQSYQSPTTFGCGTKVEIKSGGGGSEVQLVESGGGLVQPGGSLKLSCAASGF<br>TFNKYAMNWVRQAPGKGLEWVARIRSKYNNYATYYADSVKDRFTISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 65) |
| MA_09-<br>H7_CC_x_I2C0_<br>x_scFc_(T3S)_<br>translation | NA<br>AA | (SEQ ID NO: 66)<br>MDMRVPAQLLGLLLLWLRGARCQITLKESGPALVKPTQTLTLTCTFSGFSFTTHKMGVDWIRQPPGKCLEWLALI<br>YWNDDKRYSPSLQSRLTITKDTSKNQVVLTMTNMDPVDTATYYCAYRRYNWNYENWDPWGQGTLVTVSSGGGGS<br>GGGGSGGGGSDIQMTQSPSSLSASVGDRVTITCQASQDISNYLNWYQQKPGKAPKLLIYAASSLQSGVPSRESGS<br>GSGTDFTLTISSLQPEDFATYYCQQSYFPVVEFGCGTKVEIKSGGGGSEVQLVESGGGLVQPGGSLKLSCAASGF<br>TENKYAMNWVRQAPGKGLEWVARIRSKYNNYATYYADSVKDRFTISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 67) |
| MA_09-<br>H10_CC_x_I2C0_<br>x_scFc_(B6N)_<br>translation | NA<br>AA | (SEQ ID NO: 68)<br>MDMRVPAQLLGLLLLWLRGARCQITLKESGPTLVKPTQTLTLTCTFSGFSFTTHKMGVDWIRQPPGKCLEWLALI<br>YWNDDKRYSPSLQSRLTITKDTSKNQVVLTMTNMDPVDTATYYCAYRRYNWNYENWDPWGQGTLVTVSSGGGGS<br>GGGGSGGGGSDIQMTQSPSSLSASVGDRVTITCQASQDISNYLNWYQQKPGKAPKLLIYAASSLQSGVPSRESGR<br>GSGTDFTLTISSLQPEDFATYYCQQSYTPPTTFGCGTKVEIKSGGGGSEVQLVESGGGLVQPGGSLKLSCAASGF<br>TENKYAMNWVRQAPGKGLEWVARIRSKYNNYATYYADSVKDRFTISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 69) |
| MA_09-<br>H11_CC_x_I2C0_<br>x_scFc_(I8L)_<br>translation | NA<br>AA | (SEQ ID NO: 70)<br>MDMRVPAQLLGLLLLWLRGARCQITLKESGPTLVKPTQTLTLTCTFSGFSFTTHKMGVDWIRQPPGKCLEWLALI<br>YWNDDKRYSPSLQSRLTITKDTSKNQVVLTMTNMDPVDTATYYCAYRRYNWNYENWEDPWGQGTLVTVSSGGGGS<br>GGGGSGGGGSDIQMTQSPSSLSASVGDRVTITCRASQFISSYLNWYQQKPGKAPKLLIYAASSLQSGVPSRESGS<br>GSGTDFTLTISSLQPEDFATYYCQQSYSYPNSFGCGTKVEIKSGGGGSEVQLVESGGGLVQPGGSLKLSCAASGF<br>TFNKYAMNWVRQAPGKGLEWVARIRSKYNNYATYYADSVKDRFTISRDDSKNTAYLQMNNLKTEDTAVYYCVRHG<br>NFGNSYISYWAYWGQGTLVTVSSGGGGSGGGGSGGGGSQTVVTQEPSLTVSPGGTVTLTCGSSTGAVTSGNYPNW<br>VQQKPGQAPRGLIGGTKFLAPGTPARFSGSLLGGKAALTLSGVQPEDEAEYYCVLWYSNRWVFGGGTKLTVLGGG<br>GDKTHTCPPCPAPELLGGPSVFLFPPKPKDTLMISRTPEVTCVVVDVSHEDPEVKENWYVDGVEVHNAKTKPCEE<br>QYGSTYRCVSVLTVLHQDWLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCSVMHEALHNHYTQKSLSLS<br>PGKGGGGSGGGGSGGGGSGGGGSGGGGSGGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 71) |

TABLE 22-continued

BiTE-scFc Full Sequences

| Ab | Type | BITE scFc |
|---|---|---|
| MA_10-B5_CC_x_I2C0_x_scFc_(H6H)_translation | NA AA | (SEQ ID NO: 72)<br>MDMRVPAQLLGLLLLWLRGARCEVQLVESGGGLVQPGGSLRLSCAASGFTFSNAWMSVRQAPGKCLEWVGRIRS<br>RSYGGTTDYAAPVKGRFTISRDDSKNTLFLQMNSLKTEDTAVYYCTTPSYSGSYYNYFSVMDVWGQGTTVTVSS<br>GGGSGGGGSGGGGSDIQMTQSPSSLSASVGDRVTITCRTSQSISSYLNWYQQKPGRAPKLLIFAASSLQGGVPSR<br>FSGSGSGTDFTLTISSLQPEDFATYYCQQTYSMPFTFGCGTKVEIKSGGGGSEVQLVESGGGLVQPGGSLKLSCA<br>ASGFTFNKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKFNWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 73) |
| MA_10-B6_CC_x_I2C0_x_scFc_(I30)_translation | NA AA | (SEQ ID NO: 74)<br>MDMRVPAQLLGLLLLWLRGARCEVQLVESGGGLVQPGGSLRLSCAASGFTFSNAWMSVRQAPGKCLEWVGRIKS<br>KTYGGTTDYAAPVKGRFTISRDDSKNTLYLQMNSLKTEDTAVYYCTTPSYSGSYYNYFSVMDVWGQGTTVTVSSG<br>GGGSGGGGSGGGGSDIQMTQSPSSLSASVGDRVTITCRTSQSISSYLNWYQQKPGRAPKLLIFAASSLQGGVPSR<br>FSGSGSGTDFTLTISSLQPEDFATYYCIQAYTSPFTFGCGTKLEIKSGGGGSEVQLVESGGGLVQPGGSLKLSCA<br>ASGFTFNKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 75) |
| MA_10-D3_CC_x_I2C0_x_scFc_(06B)_translation | NA AA | (SEQ ID NO: 76)<br>MDMRVPAQLLGLLLLWLRGARCEVQLVESGGGLVQPGGSLRLSCAASGFTFSNAWMSVRQAPGKCLEWVGRITS<br>SRYGGTTDYAAPVKGRFTISRDDSKNTLFLQMNSLKTEDTAVYYCTTPSYSGSYYNYFSVMDVWGQGTTVTVSSG<br>GGGSGGGGSGGGGSDIQMTQSPSSLSASVGDRVTITCRTSQSISSYLNWYQQKPGRAPKLLIFAASSLQGGVPSR<br>FSGSGSGTDFTLTISSLQPEDFATYYCQQTYSMPFTFGCGTKVDIKSGGGGSEVQLVESGGGLVQPGGSLKLSCA<br>ASGFTFNKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 77) |
| MA_10-D6_CC_x_I2C0_x_scFc_(V6Z)_translation | NA AA | (SEQ ID NO: 78)<br>MDMRVPAQLLGLLLLWLRGARCEVQLVESGGGLVKPGGSLRLSCAASGFTFSNAWMSVRQAPGKCLEWVGRILN<br>NAYGGTTDYAAPVKGRFTISRDDSKNTLYLQMNSLKTEDTAVYYCTTPSYSGSYYNYFSVMDVWGQGTTVTVSSG<br>GGGSGGGGSGGGGSDIQMTQSPSSLSASVGDRVTITCRTSQSISSYLNWYQQKPGRAPKLLIFAASSLQGGVPSR<br>FSGSGSGTDFTLTISSLQPEDFATYYCQQTYSMPFTFGCGTKVDIKSGGGGSEVQLVESGGGLVQPGGSLKLSCA<br>ASGFTENKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 79) |
| MA_10-G2_CC_x_I2C0_x_scFc_(T1S)_translation | NA AA | (SEQ ID NO: 80)<br>MDMRVPAQLLGLLLLWLRGARCEVQLVESGGGLVQPGGSLRLSCAASGFTFSNAWMSVRQAPGKCLEWVGRILS<br>MHYGGTTDYAAPVKGRFTISRDDSKNTLYLQMNSLKTEDTAVYYCTTPSYSGSYYNYFSVMDVWGQGTTVTVSSG<br>GGGSGGGGSGGGGSDIQMTQSPSSLSASVGDRVTITCRTSQSISSYLNWFQQKPGKAPKLLIFAASSLQSGVPSR<br>FSGSGSGTDFTLTISSLQPEDFATYYCQQTYSMPFTFGCGTKVDIKSGGGGSEVQLVESGGGLVQPGGSLKLSCA<br>ASGFTFNKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN |

TABLE 22-continued

BiTE-scFc Full Sequences

| Ab | Type | BITE scFc |
|---|---|---|
| | | YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSGGGGSDKTHTCPPCPAPELLGGPSVFLFPPKPKDTLMISRTPE<br>VTCVVVDVSHEDPEVKENWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 81) |
| MA_10-<br>G5_CC_x_I2C0_<br>x_scFc_(S9O)_<br>translation | NA<br>AA | (SEQ ID NO: 82)<br>MDMRVPAQLLGLLLLWLRGARCEVQLVESGGGLVQPGGSLRLSCAASGFTFSNAWMSWVRQAPGKCLEWVGRIVS<br>STYGGTTDYAAPVKGRFTISRDDSKNTLYLQMNSLKTEDTAVYYCTTPSYSGSYYNYFSVMDVWGQGTTVTVSSG<br>GGGGSGGGGSGGGGSDIQMTQSPSSLSASVGDRVTITCRTSQSISSYLNWYQQKPGRAPKLLIFAASSLQGGVPSR<br>FSGSGSGTDFTLTISSLQPEDFATYYCQQTYSMPFTFGCGTKVDIKSGGGGSEVQLVESGGGLVQPGGSLKLSCA<br>ASGFTENKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 83) |
| MA_10-<br>G10_AS_CC_x_<br>I2C0_x_scFc_<br>(T1I)_<br>translation | NA<br>AA | (SEQ ID NO: 84)<br>MDMRVPAQLLGLLLLWLRGARCEVQLLESGGGLVQPGGSLRLSCAASGFTFSSHAMSWVRQAPGKCLEWVSAISG<br>SGGGTYNAASVKGRFTISRDNSKNTLYLQMNSLRAEDTAVYYCARGGGGSYVLTQPPSVSVAPGQTARITCGGNNIGSKSVHWYQQKPGQAPVMVVYDDNDRPSGIPERFSGSNSGNT<br>ATLTISRVEAGDEADYYCQVWDYVAPRHVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 85) |
| MA_10-<br>G10_CC_x_I2C0_<br>x_scFc_(B3A)_<br>translation | NA<br>AA | (SEQ ID NO: 86)<br>MDMRVPAQLLGLLLLWLRGARCEVQLLESGGGLVQPGGSLRLSCAASGFTFSSHAMSWVRQAPGKCLEWVSAISG<br>SGGGTYNADSVKGRFTISRDNSKNTLYLQMNSLRAEDTAVYYCATGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNSGNT<br>ATLTISRVEAGDEADYYCQVWDYVAPRHVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 87) |
| MA_10-<br>H1_CC_x_I2C0_<br>x_scFc_(T9K)_<br>translation | NA<br>AA | (SEQ ID NO: 88)<br>MDMRVPAQLLGLLLLWLRGARCEVQLVESGGGLVQPGGSLRLSCAASGFTFSNAWMSWVRQAPGKCLEWVGRITS<br>GIYGGTTDYAAPVKGRFTISRDDSKNTLYLQMNSLKTEDTAVYYCTTPSYSGSYYNYFSVMDVWGQGTTVTVSSG<br>GGGSGGGGSGGGGSDIQMTQSPSSLSASVGDRVTITCRTSQSISSYLNWYQQKPGRAPKLLIFAASSLQSGVPSR<br>FSGSGSGTDFTLTISSLQPEDFATYYCQQTYSMPFTFGCGTKVDIKSGGGGSEVQLVESGGGLVQPGGSLKLSCA<br>ASGFTENKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS |

TABLE 22-continued

BiTE-scFc Full Sequences

| Ab | Type | BITE scFc |
|---|---|---|
| | | LSLSPGKGGGGSGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 89) |
| MA_10-<br>H3_CC_x_I2C0_<br>x_scFc_(M9L)_<br>translation | NA<br>AA | (SEQ ID NO: 90)<br>MDMRVPAQLLGLLLLWLRGARCEVQLVESGGGLVQPGGSLRLSCAASGFTFSNAWMSWVRQAPGKCLEWVGRIRS<br>RPYGGTTDYAAPVKGRFTISRDDSKNTLYLQMNSLKTEDTAVYYCTTPSYSGSYYNYFSVMDVWGQGTTVTVSSG<br>GGGSGGGGSGGGGSDIQMTQSPSSLSASVGDRVTITCRTSQSISSYLNWYQQKPGRAPKLLIFAASSLQGGVPSR<br>FSGSGSGTDFTLTISSLQPEDFATYYCQQTYSSPFTFGCGTKLEIKSGGGGSEVQLVESGGGLVQPGGSLKLSCA<br>ASGFTENKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 91) |
| MA_81-<br>B9_CC_x_I2C0_<br>x_scFc_(U4L)_<br>translation | NA<br>AA | (SEQ ID NO: 92)<br>MDMRVPAQLLGLLLLWLRGARCQVQLQESGPGLVKPSETLSLTCTVSGDSISSSRYYWGWIRQPPGKCLEWIGSI<br>YYSGSTYYNPSLKSRVTISVDTSKNQFSLKLSSVTAADTAVYYCARGIFGVITYFDYWGQGTLVTVSSGGGGSGG<br>GGSGGGGSDIVMTQSPDSLAVSLGERATINCKSSQSVLYSSNNKNYLAWYQQKPGQPPKLLIYWASTRESGVPDR<br>FSGSGSGTDFTLTISSLQAEDVAVYYCQQFYSTPITFGCGTRLEIKSGGGGSEVQLVESGGGLVQPGGSLKLSCA<br>ASGFTENKYAMNWVRQAPGKGLEWVARIRSKYNNYATYYADSVKDRFTISRDDSKNTAYLQMNNLKTEDTAVYYC<br>VRHGNFGNSYISYWAYWGQGTLVTVSSGGGGSGGGGSGGGGSQTVVTQEPSLTVSPGGTVTLTCGSSTGAVTSGN<br>YPNWVQQKPGQAPRGLIGGTKFLAPGTPARFSGSLLGGKAALTLSGVQPEDEAEYYCVLWYSNRWVFGGGTKLTV<br>LGGGGDKTHTCPPCPAPELLGGPSVFLFPPKPKDTLMISRTPEVTCVVVDVSHEDPEVKENWYVDGVEVHNAKTK<br>PCEEQYGSTYRCVSVLTVLHQDWLNGKEYKCKVSNKALPAPIEKTISKAKGQPREPQVYTLPPSREEMTKNQVSL<br>TCLVKGFYPSDIAVEWESNGQPENNYKTTPPVLDSDGSFFLYSKLTVDKSRWQQGNVFSCSVMHEALHNHYTQKS<br>LSLSPGKGGGGSGGGGSGGGGSGGGGSGGGGSGGGGSDKTHTCPPCPAPELLGGPSVFLFPPKPKDTLMISRTPE<br>VTCVVVDVSHEDPEVKFNWYVDGVEVHNAKTKPCEEQYGSTYRCVSVLTVLHQDWLNGKEYKCKVSNKALPAPIE<br>KTISKAKGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 93) |
| MA_86-<br>A4_CC_x_I2C0_<br>x_scFc_(K2W)_<br>translation | NA<br>AA | (SEQ ID NO: 94)<br>MDMRVPAQLLGLLLLWLRGARCQVQLVESGGGVVQPGRSLRLSCAASGFTFSTYGMHWVRQAPGKCLEWVAVISY<br>DASNKYYAESVKGRFTISRDNSKNTLYLQMNSLRAEDTAVYYCARGQLLTGYWGQGTLVTVSSGGGGSGGGGSGG<br>GGSDIQMTQSPSSLSASVGDRVTITCRASQGISNYLAWYQQKPGKVPKLLIYAASTLQSGVPSRFSGSGSGTDET<br>LTISSLQPEDFATYYCQKYNSAPFTFGCGTKVEIKSGGGGSEVQLVESGGGLVQPGGSLKLSCAASGFTENKYAM<br>NWVRQAPGKGLEWVARIRSKYNNYATYYADSVKDRFTISRDDSKNTAYLQMNNLKTEDTAVYYCVRHGNFGNSYI<br>SYWAYWGQGTLVTVSSGGGGSGGGGSGGGGSQTVVTQEPSLTVSPGGTVTLTCGSSTGAVTSGNYPNWVQQKPGQ<br>APRGLIGGTKFLAPGTPARFSGSLLGGKAALTLSGVQPEDEAEYYCVLWYSNRWVFGGGTKLTVLGGGGDKTHTC<br>PPCPAPELLGGPSVFLFPPKPKDTLMISRTPEVTCVVVDVSHEDPEVKFNWYVDGVEVHNAKTKPCEEQYGSTYR<br>CVSVLTVLHQDWLNGKEYKCKVSNKALPAPIEKTISKAKGQPREPQVYTLPPSREEMTKNQVSLTCLVKGFYPSD<br>IAVEWESNGQPENNYKTTPPVLDSDGSFFLYSKLTVDKSRWQQGNVFSCSVMHEALHNHYTQKSLSLSPGKGGGG<br>SGGGGSGGGGSGGGGSGGGGSGGGGSDKTHTCPPCPAPELLGGPSVFLFPPKPKDTLMISRTPEVTCVVVDVSHE<br>DPEVKFNWYVDGVEVHNAKTKPCEEQYGSTYRCVSVLTVLHQDWLNGKEYKCKVSNKALPAPIEKTISKAKGQPR<br>EPQVYTLPPSREEMTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK<br>(SEQ ID NO: 95) |
| MA_86-A4-N-<br>F5_CC_x_I2C0_<br>x_scFc_(M4H)_<br>translation | NA<br>AA | (SEQ ID NO: 96)<br>MDMRVPAQLLGLLLLWLRGARCQVQLVESGGGVVQPGRSLRLSCAASGFTFSTYGMHWVRQAPGKCLEWVAVISY<br>DAETVKYAESVKGRFTISRDNSKNTLYLQMNSLRAEDTAVYYCARGQLLTGYWGQGTLVTVSSGGGGSGGGGSGG<br>GGSDIQMTQSPSSLSASVGDRVTITCRASQGISNYLAWYQQKPGKVPKLLIYAASTLQSGVPSRFSGSGSGTDET<br>LTISSLQPEDVATYYCQKYNSAPFTFGCGTKVEIKSGGGGSEVQLVESGGGLVQPGGSLKLSCAASGFTENKYAM<br>NWVRQAPGKGLEWVARIRSKYNNYATYYADSVKDRFTISRDDSKNTAYLQMNNLKTEDTAVYYCVRHGNFGNSYI<br>SYWAYWGQGTLVTVSSGGGGSGGGGSGGGGSQTVVTQEPSLTVSPGGTVTLTCGSSTGAVTSGNYPNWVQQKPGQ<br>APRGLIGGTKFLAPGTPARFSGSLLGGKAALTLSGVQPEDEAEYYCVLWYSNRWVFGGGTKLTVLGGGGDKTHTC<br>PPCPAPELLGGPSVFLFPPKPKDTLMISRTPEVTCVVVDVSHEDPEVKFNWYVDGVEVHNAKTKPCEEQYGSTYR<br>CVSVLTVLHQDWLNGKEYKCKVSNKALPAPIEKTISKAKGQPREPQVYTLPPSREEMTKNQVSLTCLVKGFYPSD<br>IAVEWESNGQPENNYKTTPPVLDSDGSFFLYSKLTVDKSRWQQGNVFSCSVMHEALHNHYTQKSLSLSPGKGGGG<br>SGGGGSGGGGSGGGGSGGGGSGGGGSDKTHTCPPCPAPELLGGPSVFLFPPKPKDTLMISRTPEVTCVVVDVSHE<br>DPEVKFNWYVDGVEVHNAKTKPCEEQYGSTYRCVSVLTVLHQDWLNGKEYKCKVSNKALPAPIEKTISKAKGQPR<br>EPQVYTLPPSREEMTKNQVSLTCLVKGFYPSDIAVEWESNGQPENNYKTTPPVLDSDGSFFLYSKLTVDKSRWQQ<br>GNVFSCSVMHEALHNHYTQKSLSLSPGK<br>(SEQ ID NO: 97) |

TABLE 22-continued

BiTE-scFc Full Sequences

| Ab | Type | BITE scFc |
|---|---|---|
| MA_88-B3-F9_CC_x_I2C0_x_scFc_(Y4E)_translation | NA<br>AA | (SEQ ID NO: 98)<br>MDMRVPAQLLGLLLLWLRGARCQVQLVESGGGLVKPGGSLRLSCAASGFTFSDYYMSWIRQAPGKCLEWVSYISK<br>SSYTVTYADAVKGRFTISRDNAKNSLYLQMNSLRAEDTAVYYCATYNYGHFDYWGQGTLVTVSSGGGGSGGGGSG<br>GGGGSSYVLTQPPSVSVAPGQTARITCGGNNIGSKSVHWYQQKPGQAPVLVVYDDADRPSGIPERFSGSNSGNTAT<br>LTISRVEAGDEADYYCQVWDASAGYGVVFGCGTKLTVLSGGGGSEVQLVESGGGLVQPGGSLKLSCAASGFTENK<br>YAMNWVRQAPGKGLEWVARIRSKYNNYATYYADSVKDRFTISRDDSKNTAYLQMNNLKTEDTAVYYCVRHGNFGN<br>SYISYWAYWGQGTLVTVSSGGGGSGGGGSGGGGSQTVVTQEPSLTVSPGGTVTLTCGSSTGAVTSGNYPNWVQQK<br>PGQAPRGLIGGTKFLAPGTPARFSGSLLGGKAALTLSGVQPEDEAEYYCVLWYSNRWVFGGGTKLTVLGGGGDKT<br>HTCPPCPAPELLGGPSVFLFPPKPKDTLMISRTPEVTCVVVDVSHEDPEVKENWYVDGVEVHNAKTKPCEEQYGS<br>TYRCVSVLTVLHQDWLNGKEYKCKVSNKALPAPIEKTISKAKGQPREPQVYTLPPSREEMTKNQVSLTCLVKGFY<br>PSDIAVEWESNGQPENNYKTTPPVLDSDGSFFLYSKLTVDKSRWQQGNVFSCSVMHEALHNHYTQKSLSLSPGKG<br>GGGSGGGGSGGGGSGGGGSGGGGSGGGGSDKTHTCPPCPAPELLGGPSVFLFPPKPKDTLMISRTPEVTCVVVDV<br>SHEDPEVKFNWYVDGVEVHNAKTKPCEEQYGSTYRCVSVLTVLHQDWLNGKEYKCKVSNKALPAPIEKTISKAKG<br>QPREPQVYTLPPSREEMTKNQVSLTCLVKGFYPSDIAVEWESNGQPENNYKTTPPVLDSDGSFFLYSKLTVDKSR<br>WQQGNVFSCSVMHEALHNHYTQKSLSLSPGK<br>(SEQ ID NO: 99) |
| MA_98-C7_CC_x_I2C0_x_scFc_(Y8P)_translation | NA<br>AA | (SEQ ID NO: 100)<br>MDMRVPAQLLGLLLLWLRGARCEVQLLESGGGLVQPGGSLRLSCAASGFTFSSHAMSWVRQAPGKCLEWVSSISG<br>SGGGGTYYAASVKGRFTISRDNSKNTLYLQMNSLRAEDTAVYYCATGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNSGNT<br>ATLTISRVEAGDEADYYCQVWDYSPLRHVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 101) |
| MA_98-G12_AS_CC_x_I2C0_x_scFc_(Q4Z)_translation | NA<br>AA | (SEQ ID NO: 102)<br>MDMRVPAQLLGLLLLWLRGARCEVQLLESGGGLVQPGGSLRLSCAASGFTFSSHAMSWVRQAPGKCLEWVSAISG<br>SGGGTYNAASVKGRFTISRDNSKNTLYLQMNSLRAEDTAAYYCVTGKGVHLGFDYWGQGTLVTVSSGGGGSGGGG<br>SGGGGSSYVLTQPPSVSVAPGQTARITCGGNNIGSKSVHWYQQKPGQAPVMVVYDDNDRPSGIPERFSGSNEGNT<br>ATLIISRVEAGDEADYYCQVWDYFSMTHVFGCGTKLTVLSGGGGSEVQLVESGGGLVQPGGSLKLSCAASGFTEN<br>KYAMNWVRQAPGKGLEWVARIRSKYNNYATYYADSVKDRFTISRDDSKNTAYLQMNNLKTEDTAVYYCVRHGNFG<br>NSYISYWAYWGQGTLVTVSSGGGGSGGGGSGGGGSQTVVTQEPSLTVSPGGTVTLTCGSSTGAVTSGNYPNWVQQ<br>KPGQAPRGLIGGTKFLAPGTPARFSGSLLGGKAALTLSGVQPEDEAEYYCVLWYSNRWVFGGGTKLTVLGGGGDK<br>THTCPPCPAPELLGGPSVFLFPPKPKDTLMISRTPEVTCVVVDVSHEDPEVKENWYVDGVEVHNAKTKPCEEQYG<br>STYRCVSVLTVLHQDWLNGKEYKCKVSNKALPAPIEKTISKAKGQPREPQVYTLPPSREEMTKNQVSLTCLVKGF<br>YPSDIAVEWESNGQPENNYKTTPPVLDSDGSFFLYSKLTVDKSRWQQGNVFSCSVMHEALHNHYTQKSLSLSPGK<br>GGGGSGGGGSGGGGSGGGGSGGGGSGGGGSDKTHTCPPCPAPELLGGPSVFLFPPKPKDTLMISRTPEVTCVVVD<br>VSHEDPEVKFNWYVDGVEVHNAKTKPCEEQYGSTYRCVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK<br>(SEQ ID NO: 103) |
| MA_SG-F28_CC_x_I2C0_x_scFc_(D9R)_translation | NA<br>AA | (SEQ ID NO: 104)<br>MDMRVPAQLLGLLLLWLRGARCQVQLQESGPGLVKPSQTLSLTCTVSGDSISSNPYYWSWIRQHPGKCLEWIGYI<br>SYSGITNYNPSLKSRVTMSVDTSKNQFSLKLTSLTAADTAVYYCAREKMWFGVLNYYYGMDVWGQGTTVTVSSGG<br>GGSGGGGSGGGGSDIVMTQTPLSLPVTGEPASISCRSSQSLLHRSGYNYLDWYLQKPGQSPQLLIYLGSNRASG<br>VPDRFSGSGSGTDFTLKISRVEAGDVGVYYCMQALQTPWTFGCGTKVEIKSGGGGSEVQLVESGGGLVQPGGSLK<br>LSCAASGFTFNKYAMNWVRQAPGKGLEWVARIRSKYNNYATYYADSVKDRFTISRDDSKNTAYLQMNNLKTEDTA<br>VYYCVRHGNFGNSYISYWAYWGQGTLVTVSSGGGGSGGGGSGGGGSQTVVTQEPSLTVSPGGTVTLTCGSSTGAV<br>TSGNYPNWVQQKPGQAPRGLIGGTKFLAPGTPARFSGSLLGGKAALTLSGVQPEDEAEYYCVLWYSNRWVFGGGT<br>KLTVLGGGGDKTHTCPPCPAPELLGGPSVFLFPPKPKDTLMISRTPEVTCVVVDVSHEDPEVKENWYVDGVEVHN<br>AKTKPCEEQYGSTYRCVSVLTVLHQDWLNGKEYKCKVSNKALPAPIEKTISKAKGQPREPQVYTLPPSREEMTKN<br>QVSLTCLVKGFYPSDIAVEWESNGQPENNYKTTPPVLDSDGSFFLYSKLTVDKSRWQQGNVFSCSVMHEALHNHY<br>TQKSLSLSPGKGGGSGGGGSGGGGSGGGGSGGGGSGGGGSDKTHTCPPCPAPELLGGPSVFLFPPKPKDTLMIS<br>RTPEVTCVVVDVSHEDPEVKFNWYVDGVEVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSDIAVEWESNGQPENNYKTTPPVLDSDGSF<br>FLYSKLTVDKSRWQQGNVFSCSVMHEALHNHYTQKSLSLSPGK<br>(SEQ ID NO: 105) |

TABLE 23

BiTE-scFc_Fv#1 (MAGEB2) VL CDRs

| Ab Type | | CDR1 | CDR2 | CDR3 |
|---|---|---|---|---|
| MA_03-C7_AS_CC_x_I2C0_x_scFc_(G2H)_translation | NA<br>AA | (SEQ ID NO: 106)<br>GGNNIGSKSVH<br>(SEQ ID NO: 109) | (SEQ ID NO: 107)<br>DDNDRPS<br>(SEQ ID NO: 110) | (SEQ ID NO: 108)<br>QVWDYERPAMV<br>(SEQ ID NO: 111) |
| MA_03-D8_AS_CC_x_I2C0_x_scFc_(L7E)_translation | NA<br>AA | (SEQ ID NO: 112)<br>GGNNIGSKSVH<br>(SEQ ID NO: 115) | (SEQ ID NO: 113)<br>DDNDRPS<br>(SEQ ID NO: 116) | (SEQ ID NO: 114)<br>QVWDYRTLDWV<br>(SEQ ID NO: 117) |
| MA_03-D8_CC_x_I2C0_x_scFc_(H6N)_translation | NA<br>AA | (SEQ ID NO: 118)<br>GGNNIGSKSVH<br>(SEQ ID NO: 121) | (SEQ ID NO: 119)<br>DDNDRPS<br>(SEQ ID NO: 122) | (SEQ ID NO: 120)<br>QVWDYRTLDWV<br>(SEQ ID NO: 123) |
| MA_03-D12_AS_CC_x_I2C0_x_scFc_(L6A)_translation | NA<br>AA | (SEQ ID NO: 124)<br>GGNNIGSKSVH<br>(SEQ ID NO: 127) | (SEQ ID NO: 125)<br>DDNDRPS<br>(SEQ ID NO: 128) | (SEQ ID NO: 126)<br>QVWDYLRQQQV<br>(SEQ ID NO: 129) |
| MA_03-E7_AS_CC_x_I2C0_x_scFc_(L6M)_translation | NA<br>AA | (SEQ ID NO: 130)<br>GGNNIGSKSVH<br>(SEQ ID NO: 133) | (SEQ ID NO: 131)<br>DDNDRPS<br>(SEQ ID NO: 134) | (SEQ ID NO: 132)<br>QVWDYNMNVWV<br>(SEQ ID NO: 135) |
| MA_03-E11_AS_CC_x_I2C0_x_scFc_(G2B)_translation | NA<br>AA | (SEQ ID NO: 136)<br>GGNNIGSKSVH<br>(SEQ ID NO: 139) | (SEQ ID NO: 137)<br>DDNDRPS<br>(SEQ ID NO: 140) | (SEQ ID NO: 138)<br>QVWDYYSNRAV<br>(SEQ ID NO: 141) |
| MA_03-G10_AS_CC_x_I2C0_x_scFc_(N3H)_translation | NA<br>AA | (SEQ ID NO: 142)<br>GGNNIGSKSVH<br>(SEQ ID NO: 145) | (SEQ ID NO: 143)<br>DDNDRPS<br>(SEQ ID NO: 146) | (SEQ ID NO: 144)<br>QVWDYSGQRQV<br>(SEQ ID NO: 147) |
| MA_03-G11_AS_CC_x_I2C0_x_scFc_(O4R)_translation | NA<br>AA | (SEQ ID NO: 148)<br>GGNNIGSKSVH<br>(SEQ ID NO: 151) | (SEQ ID NO: 149)<br>DDNDRPS<br>(SEQ ID NO: 152) | (SEQ ID NO: 150)<br>QVWDYLLPGQV<br>(SEQ ID NO: 153) |
| MA_03-H12_AS_CC_x_I2C0_x_scFc_(K5A)_translation | NA<br>AA | (SEQ ID NO: 154)<br>GGNNIGSKSVH<br>(SEQ ID NO: 157) | (SEQ ID NO: 155)<br>DDNDRPS<br>(SEQ ID NO: 158) | (SEQ ID NO: 156)<br>QVWDYVTPRWV<br>(SEQ ID NO: 159) |
| MA_09-C7_CC_x_I2C0_x_scFc_(K9T)_translation | NA<br>AA | (SEQ ID NO: 160)<br>RASQSISNYEN<br>(SEQ ID NO: 163) | (SEQ ID NO: 161)<br>AASSLQS<br>(SEQ ID NO: 164) | (SEQ ID NO: 162)<br>QQSYITPFT<br>(SEQ ID NO: 165) |
| MA_09-E2_CC_x_I2C0_x_scFc_(V8T)_translation | NA<br>AA | (SEQ ID NO: 166)<br>RTSQSISSYLN<br>(SEQ ID NO: 169) | (SEQ ID NO: 167)<br>AASSLQG<br>(SEQ ID NO: 170) | (SEQ ID NO: 168)<br>QQSYSSPFT<br>(SEQ ID NO: 171) |
| MA_09-F11_CC_x_I2C0_x_scFc_(L60)_translation | NA<br>AA | (SEQ ID NO: 172)<br>QASQDISNYLN<br>(SEQ ID NO: 175) | (SEQ ID NO: 173)<br>AASSLQS<br>(SEQ ID NO: 176) | (SEQ ID NO: 174)<br>QQSYMWPTI<br>(SEQ ID NO: 177) |
| MA_09-F12_CC_x_I2C0_x_scFc_(D1U)_translation | NA<br>AA | (SEQ ID NO: 178)<br>QASQDISNYLN<br>(SEQ ID NO: 181) | (SEQ ID NO: 179)<br>AASSLQS<br>(SEQ ID NO: 182) | (SEQ ID NO: 180)<br>QQSYYYPTL<br>(SEQ ID NO: 183) |
| MA_09-G8_CC_x_I2C0_x_scFc_(I6K)_translation | NA<br>AA | (SEQ ID NO: 184)<br>QASQDISNYLN<br>(SEQ ID NO: 187) | (SEQ ID NO: 185)<br>AASSLQS<br>(SEQ ID NO: 188) | (SEQ ID NO: 186)<br>QQSYTLHPL<br>(SEQ ID NO: 189) |
| MA_09-G10_CC_x_I2C0_x_scFc_(C4K)_translation | NA<br>AA | (SEQ ID NO: 190)<br>QASQDISNYEN<br>(SEQ ID NO: 193) | (SEQ ID NO: 191)<br>AASSLQS<br>(SEQ ID NO: 194) | (SEQ ID NO: 192)<br>QQSYITPFT<br>(SEQ ID NO: 195) |
| MA_09-G11_CC_x_I2C0_x_scFc_(Y90)_translation | NA<br>AA | (SEQ ID NO: 196)<br>RASQFISSYLN<br>(SEQ ID NO: 199) | (SEQ ID NO: 197)<br>AASSLQS<br>(SEQ ID NO: 200) | (SEQ ID NO: 198)<br>QQSYQSPTT<br>(SEQ ID NO: 201) |
| MA_09-H7_CC_x_I2C0_x_scFc_(T3S)_translation | NA<br>AA | (SEQ ID NO: 202)<br>QASQDISNYLN<br>(SEQ ID NO: 205) | (SEQ ID NO: 203)<br>AASSLQS<br>(SEQ ID NO: 206) | (SEQ ID NO: 204)<br>QQSYFPVVE<br>(SEQ ID NO: 207) |
| MA_09-H10_CC_x_I2C0_x_scFc_(B6N)_translation | NA<br>AA | (SEQ ID NO: 208)<br>QASQDISNYLN<br>(SEQ ID NO: 211) | (SEQ ID NO: 209)<br>AASSLQS<br>(SEQ ID NO: 212) | (SEQ ID NO: 210)<br>QQSYTPPTT<br>(SEQ ID NO: 213) |
| MA_09-H11_CC_x_I2C0_x_scFc_(I8L)_translation | NA<br>AA | (SEQ ID NO: 214)<br>RASQFISSYLN<br>(SEQ ID NO: 217) | (SEQ ID NO: 215)<br>AASSLQS<br>(SEQ ID NO: 218) | (SEQ ID NO: 216)<br>QQSYSYPNS<br>(SEQ ID NO: 219) |

TABLE 23-continued

BiTE-scFc Fv#1 (MAGEB2) VL CDRs

| Ab Type | | CDR1 | CDR2 | CDR3 |
|---|---|---|---|---|
| MA_10-B5_CC_x_I2C0_x_scFc_(H6H)_ translation | NA AA | (SEQ ID NO: 220) RTSQSISSYLN (SEQ ID NO: 223) | (SEQ ID NO: 221) AASSLQG (SEQ ID NO: 224) | (SEQ ID NO: 222) QQTYSMPFT (SEQ ID NO: 225) |
| MA_10-B6_CC_x_I2C0_x_scFc_(I30)_ translation | NA AA | (SEQ ID NO: 226) RTSQSISSYLN (SEQ ID NO: 229) | (SEQ ID NO: 227) AASSLQG (SEQ ID NO: 230) | (SEQ ID NO: 228) IQAYTSPFT (SEQ ID NO: 231) |
| MA_10-D3_CC_x_I2C0_x_scFc_(O6B)_ translation | NA AA | (SEQ ID NO: 232) RTSQSISSYLN (SEQ ID NO: 235) | (SEQ ID NO: 233) AASSLQG (SEQ ID NO: 236) | (SEQ ID NO: 234) QQTYSMPFT (SEQ ID NO: 237) |
| MA_10-D6_CC_x_I2C0_x_scFc_(V6Z)_ translation | NA AA | (SEQ ID NO: 238) RTSQSISSYLN (SEQ ID NO: 241) | (SEQ ID NO: 239) AASSLQG (SEQ ID NO: 242) | (SEQ ID NO: 240) QQTYSMPFT (SEQ ID NO: 243) |
| MA_10-G2_CC_x_I2C0_x_scFc_(T1S)_ translation | NA AA | (SEQ ID NO: 244) RTSQSISSYLN (SEQ ID NO: 247) | (SEQ ID NO: 245) AASSLQS (SEQ ID NO: 248) | (SEQ ID NO: 246) QQTYSMPFT (SEQ ID NO: 249) |
| MA_10-G5_CC_x_I2C0_x_scFc_(S9O)_ translation | NA AA | (SEQ ID NO: 250) RTSQSISSYLN (SEQ ID NO: 253) | (SEQ ID NO: 251) AASSLQG (SEQ ID NO: 254) | (SEQ ID NO: 252) QQTYSMPFT (SEQ ID NO: 255) |
| MA_10-G10_AS_CC_x_I2C0_x_scFc_(T1I)_ translation | NA AA | (SEQ ID NO: 256) GGNNIGSKSVH (SEQ ID NO: 259) | (SEQ ID NO: 257) DDDNDRPS (SEQ ID NO: 260) | (SEQ ID NO: 258) QVWDYVAPRHV (SEQ ID NO: 261) |
| MA_10-G10_CC_x_I2C0_x_scFc_(B3A)_ translation | NA AA | (SEQ ID NO: 262) GGNNIGSKSVH (SEQ ID NO: 265) | (SEQ ID NO: 263) DDDNDRPS (SEQ ID NO: 266) | (SEQ ID NO: 264) QVWDYVAPRHV (SEQ ID NO: 267) |
| MA_10-H1_CC_x_I2C0_x_scFc_(T9K)_ translation | NA AA | (SEQ ID NO: 268) RTSQSISSYLN (SEQ ID NO: 271) | (SEQ ID NO: 269) AASSLQS (SEQ ID NO: 272) | (SEQ ID NO: 270) QQTYSMPFT (SEQ ID NO: 273) |
| MA_10-H3_CC_x_I2C0_x_scFc_(M9L)_ translation | NA AA | (SEQ ID NO: 274) RTSQSISSYLN (SEQ ID NO: 277) | (SEQ ID NO: 275) AASSLQG (SEQ ID NO: 278) | (SEQ ID NO: 276) QQTYSSPFT (SEQ ID NO: 279) |
| MA_81-B9_CC_x_I2C0_x_scFc_(U4L)_ translation | NA AA | (SEQ ID NO: 280) KSSQSVLYSSNNK-NYLA (SEQ ID NO: 283) | (SEQ ID NO: 281) WASTRES (SEQ ID NO: 284) | (SEQ ID NO: 282) QQFYSTPIT (SEQ ID NO: 285) |
| MA_86-A4_CC_x_I2C0_x_scFc_(K2W)_ translation | NA AA | (SEQ ID NO: 286) RASQGISNYLA (SEQ ID NO: 289) | (SEQ ID NO: 287) AASTLQS (SEQ ID NO: 290) | (SEQ ID NO: 288) QKYNSAPFT (SEQ ID NO: 291) |
| MA_86-A4-N-F5_CC_x_I2C0_x_scFc_(M4H)_ translation | NA AA | (SEQ ID NO: 292) RASQGISNYLA (SEQ ID NO: 295) | (SEQ ID NO: 293) AASTLQS (SEQ ID NO: 296) | (SEQ ID NO: 294) QKYNSAPFT (SEQ ID NO: 297) |
| MA_88-B3-F9_CC_x_I2C0_x_scFc_(Y4E)_ translation | NA AA | (SEQ ID NO: 298) GGNNIGSKSVH (SEQ ID NO: 301) | (SEQ ID NO: 299) DDADRPS (SEQ ID NO: 302) | (SEQ ID NO: 300) QVWDASAGYGVV (SEQ ID NO: 303) |
| MA_98-C7_CC_x_I2C0_x_scFc_(Y8P)_ translation | NA AA | (SEQ ID NO: 304) GGNNIGSKSVH (SEQ ID NO: 307) | (SEQ ID NO: 305) DDDNDRPS (SEQ ID NO: 308) | (SEQ ID NO: 306) QVWDYSPLRHV (SEQ ID NO: 309) |
| MA_98-G12_AS_CC_x_I2C0_x_scFc_(Q4Z)_ translation | NA AA | (SEQ ID NO: 310) GGNNIGSKSVH (SEQ ID NO: 313) | (SEQ ID NO: 311) DDDNDRPS (SEQ ID NO: 314) | (SEQ ID NO: 312) QVWDYFSMTHV (SEQ ID NO: 315) |
| MA_SG-F28_CC_x_I2C0_x_scFc_(D9R)_ translation | NA AA | (SEQ ID NO: 316) RSSQSLLHRSGYNYLD (SEQ ID NO: 319) | (SEQ ID NO: 317) LGSNRAS (SEQ ID NO: 320) | (SEQ ID NO: 318) MQALQTPWT (SEQ ID NO: 321) |

TABLE 24

| Ab | Type | CDR1 | CDR2 | CDR3 |
|---|---|---|---|---|
| | | BiTE-scFc_Fv#1 (MAGEB2) VH CDRs | | |
| MA_03-C7_AS_CC_x_I2C0_x_scFc_(G2H)_ | NA | (SEQ ID NO: 322) | (SEQ ID NO: 323) | (SEQ ID NO: 324) |
| translation | AA | SHAMS | AISGSGGGTYYAASVKG | GKGVHLGEDY |
| | | (SEQ ID NO: 325) | (SEQ ID NO: 326) | (SEQ ID NO: 327) |
| MA_03-D8_AS_CC_x_I2C0_x_scFc_(L7E)_ | NA | (SEQ ID NO: 328) | (SEQ ID NO: 329 | (SEQ ID NO: 330) |
| translation | AA | SHAMS | TISGSGGGTYYAASVKG | GKGVHLGEDY |
| | | (SEQ ID NO: 331) | (SEQ ID NO: 332) | (SEQ ID NO: 333) |
| MA_03-D8_CC_x_I2C0_x_scFc_(H6N)_ | NA | (SEQ ID NO: 334) | (SEQ ID NO: 335) | (SEQ ID NO: 336) |
| translation | AA | SHAMS | TISGSGGGTYYADSVKG | GKGVHLGEDY |
| | | (SEQ ID NO: 337) | (SEQ ID NO: 338) | (SEQ ID NO: 339) |
| MA_03-D12_AS_CC_x_I2C0_x_scFc_(L6A)_ | NA | (SEQ ID NO: 340 | (SEQ ID NO: 341) | (SEQ ID NO: 342) |
| translation | AA | SHAMS | AISGSGGGTYYAASVKA | GKGVHLGFDY |
| | | (SEQ ID NO: 343) | (SEQ ID NO: 344) | (SEQ ID NO: 345) |
| MA_03-E7_AS_CC_x_I2C0_x_scFc_(L6M)_ | NA | (SEQ ID NO: 346) | (SEQ ID NO: 347) | (SEQ ID NO: 348) |
| translation | AA | SHAMS | AISGSGGGTYYAASGKG | GKGVHLGFDY |
| | | (SEQ ID NO: 349) | (SEQ ID NO: 350) | (SEQ ID NO: 351) |
| MA_03-E11_AS_CC_x_I2C0_x_scFc_(G2B)_ | NA | (SEQ ID NO: 352) | (SEQ ID NO: 353) | (SEQ ID NO: 354) |
| translation | AA | SHAMS | AISGSGGGTYNAASVKG | GKGVHLGFDY |
| | | (SEQ ID NO: 355) | (SEQ ID NO: 356) | (SEQ ID NO: 357) |
| MA_03-G10_AS_CC_x_I2C0_x_scFc_(N3H)_ | NA | (SEQ ID NO: 358) | (SEQ ID NO: 359) | (SEQ ID NO: 360) |
| translation | AA | SYAMS | AISGSGGGTYYAASVKG | GKGVHLGFDY |
| | | (SEQ ID NO: 361) | (SEQ ID NO: 362) | (SEQ ID NO: 363) |
| MA_03-G11_AS_CC_x_I2C0_x_scFc_(O4R)_ | NA | (SEQ ID NO: 364) | (SEQ ID NO: 365) | (SEQ ID NO: 366) |
| translation | AA | SHAMS | AISGSGGGTYYAASVKG | GKGVHLNEDY |
| | | (SEQ ID NO: 367) | (SEQ ID NO: 368) | (SEQ ID NO: 369) |
| MA_03-H12_AS_CC_x_I2C0_x_scFc_(K5A)_ | NA | (SEQ ID NO: 370) | (SEQ ID NO: 371) | (SEQ ID NO: 372) |
| translation | AA | SHAMS | AISGSGGGTYNAASVKG | GKGVHLGFDY |
| | | (SEQ ID NO: 373) | (SEQ ID NO: 374) | (SEQ ID NO: 375) |
| MA_09-C7_CC_x_I2C0_x_scFc_(K9T)_ | NA | (SEQ ID NO: 376) | (SEQ ID NO: 377) | (SEQ ID NO: 378) |
| translation | AA | THKMGVD | EIHSEDDKRYSPSLQS | RRYNWNYENWFDP |
| | | (SEQ ID NO:379) | (SEQ ID NO: 380) | (SEQ ID NO: 381) |
| MA_09-E2_CC_x_I2C0_x_scFc_(V8T)_ | NA | (SEQ ID NO: 382) | (SEQ ID NO: 383 | (SEQ ID NO: 384) |
| translation | AA | NAWMS | RIKSKTYGGTTDYAAPVKG | PSYSGSYYNYFSVMDV |
| | | (SEQ ID NO: 385) | (SEQ ID NO: 386) | (SEQ ID NO: 387) |
| MA_09-F11_CC_x_I2C0_x_scFc_(L60)_ | NA | (SEQ ID NO: 388) | (SEQ ID NO: 389) | (SEQ ID NO: 390) |
| translation | AA | THKMGVD | LIYWNDDKRYSPSLQS | RRYNWNYENWFDP |
| | | (SEQ ID NO: 391) | (SEQ ID NO: 392) | (SEQ ID NO: 393) |
| MA_09-F12_CC_x_I2C0_x_scFc_(D1U)_ | NA | (SEQ ID NO: 394) | (SEQ ID NO: 395) | (SEQ ID NO: 396) |
| translation | AA | THKMGVD | LIYWNDDKRYSPSLQS | RRYNWNYENWFDP |
| | | (SEQ ID NO: 397) | (SEQ ID NO: 398) | (SEQ ID NO: 399) |
| MA_09-G8_CC_x_I2C0_x_scFc_(I6K)_ | NA | (SEQ ID NO: 400) | (SEQ ID NO: 401) | (SEQ ID NO: 402) |
| translation | AA | THKMGVD | LIYWNDDKRYSPSLQS | RRYNWNYENWEDP |
| | | (SEQ ID NO: 403) | (SEQ ID NO: 404) | (SEQ ID NO: 405) |
| MA_09-G10_CC_x_I2C0_x_scFc_(C4K)_ | NA | (SEQ ID NO: 406) | (SEQ ID NO: 407) | (SEQ ID NO: 408) |
| translation | AA | THKMGVD | GIHIYDDKRYSPSLQS | RRYNWNYENWEDP |
| | | (SEQ ID NO: 409) | (SEQ ID NO: 410) | (SEQ ID NO: 411) |
| MA_09-G11_CC_x_I2C0_x_scFc_(Y90)_ | NA | (SEQ ID NO: 412) | (SEQ ID NO: 413) | (SEQ ID NO: 414) |
| translation | AA | THKMGVD | LIYWNDDKRYSPSLQS | RRYNWNYENWFDP |
| | | (SEQ ID NO: 415) | (SEQ ID NO: 416) | (SEQ ID NO: 417) |
| MA_09-H7_CC_x_I2C0_x_scFc_(T3S)_ | NA | (SEQ ID NO: 418) | (SEQ ID NO: 419) | (SEQ ID NO: 420) |
| translation | AA | THKMGVD | LIYWNDDKRYSPSLQS | RRYNWNYENWEDP |
| | | (SEQ ID NO: 421) | (SEQ ID NO: 422) | (SEQ ID NO: 423) |
| MA_09-H10_CC_x_I2C0_x_scFc_(B6N)_ | NA | (SEQ ID NO: 424) | (SEQ ID NO: 425) | (SEQ ID NO: 426) |
| translation | AA | THKMGVD | LIYWNDDKRYSPSLQS | RRYNWNYENWEDP |
| | | (SEQ ID NO: 427) | (SEQ ID NO: 428) | (SEQ ID NO: 429) |
| MA_09-H11_CC_x_I2C0_x_scFc_(I8L)_ | NA | (SEQ ID NO: 430) | (SEQ ID NO: 431) | (SEQ ID NO: 432) |
| translation | AA | THKMGVD | LIYWNDDKRYSPSLQS | RRYNWNYENWFDP |
| | | (SEQ ID NO: 433) | (SEQ ID NO: 434) | (SEQ ID NO: 435) |

TABLE 24-continued

BiTE-scFc Fv#1 (MAGEB2) VH CDRs

| Ab | Type | CDR1 | CDR2 | CDR3 |
|---|---|---|---|---|
| MA_10-B5_CC_x_I2C0_x_scFc_(H6H)_ | NA | (SEQ ID NO: 436) | (SEQ ID NO: 437) | (SEQ ID NO: 438) |
| translation | AA | NAWMS | RIRSRSYGGTTDYAAPVKG | PSYSGSYYNYFSVMDV |
|  |  | (SEQ ID NO: 439) | (SEQ ID NO: 440) | (SEQ ID NO: 441) |
| MA_10-B6_CC_x_I2C0_x_scFc_(I30)_ | NA | (SEQ ID NO: 442) | (SEQ ID NO: 443) | (SEQ ID NO: 444) |
| translation | AA | NAWMS | RIKSKTYGGTTDYAAPVKG | PSYSGSYYNYFSVMDV |
|  |  | (SEQ ID NO: 445) | (SEQ ID NO: 446) | (SEQ ID NO: 447) |
| MA_10-D3_CC_x_I2C0_x_scFc_(O6B)_ | NA | (SEQ ID NO: 448) | (SEQ ID NO: 449) | (SEQ ID NO: 450) |
| translation | AA | NAWMS | RITSSRYGGTTDYAAPVKG | PSYSGSYYNYFSVMDV |
|  |  | (SEQ ID NO: 451) | (SEQ ID NO: 452) | (SEQ ID NO: 453) |
| MA_10-D6_CC_x_I2C0_x_scFc_(V6Z)_ | NA | (SEQ ID NO: 454) | (SEQ ID NO: 455) | (SEQ ID NO: 456) |
| translation | AA | NAWMS | RILNNAYGGTTDYAAPVKG | PSYSGSYYNYFSVMDV |
|  |  | (SEQ ID NO: 457) | (SEQ ID NO: 458) | (SEQ ID NO: 459) |
| MA_10-G2_CC_x_I2C0_x_scFc_(T1S)_ | NA | (SEQ ID NO: 460) | (SEQ ID NO: 461) | (SEQ ID NO: 462) |
| translation | AA | NAWMS | RILSMHYGGTTDYAAPVKG | PSYSGSYYNYFSVMDV |
|  |  | (SEQ ID NO: 463) | (SEQ ID NO: 464) | (SEQ ID NO: 465) |
| MA_10-G5_CC_x_I2C0_x_scFc_(S9O)_ | NA | (SEQ ID NO: 466) | (SEQ ID NO: 467) | (SEQ ID NO: 468) |
| translation | AA | NAWMS | RIVSSTYGGTTDYAAPVKG | PSYSGSYYNYFSVMDV |
|  |  | (SEQ ID NO: 469) | (SEQ ID NO: 470) | (SEQ ID NO: 471) |
| MA_10-G10_AS_CC_x_I2C0_x_scFc_(T1I)_ | NA | (SEQ ID NO: 472) | (SEQ ID NO: 473) | (SEQ ID NO: 474) |
| translation | AA | SHAMS | AISGSGGGTYNAASVKG | GKGVHLGEDY |
|  |  | (SEQ ID NO: 475) | (SEQ ID NO: 476) | (SEQ ID NO: 477) |
| MA_10-G10_CC_x_I2C0_x_scFc_(B3A)_ | NA | (SEQ ID NO: 478) | (SEQ ID NO: 479) | (SEQ ID NO: 480) |
| translation | AA | SHAMS | AISGSGGGTYNADSVKG | GKGVHLGEDY |
|  |  | (SEQ ID NO: 481) | (SEQ ID NO: 482) | (SEQ ID NO: 483) |
| MA_10-H1_CC_x_I2C0_x_scFc_(T9K)_ | NA | (SEQ ID NO: 484) | (SEQ ID NO: 485) | (SEQ ID NO: 486) |
| translation | AA | NAWMS | RITSGIYGGTTDYAAPVKG | PSYSGSYYNYFSVMDV |
|  |  | (SEQ ID NO: 487) | (SEQ ID NO: 488) | (SEQ ID NO: 489) |
| MA_10-H3_CC_x_I2C0_x_scFc_(M9L)_ | NA | (SEQ ID NO: 490) | (SEQ ID NO: 491) | (SEQ ID NO: 492) |
| translation | AA | NAWMS | RIRSRPYGGTTDYAAPVKG | PSYSGSYYNYFSVMDV |
|  |  | (SEQ ID NO: 493) | (SEQ ID NO: 494) | (SEQ ID NO: 495) |
| MA_81-B9_CC_x_I2C0_x_scFc_(U4L)_ | NA | (SEQ ID NO: 496) | (SEQ ID NO: 497) | (SEQ ID NO: 498) |
| translation | AA | SSRYYWG | SIYYSGSTYYNPSLKS | GIFGVITYFDY |
|  |  | (SEQ ID NO: 499) | (SEQ ID NO: 500) | (SEQ ID NO: 501) |
| MA_86-A4_CC_x_I2C0_x_scFc_(K2W)_ | NA | (SEQ ID NO: 502) | (SEQ ID NO: 503) | (SEQ ID NO: 504) |
| translation | AA | TYGMH | VISYDASNKYYAESVKG | GQLLTGY |
|  |  | (SEQ ID NO: 505) | (SEQ ID NO: 506) | (SEQ ID NO: 507) |
| MA_86-A4-N-F5_CC_x_I2C0_x_scFc_(M4H)_ | NA | (SEQ ID NO: 508) | (SEQ ID NO: 509) | (SEQ ID NO: 510) |
| translation | AA | TYGMH | VISYDAETVKYAESVKG | GQLLTGY |
|  |  | (SEQ ID NO: 511) | (SEQ ID NO: 512) | (SEQ ID NO: 513) |
| MA_88-B3-F9_CC_x_I2C0_x_scFc_(Y4E)_ | NA | (SEQ ID NO: 514) | (SEQ ID NO: 515) | (SEQ ID NO: 516) |
| translation | AA | DYYMS | YISKSSYTVTYADAVKG | YNYGHEDY |
|  |  | (SEQ ID NO: 517) | (SEQ ID NO: 518) | (SEQ ID NO: 519) |
| MA_98-C7_CC_x_I2C0_x_scFc_(Y8P)_ | NA | (SEQ ID NO: 520) | (SEQ ID NO: 521) | (SEQ ID NO: 522) |
| translation | AA | SHAMS | SISGSGGGTYYAASVKG | GKGVHLGFDY |
|  |  | (SEQ ID NO: 523) | (SEQ ID NO: 524) | (SEQ ID NO: 525) |
| MA_98-G12_AS_CC_x_I2C0_x_scFc_(Q4Z) | NA | (SEQ ID NO: 526) | (SEQ ID NO: 527) | (SEQ ID NO: 528) |
| translation | AA | SHAMS | AISGSGGGTYNAASVKG | GKGVHLGEDY |
|  |  | (SEQ ID NO: 529) | (SEQ ID NO: 530) | (SEQ ID NO: 531) |
| MA_SG-F28_CC_x_I2C0_x_scFc_(D9R)_ | NA | (SEQ ID NO: 532) | (SEQ ID NO: 533) | (SEQ ID NO: 534) |
| translation | AA | SNPYWS | YISYSGITNYNPSLKS | EKMWFGVLNYYYGMDV |
|  |  | (SEQ ID NO: 535) | (SEQ ID NO: 536) | (SEQ ID NO: 537) |

TABLE 25

BiTE-scFc_Fv#2 (CD3) VL CDRs

| Ab | Type | CDR1 | CDR2 | CDR3 |
|---|---|---|---|---|
| MA_03-C7_AS_CC_x_I2C0_x_scFc_(G2H)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-D8_AS_CC_x_I2C0_x_scFc_(L7E)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-D8_CC_x_I2C0_x_scFc_(H6N)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-D12_AS_CC_x_I2C0_x_scFc_(L6A)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-E7_AS_CC_x_I2C0_x_scFc_(L6M)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-E11_AS_CC_x_I2C0_x_scFc_(G2B)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-G10_AS_CC_x_I2C0_x_scFc_(N3H)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-G11_AS_CC_x_I2C0_x_scFc_(O4R)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_03-H12_AS_CC_x_I2C0_x_scFc_(K5A)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-C7_CC_x_I2C0_x_scFc_(K9T)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-E2_CC_x_I2C0_x_scFc_(V8T)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-F11_CC_x_I2C0_x_scFc_(L60)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-F12_CC_x_I2C0_x_scFc_(D1U)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-G8_CC_x_I2C0_x_scFc_(I6K)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-G10_CC_x_I2C0_x_scFc_(C4K)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-G11_CC_x_I2C0_x_scFc_(Y90)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-H7_CC_x_I2C0_x_scFc_(T3S)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-H10_CC_x_I2C0_x_scFc_(B6N)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |
| MA_09-H11_CC_x_I2C0_x_scFc_(I8L)_ translation | NA<br>AA | (SEQ ID NO: 538)<br>GSSTGAVTSGNYPN<br>(SEQ ID NO: 541) | (SEQ ID NO: 539)<br>GTKFLAP<br>(SEQ ID NO: 542) | (SEQ ID NO: 540)<br>VLWYSNRWV<br>(SEQ ID NO: 543) |

TABLE 25-continued

| BiTE-scFc Fv#2 (CD3) VL CDRs | | | | |
|---|---|---|---|---|
| Ab | Type | CDR1 | CDR2 | CDR3 |
| MA_10-B5_CC_x_I2C0_x_scFc_(H6H)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-B6_CC_x_I2C0_x_scFc_(I30)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-D3_CC_x_I2C0_x_scFc_(O6B)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-D6_CC_x_I2C0_x_scFc_(V6Z)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-G2_CC_x_I2C0_x_scFc_(T1S)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-G5_CC_x_I2C0_x_scFc_(S9O)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-G10_AS_CC_x_I2C0_x_scFc_(T1I) translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-G10_CC_x_I2C0_x_scFc_(B3A)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-H1_CC_x_I2C0_x_scFc_(T9K)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_10-H3_CC_x_I2C0_x_scFc_(M9L)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_81-B9_CC_x_I2C0_x_scFc_(U4L)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_86-A4_CC_x_I2C0_x_scFc_(K2W)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_86-A4-N-F5_CC_x_I2C0_x_scFc_ (M4H)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_88-B3-F9_CC_x_I2C0_x_scFc_(Y4E)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_98-C7_CC_x_I2C0_x_scFc_(Y8P)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_98-G12_AS_CC_x_I2C0_x_scFc_(Q4Z)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |
| MA_SG-F28_CC_x_I2C0_x_scFc_(D9R)_ translation | NA AA | (SEQ ID NO: 538) GSSTGAVTSGNYPN (SEQ ID NO: 541) | (SEQ ID NO: 539) GTKFLAP (SEQ ID NO: 542) | (SEQ ID NO: 540) VLWYSNRWV (SEQ ID NO: 543) |

TABLE 26

| | | BiTE-scFc_Fv#2 (CD3) VH CDRs | | |
|---|---|---|---|---|
| Ab | Type | CDR1 | CDR2 | CDR3 |
| MA_03-C7_AS_CC_x_I2C0_x_scFc_(G2H)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-D8_AS_CC_x_I2C0_x_scFc_(L7E)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-D8_CC_x_I2C0_x_scFc_(H6N)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-D12_AS_CC_x_I2C0_x_scFc_(L6A)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-E7_AS_CC_x_I2C0_x_scFc_(L6M)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-E11_AS_CC_x_I2C0_x_scFc_(G2B)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-G10_AS_CC_x_I2C0_x_scFc_(N3H)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-G11_AS_CC_x_I2C0_x_scFc_(O4R)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_03-H12_AS_CC_x_I2C0_x_scFc_(K5A)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-C7_CC_x_I2C0_x_scFc_(K9T)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-E2_CC_x_I2C0_x_scFc_(V8T)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-F11_CC_x_I2C0_x_scFc_(L60)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-F12_CC_x_I2C0_x_scFc_(D1U)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-G8_CC_x_I2C0_x_scFc_(I6K)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-G10_CC_x_I2C0_x_scFc_(C4K)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-G11_CC_x_I2C0_x_scFc_(Y90)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-H7_CC_x_I2C0_x_scFc_(T3S)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-H10_CC_x_I2C0_x_scFc_(B6N)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_09-H11_CC_x_I2C0_x_scFc_(I8L)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |

TABLE 26-continued

| | | BiTE-scFc Fv#2 (CD3) VH CDRs | | |
|---|---|---|---|---|
| Ab | Type | CDR1 | CDR2 | CDR3 |
| MA_10-B5_CC_x_I2C0_x_scFc_(H6H)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-B6_CC_x_I2C0_x_scFc_(I30)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-D3_CC_x_I2C0_x_scFc_(O6B)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-D6_CC_x_I2C0_x_scFc_(V6Z)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-G2_CC_x_I2C0_x_scFc_(T1S)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-G5_CC_x_I2C0_x_scFc_(S9O)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-G10_AS_CC_x_I2C0_x_scFc_(T1I)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-G10_CC_x_I2C0_x_scFc_(B3A)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-H1_CC_x_I2C0_x_scFc_(T9K)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_10-H3_CC_x_I2C0_x_scFc_(M9L)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_81-B9_CC_x_I2C0_x_scFc_(U4L)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_86-A4_CC_x_I2C0_x_scFc_(K2W)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_86-A4-N-F5_CC_x_I2C0_x_scFc_ (M4H)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_88-B3-F9_CC_x_I2C0_x_scFc_(Y4E)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_98-C7_CC_x_I2C0_x_scFc_(Y8P)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_98-G12_AS_CC_x_I2C0_x_scFc_(Q4Z) translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |
| MA_SG-F28_CC_x_I2C0_x_scFc_(D9R)_ translation | NA AA | (SEQ ID NO: 544) KYAMN (SEQ ID NO: 547) | (SEQ ID NO: 545) RIRSKYNNYATYYADSVKD (SEQ ID NO: 548) | (SEQ ID NO: 546) HGNFGNSYISYWAY (SEQ ID NO: 549) |

TABLE 27

| | | Fv#1 (MAGEB2) |
|---|---|---|
| Ab | Type | LC V-region |
| MA_03-C7_AS_CC_x_I2C0_x_scFc_(G2H)_translation | NA AA | (SEQ ID NO: 550)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYERPAMVFGCGTKLTVL<br>(SEQ ID NO: 552) |
| MA_03-D8_AS_CC_x_I2C0_x_scFc_(L7E)_translation | NA AA | (SEQ ID NO: 554)<br>SYVLTQPPSVSVAPGQTARITCGGNNIGSKSVHWYQQKP<br>GQAPVMVVYDDNDRPSGIPERFSGSNEGNTATLIISRVE<br>AGDEADYYCQVWDYRTLDWVFGCGTKLTVL<br>(SEQ ID NO: 556) |
| MA_03-D8_CC_x_I2C0_x_scFc_(H6N)_translation | NA AA | (SEQ ID NO: 558)<br>SYVLTQPPSVSVAPGQTARITCGGNNIGSKSVHWYQQKP<br>GQAPVMVVYDDNDRPSGIPERFSGSNFGNTATLIISRVE<br>AGDEADYYCQVWDYRTLDWVFGCGTKLTVL<br>(SEQ ID NO: 560) |
| MA_03-D12_AS_CC_x_I2C0_x_scFc_(L6A)_translation | NA AA | (SEQ ID NO: 562)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYLRQQQVFGCGTKLTVL<br>(SEQ ID NO: 564) |
| MA_03-E7_AS_CC_x_I2C0_x_scFc_(L6M)_translation | NA AA | (SEQ ID NO: 566)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYNMNVWVFGCGTKLTVL<br>(SEQ ID NO: 568) |
| MA_03-E11_AS_CC_x_I2C0_x_scFc_(G2B)_translation | NA AA | (SEQ ID NO: 570)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYYSNRAVFGCGTKLTVL<br>(SEQ ID NO: 572) |
| MA_03-G10_AS_CC_x_I2C0_x_scFc_(N3H)_translation | NA AA | (SEQ ID NO: 574)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYSGQRQVFGCGTKLTVL<br>(SEQ ID NO: 576) |
| MA_03-G11_AS_CC_x_I2C0_x_scFc_(O4R)_translation | NA AA | (SEQ ID NO: 578)<br>SYVLTQPPSVSVAPGQTARITCGGNNIGSKSVHWYQQKP<br>GQAPVLVVYDDNDRPSGIPERFSGSNFGNTATLIISRVE<br>AGDEADYYCQVWDYLLPGQVFGCGTKLTVL<br>(SEQ ID NO: 580) |
| MA_03-H12_AS_CC_x_I2C0_x_scFc_(K5A)_translation | NA AA | (SEQ ID NO: 582)<br>SYVLTQPPSVSVAPGQTARITCGGNNIGSKSVHWYQQKP<br>GQAPVMVVYDDNDRPSGIPERFSGSNEGNTATLTISRVE<br>AGDEADYYCQVWDYVTPRWVFGCGTKLTVL<br>(SEQ ID NO: 584) |
| MA_09-C7_CC_x_I2C0_x_scFc_(K9T)_translation | NA AA | (SEQ ID NO: 586)<br>DIQMTQSPSSLSASVGDRVTITCRASQSISNYFNWYQQK<br>PGKAPKLLIYAASSLQSGVPSRESGSGSGTDFTLTISSL<br>QPEDFATYYCQQSYITPFTFGCGTKVEIK<br>(SEQ ID NO: 588) |
| MA_09-E2_CC_x_I2C0_x_scFc_(V8T)_translation | NA AA | (SEQ ID NO: 590)<br>DIQMTQSPSSLSASVGDRVTITCRTSQSISSYLNWYQQK<br>PGRAPKLLIFAASSLQGGVPSRESGSGSGTDFTLTISSL<br>QPEDFATYYCQQSYSSPFTFGCGTKVEIK<br>(SEQ ID NO: 592) |
| MA_09-F11_CC_x_I2C0_x_scFc_(L60)_translation | NA AA | (SEQ ID NO: 594)<br>DIQMTQSPDSLSASVGDRVTITCQASQDISNYLNWYQQK<br>PGKAPKLLIYAASSLQSGVPSRESGSGSGTDFTLTISSL<br>QPEDFATYYCQQSYMWPTIFGCGTKVEIK<br>(SEQ ID NO: 596) |

TABLE 27-continued

| BiTE-scFc_Variable Region Sequences | | |
|---|---|---|
| MA_09-F12_CC_x_I2C0_x_scFc_(D1U)_translation | NA<br>AA | (SEQ ID NO: 598)<br>DIQMTQSPSSLSASVGDRVTITCQASQDISNYLNWYQQK<br>PGKAPKLLIYAASSLQSGVPSRESGRGSGTDFTLTISSL<br>QPEDFATYYCQQSYYYPTLEGCGTKVEIK<br>(SEQ ID NO: 600) |
| MA_09-G8_CC_x_I2C0_x_scFc_(I6K)_translation | NA<br>AA | (SEQ ID NO: 602)<br>DIQMTQSPSSLSASVGDRVTITCQASQDISNYLNWYQQK<br>PGKAPKLLIYAASSLQSGVPSRFSGSGSGTDFTLTISSL<br>QPEDFATYYCQQSYTLHPLFGCGTKVEIK<br>(SEQ ID NO: 604) |
| MA_09-G10_CC_x_I2C0_x_scFc_(C4K)_translation | NA<br>AA | (SEQ ID NO: 606)<br>DIQMTQSPSSLSASVGDRVTITCQASQDISNYENWYQQK<br>PGKAPKLLIYAASSLQSGVPSRESGSGSGTDFTLTISSL<br>QPEDFATYYCQQSYITPFTEGCGTKVEIK<br>(SEQ ID NO: 608) |
| MA_09-G11_CC_x_I2C0_x_scFc_(Y9O)_translation | NA<br>AA | (SEQ ID NO: 610)<br>DIQMTQSPSSLSASVGDRVTITCRASQFISSYLNWYQQK<br>PGKAPKLLIYAASSLQSGVPSRESGRGSGTDFTLTISSL<br>QPEDFATYYCQQSYQSPTTFGCGTKVEIK<br>(SEQ ID NO: 612) |
| MA_09-H7_CC_x_I2C0_x_scFc_(T3S)_translation | NA<br>AA | (SEQ ID NO: 614)<br>DIQMTQSPSSLSASVGDRVTITCQASQDISNYLNWYQQK<br>PGKAPKLLIYAASSLQSGVPSRESGSGSGTDFTLTISSL<br>QPEDFATYYCQQSYFPVVEFGCGTKVEIK<br>(SEQ ID NO: 616) |
| MA_09-H10_CC_x_I2C0_x_scFc_(B6N)_translation | NA<br>AA | (SEQ ID NO: 618)<br>DIQMTQSPSSLSASVGDRVTITCQASQDISNYLNWYQQK<br>PGKAPKLLIYAASSLQSGVPSRESGRGSGTDFTLTISSL<br>QPEDFATYYCQQSYTPPTTFGCGTKVEIK<br>(SEQ ID NO: 620) |
| MA_09-H11_CC_x_I2C0_x_scFc_(I8L)_translation | NA<br>AA | (SEQ ID NO: 622)<br>DIQMTQSPSSLSASVGDRVTITCRASQFISSYLNWYQQK<br>PGKAPKLLIYAASSLQSGVPSRESGSGSGTDFTLTISSL<br>QPEDFATYYCQQSYSYPNSFGCGTKVEIK<br>(SEQ ID NO: 624) |
| MA_10-B5_CC_x_I2C0_x_scFc_(H6H)_translation | NA<br>AA | (SEQ ID NO: 626)<br>DIQMTQSPSSLSASVGDRVTITCRTSQSISSYLNWYQQK<br>PGRAPKLLIFAASSLQGGVPSRESGSGSGTDFTLTISSL<br>QPEDFATYYCQQTYSMPFTFGCGTKVEIK<br>(SEQ ID NO: 628) |
| MA_10-B6_CC_x_I2C0_x_scFc_(I3O)_translation | NA<br>AA | (SEQ ID NO: 630)<br>DIQMTQSPSSLSASVGDRVTITCRTSQSISSYLNWYQQK<br>PGRAPKLLIFAASSLQGGVPSRESGSGSGTDFTLTISSL<br>QPEDFATYYCIQAYTSPFTFGCGTKLEIK<br>(SEQ ID NO: 632) |
| MA_10-D3_CC_x_I2C0_x_scFc_(O6B)_translation | NA<br>AA | (SEQ ID NO: 634)<br>DIQMTQSPSSLSASVGDRVTITCRTSQSISSYLNWYQQK<br>PGRAPKLLIFAASSLQGGVPSRFSGSGSGTDFTLTISSL<br>QPEDFATYYCQQTYSMPFTFGCGTKVDIK<br>(SEQ ID NO: 636) |
| MA_10-D6_CC_x_I2C0_x_scFc_(V6Z)_translation | NA<br>AA | (SEQ ID NO: 638)<br>DIQMTQSPSSLSASVGDRVTITCRTSQSISSYLNWYQQK<br>PGRAPKLLIFAASSLQGGVPSRESGSGSGTDFTLTISSL<br>QPEDFATYYCQQTYSMPFTFGCGTKVDIK<br>(SEQ ID NO: 640) |
| MA_10-G2_CC_x_I2C0_x_scFc_(T1S)_translation | NA<br>AA | (SEQ ID NO: 642)<br>DIQMTQSPSSLSASVGDRVTITCRTSQSISSYLNWFQQK<br>PGKAPKLLIFAASSLQSGVPSRESGSGSGTDFTLTISSL<br>QPEDFATYYCQQTYSMPFTFGCGTKVDIK<br>(SEQ ID NO: 644) |
| MA_10-G5_CC_x_I2C0_x_scFc_(S9O)_translation | NA<br>AA | (SEQ ID NO: 646)<br>DIQMTQSPSSLSASVGDRVTITCRTSQSISSYLNWYQQK<br>PGRAPKLLIFAASSLQGGVPSRESGSGSGTDFTLTISSL<br>QPEDFATYYCQQTYSMPFTFGCGTKVDIK<br>(SEQ ID NO: 648) |

TABLE 27-continued

BiTE-scFc_Variable Region Sequences

| | | |
|---|---|---|
| MA_10-G10_AS_CC_x_I2C0_<br>x_scFc_(T1I)_translation | NA<br>AA | (SEQ ID NO: 650)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYVAPRHVFGCGTKLTVL<br>(SEQ ID NO: 652) |
| MA_10-G10_CC_x_I2C0_x_<br>scFc_(B3A)_translation | NA<br>AA | (SEQ ID NO: 654)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYVAPRHVFGCGTKLTVL<br>(SEQ ID NO: 656) |
| MA_10-H1_CC_x_I2C0_x_<br>scFc_(T9K)_translation | NA<br>AA | (SEQ ID NO: 658)<br>DIQMTQSPSSLSASVGDRVTITCRTSQSISSYLNWYQQK<br>PGRAPKLLIFAASSLQSGVPSRESGSGSGTDFTLTISSL<br>QPEDFATYYCQQTYSMPFTFGCGTKVDIK<br>(SEQ ID NO: 660) |
| MA_10-H3_CC_x_I2C0_x_<br>scFc_(M9L)_translation | NA<br>AA | (SEQ ID NO: 662)<br>DIQMTQSPSSLSASVGDRVTITCRTSQSISSYLNWYQQK<br>PGRAPKLLIFAASSLQGGVPSRFSGSGSGTDFTLTISSL<br>QPEDFATYYCQQTYSSPFTFGCGTKLEIK<br>(SEQ ID NO: 664) |
| MA_81-B9_CC_x_I2C0_x_<br>scFc_(U4L)_translation | NA<br>AA | (SEQ ID NO: 666)<br>DIVMTQSPDSLAVSLGERATINCKSSQSVLYSSNNKNYL<br>AWYQQKPGQPPKLLIYWASTRESGVPDRFSGSGSGTDFT<br>LTISSLQAEDVAVYYCQQFYSTPITFGCGTRLEIK<br>(SEQ ID NO: 668) |
| MA_86-A4_CC_x_I2C0_x_<br>scFc_(K2W)_translation | NA<br>AA | (SEQ ID NO: 670)<br>DIQMTQSPSSLSASVGDRVTITCRASQGISNYLAWYQQK<br>PGKVPKLLIYAASTLQSGVPSRESGSGSGTDFTLTISSL<br>QPEDFATYYCQKYNSAPFTFGCGTKVEIK<br>(SEQ ID NO: 672) |
| MA_86-A4-N-F5_CC_x_I2C0_<br>x_scFc_(M4H)_translation | NA<br>AA | (SEQ ID NO: 674)<br>DIQMTQSPSSLSASVGDRVTITCRASQGISNYLAWYQQK<br>PGKVPKLLIYAASTLQSGVPSRESGSGSGTDFTLTISSL<br>QPEDVATYYCQKYNSAPFTFGCGTKVEIK<br>(SEQ ID NO: 676) |
| MA_88-B3-F9_CC_x_I2C0_x_<br>scFc_(Y4E)_translation | NA<br>AA | (SEQ ID NO: 678)<br>SYVLTQPPSVSVAPGQTARITCGGNNIGSKSVHWYQQKP<br>GQAPVLVVYDDADRPSGIPERFSGSNSGNTATLTISRVE<br>AGDEADYYCQVWDASAGYGVVFGCGTKLTVL<br>(SEQ ID NO: 680) |
| MA_98-C7_CC_x_I2C0_x_<br>scFc_(Y8P)_translation | NA<br>AA | (SEQ ID NO: 682)<br>SYVLTQPPSVSVAPGQTARITCGGNNIGSKSVHWYQQKP<br>GQAPVMVVYDDNDRPSGIPERFSGSNSGNTATLTISRVE<br>AGDEADYYCQVWDYSPLRHVFGCGTKLTVL<br>(SEQ ID NO: 684) |
| MA_98-G12_AS_CC_x_I2C0_x<br>scFc_(Q4Z)_translation | NA<br>AA | (SEQ ID NO: 686)<br>SYVLTQPPSVSVAPGQTARITCGGNNIGSKSVHWYQQKP<br>GQAPVMVVYDDNDRPSGIPERFSGSNFGNTATLIISRVE<br>AGDEADYYCQVWDYFSMTHVFGCGTKLTVL<br>(SEQ ID NO: 688) |
| MA_SG-F28_CC_x_I2C0_x_<br>scFc_(D9R)_translation | NA<br>AA | (SEQ ID NO: 690)<br>DIVMTQTPLSLPVTPGEPASISCRSSQSLLHRSGYNYLD<br>WYLQKPGQSPQLLIYLGSNRASGVPDRESGSGSGTDFTL<br>KISRVEAGDVGVYYCMQALQTPWTFGCGTKVEIK<br>(SEQ ID NO: 692) |
| Ab | Type | Fv#1 (MAGEB2)<br>HC V-region |
| MA_03-C7_AS_CC_x_I2C0_<br>x_scFc_(G2H)_translation | | (SEQ ID NO: 551)<br>EVQLLESGGGLVQPGGSLRLSCAASGFTESSHAMSWVRQAPG<br>KCLEWVSAISGSGGGTYYAASVKGRFTISRDNSKNTLYLQMN<br>SLRAEDTAVYYCATGKGVHLGFDYWGQGTLVTVSS<br>(SEQ ID NO: 553) |

TABLE 27-continued

BiTE-scFc_Variable Region Sequences

| | |
|---|---|
| MA_03-D8_AS_CC_x_I2C0_x_scFc_(L7E)_translation | (SEQ ID NO: 555)<br>EVQLLESGGGLVQPGGSLRLSCAASGFTFSSHAMSWVRQAPG<br>KCLEWVSTISGSGGGTYYAASVKGRFTISRDNSKNTLYLQMN<br>SLRAEDTAVYYCATGKGVHLGFDYWGQGTLVTVSS<br>(SEQ ID NO: 557) |
| MA_03-D8_CC_x_I2C0_x_scFc_(H6N)_translation | (SEQ ID NO: 559)<br>EVQLLESGGGLVQPGGSLRLSCAASGFTFSSHAMSWVRQAPG<br>KCLEWVSTISGSGGGTYYADSVKGRATISRDNSKNTLYLQMN<br>SLRAEDTAVYYCATGKGVHLGFDYWGQGTLVTVSS<br>(SEQ ID NO: 561) |
| MA_03-D12_AS_CC_x_I2C0_x_scFc_(L6A)_translation | (SEQ ID NO: 563)<br>EVQLLESGGGLVQPGGSLRLSCAASGFTFSSHAMSWVRQAPG<br>KCLEWVSAISGSGGGTYYAASVKARFTISRDNSKNTLYLQMN<br>SLRAEDTAVYYCATGKGVHLGFDYWGQGTLVTVSS<br>(SEQ ID NO: 565) |
| MA_03-E7_AS_CC_x_I2C0_x_scFc_(L6M)_translation | (SEQ ID NO: 567)<br>EVQLLESGGGVVQPGRSLRLSCAASGFTFSSHAMSWVRQAPG<br>KCLEWVSAISGSGGGTYYAASGKGRATISRDNSKNTLYLQMN<br>SLRAEDTAAYYCVTGKGVHLGFDYWGQGTLVTVSS<br>(SEQ ID NO: 569) |
| MA_03-E11_AS_CC_x_I2C0_x_scFc_(G2B)_translation | (SEQ ID NO: 571)<br>EVQLLESGGGLVQPGGSLRLSCAASGFTFSSHAMSWVRQAPG<br>KCLEWVSAISGSGGGTYNAASVKGRFTISRDNSKNTLYLQMN<br>SLRAEDTAAYYCVTGKGVHLGFDYWGQGTLVTVSS<br>(SEQ ID NO: 573) |
| MA_03-G10_AS_CC_x_I2C0_x_scFc_(N3H)_translation | (SEQ ID NO: 575)<br>EVQLLESGGGLVQPGGSLRLSCAASGFTFSSYAMSWVRQAPG<br>KCLEWVSAISGSGGGTYYAASVKGRFTISRDNSKNTLYLQMS<br>SLRAEDTAVYYCATGKGVHLGFDYWGQGTLVTVSS<br>(SEQ ID NO: 577) |
| MA_03-G11_AS_CC_x_I2C0_x_scFc_(O4R)_translation | (SEQ ID NO: 579)<br>EVQLLESGGGLVKPGGSLRLSCAASGFTFSSHAMSWVRQAPG<br>KCLEWVSAISGSGGGTYYAASVKGRFTISRDNSKNTLYLQMN<br>SLRAEDTAVYYCATGKGVHLNEDYWGQGTLVTVSS<br>(SEQ ID NO: 581) |
| MA_03-H12_AS_CC_x_I2C0_x_scFc_(K5A)_translation | (SEQ ID NO: 583)<br>EVQLLESGGGLVQPGGSLRLSCAASGFTESSHAMSWVRQAPG<br>KCLEWVSAISGSGGGTYNAASVKGRFTISRDNSKNTLYLQMN<br>SLRAEDTAAYYCVTGKGVHLGFDYWGQGTLVTVSS<br>(SEQ ID NO: 585) |
| MA_09-C7_CC_x_I2C0_x_scFc_(K9T)_translation | (SEQ ID NO: 587)<br>QVTLKESGPALVKPTQTLTLTCTFSGFSFTTHKMGVDWIRQP<br>PGKCLEWLAEIHSEDDKRYSPSLQSRLTITKDTSKNQVVLTM<br>TNMDPVDTATYYCAYRRYNWNYENWEDPWGQGTLVTVSS<br>(SEQ ID NO: 589) |
| MA_09-E2_CC_x_I2C0_x_scFc_(V8T)_translation | (SEQ ID NO: 591)<br>EVQLVESGGGLVQPGGSLRLSCAASGFTFSNAWMSWVRQAPG<br>KCLEWVGRIKSKTYGGTTDYAAPVKGRFTISRDDSKNTLFLQ<br>MNSLKTEDTAVYYCTTPSYSGSYYVMDVWGQGTTVTVSS<br>(SEQ ID NO: 593) |
| MA_09-F11_CC_x_I2C0_x_scFc_(L6O)_translation | (SEQ ID NO: 595)<br>QITLKESGPMLVKPTQTLTLTCTFSGFSFTTHKMGVDWIRQP<br>PGKCLEWLALIYWNDDKRYSPSLQSRLTITKDTSKNQVVLTM<br>TNMDPVDTATYYCAYRRYNWNYENWEDPWGQGTLVTVSS<br>(SEQ ID NO: 597) |
| MA_09-F12_CC_x_I2C0_x_scFc_(D1U)_translation | (SEQ ID NO: 599)<br>QITLKESGPALVKPTQTLTLTCTESGFSFTTHKMGVDWIRQP<br>PGKCLEWLALIYWNDDKRYSPSLQSRLTITKDTSKNQVVLTM<br>TNMDPVDTATYYCAYRRYNWNYENWEDPWGQGTLVTVSS<br>(SEQ ID NO: 601) |
| MA_09-G8_CC_x_I2C0_x_scFc_(I6K)_translation | (SEQ ID NO: 603)<br>QITLKESGPTLVKPTQTLTLTCTFSGFSFTTHKMGVDWIRQP<br>PGKCLEWLALIYWNDDKRYSPSLQSRLTITKDTSKNQVVLTM<br>INMDPVDTATYYCAYRRYNWNYENWEDPWGQGTLVTVSS<br>(SEQ ID NO: 605) |

TABLE 27-continued

BiTE-scFc_Variable Region Sequences

| | |
|---|---|
| MA_09-G10_CC_x_I2C0_x_scFc_(C4K)_translation | (SEQ ID NO: 607)<br>QITLKESGPTLVKPTQTLTLTCTESGFSFTTHKMGVDWIRQPPGKCLEWLAGIHIYDDKRYSPSLQSRLTITKDTSKNQVVLTMTNMDPVDTATYYCAYRRYNWNYENWEDPWGQGTLVTVSS<br>(SEQ ID NO: 609) |
| MA_09-G11_CC_x_I2C0_x_scFc_(Y9O)_translation | (SEQ ID NO: 611)<br>QITLKESGPMLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWEDPWGQGTLVTVSS<br>(SEQ ID NO: 613) |
| MA_09-H7_CC_x_I2C0_x_scFc_(T3S)_translation | (SEQ ID NO: 615)<br>QITLKESGPALVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWEDPWGQGTLVTVSS<br>(SEQ ID NO: 617) |
| MA_09-H10_CC_x_I2C0_x_scFc_(B6N)_translation | (SEQ ID NO: 619)<br>QITLKESGPTLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWEDPWGQGTLVTVSS<br>(SEQ ID NO: 621) |
| MA_09-H11_CC_x_I2C0_x_scFc_(I8L)_translation | (SEQ ID NO: 623)<br>QITLKESGPTLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWEDPWGQGTLVTVSS<br>(SEQ ID NO: 625) |
| MA_10-B5_CC_x_I2C0_x_scFc_(H6H)_translation | (SEQ ID NO: 627)<br>EVQLVESGGGLVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSS<br>(SEQ ID NO: 629) |
| MA_10-B6_CC_x_I2C0_x_scFc_(I3O)_translation | (SEQ ID NO: 631)<br>EVQLVESGGGLVQPGGSLRLSCAASGFTFSNAWMSWVRQAPGKCLEWVGRIKSKTYGGTTDYAAPVKGRFTISRDDSKNTLYLQMNSLKTEDTAVYYCTTPSYSGSYYNYFSVMDVWGQGTTVTVSS<br>(SEQ ID NO: 633) |
| MA_10-D3_CC_x_I2C0_x_scFc_(O6B)_translation | (SEQ ID NO: 635)<br>EVQLVESGGGLVQPGGSLRLSCAASGFTFSNAWMSWVRQAPGKCLEWVGRITSSRYGGTTDYAAPVKGRFTISRDDSKNTLFLQMNSLKTEDTAVYYCTTPSYSGSYYNYFSVMDVWGQGTTVTVSS<br>(SEQ ID NO: 637) |
| MA_10-D6_CC_x_I2C0_x_scFc_(V6Z)_translation | (SEQ ID NO: 639)<br>EVQLVESGGGLVKPGGSLRLSCAASGFTFSNAWMSWVRQAPGKCLEWVGRILNNAYGGTTDYAAPVKGRETISRDDSKNTLYLQMNSLKTEDTAVYYCTTPSYSGSYYNYFSVMDVWGQGTTVTVSS<br>(SEQ ID NO: 641) |
| MA_10-G2_CC_x_I2C0_x_scFc_(T1S)_translation | (SEQ ID NO: 643)<br>EVQLVESGGGLVQPGGSLRLSCAASGFTFSNAWMSWVRQAPGKCLEWVGRILSMHYGGTTDYAAPVKGRFTISRDDSKNTLYLQMNSLKTEDTAVYYCTTPSYSGSYYNYFSVMDVWGQGTTVTVSS<br>(SEQ ID NO: 645) |
| MA_10-G5_CC_x_I2C0_x_scFc_(S9O)_translation | (SEQ ID NO: 647)<br>EVQLVESGGGLVQPGGSLRLSCAASGFTFSNAWMSWVRQAPGKCLEWVGRIVSSTYGGTTDYAAPVKGRFTISRDDSKNTLYLQMNSLKTEDTAVYYCTTPSYSGSYYNYFSVMDVWGQGTTVTVSS<br>(SEQ ID NO: 649) |
| MA_10-G10_AS_CC_x_I2C0_x_scFc_(T1I)_translation | (SEQ ID NO: 651)<br>EVQLLESGGGLVQPGGSLRLSCAASGFTFSSHAMSWVRQAPGKCLEWVSAISGSGGGTYNAASVKGRFTISRDNSKNTLYLQMNSLRAEDTAVYYCATGKGVHLGFDYWGQGTLVTVSS<br>(SEQ ID NO: 653) |
| MA_10-G10_CC_x_I2C0_x_scFc_(B3A)_translation | (SEQ ID NO: 655)<br>EVQLLESGGGLVQPGGSLRLSCAASGFTFSSHAMSWVRQAPGKCLEWVSAISGSGGGTYNADSVKGRFTISRDNSKNTLYLQMNSLRAEDTAVYYCATGKGVHLGFDYWGQGTLVTVSS<br>(SEQ ID NO: 657) |

TABLE 27-continued

BiTE-scFc_Variable Region Sequences

| | |
|---|---|
| MA_10-H1_CC_x_I2C0_x_<br>scFc_(T9K)_translation | (SEQ ID NO: 659)<br>EVQLVESGGGLVQPGGSLRLSCAASGFTESNAWMSWVRQAPGK<br>CLEWVGRITSGIYGGTTDYAAPVKGRFTISRDDSKNTLYLQMN<br>SLKTEDTAVYYCTTPSYSGSYYNYFSVMDVWGQGTTVTVSS<br>(SEQ ID NO: 661) |
| MA_10-H3_CC_x_I2C0_x_<br>scFc_(M9L)_translation | (SEQ ID NO: 663)<br>EVQLVESGGGLVQPGGSLRLSCAASGFTFSNAWMSWVRQAPGK<br>CLEWVGRIRSRPYGGTTDYAAPVKGRFTISRDDSKNTLYLQMN<br>SLKTEDTAVYYCTTPSYSGSYYNYFSVMDVWGQGTTVTVSS<br>(SEQ ID NO: 665) |
| MA_81-B9_CC_x_I2C0_x_<br>scFc_(U4L)_translation | (SEQ ID NO: 667)<br>QVQLQESGPGLVKPSETLSLTCTVSGDSISSSRYYWGWIRQPP<br>GKCLEWIGSIYYSGSTYYNPSLKSRVTISVDTSKNQFSLKLSS<br>VTAADTAVYYCARGIFGVITYFDYWGQGTLVTVSS<br>(SEQ ID NO: 669) |
| MA_86-A4_CC_x_I2C0_x_<br>scFc_(K2W)_translation | (SEQ ID NO: 671)<br>QVQLVESGGGVVQPGRSLRLSCAASGFTFSTYGMHWVRQAPGK<br>CLEWVAVISYDASNKYYAESVKGRFTISRDNSKNTLYLQMNSL<br>RAEDTAVYYCARGQLLTGYWGQGTLVTVSS<br>(SEQ ID NO: 673) |
| MA_86-A4-N-F5_CC_x_I2C0_<br>x_scFc_(M4H)_translation | (SEQ ID NO: 675)<br>QVQLVESGGGVVQPGRSLRLSCAASGFTESTYGMHWVRQAPGK<br>CLEWVAVISYDAETVKYAESVKGRETISRDNSKNTLYLQMNSL<br>RAEDTAVYYCARGQLLTGYWGQGTLVTVSS<br>(SEQ ID NO: 677) |
| MA_88-B3-F9_CC_x_I2C0_x_<br>scFc_(Y4E)_translation | (SEQ ID NO: 679)<br>QVQLVESGGGLVKPGGSLRLSCAASGFTFSDYYMSWIRQAPGK<br>CLEWVSYISKSSYTVTYADAVKGRFTISRDNAKNSLYLQMNSL<br>RAEDTAVYYCATYNYGHEDYWGQGTLVTVSS<br>(SEQ ID NO: 681) |
| MA_98-C7_CC_x_I2C0_x_<br>scFc_(Y8P)_translation | (SEQ ID NO: 683)<br>EVQLLESGGGLVQPGGSLRLSCAASGFTFSSHAMSWVRQAPGK<br>CLEWVSSISGSGGGTYYAASVKGRFTISRDNSKNTLYLQMNSL<br>RAEDTAVYYCATGKGVHLGFDYWGQGTLVTVSS<br>(SEQ ID NO: 685) |
| MA_98-G12_AS_CC_x_I2C0_x_<br>scFc_(Q4Z)_translation | (SEQ ID NO: 687)<br>EVQLLESGGGLVQPGGSLRLSCAASGFTFSSHAMSWVRQAPGK<br>CLEWVSAISGSGGGTYNAASVKGRFTISRDNSKNTLYLQMNSL<br>RAEDTAAYYCVTGKGVHLGFDYWGQGTLVTVSS<br>(SEQ ID NO: 689) |
| MA_SG-F28_CC_x_I2C0_x_<br>scFc_(D9R)_translation | (SEQ ID NO: 691)<br>QVQLQESGPGLVKPSQTLSLTCTVSGDSISSNPYYWSWIRQHP<br>GKCLEWIGYISYSGITNYNPSLKSRVTMSVDTSKNQFSLKLTS<br>LTAADTAVYYCAREKMWFGVLNYYYGMDVWGQGTTVTVSS<br>(SEQ ID NO: 693) |

| Ab | Type | Fv#2 (CD3)<br>LC V-region |
|---|---|---|
| MA_03-C7_AS_CC_x_I2C0_<br>x_scFc_(G2H)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_03-D8_AS_CC_x_I2C0_<br>x_scFc_(L7E)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_03-D8_CC_x_I2C0_x_<br>scFc_(H6N)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |

TABLE 27-continued

| BiTE-scFc_Variable Region Sequences | | |
|---|---|---|
| MA_03-D12_AS_CC_x_I2C0_x_scFc_(L6A)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_03-E7_AS_CC_x_I2C0_x_scFc_(L6M)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_03-E11_AS_CC_x_I2C0_x_scFc_(G2B)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_03-G10_AS_CC_x_I2C0_x_scFc_(N3H)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_03-G11_AS_CC_x_I2C0_x_scFc_(O4R)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_03-H12_AS_CC_x_I2C0_x_scFc_(K5A)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-C7_CC_x_I2C0_x_scFc_(K9T)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-E2_CC_x_I2C0_x_scFc_(V8T)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-F11_CC_x_I2C0_x_scFc_(L6O)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-F12_CC_x_I2C0_x_scFc_(D1U)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-G8_CC_x_I2C0_x_scFc_(I6K)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-G10_CC_x_I2C0_x_scFc_(C4K)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-G11_CC_x_I2C0_x_scFc_(Y9O)_translation | NA AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |

TABLE 27-continued

BiTE-scFc_Variable Region Sequences

| | | |
|---|---|---|
| MA_09-H7_CC_x_I2C0_x_<br>scFc_(T3S)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-H10_CC_x_I2C0_x_<br>scFc_(B6N)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_09-H11_CC_x_I2C0_x_<br>scFc_(I8L)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-B5_CC_x_I2C0_x_<br>scFc_(H6H)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-B6_CC_x_I2C0_x_<br>scFc_(I3O)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-D3_CC_x_I2C0_x_<br>scFc_(O6B)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-D6_CC_x_I2C0_x_<br>scFc_(V6Z)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-G2_CC_x_I2C0_x_<br>scFc_(T1S)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-G5_CC_x_I2C0_x_<br>scFc_(S9O)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-G10_AS_CC_x_I2C0_<br>x_scFc_(T1I)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-G10_CC_x_I2C0_x_<br>scFc_(B3A)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-H1_CC_x_I2C0_x_<br>scFc_(T9K)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_10-H3_CC_x_I2C0_x_<br>scFc_(M9L)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |

TABLE 27-continued

BiTE-scFc_Variable Region Sequences

| | | |
|---|---|---|
| MA_81-B9_CC_x_I2C0_x_<br>scFc_(U4L)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_86-A4_CC_x_I2C0_x_<br>scFc_(K2W)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_86-A4-N-F5_CC_x_I2C0_<br>x_scFc_(M4H)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_88-B3-F9_CC_x_I2C0_x_<br>scFc_(Y4E)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_98-C7_CC_x_I2C0_x_<br>scFc_(Y8P)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_98-G12_AS_CC_x_I2C0_x_<br>scFc_(Q4Z)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| MA_SG-F28_CC_x_I2C0_x_<br>scFc_(D9R)_translation | NA<br>AA | (SEQ ID NO: 694)<br>QTVVTQEPSLTVSPGGTVTLTCGSSTGAVTSGNYPNWVQ<br>QKPGQAPRGLIGGTKFLAPGTPARESGSLLGGKAALTLS<br>GVQPEDEAEYYCVLWYSNRWVFGGGTKLTVL<br>(SEQ ID NO: 696) |
| Ab | Type | Fv#2 (CD3)<br>HC V-region |
| MA_03-C7_AS_CC_x_I2C0_<br>x_scFc_(G2H)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_03-D8_AS_CC_x_I2C0_<br>x_scFc_(L7E)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_03-D8_CC_x_I2C0_x_<br>scFc_(H6N)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_03-D12_AS_CC_x_I2C0_<br>x_scFc_(L6A)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_03-E7_AS_CC_x_I2C0_<br>x_scFc_(L6M)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |

TABLE 27-continued

BiTE-scFc_Variable Region Sequences

| | | |
|---|---|---|
| MA_03-E11_AS_CC_x_I2C0_<br>x_scFc_(G2B)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_03-G10_AS_CC_x_I2C0_<br>x_scFc_(N3H)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_03-G11_AS_CC_x_I2C0_<br>x_scFc_(O4R)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_03-H12_AS_CC_x_I2C0_x_<br>scFc_(K5A)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-C7_CC_x_I2C0_x_<br>scFc_(K9T)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-E2_CC_x_I2C0_x_<br>scFc_(V8T)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-F11_CC_x_I2C0_x_<br>scFc_(L60)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-F12_CC_x_I2C0_x_<br>scFc_(D1U)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-G8_CC_x_I2C0_x_<br>scFc_(I6K)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-G10_CC_x_I2C0_x_<br>scFc_(C4K)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-G11_CC_x_I2C0_x_<br>scFc_(Y90)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-H7_CC_x_I2C0_x_<br>scFc_(T3S)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_09-H10_CC_x_I2C0_x_<br>scFc_(B6N)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |

TABLE 27-continued

| BiTE-scFc_Variable Region Sequences | | |
|---|---|---|
| MA_09-H11_CC_x_I2C0_x_scFc_(I8L)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-B5_CC_x_I2C0_x_scFc_(H6H)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-B6_CC_x_I2C0_x_scFc_(I30)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-D3_CC_x_I2C0_x_scFc_(O6B)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-D6_CC_x_I2C0_x_scFc_(V6Z)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-G2_CC_x_I2C0_x_scFc_(T1S)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-G5_CC_x_I2C0_x_scFc_(S9O)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-G10_AS_CC_x_I2C0_x_scFc_(T1I)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-G10_CC_x_I2C0_x_scFc_(B3A)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-H1_CC_x_I2C0_x_scFc_(T9K)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_10-H3_CC_x_I2C0_x_scFc_(M9L)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_81-B9_CC_x_I2C0_x_scFc_(U4L)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_86-A4_CC_x_I2C0_x_scFc_(K2W)_translation | NA AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |

TABLE 27-continued

BiTE-scFc_Variable Region Sequences

| | | |
|---|---|---|
| MA_86-A4-N-F5_CC_x_I2C0_x_scFc_(M4H)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_88-B3-F9_CC_x_I2C0_x_scFc_(Y4E)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_98-C7_CC_x_I2C0_x_scFc_(Y8P)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_98-G12_AS_CC_x_I2C0_x_scFc_(Q4Z)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |
| MA_SG-F28_CC_x_I2C0_x_scFc_(D9R)_translation | NA<br>AA | (SEQ ID NO: 695)<br>EVQLVESGGGLVQPGGSLKLSCAASGFTENKYAMNWVRQNTA<br>PGKGLEWVARIRSKYNNYATYYADSVKDRFTISRDDSKAYLQ<br>MNNLKTEDTAVYYCVRHGNFGNSYISYWAYWGQGTLVTVSS<br>(SEQ ID NO: 697) |

TABLE 28

BiTE-scFc Variable Region #1 (MAGEB2) Protein Alignment
CDRs defined by Kabat
Alignment numbering defined by Amgen Reference (AHo)

| | Germline | K_FR1 | SEQ ID NO: |
|---|---|---|---|
| VK1\|O12/JK1 | | DIQMTQSPSSLSASVGDRVTITC | 698 |
| MA_09-C7_CC_x_I2C0_x_scFc_(K9T)_translation | VK1\|O12/JK1 | DIQMTQSPSSLSASVGDRVTITC | 699 |
| MA_09-E2_CC_x_I2C0_x_scFc_(V8T)_translation | VK1\|O12/JK1 | DIQMTQSPSSLSASVGDRVTITC | 700 |
| MA_09-F11_CC_x_I2C0_x_scFc_(L6Q)_translation | VK1\|O12/JK1 | DIQMTQSPDSLSASVGDRVTITC | 701 |
| MA_09-F12_CC_x_I2C0_x_scFc_(D1U)_translation | VK1\|O12/JK1 | DIQMTQSPSSLSASVGDRVTITC | 702 |
| MA_09-G8_CC_x_I2C0_x_scFc_(I6K)_translation | VK1\|O12/JK1 | DIQMTQSPSSLSASVGDRVTITC | 703 |
| MA_09-G10_CC_x_I2C0_x_scFc_(C4K)_translation | VK1\|O12/JK1 | DIQMTQSPSSLSASVGDRVTITC | 704 |
| MA_09-G11_CC_x_I2C0_x_scFc_(Y9Q)_translation | VK1\|O12/JK1 | DIQMTQSPSSLSASVGDRVTITC | 705 |
| MA_09-H7_CC_x_I2C0_x_scFc_(T3S)_translation | VK1\|O12/JK1 | DIQMTQSPSSLSASVGDRVTITC | 706 |
| MA_09-H10_CC_x_I2C0_x_scFc_(B6N)_translation | VK1\|O12/JK1 | DIQMTQSPSSLSASVGDRVTITC | 707 |
| MA_09-H11_CC_x_I2C0_x_scFc_(I8L)_translation | VK1\|O12/JK1 | DIQMTQSPSSLSASVGDRVTITC | 708 |
| MA_10-B5_CC_x_I2C0_x_scFc_(H6H)_translation | VK1\|O12/JK1 | DIQMTQSPSSLSASVGDRVTITC | 709 |
| VK1\|O12/JK2 | | DIQMTQSPSSLSASVGDRVTITC | 710 |
| MA_10-B6_CC_x_I2C0_x_scFc_(I3O)_translation | VK1\|O12/JK2 | DIQMTQSPSSLSASVGDRVTITC | 711 |
| MA_10-H3_CC_x_I2C0_x_scFc_(M9L)_translation | VK1\|O12/JK2 | DIQMTQSPSSLSASVGDRVTITC | 712 |
| VK1\|O12/JK3 | | DIQMTQSPSSLSASVGDRVTITC | 713 |
| MA_10-D3_CC_x_I2C0_x_scFc_(O6B)_translation | VK1\|O12/JK3 | DIQMTQSPSSLSASVGDRVTITC | 714 |
| MA_10-D6_CC_x_I2C0_x_scFc_(V6Z)_translation | VK1\|O12/JK3 | DIQMTQSPSSLSASVGDRVTITC | 715 |
| MA_10-G2_CC_x_I2C0_x_scFc_(T1S)_translation | VK1\|O12/JK3 | DIQMTQSPSSLSASVGDRVTITC | 716 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_10-G5_CC_x_I2C0_x_scFc_(S9O)_translation | VK1\|O12/JK3 | DIQMTQSPSSLSASVGDRVTITC | 717 |
| MA_10-H1_CC_x_I2C0_x_scFc_(T9K)_translation | VK1\|O12/JK3 | DIQMTQSPSSLSASVGDRVTITC | 718 |
| VK4\|B3/JK5 | | DIVMTQSPDSLAVSLGERATINC | 719 |
| MA_81-B9_CC_x_I2C0_x_scFc_(U4L)_translation | VK4\|B3/JK5 | DIVMTQSPDSLAVSLGERATINC | 720 |
| VK1\|A20/JK1 | | DIQMTQSPSSLSASVGDRVTITC | 721 |
| MA_86-A4_CC_x_I2C0_x_scFc_(K2W)_translation | VK1\|A20/JK1 | DIQMTQSPSSLSASVGDRVTITC | 722 |
| MA_86-A4-N-F5_CC_x_I2C0_x_scFc_(M4H)_translation | VK1\|A20/JK1 | DIQMTQSPSSLSASVGDRVTITC | 723 |
| VK2\|O1/JK1 | | DIVMTQTPLSLPVTPGEPASISC | 724 |
| MA_SG-F28_CC_x_I2C0_x_scFc_(D9R)_translation | VK2\|O1/JK1 | DIVMTQTPLSLPVTPGEPASISC | 725 |
| | | K_CDR1 | |
| VK1\|O12/JK1 | | RAS--QSIS------SYLN | 860 |
| MA_09-C7_CC_x_I2C0_x_scFc_(K9T)_translation | VK1\|O12/JK1 | RAS--QSIS------NYfN | 861 |
| MA_09-E2_CC_x_I2C0_x_scFc_(V8T)_translation | VK1\|O12/JK1 | RTS--QSIS------SYLN | 862 |
| MA_09-F11_CC_x_I2C0_x_scFc_(L6Q)_translation | VK1\|O12/JK1 | QAS--QDIS------NYLN | 863 |
| MA_09-F12_CC_x_I2C0_x_scFc_(D1U)_translation | VK1\|O12/JK1 | QAS--QDIS------NYLN | 864 |
| MA_09-G8_CC_x_I2C0_x_scFc_(I6K)_translation | VK1\|O12/JK1 | QAS--QDIS------NYLN | 865 |
| MA_09-G10_CC_x_I2C0_x_scFc_(C4K)_translation | VK1\|O12/JK1 | QAS--QDIS------NYFN | 866 |
| MA_09-G11_CC_x_I2C0_x_scFc_(Y9Q)_translation | VK1\|O12/JK1 | RAS--QFIS------SYLN | 867 |
| MA_09-H7_CC_x_I2C0_x_scFc_(T3S)_translation | VK1\|O12/JK1 | QAS--QDIS------NYLN | 868 |
| MA_09-H10_CC_x_I2C0_x_scFc_(B6N)_translation | VK1\|O12/JK1 | QAS--QDIS------NYLN | 869 |
| MA_09-H11_CC_x_I2C0_x_scFc_(I8L)_translation | VK1\|O12/JK1 | RAS--QFIS------SYLN | 870 |
| MA_10-B5_CC_x_I2C0_x_scFc_(H6H)_translation | VK1\|O12/JK1 | RTS--QSIS------SYLN | 871 |
| VK1\|O12/JK2 | | RAS--QSIS------SYLN | 872 |
| MA_10-B6_CC_x_I2C0_x_scFc_(I3O)_translation | VK1\|O12/JK2 | RTS--QSIS------SYLN | 873 |
| MA_10-H3_CC_x_I2C0_x_scFc_(M9L)_translation | VK1\|O12/JK2 | RTS--QSIS------SYLN | 874 |
| VK1\|O12/JK3 | | RAS--QSIS------SYLN | 875 |
| MA_10-D3_CC_x_I2C0_x_scFc_(O6B)_translation | VK1\|O12/JK3 | RTS--QSIS------SYLN | 876 |
| MA_10-D6_CC_x_I2C0_x_scFc_(V6Z)_translation | VK1\|O12/JK3 | RTS--QSIS------SYLN | 877 |
| MA_10-G2_CC_x_I2C0_x_scFc_(T1S)_translation | VK1\|O12/JK3 | RTS--QSIS------SYLN | 878 |
| MA_10-G5_CC_x_I2C0_x_scFc_(S9O)_translation | VK1\|O12/JK3 | RTS--QSIS------SYLN | 879 |
| MA_10-H1_CC_x_I2C0_x_scFc_(T9K)_translation | VK1\|O12/JK3 | RTS--QSIS------SYLN | 880 |
| VK4\|B3/JK5 | | KSS--QSVLYSSNNKNYLA | 881 |
| MA_81-B9_CC_x_I2C0_x_scFc_(U4L)_translation | VK4\|B3/JK5 | KSS--QSVLYSSNNKNYLA | 882 |
| VK1\|A20/JK1 | | RAS--QGIS------NYLA | 883 |
| MA_86-A4_CC_x_I2C0_x_scFc_(K2W)_translation | VK1\|A20/JK1 | RAS--QGIS------NYLA | 884 |
| MA_86-A4-N-F5_CC_x_I2C0_x_scFc_(M4H)_translation | VK1\|A20/JK1 | RAS--QGIS------NYLA | 885 |
| VK2\|O1/JK1 | | RSS--QSLLDSDDGNTYLD | 886 |
| MA_SG-F28_CC_x_I2C0_x_scFc_(D9R)_translation | VK2\|O1/JK1 | RSS--QSLLHRS-GYNYLD | 887 |

TABLE 28-continued

BiTE-scFc Variable Region #1 (MAGEB2) Protein Alignment
CDRs defined by Kabat
Alignment numbering defined by Amgen Reference (AHo)

| | Germline | L_FR1 | SEQ ID NO: |
|---|---|---|---|
| VL3\|3h/JL2 | | SYVLTQP-PSVSVAPGKTARITC | 726 |
| MA_03-C7_AS_CC_x_I2C0_x_scFc_(G2H)_translation | VL3\|3h/JL2 | SYVLTQP-PSVSVAPGQTARITC | 727 |
| MA_03-D12_AS_CC_x_I2C0_x_scFc_(L6A)_translation | VL3\|3h/JL2 | SYVLTQP-PSVSVAPGQTARITC | 728 |
| MA_03-E11_AS_CC_x_I2C0_x_scFc_(G2B)_translation | VL3\|3h/JL2 | SYVLTQP-PSVSVAPGQTARITC | 729 |
| MA_03-G10_AS_CC_x_I2C0_x_scFc_(N3H)_translation | VL3\|3h/JL2 | SYVLTQP-PSVSVAPGQTARITC | 730 |
| MA_03-G11_AS_CC_x_I2C0_x_scFc_(O4R)_translation | VL3\|3h/JL2 | SYVLTQP-PSVSVAPGQTARITC | 731 |
| MA_10-G10_AS_CC_x_I2C0_x_scFc_(T1I)_translation | VL3\|3h/JL2 | SYVLTQP-PSVSVAPGQTARITC | 732 |
| MA_10-G10_CC_x_I2C0_x_scFc_(B3A)_translation | VL3\|3h/JL2 | SYVLTQP-PSVSVAPGQTARITC | 733 |
| MA_88-B3-F9_CC_x_I2C0_x_scFc_(Y4E)_translation | VL3\|3h/JL2 | SYVLTQP-PSVSVAPGQTARITC | 734 |
| MA_98-C7_CC_x_I2C0_x_scFc_(Y8P)_translation | VL3\|3h/JL2 | SYVLTQP-PSVSVAPGQTARITC | 735 |
| MA_98-G12_AS_CC_x_I2C0_x_scFc_(Q4Z)_translation | VL3\|3h/JL2 | SYVLTQP-PSVSVAPGQTARITC | 736 |
| VL7\|7a/JL3b | | QTVVTQE-PSLTVSPGGTVTLTC | 737 |
| MA_03-C7_AS_CC_x_I2C0_x_scFc_(G2H)_translation | VL7\|7a/JL3b | QTVVTQE-PSLTVSPGGTVTLTC | 738 |
| MA_03-D8_AS_CC_x_I2C0_x_scFc_(L7E)_translation | VL7\|7a/JL3b | QTVVTQE-PSLTVSPGGTVTLTC | 739 |
| MA_03-D8_CC_x_I2C0_x_scFc_(H6N)_translation | VL7\|7a/JL3b | QTVVTQE-PSLTVSPGGTVTLTC | 740 |
| MA_03-D12_AS_CC_x_I2C0_x_scFc_(L6A)_translation | VL7\|7a/JL3b | QTVVTQE-PSLTVSPGGTVTLTC | 741 |
| MA_03-E7_AS_CC_x_I2C0_x_scFc_(L6M)_translation | VL7\|7a/JL3b | QTVVTQE-PSLTVSPGGTVTLTC | 742 |
| MA_03-E11_AS_CC_x_I2C0_x_scFc_(G2B)_translation | VL7\|7a/JL3b | QTVVTQE-PSLTVSPGGTVTLTC | 743 |
| MA_03-G10_AS_CC_x_I2C0_x_scFc_(N3H)_translation | VL7\|7a/JL3b | QTVVTQE-PSLTVSPGGTVTLTC | 744 |
| MA_03-G11_AS_CC_x_I2C0_x_scFc_(O4R)_translation | VL7\|7a/JL3b | QTVVTQE-PSLTVSPGGTVTLTC | 745 |
| MA_03-H12_AS_CC_x_I2C0_x_scFc_(K5A)_translation | VL7\|7a/JL3b | QTVVTQE-PSLTVSPGGTVTLTC | 746 |
| MA_09-C7_CC_x_I2C0_x_scFc_(K9T)_translation | VL7\|7a/JL3b | QTVVTQE-PSLTVSPGGTVTLTC | 747 |
| MA_09-E2_CC_x_I2C0_x_scFc_(V8T)_translation | VL7\|7a/JL3b | QTVVTQE-PSLTVSPGGTVTLTC | 748 |
| MA_09-F11_CC_x_I2C0_x_scFc_(L6Q)_translation | VL7\|7a/JL3b | QTVVTQE-PSLTVSPGGTVTLTC | 749 |
| MA_09-F12_CC_x_I2C0_x_scFc_(D1U)_translation | VL7\|7a/JL3b | QTVVTQE-PSLTVSPGGTVTLTC | 750 |
| MA_09-G8_CC_x_I2C0_x_scFc_(I6K)_translation | VL7\|7a/JL3b | QTVVTQE-PSLTVSPGGTVTLTC | 751 |
| MA_09-G10_CC_x_I2C0_x_scFc_(C4K)_translation | VL7\|7a/JL3b | QTVVTQE-PSLTVSPGGTVTLTC | 752 |
| MA_09-G11_CC_x_I2C0_x_scFc_(Y9Q)_translation | VL7\|7a/JL3b | QTVVTQE-PSLTVSPGGTVTLTC | 753 |
| MA_09-H7_CC_x_I2C0_x_scFc_(T3S)_translation | VL7\|7a/JL3b | QTVVTQE-PSLTVSPGGTVTLTC | 754 |
| MA_09-H10_CC_x_I2C0_x_scFc_(B6N)_translation | VL7\|7a/JL3b | QTVVTQE-PSLTVSPGGTVTLTC | 755 |
| MA_09-H11_CC_x_I2C0_x_scFc_(I8L)_translation | VL7\|7a/JL3b | QTVVTQE-PSLTVSPGGTVTLTC | 756 |
| MA_10-B5_CC_x_I2C0_x_scFc_(H6H)_translation | VL7\|7a/JL3b | QTVVTQE-PSLTVSPGGTVTLTC | 757 |
| MA_10-B6_CC_x_I2C0_x_scFc_(I3O)_translation | VL7\|7a/JL3b | QTVVTQE-PSLTVSPGGTVTLTC | 758 |
| MA_10-D3_CC_x_I2C0_x_scFc_(O6B)_translation | VL7\|7a/JL3b | QTVVTQE-PSLTVSPGGTVTLTC | 759 |
| MA_10-D6_CC_x_I2C0_x_scFc_(V6Z)_translation | VL7\|7a/JL3b | QTVVTQE-PSLTVSPGGTVTLTC | 760 |
| MA_10-G2_CC_x_I2C0_x_scFc_(T1S)_translation | VL7\|7a/JL3b | QTVVTQE-PSLTVSPGGTVTLTC | 761 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_10-G5_CC_x_I2C0_x_scFc_(S9O)_translation | VL7\|7a/JL3b | QTVVTQE-PSLTVSPGGTVTLTC | 762 |
| MA_10-G10_AS_CC_x_I2C0_x_scFc_(T1I)_translation | VL7\|7a/JL3b | QTVVTQE-PSLTVSPGGTVTLTC | 763 |
| MA_10-G10_CC_x_I2C0_x_scFc_(B3A)_translation | VL7\|7a/JL3b | QTVVTQE-PSLTVSPGGTVTLTC | 764 |
| MA_10-H1_CC_x_I2C0_x_scFc_(T9K)_translation | VL7\|7a/JL3b | QTVVTQE-PSLTVSPGGTVTLTC | 765 |
| MA_10-H3_CC_x_I2C0_x_scFc_(M9L)_translation | VL7\|7a/JL3b | QTVVTQE-PSLTVSPGGTVTLTC | 766 |
| MA_81-B9_CC_x_I2C0_x_scFc_(U4L)_translation | VL7\|7a/JL3b | QTVVTQE-PSLTVSPGGTVTLTC | 767 |
| MA_86-A4_CC_x_I2C0_x_scFc_(K2W)_translation | VL7\|7a/JL3b | QTVVTQE-PSLTVSPGGTVTLTC | 768 |
| MA_86-A4-N-F5_CC_x_I2C0_x_scFc_(M4H)_translation | VL7\|7a/JL3b | QTVVTQE-PSLTVSPGGTVTLTC | 769 |
| MA_88-B3-F9_CC_x_I2C0_x_scFc_(Y4E)_translation | VL7\|7a/JL3b | QTVVTQE-PSLTVSPGGTVTLTC | 770 |
| MA_98-C7_CC_x_I2C0_x_scFc_(Y8P)_translation | VL7\|7a/JL3b | QTVVTQE-PSLTVSPGGTVTLTC | 771 |
| MA_98-G12_AS_CC_x_I2C0_x_scFc_(Q4Z)_translation | VL7\|7a/JL3b | QTVVTQE-PSLTVSPGGTVTLTC | 772 |
| MA_SG-F28_CC_x_I2C0_x_scFc_(D9R)_translation | VL7\|7a/JL3b | QTVVTQE-PSLTVSPGGTVTLTC | 773 |
| VL3\|3h/JL3b | | SYVLTQP-PSVSVAPGKTARITC | 774 |
| MA_03-D8_AS_CC_x_I2C0_x_scFc_(L7E)_translation | VL3\|3h/JL3b | SYVLTQP-PSVSVAPGQTARITC | 775 |
| MA_03-D8_CC_x_I2C0_x_scFc_(H6N)_translation | VL3\|3h/JL3b | SYVLTQP-PSVSVAPGQTARITC | 776 |
| MA_03-E7_AS_CC_x_I2C0_x_scFc_(L6M)_translation | VL3\|3h/JL3b | SYVLTQP-PSVSVAPGQTARITC | 777 |
| MA_03-H12_AS_CC_x_I2C0_x_scFc_(K5A)_translation | VL3\|3h/JL3b | SYVLTQP-PSVSVAPGQTARITC | 778 |
| | | L_CDR1 | |
| VL3\|3h/JL2 | | GGN---NIGS-----KSVH | 888 |
| MA_03-C7_AS_CC_x_I2C0_x_scFc_(G2H)_translation | VL3\|3h/JL2 | GGN---NIGS-----KSVH | 889 |
| MA_03-D12_AS_CC_x_I2C0_x_scFc_(L6A)_translation | VL3\|3h/JL2 | GGN---NIGS-----KSVH | 890 |
| MA_03-E11_AS_CC_x_I2C0_x_scFc_(G2B)_translation | VL3\|3h/JL2 | GGN---NIGS-----KSVH | 891 |
| MA_03-G10_AS_CC_x_I2C0_x_scFc_(N3H)_translation | VL3\|3h/JL2 | GGN---NIGS-----KSVH | 892 |
| MA_03-G11_AS_CC_x_I2C0_x_scFc_(O4R)_translation | VL3\|3h/JL2 | GGN---NIGS-----KSVH | 893 |
| MA_10-G10_AS_CC_x_I2C0_x_scFc_(T1I)_translation | VL3\|3h/JL2 | GGN---NIGS-----KSVH | 894 |
| MA_10-G10_CC_x_I2C0_x_scFc_(B3A)_translation | VL3\|3h/JL2 | GGN---NIGS-----KSVH | 895 |
| MA_88-B3-F9_CC_x_I2C0_x_scFc_(Y4E)_translation | VL3\|3h/JL2 | GGN---NIGS-----KSVH | 896 |
| MA_98-C7_CC_x_I2C0_x_scFc_(Y8P)_translation | VL3\|3h/JL2 | GGN---NIGS-----KSVH | 897 |
| MA_98-G12_AS_CC_x_I2C0_x_scFc_(Q4Z)_translation | VL3\|3h/JL2 | GGN---NIGS-----KSVH | 898 |
| VL7\|7a/JL3b | | ASST-GAVTSG----YYPN | 899 |
| MA_03-C7_AS_CC_x_I2C0_x_scFc_(G2H)_translation | VL7\|7a/JL3b | GSST-GAVTSG----NYPN | 900 |
| MA_03-D8_AS_CC_x_I2C0_x_scFc_(L7E)_translation | VL7\|7a/JL3b | GSST-GAVTSG----NYPN | 901 |
| MA_03-D8_CC_x_I2C0_x_scFc_(H6N)_translation | VL7\|7a/JL3b | GSST-GAVTSG----NYPN | 902 |
| MA_03-D12_AS_CC_x_I2C0_x_scFc_(L6A)_translation | VL7\|7a/JL3b | GSST-GAVTSG----NYPN | 903 |
| MA_03-E7_AS_CC_x_I2C0_x_scFc_(L6M)_translation | VL7\|7a/JL3b | GSST-GAVTSG----NYPN | 904 |
| MA_03-E11_AS_CC_x_I2C0_x_scFc_(G2B)_translation | VL7\|7a/JL3b | GSST-GAVTSG----NYPN | 905 |
| MA_03-G10_AS_CC_x_I2C0_x_scFc_(N3H)_translation | VL7\|7a/JL3b | GSST-GAVTSG----NYPN | 906 |
| MA_03- | VL7\|7a/JL3b | GSST-GAVTSG----NYPN | 907 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| G11_AS_CC_x_I2C0_x_scFc_(O4R)_translation | VL7\|7a/JL3b | GSST-GAVTSG----NYPN | 908 |
| MA_03-H12_AS_CC_x_I2C0_x_scFc_(K5A)_translation | VL7\|7a/JL3b | GSST-GAVTSG----NYPN | 909 |
| MA_09-C7_CC_x_I2C0_x_scFc_(K9T)_translation | VL7\|7a/JL3b | GSST-GAVTSG----NYPN | 910 |
| MA_09-E2_CC_x_I2C0_x_scFc_(V8T)_translation | VL7\|7a/JL3b | GSST-GAVTSG----NYPN | 911 |
| MA_09-F11_CC_x_I2C0_x_scFc_(L6Q)_translation | VL7\|7a/JL3b | GSST-GAVTSG----NYPN | 912 |
| MA_09-F12_CC_x_I2C0_x_scFc_(D1U)_translation | VL7\|7a/JL3b | GSST-GAVTSG----NYPN | 913 |
| MA_09-G8_CC_x_I2C0_x_scFc_(I6K)_translation | VL7\|7a/JL3b | GSST-GAVTSG----NYPN | 914 |
| MA_09-G10_CC_x_I2C0_x_scFc_(C4K)_translation | VL7\|7a/JL3b | GSST-GAVTSG----NYPN | 915 |
| MA_09-G11_CC_x_I2C0_x_scFc_(Y9Q)_translation | VL7\|7a/JL3b | GSST-GAVTSG----NYPN | 916 |
| MA_09-H7_CC_x_I2C0_x_scFc_(T3S)_translation | VL7\|7a/JL3b | GSST-GAVTSG----NYPN | 917 |
| MA_09-H10_CC_x_I2C0_x_scFc_(B6N)_translation | VL7\|7a/JL3b | GSST-GAVTSG----NYPN | 918 |
| MA_09-H11_CC_x_I2C0_x_scFc_(I8L)_translation | VL7\|7a/JL3b | GSST-GAVTSG----NYPN | 919 |
| MA_10-B5_CC_x_I2C0_x_scFc_(H6H)_translation | VL7\|7a/JL3b | GSST-GAVTSG----NYPN | 920 |
| MA_10-B6_CC_x_I2C0_x_scFc_(I3O)_translation | VL7\|7a/JL3b | GSST-GAVTSG----NYPN | 921 |
| MA_10-D3_CC_x_I2C0_x_scFc_(O6B)_translation | VL7\|7a/JL3b | GSST-GAVTSG----NYPN | 922 |
| MA_10-D6_CC_x_I2C0_x_scFc_(V6Z)_translation | VL7\|7a/JL3b | GSST-GAVTSG----NYPN | 923 |
| MA_10-G2_CC_x_I2C0_x_scFc_(T1S)_translation | VL7\|7a/JL3b | GSST-GAVTSG----NYPN | 924 |
| MA_10-G5_CC_x_I2C0_x_scFc_(S9O)_translation | VL7\|7a/JL3b | GSST-GAVTSG----NYPN | 925 |
| MA_10-G10_AS_CC_x_I2C0_x_scFc_(T1I)_translation | VL7\|7a/JL3b | GSST-GAVTSG----NYPN | 926 |
| MA_10-G10_CC_x_I2C0_x_scFc_(B3A)_translation | VL7\|7a/JL3b | GSST-GAVTSG----NYPN | 927 |
| MA_10-H1_CC_x_I2C0_x_scFc_(T9K)_translation | VL7\|7a/JL3b | GSST-GAVTSG----NYPN | 928 |
| MA_10-H3_CC_x_I2C0_x_scFc_(M9L)_translation | VL7\|7a/JL3b | GSST-GAVTSG----NYPN | 929 |
| MA_81-B9_CC_x_I2C0_x_scFc_(U4L)_translation | VL7\|7a/JL3b | GSST-GAVTSG----NYPN | 930 |
| MA_86-A4_CC_x_I2C0_x_scFc_(K2W)_translation | VL7\|7a/JL3b | GSST-GAVTSG----NYPN | 931 |
| MA_86-A4-N-F5_CC_x_I2C0_x_scFc_(M4H)_translation | VL7\|7a/JL3b | GSST-GAVTSG----NYPN | 932 |
| MA_88-B3-F9_CC_x_I2C0_x_scFc_(Y4E)_translation | VL7\|7a/JL3b | GSST-GAVTSG----NYPN | 933 |
| MA_98-C7_CC_x_I2C0_x_scFc_(Y8P)_translation | VL7\|7a/JL3b | GSST-GAVTSG----NYPN | 934 |
| MA_98-G12_AS_CC_x_I2C0_x_scFc_(Q4Z)_translation | VL7\|7a/JL3b | GSST-GAVTSG----NYPN | 935 |
| MA_SG-F28_CC_x_I2C0_x_scFc_(D9R)_translation VL3\|3h/JL3b | | GGN---NIGS-----KSVH | 936 |
| MA_03-D8_AS_CC_x_I2C0_x_scFc_(L7E)_translation | VL3\|3h/JL3b | GGN---NIGS-----KSVH | 937 |
| MA_03-D8_CC_x_I2C0_x_scFc_(H6N)_translation | VL3\|3h/JL3b | GGN---NIGS-----KSVH | 938 |
| MA_03-E7_AS_CC_x_I2C0_x_scFc_(L6M)_translation | VL3\|3h/JL3b | GGN---NIGS-----KSVH | 939 |
| MA_03-H12_AS_CC_x_I2C0_x_scFc_(K5A)_translation | VL3\|3h/JL3b | GGN---NIGS-----KSVH | 940 |

TABLE 28-continued

BiTE-scFc Variable Region #1 (MAGEB2) Protein Alignment
CDRs defined by Kabat
Alignment numbering defined by Amgen Reference (AHo)

| | Germline | H_FR1 | SEQ ID NO: |
|---|---|---|---|
| VH3\|3-23/D6\|6-19\|RF2/JH4 | | EVQLLES-GGGLVQPGGSLRLSCAASG-FTES | 779 |
| MA_03-C7_AS_CC_x_I2C0_x_scFc_(G2H)_translation Fv#1 | VH3\|3-23/D6\|6-19\|RF2/JH4 | EVQLLES-GGGLVQPGGSLRLSCAASG-FTES | 780 |
| MA_03-D8_AS_CC_x_I2C0_x_scFc_(L7E)_translation Fv#1 | VH3\|3-23/D6\|6-19\|RF2/JH4 | EVQLLES-GGGLVQPGGSLRLSCAASG-FTES | 781 |
| MA_03-D8_CC_x_I2C0_x_scFc_(H6N)_translation Fv#1 | VH3\|3-23/D6\|6-19\|RF2/JH4 | EVQLLES-GGGLVQPGGSLRLSCAASG-FTES | 782 |
| MA_03-D12_AS_CC_x_I2C0_x_scFc_(L6A)_translation Fv#1 | VH3\|3-23/D6\|6-19\|RF2/JH4 | EVQLLES-GGGLVQPGGSLRLSCAASG-FTES | 783 |
| MA_03-E7_AS_CC_x_I2C0_x_scFc_(L6M)_translation Fv#1 | VH3\|3-23/D6\|6-19\|RF2/JH4 | EVQLLES-GGGVVQPGRSLRLSCAASG-FTFS | 784 |
| MA_03-E11_AS_CC_x_I2C0_x_scFc_(G2B)_translation Fv#1 | VH3\|3-23/D6\|6-19\|RF2/JH4 | EVQLLES-GGGLVQPGGSLRLSCAASG-FTFS | 785 |
| MA_03-G10_AS_CC_x_I2C0_x_scFc_(N3H)_translation Fv#1 | VH3\|3-23/D6\|6-19\|RF2/JH4 | EVQLLES-GGGLVQPGGSLRLSCAASG-FTES | 786 |
| MA_03-G11_AS_CC_x_I2C0_x_scFc_(O4R)_translation Fv#1 | VH3\|3-23/D6\|6-19\|RF2/JH4 | EVQLLES-GGGLVKPGGSLRLSCAASG-FTES | 787 |
| MA_03-H12_AS_CC_x_I2C0_x_scFc_(K5A)_translation Fv#1 | VH3\|3-23/D6\|6-19\|RF2/JH4 | EVQLLES-GGGLVQPGGSLRLSCAASG-FTES | 788 |
| MA_10-G10_AS_CC_x_I2C0_x_scFc_(T1I)_translation Fv#1 | VH3\|3-23/D6\|6-19\|RF2/JH4 | EVQLLES-GGGLVQPGGSLRLSCAASG-FTES | 789 |
| MA_10-G10_CC_x_I2C0_x_scFc_(B3A)_translation Fv#1 | VH3\|3-23/D6\|6-19\|RF2/JH4 | EVQLLES-GGGLVQPGGSLRLSCAASG-FTES | 790 |
| MA_98-C7_CC_x_I2C0_x_scFc_(Y8P)_translation Fv#1 | VH3\|3-23/D6\|6-19\|RF2/JH4 | EVQLLES-GGGLVQPGGSLRLSCAASG-FTES | 791 |
| MA_98-G12_AS_CC_x_I2C0_x_scFc_(Q4Z)_translation Fv#1 | VH3\|3-23/D6\|6-19\|RF2/JH4 | EVQLLES-GGGLVQPGGSLRLSCAASG-FTES | 792 |
| VH3\|3-73/D3\|3-3\|RF3/JH4 | | EVQLVES-GGGLVQPGGSLKLSCAASG-FTES | 793 |
| MA_03-C7_AS_CC_x_I2C0_x_scFc_(G2H)_translation Fv#2 | VH3\|3-73/D3\|3-3\|RF3/JH4 | EVQLVES-GGGLVQPGGSLKLSCAASG-FTEN | 794 |
| MA_03-D8_AS_CC_x_I2C0_x_scFc_(L7E)_translation Fv#2 | VH3\|3-73/D3\|3-3\|RF3/JH4 | EVQLVES-GGGLVQPGGSLKLSCAASG-FTEN | 795 |
| MA_03-D8_CC_x_I2C0_x_scFc_(H6N)_translation Fv#2 | VH3\|3-73/D3\|3-3\|RF3/JH4 | EVQLVES-GGGLVQPGGSLKLSCAASG-FTEN | 796 |
| MA_03-D12_AS_CC_x_I2C0_x_scFc_(L6A)_translation Fv#2 | VH3\|3-73/D3\|3-3\|RF3/JH4 | EVQLVES-GGGLVQPGGSLKLSCAASG-FTEN | 797 |
| MA_03-E7_AS_CC_x_I2C0_x_scFc_(L6M)_translation Fv#2 | VH3\|3-73/D3\|3-3\|RF3/JH4 | EVQLVES-GGGLVQPGGSLKLSCAASG-FTEN | 798 |
| MA_03-E11_AS_CC_x_I2C0_x_scFc_(G2B)_translation Fv#2 | VH3\|3-73/D3\|3-3\|RF3/JH4 | EVQLVES-GGGLVQPGGSLKLSCAASG-FTEN | 799 |
| MA_03-G10_AS_CC_x_I2C0_x_scFc_(N3H)_translation Fv#2 | VH3\|3-73/D3\|3-3\|RF3/JH4 | EVQLVES-GGGLVQPGGSLKLSCAASG-FTEN | 800 |
| MA_03-G11_AS_CC_x_I2C0_x_scFc_(O4R)_translation Fv#2 | VH3\|3-73/D3\|3-3\|RF3/JH4 | EVQLVES-GGGLVQPGGSLKLSCAASG-FTEN | 801 |
| MA_03-H12_AS_CC_x_I2C0_x_scFc_(K5A)_translation Fv#2 | VH3\|3-73/D3\|3-3\|RF3/JH4 | EVQLVES-GGGLVQPGGSLKLSCAASG-FTEN | 802 |
| MA_09-C7_CC_x_I2C0_x_scFc_(K9T)_translation Fv#2 | VH3\|3-73/D3\|3-3\|RF3/JH4 | EVQLVES-GGGLVQPGGSLKLSCAASG-FTEN | 803 |
| MA_09-E2_CC_x_I2C0_x_scFc_(V8T)_translation Fv#2 | VH3\|3-73/D3\|3-3\|RF3/JH4 | EVQLVES-GGGLVQPGGSLKLSCAASG-FTEN | 804 |
| MA_09-F11_CC_x_I2C0_x_scFc_(L6Q)_translation Fv#2 | VH3\|3-73/D3\|3-3\|RF3/JH4 | EVQLVES-GGGLVQPGGSLKLSCAASG-FTEN | 805 |
| MA_09-F12_CC_x_I2C0_x_scFc_(D1U)_translation Fv#2 | VH3\|3-73/D3\|3-3\|RF3/JH4 | EVQLVES-GGGLVQPGGSLKLSCAASG-FTEN | 806 |
| MA_09-G8_CC_x_I2C0_x_scFc_(I6K)_translation Fv#2 | VH3\|3-73/D3\|3-3\|RF3/JH4 | EVQLVES-GGGLVQPGGSLKLSCAASG-FTEN | 807 |
| MA_09-G10_CC_x_I2C0_x_scFc_(C4K)_translation Fv#2 | VH3\|3-73/D3\|3-3\|RF3/JH4 | EVQLVES-GGGLVQPGGSLKLSCAASG-FTEN | 808 |
| MA_09-G11_CC_x_I2C0_x_scFc_(Y9Q)_translation Fv#2 | VH3\|3-73/D3\|3-3\|RF3/JH4 | EVQLVES-GGGLVQPGGSLKLSCAASG-FTEN | 809 |
| MA_09-H7_CC_x_I2C0_x_scFc_(T3S)_translation Fv#2 | VH3\|3-73/D3\|3-3\|RF3/JH4 | EVQLVES-GGGLVQPGGSLKLSCAASG-FTEN | 810 |
| MA_09-H10_CC_x_I2C0_x_scFc_(B6N)_translation Fv#2 | VH3\|3-73/D3\|3-3\|RF3/JH4 | EVQLVES-GGGLVQPGGSLKLSCAASG-FTEN | 811 |
| MA_09-H11_CC_x_I2C0_x_scFc_(I8L)_translation Fv#2 | VH3\|3-73/D3\|3-3\|RF3/JH4 | EVQLVES-GGGLVQPGGSLKLSCAASG-FTEN | 812 |
| MA_10-B5_CC_x_I2C0_x_scFc_(H6H)_translation Fv#2 | VH3\|3-73/D3\|3-3\|RF3/JH4 | EVQLVES-GGGLVQPGGSLKLSCAASG-FTEN | 813 |
| MA_10-B6_CC_x_I2C0_x_scFc_(I3O)_translation Fv#2 | VH3\|3-73/D3\|3-3\|RF3/JH4 | EVQLVES-GGGLVQPGGSLKLSCAASG-FTEN | 814 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_10-D3_CC_x_I2C0_x_scFc_(O6B)_translation Fv#2 | VH3\|3-73/D3\|3-3\|RF3/JH4 | EVQLVES-GGGLVQPGGSLKLSCAASG-FTEN | 815 |
| MA_10-D6_CC_x_I2C0_x_scFc_(V6Z)_translation Fv#2 | VH3\|3-73/D3\|3-3\|RF3/JH4 | EVQLVES-GGGLVQPGGSLKLSCAASG-FTEN | 816 |
| MA_10-G2_CC_x_I2C0_x_scFc_(T1S)_translation Fv#2 | VH3\|3-73/D3\|3-3\|RF3/JH4 | EVQLVES-GGGLVQPGGSLKLSCAASG-FTEN | 817 |
| MA_10-G5_CC_x_I2C0_x_scFc_(S9O)_translation Fv#2 | VH3\|3-73/D3\|3-3\|RF3/JH4 | EVQLVES-GGGLVQPGGSLKLSCAASG-FTEN | 818 |
| MA_10-G10_AS_CC_x_I2C0_x_scFc_(T1I)_translation Fv#2 | VH3\|3-73/D3\|3-3\|RF3/JH4 | EVQLVES-GGGLVQPGGSLKLSCAASG-FTEN | 819 |
| MA_10-G10_CC_x_I2C0_x_scFc_(B3A)_translation Fv#2 | VH3\|3-73/D3\|3-3\|RF3/JH4 | EVQLVES-GGGLVQPGGSLKLSCAASG-FTEN | 820 |
| MA_10-H1_CC_x_I2C0_x_scFc_(T9K)_translation Fv#2 | VH3\|3-73/D3\|3-3\|RF3/JH4 | EVQLVES-GGGLVQPGGSLKLSCAASG-FTEN | 821 |
| MA_10-H3_CC_x_I2C0_x_scFc_(M9L)_translation Fv#2 | VH3\|3-73/D3\|3-3\|RF3/JH4 | EVQLVES-GGGLVQPGGSLKLSCAASG-FTEN | 822 |
| MA_81-B9_CC_x_I2C0_x_scFc_(U4L)_translation Fv#2 | VH3\|3-73/D3\|3-3\|RF3/JH4 | EVQLVES-GGGLVQPGGSLKLSCAASG-FTEN | 823 |
| MA_86-A4_CC_x_I2C0_x_scFc_(K2W)_translation Fv#2 | VH3\|3-73/D3\|3-3\|RF3/JH4 | EVQLVES-GGGLVQPGGSLKLSCAASG-FTEN | 824 |
| MA_86-F5_CC_x_I2C0_x_scFc_(M4H)_translation Fv#2 | VH3\|3-73/D3\|3-3\|RF3/JH4 | EVQLVES-GGGLVQPGGSLKLSCAASG-FTEN | 825 |
| MA_88-B3-F9_CC_x_I2C0_x_scFc_(Y4E)_translation Fv#2 | VH3\|3-73/D3\|3-3\|RF3/JH4 | EVQLVES-GGGLVQPGGSLKLSCAASG-FTEN | 826 |
| MA_98-C7_CC_x_I2C0_x_scFc_(Y8P)_translation Fv#2 | VH3\|3-73/D3\|3-3\|RF3/JH4 | EVQLVES-GGGLVQPGGSLKLSCAASG-FTEN | 827 |
| MA_87-G12_AS_CC_x_I2C0_x_scFc_(Q4Z)_translation Fv#2 | VH3\|3-73/D3\|3-3\|RF3/JH4 | EVQLVES-GGGLVQPGGSLKLSCAASG-FTEN | 828 |
| MA_SG-F28_CC_x_I2C0_x_scFc_(D9R)_translation Fv#2 | VH3\|3-73/D3\|3-3\|RF3/JH4 | EVQLVES-GGGLVQPGGSLKLSCAASG-FTEN | 829 |
| VH2\|2-70/D2\|2-15\|RF1/JH5 | | QVTLKES-GPALVKPTQTLTLTCTFSG-FSLS | 830 |
| MA_09-C7_CC_x_I2C0_x_scFc_(K9T)_translation Fv#1 | VH2\|2-70/D2\|2-15\|RF1/JH5 | QVTLKES-GPALVKPTQTLTLTCTFSG-FSFT | 831 |
| VH3\|3-15/D3\|3-10\|RF2/JH6 | | EVQLVES-GGGLVKPGGSLRLSCAASG-FTES | 832 |
| MA_09-E2_CC_x_I2C0_x_scFc_(V8T)_translation Fv#1 | VH3\|3-15/D3\|3-10\|RF2/JH6 | EVQLVES-GGGLVQPGGSLRLSCAASG-FTES | 833 |
| MA_10-B5_CC_x_I2C0_x_scFc_(H6H)_translation Fv#1 | VH3\|3-15/D3\|3-10\|RF2/JH6 | EVQLVES-GGGLVQPGGSLRLSCAASG-FTES | 834 |
| MA_10-B6_CC_x_I2C0_x_scFc_(I3O)_translation Fv#1 | VH3\|3-15/D3\|3-10\|RF2/JH6 | EVQLVES-GGGLVQPGGSLRLSCAASG-FTES | 835 |
| MA_10-D3_CC_x_I2C0_x_scFc_(O6B)_translation Fv#1 | VH3\|3-15/D3\|3-10\|RF2/JH6 | EVQLVES-GGGLVQPGGSLRLSCAASG-FTES | 836 |
| MA_10-D6_CC_x_I2C0_x_scFc_(V6Z)_translation Fv#1 | VH3\|3-15/D3\|3-10\|RF2/JH6 | EVQLVES-GGGLVQPGGSLRLSCAASG-FTES | 837 |
| MA_10-G2_CC_x_I2C0_x_scFc_(T1S)_translation Fv#1 | VH3\|3-15/D3\|3-10\|RF2/JH6 | EVQLVES-GGGLVQPGGSLRLSCAASG-FTES | 838 |
| MA_10-G5_CC_x_I2C0_x_scFc_(S9O)_translation Fv#1 | VH3\|3-15/D3\|3-10\|RF2/JH6 | EVQLVES-GGGLVQPGGSLRLSCAASG-FTES | 839 |
| MA_10-H1_CC_x_I2C0_x_scFc_(T9K)_translation Fv#1 | VH3\|3-15/D3\|3-10\|RF2/JH6 | EVQLVES-GGGLVQPGGSLRLSCAASG-FTES | 840 |
| MA_10-H3_CC_x_I2C0_x_scFc_(M9L)_translation Fv#1 | VH3\|3-15/D3\|3-10\|RF2/JH6 | EVQLVES-GGGLVQPGGSLRLSCAASG-FTES | 841 |
| VH2\|2-05/D2\|2-15\|RF1/JH5 | | QITLKES-GPTLVKPTQTLTLTCTFSG-FSLS | 842 |
| MA_09-F11_CC_x_I2C0_x_scFc_(L6Q)_translation Fv#1 | VH2\|2-05/D2\|2-15\|RF1/JH5 | QITLKES-GPMLVKPTQTLTLTCTFSG-FSFT | 843 |
| MA_09-F12_CC_x_I2C0_x_scFc_(D1U)_translation Fv#1 | VH2\|2-05/D2\|2-15\|RF1/JH5 | QITLKES-GPALVKPTQTLTLTCTFSG-FSFT | 844 |
| MA_09-G8_CC_x_I2C0_x_scFc_(I6K)_translation Fv#1 | VH2\|2-05/D2\|2-15\|RF1/JH5 | QITLKES-GPTLVKPTQTLTLTCTFSG-FSFT | 845 |
| MA_09-G10_CC_x_I2C0_x_scFc_(C4K)_translation Fv#1 | VH2\|2-05/D2\|2-15\|RF1/JH5 | QITLKES-GPTLVKPTQTLTLTCTESG-FSFT | 846 |
| MA_09-G11_CC_x_I2C0_x_scFc_(Y9Q)_translation Fv#1 | VH2\|2-05/D2\|2-15\|RF1/JH5 | QITLKES-GPMLVKPTQTLTLTCTFSG-FSFT | 847 |
| MA_09-H7_CC_x_I2C0_x_scFc_(T3S)_translation Fv#1 | VH2\|2-05/D2\|2-15\|RF1/JH5 | QITLKES-GPALVKPTQTLTLTCTFSG-FSFT | 848 |
| MA_09-H10_CC_x_I2C0_x_scFc_(B6N)_translation Fv#1 | VH2\|2-05/D2\|2-15\|RF1/JH5 | QITLKES-GPTLVKPTQTLTLTCTFSG-FSFT | 849 |
| MA_09-H11_CC_x_I2C0_x_scFc_(I8L)_translation Fv#1 | VH2\|2-05/D2\|2-15\|RF1/JH5 | QITLKES-GPTLVKPTQTLTLTCTFSG-FSFT | 850 |
| VH4\|4-59/D3\|3-3\|RF3/JH4 | | QVQLQES-GPGLVKPSETLSLTCTVSG-GSIS | 851 |
| MA_81-B9_CC_x_I2C0_x_scFc_(U4L)_translation Fv#1 | VH4\|4-59/D3\|3-3\|RF3/JH4 | QVQLQES-GPGLVKPSETLSLTCTVSG-DSIS | 852 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| VH3\|3-30.3/D1\|1-1\|RF2/JH4 | | QVQLVES-GGGVVQPGRSLRLSCAASG-FTES | 853 |
| MA_86-A4_CC_x_I2C0_x_scFc_(K2W)_translation Fv#1 | VH3\|3-30.3/D1\|1-1\|RF2/JH4 | QVQLVES-GGGVVQPGRSLRLSCAASG-FTES | 854 |
| MA_86-A4-N-F5_CC_x_I2C0_x_scFc_(M4H)_translation Fv#1 | VH3\|3-30.3/D1\|1-1\|RF2/JH4 | QVQLVES-GGGVVQPGRSLRLSCAASG-FTES | 855 |
| VH3\|3-11/D1\|1-1\|RF3/JH4 | | QVQLVES-GGGLVKPGGSLRLSCAASG-FTES | 856 |
| MA_88-B3-F9_CC_x_I2C0_x_scFc_(Y4E)_translation Fv#1 | VH3\|3-11/D1\|1-1\|RF3/JH4 | QVQLVES-GGGLVKPGGSLRLSCAASG-FTFS | 857 |
| VH4\|4-30._1/D3\|3-10\|RF3/_JH6 | | QVQLQES-GPGLVKPSQTLSLTCTVSG-GSIS | 858 |
| MA_SG-F28_CC_x_I2C0_x_scFc_(D9R)_translation Fv#1 | VH4\|4-30.1/D3\|3-10\|RF3/JH6 | QVQLQES-GPGLVKPSQTLSLTCTVSG-DSIS | 859 |
| | | H_CDR1 | |
| VH3\|3-23/D6\|6-19\|RF2/JH4 | | S-----HAMS | 941 |
| MA_03-C7_AS_CC_x_I2C0_x_scFc_(G2H)_translation Fv#1 | VH3\|3-23/D6\|6-19\|RF2/JH4 | S-----HAMS | 942 |
| MA_03-D8_AS_CC_x_I2C0_x_scFc_(L7E)_translation Fv#1 | VH3\|3-23/D6\|6-19\|RF2/JH4 | S-----HAMS | 943 |
| MA_03-D8_CC_x_I2C0_x_scFc_(H6N)_translation Fv#1 | VH3\|3-23/D6\|6-19\|RF2/JH4 | S-----HAMS | 944 |
| MA_03-D12_AS_CC_x_I2C0_x_scFc_(L6A)_translation Fv#1 | VH3\|3-23/D6\|6-19\|RF2/JH4 | S-----HAMS | 945 |
| MA_03-E7_AS_CC_x_I2C0_x_scFc_(L6M)_translation Fv#1 | VH3\|3-23/D6\|6-19\|RF2/JH4 | S-----HAMS | 946 |
| MA_03-E11_AS_CC_x_I2C0_x_scFc_(G2B)_translation Fv#1 | VH3\|3-23/D6\|6-19\|RF2/JH4 | S-----HAMS | 947 |
| MA_03-G10_AS_CC_x_I2C0_x_scFc_(N3H)_translation Fv#1 | VH3\|3-23/D6\|6-19\|RF2/JH4 | S-----YAMS | 948 |
| MA_03-G11_AS_CC_x_I2C0_x_scFc_(O4R)_translation Fv#1 | VH3\|3-23/D6\|6-19\|RF2/JH4 | S-----HAMS | 949 |
| MA_03-H12_AS_CC_x_I2C0_x_scFc_(K5A)_translation Fv#1 | VH3\|3-23/D6\|6-19\|RF2/JH4 | S-----HAMS | 950 |
| MA_10-G10_AS_CC_x_I2C0_x_scFc_(T1I)_translation Fv#1 | VH3\|3-23/D6\|6-19\|RF2/JH4 | S-----HAMS | 951 |
| MA_10-G10_CC_x_I2C0_x_scFc_(B3A)_translation Fv#1 | VH3\|3-23/D6\|6-19\|RF2/JH4 | S-----HAMS | 952 |
| MA_98-C7_CC_x_I2C0_x_scFc_(Y8P)_translation Fv#1 | VH3\|3-23/D6\|6-19\|RF2/JH4 | S-----HAMS | 953 |
| MA_98-G12_AS_CC_x_I2C0_x_scFc_(Q4Z)_translation Fv#1 | VH3\|3-23/D6\|6-19\|RF2/JH4 | S-----HAMS | 954 |
| VH3\|3-73/D3\|3-3\|RF3/JH4 | | G-----SAMH | 955 |
| MA_03-C7_AS_CC_x_I2C0_x_scFc_(G2H)_translation Fv#2 | VH3\|3-73/D3\|3-3\|RF3/JH4 | K-----YAMN | 956 |
| MA_03-D8_AS_CC_x_I2C0_x_scFc_(L7E)_translation Fv#2 | VH3\|3-73/D3\|3-3\|RF3/JH4 | K-----YAMN | 957 |
| MA_03-D8_CC_x_I2C0_x_scFc_(H6N)_translation Fv#2 | VH3\|3-73/D3\|3-3\|RF3/JH4 | K-----YAMN | 958 |
| MA_03-D12_AS_CC_x_I2C0_x_scFc_(L6A)_translation Fv#2 | VH3\|3-73/D3\|3-3\|RF3/JH4 | K-----YAMN | 959 |
| MA_03-E7_AS_CC_x_I2C0_x_scFc_(L6M)_translation Fv#2 | VH3\|3-73/D3\|3-3\|RF3/JH4 | K-----YAMN | 960 |
| MA_03-E11_AS_CC_x_I2C0_x_scFc_(G2B)_translation Fv#2 | VH3\|3-73/D3\|3-3\|RF3/JH4 | K-----YAMN | 961 |
| MA_03-G10_AS_CC_x_I2C0_x_scFc_(N3H)_translation Fv#2 | VH3\|3-73/D3\|3-3\|RF3/JH4 | K-----YAMN | 962 |
| MA_03-G11_AS_CC_x_I2C0_x_scFc_(O4R)_translation Fv#2 | VH3\|3-73/D3\|3-3\|RF3/JH4 | K-----YAMN | 963 |
| MA_03-H12_AS_CC_x_I2C0_x_scFc_(K5A)_translation Fv#2 | VH3\|3-73/D3\|3-3\|RF3/JH4 | K-----YAMN | 964 |
| MA_09-C7_CC_x_I2C0_x_scFc_(K9T)_translation Fv#2 | VH3\|3-73/D3\|3-3\|RF3/JH4 | K-----YAMN | 965 |
| MA_09-E2_CC_x_I2C0_x_scFc_(V8T)_translation Fv#2 | VH3\|3-73/D3\|3-3\|RF3/JH4 | K-----YAMN | 966 |
| MA_09-F11_CC_x_I2C0_x_scFc_(L6Q)_translation Fv#2 | VH3\|3-73/D3\|3-3\|RF3/JH4 | K-----YAMN | 967 |
| MA_09-F12_CC_x_I2C0_x_scFc_(D1U)_translation Fv#2 | VH3\|3-73/D3\|3-3\|RF3/JH4 | K-----YAMN | 968 |
| MA_09-G8_CC_x_I2C0_x_scFc_(I6K)_translation Fv#2 | VH3\|3-73/D3\|3-3\|RF3/JH4 | K-----YAMN | 969 |
| MA_09-G10_CC_x_I2C0_x_scFc_(C4K)_translation Fv#2 | VH3\|3-73/D3\|3-3\|RF3/JH4 | K-----YAMN | 970 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_09-G11_CC_x_I2C0_x_scFc_(Y9Q)_translation Fv#2 | VH3\|3-73/D3\|3-3\|RF3/JH4 | K-----YAMN | 971 |
| MA_09-H7_CC_x_I2C0_x_scFc_(T3S)_translation Fv#2 | VH3\|3-73/D3\|3-3\|RF3/JH4 | K-----YAMN | 972 |
| MA_09-H10_CC_x_I2C0_x_scFc_(B6N)_translation Fv#2 | VH3\|3-73/D3\|3-3\|RF3/JH4 | K-----YAMN | 973 |
| MA_09-H11_CC_x_I2C0_x_scFc_(I8L)_translation Fv#2 | VH3\|3-73/D3\|3-3\|RF3/JH4 | K-----YAMN | 974 |
| MA_10-B5_CC_x_I2C0_x_scFc_(H6H)_translation Fv#2 | VH3\|3-73/D3\|3-3\|RF3/JH4 | K-----YAMN | 975 |
| MA_10-B6_CC_x_I2C0_x_scFc_(I3O)_translation Fv#2 | VH3\|3-73/D3\|3-3\|RF3/JH4 | K-----YAMN | 976 |
| MA_10-D3_CC_x_I2C0_x_scFc_(O6B)_translation Fv#2 | VH3\|3-73/D3\|3-3\|RF3/JH4 | K-----YAMN | 977 |
| MA_10-D6_CC_x_I2C0_x_scFc_(V6Z)_translation Fv#2 | VH3\|3-73/D3\|3-3\|RF3/JH4 | K-----YAMN | 978 |
| MA_10-G2_CC_x_I2C0_x_scFc_(T1S)_translation Fv#2 | VH3\|3-73/D3\|3-3\|RF3/JH4 | K-----YAMN | 979 |
| MA_10-G5_CC_x_I2C0_x_scFc_(S9O)_translation Fv#2 | VH3\|3-73/D3\|3-3\|RF3/JH4 | K-----YAMN | 980 |
| MA_10-G10_AS_CC_x_I2C0_x_scFc_(T1I)_translation Fv#2 | VH3\|3-73/D3\|3-3\|RF3/JH4 | K-----YAMN | 981 |
| MA_10-G10_CC_x_I2C0_x_scFc_(B3A)_translation Fv#2 | VH3\|3-73/D3\|3-3\|RF3/JH4 | K-----YAMN | 982 |
| MA_10-H1_CC_x_I2C0_x_scFc_(T9K)_translation Fv#2 | VH3\|3-73/D3\|3-3\|RF3/JH4 | K-----YAMN | 983 |
| MA_10-H3_CC_x_I2C0_x_scFc_(M9L)_translation Fv#2 | VH3\|3-73/D3\|3-3\|RF3/JH4 | K-----YAMN | 984 |
| MA_81-B9_CC_x_I2C0_x_scFc_(U4L)_translation Fv#2 | VH3\|3-73/D3\|3-3\|RF3/JH4 | K-----YAMN | 985 |
| MA_86-A4_CC_x_I2C0_x_scFc_(K2W)_translation Fv#2 | VH3\|3-73/D3\|3-3\|RF3/JH4 | K-----YAMN | 986 |
| MA_86-F5_CC_x_I2C0_x_scFc_(M4H)_translation Fv#2 | VH3\|3-73/D3\|3-3\|RF3/JH4 | K-----YAMN | 987 |
| MA_88-B3-F9_CC_x_I2C0_x_scFc_(Y4E)_translation Fv#2 | VH3\|3-73/D3\|3-3\|RF3/JH4 | K-----YAMN | 988 |
| MA_98-C7_CC_x_I2C0_x_scFc_(Y8P)_translation Fv#2 | VH3\|3-73/D3\|3-3\|RF3/JH4 | K-----YAMN | 989 |
| MA_87-G12_AS_CC_x_I2C0_x_scFc_(Q4Z)_translation Fv#2 | VH3\|3-73/D3\|3-3\|RF3/JH4 | K-----YAMN | 990 |
| MA_SG-F28_CC_x_I2C0_x_scFc_(D9R)_translation Fv#2 | VH3\|3-73/D3\|3-3\|RF3/JH4 | K-----YAMN | 991 |
| VH2\|2-70/D2\|2-15\|RF1/JH5 | | TS---GMRVS | 992 |
| MA_09-C7_CC_x_I2C0_x_scFc_(K9T)_translation Fv#1 | VH2\|2-70/D2\|2-15\|RF1/JH5 | TH---KMGVD | 993 |
| VH3\|3-15/D3\|3-10\|RF2/JH6 | | N-----AWMS | 994 |
| MA_09-E2_CC_x_I2C0_x_scFc_(V8T)_translation Fv#1 | VH3\|3-15/D3\|3-10\|RF2/JH6 | N-----AWMS | 995 |
| MA_10-B5_CC_x_I2C0_x_scFc_(H6H)_translation Fv#1 | VH3\|3-15/D3\|3-10\|RF2/JH6 | N-----AWMS | 996 |
| MA_10-B6_CC_x_I2C0_x_scFc_(I3O)_translation Fv#1 | VH3\|3-15/D3\|3-10\|RF2/JH6 | N-----AWMS | 997 |
| MA_10-D3_CC_x_I2C0_x_scFc_(O6B)_translation Fv#1 | VH3\|3-15/D3\|3-10\|RF2/JH6 | N-----AWMS | 998 |
| MA_10-D6_CC_x_I2C0_x_scFc_(V6Z)_translation Fv#1 | VH3\|3-15/D3\|3-10\|RF2/JH6 | N-----AWMS | 999 |
| MA_10-G2_CC_x_I2C0_x_scFc_(T1S)_translation Fv#1 | VH3\|3-15/D3\|3-10\|RF2/JH6 | N-----AWMS | 1000 |
| MA_10-G5_CC_x_I2C0_x_scFc_(S9O)_translation Fv#1 | VH3\|3-15/D3\|3-10\|RF2/JH6 | N-----AWMS | 1001 |
| MA_10-H1_CC_x_I2C0_x_scFc_(T9K)_translation Fv#1 | VH3\|3-15/D3\|3-10\|RF2/JH6 | N-----AWMS | 1002 |
| MA_10-H3_CC_x_I2C0_x_scFc_(M9L)_translation Fv#1 | VH3\|3-15/D3\|3-10\|RF2/JH6 | N-----AWMS | 1003 |
| VH2\|2-05/D2\|2-15\|RF1/JH5 | | TS---GVGVG | 1004 |
| MA_09-F11_CC_x_I2C0_x_scFc_(L6Q)_translation Fv#1 | VH2\|2-05/D2\|2-15\|RF1/JH5 | TH---KMGVD | 1005 |
| MA_09-F12_CC_x_I2C0_x_scFc_(D1U)_translation Fv#1 | VH2\|2-05/D2\|2-15\|RF1/JH5 | TH---KMGVD | 1006 |
| MA_09-G8_CC_x_I2C0_x_scFc_(I6K)_translation Fv#1 | VH2\|2-05/D2\|2-15\|RF1/JH5 | TH---KMGVD | 1007 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_09-G10_CC_x_I2C0_x_scFc_(C4K)_translation Fv#1 | VH2\|2-05/D2\|2-15\|RF1/JH5 | TH---KMGVD | 1008 |
| MA_09-G11_CC_x_I2C0_x_scFc_(Y9Q)_translation Fv#1 | VH2\|2-05/D2\|2-15\|RF1/JH5 | TH---KMGVD | 1009 |
| MA_09-H7_CC_x_I2C0_x_scFc_(T3S)_translation Fv#1 | VH2\|2-05/D2\|2-15\|RF1/JH5 | TH---KMGVD | 1010 |
| MA_09-H10_CC_x_I2C0_x_scFc_(B6N)_translation Fv#1 | VH2\|2-05/D2\|2-15\|RF1/JH5 | TH---KMGVD | 1011 |
| MA_09-H11_CC_x_I2C0_x_scFc_(I8L)_translation Fv#1 | VH2\|2-05/D2\|2-15\|RF1/JH5 | TH---KMGVD | 1012 |
| VH4\|4-59/D3\|3-3\|RF3/JH4 | | S-----YYWS | 1013 |
| MA_81-B9_CC_x_I2C0_x_scFc_(U4L)_translation Fv#1 | VH4\|4-59/D3\|3-3\|RF3/JH4 | SS----RYYWG | 1014 |
| VH3\|3-30.3/D1\|1-1\|RF2/JH4 | | S-----YAMH | 1015 |
| MA_86-A4_CC_x_I2C0_x_scFc_(K2W)_translation Fv#1 | VH3\|3-30.3/D1\|1-1\|RF2/JH4 | T-----YGMH | 1016 |
| MA_86-A4-N-F5_CC_x_I2C0_x_scFc_(M4H)_translation Fv#1 | VH3\|3-30.3/D1\|1-1\|RF2/JH4 | T-----YGMH | 1017 |
| VH3\|3-11/D1\|1-1\|RF3/JH4 | | D-----YYMS | 1018 |
| MA_88-B3-F9_CC_x_I2C0_x_scFc_(Y4E)_translation Fv#1 | VH3\|3-11/D1\|1-1\|RF3/JH4 | D-----YYMS | 1019 |
| VH4\|4-30._1/D3\|3-10\|RF3/_JH6 | | SG---GYYWS | 1020 |
| MA_SG-F28_CC_x_I2C0_x_scFc_(D9R)_translation Fv#1 | VH4\|4-30.1/D3\|3-10\|RF3/JH6 | SN---PYYWS | 1021 |
| | | KFR2 | |
| VK1\|O12/JK1 | | WYQQKPGKAPKLLIY | 1022 |
| MA_09-C7_CC_x_I2C0_x_scFc_(K9T)_translation | VK1\|O12/JK1 | WYQQKPGKAPKLLIY | 1023 |
| MA_09-E2_CC_x_I2C0_x_scFc_(V8T)_translation | VK1\|O12/JK1 | WYQQKPGRAPKLLIF | 1024 |
| MA_09-F11_CC_x_I2C0_x_scFc_(L6Q)_translation | VK1\|O12/JK1 | WYQQKPGKAPKLLIY | 1025 |
| MA_09-F12_CC_x_I2C0_x_scFc_(D1U)_translation | VK1\|O12/JK1 | WYQQKPGKAPKLLIY | 1026 |
| MA_09-G8_CC_x_I2C0_x_scFc_(I6K)_translation | VK1\|O12/JK1 | WYQQKPGKAPKLLIY | 1027 |
| MA_09-G10_CC_x_I2C0_x_scFc_(C4K)_translation | VK1\|O12/JK1 | WYQQKPGKAPKLLIY | 1028 |
| MA_09-G11_CC_x_I2C0_x_scFc_(Y9Q)_translation | VK1\|O12/JK1 | WYQQKPGKAPKLLIY | 1029 |
| MA_09-H7_CC_x_I2C0_x_scFc_(T3S)_translation | VK1\|O12/JK1 | WYQQKPGKAPKLLIY | 1030 |
| MA_09-H10_CC_x_I2C0_x_scFc_(B6N)_translation | VK1\|O12/JK1 | WYQQKPGKAPKLLIY | 1031 |
| MA_09-H11_CC_x_I2C0_x_scFc_(I8L)_translation | VK1\|O12/JK1 | WYQQKPGKAPKLLIY | 1032 |
| MA_10-B5_CC_x_I2C0_x_scFc_(H6H)_translation | VK1\|O12/JK1 | WYQQKPGRAPKLLIE | 1033 |
| VK1\|O12/JK2 | | WYQQKPGKAPKLLIY | 1034 |
| MA_10-B6_CC_x_I2C0_x_scFc_(I3O)_translation | VK1\|O12/JK2 | WYQQKPGRAPKLLIF | 1035 |
| MA_10-H3_CC_x_I2C0_x_scFc_(M9L)_translation | VK1\|O12/JK2 | WYQQKPGRAPKLLIF | 1036 |
| VK1\|O12/JK3 | | WYQQKPGKAPKLLIY | 1037 |
| MA_10-D3_CC_x_I2C0_x_scFc_(O6B)_translation | VK1\|O12/JK3 | WYQQKPGRAPKLLIF | 1038 |
| MA_10-D6_CC_x_I2C0_x_scFc_(V6Z)_translation | VK1\|O12/JK3 | WYQQKPGRAPKLLIF | 1039 |
| MA_10-G2_CC_x_I2C0_x_scFc_(T1S)_translation | VK1\|O12/JK3 | WFQQKPGKAPKLLIE | 1040 |
| MA_10-G5_CC_x_I2C0_x_scFc_(S9O)_translation | VK1\|O12/JK3 | WYQQKPGRAPKLLIF | 1041 |
| MA_10-H1_CC_x_I2C0_x_scFc_(T9K)_translation | VK1\|O12/JK3 | WYQQKPGRAPKLLIF | 1042 |
| VK4\|B3/JK5 | | WYQQKPGQPPKLLIY | 1043 |
| MA_81-B9_CC_x_I2C0_x_scFc_(U4L)_translation | VK4\|B3/JK5 | WYQQKPGQPPKLLIY | 1044 |
| VK1\|A20/JK1 | | WYQQKPGKVPKLLIY | 1045 |
| MA_86-A4_CC_x_I2C0_x_scFc_(K2W)_translation | VK1\|A20/JK1 | WYQQKPGKVPKLLIY | 1046 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_86-A4-N-F5_CC_x_I2C0_x_scFc_(M4H)_translation | VK1\|A20/JK1 | WYQQKPGKVPKLLIY | 1047 |
| VK2\|O1/JK1 | | WYLQKPGQSPQLLIY | 1048 |
| MA_SG-F28_CC_x_I2C0_x_scFc_(D9R)_translation | VK2\|O1/JK1 | WYLQKPGQSPQLLIY | 1049 |
| | | K_CDR2 | |
| VK1\|O12/JK1 | | A--------ASSLQS | 1184 |
| MA_09-C7_CC_x_I2C0_x_scFc_(K9T)_translation | VK1\|O12/JK1 | A--------ASSLQS | 1185 |
| MA_09-E2_CC_x_I2C0_x_scFc_(V8T)_translation | VK1\|O12/JK1 | A--------ASSLQG | 1186 |
| MA_09-F11_CC_x_I2C0_x_scFc_(L6Q)_translation | VK1\|O12/JK1 | A--------ASSLQS | 1187 |
| MA_09-F12_CC_x_I2C0_x_scFc_(D1U)_translation | VK1\|O12/JK1 | A--------ASSLQS | 1188 |
| MA_09-G8_CC_x_I2C0_x_scFc_(I6K)_translation | VK1\|O12/JK1 | A--------ASSLQS | 1189 |
| MA_09-G10_CC_x_I2C0_x_scFc_(C4K)_translation | VK1\|O12/JK1 | A--------ASSLQS | 1190 |
| MA_09-G11_CC_x_I2C0_x_scFc_(Y9Q)_translation | VK1\|O12/JK1 | A--------ASSLQS | 1191 |
| MA_09-H7_CC_x_I2C0_x_scFc_(T3S)_translation | VK1\|O12/JK1 | A--------ASSLQS | 1192 |
| MA_09-H10_CC_x_I2C0_x_scFc_(B6N)_translation | VK1\|O12/JK1 | A--------ASSLQS | 1193 |
| MA_09-H11_CC_x_I2C0_x_scFc_(I8L)_translation | VK1\|O12/JK1 | A--------ASSLQS | 1194 |
| MA_10-B5_CC_x_I2C0_x_scFc_(H6H)_translation | VK1\|O12/JK1 | A--------ASSLQG | 1195 |
| VK1\|O12/JK2 | | A--------ASSLQS | 1196 |
| MA_10-B6_CC_x_I2C0_x_scFc_(I3O)_translation | VK1\|O12/JK2 | A--------ASSLQG | 1197 |
| MA_10-H3_CC_x_I2C0_x_scFc_(M9L)_translation | VK1\|O12/JK2 | A---------ASSLQG | 1198 |
| VK1\|O12/JK3 | | A--------ASSLQS | 1199 |
| MA_10-D3_CC_x_I2C0_x_scFc_(O6B)_translation | VK1\|O12/JK3 | A--------ASSLQG | 1200 |
| MA_10-D6_CC_x_I2C0_x_scFc_(V6Z)_translation | VK1\|O12/JK3 | A--------ASSLQG | 1201 |
| MA_10-G2_CC_x_I2C0_x_scFc_(T1S)_translation | VK1\|O12/JK3 | A--------ASSLQS | 1202 |
| MA_10-G5_CC_x_I2C0_x_scFc_(S9O)_translation | VK1\|O12/JK3 | A--------ASSLQG | 1203 |
| MA_10-H1_CC_x_I2C0_x_scFc_(T9K)_translation | VK1\|O12/JK3 | A--------ASSLQS | 1204 |
| VK4\|B3/JK5 | | W--------ASTRES | 1205 |
| MA_81-B9_CC_x_I2C0_x_scFc_(U4L)_translation | VK4\|B3/JK5 | W--------ASTRES | 1206 |
| VK1\|A20/JK1 | | A--------ASTLQS | 1207 |
| MA_86-A4_CC_x_I2C0_x_scFc_(K2W)_translation | VK1\|A20/JK1 | A--------ASTLQS | 1208 |
| MA_86-A4-N-F5_CC_x_I2C0_x_scFc_(M4H)_translation | VK1\|A20/JK1 | A--------ASTLQS | 1209 |
| VK2\|O1/JK1 | | T--------LSYRAS | 1210 |
| MA_SG-F28_CC_x_I2C0_x_scFc_(D9R)_translation | VK2\|O1/JK1 | L--------GSNRAS | 1211 |
| | | LFR2 | |
| VL3\|3h/JL2 | | WYQQKPGQAPVLVIY | 1050 |
| MA_03-C7_AS_CC_x_I2C0_x_scFc_(G2H)_translation | VL3\|3h/JL2 | WYQQKPGQAPVMVVY | 1051 |
| MA_03-D12_AS_CC_x_I2C0_x_scFc_(L6A)_translation | VL3\|3h/JL2 | WYQQKPGQAPVMVVY | 1052 |
| MA_03-E11_AS_CC_x_I2C0_x_scFc_(G2B)_translation | VL3\|3h/JL2 | WYQQKPGQAPVMVVY | 1053 |
| MA_03-G10_AS_CC_x_I2C0_x_scFc_(N3H)_translation | VL3\|3h/JL2 | WYQQKPGQAPVMVVY | 1054 |
| MA_03-G11_AS_CC_x_I2C0_x_scFc_(O4R)_translation | VL3\|3h/JL2 | WYQQKPGQAPVLVVY | 1055 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_10-G10_AS_CC_x_I2C0_x_scFc_(T1I)_translation | VL3\|3h/JL2 | WYQQKPGQAPVMVVY | 1056 |
| MA_10-G10_CC_x_I2C0_x_scFc_(B3A)_translation | VL3\|3h/JL2 | WYQQKPGQAPVMVVY | 1057 |
| MA_88-B3-F9_CC_x_I2C0_x_scFc_(Y4E)_translation | VL3\|3h/JL2 | WYQQKPGQAPVLVVY | 1058 |
| MA_98-C7_CC_x_I2C0_x_scFc_(Y8P)_translation | VL3\|3h/JL2 | WYQQKPGQAPVMVVY | 1059 |
| MA_98-G12_AS_CC_x_I2C0_x_scFc_(Q4Z)_translation | VL3\|3h/JL2 | WYQQKPGQAPVMVVY | 1060 |
| VL7\|7a/JL3b | | WFQQKPGQAPRALIY | 1061 |
| MA_03-C7_AS_CC_x_I2C0_x_scFc_(G2H)_translation | VL7\|7a/JL3b | WVQQKPGQAPRGLIG | 1062 |
| MA_03-D8_AS_CC_x_I2C0_x_scFc_(L7E)_translation | VL7\|7a/JL3b | WVQQKPGQAPRGLIG | 1063 |
| MA_03-D8_CC_x_I2C0_x_scFc_(H6N)_translation | VL7\|7a/JL3b | WVQQKPGQAPRGLIG | 1064 |
| MA_03-D12_AS_CC_x_I2C0_x_scFc_(L6A)_translation | VL7\|7a/JL3b | WVQQKPGQAPRGLIG | 1065 |
| MA_03-E7_AS_CC_x_I2C0_x_scFc_(L6M)_translation | VL7\|7a/JL3b | WVQQKPGQAPRGLIG | 1066 |
| MA_03-E11_AS_CC_x_I2C0_x_scFc_(G2B)_translation | VL7\|7a/JL3b | WVQQKPGQAPRGLIG | 1067 |
| MA_03-G10_AS_CC_x_I2C0_x_scFc_(N3H)_translation | VL7\|7a/JL3b | WVQQKPGQAPRGLIG | 1068 |
| MA_03-G11_AS_CC_x_I2C0_x_scFc_(O4R)_translation | VL7\|7a/JL3b | WVQQKPGQAPRGLIG | 1069 |
| MA_03-H12_AS_CC_x_I2C0_x_scFc_(K5A)_translation | VL7\|7a/JL3b | WVQQKPGQAPRGLIG | 1070 |
| MA_09-C7_CC_x_I2C0_x_scFc_(K9T)_translation | VL7\|7a/JL3b | WVQQKPGQAPRGLIG | 1071 |
| MA_09-E2_CC_x_I2C0_x_scFc_(V8T)_translation | VL7\|7a/JL3b | WVQQKPGQAPRGLIG | 1072 |
| MA_09-F11_CC_x_I2C0_x_scFc_(L6Q)_translation | VL7\|7a/JL3b | WVQQKPGQAPRGLIG | 1073 |
| MA_09-F12_CC_x_I2C0_x_scFc_(D1U)_translation | VL7\|7a/JL3b | WVQQKPGQAPRGLIG | 1074 |
| MA_09-G8_CC_x_I2C0_x_scFc_(I6K)_translation | VL7\|7a/JL3b | WVQQKPGQAPRGLIG | 1075 |
| MA_09-G10_CC_x_I2C0_x_scFc_(C4K)_translation | VL7\|7a/JL3b | WVQQKPGQAPRGLIG | 1076 |
| MA_09-G11_CC_x_I2C0_x_scFc_(Y9Q)_translation | VL7\|7a/JL3b | WVQQKPGQAPRGLIG | 1077 |
| MA_09-H7_CC_x_I2C0_x_scFc_(T3S)_translation | VL7\|7a/JL3b | WVQQKPGQAPRGLIG | 1078 |
| MA_09-H10_CC_x_I2C0_x_scFc_(B6N)_translation | VL7\|7a/JL3b | WVQQKPGQAPRGLIG | 1079 |
| MA_09-H11_CC_x_I2C0_x_scFc_(I8L)_translation | VL7\|7a/JL3b | WVQQKPGQAPRGLIG | 1080 |
| MA_10-B5_CC_x_I2C0_x_scFc_(H6H)_translation | VL7\|7a/JL3b | WVQQKPGQAPRGLIG | 1081 |
| MA_10-B6_CC_x_I2C0_x_scFc_(I3O)_translation | VL7\|7a/JL3b | WVQQKPGQAPRGLIG | 1082 |
| MA_10-D3_CC_x_I2C0_x_scFc_(O6B)_translation | VL7\|7a/JL3b | WVQQKPGQAPRGLIG | 1083 |
| MA_10-D6_CC_x_I2C0_x_scFc_(V6Z)_translation | VL7\|7a/JL3b | WVQQKPGQAPRGLIG | 1084 |
| MA_10-G2_CC_x_I2C0_x_scFc_(T1S)_translation | VL7\|7a/JL3b | WVQQKPGQAPRGLIG | 1085 |
| MA_10-G5_CC_x_I2C0_x_scFc_(S9O)_translation | VL7\|7a/JL3b | WVQQKPGQAPRGLIG | 1086 |
| MA_10-G10_AS_CC_x_I2C0_x_scFc_(T1I)_translation | VL7\|7a/JL3b | WVQQKPGQAPRGLIG | 1087 |
| MA_10-G10_CC_x_I2C0_x_scFc_(B3A)_translation | VL7\|7a/JL3b | WVQQKPGQAPRGLIG | 1088 |
| MA_10-H1_CC_x_I2C0_x_scFc_(T9K)_translation | VL7\|7a/JL3b | WVQQKPGQAPRGLIG | 1089 |
| MA_10-H3_CC_x_I2C0_x_scFc_(M9L)_translation | VL7\|7a/JL3b | WVQQKPGQAPRGLIG | 1090 |
| MA_81-B9_CC_x_I2C0_x_scFc_(U4L)_translation | VL7\|7a/JL3b | WVQQKPGQAPRGLIG | 1091 |
| MA_86-A4_CC_x_I2C0_x_scFc_(K2W)_translation | VL7\|7a/JL3b | WVQQKPGQAPRGLIG | 1092 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_86-A4-N-F5_CC_x_I2C0_x_scFc_(M4H)_translation | VL7\|7a/JL3b | WVQQKPGQAPRGLIG | 1093 |
| MA_88-B3-F9_CC_x_I2C0_x_scFc_(Y4E)_translation | VL7\|7a/JL3b | WVQQKPGQAPRGLIG | 1094 |
| MA_98-C7_CC_x_I2C0_x_scFc_(Y8P)_translation | VL7\|7a/JL3b | WVQQKPGQAPRGLIG | 1095 |
| MA_98-G12_AS_CC_x_I2C0_x_scFc_(Q4Z)_translation | VL7\|7a/JL3b | WVQQKPGQAPRGLIG | 1096 |
| MA_SG-F28_CC_x_I2C0_x_scFc_(D9R)_translation | VL7\|7a/JL3b | WVQQKPGQAPRGLIG | 1097 |
| VL3\|3h/JL3b | | WYQQKPGQAPVLVIY | 1098 |
| MA_03-D8_AS_CC_x_I2C0_x_scFc_(L7E)_translation | VL3\|3h/JL3b | WYQQKPGQAPVMVVY | 1099 |
| MA_03-D8_CC_x_I2C0_x_scFc_(H6N)_translation | VL3\|3h/JL3b | WYQQKPGQAPVMVVY | 1100 |
| MA_03-E7_AS_CC_x_I2C0_x_scFc_(L6M)_translation | VL3\|3h/JL3b | WYQQKPGQAPVMVVY | 1101 |
| MA_03-H12_AS_CC_x_I2C0_x_scFc_(K5A)_translation | VL3\|3h/JL3b | WYQQKPGQAPVMVVY | 1102 |
| | | L_CDR2 | |
| VL3\|3h/JL2 | | Y--------DSDRPS | 1212 |
| MA_03-C7_AS_CC_x_I2C0_x_scFc_(G2H)_translation | VL3\|3h/JL2 | D--------DNDRPS | 1213 |
| MA_03-D12_AS_CC_x_I2C0_x_scFc_(L6A)_translation | VL3\|3h/JL2 | D--------DNDRPS | 1214 |
| MA_03-E11_AS_CC_x_I2C0_x_scFc_(G2B)_translation | VL3\|3h/JL2 | D--------DNDRPS | 1215 |
| MA_03-G10_AS_CC_x_I2C0_x_scFc_(N3H)_translation | VL3\|3h/JL2 | D--------DNDRPS | 1216 |
| MA_03-G11_AS_CC_x_I2C0_x_scFc_(O4R)_translation | VL3\|3h/JL2 | D--------DNDRPS | 1217 |
| MA_10-G10_AS_CC_x_I2C0_x_scFc_(T1I)_translation | VL3\|3h/JL2 | D--------DNDRPS | 1218 |
| MA_10-G10_CC_x_I2C0_x_scFc_(B3A)_translation | VL3\|3h/JL2 | D--------DNDRPS | 1219 |
| MA_88-B3-F9_CC_x_I2C0_x_scFc_(Y4E)_translation | VL3\|3h/JL2 | D--------DADRPS | 1220 |
| MA_98-C7_CC_x_I2C0_x_scFc_(Y8P)_translation | VL3\|3h/JL2 | D--------DNDRPS | 1221 |
| MA_98-G12_AS_CC_x_I2C0_x_scFc_(Q4Z)_translation | VL3\|3h/JL2 | D--------DNDRPS | 1222 |
| VL7\|7a/JL3b | | S--------TSNKHS | 1223 |
| MA_03-C7_AS_CC_x_I2C0_x_scFc_(G2H)_translation | VL7\|7a/JL3b | G--------TKFLAP | 1224 |
| MA_03-D8_AS_CC_x_I2C0_x_scFc_(L7E)_translation | VL7\|7a/JL3b | G--------TKFLAP | 1225 |
| MA_03-D8_CC_x_I2C0_x_scFc_(H6N)_translation | VL7\|7a/JL3b | G--------TKFLAP | 1226 |
| MA_03-D12_AS_CC_x_I2C0_x_scFc_(L6A)_translation | VL7\|7a/JL3b | G--------TKFLAP | 1227 |
| MA_03-E7_AS_CC_x_I2C0_x_scFc_(L6M)_translation | VL7\|7a/JL3b | G--------TKFLAP | 1228 |
| MA_03-E11_AS_CC_x_I2C0_x_scFc_(G2B)_translation | VL7\|7a/JL3b | G--------TKFLAP | 1229 |
| MA_03-G10_AS_CC_x_I2C0_x_scFc_(N3H)_translation | VL7\|7a/JL3b | G--------TKFLAP | 1230 |
| MA_03-G11_AS_CC_x_I2C0_x_scFc_(O4R)_translation | VL7\|7a/JL3b | G--------TKFLAP | 1231 |
| MA_03-H12_AS_CC_x_I2C0_x_scFc_(K5A)_translation | VL7\|7a/JL3b | G--------TKFLAP | 1232 |
| MA_09-C7_CC_x_I2C0_x_scFc_(K9T)_translation | VL7\|7a/JL3b | G--------TKFLAP | 1233 |
| MA_09-E2_CC_x_I2C0_x_scFc_(V8T)_translation | VL7\|7a/JL3b | G--------TKFLAP | 1234 |
| MA_09-F11_CC_x_I2C0_x_scFc_(L6Q)_translation | VL7\|7a/JL3b | G--------TKFLAP | 1235 |
| MA_09-F12_CC_x_I2C0_x_scFc_(D1U)_translation | VL7\|7a/JL3b | G--------TKFLAP | 1236 |
| MA_09-G8_CC_x_I2C0_x_scFc_(I6K)_translation | VL7\|7a/JL3b | G--------TKFLAP | 1237 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_09-G10_CC_x_I2C0_x_scFc_(C4K)_translation | VL7\|7a/JL3b | G--------TKFLAP | 1238 |
| MA_09-G11_CC_x_I2C0_x_scFc_(Y9Q)_translation | VL7\|7a/JL3b | G--------TKFLAP | 1239 |
| MA_09-H7_CC_x_I2C0_x_scFc_(T3S)_translation | VL7\|7a/JL3b | G--------TKFLAP | 1240 |
| MA_09-H10_CC_x_I2C0_x_scFc_(B6N)_translation | VL7\|7a/JL3b | G--------TKFLAP | 1241 |
| MA_09-H11_CC_x_I2C0_x_scFc_(I8L)_translation | VL7\|7a/JL3b | G--------TKFLAP | 1242 |
| MA_10-B5_CC_x_I2C0_x_scFc_(H6H)_translation | VL7\|7a/JL3b | G--------TKFLAP | 1243 |
| MA_10-B6_CC_x_I2C0_x_scFc_(I3O)_translation | VL7\|7a/JL3b | G--------TKFLAP | 1244 |
| MA_10-D3_CC_x_I2C0_x_scFc_(O6B)_translation | VL7\|7a/JL3b | G--------TKFLAP | 1245 |
| MA_10-D6_CC_x_I2C0_x_scFc_(V6Z)_translation | VL7\|7a/JL3b | G--------TKFLAP | 1246 |
| MA_10-G2_CC_x_I2C0_x_scFc_(T1S)_translation | VL7\|7a/JL3b | G--------TKFLAP | 1247 |
| MA_10-G5_CC_x_I2C0_x_scFc_(S9O)_translation | VL7\|7a/JL3b | G--------TKFLAP | 1248 |
| MA_10-G10_AS_CC_x_I2C0_x_scFc_(T1I)_translation | VL7\|7a/JL3b | G--------TKFLAP | 1249 |
| MA_10-G10_CC_x_I2C0_x_scFc_(B3A)_translation | VL7\|7a/JL3b | G--------TKFLAP | 1250 |
| MA_10-H1_CC_x_I2C0_x_scFc_(T9K)_translation | VL7\|7a/JL3b | G--------TKFLAP | 1251 |
| MA_10-H3_CC_x_I2C0_x_scFc_(M9L)_translation | VL7\|7a/JL3b | G--------TKFLAP | 1252 |
| MA_81-B9_CC_x_I2C0_x_scFc_(U4L)_translation | VL7\|7a/JL3b | G--------TKFLAP | 1253 |
| MA_86-A4_CC_x_I2C0_x_scFc_(K2W)_translation | VL7\|7a/JL3b | G--------TKFLAP | 1254 |
| MA_86-A4-N-F5_CC_x_I2C0_x_scFc_(M4H)_translation | VL7\|7a/JL3b | G--------TKFLAP | 1255 |
| MA_88-B3-F9_CC_x_I2C0_x_scFc_(Y4E)_translation | VL7\|7a/JL3b | G--------TKFLAP | 1256 |
| MA_98-C7_CC_x_I2C0_x_scFc_(Y8P)_translation | VL7\|7a/JL3b | G--------TKFLAP | 1257 |
| MA_98-G12_AS_CC_x_I2C0_x_scFc_(Q4Z)_translation | VL7\|7a/JL3b | G--------TKFLAP | 1258 |
| MA_SG-F28_CC_x_I2C0_x_scFc_(D9R)_translation | VL7\|7a/JL3b | G--------TKFLAP | 1259 |
| VL3\|3h/JL3b | | Y--------DSDRPS | 1260 |
| MA_03-D8_AS_CC_x_I2C0_x_scFc_(L7E)_translation | VL3\|3h/JL3b | D--------DNDRPS | 1261 |
| MA_03-D8_CC_x_I2C0_x_scFc_(H6N)_translation | VL3\|3h/JL3b | D--------DNDRPS | 1262 |
| MA_03-E7_AS_CC_x_I2C0_x_scFc_(L6M)_translation | VL3\|3h/JL3b | D--------DNDRPS | 1263 |
| MA_03-H12_AS_CC_x_I2C0_x_scFc_(K5A)_translation | VL3\|3h/JL3b | D--------DNDRPS | 1264 |

| | | H_FR2 | |
|---|---|---|---|
| VH3\|3-23/D6\|6-19\|RF2/JH4 | | WVRQAPGKGLEWVS | 1103 |
| MA_03-C7_AS_CC_x_I2C0_x_scFc_(G2H)_translation Fv#1 | VH3\|3-23/D6\|6-19\|RF2/JH4 | WVRQAPGKCLEWVS | 1104 |
| MA_03-D8_AS_CC_x_I2C0_x_scFc_(L7E)_translation Fv#1 | VH3\|3-23/D6\|6-19\|RF2/JH4 | WVRQAPGKCLEWVS | 1105 |
| MA_03-D8_CC_x_I2C0_x_scFc_(H6N)_translation Fv#1 | VH3\|3-23/D6\|6-19\|RF2/JH4 | WVRQAPGKCLEWVS | 1106 |
| MA_03-D12_AS_CC_x_I2C0_x_scFc_(L6A)_translation Fv#1 | VH3\|3-23/D6\|6-19\|RF2/JH4 | WVRQAPGKCLEWVS | 1107 |
| MA_03-E7_AS_CC_x_I2C0_x_scFc_(L6M)_translation Fv#1 | VH3\|3-23/D6\|6-19\|RF2/JH4 | WVRQAPGKCLEWVS | 1108 |
| MA_03-E11_AS_CC_x_I2C0_x_scFc_(G2B)_translation Fv#1 | VH3\|3-23/D6\|6-19\|RF2/JH4 | WVRQAPGKCLEWVS | 1109 |
| MA_03-G10_AS_CC_x_I2C0_x_scFc_(N3H)_translation Fv#1 | VH3\|3-23/D6\|6-19\|RF2/JH4 | WVRQAPGKCLEWVS | 1110 |

TABLE 28-continued

BiTE-scFc Variable Region #1 (MAGEB2) Protein Alignment
CDRs defined by Kabat
Alignment numbering defined by Amgen Reference (AHo)

|  | Germline |  | SEQ ID NO: |
|---|---|---|---|
| MA_03-G11_AS_CC_x_I2C0_x_scFc_(O4R)_translation Fv#1 | VH3\|3-23/D6\|6-19\|RF2/JH4 | WVRQAPGKCLEWVS | 1111 |
| MA_03-H12_AS_CC_x_I2C0_x_scFc_(K5A)_translation Fv#1 | VH3\|3-23/D6\|6-19\|RF2/JH4 | WVRQAPGKCLEWVS | 1112 |
| MA_10-G10_AS_CC_x_I2C0_x_scFc_(T1I)_translation Fv#1 | VH3\|3-23/D6\|6-19\|RF2/JH4 | WVRQAPGKCLEWVS | 1113 |
| MA_10-G10_CC_x_I2C0_x_scFc_(B3A)_translation Fv#1 | VH3\|3-23/D6\|6-19\|RF2/JH4 | WVRQAPGKCLEWVS | 1114 |
| MA_98-C7_CC_x_I2C0_x_scFc_(Y8P)_translation Fv#1 | VH3\|3-23/D6\|6-19\|RF2/JH4 | WVRQAPGKCLEWVS | 1115 |
| MA_98-G12_AS_CC_x_I2C0_x_scFc_(Q4Z)_translation Fv#1 | VH3\|3-23/D6\|6-19\|RF2/JH4 | WVRQAPGKCLEWVS | 1116 |
| VH3\|3-73/D3\|3-3\|RF3/JH4 |  | WVRQASGKGLEWVG | 1117 |
| MA_03-C7_AS_CC_x_I2C0_x_scFc_(G2H)_translation Fv#2 | VH3\|3-73/D3\|3-3\|RF3/JH4 | WVRQAPGKGLEWVA | 1118 |
| MA_03-D8_AS_CC_x_I2C0_x_scFc_(L7E)_translation Fv#2 | VH3\|3-73/D3\|3-3\|RF3/JH4 | WVRQAPGKGLEWVA | 1119 |
| MA_03-D8_CC_x_I2C0_x_scFc_(H6N)_translation Fv#2 | VH3\|3-73/D3\|3-3\|RF3/JH4 | WVRQAPGKGLEWVA | 1120 |
| MA_03-D12_AS_CC_x_I2C0_x_scFc_(L6A)_translation Fv#2 | VH3\|3-73/D3\|3-3\|RF3/JH4 | WVRQAPGKGLEWVA | 1121 |
| MA_03-E7_AS_CC_x_I2C0_x_scFc_(L6M)_translation Fv#2 | VH3\|3-73/D3\|3-3\|RF3/JH4 | WVRQAPGKGLEWVA | 1122 |
| MA_03-E11_AS_CC_x_I2C0_x_scFc_(G2B)_translation Fv#2 | VH3\|3-73/D3\|3-3\|RF3/JH4 | WVRQAPGKGLEWVA | 1123 |
| MA_03-G10_AS_CC_x_I2C0_x_scFc_(N3H)_translation Fv#2 | VH3\|3-73/D3\|3-3\|RF3/JH4 | WVRQAPGKGLEWVA | 1124 |
| MA_03-G11_AS_CC_x_I2C0_x_scFc_(O4R)_translation Fv#2 | VH3\|3-73/D3\|3-3\|RF3/JH4 | WVRQAPGKGLEWVA | 1125 |
| MA_03-H12_AS_CC_x_I2C0_x_scFc_(K5A)_translation Fv#2 | VH3\|3-73/D3\|3-3\|RF3/JH4 | WVRQAPGKGLEWVA | 1126 |
| MA_09-C7_CC_x_I2C0_x_scFc_(K9T)_translation Fv#2 | VH3\|3-73/D3\|3-3\|RF3/JH4 | WVRQAPGKGLEWVA | 1127 |
| MA_09-E2_CC_x_I2C0_x_scFc_(V8T)_translation Fv#2 | VH3\|3-73/D3\|3-3\|RF3/JH4 | WVRQAPGKGLEWVA | 1128 |
| MA_09-F11_CC_x_I2C0_x_scFc_(L6Q)_translation Fv#2 | VH3\|3-73/D3\|3-3\|RF3/JH4 | WVRQAPGKGLEWVA | 1129 |
| MA_09-F12_CC_x_I2C0_x_scFc_(D1U)_translation Fv#2 | VH3\|3-73/D3\|3-3\|RF3/JH4 | WVRQAPGKGLEWVA | 1130 |
| MA_09-G8_CC_x_I2C0_x_scFc_(I6K)_translation Fv#2 | VH3\|3-73/D3\|3-3\|RF3/JH4 | WVRQAPGKGLEWVA | 1131 |
| MA_09-G10_CC_x_I2C0_x_scFc_(C4K)_translation Fv#2 | VH3\|3-73/D3\|3-3\|RF3/JH4 | WVRQAPGKGLEWVA | 1132 |
| MA_09-G11_CC_x_I2C0_x_scFc_(Y9Q)_translation Fv#2 | VH3\|3-73/D3\|3-3\|RF3/JH4 | WVRQAPGKGLEWVA | 1133 |
| MA_09-H7_CC_x_I2C0_x_scFc_(T3S)_translation Fv#2 | VH3\|3-73/D3\|3-3\|RF3/JH4 | WVRQAPGKGLEWVA | 1134 |
| MA_09-H10_CC_x_I2C0_x_scFc_(B6N)_translation Fv#2 | VH3\|3-73/D3\|3-3\|RF3/JH4 | WVRQAPGKGLEWVA | 1135 |
| MA_09-H11_CC_x_I2C0_x_scFc_(I8L)_translation Fv#2 | VH3\|3-73/D3\|3-3\|RF3/JH4 | WVRQAPGKGLEWVA | 1136 |
| MA_10-B5_CC_x_I2C0_x_scFc_(H6H)_translation Fv#2 | VH3\|3-73/D3\|3-3\|RF3/JH4 | WVRQAPGKGLEWVA | 1137 |
| MA_10-B6_CC_x_I2C0_x_scFc_(I3O)_translation Fv#2 | VH3\|3-73/D3\|3-3\|RF3/JH4 | WVRQAPGKGLEWVA | 1138 |
| MA_10-D3_CC_x_I2C0_x_scFc_(O6B)_translation Fv#2 | VH3\|3-73/D3\|3-3\|RF3/JH4 | WVRQAPGKGLEWVA | 1139 |
| MA_10-D6_CC_x_I2C0_x_scFc_(V6Z)_translation Fv#2 | VH3\|3-73/D3\|3-3\|RF3/JH4 | WVRQAPGKGLEWVA | 1140 |
| MA_10-G2_CC_x_I2C0_x_scFc_(T1S)_translation Fv#2 | VH3\|3-73/D3\|3-3\|RF3/JH4 | WVRQAPGKGLEWVA | 1141 |
| MA_10-G5_CC_x_I2C0_x_scFc_(S9O)_translation Fv#2 | VH3\|3-73/D3\|3-3\|RF3/JH4 | WVRQAPGKGLEWVA | 1142 |
| MA_10-G10_AS_CC_x_I2C0_x_scFc_(T1I)_translation Fv#2 | VH3\|3-73/D3\|3-3\|RF3/JH4 | WVRQAPGKGLEWVA | 1143 |
| MA_10-G10_CC_x_I2C0_x_scFc_(B3A)_translation Fv#2 | VH3\|3-73/D3\|3-3\|RF3/JH4 | WVRQAPGKGLEWVA | 1144 |
| MA_10-H1_CC_x_I2C0_x_scFc_(T9K)_translation Fv#2 | VH3\|3-73/D3\|3-3\|RF3/JH4 | WVRQAPGKGLEWVA | 1145 |
| MA_10-H3_CC_x_I2C0_x_scFc_(M9L)_translation Fv#2 | VH3\|3-73/D3\|3-3\|RF3/JH4 | WVRQAPGKGLEWVA | 1146 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_81-B9_CC_x_I2C0_x_scFc_(U4L)_translation Fv#2 | VH3\|3-73/D3\|3-3\|RF3/JH4 | WVRQAPGKGLEWVA | 1147 |
| MA_86-A4_CC_x_I2C0_x_scFc_(K2W)_translation Fv#2 | VH3\|3-73/D3\|3-3\|RF3/JH4 | WVRQAPGKGLEWVA | 1148 |
| MA_86-A4-N-F5_CC_x_I2C0_x_scFc_(M4H)_translation Fv#2 | VH3\|3-73/D3\|3-3\|RF3/JH4 | WVRQAPGKGLEWVA | 1149 |
| MA_88-B3-F9_CC_x_I2C0_x_scFc_(Y4E)_translation Fv#2 | VH3\|3-73/D3\|3-3\|RF3/JH4 | WVRQAPGKGLEWVA | 1150 |
| MA_98-C7_CC_x_I2C0_x_scFc_(Y8P)_translation Fv#2 | VH3\|3-73/D3\|3-3\|RF3/JH4 | WVRQAPGKGLEWVA | 1151 |
| MA_98-G12_AS_CC_x_I2C0_x_scFc_(Q4Z)_translation Fv#2 | VH3\|3-73/D3\|3-3\|RF3/JH4 | WVRQAPGKGLEWVA | 1152 |
| MA_SG-F28_CC_x_I2C0_x_scFc_(D9R)_translation Fv#2 | VH3\|3-73/D3\|3-3\|RF3/JH4 | WVRQAPGKGLEWVA | 1153 |
| VH2\|2-70/D2\|2-15\|RF1/JH5 | | WIRQPPGKALEWLA | 1154 |
| MA_09-C7_CC_x_I2C0_x_scFc_(K9T)_translation Fv#1 | VH2\|2-70/D2\|2-15\|RF1/JH5 | WIRQPPGKCLEWLA | 1155 |
| VH3\|3-15/D3\|3-10\|RF2/JH6 | | WVRQAPGKGLEWVG | 1156 |
| MA_09-E2_CC_x_I2C0_x_scFc_(V8T)_translation Fv#1 | VH3\|3-15/D3\|3-10\|RF2/JH6 | WVRQAPGKCLEWVG | 1157 |
| MA_10-B5_CC_x_I2C0_x_scFc_(H6H)_translation Fv#1 | VH3\|3-15/D3\|3-10\|RF2/JH6 | WVRQAPGKCLEWVG | 1158 |
| MA_10-B6_CC_x_I2C0_x_scFc_(I3O)_translation Fv#1 | VH3\|3-15/D3\|3-10\|RF2/JH6 | WVRQAPGKCLEWVG | 1159 |
| MA_10-D3_CC_x_I2C0_x_scFc_(O6B)_translation Fv#1 | VH3\|3-15/D3\|3-10\|RF2/JH6 | WVRQAPGKCLEWVG | 1160 |
| MA_10-D6_CC_x_I2C0_x_scFc_(V6Z)_translation Fv#1 | VH3\|3-15/D3\|3-10\|RF2/JH6 | WVRQAPGKCLEWVG | 1161 |
| MA_10-G2_CC_x_I2C0_x_scFc_(T1S)_translation Fv#1 | VH3\|3-15/D3\|3-10\|RF2/JH6 | WVRQAPGKCLEWVG | 1162 |
| MA_10-G5_CC_x_I2C0_x_scFc_(S9O)_translation Fv#1 | VH3\|3-15/D3\|3-10\|RF2/JH6 | WVRQAPGKCLEWVG | 1163 |
| MA_10-H1_CC_x_I2C0_x_scFc_(T9K)_translation Fv#1 | VH3\|3-15/D3\|3-10\|RF2/JH6 | WVRQAPGKCLEWVG | 1164 |
| MA_10-H3_CC_x_I2C0_x_scFc_(M9L)_translation Fv#1 | VH3\|3-15/D3\|3-10\|RF2/JH6 | WVRQAPGKCLEWVG | 1165 |
| VH2\|2-05/D2\|2-15\|RF1/JH5 | | WIRQPPGKALEWLA | 1166 |
| MA_09-F11_CC_x_I2C0_x_scFc_(L6Q)_translation Fv#1 | VH2\|2-05/D2\|2-15\|RF1/JH5 | WIRQPPGKCLEWLA | 1167 |
| MA_09-F12_CC_x_I2C0_x_scFc_(D1U)_translation Fv#1 | VH2\|2-05/D2\|2-15\|RF1/JH5 | WIRQPPGKCLEWLA | 1168 |
| MA_09-G8_CC_x_I2C0_x_scFc_(I6K)_translation Fv#1 | VH2\|2-05/D2\|2-15\|RF1/JH5 | WIRQPPGKCLEWLA | 1169 |
| MA_09-G10_CC_x_I2C0_x_scFc_(C4K)_translation Fv#1 | VH2\|2-05/D2\|2-15\|RF1/JH5 | WIRQPPGKCLEWLA | 1170 |
| MA_09-G11_CC_x_I2C0_x_scFc_(Y9Q)_translation Fv#1 | VH2\|2-05/D2\|2-15\|RF1/JH5 | WIRQPPGKCLEWLA | 1171 |
| MA_09-H7_CC_x_I2C0_x_scFc_(T3S)_translation Fv#1 | VH2\|2-05/D2\|2-15\|RF1/JH5 | WIRQPPGKCLEWLA | 1172 |
| MA_09-H10_CC_x_I2C0_x_scFc_(B6N)_translation Fv#1 | VH2\|2-05/D2\|2-15\|RF1/JH5 | WIRQPPGKCLEWLA | 1173 |
| MA_09-H11_CC_x_I2C0_x_scFc_(I8L)_translation Fv#1 | VH2\|2-05/D2\|2-15\|RF1/JH5 | WIRQPPGKCLEWLA | 1174 |
| VH4\|4-59/D3\|3-3\|RF3/JH4 | | WIRQPPGKGLEWIG | 1175 |
| MA_81-B9_CC_x_I2C0_x_scFc_(U4L)_translation Fv#1 | VH4\|4-59/D3\|3-3\|RF3/JH4 | WIRQPPGKCLEWIG | 1176 |
| VH3\|3-30._3/D1\|1-1\|RF2/JH4 | | WVRQAPGKGLEWVA | 1177 |
| MA_86-A4_CC_x_I2C0_x_scFc_(K2W)_translation Fv#1 | VH3\|3-30.3/D1\|1-1\|RF2/JH4 | WVRQAPGKCLEWVA | 1178 |
| MA_86-A4-N-F5_CC_x_I2C0_x_scFc_(M4H)_translation Fv#1 | VH3\|3-30.3/D1\|1-1\|RF2/JH4 | WVRQAPGKCLEWVA | 1179 |
| VH3\|3-11/D1\|1-1\|RF3/JH4 | | WIRQAPGKGLEWVS | 1180 |
| MA_88-B3-F9_CC_x_I2C0_x_scFc_(Y4E)_translation Fv#1 | VH3\|3-11/D1\|1-1\|RF3/JH4 | WIRQAPGKCLEWVS | 1181 |
| VH4\|4-30._1/D3\|3-10\|RF3/_JH6 | | WIRQHPGKGLEWIG | 1182 |
| MA_SG-F28_CC_x_I2C0_x_scFc_(D9R)_translation Fv#1 | VH4\|4-30.1/D3\|3-10\|RF3/JH6 | WIRQHPGKCLEWIG | 1183 |
| | | H_CDR2 | |
| VH3\|3-23/D6\|6-19\|RF2/JH4 | | AISGS---GGSTYYADSVKG | 1265 |
| MA_03-C7_AS_CC_x_I2C0_x_scFc_(G2H)_translation Fv#1 | VH3\|3-23/D6\|6-19\|RF2/JH4 | AISGS---GGGTYYAASVKG | 1266 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_03-D8_AS_CC_x_I2C0_x_scFc_(L7E)_translation Fv#1 | VH3\|3-23/D6\|6-19\|RF2/JH4 | TISGS---GGGTYYAASVKG | 1267 |
| MA_03-D8_CC_x_I2C0_x_scFc_(H6N)_translation Fv#1 | VH3\|3-23/D6\|6-19\|RF2/JH4 | TISGS---GGGTYYADSVKG | 1268 |
| MA_03-D12_AS_CC_x_I2C0_x_scFc_(L6A)_translation Fv#1 | VH3\|3-23/D6\|6-19\|RF2/JH4 | AISGS---GGGTYYAASVKA | 1269 |
| MA_03-E7_AS_CC_x_I2C0_x_scFc_(L6M)_translation Fv#1 | VH3\|3-23/D6\|6-19\|RF2/JH4 | AISGS---GGGTYYAASGKG | 1270 |
| MA_03-E11_AS_CC_x_I2C0_x_scFc_(G2B)_translation Fv#1 | VH3\|3-23/D6\|6-19\|RF2/JH4 | AISGS---GGGTYNAASVKG | 1271 |
| MA_03-G10_AS_CC_x_I2C0_x_scFc_(N3H)_translation Fv#1 | VH3\|3-23/D6\|6-19\|RF2/JH4 | AISGS---GGGTYYAASVKG | 1272 |
| MA_03-G11_AS_CC_x_I2C0_x_scFc_(O4R)_translation Fv#1 | VH3\|3-23/D6\|6-19\|RF2/JH4 | AISGS---GGGTYYAASVKG | 1273 |
| MA_03-H12_AS_CC_x_I2C0_x_scFc_(K5A)_translation Fv#1 | VH3\|3-23/D6\|6-19\|RF2/JH4 | AISGS---GGGTYNAASVKG | 1274 |
| MA_10-G10_AS_CC_x_I2C0_x_scFc_(T1I)_translation Fv#1 | VH3\|3-23/D6\|6-19\|RF2/JH4 | AISGS---GGGTYNAASVKG | 1275 |
| MA_10-G10_CC_x_I2C0_x_scFc_(B3A)_translation Fv#1 | VH3\|3-23/D6\|6-19\|RF2/JH4 | AISGS---GGGTYNADSVKG | 1276 |
| MA_98-C7_CC_x_I2C0_x_scFc_(Y8P)_translation Fv#1 | VH3\|3-23/D6\|6-19\|RF2/JH4 | SISGS---GGGTYYAASVKG | 1277 |
| MA_98-G12_CC_x_I2C0_x_scFc_(Q4Z)_translation Fv#1 | VH3\|3-23/D6\|6-19\|RF2/JH4 | AISGS---GGGTYNAASVKG | 1278 |
| VH3\|3-73/D3\|3-3 RF3/JH4 | | RIRSKA-NSYATAYAASVKG | 1279 |
| MA_03-C7_AS_CC_x_I2C0_x_scFc_(G2H)_translation Fv#2 | VH3\|3-73/D3\|3-3\|RF3/JH4 | RIRSKY-NNYATYYADSVKD | 1280 |
| MA_03-D8_AS_CC_x_I2C0_x_scFc_(L7E)_translation Fv#2 | VH3\|3-73/D3\|3-3\|RF3/JH4 | RIRSKY-NNYATYYADSVKD | 1281 |
| MA_03-D8_CC_x_I2C0_x_scFc_(H6N)_translation Fv#2 | VH3\|3-73/D3\|3-3\|RF3/JH4 | RIRSKY-NNYATYYADSVKD | 1282 |
| MA_03-D12_AS_CC_x_I2C0_x_scFc_(L6A)_translation Fv#2 | VH3\|3-73/D3\|3-3\|RF3/JH4 | RIRSKY-NNYATYYADSVKD | 1283 |
| MA_03-E7_AS_CC_x_I2C0_x_scFc_(L6M)_translation Fv#2 | VH3\|3-73/D3\|3-3\|RF3/JH4 | RIRSKY-NNYATYYADSVKD | 1284 |
| MA_03-E11_AS_CC_x_I2C0_x_scFc_(G2B)_translation Fv#2 | VH3\|3-73/D3\|3-3\|RF3/JH4 | RIRSKY-NNYATYYADSVKD | 1285 |
| MA_03-G10_AS_CC_x_I2C0_x_scFc_(N3H)_translation Fv#2 | VH3\|3-73/D3\|3-3\|RF3/JH4 | RIRSKY-NNYATYYADSVKD | 1286 |
| MA_03-G11_AS_CC_x_I2C0_x_scFc_(O4R)_translation Fv#2 | VH3\|3-73/D3\|3-3\|RF3/JH4 | RIRSKY-NNYATYYADSVKD | 1287 |
| MA_03-H12_AS_CC_x_I2C0_x_scFc_(K5A)_translation Fv#2 | VH3\|3-73/D3\|3-3\|RF3/JH4 | RIRSKY-NNYATYYADSVKD | 1288 |
| MA_09-C7_CC_x_I2C0_x_scFc_(K9T)_translation Fv#2 | VH3\|3-73/D3\|3-3\|RF3/JH4 | RIRSKY-NNYATYYADSVKD | 1289 |
| MA_09-E2_CC_x_I2C0_x_scFc_(V8T)_translation Fv#2 | VH3\|3-73/D3\|3-3\|RF3/JH4 | RIRSKY-NNYATYYADSVKD | 1290 |
| MA_09-F11_CC_x_I2C0_x_scFc_(L6Q)_translation Fv#2 | VH3\|3-73/D3\|3-3\|RF3/JH4 | RIRSKY-NNYATYYADSVKD | 1291 |
| MA_09-F12_CC_x_I2C0_x_scFc_(D1U)_translation Fv#2 | VH3\|3-73/D3\|3-3\|RF3/JH4 | RIRSKY-NNYATYYADSVKD | 1292 |
| MA_09-G8_CC_x_I2C0_x_scFc_(I6K)_translation Fv#2 | VH3\|3-73/D3\|3-3\|RF3/JH4 | RIRSKY-NNYATYYADSVKD | 1293 |
| MA_09-G10_CC_x_I2C0_x_scFc_(C4K)_translation Fv#2 | VH3\|3-73/D3\|3-3\|RF3/JH4 | RIRSKY-NNYATYYADSVKD | 1294 |
| MA_09-G11_CC_x_I2C0_x_scFc_(Y9Q)_translation Fv#2 | VH3\|3-73/D3\|3-3\|RF3/JH4 | RIRSKY-NNYATYYADSVKD | 1295 |
| MA_09-H7_CC_x_I2C0_x_scFc_(T3S)_translation Fv#2 | VH3\|3-73/D3\|3-3\|RF3/JH4 | RIRSKY-NNYATYYADSVKD | 1296 |
| MA_09-H10_CC_x_I2C0_x_scFc_(B6N)_translation Fv#2 | VH3\|3-73/D3\|3-3\|RF3/JH4 | RIRSKY-NNYATYYADSVKD | 1297 |
| MA_09-H11_CC_x_I2C0_x_scFc_(I8L)_translation Fv#2 | VH3\|3-73/D3\|3-3\|RF3/JH4 | RIRSKY-NNYATYYADSVKD | 1298 |
| MA_10-B5_CC_x_I2C0_x_scFc_(H6H)_translation Fv#2 | VH3\|3-73/D3\|3-3\|RF3/JH4 | RIRSKY-NNYATYYADSVKD | 1299 |
| MA_10-B6_CC_x_I2C0_x_scFc_(I3O)_translation Fv#2 | VH3\|3-73/D3\|3-3\|RF3/JH4 | RIRSKY-NNYATYYADSVKD | 1300 |
| MA_10-D3_CC_x_I2C0_x_scFc_(O6B)_translation Fv#2 | VH3\|3-73/D3\|3-3\|RF3/JH4 | RIRSKY-NNYATYYADSVKD | 1301 |
| MA_10-D6_CC_x_I2C0_x_scFc_(V6Z)_translation Fv#2 | VH3\|3-73/D3\|3-3\|RF3/JH4 | RIRSKY-NNYATYYADSVKD | 1302 |
| MA_10-G2_CC_x_I2C0_x_scFc_(T1S)_translation Fv#2 | VH3\|3-73/D3\|3-3\|RF3/JH4 | RIRSKY-NNYATYYADSVKD | 1303 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_10-G5_CC_x_I2C0_x_scFc_(S9O)_translation Fv#2 | VH3\|3-73/D3\|3-3\|RF3/JH4 | RIRSKY-NNYATYYADSVKD | 1304 |
| MA_10-G10_AS_CC_x_I2C0_x_scFc_(T1I)_translation Fv#2 | VH3\|3-73/D3\|3-3\|RF3/JH4 | RIRSKY-NNYATYYADSVKD | 1305 |
| MA_10-G10_CC_x_I2C0_x_scFc_(B3A)_translation Fv#2 | VH3\|3-73/D3\|3-3\|RF3/JH4 | RIRSKY-NNYATYYADSVKD | 1306 |
| MA_10-H1_CC_x_I2C0_x_scFc_(T9K)_translation Fv#2 | VH3\|3-73/D3\|3-3\|RF3/JH4 | RIRSKY-NNYATYYADSVKD | 1307 |
| MA_10-H3_CC_x_I2C0_x_scFc_(M9L)_translation Fv#2 | VH3\|3-73/D3\|3-3\|RF3/JH4 | RIRSKY-NNYATYYADSVKD | 1308 |
| MA_81-B9_CC_x_I2C0_x_scFc_(U4L)_translation Fv#2 | VH3\|3-73/D3\|3-3\|RF3/JH4 | RIRSKY-NNYATYYADSVKD | 1309 |
| MA_86-A4_CC_x_I2C0_x_scFc_(K2W)_translation Fv#2 | VH3\|3-73/D3\|3-3\|RF3/JH4 | RIRSKY-NNYATYYADSVKD | 1310 |
| MA_86-A4-N-F5_CC_x_I2C0_x_scFc_(M4H)_translation Fv#2 | VH3\|3-73/D3\|3-3\|RF3/JH4 | RIRSKY-NNYATYYADSVKD | 1311 |
| MA_88-B3-F9_CC_x_I2C0_x_scFc_(Y4E)_translation Fv#2 | VH3\|3-73/D3\|3-3\|RF3/JH4 | RIRSKY-NNYATYYADSVKD | 1312 |
| MA_98-C7_CC_x_I2C0_x_scFc_(Y8P)_translation Fv#2 | VH3\|3-73/D3\|3-3\|RF3/JH4 | RIRSKY-NNYATYYADSVKD | 1313 |
| MA_98-G12_AS_CC_x_I2C0_x_scFc_(Q4Z)_translation Fv#2 | VH3\|3-73/D3\|3-3\|RF3/JH4 | RIRSKY-NNYATYYADSVKD | 1314 |
| MA_SG-F28_CC_x_I2C0_x_scFc_(D9R)_translation Fv#2 | VH3\|3-73/D3\|3-3\|RF3/JH4 | RIRSKY-NNYATYYADSVKD | 1315 |
| VH2\|2-70/D2\|2-15\|RF1/JH5 | | RIDW----DDDKFYSTSLKT | 1316 |
| MA_09-C7_CC_x_I2C0_x_scFc_(K9T)_translation Fv#1 | VH2\|2-70/D2\|2-15\|RF1/JH5 | EIHS----EDDKRYSPSLQS | 1317 |
| VH3\|3-15/D3\|3-10\|RF2/JH6 | | RIKSKT-DGGTTDYAAPVKG | 1318 |
| MA_09-E2_CC_x_I2C0_x_scFc_(V8T)_translation Fv#1 | VH3\|3-15/D3\|3-10\|RF2/JH6 | RIKSKT-YGGTTDYAAPVKG | 1319 |
| MA_10-B5_CC_x_I2C0_x_scFc_(H6H)_translation Fv#1 | VH3\|3-15/D3\|3-10\|RF2/JH6 | RIRSRS-YGGTTDYAAPVKG | 1320 |
| MA_10-B6_CC_x_I2C0_x_scFc_(I3O)_translation Fv#1 | VH3\|3-15/D3\|3-10\|RF2/JH6 | RIKSKT-YGGTTDYAAPVKG | 1321 |
| MA_10-D3_CC_x_I2C0_x_scFc_(O6B)_translation Fv#1 | VH3\|3-15/D3\|3-10\|RF2/JH6 | RITSSR-YGGTTDYAAPVKG | 1322 |
| MA_10-D6_CC_x_I2C0_x_scFc_(V6Z)_translation Fv#1 | VH3\|3-15/D3\|3-10\|RF2/JH6 | RILNNA-YGGTTDYAAPVKG | 1323 |
| MA_10-G2_CC_x_I2C0_x_scFc_(T1S)_translation Fv#1 | VH3\|3-15/D3\|3-10\|RF2/JH6 | RILSMH-YGGTTDYAAPVKG | 1324 |
| MA_10-G5_CC_x_I2C0_x_scFc_(S9O)_translation Fv#1 | VH3\|3-15/D3\|3-10\|RF2/JH6 | RIVSST-YGGTTDYAAPVKG | 1325 |
| MA_10-H1_CC_x_I2C0_x_scFc_(T9K)_translation Fv#1 | VH3\|3-15/D3\|3-10\|RF2/JH6 | RITSGI-YGGTTDYAAPVKG | 1326 |
| MA_10-H3_CC_x_I2C0_x_scFc_(M9L)_translation Fv#1 | VH3\|3-15/D3\|3-10\|RF2/JH6 | RIRSRP-YGGTTDYAAPVKG | 1327 |
| VH2\|2-05/D2\|2-15\|RF1/JH5 | | LIYW----NDDKRYSPSLKS | 1328 |
| MA_09-F11_CC_x_I2C0_x_scFc_(L6Q)_translation Fv#1 | VH2\|2-05/D2\|2-15\|RF1/JH5 | LIYW----NDDKRYSPSLQS | 1329 |
| MA_09-F12_CC_x_I2C0_x_scFc_(D1U)_translation Fv#1 | VH2\|2-05/D2\|2-15\|RF1/JH5 | LIYW----NDDKRYSPSLQS | 1330 |
| MA_09-G8_CC_x_I2C0_x_scFc_(I6K)_translation Fv#1 | VH2\|2-05/D2\|2-15\|RF1/JH5 | LIYW----NDDKRYSPSLQS | 1331 |
| MA_09-G10_CC_x_I2C0_x_scFc_(C4K)_translation Fv#1 | VH2\|2-05/D2\|2-15\|RF1/JH5 | GIHI----YDDKRYSPSLQS | 1332 |
| MA_09-G11_CC_x_I2C0_x_scFc_(Y9Q)_translation Fv#1 | VH2\|2-05/D2\|2-15\|RF1/JH5 | LIYW----NDDKRYSPSLQS | 1333 |
| MA_09-H7_CC_x_I2C0_x_scFc_(T3S)_translation Fv#1 | VH2\|2-05/D2\|2-15\|RF1/JH5 | LIYW----NDDKRYSPSLQS | 1334 |
| MA_09-H10_CC_x_I2C0_x_scFc_(B6N)_translation Fv#1 | VH2\|2-05/D2\|2-15\|RF1/JH5 | LIYW----NDDKRYSPSLQS | 1335 |
| MA_09-H11_CC_x_I2C0_x_scFc_(I8L)_translation Fv#1 | VH2\|2-05/D2\|2-15\|RF1/JH5 | LIYW----NDDKRYSPSLQS | 1336 |
| VH4\|4-59/D3\|3-3\|RF3/JH4 | | YIYY----SGSTNYNPSLKS | 1337 |
| MA_81-B9_CC_x_I2C0_x_scFc_(U4L)_translation | VH4\|4-59/D3\|3-3\|RF3/JH4 | SIYY----SGSTYYNPSLKS | 1338 |
| VH3\|3-30._3/D1\|1-1\|RF2/JH4 | | VISYD---GSNKYYADSVKG | 1339 |
| MA_86-A4_CC_x_I2C0_x_scFc_(K2W)_translation Fv#1 | VH3\|3-30.3/D1\|1-1\|RF2/JH4 | VISYD---ASNKYYAESVKG | 1340 |
| MA_86-A4-N-F5_CC_x_I2C0_x_scFc_(M4H)_translation Fv#1 | VH3\|3-30.3/D1\|1-1\|RF2/JH4 | VISYD---AETVKYAESVKG | 1341 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| VH3\|3-11/D1\|1-1\|RF3/JH4 | | YISSS---GSTIYYADSVKG | 1342 |
| MA_88-B3-F9_CC_x_I2C0_x_scFc_(Y4E)_translation Fv#1 | VH3\|3-11/D1\|1-1\|RF3/JH4 | YISKS---SYTVTYADAVKG | 1343 |
| VH4\|4-30._1/D3\|3-10\|RF3/_JH6 | | YIYY----SGSTYYNPSLKS | 1344 |
| MA_SG-F28_CC_x_I2C0_x_scFc_(D9R)_translation Fv#1 | VH4\|4-30.1/D3\|3-10\|RF3/JH6 | YISY----SGITNYNPSLKS | 1345 |
| | | K_FR3 | |
| VK1\|O12/JK1 | | GVPSRFSGSGSG--TDFTLTIS SLQPEDFATYYC | 1346 |
| MA_09-C7_CC_x_I2C0_x_scFc_(K9T)_translation Fv#1 | VK1\|O12/JK1 | GVPSRFSGSGSG--TDFTLTIS SLQPEDFATYYC | 1347 |
| MA_09-E2_CC_x_I2C0_x_scFc_(V8T)_translation Fv#1 | VK1\|O12/JK1 | GVPSRFSGSGSG--TDFTLTIS SLQPEDFATYYC | 1348 |
| MA_09-F11_CC_x_I2C0_x_scFc_(L6Q)_translation Fv#1 | VK1\|O12/JK1 | GVPSRFSGSGSG--TDFTLTIS SLQPEDFATYYC | 1349 |
| MA_09-F12_CC_x_I2C0_x_scFc_(D1U)_translation Fv#1 | VK1\|O12/JK1 | GVPSRFSGRGSG--TDFTLTIS SLQPEDFATYYC | 1350 |
| MA_09-G8_CC_x_I2C0_x_scFc_(I6K)_translation Fv#1 | VK1\|O12/JK1 | GVPSRFSGSGSG--TDFTLTIS SLQPEDFATYYC | 1351 |
| MA_09-G10_CC_x_I2C0_x_scFc_(C4K)_translation Fv#1 | VK1\|O12/JK1 | GVPSRFSGSGSG--TDFTLTIS SLQPEDFATYYC | 1352 |
| MA_09-G11_CC_x_I2C0_x_scFc_(Y9Q)_translation Fv#1 | VK1\|O12/JK1 | GVPSRFSGRGSG--TDFTLTIS SLQPEDFATYYC | 1353 |
| MA_09-H7_CC_x_I2C0_x_scFc_(T3S)_translation Fv#1 | VK1\|O12/JK1 | GVPSRFSGSGSG--TDFTLTIS SLQPEDFATYYC | 1354 |
| MA_09-H10_CC_x_I2C0_x_scFc_(B6N)_translation Fv#1 | VK1\|O12/JK1 | GVPSRESGRGSG--TDFTLTIS SLQPEDFATYYC | 1355 |
| MA_09-H11_CC_x_I2C0_x_scFc_(I8L)_translation Fv#1 | VK1\|O12/JK1 | GVPSRFSGSGSG--TDFTLTIS SLQPEDFATYYC | 1356 |
| MA_10-B5_CC_x_I2C0_x_scFc_(H6H)_translation Fv#1 | VK1\|O12/JK1 | GVPSRFSGSGSG--TDFTLTIS SLQPEDFATYYC | 1357 |
| VK1\|O12/JK2 | | GVPSRFSGSGSG--TDFTLTIS SLQPEDFATYYC | 1358 |
| MA_10-B6_CC_x_I2C0_x_scFc_(I3O)_translation Fv#1 | VK1\|O12/JK2 | GVPSRFSGSGSG--TDFTLTIS SLQPEDFATYYC | 1359 |
| MA_10-H3_CC_x_I2C0_x_scFc_(M9L)_translation Fv#1 | VK1\|O12/JK2 | GVPSRFSGSGSG--TDFTLTIS SLQPEDFATYYC | 1360 |
| VK1\|O12/JK3 | | GVPSRFSGSGSG--TDFTLTIS SLQPEDFATYYC | 1361 |
| MA_10-D3_CC_x_I2C0_x_scFc_(O6B)_translation Fv#1 | VK1\|O12/JK3 | GVPSRFSGSGSG--TDFTLTIS SLQPEDFATYYC | 1362 |
| MA_10-D6_CC_x_I2C0_x_scFc_(V6Z)_translation Fv#1 | VK1\|O12/JK3 | GVPSRFSGSGSG--TDFTLTIS SLQPEDFATYYC | 1363 |
| MA_10-G2_CC_x_I2C0_x_scFc_(T1S)_translation Fv#1 | VK1\|O12/JK3 | GVPSRFSGSGSG--TDFTLTIS SLQPEDFATYYC | 1364 |
| MA_10-G5_CC_x_I2C0_x_scFc_(S9O)_translation Fv#1 | VK1\|O12/JK3 | GVPSRFSGSGSG--TDFTLTIS SLQPEDFATYYC | 1365 |
| MA_10-H1_CC_x_I2C0_x_scFc_(T9K)_translation Fv#1 | VK1\|O12/JK3 | GVPSRFSGSGSG--TDFTLTIS SLQPEDFATYYC | 1366 |
| VK4\|B3/JK5 | | GVPDRFSGSGSG--TDFTLTIS SLQAEDVAVYYC | 1367 |
| MA_81-B9_CC_x_I2C0_x_scFc_(U4L)_translation Fv#1 | VK4\|B3/JK5 | GVPDRESGSGSG--TDFTLTIS SLQAEDVAVYYC | 1368 |
| VK1\|A20/JK1 | | GVPSRFSGSGSG--TDFTLTIS SLQPEDVATYYC | 1369 |
| MA_86-A4_CC_x_I2C0_x_scFc_(K2W)_translation Fv#1 | VK1\|A20/JK1 | GVPSRFSGSGSG--TDFTLTIS SLQPEDVATYYC | 1370 |
| MA_86-A4-N-F5_CC_x_I2C0_x_scFc_(M4H)_translation Fv#1 | VK1\|A20/JK1 | GVPSRFSGSGSG--TDFTLTIS SLQPEDVATYYC | 1371 |
| VK2\|O1/JK1 | | GVPDRESGSGSG--TDFTLKIS RVEAEDVGVYYC | 1372 |
| MA_SG-F28_CC_x_I2C0_x_scFc_(D9R)_translation Fv#1 | VK2\|O1/JK1 | GVPDRESGSGSG--TDFTLKIS RVEAGDVGVYYC | 1373 |

TABLE 28-continued

BiTE-scFc Variable Region #1 (MAGEB2) Protein Alignment
CDRs defined by Kabat
Alignment numbering defined by Amgen Reference (AHo)

| | Germline | K_CDR3 | SEQ ID NO: |
|---|---|---|---|
| VK1\|O12/JK1 | | QQSYS--------------------TPWT | 1508 |
| MA_09-C7_CC_x_I2C0_x_scFc_(K9T)_translation Fv#1 | VK1\|O12/JK1 | QQSYI--------------------TPFT | 1509 |
| MA_09-E2_CC_x_I2C0_x_scFc_(V8T)_translation Fv#1 | VK1\|O12/JK1 | QQSYS--------------------SPFT | 1510 |
| MA_09-F11_CC_x_I2C0_x_scFc_(L6Q)_translation Fv#1 | VK1\|O12/JK1 | QQSYM--------------------WPTI | 1511 |
| MA_09-F12_CC_x_I2C0_x_scFc_(D1U)_translation Fv#1 | VK1\|O12/JK1 | QQSYY--------------------YPTI | 1512 |
| MA_09-G8_CC_x_I2C0_x_scFc_(I6K)_translation Fv#1 | VK1\|O12/JK1 | QQSYT--------------------LHPL | 1513 |
| MA_09-G10_CC_x_I2C0_x_scFc_(C4K)_translation Fv#1 | VK1\|O12/JK1 | QQSYI--------------------TPFT | 1514 |
| MA_09-G11_CC_x_I2C0_x_scFc_(Y9Q)_translation Fv#1 | VK1\|O12/JK1 | QQSYQ--------------------SPTT | 1515 |
| MA_09-H7_CC_x_I2C0_x_scFc_(T3S)_translation Fv#1 | VK1\|O12/JK1 | QQSYF--------------------PVVE | 1516 |
| MA_09-H10_CC_x_I2C0_x_scFc_(B6N)_translation Fv#1 | VK1\|O12/JK1 | QQSYT--------------------PPTT | 1517 |
| MA_09-H11_CC_x_I2C0_x_scFc_(I8L)_translation Fv#1 | VK1\|O12/JK1 | QQSYS--------------------YPNS | 1518 |
| MA_10-B5_CC_x_I2C0_x_scFc_(H6H)_translation Fv#1 | VK1\|O12/JK1 | QQTYS--------------------MPFT | 1519 |
| VK1\|O12/JK2 | | QQSYS--------------------TPYT | 1520 |
| MA_10-B6_CC_x_I2C0_x_scFc_(I3O)_translation Fv#1 | VK1\|O12/JK2 | IQAYT--------------------SPFT | 1521 |
| MA_10-H3_CC_x_I2C0_x_scFc_(M9L)_translation Fv#1 | VK1\|O12/JK2 | QQTYS--------------------SPFT | 1522 |
| VK1\|O12/JK3 | | QQSYS--------------------TPFT | 1523 |
| MA_10-D3_CC_x_I2C0_x_scFc_(O6B)_translation Fv#1 | VK1\|O12/JK3 | QQTYS--------------------MPFT | 1524 |
| MA_10-D6_CC_x_I2C0_x_scFc_(V6Z)_translation Fv#1 | VK1\|O12/JK3 | QQTYS--------------------MPFT | 1525 |
| MA_10-G2_CC_x_I2C0_x_scFc_(T1S)_translation Fv#1 | VK1\|O12/JK3 | QQTYS--------------------MPFT | 1526 |
| MA_10-G5_CC_x_I2C0_x_scFc_(S9O)_translation Fv#1 | VK1\|O12/JK3 | QQTYS--------------------MPFT | 1527 |
| MA_10-H1_CC_x_I2C0_x_scFc_(T9K)_translation Fv#1 | VK1\|O12/JK3 | QQTYS--------------------MPFT | 1528 |
| VK4\|B3/JK5 | | QQYYS--------------------TPIT | 1529 |
| MA_81-B9_CC_x_I2C0_x_scFc_(U4L)_translation Fv#1 | VK4\|B3/JK5 | QQFYS--------------------TPIT | 1530 |
| VK1\|A20/JK1 | | QKYNS--------------------APWT | 1531 |
| MA_86-A4_CC_x_I2C0_x_scFc_(K2W)_translation Fv#1 | VK1\|A20/JK1 | QKYNS--------------------APFT | 1532 |
| MA_86-A4-N-F5_CC_x_I2C0_x_scFc_(M4H)_translation Fv#1 | VK1\|A20/JK1 | QKYNS--------------------APFT | 1533 |
| VK2\|O1/JK1 | | MQRIE--------------------FPWT | 1534 |
| MA_SG-F28_CC_x_I2C0_x_scFc_(D9R)_translation Fv#1 | VK2\|O1/JK1 | MQALQ--------------------TPWT | 1535 |
| | | K_FR4 | |
| VK1\|O12/JK1 | | FGQGTKVEIK | 1670 |
| MA_09-C7_CC_x_I2C0_x_scFc_(K9T)_translation Fv#1 | VK1\|O12/JK1 | FGCGTKVEIK | 1671 |
| MA_09-E2_CC_x_I2C0_x_scFc_(V8T)_translation Fv#1 | VK1\|O12/JK1 | FGCGTKVEIK | 1672 |
| MA_09-F11_CC_x_I2C0_x_scFc_(L6Q)_translation Fv#1 | VK1\|O12/JK1 | FGCGTKVEIK | 1673 |
| MA_09-F12_CC_x_I2C0_x_scFc_(D1U)_translation Fv#1 | VK1\|O12/JK1 | FGCGTKVEIK | 1674 |
| MA_09-G8_CC_x_I2C0_x_scFc_(I6K)_translation Fv#1 | VK1\|O12/JK1 | FGCGTKVEIK | 1675 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_09-G10_CC_x_I2C0_x_scFc_(C4K)_translation Fv#1 | VK1\|O12/JK1 | FGCGTKVEIK | 1676 |
| MA_09-G11_CC_x_I2C0_x_scFc_(Y9Q)_translation Fv#1 | VK1\|O12/JK1 | FGCGTKVEIK | 1677 |
| MA_09-H7_CC_x_I2C0_x_scFc_(T3S)_translation Fv#1 | VK1\|O12/JK1 | FGCGTKVEIK | 1678 |
| MA_09-H10_CC_x_I2C0_x_scFc_(B6N)_translation Fv#1 | VK1\|O12/JK1 | FGCGTKVEIK | 1679 |
| MA_09-H11_CC_x_I2C0_x_scFc_(I8L)_translation Fv#1 | VK1\|O12/JK1 | FGCGTKVEIK | 1680 |
| MA_10-B5_CC_x_I2C0_x_scFc_(H6H)_translation Fv#1 | VK1\|O12/JK1 | FGCGTKVEIK | 1681 |
| VK1\|O12/JK2 | | FGQGTKLEIK | 1682 |
| MA_10-B6_CC_x_I2C0_x_scFc_(I3O)_translation Fv#1 | VK1\|O12/JK2 | FGCGTKLEIK | 1683 |
| MA_10-H3_CC_x_I2C0_x_scFc_(M9L)_translation Fv#1 | VK1\|O12/JK2 | FGCGTKLEIK | 1684 |
| VK1\|O12/JK3 | | FGPGTKVDIK | 1685 |
| MA_10-D3_CC_x_I2C0_x_scFc_(O6B)_translation Fv#1 | VK1\|O12/JK3 | FGCGTKVDIK | 1686 |
| MA_10-D6_CC_x_I2C0_x_scFc_(V6Z)_translation Fv#1 | VK1\|O12/JK3 | FGCGTKVDIK | 1687 |
| MA_10-G2_CC_x_I2C0_x_scFc_(T1S)_translation Fv#1 | VK1\|O12/JK3 | FGCGTKVDIK | 1688 |
| MA_10-G5_CC_x_I2C0_x_scFc_(S9O)_translation Fv#1 | VK1\|O12/JK3 | FGCGTKVDIK | 1689 |
| MA_10-H1_CC_x_I2C0_x_scFc_(T9K)_translation Fv#1 | VK1\|O12/JK3 | FGCGTKVDIK | 1690 |
| VK4\|B3/JK5 | | FGQGTRLEIK | 1691 |
| MA_81-B9_CC_x_I2C0_x_scFc_(U4L)_translation Fv#1 | VK4\|B3/JK5 | FGCGTRLEIK | 1692 |
| VK1\|A20/JK1 | | FGQGTKVEIK | 1693 |
| MA_86-A4_CC_x_I2C0_x_scFc_(K2W)_translation Fv#1 | VK1\|A20/JK1 | FGCGTKVEIK | 1694 |
| MA_86-A4-N-F5_CC_x_I2C0_x_scFc_(M4H)_translation Fv#1 | VK1\|A20/JK1 | FGCGTKVEIK | 1695 |
| VK2\|O1/JK1 | | FGQGTKVEIK | 1696 |
| MA_SG-F28_CC_x_I2C0_x_scFc_(D9R)_translation Fv#1 | VK2\|O1/JK1 | FGCGTKVEIK | 1697 |
| | | L_FR3 | |
| VL3\|3h/JL2 | | GIPERFSGSNSG--NTATLTI SRVEAGDEADYYC | 1374 |
| MA_03-C7_AS_CC_x_I2C0_x_scFc_(G2H)_translation Fv#1 | VL3\|3h/JL2 | GIPERFSGSNSG--NTATLTI SRVEAGDEADYYC | 1375 |
| MA_03-D12_AS_CC_x_I2C0_x_scFc_(L6A)_translation Fv#1 | VL3\|3h/JL2 | GIPERFSGSNSG--NTATLTI SRVEAGDEADYYC | 1376 |
| MA_03-E11_AS_CC_x_I2C0_x_scFc_(G2B)_translation Fv#1 | VL3\|3h/JL2 | GIPERFSGSNSG--NTATLTI SRVEAGDEADYYC | 1377 |
| MA_03-G10_AS_CC_x_I2C0_x_scFc_(N3H)_translation Fv#1 | VL3\|3h/JL2 | GIPERFSGSNSG--NTATLTI SRVEAGDEADYYC | 1378 |
| MA_03-G11_AS_CC_x_I2C0_x_scFc_(O4R)_translation Fv#1 | VL3\|3h/JL2 | GIPERFSGSNSG--NTATLTI SRVEAGDEADYYC | 1379 |
| MA_10-G10_AS_CC_x_I2C0_x_scFc_(T1I)_translation Fv#1 | VL3\|3h/JL2 | GIPERFSGSNSG--NTATLTI SRVEAGDEADYYC | 1380 |
| MA_10-G10_CC_x_I2C0_x_scFc_(B3A)_translation Fv#1 | VL3\|3h/JL2 | GIPERFSGSNSG--NTATLTI SRVEAGDEADYYC | 1381 |
| MA_88-B3-F9_CC_x_I2C0_x_scFc_(Y4E)_translation Fv#1 | VL3\|3h/JL2 | GIPERFSGSNSG--NTATLTI SRVEAGDEADYYC | 1382 |
| MA_98-C7_CC_x_I2C0_x_scFc_(Y8P)_translation Fv#1 | VL3\|3h/JL2 | GIPERFSGSNSG--NTATLTI SRVEAGDEADYYC | 1383 |
| MA_98-G12_AS_CC_x_I2C0_x_scFc_(Q4Z)_translation Fv#1 | VL3\|3h/JL2 | GIPERFSGSNSG--NTATLTI SRVEAGDEADYYC | 1384 |
| VL7\|7a/JL3b | | WTPARFSGSLLG--GKAALTL SGVQPEDEAEYYC | 1385 |
| MA_03-C7_AS_CC_x_I2C0_x_scFc_(G2H)_translation Fv#2 | VL7\|7a/JL3b | GTPARFSGSLLG--GKAALTL SGVQPEDEAEYYC | 1386 |
| MA_03-D8_AS_CC_x_I2C0_x_scFc_(L7E)_translation Fv#2 | VL7\|7a/JL3b | GTPARFSGSLLG--GKAALTL SGVQPEDEAEYYC | 1387 |
| MA_03-D8_CC_x_I2C0_x_scFc_(H6N)_translation Fv#2 | VL7\|7a/JL3b | GTPARFSGSLLG--GKAALTL SGVQPEDEAEYYC | 1388 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_03-D12_AS_CC_x_I2C0_x_scFc_(L6A)_translation Fv#2 | VL7\|7a/JL3b | GTPARFSGSLLG--GKAALTL SGVQPEDEAEYYC | 1389 |
| MA_03-E7_AS_CC_x_I2C0_x_scFc_(L6M)_translation Fv#2 | VL7\|7a/JL3b | GTPARFSGSLLG--GKAALTL SGVQPEDEAEYYC | 1390 |
| MA_03-E11_AS_CC_x_I2C0_x_scFc_(G2B)_translation Fv#2 | VL7\|7a/JL3b | GTPARFSGSLLG--GKAALTL SGVQPEDEAEYYC | 1391 |
| MA_03-G10_AS_CC_x_I2C0_x_scFc_(N3H)_translation Fv#2 | VL7\|7a/JL3b | GTPARFSGSLLG--GKAALTL SGVQPEDEAEYYC | 1392 |
| MA_03-G11_AS_CC_x_I2C0_x_scFc_(O4R)_translation Fv#2 | VL7\|7a/JL3b | GTPARFSGSLLG--GKAALTL SGVQPEDEAEYYC | 1393 |
| MA_03-H12_AS_CC_x_I2C0_x_scFc_(K5A)_translation Fv#2 | VL7\|7a/JL3b | GTPARFSGSLLG--GKAALTL SGVQPEDEAEYYC | 1394 |
| MA_03-C7_CC_x_I2C0_x_scFc_(K9T)_translation Fv#2 | VL7\|7a/JL3b | GTPARFSGSLLG--GKAALTL SGVQPEDEAEYYC | 1395 |
| MA_09-E2_CC_x_I2C0_x_scFc_(V8T)_translation Fv#2 | VL7\|7a/JL3b | GTPARFSGSLLG--GKAALTL SGVQPEDEAEYYC | 1396 |
| MA_09-F11_CC_x_I2C0_x_scFc_(L6Q)_translation Fv#2 | VL7\|7a/JL3b | GTPARFSGSLLG--GKAALTL SGVQPEDEAEYYC | 1397 |
| MA_09-F12_CC_x_I2C0_x_scFc_(D1U)_translation Fv#2 | VL7\|7a/JL3b | GTPARFSGSLLG--GKAALTL SGVQPEDEAEYYC | 1398 |
| MA_09-G8_CC_x_I2C0_x_scFc_(I6K)_translation Fv#2 | VL7\|7a/JL3b | GTPARFSGSLLG--GKAALTL SGVQPEDEAEYYC | 1399 |
| MA_09-G10_CC_x_I2C0_x_scFc_(C4K)_translation Fv#2 | VL7\|7a/JL3b | GTPARFSGSLLG--GKAALTL SGVQPEDEAEYYC | 1400 |
| MA_09-G11_CC_x_I2C0_x_scFc_(Y9Q)_translation Fv#2 | VL7\|7a/JL3b | GTPARFSGSLLG--GKAALTL SGVQPEDEAEYYC | 1401 |
| MA_09-H7_CC_x_I2C0_x_scFc_(T3S)_translation Fv#2 | VL7\|7a/JL3b | GTPARFSGSLLG--GKAALTL SGVQPEDEAEYYC | 1402 |
| MA_09-H10_CC_x_I2C0_x_scFc_(B6N)_translation Fv#2 | VL7\|7a/JL3b | GTPARFSGSLLG--GKAALTL SGVQPEDEAEYYC | 1403 |
| MA_09-H11_CC_x_I2C0_x_scFc_(I8L)_translation Fv#2 | VL7\|7a/JL3b | GTPARFSGSLLG--GKAALTL SGVQPEDEAEYYC | 1404 |
| MA_10-B5_CC_x_I2C0_x_scFc_(H6H)_translation Fv#2 | VL7\|7a/JL3b | GTPARFSGSLLG--GKAALTL SGVQPEDEAEYYC | 1405 |
| MA_10-B6_CC_x_I2C0_x_scFc_(I3O)_translation Fv#2 | VL7\|7a/JL3b | GTPARFSGSLLG--GKAALTL SGVQPEDEAEYYC | 1406 |
| MA_10-D3_CC_x_I2C0_x_scFc_(O6B)_translation Fv#2 | VL7\|7a/JL3b | GTPARFSGSLLG--GKAALTL SGVQPEDEAEYYC | 1407 |
| MA_10-D6_CC_x_I2C0_x_scFc_(V6Z)_translation Fv#2 | VL7\|7a/JL3b | GTPARFSGSLLG--GKAALTL SGVQPEDEAEYYC | 1408 |
| MA_10-G2_CC_x_I2C0_x_scFc_(T1S)_translation Fv#2 | VL7\|7a/JL3b | GTPARFSGSLLG--GKAALTL SGVQPEDEAEYYC | 1409 |
| MA_10-G5_CC_x_I2C0_x_scFc_(S9O)_translation Fv#2 | VL7\|7a/JL3b | GTPARFSGSLLG--GKAALTL SGVQPEDEAEYYC | 1410 |
| MA_10-G10_AS_CC_x_I2C0_x_scFc_(T1I)_translation Fv#2 | VL7\|7a/JL3b | GTPARFSGSLLG--GKAALTL SGVQPEDEAEYYC | 1411 |
| MA_10-G10_CC_x_I2C0_x_scFc_(B3A)_translation Fv#2 | VL7\|7a/JL3b | GTPARFSGSLLG--GKAALTL SGVQPEDEAEYYC | 1412 |
| MA_10-H1_CC_x_I2C0_x_scFc_(T9K)_translation Fv#2 | VL7\|7a/JL3b | GTPARFSGSLLG--GKAALTL SGVQPEDEAEYYC | 1413 |
| MA_10-H3_CC_x_I2C0_x_scFc_(M9L)_translation Fv#2 | VL7\|7a/JL3b | GTPARFSGSLLG--GKAALTL SGVQPEDEAEYYC | 1414 |
| MA_81-B9_CC_x_I2C0_x_scFc_(U4L)_translation Fv#2 | VL7\|7a/JL3b | GTPARFSGSLLG--GKAALTL SGVQPEDEAEYYC | 1415 |
| MA_86-A4_CC_x_I2C0_x_scFc_(K2W)_translation Fv#2 | VL7\|7a/JL3b | GTPARFSGSLLG--GKAALTL SGVQPEDEAEYYC | 1416 |
| MA_86-A4-N-F5_CC_x_I2C0_x_scFc_(M4H)_translation Fv#2 | VL7\|7a/JL3b | GTPARFSGSLLG--GKAALTL SGVQPEDEAEYYC | 1417 |
| MA_88-B3-F9_CC_x_I2C0_x_scFc_(Y4E)_translation Fv#2 | VL7\|7a/JL3b | GTPARFSGSLLG--GKAALTL SGVQPEDEAEYYC | 1418 |
| MA_98-C7_CC_x_I2C0_x_scFc_(Y8P)_translation Fv#2 | VL7\|7a/JL3b | GTPARFSGSLLG--GKAALTL SGVQPEDEAEYYC | 1419 |
| MA_98-G12_AS_CC_x_I2C0_x_scFc_(Q4Z)_translation Fv#2 | VL7\|7a/JL3b | GTPARFSGSLLG--GKAALTL SGVQPEDEAEYYC | 1420 |
| MA_SG-F28_CC_x_I2C0_x_scFc_(D9R)_translation Fv#2 | VL7\|7a/JL3b | GTPARFSGSLLG--GKAALTL SGVQPEDEAEYYC | 1421 |
| | VL3\|3h/JL3b | GIPERFSGSNSG--NTATLTI SRVEAGDEADYYC | 1422 |
| D8_AS_CC_x_I2C0_x_scFc_(L7E)_translation Fv#2 | VL3\|3h/JL3b | GIPERFSGSNFG--NTATLII SRVEAGDEADYYC | 1423 |
| D8_CC_x_I2C0_x_scFc_(H6N)_translation Fv#2 | VL3\|3h/JL3b | GIPERFSGSNFG--NTATLII SRVEAGDEADYYC | 1424 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| E7_AS_CC_x_I2C0_x_scFc_(L6M)_translation Fv#2 | VL3\|3h/JL3b | GIPERFSGSNSG--NTATLTI SRVEAGDEADYYC | 1425 |
| H12_AS_CC_x_I2C0_x_scFc_(K5A)_translation Fv#2 | VL3\|3h/JL3b | GIPERFSGSNFG--NTATLTI SRVEAGDEADYYC | 1426 |
| | | L_CDR3 | |
| VL3\|3h/JL2 | | QVWDSS----------------- ----SDHVV | 1536 |
| MA_03-C7_AS_CC_x_I2C0_x_scFc_(G2H)_translation Fv#1 | VL3\|3h/JL2 | QVWDYE----------------- ----RPAMV | 1537 |
| MA_03-D12_AS_CC_x_I2C0_x_scFc_(L6A)_translation Fv#1 | VL3\|3h/JL2 | QVWDYL----------------- ----RQQQV | 1538 |
| MA_03-E11_AS_CC_x_I2C0_x_scFc_(G2B)_translation Fv#1 | VL3\|3h/JL2 | QVWDYY----------------- ----SNRAV | 1539 |
| MA_03-G10_AS_CC_x_I2C0_x_scFc_(N3H)_translation Fv#1 | VL3\|3h/JL2 | QVWDYS----------------- ----GQRQV | 1540 |
| MA_03-G11_AS_CC_x_I2C0_x_scFc_(O4R)_translation Fv#1 | VL3\|3h/JL2 | QVWDYL----------------- ----LPGQV | 1541 |
| MA_10-G10_AS_CC_x_I2C0_x_scFc_(T1I)_translation Fv#1 | VL3\|3h/JL2 | QVWDYV----------------- ----APRHV | 1542 |
| MA_10-G10_CC_x_I2C0_x_scFc_(B3A)_translation Fv#1 | VL3\|3h/JL2 | QVWDYV----------------- ----APRHV | 1543 |
| MA_88-B3-F9_CC_x_I2C0_x_scFc_(Y4E)_translation Fv#1 | VL3\|3h/JL2 | QVWDAS----------------- ----AGYGVV | 1544 |
| MA_98-C7_CC_x_I2C0_x_scFc_(Y8P)_translation Fv#1 | VL3\|3h/JL2 | QVWDYS----------------- ----PLRHV | 1545 |
| MA_98-G12_AS_CC_x_I2C0_x_scFc_(Q4Z)_translation Fv#1 | VL3\|3h/JL2 | QVWDYE----------------- ----SMTHV | 1546 |
| VL7\|7a/JL3b | | LLYYG----------------- ----GAQWV | 1547 |
| MA_03-C7_AS_CC_x_I2C0_x_scFc_(G2H)_translation Fv#2 | VL7\|7a/JL3b | VLWYS----------------- ----NRWV | 1548 |
| MA_03-D8_AS_CC_x_I2C0_x_scFc_(L7E)_translation Fv#2 | VL7\|7a/JL3b | VLWYS----------------- ----NRWV | 1549 |
| MA_03-D8_CC_x_I2C0_x_scFc_(H6N)_translation Fv#2 | VL7\|7a/JL3b | VLWYS----------------- ----NRWV | 1550 |
| MA_03-D12_AS_CC_x_I2C0_x_scFc_(L6A)_translation Fv#2 | VL7\|7a/JL3b | VLWYS----------------- ----NRWV | 1551 |
| MA_03-E7_AS_CC_x_I2C0_x_scFc_(L6M)_translation Fv#2 | VL7\|7a/JL3b | VLWYS----------------- ----NRWV | 1552 |
| MA_03-E11_AS_CC_x_I2C0_x_scFc_(G2B)_translation Fv#2 | VL7\|7a/JL3b | VLWYS----------------- ----NRWV | 1553 |
| MA_03-G10_AS_CC_x_I2C0_x_scFc_(N3H)_translation Fv#2 | VL7\|7a/JL3b | VLWYS----------------- ----NRWV | 1554 |
| MA_03-G11_AS_CC_x_I2C0_x_scFc_(O4R)_translation Fv#2 | VL7\|7a/JL3b | VLWYS----------------- ----NRWV | 1555 |
| MA_03-H12_AS_CC_x_I2C0_x_scFc_(K5A)_translation Fv#2 | VL7\|7a/JL3b | VLWYS----------------- ----NRWV | 1556 |
| MA_03-C7_CC_x_I2C0_x_scFc_(K9T)_translation Fv#2 | VL7\|7a/JL3b | VLWYS----------------- ----NRWV | 1557 |
| MA_09-E2_CC_x_I2C0_x_scFc_(V8T)_translation Fv#2 | VL7\|7a/JL3b | VLWYS----------------- ----NRWV | 1558 |
| MA_09-F11_CC_x_I2C0_x_scFc_(L6Q)_translation Fv#2 | VL7\|7a/JL3b | VLWYS----------------- ----NRWV | 1559 |
| MA_09-F12_CC_x_I2C0_x_scFc_(D1U)_translation Fv#2 | VL7\|7a/JL3b | VLWYS----------------- ----NRWV | 1560 |
| MA_09-G8_CC_x_I2C0_x_scFc_(I6K)_translation Fv#2 | VL7\|7a/JL3b | VLWYS----------------- ----NRWV | 1561 |
| MA_09-G10_CC_x_I2C0_x_scFc_(C4K)_translation Fv#2 | VL7\|7a/JL3b | VLWYS----------------- ----NRWV | 1562 |
| MA_09-G11_CC_x_I2C0_x_scFc_(Y9Q)_translation Fv#2 | VL7\|7a/JL3b | VLWYS----------------- ----NRWV | 1563 |
| MA_09-H7_CC_x_I2C0_x_scFc_(T3S)_translation Fv#2 | VL7\|7a/JL3b | VLWYS----------------- ----NRWV | 1564 |
| MA_09-H10_CC_x_I2C0_x_scFc_(B6N)_translation Fv#2 | VL7\|7a/JL3b | VLWYS----------------- ----NRWV | 1565 |
| MA_09-H11_CC_x_I2C0_x_scFc_(I8L)_translation Fv#2 | VL7\|7a/JL3b | VLWYS----------------- ----NRWV | 1566 |
| MA_10-B5_CC_x_I2C0_x_scFc_(H6H)_translation Fv#2 | VL7\|7a/JL3b | VLWYS----------------- ----NRWV | 1567 |
| MA_10-B6_CC_x_I2C0_x_scFc_(I3O)_translation Fv#2 | VL7\|7a/JL3b | VLWYS----------------- ----NRWV | 1568 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_10-D3_CC_x_I2C0_x_scFc_(O6B)_translation Fv#2 | VL7\|7a/JL3b | VLWYS----------------<br>----NRWV | 1569 |
| MA_10-D6_CC_x_I2C0_x_scFc_(V6Z)_translation Fv#2 | VL7\|7a/JL3b | VLWYS----------------<br>----NRWV | 1570 |
| MA_10-G2_CC_x_I2C0_x_scFc_(T1S)_translation Fv#2 | VL7\|7a/JL3b | VLWYS----------------<br>----NRWV | 1571 |
| MA_10-G5_CC_x_I2C0_x_scFc_(S9O)_translation Fv#2 | VL7\|7a/JL3b | VLWYS----------------<br>----NRWV | 1572 |
| MA_10-G10_AS_CC_x_I2C0_x_scFc_(T1I)_translation Fv#2 | VL7\|7a/JL3b | VLWYS----------------<br>----NRWV | 1573 |
| MA_10-G10_CC_x_I2C0_x_scFc_(B3A)_translation Fv#2 | VL7\|7a/JL3b | VLWYS----------------<br>----NRWV | 1574 |
| MA_10-H1_CC_x_I2C0_x_scFc_(T9K)_translation Fv#2 | VL7\|7a/JL3b | VLWYS----------------<br>----NRWV | 1575 |
| MA_10-H3_CC_x_I2C0_x_scFc_(M9L)_translation Fv#2 | VL7\|7a/JL3b | VLWYS----------------<br>----NRWV | 1576 |
| MA_81-B9_CC_x_I2C0_x_scFc_(U4L)_translation Fv#2 | VL7\|7a/JL3b | VLWYS----------------<br>----NRWV | 1577 |
| MA_86-A4_CC_x_I2C0_x_scFc_(K2W)_translation Fv#2 | VL7\|7a/JL3b | VLWYS----------------<br>----NRWV | 1578 |
| MA_86-A4-N-F5_CC_x_I2C0_x_scFc_(M4H)_translation Fv#2 | VL7\|7a/JL3b | VLWYS----------------<br>----NRWV | 1579 |
| MA_88-B3-F9_CC_x_I2C0_x_scFc_(Y4E)_translation Fv#2 | VL7\|7a/JL3b | VLWYS----------------<br>----NRWV | 1580 |
| MA_98-C7_CC_x_I2C0_x_scFc_(Y8P)_translation Fv#2 | VL7\|7a/JL3b | VLWYS----------------<br>----NRWV | 1581 |
| MA_98-G12_AS_CC_x_I2C0_x_scFc_(Q4Z)_translation Fv#2 | VL7\|7a/JL3b | VLWYS----------------<br>----NRWV | 1582 |
| MA_SG-F28_CC_x_I2C0_x_scFc_(D9R)_translation Fv#2 | VL7\|7a/JL3b | VLWYS----------------<br>----NRWV | 1583 |
| VL3\|3h/JL3b | | QVWDSS----------------<br>----SDHWV | 1584 |
| D8_AS_CC_x_I2C0_x_scFc_(L7E)_translation Fv#2 | VL3\|3h/JL3b | QVWDYR----------------<br>----TLDWV | 1585 |
| D8_CC_x_I2C0_x_scFc_(H6N)_translation Fv#2 | VL3\|3h/JL3b | QVWDYR----------------<br>----TLDWV | 1586 |
| E7_AS_CC_x_I2C0_x_scFc_(L6M)_translation Fv#2 | VL3\|3h/JL3b | QVWDYN----------------<br>----MNVWV | 1587 |
| H12_AS_CC_x_I2C0_x_scFc_(K5A)_translation Fv#2 | VL3\|3h/JL3b | QVWDYV----------------<br>----TPRWV | 1588 |
| | | L_FR4 | |
| VL3\|3h/JL2 | | FGGGTKLTVL | 1698 |
| MA_03-C7_AS_CC_x_I2C0_x_scFc_(G2H)_translation Fv#1 | VL3\|3h/JL2 | FGGGTKLTVL | 1699 |
| MA_03-D12_AS_CC_x_I2C0_x_scFc_(L6A)_translation Fv#1 | VL3\|3h/JL2 | FGCGTKLTVL | 1700 |
| MA_03-E11_AS_CC_x_I2C0_x_scFc_(G2B)_translation Fv#1 | VL3\|3h/JL2 | FGCGTKLTVL | 1701 |
| MA_03-G10_AS_CC_x_I2C0_x_scFc_(N3H)_translation Fv#1 | VL3\|3h/JL2 | FGCGTKLTVL | 1702 |
| MA_03-G11_AS_CC_x_I2C0_x_scFc_(O4R)_translation Fv#1 | VL3\|3h/JL2 | FGCGTKLTVL | 1703 |
| MA_10-G10_AS_CC_x_I2C0_x_scFc_(T1I)_translation Fv#1 | VL3\|3h/JL2 | FGCGTKLTVL | 1704 |
| MA_10-G10_CC_x_I2C0_x_scFc_(B3A)_translation Fv#1 | VL3\|3h/JL2 | FGCGTKLTVL | 1705 |
| MA_88-B3-F9_CC_x_I2C0_x_scFc_(Y4E)_translation Fv#1 | VL3\|3h/JL2 | FGCGTKLTVL | 1706 |
| MA_98-C7_CC_x_I2C0_x_scFc_(Y8P)_translation Fv#1 | VL3\|3h/JL2 | FGCGTKLTVL | 1707 |
| MA_98-G12_AS_CC_x_I2C0_x_scFc_(Q4Z)_translation Fv#1 | VL3\|3h/JL2 | FGCGTKLTVL | 1708 |
| VL7\|7a/JL3b | | FGGGTKLTVL | 1709 |
| MA_03-C7_AS_CC_x_I2C0_x_scFc_(G2H)_translation Fv#2 | VL7\|7a/JL3b | FGGGTKLTVL | 1710 |
| MA_03-D8_AS_CC_x_I2C0_x_scFc_(L7E)_translation Fv#2 | VL7\|7a/JL3b | FGGGTKLTVL | 1711 |
| MA_03-D8_CC_x_I2C0_x_scFc_(H6N)_translation Fv#2 | VL7\|7a/JL3b | FGGGTKLTVL | 1712 |
| MA_03-D12_AS_CC_x_I2C0_x_scFc_(L6A)_translation Fv#2 | VL7\|7a/JL3b | FGGGTKLTVL | 1713 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_03-E7_AS_CC_x_I2C0_x_scFc_(L6M)_translation Fv#2 | VL7\|7a/JL3b | FGGGTKLTVL | 1714 |
| MA_03-E11_AS_CC_x_I2C0_x_scFc_(G2B)_translation Fv#2 | VL7\|7a/JL3b | FGGGTKLTVL | 1715 |
| MA_03-G10_AS_CC_x_I2C0_x_scFc_(N3H)_translation Fv#2 | VL7\|7a/JL3b | FGGGTKLTVL | 1716 |
| MA_03-G11_AS_CC_x_I2C0_x_scFc_(O4R)_translation Fv#2 | VL7\|7a/JL3b | FGGGTKLTVL | 1717 |
| MA_03-H12_AS_CC_x_I2C0_x_scFc_(K5A)_translation Fv#2 | VL7\|7a/JL3b | FGGGTKLTVL | 1718 |
| MA_03-C7_CC_x_I2C0_x_scFc_(K9T)_translation Fv#2 | VL7\|7a/JL3b | FGGGTKLTVL | 1719 |
| MA_09-E2_CC_x_I2C0_x_scFc_(V8T)_translation Fv#2 | VL7\|7a/JL3b | FGGGTKLTVL | 1720 |
| MA_09-F11_CC_x_I2C0_x_scFc_(L6Q)_translation Fv#2 | VL7\|7a/JL3b | FGGGTKLTVL | 1721 |
| MA_09-F12_CC_x_I2C0_x_scFc_(D1U)_translation Fv#2 | VL7\|7a/JL3b | FGGGTKLTVL | 1722 |
| MA_09-G8_CC_x_I2C0_x_scFc_(I6K)_translation Fv#2 | VL7\|7a/JL3b | FGGGTKLTVL | 1723 |
| MA_09-G10_CC_x_I2C0_x_scFc_(C4K)_translation Fv#2 | VL7\|7a/JL3b | FGGGTKLTVL | 1724 |
| MA_09-G11_CC_x_I2C0_x_scFc_(Y9Q)_translation Fv#2 | VL7\|7a/JL3b | FGGGTKLTVL | 1725 |
| MA_09-H7_CC_x_I2C0_x_scFc_(T3S)_translation Fv#2 | VL7\|7a/JL3b | FGGGTKLTVL | 1726 |
| MA_09-H10_CC_x_I2C0_x_scFc_(B6N)_translation Fv#2 | VL7\|7a/JL3b | FGGGTKLTVL | 1727 |
| MA_09-H11_CC_x_I2C0_x_scFc_(I8L)_translation Fv#2 | VL7\|7a/JL3b | FGGGTKLTVL | 1728 |
| MA_10-B5_CC_x_I2C0_x_scFc_(H6H)_translation Fv#2 | VL7\|7a/JL3b | FGGGTKLTVL | 1729 |
| MA_10-B6_CC_x_I2C0_x_scFc_(I3O)_translation Fv#2 | VL7\|7a/JL3b | FGGGTKLTVL | 1730 |
| MA_10-D3_CC_x_I2C0_x_scFc_(O6B)_translation Fv#2 | VL7\|7a/JL3b | FGGGTKLTVL | 1731 |
| MA_10-D6_CC_x_I2C0_x_scFc_(V6Z)_translation Fv#2 | VL7\|7a/JL3b | FGGGTKLTVL | 1732 |
| MA_10-G2_CC_x_I2C0_x_scFc_(T1S)_translation Fv#2 | VL7\|7a/JL3b | FGGGTKLTVL | 1733 |
| MA_10-G5_CC_x_I2C0_x_scFc_(S9O)_translation Fv#2 | VL7\|7a/JL3b | FGGGTKLTVL | 1734 |
| MA_10-G10_AS_CC_x_I2C0_x_scFc_(T1I)_translation Fv#2 | VL7\|7a/JL3b | FGGGTKLTVL | 1735 |
| MA_10-G10_CC_x_I2C0_x_scFc_(B3A)_translation Fv#2 | VL7\|7a/JL3b | FGGGTKLTVL | 1736 |
| MA_10-H1_CC_x_I2C0_x_scFc_(T9K)_translation Fv#2 | VL7\|7a/JL3b | FGGGTKLTVL | 1737 |
| MA_10-H3_CC_x_I2C0_x_scFc_(M9L)_translation Fv#2 | VL7\|7a/JL3b | FGGGTKLTVL | 1738 |
| MA_81-B9_CC_x_I2C0_x_scFc_(U4L)_translation Fv#2 | VL7\|7a/JL3b | FGGGTKLTVL | 1739 |
| MA_86-A4_CC_x_I2C0_x_scFc_(K2W)_translation Fv#2 | VL7\|7a/JL3b | FGGGTKLTVL | 1740 |
| MA_86-A4-N-F5_CC_x_I2C0_x_scFc_(M4H)_translation Fv#2 | VL7\|7a/JL3b | FGGGTKLTVL | 1741 |
| MA_88-B3-F9_CC_x_I2C0_x_scFc_(Y4E)_translation Fv#2 | VL7\|7a/JL3b | FGGGTKLTVL | 1742 |
| MA_98-C7_CC_x_I2C0_x_scFc_(Y8P)_translation Fv#2 | VL7\|7a/JL3b | FGGGTKLTVL | 1743 |
| MA_98-G12_AS_CC_x_I2C0_x_scFc_(Q4Z)_translation Fv#2 | VL7\|7a/JL3b | FGGGTKLTVL | 1744 |
| MA_SG-F28_CC_x_I2C0_x_scFc_(D9R)_translation Fv#2 | VL7\|7a/JL3b | FGGGTKLTVL | 1745 |
| VL3\|3h/JL3b | | FGGGTKLTVL | 1746 |
| D8_AS_CC_x_I2C0_x_scFc_(L7E)_translation Fv#2 | VL3\|3h/JL3b | FGCGTKLTVL | 1747 |
| D8_CC_x_I2C0_x_scFc_(H6N)_translation Fv#2 | VL3\|3h/JL3b | FGCGTKLTVL | 1748 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| E7_AS_CC_x_I2C0_x_scFc_(L6M)_translation Fv#2 | VL3\|3h/JL3b | FGCGTKLTVL | 1749 |
| H12_AS_CC_x_I2C0_x_scFc_(K5A)_translation Fv#2 | VL3\|3h/JL3b | FGCGTKLTVL | 1750 |

| | Germline | H_FR3 | SEQ ID NO: |
|---|---|---|---|
| VH3\|3-23/D6\|6-19\|RF2/JH4 | | RFTISRDNSKNTLYLQMNSLRAEDTAVYYCAK | 1427 |
| MA_03-C7_AS_CC_x_I2C0_x_scFc_(G2H)_translation Fv#1 | VH3\|3-23/D6\|6-19\|RF2/JH4 | RFTISRDNSKNTLYLQMNSLRAEDTAVYYCAT | 1428 |
| MA_03-D8_AS_CC_x_I2C0_x_scFc_(L7E)_translation Fv#1 | VH3\|3-23/D6\|6-19\|RF2/JH4 | RFTISRDNSKNTLYLQMNSLRAEDTAVYYCAT | 1429 |
| MA_03-D8_CC_x_I2C0_x_scFc_(H6N)_translation Fv#1 | VH3\|3-23/D6\|6-19\|RF2/JH4 | RFTISRDNSKNTLYLQMNSLRAEDTAVYYCAT | 1430 |
| MA_03-D12_AS_CC_x_I2C0_x_scFc_(L6A)_translation Fv#1 | VH3\|3-23/D6\|6-19\|RF2/JH4 | RFTISRDNSKNTLYLQMNSLRAEDDAVYYCAT | 1431 |
| MA_03-E7_AS_CC_x_I2C0_x_scFc_(L6M)_translation Fv#1 | VH3\|3-23/D6\|6-19\|RF2/JH4 | RFTISRDNSKNTLYLQMNSLRAEDTAAYYCVT | 1432 |
| MA_03-E11_AS_CC_x_I2C0_x_scFc_(G2B)_translation Fv#1 | VH3\|3-23/D6\|6-19\|RF2/JH4 | RFTISRDNSKNTLYLQMNSLRAEDTAAYYCVT | 1433 |
| MA_03-G10_AS_CC_x_I2C0_x_scFc_(N3H)_translation Fv#1 | VH3\|3-23/D6\|6-19\|RF2/JH4 | RFTISRDNSKNTLYLQMSSLRAEDTAVYYCAT | 1434 |
| MA_03-G11_AS_CC_x_I2C0_x_scFc_(O4R)_translation Fv#1 | VH3\|3-23/D6\|6-19\|RF2/JH4 | RFTISRDNSKNTLYLQMNSLRAEDTAVYYCAT | 1435 |
| MA_03-H12_AS_CC_x_I2C0_x_scFc_(K5A)_translation Fv#1 | VH3\|3-23/D6\|6-19\|RF2/JH4 | RFTISRDNSKNTLYLQMNSLRAEDTAAYYCVT | 1436 |
| MA_10-G10_AS_CC_x_I2C0_x_scFc_(T1I)_translation Fv#1 | VH3\|3-23/D6\|6-19\|RF2/JH4 | RFTISRDNSKNTLYLQMNSLRAEDTAVYYCAT | 1437 |
| MA_10-G10_CC_x_I2C0_x_scFc_(B3A)_translation Fv#1 | VH3\|3-23/D6\|6-19\|RF2/JH4 | RFTISRDNSKNTLYLQMNSLRAEDTAVYYCAT | 1438 |
| MA_98-C7_CC_x_I2C0_x_scFc_(Y8P)_translation Fv#1 | VH3\|3-23/D6\|6-19\|RF2/JH4 | RFTISRDNSKNTLYLQMNSLRAEDTAVYYCAT | 1439 |
| MA_98-G12_AS_CC_x_I2C0_x_scFc_(Q4Z)_translation Fv#1 | VH3\|3-23/D6\|6-19\|RF2/JH4 | RFTISRDNSKNTLYLQMNSLRAEDTAAYYCVT | 1440 |
| VH3\|3-73/D3\|3-3\|RF3/JH4 | | RFTISRDDSKNTAYLQMNSLKTEDTAVYYCTR | 1441 |
| MA_03-C7_AS_CC_x_I2C0_x_scFc_(G2H)_translation Fv#2 | VH3\|3-73/D3\|3-3\|RF3/JH4 | RFTISRDDSKNTATAYLQMNNLKTYYCVR | 1442 |
| MA_03-D8_AS_CC_x_I2C0_x_scFc_(L7E)_translation Fv#2 | VH3\|3-73/D3\|3-3\|RF3/JH4 | RFTISRDDSKNTAYLQMNNLKTEDTAVYYCVR | 1443 |
| MA_03-D8_CC_x_I2C0_x_scFc_(H6N)_translation Fv#2 | VH3\|3-73/D3\|3-3\|RF3/JH4 | RFTISRDDSKNTAYLQMNNLKTEDTAVYYCVR | 1444 |
| MA_03-D12_AS_CC_x_I2C0_x_scFc_(L6A)_translation Fv#2 | VH3\|3-73/D3\|3-3\|RF3/JH4 | RFTISRDDSKNTAYLQMNNLKTEDTAVYYCVR | 1445 |
| MA_03-E7_AS_CC_x_I2C0_x_scFc_(L6M)_translation Fv#2 | VH3\|3-73/D3\|3-3\|RF3/JH4 | RFTISRDDSKNTAYLQMNNLKTEDTAVYYCVR | 1446 |
| MA_03-E11_AS_CC_x_I2C0_x_scFc_(G2B)_translation Fv#2 | VH3\|3-73/D3\|3-3\|RF3/JH4 | RFTISRDDSKNTAYLQMNNLKTEDTAVYYCVR | 1447 |
| MA_03-G10_AS_CC_x_I2C0_x_scFc_(N3H)_translation Fv#2 | VH3\|3-73/D3\|3-3\|RF3/JH4 | RFTISRDDSKNTAYLQMNNLKTEDTAVYYCVR | 1448 |
| MA_03-G11_AS_CC_x_I2C0_x_scFc_(O4R)_translation Fv#2 | VH3\|3-73/D3\|3-3\|RF3/JH4 | RFTISRDDSKNTALQMNNLKTEDYYCVR | 1449 |
| MA_03-H12_AS_CC_x_I2C0_x_scFc_(K5A)_translation Fv#2 | VH3\|3-73/D3\|3-3\|RF3/JH4 | RFTISRDDSKNTAYLQMNNLKTEDTAVYYCVR | 1450 |
| MA_09-C7_CC_x_I2C0_x_scFc_(K9T)_translation Fv#2 | VH3\|3-73/D3\|3-3\|RF3/JH4 | RFTISRDDSKNTAYLQMNNLKTEDTAVYYCVR | 1451 |
| MA_09-E2_CC_x_I2C0_x_scFc_(V8T)_translation Fv#2 | VH3\|3-73/D3\|3-3\|RF3/JH4 | RFTISRDDSKNTAYLQMNNLKTEDTAVYYCVR | 1452 |
| MA_09-F11_CC_x_I2C0_x_scFc_(L6Q)_translation Fv#2 | VH3\|3-73/D3\|3-3\|RF3/JH4 | RFTISRDDSKNTAYLQMNNLKTEDTAVYYCVR | 1453 |
| MA_09-F12_CC_x_I2C0_x_scFc_(D1U)_translation Fv#2 | VH3\|3-73/D3\|3-3\|RF3/JH4 | RFTISRDDSKNTAYLQMNNLKTEDTAVYYCVR | 1454 |
| MA_09-G8_CC_x_I2C0_x_scFc_(I6K)_translation Fv#2 | VH3\|3-73/D3\|3-3\|RF3/JH4 | RFTISRDDSKNTAYLQMNNLKTEDTAVYYCVR | 1455 |
| MA_09-G10_CC_x_I2C0_x_scFc_(C4K)_translation Fv#2 | VH3\|3-73/D3\|3-3\|RF3/JH4 | RFTISRDDSKNTAYLQMNNLKTEDTAVYYCVR | 1456 |
| MA_09-G11_CC_x_I2C0_x_scFc_(Y9Q)_translation Fv#2 | VH3\|3-73/D3\|3-3\|RF3/JH4 | RFTISRDDSKNTAYLQMNNLKTEDTAVYYCVR | 1457 |
| MA_09-H7_CC_x_I2C0_x_scFc_(T3S)_translation Fv#2 | VH3\|3-73/D3\|3-3\|RF3/JH4 | RFTISRDDSKNTAYLQMNNLKTEDTAVYYCVR | 1458 |
| MA_09-H10_CC_x_I2C0_x_scFc_(B6N)_translation Fv#2 | VH3\|3-73/D3\|3-3\|RF3/JH4 | RFTISRDDSKNTAYLQMNNLKTEDTAVYYCVR | 1459 |
| MA_09-H11_CC_x_I2C0_x_scFc_(I8L)_translation Fv#2 | VH3\|3-73/D3\|3-3\|RF3/JH4 | RFTISRDDSKNTAYLQMNNLKTEDTAVYYCVR | 1460 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_10-B5_CC_x_I2C0_x_scFc_(H6H)_translation Fv#2 | VH3\|3-73/D3\|3-3\|RF3/JH4 | RFTISRDDSKNTAYLQMNNLKTEDTAVYYCVR | 1461 |
| MA_10-B6_CC_x_I2C0_x_scFc_(I3O)_translation Fv#2 | VH3\|3-73/D3\|3-3\|RF3/JH4 | RFTISRDDSKNTAYLQMNNLKTEDTAVYYCVR | 1462 |
| MA_10-D3_CC_x_I2C0_x_scFc_(O6B)_translation Fv#2 | VH3\|3-73/D3\|3-3\|RF3/JH4 | RFTISRDDSKNTAYLQMNNLKTEDTAVYYCVR | 1463 |
| MA_10-D6_CC_x_I2C0_x_scFc_(V6Z)_translation Fv#2 | VH3\|3-73/D3\|3-3\|RF3/JH4 | RFTISRDDSKNTAYLQMNNLKTEDTAVYYCVR | 1464 |
| MA_10-G2_CC_x_I2C0_x_scFc_(T1S)_translation Fv#2 | VH3\|3-73/D3\|3-3\|RF3/JH4 | RFTISRDDSKNTAYLQMNNLKTEDTAVYYCVR | 1465 |
| MA_10-G5_CC_x_I2C0_x_scFc_(S9O)_translation Fv#2 | VH3\|3-73/D3\|3-3\|RF3/JH4 | RFTISRDDSKNTAYLQMNNLKTEDTAVYYCVR | 1466 |
| MA_10-G10_AS_CC_x_I2C0_x_scFc_(T1I)_translation Fv#2 | VH3\|3-73/D3\|3-3\|RF3/JH4 | RFTISRDDSKNTAYLQMNNLKTEDTAVYYCVR | 1467 |
| MA_10-G10_CC_x_I2C0_x_scFc_(B3A)_translation Fv#2 | VH3\|3-73/D3\|3-3\|RF3/JH4 | RFTISRDDSKNTAYLQMNNLKTEYYCVR | 1468 |
| MA_10-H1_CC_x_I2C0_x_scFc_(T9K)_translation Fv#2 | VH3\|3-73/D3\|3-3\|RF3/JH4 | RFTISRDDSKNTAYLQMNNLKTEDTAVYYCVR | 1469 |
| MA_10-H3_CC_x_I2C0_x_scFc_(M9L)_translation Fv#2 | VH3\|3-73/D3\|3-3\|RF3/JH4 | RFTISRDDSKNTAYLQMNNLKTEDTAVYYCVR | 1470 |
| MA_81-B9_CC_x_I2C0_x_scFc_(U4L)_translation Fv#2 | VH3\|3-73/D3\|3-3\|RF3/JH4 | RFTISRDDSKNTALQMNNLKTEDTAVYYCVR | 1471 |
| MA_86-A4_CC_x_I2C0_x_scFc_(K2W)_translation Fv#2 | VH3\|3-73/D3\|3-3\|RF3/JH4 | RFTISRDDSKNTAYLQMNNLKTELTAVYYCVR | 1472 |
| MA_86-A4-F5_CC_x_I2C0_x_scFc_(M4H)_translation Fv#2 | VH3\|3-73/D3\|3-3\|RF3/JH4 | RFTISRDDSKNTAYLQMNNLKTEDTAVYYCVR | 1473 |
| MA_88-B3-F9_CC_x_I2C0_x_scFc_(Y4E)_translation Fv#2 | VH3\|3-73/D3\|3-3\|RF3/JH4 | RFTISRDDSKNTAYLQMNNLKTEDTAVYYCVR | 1474 |
| MA_98-C7_CC_x_I2C0_x_scFc_(Y8P)_translation Fv#2 | VH3\|3-73/D3\|3-3\|RF3/JH4 | RFTISRDDSKNTAYLQMNNLKTEDTAVYYCVR | 1475 |
| MA_98-G12_AS_CC_x_I2C0_x_scFc_(Q4Z)_translation Fv#2 | VH3\|3-73/D3\|3-3\|RF3/JH4 | RFTISRDDSKNTAYLQMNNLKTEDTAVYYCVR | 1476 |
| MG_SG-F28_CC_x_I2C0_x_scFc_(D9R)_translation Fv#2 | VH3\|3-73/D3\|3-3\|RF3/JH4 | RFTISRDDSKNTAYLQMNNLKTEDTAVYYCVR | 1477 |
| VH2\|2-70/D2\|2-15\|RF1/JH5 | | RLTISKDTSKNQVVLTMTNMDPVDTATYYCAR | 1478 |
| MA_09-C7_CC_x_I2C0_x_scFc_(K9T)_translation Fv#1 | VH2\|2-70/D2\|2-15\|RF1/JH5 | RLTITKDTSKNQVVLTMTNMDPVDTATYYCAY | 1479 |
| VH3\|3-15/D3\|3-10\|RF2/_JH6 | | RFTISRDDSKNTLYLQMNSLKTEDTAVYYCTT | 1480 |
| MA_09-E2_CC_x_I2C0_x_scFc_(V8T)_translation Fv#1 | VH3\|3-15/D3\|3-10\|RF2/JH6 | RFTISRDDSKNTLFLQMNSLKTEDTAVYYCTT | 1481 |
| MA_09-B5_CC_x_I2C0_x_scFc_(H6H)_translation Fv#1 | VH3\|3-15/D3\|3-10\|RF2/JH6 | RFTISRDDSKNTLFLQMNSLKTEDTAVYYCTT | 1482 |
| MA_09-B6_CC_x_I2C0_x_scFc_(I3O)_translation Fv#1 | VH3\|3-15/D3\|3-10\|RF2/JH6 | RFTISRDDSKNTLYLQMNSLKTEDTAVYYCTT | 1483 |
| MA_09-D3_CC_x_I2C0_x_scFc_(O6B)_translation Fv#1 | VH3\|3-15/D3\|3-10\|RF2/JH6 | RFTISRDDSKNTLFLQMNSLKTEDTAVYYCTT | 1484 |
| MA_10-D6_CC_x_I2C0_x_scFc_(V6Z)_translation Fv#1 | VH3\|3-15/D3\|3-10\|RF2/JH6 | RFTISRDDSKNTLYLQMNSLKTEDTAVYYCTT | 1485 |
| MA_10-G2_CC_x_I2C0_x_scFc_(T1S)_translation Fv#1 | VH3\|3-15/D3\|3-10\|RF2/JH6 | RFTISRDDSKNTLYLQMNSLKTEDTAVYYCTT | 1486 |
| MA_10-G5_CC_x_I2C0_x_scFc_(S9O)_translation Fv#1 | VH3\|3-15/D3\|3-10\|RF2/JH6 | RFTISRDDSKNTLYLQMNSLKTEDTAVYYCTT | 1487 |
| MA_10-H1_CC_x_I2C0_x_scFc_(T9K)_translation Fv#1 | VH3\|3-15/D3\|3-10\|RF2/JH6 | RFTISRDDSKNTLYLQMNSLKTEDTAVYYCTT | 1488 |
| MA_10-H3_CC_x_I2C0_x_scFc_(M9L)_translation Fv#1 | VH3\|3-15/D3\|3-10\|RF2/JH6 | RFTISRDDSKNTLYLQMNSLKTEDTAVYYCTT | 1489 |
| VH2\|2-05/D2\|2-15\|RF1/JH5 | | RLTITKDTSKNQVVLTMTNMDPVDTATYYCAH | 1490 |
| MA_09-F11_CC_x_I2C0_x_scFc_(L6Q)_translation Fv#1 | VH2\|2-05/D2\|2-15\|RF1/JH5 | RLTITKDT:KNQVVLTMTNMDPVATYCAY | 1491 |
| MA_09-F12_CC_x_I2C0_x_scFc_(D1U)_translation Fv#1 | VH2\|2-05/D2\|2-15\|RF1/JH5 | RLTITKDTSKNQVVLTMTNMDPVDTATYYCAY | 1492 |
| MA_09-G8_CC_x_I2C0_x_scFc_(I6K)_translation Fv#1 | VH2\|2-05/D2\|2-15\|RF1/JH5 | RLTITKDTSKNQVVLTMTNMDPVDTATYTYY-CAY | 1493 |
| MA_09-G10_CC_x_I2C0_x_scFc_(C4K)_translation Fv#1 | VH2\|2-05/D2\|2-15\|RF1/JH5 | RLTITKDTSKNQVVLTMTNMDPVDTATYYCAY | 1494 |
| MA_09-G11_CC_x_I2C0_x_scFc_(Y9Q)_translation Fv#1 | VH2\|2-05/D2\|2-15\|RF1/JH5 | RLTITKDTSKNQVVLTMTNMDPVDTATYYCAY | 1495 |
| MA_09-H7_CC_x_I2C0_x_scFc_(T3S)_translation Fv#1 | VH2\|2-05/D2\|2-15\|RF1/JH5 | RLTITKDTSKNQVVLTMTNMDPVDTATYYCAY | 1496 |
| MA_09-H10_CC_x_I2C0_x_scFc_(B6N)_translation Fv#1 | VH2\|2-05/D2\|2-15\|RF1/JH5 | RLTITKDTSKNQVVLTMTNMDPVDTATYYCAY | 1497 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_09-H11_CC_x_I2C0_x_scFc_(I8L)_translation Fv#1 | VH2\|2-05/D2\|2-15\|RF1/JH5 | RLTITKDTSKNQVVLTMTNMDPVDTATYYCAY | 1498 |
| VH4\|4-59/D3\|3-3\|RF3/JH4 | | RVTISVDTSKNQFSLKLSSVTAADTAVYYCAR | 1499 |
| MA_81-B9_CC_x_I2C0_x_scFc_(U4L)_translation Fv#1 | VH4\|4-59/D3\|3-3\|RF3/JH4 | RVTISVDTSKNQFSLKLSSVTAADTAVYYCAR | 1500 |
| VH3\|3-30.3/D1\|1-1\|RF2/JH4 | | RFTISRDNSKNTLYLQMNSLRAEDTAVYYCAR | 1501 |
| MA_86-A4_CC_x_I2C0_x_scFc_(K2W)_translation Fv#1 | VH3\|3-30.3/D1\|1-1\|RF2/JH4 | RFTISRDNSKNTLYLQMNSLRAEDTAVYYCAR | 1502 |
| MA_86-A4-N-F5_CC_x_I2C0_x_scFc_(M4H)_translation Fv#1 | VH3\|3-30.3/D1\|1-1\|RF2/JH4 | RFTISRDNSKNTLYLQMNSLRAEDTAVYYCAR | 1503 |
| VH3\|3-11/D1\|1-1\|RF3/JH4 | | RFTISRDNAKNSLYLQMNSLRAEDTAVYYCAR | 1504 |
| MA_88-B3-F9_CC_x_I2C0_x_scFc_(Y4E)_translation Fv#1 | VH3\|3-11/D1\|1-1\|RF3/JH4 | RFTISRDNAKNSLYLQMNSLRAEDTAVYYCAT | 1505 |
| VH4\|4-30._1/D3\|3-10\|RF3/_JH6 Fv#1 | | RVTISVDTSKNQFSLKLSSVTAADTAVYYCAR | 1506 |
| MA_SG-F28_CC_x_I2C0_x_scFc_(D9R)_translation Fv#1 | VH4\|4-30.1/D3\|3-10\|RF3/JH6 | RVTMSVDTSKNQFSLKLTSLTAADTAVYYCAR | 1507 |
| | | H_CDR3 | |
| VH3\|3-23/D6\|6-19\|RF2/JH4 | | GIAVA-----------------GYFDY | 1589 |
| MA_03-C7_AS_CC_x_I2C0_x_scFc_(G2H)_translation Fv#1 | VH3\|3-23/D6\|6-19\|RF2/JH4 | GKGVH-----------------LGFDY | 1590 |
| MA_03-D8_AS_CC_x_I2C0_x_scFc_(L7E)_translation Fv#1 | VH3\|3-23/D6\|6-19\|RF2/JH4 | GKGVH-----------------LGFDY | 1591 |
| MA_03-D8_CC_x_I2C0_x_scFc_(H6N)_translation Fv#1 | VH3\|3-23/D6\|6-19\|RF2/JH4 | GKGVH-----------------LGFDY | 1592 |
| MA_03-D12_AS_CC_x_I2C0_x_scFc_(L6A)_translation Fv#1 | VH3\|3-23/D6\|6-19\|RF2/JH4 | GKGVH-----------------LGFDY | 1593 |
| MA_03-E7_AS_CC_x_I2C0_x_scFc_(L6M)_translation Fv#1 | VH3\|3-23/D6\|6-19\|RF2/JH4 | GKGVH-----------------LGFDY | 1594 |
| MA_03-E11_AS_CC_x_I2C0_x_scFc_(G2B)_translation Fv#1 | VH3\|3-23/D6\|6-19\|RF2/JH4 | GKGVH-----------------LGFDY | 1595 |
| MA_03-G10_AS_CC_x_I2C0_x_scFc_(N3H)_translation Fv#1 | VH3\|3-23/D6\|6-19\|RF2/JH4 | GKGVH-----------------LGFDY | 1596 |
| MA_03-G11_AS_CC_x_I2C0_x_scFc_(O4R)_translation Fv#1 | VH3\|3-23/D6\|6-19\|RF2/JH4 | GKGVH-----------------LNFDY | 1597 |
| MA_03-H12_AS_CC_x_I2C0_x_scFc_(K5A)_translation Fv#1 | VH3\|3-23/D6\|6-19\|RF2/JH4 | GKGVH-----------------LGFDY | 1598 |
| MA_10-G10_AS_CC_x_I2C0_x_scFc_(T1I)_translation Fv#1 | VH3\|3-23/D6\|6-19\|RF2/JH4 | GKGVH-----------------LGFDY | 1599 |
| MA_10-G10_CC_x_I2C0_x_scFc_(B3A)_translation Fv#1 | VH3\|3-23/D6\|6-19\|RF2/JH4 | GKGVH-----------------LGFDY | 1600 |
| MA_98-C7_CC_x_I2C0_x_scFc_(Y8P)_translation Fv#1 | VH3\|3-23/D6\|6-19\|RF2/JH4 | GKGVH-----------------LGFDY | 1601 |
| MA_98-G12_AS_CC_x_I2C0_x_scFc_(Q4Z)_translation Fv#1 | VH3\|3-23/D6\|6-19\|RF2/JH4 | GKGVH-----------------LGFDY | 1602 |
| VH3\|3-73/D3\|3-3\|RF3/JH4 | | ITIFGVV-----------------IIYFDY | 1603 |
| MA_03-C7_AS_CC_x_I2C0_x_scFc_(G2H)_translation Fv#2 | VH3\|3-73/D3\|3-3\|RF3/JH4 | HGNFGNS-----------------YISYWAY | 1604 |
| MA_03-D8_AS_CC_x_I2C0_x_scFc_(L7E)_translation Fv#2 | VH3\|3-73/D3\|3-3\|RF3/JH4 | HGNFGNS-----------------YISYWAY | 1605 |
| MA_03-D8_CC_x_I2C0_x_scFc_(H6N)_translation Fv#2 | VH3\|3-73/D3\|3-3\|RF3/JH4 | HGNFGNS-----------------YISYWAY | 1606 |
| MA_03-D12_AS_CC_x_I2C0_x_scFc_(L6A)_translation Fv#2 | VH3\|3-73/D3\|3-3\|RF3/JH4 | HGNFGNS-----------------YISYWAY | 1607 |
| MA_03-E7_AS_CC_x_I2C0_x_scFc_(L6M)_translation Fv#2 | VH3\|3-73/D3\|3-3\|RF3/JH4 | HGNFGNS-----------------YISYWAY | 1608 |
| MA_03-E11_AS_CC_x_I2C0_x_scFc_(G2B)_translation Fv#2 | VH3\|3-73/D3\|3-3\|RF3/JH4 | HGNFGNS-----------------YISYWAY | 1609 |
| MA_03-G10_AS_CC_x_I2C0_x_scFc_(N3H)_translation Fv#2 | VH3\|3-73/D3\|3-3\|RF3/JH4 | HGNFGNS-----------------YISYWAY | 1610 |
| MA_03-G11_AS_CC_x_I2C0_x_scFc_(O4R)_translation Fv#2 | VH3\|3-73/D3\|3-3\|RF3/JH4 | HGNFGNS-----------------YISYWAY | 1611 |
| MA_03-H12_AS_CC_x_I2C0_x_scFc_(K5A)_translation Fv#2 | VH3\|3-73/D3\|3-3\|RF3/JH4 | HGNFGNS-----------------YISYWAY | 1612 |
| MA_09-C7_CC_x_I2C0_x_scFc_(K9T)_translation Fv#2 | VH3\|3-73/D3\|3-3\|RF3/JH4 | HGNFGNS-----------------YISYWAY | 1613 |
| MA_09-E2_CC_x_I2C0_x_scFc_(V8T)_translation Fv#2 | VH3\|3-73/D3\|3-3\|RF3/JH4 | HGNFGNS-----------------YISYWAY | 1614 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_09-F11_CC_x_I2C0_x_scFc_(L6Q)_translation Fv#2 | VH3\|3-73/D3\|3-3\|RF3/JH4 | HGNEGNS---------------YISYWAY | 1615 |
| MA_09-F12_CC_x_I2C0_x_scFc_(D1U)_translation Fv#2 | VH3\|3-73/D3\|3-3\|RF3/JH4 | HGNFGNS---------------YISYWAY | 1616 |
| MA_09-G8_CC_x_I2C0_x_scFc_(I6K)_translation Fv#2 | VH3\|3-73/D3\|3-3\|RF3/JH4 | HGNFGNS---------------YISYWAY | 1617 |
| MA_09-G10_CC_x_I2C0_x_scFc_(C4K)_translation Fv#2 | VH3\|3-73/D3\|3-3\|RF3/JH4 | HGNFGNS---------------YISYWAY | 1618 |
| MA_09-G11_CC_x_I2C0_x_scFc_(Y9Q)_translation Fv#2 | VH3\|3-73/D3\|3-3\|RF3/JH4 | HGNFGNS---------------YISYWAY | 1619 |
| MA_09-H7_CC_x_I2C0_x_scFc_(T3S)_translation Fv#2 | VH3\|3-73/D3\|3-3\|RF3/JH4 | HGNFGNS---------------YISYWAY | 1620 |
| MA_09-H10_CC_x_I2C0_x_scFc_(B6N)_translation Fv#2 | VH3\|3-73/D3\|3-3\|RF3/JH4 | HGNFGNS---------------YISYWAY | 1621 |
| MA_09-H11_CC_x_I2C0_x_scFc_(I8L)_translation Fv#2 | VH3\|3-73/D3\|3-3\|RF3/JH4 | HGNFGNS---------------YISYWAY | 1622 |
| MA_10-B5_CC_x_I2C0_x_scFc_(H6H)_translation Fv#2 | VH3\|3-73/D3\|3-3\|RF3/JH4 | HGNEGNS---------------YISYWAY | 1623 |
| MA_10-B6_CC_x_I2C0_x_scFc_(I3O)_translation Fv#2 | VH3\|3-73/D3\|3-3\|RF3/JH4 | HGNFGNS---------------YISYWAY | 1624 |
| MA_10-D3_CC_x_I2C0_x_scFc_(O6B)_translation Fv#2 | VH3\|3-73/D3\|3-3\|RF3/JH4 | HGNFGNS---------------YISYWAY | 1625 |
| MA_10-D6_CC_x_I2C0_x_scFc_(V6Z)_translation Fv#2 | VH3\|3-73/D3\|3-3\|RF3/JH4 | HGNFGNS---------------YISYWAY | 1626 |
| MA_10-G2_CC_x_I2C0_x_scFc_(T1S)_translation Fv#2 | VH3\|3-73/D3\|3-3\|RF3/JH4 | HGNFGNS---------------YISYWAY | 1627 |
| MA_10-G5_CC_x_I2C0_x_scFc_(S9O)_translation Fv#2 | VH3\|3-73/D3\|3-3\|RF3/JH4 | HGNFGNS---------------YISYWAY | 1628 |
| MA_10-G10_AS_CC_x_I2C0_x_scFc_(T1I)_translation Fv#2 | VH3\|3-73/D3\|3-3\|RF3/JH4 | HGNFGNS---------------YISYWAY | 1629 |
| MA_10-G10_CC_x_I2C0_x_scFc_(B3A)_translation Fv#2 | VH3\|3-73/D3\|3-3\|RF3/JH4 | HGNFGNS---------------YISYWAY | 1630 |
| MA_10-H1_CC_x_I2C0_x_scFc_(T9K)_translation Fv#2 | VH3\|3-73/D3\|3-3\|RF3/JH4 | HGNFGNS---------------YISYWAY | 1631 |
| MA_10-H3_CC_x_I2C0_x_scFc_(M9L)_translation Fv#2 | VH3\|3-73/D3\|3-3\|RF3/JH4 | HGNFGNS---------------YISYWAY | 1632 |
| MA_81-B9_CC_x_I2C0_x_scFc_(U4L)_translation Fv#2 | VH3\|3-73/D3\|3-3\|RF3/JH4 | HGNFGNS---------------YISYWAY | 1633 |
| MA_86-A4_CC_x_I2C0_x_scFc_(K2W)_translation Fv#2 | VH3\|3-73/D3\|3-3\|RF3/JH4 | HGNFGNS---------------YISYWAY | 1634 |
| MA_86-A4-F5_CC_x_I2C0_x_scFc_(M4H)_translation Fv#2 | VH3\|3-73/D3\|3-3\|RF3/JH4 | HGNFGNS---------------YISYWAY | 1635 |
| MA_88-B3-F9_CC_x_I2C0_x_scFc_(Y4E)_translation Fv#2 | VH3\|3-73/D3\|3-3\|RF3/JH4 | HGNFGNS---------------YISYWAY | 1636 |
| MA_98-C7_CC_x_I2C0_x_scFc_(Y8P)_translation Fv#2 | VH3\|3-73/D3\|3-3\|RF3/JH4 | HGNFGNS---------------YISYWAY | 1637 |
| MA_98-G12_AS_CC_x_I2C0_x_scFc_(Q4Z)_translation Fv#2 | VH3\|3-73/D3\|3-3\|RF3/JH4 | HGNFGNS---------------YISYWAY | 1638 |
| MG_SG-F28_CC_x_I2C0_x_scFc_(D9R)_translation Fv#2 | VH3\|3-73/D3\|3-3\|RF3/JH4 | HGNFGNS---------------YISYWAY | 1639 |
| VH2\|2-70/D2\|2-15\|RF1/JH5 | | RIL*WW*L--------------LLNWFDP | 1640 |
| MA_09-C7_CC_x_I2C0_x_scFc_(K9T)_translation Fv#1 | VH2\|2-70/D2\|2-15\|RF1/JH5 | RRYNWNY---------------ENWFDP | 1641 |
| VH3\|3-15/D3\|3-10\|RF2/_JH6 | | YYYGSGSYYN-----------YYYYYGMDV | 1642 |
| MA_09-E2_CC_x_I2C0_x_scFc_(V8T)_translation Fv#1 | VH3\|3-15/D3\|3-10\|RF2/JH6 | PSYSGSYY------------NYFSVMDV | 1643 |
| MA_09-B5_CC_x_I2C0_x_scFc_(H6H)_translation Fv#1 | VH3\|3-15/D3\|3-10\|RF2/JH6 | PSYSGSYY------------NYFSVMDV | 1644 |
| MA_09-B6_CC_x_I2C0_x_scFc_(I3O)_translation Fv#1 | VH3\|3-15/D3\|3-10\|RF2/JH6 | PSYSGSYY------------NYFSVMDV | 1645 |
| MA_09-D3_CC_x_I2C0_x_scFc_(O6B)_translation Fv#1 | VH3\|3-15/D3\|3-10\|RF2/JH6 | PSYSGSYY------------NYFSVMDV | 1646 |
| MA_10-D6_CC_x_I2C0_x_scFc_(V6Z)_translation Fv#1 | VH3\|3-15/D3\|3-10\|RF2/JH6 | PSYSGSYY------------NYFSVMDV | 1647 |
| MA_10-G2_CC_x_I2C0_x_scFc_(T1S)_translation Fv#1 | VH3\|3-15/D3\|3-10\|RF2/JH6 | PSYSGSYY------------NYFSVMDV | 1648 |
| MA_10-G5_CC_x_I2C0_x_scFc_(S9O)_translation Fv#1 | VH3\|3-15/D3\|3-10\|RF2/JH6 | PSYSGSYY------------NYFSVMDV | 1649 |
| MA_10-H1_CC_x_I2C0_x_scFc_(T9K)_translation Fv#1 | VH3\|3-15/D3\|3-10\|RF2/JH6 | PSYSGSYY------------NYFSVMDV | 1650 |

TABLE 28-continued

BiTE-scFc Variable Region #1 (MAGEB2) Protein Alignment
CDRs defined by Kabat
Alignment numbering defined by Amgen Reference (AHo)

|  | Germline |  | SEQ ID NO: |
|---|---|---|---|
| MA_10-H3_CC_x_I2C0_x_scFc_(M9L)_translation Fv#1 | VH3\|3-15/D3\|3-10\|RF2/JH6 | PSYSGSYY------------- NYFSVMDV | 1651 |
| VH2\|2-05/D2\|2-15\|RF1/JH5 |  | RIL*WW*L-------------- LLNWFDP | 1652 |
| MA_09-F11_CC_x_I2C0_x_scFc_(L6Q)_translation Fv#1 | VH2\|2-05/D2\|2-15\|RF1/JH5 | RRYNWNY--------------- ENWFDP | 1653 |
| MA_09-F12_CC_x_I2C0_x_scFc_(D1U)_translation Fv#1 | VH2\|2-05/D2\|2-15\|RF1/JH5 | RRYNWNY--------------- ENWFDP | 1654 |
| MA_09-G8_CC_x_I2C0_x_scFc_(I6K)_translation Fv#1 | VH2\|2-05/D2\|2-15\|RF1/JH5 | RRYNWNY--------------- ENWFDP | 1655 |
| MA_09-G10_CC_x_I2C0_x_scFc_(C4K)_translation Fv#1 | VH2\|2-05/D2\|2-15\|RF1/JH5 | RRYNWNY--------------- ENWFDP | 1656 |
| MA_09-G11_CC_x_I2C0_x_scFc_(Y9Q)_translation Fv#1 | VH2\|2-05/D2\|2-15\|RF1/JH5 | RRYNWNY--------------- ENWFDP | 1657 |
| MA_09-H7_CC_x_I2C0_x_scFc_(T3S)_translation Fv#1 | VH2\|2-05/D2\|2-15\|RF1/JH5 | RRYNWNY--------------- ENWFDP | 1658 |
| MA_09-H10_CC_x_I2C0_x_scFc_(B6N)_translation Fv#1 | VH2\|2-05/D2\|2-15\|RF1/JH5 | RRYNWNY--------------- ENWEDP | 1659 |
| MA_09-H11_CC_x_I2C0_x_scFc_(I8L)_translation Fv#1 | VH2\|2-05/D2\|2-15\|RF1/JH5 | RRYNWNY--------------- ENWFDP | 1660 |
| VH4\|4-59/D3\|3-3\|RF3/JH4 |  | ITIFGVV--------------- IIYFDY | 1661 |
| MA_81-B9_CC_x_I2C0_x_scFc_(U4L)_translation Fv#1 | VH4\|4-59/D3\|3-3\|RF3/JH4 | GIFGVI---------------- -TYFDY | 1662 |
| VH3\|3-30.3/D1\|1-1\|RF2/JH4 |  | VQLER----------------- --YFDY | 1663 |
| MA_86-A4_CC_x_I2C0_x_scFc_(K2W)_translation Fv#1 | VH3\|3-30.3/D1\|1-1\|RF2/JH4 | GQLL------------------ ---TGY | 1664 |
| MA_86-A4-N-F5_CC_x_I2C0_x_scFc_(M4H)_translation Fv#1 | VH3\|3-30.3/D1\|1-1\|RF2/JH4 | GQLL------------------ ---TGY | 1665 |
| VH3\|3-11/D1\|1-1\|RF3/JH4 |  | YNWND----------------- --YFDY | 1666 |
| MA_88-B3-F9_CC_x_I2C0_x_scFc_(Y4E)_translation Fv#1 | VH3\|3-11/D1\|1-1\|RF3/JH4 | YNYG------------------ --HFDY | 1667 |
| VH4\|4-30._1/D3\|3-10\|RF3/_JH6 Fv#1 |  | ITMVRGVII------------ YYYYYGMDV | 1668 |
| MA_SG-F28_CC_x_I2C0_x_scFc_(D9R)_translation Fv#1 | VH4\|4-30.1/D3\|3-10\|RF3/JH6 | EKMWFGVL------------- | 1669 |
|  |  | H_FR4 |  |
| VH3\|3-23/D6\|6-19\|RF2/JH4 |  | WGQGTLVTVSS | 1751 |
| MA_03-C7_AS_CC_x_I2C0_x_scFc_(G2H)_translation Fv#1 | VH3\|3-23/D6\|6-19\|RF2/JH4 | WGQGTLVTVSS | 1752 |
| MA_03-D8_AS_CC_x_I2C0_x_scFc_(L7E)_translation Fv#1 | VH3\|3-23/D6\|6-19\|RF2/JH4 | WGQGTLVTVSS | 1753 |
| MA_03-D8_CC_x_I2C0_x_scFc_(H6N)_translation Fv#1 | VH3\|3-23/D6\|6-19\|RF2/JH4 | WGQGTLVTVSS | 1754 |
| MA_03-D12_AS_CC_x_I2C0_x_scFc_(L6A)_translation Fv#1 | VH3\|3-23/D6\|6-19\|RF2/JH4 | WGQGTLVTVSS | 1755 |
| MA_03-E7_AS_CC_x_I2C0_x_scFc_(L6M)_translation Fv#1 | VH3\|3-23/D6\|6-19\|RF2/JH4 | WGQGTLVTVSS | 1756 |
| MA_03-E11_AS_CC_x_I2C0_x_scFc_(G2B)_translation Fv#1 | VH3\|3-23/D6\|6-19\|RF2/JH4 | WGQGTLVTVSS | 1757 |
| MA_03-G10_AS_CC_x_I2C0_x_scFc_(N3H)_translation Fv#1 | VH3\|3-23/D6\|6-19\|RF2/JH4 | WGQGTLVTVSS | 1758 |
| MA_03-G11_AS_CC_x_I2C0_x_scFc_(O4R)_translation Fv#1 | VH3\|3-23/D6\|6-19\|RF2/JH4 | WGQGTLVTVSS | 1759 |
| MA_03-H12_AS_CC_x_I2C0_x_scFc_(K5A)_translation Fv#1 | VH3\|3-23/D6\|6-19\|RF2/JH4 | WGQGTLVTVSS | 1760 |
| MA_10-G10_AS_CC_x_I2C0_x_scFc_(T1I)_translation Fv#1 | VH3\|3-23/D6\|6-19\|RF2/JH4 | WGQGTLVTVSS | 1761 |
| MA_10-G10_CC_x_I2C0_x_scFc_(B3A)_translation Fv#1 | VH3\|3-23/D6\|6-19\|RF2/JH4 | WGQGTLVTVSS | 1762 |
| MA_98-C7_CC_x_I2C0_x_scFc_(Y8P)_translation Fv#1 | VH3\|3-23/D6\|6-19\|RF2/JH4 | WGQGTLVTVSS | 1763 |
| MA_98-G12_AS_CC_x_I2C0_x_scFc_(Q4Z)_translation Fv#1 | VH3\|3-23/D6\|6-19\|RF2/JH4 | WGQGTLVTVSS | 1764 |
| VH3\|3-73/D3\|3-3\|RF3/JH4 |  | WGQGTLVTVSS | 1765 |
| MA_03-C7_AS_CC_x_I2C0_x_scFc_(G2H)_translation Fv#2 | VH3\|3-73/D3\|3-3\|RF3/JH4 | WGQGTLVTVSS | 1766 |
| MA_03-D8_AS_CC_x_I2C0_x_scFc_(L7E)_translation Fv#2 | VH3\|3-73/D3\|3-3\|RF3/JH4 | WGQGTLVTVSS | 1767 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| MA_03-D8_CC_x_I2C0_x_scFc_(H6N)_translation Fv#2 | VH3\|3-73/D3\|3-3\|RF3/JH4 | WGQGTLVTVSS | 1768 |
| MA_03-D12_AS_CC_x_I2C0_x_scFc_(L6A)_translation Fv#2 | VH3\|3-73/D3\|3-3\|RF3/JH4 | WGQGTLVTVSS | 1769 |
| MA_03-E7_AS_CC_x_I2C0_x_scFc_(L6M)_translation Fv#2 | VH3\|3-73/D3\|3-3\|RF3/JH4 | WGQGTLVTVSS | 1770 |
| MA_03-E11_AS_CC_x_I2C0_x_scFc_(G2B)_translation Fv#2 | VH3\|3-73/D3\|3-3\|RF3/JH4 | WGQGTLVTVSS | 1771 |
| MA_03-G10_AS_CC_x_I2C0_x_scFc_(N3H)_translation Fv#2 | VH3\|3-73/D3\|3-3\|RF3/JH4 | WGQGTLVTVSS | 1772 |
| MA_03-G11_AS_CC_x_I2C0_x_scFc_(O4R)_translation Fv#2 | VH3\|3-73/D3\|3-3\|RF3/JH4 | WGQGTLVTVSS | 1773 |
| MA_03-H12_AS_CC_x_I2C0_x_scFc_(K5A)_translation Fv#2 | VH3\|3-73/D3\|3-3\|RF3/JH4 | WGQGTLVTVSS | 1774 |
| MA_09-C7_CC_x_I2C0_x_scFc_(K9T)_translation Fv#2 | VH3\|3-73/D3\|3-3\|RF3/JH4 | WGQGTLVTVSS | 1775 |
| MA_09-E2_CC_x_I2C0_x_scFc_(V8T)_translation Fv#2 | VH3\|3-73/D3\|3-3\|RF3/JH4 | WGQGTLVTVSS | 1776 |
| MA_09-F11_CC_x_I2C0_x_scFc_(L6Q)_translation Fv#2 | VH3\|3-73/D3\|3-3\|RF3/JH4 | WGQGTLVTVSS | 1777 |
| MA_09-F12_CC_x_I2C0_x_scFc_(D1U)_translation Fv#2 | VH3\|3-73/D3\|3-3\|RF3/JH4 | WGQGTLVTVSS | 1778 |
| MA_09-G8_CC_x_I2C0_x_scFc_(I6K)_translation Fv#2 | VH3\|3-73/D3\|3-3\|RF3/JH4 | WGQGTLVTVSS | 1779 |
| MA_09-G10_CC_x_I2C0_x_scFc_(C4K)_translation Fv#2 | VH3\|3-73/D3\|3-3\|RF3/JH4 | WGQGTLVTVSS | 1780 |
| MA_09-G11_CC_x_I2C0_x_scFc_(Y9Q)_translation Fv#2 | VH3\|3-73/D3\|3-3\|RF3/JH4 | WGQGTLVTVSS | 1781 |
| MA_09-H7_CC_x_I2C0_x_scFc_(T3S)_translation Fv#2 | VH3\|3-73/D3\|3-3\|RF3/JH4 | WGQGTLVTVSS | 1782 |
| MA_09-H10_CC_x_I2C0_x_scFc_(B6N)_translation Fv#2 | VH3\|3-73/D3\|3-3\|RF3/JH4 | WGQGTLVTVSS | 1783 |
| MA_09-H11_CC_x_I2C0_x_scFc_(I8L)_translation Fv#2 | VH3\|3-73/D3\|3-3\|RF3/JH4 | WGQGTLVTVSS | 1784 |
| MA_10-B5_CC_x_I2C0_x_scFc_(H6H)_translation Fv#2 | VH3\|3-73/D3\|3-3\|RF3/JH4 | WGQGTLVTVSS | 1785 |
| MA_10-B6_CC_x_I2C0_x_scFc_(I3O)_translation Fv#2 | VH3\|3-73/D3\|3-3\|RF3/JH4 | WGQGTLVTVSS | 1786 |
| MA_10-D3_CC_x_I2C0_x_scFc_(O6B)_translation Fv#2 | VH3\|3-73/D3\|3-3\|RF3/JH4 | WGQGTLVTVSS | 1787 |
| MA_10-D6_CC_x_I2C0_x_scFc_(V6Z)_translation Fv#2 | VH3\|3-73/D3\|3-3\|RF3/JH4 | WGQGTLVTVSS | 1788 |
| MA_10-G2_CC_x_I2C0_x_scFc_(T1S)_translation Fv#2 | VH3\|3-73/D3\|3-3\|RF3/JH4 | WGQGTLVTVSS | 1789 |
| MA_10-G5_CC_x_I2C0_x_scFc_(S9O)_translation Fv#2 | VH3\|3-73/D3\|3-3\|RF3/JH4 | WGQGTLVTVSS | 1790 |
| MA_10-G10_AS_CC_x_I2C0_x_scFc_(T1I)_translation Fv#2 | VH3\|3-73/D3\|3-3\|RF3/JH4 | WGQGTLVTVSS | 1791 |
| MA_10-G10_CC_x_I2C0_x_scFc_(B3A)_translation Fv#2 | VH3\|3-73/D3\|3-3\|RF3/JH4 | WGQGTLVTVSS | 1792 |
| MA_10-H1_CC_x_I2C0_x_scFc_(T9K)_translation Fv#2 | VH3\|3-73/D3\|3-3\|RF3/JH4 | WGQGTLVTVSS | 1793 |
| MA_10-H3_CC_x_I2C0_x_scFc_(M9L)_translation Fv#2 | VH3\|3-73/D3\|3-3\|RF3/JH4 | WGQGTLVTVSS | 1794 |
| MA_81-B9_CC_x_I2C0_x_scFc_(U4L)_translation Fv#2 | VH3\|3-73/D3\|3-3\|RF3/JH4 | WGQGTLVTVSS | 1795 |
| MA_86-A4_CC_x_I2C0_x_scFc_(K2W)_translation Fv#2 | VH3\|3-73/D3\|3-3\|RF3/JH4 | WGQGTLVTVSS | 1796 |
| MA_86-A4-F5_CC_x_I2C0_x_scFc_(M4H)_translation Fv#2 | VH3\|3-73/D3\|3-3\|RF3/JH4 | WGQGTLVTVSS | 1797 |
| MA_88-B3-F9_CC_x_I2C0_x_scFc_(Y4E)_translation Fv#2 | VH3\|3-73/D3\|3-3\|RF3/JH4 | WGQGTLVTVSS | 1798 |
| MA_98-C7_CC_x_I2C0_x_scFc_(Y8P)_translation Fv#2 | VH3\|3-73/D3\|3-3\|RF3/JH4 | WGQGTLVTVSS | 1799 |
| MA_98-G12_AS_CC_x_I2C0_x_scFc_(Q4Z)_translation Fv#2 | VH3\|3-73/D3\|3-3\|RF3/JH4 | WGQGTLVTVSS | 1800 |
| MG_SG-F28_CC_x_I2C0_x_scFc_(D9R)_translation Fv#2 | VH3\|3-73/D3\|3-3\|RF3/JH4 | WGQGTLVTVSS | 1801 |
| VH2\|2-70/D2\|2-15\|RF1/JH5 | | WGQGTLVTVSS | 1802 |
| MA_09-C7_CC_x_I2C0_x_scFc_(K9T)_translation Fv#1 | VH2\|2-70/D2\|2-15\|RF1/JH5 | WGQGTLVTVSS | 1803 |

TABLE 28-continued

BiTE-scFc Variable Region #1 (MAGEB2) Protein Alignment
CDRs defined by Kabat
Alignment numbering defined by Amgen Reference (AHo)

| | Germline | | SEQ ID NO: |
|---|---|---|---|
| VH3\|3-15/D3\|3-10\|RF2/_JH6 | | WGQGTTVTVSS | 1804 |
| MA_09-E2_CC_x_I2C0_x_scFc_(V8T)_translation Fv#1 | VH3\|3-15/D3\|3-10\|RF2/JH6 | WGQGTTVTVSS | 1805 |
| MA_09-B5_CC_x_I2C0_x_scFc_(H6H)_translation Fv#1 | VH3\|3-15/D3\|3-10\|RF2/JH6 | WGQGTTVTVSS | 1806 |
| MA_09-B6_CC_x_I2C0_x_scFc_(I3O)_translation Fv#1 | VH3\|3-15/D3\|3-10\|RF2/JH6 | WGQGTTVTVSS | 1807 |
| MA_09-D3_CC_x_I2C0_x_scFc_(O6B)_translation Fv#1 | VH3\|3-15/D3\|3-10\|RF2/JH6 | WGQGTTVTVSS | 1808 |
| MA_10-D6_CC_x_I2C0_x_scFc_(V6Z)_translation Fv#1 | VH3\|3-15/D3\|3-10\|RF2/JH6 | | |
| MA_10-G2_CC_x_I2C0_x_scFc_(T1S)_translation Fv#1 | VH3\|3-15/D3\|3-10\|RF2/JH6 | WGQGTTVTVSS | 1810 |
| MA_10-G5_CC_x_I2C0_x_scFc_(S9O)_translation Fv#1 | VH3\|3-15/D3\|3-10\|RF2/JH6 | WGQGTTVTVSS | 1811 |
| MA_10-H1_CC_x_I2C0_x_scFc_(T9K)_translation Fv#1 | VH3\|3-15/D3\|3-10\|RF2/JH6 | WGQGTTVTVSS | 1812 |
| MA_10-H3_CC_x_I2C0_x_scFc_(M9L)_translation Fv#1 | VH3\|3-15/D3\|3-10\|RF2/JH6 | WGQGTTVTVSS | 1813 |
| VH2\|2-05/D2\|2-15\|RF1/JH5 | | WGQGTLVTVSS | 1814 |
| MA_09-F11_CC_x_I2C0_x_scFc_(L6Q)_translation Fv#1 | VH2\|2-05/D2\|2-15\|RF1/JH5 | WGQGTLVTVSS | 1815 |
| MA_09-F12_CC_x_I2C0_x_scFc_(D1U)_translation Fv#1 | VH2\|2-05/D2\|2-15\|RF1/JH5 | WGQGTLVTVSS | 1816 |
| MA_09-G8_CC_x_I2C0_x_scFc_(I6K)_translation Fv#1 | VH2\|2-05/D2\|2-15\|RF1/JH5 | WGQGTLVTVSS | 1817 |
| MA_09-G10_CC_x_I2C0_x_scFc_(C4K)_translation Fv#1 | VH2\|2-05/D2\|2-15\|RF1/JH5 | WGQGTLVTVSS | 1818 |
| MA_09-G11_CC_x_I2C0_x_scFc_(Y9Q)_translation Fv#1 | VH2\|2-05/D2\|2-15\|RF1/JH5 | WGQGTLVTVSS | 1819 |
| MA_09-H7_CC_x_I2C0_x_scFc_(T3S)_translation Fv#1 | VH2\|2-05/D2\|2-15\|RF1/JH5 | WGQGTLVTVSS | 1820 |
| MA_09-H10_CC_x_I2C0_x_scFc_(B6N)_translation Fv#1 | VH2\|2-05/D2\|2-15\|RF1/JH5 | WGQGTLVTVSS | 1821 |
| MA_09-H11_CC_x_I2C0_x_scFc_(I8L)_translation Fv#1 | VH2\|2-05/D2\|2-15\|RF1/JH5 | WGQGTLVTVSS | 1822 |
| VH4\|4-59/D3\|3-3\|RF3/JH4 | | WGQGTLVTVSS | 1823 |
| MA_81-B9_CC_x_I2C0_x_scFc_(U4L)_translation Fv#1 | VH4\|4-59/D3\|3-3\|RF3/JH4 | WGQGTLVTVSS | 1824 |
| VH3\|3-30.3/D1\|1-1\|RF2/JH4 | | WGQGTLVTVSS | 1825 |
| MA_86-A4_CC_x_I2C0_x_scFc_(K2W)_translation Fv#1 | VH3\|3-30.3/D1\|1-1\|RF2/JH4 | WGQGTLVTVSS | 1826 |
| MA_86-A4-N-F5_CC_x_I2C0_x_scFc_(M4H)_translation Fv#1 | VH3\|3-30.3/D1\|1-1\|RF2/JH4 | WGQGTLVTVSS | 1827 |
| VH3\|3-11/D1\|1-1\|RF3/JH4 | | WGQGTLVTVSS | 1828 |
| MA_88-B3-F9_CC_x_I2C0_x_scFc_(Y4E)_translation Fv#1 | VH3\|3-11/D1\|1-1\|RF3/JH4 | WGQGTLVTVSS | 1829 |
| VH4\|4-30._1/D3\|3-10\|RF3/_JH6 | | WGQGTTVTVSS | 1830 |
| MA_SG-F28_CC_x_I2C0_x_scFc_(D9R)_translation Fv#1 | VH4\|4-30.1/D3\|3-10\|RF3/JH6 | WGQGTTVTVSS | 1831 |

TABLE 29

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| | | K_FR1 | |
| VK1\|O12/JK1 | | DIQMTQSPSSLSASVGDRVTITC | 1832 |
| MA_09-C7_CC_x_I2C0_x_scFc_(K9T)_translation Fv#1 | VK1\|O12/JK1 | ...................... | 1833 |
| MA_09-E2_CC_x_I2C0_x_scFc_(V8T)_translation Fv#1 | VK1\|O12/JK1 | ...................... | 1834 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-F11_CC_x_I2C0_x_scFc_(L6Q)_translation Fv#1 | VK1\|O12/JK1 | ........D............... | 1835 |
| MA_09-F12_CC_x_I2C0_x_scFc_(D1U)_translation Fv#1 | VK1\|O12/JK1 | ........................ | 1836 |
| MA_09-G8_CC_x_I2C0_x_scFc_(I6K)_translation Fv#1 | VK1\|O12/JK1 | ........................ | 1837 |
| MA_09-G10_CC_x_I2C0_x_scFc_(C4K)_translation Fv#1 | VK1\|O12/JK1 | ........................ | 1838 |
| MA_09-G11_CC_x_I2C0_x_scFc_(Y9Q)_translation Fv#1 | VK1\|O12/JK1 | ........................ | 1839 |
| MA_09-H7_CC_x_I2C0_x_scFc_(T3S)_translation Fv#1 | VK1\|O12/JK1 | ........................ | 1840 |
| MA_09-H10_CC_x_I2C0_x_scFc_(B6N)_translation Fv#1 | VK1\|O12/JK1 | ........................ | 1841 |
| MA_09-H11_CC_x_I2C0_x_scFc_(I8L)_translation Fv#1 | VK1\|O12/JK1 | ........................ | 1842 |
| MA_10-B5_CC_x_I2C0_x_scFc_(H6H)_translation Fv#1 | VK1\|O12/JK1 | ........................ | 1843 |
| VK1\|O12/JK2 | | DIQMTQSPSSLSASVGDRVTITC | 1844 |
| MA_10-B6_CC_x_I2C0_x_scFc_(I3O)_translation Fv#1 | VK1\|O12/JK2 | ........................ | 1845 |
| MA_10-H3_CC_x_I2C0_x_scFc_(M9L)_translation Fv#1 | VK1\|O12/JK2 | ........................ | 1846 |
| VK1\|O12/JK3 | | DIQMTQSPSSLSASVGDRVTITC | 1847 |
| MA_10-D3_CC_x_I2C0_x_scFc_(O6B)_translation Fv#1 | VK1\|O12/JK3 | ........................ | 1848 |
| MA_10-D6_CC_x_I2C0_x_scFc_(V6Z)_translation Fv#1 | VK1\|O12/JK3 | ........................ | 1849 |
| MA_10-G2_CC_x_I2C0_x_scFc_(T1S)_translation Fv#1 | VK1\|O12/JK3 | ........................ | 1850 |
| MA_10-G5_CC_x_I2C0_x_scFc_(S9O)_translation Fv#1 | VK1\|O12/JK3 | ........................ | 1851 |
| MA_10-H1_CC_x_I2C0_x_scFc_(T9K)_translation Fv#1 | VK1\|O12/JK3 | ........................ | 1852 |
| VK4\|B3/JK5 | | DIVMTQSPDSLAVSLGERATINC | 1853 |
| MA_81-B9_CC_x_I2C_x_scFc_(U4L)_translation Fv#1 | VK4\|B3/JK5 | ........................ | 1854 |
| VK1\|A20/JK1 | | DIQMTQSPSSLSASVGDRVTITC | 1855 |
| MA_86-A4_CC_x_I2C0_x_scFc_(K2W)_translation Fv#1 | VK1\|A20/JK1 | ........................ | 1856 |
| MA_86-A4-N-F5_CC_x_I2C0_x_scFc_(M4H)_translation Fv#1 | VK1\|A20/JK1 | ........................ | 1857 |
| VK2\|O1/JK1 | | DIVMTQTPLSLPVTPGEPASISC | 1858 |
| MA_SG-F28_CC_x_I2C0_x_scFc_(D9R)_translation Fv#1 | VK2\|O1/JK1 | ........................ | 1859 |
| | | K CDR1 | |
| VK1\|O12/JK1 | | RAS--QSIS------SYLN | 1994 |
| MA_09-C7_CC_x_I2C0_x_scFc_(K9T)_translation Fv#1 | VK1\|O12/JK1 | ...............N.F. | 1995 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_09-E2_CC_x_I2C0_x_scFc_(V8T)_translation Fv#1 | VK1\|O12/JK1 | .T................ | 1996 |
| MA_09-F11_CC_x_I2C0_x_scFc_(L6Q)_translation Fv#1 | VK1\|O12/JK1 | Q.....D........N... | 1997 |
| MA_09-F12_CC_x_I2C0_x_scFc_(D1U)_translation Fv#1 | VK1\|O12/JK1 | Q.....D........N... | 1998 |
| MA_09-G8_CC_x_I2C0_x_scFc_(I6K)_translation Fv#1 | VK1\|O12/JK1 | Q.....D........N... | 1999 |
| MA_09-G10_CC_x_I2C0_x_scFc_(C4K)_translation Fv#1 | VK1\|O12/JK1 | Q.....D........N.F. | 2000 |
| MA_09-G11_CC_x_I2C0_x_scFc_(Y9Q)_translation Fv#1 | VK1\|O12/JK1 | ......F............ | 2001 |
| MA_09-H7_CC_x_I2C0_x_scFc_(T3S)_translation Fv#1 | VK1\|O12/JK1 | Q.....D........N... | 2002 |
| MA_09-H10_CC_x_I2C0_x_scFc_(B6N)_translation Fv#1 | VK1\|O12/JK1 | Q.....D........N... | 2003 |
| MA_09-H11_CC_x_I2C0_x_scFc_(I8L)_translation Fv#1 | VK1\|O12/JK1 | ......F............ | 2004 |
| MA_10-B5_CC_x_I2C0_x_scFc_(H6H)_translation Fv#1 | VK1\|O12/JK1 | .T................ | 2005 |
| VK1\|O12/JK2 |  | RAS--QSIS------SYLN | 2006 |
| MA_10-B6_CC_x_I2C0_x_scFc_(I3O)_translation Fv#1 | VK1\|O12/JK2 | .T................ | 2007 |
| MA_10-H3_CC_x_I2C0_x_scFc_(M9L)_translation Fv#1 | VK1\|O12/JK2 | .T................ | 2008 |
| VK1\|O12/JK3 |  | RAS--QSIS------SYLN | 2009 |
| MA_10-D3_CC_x_I2C0_x_scFc_(O6B)_translation Fv#1 | VK1\|O12/JK3 | .T................ | 2010 |
| MA_10-D6_CC_x_I2C0_x_scFc_(V6Z)_translation Fv#1 | VK1\|O12/JK3 | .T................ | 2011 |
| MA_10-G2_CC_x_I2C0_x_scFc_(T1S)_translation Fv#1 | VK1\|O12/JK3 | .T................ | 2012 |
| MA_10-G5_CC_x_I2C0_x_scFc_(S9O)_translation Fv#1 | VK1\|O12/JK3 | .T................ | 2013 |
| MA_10-H1_CC_x_I2C0_x_scFc_(T9K)_translation Fv#1 | VK1\|O12/JK3 | .T................ | 2014 |
| VK4\|B3/JK5 |  | KSS--QSVLYSSNNKNYLA | 2015 |
| MA_81-B9_CC_x_I2C_x_scFc_(U4L)_translation Fv#1 | VK4\|B3/JK5 | ................... | 2016 |
| VK1\|A20/JK1 |  | RAS--QGIS------NYLA | 2017 |
| MA_86-A4_CC_x_I2C0_x_scFc_(K2W)_translation Fv#1 | VK1\|A20/JK1 | ................... | 2018 |
| MA_86-A4-N-F5_CC_x_I2C0_x_scFc_(M4H)_translation Fv#1 | VK1\|A20/JK1 | ................... | 2019 |
| VK2\|O1/JK1 |  | RSS--QSLLDSDDGNTYLD | 2020 |
| MA_SG-F28_CC_x_I2C0_x_scFc_(D9R)_translation Fv#1 | VK2\|O1/JK1 | .........HRS-.YN... | 2021 |
| VK1\|O12/JK1 |  | WYQQKPGKAPKLLIY | 2156 |
| MA_09-C7_CC_x_I2C0_x_scFc_(K9T)_translation Fv#1 | VK1\|O12/JK1 | ............... | 2157 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-E2_CC_x_I2C0_x_scFc_(V8T)_translation Fv#1 | VK1\|O12/JK1 | .......R......F | 2158 |
| MA_09-F11_CC_x_I2C0_x_scFc_(L6Q)_translation Fv#1 | VK1\|O12/JK1 | ............... | 2159 |
| MA_09-F12_CC_x_I2C0_x_scFc_(D1U)_translation Fv#1 | VK1\|O12/JK1 | ............... | 2160 |
| MA_09-G8_CC_x_I2C0_x_scFc_(I6K)_translation Fv#1 | VK1\|O12/JK1 | ............... | 2161 |
| MA_09-G10_CC_x_I2C0_x_scFc_(C4K)_translation Fv#1 | VK1\|O12/JK1 | ............... | 2162 |
| MA_09-G11_CC_x_I2C0_x_scFc_(Y9Q)_translation Fv#1 | VK1\|O12/JK1 | ............... | 2163 |
| MA_09-H7_CC_x_I2C0_x_scFc_(T3S)_translation Fv#1 | VK1\|O12/JK1 | ............... | 2164 |
| MA_09-H10_CC_x_I2C0_x_scFc_(B6N)_translation Fv#1 | VK1\|O12/JK1 | ............... | 2165 |
| MA_09-H11_CC_x_I2C0_x_scFc_(I8L)_translation Fv#1 | VK1\|O12/JK1 | ............... | 2166 |
| MA_10-B5_CC_x_I2C0_x_scFc_(H6H)_translation Fv#1 | VK1\|O12/JK1 | .......R......F | 2167 |
| VK1\|O12/JK2 | VK1\|O12/JK2 | WYQQKPGKAPKLLIY | 2168 |
| MA_10-B6_CC_x_I2C0_x_scFc_(I3O)_translation Fv#1 | VK1\|O12/JK2 | .......R......F | 2169 |
| MA_10-H3_CC_x_I2C0_x_scFc_(M9L)_translation Fv#1 | VK1\|O12/JK2 | .......R......F | 2170 |
| VK1\|O12/JK3 | VK1\|O12/JK3 | WYQQKPGKAPKLLIY | 2171 |
| MA_10-D3_CC_x_I2C0_x_scFc_(O6B)_translation Fv#1 | VK1\|O12/JK3 | .......R......F | 2172 |
| MA_10-D6_CC_x_I2C0_x_scFc_(V6Z)_translation Fv#1 | VK1\|O12/JK3 | .......R......F | 2173 |
| MA_10-G2_CC_x_I2C0_x_scFc_(T1S)_translation Fv#1 | VK1\|O12/JK3 | .F............F | 2174 |
| MA_10-G5_CC_x_I2C0_x_scFc_(S9O)_translation Fv#1 | VK1\|O12/JK3 | .......R......F | 2175 |
| MA_10-H1_CC_x_I2C0_x_scFc_(T9K)_translation Fv#1 | VK1\|O12/JK3 | .......R......F | 2176 |
| VK4\|B3/JK5 | VK4\|B3/JK5 | WYQQKPGQPPKLLIY | 2177 |
| MA_81-B9_CC_x_I2C_x_scFc_(U4L)_translation Fv#1 | VK4\|B3/JK5 | ............... | 2178 |
| VK1\|A20/JK1 | VK1\|A20/JK1 | WYQQKPGKVPKLLIY | 2179 |
| MA_86-A4_CC_x_I2C0_x_scFc_(K2W)_translation Fv#1 | VK1\|A20/JK1 | ............... | 2180 |
| MA_86-A4-N-F5_CC_x_I2C0_x_scFc_(M4H)_translation Fv#1 | VK1\|A20/JK1 | ............... | 2181 |
| VK2\|O1/JK1 | VK2\|O1/JK1 | WYLQKPGQSPQLLIY | 2182 |
| MA_SG-F28_CC_x_I2C0_x_scFc_(D9R)_translation Fv#1 | VK2\|O1/JK1 | ............... | 2183 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | L_FR1 | SEQ ID NO: |
|---|---|---|---|
| VL3\|3h/JL2 | | SYVLTQP-PSVSVAPGKTARITC | 1860 |
| MA_03-C7_AS_CC_x_I2C0_x_scFc_(G2H)_translation Fv#1 | VL3\|3h/JL2 | ................Q...... | 1861 |
| MA_03-D12_AS_CC_x_I2C0_x_scFc_(L6A)_translation Fv#1 | VL3\|3h/JL2 | ................Q...... | 1862 |
| MA_03-E11_AS_CC_x_I2C0_x_scFc_(G2B)_translation Fv#1 | VL3\|3h/JL2 | ................Q...... | 1863 |
| MA_03-G10_AS_CC_x_I2C0_x_scFc_(N3H)_translation Fv#1 | VL3\|3h/JL2 | ................Q...... | 1864 |
| MA_03-G11_AS_CC_x_I2C0_x_scFc_(O4R)_translation Fv#1 | VL3\|3h/JL2 | ................Q...... | 1865 |
| MA_10-G10_AS_CC_x_I2C0_x_scFc_(T1I)_translation Fv#1 | VL3\|3h/JL2 | ................Q...... | 1866 |
| MA_10-G10_CC_x_I2C0_x_scFc_(B3A)_translation Fv#1 | VL3\|3h/JL2 | ................Q...... | 1867 |
| MA_88-B3-F9_CC_x_I2C0_x_scFc_(Y4E)_translation Fv#1 | VL3\|3h/JL2 | ................Q...... | 1868 |
| MA_98-C7_CC_x_I2C0_x_scFc_(Y8P)_translation Fv#1 | VL3\|3h/JL2 | ................Q...... | 1869 |
| MA_98-G12_AS_CC_x_I2C0_x_scFc_(Q4Z)_translation Fv#1 | VL3\|3h/JL2 | ................Q...... | 1870 |
| VL7\|7a/JL3b | | QTVVTQE-PSLTVSPGGTVTLTC | 1871 |
| MA_03-C7_AS_CC_x_I2C0_x_scFc_(G2H)_translation Fv#2 | VL7\|7a/JL3b | ....................... | 1872 |
| MA_03-D8_AS_CC_x_I2C0_x_scFc_(L7E)_translation Fv#2 | VL7\|7a/JL3b | ....................... | 1873 |
| MA_03-D8_CC_x_I2C0_x_scFc_(H6N)_translation Fv#2 | VL7\|7a/JL3b | ....................... | 1874 |
| MA_03-D12_AS_CC_x_I2C0_x_scFc_(L6A)_translation Fv#2 | VL7\|7a/JL3b | ....................... | 1875 |
| MA_03-E7_AS_CC_x_I2C0_x_scFc_(L6M)_translation Fv#2 | VL7\|7a/JL3b | ....................... | 1876 |
| MA_03-E11_AS_CC_x_I2C0_x_scFc_(G2B)_translation Fv#2 | VL7\|7a/JL3b | ....................... | 1877 |
| MA_03-G10_AS_CC_x_I2C0_x_scFc_(N3H)_translation Fv#2 | VL7\|7a/JL3b | ....................... | 1878 |
| MA_03-G11_AS_CC_x_I2C0_x_scFc_(O4R)_translation Fv#2 | VL7\|7a/JL3b | ....................... | 1879 |
| MA_03-H12_AS_CC_x_I2C0_x_scFc_(K5A)_translation Fv#2 | VL7\|7a/JL3b | ....................... | 1880 |
| MA_09-C7_CC_x_I2C0_x_scFc_(K9T)_translation Fv#2 | VL7\|7a/JL3b | ....................... | 1881 |
| MA_09-E2_CC_x_I2C0_x_scFc_(V8T)_translation Fv#2 | VL7\|7a/JL3b | ....................... | 1882 |
| MA_09-F11_CC_x_I2C0_x_scFc_(L6Q)_translation Fv#2 | VL7\|7a/JL3b | ....................... | 1883 |
| MA_09-F12_CC_x_I2C0_x_scFc_(D1U)_translation Fv#2 | VL7\|7a/JL3b | ....................... | 1884 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-G8_CC_x_I2C0_x_scFc_(I6K)_translation Fv#2 | VL7\|7a/JL3b | .................. | 1885 |
| MA_09-G10_CC_x_I2C0_x_scFc_(C4K)_translation Fv#2 | VL7\|7a/JL3b | ...................... | 1886 |
| MA_09-G11_CC_x_I2C0_x_scFc_(Y9Q)_translation Fv#2 | VL7\|7a/JL3b | ...................... | 1887 |
| MA_09-H7_CC_x_I2C0_x_scFc_(T3S)_translation Fv#2 | VL7\|7a/JL3b | ...................... | 1888 |
| MA_09-H10_CC_x_I2C0_x_scFc_(B6N)_translation Fv#2 | VL7\|7a/JL3b | ...................... | 1889 |
| MA_09-H11_CC_x_I2C0_x_scFc_(I8L)_translation Fv#2 | VL7\|7a/JL3b | ...................... | 1890 |
| MA_10-B5_CC_x_I2C0_x_scFc_(H6H)_translation Fv#2 | VL7\|7a/JL3b | ...................... | 1891 |
| MA_10-B6_CC_x_I2C0_x_scFc_(I3O)_translation Fv#2 | VL7\|7a/JL3b | ...................... | 1892 |
| MA_10-D3_CC_x_I2C0_x_scFc_(O6B)_translation Fv#2 | VL7\|7a/JL3b | ...................... | 1893 |
| MA_10-D6_CC_x_I2C0_x_scFc_(V6Z)_translation Fv#2 | VL7\|7a/JL3b | ...................... | 1894 |
| MA_10-G2_CC_x_I2C0_x_scFc_(T1S)_translation Fv#2 | VL7\|7a/JL3b | ...................... | 1895 |
| MA_10-G5_CC_x_I2C0_x_scFc_(S9O)_translation Fv#2 | VL7\|7a/JL3b | ...................... | 1896 |
| MA_10-G10_AS_CC_x_I2C0_x_scFc_(T1I)_translation Fv#2 | VL7\|7a/JL3b | ...................... | 1897 |
| MA_10-G10_CC_x_I2C0_x_scFc_(B3A)_translation Fv#2 | VL7\|7a/JL3b | ...................... | 1898 |
| MA_10-H1_CC_x_I2C0_x_scFc_(T9K)_translation Fv#2 | VL7\|7a/JL3b | ...................... | 1899 |
| MA_10-H3_CC_x_I2C0_x_scFc_(M9L)_translation Fv#2 | VL7\|7a/JL3b | ...................... | 1900 |
| MA_81-B9_CC_x_I2C0_x_scFc_(U4L)_translation Fv#2 | VL7\|7a/JL3b | ...................... | 1901 |
| MA_86-A4_CC_x_I2C0_x_scFc_(K2W)_translation Fv#2 | VL7\|7a/JL3b | ...................... | 1902 |
| MA_86-A4-N-F5_CC_x_I2C0_x_scFc_(M4H)_translation Fv#2 | VL7\|7a/JL3b | ...................... | 1903 |
| MA_88-B3-F9_CC_x_I2C0_x_scFc_(Y4E)_translation Fv#2 | VL7\|7a/JL3b | ...................... | 1904 |
| MA_98-C7_CC_x_I2C0_x_scFc_(Y8P)_translation Fv#2 | VL7\|7a/JL3b | ...................... | 1905 |
| MA_98-G12_AS_CC_x_I2C0_x_scFc_(Q4Z)_translation Fv#2 | VL7\|7a/JL3b | ...................... | 1906 |
| MA_SG-F28_CC_x_I2C0_x_scFc_(D9R)_translationFv#2 | VL7\|7a/JL3b | ...................... | 1907 |
| VL3\|3h/JL3b | | SYVLTQP-PSVSVAPGKTARITC | 1908 |
| MA_03-D8_AS_CC_x_I2C0_x_scFc_(L7E)_translation Fv#1 | VL3\|3h/JL3b | | 1909 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_03-D8_CC_x_I2C0_x_scFc_(H6N)_translation Fv#1 | VL3\|3h/JL3b | ................Q...... | 1910 |
| MA_03-E7_AS_CC_x_I2C0_x_scFc_(L6M)_translation Fv#1 | VL3\|3h/JL3b | ................Q...... | 1911 |
| MA_03-H12_AS_CC_x_I2C0_x_scFc_(K5A)_translation Fv#1 | VL3\|3h/JL3b | ................Q...... | 1912 |
| | | L_CDR1 | |
| VL3\|3h/JL2 | | GGN---NIGS-----KSVH | 2022 |
| MA_03-C7_AS_CC_x_I2C0_x_scFc_(G2H)_translation Fv#1 | VL3\|3h/JL2 | ................... | 2023 |
| MA_03-D12_AS_CC_x_I2C0_x_scFc_(L6A)_translation Fv#1 | VL3\|3h/JL2 | ................... | 2024 |
| MA_03-E11_AS_CC_x_I2C0_x_scFc_(G2B)_translation Fv#1 | VL3\|3h/JL2 | ................... | 2025 |
| MA_03-G10_AS_CC_x_I2C0_x_scFc_(N3H)_translation Fv#1 | VL3\|3h/JL2 | ................... | 2026 |
| MA_03-G11_AS_CC_x_I2C0_x_scFc_(O4R)_translation Fv#1 | VL3\|3h/JL2 | ................... | 2027 |
| MA_10-G10_AS_CC_x_I2C0_x_scFc_(T1I)_translation Fv#1 | VL3\|3h/JL2 | ................... | 2028 |
| MA_10-G10_CC_x_I2C0_x_scFc_(B3A)_translation Fv#1 | VL3\|3h/JL2 | ................... | 2029 |
| MA_88-B3-F9_CC_x_I2C0_x_scFc_(Y4E)_translation Fv#1 | VL3\|3h/JL2 | ................... | 2030 |
| MA_98-C7_CC_x_I2C0_x_scFc_(Y8P)_translation Fv#1 | VL3\|3h/JL2 | ................... | 2031 |
| MA_98-G12_AS_CC_x_I2C0_x_scFc_(Q4Z)_translation Fv#1 | VL3\|3h/JL2 | ................... | 2032 |
| VL7\|7a/JL3b | | ASST-GAVTSG----YYPN | 2033 |
| MA_03-C7_AS_CC_x_I2C0_x_scFc_(G2H)_translation Fv#2 | VL7\|7a/JL3b | G..............N... | 2034 |
| MA_03-D8_AS_CC_x_I2C0_x_scFc_(L7E)_translation Fv#2 | VL7\|7a/JL3b | G..............N... | 2035 |
| MA_03-D8_CC_x_I2C0_x_scFc_(H6N)_translation Fv#2 | VL7\|7a/JL3b | G..............N... | 2036 |
| MA_03-D12_AS_CC_x_I2C0_x_scFc_(L6A)_translation Fv#2 | VL7\|7a/JL3b | G..............N... | 2037 |
| MA_03-E7_AS_CC_x_I2C0_x_scFc_(L6M)_translation Fv#2 | VL7\|7a/JL3b | G..............N... | 2038 |
| MA_03-E11_AS_CC_x_I2C0_x_scFc_(G2B)_translation Fv#2 | VL7\|7a/JL3b | G..............N... | 2039 |
| MA_03-G10_AS_CC_x_I2C0_x_scFc_(N3H)_translation Fv#2 | VL7\|7a/JL3b | G..............N... | 2040 |
| MA_03-G11_AS_CC_x_I2C0_x_scFc_(O4R)_translation Fv#2 | VL7\|7a/JL3b | G..............N... | 2041 |
| MA_03-H12_AS_CC_x_I2C0_x_scFc_(K5A)_translation Fv#2 | VL7\|7a/JL3b | G..............N... | 2042 |
| MA_09-C7_CC_x_I2C0_x_scFc_(K9T)_translation Fv#2 | VL7\|7a/JL3b | G..............N... | 2043 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  |  | SEQ ID NO: |
|---|---|---|---|---|
| MA_09-E2_CC_x_I2C0_x_scFc_(V8T)_translation Fv#2 | VL7\|7a/JL3b | G..............N... |  | 2044 |
| MA_09-F11_CC_x_I2C0_x_scFc_(L6Q)_translation Fv#2 | VL7\|7a/JL3b | G..............N... |  | 2045 |
| MA_09-F12_CC_x_I2C0_x_scFc_(D1U)_translation Fv#2 | VL7\|7a/JL3b | G..............N... |  | 2046 |
| MA_09-G8_CC_x_I2C0_x_scFc_(I6K)_translation Fv#2 | VL7\|7a/JL3b | G..............N... |  | 2047 |
| MA_09-G10_CC_x_I2C0_x_scFc_(C4K)_translation Fv#2 | VL7\|7a/JL3b | G..............N... |  | 2048 |
| MA_09-G11_CC_x_I2C0_x_scFc_(Y9Q)_translation Fv#2 | VL7\|7a/JL3b | G..............N... |  | 2049 |
| MA_09-H7_CC_x_I2C0_x_scFc_(T3S)_translation Fv#2 | VL7\|7a/JL3b | G..............N... |  | 2050 |
| MA_09-H10_CC_x_I2C0_x_scFc_(B6N)_translation Fv#2 | VL7\|7a/JL3b | G..............N... |  | 2051 |
| MA_09-H11_CC_x_I2C0_x_scFc_(I8L)_translation Fv#2 | VL7\|7a/JL3b | G..............N... |  | 2052 |
| MA_10-B5_CC_x_I2C0_x_scFc_(H6H)_translation Fv#2 | VL7\|7a/JL3b | G..............N... |  | 2053 |
| MA_10-B6_CC_x_I2C0_x_scFc_(I3O)_translation Fv#2 | VL7\|7a/JL3b | G..............N... |  | 2054 |
| MA_10-D3_CC_x_I2C0_x_scFc_(O6B)_translation Fv#2 | VL7\|7a/JL3b | G..............N... |  | 2055 |
| MA_10-D6_CC_x_I2C0_x_scFc_(V6Z)_translation Fv#2 | VL7\|7a/JL3b | G..............N... |  | 2056 |
| MA_10-G2_CC_x_I2C0_x_scFc_(T1S)_translation Fv#2 | VL7\|7a/JL3b | G..............N... |  | 2057 |
| MA_10-G5_CC_x_I2C0_x_scFc_(S9O)_translation Fv#2 | VL7\|7a/JL3b | G..............N... |  | 2058 |
| MA_10-G10_AS_CC_x_I2C0_x_scFc_(T1I)_translation Fv#2 | VL7\|7a/JL3b | G..............N... |  | 2059 |
| MA_10-G10_CC_x_I2C0_x_scFc_(B3A)_translation Fv#2 | VL7\|7a/JL3b | G..............N... |  | 2060 |
| MA_10-H1_CC_x_I2C0_x_scFc_(T9K)_translation Fv#2 | VL7\|7a/JL3b | G..............N... |  | 2061 |
| MA_10-H3_CC_x_I2C0_x_scFc_(M9L)_translation Fv#2 | VL7\|7a/JL3b | G..............N... |  | 2062 |
| MA_81-B9_CC_x_I2C0_x_scFc_(U4L)_translation Fv#2 | VL7\|7a/JL3b | G..............N... |  | 2063 |
| MA_86-A4_CC_x_I2C0_x_scFc_(K2W)_translation Fv#2 | VL7\|7a/JL3b | G..............N... |  | 2064 |
| MA_86-A4-N-F5_CC_x_I2C0_x_scFc_(M4H)_translation Fv#2 | VL7\|7a/JL3b | G..............N... |  | 2065 |
| MA_88-B3-F9_CC_x_I2C0_x_scFc_(Y4E)_translation Fv#2 | VL7\|7a/JL3b | G..............N... |  | 2066 |
| MA_98-C7_CC_x_I2C0_x_scFc_(Y8P)_translation Fv#2 | VL7\|7a/JL3b | G..............N... |  | 2067 |
| MA_98-G12_AS_CC_x_I2C0_x_scFc_(Q4Z)_translation Fv#2 | VL7\|7a/JL3b | G..............N... |  | 2068 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_SG-F28_CC_x_I2C0_x_scFc_(D9R)_translationFv#2 | VL7\|7a/JL3b | G....N.<br>G..............N... | 2069 |
| VL3\|3h/JL3b | | GGN---NIGS-----KSVH | 2070 |
| MA_03-D8_AS_CC_x_I2C0_x_scFc_(L7E)_translation Fv#1 | VL3\|3h/JL3b | .................... | 2071 |
| MA_03-D8_CC_x_I2C0_x_scFc_(H6N)_translation Fv#1 | VL3\|3h/JL3b | .................... | 2072 |
| MA_03-E7_AS_CC_x_I2C0_x_scFc_(L6M)_translation Fv#1 | VL3\|3h/JL3b | .................... | 2073 |
| MA_03-H12_AS_CC_x_I2C0_x_scFc_(K5A)_translation Fv#1 | VL3\|3h/JL3b | .................... | 2074 |
| | | L_FR2 | |
| VL3\|3h/JL2 | | WYQQKPGQAPVLVIY | 2184 |
| MA_03-C7_AS_CC_x_I2C0_x_scFc_(G2H)_translation Fv#1 | VL3\|3h/JL2 | ...........M.V. | 2185 |
| MA_03-D12_AS_CC_x_I2C0_x_scFc_(L6A)_translation Fv#1 | VL3\|3h/JL2 | ...........M.V. | 2186 |
| MA_03-E11_AS_CC_x_I2C0_x_scFc_(G2B)_translation Fv#1 | VL3\|3h/JL2 | ...........M.V. | 2187 |
| MA_03-G10_AS_CC_x_I2C0_x_scFc_(N3H)_translation Fv#1 | VL3\|3h/JL2 | ...........M.V. | 2188 |
| MA_03-G11_AS_CC_x_I2C0_x_scFc_(O4R)_translation Fv#1 | VL3\|3h/JL2 | ...............V. | 2189 |
| MA_10-G10_AS_CC_x_I2C0_x_scFc_(T1I)_translation Fv#1 | VL3\|3h/JL2 | ...........M.V. | 2190 |
| MA_10-G10_CC_x_I2C0_x_scFc_(B3A)_translation Fv#1 | VL3\|3h/JL2 | ...........M.V. | 2191 |
| MA_88-B3-F9_CC_x_I2C0_x_scFc_(Y4E)_translation Fv#1 | VL3\|3h/JL2 | ...............V. | 2192 |
| MA_98-C7_CC_x_I2C0_x_scFc_(Y8P)_translation Fv#1 | VL3\|3h/JL2 | ...........M.V. | 2193 |
| MA_98-G12_AS_CC_x_I2C0_x_scFc_(Q4Z)_translation Fv#1 | VL3\|3h/JL2 | ...........M.V. | 2194 |
| | | L FR2 | |
| VL7\|7a/JL3b | | WFQQKPGQAPRALIY | 2195 |
| MA_03-C7_AS_CC_x_I2C0_x_scFc_(G2H)_translation Fv#2 | VL7\|7a/JL3b | .V.........G..G | 2196 |
| MA_03-D8_AS_CC_x_I2C0_x_scFc_(L7E)_translation Fv#2 | VL7\|7a/JL3b | .V.........G..G | 2197 |
| MA_03-D8_CC_x_I2C0_x_scFc_(H6N)_translation Fv#2 | VL7\|7a/JL3b | .V.........G..G | 2198 |
| MA_03-D12_AS_CC_x_I2C0_x_scFc_(L6A)_translation Fv#2 | VL7\|7a/JL3b | .V.........G..G | 2199 |
| MA_03-E7_AS_CC_x_I2C0_x_scFc_(L6M)_translation Fv#2 | VL7\|7a/JL3b | .V.........G..G | 2200 |
| MA_03-E11_AS_CC_x_I2C0_x_scFc_(G2B)_translation Fv#2 | VL7\|7a/JL3b | .V.........G..G | 2201 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_03-G10_AS_CC_x_I2C0_x_scFc_(N3H)_translation Fv#2 | VL7\|7a/JL3b | .V.........G..G | 2202 |
| MA_03-G11_AS_CC_x_I2C0_x_scFc_(O4R)_translation Fv#2 | VL7\|7a/JL3b | .V.........G..G | 2203 |
| MA_03-H12_AS_CC_x_I2C0_x_scFc_(K5A)_translation Fv#2 | VL7\|7a/JL3b | .V.........G..G | 2204 |
| MA_09-C7_CC_x_I2C0_x_scFc_(K9T)_translation Fv#2 | VL7\|7a/JL3b | .V.........G..G | 2205 |
| MA_09-E2_CC_x_I2C0_x_scFc_(V8T)_translation Fv#2 | VL7\|7a/JL3b | .V.........G..G | 2206 |
| MA_09-F11_CC_x_I2C0_x_scFc_(L6Q)_translation Fv#2 | VL7\|7a/JL3b | .V.........G..G | 2207 |
| MA_09-F12_CC_x_I2C0_x_scFc_(D1U)_translation Fv#2 | VL7\|7a/JL3b | .V.........G..G | 2208 |
| MA_09-G8_CC_x_I2C0_x_scFc_(I6K)_translation Fv#2 | VL7\|7a/JL3b | .V.........G..G | 2209 |
| MA_09-G10_CC_x_I2C0_x_scFc_(C4K)_translation Fv#2 | VL7\|7a/JL3b | .V.........G..G | 2210 |
| MA_09-G11_CC_x_I2C0_x_scFc_(Y9Q)_translation Fv#2 | VL7\|7a/JL3b | .V.........G..G | 2211 |
| MA_09-H7_CC_x_I2C0_x_scFc_(T3S)_translation Fv#2 | VL7\|7a/JL3b | .V.........G..G | 2212 |
| MA_09-H10_CC_x_I2C0_x_scFc_(B6N)_translation Fv#2 | VL7\|7a/JL3b | .V.........G..G | 2213 |
| MA_09-H11_CC_x_I2C0_x_scFc_(I8L)_translation Fv#2 | VL7\|7a/JL3b | .V.........G..G | 2214 |
| MA_10-B5_CC_x_I2C0_x_scFc_(H6H)_translation Fv#2 | VL7\|7a/JL3b | .V.........G..G | 2215 |
| MA_10-B6_CC_x_I2C0_x_scFc_(I3O)_translation Fv#2 | VL7\|7a/JL3b | .V.........G..G | 2216 |
| MA_10-D3_CC_x_I2C0_x_scFc_(O6B)_translation Fv#2 | VL7\|7a/JL3b | .V.........G..G | 2217 |
| MA_10-D6_CC_x_I2C0_x_scFc_(V6Z)_translation Fv#2 | VL7\|7a/JL3b | .V.........G..G | 2218 |
| MA_10-G2_CC_x_I2C0_x_scFc_(T1S)_translation Fv#2 | VL7\|7a/JL3b | .V.........G..G | 2219 |
| MA_10-G5_CC_x_I2C0_x_scFc_(S9O)_translation Fv#2 | VL7\|7a/JL3b | .V.........G..G | 2220 |
| MA_10-G10_AS_CC_x_I2C0_x_scFc_(T1I)_translation Fv#2 | VL7\|7a/JL3b | .V.........G..G | 2221 |
| MA_10-G10_CC_x_I2C0_x_scFc_(B3A)_translation Fv#2 | VL7\|7a/JL3b | .V.........G..G | 2222 |
| MA_10-H1_CC_x_I2C0_x_scFc_(T9K)_translation Fv#2 | VL7\|7a/JL3b | .V.........G..G | 2223 |
| MA_10-H3_CC_x_I2C0_x_scFc_(M9L)_translation Fv#2 | VL7\|7a/JL3b | .V.........G..G | 2224 |
| MA_81-B9_CC_x_I2C0_x_scFc_(U4L)_translation Fv#2 | VL7\|7a/JL3b | .V.........G..G | 2225 |
| MA_86-A4_CC_x_I2C0_x_scFc_(K2W)_translation Fv#2 | VL7\|7a/JL3b | .V.........G..G | 2226 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_86-A4-N-F5_CC_x_I2C0_x_scFc_(M4H)_translation Fv#2 | VL7\|7a/JL3b | .V.........G..G | 2227 |
| MA_88-B3-F9_CC_x_I2C0_x_scFc_(Y4E)_translation Fv#2 | VL7\|7a/JL3b | .V.........G..G | 2228 |
| MA_98-C7_CC_x_I2C0_x_scFc_(Y8P)_translation Fv#2 | VL7\|7a/JL3b | .V.........G..G | 2229 |
| MA_98-G12_AS_CC_x_I2C0_x_scFc_(Q4Z)_translation Fv#2 | VL7\|7a/JL3b | .V.........G..G | 2230 |
| MA_SG-F28_CC_x_I2C0_x_scFc_(D9R)_translationFv#2 | VL7\|7a/JL3b | .V.........G..G | 2231 |
| VL3\|3h/JL3b | | WYQQKPGQAPVLVIY | 2232 |
| MA_03-D8_AS_CC_x_I2C0_x_scFc_(L7E)_translation Fv#1 | VL3\|3h/JL3b | ............M.V. | 2233 |
| MA_03-D8_CC_x_I2C0_x_scFc_(H6N)_translation Fv#1 | VL3\|3h/JL3b | ............M.V. | 2234 |
| MA_03-E7_AS_CC_x_I2C0_x_scFc_(L6M)_translation Fv#1 | VL3\|3h/JL3b | ............M.V. | 2235 |
| MA_03-H12_AS_CC_x_I2C0_x_scFc_(K5A)_translation Fv#1 | VL3\|3h/JL3b | ............M.V. | 2236 |
| | | H_FR1 | |
| VH3\|3-23/D6\|6-19\|RF2/JH4 | | EVQLLES-GGGLVQPGGSLRLSCAASG-FTES | 1913 |
| MA_03-C7_AS_CC_x_I2C0_x_scFc_(G2H)_translation Fv#1 | VH3\|3-23/D6\|6-19\|RF2/JH4 | ................................ | 1914 |
| MA_03-D8_AS_CC_x_I2C0_x_scFc_(L7E)_translation Fv#1 | VH3\|3-23/D6\|6-19\|RF2/JH4 | ................................ | 1915 |
| MA_03-D8_CC_x_I2C0_x_scFc_(H6N)_translation Fv#1 | VH3\|3-23/D6\|6-19\|RF2/JH4 | ................................ | 1916 |
| MA_03-D12_AS_CC_x_I2C0_x_scFc_(L6A)_translaton x Fv#1 | VH3\|3-23/D6\|6-19\|RF2/JH4 | ................................ | 1917 |
| MA_03-E7_AS_CC_x_I2C0_x_scFc_(L6M)_translation Fv#1 | VH3\|3-23/D6\|6-19\|RF2/JH4 | ............V....R.............. | 1918 |
| MA_03-E11_AS_CC_x_I2C0_x_scFc_(G2B)_translation Fv#1 | VH3\|3-23/D6\|6-19\|RF2/JH4 | ................................ | 1919 |
| MA_03-G10_AS_CC_x_I2C0_x_scFc_(N3H)_translation Fv#1 | VH3\|3-23/D6\|6-19\|RF2/JH4 | ................................ | 1920 |
| MA_03-G11_AS_CC_x_I2C0_x_scFc_(O4R)_translation Fv#1 | VH3\|3-23/D6\|6-19\|RF2/JH4 | .............K.................. | 1921 |
| MA_03-H12_AS_CC_x_I2C0_x_scFc_(K5A)_translation Fv#1 | VH3\|3-23/D6\|6-19\|RF2/JH4 | ................................ | 1922 |
| MA_10-G10_AS_CC_x_I2C0_x_scFc_(T1I)_translation Fv#1 | VH3\|3-23/D6\|6-19\|RF2/JH4 | ................................ | 1923 |
| MA_10-G10_CC_x_I2C0_x_scFc_(B3A)_translation Fv#1 | VH3\|3-23/D6\|6-19\|RF2/JH4 | ................................ | 1924 |
| MA_98-C7_CC_x_I2C0_x_scFc_(Y8P)_translation Fv#1 | VH3\|3-23/D6\|6-19\|RF2/JH4 | ................................ | 1925 |
| MA_98-G12_AS_CC_x_I2C0_x_scFc_(Q4Z)_translation Fv#1 | VH3\|3-23/D6\|6-19\|RF2/JH4 | ................................ | 1926 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| VH3\|3-73/D3\|3-3\|RF3/JH4 | | EVQLVES-GGGLVQPGGSLKLSCAASG-FTFS | 1927 |
| MA_03-C7_AS_CC_x_I2C0_x_scFc_(G2H)_translation_Fv#2 | VH3\|3-73/D3\|3-3\|RF3/JH4 | ..............................N | 1928 |
| MA_03-D8_AS_CC_x_I2C0_x_scFc_(L7E)_translation_Fv#2 | VH3\|3-73/D3\|3-3\|RF3/JH4 | ..............................N | 1929 |
| MA_03-D8_CC_x_I2C0_x_scFc_(H6N)_translation_Fv#2 | VH3\|3-73/D3\|3-3\|RF3/JH4 | ..............................N | 1930 |
| MA_03-D12_AS_CC_x_I2C0_x_scFc_(L6A)_translation_Fv#2 | VH3\|3-73/D3\|3-3\|RF3/JH4 | ..............................N | 1931 |
| MA_03-E7_AS_CC_x_I2C0_x_scFc_(L6M)_translation_Fv#2 | VH3\|3-73/D3\|3-3\|RF3/JH4 | ..............................N | 1932 |
| MA_03-E11_AS_CC_x_I2C0_x_scFc_(G2B)_translation_Fv#2 | VH3\|3-73/D3\|3-3\|RF3/JH4 | ..............................N | 1933 |
| MA_03-G10_AS_CC_x_I2C0_x_scFc_(N3H)_translation_Fv#2 | VH3\|3-73/D3\|3-3\|RF3/JH4 | ..............................N | 1934 |
| MA_03-G11_AS_CC_x_I2C0_x_scFc_(O4R)_translation_Fv#2 | VH3\|3-73/D3\|3-3\|RF3/JH4 | ..............................N | 1935 |
| MA_03-H12_AS_CC_x_I2C0_x_scFc_(K5A)_translation_Fv#2 | VH3\|3-73/D3\|3-3\|RF3/JH4 | ..............................N | 1936 |
| MA_09-C7_CC_x_I2C0_x_scFc_(K9T)_translation_Fv#2 | VH3\|3-73/D3\|3-3\|RF3/JH4 | ..............................N | 1937 |
| MA_09-E2_CC_x_I2C0_x_scFc_(V8T)_translation_Fv#2 | VH3\|3-73/D3\|3-3\|RF3/JH4 | ..............................N | 1938 |
| MA_09-F11_CC_x_I2C0_x_scFc_(L6Q)_translation_Fv#2 | VH3\|3-73/D3\|3-3\|RF3/JH4 | ..............................N | 1939 |
| MA_09-F12_CC_x_I2C0_x_scFc_(D1U)_translation_Fv#2 | VH3\|3-73/D3\|3-3\|RF3/JH4 | ..............................N | 1940 |
| MA_09-G8_CC_x_I2C0_x_scFc_(I6K)_translation_Fv#2 | VH3\|3-73/D3\|3-3\|RF3/JH4 | ..............................N | 1941 |
| MA_09-G10_CC_x_I2C0_x_scFc_(C4K)_translation_Fv#2 | VH3\|3-73/D3\|3-3\|RF3/JH4 | ..............................N | 1942 |
| MA_09-G11_CC_x_I2C0_x_scFc_(Y9Q)_translation_Fv#2 | VH3\|3-73/D3\|3-3\|RF3/JH4 | ..............................N | 1943 |
| MA_09-H7_CC_x_I2C0_x_scFc_(T3S)_translation_Fv#2 | VH3\|3-73/D3\|3-3\|RF3/JH4 | ..............................N | 1944 |
| MA_09-H10_CC_x_I2C0_x_scFc_(B6N)_translation_Fv#2 | VH3\|3-73/D3\|3-3\|RF3/JH4 | ..............................N | 1945 |
| MA_09-H11_CC_x_I2C0_x_scFc_(I8L)_translation_Fv#2 | VH3\|3-73/D3\|3-3\|RF3/JH4 | ..............................N | 1946 |
| MA_10-B5_CC_x_I2C0_x_scFc_(H6H)_translation_Fv#2 | VH3\|3-73/D3\|3-3\|RF3/JH4 | ..............................N | 1947 |
| MA_10-B6_CC_x_I2C0_x_scFc_(I3O)_translation_Fv#2 | VH3\|3-73/D3\|3-3\|RF3/JH4 | ..............................N | 1948 |
| MA_10-D3_CC_x_I2C0_x_scFc_(O6B)_translation_Fv#2 | VH3\|3-73/D3\|3-3\|RF3/JH4 | ..............................N | 1949 |
| MA_10-D6_CC_x_I2C0_x_scFc_(V6Z)_translation_Fv#2 | VH3\|3-73/D3\|3-3\|RF3/JH4 | ..............................N | 1950 |
| MA_10-G2_CC_x_I2C0_x_scFc_(T1S)_translation_Fv#2 | VH3\|3-73/D3\|3-3\|RF3/JH4 | ..............................N | 1951 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_10-G5_CC_x_I2C0_x_scFc_(S9O)_translation Fv#2 | VH3\|3-73/D3\|3-3\|RF3/JH4 | ...............................N | 1952 |
| MA_10-G10_AS_CC_x_I2C0_x_scFc_(T1I)_translation Fv#2 | VH3\|3-73/D3\|3-3\|RF3/JH4 | ...............................N | 1953 |
| MA_10-G10_CC_x_I2C0_x_scFc_(B3A)_translation Fv#2 | VH3\|3-73/D3\|3-3\|RF3/JH4 | ...............................N | 1954 |
| MA_10-H1_CC_x_I2C0_x_scFc_(T9K)_translation Fv#2 | VH3\|3-73/D3\|3-3\|RF3/JH4 | ...............................N | 1955 |
| MA_10-H3_CC_x_I2C0_x_scFc_(M9L)_translation Fv#2 | VH3\|3-73/D3\|3-3\|RF3/JH4 | ...............................N | 1956 |
| MA_81-B9_CC_x_I2C0_x_scFc_(U4L)_translation Fv#2 | VH3\|3-73/D3\|3-3\|RF3/JH4 | ...............................N | 1957 |
| MA_86-A4_CC_x_I2C0_x_scFc_(K2W)_translation Fv#2 | VH3\|3-73/D3\|3-3\|RF3/JH4 | ...............................N | 1958 |
| MA_86-A4-N-F5_CC_x_I2C0_x_scFc_(M4H)_translation Fv#2 | VH3\|3-73/D3\|3-3\|RF3/JH4 | ...............................N | 1959 |
| MA_88-B3-F9_CC_x_I2C0_x_scFc_(Y4E)_translation Fv#2 | VH3\|3-73/D3\|3-3\|RF3/JH4 | ...............................N | 1960 |
| MA_98-C7_CC_x_I2C0_x_scFc_(Y8P)_translation Fv#2 | VH3\|3-73/D3\|3-3\|RF3/JH4 | ...............................N | 1961 |
| MA_98-G12_AS_CC_x_I2C0_x_scFc_(Q4Z)_translation Fv#2 | VH3\|3-73/D3\|3-3\|RF3/JH4 | ...............................N | 1962 |
| MA_SG-F28_CC_x_I2C0_x_scFc_(D9R)_translation Fv#2 | VH3\|3-73/D3\|3-3\|RF3/JH4 | ...............................N | 1963 |
| VH2\|2-70/D2\|2-15\|RF1/JH5 | | QVTLKES-GPALVKPTQTLTLTCTFSG-FSLS | 1964 |
| MA_09-C7_CC_x_I2C0_x_scFc_(K9T)_translation Fv#1 | VH2\|2-70/D2\|2-15\|RF1/JH5 | ...............................FT | 1965 |
| VH3\|3-15/D3\|3-10\|RF2/JH6 | | EVQLVES-GGGLVKPGGSLRLSCAASG-FTFS | 1966 |
| MA_09-E2_CC_x_I2C0_x_scFc_(V8T)_translation Fv#1 | VH3\|3-15/D3\|3-10\|RF2/JH6 | ...............Q................ | 1967 |
| MA_10-B5_CC_x_I2C0_x_scFc_(H6H)_translation Fv#1 | VH3\|3-15/D3\|3-10\|RF2/JH6 | ...............Q................ | 1968 |
| MA_10-B6_CC_x_I2C0_x_scFc_(I3O)_translation Fv#1 | VH3\|3-15/D3\|3-10\|RF2/JH6 | ...............Q................ | 1969 |
| MA_10-D3_CC_x_I2C0_x_scFc_(O6B)_translation Fv#1 | VH3\|3-15/D3\|3-10\|RF2/JH6 | ...............Q................ | 1970 |
| MA_10-D6_CC_x_I2C0_x_scFc_(V6Z)_translation Fv#_1 | VH3\|3-15/D3\|3-10\|RF2/JH6 | ...............Q................ | 1971 |
| MA_10-G2_CC_x_I2C0_x_scFc_(T1S)_translation Fv#1 | VH3\|3-15/D3\|3-10\|RF2/JH6 | ...............Q................ | 1972 |
| MA_10-G5_CC_x_I2C0_x_scFc_(S9O)_translation Fv#1 | VH3\|3-15/D3\|3-10\|RF2/JH6 | ...............Q................ | 1973 |
| MA_10-H1_CC_x_I2C0_x_scFc_(T9K)_translation Fv#1 | VH3\|3-15/D3\|3-10\|RF2/JH6 | ...............Q................ | 1974 |
| MA_10-H3_CC_x_I2C0_x_scFc_(M9L)_translation Fv#1 | VH3\|3-15/D3\|3-10\|RF2/JH6 | ...............Q................ | 1975 |
| VH2\|2-05/D2\|2-15\|RF1/JH5 | | QITLKES-GPTLVKPTQTLTLTCTFSG-FSLS | 1976 |
| MA_09-F11_CC_x_I2C0_x_scFc_(L6Q)_translation Fv#1 | VH2\|2-05/D2\|2-15\|RF1/JH5 | ..........M....................FT | 1977 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-F12_CC_x_I2C0_x_scFc_(D1U)_translation Fv#1 | VH2\|2-05/D2\|2-15\|RF1/JH5 | ..........A....................FT | 1978 |
| MA_09-G8_CC_x_I2C0_x_scFc_(I6K)_translation Fv#1 | VH2\|2-05/D2\|2-15\|RF1/JH5 | ...............................FT | 1979 |
| MA_09-G10_CC_x_I2C0_x_scFc_(C4K)_translation Fv#1 | VH2\|2-05/D2\|2-15\|RF1/JH5 | ...............................FT | 1980 |
| MA_09-G11_CC_x_I2C0_x_scFc_(Y9Q)_translation Fv#1 | VH2\|2-05/D2\|2-15\|RF1/JH5 | ........M....................FT | 1981 |
| MA_09-H7_CC_x_I2C0_x_scFc_(T3S)_translation Fv#1 | VH2\|2-05/D2\|2-15\|RF1/JH5 | ..........A....................FT | 1982 |
| MA_09-H10_CC_x_I2C0_x_scFc_(B6N)_translation Fv#1 | VH2\|2-05/D2\|2-15\|RF1/JH5 | ...............................FT | 1983 |
| MA_09-H11_CC_x_I2C0_x_scFc_(I8L)_translation Fv#1 | VH2\|2-05/D2\|2-15\|RF1/JH5 | ...............................FT | 1984 |
| VH4\|4-59/D3\|3-3\|RF3/JH4 | | QVQLQES-GPGLVKPSETLSLTCTVSG-GSIS | 1985 |
| MA_81-B9_CC_x_I2C0_x_scFc_(U4L)_translation Fv#1 | | ...........................D... | 1986 |
| VH3\|3-30.3/D1\|1-1\|RF2/JH4 | | QVQLVES-GGGVVQPGRSLRLSCAASG-FTFS | 1987 |
| MA_86-A4_CC_x_I2C0_x_scFc_(K2W)_translation Fv#1 | VH3\|3-30.3/D1\|1-1\|RF2/JH4 | ................................ | 1988 |
| MA_86-A4-N-F5_CC_x_I2C0_x_scFc_(M4H)_translation Fv#1 | VH3\|3-30.3/D1\|1-1\|RF2/JH4 | ................................ | 1989 |
| VH3\|3-11/D1\|1-1\|RF3/JH4 | | QVQLVES-GGGLVKPGGSLRLSCAASG-FTFS | 1990 |
| MA_88-B3-F9_CC_x_I2C0_x_scFc_(Y4E)_translation Fv#1 | VH3\|3-11/D1\|1-1\|RF3/JH4 | ................................ | 1991 |
| VH4\|4-30.1/D3\|3-10\|RF3/JH6 | | QVQLQES-GPGLVKPSQTLSLTCTVSG-GSIS | 1992 |
| MA_SG-F28_CC_x_I2C0_x_scFc_(D9R)_translation Fv#1 | VH4\|4-30.1/D3\|3-10\|RF3/JH6 | ...........................D... | 1993 |
| | | H_CDR1 | |
| VH3\|3-23/D6\|6-19\|RF2/JH4 | | S-----YAMS | 2075 |
| MA_03-C7_AS_CC_x_I2C0_x_scFc_(G2H)_translation Fv#1 | VH3\|3-23/D6\|6-19\|RF2/JH4 | ......H... | 2076 |
| MA_03-D8_AS_CC_x_I2C0_x_scFc_(L7E)_translation Fv#1 | VH3\|3-23/D6\|6-19\|RF2/JH4 | ......H... | 2077 |
| MA_03-D8_CC_x_I2C0_x_scFc_(H6N)_translation Fv#1 | VH3\|3-23/D6\|6-19\|RF2/JH4 | ......H... | 2078 |
| MA_03-D12_AS_CC_x_I2C0_x_scFc_(L6A)_translaton x Fv#1 | VH3\|3-23/D6\|6-19\|RF2/JH4 | ......H... | 2079 |
| MA_03-E7_AS_CC_x_I2C0_x_scFc_(L6M)_translation Fv#1 | VH3\|3-23/D6\|6-19\|RF2/JH4 | ......H... | 2080 |
| MA_03-E11_AS_CC_x_I2C0_x_scFc_(G2B)_translation Fv#1 | VH3\|3-23/D6\|6-19\|RF2/JH4 | ......H... | 2081 |
| MA_03-G10_AS_CC_x_I2C0_x_scFc_(N3H)_translation Fv#1 | VH3\|3-23/D6\|6-19\|RF2/JH4 | .......... | 2082 |
| MA_03-G11_AS_CC_x_I2C0_x_scFc_(O4R)_translation Fv#1 | VH3\|3-23/D6\|6-19\|RF2/JH4 | ......H... | 2083 |
| MA_03-H12_AS_CC_x_I2C0_x_scFc_(K5A)_translation Fv#1 | VH3\|3-23/D6\|6-19\|RF2/JH4 | ......H... | 2084 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_10-G10_AS_CC_x_I2C0_x_scFc_(T1I)_translation Fv#1 | VH3\|3-23/D6\|6-19\|RF2/JH4 | ......H... | 2085 |
| MA_10-G10_CC_x_I2C0_x_scFc_(B3A)_translation Fv#1 | VH3\|3-23/D6\|6-19\|RF2/JH4 | ......H... | 2086 |
| MA_98-C7_CC_x_I2C0_x_scFc_(Y8P)_translation Fv#1 | VH3\|3-23/D6\|6-19\|RF2/JH4 | ......H... | 2087 |
| MA_98-G12_AS_CC_x_I2C0_x_scFc_(Q4Z)_translation Fv#1 | VH3\|3-23/D6\|6-19\|RF2/JH4 | ......H... | 2088 |
| VH3\|3-73/D3\|3-3\|RF3/JH4 | | G-----SAMH | 2089 |
| MA_03-C7_AS_CC_x_I2C0_x_scFc_(G2H)_translation Fv#2 | VH3\|3-73/D3\|3-3\|RF3/JH4 | K.....Y..N | 2090 |
| MA_03-D8_AS_CC_x_I2C0_x_scFc_(L7E)_translation Fv#2 | VH3\|3-73/D3\|3-3\|RF3/JH4 | K.....Y..N | 2091 |
| MA_03-D8_CC_x_I2C0_x_scFc_(H6N)_translation Fv#2 | VH3\|3-73/D3\|3-3\|RF3/JH4 | K.....Y..N | 2092 |
| MA_03-D12_AS_CC_x_I2C0_x_scFc_(L6A)_translation Fv#2 | VH3\|3-73/D3\|3-3\|RF3/JH4 | K.....Y..N | 2093 |
| MA_03-E7_AS_CC_x_I2C0_x_scFc_(L6M)_translation Fv#2 | VH3\|3-73/D3\|3-3\|RF3/JH4 | K.....Y..N | 2094 |
| MA_03-E11_AS_CC_x_I2C0_x_scFc_(G2B)_translation Fv#2 | VH3\|3-73/D3\|3-3\|RF3/JH4 | K.....Y..N | 2095 |
| MA_03-G10_AS_CC_x_I2C0_x_scFc_(N3H)_translation Fv#2 | VH3\|3-73/D3\|3-3\|RF3/JH4 | K.....Y..N | 2096 |
| MA_03-G11_AS_CC_x_I2C0_x_scFc_(O4R)_translation Fv#2 | VH3\|3-73/D3\|3-3\|RF3/JH4 | K.....Y..N | 2097 |
| MA_03-H12_AS_CC_x_I2C0_x_scFc_(K5A)_translation Fv#2 | VH3\|3-73/D3\|3-3\|RF3/JH4 | K.....Y..N | 2098 |
| MA_09-C7_CC_x_I2C0_x_scFc_(K9T)_translation Fv#2 | VH3\|3-73/D3\|3-3\|RF3/JH4 | K.....Y..N | 2099 |
| MA_09-E2_CC_x_I2C0_x_scFc_(V8T)_translation Fv#2 | VH3\|3-73/D3\|3-3\|RF3/JH4 | K.....Y..N | 2100 |
| MA_09-F11_CC_x_I2C0_x_scFc_(L6Q)_translation Fv#2 | VH3\|3-73/D3\|3-3\|RF3/JH4 | K.....Y..N | 2101 |
| MA_09-F12_CC_x_I2C0_x_scFc_(D1U)_translation Fv#2 | VH3\|3-73/D3\|3-3\|RF3/JH4 | K.....Y..N | 2102 |
| MA_09-G8_CC_x_I2C0_x_scFc_(I6K)_translation Fv#2 | VH3\|3-73/D3\|3-3\|RF3/JH4 | K.....Y..N | 2103 |
| MA_09-G10_CC_x_I2C0_x_scFc_(C4K)_translation Fv#2 | VH3\|3-73/D3\|3-3\|RF3/JH4 | K.....Y..N | 2104 |
| MA_09-G11_CC_x_I2C0_x_scFc_(Y9Q)_translation Fv#2 | VH3\|3-73/D3\|3-3\|RF3/JH4 | K.....Y..N | 2105 |
| MA_09-H7_CC_x_I2C0_x_scFc_(T3S)_translation Fv#2 | VH3\|3-73/D3\|3-3\|RF3/JH4 | K.....Y..N | 2106 |
| MA_09-H10_CC_x_I2C0_x_scFc_(B6N)_translation Fv#2 | VH3\|3-73/D3\|3-3\|RF3/JH4 | K.....Y..N | 2107 |
| MA_09-H11_CC_x_I2C0_x_scFc_(I8L)_translation Fv#2 | VH3\|3-73/D3\|3-3\|RF3/JH4 | K.....Y..N | 2108 |
| MA_10-B5_CC_x_I2C0_x_scFc_(H6H)_translation Fv#2 | VH3\|3-73/D3\|3-3\|RF3/JH4 | K.....Y..N | 2109 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_10-B6_CC_x_I2C0_x_scFc_(I3O)_translation Fv#2 | VH3\|3-73/D3\|3-3\|RF3/JH4 | K.....Y..N | 2110 |
| MA_10-D3_CC_x_I2C0_x_scFc_(O6B)_translation Fv#2 | VH3\|3-73/D3\|3-3\|RF3/JH4 | K.....Y..N | 2111 |
| MA_10-D6_CC_x_I2C0_x_scFc_(V6Z)_translation Fv#2 | VH3\|3-73/D3\|3-3\|RF3/JH4 | K.....Y..N | 2112 |
| MA_10-G2_CC_x_I2C0_x_scFc_(T1S)_translation Fv#2 | VH3\|3-73/D3\|3-3\|RF3/JH4 | K.....Y..N | 2113 |
| MA_10-G5_CC_x_I2C0_x_scFc_(S9O)_translation Fv#2 | VH3\|3-73/D3\|3-3\|RF3/JH4 | K.....Y..N | 2114 |
| MA_10-G10_AS_CC_x_I2C0_x_scFc_(T1I)_translation Fv#2 | VH3\|3-73/D3\|3-3\|RF3/JH4 | K.....Y..N | 2115 |
| MA_10-G10_CC_x_I2C0_x_scFc_(B3A)_translation Fv#2 | VH3\|3-73/D3\|3-3\|RF3/JH4 | K.....Y..N | 2116 |
| MA_10-H1_CC_x_I2C0_x_scFc_(T9K)_translation Fv#2 | VH3\|3-73/D3\|3-3\|RF3/JH4 | K.....Y..N | 2117 |
| MA_10-H3_CC_x_I2C0_x_scFc_(M9L)_translation Fv#2 | VH3\|3-73/D3\|3-3\|RF3/JH4 | K.....Y..N | 2118 |
| MA_81-B9_CC_x_I2C0_x_scFc_(U4L)_translation Fv#2 | VH3\|3-73/D3\|3-3\|RF3/JH4 | K.....Y..N | 2119 |
| MA_86-A4_CC_x_I2C0_x_scFc_(K2W)_translation Fv#2 | VH3\|3-73/D3\|3-3\|RF3/JH4 | K.....Y..N | 2120 |
| MA_86-A4-N-F5_CC_x_I2C0_x_scFc_(M4H)_translation Fv#2 | VH3\|3-73/D3\|3-3\|RF3/JH4 | K.....Y..N | 2121 |
| MA_88-B3-F9_CC_x_I2C0_x_scFc_(Y4E)_translation Fv#2 | VH3\|3-73/D3\|3-3\|RF3/JH4 | K.....Y..N | 2122 |
| MA_98-C7_CC_x_I2C0_x_scFc_(Y8P)_translation Fv#2 | VH3\|3-73/D3\|3-3\|RF3/JH4 | K.....Y..N | 2123 |
| MA_98-G12_AS_CC_x_I2C0_x_scFc_(Q4Z)_translation Fv#2 | VH3\|3-73/D3\|3-3\|RF3/JH4 | K.....Y..N | 2124 |
| MA_SG-F28_CC_x_I2C0_x_scFc_(D9R)_translation Fv#2 | VH3\|3-73/D3\|3-3\|RF3/JH4 | K.....Y..N | 2125 |
| VH2\|2-70/D2\|2-15\|RF1/JH5 |  | TS---GMRVS | 2126 |
| MA_09-C7_CC_x_I2C0_x_scFc_(K9T)_translation Fv#1 | VH2\|2-70/D2\|2-15\|RF1/JH5 | .H...K.G.D | 2127 |
| VH3\|3-15/D3\|3-10\|RF2/JH6 |  | N-----AWMS | 2128 |
| MA_09-E2_CC_x_I2C0_x_scFc_(V8T)_translation Fv#1 | VH3\|3-15/D3\|3-10\|RF2/JH6 | .......... | 2129 |
| MA_10-B5_CC_x_I2C0_x_scFc_(H6H)_translation Fv#1 | VH3\|3-15/D3\|3-10\|RF2/JH6 | .......... | 2130 |
| MA_10-B6_CC_x_I2C0_x_scFc_(I3O)_translation Fv#1 | VH3\|3-15/D3\|3-10\|RF2/JH6 | .......... | 2131 |
| MA_10-D3_CC_x_I2C0_x_scFc_(O6B)_translation Fv#1 | VH3\|3-15/D3\|3-10\|RF2/JH6 | .......... | 2132 |
| MA_10-D6_CC_x_I2C0_x_scFc_(V6Z)_translation FV#_1 | VH3\|3-15/D3\|3-10\|RF2/JH6 | .......... | 2133 |
| MA_10-G2_CC_x_I2C0_x_scFc_(T1S)_translation Fv#1 | VH3\|3-15/D3\|3-10\|RF2/JH6 | .......... | 2134 |
| MA_10-G5_CC_x_I2C0_x_scFc_(S9O)_translation Fv#1 | VH3\|3-15/D3\|3-10\|RF2/JH6 | .......... | 2135 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_10-H1_CC_x_I2C0_x_scFc_(T9K)_translation Fv#1 | VH3\|3-15/D3\|3-10\|RF2/JH6 | .......... | 2136 |
| MA_10-H3_CC_x_I2C0_x_scFc_(M9L)_translation Fv#1 | VH3\|3-15/D3\|3-10\|RF2/JH6 | .......... | 2137 |
| VH2\|2-05/D2\|2-15\|RF1/JH5 |  | TS---GVGVG | 2138 |
| MA_09-F11_CC_x_I2C0_x_scFc_(L6Q)_translation Fv#1 | VH2\|2-05/D2\|2-15\|RF1/JH5 | .H...KM..D | 2139 |
| MA_09-F12_CC_x_I2C0_x_scFc_(D1U)_translation Fv#1 | VH2\|2-05/D2\|2-15\|RF1/JH5 | .H...KM..D | 2140 |
| MA_09-G8_CC_x_I2C0_x_scFc_(I6K)_translation Fv#1 | VH2\|2-05/D2\|2-15\|RF1/JH5 | .H...KM..D | 2141 |
| MA_09-G10_CC_x_I2C0_x_scFc_(C4K)_translation Fv#1 | VH2\|2-05/D2\|2-15\|RF1/JH5 | .H...KM..D | 2142 |
| MA_09-G11_CC_x_I2C0_x_scFc_(Y9Q)_translation Fv#1 | VH2\|2-05/D2\|2-15\|RF1/JH5 | .H...KM..D | 2143 |
| MA_09-H7_CC_x_I2C0_x_scFc_(T3S)_translation Fv#1 | VH2\|2-05/D2\|2-15\|RF1/JH5 | .H...KM..D | 2144 |
| MA_09-H10_CC_x_I2C0_x_scFc_(B6N)_translation Fv#1 | VH2\|2-05/D2\|2-15\|RF1/JH5 | .H...KM..D | 2145 |
| MA_09-H11_CC_x_I2C0_x_scFc_(I8L)_translation Fv#1 | VH2\|2-05/D2\|2-15\|RF1/JH5 | .H...KM..D | 2146 |
| VH4\|4-59/D3\|3-3\|RF3/JH4 |  | S-----YYWS | 2147 |
| MA_81-B9_CC_x_I2C0_x_scFc_(U4L)_translation Fv#1 |  | .S...R...G | 2148 |
| VH3\|3-30.3/D1\|1-1\|RF2/JH4 |  | S-----YAMH | 2149 |
| MA_86-A4_CC_x_I2C0_x_scFc_(K2W)_translation Fv#1 | VH3\|3-30.3/D1\|1-1\|RF2/JH4 | T......G.. | 2150 |
| MA_86-A4-N-F5_CC_x_I2C0_x_scFc_(M4H)_translation Fv#1 | VH3\|3-30.3/D1\|1-1\|RF2/JH4 | T......G.. | 2151 |
| VH3\|3-11/D1\|1-1\|RF3/JH4 |  | D-----YYMS | 2152 |
| MA_88-B3-F9_CC_x_I2C0_x_scFc_(Y4E)_translation Fv#1 | VH3\|3-11/D1\|1-1\|RF3/JH4 | .......... | 2153 |
| VH4\|4-30.1/D3\|3-10\|RF3/JH6 |  | SG---GYYWS | 2154 |
| MA_SG-F28_CC_x_I2C0_x_scFc_(D9R)_translation Fv#1 | VH4\|4-30.1/D3\|3-10\|RF3/JH6 | .N...P.... | 2155 |
|  |  | H_FR2 |  |
| VH3\|3-23/D6\|6-19\|RF2/JH4 |  | WVRQAPGKGLEWVS | 2237 |
| MA_03-C7_AS_CC_x_I2C0_x_scFc_(G2H)_translation Fv#1 | VH3\|3-23/D6\|6-19\|RF2/JH4 | ........C..... | 2238 |
| MA_03-D8_AS_CC_x_I2C0_x_scFc_(L7E)_translation Fv#1 | VH3\|3-23/D6\|6-19\|RF2/JH4 | ........C..... | 2239 |
| MA_03-D8_CC_x_I2C0_x_scFc_(H6N)_translation Fv#1 | VH3\|3-23/D6\|6-19\|RF2/JH4 | ........C..... | 2240 |
| MA_03-D12_AS_CC_x_I2C0_x_scFc_(L6A)_translaton x Fv#1 | VH3\|3-23/D6\|6-19\|RF2/JH4 | ........C..... | 2241 |
| MA_03-E7_AS_CC_x_I2C0_x_scFc_(L6M)_translation Fv#1 | VH3\|3-23/D6\|6-19\|RF2/JH4 | ........C..... | 2242 |
| MA_03-E11_AS_CC_x_I2C0_x_scFc_(G2B)_translation Fv#1 | VH3\|3-23/D6\|6-19\|RF2/JH4 | ........C..... | 2243 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_03-G10_AS_CC_x_I2C0_x_scFc_(N3H)_translation Fv#1 | VH3\|3-23/D6\|6-19\|RF2/JH4 | ........C..... | 2244 |
| MA_03-G11_AS_CC_x_I2C0_x_scFc_(O4R)_translation Fv#1 | VH3\|3-23/D6\|6-19\|RF2/JH4 | ........C..... | 2245 |
| MA_03-H12_AS_CC_x_I2C0_x_scFc_(K5A)_translation Fv#1 | VH3\|3-23/D6\|6-19\|RF2/JH4 | ........C..... | 2246 |
| MA_10-G10_AS_CC_x_I2C0_x_scFc_(T1I)_translation Fv#1 | VH3\|3-23/D6\|6-19\|RF2/JH4 | ........C..... | 2247 |
| MA_10-G10_CC_x_I2C0_x_scFc_(B3A)_translation Fv#1 | VH3\|3-23/D6\|6-19\|RF2/JH4 | ........C..... | 2248 |
| MA_98-C7_CC_x_I2C0_x_scFc_(Y8P)_translation Fv#1 | VH3\|3-23/D6\|6-19\|RF2/JH4 | ........C..... | 2249 |
| MA_98-G12_AS_CC_x_I2C0_x_scFc_(Q4Z)_translation Fv#1 | VH3\|3-23/D6\|6-19\|RF2/JH4 | ........C..... | 2250 |
| VH3\|3-73/D3\|3-3\|RF3/JH4 | VH3\|3-73/D3\|3-3\|RF3/JH4 | WVRQASGKGLEWVG | 2251 |
| MA_03-C7_AS_CC_x_I2C0_x_scFc_(G2H)_translation Fv#2 | VH3\|3-73/D3\|3-3\|RF3/JH4 | .....P.......A | 2252 |
| MA_03-D8_AS_CC_x_I2C0_x_scFc_(L7E)_translation Fv#2 | VH3\|3-73/D3\|3-3\|RF3/JH4 | .....P.......A | 2253 |
| MA_03-D8_CC_x_I2C0_x_scFc_(H6N)_translation Fv#2 | VH3\|3-73/D3\|3-3\|RF3/JH4 | .....P.......A | 2254 |
| MA_03-D12_AS_CC_x_I2C0_x_scFc_(L6A)_translation Fv#2 | VH3\|3-73/D3\|3-3\|RF3/JH4 | .....P.......A | 2255 |
| MA_03-E7_AS_CC_x_I2C0_x_scFc_(L6M)_translation Fv#2 | VH3\|3-73/D3\|3-3\|RF3/JH4 | .....P.......A | 2256 |
| MA_03-E11_AS_CC_x_I2C0_x_scFc_(G2B)_translation Fv#2 | VH3\|3-73/D3\|3-3\|RF3/JH4 | .....P.......A | 2257 |
| MA_03-G10_AS_CC_x_I2C0_x_scFc_(N3H)_translation Fv#2 | VH3\|3-73/D3\|3-3\|RF3/JH4 | .....P.......A | 2258 |
| MA_03-G11_AS_CC_x_I2C0_x_scFc_(O4R)_translation Fv#2 | VH3\|3-73/D3\|3-3\|RF3/JH4 | .....P.......A | 2259 |
| MA_03-H12_AS_CC_x_I2C0_x_scFc_(K5A)_translation Fv#2 | VH3\|3-73/D3\|3-3\|RF3/JH4 | .....P.......A | 2260 |
| MA_09-C7_CC_x_I2C0_x_scFc_(K9T)_translation Fv#2 | VH3\|3-73/D3\|3-3\|RF3/JH4 | .....P.......A | 2261 |
| MA_09-E2_CC_x_I2C0_x_scFc_(V8T)_translation Fv#2 | VH3\|3-73/D3\|3-3\|RF3/JH4 | .....P.......A | 2262 |
| MA_09-F11_CC_x_I2C0_x_scFc_(L6Q)_translation Fv#2 | VH3\|3-73/D3\|3-3\|RF3/JH4 | .....P.......A | 2263 |
| MA_09-F12_CC_x_I2C0_x_scFc_(D1U)_translation Fv#2 | VH3\|3-73/D3\|3-3\|RF3/JH4 | .....P.......A | 2264 |
| MA_09-G8_CC_x_I2C0_x_scFc_(I6K)_translation Fv#2 | VH3\|3-73/D3\|3-3\|RF3/JH4 | .....P.......A | 2265 |
| MA_09-G10_CC_x_I2C0_x_scFc_(C4K)_translation Fv#2 | VH3\|3-73/D3\|3-3\|RF3/JH4 | .....P.......A | 2266 |
| MA_09-G11_CC_x_I2C0_x_scFc_(Y9Q)_translation Fv#2 | VH3\|3-73/D3\|3-3\|RF3/JH4 | .....P.......A | 2267 |
| MA_09-H7_CC_x_I2C0_x_scFc_(T3S)_translation Fv#2 | VH3\|3-73/D3\|3-3\|RF3/JH4 | .....P.......A | 2268 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_09-H10_CC_x_I2C0_x_scFc_(B6N)_translation Fv#2 | VH3\|3-73/D3\|3-3\|RF3/JH4 | .....P.......A | 2269 |
| MA_09-H11_CC_x_I2C0_x_scFc_(I8L)_translation Fv#2 | VH3\|3-73/D3\|3-3\|RF3/JH4 | .....P.......A | 2270 |
| MA_10-B5_CC_x_I2C0_x_scFc_(H6H)_translation Fv#2 | VH3\|3-73/D3\|3-3\|RF3/JH4 | .....P.......A | 2271 |
| MA_10-B6_CC_x_I2C0_x_scFc_(I3O)_translation Fv#2 | VH3\|3-73/D3\|3-3\|RF3/JH4 | .....P.......A | 2272 |
| MA_10-D3_CC_x_I2C0_x_scFc_(O6B)_translation Fv#2 | VH3\|3-73/D3\|3-3\|RF3/JH4 | .....P.......A | 2273 |
| MA_10-D6_CC_x_I2C0_x_scFc_(V6Z)_translation Fv#2 | VH3\|3-73/D3\|3-3\|RF3/JH4 | .....P.......A | 2274 |
| MA_10-G2_CC_x_I2C0_x_scFc_(T1S)_translation Fv#2 | VH3\|3-73/D3\|3-3\|RF3/JH4 | .....P.......A | 2275 |
| MA_10-G5_CC_x_I2C0_x_scFc_(S9O)_translation Fv#2 | VH3\|3-73/D3\|3-3\|RF3/JH4 | .....P.......A | 2276 |
| MA_10-G10_AS_CC_x_I2C0_x_scFc_(T1I)_translation Fv#2 | VH3\|3-73/D3\|3-3\|RF3/JH4 | .....P.......A | 2277 |
| MA_10-G10_CC_x_I2C0_x_scFc_(B3A)_translation Fv#2 | VH3\|3-73/D3\|3-3\|RF3/JH4 | .....P.......A | 2278 |
| MA_10-H1_CC_x_I2C0_x_scFc_(T9K)_translation Fv#2 | VH3\|3-73/D3\|3-3\|RF3/JH4 | .....P.......A | 2279 |
| MA_10-H3_CC_x_I2C0_x_scFc_(M9L)_translation Fv#2 | VH3\|3-73/D3\|3-3\|RF3/JH4 | .....P.......A | 2280 |
| MA_81-B9_CC_x_I2C0_x_scFc_(U4L)_translation Fv#2 | VH3\|3-73/D3\|3-3\|RF3/JH4 | .....P.......A | 2281 |
| MA_86-A4_CC_x_I2C0_x_scFc_(K2W)_translation Fv#2 | VH3\|3-73/D3\|3-3\|RF3/JH4 | .....P.......A | 2282 |
| MA_86-A4-N-F5_CC_x_I2C0_x_scFc_(M4H)_translation Fv#2 | VH3\|3-73/D3\|3-3\|RF3/JH4 | .....P.......A | 2283 |
| MA_88-B3-F9_CC_x_I2C0_x_scFc_(Y4E)_translation Fv#2 | VH3\|3-73/D3\|3-3\|RF3/JH4 | .....P.......A | 2284 |
| MA_98-C7_CC_x_I2C0_x_scFc_(Y8P)_translation Fv#2 | VH3\|3-73/D3\|3-3\|RF3/JH4 | .....P.......A | 2285 |
| MA_98-G12_AS_CC_x_I2C0_x_scFc_(Q4Z)_translation Fv#2 | VH3\|3-73/D3\|3-3\|RF3/JH4 | .....P.......A | 2286 |
| MA_SG-F28_CC_x_I2C0_x_scFc_(D9R)_translation Fv#2 | VH3\|3-73/D3\|3-3\|RF3/JH4 | .....P.......A | 2287 |
| VH2\|2-70/D2\|2-15\|RF1/JH5 |  | WIRQPPGKALEWLA | 2288 |
| MA_09-C7_CC_x_I2C0_x_scFc_(K9T)_translation Fv#1 | VH2\|2-70/D2\|2-15\|RF1/JH5 | ........C..... | 2289 |
| VH3\|3-15/D3\|3-10\|RF2/JH6 |  | WVRQAPGKGLEWVG | 2290 |
| MA_09-E2_CC_x_I2C0_x_scFc_(V8T)_translation Fv#1 | VH3\|3-15/D3\|3-10\|RF2/JH6 | ........C..... | 2291 |
| MA_10-B5_CC_x_I2C0_x_scFc_(H6H)_translation Fv#1 | VH3\|3-15/D3\|3-10\|RF2/JH6 | ........C..... | 2292 |
| MA_10-B6_CC_x_I2C0_x_scFc_(I3O)_translation Fv#1 | VH3\|3-15/D3\|3-10\|RF2/JH6 | ........C..... | 2293 |
| MA_10-D3_CC_x_I2C0_x_scFc_(O6B)_translation Fv#1 | VH3\|3-15/D3\|3-10\|RF2/JH6 | ........C..... | 2294 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_10-D6_CC_x_I2C0_x_scFc_(V6Z)_translation Fv#_1 | VH3\|3-15/D3\|3-10\|RF2/JH6 | ........C..... | 2295 |
| MA_10-G2_CC_x_I2C0_x_scFc_(T1S)_translation Fv#1 | VH3\|3-15/D3\|3-10\|RF2/JH6 | ........C..... | 2296 |
| MA_10-G5_CC_x_I2C0_x_scFc_(S9O)_translation Fv#1 | VH3\|3-15/D3\|3-10\|RF2/JH6 | ........C..... | 2297 |
| MA_10-H1_CC_x_I2C0_x_scFc_(T9K)_translation Fv#1 | VH3\|3-15/D3\|3-10\|RF2/JH6 | ........C..... | 2298 |
| MA_10-H3_CC_x_I2C0_x_scFc_(M9L)_translation Fv#1 | VH3\|3-15/D3\|3-10\|RF2/JH6 | ........C..... | 2299 |
| VH2\|2-05/D2\|2-15/RF1/JH5 | | WIRQPPGKALEWLA | 2300 |
| MA_09-F11_CC_x_I2C0_x_scFc_(L6Q)_translation Fv#1 | VH2\|2-05/D2\|2-15\|RF1/JH5 | ........C..... | 2301 |
| MA_09-F12_CC_x_I2C0_x_scFc_(D1U)_translation Fv#1 | VH2\|2-05/D2\|2-15\|RF1/JH5 | ........C..... | 2302 |
| MA_09-G8_CC_x_I2C0_x_scFc_(I6K)_translation Fv#1 | VH2\|2-05/D2\|2-15\|RF1/JH5 | ........C..... | 2303 |
| MA_09-G10_CC_x_I2C0_x_scFc_(C4K)_translation Fv#1 | VH2\|2-05/D2\|2-15\|RF1/JH5 | ........C..... | 2304 |
| MA_09-G11_CC_x_I2C0_x_scFc_(Y9Q)_translation Fv#1 | VH2\|2-05/D2\|2-15\|RF1/JH5 | ........C..... | 2305 |
| MA_09-H7_CC_x_I2C0_x_scFc_(T3S)_translation Fv#1 | VH2\|2-05/D2\|2-15\|RF1/JH5 | ........C..... | 2306 |
| MA_09-H10_CC_x_I2C0_x_scFc_(B6N)_translation Fv#1 | VH2\|2-05/D2\|2-15\|RF1/JH5 | ........C..... | 2307 |
| MA_09-H11_CC_x_I2C0_x_scFc_(I8L)_translation Fv#1 | VH2\|2-05/D2\|2-15\|RF1/JH5 | ........C..... | 2308 |
| VH4\|4-59/D3\|3-3\|RF3/JH4 | | WIRQPPGKGLEWIG | 2309 |
| MA_81-B9_CC_x_I2C0_x_scFc_(U4L)_translation Fv#1 | | ........C..... | 2310 |
| VH3\|3-30.3/D1\|1-1\|RF2/JH4 | | WVRQAPGKGLEWVA | 2311 |
| MA_86-A4_CC_x_I2C0_x_scFc_(K2W)_translation Fv#1 | VH3\|3-30.3/D1\|1-1\|RF2/JH4 | ........C..... | 2312 |
| MA_86-A4-N-F5_CC_x_I2C0_x_scFc_(M4H)_translation Fv#1 | VH3\|3-30.3/D1\|1-1\|RF2/JH4 | ........C..... | 2313 |
| VH3\|3-11/D1\|1-1\|RF3/JH4 | | WIRQAPGKGLEWVS | 2314 |
| MA_88-B3-F9_CC_x_I2C0_x_scFc_(Y4E)_translation Fv#1 | VH3\|3-11/D1\|1-1\|RF3/JH4 | ........C..... | 2315 |
| VH4\|4-30.1/D3\|3-10\|RF3/JH6 | | WIRQHPGKGLEWIG | 2316 |
| MA_SG-F28_CC_x_I2C0_x_scFc_(D9R)_translation Fv#1 | VH4\|4-30.1/D3\|3-10\|RF3/JH6 | ........C..... | 2317 |
| | | K CDR2 | |
| VK1\|O12/JK1 | | A--------ASSLQS | 2318 |
| MA_09-C7_CC_x_I2C0_x_scFc_(K9T)_translation Fv#1 | VK1\|O12/JK1 | ............... | 2319 |
| MA_09-E2_CC_x_I2C0_x_scFc_(V8T)_translation Fv#1 | VK1\|O12/JK1 | ..............G | 2320 |
| MA_09-F11_CC_x_I2C0_x_scFc_(L6Q)_translation Fv#1 | VK1\|O12/JK1 | ............... | 2321 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-F12_CC_x_I2C0_x_scFc_(D1U)_translation Fv#1 | VK1\|O12/JK1 | ............... | 2322 |
| MA_09-G8_CC_x_I2C0_x_scFc_(I6K)_translation Fv#1 | VK1\|O12/JK1 | ............... | 2323 |
| MA_09-G10_CC_x_I2C0_x_scFc_(C4K)_translation Fv#1 | VK1\|O12/JK1 | ............... | 2324 |
| MA_09-G11_CC_x_I2C0_x_scFc_(Y9Q)_translation Fv#1 | VK1\|O12/JK1 | ............... | 2325 |
| MA_09-H7_CC_x_I2C0_x_scFc_(T3S)_translation Fv#1 | VK1\|O12/JK1 | ............... | 2326 |
| MA_09-H10_CC_x_I2C0_x_scFc_(B6N)_translation Fv#1 | VK1\|O12/JK1 | ............... | 2327 |
| MA_09-H11_CC_x_I2C0_x_scFc_(I8L)_translation Fv#1 | VK1\|O12/JK1 | ............... | 2328 |
| MA_10-B5_CC_x_I2C0_x_scFc_(H6H)_translation Fv#1 | VK1\|O12/JK1 | ..............G | 2329 |
| VK1\|O12/JK2 | | A--------ASSLQS | 2330 |
| MA_10-B6_CC_x_I2C0_x_scFc_(I3O)_translation Fv#1 | VK1\|O12/JK2 | ..............G | 2331 |
| MA_10-H3_CC_x_I2C0_x_scFc_(M9L)_translation Fv#1 | VK1\|O12/JK2 | ..............G | 2332 |
| VK1\|O12/JK3 | | A--------ASSLQS | 2333 |
| MA_10-D3_CC_x_I2C0_x_scFc_(O6B)_translation Fv#1 | VK1\|O12/JK3 | ..............G | 2334 |
| MA_10-D6_CC_x_I2C0_x_scFc_(V6Z)_translation Fv#1 | VK1\|O12/JK3 | ..............G | 2335 |
| MA_10-G2_CC_x_I2C0_x_scFc_(T1S)_translation Fv#1 | VK1\|O12/JK3 | ............... | 2336 |
| MA_10-G5_CC_x_I2C0_x_scFc_(S9O)_translation Fv#1 | VK1\|O12/JK3 | ..............G | 2337 |
| MA_10-H1_CC_x_I2C0_x_scFc_(T9K)_translation Fv#1 | VK1\|O12/JK3 | ............... | 2338 |
| VK4\|B3/JK5 | | W--------ASTRES | 2339 |
| MA_81-B9_CC_x_I2C0_x_scFc_(U4L)_translation Fv#1 | VK4\|B3/JK5 | ............... | 2340 |
| VK1\|A20/JK1 | | A--------ASTLQS | 2341 |
| MA_86-A4_CC_x_I2C0_x_scFc_(K2W)_translation Fv#1 | VK1\|A20/JK1 | ............... | 2342 |
| MA_86-A4-N-F5_CC_x_I2C0_x_scFc_(M4H)_translation Fv#1 | VK1\|A20/JK1 | ............... | 2343 |
| VK2\|O1/JK1 | | T--------LSYRAS | 2344 |
| MA_SG-F28_CC_x_I2C0_x_scFc_(D9R)_translation Fv#1 | VK2\|O1/JK1 | L........G.N... | 2345 |

| | | K_FR3 | |
|---|---|---|---|
| VK1\|O12/JK1 | | GVPSRFSGSGSG--TDFTLTISSLQPEDFATYYC | 2480 |
| MA_09-C7_CC_x_I2C0_x_scFc_(K9T)_translation Fv#1 | VK1\|O12/JK1 | ......................... | 2481 |
| MA_09-E2_CC_x_I2C0_x_scFc_(V8T)_translation Fv#1 | VK1\|O12/JK1 | ......................... | 2482 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-F11_CC_x_I2C0_x_scFc_(L6Q)_translation Fv#1 | VK1\|O12/JK1 | .......................<br>............ | 2483 |
| MA_09-F12_CC_x_I2C0_x_scFc_(D1U)_translation Fv#1 | VK1\|O12/JK1 | ........R..............<br>............ | 2484 |
| MA_09-G8_CC_x_I2C0_x_scFc_(I6K)_translation Fv#1 | VK1\|O12/JK1 | .......................<br>............ | 2485 |
| MA_09-G10_CC_x_I2C0_x_scFc_(C4K)_translation Fv#1 | VK1\|O12/JK1 | .......................<br>............ | 2486 |
| MA_09-G11_CC_x_I2C0_x_scFc_(Y9Q)_translation Fv#1 | VK1\|O12/JK1 | ........R..............<br>............ | 2487 |
| MA_09-H7_CC_x_I2C0_x_scFc_(T3S)_translation Fv#1 | VK1\|O12/JK1 | .......................<br>............ | 2488 |
| MA_09-H10_CC_x_I2C0_x_scFc_(B6N)_translation Fv#1 | VK1\|O12/JK1 | .......................<br>............ | 2489 |
| MA_09-H11_CC_x_I2C0_x_scFc_(I8L)_translation Fv#1 | VK1\|O12/JK1 | .......................<br>............ | 2490 |
| MA_10-B5_CC_x_I2C0_x_scFc_(H6H)_translation Fv#1 | VK1\|O12/JK1 | .......................<br>............ | 2491 |
| VK1\|O12/JK2 | A--ASSLQS | GVPSRFSGSGSG--<br>TDFTLTISSLQPEDFATYYC | 2492 |
| MA_10-B6_CC_x_I2C0_x_scFc_(I3O)_translation Fv#1 | VK1\|O12/JK2 | .......................<br>............ | 2493 |
| MA_10-H3_CC_x_I2C0_x_scFc_(M9L)_translation Fv#1 | VK1\|O12/JK2 | .......................<br>............ | 2494 |
| VK1\|O12/JK3 | | GVPSRFSGSGSG--<br>TDFTLTISSLQPEDFATYYC | 2495 |
| MA_10-D3_CC_x_I2C0_x_scFc_(O6B)_translation Fv#1 | VK1\|O12/JK3 | .......................<br>............ | 2496 |
| MA_10-D6_CC_x_I2C0_x_scFc_(V6Z)_translation Fv#1 | VK1\|O12/JK3 | .......................<br>............ | 2497 |
| MA_10-G2_CC_x_I2C0_x_scFc_(T1S)_translation Fv#1 | VK1\|O12/JK3 | .......................<br>............ | 2498 |
| MA_10-G5_CC_x_I2C0_x_scFc_(S9O)_translation Fv#1 | VK1\|O12/JK3 | .......................<br>............ | 2499 |
| MA_10-H1_CC_x_I2C0_x_scFc_(T9K)_translation Fv#1 | VK1\|O12/JK3 | .......................<br>............ | 2500 |
| VK4\|B3/JK5 | | GVPDRFSGSGSG--<br>TDFTLTISSLQAEDVAVYYC | 2501 |
| MA_81-B9_CC_x_I2C0_x_scFc_(U4L)_translation Fv#1 | VK4\|B3/JK5 | .......................<br>............ | 2502 |
| VK1\|A20/JK1 | | GVPSRFSGSGSG--<br>TDFTLTISSLQPEDVATYYC | 2503 |
| MA_86-A4_CC_x_I2C0_x_scFc_(K2W)_translation Fv#1 | VK1\|A20/JK1 | ......F................<br>............ | 2504 |
| MA_86-A4-N-F5_CC_x_I2C0_x_scFc_(M4H)_translation Fv#1 | VK1\|A20/JK1 | .......................<br>............ | 2505 |
| VK2\|O1/JK1 | | GVPDRESGSGSG--<br>TDFTLKISRVEAEDVGVYYC | 2506 |
| MA_SG-F28_CC_x_I2C0_x_scFc_(D9R)_translation Fv#1 | VK2\|O1/JK1 | .......................<br>....G....... | 2507 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | L_CDR2 | SEQ ID NO: |
|---|---|---|---|
| VL3\|3h/JL2 | | Y--------DSDRPS | 2346 |
| MA_03-C7_AS_CC_x_I2C0_x_scFc_(G2H)_translation Fv#1 | VL3\|3h/JL2 | D.........N.... | 2347 |
| MA_03-D12_AS_CC_x_I2C0_x_scFc_(L6A)_translation Fv#1 | VL3\|3h/JL2 | D.........N.... | 2348 |
| MA_03-E11_AS_CC_x_I2C0_x_scFc_(G2B)_translation Fv#1 | VL3\|3h/JL2 | D.........N.... | 2349 |
| MA_03-G10_AS_CC_x_I2C0_x_scFc_(N3H)_translation Fv#1 | VL3\|3h/JL2 | D.........N.... | 2350 |
| MA_03-G11_AS_CC_x_I2C0_x_scFc_(O4R)_translation Fv#1 | VL3\|3h/JL2 | D.........N.... | 2351 |
| MA_10-G10_AS_CC_x_I2C0_x_scFc_(T1I)_translation Fv#1 | VL3\|3h/JL2 | D.........N.... | 2352 |
| MA_10-G10_CC_x_I2C0_x_scFc_(B3A)_translation Fv#1 | VL3\|3h/JL2 | D.........N.... | 2353 |
| MA_88-B3-F9_CC_x_I2C0_x_scFc_(Y4E)_translation Fv#1 | VL3\|3h/JL2 | D.........N.... | 2354 |
| MA_98-C7_CC_x_I2C0_x_scFc_(Y8P)_translation Fv#1 | VL3\|3h/JL2 | D.........N.... | 2355 |
| MA_98-G12_AS_CC_x_I2C0_x_scFc_(Q4Z)_translation Fv#1 | VL3\|3h/JL2 | D.........N.... | 2356 |
| VL7\|7a/JL3b | | S--------TSNKHS | 2357 |
| MA_03-C7_AS_CC_x_I2C0_x_scFc_(G2H)_translation Fv#2 | VL7\|7a/JL3b | G.........KFLAP | 2358 |
| MA_03-D8_AS_CC_x_I2C0_x_scFc_(L7E)_translation Fv#2 | VL7\|7a/JL3b | G.........KFLAP | 2359 |
| MA_03-D8_CC_x_I2C0_x_scFc_(H6N)_translation Fv#2 | VL7\|7a/JL3b | G.........KFLAP | 2360 |
| MA_03-D12_AS_CC_x_I2C0_x_scFc_(L6A)_translation Fv#2 | VL7\|7a/JL3b | G.........KFLAP | 2361 |
| MA_03-E7_AS_CC_x_I2C0_x_scFc_(L6M)_translation Fv#2 | VL7\|7a/JL3b | G.........KFLAP | 2362 |
| MA_03-E11_AS_CC_x_I2C0_x_scFc_(G2B)_translation Fv#2 | VL7\|7a/JL3b | G.........KFLAP | 2363 |
| MA_03-G10_AS_CC_x_I2C0_x_scFc_(N3H)_translation Fv#2 | VL7\|7a/JL3b | G.........KFLAP | 2364 |
| MA_03-G11_AS_CC_x_I2C0_x_scFc_(O4R)_translation Fv#2 | VL7\|7a/JL3b | G.........KFLAP | 2365 |
| MA_03-H12_AS_CC_x_I2C0_x_scFc_(K5A)_translation Fv#2 | VL7\|7a/JL3b | G.........KFLAP | 2366 |
| MA_09-C7_CC_x_I2C0_x_scFc_(K9T)_translation Fv#2 | VL7\|7a/JL3b | G.........KFLAP | 2367 |
| MA_09-E2_CC_x_I2C0_x_scFc_(V8T)_translation Fv#2 | VL7\|7a/JL3b | G.........KFLAP | 2368 |
| MA_09-F11_CC_x_I2C0_x_scFc_(L6Q)_translation Fv#2 | VL7\|7a/JL3b | G.........KFLAP | 2369 |
| MA_09-F12_CC_x_I2C0_x_scFc_(D1U)_translation Fv#2 | VL7\|7a/JL3b | G.........KFLAP | 2370 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-G8_CC_x_I2C0_x_scFc_(I6K)_translation Fv#2 | VL7\|7a/JL3b | G........KFLAP | 2371 |
| MA_09-G10_CC_x_I2C0_x_scFc_(C4K)_translation Fv#2 | VL7\|7a/JL3b | G........KFLAP | 2372 |
| MA_09-G11_CC_x_I2C0_x_scFc_(Y9Q)_translation Fv#2 | VL7\|7a/JL3b | G........KFLAP | 2373 |
| MA_09-H7_CC_x_I2C0_x_scFc_(T3S)_translation Fv#2 | VL7\|7a/JL3b | G........KFLAP | 2374 |
| MA_09-H10_CC_x_I2C0_x_scFc_(B6N)_translation Fv#2 | VL7\|7a/JL3b | G........KFLAP | 2375 |
| MA_09-H11_CC_x_I2C0_x_scFc_(I8L)_translation Fv#2 | VL7\|7a/JL3b | G........KFLAP | 2376 |
| MA_10-B5_CC_x_I2C0_x_scFc_(H6H)_translation Fv#2 | VL7\|7a/JL3b | G........KFLAP | 2377 |
| MA_10-B6_CC_x_I2C0_x_scFc_(I3O)_translation Fv#2 | VL7\|7a/JL3b | G........KFLAP | 2378 |
| MA_10-D3_CC_x_I2C0_x_scFc_(O6B)_translation Fv#2 | VL7\|7a/JL3b | G........KFLAP | 2379 |
| MA_10-D6_CC_x_I2C0_x_scFc_(V6Z)_translation Fv#2 | VL7\|7a/JL3b | G........KFLAP | 2380 |
| MA_10-G2_CC_x_I2C0_x_scFc_(T1S)_translation Fv#2 | VL7\|7a/JL3b | G........KFLAP | 2381 |
| MA_10-G5_CC_x_I2C0_x_scFc_(S9O)_translation Fv#2 | VL7\|7a/JL3b | G........KFLAP | 2382 |
| MA_10-G10_AS_CC_x_I2C0_x_scFc_(T1I)_translation Fv#2 | VL7\|7a/JL3b | G........KFLAP | 2383 |
| MA_10-G10_CC_x_I2C0_x_scFc_(B3A)_translation Fv#2 | VL7\|7a/JL3b | G........KFLAP | 2384 |
| MA_10-H1_CC_x_I2C0_x_scFc_(T9K)_translation Fv#2 | VL7\|7a/JL3b | G........KFLAP | 2385 |
| MA_10-H3_CC_x_I2C0_x_scFc_(M9L)_translation Fv#2 | VL7\|7a/JL3b | G........KFLAP | 2386 |
| MA_81-B9_CC_x_I2C0_x_scFc_(U4L)_translation Fv#2 | VL7\|7a/JL3b | G........KFLAP | 2387 |
| MA_86-A4_CC_x_I2C0_x_scFc_(K2W)_translation Fv#2 | VL7\|7a/JL3b | G........KFLAP | 2388 |
| MA_86-A4-N-F5_CC_x_I2C0_x_scFc_(M4H)_translation Fv#2 | VL7\|7a/JL3b | G........KFLAP | 2389 |
| MA_88-B3-F9_CC_x_I2C0_x_scFc_(Y4E)_translation Fv#2 | VL7\|7a/JL3b | G........KFLAP | 2390 |
| MA_98-C7_CC_x_I2C0_x_scFc_(Y8P)_translation Fv#2 | VL7\|7a/JL3b | G........KFLAP | 2391 |
| MA_98-G12_AS_CC_x_I2C0_x_scFc_(Q4Z)_translation Fv#2 | VL7\|7a/JL3b | G........KFLAP | 2392 |
| MA_SG-F28_CC_x_I2C0_x_scFc_(D9R)_translation Fv#2 | VL7\|7a/JL3b | G........KFLAP | 2393 |
| VL3\|3h/JL3b | | Y--------DSDRPS | 2394 |
| MA_03-D8_AS_CC_x_I2C0_x_scFc_(L7E)_translation Fv#1 | VL3\|3h/JL3b | D.........N.... | 2395 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_03-D8_CC_x_I2C0_x_scFc_(H6N)_translation Fv#1 | VL3\|3h/JL3b | D.........N.... | 2396 |
| MA_03-E7_AS_CC_x_I2C0_x_scFc_(L6M)_translation Fv#1 | VL3\|3h/JL3b | D.........N.... | 2397 |
| MA_03-H12_AS_CC_x_I2C0_x_scFc_(K5A)_translation Fv#1 | VL3\|3h/JL3b | | 2398 |
| | | L_FR3 | |
| VL3\|3h/JL2 | | GIPERFSGSNSG-NTATLTISRVEAGDEADYYC | 2508 |
| MA_03-C7_AS_CC_x_I2C0_x_scFc_(G2H)_translation Fv#1 | VL3\|3h/JL2 | .................................. | 2509 |
| MA_03-D12_AS_CC_x_I2C0_x_scFc_(L6A)_translation Fv#1 | VL3\|3h/JL2 | .................................. | 2510 |
| MA_03-E11_AS_CC_x_I2C0_x_scFc_(G2B)_translation Fv#1 | VL3\|3h/JL2 | .................................. | 2511 |
| MA_03-G10_AS_CC_x_I2C0_x_scFc_(N3H)_translation Fv#1 | VL3\|3h/JL2 | .................................. | 2512 |
| MA_03-G11_AS_CC_x_I2C0_x_scFc_(O4R)_translation Fv#1 | VL3\|3h/JL2 | ..........F........I............. | 2513 |
| MA_10-G10_AS_CC_x_I2C0_x_scFc_(T1I)_translation Fv#1 | VL3\|3h/JL2 | .................................. | 2514 |
| MA_10-G10_CC_x_I2C0_x_scFc_(B3A)_translation Fv#1 | VL3\|3h/JL2 | .................................. | 2515 |
| MA_88-B3-F9_CC_x_I2C0_x_scFc_(Y4E)_translation Fv#1 | VL3\|3h/JL2 | .................................. | 2516 |
| MA_98-C7_CC_x_I2C0_x_scFc_(Y8P)_translation Fv#1 | VL3\|3h/JL2 | .................................. | 2517 |
| MA_98-G12_AS_CC_x_I2C0_x_scFc_(Q4Z)_translation Fv#1 | VL3\|3h/JL2 | ..........F........I............. | 2518 |
| VL7\|7a/JL3b | | WTPARFSGSLLG--GKAALTLSGVQPEDEAEYYC | 2519 |
| MA_03-C7_AS_CC_x_I2C0_x_scFc_(G2H)_translation Fv#2 | VL7\|7a/JL3b | G................................ | 2520 |
| MA_03-D8_AS_CC_x_I2C0_x_scFc_(L7E)_translation Fv#2 | VL7\|7a/JL3b | G................................ | 2521 |
| MA_03-D8_CC_x_I2C0_x_scFc_(H6N)_translation Fv#2 | VL7\|7a/JL3b | G................................ | 2522 |
| MA_03-D12_AS_CC_x_I2C0_x_scFc_(L6A)_translation Fv#2 | VL7\|7a/JL3b | G................................ | 2523 |
| MA_03-E7_AS_CC_x_I2C0_x_scFc_(L6M)_translation Fv#2 | VL7\|7a/JL3b | G................................ | 2524 |
| MA_03-E11_AS_CC_x_I2C0_x_scFc_(G2B)_translation Fv#2 | VL7\|7a/JL3b | G................................ | 2525 |
| MA_03-G10_AS_CC_x_I2C0_x_scFc_(N3H)_translation Fv#2 | VL7\|7a/JL3b | G................................ | 2526 |
| MA_03-G11_AS_CC_x_I2C0_x_scFc_(O4R)_translation Fv#2 | VL7\|7a/JL3b | G................................ | 2527 |
| MA_03-H12_AS_CC_x_I2C0_x_scFc_(K5A)_translation Fv#2 | VL7\|7a/JL3b | G................................ | 2528 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-C7_CC_x_I2C0_x_scFc_(K9T)_translation Fv#2 | VL7\|7a/JL3b | G..................... ............ | 2529 |
| MA_09-E2_CC_x_I2C0_x_scFc_(V8T)_translation Fv#2 | VL7\|7a/JL3b | G..................... ............ | 2530 |
| MA_09-F11_CC_x_I2C0_x_scFc_(L6Q)_translation Fv#2 | VL7\|7a/JL3b | G..................... ............ | 2531 |
| MA_09-F12_CC_x_I2C0_x_scFc_(D1U)_translation Fv#2 | VL7\|7a/JL3b | G..................... ............ | 2532 |
| MA_09-G8_CC_x_I2C0_x_scFc_(I6K)_translation Fv#2 | VL7\|7a/JL3b | G..................... ............ | 2533 |
| MA_09-G10_CC_x_I2C0_x_scFc_(C4K)_translation Fv#2 | VL7\|7a/JL3b | G..................... ............ | 2534 |
| MA_09-G11_CC_x_I2C0_x_scFc_(Y9Q)_translation Fv#2 | VL7\|7a/JL3b | G..................... ............ | 2535 |
| MA_09-H7_CC_x_I2C0_x_scFc_(T3S)_translation Fv#2 | VL7\|7a/JL3b | G..................... ............ | 2536 |
| MA_09-H10_CC_x_I2C0_x_scFc_(B6N)_translation Fv#2 | VL7\|7a/JL3b | G..................... ............ | 2537 |
| MA_09-H11_CC_x_I2C0_x_scFc_(I8L)_translation Fv#2 | VL7\|7a/JL3b | G..................... ............ | 2538 |
| MA_10-B5_CC_x_I2C0_x_scFc_(H6H)_translation Fv#2 | VL7\|7a/JL3b | G..................... ............ | 2539 |
| MA_10-B6_CC_x_I2C0_x_scFc_(I3O)_translation Fv#2 | VL7\|7a/JL3b | G..................... ............ | 2540 |
| MA_10-D3_CC_x_I2C0_x_scFc_(O6B)_translation Fv#2 | VL7\|7a/JL3b | G..................... ............ | 2541 |
| MA_10-D6_CC_x_I2C0_x_scFc_(V6Z)_translation Fv#2 | VL7\|7a/JL3b | G..................... ............ | 2542 |
| MA_10-G2_CC_x_I2C0_x_scFc_(T1S)_translation Fv#2 | VL7\|7a/JL3b | G..................... ............ | 2543 |
| MA_10-G5_CC_x_I2C0_x_scFc_(S9O)_translation Fv#2 | VL7\|7a/JL3b | G..................... ............ | 2544 |
| MA_10-G10_AS_CC_x_I2C0_x_scFc_(T1I)_translation Fv#2 | VL7\|7a/JL3b | G..................... ............ | 2545 |
| MA_10-G10_CC_x_I2C0_x_scFc_(B3A)_translation Fv#2 | VL7\|7a/JL3b | G..................... ............ | 2546 |
| MA_10-H1_CC_x_I2C0_x_scFc_(T9K)_translation Fv#2 | VL7\|7a/JL3b | G..................... ............ | 2547 |
| MA_10-H3_CC_x_I2C0_x_scFc_(M9L)_translation Fv#2 | VL7\|7a/JL3b | G..................... ............ | 2548 |
| MA_81-B9_CC_x_I2C0_x_scFc_(U4L)_translation Fv#2 | VL7\|7a/JL3b | G..................... ............ | 2549 |
| MA_86-A4_CC_x_I2C0_x_scFc_(K2W)_translation Fv#2 | VL7\|7a/JL3b | G..................... ............ | 2550 |
| MA_86-A4-N-F5_CC_x_I2C0_x_scFc_(M4H)_translation Fv#2 | VL7\|7a/JL3b | G..................... ............ | 2551 |
| MA_88-B3-F9_CC_x_I2C0_x_scFc_(Y4E)_translation Fv#2 | VL7\|7a/JL3b | G..................... ............ | 2552 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_98-C7_CC_x_I2C0_x_scFc_(Y8P)_translation Fv#2 | VL7\|7a/JL3b | G....................<br>............ | 2553 |
| MA_98-G12_AS_CC_x_I2C0_x_scFc_(Q4Z)_translation Fv#2 | VL7\|7a/JL3b | G....................<br>............ | 2554 |
| MA_SG-F28_CC_x_I2C0_x_scFc_(D9R)_translation Fv#2 | VL7\|7a/JL3b | G....................<br>............ | 2555 |
| VL3\|3h/JL3b | | GIPERFSGSNSG--<br>NTATLTISRVEAGDEADYYC | 2556 |
| MA_03-D8_AS_CC_x_I2C0_x_scFc_(L7E)_translation Fv#1 | VL3\|3h/JL3b | ..........F........I..<br>............ | 2557 |
| MA_03-D8_CC_x_I2C0_x_scFc_(H6N)_translation Fv#1 | VL3\|3h/JL3b | ..........F........I..<br>............ | 2558 |
| MA_03-E7_CC_x_I2C0_x_scFc_(L6M)_translation Fv#1 | VL3\|3h/JL3b | ....................<br>............ | 2559 |
| MA_03-H12_AS_CC_x_I2C0_x_scFc_(K5A)_translation Fv#1 | VL3\|3h/JL3b | ..........F...........<br>............ | 2560 |
| | | H_CDR2 | |
| VH3\|3-23/D6\|6-19\|RF2/JH4 | | AISGS---GGSTYYADSVKG | 2399 |
| MA_03-C7_AS_CC_x_I2C0_x_scFc_(G2H)_translation Fv#1 | VH3\|3-23/D6\|6-19\|RF2/JH4 | ..........G....A.... | 2400 |
| MA_03-D8_AS_CC_x_I2C0_x_scFc_(L7E)_translation Fv#1 | VH3\|3-23/D6\|6-19\|RF2/JH4 | T.........G....A.... | 2401 |
| MA_03-D8_CC_x_I2C0_x_scFc_(H6N)_translation Fv#1 | VH3\|3-23/D6\|6-19\|RF2/JH4 | T.........G......... | 2402 |
| MA_03-D12_AS_CC_x_I2C0_x_scFc_(L6A)_translation Fv#1 | VH3\|3-23/D6\|6-19\|RF2/JH4 | ..........G....A...A | 2403 |
| MA_03-E7_AS_CC_x_I2C0_x_scFc_(L6M)_translation Fv#1 | VH3\|3-23/D6\|6-19\|RF2/JH4 | ..........G....A.G.. | 2404 |
| MA_03-E11_AS_CC_x_I2C0_x_scFc_(G2B)_translation Fv#1 | VH3\|3-23/D6\|6-19\|RF2/JH4 | ..........G..N.A.... | 2405 |
| MA_03-G10_AS_CC_x_I2C0_x_scFc_(N3H)_translation Fv#1 | VH3\|3-23/D6\|6-19\|RF2/JH4 | ..........G....A.... | 2406 |
| MA_03-G11_AS_CC_x_I2C0_x_scFc_(O4R)_translation Fv#1 | VH3\|3-23/D6\|6-19\|RF2/JH4 | ..........G....A.... | 2407 |
| MA_03-H12_AS_CC_x_I2C0_x_scFc_(K5A)_translation Fv#1 | VH3\|3-23/D6\|6-19\|RF2/JH4 | ..........G..N.A.... | 2408 |
| MA_10-G10_AS_CC_x_I2C0_x_scFc_(TI1)_translation Fv#1 | VH3\|3-23/D6\|6-19\|RF2/JH4 | ..........G..N.A.... | 2409 |
| MA_10-G10_CC_x_I2C0_x_scFc_(B3A)_translation Fv#1 | VH3\|3-23/D6\|6-19\|RF2/JH4 | ..........G..N...... | 2410 |
| MA_98-C7_CC_x_I2C0_x_scFc_(Y8P)_translation Fv#1 | VH3\|3-23/D6\|6-19\|RF2/JH4 | S.........G....A.... | 2411 |
| MA_98-G12_AS_CC_x_I2C0_x_scFc_(Q4Z)_translation Fv#1 | VH3\|3-23/D6\|6-19\|RF2/JH4 | ..........G..N.A.... | 2412 |
| VH3\|3-73/D3\|3-3\|RF3/JH4 | | RIRSKA-NSYATAYAASVKG | 2413 |
| MA_03-C7_AS_CC_x_I2C0_x_scFc_(G2H)_translation Fv#2 | VH3\|3-73/D3\|3-3\|RF3/JH4 | .....Y..N...Y..D...D | 2414 |
| MA_03-D8_AS_CC_x_I2C0_x_scFc_(L7E)_translation Fv#2 | VH3\|3-73/D3\|3-3\|RF3/JH4 | .....Y..N...Y..D...D | 2415 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_03-D8_CC_x_I2C0_x_scFc_(H6N)_translation Fv#2 | VH3\|3-73/D3\|3-3\|RF3/JH4 | .....Y..N...Y..D...D | 2416 |
| MA_03-D12_AS_CC_x_I2C0_x_scFc_(L6A)_translaton x Fv#2 | VH3\|3-73/D3\|3-3\|RF3/JH4 | .....Y..N...Y..D...D | 2417 |
| MA_03-E7_AS_CC_x_I2C0_x_scFc_(L6M)_translation Fv#2 | VH3\|3-73/D3\|3-3\|RF3/JH4 | .....Y..N...Y..D...D | 2418 |
| MA_03-E11_AS_CC_x_I2C0_x_scFc_(G2B)_translation Fv#2 | VH3\|3-73/D3\|3-3\|RF3/JH4 | .....Y..N...Y..D...D | 2419 |
| MA_03-G10_AS_CC_x_I2C0_x_scFc_(N3H)_translation Fv#2 | VH3\|3-73/D3\|3-3\|RF3/JH4 | .....Y..N...Y..D...D | 2420 |
| MA_03-G11_AS_CC_x_I2C0_x_scFc_(O4R)_translation Fv#2 | VH3\|3-73/D3\|3-3\|RF3/JH4 | .....Y..N...Y..D...D | 2421 |
| MA_03-H12_AS_CC_x_I2C0_x_scFc_(K5A)_translation Fv#2 | VH3\|3-73/D3\|3-3\|RF3/JH4 | .....Y..N...Y..D...D | 2422 |
| MA_09-C7_CC_x_I2C0_x_scFc_(K9T)_translation Fv#2 | VH3\|3-73/D3\|3-3\|RF3/JH4 | .....Y..N...Y..D...D | 2423 |
| MA_09-E2_CC_x_I2C0_x_scFc_(V8T)_translation Fv#2 | VH3\|3-73/D3\|3-3\|RF3/JH4 | .....Y..N...Y..D...D | 2424 |
| MA_09-F11_CC_x_I2C0_x_scFc_(L6Q)_translation Fv#2 | VH3\|3-73/D3\|3-3\|RF3/JH4 | .....Y..N...Y..D...D | 2425 |
| MA_09-F12_CC_x_I2C0_x_scFc_(D1U)_translation Fv#2 | VH3\|3-73/D3\|3-3\|RF3/JH4 | .....Y..N...Y..D...D | 2426 |
| MA_09-G8_CC_x_I2C0_x_scFc_(I6K)_translation Fv#2 | VH3\|3-73/D3\|3-3\|RF3/JH4 | .....Y..N...Y..D...D | 2427 |
| MA_09-G10_CC_x_I2C0_x_scFc_(C4K)_translation Fv#2 | VH3\|3-73/D3\|3-3\|RF3/JH4 | .....Y..N...Y..D...D | 2428 |
| MA_09-G11_CC_x_I2C0_x_scFc_(Y9Q)_translation Fv#2 | VH3\|3-73/D3\|3-3\|RF3/JH4 | .....Y..N...Y..D...D | 2429 |
| MA_09-H7_CC_x_I2C0_x_scFc_(T3S)_translation Fv#2 | VH3\|3-73/D3\|3-3\|RF3/JH4 | .....Y..N...Y..D...D | 2430 |
| MA_09-H10_CC_x_I2C0_x_scFc_(B6N)_translation Fv#2 | VH3\|3-73/D3\|3-3\|RF3/JH4 | .....Y..N...Y..D...D | 2431 |
| MA_09-H11_CC_x_I2C0_x_scFc_(I8L)_translation Fv#2 | VH3\|3-73/D3\|3-3\|RF3/JH4 | .....Y..N...Y..D...D | 2432 |
| MA_10-B5_CC_x_I2C0_x_scFc_(H6H)_translation Fv#2 | VH3\|3-73/D3\|3-3\|RF3/JH4 | .....Y..N...Y..D...D | 2433 |
| MA_10-B6_CC_x_I2C0_x_scFc_(I3O)_translation Fv#2 | VH3\|3-73/D3\|3-3\|RF3/JH4 | .....Y..N...Y..D...D | 2434 |
| MA_10-D3_CC_x_I2C0_x_scFc_(O6B)_translation Fv#2 | VH3\|3-73/D3\|3-3\|RF3/JH4 | .....Y..N...Y..D...D | 2435 |
| MA_10-D6_CC_x_I2C0_x_scFc_(V6Z)_translation Fv#2 | VH3\|3-73/D3\|3-3\|RF3/JH4 | .....Y..N...Y..D...D | 2436 |
| MA_10-G2_CC_x_I2C0_x_scFc_(T1S)_translation Fv#2 | VH3\|3-73/D3\|3-3\|RF3/JH4 | .....Y..N...Y..D...D | 2437 |
| MA_10-G5_CC_x_I2C0_x_scFc_(S9O)_translation Fv#2 | VH3\|3-73/D3\|3-3\|RF3/JH4 | .....Y..N...Y..D...D | 2438 |
| MA_10-G10_AS_CC_x_I2C0_x_scFc_(T1I)_translation Fv#2 | VH3\|3-73/D3\|3-3\|RF3/JH4 | .....Y..N...Y..D...D | 2439 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_10-G10_CC_x_I2C0_x_scFc_(B3A)_translation Fv#2 | VH3\|3-73/D3\|3-3\|RF3/JH4 | .....Y..N...Y..D...D | 2440 |
| MA_10-H1_CC_x_I2C0_x_scFc_(T9K)_translation Fv#2 | VH3\|3-73/D3\|3-3\|RF3/JH4 | .....Y..N...Y..D...D | 2441 |
| MA_10-H3_CC_x_I2C0_x_scFc_(M9L)_translation Fv#2 | VH3\|3-73/D3\|3-3\|RF3/JH4 | .....Y..N...Y..D...D | 2442 |
| MA_81-B9_CC_x_I2C0_x_scFc_(U4L)_translation Fv#2 | VH3\|3-73/D3\|3-3\|RF3/JH4 | .....Y..N...Y..D...D | 2443 |
| MA_86-A4_CC_x_I2C0_x_scFc_(K2W)_translation Fv#2 | VH3\|3-73/D3\|3-3\|RF3/JH4 | .....Y..N...Y..D...D | 2444 |
| MA_86-A4-N-F5_CC_x_I2C0_x_scFc_(M4H)_translation Fv#2 | VH3\|3-73/D3\|3-3\|RF3/JH4 | .....Y..N...Y..D...D | 2445 |
| MA_88-B3-F9_CC_x_I2C0_x_scFc_(Y4E)_translation Fv#2 | VH3\|3-73/D3\|3-3\|RF3/JH4 | .....Y..N...Y..D...D | 2446 |
| MA_98-C7_CC_x_I2C0_x_scFc_(Y8P)_translation Fv#2 | VH3\|3-73/D3\|3-3\|RF3/JH4 | .....Y..N...Y..D...D | 2447 |
| MA_98-G12_AS_CC_x_I2C0_x_scFc_(Q4Z)_translation Fv#2 | VH3\|3-73/D3\|3-3\|RF3/JH4 | .....Y..N...Y..D...D | 2448 |
| MA_SG-F28_CC_x_I2C0_x_scFc_(D9R)_translation Fv#2 | VH3\|3-73/D3\|3-3\|RF3/JH4 | .....Y..N...Y..D...D | 2449 |
| VH\|2-70/D2\|2-15\|RF1/JH5 | | RIDW----DDDKFYSTSLKT | 2450 |
| MA_09-C7_CC_x_I2C0_x_scFc_(K9T)_translation Fv#1 | VH2\|2-70/D2\|2-15\|RF1/JH5 | E.HS....E...R..P..QS | 2451 |
| VH3\|3-15/D3\|3-10\|RF2/JH6 | | RIKSKT-DGGTTDYAAPVKG | H FR3 2452 |
| MA_09-E2_CC_x_I2C0_x_scFc_(V8T)_translation Fv#1 | VH3\|3-15/D3\|3-10\|RF2/JH6 | .......Y............ | 2453 |
| MA_10-B5_CC_x_I2C0_x_scFc_(H6H)_translation Fv#1 | VH3\|3-15/D3\|3-10\|RF2/JH6 | ..R.RS.Y............ | 2454 |
| MA_10-B6_CC_x_I2C0_x_scFc_(I3O)_translation Fv#1 | VH3\|3-15/D3\|3-10\|RF2/JH6 | .......Y............ | 2455 |
| MA_10-D3_CC_x_I2C0_x_scFc_(O6B)_translation Fv#1 | VH3\|3-15/D3\|3-10\|RF2/JH6 | ...T.SR.Y............ | 2456 |
| MA_10-D6_CC_x_I2C0_x_scFc_(V6Z)_translation Fv#1 | VH3\|3-15/D3\|3-10\|RF2/JH6 | ..LNNA.Y............ | 2457 |
| MA_10-G2_CC_x_I2C0_x_scFc_(T1S)_translation Fv#1 | VH3\|3-15/D3\|3-10\|RF2/JH6 | ..L.MH.Y............ | 2458 |
| MA_10-G5_CC_x_I2C0_x_scFc_(S9O)_translation Fv#1 | VH3\|3-15/D3\|3-10\|RF2/JH6 | ..V.S..Y............ | 2459 |
| MA_10-H1_CC_x_I2C0_x_scFc_(T9K)_translation Fv#1 | VH3\|3-15/D3\|3-10\|RF2/JH6 | ...T.GI.Y............ | 2460 |
| MA_10-H3_CC_x_I2C0_x_scFc_(M9L)_translation Fv#1 | VH3\|3-15/D3\|3-10\|RF2/JH6 | ..R.RP.Y............ | 2461 |
| VH2\|2-05/D2\|2-15\|RF1/JH5 | | LIYW----NDDKRYSPSLKS | 2462 |
| MA_09-F11_CC_x_I2C0_x_scFc_(L6Q)_translation Fv#1 | VH2\|2-05/D2\|2-15\|RF1/JH5 | ..................Q. | 2463 |
| MA_09-F12_CC_x_I2C0_x_scFc_(D1U)_translation Fv#1 | VH2\|2-05/D2\|2-15\|RF1/JH5 | ..................Q. | 2464 |
| MA_09-G8_CC_x_I2C0_x_scFc_(I6K)_translation Fv#1 | VH2\|2-05/D2\|2-15\|RF1/JH5 | ..................Q. | 2465 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-G10_CC_x_I2C0_x_scFc_(C4K)_translation Fv#1 | VH2\|2-05/D2\|2-15\|RF1/JH5 | G.HI....Y.........Q. | 2466 |
| MA_09-G11_CC_x_I2C0_x_scFc_(Y9Q)_translation Fv#1 | VH2\|2-05/D2\|2-15\|RF1/JH5 | ..................Q. | 2467 |
| MA_09-H7_CC_x_I2C0_x_scFc_(T3S)_translation Fv#1 | VH2\|2-05/D2\|2-15\|RF1/JH5 | ..................Q. | 2468 |
| MA_09-H10_CC_x_I2C0_x_scFc_(B6N)_translation Fv#1 | VH2\|2-05/D2\|2-15\|RF1/JH5 | ..................Q. | 2469 |
| MA_09-H11_CC_x_I2C0_x_scFc_(I8L)_translation Fv#1 | VH2\|2-05/D2\|2-15\|RF1/JH5 | ..................Q. | 2470 |
| VH4\|4-59/D3\|3-3\|RF3/JH4 | | YIYY----SGSTNYNPSLKS | 2471 |
| MA_81-B9_CC_x_I2C0_x_scFc_(U4L)_translation Fv#1 | VH4\|4-59/D3\|3-3\|RF3/JH4 | S...........Y....... | 2472 |
| VH3\|3-30.3/D1\|1-1\|RF2/JH4 | | VISYD---GSNKYYADSVKG | 2473 |
| MA_86-A4_CC_x_I2C0_x_scFc_(K2W)_translation Fv#1 | VH3\|3-30.3/D1\|1-1\|RF2/JH4 | ........A......E.... | 2474 |
| MA_86-A4-N-F5_CC_x_I2C0_x_scFc_(M4H)_translation Fv#1 | VH3\|3-30.3/D1\|1-1\|RF2/JH4 | ........AETVK..E.... | 2475 |
| VH3\|3-11/D1\|1-1\|RF3/JH4 | | YISSS--GSTIYYADSVKG | 2476 |
| MA_88-B3-F9_CC_x_I2C0_x_scFc_(Y4E)_translation Fv#1 | VH3\|3-11/D1\|1-1\|RF3/JH4 | ...K....SY.VT..A... | 2477 |
| VH4\|4-30.1/D3\|3-10\|RF3/JH6 | | YIYY----SGSTYYNPSLKS | 2478 |
| MA_SG-F28_CC_x_I2C0_x_scFc_(D9R)_translation Fv#1 | VH4\|4-30.1/D3\|3-10\|RF3/JH6 | ...S.......I.N....... | 2479 |
| | | H_FR3 | |
| VH3\|3-23/D6\|6-19\|RF2/JH4 | | RFTISRDNSKNTLYLQMNSLRA EDTAVYYCAK | 2561 |
| MA_03-C7_AS_CC_x_I2C0_x_scFc_(G2H)_translation Fv#1 | VH3\|3-23/D6\|6-19\|RF2/JH4 | ...........T | 2562 |
| MA_03-D8_AS_CC_x_I2C0_x_scFc_(L7E)_translation Fv#1 | VH3\|3-23/D6\|6-19\|RF2/JH4 | ...........T | 2563 |
| MA_03-D8_CC_x_I2C0_x_scFc_(H6N)_translation Fv#1 | VH3\|3-23/D6\|6-19\|RF2/JH4 | ...........T | 2564 |
| MA_03-D12_AS_CC_x_I2C0_x_scFc_(L6A)_translation Fv#1 | VH3\|3-23/D6\|6-19\|RF2/JH4 | ...........T | 2565 |
| MA_03-E7_AS_CC_x_I2C0_x_scFc_(L6M)_translation Fv#1 | VH3\|3-23/D6\|6-19\|RF2/JH4 | ....A...VT | 2566 |
| MA_03-E11_AS_CC_x_I2C0_x_scFc_(G2B)_translation Fv#1 | VH3\|3-23/D6\|6-19\|RF2/JH4 | ....A...VT | 2567 |
| MA_03-G10_AS_CC_x_I2C0_x_scFc_(N3H)_translation Fv#1 | VH3\|3-23/D6\|6-19\|RF2/JH4 | ................S.... | 2568 |
| MA_03-G11_AS_CC_x_I2C0_x_scFc_(O4R)_translation Fv#1 | VH3\|3-23/D6\|6-19\|RF2/JH4 | ...........T | 2569 |
| MA_03-H12_AS_CC_x_I2C0_x_scFc_(K5A)_translation Fv#1 | VH3\|3-23/D6\|6-19\|RF2/JH4 | ....A...VT | 2570 |
| MA_10-G10_AS_CC_x_I2C0_x_scFc_(TI1)_translation Fv#1 | VH3\|3-23/D6\|6-19\|RF2/JH4 | ...........T | 2571 |
| MA_10-G10_CC_x_I2C0_x_scFc_(B3A)_translation Fv#1 | VH3\|3-23/D6\|6-19\|RF2/JH4 | ...........T | 2572 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_98-C7_CC_x_I2C0_x_scFc_(Y8P)_translation Fv#1 | VH3\|3-23/D6\|6-19\|RF2/JH4 | ......................T | 2573 |
| MA_98-G12_AS_CC_x_I2C0_x_scFc_(Q4Z)_translation Fv#1 | VH3\|3-23/D6\|6-19\|RF2/JH4 | ....A...VT | 2574 |
| VH3\|3-73/D3\|3-3\|RF3/JH4 | | RFTISRDDSKNTAYLQMNSLKTEDTAVYYCTR | 2575 |
| MA_03-C7_AS_CC_x_I2C0_x_scFc_(G2H)_translation Fv#2 | VH3\|3-73/D3\|3-3\|RF3/JH4 | ..................N...<br>.......V. | 2576 |
| MA_03-D8_AS_CC_x_I2C0_x_scFc_(L7E)_translation Fv#2 | VH3\|3-73/D3\|3-3\|RF3/JH4 | ..................N...<br>.......V. | 2577 |
| MA_03-D8_CC_x_I2C0_x_scFc_(H6N)_translation Fv#2 | VH3\|3-73/D3\|3-3\|RF3/JH4 | ..................N...<br>.......V. | 2578 |
| MA_03-D12_AS_CC_x_I2C0_x_scFc_(L6A)_translaton x Fv#2 | VH3\|3-73/D3\|3-3\|RF3/JH4 | ..................N...<br>.......V. | 2579 |
| MA_03-E7_AS_CC_x_I2C0_x_scFc_(L6M)_translation Fv#2 | VH3\|3-73/D3\|3-3\|RF3/JH4 | ..................N...<br>.......V. | 2580 |
| MA_03-E11_AS_CC_x_I2C0_x_scFc_(G2B)_translation Fv#2 | VH3\|3-73/D3\|3-3\|RF3/JH4 | ..................N...<br>.......V. | 2581 |
| MA_03-G10_AS_CC_x_I2C0_x_scFc_(N3H)_translation Fv#2 | VH3\|3-73/D3\|3-3\|RF3/JH4 | ..................N...<br>.......V. | 2582 |
| MA_03-G11_AS_CC_x_I2C0_x_scFc_(O4R)_translation Fv#2 | VH3\|3-73/D3\|3-3\|RF3/JH4 | ..................N...<br>.......V. | 2583 |
| MA_03-H12_AS_CC_x_I2C0_x_scFc_(K5A)_translation Fv#2 | VH3\|3-73/D3\|3-3\|RF3/JH4 | ..................N...<br>.......V. | 2584 |
| MA_09-C7_CC_x_I2C0_x_scFc_(K9T)_translation Fv#2 | VH3\|3-73/D3\|3-3\|RF3/JH4 | ..................N...<br>.......V. | 2585 |
| MA_09-E2_CC_x_I2C0_x_scFc_(V8T)_translation Fv#2 | VH3\|3-73/D3\|3-3\|RF3/JH4 | ..................N...<br>.......V. | 2586 |
| MA_09-F11_CC_x_I2C0_x_scFc_(L6Q)_translation Fv#2 | VH3\|3-73/D3\|3-3\|RF3/JH4 | ..................N...<br>.......V. | 2587 |
| MA_09-F12_CC_x_I2C0_x_scFc_(D1U)_translation Fv#2 | VH3\|3-73/D3\|3-3\|RF3/JH4 | ..................N...<br>.......V. | 2588 |
| MA_09-G8_CC_x_I2C0_x_scFc_(I6K)_translation Fv#2 | VH3\|3-73/D3\|3-3\|RF3/JH4 | ..................N...<br>.......V. | 2589 |
| MA_09-G10_CC_x_I2C0_x_scFc_(C4K)_translation Fv#2 | VH3\|3-73/D3\|3-3\|RF3/JH4 | ..................N...<br>.......V. | 2590 |
| MA_09-G11_CC_x_I2C0_x_scFc_(Y9Q)_translation Fv#2 | VH3\|3-73/D3\|3-3\|RF3/JH4 | ..................N...<br>.......V. | 2591 |
| MA_09-H7_CC_x_I2C0_x_scFc_(T3S)_translation Fv#2 | VH3\|3-73/D3\|3-3\|RF3/JH4 | ..................N...<br>.......V. | 2592 |
| MA_09-H10_CC_x_I2C0_x_scFc_(B6N)_translation Fv#2 | VH3\|3-73/D3\|3-3\|RF3/JH4 | ..................N...<br>.......V. | 2593 |
| MA_09-H11_CC_x_I2C0_x_scFc_(I8L)_translation Fv#2 | VH3\|3-73/D3\|3-3\|RF3/JH4 | ..................N...<br>.......V. | 2594 |
| MA_10-B5_CC_x_I2C0_x_scFc_(H6H)_translation Fv#2 | VH3\|3-73/D3\|3-3\|RF3/JH4 | ..................N...<br>.......V. | 2595 |
| MA_10-B6_CC_x_I2C0_x_scFc_(I3O)_translation Fv#2 | VH3\|3-73/D3\|3-3\|RF3/JH4 | ..................N...<br>.......V. | 2596 |
| MA_10-D3_CC_x_I2C0_x_scFc_(O6B)_translation Fv#2 | VH3\|3-73/D3\|3-3\|RF3/JH4 | ..................N...<br>.......V. | 2597 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_10-D6_CC_x_I2C0_x_scFc_(V6Z)_translation Fv#2 | VH3\|3-73/D3\|3-3\|RF3/JH4 | ................N...<br>.......V. | 2598 |
| MA_10-G2_CC_x_I2C0_x_scFc_(T1S)_translation Fv#2 | VH3\|3-73/D3\|3-3\|RF3/JH4 | ................N...<br>.......V. | 2599 |
| MA_10-G5_CC_x_I2C0_x_scFc_(S9O)_translation Fv#2 | VH3\|3-73/D3\|3-3\|RF3/JH4 | ................N...<br>.......V. | 2600 |
| MA_10-G10_AS_CC_x_I2C0_x_scFc_(T1I)_translation Fv#2 | VH3\|3-73/D3\|3-3\|RF3/JH4 | ................N...<br>.......V. | 2601 |
| MA_10-G10_CC_x_I2C0_x_scFc_(B3A)_translation Fv#2 | VH3\|3-73/D3\|3-3\|RF3/JH4 | ................N...<br>.......V. | 2602 |
| MA_10-H1_CC_x_I2C0_x_scFc_(T9K)_translation Fv#2 | VH3\|3-73/D3\|3-3\|RF3/JH4 | ................N...<br>.......V. | 2603 |
| MA_10-H3_CC_x_I2C0_x_scFc_(M9L)_translation Fv#2 | VH3\|3-73/D3\|3-3\|RF3/JH4 | ................N...<br>.......V. | 2604 |
| MA_81-B9_CC_x_I2C0_x_scFc_(U4L)_translation Fv#2 | VH3\|3-73/D3\|3-3\|RF3/JH4 | ................N...<br>.......V. | 2605 |
| MA_86-A4_CC_x_I2C0_x_scFc_(K2W)_translation Fv#2 | VH3\|3-73/D3\|3-3\|RF3/JH4 | ................N...<br>.......V. | 2606 |
| MA_86-A4-N-F5_CC_x_I2C0_x_scFc_(M4H)_translation Fv#2 | VH3\|3-73/D3\|3-3\|RF3/JH4 | ................N...<br>.......V. | 2607 |
| MA_88-B3-F9_CC_x_I2C0_x_scFc_(Y4E)_translation Fv#2 | VH3\|3-73/D3\|3-3\|RF3/JH4 | ................N...<br>.......V. | 2608 |
| MA_98-C7_CC_x_I2C0_x_scFc_(Y8P)_translation Fv#2 | VH3\|3-73/D3\|3-3\|RF3/JH4 | ................N...<br>.......V. | 2609 |
| MA_98-G12_AS_CC_x_I2C0_x_scFc_(Q4Z)_translation Fv#2 | VH3\|3-73/D3\|3-3\|RF3/JH4 | .Y..N...Y..D...D................N...<br>.......V. | 2610 |
| MA_SG-F28_CC_x_I2C0_x_scFc_(D9R)_translation Fv#2 | VH3\|3-73/D3\|3-3\|RF3/JH4 | ..Y..N...Y..D...D................N...<br>.......V. | 2611 |
| VH2\|2-70/D2\|2-15\|RF1/JH5 | | RLTISKDTSKNQVVLTMTNMDP<br>VDTATYYCAR | 2612 |
| MA_09-C7_CC_x_I2C0_x_scFc_(K9T)_translation Fv#1 | VH2\|2-70/D2\|2-15\|RF1/JH5 | ....T................<br>........Y | 2613 |
| VH3\|3-15/D3\|3-10\|RF2/JH6 | | RFTISRDDSKNTLYLQMNSLKT<br>EDTAVYYCTT | 2614 |
| MA_09-E2_CC_x_I2C0_x_scFc_(V8T)_translation Fv#1 | VH3\|3-15/D3\|3-10\|RF2/JH6 | .............F........<br>......... | 2615 |
| MA_10-B5_CC_x_I2C0_x_scFc_(H6H)_translation Fv#1 | VH3\|3-15/D3\|3-10\|RF2/JH6 | .............F........<br>......... | 2616 |
| MA_10-B6_CC_x_I2C0_x_scFc_(I3O)_translation Fv#1 | VH3\|3-15/D3\|3-10\|RF2/JH6 | ......................<br>......... | 2617 |
| MA_10-D3_CC_x_I2C0_x_scFc_(O6B)_translation Fv#1 | VH3\|3-15/D3\|3-10\|RF2/JH6 | .............F........<br>......... | 2618 |
| MA_10-D6_CC_x_I2C0_x_scFc_(V6Z)_translation Fv#1 | VH3\|3-15/D3\|3-10\|RF2/JH6 | ......................<br>......... | 2619 |
| MA_10-G2_CC_x_I2C0_x_scFc_(T1S)_translation Fv#1 | VH3\|3-15/D3\|3-10\|RF2/JH6 | ......................<br>......... | 2620 |
| MA_10-G5_CC_x_I2C0_x_scFc_(S9O)_translation Fv#1 | VH3\|3-15/D3\|3-10\|RF2/JH6 | ......................<br>......... | 2621 |
| MA_10-H1_CC_x_I2C0_x_scFc_(T9K)_translation Fv#1 | VH3\|3-15/D3\|3-10\|RF2/JH6 | ......................<br>......... | 2622 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_10-H3_CC_x_I2C0_x_scFc_(M9L)_translation Fv#1 | VH3\|3-15/D3\|3-10\|RF2/JH6 | ..................... ......... | 2623 |
| VH2\|2-05/D2\|2-15\|RF1/JH5 | | RLTITKDTSKNQVVLTMTNMDP VDTATYYCAH | 2624 |
| MA_09-F11_CC_x_I2C0_x_scFc_(L6Q)_translation Fv#1 | VH2\|2-05/D2\|2-15\|RF1/JH5 | ..................... ........Y | 2625 |
| MA_09-F12_CC_x_I2C0_x_scFc_(D1U)_translation Fv#1 | VH2\|2-05/D2\|2-15\|RF1/JH5 | ..................... ........Y | 2626 |
| MA_09-G8_CC_x_I2C0_x_scFc_(I6K)_translation Fv#1 | VH2\|2-05/D2\|2-15\|RF1/JH5 | ..................... ........Y | 2627 |
| MA_09-G10_CC_x_I2C0_x_scFc_(C4K)_translation Fv#1 | VH2\|2-05/D2\|2-15\|RF1/JH5 | ..................... ........Y | 2628 |
| MA_09-G11_CC_x_I2C0_x_scFc_(Y9Q)_translation Fv#1 | VH2\|2-05/D2\|2-15\|RF1/JH5 | ..................... ........Y | 2629 |
| MA_09-H7_CC_x_I2C0_x_scFc_(T3S)_translation Fv#1 | VH2\|2-05/D2\|2-15\|RF1/JH5 | ..................... ........Y | 2630 |
| MA_09-H10_CC_x_I2C0_x_scFc_(B6N)_translation Fv#1 | VH2\|2-05/D2\|2-15\|RF1/JH5 | ..................... ........Y | 2631 |
| MA_09-H11_CC_x_I2C0_x_scFc_(I8L)_translation Fv#1 | VH2\|2-05/D2\|2-15\|RF1/JH5 | ..................... ........Y | 2632 |
| VH4\|4-59/D3\|3-3\|RF3/JH4 | | RVTISVDTSKNQFSLKLSSVTA ADTAVYYCAR | 2633 |
| MA_81-B9_CC_x_I2C0_x_scFc_(U4L)_translation Fv#1 | VH4\|4-59/D3\|3-3\|RF3/JH4 | ..................... ......... | 2634 |
| VH3\|3-30.3/D1\|1-1\|RF2/JH4 | | RFTISRDNSKNTLYLQMNSLRA EDTAVYYCAR | 2635 |
| MA_86-A4_CC_x_I2C0_x_scFc_(K2W)_translation Fv#1 | VH3\|3-30.3/D1\|1-1\|RF2/JH4 | ..................... ......... | 2636 |
| MA_86-A4-N-F5_CC_x_I2C0_x_scFc_(M4H)_translation Fv#1 | VH3\|3-30.3/D1\|1-1\|RF2/JH4 | ..................... ......... | 2637 |
| VH3\|3-11/D1\|1-1\|RF3/JH4 | | RFTISRDNAKNSLYLQMNSLRA EDTAVYYCAR | 2638 |
| MA_88-B3-F9_CC_x_I2C0_x_scFc_(Y4E)_translation Fv#1 | VH3\|3-11/D1\|1-1\|RF3/JH4 | ..................... .......T | 2639 |
| VH4\|4-30.1/D3\|3-10\|RF3/JH6 | | RVTISVDTSKNQFSLKLSSVTA ADTAVYYCAR | 2640 |
| MA_SG-F28_CC_x_I2C0_x_scFc_(D9R)_translation Fv#1 | VH4\|4-30.1/D3\|3-10\|RF3/JH6 | ....M............T.L.. ......... | 2641 |
| | | K_CDR3 | |
| VK1\|O12/JK1 | | QQSYS----------------------TPWT | 2642 |
| MA_09-C7_CC_x_I2C0_x_scFc_(K9T)_translation Fv#1 | VK1\|O12/JK1 | ....I........................F. | 2643 |
| MA_09-E2_CC_x_I2C0_x_scFc_(V8T)_translation Fv#1 | VK1\|O12/JK1 | ............................S.F. | 2644 |
| MA_09-F11_CC_x_I2C0_x_scFc_(L6Q)_translation Fv#1 | VK1\|O12/JK1 | ....M......................W.TI | 2645 |
| MA_09-F12_CC_x_I2C0_x_scFc_(D1U)_translation Fv#1 | VK1\|O12/JK1 | ....Y......................Y.TL | 2646 |
| MA_09-G8_CC_x_I2C0_x_scFc_(I6K)_translation Fv#1 | VK1\|O12/JK1 | ....T...................LHPL | 2647 |
| MA_09-G10_CC_x_I2C0_x_scFc_(C4K)_translation Fv#1 | VK1\|O12/JK1 | ....I........................F. | 2648 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-G11_CC_x_I2C0_x_scFc_(Y9Q)_translation Fv#1 | VK1\|O12/JK1 | ...Q.....................S.T. | 2649 |
| MA_09-H7_CC_x_I2C0_x_scFc_(T3S)_translation Fv#1 | VK1\|O12/JK1 | ...F.....................PVVE | 2650 |
| MA_09-H10_CC_x_I2C0_x_scFc_(B6N)_translation Fv#1 | VK1\|O12/JK1 | ...T.....................P.T. | 2651 |
| MA_09-H11_CC_x_I2C0_x_scFc_(I8L)_translation Fv#1 | VK1\|O12/JK1 | .........................Y.NS | 2652 |
| MA_10-B5_CC_x_I2C0_x_scFc_(H6H)_translation Fv#1 | VK1\|O12/JK1 | ..T......................M.F. | 2653 |
| VK1\|O12/JK2 | | QQSYS---------------------TPYT | 2654 |
| MA_10-B6_CC_x_I2C0_x_scFc_(I3O)_translation Fv#1 | VK1\|O12/JK2 | I.A.T....................S.F. | 2655 |
| MA_10-H3_CC_x_I2C0_x_scFc_(M9L)_translation Fv#1 | VK1\|O12/JK2 | ..T......................S.F. | 2656 |
| VK1\|O12/JK3 | | QQSYS---------------------TPFT | 2657 |
| MA_10-D3_CC_x_I2C0_x_scFc_(O6B)_translation Fv#1 | VK1\|O12/JK3 | ..T......................M... | 2658 |
| MA_10-D6_CC_x_I2C0_x_scFc_(V6Z)_translation Fv#1 | VK1\|O12/JK3 | ..T......................M... | 2659 |
| MA_10-G2_CC_x_I2C0_x_scFc_(T1S)_translation Fv#1 | VK1\|O12/JK3 | ..T......................M... | 2660 |
| MA_10-G5_CC_x_I2C0_x_scFc_(S9O)_translation Fv#1 | VK1\|O12/JK3 | ..T......................M... | 2661 |
| MA_10-H1_CC_x_I2C0_x_scFc_(T9K)_translation Fv#1 | VK1\|O12/JK3 | ..T......................M... | 2662 |
| VK4\|B3/JK5 | | QQYYS---------------------TPIT | 2663 |
| MA_81-B9_CC_x_I2C0_x_scFc_(U4L)_translation Fv#1 | VK4\|B3/JK5 | ..F........................... | 2664 |
| VK1\|A20/JK1 | | QKYNS---------------------APWT | 2665 |
| MA_86-A4_CC_x_I2C0_x_scFc_(K2W)_translation Fv#1 | VK1\|A20/JK1 | ............................F. | 2666 |
| MA_86-A4-N-F5_CC_x_I2C0_x_scFc_(M4H)_translation Fv#1 | VK1\|A20/JK1 | ............................F. | 2667 |
| VK2\|O1/JK1 | | MQRIE---------------------FPWT | 2668 |
| MA_SG-F28_CC_x_I2C0_x_scFc_(D9R)_translation Fv#1 | VK2\|O1/JK1 | ..ALQ....................T... | 2669 |
| | | K_FR4 | |
| VK1\|O12/JK1 | | FGQGTKVEIK | 2804 |
| MA_09-C7_CC_x_I2C0_x_scFc_(K9T)_translation Fv#1 | VK1\|O12/JK1 | ...C...... | 2805 |
| MA_09-E2_CC_x_I2C0_x_scFc_(V8T)_translation Fv#1 | VK1\|O12/JK1 | ...C...... | 2806 |
| MA_09-F11_CC_x_I2C0_x_scFc_(L6Q)_translation Fv#1 | VK1\|O12/JK1 | ...C...... | 2807 |
| MA_09-F12_CC_x_I2C0_x_scFc_(D1U)_translation Fv#1 | VK1\|O12/JK1 | ...C...... | 2808 |
| MA_09-G8_CC_x_I2C0_x_scFc_(I6K)_translation Fv#1 | VK1\|O12/JK1 | ...C...... | 2809 |
| MA_09-G10_CC_x_I2C0_x_scFc_(C4K)_translation Fv#1 | VK1\|O12/JK1 | ...C...... | 2810 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-G11_CC_x_I2C0_x_scFc_(Y9Q)_translation Fv#1 | VK1\|O12/JK1 | ...C....... | 2811 |
| MA_09-H7_CC_x_I2C0_x_scFc_(T3S)_translation Fv#1 | VK1\|O12/JK1 | ...C....... | 2812 |
| MA_09-H10_CC_x_I2C0_x_scFc_(B6N)_translation Fv#1 | VK1\|O12/JK1 | ...C....... | 2813 |
| MA_09-H11_CC_x_I2C0_x_scFc_(I8L)_translation Fv#1 | VK1\|O12/JK1 | ...C....... | 2814 |
| MA_10-B5_CC_x_I2C0_x_scFc_(H6H)_translation Fv#1 | VK1\|O12/JK1 | ...C....... | 2815 |
| VK1\|O12/JK2 | | FGQGTKLEIK | 2816 |
| MA_10-B6_CC_x_I2C0_x_scFc_(I3O)_translation Fv#1 | VK1\|O12/JK2 | ...C....... | 2817 |
| MA_10-H3_CC_x_I2C0_x_scFc_(M9L)_translation Fv#1 | VK1\|O12/JK2 | ...C....... | 2818 |
| VK1\|O12/JK3 | | FGPGTKVDIK | 2819 |
| MA_10-D3_CC_x_I2C0_x_scFc_(O6B)_translation Fv#1 | VK1\|O12/JK3 | ...C....... | 2820 |
| MA_10-D6_CC_x_I2C0_x_scFc_(V6Z)_translation Fv#1 | VK1\|O12/JK3 | ...C....... | 2821 |
| MA_10-G2_CC_x_I2C0_x_scFc_(T1S)_translation Fv#1 | VK1\|O12/JK3 | ...C....... | 2822 |
| MA_10-G5_CC_x_I2C0_x_scFc_(S9O)_translation Fv#1 | VK1\|O12/JK3 | ...C....... | 2823 |
| MA_10-H1_CC_x_I2C0_x_scFc_(T9K)_translation Fv#1 | VK1\|O12/JK3 | ...C....... | 2824 |
| VK4\|B3/JK5 | | FGQGTRLEIK | 2825 |
| MA_81-B9_CC_x_I2C0_x_scFc_(U4L)_translation Fv#1 | VK4\|B3/JK5 | ...C....... | 2826 |
| VK1\|A20/JK1 | | FGQGTKVEIK | 2827 |
| MA_86-A4_CC_x_I2C0_x_scFc_(K2W)_translation Fv#1 | VK1\|A20/JK1 | ...C....... | 2828 |
| MA_86-A4-N-F5_CC_x_I2C0_x_scFc_(M4H)_translation Fv#1 | VK1\|A20/JK1 | ...C....... | 2829 |
| VK2\|O1/JK1 | | FGQGTKVEIK | 2830 |
| MA_SG-F28_CC_x_I2C0_x_scFc_(D9R)_translation Fv#1 | VK2\|O1/JK1 | ...C....... | 2831 |
| | | L_CDR3 | |
| VL3\|3h/JL2 | | QVWDSS---------------------SDHVV | 2670 |
| MA_03-C7_AS_CC_x_I2C0_x_scFc_(G2H)_translation Fv#1 | VL3\|3h/JL2 | .....YE.................R-PAM. | 2671 |
| MA_03-D12_AS_CC_x_I2C0_x_scFc_(L6A)_translation Fv#1 | VL3\|3h/JL2 | .....YL....................RQQQ | 2672 |
| MA_03-E11_AS_CC_x_I2C0_x_scFc_(G2B)_translation Fv#1 | VL3\|3h/JL2 | .....YY....................NRA | 2673 |
| MA_03-G10_AS_CC_x_I2C0_x_scFc_(N3H)_translation Fv#1 | VL3\|3h/JL2 | .....Y.....................GQRQ | 2674 |
| MA_03-G11_AS_CC_x_I2C0_x_scFc_(O4R)_translation Fv#1 | VL3\|3h/JL2 | .....YL....................LPGQ | 2675 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_10-G10_AS_CC_x_I2C0_x_scFc_(T1I)_translation Fv#1 | VL3\|3h/JL2 | ....YV......................APRH | 2676 |
| MA_10-G10_CC_x_I2C0_x_scFc_(B3A)_translation Fv#1 | VL3\|3h/JL2 | ....YV......................APRH | 2677 |
| MA_88-B3-F9_CC_x_I2C0_x_scFc_(Y4E)_translation Fv#1 | VL3\|3h/JL2 | ....A........................AGYG. | 2678 |
| MA_98-C7_CC_x_I2C0_x_scFc_(Y8P)_translation Fv#1 | VL3\|3h/JL2 | ....Y........................PLRH | 2679 |
| MA_98-G12_AS_CC_x_I2C0_x_scFc_(Q4Z)_translation Fv#1 | VL3\|3h/JL2 | ....YF.......................MTH | 2680 |
| VL7\|7a/JL3b |  | LLYYG---------------------GAQWV | 2681 |
| MA_03-C7_AS_CC_x_I2C0_x_scFc_(G2H)_translation Fv#2 | VL7\|7a/JL3b | V.W.S......................-NR.. | 2682 |
| MA_03-D8_AS_CC_x_I2C0_x_scFc_(L7E)_translation Fv#2 | VL7\|7a/JL3b | V.W.S......................-NR.. | 2683 |
| MA_03-D8_CC_x_I2C0_x_scFc_(H6N)_translation Fv#2 | VL7\|7a/JL3b | V.W.S......................-NR.. | 2684 |
| MA_03-D12_AS_CC_x_I2C0_x_scFc_(L6A)_translation Fv#2 | VL7\|7a/JL3b | V.W.S......................-NR.. | 2685 |
| MA_03-E7_AS_CC_x_I2C0_x_scFc_(L6M)_translation Fv#2 | VL7\|7a/JL3b | V.W.S......................-NR.. | 2686 |
| MA_03-E11_AS_CC_x_I2C0_x_scFc_(G2B)_translation Fv#2 | VL7\|7a/JL3b | V.W.S......................-NR.. | 2687 |
| MA_03-G10_AS_CC_x_I2C0_x_scFc_(N3H)_translation Fv#2 | VL7\|7a/JL3b | V.W.S......................-NR.. | 2688 |
| MA_03-G11_AS_CC_x_I2C0_x_scFc_(O4R)_translation Fv#2 | VL7\|7a/JL3b | V.W.S......................-NR.. | 2689 |
| MA_03-H12_AS_CC_x_I2C0_x_scFc_(K5A)_translation Fv#2 | VL7\|7a/JL3b | V.W.S......................-NR.. | 2690 |
| MA_09-C7_CC_x_I2C0_x_scFc_(K9T)_translation Fv#2 | VL7\|7a/JL3b | V.W.S......................-NR.. | 2691 |
| MA_09-E2_CC_x_I2C0_x_scFc_(V8T)_translation Fv#2 | VL7\|7a/JL3b | V.W.S......................-NR.. | 2692 |
| MA_09-F11_CC_x_I2C0_x_scFc_(L6Q)_translation Fv#2 | VL7\|7a/JL3b | V.W.S......................-NR.. | 2693 |
| MA_09-F12_CC_x_I2C0_x_scFc_(D1U)_translation Fv#2 | VL7\|7a/JL3b | V.W.S......................-NR.. | 2694 |
| MA_09-G8_CC_x_I2C0_x_scFc_(I6K)_translation Fv#2 | VL7\|7a/JL3b | V.W.S......................-NR.. | 2695 |
| MA_09-G10_CC_x_I2C0_x_scFc_(C4K)_translation Fv#2 | VL7\|7a/JL3b | V.W.S......................-NR.. | 2696 |
| MA_09-G11_CC_x_I2C0_x_scFc_(Y9Q)_translation Fv#2 | VL7\|7a/JL3b | V.W.S......................-NR.. | 2697 |
| MA_09-H7_CC_x_I2C0_x_scFc_(T3S)_translation Fv#2 | VL7\|7a/JL3b | V.W.S......................-NR.. | 2698 |
| MA_09-H10_CC_x_I2C0_x_scFc_(B6N)_translation Fv#2 | VL7\|7a/JL3b | V.W.S......................-NR.. | 2699 |
| MA_09-H11_CC_x_I2C0_x_scFc_(I8L)_translation Fv#2 | VL7\|7a/JL3b | V.W.S......................-NR.. | 2700 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_10-B5_CC_x_I2C0_x_scFc_(H6H)_translation Fv#2 | VL7\|7a/JL3b | V.W.S........................-NR.. | 2701 |
| MA_10-B6_CC_x_I2C0_x_scFc_(I3O)_translation Fv#2 | VL7\|7a/JL3b | V.W.S........................-NR.. | 2702 |
| MA_10-D3_CC_x_I2C0_x_scFc_(O6B)_translation Fv#2 | VL7\|7a/JL3b | V.W.S........................-NR.. | 2703 |
| MA_10-D6_CC_x_I2C0_x_scFc_(V6Z)_translation Fv#2 | VL7\|7a/JL3b | V.W.S........................-NR.. | 2704 |
| MA_10-G2_CC_x_I2C0_x_scFc_(T1S)_translation Fv#2 | VL7\|7a/JL3b | V.W.S........................-NR.. | 2705 |
| MA_10-G5_CC_x_I2C0_x_scFc_(S9O)_translation Fv#2 | VL7\|7a/JL3b | V.W.S........................-NR.. | 2706 |
| MA_10-G10_AS_CC_x_I2C0_x_scFc_(T1I)_translation Fv#2 | VL7\|7a/JL3b | V.W.S........................-NR.. | 2707 |
| MA_10-G10_CC_x_I2C0_x_scFc_(B3A)_translation Fv#2 | VL7\|7a/JL3b | V.W.S........................-NR.. | 2708 |
| MA_10-H1_CC_x_I2C0_x_scFc_(T9K)_translation Fv#2 | VL7\|7a/JL3b | V.W.S........................-NR.. | 2709 |
| MA_10-H3_CC_x_I2C0_x_scFc_(M9L)_translation Fv#2 | VL7\|7a/JL3b | V.W.S........................-NR.. | 2710 |
| MA_81-B9_CC_x_I2C0_x_scFc_(U4L)_translation Fv#2 | VL7\|7a/JL3b | V.W.S........................-NR.. | 2711 |
| MA_86-A4_CC_x_I2C0_x_scFc_(K2W)_translation Fv#2 | VL7\|7a/JL3b | V.W.S........................-NR.. | 2712 |
| MA_86-A4-N-F5_CC_x_I2C0_x_scFc_(M4H)_translation Fv#2 | VL7\|7a/JL3b | V.W.S........................-NR.. | 2713 |
| MA_88-B3-F9_CC_x_I2C0_x_scFc_(Y4E)_translation Fv#2 | VL7\|7a/JL3b | V.W.S........................-NR.. | 2714 |
| MA_98-C7_CC_x_I2C0_x_scFc_(Y8P)_translation Fv#2 | VL7\|7a/JL3b | V.W.S........................-NR.. | 2715 |
| MA_98-G12_AS_CC_x_I2C0_x_scFc_(Q4Z)_translation Fv#2 | VL7\|7a/JL3b | V.W.S........................-NR.. | 2716 |
| MA_SG-F28_CC_x_I2C0_x_scFc_(D9R)_translation Fv#2 | VL7\|7a/JL3b | V.W.S........................-NR.. | 2717 |
| VL3\|3h/JL3b | | QVWDSS--------------------SDHWV | 2718 |
| MA_03-D8_AS_CC_x_I2C0_x_scFc_(L7E)_translation Fv#1 | VL3\|3h/JL3b | ....YR.....................TLD.. | 2719 |
| MA_03-D8_CC_x_I2C0_x_scFc_(H6N)_translation Fv#1 | VL3\|3h/JL3b | ....YR.....................TLD.. | 2720 |
| MA_03-E7_AS_CC_x_I2C0_x_scFc_(L6M)_translation Fv#1 | VL3\|3h/JL3b | ....YN.....................MNV.. | 2721 |
| MA_03-H12_AS_CC_x_I2C0_x_scFc_(K5A)_translation Fv#1 | VL3\|3h/JL3b | ....YV.....................TPR.. | 2722 |
| | | L_FR4 | |
| VL3\|3h/JL2 | | FGGGTKLTVL | 2832 |
| MA_03-C7_AS_CC_x_I2C0_x_scFc_(G2H)_translation Fv#1 | VL7\|7a/JL3b | ..C....... | 2833 |
| MA_03-D12_AS_CC_x_I2C0_x_scFc_(L6A)_translation Fv#1 | VL7\|7a/JL3b | ..C....... | 2834 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_03-E11_AS_CC_x_I2C0_x_scFc_(G2B)_translation Fv#1 | VL7\|7a/JL3b | ...C....... | 2835 |
| MA_03-G10_AS_CC_x_I2C0_x_scFc_(N3H)_translation Fv#1 | VL7\|7a/JL3b | ...C....... | 2836 |
| MA_03-G11_AS_CC_x_I2C0_x_scFc_(O4R)_translation Fv#1 | VL7\|7a/JL3b | ...C....... | 2837 |
| MA_10-G10_AS_CC_x_I2C0_x_scFc_(T1I)_translation Fv#1 | VL7\|7a/JL3b | ...C....... | 2838 |
| MA_10-G10_CC_x_I2C0_x_scFc_(B3A)_translation Fv#1 | VL7\|7a/JL3b | ...C....... | 2839 |
| MA_88-B3-F9_CC_x_I2C0_x_scFc_(Y4E)_translation Fv#1 | VL7\|7a/JL3b | ...C....... | 2840 |
| MA_98-C7_CC_x_I2C0_x_scFc_(Y8P)_translation Fv#1 | VL7\|7a/JL3b | ...C....... | 2841 |
| MA_98-G12_AS_CC_x_I2C0_x_scFc_(Q4Z)_translation Fv#1 | VL7\|7a/JL3b | ...C....... | 2842 |
| VL7\|7a/JL3b |  | FGGGTKLTVL | 2843 |
| MA_03-C7_AS_CC_x_I2C0_x_scFc_(G2H)_translation Fv#2 | VL7\|7a/JL3b | .......... | 2844 |
| MA_03-D8_AS_CC_x_I2C0_x_scFc_(L7E)_translation Fv#2 | VL7\|7a/JL3b | .......... | 2845 |
| MA_03-D8_CC_x_I2C0_x_scFc_(H6N)_translation Fv#2 | VL7\|7a/JL3b | .......... | 2846 |
| MA_03-D12_AS_CC_x_I2C0_x_scFc_(L6A)_translation Fv#2 | VL7\|7a/JL3b | .......... | 2847 |
| MA_03-E7_AS_CC_x_I2C0_x_scFc_(L6M)_translation Fv#2 | VL7\|7a/JL3b | .......... | 2848 |
| MA_03-E11_AS_CC_x_I2C0_x_scFc_(G2B)_translation Fv#2 | VL7\|7a/JL3b | .......... | 2849 |
| MA_03-G10_AS_CC_x_I2C0_x_scFc_(N3H)_translation Fv#2 | VL7\|7a/JL3b | .......... | 2850 |
| MA_03-G11_AS_CC_x_I2C0_x_scFc_(O4R)_translation Fv#2 | VL7\|7a/JL3b | .......... | 2851 |
| MA_03-H12_AS_CC_x_I2C0_x_scFc_(K5A)_translation Fv#2 | VL7\|7a/JL3b | .......... | 2852 |
| MA_09-C7_CC_x_I2C0_x_scFc_(K9T)_translation Fv#2 | VL7\|7a/JL3b | .......... | 2853 |
| MA_09-E2_CC_x_I2C0_x_scFc_(V8T)_translation Fv#2 | VL7\|7a/JL3b | .......... | 2854 |
| MA_09-F11_CC_x_I2C0_x_scFc_(L6Q)_translation Fv#2 | VL7\|7a/JL3b | .......... | 2855 |
| MA_09-F12_CC_x_I2C0_x_scFc_(D1U)_translation Fv#2 | VL7\|7a/JL3b | .......... | 2856 |
| MA_09-G8_CC_x_I2C0_x_scFc_(I6K)_translation Fv#2 | VL7\|7a/JL3b | .......... | 2857 |
| MA_09-G10_CC_x_I2C0_x_scFc_(C4K)_translation Fv#2 | VL7\|7a/JL3b | .......... | 2858 |
| MA_09-G11_CC_x_I2C0_x_scFc_(Y9Q)_translation Fv#2 | VL7\|7a/JL3b | .......... | 2859 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-H7_CC_x_I2C0_x_scFc_(T3S)_translation Fv#2 | VL7\|7a/JL3b | .......... | 2860 |
| MA_09-H10_CC_x_I2C0_x_scFc_(B6N)_translation Fv#2 | VL7\|7a/JL3b | .......... | 2861 |
| MA_09-H11_CC_x_I2C0_x_scFc_(I8L)_translation Fv#2 | VL7\|7a/JL3b | .......... | 2862 |
| MA_10-B5_CC_x_I2C0_x_scFc_(H6H)_translation Fv#2 | VL7\|7a/JL3b | .......... | 2863 |
| MA_10-B6_CC_x_I2C0_x_scFc_(I3O)_translation Fv#2 | VL7\|7a/JL3b | .......... | 2864 |
| MA_10-D3_CC_x_I2C0_x_scFc_(O6B)_translation Fv#2 | VL7\|7a/JL3b | .......... | 2865 |
| MA_10-D6_CC_x_I2C0_x_scFc_(V6Z)_translation Fv#2 | VL7\|7a/JL3b | .......... | 2866 |
| MA_10-G2_CC_x_I2C0_x_scFc_(T1S)_translation Fv#2 | VL7\|7a/JL3b | .......... | 2867 |
| MA_10-G5_CC_x_I2C0_x_scFc_(S9O)_translation Fv#2 | VL7\|7a/JL3b | .......... | 2868 |
| MA_10-G10_AS_CC_x_I2C0_x_scFc_(T1I)_translation Fv#2 | VL7\|7a/JL3b | .......... | 2869 |
| MA_10-G10_CC_x_I2C0_x_scFc_(B3A)_translation Fv#2 | VL7\|7a/JL3b | .......... | 2870 |
| MA_10-H1_CC_x_I2C0_x_scFc_(T9K)_translation Fv#2 | VL7\|7a/JL3b | .......... | 2871 |
| MA_10-H3_CC_x_I2C0_x_scFc_(M9L)_translation Fv#2 | VL7\|7a/JL3b | .......... | 2872 |
| MA_81-B9_CC_x_I2C0_x_scFc_(U4L)_translation Fv#2 | VL7\|7a/JL3b | .......... | 2873 |
| MA_86-A4_CC_x_I2C0_x_scFc_(K2W)_translation Fv#2 | VL7\|7a/JL3b | .......... | 2874 |
| MA_86-A4-N-F5_CC_x_I2C0_x_scFc_(M4H)_translation Fv#2 | VL7\|7a/JL3b | .......... | 2875 |
| MA_88-B3-F9_CC_x_I2C0_x_scFc_(Y4E)_translation Fv#2 | VL7\|7a/JL3b | .......... | 2876 |
| MA_98-C7_CC_x_I2C0_x_scFc_(Y8P)_translation Fv#2 | VL7\|7a/JL3b | .......... | 2877 |
| MA_98-G12_AS_CC_x_I2C0_x_scFc_(Q4Z)_translation Fv#2 | VL7\|7a/JL3b | .......... | 2878 |
| MA_SG-F28_CC_x_I2C0_x_scFc_(D9R)_translation Fv#2 | VL7\|7a/JL3b | ....... | 2879 |
| VL3\|3h/JL3b | | FGGGTKLTVL | 2880 |
| MA_03-D8_AS_CC_x_I2C0_x_scFc_(L7E)_translation Fv#1 | VL3\|3h/JL3b | ..C....... | 2881 |
| MA_03-D8_CC_x_I2C0_x_scFc_(H6N)_translation Fv#1 | VL3\|3h/JL3b | ...C...... | 2882 |
| MA_03-E7_AS_CC_x_I2C0_x_scFc_(L6M)_translation Fv#1 | VL3\|3h/JL3b | ..C....... | 2883 |
| MA_03-H12_AS_CC_x_I2C0_x_scFc_(K5A)_translation Fv#1 | VL3\|3h/JL3b | ...C....... | 2884 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | H_CDR3 | SEQ ID NO: |
|---|---|---|---|
| | VH3\|3-23/D6\|6-19\|RF2/JH4 | GIAVA-------------------GYFDY | 2723 |
| MA_03-C7_AS_CC_x_I2C0_x_scFc_(G2H)_translation Fv#1 | VH3\|3-23/D6\|6-19\|RF2/JH4 | .KG.H....................LG... | 2724 |
| MA_03-D8_AS_CC_x_I2C0_x_scFc_(L7E)_translation Fv#1 | VH3\|3-23/D6\|6-19\|RF2/JH4 | .KG.H....................LG... | 2725 |
| MA_03-D8_CC_x_I2C0_x_scFc_(H6N)_translation Fv#1 | VH3\|3-23/D6\|6-19\|RF2/JH4 | .KG.H....................LG... | 2726 |
| MA_03-D12_AS_CC_x_I2C0_x_scFc_(L6A)_translation Fv#1 | VH3\|3-23/D6\|6-19\|RF2/JH4 | .KG.H....................LG... | 2727 |
| MA_03-E7_AS_CC_x_I2C_x_scFc_(L6M)_translation Fv#1 | VH3\|3-23/D6\|6-19\|RF2/JH4 | .KG.H....................LG... | 2728 |
| MA_03-E11_AS_CC_x_I2C0_x_scFc_(G2B)_translation Fv#1 | VH3\|3-23/D6\|6-19\|RF2/JH4 | .KG.H....................LG... | 2729 |
| MA_03-G10_AS_CC_x_I2C0_x_scFc_(N3H)_translation Fv#1 | VH3\|3-23/D6\|6-19\|RF2/JH4 | .KG.H....................LG... | 2730 |
| MA_03-G11_AS_CC_x_I2C0_x_scFc_(O4R)_translation Fv#1 | VH3\|3-23/D6\|6-19\|RF2/JH4 | .KG.H....................LN... | 2731 |
| MA_03-H12_AS_CC_x_I2C0_x_scFc_(K5A)_translation Fv#1 | VH3\|3-23/D6\|6-19\|RF2/JH4 | .KG.H....................LG... | 2732 |
| MA_10-G10_AS_CC_x_I2C0_x_scFc_(T1I)_translation Fv#1 | VH3\|3-23/D6\|6-19\|RF2/JH4 | .KG.H....................LG... | 2733 |
| MA_10-G10_CC_x_I2C0_x_scFc_(B3A)_translation Fv#1 | VH3\|3-23/D6\|6-19\|RF2/JH4 | .KG.H....................LG... | 2734 |
| MA_98-C7_CC_x_I2C0_x_scFc_(Y8P)_translation Fv#1 | VH3\|3-23/D6\|6-19\|RF2/JH4 | .KG.H....................LG... | 2735 |
| MA_98-G12_AS_CC_x_I2C0_x_scFc_(Q4Z)_translation Fv#1 | VH3\|3-23/D6\|6-19\|RF2/JH4 | .KG.H....................LG... | 2736 |
| | VH3\|3-73/D3\|3-3\|RF3/JH4 | ITIFGVV-----------------IIYFDY | 2737 |
| MA_03-C7_AS_CC_x_I2C0_x_scFc_(G2H)_translation Fv#2 | VH3\|3-73/D3\|3-3\|RF3/JH4 | HGN..NS.................Y.S.WA. | 2738 |
| MA_03-D8_AS_CC_x_I2C0_x_scFc_(L7E)_translation Fv#2 | VH3\|3-73/D3\|3-3\|RF3/JH4 | HGN..NS.................Y.S.WA. | 2739 |
| MA_03-D8_CC_x_I2C0_x_scFc_(H6N)_translation Fv#2 | VH3\|3-73/D3\|3-3\|RF3/JH4 | HGN..NS.................Y.S.WA. | 2740 |
| MA_03-D12_AS_CC_x_I2C0_x_scFc_(L6A)_translation Fv#2 | VH3\|3-73/D3\|3-3\|RF3/JH4 | HGN..NS.................Y.S.WA. | 2741 |
| MA_03-E7_AS_CC_x_I2C0_x_scFc_(L6M)_translation Fv#2 | VH3\|3-73/D3\|3-3\|RF3/JH4 | HGN..NS.................Y.S.WA. | 2742 |
| MA_03-E11_AS_CC_x_I2C0_x_scFc_(G2B)_translation Fv#2 | VH3\|3-73/D3\|3-3\|RF3/JH4 | HGN..NS.................Y.S.WA. | 2743 |
| MA_03-G10_AS_CC_x_I2C0_x_scFc_(N3H)_translation Fv#2 | VH3\|3-73/D3\|3-3\|RF3/JH4 | HGN..NS.................Y.S.WA. | 2744 |
| MA_03-G11_AS_CC_x_I2C0_x_scFc_(O4R)_translation Fv#2 | VH3\|3-73/D3\|3-3\|RF3/JH4 | HGN..NS.................Y.S.WA. | 2745 |
| MA_03-H12_AS_CC_x_I2C0_x_scFc_(K5A)_translation Fv#2 | VH3\|3-73/D3\|3-3\|RF3/JH4 | HGN..NS.................Y.S.WA. | 2746 |
| MA_09-C7_CC_x_I2C0_x_scFc_(K9T)_translation Fv#2 | VH3\|3-73/D3\|3-3\|RF3/JH4 | HGN..NS.................Y.S.WA. | 2747 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| MA_09-E2_CC_x_I2C0_x_scFc_(V8T)_translation Fv#2 | VH3\|3-73/D3\|3-3\|RF3/JH4 | HGN..NS................Y.S.WA. | 2748 |
| MA_09-F11_CC_x_I2C0_x_scFc_(L6Q)_translation Fv#2 | VH3\|3-73/D3\|3-3\|RF3/JH4 | HGN..NS................Y.S.WA. | 2749 |
| MA_09-F12_CC_x_I2C0_x_scFc_(D1U)_translation Fv#2 | VH3\|3-73/D3\|3-3\|RF3/JH4 | HGN..NS................Y.S.WA. | 2750 |
| MA_09-G8_CC_x_I2C0_x_scFc_(I6K)_translation Fv#2 | VH3\|3-73/D3\|3-3\|RF3/JH4 | HGN..NS................Y.S.WA. | 2751 |
| MA_09-G10_CC_x_I2C0_x_scFc_(C4K)_translation Fv#2 | VH3\|3-73/D3\|3-3\|RF3/JH4 | HGN..NS................Y.S.WA. | 2752 |
| MA_09-G11_CC_x_I2C0_x_scFc_(Y9Q)_translation Fv#2 | VH3\|3-73/D3\|3-3\|RF3/JH4 | HGN..NS................Y.S.WA. | 2753 |
| MA_09-H7_CC_x_I2C0_x_scFc_(T3S)_translation Fv#2 | VH3\|3-73/D3\|3-3\|RF3/JH4 | HGN..NS................Y.S.WA. | 2754 |
| MA_09-H10_CC_x_I2C0_x_scFc_(B6N)_translation Fv#2 | VH3\|3-73/D3\|3-3\|RF3/JH4 | HGN..NS................Y.S.WA. | 2755 |
| MA_09-H11_CC_x_I2C0_x_scFc_(I8L)_translation Fv#2 | VH3\|3-73/D3\|3-3\|RF3/JH4 | HGN..NS................Y.S.WA. | 2756 |
| MA_10-B5_CC_x_I2C0_x_scFc_(H6H)_translation Fv#2 | VH3\|3-73/D3\|3-3\|RF3/JH4 | HGN..NS................Y.S.WA. | 2757 |
| MA_10-B6_CC_x_I2C0_x_scFc_(I3O)_translation Fv#2 | VH3\|3-73/D3\|3-3\|RF3/JH4 | HGN..NS................Y.S.WA. | 2758 |
| MA_10-D3_CC_x_I2C0_x_scFc_(O6B)_translation Fv#2 | VH3\|3-73/D3\|3-3\|RF3/JH4 | HGN..NS................Y.S.WA. | 2759 |
| MA_10-D6_CC_x_I2C0_x_scFc_(V6Z)_translation Fv#2 | VH3\|3-73/D3\|3-3\|RF3/JH4 | HGN..NS................Y.S.WA. | 2760 |
| MA_10-G2_CC_x_I2C0_x_scFc_(T1S)_translation Fv#2 | VH3\|3-73/D3\|3-3\|RF3/JH4 | HGN..NS................Y.S.WA. | 2761 |
| MA_10-G5_CC_x_I2C0_x_scFc_(S9O)_translation Fv#2 | VH3\|3-73/D3\|3-3\|RF3/JH4 | HGN..NS................Y.S.WA. | 2762 |
| MA_10-G10_AS_CC_x_I2C0_x_scFc_(T1I)_translation Fv#2 | VH3\|3-73/D3\|3-3\|RF3/JH4 | HGN..NS................Y.S.WA. | 2763 |
| MA_10-G10_CC_x_I2C0_x_scFc_(B3A)_translation Fv#2 | VH3\|3-73/D3\|3-3\|RF3/JH4 | HGN..NS................Y.S.WA. | 2764 |
| MA_10-H1_CC_x_I2C0_x_scFc_(T9K)_translation Fv#2 | VH3\|3-73/D3\|3-3\|RF3/JH4 | HGN..NS................Y.S.WA. | 2765 |
| MA_10-H3_CC_x_I2C0_x_scFc_(M9L)_translation Fv#2 | VH3\|3-73/D3\|3-3\|RF3/JH4 | HGN..NS................Y.S.WA. | 2766 |
| MA_81-B9_CC_x_I2C0_x_scFc_(U4L)_translation Fv#2 | VH3\|3-73/D3\|3-3\|RF3/JH4 | HGN..NS................Y.S.WA. | 2767 |
| MA_86-A4_CC_x_I2C0_x_scFc_(K2W)_translation Fv#2 | VH3\|3-73/D3\|3-3\|RF3/JH4 | HGN..NS................Y.S.WA. | 2768 |
| MA_86-A4-N-F5_CC_x_I2C0_x_scFc_(M4H)_translation Fv#2 | VH3\|3-73/D3\|3-3\|RF3/JH4 | HGN..NS................Y.S.WA. | 2769 |
| MA_88-B3-F9_CC_x_I2C0_x_scFc_(Y4E)_translation Fv#2 | VH3\|3-73/D3\|3-3\|RF3/JH4 | HGN..NS................Y.S.WA. | 2770 |
| MA_98-C7_CC_x_I2C0_x_scFc_(Y8P)_translation Fv#2 | VH3\|3-73/D3\|3-3\|RF3/JH4 | HGN..NS................Y.S.WA. | 2771 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_98-G12_AS_CC_x_I2C_x_scFc_(Q4Z)_translation Fv#2 | VH3\|3-73/D3\|3-3\|RF3/JH4 | HGN..NS................Y.S.WA. | 2772 |
| MA_SG-F28_CC_x_I2C0_x_scFc_(D9R)_translation Fv#2 | VH3\|3-73/D3\|3-3\|RF3/JH4 | HGN..NS................Y.S.WA. | 2773 |
| VH2\|2-70/D2\|2-15\|RF1/JH5 |  | RIL*WW*L---------------LLNWFDP | 2774 |
| MA_09-C7_CC_x_I2C0_x_scFc_(K9T)_translation Fv#1 | VH2\|2-70/D2\|2-15\|RF1/JH5 | .RYN.NY-...............-E..... | 2775 |
| VH3\|3-15/D3\|3-10\|RF2/JH6 |  | YYYGSGSYYN-----------YYYYYGMDV | 2776 |
| MA_09-E2_CC_x_I2C0_x_scFc_(V8T)_translation Fv#1 | VH3\|3-15/D3\|3-10\|RF2/JH6 | PS.SGSY.-............-N.FSV... | 2777 |
| MA_10-B5_CC_x_I2C0_x_scFc_(H6H)_translation Fv#1 | VH3\|3-15/D3\|3-10\|RF2/JH6 | PS.SGSY.-............-N.FSV... | 2778 |
| MA_10-B6_CC_x_I2C0_x_scFc_(I3O)_translation Fv#1 | VH3\|3-15/D3\|3-10\|RF2/JH6 | PS.SGSY.-............-N.FSV... | 2779 |
| MA_10-D3_CC_x_I2C0_x_scFc_(O6B)_translation Fv#1 | VH3\|3-15/D3\|3-10\|RF2/JH6 | PS.SGSY.-............-N.FSV... | 2780 |
| MA_10-D6_CC_x_I2C0_x_scFc_(V6Z)_translation Fv#1 | VH3\|3-15/D3\|3-10\|RF2/JH6 | PS.SGSY.-............-N.FSV... | 2781 |
| MA_10-G2_CC_x_I2C0_x_scFc_(T1S)_translation Fv#1 | VH3\|3-15/D3\|3-10\|RF2/JH6 | PS.SGSY.-............-N.FSV... | 2782 |
| MA_10-G5_CC_x_I2C0_x_scFc_(S9O)_translation Fv#1 | VH3\|3-15/D3\|3-10\|RF2/JH6 | PS.SGSY.-............-N.FSV... | 2783 |
| MA_10-H1_CC_x_I2C0_x_scFc_(T9K)_translation Fv#1 | VH3\|3-15/D3\|3-10\|RF2/JH6 | PS.SGSY.-............-N.FSV... | 2784 |
| MA_10-H3_CC_x_I2C0_x_scFc_(M9L)_translation Fv#1 | VH3\|3-15/D3\|3-10\|RF2/JH6 | PS.SGSY.-............-N.FSV... | 2785 |
| VH2\|2-05/D2\|2-15\|RF1/JH5 |  | RIL*WW*L---------------LLNWFDP | 2786 |
| MA_09-F11_CC_x_I2C0_x_scFc_(L6Q)_translation Fv#1 | VH2\|2-05/D2\|2-15\|RF1/JH5 | .RYN.NY-...............-E..... | 2787 |
| MA_09-F12_CC_x_I2C0_x_scFc_(D1U)_translation Fv#1 | VH2\|2-05/D2\|2-15\|RF1/JH5 | .RYN.NY-...............-E..... | 2788 |
| MA_09-G8_CC_x_I2C0_x_scFc_(I6K)_translation Fv#1 | VH2\|2-05/D2\|2-15\|RF1/JH5 | .RYN.NY-...............-E..... | 2789 |
| MA_09-G10_CC_x_I2C0_x_scFc_(C4K)_translation Fv#1 | VH2\|2-05/D2\|2-15\|RF1/JH5 | .RYN.NY-...............-E..... | 2790 |
| MA_09-G11_CC_x_I2C0_x_scFc_(Y9Q)_translation Fv#1 | VH2\|2-05/D2\|2-15\|RF1/JH5 | .RYN.NY-...............-E..... | 2791 |
| MA_09-H7_CC_x_I2C0_x_scFc_(T3S)_translation Fv#1 | VH2\|2-05/D2\|2-15\|RF1/JH5 | .RYN.NY-...............-E..... | 2792 |
| MA_09-H10_CC_x_I2C0_x_scFc_(B6N)_translation Fv#1 | VH2\|2-05/D2\|2-15\|RF1/JH5 | .RYN.NY-...............-E..... | 2793 |
| MA_09-H11_CC_x_I2C0_x_scFc_(I8L)_translation Fv#1 | VH2\|2-05/D2\|2-15\|RF1/JH5 | .RYN.NY-...............-E..... | 2794 |
| VH4\|4-59/D3\|3-3\|RF3/JH4 |  | ITIFGVV----------------IIYFDY | 2795 |
| MA_81-B9_CC_x_I2C0_x_scFc_(U4L)_translation Fv#1 | VH4\|4-59/D3\|3-3\|RF3/JH4 | GIFGVI-................-T..... | 2796 |
| VH3\|3-30.3/D1\|1-1\|RF2/JH4 |  | VQLER-------------------YFDY | 2797 |
| MA_86-A4_CC_x_I2C0_x_scFc_(K2W)_translation Fv#1 | VH3\|3-30.3/D1\|1-1\|RF2/JH4 | G..L-....................-TG. | 2798 |
| MA_86-A4-N-F5_CC_x_I2C0_x_scFc_(M4H)_translation Fv#1 | VH3\|3-30.3/D1\|1-1\|RF2/JH4 | G..L-....................-TG. | 2799 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| VH3\|3-11/D1\|1-1\|RF3/JH4 | | YNWND--------------------YFDY | 2800 |
| MA_88-B3-F9_CC_x_I2C0_x_scFc_(Y4E)_translation Fv#1 | VH3\|3-11/D1\|1-1\|RF3/JH4 | ..YG-................H... | 2801 |
| VH4\|4-30.1/D3\|3-10\|RF3/JH6 | | IMTVRGVII-----------YYYYYGMDV | 2802 |
| MA_SG-F28_CC_x_I2C0_x_scFc_(D9R)_translation Fv#1 | VH4\|4-30.1/D3\|3-10\|RF3/JH6 | EK.WF..L-...........-N....... | 2803 |
| | | H_FR4 | |
| VH3\|3-23/D6\|6-19\|RF2/JH4 | | WGQGTLVTVSS | 2885 |
| MA_03-C7_AS_CC_x_I2C0_x_scFc_(G2H)_translation Fv#1 | VH3\|3-23/D6\|6-19\|RF2/JH4 | ........... | 2886 |
| MA_03-D8_AS_CC_x_I2C0_x_scFc_(L7E)_translation Fv#1 | VH3\|3-23/D6\|6-19\|RF2/JH4 | ........... | 2887 |
| MA_03-D8_CC_x_I2C0_x_scFc_(H6N)_translation Fv#1 | VH3\|3-23/D6\|6-19\|RF2/JH4 | ........... | 2888 |
| MA_03-D12_AS_CC_x_I2C0_x_scFc_(L6A)_translation Fv#1 | VH3\|3-23/D6\|6-19\|RF2/JH4 | ........... | 2889 |
| MA_03-E7_AS_CC_x_I2C_x_scFc_(L6M)_translation Fv#1 | VH3\|3-23/D6\|6-19\|RF2/JH4 | ........... | 2890 |
| MA_03-E11_AS_CC_x_I2C0_x_scFc_(G2B)_translation Fv#1 | VH3\|3-23/D6\|6-19\|RF2/JH4 | ........... | 2891 |
| MA_03-G10_AS_CC_x_I2C0_x_scFc_(N3H)_translation Fv#1 | VH3\|3-23/D6\|6-19\|RF2/JH4 | ........... | 2892 |
| MA_03-G11_AS_CC_x_I2C0_x_scFc_(O4R)_translation Fv#1 | VH3\|3-23/D6\|6-19\|RF2/JH4 | ........... | 2893 |
| MA_03-H12_AS_CC_x_I2C0_x_scFc_(K5A)_translation Fv#1 | VH3\|3-23/D6\|6-19\|RF2/JH4 | ........... | 2894 |
| MA_10-G10_AS_CC_x_I2C0_x_scFc_(T1I)_translation Fv#1 | VH3\|3-23/D6\|6-19\|RF2/JH4 | ........... | 2895 |
| MA_10-G10_CC_x_I2C0_x_scFc_(B3A)_translation Fv#1 | VH3\|3-23/D6\|6-19\|RF2/JH4 | ........... | 2896 |
| MA_98-C7_CC_x_I2C0_x_scFc_(Y8P)_translation Fv#1 | VH3\|3-23/D6\|6-19\|RF2/JH4 | ........... | 2897 |
| MA_98-G12_AS_CC_x_I2C0_x_scFc_(Q4Z)_translation Fv#1 | VH3\|3-23/D6\|6-19\|RF2/JH4 | ........... | 2898 |
| VH3\|3-73/D3\|3-3\|RF3/JH4 | | WGQGTLVTVSS | 2899 |
| MA_03-C7_AS_CC_x_I2C0_x_scFc_(G2H)_translation Fv#2 | VH3\|3-73/D3\|3-3\|RF3/JH4 | ........... | 2900 |
| MA_03-D8_AS_CC_x_I2C0_x_scFc_(L7E)_translation Fv#2 | VH3\|3-73/D3\|3-3\|RF3/JH4 | ........... | 2901 |
| MA_03-D8_CC_x_I2C0_x_scFc_(H6N)_translation Fv#2 | VH3\|3-73/D3\|3-3\|RF3/JH4 | ........... | 2902 |
| MA_03-D12_AS_CC_x_I2C0_x_scFc_(L6A)_translation Fv#2 | VH3\|3-73/D3\|3-3\|RF3/JH4 | ........... | 2903 |
| MA_03-E7_AS_CC_x_I2C0_x_scFc_(L6M)_translation Fv#2 | VH3\|3-73/D3\|3-3\|RF3/JH4 | ........... | 2904 |
| MA_03-E11_AS_CC_x_I2C0_x_scFc_(G2B)_translation Fv#2 | VH3\|3-73/D3\|3-3\|RF3/JH4 | ........... | 2905 |
| MA_03-G10_AS_CC_x_I2C0_x_scFc_(N3H)_translation Fv#2 | VH3\|3-73/D3\|3-3\|RF3/JH4 | ........... | 2906 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_03-G11_AS_CC_x_I2C0_x_scFc_(O4R)_translation Fv#2 | VH3\|3-73/D3\|3-3\|RF3/JH4 | ........... | 2907 |
| MA_03-H12_AS_CC_x_I2C0_x_scFc_(K5A)_translation Fv#2 | VH3\|3-73/D3\|3-3\|RF3/JH4 | ........... | 2908 |
| MA_09-C7_CC_x_I2C0_x_scFc_(K9T)_translation Fv#2 | VH3\|3-73/D3\|3-3\|RF3/JH4 | ........... | 2909 |
| MA_09-E2_CC_x_I2C0_x_scFc_(V8T)_translation Fv#2 | VH3\|3-73/D3\|3-3\|RF3/JH4 | ........... | 2910 |
| MA_09-F11_CC_x_I2C0_x_scFc_(L6Q)_translation Fv#2 | VH3\|3-73/D3\|3-3\|RF3/JH4 | ........... | 2911 |
| MA_09-F12_CC_x_I2C0_x_scFc_(D1U)_translation Fv#2 | VH3\|3-73/D3\|3-3\|RF3/JH4 | ........... | 2912 |
| MA_09-G8_CC_x_I2C0_x_scFc_(I6K)_translation FV#2 | VH3\|3-73/D3\|3-3\|RF3/JH4 | ........... | 2913 |
| MA_09-G10_CC_x_I2C0_x_scFc_(C4K)_translation Fv#2 | VH3\|3-73/D3\|3-3\|RF3/JH4 | ........... | 2914 |
| MA_09-G11_CC_x_I2C0_x_scFc_(Y9Q)_translation Fv#2 | VH3\|3-73/D3\|3-3\|RF3/JH4 | ........... | 2915 |
| MA_09-H7_CC_x_I2C0_x_scFc_(T3S)_translation Fv#2 | VH3\|3-73/D3\|3-3\|RF3/JH4 | ........... | 2916 |
| MA_09-H10_CC_x_I2C0_x_scFc_(B6N)_translation Fv#2 | VH3\|3-73/D3\|3-3\|RF3/JH4 | ........... | 2917 |
| MA_09-H11_CC_x_I2C0_x_scFc_(I8L)_translation Fv#2 | VH3\|3-73/D3\|3-3\|RF3/JH4 | ........... | 2918 |
| MA_10-B5_CC_x_I2C0_x_scFc_(H6H)_translation Fv#2 | VH3\|3-73/D3\|3-3\|RF3/JH4 | ........... | 2919 |
| MA_10-B6_CC_x_I2C0_x_scFc_(I3O)_translation Fv#2 | VH3\|3-73/D3\|3-3\|RF3/JH4 | ........... | 2920 |
| MA_10-D3_CC_x_I2C0_x_scFc_(O6B)_translation Fv#2 | VH3\|3-73/D3\|3-3\|RF3/JH4 | ........... | 2921 |
| MA_10-D6_CC_x_I2C0_x_scFc_(V6Z)_translation Fv#2 | VH3\|3-73/D3\|3-3\|RF3/JH4 | ........... | 2922 |
| MA_10-G2_CC_x_I2C0_x_scFc_(T1S)_translation Fv#2 | VH3\|3-73/D3\|3-3\|RF3/JH4 | ........... | 2923 |
| MA_10-G5_CC_x_I2C0_x_scFc_(S9O)_translation Fv#2 | VH3\|3-73/D3\|3-3\|RF3/JH4 | ........... | 2924 |
| MA_10-G10_AS_CC_x_I2C0_x_scFc_(T1I)_translation Fv#2 | VH3\|3-73/D3\|3-3\|RF3/JH4 | ........... | 2925 |
| MA_10-G10_CC_x_I2C0_x_scFc_(B3A)_translation Fv#2 | VH3\|3-73/D3\|3-3\|RF3/JH4 | ........... | 2926 |
| MA_10-H1_CC_x_I2C0_x_scFc_(T9K)_translation Fv#2 | VH3\|3-73/D3\|3-3\|RF3/JH4 | ........... | 2927 |
| MA_10-H3_CC_x_I2C0_x_scFc_(M9L)_translation Fv#2 | VH3\|3-73/D3\|3-3\|RF3/JH4 | ........... | 2928 |
| MA_81-B9_CC_x_I2C0_x_scFc_(U4L)_translation Fv#2 | VH3\|3-73/D3\|3-3\|RF3/JH4 | ........... | 2929 |
| MA_86-A4_CC_x_I2C0_x_scFc_(K2W)_translation Fv#2 | VH3\|3-73/D3\|3-3\|RF3/JH4 | ........... | 2930 |

TABLE 29-continued

BiTE-scFc Variable Region #1 (MAGEB2) Consensus Protein Alignment
CDRs defined by Kabat
Alignment numbering defined by Amgen Reference (AHo)

|  | Germline |  | SEQ ID NO: |
|---|---|---|---|
| MA_86-A4-N-F5_CC_x_I2C0_x_scFc_(M4H)_translation Fv#2 | VH3\|3-73/D3\|3-3\|RF3/JH4 | ........... | 2931 |
| MA_88-B3-F9_CC_x_I2C0_x_scFc_(Y4E)_translation Fv#2 | VH3\|3-73/D3\|3-3\|RF3/JH4 | ........... | 2932 |
| MA_98-C7_CC_x_I2C0_x_scFc_(Y8P)_translation Fv#2 | VH3\|3-73/D3\|3-3\|RF3/JH4 | ........... | 2933 |
| MA_98-G12_AS_CC_x_I2C_x_scFc_(Q4Z)_translation Fv#2 | VH3\|3-73/D3\|3-3\|RF3/JH4 | ........... | 2934 |
| MA_SG-F28_CC_x_I2C0_x_scFc_(D9R)_translation Fv#2 | VH3\|3-73/D3\|3-3\|RF3/JH4 | ........... | 2935 |
| VH2\|2-70/D2\|2-15\|RF1/JH5 |  | WGQGTLVTVSS | 2936 |
| MA_09-C7_CC_x_I2C0_x_scFc_(K9T)_translation Fv#1 | VH2\|2-70/D2\|2-15\|RF1/JH5 | ........... | 2937 |
| VH3\|3-15/D3\|3-10\|RF2/JH6 |  | WGQGTTVTVSS | 2938 |
| MA_09-E2_CC_x_I2C0_x_scFc_(V8T)_translation Fv#1 | VH3\|3-15/D3\|3-10\|RF2/JH6 | ........... | 2939 |
| MA_10-B5_CC_x_I2C0_x_scFc_(H6H)_translation Fv#1 | VH3\|3-15/D3\|3-10\|RF2/JH6 | ........... | 2940 |
| MA_10-B6_CC_x_I2C0_x_scFc_(I3O)_translation Fv#1 | VH3\|3-15/D3\|3-10\|RF2/JH6 | ........... | 2941 |
| MA_10-D3_CC_x_I2C0_x_scFc_(O6B)_translation Fv#1 | VH3\|3-15/D3\|3-10\|RF2/JH6 | ........... | 2942 |
| MA_10-D6_CC_x_I2C0_x_scFc_(V6Z)_translation Fv#1 | VH3\|3-15/D3\|3-10\|RF2/JH6 | ........... | 2943 |
| MA_10-G2_CC_x_I2C0_x_scFc_(T1S)_translation Fv#1 | VH3\|3-15/D3\|3-10\|RF2/JH6 | ........... | 2944 |
| MA_10-G5_CC_x_I2C0_x_scFc_(S9O)_translation Fv#1 | VH3\|3-15/D3\|3-10\|RF2/JH6 | ........... | 2945 |
| MA_10-H1_CC_x_I2C0_x_scFc_(T9K)_translation Fv#1 | VH3\|3-15/D3\|3-10\|RF2/JH6 | ........... | 2946 |
| MA_10-H3_CC_x_I2C0_x_scFc_(M9L)_translation Fv#1 | VH3\|3-15/D3\|3-10\|RF2/JH6 | ........... | 2947 |
| VH2\|2-05/D2\|2-15\|RF1/JH5 |  | WGQGTLVTVSS | 2948 |
| MA_09-F11_CC_x_I2C0_x_scFc_(L6Q)_translation Fv#1 | VH2\|2-05/D2\|2-15\|RF1/JH5 | ........... | 2949 |
| MA_09-F12_CC_x_I2C0_x_scFc_(D1U)_translation Fv#1 | VH2\|2-05/D2\|2-15\|RF1/JH5 | ........... | 2950 |
| MA_09-G8_CC_x_I2C0_x_scFc_(I6K)_translation Fv#1 | VH2\|2-05/D2\|2-15\|RF1/JH5 | ........... | 2951 |
| MA_09-G10_CC_x_I2C0_x_scFc_(C4K)_translation Fv#1 | VH2\|2-05/D2\|2-15\|RF1/JH5 | ........... | 2952 |
| MA_09-G11_CC_x_I2C0_x_scFc_(Y9Q)_translation Fv#1 | VH2\|2-05/D2\|2-15\|RF1/JH5 | ........... | 2953 |
| MA_09-H7_CC_x_I2C0_x_scFc_(T3S)_translation Fv#1 | VH2\|2-05/D2\|2-15\|RF1/JH5 | ........... | 2954 |
| MA_09-H10_CC_x_I2C0_x_scFc_(B6N)_translation Fv#1 | VH2\|2-05/D2\|2-15\|RF1/JH5 | ........... | 2955 |
| MA_09-H11_CC_x_I2C0_x_scFc_(I8L)_translation Fv#1 | VH2\|2-05/D2\|2-15\|RF1/JH5 | ........... | 2956 |

TABLE 29-continued

BiTE-scFc Variable Region #1 (MAGEB2) Consensus Protein Alignment
CDRs defined by Kabat
Alignment numbering defined by Amgen Reference (AHo)

| | Germline | | SEQ ID NO: |
|---|---|---|---|
| VH4\|4-59/D3\|3-3\|RF3/JH4 | | WGQGTLVTVSS | 2957 |
| MA_81-B9_CC_x_I2C0_x_scFc_(U4L)_translation Fv#1 | VH4\|4-59/D3\|3-3\|RF3/JH4 | ........... | 2958 |
| VH3\|3-30.3/D1\|1-1\|RF2/JH4 | | WGQGTLVTVSS | 2959 |
| MA_86-A4_CC_x_I2C0_x_scFc_(K2W)_translation Fv#1 | VH3\|3-30.3/D1\|1-1\|RF2/JH4 | ........... | 2960 |
| MA_86-A4-N-F5_CC_x_I2C0_x_scFc_(M4H)_translation Fv#1 | VH3\|3-30.3/D1\|1-1\|RF2/JH4 | ........... | 2961 |
| VH3\|3-11/D1\|1-1\|RF3/JH4 | | WGQGTLVTVSS | 2962 |
| MA_88-B3-F9_CC_x_I2C0_x_scFc_(Y4E)_translation Fv#1 | VH3\|3-11/D1\|1-1\|RF3/JH4 | ........... | 2963 |
| VH4\|4-30.1/D3\|3-10\|RF3/JH6 | | WGQGTLVTVSS | 2964 |
| MA_SG-F28_CC_x_I2C0_x_scFc_(D9R)_translation Fv#1 | VH4\|4-30.1/D3\|3-10\|RF3/JH6 | ........... | 2965 |

TABLE 30

BiTE-scFc Full Sequences

| Ab | Type | BITE_scFc |
|---|---|---|
| MA_79-G12_CC_x_I2C0x_scFc_(K1F)_translation | NA<br>AA | No nuc.seq available<br>MDMRVPAQLLGLLLLWLRGARCEVQLLESGAEVKKPGASVKVSCKASGYTFTRNGLSWVRQAPGQCLEW MGWISGYNGDTNYAQKLQGRGTMTTDTSTSTAYMELRSLRSDDTAVYYCARGRATFDYWGQGTLVTVSS GGGGSGGGGSGGGGSELVMTQSPSSLSASVGDRVTITCRASQGISNYLAWYQQKPGKVPKLLISAASTL QSGVPSRFSGSGSGTDFTLTISSLQPEDVATYYCQKYNSAPFTFGCGTKLEIKSGGGGSEVQLVESGGG LVQPGGSLKLSCAASGFTENKYAMNWVRQAPGKGLEWVARIRSKYNNYATYYADSVKDRFTISRDDSKN TAYLQMNNLKTEDTAVYYCVRHGNFGNSYISYWAYWGQGTLVTVSSGGGGSGGGGSGGGGSGQTVVTQEP SLTVSPGGTVTLTCGSSTGAVTSGNYPNWVQQKPGQAPRGLIGGTKFLAPGTPARFSGSLLGGKAALTL SGVQPEDEAEYYCVLWYSNRWVFGGGTKLTVLGGGGDKTHTCPPCPAPELLGGPSVFLFPPKPKDTLMI SRTPEVTCVVVDVSHEDPEVKENWYVDGVEVHNAKTKPCEEQYGSTYRCVSVLTVLHQDWLNGKEYKCK VSNKALPAPIEKTISKAKGQPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKSLSLSPGKGGGGSGGGGSGGG GSGGGGSGGGGSGGGGSDKTHTCPPCPAPELLGGPSVFLFPPKPKDTLMISRTPEVTCVVVDVSHEDPE VKENWYVDGVEVHNAKTKPCEEQYGSTYRCVSVLTVLHQDWLNGKEYKCKVSNKALPAPIEKTISKAKG QPREPQVYTLPPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK<br>(SEQ ID NO: 2966) |
| MA_79-H7_CCx_I2C0x_scFc_(Q4C)_translation | NA<br>AA | No nuc.seq available<br>MDMRVPAQLLGLLLLWLRGARCEVQLLESGGGLVQPGGSLRLSCAASGFTFSNAWMSWVRQAPGKCLEW VGRIKSKTYGGTTDYAAPVKGRFTISRDDSKNTLYLQMNSLKTEDTAVYYCTTPSYSGSYYNYFSVMDV WGQGTTVTVSSGGGGSGGGGSGGGGSELQMTQSPSSLSASVGDRVTITCRTSQSISSYLNWFQQKPGKA PKLLIFAASSLQSGVPSRFSGSGSGTDFTLTISSLQPEDFATYYCQQSYSSPPFTFGCGTKVEIKSGGGG SEVQLVESGGGLVQPGGSLKLSCAASGFTENKYAMNWVRQAPGKGLEWVARIRSKYNNYATYYADSVKD RFTISRDDSKNTAYLQMNNLKTEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQAPRGLIGGTKFLAPGTPARFSG SLLGGKAALTLSGVQPEDEAEYYCVLWYSNRWVFGGGTKLTVLGGGGDKTHTCPPCPAPELLGGPSVFL FPPKPKDTLMISRTPEVTCVVVDVSHEDPEVKENWYVDGVEVHNAKTKPCEEQYGSTYRCVSVLTVLHQ DWLNGKEYKCKVSNKALPAPIEKTISKAKGQPREPQVYTLPPSREEMTKNQVSLTCLVKGFYPSDIAVE WESNGQPENNYKTTPPVLDSDGSFFLYSKLTVDKSRWQQGNVFSCSVMHEALHNHYTQKSLSLSPGKGG GSGGGGSGGGGSGGGGSGGGGSGGGGSDKTHTCPPCPAPELLGGPSVFLFPPKPKDTLMISRTPEVTC VVVDVSHEDPEVKENWYVDGVEVHNAKTKPCEEQYGSTYRCVSVLTVLHQDWLNGKEYKCKVSNKALPA PIEKTISKAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK<br>(SEQ ID NO: 2967) |
| MA_81-E7_CCx_I2C0x_scFc_(O8Y)_translation | NA<br>AA | No nuc.seq available<br>MDMRVPAQLLGLLLLWLRGARCEVQLLESGPGLVKPSETLSLTCTVSGDSISSSRYYWGWIRQPPGKCL EWIGSIYYSGSTYYNPSLKSRVTISVDTSKNQFSLKLSSVTAADTAVYYCARGIFGVITYFDYWGQGTL VTVSSGGGGSGGGGSGGGGSELVMTQSPGTLSLSPGERATINCKSSQSVLYSSNNKNYLAWYQQKPGQP PKLLIYWASTRESGVPDRESGSGSGTDFTLTISSLQAEDVAVYYCQQYYSTPLTFGCGTKVEIKSGGGG SEVQLVESGGGLVQPGGSLKLSCAASGFTENKYAMNWVRQAPGKGLEWVARIRSKYNNYATYYADSVKD RFTISRDDSKNTAYLQMNNLKTEDTAVYYCVRHGNFGNSYISYWAYWGQGTLVTVSSGGGGGGGGSGGG GSQTVVTQEPSLTVSPGGTVTLTCGSSTGAVTSGNYPNWVQQKPGQAPRGLIGGTKFLAPGTPARFSGS LLGGKAALTLSGVQPEDEAEYYCVLWYSNRWVFGGGTKLTVLGGGGDKTHTCPPCPAPELLGGPSVFLF |

TABLE 30-continued

BiTE-scFc_Full Sequences

| Ab | Type | BITE_scFc |
|---|---|---|
| | | PPKPKDTLMISRTPEVTCVVVDVSHEDPEVKENWYVDGVEVHGFYPSDIAVEWESNGQPENNYKTTPPV<br>LDSDGSFFLYSKLTVDKSRWQQGNVFSCSVMHEALHNHYTQKSLSLSPGKGGGGSGGGGNAKTKPCEEQY<br>GSTYRCVSVLTVLHQDWLNGKEYKCKVSNKALPAPIEKTISKAKGQPREPQVYTLPPSREEMTKNQVSL<br>TCLVKGSGGGGSGGGGSGGGGSGGGGSDKTHTCPPCPAPELLGGPSVFLFPPKPKDTLMISRTPEVTCV<br>VVDVSHEDPEVKENWYVDGVEVHNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK<br>(SEQ ID NO: 2968) |
| MA_81-F9_CCx_I2C0x_<br>scFc_(16I)_translation | NA<br>AA | No nuc.seq available<br>MDMRVPAQLLGLLLLWLRGARCEVQLLESGPMLVKPTQTLTLTCTFSGFSFTTHKMGVDWIRQPPGKCL<br>EWLALIYWNDDKRYSPSLQSRLTITKDTSKNQVVLTMTNMDPVDTATYYCAYRRYNWNYENWFDPWGQG<br>TLVTVSSGGGGSGGGGSGGGGSELQMTQSPSSLSASVGDRVTITCRASQSISSYLNWYQQKPGKAPKLL<br>IYAASSLQSGVPSRFSGSGSGTDFTLTISSLQPEDFATYYCQQSYSTPFTFGCGTKVEIKSGGGGSEVQ<br>LVESGGGLVQPGGSLKLSCAASGFTENKYAMNWVRQAPGKGLEWVARIRSKYNNYATYYADSVKDRFTI<br>SRDDSKNTAYLQMNNLKTEDTAVYYCVRHGNFGNSYISYWAYWGQGTLVTVSSGGGGSGGGGSGGGGSQ<br>TVVTQEPSLTVSPGGTVTLTCGSSTGAVTSGNYPNWVQQKPGQAPRGLIGGTKFLAPGTPARFSGSLLG<br>GKAALTLSGVQPEDEAEYYCVLWYSNRWVFGGGTKLTVLGGGGDKTHTCPPCPAPELLGGPSVFLFPPK<br>PKDTLMISRTPEVTCVVVDVSHEDPEVKENWYVDGVEVHNAKTKPCEEQYGSTYRCVSVLTVLHQDWLN<br>GKEYKCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGKGGGGSG<br>GGGSGGGGSGGGGSGGGGSDKTHTCPPCPAPELLGGPSVFLFPPKPKDTLMISRTPEVTCVVVD<br>VSHEDPEVKENWYVDGVEVHNAKTKPCEEQYGSTYRCVSVLTVLHQDWLNGKEYKCKVSNKALPAPIEK<br>TISKAKGQPREPQVYTLPPSREEMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK<br>(SEQ ID NO: 2969) |
| MA_81-H7_CC_xI2C0x_<br>scFc_(M5O)_translation | NA<br>AA | No nuc.seq available<br>MDMRVPAQLLGLLLLWLRGARCEVQLLESGPGLVKPSQTLSLTCTVSGDSISSNPYYWSWIRQHPGKCL<br>EWIGYISYSGITNYNPSLKSRVTMSVDTSKNQFSLKLTSLTAADTAVYYCAREKMWFGVLNYYYGMDVW<br>GQGTTVTVSSGGGGSGGGGSGGGGSELVMTQTPLSLPVTPGEPASISCRSSQSLLHRNGYNYLDWYLQK<br>PGQSPQLLIYLGSNRASGVPDRESGSGSGTDFTLKISRVEAGDVGVYYCMQALQTPWTFGCGTKVEIKS<br>GGGGSEVQLVESGGGLVQPGGSLKLSCAASGFTENKYAMNWVRQAPGKGLEWVARIRSKYNNYATYYAD<br>SVKDRFTISRDDSKNTAYLQMNNLKTEDTAVYYCVRHGNFGNSYISYWAYWGQGTLVTVSSGGGGSGGG<br>GSGGGGSQTVVTQEPSLTVSPGGTVTLTCGSSTGAVTSGNYPNWVQQKPGQAPRGLIGGTKFLAPGTPA<br>RFSGSLLGGKAALTLSGVQPEDEAEYYCVLWYSNRWVFGGGTKLTVLGGGGDKTHTCPPCPAPELLGGP<br>SVFLFPPKPKDTLMISRTPEVTCVVVDVSHEDPEVKENWYVDGVEVHNAKTKPCEEQYGSTYRCVSVLT<br>VLHQDWLNGKEYKCKVSNKALPAPIEKTISKAKGQPREPQVYTLPPSREEMTKNQVSLTCLVKGFYPSD<br>IAVEWESNGQPENNYKTTPPVLDSDGSFFLYSKLTVDKSRWQQGNVFSCSVMHEALHNHYTQKSLSLSP<br>GKGGGGSGGGGSGGGGSGGGGSGGGGSDKTHTCPPCPAPELLGGPSVFLFPPKPKDTLMISRTP<br>EVTCVVVDVSHEDPEVKENWYVDGVEVHNAKTKPCEEQYGSTYRCVSVLTVLHQDWLNGKEYKCKVSNK<br>ALPAPIEKTISKAKGQPREPQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSPGK<br>(SEQ ID NO: 2970) |
| MA_82-B5 CCx_I2C0x_<br>scFc_(B3K)_translation | NA<br>AA | No nuc.seq available<br>MDMRVPAQLLGLLLLWLRGARCEVQLLESGGGLVQPGGSLRLSCAASGFTFSSHAMSWVRQAPGKCLEW<br>VSAISGSGGGTYYADSVKGRFTISRDNSKNTLYLQMNSLRAEDTAVYYCATGKGVHLGFDYWGQGTLVT<br>VSSGGGGSGGGGSGGGGSELVLTQPPSVSVAPGQTARITCGGNNIGSKSVHWYQQKPGQAPVLVVYDDN<br>DRPSGIPERFSGSNFGNTATLIISRVEAGDEADYYCQVMDSSSDHVVEGCGTKLTVLSGGGGSEVQLVE<br>SGGGGLVQPGGSLKLSCAASGFTENKYAMNWVRQAPGKGLEWVARIRSKYNNYATYYADSVKDRFTISRD<br>DSKNTAYLQMNNLKTEDTAVYYCVRHGNFGNSYISYWAYWGQGTLVTVSSGGGGSGGGGSGGGGSQTVV<br>TQEPSLTVSPGGTVTLTCGSSTGAVTSGNYPNWVQQKPGQAPRGLIGGTKFLAPGTPARFSGSLLGGKA<br>ALTLSGVQPEDEAEYYCVLWYSNRWVEGGGTKLTVLGGGGDKTHTCPPCPAPELLGGPSVFLFPPKPKD<br>TLMISRTPEVTCVVVDVSHEDPEVKENWYVDGVEVHNAKTKPCAVEWESNGQPENNYKTTPPVLDSDGS<br>FFLYSKLTVDKSRWQQGNVFSCSVMHEALHNHYTQKSLSLSPGKGGGGSGGGGSGGGGSEEQYGSTYRC<br>VSVLTVLHQDWLNGKEYKCKVSNKALPAPIEKTISKAKGQPREPQVYTLPPSREEMTKNQVSLTCLVKG<br>FYPSDIGGGSGGGGSGGGGSDKTHTCPPCPAPELLGGPSVFLFPPKPKDTLMISRTPEVTCVVVDVSH<br>EDPEVKENWYVDGVEVHNAKTKPCEEQYGSTYRCVSVLTVLHQDWLNGKEYKCKVSNKALPAPIEKTIS<br>KAKGQPREPQVYTLPPSREEMTKNQVSLTCLVKGFYPSDIAVEWESNGQPENNYKTTPPVLDSDGSFFL<br>YSKLTVDKSRWQQGNVFSCSVMHEALHNHYTQKSLSLSPGK<br>(SEQ ID NO: 2971) |
| MA_89-B2 CCx_I2C0x_<br>scFc_(N1M)_translation | NA<br>AA | No nuc.seq available<br>MDMRVPAQLLGLLLLWLRGARCEVQLLESGGGLVQPGGSLRLSCAASGFTFSSYAMSWVRQAPGRCLEW<br>VSTISISGGSTNYADSVKGRFTISRDNSKNTLYLQMNSLRAEDTAVYYCAKDGGSGWFPKLLHYGLDVW<br>GQGTTVTVSSGGGGSGGGGSGGGGSELSLSASVGDRVTITCQASQDISNYLNWYQQKPGKAP<br>KLLIYAASSLQSGVPSRFSGSGSGTDFTLTISSLQPEDFATYYCQQSYSIPLTFGCGTKVEIKSGGGGS<br>EVQLVESGGGLVQPGGSLKLSCAASGFTENKYAMNWVRQAPGKGLEWVARIRSKYNNYATYYADSVKDR<br>FTISRDDSKNTAYLQMNNLKTEDTAVYYCVRHGNFGNSYISYWAYWGQGTLVTVSSGGGGSGGGGSGGG<br>GSQTVVTQEPSLTVSPGGTVTLTCGSSTGAVTSGNYPNWVQQKPGQAPRGLIGGTKFLAPGTPARFSGS<br>LLGGKAALTLSGVQPEDEAEYYCVLWYSNRWVFGGGTKLTVLGGGGDKTHTCPPCPAPELLGGPSVFLF<br>PPKPKDTLMISRTPEVTCVVVDVSHEDPEVKENWYVDGVEVHNAKTKPCEEQYGSTYRCVSVLTVLHQD<br>WLNGKEYKCKVSNKALPAPIEKTISKAKGQPREPQVYTLPPSREEMTKNQVSLTCLVKGFYPSDIAVEW<br>ESNGQPENNYKTTPPVLDSDGSFFLYSKLTVDKSRWQQGNVFSCSVMHEALHNHYTQKSLSLSPGKGGG<br>GSGGGGSGGGGSGGGGSGGGGSGGGGSDKTHTCPPCPAPELLGGPSVFLFPPKPKDTLMISRTPEVTCV |

TABLE 30-continued

BiTE-scFc_Full Sequences

| Ab | Type | BITE_scFc |
|---|---|---|
| | | VVDVSHEDPEVKENWYVDGVEVHNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK<br>(SEQ ID NO: 2972) |
| MA_89-D12_CCx_I2C0x_<br>scFc_(Y4C)_translation | NA<br>AA | No nuc.seq available<br>MDMRVPAQLLGLLLLWLRGARCEVQLLESGGGVVQPGRSLRLSCAASGFTFSTYGMHWVRQAPGKCLEW<br>VAVISYDGSNKYYADSVKGRFTISRDDSKNTLYLQMNSLRAEDTAVYYCARGQLLTGYWGQGTLVTVSS<br>GGGGSGGGGSGGGGSELVMTQSPSSLSASVGDRVTITCRASQGISNYLAWYQQKPGKVPKLLIYAASTL<br>QSGVPSRFSGSGSGTDFTLTISSLQPEDVATYYCQKYNSAPFTFGCGTKVEIKSGGGGSEVQLVESGGG<br>LVQPGGSLKLSCAASGFTENKYAMNWVRQAPGKGLEWVARIRSKYNNYATYYADSVKDRFTISRDDSKN<br>TAYLQMNNLKTEDTAVYYCVRHGNFGNSYISYWAYWGQGTLVTVSSGGGGSGGGGSGGGGSQTVVTQEP<br>SLTVSPGGTVTLTCGSSTGAVTSGNYPNWVQQKPGQAPRGLIGGTKFLAPGTPARFSGSLLGGKAALTL<br>SGVQPEDEAEYYCVLWYSNRWVEGGGTKLTVLGGGGDKTHTCPPCPAPELLGGPSVFLFPPKPKDTLMI<br>SRTPEVTCVVVDVSHEDPEVKENWYVDGVEVHNAKTKPCEEQYGSTYRCVSVLTVLHQDWLNGKEYKCK<br>VSNKALPAPIEKTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGKGGGGSGGGGSGGG<br>GSGGGGSGGGGSGGGGSDKTHTCPPCPAPELLGGPSVFLFPPKPKDTLMISRTPEVTCVVVDVSHEDPE<br>VKENWYVDGVEVHNAKTKPCEEQYGSTYRCVSVLTVLHQDWLNGKEYKCKVSNKALPAPIEKTISKAKG<br>QPREPQVYTLPPSREEMTKNQVSLTCLVKGFYPSDIAVEWESNGQPENNYKTTPPVLDSDGSFFLYSKL<br>TVDKSRWQQGNVFSCSVMHEALHNHYTQKSLSLSPGK<br>(SEQ ID NO: 2973) |
| | NA<br>AA | No nuc.seq available<br>MDMRVPAQLLGLLLLWLRGARCEVQLLESGGGLVKPGGSLRLSCAASGFTFSDYYMSWIRQAPGKCLEW<br>VSYISKSGSTIYYADSVKGRFTISRDNAKNSLYLQMNSLRAEDTAVYYCATYNYGHFDYWGQGTLVTVS<br>SGGGGSGGGGSGGGGSELVLTQPPSVSVAPGQTARITCGGNNIGSKSVHWYQQKPGQAPVLVVYDDSDR<br>PSGIPERFSGSNSGNTATLTISRVEAGDEADYYCQVWDSSSDHHVVFGCGTKLTVSGGGGSEVQLVESG<br>GGLVQPGGSLKLSCAASGFTENKYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVSSGGGGSGGGGSGGGGSQTVVTQ<br>EPSLTVSPGGTVTLTCGSSTGAVTSGNYPNWVQQKPGQAPRGLIGGTKFLAPGTPARFSGSLLGGKAAL<br>TLSGVQPEDEAEYYCVLWYSNRWVFGGGTKLTVLGGGGDKTHTCPPCPAPELLGGPSVFLFPPKPKDTL<br>MISRTPEVTCVVVDVSHEDPEVKENWYVDGVEVHNAKTKPCEEQYGSTYRCVSVLTVLHQDWLNGKEYK<br>CKVSNKALPAPIEKTISKAKGQPREPQVYTLPPSREEMTKNQVSLTCLVKGFYPSDIAVEWESNGQPEN<br>NYKTTPPVLDSDGSFFLYSKLTVDKSRWQQGNVFSCSVMHEALHNHYTQKSLSLSPGKGGGGSGGGGSG<br>GGGSGGGGSGGGGSGGGGSDKTHTCPPCPAPELLGGPSVFLFPPKPKDTLMISRTPEVTCVVVDVSHED<br>PEVKENWYVDGVEVHNAKTKPCEEQYGSTYRCVSVLTVLHQDWLNGKEYKCKVSNKALPAPIEKTISKA<br>KGQPREPQVYTLPPSREEMTKNQVSLTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 2974) |

TABLE 31

BiTE-scFc_Fv#1 (MAGEB2) VL CDRs

| Ab | Type | CDR1 | CDR2 | CDR3 |
|---|---|---|---|---|
| MA_79-<br>G12_CC_x_I2C0x_scFc_(K1F)_transla-<br>tion | NA<br><br>AA | No nuc.seq<br>available<br>RASQGISNYLA<br>(SEQ ID NO: 2975) | No nuc.seq<br>available<br>AASTLQS<br>(SEQ ID NO: 3011) | No nuc.seq<br>available<br>QKYNSAPFT<br>(SEQ ID NO: 3047) |
| MA_79-<br>H7_CCx_I2C0x_scFc_(Q4C)_translation | NA<br><br>AA | No nuc.seq<br>available<br>RTSQSISSYLN<br>(SEQ ID NO: 2976) | No nuc.seq<br>available<br>AASSLQS<br>(SEQ ID NO: 3012) | No nuc.seq<br>available<br>QQSYSSPFT<br>(SEQ ID NO: 3048) |
| MA_81-<br>E7_CCx_I2C0x_scFc_(O8Y)_translation | NA<br><br>AA | No nuc.seq<br>available<br>KSSQSVLYSSNNK-<br>NYLA<br>(SEQ ID NO: 2977) | No nuc.seq<br>available<br>WASTRES<br>(SEQ ID NO: 3013) | No nuc.seq<br>available<br>QQYYSTPLT<br>(SEQ ID NO: 3049) |
| MA_81-<br>F9_CCx_I2C0x_scFc_(16I)_translation | NA<br><br>AA | No nuc.seq<br>available<br>RASQSISSYLN<br>(SEQ ID NO: 2978) | No nuc.seq<br>available<br>AASSLQS<br>(SEQ ID NO: 3014) | No nuc.seq<br>available<br>QQSYSTPFT<br>(SEQ ID NO: 3050) |
| MA_81-<br>H7_CC_xI2C0x_scFc_(M5O)_translation | NA<br><br>AA | No nuc.seq<br>available<br>RSSQSLLHRNGYNYLD<br>(SEQ ID NO: 2979) | No nuc.seq<br>available<br>LGSNRAS<br>(SEQ ID NO: 3015) | No nuc.seq<br>available<br>MQALQTPWT<br>(SEQ ID NO: 3051) |

TABLE 31-continued

BiTE-scFc_Fv#1 (MAGEB2) VL CDRs

| Ab | Type | CDR1 | CDR2 | CDR3 |
|---|---|---|---|---|
| MA_82-B5_CCx_I2C0x_scFc_(B3K)_translation | NA | No nuc.seq available | No nuc.seq available | No nuc.seq available |
|  | AA | GGNNIGSKSVH (SEQ ID NO: 2980) | DDNDRPS (SEQ ID NO: 3016) | QVWDSSSDHVV (SEQ ID NO: 3052) |
| MA_89-B2_CCx_I2C0x_scFc_(N1M)_translation | NA | No nuc.seq available | No nuc.seq available | No nuc.seq available |
|  | AA | QASQDISNYLN (SEQ ID NO: 2981) | AASSLQS (SEQ ID NO: 3017) | QQSYSIPLT (SEQ ID NO: 3053) |
| MA_89-D12_CCx_I2C0x_scFc_(Y4C)_translation | NA | No nuc.seq available | No nuc.seq available | No nuc.seq available |
|  | AA | RASQGISNYLA (SEQ ID NO: 2982) | AASTLQS (SEQ ID NO: 3018) | QKYNSAPFT (SEQ ID NO: 3054) |
| MA_93-B11_CCx_I2C0x_scFc_(N7N)_translation | NA | No nuc.seq available | No nuc.seq available | No nuc.seq available |
|  | AA | GGNNIGSKSVH (SEQ ID NO: 2983) | DDSDRPS (SEQ ID NO: 3019) | QVWDSSSDHHVV (SEQ ID NO: 3055) |

TABLE 32

BiTE-scFc_Fv#1 (MAGEB2) VH CDRs

| Ab | Type | CDR1 | CDR2 | CDR3 |
|---|---|---|---|---|
| MA_79-G12_CC_x_I2C0x_scFc_(K1F)_translation | NA | No nuc.seq available | No nuc.seq available | No nuc.seq available |
|  | AA | RNGLS (SEQ ID NO: 2984) | WISGYNGDTNYAQ KLQG (SEQ ID NO: 3020) | GRATEDY (SEQ ID NO: 3056) |
| MA_79-H7_CCx_I2C0x_scFc_(Q4C)_translation | NA | No nuc.seq available | No nuc.seq available | No nuc.seq available |
|  | AA | NAWMS (SEQ ID NO: 2985) | RIKSKTYGGTTDY AAPVKG (SEQ ID NO: 3021) | PSYSGSYYNYFSV MDV (SEQ ID NO: 3057) |
| MA_81-E7_CCx_I2C0x_scFc_(O8Y)_translation | NA | No nuc.seq available | No nuc.seq available | No nuc.seq available |
|  | AA | SSRYYWG (SEQ ID NO: 2986) | SIYYSGSTYYNPS LKS (SEQ ID NO: 3022) | GIFGVITYFDY (SEQ ID NO: 3058) |
| MA_81-F9_CCx_I2C0x_scFc_(I6I)_translation | NA | No nuc.seq available | No nuc.seq available | No nuc.seq available |
|  | AA | THKMGVD (SEQ ID NO: 2987) | LIYWNDDKRYSPS LQS (SEQ ID NO: 3023) | RRYNWNYENWEDP (SEQ ID NO: 3059) |
| MA_81-H7_CC_xI2C0x_scFc_(M5O)_translation | NA | No nuc.seq available | No nuc.seq available | No nuc.seq available |
|  | AA | SNPYYWS (SEQ ID NO: 2988) | YISYSGITNYNPS LKS (SEQ ID NO: 3024) | EKMWFGVLNYYYG MDV (SEQ ID NO: 3060) |
| MA_82-B5_CCx_I2C0x_scFc_(B3K)_translation | NA | No nuc.seq available | No nuc.seq available | No nuc.seq available |
|  | AA | SHAMS (SEQ ID NO: 2989) | AISGSGGGTYYAD SVKG (SEQ ID NO: 3025) | GKGVHLGFDY (SEQ ID NO: 3061) |
| MA_89-B2_CCx_I2C0x_ScFc_(N1M)_translation | NA | No nuc.seq available | No nuc.seq available | No nuc.seq available |
|  | AA | SYAMS (SEQ ID NO: 2990) | TISISGGSTNYAD SVKG (SEQ ID NO: 3026) | DGGSGWFPKLLHY GLDV (SEQ ID NO: 3062) |

TABLE 32-continued

BiTE-scFc_Fv#1 (MAGEB2) VH CDRs

| Ab | Type | CDR1 | CDR2 | CDR3 |
|---|---|---|---|---|
| MA_89-D12_CCx_I2C0x_scFc_(Y4C)_translation | NA AA | No nuc.seq available TYGMH (SEQ ID NO: 2991) | No nuc.seq available VISYDGSNKYYADSVKG (SEQ ID NO: 3027) | No nuc.seq available GQLLTGY (SEQ ID NO: 3063) |
| MA_93-B11_CCx_I2C0x_scFc_(N7N)_translation | NA AA | No nuc.seq available DYYMS (SEQ ID NO: 2992) | No nuc.seq available YISKSGSTIYYADSVKG (SEQ ID NO: 3028) | No nuc.seq available YNYGHEDY (SEQ ID NO: 3064) |

TABLE 33

BiTE-scFc_Fv#2 (CD3) VL CDRs

| Ab | Type | CDR1 | CDR2 | CDR3 |
|---|---|---|---|---|
| MA_79-G12_CC_x_I2C0x_scFc_(K1F)_translation | NA AA | No nuc.seq available GSSTGAVTSGNYPN (SEQ ID NO: 2993) | No nuc.seq available GTKFLAP (SEQ ID NO: 3029) | No nuc.seq available VLWYSNRWV (SEQ ID NO: 3065) |
| MA_79-H7_CCx_I2C0x_scFc_(Q4C)_translation | NA AA | No nuc.seq available GSSTGAVTSGNYPN (SEQ ID NO: 2994) | No nuc.seq available GTKFLAP (SEQ ID NO: 3030) | No nuc.seq available VLWYSNRWV (SEQ ID NO: 3066) |
| MA_81-E7_CCx_I2C0x_scFc_(O8Y)_translation | NA AA | No nuc.seq available GSSTGAVTSGNYPN (SEQ ID NO: 2995) | No nuc.seq available GTKFLAP (SEQ ID NO: 3031) | No nuc.seq available VLWYSNRWV (SEQ ID NO: 3067) |
| MA_81-F9_CCx_I2C0x_scFc_(I6I)_translation | NA AA | No nuc.seq available GSSTGAVTSGNYPN (SEQ ID NO: 2996) | No nuc.seq available GTKFLAP (SEQ ID NO: 3032) | No nuc.seq available VLWYSNRWV (SEQ ID NO: 3068) |
| MA_81-H7_CC_xI2C0x_scFc_(M5O)_translation | NA AA | No nuc.seq available GSSTGAVTSGNYPN (SEQ ID NO: 2997) | No nuc.seq available GTKFLAP (SEQ ID NO: 3033) | No nuc.seq available VLWYSNRWV (SEQ ID NO: 3069) |
| MA_82-B5_CCx_I2C0x_scFc_(B3K)_translation | NA AA | No nuc.seq available GSSTGAVTSGNYPN (SEQ ID NO: 2998) | No nuc.seq available GTKFLAP (SEQ ID NO: 3034) | No nuc.seq available VLWYSNRWV (SEQ ID NO: 3070) |
| MA_89-B2_CCx_I2C0x_ScFc_(N1M)_translation | NA AA | No nuc.seq available GSSTGAVTSGNYPN (SEQ ID NO: 2999) | No nuc.seq available GTKFLAP (SEQ ID NO: 3035) | No nuc.seq available VLWYSNRWV (SEQ ID NO: 3071) |

TABLE 33-continued

| BiTE-scFc_Fv#2 (CD3) VL CDRs | | | | |
|---|---|---|---|---|
| Ab | Type | CDR1 | CDR2 | CDR3 |
| MA_89-D12_CCx_I2C0x_scFc_(Y4C)_translation | NA AA | No nuc.seq available GSSTGAVTSGNYPN (SEQ ID NO: 3000) | No nuc.seq available GTKFLAP (SEQ ID NO: 3036) | No nuc.seq available VLWYSNRWV (SEQ ID NO: 3072) |
| MA_93-B11_CCx_I2C0x_scFc_(N7N)_translation | NA AA | No nuc.seq available GSSTGAVTSGNYPN (SEQ ID NO: 3001) | No nuc.seq available GTKFLAP (SEQ ID NO: 3037) | No nuc.seq available VLWYSNRWV (SEQ ID NO: 3073) |

TABLE 34

| BiTE-scFc_Fv#2 (CD3) VH CDRs | | | | |
|---|---|---|---|---|
| Ab | Type | CDR1 | CDR2 | CDR3 |
| MA_79-G12_CC x I2C0x_scFc_(K1F)_translation | NA AA | No nuc.seq available KYAMN (SEQ ID NO: 3002) | No nuc.seq available RIRSKYNNYATYYADSVKD (SEQ ID NO: 3038) | No nuc.seq available HGNFGNSYISYWAY (SEQ ID NO: 3074) |
| MA_79-H7_CCx_I2C0x_scFc_(Q4C)_translation | NA AA | No nuc.seq available KYAMN (SEQ ID NO: 3003) | No nuc.seq available RIRSKYNNYATYYADSVKD (SEQ ID NO: 3039) | No nuc.seq available HGNFGNSYISYWAY (SEQ ID NO: 3075) |
| MA_81-E7_CCx_I2C0x_scFc_(O8Y)_translation | NA AA | No nuc.seq available KYAMN (SEQ ID NO: 3004) | No nuc.seq available RIRSKYNNYATYYADSVKD (SEQ ID NO: 3040) | No nuc.seq available HGNFGNSYISYWAY (SEQ ID NO: 3076) |
| MA_81-F9_CCx_I2C0x_scFc_(I6I)_translation | NA AA | No nuc.seq available KYAMN (SEQ ID NO: 3005) | No nuc.seq available RIRSKYNNYATYYADSVKD (SEQ ID NO: 3041) | No nuc.seq available HGNFGNSYISYWAY (SEQ ID NO: 3077) |
| MA_81-H7_CC_xI2C0x_scFc_(M5O)_translation | NA AA | No nuc.seq available KYAMN (SEQ ID NO: 3006) | No nuc.seq available RIRSKYNNYATYYADSVKD (SEQ ID NO: 3042) | No nuc.seq available HGNFGNSYISYWAY (SEQ ID NO: 3078) |
| MA_82-B5_CCx_I2C0x_scFc_(B3K)_translation | NA AA | No nuc.seq available KYAMN (SEQ ID NO: 3007) | No nuc.seq available RIRSKYNNYATYYADSVKD (SEQ ID NO: 3043) | No nuc.seq available HGNFGNSYISYWAY (SEQ ID NO: 3079) |
| MA_89-B2_CCx_I2C0x_scFc_(N1M)_translation | NA AA | No nuc.seq available KYAMN (SEQ ID NO: 3008) | No nuc.seq available RIRSKYNNYATYYADSVKD (SEQ ID NO: 3044) | No nuc.seq available HGNFGNSYISYWAY (SEQ ID NO: 3080) |

TABLE 34-continued

| | | BiTE-scFc_Fv#2 (CD3) VH CDRs | | |
|---|---|---|---|---|
| Ab | Type | CDR1 | CDR2 | CDR3 |
| MA_89-D12_CCx_I2C0x_scFc_(Y4C)_translation | NA AA | No nuc.seq available KYAMN (SEQ ID NO: 3009) | No nuc.seq available RIRSKYNNYATYY ADSVKD (SEQ ID NO: 3045 | No nuc.seq available HGNFGNSYISYWAY (SEQ ID NO: 3081 |
| MA_93-B11_CCx_I2C0x_scFc_(N7N)_translation | NA AA | No nuc.seq available KYAMN (SEQ ID NO: 3010) | No nuc.seq available RIRSKYNNYATYY ADSVKD (SEQ ID NO: 3046 | No nuc.seq available HGNFGNSYISYWAY (SEQ ID NO: 3082 |

TABLE 35

| | | BiTE-scFc_Variable Region Sequences (MAGEB2) | |
|---|---|---|---|
| Ab | Type | LC V-region | HC V-region |
| | | Fv#1 (MAGEB2) | |
| MA_79-G12_CC_x_I2C0x_scFc_(K1F)_translation | NA AA | No nuc.seq available ELVMTQSPSSLSASVGDRVTI TCRASQGISNYLAWYQQKPGK VPKLLISAASTLQSGVPSRES GSGSGTDFTLTISSLQPEDVA TYYCQKYNSAPFTFGCGTKLE IK (SEQ ID NO: 3083 | No nuc.seq available EVQLLESGAEVKKPGASVKVS CKASGYTFTRNGLSWVRQAPG QCLEWMGWISGYNGDTNYAQK LQGRGTMTTDTSTSTAYMELR SLRSDDTAVYYCARGRATEDY WGQGTLVTVSS (SEQ ID NO: 3092) |
| MA_79-H7_CCx_I2C0x_scFc_(Q4C)_translation | NA AA | No nuc.seq available ELQMTQSPSSLSASVGDRVTI TCRTSQSISSYLNWFQQKPGK APKLLIFAASSLQSGVPSRFS GSGSGTDFTLTISSLQPEDFA TYYCQQSYSSPFTFGCGTKVE IK (SEQ ID NO: 3084 | No nuc.seq available EVQLLESGGGLVQPGGSLRLS CAASGFTFSNAWMSWVRQAPG KCLEWVGRIKSKTYGGTTDYA APVKGRFTISRDDSKNTLYLQ MNSLKTEDTAVYYCTTPSYSG SYYNYFSVMDVWGQGTTVTVS S (SEQ ID NO: 3093 |
| MA_81-E7_CCx_I2C0x_scFc_(O8Y)_translation | NA AA | No nuc.seq available ELVMTQTPDSLAVSLGERATI NCKSSQSVLYSSNNKNYLAWY QQKPGQPPKLLIYWASTRESG VPDRFSGSGSGTDFTLTISSL QAEDVAVYYCQQYYSTPLTFG CGTKVEIK (SEQ ID NO: 3085) | No nuc.seq available EVQLLESGPGLVKPSETLSLT CTVSGDSISSSRYYWGWIRQP PGKCLEWIGSIYYSGSTYYNP SLKSRVTISVDTSKNQFSLKL SSVTAADTAVYYCARGIFGVI TYFDYWGQGTLVTVSS (SEQ ID NO: 3094) |
| MA_81-F9_CCx_I2C0x_scFc_(I6I)_translation | NA AA | No nuc.seq available ELQMTQSPSSLSASVGDRVTI TCRASQSISSYLNWYQQKPGK APKLLIYAASSLQSGVPSRFS GSGSGTDFTLTISSLQPEDFA TYYCQQSYSTPFTFGCGTKVE IK (SEQ ID NO: 3086) | No nuc.seq available EVQLLESGPMLVKPTQTLTLT CTESGFSFTTHKMGVDWIRQP PGKCLEWLALIYWNDDKRYSP SLQSRLTITKDTSKNQVVLTM TNMDPVDTATYYCAYRRYNWN YENWEDPWGQGTLVTVSS (SEQ ID NO: 3095) |
| MA_81-H7_CC_xI2C0x_scFc_(M5O)_translation | NA AA | No nuc.seq available ELVMTQTPLSLPVTPGEPASI SCRSSQSLLHRNGYNYLDWYL QKPGQSPQLLIYLGSNRASGV PDRFSGSGSGTDFTLKISRVE AGDVGVYYCMQALQTPWTFGC GTKVEIK (SEQ ID NO: 3087) | No nuc.seq available EVQLLESGPGLVKPSQTLSLT CTVSGDSISSNPYYWSWIRQH PGKCLEWIGYISYSGITNYNP SLKSRVTMSVDTSKNQFSLKL TSLTAADTAVYYCAREKMWFG VLNYYYGMDVWGQGTTVTVSS (SEQ ID NO: 3096) |

TABLE 35-continued

BiTE-scFc Variable Region Sequences (MAGEB2)

| Ab | Type | LC V-region | HC V-region |
|---|---|---|---|
| MA_82-B5_CCx_I2C0x_scFc_(B3K) translation | NA<br>AA | No nuc.seq available<br>ELVLTQPPSVSVAPGQTARIT CGGNNIGSKSVHWYQQKPGQA PVLVVYDDNDRPSGIPERFSG SNEGNTATLIISRVEAGDEAD YYCQVWDSSSDHVVFGCGTKL TVL<br>(SEQ ID NO: 3088 | No nuc.seq available<br>EVQLLESGGGLVQPGGSLRLS CAASGFTFSSHAMSWVRQAPG KCLEWVSAISGSGGTYYADS VKGRFTISRDNSKNTLYLQMN SLRAEDTAVYYCATGKGVHLG FDYWGQGTLVTVSS<br>(SEQ ID NO: 3097) |
| MA_89-B2_CCx_I2C0x_scFc_(N1M)_translation | NA<br>AA | No nuc.seq available<br>ELQMTQSPSSLSASVGDRVTI TCQASQDISNYLNWYQQKPGK APKLLIYAASSLQSGVPSRES GSGSGTDFTLTISSLQPEDFA TYYCQQSYSIPLTFGCGTKVE IK<br>(SEQ ID NO: 3089 | No nuc.seq available<br>EVQLLESGGGLVQPGGSLRLS CAASGFTFSSYAMSWVRQAPG RCLEWVSTISISGGSTNYADS VKGRFTISRDNSKNTLYLQMN SLRAEDTAVYYCAKDGGSGWF PKLLHYGLDVWGQGTTVTVSS<br>(SEQ ID NO: 3098) |
| MA_89-D12_CCx_I2C0x_scFc_(Y4C)_translation | NA<br>AA | No nuc.seq available<br>ELVMTQSPSSLSASVGDRVTI TCRASQGISNYLAWYQQKPGK VPKLLIYAASTLQSGVPSRFS GSGSGTDFTLTISSLQPEDVA TYYCQQKYNSAPFTFGCGTKVE IK<br>SEQ ID NO: 3090 | No nuc.seq available<br>EVQLLESGGGVVQPGRSLRLS CAASGFTFSTYGMHWVRQAPG KCLEWVAVISYDGSNKYYADS VKGRFTISRDDSKNTLYLQMN SLRAEDTAVYYCARGQLLTGY WGQGTLVTVSS<br>(SEQ ID NO: 3099) |
| MA_93-B11_CCx_I2C0x_scFc_(N7N)_translation | NA<br>AA | No nuc.seq available<br>ELVLTQPPSVSVAPGQTARIT CGGNNIGSKSVHWYQQKPGQA PVLVVYDDSDRPSGIPERFSG SNSGNTATLTISRVEAGDEAD YYCQVWDSSSDHHVVFGCGTK LTVS<br>(SEQ ID NO: 3091) | No nuc.seq available<br>EVQLLESGGGLVKPGGSLRLS CAASGFTFSIYMSWIRQAPGK CLEWVSYISKSGSTIYYADSV KGRFTISRDNAKNSLYLQMNS LRAEDTAVYYCATYNYGHEDY WGQGTLVTVSS<br>(SEQ ID NO: 3100) |
| | | Fv#2 (CD3) | |
| MA_79-G12_CC_x_I2C0x_scFc_(K1F)_translation | NA<br>AA | No nuc.seq available<br>QTVVTQEPSLTVSPGGTVTLT CGSSTGAVTSGNYPNWVQQKP GQAPRGLIGGTKFLAPGTPAR FSGSLLGGKAALTLSGVQPED EAEYYCVLWYSNRWVFGGGTK LTVL<br>SEQ ID NO: 3101 | No nuc.seq available<br>EVQLVESGGGLVQPGGSLKLS CAASGFTENKYAMNWVRQAPG KGLEWVARIRSKYNNYATYYA DSVKDRFTISRDDSKNTAYLQ MNNLKTEDTAVYYCVRHGNFG NSYISYWAYWGQGTLVTVSS<br>(SEQ ID NO: 3110) |
| MA_79-H7_CCx_I2C0x_scFc_(Q4C)_translation | NA<br>AA | No nuc.seq available<br>QTVVTQEPSLTVSPGGTVTLT CGSSTGAVTSGNYPNWVQQKP GQAPRGLIGGTKFLAPGTPAR FSGSLLGGKAALTLSGVQPED EAEYYCVLWYSNRWVFGGGTK LTVL<br>SEQ ID NO: 3102 | No nuc.seq available<br>EVQLVESGGGLVQPGGSLKLS CAASGFTENKYAMNWVRQAPG KGLEWVARIRSKYNNYATYYA DSVKDRFTISRDDSKNTAYLQ MNNLKTEDTAVYYCVRHGNEG NSYISYWAYWGQGTLVTVSS<br>(SEQ ID NO: 3111) |
| MA_81-E7_CCx_I2C0x_scFc_(O8Y)_translation | NA<br>AA | No nuc.seq available<br>QTVVTQEPSLTVSPGGTVTLT CGSSTGAVTSGNYPNWVQQKP GQAPRGLIGGTKFLAPGTPAR FSGSLLGGKAALTLSGVQPED EAEYYCVLWYSNRWVFGGGTK LTVL<br>(SEQ ID NO: 3103) | No nuc.seq available<br>EVQLVESGGGLVQPGGSLKLS CAASGFTENKYAMNWVRQAPG KGLEWVARIRSKYNNYATYYA DSVKDRFTISRDDSKNTAYLQ MNNLKTEDTAVYYCVRHGNFG NSYISYWAYWGQGTLVTVSS<br>(SEQ ID NO: 3112) |
| MA_81-F9_CCx_I2C0x_scFc_(I6I)_translation | NA<br>AA | No nuc.seq available<br>QTVVTQEPSLTVSPGGTVTLT CGSSTGAVTSGNYPNWVQQKP GQAPRGLIGGTKFLAPGTPAR FSGSLLGGKAALTLSGVQPED EAEYYCVLWYSNRWVFGGGTK LTVL<br>(SEQ ID NO: 3104) | No nuc.seq available<br>EVQLVESGGGLVQPGGSLKLS CAASGFTENKYAMNWVRQAPG KGLEWVARIRSKYNNYATYYA DSVKDRFTISRDDSKNTAYLQ MNNLKTEDTAVYYCVRHGNFG NSYISYWAYWGQGTLVTVSS<br>(SEQ ID NO: 3113) |

TABLE 35-continued

BiTE-scFc_Variable Region Sequences (MAGEB2)

| Ab | Type | LC V-region | HC V-region |
|---|---|---|---|
| MA_81-H7_CC_xI2C0x_scFc_(M5O)_translation | NA<br>AA | No nuc.seq available<br>QTVVTQEPSLTVSPGGTVTLT<br>CGSSTGAVTSGNYPNWVQQKP<br>GQAPRGLIGGTKFLAPGTPAR<br>FSGSLLGGKAALTLSGVQPED<br>EAEYYCVLWYSNRWVEGGGTK<br>LTVI<br>(SEQ ID NO: 3105 | No nuc.seq available<br>EVQLVESGGGLVQPGGSLKLS<br>CAASGFTENKYAMNWVRQAPG<br>KGLEWVARIRSKYNNYATYYA<br>DSVKDRETISRDDSKNTAYLQ<br>MNNLKTEDTAVYYCVRHGNFG<br>NSYISYWAYWGQGTLVTVSS<br>(SEQ ID NO: 3114 |
| MA_82-B5_CCx_I2C0x_scFc_(B3K)_translation | NA<br>AA | No nuc.seq available<br>QTVVTQEPSLTVSPGGTVTLT<br>CGSSTGAVTSGNYPNWVQQKP<br>GQAPRGLIGGTKFLAPGTPAR<br>FSGSLLGGKAALTLSGVQPED<br>EAEYYCVLWYSNRWVFGGGTK<br>LTVL<br>(SEQ ID NO: 3106 | No nuc.seq available<br>EVQLVESGGGLVQPGGSLKLS<br>CAASGFTENKYAMNWVRQAPG<br>KGLEWVARIRSKYNNYATYYA<br>DSVKDRETISRDDSKNTAYLQ<br>MNNLKTEDTAVYYCVRHGNFG<br>NSYISYWAYWGQGTLVTVSS<br>(SEQ ID NO: 3115 |
| MA_89-B2_CCx_I2C0x_scFc_(N1M)_translation | NA<br>AA | No nuc.seq available<br>QTVVTQEPSLTVSPGGTVTLT<br>CGSSTGAVTSGNYPNWVQQKP<br>GQAPRGLIGGTKFLAPGTPAR<br>FSGSLLGGKAALTLSGVQPED<br>EAEYYCVLWYSNRWVFGGGTK<br>LTVL<br>(SEQ ID NO: 3107 | No nuc.seq available<br>EVQLVESGGGLVQPGGSLKLS<br>CAASGFTENKYAMNWVRQAPG<br>KGLEWVARIRSKYNNYATYYA<br>DSVKDRFTISRDDSKNTAYLQ<br>MNNLKTEDTAVYYCVRHGNFG<br>NSYISYWAYWGQGTLVTVSS<br>(SEQ ID NO: 3116 |
| MA_89-D12_CCx_I2C0x_scFc_(Y4C)_translation | NA<br>AA | No nuc.seq available<br>QTVVTQEPSLTVSPGGTVTLT<br>CGSSTGAVTSGNYPNWVQQKP<br>GQAPRGLIGGTKFLAPGTPAR<br>FSGSLLGGKAALTLSGVQPED<br>EAEYYCVLWYSNRWVFGGGTK<br>LTVL<br>(SEQ ID NO: 3108 | No nuc.seq available<br>EVQLVESGGGLVQPGGSLKLS<br>CAASGFTENKYAMNWVRQAPG<br>KGLEWVARIRSKYNNYATYYA<br>DSVKDRFTISRDDSKNTAYLQ<br>MNNLKTEDTAVYYCVRHGNEG<br>NSYISYWAYWGQGTLVTVSS<br>(SEQ ID NO: 3117 |
| MA_93-B11_CCx_I2C0x_scFc_(N7N)_translation | NA<br>AA | No nuc.seq available<br>QTVVTQEPSLTVSPGGTVTLT<br>CGSSTGAVTSGNYPNWVQQKP<br>GQAPRGLIGGTKFLAPGTPAR<br>FSGSLLGGKAALTLSGVQPED<br>EAEYYCVLWYSNRWVFGGGTK<br>LTVL<br>(SEQ ID NO: 3109 | No nuc.seq available<br>EVQLVESGGGLVQPGGSLKLS<br>CAASGFTFIRQAPGKGLEWVA<br>RIRSKYNNYATYYADSVKDRE<br>TISRDDSKNTAYLQMNNLKTE<br>DTAVYYCVRHGNFGNSYISYW<br>AYWGQGTLVTVSS<br>(SEQ ID NO: 3118 |

TABLE 36

BiTE-scFc_Variable Region Protein Alignment (MAGEB2)
CDRs defined by Kabat
Alignment numbering defined by Amgen Reference (AHo)

KAPPA_VARIABLE

| Germline | | SEQ ID NO: |
|---|---|---|
| | K_FR1 | |
| VK1\|A20/JK2 | DIQMTQSPSSLSASVGDRVTITC | 3119 |
| MA_79-G12_CC_x_I2C0x_scFc_(K1F)_translation Fv#1  VK1\|A20/JK2 | ELVMTQSPSSLSASVGDRVTITC | 3120 |
| VK1\|O12/JK1 | DIQMTQSPSSLSASVGDRVTITC | 3121 |
| MA_79-H7_CCx_I2C0x_scFc_(Q4C)_translation Fv#1  VK1\|O12/JK1 | ELQMTQSPSSLSASVGDRVTITC | 3122 |
| MA_81-F9_CCx_I2C0x_scFc_(I6I)_translation Fv#1  VK1\|O12/JK1 | ELQMTQSPSSLSASVGDRVTITC | 3123 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| VK4\|B3/JK4 | | DIVMTQSPDSLAVSLGERATINC | 3124 |
| MA_81-E7_CCx_I2C0x_scFc_(O8Y)_translation Fv#1 | VK4\|B3/JK4 | ELVMTQTPDSLAVSLGERATINC | 3125 |
| VK2\|O1/JK1 | | DIVMTQTPLSLPVTPGEPASISC | 3126 |
| MA_81-H7_CC_xI2C0x_scFc_(M5O)_translation Fv#1 | VK2\|O1/JK1 | ELVMTQTPLSLPVTPGEPASISC | 3127 |
| VK1\|O12/JK4 | | DIQMTQSPSSLSASVGDRVTITC | 3128 |
| MA_89-B2_CCx_I2C0x_scFc_(N1M)_translation Fv#1 | VK1\|O12/JK4 | ELQMTQSPSSLSASVGDRVTITC | 3129 |
| VK1\|A20/JK1 | | DIQMTQSPSSLSASVGDRVTITC | 3130 |
| MA_89-D12_CCx_I2C0x_scFc_(Y4C)_translation Fv#1 | VK1\|A20/JK1 | ELVMTQSPSSLSASVGDRVTITC | 3131 |
| | | K_CDR1 | |
| VK1\|A20/JK2 | | RAS--QGIS------NYLA | 3173 |
| MA_79-G12_CC_x_I2C0x_scFc_(K1F)_translation Fv#1 | VK1\|A20/JK2 | RAS--QGIS------NYLA | 3174 |
| VK1\|O12/JK1 | | RAS--QSIS------SYLN | 3175 |
| MA_79-H7_CCx_I2C0x_scFc_(Q4C)_translation Fv#1 | VK1\|O12/JK1 | RTS--QSIS------SYLN | 3176 |
| MA_81-F9_CCx_I2C0x_scFc_(I6I)_translation Fv#1 | VK1\|O12/JK1 | RAS--QSIS------SYLN | 3177 |
| VK4\|B3/JK4 | | KSS--QSVLYSSNNKNYLA | 3178 |
| MA_81-E7_CCx_I2C0x_scFc_(O8Y)_translation Fv#1 | VK4\|B3/JK4 | KSS--QSVLYSSNNKNYLA | 3179 |
| VK2\|O1/JK1 | | RSS--QSLLDSDDGNTYLD | 3180 |
| MA_81-H7_CC_xI2C0x_scFc_(M5O)_translation Fv#1 | VK2\|O1/JK1 | RSS--QSLLHRN-GYNYLD | 3181 |
| VK1\|O12/JK4 | | RAS--QSIS------SYLN | 3182 |
| MA_89-B2_CCx_I2C0x_scFc_(N1M)_translation Fv#1 | VK1\|O12/JK4 | QAS--QDIS------NYLN | 3183 |
| VK1\|A20/JK1 | | RAS--QGIS------NYLA | 3184 |
| MA_89-D12_CCx_I2C0x_scFc_(Y4C)_translation Fv#1 | VK1\|A20/JK1 | RAS--QGIS------NYLA | 3185 |

TABLE 36-continued

BiTE-scFc_Variable Region Protein Alignment (MAGEB2)
CDRs defined by Kabat
Alignment numbering defined by Amgen Reference (AHo)

LAMBDA_VARIABLE

| | Germline | | SEQ ID NO: |
|---|---|---|---|
| | | L_FR1 | |
| VL7\|7a/JL3b | | QTVVTQE-PSLTVSPGGTVTLTC | 3132 |
| MA_79-G12_CC_x_I2C0x_scFc_(K1F)_translation Fv#2 | VL7\|7a/JL3b | QTVVTQE-PSLTVSPGGTVTLTC | 3133 |
| MA_79-H7_CCx_I2C0x_scFc_(Q4C)_translation Fv#2 | VL7\|7a/JL3b | QTVVTQE-PSLTVSPGGTVTLTC | 3134 |
| MA_81-E7_CCx_I2C0x_scFc_(O8Y)_translation Fv#2 | VL7\|7a/JL3b | QTVVTQE-PSLTVSPGGTVTLTC | 3135 |
| MA_81-F9_CCx_I2C0x_scFc_(I6I)_translation Fv#2 | VL7\|7a/JL3b | QTVVTQE-PSLTVSPGGTVTLTC | 3136 |
| MA_81-H7_CC_xI2C0x_scFc_(M5O)_translation Fv#2 | VL7\|7a/JL3b | QTVVTQE-PSLTVSPGGTVTLTC | 3137 |
| MA_82-B5_CCx_I2C0x_scFc_(B3K)_translation Fv#2 | VL7\|7a/JL3b | QTVVTQE-PSLTVSPGGTVTLTC | 3138 |
| MA_89-B2_CCx_I2C0x_scFc_(N1M)_translation Fv#2 | VL7\|7a/JL3b | QTVVTQE-PSLTVSPGGTVTLTC | 3139 |
| MA_89-D12_CCx_I2C0x_scFc_(Y4C)_translation Fv#2 | VL7\|7a/JL3b | QTVVTQE-PSLTVSPGGTVTLTC | 3140 |
| MA_93-B11_CCx_I2C0x_scFc_(N7N)_translation Fv#2 | \|VL7\|7a/JL3b | QTVVTQE-PSLTVSPGGTVTLTC | 3141 |
| VL3\|3h/JL2 | | SYVLTQP-PSVSVAPGKTARITC | 3142 |
| MA_82-B5_CCx_I2C0x_scFc_(B3K)_translation Fv#1 | VL3\|3h/JL2 | ELVLTQP-PSVSVAPGQTARITC | 3143 |
| MA_93-B11_CCx_I2C0x_scFc_(N7N)_translation Fv#1 | VL3\|3h/JL2 | ELVLTQP-PSVSVAPGQTARITC | 3144 |
| | | L_CDR1 | |
| VL7\|7a/JL3b | | ASST-GAVTSG----YYPN | 3186 |
| MA_79-G12_CC_x_I2C0x_scFc_(K1F)_translation Fv#2 | VL7\|7a/JL3b | GSST-GAVTSG----NYPN | 3187 |
| MA_79-H7_CCx_I2C0x_scFc_(Q4C)_translation Fv#2 | VL7\|7a/JL3b | GSST-GAVTSG----NYPN | 3188 |
| MA_81-E7_CCx_I2C0x_scFc_(O8Y)_translation Fv#2 | VL7\|7a/JL3b | GSST-GAVTSG----NYPN | 3189 |
| MA_81-F9_CCx_I2C0x_scFc_(I6I)_translation Fv#2 | VL7\|7a/JL3b | GSST-GAVTSG----NYPN | 3190 |

TABLE 36-continued

BiTE-scFc_Variable Region Protein Alignment (MAGEB2)
CDRs defined by Kabat
Alignment numbering defined by Amgen Reference (AHo)

| | | | SEQ ID NO: |
|---|---|---|---|
| MA_81-H7_CC_xI2C0x_scFc_(M5O)_translation Fv#2 | VL7\|7a/JL3b | GSST-GAVTSG----NYPN | 3191 |
| MA_82-B5_CCx_I2C0x_scFc_(B3K)_translation Fv#2 | VL7\|7a/JL3b | GSST-GAVTSG----NYPN | 3192 |
| MA_89-B2_CCx_I2C0x_scFc_(N1M)_translation Fv#2 | VL7\|7a/JL3b | GSST-GAVTSG----NYPN | 3193 |
| MA_89-D12_CCx_I2C0x_scFc_(Y4C)_translation Fv#2 | VL7\|7a/JL3b | GSST-GAVTSG----NYPN | 3194 |
| MA_93-B11_CCx_I2C0x_scFc_(N7N)_translation Fv#2 | VL7\|7a/JL3b | GSST-GAVTSG----NYPN | 3195 |
| | VL3\|3h/JL2 | GGN---NIGS-----KSVH | 3196 |
| MA_82-B5_CCx_I2C0x_scFc_(B3K)_translation Fv#1 | VL3\|3h/JL2 | GGN---NIGS-----KSVH | 3197 |
| MA_93-B11_CCx_I2C0x_scFc_(N7N)_translation Fv#1 | VL3\|3h/JL2 | GGN---NIGS-----KSVH | 3198 |

HEAVY_VARIABLE

| | Germline | | SEQ ID NO: |
|---|---|---|---|
| | | H_FR1 | |
| VH1\|1-18/D6\|6-13\|RF2/JH4 | | QVQLVQS-GAEVKKPGASVKVSCKASG-YTFT | 3145 |
| MA_79-G12_CC_x_I2C0x_scFc_(K1F)_translation Fv#1 | VH1\|1-18/D6\|6-13\|RF2/JH4 | EVQLLES-GAEVKKPGASVKVSCKASG-YTFT | 3146 |
| VH3\|3-73/D3\|3-3\|RF3/JH4 | | EVQLVES-GGGLVQPGGSLKLSCAASG-FTFS | 3147 |
| MA_79-G12_CC_x_I2C0x_scFc_(K1F)_translation Fv#2 | VH3\|3-73/D3\|3-3\|RF3/JH4 | EVQLVES-GGGLVQPGGSLKLSCAASG-FTEN | 3148 |
| MA_79-H7_CCx_I2C0x_scFc_(Q4C)_translation Fv#2 | VH3\|3-73/D3\|3-3\|RF3/JH4 | EVQLVES-GGGLVQPGGSLKLSCAASG-FTEN | 3149 |
| MA_81-E7_CCx_I2C0x_scFc_(O8Y)_translation Fv#2 | VH3\|3-73/D3\|3-3\|RF3/JH4 | EVQLVES-GGGLVQPGGSLKLSCAASG-FTEN | 3150 |
| MA_81-F9_CCx_I2C0x_scFc_(I6I)_translation Fv#2 | VH3\|3-73/D3\|3-3\|RF3/JH4 | EVQLVES-GGGLVQPGGSLKLSCAASG-FTEN | 3151 |
| MA_81-H7_CC_xI2C0x_scFc_(M5O)_translation Fv#2 | VH3\|3-73/D3\|3-3\|RF3/JH4 | EVQLVES-GGGLVQPGGSLKLSCAASG-FTEN | 3152 |
| MA_82-B5_CCx_I2C0x_scFc_(B3K)_translation Fv#2 | VH3\|3-73/D3\|3-3\|RF3/JH4 | EVQLVES-GGGLVQPGGSLKLSCAASG-FTEN | 3153 |
| MA_89-B2_CCx_I2C0x_scFc_(N1M)_translation Fv#2 | VH3\|3-73/D3\|3-3\|RF3/JH4 | EVQLVES-GGGLVQPGGSLKLSCAASG-FTEN | 3154 |
| MA_89-D12_CCx_I2C0x_scFc_(Y4C)_translation Fv#2 | VH3\|3-73/D3\|3-3\|RF3/JH4 | EVQLVES-GGGLVQPGGSLKLSCAASG-FTEN | 3155 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| MA_93-<br>B11_CCx_I2C0x_scFc_(N7N)_<br>translation Fv#2 | VH3\|3-73/D3\|3-<br>3\|RF3/JH4 | EVQLVES-GGGLVQPGGSLKLSCAASG-FTEN | 3156 |
| VH3\|3-15/D3\|3-10\|RF2/JH6 | | EVQLVES-GGGLVKPGGSLRLSCAASG-FTES | 3157 |
| MA_79-<br>H7_CCx_I2C0x_scFc_(Q4C)_<br>translation Fv#1 | VH3\|3-15/D3\|3-<br>10\|RF2/JH6 | EVQLLES-GGGLVQPGGSLRLSCAASG-FTES | 3158 |
| VH4\|4-59/D3\|3-3\|RF3/JH4 | | QVQLQES-GPGLVKPSETLSLTCTVSG-GSIS | 3159 |
| MA_81-<br>E7_CCx_I2C0x_scFc_(O8Y)_<br>translation Fv#1 | VH4\|4-59/D3\|3-<br>3\|RF3/JH4 | EVQLLES-GPGLVKPSETLSLTCTVSG-DSIS | 3160 |
| VH2\|2-05/D2\|2-15\|RF1/JH5 | | QITLKES-GPTLVKPTQTLTLTCTFSG-FSLS | 3161 |
| MA_81-<br>F9_CCx_I2C0x_scFc_(I6I)_<br>translation Fv#1 | VH2\|2-05/D2\|2-<br>15\|RF1/JH5 | EVQLLES-GPMLVKPTQTLTLTCTFSG-FSFT | 3162 |
| VH4\|4-30.1/D3\|3-10\|RF3/JH6 | | QVQLQES-GPGLVKPSQTLSLTCTVSG-GSIS | 3163 |
| MA_81-<br>H7_CC_xI2C0x_scFc_(M5O)_<br>translation Fv#1 | VH4\|4-30.1/D3\|3-<br>10\|RF3/JH6 | EVQLLES-GPGLVKPSQTLSLTCTVSG-DSIS | 3164 |
| VH3\|3-23/D6\|6-19\|RF2/JH4 | | EVQLLES-GGGLVQPGGSLRLSCAASG-FTES | 3165 |
| MA_82-<br>B5_CCx_I2C0x_scFc_(B3K)_<br>translation Fv#1 | VH3\|3-23/D6\|6-<br>19\|RF2/JH4 | EVQLLES-GGGLVQPGGSLRLSCAASG-FTES | 3166 |
| VH3\|3-23/D6\|6-19\|RF1/JH6 | | EVQLLES-GGGLVQPGGSLRLSCAASG-FTES | 3167 |
| MA_89-<br>B2_CCx_I2C0x_scFc_(N1M)_<br>translation Fv#1 | VH3\|3-23/D6\|6-<br>19\|RF1/JH6 | EVQLLES-GGGLVQPGGSLRLSCAASG-FTFS | 3168 |
| VH3\|3-30.3/D1\|1-1\|RF2/JH4 | | QVQLVES-GGGVVQPGRSLRLSCAASG-FTES | 3169 |
| MA_89-<br>D12_CCx_I2C0x_scFc_(Y4C)_<br>translation Fv#1 | VH3\|3-30.3/D1\|1-<br>1\|RF2/JH4 | EVQLLES-GGGVVQPGRSLRLSCAASG-FTES | 3170 |
| VH3\|3-11/D1\|1-1\|RF3/JH4 | | QVQLVES-GGGLVKPGGSLRLSCAASG-FTES | 3171 |
| MA_93-<br>B11_CCx_I2C0x_scFc_(N7N)_<br>translation Fv#1 | VH3\|3-11/D1\|1-<br>1\|RF3/JH4 | EVQLLES-GGGLVKPGGSLRLSCAASG-FTES | 3172 |
| | | H_CDR1 | |
| VH1\|1-18/D6\|6-13\|RF2/JH4 | | S-----YGIS | 3199 |
| MA_79-<br>G12_CC_x_I2C0x_scFc_(K1F)_<br>translation Fv#1 | VH1\|1-18/D6\|6-<br>13\|RF2/JH4 | R-----NGLS | 3200 |
| VH3\|3-73/D3\|3-3\|RF3/JH4 | | G-----SAMH | 3201 |
| MA_79-<br>G12_CC_x_I2C0x_scFc_(K1F)_<br>translation Fv#2 | VH3\|3-73/D3\|3-<br>3\|RF3/JH4 | K-----YAMN | 3202 |
| MA_79-<br>H7_CCx_I2C0x_scFc_(Q4C)_<br>translation Fv#2 | VH3\|3-73/D3\|3-<br>3\|RF3/JH4 | K-----YAMN | 3203 |
| MA_81-<br>E7_CCx_I2C0x_scFc_(O8Y)_<br>translation Fv#2 | VH3\|3-73/D3\|3-<br>3\|RF3/JH4 | K-----YAMN | 3204 |

TABLE 36-continued

BiTE-scFc_Variable Region Protein Alignment (MAGEB2)
CDRs defined by Kabat
Alignment numbering defined by Amgen Reference (AHo)

| Name | V/D/J | CDR | SEQ ID NO |
|---|---|---|---|
| MA_81-F9_CCx_I2C0x_scFc_(I6I)_translation Fv#2 | VH3\|3-73/D3\|3-3\|RF3/JH4 | K-----YAMN | 3205 |
| MA_81-H7_CC_xI2C0x_scFc_(M5O)_translation Fv#2 | VH3\|3-73/D3\|3-3\|RF3/JH4 | K-----YAMN | 3206 |
| MA_82-B5_CCx_I2C0x_scFc_(B3K)_translation Fv#2 | VH3\|3-73/D3\|3-3\|RF3/JH4 | K-----YAMN | 3207 |
| MA_89-B2_CCx_I2C0x_scFc_(N1M)_translation Fv#2 | VH3\|3-73/D3\|3-3\|RF3/JH4 | K-----YAMN | 3208 |
| MA_89-D12_CCx_I2C0x_scFc_(Y4C)_translation Fv#2 | VH3\|3-73/D3\|3-3\|RF3/JH4 | K-----YAMN | 3209 |
| MA_93-B11_CCx_I2C0x_scFc_(N7N)_translation Fv#2 | VH3\|3-73/D3\|3-3\|RF3/JH4 | K-----YAMN | 3210 |
| VH3\|3-15/D3\|3-10\|RF2/JH6 | | N-----AWMS | 3211 |
| MA_79-H7_CCx_I2C0x_scFc_(Q4C)_translation Fv#1 | VH3\|3-15/D3\|3-10\|RF2/JH6 | N-----AWMS | 3212 |
| VH4\|4-59/D3\|3-3\|RF3/JH4 | | S-----YYWS | 3213 |
| MA_81-E7_CCx_I2C0x_scFc_(O8Y)_translation Fv#1 | VH4\|4-59/D3\|3-3\|RF3/JH4 | SS---RYYWG | 3214 |
| VH2\|2-05/D2\|2-15\|RF1/JH5 | | TS---GVGVG | 3215 |
| MA_81-F9_CCx_I2C0x_scFc_(I6I)_translation Fv#1 | VH2\|2-05/D2\|2-15\|RF1/JH5 | TH---KMGVD | 3216 |
| VH4\|4-30.1/D3\|3-10\|RF3/JH6 | | SG---GYYWS | 3217 |
| MA_81-H7_CC_xI2C0x_scFc_(M5O)_translation Fv#1 | VH4\|4-30.1/D3\|3-10\|RF3/JH6 | SN---PYYWS | 3218 |
| VH3\|3-23/D6\|6-19\|RF2/JH4 | | S-----YAMS | 3219 |
| MA_82-B5_CCx_I2C0x_scFc_(B3K)_translation Fv#1 | VH3\|3-23/D6\|6-19\|RF2/JH4 | S-----HAMS | 3220 |
| VH3\|3-23/D6\|6-19\|RF1/JH6 | | S-----YAMS | 3221 |
| MA_89-B2_CCx_I2C0x_scFc_(N1M)_translation Fv#1 | VH3\|3-23/D6\|6-19\|RF1/JH6 | S-----YAMS | 3222 |
| VH3\|3-30.3/D1\|1-1\|RF2/JH4 | | S-----YAMH | 3223 |
| MA_89-D12_CCx_I2C0x_scFc_(Y4C)_translation Fv#1 | VH3\|3-30.3/D1\|1-1\|RF2/JH4 | T-----YGMH | 3224 |
| VH3\|3-11/D1\|1-1\|RF3/JH4 | | D-----YYMS | 3225 |
| MA_93-B11_CCx_I2C0x_scFc_(N7N)_translation Fv#1 | VH3\|3-11/D1\|1-1\|RF3/JH4 | D-----YYMS | 3226 |

TABLE 36-continued

BiTE-scFc_Variable Region Protein Alignment (MAGEB2)
CDRs defined by Kabat
Alignment numbering defined by Amgen Reference (AHo)

KAPPA_VARIABLE

| | Germline | | SEQ ID NO: |
|---|---|---|---|
| | | K_FR2 | |
| VK1\|A20/JK2 | | WYQQKPGKVPKLLIY | 3227 |
| MA_79-G12_CC_x_I2C0x_scFc_(K1F) translation Fv#1 | VK1\|A20/JK2 | WYQQKPGKVPKLLIS | 3228 |
| VK1\|O12/JK1 | | WYQQKPGKAPKLLIY | 3229 |
| MA_79-H7_CCx_I2C0x_scFc_(Q4C)_ translation Fv#1 | VK1\|O12/JK1 | WFQQKPGKAPKLLIF | 3230 |
| MA_81-F9_CCx_I2C0x_scFc_(I6I)_ translation Fv#1 | VK1\|O12/JK1 | WYQQKPGKAPKLLIY | 3231 |
| VK4\|B3/JK4 | | WYQQKPGQPPKLLIY | 3232 |
| MA_81-E7_CCx_I2C0x_scFc_(O8Y)_ translation Fv#1 | VK4\|B3/JK4 | WYQQKPGQPPKLLIY | 3233 |
| VK2\|O1/JK1 | | WYLQKPGQSPOLLIY | 3234 |
| MA_81-H7_CC_xI2C0x_scFc_(M5O)_ translation Fv#1 | VK2\|O1/JK1 | WYLQKPGQSPOLLIY | 3235 |
| VK1\|O12/JK4 | | WYQQKPGKAPKLLIY | 3236 |
| MA_89-B2_CCx_I2C0x_scFc_(N1M)_ translation Fv#1 | VK1\|O12/JK4 | WYQQKPGKAPKLLIY | 3237 |
| VK1\|A20/JK1 | | WYQQKPGKVPKLLIY | 3238 |
| MA_89-D12_CCx_I2C0x_scFc_(Y4C)_ translation Fv#1 | VK1\|O12/JK4 | WYQQKPGKVPKLLIY | 3239 |
| | | K_CDR2 | |
| VK1\|A20/JK2 | | A--------ASTLQS | 3281 |
| MA_79-G12_CC_x_I2C0x_scFc_(K1F) translation Fv#1 | VK1\|A20/JK2 | A--------ASTLQS | 3282 |
| VK1\|O12/JK1 | | A--------ASSLQS | 3283 |
| MA_79-H7_CCx_I2C0x_scFc_(Q4C)_ translation Fv#1 | VK1\|O12/JK1 | A--------ASSLQS | 3284 |
| MA_81-+0SLQS F9_CCx_I2C0x_scFc_(I6I)_ translation Fv#1 | VK1\|O12/JK1 | A--------AS | 3285 |
| VK4\|B3/JK4 | | W--------ASTRES | 3286 |
| MA_81-E7_CCx_I2C0x_scFc_(O8Y)_ translation Fv#1 | VK4\|B3/JK4 | W--------ASTRES | 3287 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| VK2\|O1/JK1 | | T--------LSYRAS | 3288 |
| MA_81-H7_CC_xI2C0x_scFc_(M5O)_translation Fv#1 | VK2\|O1/JK1 | L--------GSNRAS | 3289 |
| VK1\|O12/JK4 | | A--------ASSLQS | 3290 |
| MA_89-B2_CCx_I2C0x_scFc_(N1M)_translation Fv#1 | VK1\|O12/JK4 | A--------ASSLQS | 3291 |
| VK1\|A20/JK1 | | A--------ASTLQS | 3292 |
| MA_89-D12_CCx_I2C0x_scFc_(Y4C)_translation Fv#1 | VK1\|O12/JK4 | A--------ASTLQS | 3293 |
| | | K FR3 | |
| VK1\|A20/JK2 | | GVPSRFSGSGSG--TDFTLTISSLOPEDVATYYC | 3335 |
| MA_79-G12_CC_x_I2C0x_scFc_(K1F)_translation Fv#1 | VK1\|A20/JK2 | GVPSRFSGSGSG--TDFTLTISSLQPEDVATYYC | 3336 |
| VK1\|O12/JK1 | | GVPSRFSGSGSG--TDFTLTISSLQPEDFATYYC | 3337 |
| MA_79-H7_CCx_I2C0x_scFc_(Q4C)_translation Fv#1 | VK1\|O12/JK1 | GVPSRFSGSGSG--TDFTLTISSLOPEDEATYYC | 3338 |
| MA_81-F9_CCx_I2C0x_scFc_(I6I)_translation Fv#1 | VK1\|O12/JK1 | GVPSRFSGSGSG--TDFTLTISSLOPEDEATYYC | 3339 |
| VK4\|B3/JK4 | | GVPDRESGSGSG--TDFTLTISSLQAEDVAVYYC | 3340 |
| MA_81-E7_CCx_I2C0x_scFc_(O8Y)_translation Fv#1 | VK4\|B3/JK4 | GVPDRESGSGSG--TDFTLTISSLQAEDVAVYYC | 3341 |
| VK2\|O1/JK1 | | GVPDRESGSGSG--TDFTLKISRVEAEDVGVYYC | 3342 |
| MA_81-H7_CC_xI2C0x_scFc_(M5O)_translation Fv#1 | VK2\|O1/JK1 | GVPDRFSGSGSG--TDFTLKISRVEAGDVGVYYC | 3343 |
| VK1\|O12/JK4 | | GVPSRFSGSGSG--TDFTLTISSLQPEDEATYYC | 3344 |
| MA_89-B2_CCx_I2C0x_scFc_(N1M)_translation Fv#1 | VK1\|O12/JK4 | GVPSRFSGSGSG--TDFTLTISSLOPEDEATYYC | 3345 |
| VK1\|A20/JK1 | | GVPSRFSGSGSG--TDFTLTISSLOPEDVATYYC | 3346 |
| MA_89-D12_CCx_I2C0x_scFc_(Y4C)_translation Fv#1 | VK1\|O12/JK4 | GVPSRFSGSGSG--TDFTLTISSLOPEDVATYYC | 3347 |

TABLE 36-continued

BiTE-scFc_Variable Region Protein Alignment (MAGEB2)
CDRs defined by Kabat
Alignment numbering defined by Amgen Reference (AHo)

LAMBDA_VARIABLE

| | Germline | | SEQ ID NO: |
|---|---|---|---|
| | | L_FR2 | |
| VL7\|7a/JL3b | | WFQQKPGQAPRALIY | 3240 |
| MA_79-G12_CC_x_I2C0x_scFc_(K1F)_translation Fv#2 | VL7\|7a/JL3b | WVQQKPGQAPRGLIG | 3241 |
| MA_79-H7_CCx_I2C0x_scFc_(Q4C)_translation Fv#2 | VL7\|7a/JL3b | WVQQKPGQAPRGLIG | 3242 |
| MA_81-E7_CCx_I2C0x_scFc_(O8Y)_translation Fv#2 | VL7\|7a/JL3b | WVQQKPGQAPRGLIG | 3243 |
| MA_81-F9_CCx_I2C0x_scFc_(I6I)_translation Fv#2 | VL7\|7a/JL3b | WVQQKPGQAPRGLIG | 3244 |
| MA_81-H7_CC_xI2C0x_scFc_(M5O)_translation Fv#2 | VL7\|7a/JL3b | WVQQKPGQAPRGLIG | 3245 |
| MA_82-B5_CCx_I2C0x_scFc_(B3K)_translation Fv#2 | VL7\|7a/JL3b | WVQQKPGQAPRGLIG | 3246 |
| MA_89-B2_CCx_I2C0x_scFc_(N1M)_translation Fv#2 | VL7\|7a/JL3b | WVQQKPGQAPRGLIG | 3247 |
| MA_89-D12_CCx_I2C0x_scFc_(Y4C)_translation Fv#2 | VL7\|7a/JL3b | WVQQKPGQAPRGLIG | 3248 |
| MA_93-B11_CCx_I2C0x_scFc_(N7N)_translation Fv#2 | VL7\|7a/JL3b | WVQQKPGQAPRGLIG | 3249 |
| VL3\|3h/JL2 | | WYQQKPGQAPVLVIY | 3250 |
| MA_82-B5_CCx_I2C0x_scFc_(B3K)_translation Fv#1 | VL3\|3h/JL2 | WYQQKPGQAPVLVVY | 3251 |
| MA_93-B11_CCx_I2C0x_scFc_(N7N)_translation Fv#1 | VL3\|3h/JL2 | WYQQKPGQAPVLVVY | 3252 |
| | | L_CDR2 | |
| VL7\|7a/JL3b | | S--------TSNKHS | 3294 |
| MA_79-G12_CC_x_I2C0x_scFc_(K1F)_translation Fv#2 | VL7\|7a/JL3b | G--------TKFLAP | 3295 |
| MA_79-H7_CCx_I2C0x_scFc_(Q4C)_translation Fv#2 | VL7\|7a/JL3b | G--------TKFLAP | 3296 |
| MA_81-E7_CCx_I2C0x_scFc_(O8Y)_translation Fv#2 | VL7\|7a/JL3b | G--------TKFLAP | 3297 |
| MA_81-F9_CCx_I2C0x_scFc_(I6I)_translation Fv#2 | VL7\|7a/JL3b | G--------TKFLAP | 3298 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| MA_81-H7_CC_xI2C0x_scFc_(M5O)_translation Fv#2 | VL7\|7a/JL3b | G--------TKFLAP | 3299 |
| MA_82-B5_CCx_I2C0x_scFc_(B3K)_translation Fv#2 | VL7\|7a/JL3b | G--------TKFLAP | 3300 |
| MA_89-B2_CCx_I2C0x_scFc_(N1M)_translation Fv#2 | VL7\|7a/JL3b | G--------TKFLAP | 3301 |
| MA_89-D12_CCx_I2C0x_scFc_(Y4C)_translation Fv#2 | VL7\|7a/JL3b | G--------TKFLAP | 3302 |
| MA_93-B11_CCx_I2C0x_scFc_(N7N)_translation Fv#2 | VL7\|7a/JL3b | G--------TKFLAP | 3303 |
| VL3\|3h/JL2 | | Y--------DSDRPS | 3304 |
| MA_82-B5_CCx_I2C0x_scFc_(B3K)_translation Fv#1 | VL3\|3h/JL2 | D--------DNDRPS | 3305 |
| MA_93-B11_CCx_I2C0x_scFc_(N7N)_translation Fv#1 | VL3\|3h/JL2 | D--------DSDRPS | 3306 |
| | | L FR3 | |
| VL7\|7a/JL3b | | WTPARFSGSLLG--GKAALTLSGVQPEDEAEYYC | 3348 |
| MA_79-G12_CC_x_I2C0x_scFc_(K1F)_translation Fv#2 | VL7\|7a/JL3b | GTPARFSGSLLG--GKAALTLSGVQPEDEAEYYC | 3349 |
| MA_79-H7_CCx_I2C0x_scFc_(Q4C)_translation Fv#2 | VL7\|7a/JL3b | GTPARFSGSLLG--GKAALTLSGVQPEDEAEYYC | 3350 |
| MA_81-E7_CCx_I2C0x_scFc_(O8Y)_translation Fv#2 | VL7\|7a/JL3b | GTPARFSGSLLG--GKAALTLSGVQPEDEAEYYC | 3351 |
| MA_81-F9_CCx_I2C0x_scFc_(I6I)_translation Fv#2 | VL7\|7a/JL3b | GTPARFSGSLLG--GKAALTLSGVQPEDEAEYYC | 3352 |
| MA_81-H7_CC_xI2C0x_scFc_(M5O)_translation Fv#2 | VL7\|7a/JL3b | GTPARFSGSLLG--GKAALTLSGVQPEDEAEYYC | 3353 |
| MA_82-B5_CCx_I2C0x_scFc_(B3K)_translation Fv#2 | VL7\|7a/JL3b | GTPARFSGSLLG--GKAALTLSGVQPEDEAEYYC | 3354 |
| MA_89-B2_CCx_I2C0x_scFc_(N1M)_translation Fv#2 | VL7\|7a/JL3b | GTPARFSGSLLG--GKAALTLSGVQPEDEAEYYC | 3355 |
| MA_89-D12_CCx_I2C0x_scFc_(Y4C)_translation Fv#2 | VL7\|7a/JL3b | GTPARFSGSLLG--GKAALTLSGVQPEDEAEYYC | 3356 |
| MA_93-B11_CCx_I2C0x_scFc_(N7N)_translation Fv#2 | VL7\|7a/JL3b | GTPARFSGSLLG--GKAALTLSGVQPEDEAEYYC | 3357 |
| VL3\|3h/JL2 | | GIPERFSGSNSG--NTATLTISRVEAGDEADYYC | 3358 |

TABLE 36-continued

BiTE-scFc_Variable Region Protein Alignment (MAGEB2)
CDRs defined by Kabat
Alignment numbering defined by Amgen Reference (AHo)

| | | | SEQ ID NO: |
|---|---|---|---|
| MA_82-B5_CCx_I2C0x_scFc_(B3K)_translation Fv#1 | VL3\|3h/JL2 | GIPERFSGSNFG--NTATLIISRVEAGDEADYYC | 3359 |
| MA_93-B11_CCx_I2C0x_scFc_(N7N)_translation Fv#1 | VL3\|3h/JL2 | GIPERFSGSNSG--NTATLTISRVEAGDEADYYC | 3360 |

HEAVY VARIABLE

| | Germline | | SEQ ID NO: |
|---|---|---|---|
| | | H FR2 | |
| VH1\|1-18/D6\|6-13\|RF2/JH4 | | WVRQAPGQGLEWMG | 3253 |
| MA_79-G12_CC_x_I2C0x_scFc_(K1F)_translation Fv#1 | VH1\|1-18/D6\|6-13\|RF2/JH4 | WVRQAPGQCLEWMG | 3254 |
| VH3\|3-73/D3\|3-3\|RF3/JH4 | | WVRQASGKGLEWVG | 3255 |
| MA_79-G12_CC_x_I2C0x_scFc_(K1F)_translation Fv#2 | VH3\|3-73/D3\|3-3\|RF3/JH4 | WVRQAPGKGLEWVA | 3256 |
| MA_79-H7_CCx_I2C0x_scFc_(Q4C)_translation Fv#2 | VH3\|3-73/D3\|3-3\|RF3/JH4 | WVRQAPGKGLEWVA | 3257 |
| MA_81-E7_CCx_I2C0x_scFc_(O8Y)_translation Fv#2 | VH3\|3-73/D3\|3-3\|RF3/JH4 | WVRQAPGKGLEWVA | 3258 |
| MA_81-F9_CCx_I2C0x_scFc_(I6I)_translation Fv#2 | VH3\|3-73/D3\|3-3\|RF3/JH4 | WVRQAPGKGLEWVA | 3259 |
| MA_81-H7_CC_xI2C0x_scFc_(M5O)_translation Fv#2 | VH3\|3-73/D3\|3-3\|RF3/JH4 | WVRQAPGKGLEWVA | 3260 |
| MA_82-B5_CCx_I2C0x_scFc_(B3K)_translation Fv#2 | VH3\|3-73/D3\|3-3\|RF3/JH4 | WVRQAPGKGLEWVA | 3261 |
| MA_89-B2_CCx_I2C0x_scFc_(N1M)_translation Fv#2 | VH3\|3-73/D3\|3-3\|RF3/JH4 | WVRQAPGKGLEWVA | 3262 |
| MA_89-D12_CCx_I2C0x_scFc_(Y4C)_translation Fv#2 | VH3\|3-73/D3\|3-3\|RF3/JH4 | WVRQAPGKGLEWVA | 3263 |
| MA_93-B11_CCx_I2C0x_scFc_(N7N)_translation Fv#2 | VH3\|3-73/D3\|3-3\|RF3/JH4 | WVRQAP+0GKGLEWVA | 3264 |
| VH3\|3-15/D3\|3-10\|RF2/JH6 | | WVRQAPGKGLEWVG | 3265 |
| MA_79-H7_CCx_I2C0x_scFc_(Q4C)_translation Fv#1 | VH3\|3-15/D3\|3-10\|RF2/JH6 | WVRQAPGKCLEWVG | 3266 |
| VH4\|4-59/D3\|3-3\|RF3/JH4 | | WIRQPPGKGLEWIG | 3267 |
| MA_81-E7_CCx_I2C0x_scFc_(O8Y)_translation Fv#1 | VH4\|4-59/D3\|3-3\|RF3/JH4 | WIRQPPGKCLEWIG | 3268 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| VH2\|2-05/D2\|2-15\|RF1/JH5 | | WIRQPPGKALEWLA | 3269 |
| MA_81-F9_CCx_I2C0x_scFc_(I6I)_translation Fv#1 | VH2\|2-05/D2\|2-15\|RF1/JH5 | WIRQPPGKCLEWLA | 3270 |
| VH4\|4-30.1/D3\|3-10\|RF3/JH6 | | WIRQHPGKGLEWIG | 3271 |
| MA_81-H7_CC_xI2C0x_scFc_(M5O)_translation Fv#1 | VH4\|4-30.1/D3\|3-10\|RF3/JH6 | WIRQHPGKCLEWIG | 3272 |
| VH3\|3-23/D6\|6-19\|RF2/JH4 | | WVRQAPGKGLEWVS | 3273 |
| MA_82-B5_CCx_I2C0x_scFc_(B3K)_translation Fv#1 | VH3\|3-23/D6\|6-19\|RF2/JH4 | WVRQAPGKCLEWVS | 3274 |
| VH3\|3-23/D6\|6-19\|RF1/JH6 | | WVRQAPGKGLEWVS | 3275 |
| MA_89-B2_CCx_I2C0x_scFc_(N1M)_translation Fv#1 | VH3\|3-23/D6\|6-19\|RF1/JH6 | WVRQAPGRCLEWVS | 3276 |
| VH3\|3-30.3/D1\|1-1\|RF2/JH4 | | WVRQAPGKGLEWVA | 3277 |
| MA_89-D12_CCx_I2C0x_scFc_(Y4C)_translation Fv#1 | VH3\|3-30.3/D1\|1-1\|RF2/JH4 | WVRQAPGKCLEWVA | 3278 |
| VH3\|3-11/D1\|1-1\|RF3/JH4 | | WIRQAPGKGLEWVS | 3279 |
| MA_93-B11_CCx_I2C0x_scFc_(N7N)_translation Fv#1 | VH3\|3-11/D1\|1-1\|RF3/JH4 | WIRQAPGKCLEWVS | 3280 |
| | | H_CDR2 | |
| VH1\|1-18/D6\|6-13\|RF2/JH4 | | WISAY---NGNTNYAQKLQG | 3307 |
| MA_79-G12_CC_x_I2C0x_scFc_(K1F)_translation Fv#1 | VH1\|1-18/D6\|6-13\|RF2/JH4 | WISGY---NGDTNYAQKLQG | 3308 |
| VH3\|3-73/D3\|3-3\|RF3/JH4 | | RIRSKA-NSYATAYAASVKG | 3309 |
| MA_79-G12_CC_x_I2C0x_scFc_(K1F)_translation Fv#2 | VH3\|3-73/D3\|3-3\|RF3/JH4 | RIRSKY-NNYATYYADSVKD | 3310 |
| MA_79-H7_CCx_I2C0x_scFc_(Q4C)_translation Fv#2 | VH3\|3-73/D3\|3-3\|RF3/JH4 | RIRSKY-NNYATYYADSVKD | 3311 |
| MA_81-E7_CCx_I2C0x_scFc_(O8Y)_translation Fv#2 | VH3\|3-73/D3\|3-3\|RF3/JH4 | RIRSKY-NNYATYYADSVKD | 3312 |
| MA_81-F9_CCx_I2C0x_scFc_(I6I)_translation Fv#2 | VH3\|3-73/D3\|3-3\|RF3/JH4 | RIRSKY-NNYATYYADSVKD | 3313 |
| MA_81-H7_CC_xI2C0x_scFc_(M5O)_translation Fv#2 | VH3\|3-73/D3\|3-3\|RF3/JH4 | RIRSKY-NNYATYYADSVKD | 3314 |
| MA_82-B5_CCx_I2C0x_scFc_(B3K)_translation Fv#2 | VH3\|3-73/D3\|3-3\|RF3/JH4 | RIRSKY-NNYATYYADSVKD | 3315 |
| MA_89-B2_CCx_I2C0x_scFc_(N1M)_translation Fv#2 | VH3\|3-73/D3\|3-3\|RF3/JH4 | RIRSKY-NNYATYYADSVKD | 3316 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| MA_89-D12_CCx_I2C0x_scFc_(Y4C)_ translation Fv#2 | VH3\|3-73/D3\|3-3\|RF3/JH4 | RIRSKY-NNYATYYADSVKD | 3317 |
| MA_93-B11_CCx_I2C0x_scFc_(N7N)_ translation Fv#2 | VH3\|3-73/D3\|3-3\|RF3/JH4 | RIRSKY-NNYATYYADSVKD | 3318 |
| VH3\|3-15/D3\|3-10\|RF2/JH6 | | RIKSKT-DGGTTDYAAPVKG | 3319 |
| MA_79-H7_CCx_I2C0x_scFc_(Q4C)_ translation Fv#1 | VH3\|3-15/D3\|3-10\|RF2/JH6 | RIKSKT-YGGTTDYAAPVKG | 3320 |
| VH4\|4-59/D3\|3-3\|RF3/JH4 | | YIYY----SGSTNYNPSLKS | 3321 |
| MA_81-E7_CCx_I2C0x_scFc_(O8Y)_ translation Fv#1 | VH4\|4-59/D3\|3-3\|RF3/JH4 | SIYY----SGSTYYNPSLKS | 3322 |
| VH2\|2-05/D2\|2-15\|RF1/JH5 | | LIYW----NDDKRYSPSLKS | 3323 |
| MA_81-F9_CCx_I2C0x_scFc_(I6I)_ translation Fv#1 | VH2\|2-05/D2\|2-15\|RF1/JH5 | LIYW----NDDKRYSPSLQS | 3324 |
| VH4\|4-30.1/D3\|3-10\|RF3/JH6 | | YIYY----SGSTYYNPSLKS | 3325 |
| MA_81-H7_CC_xI2C0x_scFc_(M5O)_ translation Fv#1 | VH4\|4-30.1/D3\|3-10\|RF3/JH6 | YISY----SGITNYNPSLKS | 3326 |
| VH3\|3-23/D6\|6-19\|RF2/JH4 | | AISGS---GGSTYYADSVKG | 3327 |
| MA_82-B5_CCx_I2C0x_scFc_(B3K)_ translation Fv#1 | VH3\|3-23/D6\|6-19\|RF2/JH4 | AISGS---GGGTYYADSVKG | 3328 |
| VH3\|3-23/D6\|6-19\|RF1/JH6 | | AISGS---GGSTYYADSVKG | 3329 |
| MA_89-B2_CCx_I2C0x_scFc_(N1M)_ translation Fv#1 | VH3\|3-23/D6\|6-19\|RF1/JH6 | TISIS---GGSTNYADSVKG | 3330 |
| VH3\|3-30.3/D1\|1-1\|RF2/JH4 | | VISYD---GSNKYYADSVKG | 3331 |
| MA_89-D12_CCx_I2C0x_scFc_(Y4C)_ translation Fv#1 | VH3\|3-30.3/D1\|1-1\|RF2/JH4 | VISYD---GSNKYYADSVKG | 3332 |
| VH3\|3-11/D1\|1-1\|RF3/JH4 | | YISSS---GSTIYYADSVKG | 3333 |
| MA_93-B11_CCx_I2C0x_scFc_(N7N)_ translation Fv#1 | VH3\|3-11/D1\|1-1\|RF3/JH4 | YISKS---GSTIYYADSVKG | 3334 |
| | | H FR3 | |
| VH1\|1-18/D6\|6-13\|RF2/JH4 | | RVTMTTDTSTSTA YMELRSLRSDDTA VYYCAR | 3361 |
| MA_79-G12_CC_x_I2C0x_scFc_(K1F)_ translation Fv#1 | VH1\|1-18/D6\|6-13\|RF2/JH4 | RGTMTTDTSTSTA YMELRSLRSDDTA VYYCAR | 3362 |
| VH3\|3-73/D3\|3-3\|RF3/JH4 | | RFTISRDDSKNTA YLQMNSLKTEDTA VYYCTR | 3363 |
| MA_79-G12_CC_x_I2C0x_scFc_(K1F)_ translation Fv#2 | VH3\|3-73/D3\|3-3\|RF3/JH4 | RFTISRDDSKNTA YLQMNNLKTEDTA VYYCVR | 3364 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| MA_79-H7_CCx_I2C0x_scFc_(Q4C)_translation Fv#2 | VH3\|3-73/D3\|3-3\|RF3/JH4 | RFTISRDDSKNTA YLQMNNLKTEDTA VYYCVR | 3365 |
| MA_81-E7_CCx_I2C0x_scFc_(O8Y)_translation Fv#2 | VH3\|3-73/D3\|3-3\|RF3/JH4 | YLQMNNLKTEDTA VYYCVR | 3366 |
| MA_81-F9_CCx_I2C0x_scFc_(I6I)_translation Fv#2 | VH3\|3-73/D3\|3-3\|RF3/JH4 | RFTISRDDSKNTA YLQMNNLKTEDTA VYYCVR | 3367 |
| MA_81-H7_CC_xI2C0x_scFc_(M5O)_translation Fv#2 | VH3\|3-73/D3\|3-3\|RF3/JH4 | RFTISRDDSKNTA YLQMNNLKTEDTA VYYCVR | 3368 |
| MA_82-B5_CCx_I2C0x_scFc_(B3K)_translation Fv#2 | VH3\|3-73/D3\|3-3\|RF3/JH4 | RFTISRDDSKNTA YLQMNNLKTEDTA VYYCVR | 3369 |
| MA_89-B2_CCx_I2C0x_scFc_(N1M)_translation Fv#2 | VH3\|3-73/D3\|3-3\|RF3/JH4 | RFTISRDDSKNTA YLQMNNLKTEDTA VYYCVR | 3370 |
| MA_89-D12_CCx_I2C0x_scFc_(Y4C)_translation Fv#2 | VH3\|3-73/D3\|3-3\|RF3/JH4 | RFTISRDDSKNTA YLQMNNLKTEDTA VYYCVR | 3371 |
| MA_93-B11_CCx_I2C0x_scFc_(N7N)_translation Fv#2 | VH3\|3-73/D3\|3-3\|RF3/JH4 | RFTISRDDSKNTA YLQMNNLKTEDTA VYYCVR | 3372 |
| VH3\|3-15/D3\|3-10\|RF2/JH6 | | RFTISRDDSKNTL YLQMNSLKTEDTA VYYCTT | 3373 |
| MA_79-H7_CCx_I2C0x_scFc_(Q4C)_translation Fv#1 | VH3\|3-15/D3\|3-10\|RF2/JH6 | RFTISRDDSKNTL YLQMNSLKTEDTA VYYCTT | 3374 |
| VH4\|4-59/D3\|3-3\|RF3/JH4 | | RVTISVDTSKNQF SLKLSSVTAADTA VYYCAR | 3375 |
| MA_81-E7_CCx_I2C0x_scFc_(O8Y)_translation Fv#1 | VH4\|4-59/D3\|3-3\|RF3/JH4 | RVTISVDTS KNQF SLKLSSVTAADTA VYYCAR | 3376 |
| VH2\|2-05/D2\|2-15\|RF1/JH5 | | RLTITKDTSKNQV VLTMTNMDPVDTA TYYCAH | 3377 |
| MA_81-F9_CCx_I2C0x_scFc_(I6I)_translation Fv#1 | VH2\|2-05/D2\|2-15\|RF1/JH5 | RLTITKDTSKNQV VLTMTNMDPVDTA TYYCAY | 3378 |
| VH4\|4-30.1/D3\|3-10\|RF3/JH6 | | RVTISVDTSKNQF SLKLSSVTAADTA VYYCAR | 3379 |
| MA_81-H7_CC_xI2C0x_scFc_(M5O)_translation Fv#1 | VH4\|4-30.1/D3\|3-10\|RF3/JH6 | RVTMSVDTSKNQF SLKLTSLTAADTA VYYCAR | 3380 |
| VH3\|3-23/D6\|6-19\|RF2/JH4 | | RFTISRDNSKNTL YLQMNSLRAEDTA VYYCAK | 3381 |
| MA_82-B5_CCx_I2C0x_scFc_(B3K)_translation Fv#1 | VH3\|3-23/D6\|6-19\|RF2/JH4 | RFTISRDNSKNTL YLQMNSLRAEDTA VYYCAT | 3382 |
| VH3\|3-23/D6\|6-19\|RF1/JH6 | | RFTISRDNSKNTL YLQMNSLRAEDTA VYYCAK | 3383 |

TABLE 36-continued

BiTE-scFc_Variable Region Protein Alignment (MAGEB2)
CDRs defined by Kabat
Alignment numbering defined by Amgen Reference (AHo)

| Name | Germline | Sequence | SEQ ID NO |
|---|---|---|---|
| MA_89-B2_CCx_I2C0x_scFc_(N1M)_translation Fv#1 | VH3\|3-23/D6\|6-19\|RF1/JH6 | RFTISRDNSKNTL YLQMNSLRAEDTA VYYCAK | 3384 |
| | VH3\|3-30.3/D1\|1-1\|RF2/JH4 | RFTISRDNSKNTL YLQMNSLRAEDTA VYYCAR | 3385 |
| MA_89-D12_CCx_I2C0x_scFc_(Y4C)_translation Fv#1 | VH3\|3-30.3/D1\|1-1\|RF2/JH4 | RFTISRDDSKNTL YLQMNSLRAEDTA VYYCAR | 3386 |
| | VH3\|3-11/D1\|1-1\|RF3/JH4 | RFTISRDNAKNSL YLQMNSLRAEDTA VYYCAR | 3387 |
| MA_93-B11_CCx_I2C0x_scFc_(N7N)_translation Fv#1 | VH3\|3-11/D1\|1-1\|RF3/JH4 | RFTISRDNAKNSL YLQMNSLRAEDTA VYYCAT | 3388 |

KAPPA_VARIABLE

| Name | Germline | | SEQ ID NO |
|---|---|---|---|
| | | K_CDR3 | |
| VK1\|A20/JK2 | | QKYNS----------------------APYT | 3389 |
| MA_79-G12_CC_x_I2C0x_scFc_(K1F)_translation Fv#1 | VK1\|A20/JK2 | QKYNS----------------------APFT | 3390 |
| VK1\|O12/JK1 | | QQSYS----------------------TPWT | 3391 |
| MA_79-H7_CCx_I2C0x_scFc_(Q4C)_translation Fv#1 | VK1\|O12/JK1 | QQSYS----------------------SPFT | 3392 |
| MA_81-F9_CCx_I2C0x_scFc_(I6I)_translation Fv#1 | VK1\|O12/JK1 | QQSYS----------------------TPFT | 3393 |
| VK4\|B3/JK4 | | QQYYS----------------------TPLT | 3394 |
| MA_81-E7_CCx_I2C0x_scFc_(O8Y)_translation Fv#1 | VK4\|B3/JK4 | QQYYS----------------------TPLT | 3395 |
| VK2\|O1/JK1 | | MQRIE----------------------FPWT | 3396 |
| MA_81-H7_CC_xI2C0x_scFc_(M5O)_translation Fv#1 | VK2\|O1/JK1 | MQALQ----------------------TPWT | 3397 |
| VK1\|O12/JK4 | | QQSYS----------------------TPLT | 3398 |
| MA_89-B2_CCx_I2C0x_scFc_(N1M)_translation Fv#1 | VK1\|O12/JK4 | QQSYS----------------------IPLT | 3399 |
| VK1\|A20/JK1 | | QKYNS----------------------APWT | 3400 |
| MA_89-D12_CCx_I2C0x_scFc_(Y4C)_translation Fv#1 | VK1\|A20/JK1 | QKYNS----------------------APFT | 3401 |
| | | K_FR4 | |
| VK1\|A20/JK2 | | FGQGTKLEIK | 3443 |
| MA_79-G12_CC_x_I2C0x_scFc_(K1F)_translation Fv#1 | VK1\|A20/JK2 | FGCGTKLEIK | 3444 |

TABLE 36-continued

BiTE-scFc_Variable Region Protein Alignment (MAGEB2)
CDRs defined by Kabat
Alignment numbering defined by Amgen Reference (AHo)

| | Germline | | SEQ ID NO: |
|---|---|---|---|
| VK1\|O12/JK1 | | FGQGTKVEIK | 3445 |
| MA_79-H7_CCx_I2C0x_scFc_(Q4C)_translation Fv#1 | VK1\|O12/JK1 | FGCGTKVEIK | 3446 |
| MA_81-F9_CCx_I2C0x_scFc_(I6I)_translation Fv#1 | VK1\|O12/JK1 | FGCGTKVEIK | 3447 |
| VK4\|B3/JK4 | | FGGGTKVEIK | 3448 |
| MA_81-E7_CCx_I2C0x_scFc_(O8Y)_translation Fv#1 | VK4\|B3/JK4 | FGCGTKVEIK | 3449 |
| VK2\|O1/JK1 | | FGQGTKVEIK | 3450 |
| MA_81-H7_CC_xI2C0x_scFc_(M5O)_translation Fv#1 | VK2\|O1/JK1 | FGCGTKVEIK | 3451 |
| VK1\|O12/JK4 | | FGGGTKVEIK | 3452 |
| MA_89-B2_CCx_I2C0x_scFc_(N1M)_translation Fv#1 | VK1\|O12/JK4 | FGCGTKVEIK | 3453 |
| VK1\|A20/JK1 | | FGQGTKVEIK | 3454 |
| MA_89-D12_CCx_I2C0x_scFc_(Y4C)_translation Fv#1 | VK1\|A20/JK1 | FGCGTKVEIK | 3455 |

LAMBDA_VARIABLE

| | Germline | | SEQ ID NO: |
|---|---|---|---|
| | | L_CDR3 | |
| VL7\|7a/JL3b | | LLYYG---------------------GAQWV | 3402 |
| MA_79-G12_CC_x_I2C0x_scFc_(K1F)_translation Fv#2 | VL7\|7a/JL3b | VLWYS---------------------NRWV | 3403 |
| MA_79-H7_CCx_I2C0x_scFc_(Q4C)_translation Fv#2 | VL7\|7a/JL3b | VLWYS---------------------NRWV | 3404 |
| MA_81-E7_CCx_I2C0x_scFc_(O8Y)_translation Fv#2 | VL7\|7a/JL3b | VLWYS---------------------NRWV | 3405 |
| MA_81-F9_CCx_I2C0x_scFc_(I6I)_translation Fv#2 | VL7\|7a/JL3b | VLWYS---------------------NRWV | 3406 |
| MA_81-H7_CC_xI2C0x_scFc_(M5O)_translation Fv#2 | VL7\|7a/JL3b | VLWYS---------------------NRWV | 3407 |
| MA_82-B5_CCx_I2C0x_scFc_(B3K)_translation Fv#2 | VL7\|7a/JL3b | VLWYS---------------------NRWV | 3408 |
| MA_89-B2_CCx_I2C0x_scFc_(N1M)_translation Fv#2 | VL7\|7a/JL3b | VLWYS---------------------NRWV | 3409 |
| MA_89-D12_CCx_I2C0x_scFc_(Y4C)_translation Fv#2 | VL7\|7a/JL3b | VLWYS---------------------NRWV | 3410 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| MA_93-B11_CCx_I2C0x_scFc_(N7N)_translation Fv#2 | VL7\|7a/JL3b | VLWYS--------------------NRWV | 3411 |
| VL3\|3h/JL2 | | QVWDSS-------------------SDHVV | 3412 |
| MA_82-B5_CCx_I2C0x_scFc_(B3K)_translation Fv#1 | VL3\|3h/JL2 | QVWDSS-------------------SDHVV | 3413 |
| MA_93-B11_CCx_I2C0x_scFc_(N7N)_translation Fv#1 | VL3\|3h/JL2 | QVWDSS-------------------SDHHVV | 3414 |
| | | L_FR4 | |
| VL7\|7a/JL3b | | FGGGTKLTVL | 3456 |
| MA_79-G12_CC_x_I2C0x_scFc_(K1F)_translation Fv#2 | VL7\|7a/JL3b | FGGGTKLTVL | 3457 |
| MA_79-H7_CCx_I2C0x_scFc_(Q4C)_translation Fv#2 | VL7\|7a/JL3b | FGGGTKLTVL | 3458 |
| MA_81-E7_CCx_I2C0x_scFc_(O8Y)_translation Fv#2 | VL7\|7a/JL3b | FGGGTKLTVL | 3459 |
| MA_81-F9_CCx_I2C0x_scFc_(I6I)_translation Fv#2 | VL7\|7a/JL3b | FGGGTKLTVL | 3460 |
| MA_81-H7_CC_xI2C0x_scFc_(M5O)_translation Fv#2 | VL7\|7a/JL3b | FGGGTKLTVL | 3461 |
| MA_82-B5_CCx_I2C0x_scFc_(B3K)_translation Fv#2 | VL7\|7a/JL3b | FGGGTKLTVL | 3462 |
| MA_89-B2_CCx_I2C0x_scFc_(N1M)_translation Fv#2 | VL7\|7a/JL3b | FGGGTKLTVL | 3463 |
| MA_89-D12_CCx_I2C0x_scFc_(Y4C)_translation Fv#2 | VL7\|7a/JL3b | FGGGTKLTVL | 3464 |
| MA_93-B11_CCx_I2C0x_scFc_(N7N)_translation Fv#2 | VL7\|7a/JL3b | FGGGTKLTVL | 3465 |
| VL3\|3h/JL2 | | FGGGTKLTVL | 3466 |
| MA_82-B5_CCx_I2C0x_scFc_(B3K)_translation Fv#1 | VL3\|3h/JL2 | FGCGTKLTVL | 3467 |
| MA_93-B11_CCx_I2C0x_scFc_(N7N)_translation Fv#1 | VL3\|3h/JL2 | FGCGTKLTVS | 3468 |

| HEAVY VARIABLE | | | |
|---|---|---|---|
| | Germline | | SEQ ID NO: |
| | | H_CDR3 | |
| VH1\|1-18/D6\|6-13\|RF2/JH4 | | GIAAA-------------------GYFDY | 3415 |
| MA_79-G12_CC_x_I2C0x_scFc_(K1F)_translation Fv#1 | VH1\|1-18/D6\|6-13\|RF2/JH4 | GRAT---------------------FDY | 3416 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| VH3\|3-73/D3\|3-3\|RF3/JH4 | | ITIFGVV----------------IIYFDY | 3417 |
| MA_79-G12_CC_x_I2C0x_scFc_(K1F)_ translation Fv#2 | VH3\|3-73/D3\|3-3\|RF3/JH4 | HGNFGNS---------------YISYWAY | 3418 |
| MA_79-H7_CCx_I2C0x_scFc_(Q4C)_ translation Fv#2 | VH3\|3-73/D3\|3-3\|RF3/JH4 | HGNFGNS---------------YISYWAY | 3419 |
| MA_81-E7_CCx_I2C0x_scFc_(O8Y)_ translation Fv#2 | VH3\|3-73/D3\|3-3\|RF3/JH4 | HGNFGNS---------------YISYWAY | 3420 |
| MA_81-F9_CCx_I2C0x_scFc_(I6I)_ translation Fv#2 | VH3\|3-73/D3\|3-3\|RF3/JH4 | HGNFGNS---------------YISYWAY | 3421 |
| MA_81-H7_CC_xI2C0x_scFc_(M5O)_ translation Fv#2 | VH3\|3-73/D3\|3-3\|RF3/JH4 | HGNFGNS---------------YISYWAY | 3422 |
| MA_82-B5_CCx_I2C0x_scFc_(B3K)_ translation Fv#2 | VH3\|3-73/D3\|3-3\|RF3/JH4 | HGNFGNS---------------YISYWAY | 3423 |
| MA_89-B2_CCx_I2C0x_scFc_(N1M)_ translation Fv#2 | VH3\|3-73/D3\|3-3\|RF3/JH4 | HGNFGNS---------------YISYWAY | 3424 |
| MA_89-D12_CCx_I2C0x_scFc_(Y4C)_ translation Fv#2 | VH3\|3-73/D3\|3-3\|RF3/JH4 | HGNEGNS---------------YISYWAY | 3425 |
| MA_93-B11_CCx_I2C0x_scFc_(N7N)_ translation Fv#2 | VH3\|3-73/D3\|3-3\|RF3/JH4 | HGNFGNS---------------YISYWAY | 3426 |
| VH3\|3-15/D3\|3-10\|RF2/JH6 | | YYYGSGSYYN----------YYYYYGMDV | 3427 |
| MA_79-H7_CCx_I2C0x_scFc_(Q4C)_ translation Fv#1 | VH3\|3-15/D3\|3-10\|RF2/JH6 | PSYSGSYY-------------NYFSVMDV | 3428 |
| VH4\|4-59/D3\|3-3\|RF3/JH4 | | ITIFGVV----------------IIYFDY | 3429 |
| MA_81-E7_CCx_I2C0x_scFc_(O8Y)_ translation Fv#1 | VH4\|4-59/D3\|3-3\|RF3/JH4 | GIFGVI-------------------TYFDY | 3430 |
| VH2\|2-05/D2\|2-15\|RF1/JH5 | | RIL*WW*L---------------LLNWFDP | 3431 |
| MA_81-F9_CCx_I2C0x_scFc_(I6I)_ translation Fv#1 | VH2\|2-05/D2\|2-15\|RF1/JH5 | RRYNWNY----------------ENWFDP | 3432 |
| VH4\|4-30.1/D3\|3-10\|RF3/JH6 | | ITMVRGVII------------YYYYYGMDV | 3433 |
| MA_81-H7_CC_xI2C0x_scFc_(M5O)_ translation Fv#1 | VH4\|4-30.1/D3\|3-10\|RF3/JH6 | EKMWFGVL-------------NYYYGMDV | 3434 |
| VH3\|3-23/D6\|6-19\|RF2/JH4 | | GIAVA-------------------GYFDY | 3435 |
| MA_82-B5_CCx_I2C0x_scFc_(B3K)_ translation Fv#1 | VH3\|3-23/D6\|6-19\|RF2/JH4 | GKGVH-------------------LGFDY | 3436 |
| VH3\|3-23/D6\|6-19\|RF1/JH6 | | GYSSGWYY--------------YYYYGMDV | 3437 |
| MA_89-B2_CCx_I2C0x_scFc_(N1M)_ translation Fv#1 | VH3\|3-23/D6\|6-19\|RF1/JH6 | DGGSGWFPK------------LLHYGLDV | 3438 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| VH3\|3-30.3/D1\|1-1\|RF2/JH4 | | VQLER--------------------YFDY | 3439 |
| MA_89-D12_CCx_I2C0x_scFc_(Y4C)_ translation Fv#1 | VH3\|3-30.3/D1\|1-1\|RF2/JH4 | GQLL---------------------TGY | 3440 |
| VH3\|3-11/D1\|1-1\|RF3/JH4 | | YNWND--------------------YFDY | 3441 |
| MA_93-B11_CCx_I2C0x_scFc_(N7N)_ translation Fv#1 | VH3\|3-11/D1\|1-1\|RF3/JH4 | YNYG---------------------HFDY | 3442 |
| | | H_FR4 | |
| VH1\|1-18/D6\|6-13\|RF2/JH4 | | WGQGTLVTVSS | 3469 |
| MA_79-G12_CC_x_I2C0x_scFc_(K1F)_ translation Fv#1 | VH1\|1-18/D6\|6-13\|RF2/JH4 | WGQGTLVTVSS | 3470 |
| VH3\|3-73/D3\|3-3\|RF3/JH4 | | WGQGTLVTVSS | 3471 |
| MA_79-G12_CC_x_I2C0x_scFc_(K1F)_ translation Fv#2 | VH3\|3-73/D3\|3-3\|RF3/JH4 | WGQGTLVTVSS | 3472 |
| MA_79-H7_CCx_I2C0x_scFc_(Q4C)_ translation Fv#2 | VH3\|3-73/D3\|3-3\|RF3/JH4 | WGQGTLVTVSS | 3473 |
| MA_81-E7_CCx_I2C0x_scFc_(O8Y)_ translation Fv#2 | VH3\|3-73/D3\|3-3\|RF3/JH4 | WGQGTLVTVSS | 3474 |
| MA_81-F9_CCx_I2C0x_scFc_(I6I)_ translation Fv#2 | VH3\|3-73/D3\|3-3\|RF3/JH4 | WGQGTLVTVSS | 3475 |
| MA_81-H7_CC_xI2C0x_scFc_(M5O)_ translation Fv#2 | VH3\|3-73/D3\|3-3\|RF3/JH4 | WGQGTLVTVSS | 3476 |
| MA_82-B5_CCx_I2C0x_scFc_(B3K)_ translation Fv#2 | VH3\|3-73/D3\|3-3\|RF3/JH4 | WGQGTLVTVSS | 3477 |
| MA_89-B2_CCx_I2C0x_scFc_(N1M)_ translation Fv#2 | VH3\|3-73/D3\|3-3\|RF3/JH4 | WGQGTLVTVSS | 3478 |
| MA_89-D12_CCx_I2C0x_scFc_(Y4C)_ translation Fv#2 | VH3\|3-73/D3\|3-3\|RF3/JH4 | WGQGTLVTVSS | 3479 |
| MA_93-B11_CCx_I2C0x_scFc_(N7N)_ translation Fv#2 | VH3\|3-73/D3\|3-3\|RF3/JH4 | WGQGTLVTVSS | 3480 |
| VH3\|3-15/D3\|3-10\|RF2/JH6 | | WGQGTTVTVSS | 3481 |
| MA_79-H7_CCx_I2C0x_scFc_(Q4C)_ translation Fv#1 | VH3\|3-15/D3\|3-10\|RF2/JH6 | WGQGTTVTVSS | 3482 |
| VH4\|4-59/D3\|3-3\|RF3/JH4 | | WGQGTLVTVSS | 3483 |
| MA_81-E7_CCx_I2C0x_scFc_(O8Y)_ translation Fv#1 | VH4\|4-59/D3\|3-3\|RF3/JH4 | WGQGTLVTVSS | 3484 |
| VH2\|2-05/D2\|2-15\|RF1/JH5 | | WGQGTLVTVSS | 3485 |
| MA_81-F9_CCx_I2C0x_scFc_(I6I)_ translation Fv#1 | VH2\|2-05/D2\|2-15\|RF1/JH5 | WGQGTLVTVSS | 3486 |

TABLE 36-continued

BiTE-scFc_Variable Region Protein Alignment (MAGEB2)
CDRs defined by Kabat
Alignment numbering defined by Amgen Reference (AHo)

| | | | |
|---|---|---|---|
| VH4\|4-30.1/D3\|3-10\|RF3/JH6 | | WGQGTTVTVSS | 3487 |
| MA_81-H7_CC_xI2C0x_scFc_(M5O)_translation Fv#1 | VH4\|4-30.1/D3\|3-10\|RF3/JH6 | WGQGTTVTVSS | 3488 |
| VH3\|3-23/D6\|6-19\|RF2/JH4 | | WGQGTLVTVSS | 3489 |
| MA_82-B5_CCx_I2C0x_scFc_(B3K)_translation Fv#1 | VH3\|3-23/D6\|6-19\|RF2/JH4 | WGQGTLVTVSS | 3490 |
| VH3\|3-23/D6\|6-19\|RF1/JH6 | | WGQGTTVTVSS | 3491 |
| MA_89-B2_CCx_I2C0x_scFc_(N1M)_translation Fv#1 | VH3\|3-23/D6\|6-19\|RF1/JH6 | WGQGTTVTVSS | 3492 |
| VH3\|3-30.3/D1\|1-1\|RF2/JH4 | | WGQGTLVTVSS | 3493 |
| MA_89-D12_CCx_I2C0x_scFc_(Y4C)_translation Fv#1 | VH3\|3-30.3/D1\|1-1\|RF2/JH4 | WGQGTLVTVSS | 3494 |
| VH3\|3-11/D1\|1-1\|RF3/JH4 | | WGQGTLVTVSS | 3495 |
| MA_93-B11_CCx_I2C0x_scFc_(N7N)_translation Fv#1 | VH3\|3-11/D1\|1-1\|RF3/JH4 | WGQGTLVTVSS | 3496 |

TABLE 37

BiTE-scFc_Variable Region Consensus Protein Alignment (MAGEB2)
CDRs defined by Kabat
Alignment numbering defined by Amgen Reference (AHo)

KAPPA_VARIABLE

| | Germline | | SEQ ID NO: |
|---|---|---|---|
| | | K_FR1 | |
| VK1\|A20/JK2 | | DIQMTQSPSSLSASVGDRVTITC | 3497 |
| MA_79-G12_CC_x_I2C0x_scFc_(K1F)_translation Fv#1 | VK1\|A20/JK2 | ELV.................. | 3498 |
| VK1\|O12/JK1 | | DIQMTQSPSSLSASVGDRVTITC | 3499 |
| MA_79-H7_CCx_I2C0x_scFc_(Q4C)_translation Fv#1 | VK1\|O12/JK1 | EL................... | 3500 |
| MA_81-F9_CCx_I2C0x_scFc_(I6I)_translation Fv#1 | VK1\|O12/JK1 | EL................... | 3501 |
| VK4\|B3/JK4 | | DIVMTQSPDSLAVSLGERATINC | 3502 |
| MA_81-E7_CCx_I2C0x_scFc_(O8Y)_translation Fv#1 | VK4\|B3/JK4 | EL....T.............. | 3503 |
| VK2\|O1/JK1 | | DIVMTQTPLSLPVTPGEPASISC | 3504 |
| MA_81-H7_CC_xI2C0x_scFc_(M5O)_translation Fv#1 | VK2\|O1/JK1 | EL................... | 3505 |

TABLE 37-continued

BiTE-scFc_Variable Region Consensus Protein Alignment (MAGEB2)
CDRs defined by Kabat
Alignment numbering defined by Amgen Reference (AHo)

| | | | |
|---|---|---|---|
| VK1\|O12/JK4 | | DIQMTQSPSSLSASVGDRVTITC | 3506 |
| MA_89-B2_CCx_I2C0x_scFc_(N1M)_translation Fv#1 | VK1\|O12/JK4 | EL.................... | 3507 |
| VK1\|A20/JK1 | | DIQMTQSPSSLSASVGDRVTITC | 3508 |
| MA_89-D12_CCx_I2C0x_scFc_(Y4C)_translation Fv#1 | VK1\|A20/JK1 | ELV................... | 3509 |
| | | K_CDR1 | |
| VK1\|A20/JK2 | | RAS--QGIS------NYLA | 3551 |
| MA_79-G12_CC_x_I2C0x_scFc_(K1F)_translation Fv#1 | VK1\|A20/JK2 | ................. | 3552 |
| VK1\|O12/JK1 | | RAS--QGIS------SYLN | 3553 |
| MA_79-H7_CCx_I2C0x_scFc_(Q4C)_translation Fv#1 | VK1\|O12/JK1 | .T............... | 3554 |
| MA_81-F9_CCx_I2C0x_scFc_(I6I)_translation Fv#1 | VK1\|O12/JK1 | ................. | 3555 |
| VK4\|B3/JK4 | | KSS--QSVLYSSNNKNYLA | 3556 |
| MA_81-E7_CCx_I2C0x_scFc_(O8Y)_translation Fv#1 | VK4\|B3/JK4 | ................. | 3557 |
| VK2\|O1/JK1 | | RSS--QSLLDSDDGNTYLD | 3558 |
| MA_81-H7_CC_xI2C0x_scFc_(M5O)_translation Fv#1 | VK2\|O1/JK1 | .........HRN-.YN... | 3559 |
| VK1\|O12/JK4 | | RAS--QSIS------SYLN | 3560 |
| MA_89-B2_CCx_I2C0x_scFc_(N1M)_translation Fv#1 | VK1\|O12/JK4 | Q.....D........N... | 3561 |
| VK1\|A20/JK1 | | RAS--QGIS------NYLA | 3562 |
| MA_89-D12_CCx_I2C0x_scFc_(Y4C)_translation Fv#1 | VK1\|A20/JK1 | ................. | 3563 |
| | | K_FR2 | |
| VK1\|A20/JK2 | | WYQQKPGKVPKLLIY | 3605 |
| MA_79-G12_CC_x_I2C0x_scFc_(K1F)_translation Fv#1 | VK1\|A20/JK2 | ..............S | 3606 |
| VK1\|O12/JK1 | | WYQQKPGKAPKLLIY | 3607 |
| MA_79-H7_CCx_I2C0x_scFc_(Q4C)_translation Fv#1 | VK1\|O12/JK1 | .F...........F | 3608 |
| MA_81-F9_CCx_I2C0x_scFc_(I6I)_translation Fv#1 | VK1\|O12/JK1 | ............... | 3609 |

TABLE 37-continued

BiTE-scFc_Variable Region Consensus Protein Alignment (MAGEB2)
CDRs defined by Kabat
Alignment numbering defined by Amgen Reference (AHo)

| | | | |
|---|---|---|---|
| VK4\|B3/JK4 | | WYQQKPGQPPKLLIY | 3610 |
| MA_81-E7_CCx_I2C0x_scFc_(O8Y)_translation Fv#1 | VK4\|B3/JK4 | ............... | 3611 |
| VK2\|O1/JK1 | | WYLQKPGQSPQLLIY | 3612 |
| MA_81-H7_CC_xI2C0x_scFc_(M5O)_translation Fv#1 | VK2\|O1/JK1 | ............... | 3613 |
| VK1\|O12/JK4 | | WYQQKPGKAPKLLIY | 3614 |
| MA_89-B2_CCx_I2C0x_scFc_(N1M)_translation Fv#1 | VK1\|O12/JK4 | ............... | 3615 |
| VK1\|A20/JK1 | | WYQQKPGKVPKLLIY | 3616 |
| MA_89-D12_CCx_I2C0x_scFc_(Y4C)_translation Fv#1 | VK1\|A20/JK1 | ............... | 3617 |

| LAMBDA VARIABLE | | | |
|---|---|---|---|
| | Germline | | SEQ ID NO: |
| | | L_FR1 | |
| VL7\|7a/JL3b | | QTVVTQE-PSLTVSPGGTVTLTC | 3510 |
| MA_79-G12_CC_x_I2C0x_scFc_(K1F)_translation Fv#2 | VL7\|7a/JL3b | ...................... | 3511 |
| MA_79-H7_CCx_I2C0x_scFc_(Q4C)_translation Fv#2 | VL7\|7a/JL3b | ...................... | 3512 |
| MA_81-E7_CCx_I2C0x_scFc_(O8Y)_translation Fv#2 | VL7\|7a/JL3b | ...................... | 3513 |
| MA_81-F9_CCx_I2C0x_scFc_(I6I)_translation Fv#2 | VL7\|7a/JL3b | ...................... | 3514 |
| MA_81-H7_CC_xI2C0x_scFc_(M5O)_translation Fv#2 | VL7\|7a/JL3b | ...................... | 3515 |
| MA_82-B5_CCx_I2C0x_scFc_(B3K)_translation Fv#2 | VL7\|7a/JL3b | ...................... | 3516 |
| MA_89-B2_CCx_I2C0x_scFc_(N1M)_translation Fv#2 | VL7\|7a/JL3b | ...................... | 3517 |
| MA_89-D12_CCx_I2C0x_scFc_(Y4C)_translation Fv#2 | VL7\|7a/JL3b | ...................... | 3518 |
| MA_93-B11_CCx_I2C0x_scFc_(N7N)_translation Fv#2 | VL7\|7a/JL3b | ...................... | 3519 |
| VL3\|3h/JL2 | | SYVLTQP-PSVSVAPGKTARITC | 3520 |
| MA_82-B5_CCx_I2C0x_scFc_(B3K)_translation Fv#1 | VL3\|3h/JL2 | EL.............Q...... | 3521 |

TABLE 37-continued

BiTE-scFc_Variable Region Consensus Protein Alignment (MAGEB2)
CDRs defined by Kabat
Alignment numbering defined by Amgen Reference (AHo)

| | | | |
|---|---|---|---|
| MA_93-B11_CCx_I2C0x_scFc_(N7N)_translation Fv#1 | VL3\|3h/JL2 | EL..............Q...... | 3522 |
| | | L_CDR1 | |
| VL7\|7a/JL3b | | ASST-GAVTSG----YYPN | 3564 |
| MA_79-G12_CC_x_I2C0x_scFc_(K1F)_translation Fv#2 | VL7\|7a/JL3b | G..............N... | 3565 |
| MA_79-H7_CCx_I2C0x_scFc_(Q4C)_translation Fv#2 | VL7\|7a/JL3b | G..............N... | 3566 |
| MA_81-E7_CCx_I2C0x_scFc_(O8Y)_translation Fv#2 | VL7\|7a/JL3b | G..............N... | 3567 |
| MA_81-F9_CCx_I2C0x_scFc_(I6I)_translation Fv#2 | VL7\|7a/JL3b | G..............N... | 3568 |
| MA_81-H7_CC_xI2C0x_scFc_(M5O)_translation Fv#2 | VL7\|7a/JL3b | G..............N... | 3569 |
| MA_82-B5_CCx_I2C0x_scFc_(B3K)_translation Fv#2 | VL7\|7a/JL3b | G..............N... | 3570 |
| MA_89-B2_CCx_I2C0x_scFc_(N1M)_translation Fv#2 | VL7\|7a/JL3b | G..............N... | 3571 |
| MA_89-D12_CCx_I2C0x_scFc_(Y4C)_translation Fv#2 | VL7\|7a/JL3b | G..............N... | 3572 |
| MA_93-B11_CCx_I2C0x_scFc_(N7N)_translation Fv#2 | VL7\|7a/JL3b | G..............N... | 3573 |
| VL3\|3h/JL2 | | GGN---NIGS-----KSVH | 3574 |
| MA_82-B5_CCx_I2C0x_scFc_(B3K)_translation Fv#1 | VL3\|3h/JL2 | ................... | 3575 |
| MA_93-B11_CCx_I2C0x_scFc_(N7N)_translation Fv#1 | VL3\|3h/JL2 | ................... | 3576 |
| | | L_FR2 | |
| VL7\|7a/JL3b | | WFQQKPGQAPRALIY | 3618 |
| MA_79-G12_CC_x_I2C0x_scFc_(K1F)_translation Fv#2 | VL7\|7a/JL3b | .V.........G..G | 3619 |
| MA_79-H7_CCx_I2C0x_scFc_(Q4C)_translation Fv#2 | VL7\|7a/JL3b | .V.........G..G | 3620 |
| MA_81-E7_CCx_I2C0x_scFc_(O8Y)_translation Fv#2 | VL7\|7a/JL3b | .V.........G..G | 3621 |

TABLE 37-continued

BiTE-scFc_Variable Region Consensus Protein Alignment (MAGEB2)
CDRs defined by Kabat
Alignment numbering defined by Amgen Reference (AHo)

| Name | Germline | Sequence | SEQ ID NO: |
|---|---|---|---|
| MA_81-F9_CCx_I2C0x_scFc_(I6I)_translation Fv#2 | VL7\|7a/JL3b | .V.........G..G | 3622 |
| MA_81-H7_CC_xI2C0x_scFc_(M5O)_translation Fv#2 | VL7\|7a/JL3b | .V.........G..G | 3623 |
| MA_82-B5_CCx_I2C0x_scFc_(B3K)_translation Fv#2 | VL7\|7a/JL3b | .V.........G..G | 3624 |
| MA_89-B2_CCx_I2C0x_scFc_(N1M)_translation Fv#2 | VL7\|7a/JL3b | .V.........G..G | 3625 |
| MA_89-D12_CCx_I2C0x_scFc_(Y4C)_translation Fv#2 | VL7\|7a/JL3b | .V.........G..G | 3626 |
| MA_93-B11 CCx_I2C0x scFc_(N7N)_translation Fv#2 | VL7\|7a/JL3b | .V.........G..G | 3627 |
| VL3\|3h/JL2 | | WYQQKPGQAPVLVIY | 3628 |
| MA_82-B5_CCx_I2C0x_scFc_(B3K)_translation Fv#1 | VL3\|3h/JL2 | .......V. | 3629 |
| MA_93-B11_CCx_I2C0x scFc_(N7N)_translation Fv#1 | VL3\|3h/JL2 | ............V. | 3630 |

| HEAVY_VARIABLE | | | |
|---|---|---|---|
| | Germline | | SEQ ID NO: |
| | | H_FR1 | |
| VH1\|1-18/D6\|6-13\|RF2/JH4 | | QVQLVQS-GAEVKKPGASVKVSCKASG-YTFT | 3523 |
| MA_79-G12_CC_x_I2C0x_scFc_(K1F)_translation Fv#1 | VH1\|1-18/D6\|6-13\|RF2/JH4 | E...LE......................... | 3524 |
| VH3\|3-73/D3\|3-3\|RF3/JH4 | | EVQLVES-GGGLVQPGGSLKLSCAASG-FTFS | 3525 |
| MA_79-G12_CC_x_I2C0x_scFc_(K1F)_translation Fv#2 | VH3\|3-73/D3\|3-3\|RF3/JH4 | ..........................N | 3526 |
| MA_79-H7_CCx_I2C0x_scFc_(Q4C)_translation Fv#2 | VH3\|3-73/D3\|3-3\|RF3/JH4 | ..........................N | 3527 |
| MA_81-E7_CCx_I2C0x_scFc_(O8Y)_translation Fv#2 | VH3\|3-73/D3\|3-3\|RF3/JH4 | ..........................N | 3528 |
| MA_81-F9_CCx_I2C0x_scFc_(I6I)_translation Fv#2 | VH3\|3-73/D3\|3-3\|RF3/JH4 | ..........................N | 3529 |
| MA_81-H7_CC_xI2C0x_scFc_(M5O)_translation Fv#2 | VH3\|3-73/D3\|3-3\|RF3/JH4 | ..........................N | 3530 |

TABLE 37-continued

BiTE-scFc_Variable Region Consensus Protein Alignment (MAGEB2)
CDRs defined by Kabat
Alignment numbering defined by Amgen Reference (AHo)

| Name | V/D/J | Sequence | SEQ ID |
|---|---|---|---|
| MA_82-B5_CCx_I2C0x_scFc_(B3K)_translation Fv#2 | VH3\|3-73/D3\|3-3\|RF3/JH4 | ...........................NB<br>...........................N | 3531 |
| MA_89-B2_CCx_I2C0x_scFc_(N1M)_translation Fv#2 | VH3\|3-73/D3\|3-3\|RF3/JH4 | ...........................<br>...........................N | 3532 |
| MA_89-D12_CCx_I2C0x_scFc_(Y4C)_translation Fv#2 | VH3\|3-73/D3\|3-3\|RF3/JH4 | ...........................NB<br>...........................N | 3533 |
| MA_93-B11_CCx_I2C0x_scFc_(N7N)_translation Fv#2 | VH3\|3-73/D3\|3-3\|RF3/JH4 | ...........................<br>...........................N | 3534 |
| VH3\|3-15/D3\|3-10\|RF2/JH6 | | EVQLVES-GGGLVKPGGSLRLSCAASG-FTFS | 3535 |
| MA_79-H7_CCx_I2C0x_scFc_(Q4C)_translation Fv#1 | VH3\|3-15/D3\|3-10\|RF2/JH6 | ....L........Q................. | 3536 |
| VH4\|4-59/D3\|3-3\|RF3/JH4 | | QVQLQES-GPGLVKPSETLSLTCTVSG-GSIS | 3537 |
| MA_81-E7_CCx_I2C0x_scFc_(O8Y)_translation Fv#1 | VH4\|4-59/D3\|3-3\|RF3/JH4 | E...L................D... | 3538 |
| VH2\|2-05/D2\|2-15\|RF1/JH5 | | QITLKES-GPTLVKPTQTLTLTCTESG-FSLS | 3539 |
| MA_81-F9_CCx_I2C0x_scFc_(I6I)_translation Fv#1 | VH2\|2-05/D2\|2-15\|RF1/JH5 | EVQ.L.....M................FT | 3540 |
| VH4\|4-30.1/D3\|3-10\|RF3/JH6 | | QVQLQES-GPGLVKPSQTLSLTCTVSG-GSIS | 3541 |
| MA_81-H7_CC_xI2C0x_scFc_(M5O)_translation Fv#1 | VH4\|4-30.1/D3\|3-10\|RF3/JH6 | E...L................D... | 3542 |
| VH3\|3-23/D6\|6-19\|RF2/JH4 | | EVQLLES-GGGLVQPGGSLRLSCAASG-FTFS | 3543 |
| MA_82-B5_CCx_I2C0x_scFc_(B3K)_translation Fv#1 | VH3\|3-23/D6\|6-19\|RF2/JH4 | ........................... | 3544 |
| VH3\|3-23/D6\|6-19\|RF1/JH6 | | EVQLLES-GGGLVQPGGSLRLSCAASG-FTFS | 3545 |
| MA_89-B2_CCx_I2C0x_scFc_(N1M)_translation Fv#1 | VH3\|3-23/D6\|6-19\|RF1/JH6 | ........................... | 3546 |
| VH3\|3-30.3/D1\|1-1\|RF2/JH4 | | QVQLVES-GGGVVQPGRSLRLSCAASG-FTFS | 3547 |
| MA_89-D12_CCx_I2C0x_scFc_(Y4C)_translation Fv#1 | VH3\|3-30.3/D1\|1-1\|RF2/JH4 | E...L........................ | 3548 |
| VH3\|3-11/D1\|1-1\|RF3/JH4 | | QVQLVES-GGGLVKPGGSLRLSCAASG-FTFS | 3549 |
| MA_93-B11_CCx_I2C0x_scFc_(N7N)_translation Fv#1 | VH3\|3-11/D1\|1-1\|RF3/JH4 | E...L........................ | 3550 |

TABLE 37-continued

BiTE-scFc_Variable Region Consensus Protein Alignment (MAGEB2)
CDRs defined by Kabat
Alignment numbering defined by Amgen Reference (AHo)

|  |  | H_CDR1 |  |
|---|---|---|---|
| VH1\|1-18/D6\|6-13\|RF2/JH4 |  | S-----YGIS | 3577 |
| MA_79-G12_CC_x_I2C0x_scFc_(K1F)_translation Fv#1 | VH1\|1-18/D6\|6-13\|RF2/JH4 | R.....N.L. | 3578 |
| VH3\|3-73/D3\|3-3\|RF3/JH4 |  | G-----SAMH | 3579 |
| MA_79-G12_CC_x_I2C0x_scFc_(K1F)_translation Fv#2 | VH3\|3-73/D3\|3-3\|RF3/JH4 | K.....Y..N | 3580 |
| MA_79-H7_CCx_I2C0x_scFc_(Q4C)_translation Fv#2 | VH3\|3-73/D3\|3-3\|RF3/JH4 | K.....Y..N | 3581 |
| MA_81-E7_CCx_I2C0x_scFc_(O8Y)_translation Fv#2 | VH3\|3-73/D3\|3-3\|RF3/JH4 | K.....Y..N | 3582 |
| MA_81-F9_CCx_I2C0x_scFc_(I6I)_translation Fv#2 | VH3\|3-73/D3\|3-3\|RF3/JH4 | K.....Y..N | 3583 |
| MA_81-H7_CC_xI2C0x_scFc_(M5O)_translation Fv#2 | VH3\|3-73/D3\|3-3\|RF3/JH4 | K.....Y..N | 3584 |
| MA_82-B5_CCx_I2C0x_scFc_(B3K)_translation Fv#2 | VH3\|3-73/D3\|3-3\|RF3/JH4 | K.....Y..N | 3585 |
| MA_89-B2_CCx_I2C0x_scFc_(N1M)_translation Fv#2 | VH3\|3-73/D3\|3-3\|RF3/JH4 | K.....Y..N | 3586 |
| MA_89-D12_CCx_I2C0x_scFc_(Y4C)_translation Fv#2 | VH3\|3-73/D3\|3-3\|RF3/JH4 | K.....Y..N | 3587 |
| MA_93-B11_CCx_I2C0x_scFc_(N7N)_translation Fv#2 | VH3\|3-73/D3\|3-3\|RF3/JH4 | K.....Y..N | 3588 |
| VH3\|3-15/D3\|3-10\|RF2/JH6 |  | N-----AWMS | 3589 |
| MA_79-H7_CCx_I2C0x_scFc_(Q4C)_translation Fv#1 | VH3\|3-15/D3\|3-10\|RF2/JH6 | .......... | 3590 |
| VH4\|4-59/D3\|3-3\|RF3/JH4 |  | S-----YYWS | 3591 |
| MA_81-E7_CCx I2C0x_scFc_(O8Y)_translation Fv#1 | VH4\|4-59/D3\|3-3\|RF3/JH4 | .S...R...G | 3592 |
| VH2\|2-05/D2\|2-15\|RF1/JH5 |  | TS---GVGVG | 3593 |
| MA_81-F9_CCx_I2C0x_scFc_(I6I)_translation Fv#1 | VH2\|2-05/D2\|2-15\|RF1/JH5 | .H...KM..D | 3594 |
| VH4\|4-30.1/D3\|3-10\|RF3/JH6 |  | SG---GYYWS | 3595 |
| MA_81-H7_CC_xI2C0x_scFc_(M5O)_translation Fv#1 | VH4\|4-30.1/D3\|3-10\|RF3/JH6 | .N...P.... | 3596 |

TABLE 37-continued

BiTE-scFc_Variable Region Consensus Protein Alignment (MAGEB2)
CDRs defined by Kabat
Alignment numbering defined by Amgen Reference (AHo)

| Name | VH family | Sequence | SEQ ID |
|---|---|---|---|
| VH3\|3-23/D6\|6-19\|RF2/JH4 | | S-----YAMS | 3597 |
| MA_82-B5_CCx_I2C0x_scFc_(B3K)_translation Fv#1 | VH3\|3-23/D6\|6-19\|RF2/JH4 | .......... | 3598 |
| VH3\|3-23/D6\|6-19\|RF1/JH6 | | S-----YAMS | 3599 |
| MA_89-B2_CCx_I2C0x_scFc_(N1M)_translation Fv#1 | VH3\|3-23/D6\|6-19\|RF1/JH6 | .......... | 3600 |
| VH3\|3-30.3/D1\|1-1\|RF2/JH4 | | S-----YAMH | 3601 |
| MA_89-D12_CCx_I2C0x_scFc_(Y4C)_translation Fv#1 | VH3\|3-30.3/D1\|1-1\|RF2/JH4 | T......G.. | 3602 |
| VH3\|3-11/D1\|1-1\|RF3/JH4 | | D-----YYMS | 3603 |
| MA_93-B11_CCx_I2C0x_scFc_(N7N)_translation Fv#1 | VH3\|3-11/D1\|1-1\|RF3/JH4 | .......... | 3604 |

| | | H_FR2 | |
|---|---|---|---|
| VH1\|1-18/D6\|6-13\|RF2/JH4 | | WVRQAPGQGLEWMG | 3631 |
| MA_79-G12_CC_x_I2C0x_scFc_(K1F)_translation Fv#1 | VH1\|1-18/D6\|6-13\|RF2/JH4 | ........C..... | 3632 |
| VH3\|3-73/D3\|3-3\|RF3/JH4 | | WVRQASGKGLEWVG | 3633 |
| MA_79-G12_CC_x_I2C0x_scFc_(K1F)_translation Fv#2 | VH3\|3-73/D3\|3-3\|RF3/JH4 | .....P........ | 3634 |
| MA_79-H7_CCx_I2C0x_scFc_(Q4C)_translation Fv#2 | VH3\|3-73/D3\|3-3\|RF3/JH4 | .....P........ | 3635 |
| MA_81-E7_CCx_I2C0x_scFc_(O8Y)_translation Fv#2 | VH3\|3-73/D3\|3-3\|RF3/JH4 | .....P........ | 3636 |
| MA_81-F9_CCx_I2C0x_scFc_(I6I)_translation Fv#2 | VH3\|3-73/D3\|3-3\|RF3/JH4 | .....P........ | 3637 |
| MA_81-H7_CC_xI2C0x_scFc_(M5O)_translation Fv#2 | VH3\|3-73/D3\|3-3\|RF3/JH4 | .....P........ | 3638 |
| MA_82-B5_CCx_I2C0x_scFc_(B3K)_translation Fv#2 | VH3\|3-73/D3\|3-3\|RF3/JH4 | .....P.......A | 3639 |
| MA_89-B2_CCx_I2C0x_scFc_ (N1M)_translation Fv#2 | VH3\|3-73/D3\|3-3\|RF3/JH4 | .....P.......A | 3640 |
| MA_89-D12_CCx_I2C0x_scFc_(Y4C)_translation Fv#2 | VH3\|3-73/D3\|3-3\|RF3/JH4 | .....P.......A | 3641 |
| MA_93-B11_CCx_I2C0x_scFc_(N7N)_translation Fv#2 | VH3\|3-73/D3\|3-3\|RF3/JH4 | .....P.......A | 3642 |

TABLE 37-continued

BiTE-scFc_Variable Region Consensus Protein Alignment (MAGEB2)
CDRs defined by Kabat
Alignment numbering defined by Amgen Reference (AHo)

| | Germline | | SEQ ID NO: |
|---|---|---|---|
| VH3\|3-15/D3\|3-10\|RF2/JH6 | | WVRQAPGKGLEWVG | 3643 |
| MA_79-H7_CCx_I2C0x_scFc_(Q4C)_translation Fv#1 | VH3\|3-15/D3\|3-10\|RF2/JH6 | ........C..... | 3644 |
| VH4\|4-59/D3\|3-3\|RF3/JH4 | | WIRQPPGKGLEWIG | 3645 |
| MA_81-E7_CCx_I2C0x_scFc_(O8Y)_translation Fv#1 | VH4\|4-59/D3\|3-3\|RF3/JH4 | ........C..... | 3646 |
| VH2\|2-05/D2\|2-15\|RF1/JH5 | | WIRQPPGKALEWLA | 3647 |
| MA_81-F9_CCx_I2C0x_scFc_(I6I)_translation Fv#1 | VH2\|2-05/D2\|2-15\|RF1/JH5 | ........C..... | 3648 |
| VH4\|4-30.1/D3\|3-10\|RF3/JH6 | | WIRQHPGKGLEWIG | 3649 |
| MA_81-H7_CC_xI2C0x_scFc_(M5O)_translation Fv#1 | VH4\|4-30.1/D3\|3-10\|RF3/JH6 | ........C..... | 3650 |
| VH3\|3-23/D6\|6-19\|RF2/JH4 | | WVRQAPGKGLEWVS | 3651 |
| MA_82-B5_CCx_I2C0x_scFc_(B3K)_translation Fv#1 | VH3\|3-23/D6\|6-19\|RF2/JH4 | ........C..... | 3652 |
| VH3\|3-23/D6\|6-19\|RF1/JH6 | | WVRQAPGKGLEWVS | 3653 |
| MA_89-B2_CCx_I2C0x_scFc_(N1M)_translation Fv#1 | VH3\|3-23/D6\|6-19\|RF1/JH6 | .......RC..... | 3654 |
| VH3\|3-30.3/D1\|1-1\|RF2/JH4 | | WVRQAPGKGLEWVA | 3655 |
| MA_89-D12_CCx_I2C0x_scFc_(Y4C)_translation Fv#1 | VH3\|3-30.3/D1\|1-1\|RF2/JH4 | ........C..... | 3656 |
| VH3\|3-11/D1\|1-1\|RF3/JH4 | | WIRQAPGKGLEWVS | 3657 |
| MA_93-B11_CCx_I2C0x_scFc_(N7N)_translation Fv#1 | VH3\|3-11/D1\|1-1\|RF3/JH4 | ........C..... | 3658 |

| KAPPA VARIABLE | | | |
|---|---|---|---|
| | Germline | | SEQ ID NO: |
| | | K_CDR2 | |
| VK1\|A20/JK2 | | A--------ASTLQS | 3659 |
| MA_79-G12_CC_x_I2C0x_scFc_(K1F)_translation Fv#1 | VK1\|A20/JK2 | ............... | 3660 |
| VK1\|O12/JK1 | | A--------ASSLQS | 3661 |
| MA_79-H7_CCx_I2C0x_scFc_(Q4C)_translation Fv#1 | VK1\|O12/JK1 | ............... | 3662 |
| MA_81-F9_CCx_I2C0x_scFc_(I6I)_translation Fv#1 | VK1\|O12/JK1 | ............... | 3663 |

TABLE 37-continued

BiTE-scFc_Variable Region Consensus Protein Alignment (MAGEB2)
CDRs defined by Kabat
Alignment numbering defined by Amgen Reference (AHo)

| | | | |
|---|---|---|---|
| VK4\|B3/JK4 | | W--------ASTRES | 3664 |
| MA_81-E7_CCx_I2C0x_scFc_(O8Y)_translation Fv#1 | VK4\|B3/JK4 | ............... | 3665 |
| VK2\|O1/JK1 | | T--------LSYRAS | 3666 |
| MA_81-H7_CC_xI2C0x_scFc_(M5O)_translation Fv#1 | VK2\|O1/JK1 | L........G.N... | 3667 |
| VK1\|O12/JK4 | | A--------ASSLQS | 3668 |
| MA_89-B2_CCx_I2C0x_scFc_(N1M)_translation Fv#1 | VK1\|O12/JK4 | ............... | 3669 |
| VK1\|A20/JK1 | | A--------ASTLQS | 3670 |
| MA_89-D12_CCx_I2C0x_scFc_(Y4C)_translation Fv#1 | VK1\|A20/JK1 | ............... | 3671 |
| | | K_FR3 | |
| VK1\|A20/JK2 | | GVPSRFSGSGSG--TDFTLTISSLQPEDVATYYC | 3713 |
| MA_79-G12_CC_x_I2C0x_scFc_(K1F)_translation Fv#1 | VK1\|A20/JK2 | ..................<br>............ | 3714 |
| VK1\|O12/JK1 | | GVPSRFSGSGSG--TDFTLTISSLQPEDFATYYC | 3715 |
| MA_79-H7_CCx_I2C0x_scFc_(Q4C)_translation Fv#1 | VK1\|O12/JK1 | ..................<br>............ | 3716 |
| MA_81-F9_CCx_I2C0x_scFc_(I6I)_translation Fv#1 | VK1\|O12/JK1 | ..................<br>............ | 3717 |
| VK4\|B3/JK4 | | GVPDRESGSGSG--TDFTLTISSLQAEDVAVYYC | 3718 |
| MA_81-E7_CCx_I2C0x_scFc_(O8Y)_translation Fv#1 | VK4\|B3/JK4 | ..................<br>............ | 3719 |
| VK2\|O1/JK1 | | GVPDRESGSGSG--TDFTLKISRVEAEDVGVYYC | 3720 |
| MA_81-H7_CC_xI2C0x_scFc_(M5O)_translation Fv#1 | VK2\|O1/JK1 | ..................<br>....G....... | 3721 |
| VK1\|O12/JK4 | | GVPSRFSGSGSG--TDFTLTISSLQPEDFATYYC | 3722 |
| MA_89-B2_CCx_I2C0x_scFc_(N1M)_translation Fv#1 | VK1\|O12/JK4 | ..................<br>............ | 3723 |
| VK1\|A20/JK1 | | GVPSRFSGSGSG--TDFTLTISSLQPEDVATYYC | 3724 |
| MA_89-D12_CCx_I2C0x_scFc_(Y4C)_translation Fv#1 | VK1\|A20/JK1 | ..................<br>............ | 3725 |

TABLE 37-continued

BiTE-scFc_Variable Region Consensus Protein Alignment (MAGEB2)
CDRs defined by Kabat
Alignment numbering defined by Amgen Reference (AHo)

LAMBDA VARIABLE

| | Germline | | SEQ ID NO: |
|---|---|---|---|
| | | L_CDR2 | |
| VL7\|7a/JL3b | | S--------TSNKHS | 3672 |
| MA_79-G12_CC_x_I2C0x_scFc_(K1F)_translation Fv#2 | VL7\|7a/JL3b | G.........KFLAP | 3673 |
| MA_79-H7_CCx_I2C0x_scFc_(Q4C)_translation Fv#2 | VL7\|7a/JL3b | G.........KFLAP | 3674 |
| MA_81-E7_CCx_I2C0x_scFc_(O8Y)_translation Fv#2 | VL7\|7a/JL3b | G.........KFLAP | 3675 |
| MA_81-F9_CCx_I2C0x_scFc_(I6I)_translation Fv#2 | VL7\|7a/JL3b | G.........KFLAP | 3676 |
| MA_81-H7_CC_xI2C0x_scFc_(M5O)_translation Fv#2 | VL7\|7a/JL3b | G.........KFLAP | 3677 |
| MA_82-B5_CCx_I2C0x_scFc_(B3K)_translation Fv#2 | VL7\|7a/JL3b | G.........KFLAP | 3678 |
| MA_89-B2_CCx_I2C0x_scFc_(N1M)_translation Fv#2 | VL7\|7a/JL3b | G.........KFLAP | 3679 |
| MA_89-D12_CCx_I2C0x_scFc_(Y4C)_translation Fv#2 | VL7\|7a/JL3b | G.........KFLAP | 3680 |
| MA_93-B11_CCx_I2C0x_scFc_(N7N)_translation Fv#2 | VL7\|7a/JL3b | G.........KFLAP | 3681 |
| VL3\|3h/JL2 | | Y--------DSDRPS | 3682 |
| MA_82-B5_CCx_I2C0x_scFc_(B3K)_translation Fv#1 | VL3\|3h/JL2 | D.........N.... | 3683 |
| MA_93-B11_CCx_I2C0x_scFc_(N7N)_translation Fv#1 | VL3\|3h/JL2 | D.............. | 3684 |
| | | L_FR3 | |
| VL7\|7a/JL3b | | WTPARFSGSLLG--GKAALTLSGVQPEDEAEYYC | 3726 |
| MA_79-G12_CC_x_I2C0x_scFc_(K1F)_translation Fv#2 | VL7\|7a/JL3b | G.......................... | 3727 |
| MA_79-H7_CCx_I2C0x_scFc_(Q4C)_translation Fv#2 | VL7\|7a/JL3b | G.......................... | 3728 |
| MA_81-E7_CCx_I2C0x_scFc_(O8Y)_translation Fv#2 | VL7\|7a/JL3b | G.......................... | 3729 |

TABLE 37-continued

BiTE-scFc_Variable Region Consensus Protein Alignment (MAGEB2)
CDRs defined by Kabat
Alignment numbering defined by Amgen Reference (AHo)

| Name | Germline | Sequence | SEQ ID NO: |
|---|---|---|---|
| MA_81-F9_CCx_I2C0x_scFc_(I6I)_translation Fv#2 | VL7\|7a/JL3b | G.................... ............ | 3730 |
| MA_81-H7_CC_xI2C0x_scFc_(M5O)_translation Fv#2 | VL7\|7a/JL3b | G.................... ............ | 3731 |
| MA_82-B5_CCx_I2C0x_scFc_(B3K)_translation Fv#2 | VL7\|7a/JL3b | G.................... ............ | 3732 |
| MA_89-B2_CCx_I2C0x_scFc_(N1M)_translation Fv#2 | VL7\|7a/JL3b | G.................... ............ | 3733 |
| MA_89-D12_CCx_I2C0x_scFc_(Y4C)_translation Fv#2 | VL7\|7a/JL3b | G.................... ............ | 3734 |
| MA_93-B11_CCx_I2C0x_scFc_(N7N)_translation Fv#2 | VL7\|7a/JL3b | G.................... ............ | 3735 |
| VL3\|3h/JL2 | | GIPERFSGSNSG--NTATLTISRVEAGDEADYYC | 3736 |
| MA_82-B5_CCx_I2C0x_scFc_(B3K)_translation Fv#1 | VL3\|3h/JL2 | ..........F........I.. ............ | 3737 |
| MA_93-B11_CCx_I2C0x_scFc_(N7N)_translation Fv#1 | VL3\|3h/JL2 | ...................... ............ | 3738 |

| HEAVY VARIABLE | | | |
|---|---|---|---|
| | Germline | | SEQ ID NO: |
| | | H_CDR2 | |
| VH1\|1-18/D6\|6-13\|RF2/JH4 | | WISAY---NGNTNYAQKLQG | 3685 |
| MA_79-G12_CC_x_I2C0x_scFc_(K1F)_translation Fv#1 | VH1\|1-18/D6\|6-13\|RF2/JH4 | ...G......D......... | 3686 |
| VH3\|3-73/D3\|3-3/RF3/JH4 | | RIRSKA-NSYATAYAASVKG | 3687 |
| MA_79-G12_CC_x_I2C0x_scFc_(K1F)_translation Fv#2 | VH3\|3-73/D3\|3-3\|RF3/JH4 | .....Y..N...Y..D...D | 3688 |
| MA_79-H7_CCx_I2C0x_scFc_(Q4C)_translation Fv#2 | VH3\|3-73/D3\|3-3\|RF3/JH4 | .....Y..N...Y..D...D | 3689 |
| MA_81-E7_CCx_I2C0x_scFc_(O8Y)_translation Fv#2 | VH3\|3-73/D3\|3-3\|RF3/JH4 | .....Y..N...Y..D...D | 3690 |
| MA_81-F9_CCx_I2C0x_scFc_(I6I)_translation Fv#2 | VH3\|3-73/D3\|3-3\|RF3/JH4 | .....Y..N...Y..D...D | 3691 |
| MA_81-H7_CC_xI2C0x_scFc_(M5O)_translation Fv#2 | VH3\|3-73/D3\|3-3\|RF3/JH4 | .....Y..N...Y..D...D | 3692 |

TABLE 37-continued

BiTE-scFc_Variable Region Consensus Protein Alignment (MAGEB2)
CDRs defined by Kabat
Alignment numbering defined by Amgen Reference (AHo)

| Name | V-D-J | Sequence | SEQ ID NO |
|---|---|---|---|
| MA_82-B5_CCx_I2C0x_scFc_(B3K)_translation Fv#2 | VH3\|3-73/D3\|3-3\|RF3/JH4 | .....Y..N...Y..D...D | 3693 |
| MA_89-B2_CCx_I2C0x_scFc_(N1M)_translation Fv#2 | VH3\|3-73/D3\|3-3\|RF3/JH4 | .....Y..N...Y..D...D | 3694 |
| MA_89-D12_CCx_I2C0x_scFc_(Y4C)_translation Fv#2 | VH3\|3-73/D3\|3-3\|RF3/JH4 | .....Y..N...Y..D...D | 3695 |
| MA_93-B11_CCx_I2C0x_scFc_(N7N)_translation Fv#2 | VH3\|3-73/D3\|3-3\|RF3/JH4 | .....Y..N...Y..D...D | 3696 |
| VH3\|3-15/D3\|3-10\|RF2/JH6 | | RIKSKT-DGGTTDYAAPVKG | 3697 |
| MA_79-H7_CCx_I2C0x_scFc_(Q4C)_translation Fv#1 | VH3\|3-15/D3\|3-10\|RF2/JH6 | .......Y............ | 3698 |
| VH4\|4-59/D3\|3-3\|RF3/JH4 | | YIYY----SGSTNYNPSLKS | 3699 |
| MA_81-E7_CCx_I2C0x_scFc_(O8Y)_translation Fv#1 | VH4\|4-59/D3\|3-3\|RF3/JH4 | S..........Y....... | 3700 |
| VH2\|2-05/D2\|2-15\|RF1/JH5 | | LIYW----NDDKRYSPSLKS | 3701 |
| MA_81-F9_CCx_I2C0x_scFc_(I6I)_translation Fv#1 | VH2\|2-05/D2\|2-15\|RF1/JH5 | ..................Q. | 3702 |
| VH4\|4-30.1/D3\|3-10\|RF3/JH6 | | YIYY----SGSTYYNPSLKS | 3703 |
| MA_81-H7_CC_xI2C0x_scFc_(M5O)_translation Fv#1 | VH4\|4-30.1/D3\|3-10\|RF3/JH6 | ...S.......I.N....... | 3704 |
| VH3\|3-23/D6\|6-19\|RF2/JH4 | | AISGS---GGSTYYADSVKG | 3705 |
| MA_82-B5_CCx_I2C0x_scFc_(B3K)_translation Fv#1 | VH3\|3-23/D6\|6-19\|RF2/JH4 | ..........G......... | 3706 |
| VH3\|3-23/D6\|6-19\|RF1/JH6 | | AISGS---GGSTYYADSVKG | 3707 |
| MA_89-B2_CCx_I2C0x_scFc_(NIM)_translation Fv#1 | VH3\|3-23/D6\|6-19\|RF1/JH6 | T..I........N....... | 3708 |
| VH3\|3-30.3/D1\|1-1\|RF2/JH4 | | VISYD---GSNKYYADSVKG | 3709 |
| MA_89-D12_CCx_I2C0x_scFc_(Y4C)_translation Fv#1 | VH3\|3-30.3/D1\|1-1\|RF2/JH4 | .................... | 3710 |
| VH3\|3-11/D1\|1-1\|RF3/JH4 | | YISSS---GSTIYYADSVKG | 3711 |
| MA_93-B11_CCx_I2C0x_scFc_(N7N)_translation Fv#1 | VH3\|3-11/D1\|1-1\|RF3/JH4 | ...K................ | 3712 |

TABLE 37-continued

BiTE-scFc_Variable Region Consensus Protein Alignment (MAGEB2)
CDRs defined by Kabat
Alignment numbering defined by Amgen Reference (AHo)

| | | H_FR3 | |
|---|---|---|---|
| VH1\|1-18/D6\|6-13\|RF2/JH4 | | RVTMTTDTSTSTAYMELRSLRS DDTAVYYCAR | 3739 |
| MA_79-G12_CC_x_I2C0x_scFc_(K1F)_translation Fv#1 | VH1\|1-18/D6\|6-13\|RF2/JH4 | .G................ .......... | 3740 |
| VH3\|3-73/D3\|3-3\|RF3/JH4 | | RFTISRDDSKNTAYLQMNSLKT EDTAVYYCTR | 3741 |
| MA_79-G12_CC_x_I2C0x_scFc_(K1F)_translation Fv#2 | VH3\|3-73/D3\|3-3\|RF3/JH4 | ................N... ........V. | 3742 |
| MA_79-H7_CCx_I2C0x_scFc_(Q4C)_translation Fv#2 | VH3\|3-73/D3\|3-3\|RF3/JH4 | ................N... ........V. | 3743 |
| MA_81-E7_CCx_I2C0x_scFc_(O8Y)_translation Fv#2 | VH3\|3-73/D3\|3-3\|RF3/JH4 | ................N... ........V. | 3744 |
| MA_81-F9_CCx_I2C0x_scFc_(I6I)_translation Fv#2 | VH3\|3-73/D3\|3-3\|RF3/JH4 | ................N... ........V. | 3745 |
| MA_81-H7_CC_xI2C0x_scFc_(M5O)_translation Fv#2 | VH3\|3-73/D3\|3-3\|RF3/JH4 | ................N... ........V. | 3746 |
| MA_82-B5_CCx_I2C0x_scFc_(B3K)_translation Fv#2 | VH3\|3-73/D3\|3-3\|RF3/JH4 | ................N... ........V. | 3747 |
| MA_89-B2_CCx_I2C0x_scFc_(N1M)_translation Fv#2 | VH3\|3-73/D3\|3-3\|RF3/JH4 | ................N... ........V. | 3748 |
| MA_89-D12_CCx_I2C0x_scFc_(Y4C)_translation Fv#2 | VH3\|3-73/D3\|3-3\|RF3/JH4 | ................N... ........V. | 3749 |
| MA_93-B11_CCx_I2C0x_scFc_(N7N)_translation Fv#2 | VH3\|3-73/D3\|3-3\|RF3/JH4 | ................N... ........V. | 3750 |
| VH3\|3-15/D3\|3-10\|RF2/JH6 | | RFTISRDDSKNTLYLQMNSLKT EDTAVYYCTT | 3751 |
| MA_79-H7_CCx_I2C0x_scFc_(Q4C)_translation Fv#1 | VH3\|3-15/D3\|3-10\|RF2/JH6 | .................... .......... | 3752 |
| VH4\|4-59/D3\|3-3\|RF3/JH4 | | RVTISVDTSKNQFSLKLSSVTA ADTAVYYCAR | 3753 |
| MA_81-E7_CCx_I2C0x_scFc_(O8Y)_translation Fv#1 | VH4\|4-59/D3\|3-3\|RF3/JH4 | .................... .......... | 3754 |
| VH2\|2-05/D2\|2-15\|RF1/JH5 | | RLTITKDTSKNQVVLTMTNMDP VDTATYYCAH | 3755 |
| MA_81-F9_CCx_I2C0x_scFc_(I6I)_translation Fv#1 | VH2\|2-05/D2\|2-15\|RF1/JH5 | .................... .........Y | 3756 |

TABLE 37-continued

BiTE-scFc_Variable Region Consensus Protein Alignment (MAGEB2)
CDRs defined by Kabat
Alignment numbering defined by Amgen Reference (AHo)

| | | | SEQ ID NO: |
|---|---|---|---|
| | VH4\|4-30.1/D3\|3-10\|RF3/JH6 | RVTISVDTSKNQFSLKLSSVTA ADTAVYYCAR | 3757 |
| MA_81-H7_CC_xI2C0x_scFc_(M5O)_translation Fv#1 | VH4\|4-30.1/D3\|3-10\|RF3/JH6 | ...M.............T.L.. .......... | 3758 |
| | VH3\|3-23/D6\|6-19\|RF2/JH4 | RFTISRDNSKNTLYLQMNSLRA EDTAVYYCAK | 3759 |
| MA_82-B5_CCx_I2C0x_scFc_(B3K)_translation Fv#1 | VH3\|3-23/D6\|6-19\|RF2/JH4 | ...................... .........T | 3760 |
| | VH3\|3-23/D6\|6-19\|RF1/JH6 | RFTISRDNSKNTLYLQMNSLRA EDTAVYYCAK | 3761 |
| MA_89-B2_CCx_I2C0x_scFc_(NIM)_translation Fv#1 | VH3\|3-23/D6\|6-19\|RF1/JH6 | ...................... .......... | 3762 |
| | VH3\|3-30.3/D1\|1-1\|RF2/JH4 | RFTISRDNSKNTLYLQMNSLRA EDTAVYYCAR | 3763 |
| MA_89-D12_CCx_I2C0x_scFc_(Y4C)_translation Fv#1 | VH3\|3-30.3/D1\|1-1\|RF2/JH4 | .......D.............. .......... | 3764 |
| | VH3\|3-11/D1\|1-1\|RF3/JH4 | RFTISRDNAKNSLYLQMNSLRA EDTAVYYCAR | 3765 |
| MA_93-B11_CCx_I2C0x_scFc_(N7N)_translation Fv#1 | VH3\|3-11/D1\|1-1\|RF3/JH4 | ...................... .........T | 3766 |

| KAPPA VARIABLE | | | |
|---|---|---|---|
| | Germline | | SEQ ID NO: |
| | | K_CDR3 | |
| | VK1\|A20/JK2 | QKYNS---------------------APYT | 3767 |
| MA_79-G12_CC_x_I2C0x_scFc_(K1F)_translation Fv#1 | VK1\|A20/JK2 | ................................F | 3768 |
| | VK1\|O12/JK1 | QQSYS---------------------TPWT | 3769 |
| MA_79-H7_CCx_I2C0x_scFc_(Q4C)_translation Fv#1 | VK1\|O12/JK1 | ..............................S.F | 3770 |
| MA_81-F9_CCx_I2C0x_scFc_(I6I)_translation Fv#1 | VK1\|O12/JK1 | ................................F | 3771 |
| | VK4\|B3/JK4 | QQYYS---------------------TPLT | 3772 |
| MA_81-E7_CCx_I2C0x_scFc_(O8Y)_translation Fv#1 | VK4\|B3/JK4 | ................................. | 3773 |
| | VK2\|O1/JK1 | MQRIE---------------------FPWT | 3774 |
| MA_81-H7_CC_xI2C0x_scFc_(M5O)_translation Fv#1 | VK2\|O1/JK1 | ..ALQ....................T... | 3775 |

TABLE 37-continued

BiTE-scFc_Variable Region Consensus Protein Alignment (MAGEB2)
CDRs defined by Kabat
Alignment numbering defined by Amgen Reference (AHo)

| | | | SEQ ID NO: |
|---|---|---|---|
| VK1\|O12/JK4 | | QQSYS---------------------TPLT | 3776 |
| MA_89-B2_CCx_I2C0x_scFc_(N1M)_translation Fv#1 | VK1\|O12/JK4 | ............................I... | 3777 |
| VK1\|A20/JK1 | | QKYNS---------------------APWT | 3778 |
| MA_89-D12_CCx_I2C0x_scFc_(Y4C)_translation Fv#1 | VK1\|A20/JK1 | ...........................F. | 3779 |

| | | K_FR4 | |
|---|---|---|---|
| VK1\|A20/JK2 | | FGQGTKLEIK | 3821 |
| MA_79-G12_CC_x_I2C0x_scFc_(K1F)_translation Fv#1 | VK1\|A20/JK2 | ..C....... | 3822 |
| VK1\|O12/JK1 | | FGQGTKVEIK | 3823 |
| MA_79-H7_CCx_I2C0x_scFc_(Q4C)_translation Fv#1 | VK1\|O12/JK1 | ..C....... | 3824 |
| MA_81-F9_CCx_I2C0x_scFc_(I6I)_translation Fv#1 | VK1\|O12/JK1 | ..C....... | 3825 |
| VK4\|B3/JK4 | | FGGGTKVEIK | 3826 |
| MA_81-E7_CCx_I2C0x_scFc_(O8Y)_translation Fv#1 | VK4\|B3/JK4 | ..C....... | 3827 |
| VK2\|O1/JK1 | | FGQGTKVEIK | 3828 |
| MA_81-H7_CC_xI2C0x_scFc_(M5O)_translation Fv#1 | VK2\|O1/JK1 | ..C....... | 3829 |
| VK1\|O12/JK4 | | FGGGTKVEIK | 3830 |
| MA_89-B2_CCx_I2C0x_scFc_(N1M)_translation Fv#1 | VK1\|O12/JK4 | ..C....... | 3831 |
| VK1\|A20/JK1 | | FGQGTKVEIK | 3832 |
| MA_89-D12_CCx_I2C0x_scFc_(Y4C)_translation Fv#1 | VK1\|A20/JK1 | ..C....... | 3833 |

| LAMBDA VARIABLE | | | |
|---|---|---|---|
| | Germline | | SEQ ID NO: |
| | | L_CDR3 | |
| VL7\|7a/JL3b | | LLYYG---------------------GAQWV | 3780 |
| MA_79-G12_CC_x_I2C0x_scFc_(K1F)_translation Fv#2 | VL7\|7a/JL3b | V.W.S.....................-NR.. | 3781 |

TABLE 37-continued

BiTE-scFc_Variable Region Consensus Protein Alignment (MAGEB2)
CDRs defined by Kabat
Alignment numbering defined by Amgen Reference (AHo)

| | | | |
|---|---|---|---|
| MA_79-H7_CCx_I2C0x_scFc_(Q4C)_translation Fv#2 | VL7\|7a/JL3b | V.W.S......................-<br>NR.. | 3782 |
| MA_81-E7_CCx_I2C0x_scFc_(O8Y)_translation Fv#2 | VL7\|7a/JL3b | V.W.S......................-<br>NR.. | 3783 |
| MA_81-F9_CCx_I2C0x_scFc_(I6I)_translation Fv#2 | VL7\|7a/JL3b | V.W.S......................-<br>NR.. | 3784 |
| MA_81-H7_CC_xI2C0x_scFc_(M5O)_translation Fv#2 | VL7\|7a/JL3b | V.W.S......................-<br>NR.. | 3785 |
| MA_82-B5_CCx_I2C0x_scFc_(B3K)_translation Fv#2 | VL7\|7a/JL3b | V.W.S......................-<br>NR.. | 3786 |
| MA_89-B2_CCx_I2C0x_scFc_(N1M)_translation Fv#2 | VL7\|7a/JL3b | V.W.S......................-<br>NR.. | 3787 |
| MA_89-D12_CCx_I2C0x_scFc_(Y4C)_translation Fv#2 | VL7\|7a/JL3b | V.W.S......................-<br>NR.. | 3788 |
| MA_93-B11_CCx_I2C0x_scFc_(N7N)_translation Fv#2 | VL7\|7a/JL3b | V.W.S......................-<br>NR.. | 3789 |
| VL3\|3h/JL2 | | QVWDSS--------------------<br>SDHVV | 3790 |
| MA_82-B5_CCx_I2C0x_scFc_(B3K)_translation Fv#1 | VL3\|3h/JL2 | ........................... | 3791 |
| MA_93-B11_CCx_I2C0x_scFc_(N7N)_translation Fv#1 | VL3\|3h/JL2 | .........................SDH... | 3792 |
| | | L_FR4 | |
| VL7\|7a/JL3b | | FGGGTKLTVL | 3834 |
| MA_79-G12_CC_x_I2C0x_scFc_(K1F)_translation Fv#2 | VL7\|7a/JL3b | .......... | 3835 |
| MA_79-H7_CCx_I2C0x_scFc_(Q4C)_translation Fv#2 | VL7\|7a/JL3b | .......... | 3836 |
| MA_81-E7_CCx_I2C0x_scFc_(O8Y)_translation Fv#2 | VL7\|7a/JL3b | .......... | 3837 |
| MA_81-F9_CCx_I2C0x_scFc_(I6I)_translation Fv#2 | VL7\|7a/JL3b | .......... | 3838 |
| MA_81-H7_CC_xI2C0x_scFc_(M5O)_translation Fv#2 | VL7\|7a/JL3b | .......... | 3839 |

TABLE 37-continued

BiTE-scFc_Variable Region Consensus Protein Alignment (MAGEB2)
CDRs defined by Kabat
Alignment numbering defined by Amgen Reference (AHo)

| | | | SEQ ID NO: |
|---|---|---|---|
| MA_82-B5_CCx_I2C0x_scFc_(B3K)_translation Fv#2 | VL7\|7a/JL3b | .......... | 3840 |
| MA_89-B2_CCx_I2C0x_scFc_(N1M)_translation Fv#2 | VL7\|7a/JL3b | .......... | 3841 |
| MA_89-D12_CCx_I2C0x_scFc_(Y4C)_translation Fv#2 | VL7\|7a/JL3b | ......... | 3842 |
| MA_93-B11_CCx_I2C0x_scFc_(N7N)_translation Fv#2 | VL7\|7a/JL3b | .......... | 3843 |
| VL3\|3h/JL2 | | FGGGTKLTVL | 3844 |
| MA_82-B5_CCx_I2C0x_scFc_(B3K)_translation Fv#1 | VL3\|3h/JL2 | .......... | 3845 |
| MA_93-B11_CCx_I2C0x_scFc_(N7N)_translation Fv#1 | VL3\|3h/JL2 | ..C......S | 3846 |

HEAVY VARIABLE

| | Germline | | SEQ ID NO: |
|---|---|---|---|
| | | H_CDR3 | |
| VH1\|1-18/D6\|6-13\|RF2/JH4 | | GIAAA-------------------GYFDY | 3793 |
| MA_79-G12_CC_x_I2C0x_scFc_(K1F)_translation Fv#1 | VH1\|1-18/D6\|6-13\|RF2/JH4 | .R.T-..................--... | 3794 |
| VH3\|3-73/D3\|3-3\|RF3/JH4 | | ITIFGVV----------------IIYFDY | 3795 |
| MA_79-G12_CC_x_I2C0x_scFc_(K1F)_translation Fv#2 | VH3\|3-73/D3\|3-3\|RF3/JH4 | HGN...NS................Y.S.WA. | 3796 |
| MA_79-H7_CCx_I2C0x_scFc_(Q4C)_translation Fv#2 | VH3\|3-73/D3\|3-3\|RF3/JH4 | HGN...NS................Y.S.WA. | 3797 |
| MA_81-E7_CCx_I2C0x_scFc_(O8Y)_translation Fv#2 | VH3\|3-73/D3\|3-3\|RF3/JH4 | HGN...NS................Y.S.WA. | 3798 |
| MA_81-F9_CCx_I2C0x_scFc_(I6I)_translation Fv#2 | VH3\|3-73/D3\|3-3\|RF3/JH4 | HGN...NS................Y.S.WA. | 3799 |
| MA_81-H7_CC_xI2C0x_scFc_(M5O)_translation Fv#2 | VH3\|3-73/D3\|3-3\|RF3/JH4 | HGN...NS................Y.S.WA. | 3800 |
| MA_82-B5_CCx I2C0x_scFc_(B3K)_translation Fv#2 | VH3\|3-73/D3\|3-3\|RF3/JH4 | HGN...NS................Y.S.WA. | 3801 |
| MA_89-B2_CCx I2C0x_scFc_(N1M)_translation Fv#2 | VH3\|3-73/D3\|3-3\|RF3/JH4 | HGN...NS................Y.S.WA. | 3802 |

TABLE 37-continued

BiTE-scFc_Variable Region Consensus Protein Alignment (MAGEB2)
CDRs defined by Kabat
Alignment numbering defined by Amgen Reference (AHo)

| | | | |
|---|---|---|---|
| MA_89-D12_CCx_I2C0x_scFc_(Y4C)_translation Fv#2 | VH3\|3-73/D3\|3-3\|RF3/JH4 | HGN..NS................Y.S.WA. | 3803 |
| MA_93-B11_CCx_I2C0x_scFc_(N7N)_translation Fv#2 | VH3\|3-73/D3\|3-3\|RF3/JH4 | HGN..NS................Y.S.WA. | 3804 |
| VH3\|3-15/D3\|3-10\|RF2/JH6 | | YYYGSGSYYN----------YYYYYGMDV | 3805 |
| MA_79-H7_CCx_I2C0x_scFc_(Q4C)_translation Fv#1 | VH3\|3-15/D3\|3-10\|RF2/JH6 | PS.SGSY.--............-N.FSV... | 3806 |
| VH4\|4-59/D3\|3-3\|RF3/JH4 | | ITIFGVV----------------IIYFDY | 3807 |
| MA_81-E7_CCx_I2C0x_scFc_(O8Y)_translation Fv#1 | VH4\|4-59/D3\|3-3\|RF3/JH4 | GIFGVI-................-T.... | 3808 |
| VH2\|2-05/D2\|2-15\|RF1/JH5 | | RIL*WW*L--------------LLNWEDP | 3809 |
| MA_81-F9_CCx_I2C0x_scFc_(I6I)_translation Fv#1 | VH2\|2-05/D2\|2-15\|RF1/JH5 | .RYN.NY-................-E..... | 3810 |
| VH4\|4-30.1/D3\|3-10\|RF3/JH6 | | ITMVRGVII-----------YYYYYGMDV | 3811 |
| MA_81-H7_CC_xI2C0x_scFc_(M5O)_translation Fv#1 | VH4\|4-30.1/D3\|3-10\|RF3/JH6 | EK.WF..L-..............-N....... | 3812 |
| VH3\|3-23/D6\|6-19\|RF2/JH4 | | GIAVA--------------------GYFDY | 3813 |
| MA_82-B5_CCx_I2C0x_scFc_(B3K)_translation Fv#1 | VH3\|3-23/D6\|6-19\|RF2/JH4 | .KG.H....................LG... | 3814 |
| VH3\|3-23/D6\|6-19\|RF1/JH6 | | GYSSGWYY--------------YYYYYGMDV | 3815 |
| MA_89-B2_CCx_I2C0x_scFc_(N1M)_translation Fv#1 | VH3\|3-23/D6\|6-19\|RF1/JH6 | DGG...FPK.............LLH..L... | 3816 |
| VH3\|3-30.3/D1\|1-1\|RF2/JH4 | | VQLER--------------------YFDY | 3817 |
| MA_89-D12_CCx_I2C0x_scFc_(Y4C)_translation Fv#1 | VH3\|3-30.3/D1\|1-1\|RF2/JH4 | G..L-......................-TG. | 3818 |
| VH3\|3-11/D1\|1-1\|RF3/JH4 | | YNWND--------------------YFDY | 3819 |
| MA_93-B11_CCx_I2C0x_scFc_(N7N)_translation Fv#1 | VH3\|3-11/D1\|1-1\|RF3/JH4 | ..YG-......................H... | 3820 |
| | | H_FR4 | |
| VH1\|1-18/D6\|6-13\|RF2/JH4 | | WGQGTLVTVSS | 3847 |
| MA_79-G12_CC_x_I2C0x_scFc_(K1F)_translation Fv#1 | VH1\|1-18/D6\|6-13\|RF2/JH4 | ........... | 3848 |
| VH3\|3-73/D3\|3-3\|RF3/JH4 | | WGQGTLVTVSS | 3849 |
| MA_79-G12_CC_x_I2C0x_scFc_(K1F)_translation Fv#2 | VH3\|3-73/D3\|3-3\|RF3/JH4 | ........... | 3850 |

TABLE 37-continued

BiTE-scFc_Variable Region Consensus Protein Alignment (MAGEB2)
CDRs defined by Kabat
Alignment numbering defined by Amgen Reference (AHo)

| Name | V/D/J | Sequence | SEQ ID NO |
|---|---|---|---|
| MA_79-H7_CCx_I2C0x_scFc_(Q4C)_translation Fv#2 | VH3\|3-73/D3\|3-3\|RF3/JH4 | .......... | 3851 |
| MA_81-E7_CCx_I2C0x_scFc_(O8Y)_translation Fv#2 | VH3\|3-73/D3\|3-3\|RF3/JH4 | .......... | 3852 |
| MA_81-F9_CCx_I2C0x_scFc_(I6I)_translation Fv#2 | VH3\|3-73/D3\|3-3\|RF3/JH4 | .......... | 3853 |
| MA_81-H7_CC_xI2C0x_scFc_(M5O)_translation Fv#2 | VH3\|3-73/D3\|3-3\|RF3/JH4 | .......... | 3854 |
| MA_82-B5_CCx_I2C0x_scFc_(B3K)_translation Fv#2 | VH3\|3-73/D3\|3-3\|RF3/JH4 | .......... | 3855 |
| MA_89-B2_CCx_I2C0x_scFc_(N1M)_translation Fv#2 | VH3\|3-73/D3\|3-3\|RF3/JH4 | .......... | 3856 |
| MA_89-D12_CCx_I2C0x_scFc_(Y4C)_translation Fv#2 | VH3\|3-73/D3\|3-3\|RF3/JH4 | .......... | 3857 |
| MA_93-B11_CCx_I2C0x_scFc_(N7N)_translation Fv#2 | VH3\|3-73/D3\|3-3\|RF3/JH4 | .......... | 3858 |
| VH3\|3-15/D3\|3-10\|RF2/JH6 | | WGQGTTVTVSS | 3859 |
| MA_79-H7_CCx_I2C0x_scFc_(Q4C)_translation Fv#1 | VH3\|3-15/D3\|3-10\|RF2/JH6 | .......... | 3860 |
| VH4\|4-59/D3\|3-3\|RF3/JH4 | | WGQGTLVTVSS | 3861 |
| MA_81-E7_CCx_I2C0x_scFc_(O8Y)_translation Fv#1 | VH4\|4-59/D3\|3-3\|RF3/JH4 | .......... | 3862 |
| VH2\|2-05/D2\|2-15\|RF1/JH5 | | WGQGTLVTVSS | 3863 |
| MA_81-F9_CCx_I2C0x_scFc_(I6I)_translation Fv#1 | VH2\|2-05/D2\|2-15\|RF1/JH5 | .......... | 3864 |
| VH4\|4-30.1/D3\|3-10\|RF3/JH6 | | WGQGTTVTVSS | 3865 |
| MA_81-H7_CC_xI2C0x_scFc_(M5O)_translation Fv#1 | VH4\|4-30.1/D3\|3-10\|RF3/JH6 | .......... | 3866 |
| VH3\|3-23/D6\|6-19\|RF2/JH4 | | WGQGTLVTVSS | 3867 |
| MA_82-B5_CCx_I2C0x_scFc_(B3K)_translation Fv#1 | VH3\|3-23/D6\|6-19\|RF2/JH4 | .......... | 3868 |
| VH3\|3-23/D6\|6-19\|RF1/JH6 | | WGQGTTVTVSS | 3869 |
| MA_89-B2_CCx_I2C0x_scFc_(N1M)_translation Fv#1 | VH3\|3-23/D6\|6-19\|RF1/JH6 | .......... | 3870 |

TABLE 37-continued

BiTE-scFc_Variable Region Consensus Protein Alignment (MAGEB2)
CDRs defined by Kabat
Alignment numbering defined by Amgen Reference (AHo)

| | | | |
|---|---|---|---|
| VH3\|3-30.3/D1\|1-1\|RF2/JH4 | | WGQGTLVTVSS | 3871 |
| MA_89-D12_CCx_I2C0x_scFc_(Y4C)_translation Fv#1 | VH3\|3-30.3/D1\|1-1\|RF2/JH4 | .......... | 3872 |
| VH3\|3-11/D1\|1-1\|RF3/JH4 | | WGQGTLVTVSS | 3873 |
| MA_93-B11_CCx_I2C0x_scFc_(N7N)_translation Fv#1 | VH3\|3-11/D1\|1-1\|RF3/JH4 | .......... | 3874 |

TABLE 38

BiTE-scFc_Full Sequences

| Ab | Type | BITE_scFc |
|---|---|---|
| MA_12-E12_CCx_I2C0_x_scFc_(J7J)_translation | NA<br>AA | No nuc. seq available<br>MDMRVPAQLLGLLLLWLRGARCEVQLVESGGGLVKPGGSLRLSCAASGFTFSTYSMNWVRQAPGKCLEW VSSISSSSSYIYYADSVKGRFTISRDNAKNSLYLQMNSLRDEDTAVYYCARDRIAVTYFDNWGQGTLVT VSSGGGGSGGGGSGGGGSEIVLTQSPGTLSLSPGERATLSCRASQSVSSSYLAWYQQKPGQAPRLLIYG ASSRATGIPDRFSGSGSGTDFTLTISRLEPEDFAVYYCQQYANSPLTFGCGTKVEIKSGGGGSEVQLVE SGGGLVQPGGSLKLSCAASGFTENKYAMNWVRQAPGKGLEWVARIRSKYNNYATYYADSVKDRFTISRD DSKNTAYLQMNNLKTEDTAVYYCVRHGNFGNSYISYWAYWGQGTLVTVSSGGGGSGGGGSGGGGSQTVV TQEPSLTVSPGGTVTLTCGSSTGAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCPPCPAPELLGGPSVFLFPPKPKD TLMISRTPEVTCVVVDVSHEDPEVKFNWYVDGVEVHNAKTKPCEEQYGSTYRCVSVLTVLHQDWLNGKE YKCKVSNKALPAPIEKTISKAKGQPREPQVYTLPPSREEMTKNQVSLTCLVKGFYPSDIAVEWESNGQP ENNYKTTPPVLDSDGSFFLYSKLTVDKSRWQQGNVFSCSVMHEALHNHYTQKSLSLSPGKGGGGSGGGG SGGGGSGGGGSGGGGSGGGGSDKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGK<br>(SEQ ID NO: 3875) |
| MA_13-D12_CCx_I2C0_x_scFc_(S4S)_translation | NA<br>AA | No nuc. seq available<br>MDMRVPAQLLGLLLLWLRGARCQVQLVESGGGVVQPGRSLRLSCAASGFTFSSYGMHWVRQAPGKCLEW VALISYDGSSKYYADSVKGRFTISRDNSKNTLDLQMNSLRAEDTAVYYCARSPYDYVWGSYRNYYYGMD VWGQGTTVTVSSGGGGSGGGGSGGGGSQAVVTQEPSLTVSPGGTVTLTCGSSTGAVTSGHYPYWFQQKP GQAPRTLIYDTSNKHSWTPARFSGSLLGGKAALTLSGAQPEDEAEYYCFLSYSGARNWVFGCGTKLTVL SGGGGSEVQLVESGGGLVQPGGSLKLSCAASGFTENKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSSGGGGSGG GGSGGGGSQTVVTQEPSLTVSPGGTVTLTCGSSTGAVTSGNYPNWVQQKPGQAPRGLIGGTKFLAPGTP ARFSGSLLGGKAALTLSGVQPEDEAEYYCVLWYSNRWVFGGGTKLTVLGGGGDKTHTCPPCPAPELLGG PSVFLFPPKPKDTLMISRTPEVTCVVVDVSHEDPEVKFNWYVDGVEVHNAKTKPCEEQYGSTYRCVSVL TVLHQDWLNGKEYKCKVSNKALPAPIEKTISKAKGQPREPQVYTLPPSREEMTKNQVSLTCLVKGFYPS DIAVEWESNGQPENNYKTTPPVLDSDGSFFLYSKLTVDKSRWQQGNVFSCSVMHEALHNHYTQKSLSLS PGKGGGGSGGGGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNK ALPAPIEKTISKAKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGK<br>(SEQ ID NO: 3876) |
| MA_24-C9_CCx_I2C0x_scFc_(M6S)_translation | NA<br>AA | No nuc. seq available<br>MDMRVPAQLLGLLLLWLRGARCEVQLLEQSGPELVKPGASVKISCKASGYAFSKSWMNWVKQRPGKCLE WIGRIYPGDGDTNYNGKFKGKAALTADKSSNTANMQLNSLTSEDSAVYFCARDGVFYAPLAYWGQGTLV TVSSGGGGSGGGGSGGGGSELVMTQSPSSLAVSVGEKITMSCKSSQSLLYSSNQKNYLAWYQQKPGQSP KLLIYWASTRESGVPDRFTGSGSGTDFTLTISSVKAEDLAVYYCQQYYSYPYTFGCGTKLELKSGGGGS EVQLVESGGGLVQPGGSLKLSCAASGFTENKYAMNWVRQAPGKGLEWVARIRSKYNNYATYYADSVKDR FTISRDDSKNTAYLQMNNLKTEDTAVYYCVRHGNEGNSYISYWAYWGQGTLVTVSSGGGGSGGGGSGGG GSQTVVTQEPSLTVSPGGTVTLTCGSSTGAVTSGNYPNWVQQKPGQAPRGLIGGTKFLAPGTPARFSGS LLGGKAALTLSGVQPEDEAEYYCVLWYSNRWVFGGGTKLTVLGGGGDKTHTCPPCPAPELLGGPSVFLF PPKPKDTLMISRTPEVTCVVVDVSHEDPEVKFNWYVDGVEVHNAKTKPCEEQYGSTYRCVSVLTVLHQD WLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGKGGG GSGGGGSGGGGSGGGGSGGGGSGGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKTTPPVLDS DGSFFLYSKLTVDKSRWQQGNVFSCSVMHEALHNHYTQKSLSLSPGK<br>(SEQ ID NO: 3878) |

TABLE 38-continued

BiTE-scFc_Full Sequences

| Ab | Type | BITE_scFc |
|---|---|---|
| MA_24-G6_CCx_I2C0_x_scFc_(M9Z)_translation | NA<br>AA | No nuc. seq available<br>MDMRVPAQLLGLLLLWLRGARCEVQLLEQSGPELVKPGASVKISCKASDYTESKSWMNWVKQRPGECLE<br>WIGRVWPGDGDTTYNEKEKGKATLTADKSSRTAYMQLSSLTSEDSAVYFCARGNYFGSSEAYFDYWGQG<br>TRVTVSSGGGGSGGGGSGGGGSELVLTQSPAIMSASPGQKVTITCSASSNVNYIHWYQQKLGSSPKLWI<br>YDTSKLAPGVPARFSGSGSGTSYSLTISSMEAEDAASYFCHQWSSYPPTFGCGTKLEIKSGGGGSEVQL<br>VESGGGLVQPGGSLKLSCAASGFTFNKYAMNWVRQAPGKGLEWVARIRSKYNNYATYYADSVKDRFTIS<br>RDDSKNTAYLQMNNLKTEDTAVYYCVRHGNFGNSYISYWAYWGQGTLLVTVSSGGGGSGGGGSGGGGSQ<br>TVVTQEPSLTVSPGGTVTLTCGSSTGAVTSGNYPNWVQQKPGQAPRGLIGGTKFLAPGTPARFSGSLLG<br>GKAALTLSGVQPEDEAEYYCVLWYSNRWVFGGGTKLTVLGGGGDKTHTCPPCPAPELLGGPSVFLFPPK<br>PKDTLMISRTPEVTCVVVDVSHEDPEVKFNWYVDGVEVHNAKTKPCEEQYGSTYRCVSVLTVLHQDWLN<br>GKEYKCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGKGGGGSG<br>GGGSGGGGSGGGGSGGGGSGGGGSDKTHTCPPCPAPELLGGPSVFLFPPKPKDTLMISRTPEVTCVVVD<br>VSHEDPEVKENWYVDGVEVHNAKTKPCEEQYGSTYRCVSVLTVLHQDWLNGKEYKCKVSNKALPAPIEK<br>TISKAKGQPREPQVYTLPPSREEMTKNQVSLTCLVKGFYPSDIAVEWESNGQPENNYKTTPPVLDSDGS<br>FFLYSKLTVDKSRWQQGNVESCSVMHEALHNHYTQKSLSLSPGK<br>(SEQ ID NO: 3879) |
| MA_31-H8_CCx_I2C0_x_scFc_(F3H)_translation | NA<br>AA | No nuc. seq available<br>MDMRVPAQLLGLLLLWLRGARCEVQLLEQSGPELVKPGASVKISCKASGYAFSSSSWMNWVKQRPGKCLE<br>WIGRIYPGDGDTNYNGKFKDKATLTADKSSNTAYMQLSSLTSEDSAVYFCARRQLNHVEAMDYWGQGTS<br>VTVSSGGGGSGGGGSGGGGSELQMTQSPASLSASVGETVTITCRASGNIHNYLAWYQQKQGKSPQLLVY<br>NAKTLAGGVPSRESGSGSGTQFSLKINSLQPEDFGSYYCQHHYGTPLTFGCGTKLELKSGGGGSEVQLV<br>ESGGGLVQPGGSLKLSCAASGFTENKYAMNWVRQAPGKGLEWVARIRSKYNNYATYYADSVKDRFTISR<br>DDSKNTAYLQMNNLKTEDTAVYYCVRHGNFGNSYISYWAYWGQGTLVTVSSGGGGSGGGGSGGGGSQTV<br>VTQEPSLTVSPGGTVTLTCGSSTGAVTSGNYPNWVQQKPGQAPRGLIGGTKFLAPGTPARFSGSLLGGK<br>AALTLSGVQPEDEAEYYCVLWYSNRWVFGGGTKLTVLGGGGDKTHTCPPCPAPELLGGPSVFLFPPKPK<br>DTLMISRTPEVTCVVVDVSHEDPEVKENWYVDGVEVHNAKTKPCEEQYGSTYRCVSVLTVLHQDWLNGK<br>EYKCKVSNKALPAPIEKTISKAKGQPREPQVYTLPPSREEMTKNQVSLTCLVKGFYPSDIAVEWESNGQ<br>PENNYKTTPPVLDSDGSFFLYSKLTVDKSRWQQGNVFSCSVMHEALHNHYTQKSLSLSPGKGGGGSGGG<br>GSGGGGSGGGGSGGGGSDKTHTCPPCPAPELLGGPSVFLFPPKPKDTLMISRTPEVTCVVVDVS<br>HEDPEVKENWYVDGVEVHNAKTKPCEEQYGSTYRCVSVLTVLHQDWLNGKEYKCKVSNKALPAPIEKTI<br>SKAKGQPREPQVYTLPPSREEMTKNQVSLTCLVKGFYPSDIAVEWESNGQPENNYKTTPPVLDSDGSFF<br>LYSKLTVDKSRWQQGNVESCSVMHEALHNHYTQKSLSLSPGK<br>(SEQ ID NO: 3880) |
| MA_32-A8_CCx_I2C0_x_scFc_(J6Z)_translation | NA<br>AA | No nuc. seq available<br>MDMRVPAQLLGLLLLWLRGARCQVQLVQSGAEVKKPGASVKVSCKASGYTFTSYDINWVRQATGQCLEW<br>MGWMNPNSGNTGYAQKFQGRVTMTRNTSISTAYMELSSLRSEDTAVYYCARGGGYSNGYDYGMDVWGQG<br>TTVTVSSGGGGSGGGGSGGGGSDIVMTQSPLSLPVSPGEPASISCRSSQSLLYSNGYNYVDWYLQKPGQ<br>SPQLLIYLGSNRASGVPDRESGSGSGTDFTLKISKVEAEDVGVYYCMQALQTPPTFGCGTRLEIKSGGG<br>GSEVQLVESGGGLVQPGGSLKLSCAASGFTENKYAMNWVRQAPGKGLEWVARIRSKYNNYATYYADSVK<br>DRFTISRDDSKNTAYLQMNNLKTEDTAVYYCVRHGNEGNSYISYWAYWGQGTLVTVSSGGGGSGGGGS<br>GGGSQTVVTQEPSLTVSPGGTVTLTCGSSTGAVTSGNYPNWVQQKPGQAPRGLIGGTKFLAPGTPARFS<br>GSLLGGKAALTLSGVQPEDEAEYYCVLWYSNRWVFGGGTKLTVLGGGGDKTHTCPPCPAPELLGGPSVF<br>LFPPKPKDTLMISRTPEVTCVVVDVSHEDPEVKENWYVDGVEVHNAKTKPCEEQYGSTYRCVSVLTVLH<br>QDWLNGKEYKCKVSNKALPAPIEKTISKAKGQPREPQVYTLPPSREEMTKNQVSLTCLVKGFYPSDIAV<br>EWESNGQPENNYKTTPPVLDSDGSFFLYSKLTVDKSRWQQGNVFSCSVMHEALHNHYTQKSLSLSPGKG<br>GGGSGGGGSGGGGSGGGGSGGGGSDKTHTCPPCPAPELLGGPSVFLFPPKPKDTLMISRTPEVT<br>CVVVDVSHEDPEVKENWYVDGVEVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSDIAVEWESNGQPENNYKTTPPVL<br>DSDGSFFLYSKLTVDKSRWQQGNVFSCSVMHEALHNHYTQKSLSLSPGK<br>(SEQ ID NO: 3881) |
| MA_32-C3_CCx_I2C0x_scFc_(L2A)_translation | NA<br>AA | No nuc. seq available<br>MDMRVPAQLLGLLLLWLRGARCQVQLQQWGAGMLKPSETLSLTCAVYGGSFSGYYWNWIRQPPGKCLEW<br>IGEINHSGSTNYNPSLKSRVTISVDTSKNQFSLKLSSVTAADTAVYYCARGGGYSYGYDYGMDVWGQGT<br>TVTVSSGGGGGGGSGGGGSDIVMTQSPLSLPVTPGEPASISCRSSQSLLYSNGYNYLDWYLQKPGQSP<br>QLLIYLGSNRASGVPDRFSGSGSGTDFTLKISRVEAEDVGVYYCMQALQTPPTFGCGTKVDIKSGGGGS<br>EVQLVESGGGLVQPGGSLKLSCAASGFTENKYAMNWVRQAPGKGLEWVARIRSKYNNYATYYADSVKDR<br>FTISRDDSKNTAYLQMNNLKTEDTAVYYCVRHGNEGNSYISYWAYWGQGTLVTVSSGGGGSGGGGSGGG<br>GSQTVVTQEPSLTVSPGGTVTLTCGSSTGAVTSGNYPNWVQQKPGQAPRGLIGGTKFLAPGTPARFSGS<br>LLGGKAALTLSGVQPEDEAEYYCVLWYSNRWVFGGGTKLTVLGGGGDKTHTCPPCPAPELLGGPSVFLF<br>PPKPKDTLMISRTPEVTCVVVDVSHEDPEVKENWYVDGVEVHNAKTKPCEEQYGSTYRCVSVLTVLHQD<br>WLNGKEYKCKVSNKALPAPIEKTISKAKGQPREPQVYTLPPSREEMTKNQVSLTCLVKGFYPSDIAVEW<br>ESNGQPENNYKTTPPVLDSDGSFFLYSKLTVDKSRWQQGNVFSCSVMHEALHNHYTQKSLSLSPGKGGG<br>GSGGGGSGGGGSGGGGSGGGGSDKTHTCPPCPAPELLGGPSVFLFPPKPKDTLMISRTPEVTCV<br>VVDVSHEDPEVKENWYVDGVEVHNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK<br>(SEQ ID NO: ***) |

TABLE 38-continued

| | | BiTE-scFc_Full Sequences |
|---|---|---|
| Ab | Type | BITE_scFc |
| MA_48-D12_CCx_I2C0x_<br>scFc_(B4P)_translation | NA | No nuc. seq available<br>(SEQ ID NO: ***) |
| | AA | MDMRVPAQLLGLLLLWLRGARCQVQLVESGGGVVQPGRSLRLSCAASGFTFRSYRMHWVRQAPGKCLEW<br>VAVISYDGGNKYYADSVKGRFTISRDNSKNTLYLQMNSLRAEDTAVYYCAREQWPNYYYGMDVWGQGTT<br>VTVSSGGGGSGGGGSGGGGSEIVLTQSPGTLSLSPGERATLSCRASQSVSSSYLAWYQQKPGQAPRLLI<br>YGASSRATGIPDRESGSGSGTDFTLTISRLEPEDFAVYYCQQYGSSPLTFGCGTKLEIKSGGGGSEVQL<br>VESGGGLVQPGGSLKLSCAASGFTFNKYAMNWVRQAPGKGLEWVARIRSKYNNYATYYADSVKDRFTIS<br>RDDSKNTAYLQMNNLKTEDTAVYYCVRHGNEGNSYISYWAYWGQGTLVTVSSGGGGSGGGGSGGGGSQT<br>VVTQEPSLTVSPGGTVTLTCGSSTGAVTSGNYPNWVQQKPGQAPRGLIGGTKFLAPGTPARFSGSLLGG<br>KAALTLSGVQPEDEAEYYCVLWYSNRWVFGGGTKLTVLGGGGDKTHTCPPCPAPELLGGPSVFLPPPKP<br>KDTLMISRTPEVTCVVVDVSHEDPEVKFNWYVDGVEVHNAKTKPCEEQYGSTYRCVSVLTVLHQDWLNG<br>KEYKCKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGKGGGGSGG<br>GGSGGGGSGGGGSGGGGSGGGGSDKTHTCPPCPAPELLGGPSVFLPPPKPKDTLMISRTPEVTCVVVDV<br>SHEDPEVKFNWYVDGVEVHNAKTKPCEEQYGSTYRCVSVLTVLHQDWLNGKEYKCKVSNKALPAPIEKT<br>ISKAKGQPREPQVYTLPPSREEMTKNQVSLTCLVKGFYPSDIAVEWESNGQPENNYKTTPPVLDSDGSF<br>FLYSKLTVDKSRWQQGNVFSCSVMHEALHNHYTQKSLSLSPGK<br>(SEQ ID NO: 3882) |

TABLE 39

| | | BiTE-ScFc_Fv#1 (MAGEB2) VL CDRs | | |
|---|---|---|---|---|
| Ab | Type | CDR1 | CDR2 | CDR3 |
| MA_12-E12_CCx_I2C0_x_scFc_<br>(J7J)_translation | NA | No nuc. seq<br>available | No nuc. seq available | No nuc. seq available |
| | AA | RASQSVSSSYLA<br>(SEQ ID NO: 3883) | GASSRAT<br>(SEQ ID NO: 3915) | QQYANSPLT<br>(SEQ ID NO: 3947) |
| MA_13-D12_CCx_I2C0_x_scFc_<br>(S4S)_translation | NA | No nuc. seq<br>available | No nuc. seq available | No nuc. seq available |
| | AA | GSSTGAVTSGHYPY<br>(SEQ ID NO: 3884) | DTSNKHS<br>(SEQ ID NO: 3916) | FLSYSGARNWV<br>(SEQ ID NO: 3948) |
| MA_24-C9_CCx_I2C0x_scFc_<br>(M6S)_translation | NA | No nuc. seq<br>available | No nuc. seq available | No nuc. seq available |
| | AA | KSSQSLLYSSNQKNYLA<br>(SEQ ID NO: 3885) | WASTRES<br>(SEQ ID NO: 3917) | QQYYSYPYT<br>(SEQ ID NO: 3949) |
| MA_24-G6_CCx_I2C0x_scFc_<br>(M9Z)_translation | NA | No nuc. seq<br>available | No nuc. seq available | No nuc. seq available |
| | AA | SASSNVNYIH<br>(SEQ ID NO: 3886) | DTSKLAP<br>(SEQ ID NO: 3918) | HQWSSYPPT<br>(SEQ ID NO: 3950) |
| MA_31-H8_CCx_I2C0_x_scFc_<br>(F3H)_translation | NA | No nuc. seq<br>available | No nuc. seq available | No nuc. seq available |
| | AA | RASGNIHNYLA<br>(SEQ ID NO: 3887) | NAKTLAG<br>(SEQ ID NO: 3919) | QHHYGTPLT<br>(SEQ ID NO: 3951) |
| MA_32-A8_CCx_I2C0_x_scFc<br>(J6Z)_translation | NA | No nuc. seq<br>available | No nuc. seq available | No nuc. seq available |
| | AA | RSSQSLLYSNGYNYVD<br>(SEQ ID NO: 3888) | LGSNRAS<br>(SEQ ID NO: 3920) | MQALQTPPT<br>(SEQ ID NO: 3952) |
| MA_32-C3_CCx_I2C0x_scFc_<br>(L2A)_translation | NA | No nuc. seq<br>available | No nuc. seq available | No nuc. seq available |
| | AA | RSSQSLLYSNGYNYLD<br>(SEQ ID NO: 3889) | LGSNRAS<br>(SEQ ID NO: 3921) | MQALQTPPT<br>(SEQ ID NO: 3953) |
| MA_48-D12_CCx_I2C0x_scFc_<br>(B4P)_translation | NA | No nuc. seq<br>available | No nuc. seq available | No nuc. seq available |
| | AA | RASQSVSSSYLA<br>(SEQ ID NO: 3890) | GASSRAT<br>(SEQ ID NO: 3922) | QQYGSSPLT<br>(SEQ ID NO: 3954) |

TABLE 40

BiTE-scFc_Fv#1 (MAGEB2) VH CDRs

| Ab | Type | CDR1 | CDR2 | CDR3 |
|---|---|---|---|---|
| MA_12-E12_CCx_I2C0_x_scFc_(J7J)_translation | NA AA | No nuc. seq available TYSMN (SEQ ID NO: 3891) | No nuc. seq available SISSSSSYIYYADSVKG (SEQ ID NO: 3923) | No nuc. seq available DRIAVATYFDN (SEQ ID NO: 3955) |
| MA_13-D12_CCx_I2C0_x_scFc_(S4S)_translation | NA AA | No nuc. seq available SYGMH (SEQ ID NO: 3892) | No nuc. seq available LISYDGSSKYYADSVKG (SEQ ID NO: 3924) | No nuc. seq available PYDYVWGSYRNYYYGMDV (SEQ ID NO: 3956) |
| MA_24-C9_CCx_I2C0x_scFc_(M6S)_translation | NA AA | No nuc. seq available KSWMN (SEQ ID NO: 3893) | No nuc. seq available RIYPGDGDTNYNGKFKG (SEQ ID NO: 3925) | No nuc. seq available DGVFYAPLAY (SEQ ID NO: 3957) |
| MA_24-G6_CCx_I2C0_x_scFc_(M9Z)_translation | NA AA | No nuc. seq available KSWMN (SEQ ID NO: 3894) | No nuc. seq available RVWPGDGDTTYNEKFKG (SEQ ID NO: 3926) | No nuc. seq available GNYFGSSEAYEDY (SEQ ID NO: 3958) |
| MA_31-H8_CCx_I2C0_x_scFc_(F3H)_translation | NA AA | No nuc. seq available SSWMN (SEQ ID NO: 3895) | No nuc. seq available RIYPGDGDTNYNGKFKD (SEQ ID NO: 3927) | No nuc. seq available ROLNHVFAMDY (SEQ ID NO: 3959) |
| MA_32-A8_CCx_I2C0_x_scFc_(J6Z)_translation | NA AA | No nuc. seq available SYDIN (SEQ ID NO: 3896) | No nuc. seq available WMNPNSGNTGYAQKFQG (SEQ ID NO: 3928) | No nuc. seq available GGGYSNGYDYGMDV (SEQ ID NO: 3960) |
| MA_32-C3_CCx_I2C0x_scFc_(L2A)_translation | NA AA | No nuc. seq available GYYWN (SEQ ID NO: 3897) | No nuc. seq available EINHSGSTNYNPSLKS (SEQ ID NO: 3929) | No nuc. seq available GGGYSYGYDYGMDV (SEQ ID NO: 3961) |
| MA_48-D12_CCx_I2C0x_scFc_(B4P)_translation | NA AA | No nuc. seq available SYRMH (SEQ ID NO: 3898) | No nuc. seq available VISYDGGNKYYADSVKG (SEQ ID NO: 3930) | No nuc. seq available EQWPNYYYGMDV (SEQ ID NO: 3962) |

TABLE 41

BiTE-scFc_Fv#2 (CD3) VL CDRs

| Ab | Type | CDR1 | CDR2 | CDR3 |
|---|---|---|---|---|
| MA_12-E12_CCx_I2C0_x_scFc_(J7J)_translation | NA AA | No nuc. seq available GSSTGAVTSGNYPN (SEQ ID NO: 3899) | No nuc. seq available GTKFLAP (SEQ ID NO: 3931) | No nuc. seq available VLWYSNRWV (SEQ ID NO: 3963) |
| MA_13-D12_CCx_I2C0_x_scFc_(S4S)_translation | NA AA | No nuc. seq available GSSTGAVTSGNYPN (SEQ ID NO: 3900) | No nuc. seq available GTKFLAP (SEQ ID NO: 3932) | No nuc. seq available VLWYSNRWV (SEQ ID NO: 3964) |
| MA_24-C9_CCx_I2C0x_scFc_(M6S)_translation | NA AA | No nuc. seq available GSSTGAVTSGNYPN (SEQ ID NO: 3901) | No nuc. seq available GTKFLAP (SEQ ID NO: 3933) | No nuc. seq available VLWYSNRWV (SEQ ID NO: 3965) |
| MA_24-G6_CCx_I2C0_x_scFc_(M9Z)_translation | NA AA | No nuc. seq available GSSTGAVTSGNYPN (SEQ ID NO: 3902) | No nuc. seq available GTKFLAP (SEQ ID NO: 3934) | No nuc. seq available VLWYSNRWV (SEQ ID NO: 3966) |
| MA_31-H8_CCx_I2C0_x_scFc_(F3H)_translation | NA AA | No nuc. seq available GSSTGAVTSGNYPN (SEQ ID NO: 3903) | No nuc. seq available GTKFLAP (SEQ ID NO: 3935) | No nuc. seq available VLWYSNRWV (SEQ ID NO: 3967) |
| MA_32-A8_CCx_I2C0_x_scFc_(J6Z)_translation | NA AA | No nuc. seq available GSSTGAVTSGNYPN (SEQ ID NO: 3904) | No nuc. seq available GTKFLAP (SEQ ID NO: 3936) | No nuc. seq available VLWYSNRWV (SEQ ID NO: 3968) |
| MA_32-C3_CCx_I2C0x_scFc_(L2A)_translation | NA AA | No nuc. seq available GSSTGAVTSGNYPN (SEQ ID NO: 3905) | No nuc. seq available GTKFLAP (SEQ ID NO: 3937) | No nuc. seq available VLWYSNRWV (SEQ ID NO: 3969) |
| MA_48-D12_CCx_I2C0x_scFc_(B4P)_translation | NA AA | No nuc. seq available GSSTGAVTSGNYPN (SEQ ID NO: 3906) | No nuc. seq available GTKFLAP (SEQ ID NO: 3938) | No nuc. seq available VLWYSNRWV (SEQ ID NO: 3970) |

TABLE 42

BiTE-scFc Fv#2 (CD3) VH CDRs

| Ab | Type | CDR1 | CDR2 | CDR3 |
|---|---|---|---|---|
| MA_12-E12_CCx_I2C0_x_scFc_(J7J)_translation | NA AA | No nuc.seq available<br>KYAMN<br>(SEQ ID NO: 3907) | No nuc.seq available<br>RIRSKYNNYATYYADSVKD<br>(SEQ ID NO: 3939) | No nuc.seq available<br>HGNFGNSYISYWAY<br>(SEQ ID NO: 3971) |
| MA_13-D12_CCx_I2C0_x_scFc_(S4S)_translation | NA AA | No nuc.seq available<br>KYAMN<br>(SEQ ID NO: 3908) | No nuc.seq available<br>RIRSKYNNYATYYADSVKD<br>(SEQ ID NO: 3940) | No nuc.seq available<br>HGNFGNSYISYWAY<br>(SEQ ID NO: 3972) |
| MA_24-C9_CCx_I2C0x_scFc_(M6S)_translation | NA AA | No nuc.seq available<br>KYAMN<br>(SEQ ID NO: 3909) | No nuc.seq available<br>RIRSKYNNYATYYADSVKD<br>(SEQ ID NO: 3941) | No nuc.seq available<br>HGNFGNSYISYWAY<br>(SEQ ID NO: 3973) |
| MA_24-G6_CCx_I2C0_x_scFc_(M9Z)_translation | NA AA | No nuc.seq available<br>KYAMN<br>(SEQ ID NO: 3910) | No nuc.seq available<br>RIRSKYNNYATYYADSVKD<br>(SEQ ID NO: 3942) | No nuc.seq available<br>HGNFGNSYISYWAY<br>(SEQ ID NO: 3974) |
| MA_31-H8_CCx_I2C0_x_scFc_(F3H)_translation | NA AA | No nuc.seq available<br>KYAMN<br>(SEQ ID NO: 3911) | No nuc.seq available<br>RIRSKYNNYATYYADSVKD<br>(SEQ ID NO: 3943) | No nuc.seq available<br>HGNFGNSYISYWAY<br>(SEQ ID NO: 3975) |
| MA_32-A8_CCx_I2C0_x_scFc_(J6Z)_translation | NA AA | No nuc.seq available<br>KYAMN<br>(SEQ ID NO: 3912) | No nuc.seq available<br>RIRSKYNNYATYYADSVKD<br>(SEQ ID NO: 3944) | No nuc.seq available<br>HGNFGNSYISYWAY<br>(SEQ ID NO: 3976) |
| MA_32-C3_CCx_I2C0x_scFc_(L2A)_translation | NA AA | No nuc.seq available<br>KYAMN<br>(SEQ ID NO: 3913) | No nuc.seq available<br>RIRSKYNNYATYYADSVKD<br>(SEQ ID NO: 3945) | No nuc.seq available<br>HGNFGNSYISYWAY<br>(SEQ ID NO: 3977) |
| MA_48-D12_CCx_I2C0x_scFc_(B4P)_translation | NA AA | No nuc.seq available<br>KYAMN<br>(SEQ ID NO: 3914) | No nuc.seq available<br>RIRSKYNNYATYYADSVKD<br>(SEQ ID NO: 3946) | No nuc.seq available<br>HGNFGNSYISYWAY<br>(SEQ ID NO: 3978) |

TABLE 43

BiTE-scFc_Variable Region Sequences

| | | Fv#1 (MAGEB2) | |
|---|---|---|---|
| Ab | Type | LC V-region | HC V-region |
| MA_12-E12_CCx_I2C0_x_scFc_(J7J)_translation | NA AA | No nuc.seq available<br>EIVLTQSPGTLSLSPGERATLSCRASQ SVSSSYLAWYQQKPGQAPRLLYGASSR ATGIPDRESGSGSGTDFTLTISRLEPE DFAVYYCQQYANSPLTFGCGTKVEIK<br>(SEQ ID NO: 3979) | No nuc.seq available<br>EVQLVESGGGLVKPGGSLRLSCAASGFTFS TYSMNWVRQAPGKCLEWVSSISSSSSYIYY ADSVKGRFTISRDNAKNSLYLQMNSLRDED TAVYYCARDRIAVATYFDNWGQGTLVTVSS<br>(SEQ ID NO: 3987) |
| MA_13-D12_CCx_I2C0_x_scFc_(S4S)_translation | NA AA | No nuc.seq available<br>QAVVTQEPSLTVSPGGTVTLTCGSSTG AVTSGHYPYWFQQKPGQAPRTLIYDTS NKHSWTPARFSGSLLGGKAALTLSGAQ PEDEAEYYCFLSYSGARNWVFGCGTKL TVL<br>(SEQ ID NO: 3980) | No nuc.seq available<br>QVQLVESGGGVVQPGRSLRLSCAASGFTFS SYGMHWVRQAPGKCLEWVALISYDGSSKYY ADSVKGRFTISRDNSKNTLDLQMNSLRAED TAVYYCARSPYDYVWGSYRNYYYGMDVWGQ GTTVTVSS<br>(SEQ ID NO: 3988) |
| MA_24-C9_CCx_I2C0x_scFc_(M6S)_translation | NA AA | No nuc.seq available<br>ELVMTQSPSSLAVSVGEKITMSCKSSQ SLLYSSNQKNYLAWYQQKPGQSPKLLI YWASTRESGVPDRFTGSGSGTDFTLTI SSVKAEDLAVYYCQQYYSPYTFGCGTK LELK<br>(SEQ ID NO: 3981) | No nuc.seq available<br>VQLLEQSGPELVKPGASVKISCKASGYAFS KSWMNWVKQRPGKCLEWIGRIYPGDGDTNY NGKFKGKAALTADKSSNTANMQLNSLTSED SAVYFCARDGVFYAPLAYWGQGTLVTVSS<br>(SEQ ID NO: 3989) |
| MA_24-G6_CCx_I2C0_x_scFc_(M9Z)_translation | NA AA | No nuc.seq available<br>ELVLTQSPAIMSASPGQKVTITCSASS NVNYIHWYQQKLGSSPKLWIYDTSKLA PGVPARFSGSGSGTSYSLTISSMEAED AASYFCHQWSSYPPTFGCGTKLEIK<br>(SEQ ID NO: 3982) | No nuc.seq available<br>VQLLEQSGPELVKPGASVKISCKASDYTES KSWMNWVKQRPGECLEWIGRVWPGDGDTTY NEKFKGKATLTADKSSRTAYMQLSSLTSED SAVYFCARGNYFGSSEAYFDYWGQGTRVTV SS<br>(SEQ ID NO: 3990) |
| | NA | No nuc.seq available | |

TABLE 43-continued

BiTE-scFc_Variable Region Sequences

| | | | |
|---|---|---|---|
| H8_CCx_I2C0_x_scFc_(F3H)_ translation | AA | ELQMTQSPASLSASVGETVTITCRASGN IHNYLAWYQQKQGKSPQLLVYNAKTLAG GVPSRFSGSGSGTQFSLKINSLQPEDFG SYYCQHHYGTPLTFGCGTKLELK (SEQ ID NO: 3983) | VQLLEQSGPELVKPGASVKISCKASGYAFS SSWMNWVKQRPGKCLEWIGRIYPGDGTNY NGKFKDKATLTADKSSNTAYMQLSSLTSED SAVYFCARRQLNHVFAMDYWGQGTSVTVSS (SEQ ID NO: 3991) |
| MA_32-A8_CCx_I2C0_x_scFc_(J6Z)_ translation | NA AA | No nuc.seq available DIVMTQSPLSLPVSPGEPASISCRSSQS LLYSNGYNYVDWYLQKPGQSPQLLIYLG SNRASGVPDRFSGSGSGTDFTLKISKVE AEDGVVYYCMQALQTPPTFGCGTRLEIK (SEQ ID NO: 3984) | No nuc.seq available QVQLVQSGAEVVKKPGASVKVSCKASGYTFT SYDINWVRQATGQCLEWMGWMNPNSGNTGY AQKFQGRVTMTRNTSISTAYMELSSLRSED TAVYYCARGGGYSNGYDYGMDVWGQGTTVT VSS (SEQ ID NO: 3992) |
| MA_32-C3_CCx_I2C0x_scFc_(L2A)_ translation | NA AA | No nuc.seq available DIVMTQSPLSLPVTPGEPASISCRSSQS LLYSNGYNYLDWYLQKPGQSPQLLIYLG SNRASGVPDRFSGSGSGTDFTLKISRVE AEDGVVYYCMQALQTPPTFGCGTKVDIK (SEQ ID NO: 3985) | No nuc.seq available QVQLQQWGAGMLKPSETLSLTCAVYGGSFS GYYWNWIRQPPGKCLEWIGEINHSGSTNYN PSLKSRVTISVDTSKNQFSLKLSSVTAADT AVYYCARGGGYSYGYDYGMDVWGQGTTVTV SS (SEQ ID NO: 3993) |
| MA_48-D12_CCx_I2C0x_scFc_(B4P)_ translation | NA AA | No nuc.seq available EIVLTQSPGTLSLSPGERATLSCRASQS VSSSYLAWYQQKPGQAPRLLIYGASSRA TGIPDRESGSGSGTDFTLTISRLEPEDF AVYYCQQYGSSPLTFGCGTKLEIK (SEQ ID NO: 3986) | No nuc.seq available QVQLVESGGGVVQPGRSLRLSCAASGFTFR SYRMHWVRQAPGKCLEWVAVISYDGGNKYY ADSVKGRFTISRDNSKNTLYLQMNSLRAED TAVYYCAREQWPNYYYGMDVWGQGTTVTVS S (SEQ ID NO: 3994) |

| | | Fv#2 (CD3) | |
|---|---|---|---|
| Ab | Type | LC V-region | HC V-region |
| MA_12-E12_CCx_I2C0_x_scFc_(J7J)_ translation | NA AA | No nuc.seq available QTVVTQEPSLTVSPGGTVTLTCGSSTGA VTSGNYPNWVQQKPGQAPRGLIGGTKFL APGTPARFSGSLLGGKAALTLSGVQPED EAEYYCVLWYSNRWVFGGGTKLTVL (SEQ ID NO: 3995) | No nuc.seq available EVQLVESGGGLVQPGGSLKLSCAASGFTFN KYAMNWVRQAPGKGLEWVARIRSKYNNYAT YYADSVKDRFTISRDDSKNTAYLQMNNLKT EDTAVYYCVRHGNFGNSYISYWAYWGQGTL VTVSS (SEQ ID NO: 4003) |
| MA_13-D12_CCx_I2C0_x_scFc_(S4S)_ translation | NA AA | No nuc.seq available QTVVTQEPSLTVSPGGTVTLTCGSSTGA VTSGNYPNWVQQKPGQAPRGLIGGTKFL APGTPARFSGSLLGGKAALTLSGVQPED EAEYYCVLWYSNRWVFGGGTKLTVL (SEQ ID NO: 3996) | No nuc.seq available EVQLVESGGGLVQPGGSLKLSCAASGFTFN KYAMNWVRQAPGKGLEWVARIRSKYNNYAT YYADSVKDRFTISRDDSKNTAYLQMNNLKT EDTAVYYCVRHGNFGNSYISYWAYWGQGTL VTVSS (SEQ ID NO: 4004) |
| MA_24-C9_CCx_I2C0x_scFc_(M6S)_ translation | NA AA | No nuc.seq available QTVVTQEPSLTVSPGGTVTLTCGSSTGA VTSGNYPNWVQQKPGQAPRGLIGGTKFL APGTPARFSGSLLGGKAALTLSGVQPED EAEYYCVLWYSNRWVFGGGTKLTVL (SEQ ID NO: 3997) | No nuc.seq available EVQLVESGGGLVQPGGSLKLSCAASGFTFN KYAMNWVRQAPGKGLEWVARIRSKYNNYAT YYADSVKDRFTISRDDSKNTAYLQMNNLKT EDTAVYYCVRHGNFGNSYISYWAYWGQGTL VTVSS (SEQ ID NO: 4005) |
| MA_24-G6_CCx_I2C0_x_scFc_(M9Z)_ translation | NA AA | No nuc.seq available QTVVTQEPSLTVSPGGTVTLTCGSSTGA VTSGNYPNWVQQKPGQAPRGLIGGTKFL APGTPARFSGSLLGGKAALTLSGVQPED EAEYYCVLWYSNRWVFGGGTKLTVL (SEQ ID NO: 3998) | No nuc.seq available EVQLVESGGGLVQPGGSLKLSCAASGFTFN KYAMNWVRQAPGKGLEWVARIRSKYNNYAT YYADSVKDRFTISRDDSKNTAYLQMNNLKT EDTAVYYCVRHGNFGNSYISYWAYWGQGTL VTVSS (SEQ ID NO: 4006) |
| MA_31-H8_CCx_I2C0_x_scFc_(F3H)_ translation | NA AA | No nuc.seq available QTVVTQEPSLTVSPGGTVTLTCGSSTGA VTSGNYPNWVQQKPGQAPRGLIGGTKFL APGTPARFSGSLLGGKAALTLSGVQPED EAEYYCVLWYSNRWVFGGGTKLTVL (SEQ ID NO: 3999) | No nuc.seq available EVQLVESGGGLVQPGGSLKLSCAASGFTFN KYAMNWVRQAPGKGLEWVARIRSKYNNYAT YYADSVKDRFTISRDDSKNTAYLQMNNLKT EDTAVYYCVRHGNFGNSYISYWAYWGQGTL VTVSS (SEQ ID NO: 4007) |

TABLE 43-continued

BiTE-scFc_Variable Region Sequences

| | | | |
|---|---|---|---|
| MA_32-<br>A8_CCx_I2C0_x_scFc_(J6Z)_<br>translation | NA<br>AA | No nuc.seq available<br>QTVVTQEPSLTVSPGGTVTLTCGSSTGA<br>VTSGNYPNWVQQKPGQAPRGLIGGTKFL<br>APGTPARFSGSLLGGKAALTLSGVQPED<br>EAEYYCVLWYSNRWVFGGGTKLTVL<br>(SEQ ID NO: 4000) | EVQLVESGGGLVQPGGSLKLSCAASGFTFN<br>KYAMNWVRQAPGKGLEWVARIRSKYNNYAT<br>YYADSVKDRFTISRDDSKNTAYLQMNNLKT<br>EDTAVYYCVRHGNEGNSYISYWAYWGQGTL<br>VTVSS<br>(SEQ ID NO: 4008) |
| MA_32-<br>C3_CCx_I2C0x_scFc_(L2A)_<br>translation | NA<br>AA | No nuc.seq available<br>QTVVTQEPSLTVSPGGTVTLTCGSSTGA<br>VTSGNYPNWVQQKPGQAPRGLIGGTKFL<br>APGTPARFSGSLLGGKAALTLSGVQPED<br>EAEYYCVLWYSNRWVFGGGTKLTVL<br>(SEQ ID NO: 4001) | EVQLVESGGGLVQPGGSLKLSCAASGFTFN<br>KYAMNWVRQAPGKGLEWVARIRSKYNNYAT<br>YYADSVKDRFTISRDDSKNTAYLQMNNLKT<br>EDTAVYYCVRHGNFGNSYISYWAYWGQGTL<br>VTVSS<br>(SEQ ID NO: 4009) |
| MA_48-<br>D12_CCx_I2C0x_scFc_(B4P)_<br>translation | NA<br>AA | No nuc.seq available<br>QTVVTQEPSLTVSPGGTVTLTCGSSTGA<br>VTSGNYPNWVQQKPGQAPRGLIGGTKFL<br>APGTPARFSGSLLGGKAALTLSGVQPED<br>EAEYYCVLWYSNRWVFGGGTKLTVL<br>(SEQ ID NO: 4002) | No nuc.seq available<br>EVQLVESGGGLVQPGGSLKLSCAASGFTFN<br>KYAMNWVRQAPGKGLEWVARIRSKYNNYAT<br>YYADSVKDRFTISRDDSKNTAYLQMNNLKT<br>EDTAVYYCVRHGNFGNSYISYWAYWGQGTL<br>VTVSS<br>(SEQ ID NO: 4010) |

TABLE 44

BiTE-scFc_Variable Region Protein Alignment (MAGEB2)
CDRs defined by Kabat
Alignment numbering defined by Amgen Reference (AHo)

KAPPA_VARIABLE

| | Germline | | SEQ ID NO: |
|---|---|---|---|
| | | K_FR1 | |
| VK3\|A27/JK4 | | EIVLTQSPGTLSLSPGERATLSC | 4011 |
| MA_12-E12_CCx_I2C0_x_scFc_(J7J)_translation Fv#1 | VK3\|A27/JK4 | EIVLTQSPGTLSLSPGERATLSC | 4012 |
| VK4\|B3/JK2 | | DIVMTQSPDSLAVSLGERATINC | 4013 |
| MA_24-C9_CCx_I2C0x_scFc_(M6S)_translation Fv#1 | VK4\|B3/JK2 | ELVMTQSPSSLAVSVGEKITMSC | 4014 |
| VK6\|A10/JK2 | | EIVLTQSPDFQSVTPKEKVTITC | 4015 |
| MA_24-G6_CCx_I2C0_x_scFc_(M9Z)_translation Fv#1 | VK6\|A10/JK2 | ELVLTQSPAIMSASPGQKVTITC | 4016 |
| VK1\|L11/JK2 | | AIQMTQSPSSLSASVGDRVTITC | 4017 |
| MA_31-H8_CCx_I2C0_x_scFc_(F3H)_translation Fv#1 | VK1\|L11/JK2 | ELQMTQSPASLSASVGETVTITC | 4018 |
| VK2\|A19/JK5 | | DIVMTQSPLSLPVTPGEPASISC | 4019 |
| MA_32-A8_CCx_I2C0_x_scFc_(J6Z)_translation Fv#1 | VK2\|A19/JK5 | DIVMTQSPLSLPVSPGEPASISC | 4020 |
| VK2\|A19/JK3 | | DIVMTQSPLSLPVTPGEPASISC | 4021 |
| MA_32-C3_CCx_I2C0x_scFc_(L2A)_translation Fv#1 | VK2\|A19/JK3 | DIVMTQSPLSLPVTPGEPASISC | 4022 |
| VK3\|A27/JK2 | | EIVLTQSPGTLSLSPGERATLSC | 4023 |
| MA_48-D12_CCx_I2C0x_scFc_(B4P)_translation Fv#1 | VK3\|A27/JK2 | EIVLTQSPGTLSLSPGERATLSC | 4024 |
| | | K_CDR1 | |
| VK3\|A27/JK4 | | RAS--QSVSS-----SYLA | 4061 |
| MA_12-E12_CCx_I2C0_x_scFc_(J7J)_translation Fv#1 | VK3\|A27/JK4 | RAS--QSVSS-----SYLA | 4062 |
| VK4\|B3/JK2 | | KSS--QSVLYSSNNKNYLA | 4063 |
| MA_24-C9_CCx_I2C0x_scFc_(M6S)_translation Fv#1 | VK4\|B3/JK2 | KSS--QSLLYSSNQKNYLA | 4064 |
| VK6\|A10/JK2 | | RAS--QSIG------SSLH | 4065 |
| MA_24-G6_CCx_I2C0_x_scFc_(M9Z)_translation Fv#1 | VK6\|A10/JK2 | SAS--SNVN-------YIH | 4066 |
| VK1\|L11/JK2 | | RAS--QGIR------NDLG | 4067 |
| MA_31-H8_CCx_I2C0_x_scFc_(F3H)_translation Fv#1 | VK1\|L11/JK2 | RAS--GNIH------NYLA | 4068 |
| VK2\|A19/JK5 | | RSS--QSLLHSN-GYNYLD | 4069 |
| MA_32-A8_CCx_I2C0_x_scFc_(J6Z)_translation Fv#1 | VK2\|A19/JK5 | RSS--QSLLYSN-GYNYVD | 4070 |
| VK2\|A19/JK3 | | RSS--QSLLHSN-GYNYLD | 4071 |
| MA_32-C3_CCx_I2C0x_scFc_(L2A)_translation Fv#1 | VK2\|A19/JK3 | RSS--QSLLYSN-GYNYLD | 4072 |
| VK3\|A27/JK2 | | RAS--QSVSS-----SYLA | 4073 |
| MA_48-D12_CCx_I2C0x_scFc_(B4P)_translation Fv#1 | VK3\|A27/JK2 | RAS--QSVSS-----SYLA | 4074 |

TABLE 44-continued

BiTE-scFc_Variable Region Protein Alignment (MAGEB2)
CDRs defined by Kabat
Alignment numbering defined by Amgen Reference (AHo)

LAMBDA_VARIABLE

| Germline | | SEQ ID NO: |
|---|---|---|
| | L_FR1 | |
| VL7\|7a/JL3b | QTVVTQE-PSLTVSPGGTVTLTC | 4025 |
| MA_12-E12_CCx_I2C0_x_scFc_(J7J)_translation Fv#2 VL7\|7a/JL3b | QTVVTQE-PSLTVSPGGTVTLTC | 4026 |
| MA_13-D12_CCx_I2C0_x_scFc_(S4S)_translation Fv#2 VL7\|7a/JL3b | QTVVTQE-PSLTVSPGGTVTLTC | 4027 |
| MA_24-C9_CCx_I2C0x_scFc_(M6S)_translation Fv#2  VL7\|7a/JL3b | QTVVTQE-PSLTVSPGGTVTLTC | 4028 |
| MA_24-G6_CCx_I2C0_x_scFc_(M9Z)_translation Fv#2 VL7\|7a/JL3b | QTVVTQE-PSLTVSPGGTVTLTC | 4029 |
| MA_31-H8_CCx_I2C0_x_scFc_(F3H)_translation Fv#2 VL7\|7a/JL3b | QTVVTQE-PSLTVSPGGTVTLTC | 4030 |
| MA_32-A8_CCx_I2C0_x_scFc_(J6Z)_translation Fv#2 VL7\|7a/JL3b | QTVVTQE-PSLTVSPGGTVTLTC | 4031 |
| MA_32-C3_CCx_I2C0x_scFc_(L2A)_translation Fv#2  VL7\|7a/JL3b | QTVVTQE-PSLTVSPGGTVTLTC | 4032 |
| MA_48-D12_CCx_I2C0x_scFc_(B4P)_translation Fv#2 VL7\|7a/JL3b | QTVVTQE-PSLTVSPGGTVTLTC | 4033 |
| VL7\|7b/JL3b | QAVVTQE-PSLTVSPGGTVTLTC | 4034 |
| MA_13-D12_CCx_I2C0_x_scFc_(S4S)_translation Fv#1VL7\|7b/JL3b | QAVVTQE-PSLTVSPGGTVTLTC | 4035 |
| | L_CDR1 | |
| VL7\|7a/JL3b | ASST-GAVTSG----YYPN | 4075 |
| MA_12-E12_CCx_I2C0_x_scFc_(J7J)_translation Fv#2 VL7\|7a/JL3b | GSST-GAVTSG----NYPN | 4076 |
| MA_13-D12_CCx_I2C0_x_scFc_(S4S)_translation Fv#2 VL7\|7a/JL3b | GSST-GAVTSG----NYPN | 4077 |
| MA_24-C9_CCx_I2C0x_scFc_(M6S)_translation Fv#2  VL7\|7a/JL3b | GSST-GAVTSG----NYPN | 4078 |
| MA_24-G6_CCx_I2C0_x_scFc_(M9Z)_translation Fv#2 VL7\|7a/JL3b | GSST-GAVTSG----NYPN | 4079 |
| MA_31-H8_CCx_I2C0_x_scFc_(F3H)_translation Fv#2 VL7\|7a/JL3b | GSST-GAVTSG----NYPN | 4080 |
| MA_32-A8_CCx_I2C0_x_scFc_(J6Z)_translation Fv#2 VL7\|7a/JL3b | GSST-GAVTSG----NYPN | 4081 |
| MA_32-C3_CCx_I2C0x_scFc_(L2A)_translation Fv#2  VL7\|7a/JL3b | GSST-GAVTSG----NYPN | 4082 |
| MA_48-D12_CCx_I2C0x_scFc_(B4P)_translation Fv#2 VL7\|7a/JL3b | GSST-GAVTSG----NYPN | 4083 |
| VL7\|7b/JL3b | GSST-GAVTSG----HYPY | 4084 |
| MA_13-D12_CCx_I2C0_x_scFc_(S4S)_translation Fv#1VL7\|7b/JL3b | GSST-GAVTSG----HYPY | 4085 |

HEAVY_VARIABLE

| Germline | | SEQ ID NO: |
|---|---|---|
| | H_FR1 | |
| VH3\|3-21/D2\|2-15\|RF3/JH1 | EVQLVES-GGGLVKPGGSLRLSCAASG-FTFS | 4036 |
| MA_12-E12_CCx_I2C0_x_scFc_(J7J)_translation Fv#1VH3\|3-21/D2\|2-15\|RF3/JH1 | EVQLVES-GGGLVKPGGSLRLSCAASG-FTFS | 4037 |
| VH3\|3-73/D3\|3-3\|RF3/JH4 | EVQLVES-GGGLVQPGGSLKLSCAASG-FTFS | 4038 |
| MA_12-E12_CCx_I2C0_x_scFc_(J7J)_translation Fv#2 VH3\|3-73/D3\|3-3\|RF3/JH4 | EVQLVES-GGGLVQPGGSLKLSCAASG-FTFN | 4039 |
| MA_13-D12_CCx_I2C0_x_scFc_(S4S)_translation Fv#2VH3\|3-73/D3\|3-3\|RF3/JH4 | EVQLVES-GGGLVQPGGSLKLSCAASG-FTFN | 4040 |
| MA_24-C9_CCx_I2C0x_scFc_(M6S)_translation Fv#2  VH3\|3-73/D3\|3-3\|RF3/JH4 | EVQLVES-GGGLVQPGGSLKLSCAASG-FTFN | 4041 |
| MA_24-G6_CCx_I2C0_x_scFc_(M9Z)_translation Fv#2 VH3\|3-73/D3\|3-3\|RF3/JH4 | EVQLVES-GGGLVQPGGSLKLSCAASG-FTFN | 4042 |
| MA_31-H8_CCx_I2C0_x_scFc_(F3H)_translation Fv#2 VH3\|3-73/D3\|3-3\|RF3/JH4 | EVQLVES-GGGLVQPGGSLKLSCAASG-FTFN | 4043 |
| MA_32-A8_CCx_I2C0_x_scFc_(J6Z)_translation Fv#2 VH3\|3-73/D3\|3-3\|RF3/JH4 | EVQLVES-GGGLVQPGGSLKLSCAASG-FTFN | 4044 |
| MA_32-C3_CCx_I2C0x_scFc_(L2A)_translation Fv#2  VH3\|3-73/D3\|3-3\|RF3/JH4 | EVQLVES-GGGLVQPGGSLKLSCAASG-FTFN | 4045 |
| MA_48-D12_CCx_I2C0x_scFc_(B4P)_translation Fv#2 VH3\|3-73/D3\|3-3\|RF3/JH4 | EVQLVES-GGGLVQPGGSLKLSCAASG-FTFN | 4046 |
| VH3\|3-30.3/D3\|3-16\|RF2/JH6 | QVQLVES-GGGVVQPGRSLRLSCAASG-FTFS | 4047 |
| MA_13-D12_CCx_I2C0_x_scFc_(S4S)_translation Fv#1VH3\|3-30.3/D3\|3-16\|RF2/JH6 | QVQLVES-GGGVVQPGRSLRLSCAASG-FTFS | 4048 |
| VH1\|1-e/D2\|2-15\|RF3/JH4 | QVQLVQS-GAEVKKPGSSVKVSCKASG-GTFS | 4049 |
| MA_24-C9_CCx_I2C0x_scFc_(M6S)_translation Fv#1  VH1\|1-e/D2\|2-15\|RF3/JH4 | VQLLEQS-GPELVKPGASVKISCKASG-YAFS | 4050 |
| VH1\|1-e/D5\|5-18\|RF3/JH4 | QVQLVQS-GAEVKKPGSSVKVSCKASG-GTES | 4051 |
| MA_24-G6_CCx_I2C0_x_scFc_(M9Z)_translation Fv#1 VH1\|1-e/D5\|5-18\|RF3/JH4 | VQLLEQS-GPELVKPGASVKISCKASD-YTFS | 4052 |
| VH1\|1-e/D1\|1-1\|RF2/JH3 | QVQLVQS-GAEVKKPGSSVKVSCKASG-GTES | 4053 |
| MA_31-H8_CCx_I2C0_x_scFc_(F3H)_translation Fv#1 VH1\|1-e/D1\|1-1\|RF2/JH3 | VQLLEQS-GPELVKPGASVKISCKASG-YAFS | 4054 |

TABLE 44-continued

BiTE-scFc_Variable Region Protein Alignment (MAGEB2)
CDRs defined by Kabat
Alignment numbering defined by Amgen Reference (AHo)

| | | | |
|---|---|---|---|
| VH1\|1-08\|D5\|5-18\|RF3/JH6 | | QVQLVQS-GAEVKKPGASVKVSCKASG-YTFT | 4055 |
| MA_32-A8_CCx_I2C0_x_scFc_(J6Z)_translation Fv#1 | VH1\|1-08\|D5\|5-18\|RF3/JH6 | QVQLVQS-GAEVKKPGASVKVSCKASG-YTFT | 4056 |
| VH4\|4-34/D5\|5-12\|RF3/JH6 | | QVQLQQW-GAGLLKPSETLSLTCAVYG-GSFS | 4057 |
| MA_32-C3_CCx_I2C0x_scFc_(L2A)_translation Fv#1 | VH4\|4-34/D5\|5-12\|RF3/JH6 | QVQLQQW-GAGMLKPSETLSLTCAVYG-GSFS | 4058 |
| VH3\|3-30.3/D1\|1-1\|RF2/JH6 | | QVQLVES-GGGVVQPGRSLRLSCAASG-FTFS | 4059 |
| MA_48-D12_CCx_I2C0x_scFc_(B4P)_translation Fv#1 | VH3\|3-30.3/D1\|1-1\|RF2/JH6 | QVQLVES-GGGVVQPGRSLRLSCAASG-FTFR | 4060 |

H_CDR1

| | | | |
|---|---|---|---|
| VH3\|3-21/D2\|2-15\|RF3/JH1 | | S-----YSMN | 4086 |
| MA_12-E12_CCx_I2C0_x_scFc_(J7J)_translation Fv#1 | VH3\|3-21/D2\|2-15\|RF3/JH1 | T-----YSMN | 4087 |
| VH3\|3-73/D3\|3-3\|RF3/JH4 | | G-----SAMH | 4088 |
| MA_12-E12_CCx_I2C0_x_scFc_(J7J)_translation Fv#2 | VH3\|3-73/D3\|3-3\|RF3/JH4 | K-----YAMN | 4089 |
| MA_13-D12_CCx_I2C0_x_scFc_(S4S)_translation Fv#2 | VH3\|3-73/D3\|3-3\|RF3/JH4 | K-----YAMN | 4090 |
| MA_24-C9_CCx_I2C0_x_scFc_(M6S)_translation Fv#2 | VH3\|3-73/D3\|3-3\|RF3/JH4 | K-----YAMN | 4091 |
| MA_24-G6_CCx_I2C0_x_scFc_(M9Z)_translation Fv#2 | VH3\|3-73/D3\|3-3\|RF3/JH4 | K-----YAMN | 4092 |
| MA_31-H8_CCx_I2C0_x_scFc_(F3H)_translation Fv#2 | VH3\|3-73/D3\|3-3\|RF3/JH4 | K-----YAMN | 4093 |
| MA_32-A8_CCx_I2C0_x_scFc_(J6Z)_translation Fv#2 | VH3\|3-73/D3\|3-3\|RF3/JH4 | K-----YAMN | 4094 |
| MA_32-C3_CCx_I2C0_x_scFc_(L2A)_translation Fv#2 | VH3\|3-73/D3\|3-3\|RF3/JH4 | K-----YAMN | 4095 |
| MA_48-D12_CCx_I2C0_x_scFc_(B4P)_translation Fv#2 | VH3\|3-73/D3\|3-3\|RF3/JH4 | K-----YAMN | 4096 |
| VH3\|3-30.3/D3\|3-16\|RF2/JH6 | | S-----YAMH | 4097 |
| MA_13-D12_CCx_I2C0_x_scFc_(S4S)_translation Fv#1 | VH3\|3-30.3/D3\|3-16\|RF2/JH6 | S-----YGMH | 4098 |
| VH1\|1-e/D2\|2-15\|RF3/JH4 | | S-----YAIS | 4099 |
| MA_24-C9_CCx_I2C0_x_scFc_(M6S)_translation Fv#1 | VH1\|1-e/D2\|2-15\|RF3/JH4 | K-----SWMN | 4100 |
| VH1\|1-e/D5\|5-18\|RF3/JH4 | | S-----YAIS | 4101 |
| MA_24-G6_CCx_I2C0_x_scFc_(M9Z)_translation Fv#1 | VH1\|1-e/D5\|5-18\|RF3/JH4 | K-----SWMN | 4102 |
| VH1\|1-e/D1\|1-1\|RF2/JH3 | | S-----YAIS | 4103 |
| MA_31-H8_CCx_I2C0_x_scFc_(F3H)_translation Fv#1 | VH1\|1-e/D1\|1-1\|RF2/JH3 | S-----SWMN | 4104 |
| VH1\|1-08\|D5\|5-18\|RF3/JH6 | | S-----YDIN | 4105 |
| MA_32-A8_CCx_I2C0_x_scFc_(J6Z)_translation Fv#1 | VH1\|1-08\|D5\|5-18\|RF3/JH6 | S-----YDIN | 4106 |
| VH4\|4-34/D5\|5-12\|RF3/JH6 | | G-----YYWS | 4107 |
| MA_32-C3_CCx_I2C0x_scFc_(L2A)_translation Fv#1 | VH4\|4-34/D5\|5-12\|RF3/JH6 | G-----YYWN | 4108 |
| VH3\|3-30.3/D1\|1-1\|RF2/JH6 | | S-----YAMH | 4109 |
| MA_48-D12_CCx_I2C0_x_scFc_(B4P)_translation Fv#1 | VH3\|3-30.3/D1\|1-1\|RF2/JH6 | S-----YRMH | 4110 |

KAPPA_VARIABLE

| | Germline | | SEQ ID NO: |
|---|---|---|---|

K_FR2

| | | | |
|---|---|---|---|
| VK3\|A27/JK4 | | WYQQKPGQAPRLLIY | 4111 |
| MA_12-E12_CCx_I2C0_x_scFc_(J7J)_translation Fv#1 | VK3\|A27/JK4 | WYQQKPGQAPRLLIY | 4112 |
| VK4\|B3/JK2 | | WYQQKPGQPPKLLIY | 4113 |
| MA_24-C9_CCx_I2C0x_scFc_(M6S)_translation Fv#1 | VK4\|B3/JK2 | WYQQKPGQSPKLLIY | 4114 |
| VK6\|A10/JK2 | | WYQQKPDQSPKLLIK | 4115 |
| MA_24-G6_CCx_I2C0_x_scFc_(M9Z)_translation Fv#1 | VK6\|A10/JK2 | WYQQKLGSSPKIWIY | 4116 |
| VK1\|L11/JK2 | | WYQQKPGKAPKLLIY | 4117 |
| MA_31-H8_CCx_I2C0_x_scFc_(F3H)_translation Fv#1 | VK1\|L11/JK2 | WYQQKQGKSPQLLVY | 4118 |
| VK2\|A19/JK5 | | WYLQKPGQSPQLLIY | 4119 |
| MA_32-A8_CCx_I2C0_x_scFc_(J6Z)_translation Fv#1 | VK2\|A19/JK5 | WYLQKPGQSPQLLIY | 4120 |
| VK2\|A19/JK3 | | WYLQKPGQSPQLLIY | 4121 |
| MA_32-C3_CCx_I2C0x_scFc_(L2A)_translation Fv#1 | VK2\|A19/JK3 | WYLQKPGQSPQLLIY | 4122 |
| VK3\|A27/JK2 | | WYQQKPGQAPRLLIY | 4123 |
| MA_48-D12_CCx_I2C0x_scFc_(B4P)_translation Fv#1 | VK3\|A27/JK2 | WYQQKPGQAPRLLIY | 4124 |

TABLE 44-continued

BiTE-scFc_Variable Region Protein Alignment (MAGEB2)
CDRs defined by Kabat
Alignment numbering defined by Amgen Reference (AHo)

| | | K_CDR2 | |
|---|---|---|---|
| VK3\|A27/JK4 | | G--------ASSRAT | 4161 |
| MA_12-E12_CCx_I2C0_x_scFc_(J7J)_translation Fv#1 | VK3\|A27/JK4 | G--------ASSRAT | 4162 |
| VK4\|B3/JK2 | | W--------ASTRES | 4163 |
| MA_24-C9_CCx_I2C0x_scFc_(M6S)_translation Fv#1 | VK4\|B3/JK2 | W--------ASTRES | 4164 |
| VK6\|A10/JK2 | | Y--------ASQSES | 4165 |
| MA_24-G6_CCx_I2C0_x_scFc_(M9Z)_translation Fv#1 | VK6\|A10/JK2 | D--------TSKLAP | 4166 |
| VK1\|L11/JK2 | | A--------ASSLQS | 4167 |
| MA_31-H8_CCx_I2C0_x_scFc_(F3H)_translation Fv#1 | VK1\|L11/JK2 | N--------AKTLAG | 4168 |
| VK2\|A19/JK5 | | L--------GSNRAS | 4169 |
| MA_32-A8_CCx_I2C0_x_scFc_(J6Z)_translation Fv#1 | VK2\|A19/JK5 | L--------GSNRAS | 4170 |
| VK2\|A19/JK3 | | L--------GSNRAS | 4171 |
| MA_32-C3_CCx_I2C0x_scFc_(L2A)_translation Fv#1 | VK2\|A19/JK3 | L--------GSNRAS | 4172 |
| VK3\|A27/JK2 | | G--------ASSRAT | 4173 |
| MA_48-D12_CCx_I2C0x_scFc_(B4P)_translation Fv#1 | VK3\|A27/JK2 | G--------ASSRAT | 4174 |

| | | K_FR3 | |
|---|---|---|---|
| VK3\|A27/JK4 | | GIPDRESGSGSG--TDFTLTISRLEPEDEAVYYC | 4211 |
| MA_12-E12_CCx_I2C0_x_scFc_(J7J)_translation Fv#1 | VK3\|A27/JK4 | GIPDRESGSGSG--TDFTLTISRLEPEDFAVYYC | 4212 |
| VK4\|B3/JK2 | | GVPDRESGSGSG--TDFTLTISSLQAEDVAVYYC | 4213 |
| MA_24-C9_CCx_I2C0x_scFc_(M6S)_translation Fv#1 | VK4\|B3/JK2 | GVPDRFTGSGSG--TDFTLTISSVKAEDLAVYYC | 4214 |
| VK6\|A10/JK2 | | GVPSRFSGSGSG--TDFTLTINSLEAEDAATYYC | 4215 |
| MA_24-G6_CCx_I2C0_x_scFc_(M9Z)_translation Fv#1 | VK6\|A10/JK2 | GVPARFSGSGSG--TSYSLTISSMEAEDAASYFC | 4216 |
| VK1\|L11/JK2 | | GVPSRFSGSGSG--TDFTLTISSLQPEDFATYYC | 4217 |
| MA_31-H8_CCx_I2C0_x_scFc_(F3H)_translation Fv#1 | VK1\|L11/JK2 | GVPSRFSGSGSG--TQFSLKINSLQPEDFGSYYC | 4218 |
| VK2\|A19/JK5 | | GVPDRESGSGSG--TDFTLKISRVEAEDVGVYYC | 4219 |
| MA_32-A8_CCx_I2C0_x_scFc_(J6Z)_translation Fv#1 | VK2\|A19/JK5 | GVPDRFSGSGSG--TDFTLKISKVEAEDVGVYYC | 4220 |
| VK2\|A19/JK3 | | GVPDRESGSGSG--TDFTLKISRVEAEDVGVYYC | 4221 |
| MA_32-C3_CCx_I2C0x_scFc_(L2A)_translation Fv#1 | VK2\|A19/JK3 | GVPDRESGSGSG--TDFTLKISRVEAEDVGVYYC | 4222 |
| VK3\|A27/JK2 | | GIPDRFSGSGSG--TDFTLTISRLEPEDEAVYYC | 4223 |
| MA_48-D12_CCx_I2C0x_scFc_(B4P)_translation Fv#1 | VK3\|A27/JK2 | GIPDRFSGSGSG--TDFTLTISRLEPEDEAVYYC | 4224 |

LAMBDA_VARIABLE

| | Germline | | SEQ ID NO: |
|---|---|---|---|
| | | L_FR2 | |
| VL7\|7a/JL3b | | WFQQKPGQAPRALIY | 4125 |
| MA_12-E12_CCx_I2C0_x_scFc_(J7J)_translation Fv#2 | VL7\|7a/JL3b | WVQQKPGQAPRGLIG | 4126 |
| MA_13-D12_CCx_I2C0_x_scFc_(S4S)_translation Fv#2 | VL7\|7a/JL3b | WVQQKPGQAPRGLIG | 4127 |
| MA_24-C9_CCx_I2C0x_scFc_(M6S)_translation Fv#2 | VL7\|7a/JL3b | WVQQKPGQAPRGLIG | 4128 |
| MA_24-G6_CCx_I2C0_x_scFc_(M9Z)_translation Fv#2 | VL7\|7a/JL3b | WVQQKPGQAPRGLIG | 4129 |

TABLE 44-continued

BiTE-scFc_Variable Region Protein Alignment (MAGEB2)
CDRs defined by Kabat
Alignment numbering defined by Amgen Reference (AHo)

| | | |
|---|---|---|
| MA_31-H8_CCx_I2C0_x_scFc_(F3H)_translation Fv#2 VL7\|7a/JL3b | WVQQKPGQAPRGLIG | 4130 |
| MA_32-A8_CCx_I2C0_x_scFc_(J6Z)_translation Fv#2 VL7\|7a/JL3b | WVQQKPGQAPRGLIG | 4131 |
| MA_32-C3_CCx_I2C0x_scFc_(L2A)_translation Fv#2 VL7\|7a/JL3b | WVQQKPGQAPRGLIG | 4132 |
| MA_48-D12_CCx_I2C0x_scFc_(B4P)_translation Fv#2 VL7\|7a/JL3b | WVQQKPGQAPRGLIG | 4133 |
| VL7\|7b/JL3b | WFQQKPGQAPRTLIY | 4134 |
| MA_13-D12_CCx_I2C0_x_scFc_(S4S)_translation Fv#1VL7\|7b/JL3b | WFQQKPGQAPRTLIY | 4135 |
| | L_CDR2 | |
| VL7\|7a/JL3b | S--------TSNKHS | 4175 |
| MA_12-E12_CCx_I2C0_x_scFc_(J7J)_translation Fv#2 VL7\|7a/JL3b | G--------TKFLAP | 4176 |
| MA_13-D12_CCx_I2C0_x_scFc_(S4S)_translation Fv#2 VL7\|7a/JL3b | G--------TKFLAP | 4177 |
| MA_24-C9_CCx_I2C0x_scFc_(M6S)_translation Fv#2 VL7\|7a/JL3b | G--------TKFLAP | 4178 |
| MA_24-G6_CCx_I2C0_x_scFc_(M9Z)_translation Fv#2 VL7\|7a/JL3b | G--------TKFLAP | 4179 |
| MA_31-H8_CCx_I2C0_x_scFc_(F3H)_translation Fv#2 VL7\|7a/JL3b | G--------TKFLAP | 4180 |
| MA_32-A8_CCx_I2C0_x_scFc_(J6Z)_translation Fv#2 VL7\|7a/JL3b | G--------TKFLAP | 4181 |
| MA_32-C3_CCx_I2C0x_scFc_(L2A)_translation Fv#2 VL7\|7a/JL3b | G--------TKFLAP | 4182 |
| MA_48-D12_CCx_I2C0x_scFc_(B4P)_translation Fv#2 VL7\|7a/JL3b | G--------TKFLAP | 4183 |
| VL7\|7b/JL3b | D--------TSNKHS | 4184 |
| MA_13-D12_CCx_I2C0_x_scFc_(S4S)_translation Fv#1VL7\|7b/JL3b | D--------TSNKHS | 4185 |
| | L_FR3 | |
| VL7\|7a/JL3b | WTPARFSGSLLG--GKAALTLSGVQPEDEAEYYC | 4225 |
| MA_12-E12_CCx_I2C0_x_scFc_(J7J)_translation Fv#2 VL7\|7a/JL3b | GTPARFSGSLLG--GKAALTLSGVQPEDEAEYYC | 4226 |
| MA_13-D12_CCx_I2C0_x_scFc_(S4S)_translation Fv#2 VL7\|7a/JL3b | GTPARFSGSLLG--GKAALTLSGVQPEDEAEYYC | 4227 |
| MA_24-C9_CCx_I2C0x_scFc_(M6S)_translation Fv#2 VL7\|7a/JL3b | GTPARFSGSLLG--GKAALTLSGVQPEDEAEYYC | 4228 |
| MA_24-G6_CCx_I2C0x_scFc_(M9Z)_translation Fv#2 VL7\|7a/JL3b | GTPARFSGSLLG--GKAALTLSGVQPEDEAEYYC | 4229 |
| MA_31-H8_CCx_I2C0_x_scFc_(F3H)_translation Fv#2 VL7\|7a/JL3b | GTPARFSGSLLG--GKAALTLSGVQPEDEAEYYC | 4230 |
| MA_32-A8_CCx_I2C0_x_scFc_(J6Z)_translation Fv#2 VL7\|7a/JL3b | GTPARFSGSLLG--GKAALTLSGVQPEDEAEYYC | 4231 |
| MA_32-C3_CCx_I2C0x_scFc_(L2A)_translation Fv#2 VL7\|7a/JL3b | GTPARFSGSLLG--GKAALTLSGVQPEDEAEYYC | 4232 |
| MA_48-D12_CCx_I2C0x_scFc_(B4P)_translation Fv#2 VL7\|7a/JL3b | GTPARFSGSLLG--GKAALTLSGVQPEDEAEYYC | 4233 |
| VL7\|7b/JL3b | WTPARFSGSLLG--GKAALTLSGAQPEDEAEYYC | 4234 |
| MA_13-D12_CCx_I2C0_x_scFc_(S4S)_translation Fv#1VL7\|7b/JL3b | WTPARFSGSLLG-GKAALTLSGAQPEDEAEYYC | 4235 |

HEAVY_VARIABLE

| | Germline | | SEQ ID NO: |
|---|---|---|---|
| | | H_FR2 | |
| VH3\|3-21/D2\|2-15\|RF3/JH1 | | WVRQAPGKGLEWVS | 4136 |
| MA_12-E12_CCx_I2C0_x_scFc_(J7J)_translation Fv#1VH3\|3-21/D2\|2-15\|RF3/JH1 | | WVRQAPGKCLEWVS | 4137 |
| VH3\|3-73/D3\|3-3\|RF3/JH4 | | WVRQASGKGLEWVG | 4138 |
| MA_12-E12_CCx_I2C0_x_scFc_(J7J)_translation Fv#2 VH3\|3-73/D3\|3-3\|RF3/JH4 | | WVRQAPGKGLEWVA | 4139 |
| MA_13-D12_CCx_I2C0_x_scFc_(S4S)_translation Fv#2 VH3\|3-73/D3\|3-3\|RF3/JH4 | | WVRQAPGKGLEWVA | 4140 |
| MA_24-C9_CCx_I2C0x_scFc_(M6S)_translation Fv#2 VH3\|3-73/D3\|3-3\|RF3/JH4 | | WVRQAPGKGLEWVA | 4141 |

TABLE 44-continued

BiTE-scFc_Variable Region Protein Alignment (MAGEB2)
CDRs defined by Kabat
Alignment numbering defined by Amgen Reference (AHo)

| | | | |
|---|---|---|---|
| MA_24-G6_CCx_I2C0_x_scFc_(M9Z)_translation Fv#2 | VH3\|3-73/D3\|3-3\|RF3/JH4 | WVRQAPGKGLEWVA | 4142 |
| MA_31-H8_CCx_I2C0_x_scFc_(F3H)_translation Fv#2 | VH3\|3-73/D3\|3-3\|RF3/JH4 | WVRQAPGKGLEWVA | 4143 |
| MA_32-A8_CCx_I2C0_x_scFc_(J6Z)_translation Fv#2 | VH3\|3-73/D3\|3-3\|RF3/JH4 | WVRQAPGKGLEWVA | 4144 |
| MA_32-C3_CCx_I2C0x_scFc_(L2A)_translation Fv#2 | VH3\|3-73/D3\|3-3\|RF3/JH4 | WVRQAPGKGLEWVA | 4145 |
| MA_48-D12_CCx_I2C0x_scFc_(B4P)_translation Fv#2 | VH3\|3-73/D3\|3-3\|RF3/JH4 | WVRQAPGKGLEWVA | 4146 |
| VH3\|3-30.3/D3\|3-16\|RF2/JH6 | | WVRQAPGKGLEWVA | 4147 |
| MA_13-D12_CCx_I2C0_x_scFc_(S4S)_translation Fv#1 | VH3\|3-30.3/D3\|3-16\|RF2/JH6 | WVRQAPGKCLEWVA | 4148 |
| VH1\|1-e/D2\|2-15\|RF3/JH4 | | WVRQAPGQGLEWMG | 4149 |
| MA_24-C9_CCx_I2C0x_scFc_(M6S)_translation Fv#1 | VH1\|1-e/D2\|2-15\|RF3/JH4 | WVKQRPGKCLEWIG | 4150 |
| VH1\|1-e/D5\|5-18\|RF3/JH4 | | WVRQAPGQGLEWMG | 4151 |
| MA_24-G6_CCx_I2C0_x_scFc_(M9Z)_translation Fv#1 | VH1\|1-e/D5\|5-18\|RF3/JH4 | WVKQRPGECLEWIG | 4152 |
| VH1\|1-e/D1\|1-1\|RF2/JH3 | | WVRQAPGQGLEWMG | 4153 |
| MA_31-H8_CCx_I2C0_x_scFc_(F3H)_translation Fv#1 | VH1\|1-e/D1\|1-1\|RF2/JH3 | WVKQRPGKCLEWIG | 4154 |
| VH1\|1-08/D5\|5-18\|RF3/JH6 | | WVRQATGQGLEWMG | 4155 |
| MA_32-A8_CCx_I2C0_x_scFc_(J6Z)_translation Fv#1 | VH1\|1-08/D5\|5-18\|RF3/JH6 | WVRQATGQCLEWMG | 4156 |
| VH4\|4-34/D5\|5-12\|RF3/JH6 | | WIRQPPGKGLEWIG | 4157 |
| MA_32-C3_CCx_I2C0x_scFc_(L2A)_translation Fv#1 | VH4\|4-34/D5\|5-12\|RF3/JH6 | WIRQPPGKCLEWIG | 4158 |
| VH3\|3-30.3/D1\|1-1\|RF2/JH6 | | WVRQAPGKGLEWVA | 4159 |
| MA_48-D12_CCx_I2C0x_scFc_(B4P)_translation Fv#1 | VH3\|3-30.3/D1\|1-1\|RF2/JH6 | WVRQAPGKCLEWVA | 4160 |
| | | H_CDR2 | |
| VH3\|3-21/D2\|2-15\|RF3/JH1 | | SISSS---SSYIYYADSVKG | 4186 |
| MA_12-E12_CCx_I2C0_x_scFc_(J7J)_translation Fv#1 | VH3\|3-21/D2\|2-15\|RF3/JH1 | SISSS---SSYIYYADSVKG | 4187 |
| VH3\|3-73/D3\|3-3\|RF3/JH4 | | RIRSKA-NSYATAYAASVKG | 4188 |
| MA_12-E12_CCx_I2C0_x_scFc_(J7J)_translation Fv#2 | VH3\|3-73/D3\|3-3\|RF3/JH4 | RIRSKY-NNYATYYADSVKD | 4189 |
| MA_13-D12_CCx_I2C0_x_scFc_(S4S)_translation Fv#2 | VH3\|3-73/D3\|3-3\|RF3/JH4 | RIRSKY-NNYATYYADSVKD | 4190 |
| MA_24-C9_CCx_I2C0x_scFc_(M6S)_translation Fv#2 | VH3\|3-73/D3\|3-3\|RF3/JH4 | RIRSKY-NNYATYYADSVKD | 4191 |
| MA_24-G6_CCx_I2C0_x_scFc_(M9Z)_translation Fv#2 | VH3\|3-73/D3\|3-3\|RF3/JH4 | RIRSKY-NNYATYYADSVKD | 4192 |
| MA_31-H8_CCx_I2C0_x_scFc_(F3H)_translation Fv#2 | VH3\|3-73/D3\|3-3\|RF3/JH4 | RIRSKY-NNYATYYADSVKD | 4193 |
| MA_32-A8_CCx_I2C0_x_scFc_(J6Z)_translation Fv#2 | VH3\|3-73/D3\|3-3\|RF3/JH4 | RIRSKY-NNYATYYADSVKD | 4194 |
| MA_32-C3_CCx_I2C0x_scFc_(L2A)_translation Fv#2 | VH3\|3-73/D3\|3-3\|RF3/JH4 | RIRSKY-NNYATYYADSVKD | 4195 |
| MA_48-D12_CCx_I2C0x_scFc_(B4P)_translation Fv#2 | VH3\|3-73/D3\|3-3\|RF3/JH4 | RIRSKY-NNYATYYADSVKD | 4196 |
| VH3\|3-30.3/D3\|3-16\|RF2/JH6 | | VISYD---GSNKYYADSVKG | 4197 |
| MA_13-D12_CCx_I2C0_x_scFc_(S4S)_translation Fv#1 | VH3\|3-30.3/D3\|3-16\|RF2/JH6 | LISYD---GSSKYYADSVKG | 4198 |
| VH1\|1-e/D2\|2-15\|RF3/JH4 | | GIIPI---FGTANYAQKFQG | 4199 |
| MA_24-C9_CCx_I2C0x_scFc_(M6S)_translation Fv#1 | VH1\|1-e/D2\|2-15\|RF3/JH4 | RIYPG---DGDTNYNGKFKG | 4200 |
| VH1\|1-e/D5\|5-18\|RF3/JH4 | | GIIPI---FGTANYAQKFQG | 4201 |
| MA_24-G6_CCx_I2C0_x_scFc_(M9Z)_translation Fv#1 | VH1\|1-e/D5\|5-18\|RF3/JH4 | RVWPG---DGDTTYNEKFKG | 4202 |
| VH1\|1-e/D1\|1-1\|RF2/JH3 | | GIIPI---FGTANYAQKFQG | 4203 |
| MA_31-H8_CCx_I2C0_x_scFc_(F3H)_translation Fv#1 | VH1\|1-e/D1\|1-1\|RF2/JH3 | RIYPG---DGDTNYNGKFKD | 4204 |
| VH1\|1-08/D5\|5-18\|RF3/JH6 | | WMNPN---SGNTGYAQKFQG | 4205 |
| MA_32-A8_CCx_I2C0_x_scFc_(J6Z)_translation Fv#1 | VH1\|1-08/D5\|5-18\|RF3/JH6 | WMNPN---SGNTGYAQKFQG | 4206 |
| VH4\|4-34/D5\|5-12\|RF3/JH6 | | EINH----SGSTNYNPSLKS | 4207 |
| MA_32-C3_CCx_I2C0x_scFc_(L2A)_translation Fv#1 | VH4\|4-34/D5\|5-12\|RF3/JH6 | EINH----SGSTNYNPSLKS | 4208 |
| VH3\|3-30.3/D1\|1-1\|RF2/JH6 | | VISYD---GSNKYYADSVKG | 4209 |
| MA_48-D12_CCx_I2C0x_scFc_(B4P)_translation Fv#1 | VH3\|3-30.3/D1\|1-1\|RF2/JH6 | VISYD---GGNKYYADSVKG | 4210 |

TABLE 44-continued

BiTE-scFc_Variable Region Protein Alignment (MAGEB2)
CDRs defined by Kabat
Alignment numbering defined by Amgen Reference (AHo)

| | | H_FR3 | |
|---|---|---|---|
| VH3\|3-21/D2\|2-15\|RF3/JH1 | | RFTISRDNAKNSL YLQMNSLRAEDTA VYYCAR- | 4236 |
| MA_12-E12_CCx_I2C0_x_scFc_(J7J)_translation Fv#1 | VH3\|3-21/D2\|2-15\|RF3/JH1 | RFTISRDNAKNSL YLQMNSLRDEDTA VYYCAR- | 4237 |
| VH3\|3-73/D3\|3-3\|RF3/JH4 | | RFTISRDDSKNTA YLQMNSLKTEDTA VYYCTR- | 4238 |
| MA_12-E12_CCx_I2C0_x_scFc_(J7J)_translation Fv#2 | VH3\|3-73/D3\|3-3\|RF3/JH4 | RFTISRDDSKNTA YLQMNNLKTEDTA VYYCVR- | 4239 |
| MA_13-D12_CCx_I2C0_x_scFc_(S4S)_translation Fv#2 1 | VH3\|3-73/D3\|3-3\|RF3/JH4 | RFTISRDDSKNTA YLQMNNLKTEDTA VYYCVR- | 4240 |
| MA_24-C9_CCx_I2C0x_scFc_(M6S)_translation Fv#2 | VH3\|3-73/D3\|3-3\|RF3/JH4 | RFTISRDDSKNTA YLQMNNLKTEDTA VYYCVR- | 4241 |
| MA_24-G6_CCx_I2C0_x_scFc_(M9Z)_translation Fv#2 | VH3\|3-73/D3\|3-3\|RF3/JH4 | RFTISRDDSKNTA YLQMNNLKTEDTA VYYCVR- | 4242 |
| MA_31-H8_CCx_I2C0_x_scFc_(F3H)_translation Fv#2 | VH3\|3-73/D3\|3-3\|RF3/JH4 | RFTISRDDSKNTA YLQMNNLKTEDTA VYYCVR- | 4243 |
| MA_32-A8_CCx_I2C0_x_scFc_(J6Z)_translation Fv#2 | VH3\|3-73/D3\|3-3\|RF3/JH4 | RFTISRDDSKNTA YLQMNNLKTEDTA VYYCVR- | 4244 |
| MA_32-C3_CCx_I2C0x_scFc_(L2A)_translation Fv#2 | VH3\|3-73/D3\|3-3\|RF3/JH4 | RFTISRDDSKNTA YLQMNNLKTEDTA VYYCVR- | 4245 |
| MA_48-D12_CCx_I2C0x_scFc_(B4P)_translation Fv#2 | VH3\|3-73/D3\|3-3\|RF3/JH4 | RFTISRDDSKNTA YLQMNNLKTEDTA VYYCVR- | 4246 |
| VH3\|3-30.3/D3\|3-16\|RF2/JH6 | | RFTISRDDSKNTA YLQMNSLRAEDTA VYYCAR- | 4247 |
| MA_13-D12_CCx_I2C0_x_scFc_(S4S)_translation Fv#1 | VH3\|3-30.3/D3\|3-16\|RF2/JH6 | RFTISRDNSKNTL DLQMNSLRAEDTA VYYCARS | 4248 |
| VH1\|1-e/D2\|2-15\|RF3/JH4 | | RVTITADKSTSTA YMELSSLRSEDTA VYYCAR- | 4249 |
| MA_24-C9_CCx_I2C0x_scFc_(M6S)_translation Fv#1 | VH1\|1-e/D2\|2-15\|RF3/JH4 | KAALTADKSSNTA NMQLNSLTSEDSA VYFCAR- | 4250 |
| VH1\|1-e/D5\|5-18\|RF3/JH4 | | RVTITADKSTSTA YMELSSLRSEDTA VYYCAR- | 4251 |
| MA_24-G6_CCx_I2C0_x_scFc_(M9Z)_translation Fv#1 | VH1\|1-e/D5\|5-18\|RF3/JH4 | KATLTADKSSRTA YMQLSSLTSEDSA VYFCAR- | 4252 |
| VH1\|1-e/D1\|1-1\|RF2/JH3 | | RVTITADKSTSTA YMELSSLRSEDTA VYYCAR- | 4253 |
| MA_31-H8_CCx_I2C0_x_scFc_(F3H)_translation Fv#1 | VH1\|1-e/D1\|1-1\|RF2/JH3 | KATLTADKSSNTA YMQLSSLTSEDSA VYFCAR- | 4254 |
| VH1\|1-08/D5\|5-18\|RF3/JH6 | | RVTMTRNTSISTA YMELSSLRSEDTA VYYCAR- | 4255 |
| MA_32-A8_CCx_I2C0_x_scFc_(J6Z)_translation Fv#1 | VH1\|1-08/D5\|5-18\|RF3/JH6 | RVTMTRNTSISTA YMELSSLRSEDTA VYYCAR- | 4256 |
| VH4\|4-34/D5\|5-12\|RF3/JH6 | | RVTISVDTSKNQF SLKLSSVTAADTA VYYCAR- | 4257 |
| MA_32-C3_CCx_I2C0x_scFc_(L2A)_translation Fv#1 | VH4\|4-34/D5\|5-12\|RF3/JH6 | RVTISVDTSKNQF SLKLSSVTAADTA VYYCAR- | 4258 |
| VH3\|3-30.3/D1\|1-1\|RF2/JH6 | | RFTISRDNSKNTL YLQMNSLRAEDTA VYYCAR- | 4259 |

TABLE 44-continued

BiTE-scFc_Variable Region Protein Alignment (MAGEB2)
CDRs defined by Kabat
Alignment numbering defined by Amgen Reference (AHo)

| | | | SEQ ID NO: |
|---|---|---|---|
| MA_48-D12_CCx_I2C0x_scFc_(B4P)_translation Fv#1 | VH3\|3-30.3/D1 1-1\|RF2/JH6 | RFTISRDNSKNTL YLQMNSLRAEDTA VYYCAR- | 4260 |

KAPPA_VARIABLE

| | Germline | | SEQ ID NO: |
|---|---|---|---|
| | | K_CDR3 | |
| VK3\|A27/JK4 | | QQYGS----------------------SPLT | 4261 |
| MA_12-E12_CCx_I2C0_x_scFc_(J7J)_translation Fv#1 | VK3\|A27/JK4 | QQYAN----------------------SPLT | 4262 |
| VK4\|B3/JK2 | | QQYYS----------------------TPYT | 4263 |
| MA_24-C9_CCx_I2C0x_scFc_(M6S)_translation Fv#1 | VK4\|B3/JK2 | QQYYS----------------------YPYT | 4264 |
| VK6\|A10/JK2 | | HQSSS----------------------LPYT | 4265 |
| MA_24-G6_CCx_I2C0_x_scFc_(M9Z)_translation Fv#1 | VK6\|A10/JK2 | HQWSS----------------------YPPT | 4266 |
| VK1\|L11/JK2 | | LQDYN----------------------YPYT | 4267 |
| MA_31-H8_CCx_I2C0_x_scFc_(F3H)_translation Fv#1 | VK1\|L11/JK2 | QHHYG----------------------TPLT | 4268 |
| VK2\|A19/JK5 | | MQALQ----------------------TPIT | 4269 |
| MA_32-A8_CCx_I2C0_x_scFc_(J6Z)_translation Fv#1 | VK2\|A19/JK5 | MQALQ----------------------TPPT | 4270 |
| VK2\|A19/JK3 | | MQALQ----------------------TPFT | 4271 |
| MA_32-C3_CCx_I2C0x_scFc_(L2A)_translation Fv#1 | VK2\|A19/JK3 | MQALQ----------------------TPPT | 4272 |
| VK3\|A27/JK2 | | QQYGS----------------------SPYT | 4273 |
| MA_48-D12_CCx_I2C0x_scFc_(B4P)_translation Fv#1 | VK3\|A27/JK2 | QQYGS----------------------SPLT | 4274 |
| | | K_FR4 | |
| VK3\|A27/JK4 | | FGGGTKVEIK | 4311 |
| MA_12-E12_CCx_I2C0_x_scFc_(J7J)_translation Fv#1 | VK3\|A27/JK4 | FGCGTKVEIK | 4312 |
| VK4\|B3/JK2 | | FGQGTKLEIK | 4313 |
| MA_24-C9_CCx_I2C0x_scFc_(M6S)_translation Fv#1 | VK4\|B3/JK2 | FGCGTKLELK | 4314 |
| VK6\|A10/JK2 | | FGQGTKLEIK | 4315 |
| MA_24-G6_CCx_I2C0_x_scFc_(M9Z)_translation Fv#1 | VK6\|A10/JK2 | FGCGTKLEIK | 4316 |
| VK1\|L11/JK2 | | FGQGTKLEIK | 4317 |
| MA_31-H8_CCx_I2C0_x_scFc_(F3H)_translation Fv#1 | VK1\|L11/JK2 | FGCGTKLELK | 4318 |
| VK2\|A19/JK5 | | FGQGTRLEIK | 4319 |
| MA_32-A8_CCx_I2C0_x_scFc_(J6Z)_translation Fv#1 | VK2\|A19/JK5 | FGCGTRLEIK | 4320 |
| VK2\|A19/JK3 | | FGPGTKVDIK | 4321 |
| MA_32-C3_CCx_I2C0x_scFc_(L2A)_translation Fv#1 | VK2\|A19/JK3 | FGCGTKVDIK | 4322 |
| VK3\|A27/JK2 | | FGQGTKLEIK | 4323 |
| MA_48-D12_CCx_I2C0x_scFc_(B4P)_translation Fv#1 | VK3\|A27/JK2 | FGCGTKLEIK | 4324 |

LAMBDA_VARIABLE

| | Germline | | SEQ ID NO: |
|---|---|---|---|
| | | L_CDR3 | |
| VL7\|7a/JL3b | | LLYYG----------------------GAQWV | 4275 |
| MA_12-E12_CCx_I2C0_x_scFc_(J7J)_translation Fv#2 | VL7\|7a/JL3b | VLWYS----------------------NRWV | 4276 |
| MA_13-D12_CCx_I2C0_x_scFc_(S4S)_translation Fv#2 | VL7\|7a/JL3b | VLWYS----------------------NRWV | 4277 |
| MA_24-C9_CCx_I2C0x_scFc_(M6S)_translation Fv#2 | VL7\|7a/JL3b | VLWYS----------------------NRWV | 4278 |
| MA_24-G6_CCx_I2C0_x_scFc_(M9Z)_translation Fv#2 | VL7\|7a/JL3b | VLWYS----------------------NRWV | 4279 |
| MA_31-H8_CCx_I2C0_x_scFc_(F3H)_translation Fv#2 | VL7\|7a/JL3b | VLWYS----------------------NRWV | 4280 |
| MA_32-A8_CCx_I2C0_x_scFc_(J6Z)_translation Fv#2 | VL7\|7a/JL3b | VLWYS----------------------NRWV | 4281 |
| MA_32-C3_CCx_I2C0x_scFc_(L2A)_translation Fv#2 | VL7\|7a/JL3b | VLWYS----------------------NRWV | 4282 |
| MA_48-D12_CCx_I2C0x_scFc_(B4P)_translation Fv#2 | VL7\|7a/JL3b | VLWYS----------------------NRWV | 4283 |
| VL7\|7b/JL3b | | LLSYS----------------------GARWV | 4284 |
| MA_13-D12_CCx_I2C0_x_scFc_(S4S)_translation Fv#1 | VL7\|7b/JL3b | FLSYSG---------------------ARNWV | 4285 |
| | | L_FR4 | |
| VL7\|7a/JL3b | | FGGGTKLTVL | 4325 |
| MA_12-E12_CCx_I2C0_x_scFc_(J7J)_translation Fv#2 | VL7\|7a/JL3b | FGGGTKLTVL | 4326 |
| MA_13-D12_CCx_I2C0_x_scFc_(S4S)_translation Fv#2 | VL7\|7a/JL3b | FGGGTKLTVL | 4327 |
| MA_24-C9_CCx_I2C0x_scFc_(M6S)_translation Fv#2 | VL7\|7a/JL3b | FGGGTKLTVL | 4328 |
| MA_24-G6_CCx_I2C0_x_scFc_(M9Z)_translation Fv#2 | VL7\|7a/JL3b | FGGGTKLTVL | 4329 |
| MA_31-H8_CCx_I2C0_x_scFc_(F3H)_translation Fv#2 | VL7\|7a/JL3b | FGGGTKLTVL | 4330 |
| MA_32-A8_CCx_I2C0_x_scFc_(J6Z)_translation Fv#2 | VL7\|7a/JL3b | FGGGTKLTVL | 4331 |

TABLE 44-continued

BiTE-scFc_Variable Region Protein Alignment (MAGEB2)
CDRs defined by Kabat
Alignment numbering defined by Amgen Reference (AHo)

| | | SEQ ID NO: |
|---|---|---|
| MA_32-C3_CCx_I2C0x_scFc_(L2A)_translation Fv#2 VL7\|7a/JL3b | FGGGTKLTVL | 4332 |
| MA_48-D12_CCx_I2C0x_scFc_(B4P)_translation Fv#2 VL7\|7a/JL3b | FGGGTKLTVL | 4333 |
| VL7\|7b/JL3b | FGGGTKLTVL | 4334 |
| MA_13-D12_CCx_I2C0_x_scFc_(S4S)_translation Fv#1VL7\|7b/JL3b | FGCGTKLTVL | 4335 |

HEAVY_VARIABLE

| Germline | H_CDR3 | SEQ ID NO: |
|---|---|---|
| VH3\|3-21/D2\|2-15\|RF3/JH1 | DIVVVVAA---------------TAEYFQH | 4286 |
| MA_12-E12_CCx_I2C0_x_scFc_(J7J)_translation Fv#1VH3\|3-21/D2\|2-15\|RF3/JH1 | DRIAVA------------------TYFDN | 4287 |
| VH3\|3-73/D3\|3-3\|RF3/JH4 | ITIFGVV----------------IIYFDY | 4288 |
| MA_12-E12_CCx_I2C0_x_scFc_(J7J)_translation Fv#2VH3\|3-73/D3\|3-3\|RF3/JH4 | HGNFGNS----------------YISYWAY | 4289 |
| MA_13-D12_CCx_I2C0_x_scFc_(S4S)_translation Fv#2VH3\|3-73/D3\|3-3\|RF3/JH4 | HGNFGNS----------------YISYWAY | 4290 |
| MA_24-C9_CCx_I2C0x_scFc_(M6S)_translation Fv#2 VH3\|3-73/D3\|3-3\|RF3/JH4 | HGNFGNS----------------YISYWAY | 4291 |
| MA_24-G6_CCx_I2C0_x_scFc_(M9Z)_translation Fv#2 VH3\|3-73/D3\|3-3\|RF3/JH4 | HGNFGNS----------------YISYWAY | 4292 |
| MA_31-H8_CCx_I2C0_x_scFc_(F3H)_translation Fv#2 VH3\|3-73/D3\|3-3\|RF3/JH4 | HGNFGNS----------------YISYWAY | 4293 |
| MA_32-A8_CCx_I2C0_x_scFc_(J6Z)_translation Fv#2 VH3\|3-73/D3\|3-3\|RF3/JH4 | HGNFGNS----------------YISYWAY | 4294 |
| MA_32-C3_CCx_I2C0x_scFc_(L2A)_translation Fv#2 VH3\|3-73/D3\|3-3\|RF3/JH4 | HGNFGNS----------------YISYWAY | 4295 |
| MA_48-D12_CCx_I2C0x_scFc_(B4P)_translation Fv#2 VH3\|3-73/D3\|3-3\|RF3/JH4 | HGNFGNS----------------YISYWAY | 4296 |
| VH3\|3-30.3/D3\|3-16\|RF2/JH6 | YYDYVWGSYRY---------TYYYYYGMDV | 4297 |
| MA_13-D12_CCx_I2C0_x_scFc_(S4S)_translation Fv#1VH3\|3-30.3/D3\|3-16\|RF2/JH6 | PYDYVWGSY-----------RNYYYGMDV | 4298 |
| VH1\|1-e/D2\|2-15\|RF3/JH4 | DIVVVVA----------------ATYFDY | 4299 |
| MA_24-C9_CCx_I2C0x_scFc_(M6S)_translation Fv#1 VH1\|1-e/D2\|2-15\|RF3/JH4 | DGVFY------------------APLAY | 4300 |
| VH1\|1-e/D5\|5-18\|RF3/JH4 | GYSYG------------------YYFDY | 4301 |
| MA_24-G6_CCx_I2C0_x_scFc_(M9Z)_translation Fv#1 VH1\|1-e/D5\|5-18\|RF3/JH4 | GNYFGSS----------------EAYFDY | 4302 |
| VH1\|1-e/D1\|1-1\|RF2/JH3 | VQLER------------------DAFDI | 4303 |
| MA_31-H8_CCx_I2C0_x_scFc_(F3H)_translation Fv#1 VH1\|1-e/D1\|1-1\|RF2/JH3 | RQLNHV-----------------FAMDY | 4304 |
| VH1\|1-08/D5\|5-18\|RF3/JH6 | GYSYGYYY---------------YYYGMDV | 4305 |
| MA_32-A8_CCx_I2C0_x_scFc_(J6Z)_translation Fv#1 VH1\|1-08/D5\|5-18\|RF3/JH6 | GGGYSNG----------------YDYGMDV | 4306 |
| VH4\|4-34/D5\|5-12\|RF3/JH6 | GYSGYDYY---------------YYYYGMDV | 4307 |
| MA_32-C3_CCx_I2C0_x_scFc_(L2A)_translation Fv#1 VH4\|4-34/D5\|5-12\|RF3/JH6 | GGGYSYG----------------YDYGMDV | 4308 |
| VH3\|3-30.3/D1\|1-1\|RF2/JH6 | VQLERYY---------------YYYGMDV | 4309 |
| MA_48-D12_CCx_I2C0x_scFc_(B4P)_translation Fv#1 VH3\|3-30.3/D1\|1-1\|RF2/JH6 | EQWPNY----------------YYGMDV | 4310 |

TABLE 44-continued

BiTE-scFc_Variable Region Protein Alignment (MAGEB2)
CDRs defined by Kabat
Alignment numbering defined by Amgen Reference (AHo)

| VH3\|3-21/D2\|2-15\|RF3/JH1 | | H_FR4 | |
|---|---|---|---|
| MA_12-E12_CCx_I2C0_x_scFc_(J7J)_translation Fv#1 | VH3\|3-21/D2\|2-15\|RF3/JH1 | WGQGTLVTVSS | 4336 |
|  |  | WGQGTLVTVSS | 4337 |
| MA_12-E12_CCx_I2C0_x_scFc_(J7J)_translation Fv#2 | VH3\|3-73/D3\|3-3\|RF3/JH4 | WGQGTLVTVSS | 4339 |
| MA_13-D12_CCx_I2C0_x_scFc_(S4S)_translation Fv#2 | VH3\|3-73/D3\|3-3\|RF3/JH4 | WGQGTLVTVSS | 4340 |
| MA_24-C9_CCx_I2C0x_scFc_(M6S)_translation Fv#2 | VH3\|3-73/D3\|3-3\|RF3/JH4 | WGQGTLVTVSS | 4341 |
| MA_24-G6_CCx_I2C0_x_scFc_(M9Z)_translation Fv#2 | VH3\|3-73/D3\|3-3\|RF3/JH4 | WGQGTLVTVSS | 4342 |
| MA_31-H8_CCx_I2C0_x_scFc_(F3H)_translation Fv#2 | VH3\|3-73/D3\|3-3\|RF3/JH4 | WGQGTLVTVSS | 4343 |
| MA_32-A8_CCx_I2C0_x_scFc_(J6Z)_translation Fv#2 | VH3\|3-73/D3\|3-3\|RF3/JH4 | WGQGTLVTVSS | 4344 |
| MA_32-C3_CCx_I2C0x_scFc_(L2A)_translation Fv#2 | VH3\|3-73/D3\|3-3\|RF3/JH4 | WGQGTLVTVSS | 4345 |
| MA_48-D12_CCx_I2C0x_scFc_(B4P)_translation Fv#2 | VH3\|3-73/D3\|3-3\|RF3/JH4 | WGQGTLVTVSS | 4346 |
| VH3\|3-30.3/D3\|3-16\|RF2/JH6 | | | |
| MA_13-D12_CCx_I2C0_x_scFc_(S4S)_translation Fv#1 | VH3\|3-30.3/D3\|3-16\|RF2/JH6 | WGQGTTVTVSS | 4347 |
|  |  | WGQGTTVTVSS | 4348 |
| VH1\|1-e/D2\|2-15\|RF3/JH4 | | | |
| MA_24-C9_CCx_I2C0x_scFc_(M6S)_translation Fv#1 | VH1\|1-e/D2\|2-15\|RF3/JH4 | WGQGTLVTVSS | 4349 |
|  |  | WGQGTLVTVSS | 4350 |
| VH1\|1-e/D5\|5-18\|RF3/JH4 | | | |
| MA_24-G6_CCx_I2C0_x_scFc_(M9Z)_translation Fv#1 | VH1\|1-e/D5\|5-18\|RF3/JH4 Germline | WGQGTLVTVSS | 4351 |
|  |  | WGQGTRVTVSS | 4352 |
| VH1\|1-e/D1\|1-1\|RF2/JH3 | | | |
| MA_31-H8_CCx_I2C0_x_scFc_(F3H)_translation Fv#1 | VH1\|1-e/D1\|1-1\|RF2/JH3 | WGQGTMVTVSS | 4353 |
|  |  | WGQGTSVTVSS | 4354 |
| VH1\|1-08/D5\|5-18\|RF3/JH6 | | | |
| MA_32-A8_CCx_I2C0_x_scFc_(J6Z)_translation Fv#1 | VH1\|1-08/D5\|5-18\|RF3/JH6 | WGQGTTVTVSS | 4355 |
|  |  | WGQGTTVTVSS | 4356 |
| VH4\|4-34/D5\|5-12\|RF3/JH6 | | | |
| MA_32-C3_CCx_I2C0x_scFc_(L2A)_translation Fv#1 | VH4\|4-34/D5\|5-12\|RF3/JH6 | WGQGTTVTVSS | 4357 |
|  |  | WGQGTTVTVSS | 4358 |
| VH3\|3-30.3/D1\|1-1\|RF2/JH6 | | | |
| MA_48-D12_CCx_I2C0x_scFc_(B4P)_translation Fv#1 | VH3\|3-30.3/D1\|1-1\|RF2/JH6 | WGQGTTVTVSS | 4359 |
|  |  | WGQGTTVTVSS | 4360 |

TABLE 45

BiTE-scFc_Variable Region Protein Alignment (MAGEB2)
CDRs defined by Kabat
Alignment numbering defined by Amgen Reference (AHo)

KAPPA_VARIABLE

| | Germline | K_FR1 | SEQ ID NO: |
|---|---|---|---|
| VK3\|A27/JK4 | | EIVLTQSPGTLSLSPGERATLSC | 4361 |
| MA_12-E12_CCx_I2C0_x_scFc_(J7J)_translation Fv#1 | VK3\|A27/JK4 | ........................ | 4362 |
| VK4\|B3/JK2 | | DIVMTQSPDSLAVSLGERATINC | 4363 |
| MA_24-C9_CCx_I2C0x_scFc_(M6S)_translation Fv#1 | VK4\|B3/JK2 | EL.......S....V..KI.MS. | 4364 |
| VK6\|A10/JK2 | | EIVLTQSPDFQSVTPKEKVTITC | 4365 |
| MA_24-G6_CCx_I2C0_x_scFc_(M9Z)_translation Fv#1 | VK6\|A10/JK2 | .L......AIM.AS.GQ...... | 4366 |
| VK1\|L11/JK2 | | AIQMTQSPSSLSASVGDRVTITC | 4367 |
| MA_31-H8_CCx_I2C0_x_scFc_(F3H)_translation Fv#1 | VK1\|L11/JK2 | EL......A.......ET..... | 4368 |
| VK2\|A19/JK5 | | DIVMTQSPLSLPVTPGEPASISC | 4369 |
| MA_32-A8_CCx_I2C0_x_scFc_(J6Z)_translation Fv#1 | VK2\|A19/JK5 | .............S.......... | 4370 |
| VK2\|A19/JK3 | | DIVMTQSPLSLPVTPGEPASISC | 4371 |
| MA_32-C3_CCx_I2C0x_scFc_(L2A)_translation Fv#1 | VK2\|A19/JK3 | ........................ | 4372 |
| VK3\|A27/JK2 | | EIVLTQSPGTLSLSPGERATLSC | 4373 |
| MA_48-D12_CCx_I2C0x_scFc_(B4P)_translation Fv#1 | VK3\|A27/JK2 | ........................ | 4374 |

TABLE 45-continued

BiTE-scFc_Variable Region Protein Alignment (MAGEB2)
CDRs defined by Kabat
Alignment numbering defined by Amgen Reference (AHo)

K_CDR1

| | | |
|---|---|---|
| VK3\|A27/JK4 | RAS--QSVSS-----SYLA | 4411 |
| MA_12-E12_CCx_I2C0_x_scFc_(J7J)_translation Fv#1 VK3\|A27/JK4 | .................... | 4412 |
| VK4\|B3/JK2 | KSS--QSVLYSSNNKNYLA | 4413 |
| MA_24-C9_CCx_I2C0x_scFc_(M6S)_translation Fv#1 VK4\|B3/JK2 | .......L......Q..... | 4414 |
| VK6\|A10/JK2 | RAS--QSIG------SSLH | 4415 |
| MA_24-G6_CCx_I2C0_x_scFc_(M9Z)_translation Fv#1 VK6\|A10/JK2 | S....SNVN.......-YI. | 4416 |
| VK1\|L11/JK2 | RAS--QGIR------NDLG | 4417 |
| MA_31-H8_CCx_I2C0_x_scFc_(F3H)_translation Fv#1 VK1\|L11/JK2 | .....GN.H........Y.A | 4418 |
| VK2\|A19/JK5 | RSS--QSLLHSN-GYNYLD | 4419 |
| MA_32-A8_CCx_I2C0_x_scFc_(J6Z)_translation Fv#1 VK2\|A19/JK5 | .........Y.......V. | 4420 |
| VK2\|A19/JK3 | RSS--QSLLHSN-GYNYLD | 4421 |
| MA_32-C3_CCx_I2C0x_scFc_(L2A)_translation Fv#1 VK2\|A19/JK3 | .........Y.......... | 4422 |
| VK3\|A27/JK2 | RAS--QSVSS-----SYLA | 4423 |
| MA_48-D12_CCx_I2C0x_scFc_(B4P)_translation Fv#1 VK3\|A27/JK2 | .................... | 4424 |

K_FR2

| | | |
|---|---|---|
| VK3\|A27/JK4 | WYQQKPGQAPRLLIY | 4461 |
| MA_12-E12_CCx_I2C0_x_scFc_(J7J)_translation Fv#1 VK3\|A27/JK4 | ............... | 4462 |
| VK4\|B3/JK2 | WYQQKPGQPPKLLIY | 4463 |
| MA_24-C9_CCx_I2C0x_scFc_(M6S)_translation Fv#1 VK4\|B3/JK2 | ........S...... | 4464 |
| VK6\|A10/JK2 | WYQQKPDQSPKLLIK | 4465 |
| MA_24-G6_CCx_I2C0_x_scFc_(M9Z)_translation Fv#1 VK6\|A10/JK2 | .....LGS....W.Y | 4466 |
| VK1\|L11/JK2 | WYQQKPGKAPKLLIY | 4467 |
| MA_31-H8_CCx_I2C0_x_scFc_(F3H)_translation Fv#1 VK1\|L11/JK2 | .....Q..S.Q..V. | 4468 |
| VK2\|A19/JK5 | WYLQKPGQSPQLLIY | 4469 |
| MA_32-A8_CCx_I2C0_x_scFc_(J6Z)_translation Fv#1 VK2\|A19/JK5 | ............... | 4470 |
| VK2\|A19/JK3 | WYLQKPGQSPQLLIY | 4471 |
| MA_32-C3_CCx_I2C0x_scFc_(L2A)_translation Fv#1 VK2\|A19/JK3 | ............... | 4472 |
| VK3\|A27/JK2 | WYQQKPGQAPRLLIY | 4473 |
| MA_48-D12_CCx_I2C0x_scFc_(B4P)_translation Fv#1 VK3\|A27/JK2 | ............... | 4474 |

LAMBDA_VARIABLE

| Germline | | SEQ ID NO: |
|---|---|---|

L_FR1

| | | |
|---|---|---|
| VL7\|7a/JL3b | QTVVTQE-PSLTVSPGGTVTLTC | 4375 |
| MA_12-E12_CCx_I2C0_x_scFc_(J7J)_translation Fv#2 VL7\|7a/JL3b | ....................... | 4376 |
| MA_13-D12_CCx_I2C0_x_scFc_(S4S)_translation Fv#2 VL7\|7a/JL3b | ....................... | 4377 |
| MA_24-C9_CCx_I2C0x_scFc_(M6S)_translation Fv#2 VL7\|7a/JL3b | ....................... | 4378 |
| MA_24-G6_CCx_I2C0_x_scFc_(M9Z)_translation Fv#2 VL7\|7a/JL3b | ....................... | 4379 |
| MA_31-H8_CCx_I2C0_x_scFc_(F3H)_translation Fv#2 VL7\|7a/JL3b | ....................... | 4380 |
| MA_32-A8_CCx_I2C0_x_scFc_(J6Z)_translation Fv#2 VL7\|7a/JL3b | ....................... | 4381 |
| MA_32-C3_CCx_I2C0x_scFc_(L2A)_translation Fv#2 VL7\|7a/JL3b | ....................... | 4382 |
| MA_48-D12_CCx_I2C0x_scFc_(B4P)_translation Fv#2 VL7\|7a/JL3b | ....................... | 4383 |
| VL7\|7b/JL3b | QAVVTQE-PSLTVSPGGTVTLTC | 4384 |
| MA_13-D12_CCx_I2C0_x_scFc_(S4S)_translation Fv#1 VL7\|7b/JL3b | ....................... | 4385 |

L_CDR1

| | | |
|---|---|---|
| VL7\|7a/JL3b | ASST-GAVTSG----YYPN | 4425 |
| MA_12-E12_CCx_I2C0_x_scFc_(J7J)_translation Fv#2 VL7\|7a/JL3b | G..............N... | 4426 |
| MA_13-D12_CCx_I2C0_x_scFc_(S4S)_translation Fv#2 VL7\|7a/JL3b | G..............N... | 4427 |
| MA_24-C9_CCx_I2C0x_scFc_(M6S)_translation Fv#2 VL7\|7a/JL3b | G..............N... | 4428 |
| MA_24-G6_CCx_I2C0_x_scFc_(M9Z)_translation Fv#2 VL7\|7a/JL3b | G..............N... | 4429 |
| MA_31-H8_CCx_I2C0_x_scFc_(F3H)_translation Fv#2 VL7\|7a/JL3b | G..............N... | 4430 |
| MA_32-A8_CCx_I2C0_x_scFc_(J6Z)_translation Fv#2 VL7\|7a/JL3b | G..............N... | 4431 |
| MA_32-C3_CCx_I2C0x_scFc_(L2A)_translation Fv#2 VL7\|7a/JL3b | G..............N... | 4432 |
| MA_48-D12_CCx_I2C0x_scFc_(B4P)_translation Fv#2 VL7\|7a/JL3b | G..............N... | 4433 |
| VL7\|7b/JL3b | GSST-GAVTSG----HYPY | 4434 |
| MA_13-D12_CCx_I2C0_x_scFc_(S4S)_translation Fv#1 VL7\|7b/JL3b | ................... | 4435 |

L_FR2

| | | |
|---|---|---|
| VL7\|7a/JL3b | WFQQKPGQAPRALIY | 4475 |
| MA_12-E12_CCx_I2C0_x_scFc_(J7J)_translation Fv#2 VL7\|7a/JL3b | .V.........G..G | 4476 |
| MA_13-D12_CCx_I2C0_x_scFc_(S4S)_translation Fv#2 VL7\|7a/JL3b | .V.........G..G | 4477 |
| MA_24-C9_CCx_I2C0x_scFc_(M6S)_translation Fv#2 VL7\|7a/JL3b | .V.........G..G | 4478 |
| MA_24-G6_CCx_I2C0_x_scFc_(M9Z)_translation Fv#2 VL7\|7a/JL3b | .V.........G..G | 4479 |
| MA_31-H8_CCx_I2C0_x_scFc_(F3H)_translation Fv#2 VL7\|7a/JL3b | .V.........G..G | 4480 |

TABLE 45-continued

BiTE-scFc_Variable Region Protein Alignment (MAGEB2)
CDRs defined by Kabat
Alignment numbering defined by Amgen Reference (AHo)

| | | | SEQ ID NO: |
|---|---|---|---|
| MA_32-A8_CCx_I2C0_x_scFc_(J6Z)_translation Fv#2 | VL7\|7a/JL3b | .V.........G..G | 4481 |
| MA_32-C3_CCx_I2C0x_scFc_(L2A)_translation Fv#2 | VL7\|7a/JL3b | .V.........G..G | 4482 |
| MA_48-D12_CCx_I2C0x_scFc_(B4P)_translation Fv#2 | VL7\|7a/JL3b | .V.........G..G | 4483 |
| VL7\|7b/JL3b | | WFQQKPGQAPRTLIY | 4484 |
| MA_13-D12_CCx_I2C0_x_scFc_(S4S)_translation Fv#1 | VL7\|7b/JL3b | ............... | 4485 |

HEAVY_VARIABLE

| | Germline | H_FR1 | SEQ ID NO: |
|---|---|---|---|
| VH3\|3-21/D2\|2-15\|RF3/JH1 | | EVQLVES-GGGLVKPGGSLRLSCAASG-FTFS | 4386 |
| MA_12-E12_CCx_I2C0_x_scFc_(J7J)_translation Fv#1 | VH3\|3-21/D2\|2-15\|RF3/JH1 | ................................ | 4387 |
| VH3\|3-73/D3\|3-3\|RF3/JH4 | | EVQLVES-GGGLVQPGGSLKLSCAASG-FTFS | 4388 |
| MA_12-E12_CCx_I2C0_x_scFc_(J7J)_translation Fv#2 | VH3\|3-73/D3\|3-3\|RF3/JH4 | ...............................N | 4389 |
| MA_13-D12_CCx_I2C0_x_scFc_(S4S)_translation Fv#2 | VH3\|3-73/D3\|3-3\|RF3/JH4 | ...............................N | 4390 |
| MA_24-C9_CCx_I2C0x_scFc_(M6S)_translation Fv#2 | VH3\|3-73/D3\|3-3\|RF3/JH4 | ...............................N | 4391 |
| MA_24-G6_CCx_I2C0_x_scFc_(M9Z)_translation Fv#2 | VH3\|3-73/D3\|3-3\|RF3/JH4 | ...............................N | 4392 |
| MA_31-H8_CCx_I2C0_x_scFc_(F3H)_translation Fv#2 | VH3\|3-73/D3\|3-3\|RF3/JH4 | ...............................N | 4393 |
| MA_32-A8_CCx_I2C0_x_scFc_(J6Z)_translation Fv#2 | VH3\|3-73/D3\|3-3\|RF3/JH4 | ...............................N | 4394 |
| MA_32-C3_CCx_I2C0x_scFc_(L2A)_translation Fv#2 | VH3\|3-73/D3\|3-3\|RF3/JH4 | ...............................N | 4395 |
| MA_48-D12_CCx_I2C0x_scFc_(B4P)_translation Fv#2 | VH3\|3-73/D3\|3-3\|RF3/JH4 | ...............................N | 4396 |
| VH3\|3-30.3/D3\|3-16\|RF2/JH6 | | QVQLVES-GGGVVQPGRSLRLSCAASG-FTFS | 4397 |
| MA_13-D12_CCx_I2C0_x_scFc_(S4S)_translation Fv#1 | VH3\|3-30.3/D3\|3-16\|RF2/JH6 | ................................ | 4398 |
| VH1\|1-e/D2\|2-15\|RF3/JH4 | | QVQLVQS-GAEVKKPGSSVKVSCKASG-GTFS | 4399 |
| MA_24-C9_CCx_I2C0x_scFc_(M6S)_translation Fv#1 | VH1\|1-e/D2\|2-15\|RF3/JH4 | VQL.E....P.LV...A......I........YA.. | 4400 |
| VH1\|1-e/D5\|5-18\|RF3/JH4 | | QVQLVQS-GAEVKKPGSSVKVSCKASG-GTFS | 4401 |
| MA_24-G6_CCx_I2C0_x_scFc_(M9Z)_translation Fv#1 | VH1\|1-e/D5\|5-18\|RF3/JH4 | VQL.E...P.LV...A...I......D.Y... | 4402 |
| VH1\|1-e/D1\|1-1\|RF2/JH3 | | QVQLVQS-GAEVKKPGSSVKVSCKASG-GTFS | 4403 |
| MA_31-H8_CCx_I2C0_x_scFc_(F3H)_translation Fv#1 | VH1\|1-e/D1\|1-1\|RF2/JH3 | VQL.E...P.LV...A...I........YA.. | 4404 |
| VH1\|1-08/D5\|5-18\|RF3/JH6 | | QVQLVQS-GAEVKKPGASVKVSCKASG-YTFT | 4405 |
| MA_32-A8_CCx_I2C0_x_scFc_(J6Z)_translation Fv#1 | VH1\|1-08/D5\|5-18\|RF3/JH6 | ................................ | 4406 |
| VH4\|4-34/D5\|5-12\|RF3/JH6 | | QVQLQQW-GAGLLKPSETLSLTCAVYG-GSFS | 4407 |
| MA_32-C3_CCx_I2C0x_scFc_(L2A)_translation Fv#1 | VH4\|4-34/D5\|5-12\|RF3/JH6 | ............N................... | 4408 |
| VH3\|3-30.3/D1\|1-1\|RF2/JH6 | | QVQLVES-GGGVVQPGRSLRLSCAASG-FTFS | 4409 |
| MA_48-D12_CCx_I2C0x_scFc_(B4P)_translation Fv#1 | VH3\|3-30.3/D1\|1-1\|RF2/JH6 | ...............................R | 4410 |

| | | H_CDR1 | |
|---|---|---|---|
| VH3\|3-21/D2\|2-15\|RF3/JH1 | | S-----YSMN | 4436 |
| MA_12-E12_CCx_I2C0_x_scFc_(J7J)_translation Fv#1 | VH3\|3-21/D2\|2-15\|RF3/JH1 | T......... | 4437 |
| VH3\|3-73/D3\|3-3\|RF3/JH4 | | G-----SAMH | 4438 |
| MA_12-E12_CCx_I2C0_x_scFc_(J7J)_translation Fv#2 | VH3\|3-73/D3\|3-3\|RF3/JH4 | K.....Y..N | 4439 |
| MA_13-D12_CCx_I2C0_x_scFc_(S4S)_translation Fv#2 | VH3\|3-73/D3\|3-3\|RF3/JH4 | K.....Y..N | 4440 |
| MA_24-C9_CCx_I2C0x_scFc_(M6S)_translation Fv#2 | VH3\|3-73/D3\|3-3\|RF3/JH4 | K.....Y..N | 4441 |
| MA_24-G6_CCx_I2C0_x_scFc_(M9Z)_translation Fv#2 | VH3\|3-73/D3\|3-3\|RF3/JH4 | K.....Y..N | 4442 |
| MA_31-H8_CCx_I2C0_x_scFc_(F3H)_translation Fv#2 | VH3\|3-73/D3\|3-3\|RF3/JH4 | K.....Y..N | 4443 |
| MA_32-A8_CCx_I2C0_x_scFc_(J6Z)_translation Fv#2 | VH3\|3-73/D3\|3-3\|RF3/JH4 | K.....Y..N | 4444 |
| MA_32-C3_CCx_I2C0x_scFc_(L2A)_translation Fv#2 | VH3\|3-73/D3\|3-3\|RF3/JH4 | K.....Y..N | 4445 |

TABLE 45-continued

BiTE-scFc_Variable Region Protein Alignment (MAGEB2)
CDRs defined by Kabat
Alignment numbering defined by Amgen Reference (AHo)

| | | | |
|---|---|---|---|
| MA_48-D12_CCx_I2C0x_scFc_(B4P)_translation Fv#2 | VH3\|3-73/D3\|3-3\|RF3/JH4 | K.....Y..N | 4446 |
| VH3\|3-30.3/D3\|3-16\|RF2/JH6 | | S-----YAMH | 4447 |
| MA_13-D12_CCx_I2C0_x_scFc_(S4S)_translation Fv#1 | VH3\|3-30.3/D3\|3-16\|RF2/JH6 | .......G.. | 4448 |
| VH1\|1-e/D2\|2-15\|RF3/JH4 | | S-----YAIS | 4449 |
| MA_24-C9_CCx_I2C0x_scFc_(M6S)_translation Fv#1 | VH1\|1-e/D2\|2-15\|RF3/JH4 | K.....SWMN | 4450 |
| VH1\|1-e/D5\|5-18\|RF3/JH4 | | S-----YAIS | 4451 |
| MA_24-G6_CCx_I2C0_x_scFc_(M9Z)_translation Fv#1 | VH1\|1-e/D5\|5-18\|RF3/JH4 | K.....SWMN | 4452 |
| VH1\|1-e/D1\|1-1\|RF2/JH3 | | S-----YAIS | 4453 |
| MA_31-H8_CCx_I2C0_x_scFc_(F3H)_translation Fv#1 | VH1\|1-e/D1\|1-1\|RF2/JH3 | ......SWMN | 4454 |
| VH1\|1-08\|D5\|5-18\|RF3/JH6 | | S-----YDIN | 4455 |
| MA_32-A8_CCx_I2C0_x_scFc_(J6Z)_translation Fv#1 | VH1\|1-08\|D5\|5-18\|RF3/JH6 | .......... | 4456 |
| VH4\|4-34\|D5\|5-12\|RF3/JH6 | | G-----YYWS | 4457 |
| MA_32-C3_CCx_I2C0x_scFc_(L2A)_translation Fv#1 | VH4\|4-34\|D5\|5-12\|RF3/JH6 | .........N | 4458 |
| VH3\|3-30.3/D1\|1-1\|RF2/JH6 | | S-----YAMH | 4459 |
| MA_48-D12_CCx_I2C0_x_scFc_(B4P)_translation Fv#1 | VH3\|3-30.3/D1\|1-1\|RF2/JH6 | .......R.. | 4460 |
| | | H_FR2 | |
| VH3\|3-21/D2\|2-15\|RF3/JH1 | | WVRQAPGKGLEWVS | 4486 |
| MA_12-E12_CCx_I2C0_x_scFc_(J7J)_translation Fv#1 | VH3\|3-21/D2\|2-15\|RF3/JH1 | ........C..... | 4487 |
| VH3\|3-73/D3\|3-3\|RF3/JH4 | | WVRQASGKGLEWVG | 4488 |
| MA_12-E12_CCx_I2C0_x_scFc_(J7J)_translation Fv#2 | VH3\|3-73/D3\|3-3\|RF3/JH4 | .....P.......A | 4489 |
| MA_13-D12_CCx_I2C0_x_scFc_(S4S)_translation Fv#2 1 | VH3\|3-73/D3\|3-3\|RF3/JH4 | .....P.......A | 4490 |
| MA_24-C9_CCx_I2C0x_scFc_(M6S)_translation Fv#2 | VH3\|3-73/D3\|3-3\|RF3/JH4 | .....P.......A | 4491 |
| MA_24-G6_CCx_I2C0_x_scFc_(M9Z)_translation Fv#2 | VH3\|3-73/D3\|3-3\|RF3/JH4 | .....P.......A | 4492 |
| MA_31-H8_CCx_I2C0_x_scFc_(F3H)_translation Fv#2 | VH3\|3-73/D3\|3-3\|RF3/JH4 | .....P.......A | 4493 |
| MA_32-A8_CCx_I2C0_x_scFc_(J6Z)_translation Fv#2 | VH3\|3-73/D3\|3-3\|RF3/JH4 | .....P.......A | 4494 |
| MA_32-C3_CCx_I2C0_x_scFc_(L2A)_translation Fv#2 | VH3\|3-73/D3\|3-3\|RF3/JH4 | .....P.......A | 4495 |
| MA_48-D12_CCx_I2C0_x_scFc_(B4P)_translation Fv#2 | VH3\|3-73/D3\|3-3\|RF3/JH4 | .....P.......A | 4496 |
| VH3\|3-30.3/D3\|3-16\|RF2/JH6 | | WVRQAPGKGLEWVA | 4497 |
| MA_13-D12_CCx_I2C0_x_scFc_(S4S)_translation Fv#1 | VH3\|3-30.3/D3\|3-16\|RF2/JH6 | ........C..... | 4498 |
| VH1\|1-e/D2\|2-15\|RF3/JH4 | | WVRQAPGQGLEWMG | 4499 |
| MA_24-C9_CCx_I2C0_x_scFc_(M6S)_translation Fv#1 | VH1\|1-e/D2\|2-15\|RF3/JH4 | ..K.R..KC...I. | 4500 |
| VH1\|1-e/D5\|5-18\|RF3/JH4 | | WVRQAPGQGLEWMG | 4501 |
| MA_24-G6_CCx_I2C0_x_scFc_(M9Z)_translation Fv#1 | VH1\|1-e/D5\|5-18\|RF3/JH4 | ..K.R..EC...I. | 4502 |
| VH1\|1-e/D1\|1-1\|RF2/JH3 | | WVRQAPGQGLEWMG | 4503 |
| MA_31-H8_CCx_I2C0_x_scFc_(F3H)_translation Fv#1 | VH1\|1-e/D1\|1-1\|RF2/JH3 | ..K.R..KC...I. | 4504 |
| VH1\|1-08\|D5\|5-18\|RF3/JH6 | | WVRQATGQGLEWMG | 4505 |
| MA_32-A8_CCx_I2C0_x_scFc_(J6Z)_translation Fv#1 | VH1\|1-08\|D5\|5-18\|RF3/JH6 | ........C..... | 4506 |
| VH4\|4-34\|D5\|5-12\|RF3/JH6 | | WIRQPPGKGLEWIG | 4507 |
| MA_32-C3_CCx_I2C0_x_scFc_(L2A)_translation Fv#1 | VH4\|4-34\|D5\|5-12\|RF3/JH6 | ........C..... | 4508 |
| VH3\|3-30.3/D1\|1-1\|RF2/JH6 | | WVRQAPGKGLEWVA | 4509 |
| MA_48-D12_CCx_I2C0_x_scFc_(B4P)_translation Fv#1 | VH3\|3-30.3/D1\|1-1\|RF2/JH6 | ........C..... | 4510 |

TABLE 45-continued

BiTE-scFc_Variable Region Protein Alignment (MAGEB2)
CDRs defined by Kabat
Alignment numbering defined by Amgen Reference (AHo)

KAPPA_VARIABLE

| Germline | | SEQ ID NO: |
|---|---|---|
| | K_CDR2 | |
| VK3\|A27/JK4 | G--------ASSRAT | 4511 |
| MA_12-E12_CCx_I2C0_x_scFc_(J7J)_translation Fv#1 VK3\|A27/JK4 | ................ | 4512 |
| VK4\|B3/JK2 | W--------ASTRES | 4513 |
| MA_24-C9_CCx_I2C0x_scFc_(M6S)_translation Fv#1  VK4\|B3/JK2 | ................ | 4514 |
| VK6\|A10/JK2 | Y--------ASQSES | 4515 |
| MA_24-G6_CCx_I2C0_x_scFc_(M9Z)_translation Fv#1 VK6\|A10/JK2 | D........T.KLAP | 4516 |
| VK1\|L11/JK2 | A--------ASSLQS | 4517 |
| MA_31-H8_CCx_I2C0_x_scFc_(F3H)_translation Fv#1 VK1\|L11/JK2 | N.........KTL.G | 4518 |
| VK2\|A19/JK5 | L--------GSNRAS | 4519 |
| MA_32-A8_CCx_I2C0_x_scFc_(J6Z)_translation Fv#1 VK2\|A19/JK5 | ................ | 4520 |
| VK2\|A19/JK3 | L--------GSNRAS | 4521 |
| MA_32-C3_CCx_I2C0x_scFc_(L2A)_translation Fv#1  VK2\|A19/JK3 | ................ | 4522 |
| VK3\|A27/JK2 | G--------ASSRAT | 4523 |
| MA_48-D12_CCx_I2C0x_scFc_(B4P)_translation Fv#1 VK3\|A27/JK2 | ................ | 4524 |
| | K_FR3 | |
| VK3\|A27/JK4 | GIPDRESGSGSG--TDFTLTISRLEPEDEAVYYC | 4561 |
| MA_12-E12_CCx_I2C0_x_scFc_(J7J)_translation Fv#1 VK3\|A27/JK4 | ................................. | 4562 |
| VK4\|B3/JK2 | GVPDRESGSGSG--TDFTLTISSLQAEDVAVYYC | 4563 |
| MA_24-C9_CCx_I2C0_x_scFc_(M6S)_translation Fv#1  VK4\|B3/JK2 | ......T.................VK...L..... | 4564 |
| VK6\|A10/JK2 | GVPSRFSGSGSG--TDFTLTINSLEAEDAATYYC | 4565 |
| MA_24-G6_CCx_I2C0_x_scFc_(M9Z)_translation Fv#1 VK6\|A10/JK2 | ...A..........SYS...S.M......S.F. | 4566 |
| VK1\|L11/JK2 | GVPSRFSGSGSGT--DFTLTISSLQPEDFATYYC | 4567 |
| MA_31-H8_CCx_I2C0_x_scFc_(F3H)_translation Fv#1 VK1\|L11/JK2 | ................Q.S.K.N.......GS... | 4568 |
| VK2\|A19/JK5 | GVPDRESGSGSG--TDFTLKISRVEAEDVGVYYC | 4569 |
| MA_32-A8_CCx_I2C0_x_scFc_(J6Z)_translation Fv#1 VK2\|A19/JK5 | ............................K..... | 4570 |
| VK2\|A19/JK3 | GVPDRESGSGSG--TDFTLKISRVEAEDVGVYYC | 4571 |
| MA_32-C3_CCx_I2C0x_scFc_(L2A)_translation Fv#1  VK2\|A19/JK3 | ................................. | 4572 |
| VK3\|A27/JK2 | GIPDRFSGSGSG--TDFTLTISRLEPEDEAVYYC | 4573 |
| MA_48-D12_CCx_I2C0x_scFc_(B4P)_translation Fv#1 VK3\|A27/JK2 | ................................. | 4574 |

LAMBDA_VARIABLE

| Germline | | SEQ ID NO: |
|---|---|---|
| | L_CDR2 | |
| VL7\|7a/JL3b | S--------TSNKHS | 4525 |
| MA_12-E12_CCx_I2C0_x_scFc_(J7J)_translation Fv#2 VL7\|7a/JL3b | G........TKFLAP | 4526 |
| MA_13-D12_CCx_I2C0_x_scFc_(S4S)_translation Fv#2 VL7\|7a/JL3b | G........TKFLAP | 4527 |
| MA_24-C9_CCx_I2C0x_scFc_(M6S)_translation Fv#2  VL7\|7a/JL3b | G........TKFLAP | 4528 |
| MA_24-G6_CCx_I2C0_x_scFc_(M9Z)_translation Fv#2 VL7\|7a/JL3b | G........TKFLAP | 4529 |
| MA_31-H8_CCx_I2C0_x_scFc_(F3H)_translation Fv#2 VL7\|7a/JL3b | G........TKFLAP | 4530 |
| MA_32-A8_CCx_I2C0_x_scFc_(J6Z)_translation Fv#2 VL7\|7a/JL3b | G........TKFLAP | 4531 |
| MA_32-C3_CCx_I2C0x_scFc_(L2A)_translation Fv#2  VL7\|7a/JL3b | G........TKFLAP | 4532 |
| MA_48-D12_CCx_I2C0x_scFc_(B4P)_translation Fv#2 VL7\|7a/JL3b | G........TKFLAP | 4533 |
| VL7\|7b/JL3b | D--------TSNKHS | 4534 |
| MA_13-D12_CCx_I2C0_x_scFc_(S4S)_translation Fv#1 VL7\|7b/JL3b | ................ | 4535 |
| | L_FR3 | |
| VL7\|7a/JL3b | WTPARFSGSLLG--GKAALTLSGVQPEDEAEYYC | 4225 |
| MA_12-E12_CCx_I2C0_x_scFc_(J7J)_translation Fv#2 VL7\|7a/JL3b | G................................ | 4226 |
| MA_13-D12_CCx_I2C0_x_scFc_(S4S)_translation Fv#2 VL7\|7a/JL3b | G................................ | 4227 |
| MA_24-C9_CCx_I2C0x_scFc_(M6S)_translation Fv#2  VL7\|7a/JL3b | G................................ | 4228 |
| MA_24-G6_CCx_I2C0_x_scFc_(M9Z)_translation Fv#2 VL7\|7a/JL3b | G................................ | 4229 |
| MA_31-H8_CCx_I2C0_x_scFc_(F3H)_translation Fv#2 VL7\|7a/JL3b | G................................ | 4230 |
| MA_32-A8_CCx_I2C0_x_scFc_(J6Z)_translation Fv#2 VL7\|7a/JL3b | G................................ | 4231 |
| MA_32-C3_CCx_I2C0x_scFc_(L2A)_translation Fv#2  VL7\|7a/JL3b | G................................ | 4232 |
| MA_48-D12_CCx_I2C0x_scFc_(B4P)_translation Fv#2 VL7\|7a/JL3b | G................................ | 4233 |
| VL7\|7b/JL3b | WTPARFSGSLLG--GKAALTLSGAQPEDEAEYYC | 4234 |
| MA_13-D12_CCx_I2C0_x_scFc_(S4S)_translation Fv#1 VL7\|7b/JL3b | ................................. | 4235 |

TABLE 45-continued

BiTE-scFc_Variable Region Protein Alignment (MAGEB2)
CDRs defined by Kabat
Alignment numbering defined by Amgen Reference (AHo)

HEAVY_VARIABLE

H_CDR2

| | Germline | H_CDR2 | SEQ ID NO: |
|---|---|---|---|
| VH3\|3-21/D2\|2-15\|RF3/JH1 | | SISSS---SSYIYYADSVKG | 4536 |
| MA_12-E12_CCx_I2C0_x_scFc_(J7J)_translation Fv#1 | VH3\|3-21/D2\|2-15\|RF3/JH1 | .................... | 4537 |
| VH3\|3-73/D3\|3-3\|RF3/JH4 | | RIRSKA-NSYATAYAASVKG | 4538 |
| MA_12-E12_CCx_I2C0_x_scFc_(J7J)_translation Fv#2 | VH3\|3-73/D3\|3-3\|RF3/JH4 | .....Y.N...Y..D...D | 4539 |
| MA_13-D12_CCx_I2C0_x_scFc_(S4S)_translation Fv#2 1 | VH3\|3-73/D3\|3-3\|RF3/JH4 | .....Y.N...Y..D...D | 4540 |
| MA_24-C9_CCx_I2C0x_scFc_(M6S)_translation Fv#2 | VH3\|3-73/D3\|3-3\|RF3/JH4 | .....Y.N...Y..D...D | 4541 |
| MA_24-G6_CCx_I2C0_x_scFc_(M9Z)_translation Fv#2 | VH3\|3-73/D3\|3-3\|RF3/JH4 | .....Y.N...Y..D...D | 4542 |
| MA_31-H8_CCx_I2C0_x_scFc_(F3H)_translation Fv#2 | VH3\|3-73/D3\|3-3\|RF3/JH4 | .....Y.N...Y..D...D | 4543 |
| MA_32-A8_CCx_I2C0_x_scFc_(J6Z)_translation Fv#2 | VH3\|3-73/D3\|3-3\|RF3/JH4 | .....Y.N...Y..D...D | 4544 |
| MA_32-C3_CCx_I2C0x_scFc_(L2A)_translation Fv#2 | VH3\|3-73/D3\|3-3\|RF3/JH4 | .....Y.N...Y..D...D | 4545 |
| MA_48-D12_CCx_I2C0x_scFc_(B4P)_translation Fv#2 | VH3\|3-73/D3\|3-3\|RF3/JH4 | .....Y.N...Y..D...D | 4546 |
| VH3\|3-30.3/D3\|3-16\|RF2/JH6 | | VISYD---GSNKYYADSVKG | 4547 |
| MA_13-D12_CCx_I2C0_x_scFc_(S4S)_translation Fv#1 | VH3\|3-30.3/D3\|3-16\|RF2/JH6 | L.........S......... | 4548 |
| VH1\|1-e/D2\|2-15\|RF3/JH4 | | GIIPI---FGTANYAQKFQG | 4549 |
| MA_24-C9_CCx_I2C0x_scFc_(M6S)_translation Fv#1 | VH1\|1-e/D2\|2-15\|RF3/JH4 | R.Y.G...D.DT..NG..K. | 4550 |
| VH1\|1-e/D5\|5-18\|RF3/JH4 | | GIIPI---FGTANYAQKFQG | 4551 |
| MA_24-G6_CCx_I2C0_x_scFc_(M9Z)_translation Fv#1 | VH1\|1-e/D5\|5-18\|RF3/JH4 | RVW.G...D.DTT.NE..K. | 4552 |
| VH1\|1-e/D1\|1-1\|RF2/JH3 | | GIIPI---FGTANYAQKFQG | 4553 |
| MA_31-H8_CCx_I2C0_x_scFc_(F3H)_translation Fv#1 | VH1\|1-e/D1\|1-1\|RF2/JH3 | R.Y.G...D.DT..NG..KD | 4554 |
| VH1\|1-08\|D5\|5-18\|RF3/JH6 | | WMNPN---SGNTGYAQKFQG | 4555 |
| MA_32-A8_CCx_I2C0_x_scFc_(J6Z)_translation Fv#1 | VH1\|1-08\|D5\|5-18\|RF3/JH6 | .................... | 4556 |
| VH4\|4-34/D5\|5-12\|RF3/JH6 | | EINH----SGSTNYNPSLKS | 4557 |
| MA_32-C3_CCx_I2C0x_scFc_(L2A)_translation Fv#1 | VH4\|4-34/D5\|5-12\|RF3/JH6 | .................... | 4558 |
| VH3\|3-30.3/D1\|1-1\|RF2/JH6 | | VISYD---GSNKYYADSVKG | 4559 |
| MA_48-D12_CCx_I2C0x_scFc_(B4P)_translation Fv#1 | VH3\|3-30.3/D1\|1-1\|RF2/JH6 | .........G.......... | 4560 |

H_FR3

| | Germline | H_FR3 | SEQ ID NO: |
|---|---|---|---|
| VH3\|3-21/D2\|2-15\|RF3/JH1 | | RFTISRDNAKNSLYLQMNSLRAEDTAVYYCAR- | 4586 |
| MA_12-E12_CCx_I2C0_x_scFc_(J7J)_translation Fv#1 | VH3\|3-21/D2\|2-15\|RF3/JH1 | ................D............ | 4587 |
| VH3\|3-73/D3\|3-3\|RF3/JH4 | | RFTISRDDSKNTAYLQMNSLKTEDTAVYYCTR- | 4588 |
| MA_12-E12_CCx_I2C0_x_scFc_(J7J)_translation Fv#2 | VH3\|3-73/D3\|3-3\|RF3/JH4 | ....................N..........V.. | 4589 |
| MA_13-D12_CCx_I2C0_x_scFc_(S4S)_translation Fv#2 1 | VH3\|3-73/D3\|3-3\|RF3/JH4 | ....................N..........V.. | 4590 |
| MA_24-C9_CCx_I2C0x_scFc_(M6S)_translation Fv#2 | VH3\|3-73/D3\|3-3\|RF3/JH4 | ....................N..........V.. | 4591 |
| MA_24-G6_CCx_I2C0_x_scFc_(M9Z)_translation Fv#2 | VH3\|3-73/D3\|3-3\|RF3/JH4 | ....................N..........V.. | 4592 |
| MA_31-H8_CCx_I2C0_x_scFc_(F3H)_translation Fv#2 | VH3\|3-73/D3\|3-3\|RF3/JH4 | ....................N..........V.. | 4593 |
| MA_32-A8_CCx_I2C0_x_scFc_(J6Z)_translation Fv#2 | VH3\|3-73/D3\|3-3\|RF3/JH4 | ....................N..........V.. | 4594 |
| MA_32-C3_CCx_I2C0x_scFc_(L2A)_translation Fv#2 | VH3\|3-73/D3\|3-3\|RF3/JH4 | ....................N..........V.. | 4595 |
| MA_48-D12_CCx_I2C0x_scFc_(B4P)_translation Fv#2 | VH3\|3-73/D3\|3-3\|RF3/JH4 | ....................N..........V.. | 4596 |
| VH3\|3-30.3/D3\|3-16\|RF2/JH6 | | RFTISRDDSKNTAYLQMNSLRAEDTAVYYCAR- | 4597 |
| MA_13-D12_CCx_I2C0_x_scFc_(S4S)_translation Fv#1 | VH3\|3-30.3/D3\|3-16\|RF2/JH6 | .............D..................S | 4598 |

TABLE 45-continued

BiTE-scFc_Variable Region Protein Alignment (MAGEB2)
CDRs defined by Kabat
Alignment numbering defined by Amgen Reference (AHo)

| Germline / Construct | | Sequence | SEQ ID NO: |
|---|---|---|---|
| VH1\|1-e/D2\|2-15\|RF3/JH4 | | RVTITADKSTSTAYMELSSLRSEDTAVYYCAR- | 4599 |
| MA_24-C9_CCx_I2C0x_scFc_(M6S)_translation Fv#1 | VH1\|1-e/D2\|2-15\|RF3/JH4 | KAAL.....SN..N.Q.N..T...S...F.... | 4600 |
| VH1\|1-e/D5\|5-18\|RF3/JH4 | | RVTITADKSTSTAYMELSSLRSEDTAVYYCAR- | 4601 |
| MA_24-G6_CCx_I2C0_x_scFc_(M9Z)_translation Fv#1 | VH1\|1-e/D5\|5-18\|RF3/JH4 | KA.L.....SR....Q....T...S...F.... | 4602 |
| VH1\|1-e/D1\|1-1\|RF2/JH3 | | RVTITADKSTSTAYMELSSLRSEDTAVYYCAR- | 4603 |
| MA_31-H8_CCx_I2C0_x_scFc_(F3H)_translation Fv#1 | VH1\|1-e/D1\|1-1\|RF2/JH3 | KA.L.....SN....Q....T...S...F.... | 4604 |
| VH1\|1-08/D5\|5-18\|RF3/JH6 | | RVTMTRNTSISTAYMELSSLRSEDTAVYYCAR- | 4605 |
| MA_32-A8_CCx_I2C0_x_scFc_(J6Z)_translation Fv#1 | VH1\|1-08/D5\|5-18\|RF3/JH6 | ................................ | 4606 |
| VH4\|4-34/D5\|5-12\|RF3/JH6 | | RVTISVDTSKNQFSLKLSSVTAADTAVYYCAR- | 4607 |
| MA_32-C3_CCx_I2C0x_scFc_(L2A)_translation Fv#1 | VH4\|4-34/D5\|5-12\|RF3/JH6 | ................................ | 4608 |
| VH3\|3-30.3/D1\|1-1\|RF2/JH6 | | RFTISRDNSKNTLYLQMNSLRAEDTAVYYCAR- | 4609 |
| MA_48-D12_CCx_I2C0x_scFc_(B4P)_translation Fv#1 | VH3\|3-30.3/D1\|1-1\|RF2/JH6 | ................................ | 4610 |

KAPPA_VARIABLE

| Germline | | K_CDR3 | SEQ ID NO: |
|---|---|---|---|
| VK3\|A27/JK4 | | QQYGS---------------------SPLT | 4611 |
| MA_12-E12_CCx_I2C0_x_scFc_(J7J)_translation Fv#1 | VK3\|A27/JK4 | ...AN......................... | 4612 |
| VK4\|B3/JK2 | | QQYYS---------------------TPYT | 4613 |
| MA_24-C9_CCx_I2C0x_scFc_(M6S)_translation Fv#1 | VK4\|B3/JK2 | .........................Y... | 4614 |
| VK6\|A10/JK2 | | HQSSS---------------------LPYT | 4615 |
| MA_24-G6_CCx_I2C0_x_scFc_(M9Z)_translation Fv#1 | VK6\|A10/JK2 | ..W......................Y.P. | 4616 |
| VK1\|L11/JK2 | | LQDYN---------------------YPYT | 4617 |
| MA_31-H8_CCx_I2C0_x_scFc_(F3H)_translation Fv#1 | VK1\|L11/JK2 | QHH.G....................T.L. | 4618 |
| VK2\|A19/JK5 | | MQALQ---------------------TPIT | 4619 |
| MA_32-A8_CCx_I2C0_x_scFc_(J6Z)_translation Fv#1 | VK2\|A19/JK5 | .........................P.. | 4620 |
| VK2\|A19/JK3 | | MQALQ---------------------TPFT | 4621 |
| MA_32-C3_CCx_I2C0x_scFc_(L2A)_translation Fv#1 | VK2\|A19/JK3 | .........................P.. | 4622 |
| VK3\|A27/JK2 | | QQYGS---------------------SPYT | 4623 |
| MA_48-D12_CCx_I2C0x_scFc_(B4P)_translation Fv#1 | VK3\|A27/JK2 | .........................L.. | 4624 |

| Germline | | K_FR4 | |
|---|---|---|---|
| VK3\|A27/JK4 | | FGGGTKVEIK | 4661 |
| MA_12-E12_CCx_I2C0_x_scFc_(J7J)_translation Fv#1 | VK3\|A27/JK4 | ..C....... | 4662 |
| VK4\|B3/JK2 | | FGQGTKLEIK | 4663 |
| MA_24-C9_CCx_I2C0x_scFc_(M6S)_translation Fv#1 | VK4\|B3/JK2 | ..C.....L. | 4664 |
| VK6\|A10/JK2 | | FGQGTKLEIK | 4665 |
| MA_24-G6_CCx_I2C0_x_scFc_(M9Z)_translation Fv#1 | VK6\|A10/JK2 | ..C....... | 4666 |
| VK1\|L11/JK2 | | FGQGTKLEIK | 4667 |
| MA_31-H8_CCx_I2C0_x_scFc_(F3H)_translation Fv#1 | VK1\|L11/JK2 | ..C.....L. | 4668 |
| VK2\|A19/JK5 | | FGQGTRLEIK | 4669 |
| MA_32-A8_CCx_I2C0_x_scFc_(J6Z)_translation Fv#1 | VK2\|A19/JK5 | ..C....... | 4670 |
| VK2\|A19/JK3 | | FGPGTKVDIK | 4671 |
| MA_32-C3_CCx_I2C0x_scFc_(L2A)_translation Fv#1 | VK2\|A19/JK3 | ..C....... | 4672 |
| VK3\|A27/JK2 | | FGQGTKLEIK | 4673 |
| MA_48-D12_CCx_I2C0x_scFc_(B4P)_translation Fv#1 | VK3\|A27/JK2 | ..C....... | 4674 |

LAMBDA_VARIABLE

| Germline | | L_CDR3 | SEQ ID NO: |
|---|---|---|---|
| VL7\|7a/JL3b | | LLYYG---------------------GAQWV | 4625 |
| MA_12-E12_CCx_I2C0_x_scFc_(J7J)_translation Fv#2 | VL7\|7a/JL3b | V.W.S.....................-NR.. | 4626 |
| MA_13-D12_CCx_I2C0_x_scFc_(S4S)_translation Fv#2 | VL7\|7a/JL3b | V.W.S.....................-NR.. | 4627 |
| MA_24-C9_CCx_I2C0x_scFc_(M6S)_translation Fv#2 | VL7\|7a/JL3b | V.W.S.....................-NR.. | 4628 |
| MA_24-G6_CCx_I2C0_x_scFc_(M9Z)_translation Fv#2 | VL7\|7a/JL3b | V.W.S.....................-NR.. | 4629 |
| MA_31-H8_CCx_I2C0_x_scFc_(F3H)_translation Fv#2 | VL7\|7a/JL3b | V.W.S.....................-NR.. | 4630 |
| MA_32-A8_CCx_I2C0_x_scFc_(J6Z)_translation Fv#2 | VL7\|7a/JL3b | V.W.S.....................-NR.. | 4631 |
| MA_32-C3_CCx_I2C0x_scFc_(L2A)_translation Fv#2 | VL7\|7a/JL3b | V.W.S.....................-NR.. | 4632 |

TABLE 45-continued

BiTE-scFc_Variable Region Protein Alignment (MAGEB2)
CDRs defined by Kabat
Alignment numbering defined by Amgen Reference (AHo)

| | | SEQ ID NO: |
|---|---|---|
| MA_48-D12_CCx_I2C0x_scFc_(B4P)_translation Fv#2 VL7\|7a/JL3b | V.W.S....................-NR.. | 4633 |
| VL7\|7b/JL3b | LLSYS---------------------GARWV | 4634 |
| MA_13-D12_CCx_I2C0_x_scFc_(S4S)_translation Fv#1VL7\|7b/JL3b | F....G....................ARN.. | 4635 |

| | L_FR4 | |
|---|---|---|
| VL7\|7a/JL3b | FGGGTKLTVL | 4675 |
| MA_12-E12_CCx_I2C0_x_scFc_(J7J)_translation Fv#2VL7\|7a/JL3b | .......... | 4676 |
| MA_13-D12_CCx_I2C0_x_scFc_(S4S)_translation Fv#2 VL7\|7a/JL3b | .......... | 4677 |
| MA_24-C9_CCx_I2C0x_scFc_(M6S)_translation Fv#2 VL7\|7a/JL3b | .......... | 4678 |
| MA_24-G6_CCx_I2C0_x_scFc_(M9Z)_translation Fv#2 VL7\|7a/JL3b | .......... | 4679 |
| MA_31-H8_CCx_I2C0_x_scFc_(F3H)_translation Fv#2 VL7\|7a/JL3b | .......... | 4680 |
| MA_32-A8_CCx_I2C0_x_scFc_(J6Z)_translation Fv#2 VL7\|7a/JL3b | .......... | 4681 |
| MA_32-C3_CCx_I2C0x_scFc_(L2A)_translation Fv#2 VL7\|7a/JL3b | .......... | 4682 |
| MA_48-D12_CCx_I2C0x_scFc_(B4P)_translation Fv#2 VL7\|7a/JL3b | .......... | 4683 |
| VL7\|7b/JL3b | FGGGTKLTVL | 4684 |
| MA_13-D12_CCx_I2C0_x_scFc_(S4S)_translation Fv#1VL7\|7b/JL3b | ..C....... | 4685 |

HEAVY_VARIABLE

| Germline | | SEQ ID NO: |
|---|---|---|
| | H_CDR3 | |
| VH3\|3-21/D2\|2-15\|RF3/JH1 | DIVVVAA---------------TAEYFQH | 4636 |
| MA_12-E12_CCx_I2C0_x_scFc_(J7J)_translation Fv#1VH3\|3-21/D2\|2-15\|RF3/JH1 | .RIA.A--................--T..DN | 4637 |
| VH3\|3-73/D3\|3-3\|RF3/JH4 | ITIFGVV----------------IIYFDY | 4638 |
| MA_12-E12_CCx_I2C0_x_scFc_(J7J)_translation Fv#2VH3\|3-73/D3\|3-3\|RF3/JH4 | HGN..NS..............Y.S.WA. | 4639 |
| MA_13-D12_CCx_I2C0_x_scFc_(S4S)_translation Fv#2VH3\|3-73/D3\|3-3\|RF3/JH4 | HGN..NS..............Y.S.WA. | 4640 |
| MA_24-C9_CCx_I2C0x_scFc_(M6S)_translation Fv#2 VH3\|3-73/D3\|3-3\|RF3/JH4 | HGN..NS..............Y.S.WA. | 4641 |
| MA_24-G6_CCx_I2C0_x_scFc_(M9Z)_translation Fv#2 VH3\|3-73/D3\|3-3\|RF3/JH4 | HGN..NS..............Y.S.WA. | 4642 |
| MA_31-H8_CCx_I2C0_x_scFc_(F3H)_translation Fv#2 VH3\|3-73/D3\|3-3\|RF3/JH4 | HGN..NS..............Y.S.WA. | 4643 |
| MA_32-A8_CCx_I2C0_x_scFc_(J6Z)_translation Fv#2 VH3\|3-73/D3\|3-3\|RF3/JH4 | HGN..NS..............Y.S.WA. | 4644 |
| MA_32-C3_CCx_I2C0x_scFc_(L2A)_translation Fv#2 VH3\|3-73/D3\|3-3\|RF3/JH4 | HGN..NS..............Y.S.WA. | 4645 |
| MA_48-D12_CCx_I2C0x_scFc_(B4P)_translation Fv#2 VH3\|3-73/D3\|3-3\|RF3/JH4 | HGN..NS..............Y.S.WA. | 4646 |
| VH3\|3-30.3/D3\|3-16\|RF2/JH6 | YYDYVWGSYRY---------TYYYYYGMDV | 4647 |
| MA_13-D12_CCx_I2C0_x_scFc_(S4S)_translation Fv#1VH3\|3-30.3/D3\|3-16\|RF2/JH6 | P..........--..........RN...... | 4648 |
| VH1\|1-e/D2\|2-15\|RF3/JH4 | DIVVVA----------------ATYFDY | 4649 |
| MA_24-C9_CCx_I2C0x_scFc_(M6S)_translation Fv#1 VH1\|1-e/D2\|2-15\|RF3/JH4 | .G.FY--..............-APLA. | 4650 |
| VH1\|1-e/D5\|5-18\|RF3/JH4 | GYSYG------------------YYFDY | 4651 |
| MA_24-G6_CCx_I2C0x_scFc_(M9Z)_translation Fv#1 VH1\|1-e/D5\|5-18\|RF3/JH4 | .NYF.SS..............EA.... | 4652 |
| VH1\|1-e/D1\|1-1\|RF2/JH3 | VQLER------------------DAFDI | 4653 |
| MA_31-H8_CCx_I2C0_x_scFc_(F3H)_translation Fv#1 VH1\|1-e/D1\|1-1\|RF2/JH3 | R..NHV................F.M.Y | 4654 |
| VH1\|1-08/D5\|5-18\|RF3/JH6 | GYSYGYYY--------------YYYGMDV | 4655 |
| MA_32-A8_CCx_I2C0_x_scFc_(J6Z)_translation Fv#1 VH1\|1-08/D5\|5-18\|RF3/JH6 | .GG.SNG-...............D..... | 4656 |
| VH4\|4-34/D5\|5-12\|RF3/JH6 | GYSGYDYY--------------YYYYGMDV | 4657 |
| MA_32-C3_CCx_I2C0x_scFc_(L2A)_translation Fv#1 VH4\|4-34/D5\|5-12\|RF3/JH6 | .GGYSYG-................-.D..... | 4658 |
| VH3\|3-30.3/D1\|1-1\|RF2/JH6 | VQLERYY--------------YYYGMDV | 4659 |
| MA_48-D12_CCx_I2C0x_scFc_(B4P)_translation Fv#1 VH3\|3-30.3/D1\|1-1\|RF2/JH6 | E.WPN.-..................-...... | 4660 |
| | H_FR4 | |
| VH3\|3-21/D2\|2-15\|RF3/JH1 | | |
| MA_12-E12_CCx_I2C0_x_scFc_(J7J)_translation Fv#1VH3\|3-21/D2\|2-15\|RF3/JH1 | WGQGTLVTVSS | 4686 |
| MA_12-E12_CCx_I2C0_x_scFc_(J7J)_translation Fv#2VH3\|3-73/D3\|3-3\|RF3/JH4 | .......... | 4687 |
| | .......... | 4689 |

TABLE 45-continued

BiTE-scFc_Variable Region Protein Alignment (MAGEB2)
CDRs defined by Kabat
Alignment numbering defined by Amgen Reference (AHo)

| | | | |
|---|---|---|---|
| MA_13-D12_CCx_I2C0_x_scFc_(S4S)_translation Fv#2 | VH3\|3-73/D3\|3-3\|RF3/JH4 | ........... | 4690 |
| MA_24-C9_CCx_I2C0x_scFc_(M6S)_translation Fv#2 | VH3\|3-73/D3\|3-3\|RF3/JH4 | ........... | 4691 |
| MA_24-G6_CCx_I2C0_x_scFc_(M9Z)_translation Fv#2 | VH3\|3-73/D3\|3-3\|RF3/JH4 | ........... | 4692 |
| MA_31-H8_CCx_I2C0_x_scFc_(F3H)_translation Fv#2 | VH3\|3-73/D3\|3-3\|RF3/JH4 | ........... | 4693 |
| MA_32-A8_CCx_I2C0_x_scFc_(J6Z)_translation Fv#2 | VH3\|3-73/D3\|3-3\|RF3/JH4 | ........... | 4694 |
| MA_32-C3_CCx_I2C0x_scFc_(L2A)_translation Fv#2 | VH3\|3-73/D3\|3-3\|RF3/JH4 | ........... | 4695 |
| MA_48-D12_CCx_I2C0x_scFc_(B4P)_translation Fv#2 | VH3\|3-73/D3\|3-3\|RF3/JH4 | ........... | 4696 |
| VH3\|3-30.3/D3\|3-16\|RF2/JH6 | | | |
| MA_13-D12_CCx_I2C0_x_scFc_(S4S)_translation Fv#1 | VH3\|3-30.3/D3\|3-16\|RF2/JH6 | WGQGTTVTVSS ........... | 4697 4698 |
| VH1\|1-e/D2\|2-15\|RF3/JH4 | | | |
| MA_24-C9_CCx_I2C0x_scFc_(M6S)_translation Fv#1 | VH1\|1-e/D2\|2-15\|RF3/JH4 | WGQGTLVTVSS ........... | 4699 4700 |
| VH1\|1-e/D5\|5-18\|RF3/JH4 | | | |
| MA_24-G6_CCx_I2C0_x_scFc_(M9Z)_translation Fv#1 | VH1\|1-e/D5\|5-18\|RF3/JH4 Germline | WGQGTLVTVSS .....R..... | 4701 4702 |
| VH1\|1-e/D1\|1-1\|RF2/JH3 | | | |
| MA_31-H8_CCx_I2C0_x_scFc_(F3H)_translation Fv#1 | VH1\|1-e/D1\|1-1\|RF2/JH3 | WGQGTMVTVSS .....S..... | 4703 4704 |
| VH1\|1-08/D5\|5-18\|RF3/JH6 | | | |
| MA_32-A8_CCx_I2C0_x_scFc_(J6Z)_translation Fv#1 | VH1\|1-08/D5\|5-18\|RF3/JH6 | WGQGTTVTVSS ........... | 4705 4706 |
| VH4\|4-34/D5\|5-12\|RF3/JH6 | | | |
| MA_32-C3_CCx_I2C0x_scFc_(L2A)_translation Fv#1 | VH4\|4-34/D5\|5-12\|RF3/JH6 | WGQGTTVTVSS ........... | 4707 4708 |
| VH3\|3-30.3/D1\|1-1\|RF2/JH6 | | | |
| MA_48-D12_CCx_I2C0x_scFc_(B4P)_translation Fv#1 | VH3\|3-30.3/D1\|1-1\|RF2/JH6 | WGQGTTVTVSS ........... | 4709 4710 |

TABLE 46

BiTE-scFc_Full Sequences

| Ab | Type |  |
|---|---|---|
| BiTE scFc | | |
| MA_12-E12_CC_x_I2C0x_scFc_(E9U)_translation | NA | No nuc. seq available |
| | AA | MDMRVPAQLLGLLLLWLRGARCEVQLVESGGGLVKPGGSLRLSCAASGFTFSTYSMNWVRQAPGKGLEWVSSISSSSSYIYYADSVKGRFTISRDNAKNS LYLQMNSLRDEDTAVYYCARDRIAVATYFDNWGQGTLVTVSSGGGGSGGGGSGGGGSEIVLTQSPGTLSLSPGERATLSCRASQSVSSSYLAWYQQKPGQ APRLLIYGASSRATGIPDRESGSGSGTDFTLTISRLEPEDFAVYYCQQYANSPLTFGCGTKVEIKSGGGGSEVQLVESGGGLVQPGGSLKLSCAASGFTF NKYAMNWVRQAPGKGLEWVARIRSKYNNYATYYADSVKDRITISRDDSKNTAYLQMNNLKTEDTAVYYCVRHGNSYISYWAYWGQGTLVTVSSGGGG SGGGGSGGGGSQTVVTGGGTKLTVLGGGGSGGGGSVFLFPPKPKDTLMISRTPEVTCVVVDVSHEDPEVKFNWYVDGVEVHNAKTKPCEEQY CVLWYSNRMVFGGGTKLTVLGGGDKTHTCPPCPAPELLGGPSVFLFPPKPKDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGK (SEQ ID NO: 4711) |
| MA_12-E12x_I2C0x_scFc_(W1U)_translation | NA | No nuc. seq available |
| | AA | MDMRVPAQLLGLLLLWLRGARCEVQLVESGGGLVKPGGSLRLSCAASGFTFSTYSMNWVRQAPGKGLEWVSSISSSSSYIYYADSVKGRFTISRDNAKNS LYLQMNSLRDEDTAVYYCARDRIAVATYFDNWGQGTLVTVSSGGGGSGGGGSGGGGSEIVLTQSPGTLSLSPGERATLSCRASQSVSSSYLAWYQQKPGQ APRLLIYGASSRATGIPDRESGSGSGTDFTLTISRLEPEDFAVYYCQQYANSPLTFGCGTKVEIKSGGGGSEVQLVESGGGLVQPGGSLKLSCAASGFTE NKYAMNWVRQAPGKGLEWVARIRSKYNNYATYYADSVKDRFTISRDDSKNTAYLQMNNLKTEDTAVYYCVRHGNSYISYWAYWGQGTLVTVSSGGGG SGGGGSGGGGSQTVVTGGGTKLTVLGGGGSGGGGSVFLFPPKPKDTLMISRTPEVTCVVVDSHEDPEVKFNWYVDGVEVHNAKTKPCEEQY CVLWYSNRMVFGGGTKLTVLGGGDKTHTCPPCPAPELLGGPSVFLFPPKPKDTLMISRTPEVTCVVVDSHEDPEVKFNWYVDGVEVHNAKTKPCEEQY GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGK (SEQ ID NO: 4712) |
| MA_13-D8_CCx_I2C0x_scFc_(U7V)_translation | NA | No nuc. seq available |
| | AA | MDMRVPAQLLGLLLLWLRGARCEVQLLESGGGLVQPGGSLRLSCAASGFTFSSFAMSWVRQAPGKCIEWVSAISGSGGSTYYADSVKGRFTISRDNSKNT VPKLLIYAASTLQSGVPSRFSGSGSGTDFTLTISSLQPEDFATYYCQQSYSTPPTFGQGTKVEIKSGGGGSEVQLVESGGGLVQPGGSLKLSCAASGETE NKYAMNWVRQAPGKGLEWVARIRSKYNNYATYYADSVKDRFTISRDDSKNTAYLQMNNLKTEDTAVYYCVRHGNSYISYWAYWGQGTLVTVSSGGGG SGGGGSGGGGSQTVVTGGGTKLTVLGGGGSGGGGSVFLFPPKPKDTLMISRTPEVTCVVVDSHEDPEVKFNWYVDGVEVHNAKTKPCEEQY CVLWYSNRMVFGGGTKLTVLGGGDKTHTCPPCPAPELLGGPSVFLFPPKPKDTLMISRTPEVTCVVVDSHEDPEVKFNWYVDGVEVHNAKTKPCEEQY GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGK (SEQ ID NO: 4713) |
| MA_13-D8x_I2C0x_scFc_(M7M)_translation | NA | No nuc. seq available |
| | AA | MDMRVPAQLLGLLLLWLRGARCEVQLLESGGGLVQPGGSLRLSCAASGFTFSSFAMSWVRQAPGKCIEWVSAISGSGGSTYYADSVKGRFTISRDNSKNT LYLQMNSLRAEDTAEYYCAKMVTPDYYYDMDVWGQGTVTVSSLQPEDFTLTISSLQPEDFATYYCQQSPSLSASVGDRVTITCRASQGISNYLAWYQQKPGK VPKLLIYAASTLQSGVPSRFSGSGSGTDFTLTISSLQPEDFATYYCQQSYSTPPTFGQGTKVEIKSGGGGSEVQLVESGGGLVQPGGSLKLSCAASGETE NKYAMNWVRQAPGKGLEWVARIRSKYNNYATYYADSVKDRFTISRDDSKNTAYLQMNNLKTEDTAVYYCVRHGNSYISYWAYWGQGTLVTVSSGGGG |

TABLE 46-continued

BiTE-scFc_Full Sequences

| BiTE-scFc Ab | Type | |
|---|---|---|
| | BiTE scFc | CVLMYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPP<br>VLDSDGSFFLYSKLTVDKSRWQQGNVFSCSVMHEALHNHYTQKSLSLSPGKGGGGSGGGGSGGGGSGGGGSDKTHTCPPCPAPELLGGPS<br>VFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKA<br>KGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK<br>SLSLSPGK<br>(SEQ ID NO: 4714) |
| MA_24-39_CCx_I2C0x_scFc_(I2U)_translation | NA<br>AA | No nuc. seq available<br>MDMRVPAQLLGLLLLWLRGARCEVQLLEQSGPELVKPGASVKISCKASGYAFSKSWMNWVKQRPGKLEWIGRIYPGDGDTNYNGKFKGKAALTADKSSN<br>TANMQLNSLTSEDSAVYFCARDGVFYAPLAYWGQGTLVTVSSGGGGSGGGGSGGGGSELVMTQSPSSLAVSVGEKITMSCKSSQSLLYSSNQKNYLAWYQ<br>QKPGQSPKLLIYWASTRESGVPDRFTGSGSGTDFTLTISSVKAEDLAVYYCQQYYSYPYTFGCGTKLELKSGGGSEVQLVESGGGLVQPGGSLKLSCAA<br>SGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPED<br>EAEYYCVLMYSNRWVFGGGTKLTVLGGGGDKTHTCPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNY<br>KTTPPVLDSDGSFFLYSKLTVDKPKDTLMISRTPEVTCVVVDVSHEDPEVKFNWYVDGVEVHNAKTKPCEEQYGSTYRCVSVLTVLHQDWLNGKEYKCKVSNKALPAPIEK<br>LGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEK<br>TISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHN<br>HYTQKSLSLSPGK<br>(SEQ ID NO: 4715) |
| MA_24-C9x_I2C0x_scFc_(L9Y)_translation | NA<br>AA | No nuc. seq available<br>MDMRVPAQLLGLLLLWLRGARCEVQLLEQSGPELVKPGASVKISCKASGYAFSKSWMNWVKQRPGKLEWIGRIYPGDGDTNYNGKFKGKAALTADKSSN<br>TANMQLNSLTSEDSAVYFCARDGVFYAPLAYWGQGTLVTVSSGGGGSGGGGSGGGGSELVMTQSPSSLAVSVGEKITMSCKSSQSLLYSSNQKNYLAWYQ<br>QKPGQSPKLLIYWASTRESGVPDRFTGSGSGTDFTLTISSVKAEDLAVYYCQQYYSYPYTFGGGTKLELKSGGGSEVQLVESGGGLVQPGGSLKLSCAA<br>SGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPED<br>EAEYYCVLMYSNRWVFGGGTKLTVLGGGGDKTHTCPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNY<br>KTTPPVLDSDGSFFLYSKLTVDKSRWQQGNVFSCSVMHEALHNHYTQKSLSLSPGKGGGGSGGGGSGGGGSDKTHTCPPCPAPEL<br>LGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEK<br>TISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHN<br>HYTQKSLSLSPGK<br>(SEQ ID NO: 4716) |
| MA_24-G6_I2C0x_scFc_(B1I)_translation | NA<br>AA | No nuc. seq available<br>MDMRVPAQLLGLLLLWLRGARCEVQLLEQSGPELVKPGASVKISCKASGYTFSEAYFDYWGQGTRVTVSSGGGGSGGGGSGGGGSELVLTQSPAIMSASPGQKVTITCSASSNVNYIHWYQQKLG<br>TAYMQLSSLTSEDSAVYPCARGNYFGSSEAYFDYWGQGTRVTVSSGGGGSGGGGSGGGGSGGGGSELVLTQSPAIMSASPGQKVTITCSASSNVNYIHWYQQKLG<br>SSPKLWIYDTSKLAPGVPARFSGSGSGTSYSLTISSMEAEDAASYFCHQWSSYPPTFGCGTKLEIKSGGGGSEVQLVESGGGLVQPGGSLKLSCAASGFT<br>FNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGG<br>GSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEY<br>YCVLMYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQ<br>YGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTP<br>PVLDSDGSFFLYSKLTVDKSRWQQGNVFSCSVMHEALHNHYTQKSLSLSPGKGGGGSGGGGSGGGGSGGGGSDKTHTCPPCPAPELLGGP |

TABLE 46-continued

BiTE-scFc_Full Sequences

| Ab | Type | |
|---|---|---|
| | BiTE scFc | SVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISK AKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQ KSLSLSPGK<br>(SEQ ID NO: 4717) |
| MA_24-G6x_I2C0x_scFc_(F1M)_translation | NA<br>AA | No nuc. seq available<br>MDMRVPAQLLGLLLLWLRGARCEVQLLEQSGPELVKPGASVKISCKASDYTFSKSWMNWVKQRPGEGLEWIGRVWPGDGDTTYNEKFPGKATLTADKSSR TAYMQLSSLTSEDSAVYFCARGNYFGSSEAYFDYWGQGTRVTVSSGGGGSGGGGSGGGGSELVLTQSPAIMSASPGQKVTITCSASSNVNYIHWYQQKLG SSPKLWIYDTSKLAPGVPARFSGSGSGTSYSLTISSMEAEDAASYFCHQWSSYPPTFGSGTKLEIKSGGGGSEVQLVESGGGLVQPGGSLKLSCAASGET FNKYAMNWVRQAPGKGLEWVARIRSKNNYATYYADSVKDRFTISRDDSKNTAYLQMNNLKTEDTAVYYCVRHGNEGNSYISYWAYWGQGTLVTVSSGGG GSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEY YCVLWYSNRWVFGGGTKLTVLGGGDKTHTCPPCPAPELLGGPSVFLFPPKPKDTLMISRTPEVTCVVVDVSHEDPEVKENWYVDGVEVHNAKTKPCEEQ YGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGKGGGGSGGGGSTYRCVSVLTVLHQDWLNGKEYKCKVSNKALPAPIEKTISK AKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQ KSLSLSPGK<br>(SEQ ID NO: 4718) |
| MA_31-H8_CCx_I2C0x_scFc_(K4E)_translation | NA<br>AA | No nuc. seq available<br>MDMRVPAQLLGLLLLWLRGARCEVQLLEQSGPELVKPGASVKISCKASGYAFSSSWMNWVKQRPGKGLEWIGRIYPGDGDTNYNGKFKDKATLTADKSSN TAYMQLSSLTSEDSAVYFCARRQLNHVFAMDYWGQGTSVTVSSGGGGSGGGGSELQMTQSPASLSASVGETVTITCRASGNIHNYLAWYQQKOGK SPQLLVYNAKTLAGGVPSRFSGSGSGTQFSLKINSLQPEDFGSYYCQHHYGTPLTFGAGTKLELKSGGGGSEVQLVESGGGLVQPGGSLKLSCAASGFTF NKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPNWVQQKPGQAPRGLIGTKFLAPGTPARFSGSLLGGKAALTLSGVQPEDEAEYY CVLWYSNRWVFGGGTKLTVLGGGDKTHTCPPCPAPELLGGPSVFLFPPKPKDTLMISRTPEVTCVVVDVSHEDPEVKENWYVDGVEVHNAKTKPCEEQY GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGKGGGGSGGGGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK SLSLSPGK<br>(SEQ ID NO: 4719) |
| MA_31-H8x_I2C0x_scFc_(A9E)_translation | NA<br>AA | No nuc. seq available<br>MDMRVPAQLLGLLLLWLRGARCEVQLLEQSGPELVKPGASVKISCKASGYAFSSSWMNWVKQRPGKGLEWIGRIYPGDGDTNYNGKFKDKATLTADKSSN TAYMQLSSLTSEDSAVYFCARRQLNHVFAMDYWGQGTSVTVSSGGGGSGGGGSELQMTQSPASLSASVGETVTITCRASGNIHNYLAWYQQKOGK SPQLLVYNAKTLAGGVPSRFSGSGSGTQFSLKINSLQPEDFGSYYCQHHYGTPLTFGAGTKLELKSGGGGSEVQLVESGGGLVQPGGSLKLSCAASGFTF NKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGG SGGGGSGGGGSQTVVTQEPSLTVSPGGTVTLTCGSSTGAVTSGNYPNWVQQKPGQAPRGLIGTKFLAPGTPARFSGSLLGGKAALTLSGVQPEDEAEYY CVLWYSNRWVFGGGTKLTVLGGGDKTHTCPPCPAPELLGGPSVFLFPPKPKDTLMISRTPEVTCVVVDVSHEDPEVKENWYVDGVEVHNAKTKPCEEQY GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTPP VLFPPKPKDTLMISRTPEVTCVVVDVSHEDPEVKENWYVDGVEVHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK SLSLSPGK<br>(SEQ ID NO: 4720) |

TABLE 46-continued

BiTE-scFc_Full Sequences

| Ab | Type | BiTE scFc |
|---|---|---|
| MA_32-A8_CCx_I2C0x_scFc_(A9E)_translation | NA | No nuc. seq available |
| | AA | MDMRVPAQLLGLLLLWLRGARCQVLVQSGAEVKKPGASVKVSCKASGYTFTSYDINWVRQATGQCLEWMGWMNPNSGNTGYAQKFQGRVTMTRNTSISTAYMELSSLRSEDTAVYYCARGGYSNGYDYGMDVWGQGTTVTVSSGGGGSGGGGSDIVMTQSPLSLPVSPGEPASISCRSSQSLLYSNGYNYVDWYLQKPGQSPQLLIYLGSNRASGVPDRESGSGSGTDFTLKISKVEAEDVGVYYCMQALQTPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNEGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKENWYDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 4721) |
| MA_32-A8_x_I2C0x_scFc_(G6J)_translation | NA | No nuc. seq available |
| | AA | MDMRVPAQLLGLLLLWLRGARCQVLVQSGAEVKKPGASVKVSCKASGYTFTSYDINWVRQATGQCLEWMGWMNPNSGNTGYAQKFQGRVTMTRNTSISTAYMELSSLRSEDTAVYYCARGGYSNGYDYGMDVWGQGTTVTVSSGGGGSGGGGSDIVMTQSPLSLPVSPGEPASISCRSSQSLLYSNGYNYVDWYLQKPGQSPQLLIYLGSNRASGVPDRESGSGSGTDFTLKISKVEAEDVGVYYCMQALQTPFTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNEGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKENWYDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 4722) |
| MA_48-D12_CCx_I2C0x_scFc_(M9T)_translation | NA | No nuc. seq available |
| | AA | MDMRVPAQLLGLLLLWLRGARCQVLVESGGGVVQPGRSLRLSCAASGFTFRSYRMHWVRQAPGKCLEWVAVISYDGGNKYYADSVKGRFTISRDNSKNTLYLQMNSLRAEDTAVYYCAREQWPNYYYGMDVWGQGTTVTVSSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGETFNKYAMNWVRQAPGKGLEWVARIRSKYNNYATYYADSVKDRFTISRDDSKNTAYLQMNNLKTEDTAVYYCVRHGNEGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKENWYDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 4723) |
| MA_48-D12x_I2C0x_scFc_(R9D)_translation | NA | No nuc. seq available |
| | AA | MDMRVPAQLLGLLLLWLRGARCQVLVESGGGVVQPGRSLRLSCAASGFTFRSYRMHWVRQAPGKGLEWVAVISYDGGNKYYADSVKGRFTISRDNSKNTLYLQMNSLRAEDTAVYYCAREQWPNYYYGMDVWGQGTTVTVSSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGETFNKYAMNWVRQAPGKGLEWVARIRSKYNNYATYYADSVKDRFTISRDDSKNTAYLQMNNLKTEDTAVYYCVRHGNEGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELL |

TABLE 46-continued

BiTE-scFc_Full Sequences

| Ab | Type | BiTE scFc |
|---|---|---|
| | | YGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGK (SEQ ID NO: 4724) |
| MA_50-D9_CCx_I2C0x_scFc_(K6S)_translation | NA | No nuc. seq available |
| | AA | MDMRVPAQLLGLLLLWLRGARCQVQLQQSGPGLVKPSQTLSLTCAISGDSVSSNSAAWNWIRQSPSRCLEWLGRTYYRSKWNDYAVSVKSRITINPDTS KNQFSLQLNSVFPEDTAVYYCVREILWFGKLNYYYGMDVWGQGTTVTVSSGGGGSGGGGSGGGGSDIVLTQSPLSLPVTPGDPASISCRSSQSLLHSNGY NYLDWYLQKPGQSPQLLIYLGSNRASGVPDRESGSGSGTDFTLKISRVEAEDVGVYCMQALQTPLTFGCGTKVDIKSGGGGSEVQLVESGGGLVQPGGS LKLSCAASGFTFNKYAMNWRQAPGKGLEWVARIRSKYNNYATYYADSVKDRFTISRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTL SGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGKGGGGSGGGGSGGGGSGGGGSDKTHTCP PCPAPELLGGPSVFLFPPKPKDTLMISRTPEVTCVVVDVSHEDPEVKENWYVDGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSV MHEALHNHYTQKSLSLSPGK (SEQ ID NO: 4725) |
| MA_50-D9x_CCx_I2C0x_scFc_(A4U)_translation | NA | No nuc. seq available |
| | AA | MDMRVPAQLLGLLLLWLRGARCQVQLQQSGPGLVKPSQTLSLTCAISGDSVSSNSAAWNWIRQSPSRGLEWLGRTYYRSKWNDYAVSVKSRITINPDTS KNQFSLQLNSVFPEDTAVYYCVREILWFGKLNYYYGMDVWGQGTTVTVSSGGGGSGGGGSGGGGSDIVLTQSPLSLPVTPGDPASISCRSSQSLLHSNGY NYLDWYLQKPGQSPQLLIYLGSNRASGVPDRESGSGSGTDFTLKISRVEAEDVGVYCMQALQTPLTFGGGTKVDIKSGGGGSEVQLVESGGGLVQPGGS LKLSCAASGFTFNKYAMNWRQAPGKGLEWVARIRSKYNNYATYYADSVKDRETISRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTL SGVQPEDEAEYYCVLWYSNRWVFGGGTKLTVLGGGGDKTHTCPPCPAPELLGGPSVFLFPPKPKDTLMISRTPEVTCVVVDVSHEDPEVKENWYVDGVEV HNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGKGGGGSGGGGSGGGGSGGGGSDKTHTCP PCPAPELLGGPSVFLFPPKPKDTLMISRTPEVTCVVVDVSHEDPEVKENWYVDGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSV MHEALHNHYTQKSLSLSPGK (SEQ ID NO: 4726) |
| MA_78-A6_CCx_I2C0x_scFc_(D8Z)_translation | NA | No nuc. seq available |
| | AA | MDMRVPAQLLGLLLLWLRGARCQVQLQQWGAGLLKPSETLSLTCAVYGGSFSGYYWNWIRQPPGKCLEWIGEINHRGSTNYNPSLKSRVTISVDASKNQF SLKLSSVTAADTAVYYCARGGGYSDGYDYGMDVWGQGTTVTVSSGGGGSGGGGSGGGGSDIVLTQSPGGGSDIVLTQSSPVSPGEPASISCRSSQSLLYSNGYNYVDWY LQKPGQSPQLLIYLGSNRASGVPDRESGSGSGTDFTLKISKVEAEDVGVYCMQALQTPFTFGCGTKVEIKSGGGGSEVQLVESGGGLVQPGGSLKLSCA ASGFTFNKYAMNWRQAPGKGLEWVARIRSKYNNYATYYADSVKDRFTISRDDSKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPE DEAEYYCVLWYSNRWVFGGGTKLTVLGGGGDKTHTCPPCPAPELLGGPSVFLFPPKPKDTLMISRTPEVTCVVVDVSHEDPEVKENWYVDGVEVHNAKTK PCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGKGGGGSGGGGSGGGGSGGGGSGGGGSDKTHTCPPCPAPE LLGGPSVFLFPPKPKDTLMISRTPEVTCVVVDVSHEDPEVKENWYVDGVEVHNAKTKPCEEQYGSTYRCVSVLTVLHQDWLNGKEYKCKVSNKALPAPIE KTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALH NHYTQKSLSLSPGK (SEQ ID NO: 4727) |

TABLE 46-continued

BiTE-scFc_Full Sequences

| BiTE-scFc Ab | Type | |
|---|---|---|
| MA_78-A6x_I2C0x_scFc_(K6P)_translation | BITE scFc NA AA | No nuc. seq available<br>MDMRVPAQLLGLLLLWLRGARCQVQLQQMGAGLLKPSETLSLTCAVYGGSFSGYYWMIRQPPGKCLEWIGEINHRGSTNYMPSLKSRVTISDASKNQF SLKLSSVTAADTAVYYCARGGYSDGYDYGMDVWGQGTTVTVSSGGGGSGGGGSGGGGSDIVLTQSPLSPVSGEPASISCRSSQSLLYSNGYNYVDWY LQKPGQSPQLLIYLGSNRASGVPDRESGSGSGTDFTLKISKVEAEDVGVYYCMQALQTPFTFGCGTKVEIKSGGGGSEVQLVESGGGLVQPGGSLKLSCA ASGFTFNKYAMMWVRQAPGKGLEWVARIRSKYNNYATYYADSVKDRFTISRDDSKNTAYLQMNNLKTEDTAVYYCVRHGNEGNSYISYWAYWGQGTLVTV SSGGGGSGGGGSGGGGSQTVVTQEPSLTVSPGGTVTLTCGSSTGAVTSGNYPNWVQQKPGQAPRGLLIGGTKFLAPGTPARFSGSLLGGKAALTLSGVQPE DEAEYYCVLWYSNRWVFGGGTKLTVLGGGGDKTHTCPPCPAPELLGGPSVFLFPPKPKDTLMISRTPEVTCVVVDVSHEDPEVKENWYVDGVEVHNAKTK PCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGKGGGGSGGGGSGGGGSGGGGSDKTHTCPPCPAPE LLGGPSVFLFPPKPKDTLMISRTPEVTCVVVDVSHEDPEVKENWYVDGVEVHNAKTKPCEEQYGSTYRCVSVLTVLHQDWLNGKEYKCKVSNKALPAPIE KTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALH NHYTQKSLSLSPGK<br>(SEQ ID NO: 4728) |
| MA_79-E3_CC_x_I2C0x_scFc_(E2Y)_translation | NA AA | No nuc. seq available<br>MDMRVPAQLLGLLLLWLRGARCEVQLLESGGGLVQPGGSLRLSCAASGFTFSSFAMSWVRQAPGKCLEWVSAISGSGGSTYYADSVKGRFTISRDNSKNT LYLQMNSLRAEDTAEYYCAKMVTPDYYYDMDVWGQGTTVTVSSGGGGSGGGGSGGGGSDIQMTQSPSSVSASVGDRVTITCRASQSISSYLNWYQQKPGK APKSLIIYAASSLQSGVPSRFSGSGSGTDFTLTISSLQPEDFATYYCQQSYRTPPTFGQGTKVDIKSGGGGSEVQLVESGGGLVQPGGSLKLSCAASGETE NKYAMMWVRQAPGKGLEWVARIRSKYNNYATYYADSVKDRFTISRDDSKNTAYLQMNNLKTEDTAVYYCVRHGNEGNSYISYWAYWGQGTLVTVSSGGGG SGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKENWYVDGVEVHNAKTKPCEEQY GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGKGGGGSGGGGSGGGGSGGGGSDKTHTCPPCPAPELLGGPS VFLFPPKPKDTLMISRTPEVTCVVVDVSHEDPEVKENWYVDGVEVHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK SLSLSPGK<br>(SEQ ID NO: 4729) |
| MA_79-E3x_CC_I2C0x_scFc_(N4F)_translation | NA AA | No nuc. seq available<br>MDMRVPAQLLGLLLLWLRGARCEVQLLESGGGLVQPGGSLRLSCAASGFTFSSFAMSWVRQAPGKGLEWVSAISGSGGSTYYADSVKGRFTISRDNSKNT LYLQMNSLRAEDTAEYYCAKMVTPDYYYDMDVWGQGTTVTVSSGGGGSGGGGSGGGGSDIQMTQSPSSVSASVGDRVTITCRASQSISSYLNWYQQKPGK APKSLIIYAASSLQSGVPSRFSGSGSGTDFTLTISSLQPEDFATYYCQQSYRTPPTFGQGTKVDIKSGGGGSEVQLVESGGGLVQPGGSLKLSCAASGETE NKYAMMWVRQAPGKGLEWVARIRSKYNNYATYYADSVKDRFTISRDDSKNTAYLQMNNLKTEDTAVYYCVRHGNEGNSYISYWAYWGQGTLVTVSSGGGG SGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKENWYVDGVEVHNAKTKPCEEQY GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGKGGGGSGGGGSGGGGSGGGGSDKTHTCPPCPAPELLGGPS VFLFPPKPKDTLMISRTPEVTCVVVDVSHEDPEVKENWYVDGVEVHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQK SLSLSPGK<br>(SEQ ID NO: 4730) |
| MA_83-F3_CCx_I2C0x_scFc_(G5K)_translation | NA AA | No nuc. seq available<br>MDMRVPAQLLGLLLLWLRGARCQVQLVQSGAEVKKPGASVKVSCKASGYSFTGYYMHWVRQAPGQCLEWMGRINPNSGDTHYAQKFQGRVTMTRDTSIST AYMELSRLRSDDTAVYYCARGLGISFFDYWGQGTLVTVSSGGGGSGGGGSGGGGSDIQMTQSPSSLSASVGDRVTITCRASQSISNYLAWYQQKPGKVPK LLIYAASTLQSGVPSRFSGSGSGTDFTLTISSLQPEDVATYYCQKYNSAPWTFGCGTKLEIKSGGGGSEVQLVESGGGLVQPGGSLKLSCAASGFTFNKY AMMWVRQAPGKGLEWVARIRSKYNNYATYYADSVKDRFTISRDDSKNTAYLQMNNLKTEDTAVYYCVRHGNEGNSYISYWAYWGQGTLVTVSSGGGGSGG GGSGGGGSQTVVTQEPSLTVSPGGTVTLTCGSSTGAVTSGNYPNWVQQKPGQAPRGLIGGTKFLAPGTPARRSGSLLGGKAALTLSGVQPEDEAEYYCVL WYSNRWVFGGGTKLTVLGGGGDKTHTCPPCPAPELLGGPSVFLFPPKPKDTLMISRTPEVTCVVVDVSHEDPEVKENWYVDGVEVHNAKTKPCEEQYGST |

TABLE 46-continued

BiTE-scFc_Full Sequences

| Ab | Type | BiTE scFc |
|---|---|---|
| | | YRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLD |
| | | SDGSFFLYSKLTVDKSRWQQGNVFSCSVMHEALHNHYTQKSLSLSPGKGGGGSGGGGSGGGGSGGGGSTYRCVSVLTVLHQDWLNGKEYKCKVSNKALPAPIEKTISKAKGQ |
| | | FPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQ |
| | | PREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLS |
| | | LSPGK |
| | | (SEQ ID NO: 4731) |
| MA_83-F3x_I2Cox_scFc_(B9A)_translation | NA | No nuc. seq available |
| | AA | MDMRVPAQLLGLLLLWLRGARCQVQLVQSGAEVKKPGASVKVSCKASGYSFTGYYMHWVRQAPGQGLEWMGRINPNSGDTHYAQKFQGRVTMTRDTSIST |
| | | AYMELSRLRSDDTAVYYCARGLGISFFDYWGQGTLVTVSSGGGGSGGGGSGGGGSDIQMTQSPSSLSASVGDRVTITCRASQGISNYLAWYQQKPGKVPK |
| | | LLIYAASTLQSGVPSRFSGSGSGTDFTLTISSLQPEDVATYYCQKYNSAPWTFGQGTKLEIKSGGGGSEVQLVESGGGLVQPGGSLKLSCAASGFTFNKY |
| | | AMNWVRQAPGKGLEWVARIRSKYNNYATYYADSVKDRFTISRDDSKNTAYLQMNNLKTEDTAVYYCVRHGNENGNSYISYWAYWGQGTLVTVSSGGGGSG |
| | | GGSGGGGSQTVVTQEPSLTVSPGGTVTLTCGSSTGAVTSGNYPNWVQQKPGQAPRGLIGGTKFLAPGTPARESGSLLGGKAALTLSGVQPEDEAEYYCVL |
| | | WYSNRWVFGGGTKLTVLGGGGDKTHTCPPCPAPELLGGPSVFLFPPKPKDTLMISRTPEVTCVVVDVSHEDPEVKENWYDGVEVHNAKTKPCEEQYGST |
| | | YRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLD |
| | | SDGSFFLYSKLTVDKSRWQQGNVFSCSVMHEALHNHYTQKSLSLSPGKGGGGSGGGGSGGGGSGGGGSDKTHTCPPCPAPELLGGPSVEL |
| | | FPPKPKDTLMISRTPEVTCVVVDVSHEDPEVKENWYVDGVEVHNAKTKPCEEQYGSTYRCVSVLTVLHQDWLNGKEYKCKVSNKALPAPIEKTISKAKGQ |
| | | PREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLS |
| | | LSPGK |
| | | (SEQ ID NO: 4732) |
| MA_84-G10_CC_x_I2Cox_scFc_(H90)_translation | NA | No nuc. seq available |
| | AA | MDMRVPAQLLGLLLLWLRGARCQVQLQESGPGLVKPSQTLSLTCTVSGDSISRDPYYWSWIRQHPGKCLEWIGYIYYSGSTYYNPSLKSRVTISVDTSKN |
| | | QFSLKLSSVTAADTAVYYCARDKLWFGKLNYYYGMDVWGQGTTVTVSSGGGGSGGGGSGTDIVMTQTPLSLPVTPGEPASISCRSSQSLLHSNGYNY |
| | | LDWYLQKPGQSPQLLIYLGSNRASGVPDRESGSGSGTDFTLKISRVEAEDVGVYYCMQALQTPITFGQGTRLEIKSGGGGSEVQLVESGGGLVQPGGSLK |
| | | LSCAASGFTFNKYAMNWVRQAPGKGLEWVARIRSKYNNYATYYADSVKDRFTISRDDSKNTAYLQMNNLKTEDTAVYYCVRHGNENGNSYISYWAYWGQGT |
| | | LVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSG |
| | | VQPEDEAEYYCVLWYSNRWVFGGGTKLTVLGGGGDKTHTCPPCPAPELLGGPSVFLFPPKPKDTLMISRTPEVTCVVVDVSHEDPEVKENWYVDGVEVHN |
| | | AKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQ |
| | | PENNYKTTPPVLDSDGSFFLYSKLTVDKSRWQQGNVFSCSVMHEALHNHYTQKSLSLSPGKGGGGSGGGGSGGGGSGGGGSDKTHTCPPC |
| | | PAPELLGGPSVFLFPPKPKDTLMISRTPEVTCVVVDVSHEDPEVKENWYVDGVEVHNAKTKPCEEQYGSTYRCVSVLTVLHQDWLNGKEYKCKVSNKALP |
| | | APIEKTISKAKGQPREPQVYTLPPSREEMTKNQVSLTCLVKGFYPSDIAVEWESNGQPENNYKTTPPVLDSDGSFFLYSKLTVDKSRWQQGNVESCSVMH |
| | | EALHNHYTQKSLSLSPGK |
| | | (SEQ ID NO: 4733) |
| MA_84-G10x_I2Cox_scFc_(Y4W)_translation | NA | No nuc. seq available |
| | AA | MDMRVPAQLLGLLLLWLRGARCQVQLQESGPGLVKPSQTLSLTCTVSGDSISRDPYYWSWIRQHPGKCLEWIGYIYYSGSTYYNPSLKSRVTISVDTSKN |
| | | QFSLKLSSVTAADTAVYYCARDKLWFGKLNYYYGMDVWGQGTTVTVSSGGGGSGGGGSGGGGSDIVMTQTPLSLPVTPGEPASISCRSSQSLLHSNGYNY |
| | | LDWYLQKPGQSPQLLIYLGSNRASGVPDRESGSGSGTDFTLKISRVEAEDVGVYYCMQALQTPITFGQGTRLEIKSGGGGSEVQLVESGGGLVQPGGSLK |
| | | LSCAASGFTFNKYAMNWVRQAPGKGLEWVARIRSKYNNYATYYADSVKDRFTISRDDSKNTAYLQMNNLKTEDTAVYYCVRHGNENGNSYISYWAYWGQGT |
| | | LVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSG |
| | | VQPEDEAEYYCVLWYSNRWVFGGGTKLTVLGGGGDKTHTCPPCPAPELLGGPSVFLFPPKPKDTLMISRTPEVTCVVVDVSHEDPEVKENWYVDGVEVHN |
| | | AKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQ |
| | | PENNYKTTPPVLDSDGSFFLYSKLTVDKSRWQQGNVFSCSVMHEALHNHYTQKSLSLSPGKGGGGSGGGGSGGGGSGGGGSDKTHTCPPC |
| | | PAPELLGGPSVFLFPPKPKDTLMISRTPEVTCVVVDVSHEDPEVKENWYVDGVEVHNAKTKPCEEQYGSTYRCVSVLTVLHQDWLNGKEYKCKVSNKALP |
| | | APIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMH |
| | | EALHNHYTQKSLSLSPGK |
| | | (SEQ ID NO: 4734) |

TABLE 47

| Ab | Type | CDR1 | CDR2 | CDR3 |
|---|---|---|---|---|
| MA_12-E12_CC_x_I2C0x_scFc_(E9U)_translation | NA | No nuc. seq available | No nuc. seq available | No nuc. seq available |
| | AA | RASQSVSSSYLA (SEQ ID NO: 4735) | GASSRAT (SEQ ID NO: 4831) | QQYANSPLT (SEQ ID NO: 4927) |
| MA_12-E12x_I2C0x_scFC_(W1U)_translation | NA | No nuc. seq available | No nuc. seq available | No nuc. seq available |
| | AA | RASQSVSSSYLA (SEQ ID NO: 4736) | GASSRAT (SEQ ID NO: 4832) | QQYANSPLT (SEQ ID NO: 4928) |
| MA_13-D8_CCx_I2C0x_scFc_(U7V)_translation | NA | No nuc. seq available | No nuc. seq available | No nuc. seq available |
| | AA | RASQGISNYLA (SEQ ID NO: 4737) | AASTLQS (SEQ ID NO: 4833) | QQSYSTPPT (SEQ ID NO: 4929) |
| MA_13-D8x_I2C0x_scFc_(M7M)_translation | NA | No nuc. seq available | No nuc. seq available | No nuc. seq available |
| | AA | RASQGISNYLA (SEQ ID NO: 4738) | AASTLQS (SEQ ID NO: 4834) | QQSYSTPPT (SEQ ID NO: 4930) |
| MA_24-C9_CCx_I2C0x_scFc_(I2U)_translation | NA | No nuc. seq available | No nuc. seq available | No nuc. seq available |
| | AA | KSSQSLLYSSNQKNYLA (SEQ ID NO: 4739) | WASTRES (SEQ ID NO: 4835) | QQYYSYPYT (SEQ ID NO: 4931) |
| MA_24-C9x_I2C0x_scFc_(L9Y)_translation | NA | No nuc. seq available | No nuc. seq available | No nuc. seq available |
| | AA | KSSQSLLYSSNQKNYLA (SEQ ID NO: 4740) | WASTRES (SEQ ID NO: 4836) | QQYYSYPYT (SEQ ID NO: 4932) |
| MA_24-G6_CCx_I2C0x_scFc_(B1I)_translation | NA | No nuc. seq available | No nuc. seq available | No nuc. seq available |
| | AA | SASSNVNYIH (SEQ ID NO: 4741) | DTSKLAP (SEQ ID NO: 4837) | HQWSSYPPT (SEQ ID NO: 4933) |
| MA_24-G6x_I2C0x_scFc_(F1M)_translation | NA | No nuc. seq available | No nuc. seq available | No nuc. seq available |
| | AA | SASSNVNYIH (SEQ ID NO: 4742) | DTSKLAP (SEQ ID NO: 4838) | HQWSSYPPT (SEQ ID NO: 4934) |
| MA_31-H8_CCx_I2C0x_scFc_(K4E)_translation | NA | No nuc. seq available | No nuc. seq available | No nuc. seq available |
| | AA | RASGNIHNYLA (SEQ ID NO: 4743) | NAKTLAG (SEQ ID NO: 4839) | QHHYGTPLT (SEQ ID NO: 4935) |
| MA_31-H8x_I2C0x_scFc_(F9Z)_translation | NA | No nuc. seq available | No nuc. seq available | No nuc. seq available |
| | AA | RASGNIHNYLA (SEQ ID NO: 4744) | NAKTLAG (SEQ ID NO: 4840) | QHHYGTPLT (SEQ ID NO: 4936) |
| MA_32-A8_CCx_I2C0x_scFc_(A9E)_translation | NA | No nuc. seq available | No nuc. seq available | No nuc. seq available |
| | AA | RSSQSLLYSNGYNYVD (SEQ ID NO: 4745) | LGSNRAS (SEQ ID NO: 4841) | MQALQTPPT (SEQ ID NO: 4937) |
| MA_32-A8_x_I2C0x_scFc_(G6J)_translation | NA | No nuc. seq available | No nuc. seq available | No nuc. seq available |
| | AA | RSSQSLLYSNGYNYVD (SEQ ID NO: 4746) | LGSNRAS (SEQ ID NO: 4842) | MQALQTPPT (SEQ ID NO: 4938) |
| MA_48-D12_CCx_I2C0x_scFc_(_M9T)_translation | NA | No nuc. seq available | No nuc. seq available | No nuc. seq available |
| | AA | RASQSVSSSYLA (SEQ ID NO: 4747) | GASSRAT (SEQ ID NO: 4843) | QQYGSSPLT (SEQ ID NO: 4939) |
| MA_48-D12x_I2C0x_scFc_(R9D)_translation | NA | No nuc. seq available | No nuc. seq available | No nuc. seq available |
| | AA | RASQSVSSSYLA (SEQ ID NO: 4748) | GASSRAT (SEQ ID NO: 4844) | QQYGSSPLT (SEQ ID NO: 4940) |
| MA_50-D9_CCx_I2C0x_scFc_(K6S)_translation | NA | No nuc. seq available | No nuc. seq available | No nuc. seq available |
| | AA | RSSQSLLHSNGYNYLD (SEQ ID NO: 4749) | LGSNRAS (SEQ ID NO: 4845) | MQALQTPLT (SEQ ID NO: 4941) |

TABLE 47-continued

BiTE-scFc Fv#1 (MAGEB2) VL CDRs

| Ab | Type | CDR1 | CDR2 | CDR3 |
|---|---|---|---|---|
| MA_50-D9x_I2C0x_scFc_(A4U)_translation | NA | No nuc. seq available | No nuc. seq available | No nuc. seq available |
| | AA | RSSQSLLHSNGYNYLD (SEQ ID NO: 4750) | LGSNRAS (SEQ ID NO: 4846) | MQALQTPLT (SEQ ID NO: 4942) |
| MA_78-A6_CCx_I2C0x_scFc_(D8Z)_translation | NA | No nuc. seq available | No nuc. seq available | No nuc. seq available |
| | AA | RSSQSLLYSNGYNYVD (SEQ ID NO: 4751) | LGSNRAS (SEQ ID NO: 4847) | MQALQTPFT (SEQ ID NO: 4943) |
| MA_78-A6x_I2C0x_scFc_(K6P)_translation | NA | No nuc. seq available | No nuc. seq available | No nuc. seq available |
| | AA | RSSQSLLYSNGYNYVD (SEQ ID NO: 4752) | LGSNRAS (SEQ ID NO: 4848) | MQALQTPFT (SEQ ID NO: 4944) |
| MA_79-E3_CC_x_I2C0x_scFc_(E2Y)_translation | NA | No nuc. seq available | No nuc. seq available | No nuc. seq available |
| | AA | RASQSISSYLN (SEQ ID NO: 4753) | AASSLQS (SEQ ID NO: 4849) | QQSYRTPPT (SEQ ID NO: 4945) |
| MA_79-E3x_I2C0x_scFc_(N4F)_translation | NA | No nuc. seq available | No nuc. seq available | No nuc. seq available |
| | AA | RASQSISSYLN (SEQ ID NO: 4754) | AASSLQS (SEQ ID NO: 4850) | QQSYRTPPT (SEQ ID NO: 4946) |
| MA_83-F3_CCx_I2C0x_scFc_(G5K)_translation | NA | No nuc. seq available | No nuc. seq available | No nuc. seq available |
| | AA | RASQGISNYLA (SEQ ID NO: 4755) | AASTLQS (SEQ ID NO: 4851) | QKYNSAPWT (SEQ ID NO: 4947) |
| MA_83-F3x_I2C0x_scFc_(B9A)_translation | NA | No nuc. seq available | No nuc. seq available | No nuc. seq available |
| | AA | RASQGISNYLA (SEQ ID NO: 4756) | AASTLQS (SEQ ID NO: 4852) | QKYNSAPWT (SEQ ID NO: 4948) |
| MA_84-G10_CC_x_I2C0x_scFc_(H9O)_translation | NA | No nuc. seq available | No nuc. seq available | No nuc. seq available |
| | AA | RSSQSLLHSNGYNYLD (SEQ ID NO: 4757) | LGSNRAS (SEQ ID NO: 4853) | MQALQTPIT (SEQ ID NO: 4949) |
| MA_84-G10x_I2C0x_scFc_(Y4W)_translation | NA | No nuc. seq available | No nuc. seq available | No nuc. seq available |
| | AA | RSSQSLLHSNGYNYLD (SEQ ID NO: 4758) | LGSNRAS (SEQ ID NO: 4854) | MQALQTPIT (SEQ ID NO: 4950) |

TABLE 48

BiTE-scFc Fv#1 (MAGEB2) VH CDRs

| Ab | Type | CDR1 | CDR2 | CDR3 |
|---|---|---|---|---|
| MA_12-E12_CC_x_I2C0x_scFc_(E9U)_translation | NA | No nuc. seq available | No nuc. seq available | No nuc. seq available |
| | AA | TYSMN (SEQ ID NO: 4759) | SISSSSSYIYYADSVKG (SEQ ID NO: 4855) | DRIAVATYFDN (SEQ ID NO: 4951) |
| MA_12-E12x_I2C0x_scFC_(W1U)_translation | NA | No nuc. seq available | No nuc. seq available | No nuc. seq available |
| | AA | TYSMN (SEQ ID NO: 4760) | SISSSSSYIYYADSVKG (SEQ ID NO: 4856) | DRIAVATYFDN (SEQ ID NO: 4952) |
| MA_13-D8_CCx_I2C0x_scFc_(U7V)_translation | NA | No nuc. seq available | No nuc. seq available | No nuc. seq available |
| | AA | SFAMS (SEQ ID NO: 4761) | AISGSGGSTYYADSVKG (SEQ ID NO: 4857) | MVTPDYYYDMDV (SEQ ID NO: 4953) |
| MA_13-D8x_I2C0x_scFc_(M7M)_translation | NA | No nuc. seq available | No nuc. seq available | No nuc. seq available |
| | AA | SFAMS (SEQ ID NO: 4762) | AISGSGGSTYYADSVKG (SEQ ID NO: 4858) | MVTPDYYYDMDV (SEQ ID NO: 4954) |

TABLE 48-continued

BiTE-scFc Fv#1 (MAGEB2) VH CDRs

| Ab | Type | CDR1 | CDR2 | CDR3 |
|---|---|---|---|---|
| MA_24-C9_CCx_I2C0x_scFc_(I2U)_translation | NA | No nuc. seq available | No nuc. seq available | No nuc. seq available |
| | AA | KSWMN (SEQ ID NO: 4763) | RIYPGDGDTNYNGKFKG (SEQ ID NO: 4859) | DGVFYAPLAY (SEQ ID NO: 4955) |
| MA_24-C9x_I2C0x_scFc_(L9Y)_translation | NA | No nuc. seq available | No nuc. seq available | No nuc. seq available |
| | AA | KSWMN (SEQ ID NO: 4764) | RIYPGDGDTNYNGKFKG (SEQ ID NO: 4860) | DGVFYAPLAY (SEQ ID NO: 4956) |
| MA_24-G6_CCx_I2C0x_scFc_(B1I)_translation | NA | No nuc. seq available | No nuc. seq available | No nuc. seq available |
| | AA | KSWMN (SEQ ID NO: 4765) | RVWPGDGDTTYNEKEKG (SEQ ID NO: 4861) | GNYFGSSEAYFDY (SEQ ID NO: 4957) |
| MA_24-G6x_I2C0x_scFc_(F1M)_translation | NA | No nuc. seq available | No nuc. seq available | No nuc. seq available |
| | AA | KSWMN (SEQ ID NO: 4766) | RVWPGDGDTTYNEKFKG (SEQ ID NO: 4862) | GNYFGSSEAYFDY (SEQ ID NO: 4958) |
| MA_31-H8_CCx_I2C0x_scFc_(K4E)_translation | NA | No nuc. seq available | No nuc. seq available | No nuc. seq available |
| | AA | SSWMN (SEQ ID NO: 4767) | RIYPGDGDTNYNGKFKD (SEQ ID NO: 4863) | RQLNHVFAMDY (SEQ ID NO: 4959) |
| MA_31-H8x_I2C0x_scFc_(F9Z)_translation | NA | No nuc. seq available | No nuc. seq available | No nuc. seq available |
| | AA | SSWMN (SEQ ID NO: 4768) | RIYPGDGDTNYNGKFKD (SEQ ID NO: 4864) | RQLNHVFAMDY (SEQ ID NO: 4960) |
| MA_32-A8_CCx_I2C0x_scFc_(A9E)_translation | NA | No nuc. seq available | No nuc. seq available | No nuc. seq available |
| | AA | SYDIN (SEQ ID NO: 4769) | WMNPNSGNTGYAQKFQG (SEQ ID NO: 4865) | GGGYSNGYDYGMDV (SEQ ID NO: 4961) |
| MA_32-A8_x_I2C0x_scFc_(G6J)_translation | NA | No nuc. seq available | No nuc. seq available | No nuc. seq available |
| | AA | SYDIN (SEQ ID NO: 4770) | WMNPNSGNTGYAQKFQG (SEQ ID NO: 4866) | GGGYSNGYDYGMDV (SEQ ID NO: 4962) |
| MA_48-D12_CCx_I2C0x_scFc_(_M9T)_translation | NA | No nuc. seq available | No nuc. seq available | No nuc. seq available |
| | AA | SYRMH (SEQ ID NO: 4771) | VISYDGGNKYYADSVKG (SEQ ID NO: 4867) | EQWPNYYYGMDV (SEQ ID NO: 4963) |
| MA_48-D12x_I2C0x_scFc_(R9D)_translation | NA | No nuc. seq available | No nuc. seq available | No nuc. seq available |
| | AA | SYRMH (SEQ ID NO: 4772) | VISYDGGNKYYADSVKG (SEQ ID NO: 4868) | EQWPNYYYGMDV (SEQ ID NO: 4964) |
| MA_50-D9_CCx_I2C0x_scFc_(K6S)_translation | NA | No nuc. seq available | No nuc. seq available | No nuc. seq available |
| | AA | SNSAAWN (SEQ ID NO: 4773) | RTYYRSKWYNDYAVSVKS (SEQ ID NO: 4869) | EILWFGKLNYYYGMDV (SEQ ID NO: 4965) |
| MA_50-D9x_I2C0x_scFc_(A4U)_translation | NA | No nuc. seq available | No nuc. seq available | No nuc. seq available |
| | AA | SNSAAWN (SEQ ID NO: 4774) | RTYYRSKWYNDYAVSVKS (SEQ ID NO: 4870) | EILWFGKLNYYYGMDV (SEQ ID NO: 4966) |
| MA_78-A6_CCx_I2C0x_scFc_(D8Z)_translation | NA | No nuc. seq available | No nuc. seq available | No nuc. seq available |
| | AA | GYYWN (SEQ ID NO: 4775) | EINHRGSTNYNPSLKS (SEQ ID NO: 4871) | GGGYSDGYDYGMDV (SEQ ID NO: 4967) |
| MA_78-A6x_I2C0x_scFc_(K6P)_translation | NA | No nuc. seq available | No nuc. seq available | No nuc. seq available |
| | AA | GYYWN (SEQ ID NO: 4776) | EINHRGSTNYNPSLKS (SEQ ID NO: 4872) | GGGYSDGYDYGMDV (SEQ ID NO: 4968) |
| MA_79-E3_CC_x_I2C0x_scFc_(E2Y)_translation | NA | No nuc. seq available | No nuc. seq available | No nuc. seq available |
| | AA | SEAMS (SEQ ID NO: 4777) | AISGSGGSTYYADSVKG (SEQ ID NO: 4873) | MVTPDYYYDMDV (SEQ ID NO: 4969) |

TABLE 48-continued

BiTE-scFc Fv#1 (MAGEB2) VH CDRs

| Ab | Type | CDR1 | CDR2 | CDR3 |
|---|---|---|---|---|
| MA_79-E3x_I2C0x_scFc_(N4F)_translation | NA | No nuc. seq available | No nuc. seq available | No nuc. seq available |
| | AA | SFAMS (SEQ ID NO: 4778) | AISGSGGSTYYADSVKG (SEQ ID NO: 4874) | MVTPDYYYDMDV (SEQ ID NO: 4970) |
| MA_83-F3_CCx_I2C0x_scFc_(G5K)_translation | NA | No nuc. seq available | No nuc. seq available | No nuc. seq available |
| | AA | GYYMH (SEQ ID NO: 4779) | RINPNSGDTHYAQKFQG (SEQ ID NO: 4875) | GLGISFFDY (SEQ ID NO: 4971) |
| MA_83-F3x_I2C0x_scFc_(B9A)_translation | NA | No nuc. seq available | No nuc. seq available | No nuc. seq available |
| | AA | GYYMH (SEQ ID NO: 4780) | RINPNSGDTHYAQKFQG (SEQ ID NO: 4876) | GLGISFFDY (SEQ ID NO: 4972) |
| MA_84-G10_CC_x_I2C0x_scFc_(H9O)_translation | NA | No nuc. seq available | No nuc. seq available | No nuc. seq available |
| | AA | RDPYYWS (SEQ ID NO: 4781) | YIYYSGSTYYNPSLKS (SEQ ID NO: 4877) | DKLWFGKLNYYYGMDV (SEQ ID NO: 4973) |
| MA_84-G10x_I2C0x_scFc_(Y4W)_translation | NA | No nuc. seq available | No nuc. seq available | No nuc. seq available |
| | AA | RDPYYWS (SEQ ID NO: 4782) | YIYYSGSTYYNPSLKS (SEQ ID NO: 4878) | DKLWFGKLNYYYGMDV (SEQ ID NO: 4974) |

TABLE 49

BITE-scFc Fv#2 (CD3) VL CDRs

| Ab | Type | CDR1 | CDR2 | CDR3 |
|---|---|---|---|---|
| MA_12-E12_CC_x_I2C0x_scFc_(E9U)_translation | NA | No nuc. seq available | No nuc. seq available | No nuc. seq available |
| | AA | GSSTGAVTSGNYPN (SEQ ID NO: 4783) | GTKFLAP (SEQ ID NO: 4879) | VLWYSNRWV (SEQ ID NO: 4975) |
| MA_12-E12x_I2C0x_scFC_(W1U)_translation | NA | No nuc. seq available | No nuc. seq available | No nuc. seq available |
| | AA | GSSTGAVTSGNYPN (SEQ ID NO: 4784) | GTKFLAP (SEQ ID NO: 4880) | VLWYSNRWV (SEQ ID NO: 4976) |
| MA_13-D8_CCx_I2C0x_scFc_(U7V)_translation | NA | No nuc. seq available | No nuc. seq available | No nuc. seq available |
| | AA | GSSTGAVTSGNYPN (SEQ ID NO: 4785) | GTKFLAP (SEQ ID NO: 4881) | VLWYSNRWV (SEQ ID NO: 4977) |
| MA_13-D8x_I2C0x_scFc_(M7M)_translation | NA | No nuc. seq available | No nuc. seq available | No nuc. seq available |
| | AA | GSSTGAVTSGNYPN (SEQ ID NO: 4786) | GTKFLAP (SEQ ID NO: 4882) | VLWYSNRWV (SEQ ID NO: 4978) |
| MA_24-C9_CCx_I2C0x_scFc_(I2U)_translation | NA | No nuc. seq available | No nuc. seq available | No nuc. seq available |
| | AP | GSSTGAVTSGNYPN (SEQ ID NO: 4787) | GTKFLAP (SEQ ID NO: 4883) | VLWYSNRWV (SEQ ID NO: 4979) |
| MA_24-C9x_I2C0x_scFc_(L9Y)_translation | NA | No nuc. seq available | No nuc. seq available | No nuc. seq available |
| | AA | GSSTGAVTSGNYPN (SEQ ID NO: 4788) | GTKFLAP (SEQ ID NO: 4884) | VLWYSNRWV (SEQ ID NO: 4980) |
| MA_24-G6_CCx_I2C0x_scFc_(B1I)_translation | NA | No nuc. seq available | No nuc. seq available | No nuc. seq available |
| | AA | GSSTGAVTSGNYPN (SEQ ID NO: 4789) | GTKFLAP (SEQ ID NO: 4885) | VLWYSNRWV (SEQ ID NO: 4981) |
| MA_24-G6x_I2C0x_scFc_(F1M)_translation | NA | No nuc. seq available | No nuc. seq available | No nuc. seq available |
| | AA | GSSTGAVTSGNYPN (SEQ ID NO: 4790) | GTKFLAP (SEQ ID NO: 4886) | VLWYSNRWV (SEQ ID NO: 4982) |

TABLE 49-continued

| BITE-scFc Fv#2 (CD3) VL CDRs | | | | |
|---|---|---|---|---|
| Ab | Type | CDR1 | CDR2 | CDR3 |
| MA_31-H8_CCx_I2C0x_scFc_(K4E)_translation | NA | No nuc. seq available | No nuc. seq available | No nuc. seq available |
| | AA | GSSTGAVTSGNYPN (SEQ ID NO: 4791) | GTKFLAP (SEQ ID NO: 4887) | VLWYSNRWV (SEQ ID NO: 4983) |
| MA_31-H8x_I2C0x_scFc_(F9Z)_translation | NA | No nuc. seq available | No nuc. seq available | No nuc. seq available |
| | AA | GSSTGAVTSGNYPN (SEQ ID NO: 4792) | GTKFLAP (SEQ ID NO: 4888) | VLWYSNRWV (SEQ ID NO: 4984) |
| MA_32-A8_CCx_I2C0x_scFc_(A9E)_translation | NA | No nuc. seq available | No nuc. seq available | No nuc. seq available |
| | AA | GSSTGAVTSGNYPN (SEQ ID NO: 4793) | GTKFLAP (SEQ ID NO: 4889) | VLWYSNRWV (SEQ ID NO: 4985) |
| MA_32-A8_x_I2C0x_scFc_(G6J)_translation | NA | No nuc. seq available | No nuc. seq available | No nuc. seq available |
| | AA | GSSTGAVTSGNYPN (SEQ ID NO: 4794) | GTKFLAP (SEQ ID NO: 4890) | VLWYSNRWV (SEQ ID NO: 4986) |
| MA_48-D12_CCx_I2C0x_scFc_(_M9T)_translation | NA | No nuc. seq available | No nuc. seq available | No nuc. seq available |
| | AA | GSSTGAVTSGNYPN (SEQ ID NO: 4795) | GTKFLAP (SEQ ID NO: 4891) | VLWYSNRWV (SEQ ID NO: 4987) |
| MA_48-D12x_I2C0x_scFc_(R9D)_translation | NA | No nuc. seq available | No nuc. seq available | No nuc. seq available |
| | AA | GSSTGAVTSGNYPN (SEQ ID NO: 4796) | GTKFLAP (SEQ ID NO: 4892) | VLWYSNRWV (SEQ ID NO: 4988) |
| MA_50-D9_CCx_I2C0x_scFc_(K6S)_translation | NA | No nuc. seq available | No nuc. seq available | No nuc. seq available |
| | AA | GSSTGAVTSGNYPN (SEQ ID NO: 4797) | GTKFLAP (SEQ ID NO: 4893) | VLWYSNRWV (SEQ ID NO: 4989) |
| MA_50-D9x_I2C0x_scFc_(A4U)_translation | NA | No nuc. seq available | No nuc. seq available | No nuc. seq available |
| | AA | GSSTGAVTSGNYPN (SEQ ID NO: 4798) | GTKFLAP (SEQ ID NO: 4894) | VLWYSNRWV (SEQ ID NO: 4990) |
| MA_78-A6_CCx_I2C0x_scFc_(D8Z)_translation | NA | No nuc. seq available | No nuc. seq available | No nuc. seq available |
| | AA | GSSTGAVTSGNYPN (SEQ ID NO: 4799) | GTKFLAP (SEQ ID NO: 4895) | VLWYSNRWV (SEQ ID NO: 4991) |
| MA_78-A6x_I2C0x_scFc_(K6P)_translation | NA | No nuc. seq available | No nuc. seq available | No nuc. seq available |
| | AA | GSSTGAVTSGNYPN (SEQ ID NO: 4800) | GTKFLAP (SEQ ID NO: 4896) | VLWYSNRWV (SEQ ID NO: 4992) |
| MA_79-E3_CC_x_I2C0x_scFc_(E2Y)_translation | NA | No nuc. seq available | No nuc. seq available | No nuc. seq available |
| | AA | GSSTGAVTSGNYPN (SEQ ID NO: 4801) | GTKFLAP (SEQ ID NO: 4897) | VLWYSNRWV (SEQ ID NO: 4993) |
| MA_79-E3x_I2C0x_scFc_(N4F)_translation | NA | No nuc. seq available | No nuc. seq available | No nuc. seq available |
| | AA | GSSTGAVTSGNYPN (SEQ ID NO: 4802) | GTKFLAP (SEQ ID NO: 4898) | VLWYSNRWV (SEQ ID NO: 4994) |
| MA_83-F3_CCx_I2C0x_scFc_(G5K)_translation | NA | No nuc. seq available | No nuc. seq available | No nuc. seq available |
| | AA | GSSTGAVTSGNYPN (SEQ ID NO: 4803) | GTKFLAP (SEQ ID NO: 4899) | VLWYSNRWV (SEQ ID NO: 4995) |
| MA_83-F3x_I2C0x_scFc_(B9A)_translation | NA | No nuc. seq available | No nuc. seq available | No nuc. seq available |
| | AA | GSSTGAVTSGNYPN (SEQ ID NO: 4804) | GTKFLAP (SEQ ID NO: 4900) | VLWYSNRWV (SEQ ID NO: 4996) |
| MA_84-G10_CC_x_I2C0x_scFc_(H9O)_translation | NA | No nuc. seq available | No nuc. seq available | No nuc. seq available |
| | AA | GSSTGAVTSGNYPN (SEQ ID NO: 4805) | GTKFLAP (SEQ ID NO: 4901) | VLWYSNRWV (SEQ ID NO: 4997) |

TABLE 49-continued

| | | BiTE-scFc Fv#2 (CD3) VL CDRs | | |
|---|---|---|---|---|
| Ab | Type | CDR1 | CDR2 | CDR3 |
| MA_84-G10x_I2C0x_scFc_(Y4W)_translation | NA | No nuc. seq available | No nuc. seq available | No nuc. seq available |
| | AA | GSSTGAVTSGNYPN (SEQ ID NO: 4806) | GTKFLAP (SEQ ID NO: 4902) | VLWYSNRWV (SEQ ID NO: 4998) |

TABLE 50

| | | BiTE-scFc Fv#2 (CD3) VH CDRs | | |
|---|---|---|---|---|
| Ab | Type | CDR1 | CDR2 | CDR3 |
| MA_12-E12_CC_x_I2C0x_scFc_(E9U)_translation | NA | No nuc. seq available | No nuc. seq available | No nuc. seq available |
| | AA | KYAMN (SEQ ID NO: 4807) | RIRSKYNNYATYYADSVKD (SEQ ID NO: 4903) | HGNFGNSYISYWAY (SEQ ID NO: 4999) |
| MA_12-E12x_I2C0x_scFC_(W1U)_translation | NA | No nuc. seq available | No nuc. seq available | No nuc. seq available |
| | AA | KYAMN (SEQ ID NO: 4808) | RIRSKYNNYATYYADSVKD (SEQ ID NO: 4904) | HGNFGNSYISYWAY (SEQ ID NO: 5000) |
| MA_13-D8_CCx_I2C0x_scFc_(U7V)_translation | NA | No nuc. seq available | No nuc. seq available | No nuc. seq available |
| | AA | KYAMN (SEQ ID NO: 4809) | RIRSKYNNYATYYADSVKD (SEQ ID NO: 4905) | HGNFGNSYISYWAY (SEQ ID NO: 5001) |
| MA_13-D8x_I2C0x_scFc_(M7M)_translation | NA | No nuc. seq available | No nuc. seq available | No nuc. seq available |
| | AP | KYAMN (SEQ ID NO: 4810) | RIRSKYNNYATYYADSVKD (SEQ ID NO: 4906) | HGNFGNSYISYWAY (SEQ ID NO: 5002) |
| MA_24-C9_CCx_I2C0x_scFc_(I2U)_translation | NA | No nuc. seq available | No nuc. seq available | No nuc. seq available |
| | AA | KYAMN (SEQ ID NO: 4811) | RIRSKYNNYATYYADSVKD (SEQ ID NO: 4907) | HGNFGNSYISYWAY (SEQ ID NO: 5003) |
| MA_24-C9x_I2C0x_scFc_(L9Y)_translation | NA | No nuc. seq available | No nuc. seq available | No nuc. seq available |
| | AA | KYAMN (SEQ ID NO: 4812) | RIRSKYNNYATYYADSVKD (SEQ ID NO: 4908) | HGNFGNSYISYWAY (SEQ ID NO: 5004) |
| MA_24-G6_CCx_I2C0x_scFc_(B1I)_translation | NA | No nuc. seq available | No nuc. seq available | No nuc. seq available |
| | AA | KYAMN (SEQ ID NO: 4813) | RIRSKYNNYATYYADSVKD (SEQ ID NO: 4909) | HGNFGNSYISYWAY (SEQ ID NO: 5005) |
| MA_24-G6x_I2C0x_scFc_(F1M)_translation | NA | No nuc. seq available | No nuc. seq available | No nuc. seq available |
| | AA | KYAMN (SEQ ID NO: 4814) | RIRSKYNNYATYYADSVKD (SEQ ID NO: 4910) | HGNFGNSYISYWAY (SEQ ID NO: 5006) |
| MA_31-H8_CCx_I2C0x_scFc_(K4E)_translation | NA | No nuc. seq available | No nuc. seq available | No nuc. seq available |
| | AA | KYAMN (SEQ ID NO: 4815) | RIRSKYNNYATYYADSVKD (SEQ ID NO: 4911) | HGNFGNSYISYWAY (SEQ ID NO: 5007) |
| MA_31-H8x_I2C0x_scFc_(F9Z)_translation | NA | No nuc. seq available | No nuc. seq available | No nuc. seq available |
| | AA | KYAMN (SEQ ID NO: 4816) | RIRSKYNNYATYYADSVKD (SEQ ID NO: 4912) | HGNFGNSYISYWAY (SEQ ID NO: 5008) |
| MA_32-A8_CCx_I2C0x_scFc_(A9E)_translation | NA | No nuc. seq available | No nuc. seq available | No nuc. seq available |
| | AA | KYAMN (SEQ ID NO: 4817) | RIRSKYNNYATYYADSVKD (SEQ ID NO: 4913) | HGNFGNSYISYWAY (SEQ ID NO: 5009) |
| MA_32-A8_x_I2C0x_scFc_(G6J)_translation | NA | No nuc. seq available | No nuc. seq available | No nuc. seq available |
| | AA | KYAMN (SEQ ID NO: 4818) | RIRSKYNNYATYYADSVKD (SEQ ID NO: 4914) | HGNFGNSYISYWAY (SEQ ID NO: 5010) |

TABLE 50-continued

BiTE-scFc Fv#2 (CD3) VH CDRs

| Ab | Type | CDR1 | CDR2 | CDR3 |
|---|---|---|---|---|
| MA_48-D12_CCx_I2C0x_scFc_(_M9T)_translation | NA | No nuc. seq available | No nuc. seq available | No nuc. seq available |
| | AA | KYAMN (SEQ ID NO: 4819) | RIRSKYNNYATYYADSVKD (SEQ ID NO: 4915) | HGNFGNSYISYWAY (SEQ ID NO: 5011) |
| MA_48-D12x_I2C0x_scFc_(R9D)_translation | NA | No nuc. seq available | No nuc. seq available | No nuc. seq available |
| | AA | KYAMN (SEQ ID NO: 4820) | RIRSKYNNYATYYADSVKD (SEQ ID NO: 4916) | HGNFGNSYISYWAY (SEQ ID NO: 5012) |
| MA_50-D9_CCx_I2C0x_scFc_(K6S)_translation | NA | No nuc. seq available | No nuc. seq available | No nuc. seq available |
| | AA | KYAMN (SEQ ID NO: 4821) | RIRSKYNNYATYYADSVKD (SEQ ID NO: 4917) | HGNFGNSYISYWAY (SEQ ID NO: 5013) |
| MA_50-D9x_I2C0x_scFc_(A4U)_translation | NA | No nuc. seq available | No nuc. seq available | No nuc. seq available |
| | AA | KYAMN (SEQ ID NO: 4822) | RIRSKYNNYATYYADSVKD (SEQ ID NO: 4918) | HGNFGNSYISYWAY (SEQ ID NO: 5014) |
| MA_78-A6_CCx_I2C0x_scFc_(D8Z)_translation | NA | No nuc. seq available | No nuc. seq available | No nuc. seq available |
| | AA | KYAMN (SEQ ID NO: 4823) | RIRSKYNNYATYYADSVKD (SEQ ID NO: 4919) | HGNFGNSYISYWAY (SEQ ID NO: 5015) |
| MA_78-A6x_I2C0x_scFc_(K6P)_translation | NA | No nuc. seq available | No nuc. seq available | No nuc. seq available |
| | AA | KYAMN (SEQ ID NO: 4824) | RIRSKYNNYATYYADSVKD (SEQ ID NO: 4920) | HGNFGNSYISYWAY (SEQ ID NO: 5016) |
| MA_79-E3_CC_x_I2C0x_scFc_(E2Y)_translation | NA | No nuc. seq available | No nuc. seq available | No nuc. seq available |
| | AA | KYAMN (SEQ ID NO: 4825) | RIRSKYNNYATYYADSVKD (SEQ ID NO: 4921) | HGNFGNSYISYWAY (SEQ ID NO: 5017) |
| MA_79-E3x_I2C0x_scFc_(N4F)_translation | NA | No nuc. seq available | No nuc. seq available | No nuc. seq available |
| | AA | KYAMN (SEQ ID NO: 4826) | RIRSKYNNYATYYADSVKD (SEQ ID NO: 4922) | HGNFGNSYISYWAY (SEQ ID NO: 5018) |
| MA_83-F3_CCx_I2C0x_scFc_(G5K)_translation | NA | No nuc. seq available | No nuc. seq available | No nuc. seq available |
| | AA | KYAMN (SEQ ID NO: 4827) | RIRSKYNNYATYYADSVKD (SEQ ID NO: 4923) | HGNFGNSYISYWAY (SEQ ID NO: 5019) |
| MA_83-F3x_I2C0x_scFc_(B9A)_translation | NA | No nuc. seq available | No nuc. seq available | No nuc. seq available |
| | AA | KYAMN (SEQ ID NO: 4828) | RIRSKYNNYATYYADSVKD (SEQ ID NO: 4924) | HGNFGNSYISYWAY (SEQ ID NO: 5020) |
| MA_84-G10_CC_x_I2C0x_scFc_(H9O)_translation | NA | No nuc. seq available | No nuc. seq available | No nuc. seq available |
| | AA | KYAMN (SEQ ID NO: 4829) | RIRSKYNNYATYYADSVKD (SEQ ID NO: 4925) | HGNFGNSYISYWAY (SEQ ID NO: 5021) |
| MA_84-G10x_I2C0x_scFc_(Y4W)_translation | NA | No nuc. seq available | No nuc. seq available | No nuc. seq available |
| | AA | KYAMN (SEQ ID NO: 4830) | RIRSKYNNYATYYADSVKD (SEQ ID NO: 4926) | HGNFGNSYISYWAY (SEQ ID NO: 5022) |

TABLE 51

BiTE-scFc Variable Region Sequences

| | | Fv#1 (MAGEB2) | |
|---|---|---|---|
| Ab | Type | LC V-region | HC V-region |
| MA 12-E12_CC_x_I2C0x_scFc_(E9U)_translation | NA | No nuc. seq available | No nuc. seq available |
| | AA | EIVLTQSPGTLSLSPGERATLS CRASQSVSSSYLAWYQQKPGQA PRLLIYGASSRATGIPDRFSGS | EVQLVESGGGLVKPGGSLRLSC AASGFTFSTYSMNWVRQAPGKC LEWVSSISSSSSYIYYADSVKG |

TABLE 51-continued

BiTE-scFc Variable Region Sequences

| | | Fv#1 (MAGEB2) | |
|---|---|---|---|
| Ab | Type | LC V-region | HC V-region |
| | | GSGTDFTLTISRLEPEDFAVYY CQQYANSPLTFGCGTKVEIK (SEQ ID NO: 5023) | RFTISRDNAKNSLYLQMNSLRD EDTAVYYCARDRIAVATYFDNW GQGTLVTVSS (SEQ ID NO: 5047) |
| MA_12-E12x_I2C0x_scFC_(W1U)_translation | NA AA | No nuc. seq available EIVLTQSPGTLSLSPGERATLS CRASQSVSSSYLAWYQQKPGQA PRLLIYGASSRATGIPDRFSGS GSGTDETLTISRLEPEDFAVYY CQQYANSPLTFGGGTKVEIK (SEQ ID NO: 5024) | No nuc. seq available EVQLVESGGGLVKPGGSLRLSC AASGFTFSTYSMNWVRQAPGKG LEWVSSISSSSSYIYYADSVKG RFTISRDNAKNSLYLQMNSLRD EDTAVYYCARDRIAVATYFDNW GQGTLVTVSS (SEQ ID NO: 5048) |
| MA_13-D8_CCx_I2C0x_scFc_(U7V)_translation | NA AA | No nuc. seq available DIQMTQSPSSLSASVGDRVTIT CRASQGISNYLAWYQQKPGKVP KLLIYAASTLQSGVPSRFSGSG SGTDFTLTISSLQPEDFATYYC QQSYSTPPTFGCGTKVEIK (SEQ ID NO: 5025) | No nuc. seq available EVQLLESGGGLVQPGGSLRLSC AASGFTFSSFAMSWVRQAPGKC LEWVSAISGSGGSTYYADSVKG RFTISRDNSKNTLYLQMNSLRA EDTAEYYCAKMVTPDYYYDMDV WGQGTTVTVSS (SEQ ID NO: 5049) |
| MA_13-D8x_I2C0x_scFc_(M7M)_translation | NA AA | No nuc. seq available DIQMTQSPSSLSASVGDRVTIT CRASQGISNYLAWYQQKPGKVP KLLIYAASTLQSGVPSRFSGSG SGTDFTLTISSLQPEDFATYYC QQSYSTPPTFGQGTKVEIK (SEQ ID NO: 5026) | No nuc. seq available EVQLLESGGGLVQPGGSLRLSC AASGFTESSFAMSWVRQAPGKG LEWVSAISGSGGSTYYADSVKG RFTISRDNSKNTLYLQMNSLRA EDTAEYYCAKMVTPDYYYDMDV WGQGTTVTVSS (SEQ ID NO: 5050) |
| MA_24-C9_CCx_I2C0x_scFc_(I2U)_translation | NA AA | No nuc. seq available ELVMTQSPSSLAVSVGEKITMS CKSSQSLLYSSNQKNYLAWYQQ KPGQSPKLLIYWASTRESGVPD RFTGSGSGTDFTLTISSVKAED LAVYYCQQYYSYPYTFGCGTKL ELK (SEQ ID NO: 5027) | No nuc. seq available VQLLEQSGPELVKPGASVKISC KASGYAFSKSWMNWVKQRPGKC LEWIGRIYPGDGDTNYNGKFKG KAALTADKSSNTANMQLNSLTS EDSAVYFCARDGVFYAPLAYWG QGTLVTVSS (SEQ ID NO: 5051) |
| MA_24-C9x_I2C0x_scFc_(L9Y)_translation | NA AA | No nuc. seq available ELVMTQSPSSLAVSVGEKITMS CKSSQSLLYSSNQKNYLAWYQQ KPGQSPKLLIYWASTRESGVPD RFTGSGSGTDFTLTISSVKAED LAVYYCQQYYSYPYTFGGGTKL ELK (SEQ ID NO: 5028) | No nuc. seq available VQLLEQSGPELVKPGASVKISC KASGYAFSKSWMNWVKQRPGKG LEWIGRIYPGDGDTNYNGKFKG KAALTADKSSNTANMQLNSLTS EDSAVYFCARDGVFYAPLAYWG QGTLVTVSS (SEQ ID NO: 5052) |
| MA_24-G6_CCx_I2C0x_scFc_(B1I)_translation | NA AA | No nuc. seq available ELVLTQSPAIMSASPGQKVTIT CSASSNVNYIHWYQQKLGSSPK LWIYDTSKLAPGVPARFSGSGS GTSYSLTISSMEAEDAASYFCH QWSSYPPTFGCGTKLEIK (SEQ ID NO: 5029) | No nuc. seq available VQLLEQSGPELVKPGASVKISC KASDYTESKSWMNWVKQRPGEC LEWIGRVWPGDGDTTYNEKFKG KATLTADKSSRTAYMQLSSLTS EDSAVYFCARGNYFGSSEAYFD YWGQGTRVTVSS (SEQ ID NO: 5053) |
| MA_24-G6x_I2C0x_scFc_(FIM)_translation | NA AA | No nuc. seq available ELVLTQSPAIMSASPGQKVTIT CSASSNVNYIHWYQQKLGSSPK LWIYDTSKLAPGVPARFSGSGS GTSYSLTISSMEAEDAASYECH QWSSYPPTFGSGTKLEIK (SEQ ID NO: 5030) | No nuc. seq available VQLLEQSGPELVKPGASVKISC KASDYTFSKSWMNWVKQRPGEG LEWIGRVWPGDGDTTYNEKFKG KATLTADKSSRTAYMQLSSLTS EDSAVYFCARGNYFGSSEAYFD YWGQGTRVTVSS (SEQ ID NO: 5054) |
| MA_31-H8_CCx_I2C0x_scFc_(K4E)_translation | NA AA | No nuc. seq available ELQMTQSPASLSASVGETVTIT CRASGNIHNYLAWYQQKQGKSP | No nuc. seq available VQLLEQSGPELVKPGASVKISC KASGYAFSSSWMNWVKQRPGKC |

TABLE 51-continued

BiTE-scFc Variable Region Sequences

| | | Fv#1 (MAGEB2) | |
|---|---|---|---|
| Ab | Type | LC V-region | HC V-region |
| | | QLLVYNAKTLAGGVPSRESGSG<br>SGTQFSLKINSLQPEDEGSYYC<br>QHHYGTPLTFGCGTKLELK<br>(SEQ ID NO: 5031) | LEWIGRIYPGDGDTNYNGKFKD<br>KATLTADKSSNTAYMQLSSLTS<br>EDSAVYFCARRQLNHVFAMDYW<br>GQGTSVTVSS<br>(SEQ ID NO: 5055) |
| MA_31-H8x_I2C0x_scFc_(F9Z)_translation | NA<br>AA | No nuc. seq available<br>ELQMTQSPASLSASVGETVTIT<br>CRASGNIHNYLAWYQQKGKSP<br>QLLVYNAKTLAGGVPSRFSGSG<br>SGTQFSLKINSLQPEDFGSYYC<br>QHHYGTPLTFGAGTKLELK<br>(SEQ ID NO: 5032) | No nuc. seq available<br>VQLLEQSGPELVKPGASVKISC<br>KASGYAFSSSWMNWVKQRPGKG<br>LEWIGRIYPGDGDTNYNGKFKD<br>KATLTADKSSNTAYMQLSSLTS<br>EDSAVYFCARRQLNHVEAMDYW<br>GQGTSVTVSS<br>(SEQ ID NO: 5056) |
| MA_32-A8_CCx_I2C0x_scFc_(A9E)_translation | NA<br>AA | No nuc. seq available<br>DIVMTQSPLSLPVSPGEPASIS<br>CRSSQSLLYSNGYNYVDWYLQK<br>PGQSPQLLIYLGSNRASGVPDR<br>FSGSGSGTDFTLKISKVEAEDV<br>GVYYCMQALQTPPTFGCGTRLE<br>IK<br>(SEQ ID NO: 5033) | No nuc. seq available<br>QVQLVQSGAEVKKPGASVKVSC<br>KASGYTFTSYDINWVRQATGQC<br>LEWMGWMNPNSGNTGYAQKFQG<br>RVTMTRNTSISTAYMELSSLRS<br>EDTAVYYCARGGGYSNGYDYGM<br>DVWGQGTTVTVSS<br>(SEQ ID NO: 5057) |
| MA_32-A8_x_I2C0x_scFc_(G6J)_translation | NA<br>AA | No nuc. seq available<br>DIVMTQSPLSLPVSPGEPASIS<br>CRSSQSLLYSNGYNVDWYLQKP<br>GQSPQLLIYLGSNRASGVPDRF<br>SGSGSGTDFTLKISKVEAEDVG<br>VYYCMQALQTPPTFGQGTRLEI<br>K<br>(SEQ ID NO: 5034) | No nuc. seq available<br>QVQLVQSGAEVKKPGASVKVSC<br>KASGYTFTSYDINWVRQATGQG<br>LEWMGWMNPNSGNTGYAQKFQG<br>RVTMTRNTSISTAYMELSSLRS<br>EDTAVYYCARGGGYSNGYDYGM<br>DVWGQGTTVTVSS<br>(SEQ ID NO: 5058) |
| MA_48-D12_CCx_I2C0x_scFc_(_M9T)_translation | NA<br>AA | No nuc. seq available<br>EIVLTQSPGTLSLSPGERATLS<br>CRASQSVSSSYLAWYQQKPGQA<br>PRLLIYGASSRATGIPDRFSGS<br>GSGTDFTLTISRLEPEDFAVYY<br>CQQYGSSPLTFGCGTKLEIK<br>(SEQ ID NO: 5035) | No nuc. seq available<br>QVQLVESGGGVVQPGRSLRLSC<br>AASGFTFRSYRMHWVRQAPGKC<br>LEWVAVISYDGGNKYYADSVKG<br>RFTISRDNSKNTLYLQMNSLRA<br>EDTAVYYCAREQWPNYYYGMDV<br>WGQGTTVTVSS<br>(SEQ ID NO: 5059) |
| MA_48-D12x_I2C0x_scFc_(R9D)_translation | NA<br>AA | No nuc. seq available<br>EIVLTQSPGTLSLSPGERATLS<br>CRASQSVSSSYLAWYQQKPGQA<br>PRLLIYGASSRATGIPDRFSGS<br>GSGTDETLTISRLEPEDFAVYY<br>CQQYGSSPLTFGGGTKLEIK<br>(SEQ ID NO: 5036) | No nuc. seq available<br>QVQLVESGGGVVQPGRSLRLSC<br>AASGFTFRSYRMHWVRQAPGKG<br>LEWVAVISYDGGNKYYADSVKG<br>RFTISRDNSKNTLYLQMNSLRA<br>EDTAVYYCAREQWPNYYYGMDV<br>WGQGTTVTVSS<br>(SEQ ID NO: 5060) |
| MA_50-D9_CCx_I2C0x_scFc_(K6S)_translation | NA<br>AA | No nuc. seq available<br>DIVLTQSPLSLPVTPGDPASIS<br>CRSSQSLLHSNGYNYLDWYLQK<br>PGQSPQLLIYLGSNRASGVPDR<br>FSGSGSGTDFTLKISRVEAEDV<br>GVYYCMQALQTPLTFGCGTKVD<br>IK<br>(SEQ ID NO: 5037) | No nuc. seq available<br>QVQLQQSGPGLVKPSQTLSLTC<br>AISGDSVSSNSAAWNWIRQSPS<br>RCLEWLGRTYYRSKWYNDYAVS<br>VKSRITINPDTSKNQFSLQLNS<br>VTPEDTAVYYCVREILWFGKLN<br>YYYGMDVWGQGTTVTVSS<br>(SEQ ID NO: 5061) |
| MA_50-D9x_I2C0x_scFc_(A4U)_translation | NA<br>AA | No nuc. seq available<br>DIVLTQSPLSLPVTPGDPASIS<br>CRSSQSLLHSNGYNYLDWYLQK<br>PGQSPQLLIYLGSNRASGVPDR<br>FSGSGSGTDFTLKISRVEAEDV<br>GVYYCMQALQTPLTFGGGTKVD<br>IK<br>(SEQ ID NO: 5038) | No nuc. seq available<br>QVQLQQSGPGLVKPSQTLSLTC<br>AISGDSVSSNSAAWNWIRQSPS<br>RGLEWLGRTYYRSKWYNDYAVS<br>VKSRITINPDTSKNQFSLQLNS<br>VTPEDTAVYYCVREILWFGKLN<br>YYYGMDVWGQGTTVTVSS<br>(SEQ ID NO: 5062) |
| MA_78-A6_CCx_I2C0x_scFc_(D8Z)_translation | NA<br>AA | No nuc. seq available<br>DIVLTQSPLSLPVSPGEPASIS<br>CRSSQSLLYSNGYNYVDWYLQK<br>PGQSPQLLIYLGSNRASGVPDR | No nuc. seq available<br>QVQLQQWGAGLLKPSETLSLTC<br>AVYGGSFSGYYWNWIRQPPGKC<br>LEWIGEINHRGSTNYNPSLKSR |

TABLE 51-continued

BiTE-scFc Variable Region Sequences

| | | Fv#1 (MAGEB2) | |
|---|---|---|---|
| Ab | Type | LC V-region | HC V-region |
| | | FSGSGSGTDFTLKISKVEAEDV GVYYCMQALQTPFTFGCGTKVE IK (SEQ ID NO: 5039) | VTISVDASKNQFSLKLSSVTAA DTAVYYCARGGGYSDGYDYGMD VWGQGTTVTVSS (SEQ ID NO: 5063) |
| MA_78-A6x_I2C0x_scFc_(K6P)_translation | NA AA | No nuc. seq available DIVLTQSPLSLPVSPGEPASIS CRSSQSLLYSNGYNYVDWYLQK PGQSPQLLIYLGSNRASGVPDR FSGSGSGTDFTLKISKVEAEDV GVYYCMQALQTPFTFGPGTKVE IK (SEQ ID NO: 5040) | No nuc. seq available QVQLQQWGAGLLKPSETLSLTC AVYGGSFSGYYWNWIRQPPGKG LEWIGEINHRGSTNYNPSLKSR VTISVDASKNQFSLKLSSVTAA DTAVYYCARGGGYSDGYDYGMD VWGQGTTVTVSS (SEQ ID NO: 5064) |
| MA_79-E3_CC_x_I2C0x_scFc_(E2Y)_translation | NA AA | No nuc. seq available DIQMTQSPSSVSASVGDRVTIT CRASQSISSYLNWYQQKPGKAP KSLIYAASSLQSGVPSRESGSG SGTDETLTISSLQPEDFATYYC QQSYRTPPTFGCGTKVDIK (SEQ ID NO: 5041) | No nuc. seq available EVQLLESGGGLVQPGGSLRLSC AASGFTFSSFAMSWVRQAPGKC LEWVSAISGSGGSTYYADSVKG RFTISRDNSKNTLYLQMNSLRA EDTAEYYCAKMVTPDYYYDMDV WGQGTTVTVSS (SEQ ID NO: 5065) |
| MA_79-E3x_I2C0x_scFc_(N4F)_translation | NA AA | No nuc. seq available DIQMTQSPSSVSASVGDRVTIT CRASQSISSYLNWYQQKPGKAP KSLIYAASSLQSGVPSRFSGSG SGTDFTLTISSLQPEDFATYYC QQSYRTPPTFGQGTKVDIK (SEQ ID NO: 5042) | No nuc. seq available EVQLLESGGGLVQPGGSLRLSC AASGFTFSSFAMSWVRQAPGKG LEWVSAISGSGGSTYYADSVKG RFTISRDNSKNTLYLQMNSLRA EDTAEYYCAKMVTPDYYYDMDV WGQGTTVTVSS (SEQ ID NO: 5066) |
| MA_83-F3_CCx_I2C0x_scFc_(G5K)_translation | NA AA | No nuc. seq available DIQMTQSPSSLSASVGDRVTIT CRASQGISNYLAWYQQKPGKVP KLLIYAASTLQSGVPSRFSGSG SGTDFTLTISSLQPEDVATYYC QKYNSAPWTFGCGTKLEIK (SEQ ID NO: 5043) | No nuc. seq available QVQLVQSGAEVKKPGASVKVSC KASGYSFTGYYMHWVRQAPGQC LEWMGRINPNSGDTHYAQKFQG RVTMTRDTSISTAYMELSRLRS DDTAVYYCARGLGISFFDYWGQ GTLVTVSS (SEQ ID NO: 5067) |
| MA_83-F3x_I2C0x_scFc_(B9A)_translation | NA AA | No nuc. seq available DIQMTQSPSSLSASVGDRVTIT CRASQGISNYLAWYQQKPGKVP KLLIYAASTLQSGVPSRFSGSG SGTDFTLTISSLQPEDVATYYC QKYNSAPWTFGQGTKLEIK (SEQ ID NO: 5044) | No nuc. seq available QVQLVQSGAEVKKPGASVKVSC KASGYSFTGYYMHWVRQAPGQG LEWMGRINPNSGDTHYAQKFQG RVTMTRDTSISTAYMELSRLRS DDTAVYYCARGLGISFFDYWGQ GTLVTVSS (SEQ ID NO: 5068) |
| MA_84-G10_CC_x_I2C0x_scFc_(H90)_translation | NA AA | No nuc. seq available DIVMTQTPLSLPVTPGEPASIS CRSSQSLLHSNGYNYLDWYLQK PGQSPQLLIYLGSNRASGVPDR FSGSGSGTDFTLKISRVEAEDV GVYYCMQALQTPITFGCGTRLE IK (SEQ ID NO: 5045) | No nuc. seq available QVQLQESGPGLVKPSQTLSLTC TVSGDSISRDPYYWSWIRQHPG KCLEWIGYIYYSGSTYYNPSLK SRVTISVDTSKNQFSLKLSSVT AADTAVYYCARDKLWFGKLNYY YGMDVWGQGTTVTVSS (SEQ ID NO: 5069) |
| MA_84-G10x_I2C0x_scFc_(Y4W)_translation | NA AA | No nuc. seq available DIVMTQTPLSLPVTPGEPASIS CRSSQSLLHSNGYNYLDWYLQK PGQSPQLLIYLGSNRASGVPDR FSGSGSGTDFTLKISRVEAEDV GVYYCMQALQTPITFGQGTRLE IK (SEQ ID NO: 5046) | No nuc. seq available QVQLQESGPGLVKPSQTLSLTC TVSGDSISRDPYYWSWIRQHPG KGLEWIGYIYYSGSTYYNPSLK SRVTISVDTSKNQFSLKLSSVT AADTAVYYCARDKLWFGKLNYY YGMDVWGQGTTVTVSS (SEQ ID NO: 5070) |
| MA_12-E12_CC_x_I2C0x_scFc_(E9U)_translation | NA AA | No nuc. seq available QTVVTQEPSLTVSPGGTVTLTC GSSTGAVTSGNYPNWVQQKPGQ APRGLIGGTKFLAPGTPARFSG | No nuc. seq available EVQLVESGGGLVQPGGSLKLSC AASGFTENKYAMNWVRQAPGKG LEWVARIRSKYNNYATYYADSV |

TABLE 51-continued

BiTE-scFc Variable Region Sequences

| | | Fv#1 (MAGEB2) | |
|---|---|---|---|
| Ab | Type | LC V-region | HC V-region |
| | | SLLGGKAALTLSGVQPEDEAEY<br>YCVLWYSNRWVFGGGTKLTVL<br>(SEQ ID NO: 5071) | KDRFTISRDDSKNTAYLQMNNL<br>KTEDTAVYYCVRHGNEGNSYIS<br>YWAYWGQGTLVTVSS<br>(SEQ ID NO: 5095) |
| MA_12-<br>E12x_I2C0x_scFC_(W1U)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5072) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNEGNSYIS<br>YWAYWGQGTLVTVSS<br>(SEQ ID NO: 5096) |
| MA_13-<br>D8_CCx_I2C0x_scFc_(U7V)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5073) | No nuc. seq available<br>EVQLVESGGGLVQPGGSLKLSC<br>AASGFTFNKYAMNWVRQAPGKG<br>LEWVARIRSKYNNYATYYADSV<br>KDRFTISRDDSKNTAYLQMNNL<br>KTEDTAVYYCVRHGNEGNSYIS<br>YWAYWGQGTLVTVSS<br>(SEQ ID NO: 5097) |
| MA_13-D8x_I2C0x_scFc_(M7M)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5074) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5098) |
| MA_24-<br>C9_CCx_I2C0x_scFc_(I2U)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5075) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNEGNSYIS<br>YWAYWGQGTLVTVSS<br>(SEQ ID NO: 5099) |
| MA_24-C9x_I2C0x_scFc_(L9Y)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5076) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNEGNSYIS<br>YWAYWGQGTLVTVSS<br>(SEQ ID NO: 5100) |
| MA_24-<br>G6_CCx_I2C0x_scFc_(B1I)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5077) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5101) |
| MA_24-G6x_I2C0x_scFc_(F1M)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5078) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5102) |
| MA_31-<br>H8_CCx_I2C0x_scFc_(K4E)_translation | NA<br>AA | No nuc. seq available<br>QTVVTQEPSLTVSPGGTVTLTC<br>GSSTGAVTSGNYPNWVQQKPGQ | No nuc. seq available<br>EVQLVESGGGLVQPGGSLKLSC<br>AASGFTENKYAMNWVRQAPGKG |

TABLE 51-continued

BiTE-scFc Variable Region Sequences

| | | Fv#1 (MAGEB2) | |
|---|---|---|---|
| Ab | Type | LC V-region | HC V-region |
| | | APRGLIGGTKFLAPGTPARFSG<br>SLLGGKAALTLSGVQPEDEAEY<br>YCVLWYSNRWVFGGGTKLTVL<br>(SEQ ID NO: 5079) | LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5103) |
| MA_31-H8x_I2C0x_scFc_(F9Z)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5080) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5104) |
| MZ_30-A8_CCx_I2C0x_scFc_(A9E)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5081) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5105) |
| MA_32-A8_x_I2C0x_scFc_(G6J)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5082) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5106) |
| MA_48-D12_CCx_I2C0x_scFc_(_M9T)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5083) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5107) |
| MA_48-D12x_I2C0x_scFc_(R9D)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5084) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5108) |
| MA_50-D9_CCx_I2C0x_scFc_(K6S)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5085) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5109) |
| MA_50-D9x_I2C0x_scFc_(A4U)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG<br>SLLGGKAALTLSGVQPEDEAEY<br>YCVLWYSNRWVFGGGTKLTVL<br>(SEQ ID NO: 5086) | No nuc. seq available<br>EVQLVESGGGLVQPGGSLKLSC<br>AASGFTENKYAMNWVRQAPGKG<br>LEWVARIRSKYNNYATYYADSV<br>KDRFTISRDDSKNTAYLQMNNL<br>KTEDTAVYYCVRHGNFGNSYIS<br>YWAYWGQGTLVTVSS<br>(SEQ ID NO: 5110) |
| MA_78-A6_CCx_I2C0x_scFc_(D8Z)_translation | NA<br>AA | No nuc. seq available<br>QTVVTQEPSLTVSPGGTVTLTC<br>GSSTGAVTSGNYPNWVQQKPGQ<br>APRGLIGGTKFLAPGTPARFSG | No nuc. seq available<br>EVQLVESGGGLVQPGGSLKLSC<br>AASGFTENKYAMNWVRQAPGKG<br>LEWVARIRSKYNNYATYYADSV |

TABLE 51-continued

BiTE-scFc Variable Region Sequences

| | | Fv#1 (MAGEB2) | |
|---|---|---|---|
| Ab | Type | LC V-region | HC V-region |
| | | SLLGGKAALTLSGVQPEDEAEY YCVLWYSNRWVFGGGTKLTVL (SEQ ID NO: 5087) | KDRFTISRDDSKNTAYLQMNNL KTEDTAVYYCVRHGNFGNSYIS YWAYWGQGTLVTVSS (SEQ ID NO: 5111) |
| MA_78-A6x_I2C0x_scFc_(K6P)_translation | NA AA | No nuc. seq available QTVVTQEPSLTVSPGGTVTLTC GSSTGAVTSGNYPNWVQQKPGQ APRGLIGGTKFLAPGTPARFSG SLLGGKAALTLSGVQPEDEAEY YCVLWYSNRWVFGGGTKLTVL (SEQ ID NO: 5088) | No nuc. seq available EVQLVESGGGLVQPGGSLKLSC AASGFTENKYAMNWVRQAPGKG LEWVARIRSKYNNYATYYADSV KDRFTISRDDSKNTAYLQMNNL KTEDTAVYYCVRHGNFGNSYIS YWAYWGQGTLVTVSS (SEQ ID NO: 5112) |
| MA_79-E3_CC_x_I2C0x_scFc_(E2Y)_translation | NA AA | No nuc. seq available QTVVTQEPSLTVSPGGTVTLTC GSSTGAVTSGNYPNWVQQKPGQ APRGLIGGTKFLAPGTPARFSG SLLGGKAALTLSGVQPEDEAEY YCVLWYSNRWVFGGGTKLTVL (SEQ ID NO: 5089) | No nuc. seq available EVQLVESGGGLVQPGGSLKLSC AASGFTENKYAMNWVRQAPGKG LEWVARIRSKYNNYATYYADSV KDRFTISRDDSKNTAYLQMNNL KTEDTAVYYCVRHGNFGNSYIS YWAYWGQGTLVTVSS (SEQ ID NO: 5113) |
| MA_79-E3x_I2C0x_scFc_(N4F)_translation | NA AA | No nuc. seq available QTVVTQEPSLTVSPGGTVTLTC GSSTGAVTSGNYPNWVQQKPGQ APRGLIGGTKFLAPGTPARFSG SLLGGKAALTLSGVQPEDEAEY YCVLWYSNRWVFGGGTKLTVL (SEQ ID NO: 5090) | No nuc. seq available EVQLVESGGGLVQPGGSLKLSC AASGFTENKYAMNWVRQAPGKG LEWVARIRSKYNNYATYYADSV KDRFTISRDDSKNTAYLQMNNL KTEDTAVYYCVRHGNFGNSYIS YWAYWGQGTLVTVSS (SEQ ID NO: 5114) |
| MA_83-F3_CCx_I2C0x_scFc_(G5K)_translation | NA AA | No nuc. seq available QTVVTQEPSLTVSPGGTVTLTC GSSTGAVTSGNYPNWVQQKPGQ APRGLIGGTKFLAPGTPARFSG SLLGGKAALTLSGVQPEDEAEY YCVLWYSNRWVFGGGTKLTVL (SEQ ID NO: 5091) | No nuc. seq available EVQLVESGGGLVQPGGSLKLSC AASGFTENKYAMNWVRQAPGKG LEWVARIRSKYNNYATYYADSV KDRFTISRDDSKNTAYLQMNNL KTEDTAVYYCVRHGNFGNSYIS YWAYWGQGTLVTVSS (SEQ ID NO: 5115) |
| MA_83-F3x_I2C0x_scFc_(B9A)_translation | NA AA | No nuc. seq available QTVVTQEPSLTVSPGGTVTLTC GSSTGAVTSGNYPNWVQQKPGQ APRGLIGGTKFLAPGTPARFSG SLLGGKAALTLSGVQPEDEAEY YCVLWYSNRWVFGGGTKLTVL (SEQ ID NO: 5092) | No nuc. seq available EVQLVESGGGLVQPGGSLKLSC AASGFTENKYAMNWVRQAPGKG LEWVARIRSKYNNYATYYADSV KDRFTISRDDSKNTAYLQMNNL KTEDTAVYYCVRHGNFGNSYIS YWAYWGQGTLVTVSS (SEQ ID NO: 5116) |
| MA_84-G10_CC_x_I2C0x_scFc_(H90)_translation | NA AA | No nuc. seq available QTVVTQEPSLTVSPGGTVTLTC GSSTGAVTSGNYPNWVQQKPGQ APRGLIGGTKFLAPGTPARFSG SLLGGKAALTLSGVQPEDEAEY YCVLWYSNRWVFGGGTKLTVL (SEQ ID NO: 5093) | No nuc. seq available EVQLVESGGGLVQPGGSLKLSC AASGFTENKYAMNWVRQAPGKG LEWVARIRSKYNNYATYYADSV KDRFTISRDDSKNTAYLQMNNL KTEDTAVYYCVRHGNFGNSYIS YWAYWGQGTLVTVSS (SEQ ID NO: 5117) |
| MA_84-G10x_I2C0x_scFc_(Y4W)_translation | NA AA | No nuc. seq available QTVVTQEPSLTVSPGGTVTLTC GSSTGAVTSGNYPNWVQQKPGQ APRGLIGGTKFLAPGTPARFSG SLLGGKAALTLSGVQPEDEAEY YCVLWYSNRWVFGGGTKLTVL (SEQ ID NO: 5094) | No nuc. seq available EVQLVESGGGLVQPGGSLKLSC AASGFTENKYAMNWVRQAPGKG LEWVARIRSKYNNYATYYADSV KDRFTISRDDSKNTAYLQMNNL KTEDTAVYYCVRHGNFGNSYIS YWAYWGQGTLVTVSS (SEQ ID NO: 5118) |

TABLE 52

BiTE-scFc Variable Region Protein Alignment_(MAGEB2)
CDRs defined by Kabat
Alignment numbering defined by Amgen Reference_(AHo)

KAPPA VARIABLE

| | Germline | | SEQ ID NO: |
|---|---|---|---|
| | | K_FR1 | |
| VK3\|A27/JK4 | | EIVLTQSPGTLSLSPGERATLSC | 5119 |
| MA_12-E12_CC_x_I2C0x_scFc_(E9U)_translation Fv#1 | VK3\|A27/JK4 | EIVLTQSPGTLSLSPGERATLSC | 5120 |
| MA_12-E12x_I2C0x_scFC_(W1U)_translation Fv#1 | VK3\|A27/JK4 | EIVLTQSPGTLSLSPGERATLSC | 5121 |
| MA_48-D12x_I2C0x_scFc_(R9D)_translation Fv#1 | VK3\|A27/JK4 | EIVLTQSPGTLSLSPGERATLSC | 5122 |
| VK1\|A20/JK1 | | DIQMTQSPSSLSASVGDRVTITC | 5123 |
| MA_13-D8_CCx_I2C0x_scFc_(U7V)_translation Fv#1 | VK1\|A20/JK1 | DIQMTQSPSSLSASVGDRVTITC | 5124 |
| MA_13-D8x_I2C0x_scFc_(M7M)_translation Fv#1 | VK1\|A20/JK1 | DIQMTQSPSSLSASVGDRVTITC | 5125 |
| VK4\|B3/JK2 | | DIVMTQSPDSLAVSLGERATINC | 5126 |
| MA_24-C9_CCx_I2C0x_scFc_(I2U)_translation Fv#1 | VK4\|B3/JK2 | ELVMTQSPSSLAVSVGEKITMSC | 5127 |
| MA_24-C9x_I2C0x_scFc_(L9Y)_translation Fv#1 | VK4\|B3/JK2 | ELVMTQSPSSLAVSVGEKITMSC | 5128 |
| VK6\|A10/JK2 | | EIVLTQSPDFQSVTPKEKVTITC | 5129 |
| MA_24-G6_CCx_I2C0x_scFc_(B1I)_translation Fv#1 | VK6\|A10/JK2 | ELVLTQSPAIMSASPGQKVTITC | 5130 |
| MA_24-G6x_I2C0x_scFc_(F1M)_translation Fv#1 | VK6\|A10/JK2 | ELVLTQSPAIMSASPGQKVTITC | 5131 |
| VK1\|L11/JK2 | | AIQMTQSPSSLSASVGDRVTITC | 5132 |
| MA_31-H8_CCx_I2C0x_scFc_(K4E)_translation Fv#1 | VK1\|L11/JK2 | ELQMTQSPASLSASVGETVTITC | 5133 |
| MA_31-H8x_I2C0x_scFc_(F9Z)_translation Fv#1 | VK1\|L11/JK2 | ELQMTQSPASLSASVGETVTITC | 5134 |
| VK2\|A19/JK5 | | DIVMTQSPLSLPVTPGEPASISC | 5135 |
| MA_32-A8_CCx_I2C0x_scFc_(A9E)_translation Fv#1 | VK2\|A19/JK5 | DIVMTQSPLSLPVSPGEPASISC | 5136 |
| MA_32-A8_x_I2C0x_scFc_(G6J)_translation Fv#1 | VK2\|A19/JK5 | DIVMTQSPLSLPVSPGEPASISC | 5137 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VK3\|A27/JK2 | | EIVLTQSPGTLSLSPGERATLSC | 5138 |
| MA_48-D12_CCx_I2C0x_scFc_(M9T)_translation Fv#1 | VK3\|A27/JK2 | EIVLTQSPGTLSLSPGERATLSC | 5139 |
| VK2\|A19/JK3 | | DIVMTQSPLSLPVTPGEPASISC | 5140 |
| MA_50-D9_CCx_I2C0x_scFc_(K6S)_translation Fv#1 | VK2\|A19/JK3 | DIVLTQSPLSLPVTPGDPASISC | 5141 |
| MA_78-A6x_I2C0x_scFc_(K6P)_translation Fv#1 | VK2\|A19/JK3 | DIVLTQSPLSLPVSPGEPASISC | 5142 |
| VK2\|A19/JK4 | | DIVMTQSPLSLPVTPGEPASISC | 5143 |
| MA_50-D9x_I2C0x_scFc_(A4U)_translation Fv#1 | VK2\|A19/JK4 | DIVLTQSPLSLPVTPGDPASISC | 5144 |
| VK2\|A19/JK1 | | DIVMTQSPLSLPVTPGEPASISC | 5145 |
| MA_78-A6_CCx_I2C0x_scFc_(D8Z)_translation Fv#1 | VK2\|A19/JK1 | DIVLTQSPLSLPVSPGEPASISC | 5146 |
| VK1\|L19/JK3 | | DIQMTQSPSSVSASVGDRVTITC | 5147 |
| MA_79-E3_CC_x_I2C0x_scFc_(E2Y)_translation Fv#1 | VK1\|L19/JK3 | DIQMTQSPSSVSASVGDRVTITC | 5148 |
| VK1\|L19/JK1 | | DIQMTQSPSSVSASVGDRVTITC | 5149 |
| MA_79-E3x_I2C0x_scFc_(N4F)_translation Fv#1 | VK1\|L19/JK1 | DIQMTQSPSSVSASVGDRVTITC | 5150 |
| VK1\|A20/JK2 | | DIQMTQSPSSLSASVGDRVTITC | 5151 |
| MA_83-F3_CCx_I2C0x_scFc_(G5K)_translation Fv#1 | VK1\|A20/JK2 | DIQMTQSPSSLSASVGDRVTITC | 5152 |
| MA_83-F3x_I2C0x_scFc_(B9A)_translation Fv#1 | VK1\|A20/JK2 | DIQMTQSPSSLSASVGDRVTITC | 5153 |
| VK2\|O1/JK5 | | DIVMTQTPLSLPVTPGEPASISC | 5154 |
| MA_84-G10_CC_x_I2C0x_scFc_(H9O)_translation Fv#1 | VK2\|O1/JK5 | DIVMTQTPLSLPVTPGEPASISC | 5155 |
| MA_84-G10x_I2C0x_scFC_(Y4W)_translation Fv#1 | VK2\|O1/JK5 | DIVMTQTPLSLPVTPGEPASISC | 5156 |
| | | K_CDR1 | |
| VK3\|A27/JK4 | | RAS--QSVSS-----SYLA | 5242 |
| MA_12-E12_CC_x_I2C0x_scFc_(E9U)_translation Fv#1 | VK3\|A27/JK4 | RAS--QSVSS-----SYLA | 5243 |
| MA_12-E12x_I2C0x_scFC_(W1U)_translation Fv#1 | VK3\|A27/JK4 | RAS--QSVSS-----SYLA | 5244 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_48-D12x_I2C0x_scFc_(R9D)_translation Fv#1 | VK3\|A27/JK4 | RAS--QSVSS-----SYLA | 5245 |
| VK1\|A20/JK1 | | RAS--QGIS------NYLA | 5246 |
| MA_13-D8_CCx_I2C0x_scFc_(U7V)_translation Fv#1 | VK1\|A20/JK1 | RAS--QGIS------NYLA | 5247 |
| MA_13-D8x_I2C0x_scFc_(M7M)_translation Fv#1 | VK1\|A20/JK1 | RAS--QGIS------NYLA | 5248 |
| VK4\|B3/JK2 | | KSS--QSVLYSSNNKNYLA | 5249 |
| MA_24-C9_CCx_I2C0x_scFc_(I2U)_translation Fv#1 | VK4\|B3/JK2 | KSS--QSLLYSSNQKNYLA | 5250 |
| MA_24-C9x_I2C0x_scFc_(L9Y)_translation Fv#1 | VK4\|B3/JK2 | KSS--QSLLYSSNQKNYLA | 5251 |
| VK6\|A10/JK2 | | RAS--QSIG------SSLH | 5252 |
| MA_24-G6_CCx_I2C0x_scFc_(B1I)_translation Fv#1 | VK6\|A10/JK2 | SAS--SNVN-------YIH | 5253 |
| MA_24-G6x_I2C0x_scFc_(F1M)_translation Fv#1 | VK6\|A10/JK2 | SAS--SNVN-------YIH | 5254 |
| VK1\|L11/JK2 | | RAS--QGIR------NDLG | 5255 |
| MA_31-H8_CCx_I2C0x_scFc_(K4E)_translation Fv#1 | VK1\|L11/JK2 | RAS--GNIH------NYLA | 5256 |
| MA_31-H8x_I2C0x_scFc_(F9Z)_translation Fv#1 | VK1\|L11/JK2 | RAS--GNIH-----NYLA | 5257 |
| VK2\|A19/JK5 | | RSS--QSLLHSN-GYNYLD | 5258 |
| MA_32-A8_CCx_I2C0x_scFc_(A9E)_translation Fv#1 | VK2\|A19/JK5 | RSS--QSLLYSN-GYNYVD | 5259 |
| MA_32-A8_x_I2C0x_scFc_(G6J)_translation Fv#1 | VK2\|A19/JK5 | RSS--QSLLYSN-GYNYVD | 5260 |
| VK3\|A27/JK2 | | RAS--QSVSS-----SYLA | 5261 |
| MA_48-D12_CCx_I2C0x_scFc_(M9T)_translation Fv#1 | VK3\|A27/JK2 | RAS--QSVSS-----SYLA | 5262 |
| VK2\|A19/JK3 | | RSS--QSLLHSN-GYNYLD | 5263 |
| MA_50-D9_CCx_I2C0x_scFc_(K6S)_translation Fv#1 | VK2\|A19/JK3 | RSS--QSLLHSN-GYNYLD | 5264 |
| MA_78-A6x_I2C0x_scFc_(K6P)_translation Fv#1 | VK2\|A19/JK3 | RSS--QSLLYSN-GYNYVD | 5265 |
| VK2\|A19/JK4 | | RSS--QSLLHSN-GYNYLD | 5266 |
| MA_50-D9x_I2C0x_scFc_(A4U)_translation Fv#1 | VK2\|A19/JK4 | RSS--QSLLHSN-GYNYLD | 5267 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VK2\|A19/JK1 | | RSS--QSLLHSN-GYNYLD | 5268 |
| MA_78-A6_CCx_I2C0x_scFc_(D8Z)_translation Fv#1 | VK2\|A19/JK1 | RSS--QSLLYSN-GYNYVD | 5269 |
| VK1\|L19/JK3 | | RAS--QGIS------SWLA | 5271 |
| MA_79-E3_CC_x_I2C0x_scFc_(E2Y)_translation Fv#1 | VK1\|L19/JK3 | RAS--QSIS------SYLN | 5272 |
| VK1\|L19/JK1 | | RAS--QGIS------SWLA | 5273 |
| MA_79-E3x_I2C0x_scFc_(N4F)_translation Fv#1 | VK1\|L19/JK1 | RAS--QSIS------SYLN | 5274 |
| VK1\|A20/JK2 | | RAS--QGIS------NYLA | 5275 |
| MA_83-F3_CCx_I2C0x_scFc_(G5K)_translation Fv#1 | VK1\|A20/JK2 | RAS--QGIS------NYLA | |
| MA_83-F3x_I2C0x_scFc_(B9A)_translation Fv#1 | VK1\|A20/JK2 | RAS--QGIS------NYLA | 5276 |
| VK2\|O1/JK5 | | RSS--QSLLDSDDGNTYLD | 5277 |
| MA_84-G10_CC_x_I2C0x_scFc_(H9O) translation Fv#1 | VK2\|O1/JK5 | RSS--QSLLHSN-GYNYLD | 5278 |
| MA_84-G10x_I2C0x_scFc_(Y4W)_translation Fv#1 | VK2\|O1/JK5 | RSS--QSLLHSN-GYNYLD | 5279 |
| | | K_FR2 | |
| VK3\|A27/JK4 | | WYQQKPGQAPRLLIY | 5365 |
| MA_12-E12_CC_x_I2C0x_scFc_(E9U) translation Fv#1 | VK3\|A27/JK4 | WYQQKPGQAPRLLIY | 5366 |
| MA_12-E12x_I2C0x_scFC_(W1U)_translation Fv#1 | VK3\|A27/JK4 | WYQQKPGQAPRLLIY | 5367 |
| MA_48-D12x_I2C0x_scFc_(R9D)_translation Fv#1 | VK3\|A27/JK4 | WYQQKPGQAPRLLIY | 5368 |
| VK1\|A20/JK1 | | WYQQKPGKVPKLLIY | 5369 |
| MA_13-D8_CCx_I2C0x_scFc_(U7V)_translation Fv#1 | VK1\|A20/JK1 | WYQQKPGKVPKLLIY | 5370 |
| MA_13-D8x_I2C0x_scFc_(M7M)_translation Fv#1 | VK1\|A20/JK1 | WYQQKPGKVPKLLIY | 5371 |
| VK4\|B3/JK2 | | WYQQKPGQPPKLLIY | 5372 |
| MA_24-C9_CCx_I2C0x_scFc_(I2U)_translation Fv#1 | VK4\|B3/JK2 | WYQQKPGQSPKLLIY | 5373 |
| MA_24-C9x_I2C0x_scFc_(L9Y)_translation Fv#1 | VK4\|B3/JK2 | WYQQKPGQSPKLLIY | 5374 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VK6\|A10/JK2 | | WYQQKPDQSPKLLIK | 5375 |
| MA_24-G6_CCx_I2C0x_scFc_(B1I)_translation Fv#1 | VK6\|A10/JK2 | WYQQKLGSSPKIWIY | 5376 |
| MA_24-G6x_I2C0x_scFc_(F1M)_translation Fv#1 | VK6\|A10/JK2 | WYQQKLGSSPKLWIY | 5377 |
| VK1\|L11/JK2 | | WYQQKPGKAPKLLIY | 5378 |
| MA_31-H8_CCx_I2C0x_scFc_(K4E)_translation Fv#1 | VK1\|L11/JK2 | WYQQKQGKSPQLLVY | 5379 |
| MA_31-H8x_I2C0x_scFc_(F9Z)_translation Fv#1 | VK1\|L11/JK2 | WYQQKQGKSPQLLVY | 5380 |
| VK2\|A19/JK5 | | WYLQKPGQSPQLLIY | 5381 |
| MA_32-A8_CCx_I2C0x_scFc_(A9E)_translation Fv#1 | VK2\|A19/JK5 | WYLQKPGQSPQLLIY | 5382 |
| MA_32-A8_x_I2C0x_scFc_(G6J)_translation Fv#1 | VK2\|A19/JK5 | WYLQKPGQSPQLLIY | 5383 |
| VK3\|A27/JK2 | | WYQQKPGQAPRLLIY | 5384 |
| MA_48-D12_CCx_I2C0x_scFc_(M9T)_translation Fv#1 | VK3\|A27/JK2 | WYQQKPGQAPRLLIY | 5385 |
| VK2\|A19/JK3 | | WYLQKPGQSPQLLIY | 5386 |
| MA_50-D9_CCx_I2C0x_scFc_(K6S)_translation Fv#1 | VK2\|A19/JK3 | WYLQKPGQSPQLLIY | 5387 |
| MA_78-A6x_I2C0x_scFc_(K6P)_translation Fv#1 | VK2\|A19/JK3 | WYLQKPGQSPQLLIY | 5388 |
| VK2\|A19/JK4 | | WYLQKPGQSPQLLIY | 5389 |
| MA_50-D9x_I2C0x_scFc_(A4U)_translation Fv#1 | VK2\|A19/JK4 | WYLQKPGQSPQLLIY | 5390 |
| VK2\|A19/JK1 | | WYLQKPGQSPQLLIY | 5391 |
| MA_78-A6_CCx_I2C0x_scFc_(D8Z)_translation Fv#1 | VK2\|A19/JK1 | WYLQKPGQSPQLLIY | 5392 |
| VK1\|L19/JK3 | | WYQQKPGKAPKLLIY | 5393 |
| MA_79-E3_CC_x_I2C0x_scFc_(E2Y)_translation Fv#1 | VK1\|L19/JK3 | WYQQKPGKAPKSLIY | 5394 |
| VK1\|L19/JK1 | | WYQQKPGKAPKLLIY | 5395 |
| MA_79-E3x_I2C0x_scFc_(N4F)_translation Fv#1 | VK1\|L19/JK1 | WYQQKPGKAPKSLIY | 5396 |
| VK1\|A20/JK2 | | WYQQKPGKVPKLLIY | 5397 |
| MA_83-F3_CCx_I2C0x_scFc_(G5K)_translation Fv#1 | VK1\|A20/JK2 | WYQQKPGKVPKLLIY | 5398 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_83-F3x_I2C0x_scFc_(B9A)_translation Fv#1 | VK1\|A20/JK2 | WYQQKPGKVPKLLIY | 5399 |
| VK2\|O1/JK5 | | WYLQKPGQSPQLLIY | 5400 |
| MA_84-G10_CC_x_I2C0x_scFc_(H9O) translation Fv#1 | VK2\|O1/JK5 | WYLQKPGQSPQLLIY | 5401 |
| MA_84-G10x_I2C0x_scFc_(Y4W)_translation Fv#1 | VK2\|O1/JK5 | WYLQKPGQSPQLLIY | 5402 |

LAMBDA VARIABLE

| | Germline | | SEQ ID NO: |
|---|---|---|---|
| | | L_FR1 | |
| VL7\|7a/JL3b | | QTVVTQE-PSLTVSPGGTVTLTC | 5157 |
| MA_12-E12_CC_x_I2C0x_scFc_(E9U) translation Fv#2 | VL7\|7a/JL3b | QTVVTQE-PSLTVSPGGTVTLTC | 5158 |
| MA_12-E12x_I2C0x_scFC_(W1U)_translation Fv#2 | VL7\|7a/JL3b | QTVVTQE-PSLTVSPGGTVTLTC | 5159 |
| MA_13-D8_CCx_I2C0x_scFc_(U7V)_translation Fv#2 | VL7\|7a/JL3b | QTVVTQE-PSLTVSPGGTVTLTC | 5160 |
| MA_13-D8x_I2C0x_scFc_(M7M)_translation Fv#2 | VL7\|7a/JL3b | QTVVTQE-PSLTVSPGGTVTLTC | 5161 |
| MA_24-C9_CCx_I2C0x_scFc_(I2U)_translation Fv#2 | VL7\|7a/JL3b | QTVVTQE-PSLTVSPGGTVTLTC | 5162 |
| MA_24-C9x_I2C0x_scFc_(L9Y)_translation Fv#2 | VL7\|7a/JL3b | QTVVTQE-PSLTVSPGGTVTLTC | 5163 |
| MA_24-G6_CCx_I2C0x_scFc_(B1I)_translation Fv#2 | VL7\|7a/JL3b | QTVVTQE-PSLTVSPGGTVTLTC | 5164 |
| MA_24-G6x_I2C0x_scFc_(F1M)_translation Fv#2 | VL7\|7a/JL3b | QTVVTQE-PSLTVSPGGTVTLTC | 5165 |
| MA_31-H8_CCx_I2C0x_scFc_(K4E)_translation Fv#2 | VL7\|7a/JL3b | QTVVTQE-PSLTVSPGGTVTLTC | 5166 |
| MA_31-H8x_I2C0x_scFc_(F9Z)_translation Fv#2 | VL7\|7a/JL3b | QTVVTQE-PSLTVSPGGTVTLTC | 5167 |
| MA_32-A8_CCx_I2C0x_scFc_(A9E)_translation Fv#2 | VL7\|7a/JL3b | QTVVTQE-PSLTVSPGGTVTLTC | 5168 |
| MA_32-A8_x_I2C0x_scFc_(G6J)_translation Fv#2 | VL7\|7a/JL3b | QTVVTQE-PSLTVSPGGTVTLTC | 5169 |
| MA_48-D12_CCx_I2C0x_scFc_(M9T)_translation Fv#2 | VL7\|7a/JL3b | QTVVTQE-PSLTVSPGGTVTLTC | 5170 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_48-D12x_I2C0x_scFc_(R9D)_translation Fv#2 | VL7\|7a/JL3b | QTVVTQE-PSLTVSPGGTVTLTC | 5171 |
| MA_50-D9_CCx_I2C0x_scFc_(K6S)_translation Fv#2 | VL7\|7a/JL3b | QTVVTQE-PSLTVSPGGTVTLTC | 5172 |
| MA_50-D9x_I2C0x_scFc_(A4U)_translation Fv#2 | VL7\|7a/JL3b | QTVVTQE-PSLTVSPGGTVTLTC | 5173 |
| MA_78-A6_CCx_I2C0x_scFc_(D8Z)_translation Fv#2 | VL7\|7a/JL3b | QTVVTQE-PSLTVSPGGTVTLTC | 5174 |
| MA_78-A6x_I2C0x_scFc_(K6P)_translation Fv#2 | VL7\|7a/JL3b | QTVVTQE-PSLTVSPGGTVTLTC | 5175 |
| MA_79-E3_CC_x_I2C0x_scFc_(E2Y)_translation Fv#2 | VL7\|7a/JL3b | QTVVTQE-PSLTVSPGGTVTLTC | 5176 |
| MA_79-E3x_I2C0x_scFc_(N4F)_translation Fv#2 | VL7\|7a/JL3b | QTVVTQE-PSLTVSPGGTVTLTC | 5177 |
| MA_83-F3_CCx_I2C0x_scFc_(G5K)_translation Fv#2 | VL7\|7a/JL3b | QTVVTQE-PSLTVSPGGTVTLTC | 5178 |
| MA_83-F3x_I2C0x_scFc_(B9A)_translation Fv#2 | VL7\|7a/JL3b | QTVVTQE-PSLTVSPGGTVTLTC | 5179 |
| MA_84-G10_CC_x_I2C0x_scFc_(H9O) translation Fv#2 | VL7\|7a/JL3b | QTVVTQE-PSLTVSPGGTVTLTC | 5180 |
| MA_84-G10x_I2C0x_scFc_(Y4W)_translation Fv#2 | VL7\|7a/JL3b | QTVVTQE-PSLTVSPGGTVTLTC | 5181 |
| | | L_CDR1 | |
| VL7\|7a/JL3b | | ASST-GAVTSG----YYPN | 5280 |
| MA_12-E12_CC_x_I2C0x_scFc_(E9U) translation Fv#2 | VL7\|7a/JL3b | GSST-GAVTSG----NYPN | 5281 |
| MA_12-E12x_I2C0x_scFC_(W1U)_translation Fv#2 | VL7\|7a/JL3b | GSST-GAVTSG----NYPN | 5282 |
| MA_13-D8_CCx_I2C0x_scFc_(U7V)_translation Fv#2 | VL7\|7a/JL3b | GSST-GAVTSG----NYPN | 5283 |
| MA_13-D8x_I2C0x_scFc_(M7M)_translation Fv#2 | VL7\|7a/JL3b | GSST-GAVTSG----NYPN | 5284 |
| MA_24-C9_CCx_I2C0x_scFc_(I2U)_translation Fv#2 | VL7\|7a/JL3b | GSST-GAVTSG----NYPN | 5285 |
| MA_24-C9x_I2C0x_scFc_(L9Y)_translation Fv#2 | VL7\|7a/JL3b | GSST-GAVTSG----NYPN | 5286 |

TABLE 52-continued

BiTE-scFc Variable Region Protein Alignment_(MAGEB2)
CDRs defined by Kabat
Alignment numbering defined by Amgen Reference_(AHo)

| Name | Chain | Sequence | SEQ ID |
|---|---|---|---|
| MA_24-G6_CCx_I2C0x_scFc_(B1I)_translation Fv#2 | VL7\|7a/JL3b | GSST-GAVTSG----NYPN | 5287 |
| MA_24-G6x_I2C0x_scFc_(F1M)_translation Fv#2 | VL7\|7a/JL3b | GSST-GAVTSG----NYPN | 5288 |
| MA_31-H8_CCx_I2C0x_scFc_(K4E)_translation Fv#2 | VL7\|7a/JL3b | GSST-GAVTSG----NYPN | 5289 |
| MA_31-H8x_I2C0x_scFc_(F9Z)_translation Fv#2 | VL7\|7a/JL3b | GSST-GAVTSG----NYPN | 5290 |
| MA_32-A8_CCx_I2C0x_scFc_(A9E)_translation Fv#2 | VL7\|7a/JL3b | GSST-GAVTSG----NYPN | 5291 |
| MA_32-A8_x_I2C0x_scFc_(G6J)_translation Fv#2 | VL7\|7a/JL3b | GSST-GAVTSG----NYPN | 5292 |
| MA_48-D12_CCx_I2C0x_scFc_(M9T)_translation Fv#2 | VL7\|7a/JL3b | GSST-GAVTSG----NYPN | 5293 |
| MA_48-D12x_I2C0x_scFc_(R9D)_translation Fv#2 | VL7\|7a/JL3b | GSST-GAVTSG----NYPN | 5294 |
| MA_50-D9_CCx_I2C0x_scFc_(K6S)_translation Fv#2 | VL7\|7a/JL3b | GSST-GAVTSG----NYPN | 5295 |
| MA_50-D9x_I2C0x_scFc_(A4U)_translation Fv#2 | VL7\|7a/JL3b | GSST-GAVTSG----NYPN | 5296 |
| MA_78-A6_CCx_I2C0x_scFc_(D8Z)_translation Fv#2 | VL7\|7a/JL3b | GSST-GAVTSG----NYPN | 5297 |
| MA_78-A6x_I2C0x_scFc_(K6P)_translation Fv#2 | VL7\|7a/JL3b | GSST-GAVTSG----NYPN | 5298 |
| MA_79-E3_CC_x_I2C0x_scFc_(E2Y)_translation Fv#2 | VL7\|7a/JL3b | GSST-GAVTSG----NYPN | 5299 |
| MA_79-E3x_I2C0x_scFc_(N4F)_translation Fv#2 | VL7\|7a/JL3b | GSST-GAVTSG----NYPN | 5300 |
| MA_83-F3_CCx_I2C0x_scFc_(G5K)_translation Fv#2 | VL7\|7a/JL3b | GSST-GAVTSG----NYPN | 5301 |
| MA_83-F3x_I2C0x_scFc_(B9A)_translation Fv#2 | VL7\|7a/JL3b | GSST-GAVTSG----NYPN | 5302 |
| MA_84-G10_CC_x_I2C0x_scFc_(H9O)_translation Fv#2 | VL7\|7a/JL3b | GSST-GAVTSG----NYPN | 5303 |
| MA_84-G10x_I2C0x_scFc_(Y4W)_translation Fv#2 | VL7\|7a/JL3b | GSST-GAVTSG----NYPN | 5304 |

TABLE 52-continued

BiTE-scFc Variable Region Protein Alignment_(MAGEB2)
CDRs defined by Kabat
Alignment numbering defined by Amgen Reference_(AHo)

| | | L_FR2 | |
|---|---|---|---|
| VL7\|7a/JL3b | | WFQQKPGQAPRALIY | 5403 |
| MA_12-E12_CC_x_I2C0x_scFc_(E9U)_translation Fv#2 | VL7\|7a/JL3b | WVQQKPGQAPRGLIG | 5404 |
| MA_12-E12x_I2C0x_scFC_(W1U)_translation Fv#2 | VL7\|7a/JL3b | WVQQKPGQAPRGLIG | 5405 |
| MA_13-D8_CCx_I2C0x_scFc_(U7V)_translation Fv#2 | VL7\|7a/JL3b | WVQQKPGQAPRGLIG | 5406 |
| MA_13-D8x_I2C0x_scFc_(M7M)_translation Fv#2 | VL7\|7a/JL3b | WVQQKPGQAPRGLIG | 5407 |
| MA_24-C9_CCx_I2C0x_scFc_(I2U)_translation Fv#2 | VL7\|7a/JL3b | WVQQKPGQAPRGLIG | 5408 |
| MA_24-C9x_I2C0x_scFc_(L9Y)_translation Fv#2 | VL7\|7a/JL3b | WVQQKPGQAPRGLIG | 5409 |
| MA_24-G6_CCx_I2C0x_scFc_(B1I)_translation Fv#2 | VL7\|7a/JL3b | WVQQKPGQAPRGLIG | 5410 |
| MA_24-G6x_I2C0x_scFc_(F1M)_translation Fv#2 | VL7\|7a/JL3b | WVQQKPGQAPRGLIG | 5411 |
| MA_31-H8_CCx_I2C0x_scFc_(K4E)_translation Fv#2 | VL7\|7a/JL3b | WVQQKPGQAPRGLIG | 5412 |
| MA_31-H8x_I2C0x_scFc_(F9Z)_translation Fv#2 | VL7\|7a/JL3b | WVQQKPGQAPRGLIG | 5413 |
| MA_32-A8_CCx_I2C0x_scFc_(A9E)_translation Fv#2 | VL7\|7a/JL3b | WVQQKPGQAPRGLIG | 5414 |
| MA_32-A8_x_I2C0x_scFc_(G6J)_translation Fv#2 | VL7\|7a/JL3b | WVQQKPGQAPRGLIG | 5415 |
| MA_48-D12_CCx_I2C0x_scFc_(M9T)_translation Fv#2 | VL7\|7a/JL3b | WVQQKPGQAPRGLIG | 5416 |
| MA_48-D12x_I2C0x_scFc_(R9D)_translation Fv#2 | VL7\|7a/JL3b | WVQQKPGQAPRGLIG | 5417 |
| MA_50-D9_CCx_I2C0x_scFc_(K6S)_translation Fv#2 | VL7\|7a/JL3b | WVQQKPGQAPRGLIG | 5418 |
| MA_50-D9x_I2C0x_scFc_(A4U)_translation Fv#2 | VL7\|7a/JL3b | WVQQKPGQAPRGLIG | 5419 |
| MA_78-A6_CCx_I2C0x_scFc_(D8Z)_translation Fv#2 | VL7\|7a/JL3b | WVQQKPGQAPRGLIG | 5420 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_78-A6x_I2C0x_scFc_(K6P)_translation Fv#2 | VL7\|7a/JL3b | WVQQKPGQAPRGLIG | 5421 |
| MA_79-E3_CC_x_I2C0x_scFc_(E2Y)_translation Fv#2 | VL7\|7a/JL3b | WVQQKPGQAPRGLIG | 5422 |
| MA_79-E3x_I2C0x_scFc_(N4F)_translation Fv#2 | VL7\|7a/JL3b | WVQQKPGQAPRGLIG | 5423 |
| MA_83-F3_CCx_I2C0x_scFc_(G5K)_translation Fv#2 | VL7\|7a/JL3b | WVQQKPGQAPRGLIG | 5424 |
| MA_83-F3x_I2C0x_scFc_(B9A)_translation Fv#2 | VL7\|7a/JL3b | WVQQKPGQAPRGLIG | 5425 |
| MA_84-G10_CC_x_I2C0x_scFc_(H9O) translation Fv#2 | VL7\|7a/JL3b | WVQQKPGQAPRGLIG | 5426 |
| MA_84-G10x_I2C0x_scFc_(Y4W)_translation Fv#2 | VL7\|7a/JL3b | WVQQKPGQAPRGLIG | 5427 |

| HEAVY VARIABLE | | | |
|---|---|---|---|
| | Germline | | SEQ ID NO: |
| | | H_FR1 | |
| VH3\|3-21/D2\|2-15\|RF3/JH1 | | EVQLVES-GGGLVKPGGSLRLSCAASG-FTFS | 5182 |
| MA_12-E12_CC_x_I2C0x_scFC_(E9U)_translation Fv#1 | VH3\|3-21/D2\|2-15\|RF3/JH1 | EVQLVES-GGGLVKPGGSLRLSCAASG-FTES | 5183 |
| MA_12-E12x_I2C0x_scFC_(W1U)_translation Fv#1 | VH3\|3-21/D2\|2-15\|RF3/JH1 | EVQLVES-GGGLVKPGGSLRLSCAASG-FTFS | 5184 |
| VH3\|3-73/D3\|3-3\|RF3/JH4 | | EVQLVES-GGGLVQPGGSLKLSCAASG-FTES | 5185 |
| MA_12-E12_CC_x_I2C0x_scFc_(E9U)_translation Fv#2 | VH3\|3-73/D3\|3-3\|RF3/JH4 | EVQLVES-GGGLVQPGGSLKLSCAASG-FTEN | 5186 |
| MA_12-E12x_I2C0x_scFC_(W1U)_translation Fv#2 | VH3\|3-73/D3\|3-3\|RF3/JH4 | EVQLVES-GGGLVQPGGSLKLSCAASG-FTEN | 5187 |
| MA_13-D8_CCx_I2C0x_scFc_(U7V)_translation Fv#2 | VH3\|3-73/D3\|3-3\|RF3/JH4 | EVQLVES-GGGLVQPGGSLKLSCAASG-FTEN | 5188 |
| MA_13-D8x_I2C0x_scFc_(M7M)_translation Fv#2 | VH3\|3-73/D3\|3-3\|RF3/JH4 | EVQLVES-GGGLVQPGGSLKLSCAASG-FTEN | 5189 |
| MA_24-C9_CCx_I2C0x_scFc_(I2U)_translation Fv#2 | VH3\|3-73/D3\|3-3\|RF3/JH4 | EVQLVES-GGGLVQPGGSLKLSCAASG-FTEN | 5190 |
| MA_24-C9x_I2C0x_scFc_(L9Y)_translation Fv#2 | VH3\|3-73/D3\|3-3\|RF3/JH4 | EVQLVES-GGGLVQPGGSLKLSCAASG-FTEN | 5191 |
| MA_24-G6_CCx_I2C0x_scFc_(B1I)_translation Fv#2 | VH3\|3-73/D3\|3-3\|RF3/JH4 | EVQLVES-GGGLVQPGGSLKLSCAASG FTEN | 5192 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_24-G6x_I2C0x_scFc_(F1M)_translation Fv#2 | VH3\|3-73/D3\|3-3\|RF3/JH4 | EVQLVES-GGGLVQPGGSLKLSCAASG-FTEN | 5193 |
| MA_31-H8_CCx_I2C0x_scFc_(K4E)_translation Fv#2 | VH3\|3-73/D3\|3-3\|RF3/JH4 | EVQLVES-GGGLVQPGGSLKLSCAASG-FTEN | 5194 |
| MA_31-H8x_I2C0x_scFc_(F9Z)_translation Fv#2 | VH3\|3-73/D3\|3-3\|RF3/JH4 | EVQLVES-GGGLVQPGGSLKLSCAASG-FTEN | 5195 |
| MA_32-A8_CCx_I2C0x_scFc_(A9E)_translation Fv#2 | VH3\|3-73/D3\|3-3\|RF3/JH4 | EVQLVES-GGGLVQPGGSLKLSCAASG-FTEN | 5196 |
| MA_32-A8_x_I2C0x_scFc_(G6J)_translation Fv#2 | VH3\|3-73/D3\|3-3\|RF3/JH4 | EVQLVES-GGGLVQPGGSLKLSCAASG-FTEN | 5197 |
| MA_48-D12_CCx_I2C0x_scFc_(M9T)_translation Fv#2 | VH3\|3-73/D3\|3-3\|RF3/JH4 | EVQLVES-GGGLVQPGGSLKLSCAASG-FTEN | 5198 |
| MA_48-D12x_I2C0x_scFc_(R9D)_translation Fv#2 | VH3\|3-73/D3\|3-3\|RF3/JH4 | EVQLVES-GGGLVQPGGSLKLSCAASG-FTEN | 5199 |
| MA_50-D9_CCx_I2C0x_scFc_(K6S)_translation Fv#2 | VH3\|3-73/D3\|3-3\|RF3/JH4 | EVQLVES-GGGLVQPGGSLKLSCAASG-FTEN | 5200 |
| MA_50-D9x_I2C0x_scFc_(A4U)_translation Fv#2 | VH3\|3-73/D3\|3-3\|RF3/JH4 | EVQLVES-GGGLVQPGGSLKLSCAASG-FTEN | 5201 |
| MA_78-A6_CCx_I2C0x_scFc_(D8Z)_translation Fv#2 | VH3\|3-73/D3\|3-3\|RF3/JH4 | EVQLVES-GGGLVQPGGSLKLSCAASG-FTFN | 5202 |
| MA_78-A6x_I2C0x_scFc_(K6P)_translation Fv#2 | VH3\|3-73/D3\|3-3\|RF3/JH4 | EVQLVES-GGGLVQPGGSLKLSCAASG-FTEN | 5203 |
| MA_79-E3_CC_x_I2C0x_scFc_(E2Y)_translation Fv#2 | VH3\|3-73/D3\|3-3\|RF3/JH4 | EVQLVES-GGGLVQPGGSLKLSCAASG-FTEN | 5204 |
| MA_79-E3x_I2C0x_scFc_(N4F)_translation Fv#2 | VH3\|3-73/D3\|3-3\|RF3/JH4 | EVQLVES-GGGLVQPGGSLKLSCAASG FTEN | 5205 |
| MA_83-F3_CCx_I2C0x_scFc_(G5K)_translation Fv#2 | VH3\|3-73/D3\|3-3\|RF3/JH4 | EVQLVES-GGGLVQPGGSLKLSCAASG-FTEN | 5206 |
| MA_83-F3x_I2C0x_scFc_(B9A)_translation Fv#2 | VH3\|3-73/D3\|3-3\|RF3/JH4 | EVQLVES-GGGLVQPGGSLKLSCAASG-FTEN | 5207 |
| MA_84-G10_CC_x_I2C0x_scFc_(H9O)_translation Fv#2 | VH3\|3-73/D3\|3-3\|RF3/JH4 | EVQLVES-GGGLVQPGGSLKLSCAASG-FTEN | 5208 |
| MA_84-G10x_I2C0x_scFc_(Y4W)_translation Fv#2 | VH3\|3-73/D3\|3-3\|RF3/JH4 | EVQLVES-GGGLVQPGGSLKLSCAASG-FTEN | 5209 |
| VH3\|3-23/D1\|1-1\|RF1/JH6 | | EVQLLES-GGGLVQPGGSLRLSCAASG-FTFS | 5210 |
| MA_13-D8_CCx_I2C0x_scFc_(U7V)_translation Fv#1 | VH3\|3-23/D1\|1-1\|RF1/JH6 | EVQLLES-GGGLVQPGGSLRLSCAASG-FTES | 5211 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_13-<br>D8x_I2C0x_scFc_(M7M)_<br>translation Fv#1 | VH3\|3-23/D1\|1-<br>1\|RF1/JH6 | EVQLLES-GGGLVQPGGSLRLSCAASG-<br>FTFS | 5212 |
| MA_79-<br>E3_CC_x_I2C0x_scFc_(E2Y)_<br>translation Fv#1 | VH3\|3-23/D1\|1-<br>1\|RF1/JH6 | EVQLLES-GGGLVQPGGSLRLSCAASG-<br>FTES | 5213 |
| MA_79-<br>E3x_I2C0x_scFc_(N4F)_<br>translation Fv#1 | VH3\|3-23/D1\|1-<br>1\|RF1/JH6 | EVQLLES-GGGLVQPGGSLRLSCAASG-<br>FTES | 5214 |
| VH1\|1-e/D2\|2-15\|RF3/JH4 | | QVQLVQS-GAEVKKPGSSVKVSCKASG-<br>GTES | 5215 |
| MA_24-<br>C9_CCx_I2C0x_scFc_(I2U)_<br>translation Fv#1 | VH1\|1-e/D2\|2-<br>15\|RF3/JH4 | VQLLEQS-GPELVKPGASVKISCKASG-<br>YAFS | 5216 |
| MA_24-<br>C9x_I2C0x_scFc_(L9Y)_<br>translation Fv#1 | VH1\|1-e/D2\|2-<br>15\|RF3/JH4 | VQLLEQS-GPELVKPGASVKISCKASG-<br>YAFS | 5217 |
| VH1\|1-e/D5\|5-18\|RF3/JH4 | | QVQLVQS-GAEVKKPGSSVKVSCKASG<br>GTES | 5218 |
| MA_24-<br>G6_CCx_I2C0x_scFc_(B1I)_<br>translation Fv#1 | VH1\|1-e/D5\|5-<br>18\|RF3/JH4 | VQLLEQS-GPELVKPGASVKISCKASD-<br>YTFS | 5219 |
| MA_24-<br>G6x_I2C0x_scFc_(F1M)_<br>translation Fv#1 | VH1\|1-e/D5\|5-<br>18\|RF3/JH4 | VQLLEQS-GPELVKPGASVKISCKASD-<br>YTFS | 5220 |
| VH1\|1-e/D1\|1-1\|RF2/JH3 | | QVQLVQS-GAEVKKPGSSVKVSCKASG-<br>GTES | 5221 |
| MA_31-<br>H8_CCx_I2C0x_scFc_(K4E)_<br>translation Fv#1 | VH1\|1-e/D1\|1-<br>1\|RF2/JH3 | VQLLEQS-GPELVKPGASVKISCKASG-<br>YAFS | 5222 |
| MA_31-<br>H8x_I2C0x_scFc_(F9Z)_<br>translation Fv#1 | VH1\|1-e/D1\|1-<br>1\|RF2/JH3 | VQLLEQS-GPELVKPGASVKISCKASG-<br>YAFS | 5223 |
| VH1\|1-08/D5\|5-18\|RF3/JH6 | | QVQLVQS-GAEVKKPGASVKVSCKASG-<br>YTFT | 5224 |
| MA_32-<br>A8_CCx_I2C0x_scFc_(A9E)_<br>translation Fv#1 | VH1\|1-08/D5\|5-<br>18\|RF3/JH6 | QVQLVQS-GAEVKKPGASVKVSCKASG-<br>YTFT | 5225 |
| MA_32-<br>A8_x_I2C0x_scFc_(G6J)_<br>translation Fv#1 | VH1\|1-08/D5\|5-<br>18\|RF3/JH6 | QVQLVQS-GAEVKKPGASVKVSCKASG-<br>YTFT | 5226 |
| VH3\|3-30.3/D1\|1-1\|RF2/JH6 | | QVQLVES-GGGVVQPGRSLRLSCAASG-<br>FTES | 5227 |
| MA_48-<br>D12_CCx_I2C0x_scFc_(M9T)_<br>translation Fv#1 | VH3\|3-30.3/D1\|1-<br>1\|RF2/JH6 | QVQLVES-GGGVVQPGRSLRLSCAASG-<br>FTFR | 5228 |
| MA_48-<br>D12x_I2C0x_scFc_(R9D)_<br>translation Fv#1 | VH3\|3-30.3/D1\|1-<br>1\|RF2/JH6 | QVQLVES-GGGVVQPGRSLRLSCAASG<br>FTER | 5229 |
| VH6\|6-01/D3\|3-10\|RF1/JH6 | | QVQLQQS-GPGLVKPSQTLSLTCAISG-<br>DSVS | 5230 |
| MA_50-<br>D9_CCx_I2C0x_scFc_(K6S)_<br>translation Fv#1 | VH6\|6-01/D3\|3-<br>10\|RF1/JH6 | QVQLQQS-GPGLVKPSQTLSLTCAISG-<br>DSVS | 5231 |

TABLE 52-continued

BiTE-scFc Variable Region Protein Alignment_(MAGEB2)
CDRs defined by Kabat
Alignment numbering defined by Amgen Reference_(AHo)

| Name | V/D/J | Sequence | SEQ ID |
|---|---|---|---|
| MA_50-D9x_I2C0x_scFc_(A4U)_translation Fv#1 | VH6\|6-01/D3\|3-10\|RF1/JH6 | QVQLQQS-GPGLVKPSQTLSLTCAISG-DSVS | 5232 |
| VH4\|4-34/D5\|5-18\|RF3/JH6 | | QVQLQQW-GAGLLKPSETLSLTCAVYG-GSFS | 5233 |
| MA_78-A6_CCx_I2C0x_scFc_(D8Z)_translation Fv#1 | VH4\|4-34/D5\|5-18\|RF3/JH6 | QVQLQQW-GAGLLKPSETLSLTCAVYG GSFS | 5234 |
| MA_78-A6x_I2C0x_scFc_(K6P)_translation Fv#1 | VH4\|4-34/D5\|5-18\|RF3/JH6 | QVQLQQW-GAGLLKPSETLSLTCAVYG GSFS | 5235 |
| VH1\|1-02/D7\|7-27\|RF2/JH4 | | QVQLVQS-GAEVKKPGASVKVSCKASG-YTFT | 5236 |
| MA_83-F3_CCx_I2C0x_scFc_(G5K)_translation Fv#1 | VH1\|1-02/D7\|7-27\|RF2/JH4 | QVQLVQS-GAEVKKPGASVKVSCKASG-YSFT | 5237 |
| MA_83-F3x_I2C0x_scFc_(B9A)_translation Fv#1 | VH1\|1-02/D7\|7-27\|RF2/JH4 | QVQLVQS-GAEVKKPGASVKVSCKASG YSFT | 5238 |
| VH4\|4-30.1/D3\|3-10\|RF1/JH6 | | QVQLQES-GPGLVKPSQTLSLTCTVSG-GSIS | 5239 |
| MA_84-G10_CC_x_I2C0x_scFc_(H9O)_translation Fv#1 | VH4\|4-30.1/D3\|3-10\|RF1/JH6 | QVQLQES-GPGLVKPSQTLSLTCTVSG-DSIS | 5240 |
| MA_84-G10x_I2C0x_scFc_(Y4W)_translation Fv#1 | VH4\|4-30.1/D3\|3-10\|RF1/JH6 | QVQLQES-GPGLVKPSQTLSLTCTVSG-DSIS | 5241 |
| | | H_CDR1 | |
| VH3\|3-21/D2\|2-15\|RF3/JH1 | | S-----YSMN | 5305 |
| MA_12-E12_CC_x_I2C0x_scFc_(E9U)_translation Fv#1 | VH3\|3-21/D2\|2-15\|RF3/JH1 | T-----YSMN | 5306 |
| MA_12-E12x_I2C0x_scFC_(W1U)_translation Fv#1 | VH3\|3-21/D2\|2-15\|RF3/JH1 | T-----YSMN | 5307 |
| VH3\|3-73/D3\|3-3\|RF3/JH4 | | G-----SAMH | 5308 |
| MA_12-E12_CC_x_I2C0x_scFc_(E9U)_translation Fv#2 | VH3\|3-73/D3\|3-3\|RF3/JH4 | K-----YAMN | 5309 |
| MA_12-E12x_I2C0x_scFc_(W1U)_translation Fv#2 | VH3\|3-73/D3\|3-3\|RF3/JH4 | K-----YAMH | 5310 |
| MA_13-D8_CCx_I2C0x_scFc_(U7V)_translation Fv#2 | VH3\|3-73/D3\|3-3\|RF3/JH4 | K-----YAMN | 5311 |
| MA_13-D8x_I2C0x_scFc_(M7M)_translation Fv#2 | VH3\|3-73/D3\|3-3\|RF3/JH4 | K-----YAMN | 5312 |
| MA_24-C9_CCx_I2C0x_scFc_(I2U)_translation Fv#2 | VH3\|3-73/D3\|3-3\|RF3/JH4 | K-----YAMN | 5313 |
| MA_24-C9x_I2C0x_scFc_(L9Y)_translation Fv#2 | VH3\|3-73/D3\|3-3\|RF3/JH4 | K-----YAMN | 5314 |

TABLE 52-continued

BiTE-scFc Variable Region Protein Alignment_(MAGEB2)
CDRs defined by Kabat
Alignment numbering defined by Amgen Reference_(AHo)

| Name | V/D/J | CDR | SEQ ID |
|---|---|---|---|
| MA_24-G6_CCx_I2C0x_scFc_(B1I)_ translation Fv#2 | VH3\|3-73/D3\|3-3\|RF3/JH4 | K-----YAMN | 5314 |
| MA_24-G6x_I2C0x_scFc_(F1M)_ translation Fv#2 | VH3\|3-73/D3\|3-3\|RF3/JH4 | K-----YAMN | 5315 |
| MA_31-H8_CCx_I2C0x_scFc_(K4E)_ translation Fv#2 | VH3\|3-73/D3\|3-3\|RF3/JH4 | K-----YAMN | 5316 |
| MA_31-H8x_I2C0x_scFc_(F9Z)_ translation Fv#2 | VH3\|3-73/D3\|3-3\|RF3/JH4 | K-----YAMN | 5317 |
| MA_32-A8_CCx_I2C0x_scFc_(A9E)_ translation Fv#2 | VH3\|3-73/D3\|3-3\|RF3/JH4 | K-----YAMN | 5318 |
| MA_32-A8_x_I2C0x_scFc_(G6J)_ translation Fv#2 | VH3\|3-73/D3\|3-3\|RF3/JH4 | K-----YAMN | 5319 |
| MA_48-D12_CCx_I2C0x_scFc_(M9T)_ translation Fv#2 | VH3\|3-73/D3\|3-3\|RF3/JH4 | K-----YAMN | 5320 |
| MA_48-D12x_I2C0x_scFc_(R9D)_ translation Fv#2 | VH3\|3-73/D3\|3-3\|RF3/JH4 | K-----YAMN | 5321 |
| MA_50-D9_CCx_I2C0x_scFc_(K6S)_ translation Fv#2 | VH3\|3-73/D3\|3-3\|RF3/JH4 | K-----YAMN | 5322 |
| MA_50-D9x_I2C0x_scFc_(A4U)_ translation Fv#2 | VH3\|3-73/D3\|3-3\|RF3/JH4 | K-----YAMN | 5323 |
| MA_78-A6_CCx_I2C0x_scFc_(D8Z)_ translation Fv#2 | VH3\|3-73/D3\|3-3\|RF3/JH4 | K-----YAMN | 5324 |
| MA_78-A6x_I2C0x_scFc_(K6P)_ translation Fv#2 | VH3\|3-73/D3\|3-3\|RF3/JH4 | K-----YAMN | 5325 |
| MA_79-E3_CC_x_I2C0x_scFc_(E2Y)_ translation Fv#2 | VH3\|3-73/D3\|3-3\|RF3/JH4 | K-----YAMN | 5326 |
| MA_79-E3x_I2C0x_scFc_(N4F)_ translation Fv#2 | VH3\|3-73/D3\|3-3\|RF3/JH4 | K-----YAMN | 5327 |
| MA_83-F3_CCx_I2C0x_scFc_(G5K)_ translation Fv#2 | VH3\|3-73/D3\|3-3\|RF3/JH4 | K-----YAMN | 5328 |
| MA_83-F3x_I2C0x_scFc_(B9A)_ translation Fv#2 | VH3\|3-73/D3\|3-3\|RF3/JH4 | K-----YAMN | 5329 |
| MA_84-G10_CC_x_I2C0x_scFc_(H9O)_ translation Fv#2 | VH3\|3-73/D3\|3-3\|RF3/JH4 | K-----YAMN | 5330 |
| MA_84-G10x_I2C0x_scFc_(Y4W)_ translation Fv#2 | VH3\|3-73/D3\|3-3\|RF3/JH4 | K-----YAMN | 5331 |
| VH3\|3-23/D1\|1-1\|RF1/JH6 | | K-----YAMN | 5332 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_13-D8_CCx_I2C0x_scFc_(U7V)_translation Fv#1 | VH3\|3-23/D1\|1-1\|RF1/JH6 | S-----YAMS | 5333 |
| MA_13-D8x_I2C0x_scFc_(M7M)_translation Fv#1 | VH3\|3-23/D1\|1-1\|RF1/JH6 | S-----FAMS | 5334 |
| MA_79-E3_CC_x_I2C0x_scFc_(E2Y)_translation Fv#1 | VH3\|3-23/D1\|1-1\|RF1/JH6 | S-----FAMS | 5335 |
| MA_79-E3x_I2C0x_scFc_(N4F)_translation Fv#1 | VH3\|3-23/D1\|1-1\|RF1/JH6 | S-----FAMS | 5336 |
| VH1\|1-e/D2\|2-15\|RF3/JH4 | | S-----FAMS | 5337 |
| MA_24-C9_CCx_I2C0x_scFc_(I2U)_translation Fv#1 | VH1\|1-e/D2\|2-15\|RF3/JH4 | S-----YAIS | 5338 |
| MA_24-C9x_I2C0x_scFc_(L9Y)_translation Fv#1 | VH1\|1-e/D2\|2-15\|RF3/JH4 | K-----SWMN | 5339 |
| VH1\|1-e/D5\|5-18\|RF3/JH4 | | K-----SWMN | 5340 |
| MA_24-G6_CCx_I2C0x_scFc_(B1I)_translation Fv#1 | VH1\|1-e/D5\|5-18\|RF3/JH4 | S-----YAIS K-----SWMN | 5341 5342 |
| MA_24-G6x_I2C0x_scFc_(F1M)_translation Fv#1 | VH1\|1-e/D5\|5-18\|RF3/JH4 | K-----SWMN | 5343 |
| VH1\|1-e/D1\|1-1\|RF2/JH3 | | S-----YAIS | 5344 |
| MA_31-H8_CCx_I2C0x_scFc_(K4E)_translation Fv#1 | VH1\|1-e/D1\|1-1\|RF2/JH3 | S-----SWMN | 5345 |
| MA_31-H8x_I2C0x_scFc_(F9Z)_translation Fv#1 | VH1\|1-e/D1\|1-1\|RF2/JH3 | S-----SWMN | 5346 |
| VH1\|1-08/D5\|5-18\|RF3/JH6 | | S-----YDIN | 5347 |
| MA_32-A8_CCx_I2C0x_scFc_(A9E)_translation Fv#1 | VH1\|1-08/D5\|5-18\|RF3/JH6 | S-----YDIN | 5348 |
| MA_32-A8_x_I2C0x_scFc_(G6J)_translation Fv#1 | VH1\|1-08/D5\|5-18\|RF3/JH6 | S-----YDIN | 5349 |
| VH3\|3-30.3/D1\|1-1\|RF2/JH6 | | S-----YAMH | 5350 |
| MA_48-D12_CCx_I2C0x_scFc_(M9T)_translation Fv#1 | VH3\|3-30.3/D1\|1-1\|RF2/JH6 | S-----YRMH | 5351 |
| MA_48-D12x_I2C0x_scFc_(R9D)_translation Fv#1 | VH3\|3-30.3/D1\|1-1\|RF2/JH6 | S-----YRMH | 5352 |
| VH6\|6-01/D3\|3-10\|RF1/JH6 | | SN---SAAWN | 5353 |
| MA_50-D9_CCx_I2C0x_scFc_(K6S)_translation Fv#1 | VH6\|6-01/D3\|3-10\|RF1/JH6 | SN---SAAWN | 5354 |
| MA_50-D9x_I2C0x_scFc_(A4U)_translation Fv#1 | VH6\|6-01/D3\|3-10\|RF1/JH6 | SN---SAAWN | 5355 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VH4\|4-34/D5\|5-18\|RF3/JH6 | | G-----YYWS | 5356 |
| MA_78-A6_CCx_I2C0x_scFc_(D8Z)_ translation Fv#1 | VH4\|4-34/D5\|5-18\|RF3/JH6 | G-----YYWN | 5357 |
| MA_78-A6x_I2C0x_scFc_(K6P)_ translation Fv#1 | VH4\|4-34/D5\|5-18\|RF3/JH6 | G-----YYWN | 5358 |
| VH1\|1-02/D7\|7-27\|RF2/JH4 | | G-----YYMH | 5359 |
| MA_83-F3_CCx_I2C0x_scFc_(G5K)_ translation Fv#1 | VH1\|1-02/D7\|7-27\|RF2/JH4 | G-----YYMH | 5360 |
| MA_83-F3x_I2C0x_scFc_(B9A)_ translation Fv#1 | VH1\|1-02/D7\|7-27\|RF2/JH4 | G-----YYMH | 5361 |
| VH4\|4-30.1/D3\|3-10\|RF1/JH6 | | SG---GYYWS | 5362 |
| MA_84-G10_CC_x_I2C0x_scFc_(H9O)_ translation Fv#1 | VH4\|4-30.1/D3\|3-10\|RF1/JH6 | RD---PYYWS | 5363 |
| MA_84-G10x_I2C0x_scFc_(Y4W)_ translation Fv#1 | VH4\|4-30.1/D3\|3-10\|RF1/JH6 | RD---PYYWS | 5364 |
| | | H_FR2 | |
| VH3\|3-21/D2\|2-15\|RF3/JH1 | | WVRQAPGKGLEWVS | 5428 |
| MA_12-E12_CC_x_I2C0x_scFc_(E9U)_ translation Fv#1 | VH3\|3-21/D2\|2-15\|RF3/JH1 | WVRQAPGKCLEWVS | 5429 |
| MA_12-E12x_I2C0x_scFC_(W1U)_ translation Fv#1 | VH3\|3-21/D2\|2-15\|RF3/JH1 | WVRQAPGKGLEWVS | 5430 |
| VH3\|3-73/D3\|3-3\|RF3/JH4 | | WVRQASGKGLEWVG | 5431 |
| MA_12-E12_CC_x_I2C0x_scFc_(E9U)_ translation Fv#2 | VH3\|3-73/D3\|3-3\|RF3/JH4 | WVRQAPGKGLEWVA | 5432 |
| MA_12-E12x_I2C0x_scFC_(W1U)_ translation Fv#2 | VH3\|3-73/D3\|3-3\|RF3/JH4 | WVRQAPGKGLEWVA | 5433 |
| MA_13-D8_CCx_I2C0x_scFc_(U7V)_ translation Fv#2 | VH3\|3-73/D3\|3-3\|RF3/JH4 | WVRQAPGKGLEWVA | 5434 |
| MA_13-D8x_I2C0x_scFc_(M7M)_ translation Fv#2 | VH3\|3-73/D3\|3-3\|RF3/JH4 | WVRQAPGKGLEWVA | 5435 |
| MA_24-C9_CCx_I2C0x_scFc_(I2U)_ translation Fv#2 | VH3\|3-73/D3\|3-3\|RF3/JH4 | WVRQAPGKGLEWVA | 5436 |
| MA_24-C9x_I2C0x_scFc_(L9Y)_ translation Fv#2 | VH3\|3-73/D3\|3-3\|RF3/JH4 | WVRQAPGKGLEWVA | 5437 |
| MA_24-G6_CCx_I2C0x_scFc_(B1I)_ translation Fv#2 | VH3\|3-73/D3\|3-3\|RF3/JH4 | WVRQAPGKGLEWVA | 5438 |
| MA_24-G6x_I2C0x_scFc_(F1M)_ translation Fv#2 | VH3\|3-73/D3\|3-3\|RF3/JH4 | WVRQAPGKGLEWVA | 5439 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_31-H8_CCx_I2C0x_scFc_(K4E)_translation Fv#2 | VH3\|3-73/D3\|3-3\|RF3/JH4 | WVRQAPGKGLEWVA | 5440 |
| MA_31-H8x_I2C0x_scFc_(F9Z)_translation Fv#2 | VH3\|3-73/D3\|3-3\|RF3/JH4 | WVRQAPGKGLEWVA | 5441 |
| MA_32-A8_CCx_I2C0x_scFc_(A9E)_translation Fv#2 | VH3\|3-73/D3\|3-3\|RF3/JH4 | WVRQAPGKGLEWVA | 5442 |
| MA_32-A8_x_I2C0x_scFc_(G6J)_translation Fv#2 | VH3\|3-73/D3\|3-3\|RF3/JH4 | WVRQAPGKGLEWVA | 5443 |
| MA_48-D12_CCx_I2C0x_scFc_(M9T)_translation Fv#2 | VH3\|3-73/D3\|3-3\|RF3/JH4 | WVRQAPGKGLEWVA | 5444 |
| MA_48-D12x_I2C0x_scFc_(R9D)_translation Fv#2 | VH3\|3-73/D3\|3-3\|RF3/JH4 | WVRQAPGKGLEWVA | 5445 |
| MA_50-D9_CCx_I2C0x_scFc_(K6S)_translation Fv#2 | VH3\|3-73/D3\|3-3\|RF3/JH4 | WVRQAPGKGLEWVA | 5446 |
| MA_50-D9x_I2C0x_scFc_(A4U)_translation Fv#2 | VH3\|3-73/D3\|3-3\|RF3/JH4 | WVRQAPGKGLEWVA | 5447 |
| MA_78-A6_CCx_I2C0x_scFc_(D8Z)_translation Fv#2 | VH3\|3-73/D3\|3-3\|RF3/JH4 | WVRQAPGKGLEWVA | 5448 |
| MA_78-A6x_I2C0x_scFc_(K6P)_translation Fv#2 | VH3\|3-73/D3\|3-3\|RF3/JH4 | WVRQAPGKGLEWVA | 5449 |
| MA_79-E3_CC_x_I2C0x_scFc_(E2Y)_translation Fv#2 | VH3\|3-73/D3\|3-3\|RF3/JH4 | WVRQAPGKGLEWVA | 5450 |
| MA_79-E3x_I2C0x_scFc_(N4F)_translation Fv#2 | VH3\|3-73/D3\|3-3\|RF3/JH4 | WVRQAPGKGLEWVA | 5451 |
| MA_83-F3_CCx_I2C0x_scFc_(G5K)_translation Fv#2 | VH3\|3-73/D3\|3-3\|RF3/JH4 | WVRQAPGKGLEWVA | 5452 |
| MA_83-F3x_I2C0x_scFc_(B9A)_translation Fv#2 | VH3\|3-73/D3\|3-3\|RF3/JH4 | WVRQAPGKGLEWVA | 5453 |
| MA_84-G10_CC_x_I2C0x_scFc_(H9O)_translation Fv#2 | VH3\|3-73/D3\|3-3\|RF3/JH4 | WVRQAPGKGLEWVA | 5454 |
| MA_84-G10x_I2C0x_scFc_(Y4W)_translation Fv#2 | VH3\|3-73/D3\|3-3\|RF3/JH4 | WVRQAPGKGLEWVA | 5455 |
| VH3\|3-23/D1\|1-1\|RF1/JH6 | | WVRQAPGKGLEWVS | 5456 |
| MA_13-D8_CCx_I2C0x_scFc_(U7V)_translation Fv#1 | VH3\|3-23/D1\|1-1\|RF1/JH6 | WVRQAPGKCLEWVS | 5457 |
| MA_13-D8x_I2C0x_scFc_(M7M)_translation Fv#1 | VH3\|3-23/D1\|1-1\|RF1/JH6 | WVRQAPGKGLEWVS | 5458 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_79-E3_CC_x_I2C0x_scFc_(E2Y)_ translation Fv#1 | VH3\|3-23/D1\|1-1\|RF1/JH6 | WVRQAPGKCLEWVS | 5459 |
| MA_79-E3x_I2C0x_scFc_(N4F)_ translation Fv#1 | VH3\|3-23/D1\|1-1\|RF1/JH6 | WVRQAPGKGLEWVS | 5460 |
| VH1\|1-e/D2\|2-15\|RF3/JH4 | | WVRQAPGQGLEWMG | 5461 |
| MA_24-C9_CCx_I2C0x_scFc_(I2U)_ translation Fv#1 | VH1\|1-e/D2\|2-15\|RF3/JH4 | WVKQRPGKCLEWIG | 5462 |
| MA_24-C9x_I2C0x_scFc_(L9Y)_ translation Fv#1 | VH1\|1-e/D2\|2-15\|RF3/JH4 | WVKQRPGKGLEWIG | 5463 |
| VH1\|1-e/D5\|5-18\|RF3/JH4 | | WVRQAPGQGLEWMG | 5464 |
| MA_24-G6_CCx_I2C0x_scFc_(B1I)_ translation Fv#1 | VH1\|1-e/D5\|5-18\|RF3/JH4 | WVKQRPGECLEWIG | 5465 |
| MA_24-G6x_I2C0x_scFc_(F1M)_ translation Fv#1 | VH1\|1-e/D5\|5-18\|RF3/JH4 | WVKQRPGEGLEWIG | 5466 |
| VH1\|1-e/D1\|1-1\|RF2/JH3 | | WVRQAPGQGLEWMG | 5467 |
| MA_31-H8_CCx_I2C0x_scFc_(K4E)_ translation Fv#1 | VH1\|1-e/D1\|1-1\|RF2/JH3 | WVKQRPGKCLEWIG | 5468 |
| MA_31-H8x_I2C0x_scFc_(F9Z)_ translation Fv#1 | VH1\|1-e/D1\|1-1\|RF2/JH3 | WVKQRPGKGLEWIG | 5469 |
| VH1\|1-08/D5\|5-18\|RF3/JH6 | | WVRQATGQGLEWMG | 5470 |
| MA_32-A8_CCx_I2C0x_scFc_(A9E)_ translation Fv#1 | VH1\|1-08/D5\|5-18\|RF3/JH6 | WVRQATGQCLEWMG | 5471 |
| MA_32-A8_x_I2C0x_scFc_(G6J)_ translation Fv#1 | VH1\|1-08/D5\|5-18\|RF3/JH6 | WVRQATGQGLEWMG | 5472 |
| VH3\|3-30.3/D1\|1-1\|RF2/JH6 | | WVRQAPGKGLEWVA | 5473 |
| MA_48-D12_CCx_I2C0x_scFc_(M9T)_ translation Fv#1 | VH3\|3-30.3/D1\|1-1\|RF2/JH6 | WVRQAPGKCLEWVA | 5474 |
| MA_48-D12x_I2C0x_scFc_(R9D)_ translation Fv#1 | VH3\|3-30.3/D1\|1-1\|RF2/JH6 | WVRQAPGKGLEWVA | 5475 |
| VH6\|6-01/D3\|3-10\|RF1/JH6 | | WIRQSPSRGLEWLG | 5476 |
| MA_50-D9_CCx_I2C0x_scFc_(K6S)_ translation Fv#1 | VH6\|6-01/D3\|3-10\|RF1/JH6 | WIRQSPSRCLEWLG | 5477 |
| MA_50-D9x_I2C0x_scFc_(A4U)_ translation Fv#1 | VH6\|6-01/D3\|3-10\|RF1/JH6 | WIRQSPSRGLEWLG | 5478 |
| VH4\|4-34/D5\|5-18\|RF3/JH6 | | WIRQPPGKGLEWIG | 5479 |
| MA_78-A6_CCx_I2C0x_scFc_(D8Z)_ translation Fv#1 | VH4\|4-34/D5\|5-18\|RF3/JH6 | WIRQPPGKCLEWIG | 5480 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_78-A6x_I2C0x_scFc_(K6P)_translation Fv#1 | VH4\|4-34/D5\|5-18\|RF3/JH6 | WIRQPPGKGLEWIG | 5481 |
| VH1\|1-02/D7\|7-27\|RF2/JH4 | | WVRQAPGQGLEWMG | 5482 |
| MA_83-F3_CCx_I2C0x scFc_(G5K)_translation Fv#1 | VH1\|1-02/D7\|7-27\|RF2/JH4 | WVRQAPGQCLEWMG | 5483 |
| MA_83-F3x_I2C0x_scFc_(B9A)_translation Fv#1 | VH1\|1-02/D7\|7-27\|RF2/JH4 | WVRQAPGQGLEWMG | 5484 |
| VH4\|4-30.1/D3\|3-10\|RF1/JH6 | | WIRQHPGKGLEWIG | 5485 |
| MA_84-G10_CC_x_I2C0x_scFc_(H9O)_translation Fv#1 | VH4\|4-30.1/D3\|3-10\|RF1/JH6 | WIRQHPGKCLEWIG | 5486 |
| MA_84-G10x_I2C0x_scFc_(Y4W)_translation Fv#1 | VH4\|4-30.1/D3\|3-10\|RF1/JH6 | WIRQHPGKGLEWIG | 5487 |

| KAPPA VARIABLE | | | |
|---|---|---|---|
| | Germline | | SEQ ID NO: |
| | | K_CDR2 | |
| VK3\|A27/JK4 | | G--------ASSRAT | 5488 |
| MA_12-E12_CC_x_I2C0x_scFc_(E9U) translation Fv#1 | VK3\|A27/JK4 | G--------ASSRAT | 5489 |
| MA_12-E12x_I2C0x_scFC_(W1U)_translation Fv#1 | VK3\|A27/JK4 | G--------ASSRAT | 5490 |
| MA_48-D12x_I2C0x_scFc_(R9D)_translation Fv#1 | VK3\|A27/JK4 | G--------ASSRAT | 5491 |
| VK1\|A20/JK1 | | A--------ASTLQS | 5492 |
| MA_13-D8_CCx_I2C0x_scFc_(U7V)_translation Fv#1 | VK1\|A20/JK1 | A--------ASTLQS | 5493 |
| MA_13-D8x_I2C0x_scFc_(M7M)_translation Fv#1 | VK1\|A20/JK1 | A--------ASTLQS | 5494 |
| VK4\|B3/JK2 | | W--------ASTRES | 5495 |
| MA_24-C9_CCx_I2C0x_scFc_(I2U)_translation Fv#1 | VK4\|B3/JK2 | W--------ASTRES | 5496 |
| MA_24-C9x_I2C0x_scFc_(L9Y)_translation Fv#1 | VK4\|B3/JK2 | W--------ASTRES | 5497 |
| VK6\|A10/JK2 | | Y--------ASQSES | 5498 |
| MA_24-G6_CCx_I2C0x_scFc_(B1I)_translation Fv#1 | VK6\|A10/JK2 | D--------TSKLAP | 5499 |
| MA_24-G6x_I2C0x_scFc_(F1M)_translation Fv#1 | VK6\|A10/JK2 | D--------TSKLAP | 5500 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VK1\|L11/JK2 | | A--------ASSLQS | 5501 |
| MA_31-H8_CCx_I2C0x_scFc_(K4E)_translation Fv#1 | VK1\|L11/JK2 | N--------AKTLAG | 5502 |
| MA_31-H8x_I2C0x_scFc_(F9Z)_translation Fv#1 | VK1\|L11/JK2 | N--------AKTLAG | 5503 |
| VK2\|A19/JK5 | | L--------GSNRAS | 5504 |
| MA_32-A8_CCx_I2C0x_scFc_(A9E)_translation Fv#1 | VK2\|A19/JK5 | L--------GSNRAS | 5505 |
| MA_32-A8_x_I2C0x_scFc_(G6J)_translation Fv#1 | VK2\|A19/JK5 | L--------GSNRAS | 5506 |
| VK3\|A27/JK2 | | G--------ASSRAT | 5507 |
| MA_48-D12_CCx_I2C0x_scFc_(M9T)_translation Fv#1 | VK3\|A27/JK2 | G--------ASSRAT | 5508 |
| VK2\|A19/JK3 | | L--------GSNRAS | 5509 |
| MA_50-D9_CCx_I2C0x_scFc_(K6S)_translation Fv#1 | VK2\|A19/JK3 | L--------GSNRAS | 5510 |
| MA_78-A6x_I2C0x_scFc_(K6P)_translation Fv#1 | VK2\|A19/JK3 | L--------GSNRAS | 5511 |
| VK2\|A19/JK4 | | L--------GSNRAS | 5512 |
| MA_50-D9x_I2C0x_scFc_(A4U)_translation Fv#1 | VK2\|A19/JK4 | L--------GSNRAS | 5513 |
| VK2\|A19/JK1 | | L--------GSNRAS | 5514 |
| MA_78-A6_CCx_I2C0x_scFc_(D8Z)_translation Fv#1 | VK2\|A19/JK1 | L--------GSNRAS | 5515 |
| VK1\|L19/JK3 | | A--------ASSLQS | 5516 |
| MA_79-E3_CC_x_I2C0x_scFc_(E2Y)_translation Fv#1 | VK1\|L19/JK3 | A--------ASSLQS | 5517 |
| VK1\|L19/JK1 | | A--------ASSLQS | 5518 |
| MA_79-E3x_I2C0x_scFc_(N4F)_translation Fv#1 | VK1\|L19/JK1 | A--------ASSLQS | 5519 |
| VK1\|A20/JK2 | | A--------ASTLQS | 5520 |
| MA_83-F3_CCx_I2C0x_scFc_(G5K)_translation Fv#1 | VK1\|A20/JK2 | A--------ASTLQS | 5521 |
| MA_83-F3x_I2C0x_scFc_(B9A)_translation Fv#1 | VK1\|A20/JK2 | A--------ASTLQS | 5522 |
| VK2\|O1/JK5 | | T--------LSYRAS | 5523 |
| MA_84-G10_CC_x_I2C0x_scFc_(H9O)_translation Fv#1 | VK2\|O1/JK5 | L--------GSNRAS | 5524 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_84-G10x_I2C0x_scFc_(Y4W)_translation Fv#1 | VK2\|O1/JK5 | L--------GSNRAS | 5525 |
| | | K_FR3 | |
| VK3\|A27/JK4 | | GIPDRESGSGSG--TDFTLTISRLEPEDFAVYYC | 5611 |
| MA_12-E12_CC_x_I2C0x_scFc_(E9U)_translation Fv#1 | VK3\|A27/JK4 | GIPDRESGSGSG--TDFTLTISRLEPEDFAVYYC | 5612 |
| MA_12-E12x_I2C0x_scFC_(W1U)_translation Fv#1 | VK3\|A27/JK4 | GIPDRESGSGSG--TDETLTISRLEPEDFAVYYC | 5613 |
| MA_48-D12x_I2C0x_scFc_(R9D)_translation Fv#1 | VK3\|A27/JK4 | GIPDRESGSGSG--TDFTLTISRLEPEDFAVYYC | 5614 |
| VK1\|A20/JK1 | | GVPSRFSGSGSG--TDFTLTISSLQPEDVATYYC | 5615 |
| MA_13-D8_CCx_I2C0x_scFc_(U7V)_translation Fv#1 | VK1\|A20/JK1 | GVPSRFSGSGSG--TDFTLTISSLQPEDFATYYC | 5616 |
| MA_13-D8x_I2C0x_scFc_(M7M)_translation Fv#1 | VK1\|A20/JK1 | GVPSRFSGSGSG--TDFTLTISSLQPEDFATYYC | 5617 |
| VK4\|B3/JK2 | | GVPDRESGSGSG--TDETLTISSLQAEDVAVYYC | 5618 |
| MA_24-C9_CCx_I2C0x_scFc_(I2U)_translation Fv#1 | VK4\|B3/JK2 | GVPDRFTGSGSG--TDFTLTISSVKAEDLAVYYC | 5619 |
| MA_24-C9x_I2C0x_scFc_(L9Y)_translation Fv#1 | VK4\|B3/JK2 | GVPDRFTGSGSG--TDFTLTISSVKAEDLAVYYC | 5620 |
| VK6\|A10/JK2 | | GVPSRFSGSGSG--TDFTLTINSLEAEDAATYYC | 5621 |
| MA_24-G6_CCx_I2C0x_scFc_(B1I)_translation Fv#1 | VK6\|A10/JK2 | GVPARFSGSGSG--TSYSLTISSMEAEDAASYFC | 5622 |
| MA_24-G6x_I2C0x_scFc_(F1M)_translation Fv#1 | VK6\|A10/JK2 | GVPARFSGSGSG--TSYSLTISSMEAEDAASYFC | 5623 |
| VK1\|L11/JK2 | | GVPSRFSGSGSG--TDFTLTISSLQPEDFATYYC | 5624 |
| MA_31-H8_CCx_I2C0x_scFc_(K4E)_translation Fv#1 | VK1\|L11/JK2 | GVPSRFSGSGSG--TQFSLKINSLQPEDFGSYYC | 5625 |
| MA_31-H8x_I2C0x_scFc_(F9Z)_translation Fv#1 | VK1\|L11/JK2 | GVPSRFSGSGSG--TQFSLKINSLQPEDEGSYYC | 5626 |
| VK2\|A19/JK5 | | GVPDRESGSGSG--TDFTLKISRVEAEDVGVYYC | 5627 |
| MA_32-A8_CCx_I2C0x_scFc_(A9E)_translation Fv#1 | VK2\|A19/JK5 | GVPDRESGSGSG--TDFTLKISKVEAEDVGVYYC | 5628 |
| MA_32-A8_x_I2C0x_scFc_(G6J)_translation Fv#1 | VK2\|A19/JK5 | GVPDRESGSGSG--TDFTLKISKVEAEDVGVYYC | 5629 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VK3\|A27/JK2 | | GIPDRESGSGSG--<br>TDFTLTISRLEPEDFAVYYC | 5630 |
| MA_48-<br>D12_CCx_I2C0x_scFc_(M9T)_<br>translation Fv#1 | VK3\|A27/JK2 | GIPDRESGSGSG--<br>TDFTLTISRLEPEDFAVYYC | 5631 |
| VK2\|A19/JK3 | | GVPDRESGSGSG--<br>TDFTLKISRVEAEDVGVYYC | 5632 |
| MA_50-<br>D9_CCx_I2C0x_scFc_(K6S)_<br>translation Fv#1 | VK2\|A19/JK3 | GVPDRFSGSGSG--<br>TDFTLKISRVEAEDVGVYYC | 5633 |
| MA_78-<br>A6x_I2C0x_scFc_(K6P)_<br>translation Fv#1 | VK2\|A19/JK3 | GVPDRESGSGSG--<br>TDFTLKISKVEAEDVGVYYC | 5634 |
| VK2\|A19/JK4 | | GVPDRESGSGSG--<br>TDFTLKISRVEAEDVGVYYC | 5635 |
| MA_50-<br>D9x_I2C0x_scFc_(A4U)_<br>translation Fv#1 | VK2\|A19/JK4 | GVPDRESGSGSG--<br>TDFTLKISRVEAEDVGVYYC | 5636 |
| VK2\|A19/JK1 | | GVPDRFSGSGSG--<br>TDFTLKISRVEAEDVGVYYC | 5637 |
| MA_78-<br>A6_CCx_I2C0x_scFc_(D8Z)_<br>translation Fv#1 | VK2\|A19/JK1 | GVPDRESGSGSG--<br>TDFTLKISKVEAEDVGVYYC | 5638 |
| VK1\|L19/JK3 | | GVPSRFSGSGSG--<br>TDFTLTISSLQPEDFATYYC | 5639 |
| MA_79-<br>E3_CC_x_I2C0x_scFc_(E2Y)_<br>translation Fv#1 | VK1\|L19/JK3 | GVPSRFSGSGSG--<br>TDFTLTISSLQPEDFATYYC | 5640 |
| VK1\|L19/JK1 | | GVPSRFSGSGSG--<br>TDFTLTISSLQPEDFATYYC | 5641 |
| MA_79-<br>E3x_I2C0x_scFc_(N4F)_<br>translation Fv#1 | VK1\|L19/JK1 | GVPSRFSGSGSG--<br>TDFTLTISSLQPEDFATYYC | 5642 |
| VK1\|A20/JK2 | | GVPSRFSGSGSG--<br>TDFTLTISSLQPEDVATYYC | 5643 |
| MA_83-<br>F3_CCx_I2C0x_scFc_(G5K)_<br>translation Fv#1 | VK1\|A20/JK2 | GVPSRFSGSGSG--<br>TDFTLTISSLQPEDVATYYC | 5644 |
| MA_83-<br>F3x_I2C0x_scFc_(B9A)_<br>translation Fv#1 | VK1\|A20/JK2 | GVPSRFSGSGSG--<br>TDFTLTISSLQPEDVATYYC | 5645 |
| VK2\|O1/JK5 | | GVPDRESGSGSG--<br>TDFTLKISRVEAEDVGVYYC | 5646 |
| MA_84-<br>G10_CC_x_I2C0x_scFc_(H9O)_<br>translation Fv#1 | VK2\|O1/JK5 | GVPDRESGSGSG--<br>TDFTLKISRVEAEDVGVYYC | 5647 |
| MA_84-<br>G10x_I2C0x_scFc_(Y4W)_<br>translation Fv#1 | VK2\|O1/JK5 | GVPDRESGSGSG--<br>TDFTLKISRVEAEDVGVYYC | 5648 |

TABLE 52-continued

BiTE-scFc Variable Region Protein Alignment_(MAGEB2)
CDRs defined by Kabat
Alignment numbering defined by Amgen Reference_(AHo)

LAMBDA VARIABLE

| | Germline | L_CDR2 | SEQ ID NO: |
|---|---|---|---|
| VL7\|7a/JL3b | | S--------TSNKHS | 5526 |
| MA_12-E12_CC_x_I2C0x_scFc_(E9U)_translation Fv#2 | VL7\|7a/JL3b | G--------TKFLAP | 5527 |
| MA_12-E12x_I2C0x_scFC_(W1U)_translation Fv#2 | VL7\|7a/JL3b | G--------TKFLAP | 5528 |
| MA_13-D8_CCx_I2C0x_scFc_(U7V)_translation Fv#2 | VL7\|7a/JL3b | G--------TKFLAP | 5529 |
| MA_13-D8x_I2C0x_scFc_(M7M)_translation Fv#2 | VL7\|7a/JL3b | G--------TKFLAP | 5530 |
| MA_24-C9_CCx_I2C0x_scFc_(I2U)_translation Fv#2 | VL7\|7a/JL3b | G--------TKFLAP | 5531 |
| MA_24-C9x_I2C0x_scFc_(L9Y)_translation Fv#2 | VL7\|7a/JL3b | G--------TKFLAP | 5532 |
| MA_24-G6_CCx_I2C0x_scFc_(B1I)_translation Fv#2 | VL7\|7a/JL3b | G--------TKFLAP | 5533 |
| MA_24-G6x_I2C0x_scFc_(F1M)_translation Fv#2 | VL7\|7a/JL3b | G--------TKFLAP | 5534 |
| MA_31-H8_CCx_I2C0x_scFc_(K4E)_translation Fv#2 | VL7\|7a/JL3b | G--------TKFLAP | 5535 |
| MA_31-H8x_I2C0x_scFc_(F9Z)_translation Fv#2 | VL7\|7a/JL3b | G--------TKFLAP | 5536 |
| MA_32-A8_CCx_I2C0x_scFc_(A9E)_translation Fv#2 | VL7\|7a/JL3b | G--------TKFLAP | 5537 |
| MA_32-A8_x_I2C0x_scFc_(G6J)_translation Fv#2 | VL7\|7a/JL3b | G--------TKFLAP | 5538 |
| MA_48-D12_CCx_I2C0x_scFc_(M9T)_translation Fv#2 | VL7\|7a/JL3b | G--------TKFLAP | 5539 |
| MA_48-D12x_I2C0x_scFc_(R9D)_translation Fv#2 | VL7\|7a/JL3b | G--------TKFLAP | 5540 |
| MA_50-D9_CCx_I2C0x_scFc_(K6S)_translation Fv#2 | VL7\|7a/JL3b | G--------TKFLAP | 5541 |
| MA_50-D9x_I2C0x_scFc_(A4U)_translation Fv#2 | VL7\|7a/JL3b | G--------TKFLAP | 5542 |
| MA_78-A6_CCx_I2C0x_scFc_(D8Z)_translation Fv#2 | VL7\|7a/JL3b | G--------TKFLAP | 5543 |

TABLE 52-continued

BiTE-scFc Variable Region Protein Alignment_(MAGEB2)
CDRs defined by Kabat
Alignment numbering defined by Amgen Reference_(AHo)

| Name | Chain | Sequence | SEQ ID |
|---|---|---|---|
| MA_78-A6x_I2C0x_scFc_(K6P)_translation Fv#2 | VL7\|7a/JL3b | G--------TKFLAP | 5544 |
| MA_79-E3_CC_x_I2C0x_scFc_(E2Y)_translation Fv#2 | VL7\|7a/JL3b | G--------TKFLAP | 5545 |
| MA_79-E3x_I2C0x_scFc_(N4F)_translation Fv#2 | VL7\|7a/JL3b | G--------TKFLAP | 5546 |
| MA_83-F3_CCx_I2C0x_scFc_(G5K)_translation Fv#2 | VL7\|7a/JL3b | G--------TKFLAP | 5547 |
| MA_83-F3x_I2C0x_scFc_(B9A)_translation Fv#2 | VL7\|7a/JL3b | G--------TKFLAP | 5548 |
| MA_84-G10_CC_x_I2C0x_scFc_(H9O)_translation Fv#2 | VL7\|7a/JL3b | G--------TKFLAP | 5549 |
| MA_84-G10x_I2C0x_scFc_(Y4W)_translation Fv#2 | VL7\|7a/JL3b | G--------TKFLAP | 5550 |

| | | L_FR3 | |
|---|---|---|---|
| VL7\|7a/JL3b | | WTPARFSGSLLG--GKAALTLSGVQPEDEAEYYC | 5649 |
| MA_12-E12_CC_x_I2C0x_scFc_(E9U)_translation Fv#2 | VL7\|7a/JL3b | GTPARFSGSLLG--GKAALTLSGVQPEDEAEYYC | 5650 |
| MA_12-E12x_I2C0x_scFC_(W1U)_translation Fv#2 | VL7\|7a/JL3b | GTPARFSGSLLG--GKAALTLSGVQPEDEAEYYC | 5651 |
| MA_13-D8_CCx_I2C0x_scFc_(U7V)_translation Fv#2 | VL7\|7a/JL3b | GTPARFSGSLLG--GKAALTLSGVQPEDEAEYYC | 5652 |
| MA_13-D8x_I2C0x_scFc_(M7M)_translation Fv#2 | VL7\|7a/JL3b | GTPARFSGSLLG--GKAALTLSGVQPEDEAEYYC | 5653 |
| MA_24-C9_CCx_I2C0x_scFc_(I2U)_translation Fv#2 | VL7\|7a/JL3b | GTPARFSGSLLG--GKAALTLSGVQPEDEAEYYC | 5654 |
| MA_24-C9x_I2C0x_scFc_(L9Y)_translation Fv#2 | VL7\|7a/JL3b | GTPARFSGSLLG--GKAALTLSGVQPEDEAEYYC | 5655 |
| MA_24-G6_CCx_I2C0x_scFc_(B1I)_translation Fv#2 | VL7\|7a/JL3b | GTPARFSGSLLG--GKAALTLSGVQPEDEAEYYC | 5656 |
| MA_24-G6x_I2C0x_scFc_(F1M)_translation Fv#2 | VL7\|7a/JL3b | GTPARFSGSLLG--GKAALTLSGVQPEDEAEYYC | 5657 |
| MA_31-H8_CCx_I2C0x_scFc_(K4E)_translation Fv#2 | VL7\|7a/JL3b | GTPARFSGSLLG--GKAALTLSGVQPEDEAEYYC | 5658 |
| MA_31-H8x_I2C0x_scFc_(F9Z)_translation Fv#2 | VL7\|7a/JL3b | GTPARFSGSLLG--GKAALTLSGVQPEDEAEYYC | 5659 |

TABLE 52-continued

BiTE-scFc Variable Region Protein Alignment_(MAGEB2)
CDRs defined by Kabat
Alignment numbering defined by Amgen Reference_(AHo)

| | | | SEQ ID NO: |
|---|---|---|---|
| MA_32-A8_CCx_I2C0x_scFc_(A9E)_translation Fv#2 | VL7\|7a/JL3b | GTPARFSGSLLG--GKAALTLSGVQPEDEAEYYC | 5660 |
| MA_32-A8_x_I2C0x_scFc_(G6J)_translation Fv#2 | VL7\|7a/JL3b | GTPARFSGSLLG--GKAALTLSGVQPEDEAEYYC | 5661 |
| MA_48-D12_CCx_I2C0x_scFc_(M9T)_translation Fv#2 | VL7\|7a/JL3b | GTPARFSGSLLG--GKAALTLSGVQPEDEAEYYC | 5662 |
| MA_48-D12x_I2C0x_scFc_(R9D)_translation Fv#2 | VL7\|7a/JL3b | GTPARFSGSLLG--GKAALTLSGVQPEDEAEYYC | 5663 |
| MA_50-D9_CCx_I2C0x_scFc_(K6S)_translation Fv#2 | VL7\|7a/JL3b | GTPARFSGSLLG--GKAALTLSGVQPEDEAEYYC | 5664 |
| MA_50-D9x_I2C0x_scFc_(A4U)_translation Fv#2 | VL7\|7a/JL3b | GTPARFSGSLLG--GKAALTLSGVQPEDEAEYYC | 5665 |
| MA_78-A6_CCx_I2C0x_scFc_(D8Z)_translation Fv#2 | VL7\|7a/JL3b | GTPARFSGSLLG--GKAALTLSGVQPEDEAEYYC | 5666 |
| MA_78-A6x_I2C0x_scFc_(K6P)_translation Fv#2 | VL7\|7a/JL3b | GTPARFSGSLLG--GKAALTLSGVQPEDEAEYYC | 5667 |
| MA_79-E3_CC_x_I2C0x_scFc_(E2Y)_translation Fv#2 | VL7\|7a/JL3b | GTPARFSGSLLG--GKAALTLSGVQPEDEAEYYC | 5668 |
| MA_79-E3x_I2C0x_scFc_(N4F)_translation Fv#2 | VL7\|7a/JL3b | GTPARFSGSLLG--GKAALTLSGVQPEDEAEYYC | 5669 |
| MA_83-F3_CCx_I2C0x_scFc_(G5K)_translation Fv#2 | VL7\|7a/JL3b | GTPARFSGSLLG--GKAALTLSGVQPEDEAEYYC | 5670 |
| MA_83-F3x_I2C0x_scFc_(B9A)_translation Fv#2 | VL7\|7a/JL3b | GTPARFSGSLLG--GKAALTLSGVQPEDEAEYYC | 5671 |
| MA_84-G10_CC_x_I2C0x_scFc_(H9O)_translation Fv#2 | VL7\|7a/JL3b | GTPARFSGSLLG--GKAALTLSGVQPEDEAEYYC | 5672 |
| MA_84-G10x_I2C0x_scFc_(Y4W)_translation Fv#2 | VL7\|7a/JL3b | GTPARFSGSLLG--GKAALTLSGVQPEDEAEYYC | 5673 |

| HEAVY VARIABLE | | | |
|---|---|---|---|
| | Germline | | SEQ ID NO: |
| | | H_CDR2 | |
| VH3\|3-21/D2\|2-15\|RF3/JH1 | | SISSS---SSYIYYADSVKG | 5551 |
| MA_12-E12_CC_x_I2C0x_scFc_(E9U)_translation Fv#1 | VH3\|3-21/D2\|2-15\|RF3/JH1 | SISSS---SSYIYYADSVKG | 5552 |
| MA_12-E12x_I2C0x_scFC_(W1U)_translation Fv#1 | VH3\|3-21/D2\|2-15\|RF3/JH1 | SISSS---SSYIYYADSVKG | 5553 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VH3\|3-73/D3\|3-3\|RF3/JH4 | | RIRSKA-NSYATAYAASVKG | 5554 |
| MA_12-E12_CC_x_I2C0x_scFc_(E9U)_ translation Fv#2 | VH3\|3-73/D3\|3-3\|RF3/JH4 | RIRSKY-NNYATYYADSVKD | 5555 |
| MA_12-E12x_I2C0x_scFC_(W1U)_ translation Fv#2 | VH3\|3-73/D3\|3-3\|RF3/JH4 | RIRSKY-NNYATYYADSVKD | 5556 |
| MA_13-D8_CCx_I2C0x_scFc_(U7V)_ translation Fv#2 | VH3\|3-73/D3\|3-3\|RF3/JH4 | RIRSKY-NNYATYYADSVKD | 5557 |
| MA_13-D8x_I2C0x_scFc_(M7M)_ translation Fv#2 | VH3\|3-73/D3\|3-3\|RF3/JH4 | RIRSKY-NNYATYYADSVKD | 5558 |
| MA_24-C9_CCx_I2C0x_scFc_(I2U)_ translation Fv#2 | VH3\|3-73/D3\|3-3\|RF3/JH4 | RIRSKY-NNYATYYADSVKD | 5559 |
| MA_24-C9x_I2C0x_scFc_(L9Y)_ translation Fv#2 | VH3\|3-73/D3\|3-3\|RF3/JH4 | RIRSKY-NNYATYYADSVKD | 5560 |
| MA_24-G6_CCx_I2C0x_scFc_(B1I)_ translation Fv#2 | VH3\|3-73/D3\|3-3\|RF3/JH4 | RIRSKY-NNYATYYADSVKD | 5561 |
| MA_24-G6x_I2C0x_scFc_(F1M)_ translation Fv#2 | VH3\|3-73/D3\|3-3\|RF3/JH4 | RIRSKY-NNYATYYADSVKD | 5562 |
| MA_31-H8_CCx_I2C0x_scFc_(K4E)_ translation Fv#2 | VH3\|3-73/D3\|3-3\|RF3/JH4 | RIRSKY-NNYATYYADSVKD | 5563 |
| MA_31-H8x_I2C0x_scFc_(F9Z)_ translation Fv#2 | VH3\|3-73/D3\|3-3\|RF3/JH4 | RIRSKY-NNYATYYADSVKD | 5564 |
| MA_32-A8_CCx_I2C0x_scFc_(A9E)_ translation Fv#2 | VH3\|3-73/D3\|3-3\|RF3/JH4 | RIRSKY-NNYATYYADSVKD | 5565 |
| MA_32-A8_x_I2C0x_scFc_(G6J)_ translation Fv#2 | VH3\|3-73/D3\|3-3\|RF3/JH4 | RIRSKY-NNYATYYADSVKD | 5566 |
| MA_48-D12_CCx_I2C0x_scFc_(M9T)_ translation Fv#2 | VH3\|3-73/D3\|3-3\|RF3/JH4 | RIRSKY-NNYATYYADSVKD | 5567 |
| MA_48-D12x_I2C0x_scFc_(R9D)_ translation Fv#2 | VH3\|3-73/D3\|3-3\|RF3/JH4 | RIRSKY-NNYATYYADSVKD | 5568 |
| MA_50-D9_CCx_I2C0x_scFc_(K6S)_ translation Fv#2 | VH3\|3-73/D3\|3-3\|RF3/JH4 | RIRSKY-NNYATYYADSVKD | 5569 |
| MA_50-D9x_I2C0x_scFc_(A4U)_ translation Fv#2 | VH3\|3-73/D3\|3-3\|RF3/JH4 | RIRSKY-NNYATYYADSVKD | 5570 |
| MA_78-A6_CCx_I2C0x_scFc_(D8Z)_ translation Fv#2 | VH3\|3-73/D3\|3-3\|RF3/JH4 | RIRSKY-NNYATYYADSVKD | 5571 |
| MA_78-A6x_I2C0x_scFc_(K6P)_ translation Fv#2 | VH3\|3-73/D3\|3-3\|RF3/JH4 | RIRSKY-NNYATYYADSVKD | 5572 |

TABLE 52-continued

BiTE-scFc Variable Region Protein Alignment_(MAGEB2)
CDRs defined by Kabat
Alignment numbering defined by Amgen Reference_(AHo)

| Name | V-gene | CDR | SEQ ID |
|---|---|---|---|
| MA_79-E3_CC_x_I2C0x_scFc_(E2Y)_translation Fv#2 | VH3\|3-73/D3\|3-3\|RF3/JH4 | RIRSKY-NNYATYYADSVKD | 5573 |
| MA_79-E3x_I2C0x_scFc_(N4F)_translation Fv#2 | VH3\|3-73/D3\|3-3\|RF3/JH4 | RIRSKY-NNYATYYADSVKD | 5574 |
| MA_83-F3_CCx_I2C0x_scFc_(G5K)_translation Fv#2 | VH3\|3-73/D3\|3-3\|RF3/JH4 | RIRSKY-NNYATYYADSVKD | 5575 |
| MA_83-F3x_I2C0x_scFc_(B9A)_translation Fv#2 | VH3\|3-73/D3\|3-3\|RF3/JH4 | RIRSKY-NNYATYYADSVKD | 5576 |
| MA_84-G10_CC_x_I2C0x_scFc_(H9O)_translation Fv#2 | VH3\|3-73/D3\|3-3\|RF3/JH4 | RIRSKY-NNYATYYADSVKD | 5577 |
| MA_84-G10x_I2C0x_scFc_(Y4W)_translation Fv#2 | VH3\|3-73/D3\|3-3\|RF3/JH4 | RIRSKY-NNYATYYADSVKD | 5578 |
| VH3\|3-23/D1\|1-1\|RF1/JH6 | | AISGS---GGSTYYADSVKG | 5579 |
| MA_13-D8_CCx_I2C0x_scFc_(U7V)_translation Fv#1 | VH3\|3-23/D1\|1-1\|RF1/JH6 | AISGS---GGSTYYADSVKG | 5580 |
| MA_13-D8x_I2C0x scFc_(M7M)_translation Fv#1 | VH3\|3-23/D1\|1-1\|RF1/JH6 | AISGS---GGSTYYADSVKG | 5581 |
| MA_79-E3_CC_x_I2C0x_scFc_(E2Y)_translation Fv#1 | VH3\|3-23/D1\|1-1\|RF1/JH6 | AISGS---GGSTYYADSVKG | 5582 |
| MA_79-E3x_I2C0x scFc_(N4F)_translation Fv#1 | VH3\|3-23/D1\|1-1\|RF1/JH6 | AISGS---GGSTYYADSVKG | 5583 |
| VH1\|1-e/D2\|2-15\|RF3/JH4 | | GIIPI---FGTANYAQKFQG | 5584 |
| MA_24-C9_CCx_I2C0x_scFc_(I2U)_translation Fv#1 | VH1\|1-e/D2\|2-15\|RF3/JH4 | RIYPG---DGDTNYNGKFKG | 5585 |
| MA_24-C9x_I2C0x_scFc_(L9Y)_translation Fv#1 | VH1\|1-e/D2\|2-15\|RF3/JH4 | RIYPG---DGDTNYNGKFKG | 5586 |
| VH1\|1-e/D5\|5-18\|RF3/JH4 | | GIIPI---FGTANYAQKFQG | 5587 |
| MA_24-G6_CCx_I2C0x_scFc_(B1I)_translation Fv#1 | VH1\|1-e/D5\|5-18\|RF3/JH4 | RVWPG---DGDTTYNEKFKG | 5588 |
| MA_24-G6x_I2C0x_scFc_(F1M)_translation Fv#1 | VH1\|1-e/D5\|5-18\|RF3/JH4 | RVWPG---DGDTTYNEKFKG | 5589 |
| VH1\|1-e/D1\|1-1\|RF2/JH3 | | GIIPI---FGTANYAQKFQG | 5590 |
| MA_31-H8_CCx_I2C0x_scFc_(K4E)_translation Fv#1 | VH1\|1-e/D1\|1-1\|RF2/JH3 | RIYPG---DGDTNYNGKFKD | 5591 |
| MA_31-H8x_I2C0x_scFc_(F9Z)_translation Fv#1 | VH1\|1-e/D1\|1-1\|RF2/JH3 | RIYPG---DGDTNYNGKFKD | 5592 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VH1\|1-08/D5\|5-18\|RF3/JH6 | | WMNPN---SGNTGYAQKFQG | 5593 |
| MA_32-A8_CCx_I2C0x_scFc_(A9E)_ translation Fv#1 | VH1\|1-08/D5\|5-18\|RF3/JH6 | WMNPN---SGNTGYAQKFQG | 5594 |
| MA_32-A8_x_I2C0x_scFc_(G6J)_ translation Fv#1 | VH1\|1-08/D5\|5-18\|RF3/JH6 | WMNPN---SGNTGYAQKFQG | 5595 |
| VH3\|3-30.3/D1\|1-1\|RF2/JH6 | | VISYD---GSNKYYADSVKG | 5596 |
| MA_48-D12_CCx_I2C0x_scFc_(M9T)_ translation Fv#1 | VH3\|3-30.3/D1\|1-1\|RF2/JH6 | VISYD---GGNKYYADSVKG | 5597 |
| MA_48-D12x_I2C0x_scFc_(R9D)_ translation Fv#1 | VH3\|3-30.3/D1\|1-1\|RF2/JH6 | VISYD---GGNKYYADSVKG | 5598 |
| VH6\|6-01/D3\|3-10\|RF1/JH6 | | RTYYR--SKWYNDYAVSVKS | 5599 |
| MA_50-D9_CCx_I2C0x_scFc_(K6S)_ translation Fv#1 | VH6\|6-01/D3\|3-10\|RF1/JH6 | RTYYR--SKWYNDYAVSVKS | 5600 |
| MA_50-D9x_I2C0x_scFc_(A4U)_ translation Fv#1 | VH6\|6-01/D3\|3-10\|RF1/JH6 | RTYYR--SKWYNDYAVSVKS | 5601 |
| VH4\|4-34/D5\|5-18\|RF3/JH6 | | EINH----SGSTNYNPSLKS | 5602 |
| MA_78-A6_CCx_I2C0x_scFc_(D8Z)_ translation Fv#1 | VH4\|4-34/D5\|5-18\|RF3/JH6 | EINH----RGSTNYNPSLKS | 5603 |
| MA_78-A6x_I2C0x_scFc_(K6P)_ translation Fv#1 | VH4\|4-34/D5\|5-18\|RF3/JH6 | EINH----RGSTNYNPSLKS | 5604 |
| VH1\|1-02/D7\|7-27\|RF2/JH4 | | WINPN---SGGTNYAQKFQG | 5605 |
| MA_83-F3_CCx_I2C0x_scFc_(G5K)_ translation Fv#1 | VH1\|1-02/D7\|7-27\|RF2/JH4 | RINPN---SGDTHYAQKFQG | 5606 |
| MA_83-F3x_I2C0x_scFc_(B9A)_ translation Fv#1 | VH1\|1-02/D7\|7-27\|RF2/JH4 | RINPN---SGDTHYAQKFQG | 5607 |
| VH4\|4-30.1/D3\|3-10\|RF1/JH6 | | YIYY----SGSTYYNPSLKS | 5608 |
| MA_84-G10_CC_x_I2C0x_scFc_(H9O)_ translation Fv#1 | VH4\|4-30.1/D3\|3-10\|RF1/JH6 | YIYY----SGSTYYNPSLKS | 5609 |
| MA_84-G10x_I2C0x_scFc_(Y4W)_ translation Fv#1 | VH4\|4-30.1/D3\|3-10\|RF1/JH6 | YIYY----SGSTYYNPSLKS | 5610 |
| | | H_FR3 | |
| VH3\|3-21/D2\|2-15\|RF3/JH1 | | RFTISRDNAKNSLYLQMNSLRAEDTAVYYCAR | 5674 |
| MA_12-E12_CC_x_I2C0x_scFc_(E9U)_ translation Fv#1 | VH3\|3-21/D2\|2-15\|RF3/JH1 | RFTISRDNAKNSLYLQMNSLRDEDTAVYYCAR | 5675 |
| MA_12-E12x_I2C0x_scFC_(W1U)_ translation Fv#1 | VH3\|3-21/D2\|2-15\|RF3/JH1 | RFTISRDNAKNSLYLQMNSLRDEDTAVYYCAR | 5676 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VH3\|3-73/D3\|3-3\|RF3/JH4 | | RFTISRDDSKNTAYLQMNSLKTEDTAVYYCTR | 5677 |
| MA_12-E12_CC_x_I2C0x_scFc_(E9U)_translation Fv#2 | VH3\|3-73/D3\|3-3\|RF3/JH4 | RFTISRDDSKNTAYLQMNNLKTEDTAVYYCVR | 5678 |
| MA_12-E12x_I2C0x_scFC_(W1U)_translation Fv#2 | VH3\|3-73/D3\|3-3\|RF3/JH4 | RFTISRDDSKNTAYLQMNNLKTEDTAVYYCVR | 5679 |
| MA_13-D8_CCx_I2C0x_scFc_(U7V)_translation Fv#2 | VH3\|3-73/D3\|3-3\|RF3/JH4 | RFTISRDDSKNTAYLQMNNLKTEDTAVYYCVR | 5680 |
| MA_13-D8x_I2C0x_scFc_(M7M)_translation Fv#2 | VH3\|3-73/D3\|3-3\|RF3/JH4 | RFTISRDDSKNTAYLQMNNLKTEDTAVYYCVR | 5681 |
| MA_24-C9_CCx_I2C0x_scFc_(I2U)_translation Fv#2 | VH3\|3-73/D3\|3-3\|RF3/JH4 | RFTISRDDSKNTAYLQMNNLKTEDTAVYYCVR | 5682 |
| MA_24-C9x_I2C0x_scFc_(L9Y)_translation Fv#2 | VH3\|3-73/D3\|3-3\|RF3/JH4 | RFTISRDDSKNTAYLQMNNLKTEDTAVYYCVR | 5683 |
| MA_24-G6_CCx_I2C0x_scFc_(B1I)_translation Fv#2 | VH3\|3-73/D3\|3-3\|RF3/JH4 | RFTISRDDSKNTAYLQMNNLKTEDTAVYYCVR | 5684 |
| MA_24-G6x_I2C0x_scFc_(F1M)_translation Fv#2 | VH3\|3-73/D3\|3-3\|RF3/JH4 | RFTISRDDSKNTAYLQMNNLKTEDTAVYYCVR | 5685 |
| MA_31-H8_CCx_I2C0x_scFc_(K4E)_translation Fv#2 | VH3\|3-73/D3\|3-3\|RF3/JH4 | RFTISRDDSKNTAYLQMNNLKTEDTAVYYCVR | 5686 |
| MA_31-H8x_I2C0x_scFc_(F9Z)_translation Fv#2 | VH3\|3-73/D3\|3-3\|RF3/JH4 | RFTISRDDSKNTAYLQMNNLKTEDTAVYYCVR | 5687 |
| MA_32-A8_CCx_I2C0x_scFc_(A9E)_translation Fv#2 | VH3\|3-73/D3\|3-3\|RF3/JH4 | RFTISRDDSKNTAYLQMNNLKTEDTAVYYCVR | 5688 |
| MA_32-A8_x_I2C0x_scFc_(G6J)_translation Fv#2 | VH3\|3-73/D3\|3-3\|RF3/JH4 | RFTISRDDSKNTAYLQMNNLKTEDTAVYYCVR | 5689 |
| MA_48-D12_CCx_I2C0x_scFc_(M9T)_translation Fv#2 | VH3\|3-73/D3\|3-3\|RF3/JH4 | RFTISRDDSKNTAYLQMNNLKTEDTAVYYCVR | 5690 |
| MA_48-D12x_I2C0x_scFc_(R9D)_translation Fv#2 | VH3\|3-73/D3\|3-3\|RF3/JH4 | RFTISRDDSKNTAYLQMNNLKTEDTAVYYCVR | 5691 |
| MA_50-D9_CCx_I2C0x_scFc_(K6S)_translation Fv#2 | VH3\|3-73/D3\|3-3\|RF3/JH4 | RFTISRDDSKNTAYLQMNNLKTEDTAVYYCVR | 5692 |
| MA_50-D9x_I2C0x_scFc_(A4U)_translation Fv#2 | VH3\|3-73/D3\|3-3\|RF3/JH4 | RFTISRDDSKNTAYLQMNNLKTEDTAVYYCVR | 5693 |
| MA_78-A6_CCx_I2C0x_scFc_(D8Z)_translation Fv#2 | VH3\|3-73/D3\|3-3\|RF3/JH4 | RFTISRDDSKNTAYLQMNNLKTEDTAVYYCVR | 5694 |
| MA_78-A6x_I2C0x_scFc_(K6P)_translation Fv#2 | VH3\|3-73/D3\|3-3\|RF3/JH4 | RFTISRDDSKNTAYLQMNNLKTEDTAVYYCVR | 5695 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_79-E3_CC_x_I2C0x_scFc_(E2Y)_translation Fv#2 | VH3\|3-73/D3\|3-3\|RF3/JH4 | RFTISRDDSKNTAYLQMNNLKTEDTAVYYCVR | 5696 |
| MA_79-E3x_I2C0x_scFc_(N4F)_translation Fv#2 | VH3\|3-73/D3\|3-3\|RF3/JH4 | RFTISRDDSKNTAYLQMNNLKTEDTAVYYCVR | 5697 |
| MA_83-F3_CCx_I2C0x_scFc_(G5K)_translation Fv#2 | VH3\|3-73/D3\|3-3\|RF3/JH4 | RFTISRDDSKNTAYLQMNNLKTEDTAVYYCVR | 5698 |
| MA_83-F3x_I2C0x_scFc_(B9A)_translation Fv#2 | VH3\|3-73/D3\|3-3\|RF3/JH4 | RFTISRDDSKNTAYLQMNNLKTEDTAVYYCVR | 5699 |
| MA_84-G10_CC_x_I2C0x_scFc_(H9O)_translation Fv#2 | VH3\|3-73/D3\|3-3\|RF3/JH4 | RFTISRDDSKNTAYLQMNNLKTEDTAVYYCVR | 5700 |
| MA_84-G10x_I2C0x_scFc_(Y4W)_translation Fv#2 | VH3\|3-73/D3\|3-3\|RF3/JH4 | RFTISRDDSKNTAYLQMNNLKTEDTAVYYCVR | 5701 |
| VH3\|3-23/D1\|1-1\|RF1/JH6 | | RFTISRDNSKNTLYLQMNSLRAEDTAVYYCAK | 5702 |
| MA_13-D8_CCx_I2C0x_scFc_(U7V)_translation Fv#1 | VH3\|3-23/D1\|1-1\|RF1/JH6 | RFTISRDNSKNTLYLQMNSLRAEDTAEYYCAK | 5703 |
| MA_13-D8x_I2C0x_scFc_(M7M)_translation Fv#1 | VH3\|3-23/D1\|1-1\|RF1/JH6 | RFTISRDNSKNTLYLQMNSLRAEDTAEYYCAK | 5704 |
| MA_79-E3_CC_x_I2C0x_scFc_(E2Y)_translation Fv#1 | VH3\|3-23/D1\|1-1\|RF1/JH6 | RFTISRDNSKNTLYLQMNSLRAEDTAEYYCAK | 5705 |
| MA_79-E3x_I2C0x_scFc_(N4F)_translation Fv#1 | VH3\|3-23/D1\|1-1\|RF1/JH6 | RFTISRDNSKNTLYLQMNSLRAEDTAEYYCAK | 5706 |
| VH1\|1-e/D2\|2-15\|RF3/JH4 | | RVTITADKSTSTAYMELSSLRSEDTAVYYCAR | 5707 |
| MA_24-C9_CCx_I2C0x_scFc_(I2U)_translation Fv#1 | VH1\|1-e/D2\|2-15\|RF3/JH4 | KAALTADKSSNTANMQLNSLTSEDSAVYFCAR | 5708 |
| MA_24-C9x_I2C0x_scFc_(L9Y)_translation Fv#1 | VH1\|1-e/D2\|2-15\|RF3/JH4 | KAALTADKSSNTANMQLNSLTSEDSAVYFCAR | 5709 |
| VH1\|1-e/D5\|5-18\|RF3/JH4 | | RVTITADKSTSTAYMELSSLRSEDTAVYYCAR | 5710 |
| MA_24-G6_CCx_I2C0x_scFc_(B1I)_translation Fv#1 | VH1\|1-e/D5\|5-18\|RF3/JH4 | KATLTADKSSRTAYMQLSSLTSEDSAVYFCAR | 5711 |
| MA_24-G6x_I2C0x_scFc_(F1M)_translation Fv#1 | VH1\|1-e/D5\|5-18\|RF3/JH4 | KATLTADKSSRTAYMQLSSLTSEDSAVYFCAR | 5712 |
| VH1\|1-e/D1\|1-1\|RF2/JH3 | | RVTITADKSTSTAYMELSSLRSEDTAVYYCAR | 5713 |
| MA_31-H8_CCx_I2C0x_scFc_(K4E)_translation Fv#1 | VH1\|1-e/D1\|1-1\|RF2/JH3 | KATLTADKSSNTAYMQLSSLTSEDSAVYFCAR | 5714 |
| MA_31-H8x_I2C0x_scFc_(F9Z)_translation Fv#1 | VH1\|1-e/D1\|1-1\|RF2/JH3 | KATLTADKSSNTAYMQLSSLTSEDSAVYFCAR | 5715 |

TABLE 52-continued

BiTE-scFc Variable Region Protein Alignment_(MAGEB2)
CDRs defined by Kabat
Alignment numbering defined by Amgen Reference_(AHo)

| Name | Germline | Sequence | SEQ ID |
|---|---|---|---|
| VH1\|1-08/D5\|5-18\|RF3/JH6 | | RVTMTRNTSISTAYMELSSLRSEDTAV YYCAR | 5716 |
| MA_32-A8_CCx_I2C0x_scFc_(A9E)_ translation Fv#1 | VH1\|1-08/D5\|5-18\|RF3/JH6 | RVTMTRNTSISTAYMELSSLRSEDTAV YYCAR | 5717 |
| MA_32-A8_x_I2C0x_scFc_(G6J)_ translation Fv#1 | VH1\|1-08/D5\|5-18\|RF3/JH6 | RVTMTRNTSISTAYMELSSLRSEDTAV YYCAR | 5718 |
| VH3\|3-30.3/D1\|1-1\|RF2/JH6 | | RFTISRDNSKNTLYLQMNSLRAEDTAV YYCAR | 5719 |
| MA_48-D12_CCx_I2C0x_scFc_(M9T)_ translation Fv#1 | VH3\|3-30.3/D1\|1-1\|RF2/JH6 | RFTISRDNSKNTLYLQMNSLRAEDTAV YYCAR | 5720 |
| MA_48-D12x_I2C0x_scFc_(R9D)_ translation Fv#1 | VH3\|3-30.3/D1\|1-1\|RF2/JH6 | RFTISRDNSKNTLYLQMNSLRAEDTAV YYCAR | 5721 |
| VH6\|6-01/D3\|3-10\|RF1/JH6 | | RITINPDTSKNQFSLQLNSVTPEDTAV YYCAR | 5722 |
| MA_50-D9_CCx_I2C0x_scFc_(K6S)_ translation Fv#1 | VH6\|6-01/D3\|3-10\|RF1/JH6 | RITINPDTSKNQFSLQLNSVTPEDTAV YYCVR | 5723 |
| MA_50-D9x_I2C0x_scFc_(A4U)_ translation Fv#1 | VH6\|6-01/D3\|3-10\|RF1/JH6 | RITINPDTSKNQFSLQLNSVTPEDTAV YYCVR | 5724 |
| VH4\|4-34/D5\|5-18\|RF3/JH6 | | RVTISVDTSKNQFSLKLSSVTAADTAV YYCAR | 5725 |
| MA_78-A6_CCx_I2C0x_scFc_(D8Z)_ translation Fv#1 | VH4\|4-34/D5\|5-18\|RF3/JH6 | RVTISVDASKNQFSLKLSSVTAADTAV YYCAR | 5726 |
| MA_78-A6x_I2C0x_scFc_(K6P)_ translation Fv#1 | VH4\|4-34/D5\|5-18\|RF3/JH6 | RVTISVDASKNQFSLKLSSVTAADTAV YYCAR | 5727 |
| VH1\|1-02/D7\|7-27\|RF2/JH4 | | RVTMTRDTSISTAYMELSRLRSDDTAV YYCAR | 5728 |
| MA_83-F3_CCx_I2C0x_scFc_(G5K)_ translation Fv#1 | VH1\|1-02/D7\|7-27\|RF2/JH4 | RVTMTRDTSISTAYMELSRLRSDDTAV YYCAR | 5729 |
| MA_83-F3x_I2C0x_scFc_(B9A)_ translation Fv#1 | VH1\|1-02/D7\|7-27\|RF2/JH4 | RVTMTRDTSISTAYMELSRLRSDDTAV YYCAR | 5730 |
| VH4\|4-30.1/D3\|3-10\|RF1/JH6 | | RVTISVDTSKNQFSLKLSSVTAADTAV YYCAR | 5731 |
| MA_84-G10_CC_x_I2C0x_scFc_(H9O)_ translation Fv#1 | VH4\|4-30.1/D3\|3-10\|RF1/JH6 | RVTISVDTSKNQFSLKLSSVTAADTAV YYCAR | 5732 |
| MA_84-G10x_I2C0x_scFc_(Y4W)_ translation Fv#1 | VH4\|4-30.1/D3\|3-10\|RF1/JH6 | RVTISVDTSKNQFSLKLSSVTAADTAV YYCAR | 5733 |

TABLE 52-continued

BiTE-scFc Variable Region Protein Alignment_(MAGEB2)
CDRs defined by Kabat
Alignment numbering defined by Amgen Reference_(AHo)

| KAPPA VARIABLE | | | |
|---|---|---|---|
| | Germline | | SEQ ID NO: |
| | | K_CDR3 | |
| VK3\|A27/JK4 | | QQYGS---------------------SPLT | 5734 |
| MA_12-E12_CC_x_I2C0x_scFc_(E9U)_translation Fv#1 | VK3\|A27/JK4 | QQYAN---------------------SPLT | 5735 |
| MA_12-E12x_I2C0x_scFC_(W1U)_translation Fv#1 | VK3\|A27/JK4 | QQYAN---------------------SPLT | 5736 |
| MA_48-D12x_I2C0x_scFc_(R9D)_translation Fv#1 | VK3\|A27/JK4 | QQYGS---------------------SPLT | 5737 |
| VK1\|A20/JK1 | | QKYNS---------------------APWT | 5738 |
| MA_13-D8_CCx_I2C0x_scFc_(U7V)_translation Fv#1 | VK1\|A20/JK1 | QQSYS---------------------TPPT | 5739 |
| MA_13-D8x_I2C0x_scFc_(M7M)_translation Fv#1 | VK1\|A20/JK1 | QQSYS---------------------TPPT | 5740 |
| VK4\|B3/JK2 | | QQYYS---------------------TPYT | 5741 |
| MA_24-C9_CCx_I2C0x_scFc_(I2U)_translation Fv#1 | VK4\|B3/JK2 | QQYYS---------------------YPYT | 5742 |
| MA_24-C9x_I2C0x_scFc_(L9Y)_translation Fv#1 | VK4\|B3/JK2 | QQYYS---------------------YPYT | 5743 |
| VK6\|A10/JK2 | | HQSSS---------------------LPYT | 5744 |
| MA_24-G6_CCx_I2C0x_scFc_(B1I)_translation Fv#1 | VK6\|A10/JK2 | HQWSS---------------------YPPT | 5745 |
| MA_24-G6x_I2C0x_scFc_(F1M)_translation Fv#1 | VK6\|A10/JK2 | HQWSS---------------------YPPT | 5746 |
| VK1\|L11/JK2 | | LQDYN---------------------YPYT | 5747 |
| MA_31-H8_CCx_I2C0x_scFc_(K4E)_translation Fv#1 | VK1\|L11/JK2 | QHHYG---------------------TPLT | 5748 |
| MA_31-H8x_I2C0x_scFc_(F9Z)_translation Fv#1 | VK1\|L11/JK2 | QHHYG---------------------TPLT | 5749 |
| VK2\|A19/JK5 | | MQALQ---------------------TPIT | 5750 |
| MA_32-A8_CCx_I2C0x_scFc_(A9E)_translation Fv#1 | VK2\|A19/JK5 | MQALQ---------------------TPPT | 5751 |
| MA_32-A8_x_I2C0x_scFc_(G6J)_translation Fv#1 | VK2\|A19/JK5 | MQALQ---------------------TPPT | 5752 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VK3\|A27/JK2 | | QQYGS--------------------SPYT | 5753 |
| MA_48-D12_CCx_I2C0x_scFc_(M9T)_ translation Fv#1 | VK3\|A27/JK2 | QQYGS--------------------SPLT | 5754 |
| VK2\|A19/JK3 | | MQALQ--------------------TPFT | 5755 |
| MA_50-D9_CCx_I2C0x_scFc_(K6S)_ translation Fv#1 | VK2\|A19/JK3 | MQALQ--------------------TPLT | 5756 |
| MA_78-A6x_I2C0x_scFc_(K6P)_ translation Fv#1 | VK2\|A19/JK3 | MQALQ--------------------TPFT | 5757 |
| VK2\|A19/JK4 | | MQALQ--------------------TPLT | 5758 |
| MA_50-D9x_I2C0x_scFc_(A4U)_ translation Fv#1 | VK2\|A19/JK4 | MQALQ--------------------TPLT | 5759 |
| VK2\|A19/JK1 | | MQALQ--------------------TPWT | 5760 |
| MA_78-A6_CCx_I2C0x_scFc_(D8Z)_ translation Fv#1 | VK2\|A19/JK1 | MQALQ--------------------TPFT | 5761 |
| VK1\|L19/JK3 | | QQANS--------------------FPFT | 5762 |
| MA_79-E3_CC_x_I2C0x_scFc_(E2Y)_ translation Fv#1 | VK1\|L19/JK3 | QQSYR--------------------TPPT | 5763 |
| VK1\|L19/JK1 | | QQANS--------------------FPWT | 5764 |
| MA_79-E3x_I2C0x_scFc_(N4F)_ translation Fv#1 | VK1\|L19/JK1 | QQSYR--------------------TPPT | 5765 |
| VK1\|A20/JK2 | | QKYNS--------------------APYT | 5766 |
| MA_83-F3_CCx_I2C0x_scFc_(G5K)_ translation Fv#1 | VK1\|A20/JK2 | QKYNS--------------------APWT | 5767 |
| MA_83-F3x_I2C0x_scFc_(B9A)_ translation Fv#1 | VK1\|A20/JK2 | QKYNS--------------------APWT | 5768 |
| VK2\|O1/JK5 | | MQRIE--------------------FPIT | 5769 |
| MA_84-G10_CC_x_I2C0x_scFc_(H9O)_ translation Fv#1 | VK2\|O1/JK5 | MQALQ--------------------TPIT | 5770 |
| MA_84-G10x_I2C0x_scFc_(Y4W)_ translation Fv#1 | VK2\|O1/JK5 | MQALQ--------------------TPIT | 5771 |
| | | K_FR4 | |
| VK3\|A27/JK4 | | FGGGTKVEIK | 5859 |
| MA_12-E12_CC_x_I2C0x_scFc_(E9U) translation Fv#1 | VK3\|A27/JK4 | FGCGTKVEIK | 5860 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_12-E12x_I2C0x_scFC_(W1U)_translation Fv#1 | VK3\|A27/JK4 | FGGGTKVEIK | 5861 |
| MA_48-D12x_I2C0x_scFc_(R9D)_translation Fv#1 | VK3\|A27/JK4 | FGGGTKLEIK | 5862 |
| VK1\|A20/JK1 | | FGQGTKVEIK | 5863 |
| MA_13-D8_CCx_I2C0x_scFc_(U7V)_translation Fv#1 | VK1\|A20/JK1 | FGCGTKVEIK | 5864 |
| MA_13-D8x_I2C0x_scFc_(M7M)_translation Fv#1 | VK1\|A20/JK1 | FGQGTKVEIK | 5865 |
| VK4\|B3/JK2 | | FGQGTKLEIK | 5866 |
| MA_24-C9_CCx_I2C0x_scFc_(I2U)_translation Fv#1 | VK4\|B3/JK2 | FGCGTKLELK | 5867 |
| MA_24-C9x_I2C0x_scFc_(L9Y)_translation Fv#1 | VK4\|B3/JK2 | FGGGTKLELK | 5868 |
| VK6\|A10/JK2 | | FGQGTKLEIK | 5869 |
| MA_24-G6_CCx_I2C0x_scFc_(B1I)_translation Fv#1 | VK6\|A10/JK2 | FGCGTKLEIK | 5870 |
| MA_24-G6x_I2C0x_scFc_(F1M)_translation Fv#1 | VK6\|A10/JK2 | FGSGTKLEIK | 5871 |
| VK1\|L11/JK2 | | FGQGTKLEIK | 5872 |
| MA_31-H8_CCx_I2C0x_scFc_(K4E)_translation Fv#1 | VK1\|L11/JK2 | FGCGTKLELK | 5873 |
| MA_31-H8x_I2C0x_scFc_(F9Z)_translation Fv#1 | VK1\|L11/JK2 | FGAGTKLELK | 5874 |
| VK2\|A19/JK5 | | FGQGTRLEIK | 5875 |
| MA_32-A8_CCx_I2C0x_scFc_(A9E)_translation Fv#1 | VK2\|A19/JK5 | FGCGTRLEIK | 5876 |
| MA_32-A8_x_I2C0x_scFc_(G6J)_translation Fv#1 | VK2\|A19/JK5 | FGQGTRLEIK | 5877 |
| VK3\|A27/JK2 | | FGQGTKLEIK | 5878 |
| MA_48-D12_CCx_I2C0x_scFc_(M9T)_translation Fv#1 | VK3\|A27/JK2 | FGCGTKLEIK | 5879 |
| VK2\|A19/JK3 | | FGPGTKVDIK | 5880 |
| MA_50-D9_CCx_I2C0x_scFc_(K6S)_translation Fv#1 | VK2\|A19/JK3 | FGCGTKVDIK | 5881 |
| MA_78-A6x_I2C0x_scFc_(K6P)_translation Fv#1 | VK2\|A19/JK3 | FGPGTKVEIK | 5882 |

TABLE 52-continued

BiTE-scFc Variable Region Protein Alignment_(MAGEB2)
CDRs defined by Kabat
Alignment numbering defined by Amgen Reference_(AHo)

| | | | SEQ ID NO: |
|---|---|---|---|
| VK2\|A19/JK4 | | FGGGTKVEIK | 5883 |
| MA_50-D9x_I2C0x_scFc_(A4U)_translation Fv#1 | VK2\|A19/JK4 | FGGGTKVDIK | 5884 |
| VK2\|A19/JK1 | | FGQGTKVEIK | 5885 |
| MA_78-A6_CCx_I2C0x_scFc_(D8Z)_translation Fv#1 | VK2\|A19/JK1 | FGCGTKVEIK | 5886 |
| VK1\|L19/JK3 | | FGPGTKVDIK | 5887 |
| MA_79-E3_CC_x_I2C0x_scFc_(E2Y)_translation Fv#1 | VK1\|L19/JK3 | FGCGTKVDIK | 5888 |
| VK1\|L19/JK1 | | FGQGTKVEIK | 5889 |
| MA_79-E3x_I2C0x_scFc_(N4F)_translation Fv#1 | VK1\|L19/JK1 | FGQGTKVDIK | 5890 |
| VK1\|A20/JK2 | | FGQGTKLEIK | 5891 |
| MA_83-F3_CCx_I2C0x scFc_(G5K)_translation Fv#1 | VK1\|A20/JK2 | FGCGTKLEIK | 5892 |
| MA_83-F3x_I2C0x_scFc_(B9A)_translation Fv#1 | VK1\|A20/JK2 | FGQGTKLEIK | 5893 |
| VK2\|O1/JK5 | | FGQGTRLEIK | 5894 |
| MA_84-G10_CC_x_I2C0x_scFc_(H9O)_translation Fv#1 | VK2\|O1/JK5 | FGCGTRLEIK | 5895 |
| MA_84-G10x_I2C0x_scFc_(Y4W)_translation Fv#1 | VK2\|O1/JK5 | FGQGTRLEIK | 5896 |

| LAMBDA_VARIABLE | | | |
|---|---|---|---|
| | Germline | | SEQ ID NO: |
| | | L_CDR3 | |
| VL7\|7a/JL3b | | LLYYG--------------------GAQWV | 5772 |
| MA_12-E12_CC_x_I2C0x_scFc_(E9U)_translation Fv#2 | VL7\|7a/JL3b | VLWYS--------------------NRWV | 5773 |
| MA_12-E12x_I2C0x_scFC_(W1U)_translation Fv#2 | VL7\|7a/JL3b | VLWYS--------------------NRWV | 5774 |
| MA_13-D8_CCx_I2C0x_scFc_(U7V)_translation Fv#2 | VL7\|7a/JL3b | VLWYS--------------------NRWV | 5775 |
| MA_13-D8x_I2C0x_scFc_(M7M)_translation Fv#2 | VL7\|7a/JL3b | VLWYS--------------------NRWV | 5776 |
| MA_24-C9_CCx_I2C0x_scFc_(I2U)_translation Fv#2 | VL7\|7a/JL3b | VLWYS--------------------NRWV | 5777 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_24-C9x_I2C0x_scFc_(L9Y)_translation Fv#2 | VL7\|7a/JL3b | VLWYS---------------------NRWV | 5778 |
| MA_24-G6_CCx_I2C0x_scFc_(B1I)_translation Fv#2 | VL7\|7a/JL3b | VLWYS---------------------NRWV | 5779 |
| MA_24-G6x_I2C0x_scFc_(F1M)_translation Fv#2 | VL7\|7a/JL3b | VLWYS---------------------NRWV | 5780 |
| MA_31-H8_CCx_I2C0x_scFc_(K4E)_translation Fv#2 | VL7\|7a/JL3b | VLWYS---------------------NRWV | 5781 |
| MA_31-H8x_I2C0x scFc_(F9Z)_translation Fv#2 | VL7\|7a/JL3b | VLWYS---------------------NRWV | 5782 |
| MA_32-A8_CCx_I2C0x_scFc_(A9E)_translation Fv#2 | VL7\|7a/JL3b | VLWYS---------------------NRWV | 5783 |
| MA_32-A8_x_I2C0x_scFc_(G6J)_translation Fv#2 | VL7\|7a/JL3b | VLWYS---------------------NRWV | 5784 |
| MA_48-D12_CCx_I2C0x_scFc_(M9T)_translation Fv#2 | VL7\|7a/JL3b | VLWYS---------------------NRWV | 5785 |
| MA_48-D12x_I2C0x_scFc_(R9D)_translation Fv#2 | VL7\|7a/JL3b | VLWYS---------------------NRWV | 5786 |
| MA_50-D9_CCx_I2C0x_scFc_(K6S)_translation Fv#2 | VL7\|7a/JL3b | VLWYS---------------------NRWV | 5787 |
| MA_50-D9x_I2C0x_scFc_(A4U)_translation Fv#2 | VL7\|7a/JL3b | VLWYS---------------------NRWV | 5788 |
| MA_78-A6_CCx_I2C0x_scFc_(D8Z)_translation Fv#2 | VL7\|7a/JL3b | VLWYS---------------------NRWV | 5789 |
| MA_78-A6x_I2C0x scFc_(K6P)_translation Fv#2 | VL7\|7a/JL3b | VLWYS---------------------NRWV | 5790 |
| MA_79-E3_CC_x_I2C0x_scFc_(E2Y)_translation Fv#2 | VL7\|7a/JL3b | VLWYS---------------------NRWV | 5791 |
| MA_79-E3x_I2C0x scFc_(N4F)_translation Fv#2 | VL7\|7a/JL3b | VLWYS---------------------NRWV | 5792 |
| MA_83-F3_CCx_I2C0x_scFc_(G5K)_translation Fv#2 | VL7\|7a/JL3b | VLWYS---------------------NRWV | 5793 |
| MA_83-F3x_I2C0x_scFc_(B9A)_translation Fv#2 | VL7\|7a/JL3b | VLWYS---------------------NRWV | 5794 |
| MA_84-G10_CC_x_I2C0x_scFc_(H9O)_translation Fv#2 | VL7\|7a/JL3b | VLWYS---------------------NRWV | 5795 |
| MA_84-G10x_I2C0x_scFc_(Y4W)_translation Fv#2 | VL7\|7a/JL3b | VLWYS---------------------NRWV | 5796 |

TABLE 52-continued

BiTE-scFc Variable Region Protein Alignment_(MAGEB2)
CDRs defined by Kabat
Alignment numbering defined by Amgen Reference_(AHo)

| | | L_FR4 | |
|---|---|---|---|
| VL7\|7a/JL3b | | FGGGTKLTVL | 5897 |
| MA_12-E12_CC_x_I2C0x_scFc_(E9U)_translation Fv#2 | VL7\|7a/JL3b | FGGGTKLTVL | 5898 |
| MA_12-E12x_I2C0x_scFC_(W1U)_translation Fv#2 | VL7\|7a/JL3b | FGGGTKLTVL | 5899 |
| MA_13-D8_CCx_I2C0x_scFc_(U7V)_translation Fv#2 | VL7\|7a/JL3b | FGGGTKLTVL | 5900 |
| MA_13-D8x_I2C0x_scFc_(M7M)_translation Fv#2 | VL7\|7a/JL3b | FGGGTKLTVL | 5901 |
| MA_24-C9_CCx_I2C0x_scFc_(I2U)_translation Fv#2 | VL7\|7a/JL3b | FGGGTKLTVL | 5902 |
| MA_24-C9x_I2C0x_scFc_(L9Y)_translation Fv#2 | VL7\|7a/JL3b | FGGGTKLTVL | 5903 |
| MA_24-G6_CCx_I2C0x_scFc_(B1I)_translation Fv#2 | VL7\|7a/JL3b | FGGGTKLTVL | 5904 |
| MA_24-G6x_I2C0x_scFc_(F1M)_translation Fv#2 | VL7\|7a/JL3b | FGGGTKLTVL | 5905 |
| MA_31-H8_CCx_I2C0x_scFc_(K4E)_translation Fv#2 | VL7\|7a/JL3b | FGGGTKLTVL | 5906 |
| MA_31-H8x_I2C0x scFc_(F9Z)_translation Fv#2 | VL7\|7a/JL3b | FGGGTKLTVL | 5907 |
| MA_32-A8_CCx_I2C0x_scFc_(A9E)_translation Fv#2 | VL7\|7a/JL3b | FGGGTKLTVL | 5908 |
| MA_32-A8_x_I2C0x_scFc_(G6J)_translation Fv#2 | VL7\|7a/JL3b | FGGGTKLTVL | 5909 |
| MA_48-D12_CCx_I2C0x_scFc_(M9T)_translation Fv#2 | VL7\|7a/JL3b | FGGGTKLTVL | 5910 |
| MA_48-D12x_I2C0x_scFc_(R9D)_translation Fv#2 | VL7\|7a/JL3b | FGGGTKLTVL | 5911 |
| MA_50-D9_CCx_I2C0x_scFc_(K6S)_translation Fv#2 | VL7\|7a/JL3b | FGGGTKLTVL | 5912 |
| MA_50-D9x_I2C0x_scFc_(A4U)_translation Fv#2 | VL7\|7a/JL3b | FGGGTKLTVL | 5913 |
| MA_78-A6_CCx_I2C0x_scFc_(D8Z)_translation Fv#2 | VL7\|7a/JL3b | FGGGTKLTVL | 5914 |
| MA_78-A6x_I2C0x scFc_(K6P)_translation Fv#2 | VL7\|7a/JL3b | FGGGTKLTVL | 5915 |

TABLE 52-continued

BiTE-scFc Variable Region Protein Alignment_(MAGEB2)
CDRs defined by Kabat
Alignment numbering defined by Amgen Reference_(AHo)

| | | | SEQ ID NO: |
|---|---|---|---|
| MA_79-E3_CC_x_I2C0x_scFc_(E2Y)_translation Fv#2 | VL7\|7a/JL3b | FGGGTKLTVL | 5916 |
| MA_79-E3x_I2C0x scFc_(N4F)_translation Fv#2 | VL7\|7a/JL3b | FGGGTKLTVL | 5917 |
| MA_83-F3_CCx_I2C0x_scFc_(G5K)_translation Fv#2 | VL7\|7a/JL3b | FGGGTKLTVL | 5918 |
| MA_83-F3x_I2C0x_scFc_(B9A)_translation Fv#2 | VL7\|7a/JL3b | FGGGTKLTVL | 5919 |
| MA_84-G10_CC_x_I2C0x_scFc_(H9O)_translation Fv#2 | VL7\|7a/JL3b | FGGGTKLTVL | 5920 |
| MA_84-G10x_I2C0x_scFc_(Y4W)_translation Fv#2 | VL7\|7a/JL3b | FGGGTKLTVL | 5921 |

| HEAVY VARIABLE | | | |
|---|---|---|---|
| | Germline | | SEQ ID NO: |
| | | H_CDR3 | |
| VH3\|3-21/D2\|2-15\|RF3/JH1 | | DIVVVAA--------------TAEYFQH | 5797 |
| MA_12-E12_CC_x_I2C0x_scFc_(E9U)_translation Fv#1 | VH3\|3-21/D2\|2-15\|RF3/JH1 | DRIAVA------------------TYFDN | 5798 |
| MA_12-E12x_I2C0x scFC_(W1U)_translation Fv#1 | VH3\|3-21/D2\|2-15\|RF3/JH1 | DRIAVA------------------TYFDN | 5799 |
| VH3\|3-73/D3\|3-3\|RF3/JH4 | | ITIFGVV-----------------IIYFDY | 5800 |
| MA_12-E12_CC_x_I2C0x_scFc_(E9U)_translation Fv#2 | VH3\|3-73/D3\|3-3\|RF3/JH4 | HGNFGNS-----------------YISYWAY | 5801 |
| MA_12-E12x_I2C0x_scFC_(W1U)_translation Fv#2 | VH3\|3-73/D3\|3-3\|RF3/JH4 | HGNFGNS-----------------YISYWAY | 5802 |
| MA_13-D8_CCx_I2C0x_scFc_(U7V)_translation Fv#2 | VH3\|3-73/D3\|3-3\|RF3/JH4 | HGNFGNS-----------------YISYWAY | 5803 |
| MA_13-D8x_I2C0x_scFc_(M7M)_translation Fv#2 | VH3\|3-73/D3\|3-3\|RF3/JH4 | HGNFGNS-----------------YISYWAY | 5804 |
| MA_24-C9_CCx_I2C0x_scFc_(I2U)_translation Fv#2 | VH3\|3-73/D3\|3-3\|RF3/JH4 | HGNFGNS-----------------YISYWAY | 5805 |
| MA_24-C9x_I2C0x_scFc_(L9Y)_translation Fv#2 | VH3\|3-73/D3\|3-3\|RF3/JH4 | HGNFGNS-----------------YISYWAY | 5806 |
| MA_24-G6_CCx_I2C0x_scFc_(B1I)_translation Fv#2 | VH3\|3-73/D3\|3-3\|RF3/JH4 | HGNFGNS-----------------YISYWAY | 5807 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_24-G6x_I2C0x_scFc_(F1M)_ translation Fv#2 | VH3\|3-73/D3\|3-3\|RF3/JH4 | HGNFGNS-----------------YISYWAY | 5808 |
| MA_31-H8_CCx_I2C0x_scFc_(K4E)_ translation Fv#2 | VH3\|3-73/D3\|3-3\|RF3/JH4 | HGNFGNS-----------------YISYWAY | 5809 |
| MA_31-H8x_I2C0x_scFc_(F9Z)_ translation Fv#2 | VH3\|3-73/D3\|3-3\|RF3/JH4 | HGNFGNS-----------------YISYWAY | 5810 |
| MA_32-A8_CCx_I2C0x_scFc_(A9E)_ translation Fv#2 | VH3\|3-73/D3\|3-3\|RF3/JH4 | HGNFGNS-----------------YISYWAY | 5811 |
| MA_32-A8_x_I2C0x_scFc_(G6J)_ translation Fv#2 | VH3\|3-73/D3\|3-3\|RF3/JH4 | HGNFGNS-----------------YISYWAY | 5812 |
| MA_48-D12_CCx_I2C0x_scFc_(M9T)_ translation Fv#2 | VH3\|3-73/D3\|3-3\|RF3/JH4 | HGNFGNS-----------------YISYWAY | 5813 |
| MA_48-D12x_I2C0x_scFc_(R9D)_ translation Fv#2 | VH3\|3-73/D3\|3-3\|RF3/JH4 | HGNFGNS-----------------YISYWAY | 5814 |
| MA_50-D9_CCx_I2C0x_scFc_(K6S)_ translation Fv#2 | VH3\|3-73/D3\|3-3\|RF3/JH4 | HGNFGNS-----------------YISYWAY | 5815 |
| MA_50-D9x_I2C0x_scFc_(A4U)_ translation Fv#2 | VH3\|3-73/D3\|3-3\|RF3/JH4 | HGNFGNS-----------------YISYWAY | 5816 |
| MA_78-A6_CCx_I2C0x_scFc_(D8Z)_ translation Fv#2 | VH3\|3-73/D3\|3-3\|RF3/JH4 | HGNFGNS-----------------YISYWAY | 5817 |
| MA_78-A6x_I2C0x_scFc_(K6P)_ translation Fv#2 | VH3\|3-73/D3\|3-3\|RF3/JH4 | HGNFGNS-----------------YISYWAY | 5818 |
| MA_79-E3_CC_x_I2C0x_scFc_(E2Y)_ translation Fv#2 | VH3\|3-73/D3\|3-3\|RF3/JH4 | HGNFGNS-----------------YISYWAY | 5819 |
| MA_79-E3x_I2C0x_scFc_(N4F)_ translation Fv#2 | VH3\|3-73/D3\|3-3\|RF3/JH4 | HGNFGNS-----------------YISYWAY | 5820 |
| MA_83-F3_CCx_I2C0x_scFc_(G5K)_ translation Fv#2 | VH3\|3-73/D3\|3-3\|RF3/JH4 | HGNFGNS-----------------YISYWAY | 5821 |
| MA_83-F3x_I2C0x_scFc_(B9A)_ translation Fv#2 | VH3\|3-73/D3\|3-3\|RF3/JH4 | HGNFGNS-----------------YISYWAY | 5822 |
| MA_84-G10_CC_x_I2C0x_scFc_(H9O)_ translation Fv#2 | VH3\|3-73/D3\|3-3\|RF3/JH4 | HGNFGNS-----------------YISYWAY | 5823 |
| MA_84-G10x_I2C0x_scFc_(Y4W)_ translation Fv#2 | VH3\|3-73/D3\|3-3\|RF3/JH4 | HGNFGNS-----------------YISYWAY | 5824 |
| | VH3\|3-23/D1\|1-1\|RF1/JH6 | GTTGTYY-----------------YYYGMDV | 5825 |
| MA_13-D8_CCx_I2C0x_scFc_(U7V)_ translation Fv#1 | VH3\|3-23/D1\|1-1\|RF1/JH6 | MVTPDY------------------YYDMDV | 5826 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_13-D8x_I2C0x_scFc_(M7M)_ translation Fv#1 | VH3\|3-23/D1\|1-1\|RF1/JH6 | MVTPDY------------------YYDMDV | 5827 |
| MA_79-E3_CC_x_I2C0x_scFc_(E2Y)_ translation Fv#1 | VH3\|3-23/D1\|1-1\|RF1/JH6 | MVTPDY------------------YYDMDV | 5828 |
| MA_79-E3x_I2C0x_scFc_(N4F)_ translation Fv#1 | VH3\|3-23/D1\|1-1\|RF1/JH6 | MVTPDY------------------YYDMDV | 5829 |
| VH1\|1-e/D2\|2-15\|RF3/JH4 | | DIVVVVA------------------ATYFDY | 5830 |
| MA_24-C9_CCx_I2C0x_scFc_(I2U)_ translation Fv#1 | VH1\|1-e/D2\|2-15\|RF3/JH4 | DGVFY------------------APLAY | 5831 |
| MA_24-C9x_I2C0x_scFc_(L9Y)_ translation Fv#1 | VH1\|1-e/D2\|2-15\|RF3/JH4 | DGVFY------------------APLAY | 5832 |
| VH1\|1-e/D5\|5-18\|RF3/JH4 | | GYSYG------------------YYFDY | 5833 |
| MA_24-G6_CCx_I2C0x_scFc_(B1I)_ translation Fv#1 | VH1\|1-e/D5\|5-18\|RF3/JH4 | GNYFGSS------------------EAYFDY | 5834 |
| MA_24-G6x_I2C0x_scFc_(F1M)_ translation Fv#1 | VH1\|1-e/D5\|5-18\|RF3/JH4 | GNYFGSS--------------------EAYFDY | 5835 |
| VH1\|1-e/D1\|1-1\|RF2/JH3 | | VQLER------------------DAFDI | 5836 |
| MA_31-H8_CCx_I2C0x_scFc_(K4E)_ translation Fv#1 | VH1\|1-e/D1\|1-1\|RF2/JH3 | RQLNHV------------------FAMDY | 5837 |
| MA_31-H8x_I2C0x_scFc_(F9Z)_ translation Fv#1 | VH1\|1-e/D1\|1-1\|RF2/JH3 | RQLNHV------------------FAMDY | 5838 |
| VH1\|1-08/D5\|5-18\|RF3/JH6 | | GYSYGYYY---------------YYYGMDV | 5839 |
| MA_32-A8_CCx_I2C0x_scFc_(A9E)_ translation Fv#1 | VH1\|1-08/D5\|5-18\|RF3/JH6 | GGGYSNG---------------YDYGMDV | 5840 |
| MA_32-A8_x_I2C0x_scFc_(G6J)_ translation Fv#1 | VH1\|1-08/D5\|5-18\|RF3/JH6 | GGGYSNG---------------YDYGMDV | 5841 |
| VH3\|3-30.3/D1\|1-1\|RF2/JH6 | | VQLERYY---------------YYYGMDV | 5842 |
| MA_48-D12_CCx_I2C0x_scFc_(M9T)_ translation Fv#1 | VH3\|3-30.3/D1\|1-1\|RF2/JH6 | EQWPNY------------------YYGMDV | 5843 |
| MA_48-D12x_I2C0x_scFc_(R9D)_ translation Fv#1 | VH3\|3-30.3/D1\|1-1\|RF2/JH6 | EQWPNY------------------YYGMDV | 5844 |
| VH6\|6-01/D3\|3-10\|RF1/JH6 | | VLLWFGELL*-----------YYYYYGMDV | 5845 & 5846 |
| MA_50-D9_CCx_I2C0x_scFc_(K6S)_ translation Fv#1 | VH6\|6-01/D3\|3-10\|RF1/JH6 | EILWFGKL--------------NYYYGMDV | 5847 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_50-D9x_I2C0x_scFc_(A4U)_ translation Fv#1 | VH6\|6-01/D3\|3-10\|RF1/JH6 | EILWFGKL-------------NYYYGMDV | 5848 |
| VH4\|4-34/D5\|5-18\|RF3/JH6 | | GYSYGYYY---------------YYYGMDV | 5849 |
| MA_78-A6_CCx_I2C0x_scFc_(D8Z)_ translation Fv#1 | VH4\|4-34/D5\|5-18\|RF3/JH6 | GGGYSDG----------------YDYGMDV | 5850 |
| MA_78-A6x_I2C0x_scFc_(K6P)_ translation Fv#1 | VH4\|4-34/D5\|5-18\|RF3/JH6 | GGGYSDG----------------YDYGMDV | 5851 |
| VH1\|1-02/D7\|7-27\|RF2/JH4 | | *LGY----------------------FDY | 5852 |
| MA_83-F3_CCx_I2C0x_scFc_(G5K)_ translation Fv#1 | VH1\|1-02/D7\|7-27\|RF2/JH4 | GLGIS---------------------FFDY | 5853 |
| MA_83-F3x_I2C0x_scFc_(B9A)_ translation Fv#1 | VH1\|1-02/D7\|7-27\|RF2/JH4 | GLGIS---------------------FFDY | 5854 |
| VH4\|4-30.1/D3\|3-10\|RF1/JH6 | | VLLWFGELL*-----------YYYYYGMDV | 5855 & 5856 |
| MA_84-G10_CC_x_I2C0x_scFc_(H9O)_ translation Fv#1 | VH4\|4-30.1/D3\|3-10\|RF1/JH6 | DKLWFGKL-------------NYYYGMDV | 5857 |
| MA_84-G10x_I2C0x_scFc_(Y4W)_ translation Fv#1 | VH4\|4-30.1/D3\|3-10\|RF1/JH6 | DKLWFGKL-------------NYYYGMDV | 5858 |

| | | H_FR4 | |
|---|---|---|---|
| VH3\|3-21/D2\|2-15\|RF3/JH1 | | WGQGTLVTVSS | 5922 |
| MA_12-E12_CC_x_I2C0x_scFc_(E9U)_ translation Fv#1 | VH3\|3-21/D2\|2-15\|RF3/JH1 | WGQGTLVTVSS | 5923 |
| MA_12-E12x_I2C0x_scFC_(W1U)_ translation Fv#1 | VH3\|3-21/D2\|2-15\|RF3/JH1 | WGQGTLVTVSS | 5924 |
| VH3\|3-73/D3\|3-3/RF3/JH4 | | WGQGTLVTVSS | 5925 |
| MA_12-E12_CC_x_I2C0x_scFc_(E9U)_ translation Fv#2 | VH3\|3-73/D3\|3-3\|RF3/JH4 | WGQGTLVTVSS | 5926 |
| MA_12-E12x_I2C0x_scFc_(W1U)_ translation Fv#2 | VH3\|3-73/D3\|3-3\|RF3/JH4 | WGQGTLVTVSS | 5927 |
| MA_13-D8_CCx_I2C0x_scFc_(U7V)_ translation Fv#2 | VH3\|3-73/D3\|3-3\|RF3/JH4 | WGQGTLVTVSS | 5928 |
| MA_13-D8x_I2C0x_scFc_(M7M)_ translation Fv#2 | VH3\|3-73/D3\|3-3\|RF3/JH4 | WGQGTLVTVSS | 5929 |
| MA_24-C9_CCx_I2C0x_scFc_(I2U)_ translation Fv#2 | VH3\|3-73/D3\|3-3\|RF3/JH4 | WGQGTLVTVSS | 5930 |
| MA_24-C9x_I2C0x_scFc_(L9Y)_ translation Fv#2 | VH3\|3-73/D3\|3-3\|RF3/JH4 | WGQGTLVTVSS | 5931 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_24-G6_CCx_I2C0x_scFc_(B1I)_ translation Fv#2 | VH3\|3-73/D3\|3-3\|RF3/JH4 | WGQGTLVTVSS | 5932 |
| MA_24-G6x_I2C0x_scFc_(F1M)_ translation Fv#2 | VH3\|3-73/D3\|3-3\|RF3/JH4 | WGQGTLVTVSS | 5933 |
| MA_31-H8_CCx_I2C0x_scFc_(K4E)_ translation Fv#2 | VH3\|3-73/D3\|3-3\|RF3/JH4 | WGQGTLVTVSS | 5934 |
| MA_31-H8x_I2C0x_scFc_(F9Z)_ translation Fv#2 | VH3\|3-73/D3\|3-3\|RF3/JH4 | WGQGTLVTVSS | 5935 |
| MA_32-A8_CCx_I2C0x_scFc_(A9E)_ translation Fv#2 | VH3\|3-73/D3\|3-3\|RF3/JH4 | WGQGTLVTVSS | 5936 |
| MA_32-A8_x_I2C0x_scFc_(G6J)_ translation Fv#2 | VH3\|3-73/D3\|3-3\|RF3/JH4 | WGQGTLVTVSS | 5937 |
| MA_48-D12_CCx_I2C0x_scFc_(M9T)_ translation Fv#2 | VH3\|3-73/D3\|3-3\|RF3/JH4 | WGQGTLVTVSS | 5938 |
| MA_48-D12x_I2C0x_scFc_(R9D)_ translation Fv#2 | VH3\|3-73/D3\|3-3\|RF3/JH4 | WGQGTLVTVSS | 5939 |
| MA_50-D9_CCx_I2C0x_scFc_(K6S)_ translation Fv#2 | VH3\|3-73/D3\|3-3\|RF3/JH4 | WGQGTLVTVSS | 5940 |
| MA_50-D9x_I2C0x_scFc_(A4U)_ translation Fv#2 | VH3\|3-73/D3\|3-3\|RF3/JH4 | WGQGTLVTVSS | 5941 |
| MA_78-A6_CCx_I2C0x_scFc_(D8Z)_ translation Fv#2 | VH3\|3-73/D3\|3-3\|RF3/JH4 | WGQGTLVTVSS | 5942 |
| MA_78-A6x_I2C0x_scFc_(K6P)_ translation Fv#2 | VH3\|3-73/D3\|3-3\|RF3/JH4 | WGQGTLVTVSS | 5943 |
| MA_79-E3_CC_x_I2C0x_scFc_(E2Y)_ translation Fv#2 | VH3\|3-73/D3\|3-3\|RF3/JH4 | WGQGTLVTVSS | 5944 |
| MA_79-E3x_I2C0x_scFc_(N4F)_ translation Fv#2 | VH3\|3-73/D3\|3-3\|RF3/JH4 | WGQGTLVTVSS | 5945 |
| MA_83-F3_CCx_I2C0x_scFc_(G5K)_ translation Fv#2 | VH3\|3-73/D3\|3-3\|RF3/JH4 | WGQGTLVTVSS | 5946 |
| MA_83-F3x_I2C0x_scFc_(B9A)_ translation Fv#2 | VH3\|3-73/D3\|3-3\|RF3/JH4 | WGQGTLVTVSS | 5947 |
| MA_84-G10_CC_x_I2C0x_scFc_(H9O)_ translation Fv#2 | VH3\|3-73/D3\|3-3\|RF3/JH4 | WGQGTLVTVSS | 5948 |
| MA_84-G10x_I2C0x_scFc_(Y4W)_ translation Fv#2 | VH3\|3-73/D3\|3-3\|RF3/JH4 | WGQGTLVTVSS | 5949 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| VH3\|3-23/D1\|1-1\|RF1/JH6 | | WGQGTTVTVSS | 5950 |
| MA_13-D8_CCx_I2C0x_scFc_(U7V)_translation Fv#1 | VH3\|3-23/D1\|1-1\|RF1/JH6 | WGQGTTVTVSS | 5951 |
| MA_13-D8x_I2C0x_scFc_(M7M)_translation Fv#1 | VH3\|3-23/D1\|1-1\|RF1/JH6 | WGQGTTVTVSS | 5952 |
| MA_79-E3_CC_x_I2C0x_scFc_(E2Y)_translation Fv#1 | VH3\|3-23/D1\|1-1\|RF1/JH6 | WGQGTTVTVSS | 5953 |
| MA_79-E3x_I2C0x_scFc_(N4F)_translation Fv#1 | VH3\|3-23/D1\|1-1\|RF1/JH6 | WGQGTTVTVSS | 5954 |
| VH1\|1-e/D2\|2-15\|RF3/JH4 | | WGQGTLVTVSS | 5955 |
| MA_24-C9_CCx_I2C0x_scFc_(I2U)_translation Fv#1 | VH1\|1-e/D2\|2-15\|RF3/JH4 | WGQGTLVTVSS | 5956 |
| MA_24-C9x_I2C0x_scFc_(L9Y)_translation Fv#1 | VH1\|1-e/D2\|2-15\|RF3/JH4 | WGQGTLVTVSS | 5957 |
| VH1\|1-e/D5\|5-18\|RF3/JH4 | | WGQGTLVTVSS | 5958 |
| MA_24-G6_CCx_I2C0x_scFc_(B1I)_translation Fv#1 | VH1\|1-e/D5\|5-18\|RF3/JH4 | WGQGTRVTVSS | 5959 |
| MA_24-G6x_I2C0x_scFc_(F1M)_translation Fv#1 | VH1\|1-e/D5\|5-18\|RF3/JH4 | WGQGTRVTVSS | 5960 |
| VH1\|1-e/D1\|1-1\|RF2/JH3 | | WGQGTMVTVSS | 5961 |
| MA_31-H8_CCx_I2C0x_scFc_(K4E)_translation Fv#1 | VH1\|1-e/D1\|1-1\|RF2/JH3 | WGQGTSVTVSS | 5962 |
| MA_31-H8x_I2C0x_scFc_(F9Z)_translation Fv#1 | VH1\|1-e/D1\|1-1\|RF2/JH3 | WGQGTSVTVSS | 5963 |
| VH1\|1-08/D5\|5-18\|RF3/JH6 | | WGQGTTVTVSS | 5964 |
| MA_32-A8_CCx_I2C0x_scFc_(A9E)_translation Fv#1 | VH1\|1-08/D5\|5-18\|RF3/JH6 | WGQGTTVTVSS | 5965 |
| MA_32-A8_x_I2C0x_scFc_(G6J)_translation Fv#1 | VH1\|1-08/D5\|5-18\|RF3/JH6 | WGQGTTVTVSS | 5966 |
| VH3\|3-30.3/D1\|1-1\|RF2/JH6 | | WGQGTTVTVSS | 5967 |
| MA_48-D12_CCx_I2C0x_scFc_(M9T)_translation Fv#1 | VH3\|3-30.3/D1\|1-1\|RF2/JH6 | WGQGTTVTVSS | 5968 |
| MA_48-D12x_I2C0x_scFc_(R9D)_translation Fv#1 | VH3\|3-30.3/D1\|1-1\|RF2/JH6 | WGQGTTVTVSS | 5969 |
| VH6\|6-01/D3\|3-10\|RF1/JH6 | | WGQGTTVTVSS | 5970 |
| MA_50-D9_CCx_I2C0x_scFc_(K6S)_translation Fv#1 | VH6\|6-01/D3\|3-10\|RF1/JH6 | WGQGTTVTVSS | 5971 |

TABLE 52-continued

BiTE-scFc Variable Region Protein Alignment_(MAGEB2)
CDRs defined by Kabat
Alignment numbering defined by Amgen Reference_(AHo)

| | | | |
|---|---|---|---|
| MA_50-D9x_I2C0x_scFc_(A4U)_translation Fv#1 | VH6\|6-01/D3\|3-10\|RF1/JH6 | WGQGTTVTVSS | 5972 |
| VH4\|4-34/D5\|5-18\|RF3/JH6 | | WGQGTTVTVSS | 5973 |
| MA_78-A6_CCx_I2C0x_scFc_(D8Z)_translation Fv#1 | VH4\|4-34/D5\|5-18\|RF3/JH6 | WGQGTTVTVSS | 5974 |
| MA_78-A6x_I2C0x_scFc_(K6P)_translation Fv#1 | VH4\|4-34/D5\|5-18\|RF3/JH6 | WGQGTTVTVSS | 5975 |
| VH1\|1-02/D7\|7-27\|RF2/JH4 | | WGQGTLVTVSS | 5976 |
| MA_83-F3_CCx_I2C0x_scFc_(G5K)_translation Fv#1 | VH1\|1-02/D7\|7-27\|RF2/JH4 | WGQGTLVTVSS | 5977 |
| MA_83-F3x_I2C0x_scFc_(B9A)_translation Fv#1 | VH1\|1-02/D7\|7-27\|RF2/JH4 | WGQGTLVTVSS | 5978 |
| VH4\|4-30.1/D3\|3-10\|RF1/JH6 | | WGQGTTVTVSS | 5979 |
| MA_84-G10_CC_x_I2C0x_scFc_(H9O)_translation Fv#1 | VH4\|4-30.1/D3\|3-10\|RF1/JH6 | WGQGTTVTVSS | 5980 |
| MA_84-G10x_I2C0x_scFc_(Y4W)_translation Fv#1 | VH4\|4-30.1/D3\|3-10\|RF1/JH6 | WGQGTTVTVSS | 5981 |

TABLE 53

BiTE-scFc Variable Region Consensus Protein Alignment (MAGEB2)
CDRs defined by Kabat
Alignment numbering defined by Amgen Reference (AHo)

KAPPA_VARIABLE

| | Germline | K_FR1 | SEQ ID NO: | K_CDR1 | SEQ ID NO: | K_FR2 | SEQ ID NO: |
|---|---|---|---|---|---|---|---|
| VK3\|A27/JK4 | | EIVLTQSPGTLSLSPGERATLSC | 5982 | RAS-QSVSS-----SYLA | 6105 | WYQQKPGQAPRLLIY | 6228 |
| MA_12-E12_CC_x_I2C0x_scFc_(E9U)_translation_Fv#1 | VK3\|A27/JK4 | ............................ | 5983 | .................. | 6106 | ............... | 6229 |
| MA_12-E12x_I2C0x_scFc_(W1U)_translation_Fv#1 | VK3\|A27/JK4 | ............................ | 5984 | .................. | 6107 | ............... | 6230 |
| MA_48-D12x_I2C0x_scFc_(R9D)_translation_Fv#1 | VK3\|A27/JK4 | ............................ | 5985 | .................. | 6108 | ............... | 6231 |
| VK1\|A20/JK1 | | DIQMTQSPSSLSASVGDRVTITC | 5986 | RAS-QGIS-----NYLA | 6109 | WYQQKPGKVPKLLIY | 6232 |
| MA_13-D8_CCx_I2C0x_scFc_(U7V)_translation_Fv#1 | VK1\|A20/JK1 | ............................ | 5987 | ........L........Q. | 6110 | ............... | 6233 |
| MA_13-D8x_I2C0x_scFc_(M7M)_translation_Fv#1 | VK1\|A20/JK1 | ............................ | 5988 | ........L........Q. | 6111 | ............... | 6234 |
| VK4\|B3/JK2 | | DIVMTQSPDSLAVSLGERATINC | 5989 | KSS-QSVLYSSNNKNYLA | 6112 | WYQQKPGQPPKLLIY | 6235 |
| MA_24-C9_CCx_I2C0x_scFc_(I2U)_translation_Fv#1 | VK4\|B3/JK2 | EL......S......V..KI.MS. | 5990 | .................. | 6113 | .........S..... | 6236 |
| MA_24-C9x_I2C0x_scFc_(L9Y)_translation_Fv#1 | VK4\|B3/JK2 | EL......S......V..KI.MS. | 5991 | .................. | 6114 | .........S..... | 6237 |
| VK6\|A10/JK2 | | EIVLTQSPDFQSVTPKEKVTITC | 5992 | RAS-QSIG-----SSLH | 6115 | WYQQKPDQSPKLLIK | 6238 |
| MA_24-G6_CCx_I2C0x_scFc_(B1I)_translation_Fv#1 | VK6\|A10/JK2 | .L......AIM.AS.GQ....... | 5993 | S...SNVN.......YI. | 6116 | .....LGS....W.Y | 6239 |

TABLE 53-continued

BiTE-scFc Variable Region Consensus Protein Alignment (MAGEB2)
CDRs defined by Kabat
Alignment numbering defined by Amgen Reference (AHo)

| | | | | | | | |
|---|---|---|---|---|---|---|---|
| MA_24-G6x_I2C0x_scFc_(F1M)_translation Fv#1 | VK6\|A10/JK2 | .L......AIM.AS.GQ...... | 5994 | S....SNVN......-YI. | 6117 | ....LGS.....W.Y | 6240 |
| VK1\|L11/JK2 | | AIQMTQSPSSLSASVGDRVTITC | 5995 | RAS-QGIR-----NDLG | 6118 | WYQQKPGKAPKLLIY | 6241 |
| MA_31-H8_CCx_I2C0x_scFc_(K4E)_translation Fv#1 | VK1\|L11/JK2 | EL......A.......ET.... | 5996 | ....GN.H......Y.A | 6119 | .....Q..S.Q..V. | 6242 |
| MA_31-H8x_I2C0x_scFc_(F9Z)_translation Fv#1 | VK1\|L11/JK2 | EL......A.......ET.... | 5997 | ....GN.H......Y.A | 6120 | .....Q..S.Q..V. | 6243 |
| VK2\|A19/JK5 | | DIVMTQSPLSLPVTPGEPASISC | 5998 | RSS--QSLLHSN-GYNYLD | 6121 | WVLQKPGQSPQLLIY | 6244 |
| MA_32-A8_CCx_I2C0x_scFc_(A9E)_translation Fv#1 | VK2\|A19/JK5 | .................S....... | 5999 | ........Y........V. | 6122 | ............... | 6245 |
| MA_32-A8_x_I2C0x_scFc_(G6J)_translation Fv#1 | VK2\|A19/JK5 | .................S....... | 6000 | ........Y........V. | 6123 | ............... | 6246 |
| VK3\|A27/JK2 | | EIVLTQSPGTLSLSPGERATLSC | 6001 | RAS-QSVSS-----SYLA | 6124 | WYQQKPGQAPRLLIY | 6247 |
| MA_48-D12_CCx_I2C0x_scFc_(_M9T)_translation Fv#1 | VK3\|A27/JK2 | ....................... | 6002 | ................... | 6125 | ............... | 6248 |
| VK2\|A19/JK3 | | DIVMTQSPLSLPVTPGEPASISC | 6003 | RSS--QSLLHSN-GYNYLD | 6126 | WVLQKPGQSPQLLIY | 6249 |
| MA_50-D9_CCx_I2C0x_scFc_(K6S)_translation Fv#1 | VK2\|A19/JK3 | ...L..............D..... | 6004 | ................... | 6127 | ............... | 6250 |
| MA_78-A6x_I2C0x_scFc_(K6P)_translation Fv#1 | VK2\|A19/JK3 | ...L..............S..... | 6005 | ........Y........V. | 6128 | ............... | 6251 |
| VK2\|A19/JK4 | | DIVMTQSPLSLPVTPGEPASISC | 6006 | RSS--QSLLHSN-GYNYLD | 6129 | WVLQKPGQSPQLLIY | 6252 |
| MA_50-D9x_I2C0x_scFc_(A4U)_translation Fv#1 | VK2\|A19/JK4 | ...L..............D..... | 6007 | ................... | 6130 | ............... | 6253 |

TABLE 53-continued

BiTE-scFc Variable Region Consensus Protein Alignment (MAGEB2)
CDRs defined by Kabat
Alignment numbering defined by Amgen Reference (AHo)

| Name | Chain | Seq1 | SeqID | Seq2 | SeqID | Seq3 | SeqID |
|---|---|---|---|---|---|---|---|
| VK2\|A19/JK1 | | DIVMTQSPLSLPVTPGEPASISC | 6008 | RSS--QSLLHSN-GYNYLD | 6131 | WYLQKPGQSPQLLIY | 6254 |
| MA_78-A6_CCx_I2C0x_scFc_(D8Z)_translation_Fv#1 | VK2\|A19/JK1 | ...L......... | 6009 | .......Y........V. | 6132 | ................ | 6255 |
| VK1\|L19/JK3 | | DIQMTQSPSSVSASVGDRVTITC | 6010 | RAS--QGIS-----SWLA | 6133 | WYQQKPGKAPKLLIY | 6256 |
| MA_79-E3_CC_x_I2C0x_scFc_(E2Y)_translation_Fv#1 | VK1\|L19/JK3 | ....................... | 6011 | ........S........Y.N | 6134 | ................ | 6257 |
| VK1\|L19/JK1 | | DIQMTQSPSSVSASVGDRVTITC | 6012 | RAS--QGIS-----SWLA | 6135 | WYQQKPGKAPKLLIY | 6258 |
| MA_79-E3x_I2C0x_scFc_(N4F)_translation_Fv#1 | VK1\|L19/JK1 | ....................... | 6013 | ........S........Y.N | 6136 | ...............S. | 6259 |
| VK1\|A20/JK2 | | DIQMTQSPSSLSASVGDRVTITC | 6014 | RAS--QGIS-----NYLA | 6137 | WYQQKPGKVPKLLIY | 6260 |
| MA_83-F3_CCx_I2C0x_scFc_(G5K)_translation_Fv#1 | VK1\|A20/JK2 | ....................... | 6015 | ................... | 6138 | ................ | 6261 |
| MA_83-F3x_I2C0x_scFc_(B9A)_translation_Fv#1 | VK1\|A20/JK2 | ....................... | 6016 | ................... | 6139 | ................ | 6262 |
| VK2\|O1/JK5 | | DIVMTQTPLSLPVTPGEPASISC | 6017 | RSS--QSLLDSDDGNTYLD | 6140 | WYLQKPGQSPQLLIY | 6263 |
| MA_84-G10_CC_x_I2C0x_scFc_(H9O)_translation_Fv#1 | VK2\|O1/JK5 | ....................... | 6018 | ........H.N-YN... | 6141 | ................ | 6264 |
| MA_84-G10x_I2C0x_scFc_(Y4W)_translation_Fv#1 | VK2\|O1/JK5 | ....................... | 6019 | ........H.N-YN... | 6142 | ................ | 6265 |

TABLE 53-continued

BiTE-scFc Variable Region Consensus Protein Alignment (MAGEB2)
CDRs defined by Kabat
Alignment numbering defined by Amgen Reference (AHo)

LAMBDA_VARIABLE

| Germline | L_FR1 | | L_CDR1 | | L_FR2 | |
|---|---|---|---|---|---|---|
| VL7|7a/JL3b | QTVVTQE-PSLTVSPGGTVTLTC | 6020 | ASST-GAVTSG---YYPN | 6143 | WFQQKPGQAPRALIY | 6266 |
| MA_12-E12_CC_x_I2C0x_scFc_(E9U)_translation Fv#2 | VL7|7a/JL3b | ................................ | 6021 | G................N... | 6144 | .V..................G..G | 6267 |
| MA_12-E12x_I2C0x_scFc_(W1U)_translation Fv#2 | VL7|7a/JL3b | ................................ | 6022 | G................N... | 6145 | .V..................G..G | 6268 |
| MA_13-D8_CCx_I2C0x_scFc_(U7V)_translation Fv#2 | VL7|7a/JL3b | ................................ | 6023 | G................N... | 6146 | .V..................G..G | 6269 |
| MA_13-D8x_I2C0x_scFc_(M7M)_translation Fv#2 | VL7|7a/JL3b | ................................ | 6024 | G................N... | 6147 | .V..................G..G | 6270 |
| MA_24-C9_CCx_I2C0x_scFc_(I2U)_translation Fv#2 | VL7|7a/JL3b | ................................ | 6025 | G................N... | 6148 | .V..................G..G | 6271 |
| MA_24-C9x_I2C0x_scFc_(L9Y)_translation Fv#2 | VL7|7a/JL3b | ................................ | 6026 | G................N... | 6149 | .V..................G..G | 6272 |
| MA_24-G6_CCx_I2C0x_scFc_(B1I)_translation Fv#2 | VL7|7a/JL3b | ................................ | 6027 | G................N... | 6150 | .V..................G..G | 6273 |
| MA_24-G6x_I2C0x_scFc_(F1M)_translation Fv#2 | VL7|7a/JL3b | ................................ | 6028 | G................N... | 6151 | .V..................G..G | 6274 |
| MA_31-H8_CCx_I2C0x_scFc_(K4E)_translation Fv#2 | VL7|7a/JL3b | ................................ | 6029 | G................N... | 6152 | .V..................G..G | 6275 |
| MA_31-H8x_I2C0x_scFc_(F9Z)_translation Fv#2 | VL7|7a/JL3b | ................................ | 6030 | G................N... | 6153 | .V..................G..G | 6276 |

TABLE 53-continued

BiTE-scFc Variable Region Consensus Protein Alignment (MAGEB2)
CDRs defined by Kabat
Alignment numbering defined by Amgen Reference (AHo)

| Name | | | | | | |
|---|---|---|---|---|---|---|
| MA_32-A8_CCx_I2C0x_scFc_(A9E)_translation Fv#2 | VL7\|7a/JL3b | 6031 | G................................N... | 6154 | .V................................G..G | 6277 |
| MA_32-A8_x_I2C0x_scFc_(G6J)_translation Fv#2 | VL7\|7a/JL3b | 6032 | G................................N... | 6155 | .V................................G..G | 6278 |
| MA_48-D12_CCx_I2C0x_scFc_(_M9T)_translation Fv#2 | VL7\|7a/JL3b | 6033 | G................................N... | 6156 | .V................................G..G | 6279 |
| MA_48-D12x_I2C0x_scFc_(R9D)_translation Fv#2 | VL7\|7a/JL3b | 6034 | G................................N... | 6157 | .V................................G..G | 6280 |
| MA_50-D9_CCx_I2C0x_scFc_(K6S)_translation Fv#2 | VL7\|7a/JL3b | 6035 | G................................N... | 6158 | .V................................G..G | 6281 |
| MA_50-D9x_I2C0x_scFc_(A4U)_translation Fv#2 | VL7\|7a/JL3b | 6036 | G................................N... | 6159 | .V................................G..G | 6282 |
| MA_78-A6_CCx_I2C0x_scFc_(D8Z)_translation Fv#2 | VL7\|7a/JL3b | 6037 | G................................N... | 6160 | .V................................G..G | 6283 |
| MA_78-A6x_I2C0x_scFc_(K6P)_translation Fv#2 | VL7\|7a/JL3b | 6038 | G................................N... | 6161 | .V................................G..G | 6284 |
| MA_79-E3_CC_x_I2C0x_scFc_(E2Y)_translation Fv#2 | VL7\|7a/JL3b | 6039 | G................................N... | 6162 | .V................................G..G | 6285 |
| MA_79-E3x_I2C0x_scFc_(N4F)_translation Fv#2 | VL7\|7a/JL3b | 6040 | G................................N... | 6163 | .V................................G..G | 6286 |
| MA_83-F3_CCx_I2C0x_scFc_(G5K)_translation Fv#2 | VL7\|7a/JL3b | 6041 | G................................N... | 6164 | .V................................G..G | 6287 |
| MA_83-F3x_I2C0x_scFc_(B9A)_translation Fv#2 | VL7\|7a/JL3b | 6042 | G................................N... | 6165 | .V................................G..G | 6288 |

TABLE 53-continued

BiTE-scFc Variable Region Consensus Protein Alignment (MAGEB2)
CDRs defined by Kabat
Alignment numbering defined by Amgen Reference (AHo)

| | Germline | H_FR1 | | H_CDR1 | | H_FR2 | |
|---|---|---|---|---|---|---|---|
| MA_84-G10_CC_x_I2C0x_scFc_(H9O)_translation Fv#2 | VL7\|7a/JL3b | | 6043 | G.........N... | 6166 | .V.........G..G | 6289 |
| MA_84-G10x_I2C0x_scFc_(Y4W)_translation Fv#2 | VL7\|7a/JL3b | | 6044 | G.........N... | 6167 | .V.........G..G | 6290 |
| | | HEAVY_VARIABLE | | | | | |
| | Germline | H_FR1 | | H_CDR1 | | H_FR2 | |
| VH3\|3-21\|D2\|2-15\|RF3/JH1 | | EVQLVES-GGGLVKPGGSLRLSCAASG-FTFS | 6045 | S-----YSMN | 6168 | WVRQAPGKGLEWVS | 6291 |
| MA_12-E12_CC_x_I2C0x_scFc_(E9U)_translation Fv#1 | VH3\|3-21\|D2\|2-15\|RF3/JH1 | .............................. | 6046 | T......... | 6169 | ........C..... | 6292 |
| MA_12-E12x_I2C0x_scFc_(W1U)_translation Fv#1 | VH3\|3-21\|D2\|2-15\|RF3/JH1 | .............................. | 6047 | T......... | 6170 | .............. | 6293 |
| VH3\|3-73/D3\|3-3\|RF3/JH4 | | EVQLVES-GGGLVQPGGSLKLSCAASG-FTFS | 6048 | G-----SAMH | 6171 | WVRQASGKGLEWVG | 6294 |
| MA_12-E12_CC_x_I2C0x_scFc_(E9U)_translation Fv#2 | VH3\|3-73/D3\|3-3\|RF3/JH4 | ...........................N | 6049 | K....Y..N | 6172 | .....P........A | 6295 |
| MA_12-E12x_I2C0x_scFc_(W1U)_translation Fv#2 | VH3\|3-73/D3\|3-3\|RF3/JH4 | ...........................N | 6050 | K....Y..N | 6173 | .....P........A | 6296 |
| MA_13-D8_CCx_I2C0x_scFc_(U7V)_translation Fv#2 | VH3\|3-73/D3\|3-3\|RF3/JH4 | ...........................N | 6051 | K....Y..N | 6174 | .....P........A | 6297 |
| MA_13-D8x_I2C0x_scFc_(M7M)_translation Fv#2 | VH3\|3-73/D3\|3-3\|RF3/JH4 | ...........................N | 6052 | K....Y..N | 6175 | .....P........A | 6298 |
| MA_24-C9_CCx_I2C0x_scFc_(I2U)_translation Fv#2 | VH3\|3-73/D3\|3-3\|RF3/JH4 | ...........................N | 6053 | K....Y..N | 6176 | .....P........A | 6299 |
| MA_24-C9x_I2C0x_scFc_(L9Y)_translation Fv#2 | VH3\|3-73/D3\|3-3\|RF3/JH4 | ...........................N | 6054 | K....Y..N | 6177 | .....P........A | 6300 |

TABLE 53-continued

BiTE-scFc Variable Region Consensus Protein Alignment (MAGEB2)
CDRs defined by Kabat
Alignment numbering defined by Amgen Reference (AHo)

| | | | | | | |
|---|---|---|---|---|---|---|
| MA_24-G6_CCx_I2C0x_scFc_(B1I)_translation_Fv#2 | VH3\|3-73/D3\|3-3\|RF3/JH4 | ........................N | 6055 | K.....Y..N | 6178 | .....P........A | 6301 |
| MA_24-G6x_I2C0x_scFc_(F1M)_translation_Fv#2 | VH3\|3-73/D3\|3-3\|RF3/JH4 | ........................N | 6056 | K.....Y..N | 6179 | .....P........A | 6302 |
| MA_31-H8_CCx_I2C0x_scFc_(K4E)_translation_Fv#2 | VH3\|3-73/D3\|3-3\|RF3/JH4 | ........................N | 6057 | K.....Y..N | 6180 | .....P........A | 6303 |
| MA_31-H8x_I2C0x_scFc_(F9Z)_translation_Fv#2 | VH3\|3-73/D3\|3-3\|RF3/JH4 | ........................N | 6058 | K.....Y..N | 6181 | .....P........A | 6304 |
| MA_32-A8_CCx_I2C0x_scFc_(A9E)_translation_Fv#2 | VH3\|3-73/D3\|3-3\|RF3/JH4 | ........................N | 6059 | K.....Y..N | 6182 | .....P........A | 6305 |
| MA_32-A8_x_I2C0x_scFc_(G6J)_translation_Fv#2 | VH3\|3-73/D3\|3-3\|RF3/JH4 | ........................N | 6060 | K.....Y..N | 6183 | .....P........A | 6306 |
| MA_48-D12_CCx_I2C0x_scFc_(_M9T)_translation_Fv#2 | VH3\|3-73/D3\|3-3\|RF3/JH4 | ........................N | 6061 | K.....Y..N | 6184 | .....P........A | 6307 |
| MA_48-D12x_I2C0x_scFc_(R9D)_translation_Fv#2 | VH3\|3-73/D3\|3-3\|RF3/JH4 | ........................N | 6062 | K.....Y..N | 6185 | .....P........A | 6308 |
| MA_50-D9_CCx_I2C0x_scFc_(K6S)_translation_Fv#2 | VH3\|3-73/D3\|3-3\|RF3/JH4 | ........................N | 6063 | K.....Y..N | 6186 | .....P........A | 6309 |
| MA_50-D9x_I2C0x_scFc_(A4U)_translation_Fv#2 | VH3\|3-73/D3\|3-3\|RF3/JH4 | ........................N | 6064 | K.....Y..N | 6187 | .....P........A | 6310 |
| MA_78-A6_CCx_I2C0x_scFc_(D8Z)_translation_Fv#2 | VH3\|3-73/D3\|3-3\|RF3/JH4 | ........................N | 6065 | K.....Y..N | 6188 | .....P........A | 6311 |
| MA_78-A6x_I2C0x_scFc_(K6P)_translation_Fv#2 | VH3\|3-73/D3\|3-3\|RF3/JH4 | ........................N | 6066 | K.....Y..N | 6189 | .....P........A | 6312 |

TABLE 53-continued

BiTE-scFc Variable Region Consensus Protein Alignment (MAGEB2)
CDRs defined by Kabat
Alignment numbering defined by Amgen Reference (AHo)

| | | | | | | | |
|---|---|---|---|---|---|---|---|
| MA_79-E3_CC_x_I2C0x_scFc_(E2Y)_translation Fv#2 | VH3\|3-73/D3\|3-3\|RF3/JH4 | ......................N | 6067 | K....Y.N | 6190 | ......P........A | 6313 |
| MA_79-E3x_I2C0x_scFc_(N4F)_translation Fv#2 | VH3\|3-73/D3\|3-3\|RF3/JH4 | ........................ | 6068 | K....Y.N | 6191 | ......P........A | 6314 |
| MA_83-F3_CCx_I2C0x_scFc_(G5K)_translation Fv#2 | VH3\|3-73/D3\|3-3\|RF3/JH4 | ........................ | 6069 | K....Y.N | 6192 | ......P........A | 6315 |
| MA_83-F3x_I2C0x_scFc_(B9A)_translation Fv#2 | VH3\|3-73/D3\|3-3\|RF3/JH4 | ........................ | 6070 | K....Y.N | 6193 | ......P........A | 6316 |
| MA_84-G10_CC_x_I2C0x_scFc_(H90)_translation Fv#2 | VH3\|3-73/D3\|3-3\|RF3/JH4 | ........................ | 6071 | K....Y.N | 6194 | ......P........A | 6317 |
| MA_84-G10x_I2C0x_scFc_(Y4W)_translation Fv#2 | VH3\|3-73/D3\|3-3\|RF3/JH4 | ........................ | 6072 | K....Y.N | 6195 | ......P........A | 6318 |
| VH3\|3-23/D1\|1-1\|RF1/JH6 | | EVQLLES-GGGLVQPGGSLRLSCAASG-FTFS | 6073 | S----YAMS | 6196 | WVRQAPGKGLEWVS | 6319 |
| MA_13-D8_CCx_I2C0x_scFc_(U7V)_translation Fv#1 | VH3\|3-23/D1\|1-1\|RF1/JH6 | ........................ | 6074 | .......F... | 6197 | ......C....... | 6320 |
| MA_13-D8x_I2C0x_scFc_(M7M)_translation Fv#1 | VH3\|3-23/D1\|1-1\|RF1/JH6 | ........................ | 6075 | .......F... | 6198 | .............. | 6321 |
| MA_79-E3_CC_x_I2C0x_scFc_(E2Y)_translation Fv#1 | VH3\|3-23/D1\|1-1\|RF1/JH6 | ........................ | 6076 | .......F... | 6199 | ......C....... | 6322 |
| MA_79-E3x_I2C0x_scFc_(N4F)_translation Fv#1 | VH3\|3-23/D1\|1-1\|RF1/JH6 | ........................ | 6077 | .......F... | 6200 | .............. | 6323 |
| VH1\|1-e/D2\|2-15\|RF3/JH4 | | QVQLVQS-GAEVKKPGSSVKVSCKASG-GTFS | 6078 | S----YAIS | 6201 | WVRQAPGQGLEWMG | 6324 |
| MA_24-C9_CCx_I2C0x_scFc_(I2U)_translation Fv#1 | VH1\|1-e/D2\|2-15\|RF3/JH4 | VQL.E..P.LV..A..I......YA.. | 6079 | K....SWMN | 6202 | ..K.R..KC...I. | 6325 |

TABLE 53-continued

BiTE-scFc Variable Region Consensus Protein Alignment (MAGEB2)
CDRs defined by Kabat
Alignment numbering defined by Amgen Reference (AHo)

| Name | Germline | Sequence 1 | SEQ ID | Sequence 2 | SEQ ID | Sequence 3 | SEQ ID |
|---|---|---|---|---|---|---|---|
| MA_24-C9x_I2C0x_scFc_(L9Y)_translation Fv#1 | VH1\|1-e/D2\|2-15\|RF3/JH4 | VQL.E....P.LV...A......YA.. | 6080 | K.....SWMN | 6203 | ..K.R..K....I. | 6326 |
| VH1\|1-e/D5\|5-18\|RF3/JH4 | | QVQLVQS-GAEVKKPGSSVKVSCKASG-GTFS | 6081 | S-----YAIS | 6204 | WVRQAPGQGLEWMG | 6327 |
| MA_24-G6_CCx_I2C0x_scFc_(B1I)_translation Fv#1 | VH1\|1-e/D5\|5-18\|RF3/JH4 | VQL.E....P.LV...A....I..D.Y... | 6082 | K.....SWMN | 6205 | ..K.R..EC....I. | 6328 |
| MA_24-G6x_I2C0x_scFc_(F1M)_translation Fv#1 | VH1\|1-e/D5\|5-18\|RF3/JH4 | VQL.E....P.LV...A....I..D.Y... | 6083 | K.....SWMN | 6206 | ..K.R..E....I. | 6329 |
| VH1\|1-e/D1\|1-1\|RF2/JH3 | | QVQLVQS-GAEVKKPGSSVKVSCKASG-GTFS | 6084 | S-----YAIS | 6207 | WVRQAPGQGLEWMG | 6330 |
| MA_31-H8_CCx_I2C0x_scFc_(K4E)_translation Fv#1 | VH1\|1-e/D1\|1-1\|RF2/JH3 | VQL.E....P.LV...A....I......YA.. | 6085 | .......SWMN | 6208 | ..K.R..KC....I. | 6331 |
| MA_31-H8x_I2C0x_scFc_(F9Z)_translation Fv#1 | VH1\|1-e/D1\|1-1\|RF2/JH3 | VQL.E....P.LV...A....I......YA.. | 6086 | .......SWMN | 6209 | ..K.R..KC....I. | 6332 |
| VH1\|1-08/D5\|5-18\|RF3/JH6 | | QVQLVQS-GAEVKKPGASVKVSCKASG-YTFT | 6087 | S-----YDIN | 6210 | WVRQATGQGLEWMG | 6333 |
| MA_32-A8_CCx_I2C0x_scFc_(A9E)_translation Fv#1 | VH1\|1-08/D5\|5-18\|RF3/JH6 | | 6088 | | 6211 | .......C...... | 6334 |
| MA_32-A8_x_I2C0x_scFc_(G6J)_translation Fv#1 | VH1\|1-08/D5\|5-18\|RF3/JH6 | | 6089 | | 6212 | | 6335 |
| VH3\|3-30.3/D1\|1-1\|RF2/JH6 | | QVQLVES-GGGVVQPGRSLRLSCAASG-FTFS | 6090 | S-----YAMH | 6213 | WVRQAPGKGLEWVA | 6336 |
| MA_48-D12_CCx_I2C0x_scFc_(_M9T)_translation Fv#1 | VH3\|3-30.3/D1\|1-1\|RF2/JH6 | ..............................R | 6091 | .......R.. | 6214 | .......C...... | 6337 |
| MA_48-D12x_I2C0x_scFc_(R9D)_translation Fv#1 | VH3\|3-30.3/D1\|1-1\|RF2/JH6 | ..............................R | 6092 | .......R.. | 6215 | ............... | 6338 |

TABLE 53-continued

BiTE-scFc Variable Region Consensus Protein Alignment (MAGEB2)
CDRs defined by Kabat
Alignment numbering defined by Amgen Reference (AHo)

| Name | V gene | Seq1 | SEQ ID | Seq2 | SEQ ID | Seq3 | SEQ ID |
|---|---|---|---|---|---|---|---|
| VH6\|6-01/D3\|3-10\|RF1/JH6 | | QVQLQQS-GPGLVKPSQTLSLTCAISG-DSVS | 6093 | SN---SAAWN | 6216 | WIRQSPSRGLEWLG | 6339 |
| MA_50-D9_CCx_I2C0x_scFc_(K6S)_translation Fv#1 | VH6\|6-01/D3\|3-10\|RF1/JH6 | ................................ | 6094 | .......... | 6217 | ........C..... | 6340 |
| MA_50-D9x_I2C0x_scFc_(A4U)_translation Fv#1 | VH6\|6-01/D3\|3-10\|RF1/JH6 | ................................ | 6095 | .......... | 6218 | .............. | 6341 |
| VH4\|4-34/D5\|5-18\|RF3/JH6 | | QVQLQQW-GAGLLKPSETLSLTCAVYG-GSFS | 6096 | G----YYWS | 6219 | WIRQPPGKGLEWIG | 6342 |
| MA_78-A6_CCx_I2C0x_scFc_(D8Z)_translation Fv#1 | VH4\|4-34/D5\|5-18\|RF3/JH6 | ................................ | 6097 | .........N | 6220 | ........C..... | 6343 |
| MA_78-A6x_I2C0x_scFc_(K6P)_translation Fv#1 | VH4\|4-34/D5\|5-18\|RF3/JH6 | ................................ | 6098 | .........N | 6221 | .............. | 6344 |
| VH1\|1-02/D7\|7-27\|RF2/JH4 | | QVQLVQS-GAEVKKPGASVKVSCKASG-YTFT | 6099 | G----YYMH | 6222 | WVRQAPGQGLEWMG | 6345 |
| MA_83-F3_CCx_I2C0x_scFc_(G5K)_translation Fv#1 | VH1\|1-02/D7\|7-27\|RF2/JH4 | ..........................S..... | 6100 | .......... | 6223 | ........C..... | 6346 |
| MA_83-F3x_I2C0x_scFc_(B9A)_translation Fv#1 | VH1\|1-02/D7\|7-27\|RF2/JH4 | ..........................S..... | 6101 | .......... | 6224 | .............. | 6347 |
| VH4\|4-30.1/D3\|3-10\|RF1/JH6 | | QVQLQES-GPGLVKPSQTLSLTCTVSG-GSIS | 6102 | SG--GYYWS | 6225 | WIRQHPGKGLEWIG | 6348 |
| MA_84-G10_CC_x_I2C0x_scFc_(H9O)_translation Fv#1 | VH4\|4-30.1/D3\|3-10\|RF1/JH6 | ..........................D..... | 6103 | RD..P.... | 6226 | ........C..... | 6349 |
| MA_84-G10x_I2C0x_scFc_(Y4W)_translation Fv#1 | VH4\|4-30.1/D3\|3-10\|RF1/JH6 | ..........................D..... | 6104 | RD..P.... | 6227 | .............. | 6350 |

TABLE 53-continued

BiTE-scFc Variable Region Consensus Protein Alignment (MAGEB2)
CDRs defined by Kabat
Alignment numbering defined by Amgen Reference (AHo)

KAPPA_VARIABLE

| | Germline | K_CDR2 | SEQ ID NO: K_FR3 | K_FR3 | SEQ ID NO: |
|---|---|---|---|---|---|
| VK3\|A27/JK4 | VK3\|A27/JK4 | G------ASSRAT | 6351 | GIPDRFSGSGSG-TDFTLTISRLEPEDFAVYYC | 6474 |
| MA_12-E12_CC_x_I2C0x_scFc_(E9U)_translation_Fv#1 | VK3\|A27/JK4 | .............. | 6352 | ................................ | 6475 |
| MA_12-E12x_I2C0x_scFc_(W1U)_translation_Fv#1 | VK3\|A27/JK4 | .............. | 6353 | ................................ | 6476 |
| MA_48-D12x_I2C0x_scFc_(R9D)_translation_Fv#1 | VK3\|A27/JK4 | .............. | 6354 | ................................ | 6477 |
| VK1\|A20/JK1 | VK1\|A20/JK1 | A------ASTLQS | 6355 | GVPSRFSGSGSG-TDFTLTISSLQPEDVATYYC | 6478 |
| MA_13-D8_CCx_I2C0x_scFc_(U7V)_translation_Fv#1 | VK1\|A20/JK1 | .............. | 6356 | ..........F..................... | 6479 |
| MA_13-D8x_I2C0x_scFc_(M7M)_translation_Fv#1 | VK1\|A20/JK1 | .............. | 6357 | ..........F..................... | 6480 |
| VK4\|B3/JK2 | VK4\|B3/JK2 | W------ASTRES | 6358 | GVPDRFSGSGSG-TDFTLTISSLQAEDVAVYYC | 6481 |
| MA_24-C9_CCx_I2C0x_scFc_(I2U)_translation_Fv#1 | VK4\|B3/JK2 | .............. | 6359 | ........T........VK...L......... | 6482 |
| MA_24-C9x_I2C0x_scFc_(L9Y)_translation_Fv#1 | VK4\|B3/JK2 | .............. | 6360 | ........T........VK...L......... | 6483 |
| VK6\|A10/JK2 | VK6\|A10/JK2 | Y------ASQSFS | 6361 | GVPSRFSGSGSG-TDFTLTINSLEAEDAATYYC | 6484 |
| MA_24-G6_CCx_I2C0x_scFc_(B1I)_translation_Fv#1 | VK6\|A10/JK2 | D........T.KLAP | 6362 | ...A.........SYS...S.M......S.F. | 6485 |

TABLE 53-continued

BiTE-scFc Variable Region Consensus Protein Alignment (MAGEB2)
CDRs defined by Kabat
Alignment numbering defined by Amgen Reference (AHo)

| Name | Germline | Sequence | | | |
|---|---|---|---|---|---|
| MA_24-G6x_I2C0x_scFc_(F1M)_translation Fv#1 | VK6\|A10/JK2 | D........T.KLAP | 6363 | ...A........SYS....<br>S.M.......S.F. | 6486 |
| VK1\|L11/JK2 | | A------ASSLQS | 6364 | GVPSRFSGSGSG-<br>TDFTLTISSLQPEDFATYYC | 6487 |
| MA_31-H8_CCx_I2C0x_scFc_(K4E)_translation Fv#1 | VK1\|L11/JK2 | N.........KT.AG | 6365 | N.......GS.... | Q.S.K. 6488 |
| MA_31-H8x_I2C0x_scFc_(F9Z)_translation Fv#1 | VK1\|L11/JK2 | N.........KT.AG | 6366 | N.......GS.... | Q.S.K. 6489 |
| VK2\|A19/JK5 | | L------GSNRAS | 6367 | GVPDRFSGSGSG--<br>TDFTLKISRVEAEDVGVYYC | 6490 |
| MA_32-A8_CCx_I2C0x_scFc_(A9E)_translation Fv#1 | VK2\|A19/JK5 | ............. | 6368 | .K.................. | 6491 |
| MA_32-A8_x_I2C0x_scFc_(G6J)_translation Fv#1 | VK2\|A19/JK5 | ............. | 6369 | .K.................. | 6492 |
| VK3\|A27/JK2 | | G------ASSRAT | 6370 | GIPDRFSGSGSG--<br>TDFTLTISRLEPEDFAVYYC | 6493 |
| MA_48-D12_CCx_I2C0x_scFc_(_M9T)_translation Fv#1 | VK3\|A27/JK2 | ............. | 6371 | .................... | 6494 |
| VK2\|A19/JK3 | | L------GSNRAS | 6372 | GVPDRFSGSGSG--<br>TDFTLKISRVEAEDVGVYYC | 6495 |
| MA_50-D9_CCx_I2C0x_scFc_(K6S)_translation Fv#1 | VK2\|A19/JK3 | ............. | 6373 | .................... | 6496 |
| MA_78-A6x_I2C0x_scFc_(K6P)_translation Fv#1 | VK2\|A19/JK3 | ............. | 6374 | .K.................. | 6497 |

TABLE 53-continued

BiTE-scFc Variable Region Consensus Protein Alignment (MAGEB2)
CDRs defined by Kabat
Alignment numbering defined by Amgen Reference (AHo)

| Name | V gene | | | | |
|---|---|---|---|---|---|
| VK2\|A19/JK4 | | L-------GSNRAS | 6375 | GVPDRFSGSGSG--TDFTLKISRVEAEDVGVYYC | 6498 |
| MA_50-D9x_I2C0x_scFc_(A4U)_translation_Fv#1 | VK2\|A19/JK4 | ................ | 6376 | ................ | 6499 |
| VK2\|A19/JK1 | | L-------GSNRAS | 6377 | GVPDRFSGSGSG--TDFTLKISRVEAEDVGVYYC | 6500 |
| MA_78-A6_CCx_I2C0x_scFc_(D8Z)_translation_Fv#1 | VK2\|A19/JK1 | ................ | 6378 | ....K........... | 6501 |
| VK1\|L19/JK3 | | A-------ASSLQS | 6379 | GVPSRFSGSGSG--TDFTLTISSLQPEDFATYYC | 6502 |
| MA_79-E3_CC_x_I2C0x_scFc_(E2Y)_translation_Fv#1 | VK1\|L19/JK3 | ................ | 6380 | ................ | 6503 |
| VK1\|L19/JK1 | | A-------ASSLQS | 6381 | GVPSRFSGSGSG--TDFTLTISSLQPEDFATYYC | 6504 |
| MA_79-E3x_I2C0x_scFc_(N4F)_translation_Fv#1 | VK1\|L19/JK1 | ................ | 6382 | ................ | 6505 |
| VK1\|A20/JK2 | | A-------ASTLQS | 6383 | GVPSRFSGSGSG--TDFTLTISSLQPEDVATYYC | 6506 |
| MA_83-F3_CCx_I2C0x_scFc_(G5K)_translation_Fv#1 | VK1\|A20/JK2 | ................ | 6384 | ................ | 6507 |
| MA_83-F3x_I2C0x_scFc_(B9A)_translation_Fv#1 | VK1\|A20/JK2 | ................ | 6385 | ................ | 6508 |
| VK2\|O1/JK5 | | T-------LSYRAS | 6386 | GVPDRFSGSGSG--TDFTLKISRVEAEDVGVYYC | 6509 |
| MA_84-G10_CC_x_I2C0x_scFc_(H9O)_translation_Fv#1 | VK2\|O1/JK5 | L........G.N... | 6387 | ................ | 6510 |

TABLE 53-continued

BiTE-scFc Variable Region Consensus Protein Alignment (MAGEB2)
CDRs defined by Kabat
Alignment numbering defined by Amgen Reference (AHo)

| | | | | | | |
|---|---|---|---|---|---|---|
| MA_84-G10x_I2C0x_scFc_(Y4W)_translation Fv#1 | VK2\|O1/JK5 | L........G.N... | 6388 | ........................ | 6511 | |

LAMBDA_VARIABLE

| | Germline | L_CDR2 | | L_FR3 | |
|---|---|---|---|---|---|
| VL7\|7a/JL3b | | S------TSNKHS | 6389 | WTPARFSGSLLG--GKAALTLSGVQPEDEAEYYC | 6512 |
| MA_12-E12_CC_x_I2C0x_scFc_(E9U)_translation Fv#2 | VL7\|7a/JL3b | G..........KFLAP | 6390 | G.................................. | 6513 |
| MA_12-E12x_I2C0x_scFc_(W1U)_translation Fv#2 | VL7\|7a/JL3b | G..........KFLAP | 6391 | G.................................. | 6514 |
| MA_13-D8_CCx_I2C0x_scFc_(U7V)_translation Fv#2 | VL7\|7a/JL3b | G..........KFLAP | 6392 | G.................................. | 6515 |
| MA_13-D8x_I2C0x_scFc_(M7M)_translation Fv#2 | VL7\|7a/JL3b | G..........KFLAP | 6393 | G.................................. | 6516 |
| MA_24-C9_CCx_I2C0x_scFc_(I2U)_translation Fv#2 | VL7\|7a/JL3b | G..........KFLAP | 6394 | G.................................. | 6517 |
| MA_24-C9x_I2C0x_scFc_(L9Y)_translation Fv#2 | VL7\|7a/JL3b | G..........KFLAP | 6395 | G.................................. | 6518 |
| MA_24-G6_CCx_I2C0x_scFc_(B1I)_translation Fv#2 | VL7\|7a/JL3b | G..........KFLAP | 6396 | G.................................. | 6519 |
| MA_24-G6x_I2C0x_scFc_(F1M)_translation Fv#2 | VL7\|7a/JL3b | G..........KFLAP | 6397 | G.................................. | 6520 |
| MA_31-H8_CCx_I2C0x_scFc_(K4E)_translation Fv#2 | VL7\|7a/JL3b | G..........KFLAP | 6398 | G.................................. | 6521 |

TABLE 53-continued

BiTE-scFc Variable Region Consensus Protein Alignment (MAGEB2)
CDRs defined by Kabat
Alignment numbering defined by Amgen Reference (AHo)

| | | | | |
|---|---|---|---|---|
| MA_31-H8x_I2C0x_scFc_(F9Z)_translation Fv#2 | VL7\|7a/JL3b | G..........KFLAP | 6399 | 6522 |
| MA_32-A8_CCx_I2C0x_scFc_(A9E)_translation Fv#2 | VL7\|7a/JL3b | G..........KFLAP | 6400 | 6523 |
| MA_32-A8_x_I2C0x_scFc_(G6J)_translation Fv#2 | VL7\|7a/JL3b | G..........KFLAP | 6401 | 6524 |
| MA_48-D12_CCx_I2C0x_scFc_(_M9T)_translation Fv#2 | VL7\|7a/JL3b | G..........KFLAP | 6402 | 6525 |
| MA_48-D12x_I2C0x_scFc_(R9D)_translation Fv#2 | VL7\|7a/JL3b | G..........KFLAP | 6403 | 6526 |
| MA_50-D9_CCx_I2C0x_scFc_(K6S)_translation Fv#2 | VL7\|7a/JL3b | G..........KFLAP | 6404 | 6527 |
| MA_50-D9x_I2C0x_scFc_(A4U)_translation Fv#2 | VL7\|7a/JL3b | G..........KFLAP | 6405 | 6528 |
| MA_78-A6_CCx_I2C0x_scFc_(D8Z)_translation Fv#2 | VL7\|7a/JL3b | G..........KFLAP | 6406 | 6529 |
| MA_78-A6x_I2C0x_scFc_(K6P)_translation Fv#2 | VL7\|7a/JL3b | G..........KFLAP | 6407 | 6530 |
| MA_79-E3_CC_x_I2C0x_scFc_(E2Y)_translation Fv#2 | VL7\|7a/JL3b | G..........KFLAP | 6408 | 6531 |
| MA_79-E3x_I2C0x_scFc_(N4F)_translation Fv#2 | VL7\|7a/JL3b | G..........KFLAP | 6409 | 6532 |
| MA_83-F3_CCx_I2C0x_scFc_(G5K)_translation Fv#2 | VL7\|7a/JL3b | G..........KFLAP | 6410 | 6533 |

TABLE 53-continued

BiTE-scFc Variable Region Consensus Protein Alignment (MAGEB2)
CDRs defined by Kabat
Alignment numbering defined by Amgen Reference (AHo)

| | Germline | | | |
|---|---|---|---|---|
| MA_83-F3x_I2C0x_scFc_(B9A)_translation Fv#2 | VL7\|7a/JL3b | G........KPLAP | 6411 | 6534 |
| MA_84-G10_CC_x_I2C0x_scFc_(H9O)_translation Fv#2 | VL7\|7a/JL3b | G........KPLAP | 6412 | 6535 |
| MA_84-G10x_I2C0x_scFc_(Y4W)_translation Fv#2 | VL7\|7a/JL3b | G........KPLAP | 6413 | 6536 |

HEAVY_VARIABLE

| | Germline | H_CDR2 | | H_FR3 | |
|---|---|---|---|---|---|
| VH3\|3-21/D2\|2-15\|RF3/JH1 | | SISSS---SSYIYYADSVKG | 6414 | RFTISRDNAKNSLYLQMNSLR AEDTAVYYCAR | 6537 |
| MA_12-E12_CC_x_I2C0x_scFc_(E9U)_translation Fv#1 | VH3\|3-21/D2\|2-15\|RF3/JH1 | ................ | 6415 | ........D............ | 6538 |
| MA_12-E12x_I2C0x_scFc_(W1U)_translation Fv#1 | VH3\|3-21/D2\|2-15\|RF3/JH1 | ................ | 6416 | ........D............ | 6539 |
| VH3\|3-73/D3\|3-3\|RF3/JH4 | | RIRSKA-NSYATAYAASVKG | 6417 | RFTISRDDSKNTAYLQMNSLK TEDTAVYYCTR | 6540 |
| MA_12-E12_CC_x_I2C0x_scFc_(E9U)_translation Fv#2 | VH3\|3-73/D3\|3-3\|RF3/JH4 | .....Y.N...Y..D...D | 6418 | ..........N.. ..........V. | 6541 |
| MA_12-E12x_I2C0x_scFc_(W1U)_translation Fv#2 | VH3\|3-73/D3\|3-3\|RF3/JH4 | .....Y.N...Y..D...D | 6419 | ..........N.. ..........V. | 6542 |
| MA_13-D8_CCx_I2C0x_scFc_(U7V)_translation Fv#2 | VH3\|3-73/D3\|3-3\|RF3/JH4 | .....Y.N...Y..D...D | 6420 | ..........N.. ..........V. | 6543 |
| MA_13-D8x_I2C0x_scFc_(M7M)_translation Fv#2 | VH3\|3-73/D3\|3-3\|RF3/JH4 | .....Y.N...Y..D...D | 6421 | ..........N.. ..........V. | 6544 |

TABLE 53-continued

BiTE-scFc Variable Region Consensus Protein Alignment (MAGEB2)
CDRs defined by Kabat
Alignment numbering defined by Amgen Reference (AHo)

| | | | | |
|---|---|---|---|---|
| MA_24-C9_CCx_I2C0x_scFc_(I2U)_translation Fv#2 | VH3\|3-73/D3\|3-3\|RF3/JH4 | 6422 | ......Y.N...Y...D...D | ..........V. ........N.. 6545 |
| MA_24-C9x_I2C0x_scFc_(L9Y)_translation Fv#2 | VH3\|3-73/D3\|3-3\|RF3/JH4 | 6423 | ......Y.N...Y...D...D | ..........V. ........N.. 6546 |
| MA_24-G6_CCx_I2C0x_scFc_(B1I)_translation Fv#2 | VH3\|3-73/D3\|3-3\|RF3/JH4 | 6424 | ......Y.N...Y...D...D | ..........V. ........N.. 6547 |
| MA_24-G6x_I2C0x_scFc_(F1M)_translation Fv#2 | VH3\|3-73/D3\|3-3\|RF3/JH4 | 6425 | ......Y.N...Y...D...D | ..........V. ........N.. 6548 |
| MA_31-H8_CCx_I2C0x_scFc_(K4E)_translation Fv#2 | VH3\|3-73/D3\|3-3\|RF3/JH4 | 6426 | ......Y.N...Y...D...D | ..........V. ........N.. 6549 |
| MA_31-H8x_I2C0x_scFc_(F9Z)_translation Fv#2 | VH3\|3-73/D3\|3-3\|RF3/JH4 | 6427 | ......Y.N...Y...D...D | ..........V. ........N.. 6550 |
| MA_32-A8_CCx_I2C0x_scFc_(A9E)_translation Fv#2 | VH3\|3-73/D3\|3-3\|RF3/JH4 | 6428 | ......Y.N...Y...D...D | ..........V. ........N.. 6551 |
| MA_32-A8x_I2C0x_scFc_(G6J)_translation Fv#2 | VH3\|3-73/D3\|3-3\|RF3/JH4 | 6429 | ......Y.N...Y...D...D | ..........V. ........N.. 6552 |
| MA_48-D12_CCx_I2C0x_scFc_(_M9T)_translation Fv#2 | VH3\|3-73/D3\|3-3\|RF3/JH4 | 6430 | ......Y.N...Y...D...D | ..........V. ........N.. 6553 |
| MA_48-D12x_I2C0x_scFc_(R9D)_translation Fv#2 | VH3\|3-73/D3\|3-3\|RF3/JH4 | 6431 | ......Y.N...Y...D...D | ..........V. ........N.. 6554 |
| MA_50-D9_CCx_I2C0x_scFc_(K6S)_translation Fv#2 | VH3\|3-73/D3\|3-3\|RF3/JH4 | 6432 | ......Y.N...Y...D...D | ..........V. ........N.. 6555 |
| MA_50-D9x_I2C0x_scFc_(A4U)_translation Fv#2 | VH3\|3-73/D3\|3-3\|RF3/JH4 | 6433 | ......Y.N...Y...D...D | ..........V. ........N.. 6556 |

TABLE 53-continued

BiTE-scFc Variable Region Consensus Protein Alignment (MAGEB2)
CDRs defined by Kabat
Alignment numbering defined by Amgen Reference (AHo)

| Name | Germline | | Sequence | | | |
|---|---|---|---|---|---|---|
| MA_78-A6_CCx_I2C0x_scFc_(D8Z)_translation Fv#2 | VH3\|3-73/D3\|3-3\|RF3/JH4 | 6434 | .....Y.N...Y..D...D | | .........................N.. | 6557 |
| MA_78-A6x_I2C0x_scFc_(K6P)_translation Fv#2 | VH3\|3-73/D3\|3-3\|RF3/JH4 | 6435 | .....Y.N...Y..D...D | | ..........V..............N.. | 6558 |
| MA_79-E3_CC_x_I2C0x_scFc_(E2Y)_translation Fv#2 | VH3\|3-73/D3\|3-3\|RF3/JH4 | 6436 | .....Y.N...Y..D...D | | ..........V..............N.. | 6559 |
| MA_79-E3x_I2C0x_scFc_(N4F)_translation Fv#2 | VH3\|3-73/D3\|3-3\|RF3/JH4 | 6437 | .....Y.N...Y..D...D | | ..........V..............N.. | 6560 |
| MA_83-F3_CCx_I2C0x_scFc_(G5K)_translation Fv#2 | VH3\|3-73/D3\|3-3\|RF3/JH4 | 6438 | .....Y.N...Y..D...D | | ..........V..............N.. | 6561 |
| MA_83-F3x_I2C0x_scFc_(B9A)_translation Fv#2 | VH3\|3-73/D3\|3-3\|RF3/JH4 | 6439 | .....Y.N...Y..D...D | | ..........V..............N.. | 6562 |
| MA_84-G10_CC_x_I2C0x_scFc_(H9O)_translation Fv#2 | VH3\|3-73/D3\|3-3\|RF3/JH4 | 6440 | .....Y.N...Y..D...D | | ..........V..............N.. | 6563 |
| MA_84-G10x_I2C0x_scFc_(Y4W)_translation Fv#2 | VH3\|3-73/D3\|3-3\|RF3/JH4 | 6441 | .....Y.N...Y..D...D | | ..........V..............N.. | 6564 |
| VH3\|3-23/D1\|1-1\|RF1/JH6 | | 6442 | AISGS--GGSTYYADSVKG | | RFTISRDNSKNTLYLQMNSLR AEDTAVYYCAK | 6565 |
| MA_13-D8_CCx_I2C0x_scFc_(U7V)_translation Fv#1 | VH3\|3-23/D1\|1-1\|RF1/JH6 | 6443 | | | .....E.................. | 6566 |
| MA_13-D8x_I2C0x_scFc_(M7M)_translation Fv#1 | VH3\|3-23/D1\|1-1\|RF1/JH6 | 6444 | | | .....E.................. | 6567 |
| MA_79-E3_CC_x_I2C0x_scFc_(E2Y)_translation Fv#1 | VH3\|3-23/D1\|1-1\|RF1/JH6 | 6445 | | | .....E.................. | 6568 |

TABLE 53-continued

BiTE-scFc Variable Region Consensus Protein Alignment (MAGEB2)
CDRs defined by Kabat
Alignment numbering defined by Amgen Reference (AHo)

| Name | Germline | Sequence 1 | SEQ | Sequence 2 | SEQ |
|---|---|---|---|---|---|
| MA_79-E3x_I2C0x_scFc_(N4F)_translation Fv#1 | VH3\|3-23/D1\|1-1\|RF1/JH6 | .................................... | 6446 | ......E......................... 6569 | |
| VH1\|1-e/D2\|2-15\|RF3/JH4 | | GIIPI---FGTANYAQKFQG | 6447 | RVTITADKSTSTAYMELSSLR SEDTAVYYCAR | 6570 |
| MA_24-C9_CCx_I2C0x_scFc_(I2U)_translation Fv#1 | VH1\|1-e/D2\|2-15\|RF3/JH4 | R..Y.G...D.DT..NG..K. | 6448 | KAAL.....SN..N.Q.N..T ...S...F... | 6571 |
| MA_24-C9x_I2C0x_scFc_(L9Y)_translation Fv#1 | VH1\|1-e/D2\|2-15\|RF3/JH4 | R..Y.G...D.DT..NG..K. | 6449 | KAAL.....SN..N.Q.N..T ...S...F... | 6572 |
| VH1\|1-e/D5\|5-18\|RF3/JH4 | | GIIPI---FGTANYAQKFQG | 6450 | RVTITADKSTSTAYMELSSLR SEDTAVYYCAR | 6573 |
| MA_24-G6_CCx_I2C0x_scFc_(B1I)_translation Fv#1 | VH1\|1-e/D5\|5-18\|RF3/JH4 | RVW.G....D.DTT.NE..K. | 6451 | KA.L.....SR......Q....T ...S...F... | 6574 |
| MA_24-G6x_I2C0x_scFc_(F1M)_translation Fv#1 | VH1\|1-e/D5\|5-18\|RF3/JH4 | RVW.G....D.DTT.NE..K. | 6452 | KA.L.....SR......Q....T ...S...F... | 6575 |
| VH1\|1-e/D1\|1-1\|RF2/JH3 | | GIIPI---FGTANYAQKFQG | 6453 | RVTITADKSTSTAYMELSSLR SEDTAVYYCAR | 6576 |
| MA_31-H8_CCx_I2C0x_scFc_(K4E)_translation Fv#1 | VH1\|1-e/D1\|1-1\|RF2/JH3 | R..Y.G...D.DT..NG..KD | 6454 | KA.L.....SN......Q....T ...S...F... | 6577 |
| MA_31-H8x_I2C0x_scFc_(F9Z)_translation Fv#1 | VH1\|1-e/D1\|1-1\|RF2/JH3 | R..Y.G...D.DT..NG..KD | 6455 | KA.L.....SN......Q....T ...S...F... | 6578 |
| MA_32-A8_CCx_I2C0x_scFc_(A9E)_translation Fv#1 | VH1\|1-08/D5\|5-18\|RF3/JH6 | WMNPN---SGNTGYAQKFQG | 6456 | RVTMTRNTSISTAYMELSSLR SEDTAVYYCAR | 6579 |
| MA_32-A8_x_I2C0x_scFc_(G6J)_translation Fv#1 | VH1\|1-08/D5\|5-18\|RF3/JH6 | .................... | 6457 | .................... | 6580 |
| | | .................... | 6458 | .................... | 6581 |

TABLE 53-continued

BiTE-scFc Variable Region Consensus Protein Alignment (MAGEB2)
CDRs defined by Kabat
Alignment numbering defined by Amgen Reference (AHo)

| | | | | | |
|---|---|---|---|---|---|
| VH3\|3-30.3/D1\|1-1\|RF2/JH6 | | VISYD---GSNKYYADSVKG | | RFTISRDNSKNTLYLQMNSLR AEDTAVYYCAR | 6459 / 6582 |
| MA_48-D12_CCx_I2C0x_scFc_(M9T)_translation Fv#1 | VH3\|3-30.3/D1\|1-1\|RF2/JH6 | .........G......... | 6460 | ...................... | 6583 |
| MA_48-D12x_I2C0x_scFc_(R9D)_translation Fv#1 | VH3\|3-30.3/D1\|1-1\|RF2/JH6 | .........G......... | 6461 | ...................... | 6584 |
| VH6\|6-01/D3\|3-10\|RF1/JH6 | | RTYYR--SKWYNDYAVSVKS | | RITINPDTSKNQFSLQLNSVT PEDTAVYYCAR | 6462 / 6585 |
| MA_50-D9_CCx_I2C0x_scFc_(K6S)_translation Fv#1 | VH6\|6-01/D3\|3-10\|RF1/JH6 | .................... | 6463 | .......V.............. | 6586 |
| MA_50-D9x_I2C0x_scFc_(A4U)_translation Fv#1 | VH6\|6-01/D3\|3-10\|RF1/JH6 | .................... | 6464 | .......V.............. | 6587 |
| VH4\|4-34/D5\|5-18\|RF3/JH6 | | EINH---SGSTNYNPSLKS | | RVTISVDTSKNQFSLKLSVT AADTAVYYCAR | 6465 / 6588 |
| MA_78-A6_CCx_I2C0x_scFc_(D8Z)_translation Fv#1 | VH4\|4-34/D5\|5-18\|RF3/JH6 | ...........R........ | 6466 | ........A............. | 6589 |
| MA_78-A6x_I2C0x_scFc_(K6P)_translation Fv#1 | VH4\|4-34/D5\|5-18\|RF3/JH6 | ...........R........ | 6467 | ........A............. | 6590 |
| VH1\|1-02/D7\|7-27\|RF2/JH4 | | WINPN---SGGTNYAQKFQG | | RVTMTRDTSISTAYMELSRLR SDDTAVYYCAR | 6468 / 6591 |
| MA_83-F3_CCx_I2C0x_scFc_(G5K)_translation Fv#1 | VH1\|1-02/D7\|7-27\|RF2/JH4 | R.........D.H....... | 6469 | ...................... | 6592 |
| MA_83-F3x_I2C0x_scFc_(B9A)_translation Fv#1 | VH1\|1-02/D7\|7-27\|RF2/JH4 | R.........D.H....... | 6470 | ...................... | 6593 |

TABLE 53-continued

BiTE-scFc Variable Region Consensus Protein Alignment (MAGEB2)
CDRs defined by Kabat
Alignment numbering defined by Amgen Reference (AHo)

| | | | | SEQ ID NO: | |
|---|---|---|---|---|---|
| VH4|4-30.1/D3|3-10|RF1/JH6 | | YIYY----SGSTYNPSLKS | 6471 | RVTISVDTSKNQFSLKLSSVT AADTAVYYCAR | 6594 |
| MA_84-G10_CC_x_I2C0x_scFc_(H9O)_translation Fv#1 | VH4|4-30.1/D3|3-10|RF1/JH6 | ................ | 6472 | ................ | 6595 |
| MA_84-G10x_I2C0x_scFc_(Y4W)_translation Fv#1 | VH4|4-30.1/D3|3-10|RF1/JH6 | ................ | 6473 | ................ | 6596 |

KAPPA VARIABLE

| | Germline | K_CDR3 | SEQ ID NO: K_CDR3 | K_FR4 | SEQ ID NO: K_FR4 |
|---|---|---|---|---|---|
| | | QQYGS--------SPLT | 6597 | FGGGTKVEIK | 6722 |
| MA_12-E12_CC_x_I2C0x_scFc_(E9U)_translation Fv#1 | VK3|A27/JK4 | ...AN........... | 6598 | ..C....... | 6723 |
| MA_12-E12x_I2C0x_scFc_(W1U)_translation Fv#1 | VK3|A27/JK4 | ...AN........... | 6599 | ................ | 6724 |
| MA_48-D12x_I2C0x_scFc_(R9D)_translation Fv#1 | VK3|A27/JK4 | ................L. | 6600 | ................ | 6725 |
| | VK1|A20/JK1 | QKNS--------APWT | 6601 | FGQGTKVEIK | 6726 |
| MA_13-D8_CCx_I2C0x_scFc_(U7V)_translation Fv#1 | VK1|A20/JK1 | .QSY......T.P. | 6602 | ..C....... | 6727 |
| MA_13-D8x_I2C0x_scFc_(M7M)_translation Fv#1 | VK1|A20/JK1 | .QSY......T.P. | 6603 | ................ | 6728 |
| | VK4|B3/JK2 | QQYYS--------TPYT | 6604 | FGQGTKLEIK | 6729 |
| MA_24-C9_CCx_I2C0x_scFc_(I2U)_translation Fv#1 | VK4|B3/JK2 | ..........Y.... | 6605 | ..C....L. | 6730 |

TABLE 53-continued

BiTE-scFc Variable Region Consensus Protein Alignment (MAGEB2)
CDRs defined by Kabat
Alignment numbering defined by Amgen Reference (AHo)

| | | K_CDR3 | | K_FR4 | |
|---|---|---|---|---|---|
| MA_24-C9x_I2C0x_scFc_(L9Y)_translation Fv#1 | VK4\|B3/JK2 | ........... | ....Y.... | ..G....L. | 6731 |
| VK6\|A10/JK2 | | HQSSS----- | -----LPYT | FGQGTKLEIK | 6732 |
| MA_24-G6_CCx_I2C0x_scFc_(B1I)_translation Fv#1 | VK6\|A10/JK2 | ..W....... | .....Y.P. | ..C....... | 6733 |
| MA_24-G6x_I2C0x_scFc_(F1M)_translation Fv#1 | VK6\|A10/JK2 | ..W....... | .....Y.P. | ..S....... | 6734 |
| VK1\|L11/JK2 | | LQDYN----- | -----YPYT | FGQGTKLEIK | 6735 |
| MA_31-H8_CCx_I2C0x_scFc_(K4E)_translation Fv#1 | VK1\|L11/JK2 | QHH.G..... | .....T.L. | ..C....L. | 6736 |
| MA_31-H8x_I2C0x_scFc_(F9Z)_translation Fv#1 | VK1\|L11/JK2 | QHH.G..... | .....T.L. | ..A....L. | 6737 |
| VK2\|A19/JK5 | | MQALQ----- | -----TPIT | FGQGTRLEIK | 6738 |
| MA_32-A8_CCx_I2C0x_scFc_(A9E)_translation Fv#1 | VK2\|A19/JK5 | .......... | .......P. | ..C....... | 6739 |
| MA_32-A8_x_I2C0x_scFc_(G6J)_translation Fv#1 | VK2\|A19/JK5 | .......... | .......P. | .......... | 6740 |
| VK3\|A27/JK2 | | QQYGS----- | -----SPYT | FGQGTKLEIK | 6741 |
| MA_48-D12_CCx_I2C0x_scFc_(_M9T)_translation Fv#1 | VK3\|A27/JK2 | .......... | .......L. | ..C....... | 6742 |

| | | K_CDR3 | | K_FR4 | |
|---|---|---|---|---|---|
| Germline | | MQALQ----- | -----TPFT | FGPGTKVDIK | 6743 |
| MA_50-D9_CCx_I2C0x_scFc_(K6S)_translation Fv#1 | VK2\|A19/JK3 | .......... | .......L. | ..C....... | 6744 |

TABLE 53-continued

BiTE-scFc Variable Region Consensus Protein Alignment (MAGEB2)
CDRs defined by Kabat
Alignment numbering defined by Amgen Reference (AHo)

| | Germline | | K_CDR3 | | | K_FR4 | |
|---|---|---|---|---|---|---|---|
| MA_78-A6x_I2C0x_scFc_(K6P)_translation Fv#1 | VK2\|A19/JK3 | | MQALQ----------TPLT | 6620 | .......E.. | FGGGTKVEIK | 6745 |
| | | | | 6621 | | | 6746 |
| MA_50-D9x_I2C0x_scFc_(A4U)_translation Fv#1 | VK2\|A19/JK4 | | .................... | 6622 | .......D.. | ..........D. | 6747 |
| MA_78-A6_CCx_I2C0x_scFc_(D8Z)_translation Fv#1 | VK2\|A19/JK1 | | MQALQ----------TPWT | 6623 | ......F... | FGQGTKVEIK | 6748 |
| | | | .................... | 6624 | ..C....... | ..C....... | 6749 |
| MA_79-E3_CC_x_I2C0x_scFc_(E2Y)_translation Fv#1 | VK1\|L19/JK3 | | QQANS----------FPFT | 6625 | ..T.P..... | FGPGTKVDIK | 6750 |
| | | | ..SYR............... | 6626 | ..C....... | ..C....... | 6751 |
| MA_79-E3x_I2C0x_scFc_(N4F)_translation Fv#1 | VK1\|L19/JK1 | | QQANS----------FPWT | 6627 | ..T.P..... | FGQGTKVEIK | 6752 |
| | | | ..SYR............... | 6628 | .......D.. | ..........D. | 6753 |
| MA_83-F3_CCx_I2C0x_scFc_(G5K)_translation Fv#1 | VK1\|A20/JK2 | | QKYNS----------APYT | 6629 | ......W... | FGQGTKLEIK | 6754 |
| | | | .................... | 6630 | ..C....... | ..C....... | 6755 |
| MA_83-F3x_I2C0x_scFc_(B9A)_translation Fv#1 | VK1\|A20/JK2 | | .................... | 6631 | ......W... | .................... | 6756 |
| MA_84-G10_CC_x_I2C0x_scFc_(H9O)_translation Fv#1 | VK2\|O1/JK5 | | MQRIE---------FPIT | 6632 | ......T... | FGQGTRLEIK | 6757 |
| | | | ..ALQ............... | 6633 | | ..C....... | 6758 |

TABLE 53-continued

BiTE-scFc Variable Region Consensus Protein Alignment (MAGEB2)
CDRs defined by Kabat
Alignment numbering defined by Amgen Reference (AHo)

| | Germline | | | | | |
|---|---|---|---|---|---|---|
| MA_84-G10x_I2C0x_scFc_(Y4W)_translation Fv#1 | VK2\|O1/JK5 | ..ALQ................T... | 6634 | | | 6759 |

LAMBDA_VARIABLE

| | Germline | L_CDR3 | | L_FR4 | |
|---|---|---|---|---|---|
| VL7\|7a/JL3b | | LLIYYG------------GAQWV | 6635 | FGGGTKLITVL | 6760 |
| MA_12-E12_CC_x_I2C0x_scFc_(E9U)_translation Fv#2 | VL7\|7a/JL3b | V.W.S................-NR.. | 6636 | | 6761 |
| MA_12-E12x_I2C0x_scFc_(W1U)_translation Fv#2 | VL7\|7a/JL3b | V.W.S................-NR.. | 6637 | | 6762 |
| MA_13-D8_CCx_I2C0x_scFc_(U7V)_translation Fv#2 | VL7\|7a/JL3b | V.W.S................-NR.. | 6638 | | 6763 |
| MA_13-D8x_I2C0x_scFc_(M7M)_translation Fv#2 | VL7\|7a/JL3b | V.W.S................-NR.. | 6639 | | 6764 |
| MA_24-C9_CCx_I2C0x_scFc_(I2U)_translation Fv#2 | VL7\|7a/JL3b | V.W.S................-NR.. | 6640 | | 6765 |
| MA_24-C9x_I2C0x_scFc_(L9Y)_translation Fv#2 | VL7\|7a/JL3b | V.W.S................-NR.. | 6641 | | 6766 |
| MA_24-G6_CCx_I2C0x_scFc_(B1I)_translation Fv#2 | VL7\|7a/JL3b | V.W.S................-NR.. | 6642 | | 6767 |
| MA_24-G6x_I2C0x_scFc_(F1M)_translation Fv#2 | VL7\|7a/JL3b | V.W.S................-NR.. | 6643 | | 6768 |
| MA_31-H8_CCx_I2C0x_scFc_(K4E)_translation Fv#2 | VL7\|7a/JL3b | V.W.S................-NR.. | 6644 | | 6769 |

TABLE 53-continued

BiTE-scFc Variable Region Consensus Protein Alignment (MAGEB2)
CDRs defined by Kabat
Alignment numbering defined by Amgen Reference (AHo)

| | | | | |
|---|---|---|---|---|
| MA_31-<br>H8x_I2C0x_scFc_(F9Z)_translation<br>Fv#2 | VL7\|7a/JL3b | V.W.S................................-NR.. | 6645 | 6770 |
| MA_32-<br>A8_CCx_I2C0x_scFc_(A9E)_translation<br>Fv#2 | VL7\|7a/JL3b | V.W.S................................-NR.. | 6646 | 6771 |
| MA_32-<br>A8_x_I2C0x_scFc_(G6J)_translation<br>Fv#2 | VL7\|7a/JL3b | V.W.S................................-NR.. | 6647 | 6772 |
| MA_48-<br>D12_CCx_I2C0x_scFc_(_M9T)_translation<br>Fv#2 | VL7\|7a/JL3b | V.W.S................................-NR.. | 6648 | 6773 |
| MA_48-<br>D12x_I2C0x_scFc_(R9D)_translation<br>Fv#2 | VL7\|7a/JL3b | V.W.S................................-NR.. | 6649 | 6774 |
| MA_50-<br>D9_CCx_I2C0x_scFc_(K6S)_translation<br>Fv#2 | VL7\|7a/JL3b | V.W.S................................-NR.. | 6650 | 6775 |
| MA_50-<br>D9x_I2C0x_scFc_(A4U)_translation<br>Fv#2 | VL7\|7a/JL3b | V.W.S................................-NR.. | 6651 | 6776 |
| MA_78-<br>A6_CCx_I2C0x_scFc_(D8Z)_translation<br>Fv#2 | VL7\|7a/JL3b | V.W.S................................-NR.. | 6652 | 6777 |
| MA_78-<br>A6x_I2C0x_scFc_(K6P)_translation<br>Fv#2 | VL7\|7a/JL3b | V.W.S................................-NR.. | 6653 | 6778 |
| MA_79-<br>E3_CC_x_I2C0x_scFc_(E2Y)_translation<br>Fv#2 | VL7\|7a/JL3b | V.W.S................................-NR.. | 6654 | 6779 |
| MA_79-<br>E3x_I2C0x_scFc_(N4F)_translation<br>Fv#2 | VL7\|7a/JL3b | V.W.S................................-NR.. | 6655 | 6780 |
| MA_83-<br>F3_CCx_I2C0x_scFc_(G5K)_translation<br>Fv#2 | VL7\|7a/JL3b | V.W.S................................-NR.. | 6656 | 6781 |

TABLE 53-continued

BiTE-scFc Variable Region Consensus Protein Alignment (MAGEB2)
CDRs defined by Kabat
Alignment numbering defined by Amgen Reference (AHo)

| | Germline | | | |
|---|---|---|---|---|
| MA_83-F3x_I2C0x_scFc_(B9A)_translation Fv#2 | VL7\|7a/JL3b | V..W.S.................-NR.. | | 6782 |
| MA_84-G10_CC_x_I2C0x_scFc_(H9O)_translation Fv#2 | VL7\|7a/JL3b | V..W.S.................-NR.. | | 6783 |
| MA_84-G10x_I2C0x_scFc_(Y4W)_translation Fv#2 | VL7\|7a/JL3b | V..W.S.................-NR.. | | 6784 |

HEAVY VARIABLE

| | Germline | H_CDR3 | H_FR4 | |
|---|---|---|---|---|
| VH3\|3-21/D2\|2-15\|RF3/JH1 | | DIVVVAA------TAEYFQH | 6660 WGQGTLVTVSS | 6785 |
| MA_12-E12_CC_x_I2C0x_scFC_(E9U)_translation Fv#1 | VH3\|3-21/D2\|2-15\|RF3/JH1 | .RIA.A---------T..DN | 6661 ................ | 6786 |
| MA_12-E12x_I2C0x_scFc_(W1U)_translation Fv#1 | VH3\|3-21/D2\|2-15\|RF3/JH1 | .RIA.A---------T..DN | 6662 ................ | 6787 |
| VH3\|3-73/D3\|3-3\|RF3/JH4 | | ITIFGVV-------IIYFDY | 6663 WGQGTLVTVSS | 6788 |
| MA_12-E12_CC_x_I2C0x_scFc_(E9U)_translation Fv#2 | VH3\|3-73/D3\|3-3\|RF3/JH4 | HGN..NS........Y.S.WA. | 6664 ................ | 6789 |
| MA_12-E12x_I2C0x_scFc_(W1U)_translation Fv#2 | VH3\|3-73/D3\|3-3\|RF3/JH4 | HGN..NS........Y.S.WA. | 6665 ................ | 6790 |
| MA_13-D8_CCx_I2C0x_scFc_(U7V)_translation Fv#2 | VH3\|3-73/D3\|3-3\|RF3/JH4 | HGN..NS........Y.S.WA. | 6666 ................ | 6791 |
| MA_13-D8x_I2C0x_scFc_(M7M)_translation Fv#2 | VH3\|3-73/D3\|3-3\|RF3/JH4 | HGN..NS........Y.S.WA. | 6667 ................ | 6792 |
| MA_24-C9_CCx_I2C0x_scFc_(I2U)_translation Fv#2 | VH3\|3-73/D3\|3-3\|RF3/JH4 | HGN..NS........Y.S.WA. | 6668 ................ | 6793 |

TABLE 53-continued

BiTE-scFc Variable Region Consensus Protein Alignment (MAGEB2)
CDRs defined by Kabat
Alignment numbering defined by Amgen Reference (AHo)

| | | | | |
|---|---|---|---|---|
| MA_24-C9x_I2C0x_scFc_(L9Y)_translation_Fv#2 | VH3\|3-73/D3\|3-3\|RF3/JH4 | HGN..NS................Y.S.WA. | 6669 | 6794 |
| MA_24-G6_CCx_I2C0x_scFc_(B1I)_translation_Fv#2 | VH3\|3-73/D3\|3-3\|RF3/JH4 | HGN..NS................Y.S.WA. | 6670 | 6795 |
| MA_24-G6x_I2C0x_scFc_(F1M)_translation_Fv#2 | VH3\|3-73/D3\|3-3\|RF3/JH4 | HGN..NS................Y.S.WA. | 6671 | 6796 |
| MA_31-H8_CCx_I2C0x_scFc_(K4E)_translation_Fv#2 | VH3\|3-73/D3\|3-3\|RF3/JH4 | HGN..NS................Y.S.WA. | 6672 | 6797 |
| MA_31-H8x_I2C0x_scFc_(F9Z)_translation_Fv#2 | VH3\|3-73/D3\|3-3\|RF3/JH4 | HGN..NS................Y.S.WA. | 6673 | 6798 |
| MA_32-A8_CCx_I2C0x_scFc_(A9E)_translation_Fv#2 | VH3\|3-73/D3\|3-3\|RF3/JH4 | HGN..NS................Y.S.WA. | 6674 | 6799 |
| MA_32-A8_x_I2C0x_scFc_(G6J)_translation_Fv#2 | VH3\|3-73/D3\|3-3\|RF3/JH4 | HGN..NS................Y.S.WA. | 6675 | 6800 |
| MA_48-D12_CCx_I2C0x_scFc_(_M9T)_translation_Fv#2 | VH3\|3-73/D3\|3-3\|RF3/JH4 | HGN..NS................Y.S.WA. | 6676 | 6801 |
| MA_48-D12x_I2C0x_scFc_(R9D)_translation_Fv#2 | VH3\|3-73/D3\|3-3\|RF3/JH4 | HGN..NS................Y.S.WA. | 6677 | 6802 |
| MA_50-D9_CCx_I2C0x_scFc_(K6S)_translation_Fv#2 | VH3\|3-73/D3\|3-3\|RF3/JH4 | HGN..NS................Y.S.WA. | 6678 | 6803 |
| MA_50-D9x_I2C0x_scFc_(A4U)_translation_Fv#2 | VH3\|3-73/D3\|3-3\|RF3/JH4 | HGN..NS................Y.S.WA. | 6679 | 6804 |
| MA_78-A6_CCx_I2C0x_scFc_(D8Z)_translation_Fv#2 | VH3\|3-73/D3\|3-3\|RF3/JH4 | HGN..NS................Y.S.WA. | 6680 | 6805 |

TABLE 53-continued

BiTE-scFc Variable Region Consensus Protein Alignment (MAGEB2)
CDRs defined by Kabat
Alignment numbering defined by Amgen Reference (AHo)

| | | | | | |
|---|---|---|---|---|---|
| MA_78-A6x_I2C0x_scFc_(K6P)_translation Fv#2 | VH3\|3-73/D3\|3-3\|RF3/JH4 | HGN..NS............ | Y.S.WA. | 6681 | 6806 |
| MA_79-E3_CC_x_I2C0x_scFc_(E2Y)_translation Fv#2 | VH3\|3-73/D3\|3-3\|RF3/JH4 | HGN..NS............ | Y.S.WA. | 6682 | 6807 |
| MA_79-E3x_I2C0x_scFc_(N4F)_translation Fv#2 | VH3\|3-73/D3\|3-3\|RF3/JH4 | HGN..NS............ | Y.S.WA. | 6683 | 6808 |
| MA_83-F3_CCx_I2C0x_scFc_(G5K)_translation Fv#2 | VH3\|3-73/D3\|3-3\|RF3/JH4 | HGN..NS............ | Y.S.WA. | 6684 | 6809 |
| MA_83-F3x_I2C0x_scFc_(B9A)_translation Fv#2 | VH3\|3-73/D3\|3-3\|RF3/JH4 | HGN..NS............ | Y.S.WA. | 6685 | 6810 |
| MA_84-G10_CC_x_I2C0x_scFc_(H9O)_translation Fv#2 | VH3\|3-73/D3\|3-3\|RF3/JH4 | HGN..NS............ | Y.S.WA. | 6686 | 6811 |
| MA_84-G10x_I2C0x_scFc_(Y4W)_translation Fv#2 | VH3\|3-73/D3\|3-3\|RF3/JH4 | HGN..NS............ | Y.S.WA. | 6687 | 6812 |
| VH3\|3-23/D1\|1-1\|RF1/JH6 | | GTTGTGTYY------YYYGMDV | WGQGTTVTVSS | 6688 | 6813 |
| MA_13-D8_CCx_I2C0x_scFc_(U7V)_translation Fv#1 | VH3\|3-23/D1\|1-1\|RF1/JH6 | MV.PD.-......D... | | 6689 | 6814 |
| MA_13-D8x_I2C0x_scFc_(M7M)_translation Fv#1 | VH3\|3-23/D1\|1-1\|RF1/JH6 | MV.PD.-......D... | | 6690 | 6815 |
| MA_79-E3_CC_x_I2C0x_scFc_(E2Y)_translation Fv#1 | VH3\|3-23/D1\|1-1\|RF1/JH6 | MV.PD.-......D... | | 6691 | 6816 |
| MA_79-E3x_I2C0x_scFc_(N4F)_translation Fv#1 | VH3\|3-23/D1\|1-1\|RF1/JH6 | MV.PD.-......D... | | 6692 | 6817 |

TABLE 53-continued

BiTE-scFc Variable Region Consensus Protein Alignment (MAGEB2)
CDRs defined by Kabat
Alignment numbering defined by Amgen Reference (AHo)

| | | H_CDR3 | | H_FR4 | |
|---|---|---|---|---|---|
| VH1\|1-e/D2\|2-15\|RF3/JH4 | | DIVVVA----------ATYFDY | 6693 | WGQGTLVTVSS | 6818 |
| MA_24-C9_CCx_I2C0x_scFc_(I2U)_translation Fv#1 | VH1\|1-e/D2\|2-15\|RF3/JH4 | .G.FY-------APLA. | 6694 | ............ | 6819 |
| MA_24-C9x_I2C0x_scFc_(L9Y)_translation Fv#1 | VH1\|1-e/D2\|2-15\|RF3/JH4 | .G.FY-------APLA. | 6695 | ............ | 6820 |
| VH1\|1-e/D5\|5-18\|RF3/JH4 | | GYSYG-----------YYFDY | 6696 | WGQGTMVTVSS | 6821 |
| MA_24-G6_CCx_I2C0x_scFc_(B1I)_translation Fv#1 | VH1\|1-e/D5\|5-18\|RF3/JH4 | .NYF.SS......EA..... | 6697 | ......R..... | 6822 |
| MA_24-G6x_I2C0x_scFc_(F1M)_translation Fv#1 | VH1\|1-e/D5\|5-18\|RF3/JH4 | .NYF.SS......EA..... | 6698 | ......R..... | 6823 |

| | | H_CDR3 | | H_FR4 | |
|---|---|---|---|---|---|
| Germline | | VQLER-----------DAFDI | 6699 | WGQGTMVTVSS | 6824 |
| VH1\|1-e/D1\|1-1\|RF2/JH3 | | R..NHV..........F.M.Y | 6700 | ......S..... | 6825 |
| MA_31-H8_CCx_I2C0x_scFc_(K4E)_translation Fv#1 | VH1\|1-e/D1\|1-1\|RF2/JH3 | R..NHV..........F.M.Y | 6701 | ......S..... | 6826 |
| MA_31-H8x_I2C0x_scFc_(F9Z)_translation Fv#1 | VH1\|1-e/D1\|1-1\|RF2/JH3 | | | | |

| | | H_CDR3 | | H_FR4 | |
|---|---|---|---|---|---|
| Germline | | GYSYGYYY--------YYYGMDV | 6702 | WGQGTTVTVSS | 6827 |
| VH1\|1-08/D5\|5-18\|RF3/JH6 | | .GG.SNG-.........D..... | 6703 | ............ | 6828 |
| MA_32-A8_CCx_I2C0x_scFc_(A9E)_translation Fv#1 | VH1\|1-08/D5\|5-18\|RF3/JH6 | .GG.SNG-.........D..... | 6704 | ............ | 6829 |
| MA_32-A8_x_I2C0x_scFc_(G6J)_translation Fv#1 | VH1\|1-08/D5\|5-18\|RF3/JH6 | | | | |

TABLE 53-continued

BiTE-scFc Variable Region Consensus Protein Alignment (MAGEB2)
CDRs defined by Kabat
Alignment numbering defined by Amgen Reference (AHo)

| Name | Germline | Sequence | SEQ ID |
|---|---|---|---|
| VH3\|3-30.3/D1\|1-1\|RF2/JH6 | | VQLERYY--------YYYGMDV | 6705 WGQGTTVTVSS | 6830 |
| MA_48-D12_CCx_I2C0x_scFc_(_M9T)_translation_Fv#1 | VH3\|3-30.3/D1\|1-1\|RF2/JH6 | E.WPN.-.......-........ | 6706 | 6831 |
| MA_48-D12x_I2C0x_scFc_(R9D)_translation_Fv#1 | VH3\|3-30.3/D1\|1-1\|RF2/JH6 | E.WPN.-.......-........ | 6707 | 6832 |
| VH6\|6-01/D3\|3-10\|RF1/JH6 | | VLLWFGELL*------YYYYYGMDV | 6708 & 6709 WGQGTTVTVSS | 6833 |
| MA_50-D9_CCx_I2C0x_scFc_(K6S)_translation_Fv#1 | VH6\|6-01/D3\|3-10\|RF1/JH6 | EI.....K.-......N....... | 6710 | 6834 |
| MA_50-D9x_I2C0x_scFc_(A4U)_translation_Fv#1 | VH6\|6-01/D3\|3-10\|RF1/JH6 | EI.....K.-......N....... | 6711 | 6835 |
| VH4\|4-34/D5\|5-18\|RF3/JH6 | | GYSYGYYY--------YYYGMDV | 6712 WGQGTTVTVSS | 6836 |
| MA_78-A6_CCx_I2C0x_scFc_(D8Z)_translation_Fv#1 | VH4\|4-34/D5\|5-18\|RF3/JH6 | .GG.SDG-.........D...... | 6713 | 6837 |
| MA_78-A6x_I2C0x_scFc_(K6P)_translation_Fv#1 | VH4\|4-34/D5\|5-18\|RF3/JH6 | .GG.SDG-.........D...... | 6714 | 6838 |

TABLE 53-continued

BiTE-scFc Variable Region Consensus Protein Alignment (MAGEB2)
CDRs defined by Kabat
Alignment numbering defined by Amgen Reference (AHo)

| | | | | | |
|---|---|---|---|---|---|
| VH1\|1-02/D7\|7-27\|RF2/JH4 | | *LGY------------FDY | 6715 | WGQGTLVTVSS | 6839 |
| MA_83-<br>F3_CCx_I2C0x_scFc_(G5K)_translation<br>Fv#1 | VH1\|1-02/D7\|7-27\|RF2/JH4 | G..IS..............F... | 6716 | .................. | 6840 |
| MA_83-<br>F3x_I2C0x_scFc_(B9A)_translation<br>Fv#1 | VH1\|1-02/D7\|7-27\|RF2/JH4 | G..IS..............F... | 6717 | .................. | 6841 |
| VH4\|4-30.1/D3\|3-10\|RF1/JH6 | | VLLWFGELL*------YYYYYGMDV | 6718 &<br>6719 | WGQGTTVTVSS | 6842 |
| MA_84-<br>G10_CC_x_I2C0x_scFc_(H9O)_translation<br>Fv#1 | VH4\|4-30.1/D3\|3-10\|RF1/JH6 | DK....K.---.........N... | 6720 | .................. | 6843 |
| MA_84-<br>G10x_I2C0x_scFc_(Y4W)_translation<br>Fv#1 | VH4\|4-30.1/D3\|3-10\|RF1/JH6 | DK....K.---.........N... | 6721 | .................. | 6844 |

TABLE 54 scFv Full Sequences

| Ab | Type | SCFV |
|---|---|---|
| 17724-C9 | NA | GAGGTGCAGCTGCTCGAGCAGTCTGGACCTGAGCTGGTGAAGCCTGGGGCCTCAGTGAAGATTTCCTGCAAGGCTTCTGGCT<br>ACGCATTCAGTAAGTCCTGGATGAACTGGGTGAAGCAGAGGCCTGGAAAGGGTCTTGAGTGGATTGGACGGATTTATCCTGG<br>AGATGGAGATACTAACTACAATGGGAAGTTCAAGGGCAAGGCCGCACTGACTGCAGACAAATCCTCCAACACAGCCAACATG<br>CAACTCAAC<br>(SEQ ID NO: 6845) |
| | AA | EVQLLEQSGPELVKPGASVKISCKASGYAFSKSWMNWVKQRPGKGLEWIGRIYPGDGDTNYNGKFKGKAALTADKSSNTANM<br>QLNSLTSEDSAVYFCARDGVFYAPLAYWGQGTLVTVSSGGGGSGGGGSGGGGSELVMTQSPSSLAVSVGEKITMSCKSSQSL<br>LYSSNQKNYLAWYQQKPGQSPKLLIYWASTRESGVPDRFTGSGSGTDFTLTISSVKAEDLAVYYCQQYYSYPYTFGGGTKLE<br>LK<br>(SEQ ID NO: 6846) |
| 17724-G6 | NA | GAGGTGCAGCTGCTCGAGCAGTCTGGACCTGAGTTGGTGAAGCCTGGGGCCTCAGTGAAGATTTCCTGCAAGGCTTCTGACT<br>ACACATTCAGTAAGTCCTGGATGAACTGGGTGAAGCAGAGGCCTGGAGAGGGTCTTGAGTGGATTGGACGTGTTTGGCCTGG<br>AGATGGAGATACTACGTACAATGAGAAGTTCAAGGGCAAGGCCACACTGACTGCAGACAAATCCTCCAGGACAGCCTACATG<br>CAACTCAGC<br>(SEQ ID NO: 6847) |
| | AA | EVQLLEQSGPELVKPGASVKISCKASDYTFSKSWMNWVKQRPGEGLEWIGRVWPGDGDTTYNEKFKGKATLTADKSSRTAYM<br>QLSSLTSEDSAVYFCARGNYFGSSEAYFDYWGQGTRVTVSSGGGGSGGGGSGGGGSELVLTQSPAIMSASPGQKVTITCSAS<br>SNVNYIHWYQQKLGSSPKLWIYDTSKLAPGVPARFSGSGSGTSYSLTISSMEAEDAASYFCHQWSSYPPTFGSGTKLEIK<br>(SEQ ID NO: 6848) |
| 17731-H8 | NA | GAGGTGCAGCTGCTCGAGCAGTCTGGACCTGAGCTGGTGAAGCCTGGGGCCTCAGTGAAGATTTCCTGCAAGGCTTCTGGCT<br>ACGCATTCAGTAGCTCCTGGATGAACTGGGTGAAGCAGAGGCCTGGAAAGGGTCTTGAGTGGATTGGACGGATTTATCCTGG<br>AGATGGAGATACTAACTACAATGGGAAGTTCAAGGACAAGGCCACACTGACTGCAGACAAATCCTCCAACACAGCCTACATG<br>CAACTCAGC<br>(SEQ ID NO: 6849) |
| | AA | EVQLLEQSGPELVKPGASVKISCKASGYAFSSSWMNWVKQRPGKGLEWIGRIYPGDGDTNYNGKFKDKATLTADKSSNTAYM<br>QLSSLTSEDSAVYFCARRQLNHVFAMDYWGQGTSVTVSSGGGGSGGGGSGGGGSELQMTQSPASLSASVGETVTITCRASGN<br>IHNYLAWYQQKQGKSPQLLVYNAKTLAGGVPSRFSGSGSGTQFSLKINSLQPEDFGSYYCQHHYGTPLTFGAGTKLELK<br>(SEQ ID NO: 6850) |
| 17732-A8 | NA | GAGGTGCAGCTGCTCGAGTCTGGAGCAGAGGTGAAAAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAACAG<br>TGGTAACACAGGCTATGCACAGAAGTTCCAGGGCAGAGTCACCATGACCAGGAACACCTCCATAAGCACAGCCTACATGGAG<br>CTGAGCAGC<br>(SEQ ID NO: 6851) |
| | AA | EVQLLESGAEVKKPGASVKVSCKASGYTFTSYDINWVRQATGQGLEWMGWMNPNSGNTGYAQKFQGRVTMTRNTSISTAYME<br>LSSLRSEDTAVYYCARGGGYSNGYDYGMDVWGQGTTVTVSSGGGGSGGGGSGGGGSELVMTQSPLSLPVSPGEPASISCRSS<br>QSLLYSNGYNYVDWYLQKPGQSPQLLIYLGSNRASGVPDRFSGSGSGTDFTLKISKVEAEDVGVYYCMQALQTPPTFGQGTR<br>LEIK<br>(SEQ ID NO: 6852) |
| 17745-E5 | NA | GAGGTGCAGCTGCTCGAGTCTGGAGCTGAGGTGAAGAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAACAG<br>TGGTAACACAGGCTATGCACAGAAGTTCCAGGGCAGAGTCACCATGACCAGGAACACCTCCATAAGCACAGCCTACATGGAG<br>CTGAGCAGC<br>(SEQ ID NO: 6853) |
| | AA | EVQLLESGAEVKKPGASVKVSCKASGYTFTSYDINWVRQATGQGLEWMGWMNPNSGNTGYAQKFQGRVTMTRNTSISTAYME<br>LSSLRSEDTAVYYCARGGGYSYGYDYGMDVWGQGTTVTVSSGGGGSGGGGSGGGGSELVMTQSPLSLPVTPGEPASISCRSS<br>QSLLYSNGYHYLDWYLQKPGQSPQLLIYLGSIRASGVPDRFSGSGSGTDFTLKISRVEAEDVGVYYCMQPLQTPPTFGPGTK<br>LEIK<br>(SEQ ID NO: 6854) |
| 17745-E8 | NA | GAGGTGCAGCTGCTCGAGTGGGCGCAGGACTGTTGAAGCCTTCGGAGACCCTGTCCCTCACCTGCGCTGTCTATGGTGGGT<br>CCTTCAGTGGTTACTACTGGAACTGGATCCGCCAGCCCCCAGGGAAGGGGCTGGAGTGGATTGGGGAAATCAGTCATAGTGG<br>AAGCACCAACTACAACCCGTCCCTCAAGAGTCGAGTCAGCATATCAGGAGACACGTCCAAGAACCAGTTCTCCCTGAAGCTG<br>AGCTCTGTG<br>(SEQ ID NO: 6855) |
| | AA | EVQLLEWGAGLLKPSETLSLTCAVYGGSFSGYYWNWIRQPPGKGLEWIGEISHSGSTNYNPSLKSRVSISGDTSKNQFSLKL<br>SSVTAADTAVYYCARGGGYSHGYDYGMDVWGQGTTVTVSSGGGGSGGGGSGGGGSELVMTQTPLSLPVIPGEPASISCRSSQ<br>SLLYSNGYNYLDWYLQKPGQSPQLLIYLGSKRASGVPDRFSGSGSGTDFTLKISRVEAEDVGVYYCMQGTHWPRTFGQGTKV<br>EIK<br>(SEQ ID NO: 6856) |
| 17745-G8 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGATATCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6857) |
| | AA | EVQLLESGGGLVQPGGSLRLSCAASGFTFSSYAMSWVRQAPGKGLEWVSAISGSGDITYYADSVKGRFTISRDNSKNTLYLQ<br>MNSLRAEDTAVYYCAKHLRYFDWPLDYWGQGTLVTVSSGGGGSGGGGSGGGGSELTLTQSPGTLSLSPGERATLSCRASQSV<br>SSSYLAWYQQKPGQAPRLLIYGASSRATGIPDRFSGSGSGTDFTLTISRLEPEDFAVYYCQQYGRSLFTFGPGTKVDIK<br>(SEQ ID NO: 6858) |

TABLE 54-continued scFv Full Sequences

| Ab | Type | SCFV |
|---|---|---|
| 17748-D12 | NA | GAGGTGCAGCTGCTCGAGTCCGGGGGAGGCGTGGTCCAGCCTGGGAGGTCCCTGAGACTCTCCTGTGCAGCCTCTGGATTCA<br>CCTTCCGTAGCTATCGCATGCACTGGGTCCGCCAGGCTCCAGGCAAGGGGCTGGAGTGGGTGGCAGTTATATCATATGATGG<br>AGGTAATAAATACTATGCAGACTCCGTGAAGGGCCGATTCACCATCTCCAGAGACAATTCCAAGAACACGCTGTATCTGCAA<br>ATGAACAGC<br>(SEQ ID NO: 6859) |
| | AA | EVQLLESGGGVVQPGRSLRLSCAASGFTFRSYRMHWVRQAPGKGLEWVAVISYDGGNKYYADSVKGRFTISRDNSKNTLYLQ<br>MNSLRAEDTAVYYCAREQWPNYYYGMDVWGQGTTVTVSSGGGGSGGGGSGGGGSELVLTQSPGTLSLSPGERATLSCRASQS<br>VSSSYLAWYQQKPGQAPRLLIYGASSRATGIPDRFSGSGSGTDFTLTISRLEPEDFAVYYCQQYGSSPLTFGGGTKLEIK<br>(SEQ ID NO: 6860) |
| 17753-F4 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAACTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6861) |
| | AA | EVQLLEWGAGLLKPSETLSLTCAVYGGSFSGYYWNWIRQPPGKGLEWIGEINHSGSTNYNPSLKSRVTISVDTSKNQFSLKL<br>SSVTAADTAVYYCARGGGYSYGYDYGMDVWGQGTTVTVSSGGGGSGGGGSGGGGSELVMTQSPLSLPVTPGEPASISCRSSQ<br>SLLYSNGYNYLDWYLQKPGQSPQLLIYLGSNRASGVPDRFSGSGSGTDFTLKISRVEAEDVGVYYCMQALQTPFTFGPGTKV<br>EIK<br>(SEQ ID NO: 6862) |
| 17771-D2 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCTCCTATGCCATGAGCTGGGTCCGCCAGGCTCCAGGGAGGGGGCTGGAGTGGGTCTCAACTATTAGTGGTAGTGG<br>TGGTAGCACAGACTACGCAGACTCCGTGAAGGGCCGGTTCACCATCTCCAGAGACAATTCCAAGAACACGCTGTATCTGCAA<br>ATGAACAGC<br>(SEQ ID NO: 6863) |
| | AA | EVQLLESGGGLVQPGGSLRLSCAASGFTFSSYAMSWVRQAPGRGLEWVSTISGSGGSTDYADSVKGRFTISRDNSKNTLYLQ<br>MNSLRAEDTAVYYCAKDGGSGWFPKLLHYGLDVWGQGTTVTVSSGGGGSGGGGSGGGGSELQMTQSPSSVSASVGDRVTITC<br>RASQGISSWLAWYQQKPGKAPKLLIYAASSLQSGVPSRFSGSGSGTDFTLTISSLQPEDFATYYCQQANSFPPTFGQGTKVE<br>IK<br>(SEQ ID NO: 6864) |
| 17777-B4 | NA | GAGGTGCAGCTGCTCGAGTCTGGAGCAGAGGTGAAAAAGCCTGGGGCCTCAGTGAAGGTCTCCTGCATGGCTTCTGGATACA<br>CCTTCACCGGTTATGATATCAACTGGGTGCGACAGGCCACTGGGCAAGGGCTTGAGTGGATGGGATGGATGAACCCTAACCG<br>TGGCACCACAGGCTATGCACAGAAGTTCCAGGGCAGAGTCACCATGACCAGGAACACCTCCATAAGCACAGCCTACATGGAG<br>CTGAGCAGC<br>(SEQ ID NO: 6865) |
| | AA | EVQLLESGAEVKKPGASVKVSCMASGYTFTGYDINWVRQATGQGLEWMGWMNPNRGTTGYAQKFQGRVTMTRNTSISTAYME<br>LSSLRSEDTAVYYCARGGGYSYGYDYGMDVWGQGTTVTVSSGGGGSGGGGSGGGGSELVMTQSPLSLPVTPGEPASISCRSS<br>QSLLYSNGYNYLDWYLQKPGQSPQLLIYLGSNRASGVPDRFSGSGSGTDFTLKISRVEAEDVGVYYCMQALQTPLTFGGGTK<br>VEIK<br>(SEQ ID NO: 6866) |
| 17777-C4 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGATTACACATACTACGCAGACTCCGTGAAGGGCCGGTTCACCATCTCCAGAGACAATTCCAAGAACACGCTGTATCTGCAA<br>ATGAACAGC<br>(SEQ ID NO: 6867) |
| | AA | EVQLLESGGGLVQPGGSLRLSCAASGFTFSSYAMSWVRQAPGKGLEWVSAISGSGDYTYYADSVKGRFTISRDNSKNTLYLQ<br>MNSLRAEDTAVYYCAKHLRYSDWPLDYWGQGTLVTVSSGGGGSGGGGSGGGGSELVLTQSPGTLSLSPGERATLSCRASQSV<br>SSSYLAWYQQKPGQAPRLLIYGASSRATGIPDRFSGSGSGTDFTLTISRLEPEDFAVYYCQQYGSSPLTFGGGTKLEIK<br>(SEQ ID NO: 6868) |
| 17777-C5 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGACCTGGATCCGCCAGCCCCCAGGGAAGGGGCTGGAGTGGATTGGGGAAATCAATCACAGTGG<br>AAGAACCAACTACAATCCGTCCCTCAAGAGTCGCGTCACCATGTCAGAAGACACGGCCAAGAACCAGTTCTCCCTGAAGCTG<br>AGCTCTGTG<br>(SEQ ID NO: 6869) |
| | AA | EVQLLEWGAGLLKPSETLSLTCAVYGGSFSGYYWTWIRQPPGKGLEWIGEINHSGRTNYNPSLKSRVTMSEDTAKNQFSLKL<br>SSVTAADTAVYYCARGGGYSDGYDYGMDVWGQGTTVTVSSGGGGSGGGGSGGGGSELVLTQSPLSLPVSPGEPASISCRSSQ<br>SLLYSNGYNYVDWYLQKPGQSPQLLIYLGSNRASGVPDRFSGSGSGTDFTLKISRVEAEDVGVYYCMQGTHWPLTFGGGTKV<br>DIK<br>(SEQ ID NO: 6870) |
| 17778-C9 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAACTGGATCCGCCAGCCCCCAGGGAAGGGGCTGGAGTGGATTGGGGAAATCAATCATCGTGG<br>AAGCACCAACTACAACCCGTCCCTCAAGAGTCGAGTCACCATATCAGTAGACGCGTCCAAGAACCAGTTCTCCCTGAAGCTG<br>AGTTCTGTG<br>(SEQ ID NO: 6871) |
| | AA | EVQLLEWGAGLLKPSETLSLTCAVYGGSFSGYYWNWIRQPPGKGLEWIGEINHRGSTNYNPSLKSRVTISVDASKNQFSLKL<br>SSVTAADTAVYYCARGGGYSDGYDYGMDVWGQGTTVTVSSGGGGSGGGGSGGGGSELVMTQTPLSLPVSPGEPASISCRSSQ<br>SLLYSNGYNYVDWYLQKPGQSPQLLIYLGSNRASGVPDRFSGSGSGTDFTLKISKVEAEDVGVYYCMQALQTPCSFGQGTKL<br>EIK<br>(SEQ ID NO: 6872) |

TABLE 54-continued scFv Full Sequences

| Ab | Type | SCFV |
|---|---|---|
| 17778-F1 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAACTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6873) |
| | AA | EVQLLEWGAGLLKPSETLSLTCAVYGGSFSGYYWNWIRQPPGKGLEWIGEINHSGSTNYNPSLKSRVTISVDTSKNQFSLKL<br>SSVTAADTAVYYCARGGGYSYGYDYGMDVWGQGTTVTVSSGGGGSGGGGSGGGGSELVMTQSPLSLPVTPGEPASISCRSSQ<br>RLLFSNGYHYLDWYLQKPGQSPQLLIYLGSNRASGVPDRFSGSGSTDFTLKISRVEAEDVGVYYCMQALQTPPTFGQGTKL<br>EIK<br>(SEQ ID NO: 6874) |
| 17778-H8 | NA | GAGGTGCAGCTGCTCGAGTGGGGCGCAGGACTGTTGAAGCCTTCGGAGACCCTGTCCCTCACCTGCGGTGTCTATGGTGGGT<br>CCTTCAGTGGTTACTACTGGAGCTGGATCCGCCAGCCCCCAGGGAAGGGGCTGGAGTGGATTGGGGAAATCAATCATCGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6875) |
| | AA | EVQLLEWGAGLLKPSETLSLTCGVYGGSFSGYYWSWIRQPPGKGLEWIGEINHRGSTNYNPSLKSRVTISVDASKNQFSLKL<br>SSVTAADTAVYYCARGGGYSYGYDYGMDVWGQGTTVTVSSGGGGSGGGGSGGGGSELVLTQSPLSLPVTPGEPASISCRSSQ<br>SLLYSNGYNYLDWYLQKPGQSPQLLIYLGSNRASGVPDRFSGSGSTDFTLKISRVEAEDVGVYYCMQALQTPPTFGQGTKL<br>EIK<br>(SEQ ID NO: 6876) |
| 17779-D11 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGGCATGAGCTGGGTCCGCCAGGCTCCAGGGAAGGGGCTGGAGTGGGTCTCAGCTATTAGTGGTAGTGG<br>TGGTAGCACATACTACGCAGACTCCGCGAAGGGCCGGTTCACCATCTCCAGAGACAATTCCAAGAACACGCTGTATCTGCAA<br>ATGAACAGC<br>(SEQ ID NO: 6877) |
| | AA | EVQLLESGGGLVQPGGSLRLSCAASGFTFSSYGMSWVRQAPGKGLEWVSAISGSGGSTYYADSAKGRFTISRDNSKNTLYLQ<br>MNSLRAEDTAVYYCAKLVTPDYYYGMDVWGQGTTVTVSSGGGGSGGGGSGGGGSELQMTQSPSSLSASVGDRVTITCRASQS<br>ISSYLNWYQQKPGKAPKLLIYDASSLQSGVPSRFSGSGSTDFTLTISSLQPEDFATYYCQQSYRTPPTFGQGTKVDIK<br>(SEQ ID NO: 6878) |
| 17779-E1 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAGCTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6879) |
| | AA | EVQLLEWGAGLLKPSETLSLTCAVYGGSFSGYYWSWIRQPPGKGLEWIGEINHSGSTNYNPSLKSRVTISVDTSKNQFSLKL<br>SSVTAADTAVYYCARGGGYSYGYDYGMDVWGQGTTVTVSSGGGGSGGGGSGGGGSELVLTQSPLSLPVTPGEPASISCRSSQ<br>SLLYSNGYHYLDWYLQKPGQSPQLLIFLGSNRASGVPDRFSASRSGTDFTLKISRVEAEDVGVYYCMQALQTPFTFGPGTKV<br>EIK<br>(SEQ ID NO: 6880) |
| 17780-D12 | NA | GAGGTGCAGCTGCTCGAGTCTGGAGCAGAGGTGAAAAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAACAG<br>TGGTAACACAGGCTATGCACAGAAGTTCCAGGGCAGAGTCACCATGACCAGGAACACCTCCATAAGCACAGCCTACATGGAG<br>CTGAGCAGC<br>(SEQ ID NO: 6881) |
| | AA | EVQLLESGAEVKKPGASVKVSCKASGYTFTSYDINWVRQATGQGLEWMGWMNPNSGNTGYAQKFQGRVTMTRNTSISTAYME<br>LSSLRSEDTAVYYCARGGGYSNGYDYGMDVWGQGTTVTVSSGGGGSGGGGSGGGGSELVMTQTPLSLPVSPGEPASISCRSS<br>QSLLYSNGYNYLDWYLQKPGQSPQLLIYLGSNRASGVPDRFSGSGSTDFTLKISRVEAEDVGVYYCMQALQTPITFGQGTR<br>LEIK<br>(SEQ ID NO: 6882) |
| 17780-E6 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAACTGGATCCGCCAGCCCCCAGGGAAGGGGCTGGAGTGGATTGGGGAAATCAATCATAGTGG<br>AAGCACCACCTACAACCCGTCCCTCAAGAGTCGAGTCACCATATCAGAAGACACGTCCAGGAACCAGTTCTCCCTGAAGCTG<br>AGTTCTGTG<br>(SEQ ID NO: 6883) |
| | AA | EVQLLEWGAGLLKPSETLSLTCAVYGGSFSGYYWNWIRQPPGKGLEWIGEINHSGTTYNPSLKSRVTISEDTSRNQFSLKL<br>SSVTAADTAVYYCTRGGGYSHGYDYGMDVWGQGTTVTVSSGGGGSGGGGSGGGGSELVMTQSPLSLPVTPGEPASISCRSSQ<br>SLLYSNGYNYLDWYLQKPGQSPQLLIYLGSNRASGVPDRFSGSGSTDFTLQISRVEAEDVGVYYCMQGTHWPFTFGPGTKV<br>EIK<br>(SEQ ID NO: 6884) |
| 17781-B3 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTTCTACTGGAACTGGATCCGCCAGCCCCCAGGGAAGGGGCTGGAGTGGATTGGGGAAATCAATCATCGTGG<br>AAGCACCAACTACAACCCGTCCCTCAAGAGTCGAGTCACCATATCAGTAGACACGTCCAAGAACCAGTTCTCCCTGAAGCTG<br>AGTTCTGTG<br>(SEQ ID NO: 6885) |
| | AA | EVQLLEWGAGLLKPSETLSLTCAVYGGSFSGFYWNWIRQPPGKGLEWIGEINHRGSTNYNPSLKSRVTISVDASKNQFSLKL<br>SSVTAADTAVYYCARGGGYSDGYDYGMDVWGQGTTVTVSSGGGGSGGGGSGGGGSELVMTQSPLSLPVTPGEPASISCRSSQ<br>SLLYSNGYNYLDWYLQKPGQSPQLLIYLGSNRASGVPDRFSGSGSTDFTLKISRVEAEDVGVYYCMQALQTPWTFGQGTKV<br>DIK<br>(SEQ ID NO: 6886) |

TABLE 54-continued scFv Full Sequences

| Ab | Type | SCFV |
|---|---|---|
| 17781-H12 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAACTGGATCCGCCAGCCCCCAGGGAAGGGGCTGGAGTGGATTGGGGAAATCAGTCATAGTGG<br>AAGCACCAACTACAACCCGTCCCTCAAGAGTCGAGTCAGCATATCAGGAGACACGTCCAAGAACCAGTTCTCCCTGAAGCTG<br>AGCTCTGTG<br>(SEQ ID NO: 6887) |
| | AA | EVQLLEWGAGLLKPSETLSLTCAVYGGSFSGYYWNWIRQPPGKGLEWIGEISHSGSTNYNPSLKSRVSISGDTSKNQFSLKL<br>SSVTAADTAVYYCARGGGYSHGYDYGMDVWGQGTTVTVSSGGGGSGGGGSGGGGSELVMTQSPLSLPVSPGEPASISCRSSQ<br>SLLYSNGYNYVDWYLQKPGQSPQLLIYLGSNRASGVPDRFSGSGSGTDFTLKISRVEAEDVGVYYCMQSIQLPWTFGQGTKV<br>DIK<br>(SEQ ID NO: 6888) |
| 17783-C11 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAGCTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACGCGTCCAAGAACCAGTTCTCCCTGAAGCTG<br>AGTTCTGTG<br>(SEQ ID NO: 6889) |
| | AA | EVQLLEWGAGLLKPSETLSLTCAVYGGSFSGYYWSWIRQPPGKGLEWIGEINHSGSTNYNPSLKSRVTISVDASKNQFSLKL<br>SSVTAADTAVYYCARGGGYSDGYDYGMDVWGQGTTVTVSSGGGGSGGGGSGGGGSELVLTQSPLSLPVTPGEPASISCRSSQ<br>SLLYSNGYNYLDWYLQKPGQSPHLLIYLGSYRASGVPDRFSGSASGTDFTLKISRVEAEDVGVYYCMQGTHWPLTFGGGTKL<br>EIK<br>(SEQ ID NO: 6890) |
| 17783-G10 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAGCTGGATCCGCCAGCCCCCAGGGAAGGGGCTGGAGTGGATTGGGGAAATCACTCATAGTGG<br>AAGCACCAACTACAACCCGTCCCTCAAGAGTCGAGTCACCATATCAGTAGACACGTCCAAGAACCTGTTCTCCCTGAAGCTG<br>AGCTCTGTG<br>(SEQ ID NO: 6891) |
| | AA | EVQLLEWGAGLLKPSETLSLTCAVYGGSFSGYYWSWIRQPPGKGLEWIGEITHSGSTNYNPSLKSRVTISVDTSKNLFSLKL<br>SSVTAADTAVYYCARGGGYSDGYDYGMDVWGQGTTVTVSSGGGGSGGGGSGGGGSELVMTQTPLSLPVIPGEPASISCRSSQ<br>SLLFSNGYNYLDWYLQKPGQSPQLLIYLVSKRASGVPDRFSGSGSGTDFTLKISRVEAEDVGVYYCMQALQTPLTFGGGTKL<br>EIK<br>(SEQ ID NO: 6892) |
| 17784-B9 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6893) |
| | AA | EVQLLESGGGLVQPGGSLRLSCAASGFTFSSYAMSWVRQAPGKGLEWVSAISGSGGSTYYADSVKGRFTISRDNSKNTLYLQ<br>MNSLRAEDTAVYFCAKVMTPDYYYDMDVWGQGTTVTVSSGGGGSGGGGSGGGGSELQMTQSPSSVSASVGDRVTITCRASQS<br>ISSYLNWYQQKPGKAPKLLIYAASSLQSGVPSRFSGSGSGTDFTLTISSLQPEDFAAYYCQQSYSTPPTFGQGTKVEIK<br>(SEQ ID NO: 6894) |
| 17784-C7 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGGCATGAGCTGGGTCCGCCAGGCTCCAGGGAAGGGACTGGAGTGGGTCTCAGCTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6895) |
| | AA | EVQLLESGGGLVQPGGSLRLSCAASGFTFSSYGMSWVRQAPGKGLEWVSAISGSGGSTYYADSVKGRFTISRDNSKNTLYLQ<br>MNSLRAEDTAVYFCAKVMTPDYYYDMDVWGQGTTVTVSSGGGGSGGGGSGGGGSELQMTQSPSSLSASVGDRVTITCRASQG<br>ISNYLAWYQQKPGKVPKLLIYAASSLQSGVPSRFSGSGSGTDFTLTISSLQPEDFATYYCQQSYSTPFTFGPGTKVEIK<br>(SEQ ID NO: 6896) |
| 17784-C11 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAGCTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6897) |
| | AA | EVQLLEWGAGLLKPSETLSLTCAVYGGSFSGYYWSWIRQPPGKGLEWIGEINHSGSTNYNPSLKSRVTISVDTSKNQFSLKL<br>SSVTAADTAVYYCARGGGYSYGYDYGMDVWGQGTTVTVSSGGGGSGGGGSGGGGSELVMTQTPLSLPVTPGEPASISCRSSQ<br>SLLYSNGYNYLDWYLQKPGQSPQLLIYLGSNRASGVPDRFSGSGSGTDFTLKISRVEAEDVGVYYCMQGTHWPFTFGPGTKV<br>EIK<br>(SEQ ID NO: 6898) |
| 17784-G10 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCCGTGATCCTTACTACTGGAGCTGGATCCGCCAGCACCCAGGGAAGGGCCTGGAGTGGATTGGGTACATCTATTA<br>CAGTGGGAGCACCTACTACAACCCGTCCCTCAAGAGTCGAGTTACCATATCAGTAGACACGTCTAAGAACCAGTTCTCCCTG<br>AAGCTGAGC<br>(SEQ ID NO: 6899) |
| | AA | EVQLLESGPGLVKPSQTLSLTCTVSGDSISRDPYYWSWIRQHPGKGLEWIGYIYYSGSTYYNPSLKSRVTISVDTSKNQFSL<br>KLSSVTAADTAVYYCARDKLWFGKLNYYYGMDVWGQGTTVTVSSGGGGSGGGGSGGGGSELVMTQTPLSLPVTPGEPASISC<br>RSSQSLLHSNGYNYLDWYLQKPGQSPQLLIYLGSNRASGVPDRFSGSGSGTDFTLKISRVEAEDVGVYYCMQALQTPITFGQ<br>GTRLEIK<br>(SEQ ID NO: 6900) |

TABLE 54-continued scFv Full Sequences

| Ab | Type | SCFV |
|---|---|---|
| 17784-H5 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAGCTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATTTCAGTTGACCCGTCCAAGAACCAGTTCTCCCTGAAGCTG<br>AGCTCTGTG<br>(SEQ ID NO: 6901) |
| | AA | EVQLLEWGAGLLKPSETLSLTCAVYGGSFSGYYWSWIRQPPGKGLEWIGEINHSGSTNYNPSLKSRVTISVDPSKNQFSLKL<br>SSVTAADTAVYYCARGGGYSYGYDYGMDVWGQGTTVTVSSGGGGSGGGGSGGGGSELVLTQSPLSLPVTPGEPASISCRSSQ<br>SLLFSNGYYYLDWYLQKPGQSPQLLIYLGSNRASGVPDRFSGSGSTDFTLKISRVEAEDVGVYYCMQALQTPPTFGQGTKV<br>EIK<br>(SEQ ID NO: 6902) |
| 17785-D12 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAACTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6903) |
| | AA | EVQLLEWGAGLLKPSETLSLTCAVYGGSFSGYYWNWIRQPPGKGLEWIGEINHSGSTNYNPSLKSRVTISVDTSKNQFSLKL<br>SSVTAADTAVYYCARGGGYSYGYDYGMDVWGQGTTVTVSSGGGGSGGGGSGGGGSELVMTQSPLSLPVTPGEPASISCRSSQ<br>SLLYSNGYNYLDWYLQKPGQSPQLLIYLGSNRASGVPDRFSGSRSGTDFTLKISRVEAEDVGVYYCMQALQTPFTFGPGTKV<br>DIK<br>(SEQ ID NO: 6904) |
| 17813-D8 | NA | GAGGTGCAGCTGCTCGAGTCCGGGGGAGGCTTGGTACAGCCGGGGGGGTCCCTGAGACTCTCCTGTGCAGCCTCTGGATTCA<br>CCTTTAGCAGCTTTGCCATGAGCTGGGTCCGCCAGGCTCCAGGGAAGGGGCTGGAGTGGGTCTCAGCTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6905) |
| | AA | EVQLLESGGGLVQPGGSLRLSCAASGFTFSSFAMSWVRQAPGKGLEWVSAISGSGGSTYYADSVKGRFTISRDNSKNTLYLQ<br>MNSLRAEDTAEYYCAKMVTPDYYYDMDVWGQGTTVTVSSGGGGSGGGGSGGGGSELVMTQSPSSLSASVGDRVTITCRASQG<br>ISNYLAWYQQKPGKVPKLLIYAASTLQSGVPSRFSGSGSGTDFTLTISSLQPEDFATYYCQQSYSTPPTFGQGTKVEIK<br>(SEQ ID NO: 6906) |
| 17813-E3 | NA | GAGGTGCAGCTGCTCGAGTGGGGCGCAGGACTGTTGAAGCCTTCGGAGACCCTGTCCCTCACCTGCGCTGTCTATGGTGGGT<br>CCCTCAGTGGTTACTACTGGAGCTGGATCCGCCAGCCCCCAGGGAAGGGGCTGGAGTGGATTGGGGAAATCAATCACAGTGG<br>AAGAACCAACTACAATCCGTCCCTCAAGAGTCGCGTCACCATGTCAGAAGACACGGCCAAGAACCAGTTCTCCCTGAAGCTG<br>AGCTCTGTG<br>(SEQ ID NO: 6907) |
| | AA | EVQLLEWGAGLLKPSETLSLTCAVYGGSLSGYYWSWIRQPPGKGLEWIGEINHSGRTNYNPSLKSRVTMSEDTAKNQFSLKL<br>SSVTAADTAVYYCARGGGYSDGYDYGMDVWGQGTTVTVSSGGGGSGGGGSGGGGSELVMTQTPLSLPVTPGEPASISCRSSQ<br>SLLYSNGYNYLDWYLQKPGQSPQLLIYLGSNRASGVPDRFSGSGSTDFTLKISRVEAEDVGVYYCMQALQSLTFGGGTKLE<br>IK<br>(SEQ ID NO: 6908) |
| 17813-E5 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAGCTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6909) |
| | AA | EVQLLEWGAGLLKPSETLSLTCAVYGGSFSGYYWSWIRQPPGKGLEWIGEINHSGSTNYNPSLKSRVTISVDTSKNQFSLKL<br>SSVTAADTAVYYCARGGGYSYGYDYGMDVWGQGTTVTVSSGGGGSGGGGSGGGGSELVMTQTPLSLPVTPGEPASISCRSSQ<br>SLLYSNGYNYLDWYLQKPGQSPQLLIYLGSKRASGVPDRFSGSGSGTDFTLKISRVEAEDVGVYYCMQALQTPLTFGGGTKV<br>DIK<br>(SEQ ID NO: 6910) |
| 17813-F1 | NA | GAGGTGCAGCTGCTCGAGTGGGGCGCAGGACTGTTGAAGCCTTCGGAGACCCTGTCCCTCACCTGCGGTGTCTATGGTGGGT<br>CCTTCAGTGGTTACTACTGGAACTGGATCCGCCAGCCCCCAGGGAAGGGGCTGGAGTGGATTGGGGAAATCAATCATCGTGG<br>AAGCACCAACTACAACCCGTCCCTCAAGAGTCGAGTCACCATATCAGTAGACGCGTCCAAGAACCAGTTCTCCCTGAAGCTG<br>AGTTCTGTG<br>(SEQ ID NO: 6911) |
| | AA | EVQLLEWGAGLLKPSETLSLTCGVYGGSFSGYYWNWIRQPPGKGLEWIGEINHRGSTNYNPSLKSRVTISVDASKNQFSLKL<br>SSVTAADTAVYYCARGGGYSDGYDYGMDVWGQGTTVTVSSGGGGSGGGGSGGGGSELVMTQSPLSLSVTPGEPASISCRSSR<br>SLLHSNGYNYLDWYLQKPGQSPQLLIYLGSNRASGVPDRFSGSGSGIDFTLKISRVEAEDVGVYYCMQALQTPHFGGGTKVE<br>IK<br>(SEQ ID NO: 6912) |
| 17814-D9 | NA | GAGGTGCAGCTGCTCGAGTCTGGAGCTGAGGTGAAGAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAACAG<br>TGGTAACACAGGCTATGCACAGAAGTTCCAGGGCAGAGTCACCATGACCAGGAACACCTCCATAAGCACAGCCTACATGGAG<br>CTGAGCAGC<br>(SEQ ID NO: 6913) |
| | AA | EVQLLESGAEVKKPGASVKVSCKASGYTFTSYDINWVRQATGQGLEWMGWMNPNSGNTGYAQKFQGRVTMTRNTSISTAYME<br>LSSLRSEDTAVYYCARGGGYSYGYDYGMDVWGQGTTVTVSSGGGGSGGGGSGGGGSELVMTQSPLSLSVTPGQPASISCKSS<br>QSLLYSNGYNYLDWYLQKPGQSPQLLIYLGSNRASGVPDRFSGSGSGTDFTLKISRVEAEDVGVYYCMQALQTPITFGQGTR<br>LEIK<br>(SEQ ID NO: 6914) |

TABLE 54-continued scFv Full Sequences

| Ab | Type | SCFV |
|---|---|---|
| 18071-B1 | NA | GAGGTGCAGCTGCTCGAGTCTGGGGGAGGCGTGGTCCAGCCTGGGAGGTCCCTGAGACTCTCCTGTGCAGCGTCTGGATTCA<br>CCTTCAGCAGATACGGCATGGACTGGGTCCGCCAGGCTCCAGGCAAGGGGCTGGAGTGGGTGGCACTTATATGGTATGATGG<br>AAGTAATAAATACTATGCAGACTCCGTGAAGGGCCGATTCACCATCTCCAGAGACAATTCCAAGAACACGCTGTATCTGCAA<br>ATGAACAGC<br>(SEQ ID NO: 6915) |
| | AA | EVQLLESGGGVVQPGRSLRLSCAASGFTFSRYGMDWVRQAPGKGLEWVALIWYDGSNKYYADSVKGRFTISRDNSKNTLYLQ<br>MNSLRAEDTAVYYCARNYGSGSYGAYYYHGMDVWGQGTTVTVSSGGGGSGGGGSGGGGSELALTQPPSVSGSPGQSITISCT<br>GTSSDVGGYNYVSWYQQHPGKAPKLMIYEVSKRPSGVSNRFSGSKSGNTASLTISGLQAEDEADYYCSSYTSSSTLVFGGGT<br>KLTVL<br>(SEQ ID NO: 6916) |
| 18071-C4 | NA | GAGGTGCAGCTGCTCGAGTCTGGAGCTGAGGTGAAGAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAACAG<br>TGGTAACACAGACTATGCACAGAAGTTCCAGGGCAGAGTCACCATGACCAGGAACACCTCCATAAGCACAGCCTACATGGAG<br>CTGAGCAGC<br>(SEQ ID NO: 6917) |
| | AA | EVQLLESGAEVKKPGASVKVSCKASGYTFTSYDINWVRQATGQGLEWMGWMNPNSGNTDYAQKFQGRVTMTRNTSISTAYME<br>LSSLRSEDTAVYYCVRGWGTYYYYGMDVWGQGTTVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPWTFGQGTKV<br>EIK<br>(SEQ ID NO: 6918) |
| 18071-D4 | NA | GAGGTGCAGCTGCTCGAGTCTGGGGCTGAGGTGAAGAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAACAG<br>TGGTAACACAGACTATGCACAGAAGTTCCAGGGCAGAGTCACCATGACCAGGAACACCTCCATAAGCACAGCCTACATGGAG<br>CTGAGCAGC<br>(SEQ ID NO: 6919) |
| | AA | EVQLLESGAEVKKPGASVKVSCKASGYTFTSYDINWVRQATGQGLEWMGWMNPNSGNTDYAQKFQGRVTMTRNTSISTAYME<br>LSSLRSEDTAVYYCARGWGRYYSYGMDVWGQGTTVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPWTFGQGTKV<br>EIK<br>(SEQ ID NO: 6920) |
| 18072-D6 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGATATCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6921) |
| | AA | EVQLLESGGGLVQPGGSLRLSCAASGFTFSSYAMSWVRQAPGKGLEWVSAISGSGDITYYADSVKGRFTISRDNSKNTLYLQ<br>MNSLRAEDTAVYYCAKHLRYFDWPLDYWGQGTLVTVSSGGGGSGGGGSGGGGSELTLTQSPGTLSLSPGERATLSCRASQSV<br>SSSYLAWYQQKPGQAPRLLIYGASARATGIPDRFSGSGSGTDFTLTISRLEPEDFAVYYCQQYGSSLTFGGGTKVDIK<br>(SEQ ID NO: 6922) |
| 18072-G9 | NA | GAGGTGCAGCTGCTCGAGTCTGGGGGAGGCCTGGTCAAGCCTGGGGGGTCCCTGAGACTCTCCTGTGCAGCCTCTGGATTCA<br>CCTTCAGTGGCTATAGCATGAACTGGGTCCGCCAGGCTCCAGGGAAGGGGCTGGAGTGGGTCTCGTCCATTAGTAGTAGTAG<br>TAGTTACATATACTACGCAGACTCAGTGAAGGGCCGCTTCACCATCTCCAGAGACAACGCCAAGAACTCACTGTATCTGCAA<br>ATGAACAGC<br>(SEQ ID NO: 6923) |
| | AA | EVQLLESGGGLVKPGGSLRLSCAASGFTFSGYSMNWVRQAPGKGLEWVSSISSSSSYIYYADSVKGRFTISRDNAKNSLYLQ<br>MNSLRAEDTAVYYCVRSKAARPDDGMDVWGQGTTVTVSSGGGGSGGGGSGGGGSELVLTQPPSASGTPGQRITISCSGSSSN<br>IGSNYVYWYQHLPGTAPKLLIYRNNQRPSGVPDRFSGSKSGTSASLAISGLRSEDEADYYCAAWDDSLSGVVFGGGTKLTVL<br>(SEQ ID NO: 6924) |
| 18074-G12 | NA | GAGGTGCAGCTGCTCGAGTCTGGGGGAGGCTTGGTACAGCCGGGGGGGTCCCTGAGACTCTCCTGTGCAGCCTCTGGATTCA<br>CCTTTAGCTCCTATGCCATGAGCTGGGTCCGCCAGGCTCCAGGGAGGGGCTGGAGTGGGTCTCAAGCATAACTATTACTGG<br>TGGTAGCACATACTACGCAGACTCCGTGAAGGGCCGGTTCACCATCTCCAGAGACAATTCCAAGAACACGCTGAATCTGCAA<br>ATGAACAGC<br>(SEQ ID NO: 6925) |
| | AA | EVQLLESGGGLVQPGGSLRLSCAASGFTFSSYAMSWVRQAPGRGLEWVSSITITGGSTYYADSVKGRFTISRDNSKNTLNLQ<br>MNSLRAEDTAVYYCAKDGGSGWFPKLLHYGLDVWGQGTTVTVSSGGGGSGGGGSGGGGSELVMTQSPSSLSASVGDRVTITC<br>QASQDISNYLNWYQQKPGKAPKLLIYDASNLETGVPSRFSGSGSGTDFTFTISSLQPEDFATYYCQQSYSIPPTFGQGTKVE<br>IK<br>(SEQ ID NO: 6926) |
| 18078-H6 | NA | GAGGTGCAGCTGCTCGAGTCTGGGGGAGGCGTGGTCCAGCCTGGGAGGTCCCTGAGACTCTCCTGTGCAGCGTCTGGATTCA<br>CCTTCAGTAGATATGGCATGCAGTGGGTCCGCCAGGCTCCAGGCAAGGGGCTGGAGTGGGTGGCAGTTATATCATATGATGG<br>AAGTAATAAATACTATGCAGACTCCGTGAAGGGCCGATTCACCATCTCCAGAGACAATTCCAAGAACACGCTATATCTGCAA<br>ATGAACAGC<br>(SEQ ID NO: 6927) |
| | AA | EVQLLESGGGVVQPGRSLRLSCAASGFTFSRYGMQWVRQAPGKGLEWVAVISYDGSNKYYADSVKGRFTISRDNSKNTLYLQ<br>MNSLRAEDTAVYYCARNYGSGSYGAYYYHGMDVWGQGTTVTVSSGGGGSGGGGSGGGGSELVLTQPPSVSKGLRQTATLTCT<br>GNSNNVGNQGAAWLQQHQGHPPKLLSYRNNNRPSGISERLSASRSGNTASLTITGLQPEDEADYYCSAWDSSLSAWVFGGGT<br>KLTVL<br>(SEQ ID NO: 6928) |

TABLE 54-continued scFv Full Sequences

| Ab | Type | SCFV |
|---|---|---|
| 18079-C8 | NA | GAGGTGCAGCTGCTCGAGTCTGGGGGAGGCGTGGTCCAGCCTGGGAGGTCCCTGAGACTCTCCTGTGCAGCCTCTGGATTCA<br>CCTTCAGTAGCTATGGCATGCACTGGGTCCGCCAGGCTCCAGGCAAGGGGCTGGAGTGGGTGGCAGTTATATCATATGATGG<br>AAGTAATAAGTACTATGCAGACTCCGTGAAGGGCCGATTCACCATCTCCAGAGACAATTCCAAGAACACGCTGTTTCTGCAA<br>ATGAACAGC<br>(SEQ ID NO: 6929) |
| | AA | EVQLLESGGGVVQPGRSLRLSCAASGFTFSSYGMHWVRQAPGKGLEWVAVISYDGSNKYYADSVKGRFTISRDNSKNTLFLQ<br>MNSLRTEDTAVYYCAREQWPNYYYGLGVWGQGTTVTVSSGGGGSGGGGSGGGGSELVLTQPSSVSKDLRQTATLTCTGNSNN<br>VGNQGAAWLQQHQGHPPKLLSYRNNNRPSGISERLSASRSGNTASLTITGLQPEDEADYYCSAWDSSLSAWVFGGGTKLTVL<br>(SEQ ID NO: 6930) |
| 18079-H4 | NA | GAGGTGCAGCTGCTCGAGTCTGGAGCAGAGGTGAAAAAGCCTGGGGCCTCAGTGAAGGTCTCCTGCAAGGCTTCTGGATACA<br>CCTTCACCAGTTATGATATCAACTGGGTGCGCCAGGCCACTGGACAAGGGCTTGAGTGGATGGGATGGATGAACCCTAACAG<br>TGGTAACACAGACTATGCACAGAAGTTCCAGGGCAGAGTCACCATGACCAGGAACACCTCCATAAGCACAGCCTACATGGAG<br>CTGAGAAGC<br>(SEQ ID NO: 6931) |
| | AA | EVQLLESGAEVKKPGASVKVSCKASGYTFTSYDINWVRQATGQGLEWMGWMNPNSGNTDYAQKFQGRVTMTRNTSISTAYME<br>LRSLRSEDTAVYYCARGWGRFYSYGMDVWGQGTTVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPWTFGQGTKL<br>EIK<br>(SEQ ID NO: 6932) |
| 18079-H11 | NA | GAGGTGCAGCTGCTCGAGTCTGGAGCAGAGGTGAAAAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAACAG<br>TGGTAACACAGACTATACACAGAAGTTCCAGGGCAGAGTCACCATGACCAGGAACACCTCCATAGGCACAGCCTACATGGAG<br>CTGAGCAGC<br>(SEQ ID NO: 6933) |
| | AA | EVQLLESGAEVKKPGASVKVSCKASGYTFTSYDINWVRQATGQGLEWMGWMNPNSGNTDYTQKFQGRVTMTRNTSIGTAYME<br>LSSLRSEDTAVYYCVRGWGTYYYYGMDVWGQGTTVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPWTFGQGTKL<br>EIK<br>(SEQ ID NO: 6934) |
| 18080-C5 | NA | GAGGTGCAGCTGCTCGAGTCGGGCCCAGGACTGGTGAAGCCTTCACAGACCCTGTCCCTCACCTGCACTGTCTCTGGTGGCT<br>CCATCAGCAGTGGTGATTACTACTGGAGCTGGATCCGCCAGCACCCAGGGAAGGGCCTGGAGTGGATTGGGTACATCAATGA<br>CAGTGGGAGCACCTACTATAACCCGTCCCTCAAGAGTCGAGTTACCTTATCAGTAGACTCGTCTAAGAACCAGTTCTCCCTG<br>AAGCTGAGC<br>(SEQ ID NO: 6935) |
| | AA | EVQLLESGPGLVKPSQTLSLTCTVSGGSISSGDYYWSWIRQHPGKGLEWIGYINDSGSTYYNPSLKSRVTLSVDSSKNQFSL<br>KLSSVTAADTAVYYCARDLLWFGKLNYYYGMDVWGQGTTVTVSSGGGGSGGGGSGGGGSELVLTQSPLSLPVTPGEPASISC<br>RSSQSLLHSNGYNYLDWYLQKPGQSPQLLIYLGSNRASGVPDRFSGSGSGTDFTLKISRVEAEDVGVYYCMQALQTPRTFGQ<br>GTKVEIK<br>(SEQ ID NO: 6936) |
| 18080-H9 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGGTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6937) |
| | AA | EVQLLESGGGLVQPGGSLRLSCAASGFTFSSYAMSWVRQAPGKGLEWVSGISGSGGSTYYADSVKGRFTISRDNSKNTLYLQ<br>MNSLRAEDTAVYYCAKVMTPDYYYDMDVWGQGTTVTVSSGGGGSGGGGSGGGGSELTLTQSPGTLSLSPGERATLSCRASQS<br>VSSGYLAWYQQKPGQAPRLLIYGASSRATGIPDRFSGSGSGTDFTLTISRLEPEDFAVYYCQQYGSSPFTFGPGTKVEIK<br>(SEQ ID NO: 6938) |
| 18081-A6 | NA | GAGGTGCAGCTGCTCGAGTCGGGCCCAGGACTGGTGAAGCCTTCGGAGACCCTGTCCCTCACCTGCACTGTCTCTGGTGACT<br>CCATCAGTAGTAGTCGTTACTACTGGGGCTGGATCCGCCAGCCCCCAGGGAAGGGGCTGGAGTGGATTGGGAGTATCTATTA<br>TAGTGGGAGCACCTACTACAACCCGTCCCTCAAGAGTCGAGTCACCATATCCGTAGACACGTCCAAGAACCAGTTCTCCCTG<br>AAGCTGAGT<br>(SEQ ID NO: 6939) |
| | AA | EVQLLESGPGLVKPSETLSLTCTVSGDSISSSRYYWGWIRQPPGKGLEWIGSIYYSGSTYYNPSLKSRVTISVDTSKNQFSL<br>KLSSVTAADTAVYYCARGIFGVITYFDYWGQGTLVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPLTFGGGTKV<br>EIK<br>(SEQ ID NO: 6940) |
| 18081-B5 | NA | GAGGTGCAGCTGCTCGAGTCAGGTCCAGGACAGGTGAAGCCCTCGCAGACCCTCTCACTCACCTGTGCCATCTCCGGGGACA<br>GTGTCTCTAGCAACAGTGCTGCTTGGAACTGGATCAGGCAGTCCCCATCGAGAGGCCTTGAGTGGCTGGGAAGGACATACTA<br>CAGGTCCAAGTGGTATAATGATTATGCAGTATCTGTGAAAAGTCGAATAACCATCAACCCAGACATATCCAAGAACCAGTTC<br>TCCCTGCAG<br>(SEQ ID NO: 6941) |
| | AA | EVQLLESGPGQVKPSQTLSLTCAISGDSVSSNSAAWNWIRQSPSRGLEWLGRTYYRSKWYNDYAVSVKSRITINPDTSKNQF<br>SLQLNSVTPEDTAVYYCAREVLWFGKLNYYYGMDVWGQGTTVTVSSGGGGSGGGGSGGGGSELVLTQSPLSLPVTPGEPASI<br>SCRSSQSLLHRNGYNYLDWYLQKPGQSPQLLIYLGSNRASGVPDRFSGSGSGTDFTLKISRVEAEDVGVYYCMQALQTPITF<br>GQGTRLEIK<br>(SEQ ID NO: 6942) |

TABLE 54-continued scFv Full Sequences

| Ab | Type | SCFV |
|---|---|---|
| 18081-C10 | NA | GAGGTGCAGCTGCTCGAGTCGGGCCCAGGACTGGTGAAGCCTTCGGAGACCCTGTCCCTCACCTGCATTGTCTCTGGTGTCTC<br>CCATCAGCAGTAGTAGGTCCTACTGGGGCTGGATCCGCCAGCCCCCAGGGAAGGGACTGGAGTGGATTGGGAGATATCTATTA<br>TGGTGGGAGCACCTACTACAACCCGTCCCTCAAGAGTCGAGTCACCATATCCGTTGACACGTCCAAGAACCAGTTCTCCCTG<br>AAGCTGAGC<br>(SEQ ID NO: 6943) |
| | AA | EVQLLESGPGLVKPSETLSLTCIVSGVSISSSRSYWGWIRQPPGKGLEWIGSIYYGGSTYYNPSLKSRVTISVDTSKNQFSL<br>KLSSVTAADTAVYYCATTIFGVVGWFDPWGQGNLVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPLTFGGGTKV<br>EIK<br>(SEQ ID NO: 6944) |
| 18081-D6 | NA | GAGGTGCAGCTGCTCGAGTCTGGTCCTGCGCTGGTGAAACCCACACAGACCCTCACGCTGACCTGCACCTTCTCTGGTTTCT<br>CATTCACCACTCATAAAATGGGTGTGGACTGGATCCGTCAGCCCCCAGGAAAGGCCCTGGAGTGGCTTGCACTCATTTATTG<br>GAATGATGATACGCGCTACAGCCCATCTCTGCAGAGTAGGCTCACCATCACCAAGGACACCTCCAAAAACCAGGTGGTCCTC<br>ACAATGACC<br>(SEQ ID NO: 6945) |
| | AA | EVQLLESGPALVKPTQTLTLTCTFSGFSFTTHKMGVDWIRQPPGKALEWLALIYWNDDTRYSPSLQSRLTITKDTSKNQVVL<br>TMTNMDPVDTATYYCVYRRYNWNYENWFDPWGQGTLVTVSSGGGGSGGGGSGGGGSELVMTQSPSSLSASVGDRVTITCRAS<br>QSISSYLNWYQQKPGKAPKLLIYAASSLQSGVPSRFSGSGSGTDFTLTISSLQPEDFATYYCQQSYSTPFTFGPGTKLEIK<br>(SEQ ID NO: 6946) |
| 18081-D12 | NA | GAGGTGCAGCTGCTCGAGTCCGGGGGAGGCCTGGTCAAGCCTGGGGGGTCCCTGAGACTCTCCTGTGCAGCCTCTGGATTCA<br>CCTTTAGCATCTATGCCTTGAGCTGGGTCCGCCAGGCTCCAGGGAAGGGGCTGGAGTGGGTCTCAGCTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6947) |
| | AA | EVQLLESGGGLVKPGGSLRLSCAASGFTFSIYALSWVRQAPGKGLEWVSAISGSGGSTYYADSVKGRFTISRDNSKNTLYLQ<br>MNSLRAEDTAVYYCAKGEGIAARYYYYGMDVWGQGTTVTVSSGGGGSGGGGSGGGGSELVMTQSPSSLSASVGDRVTITCRA<br>SQSISSYLNWYQQKPGKAPKLLIYATSSLQSGVPSRFSGSGSGTDFTLTISSLQPEDFATYYCQQSYSTPPTFGQGTKVEIK<br>(SEQ ID NO: 6948) |
| 18082-F5 | NA | GAGGTGCAGCTGCTCGAGTCCGGGGGAGGCGTGGTCCAGCCTGGGAGGTCCCTGAGACTCTCCTGTGCAGCGTCTGGATTCA<br>CCTTCAGTAGATATGGCATGGATTGGGTCCGCCAGGCTCCAGGCAAGGGACTGGAGTGGGTGGCAGTTATATGGTATGATGG<br>AAGTAATAAATACTATGCAGACTCCGTGAAGGGCCGATTCACCATCTCCAGAGACAATTCCAAGAATACGCTGTATCTGCAA<br>ATGAACAGC<br>(SEQ ID NO: 6949) |
| | AA | EVQLLESGGGVVQPGRSLRLSCAASGFTFSRYGMDWVRQAPGKGLEWVAVIWYDGSNKYYADSVKGRFTISRDNSKNTLYLQ<br>MNSLRAEDTAVYYCARNYGSGSYGAYYYHGMDVWGQGTTVTVSSGGGGSGGGGSGGGGSELALTQPASASGSPGQSITISCT<br>GTSSDVGGYNYVSWYQQHPGKAPKLMIYEVSKRPSGVPDRFSGSKSGNTASLTVSGLQAEDEADYYCSSYAGSNNVVFGGGT<br>KLTVL<br>(SEQ ID NO: 6950) |
| 18084-E4 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TAGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6951) |
| | AA | EVQLLESGGGLVQPGGSLRLSCAASGFTFSSYAMSWVRQAPGKGLEWVSAISGSGSSTYYADSVKGRFTISRDNSKNTLYLQ<br>MNSLRAEDTAVYYCAKHLRYSDWPLDYWGQGTLVTVSSGGGGSGGGGSGGGGSELTLTQSPGTLSLSPGERATLSCRASQSV<br>SSSYLAWYQQKPGQAPRLLIYGASSRATGIPARFSGSGSGTDFTLTISRLEPEDFAVYYCQQYGSSPLTFGGGTKLEIK<br>(SEQ ID NO: 6952) |
| 18086-H4 | NA | GAGGTGCAGCTGCTCGAGTCTGGAGCTGAGGTGAAGAAGCCTGGGGCCTCAGTGAAGGTCTCCTGCAAGGCTTCTGGATACA<br>CCTTCACCAGTTATGATATCAACTGGGTGCGACAGGCCACTGGACAAGGGCTTGAGTGGATGGGATGGATGAACCCTAAGAG<br>TGGTAACACAGGCTATGCACAGAAGTTCCAGGACAGAGTCACCATGACCAGGAACACCTCCATAAGCACAGCCTACATGGAG<br>CTGAGCAGC<br>(SEQ ID NO: 6953) |
| | AA | EVQLLESGAEVKKPGASVKVSCKASGYTFTSYDINWVRQATGQGLEWMGWMNPKSGNTGYAQKFQDRVTMTRNTSISTAYME<br>LSSLRSDDTAVYYCVRGWGTYYYYGMDVWGQGTTVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPWTFGQGTKV<br>DIK<br>(SEQ ID NO: 6954) |
| 18088-B10 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGATATCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6955) |
| | AA | EVQLLESGGGLVQPGGSLRLSCAASGFTFSSYAMSWVRQAPGKGLEWVSAISGSGDITYYADSVKGRFTISRDNSKNTLYLQ<br>MNSLRAEDTAVYYCAKHLRYFDWPLDYWGQGTLVTVSSGGGGSGGGGSGGGGSELVMTQSPGTLSLSPGERATLSCRASQSV<br>SSSYLAWYQQKPGQAPRLLIYGASTRATGIPDRFSGSGSGTDFTLTISRLEPEDFAVYYCQQYGTSPLTFGGGTKVDIK<br>(SEQ ID NO: 6956) |

TABLE 54-continued scFv Full Sequences

| Ab | Type | SCFV |
|---|---|---|
| 18088-E4 | NA | GAGGTGCAGCTGCTCGAGTGGGGCGCAGGACTGTTGAAGCCTTCGGAGACCCTGTCCCTCACCTGCGCTGTCTATGGTGGGT<br>CCTTCAGTGGTTACTACTGGAGCTGGATCCGCCAGCCCCCAGGGAAGGGGCTGGAGTGGATTGGGGAAATCAATCATAGTGG<br>AAGCACCAACTACAACCCGTCCCTCAAGAGTCGAGTCACCATATCAGTAGACACGTCCAAGAACCAGTTCTCCCTGAAGCTG<br>AGCTCTGTG<br>(SEQ ID NO: 6957) |
| | AA | EVQLLEWGAGLLKPSETLSLTCAVYGGSFSGYYWSWIRQPPGKGLEWIGEINHSGSTNYNPSLKSRVTISVDTSKNQFSLKL<br>SSVTAADTAVYYCARGGGYSYGYDYGMDVWGQGTTVTVSSGGGGSGGGGSGGGGSELVMTQSPLSLPVIPGEPASISCRSSQ<br>SLLYSNGYNYLDWYLQKPGQSPQLLIYLGSKRASGVPDRFSGSGSGTDFTLKISRVEAEDVGVYYCMQVLQTPPTFGQGTKL<br>DIK<br>(SEQ ID NO: 6958) |
| 18089-B8 | NA | GAGGTGCAGCTGCTCGAGTCGGGCCCAGGACTGGTGAAGCCTTCGGAGACCCTGTCCCTCACCTGCATTGTCTCTGGTGGCT<br>CCATCAGCAGTAGTAGGTCCTACTGGGGCTGGATCCGCCAGCCCCCAGGGAAGGGACTGGAGTGGATTGGGAGTATCTATTA<br>TGGTGGGAGCACCTACTACAACCCGTCCCTCAAGAATCGAGTCACCATGTCCGTTGACACGTCCAAGAACCAGTTCTCCCTG<br>AAGCTGAGC<br>(SEQ ID NO: 6959) |
| | AA | EVQLLESGPGLVKPSETLSLTCIVSGGSISSSRSYWGWIRQPPGKGLEWIGSIYYGGSTYYNPSLKNRVTMSVDTSKNQFSL<br>KLSSVTAADTAVYYCATTIFGVVGWFDPWGQGNLVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPLTFGGGTKV<br>DIK<br>(SEQ ID NO: 6960) |
| 18089-C8 | NA | GAGGTGCAGCTGCTCGAGTCTGGTCCTGCGCTGGTGAAACCCACACAGACCCTCACGCTGTCCTGTTCCTTCTCTGGGTTCT<br>CACTCAGCACTAATAAAATGGCTGTGGGTTGGATCCGTCAGCCCCCAGGAAAGGGCCCTGGAGTGGCTTGCACTCATTTATTG<br>GAATGATGATAAGCGCTACAGTCCATCTCTGAAGAGCAGGCTCACCATCACCAAGGACACCTCCAAAAACCAGGTGGTCCTT<br>ACAATGACC<br>(SEQ ID NO: 6961) |
| | AA | EVQLLESGPALVKPTQTLTLSCSFSGFSLSTNKMAVGWIRQPPGKALEWLALIYWNDDKRYSPSLKSRLTITKDTSKNQVVL<br>TMTNMDPVDTATYYCARRRYNWNYENWFDPWGQGILVTVSSGGGGSGGGGSGGGGSELQMTQSPSSLSASVGDRVTITCRASQ<br>SISSSYLNWYQQKPGKAPKLLIYAASSLQSGVPSRFSGSGSGTDFTLTISSLQPEDFATYYCQQSYSTPLTFGGGTKVEIK<br>(SEQ ID NO: 6962) |
| 18089-G7 | NA | GAGGTGCAGCTGCTCGAGTCTGGTCCTGTGCTGGTGAAACCCACACAGACCCTCACGCTGACCTGCACCTTCTCTGGTTTCT<br>CATTCACCACTCATAAAATGGGTGTGGACTGGATCCGTCAGCCCCCAGGAAAGGGCCCTGGAGTGGCTTGCACTCATTTATTG<br>GAATGATGATAAGCGCTACAGCCCATCTCTGCAGAGTAGGCTCACCATCACCAAGGACACCTCCAAAAACCAGGTGGTCCTC<br>ACAATGACC<br>(SEQ ID NO: 6963) |
| | AA | EVQLLESGPVLVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSELQMTQSPSSLSASVGDRVTITCRAS<br>QSISSYLNWYQQKPGKAPKLLIYATSSLQSGVPSRFSGSGSGTDFTLTISSLQPEDFATYYCQQSYSIPFTFGPGTKVEIK<br>(SEQ ID NO: 6964) |
| 18089-G11 | NA | GAGGTGCAGCTGCTCGAGTCCGGGGGAGGCTTGGTACAGCCTGGGGGGTCCCTGAGACTCTCCTGTGCAGCCTCTGGATTCA<br>GCCTTTAGCACTATGCCATGAGCTGGGTCCGCCAGGCTCCAGGGAAGGGGCTGGAGTGGGTCTCAGGTATTAGTGGTAGTGG<br>TGGTAGCTCATACTACGCAGACTCCGTGAAGGGCCGGTTCACCATCTCCAGAGACAATTCCAAGAACACGCTGTATCTGCAA<br>ATGAACAGC<br>(SEQ ID NO: 6965) |
| | AA | EVQLLESGGGLVQPGGSLRLSCAASGFTFSSYAMSWVRQAPGKGLEWVSGISGSGGSSYYADSVKGRFTISRDNSKNTLYLQ<br>MNSLRAEDTAVYYCAKTLTPDYYYDMDVWGQGTTVTVSSGGGGSGGGGSGGGGSELQMTQSPSSVSASVGDRVTITCQASQD<br>ISNYLNWYQQKPGKAPKLLIYAASSLQSGVPSRFSGSGSGTDFTLTISSLQPEDFATYYCQQSYSTPLTFGGGTKVDIK<br>(SEQ ID NO: 6966) |
| 18089-H9 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCGTGAGCTGGGTCCGCCAGGCTCCAGGGAAGGGGCTGGAGTGGGTCTCAGGTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6967) |
| | AA | EVQLLESGGGLVQPGGSLRLSCAASGFTFSSYAVSWVRQAPGKGLEWVSGISGSGGSTYYADSVKGRFTISRDNSKNTLYLQ<br>MNSLRAEDTAVYYCAKALTPDYYYDMDVWGQGTTVTVSSGGGGSGGGGSGGGGSELQMTQSPSSLSASVGDRVTITCRASQG<br>ISNYLAWYQQKPGKVPNLLIYGASTLQLGVPSRFSGSGSGTDFTLTISSLQPEDVATYYCQKYYSAPFTFGPGTKVDIK<br>(SEQ ID NO: 6968) |
| 18089-H12 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAACTATGCCATGAGCTGGGTCCGCCAGGCTCCAGGGAAGGGGCTGGAGTGGGTCTCAGCTATTAGTGGTAGTGG<br>TGGTAGTACATACTACGCAGACTCCGTGAAGGGCCGGTTCACCATCTCCAGAGACAATTCCAAGAACACGCTGTATCTGCAA<br>ATGAACAGC<br>(SEQ ID NO: 6969) |
| | AA | EVQLLESGGGLVQPGGSLRLSCAASGFTFSNYAMSWVRQAPGKGLEWVSAISGSGGSTYYADSVKGRFTISRDNSKNTLYLQ<br>MNSLRAEDTAVYYCAKQGGIAAAYYYYDGMDVWGQGTTVTVSSGGGGSGGGGSGGGGSELQMTQSPSSLSASVGDRVTITCRA<br>SQSISSYLNWYQQKPGKAPKLLIYAASSLQSGVPSRFSGSGSGTDFTLTISSLQPEDFATYYCQQSYSTPFTFGPGTKLEIK<br>(SEQ ID NO: 6970) |

TABLE 54-continued scFv Full Sequences

| Ab | Type | SCFV |
|---|---|---|
| 18090-H9 | NA | GAGGTGCAGCTGCTCGAGTCCGGGGGAGGCGTGGTCCAGCCTGGGAGGTCCCTGAGACTCTCCTGTGCAGCGTCTGGATTCA<br>CCTTCAGTAGATATGGCATGGATTGGGTCCGCCAGGCTCCAGGCAAGGGACTGGAGTGGGTGGCAGTTATATCATATGATGG<br>AAGTAATAAATACTATGCAGACTCCGTGAAGGGCCGATTCACCATCTCCAGAGACAATTCCAAGAACACGCTGTATCTGCAA<br>ATGAACAGC<br>(SEQ ID NO: 6971) |
| | AA | EVQLLESGGGVVQPGRSLRLSCAASGFTFSRYGMDWVRQAPGKGLEWVAVISYDGSNKYYADSVKGRFTISRDNSKNTLYLQ<br>MNSLRAEDTAVYYCARNYGSGSYGAYYYYGMDVWGQGTTVTVSSGGGGSGGGGSGGGGSELVLTQLPSVSKGLRQTATLTCT<br>GNSNNVGNQGAAWLQQHQGHPPKLLSYRNNNRPSGISERLSASRSGNTASLTITGLQPEDEADYYCSAWDSSLSAVVFGGGT<br>KLTVL<br>(SEQ ID NO: 6972) |
| 18093-E2 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTACCTCCTATGCCATGAGCTGGGTCCGCCAGGCTCCAGGGAAGGGGCTGGAGTGGGTCTCAACTATTAGTCATAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6973) |
| | AA | EVQLLESGGGLVQPGGSLRLSCAASGFTFTSYAMSWVRQAPGKGLEWVSTISHSGGSTYYADSVKGRFTISRDNSKNTLYLQ<br>MNSLRAEDTAVYYCAKDGGSGWFPKLLHYGLDVWGQGTTVTVSSGGGGSGGGGSGGGGSELVMTQSPSSLSASVGDRVTITC<br>QASQDISNYLNWYQQKPGKAPKLLIYAASSLQSGVPSRFSGSGSGTEFTLTISSLQPEDFATYYCQQSYSTPPTFGQGTKVD<br>IK<br>(SEQ ID NO: 6974) |
| 18093-F5 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTGAGCATCTATGGCATGAGCTGGGTCCGCCAGGCTCCAGGGAAGGGGCTGGAGTGGGTCTCAGCTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 6975) |
| | AA | EVQLLESGGGLVQPGGSLRLSCAASGFTLSIYGMSWVRQAPGKGLEWVSAISGSGGSTYYADSVKGRFTISRDNSKNTLYLQ<br>MNSLRAEDTAVYYCAKGEGISARYYYYGMDVWGQGTTVTVSSGGGGSGGGGSGGGGSELVMTQSPSSLSASVGDRVTITCRA<br>SQSISSYLNWYQQKPGKAPKLLIYAASSLQSGVPSRFSGSGSGTDFTLTISSLQPEDFATYYCQQSYSVPPTFGQGTKVDIK<br>(SEQ ID NO: 6976) |
| 18179-A3 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCTCCCCGGGAAGGGCCTGGAGTGGATTGGGTACATCTCTTA<br>CAGTGGGAGCACCTTCTACAACCCGTCCCTCAAGAGTCGAGTTACCATATCAGTAGACACGTCTAAGAACCAGTTCTCCCTG<br>AATCTGACC<br>(SEQ ID NO: 6977) |
| | AA | EVQLLESGPGLVKPSQTLSLTCTVSGDSISSNPYYWSWIRQLPGKGLEWIGYISYSGSTFYNPSLKSRVTISVDTSKNQFSL<br>NLTSVTAADTAVYYCARDRLWFGVLNYYYGMDWGLGTTVTVSSGGGGSGGGGSGGGGSELVMTQSPLSLPVTPGEPASISC<br>RSSQSLLHRNGYNYLDWYLQKPGQSPQLLIYLGSNRASGVPDRFSGSGSGTDFTLKISRVEAEDVGVYYCMQALQTPFTFGP<br>GTKVDIK<br>(SEQ ID NO: 6978) |
| 18179-A5 | NA | GAGGTGCAGCTGCTCGAGTCGGGCCCAGGACTGGTGAAGCCTTCGGAGACCCTGTCCCTCACCTGCACTGTCTCTGGTGGCG<br>CCATCAGCAGTGGTGATTACTACTGGAGCTGGATCCGCCAGCACCCAGGGAAGGGCCTGGAGTGGATTGGGTACATCGATAA<br>GAGTGGGAGCACCTACTACAACCCGTCCCTCAAGAGTCGAGCTACCATATCAGTAGACACGTCTAAGGACCAGTTCTCCCTG<br>AAGCTGACC<br>(SEQ ID NO: 6979) |
| | AA | EVQLLESGPGLVKPSETLSLTCTVSGGAISSGDYYWSWIRQHPGKGLEWIGYIDKSGSTYYNPSLKSRATISVDTSKDQFSL<br>KLTSLTAADTAVYYCAREKMWFGVLNYYYGMDWGQGTTVTVSSGGGGSGGGGSGGGGSELVLTQSPLSLPVTPGEPASISC<br>RSSQSLLHSNGYNYLDWYLQKPGQSPQLLIYLGSNRASGVPDRFSGSGSGTDFTLKISRVEAEDVGVYYCMQALQTPFTFGP<br>GTKVEIK<br>(SEQ ID NO: 6980) |
| 18179-A9 | NA | GAGGTGCAGCTGCTCGAGTCGGGCCCAGGACTGGTGAAGCCTTCACAGACCCTGTCCCTCACCTGCACTGTCTCTGGTGGCG<br>CCATCAGCAGTGGTGATTACTACTGGAGCTGGATCCGCCAGCACCCAGGGAAGGGCCTGGAGTGGATTGGGTACATCGATAA<br>GAGTGGGAGCACCTACTACAACCCGTCCCTCAAGAGTCGAGTTACCATATCAGTTGACACGTCTAAGAACCAGTTCTCCCTG<br>AATCTGACC<br>(SEQ ID NO: 6981) |
| | AA | EVQLLESGPGLVKPSQTLSLTCTVSGGAISSGDYYWSWIRQHPGKGLEWIGYIDKSGSTYYNPSLKSRVTISVDTSKNQFSL<br>NLTSVTAADTAVYYCARDRLWFGVLNYYYGMDWGQGTTVTVSSGGGGSGGGGSGGGGSELVMTQSPLSLPVTPGEPASISC<br>RSSQSLLHSNGYNYVDWYLQKPGQSPQLLIYLGSNRASGVPDRFSGSGSGADFTLKISRVEAEDVGVYYCMQALQTPLTFGG<br>GTKVEIK<br>(SEQ ID NO: 6982) |
| 18179-A10 | NA | GAGGTGCAGCTGCTCGAGTCGGGCCCAGGACTGGTGAAGCCTTCACAGACCCTGTCCCTCACCTGCACTGTCTCTGGTGGCG<br>CCATCAGCAGTGGTGATTACTACTGGAGCTGGATCCGCCAGCACCCAGGGAAGGGCCTGGAGTGGATTGGGTACATCGATAA<br>GAGTGGGAGCACCTACTACAACCCGTCCCTCAAGAGTCGAGCTACCATATCAGTAGACACGTCTAAGGACCAGTTCTCCCTG<br>AAGCTGAGC<br>(SEQ ID NO: 6983) |
| | AA | EVQLLESGPGLVKPSQTLSLTCTVSGGAISSGDYYWSWIRQHPGKGLEWIGYIDKSGSTYYNPSLKSRATISVDTSKDQFSL<br>KLSSVTAADTAVYYCARDQLWFGVLNYYYGMDWGQGTTVTVSSGGGGSGGGGSGGGGSELVLTQSPGTLSLSPGERATLSC<br>RSSQSLLHRNGYNYLDWYLQKPGQSPQLLIYLGSNRASGVPDRFSGSGSGTDFTLKISRVEAEDVGVYYCMQALQTPRTFGQ<br>GTKVEIK<br>(SEQ ID NO: 6984) |

TABLE 54-continued scFv Full Sequences

| Ab | Type | SCFV |
|---|---|---|
| 18179-B7 | NA | GAGGTGCAGCTGCTCGAGTCTGGGGGAGGCTTGGTAAAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 6985) |
|  | AA | EVQLLESGGGLVKPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSNSGSYYNYFSVMDVWGQGTTVTVSSGGGGSGGGGSGGGGSELVMTQSPSSLSASVGDRVTIT<br>CQARQDISDYLNWFQQKPGRAPKLLIFAASSLQGGVPSRFSGSGSGTDFTLTISSLQPEDFATYYCQQTYSMPFTFGPGTKV<br>DIK<br>(SEQ ID NO: 6986) |
| 18179-B8 | NA | GAGGTGCAGCTGCTCGAGTCCGGGGGAGGCTTGGTACAGCCTGGGGGGTCCCTGAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 6987) |
|  | AA | EVQLLESGGGLVQPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSNSGSYYNYFSVMDVWGQGTTVTVSSGGGGSGGGGSGGGGSELVMTQSPSSLSASVGDRVTIT<br>CRTSQSINSYLNWFQQKPGKAPKLLIYAASSLQSGVPSRFSGSGSGTDFTLTISSLQPEDFATYYCQQSYSTPFTFGPGTKV<br>DIK<br>(SEQ ID NO: 6988) |
| 18179-C4 | NA | GAGGTGCAGCTGCTCGAGTCGGGCCCAGGACTGGTGAAGCCTTCACAGACCCTGTCCCTCACCTGCACTGTCTCTGGTGGCG<br>CCATCAGCAGTGGTGATTACTACTGGAGCTGGATCCGCCAGCACCCAGGGAAGGGCCTGGAGTGGATTGGGTACATCGATAA<br>GAGTGGGAGCACCTACTACAACCCGTCCCTCAAGAGTCGAGCTACCATATCAGTAGACACGTCTAAGGACCAGTTCTCCCTG<br>AAGCTGAGC<br>(SEQ ID NO: 6989) |
|  | AA | EVQLLESGPGLVKPSQTLSLTCTVSGGAISSGDYYWSWIRQHPGKGLEWIGYIDKSGSTYYNPSLKSRATISVDTSKDQFSL<br>KLSSVTAADTAVYYCARDRLWFGVLNYYYGMDVWGPGTTVTVSSGGGGSGGGGSGGGGSELVMTQSPLSLPVTPGEPASISC<br>RSSQSLLHSTGYNYLDWYLQKPGQSPQLLIYLGSNRASGVPDRFSGSGSGTDFTLKISRVEAGDVGFYYCMQALQTPRTFGQ<br>GTKLEIK<br>(SEQ ID NO: 6990) |
| 18179-C6 | NA | GAGGTGCAGCTGCTCGAGTCGGGCCCAGGACTGGTGAAGCCTTCACAGACCCTGTCCCTCACCTGCACTGTCTCTGGTGGCG<br>CCATCAGCAGTGGTGATTACTACTGGAGCTGGATCCGCCAGCACCCAGGGAAGGGCCTGGAGTGGATTGGGTACATCGATAA<br>GAGTGGGAGCACCTACTACAACCCGTCCCTCAAGAGTCGAGCTACCATATCAGTAGACACGTCTAAGGACCAGTTCTCCCTG<br>AAGCTGAGC<br>(SEQ ID NO: 6991) |
|  | AA | EVQLLESGPGLVKPSQTLSLTCTVSGGAISSGDYYWSWIRQHPGKGLEWIGYIDKSGSTYYNPSLKSRATISVDTSKDQFSL<br>KLSSVTAADTAVYYCARDQLWFGVLNYYYGMDVWGQGTTVTVSSGGGGSGGGGSGGGGSELVMTQTPLSLPVTPGEPASISC<br>RSSQSLLHRNGYNYLDWYLHKPGQSPQLLIYLGSNRASGVPDRFIGSGSGTDFTLKISKVEAEDVGIYYCMQALQTPRTFGQ<br>GTKVEIK<br>(SEQ ID NO: 6992) |
| 18179-C7 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCACCCAGGGAAGGGCCTGGAGTGGATTGGGTACATCTCTCA<br>CAGTGGGAGCACTTATTACAATCCGTCCCTCAAGAGTCGAGTAACCATATCAGTAGACACGTCTAAGAATCAGTTCTCCCTG<br>AATCTGACC<br>(SEQ ID NO: 6993) |
|  | AA | EVQLLESGPGLVKPSQTLSLTCTVSGDSISSNPYYWSWIRQHPGKGLEWIGYISHSGSTYYNPSLKSRVTISVDTSKNQFSL<br>NLTSVTAADTAVYYCAREKMWFGVLNYYYGMDVWGLGTTVTVSSGGGGSGGGGSGGGGSELVLTQSPLSLPVTPGEPASISC<br>RSSQSLLHRNGYHYLDWYLQKPGQSPQLLIYLGSNRASGVPDRFIGSGSGTDFTLEISRVEAEDVGVYYCMQALQTPSFGQG<br>TKLEIK<br>(SEQ ID NO: 6994) |
| 18179-C10 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCACCCAGGGAAGGGCCTGGAGTGGATTGGGTACATCTCTCA<br>CAGTGGGAGCACTTATTACAATCCGTCCCTCAAGAGTCGAGTAACCATATCAGTAGACACGTCTAAGAATCAGTTCTCCCTG<br>AAGCTGACC<br>(SEQ ID NO: 6995) |
|  | AA | EVQLLESGPGLVKPSQTLSLTCTVSGDSISSNPYYWSWIRQHPGKGLEWIGYISHSGSTYYNPSLKSRVTISVDTSKNQFSL<br>KLTSVTAADTAVYYCARDRLWFGVLNYYYGMDVWGLGTTVTVSSGGGGSGGGGSGGGGSELVLTQSPLSLPVTPGEPASISC<br>RSSQSLLHRNGYNYLDWYLQKPGQSPQLLIYLGSNRASGVPDRFSGSGSGTDFTLKISRVEAEDVGVYYCMQALQTPFTFGP<br>GTKVEIK<br>(SEQ ID NO: 6996) |
| 18179-D8 | NA | GAGGTGCAGCTGCTCGAGTCCGGGGGAGGCTTGGTAAAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 6997) |
|  | AA | EVQLLESGGGLVKPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSNSGSYYNYFSVMDVWGQGTTVTVSSGGGGSGGGGSGGGGSELVMTQSPSSLSASVGDRVTITC<br>RTSQSISSYLNWYQQKPGRAPKLLIFAASSLQGGVPSRFSGSGSGTDFTLTISSLQPEDFATYYCQQTYSMPFTFGPGTKVD<br>IK<br>(SEQ ID NO: 6998) |

TABLE 54-continued scFv Full Sequences

| Ab | Type | SCFV |
|---|---|---|
| 18179-D9 | NA | GAGGTGCAGCTGCTCGAGTCCGGGGGAGGCTTGGTAAAGCCTGGGGGGTCCCTTAGACTCTCCTGTGCAGCCTCTGGATTCA CTTTCAGTAACGCCTGGATGAGCTGGGTCCGCCAGGCTCCAGGGAAGGGGCTGGAGTGGGTTGGCCGTATTAAAGGCAACAC TTATGGTGGGACAACAGACTACGCTGCACCCGTGAAAGGCAGATTCACCATCTCAAGAGATGATTCAAAAAACACGCTGTTT CTGCAAATG (SEQ ID NO: 6999) |
|  | AA | EVQLLESGGGLVKPGGSLRLSCAASGFTFSNAWMSWVRQAPGKGLEWVGRIKGNTYGGTTDYAAPVKGRFTISRDDSKNTLF LQMNSLKTEDTAVYYCTTPSYSGSYYNYFSVMDVWGQGTTVTVSSGGGGSGGGGSGGGGSELVMTQSPSSLSASVGDRVTIT CRTSQSINSYLNWFQQKPGKAPKLLIFAASSLQSGVPSRFSGSGSTDFTLTISSLQREDFATYYCQQSYSTPFTFGPGTKV DIK (SEQ ID NO: 7000) |
| 18179-E6 | NA | GAGGTGCAGCTGCTCGAGTCTGGGGGAGGCTTGGTACAGCCTGGGGGGTCCCTGAGACTCTCCTGTGCAGCCTCTGGATTCA CTTTCAGTAACGCCTGGATGAGCTGGGTCCGCCAGGCTCCAGGGAAGGGGCTGGAGTGGGTTGGCCGTATTAAAGGCAACAC TTATGGTGGGACAACAGACTACGCTGCACCCGTGAAAGGCAGATTCACCATCTCAAGAGATGATTCAAAAAACACGCTGTTT CTGCAAATG (SEQ ID NO: 7001) |
|  | AA | EVQLLESGGGLVQPGGSLRLSCAASGFTFSNAWMSWVRQAPGKGLEWVGRIKGNTYGGTTDYAAPVKGRFTISRDDSKNTLF LQMNSLKTEDTAVYYCTTPSNSGSYYNYFSVMDVWGQGTTVTVSSGGGGSGGGGSGGGGSELQMTQSPSSLSASVGDRVTIT CRTSQSISSYLNWYQQKPGRAPKLLIFAASSLQGGVPSRFSGSGSTDFTLTISSLQPEDFATYYCQQTYSMPFTFGPGTKL EIK (SEQ ID NO: 7002) |
| 18179-F3 | NA | GAGGTGCAGCTGCTCGAGTCGGGCCCAGGACTGGTGAAGCCTTCGGAGACCCTGACCCTCACCTGCACTGTCTCTGGTGGCT CCATCAGTAGTTACTACTGGAGCTGGATCCGGCAGCCCGCCGGGAAGGGACTGGAGTGGATTGGGCATATCTATACCAGTGG GAGCACCAACTACAACCCCTCCCTCAAGAGTCGAGTCACCATGTCAGTGGACTCGTCCAAGAACCAGTTCTCCCTGAAGCTG ACCTCTCTG (SEQ ID NO: 7003) |
|  | AA | EVQLLESGPGLVKPSETLTLTCTVSGGSISSYYWSWIRQPAGKGLEWIGHIYTSGSTNYNPSLKSRVTMSVDSSKNQFSLKL TSLTAADTAVYYCAREKMWFGVLNYYYGMDVWGQGTTVTVSSGGGGSGGGGSGGGGSELVLTQSPLSLPVTPGEPASISCRS SQSLLHRNGYNYLDWYLQKPGQSPQLLIYLGSNRASGVPDRFIGSGSGTDFTLEISRVEAEDVGVYYCMQALQTPSFGQGTK LEIK (SEQ ID NO: 7004) |
| 18179-F4 | NA | GAGGTGCAGCTGCTCGAGTCGGGCCCAGGACTGGTGAAGCCTTCACAGACCCTGTCCCTCACCTGCACTGTCTCTGGTGACT CCATCAGCAGTAATCCTTACTACTGGAGCTGGATCCGCCAGCTCCCCGGGAAGGGCCTGGAGTGGATTGGGTACATCTCTTA CAGTGGGAGCACCTTCTACAACCCGTCCCTCAAGAGTCGAGTTACCATATCAGTAGACACGTCTAAGAACCAGTTCTCCCTG AATCTGACC (SEQ ID NO: 7005) |
|  | AA | EVQLLESGPGLVKPSQTLSLTCTVSGDSISSNPYYWSWIRQLPGKGLEWIGYISYSGSTFYNPSLKSRVTISVDTSKNQFSL NLTSVTAADTAVYYCARDRLWFGVLNYYYGMDVWGLGTTVTVSSGGGGSGGGGSGGGGSELVLTQSPLSLPVTPGEPASISC RSSQSLLHRNGYHYLDWYLQKPGQSPQLLIYLGSNRASGVPDRFSGSGSGTDFTLKISRVEAEDVGVYYCMQALQTPFTFGP GTKVEIK (SEQ ID NO: 7006) |
| 18179-F6 | NA | GAGGTGCAGCTGCTCGAGTCGGGCCCAGGACTGGTGAAGCCTTCACAGACCCTGTCCCTCACCTGCACTGTCTCTGGTGGCG CCATCAGCAGTGGTGATTACTACTGGAGCTGGATCCGCCAGCACCCAGGGAAGGGCCTGGAGTGGATTGGGTACATCGATAA GAGTGGGAGCACCTACTACAACCCGTCCCTCAAGAGTCGAGCTACCATATCAGTAGACACGTCTAAGGACCAGTTCTCCCTG AAGCTGAGC (SEQ ID NO: 7007) |
|  | AA | EVQLLESGPGLVKPSQTLSLTCTVSGGAISSGDYYWSWIRQHPGKGLEWIGYIDKSGSTYYNPSLKSRATISVDTSKDQFSL KLSSVTAADTAVYYCARDQLWFGVLNYYYGMDVWGQGTTVTVSSGGGGSGGGGSGGGGSELVMTQSPLSLPVTPGEPASISC RSSQSLLHSNGYNYLDWYLQKPGQSPQLLIYLGSNRASGVPDRFSGSGSGTDFTLKISRVEAEDVGFYYCMQALQTPRTFGQ GTKVEIK (SEQ ID NO: 7008) |
| 18179-F10 | NA | GAGGTGCAGCTGCTCGAGTCGGGCCCAGGACTGGTGAAGCCTACGGAGACCCTGTCCCTCACCTGCACTGTCTCTGGTGGCT CCATCAGTGATTTCTTCTGGAGCTGGATCCGGCAGCCCCCAGGAAAGGGACTGGAGTGGATTGGATATATCTATTACAGAGG GAGCACCAACTACCACCCCTCCCTCAAGAGTCGAGTCACCATGTCAGTGGACACGTCCAAGAACCAGTTCTCCCTGAAGCTG ACCTCTCTG (SEQ ID NO: 7009) |
|  | AA | EVQLLESGPGLVKPTETLSLTCTVSGGSISDFFWSWIRQPPGKGLEWIGYIYYRGSTNYHPSLKSRVTMSVDTSKNQFSLKL TSLTAADTAVYYCAREKMWFGVLNYYYGMDVWGQGTTVTVSSGGGGSGGGGSGGGGSELVMTQTPLSLPVTPGEPASISCRS SQSLLHSNGYNYLDWYLQKPGQSPQLLIYLGSNRASGVPDRFSGSGSGTDFTLKISRVEAEDVGFYYCMQALQTPRTFGQGT KVEIK (SEQ ID NO: 7010) |
| 18179-G8 | NA | GAGGTGCAGCTGCTCGAGTCGGGCCCAGGACTGGTGAAGCCTTCACAGACCCTGTCCCTCACCTGCACTGTCTCTGGTGGCG CCATCAGCAGTGGTGATTACTACTGGAGCTGGATCCGCCAGCACCCAGGGAAGGGCCTGGAGTGGATTGGGTACATCGATAA GAGTGGGAGCACCTACTACAACCCGTCCCTCAAGAGTCGAGCTACCATATCAGTAGACACGTCTAAGGACCAGTTCTCCCTG AAGCTGAGC (SEQ ID NO: 7011) |

TABLE 54-continued scFv Full Sequences

| Ab | Type | SCFV |
|---|---|---|
| | AA | EVQLLESGPGLVKPSQTLSLTCTVSGGAISSGDYYWSWIRQHPGKGLEWIGYIDKSGSTYYNPSLKSRATISVDTSKDQFSL<br>KLSSVTAADTAVYYCARDQLWFGVLNYYYGMDVWGQGTTVTVSSGGGGSGGGGSGGGGSELVMTQSPLSLPVTPGEPASISC<br>RSSQSLLHRNGYNYLDWYLHKPGQSPQLLIYLGSNRASGVPDRFSGSGSGTDFTLKISRVEAEDVGVYYCMQALQTPRTFGQ<br>GTKVEIK<br>(SEQ ID NO: 7012) |
| 18179-G9 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCACCCAGGGATGGGCCTGGAGTGGATTGGGTACATCTATTA<br>CAGTGGGAGCACCTCCTACAACCCGTCCCTCAAGAGTCGAGTCACCATGTCAGTGGACTCGTCCAAGAACCAGTTCTCCCTG<br>AAGCTGACC<br>(SEQ ID NO: 7013) |
| | AA | EVQLLESGPGLVKPSQTLSLTCTVSGDSISSNPYYWSWIRQHPGMGLEWIGYIYYSGSTSYNPSLKSRVTMSVDSSKNQFSL<br>KLTSVTAADTAVYYCARDLLWFGKLNYYYGLDVWGQGTTVTVSSGGGGSGGGGSGGGGSELVMTQTPLSLPVTPGEPASISC<br>RSSQSLLHRNGYNYLDWYLQKPGQSPQLLIYLGSNRASGVPDRFIGSGSGTDFTLKISRVEAEDVGVYYCMQALQTPSFGQG<br>TKVEIK<br>(SEQ ID NO: 7014) |
| 18179-H6 | NA | GAGGTGCAGCTGCTCGAGTCGGGCCCAGGACTGGTGAAGCCTTCACAGACCCTGTCCCTCACCTGCACTGTCTCTGGTGGCG<br>CCATCAGCAGTGGTGATTACTACTGGAGCTGGATCCGCCAGCACCCAGGGAAGGGCCTGGAGTGGATTGGGTACATCGATAA<br>GAGTGGGAGCACCTACTACAACCCGTCCCTCAAGAGTCGAGCTACCATATCAGTAGACACGTCTAAGAACCAGTTCTCCCTG<br>AAGCTGAGC<br>(SEQ ID NO: 7015) |
| | AA | EVQLLESGPGLVKPSQTLSLTCTVSGGAISSGDYYWSWIRQHPGKGLEWIGYIDKSGSTYYNPSLKSRATISVDTSKNQFSL<br>KLSSVTAADTAVYYCARDLLWFGKLNYYYGLDVWGQGTTVTVSSGGGGSGGGGSGGGGSELVMTQTPLSLPVTPGEPASISC<br>RSSQSLLHRNGYNYLDWYLQKPGQSPQLLIYLGSNRASGVPDRFSGSGSGTDFTLKISRVEAEDAGVYYCMQSLHLPPTFGG<br>GTKLEIK<br>(SEQ ID NO: 7016) |
| 18179-H9 | NA | GAGGTGCAGCTGCTCGAGTCGGGCCCAGGACTGGTGAAGCCTTCACAGACCCTGTCCCTCACCTGCACTGTCTCTGGTGGCT<br>CCATCAGCAGTAATCCTTACTACTGGAGCTGGATCCGCCAGCACCCAGGGAAGGGCCTGGAGTGGATTGGGTACATCTCTCA<br>CAGTGGGAGCACTTATTACAATCCGTCCCTCAAGAGTCGAGTAACCATATCAGTAGACACGTCTAAGAACCAGTTCTCCCTG<br>AATCTGACC<br>(SEQ ID NO: 7017) |
| | AA | EVQLLESGPGLVKPSQTLSLTCTVSGGSISSNPYYWSWIRQHPGKGLEWIGYISHSGSTYYNPSLKSRVTISVDTSKNQFSL<br>NLTSVTAADTAVYYCAREKMWFGVLNYYYGMDVWGQGTTVTVSSGGGGSGGGGSGGGGSELVLTQSPLSLPVTPGEPASISC<br>RSSQSLLHRNGYHYLDWYLQKPGQSPQLLIYLGSNRASGVPSRFSGSGSGTDFTLKISRVEAEDVGIYYCMQALQTPFTFGP<br>GTKVEIK<br>(SEQ ID NO: 7018) |
| 18181-A11 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCACCCAGGGAAGGGCCTGGAGTGGATTGGGTACATCTCTTA<br>CAGTGGGAGCACCTACTACAACCCGTCCCTCAAGAGTCGAGTTACCATATCAGTAGACACGTCTAAGAACCAGTTCTCCCTG<br>AATCTGACC<br>(SEQ ID NO: 7019) |
| | AA | EVQLLESGPGLVKPSQTLSLTCTVSGDSISSNPYYWSWIRQHPGKGLEWIGYISYSGSTYYNPSLKSRVTISVDTSKNQFSL<br>NLTSVTAADTAVYYCARDRLWFGVLNYYYGMDVWGPGTTVTVSSGGGGSGGGGSGGGGSELVMTQSPLSLPVTPGEPASISC<br>RSSQSLLHRNGYNYLDWYLQKPGQSPQLLIYLGSNRASGVPDRFSGSGSGTDFTLKISRVEAEDVGIYYCMQALQTPFTFGP<br>GTKVEIK<br>(SEQ ID NO: 7020) |
| 18181-C6 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCACCCAGGGAAGGGCCTGGAGTGGATTGGGTACATCTCTTA<br>CAGTGGGAGCACCTACTACAACCCGTCCCTCAAGAGTCGAGTTACCATATCAGTAGACACGTCTAAGAACCAGTTCTCCCTG<br>AATCTGACC<br>(SEQ ID NO: 7021) |
| | AA | EVQLLESGPGLVKPSQTLSLTCTVSGDSISSNPYYWSWIRQHPGKGLEWIGYISYSGSTYYNPSLKSRVTISVDTSKNQFSL<br>NLTSVTAADTAVYYCARDRLWFGVLNYYYGMDVWGPGTTVTVSSGGGGSGGGGSGGGGSELVMTQSPLSLPVTPGEPASISC<br>RSSQSLLHSTGYNYLDWYLQKPGQSPQLLIYLGSNRASGVPDRFSGSGSGTDFTLKISRVEAEDVGFYYCMQGLQTPRTFGQ<br>GTKLEIK<br>(SEQ ID NO: 7022) |
| 18181-G7 | NA | GAGGTGCAGCTGCTCGAGTCTGGGGAGGCTTGGTAAAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7023) |
| | AA | EVQLLESGGGLVKPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSNGGSYYNYFSVMDVWGQGTTVTVSSGGGGSGGGGSGGGGSELVMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>EIK<br>(SEQ ID NO: 7024) |

TABLE 54-continued scFv Full Sequences

| Ab | Type | SCFV |
|---|---|---|
| 18181-H10 | NA | GAGGTGCAGCTGCTCGAGTCGGGCCCAGGACTGGTGAAGCCTTCGGAGACCCTGTCCCTCACCTGCACTGTCTCTGGTGGCT<br>CCATCAGTAATTACTACTGGAGCTGGGTCCGGCAGCCCGCCGGGAAGGGACTGGAGTGGATTGGTCATATCTATACCAGTGG<br>GAGCACCAACTTCAACCCCTCCCTCAAGAGTCGAGTCACCATGTCAGTGGACACGTCCAAGAACCAGTTCTCCCTGAAGCTG<br>ACCTCTCTG<br>(SEQ ID NO: 7025) |
| | AA | EVQLLESGPGLVKPSETLSLTCTVSGGSISNYYWSWVRQPAGKGLEWIGHIYTSGSTNFNPSLKSRVTMSVDTSKNQFSLKL<br>TSLTAADTAVYYCAREKMWFGVLNYYYGMDVWGQGTTVTVSSGGGGSGGGGGGGGSELVMTQSPLSLPVTPGEPASISCRSS<br>QSLLHSNGYNYLDWYLQKPGQSPQLLIYLGSNRASGVPDRFSGSGSGTDFTLKISRVEAEDVGIYYCMQALQTPRTFGQGTK<br>VDIK<br>(SEQ ID NO: 7026) |
| 18182-A3 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGGTAGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7027) |
| | AA | EVQLLESGGGLVQPGGSLRLSCAASGFTFSSYAMSWVRQAPGKGLEWVSAISGSGGSTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7028) |
| 18182-A5 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGTAGTGG<br>TGGTGGCACTTACTACGCAGACTCCGTGAAGGGCCGGTTCACCATCTCCAGAGACAATTCCAAGAACACGCTGTATCTGCAA<br>ATGAACAGC<br>(SEQ ID NO: 7029) |
| | AA | EVQLLESGGGLVQPGGSLRLSCAASGFTFSSHAMSWVRQAPGKGLEWVSAISGSGGGTYYADSVKGRFTISRDNSKNTLYLQ<br>MNSLRAEDTAVYYCATGKGVHLNFDYWGQGTLVTVSSGGGGSGGGGSGGGGSELVLTQPPSVSVAPGQTARITCGGNNIGSK<br>SVQWYQQKPGQAPVLVVYDDNDRPSGIPERFSGSNSGNTATLTISRVEAGDEADFYCQVWDSSSDHVVFGGGTKLTVL<br>(SEQ ID NO: 7030) |
| 18182-A6 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAACTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7031) |
| | AA | EVQLLESGGGLVQPGGSLRLSCAASGFTFSSYAMSWVRQAPGKGLEWVSTISGSGGGTYYADSVKGRFTISRDNSKNTLYLQ<br>MNSLRAEDTAVYYCATGKGVHLGFDYWGQGTLVTVSSGGGGSGGGGSGGGGSELVVTQEPSVSVAPGQTARITCGGNNIGSK<br>SVHWYQQKPGQAPVMVVYDDNDRPSGIPERFSGSNSGNTATLTISRVEAGDEADYYCQVWDSSSDHVVFGGGTKLTVL<br>(SEQ ID NO: 7032) |
| 18182-A7 | NA | GAGGTGCAGCTGCTCGAGTCTGGGGGAGGCTTGGTGCAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7033) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQLPSVSVAPGQTARITCGGNNIGSK<br>SVHWHQQKPGQAPVMVVYDDNDRPSGIPERFSGSNSGNTATLTISRVEAGDEADYHCQVWDSSSDHVVFGGGTKLTVL<br>(SEQ ID NO: 7034) |
| 18182-A8 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGTAGTGG<br>TGGTGGCACATACAACGCAGACTCCGTGAAGGGCCGGTTCACCATCTCCAGAGACAATTCCAAGAACACGCTGTATCTGCAA<br>ATGAACAGC<br>(SEQ ID NO: 7035) |
| | AA | EVQLLESGGGLVQPGGSLRLSCAASGFTFSSHAMSWVRQAPGKGLEWVSAISGSGGGTYNADSVKGRFTISRDNSKNTLYLQ<br>MNSLRAEDTAAYYCVTGKGVHLGFDYWGQGTLVTVSSGGGGSGGGGSGGGGSELVLTQSSSVSVAPGQTARITCGGNNIGSK<br>SVHWYQQKPGQAPVLVVYDDNDRPSGIPERFSGSNSGNTATLTISRVEAGDEADFYCQVWDSSSDHVVFGGGTKLTVL<br>(SEQ ID NO: 7036) |
| 18182-A11 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7037) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVTPGQTARITCGGNNIGSK<br>SVHWYQQKPGQAPVLVVYDDNDRPSGIPERFSGSNFGNTATLTISRVEAGDEADYYCQVWDSSSDHVVFGGGTKLTVL<br>(SEQ ID NO: 7038) |
| 18182-B1 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGTAGTGG<br>TGGTGGCACATACAACGCAGACTCCGTGAAGGGCCGGTTCACCATCTCCAGAGACAATTCCAAGAACACGCTGTATCTGCAA<br>ATGAACAGC<br>(SEQ ID NO: 7039) |

TABLE 54-continued scFv Full Sequences

| Ab | Type | SCFV |
|---|---|---|
| | AA | EVQLLESGGGLVQPGGSLRLSCAASGFTFSSHAMSWVRQAPGKGLEWVSAISGSGGGTYNADSVKGRFTISRDNSKNTLYLQ<br>MNSLRAEDTAVYYCATGKGVHLGFDYWGQGTLVTVSSGGGGSGGGGSGGGGSELVLTQLPSVSVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7040) |
| 18182-B4 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTAGAGTGGGTCTCAGCTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7041) |
| | AA | EVQLLESGGGLVQPGGSLRLSCAASGFTFSSYAMSWVRQAPGKGLEWVSAISGSGGGTYYADSVKARFTISRDNSKNTLYLQ<br>MNSLRAEDTAVYYCATGKGVHLGFDYWGQGTLVTVSSGGGGSGGGGSGGGGSELMLTQPPSVSVAPGQTARITCGGNNIGSK<br>SVHWYQQKPGQAPVMVVYDDNDRPSGIPERFSGSNSGNTATLTISRVEAGDEADYYCQVWDSSSDHVVFGGGTKLTVL<br>(SEQ ID NO: 7042) |
| 18182-B6 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGTAGCTATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7043) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELMLTQPHSVSVAPGQTARITCGGNNIGSK<br>SVHWYQQKPGQAPVLVVYDDNDRPSGIPERFSGSNFGNTATLTISRVEAGDEADYYCQVWDSSSDHVVFGGGTKLTVL<br>(SEQ ID NO: 7044) |
| 18182-B7 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGCAGGGGCTGGAGTGGGTCTCAGCTATTAGTGGTAGTGG<br>ATGGTGGCACATACTACGCGACTCCGTGAAGGGCCGGTTCACCATCTCCAGAGACAATTCCAAGAACACGCTGTATCTGCAA<br>ATGAACAGC<br>(SEQ ID NO: 7045) |
| | AA | EVQLLESGGGLVQPGGSLRLSCAASGFTFSSYAMSWVRQAPGQGLEWVSAISGSGGGTYYADSVKGRFTISRDNSKNTLYLQ<br>MNSLRAEDTAVYYCATGKGVHLGFDHWGQGTLVTVSSGGGGSGGGGSGGGGSELMLTQPHSVSVAPGQTARITCGGNNIGSK<br>SVQWYQQKPGQAPVLVVYDDNDRPSGIPERFSGSNSGNTATLTISRVEAGDEADFYCQVWDSSSDHVVFGGGTKLTVL<br>(SEQ ID NO: 7046) |
| 18182-B10 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAACTGGGTCCGCCAGGCTCCAGGGAAGGGGCTGGAGTGGGTCTCAGCTATTAGTGGTAGTGG<br>TGGTGGCACTTACTACGCAGACTCCGTGAAGGGCCGGTTCACCATCTCCAGAGACAATTCCAAGAACACGCTGTATCTGCAA<br>ATGAACAGC<br>(SEQ ID NO: 7047) |
| | AA | EVQLLESGGGLVQPGGSLRLSCAASGFTFSSYAMNWVRQAPGKGLEWVSAISGSGGGTYYADSVKGRFTISRDNSKNTLYLQ<br>MNSLRAEDTAVYYCATGKGVHLNFDYWGQGTLVTVSSGGGGSGGGGSGGGGSELMLTQPHSVSVAPGQTARITCGGNNIGSK<br>SVHWYQQKPGQAPVMVVYDDNDRPSGIPERFSGSNSGNTATLTISRVEAGDEADYYCQVWDSSSDHVVFGGGTKLTVL<br>(SEQ ID NO: 7048) |
| 18182-C2 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7049) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVQWYQQKPGQAPVLVVYDDNDRPSGIPERFSGSNFGNTATLIISRVEAGDEADFYCQVWDSSSDHVVFGGGTKLTVL<br>(SEQ ID NO: 7050) |
| 18182-C3 | NA | GAGGTGCAGCTGCTCGAGTCTGGGGGAGACTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7051) |
| | AA | EVQLLESGGDLVQPGGSLRLSCAASGFTFSSHAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWYQQKPGQAPVMVVYDDNDRPSGIPERFSGSNSGNTATLTISRVEAGDEADYYCQVWDSSSDHAVFGGGTKLTVL<br>(SEQ ID NO: 7052) |
| 18182-C4 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7053) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELMLTQPHSVSVAPGQTARITCGGNNIGSK<br>SVHWYQQKPGQAPVMVVYDDNDRPSGIPERFSGSNSGNTATLTISRVEAGDEADYYCQVWDSSSDHVVFGGGTKLTVL<br>(SEQ ID NO: 7054) |

TABLE 54-continued scFv Full Sequences

| Ab | Type | SCFV |
|---|---|---|
| 18182-C5 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAACTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7055) |
| | AA | EVQLLESGGGLVQPGGSLRLSCAASGFTFSSYAMSWVRQAPGKGLEWVSTISGSGGGTYYADSVKGRFTISRDNSKNTLYLQ<br>MNSLRAEDTAVYYCATGKGVHLNFDYWGQGTLVTVSSGGGGSGGGGSGGGGSELVLTQPASVSVAPGQTARITCGGNNIGIK<br>SVHWYQQKPGQAPVLVVYDDNDRPSGIPERFSGSNSGNTATLTISRVEAGDEADYYCQVWDSSSDHVVFGGGTKLTVL<br>(SEQ ID NO: 7056) |
| 18182-C10 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAACTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7057) |
| | AA | EVQLLESGGGLVQPGGSLRLSCAASGFTFSSYAMSWVRQAPGKGLEWVSTISGSGGGTYYADSVKGRFTISRDNSKNTLYLQ<br>MNSLRAEDTAVYYCATGKGVHLGFDYWGQGTLVTVSSGGGGSGGGGSGGGGSELVLTQSSSVSVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7058) |
| 18182-C12 | NA | GAGGTGCAGCTGCTCGAGTCCGGGGGAGACTTGGTACAGCCTGGGGGGTCCCTGAGACTCTCCTGTGCAGCCTCTGGAATCA<br>CCTTTAGCAGCTATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGGGAAGGGCCGGTTCACCATCTCCAGAGACAATTCCAAGAACACGCTGTATCTGCAA<br>ATGAACAGC<br>(SEQ ID NO: 7059) |
| | AA | EVQLLESGGDLVQPGGSLRLSCAASGITFSSYAMSWVRQAPGKGLEWVSAISGSGGGTYYADSGKGRFTISRDNSKNTLYLQ<br>MNSLRAEDTAVYYCATGKGVHLGFDYWGQGTLVTVSSGGGGSGGGGSGGGGSELMLTQPHSVSVAPGQTARITCGGNNIGSK<br>SVHWYQQKPGQAPVMVVYDDNDRPSGIPERFSGSNSGNTATLIISRVEAGDEADYYCQVWDSSSDHVVFGGGTKLTVL<br>(SEQ ID NO: 7060) |
| 18182-D4 | NA | GAGGTGCAGCTGCTCGAGTCCGGGGGAGACTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAACTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7061) |
| | AA | EVQLLESGGDLVQPGGSLRLSCAASGFTFSSYAMSWVRQAPGKGLEWVSTISGSGGGTYYADSVKGRFTISRDNSKNTLYLQ<br>MNSLRAEDTAVYYCAPGKGVHLNFDYWGQGTLVTVSSGGGGSGGGGSGGGGSELALTQPASASVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7062) |
| 18182-D8 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7063) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQLSSVSVAPGQTARITCGGNNIGSK<br>SVQWYQQKPGQSPVMVVYDDNDRPSGIPERFSGSNSGNTATLTISRVEAGDEADYHCQVWDSSSDHVIFGGGTKLTVL<br>(SEQ ID NO: 7064) |
| 18182-D9 | NA | GAGGTGCAGCTGCTCGAGTCTGGGGGAGACTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAACTATTAGTGGTAGTGG<br>TGGTGGCACATACTACGCAGACTCCGTGAAGGGCCGGTTCACCATCTCCAGGGACAATTCCAAGAACACGCTGTATCTGCAA<br>ATGAACAGC<br>(SEQ ID NO: 7065) |
| | AA | EVQLLESGGDLVQPGGSLRLSCAASGFTFSSYAMSWVRQAPGKGLEWVSTISGSGGGTYYADSVKGRFTISRDNSKNTLYLQ<br>MNSLRAEDTAVYYCATGKGVHLNFDYWGQGTLVTVSSGGGGGGGGSGGGGSELVVTQEPSVSVAPGQTARITCGGNNIGSKS<br>VHWYQQKPGQAPVMVVYDDNDRPSGIPERFSGSNFGNTATLIISRVEAGDEADYYCQVWDSNSDHVVFGGGTKLTVL<br>(SEQ ID NO: 7066) |
| 18182-D11 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGAACTGGGTCCGCCAGGCTCCAGGGAAGGGGCTGGAGTGGGTCTCAGCTATTAGTGGTAGTGG<br>TGGTGGCACTTACTACGCAGACTCCGTGAAGGGCCGGTTCACCATCTCCAGAGACAATTCCAAGAACACGCTGTATCTGCAA<br>ATGAACAGC<br>(SEQ ID NO: 7067) |
| | AA | EVQLLESGGGLVQPGGSLRLSCAASGFTFSSYAMNWVRQAPGKGLEWVSAISGSGGGTYYADSVKGRFTISRDNSKNTLYLQ<br>MNSLRAEDTAVYYCATGKGVHLNFDYWGQGTLVTVSSGGGGSGGGGSGGGGSELMLTQPPSVSVAPGQTARITCGGNNIGSK<br>SVHWYQQKPGQAPVLVVYDDNDRPSGIPERFSGSNSGNTATLTISRVEAGDEADYYCQVWDSSSDHVIFGGGTKLTVL<br>(SEQ ID NO: 7068) |
| 18182-E2 | NA | GAGGTGCAGCTGCTCGAGTCCGGGGGAGACTTGGTACAGCCTGGGGGGTCCCTGAGACTCTCCTGTGCAGCCTCTGGATTCA<br>CCTTTGGCAGCTATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7069) |

TABLE 54-continued scFv Full Sequences

| Ab | Type | SCFV |
|---|---|---|
| | AA | EVQLLESGGDLVQPGGSLRLSCAASGFTFGSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWYQQKPGQAPVMVVYDDNDRPSGIPERFSGSNSGNTATLTISRVEAGDEADYHCQVWDSSSDHVVFGGGTKLTVL<br>(SEQ ID NO: 7070) |
| 18182-E3 | NA | GAGGTGCAGCTGCTCGAGTCCGGGGAGGCTTGGTACAGCCTGGGGGGTCCCTGAGACTCTCCTGTGCAGCCTCTGGATTCA<br>CCTTTAGTAGCTATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7071) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVQWYQQKPGQAPVLVVYDDNDRPSGIPERFSGSNFGNTATLIISRVEAGDEADYYCQVWDSSSDHVVFGGGTKLTVL<br>(SEQ ID NO: 7072) |
| 18182-E8 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAGCAGC<br>(SEQ ID NO: 7073) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MSSLRAEDTAVYYCATGKGVHLGFDYWGQGTLVTVSSGGGGGGGGSGGGGSELVLTQPASVSVAPGQTARITCGGNNIGSKS<br>VHWYQQKPGQAPVLVVYDDNDRPSGIPERFSGSNFGNTATLIISRVEAGDEADYYCQVWDSSSDHVVFGGGTKLTVL<br>(SEQ ID NO: 7074) |
| 18182-E11 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7075) |
| | AA | EVQLLESGGGLVQPGGSLRLSCAASGFTFSSYAMSWVRQAPGKGLEWVSAISGSGGGTYYADSVKARFTISRDNSKNTLYLQ<br>MNSLRAEDTAVYYCATGKGVHLGFDYWGQGTLVTVSSGGGGSGGGGSGGGGSELMLTQPHSVSVAPGQTARITCGGNNIGSK<br>SVHWYQQKPGQAPVMVVYDDNDRPSGIPERFSGSNSGNTATLTISRVEAGDEADYYCQVWDSSSDHVVFGGGTKLTVL<br>(SEQ ID NO: 7076) |
| 18182-F1 | NA | GAGGTGCAGCTGCTCGAGTCCGGGGGAGACTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7077) |
| | AA | EVQLLESGGDLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLNFDYWGQGTLVTVSSGGGGSGGGGSGGGGSELVLTQSPSVSVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7078) |
| 18182-F6 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGTGAAGGGCCGATTCACCATCTCCAGAGACAATTCCAAGAACACGCTGTATCTGCAA<br>ATGAACAGC<br>(SEQ ID NO: 7079) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLNFDYWGQGTLVTVSSGGGGSGGGGSGGGGSELALTQPPSVSVAPGQTARITCGGNNIGSK<br>SVHWYQQKPGQAPVLVVYDDNDRPSGIPERFSGSNSGNTATLTISRVEAGDEADYYCQVWDSSSDHVMFGGGTKLTVL<br>(SEQ ID NO: 7080) |
| 18182-F8 | NA | GAGGTGCAGCTGCTCGAGTCTGGGGGAGGCTTGGTACAGCCTGGGGGGTCCCTGAGACTCTCCTGTGCAGCCTCCGGATTCA<br>CCTTTAGCAGCTATGCCATGAGCTGGGTCCGCCAGGCTCCAGGGAAGGGGCTGGAGTGGGTCTCAACTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7081) |
| | AA | EVQLLESGGGLVQPGGSLRLSCAASGFTFSSYAMSWVRQAPGKGLEWVSTISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWYQQKPGQAPVMVVYDDNDRPSGIPERFSGSNFGNTATLIISRVEAGDEADYYCQVWDSSSDHVVFGGGTKLTVL<br>(SEQ ID NO: 7082) |
| 18182-G3 | NA | GAGGTGCAGCTGCTCGAGTCTGGGGGAGACTTGGTACAGCCTGGGGGGTCCCTGAGACTCTCCTGTGCAGCCTCTGGATTCA<br>CCTTTAGCAGCTATGCCATGCACTGGGTCCGCCAGGCTCCGGGGCAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7083) |
| | AA | EVQLLESGGDLVQPGGSLRLSCAASGFTFSSYAMHWVRQAPGQGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWHQQKPGQAPVLVVYDDNDRPSGIPERFSGSNFGNTATLIISRVEAGDEADYYCQVWDSSSDHVVFGGGTKLTVL<br>(SEQ ID NO: 7084) |

TABLE 54-continued scFv Full Sequences

| Ab | Type | SCFV |
|---|---|---|
| 18182-G4 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGACCTGGGTCCGCCAGGCTCCAGGGAAGGGGCTGGAGTGGGTCTCAGCTATTAGTGGTAGTGG<br>TGGTGGCACTTACTACGCAGACTCCGTGAAGGGCCGGTTCACCATCTCCAGAGACAATTCCAAGAACACGCTGTATCTGCAA<br>ATGAGCAGC<br>(SEQ ID NO: 7085) |
|  | AA | EVQLLESGGGLVQPGGSLRLSCAASGFTFSSYAMTWVRQAPGKGLEWVSAISGSGGGTYYADSVKGRFTISRDNSKNTLYLQ<br>MSSLRAEDTAVYYCATGKGVHLGFDYWGQGTLVTVSSGGGGSGGGGSGGGGSELVLTQPPSVSVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7086) |
| 18182-G5 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGGTGGCACATCAACGCAGACTCCGTGAAGGGCCGGTTCACCATCTCCAGAGACAATTCCAAGAACACGCTGTATCTGCAA<br>ATGAACAGC<br>(SEQ ID NO: 7087) |
|  | AA | EVQLLESGGGLVQPGGSLRLSCAASGFTFSSYAMSWVRQAPGKGLEWVSAISGSGGGTYNADSVKGRFTISRDNSKNTLYLQ<br>MNSLRAEDTAAYYCVTGKGVHLGFDYWGQGTLVTVSSGGGGSGGGGSGGGGSELVLTQPASVSVAPGQTARITCGGNNIGSK<br>SVHWYQQKPGQAPVMVVYDDNDRPSGIPERFSGSNFGNTATLIISRVEAGDEADYYCQVWDSSSDHVVFGGGTKLTVL<br>(SEQ ID NO: 7088) |
| 18182-G9 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7089) |
|  | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELALTQPASASVAPGQTARISCGGNNIGSK<br>GVQWYQQKPGQAPVLVVYDDNDRPSGIPERFSGSNFGNTATLIISRVEAGDEADYYCQVWDSSSDHVVFGGGTKLTVL<br>(SEQ ID NO: 7090) |
| 18182-G11 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTAGAGTGGGTCTCAGCTATTAGTGGTAGTGG<br>TGGTGGCACATACTACGCAGACTCCGTGAAGGGCCCGGTTCACCATCTCCAGAGACAATTCCAAGAACACGCTGTATCTGCAA<br>ATGAACAGC<br>(SEQ ID NO: 7091) |
|  | AA | EVQLLESGGGLVQPGGSLRLSCAASGFTFSSYAMSWVRQAPGKGLEWVSAISGSGGGTYYADSVKARFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVQWYQQKPGQAPVLVVYDDNDRPSGIPERFSGSNFGNTATLIISRVEAGDEADYYCQVWDSSSDHVVFGGGTKLTVL<br>(SEQ ID NO: 7092) |
| 18182-H5 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGTAGTGG<br>TGGTGGCACATCAACGCAGACTCCGTGAAGGGCCGGTTCACCATCTCCAGAGACAATTCCAAGAACACGCTGTATCTGCAA<br>ATGAACAGC<br>(SEQ ID NO: 7093) |
|  | AA | EVQLLESGGGLVQPGGSLRLSCAASGFTFSSHAMSWVRQAPGKGLEWVSAISGSGGGTYNADSVKGRFTISRDNSKNTLYLQ<br>MNSLRAEDTAAYYCVTGKGVHLGFDYWGQGTLVTVSSGGGGSGGGGSGGGGSELVVTQEPSVSVAPGQTARITCGGNNIGSK<br>SVHWHQQKPGQAPVLVVYDDNDRPSGIPERFSGSNSGNTATLTISRVEAGDEADFYCQVWDSSSDHVVFGGGTKLTVL<br>(SEQ ID NO: 7094) |
| 18089-D12 | NA | GAGGTGCAGCTGCTCGAGTCCGGGGGAGGCGTGGTCCAGCCTGGGAGGTCCCTGAGACTCTCCTGTGCAGCCTCTGGATTCA<br>CCTTCAGTACCTATGGCATGCACTGGGTCCGCCAGGCTCCAGGCAAGGGGCTGGAATGGGTGGCAGTTATATCATATGATGG<br>AAGTAATAAATACTATGCAGACTCCGTGAAGGGCCGATTCACCATCTCCAGAGACGATTCCAAGAACACGCTGTATCTGCAA<br>ATGAACAGC<br>(SEQ ID NO: 7095) |
|  | AA | EVQLLESGGGVVQPGRSLRLSCAASGFTFSTYGMHWVRQAPGKGLEWVAVISYDGSNKYYADSVKGRFTISRDDSKNTLYLQ<br>MNSLRAEDTAVYYCARGQLLTGYWGQGTLVTVSSGGGGSGGGGSGGGGSELVMTQSPSSLSASVGDRVTITCRASQGISNYL<br>AWYQQKPGKVPKLLIYAASTLQSGVPSRFSGSGSGTDFTLTISSLQPEDVATYYCQKYNSAPFTFGPGTKVEIK<br>(SEQ ID NO: 7096) |
| 18179-G12 | NA | GAGGTGCAGCTGCTCGAGTCTGGAGCAGAGGTGAAAAAGCCTGGGGCCTCAGTGAAGGTCTCCTGCAAGGCTTCTGGTTACA<br>CCTTTACCAGGAATGGTCTCAGCTGGGTGCGACAGGCCCCTGGACAAGGGCTTGAGTGGATGGGATGGATCAGCGGTTACAA<br>TGGTGACACAAACTATGCACAGAAGCTCCAGGGCAGAGGCACCATGACCACAGACACATCCACGAGCACAGCCTACATGGAG<br>CTGAGGAGC<br>(SEQ ID NO: 7097) |
|  | AA | EVQLLESGAEVKKPGASVKVSCKASGYTFTRNGLSWVRQAPGQGLEWMGWISGYNGDTNYAQKLQGRGTMTTDTSTSTAYME<br>LRSLRSDDTAVYYCARGRATFDYWGQGTLVTVSSGGGGSGGGGGGGGSELVMTQSPSSLSASVGDRVTITCRASQGISNYLA<br>WYQQKPGKVPKLLISAASTLQSGVPSRFSGSGSGTDFTLTISSLQPEDVATYYCQKYNSAPFTFGPGTKLEIK<br>(SEQ ID NO: 7098) |
| 18179-C1 | NA | GAGGTGCAGCTGCTCGAGTCTGGAGCAGAGGTGAAAAAGCCTGGGGCCTCAGTGAAGGTCTCCTGCAAGGCTTCTGGTTACA<br>CCTTTACCAGGAATGGTCTCAGCTGGGTGCGACAGGCCCCTGGACAAGGGCTTGAGTGGATGGGATGGATCAGCGGTTACAA<br>TGGTGACACAAACTATGCACAGAAGCTCCAGGGCAGAGGCACCATGACCACAGACACATCCACGAGCACAGCCTACATGGAG<br>CTGAGGAGC<br>(SEQ ID NO: 7099) |

TABLE 54-continued scFv Full Sequences

| Ab | Type | SCFV |
|---|---|---|
| | AA | EVQLLESGAEVKKPGASVKVSCKASGYTFTRNGLSWVRQAPGQGLEWMGWISGYNGDTNYAQKLQGRGTMTTDTSTSTAYME<br>LRSLRSDDTAVYYCARGRATFDYWGQGTLVTVSSGGGGSGGGGSGGGGSELVMTQSPSSLSASVGDRVTITCRASQGISNYL<br>AWYQQKPGKVPKLLISAASTLQSGVPSRFSGSGSGTDFTLTISSLQPEDVATYYCQKYNSAPFTFGPGTKVDIK<br>(SEQ ID NO: 7100) |
| 18093-B11 | NA | GAGGTGCAGCTGCTCGAGTCCGGGGGAGGCTTGGTAAAGCCTGGGGGGTCCCTGAGACTCTCCTGTGCAGCCTCTGGATTCA<br>CCTTCAGTGACTACTACATGAGCTGGATCCGCCAGGCTCCAGGGAAGGGGCTGGAGTGGGTTTCATACATTAGTAAAAGTGG<br>TAGTACCATATACTACGCAGACTCTGTGAAGGGCCGATTCACCATCTCCAGGGACAACGCCAAGAACTCACTGTATCTGCAA<br>ATGAACAGC<br>(SEQ ID NO: 7101) |
| | AA | EVQLLESGGGLVKPGGSLRLSCAASGFTFSDYYMSWIRQAPGKGLEWVSYISKSGSTIYYADSVKGRFTISRDNAKNSLYLQ<br>MNSLRAEDTAVYYCATYNYGHFDYWGQGTLVTVSSGGGGSGGGGSGGGGSELVLTQPPSVSVAPGQTARITCGGNNIGSKSV<br>HWYQQKPGQAPVLVVYDDSDRPSGIPERFSGSNSGNTATLTISRVEAGDEADYYCQVWDSSSDHHVVFGGGTKLTVL<br>(SEQ ID NO: 7102) |
| 18182-B5 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7103) |
| | AA | EVQLLESGGGLVQPGGSLRLSCAASGFTFSSHAMSWVRQAPGKGLEWVSAISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7104) |
| 18182-H9 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGTGAAGGCCCGGTTCACCATCTCCAGAGACAATTCCAAGAACACGCTGTATCTGCAA<br>ATGAACAGC<br>(SEQ ID NO: 7105) |
| | AA | EVQLLESGGGLVQPGGSLRLSCAASGFTFSSHAMSWVRQAPGKGLEWVSAISGSGGGTYYADSVKARFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWHQQKPGQAPVLVVYDDNDRPSGIPERFSGSNSGNTATLTISRVEAGDEADFYCQVWDSSSDHVVFGGGTKLTVL<br>(SEQ ID NO: 7106) |
| 18182-E6 | NA | GAGGTGCAGCTGCTCGAGTCCGGGGGAGGCTTGGTACAGCCTGGGGGGTCCCTGAGACTCTCCTGTGCAGCCTCCGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7107) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAVYYCATGKGVHLNFDYWGQGTLVTVSSGGGGGGGGSGGGGSELVLTQPSSVSVAPGQTARITCGGNNIGSKS<br>VHWYQQKPGQAPVLVVYDDNDRPSGIPERFSGSNFGNTATLIISRVAAGDEADYYCQVWDSSSDHVVFGGGTKLTVL<br>(SEQ ID NO: 7108) |
| 18182-G6 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGTAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7109) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MNSLRAEDTAAYYCVTGKGVHLGFDYWGQGTLVTVSSGGGGSGGGGSGGGGSELVLTQPPSVSVAPGQTARITCGGNNIGSK<br>SVHWHQQKPGQSPVLVIYDDNDRPSGIPERFSGFNSGNTATLTISRVEAGDEADYYCQVWDSSSDHVVFGGGTKLTVL<br>(SEQ ID NO: 7110) |
| 18182-G2 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGTAGTGG<br>TGGTGGCACATACAACGCAGACTCCGTGAAGGGCCGGTTCACCATCTCCAGAGACAATTCCAAGAACACGCTGTATCTGCAA<br>ATGAACAGC<br>(SEQ ID NO: 7111) |
| | AA | EVQLLESGGGLVQPGGSLRLSCAASGFTFSSHAMSWVRQAPGKGLEWVSAISGSGGGTYNADSVKGRFTISRDNSKNTLYLQ<br>MNSLRAEDTAAYYCVTGKGVHLGFDYWGQGTLVTVSSGGGGSGGGGSGGGGSELVLTQPPSVSVAPGQTARITCGGNNIGSK<br>SVHWYQQKPGQAPVMVVYDDNDRPSGIPERFSGSNSGNTATLTISRVEAGDEADYYCQVWDSSSDHVIFGGGTKLTVL<br>(SEQ ID NO: 7112) |
| 18182-H12 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAACTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7113) |
| | AA | EVQLLESGGGLVQPGGSLRLSCAASGFTFSSYAMSWVRQAPGKGLEWVSTISGSGGGTYYADSVKGRFTISRDNSKNTLYLQ<br>MNSLRAEDTAVYYCATGKGVHLGFDYWGQGTLVTVSSGGGGSGGGGSGGGGSELMLTQPHSVSVAPGQTARITCGGNNIGSK<br>SVHWYQQKPGQAPVLVVYDDNDRPSGIPERFSGSNFGNTATLIISRVEAGDEADYYCQVWDSSSDHVVFGGGTKLTVL<br>(SEQ ID NO: 7114) |

TABLE 54-continued scFv Full Sequences

| Ab | Type | SCFV |
|---|---|---|
| 18182-G8 | NA | GAGGTGCAGCTGCTCGAGTCCGGGGGAGGCTTGGTAAAGCCTGGGGGGTCCCTGAGACTCTCCTGTGCAGCCTCTGGATTCA<br>CCTTTAGCAGCTATGCCATGAACTGGGTCCGCCAGGCTCCAGGGAAGGGGCTGGAGTGGGTCTCAGCTATTAGTGGTAGTGG<br>TGGTGGCACATACTACGCAGACTCCGGGAAGGGCCGGTTCACCATCTCCAGAGACAATTCCAAGAACACGCTGTATCTGCAA<br>ATGAACAGC<br>(SEQ ID NO: 7115) |
| | AA | EVQLLESGGGLVKPGGSLRLSCAASGFTFSSYAMNWVRQAPGKGLEWVSAISGSGGGTYYADSGKGRFTISRDNSKNTLYLQ<br>MNSLRAEDTAVYYCATGKGVHLNFDYWGQGTLVTVSSGGGGSGGGGSGGGGSELVLTQPPSVSVAPGQTARITCGGNNIGSK<br>SVHWYQQKPGQAPVMVVYDDNDRPSGIPERFSGSNSGNTATLTISRVEAGDEADYYCQVWDSSSDHVVFGGGTKLTVL<br>(SEQ ID NO: 7116) |
| 18182-E10 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGCAGGGGCTGGAGTGGGTCTCGTCTATTAGTGGTAGCGG<br>TGGTGGCACATACTACGCAGCCTCCGTGAAGGGCCGGTTCACCATCTCCAGAGACAATTCCAAGAACACGCTGTATCTGCAA<br>ATGAACAGC<br>(SEQ ID NO: 7117) |
| | AA | EVQLLESGGGLVQPGGSLRLSCAASGFTFSSHAMSWVRQAPGQGLEWVSSISGSGGGTYYAASVKGRFTISRDNSKNTLYLQ<br>MNSLRAEDTAVYYCATGKGVHLNFDYWGQGTLVTVSSGGGGSGGGGSGGGGSELALTQPASASVAPGQTARITCGGNNIGSK<br>SVHWHQQKPGQAPVLVVYDDNDRPSGIPERFSGSNSGNTATLTISRVEAGDEADFYCQVWDSSSDHVVFGGGTKLTVL<br>(SEQ ID NO: 7118) |
| 18182-B12 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAGCTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAGCAGC<br>(SEQ ID NO: 7119) |
| | AA | EVQLLESGGGLVQPGGSLRLSCAASGFTFSSYAMSWVRQAPGKGLEWVSAISGSGGGTYYADSVKGRFTISRDNSKNTLYLQ<br>MSSLRAEDTAVYYCATGKGVHLGFDYWGQGTLVTVSSGGGGSGGGGSGGGGSELVLTQPPSVSVAPGQTARITCGGNNIGSK<br>SVHWHQQKPGQAPVLVVYDDNDRPSGIPERFSGSNSGNTATLTISRVEAGDEADYYCQVWDYSSDHVVFGGGTKLTVL<br>(SEQ ID NO: 7120) |
| 18182-E5 | NA | GAGGTGCAGCTGCTCGAGTCCGGGGGAGGCTTGGTACAGCCTGGGGGGTCCCTGAGACTCTCCTGTGCAGCCTCTGGATTCA<br>CCTTTAGCAGCTATGCCATGAGCTGGGTCCGCCAGGCTCCAGGGAAGGGGCTGGAGTGGGTCTCAACTATTAGTGGAAGTGG<br>TGGTGGCACATACTACGCAGACTCCGTGAAGGGCCGGTTCACCATCTCCAGAGACAATTCCAAGAACACGCTGTATCTGCAA<br>ATGAACAGC<br>(SEQ ID NO: 7121) |
| | AA | EVQLLESGGGLVQPGGSLRLSCAASGFTFSSYAMSWVRQAPGKGLEWVSTISGSGGGTYYADSVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWHQQKPGQAPVLVVYDDNDRPSGIPERFSGSNSGNTATLTISRVEAGDEADYYCQVWDYSSDHVVFGGGTKLTVL<br>(SEQ ID NO: 7122) |
| 18182-A4 | NA | GAGGTGCAGCTGCTCGAGTCTGGGGGAGGCGTGGTCCAGCCTGGGAGGTCCCTGAGACTCTCCTGTGCAGCGTCTGGATTCA<br>CCTTTAGCAGCTATGCCATGACCTGGGTCCGCCAGGCTCCAGGGCAGGGGCTGGAGTGGGTCTCGTCTATTAGTGGTAGTGG<br>TGGTGGCACATACTACGCAGCCTCCGTGAAGGGCCGGTTCACCATCTCCAGAGACAATTCCAAGAACACGCTGTATCTGCAA<br>ATGAACAGC<br>(SEQ ID NO: 7123) |
| | AA | EVQLLESGGGVVQPGRSLRLSCAASGFTFSSYAMTWVRQAPGQGLEWVSSISGSGGGTYYAASVKGRFTISRDNSKNTLYLQ<br>MNSLRAEDTAVYYCATGKGVHLGFDYWGQGTLVTVSSGGGGSGGGGSGGGGSELVLTQPPSVSVAPGQTARITCGGNNIGSK<br>SVHWYQQKPGQAPVLVVYDDNDRPSGIPERFSGSNFGNTATLIISRVAAGDEADYYCQVWDSSSDHVVFGGGTKLTVL<br>(SEQ ID NO: 7124) |
| 18182-E1 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGCAGCCATGCCATGAGCTGGGTCCGCCAGGCTCCAGGGAAGGGGCTGGAGTGGGTCTCAGCTATTAGTGGTAGTGG<br>TGGTGGCACATACAACGCAGACTCCGTGAAGGGCCGGTTCACCATCTCCAGAGACAATTCCAAGAACACGCTGTATCTGCAA<br>ATGAACAGC<br>(SEQ ID NO: 7125) |
| | AA | EVQLLESGGGLVQPGGSLRLSCAASGFTFSSHAMSWVRQAPGKGLEWVSAISGSGGGTYNADSVKGRFTISRDNSKNTLYLQ<br>MNSLRAEDTAAYYCVTGKGVHLGFDYWGQGTLVTVSSGGGGSGGGGSGGGGSELVLTQPPSVSVAPGQTARITCGGNNIGSK<br>SVHWYQQKPGQAPVMVVYDDNDRPSGIPERFSGSNSGNTATLTISRVEAGDEADYYCQVWDSSSDHVVFGGGTKLTVL<br>(SEQ ID NO: 7126) |
| 18081-B9 | NA | GAGGTGCAGCTGCTCGAGTCGGGCCCAGGACTGGTGAAGCCTTCGGAGACCCTGTCCCTCACCTGCACTGTCTCTGGTGACT<br>CCATCAGTAGTAGTCGTTACTACTGGGGCTGGATCCGCCAGCCCCCAGGGAAGGGGCTGGAGTGGATTGGGAGTATCTATTA<br>TAGTGGGAGCACCTACTACAACCCGTCCCTCAAGAGTCGAGTCACCATATCCGTAGACACGTCCAAGAACCAGTTCTCCCTG<br>AAGCTGAGC<br>(SEQ ID NO: 7127) |
| | AA | EVQLLESGPGLVKPSETLSLTCTVSGDSISSSRYYWGWIRQPPGKGLEWIGSIYYSGSTYYNPSLKSRVTISVDTSKNQFSL<br>KLSSVTAADTAVYYCARGIFGVITYFDYWGQGTLVTVSSGGGGSGGGGSGGGGSELVMTQSPDSLAVSLGERATINCKSSQS<br>VLYSSNNKNYLAWYQQKPGQPPKLLIYWASTRESGVPDRFSGSGSTDFTLTISSLQAEDVAVYYCQQFYSTPITFGQGTRL<br>EIK<br>(SEQ ID NO: 7128) |

TABLE 54-continued scFv Full Sequences

| Ab | Type | SCFV |
|---|---|---|
| 18081-E7 | NA | GAGGTGCAGCTGCTCGAGTCGGGCCCAGGACTGGTGAAGCCTTCGGAGACCCTGTCCCTCACCTGCACTGTCTCTGGTGACT<br>CCATCAGTAGTAGTCGTTACTACTGGGGCTGGATCCGCCAGCCCCAGGGAAGGGGCTGGAGTGGATTGGGAGTATCTATTA<br>TAGTGGGAGCACCTACTACAACCCGTCCCTCAAGAGTCGAGTCACCATATCCGTAGACACGTCCAAGAACCAGTTCTCCCTG<br>AAGCTGAGC<br>(SEQ ID NO: 7129) |
| | AA | EVQLLESGPGLVKPSETLSLTCTVSGDSISSSRYYWGWIRQPPGKGLEWIGSIYYSGSTYYNPSLKSRVTISVDTSKNQFSL<br>KLSSVTAADTAVYYCARGIFGVITYFDYWGQGTLVTVSSGGGGSGGGGSGGGGSELVMTQTPDSLAVSLGERATINCKSSQS<br>VLYSSNNKNYLAWYQQKPGQPPKLLIYWASTRESGVPDRFSGSGSGTDFTLTISSLQAEDVAVYYCQQYYSTPLTFGGGTKV<br>EIK<br>(SEQ ID NO: 7130) |
| 18089-D11 | NA | GAGGTGCAGCTGCTCGAGTCTGGTCCTGTGCTGGTGAAACCCACACAGACCCTCACGCTGACCTGCACCTTCTCTGGTTTCT<br>CATTCACCACTCATAAAATGGTGTGGACTGGATCCGTCAGCCCCAGGAAAGGCCCTGGAGTGGCTTGCACTCATTTATTG<br>GAATGATGATAAGCGCTACAACCCATCTCTGCAGAGTAGGCTCACCATCACCAAGGACACCTCCAAAAACCAGGTGGTCCTC<br>ACAATGACC<br>(SEQ ID NO: 7131) |
| | AA | EVQLLESGPVLVKPTQTLTLTCTFSGFSFTTHKMGVDWIRQPPGKALEWLALIYWNDDKRYNPSLQSRLTITKDTSKNQVVL<br>TMTNMDPVDTATYYCAYRRYNWNYENWFDPWGQGTLVTVSSGGGGSGGGGSGGGGSELVMTQSPSSLSASVGDRVTITCRAS<br>QSISNYFNWYQQKPGKAPKLLIYAASSLQSGVPSRFSGSGSGTDFTLTISSLQPEDFATYYCQQSYITPFTFGGGTKLEIK<br>(SEQ ID NO: 7132) |
| 18089-C9 | NA | GAGGTGCAGCTGCTCGAGTCTGGTCCTACGCTGGTGAAACCCACACAGACCCTCACGCTGACCTGCACCTTCTCTGGTTTCT<br>CATTCACCACTCATAAAATGGGTGTGGACTGGATCCGTCAGCCCCAGGAAAGGCCCTGGAGTGGCTTGCACTCATTTATTG<br>GAATGATGATAAGCGCTACAGCCCATCTCTGCAGAGTAGGCTCACCATCACCAAGGACACCTCCAAAAACCAGGTGGTCCTC<br>ACAATGACC<br>(SEQ ID NO: 7133) |
| | AA | EVQLLESGPTLVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSELQMTQSPSSLSASVGDRVTITCRAS<br>QFISSYLNWYQQKPGKAPKLLIYAASSLQSGVPSRFSGRGSGTDFTLTISSLQPEDFATYYCQQSYSTPFTFGPGTKVEIK<br>(SEQ ID NO: 7134) |
| 18089-D8 | NA | GAGGTGCAGCTGCTCGAGTCTGGTCCTATGCTGGTGAAACCCACACAGACCCTCACGCTGACCTGCACCTTCTCTGGTTTCT<br>CATTCACCACTCATAAAATGGGTGTGGACTGGATCCGTCAGCCCCAGGAAAGGCCCTGGAGTGGCTTGCACTCATTTATTG<br>GAATGATGATAAGCGCTACAGCCCATCTCTGCAGAGTAGGCTCACCATCACCAAGGACACCTCCAAAAACCAGGTGGTCCTC<br>ACAATGACC<br>(SEQ ID NO: 7135) |
| | AA | EVQLLESGPMLVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSELVMTQSPDSLSASVGDRVTITCRAS<br>QSISSYLNWYQQKPGKAPKLLIYAASSLQSGVPSRFSGSGSGTDFTLTISSLQPEDFATYYCQQSYSTPITFGQGTRLEIK<br>(SEQ ID NO: 7136) |
| 18081-F9 | NA | GAGGTGCAGCTGCTCGAGTCTGGTCCTATGCTGGTGAAACCCACACAGACCCTCACGCTGACCTGCACCTTCTCTGGTTTCT<br>CATTCACCACTCATAAAATGGGTGTGGACTGGATCCGTCAGCCCCAGGAAAGGCCCTGGAGTGGCTTGCACTCATTTATTG<br>GAATGATGATAAGCGCTACAGCCCATCTCTGCAGAGTAGGCTCACCATCACCAAGGACACCTCCAAAAACCAGGTGGTCCTC<br>ACAATGACC<br>(SEQ ID NO: 7137) |
| | AA | EVQLLESGPMLVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSELQMTQSPSSLSASVGDRVTITCRAS<br>QSISSYLNWYQQKPGKAPKLLIYAASSLQSGVPSRFSGSGSGTDFTLTISSLQPEDFATYYCQQSYSTPFTFGPGTKVEIK<br>(SEQ ID NO: 7138) |
| 18081-H11 | NA | GAGGTGCAGCTGCTCGAGTCTGGTCCTGCGCTGGTGAAACCCACACAGACCCTCACGCTGACCTGCACCTTCTCTGGTTTCT<br>CATTCACCACTCATAAAATGGGTGTGGACTGGATCCGTCAGCCCCAGGAAAGGCCCTGGAGTGGCTTGCACTCATTTATTG<br>GAATGATGATAAGCGCTACAGCCCATCTCTGCAGAGTAGGCTCACCATCACCAAGGACACCTCCAAAAACCAGGTGGTCCTC<br>ACAATGACC<br>(SEQ ID NO: 7139) |
| | AA | EVQLLESGPALVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSELQMTQSPSSLSASVGDRVTITCQAS<br>QDISNYLNWYQQKPGKAPKLLIYAASSLQSGVPSRFSGSGSGTDFTLTISSLQPEDFATYYCQQSYTTPFTFGPGTKVEIK<br>(SEQ ID NO: 7140) |
| 18081-B6 | NA | GAGGTGCAGCTGCTCGAGTCTGGTCCTATGCTGGTGAAACCCACACAGACCCTCACGCTGACCTGCACCTTCTCTGGTTTCT<br>CATTCACCACTCATAAAATGGGTGTGGACTGGATCCGTCAGCCCCAGGAAAGGCCCTGGAGTGGCTTGCACTCATTTATTG<br>GAATGATGATAAGCGCTACAGCCCATCTCTGCAGAGTAGGCTCACCATCACCAAGGACACCTCCAAAAACCAGGTGGTCCTC<br>ACAATGACC<br>(SEQ ID NO: 7141) |
| | AA | EVQLLESGPMLVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSELVMTQSPSSLSASVGDRVTITCRAS<br>QSISSYLNWYQQKPGKAPKLLIYAASSLQSGVPSRFSGSGSGTDFTLTISSLQPEDFATYYCQQSYSTPFTFGPGTKLEIK<br>(SEQ ID NO: 7142) |
| 18089-B2 | NA | GAGGTGCAGCTGCTCGAGTCTGGGGGAGGCTTGGTACAGCCTGGGGGGTCCCTGAGACTCTCCTGTGCAGCCTCTGGATTCA<br>CCTTTAGTCCTATGCCATGAGCTGGGTCCGCCAGGCTCCAGGGAGGGGCTGGAGTGGGTCTCAACTATTAGTATTAGTGG<br>TGGTAGCACAAACTACGCAGACTCCGTGAAGGGCCGGTTCACCATCTCCAGAGACAATTCCAAGAACACGCTGTATCTGCAA<br>ATGAACAGC<br>(SEQ ID NO: 7143) |

TABLE 54-continued scFv Full Sequences

| Ab | Type | SCFV |
|---|---|---|
| | AA | EVQLLESGGGLVQPGGSLRLSCAASGFTFSSYAMSWVRQAPGRGLEWVSTISISGGSTNYADSVKGRFTISRDNSKNTLYLQ<br>MNSLRAEDTAVYYCAKDGGSGWFPKLLHYGLDVWGQGTTVTVSSGGGGSGGGGSGGGGSELQMTQSPSSLSASVGDRVTITC<br>QASQDISNYLNWYQQKPGKAPKLLIYAASSLQSGVPSRFSGSGSGTDFTLTISSLQPEDFATYYCQQSYSIPLTFGGGTKVE<br>IK<br>(SEQ ID NO: 7144) |
| 18179-E1 | NA | GAGGTGCAGCTGCTCGAGTCCGGGGGAGGCTTGGTACAGCCTGGGGGGTCCCTGAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTAT<br>CTGCAAATG<br>(SEQ ID NO: 7145) |
| | AA | EVQLLESGGGLVQPGGSLRLSCAASGFTFSNAWMSWVRQAPGKGLEWVGRIKGNTYGGTTDYAAPVKGRFTISRDDSKNTLY<br>LQMNSLKTEDTAVYYCTTPSYSGSYYNYFSVMDVWGQGTTVTVSSGGGGSGGGGSGGGGSELVMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>DIK<br>(SEQ ID NO: 7146) |
| 18179-H7 | NA | GAGGTGCAGCTGCTCGAGTCTGGGGGAGGCTTGGTACAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGCAAAAC<br>TTATGGTGGGACAACAGACTACGCTGCACCCGTGAAAGGCAGATTCACCATCTCAAGAGATGATTCAAAAAACACGCTGTAT<br>CTGCAAATG<br>(SEQ ID NO: 7147) |
| | AA | EVQLLESGGGLVQPGGSLRLSCAASGFTFSNAWMSWVRQAPGKGLEWVGRIKSKTYGGTTDYAAPVKGRFTISRDDSKNTLY<br>LQMNSLKTEDTAVYYCTTPSYSGSYYNYFSVMDVWGQGTTVTVSSGGGGSGGGGSGGGGSELQMTQSPSSLSASVGDRVTIT<br>CRTSQSISSYLNWFQQKPGKAPKLLIFAASSLQSGVPSRFSGSGSGTDFTLTISSLQPEDFATYYCQQSYSSPFTFGPGTKV<br>EIK<br>(SEQ ID NO: 7148) |
| 18179-B12 | NA | GAGGTGCAGCTGCTCGAGTCCGGGGGAGGCTTGGTACAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7149) |
| | AA | EVQLLESGGGLVQPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSNSGSYYNYFSVMDVWGQGTTVTVSSGGGGSGGGGSGGGGSELVMTQSPSSLSASVGDRVTIT<br>CRTSQSISSYLNWFQQKPGKAPKLLIFAASSLQGGVPSRFSGSGSGTDFTLTISSLQPEDFATYYCQQTYSMPFTFGPGTKV<br>EIK<br>(SEQ ID NO: 7150) |
| 18179-D11 | NA | GAGGTGCAGCTGCTCGAGTCCGGGGGAGGCTTGGTAAAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7151) |
| | AA | EVQLLESGGGLVKPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSYSGSYYNYFSVMDVWGQGTTVTVSSGGGGSGGGGSGGGGSELQMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>DIK<br>(SEQ ID NO: 7152) |
| 18179-D7 | NA | GAGGTGCAGCTGCTCGAGTCCGGGGGAGGCTTGGTACAGCCTGGGGGGTCCCTGAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7153) |
| | AA | EVQLLESGGGLVQPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSYSGSYYNYFSVMDVWGQGTTVTVSSGGGGSGGGGSGGGGSELVMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>DIK<br>(SEQ ID NO: 7154) |
| 18179-A7 | NA | GAGGTGCAGCTGCTCGAGTCCGGGGGAGGCTTGGTAAAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7155) |
| | AA | EVQLLESGGGLVKPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSYSGSYYNYFSVMDVWGQGTTVTVSSGGGGSGGGGSGGGGSELVMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>DIK<br>(SEQ ID NO: 7156) |

TABLE 54-continued scFv Full Sequences

| Ab | Type | SCFV |
|---|---|---|
| 18181-H7 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCACCCAGGGAAGGGCCTGGAGTGGATTGGGTACATCTCTTA<br>CAGTGGGATCACCAACTACAACCCCTCCCTCAAGAGTCGAGTCACCATGTCAGTGGACACGTCCAAGAACCAGTTCTCCCTG<br>AAGCTGACC<br>(SEQ ID NO: 7157) |
| | AA | EVQLLESGPGLVKPSQTLSLTCTVSGDSISSNPYYWSWIRQHPGKGLEWIGYISYSGITNYNPSLKSRVTMSVDTSKNQFSL<br>KLTSLTAADTAVYYCAREKMWFGVLNYYYGMDVWGQGTTVTVSSGGGGSGGGGSGGGGSELVMTQTPLSLPVTPGEPASISC<br>RSSQSLLHRNGYNYLDWYLQKPGQSPQLLIYLGSNRASGVPDRFSGSGSGTDFTLKISRVEAGDVGVYYCMQALQTPWTFGQ<br>GTKVEIK<br>(SEQ ID NO: 7158) |
| 18181-G10 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCTCCCGGGAAGGGCCTGGAGTGGATTGGGTACATCTCTTA<br>CAGTGGGAGCACCTTCTACAACCCGTCCCTCAAGAGTCGAGTTACCATATCAGTAGACACGTCTAAGAACCAGTTCTCCCTG<br>AATCTGACC<br>(SEQ ID NO: 7159) |
| | AA | EVQLLESGPGLVKPSQTLSLTCTVSGDSISSNPYYWSWIRQLPGKGLEWIGYISYSGSTFYNPSLKSRVTISVDTSKNQFSL<br>NLTSVTAADTAVYYCARDRLWFGVLNYYYGMDVWGLGTTVTVSSGGGGSGGGGSGGGGSELVMTQSPLSLPVTPGEPASISC<br>RSSQSLLHSTGYNYVDWYLQKPGQSPQLLIYLGSNRASGVPDRFSGSGSGTDFTLKISRVEAEDVGFYYCMQALQTPRTFGQ<br>GTKVEIK<br>(SEQ ID NO: 7160) |
| 18181-G8 | NA | GAGGTGCAGCTGCTCGAGTCCGGGGAGGCTTGGTACAGCCTGGGGGGTCCCTGAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7161) |
| | AA | EVQLLESGGGLVQPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSNSGSYYNYFSVMDVWGQGTTVTVSSGGGGSGGGGSGGGGSELVMTQSPSSLSASVGDRVTIT<br>CRTSQSISSYLNWYQQKPGKAPKLLIYAASSLQSGVPSRFSGSGSGTDFTLTISSLQPEDFATYYCQQTYSMPFTFGGGTKV<br>EIK<br>(SEQ ID NO: 7162) |
| 18181-F3 | NA | GAGGTGCAGCTGCTCGAGTCTGGGGGAGGCTTGGTGCAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7163) |
| | AA | EVQLLESGGGLVQPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSYSGSYYNYFSVMDVWGQGTTVTVSSGGGGSGGGGSGGGGSELVMTQSPSSLSASVGDRVTIT<br>CRTSQSISSYLNWYQQKPGRAPKLLIFAASSLQGGVPSRFSGSGSGTDFTLTISSLQPEDFATYYCQQSYSSPFTFGPGTKV<br>EIK<br>(SEQ ID NO: 7164) |
| 18181-F1 | NA | GAGGTGCAGCTGCTCGAGTCTGGGGGAGGCTTGGTAAAGCCTGGGGGGTCCCTTAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTTT<br>CTGCAAATG<br>(SEQ ID NO: 7165) |
| | AA | EVQLLESGGGLVKPGGSLRLSCAASGFTFSNAWMSWVRQAPGKGLEWVGRIKGNTYGGTTDYAAPVKGRFTISRDDSKNTLF<br>LQMNSLKTEDTAVYYCTTPSYSGSYYNYFSVMDVWGQGTTVTVSSGGGGSGGGGSGGGGSELVMTQSPSSLSASVGDRVTIT<br>CRTSQSISSYLNWYQQKPGRAPKLLIFAASSLQGGVPSRFSGSGSGTDFTLTISSLQPEDFATYYCQQTYSSPFTFGPGTKL<br>EIK<br>(SEQ ID NO: 7166) |
| 18181-E2 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCACCCAGGGAAGGGCCTGGAGTGGATTGGGTACATCTCTCA<br>CAGTGGGAGCACTTATTACAATCCGTCCCTCAAGAGTCGAGTAACCATATCAGTAGACACGTCTAAGAATCAGTTCTCCCTG<br>AATCTGACC<br>(SEQ ID NO: 7167) |
| | AA | EVQLLESGPGLVKPSQTLSLTCTVSGDSISSNPYYWSWIRQHPGKGLEWIGYISHSGSTYYNPSLKSRVTISVDTSKNQFSL<br>NLTSVTAADTAVYYCARDRLWFGVLNYYYGMDVWGLGTTVTVSSGGGGSGGGGSGGGGSELVMTQSPLSLPVTPGEPASISC<br>RSSQSLLHSSGYNYLDWYLQKPGQSPQLLIYLGSNRASGVPDRFSGSGSGTDFTLKISKVEAEDVGVYYCMQALQTPRTFGQ<br>GTKVDIK<br>(SEQ ID NO: 7168) |
| 18181-C9 | NA | GAGGTGCAGCTGCTCGAGTCGGGCCCAGGACTGGTGAAGCCTTCACAGACCCTGTCCCTCACCTGCACTGTCTCTGGTGACT<br>CCATCAGCAGTAATCCTTACTACTGGAGCTGGATCCGCCAGCTCCCGGGAAGGGCCTGGAGTGGATTGGGTACATCTCTTA<br>CAGTGGGAGCACCTTCTACAACCCGTCCCTCAAGAGTCGAGTTACCATATCAGTAGACACGTCTAAGAACCAGTTCTCCCTG<br>AATCTGACC<br>(SEQ ID NO: 7169) |
| | AA | EVQLLESGPGLVKPSQTLSLTCTVSGDSISSNPYYWSWIRQLPGKGLEWIGYISYSGSTFYNPSLKSRVTISVDTSKNQFSL<br>NLTSVTAADTAVYYCARDRLWFGVLNYYYGMDVWGLGTTVTVSSGGGGSGGGGSGGGGSELVLTQSPLSLPVTPGEPASISC<br>RSSQSLLHRNGYNYLDWYLQKPGQSPQLLIYLGSNRASGVPDRFSGSGSGTDFTLKISRVEAEDVGVYYCMQGLQTPFTFGP<br>GTKVEIK<br>(SEQ ID NO: 7170) |

TABLE 54-continued scFv Full Sequences

| Ab | Type | SCFV |
|---|---|---|
| 18181-B8 | NA | GAGGTGCAGCTGCTCGAGTCGGGCCCAGGACTGGTGAAGCCTTCACAGACCCTGTCCCTCACCTGCACTGTCTCTGGTGGTT<br>CCATCAGCAGTGGTGGTTACTACTGGAGCTGGATCCGCCAGCACCCAGGGAAGGGCCTGGAGTGGATTGGGTACATCTCTCA<br>CAGTGGGAGCACTTATTACAATCCGTCCCTCAAGAGTCGAGTAACCATATCAGTAGACACGTCTAAGAATCAGTTCTCCCTG<br>AATCTGACC<br>(SEQ ID NO: 7171) |
| | AA | EVQLLESGPGLVKPSQTLSLTCTVSGGSISSGGYYWSWIRQHPGKGLEWIGYISHSGSTYYNPSLKSRVTISVDTSKNQFSL<br>NLTSVTAADTAVYYCAREKMWFGVLNYYYGMDVWGQGTTVTVSSGGGGSGGGGSGGGGSELVMTQTPLSLPVTPGEPASISC<br>RSSQSLLHRNGYNYLDWYLQKPGQSPQLLIYLGSNRASGVPDRFIGSGSGTDFTLEISRVEAEDVGVYYCMQALQTPSFGQG<br>TKVEIK<br>(SEQ ID NO: 7172) |
| 18181-A6 | NA | GAGGTGCAGCTGCTCGAGTCCGGGGGAGGCTTGGTACAGCCTGGGGGGTCCCTGAGACTCTCCTGTGCAGCCTCTGGATTCA<br>CTTTCAGTAACGCCTGGATGAGCTGGGTCCGCCAGGCTCCAGGGAAGGGGCTGGAGTGGGTTGGCCGTATTAAAGGCAACAC<br>TTATGGTGGGACAACAGACTACGCTGCACCCGTGAAAGGCAGATTCACCATCTCAAGAGATGATTCAAAAAACACGCTGTAT<br>CTGCAAATG<br>(SEQ ID NO: 7173) |
| | AA | EVQLLESGGGLVQPGGSLRLSCAASGFTFSNAWMSWVRQAPGKGLEWVGRIKGNTYGGTTDYAAPVKGRFTISRDDSKNTLY<br>LQMNSLKTEDTAVYYCTTPSYSGSYYNYFSVMDVWGQGTTVTVSSGGGGSGGGGSGGGGSELVMTQSPSSLSASVGDRVTIT<br>CRASQSISSYLNWYQQKPGRAPKLLIFAASSLQGGVPSRFSGSGSGTDFTLTISSLQPEDFATYYCQQTYSMPFTFGPGTKL<br>EIK<br>(SEQ ID NO: 7174) |
| 18403-F12-AS | NA | No nuc. seq available |
| | AA | EVQLLESGGGLVQPGGSLRLSCAASGFTFSSYAMSWVRQAPGKGLEWVSAISGSGGGTYYAASVKGRFTISRDNSKNTLYLQ<br>MSSLRAEDTAVYYCVTGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNFGNTATLIISRVAAGDEADYYCQVWDYRYLSQVFGGGTKLTVL<br>(SEQ ID NO: 7175) |
| 18403-G10-AS | NA | No nuc. seq available |
| | AA | EVQLLESGGGLVQPGGSLRLSCAASGFTFSSYAMSWVRQAPGKGLEWVSAISGSGGGTYYAASVKGRFTISRDNSKNTLYLQ<br>MSSLRAEDTAVYYCATGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNSGNTATLTISRVEAGDEADYYCQVWDYSGQRQVFGGGTKLTVL<br>(SEQ ID NO: 7176) |
| 02-C1-86-A4-<br>N-F5_final | NA | No nuc. seq available |
| | AA | QVQLVESGGGVVQPGRSLRLSCAASGFTFSTYGMHWVRQAPGKGLEWVAVISYDAETVKYAESVKGRFTISRDNSKNTLYLQ<br>MNSLRAEDTAVYYCARGQLLTGYWGQGTLVTVSSGGGGSGGGGSGGGGSDIQMTQSPSSLSASVGDRVTITCRASQGISNYL<br>AWYQQKPGKVPKLLIYAASTLQSGVPSRFSGSGSGTDFTLTISSLQPEDVATYYCQKYNSAPFTFGPGTKVEIK<br>(SEQ ID NO: 7177) |
| 03-F3-88-B3-<br>F9_final | NA | No nuc. seq available |
| | AA | QVQLVESGGGLVKPGGSLRLSCAASGFTFSDYYMSWIRQAPGKGLEWVSYISKSSYTVTYADAVKGRFTISRDNAKNSLYLQ<br>MNSLRAEDTAVYYCATYNYGHFDYWGQGTLVTVSSGGGGSGGGGSGGGGSSYVLTQPPSVSVAPGQTARITCGGNNIGSKSV<br>HWYQQKPGQAPVLVVYDDADRPSGIPERFSGSNSGNTATLTISRVEAGDEADYYCQVWDASAGYGVVFGGGTKLTVL<br>(SEQ ID NO: 7178) |
| 81-H7-SG-<br>F28_final | NA | No nuc. seq available |
| | AA | QVQLQESGPGLVKPSQTLSLTCTVSGDSISSNPYYWSWIRQHPGKGLEWIGYISYSGITNYNPSLKSRVTMSVDTSKNQFSL<br>KLTSLTAADTAVYYCAREKMWFGVLNYYYGMDVWGQGTTVTVSSGGGGSGGGGSGGGGSDIVMTQTPLSLPVTPGEPASISC<br>RSSQSLLHRSGYNYLDWYLQKPGQSPQLLIYLGSNRASGVPDRFSGSGSGTDFTLKISRVEAGDVGVYYCMQALQTPWTFGQ<br>GTKVEIK<br>(SEQ ID NO: 7179) |
| 18081-<br>B9_final | NA | No nuc. seq available |
| | AA | QVQLQESGPGLVKPSETLSLTCTVSGDSISSSRYYWGWIRQPPGKGLEWIGSIYYSGSTYYNPSLKSRVTISVDTSKNQFSL<br>KLSSVTAADTAVYYCARGIFGVITYFDYWGQGTLVTVSSGGGGSGGGGSGGGGSDIVMTQSPDSLAVSLGERATINCKSSQS<br>VLYSSNNKNYLAWYQQKPGQPPKLLIYWASTRESGVPDRFSGSGSGTDFTLTISSLQAEDVAVYYCQQFYSTPITFGQGTRL<br>EIK<br>(SEQ ID NO: 7180) |
| 18398-<br>C7_final | NA | No nuc. seq available |
| | AA | EVQLLESGGGLVQPGGSLRLSCAASGFTFSSHAMSWVRQAPGKGLEWVSSISGSGGGTYYAASVKGRFTISRDNSKNTLYLQ<br>MNSLRAEDTAVYYCATGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNSGNTATLTISRVEAGDEADYYCQVWDYSPLRHVFGGGTKLTVL<br>(SEQ ID NO: 7181) |
| 18403-<br>D8_final | NA | No nuc. seq available |
| | AA | EVQLLESGGGLVQPGGSLRLSCAASGFTFSSHAMSWVRQAPGKGLEWVSTISGSGGGTYYADSVKGRFTISRDNSKNTLYLQ<br>MNSLRAEDTAVYYCATGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNFGNTATLIISRVEAGDEADYYCQVWDYRTLDWVFGGGTKLTVL<br>(SEQ ID NO: 7182) |

TABLE 54-continued scFv Full Sequences

| Ab | Type | SCFV |
|---|---|---|
| 18403-D8_AS_final | NA<br>AA | No nuc. seq available<br>EVQLLESGGGLVQPGGSLRLSCAASGFTFSSHAMSWVRQAPGKGLEWVSTISGSGGGTYYAASVKGRFTISRDNSKNTLYLQ<br>MNSLRAEDTAVYYCATGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNFGNTATLIISRVEAGDEADYYCQVWDYRTLDWVFGGGTKLTVL<br>(SEQ ID NO: 7183) |
| 18403-E11_AS_final | NA<br>AA | No nuc. seq available<br>EVQLLESGGGLVQPGGSLRLSCAASGFTFSSHAMSWVRQAPGKGLEWVSAISGSGGGTYNAASVKGRFTISRDNSKNTLYLQ<br>MNSLRAEDTAAYYCVTGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNSGNTATLTISRVEAGDEADYYCQVWDYYSNRAVFGGGTKLTVL<br>(SEQ ID NO: 7184) |
| 18403-F12_final | NA<br>AA | No nuc. seq available<br>EVQLLESGGGLVQPGGSLRLSCAASGFTFSSYAMSWVRQAPGKGLEWVSAISGSGGGTYYADSVKGRFTISRDNSKNTLYLQ<br>MSSLRAEDTAVYYCVTGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNFGNTATLIISRVAAGDEADYYCQVWDYRYLSQVFGGGTKLTVL<br>(SEQ ID NO: 7185) |
| 18403-F12-AS_final | NA<br>AA | No nuc. seq available<br>EVQLLESGGGLVQPGGSLRLSCAASGFTFSSYAMSWVRQAPGKGLEWVSAISGSGGGTYYAASVKGRFTISRDNSKNTLYLQ<br>MSSLRAEDTAVYYCVTGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNFGNTATLIISRVAAGDEADYYCQVWDYRYLSQVFGGGTKLTVL<br>(SEQ ID NO: 7186) |
| 18403-G10_final | NA<br>AA | No nuc. seq available<br>EVQLLESGGGLVQPGGSLRLSCAASGFTFSSYAMSWVRQAPGKGLEWVSAISGSGGGTYYADSVKGRFTISRDNSKNTLYLQ<br>MSSLRAEDTAVYYCATGKGVHLGFDYWGQGTLVTVSSGGGGSGGGGGGGGSSYVLTQPPSVSVAPGQTARITCGGNNIGSKS<br>VHWYQQKPGQAPVMVVYDDNDRPSGIPERFSGSNSGNTATLTISRVEAGDEADYYCQVWDYSGQRQVFGGGTKLTVL<br>(SEQ ID NO: 7187) |
| 18403-G10-AS_final | NA<br>AA | No nuc. seq available<br>EVQLLESGGGLVQPGGSLRLSCAASGFTFSSYAMSWVRQAPGKGLEWVSAISGSGGGTYYAASVKGRFTISRDNSKNTLYLQ<br>MSSLRAEDTAVYYCATGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNSGNTATLTISRVEAGDEADYYCQVWDYSGQRQVFGGGTKLTVL<br>(SEQ ID NO: 7188) |
| 18409-E2_final | NA<br>AA | No nuc. seq available<br>EVQLVESGGGLVQPGGSLRLSCAASGFTFSNAWMSWVRQAPGKGLEWVGRIKSKTYGGTTDYAAPVKGRFTISRDDSKNTLF<br>LQMNSLKTEDTAVYYCTTPSYSGSYYNYFSVMDVWGQGTTVTVSSGGGGSGGGGSGGGGSDIQMTQSPSSLSASVGDRVTIT<br>CRTSQSISSYLNWYQQKPGRAPKLLIFAASSLQGGVPSRFSGSGSGTDFTLTISSLQPEDFATYYCQQSYSSPFTFGPGTKV<br>EIK<br>(SEQ ID NO: 7189) |
| 18409-F12_final | NA<br>AA | No nuc. seq available<br>QITLKESGPALVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSDIQMTQSPSSLSASVGDRVTITCQAS<br>QDISNYLNWYQQKPGKAPKLLIYAASSLQSGVPSRFSGRGSGTDFTLTISSLQPEDFATYYCQQSYYYPTLFGPGTKVEIK<br>(SEQ ID NO: 7190) |
| 18409-G10_final | NA<br>AA | No nuc. seq available<br>QITLKESGPTLVKPTQTLTLTCTFSGFSFTTHKMGVDWIRQPPGKALEWLAGIHIYDDKRYSPSLQSRLTITKDTSKNQVVL<br>TMTNMDPVDTATYYCAYRRYNWNYENWFDPWGQGTLVTVSSGGGGSGGGGSGGGGSDIQMTQSPSSLSASVGDRVTITCQAS<br>QDISNYFNWYQQKPGKAPKLLIYAASSLQSGVPSRFSGSGSGTDFTLTISSLQPEDFATYYCQQSYITPFTFGPGTKVEIK<br>(SEQ ID NO: 7191) |
| 18409-H7_final | NA<br>AA | No nuc. seq available<br>QITLKESGPALVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSDIQMTQSPSSLSASVGDRVTITCQAS<br>QDISNYLNWYQQKPGKAPKLLIYAASSLQSGVPSRFSGSGSGTDFTLTISSLQPEDFATYYCQQSYFPVVEFGPGTKVEIK<br>(SEQ ID NO: 7192) |
| 18409-H10_final | NA<br>AA | No nuc. seq available<br>QITLKESGPTLVKPTQTLTLTCTFSGFSFTTHKMGVDWIRQPPGKALEWLALIYWNDDKRYSPSLQSRLTITKDTSKNQVVL<br>TMTNMDPVDTATYYCAYRRYNWNYENWFDPWGQGTLVTVSSGGGGSGGGGSGGGGSDIQMTQSPSSLSASVGDRVTITCQAS<br>QDISNYLNWYQQKPGKAPKLLIYAASSLQSGVPSRFSGRGSGTDFTLTISSLQPEDFATYYCQQSYTPPTTFGPGTKVEIK<br>(SEQ ID NO: 7193) |
| 18410-B5_final | NA<br>AA | No nuc. seq available<br>EVQLVESGGGLVQPGGSLRLSCAASGFTFSNAWMSWVRQAPGKGLEWVGRIRSRSYGGTTDYAAPVKGRFTISRDDSKNTLF<br>LQMNSLKTEDTAVYYCTTPSYSGSYYNYFSVMDVWGQGTTVTVSSGGGGSGGGGSGGGGSDIQMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGGGTKV<br>EIK<br>(SEQ ID NO: 7194) |

TABLE 54-continued scFv Full Sequences

| Ab | Type | SCFV |
|---|---|---|
| 18410-B6_final | NA | No nuc. seq available |
| | AA | EVQLVESGGGLVQPGGSLRLSCAASGFTFSNAWMSWVRQAPGKGLEWVGRIKSKTYGGTTDYAAPVKGRFTISRDDSKNTLY<br>LQMNSLKTEDTAVYYCTTPSYSGSYYNYFSVMDVWGQTTVTVSSGGGGSGGGGSGGGGSDIQMTQSPSSLSASVGDRVTIT<br>CRTSQSISSYLNWYQQKPGRAPKLLIFAASSLQGGVPSRFSGSGSGTDFTLTISSLQPEDFATYYCIQAYTSPFTFGPGTKL<br>EIK<br>(SEQ ID NO: 7195) |
| 18410-D3_final | NA | No nuc. seq available |
| | AA | EVQLVESGGGLVQPGGSLRLSCAASGFTFSNAWMSWVRQAPGKGLEWVGRITSSRYGGTTDYAAPVKGRFTISRDDSKNTLF<br>LQMNSLKTEDTAVYYCTTPSYSGSYYNYFSVMDVWGQTTVTVSSGGGGSGGGGSGGGGSDIQMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>DIK<br>(SEQ ID NO: 7196) |
| 18410-D6_final | NA | No nuc. seq available |
| | AA | EVQLVESGGGLVKPGGSLRLSCAASGFTFSNAWMSWVRQAPGKGLEWVGRILNNAYGGTTDYAAPVKGRFTISRDDSKNTLY<br>LQMNSLKTEDTAVYYCTTPSYSGSYYNYFSVMDVWGQTTVTVSSGGGGSGGGGSGGGGSDIQMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>DIK<br>(SEQ ID NO: 7197) |
| 18410-G10_final | NA | No nuc. seq available |
| | AA | EVQLLESGGGLVQPGGSLRLSCAASGFTFSSHAMSWVRQAPGKGLEWVSAISGSGGGTYNADSVKGRFTISRDNSKNTLYLQ<br>MNSLRAEDTAVYYCATGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNSGNTATLTISRVEAGDEADYYCQVWDYVAPRHVFGGGTKLTVL<br>(SEQ ID NO: 7198) |
| 18410-G10_AS_final | NA | No nuc. seq available |
| | AA | EVQLLESGGGLVQPGGSLRLSCAASGFTFSSHAMSWVRQAPGKGLEWVSAISGSGGGTYNAASVKGRFTISRDNSKNTLYLQ<br>MNSLRAEDTAVYYCATGKGVHLGFDYWGQGTLVTVSSGGGGSGGGGSGGGGSSYVLTQPPSVSVAPGQTARITCGGNNIGSK<br>SVHWYQQKPGQAPVMVVYDDNDRPSGIPERFSGSNSGNTATLTISRVEAGDEADYYCQVWDYVAPRHVFGGGTKLTVL<br>(SEQ ID NO: 7199) |
| 18410-H1_final | NA | No nuc. seq available |
| | AA | EVQLVESGGGLVQPGGSLRLSCAASGFTFSNAWMSWVRQAPGKGLEWVGRITSGIYGGTTDYAAPVKGRFTISRDDSKNTLY<br>LQMNSLKTEDTAVYYCTTPSYSGSYYNYFSVMDVWGQTTVTVSSGGGGSGGGGSGGGGSDIQMTQSPSSLSASVGDRVTIT<br>CRTSQSISSYLNWYQQKPGRAPKLLIFAASSLQGGVPSRFSGSGSGTDFTLTISSLQPEDFATYYCQQTYSMPFTFGPGTKV<br>DIK<br>(SEQ ID NO: 7200) |
| 18410-H3_final | NA | No nuc. seq available |
| | AA | EVQLVESGGGLVQPGGSLRLSCAASGFTFSNAWMSWVRQAPGKGLEWVGRIRSRPYGGTTDYAAPVKGRFTISRDDSKNTLY<br>LQMNSLKTEDTAVYYCTTPSYSGSYYNYFSVMDVWGQTTVTVSSGGGGSGGGGSGGGGSDIQMTQSPSSLSASVGDRVTIT<br>CRTSQSISSYLNWYQQKPGRAPKLLIFAASSLQGGVPSRFSGSGSGTDFTLTISSLQPEDFATYYCQQTYSSPFTFGPGTKL<br>EIK<br>(SEQ ID NO: 7201) |
| 18486-A4_final | NA | No nuc. seq available |
| | AA | QVQLVESGGGVVQPGRSLRLSCAASGFTFSTYGMHWVRQAPGKGLEWVAVISYDASNKYYAESVKGRFTISRDNSKNTLYLQ<br>MNSLRAEDTAVYYCARGQLLTGYWGQGTLVTVSSGGGGSGGGGSGGGGSDIQMTQSPSSLSASVGDRVTITCRASQGISNYL<br>AWYQQKPGKVPKLLIYAASTLQSGVPSRFSGSGSGTDFTLTISSLQPEDFATYYCQKYNSAPFTFGPGTKVEIK<br>(SEQ ID NO: 7202) |

TABLE 55 scFv VL CDRs

| Ab | Type | CDR1 | CDR2 | CDR3 |
|---|---|---|---|---|
| 17724-C9 | NA | AAGTCCAGTCAGAGCCTTTTATATAG<br>TAGCAATCAAAAGAACTACTTGGCC<br>(SEQ ID NO: 7203) | TGGGCATCCACTAGGGAATCT<br>(SEQ ID NO: 7919) | CAGCAATATTATAGCTATCCGTACACG<br>(SEQ ID NO: 8635) |
| | AA | KSSQSLLYSSNQKNYLA<br>(SEQ ID NO: 7204) | WASTRES<br>(SEQ ID NO: 7920) | QQYYSYPYT<br>(SEQ ID NO: 8636) |
| 17724-G6 | NA | AGTGCCAGCTCAAATGTAAATTACAT<br>ACAC<br>(SEQ ID NO: 7205) | GACACATCCAAACTGGCTCCT<br>(SEQ ID NO: 7921) | CATCAGTGGAGTAGTTACCCACCTACG<br>(SEQ ID NO: 8637) |
| | AA | SASSNVNYIH<br>(SEQ ID NO: 7206) | DTSKLAP<br>(SEQ ID NO: 7922) | HQWSSYPPT<br>(SEQ ID NO: 8638) |

TABLE 55-continued scFv VL CDRs

| Ab | Type | CDR1 | CDR2 | CDR3 |
|---|---|---|---|---|
| 17731-H8 | NA | CGAGCAAGTGGGAATATTCACAATTA TTTAGCT (SEQ ID NO: 7207) | AATGCAAAAACCTTAGCAGGA (SEQ ID NO: 7923) | CAACATCATTATGGTACTCCGCTCACG (SEQ ID NO: 8639) |
|  | AA | RASGNIHNYLA (SEQ ID NO: 7208) | NAKTLAG (SEQ ID NO: 7924) | QHHYGTPLT (SEQ ID NO: 8640) |
| 17732-A8 | NA | AGGTCTAGTCAGAGCCTCCTGTATAGT AATGGATACAACTATGTGGAT (SEQ ID NO: 7209) | TTGGGTTCTAATCGGGCCTCC (SEQ ID NO: 7925) | ATGCAAGCTCTACAAACTCCTCCCACC (SEQ ID NO: 8641) |
|  | AA | RSSQSLLYSNGYNYVD ((SEQ ID NO: 7210) | LGSNRAS (SEQ ID NO: 7926) | MQALQTPPT (SEQ ID NO: 8642) |
| 17745-E5 | NA | AGGTCTAGTCAGAGCCTCCTGTATAGT AATGGATACCACTATTTGGAT (SEQ ID NO: 7211) | TTGGGTTCTATCCGGGCCTCC (SEQ ID NO: 7927) | ATGCAACCTCTACAAACTCCTCCCACT (SEQ ID NO: 8643) |
|  | AA | RSSQSLLYSNGYHYLD (SEQ ID NO: 7212) | LGSIRAS (SEQ ID NO: 7928) | MQPLQTPPT (SEQ ID NO: 8644) |
| 17745-E8 | NA | AGGTCTAGTCAGAGCCTCCTGTATAGT AATGGATACAACTGGAT (SEQ ID NO: 7213) | TTGGGTTCTAAGCGGGCCTCC (SEQ ID NO: 7929) | ATGCAAGGTACACACTGGCCTCGGACG (SEQ ID NO: 8645) |
|  | AA | RSSQSLLYSNGYNYLD ((SEQ ID NO: 7214) | LGSKRAS (SEQ ID NO: 7930) | MQGTHWPRT (SEQ ID NO: 8646) |
| 17745-G8 | NA | AGGGCCAGTCAGAGTGTTAGCAGCAGC TACTTAGCC (SEQ ID NO: 7215) | GGTGCATCCAGCAGGGCCACT (SEQ ID NO: 7931) | CAGCAGTATGGTAGGTCACTATTCACT (SEQ ID NO: 8647) |
|  | AA | RASQSVSSSYLA (SEQ ID NO: 7216) | GASSRAT (SEQ ID NO: 7932) | QQYGRSLET (SEQ ID NO: 8648) |
| 17748-D12 | NA | AGGGCCAGTCAGAGTGTTAGCAGCAGC TACTTAGCC (SEQ ID NO: 7217) | GGTGCATCCAGCAGGGCCACT (SEQ ID NO: 7933) | CAGCAGTATGGTAGCTCACCGCTCACT (SEQ ID NO: 8649) |
|  | AA | RASQSVSSSYLA (SEQ ID NO: 7218) | GASSRAT (SEQ ID NO: 7934) | QQYGSSPLT (SEQ ID NO: 8650) |
| 17753-F4 | NA | AGGTCTAGTCAGAGCCTCCTGTATAGT AATGGATACAACTATTTGGAT (SEQ ID NO: 7219) | TTGGGTTCTAATCGGGCCTCC (SEQ ID NO: 7935) | ATGCAAGCTCTACAAACTCCATTCACT (SEQ ID NO: 8651) |
|  | AA | RSSQSLLYSNGYNYLD (SEQ ID NO: 7220) | LGSNRAS (SEQ ID NO: 7936) | MQALQTPFT (SEQ ID NO: 8652) |
| 17771-D2 | NA | CGGGCGAGTCAGGGTATTAGCAGCTGG TTAGCC (SEQ ID NO: 7221) | GCTGCATCCAGTTTGCAAAGT (SEQ ID NO: 7937) | CAACAGGCTAACAGTTTCCCTCCGACG (SEQ ID NO: 8653) |
|  | AA | RASQGISSWLA (SEQ ID NO: 7222) | AASSLQS (SEQ ID NO: 7938) | QQANSFPPT (SEQ ID NO: 8654) |
| 17777-B4 | NA | AGGTCTAGTCAGAGCCTCCTGTATAGT TGGATACAACTATTTGGAT (SEQ ID NO: 7223) | TTGGGTTCTAATCGGGCCTCC (SEQ ID NO: 7939) | ATGCAAGCTCTACAAACTCCTCTCACT (SEQ ID NO: 8655) |
|  | AA | RSSQSLLYSNGYNYLD (SEQ ID NO: 7224) | LGSNRAS (SEQ ID NO: 7940) | MQALQTPLT (SEQ ID NO: 8656) |
| 17777-C4 | NA | AGGGCCAGTCAGAGTGTTAGCAGCAGC TACTTAGCC (SEQ ID NO: 7225) | GGTGCATCCAGCAGGGCCACT (SEQ ID NO: 7941) | CAGCAGTATGGTAGCTCACCGCTCACT (SEQ ID NO: 8657) |
|  | AA | RASQSVSSSYLA (SEQ ID NO: 7226) | GASSRAT (SEQ ID NO: 7942) | QQYGSSPLT (SEQ ID NO: 8658) |
| 17777-C5 | NA | AGGTCTAGTCAGAGCCTCCTGTATAGT AATGGATACAACTATGTGGAT (SEQ ID NO: 7227) | TTGGGTTCTAATCGGGCCTCC (SEQ ID NO: 7943) | ATGCAAGGTACACACTGGCCGCTCACT (SEQ ID NO: 8659) |
|  | AA | RSSQSLLYSNGYNYVD (SEQ ID NO: 7228) | LGSNRAS (SEQ ID NO: 7944) | MQGTHWPLT (SEQ ID NO: 8660) |

TABLE 55-continued scFv VL CDRs

| Ab | Type | CDR1 | CDR2 | CDR3 |
|---|---|---|---|---|
| 17778-C9 | NA | AGGTCTAGTCAGAGCCTCCTGTATAGT AATGGATACAACTATGTGGAT (SEQ ID NO: 7229) | TTGGGTTCTAATCGGGCCTCC (SEQ ID NO: 7945) | ATGCAAGCTCTACAAACTCCGTGCAGT (SEQ ID NO: 8661) |
| | AA | RSSQSLLYSNGYNYVD (SEQ ID NO: 7230) | LGSNRAS (SEQ ID NO: 7946) | MQALQTPCS (SEQ ID NO: 8662) |
| 17778-F1 | NA | AGGTCTAGTCAGCGCCTCCTGTTTAGT AATGGATACCACTATTTGGAT (SEQ ID NO: 7231) | TTGGGTTCTAATCGGGCCTCC (SEQ ID NO: 7947) | ATGCAAGCTCTACAAACTCCTCCGACG (SEQ ID NO: 8663) |
| | AA | RSSQRLLFSNGYHYLD (SEQ ID NO: 7232) | LGSNRAS (SEQ ID NO: 7948) | MQALQTPPT (SEQ ID NO: 8664) |
| 17778-H8 | NA | AGGTCTAGTCAGAGCCTCCTGTATAGT AATGGATACAACTATTTGGAT (SEQ ID NO: 7233) | TTGGGTTCTAATCGGGCCTCC (SEQ ID NO: 7949) | ATGCAAGCTCTACAAACTCCTCCGACG (SEQ ID NO: 8665) |
| | AA | RSSQSLLYSNGYNYLD (SEQ ID NO: 7234) | LGSNRAS (SEQ ID NO: 7950) | MQALQTPPT (SEQ ID NO: 8666) |
| 17779-D11 | NA | CGGGCAAGTCAGAGCATTAGCAGCTAT TTAAAT (SEQ ID NO: 7235) | GATGCATCCAGTTTGCAAAGT (SEQ ID NO: 7951) | CAACAGAGTTACAGAACCCCTCCGACG (SEQ ID NO: 8667) |
| | AA | RASQSISSYLN (SEQ ID NO: 7236) | DASSLQS (SEQ ID NO: 7952) | QQSYRTPPT (SEQ ID NO: 8668) |
| 17779-E1 | NA | AGGTCTAGTCAGAGCCTCCTGTATAGT AATGGATACCACTATTTGGAT (SEQ ID NO: 7237) | TTGGGTTCTAATCGGGCCTCC (SEQ ID NO: 7953) | ATGCAAGCTCTACAAACTCCATTCACT (SEQ ID NO: 8669) |
| | AA | RSSQSLLYSNGYHYLD (SEQ ID NO: 7238) | LGSNRAS (SEQ ID NO: 7954) | MQALQTPFT (SEQ ID NO: 8670) |
| 17780-D12 | NA | AGGTCTAGTCAGAGCCTCCTGTATAGT AATGGATACAACTATTTGGAT (SEQ ID NO: 7239) | TTGGGTTCTAATCGGGCCTCC (SEQ ID NO: 7955) | ATGCAAGCTCTACAAACTCCGATCACC (SEQ ID NO: 8671) |
| | AA | RSSQSLLYSNGYNYLD (SEQ ID NO: 7240) | LGSNRAS (SEQ ID NO: 7956) | MQALQTPIT (SEQ ID NO: 8672) |
| 17780-E6 | NA | AGGTCTAGTCAGAGCCTCCTGTATAGT AATGGATACAACTATTTGGAT (SEQ ID NO: 7241) | TTGGGTTCTAATCGGGCCTCC (SEQ ID NO: 7957) | ATGCAAGGTACACACTGGCCATTCACT (SEQ ID NO: 8673) |
| | AA | RSSQSLLYSNGYNYLD (SEQ ID NO: 7242) | LGSNRAS (SEQ ID NO: 7958) | MQGTHWPFT (SEQ ID NO: 8674) |
| 17781-B3 | NA | AGGTCTAGTCAGAGCCTCCTGTATAGT AATGGATACAACTATTTGGAT (SEQ ID NO: 7243) | TTGGGTTCTAATCGGGCCTCC (SEQ ID NO: 7959) | ATGCAAGCTCTACAAACTCCGTGGACG (SEQ ID NO: 8675) |
| | AA | RSSQSLLYSNGYNYLD (SEQ ID NO: 7244) | LGSNRAS (SEQ ID NO: 7960) | MQALQTPWT (SEQ ID NO: 8676) |
| 17781-H12 | NA | AGGTCTAGTCAGAGCCTCCTGTATAGT AATGGATACAACTATGTGGAT (SEQ ID NO: 7245) | TTGGGTTCTAATCGGGCCTCC (SEQ ID NO: 7961) | ATGCAAAGTATACAGCTTCCGTGGACG (SEQ ID NO: 8677) |
| | AA | RSSQSLLYSNGYNYVD (SEQ ID NO: 7246) | LGSNRAS (SEQ ID NO: 7962) | MQSIQLPWT (SEQ ID NO: 8678) |
| 17783-C11 | NA | AGGTCTAGTCAGAGCCTCCTGTATAGT AATGGATACAACTATTTGGAT (SEQ ID NO: 7247) | TTGGGTTCTTATCGGGCCTCC (SEQ ID NO: 7963) | ATGCAAGGTACACACTGGCCTCTCACT (SEQ ID NO: 8679) |
| | AA | RSSQSLLYSNGYNYLD (SEQ ID NO: 7248) | LGSYRAS (SEQ ID NO: 7964) | MQGTHWPLT (SEQ ID NO: 8680) |
| 17783-G10 | NA | AGGTCTAGTCAGAGCCTCCTGTTTAGT AATGGATACAACTATTTGGAT (SEQ ID NO: 7249) | TTGGTCTCTAAGCGGGCCTCC (SEQ ID NO: 7965) | ATGCAAGCTCTACAAACTCCGCTCACT (SEQ ID NO: 8681) |

TABLE 55-continued scFv VL CDRs

| Ab | Type | CDR1 | CDR2 | CDR3 |
|---|---|---|---|---|
| | AA | RSSQSLLESNGYNYLD (SEQ ID NO: 7250) | LVSKRAS (SEQ ID NO: 7966) | MQALQTPLT (SEQ ID NO: 8682) |
| 17784-B9 | NA | CGGGCAAGTCAGAGCATTAGCAGCTATTTAAAT (SEQ ID NO: 7251) | GCTGCATCCAGTTTGCAAAGT (SEQ ID NO: 7967) | CAACAGAGTTACAGTACCCCTCCGACG (SEQ ID NO: 8683) |
| | AA | RASQSISSYLN (SEQ ID NO: 7252) | AASSLQS (SEQ ID NO: 7968) | QQSYSTPPT (SEQ ID NO: 8684) |
| 17784-C7 | NA | CGGGCGAGTCAGGGCATTAGCAATTATTTAGCC (SEQ ID NO: 7253) | GCTGCATCCAGTTTGCAAAGT (SEQ ID NO: 7969) | CAACAGAGTTACAGTACCCCATTCACT (SEQ ID NO: 8685) |
| | AA | RASQGISNYLA (SEQ ID NO: 7254) | AASSLQS (SEQ ID NO: 7970) | QQSYSTPFT (SEQ ID NO: 8686) |
| 17784-C11 | NA | AGGTCTAGTCAGAGCCTCCTGTATAGTAATGGATACAACTATTTGGAT (SEQ ID NO: 7255) | TTGGGTTCTAATCGGGCCTCC (SEQ ID NO: 7971) | ATGCAAGGTACACACTGGCCATTCACT (SEQ ID NO: 8687) |
| | AA | RSSQSLLYSNGYNYLD (SEQ ID NO: 7256) | LGSNRAS (SEQ ID NO: 7972) | MQGTHWPFT (SEQ ID NO: 8688) |
| 17784-G10 | NA | AGGTCTAGTCAGAGCCTCCTGCATAGTAATGGATACAACTATTTGGAT (SEQ ID NO: 7257) | TTGGGTTCTAATCGGGCCTCC (SEQ ID NO: 7973) | ATGCAAGCTCTACAAACTCCGATCACC (SEQ ID NO: 8689) |
| | AA | RSSQSLLHSNGYNYLD (SEQ ID NO: 7258) | LGSNRAS (SEQ ID NO: 7974) | MQALQTPIT (SEQ ID NO: 8690) |
| 17784-H5 | NA | AGGTCTAGTCAGAGCCTCCTGTTTAGTAATGGATACTACTATTTGGAT (SEQ ID NO: 7259) | TTGGGTTCTAATCGGGCCTCC (SEQ ID NO: 7975) | ATGCAAGCTCTACAAACTCCTCCGACG (SEQ ID NO: 8691) |
| | AA | RSSQSLLESNGYYYLD (SEQ ID NO: 7260) | LGSNRAS (SEQ ID NO: 7976) | MQALQTPPT (SEQ ID NO: 8692) |
| 17785-D12 | NA | AGGTCTAGTCAGAGCCTCCTGTATAGTAATGGATACAACTATTTGGAT (SEQ ID NO: 7261) | TTGGGTTCTAATCGGGCCTCC (SEQ ID NO: 7977) | ATGCAAGCTCTACAAACTCCATTCACT (SEQ ID NO: 8693) |
| | AA | RSSQSLLYSNGYNYLD (SEQ ID NO: 7262) | LGSNRAS (SEQ ID NO: 7978) | MQALQTPFT (SEQ ID NO: 8694) |
| 17813-D8 | NA | CGGGCGAGTCAGGGCATTAGCAATTATTTAGCC (SEQ ID NO: 7263) | GCTGCATCCACTTTGCAATCA (SEQ ID NO: 7979) | CAACAGAGTTACAGTACCCCTCCGACG (SEQ ID NO: 8695) |
| | AA | RASQGISNYLA (SEQ ID NO: 7264) | AASTLQS (SEQ ID NO: 7980) | QQSYSTPPT (SEQ ID NO: 8696) |
| 17813-E3 | NA | AGGTCTAGTCAGAGCCTCCTGTATAGTAATGGATACAACTATTGGAT (SEQ ID NO: 7265) | TTGGGTTCTAATCGGGCCTCC (SEQ ID NO: 7981) | ATGCAAGCTCTACAATCTCTCACT (SEQ ID NO: 8697) |
| | AA | RSSQSLLYSNGYNYLD (SEQ ID NO: 7266) | LGSNRAS (SEQ ID NO: 7982) | MQALQSLT (SEQ ID NO: 8698) |
| 17813-E5 | NA | AGGTCTAGTCAGAGCCTCCTGTATAGTAATGGATACAACTATTTGGAT (SEQ ID NO: 7267) | TTGGGTTCTAAGCGGGCCTCC (SEQ ID NO: 7983) | ATGCAGGCTCTACAAACTCCGCTCACT (SEQ ID NO: 8699) |
| | AA | RSSQSLLYSNGYNYLD (SEQ ID NO: 7268) | LGSKRAS (SEQ ID NO: 7984) | MQALQTPLT (SEQ ID NO: 8700) |
| 17813-F1 | NA | AGGTCTAGTCGGAGCCTCCTGCATAGTAATGGATACAACTATTTGGAT (SEQ ID NO: 7269) | TTGGGTTCTAATCGGGCCTCC (SEQ ID NO: 7985) | ATGCAAGCTCTACAAACTCCTCAT (SEQ ID NO: 8701) |
| | AA | RSSRSLLHSNGYNYLD (SEQ ID NO: 7270) | LGSNRAS (SEQ ID NO: 7986) | MQALQTPH (SEQ ID NO: 8702) |
| 17814-D9 | NA | AAGTCTAGTCAGAGCCTCCTGTATAGTAATGGATACAACTATTTGGAT (SEQ ID NO: 7271) | TTGGGTTCTAATCGGGCCTCC (SEQ ID NO: 7987) | ATGCAAGCTCTACAAACTCCGATCACC (SEQ ID NO: 8703) |

TABLE 55-continued scFv VL CDRs

| Ab | Type | CDR1 | CDR2 | CDR3 |
|---|---|---|---|---|
| | AA | KSSQSLLYSNGYNYLD (SEQ ID NO: 7272) | LGSNRAS (SEQ ID NO: 7988) | MQALQTPIT (SEQ ID NO: 8704) |
| 18071-B1 | NA | ACTGGAACCAGCAGTGACGTTGGTGGT TATAACTATGTCTCC (SEQ ID NO: 7273) | GAGGTCAGTAAGCGGCCCTCA (SEQ ID NO: 7989) | AGCTCATATACAAGCAGCAGCACTCTG GTA (SEQ ID NO: 8705) |
| | AA | TGTSSDVGGYNYVS (SEQ ID NO: 7274) | EVSKRPS (SEQ ID NO: 7990) | SSYTSSSTLV (SEQ ID NO: 8706) |
| 18071-C4 | NA | AAGTCCAGCCAGAGTGTTTTATACAGC TCCAACAATAAGAACTACTTAGCT (SEQ ID NO: 7275) | TGGGCATCTACCCGGGAATCC (SEQ ID NO: 7991) | CAGCAATATTATAGTACTCCGTGGACG (SEQ ID NO: 8707) |
| | AA | KSSQSVLYSSNNKNYLA (SEQ ID NO: 7276) | WASTRES (SEQ ID NO: 7992) | QQYYSTPWT (SEQ ID NO: 8708) |
| 18071-D4 | NA | AAGTCCAGCCAGAGTGTTTTATACAGC TCCAACAATAAGAACTACTTAGCT (SEQ ID NO: 7277) | TGGGCATCTACCCGGGAATCC (SEQ ID NO: 7993) | CAGCAATATTATAGTACTCCGTGGACG (SEQ ID NO: 8709) |
| | AA | KSSQSVLYSSNNKNYLA (SEQ ID NO: 7278) | WASTRES (SEQ ID NO: 7994) | QQYYSTPWT (SEQ ID NO: 8710) |
| 18072-D6 | NA | AGGGCCAGTCAGAGTGTTAGCAGCAGC TACTTAGCC (SEQ ID NO: 7279) | GGTGCATCCGCCAGGGCCACT (SEQ ID NO: 7995) | CAGCAGTATGGTAGCTCGCTCACT (SEQ ID NO: 8711) |
| | AA | RASQSVSSSYLA (SEQ ID NO: 7280) | GASARAT (SEQ ID NO: 7996) | QQYGSSLT (SEQ ID NO: 8712) |
| 18072-G9 | NA | TCTGGCAGCAGCTCCAACATCGGAAGT AATTATGTATAC (SEQ ID NO: 7281) | AGGAATAATCAGCGGCCCTCA (SEQ ID NO: 7997) | GCAGCATGGGATGACAGCCTGAGTGGTG TGGTA (SEQ ID NO: 8713) |
| | AA | SGSSSNIGSNYVY (SEQ ID NO: 7282) | RNNQRPS (SEQ ID NO: 7998) | AAWDDSLSGVV (SEQ ID NO: 8714) |
| 18074-G12 | NA | CAGGCGAGTCAGGACATTAGCAACTAT TTAAAT (SEQ ID NO: 7283) | GATGCATCCAATTTGGAAACA (SEQ ID NO: 7999) | CAACAGAGTTACAGTATCCCTCCGACG (SEQ ID NO: 8715) |
| | AA | QASQDISNYLN (SEQ ID NO: 7284) | DASNLET (SEQ ID NO: 8000) | QQSYSIPPT (SEQ ID NO: 8716) |
| 18078-H6 | NA | ACTGGGAACAGCAACAATGTTGGCAAC CAAGGAGCAGCT (SEQ ID NO: 7285) | AGGAATAACAACCGGCCCTCA (SEQ ID NO: 8001) | TCAGCATGGGACAGCAGCCTCAGTGCTT GGGTG (SEQ ID NO: 8717) |
| | AA | TGNSNNVGNQGAA (SEQ ID NO: 7286) | RNNNRPS (SEQ ID NO: 8002) | SAWDSSLSAWV (SEQ ID NO: 8718) |
| 18079-C8 | NA | ACTGGGAACAGCAACAATGTTGGCAAC CAAGGAGCAGCT (SEQ ID NO: 7287) | AGGAATAACAACCGGCCCTCA (SEQ ID NO: 8003) | TCAGCATGGGACAGCAGCCTCAGTGCTT GGGTG (SEQ ID NO: 8719) |
| | AA | TGNSNNVGNQGAA (SEQ ID NO: 7288) | RNNNRPS (SEQ ID NO: 8004) | SAWDSSLSAWV (SEQ ID NO: 8720) |
| 18079-H4 | NA | AAGTCCAGCCAGAGTGTTTTATACAGC TCCAACAATAAGAACTACTTAGCT (SEQ ID NO: 7289) | TGGGCATCTACCCGGGAATCC (SEQ ID NO: 8005) | CAGCAATATTATAGTACTCCGTGGACG (SEQ ID NO: 8721) |
| | AA | KSSQSVLYSSNNKNYLA (SEQ ID NO: 7290) | WASTRES (SEQ ID NO: 8006) | QQYYSTPWT (SEQ ID NO: 8722) |
| 18079-H11 | NA | AAGTCCAGCCAGAGTGTTTTATACAGC TCCAACAATAAGAACTACTTAGCT (SEQ ID NO: 7291) | TGGGCATCTACCCGGGAATCC (SEQ ID NO: 8007) | CAGCAATATTATAGTACTCCGTGGACG (SEQ ID NO: 8723) |
| | AA | KSSQSVLYSSNNKNYLA (SEQ ID NO: 7292) | WASTRES (SEQ ID NO: 8008) | QQYYSTPWT (SEQ ID NO: 8724) |

TABLE 55-continued scFv VL CDRs

| Ab | Type | CDR1 | CDR2 | CDR3 |
|---|---|---|---|---|
| 18080-C5 | NA | AGGTCTAGTCAGAGCCTCCTGCATAGT AATGGATACAACTATTTGGAT (SEQ ID NO: 7293) | TTGGGTTCTAATCGGGCCTCC (SEQ ID NO: 8009) | ATGCAAGCTCTACAAACTCCTCGGACG (SEQ ID NO: 8725) |
|  | AA | RSSQSLLHSNGYNYLD (SEQ ID NO: 7294) | LGSNRAS (SEQ ID NO: 8010) | MQALQTPRT (SEQ ID NO: 8726) |
| 18080-H9 | NA | AGGGCCAGTCAGAGTGTTAGCAGCGGC TACTTAGCC (SEQ ID NO: 7295) | GGTGCATCCAGCAGGGCCACT (SEQ ID NO: 8011) | CAGCAGTATGGTAGCTCACCATTCACT (SEQ ID NO: 8727) |
|  | AA | RASQSVSSGYLA (SEQ ID NO: 7296) | GASSRAT (SEQ ID NO: 8012) | QQYGSSPET (SEQ ID NO: 8728) |
| 18081-A6 | NA | AAGTCCAGCCAGAGTGTTTTATACAGC TCCAACAATAAGAACTACTTAGCT (SEQ ID NO: 7297) | TGGGCATCTACCCGGGAATCC (SEQ ID NO: 8013) | CAGCAATATTATAGTACTCCGCTCACT (SEQ ID NO: 8729) |
|  | AA | KSSQSVLYSSNNKNYLA (SEQ ID NO: 7298) | WASTRES (SEQ ID NO: 8014) | QQYYSTPLT (SEQ ID NO: 8730) |
| 18081-B5 | NA | AGGTCTAGTCAGAGCCTCCTGCATCGT AATGGATACAACTATTTGGAT (SEQ ID NO: 7299) | TTGGGTTCTAATCGGGCCTCC (SEQ ID NO: 8015) | ATGCAAGCTCTACAAACTCCGATCACC (SEQ ID NO: 8731) |
|  | AA | RSSQSLLHRNGYNYLD (SEQ ID NO: 7300) | LGSNRAS (SEQ ID NO: 8016) | MQALQTPIT (SEQ ID NO: 8732) |
| 18081-C10 | NA | AAGTCCAGCCAGAGTGTTTTATACAGC TCCAACAATAAGAACTACTTAGCT (SEQ ID NO: 7301) | TGGGCATCTACCCGGGAATCC (SEQ ID NO: 8017) | CAGCAATATTATAGTACTCCGCTCACT (SEQ ID NO: 8733) |
|  | AA | KSSQSVLYSSNNKNYLA (SEQ ID NO: 7302) | WASTRES (SEQ ID NO: 8018) | QQYYSTPLT (SEQ ID NO: 8734) |
| 18081-D6 | NA | CGGGCAAGTCAGAGCATTAGCAGCTAT TTAAAT (SEQ ID NO: 7303) | GCTGCATCCAGTTTGCAAAGT (SEQ ID NO: 8019) | CAACAGAGTTACAGTACCCCATTCACT (SEQ ID NO: 8735) |
|  | AA | RASQSISSYLN (SEQ ID NO: 7304) | AASSLQS (SEQ ID NO: 8020) | QQSYSTPFT (SEQ ID NO: 8736) |
| 18081-D12 | NA | CGGGCAAGTCAGAGCATTAGCAGCTAT TTAAAT (SEQ ID NO: 7305) | GCTACATCCAGTTTGCAAAGT (SEQ ID NO: 8021) | CAACAGAGTTACAGTACCCCTCCGACG (SEQ ID NO: 8737) |
|  | AA | RASQSISSYLN (SEQ ID NO: 7306) | ATSSLQS (SEQ ID NO: 8022) | QQSYSTPPT (SEQ ID NO: 8738) |
| 18082-F5 | NA | ACTGGAACCAGCAGTGACGTTGGTGCT TATAACTATGTCTCC (SEQ ID NO: 7307) | GAGGTCAGTAAGCGGCCCTCA (SEQ ID NO: 8023) | AGCTCATATGCAGGCAGCAACAATGTGG TA (SEQ ID NO: 8739) |
|  | AA | TGTSSDVGGYNYVS (SEQ ID NO: 7308) | EVSKRPS (SEQ ID NO: 8024) | SSYAGSNNVV (SEQ ID NO: 8740) |
| 18084-E4 | NA | AGGGCCAGTCAGAGTGTTAGCAGCAGC TACTTAGCC (SEQ ID NO: 7309) | GGTGCATCCAGCAGGGCCACT (SEQ ID NO: 8025) | CAGCAGTATGGAAGCTCACCGCTCACT (SEQ ID NO: 8741) |
|  | AA | RASQSVSSSYLA (SEQ ID NO: 7310) | GASSRAT (SEQ ID NO: 8026) | QQYGSSPLT (SEQ ID NO: 8742) |
| 18086-H4 | NA | AAGTCCAGCCAGAGTGTTTTATACAGC TCCAACAATAAGAACTACTTAGCT (SEQ ID NO: 7311) | TGGGCATCTACCCGGGAATCC (SEQ ID NO: 8027) | CAGCAATATTATAGTACTCCGTGGACG (SEQ ID NO: 8743) |
|  | AA | KSSQSVLYSSNNKNYLA (SEQ ID NO: 7312) | WASTRES (SEQ ID NO: 8028) | QQYYSTPWT (SEQ ID NO: 8744) |
| 18088-B10 | NA | AGGGCCAGTCAGAGTGTTAGCAGCAGC TACTTAGCC (SEQ ID NO: 7313) | GGTGCATCCACCAGGGCCACT (SEQ ID NO: 8029) | CAGCAGTATGGTACCTCACCGCTCACT (SEQ ID NO: 8745) |
|  | AA | RASQSVSSSYLA (SEQ ID NO: 7314) | GASTRAT (SEQ ID NO: 8030) | QQYGTSPLT (SEQ ID NO: 8746) |

TABLE 55-continued

| scFv VL CDRs | | | | |
|---|---|---|---|---|
| Ab | Type | CDR1 | CDR2 | CDR3 |
| 18088-E4 | NA | AGGTCTAGTCAGAGCCTCCTGTATAGT AATGGATACAACTATTTGGAT (SEQ ID NO: 7315) | TTGGGTTCTAAGCGGGCCTCC (SEQ ID NO: 8031) | ATGCAAGTTCTACAAACCCCTCCGACG (SEQ ID NO: 8747) |
| | AA | RSSQSLLYSNGYNYLD (SEQ ID NO: 7316) | LGSKRAS (SEQ ID NO: 8032) | MQVLQTPPT (SEQ ID NO: 8748) |
| 18089-B8 | NA | AAGTCCAGCCAGAGTGTTTTATACAGC TCCAACAATAAGAACTACTTAGCT (SEQ ID NO: 7317) | TGGGCATCTACCCGGGAATCC (SEQ ID NO: 8033) | CAGCAATATTATAGTACTCCGCTCACT (SEQ ID NO: 8749) |
| | AA | KSSQSVLYSSNNKNYLA (SEQ ID NO: 7318) | WASTRES (SEQ ID NO: 8034) | QQYYSTPLT (SEQ ID NO: 8750) |
| 18089-C8 | NA | CGGGCAAGTCAGAGCATTAGCAGCTAT TTAAAT (SEQ ID NO: 7319) | GCTGCATCCAGTTTGCAAAGT (SEQ ID NO: 8035) | CAACAGAGTTACAGTACCCCGCTCACT (SEQ ID NO: 8751) |
| | AA | RASQSISSYLN (SEQ ID NO: 7320) | AASSLQS (SEQ ID NO: 8036) | QQSYSTPLT (SEQ ID NO: 8752) |
| 18089-G7 | NA | CGGGCAAGTCAGAGCATTAGCAGCTAT TTAAAT (SEQ ID NO: 7321) | GCTACATCCAGTTTGCAAAGT (SEQ ID NO: 8037) | CAACAGAGTTACAGTATCCCATTCACT (SEQ ID NO: 8753) |
| | AA | RASQSISSYLN (SEQ ID NO: 7322) | ATSSLQS (SEQ ID NO: 8038) | QQSYSIPFT (SEQ ID NO: 8754) |
| 18089-G11 | NA | CAGGCGAGTCAGGACATTAGCAACTAT TTAAAT (SEQ ID NO: 7323) | GCTGCATCCAGTTTGCAAAGT (SEQ ID NO: 8039) | CAACAGAGTTACAGTACCCCGCTCACT (SEQ ID NO: 8755) |
| | AA | QASQDISNYLN (SEQ ID NO: 7324) | AASSLQS (SEQ ID NO: 8040) | QQSYSTPLT (SEQ ID NO: 8756) |
| 18089-H9 | NA | CGGGCGAGTCAGGGCATTAGCAATTAT TTGGCA (SEQ ID NO: 7325) | GGTGCATCCACTTTGCAATTA (SEQ ID NO: 8041) | CAAAAGTATTACAGTGCCCCATTCACT (SEQ ID NO: 8757) |
| | AA | RASQGISNYLA (SEQ ID NO: 7326) | GASTLQL (SEQ ID NO: 8042) | QKYYSAPFT (SEQ ID NO: 8758) |
| 18089-H12 | NA | CGGGCAAGTCAGAGCATTAGCAGCTAT TTAAAT (SEQ ID NO: 7327) | GCTGCATCCAGTTTGCAAAGT (SEQ ID NO: 8043) | CAACAGAGTTACAGTACCCCATTCACT (SEQ ID NO: 8759) |
| | AA | RASQSISSYLN (SEQ ID NO: 7328) | AASSLQS (SEQ ID NO: 8044) | QQSYSTPFT (SEQ ID NO: 8760) |
| 18090-H9 | NA | ACTGGGAACAGCAACAATGTTGGCAAC CAAGGAGCAGCT (SEQ ID NO: 7329) | AGGAATAACAACCGGCCCTCA (SEQ ID NO: 8045) | TCAGCATGGGACAGCAGCCTCAGTGCTG TGGTA (SEQ ID NO: 8762) |
| | AA | TGNSNNVGNQGAA (SEQ ID NO: 7330) | RNNNRPS (SEQ ID NO: 8046) | SAWDSSLSAVV (SEQ ID NO: 8761) |
| 18093-E2 | NA | CAGGCGAGTCAGGACATTAGCAACTAT TTAAAT (SEQ ID NO: 7331) | GCTGCATCCAGTTTGCAAAGT (SEQ ID NO: 8047) | CAACAGAGTTACAGTACCCCTCCGACG (SEQ ID NO: 8763) |
| | AA | QASQDISNYLN (SEQ ID NO: 7332) | AASSLQS (SEQ ID NO: 8048) | QQSYSTPPT (SEQ ID NO: 8764) |
| 18093-F5 | NA | CGGGCAAGTCAGAGCATTAGCAGCTAT TTAAAT (SEQ ID NO: 7333) | GCTGCATCCAGTTTGCAAAGT (SEQ ID NO: 8049) | CAGCAGAGTTACAGTGTCCCTCCGACG (SEQ ID NO: 8765) |
| | AA | RASQSISSYLN (SEQ ID NO: 7334) | AASSLQS (SEQ ID NO: 8050) | QQSYSVPPT (SEQ ID NO: 8766) |
| 18179-A3 | NA | AGGTCTAGTCAGAGCCTCCTGCACAAG AAATGGATACAACTATTTGGAT (SEQ ID NO: 7335) | TTGGGTTCTAATCGGGCCTCC (SEQ ID NO: 8051) | ATGCAAGCTCTACAAACTCCATTCACT (SEQ ID NO: 8767) |

TABLE 55-continued scFv VL CDRs

| Ab | Type | CDR1 | CDR2 | CDR3 |
|---|---|---|---|---|
| | AA | RSSQSLLHRNGYNYLD (SEQ ID NO: 7336) | LGSNRAS (SEQ ID NO: 8052) | MQALQTPFT (SEQ ID NO: 8768) |
| 18179-A5 | NA | AGGTCTAGTCAGAGCCTCCTGCATAGT AATGGATACAACTATTTGGAT (SEQ ID NO: 7337) | TTGGGTTCTAATCGGGCCTCC (SEQ ID NO: 8053) | ATGCAAGCTCTACAAACTCCATTCACT (SEQ ID NO: 8769) |
| | AA | RSSQSLLHSNGYNYLD (SEQ ID NO: 7338) | LGSNRAS (SEQ ID NO: 8054) | MQALQTPFT (SEQ ID NO: 8770) |
| 18179-A9 | NA | AGGTCTAGTCAGAGCCTCCTGCATAGT AATGGATACAACTATGTGGAT (SEQ ID NO: 7339) | TTGGGTTCTAATCGGGCCTCC (SEQ ID NO: 8055) | ATGCAAGCTCTACAAACTCCGCTCACT (SEQ ID NO: 8771) |
| | AA | RSSQSLLHSNGYNYVD (SEQ ID NO: 7340) | LGSNRAS (SEQ ID NO: 8056) | MQALQTPLT (SEQ ID NO: 8772) |
| 18179-A10 | NA | AGGTCTAGTCAGAGCCTCCTGCATAGA AATGGATACAATTATTTGGAT (SEQ ID NO: 7341) | TTGGGTTCTAATCGGGCCTCC (SEQ ID NO: 8057) | ATGCAAGCTCTACAAACTCCTCGGACG (SEQ ID NO: 8773) |
| | AA | RSSQSLLHRNGYNYLD (SEQ ID NO: 7342) | LGSNRAS (SEQ ID NO: 8058) | MQALQTPRT (SEQ ID NO: 8774) |
| 18179-B7 | NA | CAGGCGAGGCAGGACATTAGCGACTAT TTAAAT (SEQ ID NO: 7343) | GCTGCATCCAGTTTGCAAGGT (SEQ ID NO: 8059) | CAACAGACTTACAGTATGCCATTCACT (SEQ ID NO: 8775) |
| | AA | QARQDISDYLN (SEQ ID NO: 7344) | AASSLQG (SEQ ID NO: 8060) | QQTYSMPFT (SEQ ID NO: 8776) |
| 18179-B8 | NA | CGGACAAGTCAGAGCATTAACAGCTAT TTAAAT (SEQ ID NO: 7345) | GCTGCATCCAGTTTGCAAAGT (SEQ ID NO: 8061) | CAACAGAGTTACAGTACCCCATTCACT (SEQ ID NO: 8777) |
| | AA | RTSQSINSYLN (SEQ ID NO: 7346) | AASSLQS (SEQ ID NO: 8062) | QQSYSTPFT (SEQ ID NO: 8778) |
| 18179-C4 | NA | AGGTCTAGTCAGAGCCTCCTGCATAGT ACTGGATACAACTATTTGGAT (SEQ ID NO: 7347) | TTGGGTTCTAATCGGGCCTCC (SEQ ID NO: 8063) | ATGCAAGCTCTACAAACTCCTCGGACG (SEQ ID NO: 8779) |
| | AA | RSSQSLLHSTGYNYLD (SEQ ID NO: 7348) | LGSNRAS (SEQ ID NO: 8064) | MQALQTPRT (SEQ ID NO: 8780) |
| 18179-C6 | NA | AGGTCTAGTCAGAGCCTCCTGCATAGA AATGGATACAATTATTTGGAT (SEQ ID NO: 7349) | TTGGGTTCTAATCGGGCCTCC (SEQ ID NO: 8065) | ATGCAAGCTCTACAAACTCCTCGGACG (SEQ ID NO: 8781) |
| | AA | RSSQSLLHRNGYNYLD (SEQ ID NO: 7350) | LGSNRAS (SEQ ID NO: 8066) | MQALQTPRT (SEQ ID NO: 8782) |
| 18179-C7 | NA | AGGTCTAGTCAGAGCCTCCTGCATCGT AATGGATACCACTATTTGGAT (SEQ ID NO: 7351) | TTGGGTTCTAATCGGGCCTCC (SEQ ID NO: 8067) | ATGCAAGCTCTACAAACTCCCAGT (SEQ ID NO: 8783) |
| GGAT | AA | RSSQSLLHRNGYHYLD (SEQ ID NO: 7352) | LGSNRAS (SEQ ID NO: 8068) | MQALQTPS (SEQ ID NO: 8784) |
| 18179-C10 | NA | AGGTCTAGTCAGAGCCTCCTGCATAGA AATGGATACAACTATGGAT (SEQ ID NO: 7353) | TTGGGTTCTAATCGGGCCTCC (SEQ ID NO: 8069) | ATGCAAGCTCTACAAACTCCATTCACT (SEQ ID NO: 8785) |
| | AA | RSSQSLLHRNGYNYLD (SEQ ID NO: 7354) | LGSNRAS (SEQ ID NO: 8070) | MQALQTPFT (SEQ ID NO: 8786) |
| 18179-D8 | NA | CGGACAAGTCAGAGCATTAGCAGCTAT TTAAAT (SEQ ID NO: 7355) | GCTGCATCCAGTTTGCAAGGT (SEQ ID NO: 8071) | CAACAGACTTACAGTATGCCATTCACT (SEQ ID NO: 8787) |
| | AA | RTSQSISSYLN (SEQ ID NO: 7356) | AASSLQG (SEQ ID NO: 8072) | QQTYSMPFT (SEQ ID NO: 8788) |

TABLE 55-continued scFv VL CDRs

| Ab | Type | CDR1 | CDR2 | CDR3 |
|---|---|---|---|---|
| 18179-D9 | NA | CGGACAAGTCAGAGCATTAACAGCTAT<br>TTAAAT<br>(SEQ ID NO: 7357) | GCTGCATCCAGTTTACAAAGT<br>(SEQ ID NO: 8073) | CAACAGAGTTACAGTACCCCATTCACT<br>(SEQ ID NO: 8789) |
|  | AA | RTSQSINSYLN<br>(SEQ ID NO: 7358) | AASSLQS<br>(SEQ ID NO: 8074) | QQSYSTPFT<br>(SEQ ID NO: 8790) |
| 18179-E6 | NA | CGGACAAGTCAGAGCATTAGCAGCTAT<br>TTAAAT<br>(SEQ ID NO: 7359) | GCTGCATCCAGTTTGCAAGGT<br>(SEQ ID NO: 8075) | CAACAGACTTACAGTATGCCATTCACT<br>(SEQ ID NO: 8791) |
|  | AA | RTSQSISSYLN<br>(SEQ ID NO: 7360) | AASSLQG<br>(SEQ ID NO: 8076) | QQTYSMPFT<br>(SEQ ID NO: 8792) |
| 18179-F3 | NA | AGGTCTAGTCAGAGCCTCCTGCATCGT<br>AATGGATACAACTATTTGGAT<br>(SEQ ID NO: 7361) | TTGGGTTCTAATCGGGCCTCC<br>(SEQ ID NO: 8077) | ATGCAAGCTCTACAAACTCCCAGT<br>(SEQ ID NO: 8793) |
|  | AA | RSSQSLLHRNGYNYLD<br>(SEQ ID NO: 7362) | LGSNRAS<br>(SEQ ID NO: 8078) | MQALQTPS<br>(SEQ ID NO: 8794) |
| 18179-F4 | NA | AGGTCTAGTCAGAGCCTCCTGCATCGT<br>AATGGATACCACTATGGAT<br>(SEQ ID NO: 7363) | TTGGGTTCTAATCGGGCCTCC<br>(SEQ ID NO: 8079) | ATGCAAGCTCTCCAAACTCCATTCACT<br>(SEQ ID NO: 8795) |
|  | AA | RSSQSLLHRNGYHYLD<br>(SEQ ID NO: 7364) | LGSNRAS<br>(SEQ ID NO: 8080) | MQALQTPFT<br>(SEQ ID NO: 8796) |
| 18179-F6 | NA | AGGTCTAGTCAGAGCCTCCTGCATAGT<br>AATGGATACAACTATTTGGAT<br>(SEQ ID NO: 7365) | TTGGGTTCTAATCGGGCCTCC<br>(SEQ ID NO: 8081) | ATGCAAGCTCTACAAACTCCTCGGACG<br>(SEQ ID NO: 8797) |
|  | AA | RSSQSLLHSNGYNYLD<br>(SEQ ID NO: 7366) | LGSNRAS<br>(SEQ ID NO: 8082) | MQALQTPRT<br>(SEQ ID NO: 8798) |
| 18179-F10 | NA | AGGTCTAGTCAGAGCCTCCTGCATAGT<br>AATGGATACAACTATTTGGAT<br>(SEQ ID NO: 7367) | TTGGGTTCTAATCGGGCCTCC<br>(SEQ ID NO: 8083) | ATGCAAGCTCTACAAACTCCTCGGACG<br>(SEQ ID NO: 8799) |
|  | AA | RSSQSLLHSNGYNYLD<br>(SEQ ID NO: 7368) | LGSNRAS<br>(SEQ ID NO: 8084) | MQALQTPRT<br>(SEQ ID NO: 8800) |
| 18179-G8 | NA | AGGTCTAGTCAGAGCCTCCTGCATAGA<br>AAGGATACAATTATTTGGAT<br>(SEQ ID NO: 7369) | TTGGGTTCTAATCGGGCCTCC<br>(SEQ ID NO: 8085) | ATGCAAGCTCTACAAACTCCTCGGACG<br>(SEQ ID NO: 8801) |
|  | AA | RSSQSLLHRNGYNYLD<br>(SEQ ID NO: 7370) | LGSNRAS<br>(SEQ ID NO: 8086) | MQALQTPRT<br>(SEQ ID NO: 8802) |
| 18179-G9 | NA | AGGTCTAGTCAGAGCCTCCTGCATAGA<br>AATGGTTACAATTATTTGGAT<br>(SEQ ID NO: 7371) | TTGGGTTCTAATCGGGCCTCC<br>(SEQ ID NO: 8087) | ATGCAAGCTCTACAAACTCCCAGT<br>(SEQ ID NO: 8803) |
|  | AA | RSSQSLLHRNGYNYLD<br>(SEQ ID NO: 7372) | LGSNRAS<br>(SEQ ID NO: 8088) | MQALQTPS<br>(SEQ ID NO: 8804) |
| 18179-H6 | NA | AGGTCTAGTCAGAGCCTCCTGCAAAAT<br>GGATCAACTATTTGGAT<br>(SEQ ID NO: 7373) | TTGGGTTCTAATCGGGCCTCC<br>(SEQ ID NO: 8089) | ATGCAAAGTCTACATCTTCCTCCCACT<br>(SEQ ID NO: 8805) |
|  | AA | RSSQSLLHRNGYNYLD<br>(SEQ ID NO: 7374) | LGSNRAS<br>(SEQ ID NO: 8090) | MQSLHLPPT<br>(SEQ ID NO: 8806) |
| 18179-H9 | NA | AGGTCTAGTCAGAGCCTCCTGCATCGT<br>AATGGATACCACTATTTGGAT<br>(SEQ ID NO: 7375) | TTGGGTTCTAATCGGGCCTCC<br>(SEQ ID NO: 8091) | ATGCAAGCTCTACAAACTCCATTCACT<br>(SEQ ID NO: 8807) |
|  | AA | RSSQSLLHRNGYHYLD<br>(SEQ ID NO: 7376) | LGSNRAS<br>(SEQ ID NO: 8092) | MQALQTPFT<br>(SEQ ID NO: 8808) |
| 18181-A11 | NA | AGGTCTAGTCAGAGCCTCCTGCATAGA<br>AATGGATACAACTATTTGGAT<br>(SEQ ID NO: 7377) | TTGGGTTCTAATCGGGCCTCC<br>(SEQ ID NO: 8093) | ATGCAAGCTCTCCAAACTCCATTCACT<br>(SEQ ID NO: 8809) |
|  | AA | RSSQSLLHRNGYNYLD<br>(SEQ ID NO: 7378) | LGSNRAS<br>(SEQ ID NO: 8094) | MQALQTPFT<br>(SEQ ID NO: 8810) |

TABLE 55-continued scFv VL CDRs

| Ab | Type | CDR1 | CDR2 | CDR3 |
|---|---|---|---|---|
| 18181-C6 | NA | AGGTCTAGTCAGAGCCTCCTGCATAGT ACTGGATACAACTGGAT (SEQ ID NO: 7379) | TTGGGTTCTAATCGGGCCTCC (SEQ ID NO: 8095) | ATGCAAGGTCTACAAACTCCTCGGACG (SEQ ID NO: 8811) |
|  | AA | RSSQSLLHSTGYNYLD (SEQ ID NO: 7380) | LGSNRAS (SEQ ID NO: 8096) | MQGLQTPRT (SEQ ID NO: 8812) |
| 18181-G7 | NA | CGGACAAGTCAGAGCATTAGCAGCTAT TTAAAT (SEQ ID NO: 7381) | GCTGCATCCAGTTTGCAAGGT (SEQ ID NO: 8097) | CAACAGACTTACAGTATGCCATTCACT (SEQ ID NO: 8813) |
|  | AA | RTSQSISSYLN (SEQ ID NO: 7382) | AASSLQG (SEQ ID NO: 8098) | QQTYSMPFT (SEQ ID NO: 8814) |
| 18181-H10 | NA | AGGTCTAGTCAGAGCCTCCTGCATAGT AATGGATACAACTATTTGGAT (SEQ ID NO: 7383) | TTGGGTTCTAATCGGGCCTCC (SEQ ID NO: 8099) | ATGCAAGCTCTACAAACTCCTCGGACG (SEQ ID NO: 8815) |
|  | AA | RSSQSLLHSNGYNYLD (SEQ ID NO: 7384) | LGSNRAS (SEQ ID NO: 8100) | MQALQTPRT (SEQ ID NO: 8816) |
| 18182-A3 | NA | GGGGGAAACAACATTGGAAGTAAAAGT GTGCAC (SEQ ID NO: 7385) | GATGATAACGACCGGCCCTCA (SEQ ID NO: 8101) | CAGGTGTGGGATAGCAGTAGTGATCATG TGGTA (SEQ ID NO: 8817) |
|  | AA | GGNNIGSKSVH (SEQ ID NO: 7386) | DDNDRPS (SEQ ID NO: 8102) | QVWDSSSDHVV (SEQ ID NO: 8818) |
| 18182-A5 | NA | GGGGGAAACAACATTGGAAGTAAAAGT GTGCAG (SEQ ID NO: 7387) | GATGATAACGACCGGCCCTCA (SEQ ID NO: 8103) | CAGGTGTGGGATAGTAGTAGTGATCATG TGGTA (SEQ ID NO: 8819) |
|  | AA | GGNNIGSKSVQ (SEQ ID NO: 7388) | DDNDRPS (SEQ ID NO: 8104) | QVWDSSSDHVV (SEQ ID NO: 8820) |
| 18182-A6 | NA | GGGGGAAACAACATTGGAAGTAAAAGT GTGCAC (SEQ ID NO: 7389) | GATGATAACGACCGGCCCTCA (SEQ ID NO: 8105) | CAGGTGTGGGATAGTAGTAGTGATCATG TGGTA (SEQ ID NO: 8821) |
|  | AA | GGNNIGSKSVH (SEQ ID NO: 7390) | DDNDRPS (SEQ ID NO: 8106) | QVWDSSSDHVV (SEQ ID NO: 8822) |
| 18182-A7 | NA | GGGGGAAACAACATTGGAAGTAAAAGT GTGCAC (SEQ ID NO: 7391) | GATGATAACGACCGGCCCTCA (SEQ ID NO: 8107) | CAGGTGTGGGATAGTAGTAGTGATCATG TGGTA (SEQ ID NO: 8823) |
|  | AA | GGNNIGSKSVH (SEQ ID NO: 7392) | DDNDRPS (SEQ ID NO: 8108) | QVWDSSSDHVV (SEQ ID NO: 8824) |
| 18182-A8 | NA | GGGGGAAACAACATTGGAAGTAAAAGT GTGCAC (SEQ ID NO: 7393) | GATGATAACGACCGGCCCTCA (SEQ ID NO: 8109) | CAGGTGTGGGATAGTAGTAGTGATCATG TGGTA (SEQ ID NO: 8825) |
|  | AA | GGNNIGSKSVH (SEQ ID NO: 7394) | DDNDRPS (SEQ ID NO: 8110) | QVWDSSSDHVV (SEQ ID NO: 8826) |
| 18182-A11 | NA | GGGGGAAACAACATTGGAAGTAAAAGT GTGCAC (SEQ ID NO: 7395) | GATGATAACGACCGGCCCTCA (SEQ ID NO: 8111) | CAGGTGTGGGATAGTAGTAGTGATCATG TGGTA (SEQ ID NO: 8827) |
|  | AA | GGNNIGSKSVH (SEQ ID NO: 7396) | DDNDRPS (SEQ ID NO: 8112) | QVWDSSSDHVV (SEQ ID NO: 8828) |
| 18182-B1 | NA | GGGGGAAACAACATTGGAAGTAAAAGT GTGCAC (SEQ ID NO: 7397) | GATGATAACGACCGGCCCTCA (SEQ ID NO: 8113) | CAGGTGTGGGATAGCAGTAGTGATCATG TGGTA (SEQ ID NO: 8829) |
|  | AA | GGNNIGSKSVH (SEQ ID NO: 7398) | DDNDRPS (SEQ ID NO: 8114) | QVWDSSSDHVV (SEQ ID NO: 8830) |
| 18182-B4 | NA | GGGGGAAACAACATTGGAAGTAAAAGT GTGCAC (SEQ ID NO: 7399) | GATGATAACGACCGGCCCTCA (SEQ ID NO: 8115) | CAGGTGTGGGATAGTAGTAGTGATCATG TGGTA (SEQ ID NO: 8831) |

TABLE 55-continued scFv VL CDRs

| Ab | Type | CDR1 | CDR2 | CDR3 |
|---|---|---|---|---|
| | AA | GGNNIGSKSVH<br>(SEQ ID NO: 7400) | DDNDRPS<br>(SEQ ID NO: 8116) | QVWDSSSDHVV<br>(SEQ ID NO: 8832) |
| 18182-B6 | NA | GGGGGAAACAACATTGGAAGTAAAAGT<br>GTGCAC<br>(SEQ ID NO: 7401) | GATGATAACGACCGGCCCTCA<br>(SEQ ID NO: 8117) | CAGGTGTGGGATAGTAGTAGTGATCATG<br>TGGTA<br>(SEQ ID NO: 8833) |
| | AA | GGNNIGSKSVH<br>(SEQ ID NO: 7402) | DDNDRPS<br>(SEQ ID NO: 8118) | QVWDSSSDHVV<br>(SEQ ID NO: 8834) |
| 18182-B7 | NA | GGGGGAAACAACATTGGAAGTAAAAGT<br>GTGCAG<br>(SEQ ID NO: 7403) | GATGATAACGACCGGCCCTCA<br>(SEQ ID NO: 8119) | CAGGTGTGGGATAGTAGTAGTGATCATG<br>TGGTA<br>(SEQ ID NO: 8835) |
| | AA | GGNNIGSKSVQ<br>(SEQ ID NO: 7404) | DDNDRPS<br>(SEQ ID NO: 8120) | QVWDSSSDHVV<br>(SEQ ID NO: 8836) |
| 18182-B10 | NA | GGGGGAAACAACATTGGAAGTAAAAGT<br>GTGCAC<br>(SEQ ID NO: 7405) | GATGATAACGACCGGCCCTCA<br>(SEQ ID NO: 8121) | CAGGTGTGGGATAGCAGTAGTGATCATG<br>TGGTA<br>(SEQ ID NO: 8837) |
| | AA | GGNNIGSKSVH<br>(SEQ ID NO: 7406) | DDNDRPS<br>(SEQ ID NO: 8122) | QVWDSSSDHVV<br>(SEQ ID NO: 8838) |
| 18182-C2 | NA | GGGGGAAACAACATTGGAAGTAAAAGT<br>GTGCAG<br>(SEQ ID NO: 7407) | GATGATAACGACCGGCCCTCA<br>(SEQ ID NO: 8123) | CAGGTGTGGGATAGTAGTAGTGATCATG<br>TGGTA<br>(SEQ ID NO: 8839) |
| | AA | GGNNIGSKSVQ<br>(SEQ ID NO: 7408) | DDNDRPS<br>(SEQ ID NO: 8124) | QVWDSSSDHVV<br>(SEQ ID NO: 8840) |
| 18182-C3 | NA | GGGGGAAACAACATTGGAAGTAAAAGT<br>GTGCAC<br>(SEQ ID NO: 7409) | GATGATAACGACCGGCCCTCA<br>(SEQ ID NO: 8125) | CAGGTGTGGGATAGCAGTAGTGATCATG<br>CGGTA<br>(SEQ ID NO: 8841) |
| | AA | GGNNIGSKSVH<br>(SEQ ID NO: 7410) | DDNDRPS<br>(SEQ ID NO: 8126) | QVWDSSSDHAV<br>(SEQ ID NO: 8842) |
| 18182-C4 | NA | GGGGGAAACAACATTGGAAGTAAAAGT<br>GTGCAC<br>(SEQ ID NO: 7411) | GATGATAACGACCGGCCCTCA<br>(SEQ ID NO: 8127) | CAGGTGTGGGATAGTAGTAGTGATCATG<br>TGGTA<br>(SEQ ID NO: 8843) |
| | AA | GGNNIGSKSVH<br>(SEQ ID NO: 7412) | DDNDRPS<br>(SEQ ID NO: 8128) | QVWDSSSDHVV<br>(SEQ ID NO: 8844) |
| 18182-C5 | NA | GGGGGAAACAACATTGGAATTAAAAGT<br>GTGCAC<br>(SEQ ID NO: 7413) | GATGATAACGACCGGCCCTCA<br>(SEQ ID NO: 8129) | CAGGTGTGGGATAGTAGTAGTGATCATG<br>TGGTA<br>(SEQ ID NO: 8845) |
| | AA | GGNNIGIKSVH<br>(SEQ ID NO: 7414) | DDNDRPS<br>(SEQ ID NO: 8130) | QVWDSSSDHVV<br>(SEQ ID NO: 8846) |
| 18182-C10 | NA | GGGGGAAACAACATTGGAAGTAAAAGT<br>GTGCAC<br>(SEQ ID NO: 7415) | GATGATAACGACCGGCCCTCA<br>(SEQ ID NO: 8131) | CAGGTGTGGGATAGCAGTAGTGATCATG<br>TGGTA<br>(SEQ ID NO: 8847) |
| | AA | GGNNIGSKSVH<br>(SEQ ID NO: 7416) | DDNDRPS<br>(SEQ ID NO: 8132) | QVWDSSSDHVV<br>(SEQ ID NO: 8848) |
| 18182-C12 | NA | GGGGGAAACAACATTGGAAGTAAAAGT<br>GTGCAC<br>(SEQ ID NO: 7417) | GATGATAACGACCGGCCCTCA<br>(SEQ ID NO: 8133) | CAGGTGTGGGATAGTAGTAGTGATCATG<br>TGGTA<br>(SEQ ID NO: 8849) |
| | AA | GGNNIGSKSVH<br>(SEQ ID NO: 7418) | DDNDRPS<br>(SEQ ID NO: 8134) | QVWDSSSDHVV<br>(SEQ ID NO: 8850) |
| 18182-D4 | NA | GGGGGAAACAACATTGGAAGTAAAAGT<br>GTGCAC<br>(SEQ ID NO: 7419) | GATGATAACGACCGGCCCTCA<br>(SEQ ID NO: 8135) | CAGGTGTGGGATAGCAGTAGTGATCATG<br>TGGTA<br>(SEQ ID NO: 8851) |
| | AA | GGNNIGSKSVH<br>(SEQ ID NO: 7420) | DDNDRPS<br>(SEQ ID NO: 8136) | QVWDSSSDHVV<br>(SEQ ID NO: 8852) |
| 18182-D8 | NA | GGGGGAAACAACATTGGAAGTAAAAGT<br>GTGCAG<br>(SEQ ID NO: 7421) | GATGATAACGACCGGCCCTCA<br>(SEQ ID NO: 8137) | CAGGTGTGGGATAGTAGTAGTGATCATG<br>TGATA<br>(SEQ ID NO: 8853) |

TABLE 55-continued scFv VL CDRs

| Ab | Type | CDR1 | CDR2 | CDR3 |
|---|---|---|---|---|
| | AA | GGNNIGSKSVQ (SEQ ID NO: 7422) | DDNDRPS (SEQ ID NO: 8138) | QVWDSSSDHVI (SEQ ID NO: 8854) |
| 18182-D9 | NA | GGGGGAAACAACATTGGAAGTAAAAGTGTGCAC (SEQ ID NO: 7423) | GATGATAACGACCGGCCCTCA (SEQ ID NO: 8139) | CAGGTGTGGGATAGTAATAGTGATCATGTGGTA (SEQ ID NO: 8855) |
| | AA | GGNNIGSKSVH (SEQ ID NO: 7424) | DDNDRPS (SEQ ID NO: 8140) | QVWDSNSDHVV (SEQ ID NO: 8856) |
| 18182-D11 | NA | GGGGGAAACAACATTGGAAGTAAAAGTGTGCAC (SEQ ID NO: 7425) | GATGATAACGACCGGCCCTCA (SEQ ID NO: 8141) | CAGGTGTGGGATAGTAGTAGTGATCATGTGATA (SEQ ID NO: 8857) |
| | AA | GGNNIGSKSVH (SEQ ID NO: 7426) | DDNDRPS (SEQ ID NO: 8142) | QVWDSSSDHVI (SEQ ID NO: 8858) |
| 18182-E2 | NA | GGGGGAAACAACATTGGAAGTAAAAGTGTGCAC (SEQ ID NO: 7427) | GATGATAACGACCGGCCCTCA (SEQ ID NO: 8143) | CAGGTGTGGGATAGTAGTAGTGATCATGTGGTA (SEQ ID NO: 8859) |
| | AA | GGNNIGSKSVH (SEQ ID NO: 7428) | DDNDRPS (SEQ ID NO: 8144) | QVWDSSSDHVV (SEQ ID NO: 8860) |
| 18182-E3 | NA | GGGGGAAACAACATTGGAAGTAAAAGTGTGCAG (SEQ ID NO: 7429) | GATGATAACGACCGGCCCTCA (SEQ ID NO: 8145) | CAGGTGTGGGATAGTAGTAGTGATCATGTGGTA (SEQ ID NO: 8861) |
| | AA | GGNNIGSKSVQ (SEQ ID NO: 7430) | DDNDRPS (SEQ ID NO: 8146) | QVWDSSSDHVV (SEQ ID NO: 8862) |
| 18182-E8 | NA | GGGGGAAACAACATTGGAAGTAAAAGTGTGCAC (SEQ ID NO: 7431) | GATGATAACGACCGGCCCTCA (SEQ ID NO: 8147) | CAGGTGTGGGATAGCAGTAGTGATCATGTGGTA (SEQ ID NO: 8863) |
| | AA | GGNNIGSKSVH (SEQ ID NO: 7432) | DDNDRPS (SEQ ID NO: 8148) | QVWDSSSDHVV (SEQ ID NO: 8864) |
| 18182-E11 | NA | GGGGGAAACAACATTGGAAGTAAAAGTGTGCAC (SEQ ID NO: 7433) | GATGATAACGACCGGCCCTCA (SEQ ID NO: 8149) | CAGGTGTGGGATAGTAGTAGTGATCATGTGGTA (SEQ ID NO: 8865) |
| | AA | GGNNIGSKSVH (SEQ ID NO: 7434) | DDNDRPS (SEQ ID NO: 8150) | QVWDSSSDHVV (SEQ ID NO: 8866) |
| 18182-F1 | NA | GGGGGAAACAACATTGGAAGTAAAAGTGTGCAC (SEQ ID NO: 7435) | GATGATAACGACCGGCCCTCA (SEQ ID NO: 8151) | CAGGTGTGGGATAGCAGTAGTGATCATGTGGTA (SEQ ID NO: 8867) |
| | AA | GGNNIGSKSVH (SEQ ID NO: 7436) | DDNDRPS (SEQ ID NO: 8152) | QVWDSSSDHVV (SEQ ID NO: 8868) |
| 18182-F6 | NA | GGGGGAAACAACATTGGAAGTAAAAGTGTGCAC (SEQ ID NO: 7437) | GATGATAACGACCGGCCCTCA (SEQ ID NO: 8153) | CAGGTGTGGGATAGTAGTAGTGATCATGTGATG (SEQ ID NO: 8869) |
| | AA | GGNNIGSKSVH (SEQ ID NO: 7438) | DDNDRPS (SEQ ID NO: 8154) | QVWDSSSDHVM (SEQ ID NO: 8870) |
| 18182-F8 | NA | GGGGGAAACAACATTGGAAGTAAAAGTGTGCAC (SEQ ID NO: 7439) | GATGATAACGACCGGCCCTCA (SEQ ID NO: 8155) | CAGGTGTGGGATAGTAGTAGTGATCATGTGGTA (SEQ ID NO: 8871) |
| | AA | GGNNIGSKSVH (SEQ ID NO: 7440) | DDNDRPS (SEQ ID NO: 8156) | QVWDSSSDHVV (SEQ ID NO: 8872) |
| 18182-G3 | NA | GGGGGAAACAACATTGGAAGTAAAAGTGTGCAC (SEQ ID NO: 7441) | GATGATAACGACCGGCCCTCA (SEQ ID NO: 8157) | CAGGTGTGGGATAGCAGTAGTGATCATGTGGTA (SEQ ID NO: 8873) |
| | AA | GGNNIGSKSVH (SEQ ID NO: 7442) | DDNDRPS (SEQ ID NO: 8158) | QVWDSSSDHVV (SEQ ID NO: 8874) |

TABLE 55-continued scFv VL CDRs

| Ab | Type | CDR1 | CDR2 | CDR3 |
|---|---|---|---|---|
| 18182-G4 | NA | GGGGGAAACAACATTGGAAGTAAAAGT GTGCAC (SEQ ID NO: 7443) | GATGATAACGACCGGCCCTCA (SEQ ID NO: 8159) | CAGGTGTGGGATAGCAGTAGTGATCATG TGGTA (SEQ ID NO: 8875) |
| | AA | GGNNIGSKSVH (SEQ ID NO: 7444) | DDNDRPS (SEQ ID NO: 8160) | QVWDSSSDHVV (SEQ ID NO: 8876) |
| 18182-G5 | NA | GGGGGAAACAACATTGGAAGTAAAAGT GTGCAC (SEQ ID NO: 7445) | GATGATAACGACCGGCCCTCA (SEQ ID NO: 8161) | CAGGTGTGGGATAGCAGTAGTGATCATG TGGTA (SEQ ID NO: 8877) |
| | AA | GGNNIGSKSVH (SEQ ID NO: 7446) | DDNDRPS (SEQ ID NO: 8162) | QVWDSSSDHVV (SEQ ID NO: 8878) |
| 18182-G9 | NA | GGGGGAAACAACATTGGAAGTAAAGGT GTGCAG (SEQ ID NO: 7447) | GATGATAACGACCGGCCCTCA (SEQ ID NO: 8163) | CAGGTGTGGGATAGCAGTAGTGATCATG TGGTA (SEQ ID NO: 8879) |
| | AA | GGNNIGSKGVQ (SEQ ID NO: 7448) | DDNDRPS (SEQ ID NO: 8164) | QVWDSSSDHVV (SEQ ID NO: 8880) |
| 18182-G11 | NA | GGGGGAAACAACATTGGAAGTAAAAGT GTGCAG (SEQ ID NO: 7449) | GATGATAACGACCGGCCCTCA (SEQ ID NO: 8165) | CAGGTGTGGGATAGCAGTAGTGATCATG TGGTA (SEQ ID NO: 8881) |
| | AA | GGNNIGSKSVQ (SEQ ID NO: 7450) | DDNDRPS (SEQ ID NO: 8166) | QVWDSSSDHVV (SEQ ID NO: 8882) |
| 18182-H5 | NA | GGGGGAAACAACATTGGAAGTAAAAGT GTGCAC (SEQ ID NO: 7451) | GATGATAACGACCGGCCCTCA (SEQ ID NO: 8167) | CAGGTGTGGGATAGTAGTAGTGATCATG TGGTA (SEQ ID NO: 8883) |
| | AA | GGNNIGSKSVH (SEQ ID NO: 7452) | DDNDRPS (SEQ ID NO: 8168) | QVWDSSSDHVV (SEQ ID NO: 8884) |
| 18089-D12 | NA | CGGGCGAGTCAGGGCATTAGCAATTAT TTAGCC (SEQ ID NO: 7453) | GCTGCATCCACTTTGCAATCA (SEQ ID NO: 8169) | CAAAAGTATAACAGTGCCCCATTCACT (SEQ ID NO: 8885) |
| | AA | RASQGISNYLA (SEQ ID NO: 7454) | AASTLQS (SEQ ID NO: 8170) | QKYNSAPFT (SEQ ID NO: 8886) |
| 18179-G12 | NA | CGGGCGAGTCAGGGCATTAGCAATTAT TTAGCC (SEQ ID NO: 7455) | GCTGCATCCACTTTGCAATCA (SEQ ID NO: 8171) | CAAAAGTATAACAGTGCCCCATTCACT (SEQ ID NO: 8887) |
| | AA | RASQGISNYLA (SEQ ID NO: 7456) | AASTLQS (SEQ ID NO: 8172) | QKYNSAPFT (SEQ ID NO: 8888) |
| 18179-C1 | NA | CGGGCGAGTCAGGGCATTAGCAATTAT TTAGCC (SEQ ID NO: 7457) | GCTGCATCCACTTTGCAATCA (SEQ ID NO: 8173) | CAAAAGTATAACAGTGCCCCATTCACT (SEQ ID NO: 8889) |
| | AA | RASQGISNYLA (SEQ ID NO: 7458) | AASTLQS (SEQ ID NO: 8174) | QKYNSAPFT (SEQ ID NO: 8890) |
| 18093-B11 | NA | GGGGGAAACAACATTGGAAGTAAAAGT GTGCAC (SEQ ID NO: 7459) | GATGATAGCGACCGGCCCTCA (SEQ ID NO: 8175) | CAGGTGTGGGATAGTAGTAGTGATCATC ATGTGGTA (SEQ ID NO: 8891) |
| | AA | GGNNIGSKSVH (SEQ ID NO: 7460) | DDSDRPS (SEQ ID NO: 8176) | QVWDSSSDHHVV (SEQ ID NO: 8892) |
| 18182-B5 | NA | GGGGGAAACAACATTGGAAGTAAAAGT GTGCAC (SEQ ID NO: 7461) | GATGATAACGACCGGCCCTCA (SEQ ID NO: 8177) | CAGGTGTGGGATAGTAGTAGTGATCATG TGGTA (SEQ ID NO: 8893) |
| | AA | GGNNIGSKSVH (SEQ ID NO: 7462) | DDNDRPS (SEQ ID NO: 8178) | QVWDSSSDHVV (SEQ ID NO: 8894) |
| 18182-H9 | NA | GGGGGAAACAACATTGGAAGTAAAAGT GTGCAC (SEQ ID NO: 7463) | GATGATAACGACCGGCCCTCA (SEQ ID NO: 8179) | CAGGTGTGGGATAGTAGTAGTGATCATG TGGTA (SEQ ID NO: 8895) |
| | AA | GGNNIGSKSVH (SEQ ID NO: 7464) | DDNDRPS (SEQ ID NO: 8180) | QVWDSSSDHVV (SEQ ID NO: 8896) |

TABLE 55-continued

| scFv VL CDRs | | | | |
|---|---|---|---|---|
| Ab | Type | CDR1 | CDR2 | CDR3 |
| 18182-E6 | NA | GGGGGAAACAACATTGGAAGTAAAAGT<br>GTGCAC<br>(SEQ ID NO: 7465) | GATGATAACGACCGGCCCTCA<br>(SEQ ID NO: 8181) | CAGGTGTGGGATAGCAGTAGTGATCATG<br>TGGTA<br>(SEQ ID NO: 8897) |
| | AA | GGNNIGSKSVH<br>(SEQ ID NO: 7466) | DDNDRPS<br>(SEQ ID NO: 8182) | QVWDSSSDHVV<br>(SEQ ID NO: 8898) |
| 18182-G6 | NA | GGGGGAAATAACATTGGAAGTAAAAGT<br>GTGCAC<br>(SEQ ID NO: 7467) | GATGATAACGACCGGCCCTCA<br>(SEQ ID NO: 8183) | CAGGTGTGGGATAGTAGTAGTGATCATG<br>TGGTA<br>(SEQ ID NO: 8899) |
| | AA | GGNNIGSKSVH<br>(SEQ ID NO: 7468) | DDNDRPS<br>(SEQ ID NO: 8184) | QVWDSSSDHVV<br>(SEQ ID NO: 8900) |
| 18182-G2 | NA | GGGGGAAACAACATTGGAAGTAAAAGT<br>GTGCAC<br>(SEQ ID NO: 7469) | GATGATAACGACCGGCCCTCA<br>(SEQ ID NO: 8185) | CAGGTGTGGGATAGTAGTAGTGATCATG<br>TGATA<br>(SEQ ID NO: 8901) |
| | AA | GGNNIGSKSVH<br>(SEQ ID NO: 7470) | DDNDRPS<br>(SEQ ID NO: 8186) | QVWDSSSDHVI<br>(SEQ ID NO: 8902) |
| 18182-H12 | NA | GGGGGAAACAACATTGGAAGTAAAAGT<br>GTGCAC<br>(SEQ ID NO: 7471) | GATGATAACGACCGGCCCTCA<br>(SEQ ID NO: 8187) | CAGGTGTGGGATAGCAGTAGTGATCATG<br>TGGTA<br>(SEQ ID NO: 8903) |
| | AA | GGNNIGSKSVH<br>(SEQ ID NO: 7472) | DDNDRPS<br>(SEQ ID NO: 8188) | QVWDSSSDHVV<br>(SEQ ID NO: 8904) |
| 18182-G8 | NA | GGGGGAAACAACATTGGAAGTAAAAGT<br>GTGCAC<br>(SEQ ID NO: 7473) | GATGATAACGACCGGCCCTCA<br>(SEQ ID NO: 8189) | CAGGTGTGGGATAGTAGTAGTGATCATG<br>TGGTA<br>(SEQ ID NO: 8905) |
| | AA | GGNNIGSKSVH<br>(SEQ ID NO: 7474) | DDNDRPS<br>(SEQ ID NO: 8190) | QVWDSSSDHVV<br>(SEQ ID NO: 8906) |
| 18182-E10 | NA | GGGGGAAACAACATTGGAAGTAAAAGT<br>GTGCAC<br>(SEQ ID NO: 7475) | GATGATAACGACCGGCCCTCA<br>(SEQ ID NO: 8191) | CAGGTGTGGGATAGTAGTAGTGATCATG<br>TGGTA<br>(SEQ ID NO: 8907) |
| | AA | GGNNIGSKSVH<br>(SEQ ID NO: 7476) | DDNDRPS<br>(SEQ ID NO: 8192) | QVWDSSSDHVV<br>(SEQ ID NO: 8908) |
| 18182-B12 | NA | GGGGGAAACAACATTGGAAGTAAAAGT<br>GTGCAC<br>(SEQ ID NO: 7477) | GATGATAACGACCGGCCCTCA<br>(SEQ ID NO: 8193) | CAGGTGTGGGATTATAGTAGTGATCATG<br>TGGTG<br>(SEQ ID NO: 8909) |
| | AA | GGNNIGSKSVH<br>(SEQ ID NO: 7478) | DDNDRPS<br>(SEQ ID NO: 8194) | QVWDYSSDHVV<br>(SEQ ID NO: 8910) |
| 18182-E5 | NA | GGGGGAAACAACATTGGAAGTAAAAGT<br>GTGCAC<br>(SEQ ID NO: 7479) | GATGATAACGACCGGCCCTCA<br>(SEQ ID NO: 8195) | CAGGTGTGGGATTATAGTAGTGATCATG<br>TGGTG<br>(SEQ ID NO: 8911) |
| | AA | GGNNIGSKSVH<br>(SEQ ID NO: 7480) | DDNDRPS<br>(SEQ ID NO: 8196) | QVWDYSSDHVV<br>(SEQ ID NO: 8912) |
| 18182-A4 | NA | GGGGGAAACAACATTGGAAGTAAAAGT<br>GTGCAC<br>(SEQ ID NO: 7481) | GATGATAACGACCGGCCCTCA<br>(SEQ ID NO: 8197) | CAGGTGTGGGATAGCAGTAGTGATCATG<br>TGGTA<br>(SEQ ID NO: 8913) |
| | AA | GGNNIGSKSVH<br>(SEQ ID NO: 7482) | DDNDRPS<br>(SEQ ID NO: 8198) | QVWDSSSDHVV<br>(SEQ ID NO: 8914) |
| 18182-E1 | NA | GGGGGAAACAACATTGGAAGTAAAAGT<br>GTGCAC<br>(SEQ ID NO: 7483) | GATGATAACGACCGGCCCTCA<br>(SEQ ID NO: 8199) | CAGGTGTGGGATAGTAGTAGTGATCATG<br>TGGTA<br>(SEQ ID NO: 8915) |
| | AA | GGNNIGSKSVH<br>(SEQ ID NO: 7484) | DDNDRPS<br>(SEQ ID NO: 8200) | QVWDSSSDHVV<br>(SEQ ID NO: 8916) |
| 18081-B9 | NA | AAGTCCAGCCAGAGTGTTTTATACAGC<br>TCCAACAATAAGAACTACTTAGCT<br>(SEQ ID NO: 7485) | TGGGCATCTACCCGGGAATCC<br>(SEQ ID NO: 8201) | CAGCAGTTTTATAGTACTCCGATCACC<br>(SEQ ID NO: 8917) |

TABLE 55-continued scFv VL CDRs

| Ab | Type | CDR1 | CDR2 | CDR3 |
|---|---|---|---|---|
| | AA | KSSQSVLYSSNNKNYLA<br>(SEQ ID NO: 7486) | WASTRES<br>(SEQ ID NO: 8202) | QQFYSTPIT<br>(SEQ ID NO: 8918) |
| 18081-E7 | NA | AAGTCCAGCCAGAGTGTTTTATACAGC<br>TCCAACAATAAAAACTACTTAGCT<br>(SEQ ID NO: 7487) | TGGGCATCTACCCGGGAATCC<br>(SEQ ID NO: 8203) | CAGCAATATTATAGTACTCCGCTCACT<br>(SEQ ID NO: 8919) |
| | AA | KSSQSVLYSSNNKNYLA<br>(SEQ ID NO: 7488) | WASTRES<br>(SEQ ID NO: 8204) | QQYYSTPLT<br>(SEQ ID NO: 8920) |
| 18089-D11 | NZ | CGGGCAAGTCAGAGCATTAGCAACTAT<br>TTCAAT<br>(SEQ ID NO: 7489) | GCTGCATCCAGTTTGCAAAGT<br>(SEQ ID NO: 8205) | CAACAGAGTTACATTACCCCGTTCACT<br>(SEQ ID NO: 8921) |
| | AA | RASQSISNYEN<br>(SEQ ID NO: 7490) | AASSLQS<br>(SEQ ID NO: 8206) | QQSYITPFT<br>(SEQ ID NO: 8922) |
| 18089-C9 | NA | CGGGCAAGTCAGTTTATTAGCAGCTAT<br>TTAAAT<br>(SEQ ID NO: 7491) | GCTGCATCCAGTTTGCAAAGT<br>(SEQ ID NO: 8207) | CAACAGAGTTACAGTACCCCTTTCACT<br>(SEQ ID NO: 8923) |
| | AA | RASQFISSYLN<br>(SEQ ID NO: 7492) | AASSLQS<br>(SEQ ID NO: 8208) | QQSYSTPFT<br>(SEQ ID NO: 8924) |
| 18089-D8 | NA | CGGGCAAGTCAGAGCATTAGCAGCTAT<br>TTAAAT<br>(SEQ ID NO: 7493) | GCTGCATCCAGTTTGCAAAGT<br>(SEQ ID NO: 8209) | CAACAGAGTTACAGTACCCCGATCACC<br>(SEQ ID NO: 8925) |
| | AA | RASQSISSYLN<br>(SEQ ID NO: 7494) | AASSLQS<br>(SEQ ID NO: 8210) | QQSYSTPIT<br>(SEQ ID NO: 8926) |
| 18081-F9 | NA | CGGGCAAGTCAGAGCATTAGCAGCTAT<br>TTAAAT<br>(SEQ ID NO: 7495) | GCTGCATCCAGTTTGCAAAGT<br>(SEQ ID NO: 8211) | CAACAGAGTTACAGTACCCCATTCACT<br>(SEQ ID NO: 8927) |
| | AA | RASQSISSYLN<br>(SEQ ID NO: 7496) | AASSLQS<br>(SEQ ID NO: 8212) | QQSYSTPFT<br>(SEQ ID NO: 8928) |
| 18081-H11 | NA | CAGGCGAGTCAGGACATTAGCAACTAT<br>TTAAAT<br>(SEQ ID NO: 7497) | GCTGCATCCAGTTTGCAAAGT<br>(SEQ ID NO: 8213) | CAACAGAGTTACACTACCCCATTCACT<br>(SEQ ID NO: 8929) |
| | AA | QASQDISNYLN<br>(SEQ ID NO: 7498) | AASSLQS<br>(SEQ ID NO: 8214) | QQSYTTPFT<br>(SEQ ID NO: 8930) |
| 18081-B6 | NA | CGGGCAAGTCAGAGCATTAGCAGCTAT<br>TTAAAT<br>(SEQ ID NO: 7499) | GCTGCATCCAGTTTGCAAAGT<br>(SEQ ID NO: 8215) | CAACAGAGTTACAGTACCCCATTCACT<br>(SEQ ID NO: 8931) |
| | AA | RASQSISSYLN<br>(SEQ ID NO: 7500) | AASSLQS<br>(SEQ ID NO: 8216) | QQSYSTPFT<br>(SEQ ID NO: 8932) |
| 18089-B2 | NA | CAGGCGAGTCAGGACATTAGCAACTAT<br>TTAAAT<br>(SEQ ID NO: 7501) | GCTGCATCCAGTTTGCAAAGT<br>(SEQ ID NO: 8217) | CAACAGAGTTACAGTATTCCGCTCACT<br>(SEQ ID NO: 8933) |
| | AA | QASQDISNYLN<br>(SEQ ID NO: 7502) | AASSLQS<br>(SEQ ID NO: 8218) | QQSYSIPLT<br>(SEQ ID NO: 8934) |
| 18179-E1 | NA | CGGACAAGTCAGAGCATTAGCAGCTAT<br>TTAAAT<br>(SEQ ID NO: 7503) | GCTGCATCCAGTTTGCAAGGT<br>(SEQ ID NO: 8219) | CAACAGACTTACAGTATGCCATTCACT<br>(SEQ ID NO: 8935) |
| | AA | RTSQSISSYLN<br>(SEQ ID NO: 7504) | AASSLQG<br>(SEQ ID NO: 8220) | QQTYSMPFT<br>(SEQ ID NO: 8936) |
| 18179-H7 | NA | CGGACAAGTCAGAGCATTAGCAGCTAT<br>TTAAAT<br>(SEQ ID NO: 7505) | GCTGCATCCAGTTTGCAAAGT<br>(SEQ ID NO: 8221) | CAACAGAGTTACAGTAGTCCATTCACT<br>(SEQ ID NO: 8937) |
| | AA | RTSQSISSYLN<br>(SEQ ID NO: 7506) | AASSLQS<br>(SEQ ID NO: 8222) | QQSYSSPFT<br>(SEQ ID NO: 8938) |
| 18179-B12 | NA | CGGACAAGTCAGAGCATTAGCAGCTAT<br>TTAAAT<br>(SEQ ID NO: 7507) | GCTGCATCCAGTTTGCAAAGT<br>(SEQ ID NO: 8223) | CAACAGACTTACAGTATGCCATTCACT<br>(SEQ ID NO: 8939) |

TABLE 55-continued scFv VL CDRs

| Ab | Type | CDR1 | CDR2 | CDR3 |
|---|---|---|---|---|
| | AA | RTSQSISSYLN<br>(SEQ ID NO: 7508) | AASSLQS<br>(SEQ ID NO: 8224) | QQTYSMPFT<br>(SEQ ID NO: 8940) |
| 18179-D11 | NA | CGGACAAGTCAGAGCATTAGCAGCTAT<br>TTAAAT<br>(SEQ ID NO: 7509) | GCTGCATCCAGTTTGCAAGGT<br>(SEQ ID NO: 8225) | CAACAGACTTACAGTATGCCATTCACT<br>(SEQ ID NO: 8941) |
| | AA | RTSQSISSYLN<br>(SEQ ID NO: 7510) | AASSLQG<br>(SEQ ID NO: 8226) | QQTYSMPFT<br>(SEQ ID NO: 8942) |
| 18179-D7 | NA | CGGACAAGTCAGAGCATTAGCAGCTAT<br>TTAAAT<br>(SEQ ID NO: 7511) | GCTGCATCCAGTTTGCAAGGT<br>(SEQ ID NO: 8227) | CAACAGACTTACAGTATGCCATTCACT<br>(SEQ ID NO: 8943) |
| | AA | RTSQSISSYLN<br>(SEQ ID NO: 7512) | AASSLQG<br>(SEQ ID NO: 8228) | QQTYSMPFT<br>(SEQ ID NO: 8944) |
| 18179-A7 | NA | CGGACAAGTCAGAGCATTAGCAGCTAT<br>TTAAAT<br>(SEQ ID NO: 7513) | GCTGCATCCAGTTTGCAAGGT<br>(SEQ ID NO: 8229) | CAACAGACTTACAGTATGCCATTCACT<br>(SEQ ID NO: 8945) |
| | AA | RTSQSISSYLN<br>(SEQ ID NO: 7514) | AASSLQG<br>(SEQ ID NO: 8230) | QQTYSMPFT<br>(SEQ ID NO: 8946) |
| 18181-H7 | NA | AGGTCTAGTCAGAGCCTCCTGCATAGA<br>AATGGATACAACTATTTGGAT<br>(SEQ ID NO: 7515) | TTGGGTTCTAATCGGGCCTCC<br>(SEQ ID NO: 8231) | ATGCAAGCTCTACAAACTCCGTGGACG<br>(SEQ ID NO: 8947) |
| | AA | RSSQSLLHRNGYNYLD<br>(SEQ ID NO: 7516) | LGSNRAS<br>(SEQ ID NO: 8232) | MQALQTPWT<br>(SEQ ID NO: 8948) |
| 18181-G10 | NA | AGGTCTAGTCAGAGCCTCCTGCATAGT<br>ACTGGATACAACTATGTGGAT<br>(SEQ ID NO: 7517) | TTGGGTTCTAATCGGGCCTCC<br>(SEQ ID NO: 8233) | ATGCAAGCTCTACAAACTCCTCGGACG<br>(SEQ ID NO: 8949) |
| | AA | RSSQSLLHSTGYNYVD<br>(SEQ ID NO: 7518) | LGSNRAS<br>(SEQ ID NO: 8234) | MQALQTPRT<br>(SEQ ID NO: 8950) |
| 18181-G8 | NA | CGGACAAGTCAGAGCATTAGCAGCTAT<br>TTAAAT<br>(SEQ ID NO: 7519) | GCTGCATCCAGTTTGCAAAGT<br>(SEQ ID NO: 8235) | CAACAGACTTACAGTATGCCATTCACT<br>(SEQ ID NO: 8951) |
| | AA | RTSQSISSYLN<br>(SEQ ID NO: 7520) | AASSLQS<br>(SEQ ID NO: 8236) | QQTYSMPFT<br>(SEQ ID NO: 8952) |
| 18181-F3 | NA | CGGACAAGTCAGAGCATTAGCAGCTAT<br>TTAAAT<br>(SEQ ID NO: 7521) | GCTGCATCCAGTTTGCAAGGT<br>(SEQ ID NO: 8237) | CAACAGAGTTACAGTAGTCCATTCACT<br>(SEQ ID NO: 8953) |
| | AA | RTSQSISSYLN<br>(SEQ ID NO: 7522) | AASSLQG<br>(SEQ ID NO: 8238) | QQSYSSPFT<br>(SEQ ID NO: 8954) |
| 18181-F1 | NA | CGGACAAGTCAGAGCATTAGCAGCTAT<br>TTAAAT<br>(SEQ ID NO: 7523) | GCTGCATCCAGTTTGCAAGGT<br>(SEQ ID NO: 8239) | CAACAGACTTACAGTAGTCCATTCACT<br>(SEQ ID NO: 8955) |
| | AA | RTSQSISSYLN<br>(SEQ ID NO: 7524) | AASSLQG<br>(SEQ ID NO: 8240) | QQTYSSPFT<br>(SEQ ID NO: 8956) |
| 18181-E2 | NA | AGGTCTAGTCAGAGCCTCCTGCATAGT<br>AGTGGATACAACTATTTGGAT<br>(SEQ ID NO: 7525) | TTGGGTTCTAATCGGGCCTCC<br>(SEQ ID NO: 8241) | ATGCAGGCTCTACAAACTCCTCGGACG<br>(SEQ ID NO: 8957) |
| | AA | RSSQSLLHSSGYNYLD<br>(SEQ ID NO: 7526) | LGSNRAS<br>(SEQ ID NO: 8242) | MQALQTPRT<br>(SEQ ID NO: 8958) |
| 18181-C9 | NA | AGGTCTAGTCAGAGCCTCCTGCACAAA<br>TGGATACATGGAT<br>(SEQ ID NO: 7527) | TTGGGTTCTAATCGGGCCTCC<br>(SEQ ID NO: 8243) | ATGCAAGGTCTACAAACTCCATTCACT<br>(SEQ ID NO: 8959) |
| | AA | RSSQSLLHRNGYNYLD<br>(SEQ ID NO: 7528) | LGSNRAS<br>(SEQ ID NO: 8244) | MQGLQTPFT<br>(SEQ ID NO: 8960) |

TABLE 55-continued scFv VL CDRs

| Ab | Type | CDR1 | CDR2 | CDR3 |
|---|---|---|---|---|
| 18181-B8 | NA | AGGTCTAGTCAGAGCCTCCTGCATAGA<br>AATGGATACAATTATTTGGAT<br>(SEQ ID NO: 7529) | TTGGGTTCTAATCGGGCCTCC<br>(SEQ ID NO: 8245) | ATGCAAGCTCTACAAACTCCCAGT<br>(SEQ ID NO: 8961) |
|  | AA | RSSQSLLHRNGYNYLD<br>(SEQ ID NO: 7530) | LGSNRAS<br>(SEQ ID NO: 8246) | MQALQTPS<br>(SEQ ID NO: 8962) |
| 18181-A6 | NA | CGGGCAAGTCAGAGCATTAGCAGCTAT<br>TTAAAT<br>(SEQ ID NO: 7531) | GCTGCATCCAGTTTGCAAGGT<br>(SEQ ID NO: 8247) | CAACAGACTTACAGTATGCCATTCACT<br>(SEQ ID NO: 8963) |
|  | AA | RASQSISSYLN<br>(SEQ ID NO: 7532) | AASSLQG<br>(SEQ ID NO: 8248) | QQTYSMPFT<br>(SEQ ID NO: 8964) |
| 18403-F12-AS | NA<br>AA | No nuc. seq available<br>GGNNIGSKSVH<br>(SEQ ID NO: 7533) | No nuc. seq available<br>DDNDRPS<br>(SEQ ID NO: 8249) | No nuc. seq available<br>QVWDYRYLSQV<br>(SEQ ID NO: 8965) |
| 18403-G10-AS | NA<br>AZ | No nuc. seq available<br>GGNNIGSKSVH<br>(SEQ ID NO: 7534) | No nuc. seq available<br>DDNDRPS<br>(SEQ ID NO: 8250) | No nuc. seq available<br>QVWDYSGQRQV<br>(SEQ ID NO: 8966) |
| 02-C1-86-A4-N-F5_final | NA<br>AA | No nuc. seq available<br>RASQGISNYLA<br>(SEQ ID NO: 7535) | No nuc. seq available<br>AASTLQS<br>(SEQ ID NO: 8251) | No nuc. seq available<br>QKYNSAPFT<br>(SEQ ID NO: 8967) |
| 03-F3-88-B3-F9_final | NA<br>AA | No nuc. seq available<br>GGNNIGSKSVH<br>(SEQ ID NO: 7536) | No nuc. seq available<br>DDADRPS<br>(SEQ ID NO: 8252) | No nuc. seq available<br>QVWDASAGYGVV<br>(SEQ ID NO: 8968) |
| 81-H7-SG-F28_final | NA<br>AA | No nuc. seq available<br>RSSQSLLHRSGYNYLD<br>(SEQ ID NO: 7537) | No nuc. seq available<br>LGSNRAS<br>(SEQ ID NO: 8253) | No nuc. seq available<br>MQALQTPWT<br>(SEQ ID NO: 8969) |
| 18081-B9_final | NA<br>AA | No nuc. seq available<br>KSSQSVLYSSNNKNYLA<br>(SEQ ID NO: 7538) | No nuc. seq available<br>WASTRES<br>(SEQ ID NO: 8254) | No nuc. seq available<br>QQFYSTPIT<br>(SEQ ID NO: 8970) |
| 18398-C7_final | NA<br>AA | No nuc. seq available<br>GGNNIGSKSVH<br>(SEQ ID NO: 7539) | No nuc. seq available<br>DDNDRPS<br>(SEQ ID NO: 8255) | No nuc. seq available<br>QVWDYSPLRHV<br>(SEQ ID NO: 8971) |
| 18403-D8_final | NA<br>AA | No nuc. seq available<br>GGNNIGSKSVH<br>(SEQ ID NO: 7540) | No nuc. seq available<br>DDNDRPS<br>(SEQ ID NO: 8256) | No nuc. seq available<br>QVWDYRTLDWV<br>(SEQ ID NO: 8972) |
| 18403-D8_AS_final | NA<br>AA | No nuc. seq available<br>GGNNIGSKSVH<br>(SEQ ID NO: 7541) | No nuc. seq available<br>DDNDRPS<br>(SEQ ID NO: 8257) | No nuc. seq available<br>QVWDYRTLDWV<br>(SEQ ID NO: 8973) |
| 18403-E11_AS_final | NA<br>AA | No nuc. seq available<br>GGNNIGSKSVH<br>(SEQ ID NO: 7542) | No nuc. seq available<br>DDNDRPS<br>(SEQ ID NO: 8258) | No nuc. seq available<br>QVWDYYSNRAV<br>(SEQ ID NO: 8974) |
| 18403-F12_final | NA<br>AA | No nuc. seq available<br>GGNNIGSKSVH<br>(SEQ ID NO: 7543) | No nuc. seq available<br>DDNDRPS<br>(SEQ ID NO: 8259) | No nuc. seq available<br>QVWDYRYLSQV<br>(SEQ ID NO: 8975) |
| 18403-F12-AS_final | NA<br>AA | No nuc. seq available<br>GGNNIGSKSVH<br>(SEQ ID NO: 7544) | No nuc. seq available<br>DDNDRPS<br>(SEQ ID NO: 8260) | No nuc. seq available<br>QVWDYRYLSQV<br>(SEQ ID NO: 8976) |
| 18403-G10_final | NA<br>AA | No nuc. seq available<br>GGNNIGSKSVH<br>(SEQ ID NO: 7545) | No nuc. seq available<br>DDNDRPS<br>(SEQ ID NO: 8261) | No nuc. seq available<br>QVWDYSGQRQV<br>(SEQ ID NO: 8977) |
| 18403-G10-AS_final | NA<br>AA | No nuc. seq available<br>GGNNIGSKSVH<br>(SEQ ID NO: 7546) | No nuc. seq available<br>DDNDRPS<br>(SEQ ID NO: 8262) | No nuc. seq available<br>QVWDYSGQRQV<br>(SEQ ID NO: 8978) |
| 18409-E2_final | NA<br>AZ | No nuc. seq available<br>RTSQSISSYLN<br>(SEQ ID NO: 7547) | No nuc. seq available<br>AASSLQG<br>(SEQ ID NO: 8263) | No nuc. seq available<br>QQSYSSPFT<br>(SEQ ID NO: 8979) |

TABLE 55-continued scFv VL CDRs

| Ab | Type | CDR1 | CDR2 | CDR3 |
|---|---|---|---|---|
| 18409-F12_final | NA<br>AA | No nuc. seq available<br>QASQDISNYLN<br>(SEQ ID NO: 7548) | No nuc. seq available<br>AASSLQS<br>(SEQ ID NO: 8264) | No nuc. seq available<br>QQSYYYPTL<br>(SEQ ID NO: 8980) |
| 18409-G10_final | NA<br>AA | No nuc. seq available<br>QASQDISNYEN<br>(SEQ ID NO: 7549) | No nuc. seq available<br>AASSLQS<br>(SEQ ID NO: 8265) | No nuc. seq available<br>QQSYITPFT<br>(SEQ ID NO: 8981) |
| 18409-H7_final | NA<br>AA | No nuc. seq available<br>QASQDISNYLN<br>(SEQ ID NO: 7550) | No nuc. seq available<br>AASSLQS<br>(SEQ ID NO: 8266) | No nuc. seq available<br>QQSYFPVVE<br>(SEQ ID NO: 8982) |
| 18409-H10_final | NA<br>AA | No nuc. seq available<br>QASQDISNYLN<br>(SEQ ID NO: 7551) | No nuc. seq available<br>AASSLQS<br>(SEQ ID NO: 8267) | No nuc. seq available<br>QQSYTPPTT<br>(SEQ ID NO: 8983) |
| 18410-B5_final | NA<br>AA | No nuc. seq available<br>RTSQSISSYLN<br>(SEQ ID NO: 7552) | No nuc. seq available<br>AASSLQG<br>(SEQ ID NO: 8268) | No nuc. seq available<br>QQTYSMPFT<br>(SEQ ID NO: 8984) |
| 18410-B6_final | NA<br>AA | No nuc. seq available<br>RTSQSISSYLN<br>(SEQ ID NO: 7553) | No nuc. seq available<br>AASSLQG<br>(SEQ ID NO: 8269) | No nuc. seq available<br>IQAYTSPFT<br>(SEQ ID NO: 8985) |
| 18410-D3_final | NA<br>AA | No nuc. seq available<br>RTSQSISSYLN<br>(SEQ ID NO: 7554) | No nuc. seq available<br>AASSLQG<br>(SEQ ID NO: 8270) | No nuc. seq available<br>QQTYSMPFT<br>(SEQ ID NO: 8986) |
| 18410-D6_final | NA<br>AA | No nuc. seq available<br>(SEQ ID NO: 7555)<br>RTSQSISSYLN | No nuc. seq available<br>AASSLQG<br>(SEQ ID NO: 8271) | No nuc. seq available<br>QQTYSMPFT<br>(SEQ ID NO: 8987) |
| 18410-G10_final | NA<br>AA | No nuc. seq available<br>GGNNIGSKSVH<br>(SEQ ID NO: 7556) | No nuc. seq available<br>DDNDRPS<br>(SEQ ID NO: 8272) | No nuc. seq available<br>QVWDYVAPRHV<br>(SEQ ID NO: 8988) |
| 18410-G10_AS_final | NA<br>AA | No nuc. seq available<br>GGNNIGSKSVH<br>(SEQ ID NO: 7557) | No nuc. seq available<br>DDNDRPS<br>(SEQ ID NO: 8273) | No nuc. seq available<br>QVWDYVAPRHV<br>(SEQ ID NO: 8989) |
| 18410-H1_final | NA<br>AA | No nuc. seq available<br>RTSQSISSYLN<br>(SEQ ID NO: 7558) | No nuc. seq available<br>AASSLQS<br>(SEQ ID NO: 8274) | No nuc. seq available<br>QQTYSMPFT<br>(SEQ ID NO: 8990) |
| 18410-H3_final | NA<br>AA | No nuc. seq available<br>RTSQSISSYLN<br>(SEQ ID NO: 7559) | No nuc. seq available<br>AASSLQG<br>(SEQ ID NO: 8275) | No nuc. seq available<br>QQTYSSPET<br>(SEQ ID NO: 8991) |
| 18486-A4_final | NA<br>AA | No nuc. seq available<br>RASQGISNYLA<br>(SEQ ID NO: 7560) | No nuc. seq available<br>AASTLQS<br>(SEQ ID NO: 8276) | No nuc. seq available<br>QKYNSAPFT<br>(SEQ ID NO: 8992) |

TABLE 56 scFv VH CDRs

| Ab | Type | CDR1 | CDR2 | CDR3 |
|---|---|---|---|---|
| 17724-C9 | NA<br>AA | AAGTCCTGGATGAAC<br>(SEQ ID NO: 7561)<br>KSWMN<br>(SEQ ID NO: 7562) | CGGATTTATCCTGGAGATGGAGATACT<br>AACTACAATGGGAAGTTCAAGGGC<br>(SEQ ID NO: 8277)<br>RIYPGDGDTNYNGKFKG<br>(SEQ ID NO: 8278) | GATGGAGTCTTCTATGCCCCTCTTGCTTAC<br>(SEQ ID NO: 8993)<br>DGVFYAPLAY<br>(SEQ ID NO: 8994) |
| 17724-G6 | NA<br>AA | AAGTCCTGGATGAAC<br>(SEQ ID NO: 7563)<br>KSWMN<br>(SEQ ID NO: 7564) | CGTGTTTGGCCTGGAGATGGAGATACT<br>ACGTACAATGAGAAGTTCAAGGGC<br>(SEQ ID NO: 8279)<br>RVWPGDGDTTYNEKFKG<br>(SEQ ID NO: 8280) | GGCAATTACTTCGGTAGTAGCGAGGCCTAC<br>TTTGACTAC<br>(SEQ ID NO: 8995)<br>GNYFGSSEAYFDY<br>(SEQ ID NO: 8996) |

TABLE 56-continued scFv VH CDRs

| Ab | Type | CDR1 | CDR2 | CDR3 |
|---|---|---|---|---|
| 17731-H8 | NA | AGCTCCTGGATGAAC (SEQ ID NO: 7565) | CGGATTTATCCTGGAGATGGAGATACT AACTACAATGGGAAGTTCAAGGAC (SEQ ID NO: 8281) | CGACAACTTAACCACGTCTTTGCTATGGAC TAC (SEQ ID NO: 8997) |
|  | AA | SSWMN (SEQ ID NO: 7566) | RIYPGDGDTNYNGKFKD (SEQ ID NO: 8282) | RQLNHVFAMDY (SEQ ID NO: 8998) |
| 17732-A8 | NA | AGTTATGATATCAAC (SEQ ID NO: 7567) | TGGATGAACCCTAACAGTGGTAACACA GGCTATGCACAGAAGTTCCAGGGC (SEQ ID NO: 8283) | GGGGGTGGATACAGCAATGGTTACGACTAC GGTATGGACGTC (SEQ ID NO: 8999) |
|  | AA | SYDIN (SEQ ID NO: 7568) | WMNPNSGNTGYAQKFQG (SEQ ID NO: 8284) | GGGYSNGYDYGMDV (SEQ ID NO: 9000) |
| 17745-E5 | NA | AGTTATGATATCAAC (SEQ ID NO: 7569) | TGGATGAACCCTAACAGTGGTAACACA GGCTATGCACAGAAGTTCCAGGGC (SEQ ID NO: 8285) | GGGGGTGGATACAGCTATGGTTACGACTAC GGTATGGACGTC (SEQ ID NO: 9001) |
|  | AA | SYDIN (SEQ ID NO: 7570) | WMNPNSGNTGYAQKFQG (SEQ ID NO: 8286) | GGGYSYGYDYGMDV (SEQ ID NO: 9002) |
| 17745-E8 | NA | GGTTACTACTGGAAC (SEQ ID NO: 7571) | GAAATCAGTCATAGTGGAAGCACCAAC TACAACCCGTCCCTCAAGAGT (SEQ ID NO: 8287) | GGCGGTGGATACAGTCATGGTTATGACTAC GGTATGGACGTC (SEQ ID NO: 9003) |
|  | AA | GYYWN (SEQ ID NO: 7572) | EISHSGSTNYNPSLKS (SEQ ID NO: 8288) | GGGYSHGYDYGMDV (SEQ ID NO: 9004) |
| 17745-G8 | NA | AGCTATGCCATGAGC (SEQ ID NO: 7573) | GCTATTAGTGGTAGTGGTGATATCACA TACTACGCAGACTCCGTGAAGGGC (SEQ ID NO: 8289) | CACCTACGATATTTTGACTGGCCCCTTGAC TAC (SEQ ID NO: 9005) |
|  | AA | SYAMS (SEQ ID NO: 7574) | AISGSGDITYYADSVKG (SEQ ID NO: 8290) | HLRYFDWPLDY (SEQ ID NO: 9006) |
| 17748-D12 | NA | AGCTATCGCATGCAC (SEQ ID NO: 7575) | GTTATATCATATGATGGAGGTAATAAA TACTATGCAGACTCCGTGAAGGGC (SEQ ID NO: 8291) | GAGCAGTGGCCCAACTACTACTACGGTATG GACGTC (SEQ ID NO: 9007) |
|  | AA | SYRMH (SEQ ID NO: 7576) | VISYDGGNKYYADSVKG (SEQ ID NO: 8292) | EQWPNYYYGMDV (SEQ ID NO: 9008) |
| 17753-F4 | NA | GGTTACTACTGGAAC (SEQ ID NO: 7577) | GAAATCAATCATAGTGGAAGCACCAAC TACAACCCGTCCCTCAAGAGT (SEQ ID NO: 8293) | GGCGGTGGATACAGCTATGGTTACGACTAC GGTATGGACGTC (SEQ ID NO: 9009) |
|  | AA | GYYWN (SEQ ID NO: 7578) | EINHSGSTNYNPSLKS (SEQ ID NO: 8294) | GGGYSYGYDYGMDV (SEQ ID NO: 9010) |
| 17771-D2 | NA | TCCTATGCCATGAGC (SEQ ID NO: 7579) | ACTATTAGTGGTAGTGGTGGTAGCACAG ACTACGCAGACTCCGTGAAGGGC (SEQ ID NO: 8295) | GATGGGGGCAGTGGCTGGTTCCCTAAACTA CTACACTACGGTCTGGACGTC (SEQ ID NO: 9011) |
|  | AA | SYAMS (SEQ ID NO: 7580) | TISGSGGSTDYADSVKG (SEQ ID NO: 8296) | DGGSGWFPKLLHYGLDV (SEQ ID NO: 9012) |
| 17777-B4 | NA | GGTTATGATATCAAC (SEQ ID NO: 7581) | TGGATGAACCCTAACCGTGGCACCACA GGCTATGCACAGAAGTTCCAGGGC (SEQ ID NO: 8297) | GGGGGTGGCTACAGTTATGGTTACGACTAT GGTATGGACGTC (SEQ ID NO: 9013) |
|  | AA | GYDIN (SEQ ID NO: 7582) | WMNPNRGTTGYAQKFQG (SEQ ID NO: 8298) | GGGYSYGYDYGMDV (SEQ ID NO: 9014) |
| 17777-C4 | NA | AGCTATGCCATGAGC (SEQ ID NO: 7583) | GCTATTAGTGGTAGTGGTGATTACACA TACTACGCAGACTCCGTGAAGGGC (SEQ ID NO: 8299) | CACCTACGATATTCTGACTGGCCCCTTGAC TAC (SEQ ID NO: 9015) |
|  | AA | SYAMS (SEQ ID NO: 7584) | AISGSGDYTYYADSVKG (SEQ ID NO: 8300) | HLRYSDWPLDY (SEQ ID NO: 9016) |
| 17777-C5 | NA | GGTTACTACTGGACC (SEQ ID NO: 7585) | GAAATCAATCACAGTGGAAGAACCAAC TACAATCCGTCCCTCAAGAGT (SEQ ID NO: 8301) | GGCGGTGGATACAGCGATGGTTACGACTAC GGTATGGACGTC (SEQ ID NO: 9017) |
|  | AA | GYYWT (SEQ ID NO: 7586) | EINHSGRTNYNPSLKS (SEQ ID NO: 8302) | GGGYSDGYDYGMDV (SEQ ID NO: 9018) |
| 17778-C9 | NA | GGTTACTACTGGAAC (SEQ ID NO: 7587) | GAAATCAATCATCGTGGAAGCACCAAC TACAACCCGTCCCTCAAGAGT (SEQ ID NO: 8303) | GGCGGTGGATACAGCGATGGTTACGACTAC GGTATGGACGTC (SEQ ID NO: 9019) |
|  | AA | GYYWN (SEQ ID NO: 7588) | EINHRGSTNYNPSLKS (SEQ ID NO: 8304) | GGGYSDGYDYGMDV (SEQ ID NO: 9020) |
| 17778-F1 | NA | GGTTACTACTGGAAC (SEQ ID NO: 7589) | GAAATCAATCATAGTGGAAGCACCAAC TACAACCCGTCCCTCAAGAGT (SEQ ID NO: 8305) | GGCGGTGGATACAGCTATGGTTACGACTAC GGTATGGACGTC (SEQ ID NO: 9021) |

TABLE 56-continued scFv VH CDRs

| Ab | Type | CDR1 | CDR2 | CDR3 |
|---|---|---|---|---|
| | AA | GYYWN (SEQ ID NO: 7590) | EINHSGSTNYNPSLKS (SEQ ID NO: 8306) | GGGYSYGYDYGMDV (SEQ ID NO: 9022) |
| 17778-H8 | NA | GGTTACTACTGGAGC (SEQ ID NO: 7591) | GAAATCAATCATCGTGGAAGCACCAAC TACAACCCGTCCCTCAAGAGT (SEQ ID NO: 8307) | GGCGGTGGATACAGCTATGGTTACGACTAC GGTATGGACGTC (SEQ ID NO: 9023) |
| | AA | GYYWS (SEQ ID NO: 7592) | EINHRGSTNYNPSLKS (SEQ ID NO: 8308) | GGGYSYGYDYGMDV (SEQ ID NO: 9024) |
| 17779-D11 | NA | AGCTATGGCATGAGC (SEQ ID NO: 7593) | GCTATTAGTGGTAGTGGTGGTAGCACA TACTACGCAGACTCCGCGAAGGGC (SEQ ID NO: 8309) | CTGGTAACTCCGGACTACTACTACGGTATG GACGTC (SEQ ID NO: 9025) |
| | AA | SYGMS (SEQ ID NO: 7594) | AISGSGGSTYYADSAKG (SEQ ID NO: 8310) | LVTPDYYYGMDV (SEQ ID NO: 9026) |
| 17779-E1 | NA | GGTTACTACTGGAGC (SEQ ID NO: 7595) | GAAATCAATCATAGTGGAAGCACCAAC TACAACCCGTCCCAAGAGT (SEQ ID NO: 8311) | GGCGGTGGATACAGCTATGGTTACGACTAC GGTATGGACGTC (SEQ ID NO: 9027) |
| | AA | GYYWS (SEQ ID NO: 7596) | EINHSGSTNYNPSLKS (SEQ ID NO: 8312) | GGGYSYGYDYGMDV (SEQ ID NO: 9028) |
| 17780-D12 | NA | AGTTATGATATCAAC (SEQ ID NO: 7597) | TGGATGAACCCTAACAGTGGTAACACA GGCTATGCACAGAAGTTCCAGGGC (SEQ ID NO: 8313) | GGGGGTGGATACAGCAATGGTTACGACTAC GGTATGGACGTC (SEQ ID NO: 9029) |
| | AA | SYDIN (SEQ ID NO: 7598) | WMNPNSGNTGYAQKFQG (SEQ ID NO: 8314) | GGGYSNGYDYGMDV (SEQ ID NO: 9030) |
| 17780-E6 | NA | GGTTACTACTGGAAC (SEQ ID NO: 7599) | GAAATCAATCATAGTGGAAGCACCACC TACAACCCGTCCCTCAAGAGT (SEQ ID NO: 8315) | GGCGGTGGATACAGCATGGTTACGACTAC GGTATGGACGTC (SEQ ID NO: 9031) |
| | AA | GYYWN (SEQ ID NO: 7600) | EINHSGSTTYNPSLKS (SEQ ID NO: 8316) | GGGYSHGYDYGMDV (SEQ ID NO: 9032) |
| 17781-B3 | NA | GGTTTCTACTGGAAC (SEQ ID NO: 7601) | GAAATCAATCATCGTGGAAGCACCAAC TACAACCCGTCCCTCAAGAGT (SEQ ID NO: 8317) | GGCGGTGGATACAGCGATGGTTACGACTAC GGTATGGACGTC (SEQ ID NO: 9033) |
| | AA | GFYWN (SEQ ID NO: 7602) | EINHRGSTNYNPSLKS (SEQ ID NO: 8318) | GGGYSDGYDYGMDV (SEQ ID NO: 9034) |
| 17781-H12 | NA | GGTTACTACTGGAAC (SEQ ID NO: 7603) | GAAATCAGTCATAGTGGAAGCACCAAC TACAACCCGTCCCTCAAGAGT (SEQ ID NO: 8319) | GGCGGTGGATACAGTCATGGTTATGACTAC GGTATGGACGTC (SEQ ID NO: 9035) |
| | AA | GYYWN (SEQ ID NO: 7604) | EISHSGSTNYNPSLKS (SEQ ID NO: 8320) | GGGYSHGYDYGMDV (SEQ ID NO: 9036) |
| 17783-C11 | NA | GGTTACTACTGGAGC (SEQ ID NO: 7605) | GAAATCAATCATAGTGGAAGCACCAAC TACAACCCGTCCCTCAAGAGT (SEQ ID NO: 8321) | GGCGGTGGATACAGCGATGGTTACGACTAC GGTATGGACGTC (SEQ ID NO: 9037) |
| | AA | GYYWS (SEQ ID NO: 7606) | EINHSGSTNYNPSLKS (SEQ ID NO: 8322) | GGGYSDGYDYGMDV (SEQ ID NO: 9038) |
| 17783-G10 | NA | GGTTACTACTGGAGC (SEQ ID NO: 7607) | GAAATCACTCATAGTGGAAGCACCAAC TACAACCCGTCCCTCAAGAGT (SEQ ID NO: 8323) | GGCGGTGGATACAGCGATGGTTACGACTAC GGTATGGACGTC (SEQ ID NO: 9039) |
| | AA | GYYWS (SEQ ID NO: 7608) | EITHSGSTNYNPSLKS (SEQ ID NO: 8324) | GGGYSDGYDYGMDV (SEQ ID NO: 9040) |
| 17784-B9 | NA | AGCTATGCCATGAGC (SEQ ID NO: 7609) | GCTATTAGTGGTAGTGGTGGTAGCACA TACTACGCAGACTCCGTGAAGGGC (SEQ ID NO: 8325) | GTGATGACTCCGGACTACTACTACGATATG GACGTC (SEQ ID NO: 9041) |
| | AA | SYAMS (SEQ ID NO: 7610) | AISGSGGSTYYADSVKG (SEQ ID NO: 8326) | VMTPDYYYDMDV (SEQ ID NO: 9042) |
| 17784-C7 | NA | AGCTATGGCATGAGC (SEQ ID NO: 7611) | GCTATTAGTGGTAGTGGTGGTAGCACA TACTACGCAGACTCCGTGAAGGGC (SEQ ID NO: 8327) | GTGATGACTCCGGACTACTACTACGATATG GACGTC (SEQ ID NO: 9043) |
| | AA | SYGMS (SEQ ID NO: 7612) | AISGSGGSTYYADSVKG (SEQ ID NO: 8328) | VMTPDYYYDMDV (SEQ ID NO: 9044) |
| 17784-C11 | NA | GGTTACTACTGGAGC (SEQ ID NO: 7613) | GAAATCAATCATAGTGGAAGCACCAAC TACAACCCGTCCCTCAAGAGT (SEQ ID NO: 8329) | GGCGGTGGATACAGCTATGGTTACGACTAC GGTATGGACGTC (SEQ ID NO: 9045) |
| | AA | GYYWS (SEQ ID NO: 7614) | EINHSGSTNYNPSLKS (SEQ ID NO: 8330) | GGGYSYGYDYGMDV (SEQ ID NO: 9046) |

TABLE 56-continued scFv VH CDRs

| Ab | Type | CDR1 | CDR2 | CDR3 |
|---|---|---|---|---|
| 17784-G10 | NA | CGTGATCCTTACTACTGGAGC (SEQ ID NO: 7615) | TACATCTATTACAGTGGGAGCACCTAC TACAACCCGTCCCTCAAGAGT (SEQ ID NO: 8331) | GATAAACTATGGTTCGGGAAATTAAACTAC TACTACGGTATGGACGTC (SEQ ID NO: 9047) |
|  | AA | RDPYYWS (SEQ ID NO: 7616) | YIYYSGSTYYNPSLKS (SEQ ID NO: 8332) | DKLWFGKLNYYYGMDV (SEQ ID NO: 9048) |
| 17784-H5 | NA | GGTTACTACTGGAGC (SEQ ID NO: 7617) | GAAATCAATCATAGTGGAAGCACCAAC TACAACCCGTCCCTCAAGAGT (SEQ ID NO: 8333) | GGCGGTGGATACAGCTATGGTTACGACTAC GGTATGGACGTC (SEQ ID NO: 9049) |
|  | AA | GYYWS (SEQ ID NO: 7618) | EINHSGSTNYNPSLKS (SEQ ID NO: 8334) | GGGYSYGYDYGMDV (SEQ ID NO: 9050) |
| 17785-D12 | NA | GGTTACTACTGGAAC (SEQ ID NO: 7619) | GAAATCAATCATAGTGGAAGCACCAAC TACAACCCGTCCCTCAAGAGT (SEQ ID NO: 8335) | GGCGGTGGATACAGCTATGGTTACGACTAC GGTATGGACGTC (SEQ ID NO: 9051) |
|  | AA | GYYWN (SEQ ID NO: 7620) | EINHSGSTNYNPSLKS (SEQ ID NO: 8336) | GGGYSYGYDYGMDV (SEQ ID NO: 9052) |
| 17813-D8 | NA | AGCTTTGCCATGAGC (SEQ ID NO: 7621) | GCTATTAGTGGTAGTGGTGGTAGCACA TACTACGCAGACTCCGTGAAGGGC (SEQ ID NO: 8337) | ATGGTAACTCCGGACTACTACTACGATATG GACGTC (SEQ ID NO: 9053) |
|  | AA | SFAMS (SEQ ID NO: 7622) | AISGSGGSTYYADSVKG (SEQ ID NO: 8338) | MVTPDYYYDMDV (SEQ ID NO: 9054) |
| 17813-E3 | NA | GGTTACTACTGGAGC (SEQ ID NO: 7623) | GAAATCAATCACAGTGGAAGAACCAAC TACAATCCGTCCCTCAAGAGT (SEQ ID NO: 8339) | GGCGGTGGATACAGCGATGGTTACGACTAC GGTATGGACGTC (SEQ ID NO: 9055) |
|  | AA | GYYWS (SEQ ID NO: 7624) | EINHSGRTNYNPSLKS (SEQ ID NO: 8340) | GGGYSDGYDYGMDV (SEQ ID NO: 9056) |
| 17813-E5 | NA | GGTTACTACTGGAGC (SEQ ID NO: 7625) | GAAATCAATCATAGTGGAAGCACCAAC TACAACCCGTCCCTCAAGAGT (SEQ ID NO: 8341) | GGCGGTGGATACAGCTATGGTTACGACTAC GGTATGGACGTC (SEQ ID NO: 9057) |
|  | AA | GYYWS (SEQ ID NO: 7626) | EINHSGSTNYNPSLKS (SEQ ID NO: 8342) | GGGYSYGYDYGMDV (SEQ ID NO: 9058) |
| 17813-F1 | NA | GGTTACTACTGGAAC (SEQ ID NO: 7627) | GAAATCAATCATCGTGGAAGCACCAAC TACAACCCGTCCCTCAAGAGT (SEQ ID NO: 8343) | GGCGGTGGATACAGCGATGGTTACGACTAC GGTATGGACGTC (SEQ ID NO: 9059) |
|  | AA | GYYWN (SEQ ID NO: 7628) | EINHRGSTNYNPSLKS (SEQ ID NO: 8344) | GGGYSDGYDYGMDV (SEQ ID NO: 9060) |
| 17814-D9 | NA | AGTTATGATATCAAC (SEQ ID NO: 7629) | TGGATGAACCCTAACAGTGGTAACACA GGCTATGCACAGAAGTTCCAGGGC (SEQ ID NO: 8345) | GGGGGTGGATACAGCTATGGTTACGACTAC GGTATGGACGTC (SEQ ID NO: 9061) |
|  | AA | SYDIN (SEQ ID NO: 7630) | WMNPNSGNTGYAQKFQG (SEQ ID NO: 8346) | GGGYSYGYDYGMDV (SEQ ID NO: 9062) |
| 18071-B1 | NA | AGATACGGCATGGAC (SEQ ID NO: 7631) | CTTATATGGTATGATGGAAGTAATAAA TACTATGCAGACTCCGTGAAGGGC (SEQ ID NO: 8347) | AACTATGGTTCGGGGAGTTATGGGCCTAC TACTACCACGGTATGGACGTC (SEQ ID NO: 9063) |
|  | AA | RYGMD (SEQ ID NO: 7632) | LIWYDGSNKYYADSVKG (SEQ ID NO: 8348) | NYGSGSYGAYYYHGMDV (SEQ ID NO: 9064) |
| 18071-C4 | NA | AGTTATGATATCAAC (SEQ ID NO: 7633) | TGGATGAACCCTAACAGTGGTAACACA GACTATGCACAGAAGTTCCAGGGC (SEQ ID NO: 8349) | GGCTGGGGAACCTACTACTACTACGGTATG GACGTC (SEQ ID NO: 9065) |
|  | AA | SYDIN (SEQ ID NO: 7634) | WMNPNSGNTDYAQKFQG (SEQ ID NO: 8350) | GWGTYYYYGMDV (SEQ ID NO: 9066) |
| 18071-D4 | NA | AGTTATGATATCAAC (SEQ ID NO: 7635) | TGGATGAACCCTAACAGTGGTAACACA GACTATGCACAGAAGTTCCAGGGC (SEQ ID NO: 8351) | GGCTGGGGAAGGTACTATTCCTACGGTATG GACGTC (SEQ ID NO: 9067) |
|  | AA | SYDIN (SEQ ID NO: 7636) | WMNPNSGNTDYAQKFQG (SEQ ID NO: 8352) | GWGRYYSYGMDV (SEQ ID NO: 9068) |
| 18072-D6 | NA | AGCTATGCCATGAGC (SEQ ID NO: 7637) | GCTATTAGTGGTAGTGGTGATATCACA TACTACGCAGACTCCGTGAAGGGC (SEQ ID NO: 8353) | CACCTACGATATTTTGACTGGCCCCTTGAC TAC (SEQ ID NO: 9069) |
|  | AA | SYAMS (SEQ ID NO: 7638) | AISGSGDITYYADSVKG (SEQ ID NO: 8354) | HLRYFDWPLDY (SEQ ID NO: 9070) |
| 18072-G9 | NA | GGCTATAGCATGAAC (SEQ ID NO: 7639) | TCCATTAGTAGTAGTAGTAGTTACATA TACTACGCAGACTCAGTGAAGGGC (SEQ ID NO: 8355) | AGTAAAGCAGCTCGTCCGGACGACGGTATG GACGTC (SEQ ID NO: 9071) |

TABLE 56-continued scFv VH CDRs

| Ab | Type | CDR1 | CDR2 | CDR3 |
|---|---|---|---|---|
| | AA | GYSMN<br>(SEQ ID NO: 7640) | SISSSSSYIYYADSVKG<br>(SEQ ID NO: 8356) | SKAARPDDGMDV<br>(SEQ ID NO: 9072) |
| 18074-G12 | NA | TCCTATGCCATGAGC<br>(SEQ ID NO: 7641) | AGCATAACTATTACTGGTGGTAGCACA<br>TACTACGCAGACTCCGTGAAGGGC<br>(SEQ ID NO: 8357) | GATGGGGGCAGTGGCTGGTTCCCTAAACTA<br>CTACACTACGGTCTGGACGTC<br>(SEQ ID NO: 9073) |
| | AA | SYAMS<br>(SEQ ID NO: 7642) | SITITGGSTYYADSVKG<br>(SEQ ID NO: 8358) | DGGSGWFPKLLHYGLDV<br>(SEQ ID NO: 9074) |
| 18078-H6 | NA | AGATATGGCATGCAG<br>(SEQ ID NO: 7643) | GTTATATCATATGATGGAAGTAATAAA<br>TACTATGCAGACTCCGTGAAGGGC<br>(SEQ ID NO: 8359) | AACTATGGTTCGGGGAGTTATGGGGCCTAC<br>TACTACCACGGAATGGACGTC<br>(SEQ ID NO: 9075) |
| | AA | RYGMQ<br>(SEQ ID NO: 7644) | VISYDGSNKYYADSVKG<br>(SEQ ID NO: 8360) | NYGSGSYGAYYYHGMDV<br>(SEQ ID NO: 9076) |
| 18079-C8 | NA | AGCTATGGCATGCAC<br>(SEQ ID NO: 7645) | GTTATATCATATGATGGAAGTAATAAG<br>TACTATGCAGACTCCGTGAAGGGC<br>(SEQ ID NO: 8361) | GAGCAGTGGCCCAACTACTACTACGGTTTG<br>GGCGTC<br>(SEQ ID NO: 9077) |
| | AA | SYGMH<br>(SEQ ID NO: 7646) | VISYDGSNKYYADSVKG<br>(SEQ ID NO: 8362) | EQWPNYYYGLGV<br>(SEQ ID NO: 9078) |
| 18079-H4 | NA | AGTTATGATATCAAC<br>(SEQ ID NO: 7647) | TGGATGAACCCTAACAGTGGTAACACA<br>GACTATGCACAGAAGTTCCAGGGC<br>(SEQ ID NO: 8363) | GGCTGGGGAAGGTTCTATTCCTACGGTATG<br>GACGTC<br>(SEQ ID NO: 9079) |
| | AA | SYDIN<br>(SEQ ID NO: 7648) | WMNPNSGNTDYAQKFQG<br>(SEQ ID NO: 8364) | GWGRFYSYGMDV<br>(SEQ ID NO: 9080) |
| 18079-H11 | NA | AGTTATGATATCAAC<br>(SEQ ID NO: 7649) | TGGATGAACCCTAACAGTGGTAACACA<br>GACTATACACAGAAGTTCCAGGGC<br>(SEQ ID NO: 8365) | GGCTGGGGAACCTACTACTACTACGGTATG<br>GACGTC<br>(SEQ ID NO: 9081) |
| | AA | SYDIN<br>(SEQ ID NO: 7650) | WMNPNSGNTDYTQKFQG<br>(SEQ ID NO: 8366) | GWGTYYYYGMDV<br>(SEQ ID NO: 9082) |
| 18080-C5 | NA | AGTGGTGATTACTACTGGAGC<br>(SEQ ID NO: 7651) | TACATCAATGACAGTGGGAGCACCTAC<br>TATAACCCGTCCCTCAAGAGT<br>(SEQ ID NO: 8367) | GATTTACTATGGTTCGGGAAGTTAAACTAC<br>TACTACGGTATGGACGTC<br>(SEQ ID NO: 9083) |
| | AA | SGDYYWS<br>(SEQ ID NO: 7652) | YINDSGSTYYNPSLKS<br>(SEQ ID NO: 8368) | DLLWFGKLNYYYGMDV<br>(SEQ ID NO: 9084) |
| 18080-H9 | NA | AGCTATGCCATGAGC<br>(SEQ ID NO: 7653) | GGTATTAGTGGTAGTGGTGGTAGCACA<br>TACTACGCAGACTCCGTGAAGGGC<br>(SEQ ID NO: 8369) | GTGATGACTCCGGACTACTACGATATG<br>GACGTC<br>(SEQ ID NO: 9085) |
| | AA | SYAMS<br>(SEQ ID NO: 7654) | GISGSGGSTYYADSVKG<br>(SEQ ID NO: 8370) | VMTPDYYYDMDV<br>(SEQ ID NO: 9086) |
| 18081-A6 | NA | AGTAGTCGTTACTACTGGGGC<br>(SEQ ID NO: 7655) | AGTATCTATTATAGTGGGAGCACCTAC<br>TACAACCCGTCCCTCAAGAGT<br>(SEQ ID NO: 8371) | GGGATTTTTGGAGTGATTACGTACTTTGAC<br>TAC<br>(SEQ ID NO: 9087) |
| | AA | SSRYYWG<br>(SEQ ID NO: 7656) | SIYYSGSTYYNPSLKS<br>(SEQ ID NO: 8372) | GIFGVITYFDY<br>(SEQ ID NO: 9088) |
| 18081-B5 | NA | AGCAACAGTGCTGCTTGGAAC<br>(SEQ ID NO: 7657) | AGGACATACTACAGGTCCAAGTGGTAT<br>AATGATTATGCAGTATCTGTGAAAAGT<br>(SEQ ID NO: 8373) | GAGGTACTATGGTTCGGGAAGTTAAACTAC<br>TACTACGGTATGGACGTC<br>(SEQ ID NO: 9089) |
| | AA | SNSAAWN<br>(SEQ ID NO: 7658) | RTYYRSKWYNDYAVSVKS<br>(SEQ ID NO: 8374) | EVLWFGKLNYYYGMDV<br>(SEQ ID NO: 9090) |
| 18081-C10 | NA | AGTAGTAGGTCCTACTGGGGC<br>(SEQ ID NO: 7659) | AGTATCTATTATGGTGGGAGCACCTAC<br>TACAACCCGTCCCTCAAGAGT<br>(SEQ ID NO: 8375) | ACGATTTTTGGAGTGGTAGGATGGTTCGAC<br>CCC<br>(SEQ ID NO: 9091) |
| | AA | SSRSYWG<br>(SEQ ID NO: 7660) | SIYYGGSTYYNPSLKS<br>(SEQ ID NO: 8376) | TIFGVVGWFDP<br>(SEQ ID NO: 9092) |
| 18081-D6 | NA | ACTCATAAAATGGGTGTGGAC<br>(SEQ ID NO: 7661) | CTCATTTATTGGAATGATGATACGCGC<br>TACAGCCCATCTCTGCAGAGT<br>(SEQ ID NO: 8377) | AGACGGTATAACTGGAACTACGAGAACTGG<br>TTCGACCCC<br>(SEQ ID NO: 9093) |
| | AA | THKMGVD<br>(SEQ ID NO: 7662) | LIYWNDDTRYSPSLQS<br>(SEQ ID NO: 8378) | RRYNWNYENWFDP<br>(SEQ ID NO: 9094) |
| 18081-D12 | NA | ATCTATGCCTTGAGC<br>(SEQ ID NO: 7663) | GCTATTAGTGGTAGTGGTGGTAGCACA<br>TACTACGCAGACTCCGTGAAGGGC<br>(SEQ ID NO: 8379) | GGGGAGGGTATAGCAGCTCGGTACTACTAC<br>TACGGTATGGACGTC<br>(SEQ ID NO: 9095) |
| | AA | IYALS<br>(SEQ ID NO: 7664) | AISGSGGSTYYADSVKG<br>(SEQ ID NO: 8380) | GEGIAARYYYYGMDV<br>(SEQ ID NO: 9096) |

TABLE 56-continued scFv VH CDRs

| Ab | Type | CDR1 | CDR2 | CDR3 |
|---|---|---|---|---|
| 18082-F5 | NA | AGATATGGCATGGAT (SEQ ID NO: 7665) | GTTATATGGTATGATGAAGTAATAAA TACTATGCAGACTCCGTGAAGGGC (SEQ ID NO: 8381) | AACTATGGTTCGGGGAGTTATGGGGCCTAC TACTACCACGGAATGGACGTC (SEQ ID NO: 9097) |
| | AA | RYGMD (SEQ ID NO: 7666) | VIWYDGSNKYYADSVKG (SEQ ID NO: 8382) | NYGSGSYGAYYYHGMDV (SEQ ID NO: 9098) |
| 18084-E4 | NA | AGCTATGCCATGAGC (SEQ ID NO: 7667) | GCTATTAGTGGTAGTGGTAGTAGCACA TACTACGCAGACTCCGTGAAGGGC (SEQ ID NO: 8383) | CACCTACGATATTCTGACTGGCCCCTTGAC TAC (SEQ ID NO: 9099) |
| | AA | SYAMS (SEQ ID NO: 7668) | AISGSGSSTYYADSVKG (SEQ ID NO: 8384) | HLRYSDWPLDY (SEQ ID NO: 9100) |
| 18086-H4 | NA | AGTTATGATATCAAC (SEQ ID NO: 7669) | TGGATGAACCCTAAGAGTGGTAACACA GGCTATGCACAGAAGTTCCAGGAC (SEQ ID NO: 8385) | GGCTGGGGAACCTACTACTACTACGGTATG GACGTC (SEQ ID NO: 9101) |
| | AA | SYDIN (SEQ ID NO: 7670) | WMNPKSGNTGYAQKFQD (SEQ ID NO: 8386) | GWGTYYYYGMDV (SEQ ID NO: 9102) |
| 18088-B10 | NA | AGCTATGCCATGAGC (SEQ ID NO: 7671) | GCTATTAGTGGTAGTGGTGATATCACA TACTACGCAGACTCCGTGAAGGGC (SEQ ID NO: 8387) | CACCTACGATATTTTGACTGGCCCCTTGAC TAC (SEQ ID NO: 9103) |
| | AA | SYAMS (SEQ ID NO: 7672) | AISGSGDITYYADSVKG (SEQ ID NO: 8388) | HLRYFDWPLDY (SEQ ID NO: 9104) |
| 18088-E4 | NA | GGTTACTACTGGAGC (SEQ ID NO: 7673) | GAAATCAATCATAGTGGAAGCACCAAC TACAACCCGTCCCTCAAGAGT (SEQ ID NO: 8389) | GGCGGTGGATACAGCTATGGTTACGACTAC GGTATGGACGTC (SEQ ID NO: 9105) |
| | AA | GYYWS (SEQ ID NO: 7674) | EINHSGSTNYNPSLKS (SEQ ID NO: 8390) | GGGYSYGYDYGMDV (SEQ ID NO: 9106) |
| 18089-B8 | NA | AGTAGTAGGTCCTACTGGGGC (SEQ ID NO: 7675) | AGTATCTATTATGGTGGGAGCACCTAC TACAACCCGTCCCTCAAGAAT (SEQ ID NO: 8391) | ACGATTTTTGGAGTGGTAGGATGGTTCGAC CCC (SEQ ID NO: 9107) |
| | AA | SSRSYWG (SEQ ID NO: 7676) | SIYYGGSTYYNPSLKN (SEQ ID NO: 8392) | TIFGVVGWFDP (SEQ ID NO: 9108) |
| 18089-C8 | NA | ACTAATAAAATGGCTGTGGGT (SEQ ID NO: 7677) | CTCATTTATTGGAATGATGATAAGCGC TACAGTCCATCTCTGAAGAGC (SEQ ID NO: 8393) | AGACGGTATAACTGGAACTACGAAAACTGG TTCGACCCC (SEQ ID NO: 9109) |
| | AA | TNKMAVG (SEQ ID NO: 7678) | LIYWNDDKRYSPSLKS (SEQ ID NO: 8394) | RRYNWNYENWFDP (SEQ ID NO: 9110) |
| 18089-G7 | NA | ACTCATAAAATGGGTGTGGAC (SEQ ID NO: 7679) | CTCATTTATTGGAATGATGATAAGCGC TACAGCCCATCTCTGCAGAGT (SEQ ID NO: 8395) | AGACGGTATAACTGGAACTACGAGAACTGG TTCGACCCC (SEQ ID NO: 9111) |
| | AA | THKMGVD (SEQ ID NO: 7680) | LIYWNDDKRYSPSLQS (SEQ ID NO: 8396) | RRYNWNYENWFDP (SEQ ID NO: 9112) |
| 18089-G11 | NA | AGCTATGCCATGAGC (SEQ ID NO: 7681) | GGTATTAGTGGTAGTGGTGGTAGCTCA TACTACGCAGACTCCGTGAAGGGC (SEQ ID NO: 8397) | ACTTTAACCCCTGACTACTACTACGATATG GACGTC (SEQ ID NO: 9113) |
| | AA | SYAMS (SEQ ID NO: 7682) | GISGSGGSSYYADSVKG (SEQ ID NO: 8398) | TLTPDYYYDMDV (SEQ ID NO: 9114) |
| 18089-H9 | NA | AGCTATGCCGTGAGC (SEQ ID NO: 7683) | GGTATTAGTGGTAGTGGTGGTAGCACA TACTACGCAGACTCCGTGAAGGGC (SEQ ID NO: 8399) | GCTTTAACCCCTGACTACTACTACGATATG GACGTC (SEQ ID NO: 9115) |
| | AA | SYAVS (SEQ ID NO: 7684) | GISGSGGSTYYADSVKG (SEQ ID NO: 8400) | ALTPDYYYDMDV (SEQ ID NO: 9116) |
| 18089-H12 | NA | AACTATGCCATGAGC (SEQ ID NO: 7685) | GCTATTAGTGGTAGTGGTGGTAGTACA TACTACGCAGACTCCGTGAAGGGC (SEQ ID NO: 8401) | CAGGGGGGTATAGCAGCAGCTTACTACTAC TACGACGGTATGGACGTC (SEQ ID NO: 9117) |
| | AA | NYAMS (SEQ ID NO: 7686) | AISGSGGSTYYADSVKG (SEQ ID NO: 8402) | QGGIAAAYYYDGMDV (SEQ ID NO: 9118) |
| 18090-H9 | NA | AGATATGGCATGGAT (SEQ ID NO: 7687) | GTTATATCATATGATGAAGTAATAAA TACTATGCAGACTCCGTGAAGGGC (SEQ ID NO: 8403) | AACTATGGTTCGGGGAGTTATGGGGCCTAC TACTACGGTATGGACGTC (SEQ ID NO: 9119) |
| | AA | RYGMD (SEQ ID NO: 7688) | VISYDGSNKYYADSVKG (SEQ ID NO: 8404) | NYGSGSYGAYYYYGMDV (SEQ ID NO: 9120) |
| 18093-E2 | NA | TCCTATGCCATGAGC (SEQ ID NO: 7689) | ACTATTAGTCATAGTGGTGGTAGCACA TACTACGCAGACTCCGTGAAGGGC (SEQ ID NO: 8405) | GATGGGGGCAGTGGCTGGTTCCCTAAACTA CTACACTACGGTCTGGACGTC (SEQ ID NO: 9121) |

TABLE 56-continued scFv VH CDRs

| Ab | Type | CDR1 | CDR2 | CDR3 |
|---|---|---|---|---|
| | AA | SYAMS<br>(SEQ ID NO: 7690) | TISHSGGSTYYADSVKG<br>(SEQ ID NO: 8406) | DGGSGWFPKLLHYGLDV<br>(SEQ ID NO: 9122) |
| 18093-F5 | NA | ATCTATGGCATGAGC<br>(SEQ ID NO: 7691) | GCTATTAGTGGTAGTGGTGGTAGCACATACTACGCAGACTCCGTGAAGGGC<br>(SEQ ID NO: 8407) | GGGGAGGGTATATCAGCTCGGTACTACTACTACGGTATGGACGTC<br>(SEQ ID NO: 9123) |
| | AA | IYGMS<br>(SEQ ID NO: 7692) | AISGSGGSTYYADSVKG<br>(SEQ ID NO: 8408) | GEGISARYYYYGMDV<br>(SEQ ID NO: 9124) |
| 18179-A3 | NA | AGTAATCCTTACTACTGGAGC<br>(SEQ ID NO: 7693) | TACATCTCTTACAGTGGGAGCACCTTCTACAACCCGTCCCTCAAGAGT<br>(SEQ ID NO: 8409) | GATCGTCTTTGGTTCGGAGTGTTAAACTACTACTACGGTATGGACGTC<br>(SEQ ID NO: 9125) |
| | AP | SNPYYWS<br>(SEQ ID NO: 7694) | YISYSGSTFYNPSLKS<br>(SEQ ID NO: 8410) | DRLWFGVLNYYYGMDV<br>(SEQ ID NO: 9126) |
| 18179-A5 | NA | AGTGGTGATTACTACTGGAGC<br>(SEQ ID NO: 7695) | TACATCGATAAGAGTGGGAGCACCTACTACAACCCGTCCCTCAAGAGT<br>(SEQ ID NO: 8411) | GAGAAGATGTGGTTCGGGGTGTTAAACTACTACTACGGTATGGACGTC<br>(SEQ ID NO: 9127) |
| | AA | SGDYYWS<br>(SEQ ID NO: 7696) | YIDKSGSTYYNPSLKS<br>(SEQ ID NO: 8412) | EKMWFGVLNYYYGMDV<br>(SEQ ID NO: 9128) |
| 18179-A9 | NA | AGTGGTGATTACTACTGGAGC<br>(SEQ ID NO: 7697) | TACATCGATAAGAGTGGGAGCACCTACTACAACCCGTCCCTCAAGAGT<br>(SEQ ID NO: 8413) | GATCGTCTATGGTTCGGAGTGTTAAACTACTACTACGGTATGGACGTC<br>(SEQ ID NO: 9129) |
| | AA | SGDYYWS<br>(SEQ ID NO: 7698) | YIDKSGSTYYNPSLKS<br>(SEQ ID NO: 8414) | DRLWFGVLNYYYGMDV<br>(SEQ ID NO: 9130) |
| 18179-A10 | NA | AGTGGTGATTACTACTGGAGC<br>(SEQ ID NO: 7699) | TACATCGATAAGAGTGGGAGCACCTACTACAACCCGTCCCTCAAGAGT<br>(SEQ ID NO: 8415) | GATCAACTATGGTTCGGGGTTTTAAACTACTATTACGGTATGGACGTC<br>(SEQ ID NO: 9131) |
| | AA | SGDYYWS<br>(SEQ ID NO: 7700) | YIDKSGSTYYNPSLKS<br>(SEQ ID NO: 8416) | DQLWFGVLNYYYGMDV<br>(SEQ ID NO: 9132) |
| 18179-B7 | NA | AACGCCTGGATGAGC<br>(SEQ ID NO: 7701) | CGTATTAAAGGCAACACTTATGGTGGGACAACAGACTACGCTGCACCCGTGAAAGGC<br>(SEQ ID NO: 8417) | CCATCGAATAGTGGGAGCTATTATAATTACTTCTCCGTTATGGACGTC<br>(SEQ ID NO: 9133) |
| | AA | NAWMS<br>(SEQ ID NO: 7702) | RIKGNTYGGTTDYAAPVKG<br>(SEQ ID NO: 8418) | PSNSGSYYNYFSVMDV<br>(SEQ ID NO: 9134) |
| 18179-B8 | NA | AACGCCTGGATGAGC<br>(SEQ ID NO: 7703) | CGTATTAAAGGCAACACTTATGGTGGGACAACAGACTACGCTGCACCCGTGAAAGGC<br>(SEQ ID NO: 8419) | CCATCGAATAGTGGGAGCTATTATAATTACTTCTCCGTTATGGACGTC<br>(SEQ ID NO: 9135) |
| | AA | NAWMS<br>(SEQ ID NO: 7704) | RIKGNTYGGTTDYAAPVKG<br>(SEQ ID NO: 8420) | PSNSGSYYNYFSVMDV<br>(SEQ ID NO: 9136) |
| 18179-C4 | NA | AGTGGTGATTACTACTGGAGC<br>(SEQ ID NO: 7705) | TACATCGATAAGAGTGGGAGCACCTACTACAACCCGTCCCTCAAGAGT<br>(SEQ ID NO: 8421) | GATCGTCTATGGTTCGGAGTGTTAAACTACTACTACGGTATGGACGTC<br>(SEQ ID NO: 9137) |
| | AA | SGDYYWS<br>(SEQ ID NO: 7706) | YIDKSGSTYYNPSLKS<br>(SEQ ID NO: 8422) | DRLWFGVLNYYYGMDV<br>(SEQ ID NO: 9138) |
| 18179-C6 | NA | AGTGGTGATTACTACTGGAGC<br>(SEQ ID NO: 7707) | TACATCGATAAGAGTGGGAGCACCTACTACAACCCGTCCCTCAAGAGT<br>(SEQ ID NO: 8423) | GATCAACTATGGTTCGGGGTTTTAAACTACTATTACGGTATGGACGTC<br>(SEQ ID NO: 9139) |
| | AA | SGDYYWS<br>(SEQ ID NO: 7708) | YIDKSGSTYYNPSLKS<br>(SEQ ID NO: 8424) | DQLWFGVLNYYYGMDV<br>(SEQ ID NO: 9140) |
| 18179-C7 | NA | AGTAATCCTTACTACTGGAGC<br>(SEQ ID NO: 7709) | TACATCTCTCACAGTGGGAGCACTTATTACAATCCGTCCCTCAAGAGT<br>(SEQ ID NO: 8425) | GAGAAGATGTGGTTCGGGGTGTTAAACTACTACTACGGTATGGACGTC<br>(SEQ ID NO: 9141) |
| | AA | SNPYYWS<br>(SEQ ID NO: 7710) | YISHSGSTYYNPSLKS<br>(SEQ ID NO: 8426) | EKMWFGVLNYYYGMDV<br>(SEQ ID NO: 9142) |
| 18179-C10 | NA | AGTAATCCTTACTACTGGAGC<br>(SEQ ID NO: 7711) | TACATCTCTCACAGTGGGAGCACTTATTACAATCCGTCCCTCAAGAGT<br>(SEQ ID NO: 8427) | GATCGTCTATGGTTCGGAGTGTTAAACTACTACTACGGTATGGACGTC<br>(SEQ ID NO: 9143) |
| | AA | SNPYYWS<br>(SEQ ID NO: 7712) | YISHSGSTYYNPSLKS<br>(SEQ ID NO: 8428) | DRLWFGVLNYYYGMDV<br>(SEQ ID NO: 9144) |
| 18179-D8 | NA | AACGCCTGGATGAGC<br>(SEQ ID NO: 7713) | CGTATTAAAGGCAACACTTATGGTGGGACAACAGACTACGCTGCACCCGTGAAAGGC<br>(SEQ ID NO: 8429) | CCATCGAATAGTGGGAGCTATTATAATTACTTCTCCGTTATGGACGTC<br>(SEQ ID NO: 9145) |

TABLE 56-continued scFv VH CDRs

| Ab | Type | CDR1 | CDR2 | CDR3 |
|---|---|---|---|---|
| | AA | NAWMS<br>(SEQ ID NO: 7714) | RIKGNTYGGTTDYAAPVKG<br>(SEQ ID NO: 8430) | PSNSGSYYNYFSVMDV<br>(SEQ ID NO: 9146) |
| 18179-D9 | NA | AACGCCTGGATGAGC<br>(SEQ ID NO: 7715) | CGTATTAAAGGCAACACTTATGGTGGG<br>ACAACAGACTACGCTGCACCCGTGAAA<br>GGC<br>(SEQ ID NO: 8431) | CCTTCGTATAGTGGGAGCTATTATAATTAC<br>TTCTCCGTTATGGACGTC<br>(SEQ ID NO: 9147) |
| | AA | NAWMS<br>(SEQ ID NO: 7716) | RIKGNTYGGTTDYAAPVKG<br>(SEQ ID NO: 8432) | PSYSGSYYNYFSVMDV<br>(SEQ ID NO: 9148) |
| 18179-E6 | NA | AACGCCTGGATGAGC<br>(SEQ ID NO: 7717) | CGTATTAAAGGCAACACTTATGGTGGG<br>ACAACAGACTACGCTGCACCCGTGAAA<br>GGC<br>(SEQ ID NO: 8433) | CCATCGAATAGTGGGAGCTATTATAATTAC<br>TTCTCCGTTATGGACGTC<br>(SEQ ID NO: 9149) |
| | AA | NAWMS<br>(SEQ ID NO: 7718) | RIKGNTYGGTTDYAAPVKG<br>(SEQ ID NO: 8434) | PSNSGSYYNYFSVMDV<br>(SEQ ID NO: 9150) |
| 18179-F3 | NA | AGTTACTACTGGAGC<br>(SEQ ID NO: 7719) | CATATCTATACCAGTGGGAGCACCAAC<br>TACAACCCCTCCCTCAAGAGT<br>(SEQ ID NO: 8435) | GAGAAGATGTGGTTCGGGGTGTTAAACTAC<br>TACTACGGTATGGACGTC<br>(SEQ ID NO: 9151) |
| | AA | SYYWS<br>(SEQ ID NO: 7720) | HIYTSGSTNYNPSLKS<br>(SEQ ID NO: 8436) | EKMWFGVLNYYYGMDV<br>(SEQ ID NO: 9152) |
| 18179-F4 | NA | AGTAATCCTTACTACTGGAGC<br>(SEQ ID NO: 7721) | TACATCTCTTACAGTGGGAGCACCTTC<br>TACAACCCGTCCCTCAAGAGT<br>(SEQ ID NO: 8437) | GATCGTCTTTGGTTCGGAGTGTTAAACTAC<br>TACTACGGTATGGACGTC<br>(SEQ ID NO: 9153) |
| | AA | SNPYYWS<br>(SEQ ID NO: 7722) | YISYSGSTFYNPSLKS<br>(SEQ ID NO: 8438) | DRLWFGVLNYYYGMDV<br>(SEQ ID NO: 9154) |
| 18179-F6 | NA | AGTGGTGATTACTACTGGAGC<br>(SEQ ID NO: 7723) | TACATCGATAAGAGTGGGAGCACCTAC<br>TACAACCCGTCCCTCAAGAGT<br>(SEQ ID NO: 8439) | GATCAACTATGGTTCGGGGTTTTAAACTAC<br>TATTACGGTATGGACGTC<br>(SEQ ID NO: 9155) |
| | AA | SGDYYWS<br>(SEQ ID NO: 7724) | YIDKSGSTYYNPSLKS<br>(SEQ ID NO: 8440) | DQLWEGVLNYYYGMDV<br>(SEQ ID NO: 9156) |
| 18179-F10 | NA | GATTTCTTCTGGAGC<br>(SEQ ID NO: 7725) | TATATCTATTACAGAGGGAGCACCAAC<br>TACCACCCCTCCCTCAAGAGT<br>(SEQ ID NO: 8441) | GAGAAGATGTGGTTCGGGGTGTTAAACTAC<br>TACTACGGTATGGACGTC<br>(SEQ ID NO: 9157) |
| | AA | DFFWS<br>(SEQ ID NO: 7726) | YIYYRGSTNYHPSLKS<br>(SEQ ID NO: 8442) | EKMWFGVLNYYYGMDV<br>(SEQ ID NO: 9158) |
| 18179-G8 | NA | AGTGGTGATTACTACTGGAGC<br>(SEQ ID NO: 7727) | TACATCGATAAGAGTGGGAGCACCTAC<br>TACAACCCGTCCCTCAAGAGT<br>(SEQ ID NO: 8443) | GATCAACTATGGTTCGGGGTTTTAAACTAC<br>TATTACGGTATGGACGTC<br>(SEQ ID NO: 9159) |
| | AA | SGDYYWS<br>(SEQ ID NO: 7728) | YIDKSGSTYYNPSLKS<br>(SEQ ID NO: 8444) | DQLWFGVLNYYYGMDV<br>(SEQ ID NO: 9160) |
| 18179-G9 | NA | AGTAATCCTTACTACTGGAGC<br>(SEQ ID NO: 7729) | TACATCTATTACAGTGGGAGCACCTCC<br>TACAACCCGTCCCTCAAGAGT<br>(SEQ ID NO: 8445) | GATTTACTTTGGTTCGGGAAGCTTAACTAC<br>TACTACGGTTTGGACGTC<br>(SEQ ID NO: 9161) |
| | AA | SNPYYWS<br>(SEQ ID NO: 7730) | YIYYSGSTSYNPSLKS<br>(SEQ ID NO: 8446) | DLLWFGKLNYYYGLDV<br>(SEQ ID NO: 9162) |
| 18179-H6 | NA | AGTGGTGATTACTACTGGAGC<br>(SEQ ID NO: 7731) | TACATCGATAAGAGTGGGAGCACCTAC<br>TACAACCCGTCCCTCAAGAGT<br>(SEQ ID NO: 8447) | GATTTACTTTGGTTCGGGAAGCTTAACTAC<br>TACTACGGTTTGGACGTC<br>(SEQ ID NO: 9163) |
| | AA | SGDYYWS<br>(SEQ ID NO: 7732) | YIDKSGSTYYNPSLKS<br>(SEQ ID NO: 8448) | DLLWFGKLNYYYGLDV<br>(SEQ ID NO: 9164) |
| 18179-H9 | NA | AGTAATCCTTACTACTGGAGC<br>(SEQ ID NO: 7733) | TACATCTCTCACAGTGGGAGCACTTAT<br>TACAATCCGTCCCTCAAGAGT<br>(SEQ ID NO: 8449) | GAGAAGATGTGGTTCGGGGTGTTAAACTAC<br>TACTACGGTATGGACGTC<br>(SEQ ID NO: 9165) |
| | AA | SNPYYWS<br>(SEQ ID NO: 7734) | YISHSGSTYYNPSLKS<br>(SEQ ID NO: 8450) | EKMWFGVLNYYYGMDV<br>(SEQ ID NO: 9166) |
| 18181-A11 | NA | AGTAATCCTTACTACTGGAGC<br>(SEQ ID NO: 7735) | TACATCTCTTACAGTGGGAGCACCTAC<br>TACAACCCGTCCCTCAAGAGT<br>(SEQ ID NO: 8451) | GATCGTCTATGGTTCGGAGTGTTAAACTAC<br>TACTACGGTATGGACGTC<br>(SEQ ID NO: 9167) |
| | AA | SNPYYWS<br>(SEQ ID NO: 7736) | YISYSGSTYYNPSLKS<br>(SEQ ID NO: 8452) | DRLWFGVLNYYYGMDV<br>(SEQ ID NO: 9168) |
| 18181-C6 | NA | AGTAATCCTTACTACTGGAGC<br>(SEQ ID NO: 7737) | TACATCTCTTACAGTGGGAGCACCTAC<br>TACAACCCGTCCCTCAAGAGT<br>(SEQ ID NO: 8453) | GATCGTCTATGGTTCGGAGTGTTAAACTAC<br>TACTACGGTATGGACGTC<br>(SEQ ID NO: 9169) |
| | AA | SNPYYWS<br>(SEQ ID NO: 7738) | YISYSGSTYYNPSLKS<br>(SEQ ID NO: 8454) | DRLWFGVLNYYYGMDV<br>(SEQ ID NO: 9170) |

TABLE 56-continued scFv VH CDRs

| Ab | Type | CDR1 | CDR2 | CDR3 |
|---|---|---|---|---|
| 18181-G7 | NA | AACGCCTGGATGAGC (SEQ ID NO: 7739) | CGTATTAAAGGCAACACTTATGGTGGG ACAACAGACTACGCTGCACCCGTGAAA GGC (SEQ ID NO: 8455) | CCATCGAATGGTGGGAGCTATTATAATTAC TTCTCCGTTATGGACGTC (SEQ ID NO: 9171) |
| | AA | NAWMS (SEQ ID NO: 7740) | RIKGNTYGGTTDYAAPVKG (SEQ ID NO: 8456) | PSNGGSYYNYFSVMDV (SEQ ID NO: 9172) |
| 18181-H10 | NA | AATTACTACTGGAGC (SEQ ID NO: 7741) | CATATCTATACCAGTGGGAGCACCAAC TTCAACCCCTCCCTCAAGAGT (SEQ ID NO: 8457) | GAGAAGATGTGGTTCGGGGTGTTAAACTAC TACTACGGTATGGACGTC (SEQ ID NO: 9173) |
| | AA | NYYWS (SEQ ID NO: 7742) | HIYTSGSTNENPSLKS (SEQ ID NO: 8458) | EKMWFGVLNYYYGMDV (SEQ ID NO: 9174) |
| 18182-A3 | NA | AGCTATGCCATGAGC (SEQ ID NO: 7743) | GCTATTAGTGGTAGTGGTGGTAGCACA TACTACGCAGACTCCGTGAAGGGC (SEQ ID NO: 8459) | GGAAAGGGAGTACATCTGGGCTTTGACTAC (SEQ ID NO: 9175) |
| | AA | SYAMS (SEQ ID NO: 7744) | AISGSGGSTYYADSVKG (SEQ ID NO: 8460) | GKGVHLGFDY (SEQ ID NO: 9176) |
| 18182-A5 | NA | AGCCATGCCATGAGC (SEQ ID NO: 7745) | GCTATTAGTGGTAGTGGTGGTGGCACT TACTACGCAGACTCCGTGAAGGGC (SEQ ID NO: 8461) | GGAAAGGGAGTACATCTGAACTTTGACTAC (SEQ ID NO: 9177) |
| | AA | SHAMS (SEQ ID NO: 7746) | AISGSGGGTYYADSVKG (SEQ ID NO: 8462) | GKGVHLNFDY (SEQ ID NO: 9178) |
| 18182-A6 | NA | AGCTATGCCATGAGC (SEQ ID NO: 7747) | ACTATTAGTGGAAGTGGTGGTGGCACA TACTACGCAGACTCCGTGAAGGGC (SEQ ID NO: 8463) | GGAAAGGGAGTACATCTGGGCTTTGACTAC (SEQ ID NO: 9179) |
| | AA | SYAMS (SEQ ID NO: 7748) | TISGSGGGTYYADSVKG (SEQ ID NO: 8464) | GKGVHLGFDY (SEQ ID NO: 9180) |
| 18182-A7 | NA | AGCTATGCCATGAGC (SEQ ID NO: 7749) | GCTATTAGTGGAAGTGGTGGTGGCACA TACTACGCAGACTCCGTGAAGGGC (SEQ ID NO: 8465) | GGAAAGGGAGTACATCTGGGCTTTGACTAC (SEQ ID NO: 9181) |
| | AA | SYAMS (SEQ ID NO: 7750) | AISGSGGGTYYADSVKG (SEQ ID NO: 8466) | GKGVHLGFDY (SEQ ID NO: 9182) |
| 18182-A8 | NA | AGCCATGCCATGAGC (SEQ ID NO: 7751) | GCTATTAGTGGTAGTGGTGGTGGCACA TACAACGCAGACTCCGTGAAGGGC (SEQ ID NO: 8467) | GGAAAGGGAGTACATCTGGGCTTTGACTAC (SEQ ID NO: 9183) |
| | AA | SHAMS (SEQ ID NO: 7752) | AISGSGGGTYNADSVKG (SEQ ID NO: 8468) | GKGVHLGFDY (SEQ ID NO: 9184) |
| 18182-A11 | NA | AGCTATGCCATGAGC (SEQ ID NO: 7753) | GCTATTAGTGGAAGTGGTGGTGGCACA TACTACGCAGACTCCGTGAAGGGC (SEQ ID NO: 8469) | GGAAAGGGAGTACATCTGGGCTTTGACTAC (SEQ ID NO: 9185) |
| | AA | SYAMS (SEQ ID NO: 7754) | AISGSGGGTYYADSVKG (SEQ ID NO: 8470) | GKGVHLGFDY (SEQ ID NO: 9186) |
| 18182-B1 | NA | AGCCATGCCATGAGC (SEQ ID NO: 7755) | GCTATTAGTGGTAGTGGTGGTGGCACA TACAACGCAGACTCCGTGAAGGGC (SEQ ID NO: 8471) | GGAAAGGGAGTACATCTGGGCTTTGACTAC (SEQ ID NO: 9187) |
| | AA | SHAMS (SEQ ID NO: 7756) | AISGSGGGTYNADSVKG (SEQ ID NO: 8472) | GKGVHLGFDY (SEQ ID NO: 9188) |
| 18182-B4 | NA | AGCTATGCCATGAGC (SEQ ID NO: 7757) | GCTATTAGTGGTAGTGGTGGTGGCACA TACTACGCAGACTCCGTGAAGGCC (SEQ ID NO: 8473) | GGAAAGGGAGTACATCTGGGCTTTGACTAC (SEQ ID NO: 9189) |
| | AA | SYAMS (SEQ ID NO: 7758) | AISGSGGGTYYADSVKA (SEQ ID NO: 8474) | GKGVHLGFDY (SEQ ID NO: 9190) |
| 18182-B6 | NA | AGCTATGCCATGAGC (SEQ ID NO: 7759) | GCTATTAGTGGTAGTGGTGGTGGCACA TACTACGCAGACTCCGTGAAGGGC (SEQ ID NO: 8475) | GGAAAGGGAGTACATCTGGGCTTTGACTAC (SEQ ID NO: 9191) |
| | AA | SYAMS (SEQ ID NO: 7760) | AISGSGGGTYYADSVKG (SEQ ID NO: 8476) | GKGVHLGFDY (SEQ ID NO: 9192) |
| 18182-B7 | NA | AGCTATGCCATGAGC (SEQ ID NO: 7761) | GCTATTAGTGGTAGTGGTGGTGGCACA TACTACGCAGACTCCGTGAAGGGC (SEQ ID NO: 8477) | GGAAAGGGAGTACATCTGGGCTTTGACCAC (SEQ ID NO: 9193) |
| | AA | SYAMS (SEQ ID NO: 7762) | AISGSGGGTYYADSVKG (SEQ ID NO: 8478) | GKGVHLGFDH (SEQ ID NO: 9194) |

TABLE 56-continued scFv VH CDRs

| Ab | Type | CDR1 | CDR2 | CDR3 |
|---|---|---|---|---|
| 18182-B10 | NA | AGCTATGCCATGAAC (SEQ ID NO: 7763) | GCTATTAGTGGTAGTGGTGGTGGCACT TACTACGCAGACTCCGTGAAGGGC (SEQ ID NO: 8479) | GGAAAGGGAGTACATCTGAACTTTGACTAC (SEQ ID NO: 9195) |
| | AA | SYAMN (SEQ ID NO: 7764) | AISGSGGGTYYADSVKG (SEQ ID NO: 8480) | GKGVHLNFDY (SEQ ID NO: 9196) |
| 18182-C2 | NA | AGCTATGCCATGAGC (SEQ ID NO: 7765) | GCTATTAGTGGAAGTGGTGGTGGCACA TACTACGCAGACTCCGTGAAGGGC (SEQ ID NO: 8481) | GGAAAGGGAGTACATCTGGGCTTTGACTAC (SEQ ID NO: 9197) |
| | AA | SYAMS (SEQ ID NO: 7766) | AISGSGGGTYYADSVKG (SEQ ID NO: 8482) | GKGVHLGFDY (SEQ ID NO: 9198) |
| 18182-C3 | NA | AGCCATGCCATGAGC (SEQ ID NO: 7767) | GCTATTAGTGGAAGTGGTGGTGGCACA TACTACGCAGACTCCGTGAAGGGC (SEQ ID NO: 8483) | GGAAAGGGAGTACATCTGGGCTTTGACTAC (SEQ ID NO: 9199) |
| | AA | SHAMS (SEQ ID NO: 7768) | AISGSGGGTYYADSVKG (SEQ ID NO: 8484) | GKGVHLGFDY (SEQ ID NO: 9200) |
| 18182-C4 | NA | AGCTATGCCATGAGC (SEQ ID NO: 7769) | GCTATTAGTGGAAGTGGTGGTGGCACA TACTACGCAGACTCCGTGAAGGGC (SEQ ID NO: 8485) | GGAAAGGGAGTACATCTGGGCTTTGACTAC (SEQ ID NO: 9201) |
| | AA | SYAMS (SEQ ID NO: 7770) | AISGSGGGTYYADSVKG (SEQ ID NO: 8486) | GKGVHLGFDY (SEQ ID NO: 9202) |
| 18182-C5 | NA | AGCTATGCCATGAGC (SEQ ID NO: 7771) | ACTATTAGTGGTAGTGGTGGTGGCACA TACTACGCAGACTCCGTGAAGGGC (SEQ ID NO: 8487) | GGAAAGGGAGTACATCTGAACTTTGACTAC (SEQ ID NO: 9203) |
| | AA | SYAMS (SEQ ID NO: 7772) | TISGSGGGTYYADSVKG (SEQ ID NO: 8488) | GKGVHLNFDY (SEQ ID NO: 9204) |
| 18182-C10 | NA | AGCTATGCCATGAGC (SEQ ID NO: 7773) | ACTATTAGTGGAAGTGGTGGTGGCACA TACTACGCAGACTCCGTGAAGGGC (SEQ ID NO: 8489) | GGAAAGGGAGTACATCTGGGCTTTGACTAC (SEQ ID NO: 9205) |
| | AA | SYAMS (SEQ ID NO: 7774) | TISGSGGGTYYADSVKG (SEQ ID NO: 8490) | GKGVHLGFDY (SEQ ID NO: 9206) |
| 18182-C12 | NA | AGCTATGCCATGAGC (SEQ ID NO: 7775) | GCTATTAGTGGTAGTGGTGGTGGCACA TACTACGCAGACTCCGGGAAGGGC (SEQ ID NO: 8491) | GGAAAGGGAGTACATCTGGGCTTTGACTAC (SEQ ID NO: 9207) |
| | AA | SYAMS (SEQ ID NO: 7776) | AISGSGGGTYYADSGKG (SEQ ID NO: 8492) | GKGVHLGFDY (SEQ ID NO: 9208) |
| 18182-D4 | NA | AGCTATGCCATGAGC (SEQ ID NO: 7777) | ACTATTAGTGGTAGTGGTGGTGGCACA TACTACGCAGACTCCGTGAAGGGC (SEQ ID NO: 8493) | GGAAAGGGAGTACATCTGAACTTTGACTAC (SEQ ID NO: 9209) |
| | AA | SYAMS (SEQ ID NO: 7778) | TISGSGGGTYYADSVKG (SEQ ID NO: 8494) | GKGVHLNFDY (SEQ ID NO: 9210) |
| 18182-D8 | NA | AGCTATGCCATGAGC (SEQ ID NO: 7779) | GCTATTAGTGGAAGTGGTGGTGGCACA TACTACGCAGACTCCGTGAAGGGC (SEQ ID NO: 8495) | GGAAAGGGAGTACATCTGGGCTTTGACTAC (SEQ ID NO: 9211) |
| | AA | SYAMS (SEQ ID NO: 7780) | AISGSGGGTYYADSVKG (SEQ ID NO: 8496) | GKGVHLGFDY (SEQ ID NO: 9212) |
| 18182-D9 | NA | AGCTATGCCATGAGC (SEQ ID NO: 7781) | ACTATTAGTGGTAGTGGTGGTGGCACA TACTACGCAGACTCCGTGAAGGGC (SEQ ID NO: 8497) | GGAAAGGGAGTACATCTGAACTTTGACTAC (SEQ ID NO: 9213) |
| | AA | SYAMS (SEQ ID NO: 7782) | TISGSGGGTYYADSVKG (SEQ ID NO: 8498) | GKGVHLNFDY (SEQ ID NO: 9214) |
| 18182-D11 | NA | AGCTATGCCATGAAC (SEQ ID NO: 7783) | GCTATTAGTGGTAGTGGTGGTGGCACT TACTACGCAGACTCCGTGAAGGGC (SEQ ID NO: 8499) | GGAAAGGGAGTACATCTGAACTTTGACTAC (SEQ ID NO: 9215) |
| | AA | SYAMN (SEQ ID NO: 7784) | AISGSGGGTYYADSVKG (SEQ ID NO: 8500) | GKGVHLNFDY (SEQ ID NO: 9216) |
| 18182-E2 | NA | AGCTATGCCATGAGC (SEQ ID NO: 7785) | GCTATTAGTGGTAGTGGTGGTGGCACA TACTACGCAGACTCCGTGAAGGGC (SEQ ID NO: 8501) | GGAAAGGGAGTACATCTGGGCTTTGACTAC (SEQ ID NO: 9217) |
| | AA | SYAMS (SEQ ID NO: 7786) | AISGSGGGTYYADSVKG (SEQ ID NO: 8502) | GKGVHLGFDY (SEQ ID NO: 9218) |

TABLE 56-continued scFv VH CDRs

| Ab | Type | CDR1 | CDR2 | CDR3 |
|---|---|---|---|---|
| 18182-E3 | NA | AGCTATGCCATGAGC (SEQ ID NO: 7787) | GCTATTAGTGGTAGTGGTGGTGGCACA TACTACGCAGACTCCGTGAAGGGC (SEQ ID NO: 8503) | GGAAAGGGAGTACATCTGGGCTTTGACTAC (SEQ ID NO: 9219) |
| | AA | SYAMS (SEQ ID NO: 7788) | AISGSGGGTYYADSVKG (SEQ ID NO: 8504) | GKGVHLGFDY (SEQ ID NO: 9220) |
| 18182-E8 | NA | AGCTATGCCATGAGC (SEQ ID NO: 7789) | GCTATTAGTGGAAGTGGTGGTGGCACA TACTACGCAGACTCCGTGAAGGGC (SEQ ID NO: 8505) | GGAAAGGGAGTACATCTGGGCTTTGACTAC (SEQ ID NO: 9221) |
| | AA | SYAMS (SEQ ID NO: 7790) | AISGSGGGTYYADSVKG (SEQ ID NO: 8506) | GKGVHLGFDY (SEQ ID NO: 9222) |
| 18182-E11 | NA | AGCTATGCCATGAGC (SEQ ID NO: 7791) | GCTATTAGTGGTAGTGGTGGTGGCACA TACTACGCAGACTCCGTGAAGGCC (SEQ ID NO: 8507) | GGAAAGGGAGTACATCTGGGCTTTGACTAC (SEQ ID NO: 9223) |
| | AA | SYAMS (SEQ ID NO: 7792) | AISGSGGGTYYADSVKA (SEQ ID NO: 8508) | GKGVHLGFDY (SEQ ID NO: 9224) |
| 18182-F1 | NA | AGCTATGCCATGAGC (SEQ ID NO: 7793) | GCTATTAGTGGAAGTGGTGGTGGCACA TACTACGCAGACTCCGTGAAGGGC (SEQ ID NO: 8509) | GGAAAGGGAGTACATCTGAACTTTGACTAC (SEQ ID NO: 9225) |
| | AA | SYAMS (SEQ ID NO: 7794) | AISGSGGGTYYADSVKG (SEQ ID NO: 8510) | GKGVHLNFDY (SEQ ID NO: 9226) |
| 18182-F6 | NA | AGCTATGCCATGAGC (SEQ ID NO: 7795) | GCTATTAGTGGTAGTGGTGGTGGCACA TACTACGCAGACTCCGTGAAGGGC (SEQ ID NO: 8511) | GGAAAGGGAGTACATCTGAACTTTGACTAC (SEQ ID NO: 9227) |
| | AA | SYAMS (SEQ ID NO: 7796) | AISGSGGGTYYADSVKG (SEQ ID NO: 8512) | GKGVHLNFDY (SEQ ID NO: 9228) |
| 18182-F8 | NA | AGCTATGCCATGAGC (SEQ ID NO: 7797) | ACTATTAGTGGTAGTGGTGGTGGCACA TACTACGCAGACTCCGTGAAGGGC (SEQ ID NO: 8513) | GGAAAGGGAGTACATCTGGGCTTTGACTAC (SEQ ID NO: 9229) |
| | AA | SYAMS (SEQ ID NO: 7798) | TISGSGGGTYYADSVKG (SEQ ID NO: 8514) | GKGVHLGFDY (SEQ ID NO: 9230) |
| 18182-G3 | NA | AGCTATGCCATGCAC (SEQ ID NO: 7799) | GCTATTAGTGGAAGTGGTGGTGGCACA TACTACGCAGACTCCGTGAAGGGC (SEQ ID NO: 8515) | GGAAAGGGAGTACATCTGGGCTTTGACTAC (SEQ ID NO: 9231) |
| | AA | SYAMH (SEQ ID NO: 7800) | AISGSGGGTYYADSVKG (SEQ ID NO: 8516) | GKGVHLGFDY (SEQ ID NO: 9232) |
| 18182-G4 | NA | AGCTATGCCATGACC (SEQ ID NO: 7801) | GCTATTAGTGGTAGTGGTGGTGGCAC TTACTACGCAGACTCCGTGAAGGGC (SEQ ID NO: 8517) | GGAAAGGGAGTACATCTGGGCTTTGACTAC (SEQ ID NO: 9233) |
| | AA | SYAMT (SEQ ID NO: 7802) | AISGSGGGTYYADSVKG (SEQ ID NO: 8518) | GKGVHLGFDY (SEQ ID NO: 9234) |
| 18182-G5 | NA | AGCTATGCCATGAGC (SEQ ID NO: 7803) | GCTATTAGTGGTAGTGGTGGTGGCACA TACAACGCAGACTCCGTGAAGGGC (SEQ ID NO: 8519) | GGAAAGGGAGTACATCTGGGCTTTGACTAC (SEQ ID NO: 9235) |
| | AA | SYAMS (SEQ ID NO: 7804) | AISGSGGGTYNADSVKG (SEQ ID NO: 8520) | GKGVHLGFDY (SEQ ID NO: 9236) |
| 18182-G9 | NA | AGCTATGCCATGAGC (SEQ ID NO: 7805) | GCTATTAGTGGAAGTGGTGGTGGCACA TACTACGCAGACTCCGTGAAGGGC (SEQ ID NO: 8521) | GGAAAGGGAGTACATCTGGGCTTTGACTAC (SEQ ID NO: 9237) |
| | AA | SYAMS (SEQ ID NO: 7806) | AISGSGGGTYYADSVKG (SEQ ID NO: 8522) | GKGVHLGFDY (SEQ ID NO: 9238) |
| 18182-G11 | NA | AGCTATGCCATGAGC (SEQ ID NO: 7807) | GCTATTAGTGGTAGTGGTGGTGGCACA TACTACGCAGACTCCGTGAAGGCC (SEQ ID NO: 8523) | GGAAAGGGAGTACATCTGGGCTTTGACTAC (SEQ ID NO: 9239) |
| | AA | SYAMS (SEQ ID NO: 7808) | AISGSGGGTYYADSVKA (SEQ ID NO: 8524) | GKGVHLGFDY (SEQ ID NO: 9240) |
| 18182-H5 | NA | AGCCATGCCATGAGC (SEQ ID NO: 7809) | GCTATTAGTGGTAGTGGTGGTGGCACA TACAACGCAGACTCCGTGAAGGGC (SEQ ID NO: 8525) | GGAAAGGGAGTACATCTGGGCTTTGACTAC (SEQ ID NO: 9241) |
| | AA | SHAMS (SEQ ID NO: 7810) | AISGSGGGTYNADSVKG (SEQ ID NO: 8526) | GKGVHLGFDY (SEQ ID NO: 9242) |
| 18089-D12 | NA | ACCTATGGCATGCAC (SEQ ID NO: 7811) | GTTATATCATATGATGGAAGTAATAAA TACTATGCAGACTCCGTGAAGGGC (SEQ ID NO: 8527) | GGGCAGCTGCTGACTGGGTAC (SEQ ID NO: 9243) |

TABLE 56-continued scFv VH CDRs

| Ab | Type | CDR1 | CDR2 | CDR3 |
|---|---|---|---|---|
| | AA | TYGMH<br>(SEQ ID NO: 7812) | VISYDGSNKYYADSVKG<br>(SEQ ID NO: 8528) | GQLLTGY<br>(SEQ ID NO: 9244) |
| 18179-G12 | NA | AGGAATGGTCTCAGC<br>(SEQ ID NO: 7813) | TGGATCAGCGGTTACAATGGTGACACA<br>AACTATGCACAGAAGCTCCAGGGC<br>(SEQ ID NO: 8529) | GGAAGGGCTACTTTTGACTAC<br>(SEQ ID NO: 9245) |
| | AA | RNGLS<br>(SEQ ID NO: 7814) | WISGYNGDTNYAQKLQG<br>(SEQ ID NO: 8530) | GRATFDY<br>(SEQ ID NO: 9246) |
| 18179-C1 | NA | AGGAATGGTCTCAGC<br>(SEQ ID NO: 7815) | TGGATCAGCGGTTACAATGGTGACACA<br>AACTATGCACAGAAGCTCCAGGGC<br>(SEQ ID NO: 8531) | GGAAGGGCTACTTTTGACTAC<br>(SEQ ID NO: 9247) |
| | AA | RNGLS<br>(SEQ ID NO: 7816) | WISGYNGDTNYAQKLQG<br>(SEQ ID NO: 8532) | GRATFDY<br>(SEQ ID NO: 9248) |
| 18093-B11 | NA | GACTACTACATGAGC<br>(SEQ ID NO: 7817) | TACATTAGTAAAAGTGGTAGTACCATA<br>TACTACGCAGACTCTGTGAAGGGC<br>(SEQ ID NO: 8533) | TACAACTATGGTCACTTTGACTAC<br>(SEQ ID NO: 9249) |
| | AA | DYYMS<br>(SEQ ID NO: 7818) | YISKSGSTIYYADSVKG<br>(SEQ ID NO: 8534) | YNYGHFDY<br>(SEQ ID NO: 9250) |
| 18182-B5 | NA | AGCCATGCCATGAGC<br>(SEQ ID NO: 7819) | GCTATTAGTGGAAGTGGTGGTGGCACA<br>TACTACGCAGACTCCGTGAAGGGC<br>(SEQ ID NO: 8535) | GGAAAGGGAGTACATCTGGGCTTTGACTAC<br>(SEQ ID NO: 9251) |
| | AA | SHAMS<br>(SEQ ID NO: 7820) | AISGSGGGTYYADSVKG<br>(SEQ ID NO: 8536) | GKGVHLGFDY<br>(SEQ ID NO: 9252) |
| 18182-H9 | NA | AGCCATGCCATGAGC<br>(SEQ ID NO: 7821) | GCTATTAGTGGTAGTGGTGGTGGCACA<br>TACTACGCAGACTCCGTGAAGGCC<br>(SEQ ID NO: 8537) | GGAAAGGGAGTACATCTGGGCTTTGACTAC<br>(SEQ ID NO: 9253) |
| | AA | SHAMS<br>(SEQ ID NO: 7822) | AISGSGGGTYYADSVKA<br>(SEQ ID NO: 8538) | GKGVHLGFDY<br>(SEQ ID NO: 9254) |
| 18182-E6 | NA | AGCTATGCCATGAGC<br>(SEQ ID NO: 7823) | GCTATTAGTGGAAGTGGTGGTGGCACA<br>TACTACGCAGACTCCGTGAAGGGC<br>(SEQ ID NO: 8539) | GGGAAGGGAGTTCATCTGAACTTTGACTAC<br>(SEQ ID NO: 9255) |
| | AA | SYAMS<br>(SEQ ID NO: 7824) | AISGSGGGTYYADSVKG<br>(SEQ ID NO: 8540) | GKGVHLNFDY<br>(SEQ ID NO: 9256) |
| 18182-G6 | NA | AGCTATGCCATGAGC<br>(SEQ ID NO: 7825) | GCTATTAGTGGTAGTGGTGGTGGCACA<br>TACTACGCAGACTCCGTGAAGGGC<br>(SEQ ID NO: 8541) | GGAAAGGGAGTACATCTGGGCTTTGACTAC<br>(SEQ ID NO: 9257) |
| | AA | SYAMS<br>(SEQ ID NO: 7826) | AISGSGGGTYYADSVKG<br>(SEQ ID NO: 8542) | GKGVHLGFDY<br>(SEQ ID NO: 9258) |
| 18182-G2 | NA | AGCCATGCCATGAGC<br>(SEQ ID NO: 7827) | GCTATTAGTGGTAGTGGTGGTGGCACA<br>TACAACGCAGACTCCGTGAAGGGC<br>(SEQ ID NO: 8543) | GGAAAGGGAGTACATCTGGGCTTTGACTAC<br>(SEQ ID NO: 9259) |
| | AA | SHAMS<br>(SEQ ID NO: 7828) | AISGSGGGTYNADSVKG<br>(SEQ ID NO: 8544) | GKGVHLGFDY<br>(SEQ ID NO: 9260) |
| 18182-H12 | NA | AGCTATGCCATGAGC<br>(SEQ ID NO: 7829) | ACTATTAGTGGAAGTGGTGGTGGCACA<br>TACTACGCAGACTCCGTGAAGGGC<br>(SEQ ID NO: 8545) | GGAAAGGGAGTACATCTGGGCTTTGACTAC<br>(SEQ ID NO: 9261) |
| | AA | SYAMS<br>(SEQ ID NO: 7830) | TISGSGGGTYYADSVKG<br>(SEQ ID NO: 8546) | GKGVHLGFDY<br>(SEQ ID NO: 9262) |
| 18182-G8 | NA | AGCTATGCCATGAAC<br>(SEQ ID NO: 7831) | GCTATTAGTGGTAGTGGTGGTGGCACA<br>TACTACGCAGACTCCGGGAAGGGC<br>(SEQ ID NO: 8547) | GGAAAGGGAGTTCATCTGAACTTTGACTAC<br>(SEQ ID NO: 9263) |
| | AA | SYAMN<br>(SEQ ID NO: 7832) | AISGSGGGTYYADSGKG<br>(SEQ ID NO: 8548) | GKGVHLNFDY<br>(SEQ ID NO: 9264) |
| 18182-E10 | NA | AGCCATGCCATGAGC<br>(SEQ ID NO: 7833) | TCTATTAGTGGTAGCGGTGGTGGCACA<br>TACTACGCAGCCTCCGTGAAGGGC<br>(SEQ ID NO: 8549) | GGAAAGGGAGTACATCTGAACTTTGACTAC<br>(SEQ ID NO: 9265) |
| | AA | SHAMS<br>(SEQ ID NO: 7834) | SISGSGGGTYYAASVKG<br>(SEQ ID NO: 8550) | GKGVHLNFDY<br>(SEQ ID NO: 9266) |
| 18182-B12 | NA | AGCTATGCCATGAGC<br>(SEQ ID NO: 7835) | GCTATTAGTGGAAGTGGTGGTGGCACA<br>TACTACGCAGACTCCGTGAAGGGC<br>(SEQ ID NO: 8551) | GGAAAGGGAGTACATCTGGGCTTTGACTAC<br>(SEQ ID NO: 9267) |
| | AA | SYAMS<br>(SEQ ID NO: 7836) | AISGSGGGTYYADSVKG<br>(SEQ ID NO: 8552) | GKGVHLGFDY<br>(SEQ ID NO: 9268) |

TABLE 56-continued scFv VH CDRs

| Ab | Type | CDR1 | CDR2 | CDR3 |
|---|---|---|---|---|
| 18182-E5 | NA | AGCTATGCCATGAGC (SEQ ID NO: 7837) | ACTATTAGTGGAAGTGGTGGTGGCACA TACTACGCAGACTCCGTGAAGGGC (SEQ ID NO: 8553) | GGAAAGGGAGTACATCTGGGCTTTGACTAC (SEQ ID NO: 9269) |
| | AA | SYAMS (SEQ ID NO: 7838) | TISGSGGGTYYADSVKG (SEQ ID NO: 8554) | GKGVHLGFDY (SEQ ID NO: 9270) |
| 18182-A4 | NA | AGCTATGCCATGACC (SEQ ID NO: 7839) | TCTATTAGTGGTAGTGGTGGTGGCACA TACTACGCAGCCTCCGTGAAGGGC (SEQ ID NO: 8555) | GGAAAGGGAGTACATCTGGGCTTTGACTAC (SEQ ID NO: 9271) |
| | AA | SYAMT (SEQ ID NO: 7840) | SISGSGGGTYYAASVKG (SEQ ID NO: 8556) | GKGVHLGFDY (SEQ ID NO: 9272) |
| 18182-E1 | NA | AGCCATGCCATGAGC (SEQ ID NO: 7841) | GCTATTAGTGGTAGTGGTGGTGGCACA TACAACGCAGACTCCGTGAAGGGC (SEQ ID NO: 8557) | GGAAAGGGAGTACATCTGGGCTTTGACTAC (SEQ ID NO: 9273) |
| | AA | SHAMS (SEQ ID NO: 7842) | AISGSGGGTYNADSVKG (SEQ ID NO: 8558) | GKGVHLGFDY (SEQ ID NO: 9274) |
| 18081-B9 | NA | AGTAGTCGTTACTACTGGGGC (SEQ ID NO: 7843) | AGTATCTATTATAGTGGGAGCACCTAC TACAACCCGTCCCTCAAGAGT (SEQ ID NO: 8559) | GGGATTTTTGGAGTGATTACGTACTTTGAC TAC (SEQ ID NO: 9275) |
| | AA | SSRYYWG (SEQ ID NO: 7844) | SIYYSGSTYYNPSLKS (SEQ ID NO: 8560) | GIFGVITYFDY (SEQ ID NO: 9276) |
| 18081-E7 | NA | AGTAGTCGTTACTACTGGGGC (SEQ ID NO: 7845) | AGTATCTATTATAGTGGGAGCACCTAC TACAACCCGTCCCTCAAGAGT (SEQ ID NO: 8561) | GGGATTTTTGGAGTGATTACGTACTTTGAC TAC (SEQ ID NO: 9277) |
| | AA | SSRYYWG (SEQ ID NO: 7846) | SIYYSGSTYYNPSLKS (SEQ ID NO: 8562) | GIFGVITYFDY (SEQ ID NO: 9278) |
| 18089-D11 | NA | ACTCATAAAATGGGTGTGGAC (SEQ ID NO: 7847) | CTCATTTATTGGAATGATGATAAGCGC TACAACCCATCTCTGCAGAGT (SEQ ID NO: 8563) | AGACGGTATAACTGGAACTACGAGAACTGG TTCGACCCC (SEQ ID NO: 9279) |
| | AA | THKMGVD (SEQ ID NO: 7848) | LIYWNDDKRYNPSLQS (SEQ ID NO: 8564) | RRYNWNYENWFDP (SEQ ID NO: 9280) |
| 18089-C9 | NA | ACTCATAAAATGGGTGTGGAC (SEQ ID NO: 7849) | CTCATTTATTGGAATGATGATAAGCGC TACAGCCCATCTCTGCAGAGT (SEQ ID NO: 8565) | AGACGGTATAACTGGAACTACGAGAACTGG TTCGACCCC (SEQ ID NO: 9281) |
| | AA | THKMGVD (SEQ ID NO: 7850) | LIYWNDDKRYSPSLQS (SEQ ID NO: 8566) | RRYNWNYENWFDP (SEQ ID NO: 9282) |
| 18089-D8 | NA | ACTCATAAAATGGGTGTGGAC (SEQ ID NO: 7851) | CTCATTTATTGGAATGATGATAAGCGC TACAGCCCATCTCTGCAGAGT (SEQ ID NO: 8567) | AGACGGTATAACTGGAACTACGAGAACTGG TTCGACCCC (SEQ ID NO: 9283) |
| | AA | THKMGVD (SEQ ID NO: 7852) | LIYWNDDKRYSPSLQS (SEQ ID NO: 8568) | RRYNWNYENWFDP (SEQ ID NO: 9284) |
| 18081-F9 | NA | ACTCATAAAATGGGTGTGGAC (SEQ ID NO: 7853) | CTCATTTATTGGAATGATGATAAGCGC TACAGCCCATCTCTGCAGAGT (SEQ ID NO: 8569) | AGACGGTATAACTGGAACTACGAGAACTGG TTCGACCCC (SEQ ID NO: 9285) |
| | AA | THKMGVD (SEQ ID NO: 7854) | LIYWNDDKRYSPSLQS (SEQ ID NO: 8570) | RRYNWNYENWFDP (SEQ ID NO: 9286) |
| 18081-H11 | NA | ACTCATAAAATGGGTGTGGAC (SEQ ID NO: 7855) | CTCATTTATTGGAATGATGATAAGCGC TACAGCCCATCTCTGCAGAGT (SEQ ID NO: 8571) | AGACGGTATAACTGGAACTACGAGAACTGG TTCGACCCC (SEQ ID NO: 9287) |
| | AA | THKMGVD (SEQ ID NO: 7856) | LIYWNDDKRYSPSLQS (SEQ ID NO: 8572) | RRYNWNYENWFDP (SEQ ID NO: 9288) |
| 18081-B6 | NA | ACTCATAAAATGGGTGTGGAC (SEQ ID NO: 7857) | CTCATTTATTGGAATGATGATAAGCGC TACAGCCCATCTCTGCAGAGT (SEQ ID NO: 8573) | AGACGGTATAACTGGAACTACGAGAACTGG TTCGACCCC (SEQ ID NO: 9289) |
| | AA | THKMGVD (SEQ ID NO: 7858) | LIYWNDDKRYSPSLQS (SEQ ID NO: 8574) | RRYNWNYENWFDP (SEQ ID NO: 9290) |
| 18089-B2 | NA | TCCTATGCCATGAGC (SEQ ID NO: 7859) | ACTATTAGTATTAGTGGTGGTAGCACA AACTACGCAGACTCCGTGAAGGGC (SEQ ID NO: 8575) | GATGGGGGCAGTGGCTGGTTCCCTAAACTA CTCACACTACGGTCTGGACGTC (SEQ ID NO: 9291) |
| | AA | SYAMS (SEQ ID NO: 7860) | TISISGGSTNYADSVKG (SEQ ID NO: 8576) | DGGSGWFPKLLHYGLDV (SEQ ID NO: 9292) |
| 18179-E1 | NA | AACGCCTGGATGAGC (SEQ ID NO: 7861) | CGTATTAAAGGCAACACTTATGGTGGG ACAACAGACTACGCTGCACCCGTGAAA GGC (SEQ ID NO: 8577) | CCTTCGTATAGTGGGAGCTATTATAATTAC TTCTCCGTTATGGACGTC (SEQ ID NO: 9293) |

TABLE 56-continued scFv VH CDRs

| Ab | Type | CDR1 | CDR2 | CDR3 |
|---|---|---|---|---|
| | AA | NAWMS<br>(SEQ ID NO: 7862) | RIKGNTYGGTTDYAAPVKG<br>(SEQ ID NO: 8578) | PSYSGSYYNYFSVMDV<br>(SEQ ID NO: 9294) |
| 18179-H7 | NA | AACGCCTGGATGAGC<br>(SEQ ID NO: 7863) | CGTATTAAAAGCAAAACTTATGGTGGG<br>ACAACAGACTACGCTGCACCCGTGAAA<br>GGC<br>(SEQ ID NO: 8579) | CCTTCGTATAGTGGGAGCTATTATAATTAC<br>TTCTCCGTTATGGACGTC<br>(SEQ ID NO: 9295) |
| | AA | NAWMS<br>(SEQ ID NO: 7864) | RIKSKTYGGTTDYAAPVKG<br>(SEQ ID NO: 8580) | PSYSGSYYNYFSVMDV<br>(SEQ ID NO: 9296) |
| 18179-B12 | NA | AACGCCTGGATGAGC<br>(SEQ ID NO: 7865) | CGTATTAAAGGCAACACTTATGGTGGG<br>ACAACAGACTACGCTGCACCCGTGAAA<br>GGC<br>(SEQ ID NO: 8581) | CCATCGAATAGTGGGAGCTATTATAATTAC<br>TTCTCCGTTATGGACGTC<br>(SEQ ID NO: 9297) |
| | AA | NAWMS<br>(SEQ ID NO: 7866) | RIKGNTYGGTTDYAAPVKG<br>(SEQ ID NO: 8582) | PSNSGSYYNYFSVMDV<br>(SEQ ID NO: 9298) |
| 18179-D11 | NA | AACGCCTGGATGAGC<br>(SEQ ID NO: 7867) | CGTATTAAAGGCAACACTTATGGTGGG<br>ACAACAGACTACGCTGCACCCGTGAAA<br>GGC<br>(SEQ ID NO: 8583) | CCTTCGTATAGTGGGAGCTATTATAATTAC<br>TTCTCCGTTATGGACGTC<br>(SEQ ID NO: 9299) |
| | AA | NAWMS<br>(SEQ ID NO: 7868) | RIKGNTYGGTTDYAAPVKG<br>(SEQ ID NO: 8584) | PSYSGSYYNYFSVMDV<br>(SEQ ID NO: 9300) |
| 18179-D7 | NA | AACGCCTGGATGAGC<br>(SEQ ID NO: 7869) | CGTATTAAAGGCAACACTTATGGTGGG<br>ACAACAGACTACGCTGCACCCGTGAAA<br>GGC<br>(SEQ ID NO: 8585) | CCTTCGTATAGTGGGAGCTATTATAATTAC<br>TTCTCCGTTATGGACGTC<br>(SEQ ID NO: 9301) |
| | AA | NAWMS<br>(SEQ ID NO: 7870) | RIKGNTYGGTTDYAAPVKG<br>(SEQ ID NO: 8586) | PSYSGSYYNYFSVMDV<br>(SEQ ID NO: 9302) |
| 18179-A7 | NA | AACGCCTGGATGAGC<br>(SEQ ID NO: 7871) | CGTATTAAAGGCAACACTTATGGTGGG<br>ACAACAGACTACGCTGCACCCGTGAAA<br>GGC<br>(SEQ ID NO: 8587) | CCTTCGTATAGTGGGAGCTATTATAATTAC<br>TTCTCCGTTATGGACGTC<br>(SEQ ID NO: 9303) |
| | AA | NAWMS<br>(SEQ ID NO: 7872) | RIKGNTYGGTTDYAAPVKG<br>(SEQ ID NO: 8588) | PSYSGSYYNYFSVMDV<br>(SEQ ID NO: 9304) |
| 18181-H7 | NA | AGTAATCCTTACTACTGGAGC<br>(SEQ ID NO: 7873) | TACATCTCTTACAGTGGGATCACCAAC<br>TACAACCCCTCCCTCAAGAGT<br>(SEQ ID NO: 8589) | GAGAAGATGTGGTTCGGGGTGTTAAACTAC<br>TACTACGGTATGGACGTC<br>(SEQ ID NO: 9305) |
| | AA | SNPYYWS<br>(SEQ ID NO: 7874) | YISYSGITNYNPSLKS<br>(SEQ ID NO: 8590) | EKMWFGVLNYYYGMDV<br>(SEQ ID NO: 9306) |
| 18181-G10 | NA | AGTAATCCTTACTACTGGAGC<br>(SEQ ID NO: 7875) | TACATCTCTTACAGTGGGAGCACCTTC<br>TACAACCCGTCCCTCAAGAGT<br>(SEQ ID NO: 8591) | GATCGTCTTTGGTTCGGAGTGTTAAACTAC<br>TACTACGGTATGGACGTC<br>(SEQ ID NO: 9307) |
| | AA | SNPYYWS<br>(SEQ ID NO: 7876) | YISYSGSTFYNPSLKS<br>(SEQ ID NO: 8592) | DRLWFGVLNYYYGMDV<br>(SEQ ID NO: 9308) |
| 18181-G8 | NA | AACGCCTGGATGAGC<br>(SEQ ID NO: 7877) | CGTATTAAAGGCAACACTTATGGTGGG<br>ACAACAGACTACGCTGCACCCGTGAAA<br>GGC<br>(SEQ ID NO: 8593) | CCATCGAATAGTGGGAGCTATTATAATTAC<br>TTCTCCGTTATGGACGTC<br>(SEQ ID NO: 9309) |
| | AA | NAWMS<br>(SEQ ID NO: 7878) | RIKGNTYGGTTDYAAPVKG<br>(SEQ ID NO: 8594) | PSNSGSYYNYFSVMDV<br>(SEQ ID NO: 9310) |
| 18181-F3 | NA | AACGCCTGGATGAGC<br>(SEQ ID NO: 7879) | CGTATTAAAGGCAACACTTATGGTGGG<br>ACAACAGACTACGCTGCACCCGTGAAA<br>GGC<br>(SEQ ID NO: 8595) | CCTTCGTATAGTGGGAGCTATTATAATTAC<br>TTCTCCGTTATGGACGTC<br>(SEQ ID NO: 9311) |
| | AA | NAWMS<br>(SEQ ID NO: 7880) | RIKGNTYGGTTDYAAPVKG<br>(SEQ ID NO: 8596) | PSYSGSYYNYFSVMDV<br>(SEQ ID NO: 9312) |
| 18181-F1 | NA | AACGCCTGGATGAGC<br>(SEQ ID NO: 7881) | CGTATTAAAGGCAACACTTATGGTGGG<br>ACAACAGACTACGCTGCACCCGTGAAA<br>GGC<br>(SEQ ID NO: 8597) | CCTTCGTATAGTGGGAGCTATTATAATTAC<br>TTCTCCGTTATGGACGTC<br>(SEQ ID NO: 9313) |
| | AA | NAWMS<br>(SEQ ID NO: 7882) | RIKGNTYGGTTDYAAPVKG<br>(SEQ ID NO: 8598) | PSYSGSYYNYFSVMDV<br>(SEQ ID NO: 9314) |
| 18181-E2 | NA | AGTAATCCTTACTACTGGAGC<br>(SEQ ID NO: 7883) | TACATCTCTCACAGTGGGAGCACTTAT<br>TACAATCCGTCCCTCAAGAGT<br>(SEQ ID NO: 8599) | GATCGTCTATGGTTCGGAGTGTTAAACTAC<br>TACTACGGTATGGACGTC<br>(SEQ ID NO: 9315) |
| | AA | SNPYYWS<br>(SEQ ID NO: 7884) | YISHSGSTYYNPSLKS<br>(SEQ ID NO: 8600) | DRLWFGVLNYYYGMDV<br>(SEQ ID NO: 9316) |

TABLE 56-continued scFv VH CDRs

| Ab | Type | CDR1 | CDR2 | CDR3 |
|---|---|---|---|---|
| 18181-C9 | NA | AGTAATCCTTACTACTGGAGC (SEQ ID NO: 7885) | TACATCTCTTACAGTGGGAGCACCTTC TACAACCCGTCCCTCAAGAGT (SEQ ID NO: 8601) | GATCGTCTTTGGTTCGGAGTGTTAAACTAC TACTACGGTATGGACGTC (SEQ ID NO: 9317) |
|  | AA | SNPYYWS (SEQ ID NO: 7886) | YISYSGSTFYNPSLKS (SEQ ID NO: 8602) | DRLWFGVLNYYYGMDV (SEQ ID NO: 9318) |
| 18181-B8 | NA | AGTGGTGGTTACTACTGGAGC (SEQ ID NO: 7887) | TACATCTCTCACAGTGGGAGCACTTAT TACAATCCGTCCCTCAAGAGT (SEQ ID NO: 8603) | GAGAAGATGTGGTTCGGGGTGTTAAACTAC TACTACGGTATGGACGTC (SEQ ID NO: 9319) |
|  | AA | SGGYYWS (SEQ ID NO: 7888) | YISHSGSTYYNPSLKS (SEQ ID NO: 8604) | EKMWFGVLNYYYGMDV (SEQ ID NO: 9320) |
| 18181-A6 | NA | AACGCCTGGATGAGC (SEQ ID NO: 7889) | CGTATTAAAGGCAACACTTATGGTGGG ACAACAGACTACGCTGCACCCGTGAAA GGC (SEQ ID NO: 8605) | CCTTCGTATAGTGGGAGCTATTATAATTAC TTCTCCGTTATGGACGTC (SEQ ID NO: 9321) |
|  | AA | NAWMS (SEQ ID NO: 7890) | RIKGNTYGGTTDYAAPVKG (SEQ ID NO: 8606) | PSYSGSYYNYFSVMDV (SEQ ID NO: 9322) |
| 18403-F12-AS | NA | No nuc. seq available | No nuc. seq available | No nuc. seq available |
|  | AA | SYAMS (SEQ ID NO: 7891) | AISGSGGGTYYAASVKG (SEQ ID NO: 8607) | GKGVHLGFDY (SEQ ID NO: 9323) |
| 18403-G10-AS | NA | No nuc. seq available | No nuc. seq available | No nuc. seq available |
|  | AA | SYAMS (SEQ ID NO: 7892) | AISGSGGGTYYAASVKG (SEQ ID NO: 8608) | GKGVHLGFDY (SEQ ID NO: 9324) |
| 02-C1-86-A4-N-F5_final | NA | No nuc. seq available | No nuc. seq available | No nuc. seq available |
|  | AA | TYGMH (SEQ ID NO: 7893) | VISYDAETVKYAESVKG (SEQ ID NO: 8609) | GQLLTGY (SEQ ID NO: 9325) |
| 03-F3-88-B3-F9_final | NA | No nuc. seq available | No nuc. seq available | No nuc. seq available |
|  | AA | DYYMS (SEQ ID NO: 7894) | YISKSSYTVTYADAVKG (SEQ ID NO: 8610) | YNYGHFDY (SEQ ID NO: 9326) |
| 81-H7-SG-F28_final | NA | No nuc. seq available | No nuc. seq available | No nuc. seq available |
|  | AA | SNPYYWS (SEQ ID NO: 7895) | YISYSGITNYNPSLKS (SEQ ID NO: 8611) | EKMWFGVLNYYYGMDV (SEQ ID NO: 9327) |
| 18081-B9_final | NA | No nuc. seq available | No nuc. seq available | No nuc. seq available |
|  | AA | SSRYYWG (SEQ ID NO: 7896) | SIYYSGSTYYNPSLKS (SEQ ID NO: 8612) | GIFGVITYFDY (SEQ ID NO: 9328) |
| 18398-C7_final | NA | No nuc. seq available | No nuc. seq available | No nuc. seq available |
|  | AA | SHAMS (SEQ ID NO: 7897) | SISGSGGGTYYAASVKG (SEQ ID NO: 8613) | GKGVHLGFDY (SEQ ID NO: 9329) |
| 18403-D8_final | NA | No nuc. seq available | No nuc. seq available | No nuc. seq available |
|  | AA | SHAMS (SEQ ID NO: 7898) | TISGSGGGTYYADSVKG (SEQ ID NO: 8614) | GKGVHLGFDY (SEQ ID NO: 9330) |
| 18403-D8_AS_final | NA | No nuc. seq available | No nuc. seq available | No nuc. seq available |
|  | AP | SHAMS (SEQ ID NO: 7899) | TISGSGGGTYYAASVKG (SEQ ID NO: 8615) | GKGVHLGFDY (SEQ ID NO: 9331) |
| 18403-E11_AS_final | NA | No nuc. seq available | No nuc. seq available | No nuc. seq available |
|  | AP | SHAMS (SEQ ID NO: 7900) | AISGSGGGTYNAASVKG (SEQ ID NO: 8616) | GKGVHLGFDY (SEQ ID NO: 9332) |
| 18403-F12_final | NA | No nuc. seq available | No nuc. seq available | No nuc. seq available |
|  | AA | SYAMS (SEQ ID NO: 7901) | AISGSGGGTYYADSVKG (SEQ ID NO: 8617) | GKGVHLGFDY (SEQ ID NO: 9333) |
| 18403-F12-AS_final | NA | No nuc. seq available | No nuc. seq available | No nuc. seq available |
|  | AA | SYAMS (SEQ ID NO: 7902) | AISGSGGGTYYAASVKG (SEQ ID NO: 8618) | GKGVHLGFDY (SEQ ID NO: 9334) |
| 18403-G10_final | NA | No nuc. seq available | No nuc. seq available | No nuc. seq available |
|  | AA | SYAMS (SEQ ID NO: 7903) | AISGSGGGTYYADSVKG (SEQ ID NO: 8619) | GKGVHLGFDY (SEQ ID NO: 9335) |
| 18403-G10-AS_final | NA | No nuc. seq available | No nuc. seq available | No nuc. seq available |
|  | AA | SYAMS (SEQ ID NO: 7904) | AISGSGGGTYYAASVKG (SEQ ID NO: 8620) | GKGVHLGFDY (SEQ ID NO: 9336) |

TABLE 56-continued scFv VH CDRs

| Ab | Type | CDR1 | CDR2 | CDR3 |
|---|---|---|---|---|
| 18409-E2_final | NA<br>AA | No nuc. seq available<br>NAWMS<br>(SEQ ID NO: 7905) | No nuc. seq available<br>RIKSKTYGGTTDYAAPVKG<br>(SEQ ID NO: 8621) | No nuc. seq available<br>PSYSGSYYNYFSVMDV<br>(SEQ ID NO: 9337) |
| 18409-F12_final | NA<br>AA | No nuc. seq available<br>THKMGVD<br>(SEQ ID NO: 7906) | No nuc. seq available<br>LIYWNDDKRYSPSLQS<br>(SEQ ID NO: 8622) | No nuc. seq available<br>RRYNWNYENWFDP<br>(SEQ ID NO: 9338) |
| 18409-G10_final | NA<br>AA | No nuc. seq available<br>THKMGVD<br>(SEQ ID NO: 7907) | No nuc. seq available<br>GIHIYDDKRYSPSLQS<br>(SEQ ID NO: 8623) | No nuc. seq available<br>RRYNWNYENWFDP<br>(SEQ ID NO: 9339) |
| 18409-H7_final | NA<br>AA | No nuc. seq available<br>THKMGVD<br>(SEQ ID NO: 7908) | No nuc. seq available<br>LIYWNDDKRYSPSLQS<br>(SEQ ID NO: 8624) | No nuc. seq available<br>RRYNWNYENWFDP<br>(SEQ ID NO: 9340) |
| 18409-H10_final | NA<br>AA | No nuc. seq available<br>THKMGVD<br>(SEQ ID NO: 7909) | No nuc. seq available<br>LIYWNDDKRYSPSLQS<br>(SEQ ID NO: 8625) | No nuc. seq available<br>RRYNWNYENWFDP<br>(SEQ ID NO: 9341) |
| 18410-B5_final | NA<br>AA | No nuc. seq available<br>NAWMS<br>(SEQ ID NO: 7910) | No nuc. seq available<br>RIRSRSYGGTTDYAAPVKG<br>(SEQ ID NO: 8626) | No nuc. seq available<br>PSYSGSYYNYFSVMDV<br>(SEQ ID NO: 9342) |
| 18410-B6_final | NA<br>AA | No nuc. seq available<br>NAWMS<br>(SEQ ID NO: 7911) | No nuc. seq available<br>RIKSKTYGGTTDYAAPVKG<br>(SEQ ID NO: 8627) | No nuc. seq available<br>PSYSGSYYNYFSVMDV<br>(SEQ ID NO: 9343) |
| 18410-D3_final | NA<br>AA | No nuc. seq available<br>NAWMS<br>(SEQ ID NO: 7912) | No nuc. seq available<br>RITSSRYGGTTDYAAPVKG<br>(SEQ ID NO: 8628) | No nuc. seq available<br>PSYSGSYYNYFSVMDV<br>(SEQ ID NO: 9344) |
| 18410-D6_final | NA<br>AA | No nuc. seq available<br>NAWMS<br>(SEQ ID NO: 7913) | No nuc. seq available<br>RILNNAYGGTTDYAAPVKG<br>(SEQ ID NO: 8629) | No nuc. seq available<br>PSYSGSYYNYFSVMDV<br>(SEQ ID NO: 9345) |
| 18410-G10_final | NA<br>AA | No nuc. seq available<br>SHAMS<br>(SEQ ID NO: 7914) | No nuc. seq available<br>AISGSGGGTYNADSVKG<br>(SEQ ID NO: 8630) | No nuc. seq available<br>GKGVHLGFDY<br>(SEQ ID NO: 9346) |
| 18410-G10_AS_final | NA<br>AA | No nuc. seq available<br>SHAMS<br>(SEQ ID NO: 7915) | No nuc. seq available<br>AISGSGGGTYNAASVKG<br>(SEQ ID NO: 8631) | No nuc. seq available<br>GKGVHLGFDY<br>(SEQ ID NO: 9347) |
| 18410-H1_final | NA<br>AA | No nuc. seq available<br>NAWMS<br>(SEQ ID NO: 7916) | No nuc. seq available<br>RITSGIYGGTTDYAAPVKG<br>(SEQ ID NO: 8632) | No nuc. seq available<br>PSYSGSYYNYFSVMDV<br>(SEQ ID NO: 9348) |
| 18410-H3_final | NA<br>AA | No nuc. seq available<br>NAWMS<br>(SEQ ID NO: 7917) | No nuc. seq available<br>RIRSRPYGGTTDYAAPVKG<br>(SEQ ID NO: 8633) | No nuc. seq available<br>PSYSGSYYNYFSVMDV<br>(SEQ ID NO: 9349) |
| 18486-A4_final | NA<br>AA | No nuc. seq available<br>TYGMH<br>(SEQ ID NO: 7918) | No nuc. seq available<br>VISYDASNKYYAESVKG<br>(SEQ ID NO: 8634) | No nuc. seq available<br>GQLLTGY<br>(SEQ ID NO: 9350) |

TABLE 57 scFv Variable Region Sequences

| Ab | Type | LC V-region | HC V-region |
|---|---|---|---|
| 17724-C9 | NA | GAGCTCGTGATGACACAGTCTCCATCCTCCCTAG<br>CTGTGTCCGTTGGAGAGAAAATTACTATGAGCTG<br>CAAGTCCAGTCAGAGCCTTTTATATAGTAGCAAT<br>CAAAAGAACTACTTGGCCTGGTACCAGCAGAAAC<br>CAGGGCAGTCTCCTAAACTGCTGATTTACTGGGC<br>ATCCACTAGGGAATCTGGGTCCCTGATCGCTTC<br>ACAGGCAGTGGATCTGGGACAGATTTCACTCTCA<br>CCATCAGCAGTGTGAAG<br>(SEQ ID NO: 9351) | GAGGTGCAGCTGCTCGAGCAGTCTGGACCTGAGCT<br>GGTGAAGCCTGGGGCCTCAGTGAAGATTTCCTGCA<br>AGGCTTCTGGCTACGCATTCAGTAAGTCCTGGATG<br>AACTGGGTGAAGCAGAGGCCTGGAAAGGGTCTTGA<br>GTGGATTGGACGGATTTATCCTGGAGATGGAGATA<br>CTAACTACAATGGGAAGTTCAAGGGCAAGGCCGCA<br>CTGACTGCAGACAAATCCTCCAACACAGCCAACAT<br>GCAACTCAAC<br>(SEQ ID NO: 9709) |

TABLE 57-continued scFv Variable Region Sequences

| Ab | Type | LC V-region | HC V-region |
|---|---|---|---|
| | AA | ELVMTQSPSSLAVSVGEKITMSCKSSQSLLYSSN<br>QKNYLAWYQQKPGQSPKLLIYWASTRESGVPDRF<br>TGSGSGTDFTLTISSVKAEDLAVYYCQQYYSYPY<br>TFGGGTKLELK<br>(SEQ ID NO: 9352) | EVQLLEQSGPELVKPGASVKISCKASGYAFSKSWM<br>NWVKQRPGKGLEWIGRIYPGDGDTNYNGKEKGKAA<br>LTADKSSNTANMQLNSLTSEDSAVYFCARDGVFYA<br>PLAYWGQGTLVTVSS<br>(SEQ ID NO: 9710) |
| 17724-G6 | NA | GAGCTCGTGCTCACCCAGTCTCCAGCAATCATGT<br>CTGCATCTCCAGGGCAGAAAGTCACCATAACCTG<br>CAGTGCCAGCTCAAATGTAAATTACATACACTGG<br>TACCAGCAGAAGCTAGGATCCTCCCCCAAACTCT<br>GGATTTATGACACATCCAAACTGGCTCCTGGAGT<br>CCCTGCTCGCTTCAGTGGCAGTGGGTCTGGGACC<br>TCTTACTCTCTCACAATCAGCAGCATGGAGGCTG<br>AAGATGCTGCCTCTTAT<br>(SEQ ID NO: 9353) | GAGGTGCAGCTGCTCGAGCAGTCTGGACCTGAGTT<br>GGTGAAGCCTGGGGCCTCAGTGAAGATTTCCTGCA<br>AGGCTTCTGACTACACATTCAGTAAGTCCTGGATG<br>AACTGGGTGAAGCAGAGGCCTGGAGAGGGTCTTGA<br>GTGGATTGGACGTGTTTGGCCTGGAGATGGAGATA<br>CTACGTACAATGAGAAGTTCAAGGGCAAGGCCACA<br>CTGACTGCAGACAAATCCTCCAGGACAGCCTACAT<br>GCAACTCAGC<br>(SEQ ID NO: 9711) |
| | AA | ELVLTQSPAIMSASPGQKVTITCSASSNVNYIHW<br>YQQKLGSSPKLWIYDTSKLAPGVPARFSGSGSGT<br>SYSLTISSMEAEDAASYFCHQWSSYPPTFGSGTK<br>LEIK<br>(SEQ ID NO: 9354) | EVQLLEQSGPELVKPGASVKISCKASDYTFSKSWM<br>NWVKQRPGEGLEWIGRVWPGDGDTTYNEKFKGKAT<br>LTADKSSRTAYMQLSSLTSEDSAVYFCARGNYFGS<br>SEAYFDYWGQGTRVTVSS<br>(SEQ ID NO: 9712) |
| 17731-H8 | NA | GAGCTCCAGATGACCCAGTCTCCAGCCTCCCTAT<br>CTGCATCTGTGGGAGAAACTGTCACCATCACATG<br>TCGAGCAAGTGGGAATATTCACAATTATTTAGCT<br>TGGTATCAGCAGAAACAGGGAAAATCTCCTCAGC<br>TCCTGGTCTATAATGCAAAAACCTTAGCAGGAGG<br>TGTGCCATCAAGGTTCAGTGGCAGTGGATCAGGC<br>ACACAGTTTTCTCTGAAGATCAACAGCCTGCAGC<br>CTGAAGATTTTGGGAGT<br>(SEQ ID NO: 9355) | GAGGTGCAGCTGCTCGAGCAGTCTGGACCTGAGCT<br>GGTGAAGCCTGGGGCCTCAGTGAAGATTTCCTGCA<br>AGGCTTCTGGCTACGCATTCAGTAGCTCCTGGATG<br>AACTGGGTGAAGCAGAGGCCTGGAAAGGGTCTTGA<br>GTGGATTGGACGGATTTATCCTGGAGATGGAGATA<br>CTAACTACAATGGGAAGTTCAAGGACAAGGCCACA<br>CTGACTGCAGACAAATCCTCCAACACAGCCTACAT<br>GCAACTCAGC<br>(SEQ ID NO: 9713) |
| | AA | ELQMTQSPASLSASVGETVTITCRASGNIHNYLA<br>WYQQKQGKSPQLLVYNAKTLAGGVPSRFSGSGSG<br>TQFSLKINSLQPEDFGSYYCQHHYGTPLTFGAGT<br>KLELK<br>(SEQ ID NO: 9356) | EVQLLEQSGPELVKPGASVKISCKASGYAFSSSWM<br>NWVKQRPGKGLEWIGRIYPGDGDTNYNGKFKDKAT<br>LTADKSSNTAYMQLSSLTSEDSAVYFCARRQLNHV<br>FAMDYWGQGTSVTVSS<br>(SEQ ID NO: 9714) |
| 17732-A8 | NA | GAGCTCGTGATGACCCAGTCTCCACTCTCCCTGC<br>CCGTCTCCCCTGGGAGAGCCGGCCTCCATCTCCTG<br>CAGGTCTAGTCAGAGCCTCCTGTATAGTAATGGA<br>TACAACTATGTGGATTGGTACTTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAAAGTGGAGGCT<br>(SEQ ID NO: 9357) | GAGGTGCAGCTGCTCGAGTCTGGAGCAGAGGTGAA<br>AAAGCCTGGGGCCTCAGTGAAGGTCTCCTGCAAGG<br>CTTCTGGATACACCTTCACCAGTTATGATATCAAC<br>TGGGTGCGACAGGCCACTGGACAAGGGCTTGAGTG<br>GATGGGATGGATGAACCCTAACAGTGGTAACACAG<br>GCTATGCACAGAAGTTCCAGGGCAGAGTCACCATG<br>ACCAGGAACACCTCCATAAGCACAGCCTACATGGA<br>GCTGAGCAGC<br>(SEQ ID NO: 9715) |
| | AA | ELVMTQSPLSLPVSPGEPASISCRSSQSLLYSNG<br>YNYVDWYLQKPGQSPQLLIYLGSNRASGVPDRFS<br>GSGSGTDFTLKISKVEAEDVGVYYCMQALQTPPT<br>FGQGTRLEIK<br>(SEQ ID NO: 9358) | EVQLLESGAEVKKPGASVKVSCKASGYTFTSYDIN<br>WVRQATGQGLEWMGWMNPNSGNTGYAQKFQGRVTM<br>TRNTSISTAYMELSSLRSEDTAVYYCARGGGYSNG<br>YDYGMDVWGQGTTVTVSS<br>(SEQ ID NO: 9716) |
| 17745-E5 | NA | GAGCTCGTGATGACCCAGTCTCCACTCTCCCTGC<br>CCGTCACCCCTGGAGAGCCGGCCTCCATCTCCTG<br>CAGGTCTAGTCAGAGCCTCCTGTATAGTAATGGA<br>TACCACTATTTGGATTGGTACCTGCAGAAGCCAG<br>GACAGTCTCCACAGCTCCTGATCTATTTGGGTTC<br>TATCCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9359) | GAGGTGCAGCTGCTCGAGTCTGGAGCTGAGGTGAA<br>GAAGCCTGGGGCCTCAGTGAAGGTCTCCTGCAAGG<br>CTTCTGGATACACCTTCACCAGTTATGATATCAAC<br>TGGGTGCGACAGGCCACTGGACAAGGGCTTGAGTG<br>GATGGGATGGATGAACCCTAACAGTGGTAACACAG<br>GCTATGCACAGAAGTTCCAGGGCAGAGTCACCATG<br>ACCAGGAACACCTCCATAAGCACAGCCTACATGGA<br>GCTGAGCAGC<br>(SEQ ID NO: 9717) |
| | AA | ELVMTQSPLSLPVTPGEPASISCRSSQSLLYSNG<br>YHYLDWYLQKPGQSPQLLIYLGSIRASGVPDRES<br>GSGSGTDFTLKISRVEAEDVGVYYCMQPLQTPPT<br>FGPGTKLEIK<br>(SEQ ID NO: 9360) | EVQLLESGAEVKKPGASVKVSCKASGYTFTSYDIN<br>WVRQATGQGLEWMGWMNPNSGNTGYAQKFQGRVTM<br>TRNTSISTAYMELSSLRSEDTAVYYCARGGGYSYG<br>YDYGMDVWGQGTTVTVSS<br>(SEQ ID NO: 9718) |
| 17745-E8 | NA | GAGCTCGTGATGACCCAGACTCCACTCTCCCTGC<br>CCGTCATCCCTGGAGAGCCGGCCTCCATCTCCTG<br>CAGGTCTAGTCAGAGCCTCCTGTATAGTAATGGA<br>TACAACTATTTGGATTGGTACCTGCAGAAGCCAG<br>GGCAGTCTCCACAGCTCCTGATCTATTTGGGTTC<br>TAAGCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9361) | GAGGTGCAGCTGCTCGAGTGGGCGCAGGACTGTT<br>GAAGCCTTCGGAGACCCTGTCCCTCACCTGCGCTG<br>TCTATGGTGGGTCCTTCAGTGGTTACTACTGGAAC<br>TGGATCCGCCAGCCCCCAGGGAAGGGGCTGGAGTG<br>GATTGGGGAAATCAGTCATAGTGGAAGCACCAACT<br>ACAACCCGTCCCTCAAGAGTCGAGTCAGCATATCA<br>GGAGACACGTCCAAGAACCAGTTCTCCCTGAAGCT<br>GAGCTCTGTG<br>(SEQ ID NO: 9719) |

TABLE 57-continued scFv Variable Region Sequences

| Ab | Type | LC V-region | HC V-region |
|---|---|---|---|
| | AA | ELVMTQTPLSLPVIPGEPASISCRSSQSLLYSNG YNYLDWYLQKPGQSPQLLIYLGSKRASGVPDRFS GSGSGTDFTLKISRVEAEDVGVYYCMQGTHWPRT FGQGTKVEIK (SEQ ID NO: 9362) | EVQLLEWGAGLLKPSETLSLTCAVGGSFSGYYWN WIRQPPGKGLEWIGEISHSGSTNYNPSLKSRVSIS GDTSKNQFSLKLSSVTAADTAVYYCARGGGYSHGY DYGMDVWGQGTTVTSS (SEQ ID NO: 9720) |
| 17745-G8 | NA | GAGCTCACACTCACGCAGTCTCCAGGCACCCTGT CTTTGTCTCCAGGGGAAAGAGCCACCCTCTCCTG CAGGGCCAGTCAGAGTGTTAGCAGCAGCTACTTA GCCTGGTACCAGCAGAAACCTGGCCAGGCTCCCA GGCTCCTCATCTATGGTGCATCCAGCAGGGCCAC TGGCATCCCAGACAGGTTCAGTGGCAGTGGGTCT GGGACAGACTTCACTCTCACAATCAGCAGACTGG AGCCTGAAGATTTTGCA (SEQ ID NO: 9363) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGTAGTGGTGATATCACAT ACTACGCAGACTCCGTGAAGGGCCGGTTCACCATC TCCAGACAATTCCAAGAACACGCTGTATCTGCA AATGAACAGC (SEQ ID NO: 9721) |
| | AA | ELTLTQSPGTLSLSPGERATLSCRASQSVSSSYL AWYQQKPGQAPRLLIYGASSRATGIPDRFSGSGS GTDFTLTISRLEPEDFAVYYCQQYGRSLFTFGPG TKVDIK (SEQ ID NO: 9364) | EVQLLESGGGLVQPGGSLRLSCAASGFTFSSYAMS WVRQAPGKGLEWVSAISGSGDITYYADSVKGRFTI SRDNSKNTLYLQMNSLRAEDTAVYYCAKHLRYFDW PLDYWGQGTLVTVSS (SEQ ID NO: 9722) |
| 17748-D12 | NA | GAGCTCGTGTTGACGCAGTCTCCAGGCACCCTGT CTTTGTCTCCAGGGGAAAGAGCCACCCTCTCCTG CAGGGCCAGTCAGAGTGTTAGCAGCAGCTACTTA GCCTGGTACCAGCAGAAACCTGGCCAGGCTCCCA GGCTCCTCATCTATGGTGCATCCAGCAGGGCCAC TGGCATCCCAGACAGGTTCAGTGGCAGTGGGTCT GGGACAGACTTCACTCTCACCATCAGCAGACTGG AGCCTGAAGATTTTGCA (SEQ ID NO: 9365) | GAGGTGCAGCTGCTCGAGTCCGGGGGAGGCGTGGT CCAGCCTGGGAGGTCCCTGAGACTCTCCTGTGCAG CCTCTGGATTCACCTTCCGTAGCTATCGCATGCAC TGGGTCCGCCAGGCTCCAGGCAAGGGGCTGGAGTG GGTGGCAGTTATATCATATGATGGAGGTAATAAAT ACTATGCAGACTCCGTGAAGGGCCGATTCACCATC TCCAGAGACAATTCCAAGAACACGCTGTATCTGCA AATGAACAGC (SEQ ID NO: 9723) |
| | AA | ELVLTQSPGTLSLSPGERATLSCRASQSVSSSYL AWYQQKPGQAPRLLIYGASSRATGIPDRFSGSGS GTDFTLTISRLEPEDFAVYYCQQYGSSPLTFGGG TKLEIK (SEQ ID NO: 9366) | EVQLLESGGGVVQPGRSLRLSCAASGFTFRSYRMH WVRQAPGKGLEWVAVISYDGGNKYYADSVKGRFTI SRDNSKNTLYLQMNSLRAEDTAVYYCAREQWPNYY YGMDVWGQGTTVTVSS (SEQ ID NO: 9724) |
| 17753-F4 | NA | GAGCTCGTGATGACCCAGTCTCCACTCTCCCTGC CCGTCACCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9367) | GAGGTGCAGCTGCTCGAGTGGGCGCAGGACTGTT GAAGCCTTCGGAGACCCTGTCCCTCACCTGCGCTG TCTATGGTGGGTCCTTCAGTGGTTACTACTGGAAC TGGATCCGCCAGCCCCCAGGGAAGGGGCTGGAGTG GATTGGGGAAATCAATCATAGTGGAAGCACCAACT ACAACCCGTCCCTCAAGAGTCGAGTCACCATATCA GTAGACACGTCCAAGAACCAGTTCTCCCTGAAGCT GAGCTCTGTG (SEQ ID NO: 9725) |
| | AA | ELVMTQSPLSLPVTPGEPASISCRSSQSLLYSNG YNYLDWYLQKPGQSPQLLIYLGSNRASGVPDRFS GSGSGTDFTLKISRVEAEDVGVYYCMQALQTPFT FGPGTKVEIK (SEQ ID NO: 9368) | EVQLLEWGAGLLKPSETLSLTCAVGGSFSGYYWN WIRQPPGKGLEWIGEINHSGSTNYNPSLKSRVTIS VDTSKNQFSLKLSSVTAADTAVYYCARGGGYSYGY DYGMDVWGQGTTVTVSS (SEQ ID NO: 9726) |
| 17771-D2 | NA | GAGCTCCAGATGACCCAGTCTCCATCTTCCGTGT CTGCATCTGTAGGAGACAGAGTCACCATCACTTG TCGGGCGAGTCAGGGTATTAGCAGCTGGTTAGCC TGGTATCAGCAGAAACCAGGGAAAGCCCCTAAGC TCCTGATCTATGCTGCATCCAGTTTGCAAAGTGG GGTCCCATCAAGGTTCAGCGGCAGTGGATCTGGG ACAGATTTCACTCTCACCATCAGCAGCCTGCAGC CTGAAGATTTTGCAACT (SEQ ID NO: 9369) | GAGGTGCAGCTGCTCGAGTCCGGGGGAGGCTTGGT ACAGCCTGGGGGGTCCCTGAGACTCTCCTGTGCAG CCTCTGGATTCACCTTTAGCTCCTATGCCATGAGC TGGGTCCGCCAGGCTCCAGGGAGGGGGCTGGAGTG GGTCTCAACTATTAGTGGTAGTGGTGGTAGCACAG ACTACGCAGACTCCGTGAAGGGCCGGTTCACCATC TCCAGAGACAATTCCAAGAACACGCTGTATCTGCA AATGAACAGC (SEQ ID NO: 9727) |
| | AA | ELQMTQSPSSVSASVGDRVTITCRASQGISSWLA WYQQKPGKAPKLLIYAASSLQSGVPSRFSGSGSG TDFTLTISSLQPEDFATYYCQQANSFPPTFGQGT KVEIK (SEQ ID NO: 9370) | EVQLLESGGGLVQPGGSLRLSCAASGFTFSSYAMS WVRQAPGRGLEWVSTISGSGGSTDYADSVKGRFTI SRDNSKNTLYLQMNSLRAEDTAVYYCAKDGGSGWF PKLLHYGLDVWGQGTTVTVSS (SEQ ID NO: 9728) |
| 17777-B4 | NA | GAGCTCGTGATGACTCAGTCTCCACTCTCCCTGC CCGTCACCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9371) | GAGGTGCAGCTGCTCGAGTCGGAGCAGAGGTGAA AAAGCCTGGGGCCTCAGTGAAGGTCTCCTGCATGG CTTCTGGATACACCTTCACCGGTTATGATATCAAC TGGGTGCGACAGGCCACTGGGCAAGGGCTTGAGTG GATGGGATGGATGAACCCTAACCGTGGCACCACAG GCTATGCACAGAAGTTCCAGGGCAGAGTCACCATG ACCAGGAACACCTCCATAAGCACAGCCTACATGGA GCTGAGCAGC (SEQ ID NO: 9729) |

TABLE 57-continued scFv Variable Region Sequences

| Ab | Type | LC V-region | HC V-region |
|---|---|---|---|
| | AA | ELVMTQSPLSLPVTPGEPASISCRSSQSLLYSNG YNYLDWYLQKPGQSPQLLIYLGSNRASGVPDRFS GSGSGTDFTLKISRVEAEDVGVYYCMQALQTPLT FGGGTKVEIK (SEQ ID NO: 9372) | EVQLLESGAEVKKPGASVKVSCMASGYTFTGYDIN WVRQATGQGLEWMGWMNPNRGTTGYAQKFQGRVTM TRNTSISTAYMELSSLRSEDTAVYYCARGGGYSYG YDYGMDVWGQGTTVTVSS (SEQ ID NO: 9730) |
| 17777-c4 | NA | GAGCTCGTGTTGACGCAGTCTCCAGGCACCCTGT CTTTGTCTCCAGGGGAAAGAGCCACCCTCTCCTG CAGGGCCAGTCAGAGTGTTAGCAGCAGCTACTTA GCCTGGTACCAGCAGAAACCTGGCCAGGCTCCCA GGCTCCTCATCTATGGTGCATCCAGCAGGGCCAC TGGCATCCCAGACAGGTTCAGTGGCAGTGGGTCT GGGACAGACTTCACTCTCACCATCAGCAGACTGG AGCCTGAAGATTTTGCA (SEQ ID NO: 9373) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGTAGTGGTGATTACACAT ACTACGCAGACTCCGTGAAGGGCCGGTTCACCATC TCCAGAGACAATTCCAAGAACACGCTGTATCTGCA AATGAACAGC (SEQ ID NO: 9731) |
| | AA | ELVLTQSPGTLSLSPGERATLSCRASQSVSSSYL AWYQQKPGQAPRLLIYGASSRATGIPDRFSGSGS GTDFTLTISRLEPEDFAVYYCQQYGSSPLTFGGG TKLEIK (SEQ ID NO: 9374) | EVQLLESGGGLVQPGGSLRLSCAASGFTFSSYAMS WVRQAPGKGLEWVSAISGSGDYTYYADSVKGRFTI SRDNSKNTLYLQMNSLRAEDTAVYYCAKHLRYSDW PLDYWGQGTLVTVSS (SEQ ID NO: 9732) |
| 17777-C5 | NA | GAGCTCGTGCTGACTCAGTCTCCACTCTCCCTGC CCGTCTCCCCTGGAGAGCCGGCCTCCATCTCCTG CAGGTCTAGTCAGAGCCTCCTGTATAGTAATGGA TACAACTATGTGGATTGGTACTTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9375) | GAGGTGCAGCTGCTCGAGTGGGGCGCAGGACTGTT GAAGCCTTCGGAGACCCTGTCCCTCACCTGCGCTG TCTATGGTGGGTCCTTCAGTGGTTACTACTGGACC TGGATCCGCCAGCCCCCAGGGAAGGGGCTGGAGTG GATTGGGAAATCAATCACAGTGGAAGAACCAACT ACAATCCGTCCCTCAAGAGTCGCGTCACCATGTCA GAAGACACGGCCAAGAACCAGTTCTCCCTGAAGCT GAGCTCTGTG (SEQ ID NO: 9733) |
| | AA | ELVLTQSPLSLPVSPGEPASISCRSSQSLLYSNG YNYVDWYLQKPGQSPQLLIYLGSNRASGVPDRFS GSGSGTDFTLKISRVEAEDVGVYYCMQGTHWPLT FGGGTKVDIK (SEQ ID NO: 9376) | EVQLLEWGAGLLKPSETLSLTCAVYGGSFSGYYWT WIRQPPGKGLEWIGEINHSGRTNYNPSLKSRVTMS EDTAKNQFSLKLSSVTAADTAVYYCARGGGYSDGY DYGMDVWGQGTTVTVSS (SEQ ID NO: 9734) |
| 17778-C9 | NA | GAGCTCGTGATGACTCAGACTCCACTCTCCCTGC CCGTCTCCCCTGGAGAGCCGGCCTCCATCTCCTG CAGGTCTAGTCAGAGCCTCCTGTATAGTAATGGA TACAACTATGTGGATTGGTACTTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAAAGTGGAGGCT (SEQ ID NO: 9377) | GAGGTGCAGCTGCTCGAGTGGGGCGCAGGACTGTT GAAGCCTTCGGAGACCCTGTCCCTCACCTGCGCTG TCTATGGTGGGTCCTTCAGTGGTTACTACTGGAAC TGGATCCGCCAGCCCCCAGGGAAGGGGCTGGAGTG GATTGGGAAATCAATCATCGTGGAAGCACCAACT ACAACCCGTCCCTCAAGAGTCGAGTCACCATATCA GTAGACGCGTCCAAGAACCAGTTCTCCCTGAAGCT GAGTTCTGTG (SEQ ID NO: 9735) |
| | AA | ELVMTQTPLSLPVSPGEPASISCRSSQSLLYSNG YNYVDWYLQKPGQSPQLLIYLGSNRASGVPDRFS GSGSGTDFTLKISKVEAEDVGVYYCMQALQTPCS FGQGTKLEIK (SEQ ID NO: 9378) | EVQLLEWGAGLLKPSETLSLTCAVYGGSFSGYYWN WIRQPPGKGLEWIGEINHRGSTNYNPSLKSRVTIS VDASKNQFSLKLSSVTAADTAVYYCARGGGYSDGY DYGMDVWGQGTTVTVSS (SEQ ID NO: 9736) |
| 17778-F1 | NA | GAGCTCGTGATGACTCAGTCTCCACTCTCCCTGC CGTCACCCCTGGAGAGCCGGCCTCCATCTCCTG CAGGTCTAGCGCCTCCTGTTTAGTAATGGA TACCACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9379) | GAGGTGCAGCTGCTCGAGTGGGGCGCAGGACTGTT GAAGCCTTCGGAGACCCTGTCCCTCACCTGCGCTG TCTATGGTGGGTCCTTCAGTGGTTACTACTGGAAC TGGATCCGCCAGCCCCCAGGGAAGGGGCTGGAGTG GATTGGGAAATCAATCATAGTGGAAGCACCAACT ACAACCCGTCCCTCAAGAGTCGAGTCACCATATCA GTAGACACGTCCAAGAACCAGTTCTCCCTGAAGCT GAGCTCTGTG (SEQ ID NO: 9737) |
| | AA | ELVMTQSPLSLPVTPGEPASISCRSSQRLLFSNG YHYLDWYLQKPGQSPQLLIYLGSNRASGVPDRFS GSGSGTDFTLKISRVEAEDVGVYYCMQALQTPPT FGQGTKLEIK (SEQ ID NO: 9380) | EVQLLEWGAGLLKPSETLSLTCAVYGGSFSGYYWN WIRQPPGKGLEWIGEINHSGSTNYNPSLKSRVTIS VDTSKNQFSLKLSSVTAADTAVYYCARGGGYSYGY DYGMDVWGQGTTVTVSS (SEQ ID NO: 9738) |
| 17778-H8 | NA | GAGCTCGTGCTGACTCAGTCTCCACTCTCCCTGC CCGTCACCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9381) | GAGGTGCAGCTGCTCGAGTGGGGCGCAGGACTGTT GAAGCCTTCGGAGACCCTGTCCCTCACCTGCGGTG TCTATGGTGGGTCCTTCAGTGGTTACTACTGGAGC TGGATCCGCCAGCCCCCAGGGAAGGGGCTGGAGTG GATTGGGAAATCAATCATCGTGGAAGCACCAACT ACAACCCGTCCCTCAAGAGTCGAGTCACCATATCA GTAGACGCGTCCAAGAACCAGTTCTCCCTGAAGCT GAGCTCTGTG (SEQ ID NO: 9739) |

TABLE 57-continued scFv Variable Region Sequences

| Ab | Type | LC V-region | HC V-region |
|---|---|---|---|
| | AA | ELVLTQSPLSLPVTPGEPASISCRSSQSLLYSNG YNYLDWYLQKPGQSPQLLIYLGSNRASGVPDRFS GSGSGTDFTLKISRVEAEDVGVYYCMQALQTPPT FGQGTKLEIK (SEQ ID NO: 9382) | EVQLLEWGAGLLKPSETLSLTCGVYGGSFSGYYWS WIRQPPGKGLEWIGEINHRGSTNYNPSLKSRVTIS VDASKNQFSLKLSSVTAADTAVYYCARGGGYSYGY DYGMDVWGQGTTVTVSS (SEQ ID NO: 9740) |
| 17779-D11 | NA | GAGCTCCAGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGATGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9383) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCTATGGCATGAGC TGGGTCCGCCAGGCTCCAGGGAAGGGGCTGGAGTG GGTCTCAGCTATTAGTGGTAGTGGTGGTAGCACAT ACTACGCAGACTCCGCGAAGGGCCGGTTCACCATC TCCAGAGACAATTCCAAGAACACGCTGTATCTGCA AATGAACAGC (SEQ ID NO: 9741) |
| | AA | ELQMTQSPSSLSASVGDRVTITCRASQSISSYLN WYQQKPGKAPKLLIYDASSLQSGVPSRFSGSGSG TDFTLTISSLQPEDFATYYCQQSYRTPPTFGQGT KVDIK (SEQ ID NO: 9384) | EVQLLESGGGLVQPGGSLRLSCAASGFTFSSYGMS WVRQAPGKGLEWVSAISGSGGSTYYADSAKGRFTI SRDNSKNTLYLQMNSLRAEDTAVYYCAKLVTPDYY YGMDVWGQGTTVTVSS (SEQ ID NO: 9742) |
| 17779-E1 | NA | GAGCTCGTGCTGACTCAGTCTCCACTCTCCCTGC CCGTCACCCCTGGAGAGCCGGCCTCCATCTCCTG CAGGTCTAGTCAGAGCCTCCTGTATAGTAATGGA TACCACTATTTGGATTGGTACCTGCAGAAGCCAG GGCAGTCTCCACAGCTCCTGATCTTTTTGGGTTC TAATCGGGCCTCCGGGGTCCCTGACAGGTTCAGT GCCAGTAGATCAGGCACAGATTTACACTGAAAA TCAGCAGAGTGGAGGCT (SEQ ID NO: 9385) | GAGGTGCAGCTGCTCGAGTGGGCGCAGGACTGTT GAAGCCTTCGGAGACCCTGTCCCTCACCTGCGCTG TCTATGGTGGGTCCTTCAGTGGTTACTACTGGAGC TGGATCCGCCAGCCCCCAGGGAAGGGGCTGGAGTG GATTGGGAAATCAATCATAGTGGAAGCACCAACT ACAACCCGTCCCTCAAGAGTCGAGTCACCATATCA GTAGACACGTCCAAGAACCAGTTCTCCCTGAAGCT GAGCCTCTGTG (SEQ ID NO: 9743) |
| | AA | ELVLTQSPLSLPVTPGEPASISCRSSQSLLYSNG YHYLDWYLQKPGQSPQLLIFLGSNRASGVPDRFS ASRSGTDFTLKISRVEAEDVGVYYCMQALQTPFT FGPGTKVEIK (SEQ ID NO: 9386) | EVQLLEWGAGLLKPSETLSLTCAVYGGSFSGYYWS WIRQPPGKGLEWIGEINHSGSTNYNPSLKSRVTIS VDTSKNQFSLKLSSVTAADTAVYYCARGGGYSYGY DYGMDVWGQGTTVTVSS (SEQ ID NO: 9744) |
| 17780-D12 | NA | GAGCTCGTGATGACTCAGACTCCACTCTCCCTGC CCGTCTCCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTACACTGAAAA TCAGCAGAGTGGAGGCT (SEQ ID NO: 9387) | GAGGTGCAGCTGCTCGAGTCTGGAGCAGAGGTGAA AAAGCCTGGGGCCTCAGTGAAGGTCTCCTGCAAGG CTTCTGGATACACCTTCACCAGTTATGATATCAAC TGGGTGCGACAGGCCACTGGACAAGGGCTTGAGTG GATGGGATGGATGAACCCTAACAGTGGTAACACAG GCTATGCACAGAAGTTCCAGGGCAGAGTCACCATG ACCAGGAACACCTCCATAAGCACAGCCTACATGGA GCTGAGCAGC (SEQ ID NO: 9745) |
| | AA | ELVMTQTPLSLPVSPGEPASISCRSSQSLLYSNG YNYLDWYLQKPGQSPQLLIYLGSNRASGVPDRFS GSGSGTDFTLKISRVEAEDVGVYYCMQALQTPIT FGQGTRLEIK (SEQ ID NO: 9388) | EVQLLESGAEVKKPGASVKVSCKASGYTFTSYDIN WVRQATGQGLEWMGWMNPNSGNTGYAQKFQGRVTM TRNTSISTAYMELSSLRSEDTAVYYCARGGGYSNG YDYGMDVWGQGTTVTVSS (SEQ ID NO: 9746) |
| 17780-E6 | NA | GAGCTCGTGATGACTCAGTCTCCACTCTCCCTGC CCGTCACCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTACACTGCAAA TCAGCAGGGTGGAGGCT (SEQ ID NO: 9389) | GAGGTGCAGCTGCTCGAGTGGGCGCAGGACTGTT GAAGCCTTCGGAGACCCTGTCCCTCACCTGCGCTG TCTATGGTGGGTCCTTCAGTGGTTACTACTGGAAC TGGATCCGCCAGCCCCCAGGGAAGGGGCTGGAGTG GATTGGGAAATCAATCATAGTGGAAGCACCACCT ACAACCCGTCCCTCAAGAGTCGAGTCACCATATCA GAAGACACGTCCAGGAACCAGTTCTCCCTGAAGCT GAGTTCTGTG (SEQ ID NO: 9747) |
| | AA | ELVMTQSPLSLPVTPGEPASISCRSSQSLLYSNG YNYLDWYLQKPGQSPQLLIYLGSNRASGVPDRFS GSGSGTDFTLQISRVEAEDVGVYYCMQGTHWPFT FGPGTKVEIK (SEQ ID NO: 9390) | EVQLLEWGAGLLKPSETLSLTCAVYGGSFSGYYWN WIRQPPGKGLEWIGEINHSGSTTYNPSLKSRVTIS EDTSRNQFSLKLSSVTAADTAVYYCTRGGGYSHGY DYGMDVWGQGTTVTVSS (SEQ ID NO: 9748) |
| 17781-B3 | NA | GAGCTCGTGATGACCCAGTCTCCACTCTCCCTGC CCGTCACCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTACACTGAAAA TCAGCAGAGTGGAGGCT (SEQ ID NO: 9391) | GAGGTGCAGCTGCTCGAGTGGGCGCAGGACTGTT GAAGCCTTCGGAGACCCTGTCCCTCACCTGCGCTG TCTATGGTGGGTCCTTCAGTGGTTTCTACTGGAAC TGGATCCGCCAGCCCCCAGGGAAGGGGCTGGAGTG GATTGGGAAATCAATCATCGTGGAAGCACCAACT ACAACCCGTCCCTCAAGAGTCGAGTCACCATATCA GTAGACGCGTCCAAGAACCAGTTCTCCCTGAAGCT GAGTTCTGTG (SEQ ID NO: 9749) |

TABLE 57-continued scFv Variable Region Sequences

| Ab | Type | LC V-region | HC V-region |
|---|---|---|---|
| | AA | ELVMTQSPLSLPVTPGEPASISCRSSQSLLYSNG<br>YNYLDWYLQKPGQSPQLLIYLGSNRASGVPDRFS<br>GSGSGTDFTLKISRVEAEDVGVYYCMQALQTPWT<br>FGQGTKVDIK<br>(SEQ ID NO: 9392) | EVQLLEWGAGLLKPSETLSLTCAVYGGSFSGFYWN<br>WIRQPPGKGLEWIGEINHRGSTNYNPSLKSRVTIS<br>VDASKNQFSLKLSSVTAADTAVYYCARGGGYSDGY<br>DYGMDVWGQGTTVTVSS<br>(SEQ ID NO: 9750) |
| 17781-H12 | NA | GAGCTCGTGATGACTCAGTCTCCACTCTCCCTGC<br>CCGTCTCCCCTGGAGAGCCGGCCTCCATCTCCTG<br>CAGGTCTAGTCAGAGCCTCCTGTATAGTAATGGA<br>TACAACTATGTGGATTGGTACTTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9393) | GAGGTGCAGCTGCTCGAGTGGGGCGCAGGACTGTT<br>GAAGCCTTCGGAGACCCTGTCCCTCACCTGCGCTG<br>TCTATGGTGGGTCCTTCAGTGGTTACTACTGGAAC<br>TGGATCCGCCAGCCCCCAGGGAAGGGGCTGGAGTG<br>GATTGGGGAAATCAGTCATAGTGGAAGCACCAACT<br>ACAACCCGTCCCTCAAGAGTCGAGTCAGCATATCA<br>GGAGACACGTCCAAGAACCAGTTCTCCCTGAAGCT<br>GAGCTCTGTG<br>(SEQ ID NO: 9751) |
| | AA | ELVMTQSPLSLPVSPGEPASISCRSSQSLLYSNG<br>YNYLDWYLQKPGQSPQLLIYLGSNRASGVPDRFS<br>GSGSGTDFTLKISRVEAEDVGVYYCMQSIQLPWT<br>FGQGTKVDIK<br>(SEQ ID NO: 9394) | EVQLLEWGAGLLKPSETLSLTCAVYGGSFSGYYWN<br>WIRQPPGKGLEWIGEISHSGSTNYNPSLKSRVSIS<br>GDTSKNQFSLKLSSVTAADTAVYYCARGGGYSHGY<br>DYGMDVWGQGTTVTVSS<br>(SEQ ID NO: 9752) |
| 17783-C11 | NA | GAGCTCGTGCTGACTCAGTCTCCACTCTCCCTGC<br>CCGTCACCCCTGGAGAGCCGGCCTCCATCTCCTG<br>CAGGTCTAGTCAGAGCCTCCTGTATAGTAATGGA<br>TACAACTATTTGGATTGGTACCTGCAGAAGCCAG<br>GGCAATCTCCACATCTCCTGATCTATTTGGGTTC<br>TTATCGGGCCTCCGGGGTCCCTGACAGGTTCAGT<br>GGCAGTGCATCAGGCACAGATTTCACACTGAAAA<br>TCAGCAGGGTGGAGGCT<br>(SEQ ID NO: 9395) | GAGGTGCAGCTGCTCGAGTGGGGCGCAGGACTGTT<br>GAAGCCTTCGGAGACCCTGTCCCTCACCTGCGCTG<br>TCTATGGTGGGTCCTTCAGTGGTTACTACTGGAGC<br>TGGATCCGCCAGCCCCCAGGGAAGGGGCTGGAGTG<br>GATTGGGGAAATAATCATAGTGGAAGCACCAACT<br>ACAACCCGTCCCTCAAGAGTCGAGTCACCATATCA<br>GTAGACGCGTCCAAGAACCAGTTCTCCCTGAAGCT<br>GAGTTCTGTG<br>(SEQ ID NO: 9753) |
| | AA | ELVLTQSPLSLPVTPGEPASISCRSSQSLLYSNG<br>YNYLDWYLQKPGQSPHLLIYLGSYRASGVPDRFS<br>GSASGTDFTLKISRVEAEDVGVYYCMQGTHWPLT<br>FGGGTKLEIK<br>(SEQ ID NO: 9396) | EVQLLEWGAGLLKPSETLSLTCAVYGGSFSGYYWS<br>WIRQPPGKGLEWIGEINHSGSTNYNPSLKSRVTIS<br>VDASKNQFSLKLSSVTAADTAVYYCARGGGYSDGY<br>DYGMDVWGQGTTVTVSS<br>(SEQ ID NO: 9754) |
| 17783-G10 | NA | GAGCTCGTGATGACTCAGACTCCACTCTCCCTGC<br>CCGTCATCCCTGGAGAGCCGGCCTCCATCTCCTG<br>CAGGTCTAGTCAGAGCCTCCTGTTTAGTAATGGA<br>TACAACTATTTGGATTGGTACCTGCAGAAGCCAG<br>GGCAGTCTCCACAGCTCCTGATCTATTTGGTCTC<br>TAAGCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9397) | GAGGTGCAGCTGCTCGAGTGGGGCGCAGGACTGTT<br>GAAGCCTTCGGAGACCCTGTCCCTCACCTGCGCTG<br>TCTATGGTGGGTCCTTCAGTGGTTACTACTGGAGC<br>TGGATCCGCCAGCCCCCAGGGAAGGGGCTGGAGTG<br>GATTGGGGAAATCACTCATAGTGGAAGCACCAACT<br>ACAACCCGTCCCTCAAGAGTCGAGTCACCATATCA<br>GTAGACACGTCCAAGAACCTGTTTCTCCCTGAAGCT<br>GAGCTCTGTG<br>(SEQ ID NO: 9755) |
| | AA | ELVMTQTPLSLPVIPGEPASISCRSSQSLLESNG<br>YNYLDWYLQKPGQSPQLLIYLVSKRASGVPDRES<br>GSGSGTDFTLKISRVEAEDVGVYYCMQALQTPLT<br>FGGGTKLEIK<br>(SEQ ID NO: 9398) | EVQLLEWGAGLLKPSETLSLTCAVYGGSFSGYYWS<br>WIRQPPGKGLEWIGEITHSGSTNYNPSLKSRVTIS<br>VDTSKNLFSLKLSSVTAADTAVYYCARGGGYSDGY<br>DYGMDVWGQGTTVTVSS<br>(SEQ ID NO: 9756) |
| 17784-B9 | NA | GAGCTCCAGATGACCCAGTCTCCATCTTCCGTGT<br>CTGCATCTGTAGGAGACAGAGTCACCATCACTTG<br>CCGGGCAAGTCAGAGCATTAGCAGCTATTTAAAT<br>TGGTATCAGCAGAAACCAGGGAAAGCCCCTAAGC<br>TCCTGATCTATGCTGCATCCAGTTTGCAAAGTGG<br>GGTCCCATCAAGGTTCAGTGGCAGTGGATCTGGG<br>ACAGATTTCACTCTCACCATCAGCAGTCTGCAAC<br>CTGAAGATTTTGCAATGCT<br>(SEQ ID NO: 9399) | GAGGTGCAGCTGCTCGAGTCCGGGGGAGGCTTGGT<br>ACAGCCTGGGGGTCCCTGAGACTCTCCTGTGCAGC<br>CTCTGGATTCACCTTTAGCAGCTATGCCATGAGCT<br>GGGTCCGCCAGGCTCCAGGGAAGGGGCTGGAGTGG<br>GTCTCAGCTATTAGTGGTAGTGGTGGTAGCACATA<br>CTACGCAGACTCCGTGAAGGGCCGGTTCACCATCT<br>CCAGAGACAATTCCAAGAACACGCTGTATCTGCAA<br>ATGAACAGC<br>(SEQ ID NO: 9757) |
| | AA | ELQMTQSPSSVSASVGDRVTITCRASQSISSYLN<br>WYQQKPGKAPKLLIYAASSLQSGVPSRFSGSGSG<br>TDFTLTISSLQPEDFAAYYCQQSYSTPPTFGQGT<br>KVEIK<br>(SEQ ID NO: 9400) | EVQLLESGGGLVQPGGSLRLSCAASGFTFSSYAMS<br>WVRQAPGKGLEWVSAISGSGGSTYYADSVKGRFTI<br>SRDNSKNTLYLQMNSLRAEDTAVYFCAKVMTPDYY<br>YDMDVWGQGTTVTVSS<br>(SEQ ID NO: 9758) |
| 17784-C7 | NA | GAGCTCCAGATGACCCAGTCTCCATCCTCCCTGT<br>CTGCATCTGTAGGAGACAGAGTCACCATCACTTG<br>CCGGGCGAGTCAGGGCATTAGCAATTATTTAGCC<br>TGGTATCAGCAGAAACCAGGGAAAGTTCCTAAGC<br>TCCTGATCTATGCTGCATCCAGTTTGCAAAGTGG<br>GGTCCCATCAAGGTTCAGTGGCAGTGGATCTGGG<br>ACAGATTTCACTCTCACCATCAGCAGTCTGCAAC<br>CTGAAGATTTTGCAACT<br>(SEQ ID NO: 9401) | GAGGTGCAGCTGCTCGAGTCTGGGGGAGGCTTGGT<br>ACAGCCTGGGGGGTCCCTGAGACTCTCCTGTGCAG<br>CCTCTGGATTCACCTTCAGCAGCTATGGCATGAGC<br>TGGGTCCGCCAGGCTCCAGGGAAGGGACTGGAGTG<br>GGTCTCAGCTATTAGTGGTAGTGGTGGTAGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9759) |

TABLE 57-continued scFv Variable Region Sequences

| Ab | Type | LC V-region | HC V-region |
|---|---|---|---|
| | AA | ELQMTQSPSSLSASVGDRVTITCRASQGISNYLA WYQQKPGKVPKLLIYAASSLQSGVPSRESGSGSG TDFTLTISSLQPEDFATYYCQQSYSTPFTFGPGT KVEIK (SEQ ID NO: 9402) | EVQLLESGGGLVQPGGSLRLSCAASGFTFSSYGMS WVRQAPGKGLEWVSAISGSGGSTYYADSVKGRFTI SRDNSKNTLYLQMNSLRAEDTAVYFCAKVMTPDYY YDMDVWGQGTTVTVSS (SEQ ID NO: 9760) |
| 17784-C11 | NA | GAGCTCGTGATGACCCAGACTCCACTCTCCCTGC CCGTCACCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9403) | GAGGTGCAGCTGCTCGAGTGGGGCGCAGGACTGTT GAAGCCTTCGGAGACCCTGTCCCTCACCTGCGCTG TCTATGGTGGGTCCTTCAGTGGTTACTACTGGAGC TGGATCCGCCAGCCCCCAGGGAAGGGGCTGGAGTG GATTGGGGAAATCAATCATAGTGGAAGCACCAACT ACAACCCGTCCCTCAAGAGTCGAGTCACCATATCA GTAGACACGTCCAAGAACCAGTTCTCCCTGAAGCT GAGCTCTGTG (SEQ ID NO: 9761) |
| | AA | ELVMTQTPLSLPVTPGEPASISCRSSQSLLYSNG YNYLDWYLQKPGQSPQLLIYLGSNRASGVPDRFS GSGSGTDFTLKISRVEAEDVGVYYCMQGTHWPFT FGPGTKVEIK (SEQ ID NO: 9404) | EVQLLEWGAGLLKPSETLSLTCAVYGGSFSGYYWS WIRQPPGKGLEWIGEINHSGSTNYNPSLKSRVTIS VDTSKNQFSLKLSSVTAADTAVYYCARGGGYSYGY DYGMDVWGQGTTVTVSS (SEQ ID NO: 9762) |
| 17784-G10 | NA | GAGCTCGTGATGACTCAGACTCCACTCTCCCTGC CCGTCACCCCTGGAGAGCCGGCCTCCATCTCCTG CAGGTCTAGTCAGAGCCTCCTGCATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9405) | GAGGTGCAGCTGCTCGAGTCGGGCCCAGGACTGGT GAAGCCTTCACAGACCCTGTCCCTCACCTGCACTG TCTCTGGTGACTCCATCAGCCGTGATCCTTACTAC TGGAGCTGGATCCGCCAGCACCCAGGGAAAGGGCCT GGAGTGGATTGGGTACATCTATTACAGTGGGAGCA CCTACTACAACCCGTCCCTCAAGAGTCGAGTTACC ATATCAGTAGACACGTCTAAGAACCAGTTCTCCCT GAAGCTGAGC (SEQ ID NO: 9763) |
| | AA | ELVMTQTPLSLPVTPGEPASISCRSSQSLLHSNG YNYLDWYLQKPGQSPQLLIYLGSNRASGVPDRES GSGSGTDFTLKISRVEAEDVGVYYCMQALQTPIT FGQGTRLEIK (SEQ ID NO: 9406) | EVQLLESGPGLVKPSQTLSLTCTVSGDSISRDPYY WSWIRQHPGKGLEWIGYIYYSGSTYYNPSLKSRVT ISVDTSKNQFSLKLSSVTAADTAVYYCARDKLWFG KLNYYYGMDVWGQGTTVTVSS (SEQ ID NO: 9764) |
| 17784-H5 | NA | GAGCTCGTGCTGACTCAGTCTCCACTCTCCCTGC CCGTCACCCCTGGAGAGCCGGCCTCCATCTCCTG CAGGTCTAGTCAGAGCCTCCTGTTAGTAATGGA TACTACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9407) | GAGGTGCAGCTGCTCGAGTGGGGCGCAGGACTGTT GAAGCCTTCGGAGACCCTGTCCCTCACCTGCGCTG TCTATGGTGGGTCCTTCAGTGGTTACTACTGGAGC TGGATCCGCCAGCCCCCAGGGAAGGGGCTGGAGTG GATTGGGGAAATCAATCATAGTGGAAGCACCAACT ACAACCCGTCCCTCAAGAGTCGAGTCACCATTTCA GTTGACCCGTCCAAGAACCAGTTCTCCCTGAAGCT GAGCTCTGTG (SEQ ID NO: 9765) |
| | AA | ELVLTQSPLSLPVTPGEPASISCRSSQSLLESNG YYYLDWYLQKPGQSPQLLIYLGSNRASGVPDRFS GSGSGTDFTLKISRVEAEDVGVYYCMQALQTPPT FGQGTKVEIK (SEQ ID NO: 9408) | EVQLLEWGAGLLKPSETLSLTCAVYGGSFSGYYWS WIRQPPGKGLEWIGEINHSGSTNYNPSLKSRVTIS VDPSKNQFSLKLSSVTAADTAVYYCARGGGYSYGYD YGMDVWGQGTTVTVSS (SEQ ID NO: 9766) |
| 17785-D12 | NA | GAGCTCGTGATGACTCAGTCTCCACTCTCCCTGC CCGTCACCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTAGATCAGGCACAGATTTTACACTGAAAA TCAGCAGAGTGGAGGCT (SEQ ID NO: 9409) | GAGGTGCAGCTGCTCGAGTGGGGCGCAGGACTGTT GAAGCCTTCGGAGACCCTGTCCCTCACCTGCGCTG TCTATGGTGGGTCCTTCAGTGGTTACTACTGGAAC TGGATCCGCCAGCCCCCAGGGAAGGGGCTGGAGTG GATTGGGGAAATCAATCATAGTGGAAGCACCAACT ACAACCCGTCCCTCAAGAGTCGAGTCACCATATCA GTAGACACGTCCAAGAACCAGTTCTCCCTGAAGCT GAGCTCTGTG (SEQ ID NO: 9767) |
| | AA | ELVMTQSPLSLPVTPGEPASISCRSSQSLLYSNG YNYLDWYLQKPGQSPQLLIYLGSNRASGVPDRFS GSRSGTDFTLKISRVEAEDVGVYYCMQALQTPFT FGPGTKVDIK (SEQ ID NO: 9410) | EVQLLEWGAGLLKPSETLSLTCAVYGGSFSGYYWN WIRQPPGKGLEWIGEINHSGSTNYNPSLKSRVTIS VDTSKNQFSLKLSSVTAADTAVYYCARGGGYSYGY DYGMDVWGQGTTVTVSS (SEQ ID NO: 9768) |
| 17813-D8 | NA | GAGCTCGTGATGACCCAGTCTCCATCCTCCCTGT CTGCATCTGTAGGAGACAGAGTCACCATCACTTG CCGGGCGAGTCAGGGCATTAGCAATTATTTAGCC TGGTATCAGCAGAAACCAGGGAAAGTTCCTAAGC TCCTGATCTATGCTGCATCCACTTTGCAATCAGG GGTCCCATCTCGGTTCAGTGGCAGTGGATCTGGG ACAGATTTCACTCTCACCATCAGCAGTCTGCAAC CTGAAGATTTTGCAACT (SEQ ID NO: 9411) | GAGGTGCAGCTGCTCGAGTCCGGGGAGGCTTGGT ACAGCCGGGGGGTCCCTGAGACTCTCCTGTGCAG CCTCTGGATTCACCTTCAGCAGCTTTGCCATGAGC TGGGTCCGCCAGGCTCCAGGGAAGGGCTGGAGTG GGTCTCAGCTATTAGTGGTAGTGGTGGTAGCACAT ACTACGCAGACTCCGTGAAGGGCCGGTTCACCATC TCCAGAGACAATTCCAAGAACACGCTGTATCTGCA AATGAACAGC (SEQ ID NO: 9769) |

TABLE 57-continued scFv Variable Region Sequences

| Ab | Type | LC V-region | HC V-region |
|---|---|---|---|
| | AA | ELVMTQSPSSLSASVGDRVTITCRASQGISNYLA<br>WYQQKPGKVPKLLIYAASTLQSGVPSRFSGSGSG<br>TDFTLTISSLQPEDFATYYCQQSYSTPPTFGQGT<br>KVEIK<br>(SEQ ID NO: 9412) | EVQLLESGGGLVQPGGSLRLSCAASGFTFSSFAMS<br>WVRQAPGKGLEWVSAISGSGGSTYYADSVKGRFTI<br>SRDNSKNTLYLQMNSLRAEDTAEYYCAKMVTPDYY<br>YDMDVWGQGTTVTVSS<br>(SEQ ID NO: 9770) |
| 17813-E3 | NA | GAGCTCGTGATGACCCAGACTCCACTCTCCCTGC<br>CCGTCACCCCTGGAGAGCCGGCCTCCATCTCCTG<br>CAGGTCTAGTCAGAGCCTCCTGTATAGTAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9413) | GAGGTGCAGCTGCTCGAGTGGGGCGCAGGACTGTT<br>GAAGCCTTCGGAGACCCTGTCCCTCACCTGCGCTG<br>TCTATGGTGGGTCCCTCAGTGGTTACTACTGGAGC<br>TGGATCCGCCAGCCCCCAGGGAAGGGGCTGGAGTG<br>GATTGGGGAAATCAATCACAGTGGAAGAACCAACT<br>ACAATCCGTCCCTCAAGAGTCGCGTCACCATGTCA<br>GAAGACACGGCCAAGAACCAGTTCTCCCTGAAGCT<br>GAGCTCTGTG<br>(SEQ ID NO: 9771) |
| | AA | ELVMTQTPLSLPVTPGEPASISCRSSQSLLYSNG<br>YNYLDWYLQKPGQSPQLLIYLGSNRASGVPDRFS<br>GSGSGTDFTLKISRVEAEDVGVYYCMQALQSLTF<br>GGGTKLEIK<br>(SEQ ID NO: 9414) | EVQLLEWGAGLLKPSETLSLTCAVYGGSLSGYYWS<br>WIRQPPGKGLEWIGEINHSGRTNYNPSLKSRVTMS<br>EDTAKNQFSLKLSSVTAADTAVYYCARGGGYSDGY<br>DYGMDVWGQGTTVTVSS<br>(SEQ ID NO: 9772) |
| 17813-E5 | NA | GAGCTCGTGATGACTCAGACTCCACTCTCCCTGC<br>CCGTCACCCCTGGAGAGCCGGCCTCCATCTCCTG<br>CAGGTCTAGTCAGAGCCTCCTGTATAGTAATGGA<br>TACAACTATTTGGATTGGTACCTGCAGAAGCCAG<br>GGCAGTCTCCACAGCTCCTGATCTATTTGGGTTC<br>TAAGCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9415) | GAGGTGCAGCTGCTCGAGTGGGGCGCAGGACTGTT<br>GAAGCCTTCGGAGACCCTGTCCCTCACCTGCGCTG<br>TCTATGGTGGGTCCTTCAGTGGTTACTACTGGAGC<br>TGGATCCGCCAGCCCCCAGGGAAGGGGCTGGAGTG<br>GATTGGGGAAATCAATCATAGTGGAAGCACCAACT<br>ACAACCCGTCCCTCAAGAGTCGAGTCACCATATCA<br>GTAGACACGTCCAAGAACCAGTTCTCCCTGAAGCT<br>GAGCTCTGTG<br>(SEQ ID NO: 9773) |
| | AA | ELVMTQTPLSLPVTPGEPASISCRSSQSLLYSNG<br>YNYLDWYLQKPGQSPQLLIYLGSKRASGVPDRFS<br>GSGSGTDFTLKISRVEAEDVGVYYCMQALQTPLT<br>FGGGTKVDIK<br>(SEQ ID NO: 9416) | EVQLLEWGAGLLKPSETLSLTCAVYGGSFSGYYWS<br>WIRQPPGKGLEWIGEINHSGSTNYNPSLKSRVTIS<br>VDTSKNQFSLKLSSVTAADTAVYYCARGGGYSGGY<br>DYGMDVWGQGTTVTVSS<br>(SEQ ID NO: 9774) |
| 17813-F1 | NA | GAGCTCGTGATGACCCAGTCTCCACTCTCTCTGT<br>CCGTCACCCCTGGAGAGCCGGCCTCCATCTCCTG<br>CAGGTCTAGTCGGAGCCTCCTGCATAGTAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCATAGATTTTACACTGAAAA<br>TCAGCAGAGTGGAGGCT<br>(SEQ ID NO: 9417) | GAGGTGCAGCTGCTCGAGTGGGGCGCAGGACTGTT<br>GAAGCCTTCGGAGACCCTGTCCCTCACCTGCGGTG<br>TCTATGGTGGGTCCTTCAGTGGTTACTACTGGAAC<br>TGGATCCGCCAGCCCCCAGGGAAGGGGCTGGAGTG<br>GATTGGGGAAATCAATCATCGTGGAAGCACCAACT<br>ACAACCGTCCCTCAAGAGTCGAGTCACCATATCA<br>GTAGACGCGTCCAAGAACCAGTTCTCCCTGAAGCT<br>GAGTTCTGTG<br>(SEQ ID NO: 9775) |
| | AA | ELVMTQSPLSLSVTPGEPASISCRSSRSLLHSNG<br>YNYLDWYLQKPGQSPQLLIYLGSNRASGVPDRFS<br>GSGSGIDFTLKISRVEAEDVGVYYCMQALQTPHF<br>GGGTKVEIK<br>(SEQ ID NO: 9418) | EVQLLEWGAGLLKPSETLSLTCGVYGGSFSGYYWN<br>WIRQPPGKGLEWIGEINHRGSTNYNPSLKSRVTIS<br>VDASKNQFSLKLSSVTAADTAVYYCARGGGYSDGY<br>DYGMDVWGQGTTVTVSS<br>(SEQ ID NO: 9776) |
| 17814-D9 | NA | GAGCTCGTGATGACTCAGTCTCCACTCTCTCTGT<br>CCGTCACCCCTGGACAGCCGGCCTCCATCTCCTG<br>CAAGTCTAGTCAGAGCCTCCTGTATAGTAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGGGTGGAGGCT<br>(SEQ ID NO: 9419) | GAGGTGCAGCTGCTCGAGTCTGGAGCTGAGGTGAA<br>GAAGCCTGGGGCCTCAGTGAAGGTCTCCTGCAAGG<br>CTTCTGGATACACCTTCACCAGTTATGATATCAAC<br>TGGGTGCGACAGGCCACTGGACAAGGGCTTGAGTG<br>GATGGGATGGATGAACCCTAACAGTGGTAACACAG<br>GCTATGCACAGAAGTTCCAGGGCAGAGTCACCATG<br>ACCAGGAACACCTCCATAAGCACAGCCTACATGGA<br>GCTGAGCAGC<br>(SEQ ID NO: 9777) |
| | AA | ELVMTQSPLSLSVTPGQPASISCKSSQSLLYSNG<br>YNYLDWYLQKPGQSPQLLIYLGSNRASGVPDRES<br>GSGSGTDFTLKISRVEAEDVGVYYCMQALQTPIT<br>FGQGTRLEIK<br>(SEQ ID NO: 9420) | EVQLLESGAEVKKPGASVKVSCKASGYTFTSYDIN<br>WVRQATGQGLEWMGWMNPNSGNTGYAQKFQGRVTM<br>TRNTSISTAYMELSSLRSEDTAVYYCARGGGYSYG<br>YDYGMDVWGQGTTVTVSS<br>(SEQ ID NO: 9778) |
| 18071-B1 | NA | GAGCTCGCCCTGACTCAGCCTCCCTCCGTGTCTG<br>GGTCTCCTGGACAGTCGATCACCATCTCCTGCAC<br>TGGAACCAGCAGTGACGTTGGTGGTTATAACTAT<br>GTCCTTGGTACCAACAGCACCCAGGCAAAGCCC<br>CCAAACTCATGATTTATGAGGTCAGTAAGCGGCC<br>CTCAGGGGTTTCTAATCGCTTCTCTGGCTCCAAG<br>TCTGGCAACACGGCCTCCCTGACCATCTCTGGGC<br>TCCAGGCTGAGGACGAG<br>(SEQ ID NO: 9421) | GAGGTGCAGCTGCTCGAGTCTGGGGGAGGCGTGGT<br>CCAGCCTGGGAGGTCCCTGAGACTCTCCTGTGCAG<br>CGTCTGGATTCACCTTCAGCAGATACGCCATGGAC<br>TGGGTCCGCCAGGCTCCAGGCAAGGGGCTGGAGTG<br>GGTGGCACTTATATGGTATGATGGAAGTAATAAT<br>ACTATGCAGACTCCGTGAAGGGCCGATTCACCATC<br>TCCAGAGACAATTCCAAGAACACGCTGTATCTGCA<br>AATGAACAGC<br>(SEQ ID NO: 9779) |

TABLE 57-continued scFv Variable Region Sequences

| Ab | Type | LC V-region | HC V-region |
|---|---|---|---|
| | AA | ELALTQPPSVSGSPGQSITISCTGTSSDVGGYNY VSWYQQHPGKAPKLMIYEVSKRPSGVSNRFSGSK SGNTASLTISGLQAEDEADYYCSSYTSSSTLVFG GGTKLTVL (SEQ ID NO: 9422) | EVQLLESGGGVVQPGRSLRLSCAASGFTFSRYGMD WVRQAPGKGLEWVALIWYDGSNKYYADSVKGRFTI SRDNSKNTLYLQMNSLRAEDTAVYYCARNYGSGSY GAYYYHGMDVWGQGTTVTVSS (SEQ ID NO: 9780) |
| 18071-C4 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9423) | GAGGTGCAGCTGCTCGAGTCTGGAGCTGAGGTGAA GAAGCCTGGGGCCTCAGTGAAGGTCTCCTGCAAGG CTTCTGGATACACCTTCACCAGTTATGATATCAAC TGGGTGCGACAGGCCACTGGACAAGGGCTTGAGTG GATGGGATGGATGAACCCTAACAGTGGTAACACAG ACTATGCACAGAAGTTCCAGGGCAGAGTCACCATG ACCAGGAACACCTCCATAAGCACAGCCTACATGGA GCTGAGCAGC (SEQ ID NO: 9781) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPW TFGQGTKVEIK (SEQ ID NO: 9424) | EVQLLESGAEVKKPGASVKVSCKASGYTFTSYDIN WVRQATGQGLEWMGWMNPNSGNTDYAQKFQGRVTM TRNTSISTAYMELSSLRSEDTAVYYCVRGWGTYYY YGMDVWGQGTTVTVSS (SEQ ID NO: 9782) |
| 18071-D4 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9425) | GAGGTGCAGCTGCTCGAGTCTGGGGCTGAGGTGAA GAAGCCTGGGGCCTCAGTGAAGGTCTCCTGCAAGG CTTCTGGATACACCTTCACCAGTTATGATATCAAC TGGGTGCGACAGGCCACTGGACAAGGGCTTGAGTG GATGGGATGGATGAACCCTAACAGTGGTAACACAG ACTATGCACAGAAGTTCCAGGGCAGAGTCACCATG ACCAGGAACACCTCCATAAGCACAGCCTACATGGA GCTGAGCAGC (SEQ ID NO: 9783) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPW TFGQGTKVEIK (SEQ ID NO: 9426) | EVQLLESGAEVKKPGASVKVSCKASGYTFTSYDIN WVRQATGQGLEWMGWMNPNSGNTDYAQKFQGRVTM TRNTSISTAYMELSSLRSEDTAVYYCARGWGRYYS YGMDVWGQGTTVTVSS (SEQ ID NO: 9784) |
| 18072-D6 | NA | GAGCTCACACTCACGCAGTCTCCAGGCACCCTGT CTTTGTCTCCAGGGGAAAGAGCCACCCTCTCCTG CAGGGCCAGTCAGAGTGTTAGCAGCAGCTACTTA GCCTGGTACCAGCAGAAACCTGGCCAGGCTCCCA GGCTCCTCATCTATGGTGCATCCGCCAGGGCCAC TGGCATCCCAGACAGGTTCAGTGGCAGTGGGTCT GGGACAGACTTCACTCTCACCATCAGCAGACTGG AGCCTGAAGATTTTGCA (SEQ ID NO: 9427) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGTAGTGGTGATATCACAT ACTACGCAGACTCCGTGAAGGGCCGGTTCACCATC TCCAGAGACAATTCCAAGAACACGCTGTATCTGCA AATGAACAGC (SEQ ID NO: 9785) |
| | AA | ELTLTQSPGTLSLSPGERATLSCRASQSVSSSYL AWYQQKPGQAPRLLIYGASARATGIPDRESGSGS GTDFTLTISRLEPEDEAVYYCQQYGSSLTFGGGT KVDIK (SEQ ID NO: 9428) | EVQLLESGGGLVQPGGSLRLSCAASGFTFSSYAMS WVRQAPGKGLEWVSAISGSGDITYYADSVKGRFTI SRDNSKNTLYLQMNSLRAEDTAVYYCAKHLRYFDW PLDYWGQGTLVTVSS (SEQ ID NO: 9786) |
| 18072-G9 | NA | GAGCTCGTGCTGACTCAGCCACCCTCAGCGTCTG GGACCCCCGGGCAGAGGATCACCATCTCTTGTTC TGGCAGCAGCTCCAACATCGGAAGTAATTATGTA TACTGGTATCAGCATCTCCCAGGAACGGCCCCCA AACTCCTCATCTATAGGAATAATCAGCGGCCCTC AGGGGTCCCTGACCGATTCTCTGGCTCCAAGTCT GGCACCTCAGCCTCCCTGGCCATCAGTGGGCTCC GGTCCGAGGATGAGGCT (SEQ ID NO: 9429) | GAGGTGCAGCTGCTCGAGTCTGGGGGAGGCCTGGT CAAGCCTGGGGGGTCCCTGAGACTCTCCTGTGCAG CCTCTGGATTCACCTTCAGTGGCTATAGCATGAAC TGGGTCCGCCAGGCTCCAGGGAAGGGGCTGGAGTG GGTCTCGTCCATTAGTAGTAGTAGTTACATAT ACTACGCAGACTCAGTGAAGGGCCGCTTCACCATC TCCAGAGACAACGCCAAGAACTCACTGTATCTGCA AATGAACAGC (SEQ ID NO: 9787) |
| | AA | ELVLTQPPSASGTPGQRITISCSGSSSNIGSNYV YWYQHLPGTAPKLLIYRNNQRPSGVPDRFSGSKS GTSASLAISGLRSEDEADYYCAAWDDSLSGVVFG GGTKLTVL (SEQ ID NO: 9430) | EVQLLESGGGLVKPGGSLRLSCAASGFTFSGYSMN WVRQAPGKGLEWVSSISSSSSYIYYADSVKGRFTI SRDNAKNSLYLQMNSLRAEDTAVYYCVRSKAARPD DGMDVWGQGTTVTVSS (SEQ ID NO: 9788) |
| 18074-G12 | NA | GAGCTCGTGATGACCCAGTCTCCATCCTCCCTGT CTGCATCTGTAGGAGACAGAGTCACCATCACTTG CCAGGCGAGTCAGGACATTAGCAACTATTTAAAT TGGTATCAGCAGAAACCAGGGAAAGCCCCTAAGC TCCTGATCTACGATGCATCCAATTTGGAAACAGG GGTCCCATCAAGGTTCAGTGGCAGTGGATCTGGG ACAGATTTTACTTTCACCATCAGCAGTCTGCAAC CTGAAGATTTTGCAACT (SEQ ID NO: 9431) | GAGGTGCAGCTGCTCGAGTCTGGGGGAGGCTTGGT ACAGCCGGGGGGGTCCCTGAGACTCTCCTGTGCAG CCTCTGGATTCACCTTCTCCTATGCCATGAGC TGGGTCCGCCAGGCTCCAGGGAAGGGGCTGGAGTG GGTCTCAAGCATAACTATTACTGGTGGTAGCACAT ACTACGCAGACTCCGTGAAGGGCCGGTTCACCATC TCCAGAGACAATTCCAAGAACACGCTGAATCTGCA AATGAACAGC (SEQ ID NO: 9789) |

TABLE 57-continued scFv Variable Region Sequences

| Ab | Type | LC V-region | HC V-region |
|---|---|---|---|
| | AA | ELVMTQSPSSLSASVGDRVTITCQASQDISNYLN WYQQKPGKAPKLLIYDASNLETGVPSRFSGSGSG TDFTFTISSLQPEDFATYYCQSYSIPPTFGQGT KVEIK (SEQ ID NO: 9432) | EVQLLESGGGLVQPGGSLRLSCAASGFTFSSYAMS WVRQAPGRGLEWVSSITITGGSTYYADSVKGRFTI SRDNSKNTLNLQMNSLRAEDTAVYYCAKDGGSWF PKLLHYGLDVWGQGTTVTVSS (SEQ ID NO: 9790) |
| 18078-H6 | NA | GAGCTCGTGCTGACTCAGCCACCCTCGGTGTCCA AGGGCTTGAGACAGACCGCCACACTCACCTGCAC TGGGAACAGCAACAATGTTGGCAACCAAGGAGCA GCTTGGCTGCAGCAGCACCAGGGCCACCCTCCCA AACTCCTATCCTACAGGAATAACAACCGGCCCTC AGGGATCTCAGAGAGATTATCTGCATCCAGGTCA GGAAACACAGCCTCCCTGACCATTACTGGACTCC AGCCTGAGGACGAGGCT (SEQ ID NO: 9433) | GAGGTGCAGCTGCTCGAGTCTGGGGGAGGCGTGGT CCAGCCTGGGAGGTCCCTGAGACTCTCCTGTGCAG CGTCTGGATTCACCTTCAGTAGATATGGCATGCAG TGGGTCCGCCAGGCTCCAGGCAAGGGGCTGGAGTG GGTGGCAGTTATATCATATGATGGAAGTAATAAAT ACTATGCAGACTCCGTGAAGGGCCGATTCACCATC TCCAGAGACAATTCCAAGAACACGCTATATCTGCA AATGAACAGC (SEQ ID NO: 9791) |
| | AA | ELVLTQPPSVSKGLRQTATLTCTGNSNNVGNQGA AWLQQHQGHPPKLLSYRNNNRPSGISERLSASRS GNTASLTITGLQPEDEADYYCSAWDSSLSAWVFG GGTKLTVL (SEQ ID NO: 9434) | EVQLLESGGGVVQPGRSLRLSCAASGFTFSRYGMQ WVRQAPGKGLEWVAVISYDGSNKYYADSVKGRFTI SRDNSKNTLYLQMNSLRAEDTAVYYCARNYGSGSY GAYYYHGMDVWGQGTTVTVSS (SEQ ID NO: 9792) |
| 18079-C8 | NA | GAGCTCGTGCTGACTCAGCCATCCTCGGTGTCCA AGGACTTGAGACAGACCGCCACACTCACCTGCAC TGGGAACAGCAACAATGTTGGCAACCAAGGAGCA GCTTGGCTGCAGCAACACCAGGGCCACCCTCCCA AACTCCTATCCTACAGGAATAACAACCGGCCCTC AGGGATCTCAGAGAGATTATCTGCATCCAGGTCA GGAAACACAGCCTCCCTGACCATTACTGGACTCC AGCCTGAGGACGAGGCT (SEQ ID NO: 9435) | GAGGTGCAGCTGCTCGAGTCTGGGGGAGGCGTGGT CCAGCCTGGGAGGTCCCTGAGACTCTCCTGTGCAG CCTCTGGATTCACCTTCAGTAGCTATGGCATGCAC TGGGTCCGCCAGGCTCCAGGCAAGGGGCTGGAGTG GGTGGCAGTTATATCATATGATGGAAGTAATAAGT ACTATGCAGACTCCGTGAAGGGCCGATTCACCATC TCCAGAGACAATTCCAAGAACACGCTGTTTCTGCA AATGAACAGC (SEQ ID NO: 9793) |
| | AA | ELVLTQPSSVSKDLRQTATLTCTGNSNNVGNQGA AWLQQHQGHPPKLLSYRNNNRPSGISERLSASRS GNTASLTITGLQPEDEADYYCSAWDSSLSAWVFG GGTKLTVL (SEQ ID NO: 9436) | EVQLLESGGGVVQPGRSLRLSCAASGFTFSSYGMH WVRQAPGKGLEWVAVISYDGSNKYYADSVKGRFTI SRDNSKNTLFLQMNSLRTEDTAVYYCAREQWPNYY YGLGVWGQGTTVTVSS (SEQ ID NO: 9794) |
| 18079-H4 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9437) | GAGGTGCAGCTGCTCGAGTCTGGAGCAGAGGTGAA AAAGCCTGGGGCCTCAGTGAGGTCTCCTGCAAGGC TTCTGGATACACCTTCACCAGTTATGATATCAACT GGGTGCGCCAGGCCACTGGACAAGGGCTTGAGTGG ATGGGATGGATGAACCCTAACAGTGGTAACACAGA CTATGCACAGAAGTTCCAGGGCAGAGTCACCATGA CCAGGAACACCTCCATAAGCACAGCCTACATGGAG CTGAGAAGC (SEQ ID NO: 9795) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPW TFGQGTKLEIK (SEQ ID NO: 9438) | EVQLLESGAEVKKPGASVKVSCKASGYTFTSYDIN WVRQATGQGLEWMGWMNPNSGNTDYAQKFQGRVTM TRNTSISTAYMELRSLRSEDTAVYYCARGWGRFYS YGMDVWGQGTTVTVSS (SEQ ID NO: 9796) |
| 18079-H11 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9439) | GAGGTGCAGCTGCTCGAGTCTGGAGCAGAGGTGAA AAAGCCTGGGGCCTCAGTGAAGGTCTCCTGCAAGG CTTCTGGATACACCTTCACCAGTTATGATATCAAC TGGGTGCGACAGGCCACTGGACAAGGGCTTGAGTG GATGGGATGGATGAACCCTAACAGTGGTAACACAG ACTATACACAGAAGTTCCAGGGCAGAGTCACCATG ACCAGGAACACCTCCATAGGCACAGCCTACATGGA GCTGAGCAGC (SEQ ID NO: 9797) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPW TFGQGTKLEIK (SEQ ID NO: 9440) | EVQLLESGAEVKKPGASVKVSCKASGYTFTSYDIN WVRQATGQGLEWMGWMNPNSGNTDYTQKFQGRVTM TRNTSIGTAYMELSSLRSEDTAVYYCVRGWGTYYY YGMDVWGQGTTVTVSS (SEQ ID NO: 9798) |
| 18080-C5 | NA | GAGCTCGTGCTGACTCAGTCTCCACTCTCCCTGC CCGTCACCCCTGGAGAGCCGGCCTCCATCTCCTG CAGGTCTAGTCAGAGCCTCCTGCATAGTAATGGA TACAACATATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9441) | GAGGTGCAGCTGCTCGAGTCGGGCCCAGGACTGGT GAAGCCTTCACAGACCCTGTCCCTCACCTGCACTG TCTCTGGTGGCTCCATCAGCAGTGGTGATTACTAC TGGAGCTGGATCCGCCAGCACCCAGGGAAGGGCCT GGAGTGGATTGGGTACATCAATGACAGTGGGAGCA CCTACTATAACCCGTCCCTCAAGAGTCGAGTTACC TTATCAGTAGACTCGTCTAAGAACCAGTTCTCCCT GAAGCTGAGC (SEQ ID NO: 9799) |

TABLE 57-continued scFv Variable Region Sequences

| Ab | Type | LC V-region | HC V-region |
|---|---|---|---|
| | AA | ELVLTQSPLSLPVTPGEPASISCRSSQSLLHSNG YNYLDWYLQKPGQSPQLLIYLGSNRASGVPDRFS GSGSGTDFTLKISRVEAEDVGVYYCMQALQTPRT FGQGTKVEIK (SEQ ID NO: 9442) | EVQLLESGPGLVKPSQTLSLTCTVSGGSISSGDYY WSWIRQHPGKGLEWIGYINDSGSTYYNPSLKSRVT LSVDSSKNQFSLKLSSVTAADTAVYYCARDLLWFG KLNYYYGMDVWGQGTTVTVSS (SEQ ID NO: 9800) |
| 18080-H9 | NA | GAGCTCACACTCACGCAGTCTCCAGGCACCCTGT CTTTGTCTCCAGGGGAAAGAGCCACCCTCTCCTG CAGGGCCAGTCAGAGTGTTAGCAGCGGCTACTTA GCCTGGTACCAGCAGAAACCTGGCCAGGCTCCCA GGCTCCTCATCTATGGTGCATCCAGCAGGGCCAC TGGCATCCCAGACAGGTTCAGTGGCAGTGGGTCT GGGACAGACTTCACTCTCACCATCAGCAGACTGG AGCCTGAAGATTTTGCA (SEQ ID NO: 9443) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGGTATTAGTGGTAGTGGTGGTAGCACAT ACTACGCAGACTCCGTGAAGGGCCGGTTCACCATC TCCAGAGACAATTCCAAGAACACGCTGTATCTGCA AATGAACAGC (SEQ ID NO: 9801) |
| | AA | ELTLTQSPGTLSLSPGERATLSCRASQSVSSGYL AWYQQKPGQAPRLLIYGASSRATGIPDRFSGSGS GTDFTLTISRLEPEDFAVYYCQQYGSSPFTFGPG TKVEIK (SEQ ID NO: 9444) | EVQLLESGGGLVQPGGSLRLSCAASGFTFSSYAMS WVRQAPGKGLEWVSGISGSGGSTYYADSVKGRFTI SRDNSKNTLYLQMNSLRAEDTAVYYCAKVMTPDYY YDMDVWGQGTTVTVSS (SEQ ID NO: 9802) |
| 18081-A6 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9445) | GAGGTGCAGCTGCTCGAGTCGGGCCCAGGACTGGT GAAGCCTTCGGAGACCCTGTCCCTCACCTGCACTG TCTCTGGTGACTCCATCAGTAGTAGTCGTTACTAC TGGGGCTGGATCCGCCAGCCCCCAGGGAAGGGGCT GGAGTGGATTGGGAGTATCTATTATAGTGGGAGCA CCTACTACAACCCGTCCCTCAAGAGTCGAGTCACC ATATCCGTAGACACGTCCAAGAACCAGTTCTCCCT GAAGCTGAGT (SEQ ID NO: 9803) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPL TFGGGTKVEIK (SEQ ID NO: 9446) | EVQLLESGPGLVKPSETLSLTCTVSGDSISSSRYY WGWIRQPPGKGLEWIGSIYYSGSTYYNPSLKSRVT ISVDTSKNQFSLKLSSVTAADTAVYYCARGIFGVI TYFDYWGQGTLVTVSS (SEQ ID NO: 9804) |
| 18081-B5 | NA | GAGCTCGTGCTGACTCAGTCTCCACTCTCCCTGC CCGTCACCCCTGGAGAGCCGGCCTCCATCTCCTG CAGGTCTAGTCAGAGCCTCCTGCATCGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9447) | GAGGTGCAGCTGCTCGAGTCAGGTCCAGGACAGGT GAAGCCCTCGCAGACCCTCTCACTCACCTGTGCCA TCTCCGGGGACAGTGTCTCTAGCAACAGTGCTGCT TGGAACTGGATCAGGCAGTCCCCATCGAGAGGCCT TGAGTGGCTGGGAAGGACATACTACAGGTCCAAGT GGTATAATGATTATGCAGTATGTGAAAAGTCGA ATAACCATCAACCCAGACACATCCAAGAACCAGTT CTCCCTGCAG (SEQ ID NO: 9805) |
| | AA | ELVLTQSPLSLPVTPGEPASISCRSSQSLLHRNG YNYLDWYLQKPGQSPQLLIYLGSNRASGVPDRFS GSGSGTDFTLKISRVEAEDVGVYYCMQALQTPIT FGQGTRLEIK (SEQ ID NO: 9448) | EVQLLESGPGQVKPSQTLSLTCAISGDSVSSNSAA WNWIRQSPSRGLEWLGRTYYRSKWYNDYAVSVKSR ITINPDTSKNQFSLQLNSVTPEDTAVYYCAREVLW FGKLNYYYGMDVWGQGTTVTVSS (SEQ ID NO: 9806) |
| 18081-C10 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9449) | GAGGTGCAGCTGCTCGAGTCGGGCCCAGGACTGGT GAAGCCTTCGGAGACCCTGTCCCTCACCTGCATTG TCTCTGGTGTCTCCATCAGCAGTAGGTCCTACTGG GGCTGGATCCGCCAGCCCCCAGGGAAGGGACT GGAGTGGATTGGGAGTATCTATTATGGTGGGAGCA CCTACTACAACCCGTCCCTCAAGAGTCGAGTCACC ATATCCGTTGACACGTCCAAGAACCAGTTCTCCCT GAAGCTGAGC (SEQ ID NO: 9807) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPL TFGGGTKVEIK (SEQ ID NO: 9450) | EVQLLESGPGLVKPSETLSLTCIVSGVSISSSRSY WGWIRQPPGKGLEWIGSIYYGGSTYYNPSLKSRVT ISVDTSKNQFSLKLSSVTAADTAVYYCATTIFGVV GWFDPWGQGNLVTVSS (SEQ ID NO: 9808) |
| 18081-D6 | NA | GAGCTCGTGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9451) | GAGGTGCAGCTGCTCGAGTCTGGTCCTGCGCTGGT GAAACCCACACAGACCCTCACGCTGACCTGCACCT TCTCTGGTTTCTCATTCACCACTCATAAAATGGGT GTGACTGGGATCCGTCAGCCCCCAGGAAAGGCCCT GGAGTGGCTTGCACTCATTTATTGGAATGATGATA CGCGCTACAGCCCATCTCTGCAGAGTAGGCTCACC ATCACCAAGGACACCTCCAAAAACCAGGTGGTCCT CACAATGACC (SEQ ID NO: 9809) |

TABLE 57-continued scFv Variable Region Sequences

| Ab | Type | LC V-region | HC V-region |
|---|---|---|---|
| | AA | ELVMTQSPSSLSASVGDRVTITCRASQSISSYLN WYQQKPGKAPKLLIYAASSLQSGVPSRFSGSGSG TDFTLTISSLQPEDFATYYCQQSYSTPFTFGPGT KLEIK (SEQ ID NO: 9452) | EVQLLESGPALVKPTQTLTLTCTFSGFSFTTHKMG VDWIRQPPGKALEWLALIYWNDDTRYSPSLQSRLT ITKDTSKNQVVLTMTNMDPVDTATYYCVYRRYNWN YENWFDPWGQGTLVTVSS (SEQ ID NO: 9810) |
| 18081-D12 | NA | GAGCTCGTGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTACATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9453) | GAGGTGCAGCTGCTCGAGTCCGGGGGAGGCCTGGT CAAGCCTGGGGGGTCCCTGAGACTCTCCTGTGCAG CCTCTGGATTCACCTTTAGCATCTATGCCTTGAGC TGGGTCCGCCAGGCTCCAGGGAAGGGGCTGGAGTG GGTCTCAGCTATTAGTGGTAGTGGTGGTAGCACAT ACTACGCAGACTCCGTGAAGGGCCGGTTCACCATC TCCAGAGACAATTCCAAGAACACGCTGTATCTGCA AATGAACAGC (SEQ ID NO: 9811) |
| | AA | ELVMTQSPSSLSASVGDRVTITCRASQSISSYLN WYQQKPGKAPKLLIYATSSLQSGVPSRFSGSGSG TDFTLTISSLQPEDFATYYCQQSYSTPPTFGQGT KVEIK (SEQ ID NO: 9454) | EVQLLESGGGLVKPGGSLRLSCAASGFTFSIYALS WVRQAPGKGLEWVSAISGSGGSTYYADSVKGRFTI SRDNSKNTLYLQMNSLRAEDTAVYYCAKGEGIAAR YYYYGMDVWGQGTTVTVSS (SEQ ID NO: 9812) |
| 18082-F5 | NA | GAGCTCGCCCTGACTCAGCCTGCCTCCGCGTCTG GGTCTCCTGGACAGTCGATCACCATCTCCTGCAC TGGAACCAGCAGTGACGTTGGTGGTTATAACTAT GTCTCCTGGTACCAACAGCACCCAGGCAAAGCCC CCAAACTCATGATTTATGAGGTCAGTAAGCGGCC CTCAGGGGTCCCTGATCGCTTCTCTGGCTCCAAG TCTGGCAACACGGCCTCCCTGACCGTCTCTGGGC TCCAGGCTGAGGATGAG (SEQ ID NO: 9455) | GAGGTGCAGCTGCTCGAGTCCGGGGGAGGCGTGGT CCAGCCTGGGAGGTCCCTGAGACTCTCCTGTGCAG CGTCTGGATTCACCTTCAGTAGATATGGCATGGAT TGGGTCCGCCAGGCTCCAGGCAAGGGACTGGAGTG GGTGGCAGTTATATGGTATGATGGAAGTAATAAAT ACTATGCAGACTCCGTGAAGGGCCGATTCACCATC TCCAGAGACAATTCCAAGAATACGCTGTATCTGCA AATGAACAGC (SEQ ID NO: 9813) |
| | AA | ELALTQPASASGSPGQSITISCTGTSSDVGGYNY VSWYQQHPGKAPKLMIYEVSKRPSGVPDRFSGSK SGNTASLTVSGLQAEDEADYYCSSYAGSNNVVFG GGTKLTVL (SEQ ID NO: 9456) | EVQLLESGGGVVQPGRSLRLSCAASGFTFSRYGMD WVRQAPGKGLEWVAVIWYDGSNKYYADSVKGRFTI SRDNSKNTLYLQMNSLRAEDTAVYYCARNYGSGSY GAYYYHGMDVWGQGTTVTVSS (SEQ ID NO: 9814) |
| 18084-E4 | NA | GAGCTCACACTCACGCAGTCTCCAGGCACCCTGT CTTTGTCTCCAGGGGAAAGAGCCACCCTCTCCTG CAGGGCCAGTCAGAGTGTTAGCAGCAGCTACTTA GCCTGGTACCAGCAGAAACCTGGCCAGGCTCCCA GGCTCCTCATCTATGGTGCATCCAGCAGGGCCAC TGGTATCCCAGCCAGGTTCAGTGGCAGTGGGTCT GGGACAGACTTCACTCTCACCATCAGCAGACTGG AGCCTGAAGATTTTGCC (SEQ ID NO: 9457) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGTAGTGGTAGTAGCACAT ACTACGCAGACTCCGTGAAGGGCCGGTTCACCATC TCCAGAGACAATTCCAAGAACACGCTGTATCTGCA AATGAACAGC (SEQ ID NO: 9815) |
| | AA | ELTLTQPSPGTLSLSPGERATLSCRASQSVSSSYL AWYQQKPGQAPRLLIYGASSRATGIPARFSGSGS GTDFLTISRLEPEDFAVYYCQQYGSSPLTFGGGT KLEIK (SEQ ID NO: 9458) | EVQLLESGGGLVQPGGSLRLSCAASGFTFSSYAMS WVRQAPGKGLEWVSAISGSGSSTYYADSVKGRFTI SRDNSKNTLYLQMNSLRAEDTAVYYCAKHLRYSDW PLDYWGQGTLVTVSS (SEQ ID NO: 9816) |
| 18086-H4 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9459) | GAGGTGCAGCTGCTCGAGTCTGGAGCTGAGGTGAA GAAGCCTGGGGCCTCAGTGAAGGTCTCCTGCAAGG CTTCTGGATACACCTTCACCAGTTATGATATCAAC TGGGTGCGACAGGCCACTGGACAAGGGCTTGAGTG GATGGGATGGATGAACCCTAAGAGTGGTAACACAG GCTATGCACAGAAGTTCCAGGACAGAGTCACCATG ACCAGGAACACCTCCATAAGCACAGCCTACATGGA GCTGAGCAGC (SEQ ID NO: 9817) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPW TFGQGTKVDIK (SEQ ID NO: 9460) | EVQLLESGAEVKKPGASVKVSCKASGYTFTSYDIN WVRQATGQGLEWMGWMNPKSGNTGYAQKFQDRVTM TRNTSISTAYMELSSLRSDDTAVYYCVRGWGTYYY YGMDVWGQGTTVTVSS (SEQ ID NO: 9818) |
| 18088-B10 | NA | GAGCTCGTGATGACACAGTCTCCAGGCACCCTGT CTCTGTCTCCAGGGGAAAGAGCCACCCTCTCCTG CAGGGCCAGTCAGAGTGTTAGCAGCAGCTACTTA GCCTGGTACCAGCAGAAACCTGGCCAGGCTCCCA GGCTCCTCATCTATGGTGCATCCACCAGGGCCAC TGGCATCCCAGACAGGTTCAGTGGCAGTGGGTCT GGGACAGACTTCACTCTCACCATCAGCAGACTGG AGCCTGAAGATTTTGCA (SEQ ID NO: 9461) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGTAGTGGTGATATACAT ACTACGCAGACTCCGTGAAGGGCCGGTTCACCATC TCCAGAGACAATTCCAAGAACACGCTGTATCTGCA AATGAACAGC (SEQ ID NO: 9819) |

TABLE 57-continued scFv Variable Region Sequences

| Ab | Type | LC V-region | HC V-region |
|---|---|---|---|
| | AA | ELVMTQSPGTLSLSPGERATLSCRASQSVSSSYL AWYQQKPGQAPRLLIYGASTRATGIPDRFSGSGS GTDFTLTISRLEPEDFAVYYCQQYGTSPLTFGGG TKVDIK (SEQ ID NO: 9462) | EVQLLESGGGLVQPGGSLRLSCAASGFTFSSYAMS WVRQAPGKGLEWVSAISGSGDITYYADSVKGRFTI SRDNSKNTLYLQMNSLRAEDTAVYYCAKHLRYFDW PLDYWGQGTLVTVSS (SEQ ID NO: 9820) |
| 18088-E4 | NA | GAGCTCGTGATGACCCAGTCTCCACTCTCCCTGC CCGTCATCCCTGGAGAGCCGGCCTCCATCTCCTG CAGGTCTAGTCAGAGCCTCCTGTATAGTAATGGA TACAACTATTTGGATTGGTACCTGCAGAAGCCAG GGCAGTCTCCACAGCTCCTGATCTATTTGGGTTC TAAGCGGGCCTCCGGGGTCCCTGACAGGTTCAGT GGCAGTGGATCAGGCACAGATTTTACACTGAAAA TCAGCAGAGTGGAGGCT (SEQ ID NO: 9463) | GAGGTGCAGCTGCTCGAGTGGGGCGCAGGACTGTT GAAGCCTTCGGAGACCCTGTCCCTCACCTGCGCTG TCTATGGTGGGTCCTTCAGTGGTTACTACTGGAGC TGGATCCGCCAGCCCCCAGGGAAGGGGCTGGAGTG GATTGGGGAAATCAATCATAGTGGAAGCACCAACT ACAACCCGTCCCTCAAGAGTCGAGTCACCATATCA GTAGACACGTCCAAGAACCAGTTCTCCCTGAAGCT GAGCTCTGTG (SEQ ID NO: 9821) |
| | AA | ELVMTQSPLSLPVIPGEPASISCRSSQSLLYSNG YNYLDWYLQKPGQSPQLLIYLGSKRASGVPDRES GSGSGTDFTLKISRVEAEDVGVYYCMQVLQTPPT FGQGTKLDIK (SEQ ID NO: 9464) | EVQLLEWGAGLLKPSETLSLTCAVYGGSFSGYYWS WIRQPPGKGLEWIGEINHSGSTNYNPSLKSRVTIS VDTSKNQFSLKLSSVTAADTAVYYCARGGGYSYGY DYGMDWGQGTTVTVSS (SEQ ID NO: 9822) |
| 18089-B8 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC CAGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9465) | GAGGTGCAGCTGCTCGAGTCGGGCCCAGGACTGGT GAAGCCTTCGGAGACCCTGTCCCTCACCTGCATTG TCTCTGGTGGCTCCATCAGCAGTAGTAGGTCCTAC TGGGGCTGGATCCGCCAGCCCCCAGGGAAGGGACT GGAGTGGATTGGGAGTATCTATTATGGTGGGAGCA CCTACTACAACCCGTCCCTCAAGAATGAGTCACC ATGTCCGTTGACACGTCCAAGAACCAGTTCTCCCT GAAGCTGAGC (SEQ ID NO: 9823) |
| | AA | ELVMTQSPDSLAVSLGERATINCKSSQSVLYSSN NKNYLAWYQQKPGQPPKLLIYWASTRESGVPDRF SGSGSGTDFTLTISSLQAEDVAVYYCQQYYSTPL TFGGGTKVDIK (SEQ ID NO: 9466) | EVQLLESGPGLVKPSETLSLTCIVSGGSISSSRSY WGWIRQPPGKGLEWIGSIYYGGSTYYNPSLKNRVT MSVDTSKNQFSLKLSSVTAADTAVYYCATTIFGVV GWFDPWGQGNLVTVSS (SEQ ID NO: 9824) |
| 18089-C8 | NA | GAGCTCCAGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9467) | GAGGTGCAGCTGCTCGAGTCTGGTCCTGCGCTGGT GAAACCCACACAGACCCTCACGCTGTCCTGTTCCT TCTCTGGGTTCTCACTCAGCACTAATAAAATGGCT GTGGGTTGGATCCGTCAGCCCCCAGGAAAGGCCCT GGAGTGGCTTGCACTCATTTATTGGAATGATGATA AGCGCTACAGTCCATCTCTGAAGAGCAGGCTCACC ATCACCAAGGACACCTCCAAAAACCAGGTGGTCCT TACAATGACC (SEQ ID NO: 9825) |
| | AA | ELQMTQSPSSLSASVGDRVTITCRASQSISSYLN WYQQKPGKAPKLLIYAASSLQSGVPSRFSGSGSG TDFTLTISSLQPEDFATYYCQQSYSTPLTFGGGT KVEIK (SEQ ID NO: 9468) | EVQLLESGPALVKPTQTLTLSCSFSGFSLSTNKMA VGWIRQPPGKALEWLALIYWNDDKRYSPSLKSRLT ITKDTSKNQVVLTMTNMDPVDTATYYCARRRYNWN YENWFDPWGQGILVTVSS (SEQ ID NO: 9826) |
| 18089-G7 | NA | GAGCTCCAGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTACATCCAGTTTGCAAAGTGG GGTCCCATCACGGTTCAGTGGCAGTGGATCTGGG ACAGATTTCACTCTCACCATCAGCAGTCTGCAAC CTGAAGATTTTGCAACT (SEQ ID NO: 9469) | GAGGTGCAGCTGCTCGAGTCTGGTCCTGTGCTGGT GAAACCCACACAGACCCTCACGCTGACCTGCACCT TCTCTGGTTTCTCATTCACCACTCATAAAATGGGT GTGGACTGGATCCGTCAGCCCCCAGGAAAGGCCCT GGAGTGGCTTGCACTCATTTATTGGAATGATGATA AGCGCTACAGCCCATCTCTGCAGAGTAGGCTCACC ATCACCAAGGACACCTCCAAAAACCAGGTGGTCCT CACAATGACC (SEQ ID NO: 9827) |
| | AA | ELQMTQSPSSLSASVGDRVTITCRASQSISSYLN WYQQKPGKAPKLLIYATSSLQSGVPSRFSGSGSG TDFTLTISSLQPEDFATYYCQQSYSIPFTFGPGT KVEIK (SEQ ID NO: 9470) | EVQLLESGPVLVKPTQTLTLTCTFSGFSFTTHKMG VDWIRQPPGKALEWLALIYWNDDKRYSPSLQSRLT ITKDTSKNQVVLTMTNMDPVDTATYYCAYRRYNWN YENWFDPWGQGTLVTVSS (SEQ ID NO: 9828) |
| 18089-G11 | NA | GAGCTCCAGATGACCCAGTCTCCATCTTCCGTGT CTGCATCTGTAGGAGACAGAGTCACCATCACTTG CCAGGCAGTCAGGACATTAGCAACTATTTAAAT TGGTATCAGCAGAAACCAGGGAAAGCCCCTAAGC TCCTGATCTATGCTGCATCCAGTTTGCAAAGTGG GGTCCCATCACGGTTCAGTGGCAGTGGATCTGGG ACAGATTTCACTCTCACCATCAGCAGTCTGCAAC CTGAAGATTTTGCAACT (SEQ ID NO: 9471) | GAGGTGCAGCTGCTCGAGTCCGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGGTATTAGTGGTAGTGGTGGTAGCTCAT ACTACGCAGACTCCGTGAAGGGCCGGTTCACCATC TCCAGAGACAATTCCAAGAACACGCTGTATCTGCA AATGAACAGC (SEQ ID NO: 9829) |

TABLE 57-continued scFv Variable Region Sequences

| Ab | Type | LC V-region | HC V-region |
|---|---|---|---|
| | AA | ELQMTQSPSSVSASVGDRVTITCQASQDISNYLN WYQQKPGKAPKLLIYAASSLQSGVPSRFSGSGSG TDFTLTISSLQPEDFATYYCQQSYSTPLTFGGGT KVDIK (SEQ ID NO: 9472) | EVQLLESGGGLVQPGGSLRLSCAASGFTFSSYAMS WVRQAPGKGLEWVSGISGSGGSSYYADSVKGRFTI SRDNSKNTLYLQMNSLRAEDTAVYYCAKTLTPDYY YDMDVWGQGTTVTVSS (SEQ ID NO: 9830) |
| 18089-H9 | NA | GAGCTCCAGATGACCCAGTCTCCATCCTCCCTGT CTGCATCTGTAGGAGACAGAGTCACCATCACTTG TCGGGCGAGTCAGGGCATTAGCAATTATTTGGCA TGGTATCAGCAGAAGCCAGGGAAAGTTCCTAATC TCCTGATCTATGGTGCATCCACTTTGCAATTAGG GGTCCCATCTCGGTTCAGTGGCAGTGGCTCTGGG ACAGATTTCACTCTCACCATCAGCAGCCTGCAGC CTGAAGATGTTGCAACT (SEQ ID NO: 9473) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCGTGAGC TGGGTCCGCCAGGCTCCAGGGAAGGGGCTGGAGTG GGTCTCAGGTATTAGTGGTAGTGGTGGTAGCACAT ACTACGCAGACTCCGTGAAGGGCCGGTTCACCATC TCCAGAGACAATTCCAAGAACACGCTGTATCTGCA AATGAACAGC (SEQ ID NO: 9831) |
| | AA | ELQMTQSPSSLSASVGDRVTITCRASQGISNYLA WYQQKPGKGLEVPNLLIYGASTLQLGVPSRFSGSGSG TDFTLTISSLQPEDVATYYCQKYYSAPFTFGPGT KVDIK (SEQ ID NO: 9474) | EVQLLESGGGLVQPGGSLRLSCAASGFTFSSYAVS WVRQAPGKGLEWVSGISGSGGSSYYADSVKGRFTI SRDNSKNTLYLQMNSLRAEDTAVYYCAKALTPDYY YDMDVWGQGTTVTVSS (SEQ ID NO: 9832) |
| 18089-H12 | NA | GAGCTCCAGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9475) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAACTATGCCATGAGC TGGGTCCGCCAGGCTCCAGGGAAGGGGCTGGAGTG GGTCTCAGCTATTAGTGGTAGTGGTGGTAGTACAT ACTACGCAGACTCCGTGAAGGGCCGGTTCACCATC TCCAGAGACAATTCCAAGAACACGCTGTATCTGCA AATGAACAGC (SEQ ID NO: 9833) |
| | AA | ELQMTQSPSSLSASVGDRVTITCRASQSISSYLN WYQQKPGKAPKLLIYAASSLQSGVPSRFSGSGSG TDFTLTISSLQPEDFATYYCQQSYSTPFTFGPGT KLEIK (SEQ ID NO: 9476) | EVQLLESGGGLVQPGGSLRLSCAASGFTFSNYAMS WVRQAPGKGLEWVSAISGSGGSTYYADSVKGRFTI SRDNSKNTLYLQMNSLRAEDTAVYYCAKQGGIAAA YYYYDGMDVWGQGTTVTVSS (SEQ ID NO: 9834) |
| 18090-H9 | NA | GAGCTCGTGCTGACTCAGCTACCCTCGGTGTCCA AGGGCTTGAGACAGACCGCCACACTCACCTGCAC TGGGAACAGCAACAATGTTGGCAACCAAGGAGCA GCTTGGCTGCAGCAGCACCAGGGCCACCCTCCCA AACTCCTATCCTACAGGAATAACAACCGGCCCTC AGGGATCTCAGAGAGATTATCTGCATCCAGGTCA GGAAACACAGCCTCCCTGACCATTACTGGACTCC AGCCTGAGGACGAGGCT (SEQ ID NO: 9477) | GAGGTGCAGCTGCTCGAGTCCGGGGGAGGCGTGGT CCAGCCTGGGAGGTCCCTGAGACTCTCCTGTGCAG CGTCTGGATTCACCTTCAGTAGATATGGCATGGAT TGGGTCCGCCAGGCTCCAGGCAAGGGACTGGAGTG GGTGGCAGTTATATCATATGATGGAAGTAATAAAT ACTATGCAGACTCCGTGAAGGGCCGATTCACCATC TCCAGAGACAATTCCAAGAACACGCTGTATCTGCA AATGAACAGC (SEQ ID NO: 9835) |
| | AA | ELVLTQLPSVSKGLRQTATLTCTGNSNNVGNQGA AWLQQHQGHPPKLLSYRNNNRPSGISERLSASRS GNTASLTITGLQPEDEADYYCSAWDSSLSAVVFG GGTKLTVL (SEQ ID NO: 9478) | EVQLLESGGGVVQPGRSLRLSCAASGFTFSRYGMD WVRQAPGKGLEWVAVISYDGSNKYYADSVKGRFTI SRDNSKNTLYLQMNSLRAEDTAVYYCARNYGSGSY GAYYYYGMDVWGQGTTVTVSS (SEQ ID NO: 9836) |
| 18093-E2 | NA | GAGCTCGTGATGACCCAGTCTCCATCCTCCCTGT CTGCATCTGTAGGAGACAGAGTCACCATCACTTG CCAGGCGAGTCAGGACATTAGCAACTATTTAAAT TGGTATCAGCAGAAACCAGGGAAGGCCCCTAAGC TCCTGATCTATGCTGCATCCAGTTTGCAAAGTGG GGTCCCATCAAGGTTCAGCGGCAGTGGATCTGGG ACAGAATTCACTCTCACAATCAGCAGCCTGCAGC CTGAAGATTTTGCAACT (SEQ ID NO: 9479) | GAGGTGCAGCTGCTCGAGTCCGGGGGAGGCTTGGT ACAGCCTGGGGGGTCCCTGAGACTCTCCTGTGCAG CCTCTGGATTCACCTTACCTCCTATGCCATGAGC TGGGTCCGCCAGGCTCCAGGGAAGGGGCTGGAGTG GGTCTCAACTATTAGTCATAGTGGTGGTAGCACAT ACTACGCAGACTCCGTGAAGGGCCGGTTCACCATC TCCAGAGACAATTCCAAGAACACGCTGTATCTGCA AATGAACAGC (SEQ ID NO: 9837) |
| | AA | ELVMTQSPSSLSASVGDRVTITCQASQDISNYLN WYQQKPGKAPKLLIYAASSLQSGVPSRFSGSGSG TEFTLTISSLQPEDFATYYCQQSYSTPPTFGQGT KVDIK (SEQ ID NO: 9480) | EVQLLESGGGLVQPGGSLRLSCAASGFTFTSYAMS WVRQAPGKGLEWVSTISHSGGSTYYADSVKGRFTI SRDNSKNTLYLQMNSLRAEDTAVYYCAKDGGSGWF PKLLHYGLDVWGQGTTVTVSS (SEQ ID NO: 9838) |
| 18093-F5 | NA | GAGCTCGTGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9481) | GAGGTGCAGCTGCTCGAGTCCGGGGGAGGCTTGGT ACAGCCTGGGGGGTCCCTGAGACTCTCCTGTGCAG CCTCTGGAGTCACCTTTAGCAGCATCTATGGCATGAGC TGGGTCCGCCAGGCTCCAGGGAAGGGGCTGGAGTG GGTCTCAGCTATTAGTGGTAGTGGTGGTAGCACAT ACTACGCAGACTCCGTGAAGGGCCGGTTCACCATC TCCAGAGACAATTCCAAGAACACGCTGTATCTGCA AATGAACAGC (SEQ ID NO: 9839) |

TABLE 57-continued scFv Variable Region Sequences

| Ab | Type | LC V-region | HC V-region |
|---|---|---|---|
| | AA | ELVMTQSPSSLSASVGDRVTITCRASQSISSYLN<br>WYQQKPGKAPKLLIYAASSLQSGVPSRFSGSGSG<br>TDFTLTISSLQPEDFATYYCQQSYSVPPTFGQGT<br>KVDIK<br>(SEQ ID NO: 9482) | EVQLLESGGGLVQPGGSLRLSCAASGFTLSIYGMS<br>WVRQAPGKGLEWVSAISGSGGSTYYADSVKGRFTI<br>SRDNSKNTLYLQMNSLRAEDTAVYYCAKGEGISAR<br>YYYYGMDVWGQGTTVTVSS<br>(SEQ ID NO: 9840) |
| 18179-A3 | NA | GAGCTCGTGATGACTCAGTCTCCACTCTCCCTGC<br>CCGTCACCCCTGGAGAGCCGGCCTCCATCTCCTG<br>CAGGTCTAGTCAGAGCCTCCTGCACAGAAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9483) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCTCCCCGGGAAGGGCCT<br>GGAGTGGATTGGGTACATCTCTTACAGTGGGAGCA<br>CCTTCTACAACCCGTCCCTCAAGAGTCGAGTTACC<br>ATATCAGTAGACACGTCTAAGAACCAGTTCTCCCT<br>GAATCTGACC<br>(SEQ ID NO: 9841) |
| | AA | ELVMTQSPLSLPVTPGEPASISCRSSQSLLHRNG<br>YNYLDWYLQKPGQSPQLLIYLGSNRASGVPDRFS<br>GSGSGTDFTLKISRVEAEDVGVYYCMQALQTPFT<br>FGPGTKVDIK<br>(SEQ ID NO: 9484) | EVQLLESGPGLVKPSQTLSLTCTVSGDSISSNPYY<br>WSWIRQLPGKGLEWIGYISYSGSTFYNPSLKSRVT<br>ISVDTSKNQFSLNLTSVTAADTAVYYCARDRLWFG<br>VLNYYYGMDVWGLGTTVTVSS<br>(SEQ ID NO: 9842) |
| 18179-A5 | NA | GAGCTCGTGCTGACTCAGTCTCCACTCTCCCTGC<br>CCGTCACCCCTGGAGAGCCGGCCTCCATCTCCTG<br>CAGGTCTAGTCAGAGCCTCCTGCATAGTAATGGA<br>TACAACTATTTGGATTGGTACCTGCAGAAGCCAG<br>GGCAGTCTCCACAACTCCTGATCTATTTGGGTTC<br>TAATCGGGCCTCCGGGGTCCCTGACAGGTTCAGT<br>GGCAGTGGATCAGGCACAGATTTTACACTAAAAA<br>TCAGCAGAGTGGAGGCT<br>(SEQ ID NO: 9485) | GAGGTGCAGCTGCTCGAGTCGGGCCCAGGACTGGT<br>GAAGCCTTCGGAGACCCTGTCCCTCACCTGCACTG<br>TCTCTGGTGGCGCCATCAGCAGTGGTGATTACTAC<br>TGGAGCTGGATCCGCCAGCACCCAGGGAAGGGCCT<br>GGAGTGGATTGGGTACATCGATAAGAGTGGGAGCA<br>CCTACTACAACCCGTCCCTCAAGAGTCGAGTACC<br>ATATCAGTAGACACGTCTAAGGACCAGTTCTCCCT<br>GAAGCTGACC<br>(SEQ ID NO: 9843) |
| | AA | ELVLTQSPLSLPVTPGEPASISCRSSQSLLHSNG<br>YNYLDWYLQKPGQSPQLLIYLGSNRASGVPDRFS<br>GSGSGTDFTLKISRVEAEDVGVYYCMQALQTPFT<br>FGPGTKVEIK<br>(SEQ ID NO: 9486) | EVQLLESGPGLVKPSETLSLTCTVSGGAISSGDYY<br>WSWIRQHPGKGLEWIGYIDKSGSTYYNPSLKSRAT<br>ISVDTSKDQFSLKLTSLTAADTAVYYCAREKMWFG<br>VLNYYYGMDVWGQGTTVTVSS<br>(SEQ ID NO: 9844) |
| 18179-A9 | NA | GAGCTCGTGATGACTCAGTCTCCACTCTCCCTGC<br>CCGTCACCCCTGGAGAGCCGGCCTCCATCTCCTG<br>CAGGTCTAGTCAGAGCCTCCTGCATAGTAATGGA<br>TACAACTATGTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCGCAGATTTTACACTGAAAA<br>TCAGCAGAGTGGAGGCT<br>(SEQ ID NO: 9487) | GAGGTGCAGCTGCTCGAGTCGGGCCCAGGACTGGT<br>GAAGCCTTCACAGACCCTGTCCCTCACCTGCACTG<br>TCTCTGGTGGCGCCATCAGCAGTGGTGATTACTAC<br>TGGAGCTGGATCCGCCAGCACCCAGGGAAGGGCCT<br>GGAGTGGATTGGGTACATCGATAAGAGTGGGAGCA<br>CCTACTACAACCCGTCCCTCAAGAGTCGAGTTACC<br>ATATCAGTTGACACGTCTAAGAACCAGTTCTCCCT<br>GAATCTGACC<br>(SEQ ID NO: 9845) |
| | AA | ELVMTQSPLSLPVTPGEPASISCRSSQSLLHSNG<br>YNYVDWYLQKPGQSPQLLIYLGSNRASGVPDRFS<br>GSGSGADFTLKISRVEAEDVGVYYCMQALQTPLT<br>FGGGTKVEIK<br>(SEQ ID NO: 9488) | EVQLLESGPGLVKPSQTLSLTCTVSGGAISSGDYY<br>WSWIRQHPGKGLEWIGYIDKSGSTYYNPSLKSRVT<br>ISVDTSKNQFSLNLTSVTAADTAVYYCARDRLWFG<br>VLNYYYGMDVWGQGTTVTVSS<br>(SEQ ID NO: 9846) |
| 18179-A10 | NA | GAGCTCGTGTTGACGCAGTCTCCAGGCACCCTGT<br>CTTTGTCTCCAGGGGAAAGAGCCACCCTCTCCTG<br>CAGGTCTAGTCAGAGCCTCCTGCATAGAAATGGA<br>TACAATTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9489) | GAGGTGCAGCTGCTCGAGTCGGGCCCAGGACTGGT<br>GAAGCCTTCACAGACCCTGTCCCTCACCTGCACTG<br>TCTCTGGTGGCGCCATCAGCAGTGGTGATTACTAC<br>TGGAGCTGGATCCGCCAGCACCCAGGGAAGGGCCT<br>GGAGTGGATTGGGTACATCGATAAGAGTGGGAGCA<br>CCTACTACAACCCGTCCCTCAAGAGTCGAGCTACC<br>ATATCAGTAGACACGTCTAAGGACCAGTTCTCCCT<br>GAAGCTGAGC<br>(SEQ ID NO: 9847) |
| | AA | ELVLTQSPGTLSLSPGERATLSCRSSQSLLHRNG<br>YNYLDWYLQKPGQSPQLLIYLGSNRASGVPDRFS<br>GSGSGTDFTLKISRVEAEDVGVYYCMQALQTPRT<br>FGQGTKVEIK<br>(SEQ ID NO: 9490) | EVQLLESGPGLVKPSQTLSLTCTVSGGAISSGDYY<br>WSWIRQHPGKGLEWIGYIDKSGSTYYNPSLKSRAT<br>ISVDTSKDQFSLKLSSVTAADTAVYYCARDQLWFG<br>VLNYYYGMDVWGQGTTVTVSS<br>(SEQ ID NO: 9848) |
| 18179-B7 | NA | GAGCTCGTGATGACCCAGTCTCCATCCTCCCTGT<br>CTGCATCTGTAGGAGACAGAGTCACCATCACTTG<br>CCAGGCGAGGCAGGACATTAGCGACTATTTAAAT<br>TGGTTTCAGCAGAAACCAGGGAGAGCCCCTAAGC<br>TCCTGATCTTTGCTGCATCCAGTTTGCAAGGTGG<br>GGTCCCATCTCGGTTCAGTGGCAGTGGATCTGGG<br>ACAGATTTCACTCTCACCATCAGCAGTCTGCAAC<br>CTGAAGATTTTGCAACT<br>(SEQ ID NO: 9491) | GAGGTGCAGCTGCTCGAGTCTGGGGGAGGCTTGGT<br>AAAGCCTGGGGGGTCCCTTAGACTCTCCTGTGCAG<br>CCTCTGGATTCACTTTTAATGCCTGGATGAGC<br>TGGGTCCGCCAGGCTCCAGGGAAGGGGCTGGAGTG<br>GGTTGGCCGTATTAAAGGCAACACTTATGGTGGGA<br>CAACAGACTACGCTGCACCCGTGAAAGGCAGATTC<br>ACCATCTCAAGAGATGATTCAAAAAACACGCTGTT<br>TCTGCAAATG<br>(SEQ ID NO: 9849) |

TABLE 57-continued scFv Variable Region Sequences

| Ab | Type | LC V-region | HC V-region |
|---|---|---|---|
| | AA | ELVMTQSPSSLSASVGDRVTITCQARQDISDYLN WFQQKPGRAPKLLIFAASSLQGGVPSRFSGSGSG TDFTLTISSLQPEDFATYYCQQTYSMPFTFGPGT KVDIK (SEQ ID NO: 9492) | EVQLLESGGGLVKPGGSLRLSCAASGFTFSNAWMS WVRQAPGKGLEWVGRIKGNTYGGTTDYAAPVKGRF TISRDDSKNTLFLQMNSLKTEDTAVYYCTTPSNSG SYYNYFSVMDVWGQGTTVTVSS (SEQ ID NO: 9850) |
| 18179-B8 | NA | GAGCTCGTGATGACCCAGTCTCCATCCTCCCTGT CTGCATCTGTAGGAGACAGAGTCACCATCACTTG CCGGACAAGTCAGAGCATTAACAGCTATTTAAAT TGGTTTCAACAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTCCAAC CTGAAGATTTTGCAACT (SEQ ID NO: 9493) | GAGGTGCAGCTGCTCGAGTCCGGGGGAGGCTTGGT ACAGCCTGGGGGGTCCCTGAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 9851) |
| | AA | ELVMTQSPSSLSASVGDRVTITCRTSQSINSYLN WFQQKPGKAPKLLIYAASSLQSGVPSRFSGSGSG TDFTLTISSLQPEDFATYYCQQSYSTPFTFGPGT KVDIK (SEQ ID NO: 9494) | EVQLLESGGGLVQPGGSLRLSCAASGFTFSNAWMS WVRQAPGKGLEWVGRIKGNTYGGTTDYAAPVKGRF TISRDDSKNTLFLQMNSLKTEDTAVYYCTTPSNSG SYYNYFSVMDVWGQGTTVTVSS (SEQ ID NO: 9852) |
| 18179-C4 | NA | GAGCTCGTGATGACCCAGTCTCCACTCTCCCTGC CCGTCACCCCTGGAGAGCCGGCCTCCATCCTCTG CAGGTCTAGTCAGAGCCTCCTGCATAGTACTGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9495) | GAGGTGCAGCTGCTCGAGTCGGGCCCAGGACTGGT GAAGCCTTCACAGACCCTGTCCCTCACCTGCACTG TCTCTGGTGGCGCCATCAGCAGTGGTGATTACTAC TGGAGCTGGATCCGCCAGCACCCAGGGAAGGGCCT GGAGTGGATTGGGTACATCGATAAGAGTGGGAGCA CCTACTACAACCCGTCCCTCAAGAGTCGAGTACC ATATCAGTAGACACGTCTAAGGACCAGTTCTCCCT GAAGCTGAGC (SEQ ID NO: 9853) |
| | AA | ELVMTQSPLSLPVTPGEPASISCRSSQSLLHSTG YNYLDWYLQKPGQSPQLLIYLGSNRASGVPDRFS GSGSGTDFTLKISRVEAGDVGFYYCMQALQTPRT FGQGTKLEIK (SEQ ID NO: 9496) | EVQLLESGPGLVKPSQTLSLTCTVSGGAISSGDYY WSWIRQHPGKGLEWIGYIDKSGSTYYNPSLKSRAT ISVDTSKDQFSLKLSSVTAADTAVYYCARDRLWFG VLNYYYGMDVWGPGTTVTVSS (SEQ ID NO: 9854) |
| 18179-C6 | NA | GAGCTCGTGATGACTCAGACTCCACTCTCCCTGC CCGTCACCCCTGGAGAGCCGGCCTCCATCCTCTG CAGGTCTAGTCAGAGCCTCCTGCATAGAAATGGA TACAATTATTTGGATTGGTACTTGCATAAACCAG GGCAGTCTCCACAGCTCCTGATCTATTTGGGTTC TAATCGGGCCTCCGGGGTCCCTGAACAGGTTCATT GGCAGTGGCTCAGGCACAGATTTTACACTGAAAA TCAGCAAAGTGGAGGCT (SEQ ID NO: 9497) | GAGGTGCAGCTGCTCGAGTCGGGCCCAGGACTGGT GAAGCCTTCACAGACCCTGTCCCTCACCTGCACTG TCTCTGGTGGCGCCATCAGCAGTGGTGATTACTAC TGGAGCTGGATCCGCCAGCACCCAGGGAAGGGCCT GGAGTGGATTGGGTACATCGATAAGAGTGGGAGCA CCTACTACAACCCGTCCCTCAAGAGTCGAGTACC ATATCAGTAGACACGTCTAAGGACCAGTTCTCCCT GAAGCTGAGC (SEQ ID NO: 9855) |
| | AA | ELVMTQTPLSLPVTPGEPASISCRSSQSLLHRNG YNYLDWYLHKPGQSPQLLIYLGSNRASGVPDRFI GSGSGTDFTLKISKVEAEDVGIYYCMQALQTPRT FGQGTKVEIK (SEQ ID NO: 9498) | EVQLLESGPGLVKPSQTLSLTCTVSGGAISSGDYY WSWIRQHPGKGLEWIGYIDKSGSTYYNPSLKSRAT ISVDTSKDQFSLKLSSVTAADTAVYYCARDQLWFG VLNYYYGMDVWGQGTTVTVSS (SEQ ID NO: 9856) |
| 18179-C7 | NA | GAGCTCGTGCTGACTCAGTCTCCACTCTCCCTGC CCGTCACCCCTGGAGAGCCGGCCTCCATCCTCTG CAGGTCTAGTCAGAGCCTCCTGCATCGTAATGGA TACCACTATTTGGATTGGTACCTGCAGAAGCCAG GGCAGTCTCCACAACTCCTGATCTATTTGGGTTC TAATCGGGCCTCCGGGGTCCCTGACAGGTTCATT GGCAGTGGCTCAGGCACAGATTTTACACTGGAAA TCAGCAGAGTGGAGGCT (SEQ ID NO: 9499) | GAGGTGCAGCTGCTCGAGTCGGGCCCAGGACTGGT GAAGCCTTCACAGACCCTGTCCCTCACCTGCACTG TCTCTGGTGACTCCATCAGCAGTAATCCTTACTAC TGGAGCTGGATCCGCCAGCACCCAGGGAAGGGCCT GGAGTGGATTGGGTACATCTCTCACAGTGGGAGCA CTTATTACAATCGTCCCTCAAGAGTCGAGTAACC ATATCAGTAGACACGTCTAAGAATCAGTTCTCCCT GAATCTGACC (SEQ ID NO: 9857) |
| | AA | ELVLTQSPLSLPVTPGEPASISCRSSQSLLHRNG YHYLDWYLQKPGQSPQLLIYLGSNRASGVPDRFI GSGSGTDFTLEISRVEAEDVGVYYCMQALQTPSF GQGTKLEIK (SEQ ID NO: 9500) | EVQLLESGPGLVKPSQTLSLTCTVSGDSISSNPYY WSWIRQHPGKGLEWIGYISHSGSTYYNPSLKSRVT ISVDTSKNQFSLNLTSVTAADTAVYYCAREKMWFG VLNYYYGMDVWGLGTTVTVSS (SEQ ID NO: 9858) |
| 18179-C10 | NA | GAGCTCGTGCTGACTCAGTCTCCACTCTCCCTGC CCGTCACCCCTGGAGAGCCGGCCTCCATCCTCTG CAGGTCTAGTCAGAGCCTCCTGCATAGAAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9501) | GAGGTGCAGCTGCTCGAGTCGGGCCCAGGACTGGT GAAGCCTTCACAGACCCTGTCCCTCACCTGCACTG TCTCTGGTGACTCCATCAGCAGTAATCCTTACTAC TGGAGCTGGATCCGCCAGCACCCAGGGAAGGGCCT GGAGTGGATTGGGTACATCTCTCACAGTGGGAGCA CTTATTACAATCGTCCCTCAAGAGTCGAGTAACC ATATCAGTAGACACGTCTAAGAATCAGTTCTCCCT GAAGCTGACC (SEQ ID NO: 9859) |

TABLE 57-continued scFv Variable Region Sequences

| Ab | Type | LC V-region | HC V-region |
|---|---|---|---|
| | AA | ELVLTQSPLSLPVTPGEPASISCRSSQSLLHRNG YNYLDWYLQKPGQSPQLLIYLGSNRASGVPDRFS GSGSGTDFTLKISRVEAEDVGVYYCMQALQTPFT FGPGTKVEIK (SEQ ID NO: 9502) | EVQLLESGPGLVKPSQTLSLTCTVSGDSISSNPYY WSWIRQHPGKGLEWIGYISHSGSTYYNPSLKSRVT ISVDTSKNQFSLKLTSVTAADTAVYYCARDRLWFG VLNYYYGMDVWGLGTTVTVSS (SEQ ID NO: 9860) |
| 18179-D8 | NA | GAGCTCGTGATGACCCAGTCTCCATCCTCCCTGT CTGCATCTGTAGGAGACAGAGTCACCATCACTT GCCGGACAAGTCAGAGCATTAGCAGCTATTTAAA TTGGTATCAGCAGAAACCAGGGAGAGCCCCTAAG CTCCTGATCTTTGCTGCATCCAGTTTGCAAGGTG GGGTCCCATCAAGGTTCAGTGGCAGTGGATCTGG GACAGATTTCACTCTCACCATCAGCAGTCTCCAA CCTGAAGATTTTGCAACT (SEQ ID NO: 9503) | GAGGTGCAGCTGCTCGAGTCCGGGGGAGGCTTGGT AAAGCCTGGGGGGTCCCTTAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 9861) |
| | AA | ELVMTQSPSSLSASVGDRVTITCRTSQSISSYLN WYQQKPGKAPKLLIFAASSLQGGVPSRFSGSGSG TDFTLTISSLQPEDFATYYCQQTYSMPFTFGPGT KVDIK (SEQ ID NO: 9504) | EVQLLESGGGLVKPGGSLRLSCAASGFTFSNAWMS WVRQAPGKGLEWVGRIKGNTYGGTTDYAAPVKGRF TISRDDSKNTLFLQMNSLKTEDTAVYYCTTPSNSG SYYNYFSVMDVWGQGTTVTVSS (SEQ ID NO: 9862) |
| 18179-D9 | NA | GAGCTCGTGATGACCCAGTCTCCATCCTCCCTGT CTGCATCTGTAGGAGACAGAGTCACCATCACTTG CCGGACAAGTCAGAGCATTAACAGCTATTTAAAT TGGTTTCAACAGAAACCAGGGAAAGCCCCTAAGC TCCTGATCTTTGCTGCATCCAGTTTACAAAGTGG GGTCCCATCAAGGTTCAGTGGCAGTGGATCTGGG ACAGATTTCACTCTCACCATCAGCAGTCTGCAAC GTGAAGATTTTGCAACT (SEQ ID NO: 9505) | GAGGTGCAGCTGCTCGAGTCCGGGGGAGGCTTGGT AAAGCCTGGGGGGTCCCTTAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 9863) |
| | AA | ELVMTQSPSSLSASVGDRVTITCRTSQSINSYLN WFQQKPGKAPKLLIFAASSLQGGVPSRFSGSGSG TDFTLTISSLQREDFATYYCQQSYSTPFTFGPGT KVDIK (SEQ ID NO: 9506) | EVQLLESGGGLVKPGGSLRLSCAASGFTFSNAWMS WVRQAPGKGLEWVGRIKGNTYGGTTDYAAPVKGRF TISRDDSKNTLFLQMNSLKTEDTAVYYCTTPSYSG SYYNYFSVMDVWGQGTTVTVSS (SEQ ID NO: 9864) |
| 18179-E6 | NA | GAGCTCCAGATGACCCAGTCTCCATCCTCCCTGT CTGCATCTGTAGGAGACAGAGTCACCATCACTTG CCGGACAAGTCAGAGCATTAGCAGCTATTTAAAT TGGTATCAGCAGAAACCAGGGAGAGCCCCTAAGC TCCTGATCTTTGCTGCATCCAGTTTGCAAGGTGG GGTCCCATCAAGGTTCAGTGGCAGTGGATCTGGG ACAGATTTCACTCTCACCATCAGCAGTCTCCAAC CTGAAGATTTTGCAACT (SEQ ID NO: 9507) | GAGGTGCAGCTGCTCGAGTCTGGGGGAGGCTTGGT ACAGCCTGGGGGGTCCCTGAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 9865) |
| | AA | ELQMTQSPSSLSASVGDRVTITCRTSQSISSYLN WYQQKPGRAPKLLIFAASSLQGGVPSRFSGSGSG TDFTLTISSLQPEDFATYYCQQTYSMPFTFGPGT KLEIK (SEQ ID NO: 9508) | EVQLLESGGGLVQPGGSLRLSCAASGFTFSNAWMS WVRQAPGKGLEWVGRIKGNTYGGTTDYAAPVKGRF TISRDDSKNTLFLQMNSLKTEDTAVYYCTTPSNSG SYYNYFSVMDVWGQGTTVTVSS (SEQ ID NO: 9866) |
| 18179-F3 | NA | GAGCTCGTGCTGACTCAGTCTCCACTCTCCCTGC CCGTCACCCCTGGAGAGCCGGCCTCCATCTCCTG CAGGTCTAGTCAGAGCCTCCTGCATCGTAATGGA TACAACTATTTGGATTGGTACCTGCAGAAGCCAG GGCAGTCTCCACAGCTCCTGATCTATTTGGGTTC TAATCGGGCCTCCGGGGTCCCTGACAGGTTCATT GGCAGTGGCTCAGGCACAGATTTTACACTGGAAA TCAGCAGAGTGGAGGCT (SEQ ID NO: 9509) | GAGGTGCAGCTGCTCGAGTCGGGCCCAGGACTGGT GAAGCCTTCGGAGACCCTGACCCTCACCTGCACTG TCTCTGGTGGCTCCATCAGTAGTTACTACTGGAGC TGGATCCGGCAGCCCGCCGGGAAGGGACTGGAGTG GATTGGGCATATCTATACCAGTGGGAGCACCAACT ACAACCCCTCCCTCAAGAGTCGAGTCACCATGTCA GTGGACTCGTCCAAGAACCAGTTCTCCCTGAAGCT GACCTCTCTG (SEQ ID NO: 9867) |
| | AA | ELVLTQSPLSLPVTPGEPASISCRSSQSLLHRNG YNYLDWYLQKPGQSPQLLIYLGSNRASGVPDRFI GSGSGTDFTLEISRVEAEDVGVYYCMQALQTPSF GQGTKLEIK (SEQ ID NO: 9510) | EVQLLESGPGLVKPSETLTLTCTVSGGSISSYYWS WIRQPAGKGLEWIGHIYTSGSTNYNPSLKSRVTMS VDSSKNQFSLKLTSLTAADTAVYYCAREKMWFGVL NYYYGMDVWGQGTTVTVSS (SEQ ID NO: 9868) |
| 18179-F4 | NA | GAGCTCGTGCTGACTCAGTCTCCACTCTCCCTGC CCGTCACCCCTGGAGAGCCGGCCTCCATCTCCTG CAGGTCTAGTCAGAGCCTCCTGCATCGTAATGGA TACCACTATTTGGATTGGTACCTGCAGAAGCCAG GGCAGTCTCCACAACTCCTGATCTATTTGGGTTC TAATCGGGCCTCCGGGGTCCCTGACAGGTTCAGT GGCAGTGGATCAGGCACAGATTTTACACTGAAAA TCAGCAGAGTGGAGGCT (SEQ ID NO: 9511) | GAGGTGCAGCTGCTCGAGTCGGGCCCAGGACTGGT GAAGCCTTCACAGACCCTGTCCCTCACCTGCACTG TCTCTGGTGACTCCATCAGCAGTAATCCTTACTAC TGGAGCTGGATCCGCCAGCTCCCGGGAAGGGACT GGAGTGGATTGGGTACATCTTACAGTGGGAGCA CCTTCTACAACCCGTCCCTCAAGAGTCGAGTTACC ATATCAGTAGACACGTCTAAGAACCAGTTCTCCCT GAATCTGACC (SEQ ID NO: 9869) |

TABLE 57-continued scFv Variable Region Sequences

| Ab | Type | LC V-region | HC V-region |
|---|---|---|---|
| | AA | ELVLTQSPLSLPVTPGEPASISCRSSQSLLHRNG<br>YHYLDWYLQKPGQSPQLLIYLGSNRASGVPDRFS<br>GSGSGTDFTLKISRVEAEDVGVYYCMQALQTPFT<br>FGPGTKVEIK<br>(SEQ ID NO: 9512) | EVQLLESGPGLVKPSQTLSLTCTVSGDSISSNPYY<br>WSWIRQLPGKGLEWIGYISYSGSTFYNPSLKSRVT<br>ISVDTSKNQFSLNLTSVTAADTAVYYCARDRLWFG<br>VLNYYYGMDVWGLGTTVTVSS<br>(SEQ ID NO: 9870) |
| 18179-F6 | NA | GAGCTCGTGATGACCCAGTCTCCACTCTCCCTGC<br>CCGTCACCCCTGGAGAGCCGGCCTCCATCTCCTG<br>CAGGTCTAGTCAGAGCCTCCTGCATAGTAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTAAAAA<br>TCAGCAGAGTGGAGGCT<br>(SEQ ID NO: 9513) | GAGGTGCAGCTGCTCGAGTCGGGCCCAGGACTGGT<br>GAAGCCTTCACAGACCCTGTCCCTCACCTGCACTG<br>TCTCTGGTGGCGCCATCAGCAGTGGTGATTACTAC<br>TGGAGCTGGATCCGCCAGCACCCAGGGAAGGGCCT<br>GGAGTGGATTGGGTACATCGATAAGAGTGGGAGCA<br>CCTACTACAACCCGTCCCTCAAGAGTCGAGCTACC<br>ATATCAGTAGACACGTCTAAGGACCAGTTCTCCCT<br>GAAGCTGAGC<br>(SEQ ID NO: 9871) |
| | AA | ELVMTQSPLSLPVTPGEPASISCRSSQSLLHSNG<br>YNYLDWYLQKPGQSPQLLIYLGSNRASGVPDRFS<br>GSGSGTDFTLKISRVEAEDVGFYYCMQALQTPRT<br>FGQGTKVEIK<br>(SEQ ID NO: 9514) | EVQLLESGPGLVKPSQTLSLTCTVSGGAISSGDYY<br>WSWIRQHPGKGLEWIGYIDKSGSTYYNPSLKSRAT<br>ISVDTSKDQFSLKLSSVTAADTAVYYCARDQLWFG<br>VLNYYYGMDVWGQGTTVTVSS<br>(SEQ ID NO: 9872) |
| 18179-F10 | NA | GAGCTCGTGATGACCCAGACTCCACTCTCCCTGC<br>CCGTCACCCCTGGAGAGCCGGCCTCCATCTCCTG<br>CAGGTCTAGTCAGAGCCTCCTGCATAGTAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTAAAAA<br>TCAGCAGAGTGGAGGCT<br>(SEQ ID NO: 9515) | GAGGTGCAGCTGCTCGAGTCGGGCCCAGGACTGGT<br>GAAGCCTACGGAGACCCTGTCCCTCACCTGCACTG<br>TCTCTGGTGGCTCCATCAGTGATTTCTTCTGGAGC<br>TGGATCCGGCAGCCCCCAGGAAAGGGACTGGAGTG<br>GATTGGATATATCTATTACAGAGGGAGCACCAACT<br>ACCACCCCTCCCTCAAGAGTCGAGTCACCATGTCA<br>GTGGACACGTCCAAGAACCAGTTCTCCCTGAAGCT<br>GACCTCTCTG<br>(SEQ ID NO: 9873) |
| | AA | ELVMTQTPLSLPVTPGEPASISCRSSQSLLHSNG<br>YNYLDWYLQKPGQSPQLLIYLGSNRASGVPDRFS<br>GSGSGTDFTLKISRVEAEDVGFYYCMQALQTPRT<br>FGQGTKVEIK<br>(SEQ ID NO: 9516) | EVQLLESGPGLVKPTETLSLTCTVSGGSISDFFWS<br>WIRQPPGKGLEWIGYIYYRGSTNYHPSLKSRVTMS<br>VDTSKNQFSLKLTSLTAADTAVYYCAREKMWFGVL<br>NYYYGMDVWGQGTTVTVSS<br>(SEQ ID NO: 9874) |
| 18179-G8 | NA | GAGCTCGTGATGACCCAGTCTCCACTCTCCCTGC<br>CCGTCACCCCTGGAGAGCCGGCCTCCATCTCCTG<br>CAGGTCTAGTCAGAGCCTCCTGCATAGAAATGGA<br>TACAATTATTTGGATTGGTACTTGCATAAACCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTAAAAA<br>TCAGCAGAGTGGAGGCT<br>(SEQ ID NO: 9517) | GAGGTGCAGCTGCTCGAGTCGGGCCCAGGACTGGT<br>GAAGCCTTCACAGACCCTGTCCCTCACCTGCACTG<br>TCTCTGGTGGCGCCATCAGCAGTGGTGATTACTAC<br>TGGAGCTGGATCCGCCAGCACCCAGGGAAGGGCCT<br>GGAGTGGATTGGGTACATCGATAAGAGTGGGAGCA<br>CCTACTACAACCCGTCCCTCAAGAGTCGAGCTACC<br>ATATCAGTAGACACGTCTAAGGACCAGTTCTCCCT<br>GAAGCTGAGC<br>(SEQ ID NO: 9875) |
| | AA | ELVMTQSPLSLPVTPGEPASISCRSSQSLLHRNG<br>YNYLDWYLHKPGQSPQLLIYLGSNRASGVPDRES<br>GSGSGTDFTLKISRVEAEDVGVYYCMQALQTPRT<br>FGQGTKVEIK<br>(SEQ ID NO: 9518) | EVQLLESGPGLVKPSQTLSLTCTVSGGAISSGDYY<br>WSWIRQHPGKGLEWIGYIDKSGSTYYNPSLKSRAT<br>ISVDTSKDQFSLKLSSVTAADTAVYYCARDQLWFG<br>VLNYYYGMDVWGQGTTVTVSS<br>(SEQ ID NO: 9876) |
| 18179-G9 | NA | GAGCTCGTGATGACTCAGACTCCACTCTCCCTGC<br>CCGTCACCCCTGGAGAGCCGGCCTCCATCTCCTG<br>CAGGTCTAGTCAGAGCCTCCTGCATAGAAATGGT<br>TACAATTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCATT<br>GGCAGTGGCTCAGGCACAGATTTTACACTGAAAA<br>TCAGCAGAGTGGAGGCT<br>(SEQ ID NO: 9519) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCACCCAGGGATGGGCCT<br>GGAGTGGATTGGGTACATCTATTACAGTGGGAGCA<br>CCTCCTACAACCCGTCCCTCAAGAGTCGAGTCACC<br>ATGTCAGTGGACTCGTCCAAGAACCAGTTCTCCCT<br>GAAGCTGACC<br>(SEQ ID NO: 9877) |
| | AA | ELVMTQTPLSLPVTPGEPASISCRSSQSLLHRNG<br>YNYLDWYLQKPGQSPQLLIYLGSNRASGVPDRFI<br>GSGSGTDFTLKISRVEAEDVGVYYCMQALQTPSF<br>GQGTKVEIK<br>(SEQ ID NO: 9520) | EVQLLESGPGLVKPSQTLSLTCTVSGDSISSNPYY<br>WSWIRQHPGMGLEWIGYIYYSGSTSYNPSLKSRVT<br>MSVDSSKNQFSLKLTSVTAADTAVYYCARDLLWFG<br>KLNYYYGLDVWGQGTTVTVSS<br>(SEQ ID NO: 9878) |
| 18179-H6 | NA | GAGCTCGTGATGACTCAGACTCCACTCTCCCTGC<br>CCGTCACCCCTGGAGAGCCGGCCTCCATCTCCTG<br>CAGGTCTAGTCAGAGCCTCCTGCATAGAAATGGA<br>TACAACTATTTGGATTGGTACCTGCAGAAGCCAG<br>GGCAATCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9521) | GAGGTGCAGCTGCTCGAGTCGGGCCCAGGACTGGT<br>GAAGCCTTCACAGACCCTGTCCCTCACCTGCACTG<br>TCTCTGGTGGCGCCATCAGCAGTGGTGATTACTAC<br>TGGAGCTGGATCCGCCAGCACCCAGGGAAGGGCCT<br>GGAGTGGATTGGGTACATCGATAAGAGTGGGAGCA<br>CCTACTACAACCCGTCCCTCAAGAGTCGAGCTACC<br>ATATCAGTAGACACGTCTAAGAACCAGTTCTCCCT<br>GAAGCTGAGC<br>(SEQ ID NO: 9879) |

TABLE 57-continued scFv Variable Region Sequences

| Ab | Type | LC V-region | HC V-region |
|---|---|---|---|
| | AA | ELVMTQTPLSLPVTPGEPASISCRSSQSLLHRNG<br>YNYLDWYLQKPGQSPQLLIYLGSNRASGVPDRFS<br>GSGSGTDFTLKISRVEAEDAGVYYCMQSLHLPPT<br>FGGGTKLEIK<br>(SEQ ID NO: 9522) | EVQLLESGPGLVKPSQTLSLTCTVSGGAISSGDYY<br>WSWIRQHPGKGLEWIGYIDKSGSTYYNPSLKSRAT<br>ISVDTSKNQFSLKLSSVTAADTAVYYCARDLLWFG<br>KLNYYYGLDVWGQGTTVTVSS<br>(SEQ ID NO: 9880) |
| 18179-H9 | NA | GAGCTCGTGCTGACTCAGTCTCCACTCTCCCTGC<br>CCGYCACCCCTGGAGAGCCGGCCTCCATCTCCTG<br>CAGGTCTAGTCAGAGCCTCCTGCATCGTAATGGA<br>TACCACTATTTGGATTGGTACCTGCAGAAGCCAG<br>GCCAGTCTCCACAGCTCCTGATCTATTTGGGTTC<br>TAATCGGGCCTCCGGGGTCCCATCAAGGTTCAGT<br>GGCAGTGGATCAGGCACAGATTTTACACTGAAAA<br>TCAGCAGAGTGGAGGCT<br>(SEQ ID NO: 9523) | GAGGTGCAGCTGCTCGAGTCGGGCCCAGGACTGGT<br>GAAGCCTTCACAGACCCTGTCCCTCACCTGCACTG<br>TCTCTGGTGGCTCCATCAGCAGTAATCCTTACTAC<br>TGGAGCTGGATCCGCCAGCACCCAGGGAAGGGCCT<br>GGAGTGGATTGGGTACATCTCTCACAGTGGGAGCA<br>CTTATTACAATCCGTCCCTCAAGAGTCGAGTAACC<br>ATATCAGTAGACACGTCTAAGAACCAGTTCTCCCT<br>GAATCTGACC<br>(SEQ ID NO: 9881) |
| | AA | ELVLTQSPLSLPVTPGEPASISCRSSQSLLHRNG<br>YHYLDWYLQKPGQSPQLLIYLGSNRASGVPSRES<br>GSGSGTDFTLKISRVEAEDVGIYYCMQALQTPFT<br>FGPGTKVEIK<br>(SEQ ID NO: 9524) | EVQLLESGPGLVKPSQTLSLTCTVSGGSISSNPYY<br>WSWIRQHPGKGLEWIGYISHSGSTYYNPSLKSRVT<br>ISVDTSKNQFSLNLTSVTAADTAVYYCAREKMWFG<br>VLNYYYGMDVWGQGTTVTVSS<br>(SEQ ID NO: 9882) |
| 18181-A11 | NA | GAGCTCGTGATGACTCAGTCTCCACTCTCCCTGC<br>CCGTCACCCCTGGAGAGCCGGCCTCCATCTCCTG<br>CAGGTCTAGTCAGAGCCTCCTGCATAGAAATGGA<br>TACAACTATTTGGATTGGTACCTGCAGAAGCCAG<br>GCCAGTCTCCACAGCTCCTGATCTATTTGGGTTC<br>TAATCGGGCCTCCGGGGTCCCTGACAGGTTCAGT<br>GGCAGTGGATCAGGCACAGATTTCACGCTGAAAA<br>TCAGCAGAGTGGAGGCT<br>(SEQ ID NO: 9525) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCACCCAGGGAAGGGCCT<br>GGAGTGGATTGGGTACATCTCTTACAGTGGGAGCA<br>CCTACTACAACCCGTCCCTCAAGAGTCGAGTTACC<br>ATATCAGTAGACACGTCTAAGAACCAGTTCTCCCT<br>GAATCTGACC<br>(SEQ ID NO: 9883) |
| | AA | ELVMTQSPLSLPVTPGEPASISCRSSQSLLHRNG<br>YNYLDWYLQKPGQSPQLLIYLGSNRASGVPDRES<br>GSGSGTDFTLKISRVEAEDVGIYYCMQALQTPFT<br>FGPGTKVEIK<br>(SEQ ID NO: 9526) | EVQLLESGPGLVKPSQTLSLTCTVSGDSISSNPYY<br>WSWIRQHPGKGLEWIGYISYSGSTYYNPSLKSRVT<br>ISVDTSKNQFSLNLTSVTAADTAVYYCARDRLWFG<br>VLNYYYGMDVWGPGTTVTVSS<br>(SEQ ID NO: 9884) |
| 18181-C6 | NA | GAGCTCGTGATGACTCAGTCTCCACTCTCCCTGC<br>CCGTCACCCCTGGAGAGCCGGCCTCCATCTCCTG<br>CAGGTCTAGTCAGAGCCTCCTGCATAGTACTGGA<br>TACAACTATTTGGATTGGTACCTGCAGAAGCCAG<br>GCCAGTCTCCACAGCTCCTGATCTATTTGGGTTC<br>TAATCGGGCCTCCGGGGTCCCTGAACAGGTTCAGT<br>GGCAGTGGATCAGGCACAGATTTTACACTAAAAA<br>TCAGCAGAGTGGAGGCT<br>(SEQ ID NO: 9527) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCACCCAGGGAAGGGCCT<br>GGAGTGGATTGGGTACATCTCTTACAGTGGGAGCA<br>CCTACTACAACCCGTCCCTCAAGAGTCGAGTTACC<br>ATATCAGTAGACACGTCTAAGAACCAGTTCTCCCT<br>GAATCTGACC<br>(SEQ ID NO: 9885) |
| | AA | ELVMTQSPLSLPVTPGEPASISCRSSQSLLHSTG<br>YNYLDWYLQKPGQSPQLLIYLGSNRASGVPDRFS<br>GSGSGTDFTLKISRVEAEDVGFYYCMQGLQTPRT<br>FGQGTKLEIK<br>(SEQ ID NO: 9528) | EVQLLESGPGLVKPSQTLSLTCTVSGDSISSNPYY<br>WSWIRQHPGKGLEWIGYISYSGSTYYNPSLKSRVT<br>ISVDTSKNQFSLNLTSVTAADTAVYYCARDRLWFG<br>VLNYYYGMDVWGPGTTVTVSS<br>(SEQ ID NO: 9886) |
| 18181-G7 | NA | GAGCTCGTGATGACCCAGTCTCCATCCTCCCTGT<br>CTGCATCTGTAGGAGACAGAGTCACCATCACTTG<br>CCGGACAAGTCAGAGCATTAGCAGCTATTTAAAT<br>TGGTATCAGCAGAAACCAGGGAGAGCCCCTAAGC<br>TCCTGATCTTTGCTGCATCCAGTTTGCAAGGTGG<br>GGTCCCATCAAGGTTCAGTGGCAGTGGATCTGGG<br>ACAGATTTCACTCTCACCATCAGCAGTCTCCAAC<br>CTGAAGATTTTGCAACT<br>(SEQ ID NO: 9529) | GAGGTGCAGCTGCTCGAGTCTGGGGGAGGCTTGGT<br>AAAGCCTGGGGGGTCCCTTAGACTCTCCTGTGCAG<br>CCTCTGGATTCACTTTCAGTAACGCCTGGATGAGC<br>TGGGTCCGCCAGGCTCCAGGGAAGGGGCTGGAGTG<br>GGTTGGCCGTATTAAAGGCAACACTTATGGTGGGA<br>CAACAGACTACGCTGCACCCGTGAAAGGCAGATTC<br>ACCATCTCAAGAGATGATTCAAAAAACACGCTGTT<br>TCTGCAAATG<br>(SEQ ID NO: 9887) |
| | AA | ELVMTQSPSSLSASVGDRVTITCRTSQSISSYLN<br>WYQQKPGRAPKLLIFAASSLQGGVPSRFSGSGSG<br>TDFTLTISSLQPEDFATYYCQQTYSMPFTFGPGT<br>KVEIK<br>(SEQ ID NO: 9530) | EVQLLESGGGLVKPGGSLRLSCAASGFTFSNAWMS<br>WVRQAPGKGLEWVGRIKGNTYGGTTDYAAPVKGRF<br>TISRDDSKNTLFLQMNSLKTEDTAVYYCTTPSNGG<br>SYYNYFSVMDVWGQGTTVTVSS<br>(SEQ ID NO: 9888) |
| 18181-H10 | NA | GAGCTCGTGATGACTCAGTCTCCACTCTCCCTGC<br>CCGTCACCCCTGGAGAGCCGGCCTCCATCTCCTG<br>CAGGTCTAGTCAGAGCCTCCTGCATAGTAATGGA<br>TACAACTATTTGGATTGGTACCTGCAGAAGCCAG<br>GCCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9531) | GAGGTGCAGCTGCTCGAGTCGGGCCCAGGACTGGT<br>GAAGCCTTCGGAGACCCTGTCCCTCACCTGCACTG<br>TCTCTGGTGGCTCCATCAGTAATTACTACTGGAGC<br>TGGGTCCGGCAGCCCGCCGGGAAGGGACTGGAGTG<br>GATTGGTCATATCTATACCAGTGGGAGCACCAACT<br>TCAACCCCTCCCTCAAGAGTCGAGTCACCATGTCA<br>GTGGACACGTCCAAGAACCAGTTCTCCCTGAAGCT<br>GACCTCTCTG<br>(SEQ ID NO: 9889) |

TABLE 57-continued scFv Variable Region Sequences

| Ab | Type | LC V-region | HC V-region |
|---|---|---|---|
| | AA | ELVMTQSPLSLPVTPGEPASISCRSSQSLLHSNG YNYLDWYLQKPGQSPQLLIYLGSNRASGVPDRFS GSGSGTDFTLKISRVEAEDVGIYYCMQALQTPRT FGQGTKVDIK (SEQ ID NO: 9532) | EVQLLESGPGLVKPSETLSLTCTVSGGSISNYYWS WVRQPAGKGLEWIGHIYTSGSTNFNPSLKSRVTMS VDTSKNQFSLKLTSLTAADTAVYYCAREKMWFGVL NYYYGMDVWGQGTTVTVSS (SEQ ID NO: 9890) |
| 18182-A3 | NA | GAGCTCGTGCTGACTCAGCCACCCTCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTGCTGG TCGTCTATGATGATAACGACCGGCCCTCAGGGAT CCCTGAGCGATTCTCTGGCTCCAACTTTGGGAAC ACGGCCACCCTGATTATCAGTAGGGTCGAAGCCG GGGATGAGGCCGACTAT (SEQ ID NO: 9533) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGTAGTGGTGGTAGCACAT ACTACGCAGACTCCGTGAAGGGCCGGTTCACCATC TCCAGAGACAATTCCAAGAACACGCTGTATCTGCA AATGAACAGC (SEQ ID NO: 9891) |
| | AA | ELVLTQPPSVSVAPGQTARITCGGNNIGSKSVHW YQQKPGQAPVLVVYDDNDRPSGIPERFSGSNFGN TATLIISRVEAGDEADYYCQVWDSSSDHVVFGGG TKLTVL (SEQ ID NO: 9534) | EVQLLESGGGLVQPGGSLRLSCAASGFTFSSYAMS WVRQAPGKGLEWVSAISGSGGSTYYADSVKGRFTI SRDNSKNTLYLQMNSLRAEDTAVYYCATGKGVHLG FDYWGQGTLVTVSS (SEQ ID NO: 9892) |
| 18182-A5 | NA | GAGCTCGTGCTGACTCAGCCGCCTTCGGTGTCAG TGGCCCCAGGACAGACGGCCAGGATTACCTGTGG GGGAAACAACATTGGAAGTAAAAGTGTGCAGTGG TACCAGCAGAAGCCAGGCCAGGCCCCTGTGCTGG TCGTCTATGATGATAACGACCGGCCCTCAGGGAT CCCTGAGCGATTCTCTGGCTCCAACTCTGGGAAC ACGGCTACCCTGACCATCAGCAGGGTCGAAGCCG GGGATGAGGCCGACTTT (SEQ ID NO: 9535) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCCATGCCATGAGC TGGGTCCGCCAGGCTCCAGGGAAGGGGCTGGAGTG GGTCTCAGCTATTAGTGGTAGTGGTGGTGGCACTT ACTACGCAGACTCCGTGAAGGGCCGGTTCACCATC TCCAGAGACAATTCCAAGAACACGCTGTATCTGCA AATGAACAGC (SEQ ID NO: 9893) |
| | AA | ELVLTQPPSVSVAPGQTARITCGGNNIGSKSVQW YQQKPGQAPVLVVYDDNDRPSGIPERFSGSNSGN TATLTISRVEAGDEADFYCQVWDSSSDHVVFGGG TKLTVL (SEQ ID NO: 9536) | EVQLLESGGGLVQPGGSLRLSCAASGFTFSSHAMS WVRQAPGKGLEWVSAISGSGGGTYYADSVKGRFTI SRDNSKNTLYLQMNSLRAEDTAVYYCATGKGVHLN FDYWGQGTLVTVSS (SEQ ID NO: 9894) |
| 18182-A6 | NA | GAGCTCGTGGTGACTCAGGAGCCATCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTGATGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTAT (SEQ ID NO: 9537) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAACTATTAGTGGAAGTGGTGGTGGCACAT ACTACGCAGACTCCGTGAAGGGCCGGTTCACCATC TCCAGAGACAATTCCAAGAACACGCTGTATCTGCA AATGAACAGC (SEQ ID NO: 9895) |
| | AA | ELVVTQEPSVSVAPGQTARITCGGNNIGSKSVHW YQQKPGQAPVMVVYDDNDRPSGIPERFSGSNSGN TATLTISRVEAGDEADYYCQVWDSSSDHVVFGGG TKLTVL (SEQ ID NO: 9538) | EVQLLESGGGLVQPGGSLRLSCAASGFTFSSYAMS WVRQAPGKGLEWVSTISGSGGGTYYADSVKGRFTI SRDNSKNTLYLQMNSLRAEDTAVYYCATGKGVHLG FDYWGQGTLVTVSS (SEQ ID NO: 9896) |
| 18182-A7 | NA | GAGCTCGTGCTGACTCAGCTACCCTCGGTGTCAG TGGCCCCAGGACAGACGGCCAGGATTACCTGTGG GGGAAACAACATTGGAAGTAAAAGTGTGCACTGG CACCAGCAGAAGCCAGGCCAGGCCCCTGTGATGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTAT (SEQ ID NO: 9539) | GAGGTGCAGCTGCTCGAGTCTGGGGGAGGCTTGGT GCAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGAAGTGGTGGTGGCACAT ACTACGCAGACTCCGTGAAGGGCCGGTTCACCATC TCCAGAGACAATTCCAAGAACACGCTGTATCTGCA AATGAACAGC (SEQ ID NO: 9897) |
| | AA | ELVLTQLPSVSVAPGQTARITCGGNNIGSKSVHW HQQKPGQAPVMVVYDDNDRPSGIPERFSGSNSGN TATLTISRVEAGDEADYHCQVWDSSSDHVVFGGG TKLTVL (SEQ ID NO: 9540) | EVQLLESGGGLVQPGGSLRLSCAASGFTFSSYAMS WVRQAPGKGLEWVSAISGSGGGTYYADSVKGRFTI SRDNSKNTLYLQMNSLRAEDTAVYYCATGKGVHLG FDYWGQGTLVTVSS (SEQ ID NO: 9898) |
| 18182-A8 | NA | GAGCTCGTGCTGACTCAATCATCCTCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTGCTGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTTT (SEQ ID NO: 9541) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGTAGTGGTGGTGGCACAT ACAACGCAGACTCCGTGAAGGGCCGGTTCACCATC TCCAGAGACAATTCCAAGAACACGCTGTATCTGCA AATGAACAGC (SEQ ID NO: 9899) |

TABLE 57-continued scFv Variable Region Sequences

| Ab | Type | LC V-region | HC V-region |
|---|---|---|---|
| | AA | ELVLTQSSSVSVAPGQTARITCGGNNIGSKSVHW YQQKPGQAPVLVVYDDNDRPSGIPERFSGSNSGN TATLTISRVEAGDEADFYCQVWDSSSDHVVFGGG TKLTVL (SEQ ID NO: 9542) | EVQLLESGGGLVQPGGSLRLSCAASGFTFSSHAMS WVRQAPGKGLEWVSAISGSGGGTYNADSVKGRFTI SRDNSKNTLYLQMNSLRAEDTAAYYCVTGKGVHLG FDYWGQGTLVTVSS (SEQ ID NO: 9900) |
| 18182-A11 | NA | GAGCTCGTGCTGACTCAGCCACCCTCGGTGTCAG TGACCCCAGGACAGACGGCCAGGATTACCTGTGG GGGAAACAACATTGGAAGTAAAAGTGTGCACTGG TACCAGCAGAAGCCAGGCCAGGCCCCTGTGCTGG TCGTCTATGATGATAACGACCGGCCCTCAGGGAT CCCTGAGCGATTCTCTGGCTCCAACTTTGGGAAC ACGGGCCACCCTGACCATCAGCAGGGTCGAAGCCG GGGATGAGGCCGACTAT (SEQ ID NO: 9543) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGAAGTGGTGGTGGCACAT ACTACGCAGACTCCGTGAAGGGCCGGTTCACCATC TCCAGAGACAATTCCAAGAACACGCTGTATCTGCA AATGAACAGC (SEQ ID NO: 9901) |
| | AA | ELVLTQPPSVSVTPGQTARITCGGNNIGSKSVHW YQQKPGQAPVLVVYDDNDRPSGIPERFSGSNFGN TATLTISRVEAGDEADYYCQVWDSSSDHVVFGGG TKLTVL (SEQ ID NO: 9544) | EVQLESGGGLVQPGGSLRLSCAASGFTFSSYAMSW VRQAPGKGLEWVSAISGSGGGTYNADSVKGRFTIS RDNSKNTLYLQMNSLRAEDTAVYYCATGKGVHLGF DYWGQGTLVTVSS (SEQ ID NO: 9902) |
| 18182-B1 | NA | GAGCTCGTGCTGACTCAGCTACCCTCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTGCTGG TCGTCTATGATGATAACGACCGGCCCTCAGGGAT CCCTGAGCGATTCTCTGGCTCCAACTTTGGGAAC ACGGCCACCCTGATTATCAGTAGGGTCGAAGCCG GGGATGAGGCCGACTAT (SEQ ID NO: 9545) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCCATGCCATGAGC TGGGTCCGCCAGGCTCCAGGGAAGGGGCTGGAGTG GGTCTCAGCTATTAGTGGTAGTGGTGGTGGCACAT ACAACGCAGACTCCGTGAAGGGCCGGTTCACCATC TCCAGAGACAATTCCAAGAACACGCTGTATCTGCA AATGAACAGC (SEQ ID NO: 9903) |
| | AA | ELVLTQLPSVSVAPGQTARITCGGNNIGSKSVHW YQQKPGQAPVLVVYDDNDRPSGIPERFSGSNFGN TATLIISRVEAGDEADYYCQVWDSSSDHVVFGGG TKLTVI (SEQ ID NO: 9546) | EVQLLESGGGLVQPGGSLRLSCAASGFTFSSHAMS WVRQAPGKGLEWVSAISGSGGGTYNADSVKGRFTI SRDNSKNTLYLQMNSLRAEDTAVYYCATGKGVHLG EDYWGQGTLVTVSS (SEQ ID NO: 9904) |
| 18182-B4 | NA | GAGCTCATGCTGACTCAGCCACCCTCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTGATGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTAT (SEQ ID NO: 9547) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTAGAGTG GGTCTCAGCTATTAGTGGTAGTGGTGGTGGCACAT ACTACGCAGACTCCGTGAAGGCCCGGTTCACCATC TCCAGAGACAATTCCAAGAACACGCTGTATCTGCA AATGAACAGC (SEQ ID NO: 9905) |
| | AA | ELMLTQPPSVSVAPGQTARITCGGNNIGSKSVHW YQQKPGQAPVMVVYDDNDRPSGIPERFSGSNSGN TATLTISRVEAGDEADYYCQVWDSSSDHVVFGGG TKLTVL (SEQ ID NO: 9548) | EVQLLESGGGLVQPGGSLRLSCAASGFTFSSYAMS WVRQAPGKGLEWVSAISGSGGGTYYADSVKARFTI SRDNSKNTLYLQMNSLRAEDTAVYYCATGKGVHLG FDYWGQGTLVTVSS (SEQ ID NO: 9906) |
| 18182-B6 | NA | GAGCTCATGCTGACTCAGCCCCACTCGGTGTCAG TGGCCCCAGGACAGACGGCCAGGATTACCTGTGG GGGAAACAACATTGGAAGTAAAAGTGTGCACTGG TACCAACAGAAGCCAGGCCAGGCCCCTGTGCTGG TCGTCTATGATGATAACGACCGGCCCTCAGGGAT CCCTGAGCGATTCTCTGGCTCCAATTTTGGGAAC ACGGCCACCCTGACCATCAGCAGGGTCGAAGCCG GGGATGAGGCCGACTAT (SEQ ID NO: 9549) | GAGGTGCAGCTGCTCGAGTCCGGGGGAGGCTTGGT ACAGCCTGGGGGGTCCCTGAGACTCTCCTGTGCAG CCTCTGGATTCACCTTTAGTAGCTATGCCATGAGC TGGGTCCGCCAGGCTCCAGGGAAGGGGCTGGAGTG GGTCTCAGCTATTAGTGGTAGTGGTGGTGGCACAT ACTACGCAGACTCCGTGAAGGGCCGGTTCACCATC TCCAGAGACAATTCCAAGAACACGCTGTATCTGCA AATGAACAGC (SEQ ID NO: 9907) |
| | AA | ELMLTQPHSVSVAPGQTARITCGGNNIGSKSVHW YQQKPGQAPVLVVYDDNDRPSGIPERFSGSNFGN TATLTISRVEAGDEADYYCQVWDSSSDHVVFGGG TKLTVL (SEQ ID NO: 9550) | EVQLLESGGGLVQPGGSLRLSCAASGFTFSSYAMS WVRQAPGKGLEWVSAISGSGGGTYYADSVKGRFTI SRDNSKNTLYLQMNSLRAEDTAVYYCATGKGVHLG FDYWGQGTLVTVSS (SEQ ID NO: 9908) |
| 18182-B7 | NA | GAGCTCATGCTGACTCAGCCCCACTCGGTGTCAG TGGCCCCAGGACAGACGGCCAGGATTACCTGTGG GGGAAACAACATTGGAAGTAAAAGTGTGCAGTGG TACCAGCAGAAGCCAGGCCAGGCCCCTGTGCTGG TCGTCTATGATGATAACGACCGGCCCTCAGGGAT CCCTGAGCGATTCTCTGGCTCCAACTCTGGGAAC ACGGCTACCCTGACCATCAGCAGGGTCGAAGCCG GGGATGAGGCCGACTTT (SEQ ID NO: 9551) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGCAGGGGCTGGAGTG GGTCTCAGCTATTAGTGGTAGTGGTGGTGGCACAT ACTACGCAGACTCCGTGAAGGGCCGGTTCACCATC TCCAGAGACAATTCCAAGAACACGCTGTATCTGCA AATGAACAGC (SEQ ID NO: 9909) |

TABLE 57-continued scFv Variable Region Sequences

| Ab | Type | LC V-region | HC V-region |
|---|---|---|---|
| | AA | ELMLTQPHSVSVAPGQTARITCGGNNIGSKSVQW<br>YQQKPGQAPVLVVYDDNDRPSGIPERFSGSNSGN<br>TATLTISRVEAGDEADFYCQVWDSSSDHVVFGGG<br>TKLTVL<br>(SEQ ID NO: 9552) | EVQLLESGGGLVQPGGSLRLSCAASGFTFSSYAMS<br>WVRQAPGQGLEWVSAISGSGGGTYYADSVKGRFTI<br>SRDNSKNTLYLQMNSLRAEDTAVYYCATGKGVHLG<br>FDHWGQGTLVTVSS<br>(SEQ ID NO: 9910) |
| 18182-B10 | NA | GAGCTCATGCTGACTCAGCCCCACTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9553) | GAGGTGCAGCTGCTCGAGTCTGGGGGAGGCTTGGT<br>ACAGCCTGGGGGGTCCCTGAGACTCTCCTGTGCAG<br>CCTCTGGATTCACCTTTAGCAGCTATGCCATGAAC<br>TGGGTCCGCCAGGCTCCAGGGAAGCGGCTGGAGTG<br>GGTCTCAGCTATTAGTGGTAGTGGTGGTGGCACTT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9911) |
| | AA | ELMLTQPHSVSVAPGQTARITCGGNNIGSKSVHW<br>YQQKPGQAPVMVVYDDNDRPSGIPERFSGSNSGN<br>TATLTISRVEAGDEADYYCQVWDSSSDHVVFGGG<br>TKLTVL<br>(SEQ ID NO: 9554) | EVQLLESGGGLVQPGGSLRLSCAASGFTFSSYAMN<br>WVRQAPGKGLEWVSAISGSGGGTYYADSVKGRFTI<br>SRDNSKNTLYLQMNSLRAEDTAVYYCATGKGVHLN<br>FDYWGQGTLVTVSS<br>(SEQ ID NO: 9912) |
| 18182-C2 | NA | GAGCTCGTGCTGACGCAGCCGCCCTCGGTGTCAG<br>TGGCCCCAGGACAGACGGCCAGGATTACCTGTGG<br>GGGAAACAACATTGGAAGTAAAAGTGTGCAGTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTTT<br>(SEQ ID NO: 9555) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9913) |
| | AA | ELVLTQPPSVSVAPGQTARITCGGNNIGSKSVQW<br>YQQKPGQAPVLVVYDDNDRPSGIPERFSGSNFGN<br>TATLIISRVEAGDEADFYCQVWDSSSDHVVFGGG<br>TKLTVL<br>(SEQ ID NO: 9556) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLG<br>FDYWGQGTLVTVSS<br>(SEQ ID NO: 9914) |
| 18182-C3 | NA | GAGCTCGTGCTGACGCAGCCGCCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9557) | GAGGTGCAGCTGCTCGAGTCTGGGGGAGACTTGGT<br>ACAGCCTGGGGGGTCCCTGAGACTCTCCTGTGCAG<br>CCTCTGGATTCACCTTTAGCAGCCATGCCATGAGC<br>TGGGTCCGCCAGGCTCCAGGGAAGGGGCTGGAGTG<br>GGTCTCAGCTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9915) |
| | AA | ELVLTQPPSVSVAPGGDLVQPGGSLRLSCAASGFTFSSHAMS<br>YQQKPGQAPVMVVYDDNDRPSGIPERFSGSNSGN<br>TATLTISRVEAGDEADYYCQVWDSSSDHAVFGGG<br>TKLTVL<br>(SEQ ID NO: 9558) | EVQLLESGGDLVQPGGSLRLSCAASGFTFSSHAMS<br>WVRQAPGKGLEWVSAISGSGGGTYYADSVKGRFTI<br>SRDNSKNTLYLQMNSLRAEDTAVYYCATGKGVHLG<br>FDYWGQGTLVTVSS<br>(SEQ ID NO: 9916) |
| 18182-C4 | NA | GAGCTCATGCTGACTCAGCCCCACTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9559) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9917) |
| | AA | ELMLTQPHSVSVAPGQTARITCGGNNIGSKSVHW<br>YQQKPGQAPVMVVYDDNDRPSGIPERFSGSNSGN<br>TATLTISRVEAGDEADYYCQVWDSSSDHVVFGGG<br>TKLTVL<br>(SEQ ID NO: 9560) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLG<br>FDYWGQGTLVTVSS<br>(SEQ ID NO: 9918) |
| 18182-C5 | NA | GAGCTCGTGCTGACTCAGCCGGCTTCGGTGTCAG<br>TGGCCCCAGGACAGACGGCCAGGATTACCTGTGG<br>GGGAAACAACATTGGAATTAAAAGTGTGCACTGG<br>TACCAGCAGAAGCCAGGCCAGGCCCCTGTCCTGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9561) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAACTATTAGTGGTAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9919) |

TABLE 57-continued scFv Variable Region Sequences

| Ab | Type | LC V-region | HC V-region |
|---|---|---|---|
| | AA | ELVLTQPASVSVAPGQTARITCGGNNIGIKSVHW<br>YQQKPGQAPVLVVYDDNDRPSGIPERFSGSNSGN<br>TATLTISRVEAGDEADYYCQVWDSSSDHVVFGGG<br>TKLTVL<br>(SEQ ID NO: 9562) | EVQLLESGGGLVQPGGSLRLSCAASGFTFSSYAMS<br>WVRQAPGKGLEWVSTISGSGGGTYYADSVKGRFTI<br>SRDNSKNTLYLQMNSLRAEDTAVYYCATGKGVHLN<br>FDYWGQGTLVTVSS<br>(SEQ ID NO: 9920) |
| 18182-C10 | NA | GAGCTCGTGCTGACTCAGTCCTCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCAACTTTGGGAAC<br>ACGGCCACCCTGATTATCAGTAGGGTCGAAGCCG<br>GGGATGAGGCCGACTAT<br>(SEQ ID NO: 9563) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAACTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9921) |
| | AA | ELVLTQSSSVSVAPGQTARITCGGNNIGSKSVHW<br>YQQKPGQAPVLVVYDDNDRPSGIPERFSGSNFGN<br>TATLIISRVEAGDEADYYCQVWDSSSDHVVEGGG<br>TKLTVL<br>(SEQ ID NO: 9564) | EVQLLESGGGLVQPGGSLRLSCAASGFTFSSYAMS<br>WVRQAPGKGLEWVSTISGSGGGTYYADSVKGRFTI<br>SRDNSKNTLYLQMNSLRAEDTAVYYCATGKGVHLG<br>FDYWGQGTLVTVSS<br>(SEQ ID NO: 9922) |
| 18182-C12 | NA | GAGCTCATGCTGACTCAGCCCCACTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCCACCCTGATTATCAGTAGGGTCGAAGCCG<br>GGGATGAGGCCGACTAT<br>(SEQ ID NO: 9565) | GAGGTGCAGCTGCTCGAGTCCGGGGGAGACTTGGT<br>ACAGCCTGGGGGGTCCCTGAGACTCTCCTGTGCAG<br>CCTCTGGAATCACCTTTAGCAGCTATGCCATGAGC<br>TGGGTCCGCCAGGCTCCAGGGAAGGGGCTGGAGTG<br>GGTCTCAGCTATTAGTGGTAGTGGTGGTGGCACAT<br>ACTACGCAGACTCCGGGAAGGGCCGGTTCACCATC<br>TCCAGAGACAATTCCAAGAACACGCTGTATCTGCA<br>AATGAACAGC<br>(SEQ ID NO: 9923) |
| | AA | ELMLTQPHSVSVAPGQTARITCGGNNIGSKSVHW<br>YQQKPGQAPVMVVYDDNDRPSGIPERFSGSNSGN<br>TATLIISRVEAGDEADYYCQVWDSSSDHVVFGGG<br>TKLTVL<br>(SEQ ID NO: 9566) | EVQLLESGGDLVQPGGSLRLSCAASGITFSSYAMS<br>WVRQAPGKGLEWVSAISGSGGGTYYADSGKGRFTI<br>SRDNSKNTLYLQMNSLRAEDTAVYYCATGKGVHLG<br>FDYWGQGTLVTVSS<br>(SEQ ID NO: 9924) |
| 18182-D4 | NA | GAGCTCGCCCTGACTCAGCCTGCCTCCGCGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9567) | GAGGTGCAGCTGCTCGAGTCCGGGGGAGACTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAACTATTAGTGGTAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9925) |
| | AA | ELALTQPASASVAPGQTARITCGGNNIGSKSVHW<br>YQQKPGQAPVLVVYDDNDRPSGIPERFSGSNFGN<br>TATLIISRVEAGDEADYYCQVWDSSSDHVVFGGG<br>TKLTVL<br>(SEQ ID NO: 9568) | EVQLLESGGDLVQPGGSLRLSCAASGFTFSSYAMS<br>WVRQAPGKGLEWVSTISGSGGGTYYADSVKGRFTI<br>SRDNSKNTLYLQMNSLRAEDTAVYYCAPGKGVHLN<br>FDYWGQGTLVTVSS<br>(SEQ ID NO: 9926) |
| 18182-D8 | NA | GAGCTCGTGCTGACACAGCTATCCTCGGTGTCAG<br>TGGCCCCAGGACAGACGGCCAGGATTACCTGTGG<br>GGGAAACAACATTGGAAGTAAAAGTGTGCAGTGG<br>TACCAGCAGAAGCCAGGCCAGTCCCCTGTGATGG<br>TCGTCTATGATGATAACGACCGGCCCTCAGGGAT<br>CCCTGAGCGATTCTCCGGCTCCAACTCTGGGAAC<br>ACGGCCACCCTGACCATCAGCAGGGTCGAAGCCG<br>GGGATGAGGCCGACTAT<br>(SEQ ID NO: 9569) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9927) |
| | AA | ELVLTQLSSVSVAPGQTARITCGGNNIGSKSVQW<br>YQQKPGQSPVMVVYDDNDRPSGIPERFSGSNSGN<br>TATLTISRVEAGDEADYHCQVWDSSSDHVIFGGG<br>TKLTVL<br>(SEQ ID NO: 9570) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLG<br>FDYWGQGTLVTVSS<br>(SEQ ID NO: 9928) |
| 18182-D9 | NA | GAGCTCGTGGTGACTCAGGAGCCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9571) | GAGGTGCAGCTGCTCGAGTCTGGGGGAGACTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAACTATTAGTGGTAGTGGTGGTGGCACAT<br>ACTACGCAGACTCCGTGAAGGGCCGGTTCACCATC<br>TCCAGGGACAATTCCAAGAACACGCTGTATCTGCA<br>AATGAACAGC<br>(SEQ ID NO: 9929) |

TABLE 57-continued scFv Variable Region Sequences

| Ab | Type | LC V-region | HC V-region |
|---|---|---|---|
| | AA | ELVVTQPSVSVAPGQTARITCGGNNIGSKSVHW<br>YQQKPGQAPVMVVYDDNDRPSGIPERFSGSNFGN<br>TATLIISRVEAGDEADYYCQVWDSNSDHVVFGGG<br>TKLTVL<br>(SEQ ID NO: 9572) | EVQLLESGGDLVQPGGSLRLSCAASGFTFSSYAMS<br>WVRQAPGKGLEWVSTISGSGGGTYYADSVKGRFTI<br>SRDNSKNTLYLQMNSLRAEDTAVYYCATGKGVHLN<br>FDYWGQGTLVTVSS<br>(SEQ ID NO: 9930) |
| 18182-D11 | NA | GAGCTCATGCTGACTCAGCCACCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTACTGG<br>TCGTCTATGATATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9573) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCTATGCCATGAAC<br>TGGGTCCGCCAGGCTCCAGGGAAGGGGCTGGAGTG<br>GGTCTCAGCTATTAGTGGTAGTGGTGGTGGCACTT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9931) |
| | AA | ELMLTQPPSVSVAPGQTARITCGGNNIGSKSVHW<br>YQQKPGQAPVLVVYDDNDRPSGIPERFSGSNSGN<br>TATLTISRVEAGDEADYYCQVWDSSSDHVIFGGG<br>TKLTVL<br>(SEQ ID NO: 9574) | EVQLLESGGGLVQPGGSLRLSCAASGFTFSSYAMN<br>WVRQAPGKGLEWVSAISGSGGGTYYADSVKGRFTI<br>SRDNSKNTLYLQMNSLRAEDTAVYYCATGKGVHLN<br>FDYWGQGTLVTVSS<br>(SEQ ID NO: 9932) |
| 18182-E2 | NA | GAGCTCGTGCTGACTCAGCCACCCTCGGTGTCAG<br>TGGCCCCAGGACAGACGGCCAGGATAACCTGTGG<br>GGGAAACAACATTGGAAGTAAAAGTGTGCACTGG<br>TACCAACAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCTACCCTGACCATCAGCAGGGTCGAAGCCG<br>GGGATGAGGCCGACTAT<br>(SEQ ID NO: 9575) | GAGGTGCAGCTGCTCGAGTCCGGGGGAGACTTGGT<br>ACAGCCTGGGGGGTCCCTGAGACTCTCCTGTGCAG<br>CCTCTGGATTCACCTTTGGCAGCTATGCCATGAGC<br>TGGGTCCGCCAGGCTCCAGGGAAGGGGCTGGAGTG<br>GGTCTCAGCTATTAGTGGTAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9933) |
| | AA | ELVLTQPPSVSVAPGQTARITCGGNNIGSKSVHW<br>YQQKPGQAPVMVVYDDNDRPSGIPERFSGSNSGN<br>TATLTISRVEAGDEADYHCQVWDSSSDHVVFGGG<br>TKLTVL<br>(SEQ ID NO: 9576) | EVQLLESGGDLVQPGGSLRLSCAASGFTFGSYAMS<br>WVRQAPGKGLEWVSAISGSGGGTYYADSVKGRFTI<br>SRDNSKNTLYLQMNSLRAEDTAVYYCATGKGVHLG<br>EDYWGQGTLVTVSS<br>(SEQ ID NO: 9934) |
| 18182-E3 | NA | GAGCTCGTGCTGACTCAGCCACCCTCGGTGTCAG<br>TGGCCCCAGGACAGACGGCCAGGATTACCTGTGG<br>GGGAAACAACATTGGAAGTAAAAGTGTGCAGTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGCAGGGTCGAAGCCG<br>GGGATGAGGCCGACTAT<br>(SEQ ID NO: 9577) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGTAGCTATGCCATGAGC<br>TGGGTCCGCCAGGCTCCAGGGAAGGGGCTGGAGTG<br>GGTCTCAGCTATTAGTGGTAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9935) |
| | AA | ELVLTQPPSVSVAPGQTARITCGGNNIGSKSVQW<br>YQQKPGQAPVLVVYDDNDRPSGIPERFSGSNFGN<br>TATLIISRVEAGDEADYYCQVWDSSSDHVVFGGG<br>TKLTVL<br>(SEQ ID NO: 9578) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLG<br>FDYWGQGTLVTVSS<br>(SEQ ID NO: 9936) |
| 18182-E8 | NA | GAGCTCGTGCTGACTCAGCCGGCTTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9579) | GAGGTGCAGCTGCTCGAGTCTGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAGCAGC<br>(SEQ ID NO: 9937) |
| | AA | ELVLTQPASVSVAPGQTARITCGGNNIGSKSVHW<br>YQQKPGQAPVLVVYDDNDRPSCIPERFSGSNFGN<br>TATLIISRVEAGDEADYYCQVWDSSSDHVVFGGG<br>TKLTVL<br>(SEQ ID NO: 9580) | EVQLLESGGGLVQPGGSLRLSCAASGFTFSSYAMS<br>WVRQAPGKGLEWVSAISGSGGGTYYADSVKGRFTI<br>SRDNSKNTLYLQMSSLRAEDTAVYYCATGKGVHLG<br>FDYWGQGTLVTVSS<br>(SEQ ID NO: 9938) |
| 18182-E11 | NA | GAGCTCATGCTGACTCAGCCCCACTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9581) | GAGGTGCAGCTGCTCGAGTCTGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGTAGTGGTGGTGGCACAT<br>ACTACGCAGACTCCGTGAAGGCCCGGTTCACCATC<br>TCCAGAGACAATTCCAAGAACACGCTGTATCTGCA<br>AATGAACAGC<br>(SEQ ID NO: 9939) |

TABLE 57-continued scFv Variable Region Sequences

| Ab | Type | LC V-region | HC V-region |
|---|---|---|---|
| | AA | ELMLTQPHSVSVAPGQTARITCGGNNIGSKSVHW<br>YQQKPGQAPVMVVYDDNDRPSGIPERFSGSNSGN<br>TATLTISRVEAGDEADYYCQVWDSSSDHVVFGGG<br>TKLTVL<br>(SEQ ID NO: 9582) | EVQLLESGGGLVQPGGSLRLSCAASGFTFSSYAMS<br>WVRQAPGKGLEWVSAISGSGGGTYYADSVKARFTI<br>SRDNSKNTLYLQMNSLRAEDTAVYYCATGKGVHLG<br>FDYWGQGTLVTVSS<br>(SEQ ID NO: 9940) |
| 18182-F1 | NA | GAGCTCGTGCTGACTCAGTCCCCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGCTGA<br>TCGTCTAATAACGACCGGCCCTCAGGGATCCCTG<br>AGCGATTCTCTGGCTCCAACTTTGGGAACACGGC<br>CACCCTGATTATCAGTAGGGTCGAAGCCGGGGAT<br>GAGGCCGACTATTGATG<br>(SEQ ID NO: 9583) | GAGGTGCAGCTGCTCGAGTCCGGGGGAGACTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGAAGTGGTGGTGGCCACT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9941) |
| | AA | ELVLTQSPSVSVAPGQTARITCGGNNIGSKSVHW<br>YQQKPGQAPVLVVYDDNDRPSGIPERFSGSNFGN<br>TATLIISRVEAGDEADYYCQVWDSSSDHVVFGGG<br>TKLTVL<br>(SEQ ID NO: 9584) | EVQLLESGGDLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLN<br>FDYWGQGTLVTVSS<br>(SEQ ID NO: 9942) |
| 18182-F6 | NA | GAGCTCGCCCTGACTCAGCCTCCCTCCGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTCCTGA<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9585) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGTAGTGGTGGTGGCACAT<br>ACTACGCAGACTCCGTGAAGGGCCGATTCACCATC<br>TCCAGAGACAATTCCAAGAACACGCTGTATCTGCA<br>AATGAACAGC<br>(SEQ ID NO: 9943) |
| | AA | ELALTQPPSVSVAPGQTARITCGGNNIGSKSVHW<br>YQQKPGQAPVLVVYDDNDRPSGIPERFSGSNSGN<br>TATLTISRVEAGDEADYYCQVWDSSSDHVMFGGG<br>TKLTVL<br>(SEQ ID NO: 9586) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLN<br>FDYWGQGTLVTVSS<br>(SEQ ID NO: 9944) |
| 18182-F8 | NA | GAGCTCGTGTTGACGCAGCCGCCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9587) | GAGGTGCAGCTGCTCGAGTCTGGGGGAGGCTTGGT<br>ACAGCCTGGGGGGTCCCTGAGACTCTCCTGTGCAG<br>CCTCCGGATTCACCTTTAGCAGCTATGCCATGAGC<br>TGGGTCCGCCAGGCTCCAGGGAAGGGGCTGGAGTG<br>GGTCTCAACTATTAGTGGTAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9945) |
| | AA | ELVLTQPPSVSVAPGQTARITCGGNNIGSKSVHW<br>YQQKPGQAPVMVVYDDNDRPSGIPERFSGSNFGN<br>TATLIISRVEAGDEADYYCQVWDSSSDHVVFGGG<br>TKLTVL<br>(SEQ ID NO: 9588) | EVQLLESGGGLVQPGGSLRLSCAASGFTFSSYAMS<br>WVRQAPGKGLEWVSTISGSGGGTYYADSVKGRFTI<br>SRDNSKNTLYLQMNSLRAEDTAVYYCATGKGVHLG<br>FDYWGQGTLVTVSS<br>(SEQ ID NO: 9946) |
| 18182-G3 | NA | GAGCTCGTGCTGACTCAGCCACCCTCGGTGTCAG<br>TGGCCCCAGGACAGACGGCCAGGATTACCTGTGG<br>GGGAAACAACATTGGAAGTAAAAGTGTGCACTGG<br>CACCAGCAGAAGCCAGGCCAGGCCCCTGTGCTGA<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9589) | GAGGTGCAGCTGCTCGAGTCTGGGGGAGACTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCGGGGCAGGGGCTGGAGTG<br>GGTCTCAGCTATTAGTGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9947) |
| | AA | ELVLTQPPSVSVAPGQTARITCGGNNIGSKSVHW<br>HQQKPGQAPVLVVYDDNDRPSGIPERFSGSNFGN<br>TATLIISRVEAGDEADYYCQVWDSSSDHVVFGGG<br>TKLTVL<br>(SEQ ID NO: 9590) | EVQLLESGGDLVQPGGSLRLSCAASGFTFSSYAMH<br>WVRQAPGQGLEWVSAISGSGGGTYYADSVKGRFTI<br>SRDNSKNTLYLQMNSLRAEDTAVYYCATGKGVHLG<br>FDYWGQGTLVTVSS<br>(SEQ ID NO: 9948) |
| 18182-G4 | NA | GAGCTCGTGCTGACTCAGCCACCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9591) | GAGGTGCAGCTGCTCGAGTCCGGGGGAGGCTTGGT<br>ACAGCCTGGGGGGTCCCTGAGACTCTCCTGTGCAG<br>GCTCTGGATTCACCTTTAGCAGCTATGCCATGACC<br>TGGGTCCGCCAGGCTCCAGGGAAGGGGCTGGAGTG<br>GGTCTCAGCTATTAGTGGTAGTGGTGGTGGCACTT<br>ACTACGCAGACTCCGTGAAGGGCCGGTTCACCATC<br>TCCAGAGACAATTCCAAGAACACGCTGTATCTGCA<br>AATGAGCAGC<br>(SEQ ID NO: 9949) |

TABLE 57-continued scFv Variable Region Sequences

| Ab | Type | LC V-region | HC V-region |
|---|---|---|---|
| | AA | ELVLTQPPSVSVAPGQTARITCGGNNIGSKSVHW<br>YQQKPGQAPVLVVYDDNDRPSGIPERFSGSNFGN<br>TATLIISRVEAGDEADYYCQVWDSSSDHVVFGGG<br>TKLTVL<br>(SEQ ID NO: 9592) | EVQLLESGGGLVQPGGSLRLSCAASGFTFSSYAMT<br>WVRQAPGKGLEWVSAISGSGGGTYYADSVKGRFTI<br>SRDNSKNTLYLQMSSLRAEDTAVYYCATGKGVHLG<br>EDYWGQGTLVTVSS<br>(SEQ ID NO: 9950) |
| 18182-G5 | NA | GAGCTCGTGCTGACTCAGCCGGCTTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGATGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9593) | GAGGTGCAGCTGCTCGAGTCCGGGGGAGGCTTGGT<br>ACAGCCTGGGGGTCCCTGAGACTCCTGTGCAGCC<br>TCTGGATTCACCTTTAGCAGCTATGCCATGAGCTG<br>GGTCCGCCAGGCTCCAGGGAAGGGGCTGGAGTGG<br>GTCTCAGCTATTAGTGGTAGTGGTGGTGGCACATAC<br>AACGCAGACTCCGTGAAGGGCCGGTTCACCATCTC<br>CAGAGACAATTCCAAGAACACGCTGTATCTGCAAA<br>TGAACAGC<br>(SEQ ID NO: 9951) |
| | AA | ELVLTQPASVSVAPGQTARITCGGNNIGSKSVHW<br>YQQKPGQAPVMVVYDDNDRPSGIPERFSGSNFGN<br>TATLIISRVEAGDEADYYCQVWDSSSDHVVFGGG<br>TKLTVL<br>(SEQ ID NO: 9594) | EVQLLESGGGLVQPGGSLRLSCAASGFTFSSYAMS<br>WVRQAPGKGLEWVSAISGSGGGTYNADSVKGRFTI<br>SRDNSKNTLYLQMNSLRAEDTAAYYCVTGKGVHLG<br>FDYWGQGTLVTVSS<br>(SEQ ID NO: 9952) |
| 18182-G9 | NA | GAGCTCGCCCTGACTCAGCCTGCCTCCGCGTCAG<br>TGGCCCCAGGACAGACGGCCAGGATTTCCTGTGG<br>GGGAAACAACATTGGAAGTAAAGGTGTGCAGTGG<br>TACCAGCAGAAGCCAGGCCAGGCCCCTGTACTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9595) | GAGGTGCAGCTGCTCGAGTCTGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9953) |
| | AA | ELALTQPASASVAPGQTARISCGGNNIGSKGVQW<br>YQQKPGQAPVLVVYDDNDRPSGIPERFSGSNFGN<br>TATLIISRVEAGDEADYYCQVWDSSSDHVVFGGG<br>TKLTVL<br>(SEQ ID NO: 9596) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLG<br>FDYWGQGTLVTVSS<br>(SEQ ID NO: 9954) |
| 18182-G11 | NA | GAGCTCGTGCTGACGCAGCCGCCCTCGGTGTCAG<br>TGGCCCCAGGACAGACGGCCAGGATTACCTGTGG<br>GGGAAACAACATTGGAAGTAAAAGTGTGCAGTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9597) | GAGGTGCAGCTGCTCGAGTCCGGGGGAGGCTTGGT<br>ACAGCCTGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTAGAGTG<br>GGTCTCAGCTATTAGTGGTAGTGGTGGTGGCACAT<br>ACTACGCAGACTCCGTGAAGGCCCGGTTCACCATC<br>TCCAGAGACAATTCCAAGAACACGCTGTATCTGCA<br>AATGAACAGC<br>(SEQ ID NO: 9955) |
| | AA | ELVLTQPPSVSVAPGQTARITCGGNNIGSKSVQW<br>YQQKPGQAPVLVVYDDNDRPSGIPERFSGSNFGN<br>TATLIISRVEAGDEADYYCQVWDSSSDHVVFGGG<br>TKLTVL<br>(SEQ ID NO: 9598) | EVQLLESGGGLVQPGGSLRLSCAASGFTFSSYAMS<br>WVRQAPGKGLEWVSAISGSGGGTYYADSVKARFTI<br>SRDNSKNTLYLQMNSLRAEDTAVYYCATGKGVHLG<br>FDYWGQGTLVTVSS<br>(SEQ ID NO: 9956) |
| 18182-H5 | NA | GAGCTCGTGGTGACTCAGGAGCCCTCGGTGTCAG<br>TGGCCCCAGGACAGACGGCCAGGATTACCTGTGG<br>GGGAAACAACATTGGAAGTAAAAGTGTGCACTGG<br>CACCAGCAGAAGCCAGGCCAGGCCCCTGTTGTGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTTT<br>(SEQ ID NO: 9599) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCCATGCCATGAGC<br>TGGGTCCGCCAGGCTCCAGGGAAGGGGCTGGAGTG<br>GGTCTCAGCTATTAGTGGTAGTGGTGGTGGCACAT<br>ACAACGCAGACTCCGTGAAGGGCCGGTTCACCATC<br>TCCAGAGACAATTCCAAGAACACGCTGTATCTGCA<br>AATGAACAGC<br>(SEQ ID NO: 9957) |
| | AA | ELVVTQEPSVSVAPGQTARITCGGNNIGSKSVHW<br>HQQKPGQAPVLVVYDDNDRPSGIPERFSGSNSGN<br>TATLTISRVEAGDEADFYCQVWDSSSDHVVFGGG<br>TKLTVL<br>(SEQ ID NO: 9600) | EVQLLESGGGLVQPGGSLRLSCAASGFTFSSHAMS<br>WVRQAPGKGLEWVSAISGSGGGTYNADSVKGRFTI<br>SRDNSKNTLYLQMNSLRAEDTAAYYCVTGKGVHLG<br>FDYWGQGTLVTVSS<br>(SEQ ID NO: 9958) |
| 18089-D12 | NA | GAGCTCGTGATGACCCAGTCTCCATCCTCCCTGT<br>CTGCATCTGTAGGAGACAGAGTCACCATCACTTG<br>CCGGGCGAGTCAGGGCATTAGCAATTATTTAGCC<br>TGGTATCAGCAGAAACCAGGGAAAGTTCCTAAGC<br>TCCTGATCTATGCTGCATCCACTTTGCAATCAGG<br>GGTCCCATCTCGGTTCAGTGGCAGTGGATCTGGG<br>ACAGATTTCACTCTCACCATCAGCAGCCTGCAGC<br>CTGAAGATGTTGCAACT<br>(SEQ ID NO: 9601) | GAGGTGCAGCTGCTCGAGTCCGGGGGAGGCGTGGT<br>CCAGCCTGGGAGGTCCCTGAGACTCTCCTGTGCAG<br>CCTCTGGATTCACCTTCAGTAGTATGGCATGCAC<br>TGGGTCCGCCAGGCTCCAGGCAAGGGGCTGGAATG<br>GGTGGCAGTTATATCATATGATGGAAGTAATAAAT<br>ACTATGCAGACTCCGTGAAGGGCCGATTCACCATC<br>TCCAGAGACGATTCCAAGAACACGCTGTATCTGCA<br>AATGAACAGC<br>(SEQ ID NO: 9959) |

TABLE 57-continued scFv Variable Region Sequences

| Ab | Type | LC V-region | HC V-region |
|---|---|---|---|
| | AA | ELVMTQSPSSLSASVGDRVTITCRASQGISNYLA WYQQKPGKVPKLLIYAASTLQSGVPSRFSGSGSG TDFTLTISSLQPEDVATYYCQKYNSAPFTFGPGT KVEIK (SEQ ID NO: 9602) | EVQLLESGGGVVQPGRSLRLSCAASGFTFSTYGMH WVRQAPGKGLEWVAVISYDGSNKYYADSVKGRFTI SRDDSKNTLYLQMNSLRAEDTAVYYCARGQLLTGY WGQGTLVTVSS (SEQ ID NO: 9960) |
| 18179-G12 | NA | GAGCTCGTGATGACCCAGTCTCCATCCTCCCTGT CTGCATCTGTAGGAGACAGAGTCACCATCACTTG CCGGGCGAGTCAGGGCATTAGCAATTATTTAGCC TGGTATCAGCAGAAACCAGGGAAAGTTCCTAAGC TCCTGATCTCTGCTGCATCCACTTTGCAATCAGG GGTCCCATCTCGGTTCAGTGGCAGTGGATCTGGG ACAGATTTCACTCTCACCATCAGCAGCCTGCAGC CTGAAGATGTTGCAACT (SEQ ID NO: 9603) | GAGGTGCAGCTGCTCGAGTCTGGAGCAGAGGTGAA AAAGCCTGGGGCCTCAGTGAAGGTCTCCTGCAAGG CTTCTGGTTACACCTTTACCAGGAATGGTCTCAGC TGGGTGCGACAGGCCCCTGGACAAGGGCTTGAGTG GATGGGATGGATCAGCCGGTTACAATGGTGACACAA ACTATGCACAGAAGCTCCAGGGCAGAGGCACCATG ACCACAGACACATCCACGAGCACAGCCTACATGGA GCTGAGGAGC (SEQ ID NO: 9961) |
| | AA | ELVMTQSPSSLSASVGDRVTITCRASQGISNYLA WYQQKPGKVPKLLISAASTLQSGVPSRFSGSGSG TDFTLTISSLQPEDVATYYCQKYNSAPFTFGPGT KLEIK (SEQ ID NO: 9604) | EVQLLESGAEVKKPGASVKVSCKASGYTFTRNGLS WVRQAPGQGLEWMGWISGYNGDTNYAQKLQGRGTM TTDTSTSTAYMELRSLRSDDTAVYYCARGRATFDY WGQGTLVTVSS (SEQ ID NO: 9962) |
| 18179-C1 | NA | GAGCTCGTGATGACCCAGTCTCCATCCTCCCTGT CTGCATCTGTTGGAGACAGAGTCACCATCACTTG CCGGGCGAGTCAGGGCATTAGCAATTATTTAGCC TGGTATCAGCAGAAACCAGGGAAAGTTCCTAAGC TCCTGATCTCTGCTGCATCCACTTTGCAATCAGG GGTCCCATCTCGGTTCAGTGGCAGTGGATCTGGG ACAGATTTCACTCTCACCATCAGCAGCCTGCAGC CTGAAGATGTTGCAACT (SEQ ID NO: 9605) | GAGGTGCAGCTGCTCGAGTCTGGAGCAGAGGTGAA AAAGCCTGGGGCCTCAGTGAAGGTCTCCTGCAAGG CTTCTGGTTACACCTTTACCAGGAATGGTCTCAGC TGGGTGCGACAGGCCCCTGGACAAGGGCTTGAGTG GATGGGATGGATCAGCCGGTTACAATGGTGACACAA ACTATGCACAGAAGCTCCAGGGCAGAGGCACCATG ACCACAGACACATCCACGAGCACAGCCTACATGGA GCTGAGGAGC (SEQ ID NO: 9963) |
| | AA | ELVMTQSPSSLSASVGDRVTITCRASQGISNYLA WYQQKPGKVPKLLISAASTLQSGVPSRFSGSGSG TDFTLTISSLQPEDVATYYCQKYNSAPFTFGPGT KVDIK (SEQ ID NO: 9606) | EVQLLESGAEVKKPGASVKVSCKASGYTFTRNGLS WVRQAPGQGLEWMGWISGYNGDTNYAQKLQGRGTM TTDTSTSTAYMELRSLRSDDTAVYYCARGRATFDY WGQGTLVTVSS (SEQ ID NO: 9964) |
| 18093-B11 | NA | GAGCTCGTGCTGACTCAGCCGCCCTCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTGCTGG TCGTCTATGATGATAGCGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTAT (SEQ ID NO: 9607) | GAGGTGCAGCTGCTCGAGTCCGGGGGAGGCTTGGT AAAGCCTGGGGGGTCCCTGAGACTCTCCTGTGCAG CCTCTGGATTCACCTTTCAGTGACTACTACATGAGC TGGATCCGCCAGGCTCCAGGGAAGGGGCTGGAGTG GGTTTCATACATTAGTAAAAGTGGTAGTACCATAT ACTACGCAGACTCTGTGAAGGGCCGATTCACCATC TCCAGGGACAACGCCAAGAACTCACTGTATCTGCA AATGAACAGC (SEQ ID NO: 9965) |
| | AA | ELVLTQPPSVSVAPGQTARITCGGNNIGSKSVHW YQQKPGQAPVLVVYDDSDRPSGIPERFSGSNSGN TATLTISRVEAGDEADYYCQVWDSSSDHHVVFGG GTKLTVL (SEQ ID NO: 9608) | EVQLLESGGGLVKPGGSLRLSCAASGFTFSDYYMS WIRQAPGKGLEWVSYISKSGSTIYYADSVKGRFTI SRDNAKNSLYLQMNSLRAEDTAVYYCATYNYGHFD YWGQGTLVTVSS (SEQ ID NO: 9966) |
| 18182-B5 | NA | GAGCTCGTGCTGACTCAGCCACCCTCGGTGTCAG TGGCCCCAGGACAGACGGCCAGGATAACCTGTGG GGGAAACAACATTGGAAGTAAAAGTGTGCACTGG TACCAGCAGAAGCCAGGCCAGGCCCCTGTGCTGG TCGTCTATGATGATAACGACCGGCCCTCAGGGAT CCCTGAGCGATTCTCTGGCTCCAACTTTGGGAAC ACGGCCACCCTGATTATCAGTAGGGTCGAAGCCG GGGATGAGGCCGACTAT (SEQ ID NO: 9609) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCCATGCCATGAGC TGGGTCCGCCAGGCTCCAGGGAAGGGGCTGGAGTG GGTCTCAGCTATTAGTGGAAGTGGTGGTGGACAT ACTACGCAGACTCCGTGAAGGGCCGGTTCACCATC TCCAGAGACAATTCCAAGAACACGCTGTATCTGCA AATGAACAGC (SEQ ID NO: 9967) |
| | AA | ELVLTQPPSVSVAPGQTARITCGGNNIGSKSVHW YQQKPGQAPVLVVYDDNDRPSGIPERFSGSNFGN TATLIISRVEAGDEADYYCQVWDSSSDHVVFGGG TKLTVL (SEQ ID NO: 9610) | EVQLLESGGGLVQPGGSLRLSCAASGFTFSSHAMS WVRQAPGKGLEWVSAISGSGGGTYYADSVKGRFTI SRDNSKNTLYLQMNSLRAEDTAVYYCATGKGVHLG FDYWGQGTLVTVSS (SEQ ID NO: 9968) |
| 18182-H9 | NA | GAGCTCGTGCTGACTCAGCCACCCTCGGTGTCAG TGGCCCCAGGACAGACGGCCAGGATTACCTGTGG GGGAAACAACATTGGAAGTAAAAGTGTGCACTGG CACCAGCAGAAGCCAGGCCAGGCCCCTGTGTTGG TCGTCTATGATGATAACGACCGGCCCTCAGGGAT CCCTGAGCGATTCTCTGGCTCCAACTCTGGGAAC ACGGCCACCCTGACCATCAGCAGGGTCGAGGCCG GGGATGAGGCCGACTTT (SEQ ID NO: 9611) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCCATGCCATGAGC TGGGTCCGCCAGGCTCCAGGGAAGGGGCTGGAGTG GGTCTCAGCTATTAGTGGTAGTGGTGGTGGACAT ACTACGCAGACTCCGTGAAGGCCCGGTTCACCATC TCCAGAGACAATTCCAAGAACACGCTGTATCTGCA AATGAACAGC (SEQ ID NO: 9969) |

TABLE 57-continued scFv Variable Region Sequences

| Ab | Type | LC V-region | HC V-region |
|---|---|---|---|
| | AA | ELVLTQPPSVSVAPGQTARITCGGNNIGSKSVHW<br>HQQKPGQAPVLVVYDDNDRPSGIPERFSGSNSGN<br>TATLTISRVEAGDEADFYCQVWDSSSDHVVFGGG<br>TKLTVL<br>(SEQ ID NO: 9612) | EVQLLESGGGLVQPGGSLRLSCAASGFTFSSHAMS<br>WVRQAPGKGLEWVSAISGSGGGTYYADSVKARFTI<br>SRDNSKNTLYLQMNSLRAEDTAVYYCATGKGVHLG<br>EDYWGQGTLVTVSS<br>(SEQ ID NO: 9970) |
| 18182-E6 | NA | GAGCTCGTGCTGACTCAACCCTCCTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCAACTTTGGGAAC<br>ACGGCCACCCTGATTATCAGTAGGGTCGCAGCCG<br>GGGATGAGGCCGACTAT<br>(SEQ ID NO: 9613) | GAGGTGCAGCTGCTCGAGTCCGGGGGAGGCTTGGT<br>ACAGCCTGGGGGGTCCCTGAGACTCTCCTGTGCAG<br>CCTCCGGATTCACCTTTAGCAGCATGCCATGAGC<br>TGGGTCCGCCAGGCTCCAGGGAAGGGGCTGGAGTG<br>GGTCTCAGCTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9971) |
| | AA | ELVLTQPSSVSVAPGQTARITCGGNNIGSKSVHW<br>YQQKPGQAPVLVVYDDNDRPSGIPERFSGSNFGN<br>TATLIISRVAAGDEADYYCQVWDSSSDHVVFGGG<br>TKLTVL<br>(SEQ ID NO: 9614) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAVYYCATGKGVHLN<br>FDYWGQGTLVTVSS<br>(SEQ ID NO: 9972) |
| 18182-G6 | NA | GAGCTCGTGCTGACTCAGCCACCCTCGGTGTCAG<br>TGGCCCCAGGACAGACGGCCAGGATTACCTGTGG<br>GGGAAATAACATTGGAAGTAAAAGTGTGCACTGG<br>CACCAGCAGAAGCCAGGCCAGTCCCCTGTGTTGG<br>TCATCTATGATGATAACGACCGGCCCTCAGGGAT<br>CCCTGAGCGATTCTCTGGCTTCAACTCTGGGAAC<br>ACGGCCACCCTGACCATCAGCAGGGTCGAAGCCG<br>GGGATGAGGCCGACTAT<br>(SEQ ID NO: 9615) | GAGGTGCAGCTGCTCGAGTCTGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAGCTATTAGTGGTAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9973) |
| | AA | ELVLTQPPSVSVAPGQTARITCGGNNIGSKSVHW<br>HQQKPGQSPVLVIYDDNDRPSGIPERFSGENSGN<br>TATLTISRVEAGDEADYYCQVWDSSSDHVVFGGG<br>TKLTVL<br>(SEQ ID NO: 9616) | EVQLLESGGGLVQPGGSLRLSCAASGFTFSSYAMS<br>WVRQAPGKGLEWVSAISGSGGGTYYADSVKGRFTI<br>SRDNSKNTLYLQMNSLRAEDTAAYYCVTGKGVHLG<br>FDYWGQGTLVTVSS<br>(SEQ ID NO: 9974) |
| 18182-G2 | NA | GAGCTCGTGCTGACTCAGCCACCCTCGGTGTCAG<br>TGGCCCCAGGACAGACGGCCAGGATAACCTGTGG<br>GGGAAACAACATTGGAAGTAAAAGTGTGCACTGG<br>TACCAACAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9617) | GAGGTGCAGCTGCTCGAGTCCGGGGGAGGCTTGGT<br>ACAGCCTGGGGGGTCCCTGAGACTCTCCTGTGCAG<br>CCTCTGGATTCACCTTTAGCAGCATGCCATGAGC<br>TGGGTCCGCCAGGCTCCAGGGAAGGGGCTGGAGTG<br>GGTCTCAGCTATTAGTGGTAGTGGTGGTGGCACAT<br>ACAACGCAGACTCCGTGAAGGGCCGGTTCACCATC<br>TCCAGAGACAATTCCAAGAACACGCTGTATCTGCA<br>AATGAACAGC<br>(SEQ ID NO: 9975) |
| | AA | ELVLTQPPSVSVAPGQTARITCGGNNIGSKSVHW<br>YQQKPGQAPVMVVYDDNDRPSGIPERFSGSNSGN<br>TATLTISRVEAGDEADYYCQVWDSSSDHVIFGGG<br>TKLTVL<br>(SEQ ID NO: 9618) | EVQLLESGGGLVQPGGSLRLSCAASGFTFSSHAMS<br>WVRQAPGKGLEWVSAISGSGGGTYNADSVKGRFTI<br>SRDNSKNTLYLQMNSLRAEDTAAYYCVTGKGVHLG<br>FDYWGQGTLVTVSS<br>(SEQ ID NO: 9976) |
| 18182-H12 | NA | GAGCTCATGCTGACTCAGCCCCACTCGGTGTCAG<br>TGGCCCCAGGACAGACGGCCAGGATTACCTGTGG<br>GGGAAACAACATTGGAAGTAAAAGTGTGCACTGG<br>TACCAGCAGAAGCCAGGCCAGGCCCCTGTGCTGG<br>TCGTCTATGATGATAACGACCGGCCCTCAGGGAT<br>CCCTGAGCGATTCTCTGGCTCCAACTTTGGGAAC<br>ACGGCCACCCTGATTATCAGTAGGGTCGAAGCCG<br>GGGATGAGGCCGACTAT<br>(SEQ ID NO: 9619) | GAGGTGCAGCTGCTCGAGTCTGGGGGAGGCTTGGT<br>ACAGCCTGGGGGGTCCCTGAGACTCTCCTGTGCAG<br>CCTCTGGATTCACCTTTAGCAGCTATGCCATGAGC<br>TGGGTCCGCCAGGCTCCAGGGAAGGGGCTGGAGTG<br>GGTCTCAACTATTAGTGGAAGTGGTGGTGGCACAT<br>ACTACGCAGACTCCGTGAAGGGCCGGTTCACCATC<br>TCCAGAGACAATTCCAAGAACACGCTGTATCTGCA<br>AATGAACAGC<br>(SEQ ID NO: 9977) |
| | AA | ELMLTQPHSVSVAPGQTARITCGGNNIGSKSVHW<br>YQQKPGQAPVLVVYDDNDRPSGIPERFSGSNEGN<br>TATLIISRVEAGDEADYYCQVWDSSSDHVVFGGG<br>TKLTVL<br>(SEQ ID NO: 9620) | EVQLLESGGGLVQPGGSLRLSCAASGFTFSSYAMS<br>WVRQAPGKGLEWVSTISGSGGGTYYADSVKGRFTI<br>SRDNSKNTLYLQMNSLRAEDTAVYYCATGKGVHLG<br>FDYWGQGTLVTVSS<br>(SEQ ID NO: 9978) |
| 18182-G8 | NA | GAGCTCGTGCTGACTCAGCCACCCTCGGTGTCAG<br>TGGCCCCAGGACAGACGGCCAGGATAACCTGTGG<br>GGGAAACAACATTGGAAGTAAAAGTGTGCACTGG<br>TACCAACAGAAGCCAGGCCAGGCCCCTGTGATGG<br>TCGTCTATGATGATAACGACCGGCCCTCAGGGAT<br>CCCTGAGCGATTCTCTGGCTCCAACTCTGGGAAC<br>ACGGCCACCCTGACCATCAGCAGGGTCGAAGCCG<br>GGGATGAGGCCGACTAT<br>(SEQ ID NO: 9621) | GAGGTGCAGCTGCTCGAGTCCGGGGGAGGCTTGGT<br>AAAGCCTGGGGGGTCCCTGAGACTCTCCTGTGCAG<br>CCTCTGGATTCACCTTTAGCAGCTATGCCATGAAC<br>TGGGTCCGCCAGGCTCCAGGGAAGGGGCTGGAGTG<br>GGTCTCAGCTATTAGTGGTAGTGGTGGTGGCACAT<br>ACTACGCAGACTCCGGGAAGGGCCGGTTCACCATC<br>TCCAGAGACAATTCCAAGAACACGCTGTATCTGCA<br>AATGAACAGC<br>(SEQ ID NO: 9979) |

TABLE 57-continued scFv Variable Region Sequences

| Ab | Type | LC V-region | HC V-region |
|---|---|---|---|
| | AA | ELVLTQPPSVSVAPGQTARITCGGNNIGSKSVHW YQQKPGQAPVMVVYDDNDRPSGIPERFSGSNSGN TATLTISRVEAGDEADYYCQVWDSSSDHVVFGGG TKLTVL (SEQ ID NO: 9622) | EVQLLESGGGLVKPGGSLRLSCAASGFTFSSYAMN WVRQAPGKGLEWVSAISGSGGGTYYADSGKGRFTI SRDNSKNTLYLQMNSLRAEDTAVYYCATGKGVHLN FDYWGQGTLVTVSS (SEQ ID NO: 9980) |
| 18182-E10 | NA | GAGCTCGCCCTGACTCAGCCTGCCTCCGCGTCAG TGGCCCCAGGACAGACGGCCAGGATTACCTCTGG GGGAAACAACATTGGAAGTAAAAGTGTGCACTGG CACCAGCAGAAGCCAGGCCAGGCCCCTGTGTTGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTTT (SEQ ID NO: 9623) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCCATGCCATGAGC TGGGTCCGCCAGGCTCCAGGGCAGGGGCTGGAGTG GGTCTCGTCTATTAGTGGTAGCGGTGGTGGCACAT ACTACGCAGCCTCCGTGAAGGGCCGGTTCACCATC TCCAGAGACAATTCCAAGAACACGCTGTATCTGCA AATGAACAGC (SEQ ID NO: 9981) |
| | AA | ELALTQPASASVAPGQTARITCGGNNIGSKSVHW HQQKPGQAPVLVVYDDNDRPSGIPERFSGSNSGN TATLTISRVEAGDEADFYCQVWDSSSDHVVFGGG TKLTVL (SEQ ID NO: 9624) | EVQLLESGGGLVQPGGSLRLSCAASGFTFSSHAMS WVRQAPGQGLEWVSSISGSGGGTYYAASVKGRFTI SRDNSKNTLYLQMNSLRAEDTAVYYCATGKGVHLN FDYWGQGTLVTVSS (SEQ ID NO: 9982) |
| 18182-B12 | NA | GAGCTCGTGTTGACGCAGCCGCCCTCGGTGTCAG TGGCCCCAGGACAGACGGCCAGGATTACCTGTGG GGGAAACAACATTGGAAGTAAAAGTGTGCACTGG CACCAGCAGAAGCCAGGCCAGGCCCCTGTGTTGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTAT (SEQ ID NO: 9625) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAGCTATTAGTGGAAGTGGTGGTGGCACAT ACTACGCAGACTCCGTGAAGGGCCGGTTCACCATC TCCAGAGACAATTCCAAGAACACGCTGTATCTGCA AATGAGCAGC (SEQ ID NO: 9983) |
| | AA | ELVLTQPPSVSVAPGQTARITCGGNNIGSKSVHW HQQKPGQAPVLVVYDDNDRPSGIPERFSGSNSGN TATLTISRVEAGDEADYYCQVWDYSSDHVVFGGG TKLTVL (SEQ ID NO: 9626) | EVQLLESGGGLVQPGGSLRLSCAASGFTFSSYAMS WVRQAPGKGLEWVSAISGSGGGTYYADSVKGRFTI SRDNSKNTLYLQMSSLRAEDTAVYYCATGKGVHLG FDYWGQGTLVTVSS (SEQ ID NO: 9984) |
| 18182-E5 | NA | GAGCTCGTGCTGACTCAGCCACCCTCGGTGTCAG TGGCCCCAGGACAGACGGCCAGGATTACCTGTGG GGGAAACAACATTGGAAGTAAAAGTGTGCACTGG CACCAGCAGAAGCCAGGCCAGGCCCCTGTGTTGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTAT (SEQ ID NO: 9627) | GAGGTGCAGCTGCTCGAGTCCGGGGGAGGCTTGGT ACAGCCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGTG GGTCTCAACTATTAGTGGAAGTGGTGGTGGCACAT ACTACGCAGACTCCGTGAAGGGCCGGTTCACCATC TCCAGAGACAATTCCAAGAACACGCTGTATCTGCA AATGAACAGC (SEQ ID NO: 9985) |
| | AA | ELVLTQPPSVSVAPGQTARITCGGNNIGSKSVHW HQQKPGQAPVLVVYDDNDRPSGIPERFSGSNSGN TATLTISRVEAGDEADYYCQVWDYSSDHVVFGGG TKLTVL (SEQ ID NO: 9628) | EVQLLESGGGLVQPGGSLRLSCAASGFTFSSYAMS WVRQAPGKGLEWVSTISGSGGGTYYADSVKGRFTI SRDNSKNTLYLQMNSLRAEDTAVYYCATGKGVHLG FDYWGQGTLVTVSS (SEQ ID NO: 9986) |
| 18182-A4 | NA | GAGCTCGTGCTGACTCAGCCACCCTCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTACTGG TCGTCTATGATGATAACGACCGGCCCTCAGGGAT CCCTGAGCGATTCTCTGGCTCCAACTTTGGGAAC ACGGCCACCCTGATTATCAGTAGGGTCGCAGCCG GGGATGAGGCCGACTAT (SEQ ID NO: 9629) | GAGGTGCAGCTGCTCGAGTCTGGGGGAGGCGTGGT CCAGCCTGGGAGGTCCCTGAGACTCTCCTGTGCAG CGTCTGGATTCACCTTTAGCAGCTATGCCATGACC TGGGTCCGCCAGGCTCCAGGGCAGGGGCTGGAGTG GGTCTCGTCTATTAGTGGTAGTGGTGGTGGCACAT ACTACGCAGCCTCCGTGAAGGGCCGGTTCACCATC TCCAGAGACAATTCCAAGAACACGCTGTATCTGCA AATGAACAGC (SEQ ID NO: 9987) |
| | AA | ELVLTQPPSVSVAPGQTARITCGGNNIGSKSVHW YQQKPGQAPVLVVYDDNDRPSGIPERFSGSNFGN TATLIISRVAAGDEADYYCQVWDSSSDHVVFGGG TKLTVL (SEQ ID NO: 9630) | EVQLLESGGGVVQPGRSLRLSCAASGFTFSSYAMT WVRQAPGQGLEWVSSISGSGGGTYYAASVKGRFTI SRDNSKNTLYLQMNSLRAEDTAVYYCATGKGVHLG FDYWGQGTLVTVSS (SEQ ID NO: 9988) |
| 18182-E1 | NA | GAGCTCGTGCTGACGCAGCCGCCCTCGGTGTCAG TGGCCCCAGGACAGACGGCCAGGATTACCTGTGG GGGAAACAACATTGGAAGTAAAAGTGTGCACTGG TACCAGCAGAAGCCAGGCCAGGCCCCTGTGATGG TCGTCTATGATGATAACGACCGGCCCTCAGGGAT CCCTGAGCGATTCTCTGGCTCCAACTCTGGGAAC ACGGCCACCCTGACCATCAGCAGGGTCGAAGCCG GGGATGAGGCCGACTAT (SEQ ID NO: 9631) | GAGGTGCAGCTGCTCGAGTCTGGGGGAGGCTTGGT ACAGCCTGGGGGGTCCCTGAGACTCTCCTGTGCAG CCTCTGGATTCACCTTTAGCAGCCATGCCATGAGC TGGGTCCGCCAGGCTCCAGGGAAGGGGCTGGAGTG GGTCTCAGCTATTAGTGGTAGTGGTGGTGGCACAT ACAACGCAGACTCCGTGAAGGGCCGGTTCACCATC TCCAGAGACAATTCCAAGAACACGCTGTATCTGCA AATGAACAGC (SEQ ID NO: 9989) |

TABLE 57-continued scFv Variable Region Sequences

| Ab | Type | LC V-region | HC V-region |
|---|---|---|---|
| | AA | ELVLTQPPSVSVAPGQTARITCGGNNIGSKSVHW YQQDKPGQAPVMVVYDDNDRPSGIPERFSGSNSG NTATLTISRVEAGEADYYCQVWDSSSDHVVFGGG TKLTVL (SEQ ID NO: 9632) | EVQLLESGGGLVQPGGSLRLSCAASGFTFSSHAMS WVRQAPGKGLEWVSAISGSGGGTYNADSVKGRFTI SRDNSKNTLYLQMNSLRAEDTAAYYCVTGKGVHLG EDYWGQGTLVTVSS (SEQ ID NO: 9990) |
| 18081-B9 | NA | GAGCTCGTGATGACCCAGTCTCCAGACTCCCTGG CTGTGTCTCTGGGCGAGAGGGCCACCATCAACTG CAAGTCCAGCCAGAGTGTTTTATACAGCTCCAAC AATAAGAACTACTTAGCTTGGTACCAGCAGAAAC AGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9633) | GAGGTGCAGCTGCTCGAGTCGGGCCCAGGACTGGT GAAGCCTTCGGAGACCCTGTCCCTCACCTGCACTG TCTCTGGTGACTCCATCAGTAGTAGTCGTTACTAC TGGGGCTGGATCCGCCAGCCCCCAGGGAAGGGGCT GGAGTGGATTGGGAGTATCTATTATAGTGGGAGCA CCTACTACAACCCGTCCCTCAAGAGTCGAGTCACC ATATCCGTAGACACGTCCAAGAACCAGTTCTCCCT GAAGCTGAGC (SEQ ID NO: 9991) |
| | AA | ELVMTQSPDSLAVSLGERATINCKSSQSVLYSSN NKNYLAWYQQKPGQPPKLLIYWASTRESGVPDRE SGSGSGTDFTLTISSLQAEDVAVYYCQQFYSTPI TFGGQGTRLEIK (SEQ ID NO: 9634) | EVQLLESGPGLVKPSETLSLTCTVSGDSISSSRYY WGWIRQPPGKGLEWIGSIYYSGSTYYNPSLKSRVT ISVDTSKNQFSLKLSSVTAADTAVYYCARGIFGVI TYFDYWGQGTLVTVSS (SEQ ID NO: 9992) |
| 18081-E7 | NA | GAGCTCGTGATGACTCAGACTCCAGACTCCCTGG CTGTGTCTCTGGGCGAGAGGGCCACCATCAACTG CAAGTCCAGCCAGAGTGTTTTATACAGCTCCAAC AATAAAAACTACTTAGCTTGGTACCAGCAGAAAC AGGACAGCCTCCTAAGCTGCTCATTTACTGGGC ATCTACCCGGGAATCCGGGGTCCCTGACCGATTC AGTGGCAGCGGGTCTGGGACAGATTTCACTCTCA CCATCAGCAGCCTGCAG (SEQ ID NO: 9635) | GAGGTGCAGCTGCTCGAGTCGGGCCCAGGACTGGT GAAGCCTTCGGAGACCCTGTCCCTCACCTGCACTG TCTCTGGTGACTCCATCAGTAGTAGTCGTTACTAC TGGGGCTGGATCCGCCAGCCCCCAGGGAAGGGGCT GGAGTGGATTGGGAGTATCTATTATAGTGGGAGCA CCTACTACAACCCGTCCCTCAAGAGTCGAGTCACC ATATCCGTAGACACGTCCAAGAACCAGTTCTCCCT GAAGCTGAGC (SEQ ID NO: 9993) |
| | AA | ELVMTQTPDSLAVSLGERATINCKSSQSVLYSSN NKNYLAWYQQKPGQPPKLLIYWASTRESGVPDRF SGSGSGTDFTLTISSLQAEDVAVYYCQQYYSTPL TFGGGTKVEIK (SEQ ID NO: 9636) | EVQLLESGPGLVKPSETLSLTCTVSGDSISSSRYY WGWIRQPPGKGLEWIGSIYYSGSTYYNPSLKSRVT ISVDTSKNQFSLKLSSVTAADTAVYYCARGIFGVI TYFDYWGQGTLVTVSS (SEQ ID NO: 9994) |
| 18089-D11 | NA | GAGCTCGTGATGACCCAGTCTCCATCCTCCCTGT CTGCATCTGTAGGAGACAGAGTCACCATCACTTG CCGGGCAAGTCAGAGCATTAGCAACTATTTCAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9637) | GAGGTGCAGCTGCTCGAGTCTGGTCCTGTGCTGGT GAAACCCACACAGACCCTCACGCTGACCTGCACCT TCTCTGGTTTCTCATTCACCACTCATAAAATGGGT GTGGACTGGATCCGTCAGCCCCCAGGAAAGGCCCT GGAGTGGCTTGCACTCATTTATTGGAATGATGATA AGCGCTACAACCCATCTCTGCAGAGTAGGCTCACC ATCACCAAGGACACCTCCAAAAACCAGGTGGTCCT CACAATGACC (SEQ ID NO: 9995) |
| | AA | ELVMTQSPSSLSASVGDRVTITCRASQSISNYFN WYQQKPGKAPKLLIYAASSLQSGVPSRFSGSGSG TDFTLTISSLQPEDFATYYCQQSYITPFTFGGGT KLEIK (SEQ ID NO: 9638) | EVQLLESGPVLVKPTQTLTLTCTFSGFSFTTHKMG VDWIRQPPGKALEWLALIYWNDDKRYNPSLQSRLT ITKDTSKNQVVLTMTNMDPVDTATYYCAYRRYNWN YENWFDPWGQGTLVTVSS (SEQ ID NO: 9996) |
| 18089-C9 | NA | GAGCTCCAGATGACCCAGTCTCCTTCCTCCCTGT CTGCATCTGTAGGAGACAGAGTCACCATCACTTG CCGGGCAAGTCAGTTTATTAGCAGCTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCCGTGGATCTGGG ACAGATTTCACTCTCACCATCAGCAGTCTGCAAC CTGAAGATTTTGCAACT (SEQ ID NO: 9639) | GAGGTGCAGCTGCTCGAGTCTGGTCCTACGCTGGT GAAACCCACACAGACCCTCACGCTGACCTGCACCT TCTCTGGTTTCTCATTCACCACTCATAAAATGGGT GTGGACTGGATCCGTCAGCCCCCAGGAAAGGCCCT GGAGTGGCTTGCACTCATTTATTGGAATGATGATA AGCGCTACAGCCCATCTCTGCAGAGTAGGCTCACC ATCACCAAGGACACCTCCAAAAACCAGGTGGTCCT CACAATGACC (SEQ ID NO: 9997) |
| | AA | ELQMTQSPSSLSASVGDRVTITCRASQFISSYLN WYQQKPGKAPKLLIYAASSLQSGVPSRFSGRGSG TDFTLTISSLQPEDFATYYCQQSYSTPFTEGPGT KVEIK (SEQ ID NO: 9640) | EVQLLESGPTLVKPTQTLTLTCTFSGFSFTTHKMG VDWIRQPPGKALEWLALIYWNDDKRYSPSLQSRLT ITKDTSKNQVVLTMTNMDPVDTATYYCAYRRYNWN YENWEDPWGQGTLVTVSS (SEQ ID NO: 9998) |
| 18089-D8 | NA | GAGCTCGTGATGACCCAGTCTCCAGACTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9641) | GAGGTGCAGCTGCTCGAGTCTGGTCCTATGCTGGT GAAACCCACACAGACCCTCACGCTGACCTGCACCT TCTCTGGTTTCTCATTCACCACTCATAAAATGGGT GTGGACTGGATCCGTCAGCCCCCAGGAAAGGCCCT GGAGTGGCTTGCACTCATTTATTGGAATGATGATA AGCGCTACAGCCCATCTCTGCAGAGTAGGCTCACC ATCACCAAGGACACCTCCAAAAACCAGGTGGTCCT CACAATGACC (SEQ ID NO: 9999) |

TABLE 57-continued scFv Variable Region Sequences

| Ab | Type | LC V-region | HC V-region |
|---|---|---|---|
| | AA | ELVMTQSPDSLSASVGDRVTITCRASQSISSYLN WYQQKPGKAPKLLIYAASSLQSGVPSRFSGSGSG TDFTLTISSLQPEDFATYYCQQSYSTPITFGQGT RLEIK (SEQ ID NO: 9642) | EVQLLESGPMLVKPTQTLTLTCTFSGFSFTTHKMG VDWIRQPPGKALEWLALIYWNDDKRYSPSLQSRLT ITKDTSKNQVVLTMTNMDPVDTATYYCAYRRYNWN YENWFDPWGQGTLVTVSS (SEQ ID NO: 10000) |
| 18081-F9 | NA | GAGCTCCAGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9643) | GAGGTGCAGCTGCTCGAGTCTGGTCCTATGCTGGT GAAACCCACACAGACCCTCACGCTGACCTGCACCT TCTCTGGTTTCTCATTCACCACTCATAAAATGGGT GTGGACTGGATCCGTCAGCCCCCAGGAAAGGCCCT GGAGTGGCTTGCACTCATTTATTGGAATGATGATA AGCGCTACAGCCCATCTCTGCAGAGTAGGCTCACC ATCACCAAGGACACCTCCAAAAACCAGGTGGTCCT CACAATGACC (SEQ ID NO: 10001) |
| | AA | ELQMTQSPSSLSASVGDRVTITCRASQSISSYLN WYQQKPGKAPKLLIYAASSLQSGVPSRFSGSGSG TDFTLTISSLQPEDFATYYCQQSYSTPFTFGPGT KVEIK (SEQ ID NO: 9644) | EVQLLESGPMLVKPTQTLTLTCTFSGFSFTTHKMG VDWIRQPPGKALEWLALIYWNDDKRYSPSLQSRLT ITKDTSKNQVVLTMTNMDPVDTATYYCAYRRYNWN YENWFDPWGQGTLVTVSS (SEQ ID NO: 10002) |
| 18081-H11 | NA | GAGCTCCAGATGACCCAGTCTCCATCCTCCCTGT CTGCATCTGTAGGAGACAGAGTCACCATCACTTG CCAGGCGAGTCAGGACATTAGCAACTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9645) | GAGGTGCAGCTGCTCGAGTCTGGTCCTGCGCTGGT GAAACCCACACAGACCCTCACGCTGACCTGCACCT TCTCTGGTTTCTCATTCACCACTCATAAAATGGGT GTGGACTGGATCCGTCAGCCCCCAGGAAAGGCCCT GGAGTGGCTTGCACTCATTTATTGGAATGATGATA AGCGCTACAGCCCATCTCTGCAGAGTAGGCTCACC ATCACCAAGGACACCTCCAAAAACCAGGTGGTCCT CACAATGACC (SEQ ID NO: 10003) |
| | AA | ELQMTQSPSSLSASVGDRVTITCQASQDISNYLN WYQQKPGKAPKLLIYAASSLQSGVPSRESGSGSG TDFTLTISSLQPEDFATYYCQQSYTTPFTFGPGT KVEIK (SEQ ID NO: 9646) | EVQLLESGPALVKPTQTLTLTCTFSGFSFTTHKMG VDWIRQPPGKALEWLALIYWNDDKRYSPSLQSRLT ITKDTSKNQVVLTMTNMDPVDTATYYCAYRRYNWN YENWFDPWGQGTLVTVSS (SEQ ID NO: 10004) |
| 18081-B6 | NA | GAGCTCGTGATGACCCAGTCTCCATCCTCCCTGT CTGCATCTGTAGGAGACAGAGTCACCATCACTTG CCGGGCAAGTCAGAGCATTAGCAGCTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9647) | GAGGTGCAGCTGCTCGAGTCTGGTCCTATGCTGGT GAAACCCACACAGACCCTCACGCTGACCTGCACCT TCTCTGGTTTCTCATTCACCACTCATAAAATGGGT GTGGACTGGATCCGTCAGCCCCCAGGAAAGGCCCT GGAGTGGCTTGCACTCATTTATTGGAATGATGATA AGCGCTACAGCCCATCTCTGCAGAGTAGGCTCACC ATCACCAAGGACACCTCCAAAAACCAGGTGGTCCT CACAATGACC (SEQ ID NO: 10005) |
| | AA | ELVMTQSPSSLSASVGDRVTITCRASQSISSYLN WYQQKPGKAPKLLIYAASSLQSGVPSRFSGSGSG TDFTLTISSLQPEDFATYYCQQSYSTPFTFGPGT KLEIK (SEQ ID NO: 9648) | EVQLLESGPMLVKPTQTLTLTCTFSGFSFTTHKMG VDWIRQPPGKALEWLALIYWNDDKRYSPSLQSRLT ITKDTSKNQVVLTMTNMDPVDTATYYCAYRRYNWN YENWFDPWGQGTLVTVSS (SEQ ID NO: 10006) |
| 18089-B2 | NA | GAGCTCCAGATGACCCAGTCTCCATCCTCCCTGT CTGCATCTGTAGGAGACAGAGTCACCATCACTTG CCAGGCGAGTCAGGACATTAGCAACTATTTAAAT TGGTATCAGCAGAAACCAGGGAAAGCCCCTAAGC TCCTGATCTATGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9649) | GAGGTGCAGCTGCTCGAGTCTGGGGGAGGCTTGGT ACAGCCTGGGGGGTCCCTGAGACTCTCCTGTGCAG CCTCTGGATTCACCTTTAGCTCCTATGCCATGAGC TGGGTCCGCCAGGCTCCAGGGAGGGGGCTGGAGTG GGTCTCAACTATTAGTATTAGTGGTGGTAGCACAA ACTACGCAGACTCCGTGAAGGGCCGGTTCACCATC TCCAGAGACAATTCCAAGAACACGCTGTATCTGCA AATGAACAGC (SEQ ID NO: 10007) |
| | AA | ELQMTQSPSSLSASVGDRVTITCQASQDISNYLN WYQQKPGKAPKLLIYAASSLQSGVPSRFSGSGSG TDFTLTISSLQPEDFATYYCQQSYSIPLTFGGGT KVEIK (SEQ ID NO: 9650) | EVQLLESGGGLVQPGGSLRLSCAASGFTFSSYAMS WVRQAPGRGLEWVSTISISGGSTNYADSVKGRFTI SRDNSKNTLYLQMNSLRAEDTAVYYCAKDGGSGWF PKLLHYGLDVWGQGTTVTVSS (SEQ ID NO: 10008) |
| 18179-E1 | NA | GAGCTCGTGATGACCCAGTCTCCATCCTCCCTGT CTGCATCTGTAGGAGACAGAGTCACCATCACTTG CCGGACAAGTCAGAGCATTAGCAGCTATTTAAAT TGGTATCAGCAGAAACCAGGGAGAGCCCCTAAGC TCCTGATCTTTGCTGCATCCAGTTTGCAAGGTGG GGTCCCATCAAGGTTCAGTGGCAGTGGATCTGGG ACAGATTTCACTCTCACCATCAGCAGTCTCCAAC CTGAAGATTTTGCAACT (SEQ ID NO: 9651) | GAGGTGCAGCTGCTCGAGTCCGGGGGAGGCTTGGT ACAGCCTGGGGGGTCCCTGAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAGGCAGATTC ACCATCTCAAGAGATGATTCAAAAAACACGCTGTA TCTGCAAATG (SEQ ID NO: 10009) |

TABLE 57-continued scFv Variable Region Sequences

| Ab | Type | LC V-region | HC V-region |
|---|---|---|---|
| | AA | ELVMTQSPSSLSASVGDRVTITCRTSQSISSYLN WYQQKPGRAPKLLIFAASSLQGGVPSRFSGSGSG TDFTLTISSLQPEDFATYYCQQTYSMPFTFGPG TKVDIK (SEQ ID NO: 9652) | EVQLLESGGGLVQPGGSLRLSCAASGFTFSNAWMS WVRQAPGKGLEWVGRIKGNTYGGTTDYAAPVKGRF TISRDDSKNTLYLQMNSLKTEDTAVYYCTTPSYSG SYYNYFSVMDWGQGTTVTVSS (SEQ ID NO: 10010) |
| 18179-H7 | NA | GAGCTCCAGATGACCCAGTCTCCATCCTCCCTGT CTGCATCTGTAGGAGACAGAGTCACCATCACTTG CCGGACAAGTCAGAGCATTAGCAGCTATTTAAAT TGGTTTCAACAGAAACCAGGGAAAGCCCCTAAGC TCCTGATCTTTGCTGCATCCAGTTTGCAAAGTGG GGTCCCATCAAGGTTCAGTGGCAGTGGATCTGGG ACAGATTTCACTCTCACCATCAGCAGTCTGCAAC CTGAAGATTTTGCAACT (SEQ ID NO: 9653) | GAGGTGCAGCTGCTCGAGTCTGGGGGAGGCTTGGT ACAGCCTGGGGGGTCCCTTAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGCAAAACTTATGGTGGGA CAACAGACTACGCTGCACCCGTGAAAGGCAGATTC ACCATCTCAAGAGATGATTCAAAAAACACGCTGTA TCTGCAAATG (SEQ ID NO: 10011) |
| | AA | ELQMTQSPSSLSASVGDRVTITCRTSQSISSYLN WFQQKPGKAPKLLIFAASSLQSGVPSRFSGSGSG TDFTLTISSLQPEDFATYYCQQSYSSPFTFGPGT KVEIK (SEQ ID NO: 9654) | EVQLLESGGGLVQPGGSLRLSCAASGFTFSNAWMS WVRQAPGKGLEWVGRIKSKTYGGTTDYAAPVKGRF TISRDDSKNTLYLQMNSLKTEDTAVYYCTTPSYSG SYYNYFSVMDWGQGTTVTVSS (SEQ ID NO: 10012) |
| 18179-B12 | NA | GAGCTCGTGATGACCCAGTCTCCATCCTCCCTGT CTGCATCTGTAGGAGACAGAGTCACCATCACTTG CCGGACAAGTCAGAGCATTAGCAGCTATTTAAAT TGGTTTCAACAGAAACCAGGGAAAGCCCCTAAGC TCCTGATCTTTGCTGCATCCAGTTTGCAAAGTGG GGTCCCATCAAGGTTCAGTGGCAGTGGATCTGGG ACAGATTTCACTCTCACCATCAGCAGTCTCCAAC CTGAAGATTTTGCAACT (SEQ ID NO: 9655) | GAGGTGCAGCTGCTCGAGTCCGGGGGAGGCTTGGT ACAGCCTGGGGGGTCCCTTAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 10013) |
| | AA | ELVMTQSPSSLSASVGDRVTITCRTSQSISSYLN WFQQKPGKAPKLLIFAASSLQSGVPSRFSGSGSG TDFTLTISSLQPEDFATYYCQQTYSMPFTFGPGT KVEIK (SEQ ID NO: 9656) | EVQLLESGGGLVQPGGSLRLSCAASGFTFSNAWMS WVRQAPGKGLEWVGRIKGNTYGGTTDYAAPVKGRF TISRDDSKNTLFLQMNSLKTEDTAVYYCTTPSNSG SYYNYFSVMDWGQGTTVTVSS (SEQ ID NO: 10014) |
| 18179-D11 | NA | GAGCTCCAGATGACCCAGTCTCCATCCTCCCTGT CTGCATCTGTAGGAGACAGAGTCACCATCACTTG CCGGACAAGTCAGAGCATTAGCAGCTATTTAAAT TGGTATCAGCAGAAACCAGGGAGAGCCCCTAAGC TCCTGATCTTTGCTGCATCCAGTTTGCAAGGTGG GGTCCCATCAAGGTTCAGTGGCAGTGGATCTGGG ACAGATTTCACTCTCACCATCAGCAGTCTCCAAC CTGAAGATTTTGCAACT (SEQ ID NO: 9657) | GAGGTGCAGCTGCTCGAGTCCGGGGGAGGCTTGGT AAAGCCTGGGGGGTCCCTTAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 10015) |
| | AA | ELQMTQSPSSLSASVGDRVTITCRTSQSISSYLN WYQQKPGRAPKLLIFAASSLQGGVPSRFSGSGSG TDFTLTISSLQPEDFATYYCQQTYSMPFTFGPGT KVDIK (SEQ ID NO: 9658) | EVQLLESGGGLVKPGGSLRLSCAASGFTFSNAWMS WVRQAPGKGLEWVGRIKGNTYGGTTDYAAPVKGRF TISRDDSKNTLFLQMNSLKTEDTAVYYCTTPSYSG SYYNYFSVMDWGQGTTVTVSS (SEQ ID NO: 10016) |
| 18179-D7 | NA | GAGCTCGTGATGACCCAGTCTCCATCCTCCCTGT CTGCATCTGTAGGAGACAGAGTCACCATCACTTG CCGGACAAGTCAGAGCATTAGCAGCTATTTAAAT TGGTATCAGCAGAAACCAGGGAGAGCCCCTAAGC TCCTGATCTTTGCTGCATCCAGTTTGCAAGGTGG GGTCCCATCAAGGTTCAGTGGCAGTGGATCTGGG ACAGATTTCACTCTCACCATCAGCAGTCTCCAAC CTGAAGATTTTGCAACT (SEQ ID NO: 9659) | GAGGTGCAGCTGCTCGAGTCCGGGGGAGGCTTGGT ACAGCCTGGGGGGTCCCTGAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 10017) |
| | AA | ELVMTQSPSSLSASVGDRVTITCRTSQSISSYLN WYQQKPGRAPKLLIFAASSLQGGVPSRFSGSGSG TDFTLTISSLQPEDFATYYCQQTYSMPFTFGPGT KVDIK (SEQ ID NO: 9660) | EVQLLESGGGLVQPGGSLRLSCAASGFTFSNAWMS WVRQAPGKGLEWVGRIKGNTYGGTTDYAAPVKGRF TISRDDSKNTLFLQMNSLKTEDTAVYYCTTPSYSG SYYNYFSVMDWGQGTTVTVSS (SEQ ID NO: 10018) |
| 18179-A7 | NA | GAGCTCGTGATGACCCAGTCTCCATCCTCCCTGT CTGCATCTGTAGGAGACAGAGTCACCATCACTTG CCGGACAAGTCAGAGCATTAGCAGCTATTTAAAT TGGTATCAGCAGAAACCAGGGAGAGCCCCTAAGC TCCTGATCTTTGCTGCATCCAGTTTGCAAGGTGG GGTCCCATCAAGGTTCAGTGGCAGTGGATCTGGG ACAGATTTCACTCTCACCATCAGCAGTCTCCAAC CTGAAGATTTTGCAACT (SEQ ID NO: 9661) | GAGGTGCAGCTGCTCGAGTCCGGGGGAGGCTTGGT AAAGCCTGGGGGGTCCCTTAGACTCTCCTGTGCAG CCTCTGGATTCACTTTCAGTAACGCCTGGATGAGC TGGGTCCGCCAGGCTCCAGGGAAGGGGCTGGAGTG GGTTGGCCGTATTAAAGGCAACACTTATGGTGGGA CAACAGACTACGCTGCACCCGTGAAAGGCAGATTC ACCATCTCAAGAGATGATTCAAAAAACACGCTGTT TCTGCAAATG (SEQ ID NO: 10019) |

TABLE 57-continued scFv Variable Region Sequences

| Ab | Type | LC V-region | HC V-region |
|---|---|---|---|
| | AA | ELVMTQSPSSLSASVGDRVTITCRTSQSISSYLN<br>WYQQKPGRAPKLLIFAASSLQGGVPSRFSGSGSG<br>TDFTLTISSLQPEDFATYYCQQTYSMPFTFGPGT<br>KVDIK<br>(SEQ ID NO: 9662) | EVQLLESGGGLVKPGGSLRLSCAASGFTFSNAWMS<br>WVRQAPGKGLEWVGRIKGNTYGGTTDYAAPVKGRF<br>TISRDDSKNTLFLQMNSLKTEDTAVYYCTTPSYSG<br>SYYNYFSVMDWGQGTTVTVSS<br>(SEQ ID NO: 10020) |
| 18181-H7 | NA | GAGCTCGTGATGACCCAGACTCCACTCTCCCTGC<br>CCGTCACCCCTGGAGAGCCGGCCTCCATCTCCTG<br>CAGGTCTAGTCAGAGCCTCCTGCATAGAAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTCACGCTGAAAA<br>TCAGCAGAGTGGAGGCT<br>(SEQ ID NO: 9663) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCACCCAGGGAAGGGCCT<br>GGAGTGGATTGGGTACATCTCTTACAGTGGGATCA<br>CCAACTACAACCCCTCCCTCAAGAGTCGAGTCACC<br>ATGTCAGTGGACACGTCCAAGAACCAGTTCTCCCT<br>GAAGCTGACC<br>(SEQ ID NO: 10021) |
| | AA | ELVMTQTPLSLPVTPGEPASISCRSSQSLLHRNG<br>YNYLDWYLQKPGQSPQLLIYLGSNRASGVPDRFS<br>GSGSGTDFTLKISRVEAGDVGVYYCMQALQTPWT<br>FGQGTKVEIK<br>(SEQ ID NO: 9664) | EVQLLESGPGLVKPSQTLSLTCTVSGDSISSNPYY<br>WSWIRQHPGKGLEWIGYISYSGITNYNPSLKSRVT<br>MSVDTSKNQFSLKLTSLTAADTAVYYCAREKMWFG<br>VLNYYYGMDVWGQGTTVTVSS<br>(SEQ ID NO: 10022) |
| 18181-G10 | NA | GAGCTCGTGATGACTCAGTCTCCACTCTCCCTGC<br>CCGTCACCCCTGGAGAGCCGGCCTCCATCTCCTG<br>CAGGTCTAGTCAGAGCCTCCTGCATAGTACTGGA<br>TACAACTATGTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTAAAAA<br>TCAGCAGAGTGGAGGCT<br>(SEQ ID NO: 9665) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCTCCCCGGGAAGGGCCT<br>GGAGTGGATTGGGTACATCTCTTACAGTGGGAGCA<br>CCTTCTACAACCCGTCCCTCAAGAGTCGAGTTACC<br>ATATCAGTAGACACGTCTAAGAACCAGTTCTCCCT<br>GAATCTGACC<br>(SEQ ID NO: 10023) |
| | AA | ELVMTQSPLSLPVTPGEPASISCRSSQSLLHSTG<br>YNYVDWYLQKPGQSPLLIYLGSNRASGVPDRFS<br>GSGSGTDFTLKISRVEAEDVGFYYCMQALQTPRT<br>FGQGTKVEIK<br>(SEQ ID NO: 9666) | EVQLLESGPGLVKPSQTLSLTCTVSGDSISSNPYY<br>WSWIRQLPGKGLEWIGYISYSGSTFYNPSLKSRVT<br>ISVDTSKNQFSLNLTSVTAADTAVYYCARDRLWFG<br>VLNYYYGMDVWGLGTTVTVSS<br>(SEQ ID NO: 10024) |
| 18181-G8 | NA | GAGCTCGTGATGACCCAGTCTCCATCCTCCCTGT<br>CTGCATCTGTAGGAGACAGAGTCACCATCACTTG<br>CCGGACAAGTCAGAGCATTAGCAGCTATTTAAAT<br>TGGTATCAGCAGAAACCAGGGAAAGCCCCTAAAC<br>TCCTGATCTATGCTGCATCCAGTTTGCAAAGTGG<br>GGTCCCATCAAGGTTCAGTGGCAGTGGATCTGGG<br>ACAGATTTCACTCTCACCATCAGCAGTCTCCAAC<br>CTGAAGATTTTGCAACT<br>(SEQ ID NO: 9667) | GAGGTGCAGCTGCTCGAGTCCGGGGGAGGCTTGGT<br>ACAGCCTGGGGGTCCCTGAGACTCTCCTGTGCAG<br>CCTCTGGATTCACTTTCAGTAACGCCTGGATGAGC<br>TGGGTCCGCCAGGCTCCAGGGAAGGGGCTGGAGTG<br>GGTTGGCCGTATTAAAGGCAACACTTATGGTGGGA<br>CAACAGACTACGCTGCACCCGTGAAAGGCAGATTC<br>ACCATCTCAAGAGATGATTCAAAAAACACGCTGTT<br>TCTGCAAATG<br>(SEQ ID NO: 10025) |
| | AA | ELVMTQSPSSLSASVGDRVTITCRTSQSISSYLN<br>WYQQKPGKAPKLLIYAASSLQSGVPSRFSGSGSG<br>TDFTLTISSLQPEDFATYYCQQTYSMPFTFGGGT<br>KVEIK<br>(SEQ ID NO: 9668) | EVQLLESGGGLVQPGGSLRLSCAASGFTFSNAWMS<br>WVRQAPGKGLEWVGRIKGNTYGGTTDYAAPVKGRF<br>TISRDDSKNTLFLQMNSLKTEDTAVYYCTTPSNSG<br>SYYNYFSVMDWGQGTTVTVSS<br>(SEQ ID NO: 10026) |
| 18181-F3 | NA | GAGCTCGTGATGACCCAGTCTCCATCCTCCCTGT<br>CTGCATCTGTAGGAGACAGAGTCACCATCACTTG<br>CCGGACAAGTCAGAGCATTAGCAGCTATTTAAAT<br>TGGTATCAGCAGAAACCAGGGAGAGCCCCTAAGC<br>TCCTGATCTTTGCTGCATCCAGTTTGCAAGGTGG<br>GGTCCCATCAAGGTTCAGTGGCAGTGGATCTGGG<br>ACAGATTTCACTCTCACCATCAGCAGTCTGCAAC<br>CTGAAGATTTTGCAACT<br>(SEQ ID NO: 9669) | GAGGTGCAGCTGCTCGAGTCTGGGGGAGGCTTGGT<br>GCAGCCTGGGGGGTCCCTTAGACTCTCCTGTGCAG<br>CCTCTGGATTCACTTTCAGTAACGCCTGGATGAGC<br>TGGGTCCGCCAGGCTCCAGGGAAGGGGCTGGAGTG<br>GGTTGGCCGTATTAAAGGCAACACTTATGGTGGGA<br>CAACAGACTACGCTGCACCCGTGAAAGGCAGATTC<br>ACCATCTCAAGAGATGATTCAAAAAACACGCTGTT<br>TCTGCAAATG<br>(SEQ ID NO: 10027) |
| | AA | ELVMTQSPSSLSASVGDRVTITCRTSQSISSYLN<br>WYQQKPGRAPKLLIFAASSLQGGVPSRESGSGSG<br>TDFTLTISSLQPEDFATYYCQQSYSSPFTFGPGT<br>KVEIK<br>(SEQ ID NO: 9670) | EVQLLESGGGLVQPGGSLRLSCAASGFTFSNAWMS<br>WVRQAPGKGLEWVGRIKGNTYGGTTDYAAPVKGRF<br>TISRDDSKNTLFLQMNSLKTEDTAVYYCTTPSYSG<br>SYYNYFSVMDWGQGTTVTVSS<br>(SEQ ID NO: 10028) |
| 18181-F1 | NA | GAGCTCGTGATGACCCAGTCTCCATCCTCCCTGT<br>CTGCATCTGTAGGAGACAGAGTCACCATCACTTG<br>CCGGACAAGTCAGAGCATTAGCAGCTATTTAAAT<br>TGGTATCAGCAGAAACCAGGGAGAGCCCCTAAGC<br>TCCTGATCTTTGCTGCATCCAGTTTGCAAGGTGG<br>GGTCCCATCAAGGTTCAGTGGCAGTGGATCTGGG<br>ACAGATTTCACTCTCACCATCAGCAGTCTCCAAC<br>CTGAAGATTTTGCAACT<br>(SEQ ID NO: 9671) | GAGGTGCAGCTGCTCGAGTCTGGGGGAGGCTTGGT<br>AAAGCCTGGGGGGTCCCTTAGACTCTCCTGTGCAG<br>CCTCTGGATTCACTTTCAGTAACGCCTGGATGAGC<br>TGGGTCCGCCAGGCTCCAGGGAAGGGGCTGGAGTG<br>GGTTGGCCGTATTAAAGGCAACACTTATGGTGGGA<br>CAACAGACTACGCTGCACCCGTGAAAGGCAGATTC<br>ACCATCTCAAGAGATGATTCAAAAAACACGCTGTT<br>TCTGCAAATG<br>(SEQ ID NO: 10029) |

TABLE 57-continued scFv Variable Region Sequences

| Ab | Type | LC V-region | HC V-region |
|---|---|---|---|
| | AA | ELVMTQSPSSLSASVGDRVTITCRTSQSISSYLN<br>WYQQKPGRAPKLLIFAASSLQGGVPSRFSGSGSG<br>TDFTLTISSLQPEDFATYYCQQTYSSPFTFGPGT<br>KLEIK<br>(SEQ ID NO: 9672) | EVQLLESGGGLVKPGGSLRLSCAASGFTFSNAWMS<br>WVRQAPGKGLEWVGRIKGNTYGGTTDYAAPVKGRF<br>TISRDDSKNTLFLQMNSLKTEDTAVYYCTTPSYSG<br>SYYNYFSVMDVWGQGTTVTVSS<br>(SEQ ID NO: 10030) |
| 18181-E2 | NA | GAGCTCGTGATGACCCAGTCTCCACTCTCCCTGC<br>CCGTCACCCCTGGAGAGCCGGCCTCCATCTCCTG<br>CAGGTCTAGTCAGAGCCTCCTGCATAGTAGTGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAAAGTGGAGGCT<br>(SEQ ID NO: 9673) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCACCCAGGGAAGGGCCT<br>GGAGTGGATTGGGTACATCTCTCACAGTGGGAGCA<br>CTTATTACAATCCGTCCCTCAAGAGTCGAGTAACC<br>ATATCAGTAGACACGTCTAAGAATCAGTTCTCCCT<br>GAATCTGACC<br>(SEQ ID NO: 10031) |
| | AA | ELVMTQSPLSLPVTPGEPASISCRSSQSLLHSSG<br>YNYLDWYLQKPGQSPQLLIYLGSNRASGVPDRFS<br>GSGSGTDFTLKISKVEAEDVGVYYCMQALQTPRT<br>FGQGTKVDIK<br>(SEQ ID NO: 9674) | EVQLLESGPGLVKPSQTLSLTCTVSGDSISSNPYY<br>WSWIRQHPGKGLEWIGYISHSGSTYYNPSLKSRVT<br>ISVDTSKNQFSLNLTSVTAADTAVYYCARDRLWFG<br>VLNYYYGMDVWGLGTTVTVSS<br>(SEQ ID NO: 10032) |
| 18181-C9 | NA | GAGCTCGTGCTGACTCAGTCTCCACTCTCCCTGC<br>CCGTCACCCCTGGAGAGCCGGCCTCCATCTCCTG<br>CAGGTCTAGTCAGAGCCTCCTGCACAGAAATGGA<br>TACAACTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCAGT<br>GGCAGTGGATCAGGCACAGATTTTACACTGAAAA<br>TCAGCAGAGTGGAGGCT<br>(SEQ ID NO: 9675) | GAGGTGCAGCTGCTCGAGTCGGGCCCAGGACTGGT<br>GAAGCCTTCACAGACCCTGTCCCTCACCTGCACTG<br>TCTCTGGTGACTCCATCAGCAGTAATCCTTACTAC<br>TGGAGCTGGATCCGCCAGCTCCCCGGGAAGGGCCT<br>GGAGTGGATTGGGTACATCTCTTACAGTGGGAGCA<br>CCTTCTACAACCCGTCCCTCAAGAGTCGAGTTACC<br>ATATCAGTAGACACGTCTAAGAACCAGTTCTCCCT<br>GAATCTGACC<br>(SEQ ID NO: 10033) |
| | AA | ELVLTQSPLSLPVTPGEPASISCRSSQSLLHRNG<br>YNYLDWYLQKPGQSPQLLIYLGSNRASGVPDRFS<br>GSGSGTDFTLKISRVEAEDVGVYYCMQLQTPFT<br>FGPGTKVEIK<br>(SEQ ID NO: 9676) | EVQLLESGPGLVKPSQTLSLTCTVSGDSISSNPYY<br>WSWIRQLPGKGLEWIGYISYSGSTFYNPSLKSRVT<br>ISVDTSKNQFSLNLTSVTAADTAVYYCARDRLWFG<br>VLNYYYGMDVWGLGTTVTVSS<br>(SEQ ID NO: 10034) |
| 18181-B8 | NA | GAGCTCGTGATGACTCAGACTCCACTCTCCCTGC<br>CCGTCACCCCTGGAGAGCCGGCCTCCATCTCCTG<br>CAGGTCTAGTCAGAGCCTCCTGCATAGAAATGGA<br>TACAATTATTTGGATTGGTACCTGCAGAAGCCAG<br>GGCAGTCTCCACAGCTCCTGATCTATTTGGGTTC<br>TAATCGGGCCTCCGGGGTCCCTGACAGGTTCATT<br>GGCAGTGGCTCAGGCACAGATTTTACACTGGAAA<br>TCAGCAGAGTGGAGGCT<br>(SEQ ID NO: 9677) | GAGGTGCAGCTGCTCGAGTCGGGCCCAGGACTGGT<br>GAAGCCTTCACAGACCCTGTCCCTCACCTGCACTG<br>TCTCTGGTGGTTCCATCAGCAGTGGTGGTTACTAC<br>TGGAGCTGGATCCGCCAGCACCCAGGGAAGGGCCT<br>GGAGTGGATTGGGTACATCTCTCACAGTGGGAGCA<br>CTTATTACAATCCGTCCCTCAAGAGTCGAGTAACC<br>ATATCAGTAGACACGTCTAAGAATCAGTTCTCCCT<br>GAATCTGACC<br>(SEQ ID NO: 10035) |
| | AA | ELVMTQTPLSLPVTPGEPASISCRSSQSLLHRNG<br>YNYLDWYLQKPGQSPQLLIYLGSNRASGVPDRFI<br>GSGSGTDFTLEISRVEAEDVGVYYCMQALQTPSF<br>GQGTKVEIK<br>(SEQ ID NO: 9678) | EVQLLESGPGLVKPSQTLSLTCTVSGGSISSGGYY<br>WSWIRQHPGKGLEWIGYISHSGSTYYNPSLKSRVT<br>ISVDTSKNQFSLNLTSVTAADTAVYYCAREKMWFG<br>VLNYYYGMDVWGQGTTVTVSS<br>(SEQ ID NO: 10036) |
| 18181-A6 | NA | GAGCTCGTGATGACCCAGTCTCCATCCTCCCTGT<br>CTGCATCTGTAGGAGACAGAGTCACCATCACTTG<br>CCGGGCAAGTCAGAGCATTAGCAGCTATTTAAAT<br>TGGTATCAGCAGAAACCAGGGAGAGCCCCTAAGC<br>TCCTGATCTTTGCTGCATCCAGTTTGCAAGGTGGA<br>GTCCCATCAAGGTTCAGTGGCAGTGGATCTGGG<br>ACAGATTTCACTCTCACCATCAGCAGTCTCCAAC<br>CTGAAGATTTTGCAACT<br>(SEQ ID NO: 9679) | GAGGTGCAGCTGCTCGAGTCCGGGGAGGCTTGGT<br>ACAGCCTGGGGGGTCCCTGAGACTCTCCTGTGCAG<br>CCTCTGGATTCACTTTCAGTAACGCCTGGATGAGC<br>TGGGTCCGCCAGGCTCCAGGGAAGGGGCTGGAGTG<br>GGTTGGCCGTATTAAAGGCAACACTTATGGTGGGA<br>CAACAGACTACGCTGCACCCGTGAAAGGCAGATTC<br>ACCATCTCAAGAGATGATTCAAAAAACACGCTGTA<br>TCTGCAAATG<br>(SEQ ID NO: 10037) |
| | AA | ELVMTQSPSSLSASVGDRVTITCRASQSISSYLN<br>WYQQKPGRAPKLLIFAASSLQGGVPSRFSGSGSG<br>TDFTLTISSLQPEDFATYYCQQTYSMPFTFGPGT<br>KLEIK<br>(SEQ ID NO: 9680) | EVQLLESGGGLVQPGGSLRLSCAASGFTFSNAWMS<br>WVRQAPGKGLEWVGRIKGNTYGGTTDYAAPVKGRF<br>TISRDDSKNTLYLQMNSLKTEDTAVYYCTTPSYSG<br>SYYNYFSVMDVWGQGTTVTVSS<br>(SEQ ID NO: 10038) |
| 18403-F12-AS | NA | No nuc. seq available | No nuc. seq available |
| | AA | SYVLTQPPSVSVAPGQTARITCGGNNIGSKSVHW<br>YQQKPGQAPVMVVYDDNDRPSGIPERFSGSNFGN<br>TATLIISRVAAGDEADYYCQVWDYRLSQVFGGG<br>TKLTVL<br>(SEQ ID NO: 9681) | EVQLLESGGGLVQPGGSLRLSCAASGFTFSSYAMS<br>WVRQAPGKGLEWVSAISGSGGGTYYAASVKGRFTI<br>SRDNSKNTLYLQMSSLRAEDTAVYYCVTGKGVHLG<br>FDYWGQGTLVTVSS<br>(SEQ ID NO: 10039) |

TABLE 57-continued scFv Variable Region Sequences

| Ab | Type | LC V-region | HC V-region |
|---|---|---|---|
| 18403-G10-AS | NA | No nuc. seq available | No nuc. seq available |
| | AA | SYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGGGTKLTVL (SEQ ID NO: 9682) | EVQLLESGGGLVQPGGSLRLSCAASGFTFSSYAMSWVRQAPGKGLEWVSAISGSGGGTYYAASVKGRFTISRDNSKNTLYLQMSSLRAEDTAVYYCATGKGVHLGFDYWGQGTLVTVSS (SEQ ID NO: 10040) |
| 02-C1-86-A4-N-F5_final | NA | No nuc. seq available | No nuc. seq available |
| | AA | DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVEIK (SEQ ID NO: 9683) | QVQLVESGGGVVQPGRSLRLSCAASGFTFSTYGMHWVRQAPGKGLEWVAVISYDAETVKYAESVKGRFTISRDNSKNTLYLQMNSLRAEDTAVYYCARGQLLTGYWGQGTLVTVSS (SEQ ID NO: 10041) |
| 03-F3-88-B3-F9_final | NA | No nuc. seq available | No nuc. seq available |
| | AA | SYVLTQPPSVSVAPGQTARITCGGNNIGSKSVHWYQQKPGQAPVLVVYDDADRPSGIPERFSGSNSGNTATLTISRVEAGDEADYYCQVWDASAGYGVVFGGGTKLTVL (SEQ ID NO: 9684) | QVQLVESGGGLVQPGGSLRLSCAASGFTFSDYYMSWIRQAPGKGLEWVSYISKSSYTVTYADAVKGRFTISRDNAKNSLYLQMNSLRAEDTAVYYCATYNYGHFDYWGQGTLVTVSS (SEQ ID NO: 10042) |
| 81-H7-SG-F28_final | NA | No nuc. seq available | No nuc. seq available |
| | AA | DIVMTQTPLSLPVTPGEPASISCRSSQSLLHRSGYNYLDWYLQKPGQSPQLLIYLGSNRASGVPDRFSGSGSGTDFTLKISRVEAGDVGVYYCMQALQTPWTFGQGTKVEIK (SEQ ID NO: 9685) | QVQLQESGPGLVKPSQTLSLTCTVSGDSISSNPYYWSWIRQHPGKGLEWIGYISYSGITNYNPSLKSRVTMSVDTSKNQFSLKLTSLTAADTAVYYCAREKMWFGVLNYYYGMDVWGQGTTVTVSS (SEQ ID NO: 10043) |
| 18081-B9_final | NA | No nuc. seq available | No nuc. seq available |
| | AA | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFYSTPITFGQGTRLEIK (SEQ ID NO: 9686) | QVQLQESGPGLVKPSETLSLTCTVSGDSISSSRYYWGWIRQPPGKGLEWIGSIYYSGSTYYNPSLKSRVTISVDTSKNQFSLKLSSVTAADTAVYYCARGIFGVITYFDYWGQGTLVTVSS (SEQ ID NO: 10044) |
| 18398-C7_final | NA | No nuc. seq available | No nuc. seq available |
| | AA | SYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGGGTKLTVL (SEQ ID NO: 9687) | EVQLLESGGGLVQPGGSLRLSCAASGFTFSSHAMSWVRQAPGKGLEWVSSISGSGGGTYYAASVKGRFTISRDNSKNTLYLQMNSLRAEDTAVYYCATGKGVHLGFDYWGQGTLVTVSS (SEQ ID NO: 10045) |
| 18403-D8_final | NA | No nuc. seq available | No nuc. seq available |
| | AA | SYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGGGTKLTVL (SEQ ID NO: 9688) | EVQLLESGGGLVQPGGSLRLSCAASGFTFSSHAMSWVRQAPGKGLEWVSTISGSGGGTYYADSVKGRFTISRDNSKNTLYLQMNSLRAEDTAVYYCATGKGVHLGFDYWGQGTLVTVSS (SEQ ID NO: 10046) |
| 18403-D8_AS_final | NA | No nuc. seq available | No nuc. seq available |
| | AA | SYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGGGTKLTVL (SEQ ID NO: 9689) | EVQLLESGGGLVQPGGSLRLSCAASGFTFSSHAMSWVRQAPGKGLEWVSTISGSGGGTYYAASVKGRFTISRDNSKNTLYLQMNSLRAEDTAVYYCATGKGVHLGFDYWGQGTLVTVSS (SEQ ID NO: 10047) |
| 18403-E11_AS_final | NA | No nuc. seq available | No nuc. seq available |
| | AA | SYVLTQPPSVSVAPGQTARITCGGNNIGSKSVHWYQQKPGQAPVMVVYDDNDRPSGIPERFSGSNSGNTATLTISRVEAGDEADYYCQVWDYYSNRAVFGGGTKLTVL (SEQ ID NO: 9690) | EVQLLESGGGLVQPGGSLRLSCAASGFTFSSHAMSWVRQAPGKGLEWVSAISGSGGGTYNAASVKGRFTISRDNSKNTLYLQMNSLRAEDTAAYYCVTGKGVHLGFDYWGQGTLVTVSS (SEQ ID NO: 10048) |
| 18403-F12_final | NA | No nuc. seq available | No nuc. seq available |
| | AA | SYVLTQPPSVSVAPGQTARITCGGNNIGSKSVHWYQQKPGQAPVMVVYDDNDRPSGIPERFSGSNFGNTATLIISRVAAGDEADYYCQVWDYRYLSQVFGGGTKLTVL (SEQ ID NO: 9691) | EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCVTGKGVHLGFDYWGQGTLVTVSS (SEQ ID NO: 10049) |

TABLE 57-continued scFv Variable Region Sequences

| Ab | Type | LC V-region | HC V-region |
|---|---|---|---|
| 18403-F12-AS_final | NA<br>AA | No nuc. seq available<br>SYVLTQPPSVSVAPGQTARITCGGNNIGSKSVHW<br>YQQKPGQAPVMVVYDDNDRPSGIPERFSGSNFGN<br>TATLIISRVAAGDEADYYCQVWDYRYLSQVFGGG<br>TKLTVL<br>(SEQ ID NO: 9692) | No nuc. seq available<br>EVQLLESGGGLVQPGGSLRLSCAASGFTFSSYAMS<br>WVRQAPGKGLEWVSAISGSGGGTYYAASVKGRFTI<br>SRDNSKNTLYLQMSSLRAEDTAVYYCVTGKGVHLG<br>FDYWGQGTLVTVSS<br>(SEQ ID NO: 10050) |
| 18403-G10_final | NA<br>AA | No nuc. seq available<br>SYVLTQPPSVSVAPGQTARITCGGNNIGSKSVHW<br>YQQKPGQAPVMVVYDDNDRPSGIPERFSGSNSGN<br>TATLTISRVEAGDEADYYCQVWDYSGQRQVFGGG<br>TKLTVL<br>(SEQ ID NO: 9693) | No nuc. seq available<br>EVQLLESGGGLVQPGGSLRLSCAASGFTFSSYAMS<br>WVRQAPGKGLEWVSAISGSGGGTYYADSVKGRFTI<br>SRDNSKNTLYLQMSSLRAEDTAVYYCATGKGVHLG<br>FDYWGQGTLVTVSS<br>(SEQ ID NO: 10051) |
| 18403-G10-AS_final | NA<br>AA | No nuc. seq available<br>SYVLTQPPSVSVAPGQTARITCGGNNIGSKSVHW<br>YQQKPGQAPVMVVYDDNDRPSGIPERFSGSNSGN<br>TATLTISRVEAGDEADYYCQVWDYSGQRQVFGGG<br>TKLTVL<br>(SEQ ID NO: 9694) | No nuc. seq available<br>EVQLLESGGGLVQPGGSLRLSCAASGFTFSSYAMS<br>WVRQAPGKGLEWVSAISGSGGGTYYAASVKGRFTI<br>SRDNSKNTLYLQMSSLRAEDTAVYYCATGKGVHLG<br>FDYWGQGTLVTVSS<br>(SEQ ID NO: 10052) |
| 18409-E2_final | NA<br>AA | No nuc. seq available<br>DIQMTQSPSSLSASVGDRVTITCRTSQSISSYLN<br>WYQQKPGRAPKLLIFAASSLQGGVPSRFSGSGSG<br>TDFTLTISSLQPEDFATYYCQQSYSSPFTFGPGT<br>KVEIK<br>(SEQ ID NO: 9695) | No nuc. seq available<br>EVQLVESGGGLVQPGGSLRLSCAASGFTFSNAWMS<br>WVRQAPGKGLEWVGRIKSKTYGGTTDYAAPVKGRF<br>TISRDDSKNTLFLQMNSLKTEDTAVYYCTTPSYSG<br>SYYNYFSVMDVWGQGTTVTVSS<br>(SEQ ID NO: 10053) |
| 18409-F12_final | NA<br>AA | No nuc. seq available<br>DIQMTQSPSSLSASVGDRVTITCQASQDISNYLN<br>WYQQKPGKAPKLLIYAASSLQSGVPSRFSGRGSG<br>TDFTLTISSLQPEDFATYYCQQSYYYPTLFGPGT<br>KVEIK<br>(SEQ ID NO: 9696) | No nuc. seq available<br>QITLKESGPALVKPTQTLTLTCTFSGFSFTTHKMG<br>VDWIRQPPGKALEWLALIYWNDDKRYSPSLQSRLT<br>ITKDTSKNQVVLTMTNMDPVDTATYYCAYRRYNWN<br>YENWFDPWGQGTLVTVSS<br>(SEQ ID NO: 10054) |
| 18409-G10_final | NA<br>AA | No nuc. seq available<br>DIQMTQSPSSLSASVGDRVTITCQASQDISNYFN<br>WYQQKPGKAPKLLIYAASSLQSGVPSRFSGSGSG<br>TDFTLTISSLQPEDFATYYCQQSYITPFTFGPGT<br>KVEIK<br>(SEQ ID NO: 9697) | No nuc. seq available<br>QITLKESGPTLVKPTQTLTLTCTFSGFSFTTHKMG<br>VDWIRQPPGKALEWLAGIHIYYDDKRYSPSLQSRLT<br>ITKDTSKNQVVLTMTNMDPVDTATYYCAYRRYNWN<br>YENWFDPWGQGTLVTVSS<br>(SEQ ID NO: 10055) |
| 18409-H7_final | NA<br>AA | No nuc. seq available<br>DIQMTQSPSSLSASVGDRVTITCQASQDISNYLN<br>WYQQKPGKAPKLLIYAASSLQSGVPSRFSGSGSG<br>TDFTLTISSLQPEDFATYYCQQSYFPVVEFGPGT<br>KVEIK<br>(SEQ ID NO: 9698) | No nuc. seq available<br>QITLKESGPALVKPTQTLTLTCTFSGFSFTTHKMG<br>VDWIRQPPGKALEWLALIYWNDDKRYSPSLQSRLT<br>ITKDTSKNQVVLTMTNMDPVDTATYYCAYRRYNWN<br>YENWFDPWGQGTLVTVSS<br>(SEQ ID NO: 10056) |
| 18409-H10_final | NA<br>AA | No nuc. seq available<br>DIQMTQPSSLSASVGDRVTITCQASQDISNYLNW<br>YQQKPGKAPKLLIYAASSLQSGVPSRFSGRGSGT<br>DFTLTISSLQPEDFATYYCQQSYTPPTTFGPGTK<br>VEIK<br>(SEQ ID NO: 9699) | No nuc. seq available<br>QITLKESGPTLVKPTQTLTLTCTFSGFSFTTHKMG<br>VDWIRQPPGKALEWLALIYWNDDKRYSPSLQSRLT<br>ITKDTSKNQVVLTMTNMDPVDTATYYCAYRRYNWN<br>YENWFDPWGQGTLVTVSS<br>(SEQ ID NO: 10057) |
| 18410-B5_final | NA<br>AA | No nuc. seq available<br>DIQMTQSPSSLSASVGDRVTITCRTSQSISSYLN<br>WYQQKPGRAPKLLIFAASSLQGGVPSRFSGSGSG<br>TDFTLTISSLQPEDFATYYCQQTYSMPFTFGGGT<br>KVEIK<br>(SEQ ID NO: 9700) | No nuc. seq available<br>EVQLVESGGGLVQPGGSLRLSCAASGFTFSNAWMS<br>WVRQAPGKGLEWVGRIRSRSYGGTTDYAAPVKGRF<br>TISRDDSKNTLFLQMNSLKTEDTAVYYCTTPSYSG<br>SYYNYFSVMDVWGQGTTVTVSS<br>(SEQ ID NO: 10058) |
| 18410-B6_final | NA<br>AA | No nuc. seq available<br>DIQMTQSPSSLSASVGDRVTITCRTSQSISSYLN<br>WYQQKPGRAPKLLIFAASSLQGGVPSRFSGSGSG<br>TDFTLTISSLQPEDFATYYCIQAYTSPFTFGPGT<br>KLEIK<br>(SEQ ID NO: 9701) | No nuc. seq available<br>EVQLVESGGGLVQPGGSLRLSCAASGFTFSNAWMS<br>WVRQAPGKGLEWVGRIKSKTYGGTTDYAAPVKGRF<br>TISRDDSKNTLYLQMNSLKTEDTAVYYCTTPSYSG<br>SYYNYFSVMDVWGQGTTVTVSS<br>(SEQ ID NO: 10059) |

TABLE 57-continued scFv Variable Region Sequences

| Ab | Type | LC V-region | HC V-region |
|---|---|---|---|
| 18410-D3_final | NA<br>AA | No nuc. seq available<br>DIQMTQSPSSLSASVGDRVTITCRTSQSISSYLN<br>WYQQKPGRAPKLLIFAASSLQGGVPSRFSGSGSG<br>TDFTLTISSLQPEDFATYYCQQTYSMPFTFGPGT<br>KVDIK<br>(SEQ ID NO: 9702) | No nuc. seq available<br>EVQLVESGGGLVQPGGSLRLSCAASGFTFSNAWMS<br>WVRQAPGKGLEWVGRITSSRYGGTTDYAAPVKGRF<br>TISRDDSKNTLFLQMNSLKTEDTAVYYCTTPSYSG<br>SYYNYFSVMDVWGQGTTVTVSS<br>(SEQ ID NO: 10060) |
| 18410-D6_final | NA<br>AA | No nuc. seq available<br>DIQMTQSPSSLSASVGDRVTITCRTSQSISSYLN<br>WYQQKPGRAPKLLIFAASSLQGGVPSRFSGSGSG<br>TDFTLTISSLQPEDFATYYCQQTYSMPFTFGPGT<br>KVDIK<br>(SEQ ID NO: 9703) | No nuc. seq available<br>EVQLVESGGGLVKPGGSLRLSCAASGFTFSNAWMS<br>WVRQAPGKGLEWVGRILNNAYGGTTDYAAPVKGRF<br>TISRDDSKNTLYLQMNSLKTEDTAVYYCTTPSYSG<br>SYYNYFSVMDVWGQGTTVTVSS<br>(SEQ ID NO: 10061) |
| 18410-G10_final | NA<br>AA | No nuc. seq available<br>SYVLTQPPSVSVAPGQTARITCGGNNIGSKSVHW<br>YQQKPGQAPVMVVYDDNDRPSGIPERFSGSNSGN<br>TATLTISRVEAGDEADYYCQVWDYVAPRHVFGGG<br>TKLTVL<br>(SEQ ID NO: 9704) | No nuc. seq available<br>EVQLLESGGGLVQPGGSLRLSCAASGFTFSSHAMS<br>WVRQAPGKGLEWVSAISGSGGGTYNADSVKGRFTI<br>SRDNSKNTLYLQMNSLRAEDTAVYYCATGKGVHLG<br>FDYWGQGTLVTVSS<br>(SEQ ID NO: 10062) |
| 18410-G10_AS_final | NA<br>AA | No nuc. seq available<br>SYVLTQPPSVSVAPGQTARITCGGNNIGSKSVHW<br>YQQKPGQAPVMVVYDDNDRPSGIPERFSGSNSGN<br>TATLTISRVEAGDEADYYCQVWDYVAPRHVFGGG<br>TKLTVL<br>(SEQ ID NO: 9705) | No nuc. seq available<br>EVQLLESGGGLVQPGGSLRLSCAASGFTFSSHAMS<br>WVRQAPGKGLEWVSAISGSGGGTYNAASVKGRFTI<br>SRDNSKNTLYLQMNSLRAEDTAVYYCATGKGVHLG<br>FDYWGQGTLVTVSS<br>(SEQ ID NO: 10063) |
| 18410-H1_final | NA<br>AA | No nuc. seq available<br>DIQMTQSPSSLSASVGDRVTITCRTSQSISSYLN<br>WYQQKPGRAPKLLIFAASSLQSGVPSRFSGSGSG<br>TDFTLTISSLQPEDFATYYCQQTYSMPFTFGPGT<br>KVDIK<br>(SEQ ID NO: 9706) | No nuc. seq available<br>EVQLVESGGGLVQPGGSLRLSCAASGFTFSNAWMS<br>WVRQAPGKGLEWVGRITSGIYGGTTDYAAPVKGRF<br>TISRDDSKNTLYLQMNSLKTEDTAVYYCTTPSYSG<br>SYYNYFSVMDVWGQGTTVTVSS<br>(SEQ ID NO: 10064) |
| 18410-H3_final | NA<br>AA | No nuc. seq available<br>DIQMTQSPSSLSASVGDRVTITCRTSQSISSYLN<br>WYQQKPGRAPKLLIFAASSLQGGVPSRFSGSGSG<br>TDFTLTISSLQPEDFATYYCQQTYSSPFTFGPGT<br>KLEIK<br>(SEQ ID NO: 9707) | No nuc. seq available<br>EVQLVESGGGLVQPGGSLRLSCAASGFTFSNAWMS<br>WVRQAPGKGLEWVGRIRSRPYGGTTDYAAPVKGRF<br>TISRDDSKNTLYLQMNSLKTEDTAVYYCTTPSYSG<br>SYYNYFSVMDVWGQGTTVTVSS<br>(SEQ ID NO: 10065) |
| 18486-A4_final | NA<br>AA | No nuc. seq available<br>DIQMTQSPSSLSASVGDRVTITCRASQGISNYLA<br>WYQQKPGKVPKLLIYAASTLQSGVPSRFSGSGSG<br>TDFTLTISSLQPEDFATYYCQKYNSAPFTFGPGT<br>KVEIK<br>(SEQ ID NO: 9708) | No nuc. seq available<br>QVQLVESGGGVVQPGRSLRLSCAASGFTFSTYGMH<br>WVRQAPGKGLEWVAVISYDASNKYYAESVKGRFTI<br>SRDNSKNTLYLQMNSLRAEDTAVYYCARGQLLTGY<br>WGQGTLVTVSS<br>(SEQ ID NO: 10066) |

TABLE 58 scFv Variable Region Protein Alignment
CDRs defined by Kabat
Alignment numbering defined by Amgen Reference (AHo)

KAPPA_VARIABLE

| | Germline | | SEQ ID NO: |
|---|---|---|---|
| | | K_FR1 | |
| VK4\|B3/JK2 | | DIVMTQSPDSLAVSLGERATINC | 10067 |
| 17724-C9 | VK4\|B3/JK2 | ELVMTQSPSSLAVSVGEKITMSC | 10068 |
| 18079-H4 | VK4\|B3/JK2 | ELVMTQSPDSLAVSLGERATINC | 10069 |
| 18079-H11 | VK4\|B3/JK2 | ELVMTQSPDSLAVSLGERATINC | 10070 |
| VK6\|A10/JK2 | | EIVLTQSPDFQSVTPKEKVTITC | 10071 |
| 17724-G6 | VK6\|A10/JK2 | ELVLTQSPAIMSASPGQKVTITC | 10072 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| VK1\|L11/JK2 |  | AIQMTQSPSSLSASVGDRVTITC | 10073 |
| 17731-H8 | VK1\|L11/JK2 | ELQMTQSPASLSASVGETVTITC | 10074 |
| VK2\|A19/JK5 |  | DIVMTQSPLSLPVTPGEPASISC | 10075 |
| 17732-A8 | VK2\|A19/JK5 | ELVMTQSPLSLPVSPGEPASISC | 10076 |
| 18081-B5 | VK2\|A19/JK5 | ELVLTQSPLSLPVTPGEPASISC | 10077 |
| VK2\|A19/JK2 |  | DIVMTQSPLSLPVTPGEPASISC | 10078 |
| 17745-E5 | VK2\|A19/JK2 | ELVMTQSPLSLPVTPGEPASISC | 10079 |
| 17778-F1 | VK2\|A19/JK2 | ELVMTQSPLSLPVTPGEPASISC | 10080 |
| 17778-H8 | VK2\|A19/JK2 | ELVLTQSPLSLPVTPGEPASISC | 10081 |
| 18088-E4 | VK2\|A19/JK2 | ELVMTQSPLSLPVIPGEPASISC | 10082 |
| 18179-C4 | VK2\|A19/JK2 | ELVMTQSPLSLPVTPGEPASISC | 10083 |
| 18179-C7 | VK2\|A19/JK2 | ELVLTQSPLSLPVTPGEPASISC | 10084 |
| 18179-F3 | VK2\|A19/JK2 | ELVLTQSPLSLPVTPGEPASISC | 10085 |
| 18181-C6 | VK2\|A19/JK2 | ELVMTQSPLSLPVTPGEPASISC | 10086 |
| VK2\|O1/JK1 |  | DIVMTQTPLSLPVTPGEPASISC | 10087 |
| 17745-E8 | VK2\|O1/JK1 | ELVMTQTPLSLPVIPGEPASISC | 10088 |
| 18179-C6 | VK2\|O1/JK1 | ELVMTQTPLSLPVTPGEPASISC | 10089 |
| 18179-F10 | VK2\|O1/JK1 | ELVMTQTPLSLPVTPGEPASISC | 10090 |
| 18179-G9 | VK2\|O1/JK1 | ELVMTQTPLSLPVTPGEPASISC | 10091 |
| 18181-H7 | VK2\|O1/JK1 | ELVMTQTPLSLPVTPGEPASISC | 10092 |
| 18181-B8 | VK2\|O1/JK1 | ELVMTQTPLSLPVTPGEPASISC | 10093 |
| 81-H7-SG-F28_final | VK2\|O1/JK1 | DIVMTQTPLSLPVTPGEPASISC | 10094 |
| VK3\|A27/JK3 |  | EIVLTQSPGTLSLSPGERATLSC | 10095 |
| 17745-G8 | VK3\|A27/JK3 | ELTLTQSPGTLSLSPGERATLSC | 10096 |
| 18080-H9 | VK3\|A27/JK3 | ELTLTQSPGTLSLSPGERATLSC | 10097 |
| VK3\|A27/JK4 |  | EIVLTQSPGTLSLSPGERATLSC | 10098 |
| 17748-D12 | VK3\|A27/JK4 | ELVLTQSPGTLSLSPGERATLSC | 10099 |
| 17777-C4 | VK3\|A27/JK4 | ELVLTQSPGTLSLSPGERATLSC | 10100 |
| 18072-D6 | VK3\|A27/JK4 | ELTLTQSPGTLSLSPGERATLSC | 10101 |
| 18084-E4 | VK3\|A27/JK4 | ELTLTQSPGTLSLSPGERATLSC | 10102 |
| 18088-B10 | VK3\|A27/JK4 | ELVLTQSPGTLSLSPGERATLSC | 10103 |
| VK2\|A19/JK3 |  | DIVMTQSPLSLPVTPGEPASISC | 10104 |
| 17753-F4 | VK2\|A19/JK3 | ELVMTQSPLSLPVTPGEPASISC | 10105 |
| 17779-E1 | VK2\|A19/JK3 | ELVLTQSPLSLPVTPGEPASISC | 10106 |
| 17780-E6 | VK2\|A19/JK3 | ELVMTQSPLSLPVTPGEPASISC | 10107 |
| 17785-D12 | VK2\|A19/JK3 | ELVMTQSPLSLPVTPGEPASISC | 10108 |
| 18179-A3 | VK2\|A19/JK3 | ELVMTQSPLSLPVTPGEPASISC | 10109 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18179-A5 | VK2\|A19/JK3 | ELVLTQSPLSLPVTPGEPASISC | 10110 |
| 18179-C10 | VK2\|A19/JK3 | ELVLTQSPLSLPVTPGEPASISC | 10111 |
| 18179-F4 | VK2\|A19/JK3 | ELVLTQSPLSLPVTPGEPASISC | 10112 |
| 18179-H9 | VK2\|A19/JK3 | ELVLTQSPLSLPVTPGEPASISC | 10113 |
| 18181-A11 | VK2\|A19/JK3 | ELVMTQSPLSLPVTPGEPASISC | 10114 |
| 18181-C9 | VK2\|A19/JK3 | ELVLTQSPLSLPVTPGEPASISC | 10115 |
| VK1\|L19/JK1 | | DIQMTQSPSSVSASVGDRVTITC | 10116 |
| 17771-D2 | VK1\|L19/JK1 | ELQMTQSPSSVSASVGDRVTITC | 10117 |
| 17784-B9 | VK1\|L19/JK1 | ELQMTQSPSSVSASVGDRVTITC | 10118 |
| VK2\|A19/JK4 | | DIVMTQSPLSLPVTPGEPASISC | 10119 |
| 17777-B4 | VK2\|A19/JK4 | ELVMTQSPLSLPVTPGEPASISC | 10120 |
| 17777-C5 | VK2\|A19/JK4 | ELVLTQSPLSLPVSPGEPASISC | 10121 |
| 17783-C11 | VK2\|A19/JK4 | ELVLTQSPLSLPVTPGEPASISC | 10122 |
| 17813-F1 | VK2\|A19/JK4 | ELVMTQSPLSLSVTPGEPASISC | 10123 |
| 18179-A9 | VK2\|A19/JK4 | ELVMTQSPLSLPVTPGEPASISC | 10124 |
| VK2\|O1/JK2 | | DIVMTQTPLSLPVTPGEPASISC | 10125 |
| 17778-C9 | VK2\|O1/JK2 | ELVMTQTPLSLPVSPGEPASISC | 10126 |
| 18179-H6 | VK2\|O1/JK2 | ELVMTQTPLSLPVTPGEPASISC | 10127 |
| VK1\|O12/JK1 | | DIQMTQSPSSLSASVGDRVTITC | 10128 |
| 17779-D11 | VK1\|O12/JK1 | ELQMTQSPSSLSASVGDRVTITC | 10129 |
| 18081-D12 | VK1\|O12/JK1 | ELVMTQSPSSLSASVGDRVTITC | 10130 |
| 18093-E2 | VK1\|O12/JK1 | ELVMTQSPSSLSASVGDRVTITC | 10131 |
| 18093-F5 | VK1\|O12/JK1 | ELVMTQSPSSLSASVGDRVTITC | 10132 |
| 18409-F12_final | VK1\|O12/JK1 | DIQMTQSPSSLSASVGDRVTITC | 10133 |
| 18409-H7_final | VK1\|O12/JK1 | DIQMTQSPSSLSASVGDRVTITC | 10134 |
| 18409-H10_final | VK1\|O12/JK1 | DIQMTQSPSSLSASVGDRVTITC | 10135 |
| VK2\|O1/JK5 | | DIVMTQTPLSLPVTPGEPASISC | 10136 |
| 17780-D12 | VK2\|O1/JK5 | ELVMTQTPLSLPVSPGEPASISC | 10137 |
| 17784-G10 | VK2\|O1/JK5 | ELVMTQTPLSLPVTPGEPASISC | 10138 |
| VK2\|A19/JK1 | | DIVMTQSPLSLPVTPGEPASISC | 10139 |
| 17781-B3 | VK2\|A19/JK1 | ELVMTQSPLSLPVTPGEPASISC | 10140 |
| 17781-H12 | VK2\|A19/JK1 | ELVMTQSPLSLPVSPGEPASISC | 10141 |
| 17784-H5 | VK2\|A19/JK1 | ELVLTQSPLSLPVTPGEPASISC | 10142 |
| 18080-C5 | VK2\|A19/JK1 | ELVLTQSPLSLPVTPGEPASISC | 10143 |
| 18179-F6 | VK2\|A19/JK1 | ELVLTQSPLSLPVTPGEPASISC | 10144 |
| 18179-G8 | VK2\|A19/JK1 | ELVMTQSPLSLPVTPGEPASISC | 10145 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18181-H10 | VK2\|A19/JK1 | ELVMTQSPLSLPVTPGEPASISC | 10146 |
| 18181-G10 | VK2\|A19/JK1 | ELVMTQSPLSLPVTPGEPASISC | 10147 |
| 18181-E2 | VK2\|A19/JK1 | ELVMTQSPLSLPVTPGEPASISC | 10148 |
| VK2\|O1/JK4 |  | DIVMTQTPLSLPVTPGEPASISC | 10149 |
| 17783-G10 | VK2\|O1/JK4 | ELVMTQTPLSLPVIPGEPASISC | 10150 |
| 17813-E3 | VK2\|O1/JK4 | ELVMTQTPLSLPVTPGEPASISC | 10151 |
| 17813-E5 | VK2\|O1/JK4 | ELVMTQTPLSLPVTPGEPASISC | 10152 |
| VK1\|A20/JK3 |  | DIQMTQSPSSLSASVGDRVTITC | 10153 |
| 17784-C7 | VK1\|A20/JK3 | ELQMTQSPSSLSASVGDRVTITC | 10154 |
| 18089-H9 | VK1\|A20/JK3 | ELQMTQSPSSLSASVGDRVTITC | 10155 |
| 18089-D12 | VK1\|A20/JK3 | ELQMTQSPSSLSASVGDRVTITC | 10156 |
| 18179-C1 | VK1\|A20/JK3 | ELVMTQSPSSLSASVGDRVTITC | 10157 |
| 02-C1-86-A4-N-F5_final | VK1\|A20/JK3 | DIQMTQSPSSLSASVGDRVTITC | 10158 |
| 18486-A4_final | VK1\|A20/JK3 | DIQMTQSPSSLSASVGDRVTITC | 10159 |
| VK2\|O1/JK3 |  | DIVMTQTPLSLPVTPGEPASISC | 10160 |
| 17784-C11 | VK2\|O1/JK3 | ELVMTQTPLSLPVTPGEPASISC | 10161 |
| VK1\|A20/JK1 |  | DIQMTQSPSSLSASVGDRVTITC | 10162 |
| 17813-D8 | VK1\|A20/JK1 | ELVMTQSPSSLSASVGDRVTITC | 10163 |
| VK2\|A18/JK5 |  | DIVMTQTPLSLSVTPGQPASISC | 10164 |
| 17814-D9 | VK2\|A18/JK5 | ELVMTQSPLSLSVTPGQPASISC | 10165 |
| VK4\|B3/JK1 |  | DIVMTQSPDSLAVSLGERATINC | 10166 |
| 18071-C4 | VK4\|B3/JK1 | ELVMTQSPDSLAVSLGERATINC | 10167 |
| 18071-D4 | VK4\|B3/JK1 | ELVMTQSPDSLAVSLGERATINC | 10168 |
| 18086-H4 | VK4\|B3/JK1 | ELVMTQSPDSLAVSLGERATINC | 10169 |
| VK1\|O18/JK1 |  | DIQMTQSPSSLSASVGDRVTITC | 10170 |
| 18074-G12 | VK1\|O18/JK1 | ELVMTQSPSSLSASVGDRVTITC | 10171 |
| VK4\|B3/JK4 |  | DIVMTQSPDSLAVSLGERATINC | 10172 |
| 18081-A6 | VK4\|B3/JK4 | ELVMTQSPDSLAVSLGERATINC | 10173 |
| 18081-C10 | VK4\|B3/JK4 | ELVMTQSPDSLAVSLGERATINC | 10174 |
| 18089-B8 | VK4\|B3/JK4 | ELVMTQSPDSLAVSLGERATINC | 10175 |
| 18081-E7 | VK4\|B3/JK4 | ELVMTQTPDSLAVSLGERATINC | 10176 |
| VK1\|O12/JK2 |  | DIQMTQSPSSLSASVGDRVTITC | 10177 |
| 18081-D6 | VK1\|O12/JK2 | ELVMTQSPSSLSASVGDRVTITC | 10178 |
| 18089-H12 | VK1\|O12/JK2 | ELQMTQSPSSLSASVGDRVTITC | 10179 |
| 18179-E6 | VK1\|O12/JK2 | ELQMTQSPSSLSASVGDRVTITC | 10180 |
| 18089-D11 | VK1\|O12/JK2 | ELVMTQSPSSLSASVGDRVTITC | 10181 |
| 18081-B6 | VK1\|O12/JK2 | ELVMTQSPSSLSASVGDRVTITC | 10182 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
| --- | --- | --- | --- |
| 18181-F1 | VK1\|O12/JK2 | ELVMTQSPSSLSASVGDRVTITC | 10183 |
| 18181-A6 | VK1\|O12/JK2 | ELVMTQSPSSLSASVGDRVTITC | 10184 |
| 18410-B6_final | VK1\|O12/JK2 | DIQMTQSPSSLSASVGDRVTITC | 10185 |
| 18410-H3_final | VK1\|O12/JK2 | DIQMTQSPSSLSASVGDRVTITC | 10186 |
| VK1\|O12/JK4 |  | DIQMTQSPSSLSASVGDRVTITC | 10187 |
| 18089-C8 | VK1\|O12/JK4 | ELQMTQSPSSLSASVGDRVTITC | 10188 |
| 18089-B2 | VK1\|O12/JK4 | ELQMTQSPSSLSASVGDRVTITC | 10189 |
| 18181-G8 | VK1\|O12/JK4 | ELVMTQSPSSLSASVGDRVTITC | 10190 |
| 18410-B5_final | VK1\|O12/JK4 | DIQMTQSPSSLSASVGDRVTITC | 10191 |
| VK1\|O12/JK3 |  | DIQMTQSPSSLSASVGDRVTITC | 10192 |
| 18089-G7 | VK1\|O12/JK3 | ELQMTQSPSSLSASVGDRVTITC | 10193 |
| 18179-B7 | VK1\|O12/JK3 | ELVMTQSPSSLSASVGDRVTITC | 10194 |
| 18179-B8 | VK1\|O12/JK3 | ELVMTQSPSSLSASVGDRVTITC | 10195 |
| 18179-D8 | VK1\|O12/JK3 | ELVMTQSPSSLSASVGDRVTITC | 10196 |
| 18179-D9 | VK1\|O12/JK3 | ELVMTQSPSSLSASVGDRVTITC | 10197 |
| 18181-G7 | VK1\|O12/JK3 | ELVMTQSPSSLSASVGDRVTITC | 10198 |
| 18089-C9 | VK1\|O12/JK3 | ELQMTQSPSSLSASVGDRVTITC | 10199 |
| 18081-F9 | VK1\|O12/JK3 | ELQMTQSPSSLSASVGDRVTITC | 10200 |
| 18081-H11 | VK1\|O12/JK3 | ELQMTQSPSSLSASVGDRVTITC | 10201 |
| 18179-E1 | VK1\|O12/JK3 | ELVMTQSPSSLSASVGDRVTITC | 10202 |
| 18179-H7 | VK1\|O12/JK3 | ELQMTQSPSSLSASVGDRVTITC | 10203 |
| 18179-B12 | VK1\|O12/JK3 | ELVMTQSPSSLSASVGDRVTITC | 10204 |
| 18179-D11 | VK1\|O12/JK3 | ELQMTQSPSSLSASVGDRVTITC | 10205 |
| 18179-D7 | VK1\|O12/JK3 | ELVMTQSPSSLSASVGDRVTITC | 10206 |
| 18179-A7 | VK1\|O12/JK3 | ELVMTQSPSSLSASVGDRVTITC | 10207 |
| 18181-F3 | VK1\|O12/JK3 | ELVMTQSPSSLSASVGDRVTITC | 10208 |
| 18409-E2_final | VK1\|O12/JK3 | DIQMTQSPSSLSASVGDRVTITC | 10209 |
| 18409-G10_final | VK1\|O12/JK3 | DIQMTQSPSSLSASVGDRVTITC | 10210 |
| 18410-D3_final | VK1\|O12/JK3 | DIQMTQSPSSLSASVGDRVTITC | 10211 |
| 18410-D6_final | VK1\|O12/JK3 | DIQMTQSPSSLSASVGDRVTITC | 10212 |
| 18410-H1_final | VK1\|O12/JK3 | DIQMTQSPSSLSASVGDRVTITC | 10213 |
| VK1\|L19/JK4 |  | DIQMTQSPSSVSASVGDRVTITC | 10214 |
| 18089-G11 | VK1\|L19/JK4 | ELQMTQSPSSVSASVGDRVTITC | 10215 |
| VK3\|A27/JK1 |  | EIVLTQSPGTLSLSPGERATLSC | 10216 |
| 18179-A10 | VK3\|A27/JK1 | ELVLTQSPGTLSLSPGERATLSC | 10217 |
| VK1\|A20/JK2 |  | DIQMTQSPSSLSASVGDRVTITC | 10218 |

TABLE 58-continued scFv Variable Region Protein Alignment
CDRs defined by Kabat
Alignment numbering defined by Amgen Reference (AHo)

KAPPA_VARIABLE

| | Germline | | SEQ ID NO: |
|---|---|---|---|
| 18179-G12 | VK1\|A20/JK2 | ELVMTQSPSSLSASVGDRVTITC | 10219 |
| VK4\|B3/JK5 | | DIVMTQSPDSLAVSLGERATINC | 10220 |
| 18081-B9 | VK4\|B3/JK5 | ELVMTQSPDSLAVSLGERATINC | 10221 |
| 18081-B9_final | VK4\|B3/JK5 | DIVMTQSPDSLAVSLGERATINC | 10222 |
| VK1\|O12/JK5 | | DIQMTQSPSSLSASVGDRVTITC | 10223 |
| 18089-D8 | VK1\|O12/JK5 | ELVMTQSPDSLSASVGDRVTITC | 10224 |

| | | K_CDR1 | |
|---|---|---|---|
| VK4\|B3/JK2 | | KSS--QSVLYSSNNKNYLA | 10525 |
| 17724-C9 | VK4\|B3/JK2 | KSS--QSLLYSSNQKNYLA | 10526 |
| 18079-H4 | VK4\|B3/JK2 | KSS--QSVLYSSNNKNYLA | 10527 |
| 18079-H11 | VK4\|B3/JK2 | KSS--QSVLYSSNNKNYLA | 10528 |
| VK6\|A10/JK2 | | RAS--QSIG------SSLH | 10529 |
| 17724-G6 | VK6\|A10/JK2 | SAS--SNVN-------YIH | 10530 |
| VK1\|L11/JK2 | | RAS--QGIR------NDLG | 10531 |
| 17731-H8 | VK1\|L11/JK2 | RAS--GNIH------NYLA | 10532 |
| VK2\|A19/JK5 | | RSS--QSLLHSN-GYNYLD | 10533 |
| 17732-A8 | VK2\|A19/JK5 | RSS--QSLLYSN-GYNYVD | 10534 |
| 18081-B5 | VK2\|A19/JK5 | RSS--QSLLHRN-GYNYLD | 10535 |
| VK2\|A19/JK2 | | RSS--QSLLHSN-GYNYLD | 10536 |
| 17745-E5 | VK2\|A19/JK2 | RSS--QSLLYSN-GYHYLD | 10537 |
| 17778-F1 | VK2\|A19/JK2 | RSS--QRLLFSN-GYHYLD | 10538 |
| 17778-H8 | VK2\|A19/JK2 | RSS--QSLLYSN-GYNYLD | 10539 |
| 18088-E4 | VK2\|A19/JK2 | RSS--QSLLYSN-GYNYLD | 10540 |
| 18179-C4 | sVK2\|A19/JK2 | RSS--QSLLHST-GYNYLD | 10541 |
| 18179-C7 | VK2\|A19/JK2 | RSS--QSLLHRN-GYHYLD | 10542 |
| 18179-F3 | VK2\|A19/JK2 | RSS--QSLLHRN-GYNYLD | 10543 |
| 18181-C6 | VK2\|A19/JK2 | RSS--QSLLHST-GYNYLD | 10544 |
| VK2\|O1/JK1 | | RSS--QSLLDSDDGNTYLD | 10545 |
| 17745-E8 | VK2\|O1/JK1 | RSS--QSLLYSN-GYNYLD | 10546 |
| 18179-C6 | VK2\|O1/JK1 | RSS--QSLLHRN-GYNYLD | 10547 |
| 18179-F10 | VK2\|O1/JK1 | RSS--QSLLHSN-GYNYLD | 10548 |
| 18179-G9 | VK2\|O1/JK1 | RSS--QSLLHRN-GYNYLD | 10549 |
| 18181-H7 | VK2\|O1/JK1 | RSS--QSLLHRN-GYNYLD | 10550 |
| 18181-B8 | VK2\|O1/JK1 | RSS--QSLLHRN-GYNYLD | 10551 |
| 81-H7-SG-F28_final | VK2\|O1/JK1 | RSS--QSLLHRS-GYNYLD | 10552 |
| | VK3\|A27/JK3 | RAS--QSVSS-----SYLA | 10553 |
| 17745-G8 | VK3\|A27/JK3 | RAS--QSVSS-----SYLA | 10554 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18080-H9 | VK3|A27/JK3 | RAS--QSVSS-----GYLA | 10555 |
| VK3|A27/JK4 | | RAS--QSVSS-----SYLA | 10556 |
| 17748-D12 | VK3|A27/JK4 | RAS--QSVSS-----SYLA | 10557 |
| 17777-C4 | VK3|A27/JK4 | RAS--QSVSS-----SYLA | 10558 |
| 18072-D6 | VK3|A27/JK4 | RAS--QSVSS-----SYLA | 10559 |
| 18084-E4 | VK3|A27/JK4 | RAS--QSVSS-----SYLA | 10560 |
| 18088-B10 | VK3|A27/JK4 | RAS--QSVSS-----SYLA | 10561 |
| VK2|A19/JK3 | | RSS--QSLLHSN-GYNYLD | 10562 |
| 17753-F4 | VK2|A19/JK3 | RSS--QSLLYSN-GYNYLD | 10563 |
| 17779-E1 | VK2|A19/JK3 | RSS--QSLLYSN-GYHYLD | 10564 |
| 17780-E6 | VK2|A19/JK3 | RSS--QSLLYSN-GYNYLD | 10565 |
| 17785-D12 | VK2|A19/JK3 | RSS--QSLLYSN-GYNYLD | 10566 |
| 18179-A3 | VK2|A19/JK3 | RSS--QSLLHRN-GYNYLD | 10567 |
| 18179-A5 | VK2|A19/JK3 | RSS--QSLLHSN-GYNYLD | 10568 |
| 18179-C10 | VK2|A19/JK3 | RSS--QSLLHRN-GYNYLD | 10569 |
| 18179-F4 | VK2|A19/JK3 | RSS--QSLLHRN-GYHYLD | 10570 |
| 18179-H9 | VK2|A19/JK3 | RSS--QSLLHRN-GYHYLD | 10571 |
| 18181-A11 | VK2|A19/JK3 | RSS--QSLLHRN-GYNYLD | 10572 |
| 18181-C9 | VK2|A19/JK3 | RSS--QSLLHRN-GYNYLD | 10573 |
| VK1|L19/JK1 | | RAS--QGIS------SWLA | 10574 |
| 17771-D2 | VK1|L19/JK1 | RAS--QGIS------SWLA | 10575 |
| 17784-B9 | VK1|L19/JK1 | RAS--QSIS------SYLN | 10576 |
| VK2|A19/JK4 | | RSS--QSLLHSN-GYNYLD | 10577 |
| 17777-B4 | VK2|A19/JK4 | RSS--QSLLYSN-GYNYLD | 10578 |
| 17777-C5 | VK2|A19/JK4 | RSS--QSLLYSN-GYNYVD | 10579 |
| 17783-C11 | VK2|A19/JK4 | RSS--QSLLYSN-GYNYLD | 10580 |
| 17813-F1 | VK2|A19/JK4 | RSS--RSLLHSN-GYNYLD | 10581 |
| 18179-A9 | VK2|A19/JK4 | RSS--QSLLHSN-GYNYVD | 10582 |
| VK2|O1/JK2 | | RSS--QSLLDSDDGNTYLD | 10583 |
| 17778-C9 | VK2|O1/JK2 | RSS--QSLLYSN-GYNYVD | 10584 |
| 18179-H6 | VK2|O1/JK2 | RSS--QSLLHRN-GYNYLD | 10585 |
| VK1|O12/JK1 | | RAS--QSIS------SYLN | 10586 |
| 17779-D11 | VK1|O12/JK1 | RAS--QSIS------SYLN | 10587 |
| 18081-D12 | VK1|O12/JK1 | RAS--QSIS------SYLN | 10588 |
| 18093-E2 | VK1|O12/JK1 | QAS--QDIS------NYLN | 10589 |
| 18093-F5 | VK1|O12/JK1 | RAS--QSIS------SYLN | 10590 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18409-F12_final | VK1\|O12/JK1 | QAS--QDIS------NYLN | 10591 |
| 18409-H7_final | VK1\|O12/JK1 | QAS--QDIS------NYLN | 10592 |
| 18409-H10_final | VK1\|O12/JK1 | QAS--QDIS------NYLN | 10593 |
| VK2\|O1/JK5 |  | RSS--QSLLDSDDGNTYLD | 10594 |
| 17780-D12 | VK2\|O1/JK5 | RSS--QSLLYSN-GYNYLD | 10595 |
| 17784-G10 | VK2\|O1/JK5 | RSS--QSLLHSN-GYNYLD | 10596 |
| VK2\|A19/JK1 |  | RSS--QSLLHSN-GYNYLD | 10597 |
| 17781-B3 | VK2\|A19/JK1 | RSS--QSLLYSN-GYNYLD | 10598 |
| 17781-H12 | VK2\|A19/JK1 | RSS--QSLLYSN-GYNYVD | 10599 |
| 17784-H5 | VK2\|A19/JK1 | RSS--QSLLFSN-GYYYLD | 10600 |
| 18080-C5 | VK2\|A19/JK1 | RSS--QSLLHSN-GYNYLD | 10601 |
| 18179-F6 | VK2\|A19/JK1 | RSS--QSLLHSN-GYNYLD | 10602 |
| 18179-G8 | VK2\|A19/JK1 | RSS--QSLLHRN-GYNYLD | 10603 |
| 18181-H10 | VK2\|A19/JK1 | RSS--QSLLHSN-GYNYLD | 10604 |
| 18181-G10 | VK2\|A19/JK1 | RSS--QSLLHST-GYNYVD | 10605 |
| 18181-E2 | VK2\|A19/JK1 | RSS--QSLLHSS-GYNYLD | 10606 |
| VK2\|O1/JK4 |  | RSS--QSLLDSDDGNTYLD | 10607 |
| 17783-G10 | VK2\|O1/JK4 | RSS--QSLLFSN-GYNYLD | 10608 |
| 17813-E3 | VK2\|O1/JK4 | RSS--QSLLYSN-GYNYLD | 10609 |
| 17813-E5 | VK2\|O1/JK4 | RSS--QSLLYSN-GYNYLD | 10610 |
| VK1\|A20/JK3 |  | RAS--QGIS------NYLA | 10611 |
| 17784-C7 | VK1\|A20/JK3 | RAS--QGIS------NYLA | 10612 |
| 18089-H9 | VK1\|A20/JK3 | RAS--QGIS------NYLA | 10613 |
| 18089-D12 | VK1\|A20/JK3 | RAS--QGIS------NYLA | 10614 |
| 18179-C1 | VK1\|A20/JK3 | RAS--QGIS------NYLA | 10615 |
| 02-C1-86-A4-N-F5_final | VK1\|A20/JK3 | RAS--QGIS------NYLA | 10616 |
| 18486-A4_final | VK1\|A20/JK3 | RAS--QGIS------NYLA | 10617 |
| VK2\|O1/JK3 |  | RSS--QSLLDSDDGNTYLD | 10618 |
| 17784-C11 | VK2\|O1/JK3 | RSS--QSLLYSN-GYNYLD | 10619 |
| VK1\|A20/JK1 |  | RAS--QGIS------NYLA | 10620 |
| 17813-D8 | VK1\|A20/JK1 | RAS--QGIS------NYLA | 10621 |
| VK2\|A18/JK5 |  | KSS--QSLLHSD-GKTYLY | 10622 |
| 17814-D9 | VK2\|A18/JK5 | KSS--QSLLYSN-GYNYLD | 10623 |
| VK4\|B3/JK1 |  | KSS--QSVLYSSNNKNYLA | 10624 |
| 18071-C4 | VK4\|B3/JK1 | KSS--QSVLYSSNNKNYLA | 10625 |
| 18071-D4 | VK4\|B3/JK1 | KSS--QSVLYSSNNKNYLA | 10626 |
| 18086-H4 | VK4\|B3/JK1 | KSS--QSVLYSSNNKNYLA | 10627 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| VK1\|O18/JK1 | | QAS--QDIS------NYLN | 10628 |
| 18074-G12 | VK1\|O18/JK1 | QAS--QDIS------NYLN | 10629 |
| VK4\|B3/JK4 | | KSS--QSVLYSSNNKNYLA | 10630 |
| 18081-A6 | VK4\|B3/JK4 | KSS--QSVLYSSNNKNYLA | 10631 |
| 18081-C10 | VK4\|B3/JK4 | KSS--QSVLYSSNNKNYLA | 10632 |
| 18089-B8 | VK4\|B3/JK4 | KSS--QSVLYSSNNKNYLA | 10633 |
| 18081-E7 | VK4\|B3/JK4 | KSS--QSVLYSSNNKNYLA | 10634 |
| VK1\|O12/JK2 | | RAS--QSIS------SYLN | 10635 |
| 18081-D6 | VK1\|O12/JK2 | RAS--QSIS------SYLN | 10636 |
| 18089-H12 | VK1\|O12/JK2 | RAS--QSIS------SYLN | 10637 |
| 18179-E6 | VK1\|O12/JK2 | RTS--QSIS------SYLN | 10638 |
| 18089-D11 | VK1\|O12/JK2 | RAS--QSIS------NYFN | 10639 |
| 18081-B6 | VK1\|O12/JK2 | RAS--QSIS------SYLN | 10640 |
| 18181-F1 | VK1\|O12/JK2 | RTS--QSIS------SYLN | 10641 |
| 18181-A6 | VK1\|O12/JK2 | RAS--QSIS------SYLN | 10642 |
| 18410-B6_final | VK1\|O12/JK2 | RTS--QSIS------SYLN | 10643 |
| 18410-H3_final | VK1\|O12/JK2 | RTS--QSIS------SYLN | 10644 |
| VK1\|O12/JK4 | | RAS--QSIS------SYLN | 10645 |
| 18089-C8 | VK1\|O12/JK4 | RAS--QSIS------SYLN | 10646 |
| 18089-B2 | VK1\|O12/JK4 | QAS--QDIS------NYLN | 10647 |
| 18181-G8 | VK1\|O12/JK4 | RTS--QSIS------SYLN | 10648 |
| 18410-B5_final | VK1\|O12/JK4 | RTS--QSIS------SYLN | 10649 |
| VK1\|O12/JK3 | | RAS--QSIS------SYLN | 10650 |
| 18089-G7 | VK1\|O12/JK3 | RAS--QSIS------SYLN | 10651 |
| 18179-B7 | VK1\|O12/JK3 | QAR--QDIS------DYLN | 10652 |
| 18179-B8 | VK1\|O12/JK3 | RTS--QSIN------SYLN | 10653 |
| 18179-D8 | VK1\|O12/JK3 | RTS--QSIS------SYLN | 10654 |
| 18179-D9 | VK1\|O12/JK3 | RTS--QSIN------SYLN | 10655 |
| 18181-G7 | VK1\|O12/JK3 | RTS--QSIS------SYLN | 10656 |
| 18089-C9 | VK1\|O12/JK3 | RAS--QFIS------SYLN | 10657 |
| 18081-F9 | VK1\|O12/JK3 | RAS--QSIS------SYLN | 10658 |
| 18081-H11 | VK1\|O12/JK3 | QAS--QDIS------NYLN | 10659 |
| 18179-E1 | VK1\|O12/JK3 | RTS--QSIS------SYLN | 10660 |
| 18179-H7 | VK1\|O12/JK3 | RTS--QSIS------SYLN | 10661 |
| 18179-B12 | VK1\|O12/JK3 | RTS--QSIS------SYLN | 10662 |
| 18179-D11 | VK1\|O12/JK3 | RTS--QSIS------SYLN | 10663 |

TABLE 58-continued scFv Variable Region Protein Alignment
CDRs defined by Kabat
Alignment numbering defined by Amgen Reference (AHo)

KAPPA_VARIABLE

| | Germline | | SEQ ID NO: |
|---|---|---|---|
| 18179-D7 | VK1\|O12/JK3 | RTS--QSIS------SYLN | 10664 |
| 18179-A7 | VK1\|O12/JK3 | RTS--QSIS------SYLN | 10665 |
| 18181-F3 | VK1\|O12/JK3 | RTS--QSIS------SYLN | 10666 |
| 18409-E2_final | VK1\|O12/JK3 | RTS--QSIS------SYLN | 10667 |
| 18409-G10_final | VK1\|O12/JK3 | QAS--QDIS------NYEN | 10668 |
| 18410-D3_final | VK1\|O12/JK3 | RTS--QSIS------SYLN | 10669 |
| 18410-D6_final | VK1\|O12/JK3 | RTS--QSIS------SYLN | 10670 |
| 18410-H1_final | VK1\|O12/JK3 | RTS--QSIS------SYLN | 10671 |
| VK1\|L19/JK4 | | RAS--QGIS------SWLA | 10672 |
| 18089-G11 | VK1\|L19/JK4 | QAS--QDIS------NYLN | 10673 |
| VK3\|A27/JK1 | | RAS--QSVSS-----SYLA | 10674 |
| 18179-A10 | VK3\|A27/JK1 | RSS--QSLLHRN-GYNYLD | 10675 |
| VK1\|A20/JK2 | | RAS--QGIS------NYLA | 10676 |
| 18179-G12 | VK1\|A20/JK2 | RAS--QGIS------NYLA | 10677 |
| VK4\|B3/JK5 | | KSS--QSVLYSSNNKNYLA | 10678 |
| 18081-B9 | VK4\|B3/JK5 | KSS--QSVLYSSNNKNYLA | 10679 |
| 18081-B9_final | VK4\|B3/JK5 | KSS--QSVLYSSNNKNYLA | 10680 |
| VK1\|O12/JK5 | | RAS--QSIS------SYLN | 10681 |
| 18089-D8 | VK1\|O12/JK5 | RAS--QSIS------SYLN | 10682 |
| | K FR2 | | |
| VK4\|B3/JK2 | | WYQQKPGQPPKLLIY | 10983 |
| 17724-C9 | VK4\|B3/JK2 | WYQQKPGQSPKLLIY | 10984 |
| 18079-H4 | VK4\|B3/JK2 | WYQQKPGQPPKLLIY | 10985 |
| 18079-H11 | VK4\|B3/JK2 | WYQQKPGQPPKLLIY | 10986 |
| VK6\|A10/JK2 | | WYQQKPDQSPKLLIK | 10987 |
| 17724-G6 | VK6\|A10/JK2 | WYQQKLGSSPKIWIY | 10988 |
| VK1\|L11/JK2 | | WYQQKPGKAPKLLIY | 10989 |
| 17731-H8 | VK1\|L11/JK2 | WYQQKQGKSPQLLVY | 10990 |
| VK2\|A19/JK5 | | WYLQKPGQSPQLLIY | 10991 |
| 17732-A8 | VK2\|A19/JK5 | WYLQKPGQSPQLLIY | 10992 |
| 18081-B5 | VK2\|A19/JK5 | WYLQKPGQSPQLLIY | 10993 |
| VK2\|A19/JK2 | | WYLQKPGQSPQLLIY | 10994 |
| 17745-E5 | VK2\|A19/JK2 | WYLQKPGQSPQLLIY | 10995 |
| 17778-F1 | VK2\|A19/JK2 | WYLQKPGQSPQLLIY | 10996 |
| 17778-H8 | VK2\|A19/JK2 | WYLQKPGQSPQLLIY | 10997 |
| 18088-E4 | VK2\|A19/JK2 | WYLQKPGQSPQLLIY | 10998 |
| 18179-C4 | VK2\|A19/JK2 | WYLQKPGQSPQLLIY | 10999 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18179-C7 | VK2\|A19/JK2 | WYLQKPGQSPQLLIY | 11000 |
| 18179-F3 | VK2\|A19/JK2 | WYLQKPGQSPQLLIY | 11001 |
| 18181-C6 | VK2\|A19/JK2 | WYLQKPGQSPQLLIY | 11002 |
| VK2\|O1/JK1 |  | WYLQKPGQSPQLLIY | 11003 |
| 17745-E8 | VK2\|O1/JK1 | WYLQKPGQSPQLLIY | 11004 |
| 18179-C6 | VK2\|O1/JK1 | WYLHKPGQSPQLLIY | 11005 |
| 18179-F10 | VK2\|O1/JK1 | WYLQKPGQSPQLLIY | 11006 |
| 18179-G9 | VK2\|O1/JK1 | WYLQKPGQSPQLLIY | 11007 |
| 18181-H7 | VK2\|O1/JK1 | WYLQKPGQSPQLLIY | 11008 |
| 18181-B8 | VK2\|O1/JK1 | WYLQKPGQSPQLLIY | 11009 |
| 81-H7-SG-F28_final | VK2\|O1/JK1 | WYLQKPGQSPQLLIY | 11010 |
|  | VK3\|A27/JK3 | WYQQKPGQAPRLLIY | 11011 |
| 17745-G8 | VK3\|A27/JK3 | WYQQKPGQAPRLLIY | 11012 |
| 18080-H9 | VK3\|A27/JK3 | WYQQKPGQAPRLLIY | 11013 |
| VK3\|A27/JK4 |  | WYQQKPGQAPRLLIY | 11014 |
| 17748-D12 | VK3\|A27/JK4 | WYQQKPGQAPRLLIY | 11015 |
| 17777-C4 | VK3\|A27/JK4 | WYQQKPGQAPRLLIY | 11016 |
| 18072-D6 | VK3\|A27/JK4 | WYQQKPGQAPRLLIY | 11017 |
| 18084-E4 | VK3\|A27/JK4 | WYQQKPGQAPRLLIY | 11018 |
| 18088-B10 | VK3\|A27/JK4 | WYQQKPGQAPRLLIY | 11019 |
| VK2\|A19/JK3 |  | WYLQKPGQSPQLLIY | 11020 |
| 17753-F4 | VK2\|A19/JK3 | WYLQKPGQSPQLLIY | 11021 |
| 17779-E1 | VK2\|A19/JK3 | WYLQKPGQSPQLLIF | 11022 |
| 17780-E6 | VK2\|A19/JK3 | WYLQKPGQSPQLLIY | 11023 |
| 17785-D12 | VK2\|A19/JK3 | WYLQKPGQSPQLLIY | 11024 |
| 18179-A3 | VK2\|A19/JK3 | WYLQKPGQSPQLLIY | 11025 |
| 18179-A5 | VK2\|A19/JK3 | WYLQKPGQSPQLLIY | 11026 |
| 18179-C10 | VK2\|A19/JK3 | WYLQKPGQSPQLLIY | 11027 |
| 18179-F4 | VK2\|A19/JK3 | WYLQKPGQSPQLLIY | 11028 |
| 18179-H9 | VK2\|A19/JK3 | WYLQKPGQSPQLLIY | 11029 |
| 18181-A11 | VK2\|A19/JK3 | WYLQKPGQSPQLLIY | 11030 |
| 18181-C9 | VK2\|A19/JK3 | WYLQKPGQSPQLLIY | 11031 |
| VK1\|L19/JK1 |  | WYQQKPGKAPKLLIY | 11032 |
| 17771-D2 | VK1\|L19/JK1 | WYQQKPGKAPKLLIY | 11033 |
| 17784-B9 | VK1\|L19/JK1 | WYQQKPGKAPKLLIY | 11034 |
| VK2\|A19/JK4 |  | WYLQKPGQSPQLLIY | 11035 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 17777-B4 | VK2\|A19/JK4 | WYLQKPGQSPQLLIY | 11036 |
| 17777-C5 | VK2\|A19/JK4 | WYLQKPGQSPQLLIY | 11037 |
| 17783-C11 | VK2\|A19/JK4 | WYLQKPGQSPHLLIY | 11038 |
| 17813-F1 | VK2\|A19/JK4 | WYLQKPGQSPQLLIY | 11039 |
| 18179-A9 | VK2\|A19/JK4 | WYLQKPGQSPQLLIY | 11040 |
| VK2\|O1/JK2 |  | WYLQKPGQSPQLLIY | 11041 |
| 17778-C9 | VK2\|O1/JK2 | WYLQKPGQSPQLLIY | 11042 |
| 18179-H6 | VK2\|O1/JK2 | WYLQKPGQSPQLLIY | 11043 |
| VK1\|O12/JK1 |  | WYQQKPGKAPKLLIY | 11044 |
| 17779-D11 | VK1\|O12/JK1 | WYQQKPGKAPKLLIY | 11045 |
| 18081-D12 | VK1\|O12/JK1 | WYQQKPGKAPKLLIY | 11046 |
| 18093-E2 | VK1\|O12/JK1 | WYQQKPGKAPKLLIY | 11047 |
| 18093-F5 | VK1\|O12/JK1 | WYQQKPGKAPKLLIY | 11048 |
| 18409-F12_final | VK1\|O12/JK1 | WYQQKPGKAPKLLIY | 11049 |
| 18409-H7_final | VK1\|O12/JK1 | WYQQKPGKAPKLLIY | 11050 |
| 18409-H10_final | VK1\|O12/JK1 | WYQQKPGKAPKLLIY | 11051 |
| VK2\|O1/JK5 |  | WYLQKPGQSPQLLIY | 11052 |
| 17780-D12 | VK2\|O1/JK5 | WYLQKPGQSPQLLIY | 11053 |
| 17784-G10 | VK2\|O1/JK5 | WYLQKPGQSPQLLIY | 11054 |
| VK2\|A19/JK1 |  | WYLQKPGQSPQLLIY | 11055 |
| 17781-B3 | VK2\|A19/JK1 | WYLQKPGQSPQLLIY | 11056 |
| 17781-H12 | VK2\|A19/JK1 | WYLQKPGQSPQLLIY | 11057 |
| 17784-H5 | VK2\|A19/JK1 | WYLQKPGQSPQLLIY | 11058 |
| 18080-C5 | sVK2\|A19/JK1 | WYLQKPGQSPQLLIY | 11059 |
| 18179-F6 | VK2\|A19/JK1 | WYLQKPGQSPQLLIY | 11060 |
| 18179-G8 | VK2\|A19/JK1 | WYLHKPGQSPQLLIY | 11061 |
| 18181-H10 | VK2\|A19/JK1 | WYLQKPGQSPQLLIY | 11062 |
| 18181-G10 | VK2\|A19/JK1 | WYLQKPGQSPQLLIY | 11063 |
| 18181-E2 | VK2\|A19/JK1 | WYLQKPGQSPQLLIY | 11064 |
| VK2\|O1/JK4 |  | WYLQKPGQSPQLLIY | 11065 |
| 17783-G10 | VK2\|O1/JK4 | WYLQKPGQSPQLLIY | 11066 |
| 17813-E3 | VK2\|O1/JK4 | WYLQKPGQSPQLLIY | 11067 |
| 17813-E5 | VK2\|O1/JK4 | WYLQKPGQSPQLLIY | 11068 |
| VK1\|A20/JK3 |  | WYQQKPGKVPKLLIY | 11069 |
| 17784-C7 | VK1\|A20/JK3 | WYQQKPGKVPKLLIY | 11070 |
| 18089-H9 | VK1\|A20/JK3 | WYQQKPGKVPNLLIY | 11071 |
| 18089-D12 | VK1\|A20/JK3 | WYQQKPGKVPKLLIY | 11072 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18179-C1 | VK1\|A20/JK3 | WYQQKPGKVPKLLIS | 11073 |
| 02-C1-86-A4-N-F5_final | VK1\|A20/JK3 | WYQQKPGKVPKLLIY | 11074 |
| 18486-A4_final | VK1\|A20/JK3 | WYQQKPGKVPKLLIY | 11075 |
| VK2\|O1/JK3 | | WYLQKPGQSPQLLIY | 11076 |
| 17784-C11 | VK2\|O1/JK3 | WYLQKPGQSPQLLIY | 11077 |
| VK1\|A20/JK1 | | WYQQKPGKVPKLLIY | 11078 |
| 17813-D8 | VK1\|A20/JK1 | WYQQKPGKVPKLLIY | 11079 |
| VK2\|A18/JK5 | | WYLQKPGQSPQLLIY | 11080 |
| 17814-D9 | VK2\|A18/JK5 | WYLQKPGQSPQLLIY | 11081 |
| VK4\|B3/JK1 | | WYQQKPGQPPKLLIY | 11082 |
| 18071-C4 | VK4\|B3/JK1 | WYQQKPGQPPKLLIY | 11083 |
| 18071-D4 | VK4\|B3/JK1 | WYQQKPGQPPKLLIY | 11084 |
| 18086-H4 | VK4\|B3/JK1 | WYQQKPGQPPKLLIY | 11085 |
| VK1\|O18/JK1 | | WYQQKPGKAPKLLIY | 11086 |
| 18074-G12 | VK1\|O18/JK1 | WYQQKPGKAPKLLIY | 11087 |
| VK4\|B3/JK4 | | WYQQKPGQPPKLLIY | 11088 |
| 18081-A6 | VK4\|B3/JK4 | WYQQKPGQPPKLLIY | 11089 |
| 18081-C10 | VK4\|B3/JK4 | WYQQKPGQPPKLLIY | 11090 |
| 18089-B8 | VK4\|B3/JK4 | WYQQKPGQPPKLLIY | 11091 |
| 18081-E7 | VK4\|B3/JK4 | WYQQKPGQPPKLLIY | 11092 |
| VK1\|O12/JK2 | | WYQQKPGKAPKLLIY | 11093 |
| 18081-D6 | VK1\|O12/JK2 | WYQQKPGKAPKLLIY | 11094 |
| 18089-H12 | VK1\|O12/JK2 | WYQQKPGKAPKLLIY | 11095 |
| 18179-E6 | VK1\|O12/JK2 | WYQQKPGRAPKLLIE | 11096 |
| 18089-D11 | VK1\|O12/JK2 | WYQQKPGKAPKLLIY | 11097 |
| 18081-B6 | VK1\|O12/JK2 | WYQQKPGKAPKLLIY | 11098 |
| 18181-F1 | VK1\|O12/JK2 | WYQQKPGRAPKLLIF | 11099 |
| 18181-A6 | VK1\|O12/JK2 | WYQQKPGRAPKLLIF | 11100 |
| 18410-B6_final | VK1\|O12/JK2 | WYQQKPGRAPKLLIF | 11101 |
| 18410-H3_final | VK1\|O12/JK2 | WYQQKPGRAPKLLIF | 11102 |
| VK1\|O12/JK4 | | WYQQKPGKAPKLLIY | 11103 |
| 18089-C8 | VK1\|O12/JK4 | WYQQKPGKAPKLLIY | 11104 |
| 18089-B2 | VK1\|O12/JK4 | WYQQKPGKAPKLLIY | 11105 |
| 18181-G8 | VK1\|O12/JK4 | WYQQKPGKAPKLLIY | 11106 |
| 18410-B5_final | VK1\|O12/JK4 | WYQQKPGRAPKLLIF | 11107 |
| VK1\|O12/JK3 | | WYQQKPGKAPKLLIY | 11108 |

TABLE 58-continued scFv Variable Region Protein Alignment
CDRs defined by Kabat
Alignment numbering defined by Amgen Reference (AHo)

KAPPA_VARIABLE

|  | Germline |  | SEQ ID NO: |
|---|---|---|---|
| 18089-G7 | VK1\|O12/JK3 | WYQQKPGKAPKLLIY | 11109 |
| 18179-B7 | VK1\|O12/JK3 | WFQQKPGRAPKLLIF | 11110 |
| 18179-B8 | VK1\|O12/JK3 | WFQQKPGKAPKLLIY | 11111 |
| 18179-D8 | VK1\|O12/JK3 | WYQQKPGRAPKLLIF | 11112 |
| 18179-D9 | VK1\|O12/JK3 | WFQQKPGKAPKLLIF | 11113 |
| 18181-G7 | VK1\|O12/JK3 | WYQQKPGRAPKLLIF | 11114 |
| 18089-C9 | VK1\|O12/JK3 | WYQQKPGKAPKLLIY | 11115 |
| 18081-F9 | VK1\|O12/JK3 | WYQQKPGKAPKLLIY | 11116 |
| 18081-H11 | VK1\|O12/JK3 | WYQQKPGKAPKLLIY | 11117 |
| 18179-E1 | VK1\|O12/JK3 | WYQQKPGRAPKLLIF | 11118 |
| 18179-H7 | VK1\|O12/JK3 | WFQQKPGKAPKLLIF | 11119 |
| 18179-B12 | VK1\|O12/JK3 | WFQQKPGKAPKLLIF | 11120 |
| 18179-D11 | VK1\|O12/JK3 | WYQQKPGRAPKLLIF | 11121 |
| 18179-D7 | VK1\|O12/JK3 | WYQQKPGRAPKLLIF | 11122 |
| 18179-A7 | VK1\|O12/JK3 | WYQQKPGRAPKLLIF | 11123 |
| 18181-F3 | VK1\|O12/JK3 | WYQQKPGRAPKLLIF | 11124 |
| 18409-E2_final | VK1\|O12/JK3 | WYQQKPGRAPKLLIF | 11125 |
| 18409-G10_final | VK1\|O12/JK3 | WYQQKPGKAPKLLIY | 11126 |
| 18410-D3_final | VK1\|O12/JK3 | WYQQKPGRAPKLLIF | 11127 |
| 18410-D6_final | VK1\|O12/JK3 | WYQQKPGRAPKLLIF | 11128 |
| 18410-H1_final | VK1\|O12/JK3 | WYQQKPGRAPKLLIF | 11129 |
| VK1\|L19/JK4 |  | WYQQKPGKAPKLLIY | 11130 |
| 18089-G11 | VK1\|L19/JK4 | WYQQKPGKAPKLLIY | 11131 |
| VK3\|A27/JK1 |  | WYQQKPGQAPRLLIY | 11132 |
| 18179-A10 | VK3\|A27/JK1 | WYLQKPGQSPQLLIY | 11133 |
| VK1\|A20/JK2 |  | WYQQKPGKVPKLLIY | 11134 |
| 18179-G12 | VK1\|A20/JK2 | WYQQKPGKVPKLLIS | 11135 |
| VK4\|B3/JK5 |  | WYQQKPGQPPKLLIY | 11136 |
| 18081-B9 | VK4\|B3/JK5 | WYQQKPGQPPKLLIY | 11137 |
| 18081-B9_final | VK4\|B3/JK5 | WYQQKPGQPPKLLIY | 11138 |
| VK1\|O12/JK5 |  | WYQQKPGKAPKLLIY | 11139 |
| 18089-D8 | VK1\|O12/JK5 | WYQQKPGKAPKLLIY | 11140 |

K_CDR2

| VK4\|B3/JK2 |  | W--------ASTRES | 11441 |
|---|---|---|---|
| 17724-C9 | VK4\|B3/JK2 | W--------ASTRES | 11442 |
| 18079-H4 | VK4\|B3/JK2 | W--------ASTRES | 11443 |
| 18079-H11 | VK4\|B3/JK2 | W--------ASTRES | 11444 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| VK6\|A10/JK2 | | Y--------ASQSFS | 11445 |
| 17724-G6 | VK6\|A10/JK2 | D--------TSKLAP | 11446 |
| VK1\|L11/JK2 | | A--------ASSLQS | 11447 |
| 17731-H8 | VK1\|L11/JK2 | N--------AKTLAG | 11448 |
| VK2\|A19/JK5 | | L--------GSNRAS | 11449 |
| 17732-A8 | VK2\|A19/JK5 | L--------GSNRAS | 11450 |
| 18081-B5 | VK2\|A19/JK5 | L--------GSNRAS | 11451 |
| VK2\|A19/JK2 | | L--------GSNRAS | 11452 |
| 17745-E5 | VK2\|A19/JK2 | L--------GSIRAS | 11453 |
| 17778-F1 | VK2\|A19/JK2 | L--------GSNRAS | 11454 |
| 17778-H8 | VK2\|A19/JK2 | L--------GSNRAS | 11455 |
| 18088-E4 | VK2\|A19/JK2 | L--------GSKRAS | 11456 |
| 18179-C4 | VK2\|A19/JK2 | L--------GSNRAS | 11457 |
| 18179-C7 | VK2\|A19/JK2 | L--------GSNRAS | 11458 |
| 18179-F3 | VK2\|A19/JK2 | L--------GSNRAS | 11459 |
| 18181-C6 | VK2\|A19/JK2 | L--------GSNRAS | 11460 |
| VK2\|O1/JK1 | | T--------LSYRAS | 11461 |
| 17745-E8 | VK2\|O1/JK1 | L--------GSKRAS | 11462 |
| 18179-C6 | VK2\|O1/JK1 | L--------GSNRAS | 11463 |
| 18179-F10 | VK2\|O1/JK1 | L--------GSNRAS | 11464 |
| 18179-G9 | VK2\|O1/JK1 | L--------GSNRAS | 11465 |
| 18181-H7 | VK2\|O1/JK1 | L--------GSNRAS | 11466 |
| 18181-B8 | VK2\|O1/JK1 | L--------GSNRAS | 11467 |
| 81-H7-SG-F28_final | VK2\|O1/JK1 | L--------GSNRAS | 11468 |
| VK3\|A27/JK3 | | G--------ASSRAT | 11469 |
| 17745-G8 | VK3\|A27/JK3 | G--------ASSRAT | 11470 |
| 18080-H9 | VK3\|A27/JK3 | G--------ASSRAT | 11471 |
| VK3\|A27/JK4 | | G--------ASSRAT | 11472 |
| 17748-D12 | VK3\|A27/JK4 | G--------ASSRAT | 11473 |
| 17777-C4 | VK3\|A27/JK4 | G--------ASSRAT | 11474 |
| 18072-D6 | VK3\|A27/JK4 | G--------ASARAT | 11475 |
| 18084-E4 | VK3\|A27/JK4 | G--------ASSRAT | 11476 |
| 18088-B10 | VK3\|A27/JK4 | G--------ASTRAT | 11477 |
| VK2\|A19/JK3 | | L--------GSNRAS | 11478 |
| 17753-F4 | VK2\|A19/JK3 | L--------GSNRAS | 11479 |
| 17779-E1 | VK2\|A19/JK3 | L--------GSNRAS | 11480 |

TABLE 58-continued scFv Variable Region Protein Alignment
CDRs defined by Kabat
Alignment numbering defined by Amgen Reference (AHo)

KAPPA_VARIABLE

|  | Germline |  | SEQ ID NO: |
|---|---|---|---|
| 17780-E6 | VK2\|A19/JK3 | L--------GSNRAS | 11481 |
| 17785-D12 | VK2\|A19/JK3 | L--------GSNRAS | 11482 |
| 18179-A3 | VK2\|A19/JK3 | L--------GSNRAS | 11483 |
| 18179-A5 | VK2\|A19/JK3 | L--------GSNRAS | 11484 |
| 18179-C10 | VK2\|A19/JK3 | L--------GSNRAS | 11485 |
| 18179-F4 | VK2\|A19/JK3 | L--------GSNRAS | 11486 |
| 18179-H9 | VK2\|A19/JK3 | L--------GSNRAS | 11487 |
| 18181-A11 | VK2\|A19/JK3 | L--------GSNRAS | 11488 |
| 18181-C9 | VK2\|A19/JK3 | L--------GSNRAS | 11489 |
| VK1\|L19/JK1 |  | A--------ASSLQS | 11490 |
| 17771-D2 | VK1\|L19/JK1 | A--------ASSLQS | 11491 |
| 17784-B9 | VK1\|L19/JK1 | A--------ASSLQS | 11492 |
| VK2\|A19/JK4 |  | L--------GSNRAS | 11493 |
| 17777-B4 | VK2\|A19/JK4 | L--------GSNRAS | 11494 |
| 17777-C5 | VK2\|A19/JK4 | L--------GSNRAS | 11495 |
| 17783-C11 | VK2\|A19/JK4 | L--------GSYRAS | 11496 |
| 17813-F1 | VK2\|A19/JK4 | L--------GSNRAS | 11497 |
| 18179-A9 | VK2\|A19/JK4 | L--------GSNRAS | 11498 |
| VK2\|O1/JK2 |  | T--------LSYRAS | 11499 |
| 17778-C9 | VK2\|O1/JK2 | L--------GSNRAS | 11500 |
| 18179-H6 | VK2\|O1/JK2 | L--------GSNRAS | 11501 |
| VK1\|O12/JK1 |  | A--------ASSLQS | 11502 |
| 17779-D11 | VK1\|O12/JK1 | D--------ASSLQS | 11503 |
| 18081-D12 | sKV1\|O12/JK1 | A--------TSSLQS | 11504 |
| 18093-E2 | VK1\|O12/JK1 | A--------ASSLQS | 11505 |
| 18093-F5 | VK1\|O12/JK1 | A--------ASSLQS | 11506 |
| 18409-F12_final | VK1\|O12/JK1 | A--------ASSLQS | 11507 |
| 18409-H7_final | VK1\|O12/JK1 | A--------ASSLQS | 11508 |
| 18409-H10_final | VK1\|O12/JK1 | A--------ASSLQS | 11509 |
| VK2\|O1/JK5 |  | T--------LSYRAS | 11510 |
| 17780-D12 | VK2\|O1/JK5 | L--------GSNRAS | 11511 |
| 17784-G10 | VK2\|O1/JK5 | L--------GSNRAS | 11512 |
| VK2\|A19/JK1 |  | L--------GSNRAS | 11513 |
| 17781-B3 | VK2\|A19/JK1 | L--------GSNRAS | 11514 |
| 17781-H12 | VK2\|A19/JK1 | L--------GSNRAS | 11515 |
| 17784-H5 | VK2\|A19/JK1 | L--------GSNRAS | 11516 |
| 18080-C5 | VK2\|A19/JK1 | L--------GSNRAS | 11517 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18179-F6 | VK2\|A19/JK1 | L--------GSNRAS | 11518 |
| 18179-G8 | VK2\|A19/JK1 | L--------GSNRAS | 11519 |
| 18181-H10 | VK2\|A19/JK1 | L--------GSNRAS | 11520 |
| 18181-G10 | VK2\|A19/JK1 | L--------GSNRAS | 11521 |
| 18181-E2 | VK2\|A19/JK1 | L--------GSNRAS | 11522 |
| VK2\|O1/JK4 | | T--------LSYRAS | 11523 |
| 17783-G10 | VK2\|O1/JK4 | L--------VSKRAS | 11524 |
| 17813-E3 | VK2\|O1/JK4 | L--------GSNRAS | 11525 |
| 17813-E5 | VK2\|O1/JK4 | L--------GSKRAS | 11526 |
| VK1\|A20/JK3 | | A--------ASTLQS | 11527 |
| 17784-C7 | VK1\|A20/JK3 | A--------ASSLQS | 11528 |
| 18089-H9 | VK1\|A20/JK3 | G--------ASTLQL | 11529 |
| 18089-D12 | VK1\|A20/JK3 | A--------ASTLQS | 11530 |
| 18179-C1 | VK1\|A20/JK3 | A--------ASTLQS | 11531 |
| 02-C1-86-A4-N-F5_final | VK1\|A20/JK3 | A--------ASTLQS | 11532 |
| 18486-A4_final | VK1\|A20/JK3 | A--------ASTLQS | 11533 |
| VK2\|O1/JK3 | | T--------LSYRAS | 11534 |
| 17784-C11 | VK2\|O1/JK3 | L--------GSNRAS | 11535 |
| VK1\|A20/JK1 | | A--------ASTLQS | 11536 |
| 17813-D8 | VK1\|A20/JK1 | A--------ASTLQS | 11537 |
| VK2\|A18/JK5 | | E--------VSSRES | 11538 |
| 17814-D9 | VK2\|A18/JK5 | L--------GSNRAS | 11539 |
| VK4\|B3/JK1 | | W--------ASTRES | 11540 |
| 18071-C4 | VK4\|B3/JK1 | W--------ASTRES | 11541 |
| 18071-D4 | VK4\|B3/JK1 | W--------ASTRES | 11542 |
| 18086-H4 | VK4\|B3/JK1 | W--------ASTRES | 11543 |
| VK1\|O18/JK1 | | D--------ASNLET | 11544 |
| 18074-G12 | VK1\|O18/JK1 | D--------ASNLET | 11545 |
| VK4\|B3/JK4 | | W--------ASTRES | 11546 |
| 18081-A6 | VK4\|B3/JK4 | W--------ASTRES | 11547 |
| 18081-C10 | VK4\|B3/JK4 | W--------ASTRES | 11548 |
| 18089-B8 | VK4\|B3/JK4 | W--------ASTRES | 11549 |
| 18081-E7 | VK4\|B3/JK4 | W--------ASTRES | 11550 |
| VK1\|O12/JK2 | | A--------ASSLQS | 11551 |
| 18081-D6 | VK1\|O12/JK2 | A--------ASSLQS | 11552 |
| 18089-H12 | VK1\|O12/JK2 | A--------ASSLQS | 11553 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18179-E6 | VK1\|O12/JK2 | A--------ASSLQS | 11554 |
| 18089-D11 | VK1\|O12/JK2 | A--------ASSLQS | 11555 |
| 18081-B6 | VK1\|O12/JK2 | A--------ASSLQS | 11556 |
| 18181-F1 | VK1\|O12/JK2 | A--------ASSLQS | 11557 |
| 18181-A6 | VK1\|O12/JK2 | A--------ASSLQS | 11558 |
| 18410-B6_final | VK1\|O12/JK2 | A--------ASSLQG | 11559 |
| 18410-H3_final | VK1\|O12/JK2 | A--------ASSLQG | 11560 |
| VK1\|O12/JK4 | | A--------ASSLQS | 11561 |
| 18089-C8 | VK1\|O12/JK4 | A--------ASSLQS | 11562 |
| 18089-B2 | VK1\|O12/JK4 | A--------ASSLQS | 11563 |
| 18181-G8 | VK1\|O12/JK4 | A--------ASSLQS | 11564 |
| 18410-B5_final | VK1\|O12/JK4 | A--------ASSLQG | 11565 |
| VK1\|O12/JK3 | | A--------ASSLQS | 11566 |
| 18089-G7 | VK1\|O12/JK3 | A--------TSSLQS | 11567 |
| 18179-B7 | VK1\|O12/JK3 | A--------ASSLQG | 11568 |
| 18179-B8 | VK1\|O12/JK3 | A--------ASSLQS | 11569 |
| 18179-D8 | VK1\|O12/JK3 | A--------ASSLQG | 11570 |
| 18179-D9 | VK1\|O12/JK3 | A--------ASSLQS | 11571 |
| 18181-G7 | VK1\|O12/JK3 | A--------ASSLQG | 11572 |
| 18089-C9 | VK1\|O12/JK3 | A--------ASSLQS | 11573 |
| 18081-F9 | VK1\|O12/JK3 | A--------ASSLQS | 11574 |
| 18081-H11 | VK1\|O12/JK3 | A--------ASSLQS | 11575 |
| 18179-E1 | VK1\|O12/JK3 | A--------ASSLQG | 11576 |
| 18179-H7 | VK1\|O12/JK3 | A--------ASSLQS | 11577 |
| 18179-B12 | VK1\|O12/JK3 | A--------ASSLQS | 11578 |
| 18179-D11 | VK1\|O12/JK3 | A--------ASSLQG | 11579 |
| 18179-D7 | VK1\|O12/JK3 | A--------ASSLQG | 11580 |
| 18179-A7 | VK1\|O12/JK3 | A--------ASSLQG | 11581 |
| 18181-F3 | VK1\|O12/JK3 | A--------ASSLQG | 11582 |
| 18409-E2_final | VK1\|O12/JK3 | A--------ASSLQG | 11583 |
| 18409-G10_final | VK1\|O12/JK3 | A--------ASSLQS | 11584 |
| 18410-D3_final | VK1\|O12/JK3 | A--------ASSLQG | 11585 |
| 18410-D6_final | VK1\|O12/JK3 | A--------ASSLQG | 11586 |
| 18410-H1_final | VK1\|O12/JK3 | A--------ASSLQS | 11587 |
| VK1\|L19/JK4 | | A--------ASSLQS | 11588 |
| 18089-G11 | VK1\|L19/JK4 | A--------ASSLQS | 11589 |
| VK3\|A27/JK1 | | G--------ASSRAT | 11590 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18179-A10 | VK3\|A27/JK1 | L--------GSNRAS | 11591 |
| VK1\|A20/JK2 | | A--------ASTLQS | 11592 |
| 18179-G12 | VK1\|A20/JK2 | A--------ASTLQS | 11593 |
| VK4 \|B3/JK5 | | W--------ASTRES | 11594 |
| 18081-B9 | VK4\|B3/JK5 | W--------ASTRES | 11595 |
| 18081-B9_final | VK4\|B3/JK5 | W--------ASTRES | 11596 |
| VK1\|O12/JK5 | | A--------ASSLQS | 11597 |
| 18089-D8 | VK1\|O12/JK5 | A--------ASSLQS | 11598 |
| | | K_FR3 | |
| VK4\|B3/JK2 | | GVPDRESGSGSG--TDFTLTISSLQAEDVAVYYC | 11899 |
| 17724-C9 | VK4\|B3/JK2 | GVPDRFTGSGSG--TDFTLTISSVKAEDLAVYYC | 11900 |
| 18079-H4 | VK4\|B3/JK2 | GVPDRESGSGSG-TDFTLTISSLQAEDVAVYYC | 11901 |
| 18079-H11 | VK4\|B3/JK2 | GVPDRESGSGSG--TDFTLTISSLQAEDVAVYYC | 11902 |
| VK6\|A10/JK2 | | GVPSRFSGSGSG--TDFTLTINSLEAEDAATYYC | 11903 |
| 17724-G6 | VK6\|A10/JK2 | GVPARFSGSGSG--TSYSLTISSMEAEDAASYFC | 11904 |
| VK1\|L11/JK2 | | GVPSRFSGSGSG--TDFTLTISSLQPEDFATYYC | 11905 |
| 17731-H8 | VK1\|L11/JK2 | GVPSRFSGSGSG--TQFSLKINSLQPEDEGSYYC | 11906 |
| VK2\|A19/JK5 | | GVPDRESGSGSG--TDFTLKISRVEAEDVGVYYC | 11907 |
| 17732-A8 | sVK2\|A19/JK5 | GVPDRESGSGSG--TDFTLKISKVEAEDVGVYYC | 11908 |
| 18081-B5 | VK2\|A19/JK5 | GVPDRFSGSGSG--TDFTLKISRVEAEDVGVYYC | 11909 |
| VK2\|A19/JK2 | | GVPDRFSGSGSG--TDFTLKISRVEAEDVGVYYC | 11910 |
| 17745-E5 | VK2\|A19/JK2 | GVPDRFSGSGSG--TDFTLKISRVEAEDVGVYYC | 11911 |
| 17778-F1 | VK2\|A19/JK2 | GVPDRESGSGSG--TDFTLKISRVEAEDVGVYYC | 11912 |
| 17778-H8 | VK2\|A19/JK2 | GVPDRFSGSGSG--TDFTLKISRVEAEDVGVYYC | 11913 |
| 18088-E4 | VK2\|A19/JK2 | GVPDRESGSGSG--TDFTLKISRVEAEDVGVYYC | 11914 |
| 18179-C4 | VK2\|A19/JK2 | GVPDRESGSGSG--TDFTLKISRVEAGDVGFYYC | 11915 |
| 18179-C7 | VK2\|A19/JK2 | GVPDRFIGSGSG--TDFTLEISRVEAEDVGVYYC | 11916 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18179-F3 | VK2\|A19/JK2 | GVPDRFIGSGSG--TDFTLEISRVEAEDVGVYYC | 11917 |
| 18181-C6 | VK2\|A19/JK2 | GVPDRFSGSGSG--TDFTLKISRVEAEDVGFYYC | 11918 |
| VK2\|O1/JK1 |  | GVPDRESGSGSG--TDFTLKISRVEAEDVGVYYC | 11919 |
| 17745-E8 | VK2\|O1/JK1 | GVPDRFSGSGSG--TDFTLKISRVEAEDVGVYYC | 11920 |
| 18179-C6 | VK2\|O1/JK1 | GVPDRFIGSGSG--TDFTLKISKVEAEDVGIYYC | 11921 |
| 18179-F10 | VK2\|O1/JK1 | GVPDRFSGSGSG--TDFTLKISRVEAEDVGFYYC | 11922 |
| 18179-G9 | VK2\|O1/JK1 | GVPDRFIGSGSG--TDFTLKISRVEAEDVGVYYC | 11923 |
| 18181-H7 | VK2\|O1/JK1 | GVPDRESGSGSG--TDFTLKISRVEAGDVGVYYC | 11924 |
| 18181-B8 | VK2\|O1/JK1 | GVPDRFIGSGSG--TDFTLEISRVEAEDVGVYYC | 11925 |
| 81-H7-SG-F28_final | VK2\|O1/JK1 | GVPDRFSGSGSG--TDFTLKISRVEAGDVGVYYC | 11926 |
| VK3\|A27/JK3 |  | GIPDRFSGSGSG--TDFTLTISRLEPEDFAVYYC | 11927 |
| 17745-G8 | VK3\|A27/JK3 | GIPDRFSGSGSG--TDFTLTISRLEPEDFAVYYC | 11928 |
| 18080-H9 | VK3\|A27/JK3 | GIPDRESGSGSG--TDFTLTISRLEPEDFAVYYC | 11929 |
| VK3\|A27/JK4 |  | GIPDRESGSGSG--TDFTLTISRLEPEDFAVYYC | 11930 |
| 17748-D12 | VK3\|A27/JK4 | GIPDRESGSGSG--TDFTLTISRLEPEDFAVYYC | 11931 |
| 17777-C4 | VK3\|A27/JK4 | GIPDRFSGSGSG--TDFTLTISRLEPEDFAVYYC | 11932 |
| 18072-D6 | VK3\|A27/JK4 | GIPDRFSGSGSG--TDFTLTISRLEPEDFAVYYC | 11933 |
| 18084-E4 | VK3\|A27/JK4 | GIPARFSGSGSG--TDFTLTISRLEPEDFAVYYC | 11934 |
| 18088-B10 | VK3\|A27/JK4 | GIPDRESGSGSG--TDFTLTISRLEPEDFAVYYC | 11935 |
| VK2\|A19/JK3 |  | GVPDRESGSGSG--TDFTLKISRVEAEDVGVYYC | 11936 |
| 17753-F4 | VK2\|A19/JK3 | GVPDRFSGSGSG--TDFTLKISRVEAEDVGVYYC | 11937 |
| 17779-E1 | VK2\|A19/JK3 | GVPDRESASRSG--TDFTLKISRVEAEDVGVYYC | 11938 |
| 17780-E6 | VK2\|A19/JK3 | GVPDRESGSGSG--TDFTLQISRVEAEDVGVYYC | 11939 |
| 17785-D12 | VK2\|A19/JK3 | GVPDRFSGSRSG--TDFTLKISRVEAEDVGVYYC | 11940 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18179-A3 | VK2\|A19/JK3 | GVPDRFSGSGSG--<br>TDFTLKISRVEAEDVGVYYC | 11941 |
| 18179-A5 | VK2\|A19/JK3 | GVPDRESGSGSG--<br>TDFTLKISRVEAEDVGVYYC | 11942 |
| 18179-C10 | VK2\|A19/JK3 | GVPDRFSGSGSG--<br>TDFTLKISRVEAEDVGVYYC | 11943 |
| 18179-F4 | VK2\|A19/JK3 | GVPDRESGSGSG--<br>TDFTLKISRVEAEDVGVYYC | 11944 |
| 18179-H9 | VK2\|A19/JK3 | GVPSRFSGSGSG--<br>TDFTLKISRVEAEDVGIYYC | 11945 |
| 18181-A11 | VK2\|A19/JK3 | GVPDRESGSGSG--<br>TDFTLKISRVEAEDVGIYYC | 11946 |
| 18181-C9 | VK2\|A19/JK3 | GVPDRESGSGSG--<br>TDFTLKISRVEAEDVGVYYC | 11947 |
| VK1\|L19/JK1 |  | GVPSRFSGSGSG--<br>TDFTLTISSLQPEDFATYYC | 11948 |
| 17771-D2 | VK1\|L19/JK1 | GVPSRFSGSGSG--<br>TDFTLTISSLQPEDFATYYC | 11949 |
| 17784-B9 | VK1\|L19/JK1 | GVPSRFSGSGSG--<br>TDFTLTISSLQPEDFAAYYC | 11950 |
| VK2\|A19/JK4 |  | GVPDRFSGSGSG--<br>TDFTLKISRVEAEDVGVYYC | 11951 |
| 17777-B4 | VK2\|A19/JK4 | GVPDRESGSGSG--<br>TDFTLKISRVEAEDVGVYYC | 11952 |
| 17777-C5 | VK2\|A19/JK4 | GVPDRESGSGSG--<br>TDFTLKISRVEAEDVGVYYC | 11953 |
| 17783-C11 | VK2\|A19/JK4 | GVPDRESGSASG--<br>TDFTLKISRVEAEDVGVYYC | 11954 |
| 17813-F1 | VK2\|A19/JK4 | GVPDRESGSGSG--<br>IDFTLKISRVEAEDVGVYYC | 11955 |
| 18179-A9 | VK2\|A19/JK4 | GVPDRFSGSGSG--<br>ADFTLKISRVEAEDVGVYYC | 11956 |
| VK2\|O1/JK2 |  | GVPDRESGSGSG--<br>TDFTLKISRVEAEDVGVYYC | 11957 |
| 17778-C9 | VK2\|O1/JK2 | GVPDRESGSGSG--<br>TDFTLKISKVEAEDVGVYYC | 11958 |
| 18179-H6 | VK2\|O1/JK2 | GVPDRESGSGSG--<br>TDFTLKISRVEAEDAGVYYC | 11959 |
| VK1\|O12/JK1 |  | GVPSRFSGSGSG--<br>TDFTLTISSLQPEDFATYYC | 11960 |
| 17779-D11 | VK1\|O12/JK1 | GVPSRFSGSGSG--<br>TDFTLTISSLQPEDFATYYC | 11961 |
| 18081-D12 | VK1\|O12/JK1 | GVPSRFSGSGSG--<br>TDFTLTISSLQPEDFATYYC | 11962 |
| 18093-E2 | VK1\|O12/JK1 | GVPSRFSGSGSG--<br>TEFTLTISSLQPEDFATYYC | 11963 |
| 18093-F5 | VK1\|O12/JK1 | GVPSRFSGSGSG--<br>TDFTLTISSLQPEDFATYYC | 11964 |

TABLE 58-continued scFv Variable Region Protein Alignment
CDRs defined by Kabat
Alignment numbering defined by Amgen Reference (AHo)

KAPPA_VARIABLE

| | Germline | | SEQ ID NO: |
|---|---|---|---|
| 18409-F12_final | VK1\|O12/JK1 | GVPSRFSGRGSG--<br>TDFTLTISSLQPEDFATYYC | 11965 |
| 18409-H7_final | VK1\|O12/JK1 | GVPSRFSGSGSG--<br>TDFTLTISSLQPEDFATYYC | 11966 |
| 18409-H10_final | VK1\|O12/JK1 | GVPSRFSGRGSG--<br>TDFTLTISSLQPEDFATYYC | 11967 |
| VK2\|O1/JK5 | | GVPDRESGSGSG--<br>TDFTLKISRVEAEDVGVYYC | 11968 |
| 17780-D12 | VK2\|O1/JK5 | GVPDRESGSGSG--<br>TDFTLKISRVEAEDVGVYYC | 11969 |
| 17784-G10 | VK2\|O1/JK5 | GVPDRFSGSGSG--<br>TDFTLKISRVEAEDVGVYYC | 11970 |
| VK2\|A19/JK1 | | GVPDRFSGSGSG--<br>TDFTLKISRVEAEDVGVYYC | 11971 |
| 17781-B3 | VK2\|A19/JK1 | GVPDRFSGSGSG--<br>TDFTLKISRVEAEDVGVYYC | 11972 |
| 17781-H12 | VK2\|A19/JK1 | GVPDRESGSGSG--<br>TDFTLKISRVEAEDVGVYYC | 11973 |
| 17784-H5 | VK2\|A19/JK1 | GVPDRESGSGSG--<br>TDFTLKISRVEAEDVGVYYC | 11974 |
| 18080-C5 | VK2\|A19/JK1 | GVPDRFSGSGSG--<br>TDFTLKISRVEAEDVGVYYC | 11975 |
| 18179-F6 | VK2\|A19/JK1 | GVPDRFSGSGSG--<br>TDFTLKISRVEAEDVGFYYC | 11976 |
| 18179-G8 | VK2\|A19/JK1 | GVPDRESGSGSG--<br>TDFTLKISRVEAEDVGVYYC | 11977 |
| 18181-H10 | VK2\|A19/JK1 | GVPDRESGSGSG--<br>TDFTLKISRVEAEDVGIYYC | 11978 |
| 18181-G10 | VK2\|A19/JK1 | GVPDRFSGSGSG--<br>TDFTLKISRVEAEDVGFYYC | 11979 |
| 18181-E2 | VK2\|A19/JK1 | GVPDRESGSGSG--<br>TDFTLKISKVEAEDVGVYYC | 11980 |
| VK2\|O1/JK4 | | GVPDRESGSGSG--<br>TDFTLKISRVEAEDVGVYYC | 11981 |
| 17783-G10 | VK2\|O1/JK4 | GVPDRESGSGSG--<br>TDFTLKISRVEAEDVGVYYC | 11982 |
| 17813-E3 | VK2\|O1/JK4 | GVPDRESGSGSG--<br>TDFTLKISRVEAEDVGVYYC | 11983 |
| 17813-E5 | VK2\|O1/JK4 | GVPDRESGSGSG--<br>TDFTLKISRVEAEDVGVYYC | 11984 |
| VK1\|A20/JK3 | | GVPSRFSGSGSG--<br>TDFTLTISSLQPEDVATYYC | 11985 |
| 17784-C7 | VK1\|A20/JK3 | GVPSRFSGSGSG--<br>TDFTLTISSLQPEDFATYYC | 11986 |
| 18089-H9 | VK1\|A20/JK3 | GVPSRFSGSGSG--<br>TDFTLTISSLQPEDVATYYC | 11987 |
| 18089-D12 | VK1\|A20/JK3 | GVPSRFSGSGSG--<br>TDFTLTISSLQPEDVATYYC | 11988 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18179-C1 | VK1\|A20/JK3 | GVPSRFSGSGSG--<br>TDFTLTISSLQPEDVATYYC | 11989 |
| 02-C1-86-A4-N-F5_final | VK1\|A20/JK3 | GVPSRFSGSGSG--<br>TDFTLTISSLQPEDVATYYC | 11990 |
| 18486-A4_final | VK1\|A20/JK3 | GVPSRFSGSGSG--<br>TDFTLTISSLQPEDFATYYC | 11991 |
| VK2\|O1/JK3 | | GVPDRESGSGSG--<br>TDFTLKISRVEAEDVGVYYC | 11992 |
| 17784-C11 | VK2\|O1/JK3 | GVPDRESGSGSG--<br>TDFTLKISRVEAEDVGVYYC | 11993 |
| VK1\|A20/JK1 | | GVPSRFSGSGSG--<br>TDFTLTISSLQPEDVATYYC | 11994 |
| 17813-D8 | VK1\|A20/JK1 | GVPSRFSGSGSG--<br>TDFTLTISSLQPEDFATYYC | 11995 |
| VK2\|A18/JK5 | | GVPDRESGSGSG--<br>TDFTLKISRVEAEDVGVYYC | 11996 |
| 17814-D9 | VK2\|A18/JK5 | GVPDRESGSGSG--<br>TDFTLKISRVEAEDVGVYYC | 11997 |
| VK4\|B3/JK1 | | GVPDRESGSGSG--<br>TDFTLTISSLQAEDVAVYYC | 11998 |
| 18071-C4 | VK4\|B3/JK1 | GVPDRFSGSGSG--<br>TDFTLTISSLQAEDVAVYYC | 11999 |
| 18071-D4 | VK4\|B3/JK1 | GVPDRFSGSGSG--<br>TDFTLTISSLQAEDVAVYYC | 12000 |
| 18086-H4 | VK4\|B3/JK1 | GVPDRFSGSGSG--<br>TDFTLTISSLQAEDVAVYYC | 12001 |
| VK1\|O18/JK1 | | GVPSRFSGSGSG--<br>TDFTFTISSLQPEDIATYYC | 12002 |
| 18074-G12 | VK1\|O18/JK1 | GVPSRFSGSGSG--<br>TDFTFTISSLQPEDFATYYC | 12003 |
| VK4\|B3/JK4 | | GVPDRESGSGSG--<br>TDFTLTISSLQAEDVAVYYC | 12004 |
| 18081-A6 | VK4\|B3/JK4 | GVPDRESGSGSG--<br>TDFTLTISSLQAEDVAVYYC | 12005 |
| 18081-C10 | VK4\|B3/JK4 | GVPDRESGSGSG--<br>TDFTLTISSLQAEDVAVYYC | 12006 |
| 18089-B8 | VK4\|B3/JK4 | GVPDRESGSGSG--<br>TDFTLTISSLQAEDVAVYYC | 12007 |
| 18081-E7 | VK4\|B3/JK4 | GVPDRFSGSGSG--<br>TDFTLTISSLQAEDVAVYYC | 12008 |
| VK1\|O12/JK2 | | GVPSRFSGSGSG--<br>TDFTLTISSLQPEDFATYYC | 12009 |
| 18081-D6 | VK1\|O12/JK2 | GVPSRFSGSGSG--<br>TDFTLTISSLQPEDFATYYC | 12010 |
| 18089-H12 | VK1\|O12/JK2 | GVPSRFSGSGSG--<br>TDFTLTISSLQPEDFATYYC | 12011 |
| 18179-E6 | VK1\|O12/JK2 | GVPSRFSGSGSG--<br>TDFTLTISSLQPEDFATYYC | 12012 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18089-D11 | VK1\|O12/JK2 | GVPSRFSGSGSG--TDFTLTISSLQPEDFATYYC | 12013 |
| 18081-B6 | VK1\|O12/JK2 | GVPSRFSGSGSG--TDFTLTISSLQPEDFATYYC | 12014 |
| 18181-F1 | VK1\|O12/JK2 | GVPSRFSGSGSG--TDFTLTISSLQPEDFATYYC | 12015 |
| 18181-A6 | VK1\|O12/JK2 | GVPSRFSGSGSG--TDFTLTISSLQPEDFATYYC | 12016 |
| 18410-B6_final | VK1\|O12/JK2 | GVPSRFSGSGSG--TDFTLTISSLQPEDFATYYC | 12017 |
| 18410-H3_final | VK1\|O12/JK2 | GVPSRFSGSGSG--TDFTLTISSLQPEDFATYYC | 12018 |
| VK1\|O12/JK4 | | GVPSRFSGSGSG--TDFTLTISSLQPEDFATYYC | 12019 |
| 18089-C8 | VK1\|O12/JK4 | GVPSRFSGSGSG--TDFTLTISSLQPEDFATYYC | 12020 |
| 18089-B2 | VK1\|O12/JK4 | GVPSRFSGSGSG--TDFTLTISSLQPEDFATYYC | 12021 |
| 18181-G8 | VK1\|O12/JK4 | GVPSRFSGSGSG--TDFTLTISSLQPEDFATYYC | 12022 |
| 18410-B5_final | VK1\|O12/JK4 | GVPSRFSGSGSG--TDFTLTISSLQPEDFATYYC | 12023 |
| VK1\|O12/JK3 | | GVPSRFSGSGSG--TDFTLTISSLQPEDFATYYC | 12024 |
| 18089-G7 | VK1\|O12/JK3 | GVPSRFSGSGSG--TDFTLTISSLQPEDFATYYC | 12025 |
| 18179-B7 | VK1\|O12/JK3 | GVPSRFSGSGSG--TDFTLTISSLQPEDFATYYC | 12026 |
| 18179-B8 | VK1\|O12/JK3 | GVPSRFSGSGSG--TDFTLTISSLQPEDFATYYC | 12027 |
| 18179-D8 | VK1\|O12/JK3 | GVPSRFSGSGSG--TDFTLTISSLQPEDFATYYC | 12028 |
| 18179-D9 | VK1\|O12/JK3 | GVPSRFSGSGSG--TDFTLTISSLQREDFATYYC | 12029 |
| 18181-G7 | VK1\|O12/JK3 | GVPSRFSGSGSG--TDFTLTISSLQPEDFATYYC | 12030 |
| 18089-C9 | VK1\|O12/JK3 | GVPSRFSGRGSG--TDFTLTISSLQPEDFATYYC | 12031 |
| 18081-F9 | VK1\|O12/JK3 | GVPSRFSGSGSG--TDFTLTISSLQPEDFATYYC | 12032 |
| 18081-H11 | VK1\|O12/JK3 | GVPSRFSGSGSG--TDFTLTISSLQPEDFATYYC | 12033 |
| 18179-E1 | VK1\|O12/JK3 | GVPSRFSGSGSG--TDFTLTISSLQPEDFATYYC | 12034 |
| 18179-H7 | VK1\|O12/JK3 | GVPSRFSGSGSG--TDFTLTISSLQPEDFATYYC | 12035 |
| 18179-B12 | VK1\|O12/JK3 | GVPSRFSGSGSG--TDFTLTISSLQPEDFATYYC | 12036 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18179-D11 | VK1\|O12/JK3 | GVPSRFSGSGSG--<br>TDFTLTISSLQPEDFATYYC | 12037 |
| 18179-D7 | VK1\|O12/JK3 | GVPSRFSGSGSG--<br>TDFTLTISSLQPEDFATYYC | 12038 |
| 18179-A7 | VK1\|O12/JK3 | GVPSRFSGSGSG--<br>TDFTLTISSLQPEDFATYYC | 12039 |
| 18181-F3 | VK1\|O12/JK3 | GVPSRFSGSGSG--<br>TDFTLTISSLQPEDFATYYC | 12040 |
| 18409-E2_final | VK1\|O12/JK3 | GVPSRFSGSGSG--<br>TDFTLTISSLQPEDFATYYC | 12041 |
| 18409-G10_final | VK1\|O12/JK3 | GVPSRFSGSGSG--<br>TDFTLTISSLQPEDFATYYC | 12042 |
| 18410-D3_final | VK1\|O12/JK3 | GVPSRFSGSGSG--<br>TDFTLTISSLQPEDFATYYC | 12043 |
| 18410-D6_final | VK1\|O12/JK3 | GVPSRFSGSGSG--<br>TDFTLTISSLQPEDFATYYC | 12044 |
| 18410-H1_final | VK1\|O12/JK3 | GVPSRFSGSGSG--<br>TDFTLTISSLQPEDFATYYC | 12045 |
| VK1\|L19/JK4 | VK1\|L19/JK4 | GVPSRFSGSGSG--<br>TDFTLTISSLQPEDFATYYC | 12046 |
| 18089-G11 |  | GVPSRFSGSGSG--<br>TDFTLTISSLQPEDFATYYC | 12047 |
| VK3\|A27/JK1 |  | GIPDRFSGSGSG--<br>TDFTLTISRLEPEDFAVYYC | 12048 |
| 18179-A10 | VK3\|A27/JK1 | GVPDRESGSGSG--<br>TDFTLKISRVEAEDVGVYYC | 12049 |
| VK1\|A20/JK2 |  | GVPSRFSGSGSG--<br>TDFTLTISSLQPEDVATYYC | 12050 |
| 18179-G12 | VK1\|A20/JK2 | GVPSRFSGSGSG--<br>TDFTLTISSLQPEDVATYYC | 12051 |
| VK4\|B3/JK5 |  | GVPDRESGSGSG--<br>TDFTLTISSLQAEDVAVYYC | 12052 |
| 18081-B9 | VK4\|B3/JK5 | GVPDRESGSGSG--<br>TDFTLTISSLQAEDVAVYYC | 12053 |
| 18081-B9_final | VK4\|B3/JK5 | GVPDRESGSGSG--<br>TDFTLTISSLQAEDVAVYYC | 12054 |
| VK1\|O12/JK5 |  | GVPSRFSGSGSG--<br>TDFTLTISSLQPEDFATYYC | 12055 |
| 18089-D8 | VK1\|O12/JK5 | GVPSRFSGSGSG--<br>TDFTLTISSLQPEDFATYYC | 12056 |
|  | K_CDR3 |  |  |
| VK4\|B3/JK2 |  | QQYYS---------------------TPYT | 12357 |
| 17724-C9 | VK4\|B3/JK2 | QQYYS---------------------YPYT | 12358 |
| 18079-H4 | VK4\|B3/JK2 | QQYYS---------------------TPWT | 12359 |
| 18079-H11 | VK4\|B3/JK2 | QQYYS---------------------TPWT | 12360 |
| VK6\|A10/JK2 |  | HQSSS---------------------LPYT | 12361 |
| 17724-G6 | VK6\|A10/JK2 | HQWSS---------------------YPPT | 12362 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| VK1\|L11/JK2 | | LQDYN---------------------YPYT | 12363 |
| 17731-H8 | VK1\|L11/JK2 | QHHYG---------------------TPLT | 12364 |
| VK2\|A19/JK5 | | MQALQ---------------------TPIT | 12365 |
| 17732-A8 | VK2\|A19/JK5 | MQALQ---------------------TPPT | 12366 |
| 18081-B5 | VK2\|A19/JK5 | MQALQ---------------------TPIT | 12367 |
| VK2\|A19/JK2 | | MQALQ---------------------TPYT | 12368 |
| 17745-E5 | VK2\|A19/JK2 | MQPLQ---------------------TPPT | 12369 |
| 17778-F1 | VK2\|A19/JK2 | MQALQ---------------------TPPT | 12370 |
| 17778-H8 | VK2\|A19/JK2 | MQALQ---------------------TPPT | 12371 |
| 18088-E4 | VK2\|A19/JK2 | MQVLQ---------------------TPPT | 12372 |
| 18179-C4 | VK2\|A19/JK2 | MQALQ---------------------TPRT | 12373 |
| 18179-C7 | VK2\|A19/JK2 | MQAL----------------------QTPS | 12374 |
| 18179-F3 | VK2\|A19/JK2 | MQAL----------------------QTPS | 12375 |
| 18181-C6 | VK2\|A19/JK2 | MQGLQ---------------------TPRT | 12376 |
| VK2\|O1/JK1 | | MQRIE---------------------FPWT | 12377 |
| 17745-E8 | VK2\|O1/JK1 | MQGTH---------------------WPRT | 12378 |
| 18179-C6 | VK2\|O1/JK1 | MQALQ---------------------TPRT | 12379 |
| 18179-F10 | VK2\|O1/JK1 | MQALQ---------------------TPRT | 12380 |
| 18179-G9 | VK2\|O1/JK1 | MQAL----------------------QTPS | 12381 |
| 18181-H7 | VK2\|O1/JK1 | MQALQ---------------------TPWT | 12382 |
| 18181-B8 | VK2\|O1/JK1 | MQAL----------------------QTPS | 12383 |
| 81-H7-SG-F28_final | VK2\|O1/JK1 | MQALQ---------------------TPWT | 12384 |
| VK3\|A27/JK3 | | QQYGS---------------------SPFT | 12385 |
| 17745-G8 | VK3\|A27/JK3 | QQYGR---------------------SLFT | 12386 |
| 18080-H9 | VK3\|A27/JK3 | QQYGS---------------------SPFT | 12387 |
| VK3\|A27/JK4 | | QQYGS---------------------SPLT | 12388 |
| 17748-D12 | VK3\|A27/JK4 | QQYGS---------------------SPLT | 12389 |
| 17777-C4 | VK3\|A27/JK4 | QQYGS---------------------SPLT | 12390 |
| 18072-D6 | VK3\|A27/JK4 | QQYG----------------------SSLT | 12391 |
| 18084-E4 | VK3\|A27/JK4 | QQYGS---------------------SPLT | 12392 |
| 18088-B10 | VK3\|A27/JK4 | QQYGT---------------------SPLT | 12393 |
| VK2\|A19/JK3 | | MQALQ---------------------TPFT | 12394 |
| 17753-F4 | VK2\|A19/JK3 | MQALQ---------------------TPFT | 12395 |
| 17779-E1 | VK2\|A19/JK3 | MQALQ---------------------TPFT | 12396 |
| 17780-E6 | VK2\|A19/JK3 | MQGTH---------------------WPFT | 12397 |
| 17785-D12 | VK2\|A19/JK3 | MQALQ---------------------TPFT | 12398 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18179-A3 | VK2\|A19/JK3 | MQALQ----------------------TPFT | 12399 |
| 18179-A5 | VK2\|A19/JK3 | MQALQ----------------------TPFT | 12400 |
| 18179-C10 | VK2\|A19/JK3 | MQALQ----------------------TPFT | 12401 |
| 18179-F4 | VK2\|A19/JK3 | MQALQ----------------------TPFT | 12402 |
| 18179-H9 | VK2\|A19/JK3 | MQALQ----------------------TPFT | 12403 |
| 18181-A11 | VK2\|A19/JK3 | MQALQ----------------------TPFT | 12404 |
| 18181-C9 | VK2\|A19/JK3 | MQGLQ----------------------TPFT | 12405 |
| VK1\|L19/JK1 |  | QQANS----------------------FPWT | 12406 |
| 17771-D2 | VK1\|L19/JK1 | QQANS----------------------FPPT | 12407 |
| 17784-B9 | VK1\|L19/JK1 | QQSYS----------------------TPPT | 12408 |
| VK2\|A19/JK4 |  | MQALQ----------------------TPLT | 12409 |
| 17777-B4 | VK2\|A19/JK4 | MQALQ----------------------TPLT | 12410 |
| 17777-C5 | VK2\|A19/JK4 | MQGTH----------------------WPLT | 12411 |
| 17783-C11 | VK2\|A19/JK4 | MQGTH----------------------WPLT | 12412 |
| 17813-F1 | VK2\|A19/JK4 | MQAL-----------------------QTPH | 12413 |
| 18179-A9 | VK2\|A19/JK4 | MQALQ----------------------TPLT | 12414 |
| VK2\|O1/JK2 |  | MQRIE----------------------FPYT | 12415 |
| 17778-C9 | VK2\|O1/JK2 | MQALQ----------------------TPCS | 12416 |
| 18179-H6 | VK2\|O1/JK2 | MQSLH----------------------LPPT | 12417 |
| VK1\|O12/JK1 |  | QQSYS----------------------TPWT | 12418 |
| 17779-D11 | VK1\|O12/JK1 | QQSYR----------------------TPPT | 12419 |
| 18081-D12 | VK1\|O12/JK1 | QQSYS----------------------TPPT | 12420 |
| 18093-E2 | VK1\|O12/JK1 | QQSYS----------------------TPPT | 12421 |
| 18093-F5 | sKV1\|O12/JK1 | QQSYS----------------------VPPT | 12422 |
| 18409-F12_final | VK1\|O12/JK1 | QQSYY----------------------YPTL | 12423 |
| 18409-H7_final | VK1\|O12/JK1 | QQSYF----------------------PVVE | 12424 |
| 18409-H10_final | VK1\|O12/JK1 | QQSYT----------------------PPTT | 12425 |
| VK2\|O1/JK5 |  | MQRIE----------------------FPIT | 12426 |
| 17780-D12 | VK2\|O1/JK5 | MQALQ----------------------TPIT | 12427 |
| 17784-G10 | VK2\|O1/JK5 | MQALQ----------------------TPIT | 12428 |
| VK2\|A19/JK1 |  | MQALQ----------------------TPWT | 12429 |
| 17781-B3 | VK2\|A19/JK1 | MQALQ----------------------TPWT | 12430 |
| 17781-H12 | VK2\|A19/JK1 | MQSIQ----------------------LPWT | 12431 |
| 17784-H5 | VK2\|A19/JK1 | MQALQ----------------------TPPT | 12432 |
| 18080-C5 | VK2\|A19/JK1 | MQALQ----------------------TPRT | 12433 |
| 18179-F6 | VK2\|A19/JK1 | MQALQ----------------------TPRT | 12434 |
| 18179-G8 | VK2\|A19/JK1 | MQALQ----------------------TPRT | 12435 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18181-H10 | VK2\|A19/JK1 | MQALQ---------------------TPRT | 12436 |
| 18181-G10 | VK2\|A19/JK1 | MQALQ---------------------TPRT | 12437 |
| 18181-E2 | VK2\|A19/JK1 | MQALQ---------------------TPRT | 12438 |
| VK2\|O1/JK4 |  | MQRIE---------------------FPLT | 12439 |
| 17783-G10 | VK2\|O1/JK4 | MQALQ---------------------TPLT | 12440 |
| 17813-E3 | VK2\|O1/JK4 | MQAL----------------------QSLT | 12441 |
| 17813-E5 | VK2\|O1/JK4 | MQALQ---------------------TPLT | 12442 |
| VK1\|A20/JK3 |  | QKYNS---------------------APFT | 12443 |
| 17784-c7 | VK1\|A20/JK3 | QQSYS---------------------TPFT | 12444 |
| 18089-H9 | VK1\|A20/JK3 | QKYYS---------------------APFT | 12445 |
| 18089-D12 | VK1\|A20/JK3 | QKYNS---------------------APFT | 12446 |
| 18179-C1 | VK1\|A20/JK3 | QKYNS---------------------APFT | 12447 |
| 02-C1-86-A4-N-F5_final | VK1\|A20/JK3 | QKYNS---------------------APFT | 12448 |
| 18486-A4_final | VK1\|A20/JK3 | QKYNS---------------------APFT | 12449 |
| VK2\|O1/JK3 |  | MQRIE---------------------FPFT | 12450 |
| 17784-C11 | VK2\|O1/JK3 | MQGTH---------------------WPFT | 12451 |
| VK1\|A20/JK1 |  | QKYNS---------------------APWT | 12452 |
| 17813-D8 | VK1\|A20/JK1 | QQSYS---------------------TPPT | 12453 |
| VK2\|A18/JK5 |  | MQGIH---------------------LPIT | 12454 |
| 17814-D9 | VK2\|A18/JK5 | MQALQ---------------------TPIT | 12455 |
| VK4\|B3/JK1 |  | QQYYS---------------------TPWT | 12456 |
| 18071-C4 | VK4\|B3/JK1 | QQYYS---------------------TPWT | 12457 |
| 18071-D4 | VK4\|B3/JK1 | QQYYS---------------------TPWT | 12458 |
| 18086-H4 | VK4\|B3/JK1 | QQYYS---------------------TPWT | 12459 |
| VK1\|O18/JK1 |  | QQYDN---------------------LPWT | 12460 |
| 18074-G12 | VK1\|O18/JK1 | QQSYS---------------------IPPT | 12461 |
| VK4\|B3/JK4 |  | QQYYS---------------------TPLT | 12462 |
| 18081-A6 | VK4\|B3/JK4 | QQYYS---------------------TPLT | 12463 |
| 18081-C10 | VK4\|B3/JK4 | QQYYS---------------------TPLT | 12464 |
| 18089-B8 | VK4\|B3/JK4 | QQYYS---------------------TPLT | 12465 |
| 18081-E7 | VK4\|B3/JK4 | QQYYS---------------------TPLT | 12466 |
| VK1\|O12/JK2 |  | QQSYS---------------------TPYT | 12467 |
| 18081-D6 | VK1\|O12/JK2 | QQSYS---------------------TPFT | 12468 |
| 18089-H12 | VK1\|O12/JK2 | QQSYS---------------------TPFT | 12469 |
| 18179-E6 | VK1\|O12/JK2 | QQTYS---------------------MPFT | 12470 |
| 18089-D11 | VK1\|O12/JK2 | QQSYI---------------------TPFT | 12471 |

TABLE 58-continued scFv Variable Region Protein Alignment
CDRs defined by Kabat
Alignment numbering defined by Amgen Reference (AHo)
KAPPA_VARIABLE

| | Germline | | SEQ ID NO: |
|---|---|---|---|
| 18081-B6 | VK1\|O12/JK2 | QQSYS---------------------TPFT | 12472 |
| 18181-F1 | VK1\|O12/JK2 | QQTYS---------------------SPFT | 12473 |
| 18181-A6 | VK1\|O12/JK2 | QQTYS---------------------MPFT | 12474 |
| 18410-B6_final | VK1\|O12/JK2 | IQAYT---------------------SPFT | 12475 |
| 18410-H3_final | VK1\|O12/JK2 | QQTYS---------------------SPFT | 12476 |
| VK1\|O12/JK4 | | QQSYS---------------------TPLT | 12477 |
| 18089-C8 | VK1\|O12/JK4 | QQSYS---------------------TPLT | 12478 |
| 18089-B2 | VK1\|O12/JK4 | QQSYS---------------------IPLT | 12479 |
| 18181-G8 | VK1\|O12/JK4 | QQTYS---------------------MPFT | 12480 |
| 18410-B5_final | VK1\|O12/JK4 | QQTYS---------------------MPFT | 12481 |
| VK1\|O12/JK3 | | QQSYS---------------------TPFT | 12482 |
| 18089-G7 | VK1\|O12/JK3 | QQSYS---------------------IPFT | 12483 |
| 18179-B7 | VK1\|O12/JK3 | QQTYS---------------------MPFT | 12484 |
| 18179-B8 | VK1\|O12/JK3 | QQSYS---------------------TPFT | 12485 |
| 18179-D8 | VK1\|O12/JK3 | QQTYS---------------------MPFT | 12486 |
| 18179-D9 | VK1\|O12/JK3 | QQSYS---------------------TPFT | 12487 |
| 18181-G7 | VK1\|O12/JK3 | QQTYS---------------------MPFT | 12488 |
| 18089-C9 | VK1\|O12/JK3 | QQSYS---------------------TPFT | 12489 |
| 18081-F9 | VK1\|O12/JK3 | QQSYS---------------------TPFT | 12490 |
| 18081-H11 | VK1\|O12/JK3 | QQSYT---------------------TPFT | 12491 |
| 18179-E1 | VK1\|O12/JK3 | QQTYS---------------------MPFT | 12492 |
| 18179-H7 | VK1\|O12/JK3 | QQSYS---------------------SPFT | 12493 |
| 18179-B12 | VK1\|O12/JK3 | QQTYS---------------------MPFT | 12494 |
| 18179-D11 | sVK1\|O12/JK3 | QQTYS---------------------MPFT | 12495 |
| 18179-D7 | VK1\|O12/JK3 | QQTYS---------------------MPFT | 12496 |
| 18179-A7 | VK1\|O12/JK3 | QQTYS---------------------MPFT | 12497 |
| 18181-F3 | VK1\|O12/JK3 | QQSYS---------------------SPET | 12498 |
| 18409-E2_final | VK1\|O12/JK3 | QQSYS---------------------SPFT | 12499 |
| 18409-G10_final | VK1\|O12/JK3 | QQSYI---------------------TPFT | 12500 |
| 18410-D3_final | VK1\|O12/JK3 | QQTYS---------------------MPFT | 12501 |
| 18410-D6_final | VK1\|O12/JK3 | QQTYS---------------------MPFT | 12502 |
| 18410-H1_final | VK1\|O12/JK3 | QQTYS---------------------MPFT | 12503 |
| VK1\|L19/JK4 | | QQANS---------------------FPLT | 12504 |
| 18089-G11 | VK1\|L19/JK4 | QQSYS---------------------TPLT | 12505 |
| VK3\|A27/JK1 | | QQYGS---------------------SPWT | 12506 |
| 18179-A10 | VK3\|A27/JK1 | MQALQ---------------------TPRT | 12507 |
| VK1\|A20/JK2 | | QKYNS---------------------APYT | 12508 |

TABLE 58-continued scFv Variable Region Protein Alignment
CDRs defined by Kabat
Alignment numbering defined by Amgen Reference (AHo)

KAPPA_VARIABLE

| | Germline | | SEQ ID NO: |
|---|---|---|---|
| 18179-G12 | VK1\|A20/JK2 | QKYNS----------------------APFT | 12509 |
| VK4\|B3/JK5 | | QQYYS----------------------TPIT | 12510 |
| 18081-B9 | VK4\|B3/JK5 | QQFYS----------------------TPIT | 12511 |
| 18081-B9_final | VK4\|B3/JK5 | QQFYS----------------------TPIT | 12512 |
| VK1\|O12/JK5 | | QQSYS----------------------TPIT | 12513 |
| 18089-D8 | VK1\|O12/JK5 | QQSYS----------------------TPIT | 12514 |

K_FR4

| | | | |
|---|---|---|---|
| VK4\|B3/JK2 | | FGQGTKLEIK | 12818 |
| 17724-C9 | VK4\|B3/JK2 | FGGGTKLELK | 12819 |
| 18079-H4 | VK4\|B3/JK2 | FGQGTKLEIK | 12820 |
| 18079-H11 | VK4\|B3/JK2 | FGQGTKLEIK | 12821 |
| VK6\|A10/JK2 | | FGQGTKLEIK | 12822 |
| 17724-G6 | VK6\|A10/JK2 | FGSGTKLEIK | 12823 |
| VK1\|L11/JK2 | | FGQGTKLEIK | 12824 |
| 17731-H8 | VK1\|L11/JK2 | FGAGTKLELK | 12825 |
| VK2\|A19/JK5 | | FGQGTRLEIK | 12826 |
| 17732-A8 | VK2\|A19/JK5 | FGQGTRLEIK | 12827 |
| 18081-B5 | VK2\|A19/JK5 | FGQGTRLEIK | 12828 |
| VK2\|A19/JK2 | | FGQGTKLEIK | 12829 |
| 17745-E5 | VK2\|A19/JK2 | FGPGTKLEIK | 12830 |
| 17778-F1 | VK2\|A19/JK2 | FGQGTKLEIK | 12831 |
| 17778-H8 | VK2\|A19/JK2 | FGQGTKLEIK | 12832 |
| 18088-E4 | VK2\|A19/JK2 | FGQGTKLDIK | 12833 |
| 18179-C4 | VK2\|A19/JK2 | FGQGTKLEIK | 12834 |
| 18179-C7 | VK2\|A19/JK2 | FGQGTKLEIK | 12835 |
| 18179-F3 | VK2\|A19/JK2 | FGQGTKLEIK | 12836 |
| 18181-C6 | VK2\|A19/JK2 | FGQGTKLEIK | 12837 |
| VK2\|O1/JK1 | | FGQGTKVEIK | 12838 |
| 17745-E8 | VK2\|O1/JK1 | FGQGTKVEIK | 12839 |
| 18179-C6 | VK2\|O1/JK1 | FGQGTKVEIK | 12840 |
| 18179-F10 | VK2\|O1/JK1 | FGQGTKVEIK | 12841 |
| 18179-G9 | VK2\|O1/JK1 | FGQGTKVEIK | 12842 |
| 18181-H7 | VK2\|O1/JK1 | FGQGTKVEIK | 12843 |
| 18181-B8 | VK2\|O1/JK1 | FGQGTKVEIK | 12844 |
| 81-H7-SG-F28_final | VK2\|O1/JK1 | FGQGTKVEIK | 12845 |
| VK3\|A27/JK3 | | FGPGTKVDIK | 12846 |

TABLE 58-continued scFv Variable Region Protein Alignment
CDRs defined by Kabat
Alignment numbering defined by Amgen Reference (AHo)
KAPPA_VARIABLE

| | Germline | SEQ ID NO: |
|---|---|---|
| 17745-G8 | VK3\|A27/JK3 FGPGTKVDIK | 12847 |
| 18080-H9 | VK3\|A27/JK3 FGPGTKVEIK | 12848 |
| VK3\|A27/JK4 | FGGGTKVEIK | 12849 |
| 17748-D12 | VK3\|A27/JK4 FGGGTKLEIK | 12850 |
| 17777-C4 | VK3\|A27/JK4 FGGGTKLEIK | 12851 |
| 18072-D6 | VK3\|A27/JK4 FGGGTKVDIK | 12852 |
| 18084-E4 | VK3\|A27/JK4 FGGGTKLEIK | 12853 |
| 18088-B10 | VK3\|A27/JK4 FGGGTKVDIK | 12854 |
| VK2\|A19/JK3 | FGPGTKVDIK | 12855 |
| 17753-F4 | VK2\|A19/JK3 FGPGTKVEIK | 12856 |
| 17779-E1 | VK2\|A19/JK3 FGPGTKVEIK | 12857 |
| 17780-E6 | VK2\|A19/JK3 FGPGTKVEIK | 12858 |
| 17785-D12 | VK2\|A19/JK3 FGPGTKVDIK | 12859 |
| 18179-A3 | VK2\|A19/JK3 FGPGTKVDIK | 12860 |
| 18179-A5 | VK2\|A19/JK3 FGPGTKVEIK | 12861 |
| 18179-C10 | VK2\|A19/JK3 FGPGTKVEIK | 12862 |
| 18179-F4 | VK2\|A19/JK3 FGPGTKVEIK | 12863 |
| 18179-H9 | VK2\|A19/JK3 FGPGTKVEIK | 12864 |
| 18181-A11 | VK2\|A19/JK3 FGPGTKVEIK | 12865 |
| 18181-C9 | VK2\|A19/JK3 FGPGTKVEIK | 12866 |
| VK1\|L19/JK1 | FGQGTKVEIK | 12867 |
| 17771-D2 | VK1\|L19/JK1 FGQGTKVEIK | 12868 |
| 17784-B9 | VK1\|L19/JK1 FGQGTKVEIK | 12869 |
| VK2\|A19/JK4 | FGGGTKVEIK | 12870 |
| 17777-B4 | VK2\|A19/JK4 FGGGTKVEIK | 12871 |
| 17777-C5 | VK2\|A19/JK4 FGGGTKVDIK | 12872 |
| 17783-C11 | VK2\|A19/JK4 FGGGTKLEIK | 12873 |
| 17813-F1 | VK2\|A19/JK4 FGGGTKVEIK | 12874 |
| 18179-A9 | VK2\|A19/JK4 FGGGTKVEIK | 12875 |
| VK2\|O1/JK2 | FGQGTKLEIK | 12876 |
| 17778-C9 | VK2\|O1/JK2 FGQGTKLEIK | 12877 |
| 18179-H6 | VK2\|O1/JK2 FGGGTKLEIK | 12878 |
| VK1\|O12/JK1 | FGQGTKVEIK | 12879 |
| 17779-D11 | VK1\|O12/JK1 FGQGTKVDIK | 12880 |
| 18081-D12 | VK1\|O12/JK1 FGQGTKVEIK | 12881 |
| 18093-E2 | VK1\|O12/JK1 FGQGTKVDIK | 12882 |
| 18093-F5 | VK1\|O12/JK1 FGQGTKVDIK | 12883 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18409-F12_final | VK1\|O12/JK1 | FGPGTKVEIK | 12884 |
| 18409-H7_final | VK1\|O12/JK1 | FGPGTKVEIK | 12885 |
| 18409-H10_final | VK1\|O12/JK1 | FGPGTKVEIK | 12886 |
| VK2\|O1/JK5 |  | FGQGTRLEIK | 12887 |
| 17780-D12 | VK2\|O1/JK5 | FGQGTRLEIK | 12888 |
| 17784-G10 | VK2\|O1/JK5 | FGQGTRLEIK | 12889 |
| VK2\|A19/JK1 |  | FGQGTKVEIK | 12890 |
| 17781-B3 | VK2\|A19/JK1 | FGQGTKVDIK | 12891 |
| 17781-H12 | VK2\|A19/JK1 | FGQGTKVDIK | 12892 |
| 17784-H5 | VK2\|A19/JK1 | FGQGTKVEIK | 12893 |
| 18080-C5 | VK2\|A19/JK1 | FGQGTKVEIK | 12894 |
| 18179-F6 | VK2\|A19/JK1 | FGQGTKVEIK | 12895 |
| 18179-G8 | VK2\|A19/JK1 | FGQGTKVEIK | 12896 |
| 18181-H10 | VK2\|A19/JK1 | FGQGTKVDIK | 12897 |
| 18181-G10 | VK2\|A19/JK1 | FGQGTKVEIK | 12898 |
| 18181-E2 | VK2\|A19/JK1 | FGQGTKVDIK | 12899 |
| VK2\|O1/JK4 |  | FGGGTKVEIK | 12900 |
| 17783-G10 | VK2\|O1/JK4 | FGGGTKLEIK | 12901 |
| 17813-E3 | VK2\|O1/JK4 | FGGGTKLEIK | 12902 |
| 17813-E5 | VK2\|O1/JK4 | FGGGTKVDIK | 12903 |
| VK1\|A20/JK3 |  | FGPGTKVDIK | 12904 |
| 17784-c7 | VK1\|A20/JK3 | FGPGTKVEIK | 12905 |
| 18089-H9 | VK1\|A20/JK3 | FGPGTKVDIK | 12906 |
| 18089-D12 | VK1\|A20/JK3 | FGPGTKVEIK | 12907 |
| 18179-C1 | VK1\|A20/JK3 | FGPGTKVDIK | 12908 |
| 02-C1-86-A4-N-F5_final | VK1\|A20/JK3 | FGPGTKVEIK | 12909 |
| 18486-A4_final | VK1\|A20/JK3 | FGPGTKVEIK | 12910 |
| VK2\|O1/JK3 |  | FGPGTKVDIK | 12911 |
| 17784-C11 | VK2\|O1/JK3 | FGPGTKVEIK | 12912 |
| VK1\|A20/JK1 |  | FGQGTKVEIK | 12913 |
| 17813-D8 | VK1\|A20/JK1 | FGQGTKVEIK | 12914 |
| VK2\|A18/JK5 |  | FGQGTRLEIK | 12915 |
| 17814-D9 | VK2\|A18/JK5 | FGQGTRLEIK | 12916 |
| VK4\|B3/JK1 |  | FGQGTKVEIK | 12917 |
| 18071-C4 | VK4\|B3/JK1 | FGQGTKVEIK | 12918 |
| 18071-D4 | VK4\|B3/JK1 | FGQGTKVEIK | 12919 |

TABLE 58-continued scFv Variable Region Protein Alignment
CDRs defined by Kabat
Alignment numbering defined by Amgen Reference (AHo)
KAPPA_VARIABLE

|  | Germline |  | SEQ ID NO: |
|---|---|---|---|
| 18086-H4 | VK4\|B3/JK1 | FGQGTKVDIK | 12920 |
| VK1\|O18/JK1 |  | FGQGTKVEIK | 12921 |
| 18074-G12 | VK1\|O18/JK1 | FGQGTKVEIK | 12922 |
| VK4\|B3/JK4 |  | FGGGTKVEIK | 12923 |
| 18081-A6 | VK4\|B3/JK4 | FGGGTKVEIK | 12924 |
| 18081-C10 | VK4\|B3/JK4 | FGGGTKVEIK | 12925 |
| 18089-B8 | VK4\|B3/JK4 | FGGGTKVDIK | 12926 |
| 18081-E7 | VK4\|B3/JK4 | FGGGTKVEIK | 12927 |
| VK1\|O12/JK2 |  | FGQGTKLEIK | 12928 |
| 18081-D6 | VK1\|O12/JK2 | FGPGTKLEIK | 12929 |
| 18089-H12 | VK1\|O12/JK2 | FGPGTKLEIK | 12930 |
| 18179-E6 | VK1\|O12/JK2 | FGPGTKLEIK | 12931 |
| 18089-D11 | VK1\|O12/JK2 | FGGGTKLEIK | 12932 |
| 18081-B6 | VK1\|O12/JK2 | FGPGTKLEIK | 12933 |
| 18181-F1 | VK1\|O12/JK2 | FGPGTKLEIK | 12934 |
| 18181-A6 | VK1\|O12/JK2 | FGPGTKLEIK | 12935 |
| 18410-B6_final | VK1\|O12/JK2 | FGPGTKLEIK | 12936 |
| 18410-H3_final | VK1\|O12/JK2 | FGPGTKLEIK | 12937 |
| VK1\|O12/JK4 |  | FGGGTKVEIK | 12938 |
| 18089-C8 | VK1\|O12/JK4 | FGGGTKVEIK | 12939 |
| 18089-B2 | VK1\|O12/JK4 | FGGGTKVEIK | 12940 |
| 18181-G8 | VK1\|O12/JK4 | FGGGTKVEIK | 12941 |
| 18410-B5_final | VK1\|O12/JK4 | FGGGTKVEIK | 12942 |
| VK1\|O12/JK3 |  | FGPGTKVDIK | 12943 |
| 18089-G7 | VK1\|O12/JK3 | FGPGTKVEIK | 12944 |
| 18179-B7 | VK1\|O12/JK3 | FGPGTKVDIK | 12945 |
| 18179-B8 | VK1\|O12/JK3 | FGPGTKVDIK | 12946 |
| 18179-D8 | VK1\|O12/JK3 | FGPGTKVDIK | 12947 |
| 18179-D9 | VK1\|O12/JK3 | FGPGTKVDIK | 12948 |
| 18181-G7 | VK1\|O12/JK3 | FGPGTKVEIK | 12949 |
| 18089-C9 | VK1\|O12/JK3 | FGPGTKVEIK | 12950 |
| 18081-F9 | VK1\|O12/JK3 | FGPGTKVEIK | 12951 |
| 18081-H11 | VK1\|O12/JK3 | FGPGTKVEIK | 12952 |
| 18179-E1 | VK1\|O12/JK3 | FGPGTKVDIK | 12953 |
| 18179-H7 | VK1\|O12/JK3 | FGPGTKVEIK | 12954 |
| 18179-B12 | VK1\|O12/JK3 | FGPGTKVEIK | 12955 |
| 18179-D11 | VK1\|O12/JK3 | FGPGTKVDIK | 12956 |

TABLE 58-continued scFv Variable Region Protein Alignment
CDRs defined by Kabat
Alignment numbering defined by Amgen Reference (AHo)

KAPPA_VARIABLE

|  | Germline |  | SEQ ID NO: |
|---|---|---|---|
| 18179-D7 | VK1\|O12/JK3 | FGPGTKVDIK | 12957 |
| 18179-A7 | VK1\|O12/JK3 | FGPGTKVDIK | 12958 |
| 18181-F3 | VK1\|O12/JK3 | FGPGTKVEIK | 12959 |
| 18409-E2_final | VK1\|O12/JK3 | FGPGTKVEIK | 12960 |
| 18409-G10_final | VK1\|O12/JK3 | FGPGTKVEIK | 12961 |
| 18410-D3_final | VK1\|O12/JK3 | FGPGTKVDIK | 12962 |
| 18410-D6_final | VK1\|O12/JK3 | FGPGTKVDIK | 12963 |
| 18410-H1_final | VK1\|O12/JK3 | FGPGTKVDIK | 12964 |
| VK1\|L19/JK4 |  | FGGGTKVEIK | 12965 |
| 18089-G11 | VK1\|L19/JK4 | FGGGTKVDIK | 12966 |
| VK3\|A27/JK1 |  | FGQGTKVEIK | 12967 |
| 18179-A10 | VK3\|A27/JK1 | FGQGTKVEIK | 12968 |
| VK1\|A20/JK2 |  | FGQGTKLEIK | 12969 |
| 18179-G12 | VK1\|A20/JK2 | FGPGTKLEIK | 12970 |
| VK4\|B3/JK5 |  | FGQGTRLEIK | 12971 |
| 18081-B9 | VK4\|B3/JK5 | FGQGTRLEIK | 12972 |
| 18081-B9_final | VK4\|B3/JK5 | FGQGTRLEIK | 12973 |
| VK1\|O12/JK5 |  | FGQGTRLEIK | 12974 |
| 18089-D8 | VK1\|O12/JK5 | FGQGTRLEIK | 12975 |

TABLE 59

LAMBDA_VARIABLE

|  | Germline | L_FR1 | SEQ ID NO: | L_CDR1 | SEQ ID NO: | L_FR2 | SEQ ID NO: |
|---|---|---|---|---|---|---|---|
| VL2\|2a2/JL2 |  | QSALTQP-ASVSGSPGQSITISC | 10225 | TGTS-SDVGGY----NYVS | 10683 | WYQQHPGKAPKLMIY | 11141 |
| 18071-B1 | VL2\|2a2/JL2 | ELALTQP-PSVSGSPGQSITISC | 10226 | TGTS-SDVGGY----NYVS | 10684 | WYQQHPGKAPKLMIY | 11142 |
| VL1\|1g/JL2 |  | QSVLTQP-PSASGTPGQRVTISC | 10227 | SGSS-SNIGS-----NYVY | 10685 | WYQQLPGTAPKLLIY | 11143 |
| 18072-G9 | VL1\|1g/JL2 | ELVLTQP-PSASGTPGQRITISC | 10228 | SGSS-SNIGS-----NYVY | 10686 | WYQHLPGTAPKLLIY | 11144 |
| VL10\|10a/JL3b |  | QAGLTQP-PSVSKGLRQTATLTC | 10229 | TGNS-NNVGN-----QGAA | 10687 | WLQQHQGHPPKLLSY | 11145 |
| 18078-H6 | VL10\|10a/JL3b | ELVLTQP-PSVSKGLRQTATLTC | 10230 | TGNS-NNVGN-----QGAA | 10688 | WLQQHQGHPPKLLSY | 11146 |
| 18079-C8 | VL10\|10a/JL3b | ELVLTQP-SSVSKDLRQTATLTC | 10231 | TGNS-NNVGN-----QGAA | 10689 | WLQQHQGHPPKLLSY | 11147 |
| VL2\|2c/JL2 |  | QSALTQP-PSASGSPGQSVTISC | 10232 | TGTS-SDVGGY----NYVS | 10690 | WYQQHPGKAPKLMIY | 11148 |

TABLE 59-continued

| LAMBDA_VARIABLE | | | | | | | | |
|---|---|---|---|---|---|---|---|---|
| 18082-F5 | VL2\|2c/JL2 | ELALTQP-ASASGSPGQSITISC | 10233 | TGTS-SDVGGY----NYVS | 10691 | WYQQHPGKAPKLMIY | 11149 |
| VL10\|10a/JL2 | | QAGLTQP-PSVSKGLRQTATLTC | 10234 | TGNS-NNVGN-----QGAA | 10692 | WLQQHQGHPPKLLSY | 11150 |
| 18090-H9 | VL10\|10a/JL2 | ELVLTQL-PSVSKGLRQTATLTC | 10235 | TGNS-NNVGN-----QGAA | 10693 | WLQQHQGHPPKLLSY | 11151 |
| VL3\|3h/JL2 | | SYVLTQP-PSVSVAPGKTARITC | 10236 | GGN---NIGS-----KSVH | 10694 | WYQQKPGQAPVLVIY | 11152 |
| 18182-A3 | VL3\|3h/JL2 | ELVLTQP-PSVSVAPGQTARITC | 10237 | GGN---NIGS-----KSVH | 10695 | WYQQKPGQAPVLVVY | 11153 |
| 18182-A5 | VL3\|3h/JL2 | ELVLTQP-PSVSVAPGQTARITC | 10238 | GGN---NIGS-----KSVQ | 10696 | WYQQKPGQAPVLVVY | 11154 |
| 18182-A6 | VL3\|3h/JL2 | ELVVTQE-PSVSVAPGQTARITC | 10239 | GGN---NIGS-----KSVH | 10697 | WYQQKPGQAPVMVVY | 11155 |
| 18182-A7 | VL3\|3h/JL2 | ELVLTQL-PSVSVAPGQTARITC | 10240 | GGN---NIGS-----KSVH | 10698 | WHQQKPGQAPVMVVY | 11156 |
| 18182-A8 | VL3\|3h/JL2 | ELVLTQS-SSVSVAPGQTARITC | 10241 | GGN---NIGS-----KSVH | 10699 | WYQQKPGQAPVLVVY | 11157 |
| 18182-A11 | VL3\|3h/JL2 | ELVLTQP-PSVSVTPGQTARITC | 10242 | GGN---NIGS-----KSVH | 10700 | WYQQKPGQAPVLVVY | 11158 |
| 18182-B1 | VL3\|3h/JL2 | ELVLTQL-PSVSVAPGQTARITC | 10243 | GGN---NIGS-----KSVH | 10701 | WYQQKPGQAPVLVVY | 11159 |
| 18182-B4 | VL3\|3h/JL2 | ELMLTQP-PSVSVAPGQTARITC | 10244 | GGN---NIGS-----KSVH | 10702 | WYQQKPGQAPVMVVY | 11160 |
| 18182-B6 | VL3\|3h/JL2 | ELMLTQP-HSVSVAPGQTARITC | 10245 | GGN---NIGS-----KSVH | 10703 | WYQQKPGQAPVLVVY | 11161 |
| 18182-B7 | VL3\|3h/JL2 | ELMLTQP-HSVSVAPGQTARITC | 10246 | GGN---NIGS-----KSVQ | 10704 | WYQQKPGQAPVLVVY | 11162 |
| 18182-B10 | VL3\|3h/JL2 | ELMLTQP-HSVSVAPGQTARITC | 10247 | GGN---NIGS-----KSVH | 10705 | WYQQKPGQAPVMVVY | 11163 |
| 18182-C2 | VL3\|3h/JL2 | ELVLTQP-PSVSVAPGQTARITC | 10248 | GGN---NIGS-----KSVQ | 10706 | WYQQKPGQAPVLVVY | 11164 |
| 18182-C3 | VL3\|3h/JL2 | ELVLTQP-PSVSVAPGQTARITC | 10249 | GGN---NIGS-----KSVH | 10707 | WYQQKPGQAPVMVVY | 11165 |
| 18182-C4 | VL3\|3h/JL2 | ELMLTQP-HSVSVAPGQTARITC | 10250 | GGN---NIGS-----KSVH | 10708 | WYQQKPGQAPVMVVY | 11166 |
| 18182-C5 | VL3\|3h/JL2 | ELALTQP-ASVSVAPGQTARITC | 10251 | GGN---NIGI-----KSVH | 10709 | WYQQKPGQAPVLVVY | 11167 |
| 18182-C10 | VL3\|3h/JL2 | ELVLTQS-SSVSVAPGQTARITC | 10252 | GGN---NIGS-----KSVH | 10710 | WYQQKPGQAPVLVVY | 11168 |
| 18182-C12 | VL3\|3h/JL2 | ELMLTQP-HSVSVAPGQTARITC | 10253 | GGN---NIGS-----KSVH | 10711 | WYQQKPGQAPVMVVY | 11169 |
| 18182-D4 | VL3\|3h/JL2 | ELALTQP-ASASVAPGQTARITC | 10254 | GGN---NIGS-----KSVH | 10712 | WYQQKPGQAPVLVVY | 11170 |
| 18182-D8 | VL3\|3h/JL2 | ELVLTQL-SSVSVAPGQTARITC | 10255 | GGN---NIGS-----KSVQ | 10713 | WYQQKPGSPVMVVY | 11171 |
| 18182-D9 | VL3\|3h/JL2 | ELVVTQE-PSVSVAPGQTARITC | 10256 | GGN---NIGS-----KSVH | 10714 | WYQQKPGQAPVMVVY | 11172 |
| 18182-D11 | VL3\|3h/JL2 | ELMLTQP-PSVSVAPGQTARITC | 10257 | GGN---NIGS-----KSVH | 10715 | WYQQKPGQAPVLVVY | 11173 |
| 18182-E2 | VL3\|3h/JL2 | ELVLTQP-PSVSVAPGQTARITC | 10258 | GGN---NIGS-----KSVH | 10716 | WYQQKPGQAPVMVVY | 11174 |

TABLE 59-continued

| | | LAMBDA_VARIABLE | | | | | |
|---|---|---|---|---|---|---|---|
| 18182-E3 | VL3\|3h/JL2 | ELVLTQP-PSVSVAPGQTARITC | 10259 | GGN---NIGS-----KSVQ | 10717 | WYQQKPGQAPVLVVY | 11175 |
| 18182-E8 | VL3\|3h/JL2 | ELVLTQP-ASVSVAPGQTARITC | 10260 | GGN---NIGS-----KSVH | 10718 | WYQQKPGQAPVLVVY | 11176 |
| 18182-E11 | VL3\|3h/JL2 | ELMLTQP-HSVSVAPGQTARITC | 10261 | GGN---NIGS-----KSVH | 10719 | WYQQKPGQAPVMVVY | 11177 |
| 18182-F1 | VL3\|3h/JL2 | ELVLTQS-PSVSVAPGQTARITC | 10262 | GGN---NIGS-----KSVH | 10720 | WYQQKPGQAPVLVVY | 11178 |
| 18182-F6 | VL3\|3h/JL2 | ELALTQP-PSVSVAPGQTARITC | 10263 | GGN---NIGS-----KSVH | 10721 | WYQQKPGQAPVLVVY | 11179 |
| 18182-F8 | VL3\|3h/JL2 | ELVLTQP-PSVSVAPGQTARITC | 10264 | GGN---NIGS-----KSVH | 10722 | WYQQKPGQAPVMVVY | 11180 |
| 18182-G3 | VL3\|3h/JL2 | ELVLTQP-PSVSVAPGQTARITC | 10265 | GGN---NIGS-----KSVH | 10723 | WHQQKPGQAPVLVVY | 11181 |
| 18182-G4 | VL3\|3h/JL2 | ELVLTQP-PSVSVAPGQTARITC | 10266 | GGN---NIGS-----KSVH | 10724 | WYQQKPGQAPVLVVY | 11182 |
| 18182-G5 | VL3\|3h/JL2 | ELVLTQP-ASVSVAPGQTARITC | 10267 | GGN---NIGS-----KSVH | 10725 | WYQQKPGQAPVMVVY | 11183 |
| 18182-G9 | VL3\|3h/JL2 | ELALTQP-ASASVAPGQTARISC | 10268 | GGN---NIGS-----KGVQ | 10726 | WYQQKPGQAPVLVVY | 11184 |
| 18182-G11 | VL3\|3h/JL2 | ELVLTQP-PSVSVAPGQTARITC | 10269 | GGN---NIGS-----KSVQ | 10727 | WYQQKPGQAPVLVVY | 11185 |
| 18182-H5 | VL3\|3h/JL2 | ELVVTQE-PSVSVAPGQTARITC | 10270 | GGN---NIGS-----KSVH | 10728 | WHQQKPGQAPVLVVY | 11186 |
| 18093-B11 | VL3\|3h/JL2 | ELVLTQP-PSVSVAPGQTARITC | 10271 | GGN---NIGS-----KSVH | 10729 | WYQQKPGQAPVLVVY | 11187 |
| 18182-B5 | VL3\|3h/JL2 | ELVLTQP-PSVSVAPGQTARITC | 10272 | GGN---NIGS-----KSVH | 10730 | WYQQKPGQAPVLVVY | 11188 |
| 18182-H9 | VL3\|3h/JL2 | ELVLTQP-PSVSVAPGQTARITC | 10273 | GGN---NIGS-----KSVH | 10731 | WHQQKPGQAPVLVVY | 11189 |
| 18182-E6 | VL3\|3h/JL2 | ELVLTQP-SSVSVAPGQTARITC | 10274 | GGN---NIGS-----KSVH | 10732 | WYQQKPGQAPVLVVY | 11190 |
| 18182-G6 | VL3\|3h/JL2 | ELVLTQP-PSVSVAPGQTARITC | 10275 | GGN---NIGS-----KSVH | 10733 | WHQQKPGQSPVLVIY | 11191 |
| 18182-G2 | VL3\|3h/JL2 | ELVLTQP-PSVSVAPGQTARITC | 10276 | GGN---NIGS-----KSVH | 10734 | WYQQKPGQAPVMVVY | 11192 |
| 18182-H12 | VL3\|3h/JL2 | ELMLTQP-HSVSVAPGQTARITC | 10277 | GGN---NIGS-----KSVH | 10735 | WYQQKPGQAPVLVVY | 11193 |
| 18182-G8 | VL3\|3h/JL2 | ELVLTQP-PSVSVAPGQTARITC | 10278 | GGN---NIGS-----KSVH | 10736 | WYQQKPGQAPVMVVY | 11194 |
| 18182-E10 | VL3\|3h/JL2 | ELALTQP-ASASVAPGQTARITC | 10279 | GGN---NIGS-----KSVH | 10737 | WHQQKPGQAPVLVVY | 11195 |
| 18182-B12 | VL3\|3h/JL2 | ELVLTQP-PSVSVAPGQTARITC | 10280 | GGN---NIGS-----KSVH | 10738 | WHQQKPGQAPVLVVY | 11196 |
| 18182-E5 | VL3\|3h/JL2 | ELVLTQP-PSVSVAPGQTARITC | 10281 | GGN---NIGS-----KSVH | 10739 | WHQQKPGQAPVLVVY | 11197 |
| 18182-A4 | VL3\|3h/JL2 | ELVLTQP-PSVSVAPGQTARITC | 10282 | GGN---NIGS-----KSVH | 10740 | WYQQKPGQAPVLVVY | 11198 |
| 18182-E1 | VL3\|3h/JL2 | ELVLTQP-PSVSVAPGQTARITC | 10283 | GGN---NIGS-----KSVH | 10741 | WYQQKPGQAPVMVVY | 11199 |
| 18403-F12-AS | VL3\|3h/JL2 | SYVLTQP-PSVSVAPGQTARITC | 10284 | GGN---NIGS-----KSVH | 10742 | WYQQKPGQAPVMVVY | 11200 |

TABLE 59-continued

| | | LAMBDA_VARIABLE | | | | | |
|---|---|---|---|---|---|---|---|
| 18403-G10-AS | VL3\|3h/JL2 | SYVLTQP-PSVSVAPGQTARITC | 10285 | GGN---NIGS-----KSVH | 10743 | WYQQKPGQAPVMVVY | 11201 |
| 03-F3-88-B3-F9_final | VL3\|3h/JL2 | SYVLTQP-PSVSVAPGQTARITC | 10286 | GGN---NIGS-----KSVH | 10744 | WYQQKPGQAPVLVVY | 11202 |
| 18398-C7_final | VL3\|3h/JL2 | SYVLTQP-PSVSVAPGQTARITC | 10287 | GGN---NIGS-----KSVH | 10745 | WYQQKPGQAPVMVVY | 11203 |
| 18403-E11_AS_final | VL3\|3h/JL2 | SYVLTQP-PSVSVAPGQTARITC | 10288 | GGN---NIGS-----KSVH | 10746 | WYQQKPGQAPVMVVY | 11204 |
| 18403-F12_final | VL3\|3h/JL2 | SYVLTQP-PSVSVAPGQTARITC | 10289 | GGN---NIGS-----KSVH | 10747 | WYQQKPGQAPVMVVY | 11205 |
| 18403-F12-AS_final | VL3\|3h/JL2 | SYVLTQP-PSVSVAPGQTARITC | 10290 | GGN---NIGS-----KSVH | 10748 | WYQQKPGQAPVMVVY | 11206 |
| 18403-G10_final | VL3\|3h/JL2 | SYVLTQP-PSVSVAPGQTARITC | 10291 | GGN---NIGS-----KSVH | 10749 | WYQQKPGQAPVMVVY | 11207 |
| 18403-G10-AS_final | VL3\|3h/JL2 | SYVLTQP-PSVSVAPGQTARITC | 10292 | GGN---NIGS-----KSVH | 10750 | WYQQKPGQAPVMVVY | 11208 |
| 18410-G10_final | VL3\|3h/JL2 | SYVLTQP-PSVSVAPGQTARITC | 10293 | GGN---NIGS-----KSVH | 10751 | WYQQKPGQAPVMVVY | 11209 |
| 18410-G10_AS_final | VL3\|3h/JL2 | SYVLTQP-PSVSVAPGQTARITC | 10294 | GGN---NIGS-----KSVH | 10752 | WYQQKPGQAPVMVVY | 11210 |
| VL3\|3h/JL3b | | SYVLTQP-PSVSVAPGKTARITC | 10295 | GGN---NIGS-----KSVH | 10753 | WYQQKPGQAPVLVIY | 11211 |
| 18403-D8_final | VL3\|3h/JL3b | SYVLTQP-PSVSVAPGQTARITC | 10296 | GGN---NIGS-----KSVH | 10754 | WYQQKPGQAPVMVVY | 11212 |
| 18403-D8_AS_final | VL3\|3h/JL3b | SYVLTQP-PSVSVAPGQTARITC | 10297 | GGN---NIGS-----KSVH | 10755 | WYQQKPGQAPVMVVY | 11213 |

| | Germline | L_CDR2 | SEQ ID NO: | L_FR3 | SEQ ID NO: |
|---|---|---|---|---|---|
| | VL2\|2a2/JL2 | E--------VSNRPS | 11599 | GVSNRFSGSKSG--NTASLTISGLQAEDEADYYC | 12057 |
| 18071-B1 | VL2\|2a2/JL2 | E--------VSKRPS | 11600 | GVSNRFSGSKSG--NTASLTISGLQAEDEADYYC | 12058 |
| | VL1\|1g/JL2 | R--------NNQRPS | 11601 | GVPDRFSGSKSG--TSASLAISGLRSEDEADYYC | 12059 |
| 18072-G9 | VL1\|1g/JL2 | R--------NNQRPS | 11602 | GVPDRESGSKSG--TSASLAISGLRSEDEADYYC | 12060 |
| | VL10\|10a/JL3b | R--------NNNRPS | 11603 | GISERLSASRSG--NTASLTITGLQPEDEADYYC | 12061 |
| 18078-H6 | VL10\|10a/JL3b | R--------NNNRPS | 11604 | GISERLSASRSG--NTASLTITGLQPEDEADYYC | 12062 |
| 18079-C8 | VL10\|10a/JL3b | R--------NNNRPS | 11605 | GISERLSASRSG--NTASLTITGLQPEDEADYYC | 12063 |
| | VL2\|2c/JL2 | E--------VSKRPS | 11606 | GVPDRFSGSKSG--NTASLTVSGLQAEDEADYYC | 12064 |
| 18082-F5 | VL2\|2c/JL2 | E--------VSKRPS | 11607 | GVPDRESGSKSG--NTASLTVSGLQAEDEADYYC | 12065 |
| | VL10\|10a/JL2 | R--------NNNRPS | 11608 | GISERLSASRSG--NTASLTITGLQPEDEADYYC | 12066 |
| 18090-H9 | VL10\|10a/JL2 | R--------NNNRPS | 11609 | GISERLSASRSG--NTASLTITGLQPEDEADYYC | 12067 |
| | VL3\|3h/JL2 | Y--------DSDRPS | 11610 | GIPERFSGSNSG--NTATLTISRVEAGDEADYYC | 12068 |

TABLE 59-continued

| | | LAMBDA_VARIABLE | | | |
|---|---|---|---|---|---|
| 18182-A3 | VL3\|3h/JL2 | D--------DNDRPS | 11611 | GIPERFSGSNFG--NTATLIISRVEAGDEADYYC | 12069 |
| 18182-A5 | VL3\|3h/JL2 | D--------DNDRPS | 11612 | GIPERFSGSNSG--NTATLTISRVEAGDEADFYC | 12070 |
| 18182-A6 | VL3\|3h/JL2 | D--------DNDRPS | 11613 | GIPERFSGSNSG--NTATLTISRVEAGDEADYYC | 12071 |
| 18182-A7 | VL3\|3h/JL2 | D--------DNDRPS | 11614 | GIPERFSGSNSG--NTATLTISRVEAGDEADYHC | 12072 |
| 18182-A8 | VL3\|3h/JL2 | D--------DNDRPS | 11615 | GIPERFSGSNSG--NTATLTISRVEAGDEADFYC | 12073 |
| 18182-A11 | VL3\|3h/JL2 | D--------DNDRPS | 11616 | GIPERFSGSNFG--NTATLTISRVEAGDEADYYC | 12074 |
| 18182-B1 | VL3\|3h/JL2 | D--------DNDRPS | 11617 | GIPERFSGSNFG--NTATLIISRVEAGDEADYYC | 12075 |
| 18182-B4 | VL3\|3h/JL2 | D--------DNDRPS | 11618 | GIPERFSGSNSG--NTATLTISRVEAGDEADYYC | 12076 |
| 18182-B6 | VL3\|3h/JL2 | D--------DNDRPS | 11619 | GIPERFSGSNFG--NTATLTISRVEAGDEADYYC | 12077 |
| 18182-B7 | VL3\|3h/JL2 | D--------DNDRPS | 11620 | GIPERFSGSNSG--NTATLTISRVEAGDEADFYC | 12078 |
| 18182-B10 | VL3\|3h/JL2 | D--------DNDRPS | 11621 | GIPERFSGSNSG--NTATLTISRVEAGDEADYYC | 12079 |
| 18182-C2 | VL3\|3h/JL2 | D--------DNDRPS | 11622 | GIPERFSGSNFG--NTATLIISRVEAGDEADFYC | 12080 |
| 18182-C3 | VL3\|3h/JL2 | D--------DNDRPS | 11623 | GIPERFSGSNSG--NTATLTISRVEAGDEADYYC | 12081 |
| 18182-C4 | VL3\|3h/JL2 | D--------DNDRPS | 11624 | GIPERFSGSNSG--NTATLTISRVEAGDEADYYC | 12082 |
| 18182-C5 | VL3\|3h/JL2 | D--------DNDRPS | 11625 | GIPERFSGSNSG--NTATLTISRVEAGDEADYYC | 12083 |
| 18182-C10 | VL3\|3h/JL2 | D--------DNDRPS | 11626 | GIPERFSGSNFG--NTATLIISRVEAGDEADYYC | 12084 |
| 18182-C12 | VL3\|3h/JL2 | D--------DNDRPS | 11627 | GIPERFSGSNSG--NTATLIISRVEAGDEADYYC | 12085 |
| 18182-D4 | VL3\|3h/JL2 | D--------DNDRPS | 11628 | GIPERFSGSNFG--NTATLIISRVEAGDEADYYC | 12086 |
| 18182-D8 | VL3\|3h/JL2 | D--------DNDRPS | 11629 | GIPERFSGSNSG--NTATLTISRVEAGDEADYHC | 12087 |
| 18182-D9 | VL3\|3h/JL2 | D--------DNDRPS | 11630 | GIPERFSGSNFG--NTATLIISRVEAGDEADYYC | 12088 |
| 18182-D11 | VL3\|3h/JL2 | D--------DNDRPS | 11631 | GIPERFSGSNSG--NTATLTISRVEAGDEADYYC | 12089 |
| 18182-E2 | VL3\|3h/JL2 | D--------DNDRPS | 11632 | GIPERFSGSNSG--NTATLTISRVEAGDEADYHC | 12090 |
| 18182-E3 | VL3\|3h/JL2 | D--------DNDRPS | 11633 | GIPERFSGSNFG--NTATLIISRVEAGDEADYYC | 12091 |
| 18182-E8 | VL3\|3h/JL2 | D--------DNDRPS | 11634 | GIPERFSGSNFG--NTATLIISRVEAGDEADYYC | 12092 |
| 18182-E11 | VL3\|3h/JL2 | D--------DNDRPS | 11635 | GIPERFSGSNSG--NTATLTISRVEAGDEADYYC | 12093 |
| 18182-F1 | VL3\|3h/JL2 | D--------DNDRPS | 11636 | GIPERFSGSNFG--NTATLIISRVEAGDEADYYC | 12094 |

TABLE 59-continued

LAMBDA_VARIABLE

| | | | | | |
|---|---|---|---|---|---|
| 18182-F6 | VL3\|3h/JL2 | D--------DNDRPS | 11637 | GIPERFSGSNSG--NTATLTISRVEAGDEADYYC | 12095 |
| 18182-F8 | VL3\|3h/JL2 | D--------DNDRPS | 11638 | GIPERFSGSNFG--NTATLIISRVEAGDEADYYC | 12096 |
| 18182-G3 | VL3\|3h/JL2 | D--------DNDRPS | 11639 | GIPERFSGSNFG--NTATLIISRVEAGDEADYYC | 12097 |
| 18182-G4 | VL3\|3h/JL2 | D--------DNDRPS | 11640 | GIPERFSGSNFG--NTATLIISRVEAGDEADYYC | 12098 |
| 18182-G5 | VL3\|3h/JL2 | D--------DNDRPS | 11641 | GIPERFSGSNFG--NTATLIISRVEAGDEADYYC | 12099 |
| 18182-G9 | VL3\|3h/JL2 | D--------DNDRPS | 11642 | GIPERFSGSNFG--NTATLIISRVEAGDEADYYC | 12100 |
| 18182-G11 | VL3\|3h/JL2 | D--------DNDRPS | 11643 | GIPERFSGSNFG--NTATLIISRVEAGDEADYYC | 12101 |
| 18182-H5 | VL3\|3h/JL2 | D--------DNDRPS | 11644 | GIPERFSGSNSG--NTATLTISRVEAGDEADFYC | 12102 |
| 18093-B11 | VL3\|3h/JL2 | D--------DNDRPS | 11645 | GIPERFSGSNSG--NTATLTISRVEAGDEADYYC | 12103 |
| 18182-B5 | VL3\|3h/JL2 | D--------DNDRPS | 11646 | GIPERFSGSNFG--NTATLIISRVEAGDEADYYC | 12104 |
| 18182-H9 | VL3\|3h/JL2 | D--------DNDRPS | 11647 | GIPERFSGSNSG--NTATLTISRVEAGDEADFYC | 12105 |
| 18182-E6 | VL3\|3h/JL2 | D--------DNDRPS | 11648 | GIPERFSGSNFG--NTATLIISRVAAGDEADYYC | 12106 |
| 18182-G6 | VL3\|3h/JL2 | D--------DNDRPS | 11649 | GIPERFSGENSG--NTATLTISRVEAGDEADYYC | 12107 |
| 18182-G2 | VL3\|3h/JL2 | D--------DNDRPS | 11650 | GIPERFSGSNSG--NTATLTISRVEAGDEADYYC | 12108 |
| 18182-H12 | VL3\|3h/JL2 | D--------DNDRPS | 11651 | GIPERFSGSNFG--NTATLIISRVEAGDEADYYC | 12109 |
| 18182-G8 | VL3\|3h/JL2 | D--------DNDRPS | 11652 | GIPERFSGSNSG--NTATLTISRVEAGDEADYYC | 12110 |
| 18182-E10 | VL3\|3h/JL2 | D--------DNDRPS | 11653 | GIPERFSGSNSG--NTATLTISRVEAGDEADFYC | 12111 |
| 18182-B12 | VL3\|3h/JL2 | D--------DNDRPS | 11654 | GIPERFSGSNSG--NTATLTISRVEAGDEADYYC | 12112 |
| 18182-E5 | VL3\|3h/JL2 | D--------DNDRPS | 11655 | GIPERFSGSNSG--NTATLTISRVEAGDEADYYC | 12113 |
| 18182-A4 | VL3\|3h/JL2 | D--------DNDRPS | 11656 | GIPERFSGSNFG--NTATLIISRVAAGDEADYYC | 12114 |
| 18182-E1 | VL3\|3h/JL2 | D--------DNDRPS | 11657 | GIPERFSGSNSG--NTATLTISRVEAGDEADYYC | 12115 |
| 18403-F12-AS | VL3\|3h/JL2 | D--------DNDRPS | 11658 | GIPERFSGSNFG--NTATLIISRVAAGDEADYYC | 12116 |
| 18403-G10-AS | VL3\|3h/JL2 | D--------DNDRPS | 11659 | GIPERFSGSNSG--NTATLTISRVEAGDEADYYC | 12117 |
| 03-F3-88-B3-F9_final | VL3\|3h/JL2 | D--------DADRPS | 11660 | GIPERFSGSNSG--NTATLTISRVEAGDEADYYC | 12118 |
| 18398-C7_final | VL3\|3h/JL2 | D--------DNDRPS | 11661 | GIPERFSGSNSG--NTATLTISRVEAGDEADYYC | 12119 |
| 18403-E11_AS_final | VL3\|3h/JL2 | D--------DNDRPS | 11662 | GIPERFSGSNSG--NTATLTISRVEAGDEADYYC | 12120 |

TABLE 59-continued

| | | LAMBDA_VARIABLE | | | |
|---|---|---|---|---|---|
| 18403-F12_final | VL3\|3h/JL2 | D--------DNDRPS | 11663 | GIPERFSGSNFG--NTATLIISRVAAGDEADYYC | 12121 |
| 18403-F12-AS_final | VL3\|3h/JL2 | D--------DNDRPS | 11664 | GIPERFSGSNFG--NTATLIISRVAAGDEADYYC | 12122 |
| 18403-G10_final | VL3\|3h/JL2 | D--------DNDRPS | 11665 | GIPERFSGSNSG--NTATLTISRVEAGDEADYYC | 12123 |
| 18403-G10-AS_final | VL3\|3h/JL2 | D--------DNDRPS | 11666 | GIPERFSGSNSG--NTATLTISRVEAGDEADYYC | 12124 |
| 18410-G10_final | VL3\|3h/JL2 | D--------DNDRPS | 11667 | GIPERFSGSNSG--NTATLTISRVEAGDEADYYC | 12125 |
| 18410-G10_AS_final | VL3\|3h/JL2 | D--------DNDRPS | 11668 | GIPERFSGSNSG--NTATLTISRVEAGDEADYYC | 12126 |
| VL3\|3h/JL3b | | Y--------DSDRPS | 11669 | GIPERFSGSNSG--NTATLTISRVEAGDEADYYC | 12127 |
| 18403-D8_final | VL3\|3h/JL3b | D--------DNDRPS | 11670 | GIPERFSGSNFG--NTATLIISRVEAGDEADYYC | 12128 |
| 18403-D8_AS_final | VL3\|3h/JL3b | D--------DNDRPS | 11671 | GIPERFSGSNFG--NTATLIISRVEAGDEADYYC | 12129 |

| | Germline | L_CDR3 | SEQ ID NO: | L_FR4 | SEQ ID NO: |
|---|---|---|---|---|---|
| | VL2\|2a2/JL2 | SSYTSS--------------------STLVV | 12515 | FGGGTKLTVL | 12976 |
| 18071-B1 | VL2\|2a2/JL2 | SSYTS--------------------SSTLV | 12516 | FGGGTKLTVL | 12977 |
| | VL1\|1g/JL2 | AAWDDS--------------------LSGVV | 12517 | FGGGTKLTVL | 12978 |
| 18072-G9 | VL1\|1g/JL2 | AAWDDS--------------------LSGVV | 12518 | FGGGTKLTVL | 12979 |
| | VL10\|10a/JL3b | SAWDSS--------------------LSAWV | 12519 | FGGGTKLTVL | 12980 |
| 18078-H6 | VL10\|10a/JL3b | SAWDSS--------------------LSAWV | 12520 | FGGGTKLTVL | 12981 |
| 18079-C8 | VL10\|10a/JL3b | SAWDSS--------------------LSAWV | 12521 | FGGGTKLTVL | 12982 |
| | VL2\|2c/JL2 | SSYAGS--------------------NNFVV | 12522 | FGGGTKLTVL | 12983 |
| 18082-F5 | VL2\|2c/JL2 | SSYAG--------------------SNNVV | 12523 | FGGGTKLTVL | 12984 |
| | VL10\|10a/JL2 | SAWDSS--------------------LSAVV | 12524 | FGGGTKLTVL | 12985 |
| 18090-H9 | VL10\|10a/JL2 | SAWDSS--------------------LSAVV | 12525 | FGGGTKLTVL | 12986 |
| | VL3\|3h/JL2 | QVWDSS--------------------SDHVV | 12526 | FGGGTKLTVL | 12987 |
| 18182-A3 | VL3\|3h/JL2 | QVWDSS--------------------SDHVV | 12527 | FGGGTKLTVL | 12988 |
| 18182-A5 | VL3\|3h/JL2 | QVWDSS--------------------SDHVV | 12528 | FGGGTKLTVL | 12989 |
| 18182-A6 | VL3\|3h/JL2 | QVWDSS--------------------SDHVV | 12529 | FGGGTKLTVL | 12990 |
| 18182-A7 | VL3\|3h/JL2 | QVWDSS--------------------SDHVV | 12530 | FGGGTKLTVL | 12991 |

TABLE 59-continued

| LAMBDA_VARIABLE | | | | | | |
|---|---|---|---|---|---|---|
| 18182-A8 | VL3\|3h/JL2 | QVWDSS--------------------SDHVV | 12531 | FGGGTKLTVL | 12992 |
| 18182-A11 | VL3\|3h/JL2 | QVWDSS--------------------SDHVV | 12532 | FGGGTKLTVL | 12993 |
| 18182-B1 | VL3\|3h/JL2 | QVWDSS--------------------SDHVV | 12533 | FGGGTKLTVL | 12994 |
| 18182-B4 | VL3\|3h/JL2 | QVWDSS--------------------SDHVV | 12534 | FGGGTKLTVL | 12995 |
| 18182-B6 | VL3\|3h/JL2 | QVWDSS--------------------SDHVV | 12535 | FGGGTKLTVL | 12996 |
| 18182-B7 | VL3\|3h/JL2 | QVWDSS--------------------SDHVV | 12536 | FGGGTKLTVL | 12997 |
| 18182-B10 | VL3\|3h/JL2 | QVWDSS--------------------SDHVV | 12537 | FGGGTKLTVL | 12998 |
| 18182-C2 | VL3\|3h/JL2 | QVWDSS--------------------SDHVV | 12538 | FGGGTKLTVL | 12999 |
| 18182-C3 | VL3\|3h/JL2 | QVWDSS--------------------SDHAV | 12539 | FGGGTKLTVL | 13000 |
| 18182-C4 | VL3\|3h/JL2 | QVWDSS--------------------SDHVV | 12540 | FGGGTKLTVL | 13001 |
| 18182-C5 | VL3\|3h/JL2 | QVWDSS--------------------SDHVV | 12541 | FGGGTKLTVL | 13002 |
| 18182-C10 | VL3\|3h/JL2 | QVWDSS--------------------SDHVV | 12542 | FGGGTKLTVL | 13003 |
| 18182-C12 | VL3\|3h/JL2 | QVWDSS--------------------SDHVV | 12543 | FGGGTKLTVL | 13004 |
| 18182-D4 | VL3\|3h/JL2 | QVWDSS--------------------SDHVV | 12544 | FGGGTKLTVL | 13005 |
| 18182-D8 | VL3\|3h/JL2 | QVWDSS--------------------SDHVI | 12545 | FGGGTKLTVL | 13006 |
| 18182-D9 | VL3\|3h/JL2 | QVWDSN--------------------SDHVV | 12546 | FGGGTKLTVL | 13007 |
| 18182-D11 | VL3\|3h/JL2 | QVWDSS--------------------SDHVI | 12547 | FGGGTKLTVL | 13008 |
| 18182-E2 | VL3\|3h/JL2 | QVWDSS--------------------SDHVV | 12548 | FGGGTKLTVL | 13009 |
| 18182-E3 | VL3\|3h/JL2 | QVWDSS--------------------SDHVV | 12549 | FGGGTKLTVL | 13010 |
| 18182-E8 | VL3\|3h/JL2 | QVWDSS--------------------SDHVV | 12550 | FGGGTKLTVL | 13011 |
| 18182-E11 | VL3\|3h/JL2 | QVWDSS--------------------SDHVV | 12551 | FGGGTKLTVL | 13012 |
| 18182-F1 | VL3\|3h/JL2 | QVWDSS--------------------SDHVV | 12552 | FGGGTKLTVL | 13013 |
| 18182-F6 | VL3\|3h/JL2 | QVWDSS--------------------SDHVM | 12553 | FGGGTKLTVL | 13014 |
| 18182-F8 | VL3\|3h/JL2 | QVWDSS--------------------SDHVV | 12554 | FGGGTKLTVL | 13015 |
| 18182-G3 | VL3\|3h/JL2 | QVWDSS--------------------SDHVV | 12555 | FGGGTKLTVL | 13016 |
| 18182-G4 | VL3\|3h/JL2 | QVWDSS--------------------SDHVV | 12556 | FGGGTKLTVL | 13017 |

TABLE 59-continued

| | | LAMBDA_VARIABLE | | | |
|---|---|---|---|---|---|
| 18182-G5 | VL3\|3h/JL2 | QVWDSS--------------------SDHVV | 12557 | FGGGTKLTVL | 13018 |
| 18182-G9 | VL3\|3h/JL2 | QVWDSS--------------------SDHVV | 12558 | FGGGTKLTVL | 13019 |
| 18182-G11 | VL3\|3h/JL2 | QVWDSS--------------------SDHVV | 12559 | FGGGTKLTVL | 13020 |
| 18182-H5 | VL3\|3h/JL2 | QVWDSS--------------------SDHVV | 12560 | FGGGTKLTVL | 13021 |
| 18093-B11 | VL3\|3h/JL2 | QVWDSS--------------------DHHVV | 12561 | FGGGTKLTVL | 13022 |
| 18182-B5 | VL3\|3h/JL2 | QVWDSS--------------------SDHVV | 12562 | FGGGTKLTVL | 13023 |
| 18182-H9 | VL3\|3h/JL2 | QVWDSS--------------------SDHVV | 12563 | FGGGTKLTVL | 13024 |
| 18182-E6 | VL3\|3h/JL2 | QVWDSS--------------------SDHVV | 12564 | FGGGTKLTVL | 13025 |
| 18182-G6 | VL3\|3h/JL2 | QVWDSS--------------------SDHVV | 12565 | FGGGTKLTVL | 13026 |
| 18182-G2 | VL3\|3h/JL2 | QVWDSS--------------------SDHVI | 12566 | FGGGTKLTVL | 13027 |
| 18182-H12 | VL3\|3h/JL2 | QVWDSS--------------------SDHVV | 12567 | FGGGTKLTVL | 13028 |
| 18182-G8 | VL3\|3h/JL2 | QVWDSS--------------------SDHVV | 12568 | FGGGTKLTVL | 13029 |
| 18182-E10 | VL3\|3h/JL2 | QVWDSS--------------------SDHVV | 12569 | FGGGTKLTVL | 13030 |
| 18182-B12 | VL3\|3h/JL2 | QVWDYS--------------------SDHVV | 12570 | FGGGTKLTVL | 13031 |
| 18182-E5 | VL3\|3h/JL2 | QVWDYS--------------------SDHVV | 12571 | FGGGTKLTVL | 13032 |
| 18182-A4 | VL3\|3h/JL2 | QVWDSS--------------------SDHVV | 12572 | FGGGTKLTVL | 13033 |
| 18182-E1 | VL3\|3h/JL2 | QVWDSS--------------------SDHVV | 12573 | FGGGTKLTVL | 13034 |
| 18403-F12-AS | VL3\|3h/JL2 | QVWDYR--------------------YLSQV | 12574 | FGGGTKLTVL | 13035 |
| 18403-G10-AS | VL3\|3h/JL2 | QVWDYS--------------------GQRQV | 12575 | FGGGTKLTVL | 13036 |
| 03-F3-88-B3-F9_final | VL3\|3h/JL2 | QVWDAS--------------------AGYGVV | 12576 | FGGGTKLTVL | 13037 |
| 18398-C7_final | VL3\|3h/JL2 | QVWDYS--------------------PLRHV | 12577 | FGGGTKLTVL | 13038 |
| 18403-E11_AS_final | VL3\|3h/JL2 | QVWDYY--------------------SNRAV | 12578 | FGGGTKLTVL | 13039 |
| 18403-F12_final | VL3\|3h/JL2 | QVWDYR--------------------YLSQV | 12579 | FGGGTKLTVL | 13040 |
| 18403-F12-AS_final | VL3\|3h/JL2 | QVWDYR--------------------YLSQV | 12580 | FGGGTKLTVL | 13041 |
| 18403-G10_final | VL3\|3h/JL2 | QVWDYS--------------------GQRQV | 12581 | FGGGTKLTVL | 13042 |
| 18403-G10-AS_final | VL3\|3h/JL2 | QVWDYS--------------------GQRQV | 12582 | FGGGTKLTVL | 13043 |

TABLE 59-continued

| | | LAMBDA_VARIABLE | | | | |
|---|---|---|---|---|---|---|
| 18410-G10_final | VL3\|3h/JL2 | QVWDYV--------------------APRHV | 12583 | FGGGTKLTVL | 13044 |
| 18410-G10_AS_final | VL3\|3h/JL2 | QVWDYV--------------------APRHV | 12584 | FGGGTKLTVL | 13045 |
| | VL3\|3h/JL3b | QVWDSS--------------------SDHWV | 12585 | FGGGTKLTVL | 13046 |
| 18403-D8_final | VL3\|3h/JL3b | QVWDYR--------------------TLDWV | 12586 | FGGGTKLTVL | 13047 |
| 18403-D8_AS_final | VL3\|3h/JL3b | QVWDYR--------------------TLDWV | 12587 | FGGGTKLTVL | 13048 |

TABLE 60

| | Germline | H_FR1 | SEQ ID NO: | H_CDR1 | SEQ ID NO: | H_FR2 | SEQ ID NO: |
|---|---|---|---|---|---|---|---|
| | VH1\|1-f/D2\|2-15\|RF3/JH4 | EVQLVQS-GAEVKKPGATVKISCKVSG-YTFT | 10298 | D-----YYMH | 10756 | WVQQAPGKGLEWMG | 11214 |
| 17724-C9 | VH1\|1-f/D2\|2-15\|RF3/JH4 | EVQLLEQSGPELVKPGASVKISCKASG-YAFS | 10299 | K-----SWMN | 10757 | WVKQRPGKGLEWIG | 11215 |
| | VH1\|1-e/D5\|5-18\|RF3/JH4 | QVQLVQS-GAEVKKPGSSVKVSCKASG-GTFS | 10300 | S-----YAIS | 10758 | WVRQAPGQGLEWMG | 11216 |
| 17724-G6 | VH1\|1-e/D5\|5-18\|RF3/JH4 | EVQLLEQSGPELVKPGASVKISCKASD-YTFS | 10301 | K-----SWMN | 10759 | WVKQRPGEGLEWIG | 11217 |
| | VH1\|1-e/D1\|1-1\|RF2/JH3 | QVQLVQS-GAEVKKPGSSVKVSCKASG-GTFS | 10302 | S-----YAIS | 10760 | WVRQAPGQGLEWMG | 11218 |
| 17731-H8 | VH1\|1-e/D1\|1-1\|RF2/JH3 | EVQLLEQSGPELVKPGASVKISCKASG-YAFS | 10303 | S-----SWMN | 10761 | WVKQRPGKGLEWIG | 11219 |
| | VH1\|1-08/D5\|5-18\|RF3/JH6 | QVQLVQS-GAEVKKPGASVKVSCKASG-YTFT | 10304 | S-----YDIN | 10762 | WVRQATGQGLEWMG | 11220 |
| 17732-A8 | VH1\|1-08/D5\|5-18\|RF3/JH6 | EVQLLES-GAEVKKPGASVKVSCKASG-YTFT | 10305 | S-----YDIN | 10763 | WVRQATGQGLEWMG | 11221 |
| 17780-D12 | VH1\|1-08/D5\|5-18\|RF3/JH6 | EVQLLES-GAEVKKPGASVKVSCKASG-YTFT | 10306 | S-----YDIN | 10764 | WVRQATGQGLEWMG | 11222 |
| | VH1\|1-08/D5\|5-12\|RF3/JH6 | QVQLVQS-GAEVKKPGASVKVSCKASG-YTFT | 10307 | S-----YDIN | 10765 | WVRQATGQGLEWMG | 11223 |
| 17745-E5 | VH1\|1-08/D5\|5-12\|RF3/JH6 | EVQLLES-GAEVKKPGASVKVSCKASG-YTFT | 10308 | S-----YDIN | 10766 | WVRQATGQGLEWMG | 11224 |
| 17777-B4 | VH1\|1-08/D5\|5-12\|RF3/JH6 | EVQLLES-GAEVKKPGASVKVSCMASG-YTFT | 10309 | G-----YDIN | 10767 | WVRQATGQGLEWMG | 11225 |
| 17814-D9 | VH1\|1-08/D5\|5-12\|RF3/JH6 | EVQLLES-GAEVKKPGASVKVSCKASG-YTFT | 10310 | S-----YDIN | 10768 | WVRQATGQGLEWMG | 11226 |
| | VH4\|4-34/D5\|5-18\|RF3/JH6 | QVQLQQW-GAGLLKPSETLSLTCAVYG-GSFS | 10311 | G-----YYWS | 10769 | WIRQPPGKGLEWIG | 11227 |
| 17745-E8 | VH4\|4-34/D5\|5-18\|RF3/JH6 | EVQLLEW-GAGLLKPSETLSLTCAVYG-GSFS | 10312 | G-----YYWN | 10770 | WIRQPPGKGLEWIG | 11228 |
| 17777-C5 | VH4\|4-34/D5\|5-18\|RF3/JH6 | EVQLLEW-GAGLLKPSETLSLTCAVYG-GSFS | 10313 | G-----YYWT | 10771 | WIRQPPGKGLEWIG | 11229 |
| 17778-C9 | VH4\|4-34/D5\|5-18\|RF3/JH6 | EVQLLEW-GAGLLKPSETLSLTCAVYG-GSFS | 10314 | G-----YYWN | 10772 | WIRQPPGKGLEWIG | 11230 |

TABLE 60-continued

| HEAVY_VARIABLE | | | | | | | |
|---|---|---|---|---|---|---|---|
| 17780-E6 | VH4\|4-34/D5\|5-18\|RF3/JH6 | EVQLLEW-GAGLLKPS ETLSLTCAVYG-GSFS | 10315 | G-----YYWN | 10773 | WIRQPPGKGLEWI G | 11231 |
| 17781-B3 | VH4\|4-34/D5\|5-18\|RF3/JH6 | EVQLLEW-GAGLLKPS ETLSLTCAVYG-GSFS | 10316 | G-----FYWN | 10774 | WIRQPPGKGLEWI G | 11232 |
| 17781-H12 | VH4\|4-34/D5\|5-18\|RF3/JH6 | EVQLLEW-GAGLLKPS ETLSLTCAVYG-GSFS | 10317 | G-----YYWN | 10775 | WIRQPPGKGLEWI G | 11233 |
| 17783-C11 | VH4\|4-34/D5\|5-18\|RF3/JH6 | EVQLLEW-GAGLLKPS ETLSLTCAVYG-GSFS | 10318 | G-----YYWS | 10776 | WIRQPPGKGLEWI G | 11234 |
| 17783-G10 | VH4\|4-34/D5\|5-18\|RF3/JH6 | EVQLLEW-GAGLLKPS ETLSLTCAVYG-GSFS | 10319 | G-----YYWS | 10777 | WIRQPPGKGLEWI G | 11235 |
| 17813-E3 | VH4\|4-34/D5\|5-18\|RF3/JH6 | EVQLLEW-GAGLLKPS ETLSLTCAVYG-GSLS | 10320 | G-----YYWS | 10778 | WIRQPPGKGLEWI G | 11236 |
| 17813-F1 | VH4\|4-34/D5\|5-18\|RF3/JH6 | EVQLLEW-GAGLLKPS ETLSLTCGVYG-GSFS | 10321 | G-----YYWN | 10779 | WIRQPPGKGLEWI G | 11237 |
| VH3\|3-23/D3\|3-9\|RF1/JH4 | | EVQLLES-GGGLVQPG GSLRLSCAASG-FTFS | 10322 | S-----YAMS | 10780 | WVRQAPGKGLEWV S | 11238 |
| 17745-G8 | VH3\|3-23/D3\|3-9\|RF1/JH4 | EVQLLES-GGGLVQPG GSLRLSCAASG-FTFS | 10323 | S-----YAMS | 10781 | WVRQAPGKGLEWV S | 11239 |
| 17777-C4 | VH3\|3-23/D3\|3-9\|RF1/JH4 | EVQLLES-GGGLVQPG GSLRLSCAASG-FTFS | 10324 | S-----YAMS | 10782 | WVRQAPGKGLEWV S | 11240 |
| 18072-D6 | VH3\|3-23/D3\|3-9\|RF1/JH4 | EVQLLES-GGGLVQPG GSLRLSCAASG-FTFS | 10325 | S-----YAMS | 10783 | WVRQAPGKGLEWV S | 11241 |
| 18084-E4 | VH3\|3-23/D3\|3-9\|RF1/JH4 | EVQLLES-GGGLVQPG GSLRLSCAASG-FTFS | 10326 | S-----YAMS | 10784 | WVRQAPGKGLEWV S | 11242 |
| 18088-B10 | VH3\|3-23/D3\|3-9\|RF1/JH4 | EVQLLES-GGGLVQPG GSLRLSCAASG-FTFS | 10327 | S-----YAMS | 10785 | WVRQAPGKGLEWV S | 11243 |
| VH3\|3-30.3/D1\|1- | | QVQLVES-GGGVVQPG RSLRLSCAASG-FTFS | 10328 | S-----YAMH | 10786 | WVRQAPGKGLEWV A | 11244 |
| 17748-D12 | VH3\|3-30.3/D1\|1-1\|RF2/JH6 | EVQLLES-GGGVVQPG RSLRLSCAASG-FTFR | 10329 | S-----YRMH | 10787 | WVRQAPGKGLEWV A | 11245 |
| 18079-C8 | VH3\|3-30.3/D1\|1-1\|RF2/JH6 | EVQLLES-GGGVVQPG RSLRLSCAASG-FTFS | 10330 | S-----YGMH | 10788 | WVRQAPGKGLEWV A | 11246 |
| VH4\|4-34/D5\|5-12\|RF3/JH6 | | QVQLQQW-GAGLLKPS ETLSLTCAVYG-GSFS | 10331 | G-----YYWS | 10789 | WIRQPPGKGLEWI G | 11247 |
| 17753-F4 | VH4\|4-34/D5\|5-12\|RF3/JH6 | EVQLLEW-GAGLLKPS ETLSLTCAVYG-GSFS | 10332 | G-----YYWN | 10790 | WIRQPPGKGLEWI G | 11248 |
| 17778-F1 | VH4\|4-34/D5\|5-12\|RF3/JH6 | EVQLLEW-GAGLLKPS ETLSLTCAVYG-GSFS | 10333 | G-----YYWN | 10791 | WIRQPPGKGLEWI G | 11249 |
| 17778-H8 | VH4\|4-34/D5\|5-12\|RF3/JH6 | EVQLLEW-GAGLLKPS ETLSLTCGVYG-GSFS | 10334 | G-----YYWS | 10792 | WIRQPPGKGLEWI G | 11250 |
| 17779-E1 | VH4\|4-34/D5\|5-12\|RF3/JH6 | EVQLLEW-GAGLLKPS ETLSLTCAVYG-GSFS | 10335 | G-----YYWS | 10793 | WIRQPPGKGLEWI G | 11251 |
| 17784-C11 | VH4\|4-34/D5\|5-12\|RF3/JH6 | EVQLLEW-GAGLLKPS ETLSLTCAVYG-GSFS | 10336 | G-----YYWS | 10794 | WIRQPPGKGLEWI G | 11252 |
| 17784-H5 | VH4\|4-34/D5\|5-12\|RF3/JH6 | EVQLLEW-GAGLLKPS ETLSLTCAVYG-GSFS | 10337 | G-----YYWS | 10795 | WIRQPPGKGLEWI G | 11253 |
| 17785-D12 | VH4\|4-34/D5\|5-12\|RF3/JH6 | EVQLLEW-GAGLLKPS ETLSLTCAVYG-GSFS | 10338 | G-----YYWN | 10796 | WIRQPPGKGLEWI G | 11254 |
| 17813-E5 | VH4\|4-34/D5\|5-12\|RF3/JH6 | EVQLLEW-GAGLLKPS ETLSLTCAVYG-GSFS | 10339 | G-----YYWS | 10797 | WIRQPPGKGLEWI G | 11255 |

TABLE 60-continued

HEAVY_VARIABLE

| | | | | | | | |
|---|---|---|---|---|---|---|---|
| 18088-E4 | VH4\|4-34/D5\|5-12\|RF3/JH6 | EVQLLEW-GAGLLKPS ETLSLTCAVYG-GSFS | 10340 | G-----YYWS | 10798 | WIRQPPGKGLEWI G | 11256 |
| VH3\|3-23/D6\|6-19\|RF1/JH6 | | EVQLLES-GGGLVQPG GSLRLSCAASG-FTFS | 10341 | S-----YAMS | 10799 | WVRQAPGKGLEWV S | 11257 |
| 17771-D2 | VH3\|3-23/D6\|6-19\|RF1/JH6 | EVQLLES-GGGLVQPG GSLRLSCAASG-FTFS | 10342 | S-----YAMS | 10800 | WVRQAPGRGLEWV S | 11258 |
| 18074-G12 | VH3\|3-23/D6\|6-19\|RF1/JH6 | EVQLLES-GGGLVQPG GSLRLSCAASG-FTFS | 10343 | S-----YAMS | 10801 | WVRQAPGRGLEWV S | 11259 |
| 18093-E2 | VH3\|3-23/D6\|6-19\|RF1/JH6 | EVQLLES-GGGLVQPG GSLRLSCAASG-FTFT | 10344 | S-----YAMS | 10802 | WVRQAPGKGLEWV S | 11260 |
| 18089-B2 | VH3\|3-23/D6\|6-19\|RF1/JH6 | EVQLLES-GGGLVQPG GSLRLSCAASG-FTFS | 10345 | S-----YAMS | 10803 | WVRQAPGRGLEWV S | 11261 |
| VH3\|3-23/D7\|7-27\|RF1/JH6 | | EVQLLES-GGGLVQPG GSLRLSCAASG-FTFS | 10346 | S-----YAMS | 10804 | WVRQAPGKGLEWV S | 11262 |
| 17779-D11 | VH3\|3-23/D7\|7-27\|RF1/JH6 | EVQLLES-GGGLVQPG GSLRLSCAASG-FTFS | 10347 | S-----YGMS | 10805 | WVRQAPGKGLEWV S | 11263 |
| 18089-H12 | VH3\|3-23/D7\|7-27\|RF1/JH6 | EVQLLES-GGGLVQPG GSLRLSCAASG-FTFS | 10348 | N-----YAMS | 10806 | WVRQAPGKGLEWV S | 11264 |
| 18093-F5 | VH3\|3-23/D7\|7-27\|RF1/JH6 | EVQLLES-GGGLVQPG GSLRLSCAASG-FTLS | 10349 | I-----YGMS | 10807 | WVRQAPGKGLEWV S | 11265 |
| VH3\|3-23/D5\|5-18\|RF1/JH6 | | EVQLLES-GGGLVQPG GSLRLSCAASG-FTFS | 10350 | S-----YAMS | 10808 | WVRQAPGKGLEWV S | 11266 |
| 17784-B9 | VH3\|3-23/D5\|5-18\|RF1/JH6 | EVQLLES-GGGLVQPG GSLRLSCAASG-FTFS | 10351 | S-----YAMS | 10809 | WVRQAPGKGLEWV S | 11267 |
| 17784-C7 | VH3\|3-23/D5\|5-18\|RF1/JH6 | EVQLLES-GGGLVQPG GSLRLSCAASG-FTFS | 10352 | S-----YGMS | 10810 | WVRQAPGKGLEWV S | 11268 |
| 18080-H9 | VH3\|3-23/D5\|5-18\|RF1/JH6 | EVQLLES-GGGLVQPG GSLRLSCAASG-FTFS | 10353 | S-----YAMS | 10811 | WVRQAPGKGLEWV S | 11269 |
| VH4\|4-30.1/D3\|3- | | QVQLQES-GPGLVKPS QTLSLTCTVSG-GSIS | 10354 | SG---GYYWS | 10812 | WIRQHPGKGLEWI G | 11270 |
| 17784-G10 | VH4\|4-30.1/D3\|3-10\|RF1/JH6 | EVQLLES-GPGLVKPS QTLSLTCTVSG-DSIS | 10355 | RD---PYYWS | 10813 | WIRQHPGKGLEWI G | 11271 |
| 18080-C5 | VH4\|4-30.1/D3\|3-10\|RF1/JH6 | EVQLLES-GPGLVKPS QTLSLTCTVSG-GSIS | 10356 | SG---DYYWS | 10814 | WIRQHPGKGLEWI G | 11272 |
| 18179-A3 | VH4\|4-30.1/D3\|3-10\|RF1/JH6 | EVQLLES-GPGLVKPS QTLSLTCTVSG-DSIS | 10357 | SN---PYYWS | 10815 | WIRQLPGKGLEWI G | 11273 |
| 18179-A9 | VH4\|4-30.1/D3\|3-10\|RF1/JH6 | EVQLLES-GPGLVKPS QTLSLTCTVSG-GAIS | 10358 | SG---DYYWS | 10816 | WIRQHPGKGLEWI G | 11274 |
| 18179-A10 | VH4\|4-30.1/D3\|3-10\|RF1/JH6 | EVQLLES-GPGLVKPS QTLSLTCTVSG-GAIS | 10359 | SG---DYYWS | 10817 | WIRQHPGKGLEWI G | 11275 |
| 18179-C4 | VH4\|4-30.1/D3\|3-10\|RF1/JH6 | EVQLLES-GPGLVKPS QTLSLTCTVSG-GAIS | 10360 | SG---DYYWS | 10818 | WIRQHPGKGLEWI G | 11276 |
| 18179-C6 | VH4\|4-30.1/D3\|3-10\|RF1/JH6 | EVQLLES-GPGLVKPS QTLSLTCTVSG-GAIS | 10361 | SG---DYYWS | 10819 | WIRQHPGKGLEWI G | 11277 |
| 18179-C10 | VH4\|4-30.1/D3\|3-10\|RF1/JH6 | EVQLLES-GPGLVKPS QTLSLTCTVSG-DSIS | 10362 | SN---PYYWS | 10820 | WIRQHPGKGLEWI G | 11278 |

TABLE 60-continued

| HEAVY_VARIABLE | | | | | | | |
|---|---|---|---|---|---|---|---|
| 18179-F4 | VH4\|4-30.1/D3\|3-10\|RF1/JH6 | EVQLLES-GPGLVKPS QTLSLTCTVSG-DSIS | 10363 | SN---PYYWS | 10821 | WIRQLPGKGLEWIG | 11279 |
| 18179-F6 | VH4\|4-30.1/D3\|3-10\|RF1/JH6 | EVQLLES-GPGLVKPS QTLSLTCTVSG-GAIS | 10364 | SG---DYYWS | 10822 | WIRQHPGKGLEWIG | 11280 |
| 18179-G8 | VH4\|4-30.1/D3\|3-10\|RF1/JH6 | EVQLLES-GPGLVKPS QTLSLTCTVSG-GAIS | 10365 | SG---DYYWS | 10823 | WIRQHPGKGLEWIG | 11281 |
| 18179-G9 | VH4\|4-30.1/D3\|3-10\|RF1/JH6 | EVQLLES-GPGLVKPS QTLSLTCTVSG-DSIS | 10366 | SN---PYYWS | 10824 | WIRQHPGMGLEWIG | 11282 |
| 18179-H6 | VH4\|4-30.1/D3\|3-10\|RF1/JH6 | EVQLLES-GPGLVKPS QTLSLTCTVSG-GAIS | 10367 | SG---DYYWS | 10825 | WIRQHPGKGLEWIG | 11283 |
| 18181-A11 | VH4\|4-30.1/D3\|3-10\|RF1/JH6 | EVQLLES-GPGLVKPS QTLSLTCTVSG-DSIS | 10368 | SN---PYYWS | 10826 | WIRQHPGKGLEWIG | 11284 |
| 18181-C6 | VH4\|4-30.1/D3\|3-10\|RF1/JH6 | EVQLLES-GPGLVKPS QTLSLTCTVSG-DSIS | 10369 | SN---PYYWS | 10827 | WIRQHPGKGLEWIG | 11285 |
| 18181-G10 | VH4\|4-30.1/D3\|3-10\|RF1/JH6 | EVQLLES-GPGLVKPS QTLSLTCTVSG-DSIS | 10370 | SN---PYYWS | 10828 | WIRQLPGKGLEWIG | 11286 |
| 18181-E2 | VH4\|4-30.1/D3\|3-10\|RF1/JH6 | EVQLLES-GPGLVKPS QTLSLTCTVSG-DSIS | 10371 | SN---PYYWS | 10829 | WIRQHPGKGLEWIG | 11287 |
| 18181-C9 | VH4\|4-30.1/D3\|3-10\|RF1/JH6 | EVQLLES-GPGLVKPS QTLSLTCTVSG-DSIS | 10372 | SN---PYYWS | 10830 | WIRQLPGKGLEWIG | 11288 |
| VH3\|3-23/D1\|1-1\|RF1/JH6 | | EVQLLES-GGGLVQPG GSLRLSCAASG-FTFS | 10373 | S-----YAMS | 10831 | WVRQAPGKGLEWVS | 11289 |
| 17813-D8 | VH3\|3-23/D1\|1-1\|RF1/JH6 | EVQLLES-GGGLVQPG GSLRLSCAASG-FTFS | 10374 | S-----FAMS | 10832 | WVRQAPGKGLEWVS | 11290 |
| VH3\|3-33/D3\|3-10\|RF2/JH6 | | QVQLVES-GGGVVQPG RSLRLSCAASG-FTFS | 10375 | S-----YGMH | 10833 | WVRQAPGKGLEWVA | 11291 |
| 18071-B1 | VH3\|3-33/D3\|3-10\|RF2/JH6 | EVQLLES-GGGVVQPG RSLRLSCAASG-FTFS | 10376 | R-----YGMD | 10834 | WVRQAPGKGLEWVA | 11292 |
| 18082-F5 | VH3\|3-33/D3\|3-10\|RF2/JH6 | EVQLLES-GGGVVQPG RSLRLSCAASG-FTFS | 10377 | R-----YGMD | 10835 | WVRQAPGKGLEWVA | 11293 |
| VH1\|1-08/D7\|7-27\|RF3/JH6 | | QVQLVQS-GAEVKKPG ASVKVSCKASG-YTFT | 10378 | S-----YDIN | 10836 | WVRQATGQGLEWMG | 11294 |
| 18071-c4 | VH1\|1-08/D7\|7-27\|RF3/JH6 | EVQLLES-GAEVKKPG ASVKVSCKASG-YTFT | 10379 | S-----YDIN | 10837 | WVRQATGQGLEWMG | 11295 |
| 18071-D4 | VH1\|1-08/D7\|7-27\|RF3/JH6 | EVQLLES-GAEVKKPG ASVKVSCKASG-YTFT | 10380 | S-----YDIN | 10838 | WVRQATGQGLEWMG | 11296 |
| 18079-H4 | VH1\|1-08/D7\|7-27\|RF3/JH6 | EVQLLES-GAEVKKPG ASVKVSCKASG-YTFT | 10381 | S-----YDIN | 10839 | WVRQATGQGLEWMG | 11297 |
| 18079-H11 | VH1\|1-08/D7\|7-27\|RF3/JH6 | EVQLLES-GAEVKKPG ASVKVSCKASG-YTFT | 10382 | S-----YDIN | 10840 | WVRQATGQGLEWMG | 11298 |
| 18086-H4 | VH1\|1-08/D7\|7-27\|RF3/JH6 | EVQLLES-GAEVKKPG ASVKVSCKASG-YTFT | 10383 | S-----YDIN | 10841 | WVRQATGQGLEWMG | 11299 |
| VH3\|3-21/D6\|6-6\|RF2/JH6 | | EVQLVES-GGGLVKPG GSLRLSCAASG-FTFS | 10384 | S-----YSMN | 10842 | WVRQAPGKGLEWVS | 11300 |
| 18072-G9 | VH3\|3-21/D6\|6-6\|RF2/JH6 | EVQLLES-GGGLVKPG GSLRLSCAASG-FTFS | 10385 | G-----YSMN | 10843 | WVRQAPGKGLEWVS | 11301 |

TABLE 60-continued

| | | HEAVY_VARIABLE | | | | | |
|---|---|---|---|---|---|---|---|
| VH3\|3-30.3/D3\|3- | | QVQLVES-GGGVVQPG RSLRLSCAASG-FTFS | 10386 | S-----YAMH | 10844 | WVRQAPGKGLEWV A | 11302 |
| 18078-H6 | VH3\|3-30.3/D3\|3-10\|RF2/JH6 | EVQLLES-GGGVVQPG RSLRLSCAASG-FTFS | 10387 | R-----YGMQ | 10845 | WVRQAPGKGLEWV A | 11303 |
| 18090-H9 | VH3\|3-30.3/D3\|3-10\|RF2/JH6 | EVQLLES-GGGVVQPG RSLRLSCAASG-FTFS | 10388 | R-----YGMD | 10846 | WVRQAPGKGLEWV A | 11304 |
| VH4\|4-59/D3\|3-3\|RF3/JH4 | | QVQLQES-GPGLVKPS ETLSLTCTVSG-GSIS | 10389 | S-----YYWS | 10847 | WIRQPPGKGLEWI G | 11305 |
| 18081-A6 | VH4\|4-59/D3\|3-3\|RF3/JH4 | EVQLLES-GPGLVKPS ETLSLTCTVSG-DSIS | 10390 | SS---RYYWG | 10848 | WIRQPPGKGLEWI G | 11306 |
| 18081-B9 | VH4\|4-59/D3\|3-3\|RF3/JH4 | EVQLLES-GPGLVKPS ETLSLTCTVSG-DSIS | 10391 | SS---RYYWG | 10849 | WIRQPPGKGLEWI G | 11307 |
| 18081-E7 | VH4\|4-59/D3\|3-3\|RF3/JH4 | EVQLLES-GPGLVKPS ETLSLTCTVSG-DSIS | 10392 | SS---RYYWG | 10850 | WIRQPPGKGLEWI G | 11308 |
| 18081-B9_final | VH4\|4-59/D3\|3-3\|RF3/JH4 | QVQLQES-GPGLVKPS ETLSLTCTVSG-DSIS | 10393 | SS---RYYWG | 10851 | WIRQPPGKGLEWI G | 11309 |
| VH6\|6-01/D3\|3-10\|RF1/JH6 | | QVQLQQS-GPGLVKPS QTLSLTCAISG-DSVS | 10394 | SN---SAAWN | 10852 | WIRQSPSRGLEWL G | 11310 |
| 18081-B5 | VH6\|6-01/D3\|3-10\|RF1/JH6 | EVQLLES-GPGQVKPS QTLSLTCAISG-DSVS | 10395 | SN---SAAWN | 10853 | WIRQSPSRGLEWL G | 11311 |
| VH4\|4-b/D3\|3-3\|RF3/JH5 | | QVQLQES-GPGLVKPS ETLSLTCAVSG-YSIS | 10396 | SG----YYWG | 10854 | WIRQPPGKGLEWI G | 11312 |
| 18081-C10 | VH4\|4-b/D3\|3-3\|RF3/JH5 | EVQLLES-GPGLVKPS ETLSLTCIVSG-VSIS | 10397 | SS---RSYWG | 10855 | WIRQPPGKGLEWI G | 11313 |
| VH2\|2-70/D2\|2-15\|RF1/JH5 | | QVTLKES-GPALVKPT QTLTLTCTFSG-FSLS | 10398 | TS---GMRVS | 10856 | WIRQPPGKALEWL A | 11314 |
| 18081-D6 | VH2\|2-70/D2\|2-15\|RF1/JH5 | EVQLLES-GPALVKPT QTLTLTCTFSG-FSFT | 10399 | TH---KMGVD | 10857 | WIRQPPGKALEWL A | 11315 |
| 18089-C8 | VH2\|2-70/D2\|2-15\|RF1/JH5 | EVQLLES-GPALVKPT QTLTLSCSFSG-FSLS | 10400 | TN---KMAVG | 10858 | WIRQPPGKALEWL A | 11316 |
| 18081-H11 | VH2\|2-70/D2\|2-15\|RF1/JH5 | EVQLLES-GPALVKPT QTLTLTCTFSG-FSFT | 10401 | TH---KMGVD | 10859 | WIRQPPGKALEWL A | 11317 |
| VH3\|3-23/D1\|1-26\|RF1/JH6 | | EVQLLES-GGGLVQPG GSLRLSCAASG-FTFS | 10402 | S-----YAMS | 10860 | WVRQAPGKGLEWV S | 11318 |
| 18081-D12 | VH3\|3-23/D1\|1-26\|RF1/JH6 | EVQLLES-GGGLVKPG GSLRLSCAASG-FTFS | 10403 | I-----YALS | 10861 | WVRQAPGKGLEWV S | 11319 |
| VH4\|4-59/D3\|3-3\|RF3/JH5 | | QVQLQES-GPGLVKPS ETLSLTCTVSG-GSIS | 10404 | S-----YYWS | 10862 | WIRQPPGKGLEWI G | 11320 |
| 18089-B8 | VH4\|4-59/D3\|3-3\|RF3/JH5 | EVQLLES-GPGLVKPS ETLSLTCIVSG-GSIS | 10405 | SS---RSYWG | 10863 | WIRQPPGKGLEWI G | 11321 |
| VH2\|2-05/D2\|2-15\|RF1/JH5 | | QITLKES-GPTLVKPT QTLTLTCTFSG-FSLS | 10406 | TS---GVGVG | 10864 | WIRQPPGKALEWL A | 11322 |
| 18089-G7 | VH2\|2-05/D2\|2-15\|RF1/JH5 | EVQLLES-GPVLVKPT QTLTLTCTFSG-FSFT | 10407 | TH---KMGVD | 10865 | WIRQPPGKALEWL A | 11323 |
| 18089-D11 | VH2\|2-05/D2\|2-15\|RF1/JH5 | EVQLLES-GPVLVKPT QTLTLTCTFSG-FSFT | 10408 | TH---KMGVD | 10866 | WIRQPPGKALEWL A | 11324 |
| 18089-C9 | VH2\|2-05/D2\|2-15\|RF1/JH5 | EVQLLES-GPTLVKPT QTLTLTCTFSG-FSFT | 10409 | TH---KMGVD | 10867 | WIRQPPGKALEWL A | 11325 |
| 18089-D8 | VH2\|2-05/D2\|2-15\|RF1/JH5 | EVQLLES-GPMLVKPT QTLTLTCTFSG-FSFT | 10410 | TH---KMGVD | 10868 | WIRQPPGKALEWL A | 11326 |

TABLE 60-continued

| HEAVY_VARIABLE | | | | | | | |
|---|---|---|---|---|---|---|---|
| 18081-F9 | VH2\|2-05/D2\|2-15\|RF1/JH5 | EVQLLES-GPMLVKPT QTLTLTCTFSG-FSFT | 10411 | TH---KMGVD | 10869 | WIRQPPGKALEWL A | 11327 |
| 18081-B6 | VH2\|2-05/D2\|2-15\|RF1/JH5 | EVQLLES-GPMLVKPT QTLTLTCTFSG-FSFT | 10412 | TH---KMGVD | 10870 | WIRQPPGKALEWL A | 11328 |
| 18409-F12_final | VH2\|2-05/D2\|2-15\|RF1/JH5 | QITLKES-GPALVKPT QTLTLTCTFSG-FSFT | 10413 | TH---KMGVD | 10871 | WIRQPPGKALEWL A | 11329 |
| 18409-G10_final | VH2\|2-05/D2\|2-15\|RF1/JH5 | QITLKES-GPTLVKPT QTLTLTCTFSG-FSFT | 10414 | TH---KMGVD | 10872 | WIRQPPGKALEWL A | 11330 |
| 18409-H7_final | VH2\|2-05/D2\|2-15\|RF1/JH5 | QITLKES-GPALVKPT QTLTLTCTFSG-FSFT | 10415 | TH---KMGVD | 10873 | WIRQPPGKALEWL A | 11331 |
| 18409-H10_final | VH2\|2-05/D2\|2-15\|RF1/JH5 | QITLKES-GPTLVKPT QTLTLTCTFSG-FSFT | 10416 | TH---KMGVD | 10874 | WIRQPPGKALEWL A | 11332 |
| VH3\|3-23/D7\|7-27\|RF2/JH6 | | EVQLLES-GGGLVQPG GSLRLSCAASG-FTFS | 10417 | S-----YAMS | 10875 | WVRQAPGKGLEWV S | 11333 |
| 18089-G11 | VH3\|3-23/D7\|7-27\|RF2/JH6 | EVQLLES-GGGLVQPG GSLRLSCAASG-FTFS | 10418 | S-----YAMS | 10876 | WVRQAPGKGLEWV S | 11334 |
| 18089-H9 | VH3\|3-23/D7\|7-27\|RF2/JH6 | EVQLLES-GGGLVQPG GSLRLSCAASG-FTFS | 10419 | S-----YAVS | 10877 | WVRQAPGKGLEWV S | 11335 |
| VH4\|4-30.1/D3\|3- | | QVQLQES-GPGLVKPS QTLSLTCTVSG-GSIS | 10420 | SG---GYYWS | 10878 | WIRQHPGKGLEWI G | 11336 |
| 18179-A5 | VH4\|4-30.1/D3\|3-10\|RF3/JH6 | EVQLLES-GPGLVKPS ETLSLTCTVSG-GAIS | 10421 | SG---DYYWS | 10879 | WIRQHPGKGLEWI G | 11337 |
| 18179-C7 | VH4\|4-30.1/D3\|3-10\|RF3/JH6 | EVQLLES-GPGLVKPS QTLSLTCTVSG-DSIS | 10422 | SN---PYYWS | 10880 | WIRQHPGKGLEWI G | 11338 |
| 18179-H9 | VH4\|4-30.1/D3\|3-10\|RF3/JH6 | EVQLLES-GPGLVKPS QTLSLTCTVSG-GSIS | 10423 | SN---PYYWS | 10881 | WIRQHPGKGLEWI G | 11339 |
| 18181-H7 | VH4\|4-30.1/D3\|3-10\|RF3/JH6 | EVQLLES-GPGLVKPS QTLSLTCTVSG-DSIS | 10424 | SN---PYYWS | 10882 | WIRQHPGKGLEWI G | 11340 |
| 18181-B8 | VH4\|4-30.1/D3\|3-10\|RF3/JH6 | EVQLLES-GPGLVKPS QTLSLTCTVSG-GSIS | 10425 | SG---GYYWS | 10883 | WIRQHPGKGLEWI G | 11341 |
| 81-H7-SG-F28_final | VH4\|4-30.1/D3\|3-10\|RF3/JH6 | QVQLQES-GPGLVKPS QTLSLTCTVSG-DSIS | 10426 | SN---PYYWS | 10884 | WIRQHPGKGLEWI G | 11342 |
| VH3\|3-15/D3\|3-10\|RF2/JH6 | | EVQLVES-GGGLVKPG GSLRLSCAASG-FTFS | 10427 | N-----AWMS | 10885 | WVRQAPGKGLEWV G | 11343 |
| 18179-B7 | VH3\|3-15/D3\|3-10\|RF2/JH6 | EVQLLES-GGGLVKPG GSLRLSCAASG-FTFS | 10428 | N-----AWMS | 10886 | WVRQAPGKGLEWV G | 11344 |
| 18179-B8 | VH3\|3-15/D3\|3-10\|RF2/JH6 | EVQLLES-GGGLVQPG GSLRLSCAASG-FTFS | 10429 | N-----AWMS | 10887 | WVRQAPGKGLEWV G | 11345 |
| 18179-D8 | VH3\|3-15/D3\|3-10\|RF2/JH6 | EVQLLES-GGGLVKPG GSLRLSCAASG-FTFS | 10430 | N-----AWMS | 10888 | WVRQAPGKGLEWV G | 11346 |
| 18179-D9 | VH3\|3-15/D3\|3-10\|RF2/JH6 | EVQLLES-GGGLVKPG GSLRLSCAASG-FTFS | 10431 | N-----AWMS | 10889 | WVRQAPGKGLEWV G | 11347 |
| 18179-E6 | VH3\|3-15/D3\|3-10\|RF2/JH6 | EVQLLES-GGGLVQPG GSLRLSCAASG-FTFS | 10432 | N-----AWMS | 10890 | WVRQAPGKGLEWV G | 11348 |
| 18181-G7 | VH3\|3-15/D3\|3-10\|RF2/JH6 | EVQLLES-GGGLVKPG GSLRLSCAASG-FTFS | 10433 | N-----AWMS | 10891 | WVRQAPGKGLEWV G | 11349 |
| 18179-E1 | VH3\|3-15/D3\|3-10\|RF2/JH6 | EVQLLES-GGGLVQPG GSLRLSCAASG-FTFS | 10434 | N-----AWMS | 10892 | WVRQAPGKGLEWV G | 11350 |

TABLE 60-continued

| HEAVY_VARIABLE | | | | | | | |
|---|---|---|---|---|---|---|---|
| 18179-H7 | VH3\|3-15/D3\|3-10\|RF2/JH6 | EVQLLES-GGGLVQPGGSLRLSCAASG-FTFS | 10435 | N-----AWMS | 10893 | WVRQAPGKGLEWVG | 11351 |
| 18179-B12 | VH3\|3-15/D3\|3-10\|RF2/JH6 | EVQLLES-GGGLVQPGGSLRLSCAASG-FTFS | 10436 | N-----AWMS | 10894 | WVRQAPGKGLEWVG | 11352 |
| 18179-D11 | VH3\|3-15/D3\|3-10\|RF2/JH6 | EVQLLES-GGGLVKPGGSLRLSCAASG-FTFS | 10437 | N-----AWMS | 10895 | WVRQAPGKGLEWVG | 11353 |
| 18179-D7 | VH3\|3-15/D3\|3-10\|RF2/JH6 | EVQLLES-GGGLVQPGGSLRLSCAASG-FTFS | 10438 | N-----AWMS | 10896 | WVRQAPGKGLEWVG | 11354 |
| 18179-A7 | VH3\|3-15/D3\|3-10\|RF2/JH6 | EVQLLES-GGGLVKPGGSLRLSCAASG-FTFS | 10439 | N-----AWMS | 10897 | WVRQAPGKGLEWVG | 11355 |
| 18181-G8 | VH3\|3-15/D3\|3-10\|RF2/JH6 | EVQLLES-GGGLVQPGGSLRLSCAASG-FTFS | 10440 | N-----AWMS | 10898 | WVRQAPGKGLEWVG | 11356 |
| 18181-F3 | VH3\|3-15/D3\|3-10\|RF2/JH6 | EVQLLES-GGGLVQPGGSLRLSCAASG-FTFS | 10441 | N-----AWMS | 10899 | WVRQAPGKGLEWVG | 11357 |
| 18181-F1 | VH3\|3-15/D3\|3-10\|RF2/JH6 | EVQLLES-GGGLVKPGGSLRLSCAASG-FTFS | 10442 | N-----AWMS | 10900 | WVRQAPGKGLEWVG | 11358 |
| 18181-A6 | VH3\|3-15/D3\|3-10\|RF2/JH6 | EVQLLES-GGGLVQPGGSLRLSCAASG-FTFS | 10443 | N-----AWMS | 10901 | WVRQAPGKGLEWVG | 11359 |
| 18409-E2_final | VH3\|3-15/D3\|3-10\|RF2/JH6 | EVQLVES-GGGLVQPGGSLRLSCAASG-FTFS | 10444 | N-----AWMS | 10902 | WVRQAPGKGLEWVG | 11360 |
| 18410-B5_final | VH3\|3-15/D3\|3-10\|RF2/JH6 | EVQLVES-GGGLVQPGGSLRLSCAASG-FTFS | 10445 | N-----AWMS | 10903 | WVRQAPGKGLEWVG | 11361 |
| 18410-B6_final | VH3\|3-15/D3\|3-10\|RF2/JH6 | EVQLVES-GGGLVQPGGSLRLSCAASG-FTFS | 10446 | N-----AWMS | 10904 | WVRQAPGKGLEWVG | 11362 |
| 18410-D3_final | VH3\|3-15/D3\|3-10\|RF2/JH6 | EVQLVES-GGGLVQPGGSLRLSCAASG-FTFS | 10447 | N-----AWMS | 10905 | WVRQAPGKGLEWVG | 11363 |
| 18410-D6_final | VH3\|3-15/D3\|3-10\|RF2/JH6 | EVQLVES-GGGLVKPGGSLRLSCAASG-FTFS | 10448 | N-----AWMS | 10906 | WVRQAPGKGLEWVG | 11364 |
| 18410-H1_final | VH3\|3-15/D3\|3-10\|RF2/JH6 | EVQLVES-GGGLVQPGGSLRLSCAASG-FTFS | 10449 | N-----AWMS | 10907 | WVRQAPGKGLEWVG | 11365 |
| 18410-H3_final | VH3\|3-15/D3\|3-10\|RF2/JH6 | EVQLVES-GGGLVQPGGSLRLSCAASG-FTFS | 10450 | N-----AWMS | 10908 | WVRQAPGKGLEWVG | 11366 |
| VH4\|4-59/D3\|3-10\|RF3/JH6 | | QVQLQES-GPGLVKPSETLSLTCTVSG-GSIS | 10451 | S-----YYWS | 10909 | WIRQPPGKGLEWIG | 11367 |
| 18179-F3 | VH4\|4-59/D3\|3-10\|RF3/JH6 | EVQLLES-GPGLVKPSETLTLTCTVSG-GSIS | 10452 | S-----YYWS | 10910 | WIRQPAGKGLEWIG | 11368 |
| 18179-F10 | VH4\|4-59/D3\|3-10\|RF3/JH6 | EVQLLES-GPGLVKPTETLSLTCTVSG-GSIS | 10453 | D-----FFWS | 10911 | WIRQPPGKGLEWIG | 11369 |
| 18181-H10 | VH4\|4-59/D3\|3-10\|RF3/JH6 | EVQLLES-GPGLVKPSETLSLTCTVSG-GSIS | 10454 | N-----YYWS | 10912 | WVRQPAGKGLEWIG | 11370 |
| VH3\|3-23/D6\|6-19\|RF2/JH4 | | EVQLLES-GGGLVQPGGSLRLSCAASG-FTFS | 10455 | S-----YAMS | 10913 | WVRQAPGKGLEWVS | 11371 |
| 18182-A3 | VH3\|3-23/D6\|6-19\|RF2/JH4 | EVQLLES-GGGLVQPGGSLRLSCAASG-FTFS | 10456 | S-----YAMS | 10914 | WVRQAPGKGLEWVS | 11372 |
| 18182-A5 | VH3\|3-23/D6\|6-19\|RF2/JH4 | EVQLLES-GGGLVQPGGSLRLSCAASG-FTFS | 10457 | S-----HAMS | 10915 | WVRQAPGKGLEWVS | 11373 |
| 18182-A6 | VH3\|3-23/D6\|6-19\|RF2/JH4 | EVQLLES-GGGLVQPGGSLRLSCAASG-FTFS | 10458 | S-----YAMS | 10916 | WVRQAPGKGLEWVS | 11374 |
| 18182-A7 | VH3\|3-23/D6\|6-19\|RF2/JH4 | EVQLLES-GGGLVQPGGSLRLSCAASG-FTFS | 10459 | S-----YAMS | 10917 | WVRQAPGKGLEWVS | 11375 |
| 18182-A8 | VH3\|3-23/D6\|6-19\|RF2/JH4 | EVQLLES-GGGLVQPGGSLRLSCAASG-FTFS | 10460 | S-----HAMS | 10918 | WVRQAPGKGLEWVS | 11376 |

TABLE 60-continued

| HEAVY_VARIABLE | | | | | | | |
|---|---|---|---|---|---|---|---|
| 18182-A11 | VH3\|3-23/D6\|6-19\|RF2/JH4 | EVQLLES-GGGLVQPGGSLRLSCAASG-FTFS | 10461 | S-----YAMS | 10919 | WVRQAPGKGLEWVS | 11377 |
| 18182-B1 | VH3\|3-23/D6\|6-19\|RF2/JH4 | EVQLLES-GGGLVQPGGSLRLSCAASG-FTFS | 10462 | S-----HAMS | 10920 | WVRQAPGKGLEWVS | 11378 |
| 18182-B4 | VH3\|3-23/D6\|6-19\|RF2/JH4 | EVQLLES-GGGLVQPGGSLRLSCAASG-FTFS | 10463 | S-----YAMS | 10921 | WVRQAPGKGLEWVS | 11379 |
| 18182-B6 | VH3\|3-23/D6\|6-19\|RF2/JH4 | EVQLLES-GGGLVQPGGSLRLSCAASG-FTFS | 10464 | S-----YAMS | 10922 | WVRQAPGKGLEWVS | 11380 |
| 18182-B10 | VH3\|3-23/D6\|6-19\|RF2/JH4 | EVQLLES-GGGLVQPGGSLRLSCAASG-FTFS | 10465 | S-----YAMN | 10923 | WVRQAPGKGLEWVS | 11381 |
| 18182-C2 | VH3\|3-23/D6\|6-19\|RF2/JH4 | EVQLLES-GGGLVQPGGSLRLSCAASG-FTFS | 10466 | S-----YAMS | 10924 | WVRQAPGKGLEWVS | 11382 |
| 18182-C3 | VH3\|3-23/D6\|6-19\|RF2/JH4 | EVQLLES-GGDLVQPGGSLRLSCAASG-FTFS | 10467 | S-----HAMS | 10925 | WVRQAPGKGLEWVS | 11383 |
| 18182-C4 | VH3\|3-23/D6\|6-19\|RF2/JH4 | EVQLLES-GGGLVQPGGSLRLSCAASG-FTFS | 10468 | S-----YAMS | 10926 | WVRQAPGKGLEWVS | 11384 |
| 18182-C5 | VH3\|3-23/D6\|6-19\|RF2/JH4 | EVQLLES-GGGLVQPGGSLRLSCAASG-FTFS | 10469 | S-----YAMS | 10927 | WVRQAPGKGLEWVS | 11385 |
| 18182-C10 | VH3\|3-23/D6\|6-19\|RF2/JH4 | EVQLLES-GGGLVQPGGSLRLSCAASG-FTFS | 10470 | S-----YAMS | 10928 | WVRQAPGKGLEWVS | 11386 |
| 18182-C12 | VH3\|3-23/D6\|6-19\|RF2/JH4 | EVQLLES-GGDLVQPGGSLRLSCAASG-ITFS | 10471 | S-----YAMS | 10929 | WVRQAPGKGLEWVS | 11387 |
| 18182-D4 | VH3\|3-23/D6\|6-19\|RF2/JH4 | EVQLLES-GGDLVQPGGSLRLSCAASG-FTFS | 10472 | S-----YAMS | 10930 | WVRQAPGKGLEWVS | 11388 |
| 18182-D8 | VH3\|3-23/D6\|6-19\|RF2/JH4 | EVQLLES-GGGLVQPGGSLRLSCAASG-FTFS | 10473 | S-----YAMS | 10931 | WVRQAPGKGLEWVS | 11389 |
| 18182-D9 | VH3\|3-23/D6\|6-19\|RF2/JH4 | EVQLLES-GGDLVQPGGSLRLSCAASG-FTFS | 10474 | S-----YAMS | 10932 | WVRQAPGKGLEWVS | 11390 |
| 18182-D11 | VH3\|3-23/D6\|6-19\|RF2/JH4 | EVQLLES-GGGLVQPGGSLRLSCAASG-FTFS | 10475 | S-----YAMN | 10933 | WVRQAPGKGLEWVS | 11391 |
| 18182-E2 | VH3\|3-23/D6\|6-19\|RF2/JH4 | EVQLLES-GGDLVQPGGSLRLSCAASG-FTFG | 10476 | S-----YAMS | 10934 | WVRQAPGKGLEWVS | 11392 |
| 18182-E3 | VH3\|3-23/D6\|6-19\|RF2/JH4 | EVQLLES-GGGLVQPGGSLRLSCAASG-FTFS | 10477 | S-----YAMS | 10935 | WVRQAPGKGLEWVS | 11393 |
| 18182-E8 | VH3\|3-23/D6\|6-19\|RF2/JH4 | EVQLLES-GGGLVQPGGSLRLSCAASG-FTFS | 10478 | S-----YAMS | 10936 | WVRQAPGKGLEWVS | 11394 |
| 18182-E11 | VH3\|3-23/D6\|6-19\|RF2/JH4 | EVQLLES-GGGLVQPGGSLRLSCAASG-FTFS | 10479 | S-----YAMS | 10937 | WVRQAPGKGLEWVS | 11395 |
| 18182-F1 | VH3\|3-23/D6\|6-19\|RF2/JH4 | EVQLLES-GGDLVQPGGSLRLSCAASG-FTFS | 10480 | S-----YAMS | 10938 | WVRQAPGKGLEWVS | 11396 |
| 18182-F6 | VH3\|3-23/D6\|6-19\|RF2/JH4 | EVQLLES-GGGLVQPGGSLRLSCAASG-FTFS | 10481 | S-----YAMS | 10939 | WVRQAPGKGLEWVS | 11397 |
| 18182-F8 | VH3\|3-23/D6\|6-19\|RF2/JH4 | EVQLLES-GGGLVQPGGSLRLSCAASG-FTFS | 10482 | S-----YAMS | 10940 | WVRQAPGKGLEWVS | 11398 |
| 18182-G3 | VH3\|3-23/D6\|6-19\|RF2/JH4 | EVQLLES-GGDLVQPGGSLRLSCAASG-FTFS | 10483 | S-----YAMH | 10941 | WVRQAPGQGLEWVS | 11399 |
| 18182-G4 | VH3\|3-23/D6\|6-19\|RF2/JH4 | EVQLLES-GGGLVQPGGSLRLSCAASG-FTFS | 10484 | S-----YAMT | 10942 | WVRQAPGKGLEWVS | 11400 |
| 18182-G5 | VH3\|3-23/D6\|6-19\|RF2/JH4 | EVQLLES-GGGLVQPGGSLRLSCAASG-FTFS | 10485 | S-----YAMS | 10943 | WVRQAPGKGLEWVS | 11401 |
| 18182-G9 | VH3\|3-23/D6\|6-19\|RF2/JH4 | EVQLLES-GGGLVQPGGSLRLSCAASG-FTFS | 10486 | S-----YAMS | 10944 | WVRQAPGKGLEWVS | 11402 |

TABLE 60-continued

| HEAVY_VARIABLE | | | | | | | |
|---|---|---|---|---|---|---|---|
| 18182-G11 | VH3\|3-23/D6\|6-19\|RF2/JH4 | EVQLLES-GGGLVQPG GSLRLSCAASG-FTFS | 10487 | S-----YAMS | 10945 | WVRQAPGKGLEWVS | 11403 |
| 18182-H5 | VH3\|3-23/D6\|6-19\|RF2/JH4 | EVQLLES-GGGLVQPG GSLRLSCAASG-FTFS | 10488 | S-----HAMS | 10946 | WVRQAPGKGLEWVS | 11404 |
| 18182-B5 | VH3\|3-23/D6\|6-19\|RF2/JH4 | EVQLLES-GGGLVQPG GSLRLSCAASG-FTFS | 10489 | S-----HAMS | 10947 | WVRQAPGKGLEWVS | 11405 |
| 18182-H9 | VH3\|3-23/D6\|6-19\|RF2/JH4 | EVQLLES-GGGLVQPG GSLRLSCAASG-FTFS | 10490 | S-----HAMS | 10948 | WVRQAPGKGLEWVS | 11406 |
| 18182-E6 | VH3\|3-23/D6\|6-19\|RF2/JH4 | EVQLLES-GGGLVQPG GSLRLSCAASG-FTFS | 10491 | S-----YAMS | 10949 | WVRQAPGKGLEWVS | 11407 |
| 18182-G6 | VH3\|3-23/D6\|6-19\|RF2/JH4 | EVQLLES-GGGLVQPG GSLRLSCAASG-FTFS | 10492 | S-----YAMS | 10950 | WVRQAPGKGLEWVS | 11408 |
| 18182-G2 | VH3\|3-23/D6\|6-19\|RF2/JH4 | EVQLLES-GGGLVQPG GSLRLSCAASG-FTFS | 10493 | S-----HAMS | 10951 | WVRQAPGKGLEWVS | 11409 |
| 18182-H12 | VH3\|3-23/D6\|6-19\|RF2/JH4 | EVQLLES-GGGLVQPG GSLRLSCAASG-FTFS | 10494 | S-----YAMS | 10952 | WVRQAPGKGLEWVS | 11410 |
| 18182-G8 | VH3\|3-23/D6\|6-19\|RF2/JH4 | EVQLLES-GGGLVKPG GSLRLSCAASG-FTFS | 10495 | S-----YAMN | 10953 | WVRQAPGKGLEWVS | 11411 |
| 18182-E10 | VH3\|3-23/D6\|6-19\|RF2/JH4 | EVQLLES-GGGLVQPG GSLRLSCAASG-FTFS | 10496 | S-----HAMS | 10954 | WVRQAPGQGLEWVS | 11412 |
| 18182-B12 | VH3\|3-23/D6\|6-19\|RF2/JH4 | EVQLLES-GGGLVQPG GSLRLSCAASG-FTFS | 10497 | S-----YAMS | 10955 | WVRQAPGKGLEWVS | 11413 |
| 18182-E5 | VH3\|3-23/D6\|6-19\|RF2/JH4 | EVQLLES-GGGLVQPG GSLRLSCAASG-FTFS | 10498 | S-----YAMS | 10956 | WVRQAPGKGLEWVS | 11414 |
| 18182-A4 | VH3\|3-23/D6\|6-19\|RF2/JH4 | EVQLLES-GGGVVQPG RSLRLSCAASG-FTFS | 10499 | S-----YAMT | 10957 | WVRQAPGQGLEWVS | 11415 |
| 18182-E1 | VH3\|3-23/D6\|6-19\|RF2/JH4 | EVQLLES-GGGLVQPG GSLRLSCAASG-FTFS | 10500 | S-----HAMS | 10958 | WVRQAPGKGLEWVS | 11416 |
| 18403-F12-AS | VH3\|3-23/D6\|6-19\|RF2/JH4 | EVQLLES-GGGLVQPG GSLRLSCAASG-FTFS | 10501 | S-----YAMS | 10959 | WVRQAPGKGLEWVS | 11417 |
| 18403-G10-AS | VH3\|3-23/D6\|6-19\|RF2/JH4 | EVQLLES-GGGLVQPG GSLRLSCAASG-FTFS | 10502 | S-----YAMS | 10960 | WVRQAPGKGLEWVS | 11418 |
| 18398-C7_final | VH3\|3-23/D6\|6-19\|RF2/JH4 | EVQLLES-GGGLVQPG GSLRLSCAASG-FTFS | 10503 | S-----HAMS | 10961 | WVRQAPGKGLEWVS | 11419 |
| 18403-D8_final | VH3\|3-23/D6\|6-19\|RF2/JH4 | EVQLLES-GGGLVQPG GSLRLSCAASG-FTFS | 10504 | S-----HAMS | 10962 | WVRQAPGKGLEWVS | 11420 |
| 18403-D8_AS_final | VH3\|3-23/D6\|6-19\|RF2/JH4 | EVQLLES-GGGLVQPG GSLRLSCAASG-FTFS | 10505 | S-----HAMS | 10963 | WVRQAPGKGLEWVS | 11421 |
| 18403-E11_AS_final | VH3\|3-23/D6\|6-19\|RF2/JH4 | EVQLLES-GGGLVQPG GSLRLSCAASG-FTFS | 10506 | S-----HAMS | 10964 | WVRQAPGKGLEWVS | 11422 |
| 18403-F12_final | VH3\|3-23/D6\|6-19\|RF2/JH4 | EVQLLES-GGGLVQPG GSLRLSCAASG-FTFS | 10507 | S-----YAMS | 10965 | WVRQAPGKGLEWVS | 11423 |
| 18403-F12-AS_final | VH3\|3-23/D6\|6-19\|RF2/JH4 | EVQLLES-GGGLVQPG GSLRLSCAASG-FTFS | 10508 | S-----YAMS | 10966 | WVRQAPGKGLEWVS | 11424 |
| 18403-G10_final | VH3\|3-23/D6\|6-19\|RF2/JH4 | EVQLLES-GGGLVQPG GSLRLSCAASG-FTFS | 10509 | S-----YAMS | 10967 | WVRQAPGKGLEWVS | 11425 |
| 18403-G10-AS_final | VH3\|3-23/D6\|6-19\|RF2/JH4 | EVQLLES-GGGLVQPG GSLRLSCAASG-FTFS | 10510 | S-----YAMS | 10968 | WVRQAPGKGLEWVS | 11426 |
| 18410-G10_final | VH3\|3-23/D6\|6-19\|RF2/JH4 | EVQLLES-GGGLVQPG GSLRLSCAASG-FTFS | 10511 | S-----HAMS | 10969 | WVRQAPGKGLEWVS | 11427 |
| 18410-G10_AS_final | VH3\|3-23/D6\|6-19\|RF2/JH4 | EVQLLES-GGGLVQPG GSLRLSCAASG-FTFS | 10512 | S-----HAMS | 10970 | WVRQAPGKGLEWVS | 11428 |

TABLE 60-continued

| HEAVY_VARIABLE | | | | | | | |
|---|---|---|---|---|---|---|---|
| VH3\|3-23/D6\|6-19\|RF2/JH1 | | EVQLLES-GGGLVQPG GSLRLSCAASG-FTFS | 10513 | S-----YAMS | 10971 | WVRQAPGKGLEWV S | 11429 |
| 18182-B7 | VH3\|3-23/D6\|6-19\|RF2/JH1 | EVQLLES-GGGLVQPG GSLRLSCAASG-FTFS | 10514 | S-----YAMS | 10972 | WVRQAPGQGLEWV S | 11430 |
| VH3\|3-30.3/D1\|1- | | QVQLVES-GGGVVQPG RSLRLSCAASG-FTFS | 10515 | S-----YAMH | 10973 | WVRQAPGKGLEWV A | 11431 |
| 18089-D12 | VH3\|3-30.3/D1\|1-1\|RF2/JH4 | EVQLLES-GGGVVQPG RSLRLSCAASG-FTFS | 10516 | T-----YGMH | 10974 | WVRQAPGKGLEWV A | 11432 |
| 02-C1-86-A4-N-F5_final | VH3\|3-30.3/D1\|1-1\|RF2/JH4 | QVQLVES-GGGVVQPG RSLRLSCAASG-FTFS | 10517 | T-----YGMH | 10975 | WVRQAPGKGLEWV A | 11433 |
| 18486-A4_final | VH3\|3-30.3/D1\|1-1\|RF2/JH4 | QVQLVES-GGGVVQPG RSLRLSCAASG-FTFS | 10518 | T-----YGMH | 10976 | WVRQAPGKGLEWV A | 11434 |
| VH1\|1-18/D6\|6-13\|RF2/JH4 | | QVQLVQS-GAEVKKPG ASVKVSCKASG-YTFT | 10519 | S-----YGIS | 10977 | WVRQAPGQGLEWM G | 11435 |
| 18179-G12 | VH1\|1-18/D6\|6-13\|RF2/JH4 | EVQLLES-GAEVKKPG ASVKVSCKASG-YTFT | 10520 | R-----NGLS | 10978 | WVRQAPGQGLEWM G | 11436 |
| 18179-C1 | VH1\|1-18/D6\|6-13\|RF2/JH4 | EVQLLES-GAEVKKPG ASVKVSCKASG-YTFT | 10521 | R-----NGLS | 10979 | WVRQAPGQGLEWM G | 11437 |
| VH3\|3-11/D1\|1-1\|RF3/JH4 | | QVQLVES-GGGLVKPG GSLRLSCAASG-FTFS | 10522 | D-----YYMS | 10980 | WIRQAPGKGLEWV S | 11438 |
| 18093-B11 | VH3\|3-11/D1\|1-1\|RF3/JH4 | EVQLLES-GGGLVKPG GSLRLSCAASG-FTFS | 10523 | D-----YYMS | 10981 | WIRQAPGKGLEWV S | 11439 |
| 03-F3-88-B3-F9_final | VH3\|3-11/D1\|1-1\|RF3/JH4 | QVQLVES-GGGLVKPG GSLRLSCAASG-FTFS | 10524 | D-----YYMS | 10982 | WIRQAPGKGLEWV S | 11440 |

| | Germline | H_CDR2 | SEQ ID NO: | H_FR3 | SEQ ID NO: |
|---|---|---|---|---|---|
| VH1\|1-f/D2\|2-15\|RF3/JH4 | | LVDPE---DGETIYAEKFQG | 11672 | RVTITADTSTDTA YMELSSLRSEDTA VYYCAT | 12130 |
| 17724-C9 | VH1\|1-f/D2\|2-15\|RF3/JH4 | RIYPG---DGDTNYNGKFKG | 11673 | KAALTADKSSNTA NMQLNSLTSEDSA VYFCAR | 12131 |
| VH1\|1-e/D5\|5-18\|RF3/JH4 | | GIIPI---FGTANYAQKFQG | 11674 | RVTITADKSTSTA YMELSSLRSEDTA VYYCAR | 12132 |
| 17724-G6 | VH1\|1-e/D5\|5-18\|RF3/JH4 | RVWPG---DGDTTYNEKFKG | 11675 | KATLTADKSSRTA YMQLSSLTSEDSA VYFCAR | 12133 |
| VH1\|1-e/D1\|1-1\|RF2/JH3 | | GIIPI---FGTANYAQKFQG | 11676 | RVTITADKSTSTA YMELSSLRSEDTA VYYCAR | 12134 |
| 17731-H8 | VH1\|1-e/D1\|1-1\|RF2/JH3 | RIYPG---DGDTNYNGKFKD | 11677 | KATLTADKSSNTA YMQLSSLTSEDSA VYFCAR | 12135 |
| VH1\|1-08/D5\|5-18\|RF3/JH6 | | WMNPN---SGNTGYAQKFQG | 11678 | RVTMTRNTSISTA YMELSSLRSEDTA VYYCAR | 12136 |
| 17732-A8 | VH1\|1-08/D5\|5-18\|RF3/JH6 | WMNPN---SGNTGYAQKFQG | 11679 | RVTMTRNTSISTA YMELSSLRSEDTA VYYCAR | 12137 |
| 17780-D12 | VH1\|1-08/D5\|5-18\|RF3/JH6 | WMNPN---SGNTGYAQKFQG | 11680 | RVTMTRNTSISTA YMELSSLRSEDTA VYYCAR | 12138 |

TABLE 60-continued

| | | HEAVY_VARIABLE | | | |
|---|---|---|---|---|---|
| | VH1\|1-08/D5\|5-12\|RF3/JH6 | WMNPN----SGNTGYAQKFQG | 11681 | RVTMTRNTSISTAYMELSSLRSEDTAVYYCAR | 12139 |
| 17745-E5 | VH1\|1-08/D5\|5-12\|RF3/JH6 | WMNPN----SGNTGYAQKFQG | 11682 | RVTMTRNTSISTAYMELSSLRSEDTAVYYCAR | 12140 |
| 17777-B4 | VH1\|1-08/D5\|5-12\|RF3/JH6 | WMNPN----RGTTGYAQKFQG | 11683 | RVTMTRNTSISTAYMELSSLRSEDTAVYYCAR | 12141 |
| 17814-D9 | VH1\|1-08/D5\|5-12\|RF3/JH6 | WMNPN----SGNTGYAQKFQG | 11684 | RVTMTRNTSISTAYMELSSLRSEDTAVYYCAR | 12142 |
| | VH4\|4-34/D5\|5-18\|RF3/JH6 | EINH----SGSTNYNPSLKS | 11685 | RVTISVDTSKNQFSLKLSSVTAADTAVYYCAR | 12143 |
| 17745-E8 | VH4\|4-34/D5\|5-18\|RF3/JH6 | EISH----SGSTNYNPSLKS | 11686 | RVSISGDTSKNQFSLKLSSVTAADTAVYYCAR | 12144 |
| 17777-C5 | VH4\|4-34/D5\|5-18\|RF3/JH6 | EINH----SGRTNYNPSLKS | 11687 | RVTMSEDTAKNQFSLKLSSVTAADTAVYYCAR | 12145 |
| 17778-C9 | VH4\|4-34/D5\|5-18\|RF3/JH6 | EINH----RGSTNYNPSLKS | 11688 | RVTISVDASKNQFSLKLSSVTAADTAVYYCAR | 12146 |
| 17780-E6 | VH4\|4-34/D5\|5-18\|RF3/JH6 | EINH----SGSTTYNPSLKS | 11689 | RVTISEDTSRNQFSLKLSSVTAADTAVYYCTR | 12147 |
| 17781-B3 | VH4\|4-34/D5\|5-18\|RF3/JH6 | EINH----RGSTNYNPSLKS | 11690 | RVTISVDASKNQFSLKLSSVTAADTAVYYCAR | 12148 |
| 17781-H12 | VH4\|4-34/D5\|5-18\|RF3/JH6 | EISH----SGSTNYNPSLKS | 11691 | RVSISGDTSKNQFSLKLSSVTAADTAVYYCAR | 12149 |
| 17783-C11 | VH4\|4-34/D5\|5-18\|RF3/JH6 | EINH----SGSTNYNPSLKS | 11692 | RVTISVDASKNQFSLKLSSVTAADTAVYYCAR | 12150 |
| 17783-G10 | VH4\|4-34/D5\|5-18\|RF3/JH6 | EITH----SGSTNYNPSLKS | 11693 | RVTISVDTSKNLFSLKLSSVTAADTAVYYCAR | 12151 |
| 17813-E3 | VH4\|4-34/D5\|5-18\|RF3/JH6 | EINH----SGRTNYNPSLKS | 11694 | RVTMSEDTAKNQFSLKLSSVTAADTAVYYCAR | 12152 |
| 17813-F1 | VH4\|4-34/D5\|5-18\|RF3/JH6 | EINH----RGSTNYNPSLKS | 11695 | RVTISVDASKNQFSLKLSSVTAADTAVYYCAR | 12153 |
| | VH3\|3-23/D3\|3-9\|RF1/JH4 | AISGS----GGSTYYADSVKG | 11696 | RFTISRDNSKNTLYLQMNSLRAEDTAVYYCAK | 12154 |
| 17745-G8 | VH3\|3-23/D3\|3-9\|RF1/JH4 | AISGS----GDITYYADSVKG | 11697 | RFTISRDNSKNTLYLQMNSLRAEDTAVYYCAK | 12155 |
| 17777-C4 | VH3\|3-23/D3\|3-9\|RF1/JH4 | AISGS----GDYTYYADSVKG | 11698 | RFTISRDNSKNTLYLQMNSLRAEDTAVYYCAK | 12156 |
| 18072-D6 | VH3\|3-23/D3\|3-9\|RF1/JH4 | AISGS----GDITYYADSVKG | 11699 | RFTISRDNSKNTLYLQMNSLRAEDTAVYYCAK | 12157 |

TABLE 60-continued

HEAVY_VARIABLE

| | | | | | |
|---|---|---|---|---|---|
| 18084-E4 | VH3\|3-23/D3\|3-9\|RF1/JH4 | AISGS----GSSTYYADSVKG | 11700 | RFTISRDNSKNTL YLQMNSLRAEDTA VYYCAK | 12158 |
| 18088-B10 | VH3\|3-23/D3\|3-9\|RF1/JH4 | AISGS----GDITYYADSVKG | 11701 | RFTISRDNSKNTL YLQMNSLRAEDTA VYYCAK | 12159 |
| VH3\|3-30.3/D1\|1-1\|RF2/JH6 | | VISYD----GSNKYYADSVKG | 11702 | RFTISRDNSKNTL YLQMNSLRAEDTA VYYCAR | 12160 |
| 17748-D12 | VH3\|3-30.3/D1\|1-1\|RF2/JH6 | VISYD----GGNKYYADSVKG | 11703 | RFTISRDNSKNTL YLQMNSLRAEDTA VYYCAR | 12161 |
| 18079-C8 | VH3\|3-30.3/D1\|1-1\|RF2/JH6 | VISYD----GSNKYYADSVKG | 11704 | RFTISRDNSKNTL FLQMNSLRTEDTA VYYCAR | 12162 |
| VH4\|4-34/D5\|5-12\|RF3/JH6 | | EINH----SGSTNYNPSLKS | 11705 | RVTISVDTSKNQF SLKLSSVTAADTA VYYCAR | 12163 |
| 17753-F4 | VH4\|4-34/D5\|5-12\|RF3/JH6 | EINH----SGSTNYNPSLKS | 11706 | RVTISVDTSKNQF SLKLSSVTAADTA VYYCAR | 12164 |
| 17778-F1 | VH4\|4-34/D5\|5-12\|RF3/JH6 | EINH----SGSTNYNPSLKS | 11707 | RVTISVDTSKNQF SLKLSSVTAADTA VYYCAR | 12165 |
| 17778-H8 | VH4\|4-34/D5\|5-12\|RF3/JH6 | EINH----RGSTNYNPSLKS | 11708 | RVTISVDASKNQF SLKLSSVTAADTA VYYCAR | 12166 |
| 17779-E1 | VH4\|4-34/D5\|5-12\|RF3/JH6 | EINH----SGSTNYNPSLKS | 11709 | RVTISVDTSKNQF SLKLSSVTAADTA VYYCAR | 12167 |
| 17784-C11 | VH4\|4-34/D5\|5-12\|RF3/JH6 | EINH----SGSTNYNPSLKS | 11710 | RVTISVDTSKNQF SLKLSSVTAADTA VYYCAR | 12168 |
| 17784-H5 | VH4\|4-34/D5\|5-12\|RF3/JH6 | EINH----SGSTNYNPSLKS | 11711 | RVTISVDPSKNQF SLKLSSVTAADTA VYYCAR | 12169 |
| 17785-D12 | VH4\|4-34/D5\|5-12\|RF3/JH6 | EINH----SGSTNYNPSLKS | 11712 | RVTISVDTSKNQF SLKLSSVTAADTA VYYCAR | 12170 |
| 17813-E5 | VH4\|4-34/D5\|5-12\|RF3/JH6 | EINH----SGSTNYNPSLKS | 11713 | RVTISVDTSKNQF SLKLSSVTAADTA VYYCAR | 12171 |
| 18088-E4 | VH4\|4-34/D5\|5-12\|RF3/JH6 | EINH----SGSTNYNPSLKS | 11714 | RVTISVDTSKNQF SLKLSSVTAADTA VYYCAR | 12172 |
| VH3\|3-23/D6\|6-19\|RF1/JH6 | | AISGS----GGSTYYADSVKG | 11715 | RFTISRDNSKNTL YLQMNSLRAEDTA VYYCAK | 12173 |
| 17771-D2 | VH3\|3-23/D6\|6-19\|RF1/JH6 | TISGS----GGSTDYADSVKG | 11716 | RFTISRDNSKNTL YLQMNSLRAEDTA VYYCAK | 12174 |
| 18074-G12 | VH3\|3-23/D6\|6-19\|RF1/JH6 | SITIT----GGSTYYADSVKG | 11717 | RFTISRDNSKNTL NLQMNSLRAEDTA VYYCAK | 12175 |
| 18093-E2 | VH3\|3-23/D6\|6-19\|RF1/JH6 | TISHS----GGSTYYADSVKG | 11718 | RFTISRDNSKNTL YLQMNSLRAEDTA VYYCAK | 12176 |

TABLE 60-continued

HEAVY_VARIABLE

| ID | V/D/J | CDR | SEQ ID | FR | SEQ ID |
|---|---|---|---|---|---|
| 18089-B2 | VH3\|3-23/D6\|6-19\|RF1/JH6 | TISIS----GGSTNYADSVKG | 11719 | RFTISRDNSKNTLYLQMNSLRAEDTAVYYCAK | 12177 |
| | VH3\|3-23/D7\|7-27\|RF1/JH6 | AISGS----GGSTYYADSVKG | 11720 | RFTISRDNSKNTLYLQMNSLRAEDTAVYYCAK | 12178 |
| 17779-D11 | VH3\|3-23/D7\|7-27\|RF1/JH6 | AISGS----GGSTYYADSAKG | 11721 | RFTISRDNSKNTLYLQMNSLRAEDTAVYYCAK | 12179 |
| 18089-H12 | VH3\|3-23/D7\|7-27\|RF1/JH6 | AISGS----GGSTYYADSVKG | 11722 | RFTISRDNSKNTLYLQMNSLRAEDTAVYYCAK | 12180 |
| 18093-F5 | VH3\|3-23/D7\|7-27\|RF1/JH6 | AISGS----GGSTYYADSVKG | 11723 | RFTISRDNSKNTIYLQMNSLRAEDTAVYYCAK | 12181 |
| | VH3\|3-23/D5\|5-18\|RF1/JH6 | AISGS----GGSTYYADSVKG | 11724 | RFTISRDNSKNTLYLQMNSLRAEDTAVYYCAK | 12182 |
| 17784-B9 | VH3\|3-23/D5\|5-18\|RF1/JH6 | AISGS----GGSTYYADSVKG | 11725 | RFTISRDNSKNTLYLQMNSLRAEDTAVYFCAK | 12183 |
| 17784-C7 | VH3\|3-23/D5\|5-18\|RF1/JH6 | AISGS----GGSTYYADSVKG | 11726 | RFTISRDNSKNTLYLQMNSLRAEDTAVYFCAK | 12184 |
| 18080-H9 | VH3\|3-23/D5\|5-18\|RF1/JH6 | GISGS----GGSTYYADSVKG | 11727 | RFTISRDNSKNTLYLQMNSLRAEDTAVYYCAK | 12185 |
| | VH4\|4-30.1/D3\|3-10\|RF1/JH6 | YIYY----SGSTYYNPSLKS | 11728 | RVTISVDTSKNFSLKLSSVTAADTAVYYCAR | 12186 |
| 17784-G10 | VH4\|4-30.1/D3\|3-10\|RF1/JH6 | YIYY----SGSTYYNPSLKS | 11729 | RVTISVDTSKNFSLKLSSVTAADTAVYYCAR | 12187 |
| 18080-C5 | VH4\|4-30.1/D3\|3-10\|RF1/JH6 | YIND----SGSTYYNPSLKS | 11730 | RVTLSVDSSKNFSLKLSSVTAADTAVYYCAR | 12188 |
| 18179-A3 | VH4\|4-30.1/D3\|3-10\|RF1/JH6 | YISY----SGSTFYNPSLKS | 11731 | RVTISVDTSKNQFSLNLTSVTAADTAVYYCAR | 12189 |
| 18179-A9 | VH4\|4-30.1/D3\|3-10\|RF1/JH6 | YIDK----SGSTYYNPSLKS | 11732 | RVTISVDTSKNQFSLNLTSVTAADTAVYYCAR | 12190 |
| 18179-A10 | VH4\|4-30.1/D3\|3-10\|RF1/JH6 | YIDK----SGSTYYNPSLKS | 11733 | RATISVDTSKDQFSLKLSSVTAADTAVYYCAR | 12191 |
| 18179-c4 | VH4\|4-30.1/D3\|3-10\|RF1/JH6 | YIDK----SGSTYYNPSLKS | 11734 | RATISVDTSKDQFSLKLSSVTAADTAVYYCAR | 12192 |
| 18179-C6 | VH4\|4-30.1/D3\|3-10\|RF1/JH6 | YIDK----SGSTYYNPSLKS | 11735 | RATISVDTSKDQFSLKLSSVTAADTAVYYCAR | 12193 |
| 18179-C10 | VH4\|4-30.1/D3\|3-10\|RF1/JH6 | YISH----SGSTYYNPSLKS | 11736 | RVTISVDTSKNQFSLKLTSVTAADTAVYYCAR | 12194 |
| 18179-F4 | VH4\|4-30.1/D3\|3-10\|RF1/JH6 | YISY----SGSTFYNPSLKS | 11737 | RVTISVDTSKNQFSLNLTSVTAADTAVYYCAR | 12195 |

TABLE 60-continued

HEAVY_VARIABLE

| | | | | | |
|---|---|---|---|---|---|
| 18179-F6 | VH4\|4-30.1/D3\|3-10\|RF1/JH6 | YIDK----SGSTYYNPSLKS | 11738 | RATISVDTSKDQFSLKLSSVTAADTAVYYCAR | 12196 |
| 18179-G8 | VH4\|4-30.1/D3\|3-10\|RF1/JH6 | YIDK----SGSTYYNPSLKS | 11739 | RATISVDTSKDQESLKLSSVTAADTAVYYCAR | 12197 |
| 18179-G9 | VH4\|4-30.1/D3\|3-10\|RF1/JH6 | YIYY----SGSTSYNPSLKS | 11740 | RVTMSVDSSKNQFSLKLTSVTAADTAVYYCAR | 12198 |
| 18179-H6 | VH4\|4-30.1/D3\|3-10\|RF1/JH6 | YIDK----SGSTYYNPSLKS | 11741 | RATISVDTSKNQFSLKLSSVTAADTAVYYCAR | 12199 |
| 18181-A11 | VH4\|4-30.1/D3\|3-10\|RF1/JH6 | YISY----SGSTYYNPSLKS | 11742 | RVTISVDTSKNQFSLNLTSVTAADTAVYYCAR | 12200 |
| 18181-C6 | VH4\|4-30.1/D3\|3-10\|RF1/JH6 | YISY----SGSTYYNPSLKS | 11743 | RVTISVDTSKNQFSLNLTSVTAADTAVYYCAR | 12201 |
| 18181-G10 | VH4\|4-30.1/D3\|3-10\|RF1/JH6 | YISY----SGSTFYNPSLKS | 11744 | RVTISVDTSKNQFSLNLTSVTAADTAVYYCAR | 12202 |
| 18181-E2 | VH4\|4-30.1/D3\|3-10\|RF1/JH6 | YISH----SGSTYYNPSLKS | 11745 | RVTISVDTSKNQFSLNLTSVTAADTAVYYCAR | 12203 |
| 18181-C9 | VH4\|4-30.1/D3\|3-10\|RF1/JH6 | YISY----SGSTFYNPSLKS | 11746 | RVTISVDTSKNQFSLNLTSVTAADTAVYYCAR | 12204 |
| VH3\|3-23/D1\|1-1\|RF1/JH6 | | AISGS---GGSTYYADSVKG | 11747 | RFTISRDNSKNTLYLQMNSLRAEDTAVYYCAK | 12205 |
| 17813-D8 | VH3\|3-23/D1\|1-1\|RF1/JH6 | AISGS---GGSTYYADSVKG | 11748 | RFTISRDNSKNTLYLQMNSLRAEDTAEYYCAK | 12206 |
| VH3\|3-33/D3\|3-10\|RF2/JH6 | | VIWYD---GSNKYYADSVKG | 11749 | RFTISRDNSKNTLYLQMNSLRAEDTAVYYCAR | 12207 |
| 18071-B1 | VH3\|3-33/D3\|3-10\|RF2/JH6 | LIWYD---GSNKYYADSVKG | 11750 | RFTISRDNSKNTLYLQMNSLRAEDTAVYYCAR | 12208 |
| 18082-F5 | VH3\|3-33/D3\|3-10\|RF2/JH6 | VIWYD---GSNKYYADSVKG | 11751 | RFTISRDNSKNTLYLQMNSLRAEDTAVYYCAR | 12209 |
| VH1\|1-08/D7\|7-27\|RF3/JH6 | | WMNPN---SGNTGYAQKFQG | 11752 | RVTMTRNTSISTAYMELSSLRSEDTAVYYCAR | 12210 |
| 18071-C4 | VH1\|1-08/D7\|7-27\|RF3/JH6 | WMNPN---SGNTDYAQKFQG | 11753 | RVTMTRNTSISTAYMELSSLRSEDTAVYYCVR | 12211 |
| 18071-D4 | VH1\|1-08/D7\|7-27\|RF3/JH6 | WMNPN---SGNTDYAQKFQG | 11754 | RVTMTRNTSISTAYMELSSLRSEDTAVYYCAR | 12212 |
| 18079-H4 | VH1\|1-08/D7\|7-27\|RF3/JH6 | WMNPN---SGNTDYAQKFQG | 11755 | RVTMTRNTSISTAYMELRSLRSEDTAVYYCAR | 12213 |
| 18079-H11 | VH1\|1-08/D7\|7-27\|RF3/JH6 | WMNPN---SGNTDYTQKFQG | 11756 | RVTMTRNTSIGTAYMELSSLRSEDTAVYYCVR | 12214 |

TABLE 60-continued

HEAVY_VARIABLE

| | | | | | |
|---|---|---|---|---|---|
| 18086-H4 | VH1\|1-08/D7\|7-27\|RF3/JH6 | WMNPK---SGNTGYAQKFQD | 11757 | RVTMTRNTSISTA YMELSSLRSDDTA VYYCVR | 12215 |
| | VH3\|3-21/D6\|6-6\|RF2/JH6 | SISSS---SSYIYYADSVKG | 11758 | RFTISRDNAKNSL YLQMNSLRAEDTA VYYCAR | 12216 |
| 18072-G9 | VH3\|3-21/D6\|6-6\|RF2/JH6 | SISSS---SSYIYYADSVKG | 11759 | RFTISRDNAKNSL YLQMNSLRAEDTA VYYCVR | 12217 |
| | VH3\|3-30.3/D3\|3-10\|RF2/JH6 | VISYD---GSNKYYADSVKG | 11760 | RFTISRDNSKNTL YLQMNSLRAEDTA VYYCAR | 12218 |
| 18078-H6 | VH3\|3-30.3/D3\|3-10\|RF2/JH6 | VISYD---GSNKYYADSVKG | 11761 | RFTISRDNSKNTL YLQMNSLRAEDTA VYYCAR | 12219 |
| 18090-H9 | VH3\|3-30.3/D3\|3-10\|RF2/JH6 | VISYD---GSNKYYADSVKG | 11762 | RFTISRDNSKNTL YLQMNSLRAEDTA VYYCAR | 12220 |
| | VH4\|4-59/D3\|3-3\|RF3/JH4 | YIYY----SGSTNYNPSLKS | 11763 | RVTISVDTSKNQF SLKLSSVTAADTA VYYCAR | 12221 |
| 18081-A6 | VH4\|4-59/D3\|3-3\|RF3/JH4 | SIYY----SGSTYYNPSLKS | 11764 | RVTISVDTSKNQF SLKLSSVTAADTA VYYCAR | 12222 |
| 18081-B9 | VH4\|4-59/D3\|3-3\|RF3/JH4 | SIYY----SGSTYYNPSLKS | 11765 | RVTISVDTSKNQF SLKLSSVTAADTA VYYCAR | 12223 |
| 18081-E7 | VH4\|4-59/D3\|3-3\|RF3/JH4 | SIYY----SGSTYYNPSLKS | 11766 | RVTISVDTSKNQF SLKLSSVTAADTA VYYCAR | 12224 |
| 18081-B9_final | VH4\|4-59/D3\|3-3\|RF3/JH4 | SIYY----SGSTYYNPSLKS | 11767 | RVTISVDTSKNQF SLKLSSVTAADTA VYYCAR | 12225 |
| | VH6\|6-01/D3\|3-10\|RF1/JH6 | RTYYR--SKWYNDYAVSVKS | 11768 | RITINPDTSKNQF SLQLNSVTPEDTA VYYCAR | 12226 |
| 18081-B5 | VH6\|6-01/D3\|3-10\|RF1/JH6 | RTYYR--SKWYNDYAVSVKS | 11769 | RITINPDTSKNQF SLQLNSVTPEDTA VYYCAR | 12227 |
| | VH4\|4-b/D3\|3-3\|RF3/JH5 | SIYH----SGSTYYNPSLKS | 11770 | RVTISVDTSKNQF SLKLSSVTAADTA VYYCAR | 12228 |
| 18081-C10 | VH4\|4-b/D3\|3-3\|RF3/JH5 | SIYY----GGSTYYNPSLKS | 11771 | RVTISVDTSKNQF SLKLSSVTAADTA VYYCAT | 12229 |
| | VH2\|2-70/D2\|2-15\|RF1/JH5 | RIDW----DDDKFYSTSLKT | 11772 | RLTISKDTSKNQV VLTMTNMDPVDTA TYYCAR | 12230 |
| 18081-D6 | VH2\|2-70/D2\|2-15\|RF1/JH5 | LIYW----NDDTRYSPSLQS | 11773 | RLTITKDTSKNQV VLTMTNMDPVDTA TYYCVY | 12231 |
| 18089-C8 | VH2\|2-70/D2\|2-15\|RF1/JH5 | LIYW----NDDKRYSPSLKS | 11774 | RLTITKDTSKNQV VLTMTNMDPVDTA TYYCAR | 12232 |
| 18081-H11 | VH2\|2-70/D2\|2-15\|RF1/JH5 | LIYW----NDDKRYSPSLQS | 11775 | RLTITKDTSKNQV VLTMTNMDPVDTA TYYCAY | 12233 |

TABLE 60-continued

| | HEAVY_VARIABLE | | | | |
|---|---|---|---|---|---|
| | VH3\|3-23/D1\|1-26\|RF1/JH6 | AISGS---GGSTYYADSVKG | 11776 | RFTISRDNSKNTL YLQMNSLRAEDTA VYYCAK | 12234 |
| 18081-D12 | VH3\|3-23/D1\|1-26\|RF1/JH6 | AISGS---GGSTYYADSVKG | 11777 | RFTISRDNSKNTL YLQMNSLRAEDTA VYYCAK | 12235 |
| | VH4\|4-59/D3\|3-3\|RF3/JH5 | YIYY----SGSTNYNPSLKS | 11778 | RVTISVDTSKNQF SLKLSSVTAADTA VYYCAR | 12236 |
| 18089-B8 | VH4\|4-59/D3\|3-3\|RF3/JH5 | SIYY----GGSTYYNPSLKN | 11779 | RVTMSVDTSKNQF SLKLSSVTAADTA VYYCAT | 12237 |
| | VH2\|2-05/D2\|2-15\|RF1/JH5 | LIYW----NDDKRYSPSLKS | 11780 | RLTITKDTSKNQV VLTMTNMDPVDTA TYYCAH | 12238 |
| 18089-G7 | VH2\|2-05/D2\|2-15\|RF1/JH5 | LIYW----NDDKRYSPSLQS | 11781 | RLTITKDTSKNQV VLTMTNMDPVDTA TYYCAY | 12239 |
| 18089-D11 | VH2\|2-05/D2\|2-15\|RF1/JH5 | LIYW----NDDKRYNPSLQS | 11782 | RLTITKDTSKNQV VLTMTNMDPVDTA TYYCAY | 12240 |
| 18089-C9 | VH2\|2-05/D2\|2-15\|RF1/JH5 | LIYW----NDDKRYSPSLQS | 11783 | RLTITKDTSKNQV VLTMTNMDPVDTA TYYCAY | 12241 |
| 18089-D8 | VH2\|2-05/D2\|2-15\|RF1/JH5 | LIYW----NDDKRYSPSLQS | 11784 | RLTITKDTSKNQV VLTMTNMDPVDTA TYYCAY | 12242 |
| 18081-F9 | VH2\|2-05/D2\|2-15\|RF1/JH5 | LIYW----NDDKRYSPSLQS | 11785 | RLTITKDTSKNQV VLTMTNMDPVDTA TYYCAY | 12243 |
| 18081-B6 | VH2\|2-05/D2\|2-15\|RF1/JH5 | LIYW----NDDKRYSPSLQS | 11786 | RLTITKDTSKNQV VLTMTNMDPVDTA TYYCAY | 12244 |
| 18409-F12_final | VH2\|2-05/D2\|2-15\|RF1/JH5 | LIYW----NDDKRYSPSLQS | 11787 | RLTITKDTSKNQV VLTMTNMDPVDTA TYYCAY | 12245 |
| 18409-G10_final | VH2\|2-05/D2\|2-15\|RF1/JH5 | GIHI----YDDKRYSPSLQS | 11788 | RLTITKDTSKNQV VLTMTNMDPVDTA TYYCAY | 12246 |
| 18409-H7_final | VH2\|2-05/D2\|2-15\|RF1/JH5 | LIYW----NDDKRYSPSLQS | 11789 | RLTITKDTSKNQV VLTMTNMDPVDTA TYYCAY | 12247 |
| 18409-H10_final | VH2\|2-05/D2\|2-15\|RF1/JH5 | LIYW----NDDKRYSPSLQS | 11790 | RLTITKDTSKNQV VLTMTNMDPVDTA TYYCAY | 12248 |
| | VH3\|3-23/D7\|7-27\|RF2/JH6 | AISGS---GGSTYYADSVKG | 11791 | RFTISRDNSKNTL YLQMNSLRAEDTA VYYCAK | 12249 |
| 18089-G11 | VH3\|3-23/D7\|7-27\|RF2/JH6 | GISGS---GGSSYYADSVKG | 11792 | RFTISRDNSKNTL YLQMNSLRAEDTA VYYCAK | 12250 |
| 18089-H9 | VH3\|3-23/D7\|7-27\|RF2/JH6 | GISGS---GGSTYYADSVKG | 11793 | RFTISRDNSKNTL YLQMNSLRAEDTA VYYCAK | 12251 |
| | VH4\|4-30.1/D3\|3-10\|RF3/JH6 | YIYY----SGSTYYNPSLKS | 11794 | RVTISVDTSKNQF SLKLSSVTAADTA VYYCAR | 12252 |

TABLE 60-continued

| HEAVY_VARIABLE | | | | | |
|---|---|---|---|---|---|
| 18179-A5 | VH4\|4-30.1/D3\|3-10\|RF3/JH6 | YIDK----SGSTYYNPSLKS | 11795 | RATISVDTSKDQFSLKLTSLTAADTAVYYCAR | 12253 |
| 18179-C7 | VH4\|4-30.1/D3\|3-10\|RF3/JH6 | YISH----SGSTYYNPSLKS | 11796 | RVTISVDTSKNQESLNLTSVTAADTAVYYCAR | 12254 |
| 18179-H9 | VH4\|4-30.1/D3\|3-10\|RF3/JH6 | YISH----SGSTYYNPSLKS | 11797 | RVTISVDTSKNQFSLNLTSVTAADTAVYYCAR | 12255 |
| 18181-H7 | VH4\|4-30.1/D3\|3-10\|RF3/JH6 | YISY----SGITNYNPSLKS | 11798 | RVTMSVDTSKNQFSLKLTSLTAADTAVYYCAR | 12256 |
| 18181-B8 | VH4\|4-30.1/D3\|3-10\|RF3/JH6 | YISH----SGSTYYNPSLKS | 11799 | RVTISVDTSKNQFSLNLTSVTAADTAVYYCAR | 12257 |
| 81-H7-SG-F28_final | VH4\|4-30.1/D3\|3-10\|RF3/JH6 | YISY----SGITNYNPSLKS | 11800 | RVTMSVDTSKNQFSLKLTSLTAADTAVYYCAR | 12258 |
| VH3\|3-15/D3\|3-10\|RF2/JH6 | | RIKSKT-DGGTTDYAAPVKG | 11801 | RFTISRDDSKNTLYLQMNSLKTEDTAVYYCTT | 12259 |
| 18179-B7 | VH3\|3-15/D3\|3-10\|RF2/JH6 | RIKGNT-YGGTTDYAAPVKG | 11802 | RFTISRDDSKNTLFLQMNSLKTEDTAVYYCTT | 12260 |
| 18179-B8 | VH3\|3-15/D3\|3-10\|RF2/JH6 | RIKGNT-YGGTTDYAAPVKG | 11803 | RFTISRDDSKNTLFLQMNSLKTEDTAVYYCTT | 12261 |
| 18179-D8 | VH3\|3-15/D3\|3-10\|RF2/JH6 | RIKGNT-YGGTTDYAAPVKG | 11804 | RFTISRDDSKNTLFLQMNSLKTEDTAVYYCTT | 12262 |
| 18179-D9 | VH3\|3-15/D3\|3-10\|RF2/JH6 | RIKGNT-YGGTTDYAAPVKG | 11805 | RFTISRDDSKNTLFLQMNSLKTEDTAVYYCTT | 12263 |
| 18179-E6 | VH3\|3-15/D3\|3-10\|RF2/JH6 | RIKGNT-YGGTTDYAAPVKG | 11806 | RFTISRDDSKNTLFLQMNSLKTEDTAVYYCTT | 12264 |
| 18181-G7 | VH3\|3-15/D3\|3-10\|RF2/JH6 | RIKGNT-YGGTTDYAAPVKG | 11807 | RFTISRDDSKNTLFLQMNSLKTEDTAVYYCTT | 12265 |
| 18179-E1 | VH3\|3-15/D3\|3-10\|RF2/JH6 | RIKGNT-YGGTTDYAAPVKG | 11808 | RFTISRDDSKNTLYLQMNSLKTEDTAVYYCTT | 12266 |
| 18179-H7 | VH3\|3-15/D3\|3-10\|RF2/JH6 | RIKSKT-YGGTTDYAAPVKG | 11809 | RFTISRDDSKNTLYLQMNSLKTEDTAVYYCTT | 12267 |
| 18179-B12 | VH3\|3-15/D3\|3-10\|RF2/JH6 | RIKGNT-YGGTTDYAAPVKG | 11810 | RFTISRDDSKNTLFLQMNSLKTEDTAVYYCTT | 12268 |
| 18179-D11 | VH3\|3-15/D3\|3-10\|RF2/JH6 | RIKGNT-YGGTTDYAAPVKG | 11811 | RFTISRDDSKNTLFLQMNSLKTEDTAVYYCTT | 12269 |
| 18179-D7 | VH3\|3-15/D3\|3-10\|RF2/JH6 | RIKGNT-YGGTTDYAAPVKG | 11812 | RFTISRDDSKNTLFLQMNSLKTEDTAVYYCTT | 12270 |
| 18179-A7 | VH3\|3-15/D3\|3-10\|RF2/JH6 | RIKGNT-YGGTTDYAAPVKG | 11813 | RFTISRDDSKNTLFLQMNSLKTEDTAVYYCTT | 12271 |

TABLE 60-continued

HEAVY_VARIABLE

| | | | | | |
|---|---|---|---|---|---|
| 18181-G8 | VH3\|3-15/D3\|3-10\|RF2/JH6 | RIKGNT-YGGTTDYAAPVKG | 11814 | RFTISRDDSKNTLFLQMNSLKTEDTAVYYCTT | 12272 |
| 18181-F3 | VH3\|3-15/D3\|3-10\|RF2/JH6 | RIKGNT-YGGTTDYAAPVKG | 11815 | RFTISRDDSKNTLFLQMNSLKTEDTAVYYCTT | 12273 |
| 18181-F1 | VH3\|3-15/D3\|3-10\|RF2/JH6 | RIKGNT-YGGTTDYAAPVKG | 11816 | RFTISRDDSKNTLFLQMNSLKTEDTAVYYCTT | 12274 |
| 18181-A6 | VH3\|3-15/D3\|3-10\|RF2/JH6 | RIKGNT-YGGTTDYAAPVKG | 11817 | RFTISRDDSKNTLYLQMNSLKTEDTAVYYCTT | 12275 |
| 18409-E2_final | VH3\|3-15/D3\|3-10\|RF2/JH6 | RIKSKT-YGGTTDYAAPVKG | 11818 | RFTISRDDSKNTLFLQMNSLKTEDTAVYYCTT | 12276 |
| 18410-B5_final | VH3\|3-15/D3\|3-10\|RF2/JH6 | RIRSRS-YGGTTDYAAPVKG | 11819 | RFTISRDDSKNTLFLQMNSLKTEDTAVYYCTT | 12277 |
| 18410-B6_final | VH3\|3-15/D3\|3-10\|RF2/JH6 | RIKSKT-YGGTTDYAAPVKG | 11820 | RFTISRDDSKNTLYLQMNSLKTEDTAVYYCTT | 12278 |
| 18410-D3_final | VH3\|3-15/D3\|3-10\|RF2/JH6 | RITSSR-YGGTTDYAAPVKG | 11821 | RFTISRDDSKNTLFLQMNSLKTEDTAVYYCTT | 12279 |
| 18410-D6_final | VH3\|3-15/D3\|3-10\|RF2/JH6 | RILNNA-YGGTTDYAAPVKG | 11822 | RFTISRDDSKNTLYLQMNSLKTEDTAVYYCTT | 12280 |
| 18410-H1_final | VH3\|3-15/D3\|3-10\|RF2/JH6 | RITSGI-YGGTTDYAAPVKG | 11823 | RFTISRDDSKNTLYLQMNSLKTEDTAVYYCTT | 12281 |
| 18410-H3_final | VH3\|3-15/D3\|3-10\|RF2/JH6 | RIRSRP-YGGTTDYAAPVKG | 11824 | RFTISRDDSKNTLYLQMNSLKTEDTAVYYCTT | 12282 |
| VH4\|4-59/D3\|3-10\|RF3/JH6 | | YIYY----SGSTNYNPSLKS | 11825 | RVTISVDTSKNQFSLKLSSVTAADTAVYYCAR | 12283 |
| 18179-F3 | VH4\|4-59/D3\|3-10\|RF3/JH6 | HIYT----SGSTNYNPSLKS | 11826 | RVTMSVDSSKNQFSLKLTSLTAADTAVYYCAR | 12284 |
| 18179-F10 | VH4\|4-59/D3\|3-10\|RF3/JH6 | YIYY----RGSTNYHPSLKS | 11827 | RVTMSVDTSKNQFSLKLTSLTAADTAVYYCAR | 12285 |
| 18181-H10 | VH4\|4-59/D3\|3-10\|RF3/JH6 | HIYT----SGSTNFNPSLKS | 11828 | RVTMSVDTSKNQFSLKLTSLTAADTAVYYCAR | 12286 |
| VH3\|3-23/D6\|6-19\|RF2/JH4 | | AISGS---GGSTYYADSVKG | 11829 | RFTISRDNSKNTLYLQMNSLRAEDTAVYYCAK | 12287 |
| 18182-A3 | VH3\|3-23/D6\|6-19\|RF2/JH4 | AISGS---GGSTYYADSVKG | 11830 | RFTISRDNSKNTLYLQMNSLRAEDTAVYYCAT | 12288 |
| 18182-A5 | VH3\|3-23/D6\|6-19\|RF2/JH4 | AISGS---GGGTYYADSVKG | 11831 | RFTISRDNSKNTLYLQMNSLRAEDTAVYYCAT | 12289 |
| 18182-A6 | VH3\|3-23/D6\|6-19\|RF2/JH4 | TISGS---GGGTYYADSVKG | 11832 | RFTISRDNSKNTLYLQMNSLRAEDTAVYYCAT | 12290 |

TABLE 60-continued

| HEAVY_VARIABLE | | | | | |
|---|---|---|---|---|---|
| 18182-A7 | VH3\|3-23/D6\|6-19\|RF2/JH4 | AISGS---GGGTYYADSVKG | 11833 | RFTISRDNSKNTL YLQMNSLRAEDTA VYYCAT | 12291 |
| 18182-A8 | VH3\|3-23/D6\|6-19\|RF2/JH4 | AISGS---GGGTYNADSVKG | 11834 | RFTISRDNSKNTL YLQMNSLRAEDTA AYYCVT | 12292 |
| 18182-A11 | VH3\|3-23/D6\|6-19\|RF2/JH4 | AISGS---GGGTYYADSVKG | 11835 | RFTISRDNSKNTL YLQMNSLRAEDTA VYYCAT | 12293 |
| 18182-B1 | VH3\|3-23/D6\|6-19\|RF2/JH4 | AISGS---GGGTYNADSVKG | 11836 | RFTISRDNSKNTL YLQMNSLRAEDTA VYYCAT | 12294 |
| 18182-B4 | VH3\|3-23/D6\|6-19\|RF2/JH4 | AISGS---GGGTYYADSVKA | 11837 | RFTISRDNSKNTL YLQMNSLRAEDTA VYYCAT | 12295 |
| 18182-B6 | VH3\|3-23/D6\|6-19\|RF2/JH4 | AISGS---GGGTYYADSVKG | 11838 | RFTISRDNSKNTL YLQMNSLRAEDTA VYYCAT | 12296 |
| 18182-B10 | VH3\|3-23/D6\|6-19\|RF2/JH4 | AISGS---GGGTYYADSVKG | 11839 | RFTISRDNSKNTL YLQMNSLRAEDTA VYYCAT | 12297 |
| 18182-C2 | VH3\|3-23/D6\|6-19\|RF2/JH4 | AISGS---GGGTYYADSVKG | 11840 | RFTISRDNSKNTL YLQMNSLRAEDTA VYYCAT | 12298 |
| 18182-C3 | VH3\|3-23/D6\|6-19\|RF2/JH4 | AISGS---GGGTYYADSVKG | 11841 | RFTISRDNSKNTL YLQMNSLRAEDTA VYYCAT | 12299 |
| 18182-C4 | VH3\|3-23/D6\|6-19\|RF2/JH4 | AISGS---GGGTYYADSVKG | 11842 | RFTISRDNSKNTL YLQMNSLRAEDTA VYYCAT | 12300 |
| 18182-C5 | VH3\|3-23/D6\|6-19\|RF2/JH4 | TISGS---GGGTYYADSVKG | 11843 | RFTISRDNSKNTL YLQMNSLRAEDTA VYYCAT | 12301 |
| 18182-C10 | VH3\|3-23/D6\|6-19\|RF2/JH4 | TISGS---GGGTYYADSVKG | 11844 | RFTISRDNSKNTL YLQMNSLRAEDTA VYYCAT | 12302 |
| 18182-C12 | VH3\|3-23/D6\|6-19\|RF2/JH4 | AISGS---GGGTYYADSGKG | 11845 | RFTISRDNSKNTL YLQMNSLRAEDTA VYYCAT | 12303 |
| 18182-D4 | VH3\|3-23/D6\|6-19\|RF2/JH4 | TISGS---GGGTYYADSVKG | 11846 | RFTISRDNSKNTL YLQMNSLRAEDTA VYYCAP | 12304 |
| 18182-D8 | VH3\|3-23/D6\|6-19\|RF2/JH4 | AISGS---GGGTYYADSVKG | 11847 | RFTISRDNSKNTL YLQMNSLRAEDTA VYYCAT | 12305 |
| 18182-D9 | VH3\|3-23/D6\|6-19\|RF2/JH4 | TISGS---GGGTYYADSVKG | 11848 | RFTISRDNSKNTL YLQMNSLRAEDTA VYYCAT | 12306 |
| 18182-D11 | VH3\|3-23/D6\|6-19\|RF2/JH4 | AISGS---GGGTYYADSVKG | 11849 | RFTISRDNSKNTL YLQMNSLRAEDTA VYYCAT | 12307 |
| 18182-E2 | VH3\|3-23/D6\|6-19\|RF2/JH4 | AISGS---GGGTYYADSVKG | 11850 | RFTISRDNSKNTL YLQMNSLRAEDTA VYYCAT | 12308 |
| 18182-E3 | VH3\|3-23/D6\|6-19\|RF2/JH4 | AISGS---GGGTYYADSVKG | 11851 | RFTISRDNSKNTL YLQMNSLRAEDTA VYYCAT | 12309 |

TABLE 60-continued

HEAVY_VARIABLE

| | | | | | |
|---|---|---|---|---|---|
| 18182-E8 | VH3\|3-23/D6-19\|RF2/JH4 | AISGS---GGGTYYADSVKG | 11852 | RFTISRDNSKNTL YLQMSSLRAEDTA VYYCAT | 12310 |
| 18182-E11 | VH3\|3-23/D6-19\|RF2/JH4 | AISGS---GGGTYYADSVKA | 11853 | RFTISRDNSKNTL YLQMNSLRAEDTA VYYCAT | 12311 |
| 18182-F1 | VH3\|3-23/D6-19\|RF2/JH4 | AISGS---GGGTYYADSVKG | 11854 | RFTISRDNSKNTL YLQMNSLRAEDTA VYYCAT | 12312 |
| 18182-F6 | VH3\|3-23/D6-19\|RF2/JH4 | AISGS---GGGTYYADSVKG | 11855 | RFTISRDNSKNTL YLQMNSLRAEDTA VYYCAT | 12313 |
| 18182-F8 | VH3\|3-23/D6-19\|RF2/JH4 | TISGS---GGGTYYADSVKG | 11856 | RFTISRDNSKNTL YLQMNSLRAEDTA VYYCAT | 12314 |
| 18182-G3 | VH3\|3-23/D6-19\|RF2/JH4 | AISGS---GGGTYYADSVKG | 11857 | RFTISRDNSKNTL YLQMNSLRAEDTA VYYCAT | 12315 |
| 18182-G4 | VH3\|3-23/D6-19\|RF2/JH4 | AISGS---GGGTYYADSVKG | 11858 | RFTISRDNSKNTL YLQMSSLRAEDTA VYYCAT | 12316 |
| 18182-G5 | VH3\|3-23/D6-19\|RF2/JH4 | AISGS---GGGTYNADSVKG | 11859 | RFTISRDNSKNTL YLQMNSLRAEDTA AYYCVT | 12317 |
| 18182-G9 | VH3\|3-23/D6-19\|RF2/JH4 | AISGS---GGGTYYADSVKG | 11860 | RFTISRDNSKNTL YLQMNSLRAEDTA VYYCAT | 12318 |
| 18182-G11 | VH3\|3-23/D6-19\|RF2/JH4 | AISGS---GGGTYYADSVKA | 11861 | RFTISRDNSKNTL YLQMNSLRAEDTA VYYCAT | 12319 |
| 18182-H5 | VH3\|3-23/D6-19\|RF2/JH4 | AISGS---GGGTYNADSVKG | 11862 | RFTISRDNSKNTL YLQMNSLRAEDTA AYYCVT | 12320 |
| 18182-B5 | VH3\|3-23/D6-19\|RF2/JH4 | AISGS---GGGTYYADSVKG | 11863 | RFTISRDNSKNTL YLQMNSLRAEDTA VYYCAT | 12321 |
| 18182-H9 | VH3\|3-23/D6-19\|RF2/JH4 | AISGS---GGGTYYADSVKA | 11864 | RFTISRDNSKNTL YLQMNSLRAEDTA VYYCAT | 12322 |
| 18182-E6 | VH3\|3-23/D6-19\|RF2/JH4 | AISGS---GGGTYYADSVKG | 11865 | RFTISRDNSKNTL YLQMNSLRAEDTA VYYCAT | 12323 |
| 18182-G6 | VH3\|3-23/D6-19\|RF2/JH4 | AISGS---GGGTYYADSVKG | 11866 | RFTISRDNSKNTL YLQMNSLRAEDTA AYYCVT | 12324 |
| 18182-G2 | VH3\|3-23/D6-19\|RF2/JH4 | AISGS---GGGTYNADSVKG | 11867 | RFTISRDNSKNTL YLQMNSLRAEDTA AYYCVT | 12325 |
| 18182-H12 | VH3\|3-23/D6-19\|RF2/JH4 | TISGS---GGGTYYADSVKG | 11868 | RFTISRDNSKNTL YLQMNSLRAEDTA VYYCAT | 12326 |
| 18182-G8 | VH3\|3-23/D6-19\|RF2/JH4 | AISGS---GGGTYYADSGKG | 11869 | RFTISRDNSKNTL YLQMNSLRAEDTA VYYCAT | 12327 |
| 18182-E10 | VH3\|3-23/D6-19\|RF2/JH4 | SISGS---GGGTYYAASVKG | 11870 | RFTISRDNSKNTL YLQMNSLRAEDTA VYYCAT | 12328 |

TABLE 60-continued

HEAVY_VARIABLE

| | | | | | |
|---|---|---|---|---|---|
| 18182-B12 | VH3\|3-23/D6\|6-19\|RF2/JH4 | AISGS---GGGTYYADSVKG | 11871 | RFTISRDNSKNTL YLQMSSLRAEDTA VYYCAT | 12329 |
| 18182-E5 | VH3\|3-23/D6\|6-19\|RF2/JH4 | TISGS---GGGTYYADSVKG | 11872 | RFTISRDNSKNTL YLQMNSLRAEDTA VYYCAT | 12330 |
| 18182-A4 | VH3\|3-23/D6\|6-19\|RF2/JH4 | SISGS---GGGTYYAASVKG | 11873 | RFTISRDNSKNTL YLQMNSLRAEDTA VYYCAT | 12331 |
| 18182-E1 | VH3\|3-23/D6\|6-19\|RF2/JH4 | AISGS---GGGTYNADSVKG | 11874 | RFTISRDNSKNTL YLQMNSLRAEDTA AYYCVT | 12332 |
| 18403-F12-AS | VH3\|3-23/D6\|6-19\|RF2/JH4 | AISGS---GGGTYYAASVKG | 11875 | RFTISRDNSKNTL YLQMSSLRAEDTA VYYCVT | 12333 |
| 18403-G10-AS | VH3\|3-23/D6\|6-19\|RF2/JH4 | AISGS---GGGTYYAASVKG | 11876 | RFTISRDNSKNTL YLQMSSLRAEDTA VYYCAT | 12334 |
| 18398-C7_final | VH3\|3-23/D6\|6-19\|RF2/JH4 | SISGS---GGGTYYAASVKG | 11877 | RFTISRDNSKNTL YLQMNSLRAEDTA VYYCAT | 12335 |
| 18403-D8_final | VH3\|3-23/D6\|6-19\|RF2/JH4 | TISGS---GGGTYYADSVKG | 11878 | RFTISRDNSKNTL YLQMNSLRAEDTA VYYCAT | 12336 |
| 18403-D8_AS_final | VH3\|3-23/D6\|6-19\|RF2/JH4 | TISGS---GGGTYYAASVKG | 11879 | RFTISRDNSKNTL YLQMNSLRAEDTA VYYCAT | 12337 |
| 18403-E11_AS_final | VH3\|3-23/D6\|6-19\|RF2/JH4 | AISGS---GGGTYNAASVKG | 11880 | RFTISRDNSKNTL YLQMNSLRAEDTA AYYCVT | 12338 |
| 18403-F12_final | VH3\|3-23/D6\|6-19\|RF2/JH4 | AISGS---GGGTYYADSVKG | 11881 | RFTISRDNSKNTL YLQMSSLRAEDTA VYYCVT | 12339 |
| 18403-F12-AS_final | VH3\|3-23/D6\|6-19\|RF2/JH4 | AISGS---GGGTYYAASVKG | 11882 | RFTISRDNSKNTL YLQMSSLRAEDTA VYYCVT | 12340 |
| 18403-G10_final | VH3\|3-23/D6\|6-19\|RF2/JH4 | AISGS---GGGTYYADSVKG | 11883 | RFTISRDNSKNTL YLQMSSLRAEDTA VYYCAT | 12341 |
| 18403-G10-AS_final | VH3\|3-23/D6\|6-19\|RF2/JH4 | AISGS---GGGTYYAASVKG | 11884 | RFTISRDNSKNTL YLQMSSLRAEDTA VYYCAT | 12342 |
| 18410-G10_final | VH3\|3-23/D6\|6-19\|RF2/JH4 | AISGS---GGGTYNADSVKG | 11885 | RFTISRDNSKNTL YLQMNSLRAEDTA VYYCAT | 12343 |
| 18410-G10_AS_final | VH3\|3-23/D6\|6-19\|RF2/JH4 | AISGS---GGGTYNAASVKG | 11886 | RFTISRDNSKNTL YLQMNSLRAEDTA VYYCAT | 12344 |
| | VH3\|3-23/D6\|6-19\|RF2/JH1 | AISGS---GGSTYYADSVKG | 11887 | RFTISRDNSKNTL YLQMNSLRAEDTA VYYCAK | 12345 |
| 18182-B7 | VH3\|3-23/D6\|6-19\|RF2/JH1 | AISGS---GGGTYYADSVKG | 11888 | RFTISRDNSKNTL YLQMNSLRAEDTA VYYCAT | 12346 |
| | VH3\|3-30.3/D1\|1-1\|RF2/JH4 | VISYD---GSNKYYADSVKG | 11889 | RFTISRDNSKNTL YLQMNSLRAEDTA VYYCAR | 12347 |

TABLE 60-continued

| HEAVY_VARIABLE | | | | | |
|---|---|---|---|---|---|
| 18089-D12 | VH3\|3-30.3/D1\|1-1\|RF2/JH4 | VISYD---GSNKYYADSVKG | 11890 | RFTISRDDSKNTLYLQMNSLRAEDTAVYYCAR | 12348 |
| 02-C1-86-A4-N-F5_final | VH3\|3-30.3/D1\|1-1\|RF2/JH4 | VISYD---AETVKYAESVKG | 11891 | RFTISRDNSKNTLYLQMNSLRAEDTAVYYCAR | 12349 |
| 18486-A4_final | VH3\|3-30.3/D1\|1-1\|RF2/JH4 | VISYD---ASNKYYAESVKG | 11892 | RFTISRDNSKNTLYLQMNSLRAEDTAVYYCAR | 12350 |
| VH1\|1-18/D6\|6-13\|RF2/JH4 | | WISAY---NGNTNYAQKLQG | 11893 | RVTMTTDTSTSTAYMELRSLRSDDTAVYYCAR | 12351 |
| 18179-G12 | VH1\|1-18/D6\|6-13\|RF2/JH4 | WISGY---NGDTNYAQKLQG | 11894 | RGTMTTDTSTSTAYMELRSLRSDDTAVYYCAR | 12352 |
| 18179-C1 | VH1\|1-18/D6\|6-13\|RF2/JH4 | WISGY---NGDTNYAQKLQG | 11895 | RGTMTTDTSTSTAYMELRSLRSDDTAVYYCAR | 12353 |
| VH3\|3-11/D1\|1-1\|RF3/JH4 | | YISSS---GSTIYYADSVKG | 11896 | RFTISRDNAKNSLYLQMNSLRAEDTAVYYCAR | 12354 |
| 18093-B11 | VH3\|3-11/D1\|1-1\|RF3/JH4 | YISKS---GSTIYYADSVKG | 11897 | RFTISRDNAKNSLYLQMNSLRAEDTAVYYCAT | 12355 |
| 03-F3-88-B3-F9_final | VH3\|3-11/D1\|1-1\|RF3/JH4 | YISKS---SYTVTYADAVKG | 11898 | RFTISRDNAKNSLYLQMNSLRAEDTAVYYCAT | 12356 |

| | Germline | H_CDR3 | SEQ ID NO: | H_FR4 | SEQ ID NO: |
|---|---|---|---|---|---|
| VH1\|1-f/D2\|2-15\|RF3/JH4 | | DIVVVA----------------ATYFDY | 12588 | WGQGTLVTVSS | 13049 |
| 17724-C9 | VH1\|1-f/D2\|2-15\|RF3/JH4 | DGVFY-----------------APLAY | 12589 | WGQGTLVTVSS | 13050 |
| VH1\|1-e/D5\|5-18\|RF3/JH4 | | GYSYG-----------------YYFDY | 12590 | WGQGTLVTVSS | 13051 |
| 17724-G6 | VH1\|1-e/D5\|5-18\|RF3/JH4 | GNYFGSS---------------EAYFDY | 12591 | WGQGTRVTVSS | 13052 |
| VH1\|1-e/D1\|1-1\|RF2/JH3 | | VQLER-----------------DAFDI | 12592 | WGQGTMVTVSS | 13053 |
| 17731-H8 | VH1\|1-e/D1\|1-1\|RF2/JH3 | RQLNHV----------------FAMDY | 12593 | WGQGTSVTVSS | 13054 |
| VH1\|1-08/D5\|5-18\|RF3/JH6 | | GYSYGYYY--------------YYYGMDV | 12594 | WGQGTTVTVSS | 13055 |
| 17732-A8 | VH1\|1-08/D5\|5-18\|RF3/JH6 | GGGYSNG---------------YDYGMDV | 12595 | WGQGTTVTVSS | 13056 |
| 17780-D12 | VH1\|1-08/D5\|5-18\|RF3/JH6 | GGGYSNG---------------YDYGMDV | 12596 | WGQGTTVTVSS | 13057 |
| VH1\|1-08/D5\|5-12\|RF3/JH6 | | GYSGYDYY--------------YYYGMDV | 12597 | WGQGTTVTVSS | 13058 |
| 17745-E5 | VH1\|1-08/D5\|5-12\|RF3/JH6 | GGGYSYG---------------YDYGMDV | 12598 | WGQGTTVTVSS | 13059 |
| 17777-B4 | VH1\|1-08/D5\|5-12\|RF3/JH6 | GGGYSYG---------------YDYGMDV | 12599 | WGQGTTVTVSS | 13060 |
| 17814-D9 | VH1\|1-08/D5\|5-12\|RF3/JH6 | GGGYSYG---------------YDYGMDV | 12600 | WGQGTTVTVSS | 13061 |

TABLE 60-continued

| HEAVY_VARIABLE | | | | | |
|---|---|---|---|---|---|
| VH4\|4-34/D5\|5-18\|RF3/JH6 | | GYSYGYYY---------------YYYGMDV | 12601 | WGQGTTVTVSS | 13062 |
| 17745-E8 | VH4\|4-34/D5\|5-18\|RF3/JH6 | GGGYSHG---------------YDYGMDV | 12602 | WGQGTTVTVSS | 13063 |
| 17777-C5 | VH4\|4-34/D5\|5-18\|RF3/JH6 | GGGYSDG---------------YDYGMDV | 12603 | WGQGTTVTVSS | 13064 |
| 17778-C9 | VH4\|4-34/D5\|5-18\|RF3/JH6 | GGGYSDG---------------YDYGMDV | 12604 | WGQGTTVTVSS | 13065 |
| 17780-E6 | VH4\|4-34/D5\|5-18\|RF3/JH6 | GGGYSHG---------------YDYGMDV | 12605 | WGQGTTVTVSS | 13066 |
| 17781-B3 | VH4\|4-34/D5\|5-18\|RF3/JH6 | GGGYSDG---------------YDYGMDV | 12606 | WGQGTTVTVSS | 13067 |
| 17781-H12 | VH4\|4-34/D5\|5-18\|RF3/JH6 | GGGYSHG---------------YDYGMDV | 12607 | WGQGTTVTVSS | 13068 |
| 17783-C11 | VH4\|4-34/D5\|5-18\|RF3/JH6 | GGGYSDG---------------YDYGMDV | 12608 | WGQGTTVTVSS | 13069 |
| 17783-G10 | VH4\|4-34/D5\|5-18\|RF3/JH6 | GGGYSDG---------------YDYGMDV | 12609 | WGQGTTVTVSS | 13070 |
| 17813-E3 | VH4\|4-34/D5\|5-18\|RF3/JH6 | GGGYSDG---------------YDYGMDV | 12610 | WGQGTTVTVSS | 13071 |
| 17813-F1 | VH4\|4-34/D5\|5-18\|RF3/JH6 | GGGYSDG---------------YDYGMDV | 12611 | WGQGTTVTVSS | 13072 |
| VH3\|3-23/D3\|3-9\|RF1/JH4 | | VLRYFDW---------------LL*YFDY | 12612-12613 | WGQGTLVTVSS | 13073 |
| 17745-G8 | VH3\|3-23/D3\|3-9\|RF1/JH4 | HLRYFD-----------------WPLDY | 12614 | WGQGTLVTVSS | 13074 |
| 17777-C4 | VH3\|3-23/D3\|3-9\|RF1/JH4 | HLRYSD-----------------WPLDY | 12615 | WGQGTLVTVSS | 13075 |
| 18072-D6 | VH3\|3-23/D3\|3-9\|RF1/JH4 | HLRYFD-----------------WPLDY | 12616 | WGQGTLVTVSS | 13076 |
| 18084-E4 | VH3\|3-23/D3\|3-9\|RF1/JH4 | HLRYSD-----------------WPLDY | 12617 | WGQGTLVTVSS | 13077 |
| 18088-B10 | VH3\|3-23/D3\|3-9\|RF1/JH4 | HLRYFD-----------------WPLDY | 12618 | WGQGTLVTVSS | 13078 |
| VH3\|3-30.3/D1\|1-1\|RF2/JH6 | | VQLERYY---------------YYYGMDV | 12619 | WGQGTTVTVSS | 13079 |
| 17748-D12 | VH3\|3-30.3/D1\|1-1\|RF2/JH6 | EQWPNY-----------------YYGMDV | 12620 | WGQGTTVTVSS | 13080 |
| 18079-C8 | VH3\|3-30.3/D1\|1-1\|RF2/JH6 | EQWPNY-----------------YYGLGV | 12621 | WGQGTTVTVSS | 13081 |
| VH4\|4-34/D5\|5-12\|RF3/JH6 | | GYSGYDYY--------------YYYYGMDV | 12622 | WGQGTTVTVSS | 13082 |
| 17753-F4 | VH4\|4-34/D5\|5-12\|RF3/JH6 | GGGYSYG---------------YDYGMDV | 12623 | WGQGTTVTVSS | 13083 |
| 17778-F1 | VH4\|4-34/D5\|5-12\|RF3/JH6 | GGGYSYG---------------YDYGMDV | 12624 | WGQGTTVTVSS | 13084 |
| 17778-H8 | VH4\|4-34/D5\|5-12\|RF3/JH6 | GGGYSYG---------------YDYGMDV | 12625 | WGQGTTVTVSS | 13085 |
| 17779-E1 | VH4\|4-34/D5\|5-12\|RF3/JH6 | GGGYSYG---------------YDYGMDV | 12626 | WGQGTTVTVSS | 13086 |

TABLE 60-continued

HEAVY_VARIABLE

| | | | | | |
|---|---|---|---|---|---|
| 17784-c11 | VH4\|4-34/D5\|5-12\|RF3/JH6 | GGGYSYG---------------YDYGMDV | 12627 | WGQGTTVTVSS | 13087 |
| 17784-H5 | VH4\|4-34/D5\|5-12\|RF3/JH6 | GGGYSYG---------------YDYGMDV | 12628 | WGQGTTVTVSS | 13088 |
| 17785-D12 | VH4\|4-34/D5\|5-12\|RF3/JH6 | GGGYSYG---------------YDYGMDV | 12629 | WGQGTTVTVSS | 13089 |
| 17813-E5 | VH4\|4-34/D5\|5-12\|RF3/JH6 | GGGYSYG---------------YDYGMDV | 12630 | WGQGTTVTVSS | 13090 |
| 18088-E4 | VH4\|4-34/D5\|5-12\|RF3/JH6 | GGGYSYG---------------YDYGMDV | 12631 | WGQGTTVTVSS | 13091 |
| VH3\|3-23/D6\|6-19\|RF1/JH6 | | GYSSGWYY--------------YYYYGMDV | 12632 | WGQGTTVTVSS | 13092 |
| 17771-D2 | VH3\|3-23/D6\|6-19\|RF1/JH6 | DGGSGWFPK------------LLHYGLDV | 12633 | WGQGTTVTVSS | 13093 |
| 18074-G12 | VH3\|3-23/D6\|6-19\|RF1/JH6 | DGGSGWFPK------------LLHYGLDV | 12634 | WGQGTTVTVSS | 13094 |
| 18093-E2 | VH3\|3-23/D6\|6-19\|RF1/JH6 | DGGSGWFPK------------LLHYGLDV | 12635 | WGQGTTVTVSS | 13095 |
| 18089-B2 | VH3\|3-23/D6\|6-19\|RF1/JH6 | DGGSGWFPK------------LLHYGLDV | 12636 | WGQGTTVTVSS | 13096 |
| VH3\|3-23/D7\|7-27\|RF1/JH6 | | LTGYYY-----------------YYGMDV | 12637 | WGQGTTVTVSS | 13097 |
| 17779-D11 | VH3\|3-23/D7\|7-27\|RF1/JH6 | LVTPDY-----------------YYGMDV | 12638 | WGQGTTVTVSS | 13098 |
| 18089-H12 | VH3\|3-23/D7\|7-27\|RF1/JH6 | QGGIAAAY--------------YYYDGMDV | 12639 | WGQGTTVTVSS | 13099 |
| 18093-F5 | VH3\|3-23/D7\|7-27\|RF1/JH6 | GEGISARY---------------YYYGMDV | 12640 | WGQGTTVTVSS | 13100 |
| VH3\|3-23/D5\|5-18\|RF1/JH6 | | VDTAMVYY---------------YYYGMDV | 12641 | WGQGTTVTVSS | 13101 |
| 17784-B9 | VH3\|3-23/D5\|5-18\|RF1/JH6 | VMTPDY-----------------YYDMDV | 12642 | WGQGTTVTVSS | 13102 |
| 17784-C7 | VH3\|3-23/D5\|5-18\|RF1/JH6 | VMTPDY-----------------YYDMDV | 12643 | WGQGTTVTVSS | 13103 |
| 18080-H9 | VH3\|3-23/D5\|5-18\|RF1/JH6 | VMTPDY-----------------YYDMDV | 12644 | WGQGTTVTVSS | 13104 |
| VH4\|4-30.1/D3\|3-10\|RF1/JH6 | | VLLWFGELL*-----------YYYYYGMDV | 12645-12646 | WGQGTTVTVSS | 13105 |
| 17784-G10 | VH4\|4-30.1/D3\|3-10\|RF1/JH6 | DKLWFGKL--------------NYYYGMDV | 12647 | WGQGTTVTVSS | 13106 |
| 18080-C5 | VH4\|4-30.1/D3\|3-10\|RF1/JH6 | DLLWFGKL--------------NYYYGMDV | 12648 | WGQGTTVTVSS | 13107 |
| 18179-A3 | VH4\|4-30.1/D3\|3-10\|RF1/JH6 | DRLWFGVL--------------NYYYGMDV | 12649 | WGLGTTVTVSS | 13108 |
| 18179-A9 | VH4\|4-30.1/D3\|3-10\|RF1/JH6 | DRLWFGVL--------------NYYYGMDV | 12650 | WGQGTTVTVSS | 13109 |
| 18179-A10 | VH4\|4-30.1/D3\|3-10\|RF1/JH6 | DQLWFGVL--------------NYYYGMDV | 12651 | WGQGTTVTVSS | 13110 |

TABLE 60-continued

HEAVY_VARIABLE

| | | | | | |
|---|---|---|---|---|---|
| 18179-C4 | VH4\|4-30.1/D3\|3-10\|RF1/JH6 | DRLWFGVL--------------NYYYGMDV | 12652 | WGPGTTVTVSS | 13111 |
| 18179-C6 | VH4\|4-30.1/D3\|3-10\|RF1/JH6 | DQLWFGVL--------------NYYYGMDV | 12653 | WGQGTTVTVSS | 13112 |
| 18179-C10 | VH4\|4-30.1/D3\|3-10\|RF1/JH6 | DRLWFGVL--------------NYYYGMDV | 12654 | WGLGTTVTVSS | 13113 |
| 18179-F4 | VH4\|4-30.1/D3\|3-10\|RF1/JH6 | DRLWFGVL--------------NYYYGMDV | 12655 | WGLGTTVTVSS | 13114 |
| 18179-F6 | VH4\|4-30.1/D3\|3-10\|RF1/JH6 | DQLWFGVL--------------NYYYGMDV | 12656 | WGQGTTVTVSS | 13115 |
| 18179-G8 | VH4\|4-30.1/D3\|3-10\|RF1/JH6 | DQLWFGVI--------------NYYYGMDV | 12657 | WGQGTTVTVSS | 13116 |
| 18179-G9 | VH4\|4-30.1/D3\|3-10\|RF1/JH6 | DLLWFGKI--------------NYYYGLDV | 12658 | WGQGTTVTVSS | 13117 |
| 18179-H6 | VH4\|4-30.1/D3\|3-10\|RF1/JH6 | DLLWFGKL--------------NYYYGLDV | 12659 | WGQGTTVTVSS | 13118 |
| 18181-A11 | VH4\|4-30.1/D3\|3-10\|RF1/JH6 | DRLWFGVL--------------NYYYGMDV | 12660 | WGPGTTVTVSS | 13119 |
| 18181-C6 | VH4\|4-30.1/D3\|3-10\|RF1/JH6 | DRLWFGVL--------------NYYYGMDV | 12661 | WGPGTTVTVSS | 13120 |
| 18181-G10 | VH4\|4-30.1/D3\|3-10\|RF1/JH6 | DRLWFGVL--------------NYYYGMDV | 12662 | WGLGTTVTVSS | 13121 |
| 18181-E2 | VH4\|4-30.1/D3\|3-10\|RF1/JH6 | DRLWFGVL--------------NYYYGMDV | 12663 | WGLGTTVTVSS | 13122 |
| 18181-C9 | VH4\|4-30.1/D3\|3-10\|RF1/JH6 | DRLWFGVL--------------NYYYGMDV | 12664 | WGLGTTVTVSS | 13123 |
| VH3\|3-23/D1\|1-1\|RF1/JH6 | | GTTGTYY---------------YYYGMDV | 12665 | WGQGTTVTVSS | 13124 |
| 17813-D8 | VH3\|3-23/D1\|1-1\|RF1/JH6 | MVTPDY-----------------YYDMDV | 12666 | WGQGTTVTVSS | 13125 |
| VH3\|3-33/D3\|3-10\|RF2/JH6 | | YYYGSGSYYN-----------YYYYGMDV | 12667 | WGQGTTVTVSS | 13126 |
| 18071-B1 | VH3\|3-33/D3\|3-10\|RF2/JH6 | NYGSGSYGA-------------YYYHGMDV | 12668 | WGQGTTVTVSS | 13127 |
| 18082-F5 | VH3\|3-33/D3\|3-10\|RF2/JH6 | NYGSGSYGA-------------YYYHGMDV | 12669 | WGQGTTVTVSS | 13128 |
| VH1\|1-08/D7\|7-27\|RF3/JH6 | | NWGYYY----------------YYGMDV | 12670 | WGQGTTVTVSS | 13129 |
| 18071-C4 | VH1\|1-08/D7\|7-27\|RF3/JH6 | GWGTYY-----------------YYGMDV | 12671 | WGQGTTVTVSS | 13130 |
| 18071-D4 | VH1\|1-08/D7\|7-27\|RF3/JH6 | GWGRYY-----------------SYGMDV | 12672 | WGQGTTVTVSS | 13131 |
| 18079-H4 | VH1\|1-08/D7\|7-27\|RF3/JH6 | GWGRFY-----------------SYGMDV | 12673 | WGQGTTVTVSS | 13132 |

TABLE 60-continued

| HEAVY_VARIABLE | | | | | | |
|---|---|---|---|---|---|---|
| 18079-H11 | VH1\|1-08/D7\|7-27\|RF3/JH6 | GWGTYY-----------------YYGMDV | 12674 | WGQGTTVTVSS | 13133 |
| 18086-H4 | VH1\|1-08/D7\|7-27\|RF3/JH6 | GWGTYY-----------------YYGMDV | 12675 | WGQGTTVTVSS | 13134 |
| VH3\|3-21/D6\|6-6\|RF2/JH6 | | SIAARYY----------------YYYGMDV | 12676 | WGQGTTVTVSS | 13135 |
| 18072-G9 | VH3\|3-21/D6\|6-6\|RF2/JH6 | SKAARP-----------------DDGMDV | 12677 | WGQGTTVTVSS | 13136 |
| VH3\|3-30.3/D3\|3-10\|RF2/JH6 | | YYYGSGSYYN-----------YYYYYGMDV | 12678 | WGQGTTVTVSS | 13137 |
| 18078-H6 | VH3\|3-30.3/D3\|3-10\|RF2/JH6 | NYGSGSYGA-------------YYYHGMDV | 12679 | WGQGTTVTVSS | 13138 |
| 18090-H9 | VH3\|3-30.3/D3\|3-10\|RF2/JH6 | NYGSGSYGA-------------YYYYGMDV | 12680 | WGQGTTVTVSS | 13139 |
| VH4\|4-59/D3\|3-3\|RF3/JH4 | | ITIFGVV----------------IIYFDY | 12681 | WGQGTLVTVSS | 13140 |
| 18081-A6 | VH4\|4-59/D3\|3-3\|RF3/JH4 | GIFGVI-------------------TYFDY | 12682 | WGQGTLVTVSS | 13141 |
| 18081-B9 | VH4\|4-59/D3\|3-3\|RF3/JH4 | GIFGVI-------------------TYFDY | 12683 | WGQGTLVTVSS | 13142 |
| 18081-E7 | VH4\|4-59/D3\|3-3\|RF3/JH4 | GIFGVI-------------------TYFDY | 12684 | WGQGTLVTVSS | 13143 |
| 18081-B9_final | VH4\|4-59/D3\|3-3\|RF3/JH4 | GIFGVI-------------------TYFDY | 12685 | WGQGTLVTVSS | 13144 |
| VH6\|6-01/D3\|3-10\|RF1/JH6 | | VLLWFGELL*-----------YYYYYGMDV | 12686-12687 | WGQGTTVTVSS | 13145 |
| 18081-B5 | VH6\|6-01/D3\|3-10\|RF1/JH6 | EVLWFGKL--------------NYYYGMDV | 12688 | WGQGTTVTVSS | 13146 |
| VH4\|4-b/D3\|3-3\|RF3/JH5 | | ITIFGVV----------------IINWFDP | 12689 | WGQGTLVTVSS | 13147 |
| 18081-C10 | VH4\|4-b/D3\|3-3\|RF3/JH5 | TIFGVV------------------GWFDP | 12690 | WGQGNLVTVSS | 13148 |
| VH2\|2-70/D2\|2-15\|RF1/JH5 | | RIL*WW*L---------------LLNWFDP | 12691 | WGQGTLVTVSS | 13149 |
| 18081-D6 | VH2\|2-70/D2\|2-15\|RF1/JH5 | RRYNWNY----------------ENWFDP | 12692 | WGQGTLVTVSS | 13150 |
| 18089-C8 | VH2\|2-70/D2\|2-15\|RF1/JH5 | RRYNWNY----------------ENWFDP | 12693 | WGQGILVTVSS | 13151 |
| 18081-H11 | VH2\|2-70/D2\|2-15\|RF1/JH5 | RRYNWNY----------------ENWFDP | 12694 | WGQGTLVTVSS | 13152 |
| VH3\|3-23/D1\|1-26\|RF1/JH6 | | GIVGATYY---------------YYYGMDV | 12695 | WGQGTTVTVSS | 13153 |
| 18081-D12 | VH3\|3-23/D1\|1-26\|RF1/JH6 | GEGIAARY---------------YYYGMDV | 12696 | WGQGTTVTVSS | 13154 |
| VH4\|4-59/D3\|3-3\|RF3/JH5 | | ITIFGVV----------------IINWFDP | 12697 | WGQGTLVTVSS | 13155 |
| 18089-B8 | VH4\|4-59/D3\|3-3\|RF3/JH5 | TIFGVV------------------GWFDP | 12698 | WGQGNLVTVSS | 13156 |
| VH2\|2-05/D2\|2-15\|RF1/JH5 | | RIL*WW*I---------------LLNWFDP | 12699 | WGQGTLVTVSS | 13157 |

TABLE 60-continued

HEAVY_VARIABLE

| | | | | | |
|---|---|---|---|---|---|
| 18089-G7 | VH2\|2-05/D2\|2-15\|RF1/JH5 | RRYNWNY----------------ENWFDP | 12700 | WGQGTLVTVSS | 13158 |
| 18089-D11 | VH2\|2-05/D2\|2-15\|RF1/JH5 | RRYNWNY----------------ENWFDP | 12701 | WGQGTLVTVSS | 13159 |
| 18089-C9 | VH2\|2-05/D2\|2-15\|RF1/JH5 | RRYNWNY----------------ENWFDP | 12702 | WGQGTLVTVSS | 13160 |
| 18089-D8 | VH2\|2-05/D2\|2-15\|RF1/JH5 | RRYNWNY----------------ENWFDP | 12703 | WGQGTLVTVSS | 13161 |
| 18081-F9 | VH2\|2-05/D2\|2-15\|RF1/JH5 | RRYNWNY----------------ENWFDP | 12704 | WGQGTLVTVSS | 13162 |
| 18081-B6 | VH2\|2-05/D2\|2-15\|RF1/JH5 | RRYNWNY----------------ENWFDP | 12705 | WGQGTLVTVSS | 13163 |
| 18409-F12_final | VH2\|2-05/D2\|2-15\|RF1/JH5 | RRYNWNY----------------ENWFDP | 12706 | WGQGTLVTVSS | 13164 |
| 18409-G10_final | VH2\|2-05/D2\|2-15\|RF1/JH5 | RRYNWNY----------------ENWFDP | 12707 | WGQGTLVTVSS | 13165 |
| 18409-H7_final | VH2\|2-05/D2\|2-15\|RF1/JH5 | RRYNWNY----------------ENWFDP | 12708 | WGQGTLVTVSS | 13166 |
| 18409-H10_final | VH2\|2-05/D2\|2-15\|RF1/JH5 | RRYNWNY----------------ENWFDP | 12709 | WGQGTLVTVSS | 13167 |
| VH3\|3-23/D7\|7-27\|RF2/JH6 | | *LGYYY-----------------YYGMDV | 12710 | WGQGTTVTVSS | 13168 |
| 18089-G11 | VH3\|3-23/D7\|7-27\|RF2/JH6 | TLTPDY-----------------YYDMDV | 12711 | WGQGTTVTVSS | 13169 |
| 18089-H9 | VH3\|3-23/D7\|7-27\|RF2/JH6 | ALTPDY-----------------YYDMDV | 12712 | WGQGTTVTVSS | 13170 |
| VH4\|4-30.1/D\|3-10\|RF3/JH6 | | ITMVRGVII------------YYYYYGMDV | 12713 | WGQGTTVTVSS | 13171 |
| 18179-A5 | VH4\|4-30.1/D3\|3-10\|RF3/JH6 | EKMWFGVL--------------NYYYGMDV | 12714 | WGQGTTVTVSS | 13172 |
| 18179-C7 | VH4\|4-30.1/D3\|3-10\|RF3/JH6 | EKMWFGVL--------------NYYYGMDV | 12715 | WGLGTTVTVSS | 13173 |
| 18179-H9 | VH4\|4-30.1/D3\|3-10\|RF3/JH6 | EKMWFGVL--------------NYYYGMDV | 12716 | WGQGTTVTVSS | 13174 |
| 18181-H7 | VH4\|4-30.1/D3\|3-10\|RF3/JH6 | EKMWFGVL--------------NYYYGMDV | 12717 | WGQGTTVTVSS | 13175 |
| 18181-B8 | VH4\|4-30.1/D3\|3-10\|RF3/JH6 | EKMWFGVL--------------NYYYGMDV | 12718 | WGQGTTVTVSS | 13176 |
| 81-H7-SG-F28_final | VH4\|4-30.1/D3\|3-10\|RF3/JH6 | EKMWFGVL--------------NYYYGMDV | 12719 | WGQGTTVTVSS | 13177 |
| VH3\|3-15/D3\|3-10\|RF2/JH6 | | YYYGSGSYYN-----------YYYYYGMDV | 12720 | WGQGTTVTVSS | 13178 |
| 18179-B7 | VH3\|3-15/D3\|3-10\|RF2/JH6 | PSNSGSYY--------------NYFSVMDV | 12721 | WGQGTTVTVSS | 13179 |
| 18179-B8 | VH3\|3-15/D3\|3-10\|RF2/JH6 | PSNSGSYY--------------NYFSVMDV | 12722 | WGQGTTVTVSS | 13180 |

TABLE 60-continued

HEAVY_VARIABLE

| | | | | | |
|---|---|---|---|---|---|
| 18179-D8 | VH3\|3-15/D3\|3-10\|RF2/JH6 | PSNSGSYY--------------NYFSVMDV | 12723 | WGQGTTVTVSS | 13181 |
| 18179-D9 | VH3\|3-15/D3\|3-10\|RF2/JH6 | PSYSGSYY--------------NYFSVMDV | 12724 | WGQGTTVTVSS | 13182 |
| 18179-E6 | VH3\|3-15/D3\|3-10\|RF2/JH6 | PSNSGSYY--------------NYFSVMDV | 12725 | WGQGTTVTVSS | 13183 |
| 18181-G7 | VH3\|3-15/D3\|3-10\|RF2/JH6 | PSNGGSYY--------------NYFSVMDV | 12726 | WGQGTTVTVSS | 13184 |
| 18179-E1 | VH3\|3-15/D3\|3-10\|RF2/JH6 | PSYSGSYY--------------NYFSVMDV | 12727 | WGQGTTVTVSS | 13185 |
| 18179-H7 | VH3\|3-15/D3\|3-10\|RF2/JH6 | PSYSGSYY--------------NYFSVMDV | 12728 | WGQGTTVTVSS | 13186 |
| 18179-B12 | VH3\|3-15/D3\|3-10\|RF2/JH6 | PSNSGSYY--------------NYFSVMDV | 12729 | WGQGTTVTVSS | 13187 |
| 18179-D11 | VH3\|3-15/D3\|3-10\|RF2/JH6 | PSYSGSYY--------------NYFSVMDV | 12730 | WGQGTTVTVSS | 13188 |
| 18179-D7 | VH3\|3-15/D3\|3-10\|RF2/JH6 | PSYSGSYY--------------NYFSVMDV | 12731 | WGQGTTVTVSS | 13189 |
| 18179-A7 | VH3\|3-15/D3\|3-10\|RF2/JH6 | PSYSGSYY--------------NYFSVMDV | 12732 | WGQGTTVTVSS | 13190 |
| 18181-G8 | VH3\|3-15/D3\|3-10\|RF2/JH6 | PSNSGSYY--------------NYFSVMDV | 12733 | WGQGTTVTVSS | 13191 |
| 18181-F3 | VH3\|3-15/D3\|3-10\|RF2/JH6 | PSYSGSYY--------------NYFSVMDV | 12734 | WGQGTTVTVSS | 13192 |
| 18181-F1 | VH3\|3-15/D3\|3-10\|RF2/JH6 | PSYSGSYY--------------NYFSVMDV | 12735 | WGQGTTVTVSS | 13193 |
| 18181-A6 | VH3\|3-15/D3\|3-10\|RF2/JH6 | PSYSGSYY--------------NYFSVMDV | 12736 | WGQGTTVTVSS | 13194 |
| 18409-E2_final | VH3\|3-15/D3\|3-10\|RF2/JH6 | PSYSGSYY--------------NYFSVMDV | 12737 | WGQGTTVTVSS | 13195 |
| 18410-B5_final | VH3\|3-15/D3\|3-10\|RF2/JH6 | PSYSGSYY--------------NYFSVMDV | 12738 | WGQGTTVTVSS | 13196 |
| 18410-B6_final | VH3\|3-15/D3\|3-10\|RF2/JH6 | PSYSGSYY--------------NYFSVMDV | 12739 | WGQGTTVTVSS | 13197 |
| 18410-D3_final | VH3\|3-15/D3\|3-10\|RF2/JH6 | PSYSGSYY--------------NYFSVMDV | 12740 | WGQGTTVTVSS | 13198 |
| 18410-D6_final | VH3\|3-15/D3\|3-10\|RF2/JH6 | PSYSGSYY--------------NYFSVMDV | 12741 | WGQGTTVTVSS | 13199 |
| 18410-H1_final | VH3\|3-15/D3\|3-10\|RF2/JH6 | PSYSGSYY--------------NYFSVMDV | 12742 | WGQGTTVTVSS | 13200 |
| 18410-H3_final | VH3\|3-15/D3\|3-10\|RF2/JH6 | PSYSGSYY--------------NYFSVMDV | 12743 | WGQGTTVTVSS | 13201 |
| VH4\|4-59/D3\|3-10\|RF3/JH6 | | ITMVRGVII------------YYYYYGMDV | 12744 | WGQGTTVTVSS | 13202 |
| 18179-F3 | VH4\|4-59/D3\|3-10\|RF3/JH6 | EKMWFGVL--------------NYYYGMDV | 12745 | WGQGTTVTVSS | 13203 |
| 18179-F10 | VH4\|4-59/D3\|3-10\|RF3/JH6 | EKMWFGVL--------------NYYYGMDV | 12746 | WGQGTTVTVSS | 13204 |
| 18181-H10 | VH4\|4-59/D3\|3-10\|RF3/JH6 | EKMWFGVL--------------NYYYGMDV | 12747 | WGQGTTVTVSS | 13205 |
| VH3\|3-23/D6\|6-19\|RF2/JH4 | | GIAVA-------------------GYFDY | 12748 | WGQGTLVTVSS | 13206 |

TABLE 60-continued

| HEAVY_VARIABLE | | | | | | |
|---|---|---|---|---|---|---|
| 18182-A3 | VH3\|3-23/D6\|6-19\|RF2/JH4 | GKGVH--------------------LGFDY | 12749 | WGQGTLVTVSS | 13207 |
| 18182-A5 | VH3\|3-23/D6\|6-19\|RF2/JH4 | GKGVH--------------------LNFDY | 12750 | WGQGTLVTVSS | 13208 |
| 18182-A6 | VH3\|3-23/D6\|6-19\|RF2/JH4 | GKGVH--------------------LGFDY | 12751 | WGQGTLVTVSS | 13209 |
| 18182-A7 | VH3\|3-23/D6\|6-19\|RF2/JH4 | GKGVH--------------------LGFDY | 12752 | WGQGTLVTVSS | 13210 |
| 18182-A8 | VH3\|3-23/D6\|6-19\|RF2/JH4 | GKGVH--------------------LGFDY | 12753 | WGQGTLVTVSS | 13211 |
| 18182-A11 | VH3\|3-23/D6\|6-19\|RF2/JH4 | GKGVH--------------------LGFDY | 12754 | WGQGTLVTVSS | 13212 |
| 18182-B1 | VH3\|3-23/D6\|6-19\|RF2/JH4 | GKGVH--------------------LGFDY | 12755 | WGQGTLVTVSS | 13213 |
| 18182-B4 | VH3\|3-23/D6\|6-19\|RF2/JH4 | GKGVH--------------------LGFDY | 12756 | WGQGTLVTVSS | 13214 |
| 18182-B6 | VH3\|3-23/D6\|6-19\|RF2/JH4 | GKGVH--------------------LGFDY | 12757 | WGQGTLVTVSS | 13215 |
| 18182-B10 | VH3\|3-23/D6\|6-19\|RF2/JH4 | GKGVH--------------------LNFDY | 12758 | WGQGTLVTVSS | 13216 |
| 18182-C2 | VH3\|3-23/D6\|6-19\|RF2/JH4 | GKGVH--------------------LGFDY | 12759 | WGQGTLVTVSS | 13217 |
| 18182-C3 | VH3\|3-23/D6\|6-19\|RF2/JH4 | GKGVH--------------------LGFDY | 12760 | WGQGTLVTVSS | 13218 |
| 18182-C4 | VH3\|3-23/D6\|6-19\|RF2/JH4 | GKGVH--------------------LGFDY | 12761 | WGQGTLVTVSS | 13219 |
| 18182-C5 | VH3\|3-23/D6\|6-19\|RF2/JH4 | GKGVH--------------------LNFDY | 12762 | WGQGTLVTVSS | 13220 |
| 18182-C10 | VH3\|3-23/D6\|6-19\|RF2/JH4 | GKGVH--------------------LGFDY | 12763 | WGQGTLVTVSS | 13221 |
| 18182-C12 | VH3\|3-23/D6\|6-19\|RF2/JH4 | GKGVH--------------------LGFDY | 12764 | WGQGTLVTVSS | 13222 |
| 18182-D4 | VH3\|3-23/D6\|6-19\|RF2/JH4 | GKGVH--------------------LNFDY | 12765 | WGQGTLVTVSS | 13223 |
| 18182-D8 | VH3\|3-23/D6\|6-19\|RF2/JH4 | GKGVH--------------------LGFDY | 12766 | WGQGTLVTVSS | 13224 |
| 18182-D9 | VH3\|3-23/D6\|6-19\|RF2/JH4 | GKGVH--------------------LNFDY | 12767 | WGQGTLVTVSS | 13225 |
| 18182-D11 | VH3\|3-23/D6\|6-19\|RF2/JH4 | GKGVH--------------------LNFDY | 12768 | WGQGTLVTVSS | 13226 |
| 18182-E2 | VH3\|3-23/D6\|6-19\|RF2/JH4 | GKGVH--------------------LGFDY | 12769 | WGQGTLVTVSS | 13227 |
| 18182-E3 | VH3\|3-23/D6\|6-19\|RF2/JH4 | GKGVH--------------------LGFDY | 12770 | WGQGTLVTVSS | 13228 |
| 18182-E8 | VH3\|3-23/D6\|6-19\|RF2/JH4 | GKGVH--------------------LGFDY | 12771 | WGQGTLVTVSS | 13229 |
| 18182-E11 | VH3\|3-23/D6\|6-19\|RF2/JH4 | GKGVH--------------------LGFDY | 12772 | WGQGTLVTVSS | 13230 |
| 18182-F1 | VH3\|3-23/D6\|6-19\|RF2/JH4 | GKGVH--------------------LNFDY | 12773 | WGQGTLVTVSS | 13231 |
| 18182-F6 | VH3\|3-23/D6\|6-19\|RF2/JH4 | GKGVH--------------------LNFDY | 12774 | WGQGTLVTVSS | 13232 |

TABLE 60-continued

| HEAVY_VARIABLE | | | | | | |
|---|---|---|---|---|---|---|
| 18182-F8 | VH3\|3-23/D6\|6-19\|RF2/JH4 | GKGVH--------------------LGFDY | 12775 | WGQGTLVTVSS | 13233 |
| 18182-G3 | VH3\|3-23/D6\|6-19\|RF2/JH4 | GKGVH--------------------LGFDY | 12776 | WGQGTLVTVSS | 13234 |
| 18182-G4 | VH3\|3-23/D6\|6-19\|RF2/JH4 | GKGVH--------------------LGFDY | 12777 | WGQGTLVTVSS | 13235 |
| 18182-G5 | VH3\|3-23/D6\|6-19\|RF2/JH4 | GKGVH--------------------LGFDY | 12778 | WGQGTLVTVSS | 13236 |
| 18182-G9 | VH3\|3-23/D6\|6-19\|RF2/JH4 | GKGVH--------------------LGFDY | 12779 | WGQGTLVTVSS | 13237 |
| 18182-G11 | VH3\|3-23/D6\|6-19\|RF2/JH4 | GKGVH--------------------LGFDY | 12780 | WGQGTLVTVSS | 13238 |
| 18182-H5 | VH3\|3-23/D6\|6-19\|RF2/JH4 | GKGVH--------------------LGFDY | 12781 | WGQGTLVTVSS | 13239 |
| 18182-B5 | VH3\|3-23/D6\|6-19\|RF2/JH4 | GKGVH--------------------LGFDY | 12782 | WGQGTLVTVSS | 13240 |
| 18182-H9 | VH3\|3-23/D6\|6-19\|RF2/JH4 | GKGVH--------------------LGFDY | 12783 | WGQGTLVTVSS | 13241 |
| 18182-E6 | VH3\|3-23/D6\|6-19\|RF2/JH4 | GKGVH--------------------LNFDY | 12784 | WGQGTLVTVSS | 13242 |
| 18182-G6 | VH3\|3-23/D6\|6-19\|RF2/JH4 | GKGVH--------------------LGFDY | 12785 | WGQGTLVTVSS | 13243 |
| 18182-G2 | VH3\|3-23/D6\|6-19\|RF2/JH4 | GKGVH--------------------LGFDY | 12786 | WGQGTLVTVSS | 13244 |
| 18182-H12 | VH3\|3-23/D6\|6-19\|RF2/JH4 | GKGVH--------------------LGFDY | 12787 | WGQGTLVTVSS | 13245 |
| 18182-G8 | VH3\|3-23/D6\|6-19\|RF2/JH4 | GKGVH--------------------LNFDY | 12788 | WGQGTLVTVSS | 13246 |
| 18182-E10 | VH3\|3-23/D6\|6-19\|RF2/JH4 | GKGVH--------------------LNFDY | 12789 | WGQGTLVTVSS | 13247 |
| 18182-B12 | VH3\|3-23/D6\|6-19\|RF2/JH4 | GKGVH--------------------LGFDY | 12790 | WGQGTLVTVSS | 13248 |
| 18182-E5 | VH3\|3-23/D6\|6-19\|RF2/JH4 | GKGVH--------------------LGFDY | 12791 | WGQGTLVTVSS | 13249 |
| 18182-A4 | VH3\|3-23/D6\|6-19\|RF2/JH4 | GKGVH--------------------LGFDY | 12792 | WGQGTLVTVSS | 13250 |
| 18182-E1 | VH3\|3-23/D6\|6-19\|RF2/JH4 | GKGVH--------------------LGFDY | 12793 | WGQGTLVTVSS | 13251 |
| 18403-F12-AS | VH3\|3-23/D6\|6-19\|RF2/JH4 | GKGVH--------------------LGFDY | 12794 | WGQGTLVTVSS | 13252 |
| 18403-G10-AS | VH3\|3-23/D6\|6-19\|RF2/JH4 | GKGVH--------------------LGFDY | 12795 | WGQGTLVTVSS | 13253 |
| 18398-C7_final | VH3\|3-23/D6\|6-19\|RF2/JH4 | GKGVH--------------------LGFDY | 12796 | WGQGTLVTVSS | 13254 |
| 18403-D8_final | VH3\|3-23/D6\|6-19\|RF2/JH4 | GKGVH--------------------LGFDY | 12797 | WGQGTLVTVSS | 13255 |
| 18403-D8_AS_final | VH3\|3-23/D6\|6-19\|RF2/JH4 | GKGVH--------------------LGFDY | 12798 | WGQGTLVTVSS | 13256 |
| 18403-E11_AS_final | VH3\|3-23/D6\|6-19\|RF2/JH4 | GKGVH--------------------LGFDY | 12799 | WGQGTLVTVSS | 13257 |
| 18403-F12_final | VH3\|3-23/D6\|6-19\|RF2/JH4 | GKGVH--------------------LGFDY | 12800 | WGQGTLVTVSS | 13258 |

TABLE 60-continued

| | HEAVY_VARIABLE | | | | |
|---|---|---|---|---|---|
| 18403-F12-AS_final | VH3\|3-23/D6\|6-19\|RF2/JH4 | GKGVH--------------------LGFDY | 12801 | WGQGTLVTVSS | 13259 |
| 18403-G10_final | VH3\|3-23/D6\|6-19\|RF2/JH4 | GKGVH--------------------LGFDY | 12802 | WGQGTLVTVSS | 13260 |
| 18403-G10-AS_final | VH3\|3-23/D6\|6-19\|RF2/JH4 | GKGVH--------------------LGFDY | 12803 | WGQGTLVTVSS | 13261 |
| 18410-G10_final | VH3\|3-23/D6\|6-19\|RF2/JH4 | GKGVH--------------------LGFDY | 12804 | WGQGTLVTVSS | 13262 |
| 18410-G10_AS_final | VH3\|3-23/D6\|6-19\|RF2/JH4 | GKGVH--------------------LGFDY | 12805 | WGQGTLVTVSS | 13263 |
| VH3\|3-23/D6\|6-19\|RF2/JH1 | | GIAVAG-------------------AEYFQH | 12806 | WGQGTLVTVSS | 13264 |
| 18182-B7 | VH3\|3-23/D6\|6-19\|RF2/JH1 | GKGVH--------------------LGFDH | 12807 | WGQGTLVTVSS | 13265 |
| VH3\|3-30.3/D1\|1-1\|RF2/JH4 | | VQLER--------------------YFDY | 12808 | WGQGTLVTVSS | 13266 |
| 18089-D12 | VH3\|3-30.3/D1\|1-1\|RF2/JH4 | GQLL----------------------TGY | 12809 | WGQGTLVTVSS | 13267 |
| 02-C1-86-A4-N-F5_final | VH3\|3-30.3/D1\|1-1\|RF2/JH4 | GQLL----------------------TGY | 12810 | WGQGTLVTVSS | 13268 |
| 18486-A4_final | VH3\|3-30.3/D1\|1-1\|RF2/JH4 | GQLL----------------------TGY | 12811 | WGQGTLVTVSS | 13269 |
| VH1\|1-18/D6\|6-13\|RF2/JH4 | | GIAAA--------------------GYFDY | 12812 | WGQGTLVTVSS | 13270 |
| 18179-G12 | VH1\|1-18/D6\|6-13\|RF2/JH4 | GRAT----------------------FDY | 12813 | WGQGTLVTVSS | 13271 |
| 18179-C1 | VH1\|1-18/D6\|6-13\|RF2/JH4 | GRAT----------------------FDY | 12814 | WGQGTLVTVSS | 13272 |
| VH3\|3-11/D1\|1-1\|RF3/JH4 | | YNWND--------------------YFDY | 12815 | WGQGTLVTVSS | 13273 |
| 18093-B11 | VH3\|3-11/D1\|1-1\|RF3/JH4 | YNYG---------------------HFDY | 12816 | WGQGTLVTVSS | 13274 |
| 03-F3-88-B3-F9_final | VH3\|3-11/D1\|1-1\|RF3/JH4 | YNYG---------------------HFDY | 12817 | WGQGTLVTVSS | 13275 |

TABLE 61 scFv Variable Region Consensus Protein Alignment
CDRs defined by Kabat
Alignment numbering defined by Amgen Reference (AHo)

| | KAPPA_VARIABLE | | |
|---|---|---|---|
| | Germline | | SEQ ID NO: |
| | | K_FR1 | |
| VK4\|B3/JK2 | | DIVMTQSPDSLAVSLGERATINC | 13276 |
| 17724-C9 | VK4\|B3/JK2 | EL......S.....V..KI.MS. | 13277 |
| 18079-H4 | VK4\|B3/JK2 | EL..................... | 13278 |
| 18079-H11 | VK4\|B3/JK2 | EL..................... | 13279 |
| VK6\|A10/JK2 | | EIVLTQSPDFQSVTPKEKVTITC | 13280 |

TABLE 61-continued scFv Variable Region Consensus Protein Alignment
CDRs defined by Kabat
Alignment numbering defined by Amgen Reference (AHo)
KAPPA_VARIABLE

|  | Germline |  | SEQ ID NO: |
|---|---|---|---|
| 17724-G6 | VK6\|A10/JK2 | .L......AIM.AS.GQ...... | 13281 |
| VK1\|L11/JK2 |  | AIQMTQSPSSLSASVGDRVTITC | 13282 |
| 17731-H8 | VK1\|L11/JK2 | EL......A.......ET..... | 13283 |
| VK2\|A19/JK5 |  | DIVMTQSPLSLPVTPGEPASISC | 13284 |
| 17732-A8 | VK2\|A19/JK5 | EL...........S......... | 13285 |
| 18081-B5 | VK2\|A19/JK5 | EL.L................... | 13286 |
| VK2\|A19/JK2 |  | DIVMTQSPLSLPVTPGEPASISC | 13287 |
| 17745-E5 | VK2\|A19/JK2 | EL..................... | 13288 |
| 17778-F1 | VK2\|A19/JK2 | EL..................... | 13289 |
| 17778-H8 | VK2\|A19/JK2 | EL.L................... | 13290 |
| 18088-E4 | VK2\|A19/JK2 | EL...........I......... | 13291 |
| 18179-C4 | VK2\|A19/JK2 | EL..................... | 13292 |
| 18179-C7 | VK2\|A19/JK2 | EL.L................... | 13293 |
| 18179-F3 | VK2\|A19/JK2 | EL.L................... | 13294 |
| 18181-C6 | VK2\|A19/JK2 | EL..................... | 13295 |
| VK2\|O1/JK1 |  | DIVMTQTPLSLPVTPGEPASISC | 13296 |
| 17745-E8 | VK2\|O1/JK1 | EL...........I......... | 13297 |
| 18179-C6 | VK2\|O1/JK1 | EL..................... | 13298 |
| 18179-F10 | VK2\|O1/JK1 | EL..................... | 13299 |
| 18179-G9 | VK2\|O1/JK1 | EL..................... | 13300 |
| 18181-H7 | VK2\|O1/JK1 | EL..................... | 13301 |
| 18181-B8 | VK2\|O1/JK1 | EL..................... | 13302 |
| 81-H7-SG-F28_final | VK2\|O1/JK1 | ....................... | 13303 |
| VK3\|A27/JK3 |  | EIVLTQSPGTLSLSPGERATLSC | 13304 |
| 17745-G8 | VK3\|A27/JK3 | .LT.................... | 13305 |
| 18080-H9 | VK3\|A27/JK3 | .LT.................... | 13306 |
| VK3\|A27/JK4 |  | EIVLTQSPGTLSLSPGERATLSC | 13307 |
| 17748-D12 | VK3\|A27/JK4 | .L..................... | 13308 |
| 17777-C4 | VK3\|A27/JK4 | .L..................... | 13309 |
| 18072-D6 | VK3\|A27/JK4 | .LT.................... | 13310 |
| 18084-E4 | VK3\|A27/JK4 | .LT.................... | 13311 |
| 18088-B10 | VK3\|A27/JK4 | .L.M................... | 13312 |
| VK2\|A19/JK3 |  | DIVMTQSPLSLPVTPGEPASISC | 13313 |
| 17753-F4 | VK2\|A19/JK3 | EL..................... | 13314 |
| 17779-E1 | VK2\|A19/JK3 | EL.L................... | 13315 |
| 17780-E6 | VK2\|A19/JK3 | EL..................... | 13316 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 17785-D12 | VK2\|A19/JK3 | EL..................... | 13317 |
| 18179-A3 | VK2\|A19/JK3 | EL..................... | 13318 |
| 18179-A5 | VK2\|A19/JK3 | EL.L................... | 13319 |
| 18179-C10 | VK2\|A19/JK3 | EL.L................... | 13320 |
| 18179-F4 | VK2\|A19/JK3 | EL.L................... | 13321 |
| 18179-H9 | VK2\|A19/JK3 | EL.L................... | 13322 |
| 18181-A11 | VK2\|A19/JK3 | EL..................... | 13323 |
| 18181-C9 | VK2\|A19/JK3 | EL.L................... | 13324 |
| VK1\|L19/JK1 |  | DIQMTQSPSSVSASVGDRVTITC | 13325 |
| 17771-D2 | VK1\|L19/JK1 | EL..................... | 13326 |
| 17784-B9 | VK1\|L19/JK1 | EL..................... | 13327 |
| VK2\|A19/JK4 |  | DIVMTQSPLSLPVTPGEPASISC | 13328 |
| 17777-B4 | VK2\|A19/JK4 | EL..................... | 13329 |
| 17777-C5 | VK2\|A19/JK4 | EL.L.........S......... | 13330 |
| 17783-C11 | VK2\|A19/JK4 | EL.L................... | 13331 |
| 17813-F1 | VK2\|A19/JK4 | EL..........S.......... | 13332 |
| 18179-A9 | VK2\|A19/JK4 | EL..................... | 13333 |
| VK2\|O1/JK2 |  | DIVMTQTPLSLPVTPGEPASISC | 13334 |
| 17778-C9 | VK2\|O1/JK2 | EL.L.........S......... | 13335 |
| 18179-H6 | VK2\|O1/JK2 | EL..................... | 13336 |
| VK1\|O12/JK1 |  | DIQMTQSPSSLSASVGDRVTITC | 13337 |
| 17779-D11 | VK1\|O12/JK1 | EL..................... | 13338 |
| 18081-D12 | VK1\|O12/JK1 | ELV.................... | 13339 |
| 18093-E2 | VK1\|O12/JK1 | ELV.................... | 13340 |
| 18093-F5 | VK1\|O12/JK1 | ELV.................... | 13341 |
| 18409-F12_final | VK1\|O12/JK1 | ....................... | 13342 |
| 18409-H7_final | VK1\|O12/JK1 | ....................... | 13343 |
| 18409-H10_final | VK1\|O12/JK1 | ....................... | 13344 |
| VK2\|O1/JK5 |  | DIVMTQTPLSLPVTPGEPASISC | 13345 |
| 17780-D12 | VK2\|O1/JK5 | EL...........S......... | 13346 |
| 17784-G10 | VK2\|O1/JK5 | EL..................... | 13347 |
| VK2\|A19/JK1 |  | DIVMTQSPLSLPVTPGEPASISC | 13348 |
| 17781-B3 | VK2\|A19/JK1 | EL..................... | 13349 |
| 17781-H12 | VK2\|A19/JK1 | EL...........S......... | 13350 |
| 17784-H5 | VK2\|A19/JK1 | EL.L................... | 13351 |
| 18080-C5 | VK2\|A19/JK1 | EL.L................... | 13352 |
| 18179-F6 | VK2\|A19/JK1 | EL..................... | 13353 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18179-G8 | VK2\|A19/JK1 | EL..................... | 13354 |
| 18181-H10 | VK2\|A19/JK1 | EL..................... | 13355 |
| 18181-G10 | VK2\|A19/JK1 | EL..................... | 13356 |
| 18181-E2 | VK2\|A19/JK1 | EL..................... | 13357 |
| VK2\|O1/JK4 |  | DIVMTQTPLSLPVTPGEPASISC | 13358 |
| 17783-G10 | VK2\|O1/JK4 | EL...........I......... | 13359 |
| 17813-E3 | VK2\|O1/JK4 | EL..................... | 13360 |
| 17813-E5 | VK2\|O1/JK4 | EL..................... | 13361 |
| VK1\|A20/JK3 |  | DIQMTQSPSSLSASVGDRVTITC | 13362 |
| 17784-C7 | VK1\|A20/JK3 | EL..................... | 13363 |
| 18089-H9 | VK1\|A20/JK3 | EL..................... | 13364 |
| 18089-D12 | VK1\|A20/JK3 | ELV.................... | 13365 |
| 18179-C1 | VK1\|A20/JK3 | ELV.................... | 13366 |
| 02-C1-86-A4-N-F5_final | VK1\|A20/JK3 | ....................... | 13367 |
| 18486-A4_final | VK1\|A20/JK3 | ....................... | 13368 |
| VK2\|O1/JK3 |  | DIVMTQTPLSLPVTPGEPASISC | 13369 |
| 17784-C11 | VK2\|O1/JK3 | EL..................... | 13370 |
| VK1\|A20/JK1 |  | DIQMTQSPSSLSASVGDRVTITC | 13371 |
| 17813-D8 | VK1\|A20/JK1 | ELV.................... | 13372 |
| VK2\|A18/JK5 |  | DIVMTQTPLSLSVTPGQPASISC | 13373 |
| 17814-D9 | VK2\|A18/JK5 | EL....S................ | 13374 |
| VK4\|B3/JK1 |  | DIVMTQSPDSLAVSLGERATINC | 13375 |
| 18071-C4 | VK4\|B3/JK1 | EL..................... | 13376 |
| 18071-D4 | VK4\|B3/JK1 | EL..................... | 13377 |
| 18086-H4 | VK4\|B3/JK1 | EL..................... | 13378 |
| VK1\|O18/JK1 |  | DIQMTQSPSSLSASVGDRVTITC | 13379 |
| 18074-G12 | VK1\|O18/JK1 | ELV.................... | 13380 |
| VK4\|B3/JK4 |  | DIVMTQSPDSLAVSLGERATINC | 13381 |
| 18081-A6 | VK4\|B3/JK4 | EL................ | 13382 |
| 18081-C10 | VK4\|B3/JK4 | EL..................... | 13383 |
| 18089-B8 | VK4\|B3/JK4 | EL..................... | 13384 |
| 18081-E7 | VK4\|B3/JK4 | EL....T................ | 13385 |
| VK1\|O12/JK2 |  | DIQMTQSPSSLSASVGDRVTITC | 13386 |
| 18081-D6 | VK1\|O12/JK2 | ELV.................... | 13387 |
| 18089-H12 | VK1\|O12/JK2 | EL..................... | 13388 |
| 18179-E6 | VK1\|O12/JK2 | EL..................... | 13389 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18089-D11 | VK1\|O12/JK2 | ELV.................... | 13390 |
| 18081-B6 | VK1\|O12/JK2 | ELV.................... | 13391 |
| 18181-F1 | VK1\|O12/JK2 | ELV.................... | 13392 |
| 18181-A6 | VK1\|O12/JK2 | ELV.................... | 13393 |
| 18410-B6_final | VK1\|O12/JK2 | ....................... | 13394 |
| 18410-H3_final | VK1\|O12/JK2 | ....................... | 13395 |
| VK1\|O12/JK4 |  | DIQMTQSPSSLSASVGDRVTITC | 13396 |
| 18089-C8 | VK1\|O12/JK4 | EL..................... | 13397 |
| 18089-B2 | VK1\|O12/JK4 | EL..................... | 13398 |
| 18181-G8 | VK1\|O12/JK4 | ELV.................... | 13399 |
| 18410-B5_final | VK1\|O12/JK4 | ....................... | 13400 |
| VK1\|O12/JK3 |  | DIQMTQSPSSLSASVGDRVTITC | 13401 |
| 18089-G7 | VK1\|O12/JK3 | EL..................... | 13402 |
| 18179-B7 | VK1\|O12/JK3 | ELV.................... | 13403 |
| 18179-B8 | VK1\|O12/JK3 | ELV.................... | 13404 |
| 18179-D8 | VK1\|O12/JK3 | ELV.................... | 13405 |
| 18179-D9 | VK1\|O12/JK3 | ELV.................... | 13406 |
| 18181-G7 | VK1\|O12/JK3 | ELV.................... | 13407 |
| 18089-C9 | VK1\|O12/JK3 | EL..................... | 13408 |
| 18081-F9 | VK1\|O12/JK3 | EL..................... | 13409 |
| 18081-H11 | VK1\|O12/JK3 | EL..................... | 13410 |
| 18179-E1 | VK1\|O12/JK3 | ELV.................... | 13411 |
| 18179-H7 | VK1\|O12/JK3 | EL..................... | 13412 |
| 18179-B12 | VK1\|O12/JK3 | ELV.................... | 13413 |
| 18179-D11 | VK1\|O12/JK3 | EL..................... | 13414 |
| 18179-D7 | VK1\|O12/JK3 | ELV.................... | 13415 |
| 18179-A7 | VK1\|O12/JK3 | ELV.................... | 13416 |
| 18181-F3 | VK1\|O12/JK3 | ELV.................... | 13417 |
| 18409-E2_final | VK1\|O12/JK3 | ....................... | 13418 |
| 18409-G10_final | VK1\|O12/JK3 | ....................... | 13419 |
| 18410-D3_final | VK1\|O12/JK3 | ....................... | 13420 |
| 18410-D6_final | VK1\|O12/JK3 | ....................... | 13421 |
| 18410-H1_final | VK1\|O12/JK3 | ....................... | 13422 |
| VK1\|L19/JK4 |  | DIQMTQSPSSVSASVGDRVTITC | 13423 |
| 18089-G11 | VK1\|L19/JK4 | EL..................... | 13424 |
| VK3\|A27/JK1 |  | EIVLTQSPGTLSLSPGERATLSC | 13425 |

TABLE 61-continued scFv Variable Region Consensus Protein Alignment
CDRs defined by Kabat
Alignment numbering defined by Amgen Reference (AHo)
KAPPA_VARIABLE

|  | Germline |  | SEQ ID NO: |
|---|---|---|---|
| 18179-A10 | VK3\|A27/JK1 | .L.................... | 13426 |
| VK1\|A20/JK2 |  | DIQMTQSPSSLSASVGDRVTITC | 13427 |
| 18179-G12 | VK1\|A20/JK2 | ELV................... | 13428 |
| VK4\|B3/JK5 |  | DIVMTQSPDSLAVSLGERATINC | 13429 |
| 18081-B9 | VK4\|B3/JK5 | EL..................... | 13430 |
| 18081-B9_final | VK4\|B3/JK5 | ....................... | 13431 |
| VK1\|O12/JK5 |  | DIQMTQSPSSLSASVGDRVTITC | 13432 |
| 18089-D8 | VK1\|O12/JK5 | ELV.....D...... | 13433 |

|  |  | K_CDR1 |  |
|---|---|---|---|
| VK4\|B3/JK2 |  | KSS--QSVLYSSNNKNYLA | 13734 |
| 17724-C9 | VK4\|B3/JK2 | .......L.....Q..... | 13735 |
| 18079-H4 | VK4\|B3/JK2 | ................... | 13736 |
| 18079-H11 | VK4\|B3/JK2 | ................... | 13737 |
| VK6\|A10/JK2 |  | RAS--QSIG------SSLH | 13738 |
| 17724-G6 | VK6\|A10/JK2 | S....SNVN.......-YI. | 13739 |
| VK1\|L11/JK2 |  | RAS--QGIR------NDLG | 13740 |
| 17731-H8 | VK1\|L11/JK2 | .....GN.H........Y.A | 13741 |
| VK2\|A19/JK5 |  | RSS--QSLLHSN-GYNYLD | 13742 |
| 17732-A8 | VK2\|A19/JK5 | .........Y.......V. | 13743 |
| 18081-B5 | VK2\|A19/JK5 |  | 13744 |
| VK2\|A19/JK2 |  | RSS--QSLLHSN-GYNYLD | 13745 |
| 17745-E5 | VK2\|A19/JK2 | .........Y.....H... | 13746 |
| 17778-F1 | VK2\|A19/JK2 | ......R..F.....H... | 13747 |
| 17778-H8 | VK2\|A19/JK2 | .........Y......... | 13748 |
| 18088-E4 | VK2\|A19/JK2 | .........Y......... | 13749 |
| 18179-C4 | VK2\|A19/JK2 | ..........T........ | 13750 |
| 18179-C7 | VK2\|A19/JK2 | ..........R....H... | 13751 |
| 18179-F3 | VK2\|A19/JK2 | ..........R........ | 13752 |
| 18181-C6 | VK2\|A19/JK2 | ..........T........ | 13753 |
| VK2\|O1/JK1 |  | RSS--QSLLDSDDGNTYLD | 13754 |
| 17745-E8 | VK2\|O1/JK1 | .........Y.N-.YN... | 13755 |
| 18179-C6 | VK2\|O1/JK1 | .........HRN-.YN... | 13756 |
| 18179-F10 | VK2\|O1/JK1 | .........H.N-.YN... | 13757 |
| 18179-G9 | VK2\|O1/JK1 | .........HRN-.YN... | 13758 |
| 18181-H7 | VK2\|O1/JK1 | .........HRN-.YN... | 13759 |
| 18181-B8 | VK2\|O1/JK1 | .........HRN-.YN... | 13760 |
| 81-H7-SG-F28_final | VK2\|O1/JK1 | .........HRS-.YN... | 13761 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| VK3\|A27/JK3 |  | RAS--QSVSS-----SYLA | 13762 |
| 17745-G8 | VK3\|A27/JK3 | ................... | 13763 |
| 18080-H9 | VK3\|A27/JK3 | ..............G... | 13764 |
| VK3\|A27/JK4 |  | RAS--QSVSS-----SYLA | 13765 |
| 17748-D12 | VK3\|A27/JK4 | ................... | 13766 |
| 17777-C4 | VK3\|A27/JK4 | ................... | 13767 |
| 18072-D6 | VK3\|A27/JK4 | ................... | 13768 |
| 18084-E4 | VK3\|A27/JK4 | ................... | 13769 |
| 18088-B10 | VK3\|A27/JK4 | ................... | 13770 |
| VK2\|A19/JK3 |  | RSS--QSLLHSN-GYNYLD | 13771 |
| 17753-F4 | VK2\|A19/JK3 | .........Y......... | 13772 |
| 17779-E1 | VK2\|A19/JK3 | .........Y.....H... | 13773 |
| 17780-E6 | VK2\|A19/JK3 | .........Y......... | 13774 |
| 17785-D12 | VK2\|A19/JK3 | .........Y......... | 13775 |
| 18179-A3 | VK2\|A19/JK3 | ..........R........ | 13776 |
| 18179-A5 | VK2\|A19/JK3 | ................... | 13777 |
| 18179-C10 | VK2\|A19/JK3 | ..........R........ | 13778 |
| 18179-F4 | VK2\|A19/JK3 | ..........R....H... | 13779 |
| 18179-H9 | VK2\|A19/JK3 | ..........R....H... | 13780 |
| 18181-A11 | VK2\|A19/JK3 | ..........R........ | 13781 |
| 18181-C9 | VK2\|A19/JK3 | ..........R........ | 13782 |
| VK1\|L19/JK1 |  | RAS--QGIS------SWLA | 13783 |
| 17771-D2 | VK1\|L19/JK1 | ................... | 13784 |
| 17784-B9 | VK1\|L19/JK1 | ......S.........Y.N | 13785 |
| VK2\|A19/JK4 |  | RSS--QSLLHSN-GYNYLD | 13786 |
| 17777-B4 | VK2\|A19/JK4 | .........Y......... | 13787 |
| 17777-C5 | VK2\|A19/JK4 | .........Y.......V. | 13788 |
| 17783-C11 | VK2\|A19/JK4 | .........Y......... | 13789 |
| 17813-F1 | VK2\|A19/JK4 | .....R............. | 13790 |
| 18179-A9 | VK2\|A19/JK4 | .................V. | 13791 |
| VK2\|O1/JK2 |  | RSS--QSLLDSDDGNTYLD | 13792 |
| 17778-C9 | VK2\|O1/JK2 | .........Y.N-.YN.V. | 13793 |
| 18179-H6 | VK2\|O1/JK2 | .........HRN-.YN... | 13794 |
| VK1\|O12/JK1 |  | RAS--QSIS------SYLN | 13795 |
| 17779-D11 | VK1\|O12/JK1 | ................... | 13796 |
| 18081-D12 | VK1\|O12/JK1 | ................... | 13797 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18093-E2 | VK1\|O12/JK1 | Q.....D........N... | 13798 |
| 18093-F5 | VK1\|O12/JK1 | ................... | 13799 |
| 18409-F12_final | VK1\|O12/JK1 | Q.....D........N... | 13800 |
| 18409-H7_final | VK1\|O12/JK1 | Q.....D........N... | 13801 |
| 18409-H10_final | VK1\|O12/JK1 | Q.....D........N... | 13802 |
| VK2\|O1/JK5 |  | RSS--QSLLDSDDGNTYLD | 13803 |
| 17780-D12 | VK2\|O1/JK5 | .........Y.N-.YN... | 13804 |
| 17784-G10 | VK2\|O1/JK5 | .........H.N-.YN... | 13805 |
| VK2\|A19/JK1 |  | RSS--QSLLHSN-GYNYLD | 13806 |
| 17781-B3 | VK2\|A19/JK1 | .........Y......... | 13807 |
| 17781-H12 | VK2\|A19/JK1 | .........Y.......V. | 13808 |
| 17784-H5 | VK2\|A19/JK1 | .........F.....Y... | 13809 |
| 18080-C5 | VK2\|A19/JK1 | ................... | 13810 |
| 18179-F6 | VK2\|A19/JK1 | ................... | 13811 |
| 18179-G8 | VK2\|A19/JK1 | ..........R........ | 13812 |
| 18181-H10 | VK2\|A19/JK1 | ................... | 13813 |
| 18181-G10 | VK2\|A19/JK1 | ...........T.....V. | 13814 |
| 18181-E2 | VK2\|A19/JK1 | ...........S....... | 13815 |
| VK2\|O1/JK4 |  | RSS--QSLLDSDDGNTYLD | 13816 |
| 17783-G10 | VK2\|O1/JK4 | .........F.N-.YN... | 13817 |
| 17813-E3 | VK2\|O1/JK4 | .........Y.N-.YN... | 13818 |
| 17813-E5 | VK2\|O1/JK4 | .........Y.N-.YN... | 13819 |
| VK1\|A20/JK3 |  | RAS--QGIS------NYLA | 13820 |
| 17784-C7 | VK1\|A20/JK3 | ................... | 13821 |
| 18089-H9 | VK1\|A20/JK3 | ................... | 13822 |
| 18089-D12 | VK1\|A20/JK3 | ................... | 13823 |
| 18179-C1 | VK1\|A20/JK3 | ................... | 13824 |
| 02-C1-86-A4-N-F5_final | VK1\|A20/JK3 | ................... | 13825 |
| 18486-A4_final | VK1\|A20/JK3 | ................... | 13826 |
| VK2\|O1/JK3 |  | RSS--QSLLDSDDGNTYLD | 13827 |
| 17784-C11 | VK2\|O1/JK3 | .........Y.N-.YN... | 13828 |
| VK1\|A20/JK1 |  | RAS--QGIS------NYLA | 13829 |
| 17813-D8 | VK1\|A20/JK1 | ................... | 13830 |
| VK2\|A18/JK5 |  | KSS--QSLLHSD-GKTYLY | 13831 |
| 17814-D9 | VK2\|A18/JK5 | .........Y.N..YN..D | 13832 |
| VK4\|B3/JK1 |  | KSS--QSVLYSSNNKNYLA | 13833 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18071-C4 | VK4\|B3/JK1 | .................... | 13834 |
| 18071-D4 | VK4\|B3/JK1 | .................... | 13835 |
| 18086-H4 | VK4\|B3/JK1 | .................... | 13836 |
| VK1\|O18/JK1 |  | QAS--QDIS------NYLN | 13837 |
| 18074-G12 | VK1\|O18/JK1 |  | 13838 |
| VK4\|B3/JK4 |  | KSS--QSVLYSSNNKNYLA | 13839 |
| 18081-A6 | VK4\|B3/JK4 | .................... | 13840 |
| 18081-C10 | VK4\|B3/JK4 | .................... | 13841 |
| 18089-B8 | VK4\|B3/JK4 | .................... | 13842 |
| 18081-E7 | VK4\|B3/JK4 | .................... | 13843 |
| VK1\|O12/JK2 |  | RAS--QSIS------SYLN | 13844 |
| 18081-D6 | VK1\|O12/JK2 | .................... | 13845 |
| 18089-H12 | VK1\|O12/JK2 | .................... | 13846 |
| 18179-E6 | VK1\|O12/JK2 | .T.................. | 13847 |
| 18089-D11 | VK1\|O12/JK2 | ..............N.F.. | 13848 |
| 18081-B6 | VK1\|O12/JK2 | .................... | 13849 |
| 18181-F1 | VK1\|O12/JK2 | .T.................. | 13850 |
| 18181-A6 | VK1\|O12/JK2 | .................... | 13851 |
| 18410-B6_final | VK1\|O12/JK2 | .T.................. | 13852 |
| 18410-H3_final | VK1\|O12/JK2 | .T.................. | 13853 |
| VK1\|O12/JK4 |  | RAS--QSIS------SYLN | 13854 |
| 18089-C8 | VK1\|O12/JK4 | .................... | 13855 |
| 18089-B2 | VK1\|O12/JK4 | Q.....D........N... | 13856 |
| 18181-G8 | VK1\|O12/JK4 | .T.................. | 13857 |
| 18410-B5_final | VK1\|O12/JK4 | .T.................. | 13858 |
| VK1\|O12/JK3 |  | RAS--QSIS------SYLN | 13859 |
| 18089-G7 | VK1\|O12/JK3 | .................... | 13860 |
| 18179-B7 | VK1\|O12/JK3 | Q.R...D........D... | 13861 |
| 18179-B8 | VK1\|O12/JK3 | .T......N.......... | 13862 |
| 18179-D8 | VK1\|O12/JK3 | .T.................. | 13863 |
| 18179-D9 | VK1\|O12/JK3 | .T......N.......... | 13864 |
| 18181-G7 | VK1\|O12/JK3 | .T.................. | 13865 |
| 18089-C9 | VK1\|O12/JK3 | ......F............ | 13866 |
| 18081-F9 | VK1\|O12/JK3 | .................... | 13867 |
| 18081-H11 | VK1\|O12/JK3 | Q.....D........N... | 13868 |
| 18179-E1 | VK1\|O12/JK3 | .T.................. | 13869 |
| 18179-H7 | VK1\|O12/JK3 | .T.................. | 13870 |

TABLE 61-continued scFv Variable Region Consensus Protein Alignment
CDRs defined by Kabat
Alignment numbering defined by Amgen Reference (AHo)
KAPPA VARIABLE

| | Germline | | SEQ ID NO: |
|---|---|---|---|
| 18179-B12 | VK1\|O12/JK3 | .T................ | 13871 |
| 18179-D11 | VK1\|O12/JK3 | .T................ | 13872 |
| 18179-D7 | VK1\|O12/JK3 | .T................ | 13873 |
| 18179-A7 | VK1\|O12/JK3 | .T................ | 13874 |
| 18181-F3 | VK1\|O12/JK3 | .T................ | 13875 |
| 18409-E2_final | VK1\|O12/JK3 | .T................ | 13876 |
| 18409-G10_final | VK1\|O12/JK3 | Q.....D........N.F. | 13877 |
| 18410-D3_final | VK1\|O12/JK3 | .T................ | 13878 |
| 18410-D6_final | VK1\|O12/JK3 | .T................ | 13879 |
| 18410-H1_final | VK1\|O12/JK3 | .T................ | 13880 |
| VK1\|L19/JK4 | | RAS--QGIS------SWLA | 13881 |
| 18089-G11 | VK1\|L19/JK4 | Q.....D........NY.N | 13882 |
| VK3\|A27/JK1 | | RAS--QSVSS-----SYLA | 13883 |
| 18179-A10 | VK3\|A27/JK1 | .S.....LLHRN.GYN..D | 13884 |
| VK1\|A20/JK2 | | RAS--QGIS------NYLA | 13885 |
| 18179-G12 | VK1\|A20/JK2 | .T................ | 13886 |
| VK4\|B3/JK5 | | KSS--QSVLYSSNNKNYLA | 13887 |
| 18081-B9 | VK4\|B3/JK5 | .T................ | 13888 |
| 18081-B9_final | VK4\|B3/JK5 | .T................ | 13889 |
| VK1\|O12/JK5 | | RAS--QSIS------SYLN | 13890 |
| 18089-D8 | VK1\|O12/JK5 | .T................ | 13891 |
| | K_FR2 | | |
| VK4\|B3/JK2 | | WYQQKPGQPPKLLIY | 14192 |
| 17724-C9 | VK4\|B3/JK2 | ........S...... | 14193 |
| 18079-H4 | VK4\|B3/JK2 | ............... | 14194 |
| 18079-H11 | VK4\|B3/JK2 | ............... | 14195 |
| VK6\|A10/JK2 | | WYQQKPDQSPKLLIK | 14196 |
| 17724-G6 | VK6\|A10/JK2 | .....LGS....W.Y | 14197 |
| VK1\|L11/JK2 | | WYQQKPGKAPKLLIY | 14198 |
| 17731-H8 | VK1\|L11/JK2 | .....Q..S.Q..V. | 14199 |
| VK2\|A19/JK5 | | WYLQKPGQSPQLLIY | 14200 |
| 17732-A8 | VK2\|A19/JK5 | ............... | 14201 |
| 18081-B5 | VK2\|A19/JK5 | ............... | 14202 |
| VK2\|A19/JK2 | | WYLQKPGQSPQLLIY | 14203 |
| 17745-E5 | VK2\|A19/JK2 | ............... | 14204 |
| 17778-F1 | VK2\|A19/JK2 | ............... | 14205 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 17778-H8 | VK2\|A19/JK2 | ............... | 14206 |
| 18088-E4 | VK2\|A19/JK2 | ............... | 14207 |
| 18179-C4 | VK2\|A19/JK2 | ............... | 14208 |
| 18179-C7 | VK2\|A19/JK2 | ............... | 14209 |
| 18179-F3 | VK2\|A19/JK2 | ............... | 14210 |
| 18181-C6 | VK2\|A19/JK2 | ............... | 14211 |
| VK2\|O1/JK1 |  | WYLQKPGQSPQLLIY | 14212 |
| 17745-E8 | VK2\|O1/JK1 | ............... | 14213 |
| 18179-C6 | VK2\|O1/JK1 | ...H........... | 14214 |
| 18179-F10 | VK2\|O1/JK1 | ............... | 14215 |
| 18179-G9 | VK2\|O1/JK1 | ............... | 14216 |
| 18181-H7 | VK2\|O1/JK1 | ............... | 14217 |
| 18181-B8 | VK2\|O1/JK1 | ............... | 14218 |
| 81-H7-SG-F28_final | VK2\|O1/JK1 | ............... | 14219 |
| VK3\|A27/JK3 |  | WYQQKPGQAPRLLIY | 14220 |
| 17745-G8 | VK3\|A27/JK3 | ............... | 14221 |
| 18080-H9 | VK3\|A27/JK3 | ............... | 14222 |
| VK3\|A27/JK4 |  | WYQQKPGQAPRLLIY | 14223 |
| 17748-D12 | VK3\|A27/JK4 | ............... | 14224 |
| 17777-C4 | VK3\|A27/JK4 | ............... | 14225 |
| 18072-D6 | VK3\|A27/JK4 | ............... | 14226 |
| 18084-E4 | VK3\|A27/JK4 | ............... | 14227 |
| 18088-B10 | VK3\|A27/JK4 | ............... | 14228 |
| VK2\|A19/JK3 |  | WYLQKPGQSPQLLIY | 14229 |
| 17753-F4 | VK2\|A19/JK3 | ............... | 14230 |
| 17779-E1 | VK2\|A19/JK3 | ............F.. | 14231 |
| 17780-E6 | VK2\|A19/JK3 | ............... | 14232 |
| 17785-D12 | VK2\|A19/JK3 | ............... | 14233 |
| 18179-A3 | VK2\|A19/JK3 | ............... | 14234 |
| 18179-A5 | VK2\|A19/JK3 | ............... | 14235 |
| 18179-C10 | VK2\|A19/JK3 | ............... | 14236 |
| 18179-F4 | VK2\|A19/JK3 | ............... | 14237 |
| 18179-H9 | VK2\|A19/JK3 | ............... | 14238 |
| 18181-A11 | VK2\|A19/JK3 | ............... | 14239 |
| 18181-C9 | VK2\|A19/JK3 | ............... | 14240 |
| VK1\|L19/JK1 |  | WYQQKPGKAPKLLIY | 14241 |
| 17771-D2 | VK1\|L19/JK1 | ............... | 14242 |

TABLE 61-continued scFv Variable Region Consensus Protein Alignment
CDRs defined by Kabat
Alignment numbering defined by Amgen Reference (AHo)
KAPPA_VARIABLE

|  | Germline |  | SEQ ID NO: |
|---|---|---|---|
| 17784-B9 | VK1\|L19/JK1 | ............... | 14243 |
| VK2\|A19/JK4 |  | WYLQKPGQSPQLLIY | 14244 |
| 17777-B4 | VK2\|A19/JK4 | ............... | 14245 |
| 17777-C5 | VK2\|A19/JK4 | ............... | 14246 |
| 17783-C11 | VK2\|A19/JK4 | .........H.... | 14247 |
| 17813-F1 | VK2\|A19/JK4 | ............... | 14248 |
| 18179-A9 | VK2\|A19/JK4 | ............... | 14249 |
| VK2\|O1/JK2 |  | WYLQKPGQSPQLLIY | 14250 |
| 17778-C9 | VK2\|O1/JK2 | ............... | 14251 |
| 18179-H6 | VK2\|O1/JK2 | ............... | 14252 |
| VK1\|O12/JK1 |  | WYQQKPGKAPKLLIY | 14253 |
| 17779-D11 | VK1\|O12/JK1 | ............... | 14254 |
| 18081-D12 | VK1\|O12/JK1 | ............... | 14255 |
| 18093-E2 | VK1\|O12/JK1 | ............... | 14256 |
| 18093-F5 | VK1\|O12/JK1 | ............... | 14257 |
| 18409-F12_final | VK1\|O12/JK1 | ............... | 14258 |
| 18409-H7_final | VK1\|O12/JK1 | ............... | 14259 |
| 18409-H10_final | VK1\|O12/JK1 | ............... | 14260 |
| VK2\|O1/JK5 |  | WYLQKPGQSPQLLIY | 14261 |
| 17780-D12 | VK2\|O1/JK5 | ............... | 14262 |
| 17784-G10 | VK2\|O1/JK5 | ............... | 14263 |
| VK2\|A19/JK1 |  | WYLQKPGQSPQLLIY | 14264 |
| 17781-B3 | VK2\|A19/JK1 | ............... | 14265 |
| 17781-H12 | VK2\|A19/JK1 | ............... | 14266 |
| 17784-H5 | VK2\|A19/JK1 | ............... | 14267 |
| 18080-C5 | VK2\|A19/JK1 | ............... | 14268 |
| 18179-F6 | VK2\|A19/JK1 | ............... | 14269 |
| 18179-G8 | VK2\|A19/JK1 | ...H.......... | 14270 |
| 18181-H10 | VK2\|A19/JK1 | ............... | 14271 |
| 18181-G10 | VK2\|A19/JK1 | ............... | 14272 |
| 18181-E2 | VK2\|A19/JK1 | ............... | 14273 |
| VK2\|O1/JK4 |  | WYLQKPGQSPQLLIY | 14274 |
| 17783-G10 | VK2\|O1/JK4 | ............... | 14275 |
| 17813-E3 | VK2\|O1/JK4 | ............... | 14276 |
| 17813-E5 | VK2\|O1/JK4 | ............... | 14277 |
| VK1\|A20/JK3 |  | WYQQKPGKVPKLLIY | 14278 |

TABLE 61-continued scFv Variable Region Consensus Protein Alignment
CDRs defined by Kabat
Alignment numbering defined by Amgen Reference (AHo)
KAPPA VARIABLE

| | Germline | | SEQ ID NO: |
|---|---|---|---|
| 17784-C7 | VK1\|A20/JK3 | ............... | 14279 |
| 18089-H9 | VK1\|A20/JK3 | ..........N.... | 14280 |
| 18089-D12 | VK1\|A20/JK3 | ............... | 14281 |
| 18179-C1 | VK1\|A20/JK3 | .............S. | 14282 |
| 02-C1-86-A4-N-F5_final | VK1\|A20/JK3 | ............... | 14283 |
| 18486-A4_final | VK1\|A20/JK3 | ............... | 14284 |
| VK2\|O1/JK3 | | WYLQKPGQSPQLLIY | 14285 |
| 17784-C11 | VK2\|O1/JK3 | ............... | 14286 |
| VK1\|A20/JK1 | | WYQQKPGKVPKLLIY | 14287 |
| 17813-D8 | VK1\|A20/JK1 | ............... | 14288 |
| VK2\|A18/JK5 | | WYLQKPGQSPQLLIY | 14289 |
| 17814-D9 | VK2\|A18/JK5 | ............... | 14290 |
| VK4\|B3/JK1 | | WYQQKPGQPPKLLIY | 14291 |
| 18071-C4 | VK4\|B3/JK1 | ............... | 14292 |
| 18071-D4 | VK4\|B3/JK1 | ............... | 14293 |
| 18086-H4 | VK4\|B3/JK1 | ............... | 14294 |
| VK1\|O18/JK1 | | WYQQKPGKAPKLLIY | 14295 |
| 18074-G12 | VK1\|O18/JK1 | ............... | 14296 |
| VK4\|B3/JK4 | | WYQQKPGQPPKLLIY | 14297 |
| 18081-A6 | VK4\|B3/JK4 | ............... | 14298 |
| 18081-C10 | VK4\|B3/JK4 | ............... | 14299 |
| 18089-B8 | VK4\|B3/JK4 | ............... | 14300 |
| 18081-E7 | VK4\|B3/JK4 | ............... | 14301 |
| VK1\|O12/JK2 | | WYQQKPGKAPKLLIY | 14302 |
| 18081-D6 | VK1\|O12/JK2 | ............... | 14303 |
| 18089-H12 | VK1\|O12/JK2 | ............... | 14304 |
| 18179-E6 | VK1\|O12/JK2 | .......R......F | 14305 |
| 18089-D11 | VK1\|O12/JK2 | ............... | 14306 |
| 18081-B6 | VK1\|O12/JK2 | ............... | 14307 |
| 18181-F1 | VK1\|O12/JK2 | .......R......F | 14308 |
| 18181-A6 | VK1\|O12/JK2 | .......R......F | 14309 |
| 18410-B6_final | VK1\|O12/JK2 | .......R......F | 14310 |
| 18410-H3_final | VK1\|O12/JK2 | .......R......F | 14311 |
| VK1\|O12/JK4 | | WYQQKPGKAPKLLIY | 14312 |
| 18089-C8 | VK1\|O12/JK4 | ............... | 14313 |
| 18089-B2 | VK1\|O12/JK4 | ............... | 14314 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18181-G8 | VK1\|O12/JK4 | ............... | 14315 |
| 18410-B5_final | VK1\|O12/JK4 | .......R......F | 14316 |
| VK1\|O12/JK3 |  | WYQQKPGKAPKLLIY | 14317 |
| 18089-G7 | VK1\|O12/JK3 | ............... | 14318 |
| 18179-B7 | VK1\|O12/JK3 | .F.....R......F | 14319 |
| 18179-B8 | VK1\|O12/JK3 | .F............. | 14320 |
| 18179-D8 | VK1\|O12/JK3 | .......R......F | 14321 |
| 18179-D9 | VK1\|O12/JK3 | ..............F | 14322 |
| 18181-G7 | VK1\|O12/JK3 | .......R......F | 14323 |
| 18089-C9 | VK1\|O12/JK3 | ............... | 14324 |
| 18081-F9 | VK1\|O12/JK3 | ............... | 14325 |
| 18081-H11 | VK1\|O12/JK3 | ............... | 14326 |
| 18179-E1 | VK1\|O12/JK3 | .......R......F | 14327 |
| 18179-H7 | VK1\|O12/JK3 | .F............F | 14328 |
| 18179-B12 | VK1\|O12/JK3 | .F............F | 14329 |
| 18179-D11 | VK1\|O12/JK3 | .......R......F | 14330 |
| 18179-D7 | VK1\|O12/JK3 | .......R......F | 14331 |
| 18179-A7 | VK1\|O12/JK3 | .......R......F | 14332 |
| 18181-F3 | VK1\|O12/JK3 | .......R......F | 14333 |
| 18409-E2_final | VK1\|O12/JK3 | .......R......F | 14334 |
| 18409-G10_final | VK1\|O12/JK3 |  | 14335 |
| 18410-D3_final | VK1\|O12/JK3 | .......R......F | 14336 |
| 18410-D6_final | VK1\|O12/JK3 | .......R......F | 14337 |
| 18410-H1_final | VK1\|O12/JK3 | .......R......F | 14338 |
| VK1\|L19/JK4 |  | WYQQKPGKAPKLLIY | 14339 |
| 18089-G11 | VK1\|L19/JK4 | ............... | 14340 |
| VK3\|A27/JK1 |  | WYQQKPGQAPRLLIY | 14341 |
| 18179-A10 | VK3\|A27/JK1 | ..L.....S.Q.... | 14342 |
| VK1\|A20/JK2 |  | WYQQKPGKVPKLLIY | 14343 |
| 18179-G12 | VK1\|A20/JK2 | ..............S | 14344 |
| VK4\|B3/JK5 |  | WYQQKPGQPPKLLIY | 14345 |
| 18081-B9 | VK4\|B3/JK5 | ............... | 14346 |
| 18081-B9_final | VK4\|B3/JK5 | ............... | 14347 |
| VK1\|O12/JK5 |  | WYQQKPGKAPKLLIY | 14348 |
| 18089-D8 | VK1\|O12/JK5 | ............... | 14349 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
|  |  | K_CDR2 |  |
| VK4\|B3/JK2 |  | W--------ASTRES | 14650 |
| 17724-C9 | VK4\|B3/JK2 | ............... | 14651 |
| 18079-H4 | VK4\|B3/JK2 | ............... | 14652 |
| 18079-H11 | VK4\|B3/JK2 | ............... | 14653 |
| VK6\|A10/JK2 |  | Y--------ASQSFS | 14654 |
| 17724-G6 | VK6\|A10/JK2 | D........T.KLAP | 14655 |
| VK1\|L11/JK2 |  | A--------ASSLQS | 14656 |
| 17731-H8 | VK1\|L11/JK2 | N.........KT.AG | 14657 |
| VK2\|A19/JK5 |  | L--------GSNRAS | 14658 |
| 17732-A8 | VK2\|A19/JK5 | ............... | 14659 |
| 18081-B5 | VK2\|A19/JK5 | ............... | 14660 |
| VK2\|A19/JK2 |  | L--------GSNRAS | 14661 |
| 17745-E5 | VK2\|A19/JK2 | ...........I... | 14662 |
| 17778-F1 | VK2\|A19/JK2 | ............... | 14663 |
| 17778-H8 | VK2\|A19/JK2 | ............... | 14664 |
| 18088-E4 | VK2\|A19/JK2 | ...........K... | 14665 |
| 18179-C4 | VK2\|A19/JK2 | ............... | 14666 |
| 18179-C7 | VK2\|A19/JK2 | ............... | 14667 |
| 18179-F3 | VK2\|A19/JK2 | ............... | 14668 |
| 18181-C6 | VK2\|A19/JK2 | ............... | 14669 |
| VK2\|O1/JK1 |  | T--------LSYRAS | 14670 |
| 17745-E8 | VK2\|O1/JK1 | L........G.K... | 14671 |
| 18179-C6 | VK2\|O1/JK1 | L........G.N... | 14672 |
| 18179-F10 |  | L........G.N... | 14673 |
| 18179-G9 | VK2\|O1/JK1 | L........G.N... | 14674 |
| 18181-H7 | VK2\|O1/JK1 | L........G.N... | 14675 |
| 18181-B8 | VK2\|O1/JK1 | L........G.N... | 14676 |
| 81-H7-SG-F28_final | VK2\|O1/JK1 | L........G.N... | 14677 |
| VK3\|A27/JK3 |  | G--------ASSRAT | 14678 |
| 17745-G8 | VK3\|A27/JK3 | L........G.N... | 14679 |
| 18080-H9 | VK3\|A27/JK3 | L........G.N... | 14680 |
| VK3\|A27/JK4 |  | G--------ASSRAT | 14681 |
| 17748-D12 | VK3\|A27/JK4 | ............... | 14682 |
| 17777-C4 | VK3\|A27/JK4 | ............... | 14683 |
| 18072-D6 | VK3\|A27/JK4 | ...........A... | 14684 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18084-E4 | VK3\|A27/JK4 | ............... | 14685 |
| 18088-B10 | VK3\|A27/JK4 | ..........T... | 14686 |
| VK2\|A19/JK3 |  | L--------GSNRAS | 14687 |
| 17753-F4 | VK2\|A19/JK3 | ............... | 14688 |
| 17779-E1 | VK2\|A19/JK3 | ............... | 14689 |
| 17780-E6 | VK2\|A19/JK3 | ............... | 14690 |
| 17785-D12 | VK2\|A19/JK3 | ............... | 14691 |
| 18179-A3 | VK2\|A19/JK3 | ............... | 14692 |
| 18179-A5 | VK2\|A19/JK3 | ............... | 14693 |
| 18179-C10 | VK2\|A19/JK3 | ............... | 14694 |
| 18179-F4 | VK2\|A19/JK3 | ............... | 14695 |
| 18179-H9 | VK2\|A19/JK3 | ............... | 14696 |
| 18181-A11 | VK2\|A19/JK3 | ............... | 14697 |
| 18181-C9 | VK2\|A19/JK3 | ............... | 14698 |
| VK1\|L19/JK1 |  | A--------ASSLQS | 14699 |
| 17771-D2 | VK1\|L19/JK1 | ............... | 14700 |
| 17784-B9 | VK1\|L19/JK1 | ............... | 14701 |
| VK2\|A19/JK4 |  | L--------GSNRAS | 14702 |
| 17777-B4 | VK2\|A19/JK4 | ............... | 14703 |
| 17777-C5 | VK2\|A19/JK4 | ............... | 14704 |
| 17783-C11 | VK2\|A19/JK4 | ..........Y... | 14705 |
| 17813-F1 | VK2\|A19/JK4 | ............... | 14706 |
| 18179-A9 | VK2\|A19/JK4 | ............... | 14707 |
| VK2\|O1/JK2 |  | T--------LSYRAS | 14708 |
| 17778-C9 | VK2\|O1/JK2 | L........G.N... | 14709 |
| 18179-H6 | VK2\|O1/JK2 | L........G.N... | 14710 |
| VK1\|O12/JK1 |  | A--------ASSLQS | 14711 |
| 17779-D11 | VK1\|O12/JK1 | D.............. | 14712 |
| 18081-D12 | VK1\|O12/JK1 | .........T..... | 14713 |
| 18093-E2 | VK1\|O12/JK1 | ............... | 14714 |
| 18093-F5 | VK1\|O12/JK1 | ............... | 14715 |
| 18409-F12_final | VK1\|O12/JK1 | ............... | 14716 |
| 18409-H7_final | VK1\|O12/JK1 | ............... | 14717 |
| 18409-H10_final | VK1\|O12/JK1 | ............... | 14718 |
| VK2\|O1/JK5 |  | T--------LSYRAS | 14719 |
| 17780-D12 | VK2\|O1/JK5 | L........G.N... | 14720 |
| 17784-G10 | VK2\|O1/JK5 | L........G.N... | 14721 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| VK2\|A19/JK1 |  | L--------GSNRAS | 14722 |
| 17781-B3 | VK2\|A19/JK1 | .............. | 14723 |
| 17781-H12 | VK2\|A19/JK1 | .............. | 14724 |
| 17784-H5 | VK2\|A19/JK1 | .............. | 14725 |
| 18080-C5 | VK2\|A19/JK1 | .............. | 14726 |
| 18179-F6 | VK2\|A19/JK1 | .............. | 14727 |
| 18179-G8 | VK2\|A19/JK1 | .............. | 14728 |
| 18181-H10 | VK2\|A19/JK1 | .............. | 14729 |
| 18181-G10 | VK2\|A19/JK1 | .............. | 14730 |
| 18181-E2 | VK2\|A19/JK1 | .............. | 14731 |
| VK2\|O1/JK4 |  | T--------LSYRAS | 14732 |
| 17783-G10 | VK2\|O1/JK4 | L........V.K... | 14733 |
| 17813-E3 | VK2\|O1/JK4 | L........G.N... | 14734 |
| 17813-E5 | VK2\|O1/JK4 | L........G.K... | 14735 |
| VK1\|A20/JK3 |  | A--------ASTLQS | 14736 |
| 17784-C7 | VK1\|A20/JK3 | -----------.S... | 14737 |
| 18089-H9 | VK1\|A20/JK3 | G.............L | 14738 |
| 18089-D12 | VK1\|A20/JK3 | .............. | 14739 |
| 18179-C1 | VK1\|A20/JK3 | .............. | 14740 |
| 02-C1-86-A4-N-F5_final | VK1\|A20/JK3 | .............. | 14741 |
| 18486-A4_final | VK1\|A20/JK3 | .............. | 14742 |
| VK2\|O1/JK3 |  | T--------LSYRAS | 14743 |
| 17784-C11 | VK2\|O1/JK3 | L........G.N... | 14744 |
| VK1\|A20/JK1 |  | A--------ASTLQS | 14745 |
| 17813-D8 | VK1\|A20/JK1 | .............. | 14746 |
| VK2\|A18/JK5 |  | E--------VSSRFS | 14747 |
| 17814-D9 | VK2\|A18/JK5 | L........G.N.A. | 14748 |
| VK4\|B3/JK1 |  | W--------ASTRES | 14749 |
| 18071-C4 | VK4\|B3/JK1 | .............. | 14750 |
| 18071-D4 | VK4\|B3/JK1 | .............. | 14751 |
| 18086-H4 | VK4\|B3/JK1 | .............. | 14752 |
| VK1\|O18/JK1 |  | D--------ASNLET | 14753 |
| 18074-G12 | VK1\|O18/JK1 | .............. | 14754 |
| VK4\|B3/JK4 |  | W--------ASTRES | 14755 |
| 18081-A6 | VK4\|B3/JK4 | .............. | 14756 |
| 18081-C10 | VK4\|B3/JK4 | .............. | 14757 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18089-B8 | VK4\|B3/JK4 | ............... | 14758 |
| 18081-E7 | VK4\|B3/JK4 | ............... | 14759 |
| VK1\|O12/JK2 |  | A--------ASSLWS | 14760 |
| 18081-D6 | VK1\|O12/JK2 | ............... | 14761 |
| 18089-H12 | VK1\|O12/JK2 | ............... | 14762 |
| 18179-E6 | VK1\|O12/JK2 | ..............G | 14763 |
| 18089-D11 | VK1\|O12/JK2 | ............... | 14764 |
| 18081-B6 | VK1\|O12/JK2 | ............... | 14765 |
| 18181-F1 | VK1\|O12/JK2 | ..............G | 14766 |
| 18181-A6 | VK1\|O12/JK2 | ..............G | 14767 |
| 18410-B6_final | VK1\|O12/JK2 | ..............G | 14768 |
| 18410-H3_final | VK1\|O12/JK2 | ..............G | 14769 |
| VK1\|O12/JK4 |  | A--------ASSLQS | 14770 |
| 18089-C8 | VK1\|O12/JK4 | ............... | 14771 |
| 18089-B2 | VK1\|O12/JK4 | ............... | 14772 |
| 18181-G8 | VK1\|O12/JK4 | ............... | 14773 |
| 18410-B5_final | VK1\|O12/JK4 | ..............G | 14774 |
| VK1\|O12/JK3 |  | A--------ASSLQS | 14775 |
| 18089-G7 | VK1\|O12/JK3 | .........T..... | 14776 |
| 18179-B7 | VK1\|O12/JK3 | ..............G | 14777 |
| 18179-B8 | VK1\|O12/JK3 | ............... | 14778 |
| 18179-D8 | VK1\|O12/JK3 | ..............G | 14779 |
| 18179-D9 | VK1\|O12/JK3 | ............... | 14780 |
| 18181-G7 | VK1\|O12/JK3 | ..............G | 14781 |
| 18089-C9 | VK1\|O12/JK3 | ............... | 14782 |
| 18081-F9 | VK1\|O12/JK3 | ............... | 14783 |
| 18081-H11 | VK1\|O12/JK3 | ............... | 14784 |
| 18179-E1 | VK1\|O12/JK3 | ..............G | 14785 |
| 18179-H7 | VK1\|O12/JK3 | ............... | 14786 |
| 18179-B12 | VK1\|O12/JK3 | ............... | 14787 |
| 18179-D11 | VK1\|O12/JK3 | ..............G | 14788 |
| 18179-D7 | VK1\|O12/JK3 | ..............G | 14789 |
| 18179-A7 | VK1\|O12/JK3 | ..............G | 14790 |
| 18181-F3 | VK1\|O12/JK3 | ..............G | 14791 |
| 18409-E2_final | VK1\|O12/JK3 | ..............G | 14792 |
| 18409-G10_final | VK1\|O12/JK3 | ............... | 14793 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18410-D3_final | VK1\|O12/JK3 | ..............G | 14794 |
| 18410-D6_final | VK1\|O12/JK3 | ..............G | 14795 |
| 18410-H1_final | VK1\|O12/JK3 | ............... | 14796 |
| VK1\|L19/JK4 |  | A--------ASSLQS | 14797 |
| 18089-G11 | VK1\|L19/JK4 | ............... | 14798 |
| VK3\|A27/JK1 |  | G--------ASSRAT | 14799 |
| 18179-A10 | VK3\|A27/JK1 | L........G.N..S | 14800 |
| VK1\|A20/JK2 |  | A--------ASTLQS | 14801 |
| 18179-G12 | VK1\|A20/JK2 | ............... | 14802 |
| VK4\|B3/JK5 |  | W--------ASTRES | 14803 |
| 18081-B9 | VK4\|B3/JK5 | ............... | 14804 |
| 18081-B9_final | VK4\|B3/JK5 | ............... | 14805 |
| VK1\|O12/JK5 |  | A--------ASSLQS | 14806 |
| 18089-D8 | VK1\|O12/JK5 | ............... | 14807 |
|  | K_FR3 |  |  |
| VK4\|B3/JK2 |  | GVPDRESGSGSG--<br>TDFTLTISSLQAEDVAVYYC | 15108 |
| 17724-C9 | VK4\|B3/JK2 | ......T..........<br>.VK...L..... | 15109 |
| 18079-H4 | VK4\|B3/JK2 | ................<br>............ | 15110 |
| 18079-H11 | VK4\|B3/JK2 | ................<br>............ | 15111 |
| VK6\|A10/JK2 |  | GVPSRFSGSGSG--<br>TDFTLTINSLEAEDAATYYC | 15112 |
| 17724-G6 | VK6\|A10/JK2 | ...A............SYS...S<br>.M......S.F. | 15113 |
| VK1\|L11/JK2 |  | GVPSRFSGSGSG--<br>TDFTLTISSLQPEDFATYYC | 15114 |
| 17731-H8 | VK1\|L11/JK2 | ...............Q.S.K.N<br>.......GS... | 15115 |
| VK2\|A19/JK5 |  | GVPDRESGSGSG--<br>TDFTLKISRVEAEDVGVYYC | 15116 |
| 17732-A8 | VK2\|A19/JK5 | ................<br>K........... | 15117 |
| 18081-B5 | VK2\|A19/JK5 | ................<br>............ | 15118 |
| VK2\|A19/JK2 |  | GVPDRESGSGSG--<br>TDFTLKISRVEAEDVGVYYC | 15119 |
| 17745-E5 | VK2\|A19/JK2 | ................<br>............ | 15120 |
| 17778-F1 | VK2\|A19/JK2 | ................<br>............ | 15121 |

TABLE 61-continued scFv Variable Region Consensus Protein Alignment
CDRs defined by Kabat
Alignment numbering defined by Amgen Reference (AHo)
KAPPA VARIABLE

| | Germline | | SEQ ID NO: |
|---|---|---|---|
| 17778-H8 | VK2\|A19/JK2 | ..................... ............ | 15122 |
| 18088-E4 | VK2\|A19/JK2 | ..................... ............ | 15123 |
| 18179-C4 | VK2\|A19/JK2 | ..................... ....G...F... | 15124 |
| 18179-C7 | VK2\|A19/JK2 | ......I...........E.. ............ | 15125 |
| 18179-F3 | VK2\|A19/JK2 | ......I...........E.. ............ | 15126 |
| 18181-C6 | VK2\|A19/JK2 | ......I...........E.. ........F... | 15127 |
| VK2\|O1/JK1 | | GVPDRESGSGSG--TDFTLKISRVEAEDVGVYYC | 15128 |
| 17745-E8 | VK2\|O1/JK1 | ..................... ............ | 15129 |
| 18179-C6 | VK2\|O1/JK1 | ......I.............. K.......I... | 15130 |
| 18179-F10 | VK2\|O1/JK1 | ..................... ........F... | 15131 |
| 18179-G9 | VK2\|O1/JK1 | ......I.............. ............ | 15132 |
| 18181-H7 | VK2\|O1/JK1 | ..................... ....G....... | 15133 |
| 18181-B8 | VK2\|O1/JK1 | ......I...........E.. ............ | 15134 |
| 81-H7-SG-F28_final | VK2\|O1/JK1 | ..................... ....F....... | 15135 |
| VK3\|A27/JK3 | | GIPDRESGSGSG--TDFTLTISRLEPEDFAVYYC | 15136 |
| 17745-G8 | VK3\|A27/JK3 | ..................... ............ | 15137 |
| 18080-H9 | VK3\|A27/JK3 | ..................... ............ | 15138 |
| VK3\|A27/JK4 | | GIPDRESGSGSG--TDFTLTISRLEPEDFAVYYC | 15139 |
| 17748-D12 | VK3\|A27/JK4 | ..................... ............ | 15140 |
| 17777-C4 | VK3\|A27/JK4 | ..................... ............ | 15141 |
| 18072-D6 | VK3\|A27/JK4 | ..................... ............ | 15142 |
| 18084-E4 | VK3\|A27/JK4 | ...A................. ............ | 15143 |
| 18088-B10 | VK3\|A27/JK4 | ..................... ............ | 15144 |
| VK2\|A19/JK3 | | GVPDRESGSGSG--TDFTLKISRVEAEDVGVYYC | 15145 |

TABLE 61-continued scFv Variable Region Consensus Protein Alignment
CDRs defined by Kabat
Alignment numbering defined by Amgen Reference (AHo)
KAPPA VARIABLE

|            | Germline                                      | SEQ ID NO: |
|------------|-----------------------------------------------|------------|
| 17753-F4   | VK2\|A19/JK3 ....................... ........... | 15146      |
| 17779-E1   | VK2\|A19/JK3 .......A.R............ ........... | 15147      |
| 17780-E6   | VK2\|A19/JK3 ..................Q.. ........... | 15148      |
| 17785-D12  | VK2\|A19/JK3 ........R............. ........... | 15149      |
| 18179-A3   | VK2\|A19/JK3 ....................... ........... | 15150      |
| 18179-A5   | VK2\|A19/JK3 ....................... ........... | 15151      |
| 18179-C10  | VK2\|A19/JK3 ....................... ........... | 15152      |
| 18179-F4   | VK2\|A19/JK3 ....................... ........... | 15153      |
| 18179-H9   | VK2\|A19/JK3 ....S.................. ........I... | 15154      |
| 18181-A11  | VK2\|A19/JK3 ....................... ........I... | 15155      |
| 18181-C9   | VK2\|A19/JK3 ....................... ........... | 15156      |
| VK1\|L19/JK1 | GVPSRFSGSGSG--TDFTLTISSLQPEDFATYYC           | 15157      |
| 17771-D2   | VK1\|L19/JK1 ....................... ........... | 15158      |
| 17784-B9   | VK1\|L19/JK1 ....................... ........A... | 15159      |
| VK2\|A19/JK4 | GVPDRFSGSGSG--TDFTLKISRVEAEDVGVYYC           | 15160      |
| 17777-B4   | VK2\|A19/JK4 ....................... ........... | 15161      |
| 17777-C5   | VK2\|A19/JK4 ....................... ........... | 15162      |
| 17783-C11  | VK2\|A19/JK4 .........A............. ........... | 15163      |
| 17813-F1   | VK2\|A19/JK4 ..............I........ ........... | 15164      |
| 18179-A9   | VK2\|A19/JK4 ..............A........ ........... | 15165      |
| VK2\|O1/JK2 | GVPDRFSGSGSG--TDFTLKISRVEAEDVGVYYC            | 15166      |
| 17778-C9   | VK2\|O1/JK2 ....................... K........... | 15167      |
| 18179-H6   | VK2\|O1/JK2 ....................... ......A..... | 15168      |
| VK1\|O12/JK1 | GVPSRFSGSGSG--TDFTLTISSLQPEDFATYYC          | 15169      |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 17779-D11 | VK1\|O12/JK1 | ....................... ............ | 15170 |
| 18081-D12 | VK1\|O12/JK1 | ....................... ............ | 15171 |
| 18093-E2 | VK1\|O12/JK1 | ...............E...... ............ | 15172 |
| 18093-F5 | VK1\|O12/JK1 | ....................... ............ | 15173 |
| 18409-F12_final | VK1\|O12/JK1 | ........R............. ............ | 15174 |
| 18409-H7_final | VK1\|O12/JK1 | ....................... ............ | 15175 |
| 18409-H10_final | VK1\|O12/JK1 | ........R............. ............ | 15176 |
| VK2\|O1/JK5 |  | GVPDRESGSGSG-- TDFTLKISRVEAEDVGVYYC | 15177 |
| 17780-D12 | VK2\|O1/JK5 | ....................... ............ | 15178 |
| 17784-G10 | VK2\|O1/JK5 | ....................... ............ | 15179 |
| VK2\|A19/JK1 |  | GVPDRESGSGSG-- TDFTLKISRVEAEDVGVYYC | 15180 |
| 17781-B3 | VK2\|A19/JK1 | ....................... ............ | 15181 |
| 17781-H12 | VK2\|A19/JK1 | ....................... ............ | 15182 |
| 17784-H5 | VK2\|A19/JK1 | ....................... ............ | 15183 |
| 18080-C5 | VK2\|A19/JK1 | ....................... ............ | 15184 |
| 18179-F6 | VK2\|A19/JK1 | ....................... ........F... | 15185 |
| 18179-G8 | VK2\|A19/JK1 | ....................... ............ | 15186 |
| 18181-H10 | VK2\|A19/JK1 | ....................... ........I... | 15187 |
| 18181-G10 | VK2\|A19/JK1 | ....................... ........F... | 15188 |
| 18181-E2 | VK2\|A19/JK1 | ....................... K........... | 15189 |
| VK2\|O1/JK4 |  | GVPDRESGSGSG-- TDFTLKISRVEAEDVGVYYC | 15190 |
| 17783-G10 | VK2\|O1/JK4 | ....................... ............ | 15191 |
| 17813-E3 | VK2\|O1/JK4 | ....................... ............ | 15192 |
| 17813-E5 | VK2\|O1/JK4 | ....................... ............ | 15193 |

TABLE 61-continued scFv Variable Region Consensus Protein Alignment
CDRs defined by Kabat
Alignment numbering defined by Amgen Reference (AHo)
KAPPA VARIABLE

| | Germline | | SEQ ID NO: |
|---|---|---|---|
| VK1\|A20/JK3 | | GVPSRFSGSGSG--<br>TDFTLTISSLQPEDVATYYC | 15194 |
| 17784-C7 | VK1\|A20/JK3 | ....................<br>......F..... | 15195 |
| 18089-H9 | VK1\|A20/JK3 | ....................<br>............ | 15196 |
| 18089-D12 | VK1\|A20/JK3 | ....................<br>............ | 15197 |
| 18179-C1 | VK1\|A20/JK3 | ....................<br>............ | 15198 |
| 02-C1-86-A4-N-<br>F5_final | VK1\|A20/JK3 | ....................<br>............ | 15199 |
| 18486-A4_final | VK1\|A20/JK3 | ....................<br>......F..... | 15200 |
| VK2\|O1/JK3 | | GVPDRESGSGSG--<br>TDFTLKISRVEAEDVGVYYC | 15201 |
| 17784-C11 | VK2\|O1/JK3 | ....................<br>............ | 15202 |
| VK1\|A20/JK1 | | GVPSRFSGSGSG--<br>TDFTLTISSLQPEDVATYYC | 15203 |
| 17813-D8 | VK1\|A20/JK1 | ....................<br>......F..... | 15204 |
| VK2\|A18/JK5 | | GVPDRESGSGSG--<br>TDFTLKISRVEAEDVGVYYC | 15205 |
| 17814-D9 | VK2\|A18/JK5 | ....................<br>............ | 15206 |
| VK4\|B3/JK1 | | GVPDRESGSGSG--<br>TDFTLTISSLQAEDVAVYYC | 15207 |
| 18071-C4 | VK4\|B3/JK1 | ....................<br>............ | 15208 |
| 18071-D4 | VK4\|B3/JK1 | ....................<br>............ | 15209 |
| 18086-H4 | VK4\|B3/JK1 | ....................<br>............ | 15210 |
| VK1\|O18/JK1 | | GVPSRFSGSGSG--<br>TDFTFTISSLQPEDIATYYC | 15211 |
| 18074-G12 | VK1\|O18/JK1 | ....................<br>......F..... | 15212 |
| VK4\|B3/JK4 | | GVPDRESGSGSG-<br>TDFTLTISSLQAEDVAVYYC | 15213 |
| 18081-A6 | VK4\|B3/JK4 | ....................<br>............ | 15214 |
| 18081-C10 | VK4\|B3/JK4 | ....................<br>............ | 15215 |
| 18089-B8 | VK4\|B3/JK4 | ....................<br>............ | 15216 |
| 18081-E7 | VK4\|B3/JK4 | ....................<br>............ | 15217 |

TABLE 61-continued scFv Variable Region Consensus Protein Alignment
CDRs defined by Kabat
Alignment numbering defined by Amgen Reference (AHo)
KAPPA VARIABLE

| | Germline | | SEQ ID NO: |
|---|---|---|---|
| VK1\|O12/JK2 | | GVPSRFSGSGSG--<br>TDFTLTISSLQPEDFATYYC | 15218 |
| 18081-D6 | VK1\|O12/JK2 | ......................<br>........... | 15219 |
| 18089-H12 | VK1\|O12/JK2 | ......................<br>........... | 15220 |
| 18179-E6 | VK1\|O12/JK2 | ......................<br>........... | 15221 |
| 18089-D11 | VK1\|O12/JK2 | ......................<br>........... | 15222 |
| 18081-B6 | VK1\|O12/JK2 | ......................<br>........... | 15223 |
| 18181-F1 | VK1\|O12/JK2 | ......................<br>........... | 15224 |
| 18181-A6 | VK1\|O12/JK2 | ......................<br>........... | 15225 |
| 18410-B6_final | VK1\|O12/JK2 | ......................<br>........... | 15226 |
| 18410-H3_final | VK1\|O12/JK2 | ......................<br>........... | 15227 |
| VK1\|O12/JK4 | | GVPSRFSGSGSG--<br>TDFTLTISSLQPEDFATYYC | 15228 |
| 18089-C8 | VK1\|O12/JK4 | ......................<br>........... | 15229 |
| 18089-B2 | VK1\|O12/JK4 | ......................<br>........... | 15230 |
| 18181-G8 | VK1\|O12/JK4 | ......................<br>........... | 15231 |
| 18410-B5_final | VK1\|O12/JK4 | ......................<br>........... | 15232 |
| VK1\|O12/JK3 | | GVPSRESGSGSG--<br>TDFTLTISSLQPEDFATYYC | 15233 |
| 18089-G7 | VK1\|O12/JK3 | ......................<br>........... | 15234 |
| 18179-B7 | VK1\|O12/JK3 | ......................<br>........... | 15235 |
| 18179-B8 | VK1\|O12/JK3 | ......................<br>........... | 15236 |
| 18179-D8 | VK1\|O12/JK3 | ......................<br>........... | 15237 |
| 18179-D9 | VK1\|O12/JK3 | ......................<br>...R........ | 15238 |
| 18181-G7 | VK1\|O12/JK3 | ......................<br>........... | 15239 |
| 18089-C9 | VK1\|O12/JK3 | ........R.............<br>........... | 15240 |
| 18081-F9 | VK1\|O12/JK3 | ......................<br>........... | 15241 |

TABLE 61-continued scFv Variable Region Consensus Protein Alignment
CDRs defined by Kabat
Alignment numbering defined by Amgen Reference (AHo)
KAPPA VARIABLE

|  | Germline | SEQ ID NO: |
|---|---|---|
| 18081-H11 | VK1\|O12/JK3 ...................... ............ | 15242 |
| 18179-E1 | VK1\|O12/JK3 ...................... ............ | 15243 |
| 18179-H7 | VK1\|O12/JK3 ...................... ............ | 15244 |
| 18179-B12 | VK1\|O12/JK3 ...................... ............ | 15245 |
| 18179-D11 | VK1\|O12/JK3 ...................... ............ | 15246 |
| 18179-D7 | VK1\|O12/JK3 ...................... ............ | 15247 |
| 18179-A7 | VK1\|O12/JK3 ...................... ............ | 15248 |
| 18181-F3 | VK1\|O12/JK3 ...................... ............ | 15249 |
| 18409-E2_final | VK1\|O12/JK3 ...................... ............ | 15250 |
| 18409-G10_final | VK1\|O12/JK3 ...................... ............ | 15251 |
| 18410-D3_final | VK1\|O12/JK3 ...................... ............ | 15252 |
| 18410-D6_final | VK1\|O12/JK3 ...................... ............ | 15253 |
| 18410-H1_final | VK1\|O12/JK3 ...................... ............ | 15254 |
| VK1\|L19/JK4 | GVPSRFSGSGSG--TDFTLTISSLQPEDFATYYC | 15255 |
| 18089-G11 | VK1\|L19/JK4 ...................... ............ | 15256 |
| VK3\|A27/JK1 | GIPDRESGSGSG--TDFTLTISRLEPEDFAVYYC | 15257 |
| 18179-A10 | VK3\|A27/JK1 .V................K...V.A..VG.... | 15258 |
| VK1\|A20/JK2 | GVPSRFSGSGSG-TDFTLTISSLQPEDVATYYC | 15259 |
| 18179-G12 | VK1\|A20/JK2 ...................... ............ | 15260 |
| VK4\|B3/JK5 | GVPDRESGSGSG--TDFTLTISSLQAEDVAVYYC | 15261 |
| 18081-B9 | VK4\|B3/JK5 ...................... ............ | 15262 |
| 18081-B9_final | VK4\|B3/JK5 ...................... ............ | 15263 |
| VK1\|O12/JK5 | GVPSRFSGSGSG--TDFTLTISSLQPEDFATYYC | 15264 |
| 18089-D8 | VK1\|O12/JK5 ...................... ............ | 15265 |

TABLE 61-continued scFv Variable Region Consensus Protein Alignment
CDRs defined by Kabat
Alignment numbering defined by Amgen Reference (AHo)
KAPPA_VARIABLE

| | Germline | K_CDR3 | SEQ ID NO: |
|---|---|---|---|
| VK4\|B3/JK2 | | QQYYS--------------------TPYT | 15566 |
| 17724-C9 | VK4\|B3/JK2 | ........................Y...  | 15567 |
| 18079-H4 | VK4\|B3/JK2 | ...........................W. | 15568 |
| 18079-H11 | VK4\|B3/JK2 | ...........................W. | 15569 |
| VK6\|A10/JK2 | | HQSSS--------------------LPYT | 15570 |
| 17724-G6 | VK6\|A10/JK2 | ..W.........................Y.P. | 15571 |
| VK1\|L11/JK2 | | LQDYN--------------------YPYT | 15572 |
| 17731-H8 | VK1\|L11/JK2 | QHH.G......................T.L. | 15573 |
| VK2\|A19/JK5 | | MQALQ--------------------TPIT | 15574 |
| 17732-A8 | VK2\|A19/JK5 | ...........................P. | 15575 |
| 18081-B5 | VK2\|A19/JK5 | ............................P. | 15576 |
| VK2\|A19/JK2 | | MQALQ--------------------TPYT | 15577 |
| 17745-E5 | VK2\|A19/JK2 | ..P........................P. | 15578 |
| 17778-F1 | VK2\|A19/JK2 | ............................P. | 15579 |
| 17778-H8 | VK2\|A19/JK2 | ............................P. | 15580 |
| 18088-E4 | VK2\|A19/JK2 | ..V........................P. | 15581 |
| 18179-C4 | VK2\|A19/JK2 | ............................R. | 15582 |
| 18179-C7 | VK2\|A19/JK2 | ....-......................QTPS | 15583 |
| 18179-F3 | VK2\|A19/JK2 | ....-......................QTPS | 15584 |
| 18181-C6 | VK2\|A19/JK2 | ..G........................R. | 15585 |
| VK2\|O1/JK1 | | MQRIE--------------------FPWT | 15586 |
| 17745-E8 | VK2\|O1/JK1 | ..GTH......................W.R. | 15587 |
| 18179-C6 | VK2\|O1/JK1 | ..ALQ......................T.R. | 15588 |
| 18179-F10 | VK2\|O1/JK1 | ..ALQ......................T.R. | 15589 |
| 18179-G9 | VK2\|O1/JK1 | ..AL-......................QTPS | 15590 |
| 18181-H7 | VK2\|O1/JK1 | ..ALQ......................T... | 15591 |
| 18181-B8 | VK2\|O1/JK1 | ..AL-......................QTPS | 15592 |
| 81-H7-SG-F28_final | VK2\|O1/JK1 | ..ALQ......................T... | 15593 |
| VK3\|A27/JK3 | | QQYGS--------------------SPFT | 15594 |
| 17745-G8 | VK3\|A27/JK3 | ....R......................L.. | 15595 |

TABLE 61-continued scFv Variable Region Consensus Protein Alignment
CDRs defined by Kabat
Alignment numbering defined by Amgen Reference (AHo)
KAPPA VARIABLE

|  | Germline | | SEQ ID NO: |
|---|---|---|---|
| 18080-H9 | VK3\|A27/JK3 | ............................. | 15596 |
| VK3\|A27/JK4 | | QQYGS---------------------SPLT | 15597 |
| 17748-D12 | VK3\|A27/JK4 | ............................. | 15598 |
| 17777-C4 | VK3\|A27/JK4 | ............................. | 15599 |
| 18072-D6 | VK3\|A27/JK4 | ....-.....................S.. | 15600 |
| 18084-E4 | VK3\|A27/JK4 | ............................. | 15601 |
| 18088-B10 | VK3\|A27/JK4 | ....T........................ | 15602 |
| VK2\|A19/JK3 | | MQALQ---------------------TPFT | 15603 |
| 17753-F4 | VK2\|A19/JK3 | ............................. | 15604 |
| 17779-E1 | VK2\|A19/JK3 | ............................. | 15605 |
| 17780-E6 | VK2\|A19/JK3 | ..GTH.................W...  | 15606 |
| 17785-D12 | VK2\|A19/JK3 | ............................. | 15607 |
| 18179-A3 | VK2\|A19/JK3 | ............................. | 15608 |
| 18179-A5 | VK2\|A19/JK3 | ............................. | 15609 |
| 18179-C10 | VK2\|A19/JK3 | ............................. | 15610 |
| 18179-F4 | VK2\|A19/JK3 | ............................. | 15611 |
| 18179-H9 | VK2\|A19/JK3 | ............................. | 15612 |
| 18181-A11 | VK2\|A19/JK3 | ............................. | 15613 |
| 18181-C9 | VK2\|A19/JK3 | ...G......................... | 15614 |
| VK1\|L19/JK1 | | QQANS---------------------FPWT | 15615 |
| 17771-D2 | VK1\|L19/JK1 | ........................P. | 15616 |
| 17784-B9 | VK1\|L19/JK1 | ..SY..................T.P. | 15617 |
| VK2\|A19/JK4 | | MQALQ---------------------TPLT | 15618 |
| 17777-B4 | VK2\|A19/JK4 | ............................. | 15619 |
| 17777-C5 | VK2\|A19/JK4 | ..GTH.................W... | 15620 |
| 17783-C11 | VK2\|A19/JK4 | ..GTH.................W... | 15621 |
| 17813-F1 | VK2\|A19/JK4 | ....-....................QTPH | 15622 |
| 18179-A9 | VK2\|A19/JK4 | ............................. | 15623 |
| VK2\|O1/JK2 | | MQRIE---------------------FPYT | 15624 |
| 17778-C9 | VK2\|O1/JK2 | ..ALQ..................T.CS | 15625 |
| 18179-H6 | VK2\|O1/JK2 | ..SLH..................L.P. | 15626 |
| VK1\|O12/JK1 | | QQSYS---------------------TPWT | 15627 |
| 17779-D11 | VK1\|O12/JK1 | ....R....................P. | 15628 |

TABLE 61-continued scFv Variable Region Consensus Protein Alignment
CDRs defined by Kabat
Alignment numbering defined by Amgen Reference (AHo)
KAPPA VARIABLE

| | Germline | | SEQ ID NO: |
|---|---|---|---|
| 18081-D12 | VK1\|O12/JK1 | ............................P. | 15629 |
| 18093-E2 | VK1\|O12/JK1 | ............................P. | 15630 |
| 18093-F5 | VK1\|O12/JK1 | ..........................V.P. | 15631 |
| 18409-F12_final | VK1\|O12/JK1 | ....Y.....................Y.TL | 15632 |
| 18409-H7_final | VK1\|O12/JK1 | ....F.....................PVVE | 15633 |
| 18409-H10_final | VK1\|O12/JK1 | ....T......................P.T | 15634 |
| VK2\|O1/JK5 | | MQRIE--------------------<br>FPIT | 15635 |
| 17780-D12 | VK2\|O1/JK5 | ..ALQ.......................T... | 15636 |
| 17784-G10 | VK2\|O1/JK5 | ..ALQ.......................T... | 15637 |
| VK2\|A19/JK1 | | MQALQ--------------------<br>TPWT | 15638 |
| 17781-B3 | VK2\|A19/JK1 | ................................ | 15639 |
| 17781-H12 | VK2\|A19/JK1 | ..SI......................L... | 15640 |
| 17784-H5 | VK2\|A19/JK1 | ............................P. | 15641 |
| 18080-C5 | VK2\|A19/JK1 | ............................R. | 15642 |
| 18179-F6 | VK2\|A19/JK1 | ............................R. | 15643 |
| 18179-G8 | VK2\|A19/JK1 | ............................R. | 15644 |
| 18181-H10 | VK2\|A19/JK1 | ............................R. | 15645 |
| 18181-G10 | VK2\|A19/JK1 | ............................R. | 15646 |
| 18181-E2 | VK2\|A19/JK1 | ............................R. | 15647 |
| VK2\|O1/JK4 | | MQRIE--------------------<br>FPLT | 15648 |
| 17783-G10 | VK2\|O1/JK4 | ..ALQ.......................T... | 15649 |
| 17813-E3 | VK2\|O1/JK4 | .AL-<br>.......................QS.. | 15650 |
| 17813-E5 | VK2\|O1/JK4 | ..ALQ.......................T... | 15651 |
| VK1\|A20/JK3 | | QKYNS--------------------<br>APFT | 15652 |
| 17784-C7 | VK1\|A20/JK3 | .QSY........................T.. | 15653 |
| 18089-H9 | VK1\|A20/JK3 | ...Y............................ | 15654 |
| 18089-D12 | VK1\|A20/JK3 | ................................ | 15655 |
| 18179-C1 | VK1\|A20/JK3 | ................................ | 15656 |
| 02-C1-86-A4-N-F5_final | VK1\|A20/JK3 | ................................ | 15657 |
| 18486-A4_final | VK1\|A20/JK3 | ................................ | 15658 |
| VK2\|O1/JK3 | | MQRIE--------------------<br>FPFT | 15659 |
| 17784-C11 | VK2\|O1/JK3 | ..GTH......................W... | 15660 |
| VK1\|A20/JK1 | | QKYNS--------------------<br>APWT | 15661 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 17813-D8 | VK1\|A20/JK1 | .QSY....................T.P. | 15662 |
| VK2\|A18/JK5 |  | MQGIH--------------------LPIT | 15663 |
| 17814-D9 | VK2\|A18/JK5 | ..ALQ....................T... | 15664 |
| VK4\|B3/JK1 |  | QQYYS--------------------TPWT | 15665 |
| 18071-C4 | VK4\|B3/JK1 | ............................. | 15666 |
| 18071-D4 | VK4\|B3/JK1 | ............................. | 15667 |
| 18086-H4 | VK4\|B3/JK1 | ............................. | 15668 |
| VK1\|O18/JK1 |  | QQYDN--------------------LPWT | 15669 |
| 18074-G12 | VK1\|O18/JK1 | ..SYS....................I.P. | 15670 |
| VK4\|B3/JK4 |  | QQYYS--------------------TPLT | 15671 |
| 18081-A6 | VK4\|B3/JK4 | ............................. | 15672 |
| 18081-C10 | VK4\|B3/JK4 | ............................. | 15673 |
| 18089-B8 | VK4\|B3/JK4 | ............................. | 15674 |
| 18081-E7 | VK4\|B3/JK4 | ............................. | 15675 |
| VK1\|O12/JK2 |  | QQSYS--------------------TPYT | 15676 |
| 18081-D6 | VK1\|O12/JK2 | ............................F. | 15677 |
| 18089-H12 | VK1\|O12/JK2 | ............................F. | 15678 |
| 18179-E6 | VK1\|O12/JK2 | ..T.......................M.F. | 15679 |
| 18089-D11 | VK1\|O12/JK2 | ....I.......................F. | 15680 |
| 18081-B6 | VK1\|O12/JK2 | ............................F. | 15681 |
| 18181-F1 | VK1\|O12/JK2 | ..T.......................S.F. | 15682 |
| 18181-A6 | VK1\|O12/JK2 | ..T.......................M.F. | 15683 |
| 18410-B6_final | VK1\|O12/JK2 | I.A.T.....................S.F. | 15684 |
| 18410-H3_final | VK1\|O12/JK2 | ..T.......................S.F. | 15685 |
| VK1\|O12/JK4 |  | QQSYS--------------------TPLT | 15686 |
| 18089-C8 | VK1\|O12/JK4 | ............................. | 15687 |
| 18089-B2 | VK1\|O12/JK4 | ...........................I. | 15688 |
| 18181-G8 | VK1\|O12/JK4 | ..T.......................M.F. | 15689 |
| 18410-B5_final | VK1\|O12/JK4 | ..T.......................M.F. | 15690 |
| VK1\|O12/JK3 |  | QQSYS--------------------TPFT | 15691 |
| 18089-G7 | VK1\|O12/JK3 | ...........................I... | 15692 |
| 18179-B7 | VK1\|O12/JK3 | ..T.......................M... | 15693 |
| 18179-B8 | VK1\|O12/JK3 | ............................. | 15694 |
| 18179-D8 | VK1\|O12/JK3 | ..T.......................M... | 15695 |

TABLE 61-continued scFv Variable Region Consensus Protein Alignment
CDRs defined by Kabat
Alignment numbering defined by Amgen Reference (AHo)
KAPPA_VARIABLE

|  | Germline |  | SEQ ID NO: |
|---|---|---|---|
| 18179-D9 | VK1\|O12/JK3 | ................................ | 15696 |
| 18181-G7 | VK1\|O12/JK3 | ..T.........................M... | 15697 |
| 18089-C9 | VK1\|O12/JK3 | ................................ | 15698 |
| 18081-F9 | VK1\|O12/JK3 | ................................ | 15699 |
| 18081-H11 | VK1\|O12/JK3 | ....T........................... | 15700 |
| 18179-E1 | VK1\|O12/JK3 | ..T.........................M... | 15701 |
| 18179-H7 | VK1\|O12/JK3 | ............................S... | 15702 |
| 18179-B12 | VK1\|O12/JK3 | ..T.........................M... | 15703 |
| 18179-D11 | VK1\|O12/JK3 | ..T.........................M... | 15704 |
| 18179-D7 | VK1\|O12/JK3 | ..T.........................M... | 15705 |
| 18179-A7 | VK1\|O12/JK3 | ..T.........................M... | 15706 |
| 18181-F3 | VK1\|O12/JK3 | ............................S... | 15707 |
| 18409-E2_final | VK1\|O12/JK3 | ............................S... | 15708 |
| 18409-G10_final | VK1\|O12/JK3 | ....I........................... | 15709 |
| 18410-D3_final | VK1\|O12/JK3 | ..T.........................M... | 15710 |
| 18410-D6_final | VK1\|O12/JK3 | ..T.........................M... | 15711 |
| 18410-H1_final | VK1\|O12/JK3 | ..T.........................M... | 15712 |
| VK1\|L19/JK4 |  | QQANS--------------------FPLT | 15713 |
| 18089-G11 | VK1\|L19/JK4 | ...SY.......................T... | 15714 |
| VK3\|A27/JK1 |  | QQYGS--------------------SPWT | 15715 |
| 18179-A10 | VK3\|A27/JK1 | M.ALQ......................T.R. | 15716 |
| VK1\|A20/JK2 |  | QKYNS--------------------APYT | 15717 |
| 18179-G12 | VK1\|A20/JK2 | ...............................F. | 15718 |
| VK4\|B3/JK5 |  | QQYYS--------------------TPIT | 15719 |
| 18081-B9 | VK4\|B3/JK5 | ..F............................. | 15720 |
| 18081-B9_final | VK4\|B3/JK5 | ..F............................. | 15721 |
| VK1\|O12/JK5 |  | QQSYS--------------------TPIT | 15722 |
| 18089-D8 | VK1\|O12/JK5 | ................................ | 15723 |
|  |  | K_FR4 |  |
| VK4\|B3/JK2 |  | FGQGTKLEIK | 16027 |
| 17724-C9 | VK4\|B3/JK2 | ..G.....L. | 16028 |
| 18079-H4 | VK4\|B3/JK2 | .......... | 16029 |
| 18079-H11 | VK4\|B3/JK2 | .......... | 16030 |
| VK6\|A10/JK2 |  | FGQGTKLEIK | 16031 |

TABLE 61-continued scFv Variable Region Consensus Protein Alignment
CDRs defined by Kabat
Alignment numbering defined by Amgen Reference (AHo)
KAPPA_VARIABLE

| | Germline | SEQ ID NO: |
|---|---|---|
| 17724-G6 | VK6\|A10/JK2 ...S....... | 16032 |
| VK1\|L11/JK2 | FGQGTKLEIK | 16033 |
| 17731-H8 | VK1\|L11/JK2 ...A.....L. | 16034 |
| VK2\|A19/JK5 | FGQGTRLEIK | 16035 |
| 17732-A8 | VK2\|A19/JK5 .......... | 16036 |
| 18081-B5 | VK2\|A19/JK5 .......... | 16037 |
| VK2\|A19/JK2 | FGQGTKLEIK | 16038 |
| 17745-E5 | VK2\|A19/JK2 ...P....... | 16039 |
| 17778-F1 | VK2\|A19/JK2 .......... | 16040 |
| 17778-H8 | VK2\|A19/JK2 .......... | 16041 |
| 18088-E4 | VK2\|A19/JK2 .......D.. | 16042 |
| 18179-C4 | VK2\|A19/JK2 .......... | 16043 |
| 18179-C7 | VK2\|A19/JK2 .......... | 16044 |
| 18179-F3 | VK2\|A19/JK2 .......... | 16045 |
| 18181-C6 | VK2\|A19/JK2 .......... | 16046 |
| VK2\|O1/JK1 | FGQGTKVEIK | 16047 |
| 17745-E8 | VK2\|O1/JK1 .......... | 16048 |
| 18179-C6 | VK2\|O1/JK1 .......... | 16049 |
| 18179-F10 | VK2\|O1/JK1 .......... | 16050 |
| 18179-G9 | VK2\|O1/JK1 .......... | 16051 |
| 18181-H7 | VK2\|O1/JK1 .......... | 16052 |
| 18181-B8 | VK2\|O1/JK1 .......... | 16053 |
| 81-H7-SG-F28_final | VK2\|O1/JK1 .......... | 16054 |
| VK3\|A27/JK3 | FGPGTKVDIK | 16055 |
| 17745-G8 | VK3\|A27/JK3 .......... | 16056 |
| 18080-H9 | VK3\|A27/JK3 .......E.. | 16057 |
| VK3\|A27/JK4 | FGGGTKVEIK | 16058 |
| 17748-D12 | VK3\|A27/JK4 ......L... | 16059 |
| 17777-C4 | VK3\|A27/JK4 ......L... | 16060 |
| 18072-D6 | VK3\|A27/JK4 .......D.. | 16061 |
| 18084-E4 | VK3\|A27/JK4 ......L... | 16062 |
| 18088-B10 | VK3\|A27/JK4 .......D.. | 16063 |
| VK2\|A19/JK3 | FGPGTKVDIK | 16064 |
| 17753-F4 | VK2\|A19/JK3 .......E.. | 16065 |
| 17779-E1 | VK2\|A19/JK3 .......E.. | 16066 |
| 17780-E6 | VK2\|A19/JK3 .......E.. | 16067 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 17785-D12 | VK2\|A19/JK3 | .......... | 16068 |
| 18179-A3 | VK2\|A19/JK3 | .......... | 16069 |
| 18179-A5 | VK2\|A19/JK3 | .......E.. | 16070 |
| 18179-C10 | VK2\|A19/JK3 | .......E.. | 16071 |
| 18179-F4 | VK2\|A19/JK3 | .......E.. | 16072 |
| 18179-H9 | VK2\|A19/JK3 | .......E.. | 16073 |
| 18181-A11 | VK2\|A19/JK3 | .......E.. | 16074 |
| 18181-C9 | VK2\|A19/JK3 | .......E.. | 16075 |
| VK1\|L19/JK1 | FGQGTKVEIK |  | 16076 |
| 17771-D2 | VK1\|L19/JK1 | .......... | 16077 |
| 17784-B9 | VK1\|L19/JK1 | .......... | 16078 |
| VK2\|A19/JK4 | FGGGTKVEIK |  | 16079 |
| 17777-B4 | VK2\|A19/JK4 | .......... | 16080 |
| 17777-C5 | VK2\|A19/JK4 | .......D.. | 16081 |
| 17783-C11 | VK2\|A19/JK4 | ......L... | 16082 |
| 17813-F1 | VK2\|A19/JK4 | .......... | 16083 |
| 18179-A9 | VK2\|A19/JK4 | .......... | 16084 |
| VK2\|O1/JK2 | FGQGTKLEIK |  | 16085 |
| 17778-C9 | VK2\|O1/JK2 | .......... | 16086 |
| 18179-H6 | VK2\|O1/JK2 | ...G...... | 16087 |
| VK1\|O12/JK1 | FGQGTKVEIK |  | 16088 |
| 17779-D11 | VK1\|O12/JK1 | .......D.. | 16089 |
| 18081-D12 | VK1\|O12/JK1 | .......... | 16090 |
| 18093-E2 | VK1\|O12/JK1 | .......D.. | 16091 |
| 18093-F5 | VK1\|O12/JK1 | .......D.. | 16092 |
| 18409-F12_final | VK1\|O12/JK1 | ..P....... | 16093 |
| 18409-H7_final | VK1\|O12/JK1 | ..P....... | 16094 |
| 18409-H10_final | VK1\|O12/JK1 | ..P....... | 16095 |
| VK2\|O1/JK5 | FGQGTRLEIK |  | 16096 |
| 17780-D12 | VK2\|O1/JK5 | .......... | 16097 |
| 17784-G10 | VK2\|O1/JK5 | .......... | 16098 |
| VK2\|A19/JK1 | FGQGTKVEIK |  | 16099 |
| 17781-B3 | VK2\|A19/JK1 | .......D.. | 16100 |
| 17781-H12 | VK2\|A19/JK1 | .......D.. | 16101 |
| 17784-H5 | VK2\|A19/JK1 | .......... | 16102 |
| 18080-C5 | VK2\|A19/JK1 | .......... | 16103 |
| 18179-F6 | VK2\|A19/JK1 | .......... | 16104 |

TABLE 61-continued scFv Variable Region Consensus Protein Alignment
CDRs defined by Kabat
Alignment numbering defined by Amgen Reference (AHo)
KAPPA VARIABLE

| | Germline | | SEQ ID NO: |
|---|---|---|---|
| 18179-G8 | VK2\|A19/JK1 | .......... | 16105 |
| 18181-H10 | VK2\|A19/JK1 | .......D.. | 16106 |
| 18181-G10 | VK2\|A19/JK1 | .......... | 16107 |
| 18181-E2 | VK2\|A19/JK1 | .......D.. | 16108 |
| VK2\|O1/JK4 | | FGGGTKVEIK | 16109 |
| 17783-G10 | VK2\|O1/JK4 | ......L... | 16110 |
| 17813-E3 | VK2\|O1/JK4 | ......L... | 16111 |
| 17813-E5 | VK2\|O1/JK4 | .......D.. | 16112 |
| VK1\|A20/JK3 | | FGPGTKVDIK | 16113 |
| 17784-C7 | VK1\|A20/JK3 | .......E.. | 16114 |
| 18089-H9 | VK1\|A20/JK3 | .......... | 16115 |
| 18089-D12 | VK1\|A20/JK3 | .......E.. | 16116 |
| 18179-C1 | VK1\|A20/JK3 | .......... | 16117 |
| 02-C1-86-A4-N-F5_final | VK1\|A20/JK3 | .......E.. | 16118 |
| 18486-A4_final | VK1\|A20/JK3 | .......E.. | 16119 |
| VK2\|O1/JK3 | | FGPGTKVDIK | 16120 |
| 17784-C11 | VK2\|O1/JK3 | .......E.. | 16121 |
| VK1\|A20/JK1 | | FGQGTKVEIK | 16122 |
| 17813-D8 | VK1\|A20/JK1 | .......... | 16123 |
| VK2\|A18/JK5 | | FGQGTRLEIK | 16124 |
| 17814-D9 | VK2\|A18/JK5 | .......... | 16125 |
| VK4\|B3/JK1 | | FGQGTKVEIK | 16126 |
| 18071-C4 | VK4\|B3/JK1 | .......... | 16127 |
| 18071-D4 | VK4\|B3/JK1 | .......... | 16128 |
| 18086-H4 | VK4\|B3/JK1 | .......D.. | 16129 |
| VK1\|O18/JK1 | | FGQGTKVEIK | 16130 |
| 18074-G12 | VK1\|O18/JK1 | .......... | 16131 |
| VK4\|B3/JK4 | | FGGGTKVEIK | 16132 |
| 18081-A6 | VK4\|B3/JK4 | .......... | 16133 |
| 18081-C10 | VK4\|B3/JK4 | .......... | 16134 |
| 18089-B8 | VK4\|B3/JK4 | .......D.. | 16135 |
| 18081-E7 | VK4\|B3/JK4 | .......... | 16136 |
| VK1\|O12/JK2 | | FGQGTKLEIK | 16137 |
| 18081-D6 | VK1\|O12/JK2 | ...P...... | 16138 |
| 18089-H12 | VK1\|O12/JK2 | ...P...... | 16139 |
| 18179-E6 | VK1\|O12/JK2 | ...P...... | 16140 |

TABLE 61-continued scFv Variable Region Consensus Protein Alignment
CDRs defined by Kabat
Alignment numbering defined by Amgen Reference (AHo)
KAPPA VARIABLE

|  | Germline |  | SEQ ID NO: |
|---|---|---|---|
| 18089-D11 | VK1\|O12/JK2 | ...G....... | 16141 |
| 18081-B6 | VK1\|O12/JK2 | ...P....... | 16142 |
| 18181-F1 | VK1\|O12/JK2 | ...P....... | 16143 |
| 18181-A6 | VK1\|O12/JK2 | ...P....... | 16144 |
| 18410-B6_final | VK1\|O12/JK2 | ...P....... | 16145 |
| 18410-H3_final | VK1\|O12/JK2 | ...P....... | 16146 |
| VK1\|O12/JK4 |  | FGGGTKVEIK | 16147 |
| 18089-C8 | VK1\|O12/JK4 | .......... | 16148 |
| 18089-B2 | VK1\|O12/JK4 | .......... | 16149 |
| 18181-G8 | VK1\|O12/JK4 | .......... | 16150 |
| 18410-B5_final | VK1\|O12/JK4 | .......... | 16151 |
| VK1\|O12/JK3 |  | FGPGTKVDIK | 16152 |
| 18089-G7 | VK1\|O12/JK3 | .......E.. | 16153 |
| 18179-B7 | VK1\|O12/JK3 | .......... | 16154 |
| 18179-B8 | VK1\|O12/JK3 | .......... | 16155 |
| 18179-D8 | VK1\|O12/JK3 | .......... | 16156 |
| 18179-D9 | VK1\|O12/JK3 | .......... | 16157 |
| 18181-G7 | VK1\|O12/JK3 | .......E.. | 16158 |
| 18089-C9 | VK1\|O12/JK3 | .......E.. | 16159 |
| 18081-F9 | VK1\|O12/JK3 | .......E.. | 16160 |
| 18081-H11 | VK1\|O12/JK3 | .......E.. | 16161 |
| 18179-E1 | VK1\|O12/JK3 | .......... | 16162 |
| 18179-H7 | VK1\|O12/JK3 | .......E.. | 16163 |
| 18179-B12 | VK1\|O12/JK3 | .......E.. | 16164 |
| 18179-D11 | VK1\|O12/JK3 | .......... | 16165 |
| 18179-D7 | VK1\|O12/JK3 | .......... | 16166 |
| 18179-A7 | VK1\|O12/JK3 | .......... | 16167 |
| 18181-F3 | VK1\|O12/JK3 | .......E.. | 16168 |
| 18409-E2_final | VK1\|O12/JK3 | .......E.. | 16169 |
| 18409-G10_final | VK1\|O12/JK3 | .......E.. | 16170 |
| 18410-D3_final | VK1\|O12/JK3 | .......... | 16171 |
| 18410-D6_final | VK1\|O12/JK3 | .......... | 16172 |
| 18410-H1_final | VK1\|O12/JK3 | .......... | 16173 |
| VK1\|L19/JK4 |  | FGGGTKVEIK | 16174 |
| 18089-G11 | VK1\|L19/JK4 | .......D.. | 16175 |
| VK3\|A27/JK1 |  | FGQGTKVEIK | 16176 |

TABLE 61-continued scFv Variable Region Consensus Protein Alignment
CDRs defined by Kabat
Alignment numbering defined by Amgen Reference (AHo)
KAPPA_VARIABLE

| | Germline | | SEQ ID NO: |
|---|---|---|---|
| 18179-A10 | VK3\|A27/JK1 | .......... | 16177 |
| VK1\|A20/JK2 | | FGQGTKLEIK | 16178 |
| 18179-G12 | VK1\|A20/JK2 | ...P....... | 16179 |
| VK4\|B3/JK5 | | FGQGTRLEIK | 16180 |
| 18081-B9 | VK4\|B3/JK5 | .......... | 16181 |
| 18081-B9_final | VK4\|B3/JK5 | .......... | 16182 |
| VK1\|O12/JK5 | | FGQGTRLEIK | 16183 |
| 18089-D8 | VK1\|O12/JK5 | .......... | 16184 |

TABLE 62

LAMBDA_VARIABLE

| | Germline | | SEQ ID NO: |
|---|---|---|---|
| | | L_FR1 | |
| VL2\|2a2/JL2 | | QSALTQP-ASVSGSPGQSITISC | 13434 |
| 18071-B1 | VL2\|2a2/JL2 | EL......P.............. | 13435 |
| VL1\|1g/JL2 | | QSVLTQP-PSASGTPGQRVTISC | 13436 |
| 18072-G9 | VL1\|1g/JL2 | EL.................I.... | 13437 |
| VL10\|10a/JL3b | | QAGLTQP-PSVSKGLRQTATLTC | 13438 |
| 18078-H6 | VL10\|10a/JL3b | ELV.................... | 13439 |
| 18079-C8 | VL10\|10a/JL3b | ELV.....S....D.......... | 13440 |
| VL2\|2c/JL2 | | QSALTQP-PSASGSPGQSVTISC | 13441 |
| 18082-F5 | VL2\|2c/JL2 | EL..................... | 13442 |
| VL10\|10a/JL2 | | QAGLTQP-PSVSKGLRQTATLTC | 13443 |
| 18090-H9 | VL10\|10a/JL2 | ELV...L................. | 13444 |
| VL3\|3h/JL2 | | SYVLTQP-PSVSVAPGKTARITC | 13445 |
| 18182-A3 | VL3\|3h/JL2 | EL..............Q...... | 13446 |
| 18182-A5 | VL3\|3h/JL2 | EL..............Q...... | 13447 |
| 18182-A6 | VL3\|3h/JL2 | EL.V..E.........Q...... | 13448 |
| 18182-A7 | VL3\|3h/JL2 | EL..............Q...... | 13449 |
| 18182-A8 | VL3\|3h/JL2 | EL.....S.S.......Q...... | 13450 |
| 18182-A11 | VL3\|3h/JL2 | EL...........T..Q...... | 13451 |
| 18182-B1 | VL3\|3h/JL2 | EL....L.........Q...... | 13452 |
| 18182-B4 | VL3\|3h/JL2 | ELM.............Q...... | 13453 |
| 18182-B6 | VL3\|3h/JL2 | ELM.....H.......Q...... | 13454 |
| 18182-B7 | VL3\|3h/JL2 | ELM.....H.......Q...... | 13455 |
| 18182-B10 | VL3\|3h/JL2 | ELM.....H.......Q...... | 13456 |

TABLE 62-continued

| | LAMBDA_VARIABLE | | |
|---|---|---|---|
| | Germline | | SEQ ID NO: |
| 18182-C2 | VL3\|3h/JL2 | EL.............Q...... | 13457 |
| 18182-C3 | VL3\|3h/JL2 | EL.............Q...... | 13458 |
| 18182-C4 | VL3\|3h/JL2 | ELM.....H.......Q...... | 13459 |
| 18182-C5 | VL3\|3h/JL2 | EL......A.......Q...... | 13460 |
| 18182-C10 | VL3\|3h/JL2 | EL....S.S.......Q...... | 13461 |
| 18182-C12 | VL3\|3h/JL2 | ELM.....H.......Q...... | 13462 |
| 18182-D4 | VL3\|3h/JL2 | ELA.....A.A.....Q...... | 13463 |
| 18182-D8 | VL3\|3h/JL2 | EL....L.S.......Q...... | 13464 |
| 18182-D9 | VL3\|3h/JL2 | EL.V..E.........Q...... | 13465 |
| 18182-D11 | VL3\|3h/JL2 | ELM.............Q...... | 13466 |
| 18182-E2 | VL3\|3h/JL2 | EL.............Q...... | 13467 |
| 18182-E3 | VL3\|3h/JL2 | EL.............Q...... | 13468 |
| 18182-E8 | VL3\|3h/JL2 | EL......A.......Q...... | 13469 |
| 18182-E11 | VL3\|3h/JL2 | ELM.....H.......Q...... | 13470 |
| 18182-F1 | VL3\|3h/JL2 | EL....S.........Q...... | 13471 |
| 18182-F6 | VL3\|3h/JL2 | ELA.............Q...... | 13472 |
| 18182-F8 | VL3\|3h/JL2 | EL.............Q...... | 13473 |
| 18182-G3 | VL3\|3h/JL2 | EL.............Q...... | 13474 |
| 18182-G4 | VL3\|3h/JL2 | EL.............Q...... | 13475 |
| 18182-G5 | VL3\|3h/JL2 | EL......A.......Q...... | 13476 |
| 18182-G9 | VL3\|3h/JL2 | ELA.....A.A.....Q....S. | 13477 |
| 18182-G11 | VL3\|3h/JL2 | EL.............Q...... | 13478 |
| 18182-H5 | VL3\|3h/JL2 | EL.V..E.........Q...... | 13479 |
| 18093-B11 | VL3\|3h/JL2 | EL.............Q...... | 13480 |
| 18182-B5 | VL3\|3h/JL2 | EL.............Q...... | 13481 |
| 18182-H9 | VL3\|3h/JL2 | EL.............Q...... | 13482 |
| 18182-E6 | VL3\|3h/JL2 | EL......S.......Q...... | 13483 |
| 18182-G6 | VL3\|3h/JL2 | EL.............Q...... | 13484 |
| 18182-G2 | VL3\|3h/JL2 | EL.............Q...... | 13485 |
| 18182-H12 | VL3\|3h/JL2 | ELM.....H.......Q...... | 13486 |
| 18182-G8 | VL3\|3h/JL2 | EL.............Q...... | 13487 |
| 18182-E10 | VL3\|3h/JL2 | ELA.....A.A.....Q...... | 13488 |
| 18182-B12 | VL3\|3h/JL2 | EL.............Q...... | 13489 |
| 18182-E5 | VL3\|3h/JL2 | EL.............Q...... | 13490 |
| 18182-A4 | VL3\|3h/JL2 | EL.............Q...... | 13491 |
| 18182-E1 | VL3\|3h/JL2 | EL.............Q...... | 13492 |
| 18403-F12-AS | VL3\|3h/JL2 | ...............Q...... | 13493 |
| 18403-G10-AS | VL3\|3h/JL2 | ...............Q...... | 13494 |

TABLE 62-continued

| LAMBDA_VARIABLE | | | |
|---|---|---|---|
| | Germline | | SEQ ID NO: |
| 03-F3-88-B3-F9final | VL3\|3h/JL2 | ................Q...... | 13495 |
| 18398-C7_final | VL3\|3h/JL2 | ................Q...... | 13496 |
| 18403-E11_AS_final | VL3\|3h/JL2 | ................Q...... | 13497 |
| 18403-F12_final | VL3\|3h/JL2 | ................Q...... | 13498 |
| 18403-F12-AS_final | VL3\|3h/JL2 | ................Q...... | 13499 |
| 18403-G10_final | VL3\|3h/JL2 | ................Q...... | 13500 |
| 18403-G10-AS_final | VL3\|3h/JL2 | ................Q...... | 13501 |
| 18410-G10_final | VL3\|3h/JL2 | ................Q...... | 13502 |
| 18410-G10_AS_final | VL3\|3h/JL2 | ................Q...... | 13503 |
| VL3\|3h/JL3b | | SYVLTQP-PSVSVAPGKTARITC | 13504 |
| 18403-D8_final | VL3\|3h/JL3b | ................Q...... | 13505 |
| 18403-D8_AS_final | VL3\|3h/JL3b | ................Q...... | 13506 |
| | | L_CDR1 | |
| VL2\|2a2/JL2 | | TGTS-SDVGGY----NYVS | 13892 |
| 18071-B1 | VL2\|2a2/JL2 | | 13893 |
| VL1\|1g/JL2 | | SGSS-SNIGS-----NYVY | 13894 |
| 18072-G9 | VL1\|1g/JL2 | | 13895 |
| VL10\|10a/JL3b | | TGNS-NNVGN-----QGAA | 13896 |
| 18078-H6 | VL10\|10a/JL3b | ................... | 13897 |
| 18079-C8 | VL10\|10a/JL3b | ................... | 13898 |
| VL2\|2c/JL2 | | TGTS-SDVGGY----NYVS | 13899 |
| 18082-F5 | VL2\|2c/JL2 | ................... | 13900 |
| VL10\|10a/JL2 | | TGNS-NNVGN-----QGAA | 13901 |
| 18090-H9 | VL10\|10a/JL2 | ................... | 13902 |
| VL3\|3h/JL2 | | GGN---NIGS------KSVH | 13903 |
| 18182-A3 | VL3\|3h/JL2 | ................... | 13904 |
| 18182-A5 | VL3\|3h/JL2 | .................Q | 13905 |
| 18182-A6 | VL3\|3h/JL2 | ................... | 13906 |
| 18182-A7 | VL3\|3h/JL2 | ................... | 13907 |
| 18182-A8 | VL3\|3h/JL2 | ................... | 13908 |
| 18182-A11 | VL3\|3h/JL2 | ................... | 13909 |
| 18182-B1 | VL3\|3h/JL2 | ................... | 13910 |
| 18182-B4 | VL3\|3h/JL2 | ................... | 13911 |
| 18182-B6 | VL3\|3h/JL2 | ................... | 13912 |
| 18182-B7 | VL3\|3h/JL2 | .................Q | 13913 |
| 18182-B10 | VL3\|3h/JL2 | ................... | 13914 |
| 18182-C2 | VL3\|3h/JL2 | .................Q | 13915 |
| 18182-C3 | VL3\|3h/JL2 | ................... | 13916 |

TABLE 62-continued

| | LAMBDA_VARIABLE | | |
|---|---|---|---|
| | Germline | | SEQ ID NO: |
| 18182-C4 | VL3\|3h/JL2 | .................... | 13917 |
| 18182-C5 | VL3\|3h/JL2 | .................... | 13918 |
| 18182-C10 | VL3\|3h/JL2 | .................... | 13919 |
| 18182-C12 | VL3\|3h/JL2 | .................... | 13920 |
| 18182-D4 | VL3\|3h/JL2 | .................... | 13921 |
| 18182-D8 | VL3\|3h/JL2 | .................... | 13922 |
| 18182-D9 | VL3\|3h/JL2 | .................... | 13923 |
| 18182-D11 | VL3\|3h/JL2 | .................... | 13924 |
| 18182-E2 | VL3\|3h/JL2 | .................... | 13925 |
| 18182-E3 | VL3\|3h/JL2 | .................... | 13926 |
| 18182-E8 | VL3\|3h/JL2 | .................... | 13927 |
| 18182-E11 | VL3\|3h/JL2 | .................... | 13928 |
| 18182-F1 | VL3\|3h/JL2 | .................... | 13929 |
| 18182-F6 | VL3\|3h/JL2 | .................... | 13930 |
| 18182-F8 | VL3\|3h/JL2 | .................... | 13931 |
| 18182-G3 | VL3\|3h/JL2 | .................... | 13932 |
| 18182-G4 | VL3\|3h/JL2 | .................... | 13933 |
| 18182-G5 | VL3\|3h/JL2 | .................... | 13934 |
| 18182-G9 | VL3\|3h/JL2 | ...............G.Q | 13935 |
| 18182-G11 | VL3\|3h/JL2 | ...................Q | 13936 |
| 18182-H5 | VL3\|3h/JL2 | .................... | 13937 |
| 18093-B11 | VL3\|3h/JL2 | .................... | 13938 |
| 18182-B5 | VL3\|3h/JL2 | .................... | 13939 |
| 18182-H9 | VL3\|3h/JL2 | .................... | 13940 |
| 18182-E6 | VL3\|3h/JL2 | .................... | 13941 |
| 18182-G6 | VL3\|3h/JL2 | .................... | 13942 |
| 18182-G2 | VL3\|3h/JL2 | .................... | 13943 |
| 18182-H12 | VL3\|3h/JL2 | .................... | 13944 |
| 18182-G8 | VL3\|3h/JL2 | .................... | 13945 |
| 18182-E10 | VL3\|3h/JL2 | .................... | 13946 |
| 18182-B12 | VL3\|3h/JL2 | .................... | 13947 |
| 18182-E5 | VL3\|3h/JL2 | .................... | 13948 |
| 18182-A4 | VL3\|3h/JL2 | .................... | 13949 |
| 18182-E1 | VL3\|3h/JL2 | .................... | 13950 |
| 18403-F12-AS | VL3\|3h/JL2 | .................... | 13951 |
| 18403-G10-AS | VL3\|3h/JL2 | .................... | 13952 |
| 03-F3-88-B3-F9final | VL3\|3h/JL2 | .................... | 13953 |
| 18398-C7_final | VL3\|3h/JL2 | .................... | 13954 |

TABLE 62-continued

LAMBDA_VARIABLE

| | Germline | | SEQ ID NO: |
|---|---|---|---|
| 18403-E11_AS_final | VL3\|3h/JL2 | .................... | 13955 |
| 18403-F12_final | VL3\|3h/JL2 | .................... | 13956 |
| 18403-F12-AS_final | VL3\|3h/JL2 | .................... | 13957 |
| 18403-G10_final | VL3\|3h/JL2 | .................... | 13958 |
| 18403-G10-AS_final | VL3\|3h/JL2 | .................... | 13959 |
| 18410-G10_final | VL3\|3h/JL2 | .................... | 13960 |
| 18410-G10_AS_final | VL3\|3h/JL2 | .................... | 13961 |
| VL3\|3h/JL3b | | GGN---NIGS------KSVH | 13962 |
| 18403-D8_final | VL3\|3h/JL3b | .................... | 13963 |
| 18403-D8_AS_final | VL3\|3h/JL3b | .................... | 13964 |

L_FR2

| | Germline | | SEQ ID NO: |
|---|---|---|---|
| VL2\|2a2/JL2 | | WYQQHPGKAPKLMIY | 14350 |
| 18071-B1 | VL2\|2a2/JL2 | ............... | 14351 |
| VL1\|1g/JL2 | | WYQQLPGTAPKLLIY | 14352 |
| 18072-G9 | VL1\|1g/JL2 | ...H........... | 14353 |
| VL10\|10a/JL3b | | WLQQHQGHPPKLLSY | 14354 |
| 18078-H6 | VL10\|10a/JL3b | ............... | 14355 |
| 18079-C8 | VL10\|10a/JL3b | ............... | 14356 |
| VL2\|2c/JL2 | | WYQQHPGKAPKLMIY | 14357 |
| 18082-F5 | VL2\|2c/JL2 | ............... | 14358 |
| VL10\|10a/JL2 | | WLQQHQGHPPKLLSY | 14359 |
| 18090-H9 | VL10\|10a/JL2 | ............... | 14360 |
| VL3\|3h/JL2 | | WYQQKPGQAPVLVIY | 14361 |
| 18182-A3 | VL3\|3h/JL2 | .............V. | 14362 |
| 18182-A5 | VL3\|3h/JL2 | .............V. | 14363 |
| 18182-A6 | VL3\|3h/JL2 | ...........M.V. | 14364 |
| 18182-A7 | VL3\|3h/JL2 | .H.........M.V. | 14365 |
| 18182-A8 | VL3\|3h/JL2 | .............V. | 14366 |
| 18182-A11 | VL3\|3h/JL2 | .............V. | 14367 |
| 18182-B1 | VL3\|3h/JL2 | .............V. | 14368 |
| 18182-B4 | VL3\|3h/JL2 | ...........M.V. | 14369 |
| 18182-B6 | VL3\|3h/JL2 | .............V. | 14370 |
| 18182-B7 | VL3\|3h/JL2 | .............V. | 14371 |
| 18182-B10 | VL3\|3h/JL2 | ...........M.V. | 14372 |
| 18182-C2 | VL3\|3h/JL2 | .............V. | 14373 |
| 18182-C3 | VL3\|3h/JL2 | ...........M.V. | 14374 |
| 18182-C4 | VL3\|3h/JL2 | ...........M.V. | 14375 |
| 18182-C5 | VL3\|3h/JL2 | .............V. | 14376 |

TABLE 62-continued

| | LAMBDA_VARIABLE | | |
|---|---|---|---|
| | Germline | | SEQ ID NO: |
| 18182-C10 | VL3\|3h/JL2 | ............V. | 14377 |
| 18182-C12 | VL3\|3h/JL2 | ..........M.V. | 14378 |
| 18182-D4 | VL3\|3h/JL2 | ............V. | 14379 |
| 18182-D8 | VL3\|3h/JL2 | ........S..M.V. | 14380 |
| 18182-D9 | VL3\|3h/JL2 | ..........M.V. | 14381 |
| 18182-D11 | VL3\|3h/JL2 | ............V. | 14382 |
| 18182-E2 | VL3\|3h/JL2 | ..........M.V. | 14383 |
| 18182-E3 | VL3\|3h/JL2 | ............V. | 14384 |
| 18182-E8 | VL3\|3h/JL2 | ............V. | 14385 |
| 18182-E11 | VL3\|3h/JL2 | ..........M.V. | 14386 |
| 18182-F1 | VL3\|3h/JL2 | ............V. | 14387 |
| 18182-F6 | VL3\|3h/JL2 | ............V. | 14388 |
| 18182-F8 | VL3\|3h/JL2 | ..........M.V. | 14389 |
| 18182-G3 | VL3\|3h/JL2 | .H..........V. | 14390 |
| 18182-G4 | VL3\|3h/JL2 | ............V. | 14391 |
| 18182-G5 | VL3\|3h/JL2 | ..........M.V. | 14392 |
| 18182-G9 | VL3\|3h/JL2 | ............V. | 14393 |
| 18182-G11 | VL3\|3h/JL2 | ............V. | 14394 |
| 18182-H5 | VL3\|3h/JL2 | .H..........V. | 14395 |
| 18093-B11 | VL3\|3h/JL2 | ............V. | 14396 |
| 18182-B5 | VL3\|3h/JL2 | ............V. | 14397 |
| 18182-H9 | VL3\|3h/JL2 | .H..........V. | 14398 |
| 18182-E6 | VL3\|3h/JL2 | ............V. | 14399 |
| 18182-G6 | VL3\|3h/JL2 | .H......S...... | 14400 |
| 18182-G2 | VL3\|3h/JL2 | ..........M.V. | 14401 |
| 18182-H12 | VL3\|3h/JL2 | ............V. | 14402 |
| 18182-G8 | VL3\|3h/JL2 | ..........M.V. | 14403 |
| 18182-E10 | VL3\|3h/JL2 | .H..........V. | 14404 |
| 18182-B12 | VL3\|3h/JL2 | .H..........V. | 14405 |
| 18182-E5 | VL3\|3h/JL2 | .H..........V. | 14406 |
| 18182-A4 | VL3\|3h/JL2 | ............V. | 14407 |
| 18182-E1 | VL3\|3h/JL2 | ..........M.V. | 14408 |
| 18403-F12-AS | VL3\|3h/JL2 | ..........M.V. | 14409 |
| 18403-G10-AS | VL3\|3h/JL2 | ..........M.V. | 14410 |
| 03-F3-88-B3-F9final | VL3\|3h/JL2 | ............V. | 14411 |
| 18398-C7_final | VL3\|3h/JL2 | ..........M.V. | 14412 |
| 18403-E11_AS_final | VL3\|3h/JL2 | ..........M.V. | 14413 |
| 18403-F12_final | VL3\|3h/JL2 | ..........M.V. | 14414 |

TABLE 62-continued

LAMBDA_VARIABLE

| | Germline | | SEQ ID NO: |
|---|---|---|---|
| 18403-F12-AS_final | VL3\|3h/JL2 | ..........M.V. | 14415 |
| 18403-G10_final | VL3\|3h/JL2 | ..........M.V. | 14416 |
| 18403-G10-AS_final | VL3\|3h/JL2 | ..........M.V. | 14417 |
| 18410-G10_final | VL3\|3h/JL2 | ..........M.V. | 14418 |
| 18410-G10_AS_final | VL3\|3h/JL2 | ..........M.V. | 14419 |
| VL3\|3h/JL3b | | WYQQKPGQAPVIVIY | 14420 |
| 18403-D8_final | VL3\|3h/JL3b | ..........M.V. | 14421 |
| 18403-D8_AS_final | VL3\|3h/JL3b | ..........M.V. | 14422 |
| | | L_CDR2 | |
| VL2\|2a2/JL2 | | E--------VSNRPS | 14808 |
| 18071-B1 | VL2\|2a2/JL2 | ..........K... | 14809 |
| VL1\|1g/JL2 | | R--------NNQRPS | 14810 |
| 18072-G9 | VL1\|1g/JL2 | | 14811 |
| VL10\|10a/JL3b | | R--------NNNRPS | 14812 |
| 18078-H6 | VL10\|10a/JL3b | | 14813 |
| 18079-C8 | VL10\|10a/JL3b | | 14814 |
| VL2\|2c/JL2 | | E--------VSKRPS | 14815 |
| 18082-F5 | VL2\|2c/JL2 | | 14816 |
| VL10\|10a/JL2 | | R--------NNNRPS | 14817 |
| 18090-H9 | VL10\|10a/JL2 | | 14818 |
| VL3\|3h/JL2 | | Y--------DSDRPS | 14819 |
| 18182-A3 | VL3\|3h/JL2 | D.........N.... | 14820 |
| 18182-A5 | VL3\|3h/JL2 | D.........N.... | 14821 |
| 18182-A6 | VL3\|3h/JL2 | D.........N.... | 14822 |
| 18182-A7 | VL3\|3h/JL2 | D.........N.... | 14823 |
| 18182-A8 | VL3\|3h/JL2 | D.........N.... | 14824 |
| 18182-A11 | VL3\|3h/JL2 | D.........N.... | 14825 |
| 18182-B1 | VL3\|3h/JL2 | D.........N.... | 14826 |
| 18182-B4 | VL3\|3h/JL2 | D.........N.... | 14827 |
| 18182-B6 | VL3\|3h/JL2 | D.........N.... | 14828 |
| 18182-B7 | VL3\|3h/JL2 | D.........N.... | 14829 |
| 18182-B10 | VL3\|3h/JL2 | D.........N.... | 14830 |
| 18182-C2 | VL3\|3h/JL2 | D.........N.... | 14831 |
| 18182-C3 | VL3\|3h/JL2 | D.........N.... | 14832 |
| 18182-C4 | VL3\|3h/JL2 | D.........N.... | 14833 |
| 18182-C5 | VL3\|3h/JL2 | D.........N.... | 14834 |
| 18182-C10 | VL3\|3h/JL2 | D.........N.... | 14835 |
| 18182-C12 | VL3\|3h/JL2 | D.........N.... | 14836 |

TABLE 62-continued

LAMBDA_VARIABLE

| | Germline | | SEQ ID NO: |
|---|---|---|---|
| 18182-D4 | VL3\|3h/JL2 | D........N.... | 14837 |
| 18182-D8 | VL3\|3h/JL2 | D........N.... | 14838 |
| 18182-D9 | VL3\|3h/JL2 | D........N.... | 14839 |
| 18182-D11 | VL3\|3h/JL2 | D........N.... | 14840 |
| 18182-E2 | VL3\|3h/JL2 | D........N.... | 14841 |
| 18182-E3 | VL3\|3h/JL2 | D........N.... | 14842 |
| 18182-E8 | VL3\|3h/JL2 | D........N.... | 14843 |
| 18182-E11 | VL3\|3h/JL2 | D........N.... | 14844 |
| 18182-F1 | VL3\|3h/JL2 | D........N.... | 14845 |
| 18182-F6 | VL3\|3h/JL2 | D........N.... | 14846 |
| 18182-F8 | VL3\|3h/JL2 | D........N.... | 14847 |
| 18182-G3 | VL3\|3h/JL2 | D........N.... | 14848 |
| 18182-G4 | VL3\|3h/JL2 | D........N.... | 14849 |
| 18182-G5 | VL3\|3h/JL2 | D........N.... | 14850 |
| 18182-G9 | VL3\|3h/JL2 | D........N.... | 14851 |
| 18182-G11 | VL3\|3h/JL2 | D........N.... | 14852 |
| 18182-H5 | VL3\|3h/JL2 | D........N.... | 14853 |
| 18093-B11 | VL3\|3h/JL2 | D............. | 14854 |
| 18182-B5 | VL3\|3h/JL2 | D........N.... | 14855 |
| 18182-H9 | VL3\|3h/JL2 | D........N.... | 14856 |
| 18182-E6 | VL3\|3h/JL2 | D........N.... | 14857 |
| 18182-G6 | VL3\|3h/JL2 | D........N.... | 14858 |
| 18182-G2 | VL3\|3h/JL2 | D........N.... | 14859 |
| 18182-H12 | VL3\|3h/JL2 | D........N.... | 14860 |
| 18182-G8 | VL3\|3h/JL2 | D........N.... | 14861 |
| 18182-E10 | VL3\|3h/JL2 | D........N.... | 14862 |
| 18182-B12 | VL3\|3h/JL2 | D........N.... | 14863 |
| 18182-E5 | VL3\|3h/JL2 | D........N.... | 14864 |
| 18182-A4 | VL3\|3h/JL2 | D........N.... | 14865 |
| 18182-E1 | VL3\|3h/JL2 | D........N.... | 14866 |
| 18403-F12-AS | VL3\|3h/JL2 | D........N.... | 14867 |
| 18403-G10-AS | VL3\|3h/JL2 | D........N.... | 14868 |
| 03-F3-88-B3-F9final | VL3\|3h/JL2 | D........A.... | 14869 |
| 18398-C7_final | VL3\|3h/JL2 | D........N.... | 14870 |
| 18403-E11_AS_final | VL3\|3h/JL2 | D........N.... | 14871 |
| 18403-F12_final | VL3\|3h/JL2 | D........N.... | 14872 |
| 18403-F12-AS_final | VL3\|3h/JL2 | D........N.... | 14873 |
| 18403-G10_final | VL3\|3h/JL2 | D........N.... | 14874 |

TABLE 62-continued

LAMBDA_VARIABLE

| | Germline | | SEQ ID NO: |
|---|---|---|---|
| 18403-G10-AS_final | VL3\|3h/JL2 | D.........N.... | 14875 |
| 18410-G10_final | VL3\|3h/JL2 | D.........N.... | 14876 |
| 18410-G10_AS_final | VL3\|3h/JL2 | D.........N.... | 14877 |
| VL3\|3h/JL3b | | Y--------DSDRPS | 14878 |
| 18403-D8_final | VL3\|3h/JL3b | D.........N.... | 14879 |
| 18403-D8_AS_final | VL3\|3h/JL3b | D.........N.... | 14880 |

L_FR3

| | Germline | | SEQ ID NO: |
|---|---|---|---|
| VL2\|2a2/JL2 | | GVSNRFSGSKSG--NTASLTISGLQAEDEADYYC | 15266 |
| 18071-B1 | VL2\|2a2/JL2 | .................................. | 15267 |
| VL1\|1g/JL2 | | GVPDRFSGSKSG--TSASLAISGLRSEDEADYYC | 15268 |
| 18072-G9 | VL1\|1g/JL2 | .................................. | 15269 |
| VL10\|10a/JL3b | | GISERLSASRSG--NTASLTITGLQPEDEADYYC | 15270 |
| 18078-H6 | VL10\|10a/JL3b | .................................. | 15271 |
| 18079-C8 | VL10\|10a/JL3b | .................................. | 15272 |
| VL2\|2c/JL2 | | GVPDRFSGSKSG--NTASLTVSGLQAEDEADYYC | 15273 |
| 18082-F5 | VL2\|2c/JL2 | .................................. | 15274 |
| VL10\|10a/JL2 | | GISERLSASRSG--NTASLTITGLQPEDEADYYC | 15275 |
| 18090-H9 | VL10\|10a/JL2 | .................................. | 15276 |
| VL3\|3h/JL2 | | GIPERFSGSNSG--NTATLTISRVEAGDEADYYC | 15277 |
| 18182-A3 | VL3\|3h/JL2 | ..........F........I............. | 15278 |
| 18182-A5 | VL3\|3h/JL2 | ................................F | 15279 |
| 18182-A6 | VL3\|3h/JL2 | ................................. | 15280 |
| 18182-A7 | VL3\|3h/JL2 | .................................H. | 15281 |
| 18182-A8 | VL3\|3h/JL2 | ................................F | 15282 |
| 18182-A11 | VL3\|3h/JL2 | ..........F...................... | 15283 |
| 18182-B1 | VL3\|3h/JL2 | ..........F........I............. | 15284 |
| 18182-B4 | VL3\|3h/JL2 | ................................. | 15285 |
| 18182-B6 | VL3\|3h/JL2 | ..........F...................... | 15286 |

TABLE 62-continued

| | LAMBDA_VARIABLE | | |
|---|---|---|---|
| | Germline | | SEQ ID NO: |
| 18182-B7 | VL3\|3h/JL2 | ...............................F<br>.. | 15287 |
| 18182-B10 | VL3\|3h/JL2 | ...............................<br>.. | 15288 |
| 18182-C2 | VL3\|3h/JL2 | ..........F........I...........F<br>.. | 15289 |
| 18182-C3 | VL3\|3h/JL2 | ...............................<br>.. | 15290 |
| 18182-C4 | VL3\|3h/JL2 | ...............................<br>.. | 15291 |
| 18182-C5 | VL3\|3h/JL2 | ...............................<br>.. | 15292 |
| 18182-C10 | VL3\|3h/JL2 | ..........F........I...........<br>.. | 15293 |
| 18182-C12 | VL3\|3h/JL2 | ...................I...........<br>.. | 15294 |
| 18182-D4 | VL3\|3h/JL2 | ..........F........I...........<br>.. | 15295 |
| 18182-D8 | VL3\|3h/JL2 | ...............................<br>H. | 15296 |
| 18182-D9 | VL3\|3h/JL2 | ..........F........I...........<br>.. | 15297 |
| 18182-D11 | VL3\|3h/JL2 | ...............................<br>.. | 15298 |
| 18182-E2 | VL3\|3h/JL2 | ...............................<br>H. | 15299 |
| 18182-E3 | VL3\|3h/JL2 | ..........F........I...........<br>.. | 15300 |
| 18182-E8 | VL3\|3h/JL2 | ..........F........I...........<br>.. | 15301 |
| 18182-E11 | VL3\|3h/JL2 | ...............................<br>.. | 15302 |
| 18182-F1 | VL3\|3h/JL2 | ..........F........I...........<br>.. | 15303 |
| 18182-F6 | VL3\|3h/JL2 | ...............................<br>.. | 15304 |
| 18182-F8 | VL3\|3h/JL2 | ..........F........I...........<br>.. | 15305 |
| 18182-G3 | VL3\|3h/JL2 | ..........F........I...........<br>.. | 15306 |
| 18182-G4 | VL3\|3h/JL2 | ..........F........I...........<br>.. | 15307 |
| 18182-G5 | VL3\|3h/JL2 | ..........F........I...........<br>.. | 15308 |
| 18182-G9 | VL3\|3h/JL2 | ..........F........I...........<br>.. | 15309 |
| 18182-G11 | VL3\|3h/JL2 | ..........F........I...........<br>.. | 15310 |
| 18182-H5 | VL3\|3h/JL2 | ...............................F<br>.. | 15311 |

TABLE 62-continued

| | | LAMBDA_VARIABLE | |
|---|---|---|---|
| | Germline | | SEQ ID NO: |
| 18093-B11 | VL3\|3h/JL2 | ................................15312<br>.. | |
| 18182-B5 | VL3\|3h/JL2 | ..........F........I............15313<br>.. | |
| 18182-H9 | VL3\|3h/JL2 | ...............................F 15314<br>.. | |
| 18182-E6 | VL3\|3h/JL2 | ..........F........I....A........15315<br>.. | |
| 18182-G6 | VL3\|3h/JL2 | ........F......................15316<br>.. | |
| 18182-G2 | VL3\|3h/JL2 | ................................15317<br>.. | |
| 18182-H12 | VL3\|3h/JL2 | ..........F........I............15318<br>.. | |
| 18182-G8 | VL3\|3h/JL2 | ................................15319<br>.. | |
| 18182-E10 | VL3\|3h/JL2 | ...............................F 15320<br>.. | |
| 18182-B12 | VL3\|3h/JL2 | ................................15321<br>.. | |
| 18182-E5 | VL3\|3h/JL2 | ................................15322<br>.. | |
| 18182-A4 | VL3\|3h/JL2 | ..........F........I....A........15323<br>.. | |
| 18182-E1 | VL3\|3h/JL2 | ................................15324<br>.. | |
| 18403-F12-AS | VL3\|3h/JL2 | ..........F........I....A........15325<br>.. | |
| 18403-G10-AS | VL3\|3h/JL2 | ................................15326<br>.. | |
| 03-F3-88-B3-F9_final | VL3\|3h/JL2 | ................................15327<br>.. | |
| 18398-C7_final | VL3\|3h/JL2 | ................................15328<br>.. | |
| 18403-E11_AS_final | VL3\|3h/JL2 | ................................15329<br>.. | |
| 18403-F12_final | VL3\|3h/JL2 | ..........F........I....A........15330<br>.. | |
| 18403-F12-AS_final | VL3\|3h/JL2 | ..........F........I....A........15331<br>.. | |
| 18403-G10_final | VL3\|3h/JL2 | ................................15332<br>.. | |
| 18403-G10-AS_final | VL3\|3h/JL2 | ................................15333<br>.. | |
| 18410-G10_final | VL3\|3h/JL2 | ................................15334<br>.. | |
| 18410-G10_AS_final | VL3\|3h/JL2 | ................................15335<br>.. | |
| VL3\|3h/JL3b | | GIPERFSGSNSG--<br>NTATLTISRVEAGDEADYYC | 15336 |

TABLE 62-continued

LAMBDA_VARIABLE

| | Germline | | SEQ ID NO: |
|---|---|---|---|
| 18403-D8_final | VL3\|3h/JL3b | ..........F........I............ .. | 15337 |
| 18403-D8_AS_final | VL3\|3h/JL3b | ..........F........I............ .. | 15338 |
| | | L_CDR3 | |
| VL2\|2a2/JL2 | | SSYTSS--------------------STLVV | 15724 |
| 18071-B1 | VL2\|2a2/JL2 | .....-....................STL. | 15725 |
| VL1\|1g/JL2 | | AAWDDS--------------------LSGVV | 15726 |
| 18072-G9 | VL1\|1g/JL2 | ................................ .. | 15727 |
| VL10\|10a/JL3b | | SAWDSS--------------------LSAWV | 15728 |
| 18078-H6 | VL10\|10a/JL3b | ................................ .. | 15729 |
| 18079-C8 | VL10\|10a/JL3b | ................................ .. | 15730 |
| VL2\|2c/JL2 | | SSYAGS--------------------NNFVV | 15731 |
| 18082-F5 | VL2\|2c/JL2 | .....-....................S.N.. | 15732 |
| VL10\|10a/JL2 | | SAWDSS--------------------LSAVV | 15733 |
| 18090-H9 | VL10\|10a/JL2 | ................................ .. | 15734 |
| VL3\|3h/JL2 | | QVWDSS--------------------SDHVV | 15735 |
| 18182-A3 | VL3\|3h/JL2 | ................................ .. | 15736 |
| 18182-A5 | VL3\|3h/JL2 | ................................ .. | 15737 |
| 18182-A6 | VL3\|3h/JL2 | ................................ .. | 15738 |
| 18182-A7 | VL3\|3h/JL2 | ................................ .. | 15739 |
| 18182-A8 | VL3\|3h/JL2 | ................................ .. | 15740 |
| 18182-A11 | VL3\|3h/JL2 | ................................ .. | 15741 |
| 18182-B1 | VL3\|3h/JL2 | ................................ .. | 15742 |
| 18182-B4 | VL3\|3h/JL2 | ................................ .. | 15743 |
| 18182-B6 | VL3\|3h/JL2 | ................................ .. | 15744 |
| 18182-B7 | VL3\|3h/JL2 | ................................ .. | 15745 |

TABLE 62-continued

LAMBDA_VARIABLE

| | Germline | | SEQ ID NO: |
|---|---|---|---|
| 18182-B10 | VL3\|3h/JL2 | ............................<br>.. | 15746 |
| 18182-C2 | VL3\|3h/JL2 | ............................<br>.. | 15747 |
| 18182-C3 | VL3\|3h/JL2 | ............................<br>A. | 15748 |
| 18182-C4 | VL3\|3h/JL2 | ............................<br>.. | 15749 |
| 18182-C5 | VL3\|3h/JL2 | ............................<br>.. | 15750 |
| 18182-C10 | VL3\|3h/JL2 | ............................<br>.. | 15751 |
| 18182-C12 | VL3\|3h/JL2 | ............................<br>.. | 15752 |
| 18182-D4 | VL3\|3h/JL2 | ............................<br>.. | 15753 |
| 18182-D8 | VL3\|3h/JL2 | ............................<br>.I | 15754 |
| 18182-D9 | VL3\|3h/JL2 | .....N......................<br>.. | 15755 |
| 18182-D11 | VL3\|3h/JL2 | ............................<br>.I | 15756 |
| 18182-E2 | VL3\|3h/JL2 | ............................<br>.. | 15757 |
| 18182-E3 | VL3\|3h/JL2 | ............................<br>.. | 15758 |
| 18182-E8 | VL3\|3h/JL2 | ............................<br>.. | 15759 |
| 18182-E11 | VL3\|3h/JL2 | ............................<br>.. | 15760 |
| 18182-F1 | VL3\|3h/JL2 | ............................<br>.. | 15761 |
| 18182-F6 | VL3\|3h/JL2 | ............................<br>.M | 15762 |
| 18182-F8 | VL3\|3h/JL2 | ............................<br>.. | 15763 |
| 18182-G3 | VL3\|3h/JL2 | ............................<br>.. | 15764 |
| 18182-G4 | VL3\|3h/JL2 | ............................<br>.. | 15765 |
| 18182-G5 | VL3\|3h/JL2 | ............................<br>.. | 15766 |
| 18182-G9 | VL3\|3h/JL2 | ............................<br>.. | 15767 |
| 18182-G11 | VL3\|3h/JL2 | ............................<br>.. | 15768 |
| 18182-H5 | VL3\|3h/JL2 | ............................<br>.. | 15769 |
| 18093-B11 | VL3\|3h/JL2 | ........................SDH.<br>.. | 15770 |

TABLE 62-continued

| | LAMBDA_VARIABLE | | |
|---|---|---|---|
| | Germline | | SEQ ID NO: |
| 18182-B5 | VL3\|3h/JL2 | ................................ | 15771 |
| 18182-H9 | VL3\|3h/JL2 | ................................ | 15772 |
| 18182-E6 | VL3\|3h/JL2 | ................................ | 15773 |
| 18182-G6 | VL3\|3h/JL2 | ................................ | 15774 |
| 18182-G2 | VL3\|3h/JL2 | .............................I | 15775 |
| 18182-H12 | VL3\|3h/JL2 | ................................ | 15776 |
| 18182-G8 | VL3\|3h/JL2 | ................................ | 15777 |
| 18182-E10 | VL3\|3h/JL2 | ................................ | 15778 |
| 18182-B12 | VL3\|3h/JL2 | ....Y........................... | 15779 |
| 18182-E5 | VL3\|3h/JL2 | ....Y........................... | 15780 |
| 18182-A4 | VL3\|3h/JL2 | ................................ | 15781 |
| 18182-E1 | VL3\|3h/JL2 | ................................ | 15782 |
| 18403-F12-AS | VL3\|3h/JL2 | ....YR..................YLSQ. | 15783 |
| 18403-G10-AS | VL3\|3h/JL2 | ....Y...................GQRQ. | 15784 |
| 03-F3-88-B3-F9_finalVL3\|3h/JL2 | | ....A...................AGYG.. | 15785 |
| 18398-C7_final | VL3\|3h/JL2 | ....Y...................PLRH. | 15786 |
| 18403-E11 AS_final | VL3\|3h/JL2 | ....YY..................NRA. | 15787 |
| 18403-F12_final | VL3\|3h/JL2 | ....YR..................YLSQ. | 15788 |
| 18403-F12-AS_final | VL3\|3h/JL2 | ....YR..................YLSQ. | 15789 |
| 18403-G10_final | VL3\|3h/JL2 | ....Y...................GQRQ. | 15790 |
| 18403-G10-AS_final | VL3\|3h/JL2 | ....Y...................GQRQ. | 15791 |
| 18410-G10_final | VL3\|3h/JL2 | ....YV..................APRH. | 15792 |
| 18410-G10_AS_final | VL3\|3h/JL2 | ....YV..APRH. | 15793 |
| VL3\|3h/JL3b | | QVWDSS--------------------SDHWV | 15794 |
| 18403-D8_final | VL3\|3h/JL3b | ....YR..................TLD.. | 15795 |

TABLE 62-continued

LAMBDA_VARIABLE

| | Germline | | SEQ ID NO: |
|---|---|---|---|
| 18403-D8 AS_final | VL3\|3h/JL3b | ....YR....................TLD.. | 15796 |
| | | L_FR4 | |
| VL2\|2a2/JL2 | | FGGGTKLTVL | 16185 |
| 18071-B1 | VL2\|2a2/JL2 | .......... | 16186 |
| VL1\|1g/JL2 | | FGGGTKLTVL | 16187 |
| 18072-G9 | VL1\|1g/JL2 | .......... | 16188 |
| VL10\|10a/JL3b | | FGGGTKLTVL | 16189 |
| 18078-H6 | VL10\|10a/JL3b | .......... | 16190 |
| 18079-C8 | VL10\|10a/JL3b | .......... | 16191 |
| VL2\|2c/JL2 | | FGGGTKLTVL | 16192 |
| 18082-F5 | VL2\|2c/JL2 | .......... | 16193 |
| VL10\|10a/JL2 | | FGGGTKLTVL | 16194 |
| 18090-H9 | VL10\|10a/JL2 | .......... | 16195 |
| VL3\|3h/JL2 | | FGGGTKLTVL | 16196 |
| 18182-A3 | VL3\|3h/JL2 | .......... | 16197 |
| 18182-A5 | VL3\|3h/JL2 | .......... | 16198 |
| 18182-A6 | VL3\|3h/JL2 | .......... | 16199 |
| 18182-A7 | VL3\|3h/JL2 | .......... | 16200 |
| 18182-A8 | VL3\|3h/JL2 | .......... | 16201 |
| 18182-A11 | VL3\|3h/JL2 | .......... | 16202 |
| 18182-B1 | VL3\|3h/JL2 | .......... | 16203 |
| 18182-B4 | VL3\|3h/JL2 | .......... | 16204 |
| 18182-B6 | VL3\|3h/JL2 | .......... | 16205 |
| 18182-B7 | VL3\|3h/JL2 | .......... | 16206 |
| 18182-B10 | VL3\|3h/JL2 | .......... | 16207 |
| 18182-C2 | VL3\|3h/JL2 | .......... | 16208 |
| 18182-C3 | VL3\|3h/JL2 | .......... | 16209 |
| 18182-C4 | VL3\|3h/JL2 | .......... | 16210 |
| 18182-C5 | VL3\|3h/JL2 | .......... | 16211 |
| 18182-C10 | VL3\|3h/JL2 | .......... | 16212 |
| 18182-C12 | VL3\|3h/JL2 | .......... | 16213 |
| 18182-D4 | VL3\|3h/JL2 | .......... | 16214 |
| 18182-D8 | VL3\|3h/JL2 | .......... | 16215 |
| 18182-D9 | VL3\|3h/JL2 | .......... | 16216 |
| 18182-D11 | VL3\|3h/JL2 | .......... | 16217 |
| 18182-E2 | VL3\|3h/JL2 | .......... | 16218 |
| 18182-E3 | VL3\|3h/JL2 | .......... | 16219 |
| 18182-E8 | VL3\|3h/JL2 | .......... | 16220 |

TABLE 62-continued

| LAMBDA_VARIABLE | | | |
|---|---|---|---|
| | Germline | | SEQ ID NO: |
| 18182-E11 | VL3\|3h/JL2 | .......... | 16221 |
| 18182-F1 | VL3\|3h/JL2 | .......... | 16222 |
| 18182-F6 | VL3\|3h/JL2 | .......... | 16223 |
| 18182-F8 | VL3\|3h/JL2 | .......... | 16224 |
| 18182-G3 | VL3\|3h/JL2 | .......... | 16225 |
| 18182-G4 | VL3\|3h/JL2 | .......... | 16226 |
| 18182-G5 | VL3\|3h/JL2 | .......... | 16227 |
| 18182-G9 | VL3\|3h/JL2 | .......... | 16228 |
| 18182-G11 | VL3\|3h/JL2 | .......... | 16229 |
| 18182-H5 | VL3\|3h/JL2 | .......... | 16230 |
| 18093-B11 | VL3\|3h/JL2 | .......... | 16231 |
| 18182-B5 | VL3\|3h/JL2 | .......... | 16232 |
| 18182-H9 | VL3\|3h/JL2 | .......... | 16233 |
| 18182-E6 | VL3\|3h/JL2 | .......... | 16234 |
| 18182-G6 | VL3\|3h/JL2 | .......... | 16235 |
| 18182-G2 | VL3\|3h/JL2 | .......... | 16236 |
| 18182-H12 | VL3\|3h/JL2 | .......... | 16237 |
| 18182-G8 | VL3\|3h/JL2 | .......... | 16238 |
| 18182-E10 | VL3\|3h/JL2 | .......... | 16239 |
| 18182-B12 | VL3\|3h/JL2 | .......... | 16240 |
| 18182-E5 | VL3\|3h/JL2 | .......... | 16241 |
| 18182-A4 | VL3\|3h/JL2 | .......... | 16242 |
| 18182-E1 | VL3\|3h/JL2 | .......... | 16243 |
| 18403-F12-AS | VL3\|3h/JL2 | .......... | 16244 |
| 18403-G10-AS | VL3\|3h/JL2 | .......... | 16245 |
| 03-F3-88-B3-F9_finalVL3\|3h/JL2 | | .......... | 16246 |
| 18398-C7_final | VL3\|3h/JL2 | .......... | 16247 |
| 18403-E11 AS_final | VL3\|3h/JL2 | .......... | 16248 |
| 18403-F12_final | VL3\|3h/JL2 | .......... | 16249 |
| 18403-F12-AS_final | VL3\|3h/JL2 | .......... | 16250 |
| 18403-G10_final | VL3\|3h/JL2 | .......... | 16251 |
| 18403-G10-AS_final | VL3\|3h/JL2 | .......... | 16252 |
| 18410-G10_final | VL3\|3h/JL2 | .......... | 16253 |
| 18410-G10_AS_final | VL3\|3h/JL2 | .......... | 16254 |
| VL3\|3h/JL3b | | FGGGTKLTVL | 16255 |
| 18403-D8_final | VL3\|3h/JL3b | .......... | 16256 |
| 18403-D8 AS_final | VL3\|3h/JL3b | .......... | 16257 |

TABLE 63

| | Germline | H_FR1 | SEQ ID NO: |
|---|---|---|---|
| VH1\|1-f/D2\|2-15\|RF3/JH4 | | EVQLVQS-GAEVKKPGATVKISCKVSG-YTFT | 13507 |
| 17724-C9 | VH1\|1-f/D2\|2-15\|RF3/JH4 | ....LEQS.P.LV....S......A....A.S | 13508 |
| VH1\|1-e/D5\|5-18\|RF3/JH4 | | QVQLVQS-GAEVKKPGSSVKVSCKASG-GTFS | 13509 |
| 17724-G6 | VH1\|1-e/D5\|5-18\|RF3/JH4 | E...LEQS.P.LV...A...I......D.Y.. | 13510 |
| VH1\|1-e/D1\|1-1\|RF2/JH3 | | QVQLVQS-GAEVKKPGSSVKVSCKASG-GTFS | 13511 |
| 17731-H8 | VH1\|1-e/D1\|1-1\|RF2/JH3 | E...LEQS.P.LV...A...I.......YA.. | 13512 |
| VH1\|1-08/D5\|5-18\|RF3/JH6 | | QVQLVQS-GAEVKKPGASVKVSCKASG-YTFT | 13513 |
| 17732-A8 | VH1\|1-08/D5\|5-18\|RF3/JH6 | E...LE.......................... | 13514 |
| 17780-D12 | VH1\|1-08/D5\|5-18\|RF3/JH6 | E...LE.......................... | 13515 |
| VH1\|1-08/D5\|5-12\|RF3/JH6 | | QVQLVQS-GAEVKKPGASVKVSCKASG-YTFT | 13516 |
| 17745-E5 | VH1\|1-08/D5\|5-12\|RF3/JH6 | E...LE.......................... | 13517 |
| 17777-B4 | VH1\|1-08/D5\|5-12\|RF3/JH6 | E...LE.............M............ | 13518 |
| 17814-D9 | VH1\|1-08/D5\|5-12\|RF3/JH6 | E...LE.......................... | 13519 |
| VH4\|4-34/D5\|5-18\|RF3/JH6 | | QVQLQQW-GAGLLKPSETLSLTCAVYG-GSFS | 13520 |
| 17745-E8 | VH4\|4-34/D5\|5-18\|RF3/JH6 | E...LE.......................... | 13521 |
| 17777-C5 | VH4\|4-34/D5\|5-18\|RF3/JH6 | E...LE.......................... | 13522 |
| 17778-C9 | VH4\|4-34/D5\|5-18\|RF3/JH6 | E...LE.......................... | 13523 |
| 17780-E6 | VH4\|4-34/D5\|5-18\|RF3/JH6 | E...LE.......................... | 13524 |
| 17781-B3 | VH4\|4-34/D5\|5-18\|RF3/JH6 | E...LE.......................... | 13525 |
| 17781-H12 | VH4\|4-34/D5\|5-18\|RF3/JH6 | E...LE.......................... | 13526 |
| 17783-C11 | VH4\|4-34/D5\|5-18\|RF3/JH6 | E...LE.......................... | 13527 |
| 17783-G10 | VH4\|4-34/D5\|5-18\|RF3/JH6 | E...LE.......................... | 13528 |
| 17813-E3 | VH4\|4-34/D5\|5-18\|RF3/JH6 | E...LE........................L. | 13529 |
| 17813-F1 | VH4\|4-34/D5\|5-18\|RF3/JH6 | E...LE...................G...... | 13530 |
| VH3\|3-23/D3\|3-9\|RF1/JH4 | | EVQLLES-GGGLVQPGGSLRLSCAASG-FTFS | 13531 |

TABLE 63-continued

HEAVY_VARIABLE

| | Germline | | SEQ ID NO: |
|---|---|---|---|
| 17745-G8 | VH3\|3-23/D3\|3-9\|RF1/JH4 | ................................ | 13532 |
| 17777-C4 | VH3\|3-23/D3\|3-9\|RF1/JH4 | ................................ | 13533 |
| 18072-D6 | VH3\|3-23/D3\|3-9\|RF1/JH4 | ................................ | 13534 |
| 18084-E4 | VH3\|3-23/D3\|3-9\|RF1/JH4 | ................................ | 13535 |
| 18088-B10 | VH3\|3-23/D3\|3-9\|RF1/JH4 | ................................ | 13536 |
| VH3\|3-30.3/D1\|1-1\|RF2/JH6 | | QVQLVES-GGGVVQPGRSLRLSCAASG-FTFS | 13537 |
| 17748-D12 | VH3\|3-30.3/D1\|1-1\|RF2/JH6 | E...L.........................R | 13538 |
| 18079-C8 | VH3\|3-30.3/D1\|1-1\|RF2/JH6 | E...L.......................... | 13539 |
| VH4\|4-34/D5\|5-12\|RF3/JH6 | | QVQLQQW-GAGLLKPSETLSLTCAVYG-GSFS | 13540 |
| 17753-F4 | VH4\|4-34/D5\|5-12\|RF3/JH6 | E...LE......................... | 13541 |
| 17778-F1 | VH4\|4-34/D5\|5-12\|RF3/JH6 | E...LE......................... | 13542 |
| 17778-H8 | VH4\|4-34/D5\|5-12\|RF3/JH6 | E...LE................G........ | 13543 |
| 17779-E1 | VH4\|4-34/D5\|5-12\|RF3/JH6 | E...LE......................... | 13544 |
| 17784-C11 | VH4\|4-34/D5\|5-12\|RF3/JH6 | E...LE......................... | 13545 |
| 17784-H5 | VH4\|4-34/D5\|5-12\|RF3/JH6 | E...LE......................... | 13546 |
| 17785-D12 | VH4\|4-34/D5\|5-12\|RF3/JH6 | E...LE......................... | 13547 |
| 17813-E5 | VH4\|4-34/D5\|5-12\|RF3/JH6 | E...LE......................... | 13548 |
| 18088-E4 | VH4\|4-34/D5\|5-12\|RF3/JH6 | E...LE......................... | 13549 |
| VH3\|3-23/D6\|6-19\|RF1/JH6 | | EVQLLES-GGGLVQPGGSLRLSCAASG-FTFS | 13550 |
| 17771-D2 | VH3\|3-23/D6\|6-19\|RF1/JH6 | ................................ | 13551 |
| 18074-G12 | VH3\|3-23/D6\|6-19\|RF1/JH6 | ................................ | 13552 |
| 18093-E2 | VH3\|3-23/D6\|6-19\|RF1/JH6 | ...............................T | 13553 |
| 18089-B2 | VH3\|3-23/D6\|6-19\|RF1/JH6 | ................................ | 13554 |
| VH3\|3-23/D7\|7-27\|RF1/JH6 | | EVQLLES-GGGLVQPGGSLRLSCAASG-FTFS | 13555 |
| 17779-D11 | VH3\|3-23/D7\|7-27\|RF1/JH6 | ................................ | 13556 |

TABLE 63-continued

| | HEAVY_VARIABLE | |
|---|---|---|
| | Germline | SEQ ID NO: |
| 18089-H12 | VH3\|3-23/D7\|7-27\|RF1/JH6 | ................................13557 |
| 18093-F5 | VH3\|3-23/D7\|7-27\|RF1/JH6 | ..............................L.13558 |
| VH3\|3-23/D5\|5-18\|RF1/JH6 | | EVQLLES-GGGLVQPGGSLRLSCAASG-FTFS  13559 |
| 17784-B9 | VH3\|3-23/D5\|5-18\|RF1/JH6 | ................................13560 |
| 17784-C7 | VH3\|3-23/D5\|5-18\|RF1/JH6 | ................................13561 |
| 18080-H9 | VH3\|3-23/D5\|5-18\|RF1/JH6 | ................................13562 |
| VH4\|4-30.1/D3\|3-10\|RF1/JH6 | | QVQLQES-GPGLVKPSQTLSLTCTVSG-GSIS  13563 |
| 17784-G10 | VH4\|4-30.1/D3\|3-10\|RF1/JH6 | E...L........................D...13564 |
| 18080-C5 | VH4\|4-30.1/D3\|3-10\|RF1/JH6 | E...L............................13565 |
| 18179-A3 | VH4\|4-30.1/D3\|3-10\|RF1/JH6 | E...L........................D...13566 |
| 18179-A9 | VH4\|4-30.1/D3\|3-10\|RF1/JH6 | E...L........................A..13567 |
| 18179-A10 | VH4\|4-30.1/D3\|3-10\|RF1/JH6 | E...L........................A..13568 |
| 18179-C4 | VH4\|4-30.1/D3\|3-10\|RF1/JH6 | E...L........................A..13569 |
| 18179-C6 | VH4\|4-30.1/D3\|3-10\|RF1/JH6 | E...L........................D...13570 |
| 18179-C10 | VH4\|4-30.1/D3\|3-10\|RF1/JH6 | E...L........................D...13571 |
| 18179-F4 | VH4\|4-30.1/D3\|3-10\|RF1/JH6 | E...L........................A..13572 |
| 18179-F6 | VH4\|4-30.1/D3\|3-10\|RF1/JH6 | E...L........................A..13573 |
| 18179-G8 | VH4\|4-30.1/D3\|3-10\|RF1/JH6 | E...L........................D...13574 |
| 18179-G9 | VH4\|4-30.1/D3\|3-10\|RF1/JH6 | E...L........................A..13575 |
| 18179-H6 | VH4\|4-30.1/D3\|3-10\|RF1/JH6 | E...L........................D...13576 |
| 18181-A11 | VH4\|4-30.1/D3\|3-10\|RF1/JH6 | E...L........................D...13577 |
| 18181-C6 | VH4\|4-30.1/D3\|3-10\|RF1/JH6 | E...L........................D...13578 |
| 18181-G10 | VH4\|4-30.1/D3\|3-10\|RF1/JH6 | E...L........................D...13579 |
| 18181-E2 | VH4\|4-30.1/D3\|3-10\|RF1/JH6 | E...L........................D...13580 |
| 18181-C9 | VH4\|4-30.1/D3\|3-10\|RF1/JH6 | E...L........................D...13581 |

TABLE 63-continued

| | HEAVY_VARIABLE | | |
|---|---|---|---|
| | Germline | | SEQ ID NO: |
| VH3\|3-23/D1\|1-1\|RF1/JH6 | | EVQLLES-GGGLVQPGGSLRLSCAASG-FTFS | 13582 |
| 17813-D8 | VH3\|3-23/D1\|1-1\|RF1/JH6 | ............................. | 13583 |
| VH3\|3-33/D3\|3-10\|RF2/JH6 | | QVQLVES-GGGVVQPGRSLRLSCAASG-FTFS | 13584 |
| 18071-B1 | VH3\|3-33/D3\|3-10\|RF2/JH6 | E...L......................... | 13585 |
| 18082-F5 | VH3\|3-33/D3\|3-10\|RF2/JH6 | E...L......................... | 13586 |
| VH1\|1-08/D7\|7-27\|RF3/JH6 | | QVQLVQS-GAEVKKPGASVKVSCKASG-YTET | 13587 |
| 18071-c4 | VH1\|1-08/D7\|7-27\|RF3/JH6 | E...LE........................ | 13588 |
| 18071-D4 | VH1\|1-08/D7\|7-27\|RF3/JH6 | E...LE........................ | 13589 |
| 18079-H4 | VH1\|1-08/D7\|7-27\|RF3/JH6 | E...LE........................ | 13590 |
| 18079-H11 | VH1\|1-08/D7\|7-27\|RF3/JH6 | E...LE........................ | 13591 |
| 18086-H4 | VH1\|1-08/D7\|7-27\|RF3/JH6 | E...LE........................ | 13592 |
| VH3\|3-21/D6\|6-6\|RF2/JH6 | | EVQLVES-GGGLVKPGGSLRLSCAASG-FTFS | 13593 |
| 18072-G9 | VH3\|3-21/D6\|6-6\|RF2/JH6 | ....L......................... | 13594 |
| VH3\|3-30.3/D3\|3-10\|RF2/JH6 | | QVQLVES-GGGVVQPGRSLRLSCAASG-FTFS | 13595 |
| 18078-H6 | VH3\|3-30.3/D3\|3-10\|RF2/JH6 | E...L......................... | 13596 |
| 18090-H9 | VH3\|3-30.3/D3\|3-10\|RF2/JH6 | E...L......................... | 13597 |
| VH4\|4-59/D3\|3-3\|RF3/JH4 | | QVQLQES-GPGLVKPSETLSLTCTVSG-GSIS | 13598 |
| 18081-A6 | VH4\|4-59/D3\|3-3\|RF3/JH4 | E...L...................D... | 13599 |
| 18081-B9 | VH4\|4-59/D3\|3-3\|RF3/JH4 | E...L...................D... | 13600 |
| 18081-E7 | VH4\|4-59/D3\|3-3\|RF3/JH4 | E...L...................D... | 13601 |
| 18081-B9_final | VH4\|4-59/D3\|3-3\|RF3/JH4 | ........................D... | 13602 |
| VH6\|6-01/D3\|3-10\|RF1/JH6 | | QVQLQQS-GPGLVKPSQTLSLTCAISG-DSVS | 13603 |
| 18081-B5 | VH6\|6-01/D3\|3-10\|RF1/JH6 | E...LE.....Q................. | 13604 |
| VH4\|4-b/D3\|3-3\|RF3/JH5 | | QVQLQES-GPGLVKPSETLSLTCAVSG-YSIS | 13605 |
| 18081-C10 | VH4\|4-b/D3\|3-3\|RF3/JH5 | E...L................I....V... | 13606 |

TABLE 63-continued

| | HEAVY_VARIABLE | | |
|---|---|---|---|
| | Germline | | SEQ ID NO: |
| VH2\|2-70/D2\|2-15\|RF1/JH5 | | QVTLKES-GPALVKPTQTLTLTCTFSG-FSLS | 13607 |
| 18081-D6 | VH2\|2-70/D2\|2-15\|RF1/JH5 | E.Q.L.................FT | 13608 |
| 18089-C8 | VH2\|2-70/D2\|2-15\|RF1/JH5 | E.Q.L.........S.S........ | 13609 |
| 18081-H11 | VH2\|2-70/D2\|2-15\|RF1/JH5 | E.Q.L.................FT | 13610 |
| VH3\|3-23/D1\|1-26\|RF1/JH6 | | EVQLLES-GGGLVQPGGSLRLSCAASG-FTFS | 13611 |
| 18081-D12 | VH3\|3-23/D1\|1-26\|RF1/JH6 | ............K........... | 13612 |
| VH4\|4-59/D3\|3-3\|RF3/JH5 | | QVQLQES-GPGLVKPSETLSLTCTVSG-GSIS | 13613 |
| 18089-B8 | VH4\|4-59/D3\|3-3\|RF3/JH5 | E...L............I...... | 13614 |
| VH2\|2-05/D2\|2-15\|RF1/JH5 | | QITLKES-GPTLVKPTQTLTLTCTFSG-FSLS | 13615 |
| 18089-G7 | VH2\|2-05/D2\|2-15\|RF1/JH5 | EVQ.L.....V.............FT | 13616 |
| 18089-D11 | VH2\|2-05/D2\|2-15\|RF1/JH5 | EVQ.L.....V.............FT | 13617 |
| 18089-C9 | VH2\|2-05/D2\|2-15\|RF1/JH5 | EVQ.L...................FT | 13618 |
| 18089-D8 | VH2\|2-05/D2\|2-15\|RF1/JH5 | EVQ.L.....M.............FT | 13619 |
| 18081-F9 | VH2\|2-05/D2\|2-15\|RF1/JH5 | EVQ.L.....M.............FT | 13620 |
| 18081-B6 | VH2\|2-05/D2\|2-15\|RF1/JH5 | EVQ.L.....M.............FT | 13621 |
| 18409-F12_final | VH2\|2-05/D2\|2-15\|RF1/JH5 | ..........A.............FT | 13622 |
| 18409-G10_final | VH2\|2-05/D2\|2-15\|RF1/JH5 | ........................FT | 13623 |
| 18409-H7_final | VH2\|2-05/D2\|2-15\|RF1/JH5 | ..........A.............FT | 13624 |
| 18409-H10_final | VH2\|2-05/D2\|2-15\|RF1/JH5 | ........................FT | 13625 |
| VH3\|3-23/D7\|7-27\|RF2/JH6 | | EVQLLES-GGGLVQPGGSLRLSCAASG-FTFS | 13626 |
| 18089-G11 | VH3\|3-23/D7\|7-27\|RF2/JH6 | ........................ | 13622 |
| 18089-H9 | VH3\|3-23/D7\|7-27\|RF2/JH6 | ........................ | 13628 |
| VH4\|4-30.1/D3\|3-10\|RF3/JH6 | | QVQLQES-GPGLVKPSQTLSLTCTVSG-GSIS | 13629 |
| 18179-A5 | VH4\|4-30.1/D3\|3-10\|RF3/JH6 | E...L..........E........A.. | 13630 |
| 18179-C7 | VH4\|4-30.1/D3\|3-10\|RF3/JH6 | E...L.................D... | 13631 |

TABLE 63-continued

HEAVY_VARIABLE

| | Germline | | SEQ ID NO: |
|---|---|---|---|
| 18179-H9 | VH4\|4-30.1/D3\|3-10\|RF3/JH6 | E...L..........................D... | 13632 |
| 18181-H7 | VH4\|4-30.1/D3\|3-10\|RF3/JH6 | E...L..........................D... | 13633 |
| 18181-B8 | VH4\|4-30.1/D3\|3-10\|RF3/JH6 | E...L.............................. | 13634 |
| 81-H7-SG-F28_final | VH4\|4-30.1/D3\|3-10\|RF3/JH6 | ................................D... | 13635 |
| VH3\|3-15/D3\|3-10\|RF2/JH6 | | EVQLVES-GGGLVKPGGSLRLSCAASG-FTFS | 13636 |
| 18179-B7 | VH3\|3-15/D3\|3-10\|RF2/JH6 | ....L............................... | 13637 |
| 18179-B8 | VH3\|3-15/D3\|3-10\|RF2/JH6 | ....L........Q...................... | 13638 |
| 18179-D8 | VH3\|3-15/D3\|3-10\|RF2/JH6 | ....L............................... | 13639 |
| 18179-D9 | VH3\|3-15/D3\|3-10\|RF2/JH6 | ....L............................... | 13640 |
| 18179-E6 | VH3\|3-15/D3\|3-10\|RF2/JH6 | ....L........Q...................... | 13641 |
| 18181-G7 | VH3\|3-15/D3\|3-10\|RF2/JH6 | ....L............................... | 13642 |
| 18179-E1 | VH3\|3-15/D3\|3-10\|RF2/JH6 | ....L........Q...................... | 13643 |
| 18179-H7 | VH3\|3-15/D3\|3-10\|RF2/JH6 | ....L........Q...................... | 13644 |
| 18179-B12 | VH3\|3-15/D3\|3-10\|RF2/JH6 | ....L............................... | 13645 |
| 18179-D11 | VH3\|3-15/D3\|3-10\|RF2/JH6 | ....L............................... | 13646 |
| 18179-D7 | VH3\|3-15/D3\|3-10\|RF2/JH6 | ....L........Q...................... | 13647 |
| 18179-A7 | VH3\|3-15/D3\|3-10\|RF2/JH6 | ....L............................... | 13648 |
| 18181-G8 | VH3\|3-15/D3\|3-10\|RF2/JH6 | ....L........Q...................... | 13649 |
| 18181-F3 | VH3\|3-15/D3\|3-10\|RF2/JH6 | ....L........Q...................... | 13650 |
| 18181-F1 | VH3\|3-15/D3\|3-10\|RF2/JH6 | ....L............................... | 13651 |
| 18181-A6 | VH3\|3-15/D3\|3-10\|RF2/JH6 | ....L........Q...................... | 13652 |
| 18409-E2_final | VH3\|3-15/D3\|3-10\|RF2/JH6 | .............Q...................... | 13653 |
| 18410-B5_final | VH3\|3-15/D3\|3-10\|RF2/JH6 | .............Q...................... | 13654 |
| 18410-B6_final | VH3\|3-15/D3\|3-10\|RF2/JH6 | .............Q...................... | 13655 |
| 18410-D3_final | VH3\|3-15/D3\|3-10\|RF2/JH6 | .............Q...................... | 13656 |

TABLE 63-continued

HEAVY_VARIABLE

| | Germline | | SEQ ID NO: |
|---|---|---|---|
| 18410-D6_final | VH3\|3-15/D3\|3-10\|RF2/JH6 | ............Q................13657 | |
| 18410-H1_final | VH3\|3-15/D3\|3-10\|RF2/JH6 | .............................13658 | |
| 18410-H3_final | VH3\|3-15/D3\|3-10\|RF2/JH6 | ............Q................13659 | |
| VH4\|4-59/D3\|3-10\|RF3/JH6 | | QVQLQES-GPGLVKPSETLSLTCTVSG-GSIS | 13660 |
| 18179-F3 | VH4\|4-59/D3\|3-10\|RF3/JH6 | E...L..............T........13661 | |
| 18179-F10 | VH4\|4-59/D3\|3-10\|RF3/JH6 | E...L..........T............13662 | |
| 18181-H10 | VH4\|4-59/D3\|3-10\|RF3/JH6 | E...L.......................13663 | |
| VH3\|3-23/D6\|6-19\|RF2/JH4 | | EVQLLES-GGGLVQPGGSLRLSCAASG-FTFS | 13664 |
| 18182-A3 | VH3\|3-23/D6\|6-19\|RF2/JH4 | .............................13665 | |
| 18182-A5 | VH3\|3-23/D6\|6-19\|RF2/JH4 | .............................13666 | |
| 18182-A6 | VH3\|3-23/D6\|6-19\|RF2/JH4 | .............................13667 | |
| 18182-A7 | VH3\|3-23/D6\|6-19\|RF2/JH4 | .............................13668 | |
| 18182-A8 | VH3\|3-23/D6\|6-19\|RF2/JH4 | .............................13669 | |
| 18182-A11 | VH3\|3-23/D6\|6-19\|RF2/JH4 | .............................13670 | |
| 18182-B1 | VH3\|3-23/D6\|6-19\|RF2/JH4 | .............................13671 | |
| 18182-B4 | VH3\|3-23/D6\|6-19\|RF2/JH4 | .............................13672 | |
| 18182-B6 | VH3\|3-23/D6\|6-19\|RF2/JH4 | .............................13673 | |
| 18182-B10 | VH3\|3-23/D6\|6-19\|RF2/JH4 | .............................13674 | |
| 18182-C2 | VH3\|3-23/D6\|6-19\|RF2/JH4 | .............................13675 | |
| 18182-C3 | VH3\|3-23/D6\|6-19\|RF2/JH4 | ..........D..................13676 | |
| 18182-C4 | VH3\|3-23/D6\|6-19\|RF2/JH4 | .............................13677 | |
| 18182-C5 | VH3\|3-23/D6\|6-19\|RF2/JH4 | .............................13678 | |
| 18182-C10 | VH3\|3-23/D6\|6-19\|RF2/JH4 | .............................13679 | |
| 18182-C12 | VH3\|3-23/D6\|6-19\|RF2/JH4 | ..........D..............I...13680 | |
| 18182-D4 | VH3\|3-23/D6\|6-19\|RF2/JH4 | ..........D..................13681 | |

TABLE 63-continued

HEAVY_VARIABLE

| | Germline | | SEQ ID NO: |
|---|---|---|---|
| 18182-D8 | VH3\|3-23/D6\|6-19\|RF2/JH4 | ................................ | 13682 |
| 18182-D9 | VH3\|3-23/D6\|6-19\|RF2/JH4 | ...........D.................... | 13683 |
| 18182-D11 | VH3\|3-23/D6\|6-19\|RF2/JH4 | ................................ | 13684 |
| 18182-E2 | VH3\|3-23/D6\|6-19\|RF2/JH4 | ...........D....................G | 13685 |
| 18182-E3 | VH3\|3-23/D6\|6-19\|RF2/JH4 | ................................ | 13686 |
| 18182-E8 | VH3\|3-23/D6\|6-19\|RF2/JH4 | ................................ | 13687 |
| 18182-E11 | VH3\|3-23/D6\|6-19\|RF2/JH4 | ................................ | 13688 |
| 18182-F1 | VH3\|3-23/D6\|6-19\|RF2/JH4 | ...........D.................... | 13689 |
| 18182-F6 | VH3\|3-23/D6\|6-19\|RF2/JH4 | ................................ | 13690 |
| 18182-F8 | VH3\|3-23/D6\|6-19\|RF2/JH4 | ................................ | 13691 |
| 18182-G3 | VH3\|3-23/D6\|6-19\|RF2/JH4 | ...........D.................... | 13692 |
| 18182-G4 | VH3\|3-23/D6\|6-19\|RF2/JH4 | ................................ | 13693 |
| 18182-G5 | VH3\|3-23/D6\|6-19\|RF2/JH4 | ................................ | 13694 |
| 18182-G9 | VH3\|3-23/D6\|6-19\|RF2/JH4 | ................................ | 13695 |
| 18182-G11 | VH3\|3-23/D6\|6-19\|RF2/JH4 | ................................ | 13696 |
| 18182-H5 | VH3\|3-23/D6\|6-19\|RF2/JH4 | ................................ | 13697 |
| 18182-B5 | VH3\|3-23/D6\|6-19\|RF2/JH4 | ................................ | 13698 |
| 18182-H9 | VH3\|3-23/D6\|6-19\|RF2/JH4 | ................................ | 13699 |
| 18182-E6 | VH3\|3-23/D6\|6-19\|RF2/JH4 | ................................ | 13700 |
| 18182-G6 | VH3\|3-23/D6\|6-19\|RF2/JH4 | ................................ | 13701 |
| 18182-G2 | VH3\|3-23/D6\|6-19\|RF2/JH4 | ................................ | 13702 |
| 18182-H12 | VH3\|3-23/D6\|6-19\|RF2/JH4 | ................................ | 13703 |
| 18182-G8 | VH3\|3-23/D6\|6-19\|RF2/JH4 | ...............K................ | 13704 |
| 18182-E10 | VH3\|3-23/D6\|6-19\|RF2/JH4 | ................................ | 13705 |
| 18182-B12 | VH3\|3-23/D6\|6-19\|RF2/JH4 | ................................ | 13706 |

TABLE 63-continued

| | HEAVY_VARIABLE | | |
|---|---|---|---|
| | Germline | | SEQ ID NO: |
| 18182-E5 | VH3\|3-23/D6\|6-19\|RF2/JH4 | ................................ | 13707 |
| 18182-A4 | VH3\|3-23/D6\|6-19\|RF2/JH4 | ............V....R.............. | 13708 |
| 18182-E1 | VH3\|3-23/D6\|6-19\|RF2/JH4 | ................................ | 13709 |
| 18403-F12-AS | VH3\|3-23/D6\|6-19\|RF2/JH4 | ................................ | 13710 |
| 18403-G10-AS | VH3\|3-23/D6\|6-19\|RF2/JH4 | ................................ | 13711 |
| 18398-C7_final | VH3\|3-23/D6\|6-19\|RF2/JH4 | ................................ | 13712 |
| 18403-D8_final | VH3\|3-23/D6\|6-19\|RF2/JH4 | ................................ | 13713 |
| 18403-D8_AS_final | VH3\|3-23/D6\|6-19\|RF2/JH4 | ................................ | 13714 |
| 18403-E11_AS_final | VH3\|3-23/D6\|6-19\|RF2/JH4 | ................................ | 13715 |
| 18403-F12_final | VH3\|3-23/D6\|6-19\|RF2/JH4 | ................................ | 13716 |
| 18403-F12-AS_final | VH3\|3-23/D6\|6-19\|RF2/JH4 | ................................ | 13717 |
| 18403-G10_final | VH3\|3-23/D6\|6-19\|RF2/JH4 | ................................ | 13718 |
| 18403-G10-AS_final | VH3\|3-23/D6\|6-19\|RF2/JH4 | ................................ | 13719 |
| 18410-G10_final | VH3\|3-23/D6\|6-19\|RF2/JH4 | ................................ | 13720 |
| 18410-G10_AS_final | VH3\|3-23/D6\|6-19\|RF2/JH4 | ................................ | 13721 |
| VH3\|3-23/D6\|6-19\|RF2/JH1 | | EVQLLES-GGGLVQPGGSLRLSCAASG-FTFS | 13722 |
| 18182-B7 | VH3\|3-23/D6\|6-19\|RF2/JH1 | ................................ | 13723 |
| VH3\|3-30.3/D1\|1-1\|RF2/JH4 | | QVQLVES-GGGVVQPGRSLRLSCAASG-FTFS | 13724 |
| 18089-D12 | VH3\|3-30.3/D1\|1-1\|RF2/JH4 | E...L........................... | 13725 |
| 02-C1-86-A4-N-F5_final | VH3\|3-30.3/D1\|1-1\|RF2/JH4 | ................................ | 13726 |
| 18486-A4_final | VH3\|3-30.3/D1\|1-1\|RF2/JH4 | ................................ | 13727 |
| VH1\|1-18/D6\|6-13\|RF2/JH4 | | QVQLVQS-GAEVKKPGASVKVSCKASG-YTFT | 13728 |
| 18179-G12 | VH1\|1-18/D6\|6-13\|RF2/JH4 | E...LE.......................... | 13729 |
| 18179-C1 | VH1\|1-18/D6\|6-13\|RF2/JH4 | E...LE.......................... | 13730 |
| VH3\|3-11/D1\|1-1\|RF3/JH4 | | QVQLVES-GGGLVKPGGSLRLSCAASG-FTFS | 13731 |

TABLE 63-continued

HEAVY_VARIABLE

| | Germline | | SEQ ID NO: |
|---|---|---|---|
| 18093-B11 | VH3\|3-11/D1\|1-1\|RF3/JH4 | E...L........................ | 13732 |
| 03-F3-88-B3-F9_final | VH3\|3-11/D1\|1-1\|RF3/JH4 | ............................ | 13733 |
| | | H_CDR1 | |
| VH1\|1-f/D2\|2-15\|RF3/JH4 | | D-----YYMH | 13965 |
| 17724-C9 | VH1\|1-f/D2\|2-15\|RF3/JH4 | K.....SW.N | 13966 |
| VH1\|1-e/D5\|5-18\|RF3/JH4 | | S-----YAIS | 13967 |
| 17724-G6 | VH1\|1-e/D5\|5-18\|RF3/JH4 | K.....SWMN | 13968 |
| VH1\|1-e/D1\|1-1\|RF2/JH3 | | S-----YAIS | 13969 |
| 17731-H8 | VH1\|1-e/D1\|1-1\|RF2/JH3 | ......SWMN | 13970 |
| VH1\|1-08/D5\|5-18\|RF3/JH6 | | S-----YDIN | 13971 |
| 17732-A8 | VH1\|1-08/D5\|5-18\|RF3/JH6 | .......... | 13972 |
| 17780-D12 | VH1\|1-08/D5\|5-18\|RF3/JH6 | .......... | 13973 |
| VH1\|1-08/D5\|5-12\|RF3/JH6 | | S-----YDIN | 13974 |
| 17745-E5 | VH1\|1-08/D5\|5-12\|RF3/JH6 | .......... | 13975 |
| 17777-B4 | VH1\|1-08/D5\|5-12\|RF3/JH6 | G......... | 13976 |
| 17814-D9 | VH1\|1-08/D5\|5-12\|RF3/JH6 | .......... | 13977 |
| VH4\|4-34/D5\|5-18\|RF3/JH6 | | G-----YYWS | 13978 |
| 17745-E8 | VH4\|4-34/D5\|5-18\|RF3/JH6 | .........N | 13979 |
| 17777-C5 | VH4\|4-34/D5\|5-18\|RF3/JH6 | .........T | 13980 |
| 17778-C9 | VH4\|4-34/D5\|5-18\|RF3/JH6 | .........N | 13981 |
| 17780-E6 | VH4\|4-34/D5\|5-18\|RF3/JH6 | .........N | 13982 |
| 17781-B3 | VH4\|4-34/D5\|5-18\|RF3/JH6 | ......F..N | 13983 |
| 17781-H12 | VH4\|4-34/D5\|5-18\|RF3/JH6 | .........N | 13984 |
| 17783-C11 | VH4\|4-34/D5\|5-18\|RF3/JH6 | .......... | 13985 |
| 17783-G10 | VH4\|4-34/D5\|5-18\|RF3/JH6 | .......... | 13986 |
| 17813-E3 | VH4\|4-34/D5\|5-18\|RF3/JH6 | .......... | 13987 |
| 17813-F1 | VH4\|4-34/D5\|5-18\|RF3/JH6 | .........N | 13988 |
| VH3\|3-23/D3\|3-9\|RF1/JH4 | | S-----YAMS | 13989 |

TABLE 63-continued

| | HEAVY_VARIABLE | | |
|---|---|---|---|
| | Germline | | SEQ ID NO: |
| 17745-G8 | VH3\|3-23/D3\|3-9\|RF1/JH4 | .......... | 13990 |
| 17777-C4 | VH3\|3-23/D3\|3-9\|RF1/JH4 | .......... | 13991 |
| 18072-D6 | VH3\|3-23/D3\|3-9\|RF1/JH4 | .......... | 13992 |
| 18084-E4 | VH3\|3-23/D3\|3-9\|RF1/JH4 | .......... | 13993 |
| 18088-B10 | VH3\|3-23/D3\|3-9\|RF1/JH4 | .......... | 13994 |
| VH3\|3-30.3/D1\|1-1\|RF2/JH6 | | S-----YAMH | 13995 |
| 17748-D12 | VH3\|3-30.3/D1\|1-1\|RF2/JH6 | .......R.. | 13996 |
| 18079-C8 | VH3\|3-30.3/D1\|1-1\|RF2/JH6 | .......G.. | 13997 |
| VH4\|4-34/D5\|5-12\|RF3/JH6 | | G-----YYWS | 13998 |
| 17753-F4 | VH4\|4-34/D5\|5-12\|RF3/JH6 | .........N | 13999 |
| 17778-F1 | VH4\|4-34/D5\|5-12\|RF3/JH6 | .........N | 14000 |
| 17778-H8 | VH4\|4-34/D5\|5-12\|RF3/JH6 | .......... | 14001 |
| 17779-E1 | VH4\|4-34/D5\|5-12\|RF3/JH6 | .......... | 14002 |
| 17784-C11 | VH4\|4-34/D5\|5-12\|RF3/JH6 | .......... | 14003 |
| 17784-H5 | VH4\|4-34/D5\|5-12\|RF3/JH6 | .......... | 14004 |
| 17785-D12 | VH4\|4-34/D5\|5-12\|RF3/JH6 | .........N | 14005 |
| 17813-E5 | VH4\|4-34/D5\|5-12\|RF3/JH6 | .......... | 14006 |
| 18088-E4 | VH4\|4-34/D5\|5-12\|RF3/JH6 | .......... | 14007 |
| VH3\|3-23/D6\|6-19\|RF1/JH6 | | S-----YAMS | 14008 |
| 17771-D2 | VH3\|3-23/D6\|6-19\|RF1/JH6 | .......... | 14009 |
| 18074-G12 | VH3\|3-23/D6\|6-19\|RF1/JH6 | .......... | 14010 |
| 18093-E2 | VH3\|3-23/D6\|6-19\|RF1/JH6 | .......... | 14011 |
| 18089-B2 | VH3\|3-23/D6\|6-19\|RF1/JH6 | .......... | 14012 |
| VH3\|3-23/D7\|7-27\|RF1/JH6 | | S-----YAMS | 14013 |
| 17779-D11 | VH3\|3-23/D7\|7-27\|RF1/JH6 | .......G.. | 14014 |
| 18089-H12 | VH3\|3-23/D7\|7-27\|RF1/JH6 | N......... | 14015 |

TABLE 63-continued

HEAVY_VARIABLE

| | Germline | | SEQ ID NO: |
|---|---|---|---|
| 18093-F5 | VH3\|3-23/D7\|7-27\|RF1/JH6 | I......G.. | 14016 |
| VH3\|3-23/D5\|5-18\|RF1/JH6 | | S-----YAMS | 14017 |
| 17784-B9 | VH3\|3-23/D5\|5-18\|RF1/JH6 | .......... | 14018 |
| 17784-C7 | VH3\|3-23/D5\|5-18\|RF1/JH6 | .......G.. | 14019 |
| 18080-H9 | VH3\|3-23/D5\|5-18\|RF1/JH6 | .......... | 14020 |
| VH4\|4-30.1/D3\|3-10\|RF1/JH6 | | SG---GYYWS | 14021 |
| 17784-G10 | VH4\|4-30.1/D3\|3-10\|RF1/JH6 | RD...P.... | 14022 |
| 18080-C5 | VH4\|4-30.1/D3\|3-10\|RF1/JH6 | .....D.... | 14023 |
| 18179-A3 | VH4\|4-30.1/D3\|3-10\|RF1/JH6 | .N...P.... | 14024 |
| 18179-A9 | VH4\|4-30.1/D3\|3-10\|RF1/JH6 | .....D.... | 14025 |
| 18179-A10 | VH4\|4-30.1/D3\|3-10\|RF1/JH6 | .......... | 14026 |
| 18179-C4 | VH4\|4-30.1/D3\|3-10\|RF1/JH6 | .....D.... | 14027 |
| 18179-C6 | VH4\|4-30.1/D3\|3-10\|RF1/JH6 | .....D.... | 14028 |
| 18179-C10 | VH4\|4-30.1/D3\|3-10\|RF1/JH6 | .N...P.... | 14029 |
| 18179-F4 | VH4\|4-30.1/D3\|3-10\|RF1/JH6 | .N...P.... | 14030 |
| 18179-F6 | VH4\|4-30.1/D3\|3-10\|RF1/JH6 | .......... | 14031 |
| 18179-G8 | VH4\|4-30.1/D3\|3-10\|RF1/JH6 | .....D.... | 14032 |
| 18179-G9 | VH4\|4-30.1/D3\|3-10\|RF1/JH6 | .N...P.... | 14033 |
| 18179-H6 | VH4\|4-30.1/D3\|3-10\|RF1/JH6 | .....D.... | 14034 |
| 18181-A11 | VH4\|4-30.1/D3\|3-10\|RF1/JH6 | .N...P.... | 14035 |
| 18181-C6 | VH4\|4-30.1/D3\|3-10\|RF1/JH6 | .N...P.... | 14036 |
| 18181-G10 | VH4\|4-30.1/D3\|3-10\|RF1/JH6 | .N...P.... | 14037 |
| 18181-E2 | VH4\|4-30.1/D3\|3-10\|RF1/JH6 | .N...P.... | 14038 |
| 18181-C9 | VH4\|4-30.1/D3\|3-10\|RF1/JH6 | .N...P.... | 14039 |
| VH3\|3-23/D1\|1-1\|RF1/JH6 | | S-----YAMS | 14040 |
| 17813-D8 | VH3\|3-23/D1\|1-1\|RF1/JH6 | .......... | 14041 |

TABLE 63-continued

HEAVY_VARIABLE

| | Germline | | SEQ ID NO: |
|---|---|---|---|
| VH3\|3-33/D3\|3-10\|RF2/JH6 | | S-----YGMH | 14042 |
| 18071-B1 | VH3\|3-33/D3\|3-10\|RF2/JH6 | R........D | 14043 |
| 18082-F5 | VH3\|3-33/D3\|3-10\|RF2/JH6 | R........D | 14044 |
| VH1\|1-08/D7\|7-27\|RF3/JH6 | | S-----YDIN | 14045 |
| 18071-c4 | VH1\|1-08/D7\|7-27\|RF3/JH6 | .......... | 14046 |
| 18071-D4 | VH1\|1-08/D7\|7-27\|RF3/JH6 | .......... | 14047 |
| 18079-H4 | VH1\|1-08/D7\|7-27\|RF3/JH6 | .......... | 14048 |
| 18079-H11 | VH1\|1-08/D7\|7-27\|RF3/JH6 | .......... | 14049 |
| 18086-H4 | VH1\|1-08/D7\|7-27\|RF3/JH6 | .......... | 14050 |
| VH3\|3-21/D6\|6-6\|RF2/JH6 | | S-----YSMN | 14051 |
| 18072-G9 | VH3\|3-21/D6\|6-6\|RF2/JH6 | G......... | 14052 |
| VH3\|3-30.3/D3\|3-10\|RF2/JH6 | | S-----YAMH | 14053 |
| 18078-H6 | VH3\|3-30.3/D3\|3-10\|RF2/JH6 | R......G.Q | 14054 |
| 18090-H9 | VH3\|3-30.3/D3\|3-10\|RF2/JH6 | R......G.D | 14055 |
| VH4\|4-59/D3\|3-3\|RF3/JH4 | | S-----YYWS | 14056 |
| 18081-A6 | VH4\|4-59/D3\|3-3\|RF3/JH4 | .S...R...G | 14057 |
| 18081-B9 | VH4\|4-59/D3\|3-3\|RF3/JH4 | .S...R...G | 14058 |
| 18081-E7 | VH4\|4-59/D3\|3-3\|RF3/JH4 | .S...R...G | 14059 |
| 18081-B9_final | VH4\|4-59/D3\|3-3\|RF3/JH4 | .S...R...G | 14060 |
| VH6\|6-01/D3\|3-10\|RF1/JH6 | | SN---SAAWN | 14061 |
| 18081-B5 | VH6\|6-01/D3\|3-10\|RF1/JH6 | .......... | 14062 |
| VH4\|4-b/D3\|3-3\|RF3/JH5 | | SG----YYWG | 14063 |
| 18081-C10 | VH4\|4-b/D3\|3-3\|RF3/JH5 | .S...RS... | 14064 |
| VH2\|2-70/D2\|2-15\|RF1/JH5 | | TS---GMRVS | 14065 |
| 18081-D6 | VH2\|2-70/D2\|2-15\|RF1/JH5 | .H...K.G.D | 14066 |
| 18089-C8 | VH2\|2-70/D2\|2-15\|RF1/JH5 | .N...K.A.G | 14067 |
| 18081-H11 | VH2\|2-70/D2\|2-15\|RF1/JH5 | .H...K.G.D | 14068 |
| VH3\|3-23/D1\|1-26\|RF1/JH6 | | S-----YAMS | 14069 |

TABLE 63-continued

HEAVY_VARIABLE

| | Germline | | SEQ ID NO: |
|---|---|---|---|
| 18081-D12 | VH3\|3-23/D1\|1-26\|RF1/JH6 | I.......L. | 14070 |
| VH4\|4-59/D3\|3-3\|RF3/JH5 | | S-----YYWS | 14071 |
| 18089-B8 | VH4\|4-59/D3\|3-3\|RF3/JH5 | .S...RS..G | 14072 |
| VH2\|2-05/D2\|2-15\|RF1/JH5 | | TS---GVGVG | 14073 |
| 18089-G7 | VH2\|2-05/D2\|2-15\|RF1/JH5 | .H...KM..D | 14074 |
| 18089-D11 | VH2\|2-05/D2\|2-15\|RF1/JH5 | .H...KM..D | 14075 |
| 18089-C9 | VH2\|2-05/D2\|2-15\|RF1/JH5 | .H...KM..D | 14076 |
| 18089-D8 | VH2\|2-05/D2\|2-15\|RF1/JH5 | .H...KM..D | 14077 |
| 18081-F9 | VH2\|2-05/D2\|2-15\|RF1/JH5 | .H...KM..D | 14078 |
| 18081-B6 | VH2\|2-05/D2\|2-15\|RF1/JH5 | .H...KM..D | 14079 |
| 18409-F12_final | VH2\|2-05/D2\|2-15\|RF1/JH5 | .H...KM..D | 14080 |
| 18409-G10_final | VH2\|2-05/D2\|2-15\|RF1/JH5 | .H...KM..D | 14081 |
| 18409-H7_final | VH2\|2-05/D2\|2-15\|RF1/JH5 | .H...KM..D | 14082 |
| 18409-H10_final | VH2\|2-05/D2\|2-15\|RF1/JH5 | .H...KM..D | 14083 |
| VH3\|3-23/D7\|7-27\|RF2/JH6 | | S-----YAMS | 14084 |
| 18089-G11 | VH3\|3-23/D7\|7-27\|RF2/JH6 | .......... | 14085 |
| 18089-H9 | VH3\|3-23/D7\|7-27\|RF2/JH6 | ........V. | 14086 |
| VH4\|4-30.1/D3\|3-10\|RF3/JH6 | | SG---GYYWS | 14087 |
| 18179-A5 | VH4\|4-30.1/D3\|3-10\|RF3/JH6 | .....D.... | 14088 |
| 18179-C7 | VH4\|4-30.1/D3\|3-10\|RF3/JH6 | .N...P.... | 14089 |
| 18179-H9 | VH4\|4-30.1/D3\|3-10\|RF3/JH6 | .N...P.... | 14090 |
| 18181-H7 | VH4\|4-30.1/D3\|3-10\|RF3/JH6 | .N...P.... | 14091 |
| 18181-B8 | VH4\|4-30.1/D3\|3-10\|RF3/JH6 | .......... | 14092 |
| 81-H7-SG-F28_final | VH4\|4-30.1/D3\|3-10\|RF3/JH6 | .N...P.... | 14093 |
| VH3\|3-15/D3\|3-10\|RF2/JH6 | | N-----AWMS | 14094 |
| 18179-B7 | VH3\|3-15/D3\|3-10\|RF2/JH6 | .......... | 14095 |
| 18179-B8 | VH3\|3-15/D3\|3-10\|RF2/JH6 | .......... | 14096 |

TABLE 63-continued

| | HEAVY_VARIABLE | | |
|---|---|---|---|
| | Germline | | SEQ ID NO: |
| 18179-D8 | VH3\|3-15/D3-10\|RF2/JH6 | .......... | 14097 |
| 18179-D9 | VH3\|3-15/D3-10\|RF2/JH6 | .......... | 14098 |
| 18179-E6 | VH3\|3-15/D3-10\|RF2/JH6 | .......... | 14099 |
| 18181-G7 | VH3\|3-15/D3-10\|RF2/JH6 | .......... | 14100 |
| 18179-E1 | VH3\|3-15/D3-10\|RF2/JH6 | .......... | 14101 |
| 18179-H7 | VH3\|3-15/D3-10\|RF2/JH6 | .......... | 14102 |
| 18179-B12 | VH3\|3-15/D3-10\|RF2/JH6 | .......... | 14103 |
| 18179-D11 | VH3\|3-15/D3-10\|RF2/JH6 | .......... | 14104 |
| 18179-D7 | VH3\|3-15/D3-10\|RF2/JH6 | .......... | 14105 |
| 18179-A7 | VH3\|3-15/D3-10\|RF2/JH6 | .......... | 14106 |
| 18181-G8 | VH3\|3-15/D3-10\|RF2/JH6 | .......... | 14107 |
| 18181-F3 | VH3\|3-15/D3-10\|RF2/JH6 | .......... | 14108 |
| 18181-F1 | VH3\|3-15/D3-10\|RF2/JH6 | .......... | 14109 |
| 18181-A6 | VH3\|3-15/D3-10\|RF2/JH6 | .......... | 14110 |
| 18409-E2_final | VH3\|3-15/D3-10\|RF2/JH6 | .......... | 14111 |
| 18410-B5_final | VH3\|3-15/D3-10\|RF2/JH6 | .......... | 14112 |
| 18410-B6_final | VH3\|3-15/D3-10\|RF2/JH6 | .......... | 14113 |
| 18410-D3_final | VH3\|3-15/D3-10\|RF2/JH6 | .......... | 14114 |
| 18410-D6_final | VH3\|3-15/D3-10\|RF2/JH6 | .......... | 14115 |
| 18410-H1_final | VH3\|3-15/D3-10\|RF2/JH6 | .......... | 14116 |
| 18410-H3_final | VH3\|3-15/D3-10\|RF2/JH6 | .......... | 14117 |
| VH4\|4-59/D3\|3-10\|RF3/JH6 | | S-----YYWS | 14118 |
| 18179-F3 | VH4\|4-59/D3-10\|RF3/JH6 | .......... | 14119 |
| 18179-F10 | VH4\|4-59/D3-10\|RF3/JH6 | D.....FF.. | 14120 |
| 18181-H10 | VH4\|4-59/D3-10\|RF3/JH6 | N......... | 14121 |

TABLE 63-continued

HEAVY_VARIABLE

| | Germline | | SEQ ID NO: |
|---|---|---|---|
| VH3\|3-23/D6\|6-19\|RF2/JH4 | | S-----YAMS | 14122 |
| 18182-A3 | VH3\|3-23/D6\|6-19\|RF2/JH4 | .......... | 14123 |
| 18182-A5 | VH3\|3-23/D6\|6-19\|RF2/JH4 | ......H... | 14124 |
| 18182-A6 | VH3\|3-23/D6\|6-19\|RF2/JH4 | .......... | 14125 |
| 18182-A7 | VH3\|3-23/D6\|6-19\|RF2/JH4 | .......... | 14126 |
| 18182-A8 | VH3\|3-23/D6\|6-19\|RF2/JH4 | ......H... | 14127 |
| 18182-A11 | VH3\|3-23/D6\|6-19\|RF2/JH4 | .......... | 14128 |
| 18182-B1 | VH3\|3-23/D6\|6-19\|RF2/JH4 | ......H... | 14129 |
| 18182-B4 | VH3\|3-23/D6\|6-19\|RF2/JH4 | .......... | 14130 |
| 18182-B6 | VH3\|3-23/D6\|6-19\|RF2/JH4 | .......... | 14131 |
| 18182-B10 | VH3\|3-23/D6\|6-19\|RF2/JH4 | .........N | 14132 |
| 18182-C2 | VH3\|3-23/D6\|6-19\|RF2/JH4 | .......... | 14133 |
| 18182-C3 | VH3\|3-23/D6\|6-19\|RF2/JH4 | ......H... | 14134 |
| 18182-C4 | VH3\|3-23/D6\|6-19\|RF2/JH4 | .......... | 14135 |
| 18182-C5 | VH3\|3-23/D6\|6-19\|RF2/JH4 | .......... | 14136 |
| 18182-C10 | VH3\|3-23/D6\|6-19\|RF2/JH4 | .......... | 14137 |
| 18182-C12 | VH3\|3-23/D6\|6-19\|RF2/JH4 | .......... | 14138 |
| 18182-D4 | VH3\|3-23/D6\|6-19\|RF2/JH4 | .......... | 14139 |
| 18182-D8 | VH3\|3-23/D6\|6-19\|RF2/JH4 | .......... | 14140 |
| 18182-D9 | VH3\|3-23/D6\|6-19\|RF2/JH4 | .......... | 14141 |
| 18182-D11 | VH3\|3-23/D6\|6-19\|RF2/JH4 | .........N | 14142 |
| 18182-E2 | VH3\|3-23/D6\|6-19\|RF2/JH4 | .......... | 14143 |
| 18182-E3 | VH3\|3-23/D6\|6-19\|RF2/JH4 | .......... | 14144 |
| 18182-E8 | VH3\|3-23/D6\|6-19\|RF2/JH4 | .......... | 14145 |
| 18182-E11 | VH3\|3-23/D6\|6-19\|RF2/JH4 | .......... | 14146 |

TABLE 63-continued

HEAVY_VARIABLE

| | Germline | | SEQ ID NO: |
|---|---|---|---|
| 18182-F1 | VH3\|3-23/D6\|6-19\|RF2/JH4 | .......... | 14147 |
| 18182-F6 | VH3\|3-23/D6\|6-19\|RF2/JH4 | .......... | 14148 |
| 18182-F8 | VH3\|3-23/D6\|6-19\|RF2/JH4 | .......... | 14149 |
| 18182-G3 | VH3\|3-23/D6\|6-19\|RF2/JH4 | .........H | 14150 |
| 18182-G4 | VH3\|3-23/D6\|6-19\|RF2/JH4 | .........T | 14151 |
| 18182-G5 | VH3\|3-23/D6\|6-19\|RF2/JH4 | .......... | 14152 |
| 18182-G9 | VH3\|3-23/D6\|6-19\|RF2/JH4 | .......... | 14153 |
| 18182-G11 | VH3\|3-23/D6\|6-19\|RF2/JH4 | .......... | 14154 |
| 18182-H5 | VH3\|3-23/D6\|6-19\|RF2/JH4 | ......H... | 14155 |
| 18182-B5 | VH3\|3-23/D6\|6-19\|RF2/JH4 | ......H... | 14156 |
| 18182-H9 | VH3\|3-23/D6\|6-19\|RF2/JH4 | ......H... | 14157 |
| 18182-E6 | VH3\|3-23/D6\|6-19\|RF2/JH4 | .......... | 14158 |
| 18182-G6 | VH3\|3-23/D6\|6-19\|RF2/JH4 | .......... | 14159 |
| 18182-G2 | VH3\|3-23/D6\|6-19\|RF2/JH4 | ......H... | 14160 |
| 18182-H12 | VH3\|3-23/D6\|6-19\|RF2/JH4 | .......... | 14161 |
| 18182-G8 | VH3\|3-23/D6\|6-19\|RF2/JH4 | .........N | 14162 |
| 18182-E10 | VH3\|3-23/D6\|6-19\|RF2/JH4 | ......H... | 14163 |
| 18182-B12 | VH3\|3-23/D6\|6-19\|RF2/JH4 | .......... | 14164 |
| 18182-E5 | VH3\|3-23/D6\|6-19\|RF2/JH4 | .......... | 14165 |
| 18182-A4 | VH3\|3-23/D6\|6-19\|RF2/JH4 | .........T | 14166 |
| 18182-E1 | VH3\|3-23/D6\|6-19\|RF2/JH4 | ......H... | 14167 |
| 18403-F12-AS | VH3\|3-23/D6\|6-19\|RF2/JH4 | .......... | 14168 |
| 18403-G10-AS | VH3\|3-23/D6\|6-19\|RF2/JH4 | .......... | 14169 |
| 18398-C7_final | VH3\|3-23/D6\|6-19\|RF2/JH4 | ......H... | 14170 |
| 18403-D8_final | VH3\|3-23/D6\|6-19\|RF2/JH4 | ......H... | 14171 |

TABLE 63-continued

| | HEAVY_VARIABLE | | |
|---|---|---|---|
| | Germline | | SEQ ID NO: |
| 18403-D8_AS_final | VH3\|3-23/D6\|6-19\|RF2/JH4 | ......H... | 14172 |
| 18403-E11_AS_final | VH3\|3-23/D6\|6-19\|RF2/JH4 | ......H... | 14173 |
| 18403-F12_final | VH3\|3-23/D6\|6-19\|RF2/JH4 | .......... | 14174 |
| 18403-F12-AS_final | VH3\|3-23/D6\|6-19\|RF2/JH4 | .......... | 14175 |
| 18403-G10_final | VH3\|3-23/D6\|6-19\|RF2/JH4 | .......... | 14176 |
| 18403-G10-AS_final | VH3\|3-23/D6\|6-19\|RF2/JH4 | .......... | 14177 |
| 18410-G10_final | VH3\|3-23/D6\|6-19\|RF2/JH4 | ......H... | 14178 |
| 18410-G10_AS_final | VH3\|3-23/D6\|6-19\|RF2/JH4 | ......H... | 14179 |
| VH3\|3-23/D6\|6-19\|RF2/JH1 | | S-----YAMS | 14180 |
| 18182-B7 | VH3\|3-23/D6\|6-19\|RF2/JH1 | ......H... | 14181 |
| VH3\|3-30.3/D1\|1-1\|RF2/JH4 | | S-----YAMH | 14182 |
| 18089-D12 | VH3\|3-30.3/D1\|1-1\|RF2/JH4 | T......G.. | 14183 |
| 02-C1-86-A4-N-F5_final | VH3\|3-30.3/D1\|1-1\|RF2/JH4 | T......G.. | 14184 |
| 18486-A4_final | VH3\|3-30.3/D1\|1-1\|RF2/JH4 | T......G.. | 14185 |
| VH1\|1-18/D6\|6-13\|RF2/JH4 | | S-----YGIS | 14186 |
| 18179-G12 | VH1\|1-18/D6\|6-13\|RF2/JH4 | R.....N.L. | 14187 |
| 18179-C1 | VH1\|1-18/D6\|6-13\|RF2/JH4 | R.....N.L. | 14188 |
| VH3\|3-11/D1\|1-1\|RF3/JH4 | | D-----YYMS | 14189 |
| 18093-B11 | VH3\|3-11/D1\|1-1\|RF3/JH4 | .......... | 14190 |
| 03-F3-88-B3-F9_final | VH3\|3-11/D1\|1-1\|RF3/JH4 | .......... | 14191 |
| | | H_FR2 | |
| VH1\|1-f/D2\|2-15\|RF3/JH4 | | WVQQAPGKGLEWMG | 14423 |
| 17724-C9 | VH1\|1-f/D2\|2-15\|RF3/JH4 | ..K.R.......I. | 14424 |
| VH1\|1-e/D5\|5-18\|RF3/JH4 | | WVRQAPGQGLEWMG | 14425 |
| 17724-G6 | VH1\|1-e/D5\|5-18\|RF3/JH4 | ..K.R..E....I. | 14426 |
| VH1\|1-e/D1\|1-1\|RF2/JH3 | | WVRQAPGQGLEWMG | 14427 |
| 17731-H8 | VH1\|1-e/D1\|1-1\|RF2/JH3 | ..K.R..K....I. | 14428 |

TABLE 63-continued

| HEAVY_VARIABLE | | | |
|---|---|---|---|
| | Germline | | SEQ ID NO: |
| VH1\|1-08/D5\|5-18\|RF3/JH6 | | WVRQATGQGLEWMG | 14429 |
| 17732-A8 | VH1\|1-08/D5\|5-18\|RF3/JH6 | ............. | 14430 |
| 17780-D12 | VH1\|1-08/D5\|5-18\|RF3/JH6 | ............. | 14431 |
| VH1\|1-08/D5\|5-12\|RF3/JH6 | | WVRQATGQGLEWMG | 14432 |
| 17745-E5 | VH1\|1-08/D5\|5-12\|RF3/JH6 | ............. | 14433 |
| 17777-B4 | VH1\|1-08/D5\|5-12\|RF3/JH6 | ............. | 14434 |
| 17814-D9 | VH1\|1-08/D5\|5-12\|RF3/JH6 | ............. | 14435 |
| VH4\|4-34/D5\|5-18\|RF3/JH6 | | WIRQPPGKGLEWIG | 14436 |
| 17745-E8 | VH4\|4-34/D5\|5-18\|RF3/JH6 | ............. | 14437 |
| 17777-C5 | VH4\|4-34/D5\|5-18\|RF3/JH6 | ............. | 14438 |
| 17778-C9 | VH4\|4-34/D5\|5-18\|RF3/JH6 | ............. | 14439 |
| 17780-E6 | VH4\|4-34/D5\|5-18\|RF3/JH6 | ............. | 14440 |
| 17781-B3 | VH4\|4-34/D5\|5-18\|RF3/JH6 | ............. | 14441 |
| 17781-H12 | VH4\|4-34/D5\|5-18\|RF3/JH6 | ............. | 14442 |
| 17783-C11 | VH4\|4-34/D5\|5-18\|RF3/JH6 | ............. | 14443 |
| 17783-G10 | VH4\|4-34/D5\|5-18\|RF3/JH6 | ............. | 14444 |
| 17813-E3 | VH4\|4-34/D5\|5-18\|RF3/JH6 | ............. | 14445 |
| 17813-F1 | VH4\|4-34/D5\|5-18\|RF3/JH6 | ............. | 14446 |
| VH3\|3-23/D3\|3-9\|RF1/JH4 | | WVRQAPGKGLEWVS | 14447 |
| 17745-G8 | VH3\|3-23/D3\|3-9\|RF1/JH4 | ............. | 14448 |
| 17777-C4 | VH3\|3-23/D3\|3-9\|RF1/JH4 | ............. | 14449 |
| 18072-D6 | VH3\|3-23/D3\|3-9\|RF1/JH4 | ............. | 14450 |
| 18084-E4 | VH3\|3-23/D3\|3-9\|RF1/JH4 | ............. | 14451 |
| 18088-B10 | VH3\|3-23/D3\|3-9\|RF1/JH4 | ............. | 14452 |
| VH3\|3-30.3/D1\|1-1\|RF2/JH6 | | WVRQAPGKGLEWVA | 14453 |

TABLE 63-continued

HEAVY_VARIABLE

|  | Germline |  | SEQ ID NO: |
|---|---|---|---|
| 17748-D12 | VH3\|3-30.3/D1\|1-1\|RF2/JH6 | ............. . | 14454 |
| 18079-C8 | VH3\|3-30.3/D1\|1-1\|RF2/JH6 | ............. . | 14455 |
| VH4\|4-34/D5\|5-12\|RF3/JH6 |  | WIRQPPGKGLEWIG | 14456 |
| 17753-F4 | VH4\|4-34/D5\|5-12\|RF3/JH6 | ............. . | 14457 |
| 17778-F1 | VH4\|4-34/D5\|5-12\|RF3/JH6 | ............. . | 14458 |
| 17778-H8 | VH4\|4-34/D5\|5-12\|RF3/JH6 | ............. . | 14459 |
| 17779-E1 | VH4\|4-34/D5\|5-12\|RF3/JH6 | ............. . | 14460 |
| 17784-C11 | VH4\|4-34/D5\|5-12\|RF3/JH6 | ............. . | 14461 |
| 17784-H5 | VH4\|4-34/D5\|5-12\|RF3/JH6 | ............. . | 14462 |
| 17785-D12 | VH4\|4-34/D5\|5-12\|RF3/JH6 | ............. . | 14463 |
| 17813-E5 | VH4\|4-34/D5\|5-12\|RF3/JH6 | ............. . | 14464 |
| 18088-E4 | VH4\|4-34/D5\|5-12\|RF3/JH6 | ............. . | 14465 |
| VH3\|3-23/D6\|6-19\|RF1/JH6 |  | WVRQAPGKGLEWVS | 14466 |
| 17771-D2 | VH3\|3-23/D6\|6-19\|RF1/JH6 | .......R..... . | 14467 |
| 18074-G12 | VH3\|3-23/D6\|6-19\|RF1/JH6 | .......R..... . | 14468 |
| 18093-E2 | VH3\|3-23/D6\|6-19\|RF1/JH6 | ............. . | 14469 |
| 18089-B2 | VH3\|3-23/D6\|6-19\|RF1/JH6 | .......R..... . | 14470 |
| VH3\|3-23/D7\|7-27\|RF1/JH6 |  | WVRQAPGKGLEWVS | 14471 |
| 17779-D11 | VH3\|3-23/D7\|7-27\|RF1/JH6 | ............. . | 14472 |
| 18089-H12 | VH3\|3-23/D7\|7-27\|RF1/JH6 | ............. . | 14473 |
| 18093-F5 | VH3\|3-23/D7\|7-27\|RF1/JH6 | ............. . | 14474 |
| VH3\|3-23/D5\|5-18\|RF1/JH6 |  | WVRQAPGKGLEWVS | 14475 |
| 17784-B9 | VH3\|3-23/D5\|5-18\|RF1/JH6 | ............. . | 14476 |
| 17784-C7 | VH3\|3-23/D5\|5-18\|RF1/JH6 | ............. . | 14477 |
| 18080-H9 | VH3\|3-23/D5\|5-18\|RF1/JH6 | ............. . | 14478 |

TABLE 63-continued

HEAVY_VARIABLE

| | Germline | | SEQ ID NO: |
|---|---|---|---|
| VH4\|4-30.1/D3\|3-10\|RF1/JH6 | | WIRQHPGKGLEWIG | 14479 |
| 17784-G10 | VH4\|4-30.1/D3\|3-10\|RF1/JH6 | .............. | 14480 |
| 18080-C5 | VH4\|4-30.1/D3\|3-10\|RF1/JH6 | .............. | 14481 |
| 18179-A3 | VH4\|4-30.1/D3\|3-10\|RF1/JH6 | ....L......... | 14482 |
| 18179-A9 | VH4\|4-30.1/D3\|3-10\|RF1/JH6 | .............. | 14483 |
| 18179-A10 | VH4\|4-30.1/D3\|3-10\|RF1/JH6 | .............. | 14484 |
| 18179-C4 | VH4\|4-30.1/D3\|3-10\|RF1/JH6 | .............. | 14485 |
| 18179-C6 | VH4\|4-30.1/D3\|3-10\|RF1/JH6 | .............. | 14486 |
| 18179-C10 | VH4\|4-30.1/D3\|3-10\|RF1/JH6 | .............. | 14487 |
| 18179-F4 | VH4\|4-30.1/D3\|3-10\|RF1/JH6 | ....L......... | 14488 |
| 18179-F6 | VH4\|4-30.1/D3\|3-10\|RF1/JH6 | .............. | 14489 |
| 18179-G8 | VH4\|4-30.1/D3\|3-10\|RF1/JH6 | .............. | 14490 |
| 18179-G9 | VH4\|4-30.1/D3\|3-10\|RF1/JH6 | .......M...... | 14491 |
| 18179-H6 | VH4\|4-30.1/D3\|3-10\|RF1/JH6 | .............. | 14492 |
| 18181-A11 | VH4\|4-30.1/D3\|3-10\|RF1/JH6 | .............. | 14493 |
| 18181-C6 | VH4\|4-30.1/D3\|3-10\|RF1/JH6 | .............. | 14494 |
| 18181-G10 | VH4\|4-30.1/D3\|3-10\|RF1/JH6 | ....L......... | 14495 |
| 18181-E2 | VH4\|4-30.1/D3\|3-10\|RF1/JH6 | .............. | 14496 |
| 18181-C9 | VH4\|4-30.1/D3\|3-10\|RF1/JH6 | ....L......... | 14497 |
| VH3\|3-23/D1\|1-1\|RF1/JH6 | | WVRQAPGKGLEWVS | 14498 |
| 17813-D8 | VH3\|3-23/D1\|1-1\|RF1/JH6 | .............. | 14499 |
| VH3\|3-33/D3\|3-10\|RF2/JH6 | | WVRQAPGKGLEWVA | 14500 |
| 18071-B1 | VH3\|3-33/D3\|3-10\|RF2/JH6 | .............. | 14501 |
| 18082-F5 | VH3\|3-33/D3\|3-10\|RF2/JH6 | .............. | 14502 |
| VH1\|1-08/D7\|7-27\|RF3/JH6 | | WVRQATGQGLEWMG | 14503 |

TABLE 63-continued

| | HEAVY_VARIABLE | | |
|---|---|---|---|
| | Germline | | SEQ ID NO: |
| 18071-c4 | VH1\|1-08/D7\|7-27\|RF3/JH6 | ............. | 14504 |
| 18071-D4 | VH1\|1-08/D7\|7-27\|RF3/JH6 | ............. | 14505 |
| 18079-H4 | VH1\|1-08/D7\|7-27\|RF3/JH6 | ............. | 14506 |
| 18079-H11 | VH1\|1-08/D7\|7-27\|RF3/JH6 | ............. | 14507 |
| 18086-H4 | VH1\|1-08/D7\|7-27\|RF3/JH6 | ............. | 14508 |
| VH3\|3-21/D6\|6-6\|RF2/JH6 | | WVRQAPGKGLEWVS | 14509 |
| 18072-G9 | VH3\|3-21/D6\|6-6\|RF2/JH6 | ............. | 14510 |
| VH3\|3-30.3/D3\|3-10\|RF2/JH6 | | WVRQAPGKGLEWVA | 14511 |
| 18078-H6 | VH3\|3-30.3/D3\|3-10\|RF2/JH6 | ............. | 14512 |
| 18090-H9 | VH3\|3-30.3/D3\|3-10\|RF2/JH6 | ............. | 14513 |
| VH4\|4-59/D3\|3-3\|RF3/JH4 | | WIRQPPGKGLEWIG | 14514 |
| 18081-A6 | VH4\|4-59/D3\|3-3\|RF3/JH4 | ............. | 14515 |
| 18081-B9 | VH4\|4-59/D3\|3-3\|RF3/JH4 | ............. | 14516 |
| 18081-E7 | VH4\|4-59/D3\|3-3\|RF3/JH4 | ............. | 14517 |
| 18081-B9_final | VH4\|4-59/D3\|3-3\|RF3/JH4 | ............. | 14518 |
| VH6\|6-01/D3\|3-10\|RF1/JH6 | | WIRQSPSRGLEWLG | 14519 |
| 18081-B5 | VH6\|6-01/D3\|3-10\|RF1/JH6 | ............. | 14520 |
| VH4\|4-b/D3\|3-3\|RF3/JH5 | | WIRQPPGKGLEWIG | 14521 |
| 18081-C10 | VH4\|4-b/D3\|3-3\|RF3/JH5 | ............. | 14522 |
| VH2\|2-70/D2\|2-15\|RF1/JH5 | | WIRQPPGKALEWLA | 14523 |
| 18081-D6 | VH2\|2-70/D2\|2-15\|RF1/JH5 | ............. | |
| 18089-C8 | VH2\|2-70/D2\|2-15\|RF1/JH5 | ............. | 14525 |
| 18081-H11 | VH2\|2-70/D2\|2-15\|RF1/JH5 | ............. | 14526 |
| VH3\|3-23/D1\|1-26\|RF1/JH6 | | WVRQAPGKGLEWVS | 14527 |
| 18081-D12 | VH3\|3-23/D1\|1-26\|RF1/JH6 | ............. | 14528 |

TABLE 63-continued

| | HEAVY_VARIABLE | | |
|---|---|---|---|
| | Germline | | SEQ ID NO: |
| VH4\|4-59/D3\|3-3\|RF3/JH5 | | WIRQPPGKGLEWIG | 14529 |
| 18089-B8 | VH4\|4-59/D3\|3-3\|RF3/JH5 | .............. | 14530 |
| VH2\|2-05/D2\|2-15\|RF1/JH5 | | WIRQPPGKALEWLA | 14531 |
| 18089-G7 | VH2\|2-05/D2\|2-15\|RF1/JH5 | .............. | 14532 |
| 18089-D11 | VH2\|2-05/D2\|2-15\|RF1/JH5 | .............. | 14533 |
| 18089-C9 | VH2\|2-05/D2\|2-15\|RF1/JH5 | .............. | 14534 |
| 18089-D8 | VH2\|2-05/D2\|2-15\|RF1/JH5 | .............. | 14535 |
| 18081-F9 | VH2\|2-05/D2\|2-15\|RF1/JH5 | .............. | 14536 |
| 18081-B6 | VH2\|2-05/D2\|2-15\|RF1/JH5 | .............. | 14537 |
| 18409-F12_final | VH2\|2-05/D2\|2-15\|RF1/JH5 | .............. | 14538 |
| 18409-G10_final | VH2\|2-05/D2\|2-15\|RF1/JH5 | .............. | 14539 |
| 18409-H7_final | VH2\|2-05/D2\|2-15\|RF1/JH5 | .............. | 14540 |
| 18409-H10_final | VH2\|2-05/D2\|2-15\|RF1/JH5 | .............. | 14541 |
| VH3\|3-23/D7\|7-27\|RF2/JH6 | | WVRQAPGKGLEWVS | 14542 |
| 18089-G11 | VH3\|3-23/D7\|7-27\|RF2/JH6 | .............. | 14543 |
| 18089-H9 | VH3\|3-23/D7\|7-27\|RF2/JH6 | .............. | 14544 |
| VH4\|4-30.1/D3\|3-10\|RF3/JH6 | | WIRQHPGKGLEWIG | 14545 |
| 18179-A5 | VH4\|4-30.1/D3\|3-10\|RF3/JH6 | .............. | 14546 |
| 18179-C7 | VH4\|4-30.1/D3\|3-10\|RF3/JH6 | .............. | 14547 |
| 18179-H9 | VH4\|4-30.1/D3\|3-10\|RF3/JH6 | .............. | 14548 |
| 18181-H7 | VH4\|4-30.1/D3\|3-10\|RF3/JH6 | .............. | 14549 |
| 18181-B8 | VH4\|4-30.1/D3\|3-10\|RF3/JH6 | .............. | 14550 |
| 81-H7-SG-F28_final | VH4\|4-30.1/D3\|3-10\|RF3/JH6 | .............. | 14551 |
| VH3\|3-15/D3\|3-10\|RF2/JH6 | | WVRQAPGKGLEWVG | 14552 |
| 18179-B7 | VH3\|3-15/D3\|3-10\|RF2/JH6 | .............. | 14553 |

TABLE 63-continued

HEAVY_VARIABLE

| | Germline | | SEQ ID NO: |
|---|---|---|---|
| 18179-B8 | VH3\|3-15/D3-10\|RF2/JH6 | ............. | 14554 |
| 18179-D8 | VH3\|3-15/D3-10\|RF2/JH6 | ............. | 14555 |
| 18179-D9 | VH3\|3-15/D3-10\|RF2/JH6 | ............. | 14556 |
| 18179-E6 | VH3\|3-15/D3-10\|RF2/JH6 | ............. | 14557 |
| 18181-G7 | VH3\|3-15/D3-10\|RF2/JH6 | ............. | 14558 |
| 18179-E1 | VH3\|3-15/D3-10\|RF2/JH6 | ............. | 14559 |
| 18179-H7 | VH3\|3-15/D3-10\|RF2/JH6 | ............. | 14560 |
| 18179-B12 | VH3\|3-15/D3-10\|RF2/JH6 | ............. | 14561 |
| 18179-D11 | VH3\|3-15/D3-10\|RF2/JH6 | ............. | 14562 |
| 18179-D7 | VH3\|3-15/D3-10\|RF2/JH6 | ............. | 14563 |
| 18179-A7 | VH3\|3-15/D3-10\|RF2/JH6 | ............. | 14564 |
| 18181-G8 | VH3\|3-15/D3-10\|RF2/JH6 | ............. | 14565 |
| 18181-F3 | VH3\|3-15/D3-10\|RF2/JH6 | ............. | 14566 |
| 18181-F1 | VH3\|3-15/D3-10\|RF2/JH6 | ............. | 14567 |
| 18181-A6 | VH3\|3-15/D3-10\|RF2/JH6 | ............. | 14568 |
| 18409-E2_final | VH3\|3-15/D3-10\|RF2/JH6 | ............. | 14569 |
| 18410-B5_final | VH3\|3-15/D3-10\|RF2/JH6 | ............. | 14570 |
| 18410-B6_final | VH3\|3-15/D3-10\|RF2/JH6 | ............. | 14571 |
| 18410-D3_final | VH3\|3-15/D3-10\|RF2/JH6 | ............. | 14572 |
| 18410-D6_final | VH3\|3-15/D3-10\|RF2/JH6 | ............. | 14573 |
| 18410-H1_final | VH3\|3-15/D3-10\|RF2/JH6 | ............. | 14574 |
| 18410-H3_final | VH3\|3-15/D3-10\|RF2/JH6 | ............. | 14575 |
| VH4\|4-59/D3\|3-10\|RF3/JH6 | | WIRQPPGKGLEWIG | 14576 |
| 18179-F3 | VH4\|4-59/D3-10\|RF3/JH6 | .....A........ | 14577 |
| 18179-F10 | VH4\|4-59/D3-10\|RF3/JH6 | ............. | 14578 |

TABLE 63-continued

HEAVY_VARIABLE

| | Germline | | SEQ ID NO: |
|---|---|---|---|
| 18181-H10 | VH4\|4-59/D3-10\|RF3/JH6 | .V...A........ | 14579 |
| VH3\|3-23/D6\|6-19\|RF2/JH4 | | WVRQAPGKGLEWVS | 14580 |
| 18182-A3 | VH3\|3-23/D6\|6-19\|RF2/JH4 | .............. | 14581 |
| 18182-A5 | VH3\|3-23/D6\|6-19\|RF2/JH4 | .............. | 14582 |
| 18182-A6 | VH3\|3-23/D6\|6-19\|RF2/JH4 | .............. | 14583 |
| 18182-A7 | VH3\|3-23/D6\|6-19\|RF2/JH4 | .............. | 14584 |
| 18182-A8 | VH3\|3-23/D6\|6-19\|RF2/JH4 | .............. | 14585 |
| 18182-A11 | VH3\|3-23/D6\|6-19\|RF2/JH4 | .............. | 14586 |
| 18182-B1 | VH3\|3-23/D6\|6-19\|RF2/JH4 | .............. | 14587 |
| 18182-B4 | VH3\|3-23/D6\|6-19\|RF2/JH4 | .............. | 14588 |
| 18182-B6 | VH3\|3-23/D6\|6-19\|RF2/JH4 | .............. | 14589 |
| 18182-B10 | VH3\|3-23/D6\|6-19\|RF2/JH4 | .............. | 14590 |
| 18182-C2 | VH3\|3-23/D6\|6-19\|RF2/JH4 | .............. | 14591 |
| 18182-C3 | VH3\|3-23/D6\|6-19\|RF2/JH4 | .............. | 14592 |
| 18182-C4 | VH3\|3-23/D6\|6-19\|RF2/JH4 | .............. | 14593 |
| 18182-C5 | VH3\|3-23/D6\|6-19\|RF2/JH4 | .............. | 14594 |
| 18182-C10 | VH3\|3-23/D6\|6-19\|RF2/JH4 | .............. | 14595 |
| 18182-C12 | VH3\|3-23/D6\|6-19\|RF2/JH4 | .............. | 14596 |
| 18182-D4 | VH3\|3-23/D6\|6-19\|RF2/JH4 | .............. | 14597 |
| 18182-D8 | VH3\|3-23/D6\|6-19\|RF2/JH4 | .............. | 14598 |
| 18182-D9 | VH3\|3-23/D6\|6-19\|RF2/JH4 | .............. | 14599 |
| 18182-D11 | VH3\|3-23/D6\|6-19\|RF2/JH4 | .............. | 14600 |
| 18182-E2 | VH3\|3-23/D6\|6-19\|RF2/JH4 | .............. | 14601 |
| 18182-E3 | VH3\|3-23/D6\|6-19\|RF2/JH4 | .............. | 14602 |
| 18182-E8 | VH3\|3-23/D6\|6-19\|RF2/JH4 | .............. | 14603 |

TABLE 63-continued

HEAVY_VARIABLE

| | Germline | | SEQ ID NO: |
|---|---|---|---|
| 18182-E11 | VH3\|3-23/D6-19\|RF2/JH4 | ............. | 14604 |
| 18182-F1 | VH3\|3-23/D6-19\|RF2/JH4 | ............. | 14605 |
| 18182-F6 | VH3\|3-23/D6-19\|RF2/JH4 | ............. | 14606 |
| 18182-F8 | VH3\|3-23/D6-19\|RF2/JH4 | ............. | 14607 |
| 18182-G3 | VH3\|3-23/D6-19\|RF2/JH4 | .......Q..... | 14608 |
| 18182-G4 | VH3\|3-23/D6-19\|RF2/JH4 | ............. | 14609 |
| 18182-G5 | VH3\|3-23/D6-19\|RF2/JH4 | ............. | 14610 |
| 18182-G9 | VH3\|3-23/D6-19\|RF2/JH4 | ............. | 14611 |
| 18182-G11 | VH3\|3-23/D6-19\|RF2/JH4 | ............. | 14612 |
| 18182-H5 | VH3\|3-23/D6-19\|RF2/JH4 | ............. | 14613 |
| 18182-B5 | VH3\|3-23/D6-19\|RF2/JH4 | ............. | 14614 |
| 18182-H9 | VH3\|3-23/D6-19\|RF2/JH4 | ............. | 14615 |
| 18182-E6 | VH3\|3-23/D6-19\|RF2/JH4 | ............. | 14616 |
| 18182-G6 | VH3\|3-23/D6-19\|RF2/JH4 | ............. | 14617 |
| 18182-G2 | VH3\|3-23/D6-19\|RF2/JH4 | ............. | 14618 |
| 18182-H12 | VH3\|3-23/D6-19\|RF2/JH4 | ............. | 14619 |
| 18182-G8 | VH3\|3-23/D6-19\|RF2/JH4 | ............. | 14620 |
| 18182-E10 | VH3\|3-23/D6-19\|RF2/JH4 | .......Q..... | 14621 |
| 18182-B12 | VH3\|3-23/D6-19\|RF2/JH4 | ............. | 14622 |
| 18182-E5 | VH3\|3-23/D6-19\|RF2/JH4 | ............. | 14623 |
| 18182-A4 | VH3\|3-23/D6-19\|RF2/JH4 | .......Q..... | 14624 |
| 18182-E1 | VH3\|3-23/D6-19\|RF2/JH4 | ............. | 14625 |
| 18403-F12-AS | VH3\|3-23/D6-19\|RF2/JH4 | ............. | 14626 |
| 18403-G10-AS | VH3\|3-23/D6-19\|RF2/JH4 | ............. | 14627 |
| 18398-C7_final | VH3\|3-23/D6-19\|RF2/JH4 | ............. | 14628 |

TABLE 63-continued

| | HEAVY_VARIABLE | | |
|---|---|---|---|
| | Germline | | SEQ ID NO: |
| 18403-D8_final | VH3\|3-23/D6\|6-19\|RF2/JH4 | ............. | 14629 |
| 18403-D8_AS_final | VH3\|3-23/D6\|6-19\|RF2/JH4 | ............. | 14630 |
| 18403-E11_AS_final | VH3\|3-23/D6\|6-19\|RF2/JH4 | ............. | 14631 |
| 18403-F12_final | VH3\|3-23/D6\|6-19\|RF2/JH4 | ............. | 14632 |
| 18403-F12-AS_final | VH3\|3-23/D6\|6-19\|RF2/JH4 | ............. | 14633 |
| 18403-G10_final | VH3\|3-23/D6\|6-19\|RF2/JH4 | ............. | 14634 |
| 18403-G10-AS_final | VH3\|3-23/D6\|6-19\|RF2/JH4 | ............. | 14635 |
| 18410-G10_final | VH3\|3-23/D6\|6-19\|RF2/JH4 | ............. | 14636 |
| 18410-G10_AS_final | VH3\|3-23/D6\|6-19\|RF2/JH4 | ............. | 14637 |
| VH3\|3-23/D6\|6-19\|RF2/JH1 | | WVRQAPGKGLEWVS | 14638 |
| 18182-B7 | VH3\|3-23/D6\|6-19\|RF2/JH1 | .......Q..... | 14639 |
| VH3\|3-30.3/D1\|1-1\|RF2/JH4 | | WVRQAPGKGLEWVA | 14640 |
| 18089-D12 | VH3\|3-30.3/D1\|1-1\|RF2/JH4 | ............. | 14641 |
| 02-C1-86-A4-N-F5_final | VH3\|3-30.3/D1\|1-1\|RF2/JH4 | ............. | 14642 |
| 18486-A4_final | VH3\|3-30.3/D1\|1-1\|RF2/JH4 | ............. | 14643 |
| VH1\|1-18/D6\|6-13\|RF2/JH4 | | WVRQAPGQGLEWMG | 14644 |
| 18179-G12 | VH1\|1-18/D6\|6-13\|RF2/JH4 | ............. | 14645 |
| 18179-C1 | VH1\|1-18/D6\|6-13\|RF2/JH4 | ............. | 14646 |
| VH3\|3-11/D1\|1-1\|RF3/JH4 | | WIRQAPGKGLEWVS | 14647 |
| 18093-B11 | VH3\|3-11/D1\|1-1\|RF3/JH4 | ............. | 14648 |
| 03-F3-88-B3-F9_final | VH3\|3-11/D1\|1-1\|RF3/JH4 | ............. | 14649 |
| | | H_CDR2 | |
| VH1\|1-f/D2\|2-15\|RF3/JH4 | | LVDPE---DGETIYAEKFQG | 14881 |
| 17724-C9 | VH1\|1-f/D2\|2-15\|RF3/JH4 | RIY.G.....D.N.NG..K. | 14882 |
| VH1\|1-e/D5\|5-18\|RF3/JH4 | | GIIPI---FGTANYAQKFQG | 14883 |
| 17724-G6 | VH1\|1-e/D5\|5-18\|RF3/JH4 | RVW.G...D.DTT.NE..K. | 14884 |

TABLE 63-continued

HEAVY_VARIABLE

| | Germline | | SEQ ID NO: |
|---|---|---|---|
| VH1\|1-e/D1\|1-1\|RF2/JH3 | | GIIPI---FGTANYAQKFQG | 14885 |
| 17731-H8 | VH1\|1-e/D1\|1-1\|RF2/JH3 | R.Y.G...D.DT..NG..KD | 14886 |
| VH1\|1-08/D5\|5-18\|RF3/JH6 | | WMNPN---SGNTGYAQKFQG | 14887 |
| 17732-A8 | VH1\|1-08/D5\|5-18\|RF3/JH6 | .................... | 14888 |
| 17780-D12 | VH1\|1-08/D5\|5-18\|RF3/JH6 | .................... | 14889 |
| VH1\|1-08/D5\|5-12\|RF3/JH6 | | WMNPN---SGNTGYAQKFQG | 14890 |
| 17745-E5 | VH1\|1-08/D5\|5-12\|RF3/JH6 | .................... | 14891 |
| 17777-B4 | VH1\|1-08/D5\|5-12\|RF3/JH6 | ........R.T......... | 14892 |
| 17814-D9 | VH1\|1-08/D5\|5-12\|RF3/JH6 | .................... | 14893 |
| VH4\|4-34/D5\|5-18\|RF3/JH6 | | EINH----SGSTNYNPSLKS | 14894 |
| 17745-E8 | VH4\|4-34/D5\|5-18\|RF3/JH6 | .S.................. | 14895 |
| 17777-C5 | VH4\|4-34/D5\|5-18\|RF3/JH6 | .........R.......... | 14896 |
| 17778-C9 | VH4\|4-34/D5\|5-18\|RF3/JH6 | .........R.......... | 14897 |
| 17780-E6 | VH4\|4-34/D5\|5-18\|RF3/JH6 | .............T...... | 14898 |
| 17781-B3 | VH4\|4-34/D5\|5-18\|RF3/JH6 | ........R........... | 14899 |
| 17781-H12 | VH4\|4-34/D5\|5-18\|RF3/JH6 | .S.................. | 14900 |
| 17783-C11 | VH4\|4-34/D5\|5-18\|RF3/JH6 | .................... | 14901 |
| 17783-G10 | VH4\|4-34/D5\|5-18\|RF3/JH6 | .T.................. | 14902 |
| 17813-E3 | VH4\|4-34/D5\|5-18\|RF3/JH6 | .........R.......... | 14903 |
| 17813-F1 | VH4\|4-34/D5\|5-18\|RF3/JH6 | ........R........... | 14904 |
| VH3\|3-23/D3\|3-9\|RF1/JH4 | | AISGS---GGSTYYADSVKG | 14905 |
| 17745-G8 | VH3\|3-23/D3\|3-9\|RF1/JH4 | ........DI.......... | 14906 |
| 17777-c4 | VH3\|3-23/D3\|3-9\|RF1/JH4 | ........DY.......... | 14907 |
| 18072-D6 | VH3\|3-23/D3\|3-9\|RF1/JH4 | ........DI.......... | 14908 |
| 18084-E4 | VH3\|3-23/D3\|3-9\|RF1/JH4 | .........S.......... | 14909 |
| 18088-B10 | VH3\|3-23/D3\|3-9\|RF1/JH4 | ........DI.......... | 14910 |

TABLE 63-continued

| | Germline | HEAVY_VARIABLE | SEQ ID NO: |
|---|---|---|---|
| VH3\|3-30.3/D1\|1-1\|RF2/JH6 | | VISYD---GSNKYYADSVKG | 14911 |
| 17748-D12 | VH3\|3-30.3/D1\|1-1\|RF2/JH6 | .........G.......... | 14912 |
| 18079-C8 | VH3\|3-30.3/D1\|1-1\|RF2/JH6 | .................... | 14913 |
| VH4\|4-34/D5\|5-12\|RF3/JH6 | | EINH----SGSTNYNPSLKS | 14914 |
| 17753-F4 | VH4\|4-34/D5\|5-12\|RF3/JH6 | .................... | 14915 |
| 17778-F1 | VH4\|4-34/D5\|5-12\|RF3/JH6 | .................... | 14916 |
| 17778-H8 | VH4\|4-34/D5\|5-12\|RF3/JH6 | ........R........... | 14917 |
| 17779-E1 | VH4\|4-34/D5\|5-12\|RF3/JH6 | .................... | 14918 |
| 17784-C11 | VH4\|4-34/D5\|5-12\|RF3/JH6 | .................... | 14919 |
| 17784-H5 | VH4\|4-34/D5\|5-12\|RF3/JH6 | .................... | 14920 |
| 17785-D12 | VH4\|4-34/D5\|5-12\|RF3/JH6 | .................... | 14921 |
| 17813-E5 | VH4\|4-34/D5\|5-12\|RF3/JH6 | .................... | 14922 |
| 18088-E4 | VH4\|4-34/D5\|5-12\|RF3/JH6 | .................... | 14923 |
| VH3\|3-23/D6\|6-19\|RF1/JH6 | | AISGS---GGSTYYADSVKG | 14924 |
| 17771-D2 | VH3\|3-23/D6\|6-19\|RF1/JH6 | T..........D....... | 14925 |
| 18074-G12 | VH3\|3-23/D6\|6-19\|RF1/JH6 | S.TIT............... | 14926 |
| 18093-E2 | VH3\|3-23/D6\|6-19\|RF1/JH6 | T..H................ | 14927 |
| 18089-B2 | VH3\|3-23/D6\|6-19\|RF1/JH6 | T..I........N....... | 14928 |
| VH3\|3-23/D7\|7-27\|RF1/JH6 | | AISGS---GGSTYYADSVKG | 14929 |
| 17779-D11 | VH3\|3-23/D7\|7-27\|RF1/JH6 | ................A.. | 14930 |
| 18089-H12 | VH3\|3-23/D7\|7-27\|RF1/JH6 | .................... | 14931 |
| 18093-F5 | VH3\|3-23/D7\|7-27\|RF1/JH6 | .................... | 14932 |
| VH3\|3-23/D5\|5-18\|RF1/JH6 | | AISGS---GGSTYYADSVKG | 14933 |
| 17784-B9 | VH3\|3-23/D5\|5-18\|RF1/JH6 | .................... | 14934 |
| 17784-C7 | VH3\|3-23/D5\|5-18\|RF1/JH6 | .................... | 14935 |
| 18080-H9 | VH3\|3-23/D5\|5-18\|RF1/JH6 | G................... | 14936 |
| VH4\|4-30.1/D3\|3-10\|RF1/JH6 | | YIYY----SGSTYYNPSLKS | 14937 |

TABLE 63-continued

HEAVY_VARIABLE

| | Germline | | SEQ ID NO: |
|---|---|---|---|
| 17784-G10 | VH4\|4-30.1/D3\|3-10\|RF1/JH6 | ..................... | 14938 |
| 18080-C5 | VH4\|4-30.1/D3\|3-10\|RF1/JH6 | ...ND................ | 14939 |
| 18179-A3 | VH4\|4-30.1/D3\|3-10\|RF1/JH6 | ...S.........F....... | 14940 |
| 18179-A9 | VH4\|4-30.1/D3\|3-10\|RF1/JH6 | ...DK................ | 14941 |
| 18179-A10 | VH4\|4-30.1/D3\|3-10\|RF1/JH6 | ...DK................ | 14942 |
| 18179-C4 | VH4\|4-30.1/D3\|3-10\|RF1/JH6 | ...DK................ | 14943 |
| 18179-C6 | VH4\|4-30.1/D3\|3-10\|RF1/JH6 | ...DK................ | 14944 |
| 18179-C10 | VH4\|4-30.1/D3\|3-10\|RF1/JH6 | ...SH................ | 14945 |
| 18179-F4 | VH4\|4-30.1/D3\|3-10\|RF1/JH6 | ...S.........F....... | 14946 |
| 18179-F6 | VH4\|4-30.1/D3\|3-10\|RF1/JH6 | ...DK................ | 14947 |
| 18179-G8 | VH4\|4-30.1/D3\|3-10\|RF1/JH6 | ...DK................ | 14948 |
| 18179-G9 | VH4\|4-30.1/D3\|3-10\|RF1/JH6 | ..........S....... | 14949 |
| 18179-H6 | VH4\|4-30.1/D3\|3-10\|RF1/JH6 | ...DK................ | 14950 |
| 18181-A11 | VH4\|4-30.1/D3\|3-10\|RF1/JH6 | ...S................ | 14951 |
| 18181-C6 | VH4\|4-30.1/D3\|3-10\|RF1/JH6 | ...S................ | 14952 |
| 18181-G10 | VH4\|4-30.1/D3\|3-10\|RF1/JH6 | ...S.........F....... | 14953 |
| 18181-E2 | VH4\|4-30.1/D3\|3-10\|RF1/JH6 | ...SH................ | 14954 |
| 18181-C9 | VH4\|4-30.1/D3\|3-10\|RF1/JH6 | ...S.........F....... | 14955 |
| VH3\|3-23/D1\|1-1\|RF1/JH6 | | AISGS---GGSTYYADSVKG | 14956 |
| 17813-D8 | VH3\|3-23/D1\|1-1\|RF1/JH6 | ..................... | 14957 |
| VH3\|3-33/D3\|3-10\|RF2/JH6 | | VIWYD---GSNKYYADSVKG | 14958 |
| 18071-B1 | VH3\|3-33/D3\|3-10\|RF2/JH6 | L.................... | 14959 |
| 18082-F5 | VH3\|3-33/D3\|3-10\|RF2/JH6 | ..................... | 14960 |
| VH1\|1-08/D7\|7-27\|RF3/JH6 | | WMNPN---SGNTGYAQKFQG | 14961 |
| 18071-C4 | VH1\|1-08/D7\|7-27\|RF3/JH6 | ...........D....... | 14962 |
| 18071-D4 | VH1\|1-08/D7\|7-27\|RF3/JH6 | ...........D....... | 14963 |

TABLE 63-continued

| | HEAVY_VARIABLE | | |
|---|---|---|---|
| | Germline | | SEQ ID NO: |
| 18079-H4 | VH1\|1-08/D7\|7-27\|RF3/JH6 | ............D....... | 14964 |
| 18079-H11 | VH1\|1-08/D7\|7-27\|RF3/JH6 | ............D.T..... | 14965 |
| 18086-H4 | VH1\|1-08/D7\|7-27\|RF3/JH6 | ....K............D.. | 14966 |
| VH3\|3-21/D6\|6-6\|RF2/JH6 | | SISSS---SSYIYYADSVKG | 14967 |
| 18072-G9 | VH3\|3-21/D6\|6-6\|RF2/JH6 | .................... | 14968 |
| VH3\|3-30.3/D3\|3-10\|RF2/JH6 | | VISYD---GSNKYYADSVKG | 14969 |
| 18078-H6 | VH3\|3-30.3/D3\|3-10\|RF2/JH6 | .................... | 14970 |
| 18090-H9 | VH3\|3-30.3/D3\|3-10\|RF2/JH6 | .................... | 14971 |
| VH4\|4-59/D3\|3-3\|RF3/JH4 | | YIYY----SGSTNYNPSLKS | 14972 |
| 18081-A6 | VH4\|4-59/D3\|3-3\|RF3/JH4 | S..........Y....... | 14973 |
| 18081-B9 | VH4\|4-59/D3\|3-3\|RF3/JH4 | S..........Y....... | 14974 |
| 18081-E7 | VH4\|4-59/D3\|3-3\|RF3/JH4 | S..........Y....... | 14975 |
| 18081-B9_final | VH4\|4-59/D3\|3-3\|RF3/JH4 | S..........Y....... | 14976 |
| VH6\|6-01/D3\|3-10\|RF1/JH6 | | RTYYR--SKWYNDYAVSVKS | 14977 |
| 18081-B5 | VH6\|6-01/D3\|3-10\|RF1/JH6 | .................... | 14978 |
| VH4\|4-b/D3\|3-3\|RF3/JH5 | | SIYH----SGSTYYNPSLKS | 14979 |
| 18081-C10 | VH4\|4-b/D3\|3-3\|RF3/JH5 | ...Y....G........... | 14980 |
| VH2\|2-70/D2\|2-15\|RF1/JH5 | | RIDW----DDDKFYSTSLKT | 14981 |
| 18081-D6 | VH2\|2-70/D2\|2-15\|RF1/JH5 | L.Y.....N..TR..P..QS | 14982 |
| 18089-C8 | VH2\|2-70/D2\|2-15\|RF1/JH5 | L.Y.....N...R..P...S | 14983 |
| 18081-H11 | VH2\|2-70/D2\|2-15\|RF1/JH5 | L.Y.....N...R..P..QS | 14984 |
| VH3\|3-23/D1\|1-26\|RF1/JH6 | | AISGS---GGSTYYADSVKG | 14985 |
| 18081-D12 | VH3\|3-23/D1\|1-26\|RF1/JH6 | .................... | 14986 |
| VH4\|4-59/D3\|3-3\|RF3/JH5 | | YIYY----SGSTNYNPSLKS | 14987 |
| 18089-B8 | VH4\|4-59/D3\|3-3\|RF3/JH5 | S.......G...Y......N | 14988 |
| VH2\|2-05/D2\|2-15\|RF1/JH5 | | LIYW----NDDKRYSPSLKS | 14989 |
| 18089-G7 | VH2\|2-05/D2\|2-15\|RF1/JH5 | ...............Q. | 14990 |
| 18089-D11 | VH2\|2-05/D2\|2-15\|RF1/JH5 | ..............N...Q. | 14991 |

TABLE 63-continued

| | HEAVY_VARIABLE | | |
|---|---|---|---|
| | Germline | | SEQ ID NO: |
| 18089-C9 | VH2\|2-05/D2\|2-15\|RF1/JH5 | ................Q. | 14992 |
| 18089-D8 | VH2\|2-05/D2\|2-15\|RF1/JH5 | ................Q. | 14993 |
| 18081-F9 | VH2\|2-05/D2\|2-15\|RF1/JH5 | ................Q. | 14994 |
| 18081-B6 | VH2\|2-05/D2\|2-15\|RF1/JH5 | ................Q. | 14995 |
| 18409-F12_final | VH2\|2-05/D2\|2-15\|RF1/JH5 | ................Q. | 14996 |
| 18409-G10_final | VH2\|2-05/D2\|2-15\|RF1/JH5 | G.HI....Y.........Q. | 14997 |
| 18409-H7_final | VH2\|2-05/D2\|2-15\|RF1/JH5 | ................Q. | 14998 |
| 18409-H10_final | VH2\|2-05/D2\|2-15\|RF1/JH5 | ................Q. | 14999 |
| VH3\|3-23/D7\|7-27\|RF2/JH6 | | AISGS---GGSTYYADSVKG | 15000 |
| 18089-G11 | VH3\|3-23/D7\|7-27\|RF2/JH6 | G..........S........ | 15001 |
| 18089-H9 | VH3\|3-23/D7\|7-27\|RF2/JH6 | G................... | 15002 |
| VH4\|4-30.1/D3\|3-10\|RF3/JH6 | | YIYY----SGSTYYNPSLKS | 15003 |
| 18179-A5 | VH4\|4-30.1/D3\|3-10\|RF3/JH6 | ...DK............... | 15004 |
| 18179-C7 | VH4\|4-30.1/D3\|3-10\|RF3/JH6 | ...SH............... | 15005 |
| 18179-H9 | VH4\|4-30.1/D3\|3-10\|RF3/JH6 | ...SH............... | 15006 |
| 18181-H7 | VH4\|4-30.1/D3\|3-10\|RF3/JH6 | ...S.......I.N...... | 15007 |
| 18181-B8 | VH4\|4-30.1/D3\|3-10\|RF3/JH6 | ...SH............... | 15008 |
| 81-H7-SG-F28_final | VH4\|4-30.1/D3\|3-10\|RF3/JH6 | ..........I.N....... | 15009 |
| VH3\|3-15/D3\|3-10\|RF2/JH6 | | RIKSKT-DGGTTDYAAPVKG | 15010 |
| 18179-B7 | VH3\|3-15/D3\|3-10\|RF2/JH6 | ...GN..Y............ | 15011 |
| 18179-B8 | VH3\|3-15/D3\|3-10\|RF2/JH6 | ...GN..Y............ | 15012 |
| 18179-D8 | VH3\|3-15/D3\|3-10\|RF2/JH6 | ...GN..Y............ | 15013 |
| 18179-D9 | VH3\|3-15/D3\|3-10\|RF2/JH6 | ...GN..Y............ | 15014 |
| 18179-E6 | VH3\|3-15/D3\|3-10\|RF2/JH6 | ...GN..Y............ | 15015 |
| 18181-G7 | VH3\|3-15/D3\|3-10\|RF2/JH6 | ...GN..Y............ | 15016 |
| 18179-E1 | VH3\|3-15/D3\|3-10\|RF2/JH6 | ...GN..Y............ | 15017 |

TABLE 63-continued

HEAVY_VARIABLE

| | Germline | | SEQ ID NO: |
|---|---|---|---|
| 18179-H7 | VH3\|3-15/D3\|3-10\|RF2/JH6 | .......Y............ | 15018 |
| 18179-B12 | VH3\|3-15/D3\|3-10\|RF2/JH6 | ...GN..Y............ | 15019 |
| 18179-D11 | VH3\|3-15/D3\|3-10\|RF2/JH6 | ...GN..Y............ | 15020 |
| 18179-D7 | VH3\|3-15/D3\|3-10\|RF2/JH6 | ...GN..Y............ | 15021 |
| 18179-A7 | VH3\|3-15/D3\|3-10\|RF2/JH6 | ...GN..Y............ | 15022 |
| 18181-G8 | VH3\|3-15/D3\|3-10\|RF2/JH6 | ...GN..Y............ | 15023 |
| 18181-F3 | VH3\|3-15/D3\|3-10\|RF2/JH6 | ...GN..Y............ | 15024 |
| 18181-F1 | VH3\|3-15/D3\|3-10\|RF2/JH6 | ...GN..Y............ | 15025 |
| 18181-A6 | VH3\|3-15/D3\|3-10\|RF2/JH6 | ...GN..Y............ | 15026 |
| 18409-E2_final | VH3\|3-15/D3\|3-10\|RF2/JH6 | .......Y............ | 15027 |
| 18410-B5_final | VH3\|3-15/D3\|3-10\|RF2/JH6 | .R.RS.Y............ | 15028 |
| 18410-B6_final | VH3\|3-15/D3\|3-10\|RF2/JH6 | .......Y............ | 15029 |
| 18410-D3_final | VH3\|3-15/D3\|3-10\|RF2/JH6 | .T.SR.Y............ | 15030 |
| 18410-D6_final | VH3\|3-15/D3\|3-10\|RF2/JH6 | ..LNNA.Y............ | 15031 |
| 18410-H1_final | VH3\|3-15/D3\|3-10\|RF2/JH6 | ..T.GI.Y............ | 15032 |
| 18410-H3_final | VH3\|3-15/D3\|3-10\|RF2/JH6 | ..R.RP.Y............ | 15033 |
| VH4\|4-59/D3\|3-10\|RF3/JH6 | | YIYY----SGSTNYNPSLKS | 15034 |
| 18179-F3 | VH4\|4-59/D3\|3-10\|RF3/JH6 | H..T................ | 15035 |
| 18179-F10 | VH4\|4-59/D3\|3-10\|RF3/JH6 | ........R.....H...... | 15036 |
| 18181-H10 | VH4\|4-59/D3\|3-10\|RF3/JH6 | H..T.........F...... | 15037 |
| VH3\|3-23/D6\|6-19\|RF2/JH4 | | AISGS---GGSTYYADSVKG | 15038 |
| 18182-A3 | VH3\|3-23/D6\|6-19\|RF2/JH4 | .................... | 15039 |
| 18182-A5 | VH3\|3-23/D6\|6-19\|RF2/JH4 | ..........G......... | 15040 |
| 18182-A6 | VH3\|3-23/D6\|6-19\|RF2/JH4 | T.........G......... | 15041 |
| 18182-A7 | VH3\|3-23/D6\|6-19\|RF2/JH4 | ..........G......... | 15042 |
| 18182-A8 | VH3\|3-23/D6\|6-19\|RF2/JH4 | ..........G..N...... | 15043 |

TABLE 63-continued

HEAVY_VARIABLE

|  | Germline |  | SEQ ID NO: |
|---|---|---|---|
| 18182-A11 | VH3\|3-23/D6\|6-19\|RF2/JH4 | .........G......... | 15044 |
| 18182-B1 | VH3\|3-23/D6\|6-19\|RF2/JH4 | .........G..N...... | 15045 |
| 18182-B4 | VH3\|3-23/D6\|6-19\|RF2/JH4 | .........G........A | 15046 |
| 18182-B6 | VH3\|3-23/D6\|6-19\|RF2/JH4 | .........G......... | 15047 |
| 18182-B10 | VH3\|3-23/D6\|6-19\|RF2/JH4 | .........G......... | 15048 |
| 18182-C2 | VH3\|3-23/D6\|6-19\|RF2/JH4 | .........G......... | 15049 |
| 18182-C3 | VH3\|3-23/D6\|6-19\|RF2/JH4 | .........G......... | 15050 |
| 18182-C4 | VH3\|3-23/D6\|6-19\|RF2/JH4 | .........G......... | 15051 |
| 18182-C5 | VH3\|3-23/D6\|6-19\|RF2/JH4 | T........G......... | 15052 |
| 18182-C10 | VH3\|3-23/D6\|6-19\|RF2/JH4 | T........G......... | 15053 |
| 18182-C12 | VH3\|3-23/D6\|6-19\|RF2/JH4 | .........G......G.. | 15054 |
| 18182-D4 | VH3\|3-23/D6\|6-19\|RF2/JH4 | T........G......... | 15055 |
| 18182-D8 | VH3\|3-23/D6\|6-19\|RF2/JH4 | .........G......... | 15056 |
| 18182-D9 | VH3\|3-23/D6\|6-19\|RF2/JH4 | T........G......... | 15057 |
| 18182-D11 | VH3\|3-23/D6\|6-19\|RF2/JH4 | .........G......... | 15058 |
| 18182-E2 | VH3\|3-23/D6\|6-19\|RF2/JH4 | .........G......... | 15059 |
| 18182-E3 | VH3\|3-23/D6\|6-19\|RF2/JH4 | .........G......... | 15060 |
| 18182-E8 | VH3\|3-23/D6\|6-19\|RF2/JH4 | .........G......... | 15061 |
| 18182-E11 | VH3\|3-23/D6\|6-19\|RF2/JH4 | .........G........A | 15062 |
| 18182-F1 | VH3\|3-23/D6\|6-19\|RF2/JH4 | .........G......... | 15063 |
| 18182-F6 | VH3\|3-23/D6\|6-19\|RF2/JH4 | .........G......... | 15064 |
| 18182-F8 | VH3\|3-23/D6\|6-19\|RF2/JH4 | T........G......... | 15065 |
| 18182-G3 | VH3\|3-23/D6\|6-19\|RF2/JH4 | .........G......... | 15066 |
| 18182-G4 | VH3\|3-23/D6\|6-19\|RF2/JH4 | .........G......... | 15067 |
| 18182-G5 | VH3\|3-23/D6\|6-19\|RF2/JH4 | .........G..N...... | 15068 |

TABLE 63-continued

HEAVY_VARIABLE

| | Germline | | SEQ ID NO: |
|---|---|---|---|
| 18182-G9 | VH3\|3-23/D6-19\|RF2/JH4 | .........G......... | 15069 |
| 18182-G11 | VH3\|3-23/D6-19\|RF2/JH4 | .........G........A | 15070 |
| 18182-H5 | VH3\|3-23/D6-19\|RF2/JH4 | .........G..N...... | 15071 |
| 18182-B5 | VH3\|3-23/D6-19\|RF2/JH4 | .........G......... | 15072 |
| 18182-H9 | VH3\|3-23/D6-19\|RF2/JH4 | .........G........A | 15073 |
| 18182-E6 | VH3\|3-23/D6-19\|RF2/JH4 | .........G......... | 15074 |
| 18182-G6 | VH3\|3-23/D6-19\|RF2/JH4 | .........G......... | 15075 |
| 18182-G2 | VH3\|3-23/D6-19\|RF2/JH4 | .........G..N...... | 15076 |
| 18182-H12 | VH3\|3-23/D6-19\|RF2/JH4 | T........G......... | 15077 |
| 18182-G8 | VH3\|3-23/D6-19\|RF2/JH4 | .........G......G.. | 15078 |
| 18182-E10 | VH3\|3-23/D6-19\|RF2/JH4 | S........G....A.... | 15079 |
| 18182-B12 | VH3\|3-23/D6-19\|RF2/JH4 | .........G......... | 15080 |
| 18182-E5 | VH3\|3-23/D6-19\|RF2/JH4 | T........G......... | 15081 |
| 18182-A4 | VH3\|3-23/D6-19\|RF2/JH4 | S........G....A.... | 15082 |
| 18182-E1 | VH3\|3-23/D6-19\|RF2/JH4 | .........G..N...... | 15083 |
| 18403-F12-AS | VH3\|3-23/D6-19\|RF2/JH4 | .........G....A.... | 15084 |
| 18403-G10-AS | VH3\|3-23/D6-19\|RF2/JH4 | .........G....A.... | 15085 |
| 18398-C7_final | VH3\|3-23/D6-19\|RF2/JH4 | S........G....A.... | 15086 |
| 18403-D8_final | VH3\|3-23/D6-19\|RF2/JH4 | T........G......... | 15087 |
| 18403-D8_AS_final | VH3\|3-23/D6-19\|RF2/JH4 | T........G....A.... | 15088 |
| 18403-E11 AS_final | VH3\|3-23/D6-19\|RF2/JH4 | .........G..N.A.... | 15089 |
| 18403-F12_final | VH3\|3-23/D6-19\|RF2/JH4 | .........G......... | 15090 |
| 18403-F12-AS_final | VH3\|3-23/D6-19\|RF2/JH4 | .........G....A.... | 15091 |
| 18403-G10_final | VH3\|3-23/D6-19\|RF2/JH4 | .........G......... | 15092 |
| 18403-G10-AS_final | VH3\|3-23/D6-19\|RF2/JH4 | .........G....A.... | 15093 |

TABLE 63-continued

HEAVY_VARIABLE

| | Germline | | SEQ ID NO: |
|---|---|---|---|
| 18410-G10_final | VH3\|3-23/D6\|6-19\|RF2/JH4 | ..........G..N...... | 15094 |
| 18410-G10_AS_final | VH3\|3-23/D6\|6-19\|RF2/JH4 | ..........G...N.A.... | 15095 |
| VH3\|3-23/D6\|6-19\|RF2/JH1 | | AISGS---GGSTYYADSVKG | 15096 |
| 18182-B7 | VH3\|3-23/D6\|6-19\|RF2/JH1 | ..........G.......... | 15097 |
| VH3\|3-30.3/D1\|1-1\|RF2/JH4 | | VISYD---GSNKYYADSVKG | 15098 |
| 18089-D12 | VH3\|3-30.3/D1\|1-1\|RF2/JH4 | .................... | 15099 |
| 02-C1-86-A4-N-F5_final | VH3\|3-30.3/D1\|1-1\|RF2/JH4 | ........AETVK..E.... | 15100 |
| 18486-A4_final | VH3\|3-30.3/D1\|1-1\|RF2/JH4 | ........A......E.... | 15101 |
| VH1\|1-18/D6\|6-13\|RF2/JH4 | | WISAY---NGNTNYAQKLQG | 15102 |
| 18179-G12 | VH1\|1-18/D6\|6-13\|RF2/JH4 | ...G......D.......... | 15103 |
| 18179-C1 | VH1\|1-18/D6\|6-13\|RF2/JH4 | ...G......D.......... | 15104 |
| VH3\|3-11/D1\|1-1\|RF3/JH4 | | YISSS---GSTIYYADSVKG | 15105 |
| 18093-B11 | VH3\|3-11/D1\|1-1\|RF3/JH4 | ...K................ | 15106 |
| 03-F3-88-B3-F9_final | VH3\|3-11/D1\|1-1\|RF3/JH4 | ...K....SY.VT...A... | 15107 |

H_FR3

| | Germline | | SEQ ID NO: |
|---|---|---|---|
| VH1\|1-f/D2\|2-15\|RF3/JH4 | | RVTITADTSTDTAYMELSSLRSEDTAVYY-CAT | 15339 |
| 17724-C9 | VH1\|1-f/D2\|2-15\|RF3/JH4 | KAAL...K.SN..N.Q.N..T...S...F..R | 15340 |
| VH1\|1-e/D5\|5-18\|RF3/JH4 | | RVTITADKSTSTAYMELSSLRSEDTAVYY-CAR | 15341 |
| 17724-G6 | VH1\|1-e/D5\|5-18\|RF3/JH4 | KA.L......SR....Q....T...S...F... | 15342 |
| VH1\|1-e/D1\|1-1\|RF2/JH3 | | RVTITADKSTSTAYMELSSLRSEDTAVYY-CAR | 15343 |
| 17731-H8 | VH1\|1-e/D1\|1-1\|RF2/JH3 | KA.L-.....SN....Q....T...S...F... | 15344 |
| VH1\|1-08/D5\|5-18\|RF3/JH6 | | RVTMTRNTSISTAYMELSSLRSEDTAVYY-CAR | 15345 |
| 17732-A8 | VH1\|1-08/D5\|5-18\|RF3/JH6 | ............................. | 15346 |
| 17780-D12 | VH1\|1-08/D5\|5-18\|RF3/JH6 | ............................. | 15347 |
| VH1\|1-08/D5\|5-12\|RF3/JH6 | | RVTMTRNTSISTAYMELSSLRSEDTAVYY-CAR | 15348 |
| 17745-E5 | VH1\|1-08/D5\|5-12\|RF3/JH6 | ............................. | 15349 |

TABLE 63-continued

| | HEAVY_VARIABLE | | |
|---|---|---|---|
| | Germline | | SEQ ID NO: |
| 17777-B4 | VH1\|1-08/D5\|5-12\|RF3/JH6 | ................................15350 | |
| 17814-D9 | VH1\|1-08/D5\|5-12\|RF3/JH6 | ................................15351 | |
| VH4\|4-34/D5\|5-18\|RF3/JH6 | | RVTISVDTSKNQFSLKLSSVTAADTAVYY-CAR | 15352 |
| 17745-E8 | VH4\|4-34/D5\|5-18\|RF3/JH6 | ...S..G........................15353 | |
| 17777-C5 | VH4\|4-34/D5\|5-18\|RF3/JH6 | ...M.E..A......................15354 | |
| 17778-C9 | VH4\|4-34/D5\|5-18\|RF3/JH6 | .......A.......................15355 | |
| 17780-E6 | VH4\|4-34/D5\|5-18\|RF3/JH6 | .....E...R...................T.15356 | |
| 17781-B3 | VH4\|4-34/D5\|5-18\|RF3/JH6 | .......A.......................15357 | |
| 17781-H12 | VH4\|4-34/D5\|5-18\|RF3/JH6 | ...S..G........................15358 | |
| 17783-C11 | VH4\|4-34/D5\|5-18\|RF3/JH6 | .......A.......................15359 | |
| 17783-G10 | VH4\|4-34/D5\|5-18\|RF3/JH6 | ..........L....................15360 | |
| 17813-E3 | VH4\|4-34/D5\|5-18\|RF3/JH6 | ...M.E..A......................15361 | |
| 17813-F1 | VH4\|4-34/D5\|5-18\|RF3/JH6 | .......A.......................15362 | |
| VH3\|3-23/D3\|3-9\|RF1/JH4 | | RFTISRDNSKNTLYLQMNSLRAEDTAVYY-CAK | 15363 |
| 17745-G8 | VH3\|3-23/D3\|3-9\|RF1/JH4 | ................................15364 | |
| 17777-c4 | VH3\|3-23/D3\|3-9\|RF1/JH4 | ................................15365 | |
| 18072-D6 | VH3\|3-23/D3\|3-9\|RF1/JH4 | ................................15366 | |
| 18084-E4 | VH3\|3-23/D3\|3-9\|RF1/JH4 | ................................15367 | |
| 18088-B10 | VH3\|3-23/D3\|3-9\|RF1/JH4 | ................................15368 | |
| VH3\|3-30.3/D1\|1-1\|RF2/JH6 | | RFTISRDNSKNTLYLQMNSLRAEDTAVYY-CAR | 15369 |
| 17748-D12 | VH3\|3-30.3/D1\|1-1\|RF2/JH6 | ................................15370 | |
| 18079-C8 | VH3\|3-30.3/D1\|1-1\|RF2/JH6 | ............F.......T..........15371 | |
| VH4\|4-34/D5\|5-12\|RF3/JH6 | | RVTISVDTSKNQFSLKLSSVTAADTAVYY-CAR | 15372 |
| 17753-F4 | VH4\|4-34/D5\|5-12\|RF3/JH6 | ................................15373 | |
| 17778-F1 | VH4\|4-34/D5\|5-12\|RF3/JH6 | ................................15374 | |

TABLE 63-continued

HEAVY_VARIABLE

| | Germline | | SEQ ID NO: |
|---|---|---|---|
| 17778-H8 | VH4\|4-34/D5\|5-12\|RF3/JH6 | .......A........................ | 15375 |
| 17779-E1 | VH4\|4-34/D5\|5-12\|RF3/JH6 | ................................ | 15376 |
| 17784-C11 | VH4\|4-34/D5\|5-12\|RF3/JH6 | ................................ | 15377 |
| 17784-H5 | VH4\|4-34/D5\|5-12\|RF3/JH6 | .......P........................ | 15378 |
| 17785-D12 | VH4\|4-34/D5\|5-12\|RF3/JH6 | ................................ | 15379 |
| 17813-E5 | VH4\|4-34/D5\|5-12\|RF3/JH6 | ................................ | 15380 |
| 18088-E4 | VH4\|4-34/D5\|5-12\|RF3/JH6 | ................................ | 15381 |
| VH3\|3-23/D6\|6-19\|RF1/JH6 | | RFTISRDNSKNTLYLQMNSLRAEDTAVYYCAK | 15382 |
| 17771-D2 | VH3\|3-23/D6\|6-19\|RF1/JH6 | ................................ | 15383 |
| 18074-G12 | VH3\|3-23/D6\|6-19\|RF1/JH6 | ..............N................. | 15384 |
| 18093-E2 | VH3\|3-23/D6\|6-19\|RF1/JH6 | ................................ | 15385 |
| 18089-B2 | VH3\|3-23/D6\|6-19\|RF1/JH6 | ................................ | 15386 |
| VH3\|3-23/D7\|7-27\|RF1/JH6 | | RFTISRDNSKNTLYLQMNSLRAEDTAVYYCAK | 15387 |
| 17779-D11 | VH3\|3-23/D7\|7-27\|RF1/JH6 | ................................ | 15388 |
| 18089-H12 | VH3\|3-23/D7\|7-27\|RF1/JH6 | ................................ | 15389 |
| 18093-F5 | VH3\|3-23/D7\|7-27\|RF1/JH6 | ................................ | 15390 |
| VH3\|3-23/D5\|5-18\|RF1/JH6 | | RFTISRDNSKNTLYLQMNSLRAEDTAVYYCAK | 15391 |
| 17784-B9 | VH3\|3-23/D5\|5-18\|RF1/JH6 | ........................F... | 15392 |
| 17784-C7 | VH3\|3-23/D5\|5-18\|RF1/JH6 | ........................F... | 15393 |
| 18080-H9 | VH3\|3-23/D5\|5-18\|RF1/JH6 | ................................ | 15394 |
| VH4\|4-30.1/D3\|3-10\|RF1/JH6 | | RVTISVDTSKNQFSLKLSSVTAADTAVYYCAR | 15395 |
| 17784-G10 | VH4\|4-30.1/D3\|3-10\|RF1/JH6 | ................................ | 15396 |
| 18080-C5 | VH4\|4-30.1/D3\|3-10\|RF1/JH6 | ...L...S........................ | 15397 |
| 18179-A3 | VH4\|4-30.1/D3\|3-10\|RF1/JH6 | ..............N.T............... | 15398 |
| 18179-A9 | VH4\|4-30.1/D3\|3-10\|RF1/JH6 | ..............N.T............... | 15399 |

TABLE 63-continued

HEAVY_VARIABLE

| | Germline | | SEQ ID NO: |
|---|---|---|---|
| 18179-A10 | VH4\|4-30.1/D3\|3-10\|RF1/JH6 | .A........D..................... | 15400 |
| 18179-C4 | VH4\|4-30.1/D3\|3-10\|RF1/JH6 | .A........D..................... | 15401 |
| 18179-C6 | VH4\|4-30.1/D3\|3-10\|RF1/JH6 | .A........D..................... | 15402 |
| 18179-C10 | VH4\|4-30.1/D3\|3-10\|RF1/JH6 | ..................T............. | 15403 |
| 18179-F4 | VH4\|4-30.1/D3\|3-10\|RF1/JH6 | ................N.T............. | 15404 |
| 18179-F6 | VH4\|4-30.1/D3\|3-10\|RF1/JH6 | .A........D..................... | 15405 |
| 18179-G8 | VH4\|4-30.1/D3\|3-10\|RF1/JH6 | .A........D..................... | 15406 |
| 18179-G9 | VH4\|4-30.1/D3\|3-10\|RF1/JH6 | ....M...S.........T............. | 15407 |
| 18179-H6 | VH4\|4-30.1/D3\|3-10\|RF1/JH6 | .A.............................. | 15408 |
| 18181-A11 | VH4\|4-30.1/D3\|3-10\|RF1/JH6 | ................N.T............. | 15409 |
| 18181-C6 | VH4\|4-30.1/D3\|3-10\|RF1/JH6 | ................N.T............. | 15410 |
| 18181-G10 | VH4\|4-30.1/D3\|3-10\|RF1/JH6 | ................N.T............. | 15411 |
| 18181-E2 | VH4\|4-30.1/D3\|3-10\|RF1/JH6 | ................N.T............. | 15412 |
| 18181-C9 | VH4\|4-30.1/D3\|3-10\|RF1/JH6 | ................N.T............. | 15413 |
| VH3\|3-23/D1\|1-1\|RF1/JH6 | | RFTISRDNSKNTLYLQMNSLRAEDTAVYYCAK | 15414 |
| 17813-D8 | VH3\|3-23/D1\|1-1\|RF1/JH6 | ........................E.....  | 15415 |
| VH3\|3-33/D3\|3-10\|RF2/JH6 | | RFTISRDNSKNTLYLQMNSLRAEDTAVYYCAR | 15416 |
| 18071-B1 | VH3\|3-33/D3\|3-10\|RF2/JH6 | ................................ | 15417 |
| 18082-F5 | VH3\|3-33/D3\|3-10\|RF2/JH6 | ................................ | 15418 |
| VH1\|1-08/D7\|7-27\|RF3/JH6 | | RVTMTRNTSISTAYMELSSLRSEDTAVYYCAR | 15419 |
| 18071-C4 | VH1\|1-08/D7\|7-27\|RF3/JH6 | ..............................V | 15420 |
| 18071-D4 | VH1\|1-08/D7\|7-27\|RF3/JH6 | ................................ | 15421 |
| 18079-H4 | VH1\|1-08/D7\|7-27\|RF3/JH6 | ..................R............. | 15422 |
| 18079-H11 | VH1\|1-08/D7\|7-27\|RF3/JH6 | ..........G...................V | 15423 |
| 18086-H4 | VH1\|1-08/D7\|7-27\|RF3/JH6 | .......................D......V | 15424 |

TABLE 63-continued

HEAVY_VARIABLE

| | Germline | | SEQ ID NO: |
|---|---|---|---|
| VH3\|3-21/D6\|6-6\|RF2/JH6 | | RFTISRDNAKNSLYLQMNSLRAEDTAVYY-CAR | 15425 |
| 18072-G9 | VH3\|3-21/D6\|6-6\|RF2/JH6 | ................................V. | 15426 |
| VH3\|3-30.3/D3\|3-10\|RF2/JH6 | | RFTISRDNSKNTLYLQMNSLRAEDTAVYY-CAR | 15427 |
| 18078-H6 | VH3\|3-30.3/D3\|3-10\|RF2/JH6 | ................................ | 15428 |
| 18090-H9 | VH3\|3-30.3/D3\|3-10\|RF2/JH6 | ................................ | 15429 |
| VH4\|4-59/D3\|3-3\|RF3/JH4 | | RVTISVDTSKNQFSLKLSSVTAADTAVYY-CAR | 15430 |
| 18081-A6 | VH4\|4-59/D3\|3-3\|RF3/JH4 | ................................ | 15431 |
| 18081-B9 | VH4\|4-59/D3\|3-3\|RF3/JH4 | ................................ | 15432 |
| 18081-E7 | VH4\|4-59/D3\|3-3\|RF3/JH4 | ................................ | 15433 |
| 18081-B9_final | VH4\|4-59/D3\|3-3\|RF3/JH4 | ................................ | 15434 |
| VH6\|6-01/D3\|3-10\|RF1/JH6 | | RITINPDTSKNQFSLQLNSVTPEDTAVYY-CAR | 15435 |
| 18081-B5 | VH6\|6-01/D3\|3-10\|RF1/JH6 | ................................ | 15436 |
| VH4\|4-b/D3\|3-3\|RF3/JH5 | | RVTISVDTSKNQFSLKLSSVTAADTAVYY-CAR | 15437 |
| 18081-C10 | VH4\|4-b/D3\|3-3\|RF3/JH5 | ...............................T | 15438 |
| VH2\|2-70/D2\|2-15\|RF1/JH5 | | RLTISKDTSKNQVVLTMTNMDPVDTATYY-CAR | 15439 |
| 18081-D6 | VH2\|2-70/D2\|2-15\|RF1/JH5 | ....T.........................VY | 15440 |
| 18089-C8 | VH2\|2-70/D2\|2-15\|RF1/JH5 | ....T........................... | 15441 |
| 18081-H11 | VH2\|2-70/D2\|2-15\|RF1/JH5 | ....T..........................Y | 15442 |
| VH3\|3-23/D1\|1-26\|RF1/JH6 | | RFTISRDNSKNTLYLQMNSLRAEDTAVYY-CAK | 15443 |
| 18081-D12 | VH3\|3-23/D1\|1-26\|RF1/JH6 | ................................ | 15444 |
| VH4\|4-59/D3\|3-3\|RF3/JH5 | | RVTISVDTSKNQFSLKLSSVTAADTAVYY-CAR | 15445 |
| 18089-B8 | VH4\|4-59/D3\|3-3\|RF3/JH5 | ...M...........................T | 15446 |
| VH2\|2-05/D2\|2-15\|RF1/JH5 | | RLTITKDTSKNQVVLTMTNMDPVDTATYY-CAH | 15447 |
| 18089-G7 | VH2\|2-05/D2\|2-15\|RF1/JH5 | ...............................Y | 15448 |
| 18089-D11 | VH2\|2-05/D2\|2-15\|RF1/JH5 | ...............................Y | 15449 |

TABLE 63-continued

HEAVY_VARIABLE

| | Germline | | SEQ ID NO: |
|---|---|---|---|
| 18089-C9 | VH2\|2-05/D2\|2-15\|RF1/JH5 | ................................Y15450 | |
| 18089-D8 | VH2\|2-05/D2\|2-15\|RF1/JH5 | ................................Y15451 | |
| 18081-F9 | VH2\|2-05/D2\|2-15\|RF1/JH5 | ................................Y15452 | |
| 18081-B6 | VH2\|2-05/D2\|2-15\|RF1/JH5 | ................................Y15453 | |
| 18409-F12_final | VH2\|2-05/D2\|2-15\|RF1/JH5 | ................................Y15454 | |
| 18409-G10_final | VH2\|2-05/D2\|2-15\|RF1/JH5 | ................................Y15455 | |
| 18409-H7_final | VH2\|2-05/D2\|2-15\|RF1/JH5 | ................................Y15456 | |
| 18409-H10_final | VH2\|2-05/D2\|2-15\|RF1/JH5 | ................................Y15457 | |
| VH3\|3-23/D7\|7-27\|RF2/JH6 | | RFTISRDNSKNTLYLQMNSLRAEDTAVYY-CAK | 15458 |
| 18089-G11 | VH3\|3-23/D7\|7-27\|RF2/JH6 | ................................15459 | |
| 18089-H9 | VH3\|3-23/D7\|7-27\|RF2/JH6 | ................................15460 | |
| VH4\|4-30.1/D3\|3-10\|RF3/JH6 | | RVTISVDTSKNQFSLKLSSVTAADTAVYY-CAR | 15461 |
| 18179-A5 | VH4\|4-30.1/D3\|3-10\|RF3/JH6 | .A........D.......T.L...........15462 | |
| 18179-C7 | VH4\|4-30.1/D3\|3-10\|RF3/JH6 | .................N.T............15463 | |
| 18179-H9 | VH4\|4-30.1/D3\|3-10\|RF3/JH6 | .................N.T............15464 | |
| 18181-H7 | VH4\|4-30.1/D3\|3-10\|RF3/JH6 | ....M.............T.L............15465 | |
| 18181-B8 | VH4\|4-30.1/D3\|3-10\|RF3/JH6 | .................N.T............15466 | |
| 81-H7-SG-F28_final | VH4\|4-30.1/D3\|3-10\|RF3/JH6 | ....M.............T.L............15467 | |
| VH3\|3-15/D3\|3-10\|RF2/JH6 | | RFTISRDDSKNTLYLQMNSLKTED-TAVYYCTT | 15468 |
| 18179-B7 | VH3\|3-15/D3\|3-10\|RF2/JH6 | ..............F..................15469 | |
| 18179-B8 | VH3\|3-15/D3\|3-10\|RF2/JH6 | ..............F..................15470 | |
| 18179-D8 | VH3\|3-15/D3\|3-10\|RF2/JH6 | ..............F..................15471 | |
| 18179-D9 | VH3\|3-15/D3\|3-10\|RF2/JH6 | ..............F..................15472 | |
| 18179-E6 | VH3\|3-15/D3\|3-10\|RF2/JH6 | ..............F..................15473 | |
| 18181-G7 | VH3\|3-15/D3\|3-10\|RF2/JH6 | ..............F..................15474 | |

TABLE 63-continued

| | HEAVY_VARIABLE | | |
|---|---|---|---|
| | Germline | | SEQ ID NO: |
| 18179-E1 | VH3\|3-15/D3-10\|RF2/JH6 | ...............................15475 | |
| 18179-H7 | VH3\|3-15/D3-10\|RF2/JH6 | ...............................15476 | |
| 18179-B12 | VH3\|3-15/D3-10\|RF2/JH6 | ..............F................15477 | |
| 18179-D11 | VH3\|3-15/D3-10\|RF2/JH6 | ..............F................15478 | |
| 18179-D7 | VH3\|3-15/D3-10\|RF2/JH6 | ..............F................15479 | |
| 18179-A7 | VH3\|3-15/D3-10\|RF2/JH6 | ..............F................15480 | |
| 18181-G8 | VH3\|3-15/D3-10\|RF2/JH6 | ..............F................15481 | |
| 18181-F3 | VH3\|3-15/D3-10\|RF2/JH6 | ..............F................15482 | |
| 18181-F1 | VH3\|3-15/D3-10\|RF2/JH6 | ..............F................15483 | |
| 18181-A6 | VH3\|3-15/D3-10\|RF2/JH6 | ...............................15484 | |
| 18409-E2_final | VH3\|3-15/D3-10\|RF2/JH6 | ..............F................15485 | |
| 18410-B5_final | VH3\|3-15/D3-10\|RF2/JH6 | ..............F................15486 | |
| 18410-B6_final | VH3\|3-15/D3-10\|RF2/JH6 | ...............................15487 | |
| 18410-D3_final | VH3\|3-15/D3-10\|RF2/JH6 | ..............F................15488 | |
| 18410-D6_final | VH3\|3-15/D3-10\|RF2/JH6 | ...............................15489 | |
| 18410-H1_final | VH3\|3-15/D3-10\|RF2/JH6 | ...............................15490 | |
| 18410-H3_final | VH3\|3-15/D3-10\|RF2/JH6 | ...............................15491 | |
| VH4\|4-59/D3\|3-10\|RF3/JH6 | | RVTISVDTSKNQFSLKLSSVTAADTAVYY-CAR | 15492 |
| 18179-F3 | VH4\|4-59/D3-10\|RF3/JH6 | ...M...S.........T.L........... | 15493 |
| 18179-F10 | VH4\|4-59/D3-10\|RF3/JH6 | ...M.............T.L........... | 15494 |
| 18181-H10 | VH4\|4-59/D3-10\|RF3/JH6 | ...M.............T.L........... | 15495 |
| VH3\|3-23/D6\|6-19\|RF2/JH4 | | RFTISRDNSKNTLYLQMNSLRAEDTAVYY-CAK | 15496 |
| 18182-A3 | VH3\|3-23/D6\|6-19\|RF2/JH4 | ...............................T | 15497 |
| 18182-A5 | VH3\|3-23/D6\|6-19\|RF2/JH4 | ...............................T | 15498 |
| 18182-A6 | VH3\|3-23/D6\|6-19\|RF2/JH4 | ...............................T | 15499 |

TABLE 63-continued

HEAVY_VARIABLE

| | Germline | | SEQ ID NO: |
|---|---|---|---|
| 18182-A7 | VH3\|3-23/D6\|6-19\|RF2/JH4 | ................................T | 15500 |
| 18182-A8 | VH3\|3-23/D6\|6-19\|RF2/JH4 | ........................A...VT | 15501 |
| 18182-A11 | VH3\|3-23/D6\|6-19\|RF2/JH4 | ................................T | 15502 |
| 18182-B1 | VH3\|3-23/D6\|6-19\|RF2/JH4 | ................................T | 15503 |
| 18182-B4 | VH3\|3-23/D6\|6-19\|RF2/JH4 | ................................T | 15504 |
| 18182-B6 | VH3\|3-23/D6\|6-19\|RF2/JH4 | ................................T | 15505 |
| 18182-B10 | VH3\|3-23/D6\|6-19\|RF2/JH4 | ................................T | 15506 |
| 18182-C2 | VH3\|3-23/D6\|6-19\|RF2/JH4 | ................................T | 15507 |
| 18182-C3 | VH3\|3-23/D6\|6-19\|RF2/JH4 | ................................T | 15508 |
| 18182-C4 | VH3\|3-23/D6\|6-19\|RF2/JH4 | ................................T | 15509 |
| 18182-C5 | VH3\|3-23/D6\|6-19\|RF2/JH4 | ................................T | 15510 |
| 18182-C10 | VH3\|3-23/D6\|6-19\|RF2/JH4 | ................................T | 15511 |
| 18182-C12 | VH3\|3-23/D6\|6-19\|RF2/JH4 | ................................T | 15512 |
| 18182-D4 | VH3\|3-23/D6\|6-19\|RF2/JH4 | ................................P | 15513 |
| 18182-D8 | VH3\|3-23/D6\|6-19\|RF2/JH4 | ................................T | 15514 |
| 18182-D9 | VH3\|3-23/D6\|6-19\|RF2/JH4 | ................................T | 15515 |
| 18182-D11 | VH3\|3-23/D6\|6-19\|RF2/JH4 | ................................T | 15516 |
| 18182-E2 | VH3\|3-23/D6\|6-19\|RF2/JH4 | ................................T | 15517 |
| 18182-E3 | VH3\|3-23/D6\|6-19\|RF2/JH4 | ................................T | 15518 |
| 18182-E8 | VH3\|3-23/D6\|6-19\|RF2/JH4 | ....................S............T | 15519 |
| 18182-E11 | VH3\|3-23/D6\|6-19\|RF2/JH4 | ................................T | 15520 |
| 18182-F1 | VH3\|3-23/D6\|6-19\|RF2/JH4 | ................................T | 15521 |
| 18182-F6 | VH3\|3-23/D6\|6-19\|RF2/JH4 | ................................T | 15522 |
| 18182-F8 | VH3\|3-23/D6\|6-19\|RF2/JH4 | ................................T | 15523 |
| 18182-G3 | VH3\|3-23/D6\|6-19\|RF2/JH4 | ................................T | 15524 |

TABLE 63-continued

| | HEAVY_VARIABLE | | |
|---|---|---|---|
| | Germline | | SEQ ID NO: |
| 18182-G4 | VH3\|3-23/D6\|6-19\|RF2/JH4 | ..................S.............T | 15525 |
| 18182-G5 | VH3\|3-23/D6\|6-19\|RF2/JH4 | ..........................A...VT | 15526 |
| 18182-G9 | VH3\|3-23/D6\|6-19\|RF2/JH4 | ..............................T | 15527 |
| 18182-G11 | VH3\|3-23/D6\|6-19\|RF2/JH4 | ..............................T | 15528 |
| 18182-H5 | VH3\|3-23/D6\|6-19\|RF2/JH4 | ..........................A...VT | 15529 |
| 18182-B5 | VH3\|3-23/D6\|6-19\|RF2/JH4 | ..............................T | 15530 |
| 18182-H9 | VH3\|3-23/D6\|6-19\|RF2/JH4 | ..............................T | 15531 |
| 18182-E6 | VH3\|3-23/D6\|6-19\|RF2/JH4 | ..............................T | 15532 |
| 18182-G6 | VH3\|3-23/D6\|6-19\|RF2/JH4 | ..........................A...VT | 15533 |
| 18182-G2 | VH3\|3-23/D6\|6-19\|RF2/JH4 | ..........................A...VT | 15534 |
| 18182-H12 | VH3\|3-23/D6\|6-19\|RF2/JH4 | ..............................T | 15535 |
| 18182-G8 | VH3\|3-23/D6\|6-19\|RF2/JH4 | ..............................T | 15536 |
| 18182-E10 | VH3\|3-23/D6\|6-19\|RF2/JH4 | ..............................T | 15537 |
| 18182-B12 | VH3\|3-23/D6\|6-19\|RF2/JH4 | ..................S.............T | 15538 |
| 18182-E5 | VH3\|3-23/D6\|6-19\|RF2/JH4 | ..............................T | 15539 |
| 18182-A4 | VH3\|3-23/D6\|6-19\|RF2/JH4 | ..............................T | 15540 |
| 18182-E1 | VH3\|3-23/D6\|6-19\|RF2/JH4 | ..........................A...VT | 15541 |
| 18403-F12-AS | VH3\|3-23/D6\|6-19\|RF2/JH4 | ..................S............VT | 15542 |
| 18403-G10-AS | VH3\|3-23/D6\|6-19\|RF2/JH4 | ..................S.............T | 15543 |
| 18398-C7_final | VH3\|3-23/D6\|6-19\|RF2/JH4 | ..............................T | 15544 |
| 18403-D8_final | VH3\|3-23/D6\|6-19\|RF2/JH4 | ..............................T | 15545 |
| 18403-D8_AS_final | VH3\|3-23/D6\|6-19\|RF2/JH4 | ..............................T | 15546 |
| 18403-E11 AS_final | VH3\|3-23/D6\|6-19\|RF2/JH4 | ..........................A...VT | 15547 |
| 18403-F12_final | VH3\|3-23/D6\|6-19\|RF2/JH4 | ..................S............VT | 15548 |
| 18403-F12-AS_final | VH3\|3-23/D6\|6-19\|RF2/JH4 | ..................S............VT | 15549 |

TABLE 63-continued

HEAVY_VARIABLE

| | Germline | | SEQ ID NO: |
|---|---|---|---|
| 18403-G10_final | VH3\|3-23/D6\|6-19\|RF2/JH4 | ..................S.............T | 15550 |
| 18403-G10-AS_final | VH3\|3-23/D6\|6-19\|RF2/JH4 | ..................S.............T | 15551 |
| 18410-G10_final | VH3\|3-23/D6\|6-19\|RF2/JH4 | ...............................T | 15552 |
| 18410-G10_AS_final | VH3\|3-23/D6\|6-19\|RF2/JH4 | ...............................T | 15553 |
| VH3\|3-23/D6\|6-19\|RF2/JH1 | | RFTISRDNSKNTLYLQMNSLRAEDTAVYY-CAK | 15554 |
| 18182-B7 | VH3\|3-23/D6\|6-19\|RF2/JH1 | ...............................T | 15555 |
| VH3\|3-30.3/D1\|1-1\|RF2/JH4 | | RFTISRDNSKNTLYLQMNSLRAEDTAVYY-CAR | 15556 |
| 18089-D12 | VH3\|3-30.3/D1\|1-1\|RF2/JH4 | .......D........................ | 15557 |
| 02-C1-86-A4-N-F5_final | VH3\|3-30.3/D1\|1-1\|RF2/JH4 | ................................ | 15558 |
| 18486-A4_final | VH3\|3-30.3/D1\|1-1\|RF2/JH4 | ................................ | 15559 |
| VH1\|1-18/D6\|6-13\|RF2/JH4 | | RVTMTTDTSTSTAYMELRSLRSDDTAVYY-CAR | 15560 |
| 18179-G12 | VH1\|1-18/D6\|6-13\|RF2/JH4 | .G.............................. | 15561 |
| 18179-C1 | VH1\|1-18/D6\|6-13\|RF2/JH4 | .G.............................. | 15562 |
| VH3\|3-11/D1\|1-1\|RF3/JH4 | | RFTISRDNAKNSLYLQMNSLRAEDTAVYY-CAR | 15563 |
| 18093-B11 | VH3\|3-11/D1\|1-1\|RF3/JH4 | ...............................T | 15564 |
| 03-F3-88-B3-F9_final | VH3\|3-11/D1\|1-1\|RF3/JH4 | ...............................T | 15565 |

H_CDR3

| | | | |
|---|---|---|---|
| VH1\|1-f/D2\|2-15\|RF3/JH4 | | DIVVVA-----------------ATYFDY | 15797 |
| 17724-C9 | VH1\|1-f/D2\|2-15\|RF3/JH4 | .G.FY--.................-APLA. | 15798 |
| VH1\|1-e/D5\|5-18\|RF3/JH4 | | GYSYG------------------YYFDY | 15799 |
| 17724-G6 | VH1\|1-e/D5\|5-18\|RF3/JH4 | NYF.SS................EA.... | 15800 |
| VH1\|1-e/D1\|1-1\|RF2/JH3 | | VQLER------------------DAFDI | 15801 |
| 17731-H8 | VH1\|1-e/D1\|1-1\|RF2/JH3 | R..NHV..................F.M.Y | 15802 |
| VH1\|1-08/D5\|5-18\|RF3/JH6 | | GYSYGYYY---------------YYYGMDV | 15803 |
| 17732-A8 | VH1\|1-08/D5\|5-18\|RF3/JH6 | .GG.SNG-................D..... | 15804 |
| 17780-D12 | VH1\|1-08/D5\|5-18\|RF3/JH6 | .GG.SNG-................D..... | 15805 |
| VH1\|1-08/D5\|5-12\|RF3/JH6 | | GYSGYDYY--------------YYYYGMDV | 15806 |
| 17745-E5 | VH1\|1-08/D5\|5-12\|RF3/JH6 | .GGYSG-.................D..... | 15807 |

TABLE 63-continued

HEAVY_VARIABLE

| | Germline | | SEQ ID NO: |
|---|---|---|---|
| 17777-B4 | VH1\|1-08/D5\|5-12\|RF3/JH6 | .GGYSYG-................D..... | 15808 |
| 17814-D9 | VH1\|1-08/D5\|5-12\|RF3/JH6 | .GGYSYG-................D..... | 15809 |
| VH4\|4-34/D5\|5-18\|RF3/JH6 | | GYSYGYYY---------------YYYGMDV | 15810 |
| 17745-E8 | VH4\|4-34/D5\|5-18\|RF3/JH6 | .GG.SHG-................D..... | 15811 |
| 17777-C5 | VH4\|4-34/D5\|5-18\|RF3/JH6 | .GG.SDG-................D..... | 15812 |
| 17778-C9 | VH4\|4-34/D5\|5-18\|RF3/JH6 | .GG.SDG-................D..... | 15813 |
| 17780-E6 | VH4\|4-34/D5\|5-18\|RF3/JH6 | .GG.SHG-................D..... | 15814 |
| 17781-B3 | VH4\|4-34/D5\|5-18\|RF3/JH6 | .GG.SDG-................D..... | 15815 |
| 17781-H12 | VH4\|4-34/D5\|5-18\|RF3/JH6 | .GG.SHG-................D..... | 15816 |
| 17783-C11 | VH4\|4-34/D5\|5-18\|RF3/JH6 | .GG.SDG-................D..... | 15817 |
| 17783-G10 | VH4\|4-34/D5\|5-18\|RF3/JH6 | .GG.SDG-................D..... | 15818 |
| 17813-E3 | VH4\|4-34/D5\|5-18\|RF3/JH6 | .GG.SDG-................D..... | 15819 |
| 17813-F1 | VH4\|4-34/D5\|5-18\|RF3/JH6 | .GG.SDG-................D..... | 15820 |
| VH3\|3-23/D3\|3-9\|RF1/JH4 | | VLRYFDW---------------LL*YFDY | 15821-15822 |
| 17745-G8 | VH3\|3-23/D3\|3-9\|RF1/JH4 | H.....-...............--WPL.. | 15823 |
| 17777-C4 | VH3\|3-23/D3\|3-9\|RF1/JH4 | H...S.-...............--WPL.. | 15824 |
| 18072-D6 | VH3\|3-23/D3\|3-9\|RF1/JH4 | H.....-...............--WPL.. | 15825 |
| 18084-E4 | VH3\|3-23/D3\|3-9\|RF1/JH4 | H...S.-...............--WPL.. | 15826 |
| 18088-B10 | VH3\|3-23/D3\|3-9\|RF1/JH4 | H.....-...............--WPL.. | 15827 |
| VH3\|3-30.3/D1\|1-1\|RF2/JH6 | | VQLERYY---------------YYYGMDV | 15828 |
| 17748-D12 | VH3\|3-30.3/D1\|1-1\|RF2/JH6 | E.WPN.-..................-..... | 15829 |
| 18079-C8 | VH3\|3-30.3/D1\|1-1\|RF2/JH6 | E.WPN.-..................-...LG. | 15830 |
| VH4\|4-34/D5\|5-12\|RF3/JH6 | | GYSGYDYY--------------YYYYGMDV | 15831 |
| 17753-F4 | VH4\|4-34/D5\|5-12\|RF3/JH6 | .GGYSYG-................-.D..... | 15832 |
| 17778-F1 | VH4\|4-34/D5\|5-12\|RF3/JH6 | .GGYSYG-................-.D..... | 15833 |
| 17778-H8 | VH4\|4-34/D5\|5-12\|RF3/JH6 | .GGYSYG-................-.D..... | 15834 |

TABLE 63-continued

| | HEAVY_VARIABLE | | |
|---|---|---|---|
| | Germline | | SEQ ID NO: |
| 17779-E1 | VH4\|4-34/D5\|5-12\|RF3/JH6 | .GGYSYG-...............-.D..... | 15835 |
| 17784-C11 | VH4\|4-34/D5\|5-12\|RF3/JH6 | .GGYSYG-...............-.D..... | 15836 |
| 17784-H5 | VH4\|4-34/D5\|5-12\|RF3/JH6 | .GGYSYG-...............-.D..... | 15837 |
| 17785-D12 | VH4\|4-34/D5\|5-12\|RF3/JH6 | .GGYSYG-...............-.D..... | 15838 |
| 17813-E5 | VH4\|4-34/D5\|5-12\|RF3/JH6 | .GGYSYG-...............-.D..... | 15839 |
| 18088-E4 | VH4\|4-34/D5\|5-12\|RF3/JH6 | .GGYSYG-...............-.D..... | 15840 |
| VH3\|3-23/D6\|6-19\|RF1/JH6 | | GYSSGWYY--------------YYYYGMDV | 15841 |
| 17771-D2 | VH3\|3-23/D6\|6-19\|RF1/JH6 | DGG...FPK............LLH..L.. | 15842 |
| 18074-G12 | VH3\|3-23/D6\|6-19\|RF1/JH6 | DGG...FPK............LLH..L.. | 15843 |
| 18093-E2 | VH3\|3-23/D6\|6-19\|RF1/JH6 | DGG...FPK............LLH..L.. | 15844 |
| 18089-B2 | VH3\|3-23/D6\|6-19\|RF1/JH6 | DGG...FPK............LLH..L.. | 15845 |
| VH3\|3-23/D7\|7-27\|RF1/JH6 | | LTGYYY-----------------YYGMDV | 15846 |
| 17779-D11 | VH3\|3-23/D7\|7-27\|RF1/JH6 | .VTPD..................... | 15847 |
| 18089-H12 | VH3\|3-23/D7\|7-27\|RF1/JH6 | QG.IAAAY..............YY.D.... | 15848 |
| 18093-F5 | VH3\|3-23/D7\|7-27\|RF1/JH6 | GE.ISARY...............Y...... | 15849 |
| VH3\|3-23/D5\|5-18\|RF1/JH6 | | VDTAMVYY--------------YYYGMDV | 15850 |
| 17784-B9 | VH3\|3-23/D5\|5-18\|RF1/JH6 | .M.PDY--................-...D... | 15851 |
| 17784-C7 | VH3\|3-23/D5\|5-18\|RF1/JH6 | .M.PDY--................-...D... | 15852 |
| 18080-H9 | VH3\|3-23/D5\|5-18\|RF1/JH6 | .M.PDY--................-...D... | 15853 |
| VH4\|4-30.1/D3\|3-10\|RF1/JH6 | | VLLWFGELL*-----------YYYYYGMDV | 15854-15855 |
| 17784-G10 | VH4\|4-30.1/D3\|3-10\|RF1/JH6 | DK....K.--.....-N....... | 15856 |
| 18080-C5 | VH4\|4-30.1/D3\|3-10\|RF1/JH6 | D.....K.--.....-N....... | 15857 |
| 18179-A3 | VH4\|4-30.1/D3\|3-10\|RF1/JH6 | DR....V.--.....-N....... | 15858 |
| 18179-A9 | VH4\|4-30.1/D3\|3-10\|RF1/JH6 | DR....V.--.....-N....... | 15859 |
| 18179-A10 | VH4\|4-30.1/D3\|3-10\|RF1/JH6 | DQ....V.--.....-N....... | 15860 |
| 18179-c4 | VH4\|4-30.1/D3\|3-10\|RF1/JH6 | DR....V.--.....-N....... | 15861 |

TABLE 63-continued

HEAVY_VARIABLE

| | Germline | | SEQ ID NO: |
|---|---|---|---|
| 18179-C6 | VH4\|4-30.1/D3\|3-10\|RF1/JH6 | DQ....V.--..........-N....... | 15862 |
| 18179-C10 | VH4\|4-30.1/D3\|3-10\|RF1/JH6 | DR....V.--..........-N....... | 15863 |
| 18179-F4 | VH4\|4-30.1/D3\|3-10\|RF1/JH6 | DR....V.--..........-N....... | 15864 |
| 18179-F6 | VH4\|4-30.1/D3\|3-10\|RF1/JH6 | DQ....V.--..........-N....... | 15865 |
| 18179-G8 | VH4\|4-30.1/D3\|3-10\|RF1/JH6 | DQ....V.--..........-N....... | 15866 |
| 18179-G9 | VH4\|4-30.1/D3\|3-10\|RF1/JH6 | D.....K.--..........-N....L.. | 15867 |
| 18179-H6 | VH4\|4-30.1/D3\|3-10\|RF1/JH6 | D.....K.--..........-N....L.. | 15868 |
| 18181-A11 | VH4\|4-30.1/D3\|3-10\|RF1/JH6 | DR....V.--..........-N....... | 15869 |
| 18181-C6 | VH4\|4-30.1/D3\|3-10\|RF1/JH6 | DR....V.--..........-N....... | 15870 |
| 18181-G10 | VH4\|4-30.1/D3\|3-10\|RF1/JH6 | DR....V.--..........-N....... | 15871 |
| 18181-E2 | VH4\|4-30.1/D3\|3-10\|RF1/JH6 | DR....V.--..........-N....... | 15872 |
| 18181-C9 | VH4\|4-30.1/D3\|3-10\|RF1/JH6 | DR....V.--..........-N....... | 15873 |
| VH3\|3-23/D1\|1-1\|RF1/JH6 | | GTTGTYY----------------YYYGMDV | 15874 |
| 17813-D8 | VH3\|3-23/D1\|1-1\|RF1/JH6 | MV.PD.-................-..D... | 15875 |
| VH3\|3-33/D3\|3-10\|RF2/JH6 | | YYYGSGSYYN----------YYYYYGMDV | 15876 |
| 18071-B1 | VH3\|3-33/D3\|3-10\|RF2/JH6 | N.GSGSYGA-..............-...H.... | 15877 |
| 18082-F5 | VH3\|3-33/D3\|3-10\|RF2/JH6 | N.GSGSYGA-..............-...H.... | 15878 |
| VH1\|1-08/D7\|7-27\|RF3/JH6 | | NWGYYY------------------YYGMDV | 15879 |
| 18071-C4 | VH1\|1-08/D7\|7-27\|RF3/JH6 | G..T..................... | 15880 |
| 18071-D4 | VH1\|1-08/D7\|7-27\|RF3/JH6 | G..R................S..... | 15881 |
| 18079-H4 | VH1\|1-08/D7\|7-27\|RF3/JH6 | G..RF...............S..... | 15882 |
| 18079-H11 | VH1\|1-08/D7\|7-27\|RF3/JH6 | G..T..................... | 15883 |
| 18086-H4 | VH1\|1-08/D7\|7-27\|RF3/JH6 | G..T..................... | 15884 |
| VH3\|3-21/D6\|6-6\|RF2/JH6 | | SIAARYY----------------YYYGMDV | 15885 |
| 18072-G9 | VH3\|3-21/D6\|6-6\|RF2/JH6 | .K...P-................-DD.... | 15886 |

TABLE 63-continued

| | Germline | HEAVY_VARIABLE | SEQ ID NO: |
|---|---|---|---|
| VH3\|3-30.3/D3\|3-10\|RF2/JH6 | | YYYGSGSYYN----------YYYYYGMDV | 15887 |
| 18078-H6 | VH3\|3-30.3/D3\|3-10\|RF2/JH6 | N.GSGSYGA-..............-...H...- | 15888 |
| 18090-H9 | VH3\|3-30.3/D3\|3-10\|RF2/JH6 | N.GSGSYGA-..............-...H...- | 15889 |
| VH4\|4-59/D3\|3-3\|RF3/JH4 | | ITIFGVV----------------IIYFDY | 15890 |
| 18081-A6 | VH4\|4-59/D3\|3-3\|RF3/JH4 | GIFGVI-..................-T.... | 15891 |
| 18081-B9 | VH4\|4-59/D3\|3-3\|RF3/JH4 | GIFGVI-..................-T.... | 15892 |
| 18081-E7 | VH4\|4-59/D3\|3-3\|RF3/JH4 | GIFGVI-..................-T.... | 15893 |
| 18081-B9_final | VH4\|4-59/D3\|3-3\|RF3/JH4 | GIFGVI-..................-T.... | 15894 |
| VH6\|6-01/D3\|3-10\|RF1/JH6 | | VLLWFGELL*----------YYYYYGMDV | 15895-15896 |
| 18081-B5 | VH6\|6-01/D3\|3-10\|RF1/JH6 | EV....K.--.............-N....... | 15897 |
| VH4\|4-b/D3\|3-3\|RF3/JH5 | | ITIFGVV----------------IINWFDP | 15898 |
| 18081-C10 | VH4\|4-b/D3\|3-3\|RF3/JH5 | TIFGV.-..................--G.... | 15899 |
| VH2\|2-70/D2\|2-15\|RF1/JH5 | | RIL*WW*----------------LLNWFDP | 15900 |
| 18081-D6 | VH2\|2-70/D2\|2-15\|RF1/JH5 | .RYN.NY-................-E..... | 15901 |
| 18089-C8 | VH2\|2-70/D2\|2-15\|RF1/JH5 | .RYN.NY-................-E..... | 15902 |
| 18081-H11 | VH2\|2-70/D2\|2-15\|RF1/JH5 | .RYN.NY-................-E..... | 15903 |
| VH3\|3-23/D1\|1-26\|RF1/JH6 | | GIVGATYY---------------YYYGMDV | 15904 |
| 18081-D12 | VH3\|3-23/D1\|1-26\|RF1/JH6 | .EGI.AR...................... | 15905 |
| VH4\|4-59/D3\|3-3\|RF3/JH5 | | ITIFGVV----------------INWFDP | 15906 |
| 18089-B8 | VH4\|4-59/D3\|3-3\|RF3/JH5 | TIFGV.-..................--G.... | 15907 |
| VH2\|2-05/D2\|2-15\|RF1/JH5 | | RIL*WW*L--------------LLNWFDP | 15908 |
| 18089-G7 | VH2\|2-05/D2\|2-15\|RF1/JH5 | .RYN.NY-................-E..... | 15909 |
| 18089-D11 | VH2\|2-05/D2\|2-15\|RF1/JH5 | .RYN.NY-................-E..... | 15910 |
| 18089-C9 | VH2\|2-05/D2\|2-15\|RF1/JH5 | .RYN.NY-................-E..... | 15911 |
| 18089-D8 | VH2\|2-05/D2\|2-15\|RF1/JH5 | .RYN.NY-................-E..... | 15912 |
| 18081-F9 | VH2\|2-05/D2\|2-15\|RF1/JH5 | .RYN.NY-................-E..... | 15913 |
| 18081-B6 | VH2\|2-05/D2\|2-15\|RF1/JH5 | .RYN.NY-................-E..... | 15914 |

TABLE 63-continued

| | HEAVY_VARIABLE | | |
|---|---|---|---|
| | Germline | | SEQ ID NO: |
| 18409-F12_final | VH2\|2-05/D2\|2-15\|RF1/JH5 | .RYN.NY-................-E..... | 15915 |
| 18409-G10_final | VH2\|2-05/D2\|2-15\|RF1/JH5 | .RYN.NY-................-E..... | 15916 |
| 18409-H7_final | VH2\|2-05/D2\|2-15\|RF1/JH5 | .RYN.NY-................-E..... | 15917 |
| 18409-H10_final | VH2\|2-05/D2\|2-15\|RF1/JH5 | .RYN.NY-................-E..... | 15918 |
| VH3\|3-23/D7\|7-27\|RF2/JH6 | | *LGYYY-----------------YYGMDV | 15919 |
| 18089-G11 | VH3\|3-23/D7\|7-27\|RF2/JH6 | T.TPD.....................D... | 15920 |
| 18089-H9 | VH3\|3-23/D7\|7-27\|RF2/JH6 | A.TPD.....................D... | 15921 |
| VH4\|4-30.1/D3\|3-10\|RF3/JH6 | | ITMVRGVII------------YYYYYGMDV | 15922 |
| 18179-A5 | VH4\|4-30.1/D3\|3-10\|RF3/JH6 | EK.WF..L-..............-N....... | 15923 |
| 18179-C7 | VH4\|4-30.1/D3\|3-10\|RF3/JH6 | EK.WF..L-..............-N....... | 15924 |
| 18179-H9 | VH4\|4-30.1/D3\|3-10\|RF3/JH6 | EK.WF..L-..............-N....... | 15925 |
| 18181-H7 | VH4\|4-30.1/D3\|3-10\|RF3/JH6 | EK.WF..L-..............-N....... | 15926 |
| 18181-B8 | VH4\|4-30.1/D3\|3-10\|RF3/JH6 | EK.WF..L-..............-N....... | 15927 |
| 81-H7-SG-F28_final | VH4\|4-30.1/D3\|3-10\|RF3/JH6 | EK.WF..L-..............-N....... | 15928 |
| VH3\|3-15/D3\|3-10\|RF2/JH6 | | YYYGSGSYYN-----------YYYYYGMDV | 15929 |
| 18179-B7 | VH3\|3-15/D3\|3-10\|RF2/JH6 | PSNSGSY.--..............-N.FSV... | 15930 |
| 18179-B8 | VH3\|3-15/D3\|3-10\|RF2/JH6 | PSNSGSY.--..............-N.FSV... | 15931 |
| 18179-D8 | VH3\|3-15/D3\|3-10\|RF2/JH6 | PSNSGSY.--..............-N.FSV... | 15932 |
| 18179-D9 | VH3\|3-15/D3\|3-10\|RF2/JH6 | PS.SGSY.--..............-N.FSV... | 15933 |
| 18179-E6 | VH3\|3-15/D3\|3-10\|RF2/JH6 | PSNSGSY.--..............-N.FSV... | 15934 |
| 18181-G7 | VH3\|3-15/D3\|3-10\|RF2/JH6 | PSN.GSY.--..............-N.FSV... | 15935 |
| 18179-E1 | VH3\|3-15/D3\|3-10\|RF2/JH6 | PS.SGSY.--..............-N.FSV... | 15936 |
| 18179-H7 | VH3\|3-15/D3\|3-10\|RF2/JH6 | PS.SGSY.--..............-N.FSV... | 15937 |
| 18179-B12 | VH3\|3-15/D3\|3-10\|RF2/JH6 | PSNSGSY.--..............-N.FSV... | 15938 |
| 18179-D11 | VH3\|3-15/D3\|3-10\|RF2/JH6 | PS.SGSY.--..............-N.FSV... | 15939 |
| 18179-D7 | VH3\|3-15/D3\|3-10\|RF2/JH6 | PS.SGSY.--..............-N.FSV... | 15940 |

TABLE 63-continued

HEAVY_VARIABLE

| | Germline | | SEQ ID NO: |
|---|---|---|---|
| 18179-A7 | VH3\|3-15/D3\|3-10\|RF2/JH6 | PS.SGSY.--............-N.FSV... | 15941 |
| 18181-G8 | VH3\|3-15/D3\|3-10\|RF2/JH6 | PSNSGSY.--............-N.FSV... | 15942 |
| 18181-F3 | VH3\|3-15/D3\|3-10\|RF2/JH6 | PS.SGSY.--............-N.FSV... | 15943 |
| 18181-F1 | VH3\|3-15/D3\|3-10\|RF2/JH6 | PS.SGSY.--............-N.FSV... | 15944 |
| 18181-A6 | VH3\|3-15/D3\|3-10\|RF2/JH6 | PS.SGSY.--............-N.FSV... | 15945 |
| 18409-E2_final | VH3\|3-15/D3\|3-10\|RF2/JH6 | PS.SGSY.--............-N.FSV... | 15946 |
| 18410-B5_final | VH3\|3-15/D3\|3-10\|RF2/JH6 | PS.SGSY.--............-N.FSV... | 15947 |
| 18410-B6_final | VH3\|3-15/D3\|3-10\|RF2/JH6 | PS.SGSY.--............-N.FSV... | 15948 |
| 18410-D3_final | VH3\|3-15/D3\|3-10\|RF2/JH6 | PS.SGSY.--............-N.FSV... | 15949 |
| 18410-D6_final | VH3\|3-15/D3\|3-10\|RF2/JH6 | PS.SGSY.--............-N.FSV... | 15950 |
| 18410-H1_final | VH3\|3-15/D3\|3-10\|RF2/JH6 | PS.SGSY.--............-N.FSV... | 15951 |
| 18410-H3_final | VH3\|3-15/D3\|3-10\|RF2/JH6 | PS.SGSY.--............-N.FSV... | 15952 |
| VH4\|4-59/D3\|3-10\|RF3/JH6 | | ITMVRGVII------------YYYYYGMDV | 15953 |
| 18179-F3 | VH4\|4-59/D3\|3-10\|RF3/JH6 | EK.WF..L-..............-N....... | 15954 |
| 18179-F10 | VH4\|4-59/D3\|3-10\|RF3/JH6 | EK.WF..L-..............-N....... | 15955 |
| 18181-H10 | VH4\|4-59/D3\|3-10\|RF3/JH6 | EK.WF..L-..............-N....... | 15956 |
| VH3\|3-23/D6\|6-19\|RF2/JH4 | | GIAVA--------------------GYFDY | 15957 |
| 18182-A3 | VH3\|3-23/D6\|6-19\|RF2/JH4 | .KG.H....................LG... | 15958 |
| 18182-A5 | VH3\|3-23/D6\|6-19\|RF2/JH4 | .KG.H....................LN... | 15959 |
| 18182-A6 | VH3\|3-23/D6\|6-19\|RF2/JH4 | .KG.H....................LG... | 15960 |
| 18182-A7 | VH3\|3-23/D6\|6-19\|RF2/JH4 | .KG.H....................LG... | 15961 |
| 18182-A8 | VH3\|3-23/D6\|6-19\|RF2/JH4 | .KG.H....................LG... | 15962 |
| 18182-A11 | VH3\|3-23/D6\|6-19\|RF2/JH4 | .KG.H....................LG... | 15963 |
| 18182-B1 | VH3\|3-23/D6\|6-19\|RF2/JH4 | .KG.H....................LG... | 15964 |
| 18182-B4 | VH3\|3-23/D6\|6-19\|RF2/JH4 | .KG.H....................LG... | 15965 |
| 18182-B6 | VH3\|3-23/D6\|6-19\|RF2/JH4 | .KG.H....................LG... | 15966 |

TABLE 63-continued

HEAVY_VARIABLE

| | Germline | | SEQ ID NO: |
|---|---|---|---|
| 18182-B10 | VH3\|3-23/D6\|6-19\|RF2/JH4 | .KG.H....................LN... | 15967 |
| 18182-C2 | VH3\|3-23/D6\|6-19\|RF2/JH4 | .KG.H....................LG... | 15968 |
| 18182-C3 | VH3\|3-23/D6\|6-19\|RF2/JH4 | .KG.H....................LG... | 15969 |
| 18182-C4 | VH3\|3-23/D6\|6-19\|RF2/JH4 | .KG.H....................LG... | 15970 |
| 18182-C5 | VH3\|3-23/D6\|6-19\|RF2/JH4 | .KG.H....................LN... | 15971 |
| 18182-C10 | VH3\|3-23/D6\|6-19\|RF2/JH4 | .KG.H....................LG... | 15972 |
| 18182-C12 | VH3\|3-23/D6\|6-19\|RF2/JH4 | .KG.H....................LG... | 15973 |
| 18182-D4 | VH3\|3-23/D6\|6-19\|RF2/JH4 | .KG.H....................LN... | 15974 |
| 18182-D8 | VH3\|3-23/D6\|6-19\|RF2/JH4 | .KG.H....................LG... | 15975 |
| 18182-D9 | VH3\|3-23/D6\|6-19\|RF2/JH4 | .KG.H....................LN... | 15976 |
| 18182-D11 | VH3\|3-23/D6\|6-19\|RF2/JH4 | .KG.H....................LN... | 15977 |
| 18182-E2 | VH3\|3-23/D6\|6-19\|RF2/JH4 | .KG.H....................LG... | 15978 |
| 18182-E3 | VH3\|3-23/D6\|6-19\|RF2/JH4 | .KG.H....................LG... | 15979 |
| 18182-E8 | VH3\|3-23/D6\|6-19\|RF2/JH4 | .KG.H....................LG... | 15980 |
| 18182-E11 | VH3\|3-23/D6\|6-19\|RF2/JH4 | .KG.H....................LG... | 15981 |
| 18182-F1 | VH3\|3-23/D6\|6-19\|RF2/JH4 | .KG.H....................LN... | 15982 |
| 18182-F6 | VH3\|3-23/D6\|6-19\|RF2/JH4 | .KG.H....................LN... | 15983 |
| 18182-F8 | VH3\|3-23/D6\|6-19\|RF2/JH4 | .KG.H....................LG... | 15984 |
| 18182-G3 | VH3\|3-23/D6\|6-19\|RF2/JH4 | .KG.H....................LG... | 15985 |
| 18182-G4 | VH3\|3-23/D6\|6-19\|RF2/JH4 | .KG.H....................LG... | 15986 |
| 18182-G5 | VH3\|3-23/D6\|6-19\|RF2/JH4 | .KG.H....................LG... | 15987 |
| 18182-G9 | VH3\|3-23/D6\|6-19\|RF2/JH4 | .KG.H....................LG... | 15988 |
| 18182-G11 | VH3\|3-23/D6\|6-19\|RF2/JH4 | .KG.H....................LG... | 15989 |
| 18182-H5 | VH3\|3-23/D6\|6-19\|RF2/JH4 | .KG.H....................LG... | 15990 |
| 18182-B5 | VH3\|3-23/D6\|6-19\|RF2/JH4 | .KG.H....................LG... | 15991 |

TABLE 63-continued

| | HEAVY_VARIABLE | | |
|---|---|---|---|
| | Germline | | SEQ ID NO: |
| 18182-H9 | VH3\|3-23/D6\|6-19\|RF2/JH4 | .KG.H.............LG... | 15992 |
| 18182-E6 | VH3\|3-23/D6\|6-19\|RF2/JH4 | .KG.H.................LG... | 15993 |
| 18182-G6 | VH3\|3-23/D6\|6-19\|RF2/JH4 | .KG.H.................LN... | 15994 |
| 18182-G2 | VH3\|3-23/D6\|6-19\|RF2/JH4 | .KG.H.................LG... | 15995 |
| 18182-H12 | VH3\|3-23/D6\|6-19\|RF2/JH4 | .KG.H.................LG... | 15996 |
| 18182-G8 | VH3\|3-23/D6\|6-19\|RF2/JH4 | .KG.H.................LN... | 15997 |
| 18182-E10 | VH3\|3-23/D6\|6-19\|RF2/JH4 | .KG.H.................LN... | 15998 |
| 18182-B12 | VH3\|3-23/D6\|6-19\|RF2/JH4 | .KG.H.................LG... | 15999 |
| 18182-E5 | VH3\|3-23/D6\|6-19\|RF2/JH4 | .KG.H.................LG... | 16000 |
| 18182-A4 | VH3\|3-23/D6\|6-19\|RF2/JH4 | .KG.H.................LG... | 16001 |
| 18182-E1 | VH3\|3-23/D6\|6-19\|RF2/JH4 | .KG.H.................LG... | 16002 |
| 18403-F12-AS | VH3\|3-23/D6\|6-19\|RF2/JH4 | .KG.H.................LG... | 16003 |
| 18403-G10-AS | VH3\|3-23/D6\|6-19\|RF2/JH4 | .KG.H.................LG... | 16004 |
| 18398-C7_final | VH3\|3-23/D6\|6-19\|RF2/JH4 | .KG.H.................LG... | 16005 |
| 18403-D8_final | VH3\|3-23/D6\|6-19\|RF2/JH4 | .KG.H.................LG... | 16006 |
| 18403-D8_AS_final | VH3\|3-23/D6\|6-19\|RF2/JH4 | .KG.H.................LG... | 16007 |
| 18403-E11_AS_final | VH3\|3-23/D6\|6-19\|RF2/JH4 | .KG.H.................LG... | 16008 |
| 18403-F12_final | VH3\|3-23/D6\|6-19\|RF2/JH4 | .KG.H.................LG... | 16009 |
| 18403-F12-AS_final | VH3\|3-23/D6\|6-19\|RF2/JH4 | .KG.H.................LG... | 16010 |
| 18403-G10_final | VH3\|3-23/D6\|6-19\|RF2/JH4 | .KG.H.................LG... | 16011 |
| 18403-G10-AS_final | VH3\|3-23/D6\|6-19\|RF2/JH4 | .KG.H.................LG... | 16012 |
| 18410-G10_final | VH3\|3-23/D6\|6-19\|RF2/JH4 | .KG.H.................LG... | 16013 |
| 18410-G10_AS_final | VH3\|3-23/D6\|6-19\|RF2/JH4 | .KG.H.................LG... | 16014 |
| VH3\|3-23/D6\|6-19\|RF2/JH1 | | GIAVAG-----------------AEYFQH | 16015 |
| 18182-B7 | VH3\|3-23/D6\|6-19\|RF2/JH1 | .KG.H-.................-LG.D. | 16016 |

TABLE 63-continued

| | Germline | HEAVY_VARIABLE | SEQ ID NO: |
|---|---|---|---|
| VH3\|3-30.3/D1\|1-1\|RF2/JH4 | | VQLER--------------------YFDY | 16017 |
| 18089-D12 | VH3\|3-30.3/D1\|1-1\|RF2/JH4 | .G..L-.................-TG. | 16018 |
| 02-C1-86-A4-N-F5_final | VH3\|3-30.3/D1\|1-1\|RF2/JH4 | .G..L-.................-TG. | 16019 |
| 18486-A4_final | VH3\|3-30.3/D1\|1-1\|RF2/JH4 | .G..L-.................-TG. | 16020 |
| VH1\|1-18/D6\|6-13\|RF2/JH4 | | GIAAA---------------GYFDY | 16021 |
| 18179-G12 | VH1\|1-18/D6\|6-13\|RF2/JH4 | .R.T-...............--... | 16022 |
| 18179-C1 | VH1\|1-18/D6\|6-13\|RF2/JH4 | .R.T-...............--... | 16023 |
| VH3\|3-11/D1\|1-1\|RF3/JH4 | | YNWND---------------YFDY | 16024 |
| 18093-B11 | VH3\|3-11/D1\|1-1\|RF3/JH4 | ..YG-...................H... | 16025 |
| 03-F3-88-B3-F9_final | VH3\|3-11/D1\|1-1\|RF3/JH4 | ..YG-...................H... | 16026 |
| | | H_FR4 | |
| VH1\|1-f/D2\|2-15\|RF3/JH4 | | WGQGTLVTVSS | 16258 |
| 17724-C9 | VH1\|1-f/D2\|2-15\|RF3/JH4 | .......... | 16259 |
| VH1\|1-e/D5\|5-18\|RF3/JH4 | | WGQGTLVTVSS | 16260 |
| 17724-G6 | VH1\|1-e/D5\|5-18\|RF3/JH4 | ......R..... | 16261 |
| VH1\|1-e/D1\|1-1\|RF2/JH3 | | WGQGTMVTVSS | 16262 |
| 17731-H8 | VH1\|1-e/D1\|1-1\|RF2/JH3 | ......S..... | 16263 |
| VH1\|1-08/D5\|5-18\|RF3/JH6 | | WGQGTTVTVSS | 16264 |
| 17732-A8 | VH1\|1-08/D5\|5-18\|RF3/JH6 | .......... | 16265 |
| 17780-D12 | VH1\|1-08/D5\|5-18\|RF3/JH6 | .......... | 16266 |
| VH1\|1-08/D5\|5-12\|RF3/JH6 | | WGQGTTVTVSS | 16267 |
| 17745-E5 | VH1\|1-08/D5\|5-12\|RF3/JH6 | .......... | 16268 |
| 17777-B4 | VH1\|1-08/D5\|5-12\|RF3/JH6 | .......... | 16269 |
| 17814-D9 | VH1\|1-08/D5\|5-12\|RF3/JH6 | .......... | 16270 |
| VH4\|4-34/D5\|5-18\|RF3/JH6 | | WGQGTTVTVSS | 16271 |
| 17745-E8 | VH4\|4-34/D5\|5-18\|RF3/JH6 | .......... | 16272 |
| 17777-C5 | VH4\|4-34/D5\|5-18\|RF3/JH6 | .......... | 16273 |
| 17778-C9 | VH4\|4-34/D5\|5-18\|RF3/JH6 | .......... | 16274 |

TABLE 63-continued

HEAVY_VARIABLE

| | Germline | | SEQ ID NO: |
|---|---|---|---|
| 17780-E6 | VH4\|4-34/D5\|5-18\|RF3/JH6 | ........... | 16275 |
| 17781-B3 | VH4\|4-34/D5\|5-18\|RF3/JH6 | ........... | 16276 |
| 17781-H12 | VH4\|4-34/D5\|5-18\|RF3/JH6 | ........... | 16277 |
| 17783-C11 | VH4\|4-34/D5\|5-18\|RF3/JH6 | ........... | 16278 |
| 17783-G10 | VH4\|4-34/D5\|5-18\|RF3/JH6 | ........... | 16279 |
| 17813-E3 | VH4\|4-34/D5\|5-18\|RF3/JH6 | ........... | 16280 |
| 17813-F1 | VH4\|4-34/D5\|5-18\|RF3/JH6 | ........... | 16281 |
| VH3\|3-23/D3\|3-9\|RF1/JH4 | | WGQGTLVTVSS | 16282 |
| 17745-G8 | VH3\|3-23/D3\|3-9\|RF1/JH4 | ........... | 16283 |
| 17777-C4 | VH3\|3-23/D3\|3-9\|RF1/JH4 | ........... | 16284 |
| 18072-D6 | VH3\|3-23/D3\|3-9\|RF1/JH4 | ........... | 16285 |
| 18084-E4 | VH3\|3-23/D3\|3-9\|RF1/JH4 | ........... | 16286 |
| 18088-B10 | VH3\|3-23/D3\|3-9\|RF1/JH4 | ........... | 16287 |
| VH3\|3-30.3/D1\|1-1\|RF2/JH6 | | WGQGTTVTVSS | 16288 |
| 17748-D12 | VH3\|3-30.3/D1\|1-1\|RF2/JH6 | ........... | 16289 |
| 18079-C8 | VH3\|3-30.3/D1\|1-1\|RF2/JH6 | ........... | 16290 |
| VH4\|4-34/D5\|5-12\|RF3/JH6 | | WGQGTTVTVSS | 16291 |
| 17753-F4 | VH4\|4-34/D5\|5-12\|RF3/JH6 | ........... | 16292 |
| 17778-F1 | VH4\|4-34/D5\|5-12\|RF3/JH6 | ........... | 16293 |
| 17778-H8 | VH4\|4-34/D5\|5-12\|RF3/JH6 | ........... | 16294 |
| 17779-E1 | VH4\|4-34/D5\|5-12\|RF3/JH6 | ........... | 16295 |
| 17784-C11 | VH4\|4-34/D5\|5-12\|RF3/JH6 | ........... | 16296 |
| 17784-H5 | VH4\|4-34/D5\|5-12\|RF3/JH6 | ........... | 16297 |
| 17785-D12 | VH4\|4-34/D5\|5-12\|RF3/JH6 | ........... | 16298 |
| 17813-E5 | VH4\|4-34/D5\|5-12\|RF3/JH6 | ........... | 16299 |
| 18088-E4 | VH4\|4-34/D5\|5-12\|RF3/JH6 | ........... | 16300 |

TABLE 63-continued

HEAVY_VARIABLE

| | Germline | | SEQ ID NO: |
|---|---|---|---|
| VH3\|3-23/D6\|6-19\|RF1/JH6 | | WGQGTTVTVSS | 16301 |
| 17771-D2 | VH3\|3-23/D6\|6-19\|RF1/JH6 | ........... | 16302 |
| 18074-G12 | VH3\|3-23/D6\|6-19\|RF1/JH6 | ........... | 16303 |
| 18093-E2 | VH3\|3-23/D6\|6-19\|RF1/JH6 | ........... | 16304 |
| 18089-B2 | VH3\|3-23/D6\|6-19\|RF1/JH6 | ........... | 16305 |
| VH3\|3-23/D7\|7-27\|RF1/JH6 | | WGQGTTVTVSS | 16306 |
| 17779-D11 | VH3\|3-23/D7\|7-27\|RF1/JH6 | ........... | 16307 |
| 18089-H12 | VH3\|3-23/D7\|7-27\|RF1/JH6 | ........... | 16308 |
| 18093-F5 | VH3\|3-23/D7\|7-27\|RF1/JH6 | ........... | 16309 |
| VH3\|3-23/D5\|5-18\|RF1/JH6 | | WGQGTTVTVSS | 16310 |
| 17784-B9 | VH3\|3-23/D5\|5-18\|RF1/JH6 | ........... | 16311 |
| 17784-C7 | VH3\|3-23/D5\|5-18\|RF1/JH6 | ........... | 16312 |
| 18080-H9 | VH3\|3-23/D5\|5-18\|RF1/JH6 | ........... | 16313 |
| VH4\|4-30.1/D3\|3-10\|RF1/JH6 | | WGQGTTVTVSS | 16314 |
| 17784-G10 | VH4\|4-30.1/D3\|3-10\|RF1/JH6 | ........... | 16315 |
| 18080-C5 | VH4\|4-30.1/D3\|3-10\|RF1/JH6 | ........... | 16316 |
| 18179-A3 | VH4\|4-30.1/D3\|3-10\|RF1/JH6 | ...L....... | 16317 |
| 18179-A9 | VH4\|4-30.1/D3\|3-10\|RF1/JH6 | ........... | 16318 |
| 18179-A10 | VH4\|4-30.1/D3\|3-10\|RF1/JH6 | ........... | 16319 |
| 18179-c4 | VH4\|4-30.1/D3\|3-10\|RF1/JH6 | ...P....... | 16320 |
| 18179-C6 | VH4\|4-30.1/D3\|3-10\|RF1/JH6 | ........... | 16321 |
| 18179-C10 | VH4\|4-30.1/D3\|3-10\|RF1/JH6 | ...L....... | 16322 |
| 18179-F4 | VH4\|4-30.1/D3\|3-10\|RF1/JH6 | ...L....... | 16323 |
| 18179-F6 | VH4\|4-30.1/D3\|3-10\|RF1/JH6 | ........... | 16324 |
| 18179-G8 | VH4\|4-30.1/D3\|3-10\|RF1/JH6 | ........... | 16325 |
| 18179-G9 | VH4\|4-30.1/D3\|3-10\|RF1/JH6 | ........... | 16326 |

TABLE 63-continued

HEAVY_VARIABLE

|  | Germline |  | SEQ ID NO: |
|---|---|---|---|
| 18179-H6 | VH4\|4-30.1/D3\|3-10\|RF1/JH6 | .......... | 16327 |
| 18181-A11 | VH4\|4-30.1/D3\|3-10\|RF1/JH6 | ...P...... | 16328 |
| 18181-C6 | VH4\|4-30.1/D3\|3-10\|RF1/JH6 | ...P...... | 16329 |
| 18181-G10 | VH4\|4-30.1/D3\|3-10\|RF1/JH6 | ...L...... | 16330 |
| 18181-E2 | VH4\|4-30.1/D3\|3-10\|RF1/JH6 | ...L...... | 16331 |
| 18181-C9 | VH4\|4-30.1/D3\|3-10\|RF1/JH6 | ...L...... | 16332 |
| VH3\|3-23/D1\|1-1\|RF1/JH6 |  | WGQGTTVTVSS | 16333 |
| 17813-D8 | VH3\|3-23/D1\|1-1\|RF1/JH6 | .......... | 16334 |
| VH3\|3-33/D3\|3-10\|RF2/JH6 |  | WGQGTTVTVSS | 16335 |
| 18071-B1 | VH3\|3-33/D3\|3-10\|RF2/JH6 | .......... | 16336 |
| 18082-F5 | VH3\|3-33/D3\|3-10\|RF2/JH6 | .......... | 16337 |
| VH1\|1-08/D7\|7-27\|RF3/JH6 |  | WGQGTTVTVSS | 16338 |
| 18071-C4 | VH1\|1-08/D7\|7-27\|RF3/JH6 | .......... | 16339 |
| 18071-D4 | VH1\|1-08/D7\|7-27\|RF3/JH6 | .......... | 16340 |
| 18079-H4 | VH1\|1-08/D7\|7-27\|RF3/JH6 | .......... | 16341 |
| 18079-H11 | VH1\|1-08/D7\|7-27\|RF3/JH6 | .......... | 16342 |
| 18086-H4 | VH1\|1-08/D7\|7-27\|RF3/JH6 | .......... | 16343 |
| VH3\|3-21/D6\|6-6\|RF2/JH6 |  | WGQGTTVTVSS | 16344 |
| 18072-G9 | VH3\|3-21/D6\|6-6\|RF2/JH6 | .......... | 16345 |
| VH3\|3-30.3/D3\|3-10\|RF2/JH6 |  | WGQGTTVTVSS | 16346 |
| 18078-H6 | VH3\|3-30.3/D3\|3-10\|RF2/JH6 | .......... | 16347 |
| 18090-H9 | VH3\|3-30.3/D3\|3-10\|RF2/JH6 | .......... | 16348 |
| VH4\|4-59/D3\|3-3\|RF3/JH4 |  | WGQGTLVTVSS | 16349 |
| 18081-A6 | VH4\|4-59/D3\|3-3\|RF3/JH4 | .......... | 16350 |
| 18081-B9 | VH4\|4-59/D3\|3-3\|RF3/JH4 | .......... | 16351 |
| 18081-E7 | VH4\|4-59/D3\|3-3\|RF3/JH4 | .......... | 16352 |
| 18081-B9_final | VH4\|4-59/D3\|3-3\|RF3/JH4 | .......... | 16353 |

TABLE 63-continued

HEAVY_VARIABLE

| | Germline | | SEQ ID NO: |
|---|---|---|---|
| VH6\|6-01/D3\|3-10\|RF1/JH6 | | WGQGTTVTVSS | 16354 |
| 18081-B5 | VH6\|6-01/D3\|3-10\|RF1/JH6 | .......... | 16355 |
| VH4\|4-b/D3\|3-3\|RF3/JH5 | | WGQGTLVTVSS | 16356 |
| 18081-C10 | VH4\|4-b/D3\|3-3\|RF3/JH5 | ....N...... | 16357 |
| VH2\|2-70/D2\|2-15\|RF1/JH5 | | WGQGTLVTVSS | 16358 |
| 18081-D6 | VH2\|2-70/D2\|2-15\|RF1/JH5 | .......... | 16359 |
| 18089-C8 | VH2\|2-70/D2\|2-15\|RF1/JH5 | ....I...... | 16360 |
| 18081-H11 | VH2\|2-70/D2\|2-15\|RF1/JH5 | .......... | 16361 |
| VH3\|3-23/D1\|1-26\|RF1/JH6 | | WGQGTTVTVSS | 16362 |
| 18081-D12 | VH3\|3-23/D1\|1-26\|RF1/JH6 | .......... | 16363 |
| VH4\|4-59/D3\|3-3\|RF3/JH5 | | WGQGTLVTVSS | 16364 |
| 18089-B8 | VH4\|4-59/D3\|3-3\|RF3/JH5 | ....N...... | 16365 |
| VH2\|2-05/D2\|2-15\|RF1/JH5 | | WGQGTLVTVSS | 16366 |
| 18089-G7 | VH2\|2-05/D2\|2-15\|RF1/JH5 | .......... | 16367 |
| 18089-D11 | VH2\|2-05/D2\|2-15\|RF1/JH5 | .......... | 16368 |
| 18089-C9 | VH2\|2-05/D2\|2-15\|RF1/JH5 | .......... | 16369 |
| 18089-D8 | VH2\|2-05/D2\|2-15\|RF1/JH5 | .......... | 16370 |
| 18081-F9 | VH2\|2-05/D2\|2-15\|RF1/JH5 | .......... | 16371 |
| 18081-B6 | VH2\|2-05/D2\|2-15\|RF1/JH5 | .......... | 16372 |
| 18409-F12_final | VH2\|2-05/D2\|2-15\|RF1/JH5 | .......... | 16373 |
| 18409-G10_final | VH2\|2-05/D2\|2-15\|RF1/JH5 | .......... | 16374 |
| 18409-H7_final | VH2\|2-05/D2\|2-15\|RF1/JH5 | .......... | 16375 |
| 18409-H10_final | VH2\|2-05/D2\|2-15\|RF1/JH5 | .......... | 16376 |
| VH3\|3-23/D7\|7-27\|RF2/JH6 | | WGQGTTVTVSS | 16377 |
| 18089-G11 | VH3\|3-23/D7\|7-27\|RF2/JH6 | .......... | 16378 |
| 18089-H9 | VH3\|3-23/D7\|7-27\|RF2/JH6 | .......... | 16379 |
| VH4\|4-30.1/D3\|3-10\|RF3/JH6 | | WGQGTTVTVSS | 16380 |
| 18179-A5 | VH4\|4-30.1/D3\|3-10\|RF3/JH6 | .......... | 16381 |

TABLE 63-continued

| | HEAVY_VARIABLE | |
|---|---|---|
| | Germline | SEQ ID NO: |
| 18179-C7 | VH4\|4-30.1/D3\|3-10\|RF3/JH6 | ..L........ | 16382 |
| 18179-H9 | VH4\|4-30.1/D3\|3-10\|RF3/JH6 | ........... | 16383 |
| 18181-H7 | VH4\|4-30.1/D3\|3-10\|RF3/JH6 | ........... | 16384 |
| 18181-B8 | VH4\|4-30.1/D3\|3-10\|RF3/JH6 | ........... | 16385 |
| 81-H7-SG-F28_final | VH4\|4-30.1/D3\|3-10\|RF3/JH6 | ........... | 16386 |
| VH3\|3-15/D3\|3-10\|RF2/JH6 | WGQGTTVTVSS | 16387 |
| 18179-B7 | VH3\|3-15/D3\|3-10\|RF2/JH6 | ........... | 16388 |
| 18179-B8 | VH3\|3-15/D3\|3-10\|RF2/JH6 | ........... | 16389 |
| 18179-D8 | VH3\|3-15/D3\|3-10\|RF2/JH6 | ........... | 16390 |
| 18179-D9 | VH3\|3-15/D3\|3-10\|RF2/JH6 | ........... | 16391 |
| 18179-E6 | VH3\|3-15/D3\|3-10\|RF2/JH6 | ........... | 16392 |
| 18181-G7 | VH3\|3-15/D3\|3-10\|RF2/JH6 | ........... | 16393 |
| 18179-E1 | VH3\|3-15/D3\|3-10\|RF2/JH6 | ........... | 16394 |
| 18179-H7 | VH3\|3-15/D3\|3-10\|RF2/JH6 | ........... | 16395 |
| 18179-B12 | VH3\|3-15/D3\|3-10\|RF2/JH6 | ........... | 16396 |
| 18179-D11 | VH3\|3-15/D3\|3-10\|RF2/JH6 | ........... | 16397 |
| 18179-D7 | VH3\|3-15/D3\|3-10\|RF2/JH6 | ........... | 16398 |
| 18179-A7 | VH3\|3-15/D3\|3-10\|RF2/JH6 | ........... | 16399 |
| 18181-G8 | VH3\|3-15/D3\|3-10\|RF2/JH6 | ........... | 16400 |
| 18181-F3 | VH3\|3-15/D3\|3-10\|RF2/JH6 | ........... | 16401 |
| 18181-F1 | VH3\|3-15/D3\|3-10\|RF2/JH6 | ........... | 16402 |
| 18181-A6 | VH3\|3-15/D3\|3-10\|RF2/JH6 | ........... | 16403 |
| 18409-E2_final | VH3\|3-15/D3\|3-10\|RF2/JH6 | ........... | 16404 |
| 18410-B5_final | VH3\|3-15/D3\|3-10\|RF2/JH6 | ........... | 16405 |
| 18410-B6_final | VH3\|3-15/D3\|3-10\|RF2/JH6 | ........... | 16406 |

TABLE 63-continued

| | HEAVY_VARIABLE | | |
|---|---|---|---|
| | Germline | | SEQ ID NO: |
| 18410-D3_final | VH3\|3-15/D3-10\|RF2/JH6 | .......... | 16407 |
| 18410-D6_final | VH3\|3-15/D3-10\|RF2/JH6 | .......... | 16408 |
| 18410-H1_final | VH3\|3-15/D3-10\|RF2/JH6 | .......... | 16409 |
| 18410-H3_final | VH3\|3-15/D3-10\|RF2/JH6 | .......... | 16410 |
| VH4\|4-59/D3\|3-10\|RF3/JH6 | | WGQGTTVTVSS | 16411 |
| 18179-F3 | VH4\|4-59/D3-10\|RF3/JH6 | .......... | 16412 |
| 18179-F10 | VH4\|4-59/D3-10\|RF3/JH6 | .......... | 16413 |
| 18181-H10 | VH4\|4-59/D3-10\|RF3/JH6 | .......... | 16414 |
| VH3\|3-23/D6\|6-19\|RF2/JH4 | | WGQGTLVTVSS | 16415 |
| 18182-A3 | VH3\|3-23/D6\|6-19\|RF2/JH4 | .......... | 16416 |
| 18182-A5 | VH3\|3-23/D6\|6-19\|RF2/JH4 | .......... | 16417 |
| 18182-A6 | VH3\|3-23/D6\|6-19\|RF2/JH4 | .......... | 16418 |
| 18182-A7 | VH3\|3-23/D6\|6-19\|RF2/JH4 | .......... | 16419 |
| 18182-A8 | VH3\|3-23/D6\|6-19\|RF2/JH4 | .......... | 16420 |
| 18182-A11 | VH3\|3-23/D6\|6-19\|RF2/JH4 | .......... | 16421 |
| 18182-B1 | VH3\|3-23/D6\|6-19\|RF2/JH4 | .......... | 16422 |
| 18182-B4 | VH3\|3-23/D6\|6-19\|RF2/JH4 | .......... | 16423 |
| 18182-B6 | VH3\|3-23/D6\|6-19\|RF2/JH4 | .......... | 16424 |
| 18182-B10 | VH3\|3-23/D6\|6-19\|RF2/JH4 | .......... | 16425 |
| 18182-C2 | VH3\|3-23/D6\|6-19\|RF2/JH4 | .......... | 16426 |
| 18182-C3 | VH3\|3-23/D6\|6-19\|RF2/JH4 | .......... | 16427 |
| 18182-C4 | VH3\|3-23/D6\|6-19\|RF2/JH4 | .......... | 16428 |
| 18182-C5 | VH3\|3-23/D6\|6-19\|RF2/JH4 | .......... | 16429 |
| 18182-C10 | VH3\|3-23/D6\|6-19\|RF2/JH4 | .......... | 16430 |
| 18182-C12 | VH3\|3-23/D6\|6-19\|RF2/JH4 | .......... | 16431 |
| 18182-D4 | VH3\|3-23/D6\|6-19\|RF2/JH4 | .......... | 16432 |

TABLE 63-continued

HEAVY_VARIABLE

|  | Germline |  | SEQ ID NO: |
|---|---|---|---|
| 18182-D8 | VH3\|3-23/D6\|6-19\|RF2/JH4 | .......... | 16433 |
| 18182-D9 | VH3\|3-23/D6\|6-19\|RF2/JH4 | .......... | 16434 |
| 18182-D11 | VH3\|3-23/D6\|6-19\|RF2/JH4 | .......... | 16435 |
| 18182-E2 | VH3\|3-23/D6\|6-19\|RF2/JH4 | .......... | 16436 |
| 18182-E3 | VH3\|3-23/D6\|6-19\|RF2/JH4 | .......... | 16437 |
| 18182-E8 | VH3\|3-23/D6\|6-19\|RF2/JH4 | .......... | 16438 |
| 18182-E11 | VH3\|3-23/D6\|6-19\|RF2/JH4 | .......... | 16439 |
| 18182-F1 | VH3\|3-23/D6\|6-19\|RF2/JH4 | .......... | 16440 |
| 18182-F6 | VH3\|3-23/D6\|6-19\|RF2/JH4 | .......... | 16441 |
| 18182-F8 | VH3\|3-23/D6\|6-19\|RF2/JH4 | .......... | 16442 |
| 18182-G3 | VH3\|3-23/D6\|6-19\|RF2/JH4 | .......... | 16443 |
| 18182-G4 | VH3\|3-23/D6\|6-19\|RF2/JH4 | .......... | 16444 |
| 18182-G5 | VH3\|3-23/D6\|6-19\|RF2/JH4 | .......... | 16445 |
| 18182-G9 | VH3\|3-23/D6\|6-19\|RF2/JH4 | .......... | 16446 |
| 18182-G11 | VH3\|3-23/D6\|6-19\|RF2/JH4 | .......... | 16447 |
| 18182-H5 | VH3\|3-23/D6\|6-19\|RF2/JH4 | .......... | 16448 |
| 18182-B5 | VH3\|3-23/D6\|6-19\|RF2/JH4 | .......... | 16449 |
| 18182-H9 | VH3\|3-23/D6\|6-19\|RF2/JH4 | .......... | 16450 |
| 18182-E6 | VH3\|3-23/D6\|6-19\|RF2/JH4 | .......... | 16451 |
| 18182-G6 | VH3\|3-23/D6\|6-19\|RF2/JH4 | .......... | 16452 |
| 18182-G2 | VH3\|3-23/D6\|6-19\|RF2/JH4 | .......... | 16453 |
| 18182-H12 | VH3\|3-23/D6\|6-19\|RF2/JH4 | .......... | 16454 |
| 18182-G8 | VH3\|3-23/D6\|6-19\|RF2/JH4 | .......... | 16455 |
| 18182-E10 | VH3\|3-23/D6\|6-19\|RF2/JH4 | .......... | 16456 |
| 18182-B12 | VH3\|3-23/D6\|6-19\|RF2/JH4 | .......... | 16457 |

TABLE 63-continued

HEAVY VARIABLE

| | Germline | | SEQ ID NO: |
|---|---|---|---|
| 18182-E5 | VH3\|3-23/D6\|6-19\|RF2/JH4 | .......... | 16458 |
| 18182-A4 | VH3\|3-23/D6\|6-19\|RF2/JH4 | .......... | 16459 |
| 18182-E1 | VH3\|3-23/D6\|6-19\|RF2/JH4 | .......... | 16460 |
| 18403-F12-AS | VH3\|3-23/D6\|6-19\|RF2/JH4 | .......... | 16461 |
| 18403-G10-AS | VH3\|3-23/D6\|6-19\|RF2/JH4 | .......... | 16462 |
| 18398-C7_final | VH3\|3-23/D6\|6-19\|RF2/JH4 | .......... | 16463 |
| 18403-D8_final | VH3\|3-23/D6\|6-19\|RF2/JH4 | .......... | 16464 |
| 18403-D8_AS_final | VH3\|3-23/D6\|6-19\|RF2/JH4 | .......... | 16465 |
| 18403-E11_AS_final | VH3\|3-23/D6\|6-19\|RF2/JH4 | .......... | 16466 |
| 18403-F12_final | VH3\|3-23/D6\|6-19\|RF2/JH4 | .......... | 16467 |
| 18403-F12-AS_final | VH3\|3-23/D6\|6-19\|RF2/JH4 | .......... | 16468 |
| 18403-G10_final | VH3\|3-23/D6\|6-19\|RF2/JH4 | .......... | 16469 |
| 18403-G10-AS_final | VH3\|3-23/D6\|6-19\|RF2/JH4 | .......... | 16470 |
| 18410-G10_final | VH3\|3-23/D6\|6-19\|RF2/JH4 | .......... | 16471 |
| 18410-G10_AS_final | VH3\|3-23/D6\|6-19\|RF2/JH4 | .......... | 16472 |
| VH3\|3-23/D6\|6-19\|RF2/JH1 | | WGQGTLVTVSS | 16473 |
| 18182-B7 | VH3\|3-23/D6\|6-19\|RF2/JH1 | .......... | 16474 |
| VH3\|3-30.3/D1\|1-1\|RF2/JH4 | | WGQGTLVTVSS | 16475 |
| 18089-D12 | VH3\|3-30.3/D1\|1-1\|RF2/JH4 | .......... | 16476 |
| 02-C1-86-A4-N-F5_final | VH3\|3-30.3/D1\|1-1\|RF2/JH4 | .......... | 16477 |
| 18486-A4_final | VH3\|3-30.3/D1\|1-1\|RF2/JH4 | .......... | 16478 |
| VH1\|1-18/D6\|6-13\|RF2/JH4 | | WGQGTLVTVSS | 16479 |
| 18179-G12 | VH1\|1-18/D6\|6-13\|RF2/JH4 | .......... | 16480 |
| 18179-C1 | VH1\|1-18/D6\|6-13\|RF2/JH4 | .......... | 16481 |

TABLE 63-continued

HEAVY VARIABLE

| | Germline | | SEQ ID NO: |
|---|---|---|---|
| VH3\|3-11/D1\|1-1\|RF3/JH4 | | WGQGTLVTVSS | 16482 |
| 18093-B11 | VH3\|3-11/D1\|1-1\|RF3/JH4 | .......... | 16483 |
| 03-F3-88-B3-F9_final | VH3\|3-11/D1\|1-1\|RF3/JH4 | .......... | 16484 |

TABLE 64 scFv Full Sequences

| Ab | Type | SCFV |
|---|---|---|
| 18398-C7 | NA | GAGGTGCAGCTGCTCGAGTCCGGGGGAGGCTTGGTACAGCCTGGGGGGTCCCTGAGACTCTCCTGTGCAGCCTCCGGATTCACCTTTAG CAGCCATGCCATGAGCTGGGTCCGCCAGGCTCCAGGGAAGGGGCTGGAGTGGGTCTCGTCTATTAGTGGTAGCGGTGGTGGCACATACT ACGCAGCCTCCGTGAAGGGCCGGTTCACCATCTCCAGAGACAATTCCAAGAACACGCTGTATCTGCAAATGAACAGC (SEQ ID NO: 16485) |
| | AA | EVQLLESGGGLVQPGGSLRLSCAASGFTFSSHAMSWVRQAPGKGLEWVSSISGSGGGTYYAASVKGRFTISRDNSKNTLYLQMNSLRAE DTAVYYCATGKGVHLGFDYWGQGTLVTVSSGGGGSGGGGSGGGGSELVLTQPPSVSVAPGQTARITCGGNNIGSKSVHWYQQKPGQAPV MVVYDDNDRPSGIPERFSGSNSGNTATLTISRVEAGDEADYYCQVWDYSPLRHVFGGGTKLTVL (SEQ ID NO: 16486) |
| 18403-D1 | NA | GAGGTGCAGCTGCTCGAGTCCGGGGGAGGCTTGGTAAAGCCTGGGGGGTCCCTGAGACTCTCCTGTGCAGCCTCTGGATTCACCTTCAG TGACTACTACATGAGCTGGATCCGCCAGGCTCCAGGGAAGGGGCTGGAGTGGGTTTCATACATTAGTAAAAGTGGTAGTACCATATACT ACGCAGACTCTGTGAAGGGCCGATTCACCATCTCCAGGGACAACGCCAAGAACTCACTGTATCTGCAAATGAACAGC (SEQ ID NO: 16487) |
| | AA | EVQLLESGGGLVKPGGSLRLSCAASGFTFSDYYMSWIRQAPGKGLEWVSYISKSGSTIYYADSVKGRFTISRDNAKNSLYLQMNSLRAE DTAVYYCATYNYGHFDYWGQGTLVTVSSGGGGSGGGGSGGGGSELVLTQPPSVSVAPGQTARITCGGNNIGSKSVHWYQQKPGQAPVLV VYDDSDRPSGIPERFSGSNSGNTATLTISRVEAGDEADYYCQVWDSSLSYGTVFGGGTKLTVL (SEQ ID NO: 16488) |
| 18403-D8 | NA | GAGGTGCAGCTGCTCGAGTCCGGGGGAGGCTTGGTACAGCCTGGGGGGTCCCTGAGACTCTCCTGTGCAGCCTCTGGATTCACCTTTAG CAGCCATGCCATGAGCTGGGTCCGCCAGGCTCCAGGGAAGGGGCTGGAGTGGGTCTCAACTATTAGTGGAAGTGGTGGTGGCACATACT ACGCAGACTCCGTGAAGGGCCGGTTCACCATCTCCAGAGACAATTCCAAGAACACGCTGTATCTGCAAATGAACAGC (SEQ ID NO: 16489) |
| | AA | EVQLLESGGGLVQPGGSLRLSCAASGFTFSSHAMSWVRQAPGKGLEWVSTISGSGGGTYYADSVKGRFTISRDNSKNTLYLQMNSLRAE DTAVYYCATGKGVHLGFDYWGQGTLVTVSSGGGGSGGGGSGGGGSELVLTQPPSVSVAPGQTARITCGGNNIGSKSVHWYQQKPGQAPV MVVYDDNDRPSGIPERFSGSNEGNTATLIISRVEAGDEADYYCQVWDYRTLDWVFGGGTKLTVI (SEQ ID NO: 16490) |
| 18403-E11 | NA | GAGGTGCAGCTGCTCGAGTCCGGGGGAGGCTTGGTACAGCCTGGGGGGTCCCTGAGACTCTCCTGTGCAGCCTCTGGATTCACCTTTAG CAGCCATGCCATGAGCTGGGTCCGCCAGGCTCCAGGGAAGGGGCTGGAGTGGGTCTCAGCTATTAGTGGAAGTGGTGGTGGCACATACA ACGCAGACTCCGTGAAGGGCCGGTTCACCATCTCCAGAGACAATTCCAAGAACACGCTGTATCTGCAAATGAACAGC (SEQ ID NO: 16491) |
| | AA | EVQLLESGGGLVQPGGSLRLSCAASGFTFSSHAMSWVRQAPGKGLEWVSAISGSGGGTYNADSVKGRFTISRDNSKNTLYLQMNSLRAE DTAAYYCVTGKGVHLGFDYWGQGTLVTVSSGGGGSGGGGSGGGGSELVLTQPPSVSVAPGQTARITCGGNNIGSKSVHWYQQKPGQAPV MVVYDDNDRPSGIPERFSGSNSGNTATLTISRVEAGDEADYYCQVWDYYSNRAVFGGGTKLTVL (SEQ ID NO: 16492) |
| 18403-F3 | NA | GAGGTGCAGCTGCTCGAGTCCGGGGGAGGCTTGGTAAAGCCTGGGGGGTCCCTGAGACTCTCCTGTGCAGCCTCTGGATTCACCTTCAG TGACTACTACATGAGCTGGATCCGCCAGGCTCCAGGGAAGGGGCTGGAGTGGGTTTCATACATTAGTAAAAGTAGCTACACCGTCACGT ACGCAGACTCTGTGAAGGGCCGATTCACCATCTCCAGGGACAACGCCAAGAACTCACTGTATCTGCAAATGAACAGC (SEQ ID NO: 16493) |
| | AA | EVQLLESGGGLVKPGGSLRLSCAASGFTFSDYYMSWIRQAPGKGLEWVSYISKSSYTVTYADSVKGRFTISRDNAKNSLYLQMNSLRAE DTAVYYCATYNYGHFDYWGQGTLVTVSSGGGGSGGGGSGGGGSELVLTQPPSVSVAPGQTARITCGGNNIGSKSVHWYQQKPGQAPVLV VYDDSDRPSGIPERFSGSNSGNTATLTISRVEAGDEADYYCQVWDASAGYGVVFGGGTKLTVL (SEQ ID NO: 16494) |
| 18403-G10 | NA | GAGGTGCAGCTGCTCGAGTCCGGGGGAGGCTTGGTACAGCCTGGGGGGTCCCTGAGACTCTCCTGTGCAGCCTCTGGATTCACCTTTAG CAGCTATGCCATGAGCTGGGTCCGCCAGGCTCCAGGGAAGGGGCTGGAGTGGGTCTCAGCTATTAGTGGAAGTGGTGGTGGCACATACT ACGCAGACTCCGTGAAGGGCCGGTTCACCATCTCCAGAGACAATTCCAAGAACACGCTGTATCTGCAAATGAGCAGC (SEQ ID NO: 16495) |
| | AA | EVQLLESGGGLVQPGGSLRLSCAASGFTFSSYAMSWVRQAPGKGLEWVSAISGSGGGTYYADSVKGRFTISRDNSKNTLYLQMSSLRAE DTAVYYCATGKGVHLGFDYWGQGTLVTVSSGGGGSGGGGSGGGGSELVLTQPPSVSVAPGQTARITCGGNNIGSKSVHWYQQKPGQAPV MVVYDDNDRPSGIPERFSGSNSGNTATLTISRVEAGDEADYYCQVWDYSGQRQVFGGGTKLTVL (SEQ ID NO: 16496) |
| 18409-E2 | NA | GAGGTGCAGCTGCTCGAGTCCGGGGGAGGCTTGGTACAGCCTGGGGGGTCCCTTAGACTCTCCTGTGCAGCCTCTGGATTCACTTTCAG TAACGCCTGGATGAGCTGGGTCCGCCAGGCTCCAGGAAGGGGCTGGAGTGGGTTGGCCGTATTAAAAGCAAAACTTATGGTGGGACAAC AGATTACGCTGCACCCGTGAAAGGCAGATTCACCATCTCAAGAGATGATTCAAAAAACACGCTGTTTCTGCAAATG (SEQ ID NO: 16497) |

TABLE 64-continued scFv Full Sequences

| Ab | Type | SCFV |
|---|---|---|
| | AA | EVQLLESGGGLVQPGGSLRLSCAASGFTFSNAWMSWVRQAPGKGLEWVGRIKSKTYGGTTDYAAPVKGRFTISRDDSKNTLFLQMNSLK<br>TEDTAVYYCTTPSYSGSYYNYFSVMDVWGQGTTVTVSSGGGGSGGGGSGGGGSELVMTQSPSSLSASVGDRVTITCRTSQSISSYLNWY<br>QQKPGRAPKLLIFAASSLQGGVPSRESGSGSGTDFTLTISSLQPEDFATYYCQQSYSSPFTEGPGTKVEIK<br>(SEQ ID NO: 16498 |
| 18409-<br>F12 | NA | GAGGTGCAGCTGCTCGAGTCTGGTCCTGCGCTGGTGAAACCCACACAGACCCTCACGCTGACCTGCACCTTCTCTGGTTTCTCATTCAC<br>CACTCATAAAATGGGTGTGGACTGGATCCGTCAGCCCCAGGAAAGGCCCTGGAGTGGCTTGCACTCATTTATTGGAATGATGATAAGC<br>GCTACAGCCCATCTCTGCAGAGTAGGCTCACCATCACCAAGGACACCTCCAAAAACCAGGTGGTCCTCACAATGACC<br>(SEQ ID NO: 16499 |
| | AA | EVQLLESGPALVKPTQTLTLTCTFSGFSFTTHKMGVDWIRQPPGKALEWLALIYWNDDKRYSPSLQSRLTITKDTSKNQVVLTMTNMDP<br>VDTATYYCAYRRYNWNYENWFDPWGQGTLVTVSSGGGGSGGGGSGGGGSELQMTQSPSSLSASVGDRVTITCQASQDISNYLNWYQQKP<br>GKAPKLLIYAASSLQSGVPSRFGRGSGTDFTLTISSLQPEDFATYYCQQSYYYPTLFGPGTKVEIK<br>SEQ ID NO: 16500 |
| 18409-<br>G10 | NA | GAGGTGCAGCTGCTCGAGTCTGGTCCTACGCTGGTGAAACCCACACAGACCCTCACGCTGACCTGCACCTTCTCTGGTTTCTCATTCAC<br>CACTCATAAAATGGGTGTGGACTGGATCCGTCAGCCCCAGGAAAGGCCCTGGAGTGGCTTGCAGGGATCCACATCTACGATGATAAGC<br>GCTACAGCCCATCTCTGCAGAGTAGGCTCACCATCACCAAGGACACCTCCAAAAACCAGGTGGTCCTCACAATGACC<br>(SEQ ID NO: 16501 |
| | AA | EVQLLESGPTLVKPTQTLTLTCTFSGFSFTTHKMGVDWIRQPPGKALEWLAGIHIYDDKRYSPSLQSRLTITKDTSKNQVVLTMTNMDP<br>VDTATYYCAYRRYNWNYENWEDPWGQGTLVTVSSGGGGSGGGGSGGGGSELQMTQSPSSLSASVGDRVTITCQASQDISNYFNWYQQKP<br>GKAPKLLIYAASSLQSGVPSRFSGSGSGTDFTLTISSLQPEDFATYYCQQSYITPFTFGPGTKVEIK<br>(SEQ ID NO: 16502 |
| 18409-<br>H7 | NA | GAGGTGCAGCTGCTCGAGTCTGGTCCTGCGCTGGTGAAACCCACACAGACCCTCACGCTGACCTGCACCTTCTCTGGTTTCTCATTCAC<br>CACTCATAAAATGGGTGTGGACTGGATCCGTCAGCCCCAGGAAAGGCCCTGGAGTGGCTTGCACTCATTTATTGGAATGATGATAAGC<br>GCTACAGCCCATCTCTGCAGAGTAGGCTCACCATCACCAAGGACACCTCCAAAAACCAGGTGGTCCTCACAATGACC<br>(SEQ ID NO: 16503 |
| | AA | EVQLLESGPALVKPTQTLTLTCTFSGFSFTTHKMGVDWIRQPPGKALEWLALIYWNDDKRYSPSLQSRLTITKDTSKNQVVLTMTNMDP<br>VDTATYYCAYRRYNWNYENWFDPWGQGTLVTVSSGGGGSGGGGSGGGGSELQMTQSPSSLSASVGDRVTITCQASQDISNYLNWYQQKP<br>GKAPKLLIYAASSLQSGVPSRESGSGSGTDFTLTISSLQPEDFATYYCQQSYFPVVEFGPGTKVEIK<br>(SEQ ID NO: 16504 |
| 18410-<br>G10 | NA | GAGGTGCAGCTGCTCGAGTCCGGGGGAGGCTTGGTACAGCCTGGGGGGTCCCTGAGACTCTCCTGTGCAGCCTCTGGATTCACCTTTAG<br>CAGCCATGCCATGAGCTGGGTCCGCCAGGCTCCAGGGAAGGGGCTGGAGTGGGTCTCAGCTATTAGTGGTAGTGGTGGTGGACACATACA<br>ACGCAGACTCCGTGAAGGGCCGGTTCACCATCTCCAGAGACAATTCCAAGAACACGCTGTATCTGCAAATGAACAGC<br>(SEQ ID NO: 16505 |
| | AA | EVQLLESGGGLVQPGGSLRLSCAASGFTFSSHAMSWVRQAPGKGLEWVSAISGSGGGTYNADSVKGRFTISRDNSKNTLYLQMNSLRAE<br>DTAVYYCATGKGVHLGFDYWGQGTLVTVSSGGGGSGGGGSGGGGSELVLTQPPSVSVAPGQTARITCGGNNIGSKSVHWYQQKPGQAPV<br>MVVYDDNDRPSGIPERFSGSNSGNTATLTISRVEAGDEADYYCQVWDYVAPRHVFGGGTKLTVL<br>SEQ ID NO: 16506 |
| 18410-<br>H1 | NA | GAGGTGCAGCTGCTCGAGTCCGGGGGAGGCTTGGTACAGCCTGGGGGGTCCCTTAGACTCTCCTGTGCAGCCTCTGGATTCACTTTCAG<br>TAACGCCTGGATGAGCTGGGTCCGCCAGGCTCCAGGGAAGGGGTTGGAGTGGGTTGGCCGCATTACGTCCGGCATCTATGGTGGGACAA<br>CAGACTACGCTGCACCCGTGAAAGGCAGATTCACCATCTCAAGAGATGATTCAAAAAACACGCTGTATCTGCAAATG<br>(SEQ ID NO: 16507 |
| | AA | EVQLLESGGGLVQPGGSLRLSCAASGFTFSNAWMSWVRQAPGKGLEWVGRITSGIYGGTTDYAAPVKGRFTISRDDSKNTLYLQMNSLK<br>TEDTAVYYCTTPSYSGSYYNYFSVMDVWGQGTTVTVSSGGGGSGGGGSGGGGSELVMTQSPSSLSASVGDRVTITCRTSQSISSYLNWY<br>QQKPGRAPKLLIFAASSLQGGVPSRESGSGSGTDFTLTISSLQPEDFATYYCQQTYSMPFTFGPGTKVDIK<br>(SEQ ID NO: 16508 |
| 18410-<br>H3 | NA | GAGGTGCAGCTGCTCGAGTCCGGGGGAGGCTTGGTACAGCCTGGGGGGTCCCTGAGACTCTCCTGTGCAGCCTCTGGATTCACTTTCAG<br>TAACGCCTGGATGAGCTGGGTCCGCCAGGCTCCAGGGAAGGGGCTGGAGTGGGTTGGCCGGATTAGGAGCAGGCCCTATGGTGGGACAA<br>CAGACTACGCTGCACCCGTGAAAGGCAGATTCACCATCTCAAGAGATGATTCAAAAAACACGCTGTATCTGCAAATG<br>(SEQ ID NO: 16509 |
| | AA | EVQLLESGGGLVQPGGSLRLSCAASGFTFSNAWMSWVRQAPGKGLEWVGRIRSRPYGGTTDYAAPVKGRFTISRDDSKNTLYLQMNSLK<br>TEDTAVYYCTTPSYSGSYYNYFSVMDVWGQGTTVTVSSGGGGSGGGGSGGGGSELQMTQSPSSLSASVGDRVTITCRTSQSISSYLNWY<br>QQKPGRAPKLLIFAASSLQGGVPSRFSGSGSGTDFTLTISSLQPEDFATYYCQQTYSSPFTFGPGTKLEIK<br>(SEQ ID NO: 16510 |

TABLE 65

ScFv VL CDRs

| Ab | Type | CDR1 | CDR2 | CDR3 |
|---|---|---|---|---|
| 18398-<br>C7 | NA | GGGGGAAACAACATTGGAAGTAAAAGTGTGCAC<br>(SEQ ID NO: 16511) | GATGATAACGACCGGCCCTCA<br>(SEQ ID NO: 16563) | CAGGTGTGGGATTATAGCCCCTTGAGG<br>CACGTA<br>(SEQ ID NO: 16615 |
| | AA | GGNNIGSKSVH<br>(SEQ ID NO: 16512) | DDNDRPS<br>(SEQ ID NO: 16564) | QVWDYSPLRHV<br>(SEQ ID NO: 16616 |

TABLE 65-continued

ScFv VL CDRs

| Ab | Type | CDR1 | CDR2 | CDR3 |
|---|---|---|---|---|
| 18403-D1 | NA | GGGGGAAACAACATTGGAAGTAAAAGTGTGCAC (SEQ ID NO: 16513) | GATGATAGCGACCGGCCCTCA (SEQ ID NO: 16565) | CAGGTGTGGGACTCTAGTCTGTCCTACGGGACGGTA (SEQ ID NO: 16617) |
| | AA | GGNNIGSKSVH (SEQ ID NO: 16514) | DDSDRPS (SEQ ID NO: 16566) | QVWDSSLSYGTV (SEQ ID NO: 16618) |
| 18403-D8 | NA | GGGGGAAACAACATTGGAAGTAAAAGTGTGCAC (SEQ ID NO: 16515) | GATGATAACGACCGGCCCTCA (SEQ ID NO: 16567) | CAGGTGTGGGATTATCGCACGCTCGACTGGGTA (SEQ ID NO: 16619) |
| | AA | GGNNIGSKSVH (SEQ ID NO: 16516) | DDNDRPS (SEQ ID NO: 16568) | QVWDYRTLDWV (SEQ ID NO: 16620) |
| 18403-E11 | NA | GGGGGAAACAACATTGGAAGTAAAAGTGTGCAC (SEQ ID NO: 16517) | GATGATAACGACCGGCCCTCA (SEQ ID NO: 16569) | CAGGTGTGGGATTATTACTCCAACAGGGCCGTA (SEQ ID NO: 16621) |
| | AA | GGNNIGSKSVH (SEQ ID NO: 16518) | DDNDRPS (SEQ ID NO: 16570) | QVWDYYSNRAV (SEQ ID NO: 16622) |
| 18403-F3 | NA | GGGGGAAACAACATTGGAAGTAAAAGTGTGCAC (SEQ ID NO: 16519) | GATGATAGCGACCGGCCCTCA (SEQ ID NO: 16571) | CAGGTGTGGGACGCTAGTGCGGGGTACGGGGTCGTA (SEQ ID NO: 16623) |
| | AA | GGNNIGSKSVH (SEQ ID NO: 16520) | DDSDRPS (SEQ ID NO: 16572) | QVWDASAGYGVV (SEQ ID NO: 16624) |
| 18403-G10 | NA | GGGGGAAACAACATTGGAAGTAAAAGTGTGCAC (SEQ ID NO: 16521) | GATGATAACGACCGGCCCTCA (SEQ ID NO: 16573) | CAGGTGTGGGATTATTCGGGGCAGAGGCAGGTA (SEQ ID NO: 16625) |
| | AA | GGNNIGSKSVH (SEQ ID NO: 16522) | DDNDRPS (SEQ ID NO: 16574) | QVWDYSGQRQV (SEQ ID NO: 16626) |
| 18409-E2 | NA | CGGACAAGTCAGAGCATTAGCAGCTATTTAAAT (SEQ ID NO: 16523) | GCTGCATCCAGTTTGCAAGGT (SEQ ID NO: 16575) | CAACAGAGTTACAGTAGTCCATTCACT (SEQ ID NO: 16627) |
| | AA | RTSQSISSYLN (SEQ ID NO: 16524) | AASSLQG (SEQ ID NO: 16576) | QQSYSSPFT (SEQ ID NO: 16628) |
| 18409-F12 | NA | CAGGCGAGTCAGGACATTAGCAACTATTTAAAT (SEQ ID NO: 16525) | GCTGCATCCAGTTTGCAAAGT (SEQ ID NO: 16577) | CAACAGAGTTACTACTACCCCACCCTC (SEQ ID NO: 16629) |
| | AA | QASQDISNYLN (SEQ ID NO: 16526) | AASSLQS (SEQ ID NO: 16578) | QQSYYYPTL (SEQ ID NO: 16630) |
| 18409-G10 | NA | CAGGCGAGTCAGGACATTAGCAACTATTTCAAT (SEQ ID NO: 16527) | GCTGCATCCAGTTTGCAAAGT (SEQ ID NO: 16579) | CAACAGAGTTACATTACCCCGTTCACT (SEQ ID NO: 16631) |
| | AA | QASQDISNYFN (SEQ ID NO: 16528) | AASSLQS (SEQ ID NO: 16580) | QQSYITPFT (SEQ ID NO: 16632) |
| 18409-H7 | NA | CAGGCGAGTCAGGACATTAGCAACTATTTAAAT (SEQ ID NO: 16529) | GCTGCATCCAGTTTGCAAAGT (SEQ ID NO: 16581) | CAACAGAGTTACTTCCCCGTCGTCGAG (SEQ ID NO: 16633) |
| | AA | QASQDISNYLN (SEQ ID NO: 16530) | AASSLQS (SEQ ID NO: 16582) | QQSYFPVVE (SEQ ID NO: 16634) |
| 18410-G10 | NA | GGGGGAAACAACATTGGAAGTAAAAGTGTGCAC (SEQ ID NO: 16531) | GATGATAACGACCGGCCCTCA (SEQ ID NO: 16583) | CAGGTGTGGGATTATGTGGCGCCGAGGCACGTA (SEQ ID NO: 16635) |
| | AA | GGNNIGSKSVH (SEQ ID NO: 16532) | DDNDRPS (SEQ ID NO: 16584) | QVWDYVAPRHV (SEQ ID NO: 16636) |
| 18410-H1 | NA | CGGACAAGTCAGAGCATTAGCAGCTATTTAAAT (SEQ ID NO: 16533) | GCTGCATCCAGTTTGCAAAGT (SEQ ID NO: 16585) | CAACAGACTTACAGTATGCCATTCACT (SEQ ID NO: 16637) |
| | AA | RTSQSISSYLN (SEQ ID NO: 16534) | AASSLQS (SEQ ID NO: 16586) | QQTYSMPFT (SEQ ID NO: 16638) |
| 18410-H3 | NA | CGGACAAGTCAGAGCATTAGCAGCTATTTAAAT (SEQ ID NO: 16535) | GCTGCATCCAGTTTGCAAGGT (SEQ ID NO: 16587) | CAACAGACTTACAGTAGTCCATTCACT (SEQ ID NO: 16639) |
| | AA | RTSQSISSYLN SEQ ID NO: 16536 | AASSLQG (SEQ ID NO: 16588) | QQTYSSPFT (SEQ ID NO: 16640) |

TABLE 66

ScFv VH CDRs

| Ab | Type | CDR1 | CDR2 | CDR3 |
|---|---|---|---|---|
| 18398-C7 | NA | AGCCATGCCATGAGC (SEQ ID NO: 16537) | TCTATTAGTGGTAGCGGTGGTGGCACATAC TACGCAGCCTCCGTGAAGGGG (SEQ ID NO: 16589) | GGAAAGGGAGTACATCTGGGCTTTGACTAC (SEQ ID NO: 16641) |
|  | AA | SHAMS (SEQ ID NO: 16538) | SISGSGGGTYYAASVKG (SEQ ID NO: 16590) | GKGVHLGEDY (SEQ ID NO: 16642) |
| 18403-D1 | NA | GACTACTACATGAGC (SEQ ID NO: 16539) | TACATTAGTAAAAGTGGTAGTACCATATAC TACGCAGACTCTGTGAAGGGC (SEQ ID NO: 16591) | TACAACTATGGTCACTTTGACTAC (SEQ ID NO: 16643) |
|  | AA | DYYMS (SEQ ID NO: 16540) | YISKSGSTIYYADSVKG (SEQ ID NO: 16592) | YNYGHFDY (SEQ ID NO: 16644) |
| 18403-D8 | NA | AGCCATGCCATGAGC (SEQ ID NO: 16541) | ACTATTAGTGGAAGTGGTGGTGGCACATAC TACGCAGACTCCGTGAAGGGC (SEQ ID NO: 16593) | GGAAAGGGAGTACATCTGGGCTTTGACTAC (SEQ ID NO: 16645) |
|  | AA | SHAMS (SEQ ID NO: 16542) | TISGSGGGTYYADSVKG (SEQ ID NO: 16594) | GKGVHLGFDY (SEQ ID NO: 16646) |
| 18403-E11 | NA | AGCCATGCCATGAGC (SEQ ID NO: 16543) | GCTATTAGTGGAAGTGGTGGTGGCACATAC AACGCAGACTCCGTGAAGGGC (SEQ ID NO: 16595) | GGAAAGGGAGTACATCTGGGCTTTGACTAC (SEQ ID NO: 16647) |
|  | AA | SHAMS (SEQ ID NO: 16544) | AISGSGGGTYNADSVKG (SEQ ID NO: 16596) | GKGVHLGFDY (SEQ ID NO: 16648) |
| 18403-F3 | NA | GACTACTACATGAGC (SEQ ID NO: 16545) | TACATTAGTAAAAGTAGCTACACCGTCACG TACGCAGACTCTGTGAAGGGC (SEQ ID NO: 16597) | TACAACTATGGTCACTTTGACTAC (SEQ ID NO: 16649) |
|  | AA | DYYMS (SEQ ID NO: 16546) | YISKSSYTVTYADSVKG (SEQ ID NO: 16598) | YNYGHEDY (SEQ ID NO: 16650) |
| 18403-G10 | NA | AGCTATGCCATGAGC (SEQ ID NO: 16547) | GCTATTAGTGGAAGTGGTGGTGGCACATAC TACGCAGACTCCGTGAAGGGC (SEQ ID NO: 16599) | GGAAAGGGAGTACATCTGGGCTTTGACTAC (SEQ ID NO: 16651) |
|  | AA | SYAMS (SEQ ID NO: 16548) | AISGSGGGTYYADSVKG (SEQ ID NO: 16600) | GKGVHLGFDY (SEQ ID NO: 16652) |
| 18409-E2 | NA | AACGCCTGGATGAGC (SEQ ID NO: 16549) | CGTATTAAAAGCAAACTTATGGTGGGACA ACAGACTACGCTGCACCCGTGAAAGGC (SEQ ID NO: 16601) | CCTTCGTATAGTGGGAGCTATTATAATTAC TTCTCCGTTATGGACGTC (SEQ ID NO: 16653) |
|  | AA | NAWMS (SEQ ID NO: 16550) | RIKSKTYGGTTDYAAPVKG (SEQ ID NO: 16602) | PSYSGSYYNYFSVMDV (SEQ ID NO: 16654) |
| 18409-F12 | NA | ACTCATAAAATGGGTGTGGAC (SEQ ID NO: 16551) | CTCATTTATTGGAATGATGATAAGCGCTAC AAGCCCATCTCTGCAGAGT (SEQ ID NO: 16603) | AGACGGTATAACTGGAACTACGAGAACTGG TTCGACCCC (SEQ ID NO: 16655) |
|  | AA | THKMGVD (SEQ ID NO: 16552) | LIYWNDDKRYSPSLQS (SEQ ID NO: 16604) | RRYNWNYENWFDP (SEQ ID NO: 16656) |
| 18409-G10 | NA | ACTCATAAAATGGGTGTGGAC (SEQ ID NO: 16553) | GGGATCCACATCTACGATGATAAGCGCTAC AGCCCATCTCTGCAGAGT (SEQ ID NO: 16605) | AGACGGTATAACTGGAACTACGAGAACTGG TTCGACCCC (SEQ ID NO: 16657) |
|  | AA | THKMGVD (SEQ ID NO: 16554) | GIHIYYDDKRYSPSLQS (SEQ ID NO: 16606) | RRYNWNYENWFDP (SEQ ID NO: 16658) |
| 18409-H7 | NA | ACTCATAAAATGGGTGTGGAC (SEQ ID NO: 16555) | CTCATTTATTGGAATGATGATAAGCGCTAC AGCCCATCTCTGCAGAGT (SEQ ID NO: 16607) | AGACGGTATAACTGGAACTACGAGAACTGG TTCGACCCC (SEQ ID NO: 16659) |
|  | AA | THKMGVD (SEQ ID NO: 16556) | LIYWNDDKRYSPSLQS (SEQ ID NO: 16608) | RRYNWNYENWFDP (SEQ ID NO: 16660) |
| 18410-G10 | NA | AGCCATGCCATGAGC (SEQ ID NO: 16557) | GCTATTAGTGGTAGTGGTGGTGGCACATAC AACGCAGACTCCGTGAAGGGC (SEQ ID NO: 16609) | GGAAAGGGAGTACATCTGGGCTTTGACTAC (SEQ ID NO: 16661) |
|  | AA | SHAMS (SEQ ID NO: 16558) | AISGSGGGTYNADSVKG (SEQ ID NO: 16610) | GKGVHLGFDY (SEQ ID NO: 16662) |
| 18410-H1 | NA | AACGCCTGGATGAGC (SEQ ID NO: 16559) | CGCATTACGTCCGGCATCTATGGTGGGACA ACAGACTACGCTGCACCCGTGAAAGGC (SEQ ID NO: 16611) | CCTTCGTATAGTGGGAGCTATTATAATTAC TTCTCCGTTATGGACGTC (SEQ ID NO: 16663) |
|  | AA | NAWMS (SEQ ID NO: 16560) | RITSGIYGGTTDYAAPVKG (SEQ ID NO: 16612) | PSYSGSYYNYFSVMDV (SEQ ID NO: 16664) |

TABLE 66-continued

ScFv VH CDRs

| Ab | Type | CDR1 | CDR2 | CDR3 |
|---|---|---|---|---|
| 18410-H3 | NA | AACGCCTGGATGAGC (SEQ ID NO: 16561 | CGGATTAGGAGCAGGCCCTATGGTGGGACA ACAGACTACGCTGCACCCGTGAAAGGC (SEQ ID NO: 16613 | CCTTCGTATAGTGGGAGCTATTATAATTAC TTCTCCGTTATGGACGTC (SEQ ID NO: 16665 |
| | AA | NAWMS (SEQ ID NO: 16562) | RIRSRPYGGTTDYAAPVKG (SEQ ID NO: 16614) | PSYSGSYYNYFSVMDV (SEQ ID NO: 16666) |

TABLE 67 scFv Variable Region Sequences

| Ab | Type | LC V-region | HC V-region |
|---|---|---|---|
| 18398-C7 | NA | GAGCTCGTCGTGCTGACTCAGCCACCTTCGGTGTCAGTGGCTGTCCCAGGACAGACGGCCAGGA TTACCTGTGGGGAAACAACATTGGAAGTAAAAGTGTGCACTGGTACCAACAGAAGCC AGGCCAGGCCCCTGTGCTCTATGATGATAACGACCGGCCCTCAGGGATCCCT GAGCGATTCTCTGGCTCCAACTCTGGGAACACGGCCACCATCAGCAGGCTCG AAGCCGGGGATGAGGCCGACTAT (SEQ ID NO: 16667) | GAGGTGCAGCTGCTCGAGTCCGGGGGAGGCTTGTGTACAGCCTGGGGGGTCCCTGAGACTCTCCTGTGCAGCCTCCGG ATTCACCTTTAGCAGCCATGCCATGAGCTGGGTCCGCCAGGCTCCAGGGAAGGGCTGGAGTGGGTCTCTGTTATA GTGGTAGCGGTGGTGGCACATACTACGCAGCCTCCGTGAAGGGCCGGTTCACCATCTCCAGAGACAATTCCAAGAAC ACGCTGTATCTGCAAATGAACAGC (SEQ ID NO: 16693) |
| | AA | ELVLTQPPSVSVAPGQTARITCGGNNIGSKSVHWYQQKPGQAPVMVVYDDNDRPSGIP ERFSGSNSGNTATLTISRVEAGDEADYYCQVWDYSPLRHVFGGGTKLTVL (SEQ ID NO: 16668) | EVQLLESGGGLVQPGGSLRLSCAASGFTFSSHAMSWVRQAPGKGLEWVSSISGSGGGTYYAASVKGRFTISRDNSKN TLYLQMNSLRAEDTAVYYCATGKGVHLGFPDYWGQGTLVTVSS (SEQ ID NO: 16694) |
| 18403-D1 | NA | GAGCTCGTGCTGACTCAGCCGCCCTCGGTGTCAGTGGCCCCAGGACAGACGGCCAGGA TTACCTGTGGGGGAAACAACATTGGAAGTGTGCACTGGTACCAGCAGAAGCC AGGCCAGGCCCCTGTGCTGTCTATGATGATAGCGACCGGCCCTCAGGGATCCCT GAGCGATTCTCTGGCTCCAACTCTGGGAACACGGCCACCCTGACCATCAGCAGGCTCG AAGCCGGGGATGAGGCCGACTAT (SEQ ID NO: 16669) | GAGGTGCAGCTGCTCGAGTCCGGGGGAGGCTTGGTAAAGCCTGGGGGGTCCCTGAGACTCTCCTGTGCAGCCTCTGG ATTCACCTTCAGTGACTACTATATGAGCTGGATCCGCCAGGCTCCAGGGAAGGGGCTGGAGTGGGTTTCATACATTA GTAAAAGTGGTAGTACCATATACTACGCAGACTCTGTAAAGGGCCGATTCACCATCTCCAGGGACAACGCCAAGAAC TCACTGTATCTGCAAATGAACAGC (SEQ ID NO: 16695) |
| | AA | ELVLTQPPSVSVAPGQTARITCGGNNIGSKSVHWYQQKPGQAPVLVVYDDSDRPSGIP ERFSGSNSGNTATLTISRVEAGDEADYYCQVWDSSLSYGTVFGGGTKLTVL (SEQ ID NO: 16670) | EVQLLESGGGLVKPGGSLRLSCAASGFTFSDYYMSWIRQAPGKGLEWVSYISKSGSTIYYADSVKGRFTISRDNAKN SLYLQMNSLRAEDTAVYYCATYNYGHFDYWGQGTLVTVSS (SEQ ID NO: 16696) |
| 18403-D8 | NA | GAGCTCGTCGTGCTGACTCAGCCACCTTCGGTGTCAGTGGCCCCAGGACAGACGGCCAGGA TTACCTGTGGGGGAAACAACATTGGAAGTAAAAGTGTGCACTGGTACCAACAGAAGCCA GGCCAGGCCCCTGTATGATGTCTATGATGATAACGACCGGCCCTCAGGGATCCCT AGCGATTCTCTGGCTCCAACTTTGGGAACACGGCCACCCTGATTATCAGTAGGGTCGA AGCCGGGGATGAGGCCGACTAT (SEQ ID NO: 16671) | GAGGTGCAGCTGCTCGAGTCCGGGGGAGGCTTGGTACAGCCTGGGGGGTCCCTGAGACTCTCCTGTGCAGCCTCTGG ATTCACCTTTAGCAGCCATGCCATGAGCTGGGTCCGCCAGGCTCCAGGGAAGGGCTGGAGTGGGTCTCAACTATTA GTGGAAGTGGTGGTGGCACATACTACGCAGACTCCGTGAAGGGCCGGTTCACCATCTCCAGAGACAATTCCAAGAAC ACGCTGTATCTGCAAATGAACAGC (SEQ ID NO: 16697) |
| | AA | ELVLTQPPSVSVAPGQTARITCGGNNIGSKSVHWYQQKPGQAPVMVVYDDNDRPSGIP ERFSGSNFGNTATLIISRVEAGDEADYYCQVWDYRTLDNVFGGGTKLTVL (SEQ ID NO: 16672) | EVQLLESGGGLVQPGGSLRLSCAASGFTESSSHAMSWVRQAPGKGLEWVSTISGSGGGTYYADSVKGRFTISRDNSKN TLYLQMNSLRAEDTAVYYCATGKGVHLGFPDYWGQGTLVTVSS (SEQ ID NO: 16698) |
| 18403-E11 | NA | GAGCTCGTCGTGCTGACTCAGCCACCCTCGGTGTCAGTGGCCCCAGGACAGACGGCCAGGA TAACCTGTGGGGAAACAACATTGGAAGTAAAAGTGTGCACTGGTACCAACAGAAGCC AGGCCAGGCCCCTGTGCTCTATGATGATAACGACCGGCCCTCAGGGATCCCT GAGCGATTCTCTGGCTCCAACTCTGGGAACACGGCCACCATCAGCAGGCTCG AAGCCGGGGATGAGGCCGACTAT (SEQ ID NO: 16673) | GAGGTGCAGCTGCTCGAGTCCGGGGGAGGCTTGGTACAGCCTGGGGGGTCCCTGAGACTCTCCTGTGCAGCCTCTATTA ATTCACCTTTAGCAGCCATGCCATGAGCTGGGTCCGCCAGGCTCCAGGGAAGGGCTGGAGTGGGTCTCAGCTATTA GTGAAAGTGGTGGTGGCACATACAACGCAGACTCCGTGAAGGGCCGGTTCACCATCTCCAGAGACAATTCCAAGAAC ACGCTGTATCTGCAAATGAACAGC (SEQ ID NO: 16699) |
| | AA | ELVLTQPPSVSVAPGQTARITCGGNNIGSKSVHWYQQKPGQAPVMVVYDDNDRPSGIP ERFSGSNSGNTATLTISRVEAGDEADYYCQVWDYYSNRAVFGGGTKLTVL (SEQ ID NO: 16674) | EVQLLESGGGLVQPGGSLRLSCAASGFTFSSHAMSWVRQAPGKGLEWVSAISGSGGGTYNADSVKGRFTISRDNSKN TLYLQMNSLRAEDTAAYYCVTGKGVHLGFPDYWGQGTLVTVSS (SEQ ID NO: 16700) |

TABLE 67-continued scFv Variable Region Sequences

| Ab | Type | LC V-region | HC V-region |
|---|---|---|---|
| 18403-F3 | NA | GAGCTCGTGCTGACTCAGCCGCCCTCGGTGTCAGTGGCCCCAGGA<br>TTACCTGTGGGGGAAACAACATTGGAAGTAAAAGTGTGCACTGGTACCAGCAGAAGC<br>AGGCCAGGCCCCTGTGCTGGTCGTCTATGATGATAGCGACCGGCCCTCAGGGATCCT<br>GAGCGATTCTCTGGCTCCAACTCTGGGAACACGGCCACCCTGACCATCAGCAGGGTCG<br>AAGCCGGGGATGAGGCCGACTAT<br>(SEQ ID NO: 16675) | GAGGTGCAGCTGCTCGAGTCTGGGGGAGGCTTGTGTAAAGCCTGGGGGTCCCTGAGACTCTCCTGTGCAGCCTCTGG<br>ATTCACCTTCAGTGACTACTACCGTCACGTACGCAGACTCTGTGAAGGGCCGATTCACCATCTCCAGGGACAACGCCAAGAAC<br>GTAAAAGTAGCTACACCGTCACGTACGCAGACTCTGTGAAGGGCCGATTCACCATCTCCAGGGACAACGCCAAGAAC<br>TCACTGTATCTGCAAATGAACAGC<br>(SEQ ID NO: 16701) |
| 18403-F3 | AA | ELVLTQPPSVSVAPGQTARITCGGNNIGSKSVHWYQQKPGQAPVLVVYDDSDRPSGIP<br>ERFSGSNSGNTATLTISRVEAGDEADYYCQVWDASAGYVFGGGTKLTVL | EVQLLESGGGLVKPGGSLRLSCAASGFTFSDYYMSWIRQAPGKGLEWVSYISKSSYTVTYADSVKGRFTISRDNAKN<br>SLYLQMNSLRAEDTAVYYCATYNYGHFDYWGQGTLVTVSS |
| | | (SEQ ID NO: 16676) | (SEQ ID NO: 16702) |
| 18403-G10 | NA | GAGCTCGTGTTGACCCAGCCGCCCTCGGTGTCAGTGGCTCCCAGGACAGACGGCCAGGA<br>TAACCTGTGGGGGGAAACAACATTGGAAGTAAAGTGTGCACTGGTACCAACAGAAGCC<br>AGGCCAGGCCCCCTGTGATGGTCGTCTATGATGATAACGACCGGCCCTCAGGGATCCCT<br>GAGCGATTCTCTGGCTCCAACTCTGGGAACACGGCCACCCTGACCATCAGCAGGGTCG<br>AAGCCGGGGATGAGGCCGACTAT<br>(SEQ ID NO: 16677) | GAGGTGCAGCTGCTCGAGTCTGGGGGAGGCTTGGTACAGCCTGGGGTCCGCCAGGCTCCAGGAAGGGCTTGGAGTGGGTCGCATATTA<br>ATTCACCTTTAGCAGCTATGCCATGAGCTGGGTCCGCCAGGCTCCAGGAAGGGCTGGAGTGGGTCTCAGCTATTA<br>GTGGAAGTGGTGGTGGCACATACTACGCAGACTCCGTGAAGGGCCGGTTCACCATCTCCAGAGACAATTCCAAGAAC<br>ACGCTGTATCTGCAAATGAGCAGC<br>(SEQ ID NO: 16703) |
| 18403-G10 | AA | ELVLTQPPSVSVAPGQTARITCGGNNIGSKSVHWYQQKPGQAPVMVVYDDNDRPSGIP<br>ERFSGSNSGNTATLTISRVEAGDEADYYCQVWDYSGQRQVFGGGTKLTVL | EVQLLESGGGLVQPGGSLRLSCAASGFTFSSYAMSWVRQAPGKGLEWVSAISGSGGGTYYADSVKGRFTISRDNSKN<br>TLYLQMSSLRAEDTAVYYCATGKGVHLGPDYWGQGTLVTVSS |
| | | (SEQ ID NO: 16678) | (SEQ ID NO: 16704) |
| 18409-E2 | NA | GAGCTCGTGATGACCCAGTCTCCATCCTCCCTGTCTGCATCTGTAGGAGACAGAGTCA<br>CCATCACTTGCCGGACAAGTCAGAGCGTCAGCAGTATTAGCAGCAACTATTTAAATTGGTATCAGCAGAA<br>ACCAGGGAAGGCCCCCTAAGCTCCTGATCTATGCTGCATCCAGTTTGCAAAGTGGGGTC<br>CCATCAAGGTTCAGTGGCAGTGGATCTGGGACAGATTTCACTCTCACCATCAGCAGTC<br>TGCAACCTGAAGATTTTGCAACT<br>(SEQ ID NO: 16679) | GAGGTGCAGCTGCTCGAGTCTGGGGGAGGCGTGGTCCAGCCTGGGGGGTCCCTTAGACTCTCCTGTGCAGCAGCCTCTGG<br>ATTCACTTTCAGTAACGCCTGGATGAGCTGGGTCCGCCAGGCTCCAGGGAAGGGGCTGGAGTGGGTTGGCCGTATTA<br>AAAGCAAAACTTATGTGGGACAACACAGATACGCTACACCGTGAAAGGCAGATTCACCATCTCAAGAGATGATTCA<br>AAAAACACGCTGTTTCTGCAAATG<br>(SEQ ID NO: 16705) |
| 18409-E2 | AA | ELVMTQSPSSLSASVGDRVTITCRTSQSISYLNWYQQKPGRAPKLLIFAASSLQGGV<br>PSRFSGSGSGTDFTLTISSLQPEDFATYYCQQSYSSPFTFGPGTKVEIK | EVQLLESGGGLVQPGGSLRLSCAASGFTFSNAWMSWVRQAPGKGLEWVGRIKSKTYGGTTDYAAPVKGRFTISRDDS<br>KNTLFLQMNSLKTEDTAVYYCTTPSYSGSYNYRSVMDVWGQGTTVTVSS |
| | | (SEQ ID NO: 16680) | (SEQ ID NO: 16706) |
| 18409-F12 | NA | GAGCTCCAGATGACCCAGTCTCCATCTCCCTGTCTGCATCTGTAGGAGACAGAGTCA<br>CCATCACTTGCCAGGCGAGTCAGGCAATTAGCAACTATTTAAATTGGTATCAGCAGAA<br>ACCAGGGAAAGCCCCTAAGCTCCTGATCTATGCTGCATCCAGTTTGCAAAGTGGGGTC<br>CCATCAAGGTTCAGTGGCAGTGGATCTGGGACAGATTTCACTCTCACCATCAGCAGTC<br>TGCAACCTGAAGATTTTGCAACT<br>(SEQ ID NO: 16681) | GAGGTGCAGCTGCTCGAGTCTGGTCTGGCTGGTGAAACCCACACAGACCCTCACGCTGACCTGCACCTTCTCTGG<br>TTTCTCATTCACCACTCACAAGATGGGTGTGGAACTGGATCTGTCGCAGCCCCAGGAAAGGCCCTGGAGTGCGTTGCAC<br>TCATTATTGGAATGATGATAAGCGCTACAGCCCATCTCTGCAGAGTAGGCTCACCATCACCAAGGACACCTCCAAA<br>AACCAGGTGCTCCTCACAATGACC<br>(SEQ ID NO: 16707) |
| 18409-F12 | AA | ELQMTQSPSSLSASVGDRVTITCQASQDISNYLNWYQQKPGKAPKLLIYAASSLQSGV<br>PSRFSGRGSGTDFTLTISSLQPEDFATYYCQQSYYYPLTFGPGTKVEIK | EVQLLESGPALVKPTQTLTLTCTFSGFSFTTHKMGVDWIRQPPGKALEWLALIYWNDDKRYSPSLQSRLTITKDTSK<br>NQVVLTMTNMDPVDTATYYCAYRRYNWNYENWFDPWGQGTLVTVSS |
| | | (SEQ ID NO: 16682) | (SEQ ID NO: 16708) |
| 18409-G10 | NA | GAGCTCCAGATGACCCAGTCTCCATCTCCCTGTCTGCATCTGTAGGAGACAGAGTCA<br>CCATCACTTGCCAGGCGAGTCAGGCAGTTAGCAACTATTTCAATTGGTATCAGCAGAA<br>ACCAGGGAAAGCCCCTAAGCTCCTGATCTATGCTGCATCCAGTTTGCAAAGTGGGGTC<br>CCATCAAGGTTCAGTGGCAGTGGATCTGGGACAGATTTCACTCTCACCATCAGCAGTC<br>TGCAACCTGAAGATTTTGCAACT<br>(SEQ ID NO: 16683) | GAGGTGCAGCTGCTCGAGTCTGGTCTGGCTGGTGAAACCCACACAGACCCTCACGCTGACCTGCACCTTCTCTGG<br>TTTCTCATTCACCACTACGAGTCAGGAACTGGATCTGTCCAGCCCCCAGGAAAGGCCCTGGAGTGCGTTGCAC<br>GGATCCACATCTACGATGATAAGCGCTACAGCCCATCTCTGCAGAGTAGGCTCACCATCACCAAGGACACCTCCAAA<br>AACCAGGTGCTCCTCACAATGACC<br>(SEQ ID NO: 16709) |

TABLE 67-continued scFv Variable Region Sequences

| Ab | Type | LC V-region | HC V-region |
|---|---|---|---|
| | AA | ELQMTQSPSSLSASVGDRVTITCQASQDISNYFNWYQQKPGKAPKLLIYAASSLQSGV PSRFSGSGSGTDFTLTISSLQPEDFATYYCQQSYITPFTFGPGTKVEIK (SEQ ID NO: 16683) | EVQLLESGPTLVKPTQTLTLTCFSGFSFTTHKMGVDWIRQPPGKALEWLAGIHIYDDKRYSPSLQSRLTITKDTSK NQVLTMTNMDPVDTATYYCAYRRYNWNYENWFDPWGQGTLVTVSS (SEQ ID NO: 16710) |
| 18409-H7 | NA | GAGCTCCAGATGACCCAGTCCCATCCTCCCTGTCTGCATCTGTAGGAGACAGAGTCA CCATCACTTGCCAGGCGAGTCAGGACATTAGCAACTATTAAATTGGTATCAGCAGAA ACCAGGGAAAGCCCCTAAGCTCCTGATCTATGCTGCATCCAGCCTCCAGTCTGGGGTC CCATCAAGGTTCAGTGGCAGTGGATCTGGGACAGATTTCACTCTCACCATCAGCAGTC TGCAACCTGAAGATTTTGCAACT (SEQ ID NO: 16684) | GAGGTGCAGCTGCTCGAGTCTGGTCCTGCGCGTGGTCCTGAAACCCACACAGACCCTCACGCTGACCTGCTCTGG TTTCTCATTCACCACTCATAAAATGGGTGTGGACATGGATCCGTCAGCCCCCCAGGAAAGGCCCTGGAGTGGCTTGCA TCATTATTGGAGATATGATAAGGCGTACAGCCCCATCTCTGCAGAGTAGGCTCACCATCACCAAGGACACCTCCAAA AACCAGGTGCTCCTCACAATGACC (SEQ ID NO: 16711) |
| | AA | ELQMTQSPSSLSASVGDRVTITCQASQDISNYLNWYQQKPGKAPKLLIYAASSLQSGV PSRFSGSGSGTDFTLTISSLQPEDFATYYCQQSYPPVEFGPGTKVEIK (SEQ ID NO: 16685) | EVQLLESGPALVKPTQTLTLTCFSGFSFTTHKMGVDWIRQPPGKALEWLALIYWNDDKRYSPSLQSRLTITKDTSK NQVLTMTNMDPVDTATYYCAYRRYNWNYENWFDPWGQGTLVTVSS (SEQ ID NO: 16712) |
| 18410-G10 | NA | GAGCTCGTGTTGACGCAGCCGCCCCTCGGTGTCAGTGGCCCCAGGACAGCGGCCAGGA TTACCTGTGGGGGAAACAACATTGGAAGTAAAAGTGTGCACTGGTACCAACAGAAGCC AGGCCAGGCCCCTGTGACTTCTGGCCTATGATAACGACCGGCCCTCAGGGATCCCT AGGCGATTCTCTGGCTCCAACTCTGGGAACACGGCCACCCTGACCATCAGCAGGGTCG AAGCCGGGATGAGGCCGACTAT (SEQ ID NO: 16687) | GAGGTGCAGCTGCTCGAGTCCGGGGGAGGCTTGGTACAGCCTGGGGGTCCCTGAGACTCTCCTGTGCAGCCTCTGG ATTCACCTTTAGCAGCCATGCCATGAGCTGGGTCCGCCAGGCTCCAGGGAAGGGGCTGGAGTGGGTCTCAGCTATTA GTGGTAGTGGTGGTGGCACATACACAGACTCCGTGAAGGGCCGGTTCACCATCTCCAGAGACAATTCCAAGAAC ACGTGTATCTGCAAATGAACAGC (SEQ ID NO: 16713) |
| | AA | ELVLTQPPSVSVAPGQTARITCGGNNIGSKSVHWYQQKPGQAPVMVVYDDNDRPSGIP ERFSGSNSGNTATLTISRVEAGDEADYYCQVWDKVAPRHVFGGGTKLTVL (SEQ ID NO: 16688) | EVQLLESGGGLVQPGGSLRLSCAASGFTFSSHAMSWVRQAPGKGLEWVSAISGSGGGTYNADSVKGRFTISRDNSKN TLYLQMNSLRAEDTAVYYCATGKGVHLGFDYWGQGTLVTVSS (SEQ ID NO: 16714) |
| 18410-H1 | NA | GAGCTCGTGATGACCCAGTCCCATCCTCCCTGTCTGCATCTGTAGGAGACAGAGTCA CCATCACTTGCCAGGCAAGTCAGGACATTAGCAGCTATTAAATTGGTATCAGCAGAA ACCAGGGAGAGCCCCTAAGCTCCTGATCTTTGCTGCATCCAGTTTGCAAAGTGGGGTC CCATCAAGGTTCAGTGGCAGTGGATCTGGGACAGATTTCACTCTCACCATCAGCAGTC TCCAACCTGAAGATTTTGCAACT (SEQ ID NO: 16689) | EVQLLESGGGLVQPGGSLRLSCAASGFTFSNAWMSWVRQAPGKGLEWVGRITSGIYGGTTDYAAPVKGRFTISRDDS KNTLYLQMNSLKTEDTAVYYCTTPSYSGSYYNYFSVMDVWGQGTTVTVSS (SEQ ID NO: 16715) |
| | AA | ELVMTQSPSSLSASVGDRVTITCRTSQSISSYLNWYQQKPGRAPKLLIFAASSLQSGV PSRFSGSGSGTDFTLTISSLQPEDFATYYCQQTYSMPFTFGPGTKVDIK (SEQ ID NO: 16690) | EVQLLESGGGLVQPGGSLRLSCAASGFTFSNAWMSWVRQAPGKGLEWVGRITSGIYGGTTDYAAPVKGRFTISRDDS KNTLYLQMNSLKTEDTAVYYCTTPSYSGSYYNYFSVMDVWGQGTTVTVSS (SEQ ID NO: 16716) |
| 18410-H3 | NA | GAGCTCCAGATGACCCAGTCCTCCATCCTCCCTGTCTGCATCTGTAGGAGACAGAGTCA CCATCACTTGCCGAGCAAGTCAGAGCATTAGCAGCTATTAAATTGGTATCAGCAGAA ACCAGGGAGAGCCCCTAAGCTCCTGATCTTTGCTGCATCCAGTTTGCAAGTGGGGTC CCATCAAGGTTCAGTGGCAGTGGATCTGGGACAGATTTCACTCTCACCATCAGCAGTC TCCAACCTGAAGATTTTGCAACT (SEQ ID NO: 16691) | GAGGTGCAGCTGCTCGAGTCCGGGGGAGGCTTGGTACAGCCTGGGGGGTCCCTGAGACTCTCCTGTGCAGCCTCTGG ATTCACTTTCAGTAGCGCCTGGATGAGCTGGGTCCGCCAGGCTCCAGGGAAGGGGCTGGAGTGGGTTGGCCGGATTA GGAGCAGGCCCTATGGTGGGACAACAGACTACGCTGCACCCGTGAAAGGCCAGATTCACCATCTCAAGAGATGATTCA AAAACACCGCTGTATCTGCAAATG (SEQ ID NO: 16717) |
| | AA | ELQMTQSPSSLSASVGDRVTITCRTSQSISSYLNWYQQKPGRAPKLLIFAASSLQGGV PSRFSGSGSGTDFTLTISSLQPEDFATYYCQQTYSSPFTFGPGTKLEIK (SEQ ID NO: 16692) | EVQLLESGGGLVQPGGSLRLSCAASGFTFSNAWMSWVRQAPGKGLEWVGRIRSRPYGGTTDYAAPVKGRFTISRDDS KNTLYLQMNSLKTEDTAVYYCTTPSYSGSYYNYFSVMDVWGQGTTVTVSS (SEQ ID NO: 16718) |

TABLE 68 scFv Variable Region Protein Alignment
CDRs defined by Kabat
Alignment numbering defined by Amgen Reference (AHo)
KAPPA_VARIABLE

| | Germline | K_FR1 | SEQ ID NO: | K_CDR1 | SEQ ID NO: | K_FR2 | SEQ ID NO: |
|---|---|---|---|---|---|---|---|
| VK1\|O12/JK3 | | DIQMTQSPSSLSASVGDRVTITC | 16719 | RAS--QSIS------SYLN | 16755 | WYQQKPGKAPKLLIY | 16791 |
| 18409-E2 | VK1\|O12/JK3 | ELVMTQSPSSLSASVGDRVTITC | 16720 | RTS--QSIS------SYLN | 16756 | WYQQKPGRAPKLLIF | 16792 |
| 18409-G10 | VK1\|O12/JK3 | ELQMTQSPSSLSASVGDRVTITC | 16721 | QAS--QDIS------NYFN | 16757 | WYQQKPGKAPKLLIY | 16793 |
| 18410-H1 | VK1\|O12/JK3 | ELVMTQSPSSLSASVGDRVTITC | 16722 | RTS--QSIS------SYLN | 16758 | WYQQKPGRAPKLLIF | 16794 |
| VK1\|O12/JK1 | | DIQMTQSPSSLSASVGDRVTITC | 16723 | RAS--QSIS------SYLN | 16759 | WYQQKPGKAPKLLIY | 16795 |
| 18409-F12 | VK1\|O12/JK1 | ELQMTQSPSSLSASVGDRVTITC | 16724 | QAS--QDIS------NYLN | 16760 | WYQQKPGKAPKLLIY | 16796 |
| 18409-H7 | VK1\|O12/JK1 | ELQMTQSPSSLSASVGDRVTITC | 16725 | QAS--QDIS------NYLN | 16761 | WYQQKPGKAPKLLIY | 16797 |
| VK1\|O12/JK2 | | DIQMTQSPSSLSASVGDRVTITC | 16726 | RAS--QSIS------SYLN | 16762 | WYQQKPGKAPKLLIY | 16798 |
| 18410-H3 | VK1\|O12/JK2 | ELQMTQSPSSLSASVGDRVTITC | 16727 | RTS--QSIS------SYLN | 16763 | WYQQKPGRAPKLLIF | 16799 |

| | Germline | K_CDR2 | SEQ ID NO: | K_FR3 | SEQ ID NO: |
|---|---|---|---|---|---|
| VK1\|O12/JK3 | | A--------ASSLQS | 16827 | GVPSRFSGSGSG--TDFTLTISSLQPEDFATYYC | 16863 |
| 18409-E2 | VK1\|O12/JK3 | A--------ASSLQG | 16828 | GVPSRFSGSGSG--TDFTLTISSLQPEDFATYYC | 16864 |
| 18409-G10 | VK1\|O12/JK3 | A--------ASSLQS | 16829 | GVPSRFSGSGSG--TDFTLTISSLQPEDFATYYC | 16865 |
| 18410-H1 | VK1\|O12/JK3 | A--------ASSLQS | 16830 | GVPSRFSGSGSG--TDFTLTISSLQPEDFATYYC | 16866 |
| VK1\|O12/JK1 | | A--------ASSLQS | 16831 | GVPSRFSGSGSG--TDFTLTISSLQPEDFATYYC | 16867 |
| 18409-F12 | VK1\|O12/JK1 | A--------ASSLQS | 16832 | GVPSRFSGRGSG--TDFTLTISSLQPEDFATYYC | 16868 |
| 18409-H7 | VK1\|O12/JK1 | A--------ASSLQS | 16833 | GVPSRFSGSGSG--TDFTLTISSLQPEDFATYYC | 16869 |
| VK1\|O12/JK2 | | A--------ASSLQS | 16834 | GVPSRFSGSGSG--TDFTLTISSLQPEDFATYYC | 16870 |
| 18410-H3 | VK1\|O12/JK2 | A--------ASSLQG | 16835 | GVPSRFSGSGSG--TDFTLTISSLQPEDFATYYC | 16871 |

| | Germline | K_CDR3 | SEQ ID NO: | K_FR4 | SEQ ID NO: |
|---|---|---|---|---|---|
| VK1\|O12/JK3 | | QQSYS---------------------TPFT | 16899 | FGPGTKVDIK | 16935 |
| 18409-E2 | VK1\|O12/JK3 | QQSYS---------------------SPFT | 16900 | FGPGTKVEIK | 16936 |
| 18409-G10 | VK1\|O12/JK3 | QQSYI---------------------TPFT | 16901 | FGPGTKVEIK | 16937 |
| 18410-H1 | VK1\|O12/JK3 | QQTYS---------------------MPFT | 16902 | FGPGTKVDIK | 16938 |
| VK1\|O12/JK1 | | QQSYS---------------------TPWT | 16903 | FGQGTKVEIK | 16939 |
| 18409-F12 | VK1\|O12/JK1 | QQSYY---------------------YPTL | 16904 | FGPGTKVEIK | 16940 |
| 18409-H7 | VK1\|O12/JK1 | QQSYF---------------------PVVE | 16905 | FGPGTKVEIK | 16941 |

TABLE 68-continued scFv Variable Region Protein Alignment
CDRs defined by Kabat
Alignment numbering defined by Amgen Reference (AHo)
KAPPA_VARIABLE

| | | | | | |
|---|---|---|---|---|---|
| VK1\|O12/JK2 | | QQSYS----------------------TPYT | 16906 | FGQGTKLEIK | 16942 |
| 18410-H3 | VK1\|O12/JK2 | QQTYS----------------------SPFT | 16907 | FGPGTKLEIK | 16943 |

TABLE 69 scFv Variable Region Protein Alignment
CDRs defined by Kabat
Alignment numbering defined by Amgen Reference (AHo)
LAMBDA_VARIABLE

| | Germline | L_FR1 | SEQ ID NO: | L_CDR1 | SEQ ID NO: | L_FR2 | SEQ ID NO: |
|---|---|---|---|---|---|---|---|
| VL3\|3h/JL2 | | SYVLTQP-PSVSVAPGKTARITC | 16728 | GGN---NIGS-----KSVH | 16764 | WYQQKPGQAPVLVIY | 16800 |
| 18398-C7 | VL3\|3h/JL2 | ELVLTQP-PSVSVAPGQTARITC | 16729 | GGN---NIGS-----KSVH | 16765 | WYQQKPGQAPVMVVY | 16801 |
| 18403-D1 | VL3\|3h/JL2 | ELVLTQP-PSVSVAPGQTARITC | 16730 | GGN---NIGS-----KSVH | 16766 | WYQQKPGQAPVLVVY | 16802 |
| 18403-E11 | VL3\|3h/JL2 | ELVLTQP-PSVSVAPGQTARITC | 16731 | GGN---NIGS-----KSVH | 16767 | WYQQKPGQAPVMVVY | 16803 |
| 18403-F3 | VL3\|3h/JL2 | ELVLTQP-PSVSVAPGQTARITC | 16732 | GGN---NIGS-----KSVH | 16768 | WYQQKPGQAPVLVVY | 16804 |
| 18403-G10 | VL3\|3h/JL2 | ELVLTQP-PSVSVAPGQTARITC | 16733 | GGN---NIGS-----KSVH | 16769 | WYQQKPGQAPVMVVY | 16805 |
| 18410-G10 | VL3\|3h/JL2 | ELVLTQP-PSVSVAPGQTARITC | 16734 | GGN---NIGS-----KSVH | 16770 | WYQQKPGQAPVMVVY | 16806 |
| VL3\|3h/JL3b | | SYVLTQP-PSVSVAPGKTARITC | 16735 | GGN---NIGS-----KSVH | 16771 | WYQQKPGQAPVLVIY | 16807 |
| 18403-D8 | VL3\|3h/JL3b | ELVLTQP-PSVSVAPGQTARITC | 16736 | GGN---NIGS-----KSVH | 16772 | WYQQKPGQAPVMVVY | 16808 |

| | Germline | L_CDR2 | | L_FR3 | |
|---|---|---|---|---|---|
| VL3\|3h/JL2 | | Y--------DSDRPS | 16836 | GIPERFSGSNSG--NTATLTISRVEAGDEADYYC | 16872 |
| 18398-C7 | VL3\|3h/JL2 | D--------DNDRPS | 16837 | GIPERFSGSNSG--NTATLTISRVEAGDEADYYC | 16873 |
| 18403-D1 | VL3\|3h/JL2 | D--------DSDRPS | 16838 | GIPERFSGSNSG--NTATLTISRVEAGDEADYYC | 16874 |
| 18403-E11 | VL3\|3h/JL2 | D--------DNDRPS | 16839 | GIPERFSGSNSG--NTATLTISRVEAGDEADYYC | 16875 |
| 18403-F3 | VL3\|3h/JL2 | D--------DSDRPS | 16840 | GIPERFSGSNSG--NTATLTISRVEAGDEADYYC | 16876 |
| 18403-G10 | VL3\|3h/JL2 | D--------DNDRPS | 16841 | GIPERFSGSNSG--NTATLTISRVEAGDEADYYC | 16877 |
| 18410-G10 | VL3\|3h/JL2 | D--------DNDRPS | 16842 | GIPERFSGSNSG--NTATLTISRVEAGDEADYYC | 16878 |
| VL3\|3h/JL3b | | Y--------DSDRPS | 16843 | GIPERFSGSNSG--NTATLTISRVEAGDEADYYC | 16879 |
| 18403-D8 | VL3\|3h/JL3b | D--------DNDRPS | 16844 | GIPERFSGSNFG--NTATLIISRVEAGDEADYYC | 16880 |

| | Germline | L_CDR3 | | L_FR4 | |
|---|---|---|---|---|---|
| VL3\|3h/JL2 | | QVWDSS----------------SDHVV | 16908 | FGGGTKLTVL | 16944 |
| 18398-C7 | VL3\|3h/JL2 | QVWDYS----------------PLRHV | 16909 | FGGGTKLTVL | 16945 |
| 18403-D1 | VL3\|3h/JL2 | QVWDSS----------------LSYGTV | 16910 | FGGGTKLTVL | 16946 |

TABLE 69-continued scFv Variable Region Protein Alignment
CDRs defined by Kabat
Alignment numbering defined by Amgen Reference (AHo)
LAMBDA_VARIABLE

| | | | | | |
|---|---|---|---|---|---|
| 18403-E11 | VL3\|3h/JL2 | QVWDYY----------------<br>----SNRAV | 16911 | FGGGTKLTVL | 16947 |
| 18403-F3 | VL3\|3h/JL2 | QVWDAS----------------<br>---AGYGVV | 16912 | FGGGTKLTVL | 16948 |
| 18403-G10 | VL3\|3h/JL2 | QVWDYS----------------<br>----GQRQV | 16913 | FGGGTKLTVL | 16949 |
| 18410-G10 | VL3\|3h/JL2 | QVWDYV----------------<br>----APRHV | 16914 | FGGGTKLTVL | 16950 |
| VL3\|3h/JL3b | | QVWDSS----------------<br>----SDHWV | 16915 | FGGGTKLTVL | 16951 |
| 18403-D8 | VL3\|3h/JL3b | QVWDYR----------------<br>----TLDWV | 16916 | FGGGTKLTVL | 16952 |

TABLE 70

HEAVY_VARIABLE
CDRs defined by Kabat
Alignment numbering defined by Amgen Reference (AHo)

| | Germline | H_FR1 | SEQ ID NO: | H_CDR1 | SEQ ID NO: | H_FR2 | SEQ ID NO: |
|---|---|---|---|---|---|---|---|
| VH3\|3-23/D6\|6-19\|RF2/JH4 | | EVQLLES-GGGLVQPGGSLR LSCAASG-FTFS | 16737 | S-----YAMS | 16773 | WVRQAPGKGL EWVS | 16809 |
| 18398-C7 | VH3\|3-23/D6\|6-19\|RF2/JH4 | EVQLLES-GGGLVQPGGSLR LSCAASG-FTFS | 16738 | S-----HAMS | 16774 | WVRQAPGKGL EWVS | 16810 |
| 18403-D8 | VH3\|3-23/D6\|6-19\|RF2/JH4 | EVQLLES-GGGLVQPGGSLR LSCAASG-FTFS | 16739 | S-----HAMS | 16775 | WVRQAPGKGL EWVS | 16811 |
| 18403-E11 | VH3\|3-23/D6\|6-19\|RF2/JH4 | EVQLLES-GGGLVQPGGSLR LSCAASG-FTFS | 16740 | S-----HAMS | 16776 | WVRQAPGKGL EWVS | 16812 |
| 18403-G10 | VH3\|3-23/D6\|6-19\|RF2/JH4 | EVQLLES-GGGLVQPGGSLR LSCAASG-FTFS | 16741 | S-----YAMS | 16777 | WVRQAPGKGL EWVS | 16813 |
| 18410-G10 | VH3\|3-23/D6\|6-19\|RF2/JH4 | EVQLLES-GGGLVQPGGSLR LSCAASG-FTFS | 16742 | S-----HAMS | 16778 | WVRQAPGKGL EWVS | 16814 |
| VH3\|3-11/D1\|1-1\|RF3/JH4 | | QVQLVES-GGGLVKPGGSLR LSCAASG-FTFS | 16743 | D-----YYMS | 16779 | WIRQAPGKGL EWVS | 16815 |
| 18403-D1 | VH3\|3-11/D1\|1-1\|RF3/JH4 | EVQLLES-GGGLVKPGGSLR LSCAASG-FTFS | 16744 | D-----YYMS | 16780 | WIRQAPGKGL EWVS | 16816 |
| 18403-F3 | VH3\|3-11/D1\|1-1\|RF3/JH4 | EVQLLES-GGGLVKPGGSLR LSCAASG-FTFS | 16745 | D-----YYMS | 16781 | WIRQAPGKGL EWVS | 16817 |
| VH3\|3-15/D3\|3-10\|RF2/JH6 | | EVQLVES-GGGLVKPGGSLR LSCAASG-FTFS | 16746 | N-----AWMS | 16782 | WVRQAPGKGL EWVG | 16818 |
| 18409-E2 | VH3\|3-15/D3\|3-10\|RF2/JH6 | EVQLLES-GGGLVQPGGSLR LSCAASG-FTFS | 16747 | N-----AWMS | 16783 | WVRQAPGKGL EWVG | 16819 |
| 18410-H1 | VH3\|3-15/D3\|3-10\|RF2/JH6 | EVQLLES-GGGLVQPGGSLR LSCAASG-FTFS | 16748 | N-----AWMS | 16784 | WVRQAPGKGL EWVG | 16820 |
| 18410-H3 | VH3\|3-15/D3\|3-10\|RF2/JH6 | EVQLLES-GGGLVQPGGSLR LSCAASG-FTFS | 16749 | N-----AWMS | 16785 | WVRQAPGKGL EWVG | 16821 |
| VH2\|2-70/D2\|2-15\|RF1/JH5 | | QVTLKES-GPALVKPTQTLT LTCTFSG-FSLS | 16750 | TS---GMRVS | 16786 | WIRQPPGKAL EWLA | 16822 |
| 18409-F12 | VH2\|2-70/D2\|2-15\|RF1/JH5 | EVQLLES-GPALVKPTQTL TLTCTFSG-FSFT | 16751 | TH---KMGVD | 16787 | WIRQPPGKAL EWLA | 16823 |

TABLE 70-continued

HEAVY_VARIABLE
CDRs defined by Kabat
Alignment numbering defined by Amgen Reference (AHo)

| | Germline | | | | | |
|---|---|---|---|---|---|---|
| 18409-H7 | VH2\|2-70/D2\|2-15\|RF1/JH5 | EVQLLES-GPALVKPTQTLT LTCTFSG-FSFT | 16752 | TH---KMGVD | 16788 | WIRQPPGKAL EWLA | 16824 |
| | VH2\|2-05/D2\|2-15\|RF1/JH5 | QITLKES-GPTLVKPTQTLT LTCTFSG-FSLS | 16753 | TS---GVGVG | 16789 | WIRQPPGKAL EWLA | 16825 |
| 18409-G10 | VH2\|2-05/D2\|2-15\|RF1/JH5 | EVQLLES-GPTLVKPTQTLT LTCTFSG-FSFT | 16754 | TH---KMGVD | 16790 | WIRQPPGKAL EWLA | 16826 |

| | Germline | H_CDR2 | | H_FR3 | |
|---|---|---|---|---|---|
| | VH3\|3-23/D6\|6-19\|RF2/JH4 | AISGS---GGSTYYADSVKG | 16845 | RFTISRDNSKNTLYLQ MNSLRAEDTAVYYCAK | 16881 |
| 18398-C7 | VH3\|3-23/D6\|6-19\|RF2/JH4 | SISGS---GGGTYYAASVKG | 16846 | RFTISRDNSKNTLYLQ MNSLRAEDTAVYYCAT | 16882 |
| 18403-D8 | VH3\|3-23/D6\|6-19\|RF2/JH4 | TISGS---GGGTYYADSVKG | 16847 | RFTISRDNSKNTLYLQ MNSLRAEDTAVYYCAT | 16883 |
| 18403-E11 | VH3\|3-23/D6\|6-19\|RF2/JH4 | AISGS---GGGTYNADSVKG | 16848 | RFTISRDNSKNTLYLQ MNSLRAEDTAAYYCVT | 16884 |
| 18403-G10 | VH3\|3-23/D6\|6-19\|RF2/JH4 | AISGS---GGGTYYADSVKG | 16849 | RFTISRDNSKNTLYLQ MSSLRAEDTAVYYCAT | 16885 |
| 18410-G10 | VH3\|3-23/D6\|6-19\|RF2/JH4 | AISGS---GGGTYNADSVKG | 16850 | RFTISRDNSKNTLYLQ MNSLRAEDTAVYYCAT | 16886 |
| | VH3\|3-11/D1\|1-1\|RF3/JH4 | YISSS---GSTIYYADSVKG | 16851 | RFTISRDNAKNSLYLQ MNSLRAEDTAVYYCAR | 16887 |
| 18403-D1 | VH3\|3-11/D1\|1-1\|RF3/JH4 | YISKS---GSTIYYADSVKG | 16852 | RFTISRDNAKNSLYLQ MNSLRAEDTAVYYCAT | 16888 |
| 18403-F3 | VH3\|3-11/D1\|1-1\|RF3/JH4 | YISKS---SYTVTYADSVKG | 16853 | RFTISRDNAKNSLYLQ MNSLRAEDTAVYYCAT | 16889 |
| | VH3\|3-15/D3\|3-10\|RF2/JH6 | RIKSKT-DGGTTDYAAPVKG | 16854 | RFTISRDDSKNTLYLQ MNSLKTEDTAVYYCTT | 16890 |
| 18409-E2 | VH3\|3-15/D3\|3-10\|RF2/JH6 | RIKSKT-YGGTTDYAAPVKG | 16855 | RFTISRDDSKNTLFLQ MNSLKTEDTAVYYCTT | 16891 |
| 18410-H1 | VH3\|3-15/D3\|3-10\|RF2/JH6 | RITSGI-YGGTTDYAAPVKG | 16856 | RFTISRDDSKNTLYLQ MNSLKTEDTAVYYCTT | 16892 |
| 18410-H3 | VH3\|3-15/D3\|3-10\|RF2/JH6 | RIRSRP-YGGTTDYAAPVKG | 16857 | RFTISRDDSKNTLYLQ MNSLKTEDTAVYYCTT | 16893 |
| | VH2\|2-70/D2\|2-15\|RF1/JH5 | RIDW----DDDKFYSTSLKT | 16858 | RLTISKDTSKNQVVLT MTNMDPVDTATYYCAR | 16894 |
| 18409-F12 | VH2\|2-70/D2\|2-15\|RF1/JH5 | LIYW----NDDKRYSPSLQS | 16859 | RLTITKDTSKNQVVLT MTNMDPVDTATYYCAY | 16895 |
| 18409-H7 | VH2\|2-70/D2\|2-15\|RF1/JH5 | LIYW----NDDKRYSPSLQS | 16860 | RLTITKDTSKNQVVLT MTNMDPVDTATYYCAY | 16896 |
| | VH2\|2-05/D2\|2-15\|RF1/JH5 | LIYW----NDDKRYSPSLKS | 16861 | RLTITKDTSKNQVVLT MTNMDPVDTATYYCAH | 16897 |
| 18409-G10 | VH2\|2-05/D2\|2-15\|RF1/JH5 | GIHI----YDDKRYSPSLQS | 16862 | RLTITKDTSKNQVVLT MTNMDPVDTATYYCAY | 16898 |

| | Germline | H_CDR3 | | H_FR4 | |
|---|---|---|---|---|---|
| | VH3\|3-23/D6\|6-19\|RF2/JH4 | GIAVA---------------GYFDY | 16917 | WGQGTLVTVSS | 16953 |
| 18398-C7 | VH3\|3-23/D6\|6-19\|RF2/JH4 | GKGVH---------------LGFDY | 16918 | WGQGTLVTVSS | 16954 |
| 18403-D8 | VH3\|3-23/D6\|6-19\|RF2/JH4 | GKGVH---------------LGFDY | 16919 | WGQGTLVTVSS | 16955 |

TABLE 70-continued

HEAVY_VARIABLE
CDRs defined by Kabat
Alignment numbering defined by Amgen Reference (AHo)

| | | | SEQ ID NO: | | SEQ ID NO: |
|---|---|---|---|---|---|
| 18403-E11 | VH3\|3-23/D6\|6-19\|RF2/JH4 | GKGVH---------------------LGFDY | 16920 | WGQGTLVTVSS | 16956 |
| 18403-G10 | VH3\|3-23/D6\|6-19\|RF2/JH4 | GKGVH---------------------LGFDY | 16921 | WGQGTLVTVSS | 16957 |
| 18410-G10 | VH3\|3-23/D6\|6-19\|RF2/JH4 | GKGVH---------------------LGFDY | 16922 | WGQGTLVTVSS | 16958 |
| VH3\|3-11/D1\|1-1\|RF3/JH4 | | YNWND---------------------YFDY | 16923 | WGQGTLVTVSS | 16959 |
| 18403-D1 | VH3\|3-11/D1\|1-1\|RF3/JH4 | YNYG---------------------HFDY | 16924 | WGQGTLVTVSS | 16960 |
| 18403-F3 | VH3\|3-11/D1\|1-1\|RF3/JH4 | YNYG---------------------HFDY | 16925 | WGQGTLVTVSS | 16961 |
| VH3\|3-15/D3\|3-10\|RF2/JH6 | | YYYGSGSYYN----------YYYYYGMDV | 16926 | WGQGTTVTVSS | 16962 |
| 18409-E2 | VH3\|3-15/D3\|3-10\|RF2/JH6 | PSYSGSYY------------NYFSVMDV | 16927 | WGQGTTVTVSS | 16963 |
| 18410-H1 | VH3\|3-15/D3\|3-10\|RF2/JH6 | PSYSGSYY------------NYFSVMDV | 16928 | WGQGTTVTVSS | 16964 |
| 18410-H3 | VH3\|3-15/D3\|3-10\|RF2/JH6 | PSYSGSYY------------NYFSVMDV | 16929 | WGQGTTVTVSS | 16965 |
| VH2\|2-70/D2\|2-15\|RF1/JH5 | | RIL*WW*L------------LLNWEDP | 16930 | WGQGTLVTVSS | 16966 |
| 18409-F12 | VH2\|2-70/D2\|2-15\|RF1/JH5 | RRYNWNY-------------ENWFDP | 16931 | WGQGTLVTVSS | 16967 |
| 18409-H7 | VH2\|2-70/D2\|2-15\|RF1/JH5 | RRYNWNY-------------ENWFDP | 16932 | WGQGTLVTVSS | 16968 |
| VH2\|2-05/D2\|2-15\|RF1/JH5 | | RIL*WW*L------------LLNWEDP | 16933 | WGQGTLVTVSS | 16969 |
| 18409-G10 | VH2\|2-05/D2\|2-15\|RF1/JH5 | RRYNWNY-------------ENWFDP | 16934 | WGQGTLVTVSS | 16970 |

TABLE 71 scFv Variable Region Consensus Protein Alignment
CDRs defined by Kabat
Alignment numbering defined by Amgen Reference (AHo)
KAPPA_VARIABLE

| | Germline | K_FR1 | SEQ ID NO: | K_CDR1 | SEQ ID NO: | K_FR2 | SEQ ID NO: |
|---|---|---|---|---|---|---|---|
| | VK1\|o12/JK3 | DIQMTQSPSSLSASVGDRVTITC | 16971 | RAS--QSIS------SYLN | 17007 | WYQQKPGKAPKLLIY | 17043 |
| 18409-E2 | VK1\|o12/JK3 | ELV............... | 16972 | .T................ | 17008 | .......R......F | 17044 |
| 18409-G10 | VK1\|o12/JK3 | EL................ | 16973 | Q.....D........N.F. | 17009 | ................ | 17045 |
| 18410-H1 | VK1\|o12/JK3 | ELV............... | 16974 | .T................ | 17010 | .......R......F | 17046 |
| | VK1\|o12/JK1 | DIQMTQSPSSLSASVGDRVTITC | 16975 | RAS--QSIS------SYLN | 17011 | WYQQKPGKAPKLLIY | 17047 |
| 18409-F12 | VK1\|o12/JK1 | EL................ | 16976 | Q.....D........N... | 17012 | ................ | 17048 |

TABLE 71-continued scFv Variable Region Consensus Protein Alignment
CDRs defined by Kabat
Alignment numbering defined by Amgen Reference (AHo)
KAPPA_VARIABLE

| | | | | | | | |
|---|---|---|---|---|---|---|---|
| 18409-H7 | VK1\|o12/JK1 | EL................ .... | 16977 | Q.....D........N... | 17013 | ................ | 17049 |
| | VK1\|o12/JK2 | DIQMTQSPSSLSASVGDRV TITC | 16978 | RAS--QSIS------SYLN | 17014 | WYQQKPGKAPKLLIY | 17050 |
| 18410-H3 | VK1\|o12/JK2 | EL................ .... | 16979 | .T................ | 17015 | .......R......F | 17051 |

| | Germline | K_CDR2 | SEQ ID NO: | K_FR3 | SEQ ID NO: |
|---|---|---|---|---|---|
| | VK1\|o12/JK3 | A--------ASSLQS | 17079 | GVPSRFSGSGSG--TDFTLTISSLQPEDFATYYC | 17115 |
| 18409-E2 | VK1\|o12/JK3 | ...........G | 17080 | .................................. | 17116 |
| 18409-G10 | VK1\|o12/JK3 | ............ | 17081 | .................................. | 17117 |
| 18410-H1 | VK1\|o12/JK3 | ............ | 17082 | .................................. | 17118 |
| | VK1\|o12/JK1 | A--------ASSLQS | 17083 | GVPSRFSGSGSG--TDFTLTISSLQPEDFATYYC | 17119 |
| 18409-F12 | VK1\|o12/JK1 | ............ | 17084 | .......R.......................... | 17120 |
| 18409-H7 | VK1\|o12/JK1 | ............ | 17085 | .................................. | 17121 |
| | VK1\|o12/JK2 | A--------ASSLQS | 17086 | GVPSRFSGSGSG--TDFTLTISSLQPEDFATYYC | 17122 |
| 18410-H3 | VK1\|o12/JK2 | ...........G | 17087 | .................................. | 17123 |

| | Germline | K_CDR3 | SEQ ID NO: | K_FR4 | SEQ ID NO: |
|---|---|---|---|---|---|
| | VK1\|o12/JK3 | QQSYS----------------------TPFT | 17151 | FGPGTKVDIK | 17187 |
| 18409-E2 | VK1\|o12/JK3 | ............................S... | 17152 | .......E.. | 17188 |
| 18409-G10 | VK1\|o12/JK3 | ....I........................... | 17153 | .......E.. | 17189 |
| 18410-H1 | VK1\|o12/JK3 | ..T..........................M... | 17154 | .......... | 17190 |
| | VK1\|o12/JK1 | QQSYS----------------------TPWT | 17155 | FGQGTKVEIK | 17191 |
| 18409-F12 | VK1\|o12/JK1 | ....Y.......................Y.TL | 17156 | ..P....... | 17192 |
| 18409-H7 | VK1\|o12/JK1 | ....F.......................PVVE | 17157 | ..P....... | 17193 |
| | VK1\|o12/JK2 | QQSYS----------------------TPYT | 17158 | FGQGTKLEIK | 17194 |
| 18410-H3 | VK1\|o12/JK2 | ..T..........................S.F. | 17159 | ..P....... | 17195 |

TABLE 72 scFv Variable Region Consensus Protein Alignment
CDRs defined by Kabat
Alignment numbering defined by Amgen Reference (AHo)
LAMBDA_VARIABLE

| | Germline | L_FR1 | SEQ ID NO: | L_CDR1 | SEQ ID NO: | L_FR2 | SEQ ID NO: |
|---|---|---|---|---|---|---|---|
| | VL3\|3h/JL2 | SYVLTQP-PSVSVAPGK TARITC | 16980 | GGN---NIGS-----KSVH | 17016 | WYQQKPGQAPVLVIY | 17052 |
| 18398-C7 | VL3\|3h/JL2 | EL..............Q ...... | 16981 | ................... | 17017 | ...........M.V. | 17053 |
| 18403-D1 | VL3\|3h/JL2 | EL..............Q ...... | 16982 | ................... | 17018 | ..............V. | 17054 |
| 18403-E11 | VL3\|3h/JL2 | EL..............Q ...... | 16983 | ................... | 17019 | ...........M.V. | 17055 |

TABLE 72-continued scFv Variable Region Consensus Protein Alignment
CDRs defined by Kabat
Alignment numbering defined by Amgen Reference (AHo)
LAMBDA_VARIABLE

| | | | | | | | |
|---|---|---|---|---|---|---|---|
| 18403-F3 | VL3\|3h/JL2 | EL..............Q ...... | 16984 | .................... | 17020 | .............V. | 17056 |
| 18403-G10 | VL3\|3h/JL2 | EL..............Q ...... | 16985 | .................... | 17021 | ............M.V. | 17057 |
| 18410-G10 | VL3\|3h/JL2 | EL..............Q ...... | 16986 | .................... | 17022 | ............M.V. | 17058 |
| VL3\|3h/JL3b | | SYVLTQP-PSVSVAPGK TARITC | 16987 | GGN---NIGS-----KSVH | 17023 | WYQQKPGQAPVLVIY | 17059 |
| 18403-D8 | VL3\|3h/JL3b | EL..............Q ...... | 16988 | .................... | 17024 | ............M.V. | 17060 |

| | Germline | L_CDR2 | SEQ ID NO: | L_FR3 | SEQ ID NO: |
|---|---|---|---|---|---|
| | VL3\|3h/JL2 | Y--------DSDRPS | 17088 | GIPERFSGSNSG--NTATLTISRVEAGDEADYYC | 17124 |
| 18398-C7 | VL3\|3h/JL2 | D.........N.... | 17089 | ................................. | 17125 |
| 18403-D1 | VL3\|3h/JL2 | D.............. | 17090 | ................................. | 17126 |
| 18403-E11 | VL3\|3h/JL2 | D.........N.... | 17091 | ................................. | 17127 |
| 18403-F3 | VL3\|3h/JL2 | D.............. | 17092 | ................................. | 17128 |
| 18403-G10 | VL3\|3h/JL2 | D.........N.... | 17093 | ................................. | 17129 |
| 18410-G10 | VL3\|3h/JL2 | D.........N.... | 17094 | ................................. | 17130 |
| VL3\|3h/JL3b | | Y--------DSDRPS | 17095 | GIPERFSGSNSG--NTATLTISRVEAGDEADYYC | 17131 |
| 18403-D8 | VL3\|3h/JL3b | D.........N.... | 17096 | ..........F........I............. | 17132 |

| | Germline | L_CDR3 | SEQ ID NO: | L FR4 | SEQ ID NO: |
|---|---|---|---|---|---|
| | VL3\|3h/JL2 | QVWDSS--------------------SDHVV | 17160 | FGGGTKLTVL | 17196 |
| 18398-C7 | VL3\|3h/JL2 | ....Y................PLRH. | 17161 | .......... | 17197 |
| 18403-D1 | VL3\|3h/JL2 | .....................L.YGT. | 17162 | .......... | 17198 |
| 18403-E11 | VL3\|3h/JL2 | ....YY...............NRA. | 17163 | .......... | 17199 |
| 18403-F3 | VL3\|3h/JL2 | ....A................AGYG.. | 17164 | .......... | 17200 |
| 18403-G10 | VL3\|3h/JL2 | ....Y................GQRQ. | 17165 | .......... | 17201 |
| 18410-G10 | VL3\|3h/JL2 | ....YV...............APRH. | 17166 | .......... | 17202 |
| VL3\|3h/JL3b | | QVWDSS--------------------SDHWV | 17167 | FGGGTKLTVL | 17203 |
| 18403-D8 | VL3\|3h/JL3b | ....YR...............TLD.. | 17168 | .......... | 17204 |

TABLE 73 scFv Variable Region Consensus Protein Alignment
CDRs defined by Kabat
Alignment numbering defined by Amgen Reference (AHo)
HEAVY_VARIABLE

| | Germline | H_FR1 | SEQ ID NO: | H_CDR1 | SEQ ID NO: | H_FR2 | SEQ ID NO: |
|---|---|---|---|---|---|---|---|
| VH3\|3-23/D6\|6-19\|RF2/JH4 | | EVQLLES-GGGLVQPG GSLRLSCAASG-FTFS | 16989 | S-----YAMS | 17025 | WVRQAPGKGLEWVS | 17061 |
| 18398-C7 | VH3\|3-23/D6\|6-19\|RF2/JH4 | ................ ................ | 16990 | ......H... | 17026 | .............. | 17062 |

TABLE 73-continued scFv Variable Region Consensus Protein Alignment
CDRs defined by Kabat
Alignment numbering defined by Amgen Reference (AHo)
HEAVY_VARIABLE

| | Germline | | SEQ ID NO: | H_CDR1 | SEQ ID NO: | H_FR2 | SEQ ID NO: |
|---|---|---|---|---|---|---|---|
| 18403-D8 | VH3\|3-23/D6\|6-19\|RF2/JH4 | ................ ................ | 16991 | ......H... | 17027 | ............... | 17063 |
| 18403-E11 | VH3\|3-23/D6\|6-19\|RF2/JH4 | ................ ................ | 16992 | ......H... | 17028 | ............... | 17064 |
| 18403-G10 | VH3\|3-23/D6\|6-19\|RF2/JH4 | ................ ................ | 16993 | .......... | 17029 | ............... | 17065 |
| 18410-G10 | VH3\|3-23/D6\|6-19\|RF2/JH4 | ................ ................ | 16994 | ......H... | 17030 | ............... | 17066 |
| VH3\|3-11/D1\|1-1\|RF3/JH4 | | QVQLVES-GGGLVKPG GSLRLSCAASG-FTFS | 16995 | D-----YYMS | 17031 | WIRQAPGKGLEWVS | 17067 |
| 18403-D1 | VH3\|3-11/D1\|1-1\|RF3/JH4 | E...L........... ................ | 16996 | .......... | 17032 | ............... | 17068 |
| 18403-F3 | VH3\|3-11/D1\|1-1\|RF3/JH4 | E...L........... ................ | 16997 | .......... | 17033 | ............... | 17069 |
| VH3\|3-15/D3\|3-10\|RF2/JH6 | | EVQLVES-GGGLVKPG GSLRLSCAASG-FTFS | 16998 | N-----AWMS | 17034 | WVRQAPGKGLEWVG | 17070 |
| 18409-E2 | VH3\|3-15/D3\|3-10\|RF2/JH6 | E...L........Q.. ................ | 16999 | .......... | 17035 | ............... | 17071 |
| 18410-H1 | VH3\|3-15/D3\|3-10\|RF2/JH6 | E...L........Q.. ................ | 17000 | .......... | 17036 | ............... | 17072 |
| 18410-H3 | VH3\|3-15/D3\|3-10\|RF2/JH6 | E...L........Q.. ................ | 17001 | .......... | 17037 | ............... | 17073 |
| VH2\|2-70/D2\|2-15\|RF1/JH5 | | QVTLKES-GPALVKPT QTLTLTCTFSG-FSLS | 17002 | TS---GMRVS | 17038 | WIRQPPGKALEWLA | 17074 |
| 18409-F12 | VH2\|2-70/D2\|2-15\|RF1/JH5 | E.Q.L........... ..............FT | 17003 | .H...K.G.D | 17039 | ............... | 17075 |
| 18409-H7 | VH2\|2-70/D2\|2-15\|RF1/JH5 | E.Q.L........... ..............FT | 17004 | .H...K.G.D | 17040 | ............... | 17076 |
| VH2\|2-05/D2\|2-15\|RF1/JH5 | | QITLKES-GPTLVKPT QTLTLTCTFSG-FSLS | 17005 | TS---GVGVG | 17041 | WIRQPPGKALEWLA | 17077 |
| 18409-G10 | VH2\|2-05/D2\|2-15\|RF1/JH5 | EVQ.L........... ..............FT | 17006 | .H...KM..D | 17042 | ............... | 17078 |

| | Germline | H_CDR2 | SEQ ID NO: | H_FR3 | SEQ ID NO: |
|---|---|---|---|---|---|
| VH3\|3-23/D6\|6-19\|RF2/JH4 | | AISGS---GGSTYYADSVKG | 17097 | RFTISRDNSKNTLYLQ MNSLRAEDTAVYYCAK | 17133 |
| 18398-C7 | VH3\|3-23/D6\|6-19\|RF2/JH4 | S.........G....A.... | 17098 | ................ ...............T | 17134 |
| 18403-D8 | VH3\|3-23/D6\|6-19\|RF2/JH4 | T.........G......... | 17099 | ................ ...............T | 17135 |
| 18403-E11 | VH3\|3-23/D6\|6-19\|RF2/JH4 | ..........G..N...... | 17100 | ................ ..........A...VT | 17136 |
| 18403-G10 | VH3\|3-23/D6\|6-19\|RF2/JH4 | ..........G......... | 17101 | ................ .S.............T | 17137 |
| 18410-G10 | VH3\|3-23/D6\|6 19\|RF2/JH4 | ..........G..N...... | 17102 | ................ ...............T | 17138 |
| VH3\|3-11/D1\|1-1\|RF3/JH4 | | YISSS---GSTIYYADSVKG | 17103 | RFTISRDNAKNSLYLQ MNSLRAEDTAVYYCAR | 17139 |
| 18403-D1 | VH3\|3-11/D1\|1-1\|RF3/JH4 | ...K................ | 17104 | ................ ...............T | 17140 |

TABLE 73-continued scFv Variable Region Consensus Protein Alignment
CDRs defined by Kabat
Alignment numbering defined by Amgen Reference (AHo)
HEAVY_VARIABLE

| | | | | | |
|---|---|---|---|---|---|
| 18403-F3 | VH3\|3-11/D1\|1-1\|RF3/JH4 | ...K....SY.VT....... | 17105 | ................T | 17141 |
| VH3\|3-15/D3\|3-10\|RF2/JH6 | | RIKSKT-DGGTTDYAAPVKG | 17106 | RFTISRDDSKNTLYLQ MNSLKTEDTAVYYCTT | 17142 |
| 18409-E2 | VH3\|3-15/D3\|3-10\|RF2/JH6 | .......Y............ | 17107 | .............F... | 17143 |
| 18410-H1 | VH3\|3-15/D3\|3-10\|RF2/JH6 | ...T.GI.Y........... | 17108 | ................. | 17144 |
| 18410-H3 | VH3\|3-15/D3\|3-10\|RF2/JH6 | ...R.RP.Y........... | 17109 | ................. | 17145 |
| VH2\|2-70/D2\|2-15\|RF1/JH5 | | RIDW----DDDKFYSTSLKT | 17110 | RLTISKDTSKNQVVLT MTNMDPVDTATYYCAR | 17146 |
| 18409-F12 | VH2\|2-70/D2\|2-15\|RF1/JH5 | L.Y.....N...R..P..QS | 17111 | ....T............. ................Y | 17147 |
| 18409-H7 | VH2\|2-70/D2\|2-15\|RF1/JH5 | L.Y.....N...R..P..QS | 17112 | ....T............. ................Y | 17148 |
| VH2\|2-05/D2\|2-15\|RF1/JH5 | | LIYW----NDDKRYSPSLKS | 17113 | RLTITKDTSKNQVVLT MTNMDPVDTATYYCAH | 17149 |
| 18409-G10 | VH2\|2-05/D2\|2-15\|RF1/JH5 | G.HI....Y.........Q. | 17114 | ................Y | 17150 |

| | Germline | H_CDR3 | SEQ ID NO: | H_FR4 | SEQ ID NO: |
|---|---|---|---|---|---|
| VH3\|3-23/D6\|6-19\|RF2/JH4 | | GIAVA--------------- -----GYFDY | 17169 | WGQGTLVTVSS | 17205 |
| 18398-C7 | VH3\|3-23/D6\|6-19\|RF2/JH4 | .KG.H............... .....LG... | 17170 | ........... | 17206 |
| 18403-D8 | VH3\|3-23/D6\|6-19\|RF2/JH4 | .KG.H............... .....LG... | 17171 | ........... | 17207 |
| 18403-E11 | VH3\|3-23/D6\|6-19\|RF2/JH4 | .KG.H............... .....LG... | 17172 | ........... | 17208 |
| 18403-G10 | VH3\|3-23/D6\|6-19\|RF2/JH4 | .KG.H............... .....LG... | 17173 | ........... | 17209 |
| 18410-G10 | VH3\|3-23/D6\|6-19\|RF2/JH4 | .KG.H............... .....LG... | 17174 | ........... | 17210 |
| VH3\|3-11/D1\|1-1\|RF3/JH4 | | YNWND--------------- ------YFDY | 17175 | WGQGTLVTVSS | 17211 |
| 18403-D1 | VH3\|3-11/D1\|1-1\|RF3/JH4 | ..YG-............... ......H... | 17176 | ........... | 17212 |
| 18403-F3 | VH3\|3-11/D1\|1-1\|RF3/JH4 | ..YG-............... ......H... | 17177 | ........... | 17213 |
| VH3\|3-15/D3\|3-10\|RF2/JH6 | | YYYGSGSYYN---------- -YYYYYGMDV | 17178 | WGQGTTVTVSS | 17214 |
| 18409-E2 | VH3\|3-15/D3\|3-10\|RF2/JH6 | PS.SGSY.--.......... .-N.FSV... | 17179 | ........... | 17215 |
| 18410-H1 | VH3\|3-15/D3\|3-10\|RF2/JH6 | PS.SGSY.--.......... .-N.FSV... | 17180 | ........... | 17216 |
| 18410-H3 | VH3\|3-15/D3\|3-10\|RF2/JH6 | PS.SGSY.--.......... .-N.FSV... | 17181 | ........... | 17217 |
| VH2\|2-70/D2\|2-15\|RF1/JH5 | | RIL*WW*L------------ ---LLNWFDP | 17182 | WGQGTLVTVSS | 17218 |

TABLE 73-continued scFv Variable Region Consensus Protein Alignment
CDRs defined by Kabat
Alignment numbering defined by Amgen Reference (AHo)
HEAVY_VARIABLE

| | | | | | |
|---|---|---|---|---|---|
| 18409-F12 | VH2\|2-70/D2\|2-15\|RF1/JH5 | .RYN.NY-.............<br>....-E..... | 17183 | ............ | 17219 |
| 18409-H7 | VH2\|2-70/D2\|2-15\|RF1/JH5 | .RYN.NY-.............<br>....-E..... | 17184 | ............ | 17220 |
| VH2\|2-05/D2\|2-15\|RF1/JH5 | | RIL*WW*L------------<br>---LLNWFDP | 17185 | WGQGTLVTVSS | 17221 |
| 18409-G10 | VH2\|2-05/D2\|2-15\|RF1/JH5 | .RYN.NY-.............<br>....-E..... | 17186 | ............ | 17222 |

TABLE 77

| ATOM | 1 | N | GLY | A | 1 | 34.152 | 46.795 | 0.377 | 1.00 | 46.85 | N |
|---|---|---|---|---|---|---|---|---|---|---|---|
| ATOM | 2 | CA | GLY | A | 1 | 33.600 | 47.814 | 1.252 | 1.00 | 50.33 | C |
| ATOM | 3 | C | GLY | A | 1 | 32.311 | 47.368 | 1.930 | 1.00 | 43.23 | C |
| ATOM | 4 | O | GLY | A | 1 | 32.028 | 46.172 | 2.034 | 1.00 | 42.63 | O |
| ATOM | 5 | N | SER | A | 2 | 31.541 | 48.337 | 2.406 | 1.00 | 41.98 | N |
| ATOM | 6 | CA | SER | A | 2 | 30.265 | 48.033 | 3.030 | 1.00 | 41.90 | C |
| ATOM | 7 | C | SER | A | 2 | 29.233 | 47.639 | 1.971 | 1.00 | 38.38 | C |
| ATOM | 8 | O | SER | A | 2 | 29.372 | 47.932 | 0.785 | 1.00 | 39.72 | O |
| ATOM | 9 | CB | SER | A | 2 | 29.762 | 49.234 | 3.816 | 1.00 | 43.74 | C |
| ATOM | 10 | OG | SER | A | 2 | 29.458 | 50.285 | 2.921 | 1.00 | 55.03 | O |
| ATOM | 11 | N | HIS | A | 3 | 28.181 | 46.961 | 2.414 | 1.00 | 37.91 | N |
| ATOM | 12 | CA | HIS | A | 3 | 27.146 | 46.525 | 1.489 | 1.00 | 35.79 | C |
| ATOM | 13 | C | HIS | A | 3 | 25.801 | 46.701 | 2.165 | 1.00 | 37.23 | C |
| ATOM | 14 | O | HIS | A | 3 | 25.714 | 46.809 | 3.392 | 1.00 | 33.97 | O |
| ATOM | 15 | CB | HIS | A | 3 | 27.317 | 45.059 | 1.055 | 1.00 | 34.23 | C |
| ATOM | 16 | CG | HIS | A | 3 | 28.576 | 44.799 | 0.293 | 1.00 | 42.01 | C |
| ATOM | 17 | ND1 | HIS | A | 3 | 28.701 | 45.072 | -1.053 | 1.00 | 33.68 | N |
| ATOM | 18 | CD2 | HIS | A | 3 | 29.771 | 44.298 | 0.692 | 1.00 | 33.56 | C |
| ATOM | 19 | CE1 | HIS | A | 3 | 29.915 | 44.744 | -1.453 | 1.00 | 39.78 | C |
| ATOM | 20 | NE2 | HIS | A | 3 | 30.587 | 44.277 | -0.415 | 1.00 | 34.99 | N |
| ATOM | 21 | N | SER | A | 4 | 24.754 | 46.733 | 1.348 | 1.00 | 35.73 | N |
| ATOM | 22 | CA | SER | A | 4 | 23.399 | 46.866 | 1.856 | 1.00 | 35.57 | C |
| ATOM | 23 | C | SER | A | 4 | 22.483 | 45.917 | 1.101 | 1.00 | 36.68 | C |
| ATOM | 24 | O | SER | A | 4 | 22.701 | 45.607 | -0.077 | 1.00 | 34.04 | O |
| ATOM | 25 | CB | SER | A | 4 | 22.876 | 48.299 | 1.732 | 1.00 | 34.03 | C |
| ATOM | 26 | OG | SER | A | 4 | 22.659 | 48.635 | 0.373 | 1.00 | 35.92 | O |
| ATOM | 27 | N | MET | A | 5 | 21.478 | 45.428 | 1.808 | 1.00 | 30.36 | N |
| ATOM | 28 | CA | MET | A | 5 | 20.333 | 44.785 | 1.187 | 1.00 | 31.90 | C |
| ATOM | 29 | C | MET | A | 5 | 19.125 | 45.625 | 1.557 | 1.00 | 32.68 | C |
| ATOM | 30 | O | MET | A | 5 | 18.952 | 45.967 | 2.730 | 1.00 | 33.09 | O |
| ATOM | 31 | CB | MET | A | 5 | 20.127 | 43.349 | 1.658 | 1.00 | 29.43 | C |
| ATOM | 32 | CG | MET | A | 5 | 18.985 | 42.677 | 0.859 | 1.00 | 32.93 | C |
| ATOM | 33 | SD | MET | A | 5 | 18.768 | 40.952 | 1.236 | 1.00 | 36.24 | S |
| ATOM | 34 | CE | MET | A | 5 | 18.105 | 41.047 | 2.914 | 1.00 | 34.42 | C |
| ATOM | 35 | N | ARG | A | 6 | 18.307 | 45.966 | 0.567 | 1.00 | 32.17 | N |
| ATOM | 36 | CA | ARG | A | 6 | 17.163 | 46.837 | 0.798 | 1.00 | 31.42 | C |
| ATOM | 37 | C | ARG | A | 6 | 15.971 | 46.367 | -0.012 | 1.00 | 31.19 | C |
| ATOM | 38 | O | ARG | A | 6 | 16.107 | 46.002 | -1.180 | 1.00 | 32.46 | O |
| ATOM | 39 | CB | ARG | A | 6 | 17.494 | 48.280 | 0.432 | 1.00 | 32.32 | C |
| ATOM | 40 | CG | ARG | A | 6 | 18.529 | 48.919 | 1.368 | 1.00 | 37.09 | C |
| ATOM | 41 | CD | ARG | A | 6 | 18.961 | 50.295 | 0.865 | 1.00 | 40.30 | C |
| ATOM | 42 | NE | ARG | A | 6 | 20.154 | 50.790 | 1.553 | 1.00 | 40.25 | N |
| ATOM | 43 | CZ | ARG | A | 6 | 21.103 | 51.498 | 0.945 | 1.00 | 49.03 | C |
| ATOM | 44 | NH1 | ARG | A | 6 | 22.165 | 51.913 | 1.628 | 1.00 | 48.94 | N1+ |
| ATOM | 45 | NH2 | ARG | A | 6 | 20.992 | 51.777 | -0.354 | 1.00 | 47.63 | N |
| ATOM | 46 | N | TYR | A | 7 | 14.800 | 46.404 | 0.609 | 1.00 | 31.07 | N |
| ATOM | 47 | CA | TYR | A | 7 | 13.556 | 46.116 | -0.080 | 1.00 | 32.78 | C |
| ATOM | 48 | C | TYR | A | 7 | 12.677 | 47.353 | -0.090 | 1.00 | 34.07 | C |
| ATOM | 49 | O | TYR | A | 7 | 12.531 | 48.026 | 0.932 | 1.00 | 30.75 | O |
| ATOM | 50 | CB | TYR | A | 7 | 12.827 | 44.981 | 0.589 | 1.00 | 27.89 | C |
| ATOM | 51 | CG | TYR | A | 7 | 13.432 | 43.646 | 0.301 | 1.00 | 30.22 | C |
| ATOM | 52 | CD1 | TYR | A | 7 | 13.051 | 42.936 | -0.828 | 1.00 | 28.32 | C |
| ATOM | 53 | CD2 | TYR | A | 7 | 14.368 | 43.078 | 1.169 | 1.00 | 27.20 | C |
| ATOM | 54 | CE1 | TYR | A | 7 | 13.573 | 41.671 | -1.090 | 1.00 | 30.20 | C |
| ATOM | 55 | CE2 | TYR | A | 7 | 14.891 | 41.823 | 0.925 | 1.00 | 28.43 | C |
| ATOM | 56 | CZ | TYR | A | 7 | 14.488 | 41.130 | -0.204 | 1.00 | 31.29 | C |
| ATOM | 57 | OH | TYR | A | 7 | 14.996 | 39.890 | -0.465 | 1.00 | 33.78 | O |
| ATOM | 58 | N | PHE | A | 8 | 12.088 | 47.631 | -1.246 | 1.00 | 32.07 | N |

TABLE 77-continued

| | | | | | | | | | | |
|---|---|---|---|---|---|---|---|---|---|---|
| ATOM | 59 | CA | PHE | A | 8 | 11.210 | 48.776 | −1.440 | 1.00 | 31.80 | C |
| ATOM | 60 | C | PHE | A | 8 | 9.818 | 48.265 | −1.764 | 1.00 | 35.00 | C |
| ATOM | 61 | O | PHE | A | 8 | 9.658 | 47.444 | −2.673 | 1.00 | 33.05 | O |
| ATOM | 62 | CB | PHE | A | 8 | 11.691 | 49.667 | −2.587 | 1.00 | 33.56 | C |
| ATOM | 63 | CG | PHE | A | 8 | 13.005 | 50.360 | −2.327 | 1.00 | 36.56 | C |
| ATOM | 64 | CD1 | PHE | A | 8 | 14.190 | 49.642 | −2.208 | 1.00 | 37.70 | C |
| ATOM | 65 | CD2 | PHE | A | 8 | 13.056 | 51.742 | −2.259 | 1.00 | 36.79 | C |
| ATOM | 66 | CE1 | PHE | A | 8 | 15.394 | 50.308 | −1.984 | 1.00 | 39.16 | C |
| ATOM | 67 | CE2 | PHE | A | 8 | 14.250 | 52.407 | −2.029 | 1.00 | 42.24 | C |
| ATOM | 68 | CZ | PHE | A | 8 | 15.416 | 51.695 | −1.895 | 1.00 | 35.84 | C |
| ATOM | 69 | N | PHE | A | 9 | 8.808 | 48.771 | −1.054 | 1.00 | 28.09 | N |
| ATOM | 70 | CA | PHE | A | 9 | 7.447 | 48.324 | −1.313 | 1.00 | 31.19 | C |
| ATOM | 71 | C | PHE | A | 9 | 6.573 | 49.531 | −1.566 | 1.00 | 30.32 | C |
| ATOM | 72 | O | PHE | A | 9 | 6.716 | 50.558 | −0.894 | 1.00 | 33.05 | O |
| ATOM | 73 | CB | PHE | A | 9 | 6.877 | 47.486 | −0.158 | 1.00 | 31.78 | C |
| ATOM | 74 | CG | PHE | A | 9 | 7.748 | 46.307 | 0.209 | 1.00 | 33.34 | C |
| ATOM | 75 | CD1 | PHE | A | 9 | 7.600 | 45.085 | −0.433 | 1.00 | 30.80 | C |
| ATOM | 76 | CD2 | PHE | A | 9 | 8.743 | 46.441 | 1.161 | 1.00 | 33.74 | C |
| ATOM | 77 | CE1 | PHE | A | 9 | 8.415 | 44.012 | −0.108 | 1.00 | 32.45 | C |
| ATOM | 78 | CE2 | PHE | A | 9 | 9.560 | 45.369 | 1.490 | 1.00 | 33.27 | C |
| ATOM | 79 | CZ | PHE | A | 9 | 9.408 | 44.164 | 0.866 | 1.00 | 31.26 | C |
| ATOM | 80 | N | THR | A | 10 | 5.700 | 49.410 | −2.565 | 1.00 | 32.57 | N |
| ATOM | 81 | CA | THR | A | 10 | 4.670 | 50.407 | −2.865 | 1.00 | 36.05 | C |
| ATOM | 82 | C | THR | A | 10 | 3.344 | 49.685 | −3.049 | 1.00 | 31.29 | C |
| ATOM | 83 | O | THR | A | 10 | 3.290 | 48.690 | −3.779 | 1.00 | 30.71 | O |
| ATOM | 84 | CB | THR | A | 10 | 5.001 | 51.197 | −4.142 | 1.00 | 32.49 | C |
| ATOM | 85 | OG1 | THR | A | 10 | 6.320 | 51.746 | −4.044 | 1.00 | 32.60 | O |
| ATOM | 86 | CG2 | THR | A | 10 | 3.989 | 52.331 | −4.363 | 1.00 | 26.91 | C |
| ATOM | 87 | N | SER | A | 11 | 2.290 | 50.176 | −2.379 | 1.00 | 29.25 | N |
| ATOM | 88 | CA | SER | A | 11 | 0.904 | 49.778 | −2.640 | 1.00 | 35.45 | C |
| ATOM | 89 | C | SER | A | 11 | 0.085 | 51.017 | −2.948 | 1.00 | 33.35 | C |
| ATOM | 90 | O | SER | A | 11 | 0.131 | 51.998 | −2.203 | 1.00 | 33.18 | O |
| ATOM | 91 | CB | SER | A | 11 | 0.247 | 49.043 | −1.470 | 1.00 | 32.25 | C |
| ATOM | 92 | OG | SER | A | 11 | 0.996 | 47.903 | −1.151 | 1.00 | 45.17 | O |
| ATOM | 93 | N | VAL | A | 12 | −0.654 | 50.969 | −4.047 | 1.00 | 30.50 | N |
| ATOM | 94 | CA | VAL | A | 12 | −1.420 | 52.112 | −4.523 | 1.00 | 36.30 | C |
| ATOM | 95 | C | VAL | A | 12 | −2.878 | 51.677 | −4.636 | 1.00 | 33.65 | C |
| ATOM | 96 | O | VAL | A | 12 | −3.187 | 50.770 | −5.418 | 1.00 | 32.42 | O |
| ATOM | 97 | CB | VAL | A | 12 | −0.898 | 52.622 | −5.873 | 1.00 | 35.68 | C |
| ATOM | 98 | CG1 | VAL | A | 12 | −1.676 | 53.887 | −6.305 | 1.00 | 37.58 | C |
| ATOM | 99 | CG2 | VAL | A | 12 | 0.592 | 52.899 | −5.792 | 1.00 | 34.90 | C |
| ATOM | 100 | N | SER | A | 13 | −3.750 | 52.296 | −3.827 | 1.00 | 33.39 | N |
| ATOM | 101 | CA | SER | A | 13 | −5.203 | 52.119 | −3.955 | 1.00 | 36.45 | C |
| ATOM | 102 | C | SER | A | 13 | −5.635 | 52.423 | −5.380 | 1.00 | 35.88 | C |
| ATOM | 103 | O | SER | A | 13 | −5.159 | 53.386 | −5.986 | 1.00 | 36.53 | O |
| ATOM | 104 | CB | SER | A | 13 | −5.967 | 53.083 | −3.024 | 1.00 | 30.30 | C |
| ATOM | 105 | OG | SER | A | 13 | −5.984 | 52.624 | −1.702 | 1.00 | 52.91 | O |
| ATOM | 106 | N | ARG | A | 14 | −6.613 | 51.648 | −5.855 | 1.00 | 38.17 | N |
| ATOM | 107 | CA | ARG | A | 14 | −7.157 | 51.747 | −7.209 | 1.00 | 40.07 | C |
| ATOM | 108 | C | ARG | A | 14 | −8.673 | 51.603 | −7.155 | 1.00 | 37.29 | C |
| ATOM | 109 | O | ARG | A | 14 | −9.212 | 50.654 | −7.717 | 1.00 | 34.35 | O |
| ATOM | 110 | CB | ARG | A | 14 | −6.621 | 50.618 | −8.094 | 1.00 | 43.43 | C |
| ATOM | 111 | CG | ARG | A | 14 | −5.236 | 50.630 | −8.537 | 1.00 | 49.73 | C |
| ATOM | 112 | CD | ARG | A | 14 | −5.086 | 49.520 | −9.578 | 1.00 | 47.79 | C |
| ATOM | 113 | NE | ARG | A | 14 | −4.799 | 48.203 | −9.017 | 1.00 | 43.35 | N |
| ATOM | 114 | CZ | ARG | A | 14 | −4.119 | 47.270 | −9.681 | 1.00 | 43.07 | C |
| ATOM | 115 | NH1 | ARG | A | 14 | −3.687 | 47.532 | −10.899 | 1.00 | 38.40 | N1+ |
| ATOM | 116 | NH2 | ARG | A | 14 | −3.861 | 46.086 | −9.140 | 1.00 | 39.22 | N |
| ATOM | 117 | N | PRO | A | 15 | −9.388 | 52.492 | −6.456 | 1.00 | 34.63 | N |
| ATOM | 118 | CA | PRO | A | 15 | −10.833 | 52.265 | −6.259 | 1.00 | 43.76 | C |
| ATOM | 119 | C | PRO | A | 15 | −11.559 | 52.001 | −7.574 | 1.00 | 35.47 | C |
| ATOM | 120 | O | PRO | A | 15 | −11.467 | 52.778 | −8.527 | 1.00 | 41.61 | O |
| ATOM | 121 | CB | PRO | A | 15 | −11.315 | 53.567 | −5.602 | 1.00 | 44.64 | C |
| ATOM | 122 | CG | PRO | A | 15 | −10.076 | 54.186 | −4.994 | 1.00 | 43.27 | C |
| ATOM | 123 | CD | PRO | A | 15 | −8.956 | 53.788 | −5.901 | 1.00 | 37.62 | C |
| ATOM | 124 | N | GLY | A | 16 | −12.256 | 50.879 | −7.629 | 1.00 | 39.12 | N |
| ATOM | 125 | CA | GLY | A | 16 | −12.982 | 50.480 | −8.819 | 1.00 | 45.72 | C |
| ATOM | 126 | C | GLY | A | 16 | −12.189 | 49.619 | −9.776 | 1.00 | 52.12 | C |
| ATOM | 127 | O | GLY | A | 16 | −12.777 | 49.021 | −10.688 | 1.00 | 49.01 | O |
| ATOM | 128 | N | ARG | A | 17 | −10.874 | 49.526 | −9.604 | 1.00 | 44.20 | N |
| ATOM | 129 | CA | ARG | A | 17 | −10.075 | 48.662 | −10.458 | 1.00 | 46.31 | C |
| ATOM | 130 | C | ARG | A | 17 | −9.461 | 47.525 | −9.657 | 1.00 | 49.27 | C |
| ATOM | 131 | O | ARG | A | 17 | −8.345 | 47.092 | −9.936 | 1.00 | 50.80 | O |
| ATOM | 132 | CB | ARG | A | 17 | −9.001 | 49.465 | −11.182 | 1.00 | 50.76 | C |
| ATOM | 133 | CG | ARG | A | 17 | −9.572 | 50.596 | −12.010 | 1.00 | 54.01 | C |
| ATOM | 134 | CD | ARG | A | 17 | −8.468 | 51.336 | −12.733 | 1.00 | 70.53 | C |
| ATOM | 135 | NE | ARG | A | 17 | −7.654 | 52.139 | −11.824 | 1.00 | 71.62 | N |
| ATOM | 136 | CZ | ARG | A | 17 | −6.492 | 52.691 | −12.160 | 1.00 | 77.59 | C |
| ATOM | 137 | NH1 | ARG | A | 17 | −6.006 | 52.517 | −13.383 | 1.00 | 78.66 | N1+ |
| ATOM | 138 | NH2 | ARG | A | 17 | −5.814 | 53.414 | −11.276 | 1.00 | 72.79 | N |

TABLE 77-continued

| | | | | | | | | | | |
|---|---|---|---|---|---|---|---|---|---|---|
| ATOM | 139 | N | GLY | A | 18 | −10.171 | 47.061 | −8.636 | 1.00 | 46.35 N |
| ATOM | 140 | CA | GLY | A | 18 | −9.721 | 45.928 | −7.860 | 1.00 | 47.96 C |
| ATOM | 141 | C | GLY | A | 18 | −8.689 | 46.276 | −6.797 | 1.00 | 42.69 C |
| ATOM | 142 | O | GLY | A | 18 | −8.574 | 47.412 | −6.295 | 1.00 | 43.76 O |
| ATOM | 143 | N | GLU | A | 19 | −7.934 | 45.244 | −6.449 | 1.00 | 36.87 N |
| ATOM | 144 | CA | GLU | A | 19 | −6.997 | 45.289 | −5.346 | 1.00 | 44.65 C |
| ATOM | 145 | C | GLU | A | 19 | −5.927 | 46.346 | −5.598 | 1.00 | 37.63 C |
| ATOM | 146 | O | GLU | A | 19 | −5.604 | 46.655 | −6.753 | 1.00 | 36.57 O |
| ATOM | 147 | CB | GLU | A | 19 | −6.332 | 43.918 | −5.170 | 1.00 | 48.12 C |
| ATOM | 148 | CG | GLU | A | 19 | −5.720 | 43.370 | −6.485 | 1.00 | 57.27 C |
| ATOM | 149 | CD | GLU | A | 19 | −5.252 | 41.907 | −6.416 | 1.00 | 74.39 C |
| ATOM | 150 | OE1 | GLU | A | 19 | −5.944 | 41.078 | −5.774 | 1.00 | 71.78 O |
| ATOM | 151 | OE2 | GLU | A | 19 | −4.190 | 41.590 | −7.018 | 1.00 | 69.89 O1− |
| ATOM | 152 | N | PRO | A | 20 | −5.339 | 46.891 | −4.535 | 1.00 | 36.06 N |
| ATOM | 153 | CA | PRO | A | 20 | −4.240 | 47.835 | −4.726 | 1.00 | 40.26 C |
| ATOM | 154 | C | PRO | A | 20 | −3.127 | 47.208 | −5.545 | 1.00 | 33.70 C |
| ATOM | 155 | O | PRO | A | 20 | −2.855 | 46.008 | −5.450 | 1.00 | 34.53 O |
| ATOM | 156 | CB | PRO | A | 20 | −3.792 | 48.162 | −3.296 | 1.00 | 37.49 C |
| ATOM | 157 | CG | PRO | A | 20 | −5.028 | 47.904 | −2.455 | 1.00 | 41.49 C |
| ATOM | 158 | CD | PRO | A | 20 | −5.653 | 46.697 | −3.103 | 1.00 | 34.10 C |
| ATOM | 159 | N | ARG | A | 21 | −2.543 | 48.031 | −6.412 | 1.00 | 35.55 N |
| ATOM | 160 | CA | ARG | A | 21 | −1.299 | 47.682 | −7.076 | 1.00 | 35.61 C |
| ATOM | 161 | C | ARG | A | 21 | −0.216 | 17.516 | −6.019 | 1.00 | 35.53 C |
| ATOM | 162 | O | ARG | A | 21 | −0.062 | 48.367 | −5.143 | 1.00 | 36.29 O |
| ATOM | 163 | CB | ARG | A | 21 | −0.913 | 48.781 | −8.072 | 1.00 | 37.74 C |
| ATOM | 164 | CG | ARG | A | 21 | 0.387 | 48.527 | −8.860 | 1.00 | 37.90 C |
| ATOM | 165 | CD | ARG | A | 21 | 0.130 | 47.548 | −9.960 | 1.00 | 40.75 C |
| ATOM | 166 | NE | ARG | A | 21 | 1.309 | 47.278 | −10.772 | 1.00 | 46.00 N |
| ATOM | 167 | CZ | ARG | A | 21 | 1.695 | 48.021 | −11.806 | 1.00 | 47.59 C |
| ATOM | 168 | NH1 | ARG | A | 21 | 1.009 | 49.108 | −12.145 | 1.00 | 38.94 N1+ |
| ATOM | 169 | NH2 | ARG | A | 21 | 2.782 | 47.691 | −12.489 | 1.00 | 42.71 N |
| ATOM | 170 | N | PHE | A | 22 | 0.526 | 46.414 | −6.081 | 1.00 | 35.87 N |
| ATOM | 171 | CA | PHE | A | 22 | 1.579 | 46.162 | −5.107 | 1.00 | 33.30 C |
| ATOM | 172 | C | PHE | A | 22 | 2.860 | 45.830 | −5.847 | 1.00 | 31.67 C |
| ATOM | 173 | O | PHE | A | 22 | 2.892 | 44.881 | −6.633 | 1.00 | 32.18 O |
| ATOM | 174 | CB | PHE | A | 22 | 1.195 | 45.020 | −4.163 | 1.00 | 29.72 C |
| ATOM | 175 | CG | PHE | A | 22 | 2.291 | 44.634 | −3.200 | 1.00 | 31.88 C |
| ATOM | 176 | CD1 | PHE | A | 22 | 2.598 | 45.434 | −2.115 | 1.00 | 35.25 C |
| ATOM | 177 | CD2 | PHE | A | 22 | 2.996 | 43.456 | −3.381 | 1.00 | 38.49 C |
| ATOM | 178 | CE1 | PHE | A | 22 | 3.593 | 45.072 | −1.227 | 1.00 | 32.59 C |
| ATOM | 179 | CE2 | PHE | A | 22 | 3.985 | 43.080 | −2.484 | 1.00 | 37.15 C |
| ATOM | 180 | CZ | PHE | A | 22 | 4.266 | 43.886 | −1.398 | 1.00 | 28.01 C |
| ATOM | 181 | N | ILE | A | 23 | 3.917 | 46.596 | −5.593 | 1.00 | 29.94 N |
| ATOM | 182 | CA | ILE | A | 23 | 5.192 | 46.394 | −6.278 | 1.00 | 30.28 C |
| ATOM | 183 | C | ILE | A | 23 | 6.284 | 46.307 | −5.228 | 1.00 | 35.23 C |
| ATOM | 184 | O | ILE | A | 23 | 6.445 | 47.235 | −4.421 | 1.00 | 34.49 O |
| ATOM | 185 | CB | ILE | A | 23 | 5.509 | 47.498 | −7.293 | 1.00 | 31.65 C |
| ATOM | 186 | CG1 | ILE | A | 23 | 4.513 | 47.440 | −8.452 | 1.00 | 36.37 C |
| ATOM | 187 | CG2 | ILE | A | 23 | 6.970 | 47.338 | −7.833 | 1.00 | 30.92 C |
| ATOM | 188 | CD1 | ILE | A | 23 | 4.484 | 48.726 | −9.282 | 1.00 | 36.75 C |
| ATOM | 189 | N | ALA | A | 24 | 7.016 | 45.188 | −5.231 | 1.00 | 31.98 N |
| ATOM | 190 | CA | ALA | A | 24 | 8.134 | 44.951 | −4.331 | 1.00 | 32.97 C |
| ATOM | 191 | C | ALA | A | 24 | 9.411 | 44.856 | −5.149 | 1.00 | 36.34 C |
| ATOM | 192 | O | ALA | A | 24 | 9.438 | 44.209 | −6.199 | 1.00 | 33.41 O |
| ATOM | 193 | CB | ALA | A | 24 | 7.949 | 43.663 | −3.526 | 1.00 | 28.08 C |
| ATOM | 194 | N | VAL | A | 25 | 10.473 | 45.503 | −4.678 | 1.00 | 32.84 N |
| ATOM | 195 | CA | VAL | A | 25 | 11.751 | 45.435 | −5.370 | 1.00 | 29.50 C |
| ATOM | 196 | C | VAL | A | 25 | 12.831 | 45.215 | −4.324 | 1.00 | 29.59 C |
| ATOM | 197 | O | VAL | A | 25 | 12.812 | 45.848 | −3.263 | 1.00 | 30.59 O |
| ATOM | 198 | CB | VAL | A | 25 | 12.036 | 46.696 | −6.220 | 1.00 | 36.00 C |
| ATOM | 199 | CG1 | VAL | A | 25 | 10.830 | 47.059 | −7.054 | 1.00 | 36.44 C |
| ATOM | 200 | CG2 | VAL | A | 25 | 12.348 | 47.870 | −5.362 | 1.00 | 45.89 C |
| ATOM | 201 | N | GLY | A | 26 | 13.730 | 44.276 | −4.588 | 1.00 | 30.36 N |
| ATOM | 202 | CA | GLY | A | 26 | 14.865 | 44.004 | −3.706 | 1.00 | 29.40 C |
| ATOM | 203 | C | GLY | A | 26 | 16.166 | 44.357 | −4.387 | 1.00 | 32.36 C |
| ATOM | 204 | O | GLY | A | 26 | 16.365 | 44.041 | −5.568 | 1.00 | 29.21 O |
| ATOM | 205 | N | TYR | A | 27 | 17.058 | 45.027 | −3.642 | 1.00 | 30.19 N |
| ATOM | 206 | CA | TYR | A | 27 | 18.379 | 45.411 | −4.121 | 1.00 | 29.48 C |
| ATOM | 207 | C | TYR | A | 27 | 19.448 | 44.928 | −3.155 | 1.00 | 30.59 C |
| ATOM | 208 | O | TYR | A | 27 | 19.259 | 44.949 | −1.937 | 1.00 | 32.65 O |
| ATOM | 209 | CB | TYR | A | 27 | 18.564 | 46.933 | −4.244 | 1.00 | 33.90 C |
| ATOM | 210 | CG | TYR | A | 27 | 17.590 | 47.669 | −5.120 | 1.00 | 32.71 C |
| ATOM | 211 | CD1 | TYR | A | 27 | 17.867 | 47.915 | −6.468 | 1.00 | 37.54 C |
| ATOM | 212 | CD2 | TYR | A | 27 | 16.407 | 48.157 | −4.590 | 1.00 | 37.60 C |
| ATOM | 213 | CE1 | TYR | A | 27 | 16.959 | 48.626 | −7.272 | 1.00 | 40.02 C |
| ATOM | 214 | CE2 | TYR | A | 27 | 15.512 | 48.858 | −5.371 | 1.00 | 44.51 C |
| ATOM | 215 | CZ | TYR | A | 27 | 15.785 | 49.088 | −6.699 | 1.00 | 45.75 C |
| ATOM | 216 | OH | TYR | A | 27 | 14.863 | 49.795 | −7.426 | 1.00 | 49.50 O |
| ATOM | 217 | N | VAL | A | 28 | 20.576 | 44.518 | −3.705 | 1.00 | 28.68 N |
| ATOM | 218 | CA | VAL | A | 28 | 21.822 | 44.438 | −2.958 | 1.00 | 32.47 C |

TABLE 77-continued

| ATOM | 219 | C | VAL | A | 28 | 22.704 | 45.539 | −3.527 | 1.00 | 33.47 | C |
| ATOM | 220 | O | VAL | A | 28 | 22.980 | 45.549 | −4.736 | 1.00 | 31.08 | O |
| ATOM | 221 | CB | VAL | A | 28 | 22.481 | 43.054 | −3.073 | 1.00 | 27.63 | C |
| ATOM | 222 | CG1 | VAL | A | 28 | 23.916 | 43.102 | −2.502 | 1.00 | 29.92 | C |
| ATOM | 223 | CG2 | VAL | A | 28 | 21.651 | 42.008 | −2.306 | 1.00 | 26.80 | C |
| ATOM | 224 | N | ASP | A | 29 | 23.088 | 46.496 | −2.684 | 1.00 | 28.71 | N |
| ATOM | 225 | CA | ASP | A | 29 | 23.806 | 47.694 | −3.161 | 1.00 | 39.63 | C |
| ATOM | 226 | C | ASP | A | 29 | 22.938 | 48.355 | −4.232 | 1.00 | 37.08 | C |
| ATOM | 227 | O | ASP | A | 29 | 21.745 | 48.616 | −3.988 | 1.00 | 35.51 | O |
| ATOM | 228 | CB | ASP | A | 29 | 25.207 | 47.301 | −3.626 | 1.00 | 35.56 | C |
| ATOM | 229 | CG | ASP | A | 29 | 26.061 | 46.705 | −2.534 | 1.00 | 39.18 | C |
| ATOM | 230 | OD1 | ASP | A | 29 | 25.840 | 47.035 | −1.346 | 1.00 | 40.16 | O |
| ATOM | 231 | OD2 | ASP | A | 29 | 26.960 | 45.905 | −2.879 | 1.00 | 40.70 | O1− |
| ATOM | 232 | N | ASP | A | 30 | 23.460 | 48.603 | −5.434 | 1.00 | 35.42 | N |
| ATOM | 233 | CA | ASP | A | 30 | 22.715 | 49.223 | −6.522 | 1.00 | 39.37 | C |
| ATOM | 234 | C | ASP | A | 30 | 22.223 | 48.221 | −7.565 | 1.00 | 39.13 | C |
| ATOM | 235 | O | ASP | A | 30 | 21.888 | 48.624 | −8.688 | 1.00 | 39.10 | O |
| ATOM | 236 | CB | ASP | A | 30 | 23.582 | 50.289 | −7.191 | 1.00 | 41.79 | C |
| ATOM | 237 | CG | ASP | A | 30 | 24.023 | 51.355 | −6.223 | 1.00 | 44.19 | C |
| ATOM | 238 | OD1 | ASP | A | 30 | 23.176 | 51.860 | −5.457 | 1.00 | 42.59 | O |
| ATOM | 239 | OD2 | ASP | A | 30 | 25.227 | 51.670 | −6.211 | 1.00 | 42.46 | O1− |
| ATOM | 240 | N | THR | A | 31 | 22.187 | 46.936 | −7.223 | 1.00 | 33.06 | N |
| ATOM | 241 | CA | THR | A | 31 | 21.780 | 45.855 | −8.116 | 1.00 | 35.43 | C |
| ATOM | 242 | C | THR | A | 31 | 20.412 | 45.309 | −7.687 | 1.00 | 33.91 | C |
| ATOM | 243 | O | THR | A | 31 | 20.280 | 44.749 | −6.592 | 1.00 | 32.19 | O |
| ATOM | 244 | CB | THR | A | 31 | 22.833 | 44.743 | −8.081 | 1.00 | 35.86 | C |
| ATOM | 245 | OG1 | THR | A | 31 | 24.097 | 45.259 | −8.536 | 1.00 | 35.00 | O |
| ATOM | 246 | CG2 | THR | A | 31 | 22.426 | 43.556 | −8.938 | 1.00 | 35.36 | C |
| ATOM | 247 | N | GLN | A | 32 | 19.408 | 45.436 | −8.555 | 1.00 | 32.35 | N |
| ATOM | 248 | CA | GLN | A | 32 | 18.123 | 44.803 | −8.281 | 1.00 | 31.84 | C |
| ATOM | 249 | C | GLN | A | 32 | 18.243 | 43.300 | −8.493 | 1.00 | 31.83 | C |
| ATOM | 250 | O | GLN | A | 32 | 18.817 | 42.844 | −9.487 | 1.00 | 35.05 | O |
| ATOM | 251 | CB | GLN | A | 32 | 17.026 | 45.353 | −9.187 | 1.00 | 32.40 | C |
| ATOM | 252 | CG | GLN | A | 32 | 15.642 | 44.647 | −8.940 | 1.00 | 30.06 | C |
| ATOM | 253 | CD | GLN | A | 32 | 14.566 | 45.075 | −9.929 | 1.00 | 36.87 | C |
| ATOM | 254 | OE1 | GLN | A | 32 | 14.830 | 45.856 | −10.837 | 1.00 | 37.75 | O |
| ATOM | 255 | NE2 | GLN | A | 32 | 13.349 | 44.560 | −9.757 | 1.00 | 35.01 | N |
| ATOM | 256 | N | PHE | A | 33 | 17.724 | 42.516 | −7.561 | 1.00 | 29.19 | N |
| ATOM | 257 | CA | PHE | A | 33 | 17.830 | 41.072 | −7.723 | 1.00 | 29.49 | C |
| ATOM | 258 | C | PHE | A | 33 | 16.500 | 40.333 | −7.675 | 1.00 | 29.23 | C |
| ATOM | 259 | O | PHE | A | 33 | 16.440 | 39.174 | −8.111 | 1.00 | 28.45 | O |
| ATOM | 260 | CB | PHE | A | 33 | 18.792 | 40.486 | −6.677 | 1.00 | 31.32 | C |
| ATOM | 261 | CG | PHE | A | 33 | 18.283 | 40.529 | −5.258 | 1.00 | 29.58 | C |
| ATOM | 262 | CD1 | PHE | A | 33 | 18.340 | 41.695 | −4.512 | 1.00 | 27.85 | C |
| ATOM | 263 | CD2 | PHE | A | 33 | 17.785 | 39.382 | −4.665 | 1.00 | 29.48 | C |
| ATOM | 264 | CE1 | PHE | A | 33 | 17.870 | 41.731 | −3.202 | 1.00 | 26.73 | C |
| ATOM | 265 | CE2 | PHE | A | 33 | 17.317 | 39.394 | −3.346 | 1.00 | 31.16 | C |
| ATOM | 266 | CZ | PHE | A | 33 | 17.357 | 40.573 | −2.617 | 1.00 | 30.58 | C |
| ATOM | 267 | N | VAL | A | 34 | 15.434 | 40.959 | −7.201 | 1.00 | 27.60 | N |
| ATOM | 268 | CA | VAL | A | 34 | 14.106 | 40.343 | −7.262 | 1.00 | 29.97 | C |
| ATOM | 269 | C | VAL | A | 34 | 13.087 | 11.436 | −7.478 | 1.00 | 28.89 | C |
| ATOM | 270 | O | VAL | A | 34 | 13.343 | 42.612 | −7.216 | 1.00 | 29.46 | O |
| ATOM | 271 | CR | VAL | A | 34 | 13.704 | 39.552 | −5.988 | 1.00 | 32.13 | C |
| ATOM | 272 | CG1 | VAL | A | 34 | 14.499 | 38.238 | −5.842 | 1.00 | 27.45 | C |
| ATOM | 273 | CG2 | VAL | A | 34 | 13.844 | 40.448 | −4.758 | 1.00 | 28.08 | C |
| ATOM | 274 | N | ARG | A | 35 | 11.892 | 41.022 | −7.895 | 1.00 | 30.34 | N |
| ATOM | 275 | CA | ARG | A | 35 | 10.743 | 41.896 | −7.979 | 1.00 | 30.30 | C |
| ATOM | 276 | C | ARG | A | 35 | 9.485 | 41.068 | −7.747 | 1.00 | 32.25 | C |
| ATOM | 277 | O | ARG | A | 35 | 9.454 | 39.861 | −8.012 | 1.00 | 32.00 | O |
| ATOM | 278 | CB | ARG | A | 35 | 10.692 | 42.606 | −9.333 | 1.00 | 31.10 | C |
| ATOM | 279 | CG | ARG | A | 35 | 10.218 | 41.739 | −10.461 | 1.00 | 33.96 | C |
| ATOM | 280 | CD | ARG | A | 35 | 8.761 | 42.131 | −10.719 | 1.00 | 40.88 | C |
| ATOM | 281 | NE | ARG | A | 35 | 8.165 | 41.370 | −11.791 | 1.00 | 47.59 | N |
| ATOM | 282 | CZ | ARG | A | 35 | 7.746 | 41.901 | −12.930 | 1.00 | 45.30 | C |
| ATOM | 283 | NH1 | ARG | A | 35 | 7.851 | 43.202 | −13.140 | 1.00 | 43.23 | N1+ |
| ATOM | 284 | NH2 | ARG | A | 35 | 7.208 | 41.121 | −13.850 | 1.00 | 41.93 | N |
| ATOM | 285 | N | PHE | A | 36 | 8.464 | 41.717 | −7.203 | 1.00 | 32.19 | N |
| ATOM | 286 | CA | PHE | A | 36 | 7.104 | 41.189 | −7.234 | 1.00 | 30.76 | C |
| ATOM | 287 | C | PHE | A | 36 | 6.208 | 42.313 | −7.706 | 1.00 | 32.10 | C |
| ATOM | 288 | O | PHE | A | 36 | 6.326 | 43.444 | −7.220 | 1.00 | 34.91 | O |
| ATOM | 289 | CB | PHE | A | 36 | 6.641 | 40.679 | −5.857 | 1.00 | 33.82 | C |
| ATOM | 290 | CG | PHE | A | 36 | 5.240 | 40.078 | −5.860 | 1.00 | 35.33 | C |
| ATOM | 291 | CD1 | PHE | A | 36 | 4.112 | 40.885 | −5.690 | 1.00 | 34.87 | C |
| ATOM | 292 | CD2 | PHE | A | 36 | 5.055 | 38.713 | −6.042 | 1.00 | 35.60 | C |
| ATOM | 293 | CE1 | PHE | A | 36 | 2.820 | 40.343 | −5.715 | 1.00 | 33.23 | C |
| ATOM | 294 | CE2 | PHE | A | 36 | 3.767 | 38.161 | −6.058 | 1.00 | 33.33 | C |
| ATOM | 295 | CZ | PHE | A | 36 | 2.653 | 38.976 | −5.888 | 1.00 | 35.42 | C |
| ATOM | 296 | N | ASP | A | 37 | 5.341 | 42.017 | −8.667 | 1.00 | 35.13 | N |
| ATOM | 297 | CA | ASP | A | 37 | 4.343 | 42.961 | −9.135 | 1.00 | 36.30 | C |
| ATOM | 298 | C | ASP | A | 37 | 2.997 | 42.247 | −9.149 | 1.00 | 37.98 | C |

TABLE 77-continued

| ATOM | 299 | O | ASP | A | 37 | 2.829 | 41.261 | −9.873 | 1.00 | 32.47 | O |
|---|---|---|---|---|---|---|---|---|---|---|---|
| ATOM | 300 | CB | ASP | A | 37 | 4.684 | 43.494 | −10.528 | 1.00 | 35.83 | C |
| ATOM | 301 | CG | ASP | A | 37 | 3.788 | 44.670 | −10.941 | 1.00 | 43.32 | C |
| ATOM | 302 | OD1 | ASP | A | 37 | 2.612 | 44.745 | −10.497 | 1.00 | 36.14 | O |
| ATOM | 303 | OD2 | ASP | A | 37 | 4.276 | 45.540 | −11.697 | 1.00 | 44.29 | O1− |
| ATOM | 304 | N | SER | A | 38 | 2.039 | 42.768 | −8.372 | 1.00 | 33.17 | N |
| ATOM | 305 | CA | SER | A | 38 | 0.712 | 12.160 | −8.306 | 1.00 | 35.06 | C |
| ATOM | 306 | C | SER | A | 38 | 0.037 | 42.111 | −9.664 | 1.00 | 36.02 | C |
| ATOM | 307 | O | SER | A | 38 | −0.857 | 41.289 | −9.865 | 1.00 | 40.38 | O |
| ATOM | 308 | CB | SER | A | 38 | −0.182 | 42.944 | −7.339 | 1.00 | 34.99 | C |
| ATOM | 309 | OG | SER | A | 38 | −0.309 | 44.292 | −7.770 | 1.00 | 35.00 | O |
| ATOM | 310 | N | ASP | A | 39 | 0.412 | 42.990 | −10.587 | 1.00 | 32.72 | N |
| ATOM | 311 | CA | ASP | A | 39 | −0.197 | 42.999 | −11.909 | 1.00 | 40.55 | C |
| ATOM | 312 | C | ASP | A | 39 | 0.560 | 42.154 | −12.933 | 1.00 | 47.69 | C |
| ATOM | 313 | O | ASP | A | 39 | 0.126 | 42.102 | −14.086 | 1.00 | 44.80 | O |
| ATOM | 314 | CB | ASP | A | 39 | −0.320 | 44.436 | −12.429 | 1.00 | 46.13 | C |
| ATOM | 315 | CG | ASP | A | 39 | −1.413 | 45.238 | −11.713 | 1.00 | 46.02 | C |
| ATOM | 316 | OD1 | ASP | A | 39 | −1.962 | 44.768 | −10.695 | 1.00 | 42.48 | O |
| ATOM | 317 | OD2 | ASP | A | 39 | −1.708 | 46.369 | −12.154 | 1.00 | 47.33 | O1− |
| ATOM | 318 | N | ALA | A | 40 | 1.673 | 41.502 | −12.558 | 1.00 | 40.22 | N |
| ATOM | 319 | CA | ALA | A | 40 | 2.371 | 40.603 | −13.473 | 1.00 | 42.61 | C |
| ATOM | 320 | C | ALA | A | 40 | 1.665 | 39.245 | −13.543 | 1.00 | 41.63 | C |
| ATOM | 321 | O | ALA | A | 40 | 0.944 | 38.829 | −12.631 | 1.00 | 44.09 | O |
| ATOM | 322 | CB | ALA | A | 40 | 3.833 | 40.405 | −13.050 | 1.00 | 38.07 | C |
| ATOM | 323 | N | ALA | A | 41 | 1.897 | 38.535 | −14.640 | 1.00 | 41.49 | N |
| ATOM | 324 | CA | ALA | A | 41 | 1.153 | 37.299 | −14.853 | 1.00 | 47.71 | C |
| ATOM | 325 | C | ALA | A | 41 | 1.623 | 36.178 | −13.930 | 1.00 | 45.68 | C |
| ATOM | 326 | O | ALA | A | 41 | 0.826 | 35.307 | −13.571 | 1.00 | 42.11 | O |
| ATOM | 327 | CB | ALA | A | 41 | 1.252 | 36.868 | −16.315 | 1.00 | 47.86 | C |
| ATOM | 328 | N | SER | A | 42 | 2.883 | 36.188 | −13.495 | 1.00 | 39.24 | N |
| ATOM | 329 | CA | SER | A | 42 | 3.375 | 35.024 | −12.748 | 1.00 | 42.66 | C |
| ATOM | 330 | C | SER | A | 42 | 2.772 | 34.917 | −11.349 | 1.00 | 40.07 | C |
| ATOM | 331 | O | SER | A | 42 | 2.655 | 33.808 | −10.812 | 1.00 | 42.86 | O |
| ATOM | 332 | CB | SER | A | 42 | 4.901 | 35.068 | −12.634 | 1.00 | 43.19 | C |
| ATOM | 333 | OG | SER | A | 42 | 5.313 | 36.144 | −11.793 | 1.00 | 43.24 | O |
| ATOM | 334 | N | GLN | A | 43 | 2.437 | 36.043 | −10.726 | 1.00 | 39.12 | N |
| ATOM | 335 | CA | GLN | A | 43 | 2.075 | 36.079 | −9.307 | 1.00 | 39.40 | C |
| ATOM | 336 | C | GLN | A | 43 | 3.165 | 35.451 | −8.427 | 1.00 | 40.47 | C |
| ATOM | 337 | O | GLN | A | 43 | 2.889 | 34.835 | −7.397 | 1.00 | 39.82 | O |
| ATOM | 338 | CB | GLN | A | 43 | 0.711 | 35.411 | −9.080 | 1.00 | 45.69 | C |
| ATOM | 339 | CG | GLN | A | 43 | −0.405 | 36.150 | −9.802 | 1.00 | 43.59 | C |
| ATOM | 340 | CD | GLN | A | 43 | −0.492 | 37.600 | −9.336 | 1.00 | 47.05 | C |
| ATOM | 341 | OE1 | GLN | A | 43 | −0.876 | 37.864 | −8.197 | 1.00 | 51.03 | O |
| ATOM | 342 | NE2 | GLN | A | 43 | −0.102 | 38.544 | −10.203 | 1.00 | 42.23 | N |
| ATOM | 343 | N | ARG | A | 44 | 4.428 | 35.636 | −8.813 | 1.00 | 34.16 | N |
| ATOM | 344 | CA | ARG | A | 44 | 5.547 | 35.054 | −8.082 | 1.00 | 33.13 | C |
| ATOM | 345 | C | ARG | A | 44 | 6.609 | 36.118 | −7.871 | 1.00 | 34.46 | C |
| ATOM | 346 | O | ARG | A | 44 | 6.752 | 37.028 | −8.685 | 1.00 | 32.62 | O |
| ATOM | 347 | CB | ARG | A | 44 | 6.182 | 33.879 | −8.847 | 1.00 | 35.94 | C |
| ATOM | 348 | CG | ARG | A | 44 | 5.228 | 32.759 | −9.211 | 1.00 | 39.96 | C |
| ATOM | 349 | CD | ARG | A | 44 | 5.145 | 31.730 | −8.112 | 1.00 | 41.90 | C |
| ATOM | 350 | NE | ARG | A | 44 | 6.428 | 31.041 | −7.922 | 1.00 | 48.85 | N |
| ATOM | 351 | CZ | ARG | A | 44 | 6.672 | 30.196 | −6.921 | 1.00 | 45.46 | C |
| ATOM | 352 | NH1 | ARG | A | 44 | 5.725 | 29.932 | −6.025 | 1.00 | 45.00 | N1+ |
| ATOM | 353 | NH2 | ARG | A | 44 | 7.852 | 29.613 | −6.816 | 1.00 | 43.67 | N |
| ATOM | 354 | N | MET | A | 45 | 7.355 | 35.999 | −6.775 | 1.00 | 31.23 | N |
| ATOM | 355 | CA | MET | A | 45 | 8.641 | 36.687 | −6.724 | 1.00 | 33.68 | C |
| ATOM | 356 | C | MET | A | 45 | 9.481 | 36.194 | −7.894 | 1.00 | 33.26 | C |
| ATOM | 357 | O | MET | A | 45 | 9.510 | 34.995 | −8.187 | 1.00 | 32.36 | O |
| ATOM | 358 | CB | MET | A | 45 | 9.364 | 36.420 | −5.396 | 1.00 | 30.88 | C |
| ATOM | 359 | CG | MET | A | 45 | 10.564 | 37.348 | −5.169 | 1.00 | 34.08 | C |
| ATOM | 360 | SD | MET | A | 45 | 10.062 | 39.035 | −4.701 | 1.00 | 35.11 | S |
| ATOM | 361 | CE | MET | A | 45 | 10.159 | 38.892 | −2.910 | 1.00 | 32.89 | C |
| ATOM | 362 | N | GLU | A | 46 | 10.146 | 37.122 | −8.584 | 1.00 | 33.15 | N |
| ATOM | 363 | CA | GLU | A | 46 | 10.869 | 36.788 | −9.800 | 1.00 | 32.24 | C |
| ATOM | 364 | C | GLU | A | 46 | 12.325 | 37.214 | −9.696 | 1.00 | 34.48 | C |
| ATOM | 365 | O | GLU | A | 46 | 12.628 | 38.254 | −9.105 | 1.00 | 33.60 | O |
| ATOM | 366 | CB | GLU | A | 46 | 10.263 | 37.473 | −11.031 | 1.00 | 34.11 | C |
| ATOM | 367 | CG | GLU | A | 46 | 8.801 | 37.083 | −11.321 | 1.00 | 41.24 | C |
| ATOM | 368 | CD | GLU | A | 46 | 8.202 | 37.933 | −12.435 | 1.00 | 43.34 | C |
| ATOM | 369 | OE1 | GLU | A | 46 | 7.112 | 38.504 | −12.236 | 1.00 | 51.64 | O |
| ATOM | 370 | OE2 | GLU | A | 46 | 8.848 | 38.069 | −13.493 | 1.00 | 49.08 | O1− |
| ATOM | 371 | N | PRO | A | 47 | 13.235 | 36.450 | −10.293 | 1.00 | 33.65 | N |
| ATOM | 372 | CA | PRO | A | 47 | 14.661 | 36.795 | −10.232 | 1.00 | 31.75 | C |
| ATOM | 373 | C | PRO | A | 47 | 14.993 | 37.907 | −11.210 | 1.00 | 33.33 | C |
| ATOM | 374 | O | PRO | A | 47 | 14.423 | 38.006 | −12.297 | 1.00 | 35.04 | O |
| ATOM | 375 | CB | PRO | A | 47 | 15.358 | 35.488 | −10.639 | 1.00 | 32.02 | C |
| ATOM | 376 | CG | PRO | A | 47 | 14.351 | 34.845 | −11.603 | 1.00 | 35.91 | C |
| ATOM | 377 | CD | PRO | A | 47 | 12.989 | 35.166 | −10.987 | 1.00 | 33.92 | C |
| ATOM | 378 | N | ARG | A | 48 | 15.928 | 38.760 | −10.808 | 1.00 | 33.89 | N |

TABLE 77-continued

| | | | | | | | | | | |
|---|---|---|---|---|---|---|---|---|---|---|
| ATOM | 379 | CA | ARG | A | 48 | 16.349 | 39.858 | −11.671 | 1.00 | 34.19 | C |
| ATOM | 380 | C | ARG | A | 48 | 17.862 | 40.024 | −11.711 | 1.00 | 35.35 | C |
| ATOM | 381 | O | ARG | A | 48 | 18.348 | 40.902 | −12.424 | 1.00 | 38.35 | O |
| ATOM | 382 | CB | ARG | A | 48 | 15.688 | 41.184 | −11.234 | 1.00 | 29.89 | C |
| ATOM | 383 | CG | ARG | A | 48 | 14.195 | 41.274 | −11.633 | 1.00 | 35.59 | C |
| ATOM | 384 | CD | ARG | A | 48 | 14.061 | 41.281 | −13.156 | 1.00 | 36.11 | C |
| ATOM | 385 | NE | ARG | A | 48 | 12.689 | 41.506 | −13.612 | 1.00 | 41.85 | N |
| ATOM | 386 | CZ | ARG | A | 48 | 11.829 | 40.532 | −13.877 | 1.00 | 46.42 | C |
| ATOM | 387 | NH1 | ARG | A | 48 | 10.590 | 40.813 | −14.289 | 1.00 | 43.73 | N1+ |
| ATOM | 388 | NH2 | ARG | A | 48 | 12.208 | 39.270 | −13.713 | 1.00 | 44.46 | N |
| ATOM | 389 | N | ALA | A | 49 | 18.610 | 39.226 | −10.962 | 1.00 | 35.34 | N |
| ATOM | 390 | CA | ALA | A | 49 | 20.061 | 39.236 | −10.996 | 1.00 | 35.15 | C |
| ATOM | 391 | C | ALA | A | 49 | 20.551 | 37.819 | −11.249 | 1.00 | 36.05 | C |
| ATOM | 392 | O | ALA | A | 49 | 19.883 | 36.851 | −10.875 | 1.00 | 37.50 | O |
| ATOM | 393 | CB | ALA | A | 49 | 20.649 | 39.764 | −9.689 | 1.00 | 28.89 | C |
| ATOM | 394 | N | PRO | A | 50 | 21.709 | 37.670 | −11.890 | 1.00 | 40.74 | N |
| ATOM | 395 | CA | PRO | A | 50 | 22.168 | 36.318 | −12.251 | 1.00 | 41.04 | C |
| ATOM | 396 | C | PRO | A | 50 | 22.375 | 35.406 | −11.054 | 1.00 | 37.65 | C |
| ATOM | 397 | O | PRO | A | 50 | 22.008 | 34.225 | −11.106 | 1.00 | 38.23 | O |
| ATOM | 398 | CB | PRO | A | 50 | 23.491 | 36.579 | −13.000 | 1.00 | 44.85 | C |
| ATOM | 399 | CG | PRO | A | 50 | 23.910 | 38.003 | −12.638 | 1.00 | 42.24 | C |
| ATOM | 400 | CD | PRO | A | 50 | 22.593 | 38.731 | −12.404 | 1.00 | 38.56 | C |
| ATOM | 401 | N | TRP | A | 51 | 22.950 | 35.929 | −9.979 | 1.00 | 36.45 | N |
| ATOM | 402 | CA | TRP | A | 51 | 23.382 | 35.121 | −8.850 | 1.00 | 35.40 | C |
| ATOM | 403 | C | TRP | A | 51 | 22.226 | 34.647 | −7.975 | 1.00 | 35.78 | C |
| ATOM | 404 | O | TRP | A | 51 | 22.445 | 33.822 | −7.077 | 1.00 | 33.40 | O |
| ATOM | 405 | CB | TRP | A | 51 | 24.374 | 35.926 | −8.011 | 1.00 | 34.68 | C |
| ATOM | 406 | CG | TRP | A | 51 | 23.987 | 37.385 | −7.834 | 1.00 | 39.95 | C |
| ATOM | 407 | CD1 | TRP | A | 51 | 24.409 | 38.450 | −8.592 | 1.00 | 40.67 | C |
| ATOM | 408 | CD2 | TRP | A | 51 | 23.109 | 37.930 | −6.839 | 1.00 | 36.77 | C |
| ATOM | 409 | NE1 | TRP | A | 51 | 23.845 | 39.614 | −8.131 | 1.00 | 39.46 | N |
| ATOM | 410 | CE2 | TRP | A | 51 | 23.048 | 39.325 | −7.053 | 1.00 | 38.23 | C |
| ATOM | 411 | CE3 | TRP | A | 51 | 22.368 | 37.372 | −5.788 | 1.00 | 35.92 | C |
| ATOM | 412 | CZ2 | TRP | A | 51 | 22.283 | 40.173 | −6.253 | 1.00 | 34.31 | C |
| ATOM | 413 | CZ3 | TRP | A | 51 | 21.598 | 38.216 | −5.006 | 1.00 | 32.50 | C |
| ATOM | 414 | CH2 | TRP | A | 51 | 21.574 | 39.606 | −5.235 | 1.00 | 32.48 | C |
| ATOM | 415 | N | ILE | A | 52 | 21.018 | 35.162 | −8.198 | 1.00 | 32.71 | N |
| ATOM | 416 | CA | ILE | A | 52 | 19.855 | 34.708 | −7.448 | 1.00 | 32.99 | C |
| ATOM | 417 | C | ILE | A | 52 | 19.158 | 33.558 | −8.162 | 1.00 | 33.36 | C |
| ATOM | 418 | O | ILE | A | 52 | 18.385 | 32.834 | −7.530 | 1.00 | 34.62 | O |
| ATOM | 419 | CB | ILE | A | 52 | 18.862 | 35.864 | −7.200 | 1.00 | 35.40 | C |
| ATOM | 420 | CG1 | ILE | A | 52 | 17.918 | 35.580 | −6.023 | 1.00 | 31.68 | O |
| ATOM | 421 | CG2 | ILE | A | 52 | 17.993 | 36.101 | −8.432 | 1.00 | 32.00 | C |
| ATOM | 422 | CD1 | ILE | A | 52 | 18.577 | 35.564 | −4.677 | 1.00 | 33.93 | C |
| ATOM | 423 | N | GLU | A | 53 | 19.410 | 33.367 | −9.461 | 1.00 | 33.21 | N |
| ATOM | 424 | CA | GLU | A | 53 | 18.670 | 32.355 | −10.209 | 1.00 | 33.29 | C |
| ATOM | 425 | C | GLU | A | 53 | 18.887 | 30.953 | −9.669 | 1.00 | 36.01 | C |
| ATOM | 426 | O | GLU | A | 53 | 18.041 | 30.080 | −9.901 | 1.00 | 36.64 | O |
| ATOM | 427 | CB | GLU | A | 53 | 19.062 | 32.385 | −11.692 | 1.00 | 36.24 | C |
| ATOM | 428 | CG | GLU | A | 53 | 18.750 | 33.717 | −12.382 | 1.00 | 39.95 | C |
| ATOM | 429 | CD | GLU | A | 53 | 19.113 | 33.690 | −13.859 | 1.00 | 55.17 | C |
| ATOM | 430 | OE1 | GLU | A | 53 | 19.404 | 32.588 | −14.375 | 1.00 | 50.97 | O |
| ATOM | 431 | OE2 | GLU | A | 53 | 19.114 | 34.763 | −14.502 | 1.00 | 55.71 | O1− |
| ATOM | 432 | N | GLN | A | 54 | 20.004 | 30.704 | −8.973 | 1.00 | 32.89 | N |
| ATOM | 433 | CA | GLN | A | 54 | 20.274 | 29.360 | −8.481 | 1.00 | 32.86 | C |
| ATOM | 434 | C | GLN | A | 54 | 19.450 | 28.985 | −7.259 | 1.00 | 34.79 | C |
| ATOM | 435 | O | GLN | A | 54 | 19.389 | 27.796 | −6.933 | 1.00 | 34.56 | O |
| ATOM | 436 | CB | GLN | A | 54 | 21.766 | 29.192 | −8.145 | 1.00 | 32.69 | C |
| ATOM | 437 | CG | GLN | A | 54 | 22.218 | 29.917 | −6.872 | 1.00 | 30.72 | C |
| ATOM | 438 | CD | GLN | A | 54 | 23.725 | 29.827 | −6.674 | 1.00 | 35.90 | C |
| ATOM | 439 | OE1 | GLN | A | 51 | 24.462 | 30.720 | −7.093 | 1.00 | 39.23 | O |
| ATOM | 440 | NE2 | GLN | A | 54 | 24.188 | 28.743 | −6.052 | 1.00 | 37.83 | N |
| ATOM | 441 | N | GLU | A | 55 | 18.817 | 29.943 | −6.577 | 1.00 | 33.62 | N |
| ATOM | 442 | CA | GLU | A | 55 | 18.024 | 29.588 | −5.403 | 1.00 | 34.59 | C |
| ATOM | 443 | C | GLU | A | 55 | 16.873 | 28.671 | −5.806 | 1.00 | 35.46 | C |
| ATOM | 444 | O | GLU | A | 55 | 16.281 | 28.816 | −6.884 | 1.00 | 34.18 | O |
| ATOM | 445 | CB | GLU | A | 55 | 17.486 | 30.837 | −4.690 | 1.00 | 31.86 | C |
| ATOM | 446 | CG | GLU | A | 55 | 18.555 | 31.844 | −4.200 | 1.00 | 34.07 | C |
| ATOM | 447 | CD | GLU | A | 55 | 19.625 | 31.233 | −3.273 | 1.00 | 41.19 | C |
| ATOM | 448 | OE1 | GLU | A | 55 | 19.558 | 30.035 | −2.933 | 1.00 | 33.91 | O |
| ATOM | 419 | OE2 | GLU | A | 55 | 20.554 | 31.965 | −2.864 | 1.00 | 35.68 | O1− |
| ATOM | 450 | N | GLY | A | 56 | 16.556 | 27.719 | −4.933 | 1.00 | 32.28 | N |
| ATOM | 451 | CA | GLY | A | 56 | 15.627 | 26.671 | −5.282 | 1.00 | 34.33 | C |
| ATOM | 452 | C | GLY | A | 56 | 14.178 | 26.993 | −4.975 | 1.00 | 34.72 | C |
| ATOM | 453 | O | GLY | A | 56 | 13.837 | 28.066 | −4.467 | 1.00 | 33.30 | O |
| ATOM | 454 | N | PRO | A | 57 | 13.295 | 26.044 | −5.269 | 1.00 | 34.42 | N |
| ATOM | 455 | CA | PRO | A | 57 | 11.861 | 26.317 | −5.126 | 1.00 | 34.99 | C |
| ATOM | 456 | C | PRO | A | 57 | 11.437 | 26.647 | −3.703 | 1.00 | 31.00 | C |
| ATOM | 457 | O | PRO | A | 57 | 10.448 | 27.349 | −3.544 | 1.00 | 33.53 | O |
| ATOM | 458 | CB | PRO | A | 57 | 11.196 | 25.024 | −5.641 | 1.00 | 34.83 | C |

TABLE 77-continued

| | | | | | | | | | | |
|---|---|---|---|---|---|---|---|---|---|---|
| ATOM | 459 | CG | PRO | A | 57 | 12.232 | 23.995 | −5.623 | 1.00 | 33.41 | C |
| ATOM | 460 | CD | PRO | A | 57 | 13.548 | 24.717 | −5.860 | 1.00 | 33.42 | C |
| ATOM | 461 | N | GLU | A | 58 | 12.157 | 26.207 | −2.670 | 1.00 | 31.29 | N |
| ATOM | 462 | CA | GLU | A | 58 | 11.811 | 26.640 | −1.313 | 1.00 | 35.77 | C |
| ATOM | 463 | C | GLU | A | 58 | 12.043 | 28.134 | −1.130 | 1.00 | 34.82 | C |
| ATOM | 464 | O | GLU | A | 58 | 11.313 | 28.801 | −0.385 | 1.00 | 32.85 | O |
| ATOM | 465 | CB | GLU | A | 58 | 12.630 | 25.866 | −0.287 | 1.00 | 28.49 | C |
| ATOM | 466 | CG | GLU | A | 58 | 12.181 | 24.429 | −0.128 | 1.00 | 36.16 | C |
| ATOM | 467 | CD | GLU | A | 58 | 10.766 | 24.361 | 0.375 | 0.00 | 38.47 | C |
| ATOM | 468 | OE1 | GLU | A | 58 | 9.913 | 23.861 | −0.369 | 1.00 | 43.54 | O |
| ATOM | 469 | OE2 | GLU | A | 58 | 10.500 | 24.836 | 1.497 | 0.00 | 38.58 | O1− |
| ATOM | 470 | N | TYR | A | 59 | 13.078 | 28.662 | −1.772 | 1.00 | 31.09 | N |
| ATOM | 471 | CA | TYR | A | 59 | 13.304 | 30.097 | −1.744 | 1.00 | 31.00 | C |
| ATOM | 472 | C | TYR | A | 59 | 12.186 | 30.830 | −2.469 | 1.00 | 31.01 | C |
| ATOM | 473 | O | TYR | A | 59 | 11.564 | 31.746 | −1.913 | 1.00 | 31.42 | O |
| ATOM | 474 | CB | TYR | A | 59 | 14.675 | 30.416 | −2.363 | 1.00 | 29.94 | C |
| ATOM | 475 | CG | TYR | A | 59 | 15.000 | 31.897 | −2.386 | 1.00 | 30.65 | C |
| ATOM | 476 | CD1 | TYR | A | 59 | 14.582 | 32.711 | −3.436 | 1.00 | 30.36 | C |
| ATOM | 477 | CD2 | TYR | A | 59 | 15.718 | 32.471 | −1.352 | 1.00 | 30.87 | C |
| ATOM | 478 | CE1 | TYR | A | 59 | 14.877 | 34.065 | −3.447 | 1.00 | 30.07 | C |
| ATOM | 479 | CE2 | TYR | A | 59 | 16.023 | 33.805 | −1.354 | 1.00 | 30.54 | C |
| ATOM | 480 | CZ | TYR | A | 59 | 15.600 | 34.598 | −2.395 | 1.00 | 32.34 | C |
| ATOM | 481 | OH | TYR | A | 59 | 15.920 | 35.928 | −2.360 | 1.00 | 30.98 | O |
| ATOM | 482 | N | TRP | A | 60 | 11.919 | 30.449 | −3.721 | 1.00 | 31.48 | N |
| ATOM | 483 | CA | TRP | A | 60 | 10.927 | 31.190 | −4.492 | 1.00 | 31.81 | C |
| ATOM | 484 | C | TRP | A | 60 | 9.528 | 31.024 | −3.916 | 1.00 | 33.25 | C |
| ATOM | 485 | O | TRP | A | 60 | 8.742 | 31.977 | −3.907 | 1.00 | 31.97 | O |
| ATOM | 486 | CB | TRP | A | 60 | 11.003 | 30.777 | −5.962 | 1.00 | 33.55 | C |
| ATOM | 487 | CG | TRP | A | 60 | 12.354 | 31.137 | −6.478 | 1.00 | 32.47 | C |
| ATOM | 488 | CD1 | TRP | A | 60 | 13.383 | 30.278 | −6.787 | 1.00 | 29.75 | C |
| ATOM | 489 | CD2 | TRP | A | 60 | 12.854 | 32.460 | −6.683 | 1.00 | 30.42 | C |
| ATOM | 490 | NE1 | TRP | A | 60 | 14.498 | 31.004 | −7.182 | 1.00 | 33.69 | N |
| ATOM | 491 | CE2 | TRP | A | 60 | 14.196 | 32.342 | −7.128 | 1.00 | 35.57 | O |
| ATOM | 492 | CE3 | TRP | A | 60 | 12.305 | 33.736 | −6.540 | 1.00 | 31.37 | C |
| ATOM | 493 | CZ2 | TRP | A | 60 | 14.989 | 33.462 | −7.429 | 1.00 | 34.11 | C |
| ATOM | 494 | CZ3 | TRP | A | 60 | 13.093 | 34.840 | −6.841 | 1.00 | 33.18 | C |
| ATOM | 495 | CH2 | TRP | A | 60 | 14.424 | 34.694 | −7.276 | 1.00 | 33.36 | C |
| ATOM | 496 | N | AASP | A | 61 | 9.199 | 29.829 | −3.420 | 0.43 | 35.36 | N |
| ATOM | 497 | CA | AASP | A | 61 | 7.895 | 29.639 | −2.794 | 0.43 | 37.50 | C |
| ATOM | 498 | C | AASP | A | 61 | 7.782 | 30.452 | −1.513 | 0.43 | 34.19 | C |
| ATOM | 499 | O | AASP | A | 61 | 6.758 | 31.101 | −1.271 | 0.43 | 31.98 | O |
| ATOM | 500 | CB | AASP | A | 61 | 7.646 | 28.155 | −2.506 | 0.43 | 36.83 | C |
| ATOM | 501 | CG | AASP | A | 61 | 7.322 | 27.361 | −3.758 | 0.43 | 37.60 | C |
| ATOM | 502 | OD1 | AASP | A | 61 | 6.962 | 27.979 | −4.781 | 0.43 | 37.56 | O |
| ATOM | 503 | OD2 | AASP | A | 61 | 7.419 | 26.116 | −3.711 | 0.43 | 37.47 | O1− |
| ATOM | 504 | N | BASP | A | 61 | 9.199 | 29.833 | −3.408 | 0.57 | 36.49 | N |
| ATOM | 505 | CA | BASP | A | 61 | 7.889 | 29.650 | −2.792 | 0.57 | 37.68 | C |
| ATOM | 506 | C | BASP | A | 61 | 7.779 | 30.455 | −1.508 | 0.57 | 33.70 | C |
| ATOM | 507 | O | BASP | A | 61 | 6.754 | 31.102 | −1.259 | 0.57 | 32.13 | O |
| ATOM | 508 | CB | BASP | A | 61 | 7.625 | 28.165 | −2.514 | 0.57 | 35.98 | C |
| ATOM | 509 | CG | BASP | A | 61 | 6.270 | 27.920 | −1.857 | 0.57 | 42.46 | C |
| ATOM | 510 | OD1 | BASP | A | 61 | 5.227 | 28.176 | −2.506 | 0.57 | 40.88 | O |
| ATOM | 511 | OD2 | BASP | A | 61 | 6.250 | 27.458 | −0.691 | 0.57 | 42.51 | O1− |
| ATOM | 512 | N | GLY | A | 62 | 8.824 | 30.422 | −0.680 | 1.00 | 33.42 | N |
| ATOM | 513 | CA | GLY | A | 62 | 8.761 | 31.120 | 0.592 | 1.00 | 34.06 | C |
| ATOM | 514 | C | GLY | A | 62 | 8.732 | 32.631 | 0.421 | 1.00 | 34.95 | C |
| ATOM | 515 | O | GLY | A | 62 | 7.950 | 33.315 | 1.076 | 1.00 | 30.47 | O |
| ATOM | 516 | N | GLU | A | 63 | 9.580 | 33.161 | −0.469 | 1.00 | 33.07 | N |
| ATOM | 517 | CA | GLU | A | 63 | 9.577 | 34.591 | −0.753 | 1.00 | 31.73 | C |
| ATOM | 518 | C | GLU | A | 63 | 8.280 | 35.021 | −1.426 | 1.00 | 31.18 | C |
| ATOM | 519 | O | GLU | A | 63 | 7.773 | 36.105 | −1.150 | 1.00 | 30.88 | O |
| ATOM | 520 | CB | GLU | A | 63 | 10.774 | 34.956 | −1.635 | 1.00 | 32.35 | C |
| ATOM | 521 | CG | GLU | A | 63 | 12.140 | 34.848 | −0.919 | 1.00 | 30.18 | C |
| ATOM | 522 | CD | GLU | A | 63 | 12.207 | 35.776 | 0.286 | 1.00 | 35.66 | C |
| ATOM | 523 | OE1 | GLU | A | 63 | 11.956 | 35.323 | 1.429 | 1.00 | 35.22 | O |
| ATOM | 524 | OE2 | GLU | A | 63 | 12.486 | 36.983 | 0.092 | 1.00 | 37.89 | O1− |
| ATOM | 525 | N | THR | A | 64 | 7.737 | 34.200 | −2.326 | 1.00 | 30.10 | N |
| ATOM | 526 | CA | THR | A | 64 | 6.436 | 34.538 | −2.904 | 1.00 | 30.17 | C |
| ATOM | 527 | C | THR | A | 64 | 5.363 | 34.601 | −1.820 | 1.00 | 33.24 | C |
| ATOM | 528 | O | THR | A | 64 | 4.590 | 35.569 | −1.752 | 1.00 | 31.29 | O |
| ATOM | 529 | CB | THR | A | 64 | 6.059 | 33.540 | −3.998 | 1.00 | 30.83 | C |
| ATOM | 530 | OG1 | THR | A | 64 | 6.989 | 33.671 | −5.078 | 1.00 | 33.88 | O |
| ATOM | 531 | CG2 | THR | A | 64 | 4.640 | 33.820 | −4.519 | 1.00 | 34.45 | O |
| ATOM | 532 | N | ARG | A | 65 | 5.313 | 33.593 | −0.938 | 1.00 | 32.39 | N |
| ATOM | 533 | CA | ARG | A | 65 | 4.305 | 33.613 | 0.128 | 1.00 | 33.24 | C |
| ATOM | 534 | C | ARG | A | 65 | 4.453 | 34.843 | 1.022 | 1.00 | 31.47 | C |
| ATOM | 535 | O | ARG | A | 65 | 3.460 | 35.504 | 1.358 | 1.00 | 31.35 | O |
| ATOM | 536 | CB | ARG | A | 65 | 4.392 | 32.333 | 0.972 | 1.00 | 34.76 | C |
| ATOM | 537 | CG | ARG | A | 65 | 3.905 | 31.088 | 0.255 | 1.00 | 36.60 | C |
| ATOM | 538 | CD | ARG | A | 65 | 4.143 | 29.805 | 1.076 | 1.00 | 42.40 | C |

TABLE 77-continued

| | | | | | | | | | | |
|---|---|---|---|---|---|---|---|---|---|---|
| ATOM | 539 | NE | ARG | A | 65 | 3.568 | 28.663 | 0.383 | 1.00 | 49.08 | N |
| ATOM | 540 | CZ | ARG | A | 65 | 2.277 | 28.349 | 0.444 | 1.00 | 54.71 | C |
| ATOM | 541 | NH1 | ARG | A | 65 | 1.447 | 29.081 | 1.184 | 1.00 | 55.07 | N1+ |
| ATOM | 542 | NH2 | ARG | A | 65 | 1.819 | 27.305 | −0.219 | 1.00 | 58.64 | N |
| ATOM | 543 | N | LYS | A | 66 | 5.685 | 35.163 | 1.426 | 1.00 | 27.15 | N |
| ATOM | 544 | CA | LYS | A | 66 | 5.908 | 36.222 | 2.402 | 1.00 | 28.44 | C |
| ATOM | 545 | C | LYS | A | 66 | 5.729 | 37.603 | 1.785 | 1.00 | 31.69 | C |
| ATOM | 546 | O | LYS | A | 66 | 5.304 | 38.533 | 2.471 | 1.00 | 31.87 | O |
| ATOM | 547 | CB | LYS | A | 66 | 7.315 | 36.099 | 3.015 | 1.00 | 31.56 | C |
| ATOM | 548 | CG | LYS | A | 66 | 7.458 | 36.748 | 4.403 | 1.00 | 31.26 | C |
| ATOM | 549 | CD | LYS | A | 66 | 6.392 | 36.245 | 5.389 | 1.00 | 30.99 | C |
| ATOM | 550 | CE | LYS | A | 66 | 6.769 | 36.564 | 6.831 | 1.00 | 28.68 | C |
| ATOM | 551 | NZ | LYS | A | 66 | 6.867 | 38.012 | 7.121 | 1.00 | 29.30 | N1+ |
| ATOM | 552 | N | VAL | A | 67 | 6.048 | 37.766 | 0.505 | 1.00 | 30.74 | N |
| ATOM | 553 | CA | VAL | A | 67 | 5.845 | 39.065 | −0.105 | 1.00 | 29.50 | C |
| ATOM | 554 | C | VAL | A | 67 | 4.371 | 39.265 | −0.428 | 1.00 | 32.02 | C |
| ATOM | 555 | O | VAL | A | 67 | 3.875 | 40.402 | −0.412 | 1.00 | 30.21 | O |
| ATOM | 556 | CB | VAL | A | 67 | 6.751 | 39.220 | −1.339 | 1.00 | 36.21 | C |
| ATOM | 557 | CG1 | VAL | A | 67 | 6.181 | 38.472 | −2.562 | 1.00 | 34.29 | C |
| ATOM | 558 | CG2 | VAL | A | 67 | 6.979 | 40.689 | −1.648 | 1.00 | 37.58 | C |
| ATOM | 559 | N | LYS | A | 68 | 3.633 | 38.179 | −0.688 | 1.00 | 30.80 | N |
| ATOM | 560 | CA | LYS | A | 68 | 2.181 | 38.308 | −0.766 | 1.00 | 32.41 | C |
| ATOM | 561 | C | LYS | A | 68 | 1.585 | 38.665 | 0.582 | 1.00 | 31.07 | C |
| ATOM | 562 | O | LYS | A | 68 | 0.579 | 39.383 | 0.647 | 1.00 | 31.40 | O |
| ATOM | 563 | CB | LYS | A | 68 | 1.549 | 37.017 | −1.273 | 1.00 | 31.49 | C |
| ATOM | 564 | CG | LYS | A | 68 | 1.801 | 36.808 | −2.768 | 1.00 | 34.33 | C |
| ATOM | 565 | CD | LYS | A | 68 | 1.232 | 35.506 | −3.199 | 1.00 | 35.16 | C |
| ATOM | 566 | CE | LYS | A | 68 | 1.393 | 35.358 | −4.697 | 1.00 | 44.14 | C |
| ATOM | 567 | NZ | LYS | A | 68 | 0.809 | 34.060 | −5.164 | 1.00 | 52.36 | N1+ |
| ATOM | 568 | N | ALA | A | 69 | 2.171 | 38.151 | 1.661 | 1.00 | 31.99 | N |
| ATOM | 569 | CA | ALA | A | 69 | 1.736 | 38.562 | 2.989 | 1.00 | 33.37 | C |
| ATOM | 570 | C | ALA | A | 69 | 1.996 | 40.043 | 3.192 | 1.00 | 32.70 | C |
| ATOM | 571 | O | ALA | A | 69 | 1.146 | 40.759 | 3.732 | 1.00 | 32.41 | O |
| ATOM | 572 | CB | ALA | A | 69 | 2.437 | 37.727 | 4.071 | 1.00 | 28.09 | C |
| ATOM | 573 | N | HIS | A | 70 | 3.170 | 40.526 | 2.753 | 1.00 | 32.51 | N |
| ATOM | 574 | CA | HIS | A | 70 | 3.447 | 41.962 | 2.780 | 1.00 | 33.08 | C |
| ATOM | 575 | C | HIS | A | 70 | 2.348 | 42.748 | 2.072 | 1.00 | 29.10 | C |
| ATOM | 576 | O | HIS | A | 70 | 1.918 | 43.801 | 2.548 | 1.00 | 30.59 | O |
| ATOM | 577 | CB | HIS | A | 70 | 4.793 | 42.280 | 2.101 | 1.00 | 29.06 | C |
| ATOM | 578 | CG | HIS | A | 70 | 6.008 | 42.120 | 2.967 | 1.00 | 33.91 | C |
| ATOM | 579 | ND1 | HIS | A | 70 | 6.225 | 41.023 | 3.773 | 1.00 | 32.69 | N |
| ATOM | 580 | CD2 | HIS | A | 70 | 7.110 | 42.903 | 3.096 | 1.00 | 32.08 | C |
| ATOM | 581 | CE1 | HIS | A | 70 | 7.400 | 41.142 | 4.372 | 1.00 | 31.81 | C |
| ATOM | 582 | NE2 | HIS | A | 70 | 7.961 | 42.268 | 3.968 | 1.00 | 31.46 | N |
| ATOM | 583 | N | SER | A | 71 | 1.921 | 42.279 | 0.894 | 1.00 | 31.34 | N |
| ATOM | 584 | CA | SER | A | 71 | 0.929 | 43.044 | 0.144 | 1.00 | 33.38 | C |
| ATOM | 585 | C | SER | A | 71 | −0.386 | 43.114 | 0.895 | 1.00 | 32.58 | C |
| ATOM | 586 | O | SER | A | 71 | −1.106 | 44.118 | 0.794 | 1.00 | 33.01 | O |
| ATOM | 587 | CB | SER | A | 71 | 0.672 | 42.427 | −1.231 | 1.00 | 34.79 | C |
| ATOM | 588 | OG | SER | A | 71 | −0.116 | 41.248 | −1.116 | 1.00 | 42.57 | O |
| ATOM | 589 | N | GLN | A | 72 | −0.729 | 42.042 | 1.605 | 1.00 | 32.14 | N |
| ATOM | 590 | CA | GLN | A | 72 | −1.972 | 42.026 | 2.371 | 1.00 | 38.01 | C |
| ATOM | 591 | C | GLN | A | 72 | −1.873 | 42.928 | 3.589 | 1.00 | 33.61 | C |
| ATOM | 592 | O | GLN | A | 72 | −2.839 | 43.616 | 3.942 | 1.00 | 36.10 | O |
| ATOM | 593 | CB | GLN | A | 72 | −2.317 | 40.589 | 2.771 | 1.00 | 34.22 | C |
| ATOM | 594 | CG | GLN | A | 72 | −2.699 | 39.718 | 1.566 | 1.00 | 41.67 | C |
| ATOM | 595 | CD | GLN | A | 72 | −3.663 | 40.449 | 0.616 | 1.00 | 57.03 | C |
| ATOM | 596 | OE1 | GLN | A | 72 | −4.793 | 40.774 | 0.996 | 1.00 | 51.74 | O |
| ATOM | 597 | NE2 | GLN | A | 72 | −3.200 | 40.740 | −0.611 | 1.00 | 52.46 | N |
| ATOM | 598 | N | THR | A | 73 | −0.709 | 42.944 | 4.237 | 1.00 | 32.29 | N |
| ATOM | 599 | CA | THR | A | 73 | −0.440 | 43.931 | 5.280 | 1.00 | 29.27 | C |
| ATOM | 600 | C | THR | A | 73 | −0.639 | 45.361 | 4.767 | 1.00 | 33.67 | C |
| ATOM | 601 | O | THR | A | 73 | −1.251 | 46.193 | 5.447 | 1.00 | 33.62 | O |
| ATOM | 602 | CB | THR | A | 73 | 0.991 | 43.716 | 5.796 | 1.00 | 32.20 | C |
| ATOM | 603 | OG1 | THR | A | 73 | 1.061 | 42.410 | 6.358 | 1.00 | 32.59 | O |
| ATOM | 604 | CG2 | THR | A | 73 | 1.399 | 44.745 | 6.858 | 1.00 | 31.25 | C |
| ATOM | 605 | N | HIS | A | 74 | −0.093 | 45.679 | 3.582 | 1.00 | 31.43 | N |
| ATOM | 606 | CA | HIS | A | 74 | −0.253 | 47.024 | 3.025 | 1.00 | 33.73 | C |
| ATOM | 607 | C | HIS | A | 74 | −1.700 | 47.313 | 2.642 | 1.00 | 36.01 | C |
| ATOM | 608 | O | HIS | A | 74 | −2.154 | 48.452 | 2.747 | 1.00 | 32.79 | O |
| ATOM | 609 | CB | HIS | A | 74 | 0.629 | 47.214 | 1.789 | 1.00 | 34.83 | C |
| ATOM | 610 | CG | HIS | A | 74 | 2.042 | 47.570 | 2.101 | 1.00 | 44.16 | C |
| ATOM | 611 | ND1 | HIS | A | 74 | 2.903 | 48.084 | 1.152 | 1.00 | 46.50 | N |
| ATOM | 612 | CD2 | HIS | A | 74 | 2.755 | 47.480 | 3.249 | 1.00 | 50.75 | C |
| ATOM | 613 | CE1 | HIS | A | 74 | 4.086 | 48.293 | 1.703 | 1.00 | 49.47 | C |
| ATOM | 614 | NE2 | HIS | A | 74 | 4.027 | 47.925 | 2.971 | 1.00 | 51.47 | N |
| ATOM | 615 | N | ARG | A | 75 | −2.419 | 46.309 | 2.148 | 1.00 | 33.69 | N |
| ATOM | 616 | CA | ARG | A | 75 | −3.835 | 46.484 | 1.849 | 1.00 | 37.22 | C |
| ATOM | 617 | C | ARG | A | 75 | −4.609 | 46.886 | 3.097 | 1.00 | 33.37 | C |
| ATOM | 618 | O | ARG | A | 75 | −5.411 | 47.827 | 3.069 | 1.00 | 34.83 | O |

TABLE 77-continued

| | | | | | | | | | | |
|---|---|---|---|---|---|---|---|---|---|---|
| ATOM | 619 | CB | ARG | A | 75 | −4.390 | 45.191 | 1.254 | 1.00 | 38.68 C |
| ATOM | 620 | CG | ARG | A | 75 | −5.874 | 45.190 | 1.017 | 1.00 | 50.35 C |
| ATOM | 621 | CD | ARG | A | 75 | −6.261 | 43.932 | 0.242 | 1.00 | 55.65 C |
| ATOM | 622 | NE | ARG | A | 75 | −7.704 | 43.700 | 0.291 | 1.00 | 78.12 N |
| ATOM | 623 | CZ | ARG | A | 75 | −8.334 | 42.750 | −0.396 | 1.00 | 84.01 C |
| ATOM | 624 | NH1 | ARG | A | 75 | −7.646 | 41.939 | −1.191 | 1.00 | 82.52 N1+ |
| ATOM | 625 | NH2 | ARG | A | 75 | −9.653 | 42.612 | −0.293 | 1.00 | 86.64 N |
| ATOM | 626 | N | VAL | A | 76 | −4.379 | 46.183 | 4.207 | 1.00 | 30.92 N |
| ATOM | 627 | CA | VAL | A | 76 | −5.019 | 46.543 | 5.474 | 1.00 | 36.04 C |
| ATOM | 628 | C | VAL | A | 76 | −4.631 | 47.960 | 5.882 | 1.00 | 31.87 C |
| ATOM | 629 | O | VAL | A | 76 | −5.477 | 48.757 | 6.301 | 1.00 | 36.27 O |
| ATOM | 630 | CB | VAL | A | 76 | −4.644 | 45.530 | 6.573 | 1.00 | 38.19 C |
| ATOM | 631 | CG1 | VAL | A | 76 | −5.209 | 45.966 | 7.928 | 1.00 | 35.63 C |
| ATOM | 632 | CG2 | VAL | A | 76 | −5.148 | 44.149 | 6.212 | 1.00 | 34.98 C |
| ATOM | 633 | N | ASP | A | 77 | −3.335 | 48.275 | 5.795 | 1.00 | 34.32 N |
| ATOM | 634 | CA | ASP | A | 77 | −2.821 | 49.602 | 6.121 | 1.00 | 32.70 C |
| ATOM | 635 | C | ASP | A | 77 | −3.577 | 50.692 | 5.390 | 1.00 | 31.47 C |
| ATOM | 636 | O | ASP | A | 77 | −3.919 | 51.720 | 5.976 | 1.00 | 31.32 O |
| ATOM | 637 | CB | ASP | A | 77 | −1.331 | 49.716 | 5.743 | 1.00 | 30.70 C |
| ATOM | 638 | CG | ASP | A | 77 | −0.420 | 48.907 | 6.648 | 1.00 | 39.21 C |
| ATOM | 639 | OD1 | ASP | A | 77 | −0.911 | 48.420 | 7.681 | 1.00 | 36.54 O |
| ATOM | 640 | OD2 | ASP | A | 77 | 0.790 | 48.754 | 6.325 | 1.00 | 37.81 O1− |
| ATOM | 641 | N | LEU | A | 78 | −3.779 | 50.514 | 4.083 | 1.00 | 32.06 N |
| ATOM | 642 | CA | LEU | A | 78 | −4.475 | 51.534 | 3.305 | 1.00 | 34.37 O |
| ATOM | 643 | C | LEU | A | 78 | −5.869 | 51.794 | 3.869 | 1.00 | 34.41 C |
| ATOM | 644 | O | LEU | A | 78 | −6.303 | 52.950 | 3.975 | 1.00 | 36.18 O |
| ATOM | 645 | CB | LEU | A | 78 | −4.549 | 51.110 | 1.836 | 1.00 | 32.11 C |
| ATOM | 646 | CG | LEU | A | 78 | −3.223 | 51.262 | 1.064 | 1.00 | 31.77 C |
| ATOM | 647 | CD1 | LEU | A | 78 | −3.251 | 50.489 | −0.248 | 1.00 | 31.02 C |
| ATOM | 648 | CD2 | LEU | A | 78 | −2.939 | 52.741 | 0.767 | 1.00 | 35.66 C |
| ATOM | 649 | N | GLY | A | 79 | −6.572 | 50.739 | 4.270 | 1.00 | 30.79 N |
| ATOM | 650 | CA | GLY | A | 79 | −7.901 | 50.941 | 4.839 | 1.00 | 37.72 C |
| ATOM | 651 | C | GLY | A | 79 | −7.842 | 51.591 | 6.205 | 1.00 | 37.84 C |
| ATOM | 652 | O | GLY | A | 79 | −8.618 | 52.501 | 6.502 | 1.00 | 35.64 O |
| ATOM | 653 | N | THR | A | 80 | −6.892 | 51.156 | 7.042 | 1.00 | 33.79 N |
| ATOM | 654 | CA | THR | A | 80 | −6.724 | 51.745 | 8.368 | 1.00 | 32.85 C |
| ATOM | 655 | C | THR | A | 80 | −6.358 | 53.228 | 8.289 | 1.00 | 40.37 C |
| ATOM | 656 | O | THR | A | 80 | −6.885 | 54.045 | 9.054 | 1.00 | 37.69 O |
| ATOM | 657 | CB | THR | A | 80 | −5.652 | 50.958 | 9.132 | 1.00 | 40.11 C |
| ATOM | 658 | OG1 | THR | A | 80 | −6.042 | 49.577 | 9.197 | 1.00 | 40.09 O |
| ATOM | 659 | CG2 | THR | A | 80 | −5.458 | 51.505 | 10.545 | 1.00 | 37.87 C |
| ATOM | 660 | N | LEU | A | 81 | −5.457 | 53.594 | 7.365 | 1.00 | 35.06 N |
| ATOM | 661 | CA | LEU | A | 81 | −4.978 | 54.972 | 7.250 | 1.00 | 32.60 C |
| ATOM | 662 | C | LEU | A | 81 | −6.069 | 55.912 | 6.747 | 1.00 | 34.58 C |
| ATOM | 663 | O | LEU | A | 81 | −6.194 | 57.042 | 7.231 | 1.00 | 38.26 O |
| ATOM | 664 | CB | LEU | A | 81 | −3.766 | 55.011 | 6.319 | 1.00 | 33.56 C |
| ATOM | 665 | CG | LEU | A | 81 | −2.538 | 54.333 | 6.946 | 1.00 | 34.62 C |
| ATOM | 666 | CD1 | LEU | A | 81 | −1.515 | 54.002 | 5.868 | 1.00 | 32.94 C |
| ATOM | 667 | CD2 | LEU | A | 81 | −1.931 | 55.236 | 8.012 | 1.00 | 34.53 C |
| ATOM | 668 | N | ARG | A | 82 | −6.836 | 55.476 | 5.747 | 1.00 | 34.32 N |
| ATOM | 669 | CA | ARG | A | 82 | −8.062 | 56.181 | 5.386 | 1.00 | 39.34 C |
| ATOM | 670 | C | ARG | A | 82 | −8.906 | 56.470 | 6.629 | 1.00 | 38.72 C |
| ATOM | 671 | O | ARG | A | 82 | −9.419 | 57.584 | 6.802 | 1.00 | 39.14 O |
| ATOM | 672 | CB | ARG | A | 82 | −8.847 | 55.329 | 4.372 | 1.00 | 39.64 C |
| ATOM | 673 | CG | ARG | A | 82 | −10.125 | 55.930 | 3.851 | 1.00 | 46.44 C |
| ATOM | 674 | CD | ARG | A | 82 | −10.950 | 54.852 | 3.147 | 1.00 | 51.43 C |
| ATOM | 675 | NE | ARG | A | 82 | −10.072 | 54.043 | 2.326 | 1.00 | 55.53 N |
| ATOM | 676 | CZ | ARG | A | 82 | −10.204 | 52.738 | 2.138 | 1.00 | 52.04 C |
| ATOM | 677 | NH1 | ARG | A | 82 | −11.202 | 52.079 | 2.721 | 1.00 | 49.00 N1+ |
| ATOM | 678 | NH2 | ARG | A | 82 | −9.316 | 52.097 | 1.375 | 1.00 | 53.98 N |
| ATOM | 679 | N | GLY | A | 83 | −9.046 | 55.477 | 7.510 | 1.00 | 39.30 N |
| ATOM | 680 | CA | GLY | A | 83 | −9.701 | 55.708 | 8.790 | 1.00 | 36.93 C |
| ATOM | 681 | C | GLY | A | 83 | −9.018 | 56.779 | 9.628 | 1.00 | 42.16 C |
| ATOM | 682 | O | GLY | A | 83 | −9.661 | 57.746 | 10.056 | 1.00 | 39.74 O |
| ATOM | 683 | N | TYR | A | 84 | −7.704 | 56.622 | 9.874 | 1.00 | 38.58 N |
| ATOM | 684 | CA | TYR | A | 84 | −6.987 | 57.548 | 10.757 | 1.00 | 37.84 C |
| ATOM | 685 | C | TYR | A | 84 | −7.132 | 58.990 | 10.299 | 1.00 | 43.06 C |
| ATOM | 686 | O | TYR | A | 84 | −7.295 | 59.901 | 11.121 | 1.00 | 43.28 O |
| ATOM | 687 | CB | TYR | A | 84 | −5.498 | 57.212 | 10.825 | 1.00 | 35.29 C |
| ATOM | 688 | CG | TYR | A | 84 | −5.149 | 55.964 | 11.590 | 1.00 | 41.87 C |
| ATOM | 689 | CD1 | TYR | A | 84 | −6.098 | 55.278 | 12.347 | 1.00 | 37.88 C |
| ATOM | 690 | CD2 | TYR | A | 84 | −3.854 | 55.462 | 11.546 | 1.00 | 40.72 C |
| ATOM | 691 | CE1 | TYR | A | 84 | −5.756 | 54.136 | 13.046 | 1.00 | 41.33 C |
| ATOM | 692 | CE2 | TYR | A | 84 | −3.505 | 54.330 | 12.229 | 1.00 | 40.83 C |
| ATOM | 693 | CZ | TYR | A | 84 | −4.447 | 53.669 | 12.986 | 1.00 | 42.48 C |
| ATOM | 694 | OH | TYR | A | 84 | −4.060 | 52.533 | 13.662 | 1.00 | 44.09 O |
| ATOM | 695 | N | TYR | A | 85 | −7.012 | 59.224 | 8.998 | 1.00 | 39.41 N |
| ATOM | 696 | CA | TYR | A | 85 | −7.072 | 60.567 | 8.447 | 1.00 | 36.31 C |
| ATOM | 697 | C | TYR | A | 85 | −8.471 | 60.963 | 8.014 | 1.00 | 35.46 C |
| ATOM | 698 | O | TYR | A | 85 | −8.643 | 62.037 | 7.447 | 1.00 | 35.90 O |

TABLE 77-continued

| | | | | | | | | | | |
|---|---|---|---|---|---|---|---|---|---|---|
| ATOM | 699 | CB | TYR | A | 85 | −6.101 | 60.685 | 7.269 | 1.00 | 35.97 C |
| ATOM | 700 | CG | TYR | A | 85 | −4.669 | 60.611 | 7.727 | 1.00 | 40.43 C |
| ATOM | 701 | CD1 | TYR | A | 85 | −1.054 | 61.722 | 8.298 | 1.00 | 41.19 C |
| ATOM | 702 | CD2 | TYR | A | 85 | −3.938 | 59.421 | 7.628 | 1.00 | 37.43 C |
| ATOM | 703 | CE1 | TYR | A | 85 | −2.726 | 61.660 | 8.739 | 1.00 | 43.26 C |
| ATOM | 704 | CE2 | TYR | A | 85 | −2.612 | 59.351 | 8.064 | 1.00 | 38.35 C |
| ATOM | 705 | CZ | TYR | A | 85 | −2.020 | 60.472 | 8.621 | 1.00 | 38.66 C |
| ATOM | 706 | OH | TYR | A | 85 | −0.718 | 60.420 | 9.057 | 1.00 | 38.40 O |
| ATOM | 707 | N | ASN | A | 86 | −9.463 | 60.121 | 8.265 | 1.00 | 38.80 N |
| ATOM | 708 | CA | ASN | A | 86 | −10.858 | 60.401 | 7.913 | 1.00 | 40.81 C |
| ATOM | 709 | C | ASN | A | 86 | −10.987 | 60.814 | 6.451 | 1.00 | 38.64 C |
| ATOM | 710 | O | ASN | A | 86 | −11.618 | 61.814 | 6.112 | 1.00 | 41.64 O |
| ATOM | 711 | CB | ASN | A | 86 | −11.469 | 61.466 | 8.832 | 1.00 | 36.56 C |
| ATOM | 712 | CG | ASN | A | 86 | −12.995 | 61.486 | 8.741 | 1.00 | 45.08 C |
| ATOM | 713 | OD1 | ASN | A | 86 | −13.603 | 60.479 | 8.400 | 1.00 | 39.95 O |
| ATOM | 714 | ND2 | ASN | A | 86 | −13.607 | 62.637 | 9.015 | 1.00 | 46.14 N |
| ATOM | 715 | N | GLN | A | 87 | −10.364 | 60.039 | 5.581 | 1.00 | 38.58 N |
| ATOM | 716 | CA | GLN | A | 87 | −10.383 | 60.305 | 4.156 | 1.00 | 33.37 C |
| ATOM | 717 | C | GLN | A | 87 | −11.493 | 59.515 | 3.487 | 1.00 | 39.94 C |
| ATOM | 718 | O | GLN | A | 87 | −11.948 | 58.490 | 3.990 | 1.00 | 38.63 O |
| ATOM | 719 | CB | GLN | A | 87 | −9.050 | 59.938 | 3.508 | 1.00 | 32.17 C |
| ATOM | 720 | CG | GLN | A | 87 | −7.927 | 60.906 | 3.823 | 1.00 | 35.90 C |
| ATOM | 721 | CD | GLN | A | 87 | −6.569 | 60.279 | 3.571 | 1.00 | 38.86 C |
| ATOM | 722 | OE1 | GLN | A | 87 | −6.396 | 59.074 | 3.752 | 1.00 | 34.99 O |
| ATOM | 723 | NE2 | GLN | A | 87 | −5.603 | 61.089 | 3.151 | 1.00 | 39.88 N |
| ATOM | 724 | N | SER | A | 88 | −11.881 | 59.982 | 2.312 | 1.00 | 38.16 N |
| ATOM | 725 | CA | SER | A | 88 | −12.913 | 59.317 | 1.534 | 1.00 | 40.06 C |
| ATOM | 726 | C | SER | A | 88 | −12.349 | 58.090 | 0.828 | 1.00 | 40.29 C |
| ATOM | 727 | O | SER | A | 88 | −11.194 | 58.071 | 0.389 | 1.00 | 37.15 O |
| ATOM | 728 | CB | SER | A | 88 | −13.495 | 60.282 | 0.500 | 1.00 | 41.87 C |
| ATOM | 729 | OG | SER | A | 88 | −14.022 | 59.546 | −0.586 | 1.00 | 54.17 O |
| ATOM | 730 | N | GLU | A | 89 | −13.188 | 57.070 | 0.682 | 1.00 | 35.21 N |
| ATOM | 731 | CA | GLU | A | 89 | −12.728 | 55.799 | 0.148 | 1.00 | 41.91 C |
| ATOM | 732 | C | GLU | A | 89 | −12.610 | 55.771 | −1.375 | 1.00 | 42.03 C |
| ATOM | 733 | O | GLU | A | 89 | −12.107 | 54.778 | −1.922 | 1.00 | 49.87 O |
| ATOM | 734 | CB | GLU | A | 89 | −13.685 | 54.694 | 0.576 | 1.00 | 44.50 C |
| ATOM | 735 | CG | GLU | A | 89 | −14.951 | 54.824 | −0.179 | 1.00 | 42.74 C |
| ATOM | 736 | CD | GLU | A | 89 | −15.970 | 53.783 | 0.168 | 0.00 | 41.13 C |
| ATOM | 737 | OE1 | GLU | A | 89 | −16.978 | 53.746 | −0.518 | 1.00 | 46.21 C |
| ATOM | 738 | OE2 | GLU | A | 89 | −15.797 | 53.001 | 1.107 | 1.00 | 38.89 O1− |
| ATOM | 739 | N | ALA | A | 90 | −13.049 | 56.803 | −2.084 | 1.00 | 37.05 N |
| ATOM | 740 | CA | ALA | A | 90 | −13.086 | 56.710 | −3.541 | 1.00 | 41.52 C |
| ATOM | 741 | C | ALA | A | 90 | −11.851 | 57.287 | −4.216 | 1.00 | 40.03 C |
| ATOM | 742 | O | ALA | A | 90 | −11.786 | 57.287 | −5.448 | 1.00 | 42.40 O |
| ATOM | 743 | CB | ALA | A | 90 | −14.329 | 57.411 | −4.097 | 1.00 | 42.86 C |
| ATOM | 744 | N | GLY | A | 91 | −10.897 | 57.806 | −3.457 | 1.00 | 37.66 N |
| ATOM | 745 | CA | GLY | A | 91 | −9.661 | 58.301 | −4.015 | 1.00 | 41.43 C |
| ATOM | 746 | C | GLY | A | 91 | −8.523 | 57.296 | −3.890 | 1.00 | 42.32 C |
| ATOM | 747 | O | GLY | A | 91 | −8.578 | 56.339 | −3.124 | 1.00 | 41.45 O |
| ATOM | 748 | N | SER | A | 92 | −7.473 | 57.535 | −4.663 | 1.00 | 37.84 N |
| ATOM | 749 | CA | SER | A | 92 | −6.312 | 56.673 | −4.671 | 1.00 | 32.86 C |
| ATOM | 750 | C | SER | A | 92 | −5.302 | 57.168 | −3.648 | 1.00 | 39.40 C |
| ATOM | 751 | O | SER | A | 92 | −5.041 | 58.371 | −3.549 | 1.00 | 38.24 O |
| ATOM | 752 | CB | SER | A | 92 | −5.681 | 56.652 | −6.062 | 1.00 | 36.27 C |
| ATOM | 753 | OG | SER | A | 92 | −4.500 | 55.865 | −6.047 | 1.00 | 36.37 O |
| ATOM | 754 | N | HIS | A | 93 | −4.748 | 56.239 | −2.880 | 1.00 | 34.75 N |
| ATOM | 755 | CA | HIS | A | 93 | −3.752 | 56.544 | −1.864 | 1.00 | 36.24 C |
| ATOM | 756 | C | HIS | A | 93 | −2.593 | 55.557 | −1.975 | 1.00 | 32.60 C |
| ATOM | 757 | O | HIS | A | 93 | −2.706 | 54.516 | −2.623 | 1.00 | 33.95 O |
| ATOM | 758 | CB | HIS | A | 93 | −4.372 | 56.519 | −0.470 | 1.00 | 32.32 C |
| ATOM | 759 | CG | HIS | A | 93 | −5.410 | 57.574 | −0.283 | 1.00 | 39.15 C |
| ATOM | 760 | ND1 | HIS | A | 93 | −5.091 | 58.866 | 0.077 | 1.00 | 39.95 N |
| ATOM | 761 | CD2 | HIS | A | 93 | −6.749 | 57.556 | −0.491 | 1.00 | 34.10 C |
| ATOM | 762 | CE1 | HIS | A | 93 | −6.195 | 59.592 | 0.113 | 1.00 | 43.69 C |
| ATOM | 763 | NE2 | HIS | A | 93 | −7.213 | 58.822 | −0.227 | 1.00 | 36.62 N |
| ATOM | 764 | N | THR | A | 94 | −1.482 | 55.899 | −1.314 | 1.00 | 31.88 N |
| ATOM | 765 | CA | THR | A | 94 | −0.197 | 55.241 | −1.525 | 1.00 | 35.60 C |
| ATOM | 766 | C | THR | A | 94 | 0.451 | 54.936 | −0.186 | 1.00 | 30.36 C |
| ATOM | 767 | O | THR | A | 94 | 0.548 | 55.809 | 0.682 | 1.00 | 34.28 O |
| ATOM | 768 | CB | THR | A | 94 | 0.756 | 56.111 | −2.358 | 1.00 | 32.62 C |
| ATOM | 769 | OG1 | THR | A | 94 | 0.125 | 56.473 | −3.595 | 1.00 | 36.14 O |
| ATOM | 770 | CG2 | THR | A | 94 | 2.052 | 55.345 | −2.659 | 1.00 | 31.28 C |
| ATOM | 771 | N | VAL | A | 95 | 0.876 | 53.696 | −0.013 | 1.00 | 30.84 N |
| ATOM | 772 | CA | VAL | A | 95 | 1.731 | 53.322 | 1.104 | 1.00 | 33.52 C |
| ATOM | 773 | C | VAL | A | 95 | 3.087 | 52.957 | 0.525 | 1.00 | 33.00 C |
| ATOM | 774 | O | VAL | A | 95 | 3.165 | 52.233 | −0.470 | 1.00 | 31.63 O |
| ATOM | 775 | CB | VAL | A | 95 | 1.143 | 52.160 | 1.918 | 1.00 | 33.51 C |
| ATOM | 776 | CG1 | VAL | A | 95 | 2.237 | 51.499 | 2.747 | 1.00 | 42.33 C |
| ATOM | 777 | CG2 | VAL | A | 95 | 0.032 | 52.685 | 2.834 | 1.00 | 35.21 C |
| ATOM | 778 | N | GLN | A | 96 | 4.142 | 53.480 | 1.122 | 1.00 | 33.07 N |

TABLE 77-continued

| ATOM | 779 | CA | GLN | A | 96 | 5.488 | 53.095 | 0.724 | 1.00 | 35.51 | O |
| ATOM | 780 | C | GLN | A | 96 | 6.254 | 52.623 | 1.946 | 1.00 | 33.26 | C |
| ATOM | 781 | O | GLN | A | 96 | 6.120 | 53.185 | 3.038 | 1.00 | 31.83 | O |
| ATOM | 782 | CB | GLN | A | 96 | 6.229 | 54.229 | 0.057 | 1.00 | 30.00 | C |
| ATOM | 783 | CG | GLN | A | 96 | 5.683 | 54.589 | −1.318 | 1.00 | 32.13 | C |
| ATOM | 784 | CD | GLN | A | 96 | 6.082 | 56.007 | −1.681 | 1.00 | 38.44 | C |
| ATOM | 785 | OE1 | GLN | A | 96 | 5.367 | 56.968 | −1.367 | 1.00 | 37.16 | O |
| ATOM | 786 | NE2 | GLN | A | 96 | 7.248 | 56.151 | −2.316 | 1.00 | 31.44 | N |
| ATOM | 787 | N | ARG | A | 97 | 7.081 | 51.609 | 1.740 | 1.00 | 32.54 | N |
| ATOM | 788 | CA | ARG | A | 97 | 7.860 | 51.034 | 2.825 | 1.00 | 31.83 | C |
| ATOM | 789 | C | ARG | A | 97 | 9.225 | 50.632 | 2.306 | 1.00 | 29.62 | C |
| ATOM | 790 | O | ARG | A | 97 | 9.343 | 50.014 | 1.244 | 1.00 | 31.24 | O |
| ATOM | 791 | CB | ARG | A | 97 | 7.165 | 49.818 | 3.422 | 1.00 | 29.79 | C |
| ATOM | 792 | CG | ARG | A | 97 | 7.931 | 49.161 | 4.571 | 1.00 | 38.86 | C |
| ATOM | 793 | CD | ARG | A | 97 | 7.293 | 47.829 | 4.946 | 1.00 | 42.53 | C |
| ATOM | 794 | NE | ARG | A | 97 | 6.805 | 47.884 | 6.317 | 1.00 | 56.95 | N |
| ATOM | 795 | CZ | ARG | A | 97 | 5.540 | 47.748 | 6.707 | 1.00 | 49.60 | C |
| ATOM | 796 | NH1 | ARG | A | 97 | 5.259 | 47.821 | 7.999 | 1.00 | 52.70 | N1+ |
| ATOM | 797 | NH2 | ARG | A | 97 | 4.565 | 47.494 | 5.841 | 1.00 | 53.08 | N |
| ATOM | 798 | N | MET | A | 98 | 10.249 | 50.976 | 3.062 | 1.00 | 30.21 | N |
| ATOM | 799 | CA | MET | A | 98 | 11.607 | 50.572 | 2.735 | 1.00 | 32.56 | C |
| ATOM | 800 | C | MET | A | 98 | 12.255 | 50.079 | 4.013 | 1.00 | 31.13 | C |
| ATOM | 801 | O | MET | A | 98 | 12.177 | 50.747 | 5.055 | 1.00 | 33.79 | O |
| ATOM | 802 | CB | MET | A | 98 | 12.403 | 51.727 | 2.126 | 1.00 | 29.61 | C |
| ATOM | 803 | CG | MET | A | 98 | 13.817 | 51.347 | 1.614 | 1.00 | 37.15 | C |
| ATOM | 804 | SD | MET | A | 98 | 15.097 | 51.162 | 2.912 | 1.00 | 36.60 | S |
| ATOM | 805 | CE | MET | A | 98 | 15.251 | 52.863 | 3.496 | 1.00 | 38.70 | C |
| ATOM | 806 | N | TYR | A | 99 | 12.885 | 48.916 | 3.938 | 1.00 | 28.22 | N |
| ATOM | 807 | CA | TYR | A | 99 | 13.704 | 48.450 | 5.042 | 1.00 | 30.36 | C |
| ATOM | 808 | C | TYR | A | 99 | 14.932 | 47.753 | 4.492 | 1.00 | 34.09 | C |
| ATOM | 809 | O | TYR | A | 99 | 15.032 | 17.433 | 3.298 | 1.00 | 32.30 | O |
| ATOM | 810 | CB | TYR | A | 99 | 12.923 | 47.532 | 6.004 | 1.00 | 25.91 | C |
| ATOM | 811 | CG | TYR | A | 99 | 12.278 | 46.295 | 5.375 | 1.00 | 29.78 | C |
| ATOM | 812 | CD1 | TYR | A | 99 | 13.059 | 45.210 | 4.966 | 1.00 | 27.31 | C |
| ATOM | 813 | CD2 | TYR | A | 99 | 10.886 | 46.180 | 5.279 | 1.00 | 30.06 | C |
| ATOM | 814 | CE1 | TYR | A | 99 | 12.490 | 44.058 | 4.432 | 1.00 | 33.19 | C |
| ATOM | 815 | CE2 | TYR | A | 99 | 10.297 | 45.026 | 4.758 | 1.00 | 29.11 | C |
| ATOM | 816 | CZ | TYR | A | 99 | 11.109 | 43.970 | 4.330 | 1.00 | 32.24 | C |
| ATOM | 817 | OH | TYR | A | 99 | 10.566 | 42.817 | 3.810 | 1.00 | 31.31 | O |
| ATOM | 818 | N | GLY | A | 100 | 15.893 | 47.539 | 5.373 | 1.00 | 32.70 | N |
| ATOM | 819 | CA | GLY | A | 100 | 17.101 | 46.886 | 4.932 | 1.00 | 31.02 | C |
| ATOM | 820 | C | GLY | A | 100 | 18.142 | 46.936 | 6.019 | 1.00 | 37.71 | C |
| ATOM | 821 | O | GLY | A | 100 | 17.916 | 47.465 | 7.113 | 1.00 | 33.51 | O |
| ATOM | 822 | N | CYS | A | 101 | 19.289 | 46.360 | 5.686 | 1.00 | 33.07 | N |
| ATOM | 823 | CA | CYS | A | 101 | 20.397 | 46.206 | 6.610 | 1.00 | 36.42 | C |
| ATOM | 824 | C | CYS | A | 101 | 21.686 | 46.477 | 5.848 | 1.00 | 35.03 | C |
| ATOM | 825 | O | CYS | A | 101 | 21.784 | 46.181 | 4.654 | 1.00 | 33.88 | O |
| ATOM | 826 | CB | CYS | A | 101 | 20.431 | 44.788 | 7.244 | 1.00 | 31.89 | C |
| ATOM | 827 | SG | CYS | A | 101 | 20.392 | 43.338 | 6.080 | 1.00 | 38.85 | S |
| ATOM | 828 | N | ASP | A | 102 | 22.667 | 47.051 | 6.543 | 1.00 | 36.68 | N |
| ATOM | 829 | CA | ASP | A | 102 | 24.011 | 47.233 | 5.996 | 1.00 | 34.99 | C |
| ATOM | 830 | C | ASP | A | 102 | 25.012 | 46.356 | 6.737 | 1.00 | 36.96 | C |
| ATOM | 831 | O | ASP | A | 102 | 24.909 | 46.181 | 7.957 | 1.00 | 37.33 | O |
| ATOM | 832 | CB | ASP | A | 102 | 24.472 | 48.682 | 6.106 | 1.00 | 38.68 | C |
| ATOM | 833 | CG | ASP | A | 102 | 23.515 | 49.640 | 5.479 | 1.00 | 44.73 | C |
| ATOM | 834 | OD1 | ASP | A | 102 | 22.741 | 49.202 | 4.604 | 1.00 | 41.11 | O |
| ATOM | 835 | OD2 | ASP | A | 102 | 23.550 | 50.832 | 5.850 | 1.00 | 42.25 | O1− |
| ATOM | 836 | N | VAL | A | 103 | 25.994 | 45.823 | 6.003 | 1.00 | 34.06 | N |
| ATOM | 837 | CA | VAL | A | 103 | 27.101 | 45.098 | 6.618 | 1.00 | 34.11 | C |
| ATOM | 838 | C | VAL | A | 103 | 28.391 | 45.827 | 6.274 | 1.00 | 39.41 | C |
| ATOM | 839 | O | VAL | A | 103 | 28.475 | 46.541 | 5.271 | 1.00 | 37.71 | O |
| ATOM | 840 | CB | VAL | A | 103 | 27.208 | 43.610 | 6.201 | 1.00 | 34.91 | C |
| ATOM | 841 | CG1 | VAL | A | 103 | 25.959 | 42.820 | 6.617 | 1.00 | 38.07 | C |
| ATOM | 842 | CG2 | VAL | A | 103 | 27.491 | 43.462 | 4.709 | 1.00 | 35.98 | C |
| ATOM | 843 | N | GLY | A | 104 | 29.397 | 45.652 | 7.126 | 1.00 | 38.00 | N |
| ATOM | 844 | CA | GLY | A | 104 | 30.682 | 46.291 | 6.930 | 1.00 | 35.90 | C |
| ATOM | 845 | C | GLY | A | 104 | 31.515 | 45.556 | 5.904 | 1.00 | 39.62 | C |
| ATOM | 846 | O | GLY | A | 104 | 31.061 | 44.613 | 5.253 | 1.00 | 34.25 | O |
| ATOM | 847 | N | SER | A | 105 | 32.785 | 45.994 | 5.770 | 1.00 | 38.42 | N |
| ATOM | 848 | CA | SER | A | 105 | 33.712 | 45.328 | 4.857 | 1.00 | 41.42 | C |
| ATOM | 849 | C | SER | A | 105 | 34.088 | 43.938 | 5.339 | 1.00 | 35.62 | C |
| ATOM | 850 | O | SER | A | 105 | 34.581 | 43.127 | 4.545 | 1.00 | 38.95 | O |
| ATOM | 851 | CB | SER | A | 105 | 35.002 | 46.155 | 4.678 | 1.00 | 40.10 | C |
| ATOM | 852 | OG | SER | A | 105 | 34.688 | 47.515 | 4.501 | 1.00 | 49.56 | O |
| ATOM | 853 | N | ASP | A | 106 | 33.903 | 43.646 | 6.623 | 1.00 | 36.74 | N |
| ATOM | 854 | CA | ASP | A | 106 | 34.069 | 42.285 | 7.104 | 1.00 | 38.80 | C |
| ATOM | 855 | C | ASP | A | 106 | 32.737 | 41.555 | 7.154 | 1.00 | 40.86 | C |
| ATOM | 856 | O | ASP | A | 106 | 32.657 | 40.457 | 7.713 | 1.00 | 35.67 | O |
| ATOM | 857 | CB | ASP | A | 106 | 34.743 | 42.279 | 8.482 | 1.00 | 38.74 | C |
| ATOM | 858 | CG | ASP | A | 106 | 33.990 | 43.110 | 9.487 | 1.00 | 43.04 | C |

TABLE 77-continued

| | | | | | | | | | | | |
|---|---|---|---|---|---|---|---|---|---|---|---|
| ATOM | 859 | OD1 | ASP | A | 106 | 33.048 | 43.811 | 9.073 | 1.00 | 40.16 | O |
| ATOM | 860 | OD2 | ASP | A | 106 | 34.336 | 43.076 | 10.687 | 1.00 | 45.62 | O1− |
| ATOM | 861 | N | TRP | A | 107 | 31.695 | 42.159 | 6.588 | 1.00 | 34.91 | N |
| ATOM | 862 | CA | TRP | A | 107 | 30.339 | 41.631 | 6.527 | 1.00 | 36.81 | C |
| ATOM | 863 | C | TRP | A | 107 | 29.705 | 41.481 | 7.900 | 1.00 | 38.62 | C |
| ATOM | 864 | O | TRP | A | 107 | 28.742 | 40.726 | 8.056 | 1.00 | 41.40 | O |
| ATOM | 865 | CB | TRP | A | 107 | 30.271 | 40.304 | 5.760 | 1.00 | 34.58 | C |
| ATOM | 866 | CG | TRP | A | 107 | 30.743 | 40.403 | 4.313 | 1.00 | 32.17 | C |
| ATOM | 867 | CD1 | TRP | A | 107 | 31.218 | 41.521 | 3.654 | 1.00 | 33.38 | C |
| ATOM | 868 | CD2 | TRP | A | 107 | 30.814 | 39.329 | 3.371 | 1.00 | 31.75 | C |
| ATOM | 869 | NE1 | TRP | A | 107 | 31.544 | 41.194 | 2.345 | 1.00 | 31.63 | N |
| ATOM | 870 | CE2 | TRP | A | 107 | 31.307 | 39.855 | 2.159 | 1.00 | 29.66 | C |
| ATOM | 871 | CE3 | TRP | A | 107 | 30.497 | 37.970 | 3.435 | 1.00 | 40.83 | C |
| ATOM | 872 | CZ2 | TRP | A | 107 | 31.500 | 39.062 | 1.030 | 1.00 | 37.35 | C |
| ATOM | 873 | CZ3 | TRP | A | 107 | 30.686 | 37.185 | 2.306 | 1.00 | 40.29 | C |
| ATOM | 874 | CH2 | TRP | A | 107 | 31.176 | 37.735 | 1.123 | 1.00 | 33.93 | C |
| ATOM | 875 | N | ARG | A | 108 | 30.188 | 42.216 | 8.894 | 1.00 | 35.61 | N |
| ATOM | 876 | CA | ARG | A | 108 | 29.493 | 42.290 | 10.163 | 1.00 | 35.72 | C |
| ATOM | 877 | C | ARG | A | 108 | 28.323 | 43.260 | 10.044 | 1.00 | 34.25 | C |
| ATOM | 878 | O | ARG | A | 108 | 28.353 | 44.222 | 9.265 | 1.00 | 35.42 | O |
| ATOM | 879 | CB | ARG | A | 108 | 30.413 | 42.757 | 11.283 | 1.00 | 40.24 | C |
| ATOM | 880 | CG | ARG | A | 108 | 30.690 | 44.258 | 11.253 | 1.00 | 37.71 | C |
| ATOM | 881 | CD | ARG | A | 108 | 31.827 | 44.644 | 12.205 | 1.00 | 41.91 | C |
| ATOM | 882 | NE | ARG | A | 108 | 31.973 | 46.099 | 12.282 | 1.00 | 47.63 | N |
| ATOM | 883 | CZ | ARG | A | 108 | 32.566 | 46.861 | 11.359 | 1.00 | 45.21 | C |
| ATOM | 884 | NH1 | ARG | A | 108 | 32.632 | 48.171 | 11.530 | 1.00 | 48.11 | N1+ |
| ATOM | 885 | NH2 | ARG | A | 108 | 33.074 | 46.324 | 10.254 | 1.00 | 43.28 | N |
| ATOM | 886 | N | PHE | A | 109 | 27.297 | 42.992 | 10.832 | 1.00 | 32.99 | N |
| ATOM | 887 | CA | PHE | A | 109 | 26.136 | 43.871 | 10.881 | 1.00 | 36.36 | C |
| ATOM | 888 | C | PHE | A | 109 | 26.563 | 45.276 | 11.275 | 1.00 | 38.04 | C |
| ATOM | 889 | O | PHE | A | 109 | 27.242 | 45.465 | 12.285 | 1.00 | 39.32 | O |
| ATOM | 890 | CB | PHE | A | 109 | 25.130 | 43.319 | 11.887 | 1.00 | 36.16 | C |
| ATOM | 891 | CG | PHE | A | 109 | 23.960 | 44.212 | 12.122 | 1.00 | 38.97 | C |
| ATOM | 892 | CD1 | PHE | A | 109 | 22.903 | 44.238 | 11.221 | 1.00 | 37.05 | C |
| ATOM | 893 | CD2 | PHE | A | 109 | 23.908 | 45.019 | 13.243 | 1.00 | 39.10 | C |
| ATOM | 894 | CE1 | PHE | A | 109 | 21.815 | 45.056 | 11.440 | 1.00 | 37.79 | C |
| ATOM | 895 | CE2 | PHE | A | 109 | 22.821 | 45.838 | 13.464 | 1.00 | 47.75 | C |
| ATOM | 896 | CZ | PHE | A | 109 | 21.770 | 45.852 | 12.563 | 1.00 | 39.63 | C |
| ATOM | 897 | N | LEU | A | 110 | 26.171 | 46.263 | 10.479 | 1.00 | 38.66 | N |
| ATOM | 898 | CA | LEU | A | 110 | 26.397 | 47.668 | 10.811 | 1.00 | 36.44 | C |
| ATOM | 899 | C | LEU | A | 110 | 25.144 | 48.371 | 11.313 | 1.00 | 46.98 | C |
| ATOM | 900 | O | LEU | A | 110 | 25.168 | 49.052 | 12.341 | 1.00 | 45.52 | O |
| ATOM | 901 | CB | LEU | A | 110 | 26.911 | 48.419 | 9.588 | 1.00 | 41.56 | C |
| ATOM | 902 | CG | LEU | A | 110 | 28.317 | 48.139 | 9.102 | 1.00 | 44.50 | C |
| ATOM | 903 | CD1 | LEU | A | 110 | 28.650 | 49.214 | 8.079 | 1.00 | 42.64 | C |
| ATOM | 904 | CD2 | LEU | A | 110 | 29.305 | 48.156 | 10.276 | 1.00 | 44.19 | C |
| ATOM | 905 | N | ARG | A | 111 | 24.043 | 48.236 | 10.585 | 1.00 | 38.84 | N |
| ATOM | 906 | CA | ARG | A | 111 | 22.858 | 49.009 | 10.893 | 1.00 | 43.21 | C |
| ATOM | 907 | C | ARG | A | 111 | 21.692 | 48.418 | 10.126 | 1.00 | 40.76 | C |
| ATOM | 908 | O | ARG | A | 111 | 21.869 | 47.696 | 9.136 | 1.00 | 37.35 | O |
| ATOM | 909 | CB | ARG | A | 111 | 23.033 | 50.486 | 10.538 | 1.00 | 44.69 | C |
| ATOM | 910 | CG | ARG | A | 111 | 23.185 | 50.767 | 9.057 | 1.00 | 47.62 | C |
| ATOM | 911 | CD | ARG | A | 111 | 23.414 | 52.255 | 8.840 | 1.00 | 51.71 | C |
| ATOM | 912 | NE | ARG | A | 111 | 24.571 | 52.507 | 7.976 | 1.00 | 68.84 | N |
| ATOM | 913 | CZ | ARG | A | 111 | 25.818 | 52.690 | 8.406 | 1.00 | 66.22 | C |
| ATOM | 914 | NH1 | ARG | A | 111 | 26.090 | 52.657 | 9.705 | 1.00 | 68.46 | N1+ |
| ATOM | 915 | NH2 | ARG | A | 111 | 26.794 | 52.925 | 7.535 | 1.00 | 70.91 | N |
| ATOM | 916 | N | GLY | A | 112 | 20.499 | 48.715 | 10.628 | 1.00 | 39.09 | N |
| ATOM | 917 | CA | GLY | A | 112 | 19.274 | 48.382 | 9.941 | 1.00 | 37.62 | C |
| ATOM | 918 | C | GLY | A | 112 | 18.359 | 49.579 | 9.975 | 1.00 | 41.66 | C |
| ATOM | 919 | O | GLY | A | 112 | 18.545 | 50.515 | 10.754 | 1.00 | 39.68 | O |
| ATOM | 920 | N | TYR | A | 113 | 17.362 | 49.559 | 9.098 | 1.00 | 35.30 | N |
| ATOM | 921 | CA | TYR | A | 113 | 16.455 | 50.682 | 9.006 | 1.00 | 33.72 | C |
| ATOM | 922 | C | TYR | A | 113 | 15.122 | 50.181 | 8.478 | 1.00 | 35.52 | C |
| ATOM | 923 | O | TYR | A | 113 | 15.041 | 49.142 | 7.810 | 1.00 | 34.90 | O |
| ATOM | 924 | CB | TYR | A | 113 | 17.031 | 51.781 | 8.117 | 1.00 | 31.60 | C |
| ATOM | 925 | CG | TYR | A | 113 | 17.921 | 51.216 | 7.024 | 1.00 | 38.43 | C |
| ATOM | 926 | CD1 | TYR | A | 113 | 17.388 | 50.817 | 5.809 | 1.00 | 36.28 | C |
| ATOM | 927 | CD2 | TYR | A | 113 | 19.290 | 51.079 | 7.214 | 1.00 | 41.87 | C |
| ATOM | 928 | CE1 | TYR | A | 113 | 18.188 | 50.306 | 4.815 | 1.00 | 36.99 | C |
| ATOM | 929 | CE2 | TYR | A | 113 | 20.111 | 50.551 | 6.214 | 1.00 | 40.94 | C |
| ATOM | 930 | CZ | TYR | A | 113 | 19.548 | 50.166 | 5.019 | 1.00 | 39.21 | C |
| ATOM | 931 | OH | TYR | A | 113 | 20.334 | 49.648 | 4.010 | 1.00 | 37.27 | O |
| ATOM | 932 | N | HIS | A | 114 | 14.077 | 50.917 | 8.817 | 1.00 | 35.20 | N |
| ATOM | 933 | CA | HIS | A | 114 | 12.719 | 50.588 | 8.391 | 1.00 | 30.57 | C |
| ATOM | 934 | C | HIS | A | 114 | 11.952 | 51.903 | 8.378 | 1.00 | 38.38 | C |
| ATOM | 935 | O | HIS | A | 114 | 11.746 | 52.506 | 9.438 | 1.00 | 36.49 | O |
| ATOM | 936 | CB | HIS | A | 114 | 12.075 | 49.578 | 9.331 | 1.00 | 32.40 | C |
| ATOM | 937 | CG | HIS | A | 114 | 10.664 | 49.250 | 8.977 | 1.00 | 38.66 | C |
| ATOM | 938 | ND1 | HIS | A | 114 | 9.625 | 50.115 | 9.219 | 1.00 | 42.43 | N |

TABLE 77-continued

| | | | | | | | | | | |
|---|---|---|---|---|---|---|---|---|---|---|
| ATOM | 939 | CD2 | HIS | A | 114 | 10.118 | 48.161 | 8.386 | 1.00 | 41.71 | C |
| ATOM | 940 | CE1 | HIS | A | 114 | 8.494 | 49.573 | 8.798 | 1.00 | 41.33 | C |
| ATOM | 941 | NE2 | HIS | A | 114 | 8.767 | 48.388 | 8.289 | 1.00 | 44.31 | N |
| ATOM | 942 | N | GLN | A | 115 | 11.575 | 52.354 | 7.183 | 1.00 | 35.47 | N |
| ATOM | 943 | CA | GLN | A | 115 | 10.899 | 53.625 | 6.960 | 1.00 | 38.11 | C |
| ATOM | 944 | C | GLN | A | 115 | 9.550 | 53.377 | 6.292 | 1.00 | 36.88 | C |
| ATOM | 945 | O | GLN | A | 115 | 9.420 | 52.481 | 5.449 | 1.00 | 31.88 | O |
| ATOM | 946 | CB | GLN | A | 115 | 11.745 | 54.543 | 5.066 | 1.00 | 35.66 | C |
| ATOM | 947 | CG | GLN | A | 115 | 13.182 | 54.727 | 6.517 | 1.00 | 40.23 | C |
| ATOM | 948 | CD | GLN | A | 115 | 13.324 | 55.798 | 7.564 | 1.00 | 44.58 | C |
| ATOM | 949 | OE1 | GLN | A | 115 | 12.78: | 56.893 | 7.421 | 1.00 | 56.25 | O |
| ATOM | 950 | NE2 | GLN | A | 115 | 14.049 | 55.491 | 8.632 | 1.00 | 52.66 | N |
| ATOM | 951 | N | TYR | A | 116 | 8.559 | 54.193 | 6.645 | 1.00 | 35.75 | N |
| ATOM | 952 | CA | TYR | A | 116 | 7.199 | 53.994 | 6.164 | 1.00 | 32.50 | C |
| ATOM | 953 | C | TYR | A | 116 | 6.559 | 55.340 | 5.868 | 1.00 | 35.90 | C |
| ATOM | 954 | O | TYR | A | 116 | 6.585 | 56.240 | 6.711 | 1.00 | 36.48 | O |
| ATOM | 955 | CB | TYR | A | 116 | 6.399 | 53.233 | 7.212 | 1.00 | 33.99 | C |
| ATOM | 956 | CG | TYR | A | 116 | 5.045 | 52.737 | 6.774 | 1.00 | 37.70 | C |
| ATOM | 957 | CD1 | TYR | A | 116 | 3.949 | 53.603 | 6.680 | 1.00 | 41.64 | C |
| ATOM | 958 | CD2 | TYR | A | 116 | 4.842 | 51.389 | 6.523 | 1.00 | 39.92 | C |
| ATOM | 959 | CE1 | TYR | A | 116 | 2.691 | 53.137 | 6.305 | 1.00 | 39.16 | C |
| ATOM | 960 | CE2 | TYR | A | 116 | 3.599 | 50.912 | 6.160 | 1.00 | 40.78 | C |
| ATOM | 961 | CZ | TYR | A | 116 | 2.527 | 51.796 | 6.056 | 1.00 | 43.11 | C |
| ATOM | 962 | OH | TYR | A | 116 | 1.299 | 51.322 | 5.689 | 1.00 | 40.33 | O |
| ATOM | 963 | N | ALA | A | 117 | 5.969 | 55.473 | 4.686 | 1.00 | 36.88 | N |
| ATOM | 964 | CA | ALA | A | 117 | 5.312 | 56.707 | 4.289 | 1.00 | 36.72 | C |
| ATOM | 965 | C | ALA | A | 117 | 3.880 | 56.446 | 3.826 | 1.00 | 36.16 | C |
| ATOM | 966 | O | ALA | A | 117 | 3.566 | 55.399 | 3.247 | 1.00 | 32.34 | O |
| ATOM | 967 | CB | ALA | A | 117 | 6.092 | 57.404 | 3.172 | 1.00 | 31.99 | C |
| ATOM | 968 | N | TYR | A | 118 | 3.019 | 57.440 | 4.045 | 1.00 | 36.48 | N |
| ATOM | 969 | CA | TYR | A | 118 | 1.646 | 57.428 | 3.549 | 1.00 | 33.36 | C |
| ATOM | 970 | C | TYR | A | 118 | 1.440 | 58.632 | 2.649 | 1.00 | 31.64 | C |
| ATOM | 971 | O | TYR | A | 118 | 1.751 | 59.756 | 3.043 | 1.00 | 33.54 | O |
| ATOM | 972 | CB | TYR | A | 118 | 0.644 | 57.462 | 4.692 | 1.00 | 36.13 | C |
| ATOM | 973 | CG | TYR | A | 118 | −0.811 | 57.456 | 4.247 | 1.00 | 34.95 | C |
| ATOM | 974 | CD1 | TYR | A | 118 | −1.276 | 56.481 | 3.358 | 1.00 | 30.26 | C |
| ATOM | 975 | CD2 | TYR | A | 118 | −1.716 | 58.390 | 4.738 | 1.00 | 35.20 | C |
| ATOM | 976 | CE1 | TYR | A | 118 | −2.584 | 56.449 | 2.944 | 1.00 | 31.21 | C |
| ATOM | 977 | CE2 | TYR | A | 118 | −3.061 | 58.357 | 4.344 | 1.00 | 33.49 | C |
| ATOM | 978 | CZ | TYR | A | 118 | −3.481 | 57.385 | 3.451 | 1.00 | 33.67 | C |
| ATOM | 979 | OH | TYR | A | 118 | −4.789 | 57.300 | 3.038 | 1.00 | 35.25 | O |
| ATOM | 980 | N | ASP | A | 119 | 0.945 | 58.393 | 1.435 | 1.00 | 33.43 | N |
| ATOM | 981 | CA | ASP | A | 119 | 0.714 | 59.460 | 0.460 | 1.00 | 34.20 | C |
| ATOM | 982 | C | ASP | A | 119 | 1.953 | 60.334 | 0.268 | 1.00 | 38.19 | C |
| ATOM | 983 | O | ASP | A | 119 | 1.875 | 61.566 | 0.166 | 1.00 | 37.69 | O |
| ATOM | 984 | CB | ASP | A | 119 | −0.507 | 60.300 | 0.856 | 1.00 | 36.75 | C |
| ATOM | 985 | CG | ASP | A | 119 | −1.807 | 59.585 | 0.531 | 1.00 | 36.97 | C |
| ATOM | 986 | OD1 | ASP | A | 119 | −1.774 | 58.710 | −0.370 | 1.00 | 35.16 | O |
| ATOM | 987 | OD2 | ASP | A | 119 | −2.838 | 59.878 | 1.175 | 1.00 | 39.71 | O1− |
| ATOM | 988 | N | GLY | A | 120 | 3.111 | 59.687 | 0.223 | 1.00 | 38.07 | N |
| ATOM | 989 | CA | GLY | A | 120 | 4.359 | 60.350 | −0.105 | 1.00 | 33.50 | C |
| ATOM | 990 | C | GLY | A | 120 | 4.981 | 61.138 | 1.016 | 1.00 | 40.31 | C |
| ATOM | 991 | O | GLY | A | 120 | 5.923 | 61.890 | 0.762 | 1.00 | 36.24 | O |
| ATOM | 992 | N | LYS | A | 121 | 4.509 | 60.984 | 2.251 | 1.00 | 35.12 | N |
| ATOM | 993 | CA | LYS | A | 121 | 5.034 | 61.740 | 3.380 | 1.00 | 35.63 | C |
| ATOM | 994 | C | LYS | A | 121 | 5.466 | 60.775 | 4.470 | 1.00 | 38.50 | C |
| ATOM | 995 | O | LYS | A | 121 | 4.797 | 59.760 | 4.698 | 1.00 | 36.29 | O |
| ATOM | 996 | CB | LYS | A | 121 | 3.978 | 62.717 | 3.940 | 1.00 | 40.34 | C |
| ATOM | 997 | CG | LYS | A | 121 | 3.553 | 63.821 | 2.966 | 1.00 | 45.76 | C |
| ATOM | 998 | CD | LYS | A | 121 | 2.290 | 64.550 | 3.451 | 1.00 | 57.67 | C |
| ATOM | 999 | CE | LYS | A | 121 | 2.510 | 65.192 | 4.823 | 1.00 | 65.88 | C |
| ATOM | 1000 | NZ | LYS | A | 121 | 1.412 | 66.134 | 5.221 | 1.00 | 69.30 | N1+ |
| ATOM | 1001 | N | ASP | A | 122 | 6.588 | 61.095 | 5.133 | 1.00 | 35.26 | N |
| ATOM | 1002 | CA | ASP | A | 122 | 7.022 | 60.364 | 6.311 | 1.00 | 34.40 | C |
| ATOM | 1003 | C | ASP | A | 122 | 5.833 | 60.075 | 7.206 | 1.00 | 39.20 | C |
| ATOM | 1004 | O | ASP | A | 122 | 5.078 | 60.976 | 7.553 | 1.00 | 39.99 | O |
| ATOM | 1005 | CB | ASP | A | 122 | 8.056 | 61.159 | 7.100 | 1.00 | 40.04 | C |
| ATOM | 1006 | CG | ASP | A | 122 | 9.329 | 61.394 | 6.325 | 1.00 | 42.48 | C |
| ATOM | 1007 | OD1 | ASP | A | 122 | 9.659 | 60.579 | 5.449 | 1.00 | 45.97 | O |
| ATOM | 1008 | OD2 | ASP | A | 122 | 10.008 | 62.391 | 6.619 | 1.00 | 56.92 | O1− |
| ATOM | 1009 | N | TYR | A | 123 | 5.659 | 58.804 | 7.563 | 1.00 | 35.53 | N |
| ATOM | 1010 | CA | TYR | A | 123 | 4.627 | 58.409 | 8.499 | 1.00 | 39.41 | C |
| ATOM | 1011 | C | TYR | A | 123 | 5.283 | 57.897 | 9.801 | 1.00 | 40.51 | C |
| ATOM | 1012 | O | TYR | A | 123 | 5.124 | 58.522 | 10.842 | 1.00 | 43.16 | O |
| ATOM | 1013 | CB | TYR | A | 123 | 3.707 | 57.350 | 7.888 | 1.00 | 37.38 | C |
| ATOM | 1014 | CG | TYR | A | 123 | 2.574 | 56.940 | 8.798 | 1.00 | 38.24 | C |
| ATOM | 1015 | CD1 | TYR | A | 123 | 1.486 | 57.785 | 9.020 | 1.00 | 40.08 | C |
| ATOM | 1016 | CD2 | TYR | A | 123 | 2.585 | 55.704 | 9.436 | 1.00 | 40.52 | C |
| ATOM | 1017 | CE1 | TYR | A | 123 | 0.444 | 57.412 | 9.865 | 1.00 | 37.36 | C |
| ATOM | 1018 | CE2 | TYR | A | 123 | 1.534 | 55.314 | 10.266 | 1.00 | 40.79 | C |

TABLE 77-continued

| ATOM | 1019 | CZ | TYR | A | 123 | 0.472 | 56.173 | 10.477 | 1.00 | 37.21 | C |
| --- | --- | --- | --- | --- | --- | --- | --- | --- | --- | --- | --- |
| ATOM | 1020 | OH | TYR | A | 123 | −0.548 | 55.789 | 11.318 | 1.00 | 37.48 | O |
| ATOM | 1021 | N | ILE | A | 124 | 6.003 | 56.791 | 9.739 | 1.00 | 35.61 | N |
| ATOM | 1022 | CA | ILE | A | 124 | 6.667 | 56.272 | 10.928 | 1.00 | 39.41 | C |
| ATOM | 1023 | C | ILE | A | 124 | 7.993 | 55.654 | 10.500 | 1.00 | 39.18 | C |
| ATOM | 1024 | O | ILE | A | 124 | 8.133 | 55.143 | 9.385 | 1.00 | 37.58 | O |
| ATOM | 1025 | CB | ILE | A | 124 | 5.750 | 55.272 | 11.681 | 1.00 | 36.93 | C |
| ATOM | 1026 | CG1 | ILE | A | 124 | 6.213 | 55.098 | 13.136 | 1.00 | 36.75 | C |
| ATOM | 1027 | CG2 | ILE | A | 124 | 5.676 | 53.920 | 10.955 | 1.00 | 33.57 | C |
| ATOM | 1028 | CD1 | ILE | A | 124 | 5.304 | 54.168 | 13.949 | 1.00 | 41.02 | C |
| ATOM | 1029 | N | ALA | A | 125 | 8.996 | 55.750 | 11.371 | 1.00 | 41.69 | N |
| ATOM | 1030 | CA | ALA | A | 125 | 10.300 | 55.171 | 11.074 | 1.00 | 38.34 | C |
| ATOM | 1031 | C | ALA | A | 125 | 10.869 | 54.523 | 12.326 | 1.00 | 41.62 | C |
| ATOM | 1032 | O | ALA | A | 125 | 10.587 | 54.938 | 13.454 | 1.00 | 40.11 | O |
| ATOM | 1033 | CB | ALA | A | 125 | 11.280 | 56.211 | 10.528 | 1.00 | 37.53 | C |
| ATOM | 1034 | N | LEU | A | 126 | 11.628 | 53.461 | 12.112 | 1.00 | 39.82 | N |
| ATOM | 1035 | CA | LEU | A | 126 | 12.357 | 52.823 | 13.188 | 1.00 | 40.84 | C |
| ATOM | 1036 | C | LEU | A | 126 | 13.582 | 53.669 | 13.500 | 1.00 | 42.63 | C |
| ATOM | 1037 | O | LEU | A | 126 | 14.253 | 54.172 | 12.586 | 1.00 | 39.33 | O |
| ATOM | 1038 | CB | LEU | A | 126 | 12.764 | 51.408 | 12.775 | 1.00 | 41.49 | C |
| ATOM | 1039 | CG | LEU | A | 126 | 13.332 | 50.460 | 13.827 | 1.00 | 43.71 | C |
| ATOM | 1040 | CD1 | LEU | A | 126 | 12.333 | 50.282 | 14.958 | 1.00 | 39.80 | C |
| ATOM | 1041 | CD2 | LEU | A | 126 | 13.648 | 49.111 | 13.162 | 1.00 | 39.55 | C |
| ATOM | 1042 | N | LYS | A | 127 | 13.845 | 53.879 | 14.789 | 1.00 | 44.42 | N |
| ATOM | 1043 | CA | LYS | A | 127 | 15.013 | 54.677 | 15.139 | 1.00 | 43.94 | C |
| ATOM | 1044 | C | LYS | A | 127 | 16.280 | 53.859 | 14.921 | 1.00 | 48.03 | C |
| ATOM | 1045 | O | LYS | A | 127 | 16.233 | 52.644 | 14.736 | 1.00 | 45.96 | O |
| ATOM | 1046 | CB | LYS | A | 127 | 14.928 | 55.162 | 16.581 | 1.00 | 50.87 | C |
| ATOM | 1047 | CG | LYS | A | 127 | 14.061 | 56.405 | 16.764 | 1.00 | 56.39 | C |
| ATOM | 1048 | CD | LYS | A | 127 | 14.051 | 56.842 | 18.215 | 1.00 | 65.96 | C |
| ATOM | 1049 | CE | LYS | A | 127 | 13.632 | 58.288 | 18.379 | 1.00 | 65.92 | C |
| ATOM | 1050 | NZ | LYS | A | 127 | 13.242 | 58.567 | 19.794 | 1.00 | 64.96 | N1+ |
| ATOM | 1051 | N | GLU | A | 128 | 17.430 | 54.539 | 14.958 | 1.00 | 53.50 | N |
| ATOM | 1052 | CA | GLU | A | 128 | 18.690 | 53.867 | 14.658 | 1.00 | 47.87 | C |
| ATOM | 1053 | C | GLU | A | 128 | 19.030 | 52.804 | 15.696 | 1.00 | 50.26 | C |
| ATOM | 1054 | O | GLU | A | 128 | 19.714 | 51.831 | 15.369 | 1.00 | 53.99 | O |
| ATOM | 1055 | CB | GLU | A | 128 | 19.821 | 54.892 | 14.540 | 1.00 | 51.84 | C |
| ATOM | 1056 | CG | GLU | A | 128 | 20.147 | 55.621 | 15.844 | 1.00 | 62.56 | C |
| ATOM | 1057 | CD | GLU | A | 128 | 21.391 | 55.089 | 16.538 | 0.00 | 62.72 | C |
| ATOM | 1058 | OE1 | GLU | A | 128 | 21.966 | 54.082 | 16.072 | 1.00 | 69.39 | O |
| ATOM | 1059 | OE2 | GLU | A | 128 | 21.796 | 55.688 | 17.556 | 1.00 | 72.28 | O1− |
| ATOM | 1060 | N | ASP | A | 129 | 18.536 | 52.944 | 16.932 | 1.00 | 50.64 | N |
| ATOM | 1061 | CA | ASP | A | 129 | 18.704 | 51.901 | 17.916 | 1.00 | 51.46 | C |
| ATOM | 1062 | C | ASP | A | 129 | 17.848 | 50.669 | 17.684 | 1.00 | 51.74 | C |
| ATOM | 1063 | O | ASP | A | 129 | 18.011 | 49.667 | 18.390 | 1.00 | 49.06 | O |
| ATOM | 1064 | CB | ASP | A | 129 | 18.369 | 52.449 | 19.341 | 1.00 | 55.17 | C |
| ATOM | 1065 | CG | ASP | A | 129 | 16.965 | 53.067 | 19.422 | 1.00 | 56.65 | C |
| ATOM | 1066 | OD1 | ASP | A | 129 | 15.974 | 52.403 | 19.047 | 1.00 | 55.03 | O |
| ATOM | 1067 | OD2 | ASP | A | 129 | 16.850 | 54.226 | 19.876 | 1.00 | 72.68 | O1− |
| ATOM | 1068 | N | LEU | A | 130 | 16.917 | 50.730 | 16.727 | 1.00 | 47.87 | N |
| ATOM | 1069 | CA | LEU | A | 130 | 16.054 | 49.603 | 16.373 | 1.00 | 44.74 | C |
| ATOM | 1070 | C | LEU | A | 130 | 15.218 | 49.109 | 17.545 | 1.00 | 47.89 | C |
| ATOM | 1071 | O | LEU | A | 130 | 14.808 | 47.941 | 17.571 | 1.00 | 47.57 | O |
| ATOM | 1072 | CB | LEU | A | 130 | 16.859 | 48.432 | 15.795 | 1.00 | 42.40 | C |
| ATOM | 1073 | CG | LEU | A | 130 | 17.923 | 48.760 | 14.747 | 1.00 | 40.30 | C |
| ATOM | 1074 | CD1 | LEU | A | 130 | 18.533 | 47.466 | 14.194 | 1.00 | 41.78 | C |
| ATOM | 1075 | CD2 | LEU | A | 130 | 17.330 | 49.589 | 13.639 | 1.00 | 38.51 | C |
| ATOM | 1076 | N | ARG | A | 131 | 14.945 | 49.957 | 18.537 | 1.00 | 46.71 | N |
| ATOM | 1077 | CA | ARG | A | 131 | 14.033 | 49.565 | 19.598 | 1.00 | 51.26 | C |
| ATOM | 1078 | C | ARG | A | 131 | 12.917 | 50.575 | 19.828 | 1.00 | 49.05 | C |
| ATOM | 1079 | O | ARG | A | 131 | 12.040 | 50.316 | 20.651 | 1.00 | 49.30 | O |
| ATOM | 1080 | CB | ARG | A | 131 | 14.784 | 49.320 | 20.917 | 1.00 | 49.11 | C |
| ATOM | 1081 | CG | ARG | A | 131 | 16.258 | 49.697 | 20.902 | 1.00 | 61.78 | C |
| ATOM | 1082 | CD | ARG | A | 131 | 16.948 | 49.399 | 22.240 | 1.00 | 60.91 | C |
| ATOM | 1083 | NE | ARG | A | 131 | 16.878 | 47.983 | 22.589 | 1.00 | 68.91 | N |
| ATOM | 1084 | CZ | ARG | A | 131 | 17.667 | 47.043 | 22.069 | 1.00 | 67.08 | C |
| ATOM | 1085 | NH1 | ARG | A | 131 | 18.587 | 47.371 | 21.169 | 1.00 | 67.11 | N1+ |
| ATOM | 1086 | NH2 | ARG | A | 131 | 17.531 | 45.774 | 22.441 | 1.00 | 59.64 | N |
| ATOM | 1087 | N | SER | A | 132 | 12.912 | 51.699 | 19.124 | 1.00 | 45.54 | N |
| ATOM | 1088 | CA | SER | A | 132 | 11.893 | 52.719 | 19.326 | 1.00 | 51.95 | C |
| ATOM | 1089 | C | SER | A | 132 | 11.493 | 53.308 | 17.982 | 1.00 | 50.25. | C |
| ATOM | 1090 | O | SER | A | 132 | 12.182 | 53.133 | 16.968 | 1.00 | 46.82 | O |
| ATOM | 1091 | CB | SER | A | 132 | 12.391 | 53.816 | 20.266 | 1.00 | 52.14 | C |
| ATOM | 1092 | OG | SER | A | 132 | 13.708 | 54.208 | 19.912 | 1.00 | 60.66 | O |
| ATOM | 1093 | N | TRP | A | 133 | 10.375 | 54.035 | 17.991 | 1.00 | 46.50 | N |
| ATOM | 1094 | CA | TRP | A | 133 | 9.791 | 54.592 | 16.784 | 1.00 | 45.99 | C |
| ATOM | 1095 | C | TRP | A | 133 | 9.795 | 56.117 | 16.809 | 1.00 | 49.08 | C |
| ATOM | 1096 | O | TRP | A | 133 | 9.776 | 56.745 | 17.873 | 1.00 | 48.10 | O |
| ATOM | 1097 | CB | TRP | A | 133 | 8.365 | 54.074 | 16.612 | 1.00 | 44.72 | C |
| ATOM | 1098 | CG | TRP | A | 133 | 8.305 | 52.589 | 16.591 | 1.00 | 44.18 | C |

TABLE 77-continued

| ATOM | 1099 | CD1 | TRP | A | 133 | 8.044 | 51.753 | 17.646 | 1.00 | 44.19 | C |
|---|---|---|---|---|---|---|---|---|---|---|---|
| ATOM | 1100 | CD2 | TRP | A | 133 | 8.507 | 51.753 | 15.453 | 1.00 | 41.27 | C |
| ATOM | 1101 | NE1 | TRP | A | 133 | 8.065 | 50.443 | 17.224 | 1.00 | 44.07 | N |
| ATOM | 1102 | CE2 | TRP | A | 133 | 8.344 | 50.419 | 15.879 | 1.00 | 42.80 | C |
| ATOM | 1103 | CE3 | TRP | A | 133 | 8.787 | 52.004 | 14.100 | 1.00 | 38.32 | C |
| ATOM | 1104 | CZ2 | TRP | A | 133 | 8.472 | 49.340 | 15.007 | 1.00 | 43.30 | C |
| ATOM | 1105 | CZ3 | TRP | A | 133 | 8.909 | 50.934 | 13.244 | 1.00 | 36.61 | C |
| ATOM | 1106 | CH2 | TRP | A | 133 | 8.754 | 49.620 | 13.698 | 1.00 | 40.65 | C |
| ATOM | 1107 | N | THR | A | 134 | 9.823 | 56.702 | 15.616 | 1.00 | 48.19 | N |
| ATOM | 1108 | CA | THR | A | 134 | 9.619 | 58.129 | 15.398 | 1.00 | 46.43 | C |
| ATOM | 1109 | C | THR | A | 134 | 8.338 | 58.296 | 14.591 | 1.00 | 46.73 | C |
| ATOM | 1110 | O | THR | A | 134 | 8.267 | 57.840 | 13.445 | 1.00 | 40.75 | O |
| ATOM | 1111 | CB | THR | A | 134 | 10.798 | 58.752 | 14.650 | 1.00 | 45.96 | C |
| ATOM | 1112 | OG1 | THR | A | 134 | 11.971 | 58.657 | 15.462 | 1.00 | 62.26 | O |
| ATOM | 1113 | CG2 | THR | A | 134 | 10.513 | 60.224 | 14.348 | 1.00 | 45.82 | C |
| ATOM | 1114 | N | ALA | A | 135 | 7.338 | 58.956 | 15.181 | 1.00 | 47.26 | N |
| ATOM | 1115 | CA | ALA | A | 135 | 6.030 | 59.134 | 14.561 | 1.00 | 45.84 | C |
| ATOM | 1116 | C | ALA | A | 135 | 5.893 | 60.547 | 14.008 | 1.00 | 47.88 | C |
| ATOM | 1117 | O | ALA | A | 135 | 6.284 | 61.517 | 14.663 | 1.00 | 50.19 | O |
| ATOM | 1118 | CB | ALA | A | 135 | 4.915 | 58.859 | 15.572 | 1.00 | 45.63 | C |
| ATOM | 1119 | N | ALA | A | 136 | 5.333 | 60.667 | 12.798 | 1.00 | 46.27 | N |
| ATOM | 1120 | CA | ALA | A | 136 | 5.292 | 61.976 | 12.148 | 1.00 | 47.49 | C |
| ATOM | 1121 | C | ALA | A | 136 | 4.106 | 62.836 | 12.578 | 1.00 | 45.54 | C |
| ATOM | 1122 | O | ALA | A | 136 | 4.163 | 64.057 | 12.408 | 1.00 | 50.61 | O |
| ATOM | 1123 | CB | ALA | A | 136 | 5.283 | 61.822 | 10.627 | 1.00 | 45.33 | C |
| ATOM | 1124 | N | ASP | A | 137 | 3.042 | 62.244 | 13.115 | 1.00 | 47.82 | N |
| ATOM | 1125 | CA | ASP | A | 137 | 1.848 | 62.989 | 13.510 | 1.00 | 47.84 | C |
| ATOM | 1126 | C | ASP | A | 137 | 1.055 | 62.142 | 14.495 | 1.00 | 45.36 | O |
| ATOM | 1127 | O | ASP | A | 137 | 1.534 | 61.111 | 14.974 | 1.00 | 47.94 | O |
| ATOM | 1128 | CB | ASP | A | 137 | 1.006 | 63.396 | 12.291 | 1.00 | 48.72 | C |
| ATOM | 1129 | CG | ASP | A | 137 | 0.443 | 62.202 | 11.507 | 1.00 | 46.40 | C |
| ATOM | 1130 | OD1 | ASP | A | 137 | 0.376 | 61.072 | 12.029 | 1.00 | 42.70 | O |
| ATOM | 1131 | OD2 | ASP | A | 137 | 0.065 | 62.406 | 10.335 | 1.00 | 46.34 | O1− |
| ATOM | 1132 | N | MET | A | 138 | −0.176 | 62.572 | 14.790 | 1.00 | 44.68 | N |
| ATOM | 1133 | CA | MET | A | 138 | −0.977 | 61.870 | 15.788 | 1.00 | 45.61 | C |
| ATOM | 1134 | C | MET | A | 138 | −1.511 | 60.535 | 15.272 | 1.00 | 42.37 | C |
| ATOM | 1135 | O | MET | A | 138 | −1.714 | 59.614 | 16.065 | 1.00 | 48.43 | O |
| ATOM | 1136 | CB | MET | A | 138 | −2.123 | 62.765 | 16.259 | 1.00 | 47.93 | C |
| ATOM | 1137 | CG | MET | A | 138 | −1.672 | 63.986 | 17.087 | 1.00 | 51.35 | C |
| ATOM | 1138 | SD | MET | A | 138 | −3.058 | 64.997 | 17.700 | 1.00 | 90.10 | S |
| ATOM | 1139 | CE | MET | A | 138 | −2.228 | 66.189 | 18.756 | 1.00 | 76.32 | C |
| ATOM | 1140 | N | ALA | A | 139 | −1.762 | 60.403 | 13.966 | 1.00 | 40.62 | N |
| ATOM | 1141 | CA | ALA | A | 139 | −2.068 | 59.084 | 13.408 | 1.00 | 41.50 | C |
| ATOM | 1142 | C | ALA | A | 139 | −0.894 | 58.127 | 13.598 | 1.00 | 39.60 | C |
| ATOM | 1143 | O | ALA | A | 139 | −1.059 | 56.996 | 14.072 | 1.00 | 44.09 | O |
| ATOM | 1144 | CB | ALA | A | 139 | −2.424 | 59.197 | 11.927 | 1.00 | 36.56 | C |
| ATOM | 1145 | N | ALA | A | 140 | 0.305 | 58.568 | 13.241 | 1.00 | 40.28 | N |
| ATOM | 1146 | CA | ALA | A | 140 | 1.459 | 57.693 | 13.393 | 1.00 | 39.09 | C |
| ATOM | 1147 | C | ALA | A | 140 | 1.753 | 57.422 | 14.862 | 1.00 | 42.08 | C |
| ATOM | 1148 | O | ALA | A | 140 | 2.304 | 56.371 | 15.198 | 1.00 | 39.31 | O |
| ATOM | 1149 | CB | ALA | A | 140 | 2.659 | 58.301 | 12.689 | 1.00 | 40.05 | C |
| ATOM | 1150 | N | GLN | A | 141 | 1.383 | 58.348 | 15.755 | 1.00 | 43.05 | N |
| ATOM | 1151 | CA | GLN | A | 141 | 1.549 | 58.081 | 17.184 | 1.00 | 47.57 | C |
| ATOM | 1152 | C | GLN | A | 141 | 0.641 | 56.955 | 17.645 | 1.00 | 43.76 | C |
| ATOM | 1153 | O | GLN | A | 141 | 1.017 | 56.182 | 18.535 | 1.00 | 42.67 | O |
| ATOM | 1154 | CB | GLN | A | 141 | 1.285 | 59.350 | 18.010 | 1.00 | 47.02 | C |
| ATOM | 1155 | CG | GLN | A | 141 | 2.500 | 60.239 | 18.184 | 1.00 | 57.06 | C |
| ATOM | 1156 | CD | GLN | A | 141 | 3.503 | 59.695 | 19.206 | 1.00 | 57.62 | C |
| ATOM | 1157 | OE1 | GLN | A | 141 | 3.156 | 58.894 | 20.080 | 1.00 | 65.29 | O |
| ATOM | 1158 | NE2 | GLN | A | 141 | 4.751 | 60.135 | 19.095 | 1.00 | 65.04 | N |
| ATOM | 1159 | N | THR | A | 142 | −0.563 | 56.862 | 17.068 | 1.00 | 37.87 | N |
| ATOM | 1160 | CA | THR | A | 142 | −1.427 | 55.717 | 17.329 | 1.00 | 44.30 | C |
| ATOM | 1161 | C | THR | A | 142 | −0.793 | 54.414 | 16.859 | 1.00 | 44.04 | C |
| ATOM | 1162 | O | THR | A | 142 | −0.874 | 53.395 | 17.552 | 1.00 | 44.65 | O |
| ATOM | 1163 | CB | THR | A | 142 | −2.777 | 55.911 | 16.647 | 1.00 | 43.30 | C |
| ATOM | 1164 | OG1 | THR | A | 142 | −3.348 | 57.145 | 17.094 | 1.00 | 47.18 | O |
| ATOM | 1165 | CG2 | THR | A | 142 | −3.700 | 54.770 | 17.010 | 1.00 | 37.38 | C |
| ATOM | 1166 | N | THR | A | 143 | −0.201 | 54.417 | 15.664 | 1.00 | 41.12 | N |
| ATOM | 1167 | CA | THR | A | 143 | 0.533 | 53.251 | 15.186 | 1.00 | 38.92 | C |
| ATOM | 1168 | C | THR | A | 143 | 1.692 | 52.938 | 16.118 | 1.00 | 44.01 | C |
| ATOM | 1169 | O | THR | A | 143 | 1.901 | 51.783 | 16.509 | 1.00 | 42.19 | O |
| ATOM | 1170 | CB | THR | A | 143 | 1.055 | 53.507 | 13.767 | 1.00 | 38.42 | C |
| ATOM | 1171 | OG1 | THR | A | 143 | −0.047 | 53.743 | 12.877 | 1.00 | 42.10 | O |
| ATOM | 1172 | CG2 | THR | A | 143 | 1.895 | 52.320 | 13.265 | 1.00 | 34.05 | C |
| ATOM | 1173 | N | LYS | A | 144 | 2.454 | 53.971 | 16.481 | 1.00 | 40.39 | N |
| ATOM | 1174 | CA | LYS | A | 144 | 3.551 | 53.806 | 17.425 | 1.00 | 45.40 | C |
| ATOM | 1175 | C | LYS | A | 144 | 3.097 | 53.070 | 18.676 | 1.00 | 46.33 | C |
| ATOM | 1176 | O | LYS | A | 144 | 3.743 | 52.116 | 19.117 | 1.00 | 46.92 | O |
| ATOM | 1177 | CB | LYS | A | 144 | 4.131 | 55.168 | 17.788 | 1.00 | 42.83 | C |
| ATOM | 1178 | CG | LYS | A | 144 | 5.245 | 55.124 | 18.829 | 1.00 | 48.60 | C |

TABLE 77-continued

| | | | | | | | | | | |
|---|---|---|---|---|---|---|---|---|---|---|
| ATOM | 1179 | CD | LYS | A | 144 | 5.870 | 56.499 | 19.004 | 1.00 | 51.47 C |
| ATOM | 1180 | CE | LYS | A | 144 | 6.959 | 56.496 | 20.069 | 1.00 | 55.18 C |
| ATOM | 1181 | NZ | LYS | A | 144 | 7.864 | 57.683 | 19.912 | 1.00 | 60.79 N1+ |
| ATOM | 1182 | N | HIS | A | 145 | 1.969 | 53.483 | 19.254 | 1.00 | 46.22 N |
| ATOM | 1183 | CA | HIS | A | 145 | 1.551 | 52.856 | 20.499 | 1.00 | 47.68 C |
| ATOM | 1184 | C | HIS | A | 145 | 1.135 | 51.414 | 20.261 | 1.00 | 45.20 C |
| ATOM | 1185 | O | HIS | A | 145 | 1.468 | 50.530 | 21.054 | 1.00 | 46.61 O |
| ATOM | 1186 | CB | HIS | A | 145 | 0.431 | 53.671 | 21.148 | 1.00 | 49.50 C |
| ATOM | 1187 | CG | HIS | A | 145 | 0.883 | 55.028 | 21.589 | 1.00 | 58.76 C |
| ATOM | 1188 | ND1 | HIS | A | 145 | 2.197 | 55.297 | 21.913 | 1.00 | 63.42 N |
| ATOM | 1189 | CD2 | HIS | A | 145 | 0.216 | 56.199 | 21.724 | 1.00 | 63.97 C |
| ATOM | 1190 | CE1 | HIS | A | 145 | 2.319 | 56.570 | 22.242 | 1.00 | 65.96 C |
| ATOM | 1191 | NE2 | HIS | A | 145 | 1.132 | 57.141 | 22.136 | 1.00 | 68.42 N |
| ATOM | 1192 | N | LYS | A | 146 | 0.426 | 51.159 | 19.162 | 1.00 | 43.51 N |
| ATOM | 1193 | CA | LYS | A | 146 | 0.061 | 49.794 | 18.810 | 1.00 | 43.18 C |
| ATOM | 1194 | C | LYS | A | 146 | 1.302 | 48.925 | 18.606 | 1.00 | 44.93 C |
| ATOM | 1195 | O | LYS | A | 146 | 1.370 | 47.792 | 19.092 | 1.00 | 44.74 O |
| ATOM | 1196 | CB | LYS | A | 146 | −0.804 | 49.808 | 17.555 | 1.00 | 44.80 C |
| ATOM | 1197 | CG | LYS | A | 146 | −1.109 | 48.419 | 17.010 | 1.00 | 52.42 C |
| ATOM | 1198 | CD | LYS | A | 146 | −1.762 | 48.473 | 15.619 | 1.00 | 54.98 C |
| ATOM | 1199 | CE | LYS | A | 146 | −3.135 | 49.145 | 15.669 | 1.00 | 57.77 C |
| ATOM | 1200 | NZ | LYS | A | 146 | −3.963 | 48.807 | 14.462 | 1.00 | 58.02 N1+ |
| ATOM | 1201 | N | TRP | A | 147 | 2.309 | 49.450 | 17.908 | 1.00 | 42.77 N |
| ATOM | 1202 | CA | TRP | A | 147 | 3.499 | 48.647 | 17.636 | 1.00 | 45.80 C |
| ATOM | 1203 | C | TRP | A | 147 | 4.379 | 48.476 | 18.871 | 1.00 | 47.98 C |
| ATOM | 1204 | O | TRP | A | 147 | 5.112 | 47.483 | 18.972 | 1.00 | 49.34 O |
| ATOM | 1205 | CB | TRP | A | 147 | 4.288 | 49.271 | 16.490 | 1.00 | 40.18 C |
| ATOM | 1206 | CG | TRP | A | 147 | 3.614 | 49.069 | 15.179 | 1.00 | 36.91 C |
| ATOM | 1207 | CD1 | TRP | A | 147 | 2.421 | 48.447 | 14.965 | 1.00 | 39.12 C |
| ATOM | 1208 | CD2 | TRP | A | 147 | 4.100 | 49.469 | 13.896 | 1.00 | 37.10 C |
| ATOM | 1209 | NE1 | TRP | A | 147 | 2.130 | 48.433 | 13.620 | 1.00 | 40.47 N |
| ATOM | 1210 | CE2 | TRP | A | 147 | 3.141 | 49.066 | 12.942 | 1.00 | 38.94 O |
| ATOM | 1211 | CE3 | TRP | A | 147 | 5.241 | 50.138 | 13.461 | 1.00 | 38.60 C |
| ATOM | 1212 | CZ2 | TRP | A | 147 | 3.298 | 49.301 | 11.583 | 1.00 | 35.21 C |
| ATOM | 1213 | CZ3 | TRP | A | 147 | 5.395 | 50.372 | 12.106 | 1.00 | 45.69 C |
| ATOM | 1214 | CH2 | TRP | A | 147 | 4.433 | 49.942 | 11.184 | 1.00 | 34.08 C |
| ATOM | 1215 | N | GLU | A | 148 | 4.338 | 49.430 | 19.805 | 1.00 | 46.28 N |
| ATOM | 1216 | CA | GLU | A | 148 | 5.047 | 49.247 | 21.071 | 1.00 | 49.23 C |
| ATOM | 1217 | C | GLU | A | 148 | 4.421 | 48.117 | 21.880 | 1.00 | 50.91 C |
| ATOM | 1218 | O | GLU | A | 148 | 5.133 | 47.285 | 22.453 | 1.00 | 53.47 O |
| ATOM | 1219 | CB | GLU | A | 148 | 5.052 | 50.554 | 21.873 | 1.00 | 46.69 C |
| ATOM | 1220 | CG | GLU | A | 148 | 6.055 | 51.588 | 21.357 | 1.00 | 45.93 C |
| ATOM | 1221 | CD | GLU | A | 148 | 5.851 | 52.995 | 21.937 | 1.00 | 60.08 C |
| ATOM | 1222 | OE1 | GLU | A | 148 | 4.823 | 53.244 | 22.610 | 1.00 | 62.46 O |
| ATOM | 1223 | OE2 | GLU | A | 148 | 6.724 | 53.865 | 21.709 | 1.00 | 69.24 O1− |
| ATOM | 1224 | N | ALA | A | 149 | 3.090 | 48.051 | 21.905 | 1.00 | 46.44 N |
| ATOM | 1225 | CA | ALA | A | 149 | 2.419 | 46.992 | 22.651 | 1.00 | 48.96 C |
| ATOM | 1226 | C | ALA | A | 149 | 2.659 | 45.617 | 22.029 | 1.00 | 54.86 C |
| ATOM | 1227 | O | ALA | A | 149 | 2.768 | 44.616 | 22.750 | 1.00 | 49.03 O |
| ATOM | 1228 | CB | ALA | A | 149 | 0.917 | 47.292 | 22.740 | 1.00 | 46.07 C |
| ATOM | 1229 | N | ALA | A | 150 | 2.739 | 45.542 | 20.694 | 1.00 | 50.53 N |
| ATOM | 1230 | CA | ALA | A | 150 | 2.912 | 44.268 | 19.999 | 1.00 | 50.04 C |
| ATOM | 1231 | C | ALA | A | 150 | 4.371 | 43.852 | 19.863 | 1.00 | 51.25 C |
| ATOM | 1232 | O | ALA | A | 150 | 4.638 | 42.791 | 19.290 | 1.00 | 53.71 O |
| ATOM | 1233 | CB | ALA | A | 150 | 2.274 | 44.325 | 18.607 | 1.00 | 45.28 C |
| ATOM | 1234 | N | HIS | A | 151 | 5.306 | 44.666 | 20.349 | 1.00 | 49.13 N |
| ATOM | 1235 | CA | HIS | A | 151 | 6.747 | 44.389 | 20.282 | 1.00 | 56.16 C |
| ATOM | 1236 | C | HIS | A | 151 | 7.237 | 44.266 | 18.838 | 1.00 | 51.98 C |
| ATOM | 1237 | O | HIS | A | 151 | 8.041 | 43.393 | 18.499 | 1.00 | 48.44 O |
| ATOM | 1238 | CB | HIS | A | 151 | 7.103 | 43.145 | 21.099 | 1.00 | 56.20 C |
| ATOM | 1239 | CG | HIS | A | 151 | 6.849 | 43.312 | 22.561 | 1.00 | 61.87 C |
| ATOM | 1240 | ND1 | HIS | A | 151 | 7.705 | 44.007 | 23.387 | 1.00 | 75.16 N |
| ATOM | 1241 | CD2 | HIS | A | 151 | 5.824 | 12.899 | 23.342 | 1.00 | 66.69 C |
| ATOM | 1242 | CE1 | HIS | A | 151 | 7.225 | 44.004 | 24.618 | 1.00 | 73.76 C |
| ATOM | 1243 | NE2 | HIS | A | 151 | 6.083 | 43.341 | 24.617 | 1.00 | 71.30 N |
| ATOM | 1244 | N | VAL | A | 152 | 6.774 | 45.188 | 17.995 | 1.00 | 48.22 N |
| ATOM | 1245 | CA | VAL | A | 152 | 7.090 | 45.134 | 16.572 | 1.00 | 45.48 C |
| ATOM | 1246 | C | VAL | A | 152 | 8.571 | 45.408 | 16.335 | 1.00 | 47.20 C |
| ATOM | 1247 | O | VAL | A | 152 | 9.210 | 44.748 | 15.504 | 1.00 | 45.65 O |
| ATOM | 1248 | CB | VAL | A | 152 | 6.192 | 46.117 | 15.795 | 1.00 | 47.03 C |
| ATOM | 1249 | CG1 | VAL | A | 152 | 6.630 | 46.207 | 14.343 | 1.00 | 44.48 C |
| ATOM | 1250 | CG2 | VAL | A | 152 | 4.739 | 45.683 | 15.882 | 1.00 | 38.09 C |
| ATOM | 1251 | N | ALA | A | 153 | 9.151 | 46.356 | 17.081 | 1.00 | 43.02 N |
| ATOM | 1252 | CA | ALA | A | 153 | 10.539 | 46.749 | 16.834 | 1.00 | 43.78 C |
| ATOM | 1253 | C | ALA | A | 153 | 11.502 | 45.613 | 17.138 | 1.00 | 47.13 C |
| ATOM | 1254 | O | ALA | A | 153 | 12.506 | 45.433 | 16.438 | 1.00 | 46.48 O |
| ATOM | 1255 | CB | ALA | A | 153 | 10.897 | 47.977 | 17.664 | 1.00 | 44.95 C |
| ATOM | 1256 | N | GLU | A | 154 | 11.206 | 44.830 | 18.176 | 1.00 | 45.93 N |
| ATOM | 1257 | CA | GLU | A | 154 | 12.030 | 43.672 | 18.495 | 1.00 | 50.30 C |
| ATOM | 1258 | C | GLU | A | 154 | 11.978 | 42.632 | 17.375 | 1.00 | 44.32 C |

TABLE 77-continued

| | | | | | | | | | | |
|---|---|---|---|---|---|---|---|---|---|---|
| ATOM | 1259 | O | GLU | A | 154 | 13.002 | 42.049 | 17.014 | 1.00 | 44.44 | O |
| ATOM | 1260 | CB | GLU | A | 154 | 11.565 | 43.078 | 19.828 | 1.00 | 50.41 | C |
| ATOM | 1261 | CG | GLU | A | 154 | 11.583 | 44.088 | 21.015 | 1.00 | 67.11 | C |
| ATOM | 1262 | CD | GLU | A | 154 | 10.332 | 45.017 | 21.122 | 1.00 | 71.68 | C |
| ATOM | 1263 | OE1 | GLU | A | 154 | 9.806 | 45.496 | 20.092 | 1.00 | 58.68 | O |
| ATOM | 1264 | OE2 | GLU | A | 154 | 9.882 | 45.279 | 22.264 | 1.00 | 79.26 | O1− |
| ATOM | 1265 | N | GLN | A | 155 | 10.789 | 42.364 | 16.833 | 1.00 | 45.17 | N |
| ATOM | 1266 | CA | GLN | A | 155 | 10.678 | 41.408 | 15.737 | 1.00 | 44.02 | C |
| ATOM | 1267 | C | GLN | A | 155 | 11.419 | 41.896 | 14.500 | 1.00 | 39.85 | C |
| ATOM | 1268 | O | GLN | A | 155 | 12.008 | 41.102 | 13.761 | 1.00 | 39.00 | O |
| ATOM | 1269 | CB | GLN | A | 155 | 9.212 | 41.179 | 15.410 | 1.00 | 39.86 | C |
| ATOM | 1270 | CG | GLN | A | 155 | 8.450 | 40.573 | 16.546 | 1.00 | 48.97 | C |
| ATOM | 1271 | CD | GLN | A | 155 | 6.972 | 40.697 | 16.348 | 1.00 | 45.13 | C |
| ATOM | 1272 | OE1 | GLN | A | 155 | 6.476 | 40.641 | 15.229 | 1.00 | 48.82 | O |
| ATOM | 1273 | NE2 | GLN | A | 155 | 6.257 | 40.902 | 17.435 | 1.00 | 55.42 | N |
| ATOM | 1274 | N | LEU | A | 156 | 11.360 | 43.199 | 14.244 | 1.00 | 39.32 | N |
| ATOM | 1275 | CA | LEU | A | 156 | 12.070 | 43.797 | 13.125 | 1.00 | 37.22 | C |
| ATOM | 1276 | C | LEU | A | 156 | 13.570 | 43.767 | 13.362 | 1.00 | 42.07 | C |
| ATOM | 1277 | O | LEU | A | 156 | 14.346 | 43.435 | 12.459 | 1.00 | 38.38 | O |
| ATOM | 1278 | CB | LEU | A | 156 | 11.593 | 45.238 | 12.949 | 1.00 | 42.01 | C |
| ATOM | 1279 | CG | LEU | A | 156 | 10.966 | 45.676 | 11.636 | 1.00 | 49.40 | C |
| ATOM | 1280 | CD1 | LEU | A | 156 | 10.140 | 46.936 | 11.838 | 1.00 | 42.35 | C |
| ATOM | 1281 | CD2 | LEU | A | 156 | 12.103 | 45.928 | 10.678 | 1.00 | 49.08 | C |
| ATOM | 1282 | N | ARG | A | 157 | 13.992 | 44.127 | 14.575 | 1.00 | 39.98 | N |
| ATOM | 1283 | CA | ARG | A | 157 | 15.403 | 44.068 | 14.918 | .00 | 44.10 | C |
| ATOM | 1284 | C | ARG | A | 157 | 15.941 | 42.656 | 14.736 | 1.00 | 39.01 | C |
| ATOM | 1285 | O | ARG | A | 157 | 17.040 | 42.474 | 14.207 | 1.00 | 45.01 | O |
| ATOM | 1286 | CB | ARG | A | 157 | 15.605 | 44.552 | 16.355 | 1.00 | 43.45 | C |
| ATOM | 1287 | CG | ARG | A | 157 | 17.024 | 44.969 | 16.679 | 1.00 | 48.32 | C |
| ATOM | 1288 | CD | ARG | A | 157 | 17.094 | 45.649 | 18.039 | 1.00 | 50.72 | C |
| ATOM | 1289 | NE | ARG | A | 157 | 16.823 | 44.716 | 19.129 | 1.00 | 52.06 | N |
| ATOM | 1290 | CZ | ARG | A | 157 | 15.707 | 44.698 | 19.849 | 1.00 | 56.36 | C |
| ATOM | 1291 | NH1 | ARG | A | 157 | 14.732 | 45.580 | 19.617 | 1.00 | 58.78 | N1+ |
| ATOM | 1292 | NH2 | ARG | A | 157 | 15.567 | 43.801 | 20.813 | 1.00 | 62.58 | N |
| ATOM | 1293 | N | ALA | A | 158 | 15.161 | 41.642 | 15.134 | 1.00 | 43.21 | N |
| ATOM | 1294 | CA | ALA | A | 158 | 15.597 | 40.255 | 14.961 | 1.00 | 42.18 | C |
| ATOM | 1295 | C | ALA | A | 158 | 15.885 | 39.942 | 13.501 | 1.00 | 39.93 | C |
| ATOM | 1296 | O | ALA | A | 158 | 16.900 | 39.325 | 13.179 | 1.00 | 39.41 | O |
| ATOM | 1297 | CB | ALA | A | 158 | 14.548 | 39.283 | 15.509 | 1.00 | 38.22 | C |
| ATOM | 1298 | N | TYR | A | 159 | 14.999 | 40.362 | 12.596 | 1.00 | 38.40 | N |
| ATOM | 1299 | CA | TYR | A | 159 | 15.242 | 40.138 | 11.171 | 1.00 | 33.48 | C |
| ATOM | 1300 | C | TYR | A | 159 | 16.472 | 40.896 | 10.696 | 1.00 | 36.23 | C |
| ATOM | 1301 | O | TYR | A | 159 | 17.342 | 40.341 | 9.998 | 1.00 | 35.89 | O |
| ATOM | 1302 | CB | TYR | A | 159 | 14.005 | 40.558 | 10.373 | 1.00 | 35.16 | C |
| ATOM | 1303 | CG | TYR | A | 159 | 14.275 | 40.805 | 8.912 | 1.00 | 30.92 | C |
| ATOM | 1304 | CD1 | TYR | A | 159 | 14.445 | 39.741 | 8.025 | 1.00 | 31.80 | C |
| ATOM | 1305 | CD2 | TYR | A | 159 | 14.333 | 42.098 | 8.411 | 1.00 | 31.24 | C |
| ATOM | 1306 | CE1 | TYR | A | 159 | 14.695 | 39.967 | 6.675 | 1.00 | 28.80 | C |
| ATOM | 1307 | CE2 | TYR | A | 159 | 14.580 | 42.326 | 7.063 | 1.00 | 31.38 | C |
| ATOM | 1308 | CZ | TYR | A | 159 | 14.755 | 41.269 | 6.212 | 1.00 | 26.62 | C |
| ATOM | 1309 | OH | TYR | A | 159 | 14.976 | 41.505 | 4.881 | 1.00 | 31.30 | O |
| ATOM | 1310 | N | LEU | A | 160 | 16.562 | 42.172 | 11.075 | 1.00 | 35.27 | N |
| ATOM | 1311 | CA | LEU | A | 160 | 17.598 | 43.046 | 10.556 | 1.00 | 34.33 | C |
| ATOM | 1312 | C | LEU | A | 160 | 18.978 | 42.602 | 11.029 | 1.00 | 38.27 | C |
| ATOM | 1313 | O | LEU | A | 160 | 19.962 | 42.742 | 10.297 | 1.00 | 36.82 | O |
| ATOM | 1314 | CB | LEU | A | 160 | 17.311 | 44.490 | 10.991 | 1.00 | 35.04 | C |
| ATOM | 1315 | CG | LEU | A | 160 | 16.056 | 45.188 | 10.445 | 1.00 | 39.87 | C |
| ATOM | 1316 | CD1 | LEU | A | 160 | 15.794 | 46.522 | 11.152 | 1.00 | 32.67 | C |
| ATOM | 1317 | CD2 | LEU | A | 160 | 16.145 | 45.375 | 8.931 | 1.00 | 35.67 | C |
| ATOM | 1318 | N | GLU | A | 161 | 19.062 | 42.052 | 12.238 | 1.00 | 39.73 | N |
| ATOM | 1319 | CA | GLU | A | 161 | 20.340 | 41.610 | 12.785 | 1.00 | 45.91 | C |
| ATOM | 1320 | C | GLU | A | 161 | 20.654 | 40.150 | 12.498 | 1.00 | 41.86 | C |
| ATOM | 1321 | O | GLU | A | 161 | 21.817 | 39.750 | 12.638 | 1.00 | 46.85 | O |
| ATOM | 1322 | CB | GLU | A | 161 | 20.375 | 41.826 | 14.298 | 1.00 | 42.14 | C |
| ATOM | 1323 | CG | GLU | A | 161 | 20.314 | 43.272 | 14.697 | 1.00 | 44.94 | C |
| ATOM | 1324 | CD | GLU | A | 161 | 20.188 | 43.454 | 16.194 | 1.00 | 51.62 | C |
| ATOM | 1325 | OE1 | GLU | A | 161 | 19.864 | 42.467 | 16.894 | 1.00 | 49.46 | O |
| ATOM | 1326 | OE2 | GLU | A | 161 | 20.401 | 44.592 | 16.659 | 1.00 | 57.60 | O1− |
| ATOM | 1327 | N | GLY | A | 162 | 19.658 | 39.347 | 12.123 | 1.00 | 39.22 | N |
| ATOM | 1328 | CA | GLY | A | 162 | 19.886 | 37.951 | 11.797 | 1.00 | 34.56 | C |
| ATOM | 1329 | C | GLY | A | 162 | 19.626 | 37.652 | 10.335 | 1.00 | 39.03 | C |
| ATOM | 1330 | O | GLY | A | 162 | 20.508 | 37.795 | 9.485 | 1.00 | 36.06 | O |
| ATOM | 1331 | N | THR | A | 162 | 18.378 | 37.290 | 10.037 | 1.00 | 32.78 | N |
| ATOM | 1332 | CA | THR | A | 163 | 17.993 | 36.845 | 8.700 | 1.00 | 31.31 | C |
| ATOM | 1333 | C | THR | A | 163 | 18.442 | 37.797 | 7.596 | 1.00 | 28.47 | C |
| ATOM | 1334 | O | THR | A | 163 | 18.880 | 37.350 | 6.529 | 1.00 | 32.49 | O |
| ATOM | 1335 | CB | THR | A | 163 | 16.479 | 36.681 | 8.658 | 1.00 | 32.68 | C |
| ATOM | 1336 | OG1 | THR | A | 163 | 16.106 | 35.638 | 9.572 | 1.00 | 34.91 | O |
| ATOM | 1337 | CG2 | THR | A | 163 | 16.002 | 36.362 | 7.240 | 1.00 | 31.02 | C |
| ATOM | 1338 | N | CYS | A | 164 | 18.297 | 39.107 | 7.812 | 1.00 | 29.84 | N |

TABLE 77-continued

| ATOM | 1339 | CA | CYS | A | 164 | 18.627 | 40.085 | 6.774 | 1.00 | 30.32 | C |
|---|---|---|---|---|---|---|---|---|---|---|---|
| ATOM | 1340 | C | CYS | A | 164 | 20.096 | 40.001 | 6.372 | 1.00 | 35.35 | C |
| ATOM | 1341 | O | CYS | A | 164 | 20.428 | 39.997 | 5.179 | 1.00 | 30.08 | O |
| ATOM | 1342 | CB | CYS | A | 164 | 18.300 | 41.498 | 7.269 | 1.00 | 32.23 | C |
| ATOM | 1343 | SG | CYS | A | 164 | 18.406 | 42.760 | 6.021 | 1.00 | 36.42 | S |
| ATOM | 1344 | N | VAL | A | 165 | 20.996 | 39.961 | 7.356 | 1.00 | 31.79 | N |
| ATOM | 1345 | CA | VAL | A | 165 | 22.417 | 39.910 | 7.016 | 1.00 | 34.05 | C |
| ATOM | 1346 | C | VAL | A | 165 | 22.851 | 38.507 | 6.604 | 1.00 | 32.74 | C |
| ATOM | 1347 | O | VAL | A | 165 | 23.804 | 38.360 | 5.838 | 1.00 | 33.81 | O |
| ATOM | 1348 | CB | VAL | A | 165 | 23.278 | 40.440 | 8.178 | 1.00 | 35.06 | C |
| ATOM | 1349 | CG1 | VAL | A | 165 | 23.011 | 41.910 | 8.392 | 1.00 | 35.77 | C |
| ATOM | 1350 | CG2 | VAL | A | 165 | 23.000 | 39.666 | 9.437 | 1.00 | 39.29 | C |
| ATOM | 1351 | N | GLU | A | 166 | 22.164 | 37.456 | 7.068 | 1.00 | 32.02 | N |
| ATOM | 1352 | CA | GLU | A | 166 | 22.488 | 36.119 | 6.591 | 1.00 | 30.40 | C |
| ATOM | 1353 | C | GLU | A | 166 | 22.265 | 36.003 | 5.090 | 1.00 | 36.49 | C |
| ATOM | 1354 | O | GLU | A | 166 | 23.110 | 35.462 | 4.365 | 1.00 | 32.10 | O |
| ATOM | 1355 | CB | GLU | A | 166 | 21.655 | 35.075 | 7.341 | 1.00 | 37.21 | C |
| ATOM | 1356 | CG | GLU | A | 166 | 22.067 | 34.946 | 8.800 | 1.00 | 39.25 | C |
| ATOM | 1357 | CD | GLU | A | 166 | 21.010 | 34.274 | 9.655 | 1.00 | 45.34 | C |
| ATOM | 1358 | OE1 | GLU | A | 166 | 19.962 | 33.859 | 9.115 | 1.00 | 40.37 | O |
| ATOM | 1359 | OE2 | GLU | A | 166 | 21.226 | 34.171 | 10.879 | 1.00 | 56.48 | O1− |
| ATOM | 1360 | N | TRP | A | 167 | 21.110 | 36.480 | 4.605 | 1.00 | 32.48 | N |
| ATOM | 1361 | CA | TRP | A | 167 | 20.868 | 36.452 | 3.168 | 1.00 | 30.16 | C |
| ATOM | 1362 | C | TRP | A | 167 | 21.850 | 37.358 | 2.434 | 1.00 | 30.40 | C |
| ATOM | 1363 | O | TRP | A | 167 | 22.377 | 36.990 | 1.380 | 1.00 | 29.58 | O |
| ATOM | 1364 | CB | TRP | A | 167 | 19.420 | 36.858 | 2.866 | 1.00 | 29.93 | C |
| ATOM | 1365 | CG | TRP | A | 167 | 18.430 | 35.749 | 3.134 | 1.00 | 27.55 | C |
| ATOM | 1366 | CD1 | TRP | A | 167 | 17.419 | 35.733 | 4.077 | 1.00 | 28.99 | C |
| ATOM | 1367 | CD2 | TRP | A | 167 | 18.368 | 34.498 | 2.457 | 1.00 | 26.56 | C |
| ATOM | 1368 | NE1 | TRP | A | 167 | 16.717 | 34.540 | 4.009 | 1.00 | 31.57 | N |
| ATOM | 1369 | CE2 | TRP | A | 167 | 17.291 | 33.754 | 3.038 | 1.00 | 34.57 | C |
| ATOM | 1370 | CE3 | TRP | A | 167 | 19.110 | 33.924 | 1.412 | 1.00 | 29.43 | C |
| ATOM | 1371 | CZ2 | TRP | A | 167 | 16.944 | 32.478 | 2.603 | 1.00 | 27.07 | C |
| ATOM | 1372 | CZ3 | TRP | A | 167 | 18.773 | 32.641 | 0.979 | 1.00 | 29.72 | C |
| ATOM | 1373 | CH2 | TRP | A | 167 | 17.692 | 31.929 | 1.581 | 1.00 | 33.49 | C |
| ATOM | 1374 | N | LEU | A | 168 | 22.108 | 38.549 | 2.970 | 1.00 | 31.88 | N |
| ATOM | 1375 | CA | LEU | A | 168 | 23.019 | 39.457 | 2.288 | 1.00 | 32.56 | C |
| ATOM | 1376 | C | LEU | A | 168 | 24.399 | 38.821 | 2.120 | 1.00 | 33.30 | C |
| ATOM | 1377 | O | LEU | A | 168 | 24.992 | 38.892 | 1.038 | 1.00 | 31.89 | O |
| ATOM | 1378 | CB | LEU | A | 168 | 23.098 | 40.787 | 3.042 | 1.00 | 28.37 | C |
| ATOM | 1379 | CG | LEU | A | 168 | 24.115 | 41.844 | 2.575 | 1.00 | 31.35 | C |
| ATOM | 1380 | CD1 | LEU | A | 168 | 24.048 | 42.061 | 1.064 | 1.00 | 29.10 | C |
| ATOM | 1381 | CD2 | LEU | A | 168 | 23.880 | 43.176 | 3.318 | 1.00 | 31.30 | C |
| ATOM | 1382 | N | ARG | A | 169 | 24.900 | 38.139 | 3.153 | 1.00 | 29.19 | N |
| ATOM | 1383 | CA | ARG | A | 169 | 26.204 | 37.481 | 3.012 | 1.00 | 35.01 | C |
| ATOM | 1384 | C | ARG | A | 169 | 26.159 | 36.383 | 1.958 | 1.00 | 35.32 | C |
| ATOM | 1385 | O | ARG | A | 169 | 27.081 | 36.267 | 1.139 | 1.00 | 34.81 | O |
| ATOM | 1386 | CB | ARG | A | 169 | 26.681 | 36.947 | 4.363 | 1.00 | 33.38 | C |
| ATOM | 1387 | CG | ARG | A | 169 | 26.985 | 38.118 | 5.328 | 1.00 | 37.70 | C |
| ATOM | 1388 | CD | ARG | A | 169 | 27.716 | 37.695 | 6.593 | 1.00 | 44.91 | C |
| ATOM | 1389 | NE | ARG | A | 169 | 26.816 | 37.190 | 7.614 | 1.00 | 49.08 | N |
| ATOM | 1390 | CZ | ARG | A | 169 | 26.457 | 37.871 | 8.700 | 1.00 | 49.96 | C |
| ATOM | 1391 | NH1 | ARG | A | 169 | 26.924 | 39.086 | 8.899 | 1.00 | 47.34 | N1+ |
| ATOM | 1392 | NH2 | ARG | A | 169 | 25.624 | 37.335 | 9.587 | 1.00 | 49.13 | N |
| ATOM | 1393 | N | ARG | A | 170 | 25.062 | 35.616 | 1.902 | 1.00 | 31.58 | N |
| ATOM | 1394 | CA | ARG | A | 170 | 24.968 | 34.579 | 0.877 | 1.00 | 32.45 | C |
| ATOM | 1395 | C | ARG | A | 170 | 24.922 | 35.184 | −0.517 | 1.00 | 30.24 | C |
| ATOM | 1396 | O | ARG | A | 170 | 25.553 | 34.671 | −1.453 | 1.00 | 29.67 | O |
| ATOM | 1397 | CB | ARG | A | 170 | 23.734 | 33.697 | 1.094 | 1.00 | 33.91 | C |
| ATOM | 1398 | CG | ARG | A | 170 | 23.559 | 32.739 | −0.071 | 1.00 | 33.28 | C |
| ATOM | 1399 | CD | ARG | A | 170 | 22.409 | 31.762 | 0.169 | 1.00 | 38.65 | C |
| ATOM | 1400 | NE | ARG | A | 170 | 22.131 | 30.960 | −1.025 | 1.00 | 38.23 | N |
| ATOM | 1401 | CZ | ARG | A | 170 | 22.729 | 29.809 | −1.338 | 1.00 | 36.73 | C |
| ATOM | 1402 | NH1 | ARG | A | 170 | 23.661 | 29.306 | −0.550 | 1.00 | 38.01 | N1+ |
| ATOM | 1403 | NH2 | ARG | A | 170 | 22.379 | 29.146 | −2.439 | 1.00 | 37.08 | N |
| ATOM | 1404 | N | TYR | A | 171 | 24.157 | 36.262 | −0.679 | 1.00 | 30.41 | N |
| ATOM | 1405 | CA | TYR | A | 171 | 24.087 | 36.934 | −1.973 | 1.00 | 32.21 | C |
| ATOM | 1406 | C | TYR | A | 171 | 25.449 | 37.496 | −2.357 | 1.00 | 32.72 | C |
| ATOM | 1407 | O | TYR | A | 171 | 25.865 | 37.403 | −3.517 | 1.00 | 32.77 | O |
| ATOM | 1408 | CB | TYR | A | 171 | 23.045 | 38.051 | −1.941 | 1.00 | 26.75 | C |
| ATOM | 1409 | CG | TYR | A | 171 | 21.623 | 37.622 | −1.610 | 1.00 | 31.04 | C |
| ATOM | 1410 | CD1 | TYR | A | 171 | 21.190 | 36.305 | −1.788 | 1.00 | 30.89 | C |
| ATOM | 1411 | CD2 | TYR | A | 171 | 20.715 | 38.547 | −1.110 | 1.00 | 31.44 | C |
| ATOM | 1412 | CE1 | TYR | A | 171 | 19.878 | 35.923 | −1.456 | 1.00 | 30.76 | C |
| ATOM | 1413 | CE2 | TYR | A | 171 | 19.423 | 38.185 | −0.785 | 1.00 | 28.97 | C |
| ATOM | 1414 | CZ | TYR | A | 171 | 19.009 | 36.873 | −0.957 | 1.00 | 29.62 | C |
| ATOM | 1415 | OH | TYR | A | 171 | 17.715 | 36.526 | −0.630 | 1.00 | 29.51 | O |
| ATOM | 1416 | N | LEU | A | 172 | 26.165 | 38.069 | −1.388 | 1.00 | 33.03 | N |
| ATOM | 1417 | CA | LEU | A | 172 | 27.502 | 38.593 | −1.673 | 1.00 | 32.89 | C |
| ATOM | 1418 | C | LEU | A | 172 | 28.436 | 37.497 | −2.183 | 1.00 | 36.18 | C |

TABLE 77-continued

| ATOM | 1419 | O | LEU | A | 172 | 29.176 | 37.702 | −3.158 | 1.00 | 36.33 | O |
| --- | --- | --- | --- | --- | --- | --- | --- | --- | --- | --- | --- |
| ATOM | 1420 | CB | LEU | A | 172 | 28.070 | 39.260 | −0.417 | 1.00 | 30.67 | C |
| ATOM | 1421 | CG | LEU | A | 172 | 27.402 | 10.600 | −0.097 | 1.00 | 36.26 | C |
| ATOM | 1422 | CD1 | LEU | A | 172 | 27.863 | 41.150 | 1.235 | 1.00 | 37.95 | C |
| ATOM | 1423 | CD2 | LEU | A | 172 | 27.687 | 41.599 | −1.216 | 1.00 | 35.80 | C |
| ATOM | 1424 | N | GLU | A | 173 | 28.405 | 36.317 | −1.558 | 1.00 | 32.69 | N |
| ATOM | 1425 | CA | GLU | A | 173 | 29.302 | 35.253 | −2.018 | 1.00 | 38.61 | C |
| ATOM | 1426 | C | GLU | A | 173 | 28.816 | 34.654 | −3.332 | 1.00 | 37.86 | C |
| ATOM | 1427 | O | GLU | A | 173 | 29.613 | 34.432 | −4.248 | 1.00 | 35.97 | O |
| ATOM | 1428 | CB | GLU | A | 173 | 29.468 | 34.175 | −0.943 | 1.00 | 35.06 | C |
| ATOM | 1429 | CG | GLU | A | 173 | 28.188 | 33.573 | −0.464 | 1.00 | 49.08 | C |
| ATOM | 1430 | CD | GLU | A | 173 | 28.392 | 32.630 | 0.700 | 0.00 | 47.10 | C |
| ATOM | 1431 | OE1 | GLU | A | 173 | 27.635 | 31.641 | 0.801 | 1.00 | 62.28 | O |
| ATOM | 1432 | OE2 | GLU | A | 173 | 29.314 | 32.879 | 1.506 | 0.86 | 59.28 | O1− |
| ATOM | 1433 | N | ASN | A | 174 | 27.507 | 34.429 | −3.472 | 1.00 | 39.10 | N |
| ATOM | 1434 | CA | ASN | A | 174 | 26.992 | 33.933 | −4.748 | 1.00 | 36.48 | C |
| ATOM | 1435 | C | ASN | A | 174 | 27.132 | 34.960 | −5.867 | 1.00 | 35.73 | C |
| ATOM | 1436 | O | ASN | A | 174 | 27.303 | 34.586 | −7.037 | 1.00 | 36.70 | O |
| ATOM | 1437 | CB | ASN | A | 174 | 25.536 | 33.511 | −4.590 | 1.00 | 35.02 | C |
| ATOM | 1438 | CG | ASN | A | 174 | 25.422 | 32.130 | −3.971 | 1.00 | 42.98 | C |
| ATOM | 1439 | OD1 | ASN | A | 174 | 26.429 | 31.414 | −3.846 | 1.00 | 39.15 | O |
| ATOM | 1440 | ND2 | ASN | A | 174 | 24.216 | 31.741 | −3.600 | 1.00 | 37.33 | N |
| ATOM | 1441 | N | GLY | A | 175 | 27.027 | 36.245 | −5.542 | 1.00 | 32.95 | N |
| ATOM | 1442 | CA | GLY | A | 175 | 27.195 | 37.259 | −6.562 | 1.00 | 35.80 | C |
| ATOM | 1443 | C | GLY | A | 175 | 28.562 | 37.910 | −6.541 | 1.00 | 38.17 | C |
| ATOM | 1444 | O | GLY | A | 175 | 28.701 | 39.046 | −6.991 | 1.00 | 36.44 | O |
| ATOM | 1445 | N | LYS | A | 176 | 29.577 | 37.201 | −6.043 | 1.00 | 35.81 | N |
| ATOM | 1446 | CA | LYS | A | 176 | 30.913 | 37.798 | −5.895 | 1.00 | 39.67 | C |
| ATOM | 1447 | C | LYS | A | 176 | 31.397 | 38.460 | −7.185 | 1.00 | 39.03 | C |
| ATOM | 1448 | O | LYS | A | 176 | 31.893 | 39.591 | −7.170 | 1.00 | 41.94 | O |
| ATOM | 1449 | CB | LYS | A | 176 | 31.90 | 36.733 | −5.432 | 1.00 | 39.33 | C |
| ATOM | 1450 | CG | LYS | A | 176 | 33.383 | 37.175 | −5.452 | 1.00 | 37.77 | C |
| ATOM | 1451 | CD | LYS | A | 176 | 34.268 | 36.071 | −4.888 | 1.00 | 39.56 | C |
| ATOM | 1452 | CE | LYS | A | 176 | 34.108 | 34.786 | −5.657 | 0.00 | 41.08 | C |
| ATOM | 1453 | NZ | LYS | A | 176 | 34.959 | 33.752 | −5.031 | 1.00 | 41.46 | N1+ |
| ATOM | 1454 | N | GLU | A | 177 | 31.230 | 37.779 | −8.320 | 1.00 | 38.97 | N |
| ATOM | 1455 | CA | GLU | A | 177 | 31.809 | 38.248 | −9.575 | 1.00 | 42.56 | C |
| ATOM | 1456 | C | GLU | A | 177 | 31.182 | 39.540 | −10.095 | 1.00 | 44.69 | C |
| ATOM | 1457 | O | GLU | A | 177 | 31.761 | 40.166 | −10.983 | 1.00 | 46.94 | O |
| ATOM | 1458 | CB | GLU | A | 177 | 31.687 | 37.159 | −10.633 | 1.00 | 42.18 | C |
| ATOM | 1459 | CG | GLU | A | 177 | 32.638 | 36.000 | −10.417 | 1.00 | 42.99 | C |
| ATOM | 1460 | CD | GLU | A | 177 | 32.172 | 35.026 | −9.356 | 0.00 | 46.23 | C |
| ATOM | 1461 | OE1 | GLU | A | 177 | 31.052 | 35.176 | −8.820 | 1.00 | 52.71 | O |
| ATOM | 1462 | OE2 | GLU | A | 177 | 32.938 | 34.097 | −9.058 | 1.00 | 53.62 | O1− |
| ATOM | 1463 | N | THR | A | 178 | 30.012 | 39.941 | −9.593 | 1.00 | 44.94 | N |
| ATOM | 1464 | CA | THR | A | 178 | 29.426 | 41.227 | −9.953 | 1.00 | 43.65 | C |
| ATOM | 1465 | C | THR | A | 178 | 29.290 | 42.147 | −8.751 | 1.00 | 41.32 | C |
| ATOM | 1466 | O | THR | A | 178 | 29.761 | 43.294 | −8.796 | 1.00 | 42.72 | O |
| ATOM | 1467 | CB | THR | A | 178 | 28.059 | 41.040 | −10.655 | 1.00 | 46.91 | C |
| ATOM | 1468 | OG1 | THR | A | 178 | 27.199 | 40.201 | −9.873 | 1.00 | 45.26 | O |
| ATOM | 1469 | CG2 | THR | A | 178 | 28.253 | 40.405 | −12.038 | 1.00 | 44.06 | C |
| ATOM | 1470 | N | LEU | A | 179 | 28.747 | 41.650 | −7.643 | 1.00 | 37.34 | N |
| ATOM | 1471 | CA | LEU | A | 179 | 28.529 | 42.491 | −6.469 | 1.00 | 35.23 | C |
| ATOM | 1472 | C | LEU | A | 179 | 29.833 | 42.963 | −5.837 | 1.00 | 36.56 | C |
| ATOM | 1473 | O | LEU | A | 179 | 29.864 | 44.026 | −5.215 | 1.00 | 36.31 | O |
| ATOM | 1474 | CB | LEU | A | 179 | 27.704 | 41.737 | −5.425 | 1.00 | 34.78 | C |
| ATOM | 1475 | CG | LEU | A | 179 | 26.251 | 41.426 | −5.793 | 1.00 | 40.26 | C |
| ATOM | 1476 | CD1 | LEU | A | 179 | 25.625 | 40.629 | −4.646 | 1.00 | 36.12 | C |
| ATOM | 1477 | CD2 | LEU | A | 179 | 25.451 | 42.701 | −6.084 | 1.00 | 32.32 | C |
| ATOM | 1478 | N | GLN | A | 180 | 30.901 | 42.182 | −5.920 | 1.00 | 37.88 | N |
| ATOM | 1479 | CA | GLN | A | 180 | 32.152 | 42.596 | −5.290 | 1.00 | 37.85 | C |
| ATOM | 1480 | C | GLN | A | 180 | 33.133 | 43.205 | −6.287 | 1.00 | 44.42 | C |
| ATOM | 1481 | O | GLN | A | 180 | 34.292 | 43.470 | −5.930 | 1.00 | 44.90 | O |
| ATOM | 1482 | CB | GLN | A | 180 | 32.791 | 41.412 | −4.563 | 1.00 | 36.62 | C |
| ATOM | 1483 | CG | GLN | A | 180 | 31.970 | 40.855 | −3.389 | 1.00 | 37.53 | C |
| ATOM | 1484 | CD | GLN | A | 180 | 32.639 | 39.618 | −2.766 | 1.00 | 43.39 | C |
| ATOM | 1485 | OE1 | GLN | A | 180 | 33.831 | 39.644 | −2.460 | 1.00 | 38.31 | O |
| ATOM | 1486 | NE2 | GLN | A | 180 | 31.877 | 38.533 | −2.598 | 1.00 | 36.08 | N |
| ATOM | 1487 | N | ARG | A | 181 | 32.708 | 43.410 | −7.530 | 1.00 | 38.49 | N |
| ATOM | 1488 | CA | ARG | A | 181 | 33.556 | 44.005 | −8.551 | 1.00 | 41.74 | C |
| ATOM | 1489 | C | ARG | A | 181 | 33.040 | 45.386 | −8.913 | 1.00 | 42.00 | C |
| ATOM | 1490 | O | ARG | A | 181 | 31.966 | 45.822 | −8.488 | 1.00 | 41.37 | O |
| ATOM | 1491 | CB | ARG | A | 181 | 33.628 | 43.124 | −9.802 | 1.00 | 42.85 | C |
| ATOM | 1492 | CG | ARG | A | 181 | 34.089 | 41.694 | −9.534 | 1.00 | 47.54 | C |
| ATOM | 1493 | CD | ARG | A | 181 | 35.550 | 41.577 | −9.087 | 1.00 | 45.09 | C |
| ATOM | 1494 | NE | ARG | A | 181 | 35.758 | 40.239 | −8.535 | 1.00 | 49.26 | N |
| ATOM | 1495 | CZ | ARG | A | 181 | 36.053 | 39.989 | −7.266 | 1.00 | 46.38 | C |
| ATOM | 1496 | NH1 | ARG | A | 181 | 36.240 | 40.988 | −6.415 | 1.00 | 47.57 | N1+ |
| ATOM | 1497 | NH2 | ARG | A | 181 | 36.183 | 38.736 | −6.855 | 1.00 | 44.79 | N |
| ATOM | 1498 | N | THR | A | 182 | 33.827 | 46.071 | −9.726 | 1.00 | 40.37 | N |

TABLE 77-continued

| ATOM | 1499 | CA  | THR | A | 182 | 33.532 | 47.431 | −10.131 | 1.00 | 41.99 | C   |
|------|------|-----|-----|---|-----|--------|--------|---------|------|-------|-----|
| ATOM | 1500 | C   | THR | A | 182 | 33.557 | 47.506 | −11.645 | 1.00 | 43.20 | C   |
| ATOM | 1501 | O   | THR | A | 182 | 34.198 | 46.697 | −12.320 | 1.00 | 46.16 | O   |
| ATOM | 1502 | CB  | THR | A | 182 | 34.541 | 48.445 | −9.576  | 1.00 | 43.85 | C   |
| ATOM | 1503 | OG1 | THR | A | 182 | 35.862 | 48.050 | −9.973  | 1.00 | 44.69 | O   |
| ATOM | 1504 | CG2 | THR | A | 182 | 34.446 | 48.569 | −8.054  | 1.00 | 42.10 | C   |
| ATOM | 1505 | N   | ASP | A | 183 | 32.855 | 48.507 | −12.162 | 1.00 | 43.53 | N   |
| ATOM | 1506 | CA  | ASP | A | 183 | 32.864 | 48.837 | −13.579 | 1.00 | 43.79 | C   |
| ATOM | 1507 | C   | ASP | A | 183 | 33.235 | 50.314 | −13.672 | 1.00 | 44.27 | C   |
| ATOM | 1508 | O   | ASP | A | 183 | 32.472 | 51.177 | −13.230 | 1.00 | 39.37 | O   |
| ATOM | 1509 | CB  | ASP | A | 183 | 31.503 | 48.546 | −14.196 | 1.00 | 46.79 | C   |
| ATOM | 1510 | CG  | ASP | A | 183 | 31.586 | 48.226 | −15.661 | 1.00 | 61.12 | C   |
| ATOM | 1511 | OD1 | ASP | A | 183 | 32.223 | 49.000 | −16.416 | 1.00 | 64.89 | O   |
| ATOM | 1512 | OD2 | ASP | A | 183 | 31.018 | 47.184 | −16.048 | 1.00 | 74.86 | O1− |
| ATOM | 1513 | N   | ALA | A | 184 | 34.431 | 50.602 | −14.179 | 1.00 | 41.90 | N   |
| ATOM | 1514 | CA  | ALA | A | 184 | 34.946 | 51.959 | −14.144 | 1.00 | 38.72 | C   |
| ATOM | 1515 | C   | ALA | A | 184 | 34.180 | 52.836 | −15.133 | 1.00 | 33.81 | C   |
| ATOM | 1516 | O   | ALA | A | 184 | 33.779 | 52.364 | −16.197 | 1.00 | 39.22 | O   |
| ATOM | 1517 | CB  | ALA | A | 184 | 36.447 | 51.982 | −14.482 | 1.00 | 38.38 | C   |
| ATOM | 1518 | N   | PRO | A | 185 | 33.957 | 54.105 | −14.812 | 1.00 | 37.44 | N   |
| ATOM | 1519 | CA  | PRO | A | 185 | 33.252 | 54.988 | −15.759 | 1.00 | 41.55 | C   |
| ATOM | 1520 | C   | PRO | A | 185 | 34.054 | 55.235 | −17.036 | 1.00 | 41.56 | C   |
| ATOM | 1521 | O   | PRO | A | 185 | 35.263 | 55.463 | −17.003 | 1.00 | 41.32 | O   |
| ATOM | 1522 | CB  | PRO | A | 185 | 33.061 | 56.279 | −14.958 | 1.00 | 40.12 | C   |
| ATOM | 1523 | CG  | PRO | A | 185 | 34.159 | 56.242 | −13.916 | 1.00 | 45.69 | C   |
| ATOM | 1524 | CD  | PRO | A | 185 | 34.282 | 54.792 | −13.546 | 1.00 | 36.89 | C   |
| ATOM | 1525 | N   | LYS | A | 186 | 33.372 | 55.149 | −18.173 | 1.00 | 42.61 | N   |
| ATOM | 1526 | CA  | LYS | A | 186 | 33.895 | 55.674 | −19.426 | 1.00 | 40.86 | C   |
| ATOM | 1527 | C   | LYS | A | 186 | 33.484 | 57.137 | −19.499 | 1.00 | 45.46 | C   |
| ATOM | 1528 | O   | LYS | A | 186 | 32.310 | 57.470 | −19.298 | 1.00 | 38.98 | O   |
| ATOM | 1529 | CB  | LYS | A | 186 | 33.367 | 54.900 | −20.635 | 1.00 | 43.18 | C   |
| ATOM | 1530 | CG  | LYS | A | 186 | 33.721 | 53.397 | −20.624 | 1.00 | 48.79 | C   |
| ATOM | 1531 | CD  | LYS | A | 186 | 32.702 | 52.576 | −19.805 | 1.00 | 49.83 | C   |
| ATOM | 1532 | CE  | LYS | A | 186 | 33.332 | 51.349 | −19.140 | 1.00 | 53.82 | C   |
| ATOM | 1533 | NZ  | LYS | A | 186 | 32.521 | 50.825 | −17.983 | 1.00 | 46.25 | N1+ |
| ATOM | 1534 | N   | THR | A | 187 | 34.451 | 58.011 | −19.741 | 1.00 | 37.61 | N   |
| ATOM | 1535 | CA  | THR | A | 187 | 34.223 | 59.433 | −19.575 | 1.00 | 38.89 | C   |
| ATOM | 1536 | C   | THR | A | 187 | 34.368 | 60.155 | −20.907 | 1.00 | 45.18 | C   |
| ATOM | 1537 | O   | THR | A | 187 | 35.029 | 59.683 | −21.836 | 1.00 | 45.92 | O   |
| ATOM | 1538 | CB  | THR | A | 187 | 35.173 | 60.019 | −18.521 | 1.00 | 44.47 | C   |
| ATOM | 1539 | OG1 | THR | A | 187 | 36.519 | 59.692 | −18.872 | 1.00 | 43.49 | O   |
| ATOM | 1540 | CG2 | THR | A | 187 | 34.879 | 59.418 | −17.137 | 1.00 | 37.42 | C   |
| ATOM | 1541 | N   | HIS | A | 188 | 33.702 | 61.301 | −20.991 | 1.00 | 44.97 | N   |
| ATOM | 1542 | CA  | HIS | A | 188 | 33.679 | 62.135 | −22.182 | 1.00 | 46.98 | C   |
| ATOM | 1543 | C   | HIS | A | 188 | 33.408 | 63.554 | −21.722 | 1.00 | 47.20 | C   |
| ATOM | 1544 | O   | HIS | A | 188 | 32.794 | 63.767 | −20.673 | 1.00 | 44.16 | O   |
| ATOM | 1545 | CB  | HIS | A | 188 | 32.587 | 61.711 | −23.186 | 1.00 | 48.60 | C   |
| ATOM | 1546 | CG  | HIS | A | 188 | 32.982 | 60.579 | −24.086 | 1.00 | 66.84 | C   |
| ATOM | 1547 | ND1 | HIS | A | 188 | 33.343 | 59.335 | −23.613 | 1.00 | 68.89 | N   |
| ATOM | 1548 | CD2 | HIS | A | 188 | 33.053 | 60.499 | −25.438 | 1.00 | 75.39 | C   |
| ATOM | 1549 | CE1 | HIS | A | 188 | 33.634 | 58.544 | −24.630 | 1.00 | 72.01 | C   |
| ATOM | 1550 | NE2 | HIS | A | 188 | 33.467 | 59.225 | −25.749 | 1.00 | 74.13 | N   |
| ATOM | 1551 | N   | MET | A | 189 | 33.839 | 64.524 | −22.518 | 1.00 | 43.07 | N   |
| ATOM | 1552 | CA  | MET | A | 189 | 33.430 | 65.897 | −22.293 | 1.00 | 41.53 | C   |
| ATOM | 1553 | C   | MET | A | 189 | 32.687 | 66.409 | −23.514 | 1.00 | 48.71 | C   |
| ATOM | 1554 | O   | MET | A | 189 | 33.008 | 66.058 | −24.656 | 1.00 | 44.31 | O   |
| ATOM | 1555 | CB  | MET | A | 189 | 34.596 | 66.825 | −21.973 | 1.00 | 45.56 | C   |
| ATOM | 1556 | CG  | MET | A | 189 | 34.090 | 68.127 | −21.359 | 1.00 | 47.17 | C   |
| ATOM | 1557 | SD  | MET | A | 189 | 35.362 | 69.261 | −20.852 | 1.00 | 65.13 | S   |
| ATOM | 1558 | CE  | MET | A | 189 | 36.209 | 68.346 | −19.560 | 1.00 | 45.94 | C   |
| ATOM | 1559 | N   | THR | A | 190 | 31.693 | 67.239 | −23.253 | 1.00 | 46.29 | N   |
| ATOM | 1560 | CA  | THR | A | 190 | 30.888 | 67.841 | −24.290 | 1.00 | 43.38 | C   |
| ATOM | 1561 | C   | THR | A | 190 | 30.888 | 69.352 | −24.087 | 1.00 | 45.56 | C   |
| ATOM | 1562 | O   | THR | A | 190 | 31.089 | 69.845 | −22.973 | 1.00 | 45.47 | O   |
| ATOM | 1563 | CB  | THR | A | 190 | 29.479 | 67.209 | −24.257 | 1.00 | 49.98 | C   |
| ATOM | 1564 | OG1 | THR | A | 190 | 29.140 | 66.727 | −25.560 | 1.00 | 66.53 | O   |
| ATOM | 1565 | CG2 | THR | A | 190 | 28.432 | 68.150 | −23.711 | 1.00 | 45.26 | C   |
| ATOM | 1566 | N   | HIS | A | 191 | 30.694 | 70.086 | −25.178 | 1.00 | 44.83 | N   |
| ATOM | 1567 | CA  | HIS | A | 191 | 30.768 | 71.540 | −25.177 | 1.00 | 46.94 | C   |
| ATOM | 1568 | C   | HIS | A | 191 | 29.598 | 72.088 | −25.985 | 1.00 | 54.48 | C   |
| ATOM | 1569 | O   | HIS | A | 191 | 29.257 | 71.545 | −27.037 | 1.00 | 54.32 | O   |
| ATOM | 1570 | CB  | HIS | A | 191 | 32.084 | 71.989 | −25.785 | 1.00 | 48.36 | C   |
| ATOM | 1571 | CG  | HIS | A | 191 | 32.214 | 73.468 | −25.977 | 1.00 | 56.60 | C   |
| ATOM | 1572 | ND1 | HIS | A | 191 | 32.122 | 74.066 | −27.215 | 1.00 | 58.62 | N   |
| ATOM | 1573 | CD2 | HIS | A | 191 | 32.490 | 74.462 | −25.099 | 1.00 | 52.83 | C   |
| ATOM | 1574 | CE1 | HIS | A | 191 | 32.310 | 75.367 | −27.089 | 1.00 | 55.78 | C   |
| ATOM | 1575 | NE2 | HIS | A | 191 | 32.535 | 75.634 | −25.815 | 1.00 | 58.02 | N   |
| ATOM | 1576 | N   | HIS | A | 192 | 28.970 | 73.150 | −25.491 | 1.00 | 51.69 | N   |
| ATOM | 1577 | CA  | HIS | A | 192 | 27.922 | 73.803 | −26.266 | 1.00 | 60.56 | C   |
| ATOM | 1578 | C   | HIS | A | 192 | 27.933 | 75.298 | −25.974 | 1.00 | 56.12 | C   |

TABLE 77-continued

| | | | | | | | | | | |
|---|---|---|---|---|---|---|---|---|---|---|
| ATOM | 1579 | O | HIS | A | 192 | 27.992 | 75.716 | −24.813 | 1.00 | 54.05 | O |
| ATOM | 1580 | CB | HIS | A | 192 | 26.546 | 73.193 | −25.964 | 1.00 | 62.31 | C |
| ATOM | 1581 | CG | HIS | A | 192 | 26.297 | 71.895 | −26.667 | 1.00 | 64.18 | C |
| ATOM | 1582 | ND1 | HIS | A | 192 | 26.482 | 70.670 | −26.063 | 1.00 | 65.26 | N |
| ATOM | 1583 | CD2 | HIS | A | 192 | 25.894 | 71.632 | −27.934 | 1.00 | 71.09 | C |
| ATOM | 1584 | CE1 | HIS | A | 192 | 26.199 | 69.708 | −26.925 | 1.00 | 66.94 | C |
| ATOM | 1585 | NE2 | HIS | A | 192 | 25.835 | 70.266 | −28.066 | 1.00 | 74.97 | N |
| ATOM | 1586 | N | ALA | A | 193 | 27.915 | 76.101 | −27.030 | 1.00 | 60.57 | N |
| ATOM | 1587 | CA | ALA | A | 193 | 27.853 | 77.544 | −26.865 | 1.00 | 65.73 | C |
| ATOM | 1588 | C | ALA | A | 193 | 26.421 | 77.966 | −26.550 | 1.00 | 64.89 | C |
| ATOM | 1589 | O | ALA | A | 193 | 25.486 | 77.610 | −27.272 | 1.00 | 71.48 | O |
| ATOM | 1590 | CB | ALA | A | 193 | 28.362 | 78.245 | −28.124 | 1.00 | 65.17 | C |
| ATOM | 1591 | N | VAL | A | 194 | 26.253 | 78.683 | −25.437 | 1.00 | 64.78 | N |
| ATOM | 1592 | CA | VAL | A | 194 | 25.028 | 79.393 | −25.092 | 1.00 | 69.90 | C |
| ATOM | 1593 | C | VAL | A | 194 | 25.287 | 80.874 | −25.324 | 1.00 | 75.00 | C |
| ATOM | 1594 | O | VAL | A | 194 | 26.411 | 81.358 | −25.153 | 1.00 | 82.98 | O |
| ATOM | 1595 | CB | VAL | A | 194 | 24.599 | 79.118 | −23.631 | 1.00 | 72.84 | C |
| ATOM | 1596 | CG1 | VAL | A | 194 | 25.221 | 77.830 | −23.125 | 1.00 | 67.53 | C |
| ATOM | 1597 | CG2 | VAL | A | 194 | 24.969 | 80.275 | −22.708 | 1.00 | 73.08 | C |
| ATOM | 1598 | N | SER | A | 195 | 24.260 | 81.607 | −25.741 | 1.00 | 79.19 | N |
| ATOM | 1599 | CA | SER | A | 195 | 24.394 | 83.054 | −25.993 | 1.00 | 82.60 | C |
| ATOM | 1600 | C | SER | A | 195 | 25.583 | 83.263 | −26.935 | 1.00 | 83.44 | C |
| ATOM | 1601 | O | SER | A | 195 | 25.724 | 82.511 | −27.910 | 1.00 | 85.17 | O |
| ATOM | 1602 | CB | SER | A | 195 | 24.490 | 83.788 | −24.659 | 1.00 | 81.48 | C |
| ATOM | 1603 | OG | SER | A | 195 | 25.836 | 83.855 | −24.213 | 1.00 | 78.01 | O |
| ATOM | 1604 | N | ASP | A | 196 | 26.450 | 84.247 | −26.686 | 1.00 | 82.67 | N |
| ATOM | 1605 | CA | ASP | A | 196 | 27.694 | 84.416 | −27.432 | 1.00 | 85.36 | C |
| ATOM | 1606 | C | ASP | A | 196 | 28.886 | 84.707 | −26.536 | 1.00 | 80.43 | C |
| ATOM | 1607 | O | ASP | A | 196 | 30.021 | 84.637 | −27.016 | 1.00 | 80.97 | O |
| ATOM | 1608 | CB | ASP | A | 196 | 27.565 | 85.547 | −28.469 | 1.00 | 87.91 | C |
| ATOM | 1609 | CG | ASP | A | 196 | 26.972 | 85.073 | −29.797 | 1.00 | 90.09 | C |
| ATOM | 1610 | OD1 | ASP | A | 196 | 27.636 | 84.285 | −30.509 | 1.00 | 82.28 | O |
| ATOM | 1611 | OD2 | ASP | A | 196 | 25.839 | 85.494 | −30.128 | 1.00 | 90.57 | O |
| ATOM | 1612 | N | HIS | A | 197 | 28.671 | 85.041 | −25.266 | 1.00 | 76.42 | N |
| ATOM | 1613 | CA | HIS | A | 197 | 29.726 | 85.300 | −24.297 | 1.00 | 76.53 | C |
| ATOM | 1614 | C | HIS | A | 197 | 29.90€ | 84.154 | −23.306 | 1.00 | 76.22 | C |
| ATOM | 1615 | O | HIS | A | 197 | 30.725 | 84.262 | −22.386 | 1.00 | 69.98 | O |
| ATOM | 1616 | CB | HIS | A | 197 | 29.411 | 86.591 | −23.539 | 1.00 | 75.66 | C |
| ATOM | 1617 | CG | HIS | A | 197 | 27.976 | 86.698 | −23.126 | 1.00 | 86.33 | C |
| ATOM | 1618 | ND1 | HIS | A | 197 | 27.429 | 85.920 | −22.129 | 1.00 | 90.26 | N |
| ATOM | 1619 | CD2 | HIS | A | 197 | 26.965 | 87.461 | −23.604 | 1.00 | 90.67 | C |
| ATOM | 1620 | CE1 | HIS | A | 197 | 26.147 | 86.212 | −21.997 | 1.00 | 89.50 | C |
| ATOM | 1621 | NE2 | HIS | A | 197 | 25.840 | 87.145 | −22.880 | 1.00 | 91.45 | N |
| ATOM | 1622 | N | GLU | A | 198 | 29.156 | 83.067 | −23.463 | 1.00 | 71.38 | N |
| ATOM | 1623 | CA | GLU | A | 198 | 29.195 | 81.972 | −22.510 | 1.00 | 68.49 | C |
| ATOM | 1624 | C | GLU | A | 198 | 29.122 | 80.645 | −23.243 | 1.00 | 66.91 | C |
| ATOM | 1625 | O | GLU | A | 198 | 28.620 | 80.547 | −24.367 | 1.00 | 65.66 | O |
| ATOM | 1626 | CB | GLU | A | 198 | 28.045 | 82.040 | −21.503 | 1.00 | 73.93 | C |
| ATOM | 1627 | CG | GLU | A | 198 | 28.128 | 83.169 | −20.516 | 1.00 | 74.65 | C |
| ATOM | 1628 | CD | GLU | A | 198 | 26.846 | 83.313 | −19.726 | 1.00 | 87.51 | C |
| ATOM | 1629 | OE1 | GLU | A | 198 | 25.856 | 82.625 | −20.069 | 1.00 | 87.93 | O |
| ATOM | 1630 | OE2 | GLU | A | 198 | 26.823 | 84.113 | −18.767 | 1.00 | 96.02 | O |
| ATOM | 1631 | N | ALA | A | 199 | 29.619 | 79.615 | −22.574 | 1.00 | 53.03 | N |
| ATOM | 1632 | CA | ALA | A | 199 | 29.468 | 78.270 | −23.094 | 1.00 | 56.68 | C |
| ATOM | 1633 | C | ALA | A | 199 | 29.283 | 77.341 | −21.910 | 1.00 | 50.56 | C |
| ATOM | 1634 | O | ALA | A | 199 | 29.602 | 77.701 | −20.774 | 1.00 | 52.07 | O |
| ATOM | 1635 | CB | ALA | A | 199 | 30.663 | 77.849 | −23.950 | 1.00 | 53.27 | C |
| ATOM | 1636 | N | THR | A | 200 | 28.706 | 76.182 | −22.167 | 1.00 | 47.29 | N |
| ATOM | 1637 | CA | THR | A | 200 | 28.617 | 75.172 | −21.137 | 1.00 | 49.05 | C |
| ATOM | 1638 | C | THR | A | 200 | 29.544 | 74.018 | −21.491 | 1.00 | 48.78 | C |
| ATOM | 1639 | O | THR | A | 200 | 29.634 | 73.600 | −22.653 | 1.00 | 49.90 | O |
| ATOM | 1640 | CB | THR | A | 200 | 27.177 | 74.683 | −20.952 | 1.00 | 52.61 | C |
| ATOM | 1641 | OG1 | THR | A | 200 | 27.166 | 73.609 | −20.002 | 1.00 | 57.10 | O |
| ATOM | 1642 | CG2 | THR | A | 200 | 26.596 | 74.205 | −22.254 | 1.00 | 55.34 | C |
| ATOM | 1643 | N | LEU | A | 201 | 30.275 | 73.549 | −20.491 | 1.00 | 39.30 | N |
| ATOM | 1644 | CA | LEU | A | 201 | 31.022 | 72.307 | −20.571 | 1.00 | 40.13 | C |
| ATOM | 1645 | C | LEU | A | 201 | 30.278 | 71.250 | −19.771 | 1.00 | 40.51 | C |
| ATOM | 1646 | O | LEU | A | 201 | 29.814 | 71.524 | −18.665 | 1.00 | 40.21 | O |
| ATOM | 1647 | CB | LEU | A | 201 | 32.444 | 72.481 | −20.018 | 1.00 | 39.17 | C |
| ATOM | 1648 | CG | LEU | A | 201 | 33.306 | 73.477 | −20.786 | 1.00 | 43.50 | C |
| ATOM | 1649 | CD1 | LEU | A | 201 | 34.610 | 73.744 | −20.022 | 1.00 | 42.67 | C |
| ATOM | 1650 | CD2 | LEU | A | 201 | 33.602 | 72.937 | −22.175 | 1.00 | 42.56 | C |
| ATOM | 1651 | N | ARG | A | 202 | 30.172 | 70.044 | −20.325 | 1.00 | 37.55 | N |
| ATOM | 1652 | CA | ARG | A | 202 | 29.477 | 68.954 | −19.656 | 1.00 | 42.84 | C |
| ATOM | 1653 | C | ARG | A | 202 | 30.396 | 67.748 | −19.582 | 1.00 | 43.86 | C |
| ATOM | 1654 | O | ARG | A | 202 | 30.889 | 67.265 | −20.608 | 1.00 | 39.97 | O |
| ATOM | 1655 | CB | ARG | A | 202 | 28.170 | 68.585 | −20.365 | 1.00 | 44.89 | C |
| ATOM | 1656 | CG | ARG | A | 202 | 27.361 | 67.520 | −19.624 | 1.00 | 50.65 | C |
| ATOM | 1657 | CD | ARG | A | 202 | 26.000 | 67.225 | −20.279 | 1.00 | 52.84 | C |
| ATOM | 1658 | NE | ARG | A | 202 | 25.537 | 68.305 | −21.142 | 1.00 | 63.47 | N |

TABLE 77-continued

| | | | | | | | | | | |
|---|---|---|---|---|---|---|---|---|---|---|
| ATOM | 1659 | CZ | ARG | A | 202 | 24.917 | 69.390 | −20.701 | 1.00 | 59.31 C |
| ATOM | 1660 | NH1 | ARG | A | 202 | 24.690 | 69.533 | −19.403 | 1.00 | 63.36 N1+ |
| ATOM | 1661 | NH2 | ARG | A | 202 | 24.533 | 70.325 | −21.554 | 1.00 | 63.45 N |
| ATOM | 1662 | N | CYS | A | 203 | 30.604 | 67.264 | −18.369 | 1.00 | 36.39 N |
| ATOM | 1663 | CA | CYS | A | 203 | 31.467 | 66.131 | −18.088 | 1.00 | 38.94 C |
| ATOM | 1664 | C | CYS | A | 203 | 30.619 | 64.871 | −17.909 | 1.00 | 42.61 C |
| ATOM | 1665 | O | CYS | A | 203 | 29.714 | 64.851 | −17.073 | 1.00 | 41.59 O |
| ATOM | 1666 | CB | CYS | A | 203 | 32.270 | 66.424 | −16.826 | 1.00 | 34.11 C |
| ATOM | 1667 | SG | CYS | A | 203 | 33.457 | 65.173 | −16.412 | 1.00 | 56.22 S |
| ATOM | 1668 | N | TRP | A | 204 | 30.911 | 63.834 | −18.690 | 1.00 | 35.88 N |
| ATOM | 1669 | CA | TRP | A | 204 | 30.105 | 62.616 | −18.758 | 1.00 | 38.91 C |
| ATOM | 1670 | C | TRP | A | 204 | 30.825 | 61.429 | −18.135 | 1.00 | 42.74 C |
| ATOM | 1671 | O | TRP | A | 204 | 31.973 | 61.127 | −18.496 | 1.00 | 36.36 O |
| ATOM | 1672 | CB | TRP | A | 204 | 29.767 | 62.256 | −20.208 | 1.00 | 39.27 C |
| ATOM | 1673 | CG | TRP | A | 204 | 28.653 | 63.038 | −20.797 | 1.00 | 45.86 C |
| ATOM | 1674 | CD1 | TRP | A | 204 | 28.754 | 64.132 | −21.613 | 1.00 | 48.24 C |
| ATOM | 1675 | CD2 | TRP | A | 204 | 27.254 | 62.791 | −20.620 | 1.00 | 43.47 C |
| ATOM | 1676 | NE1 | TRP | A | 204 | 27.496 | 64.580 | −21.954 | 1.00 | 48.79 N |
| ATOM | 1677 | CE2 | TRP | A | 204 | 26.560 | 63.769 | −21.361 | 1.00 | 57.69 C |
| ATOM | 1678 | CE3 | TRP | A | 204 | 26.520 | 61.833 | −19.909 | 1.00 | 48.00 C |
| ATOM | 1679 | CZ2 | TRP | A | 204 | 25.161 | 63.815 | −21.413 | 1.00 | 57.25 C |
| ATOM | 1680 | CZ3 | TRP | A | 204 | 25.131 | 61.878 | −19.960 | 1.00 | 51.77 C |
| ATOM | 1681 | CH2 | TRP | A | 204 | 24.469 | 62.865 | −20.707 | 1.00 | 54.15 C |
| ATOM | 1682 | N | ALA | A | 205 | 30.135 | 60.730 | −17.240 | 1.00 | 32.35 N |
| ATOM | 1683 | CA | ALA | A | 205 | 30.571 | 59.430 | −16.743 | 1.00 | 31.63 C |
| ATOM | 1684 | C | ALA | A | 205 | 29.547 | 58.396 | −17.174 | 1.00 | 39.99 C |
| ATOM | 1685 | O | ALA | A | 205 | 28.353 | 58.539 | −16.869 | 1.00 | 39.07 O |
| ATOM | 1686 | CB | ALA | A | 205 | 30.733 | 59.446 | −15.222 | 1.00 | 34.25 C |
| ATOM | 1687 | N | LEU | A | 206 | 29.999 | 57.362 | −17.885 | 1.00 | 35.16 N |
| ATOM | 1688 | CA | LEU | A | 206 | 29.084 | 56.387 | −18.465 | 1.00 | 38.04 C |
| ATOM | 1689 | C | LEU | A | 206 | 29.454 | 54.970 | −18.052 | 1.00 | 43.66 C |
| ATOM | 1690 | O | LEU | A | 206 | 30.636 | 54.620 | −17.943 | 1.00 | 39.54 O |
| ATOM | 1691 | CB | LEU | A | 206 | 29.057 | 56.464 | −20.006 | 1.00 | 39.22 C |
| ATOM | 1692 | CG | LEU | A | 206 | 28.620 | 57.814 | −20.587 | 1.00 | 43.57 C |
| ATOM | 1693 | CD1 | LEU | A | 206 | 28.788 | 57.831 | −22.106 | 1.00 | 44.36 C |
| ATOM | 1694 | CD2 | LEU | A | 206 | 27.173 | 58.108 | −20.199 | 1.00 | 42.90 C |
| ATOM | 1695 | N | SER | A | 207 | 28.414 | 54.168 | −17.836 | 1.00 | 35.15 N |
| ATOM | 1696 | CA | SER | A | 207 | 28.511 | 52.726 | −17.709 | 1.00 | 38.14 C |
| ATOM | 1697 | C | SER | A | 207 | 29.375 | 52.319 | −16.517 | 1.00 | 37.86 C |
| ATOM | 1698 | O | SER | A | 207 | 30.204 | 51.408 | −16.593 | 1.00 | 40.59 O |
| ATOM | 1699 | CB | SER | A | 207 | 29.014 | 52.111 | −19.013 | 1.00 | 41.16 C |
| ATOM | 1700 | OG | SER | A | 207 | 28.797 | 50.714 | −18.984 | 1.00 | 52.31 O |
| ATOM | 1701 | N | PHE | A | 208 | 29.164 | 52.989 | −15.396 | 1.00 | 36.62 N |
| ATOM | 1702 | CA | PHE | A | 208 | 29.900 | 52.645 | −14.195 | 1.00 | 38.53 C |
| ATOM | 1703 | C | PHE | A | 208 | 29.017 | 51.887 | −13.206 | 1.00 | 40.49 C |
| ATOM | 1704 | O | PHE | A | 208 | 27.773 | 51.946 | −13.252 | 1.00 | 32.84 O |
| ATOM | 1705 | CB | PHE | A | 208 | 30.508 | 53.891 | −13.543 | 1.00 | 35.05 C |
| ATOM | 1706 | CG | PHE | A | 208 | 29.525 | 54.977 | −13.266 | 1.00 | 38.44 C |
| ATOM | 1707 | CD1 | PHE | A | 208 | 29.208 | 55.914 | −14.250 | 1.00 | 39.90 C |
| ATOM | 1708 | CD2 | PHE | A | 208 | 28.937 | 55.092 | −12.010 | 1.00 | 36.24 C |
| ATOM | 1709 | CE1 | PHE | A | 208 | 28.301 | 56.941 | −13.986 | 1.00 | 39.24 C |
| ATOM | 1710 | CE2 | PHE | A | 208 | 28.036 | 56.095 | −11.737 | 1.00 | 38.41 C |
| ATOM | 1711 | CZ | PHE | A | 208 | 27.714 | 57.033 | −12.726 | 1.00 | 39.78 C |
| ATOM | 1712 | N | TYR | A | 209 | 29.697 | 51.129 | −12.334 | 1.00 | 38.43 N |
| ATOM | 1713 | CA | TYR | A | 209 | 29.096 | 50.400 | −11.209 | 1.00 | 38.18 C |
| ATOM | 1714 | C | TYR | A | 209 | 30.143 | 50.320 | −10.102 | 1.00 | 36.86 C |
| ATOM | 1715 | O | TYR | A | 209 | 31.306 | 49.987 | −10.393 | 1.00 | 38.36 O |
| ATOM | 1716 | CB | TYR | A | 209 | 28.631 | 48.986 | −11.575 | 1.00 | 37.26 C |
| ATOM | 1717 | CG | TYR | A | 209 | 27.898 | 48.341 | −10.424 | 1.00 | 38.63 C |
| ATOM | 1718 | CD1 | TYR | A | 209 | 26.513 | 48.488 | −10.295 | 1.00 | 36.31 C |
| ATOM | 1719 | CD2 | TYR | A | 209 | 28.590 | 47.638 | −9.427 | 1.00 | 35.07 C |
| ATOM | 1720 | CE1 | TYR | A | 209 | 25.832 | 47.932 | −9.232 | 1.00 | 37.38 C |
| ATOM | 1721 | CE2 | TYR | A | 209 | 27.920 | 47.079 | −8.354 | 1.00 | 36.87 C |
| ATOM | 1722 | CZ | TYR | A | 209 | 26.530 | 47.222 | −8.269 | 1.00 | 38.02 C |
| ATOM | 1723 | OH | TYR | A | 209 | 25.844 | 46.682 | −7.204 | 1.00 | 37.63 O |
| ATOM | 1724 | N | PRO | A | 210 | 29.781 | 50.602 | −8.842 | 1.00 | 38.21 N |
| ATOM | 1725 | CA | PRO | A | 210 | 28.451 | 50.987 | −8.344 | 1.00 | 38.18 C |
| ATOM | 1726 | C | PRO | A | 210 | 28.059 | 52.411 | −8.703 | 1.00 | 45.09 C |
| ATOM | 1727 | O | PRO | A | 210 | 28.831 | 53.120 | −9.370 | 1.00 | 44.37 O |
| ATOM | 1728 | CB | PRO | A | 210 | 28.591 | 50.841 | −6.823 | 1.00 | 44.52 C |
| ATOM | 1729 | CG | PRO | A | 210 | 30.054 | 51.153 | −6.571 | 1.00 | 38.67 C |
| ATOM | 1730 | CD | PRO | A | 210 | 30.772 | 50.522 | −7.751 | 1.00 | 44.16 C |
| ATOM | 1731 | N | ALA | A | 211 | 26.871 | 52.826 | −8.248 | 1.00 | 42.48 N |
| ATOM | 1732 | CA | ALA | A | 211 | 26.322 | 54.117 | −8.648 | 1.00 | 46.67 C |
| ATOM | 1733 | C | ALA | A | 211 | 27.016 | 55.292 | −7.968 | 1.00 | 50.22 C |
| ATOM | 1734 | O | ALA | A | 211 | 26.840 | 56.436 | −8.408 | 1.00 | 45.50 O |
| ATOM | 1735 | CB | ALA | A | 211 | 24.819 | 54.176 | −8.351 | 1.00 | 45.27 C |
| ATOM | 1736 | N | GLU | A | 212 | 27.770 | 55.050 | −6.900 | 1.00 | 45.28 N |
| ATOM | 1737 | CA | GLU | A | 212 | 28.380 | 56.161 | −6.184 | 1.00 | 48.72 C |
| ATOM | 1738 | C | GLU | A | 212 | 29.534 | 56.719 | −7.008 | 1.00 | 45.90 C |

TABLE 77-continued

| ATOM | 1739 | O | GLU | A | 212 | 30.429 | 55.978 | −7.433 | 1.00 | 42.67 | O |
|---|---|---|---|---|---|---|---|---|---|---|---|
| ATOM | 1740 | CB | GLU | A | 212 | 28.864 | 55.720 | −4.803 | 1.00 | 49.70 | C |
| ATOM | 1741 | CG | GLU | A | 212 | 29.614 | 56.809 | −4.013 | 1.00 | 61.97 | C |
| ATOM | 1742 | CD | GLU | A | 212 | 28.721 | 57.991 | −3.601 | 1.00 | 72.56 | C |
| ATOM | 1743 | OE1 | GLU | A | 212 | 28.303 | 58.793 | −4.475 | 1.00 | 69.38 | O |
| ATOM | 1744 | OE2 | GLU | A | 212 | 28.435 | 58.114 | −2.389 | 1.00 | 81.33 | O1− |
| ATOM | 1745 | N | ILE | A | 213 | 29.501 | 58.025 | −7.253 | 1.00 | 47.19 | N |
| ATOM | 1746 | CA | ILE | A | 213 | 30.527 | 58.669 | −8.063 | 1.00 | 45.93 | C |
| ATOM | 1747 | C | ILE | A | 213 | 30.593 | 60.132 | −7.660 | 1.00 | 44.40 | C |
| ATOM | 1748 | O | ILE | A | 213 | 29.624 | 60.700 | −7.159 | 1.00 | 46.00 | O |
| ATOM | 1749 | CB | ILE | A | 213 | 30.229 | 58.498 | −9.569 | 1.00 | 39.63 | C |
| ATOM | 1750 | CG1 | ILE | A | 213 | 31.433 | 58.882 | −10.429 | 1.00 | 41.41 | C |
| ATOM | 1751 | CG2 | ILE | A | 213 | 29.039 | 59.319 | −9.951 | 1.00 | 41.81 | C |
| ATOM | 1752 | CD1 | ILE | A | 213 | 31.300 | 58.367 | −11.876 | 1.00 | 38.65 | C |
| ATOM | 1753 | N | THR | A | 214 | 31.762 | 60.732 | −7.837 | 1.00 | 42.46 | N |
| ATOM | 1754 | CA | THR | A | 214 | 31.928 | 62.160 | −7.594 | 1.00 | 49.17 | C |
| ATOM | 1755 | C | THR | A | 214 | 32.459 | 62.795 | −8.867 | 1.00 | 47.55 | C |
| ATOM | 1756 | O | THR | A | 214 | 33.490 | 62.363 | −9.397 | 1.00 | 42.13 | O |
| ATOM | 1757 | CB | THR | A | 214 | 32.871 | 62.429 | −6.418 | 1.00 | 50.27 | C |
| ATOM | 1758 | OG1 | THR | A | 214 | 32.286 | 61.910 | −5.216 | 1.00 | 54.55 | O |
| ATOM | 1759 | CG2 | THR | A | 214 | 33.071 | 63.913 | −6.248 | 1.00 | 51.39 | C |
| ATOM | 1760 | N | LEU | A | 215 | 31.719 | 63.769 | −9.385 | 1.00 | 46.29 | N |
| ATOM | 1761 | CA | LEU | A | 215 | 32.168 | 64.611 | −10.483 | 1.00 | 49.74 | C |
| ATOM | 1762 | C | LEU | A | 215 | 32.309 | 66.018 | −9.939 | 1.00 | 50.61 | C |
| ATOM | 1763 | O | LEU | A | 215 | 31.366 | 66.543 | −9.338 | 1.00 | 48.73 | O |
| ATOM | 1764 | CB | LEU | A | 215 | 31.178 | 64.606 | −11.647 | 1.00 | 49.79 | C |
| ATOM | 1765 | CG | LEU | A | 215 | 30.625 | 63.266 | −12.119 | 1.00 | 48.73 | C |
| ATOM | 1766 | CD1 | LEU | A | 215 | 29.554 | 63.486 | −13.186 | 1.00 | 47.21 | C |
| ATOM | 1767 | CD2 | LEU | A | 215 | 31.743 | 62.406 | −12.643 | 1.00 | 40.95 | C |
| ATOM | 1768 | N | THR | A | 216 | 33.486 | 66.618 | −10.115 | 1.00 | 44.18 | N |
| ATOM | 1769 | CA | THR | A | 216 | 33.700 | 67.972 | −9.625 | 1.00 | 51.51 | C |
| ATOM | 1770 | C | THR | A | 216 | 34.450 | 68.789 | −10.668 | 1.00 | 46.56 | C |
| ATOM | 1771 | O | THR | A | 216 | 35.325 | 68.285 | −11.373 | 1.00 | 45.82 | O |
| ATOM | 1772 | CB | THR | A | 216 | 34.481 | 67.997 | −8.307 | 1.00 | 51.21 | C |
| ATOM | 1773 | OG1 | THR | A | 216 | 35.710 | 67.296 | −8.486 | 1.00 | 49.64 | O |
| ATOM | 1774 | CG2 | THR | A | 216 | 33.673 | 67.356 | −7.173 | 1.00 | 52.02 | C |
| ATOM | 1775 | N | TRP | A | 217 | 34.088 | 70.057 | −10.752 | 1.00 | 45.03 | N |
| ATOM | 1776 | CA | TRP | A | 217 | 34.693 | 70.992 | −11.688 | 1.00 | 48.37 | C |
| ATOM | 1777 | C | TRP | A | 217 | 35.723 | 71.847 | −10.970 | 1.00 | 47.27 | C |
| ATOM | 1778 | O | TRP | A | 217 | 35.505 | 72.286 | −9.838 | 1.00 | 47.61 | O |
| ATOM | 1779 | CB | TRP | A | 217 | 33.630 | 71.888 | −12.324 | 1.00 | 45.02 | C |
| ATOM | 1780 | CG | TRP | A | 217 | 32.937 | 71.235 | −13.490 | 1.00 | 45.84 | C |
| ATOM | 1781 | CD1 | TRP | A | 217 | 31.673 | 70.730 | −13.518 | 1.00 | 49.25 | C |
| ATOM | 1782 | CD2 | TRP | A | 217 | 33.473 | 71.042 | −14.802 | 1.00 | 46.64 | C |
| ATOM | 1783 | NE1 | TRP | A | 217 | 31.388 | 70.225 | −14.768 | 1.00 | 46.01 | N |
| ATOM | 1784 | CE2 | TRP | A | 217 | 32.479 | 70.400 | −15.573 | 1.00 | 48.35 | C |
| ATOM | 1785 | CE3 | TRP | A | 217 | 34.696 | 71.335 | −15.397 | 1.00 | 44.35 | C |
| ATOM | 1786 | CZ2 | TRP | A | 217 | 32.678 | 70.051 | −16.907 | 1.00 | 47.18 | C |
| ATOM | 1787 | CZ3 | TRP | A | 217 | 34.893 | 70.990 | −16.720 | 1.00 | 50.75 | C |
| ATOM | 1788 | CH2 | TRP | A | 217 | 33.890 | 70.361 | −17.462 | 1.00 | 45.33 | C |
| ATOM | 1789 | N | GLN | A | 218 | 36.848 | 72.080 | −11.629 | 1.00 | 43.91 | N |
| ATOM | 1790 | CA | GLN | A | 218 | 37.815 | 73.050 | −11.152 | 1.00 | 41.49 | C |
| ATOM | 1791 | C | GLN | A | 218 | 38.084 | 74.091 | −12.231 | 1.00 | 44.00 | C |
| ATOM | 1792 | O | GLN | A | 218 | 38.079 | 73.790 | −13.429 | 1.00 | 41.16 | O |
| ATOM | 1793 | CB | GLN | A | 218 | 39.128 | 72.374 | −10.740 | 1.00 | 43.55 | C |
| ATOM | 1794 | CG | GLN | A | 218 | 38.975 | 71.374 | −9.606 | 1.00 | 46.89 | C |
| ATOM | 1795 | CD | GLN | A | 218 | 40.303 | 70.807 | −9.129 | 1.00 | 60.80 | C |
| ATOM | 1796 | OET | GLN | A | 218 | 41.227 | 70.588 | −9.922 | 1.00 | 57.59 | O |
| ATOM | 1797 | NE2 | GLN | A | 218 | 40.408 | 70.575 | −7.820 | 1.00 | 64.54 | N |
| ATOM | 1798 | N | ARG | A | 219 | 38.317 | 75.322 | −11.786 | 1.00 | 44.77 | N |
| ATOM | 1799 | CA | ARG | A | 219 | 38.800 | 76.407 | −12.629 | 1.00 | 45.38 | C |
| ATOM | 1800 | C | ARG | A | 219 | 40.220 | 76.730 | −12.182 | 1.00 | 42.85 | C |
| ATOM | 1801 | O | ARG | A | 219 | 40.434 | 77.126 | −11.030 | 1.00 | 40.60 | O |
| ATOM | 1802 | CB | ARG | A | 219 | 37.890 | 77.625 | −12.505 | 1.00 | 49.87 | C |
| ATOM | 1803 | CG | ARG | A | 219 | 38.256 | 78.805 | −13.383 | 1.00 | 50.91 | C |
| ATOM | 1804 | CD | ARG | A | 219 | 37.242 | 79.911 | −13.140 | 1.00 | 55.82 | C |
| ATOM | 1805 | NE | ARG | A | 219 | 37.814 | 81.109 | −12.540 | 1.00 | 62.60 | N |
| ATOM | 1806 | CZ | ARG | A | 219 | 37.987 | 82.247 | −13.202 | 1.00 | 70.24 | C |
| ATOM | 1807 | NH1 | ARG | A | 219 | 37.621 | 82.316 | −14.477 | 1.00 | 66.14 | N1+ |
| ATOM | 1808 | NH2 | ARG | A | 219 | 38.521 | 83.309 | −12.594 | 1.00 | 71.88 | N |
| ATOM | 1809 | N | ASP | A | 220 | 41.191 | 76.534 | −13.076 | 1.00 | 42.12 | N |
| ATOM | 1810 | CA | ASP | A | 220 | 42.605 | 76.753 | −12.729 | 1.00 | 42.83 | C |
| ATOM | 1811 | C | ASP | A | 220 | 42.996 | 75.935 | −11.501 | 1.00 | 44.31 | C |
| ATOM | 1812 | O | ASP | A | 220 | 43.66 | 76.431 | −10.588 | 1.00 | 41.85 | O |
| ATOM | 1813 | CB | ASP | A | 220 | 42.897 | 78.241 | −12.480 | 1.00 | 42.97 | C |
| ATOM | 1814 | CG | ASP | A | 220 | 42.946 | 79.060 | −13.759 | 1.00 | 51.11 | C |
| ATOM | 1815 | OD1 | ASP | A | 220 | 42.945 | 78.472 | −14.860 | 1.00 | 49.59 | O |
| ATOM | 1816 | OD2 | ASP | A | 220 | 43.012 | 80.306 | −13.655 | 1.00 | 55.66 | O1− |
| ATOM | 1817 | N | GLY | A | 221 | 42.528 | 74.686 | −11.451 | 1.00 | 48.54 | N |
| ATOM | 1818 | CA | GLY | A | 221 | 42.854 | 73.784 | −10.365 | 1.00 | 44.41 | C |

TABLE 77-continued

| | | | | | | | | | | |
|---|---|---|---|---|---|---|---|---|---|---|
| ATOM | 1819 | C | GLY | A | 221 | 42.174 | 74.061 | −9.044 | 1.00 | 47.64 C |
| ATOM | 1820 | O | GLY | A | 221 | 42.562 | 73.465 | −8.038 | 1.00 | 52.72 O |
| ATOM | 1821 | N | GLU | A | 222 | 41.181 | 74.946 | −9.003 | 1.00 | 47.64 N |
| ATOM | 1822 | CA | GLU | A | 222 | 40.470 | 75.284 | −7.775 | 1.00 | 50.33 C |
| ATOM | 1823 | C | GLU | A | 222 | 38.999 | 74.938 | −7.946 | 1.00 | 53.36 C |
| ATOM | 1824 | O | GLU | A | 222 | 38.394 | 75.306 | −8.960 | 1.00 | 52.37 O |
| ATOM | 1825 | CB | GLU | A | 222 | 40.624 | 76.772 | −7.442 | 1.00 | 54.30 C |
| ATOM | 1826 | CG | GLU | A | 222 | 42.061 | 77.267 | −7.287 | 1.00 | 56.20 C |
| ATOM | 1827 | CD | GLU | A | 222 | 42.583 | 77.135 | −5.862 | 1.00 | 71.48 C |
| ATOM | 1828 | OE1 | GLU | A | 222 | 41.804 | 76.696 | −4.983 | 1.00 | 76.62 O |
| ATOM | 1829 | OE2 | GLU | A | 222 | 43.770 | 77.470 | −5.621 | 1.00 | 68.31 O1− |
| ATOM | 1830 | N | ASP | A | 223 | 38.422 | 74.245 | −6.955 | 1.00 | 54.94 N |
| ATOM | 1831 | CA | ASP | A | 223 | 37.041 | 73.782 | −7.076 | 1.00 | 59.03 C |
| ATOM | 1832 | C | ASP | A | 223 | 36.098 | 74.964 | −7.250 | 1.00 | 57.03 C |
| ATOM | 1833 | O | ASP | A | 223 | 36.312 | 76.034 | −6.679 | 1.00 | 60.12 O |
| ATOM | 1834 | CB | ASP | A | 223 | 36.630 | 72.955 | −5.853 | 1.00 | 64.19 C |
| ATOM | 1835 | CG | ASP | A | 223 | 37.143 | 71.513 | −5.916 | 1.00 | 70.54 C |
| ATOM | 1836 | OD1 | ASP | A | 223 | 38.117 | 71.251 | −6.648 | 1.00 | 68.91 O |
| ATOM | 1837 | OD2 | ASP | A | 223 | 36.567 | 70.629 | −5.243 | 1.00 | 78.33 O |
| ATOM | 1838 | N | GLN | A | 224 | 35.056 | 74.779 | −8.060 | 1.00 | 58.65 N |
| ATOM | 1839 | CA | GLN | A | 224 | 34.160 | 75.877 | −8.413 | 1.00 | 68.36 C |
| ATOM | 1840 | C | GLN | A | 224 | 32.800 | 75.760 | −7.729 | 1.00 | 71.20 C |
| ATOM | 1841 | O | GLN | A | 224 | 32.478 | 76.582 | −6.865 | 1.00 | 78.82 O |
| ATOM | 1842 | CB | GLN | A | 224 | 34.003 | 75.975 | −9.931 | 1.00 | 61.48 C |
| ATOM | 1843 | CG | GLN | A | 224 | 34.689 | 77.202 | −10.546 | 1.00 | 63.59 C |
| ATOM | 1844 | CD | GLN | A | 224 | 33.788 | 77.953 | −11.517 | 1.00 | 66.62 C |
| ATOM | 1845 | OE1 | GLN | A | 224 | 32.581 | 77.712 | −11.581 | 1.00 | 69.67 O |
| ATOM | 1846 | NE2 | GLN | A | 224 | 34.374 | 78.862 | −12.280 | 1.00 | 68.90 N |
| ATOM | 1847 | N | THR | A | 225 | 31.986 | 74.772 | −8.101 | 1.00 | 67.06 N |
| ATOM | 1848 | CA | THR | A | 225 | 30.631 | 74.575 | −7.576 | 1.00 | 72.04 C |
| ATOM | 1849 | C | THR | A | 225 | 29.648 | 75.671 | −8.007 | 1.00 | 73.24 C |
| ATOM | 1850 | O | THR | A | 225 | 28.507 | 75.364 | −8.364 | 1.00 | 73.52 O |
| ATOM | 1851 | CB | THR | A | 225 | 30.648 | 74.446 | −6.048 | 1.00 | 72.17 C |
| ATOM | 1852 | OG1 | THR | A | 225 | 31.711 | 73.567 | −5.652 | 1.00 | 74.95 O |
| ATOM | 1853 | CG2 | THR | A | 225 | 29.336 | 73.866 | −5.556 | 1.00 | 74.30 C |
| ATOM | 1854 | N | GLN | A | 226 | 30.050 | 76.941 | −7.994 | 1.00 | 77.19 N |
| ATOM | 1855 | CA | GLN | A | 226 | 29.169 | 77.982 | −8.515 | 1.00 | 73.83 C |
| ATOM | 1856 | C | GLN | A | 226 | 29.045 | 77.871 | −10.031 | 1.00 | 72.47 C |
| ATOM | 1857 | O | GLN | A | 226 | 29.983 | 77.471 | −10.725 | 1.00 | 66.55 O |
| ATOM | 1858 | CB | GLN | A | 226 | 29.673 | 79.374 | −8.136 | 1.00 | 74.55 C |
| ATOM | 1859 | CG | GLN | A | 226 | 29.297 | 79.794 | −6.722 | 1.00 | 85.16 C |
| ATOM | 1860 | CD | GLN | A | 226 | 27.806 | 79.643 | −6.438 | 1.00 | 88.23 C |
| ATOM | 1861 | OE1 | GLN | A | 226 | 26.964 | 80.211 | −7.138 | 1.00 | 90.40 O |
| ATOM | 1862 | NE2 | GLN | A | 226 | 27.476 | 78.868 | −5.407 | 1.00 | 84.76 N |
| ATOM | 1863 | N | ASP | A | 227 | 27.866 | 78.228 | −10.546 | 1.00 | 68.36 N |
| ATOM | 1864 | CA | ASP | A | 227 | 27.533 | 78.090 | −11.967 | 1.00 | 71.97 C |
| ATOM | 1865 | C | ASP | A | 227 | 27.682 | 76.648 | −12.466 | 1.00 | 66.74 C |
| ATOM | 1866 | O | ASP | A | 227 | 27.836 | 76.415 | −13.673 | 1.00 | 58.94 O |
| ATOM | 1867 | CB | ASP | A | 227 | 28.375 | 79.036 | −12.840 | 1.00 | 67.52 C |
| ATOM | 1868 | CG | ASP | A | 227 | 27.916 | 80.485 | −12.751 | 1.00 | 76.85 C |
| ATOM | 1869 | OD1 | ASP | A | 227 | 26.718 | 80.746 | −13.000 | 1.00 | 73.28 O |
| ATOM | 1870 | OD2 | ASP | A | 227 | 28.753 | 81.362 | −12.432 | 1.00 | 71.72 O |
| ATOM | 1871 | N | THR | A | 228 | 27.639 | 75.671 | −11.563 | 1.00 | 65.47 N |
| ATOM | 1872 | CA | THR | A | 228 | 27.642 | 74.264 | −11.934 | 1.00 | 63.67 C |
| ATOM | 1873 | C | THR | A | 228 | 26.255 | 73.659 | −11.757 | 1.00 | 62.61 C |
| ATOM | 1874 | O | THR | A | 228 | 25.422 | 74.156 | −10.993 | 1.00 | 60.11 O |
| ATOM | 1875 | CB | THR | A | 228 | 28.648 | 73.456 | −11.099 | 1.00 | 64.82 C |
| ATOM | 1876 | OG1 | THR | A | 228 | 28.144 | 73.290 | −9.770 | 1.00 | 66.94 O |
| ATOM | 1877 | CG2 | THR | A | 228 | 29.989 | 74.154 | −11.023 | 1.00 | 63.31 C |
| ATOM | 1878 | N | GLU | A | 229 | 26.019 | 72.566 | −12.481 | 1.00 | 54.08 N |
| ATOM | 1879 | CA | GLU | A | 229 | 24.853 | 71.732 | −12.257 | 1.00 | 59.92 C |
| ATOM | 1880 | C | GLU | A | 229 | 25.264 | 70.269 | −12.362 | 1.00 | 59.77 C |
| ATOM | 1881 | O | GLU | A | 229 | 26.158 | 69.903 | −13.133 | 1.00 | 55.79 O |
| ATOM | 1882 | CB | GLU | A | 229 | 23.709 | 72.053 | −13.244 | 1.00 | 62.78 C |
| ATOM | 1883 | CG | GLU | A | 229 | 24.179 | 72.189 | −14.683 | 1.00 | 67.90 C |
| ATOM | 1884 | CD | GLU | A | 229 | 23.053 | 72.424 | −15.669 | 1.00 | 73.52 C |
| ATOM | 1885 | OE1 | GLU | A | 229 | 21.882 | 72.520 | −15.230 | 1.00 | 75.17 O |
| ATOM | 1886 | OE2 | GLU | A | 229 | 23.351 | 72.509 | −16.887 | 1.00 | 74.34 O |
| ATOM | 1887 | N | LEU | A | 230 | 24.612 | 69.441 | −11.553 | 1.00 | 53.83 N |
| ATOM | 1888 | CA | LEU | A | 230 | 24.788 | 67.997 | −11.566 | 1.00 | 56.93 C |
| ATOM | 1889 | C | LEU | A | 230 | 23.438 | 67.356 | −11.823 | 1.00 | 57.14 C |
| ATOM | 1890 | O | LEU | A | 230 | 22.419 | 67.793 | −11.277 | 1.00 | 57.55 O |
| ATOM | 1891 | CB | LEU | A | 230 | 25.352 | 67.479 | −10.237 | 1.00 | 53.52 C |
| ATOM | 1892 | CG | LEU | A | 230 | 26.842 | 67.196 | −10.113 | 1.00 | 61.61 C |
| ATOM | 1893 | CD1 | LEU | A | 230 | 27.185 | 66.898 | −8.666 | 1.00 | 63.79 C |
| ATOM | 1894 | CD2 | LEU | A | 230 | 27.243 | 66.024 | −10.989 | 1.00 | 59.03 C |
| ATOM | 1895 | N | VAL | A | 231 | 23.421 | 66.346 | −12.639 | 1.00 | 51.15 N |
| ATOM | 1896 | CA | VAL | A | 231 | 22.216 | 65.537 | −12.737 | 1.00 | 53.85 C |
| ATOM | 1897 | C | VAL | A | 231 | 22.334 | 64.414 | −11.721 | 1.00 | 50.27 C |
| ATOM | 1898 | O | VAL | A | 231 | 23.434 | 63.937 | −11.413 | 1.00 | 49.59 O |

TABLE 77-continued

| | | | | | | | | | | |
|---|---|---|---|---|---|---|---|---|---|---|
| ATOM | 1899 | CB | VAL | A | 231 | 22.007 | 65.012 | −14.171 | 1.00 | 53.72 | C |
| ATOM | 1900 | CG1 | VAL | A | 231 | 22.906 | 63.829 | −14.441 | 1.00 | 45.30 | C |
| ATOM | 1901 | CG2 | VAL | A | 231 | 20.548 | 64.692 | −14.409 | 1.00 | 51.35 | C |
| ATOM | 1902 | N | GLU | A | 232 | 21.204 | 64.015 | −11.145 | 1.00 | 52.65 | N |
| ATOM | 1903 | CA | GLU | A | 232 | 21.215 | 62.826 | −10.311 | 1.00 | 49.93 | C |
| ATOM | 1904 | C | GLU | A | 232 | 21.642 | 61.632 | −11.154 | 1.00 | 44.47 | C |
| ATOM | 1905 | O | GLU | A | 232 | 21.383 | 61.565 | −12.357 | 1.00 | 46.76 | O |
| ATOM | 1906 | CB | GLU | A | 232 | 19.840 | 62.600 | −9.699 | 1.00 | 58.91 | C |
| ATOM | 1907 | CG | GLU | A | 232 | 18.722 | 62.878 | −10.688 | 1.00 | 57.29 | C |
| ATOM | 1908 | CD | GLU | A | 232 | 17.394 | 63.119 | −10.011 | 0.00 | 57.11 | C |
| ATOM | 1909 | OE1 | GLU | A | 232 | 17.355 | 63.811 | −8.973 | 1.00 | 67.13 | O |
| ATOM | 1910 | OE2 | GLU | A | 232 | 16.386 | 62.601 | −10.521 | 1.00 | 59.62 | O1− |
| ATOM | 1911 | N | THR | A | 233 | 22.369 | 60.718 | −10.534 | 1.00 | 50.46 | N |
| ATOM | 1912 | CA | THR | A | 233 | 22.797 | 59.533 | −11.254 | 1.00 | 46.86 | C |
| ATOM | 1913 | C | THR | A | 233 | 21.576 | 58.808 | −11.818 | 1.00 | 50.58 | C |
| ATOM | 1914 | O | THR | A | 233 | 20.520 | 58.744 | −11.178 | 1.00 | 48.47 | C |
| ATOM | 1915 | CB | THR | A | 233 | 23.608 | 58.646 | −10.317 | 1.00 | 50.42 | C |
| ATOM | 1916 | OG1 | THR | A | 233 | 24.726 | 59.404 | −9.837 | 1.00 | 54.25 | O |
| ATOM | 1917 | CG2 | THR | A | 233 | 24.128 | 57.410 | −11.035 | 1.00 | 44.08 | C |
| ATOM | 1918 | N | ARG | A | 234 | 21.695 | 58.322 | −13.050 | 1.00 | 41.62 | N |
| ATOM | 1919 | CA | ARG | A | 234 | 20.573 | 57.680 | −13.719 | 1.00 | 40.12 | C |
| ATOM | 1920 | C | ARG | A | 234 | 21.001 | 56.309 | −14.211 | 1.00 | 42.04 | C |
| ATOM | 1921 | O | ARG | A | 234 | 22.201 | 56.070 | −14.402 | 1.00 | 41.65 | O |
| ATOM | 1922 | CB | ARG | A | 234 | 20.078 | 58.519 | −14.904 | 1.00 | 39.03 | C |
| ATOM | 1923 | CG | ARG | A | 234 | 21.128 | 58.703 | −15.998 | 1.00 | 37.55 | C |
| ATOM | 1924 | CD | ARG | A | 234 | 20.735 | 59.818 | −16.951 | 1.00 | 42.47 | C |
| ATOM | 1925 | NE | ARG | A | 234 | 21.457 | 59.749 | −18.221 | 1.00 | 42.80 | N |
| ATOM | 1926 | CZ | ARG | A | 234 | 21.424 | 60.709 | −19.135 | 1.00 | 38.93 | C |
| ATOM | 1927 | NH1 | ARG | A | 234 | 20.714 | 61.803 | −18.898 | 1.00 | 43.58 | N1+ |
| ATOM | 1928 | NH2 | ARG | A | 234 | 22.101 | 60.577 | −20.264 | 1.00 | 43.81 | N |
| ATOM | 1929 | N | PRO | A | 235 | 20.051 | 55.386 | −14.414 | 1.00 | 37.80 | N |
| ATOM | 1930 | CA | PRO | A | 235 | 20.418 | 54.035 | −14.846 | 1.00 | 34.17 | C |
| ATOM | 1931 | C | PRO | A | 235 | 20.591 | 53.984 | −16.349 | 1.00 | 39.12 | C |
| ATOM | 1932 | O | PRO | A | 235 | 19.877 | 54.654 | −17.097 | 1.00 | 40.48 | O |
| ATOM | 1933 | CB | PRO | A | 235 | 19.219 | 53.177 | −14.400 | 1.00 | 39.33 | C |
| ATOM | 1934 | CG | PRO | A | 235 | 18.038 | 54.152 | −14.466 | 1.00 | 35.82 | C |
| ATOM | 1935 | CD | PRO | A | 235 | 18.600 | 55.509 | −14.136 | 1.00 | 38.80 | C |
| ATOM | 1936 | N | ALA | A | 236 | 21.583 | 53.208 | −16.785 | 1.00 | 41.86 | N |
| ATOM | 1937 | CA | ALA | A | 236 | 21.762 | 52.941 | −18.207 | 1.00 | 43.72 | C |
| ATOM | 1938 | C | ALA | A | 236 | 20.777 | 51.905 | −18.715 | 1.00 | 44.36 | C |
| ATOM | 1939 | O | ALA | A | 236 | 20.520 | 51.849 | −19.923 | 1.00 | 48.28 | O |
| ATOM | 1940 | CB | ALA | A | 236 | 23.187 | 52.465 | −18.497 | 1.00 | 36.62 | C |
| ATOM | 1941 | N | GLY | A | 237 | 20.229 | 51.083 | −17.825 | 1.00 | 40.77 | N |
| ATOM | 1942 | CA | GLY | A | 237 | 19.307 | 50.037 | −18.202 | 1.00 | 45.80 | C |
| ATOM | 1943 | C | GLY | A | 237 | 19.917 | 48.655 | −18.233 | 1.00 | 44.94 | C |
| ATOM | 1944 | O | GLY | A | 237 | 19.177 | 47.674 | −18.327 | 1.00 | 49.37 | O |
| ATOM | 1945 | N | ASP | A | 238 | 21.244 | 48.544 | −18.147 | 1.00 | 44.27 | N |
| ATOM | 1946 | CA | ASP | A | 238 | 21.907 | 47.248 | −18.137 | 1.00 | 42.21 | C |
| ATOM | 1947 | C | ASP | A | 238 | 22.484 | 46.913 | −16.773 | 1.00 | 39.02 | C |
| ATOM | 1948 | O | ASP | A | 238 | 23.274 | 45.981 | −16.664 | 1.00 | 43.21 | O |
| ATOM | 1949 | CB | ASP | A | 238 | 23.015 | 47.198 | −19.190 | 1.00 | 45.87 | C |
| ATOM | 1950 | CG | ASP | A | 238 | 24.056 | 48.295 | −18.997 | 1.00 | 46.60 | C |
| ATOM | 1951 | OD1 | ASP | A | 238 | 23.903 | 49.114 | −18.065 | 1.00 | 43.24 | O |
| ATOM | 1952 | OD2 | ASP | A | 238 | 25.020 | 48.343 | −19.789 | 1.00 | 48.16 | O1− |
| ATOM | 1953 | N | GLY | A | 239 | 22.094 | 47.639 | −15.732 | 1.00 | 41.05 | N |
| ATOM | 1954 | CA | GLY | A | 239 | 22.709 | 47.490 | −14.435 | 1.00 | 39.30 | C |
| ATOM | 1955 | C | GLY | A | 239 | 23.872 | 48.431 | −14.167 | 1.00 | 40.06 | C |
| ATOM | 1956 | O | GLY | A | 239 | 24.401 | 48.427 | −13.051 | 1.00 | 39.42 | O |
| ATOM | 1957 | N | THR | A | 240 | 24.293 | 49.229 | −15.143 | 1.00 | 40.09 | N |
| ATOM | 1958 | CA | THR | A | 240 | 25.279 | 50.274 | −14.900 | 1.00 | 35.01 | C |
| ATOM | 1959 | C | THR | A | 240 | 24.600 | 51.637 | −14.887 | 1.00 | 38.43 | C |
| ATOM | 1960 | O | THR | A | 240 | 23.406 | 51.777 | −15.165 | 1.00 | 39.81 | O |
| ATOM | 1961 | CB | THR | A | 240 | 26.399 | 50.256 | −15.945 | 1.00 | 43.96 | C |
| ATOM | 1962 | OG1 | THR | A | 240 | 25.873 | 50.580 | −17.244 | 1.00 | 39.44 | O |
| ATOM | 1963 | CG2 | THR | A | 240 | 27.078 | 48.898 | −15.977 | 1.00 | 43.79 | C |
| ATOM | 1964 | N | PHE | A | 241 | 25.385 | 52.654 | −14.562 | 1.00 | 36.43 | N |
| ATOM | 1965 | CA | PHE | A | 241 | 24.849 | 53.970 | −14.301 | 1.00 | 37.74 | C |
| ATOM | 1966 | C | PHE | A | 241 | 25.547 | 55.016 | −15.147 | 1.00 | 39.75 | C |
| ATOM | 1967 | O | PHE | A | 241 | 26.626 | 54.782 | −15.711 | 1.00 | 36.78 | O |
| ATOM | 1968 | CB | PHE | A | 241 | 24.956 | 54.279 | −12.817 | 1.00 | 37.16 | C |
| ATOM | 1969 | CG | PHE | A | 241 | 24.109 | 53.367 | −11.994 | 1.00 | 37.41 | C |
| ATOM | 1970 | CD1 | PHE | A | 241 | 22.756 | 53.637 | −11.820 | 1.00 | 42.08 | C |
| ATOM | 1971 | CD2 | PHE | A | 241 | 24.643 | 52.214 | −11.438 | 1.00 | 38.23 | C |
| ATOM | 1972 | CE1 | PHE | A | 241 | 21.941 | 52.780 | −11.082 | 1.00 | 38.23 | C |
| ATOM | 1973 | CE2 | PHE | A | 241 | 23.840 | 51.352 | −10.697 | 1.00 | 41.04 | C |
| ATOM | 1974 | CZ | PHE | A | 241 | 22.485 | 51.635 | −10.529 | 1.00 | 41.74 | C |
| ATOM | 1975 | N | GLN | A | 242 | 24.892 | 56.174 | −15.221 | 1.00 | 35.29 | N |
| ATOM | 1976 | CA | GLN | A | 242 | 25.350 | 57.333 | −15.971 | 1.00 | 38.65 | C |
| ATOM | 1977 | C | GLN | A | 242 | 25.182 | 58.581 | −15.126 | 1.00 | 43.52 | C |
| ATOM | 1978 | O | GLN | A | 242 | 24.285 | 58.663 | −14.283 | 1.00 | 40.21 | O |

TABLE 77-continued

| | | | | | | | | | | |
|---|---|---|---|---|---|---|---|---|---|---|
| ATOM | 1979 | CB | GLN | A | 242 | 24.572 | 57.525 | −17.273 | 1.00 | 35.91 | C |
| ATOM | 1980 | CG | GLN | A | 242 | 24.655 | 56.361 | −18.230 | 1.00 | 39.58 | C |
| ATOM | 1981 | CD | GLN | A | 242 | 23.753 | 56.578 | −19.432 | 1.00 | 41.32 | C |
| ATOM | 1982 | OE1 | GLN | A | 242 | 23.067 | 57.594 | −19.516 | 1.00 | 38.53 | O |
| ATOM | 1983 | NE2 | GLN | A | 242 | 23.767 | 55.639 | −20.369 | 1.00 | 41.12 | N |
| ATOM | 1984 | N | LYS | A | 243 | 26.042 | 59.565 | −15.376 | 1.00 | 35.57 | N |
| ATOM | 1985 | CA | LYS | A | 243 | 25.956 | 60.836 | −14.684 | 1.00 | 35.91 | C |
| ATOM | 1986 | C | LYS | A | 243 | 26.670 | 61.880 | −15.526 | 1.00 | 42.65 | C |
| ATOM | 1987 | O | LYS | A | 243 | 27.687 | 61.584 | −16.169 | 1.00 | 38.66 | O |
| ATOM | 1988 | CB | LYS | A | 243 | 26.585 | 60.754 | −13.283 | 1.00 | 38.46 | C |
| ATOM | 1989 | CG | LYS | A | 243 | 26.254 | 61.937 | −12.356 | 1.00 | 38.81 | C |
| ATOM | 1990 | CD | LYS | A | 243 | 26.788 | 61.682 | −10.963 | 1.00 | 42.61 | C |
| ATOM | 1991 | CE | LYS | A | 243 | 26.306 | 62.706 | −9.930 | 1.00 | 43.19 | C |
| ATOM | 1992 | NZ | LYS | A | 243 | 24.821 | 62.683 | −9.732 | 1.00 | 48.88 | N1+ |
| ATOM | 1993 | N | TRP | A | 244 | 26.138 | 63.101 | −15.515 | 1.00 | 40.70 | N |
| ATOM | 1994 | CA | TRP | A | 244 | 26.863 | 64.234 | −16.073 | 1.00 | 42.37 | C |
| ATOM | 1995 | C | TRP | A | 244 | 26.887 | 65.387 | −15.077 | 1.00 | 44.38 | C |
| ATOM | 1996 | O | TRP | A | 244 | 26.065 | 65.472 | −14.161 | 1.00 | 42.29 | O |
| ATOM | 1997 | CB | TRP | A | 244 | 26.284 | 64.705 | −17.423 | 1.00 | 47.80 | C |
| ATOM | 1998 | CG | TRP | A | 244 | 24.826 | 65.142 | −17.418 | 1.00 | 49.40 | C |
| ATOM | 1999 | CD1 | TRP | A | 244 | 23.745 | 64.396 | −17.794 | 1.00 | 53.62 | C |
| ATOM | 2000 | CD2 | TRP | A | 244 | 24.311 | 66.433 | −17.049 | 1.00 | 43.70 | C |
| ATOM | 2001 | NE1 | TRP | A | 244 | 22.588 | 65.138 | −17.672 | 1.00 | 49.24 | N |
| ATOM | 2002 | CE2 | TRP | A | 244 | 22.911 | 66.389 | −17.217 | 1.00 | 49.66 | C |
| ATOM | 2003 | CE3 | TRP | A | 244 | 24.899 | 67.618 | −16.589 | 1.00 | 51.36 | C |
| ATOM | 2004 | CZ2 | TRP | A | 244 | 22.089 | 67.486 | −16.936 | 1.00 | 51.70 | C |
| ATOM | 2005 | CZ3 | TRP | A | 244 | 24.077 | 68.711 | −16.314 | 1.00 | 53.81 | C |
| ATOM | 2006 | CH2 | TRP | A | 244 | 22.691 | 68.634 | −16.490 | 1.00 | 54.56 | C |
| ATOM | 2007 | N | ALA | A | 245 | 27.885 | 66.254 | −15.260 | 1.00 | 40.41 | N |
| ATOM | 2008 | CA | ALA | A | 245 | 28.072 | 67.489 | −14.514 | 1.00 | 47.18 | C |
| ATOM | 2009 | C | ALA | A | 245 | 28.375 | 68.577 | −15.530 | 1.00 | 44.13 | C |
| ATOM | 2010 | O | ALA | A | 245 | 29.060 | 68.315 | −16.524 | 1.00 | 44.50 | O |
| ATOM | 2011 | CB | ALA | A | 245 | 29.228 | 67.378 | −13.505 | 1.00 | 39.54 | C |
| ATOM | 2012 | N | ALA | A | 246 | 27.876 | 69.784 | −15.295 | 1.00 | 44.49 | N |
| ATOM | 2013 | CA | ALA | A | 246 | 28.041 | 70.857 | −16.264 | 1.00 | 49.38 | C |
| ATOM | 2014 | C | ALA | A | 246 | 28.433 | 72.157 | −15.572 | 1.00 | 48.37 | C |
| ATOM | 2015 | O | ALA | A | 246 | 28.124 | 72.364 | −14.396 | 1.00 | 50.79 | O |
| ATOM | 2016 | CB | ALA | A | 246 | 26.758 | 71.045 | −17.092 | 1.00 | 49.12 | C |
| ATOM | 2017 | N | VAL | A | 247 | 29.141 | 73.022 | −16.317 | 1.00 | 43.95 | N |
| ATOM | 2018 | CA | VAL | A | 247 | 29.558 | 74.351 | −15.864 | 1.00 | 45.71 | C |
| ATOM | 2019 | C | VAL | A | 247 | 29.318 | 75.361 | −16.973 | 1.00 | 41.31 | C |
| ATOM | 2020 | O | VAL | A | 247 | 29.606 | 75.084 | −18.141 | 1.00 | 46.29 | O |
| ATOM | 2021 | CB | VAL | A | 247 | 31.054 | 74.423 | −15.488 | 1.00 | 50.56 | C |
| ATOM | 2022 | CG1 | VAL | A | 247 | 31.271 | 73.996 | −14.088 | 1.00 | 62.14 | O |
| ATOM | 2023 | CG2 | VAL | A | 247 | 31.920 | 73.616 | −16.479 | 1.00 | 43.08 | C |
| ATOM | 2024 | N | VAL | A | 248 | 28.855 | 76.552 | −16.599 | 1.00 | 40.67 | N |
| ATOM | 2025 | CA | VAL | A | 248 | 28.737 | 77.682 | −17.517 | 1.00 | 48.36 | C |
| ATOM | 2026 | C | VAL | A | 248 | 30.004 | 78.520 | −17.400 | 1.00 | 49.89 | C |
| ATOM | 2027 | O | VAL | A | 248 | 30.321 | 79.013 | −16.312 | 1.00 | 50.37 | O |
| ATOM | 2028 | CB | VAL | A | 248 | 27.500 | 78.532 | −17.195 | 1.00 | 52.55 | C |
| ATOM | 2029 | CG1 | VAL | A | 248 | 26.942 | 79.157 | −18.463 | 1.00 | 58.48 | C |
| ATOM | 2030 | CG2 | VAL | A | 248 | 26.459 | 77.695 | −16.495 | 1.00 | 55.81 | C |
| ATOM | 2031 | N | VAL | A | 249 | 30.719 | 78.697 | −18.505 | 1.00 | 45.44 | N |
| ATOM | 2032 | CA | VAL | A | 249 | 32.038 | 79.327 | −18.463 | 1.00 | 52.63 | C |
| ATOM | 2033 | C | VAL | A | 249 | 32.042 | 80.527 | −19.407 | 1.00 | 55.98 | C |
| ATOM | 2034 | O | VAL | A | 249 | 31.208 | 80.620 | −20.322 | 1.00 | 55.40 | O |
| ATOM | 2035 | CB | VAL | A | 249 | 33.162 | 78.329 | −18.819 | 1.00 | 45.76 | C |
| ATOM | 2036 | CG1 | VAL | A | 249 | 33.042 | 77.070 | −17.986 | 1.00 | 47.46 | C |
| ATOM | 2037 | CG2 | VAL | A | 249 | 33.150 | 77.988 | −20.298 | 1.00 | 47.65 | C |
| ATOM | 2038 | N | PRO | A | 250 | 32.964 | 81.471 | −19.203 | 1.00 | 53.69 | N |
| ATOM | 2039 | CA | PRO | A | 250 | 33.174 | 82.526 | −20.205 | 1.00 | 59.17 | C |
| ATOM | 2040 | C | PRO | A | 250 | 33.719 | 81.957 | −21.502 | 1.00 | 57.80 | C |
| ATOM | 2041 | O | PRO | A | 250 | 34.594 | 81.091 | −21.506 | 1.00 | 53.78 | O |
| ATOM | 2042 | CB | PRO | A | 250 | 34.187 | 83.457 | −19.532 | 1.00 | 60.64 | C |
| ATOM | 2043 | CG | PRO | A | 250 | 33.986 | 83.222 | −18.070 | 1.00 | 61.67 | C |
| ATOM | 2044 | CD | PRO | A | 250 | 33.688 | 81.756 | −17.953 | 1.00 | 53.51 | C |
| ATOM | 2045 | N | SER | A | 251 | 33.226 | 82.513 | −22.612 | 1.00 | 60.51 | N |
| ATOM | 2046 | CA | SER | A | 251 | 33.139 | 81.778 | −23.875 | 1.00 | 61.56 | C |
| ATOM | 2047 | C | SER | A | 251 | 34.487 | 81.303 | −24.409 | 1.00 | 63.25 | C |
| ATOM | 2048 | O | SER | A | 251 | 34.538 | 80.309 | −25.141 | 1.00 | 71.80 | O |
| ATOM | 2049 | CB | SER | A | 251 | 32.440 | 82.637 | −24.926 | 1.00 | 68.16 | C |
| ATOM | 2050 | OG | SER | A | 251 | 32.325 | 81.931 | −26.147 | 1.00 | 75.76 | O |
| ATOM | 2051 | N | GLY | A | 252 | 35.580 | 81.996 | −24.110 | 1.00 | 55.84 | N |
| ATOM | 2052 | CA | GLY | A | 252 | 36.880 | 81.524 | −24.549 | 1.00 | 57.03 | C |
| ATOM | 2053 | C | GLY | A | 252 | 37.734 | 80.897 | −23.469 | 1.00 | 55.30 | C |
| ATOM | 2054 | O | GLY | A | 252 | 38.878 | 80.529 | −23.739 | 1.00 | 57.07 | O |
| ATOM | 2055 | N | GLN | A | 253 | 37.208 | 80.736 | −22.256 | 1.00 | 56.63 | N |
| ATOM | 2056 | CA | GLN | A | 253 | 38.011 | 80.308 | −21.120 | 1.00 | 54.01 | C |
| ATOM | 2057 | C | GLN | A | 253 | 37.878 | 78.818 | −20.819 | 1.00 | 51.59 | C |
| ATOM | 2058 | O | GLN | A | 253 | 38.185 | 78.401 | −19.697 | 1.00 | 46.49 | O |

TABLE 77-continued

| | | | | | | | | | | |
|---|---|---|---|---|---|---|---|---|---|---|
| ATOM | 2059 | CB | GLN | A | 253 | 37.635 | 81.145 | −19.900 | 1.00 | 53.46 C |
| ATOM | 2060 | CG | GLN | A | 253 | 37.867 | 82.619 | −20.139 | 1.00 | 55.55 C |
| ATOM | 2061 | CD | GLN | A | 253 | 37.727 | 83.441 | −18.892 | 1.00 | 58.37 C |
| ATOM | 2062 | OE1 | GLN | A | 253 | 37.451 | 82.919 | −17.809 | 1.00 | 61.66 O |
| ATOM | 2063 | NE2 | GLN | A | 253 | 37.924 | 84.745 | −19.030 | 1.00 | 63.35 N |
| ATOM | 2064 | N | GLU | A | 254 | 37.461 | 78.012 | −21.810 | 1.00 | 46.27 N |
| ATOM | 2065 | CA | GLU | A | 254 | 37.162 | 76.600 | −21.575 | 1.00 | 52.31 C |
| ATOM | 2066 | C | GLU | A | 254 | 38.369 | 75.847 | −21.025 | 1.00 | 53.37 C |
| ATOM | 2067 | O | GLU | A | 254 | 38.219 | 74.948 | −20.185 | 1.00 | 47.17 O |
| ATOM | 2068 | CB | GLU | A | 254 | 36.681 | 75.927 | −22.868 | 1.00 | 47.99 C |
| ATOM | 2069 | CG | GLU | A | 254 | 35.222 | 76.225 | −23.262 | 1.00 | 49.94 C |
| ATOM | 2070 | CD | GLU | A | 254 | 35.084 | 77.483 | −24.111 | 1.00 | 55.65 C |
| ATOM | 2071 | OE1 | GLU | A | 254 | 36.079 | 78.238 | −24.246 | 1.00 | 51.31 O |
| ATOM | 2072 | OE2 | GLU | A | 254 | 33.981 | 77.705 | −24.654 | 1.00 | 53.66 O |
| ATOM | 2073 | N | GLN | A | 255 | 39.573 | 76.195 | −21.487 | 1.00 | 49.26 N |
| ATOM | 2074 | CA | GLN | A | 255 | 40.751 | 75.429 | −21.098 | 1.00 | 52.45 C |
| ATOM | 2075 | C | GLN | A | 255 | 41.133 | 75.649 | −19.641 | 1.00 | 47.00 C |
| ATOM | 2076 | O | GLN | A | 255 | 41.950 | 74.886 | −19.119 | 1.00 | 45.46 O |
| ATOM | 2077 | CB | GLN | A | 255 | 41.934 | 75.764 | −22.016 | 1.00 | 55.03 C |
| ATOM | 2078 | CG | GLN | A | 255 | 42.501 | 77.168 | −21.819 | 1.00 | 60.63 C |
| ATOM | 2079 | CD | GLN | A | 255 | 43.599 | 77.517 | −22.821 | 1.00 | 71.09 C |
| ATOM | 2080 | OE1 | GLN | A | 255 | 44.719 | 77.003 | −22.746 | 1.00 | 63.48 O |
| ATOM | 2081 | NE2 | GLN | A | 255 | 43.275 | 78.395 | −23.770 | 1.00 | 75.74 N |
| ATOM | 2082 | N | ARG | A | 256 | 40.554 | 76.651 | −18.969 | 1.00 | 41.18 N |
| ATOM | 2083 | CA | ARG | A | 256 | 40.810 | 76.814 | −17.545 | 1.00 | 42.24 C |
| ATOM | 2084 | C | ARG | A | 256 | 40.143 | 75.737 | −16.699 | 1.00 | 45.13 C |
| ATOM | 2085 | O | ARG | A | 256 | 40.542 | 75.551 | −15.541 | 1.00 | 41.87 O |
| ATOM | 2086 | CB | ARG | A | 256 | 40.329 | 78.179 | −17.062 | 1.00 | 46.17 C |
| ATOM | 2087 | CG | ARG | A | 256 | 41.010 | 79.355 | −17.709 | 1.00 | 52.84 C |
| ATOM | 2088 | CD | ARG | A | 256 | 40.697 | 80.616 | −16.920 | 1.00 | 50.22 C |
| ATOM | 2089 | NE | ARG | A | 256 | 41.156 | 81.800 | −17.626 | 1.00 | 58.06 N |
| ATOM | 2090 | CZ | ARG | A | 256 | 41.068 | 83.030 | −17.145 | 1.00 | 56.51 C |
| ATOM | 2091 | NH1 | ARG | A | 256 | 40.540 | 83.229 | −15.944 | 1.00 | 60.30 N |
| ATOM | 2092 | NH2 | ARG | A | 256 | 41.510 | 84.054 | −17.865 | 1.00 | 59.05 N |
| ATOM | 2093 | N | TYR | A | 257 | 39.145 | 75.035 | −17.249 | 1.00 | 45.57 N |
| ATOM | 2094 | CA | TYR | A | 257 | 38.258 | 74.154 | −16.498 | 1.00 | 40.81 C |
| ATOM | 2095 | C | TYR | A | 257 | 38.646 | 72.691 | −16.647 | 1.00 | 41.92 C |
| ATOM | 2096 | O | TYR | A | 257 | 38.991 | 72.227 | −17.739 | 1.00 | 41.69 O |
| ATOM | 2097 | CB | TYR | A | 257 | 36.805 | 74.346 | −16.954 | 1.00 | 44.10 C |
| ATOM | 2098 | CG | TYR | A | 257 | 36.282 | 75.700 | −16.575 | 1.00 | 44.90 C |
| ATOM | 2099 | CD1 | TYR | A | 257 | 36.539 | 76.818 | −17.371 | 1.00 | 45.88 C |
| ATOM | 2100 | CD2 | TYR | A | 257 | 35.574 | 75.881 | −15.395 | 1.00 | 46.43 C |
| ATOM | 2101 | CE1 | TYR | A | 257 | 36.079 | 78.077 | −17.009 | 1.00 | 47.96 C |
| ATOM | 2102 | CE2 | TYR | A | 257 | 35.112 | 77.140 | −15.023 | 1.00 | 47.53 C |
| ATOM | 2103 | CZ | TYR | A | 257 | 35.369 | 78.228 | −15.835 | 1.00 | 49.28 C |
| ATOM | 2104 | OH | TYR | A | 257 | 34.917 | 79.468 | −15.473 | 1.00 | 56.22 O |
| ATOM | 2105 | N | THR | A | 258 | 38.580 | 71.962 | −15.536 | 1.00 | 41.64 N |
| ATOM | 2106 | CA | THR | A | 258 | 38.796 | 70.522 | −15.546 | 1.00 | 42.93 C |
| ATOM | 2107 | C | THR | A | 258 | 37.683 | 69.841 | −14.768 | 1.00 | 40.69 C |
| ATOM | 2108 | O | THR | A | 258 | 37.186 | 70.363 | −13.761 | 1.00 | 40.58 O |
| ATOM | 2109 | CB | THR | A | 258 | 40.155 | 70.114 | −14.945 | 1.00 | 42.36 C |
| ATOM | 2110 | OG1 | THR | A | 258 | 40.333 | 70.758 | −13.676 | 1.00 | 40.12 O |
| ATOM | 2111 | CG2 | THR | A | 258 | 41.286 | 70.476 | −15.886 | 1.00 | 44.51 C |
| ATOM | 2112 | N | CYS | A | 259 | 37.281 | 68.687 | −15.267 | 1.00 | 40.89 N |
| ATOM | 2113 | CA | CYS | A | 259 | 36.352 | 67.823 | −14.573 | 1.00 | 38.74 C |
| ATOM | 2114 | C | CYS | A | 259 | 37.126 | 66.692 | −13.912 | 1.00 | 41.62 C |
| ATOM | 2115 | O | CYS | A | 259 | 38.000 | 66.079 | −14.539 | 1.00 | 40.71 O |
| ATOM | 2116 | CB | CYS | A | 259 | 35.319 | 67.268 | −15.541 | 1.00 | 44.60 C |
| ATOM | 2117 | SG | CYS | A | 259 | 34.250 | 66.054 | −14.766 | 1.00 | 49.86 S |
| ATOM | 2118 | N | HIS | A | 260 | 36.817 | 66.432 | −12.650 | 1.00 | 42.37 N |
| ATOM | 2119 | CA | HIS | A | 260 | 37.491 | 65.402 | −11.867 | 1.00 | 46.98 C |
| ATOM | 2120 | C | HIS | A | 260 | 36.498 | 64.298 | −11.518 | 1.00 | 40.65 C |
| ATOM | 2121 | O | HIS | A | 260 | 35.436 | 64.567 | −10.955 | 1.00 | 44.71 O |
| ATOM | 2122 | CB | HIS | A | 260 | 38.124 | 66.018 | −10.622 | 1.00 | 41.73 C |
| ATOM | 2123 | CG | HIS | A | 260 | 39.226 | 66.973 | −10.949 | 1.00 | 53.77 C |
| ATOM | 2124 | ND1 | HIS | A | 260 | 40.553 | 66.601 | −10.930 | 1.00 | 52.10 N |
| ATOM | 2125 | CD2 | HIS | A | 260 | 39.197 | 68.256 | −11.388 | 1.00 | 49.41 C |
| ATOM | 2126 | CE1 | HIS | A | 260 | 41.297 | 67.628 | −11.300 | 1.00 | 55.57 C |
| ATOM | 2127 | NE2 | HIS | A | 260 | 40.499 | 68.643 | −11.585 | 1.00 | 53.91 N |
| ATOM | 2128 | N | VAL | A | 261 | 36.843 | 63.071 | −11.885 | 1.00 | 44.19 N |
| ATOM | 2129 | CA | VAL | A | 261 | 35.975 | 61.909 | −11.751 | 1.00 | 41.06 C |
| ATOM | 2130 | C | VAL | A | 261 | 36.591 | 60.967 | −10.724 | 1.00 | 43.48 C |
| ATOM | 2131 | O | VAL | A | 261 | 37.694 | 60.441 | −10.934 | 1.00 | 43.62 O |
| ATOM | 2132 | CB | VAL | A | 261 | 35.783 | 61.206 | −13.103 | 1.00 | 42.84 C |
| ATOM | 2133 | CG1 | VAL | A | 261 | 34.837 | 59.997 | −12.971 | 1.00 | 37.01 C |
| ATOM | 2134 | CG2 | VAL | A | 261 | 35.267 | 62.204 | −14.145 | 1.00 | 41.61 C |
| ATOM | 2135 | N | GLN | A | 262 | 35.879 | 60.751 | −9.619 | 1.00 | 43.25 N |
| ATOM | 2136 | CA | GLN | A | 262 | 36.276 | 59.791 | −8.594 | 1.00 | 49.18 C |
| ATOM | 2137 | C | GLN | A | 262 | 35.288 | 58.629 | −8.567 | 1.00 | 43.84 C |
| ATOM | 2138 | O | GLN | A | 262 | 34.084 | 58.851 | −8.440 | 1.00 | 38.87 O |

TABLE 77-continued

| | | | | | | | | | | |
|---|---|---|---|---|---|---|---|---|---|---|
| ATOM | 2139 | CB | GLN | A | 262 | 36.324 | 60.453 | −7.218 | 1.00 | 47.69 C |
| ATOM | 2140 | CG | GLN | A | 262 | 37.267 | 61.625 | −7.119 | 1.00 | 54.78 C |
| ATOM | 2141 | CD | GLN | A | 262 | 37.155 | 62.311 | −5.782 | 1.00 | 63.81 C |
| ATOM | 2142 | OE1 | GLN | A | 262 | 36.549 | 63.383 | −5.660 | 1.00 | 62.22 O |
| ATOM | 2143 | NE2 | GLN | A | 262 | 37.730 | 61.689 | −4.757 | 1.00 | 69.01 N |
| ATOM | 2144 | N | HIS | A | 263 | 35.801 | 57.402 | −8.669 | 1.00 | 45.33 N |
| ATOM | 2145 | CA | HIS | A | 263 | 34.976 | 56.202 | −8.641 | 1.00 | 45.21 C |
| ATOM | 2146 | C | HIS | A | 263 | 35.831 | 55.040 | −8.141 | 1.00 | 47.88 C |
| ATOM | 2147 | O | HIS | A | 263 | 37.016 | 54.949 | −8.483 | 1.00 | 44.90 O |
| ATOM | 2148 | CB | HIS | A | 263 | 34.411 | 55.886 | −10.036 | 1.00 | 42.14 C |
| ATOM | 2149 | CG | HIS | A | 263 | 33.344 | 54.834 | −10.037 | 1.00 | 41.11 C |
| ATOM | 2150 | ND1 | HIS | A | 263 | 33.600 | 53.509 | −10.319 | 1.00 | 39.51 N |
| ATOM | 2151 | CD2 | HIS | A | 263 | 32.013 | 54.917 | −9.793 | 1.00 | 41.90 C |
| ATOM | 2152 | CE1 | HIS | A | 263 | 32.473 | 52.823 | −10.257 | 1.00 | 42.13 C |
| ATOM | 2153 | NE2 | HIS | A | 263 | 31.495 | 53.653 | −9.937 | 1.00 | 41.65 N |
| ATOM | 2154 | N | GLU | A | 264 | 35.220 | 54.146 | −7.347 | 1.00 | 46.75 N |
| ATOM | 2155 | CA | GLU | A | 264 | 35.949 | 52.980 | −6.843 | 1.00 | 43.21 C |
| ATOM | 2156 | C | GLU | A | 264 | 36.530 | 52.148 | −7.969 | 1.00 | 43.54 C |
| ATOM | 2157 | O | GLU | A | 264 | 37.528 | 51.446 | −7.771 | 1.00 | 47.33 O |
| ATOM | 2158 | CB | GLU | A | 264 | 35.043 | 52.083 | −5.992 | 1.00 | 46.99 C |
| ATOM | 2159 | CG | GLU | A | 264 | 34.264 | 52.795 | −4.910 | 1.00 | 51.03 C |
| ATOM | 2160 | CD | GLU | A | 264 | 33.004 | 52.053 | −4.546 | 0.00 | 55.04 C |
| ATOM | 2161 | OE1 | GLU | A | 264 | 33.032 | 50.802 | −4.551 | 1.00 | 56.83 O |
| ATOM | 2162 | OE2 | GLU | A | 264 | 31.985 | 52.723 | −4.277 | 1.00 | 62.95 O1− |
| ATOM | 2163 | N | GLY | A | 265 | 35.926 | 52.198 | −9.152 | 1.00 | 40.85 N |
| ATOM | 2164 | CA | GLY | A | 265 | 36.435 | 51.384 | −10.240 | 1.00 | 37.68 C |
| ATOM | 2165 | C | GLY | A | 265 | 37.680 | 51.922 | −10.912 | 1.00 | 46.95 C |
| ATOM | 2166 | O | GLY | A | 265 | 38.247 | 51.225 | −11.761 | 1.00 | 43.08 O |
| ATOM | 2167 | N | LEU | A | 266 | 38.103 | 53.145 | −10.572 | 1.00 | 46.16 N |
| ATOM | 2168 | CA | LEU | A | 266 | 39.207 | 53.793 | −11.275 | 1.00 | 50.24 C |
| ATOM | 2169 | C | LEU | A | 266 | 40.511 | 53.574 | −10.519 | 1.00 | 43.09 C |
| ATOM | 2170 | O | LEU | A | 266 | 40.528 | 53.650 | −9.291 | 1.00 | 42.87 O |
| ATOM | 2171 | CB | LEU | A | 266 | 38.953 | 55.294 | −11.416 | 1.00 | 46.21 C |
| ATOM | 2172 | CG | LEU | A | 266 | 37.869 | 55.663 | −12.427 | 1.00 | 46.87 C |
| ATOM | 2173 | CD1 | LEU | A | 266 | 37.465 | 57.127 | −12.279 | 1.00 | 40.41 C |
| ATOM | 2174 | CD2 | LEU | A | 266 | 38.383 | 55.348 | −13.832 | 1.00 | 40.76 C |
| ATOM | 2175 | N | PRO | A | 267 | 41.616 | 53.297 | −11.214 | 1.00 | 43.86 N |
| ATOM | 2176 | CA | PRO | A | 267 | 42.896 | 53.178 | −10.494 | 1.00 | 45.53 C |
| ATOM | 2177 | C | PRO | A | 267 | 43.350 | 54.507 | −9.928 | 1.00 | 46.60 C |
| ATOM | 2178 | O | PRO | A | 267 | 44.037 | 54.528 | −8.903 | 1.00 | 46.72 O |
| ATOM | 2179 | CB | PRO | A | 267 | 43.874 | 52.646 | −11.558 | 1.00 | 41.83 C |
| ATOM | 2180 | CG | PRO | A | 267 | 43.053 | 52.318 | −12.758 | 1.00 | 45.82 C |
| ATOM | 2181 | CD | PRO | A | 267 | 41.772 | 53.105 | −12.665 | 1.00 | 48.44 C |
| ATOM | 2182 | N | LYS | A | 268 | 42.973 | 55.617 | −10.561 | 1.00 | 45.69 N |
| ATOM | 2183 | CA | LYS | A | 268 | 43.270 | 56.965 | −10.096 | 1.00 | 51.56 C |
| ATOM | 2184 | C | LYS | A | 268 | 42.116 | 57.857 | −10.512 | 1.00 | 47.92 C |
| ATOM | 2185 | O | LYS | A | 268 | 41.431 | 57.549 | −11.495 | 1.00 | 47.01 O |
| ATOM | 2186 | CB | LYS | A | 268 | 44.591 | 57.504 | −10.679 | 1.00 | 49.48 C |
| ATOM | 2187 | CG | LYS | A | 268 | 45.807 | 57.240 | −9.808 | 1.00 | 59.97 C |
| ATOM | 2188 | CD | LYS | A | 268 | 47.063 | 57.931 | −10.346 | 1.00 | 54.84 C |
| ATOM | 2189 | CE | LYS | A | 268 | 47.642 | 57.175 | −11.516 | 1.00 | 62.19 C |
| ATOM | 2190 | NZ | LYS | A | 268 | 48.027 | 55.801 | −11.114 | 1.00 | 59.90 N1+ |
| ATOM | 2191 | N | PRO | A | 269 | 41.846 | 58.935 | −9.774 | 1.00 | 46.02 N |
| ATOM | 2192 | CA | PRO | A | 269 | 40.874 | 59.930 | −10.246 | 1.00 | 52.07 C |
| ATOM | 2193 | C | PRO | A | 269 | 41.245 | 60.400 | −11.642 | 1.00 | 51.91 C |
| ATOM | 2194 | O | PRO | A | 269 | 42.419 | 60.586 | −11.954 | 1.00 | 48.80 O |
| ATOM | 2195 | CB | PRO | A | 269 | 41.000 | 61.069 | −9.228 | 1.00 | 49.44 C |
| ATOM | 2196 | CG | PRO | A | 269 | 41.581 | 60.446 | −8.010 | 1.00 | 49.92 C |
| ATOM | 2197 | CD | PRO | A | 269 | 42.423 | 59.292 | −8.466 | 1.00 | 49.83 C |
| ATOM | 2198 | N | LEU | A | 270 | 40.234 | 60.578 | −12.490 | 1.00 | 50.16 N |
| ATOM | 2199 | CA | LEU | A | 270 | 40.443 | 61.057 | −13.849 | 1.00 | 49.36 C |
| ATOM | 2200 | C | LEU | A | 270 | 40.288 | 62.568 | −13.904 | 1.00 | 48.29 C |
| ATOM | 2201 | O | LEU | A | 270 | 39.473 | 63.150 | −13.183 | 1.00 | 45.38 O |
| ATOM | 2202 | CB | LEU | A | 270 | 39.458 | 60.416 | −14.828 | 1.00 | 47.07 C |
| ATOM | 2203 | CG | LEU | A | 270 | 39.634 | 58.926 | −15.103 | 1.00 | 47.27 C |
| ATOM | 2204 | CD1 | LEU | A | 270 | 38.448 | 58.396 | −15.916 | 1.00 | 49.89 C |
| ATOM | 2205 | CD2 | LEU | A | 270 | 40.953 | 58.679 | −15.821 | 1.00 | 50.47 C |
| ATOM | 2206 | N | THR | A | 271 | 41.083 | 63.196 | −14.765 | 1.00 | 45.33 N |
| ATOM | 2207 | CA | THR | A | 271 | 40.970 | 64.619 | −15.062 | 1.00 | 46.89 C |
| ATOM | 2208 | C | THR | A | 271 | 40.628 | 64.753 | −16.536 | 1.00 | 48.63 C |
| ATOM | 2209 | O | THR | A | 271 | 41.332 | 64.202 | −17.394 | 1.00 | 41.56 O |
| ATOM | 2210 | CB | THR | A | 271 | 42.265 | 65.368 | −14.733 | 1.00 | 50.08 C |
| ATOM | 2211 | OG1 | THR | A | 271 | 42.486 | 65.330 | −13.319 | 1.00 | 49.82 O |
| ATOM | 2212 | CG2 | THR | A | 271 | 42.168 | 66.822 | −15.189 | 1.00 | 49.06 C |
| ATOM | 2213 | N | LEU | A | 272 | 39.531 | 65.448 | −16.823 | 1.00 | 46.19 N |
| ATOM | 2214 | CA | LEU | A | 272 | 39.092 | 65.704 | −18.183 | 1.00 | 46.07 C |
| ATOM | 2215 | C | LEU | A | 272 | 39.194 | 67.192 | −18.465 | 1.00 | 43.73 C |
| ATOM | 2216 | O | LEU | A | 272 | 38.851 | 68.023 | −17.618 | 1.00 | 40.98 O |
| ATOM | 221 | CB | LEU | A | 272 | 37.641 | 65.244 | −18.421 | 1.00 | 39.10 C |
| ATOM | 2218 | CG | LEU | A | 272 | 37.355 | 63.743 | −18.584 | 1.00 | 51.57 C |

TABLE 77-continued

| | | | | | | | | | | |
|---|---|---|---|---|---|---|---|---|---|---|
| ATOM | 2219 | CD1 | LEU | A | 272 | 37.487 | 63.009 | −17.271 | 1.00 | 47.88 C |
| ATOM | 2220 | CD2 | LEU | A | 272 | 35.958 | 63.530 | −19.160 | 1.00 | 55.14 C |
| ATOM | 2221 | N | ARG | A | 273 | 39.614 | 67.515 | −19.678 | 1.00 | 38.54 N |
| ATOM | 2222 | CA | ARG | A | 273 | 39.685 | 68.896 | −20.112 | 1.00 | 45.77 C |
| ATOM | 2223 | C | ARG | A | 273 | 39.110 | 68.992 | −21.515 | 1.00 | 43.59 C |
| ATOM | 2224 | O | ARG | A | 273 | 39.204 | 68.048 | −22.302 | 1.00 | 44.73 O |
| ATOM | 2225 | CB | ARG | A | 273 | 41.124 | 69.409 | −20.084 | 1.00 | 45.19 C |
| ATOM | 2226 | CG | ARG | A | 273 | 41.261 | 70.911 | −20.067 | 1.00 | 50.15 C |
| ATOM | 2227 | CD | ARG | A | 273 | 42.744 | 71.293 | −20.162 | 1.00 | 55.17 C |
| ATOM | 2228 | NE | ARG | A | 273 | 43.528 | 70.807 | −19.022 | 1.00 | 55.47 N |
| ATOM | 2229 | CZ | ARG | A | 273 | 43.807 | 71.534 | −17.943 | 1.00 | 48.93 C |
| ATOM | 2230 | NH1 | ARG | A | 273 | 43.363 | 72.778 | −17.849 | 1.00 | 47.94 N |
| ATOM | 2231 | NH2 | ARG | A | 273 | 44.525 | 71.020 | −16.957 | 1.00 | 49.38 N |
| ATOM | 2232 | N | TRP | A | 274 | 38.504 | 70.138 | −21.810 | 1.00 | 42.40 N |
| ATOM | 2233 | CA | TRP | A | 274 | 38.066 | 70.446 | −23.158 | 1.00 | 46.13 C |
| ATOM | 2234 | C | TRP | A | 274 | 39.277 | 70.873 | −23.987 | 1.00 | 49.62 C |
| ATOM | 2235 | O | TRP | A | 274 | 39.685 | 70.160 | −24.908 | 1.00 | 58.77 O |
| ATOM | 2236 | CB | TRP | A | 274 | 36.997 | 71.544 | −23.146 | 1.00 | 43.71 C |
| ATOM | 2237 | CG | TRP | A | 274 | 36.513 | 71.898 | −24.511 | 1.00 | 48.48 C |
| ATOM | 2238 | CD1 | TRP | A | 274 | 36.755 | 73.060 | −25.200 | 1.00 | 48.33 C |
| ATOM | 2239 | CD2 | TRP | A | 274 | 35.728 | 71.070 | −25.379 | 1.00 | 44.38 C |
| ATOM | 2240 | NE1 | TRP | A | 274 | 36.143 | 73.012 | −26.430 | 1.00 | 49.61 N |
| ATOM | 2241 | CE2 | TRP | A | 274 | 35.512 | 71.801 | −26.570 | 1.00 | 48.91 C |
| ATOM | 2242 | CE3 | TRP | A | 274 | 35.176 | 69.788 | −25.258 | 1.00 | 47.51 C |
| ATOM | 2243 | CZ2 | TRP | A | 274 | 34.776 | 71.288 | −27.641 | 1.00 | 47.57 C |
| ATOM | 2244 | CZ3 | TRP | A | 274 | 34.432 | 69.277 | −26.321 | 1.00 | 49.96 C |
| ATOM | 2245 | CH2 | TRP | A | 274 | 34.244 | 70.028 | −27.500 | 1.00 | 48.15 C |
| HETATM | 2246 | C1 | PEG | A | 301 | 5.037 | 44.286 | −15.244 | 1.00 | 53.80 C |
| HETATM | 2247 | C2 | PEG | A | 301 | 3.638 | 44.427 | −14.650 | 1.00 | 54.98 C |
| HETATM | 2248 | C3 | PEG | A | 301 | 3.185 | 46.643 | −15.326 | 1.00 | 57.80 C |
| HETATM | 2249 | C4 | PEG | A | 301 | 2.122 | 47.599 | −15.877 | 1.00 | 58.38 C |
| HETATM | 2250 | O1 | PEG | A | 301 | 5.034 | 43.275 | −16.218 | 1.00 | 70.78 O |
| HETATM | 2251 | O2 | PEG | A | 301 | 2.857 | 45.281 | −15.445 | 1.00 | 63.00 O |
| HETATM | 2252 | O4 | PEG | A | 301 | 2.521 | 48.941 | −15.693 | 1.00 | 56.12 O |
| HETATM | 2253 | C1 | PEG | A | 401 | 3.941 | 51.537 | −12.508 | 1.00 | 44.65 C |
| HETATM | 2254 | C2 | PEG | A | 401 | 3.009 | 52.743 | −12.388 | 1.00 | 56.28 C |
| HETATM | 2255 | C3 | PEG | A | 401 | 1.356 | 52.038 | −10.837 | 1.00 | 56.96 C |
| HETATM | 2256 | C4 | PEG | A | 401 | 0.134 | 52.853 | −10.406 | 1.00 | 52.04 C |
| HETATM | 2257 | O1 | PEG | A | 401 | 3.917 | 51.028 | −13.816 | 1.00 | 57.78 O |
| HETATM | 2258 | O2 | PEG | A | 401 | 2.482 | 52.842 | −11.084 | 1.00 | 60.05 O |
| HETATM | 2259 | O4 | PEG | A | 401 | −0.964 | 51.975 | −10.228 | 1.00 | 60.95 O |
| HETATM | 2260 | C1 | PEG | A | 501 | 0.929 | 62.617 | 7.111 | 1.00 | 58.52 C |
| HETATM | 2261 | C2 | PEG | A | 501 | 0.764 | 61.592 | 5.982 | 1.00 | 49.97 C |
| HETATM | 2262 | C3 | PEG | A | 501 | −1.427 | 62.269 | 5.341 | 1.00 | 48.42 C |
| HETATM | 2263 | C4 | PEG | A | 501 | −2.209 | 62.996 | 4.252 | 1.00 | 59.06 C |
| HETATM | 2264 | O1 | PEG | A | 501 | 2.026 | 62.331 | 7.937 | 1.00 | 57.14 O |
| HETATM | 2265 | O2 | PEG | A | 501 | −0.079 | 62.107 | 4.976 | 1.00 | 59.62 O |
| HETATM | 2266 | O4 | PEG | A | 501 | −2.775 | 62.091 | 3.336 | 1.00 | 57.73 O |
| TER | | | | | | | | | | |
| ATOM | 2267 | N | ILE | B | 1 | 2.862 | 64.838 | −1.594 | 1.00 | 61.45 N |
| ATOM | 2268 | CA | ILE | B | 1 | 1.504 | 65.082 | −2.087 | 1.00 | 59.59 C |
| ATOM | 2269 | C | ILE | B | 1 | 1.492 | 65.147 | −3.629 | 1.00 | 56.88 C |
| ATOM | 2270 | O | ILE | B | 1 | 1.088 | 64.175 | −4.258 | 1.00 | 59.36 O |
| ATOM | 2271 | CB | ILE | B | 1 | 0.892 | 66.345 | −1.430 | 1.00 | 64.02 C |
| ATOM | 2272 | CG1 | ILE | B | 1 | −0.422 | 66.769 | −2.115 | 1.00 | 68.07 C |
| ATOM | 2273 | CG2 | ILE | B | 1 | 1.915 | 67.474 | −1.352 | 1.00 | 71.82 C |
| ATOM | 2274 | CD1 | ILE | B | 1 | −1.644 | 65.915 | −1.731 | 1.00 | 67.00 C |
| ATOM | 2275 | N | GLN | B | 2 | 1.924 | 66.245 | −4.261 | 1.00 | 51.64 N |
| ATOM | 2276 | CA | GLN | B | 2 | 2.058 | 66.264 | −5.719 | 1.00 | 55.07 C |
| ATOM | 2277 | C | GLN | B | 2 | 3.424 | 66.804 | −6.125 | 1.00 | 52.64 C |
| ATOM | 2278 | O | GLN | B | 2 | 3.763 | 67.953 | −5.819 | 1.00 | 55.12 O |
| ATOM | 2279 | CB | GLN | B | 2 | 0.935 | 67.068 | −6.373 | 1.00 | 55.65 C |
| ATOM | 2280 | CG | GLN | B | 2 | −0.443 | 66.590 | −5.924 | 1.00 | 59.37 C |
| ATOM | 2281 | CD | GLN | B | 2 | −1.410 | 66.382 | −7.070 | 1.00 | 68.62 C |
| ATOM | 2282 | OE1 | GLN | B | 2 | −1.538 | 67.233 | −7.960 | 1.00 | 62.68 O |
| ATOM | 2283 | NE2 | GLN | B | 2 | −2.111 | 65.246 | −7.049 | 1.00 | 61.76 N |
| ATOM | 2284 | N | ARG | B | 3 | 1.198 | 65.973 | −6.823 | 1.00 | 43.83 N |
| ATOM | 2285 | CA | ARG | B | 3 | 5.510 | 66.342 | −7.331 | 1.00 | 42.60 C |
| ATOM | 2286 | C | ARG | B | 3 | 5.568 | 66.041 | −8.819 | 1.00 | 43.42 C |
| ATOM | 2287 | O | ARG | B | 3 | 5.201 | 64.942 | −9.251 | 1.00 | 39.63 O |
| ATOM | 2288 | CB | ARG | B | 3 | 6.609 | 65.587 | −6.610 | 1.00 | 42.37 C |
| ATOM | 2289 | CG | ARG | B | 3 | 6.700 | 65.824 | −5.094 | 1.00 | 47.95 C |
| ATOM | 2290 | CD | ARG | B | 3 | 7.596 | 64.736 | −4.498 | 1.00 | 53.28 C |
| ATOM | 2291 | NE | ARG | B | 3 | 8.259 | 65.094 | −3.249 | 1.00 | 64.53 N |
| ATOM | 2292 | CZ | ARG | B | 3 | 7.925 | 64.607 | −2.056 | 1.00 | 69.55 C |
| ATOM | 2293 | NH1 | ARG | B | 3 | 6.906 | 63.745 | −1.944 | 1.00 | 61.54 N1+ |
| ATOM | 2294 | NH2 | ARG | B | 3 | 8.610 | 64.991 | −0.971 | 1.00 | 64.23 N |
| ATOM | 2295 | N | THR | B | 4 | 6.031 | 67.003 | −9.590 | 1.00 | 39.18 N |
| ATOM | 2296 | CA | THR | B | 4 | 6.003 | 66.833 | −11.031 | 1.00 | 45.00 C |
| ATOM | 2297 | C | THR | B | 4 | 7.244 | 66.056 | −11.472 | 1.00 | 42.68 C |

TABLE 77-continued

| ATOM | 2298 | O | THR | B | 4 | 8.299 | 66.177 | −10.859 | 1.00 | 40.59 | O |
|---|---|---|---|---|---|---|---|---|---|---|---|
| ATOM | 2299 | CB | THR | B | 4 | 5.944 | 68.202 | −11.727 | 1.00 | 47.18 | C |
| ATOM | 2300 | OG1 | THR | B | 4 | 5.548 | 68.027 | −13.094 | 1.00 | 52.77 | O |
| ATOM | 2301 | CG2 | THR | B | 4 | 7.306 | 68.890 | −11.684 | 1.00 | 44.85 | C |
| ATOM | 2302 | N | PRO | B | 5 | 7.134 | 65.217 | −12.498 | 1.00 | 39.13 | N |
| ATOM | 2303 | CA | PRO | B | 5 | 8.270 | 64.365 | −12.860 | 1.00 | 38.61 | C |
| ATOM | 2304 | C | PRO | B | 5 | 9.363 | 65.132 | −13.579 | 1.00 | 42.44 | C |
| ATOM | 2305 | O | PRO | B | 5 | 9.105 | 65.990 | −14.427 | 1.00 | 41.25 | O |
| ATOM | 2306 | CB | PRO | B | 5 | 7.646 | 63.304 | −13.778 | 1.00 | 36.00 | C |
| ATOM | 2307 | CG | PRO | B | 5 | 6.441 | 63.972 | −14.340 | 1.00 | 44.15 | C |
| ATOM | 2308 | CD | PRO | B | 5 | 5.929 | 64.898 | −13.286 | 1.00 | 39.88 | C |
| ATOM | 2309 | N | LYS | B | 6 | 10.599 | 64.812 | −13.216 | 1.00 | 41.50 | N |
| ATOM | 2310 | CA | LYS | B | 6 | 11.750 | 65.155 | −14.032 | 1.00 | 40.17 | C |
| ATOM | 2311 | C | LYS | B | 6 | 11.878 | 64.097 | −15.118 | 1.00 | 42.95 | C |
| ATOM | 2312 | O | LYS | B | 6 | 11.634 | 62.913 | −14.879 | 1.00 | 39.04 | O |
| ATOM | 2313 | CB | LYS | B | 6 | 13.023 | 65.218 | −13.174 | 1.00 | 40.82 | C |
| ATOM | 2314 | CG | LYS | B | 6 | 13.015 | 66.263 | −12.018 | 1.00 | 46.77 | C |
| ATOM | 2315 | CD | LYS | B | 6 | 12.139 | 65.859 | −10.790 | 1.00 | 52.93 | C |
| ATOM | 2316 | CE | LYS | B | 6 | 11.313 | 67.049 | −10.252 | 1.00 | 54.11 | C |
| ATOM | 2317 | NZ | LYS | B | 6 | 10.308 | 66.706 | −9.180 | 1.00 | 48.69 | N1+ |
| ATOM | 2318 | N | ILE | B | 7 | 12.222 | 64.522 | −16.328 | 1.00 | 39.68 | N |
| ATOM | 2319 | CA | ILE | B | 7 | 12.219 | 63.639 | −17.488 | 1.00 | 37.40 | C |
| ATOM | 2320 | C | ILE | B | 7 | 13.575 | 63.733 | −18.151 | 1.00 | 42.49 | C |
| ATOM | 2321 | O | ILE | B | 7 | 14.075 | 64.840 | −18.393 | 1.00 | 41.79 | O |
| ATOM | 2322 | CB | ILE | B | 7 | 11.106 | 64.014 | −18.486 | 1.00 | 43.99 | C |
| ATOM | 2323 | CG1 | ILE | B | 7 | 9.741 | 63.968 | −17.797 | 1.00 | 42.01 | C |
| ATOM | 2324 | CG2 | ILE | B | 7 | 11.160 | 63.095 | −19.726 | 1.00 | 42.89 | C |
| ATOM | 2325 | CD1 | ILE | B | 7 | 8.658 | 64.728 | −18.525 | 1.00 | 42.63 | C |
| ATOM | 2326 | N | GLN | B | 8 | 14.177 | 62.578 | −18.425 | 1.00 | 38.66 | N |
| ATOM | 2327 | CA | GLN | B | 8 | 15.433 | 62.495 | −19.153 | 1.00 | 38.95 | C |
| ATOM | 2328 | C | GLN | B | 8 | 15.292 | 61.451 | −20.241 | 1.00 | 37.88 | C |
| ATOM | 2329 | O | GLN | B | 8 | 14.814 | 60.348 | −19.979 | 1.00 | 39.03 | O |
| ATOM | 2330 | CB | GLN | B | 8 | 16.591 | 62.121 | −18.237 | 1.00 | 35.55 | C |
| ATOM | 2331 | CG | GLN | B | 8 | 16.883 | 63.157 | −17.180 | 1.00 | 35.48 | C |
| ATOM | 2332 | CD | GLN | B | 8 | 17.958 | 62.679 | −16.241 | 1.00 | 43.71 | C |
| ATOM | 2333 | OE1 | GLN | B | 8 | 19.139 | 62.677 | −16.591 | 1.00 | 43.03 | O |
| ATOM | 2334 | NE2 | GLN | B | 8 | 17.556 | 62.243 | −15.050 | 1.00 | 44.33 | N |
| ATOM | 2335 | N | VAL | B | 9 | 15.718 | 61.792 | −21.451 | 1.00 | 36.05 | N |
| ATOM | 2336 | CA | VAL | B | 9 | 15.699 | 60.877 | −22.582 | 1.00 | 38.97 | C |
| ATOM | 2337 | C | VAL | B | 9 | 17.128 | 60.720 | −23.077 | 1.00 | 36.88 | C |
| ATOM | 2338 | O | VAL | B | 9 | 17.828 | 61.721 | −23.280 | 1.00 | 36.78 | O |
| ATOM | 2339 | CB | VAL | B | 9 | 14.775 | 61.392 | −23.698 | 1.00 | 38.74 | C |
| ATOM | 2340 | CG1 | VAL | B | 9 | 14.686 | 60.392 | −24.822 | 1.00 | 35.95 | C |
| ATOM | 2341 | CG2 | VAL | B | 9 | 13.378 | 61.711 | −23.111 | 1.00 | 45.36 | C |
| ATOM | 2342 | N | TYR | B | 10 | 17.555 | 59.472 | −23.266 | 1.00 | 38.82 | N |
| ATOM | 2343 | CA | TYR | B | 10 | 18.956 | 59.177 | −23.558 | 1.00 | 38.55 | C |
| ATOM | 2344 | C | TYR | B | 10 | 19.088 | 57.724 | −23.985 | 1.00 | 40.55 | C |
| ATOM | 2345 | O | TYR | B | 10 | 18.187 | 56.908 | −23.764 | 1.00 | 40.92 | O |
| ATOM | 2346 | CB | TYR | B | 10 | 19.854 | 59.462 | −22.346 | 1.00 | 40.40 | C |
| ATOM | 2347 | CG | TYR | B | 10 | 19.446 | 58.715 | −21.081 | 1.00 | 44.52 | C |
| ATOM | 2348 | CD1 | TYR | B | 10 | 18.434 | 59.205 | −20.253 | 1.00 | 40.34 | C |
| ATOM | 2349 | CD2 | TYR | B | 10 | 20.090 | 57.534 | −20.705 | 1.00 | 40.09 | C |
| ATOM | 2350 | CE1 | TYR | B | 10 | 18.070 | 58.532 | −19.104 | 1.00 | 38.55 | C |
| ATOM | 2351 | CE2 | TYR | B | 10 | 19.725 | 56.842 | −19.557 | 1.00 | 38.18 | C |
| ATOM | 2352 | CZ | TYR | B | 10 | 18.721 | 57.351 | −18.757 | 1.00 | 44.82 | C |
| ATOM | 2353 | OH | TYR | B | 10 | 18.376 | 56.675 | −17.610 | 1.00 | 37.51 | O |
| ATOM | 2354 | N | SER | B | 11 | 20.220 | 57.410 | −24.619 | 1.00 | 36.88 | N |
| ATOM | 2355 | CA | SER | B | 11 | 20.486 | 56.045 | −25.042 | 1.00 | 44.88 | C |
| ATOM | 2356 | C | SER | B | 11 | 21.326 | 55.318 | −23.994 | 1.00 | 14.94 | C |
| ATOM | 2357 | O | SER | B | 11 | 22.051 | 55.936 | −23.202 | 1.00 | 43.81 | O |
| ATOM | 2358 | CB | SER | B | 11 | 21.183 | 56.014 | −26.409 | 1.00 | 46.85 | C |
| ATOM | 2359 | OG | SER | B | 11 | 22.276 | 56.903 | −26.450 | 1.00 | 46.53 | C |
| ATOM | 2360 | N | ARG | B | 12 | 21.191 | 53.991 | −23.979 | 1.00 | 39.50 | N |
| ATOM | 2361 | CA | ARG | B | 12 | 21.938 | 53.167 | −23.033 | 1.00 | 44.74 | C |
| ATOM | 2362 | C | ARG | B | 12 | 23.440 | 53.297 | −23.267 | 1.00 | 50.82 | C |
| ATOM | 2363 | O | ARG | B | 12 | 24.203 | 53.600 | −22.344 | 1.00 | 47.03 | O |
| ATOM | 2364 | CB | ARG | B | 12 | 21.499 | 51.704 | −23.143 | 1.00 | 48.63 | C |
| ATOM | 2365 | CG | ARG | B | 12 | 22.400 | 50.725 | −22.377 | 1.00 | 47.67 | C |
| ATOM | 2366 | CD | ARG | B | 12 | 21.919 | 49.293 | −22.533 | 1.00 | 46.74 | C |
| ATOM | 2367 | NE | ARG | B | 12 | 20.564 | 49.131 | −22.029 | 1.00 | 45.30 | N |
| ATOM | 2368 | CZ | ARG | B | 12 | 19.936 | 47.965 | −21.949 | 1.00 | 51.94 | C |
| ATOM | 2369 | NH1 | ARG | B | 12 | 20.539 | 46.848 | −22.349 | 1.00 | 51.69 | N1+ |
| ATOM | 2370 | NH2 | ARG | B | 12 | 18.701 | 47.913 | −21.478 | 1.00 | 50.16 | N |
| ATOM | 2371 | N | HIS | B | 13 | 23.883 | 53.073 | −24.522 | 1.00 | 51.77 | N |
| ATOM | 2372 | CA | HIS | B | 13 | 25.225 | 53.295 | −25.053 | 1.00 | 55.55 | C |
| ATOM | 2373 | C | HIS | B | 13 | 25.221 | 54.504 | −25.973 | 1.00 | 53.24 | C |
| ATOM | 2374 | O | HIS | B | 13 | 24.181 | 54.845 | −26.551 | 1.00 | 48.06 | O |
| ATOM | 2375 | CB | HIS | B | 13 | 25.722 | 52.069 | −25.825 | 1.00 | 50.23 | C |
| ATOM | 2376 | CG | HIS | B | 13 | 25.631 | 50.801 | −25.042 | 1.00 | 52.68 | C |
| ATOM | 2377 | ND1 | HIS | B | 13 | 24.666 | 49.847 | −25.283 | 1.00 | 51.34 | N |

TABLE 77-continued

| | | | | | | | | | | |
|---|---|---|---|---|---|---|---|---|---|---|
| ATOM | 2378 | CD2 | HIS | B | 13 | 26.357 | 50.347 | −23.991 | 1.00 | 49.20 | C |
| ATOM | 2379 | CE1 | HIS | B | 13 | 24.813 | 48.849 | −24.430 | 1.00 | 51.99 | C |
| ATOM | 2380 | NE2 | HIS | B | 13 | 25.830 | 49.129 | −23.633 | 1.00 | 54.02 | N |
| ATOM | 2381 | N | PRO | B | 14 | 26.352 | 55.188 | −26.125 | 1.00 | 50.96 | N |
| ATOM | 2382 | CA | PRO | B | 14 | 26.376 | 56.337 | −27.037 | 1.00 | 58.34 | C |
| ATOM | 2383 | C | PRO | B | 14 | 25.934 | 55.908 | −28.430 | 1.00 | 53.87 | C |
| ATOM | 2384 | O | PRO | B | 14 | 26.173 | 54.777 | −28.865 | 1.00 | 54.80 | O |
| ATOM | 2385 | CB | PRO | B | 14 | 27.835 | 56.813 | −27.000 | 1.00 | 59.64 | C |
| ATOM | 2386 | CG | PRO | B | 14 | 28.597 | 55.793 | −26.202 | 1.00 | 56.60 | C |
| ATOM | 2387 | CD | PRO | B | 14 | 27.621 | 55.003 | −25.400 | 1.00 | 57.62 | C |
| ATOM | 2388 | N | ALA | B | 15 | 25.210 | 56.796 | −29.095 | 1.00 | 55.98 | N |
| ATOM | 2389 | CA | ALA | B | 15 | 24.542 | 56.432 | −30.333 | 1.00 | 59.88 | C |
| ATOM | 2390 | C | ALA | B | 15 | 25.531 | 56.372 | −31.487 | 1.00 | 52.58 | C |
| ATOM | 2391 | O | ALA | B | 15 | 26.422 | 57.217 | −31.613 | 1.00 | 55.74 | O |
| ATOM | 2392 | CB | ALA | B | 15 | 23.429 | 57.428 | −30.655 | 1.00 | 59.12 | C |
| ATOM | 2393 | N | GLU | B | 16 | 25.360 | 55.368 | −32.334 | 1.00 | 54.98 | N |
| ATOM | 2394 | CA | GLU | B | 16 | 26.136 | 55.264 | −33.557 | 1.00 | 64.81 | C |
| ATOM | 2395 | C | GLU | B | 16 | 25.245 | 54.701 | −34.653 | 1.00 | 60.79 | C |
| ATOM | 2396 | O | GLU | B | 16 | 24.522 | 53.723 | −34.445 | 1.00 | 59.90 | O |
| ATOM | 2397 | CB | GLU | B | 16 | 27.383 | 54.396 | −33.349 | 1.00 | 60.69 | C |
| ATOM | 2398 | CG | GLU | B | 16 | 27.801 | 53.564 | −34.553 | 1.00 | 68.82 | C |
| ATOM | 2399 | CD | GLU | B | 16 | 29.107 | 52.818 | −34.315 | 1.00 | 65.08 | C |
| ATOM | 2400 | OE1 | GLU | B | 16 | 30.055 | 53.452 | −33.801 | 1.00 | 65.91 | O |
| ATOM | 2401 | OE2 | GLU | B | 16 | 29.176 | 51.608 | −34.630 | 1.00 | 65.74 | O1− |
| ATOM | 2402 | N | ASN | B | 17 | 25.295 | 55.348 | −35.810 | 1.00 | 60.85 | N |
| ATOM | 2403 | CA | ASN | B | 17 | 24.480 | 54.989 | −36.961 | 1.00 | 62.13 | C |
| ATOM | 2404 | C | ASN | B | 17 | 24.509 | 53.485 | −37.222 | 1.00 | 59.80 | C |
| ATOM | 2405 | O | ASN | B | 17 | 25.573 | 52.907 | −37.449 | 1.00 | 64.54 | O |
| ATOM | 2406 | CB | ASN | B | 17 | 25.015 | 55.768 | −38.166 | 1.00 | 62.67 | C |
| ATOM | 2407 | CG | ASN | B | 17 | 24.077 | 55.758 | −39.346 | 1.00 | 66.03 | C |
| ATOM | 2408 | OD1 | ASN | B | 17 | 22.870 | 55.523 | −39.202 | 1.00 | 63.53 | O |
| ATOM | 2409 | ND2 | ASN | B | 17 | 24.632 | 56.027 | −40.541 | 1.00 | 55.82 | N |
| ATOM | 2410 | N | GLY | B | 18 | 23.342 | 52.846 | −37.145 | 1.00 | 58.38 | N |
| ATOM | 2411 | CA | GLY | B | 18 | 23.179 | 51.471 | −37.577 | 1.00 | 65.50 | C |
| ATOM | 2412 | C | GLY | B | 18 | 23.496 | 50.376 | −36.572 | 1.00 | 64.30 | C |
| ATOM | 2413 | O | GLY | B | 18 | 23.370 | 49.194 | −36.922 | 1.00 | 61.33 | O |
| ATOM | 2414 | N | LYS | B | 19 | 23.916 | 50.708 | −35.349 | 1.00 | 62.20 | N |
| ATOM | 2415 | CA | LYS | B | 19 | 24.138 | 49.698 | −34.316 | 1.00 | 62.85 | C |
| ATOM | 2416 | C | LYS | B | 19 | 22.967 | 49.697 | −33.340 | 1.00 | 64.06 | C |
| ATOM | 2417 | O | LYS | B | 19 | 22.549 | 50.761 | −32.861 | 1.00 | 54.58 | O |
| ATOM | 2418 | CB | LYS | B | 19 | 25.450 | 49.930 | −33.560 | 1.00 | 60.65 | C |
| ATOM | 2419 | CG | LYS | B | 19 | 25.637 | 51.338 | −33.053 | 1.00 | 65.48 | C |
| ATOM | 2420 | CD | LYS | B | 19 | 26.204 | 51.421 | −31.631 | 1.00 | 68.61 | C |
| ATOM | 2421 | CE | LYS | B | 19 | 25.156 | 51.921 | −30.608 | 1.00 | 65.43 | C |
| ATOM | 2422 | NZ | LYS | B | 19 | 24.053 | 52.790 | −31.198 | 1.00 | 56.61 | N1+ |
| ATOM | 2423 | N | SER | B | 20 | 22.446 | 48.502 | −33.045 | 1.00 | 58.78 | N |
| ATOM | 2424 | CA | SER | B | 20 | 21.348 | 48.389 | −32.098 | 1.00 | 57.63 | C |
| ATOM | 2425 | C | SER | B | 20 | 21.761 | 48.953 | −30.742 | 1.00 | 59.52 | C |
| ATOM | 2426 | O | SER | B | 20 | 22.934 | 48.914 | −30.348 | 1.00 | 55.02 | O |
| ATOM | 2427 | CB | SER | B | 20 | 20.889 | 46.937 | −31.962 | 1.00 | 65.05 | C |
| ATOM | 2428 | OG | SER | B | 20 | 21.619 | 16.278 | −30.947 | 1.00 | 74.50 | O |
| ATOM | 2429 | N | ASN | B | 21 | 20.778 | 49.510 | −30.045 | 1.00 | 50.85 | N |
| ATOM | 2430 | CA | ASN | B | 21 | 20.983 | 50.282 | −28.834 | 1.00 | 45.75 | C |
| ATOM | 2431 | C | ASN | B | 21 | 19.684 | 50.213 | −28.033 | 1.00 | 52.66 | C |
| ATOM | 2432 | O | ASN | B | 21 | 18.782 | 49.422 | −28.339 | 1.00 | 49.13 | O |
| ATOM | 2433 | CB | ASN | B | 21 | 21.403 | 51.714 | −29.204 | 1.00 | 47.47 | C |
| ATOM | 2434 | CG | ASN | B | 21 | 22.133 | 52.450 | −28.082 | 1.00 | 50.46 | C |
| ATOM | 2435 | OD1 | ASN | B | 21 | 21.984 | 52.139 | −26.897 | 1.00 | 49.51 | O |
| ATOM | 2436 | ND2 | ASN | B | 21 | 22.907 | 53.465 | −28.459 | 1.00 | 47.70 | N |
| ATOM | 2437 | N | PHE | B | 22 | 19.582 | 51.041 | −27.003 | 1.00 | 47.72 | N |
| ATOM | 2438 | CA | PHE | B | 22 | 18.376 | 51.094 | −26.195 | 1.00 | 43.93 | C |
| ATOM | 2439 | C | PHE | B | 22 | 18.041 | 52.548 | −25.948 | 1.00 | 46.43 | C |
| ATOM | 2440 | O | PHE | B | 22 | 18.921 | 53.342 | −25.604 | 1.00 | 43.11 | O |
| ATOM | 2441 | CB | PHE | B | 22 | 18.537 | 50.339 | −24.872 | 1.00 | 48.24 | C |
| ATOM | 2442 | CG | PHE | B | 22 | 18.278 | 48.860 | −24.995 | 1.00 | 56.03 | C |
| ATOM | 2443 | CD1 | PHE | B | 22 | 16.980 | 48.372 | −24.977 | 1.00 | 53.83 | C |
| ATOM | 2444 | CD2 | PHE | B | 22 | 19.328 | 47.963 | −25.145 | 1.00 | 53.39 | C |
| ATOM | 2445 | CE1 | PHE | B | 22 | 16.730 | 47.015 | −25.098 | 1.00 | 58.83 | C |
| ATOM | 2446 | CE2 | PHE | B | 22 | 19.083 | 46.602 | −25.268 | 1.00 | 52.74 | C |
| ATOM | 2447 | CZ | PHE | B | 22 | 17.783 | 46.130 | −25.244 | 1.00 | 60.30 | C |
| ATOM | 2448 | N | LEU | B | 23 | 16.780 | 52.906 | −26.162 | 1.00 | 46.07 | N |
| ATOM | 2449 | CA | LEU | B | 23 | 16.336 | 54.269 | −25.932 | 1.00 | 45.98 | C |
| ATOM | 2450 | C | LEU | B | 23 | 15.635 | 54.304 | −24.588 | 1.00 | 41.64 | C |
| ATOM | 2451 | O | LEU | B | 23 | 14.716 | 53.513 | −24.348 | 1.00 | 43.74 | O |
| ATOM | 2452 | CB | LEU | B | 23 | 15.403 | 54.752 | −27.038 | 1.00 | 48.61 | O |
| ATOM | 2453 | CG | LEU | B | 23 | 14.903 | 56.192 | −26.851 | 1.00 | 50.41 | O |
| ATOM | 2454 | CD1 | LEU | B | 23 | 16.029 | 57.165 | −26.971 | 1.00 | 46.20 | C |
| ATOM | 2455 | CD2 | LEU | B | 23 | 13.791 | 56.505 | −27.850 | 1.00 | 51.87 | C |
| ATOM | 2456 | N | ASN | B | 24 | 16.075 | 55.209 | −23.721 | 1.00 | 42.17 | N |
| ATOM | 2457 | CA | ASN | B | 24 | 15.593 | 55.289 | −22.351 | 1.00 | 43.43 | C |

TABLE 77-continued

| | | | | | | | | | | |
|---|---|---|---|---|---|---|---|---|---|---|
| ATOM | 2458 | C | ASN | B | 24 | 14.805 | 56.569 | −22.139 | 1.00 | 41.82 C |
| ATOM | 2459 | O | ASN | B | 24 | 15.211 | 57.646 | −22.589 | 1.00 | 40.43 O |
| ATOM | 2460 | CB | ASN | B | 24 | 16.757 | 55.250 | −21.352 | 1.00 | 42.43 C |
| ATOM | 2461 | CG | ASN | B | 24 | 17.439 | 53.909 | −21.312 | 1.00 | 43.14 C |
| ATOM | 2462 | OD1 | ASN | B | 24 | 16.813 | 52.885 | −21.558 | 1.00 | 46.51 O |
| ATOM | 2463 | ND2 | ASN | E | 24 | 18.733 | 53.901 | −21.009 | 1.00 | 43.77 N |
| ATOM | 2464 | N | CYS | B | 25 | 13.674 | 56.443 | −21.450 | 1.00 | 42.21 N |
| ATOM | 2465 | CA | CYS | B | 25 | 13.005 | 57.584 | −20.842 | 1.00 | 34.09 C |
| ATOM | 2466 | C | CYS | B | 25 | 12.975 | 57.341 | −19.341 | 1.00 | 39.71 C |
| ATOM | 2467 | O | CYS | B | 25 | 12.316 | 56.402 | −18.870 | 1.00 | 39.67 O |
| ATOM | 2468 | CB | CYS | B | 25 | 11.601 | 57.782 | −21.402 | 1.00 | 38.82 C |
| ATOM | 2469 | SG | CYS | B | 25 | 10.813 | 59.231 | −20.722 | 1.00 | 45.81 S |
| ATOM | 2470 | N | TYR | B | 26 | 13.692 | 58.180 | −18.599 | 1.00 | 38.11 N |
| ATOM | 2471 | CA | TYR | B | 26 | 13.843 | 58.050 | −17.156 | 1.00 | 35.72 C |
| ATOM | 2472 | C | TYR | B | 26 | 13.034 | 59.152 | −16.500 | 1.00 | 38.20 C |
| ATOM | 2473 | O | TYR | B | 26 | 13.362 | 60.336 | −16.643 | 1.00 | 37.53 O |
| ATOM | 2474 | CB | TYR | B | 26 | 15.310 | 58.165 | −16.766 | 1.00 | 37.42 C |
| ATOM | 2475 | CG | TYR | B | 26 | 15.578 | 57.948 | −15.305 | 1.00 | 35.17 C |
| ATOM | 2476 | CD1 | TYR | B | 26 | 15.183 | 56.772 | −14.683 | 1.00 | 39.89 C |
| ATOM | 2477 | CD2 | TYR | B | 26 | 16.260 | 58.897 | −14.551 | 1.00 | 39.34 C |
| ATOM | 2478 | CE1 | TYR | B | 26 | 15.460 | 56.543 | −13.340 | 1.00 | 41.75 C |
| ATOM | 2479 | CE2 | TYR | B | 26 | 16.538 | 58.680 | −13.206 | 1.00 | 39.93 C |
| ATOM | 2480 | CZ | TYR | B | 26 | 16.139 | 57.501 | −12.613 | 1.00 | 41.61 C |
| ATOM | 2481 | OH | TYR | B | 26 | 16.412 | 57.262 | −11.285 | 1.00 | 45.97 O |
| ATOM | 2482 | N | VAL | B | 27 | 11.969 | 58.771 | −15.797 | 1.00 | 36.66 N |
| ATOM | 2483 | CA | VAL | B | 27 | 11.113 | 59.717 | −15.095 | 1.00 | 33.33 C |
| ATOM | 2484 | C | VAL | B | 27 | 11.371 | 59.552 | −13.607 | 1.00 | 33.72 C |
| ATOM | 2485 | O | VAL B | B | 27 | 11.449 | 58.425 | −13.105 | 1.00 | 34.04 C |
| ATOM | 2486 | CB | VAL B | B | 27 | 9.626 | 59.519 | −15.446 | 1.00 | 36.32 C |
| ATOM | 2487 | CG1 | VAL B | B | 27 | 9.335 | 60.078 | −16.836 | 1.00 | 39.98 C |
| ATOM | 2488 | CG2 | VAL B | B | 27 | 9.239 | 58.036 | −15.401 | 1.00 | 38.17 C |
| ATOM | 2489 | N | SER B | B | 28 | 11.555 | 60.666 | −12.912 | 1.00 | 30.89 N |
| ATOM | 2490 | CA | SER B | B | 28 | 11.954 | 60.595 | −11.516 | 1.00 | 35.63 C |
| ATOM | 2491 | C | SER B | B | 28 | 11.357 | 61.777 | −10.786 | 1.00 | 32.35 C |
| ATOM | 2492 | O | SER B | B | 28 | 10.891 | 62.736 | −11.399 | 1.00 | 38.72 O |
| ATOM | 2493 | CB | SER B | B | 28 | 13.487 | 60.586 | −11.367 | 1.00 | 34.80 C |
| ATOM | 2494 | OG | SER B | B | 28 | 14.011 | 61.803 | −11.864 | 1.00 | 35.67 O |
| ATOM | 2495 | N | GLY B | B | 29 | 11.388 | 61.700 | −9.457 | 1.00 | 36.93 N |
| ATOM | 2496 | CA | GLY B | B | 29 | 10.930 | 62.801 | −8.641 | 1.00 | 34.41 O |
| ATOM | 2497 | C | GLY B | B | 29 | 9.436 | 63.032 | −8.656 | 1.00 | 40.70 C |
| ATOM | 2498 | O | GLY B | B | 29 | 8.996 | 64.122 | −8.292 | 1.00 | 38.15 O |
| ATOM | 2499 | N | PHE B | B | 30 | 8.626 | 62.044 | −9.043 | 1.00 | 36.94 N |
| ATOM | 2500 | CA | PHE B | B | 30 | 7.199 | 62.310 | −9.153 | 1.00 | 37.99 C |
| ATOM | 2501 | C | PHE B | B | 30 | 6.392 | 61.641 | −8.043 | 1.00 | 38.91 C |
| ATOM | 2502 | O | PHE B | B | 30 | 6.820 | 60.687 | −7.384 | 1.00 | 35.01 O |
| ATOM | 2503 | CB | PHE B | B | 30 | 6.629 | 61.912 | −10.529 | 1.00 | 35.04 C |
| ATOM | 2504 | CG | PHE B | B | 30 | 6.839 | 60.472 | −10.914 | 1.00 | 37.44 C |
| ATOM | 2505 | CD1 | PHE B | B | 30 | 8.046 | 60.054 | −11.466 | 1.00 | 35.84 C |
| ATOM | 2506 | CD2 | PHE B | B | 30 | 5.807 | 59.557 | −10.806 | 1.00 | 34.47 C |
| ATOM | 2507 | CE1 | PHE B | B | 30 | 8.228 | 58.746 | −11.855 | 1.00 | 33.23 C |
| ATOM | 2508 | CE2 | PHE B | B | 30 | 5.976 | 58.232 | −11.203 | 1.00 | 39.27 C |
| ATOM | 2509 | CZ | PHE B | B | 30 | 7.197 | 57.822 | −11.724 | 1.00 | 36.47 C |
| ATOM | 2510 | N | HIS B | B | 31 | 5.214 | 62.212 | −7.825 | 1.00 | 36.32 N |
| ATOM | 2511 | CA | HIS B | B | 31 | 4.227 | 61.700 | −6.901 | 1.00 | 38.14 C |
| ATOM | 2512 | C | HIS B | B | 31 | 2.897 | 62.363 | −7.253 | 1.00 | 39.98 C |
| ATOM | 2513 | O | HIS B | B | 31 | 2.861 | 63.574 | −7.507 | 1.00 | 37.17 O |
| ATOM | 2514 | CB | HIS B | B | 31 | 4.633 | 61.971 | −5.457 | 1.00 | 35.77 C |
| ATOM | 2515 | CG | HIS B | B | 31 | 4.266 | 60.866 | −4.527 | 1.00 | 41.26 C |
| ATOM | 2516 | ND1 | HIS B | B | 31 | 2.970 | 60.636 | −4.125 | 1.00 | 38.95 N |
| ATOM | 2517 | CD2 | HIS B | B | 31 | 5.019 | 59.900 | −3.944 | 1.00 | 43.68 C |
| ATOM | 2518 | CE1 | HIS B | B | 31 | 2.936 | 59.580 | −3.332 | 1.00 | 38.98 C |
| ATOM | 2519 | NE2 | HIS B | B | 31 | 4.166 | 59.112 | −3.208 | 1.00 | 45.86 N |
| ATOM | 2520 | N | PRO | B | 32 | 1.796 | 61.606 | −7.333 | 1.00 | 40.70 N |
| ATOM | 2521 | CA | PRO | B | 32 | 1.714 | 60.154 | −7.113 | 1.00 | 40.72 C |
| ATOM | 2522 | C | PRO | B | 32 | 2.339 | 59.298 | −8.220 | 1.00 | 37.20 C |
| ATOM | 2523 | O | PRO | B | 32 | 2.867 | 59.805 | −9.209 | 1.00 | 36.81 O |
| ATOM | 2524 | CB | PRO | B | 32 | 0.204 | 59.901 | −7.042 | 1.00 | 41.15 C |
| ATOM | 2525 | CG | PRO | B | 32 | −0.384 | 60.976 | −7.906 | 1.00 | 40.68 C |
| ATOM | 2526 | CD | PRO | B | 32 | 0.477 | 62.194 | −7.642 | 1.00 | 37.62 C |
| ATOM | 2527 | N | SER | B | 33 | 2.246 | 57.982 | −8.042 | 1.00 | 34.02 N |
| ATOM | 2528 | CA | SER | B | 33 | 2.949 | 57.047 | −8.913 | 1.00 | 37.93 C |
| ATOM | 2529 | C | SER | B | 33 | 2.274 | 56.860 | −10.263 | 1.00 | 41.86 C |
| ATOM | 2530 | O | SER | B | 33 | 2.917 | 56.358 | −11.183 | 1.00 | 38.05 O |
| ATOM | 2531 | CB | SER | B | 33 | 3.074 | 55.690 | −8.234 | 1.00 | 38.92 C |
| ATOM | 2532 | OG | SER | B | 33 | 1.821 | 55.058 | −8.189 | 1.00 | 40.84 O |
| ATOM | 2533 | N | ASP | B | 34 | 1.002 | 57.237 | −10.404 | 1.00 | 39.92 N |
| ATOM | 2534 | CA | ASP | B | 34 | 0.320 | 57.069 | −11.678 | 1.00 | 41.39 C |
| ATOM | 2535 | C | ASP | B | 34 | 0.992 | 57.931 | −12.730 | 1.00 | 38.34 C |
| ATOM | 2536 | O | ASP | B | 34 | 1.086 | 59.150 | −12.570 | 1.00 | 39.37 O |
| ATOM | 2537 | CB | ASP | B | 34 | −1.151 | 57.458 | −11.533 | 1.00 | 45.51 C |

TABLE 77-continued

| ATOM | 2538 | CG  | ASP | B | 34 | −1.746 | 56.972 | −10.223 | 1.00 | 51.74 | C   |
|------|------|-----|-----|---|----|--------|--------|---------|------|-------|-----|
| ATOM | 2539 | OD1 | ASP | B | 34 | −2.216 | 55.814 | −10.166 | 1.00 | 55.90 | O   |
| ATOM | 2540 | OD2 | ASP | B | 34 | −1.684 | 57.734 | −9.235  | 1.00 | 49.48 | O1− |
| ATOM | 2541 | N   | ILE | B | 35 | 1.466  | 57.316 | −13.807 | 1.00 | 38.11 | N   |
| ATOM | 2542 | CA  | ILE | B | 35 | 2.135  | 58.090 | −14.843 | 1.00 | 39.49 | C   |
| ATOM | 2543 | C   | ILE | B | 35 | 1.981  | 57.356 | −16.161 | 1.00 | 41.43 | C   |
| ATOM | 2544 | O   | ILE | B | 35 | 1.908  | 56.127 | −16.206 | 1.00 | 45.75 | O   |
| ATOM | 2545 | CB  | ILE | B | 35 | 3.625  | 58.346 | −14.505 | 1.00 | 38.61 | C   |
| ATOM | 2546 | CG1 | ILE | B | 35 | 4.212  | 59.455 | −15.399 | 1.00 | 41.36 | C   |
| ATOM | 2547 | CG2 | ILE | B | 35 | 4.445  | 57.064 | −14.658 | 1.00 | 39.53 | C   |
| ATOM | 2548 | CD1 | ILE | B | 35 | 5.437  | 60.154 | −14.781 | 1.00 | 37.87 | C   |
| ATOM | 2549 | N   | GLU | B | 36 | 1.935  | 58.121 | −17.243 | 1.00 | 41.76 | N   |
| ATOM | 2550 | CA  | GLU | B | 36 | 1.828  | 57.561 | −18.580 | 1.00 | 47.06 | C   |
| ATOM | 2551 | C   | GLU | B | 36 | 3.042  | 58.005 | −19.374 | 1.00 | 43.01 | C   |
| ATOM | 2552 | O   | GLU | B | 36 | 3.260  | 59.207 | −19.538 | 1.00 | 44.32 | O   |
| ATOM | 2553 | CB  | GLU | B | 36 | 0.551  | 58.025 | −19.275 | 1.00 | 45.64 | C   |
| ATOM | 2554 | CG  | GLU | B | 36 | 0.503  | 57.553 | −20.698 | 1.00 | 57.83 | C   |
| ATOM | 2555 | CD  | GLU | B | 36 | −0.877 | 57.575 | −21.250 | 0.00 | 57.00 | C   |
| ATOM | 2556 | OE1 | GLU | B | 36 | −1.665 | 58.422 | −20.804 | 1.00 | 65.68 | O   |
| ATOM | 2557 | OE2 | GLU | B | 36 | −1.176 | 56.736 | −22.112 | 1.00 | 54.43 | O1− |
| ATOM | 2558 | N   | VAL | B | 37 | 3.819  | 57.042 | −19.873 | 1.00 | 41.42 | N   |
| ATOM | 2559 | CA  | VAL | B | 37 | 5.050  | 57.335 | −20.592 | 1.00 | 42.59 | C   |
| ATOM | 2560 | C   | VAL | B | 37 | 5.010  | 56.618 | −21.934 | 1.00 | 46.16 | C   |
| ATOM | 2561 | O   | VAL | B | 37 | 4.810  | 55.402 | −21.989 | 1.00 | 43.26 | O   |
| ATOM | 2562 | CB  | VAL | B | 37 | 6.297  | 56.911 | −19.791 | 1.00 | 40.34 | C   |
| ATOM | 2563 | CG1 | VAL | B | 37 | 7.557  | 57.238 | −20.578 | 1.00 | 41.74 | C   |
| ATOM | 2564 | CG2 | VAL | B | 37 | 6.319  | 57.619 | −18.439 | 1.00 | 43.50 | C   |
| ATOM | 2565 | N   | ASP | B | 38 | 5.194  | 57.366 | −23.015 | 1.00 | 46.08 | N   |
| ATOM | 2566 | CA  | ASP | B | 38 | 5.360  | 56.748 | −24.319 | 1.00 | 47.91 | C   |
| ATOM | 2567 | C   | ASP | B | 38 | 6.680  | 57.176 | −24.932 | 1.00 | 40.84 | C   |
| ATOM | 2568 | O   | ASP | B | 38 | 7.126  | 58.313 | −24.756 | 1.00 | 45.13 | O   |
| ATOM | 2569 | CB  | ASP | B | 38 | 4.220  | 57.111 | −25.271 | 1.00 | 53.10 | C   |
| ATOM | 2570 | CG  | ASP | B | 38 | 2.896  | 56.504 | −24.852 | 1.00 | 57.53 | C   |
| ATOM | 2571 | OD1 | ASP | B | 38 | 2.790  | 55.261 | −24.782 | 1.00 | 61.35 | O   |
| ATOM | 2572 | OD2 | ASP | B | 38 | 1.968  | 57.286 | −24.583 | 1.00 | 61.36 | O1− |
| ATOM | 2573 | N   | LEU | B | 39 | 7.290  | 56.253 | −25.666 | 1.00 | 43.59 | N   |
| ATOM | 2574 | CA  | LEU | B | 39 | 8.451  | 56.542 | −26.491 | 1.00 | 46.29 | C   |
| ATOM | 2575 | C   | LEU | B | 39 | 7.982  | 56.737 | −27.926 | 1.00 | 47.96 | C   |
| ATOM | 2576 | O   | LEU | B | 39 | 7.123  | 55.998 | −28.406 | 1.00 | 48.29 | O   |
| ATOM | 2577 | CB  | LEU | B | 39 | 9.482  | 55.413 | −26.414 | 1.00 | 45.25 | C   |
| ATOM | 2578 | CG  | LEU | B | 39 | 10.042 | 55.194 | −25.000 | 1.00 | 47.66 | C   |
| ATOM | 2579 | CD1 | LEU | B | 39 | 10.942 | 53.971 | −24.962 | 1.00 | 47.96 | C   |
| ATOM | 2580 | CD2 | LEU | B | 39 | 10.785 | 56.420 | −24.531 | 1.00 | 47.42 | C   |
| ATOM | 2581 | N   | LEU | B | 40 | 8.527  | 57.750 | −28.596 | 1.00 | 49.96 | N   |
| ATOM | 2582 | CA  | LEU | B | 40 | 8.044  | 58.164 | −29.908 | 1.00 | 53.67 | C   |
| ATOM | 2583 | C   | LEU | B | 40 | 9.171  | 58.103 | −30.929 | 1.00 | 56.01 | C   |
| ATOM | 2584 | O   | LEU | B | 40 | 10.283 | 58.577 | −30.664 | 1.00 | 48.26 | O   |
| ATOM | 2585 | CB  | LEU | B | 40 | 7.465  | 59.583 | −29.864 | 1.00 | 49.96 | C   |
| ATOM | 2586 | CG  | LEU | B | 40 | 6.354  | 59.874 | −28.848 | 1.00 | 53.36 | C   |
| ATOM | 2587 | CD1 | LEU | B | 40 | 5.991  | 61.337 | −28.916 | 1.00 | 46.94 | C   |
| ATOM | 2588 | CD2 | LEU | B | 40 | 5.121  | 59.000 | −29.063 | 1.00 | 45.15 | C   |
| ATOM | 2589 | N   | LYS | B | 41 | 8.872  | 57.526 | −32.093 | 1.00 | 50.82 | N   |
| ATOM | 2590 | CA  | LYS | B | 41 | 9.762  | 57.526 | −33.249 | 1.00 | 51.25 | C   |
| ATOM | 2591 | C   | LYS | B | 41 | 9.104  | 58.354 | −34.351 | 1.00 | 58.38 | C   |
| ATOM | 2592 | O   | LYS | B | 41 | 8.105  | 57.926 | −34.943 | 1.00 | 57.07 | O   |
| ATOM | 2593 | CB  | LYS | B | 41 | 10.048 | 56.103 | −33.723 | 1.00 | 48.17 | C   |
| ATOM | 2594 | CG  | LYS | B | 41 | 10.951 | 56.057 | −34.947 | 1.00 | 55.63 | C   |
| ATOM | 2595 | CD  | LYS | B | 41 | 11.185 | 54.638 | −35.445 | 1.00 | 54.46 | C   |
| ATOM | 2596 | CE  | LYS | B | 41 | 12.029 | 54.652 | −36.715 | 1.00 | 59.49 | C   |
| ATOM | 2597 | NZ  | LYS | B | 41 | 12.818 | 53.395 | −36.876 | 1.00 | 62.82 | N1+ |
| ATOM | 2598 | N   | ASN | B | 42 | 9.660  | 59.536 | −34.619 | 1.00 | 59.13 | N   |
| ATOM | 2599 | CA  | ASN | B | 42 | 9.092  | 60.469 | −35.593 | 1.00 | 61.02 | C   |
| ATOM | 2600 | C   | ASN | B | 42 | 7.633  | 60.787 | −35.250 | 1.00 | 64.16 | C   |
| ATOM | 2601 | O   | ASN | B | 42 | 6.732  | 60.688 | −36.086 | 1.00 | 62.76 | O   |
| ATOM | 2602 | CB  | ASN | B | 42 | 9.216  | 59.916 | −37.019 | 1.00 | 58.76 | C   |
| ATOM | 2603 | CG  | ASN | B | 42 | 10.650 | 59.565 | −37.396 | 1.00 | 60.19 | C   |
| ATOM | 2604 | OD1 | ASN | B | 42 | 11.564 | 60.386 | −37.262 | 1.00 | 55.02 | O   |
| ATOM | 2605 | ND2 | ASN | B | 42 | 10.853 | 58.331 | −37.856 | 1.00 | 57.05 | N   |
| ATOM | 2606 | N   | GLY | B | 43 | 7.398  | 61.140 | −33.986 | 1.00 | 60.24 | N   |
| ATOM | 2607 | CA  | GLY | B | 43 | 6.064  | 61.428 | −33.504 | 1.00 | 55.18 | C   |
| ATOM | 2608 | C   | GLY | B | 43 | 5.136  | 60.240 | −33.382 | 1.00 | 60.11 | C   |
| ATOM | 2609 | O   | GLY | B | 43 | 4.022  | 60.406 | −32.875 | 1.00 | 63.45 | O   |
| ATOM | 2610 | N   | GLU | B | 44 | 5.543  | 59.049 | −33.823 | 1.00 | 58.98 | N   |
| ATOM | 2611 | CA  | GLU | B | 44 | 4.718  | 57.849 | −33.737 | 1.00 | 56.38 | C   |
| ATOM | 2612 | C   | GLU | B | 44 | 5.132  | 57.009 | −32.531 | 1.00 | 61.06 | C   |
| ATOM | 2613 | O   | GLU | B | 44 | 6.321  | 56.909 | −32.208 | 1.00 | 56.81 | O   |
| ATOM | 2614 | CB  | GLU | B | 44 | 4.832  | 57.025 | −35.028 | 1.00 | 63.26 | C   |
| ATOM | 2615 | CG  | GLU | B | 44 | 4.138  | 55.665 | −35.010 | 1.00 | 63.30 | C   |
| ATOM | 2616 | CD  | GLU | B | 44 | 3.996  | 55.050 | −36.402 | 1.00 | 80.67 | C   |
| ATOM | 2617 | OE1 | GLU | B | 44 | 2.859  | 55.017 | −36.928 | 1.00 | 82.27 | O   |

TABLE 77-continued

| ATOM | 2618 | OE2 | GLU | B | 44 | 5.021 | 54.611 | −36.974 | 1.00 | 75.99 | O1− |
|---|---|---|---|---|---|---|---|---|---|---|---|
| ATOM | 2619 | N | ARG | B | 45 | 4.145 | 56.391 | −31.884 | 1.00 | 56.81 | N |
| ATOM | 2620 | CA | ARG | B | 45 | 4.362 | 55.662 | −30.639 | 1.00 | 59.46 | C |
| ATOM | 2621 | C | ARG | B | 45 | 4.986 | 54.295 | −30.886 | 1.00 | 58.32 | C |
| ATOM | 2622 | O | ARG | B | 45 | 4.523 | 53.529 | −31.733 | 1.00 | 55.55 | O |
| ATOM | 2623 | CB | ARG | B | 45 | 3.040 | 55.488 | −29.891 | 1.00 | 55.14 | C |
| ATOM | 2624 | CG | ARG | B | 45 | 3.186 | 54.898 | −28.500 | 1.00 | 59.49 | C |
| ATOM | 2625 | CD | ARG | B | 45 | 1.828 | 54.742 | −27.826 | 1.00 | 64.97 | C |
| ATOM | 2626 | NE | ARG | B | 45 | 0.992 | 53.801 | −28.565 | 1.00 | 66.93 | N |
| ATOM | 2627 | CZ | ARG | B | 45 | 1.067 | 52.483 | −28.425 | 1.00 | 66.18 | C |
| ATOM | 2628 | NH1 | ARG | B | 15 | 1.930 | 51.962 | −27.563 | 1.00 | 67.48 | N1+ |
| ATOM | 2629 | NH2 | ARG | B | 45 | 0.276 | 51.691 | −29.136 | 1.00 | 70.38 | N |
| ATOM | 2630 | N | ILE | B | 46 | 6.010 | 53.974 | −30.111 | 1.00 | 53.81 | N |
| ATOM | 2631 | CA | ILE | B | 46 | 6.659 | 52.672 | −30.174 | 1.00 | 50.82 | C |
| ATOM | 2632 | C | ILE | B | 46 | 5.901 | 51.708 | −29.277 | 1.00 | 48.62 | C |
| ATOM | 2633 | O | ILE | B | 46 | 5.650 | 52.006 | −28.106 | 1.00 | 51.21 | O |
| ATOM | 2634 | CB | ILE | B | 46 | 8.132 | 52.793 | −29.750 | 1.00 | 49.78 | C |
| ATOM | 2635 | CG1 | ILE | B | 46 | 8.790 | 53.907 | −30.573 | 1.00 | 41.95 | C |
| ATOM | 2636 | CG2 | ILE | B | 46 | 8.835 | 51.441 | −29.868 | 1.00 | 47.03 | C |
| ATOM | 2637 | CD1 | ILE | B | 46 | 10.225 | 54.241 | −30.179 | 1.00 | 50.75 | C |
| ATOM | 2638 | N | GLU | B | 47 | 5.529 | 50.545 | −29.817 | 1.00 | 56.74 | N |
| ATOM | 2639 | CA | GLU | B | 47 | 4.687 | 49.618 | −29.067 | 1.00 | 59.52 | C |
| ATOM | 2640 | C | GLU | B | 47 | 5.475 | 48.640 | −28.212 | 1.00 | 62.56 | C |
| ATOM | 2641 | O | GLU | B | 47 | 4.909 | 48.059 | −27.277 | 1.00 | 64.62 | O |
| ATOM | 2642 | CB | GLU | B | 47 | 3.782 | 48.823 | −30.014 | 1.00 | 67.29 | C |
| ATOM | 2643 | CG | GLU | B | 47 | 2.730 | 49.663 | −30.707 | 1.00 | 66.71 | C |
| ATOM | 2644 | CD | GLU | B | 47 | 1.891 | 48.853 | −31.664 | 0.00 | 72.40 | C |
| ATOM | 2645 | OE1 | GLU | B | 47 | 1.628 | 47.667 | −31.372 | 1.00 | 79.06 | O |
| ATOM | 2646 | OE2 | GLU | B | 47 | 1.508 | 49.401 | −32.716 | 1.00 | 79.12 | O1− |
| ATOM | 2647 | N | LYS | B | 48 | 6.754 | 48.443 | −28.507 | 1.00 | 58.59 | N |
| ATOM | 2648 | CA | LYS | B | 48 | 7.571 | 47.470 | −27.790 | 1.00 | 67.10 | C |
| ATOM | 2649 | C | LYS | B | 48 | 8.428 | 48.195 | −26.751 | 1.00 | 63.82 | C |
| ATOM | 2650 | O | LYS | B | 48 | 9.649 | 48.302 | −26.868 | 1.00 | 63.32 | O |
| ATOM | 2651 | CB | LYS | B | 48 | 8.425 | 46.685 | −28.780 | 1.00 | 66.20 | C |
| ATOM | 2652 | CG | LYS | B | 48 | 8.910 | 47.553 | −29.945 | 1.00 | 72.25 | C |
| ATOM | 2653 | CD | LYS | B | 48 | 10.105 | 46.948 | −30.657 | 1.00 | 77.71 | C |
| ATOM | 2654 | CE | LYS | B | 48 | 11.281 | 46.762 | −29.708 | 1.00 | 69.77 | C |
| ATOM | 2655 | NZ | LYS | B | 48 | 12.380 | 45.994 | −30.357 | 1.00 | 66.54 | N1+ |
| ATOM | 2656 | N | VAL | B | 49 | 7.759 | 48.703 | −25.717 | 1.00 | 62.93 | N |
| ATOM | 2657 | CA | VAL | B | 49 | 8.414 | 49.474 | −24.664 | 1.00 | 52.10 | C |
| ATOM | 2658 | C | VAL | B | 49 | 8.224 | 48.751 | −23.341 | 1.00 | 55.45 | C |
| ATOM | 2659 | O | VAL | B | 49 | 7.086 | 48.482 | −22.932 | 1.00 | 58.95 | O |
| ATOM | 2660 | CB | VAL | B | 49 | 7.871 | 50.904 | −24.574 | 1.00 | 49.17 | C |
| ATOM | 2661 | CG1 | VAL | B | 49 | 8.496 | 51.614 | −23.394 | 1.00 | 45.98 | C |
| ATOM | 2662 | CG2 | VAL | B | 49 | 8.155 | 51.652 | −25.860 | 1.00 | 50.07 | C |
| ATOM | 2663 | N | GLU | B | 50 | 9.334 | 48.431 | −22.682 | 1.00 | 50.75 | N |
| ATOM | 2664 | CA | GLU | B | 50 | 9.346 | 47.848 | −21.352 | 1.00 | 46.84 | C |
| ATOM | 2665 | C | GLU | B | 50 | 9.607 | 48.924 | −20.302 | 1.00 | 44.97 | C |
| ATOM | 2666 | O | GLU | B | 50 | 10.034 | 50.036 | −20.605 | 1.00 | 43.76 | O |
| ATOM | 2667 | CB | GLU | B | 50 | 10.416 | 46.761 | −21.262 | 1.00 | 53.19 | C |
| ATOM | 2668 | CG | GLU | B | 50 | 9.968 | 45.390 | −21.720 | 1.00 | 62.47 | C |
| ATOM | 2669 | CD | GLU | B | 50 | 11.146 | 44.492 | −22.030 | 0.00 | 64.13 | C |
| ATOM | 2670 | OE1 | GLU | B | 50 | 11.867 | 44.791 | −23.001 | 1.00 | 68.68 | O |
| ATOM | 2671 | OE2 | GLU | B | 50 | 11.370 | 43.506 | −21.297 | 1.00 | 78.44 | O1− |
| ATOM | 2672 | N | HIS | B | 51 | 9.376 | 48.571 | −19.042 | 1.00 | 43.62 | N |
| ATOM | 2673 | CA | HIS | B | 51 | 9.597 | 49.521 | −17.963 | 1.00 | 47.89 | C |
| ATOM | 2674 | C | HIS | B | 51 | 10.230 | 48.812 | −16.771 | 1.00 | 45.49 | C |
| ATOM | 2675 | O | HIS | B | 51 | 10.046 | 47.609 | −16.578 | 1.00 | 42.95 | O |
| ATOM | 2676 | CB | HIS | B | 51 | 8.283 | 50.192 | −17.549 | 1.00 | 45.57 | C |
| ATOM | 2677 | CG | HIS | B | 51 | 7.263 | 49.223 | −17.057 | 1.00 | 53.03 | C |
| ATOM | 2678 | ND1 | HIS | B | 51 | 7.257 | 48.746 | −15.763 | 1.00 | 56.77 | N |
| ATOM | 2679 | CD2 | HIS | B | 51 | 6.250 | 48.591 | −17.699 | 1.00 | 56.88 | U |
| ATOM | 2680 | CE1 | HIS | B | 51 | 6.268 | 47.879 | −15.623 | 1.00 | 61.57 | C |
| ATOM | 2681 | NE2 | HIS | B | 51 | 5.647 | 47.761 | −16.785 | 1.00 | 59.80 | N |
| ATOM | 2682 | N | SER | B | 52 | 10.967 | 49.577 | −15.966 | 1.00 | 40.64 | N |
| ATOM | 2683 | CA | SER | B | 52 | 11.547 | 49.058 | −14.733 | 1.00 | 40.60 | C |
| ATOM | 2684 | C | SER | B | 52 | 10.458 | 48.849 | −13.679 | 1.00 | 44.29 | C |
| ATOM | 2685 | O | SER | B | 52 | 9.292 | 49.211 | −13.869 | 1.00 | 36.92 | O |
| ATOM | 2686 | CB | SER | B | 52 | 12.595 | 50.024 | −14.188 | 1.00 | 35.82 | C |
| ATOM | 2687 | OG | SER | B | 52 | 11.980 | 51.276 | −13.924 | 1.00 | 39.59 | O |
| ATOM | 2688 | N | ASP | B | 53 | 10.858 | 48.291 | −12.534 | 1.00 | 40.79 | N |
| ATOM | 2689 | CA | ASP | B | 53 | 9.949 | 48.117 | −11.404 | 1.00 | 40.54 | C |
| ATOM | 2690 | C | ASP | B | 53 | 9.959 | 49.374 | −10.543 | 1.00 | 41.71 | C |
| ATOM | 2691 | O | ASP | B | 53 | 11.024 | 49.837 | −10.128 | 1.00 | 37.21 | O |
| ATOM | 2692 | CB | ASP | B | 53 | 10.344 | 46.900 | −10.568 | 1.00 | 38.88 | C |
| ATOM | 2693 | CG | ASP | B | 53 | 10.222 | 45.603 | −11.344 | 1.00 | 43.65 | C |
| ATOM | 2694 | OD1 | ASP | B | 53 | 9.095 | 45.295 | −11.772 | 1.00 | 40.38 | O |
| ATOM | 2695 | OD2 | ASP | B | 53 | 11.250 | 44.907 | −11.554 | 1.00 | 39.94 | O1− |
| ATOM | 2696 | N | LEU | B | 54 | 8.770 | 49.907 | −10.269 | 1.00 | 34.06 | N |
| ATOM | 2697 | CA | LEU | B | 54 | 8.623 | 51.146 | −9.534 | 1.00 | 34.33 | C |

TABLE 77-continued

| ATOM | 2698 | C | LEU | B | 54 | 9.446 | 51.122 | −8.258 | 1.00 | 30.21 | C |
|---|---|---|---|---|---|---|---|---|---|---|---|
| ATOM | 2699 | O | LEU | B | 54 | 9.328 | 50.198 | −7.451 | 1.00 | 36.21 | O |
| ATOM | 2700 | CB | LEU | B | 54 | 7.136 | 51.356 | −9.202 | 1.00 | 33.45 | C |
| ATOM | 2701 | CG | LEU | B | 54 | 6.727 | 52.701 | −8.611 | 1.00 | 36.41 | C |
| ATOM | 2702 | CD1 | LEU | B | 54 | 6.896 | 53.849 | −9.619 | 1.00 | 35.86 | C |
| ATOM | 2703 | CD2 | LEU | B | 51 | 5.271 | 52.645 | −8.095 | 1.00 | 37.83 | C |
| ATOM | 2704 | N | SER | B | 55 | 10.277 | 52.149 | −8.080 | 1.00 | 33.82 | N |
| ATOM | 2705 | CA | SER | B | 55 | 11.013 | 52.361 | −6.838 | 1.00 | 38.49 | C |
| ATOM | 2706 | C | SER | B | 55 | 10.889 | 53.820 | −6.465 | 1.00 | 35.30 | C |
| ATOM | 2707 | O | SER | B | 55 | 10.243 | 54.602 | −7.166 | 1.00 | 39.30 | O |
| ATOM | 2708 | CB | SER | B | 55 | 12.507 | 52.001 | −6.953 | 1.00 | 39.90 | C |
| ATOM | 2709 | OG | SER | B | 55 | 12.669 | 50.657 | −7.316 | 1.00 | 53.58 | O |
| ATOM | 2710 | N | PHE | B | 56 | 11.552 | 54.207 | −5.378 | 1.00 | 34.29 | N |
| ATOM | 2711 | CA | PHE | B | 56 | 11.442 | 55.581 | −4.927 | 1.00 | 37.95 | C |
| ATOM | 2712 | C | PHE | B | 56 | 12.720 | 56.001 | −4.218 | 1.00 | 38.84 | C |
| ATOM | 2713 | O | PHE | B | 56 | 13.555 | 55.179 | −3.852 | 1.00 | 32.16 | O |
| ATOM | 2714 | CB | PHE | B | 56 | 10.228 | 55.764 | −4.022 | 1.00 | 32.31 | C |
| ATOM | 2715 | CG | PHE | B | 56 | 10.095 | 54.700 | −2.972 | 1.00 | 37.12 | C |
| ATOM | 2716 | CD1 | PHE | B | 56 | 10.784 | 51.805 | −1.781 | 1.00 | 30.43 | C |
| ATOM | 2717 | CD2 | PHE | B | 56 | 9.248 | 53.600 | −3.172 | 1.00 | 31.90 | C |
| ATOM | 2718 | CE1 | PHE | B | 56 | 10.640 | 53.821 | −0.809 | 1.00 | 34.72 | C |
| ATOM | 2719 | CE2 | PHE | B | 56 | 9.118 | 52.622 | −2.213 | 1.00 | 30.42 | O |
| ATOM | 2720 | CZ | PHE | B | 56 | 9.795 | 52.740 | −1.034 | 1.00 | 34.08 | O |
| ATOM | 2721 | N | SER | B | 57 | 12.829 | 57.304 | −4.000 | 1.00 | 36.00 | N |
| ATOM | 2722 | CA | SER | B | 57 | 14.005 | 57.939 | −3.443 | 1.00 | 41.01 | C |
| ATOM | 2723 | C | SER | B | 57 | 13.780 | 58.265 | −1.977 | 1.00 | 43.11 | C |
| ATOM | 2724 | O | SER | B | 57 | 12.740 | 57.943 | −1.382 | 1.00 | 34.31 | O |
| ATOM | 2725 | CB | SER | B | 57 | 14.342 | 59.203 | −4.231 | 1.00 | 43.96 | C |
| ATOM | 2726 | OG | SER | B | 57 | 14.481 | 58.869 | −5.604 | 1.00 | 57.10 | O |
| ATOM | 2727 | N | LYS | B | 58 | 14.781 | 58.925 | −1.386 | 1.00 | 43.18 | N |
| ATOM | 2728 | CA | LYS | B | 58 | 14.754 | 59.192 | 0.046 | 1.00 | 45.07 | C |
| ATOM | 2729 | C | LYS | B | 58 | 13.713 | 60.231 | 0.429 | 1.00 | 44.50 | C |
| ATOM | 2730 | O | LYS | B | 58 | 13.364 | 60.318 | 1.609 | 1.00 | 46.76 | O |
| ATOM | 2731 | CB | LYS | B | 58 | 16.150 | 59.599 | 0.555 | 1.00 | 49.22 | C |
| ATOM | 2732 | CG | LYS | B | 58 | 17.036 | 60.240 | −0.481 | 0.61 | 52.79 | C |
| ATOM | 2733 | CD | LYS | B | 58 | 18.285 | 59.407 | −0.706 | 1.00 | 65.36 | C |
| ATOM | 2734 | CE | LYS | B | 58 | 17.978 | 58.172 | −1.524 | 0.00 | 52.41 | C |
| ATOM | 2735 | NZ | LYS | B | 58 | 17.436 | 58.576 | −2.845 | 1.00 | 52.32 | N1+ |
| ATOM | 2736 | N | ASP | B | 59 | 13.177 | 60.988 | −0.527 | 1.00 | 38.80 | N |
| ATOM | 2737 | CA | ASP | B | 59 | 12.039 | 61.847 | −0.260 | 1.00 | 40.26 | C |
| ATOM | 2738 | C | ASP | B | 59 | 10.724 | 61.192 | −0.673 | 1.00 | 38.88 | C |
| ATOM | 2739 | O | ASP | B | 59 | 9.705 | 61.879 | −0.800 | 1.00 | 37.78 | O |
| ATOM | 2740 | CB | ASP | B | 59 | 12.230 | 63.196 | −0.951 | 1.00 | 46.69 | C |
| ATOM | 2741 | CG | ASP | B | 59 | 12.101 | 63.113 | −2.468 | 1.00 | 49.25 | C |
| ATOM | 2742 | OD1 | ASP | B | 59 | 12.214 | 62.019 | −3.060 | 1.00 | 44.78 | O |
| ATOM | 2743 | OD2 | ASP | B | 59 | 11.905 | 64.174 | −3.079 | 1.00 | 56.11 | O1− |
| ATOM | 2744 | N | TRP | B | 60 | 10.736 | 59.878 | −0.892 | 1.00 | 34.75 | N |
| ATOM | 2745 | CA | TRP | B | 60 | 9.596 | 59.040 | −1.245 | 1.00 | 36.60 | C |
| ATOM | 2746 | C | TRP | B | 60 | 9.119 | 59.241 | −2.674 | 1.00 | 39.35 | C |
| ATOM | 2747 | O | TRP | B | 60 | 8.156 | 58.586 | −3.074 | 1.00 | 34.86 | O |
| ATOM | 2748 | CB | TRP | B | 60 | 8.404 | 59.234 | −0.300 | 1.00 | 35.61 | C |
| ATOM | 2749 | CG | TRP | B | 60 | 8.779 | 58.957 | 1.122 | 1.00 | 36.67 | C |
| ATOM | 2750 | CD1 | TRP | B | 60 | 8.988 | 59.872 | 2.116 | 1.00 | 36.32 | C |
| ATOM | 2751 | CD2 | TRP | B | 60 | 9.033 | 57.670 | 1.696 | 1.00 | 34.36 | C |
| ATOM | 2752 | NE1 | TRP | B | 60 | 9.343 | 59.223 | 3.288 | 1.00 | 37.05 | N |
| ATOM | 2753 | CE2 | TRP | B | 60 | 9.366 | 57.871 | 3.052 | 1.00 | 36.96 | C |
| ATOM | 2754 | CE3 | TRP | B | 60 | 8.994 | 56.368 | 1.202 | 1.00 | 31.65 | C |
| ATOM | 2755 | CZ2 | TRP | B | 60 | 9.647 | 56.813 | 3.910 | 1.00 | 33.34 | C |
| ATOM | 2756 | CZ3 | TRP | B | 60 | 9.258 | 55.331 | 2.056 | 1.00 | 30.74 | C |
| ATOM | 2757 | CH2 | TRP | B | 60 | 9.580 | 55.553 | 3.394 | 1.00 | 30.69 | C |
| ATOM | 2758 | N | SER | B | 61 | 9.764 | 60.107 | −3.463 | 1.00 | 36.50 | N |
| ATOM | 2759 | CA | SER | B | 61 | 9.294 | 60.338 | −4.823 | 1.00 | 38.59 | C |
| ATOM | 2760 | C | SER | B | 61 | 9.734 | 59.178 | −5.706 | 1.00 | 36.58 | C |
| ATOM | 2761 | O | SER | B | 61 | 10.751 | 58.528 | −5.453 | 1.00 | 36.02 | O |
| ATOM | 2762 | CB | SER | B | 61 | 9.806 | 61.686 | −5.371 | 1.00 | 39.88 | C |
| ATOM | 2763 | OG | SER | B | 61 | 11.230 | 61.717 | −5.452 | 1.00 | 42.58 | O |
| ATOM | 2764 | N | PHE | B | 62 | 8.944 | 58.908 | −6.736 | 1.00 | 31.93 | N |
| ATOM | 2765 | CA | PHE | B | 62 | 9.094 | 57.682 | −7.498 | 1.00 | 35.17 | C |
| ATOM | 2766 | C | PHE | B | 62 | 10.064 | 57.846 | −8.656 | 1.00 | 38.23 | C |
| ATOM | 2767 | O | PHE | B | 62 | 10.319 | 58.949 | −9.146 | 1.00 | 34.67 | O |
| ATOM | 2768 | CB | PHE | B | 62 | 7.747 | 57.239 | −8.040 | 1.00 | 37.18 | C |
| ATOM | 2769 | CG | PHE | B | 62 | 6.809 | 56.763 | −6.983 | 1.00 | 36.22 | C |
| ATOM | 2770 | CD1 | PHE | B | 62 | 7.016 | 55.531 | −6.380 | 1.00 | 31.75 | C |
| ATOM | 2771 | CD2 | PHE | B | 62 | 5.723 | 57.533 | −6.590 | 1.00 | 37.17 | C |
| ATOM | 2772 | CE1 | PHE | B | 62 | 6.176 | 55.066 | −5.400 | 1.00 | 29.70 | C |
| ATOM | 2773 | CE2 | PHE | B | 62 | 4.852 | 57.069 | −5.611 | 1.00 | 33.53 | C |
| ATOM | 2774 | CZ | PHE | B | 62 | 5.081 | 55.833 | −5.014 | 1.00 | 32.66 | C |
| ATOM | 2775 | N | TYR | B | 63 | 10.572 | 56.719 | −9.129 | 1.00 | 34.89 | N |
| ATOM | 2776 | CA | TYR | B | 63 | 11.275 | 56.743 | −10.395 | 1.00 | 36.20 | C |
| ATOM | 2777 | C | TYR | B | 63 | 10.979 | 55.479 | −11.174 | 1.00 | 36.35 | C |

TABLE 77-continued

| | | | | | | | | | | |
|---|---|---|---|---|---|---|---|---|---|---|
| ATOM | 2778 | O | TYR | B | 63 | 10.668 | 54.425 | −10.614 | 1.00 | 38.08 O |
| ATOM | 2779 | CB | TYR | B | 63 | 12.797 | 56.955 | −10.226 | 1.00 | 45.08 C |
| ATOM | 2780 | CG | TYR | B | 63 | 13.508 | 55.969 | −9.368 | 1.00 | 42.73 C |
| ATOM | 2781 | CD1 | TYR | B | 63 | 13.968 | 54.767 | −9.900 | 1.00 | 45.78 C |
| ATOM | 2782 | CD2 | TYR | B | 63 | 13.772 | 56.247 | −8.029 | 1.00 | 45.50 C |
| ATOM | 2783 | CE1 | TYR | B | 63 | 14.663 | 53.858 | −9.118 | 1.00 | 49.71 C |
| ATOM | 2784 | CE2 | TYR | B | 63 | 14.447 | 55.335 | −7.230 | 1.00 | 42.80 C |
| ATOM | 2785 | CZ | TYR | B | 63 | 14.894 | 54.143 | −7.788 | 1.00 | 52.26 C |
| ATOM | 2786 | OH | TYR | B | 63 | 15.564 | 53.220 | −7.020 | 1.00 | 57.81 O |
| ATOM | 2787 | N | LEU | B | 64 | 11.060 | 55.619 | −12.490 | 1.00 | 34.06 N |
| ATOM | 2788 | CA | LEU | B | 64 | 10.732 | 54.566 | −13.427 | 1.00 | 37.14 C |
| ATOM | 2789 | C | LEU | B | 64 | 11.585 | 54.768 | −14.657 | 1.00 | 37.22 C |
| ATOM | 2790 | O | LEU | B | 64 | 11.785 | 55.902 | −15.098 | 1.00 | 38.33 O |
| ATOM | 2791 | CB | LEU | B | 64 | 9.265 | 54.590 | −13.857 | 1.00 | 34.47 C |
| ATOM | 2792 | CG | LEU | B | 64 | 8.224 | 53.936 | −12.983 | 1.00 | 42.33 C |
| ATOM | 2793 | CD1 | LEU | B | 64 | 6.843 | 54.331 | −13.508 | 1.00 | 38.73 C |
| ATOM | 2794 | CD2 | LEU | B | 64 | 8.409 | 52.424 | −13.003 | 1.00 | 36.97 C |
| ATOM | 2795 | N | LEU | B | 65 | 12.044 | 53.662 | −15.225 | 1.00 | 37.16 N |
| ATOM | 2796 | CA | LEU | B | 65 | 12.785 | 53.680 | −16.470 | 1.00 | 37.25 C |
| ATOM | 2797 | C | LEU | B | 65 | 11.934 | 52.978 | −17.513 | 1.00 | 39.45 C |
| ATOM | 2798 | O | LEU | B | 65 | 11.515 | 51.841 | −17.299 | 1.00 | 38.17 O |
| ATOM | 2799 | CB | LEU | B | 65 | 14.129 | 52.978 | −16.309 | 1.00 | 36.34 C |
| ATOM | 2800 | CG | LEU | B | 65 | 14.925 | 52.948 | −17.600 | 1.00 | 38.41 C |
| ATOM | 2801 | CD1 | LEU | B | 65 | 15.341 | 54.366 | −17.924 | 1.00 | 38.78 C |
| ATOM | 2802 | CD2 | LEU | B | 65 | 16.151 | 52.014 | −17.463 | 1.00 | 39.61 C |
| ATOM | 2803 | N | TYR | B | 66 | 11.643 | 53.662 | −18.612 | 1.00 | 38.87 N |
| ATOM | 2804 | CA | TYR | B | 66 | 11.031 | 53.021 | −19.765 | 1.00 | 42.36 C |
| ATOM | 2805 | C | TYR | B | 66 | 12.086 | 52.920 | −20.856 | 1.00 | 38.25 C |
| ATOM | 2806 | O | TYR | B | 66 | 12.864 | 53.853 | −21.052 | 1.00 | 35.94 O |
| ATOM | 2807 | CB | TYR | B | 66 | 9.823 | 53.807 | −20.273 | 1.00 | 35.52 C |
| ATOM | 2808 | CG | TYR | B | 66 | 8.622 | 53.818 | −19.344 | 1.00 | 40.60 C |
| ATOM | 2809 | CD1 | TYR | B | 66 | 8.633 | 54.573 | −18.177 | 1.00 | 42.57 C |
| ATOM | 2810 | CD2 | TYR | B | 66 | 7.475 | 53.096 | −19.651 | 1.00 | 43.40 C |
| ATOM | 2811 | CE1 | TYR | B | 66 | 7.539 | 54.598 | −17.327 | 1.00 | 45.06 C |
| ATOM | 2812 | CE2 | TYR | B | 66 | 6.361 | 53.121 | −18.805 | 1.00 | 45.15 C |
| ATOM | 2813 | CZ | TYR | B | 66 | 6.408 | 53.876 | −17.647 | 1.00 | 45.34 C |
| ATOM | 2814 | OH | TYR | B | 66 | 5.330 | 53.921 | −16.797 | 1.00 | 57.23 O |
| ATOM | 2815 | N | TYR | B | 67 | 12.106 | 51.802 | −21.570 | 1.00 | 36.32 N |
| ATOM | 2816 | CA | TYR | B | 67 | 13.170 | 51.591 | −22.538 | 1.00 | 43.03 C |
| ATOM | 2817 | C | TYR | B | 67 | 12.687 | 50.692 | −23.664 | 1.00 | 42.65 C |
| ATOM | 2818 | O | TYR | B | 67 | 11.801 | 49.854 | −23.481 | 1.00 | 48.82 O |
| ATOM | 2819 | CB | TYR | B | 67 | 14.418 | 50.989 | −21.877 | 1.00 | 40.51 C |
| ATOM | 2820 | CG | TYR | B | 67 | 14.148 | 49.703 | −21.109 | 1.00 | 44.03 C |
| ATOM | 2821 | CD1 | TYR | B | 67 | 13.632 | 49.731 | −19.813 | 1.00 | 40.77 C |
| ATOM | 2822 | CD2 | TYR | B | 67 | 14.414 | 48.463 | −21.683 | 1.00 | 47.33 C |
| ATOM | 2823 | CE1 | TYR | B | 67 | 13.387 | 48.553 | −19.115 | 1.00 | 43.88 C |
| ATOM | 2824 | CE2 | TYR | B | 67 | 14.176 | 47.282 | −20.997 | 1.00 | 47.55 C |
| ATOM | 2825 | CZ | TYR | B | 67 | 13.666 | 47.331 | −19.720 | 1.00 | 51.20 C |
| ATOM | 2826 | OH | TYR | B | 67 | 13.428 | 46.155 | −19.057 | 1.00 | 58.44 C |
| ATOM | 2827 | N | THR | B | 68 | 13.272 | 50.901 | −24.837 | 1.00 | 42.30 N |
| ATOM | 2828 | CA | THR | B | 68 | 13.007 | 50.087 | −26.006 | 1.00 | 50.19 C |
| ATOM | 2829 | C | THR | B | 68 | 14.304 | 49.914 | −26.780 | 1.00 | 48.43 C |
| ATOM | 2830 | O | THR | B | 68 | 15.189 | 50.774 | −26.748 | 1.00 | 45.45 O |
| ATOM | 2831 | CB | THR | B | 68 | 11.932 | 50.718 | −26.907 | 1.00 | 53.15 C |
| ATOM | 2832 | OG1 | THR | B | 68 | 11.494 | 49.761 | −27.882 | 1.00 | 56.96 O |
| ATOM | 2833 | CG2 | THR | B | 68 | 12.482 | 51.946 | −27.616 | 1.00 | 48.58 C |
| ATOM | 2834 | N | GLU | B | 69 | 14.421 | 48.780 | −27.456 | 1.00 | 53.86 N |
| ATOM | 2835 | CA | GLU | B | 69 | 15.555 | 48.562 | −28.339 | 1.00 | 58.77 C |
| ATOM | 2836 | C | GLU | B | 69 | 15.338 | 49.353 | −29.625 | 1.00 | 61.31 C |
| ATOM | 2837 | O | GLU | B | 69 | 14.264 | 49.286 | −30.230 | 1.00 | 59.55 O |
| ATOM | 2838 | CB | GLU | B | 69 | 15.723 | 47.072 | −28.639 | 1.00 | 63.92 C |
| ATOM | 2839 | CG | GLU | B | 69 | 17.173 | 46.673 | −28.917 | 1.00 | 68.81 C |
| ATOM | 2840 | CD | GLU | B | 69 | 17.323 | 45.218 | −29.336 | 1.00 | 78.91 C |
| ATOM | 2841 | OE1 | GLU | B | 69 | 16.301 | 44.594 | −29.701 | 1.00 | 80.26 O |
| ATOM | 2842 | OE2 | GLU | B | 69 | 18.466 | 44.705 | −29.303 | 1.00 | 81.80 O1− |
| ATOM | 2843 | N | PHE | B | 70 | 16.339 | 50.132 | −30.025 | 1.00 | 55.70 N |
| ATOM | 2844 | CA | PHE | B | 70 | 16.270 | 50.853 | −31.286 | 1.00 | 54.20 C |
| ATOM | 2845 | C | PHE | B | 70 | 17.639 | 50.826 | −31.941 | 1.00 | 57.76 C |
| ATOM | 2846 | O | PHE | B | 70 | 18.651 | 50.540 | −31.298 | 1.00 | 54.40 O |
| ATOM | 2847 | CB | PHE | B | 70 | 15.799 | 52.311 | −31.125 | 1.00 | 51.57 C |
| ATOM | 2848 | CG | PHE | B | 70 | 16.833 | 53.246 | −30.558 | 1.00 | 46.76 C |
| ATOM | 2849 | CD1 | PHE | B | 70 | 17.600 | 52.890 | −29.465 | 1.00 | 45.17 C |
| ATOM | 2850 | CD2 | PHE | B | 70 | 17.011 | 54.503 | −31.107 | 1.00 | 52.05 C |
| ATOM | 2851 | CE1 | PHE | B | 70 | 18.538 | 53.764 | −28.950 | 1.00 | 45.00 C |
| ATOM | 2852 | CE2 | PHE | B | 70 | 17.945 | 55.380 | −30.592 | 1.00 | 48.94 C |
| ATOM | 2853 | CZ | PHE | B | 70 | 18.707 | 55.010 | −29.510 | 1.00 | 49.39 C |
| ATOM | 2854 | N | THR | B | 71 | 17.653 | 51.118 | −33.234 | 1.00 | 57.69 N |
| ATOM | 2855 | CA | THR | B | 71 | 18.902 | 51.311 | −33.967 | 1.00 | 60.56 C |
| ATOM | 2856 | C | THR | B | 71 | 18.851 | 52.699 | −34.582 | 1.00 | 56.82 C |
| ATOM | 2857 | O | THR | B | 71 | 18.083 | 52.922 | −35.535 | 1.00 | 61.77 O |

TABLE 77-continued

| | | | | | | | | | |
|---|---|---|---|---|---|---|---|---|---|
| ATOM | 2858 | CB | THR | B | 71 | 19.100 | 50.240 | −35.038 | 1.00 | 59.19 | C |
| ATOM | 2859 | OG1 | THR | B | 71 | 18.229 | 50.508 | −36.140 | 1.00 | 73.46 | O |
| ATOM | 2860 | CG2 | THR | B | 71 | 18.764 | 48.857 | −34.482 | 1.00 | 61.54 | C |
| ATOM | 2861 | N | PRO | B | 72 | 19.606 | 53.664 | −34.068 | 1.00 | 56.03 | N |
| ATOM | 2862 | CA | PRO | B | 72 | 19.502 | 55.031 | −34.589 | 1.00 | 57.40 | C |
| ATOM | 2863 | C | PRO | B | 72 | 19.964 | 55.140 | −36.036 | 1.00 | 61.07 | C |
| ATOM | 2864 | O | PRO | B | 72 | 20.906 | 54.470 | −36.462 | 1.00 | 60.02 | O |
| ATOM | 2865 | CB | PRO | B | 72 | 20.409 | 55.840 | −33.649 | 1.00 | 54.18 | C |
| ATOM | 2866 | CG | PRO | B | 72 | 21.308 | 54.833 | −33.012 | 1.00 | 54.23 | C |
| ATOM | 2867 | CD | PRO | B | 72 | 20.489 | 53.583 | −32.893 | 1.00 | 49.61 | C |
| ATOM | 2868 | N | THR | B | 73 | 19.265 | 55.989 | −36.795 | 1.00 | 66.90 | N |
| ATOM | 2869 | CA | THR | B | 73 | 19.666 | 56.484 | −38.104 | 1.00 | 57.64 | C |
| ATOM | 2870 | C | THR | B | 73 | 19.932 | 57.981 | −37.982 | 1.00 | 60.28 | C |
| ATOM | 2871 | O | THR | B | 73 | 19.936 | 58.544 | −36.880 | 1.00 | 63.33 | O |
| ATOM | 2872 | CB | THR | B | 73 | 18.597 | 56.182 | −39.154 | 1.00 | 61.67 | C |
| ATOM | 2873 | OG1 | THR | B | 73 | 17.403 | 56.912 | −38.846 | 1.00 | 61.64 | O |
| ATOM | 2874 | CG2 | THR | B | 73 | 18.275 | 54.690 | −39.181 | 1.00 | 54.73 | C |
| ATOM | 2875 | N | GLU | B | 74 | 20.178 | 58.634 | −39.115 | 1.00 | 64.40 | N |
| ATOM | 2876 | CA | GLU | B | 74 | 20.507 | 60.055 | −39.060 | 1.00 | 67.75 | C |
| ATOM | 2877 | C | GLU | B | 74 | 19.256 | 60.929 | −38.997 | 1.00 | 69.00 | C |
| ATOM | 2878 | O | GLU | B | 74 | 19.248 | 61.954 | −38.306 | 1.00 | 78.92 | O |
| ATOM | 2879 | CB | GLU | B | 74 | 21.368 | 60.450 | −40.263 | 1.00 | 70.45 | C |
| ATOM | 2880 | CG | GLU | B | 74 | 22.684 | 59.676 | −40.415 | 1.00 | 64.42 | C |
| ATOM | 2881 | CD | GLU | B | 74 | 22.591 | 58.562 | −41.440 | 0.00 | 62.88 | C |
| ATOM | 2882 | OE1 | GLU | B | 74 | 21.471 | 58.093 | −41.722 | 1.00 | 66.26 | O |
| ATOM | 2883 | OE2 | GLU | B | 74 | 23.638 | 58.151 | −41.976 | 1.00 | 68.38 | O1− |
| ATOM | 2884 | N | LYS | B | 75 | 18.190 | 60.542 | −39.698 | 1.00 | 65.81 | N |
| ATOM | 2885 | CA | LYS | B | 75 | 17.007 | 61.388 | −39.806 | 1.00 | 68.49 | C |
| ATOM | 2886 | C | LYS | B | 75 | 15.992 | 61.129 | −38.699 | 1.00 | 65.63 | C |
| ATOM | 2887 | O | LYS | B | 75 | 15.324 | 62.066 | −38.253 | 1.00 | 70.84 | O |
| ATOM | 2888 | CB | LYS | B | 75 | 16.334 | 61.187 | −41.169 | 1.00 | 67.81 | C |
| ATOM | 2889 | CG | LYS | B | 75 | 17.055 | 61.858 | −42.328 | 1.00 | 69.30 | C |
| ATOM | 2890 | CD | LYS | B | 75 | 17.050 | 63.369 | −42.208 | 0.00 | 68.42 | C |
| ATOM | 2891 | CE | LYS | B | 75 | 17.879 | 63.988 | −43.319 | 1.00 | 72.54 | C |
| ATOM | 2892 | NZ | LYS | B | 75 | 17.884 | 65.476 | −43.257 | 1.00 | 73.75 | N1+ |
| ATOM | 2893 | N | ASP | B | 76 | 15.866 | 59.880 | −38.253 | 1.00 | 60.02 | N |
| ATOM | 2894 | CA | ASP | B | 76 | 14.830 | 59.498 | −37.300 | 1.00 | 66.28 | C |
| ATOM | 2895 | C | ASP | B | 76 | 14.911 | 60.331 | −36.026 | 1.00 | 62.00 | C |
| ATOM | 2896 | O | ASP | B | 76 | 15.960 | 60.102 | −35.381 | 1.00 | 58.25 | O |
| ATOM | 2897 | CB | ASP | B | 76 | 14.947 | 58.009 | −36.968 | 1.00 | 60.24 | C |
| ATOM | 2898 | CG | ASP | B | 76 | 14.495 | 57.114 | −38.113 | 1.00 | 63.31 | C |
| ATOM | 2899 | OD1 | ASP | B | 76 | 13.442 | 57.398 | −38.724 | 1.00 | 65.44 | O |
| ATOM | 2900 | OD2 | ASP | B | 76 | 15.193 | 56.120 | −38.405 | 1.00 | 65.01 | O1− |
| ATOM | 2901 | N | GLU | B | 77 | 13.796 | 60.964 | −35.672 | 1.00 | 61.94 | N |
| ATOM | 2902 | CA | GLU | B | 77 | 13.681 | 61.746 | −34.447 | 1.00 | 61.46 | C |
| ATOM | 2903 | C | GLU | B | 77 | 13.027 | 60.903 | −33.356 | 1.00 | 57.78 | C |
| ATOM | 2904 | O | GLU | B | 77 | 12.054 | 60.176 | −33.606 | 1.00 | 51.79 | O |
| ATOM | 2905 | CB | GLU | B | 77 | 12.869 | 63.024 | −34.684 | 1.00 | 66.57 | C |
| ATOM | 2906 | CG | GLU | B | 77 | 13.555 | 64.040 | −35.596 | 1.00 | 68.89 | C |
| ATOM | 2907 | CD | GLU | B | 77 | 14.226 | 65.156 | −34.823 | 0.00 | 70.54 | C |
| ATOM | 2908 | OE1 | GLU | B | 77 | 13.504 | 65.984 | −34.224 | 1.00 | 76.59 | O |
| ATOM | 2909 | OE2 | GLU | B | 77 | 15.474 | 65.203 | −34.807 | 1.00 | 75.32 | O1− |
| ATOM | 2910 | N | TYR | B | 78 | 13.571 | 60.992 | −32.149 | 1.00 | 52.57 | N |
| ATOM | 2911 | CA | TYR | B | 78 | 13.067 | 60.221 | −31.026 | 1.00 | 51.56 | C |
| ATOM | 2912 | C | TYR | B | 78 | 12.667 | 61.160 | −29.899 | 1.00 | 47.88 | C |
| ATOM | 2913 | O | TYR | B | 78 | 13.244 | 62.241 | −29.736 | 1.00 | 49.44 | O |
| ATOM | 2914 | CB | TYR | B | 78 | 14.105 | 59.190 | −30.544 | 1.00 | 51.46 | C |
| ATOM | 2915 | CG | TYR | B | 78 | 14.261 | 58.037 | −31.508 | 1.00 | 53.18 | C |
| ATOM | 2916 | CD1 | TYR | B | 78 | 13.370 | 56.967 | −31.484 | 1.00 | 54.60 | C |
| ATOM | 2917 | CD2 | TYR | B | 78 | 15.271 | 58.032 | −32.465 | 1.00 | 54.88 | C |
| ATOM | 2918 | CE1 | TYR | B | 78 | 13.490 | 55.919 | −32.367 | 1.00 | 48.04 | C |
| ATOM | 2919 | CE2 | TYR | B | 78 | 15.403 | 56.983 | −33.355 | 1.00 | 51.48 | C |
| ATOM | 2920 | CZ | TYR | B | 78 | 14.504 | 55.935 | −33.304 | 1.00 | 50.94 | C |
| ATOM | 2921 | OH | TYR | B | 78 | 14.620 | 54.882 | −34.180 | 1.00 | 58.06 | O |
| ATOM | 2922 | N | ALA | B | 79 | 11.663 | 60.743 | −29.128 | 1.00 | 48.23 | N |
| ATOM | 2923 | CA | ALA | B | 79 | 11.166 | 61.570 | −28.034 | 1.00 | 45.98 | C |
| ATOM | 2924 | C | ALA | B | 79 | 10.445 | 60.693 | −27.015 | 1.00 | 44.32 | C |
| ATOM | 2925 | O | ALA | B | 79 | 10.128 | 59.529 | −27.272 | 1.00 | 45.81 | O |
| ATOM | 2926 | CB | ALA | B | 79 | 10.245 | 62.682 | −28.561 | 1.00 | 46.77 | C |
| ATOM | 2927 | N | CYS | B | 80 | 10.197 | 61.276 | −25.845 | 1.00 | 41.58 | N |
| ATOM | 2928 | CA | CYS | B | 80 | 9.386 | 60.682 | −24.789 | 1.00 | 45.23 | C |
| ATOM | 2929 | C | CYS | B | 80 | 8.190 | 61.590 | −24.510 | 1.00 | 43.11 | C |
| ATOM | 2930 | O | CYS | B | 80 | 8.341 | 62.811 | −24.458 | 1.00 | 48.39 | O |
| ATOM | 2931 | CB | CYS | B | 80 | 10.219 | 60.495 | −23.501 | 1.00 | 46.86 | C |
| ATOM | 2932 | SG | CYS | B | 80 | 9.394 | 59.628 | −22.157 | 1.00 | 71.10 | S |
| ATOM | 2933 | N | ARG | B | 81 | 7.006 | 61.000 | −24.325 | 1.00 | 45.37 | N |
| ATOM | 2934 | CA | ARG | B | 81 | 5.791 | 61.749 | −24.008 | 1.00 | 44.61 | C |
| ATOM | 2935 | C | ARG | B | 81 | 5.287 | 61.319 | −22.641 | 1.00 | 35.43 | C |
| ATOM | 2936 | O | ARG | B | 81 | 4.960 | 60.147 | −22.429 | 1.00 | 39.34 | O |
| ATOM | 2937 | CB | ARG | B | 81 | 4.697 | 61.539 | −25.059 | 1.00 | 47.00 | C |

TABLE 77-continued

| | | | | | | | | | | |
|---|---|---|---|---|---|---|---|---|---|---|
| ATOM | 2938 | CG | ARG | B | 81 | 3.436 | 62.365 | −24.780 | 1.00 | 47.00 | C |
| ATOM | 2939 | CD | ARG | B | 81 | 2.426 | 62.230 | −25.902 | 1.00 | 48.41 | C |
| ATOM | 2940 | NE | ARG | B | 81 | 2.197 | 60.823 | −26.220 | 1.00 | 52.69 | N |
| ATOM | 2941 | CZ | ARG | B | 81 | 1.705 | 60.388 | −27.374 | 1.00 | 50.40 | C |
| ATOM | 2942 | NH1 | ARG | B | 81 | 1.389 | 61.258 | −28.327 | 1.00 | 59.20 | N1+ |
| ATOM | 2943 | NH2 | ARG | B | 81 | 1.540 | 59.090 | −27.571 | 1.00 | 53.64 | N |
| ATOM | 2944 | N | VAL | B | 82 | 5.219 | 62.261 | −21.719 | 1.00 | 39.35 | N |
| ATOM | 2945 | CA | VAL | B | 82 | 4.925 | 61.947 | −20.334 | 1.00 | 39.00 | C |
| ATOM | 2946 | C | VAL | B | 82 | 3.679 | 62.700 | −19.921 | 1.00 | 40.19 | C |
| ATOM | 2947 | O | VAL | B | 82 | 3.597 | 63.921 | −20.092 | 1.00 | 41.16 | O |
| ATOM | 2948 | CB | VAL | B | 82 | 6.105 | 62.295 | −19.415 | 1.00 | 39.55 | C |
| ATOM | 2949 | CG1 | VAL | B | 82 | 5.706 | 62.074 | −17.965 | 1.00 | 40.89 | C |
| ATOM | 2950 | CG2 | VAL | B | 82 | 7.298 | 61.428 | −19.798 | 1.00 | 40.96 | C |
| ATOM | 2951 | N | ASN | B | 83 | 2.714 | 61.972 | −19.376 | 1.00 | 41.99 | N |
| ATOM | 2952 | CA | ASN | B | 83 | 1.552 | 62.596 | −18.777 | 1.00 | 42.47 | C |
| ATOM | 2953 | C | ASN | B | 83 | 1.435 | 62.164 | −17.326 | 1.00 | 37.09 | C |
| ATOM | 2954 | O | ASN | B | 83 | 1.657 | 60.998 | −16.992 | 1.00 | 38.14 | O |
| ATOM | 2955 | CB | ASN | B | 83 | 0.285 | 62.263 | −19.526 | 1.00 | 42.37 | C |
| ATOM | 2956 | CG | ASN | B | 83 | −0.806 | 63.287 | −19.267 | 1.00 | 55.32 | C |
| ATOM | 2957 | OD1 | ASN | B | 83 | −0.545 | 64.369 | −18.712 | 1.00 | 50.63 | O |
| ATOM | 2958 | ND2 | ASN | B | 83 | −2.028 | 62.959 | −19.664 | 1.00 | 56.51 | N |
| ATOM | 2959 | N | HIS | B | 84 | 1.092 | 63.126 | −16.478 | 1.00 | 43.29 | N |
| ATOM | 2960 | CA | HIS | B | 84 | 1.050 | 62.971 | −15.036 | 1.00 | 41.26 | C |
| ATOM | 2961 | C | HIS | B | 84 | 0.026 | 63.965 | −14.504 | 1.00 | 45.85 | C |
| ATOM | 2962 | O | HIS | B | 84 | −0.222 | 65.000 | −15.129 | 1.00 | 46.40 | O |
| ATOM | 2963 | CB | HIS | B | 84 | 2.431 | 63.231 | −14.423 | 1.00 | 37.69 | C |
| ATOM | 2964 | CG | HIS | B | 84 | 2.510 | 62.938 | −12.962 | 1.00 | 36.10 | C |
| ATOM | 2965 | ND1 | HIS | B | 84 | 2.541 | 63.930 | −12.008 | 1.00 | 37.06 | N |
| ATOM | 2966 | CD2 | HIS | B | 84 | 2.597 | 61.765 | −12.289 | 1.00 | 38.56 | C |
| ATOM | 2967 | CE1 | HIS | B | 84 | 2.631 | 63.384 | −10.809 | 1.00 | 40.41 | C |
| ATOM | 2968 | NE2 | HIS | B | 84 | 2.666 | 62.070 | −10.950 | 1.00 | 35.62 | N |
| ATOM | 2969 | N | VAL | B | 85 | −0.548 | 63.659 | −13.336 | 1.00 | 43.64 | N |
| ATOM | 2970 | CA | VAL | B | 85 | −1.612 | 64.505 | −12.802 | 1.00 | 47.51 | C |
| ATOM | 2971 | C | VAL | B | 85 | −1.129 | 65.940 | −12.612 | 1.00 | 48.83 | C |
| ATOM | 2972 | O | VAL | B | 85 | −1.928 | 66.885 | −12.656 | 1.00 | 44.79 | O |
| ATOM | 2973 | CB | VAL | B | 85 | −2.176 | 63.904 | −11.494 | 1.00 | 47.61 | C |
| ATOM | 2974 | CG1 | VAL | B | 85 | −1.179 | 64.022 | −10.353 | 1.00 | 42.26 | C |
| ATOM | 2975 | CG2 | VAL | B | 85 | −3.499 | 64.567 | −11.125 | 1.00 | 48.29 | C |
| ATOM | 2976 | N | THR | B | 86 | 0.178 | 66.137 | −12.432 | 1.00 | 44.96 | N |
| ATOM | 2977 | CA | THR | B | 86 | 0.705 | 67.478 | −12.206 | 1.00 | 46.26 | C |
| ATOM | 2978 | C | THR | B | 86 | 0.904 | 68.281 | −13.486 | 1.00 | 47.42 | C |
| ATOM | 2979 | O | THR | B | 86 | 1.263 | 69.458 | −13.399 | 1.00 | 50.72 | O |
| ATOM | 2980 | CB | THR | B | 86 | 2.047 | 67.417 | −11.474 | 1.00 | 46.22 | C |
| ATOM | 2981 | OG1 | THR | B | 86 | 2.973 | 66.635 | −12.244 | 1.00 | 42.47 | O |
| ATOM | 2982 | CG2 | THR | B | 86 | 1.878 | 66.804 | −10.081 | 1.00 | 44.39 | C |
| ATOM | 2983 | N | LEU | B | 87 | 0.698 | 67.692 | −14.660 | 1.00 | 48.02 | N |
| ATOM | 2984 | CA | LEU | B | 87 | 0.984 | 68.369 | −15.918 | 1.00 | 51.89 | C |
| ATOM | 2985 | C | LEU | B | 87 | −0.331 | 68.759 | −16.578 | 1.00 | 49.48 | C |
| ATOM | 2986 | O | LEU | B | 87 | −1.238 | 67.929 | −16.707 | 1.00 | 50.48 | O |
| ATOM | 2987 | CB | LEU | B | 87 | 1.810 | 67.484 | −16.862 | 1.00 | 44.12 | C |
| ATOM | 2988 | CG | LEU | B | 87 | 3.140 | 66.847 | −16.416 | 1.00 | 49.55 | C |
| ATOM | 2989 | CD1 | LEU | B | 87 | 3.625 | 65.815 | −17.456 | 1.00 | 44.62 | C |
| ATOM | 2990 | CD2 | LEU | B | 87 | 4.231 | 67.878 | −16.168 | 1.00 | 48.79 | C |
| ATOM | 2991 | N | SER | B | 88 | −0.433 | 70.020 | −16.994 | 1.00 | 55.78 | N |
| ATOM | 2992 | CA | SER | B | 88 | −1.646 | 70.454 | −17.679 | 1.00 | 59.62 | C |
| ATOM | 2993 | C | SER | B | 88 | −1.816 | 69.743 | −19.016 | 1.00 | 61.22 | C |
| ATOM | 2994 | O | SER | B | 88 | −2.948 | 69.499 | −19.450 | 1.00 | 61.91 | O |
| ATOM | 2995 | CB | SER | B | 88 | −1.621 | 71.966 | −17.874 | 1.00 | 52.64 | C |
| ATOM | 2996 | OG | SER | B | 88 | −0.333 | 72.405 | −18.263 | 1.00 | 70.17 | O |
| ATOM | 2997 | N | GLN | B | 89 | −0.710 | 69.385 | −19.665 | 1.00 | 56.22 | N |
| ATOM | 2998 | CA | GLN | B | 89 | −0.697 | 68.713 | −20.956 | 1.00 | 58.29 | C |
| ATOM | 2999 | C | GLN | B | 89 | 0.455 | 67.723 | −20.933 | 1.00 | 46.30 | C |
| ATOM | 3000 | O | GLN | B | 89 | 1.444 | 67.962 | −20.234 | 1.00 | 49.42 | O |
| ATOM | 3001 | CB | GLN | B | 89 | −0.522 | 69.718 | −22.108 | 1.00 | 61.72 | C |
| ATOM | 3002 | CG | GLN | B | 89 | −0.457 | 69.099 | −23.498 | 1.00 | 68.89 | C |
| ATOM | 3003 | CD | GLN | B | 89 | −1.290 | 69.854 | −24.532 | 1.00 | 78.69 | C |
| ATOM | 3004 | OE1 | GLN | B | 89 | −1.192 | 71.078 | −24.652 | 1.00 | 83.98 | O |
| ATOM | 3005 | NE2 | GLN | B | 89 | −2.112 | 69.120 | −25.286 | 1.00 | 78.16 | N |
| ATOM | 3006 | N | PRO | B | 90 | 0.345 | 66.596 | −21.634 | 1.00 | 49.40 | N |
| ATOM | 3007 | CA | PRO | B | 90 | 1.505 | 65.707 | −21.768 | 1.00 | 48.82 | C |
| ATOM | 3008 | C | PRO | B | 90 | 2.744 | 66.474 | −22.213 | 1.00 | 53.98 | C |
| ATOM | 3009 | O | PRO | B | 90 | 2.701 | 67.274 | −23.151 | 1.00 | 52.19 | O |
| ATOM | 3010 | CB | PRO | B | 90 | 1.048 | 64.696 | −22.821 | 1.00 | 50.39 | C |
| ATOM | 3011 | CG | PRO | B | 90 | −0.448 | 64.614 | −22.612 | 1.00 | 52.96 | C |
| ATOM | 3012 | CD | PRO | B | 90 | −0.884 | 65.992 | −22.199 | 1.00 | 50.18 | C |
| ATOM | 3013 | N | LYS | B | 91 | 3.847 | 66.271 | −21.491 | 1.00 | 49.04 | N |
| ATOM | 3014 | CA | LYS | B | 91 | 5.117 | 66.896 | −21.834 | 1.00 | 47.92 | C |
| ATOM | 3015 | C | LYS | B | 91 | 5.886 | 65.968 | −22.767 | 1.00 | 51.12 | C |
| ATOM | 3016 | O | LYS | B | 91 | 5.976 | 64.759 | −22.522 | 1.00 | 49.82 | O |
| ATOM | 3017 | CB | LYS | B | 91 | 5.930 | 67.198 | −20.572 | 1.00 | 49.72 | C |

TABLE 77-continued

| | | | | | | | | | | |
|---|---|---|---|---|---|---|---|---|---|---|
| ATOM | 3018 | CG | LYS | B | 91 | 7.324 | 67.761 | −20.824 | 1.00 | 54.81 C |
| ATOM | 3019 | CD | LYS | B | 91 | 7.452 | 69.192 | −20.331 | 1.00 | 61.90 C |
| ATOM | 3020 | CE | LYS | B | 91 | 8.820 | 69.805 | −20.697 | 1.00 | 56.30 C |
| ATOM | 3021 | NZ | LYS | B | 91 | 8.932 | 70.099 | −22.159 | 1.00 | 64.97 N1+ |
| ATOM | 3022 | N | ILE | B | 92 | 6.413 | 66.525 | −23.854 | 1.00 | 49.43 N |
| ATOM | 3023 | CA | ILE | B | 92 | 7.204 | 65.767 | −24.813 | 1.00 | 51.40 C |
| ATOM | 3024 | C | ILE | B | 92 | 8.653 | 66.221 | −24.689 | 1.00 | 49.41 C |
| ATOM | 3025 | O | ILE | B | 92 | 8.933 | 67.424 | −24.676 | 1.00 | 54.01 O |
| ATOM | 3026 | CB | ILE | B | 92 | 6.676 | 65.932 | −26.249 | 1.00 | 57.53 C |
| ATOM | 3027 | CG1 | ILE | B | 92 | 5.278 | 65.312 | −26.391 | 1.00 | 53.97 C |
| ATOM | 3028 | CG2 | ILE | B | 92 | 7.624 | 65.249 | −27.245 | 1.00 | 54.52 C |
| ATOM | 3029 | CD1 | ILE | B | 92 | 4.133 | 66.180 | −25.893 | 1.00 | 58.93 C |
| ATOM | 3030 | N | VAL | B | 93 | 9.564 | 65.266 | −24.535 | 1.00 | 45.22 N |
| ATOM | 3031 | CA | VAL | B | 93 | 10.992 | 65.546 | −24.419 | 1.00 | 47.43 C |
| ATOM | 3032 | C | VAL | B | 93 | 11.702 | 64.816 | −25.549 | 1.00 | 44.25 C |
| ATOM | 3033 | O | VAL | B | 93 | 11.650 | 63.583 | −25.624 | 1.00 | 45.90 O |
| ATOM | 3034 | CB | VAL | B | 93 | 11.554 | 65.126 | −23.051 | 1.00 | 47.59 C |
| ATOM | 3035 | CG1 | VAL | B | 93 | 13.063 | 65.385 | −22.980 | 1.00 | 45.12 C |
| ATOM | 3036 | CG2 | VAL | B | 93 | 10.824 | 65.859 | −21.923 | 1.00 | 46.07 C |
| ATOM | 3037 | N | LYS | B | 94 | 12.354 | 65.572 | −26.426 | 1.00 | 46.91 N |
| ATOM | 3038 | CA | LYS | B | 94 | 13.071 | 64.986 | −27.551 | 1.00 | 50.67 C |
| ATOM | 3039 | C | LYS | B | 94 | 14.420 | 64.419 | −27.111 | 1.00 | 48.14 C |
| ATOM | 3040 | O | LYS | B | 94 | 15.084 | 64.951 | −26.219 | 1.00 | 17.27 O |
| ATOM | 3041 | CB | LYS | B | 94 | 13.292 | 66.029 | −28.651 | 1.00 | 51.15 C |
| ATOM | 3042 | CG | LYS | B | 94 | 12.047 | 66.833 | −29.001 | 1.00 | 58.79 C |
| ATOM | 3043 | CD | LYS | B | 94 | 12.272 | 67.721 | −30.218 | 1.00 | 65.47 C |
| ATOM | 3044 | CE | LYS | B | 94 | 12.013 | 66.957 | −31.512 | 1.00 | 73.39 C |
| ATOM | 3045 | NZ | LYS | B | 94 | 12.924 | 65.781 | −31.691 | 1.00 | 72.91 N1+ |
| ATOM | 3046 | N | TRP | B | 95 | 14.826 | 63.332 | −27.759 | 1.00 | 47.46 N |
| ATOM | 3047 | CA | TRP | B | 95 | 16.147 | 62.766 | −27.525 | 1.00 | 51.80 O |
| ATOM | 3048 | C | TRP | B | 95 | 17.201 | 63.630 | −28.203 | 1.00 | 57.03 C |
| ATOM | 3049 | O | TRP | B | 95 | 17.208 | 63.753 | −29.432 | 1.00 | 55.11 O |
| ATOM | 3050 | CB | TRP | B | 95 | 16.227 | 61.342 | −28.058 | 1.00 | 47.44 C |
| ATOM | 3051 | CG | TRP | B | 95 | 17.622 | 60.752 | −27.989 | 1.00 | 51.79 C |
| ATOM | 3052 | CD1 | TRP | B | 95 | 18.530 | 60.882 | −26.969 | 1.00 | 52.58 C |
| ATOM | 3053 | CD2 | TRP | B | 95 | 18.255 | 59.939 | −28.986 | 1.00 | 56.01 C |
| ATOM | 3054 | NE1 | TRP | B | 95 | 19.687 | 60.192 | −27.272 | 1.00 | 54.53 N |
| ATOM | 3055 | CE2 | TRP | B | 95 | 19.544 | 59.607 | −28.502 | 1.00 | 56.97 C |
| ATOM | 3056 | CE3 | TRP | B | 95 | 17.858 | 59.459 | −30.242 | 1.00 | 52.38 C |
| ATOM | 3057 | CZ2 | TRP | B | 95 | 20.432 | 58.823 | −29.228 | 1.00 | 52.87 C |
| ATOM | 3058 | CZ3 | TRP | B | 95 | 18.744 | 58.674 | −30.963 | 1.00 | 57.64 C |
| ATOM | 3059 | CH2 | TRP | B | 95 | 20.016 | 58.362 | −30.450 | 1.00 | 59.50 C |
| ATOM | 3060 | N | ASP | B | 96 | 18.099 | 64.205 | −27.406 | 1.00 | 59.97 N |
| ATOM | 3061 | CA | ASP | B | 96 | 19.241 | 64.963 | −27.920 | 1.00 | 66.62 C |
| ATOM | 3062 | C | ASP | B | 96 | 20.443 | 64.024 | −28.030 | 1.00 | 70.40 C |
| ATOM | 3063 | O | ASP | B | 96 | 21.136 | 63.764 | −27.042 | 1.00 | 70.85 O |
| ATOM | 3064 | CB | ASP | B | 96 | 19.536 | 66.151 | −27.015 | 1.00 | 68.47 C |
| ATOM | 3065 | CG | ASP | B | 96 | 20.635 | 67.050 | −27.563 | 1.00 | 74.71 C |
| ATOM | 3066 | OD1 | ASP | B | 96 | 21.155 | 66.777 | −28.668 | 1.00 | 73.92 O |
| ATOM | 3067 | OD2 | ASP | B | 96 | 20.971 | 68.036 | −26.878 | 1.00 | 78.23 O1− |
| ATOM | 3068 | N | ARG | B | 97 | 20.700 | 63.531 | −29.249 | 1.00 | 73.16 N |
| ATOM | 3069 | CA | ARG | B | 97 | 21.795 | 62.597 | −29.509 | 1.00 | 68.55 C |
| ATOM | 3070 | C | ARG | B | 97 | 23.169 | 63.189 | −29.211 | 1.00 | 82.02 C |
| ATOM | 3071 | O | ARG | B | 97 | 24.149 | 62.435 | −29.146 | 1.00 | 85.85 O |
| ATOM | 3072 | CB | ARG | B | 97 | 21.752 | 62.125 | −30.973 | 1.00 | 70.59 C |
| ATOM | 3073 | CG | ARG | B | 97 | 20.355 | 61.764 | −31.486 | 1.00 | 74.25 C |
| ATOM | 3074 | CD | ARG | B | 97 | 20.346 | 61.406 | −32.980 | 1.00 | 78.03 C |
| ATOM | 3075 | NE | ARG | B | 97 | 18.985 | 61.296 | −33.514 | 1.00 | 77.34 N |
| ATOM | 3076 | CZ | ARG | B | 97 | 18.338 | 62.279 | −34.139 | 1.00 | 79.32 C |
| ATOM | 3077 | NH1 | ARG | B | 97 | 18.923 | 63.455 | −34.321 | 1.00 | 82.78 N1+ |
| ATOM | 3078 | NH2 | ARG | B | 97 | 17.104 | 62.089 | −34.584 | 1.00 | 75.79 N |
| ATOM | 3079 | N | ASP | B | 98 | 23.268 | 64.508 | −29.029 | 1.00 | 81.18 N |
| ATOM | 3080 | CA | ASP | B | 98 | 24.539 | 65.192 | −28.819 | 1.00 | 83.60 C |
| ATOM | 3081 | C | ASP | B | 98 | 24.582 | 65.896 | −27.467 | 1.00 | 81.34 C |
| ATOM | 3082 | O | ASP | B | 98 | 25.258 | 66.914 | −27.310 | 1.00 | 81.08 O |
| ATOM | 3083 | CB | ASP | B | 98 | 24.810 | 66.190 | −29.945 | 1.00 | 80.66 C |
| ATOM | 3084 | CG | ASP | B | 98 | 25.042 | 65.516 | −31.282 | 1.00 | 86.44 C |
| ATOM | 3085 | OD1 | ASP | B | 98 | 25.998 | 64.719 | −31.395 | 1.00 | 93.34 O |
| ATOM | 3086 | OD2 | ASP | B | 98 | 24.258 | 65.779 | −32.221 | 1.00 | 90.91 O1− |
| ATOM | 3087 | N | MET | B | 99 | 23.867 | 65.363 | −26.484 | 1.00 | 76.97 N |
| ATOM | 3088 | CA | MET | B | 99 | 23.835 | 65.954 | −25.148 | 1.00 | 80.48 C |
| ATOM | 3089 | C | MET | B | 99 | 25.227 | 66.031 | −24.495 | 1.00 | 80.39 C |
| ATOM | 3090 | O | MET | B | 99 | 26.023 | 65.095 | −24.611 | 1.00 | 78.67 O |
| ATOM | 3091 | CB | MET | B | 99 | 22.881 | 65.155 | −24.256 | 1.00 | 80.49 C |
| ATOM | 3092 | CG | MET | B | 99 | 21.634 | 65.909 | −23.878 | 1.00 | 81.32 C |
| ATOM | 3093 | SD | MET | B | 99 | 22.066 | 67.374 | −22.931 | 1.00 | 89.68 S |
| ATOM | 3094 | CE | MET | B | 99 | 21.161 | 68.636 | −23.833 | 1.00 | 85.06 C |
| ATOM | 3095 | OXT | MET | B | 99 | 25.596 | 67.017 | −23.835 | 1.00 | 70.67 O1− |
| HETATM | 3096 | C1 | PEG | B | 101 | 17.493 | 54.344 | 0.548 | 1.00 | 48.02 C |
| HETATM | 3097 | C2 | PEG | B | 101 | 16.562 | 55.498 | 0.888 | 1.00 | 56.59 C |

TABLE 77-continued

| | | | | | | | | | | |
|---|---|---|---|---|---|---|---|---|---|---|
| HETATM | 3098 | C3 | PEG | B | 101 | 14.226 | 55.244 | 1.021 | 1.00 | 44.26 C |
| HETATM | 3099 | C4 | PEG | B | 101 | 13.622 | 56.536 | 1.531 | 1.00 | 44.53 C |
| HETATM | 3100 | O1 | PEG | B | 101 | 18.576 | 54.358 | 1.448 | 1.00 | 51.42 O |
| HETATM | 3101 | O2 | PEG | B | 101 | 15.345 | 55.416 | 0.194 | 1.00 | 54.92 O |
| HETATM | 3102 | O4 | PEG | B | 101 | 13.400 | 56.533 | 2.922 | 1.00 | 49.43 O |
| TER | | | | | | | | | | |
| ATOM | 3103 | N | GLU | H | 1 | 18.890 | 26.602 | 23.899 | 1.00 | 68.59 N1+ |
| ATOM | 3104 | CA | GLU | H | 1 | 18.522 | 25.867 | 22.699 | 1.00 | 70.91 C |
| ATOM | 3105 | C | GLU | H | 1 | 17.200 | 25.136 | 22.903 | 1.00 | 62.36 C |
| ATOM | 3106 | O | GLU | H | 1 | 16.817 | 24.750 | 24.011 | 1.00 | 60.43 O |
| ATOM | 3107 | CB | GLU | H | 1 | 19.627 | 24.883 | 22.285 | 1.00 | 77.56 C |
| ATOM | 3108 | CG | GLU | H | 1 | 19.850 | 23.751 | 23.250 | 1.00 | 69.14 C |
| ATOM | 3109 | CD | GLU | H | 1 | 19.645 | 24.203 | 24.657 | 1.00 | 73.20 C |
| ATOM | 3110 | OE1 | GLU | H | 1 | 18.856 | 23.555 | 25.376 | 1.00 | 76.18 O |
| ATOM | 3111 | OE2 | GLU | H | 1 | 20.229 | 25.245 | 25.026 | 1.00 | 81.72 O1− |
| ATOM | 3112 | N | VAL | H | 2 | 16.510 | 24.974 | 21.785 | 1.00 | 56.43 N |
| ATOM | 3113 | CA | VAL | H | 2 | 15.166 | 24.442 | 21.776 | 1.00 | 53.96 C |
| ATOM | 3114 | C | VAL | H | 2 | 15.156 | 23.006 | 22.275 | 1.00 | 49.00 C |
| ATOM | 3115 | O | VAL | H | 2 | 16.089 | 22.234 | 22.042 | 1.00 | 44.67 O |
| ATOM | 3116 | CB | VAL | H | 2 | 14.638 | 24.556 | 20.338 | 1.00 | 52.91 C |
| ATOM | 3117 | CG1 | VAL | H | 2 | 13.162 | 24.255 | 20.262 | 1.00 | 47.19 C |
| ATOM | 3118 | CG2 | VAL | H | 2 | 14.959 | 25.960 | 19.812 | 1.00 | 54.76 C |
| ATOM | 3119 | N | GLN | H | 3 | 14.088 | 22.643 | 22.967 | 1.00 | 45.22 N |
| ATOM | 3120 | CA | GLN | H | 3 | 13.813 | 21.257 | 23.293 | 1.00 | 46.38 C |
| ATOM | 3121 | C | GLN | H | 3 | 12.507 | 20.853 | 22.625 | 1.00 | 46.70 C |
| ATOM | 3122 | O | GLN | H | 3 | 11.520 | 21.606 | 22.658 | 1.00 | 44.87 O |
| ATOM | 3123 | CB | GLN | H | 3 | 13.733 | 21.044 | 24.805 | 1.00 | 45.90 C |
| ATOM | 3124 | CG | GLN | H | 3 | 13.682 | 19.581 | 25.202 | 1.00 | 53.15 C |
| ATOM | 3125 | CD | GLN | H | 3 | 13.340 | 19.396 | 26.671 | 1.00 | 57.52 C |
| ATOM | 3126 | OE1 | GLN | H | 3 | 12.851 | 20.317 | 27.326 | 1.00 | 54.41 O |
| ATOM | 3127 | NE2 | GLN | H | 3 | 13.596 | 18.205 | 27.195 | 1.00 | 58.50 N |
| ATOM | 3128 | N | LEU | H | 4 | 12.516 | 19.684 | 21.996 | 1.00 | 43.12 N |
| ATOM | 3129 | CA | LEU | H | 4 | 11.314 | 19.063 | 21.454 | 1.00 | 40.41 C |
| ATOM | 3130 | C | LEU | H | 4 | 11.129 | 17.722 | 22.143 | 1.00 | 41.73 C |
| ATOM | 3131 | O | LEU | H | 4 | 12.061 | 16.911 | 22.184 | 1.00 | 41.93 O |
| ATOM | 3132 | CB | LEU | H | 4 | 11.424 | 18.861 | 19.939 | 1.00 | 40.43 C |
| ATOM | 3133 | CG | LEU | H | 4 | 11.828 | 20.097 | 19.146 | 1.00 | 44.60 C |
| ATOM | 3134 | CD1 | LEU | H | 4 | 12.062 | 19.716 | 17.685 | 1.00 | 36.70 C |
| ATOM | 3135 | CD2 | LEU | H | 4 | 10.753 | 21.181 | 19.272 | 1.00 | 36.15 C |
| ATOM | 3136 | N | VAL | H | 5 | .937 | 17.481 | 22.674 | 1.00 | 43.32 N |
| ATOM | 3137 | CA | VAL | H | 5 | 9.633 | 16.235 | 23.368 | 1.00 | 46.02 C |
| ATOM | 3138 | C | VAL | H | 5 | 8.405 | 15.618 | 22.715 | 1.00 | 43.69 C |
| ATOM | 3139 | O | VAL | H | 5 | 7.322 | 16.219 | 22.726 | 1.00 | 40.50 O |
| ATOM | 3140 | CB | VAL | H | 5 | 9.407 | 16.466 | 24.868 | 1.00 | 42.86 C |
| ATOM | 3141 | CG1 | VAL | H | 5 | 8.998 | 15.178 | 25.533 | 1.00 | 48.81 C |
| ATOM | 3142 | CG2 | VAL | H | 5 | 10.664 | 16.976 | 25.499 | 1.00 | 45.11 C |
| ATOM | 3143 | N | GLU | H | 6 | 8.579 | 14.442 | 22.124 | 1.00 | 42.40 N |
| ATOM | 3144 | CA | GLU | H | 6 | 7.484 | 13.738 | 21.465 | 1.00 | 41.28 C |
| ATOM | 3145 | C | GLU | H | 6 | 6.793 | 12.808 | 22.439 | 1.00 | 45.38 C |
| ATOM | 3146 | O | GLU | H | 6 | 7.393 | 12.322 | 23.399 | 1.00 | 47.63 O |
| ATOM | 3147 | CB | GLU | H | 6 | 7.978 | 12.897 | 20.286 | 1.00 | 40.98 C |
| ATOM | 3148 | CG | GLU | H | 6 | 8.619 | 13.663 | 19.131 | 1.00 | 42.65 C |
| ATOM | 3149 | CD | GLU | H | 6 | 10.108 | 13.461 | 19.089 | 1.00 | 48.29 C |
| ATOM | 3150 | OE1 | GLU | H | 6 | 10.697 | 13.224 | 20.167 | 1.00 | 55.17 O |
| ATOM | 3151 | OE2 | GLU | H | 6 | 10.712 | 13.547 | 18.000 | 1.00 | 44.82 O1− |
| ATOM | 3152 | N | SER | H | 7 | 5.532 | 12.515 | 22.145 | 1.00 | 41.60 N |
| ATOM | 3153 | CA | SER | # | 7 | 4.834 | 11.432 | 22.819 | 1.00 | 45.27 C |
| ATOM | 3154 | C | SER | H | 7 | 3.669 | 10.993 | 21.949 | 1.00 | 43.68 C |
| ATOM | 3155 | O | SER | H | 7 | 3.357 | 11.614 | 20.932 | 1.00 | 43.20 O |
| ATOM | 3156 | CB | SER | H | 7 | 4.348 | 11.851 | 24.206 | 1.00 | 45.40 C |
| ATOM | 3157 | OG | SER | H | 7 | 3.407 | 12.881 | 24.103 | 1.00 | 52.88 O |
| ATOM | 3158 | N | GLY | H | 8 | 3.030 | 9.903 | 22.361 | 1.00 | 39.54 N |
| ATOM | 3159 | CA | GLY | H | 8 | 1.882 | 9.366 | 21.666 | 1.00 | 35.71 C |
| ATOM | 3160 | C | GLY | H | 8 | 2.161 | 8.107 | 20.880 | 1.00 | 42.39 C |
| ATOM | 3161 | O | GLY | H | 8 | 1.217 | 7.483 | 20.374 | 1.00 | 42.39 O |
| ATOM | 3162 | N | GLY | H | 9 | 3.417 | 7.707 | 20.751 | 1.00 | 41.73 N |
| ATOM | 3163 | CA | GLY | H | 9 | 3.711 | 6.483 | 20.038 | 1.00 | 45.54 C |
| ATOM | 3164 | C | GLY | H | 9 | 3.210 | 5.262 | 20.786 | 1.00 | 45.28 C |
| ATOM | 3165 | O | GLY | H | 9 | 2.880 | 5.303 | 21.969 | 1.00 | 44.71 O |
| ATOM | 3166 | N | GLY | H | 10 | 3.129 | 4.148 | 20.078 | 1.00 | 44.84 N |
| ATOM | 3167 | CA | GLY | H | 10 | 2.694 | 2.935 | 20.731 | 1.00 | 44.87 C |
| ATOM | 3168 | C | GLY | H | 10 | 2.345 | 1.868 | 19.721 | 1.00 | 47.87 C |
| ATOM | 3169 | O | GLY | H | 10 | 2.560 | 2.021 | 18.515 | 1.00 | 45.19 O |
| ATOM | 3170 | N | LEU | H | 11 | 1.802 | 0.781 | 20.255 | 1.00 | 48.68 N |
| ATOM | 3171 | CA | LEU | H | 11 | 1.348 | −0.344 | 19.463 | 1.00 | 41.18 C |
| ATOM | 3172 | C | LEU | H | 11 | −0.106 | −0.128 | 19.105 | 1.00 | 46.73 C |
| ATOM | 3173 | O | LEU | H | 11 | −0.924 | 0.166 | 19.981 | 1.00 | 42.45 O |
| ATOM | 3174 | CB | LEU | H | 11 | 1.515 | −1.647 | 20.245 | 1.00 | 45.81 C |
| ATOM | 3175 | CG | LEU | H | 11 | 0.964 | −2.912 | 19.596 | 1.00 | 42.67 C |
| ATOM | 3176 | CD1 | LEU | H | 11 | 1.660 | −3.223 | 18.267 | 1.00 | 41.35 C |

TABLE 77-continued

| ATOM | 3177 | CD2 | LEU | H | 11 | 1.169 | −4.048 | 20.569 | 1.00 | 51.10 | C |
|---|---|---|---|---|---|---|---|---|---|---|---|
| ATOM | 3178 | N | VAL | H | 12 | −0.422 | −0.297 | 17.821 | 1.00 | 42.01 | N |
| ATOM | 3179 | CA | VAL | H | 12 | −1.735 | 0.001 | 17.272 | 1.00 | 41.67 | C |
| ATOM | 3180 | C | VAL | H | 12 | −1.975 | −0.966 | 16.125 | 1.00 | 40.73 | C |
| ATOM | 3181 | O | VAL | H | 12 | −1.035 | −1.433 | 15.481 | 1.00 | 42.82 | O |
| ATOM | 3182 | CB | VAL | H | 12 | −1.825 | 1.481 | 16.817 | 1.00 | 48.67 | C |
| ATOM | 3183 | CG1 | VAL | H | 12 | −3.029 | 1.729 | 15.921 | 1.00 | 49.00 | C |
| ATOM | 3184 | CG2 | VAL | H | 12 | −1.919 | 2.374 | 18.023 | 1.00 | 52.94 | C |
| ATOM | 3185 | N | GLN | H | 13 | −3.233 | −1.281 | 15.892 | 1.00 | 42.48 | N |
| ATOM | 3186 | CA | GLN | H | 13 | −3.688 | −2.198 | 14.862 | 1.00 | 42.94 | C |
| ATOM | 3187 | C | GLN | H | 13 | −3.616 | −1.566 | 13.472 | 1.00 | 46.67 | C |
| ATOM | 3188 | O | GLN | H | 13 | −3.904 | −0.376 | 13.310 | 1.00 | 46.29 | O |
| ATOM | 3189 | CB | GLN | H | 13 | −5.126 | −2.611 | 15.144 | 1.00 | 48.33 | C |
| ATOM | 3190 | CG | GLN | H | 13 | −5.276 | −3.517 | 16.340 | 1.00 | 51.47 | C |
| ATOM | 3191 | CD | GLN | H | 13 | −5.044 | −4.948 | 15.968 | .00 | 52.27 | C |
| ATOM | 3192 | OE1 | GLN | H | 13 | −5.195 | −5.320 | 14.804 | 1.00 | 54.71 | O |
| ATOM | 3193 | NE2 | GLN | H | 13 | −4.664 | −5.766 | 16.942 | 1.00 | 53.07 | N |
| ATOM | 3194 | N | PRO | H | 14 | −3.279 | −2.357 | 12.450 | 1.00 | 44.92 | N |
| ATOM | 3195 | CA | PRO | H | 14 | −3.423 | −1.887 | 11.066 | 1.00 | 42.76 | C |
| ATOM | 3196 | C | PRO | H | 14 | −4.823 | −1.356 | 10.813 | 1.00 | 47.92 | C |
| ATOM | 3197 | O | PRO | H | 14 | −5.816 | −1.952 | 11.232 | 1.00 | 46.49 | O |
| ATOM | 3198 | CB | PRO | H | 14 | −3.131 | −3.136 | 10.221 | 1.00 | 41.99 | C |
| ATOM | 3199 | CG | PRO | H | 14 | −2.865 | −4.249 | 11.171 | 1.00 | 52.19 | C |
| ATOM | 3200 | CD | PRO | H | 14 | −2.590 | −3.653 | 12.520 | 1.00 | 48.44 | C |
| ATOM | 3201 | N | GLY | H | 15 | −4.897 | −0.219 | 10.117 | 1.00 | 44.43 | N |
| ATOM | 3202 | CA | GLY | H | 15 | −6.144 | 0.497 | 9.958 | 1.00 | 41.37 | C |
| ATOM | 3203 | C | GLY | H | 15 | −6.532 | 1.343 | 11.148 | 1.00 | 41.00 | C |
| ATOM | 3204 | O | GLY | H | 15 | −7.524 | 2.077 | 11.070 | 1.00 | 45.37 | O |
| ATOM | 3205 | N | GLY | H | 16 | −5.795 | 1.258 | 12.251 | 1.00 | 41.91 | N |
| ATOM | 3206 | CA | GLY | H | 16 | −6.083 | 2.052 | 13.423 | 1.00 | 41.15 | C |
| ATOM | 3207 | C | GLY | H | 16 | −5.566 | 3.468 | 13.289 | 1.00 | 44.86 | C |
| ATOM | 3208 | O | GLY | H | 16 | −5.094 | 3.901 | 12.238 | 1.00 | 42.85 | O |
| ATOM | 3209 | N | SER | H | 17 | −5.663 | 4.200 | 14.397 | 1.00 | 43.75 | N |
| ATOM | 3210 | CA | SER | H | 17 | −5.363 | 5.619 | 14.454 | 1.00 | 44.63 | C |
| ATOM | 3211 | C | SER | H | 17 | −4.477 | 5.898 | 15.650 | 1.00 | 46.44 | C |
| ATOM | 3212 | O | SER | H | 17 | −4.543 | 5.212 | 16.671 | 1.00 | 46.94 | O |
| ATOM | 3213 | CB | SER | H | 17 | −6.625 | 6.477 | 14.561 | 1.00 | 44.58 | C |
| ATOM | 3214 | OG | SER | H | 17 | −7.251 | 6.615 | 13.300 | 1.00 | 53.09 | O |
| ATOM | 3215 | N | LEU | H | 18 | −3.651 | 6.924 | 15.508 | 1.00 | 45.44 | N |
| ATOM | 3216 | CA | LEU | H | 18 | −2.724 | 7.321 | 16.549 | 1.00 | 43.34 | C |
| ATOM | 3217 | C | LEU | H | 18 | −2.474 | 8.811 | 16.366 | 1.00 | 43.97 | C |
| ATOM | 3218 | O | LEU | H | 18 | −2.482 | 9.298 | 15.236 | 1.00 | 46.48 | O |
| ATOM | 3219 | CB | LEU | H | 18 | −1.430 | 6.514 | 16.433 | 1.00 | 44.67 | C |
| ATOM | 3220 | CG | LEU | H | 18 | −0.527 | 6.296 | 17.637 | 1.00 | 52.71 | C |
| ATOM | 3221 | CD1 | LEU | H | 18 | −1.326 | 5.691 | 18.785 | 1.00 | 49.47 | C |
| ATOM | 3222 | CD2 | LEU | H | 18 | 0.602 | 5.361 | 17.230 | 1.00 | 46.06 | C |
| ATOM | 3223 | N | ARG | H | 19 | −2.283 | 9.533 | 17.464 | 1.00 | 37.69 | N |
| ATOM | 3224 | CA | ARG | H | 19 | −1.999 | 10.962 | 17.406 | 1.00 | 43.89 | C |
| ATOM | 3225 | C | ARG | H | 19 | −0.695 | 11.208 | 18.132 | 1.00 | 42.87 | C |
| ATOM | 3226 | O | ARG | H | 19 | −0.593 | 10.925 | 19.333 | 1.00 | 42.23 | O |
| ATOM | 3227 | CB | ARG | H | 19 | −3.111 | 11.812 | 18.032 | 1.00 | 47.83 | C |
| ATOM | 3228 | CG | ARG | H | 19 | −2.648 | 13.225 | 18.433 | 1.00 | 44.59 | C |
| ATOM | 3229 | CD | ARG | H | 19 | −3.829 | 14.154 | 18.828 | 1.00 | 48.27 | C |
| ATOM | 3230 | NE | ARG | H | 19 | −4.511 | 14.508 | 17.606 | 1.00 | 56.87 | N |
| ATOM | 3231 | CZ | ARG | H | 19 | −4.633 | 15.726 | 17.112 | 1.00 | 49.14 | C |
| ATOM | 3232 | NH1 | ARG | H | 19 | −4.185 | 16.785 | 17.766 | 1.00 | 54.66 | N1+ |
| ATOM | 3233 | NH2 | ARG | H | 19 | −5.245 | 15.868 | 15.954 | 1.00 | 54.90 | N1+ |
| ATOM | 3234 | N | LEU | H | 20 | 0.302 | 11.702 | 17.406 | 1.00 | 35.90 | N |
| ATOM | 3235 | CA | LEU | H | 20 | 1.566 | 12.050 | 18.028 | 1.00 | 38.74 | C |
| ATOM | 3236 | C | LEU | H | 20 | 1.562 | 13.535 | 18.345 | 1.00 | 40.33 | C |
| ATOM | 3237 | O | LEU | H | 20 | 0.944 | 14.341 | 17.641 | 1.00 | 40.04 | O |
| ATOM | 3238 | CB | LEU | H | 20 | 2.761 | 11.728 | 17.123 | 1.00 | 35.71 | C |
| ATOM | 3239 | CG | LEU | H | 20 | 2.836 | 10.316 | 16.578 | 1.00 | 40.82 | C |
| ATOM | 3240 | CD1 | LEU | H | 20 | 4.092 | 10.153 | 15.717 | 1.00 | 37.78 | C |
| ATOM | 3241 | CD2 | LEU | H | 20 | 2.842 | 9.328 | 17.727 | 1.00 | 40.18 | C |
| ATOM | 3242 | N | SER | H | 21 | 2.260 | 13.891 | 19.412 | 1.00 | 36.93 | N |
| ATOM | 3243 | CA | SER | H | 21 | 2.409 | 15.282 | 19.786 | 1.00 | 40.26 | C |
| ATOM | 3244 | C | SER | H | 21 | 3.885 | 15.574 | 19.967 | 1.00 | 38.93 | C |
| ATOM | 3245 | O | SER | H | 21 | 4.685 | 14.682 | 20.271 | 1.00 | 38.63 | O |
| ATOM | 3246 | CB | SER | H | 21 | 1.634 | 15.608 | 21.068 | 1.00 | 45.38 | C |
| ATOM | 3247 | OG | SER | H | 21 | 2.310 | 15.058 | 22.182 | 1.00 | 56.31 | O |
| ATOM | 3248 | N | CYS | H | 22 | 4.248 | 16.825 | 19.732 | 1.00 | 37.14 | N |
| ATOM | 3249 | CA | CYS | H | 22 | 5.618 | 17.275 | 19.931 | 1.00 | 38.61 | C |
| ATOM | 3250 | C | CYS | H | 22 | 5.559 | 18.627 | 20.625 | 1.00 | 43.72 | C |
| ATOM | 3251 | O | CYS | H | 22 | 5.107 | 19.611 | 20.029 | 1.00 | 42.48 | O |
| ATOM | 3252 | CB | CYS | H | 22 | 6.360 | 17.358 | 18.598 | 1.00 | 39.28 | C |
| ATOM | 3253 | SG | CYS | H | 22 | 7.879 | 18.331 | 18.658 | 1.00 | 48.95 | S |
| ATOM | 3254 | N | ALA | H | 23 | 6.003 | 18.677 | 21.878 | 1.00 | 39.95 | N |
| ATOM | 3255 | CA | ALA | H | 23 | 5.990 | 19.918 | 22.642 | 1.00 | 40.62 | C |
| ATOM | 3256 | C | ALA | H | 23 | 7.337 | 20.599 | 22.504 | 1.00 | 41.15 | C |

TABLE 77-continued

| | | | | | | | | | | |
|---|---|---|---|---|---|---|---|---|---|---|
| ATOM | 3257 | O | ALA | H | 23 | 8.377 | 19.973 | 22.722 | 1.00 | 41.99 | O |
| ATOM | 3258 | CB | ALA | H | 23 | 5.675 | 19.660 | 24.113 | 1.00 | 41.11 | C |
| ATOM | 3259 | N | ALA | H | 24 | 7.313 | 21.875 | 22.127 | 1.00 | 36.48 | N |
| ATOM | 3260 | CA | ALA | H | 24 | 8.513 | 22.661 | 21.893 | 1.00 | 41.00 | C |
| ATOM | 3261 | C | ALA | H | 24 | 8.722 | 23.642 | 23.032 | 1.00 | 45.85 | C |
| ATOM | 3262 | O | ALA | H | 24 | 7.782 | 24.312 | 23.468 | 1.00 | 47.77 | O |
| ATOM | 3263 | CB | ALA | H | 24 | 8.416 | 23.425 | 20.574 | 1.00 | 44.90 | C |
| ATOM | 3264 | N | SER | H | 25 | 9.957 | 23.732 | 23.507 | 1.00 | 42.18 | N |
| ATOM | 3265 | CA | SER | H | 25 | 10.318 | 24.659 | 24.564 | 1.00 | 44.35 | C |
| ATOM | 3266 | C | SER | H | 25 | 11.557 | 25.422 | 24.138 | 1.00 | 46.23 | C |
| ATOM | 3267 | O | SER | H | 25 | 12.437 | 24.881 | 23.470 | 1.00 | 44.86 | O |
| ATOM | 3268 | CB | SER | H | 25 | 10.608 | 23.937 | 25.882 | 1.00 | 45.92 | C |
| ATOM | 3269 | OG | SER | H | 25 | 9.430 | 23.423 | 26.463 | 1.00 | 56.74 | O |
| ATOM | 3270 | N | GLY | H | 26 | 11.629 | 26.682 | 24.531 | 1.00 | 47.38 | N |
| ATOM | 3271 | CA | GLY | H | 26 | 12.874 | 27.404 | 24.422 | 1.00 | 42.55 | C |
| ATOM | 3272 | C | GLY | H | 26 | 12.989 | 28.370 | 23.268 | 1.00 | 50.65 | C |
| ATOM | 3273 | O | GLY | H | 26 | 14.050 | 28.983 | 23.109 | 1.00 | 48.48 | O |
| ATOM | 3274 | N | PHE | H | 27 | 11.953 | 28.530 | 22.456 | 1.00 | 43.39 | N |
| ATOM | 3275 | CA | PHE | H | 27 | 11.971 | 29.587 | 21.449 | 1.00 | 50.22 | C |
| ATOM | 3276 | C | PHE | H | 27 | 10.566 | 30.168 | 21.375 | 1.00 | 48.33 | C |
| ATOM | 3277 | O | PHE | H | 27 | 9.773 | 30.039 | 22.314 | 1.00 | 48.48 | O |
| ATOM | 3278 | CB | PHE | H | 27 | 12.550 | 29.081 | 20.111 | 1.00 | 48.66 | C |
| ATOM | 3279 | CG | PHE | H | 27 | 11.780 | 27.957 | 19.444 | 1.00 | 46.48 | C |
| ATOM | 3280 | CD1 | PHE | H | 27 | 10.649 | 27.399 | 20.004 | 1.00 | 43.50 | C |
| ATOM | 3281 | CD2 | PHE | H | 27 | 12.232 | 27.452 | 18.230 | 1.00 | 44.72 | C |
| ATOM | 3282 | CE1 | PHE | H | 27 | 9.963 | 26.367 | 19.359 | 1.00 | 48.32 | C |
| ATOM | 3283 | CE2 | PHE | H | 27 | 11.568 | 26.427 | 17.595 | 1.00 | 44.99 | C |
| ATOM | 3284 | CZ | PHE | H | 27 | 10.426 | 25.882 | 18.158 | 1.00 | 44.10 | C |
| ATOM | 3285 | N | THR | H | 28 | 10.252 | 30.850 | 20.277 | 1.00 | 46.11 | N |
| ATOM | 3286 | CA | THR | H | 28 | 8.889 | 31.326 | 20.039 | 1.00 | 49.73 | C |
| ATOM | 3287 | C | THR | H | 28 | 8.263 | 30.416 | 18.988 | 1.00 | 45.17 | C |
| ATOM | 3288 | O | THR | H | 28 | 8.528 | 30.551 | 17.789 | 1.00 | 45.23 | O |
| ATOM | 3289 | CB | THR | H | 28 | 8.877 | 32.787 | 19.612 | 1.00 | 50.77 | U |
| ATOM | 3290 | OG1 | THR | H | 28 | 9.078 | 32.868 | 18.197 | 1.00 | 62.73 | O |
| ATOM | 3291 | CG2 | THR | H | 28 | 9.994 | 33.547 | 20.313 | 1.00 | 45.01 | C |
| ATOM | 3292 | N | PHE | H | 29 | 7.431 | 29.487 | 19.460 | 1.00 | 44.67 | N |
| ATOM | 3293 | CA | PHE | H | 29 | 6.930 | 28.400 | 18.629 | 1.00 | 43.32 | C |
| ATOM | 3294 | C | PHE | H | 29 | 6.211 | 28.906 | 17.393 | 1.00 | 41.64 | C |
| ATOM | 3295 | O | PHE | H | 29 | 6.296 | 28.290 | 16.323 | 1.00 | 41.25 | O |
| ATOM | 3296 | CB | PHE | H | 29 | 5.999 | 27.533 | 19.455 | 1.00 | 38.83 | C |
| ATOM | 3297 | CG | PHE | H | 29 | 5.466 | 26.337 | 18.723 | 1.00 | 41.38 | C |
| ATOM | 3298 | CD1 | PHE | H | 29 | 6.245 | 25.209 | 18.552 | 1.00 | 35.71 | C |
| ATOM | 3299 | CD2 | PHE | H | 29 | 4.178 | 26.341 | 18.225 | 1.00 | 39.72 | C |
| ATOM | 3300 | CE1 | PHE | H | 29 | 5.754 | 24.101 | 17.894 | 1.00 | 40.66 | C |
| ATOM | 3301 | CE2 | PHE | H | 29 | 3.668 | 25.241 | 17.556 | 1.00 | 40.47 | C |
| ATOM | 3302 | CZ | PHE | H | 29 | 4.447 | 24.111 | 17.399 | 1.00 | 44.25 | C |
| ATOM | 3303 | N | SER | H | 30 | 5.495 | 30.022 | 17.518 | 1.00 | 43.49 | N |
| ATOM | 3304 | CA | SER | H | 30 | 4.603 | 30.469 | 16.452 | 1.00 | 43.77 | C |
| ATOM | 3305 | C | SER | H | 30 | 5.360 | 30.881 | 15.196 | 1.00 | 42.09 | C |
| ATOM | 3306 | O | SER | H | 30 | 4.778 | 30.849 | 14.105 | 1.00 | 41.24 | O |
| ATOM | 3307 | CB | SER | H | 30 | 3.727 | 31.621 | 16.958 | 1.00 | 45.11 | C |
| ATOM | 3308 | OG | SER | H | 30 | 4.541 | 32.679 | 17.414 | 1.00 | 49.18 | O |
| ATOM | 3309 | N | ASN | H | 31 | 6.645 | 31.230 | 15.324 | 1.00 | 41.39 | N |
| ATOM | 3310 | CA | ASN | H | 31 | 7.533 | 31.468 | 14.189 | 1.00 | 38.65 | C |
| ATOM | 3311 | C | ASN | H | 31 | 8.151 | 30.200 | 13.598 | 1.00 | 42.96 | C |
| ATOM | 3312 | O | ASN | H | 31 | 8.701 | 30.257 | 12.490 | 1.00 | 37.94 | O |
| ATOM | 3313 | CB | ASN | H | 31 | 8.661 | 32.403 | 14.615 | 1.00 | 45.80 | C |
| ATOM | 3314 | CG | ASN | H | 31 | 8.176 | 33.795 | 14.901 | 1.00 | 48.14 | C |
| ATOM | 3315 | OD1 | ASN | H | 31 | 7.366 | 34.338 | 14.156 | 1.00 | 54.33 | O |
| ATOM | 3316 | ND2 | ASN | H | 31 | 8.662 | 34.382 | 15.986 | 1.00 | 47.34 | N |
| ATOM | 3317 | N | ALA | H | 32 | 8.088 | 29.067 | 14.295 | 1.00 | 38.20 | N |
| ATOM | 3318 | CA | ALA | H | 32 | 8.791 | 27.866 | 13.847 | 1.00 | 41.64 | C |
| ATOM | 3319 | C | ALA | H | 32 | 8.046 | 27.134 | 12.735 | 1.00 | 34.59 | C |
| ATOM | 3320 | O | ALA | H | 32 | 6.823 | 26.950 | 12.783 | 1.00 | 36.56 | O |
| ATOM | 3321 | CB | ALA | H | 32 | 9.005 | 26.905 | 15.018 | 1.00 | 36.64 | C |
| ATOM | 3322 | N | TRP | H | 33 | 8.791 | 26.713 | 11.727 | 1.00 | 30.90 | N |
| ATOM | 3323 | CA | TRP | H | 33 | 8.312 | 25.689 | 10.811 | 1.00 | 34.89 | C |
| ATOM | 3324 | C | TRP | H | 33 | 8.672 | 24.343 | 11.422 | 1.00 | 35.86 | C |
| ATOM | 3325 | O | TRP | H | 33 | 9.806 | 24.150 | 11.862 | 1.00 | 35.42 | C |
| ATOM | 3326 | CB | TRP | H | 33 | 8.942 | 25.812 | 9.430 | 1.00 | 32.47 | C |
| ATOM | 3327 | CG | TRP | H | 33 | 8.683 | 27.104 | 8.725 | 1.00 | 34.03 | C |
| ATOM | 3328 | CD1 | TRP | H | 33 | 8.209 | 28.290 | 9.262 | 1.00 | 35.02 | C |
| ATOM | 3329 | CD2 | TRP | H | 33 | 8.896 | 27.345 | 7.333 | 1.00 | 31.08 | C |
| ATOM | 3330 | NE1 | TRP | H | 33 | 8.127 | 29.252 | 8.262 | 1.00 | 37.42 | N |
| ATOM | 3331 | CE2 | TRP | H | 33 | 8.549 | 28.695 | 7.077 | 1.00 | 32.16 | C |
| ATOM | 3332 | CE3 | TRP | H | 33 | 9.351 | 26.548 | 6.274 | 1.00 | 33.95 | C |
| ATOM | 3333 | CZ2 | TRP | H | 33 | 8.657 | 29.266 | 5.802 | 1.00 | 35.27 | O |
| ATOM | 3334 | CZ3 | TRP | H | 33 | 9.455 | 27.117 | 1.999 | 1.00 | 34.68 | C |
| ATOM | 3335 | CH2 | TRP | H | 33 | 9.120 | 28.471 | 4.781 | 1.00 | 34.21 | C |
| ATOM | 3336 | N | MET | H | 34 | 7.693 | 23.440 | 11.496 | 1.00 | 37.06 | N |

TABLE 77-continued

| ATOM | 3337 | CA | MET | H | 34 | 7.876 | 22.162 | 12.161 | 1.00 | 35.08 | C |
|---|---|---|---|---|---|---|---|---|---|---|---|
| ATOM | 3338 | C | MET | H | 34 | 7.763 | 21.022 | 11.158 | 1.00 | 37.47 | C |
| ATOM | 3339 | O | MET | H | 34 | 6.887 | 21.029 | 10.288 | 1.00 | 35.35 | O |
| ATOM | 3340 | CB | MET | H | 34 | 6.845 | 21.979 | 13.269 | 1.00 | 34.68 | C |
| ATOM | 3341 | CG | MET | H | 34 | 6.809 | 23.096 | 14.297 | 1.00 | 34.56 | C |
| ATOM | 3342 | SD | MET | H | 34 | 8.376 | 23.219 | 15.172 | 1.00 | 40.13 | S |
| ATOM | 3343 | CE | MET | H | 34 | 8.531 | 21.584 | 15.875 | 1.00 | 37.83 | C |
| ATOM | 3344 | N | SER | H | 35 | 8.649 | 20.033 | 11.292 | 1.00 | 36.44 | N |
| ATOM | 3345 | CA | SER | H | 35 | 8.693 | 18.904 | 10.377 | 1.00 | 39.17 | C |
| ATOM | 3346 | C | SER | H | 35 | 8.618 | 17.586 | 11.141 | 1.00 | 36.39 | C |
| ATOM | 3347 | O | SER | H | 35 | 9.010 | 17.493 | 12.307 | 1.00 | 36.68 | O |
| ATOM | 3348 | CB | SER | H | 35 | 9.970 | 18.918 | 9.526 | 1.00 | 38.04 | C |
| ATOM | 3349 | OG | SER | H | 35 | 10.016 | 20.059 | 8.683 | 1.00 | 40.62 | O |
| ATOM | 3350 | N | TRP | H | 36 | 8.133 | 16.563 | 10.455 | 1.00 | 35.79 | N |
| ATOM | 3351 | CA | TRP | H | 36 | 8.155 | 15.201 | 10.954 | 1.00 | 33.40 | C |
| ATOM | 3352 | C | TRP | H | 36 | 9.004 | 14.365 | 10.017 | 1.00 | 35.33 | C |
| ATOM | 3353 | O | TRP | H | 36 | 8.889 | 14.473 | 8.791 | 1.00 | 34.93 | O |
| ATOM | 3354 | CB | TRP | H | 36 | 6.758 | 14.591 | 11.044 | 1.00 | 32.21 | C |
| ATOM | 3355 | CG | TRP | H | 36 | 5.875 | 15.119 | 12.105 | 1.00 | 37.48 | C |
| ATOM | 3356 | CD1 | TRP | H | 36 | 4.857 | 16.020 | 11.946 | 1.00 | 33.71 | C |
| ATOM | 3357 | CD2 | TRP | H | 36 | 5.868 | 14.738 | 13.487 | 1.00 | 35.83 | C |
| ATOM | 3358 | NE1 | TRP | H | 36 | 4.214 | 16.214 | 13.141 | 1.00 | 36.89 | N |
| ATOM | 3359 | CE2 | TRP | H | 36 | 4.822 | 15.455 | 14.107 | 1.00 | 37.62 | C |
| ATOM | 3360 | CE3 | TRP | H | 36 | 6.648 | 13.860 | 14.262 | 1.00 | 33.48 | C |
| ATOM | 3361 | CZ2 | TRP | H | 36 | 4.535 | 15.340 | 15.474 | 1.00 | 37.45 | C |
| ATOM | 3362 | CZ3 | TRP | H | 36 | 6.371 | 13.744 | 15.622 | 1.00 | 34.09 | C |
| ATOM | 3363 | CH2 | TRP | H | 36 | 5.305 | 14.471 | 16.211 | 1.00 | 40.14 | C |
| ATOM | 3364 | N | VAL | H | 37 | 9.852 | 13.533 | 10.610 | 1.00 | 34.24 | N |
| ATOM | 3365 | CA | VAL | H | 37 | 10.740 | 12.632 | 9.891 | 1.00 | 34.68 | C |
| ATOM | 3366 | C | VAL | H | 37 | 10.675 | 11.284 | 10.594 | 1.00 | 39.35 | C |
| ATOM | 3367 | O | VAL | H | 37 | 10.679 | 11.225 | 11.828 | 1.00 | 36.71 | O |
| ATOM | 3368 | CR | VAL | H | 37 | 12.183 | 13.168 | 9.862 | 1.00 | 34.68 | C |
| ATOM | 3369 | CG1 | VAL | H | 37 | 13.113 | 12.170 | 9.167 | 1.00 | 35.27 | C |
| ATOM | 3370 | CG2 | VAL | H | 37 | 12.248 | 14.543 | 9.168 | 1.00 | 36.69 | C |
| ATOM | 3371 | N | ARG | H | 38 | 10.585 | 10.202 | 9.823 | 1.00 | 35.24 | N |
| ATOM | 3372 | CA | ARG | H | 38 | 10.470 | 8.884 | 10.423 | 1.00 | 36.89 | C |
| ATOM | 3373 | C | ARG | H | 38 | 11.620 | 7.993 | 9.970 | 1.00 | 43.32 | C |
| ATOM | 3374 | O | ARG | H | 38 | 12.256 | 8.223 | 8.933 | 1.00 | 39.81 | O |
| ATOM | 3375 | CB | ARG | H | 38 | 9.112 | 8.225 | 10.109 | 1.00 | 33.68 | C |
| ATOM | 3376 | CG | ARG | H | 38 | 8.903 | 7.816 | 8.653 | 1.00 | 35.79 | C |
| ATOM | 3377 | CD | ARG | H | 38 | 7.491 | 7.308 | 8.466 | 1.00 | 39.96 | C |
| ATOM | 3378 | NE | ARG | H | 38 | 7.260 | 6.918 | 7.084 | 1.00 | 35.61 | N |
| ATOM | 3379 | CZ | ARG | H | 38 | 6.127 | 6.406 | 6.632 | 1.00 | 39.51 | C |
| ATOM | 3380 | NH1 | ARG | H | 38 | 5.103 | 6.195 | 7.461 | 1.00 | 39.04 | N1+ |
| ATOM | 3381 | NH2 | ARG | H | 38 | 6.022 | 6.095 | 5.346 | 1.00 | 39.25 | N1+ |
| ATOM | 3382 | N | GLN | H | 39 | 11.887 | 6.972 | 10.782 | 1.00 | 41.41 | N |
| ATOM | 3383 | CA | GLN | H | 39 | 12.957 | 6.021 | 10.508 | 1.00 | 37.89 | C |
| ATOM | 3384 | C | GLN | H | 39 | 12.456 | 4.638 | 10.895 | 1.00 | 42.09 | C |
| ATOM | 3385 | O | GLN | H | 39 | 12.276 | 4.352 | 12.081 | 1.00 | 37.84 | O |
| ATOM | 3386 | CB | GLN | H | 39 | 14.221 | 6.378 | 11.274 | 1.00 | 39.79 | C |
| ATOM | 3387 | CG | GLN | H | 39 | 15.395 | 5.455 | 10.946 | 1.00 | 40.75 | C |
| ATOM | 3388 | CD | GLN | H | 39 | 16.671 | 5.952 | 11.540 | 1.00 | 42.63 | C |
| ATOM | 3389 | OE1 | GLN | H | 39 | 16.658 | 6.652 | 12.551 | 1.00 | 42.18 | O |
| ATOM | 3390 | NE2 | GLN | H | 39 | 17.798 | 5.609 | 10.915 | 1.00 | 48.96 | N |
| ATOM | 3391 | N | ALA | H | 40 | 12.208 | 3.808 | 9.891 | 1.00 | 43.78 | N |
| ATOM | 3392 | CA | ALA | H | 40 | 11.718 | 2.461 | 10.100 | 1.00 | 42.15 | C |
| ATOM | 3393 | C | ALA | H | 40 | 12.850 | 1.563 | 10.609 | 1.00 | 50.21 | C |
| ATOM | 3394 | O | ALA | H | 40 | 14.029 | 1.834 | 10.344 | 1.00 | 47.23 | O |
| ATOM | 3395 | CB | ALA | H | 40 | 11.157 | 1.922 | 8.789 | 1.00 | 45.68 | C |
| ATOM | 3396 | N | PRO | H | 41 | 12.525 | 0.495 | 11.346 | 1.00 | 49.30 | N |
| ATOM | 3397 | CA | PRO | H | 41 | 13.584 | −0.337 | 11.941 | 1.00 | 48.64 | C |
| ATOM | 3398 | C | PRO | H | 41 | 14.562 | −0.835 | 10.885 | 1.00 | 47.39 | C |
| ATOM | 3399 | O | PRO | H | 41 | 14.167 | −1.360 | 9.843 | 1.00 | 50.68 | O |
| ATOM | 3400 | CB | PRO | H | 41 | 12.812 | −1.494 | 12.587 | 1.00 | 54.66 | C |
| ATOM | 3401 | CG | PRO | H | 41 | 11.435 | −0.968 | 12.826 | 1.00 | 48.93 | C |
| ATOM | 3402 | CD | PRO | H | 41 | 11.176 | −0.008 | 11.681 | 1.00 | 51.30 | C |
| ATOM | 3403 | N | GLY | H | 42 | 15.845 | −0.623 | 11.146 | 1.00 | 52.43 | N |
| ATOM | 3404 | CA | GLY | H | 42 | 16.884 | −1.021 | 10.216 | 1.00 | 57.53 | C |
| ATOM | 3405 | C | GLY | H | 42 | 16.925 | −0.274 | 8.901 | 1.00 | 59.37 | C |
| ATOM | 3406 | O | GLY | H | 42 | 17.596 | −0.735 | 7.971 | 1.00 | 58.69 | O |
| ATOM | 3407 | N | LYS | H | 43 | 16.239 | 0.861 | 8.787 | 1.00 | 53.41 | N |
| ATOM | 3408 | CA | LYS | H | 43 | 16.177 | 1.637 | 7.548 | 1.00 | 52.55 | C |
| ATOM | 3409 | C | LYS | H | 43 | 16.745 | 3.042 | 7.776 | 1.00 | 46.67 | C |
| ATOM | 3410 | O | LYS | H | 43 | 17.157 | 3.413 | 8.882 | 1.00 | 44.31 | O |
| ATOM | 3411 | CB | LYS | H | 43 | 14.738 | 1.709 | 7.011 | 1.00 | 56.62 | C |
| ATOM | 3412 | CG | LYS | H | 43 | 14.040 | 0.345 | 6.793 | 1.00 | 58.23 | C |
| ATOM | 3413 | CD | LYS | H | 43 | 13.972 | −0.060 | 5.311 | 1.00 | 63.56 | C |
| ATOM | 3414 | CE | LYS | H | 43 | 15.377 | −0.32G | 4.736 | 1.00 | 74.62 | C |
| ATOM | 3415 | NZ | LYS | H | 43 | 15.405 | −1.007 | 3.395 | 1.00 | 79.73 | N1+ |
| ATOM | 3416 | N | GLY | H | 44 | 16.775 | 3.827 | 6.708 | 1.00 | 47.87 | N |

TABLE 77-continued

| | | | | | | | | | | |
|---|---|---|---|---|---|---|---|---|---|---|
| ATOM | 3417 | CA | GLY | H | 44 | 17.266 | 5.189 | 6.765 | 1.00 | 48.10 | C |
| ATOM | 3418 | C | GLY | H | 44 | 16.172 | 6.168 | 7.154 | 1.00 | 49.70 | C |
| ATOM | 3419 | O | GLY | H | 44 | 15.093 | 5.791 | 7.622 | 1.00 | 45.16 | O |
| ATOM | 3420 | N | LEU | H | 45 | 16.457 | 7.449 | 6.937 | 1.00 | 44.61 | N |
| ATOM | 3421 | CA | LEU | H | 45 | 15.543 | 8.526 | 7.291 | 1.00 | 40.88 | C |
| ATOM | 3422 | C | LEU | H | 45 | 14.555 | 8.809 | 6.158 | 1.00 | 43.28 | C |
| ATOM | 3423 | O | LEU | H | 45 | 14.903 | 8.711 | 4.978 | 1.00 | 44.89 | O |
| ATOM | 3424 | CB | LEU | H | 45 | 16.351 | 9.779 | 7.615 | 1.00 | 41.48 | C |
| ATOM | 3425 | CG | LEU | H | 45 | 16.791 | 10.070 | 9.053 | 1.00 | 47.04 | C |
| ATOM | 3426 | CD1 | LEU | H | 45 | 16.396 | 9.008 | 10.022 | 1.00 | 45.88 | C |
| ATOM | 3427 | CD2 | LEU | H | 45 | 18.292 | 10.374 | 9.146 | 1.00 | 42.68 | C |
| ATOM | 3428 | N | GLU | H | 46 | 13.317 | 9.161 | 6.513 | 1.00 | 36.76 | N |
| ATOM | 3429 | CA | GLU | H | 46 | 12.297 | 9.482 | 5.513 | 1.00 | 38.81 | C |
| ATOM | 3430 | C | GLU | H | 46 | 11.469 | 10.675 | 5.974 | 1.00 | 41.68 | C |
| ATOM | 3431 | O | GLU | H | 46 | 10.796 | 10.611 | 7.005 | 1.00 | 37.77 | O |
| ATOM | 3432 | CB | GLU | H | 46 | 11.365 | 8.291 | 5.233 | 1.00 | 38.07 | C |
| ATOM | 3433 | CG | GLU | H | 46 | 10.332 | 8.612 | 4.172 | 1.00 | 41.46 | C |
| ATOM | 3434 | CD | GLU | H | 46 | 9.340 | 7.477 | 3.911 | 1.00 | 48.85 | C |
| ATOM | 3435 | OE1 | GLU | H | 46 | 8.784 | 6.926 | 4.873 | 1.00 | 46.92 | O |
| ATOM | 3436 | OE2 | GLU | H | 46 | 9.105 | 7.148 | 2.731 | 1.00 | 55.56 | O1− |
| ATOM | 3437 | N | TRP | H | 47 | 11.472 | 11.733 | 5.179 | 1.00 | 39.99 | N |
| ATOM | 3438 | CA | TRP | H | 47 | 10.668 | 12.911 | 5.478 | 1.00 | 32.15 | C |
| ATOM | 3439 | C | TRP | H | 47 | 9.177 | 12.589 | 5.386 | 1.00 | 36.59 | C |
| ATOM | 3440 | O | TRP | H | 47 | 8.721 | 11.928 | 4.444 | 1.00 | 34.36 | O |
| ATOM | 3441 | CB | TRP | H | 47 | 11.064 | 14.029 | 4.513 | 1.00 | 35.56 | C |
| ATOM | 3442 | CG | TRP | H | 47 | 10.318 | 15.363 | 4.654 | 1.00 | 37.23 | C |
| ATOM | 3443 | CD1 | TRP | H | 47 | 10.565 | 16.366 | 5.563 | 1.00 | 33.36 | C |
| ATOM | 3444 | CD2 | TRP | H | 47 | 9.223 | 15.816 | 3.839 | 1.00 | 36.00 | C |
| ATOM | 3445 | NE1 | TRP | H | 47 | 9.686 | 17.423 | 5.348 | 1.00 | 38.39 | N |
| ATOM | 3446 | CE2 | TRP | H | 47 | 8.862 | 17.107 | 4.292 | 1.00 | 39.34 | C |
| ATOM | 3447 | CE3 | TRP | H | 47 | 8.535 | 15.265 | 2.745 | 1.00 | 37.08 | C |
| ATOM | 3448 | CZ2 | TRP | H | 47 | 7.831 | 17.845 | 3.697 | 1.00 | 32.67 | C |
| ATOM | 3449 | CZ3 | TRP | H | 47 | 7.519 | 15.987 | 2.163 | 1.00 | 35.39 | C |
| ATOM | 3450 | CH2 | TRP | H | 47 | 7.166 | 17.270 | 2.642 | 1.00 | 34.13 | C |
| ATOM | 3451 | N | VAL | H | 48 | 8.418 | 13.026 | 6.383 | 1.00 | 33.44 | N |
| ATOM | 3452 | CA | VAL | H | 48 | 6.982 | 12.758 | 6.446 | 1.00 | 31.23 | C |
| ATOM | 3453 | C | VAL | H | 48 | 6.173 | 13.978 | 6.029 | 1.00 | 33.81 | C |
| ATOM | 3454 | O | VAL | H | 48 | 5.224 | 13.871 | 5.249 | 1.00 | 33.57 | O |
| ATOM | 3455 | CB | VAL | H | 48 | 6.586 | 12.299 | 7.869 | 1.00 | 31.23 | C |
| ATOM | 3456 | CG1 | VAL | H | 48 | 5.065 | 12.192 | 7.977 | 1.00 | 33.27 | C |
| ATOM | 3457 | CG2 | VAL | H | 48 | 7.275 | 10.972 | 8.217 | 1.00 | 32.94 | C |
| ATOM | 3458 | N | GLY | H | 49 | 6.529 | 15.145 | 6.554 | 1.00 | 36.10 | N |
| ATOM | 3459 | CA | GLY | H | 49 | 5.828 | 16.362 | 6.193 | 1.00 | 33.27 | C |
| ATOM | 3460 | C | GLY | H | 49 | 6.298 | 17.544 | 7.016 | 1.00 | 36.31 | C |
| ATOM | 3461 | O | GLY | H | 49 | 7.180 | 17.435 | 7.880 | 1.00 | 36.14 | O |
| ATOM | 3462 | N | ARG | H | 50 | 5.651 | 18.680 | 6.756 | 1.00 | 32.20 | N |
| ATOM | 3463 | CA | ARG | H | 50 | 6.066 | 19.962 | 7.302 | 1.00 | 34.85 | C |
| ATOM | 3464 | C | ARG | H | 50 | 4.853 | 20.871 | 7.442 | 1.00 | 34.67 | C |
| ATOM | 3465 | O | ARG | H | 50 | 3.908 | 20.790 | 6.653 | 1.00 | 36.92 | O |
| ATOM | 3466 | CB | ARG | H | 50 | 7.113 | 20.640 | 6.402 | 1.00 | 29.38 | C |
| ATOM | 3467 | CG | ARG | H | 50 | 7.650 | 21.924 | 7.026 | 1.00 | 33.64 | C |
| ATOM | 3468 | CD | ARG | H | 50 | 8.622 | 22.668 | 6.093 | 1.00 | 37.86 | C |
| ATOM | 3469 | NE | ARG | H | 50 | 7.938 | 23.203 | 4.916 | 1.00 | 40.35 | N |
| ATOM | 3470 | CZ | ARG | H | 50 | 8.579 | 23.683 | 3.854 | 1.00 | 40.17 | C |
| ATOM | 3471 | NH1 | ARG | H | 50 | 9.896 | 23.673 | 3.838 | 1.00 | 32.97 | N1+ |
| ATOM | 3472 | NH2 | ARG | H | 50 | 7.907 | 24.152 | 2.815 | 1.00 | 42.23 | N1+ |
| ATOM | 3473 | N | ILE | H | 51 | 4.875 | 21.742 | 8.446 | 1.00 | 37.06 | N |
| ATOM | 3474 | CA | ILE | H | 51 | 3.853 | 22.781 | 8.563 | 1.00 | 31.60 | C |
| ATOM | 3475 | C | ILE | H | 51 | 4.557 | 24.115 | 8.757 | 1.00 | 33.89 | C |
| ATOM | 3476 | O | ILE | H | 51 | 5.396 | 24.263 | 9.655 | 1.00 | 34.60 | O |
| ATOM | 3477 | CB | ILE | H | 51 | 2.846 | 22.498 | 9.702 | 1.00 | 31.85 | C |
| ATOM | 3478 | CG1 | ILE | H | 51 | 1.785 | 23.613 | 9.815 | 1.00 | 33.68 | C |
| ATOM | 3479 | CG2 | ILE | H | 51 | 3.554 | 22.286 | 11.045 | 1.00 | 30.58 | C |
| ATOM | 3480 | CD1 | ILE | H | 53 | 0.487 | 23.123 | 10.518 | 1.00 | 33.20 | C |
| ATOM | 3481 | N | ARG | H | 52 | 4.241 | 25.075 | 7.897 | 1.00 | 31.60 | N |
| ATOM | 3482 | CA | ARG | H | 52 | 4.812 | 26.396 | 8.030 | 1.00 | 32.86 | C |
| ATOM | 3483 | C | ARG | H | 52 | 4.223 | 27.136 | 9.222 | 1.00 | 35.85 | C |
| ATOM | 3484 | O | ARG | H | 52 | 3.179 | 26.772 | 9.775 | 1.00 | 35.60 | O |
| ATOM | 3485 | CB | ARG | H | 52 | 4.581 | 27.205 | 6.758 | 1.00 | 36.12 | C |
| ATOM | 3486 | CG | ARG | H | 52 | 5.410 | 26.729 | 5.601 | 1.00 | 38.00 | C |
| ATOM | 3487 | CD | ARG | H | 52 | 4.816 | 27.237 | 4.315 | 1.00 | 45.87 | C |
| ATOM | 3488 | NE | ARG | H | 52 | 5.863 | 27.496 | 3.348 | 1.00 | 55.16 | N |
| ATOM | 3489 | CZ | ARG | H | 52 | 6.069 | 26.784 | 2.244 | 1.00 | 60.05 | C |
| ATOM | 3490 | NH1 | ARG | H | 52 | 5.270 | 25.746 | 1.953 | 1.00 | 49.50 | N1+ |
| ATOM | 3491 | NH2 | ARG | H | 52 | 7.077 | 27.129 | 1.429 | 1.00 | 47.15 | N1+ |
| ATOM | 3492 | N | SER | H | 53 | 4.907 | 28.208 | 9.607 | 1.00 | 35.18 | N |
| ATOM | 3493 | CA | SER | H | 53 | 4.329 | 29.137 | 10.563 | 1.00 | 35.45 | C |
| ATOM | 3494 | C | SER | H | 53 | 3.132 | 29.854 | 9.952 | 1.00 | 37.97 | C |
| ATOM | 3495 | O | SER | H | 53 | 2.941 | 29.886 | 8.733 | 1.00 | 34.97 | O |
| ATOM | 3496 | CB | SER | H | 53 | 5.341 | 30.184 | 10.983 | 1.00 | 37.10 | C |

TABLE 77-continued

| | | | | | | | | | | |
|---|---|---|---|---|---|---|---|---|---|---|
| ATOM | 3497 | OG | SER | H | 53 | 5.695 | 30.945 | 9.845 | 1.00 | 40.37 | O |
| ATOM | 3498 | N | ARG | H | 54 | 2.350 | 30.485 | 10.832 | 1.00 | 34.49 | N |
| ATOM | 3499 | CA | ARG | H | 54 | 1.143 | 31.174 | 10.382 | 1.00 | 41.81 | C |
| ATOM | 3500 | C | ARG | H | 54 | 1.481 | 32.405 | 9.545 | 1.00 | 41.19 | C |
| ATOM | 3501 | O | ARG | H | 54 | 0.749 | 32.731 | 8.605 | 1.00 | 40.64 | O |
| ATOM | 3502 | CB | ARG | H | 54 | 0.271 | 31.547 | 11.586 | 1.00 | 39.53 | C |
| ATOM | 3503 | CG | ARG | H | 54 | 0.691 | 32.831 | 12.298 | 1.00 | 56.99 | C |
| ATOM | 3504 | CD | ARG | H | 54 | 0.835 | 32.662 | 13.815 | 1.00 | 61.82 | C |
| ATOM | 3505 | NE | ARG | H | 54 | −0.381 | 32.130 | 14.421 | 1.00 | 73.12 | N |
| ATOM | 3506 | CZ | ARG | H | 54 | −0.542 | 31.906 | 15.723 | 1.00 | 71.85 | C |
| ATOM | 3507 | NH1 | ARG | H | 54 | 0.442 | 32.175 | 16.574 | 1.00 | 60.50 | N1+ |
| ATOM | 3508 | NH2 | ARG | H | 54 | −1.696 | 31.415 | 16.170 | 1.00 | 72.14 | N |
| ATOM | 3509 | N | SER | H | 55 | 2.603 | 33.072 | 9.826 | 1.00 | 39.23 | N |
| ATOM | 3510 | CA | SER | H | 55 | 2.942 | 34.252 | 9.036 | 1.00 | 38.68 | C |
| ATOM | 3511 | C | SER | H | 55 | 3.260 | 33.881 | 7.597 | 1.00 | 39.27 | C |
| ATOM | 3512 | O | SER | H | 55 | 3.161 | 34.732 | 6.703 | 1.00 | 34.16 | O |
| ATOM | 3513 | CB | SER | H | 55 | 4.107 | 35.008 | 9.670 | 1.00 | 36.51 | C |
| ATOM | 3514 | OG | SER | H | 55 | 5.308 | 34.245 | 9.586 | 1.00 | 45.94 | O |
| ATOM | 3515 | N | TYR | H | 56 | 3.586 | 32.615 | 7.344 | 1.00 | 34.72 | N |
| ATOM | 3516 | CA | TYR | H | 56 | 3.710 | 32.104 | 5.988 | 1.00 | 36.31 | C |
| ATOM | 3517 | C | TYR | H | 56 | 2.469 | 31.361 | 5.532 | 1.00 | 41.02 | C |
| ATOM | 3518 | O | TYR | H | 36 | 2.524 | 30.658 | 4.521 | 1.00 | 44.96 | O |
| ATOM | 3519 | CB | TYR | H | 56 | 4.914 | 31.175 | 5.867 | 1.00 | 37.47 | C |
| ATOM | 3520 | CG | TYR | H | 56 | 6.223 | 31.887 | 5.687 | 1.00 | 36.13 | C |
| ATOM | 3521 | CD1 | TYR | H | 56 | 6.904 | 32.407 | 6.784 | 1.00 | 32.92 | C |
| ATOM | 3522 | CD2 | TYR | H | 56 | 6.799 | 32.018 | 4.425 | 1.00 | 38.00 | C |
| ATOM | 3523 | CE1 | TYR | H | 56 | 8.122 | 33.059 | 6.633 | 1.00 | 35.24 | C |
| ATOM | 3524 | CE2 | TYR | H | 56 | 8.041 | 32.672 | 4.261 | 1.00 | 30.17 | C |
| ATOM | 3525 | CZ | TYR | H | 56 | 8.687 | 33.180 | 5.377 | 1.00 | 35.79 | C |
| ATOM | 3526 | OH | TYR | H | 56 | 9.907 | 33.830 | 5.245 | 1.00 | 36.75 | O |
| ATOM | 3527 | N | GLY | H | 57 | 1.366 | 31.470 | 6.269 | 1.00 | 39.94 | N |
| ATOM | 3528 | CA | GLY | H | 57 | 0.126 | 30.855 | 5.872 | 1.00 | 41.75 | C |
| ATOM | 3529 | C | GLY | H | 57 | −0.191 | 29.542 | 6.551 | 1.00 | 43.56 | C |
| ATOM | 3530 | O | GLY | H | 57 | −1.257 | 28.983 | 6.283 | 1.00 | 41.21 | O |
| ATOM | 3531 | N | GLY | H | 58 | 0.694 | 29.039 | 7.416 | 1.00 | 42.49 | N |
| ATOM | 3532 | CA | GLY | H | 58 | 0.452 | 27.800 | 8.151 | 1.00 | 36.40 | C |
| ATOM | 3533 | C | GLY | H | 58 | 0.173 | 26.584 | 7.297 | 1.00 | 34.15 | C |
| ATOM | 3534 | O | GLY | H | 58 | −0.442 | 25.631 | 7.775 | 1.00 | 41.94 | O |
| ATOM | 3535 | N | THR | H | 59 | 0.652 | 26.565 | 6.061 | 1.00 | 40.40 | N |
| ATOM | 3536 | CA | THR | H | 59 | 0.318 | 25.491 | 5.139 | 1.00 | 42.58 | C |
| ATOM | 3537 | C | THR | H | 59 | 1.162 | 24.245 | 5.405 | 1.00 | 42.80 | C |
| ATOM | 3538 | O | THR | H | 59 | 2.282 | 24.316 | 5.918 | 1.00 | 34.71 | O |
| ATOM | 3539 | CB | THR | H | 59 | 0.509 | 25.969 | 3.698 | 1.00 | 36.69 | C |
| ATOM | 3540 | OG1 | THR | H | 59 | 1.602 | 26.880 | 3.661 | 1.00 | 48.30 | O |
| ATOM | 3541 | CG2 | THR | H | 59 | −0.735 | 26.713 | 3.241 | 1.00 | 52.91 | C |
| ATOM | 3542 | N | THR | H | 60 | 0.614 | 23.095 | 5.024 | 1.00 | 34.89 | N |
| ATOM | 3543 | CA | THR | H | 60 | 1.211 | 21.800 | 5.293 | 1.00 | 38.93 | C |
| ATOM | 3544 | C | THR | H | 60 | 1.685 | 21.160 | 4.000 | 1.00 | 35.22 | C |
| ATOM | 3545 | O | THR | H | 60 | 1.117 | 21.386 | 2.930 | 1.00 | 39.55 | O |
| ATOM | 3546 | CB | THR | H | 60 | 0.211 | 20.860 | 5.972 | 1.00 | 35.71 | C |
| ATOM | 3547 | OG1 | THR | H | 60 | −1.007 | 20.814 | 5.209 | 1.00 | 38.34 | O |
| ATOM | 3548 | CG2 | THR | H | 60 | −0.088 | 21.339 | 7.368 | 1.00 | 33.71 | C |
| ATOM | 3549 | N | ASP | H | 61 | 2.723 | 20.345 | 4.109 | 1.00 | 34.93 | N |
| ATOM | 3550 | CA | ASP | H | 61 | 3.187 | 19.534 | 2.996 | 1.00 | 36.71 | C |
| ATOM | 3551 | C | ASP | H | 61 | 3.415 | 18.126 | 3.500 | 1.00 | 34.81 | C |
| ATOM | 3552 | O | ASP | H | 61 | 3.794 | 17.934 | 4.652 | 1.00 | 34.76 | O |
| ATOM | 3553 | CB | ASP | H | 61 | 4.472 | 20.115 | 2.393 | 1.00 | 38.06 | C |
| ATOM | 3554 | CG | ASP | H | 61 | 4.212 | 21.428 | 1.654 | 1.00 | 43.66 | C |
| ATOM | 3555 | OD1 | ASP | H | 61 | 3.648 | 21.383 | 0.540 | 1.00 | 43.03 | O |
| ATOM | 3556 | OD2 | ASP | H | 61 | 4.528 | 22.492 | 2.212 | 1.00 | 40.87 | O1− |
| ATOM | 3557 | N | TYR | H | 62 | 3.188 | 17.148 | 2.629 | 1.00 | 34.65 | N |
| ATOM | 3558 | CA | TYR | H | 62 | 3.215 | 15.745 | 3.010 | 1.00 | 36.43 | C |
| ATOM | 3559 | C | TYR | H | 62 | 4.010 | 14.936 | 2.008 | 1.00 | 35.04 | C |
| ATOM | 3560 | O | TYR | H | 62 | 3.963 | 15.196 | 0.803 | 1.00 | 38.77 | O |
| ATOM | 3561 | CB | TYR | H | 62 | 1.810 | 15.151 | 3.076 | 1.00 | 34.11 | C |
| ATOM | 3562 | CG | TYR | H | 62 | 0.954 | 15.800 | 4.108 | 1.00 | 34.39 | C |
| ATOM | 3563 | CD1 | TYR | H | 62 | 0.154 | 16.888 | 3.790 | 1.00 | 35.02 | C |
| ATOM | 3564 | CD2 | TYR | H | 62 | 0.940 | 15.322 | 5.407 | 1.00 | 37.34 | C |
| ATOM | 3565 | CE1 | TYR | H | 62 | −0.653 | 17.491 | 4.746 | 1.00 | 37.80 | C |
| ATOM | 3566 | CE2 | TYR | H | 62 | 0.132 | 15.896 | 6.365 | 1.00 | 38.97 | C |
| ATOM | 3567 | CZ | TYR | H | 62 | −0.662 | 16.978 | 6.034 | 1.00 | 37.28 | C |
| ATOM | 3568 | OH | TYR | H | 62 | −1.424 | 17.570 | 7.009 | 1.00 | 35.24 | O |
| ATOM | 3569 | N | ALA | H | 63 | 4.715 | 13.931 | 2.512 | 1.00 | 35.45 | N |
| ATOM | 3570 | CA | ALA | H | 63 | 5.298 | 12.956 | 1.608 | 1.00 | 37.82 | C |
| ATOM | 3571 | C | ALA | H | 63 | 4.182 | 12.114 | 0.993 | 1.00 | 37.45 | C |
| ATOM | 3572 | O | ALA | H | 63 | 3.127 | 11.898 | 1.601 | 1.00 | 40.58 | O |
| ATOM | 3573 | CB | ALA | H | 63 | 6.322 | 12.079 | 2.336 | 1.00 | 34.07 | C |
| ATOM | 3574 | N | ALA | H | 64 | 4.405 | 11.683 | −0.247 | 1.00 | 37.53 | N |
| ATOM | 3575 | CA | ALA | H | 64 | 3.445 | 10.816 | −0.934 | 1.00 | 44.67 | C |
| ATOM | 3576 | C | ALA | H | 64 | 3.010 | 9.599 | −0.120 | 1.00 | 46.02 | C |

TABLE 77-continued

| ATOM | 3577 | O   | ALA | H | 64 | 1.803  | 9.333  | −0.075 | 1.00 | 44.29 | O   |
|------|------|-----|-----|---|----|--------|--------|--------|------|-------|-----|
| ATOM | 3578 | CB  | ALA | H | 64 | 4.019  | 10.370 | −2.286 | 1.00 | 48.02 | C   |
| ATOM | 3579 | N   | PRO | H | 65 | 3.892  | 8.840  | 0.550  | 1.00 | 45.67 | N   |
| ATOM | 3580 | CA  | PRO | H | 65 | 3.425  | 7.607  | 1.220  | 1.00 | 43.80 | C   |
| ATOM | 3581 | C   | PRO | H | 65 | 2.382  | 7.831  | 2.299  | 1.00 | 47.56 | C   |
| ATOM | 3582 | O   | PRO | H | 65 | 1.793  | 6.857  | 2.768  | 1.00 | 47.91 | O   |
| ATOM | 3583 | CB  | PRO | H | 65 | 4.706  | 7.016  | 1.821  | 1.00 | 45.26 | C   |
| ATOM | 3584 | CG  | PRO | H | 65 | 5.808  | 7.635  | 1.066  | 1.00 | 46.46 | C   |
| ATOM | 3585 | CD  | PRO | H | 65 | 5.348  | 9.004  | 0.711  | 1.00 | 40.54 | C   |
| ATOM | 3586 | N   | VAL | H | 66 | 2.133  | 9.060  | 2.737  | 1.00 | 41.65 | N   |
| ATOM | 3587 | CA  | VAL | H | 66 | 0.925  | 9.278  | 3.509  | 1.00 | 49.59 | C   |
| ATOM | 3588 | C   | VAL | H | 66 | −0.292 | 9.083  | 2.622  | 1.00 | 70.36 | C   |
| ATOM | 3589 | O   | VAL | H | 66 | −1.075 | 8.138  | 2.802  | 1.00 | 68.34 | O   |
| ATOM | 3590 | CB  | VAL | H | 66 | 0.902  | 10.669 | 4.132  | 1.00 | 59.51 | C   |
| ATOM | 3591 | CG1 | VAL | H | 66 | −0.526 | 10.897 | 4.591  | 1.00 | 35.33 | C   |
| ATOM | 3592 | CG2 | VAL | H | 66 | 1.978  | 10.769 | 5.243  | 1.00 | 41.86 | C   |
| ATOM | 3593 | N   | LYS | H | 67 | −0.458 | 9.976  | 1.635  | 1.00 | 70.34 | N   |
| ATOM | 3594 | CA  | LYS | H | 67 | −1.591 | 9.926  | 0.710  | 1.00 | 67.41 | C   |
| ATOM | 3595 | C   | LYS | H | 67 | −2.888 | 10.250 | 1.444  | 1.00 | 55.10 | C   |
| ATOM | 3596 | O   | LYS | H | 67 | −3.851 | 9.486  | 1.389  | 1.00 | 77.62 | O   |
| ATOM | 3597 | CB  | LYS | H | 67 | −1.702 | 8.564  | −0.003 | 1.00 | 69.05 | C   |
| ATOM | 3598 | CG  | LYS | H | 67 | −0.725 | 8.307  | −1.142 | 1.00 | 71.60 | C   |
| ATOM | 3599 | CD  | LYS | H | 67 | −0.860 | 6.891  | −1.705 | 1.00 | 82.41 | C   |
| ATOM | 3600 | CE  | LYS | H | 67 | 0.270  | 6.560  | −2.684 | 1.00 | 82.75 | C   |
| ATOM | 3601 | NZ  | LYS | H | 67 | 0.131  | 5.192  | −3.275 | 1.00 | 89.46 | N1+ |
| ATOM | 3602 | N   | GLY | H | 68 | −2.924 | 11.394 | 2.120  | 1.00 | 47.89 | N   |
| ATOM | 3603 | CA  | GLY | H | 68 | −4.173 | 11.751 | 2.777  | 1.00 | 49.12 | C   |
| ATOM | 3604 | C   | GLY | H | 68 | −4.608 | 10.729 | 3.808  | 1.00 | 48.08 | C   |
| ATOM | 3605 | O   | GLY | H | 68 | −5.791 | 10.386 | 3.891  | 1.00 | 52.32 | O   |
| ATOM | 3606 | N   | ARG | H | 69 | −3.654 | 10.200 | 4.559  | 1.00 | 47.10 | N   |
| ATOM | 3607 | CA  | ARG | H | 69 | −3.865 | 9.382  | 5.744  | 1.00 | 44.50 | C   |
| ATOM | 3608 | C   | ARG | H | 69 | −3.425 | 10.083 | 7.017  | 1.00 | 45.73 | C   |
| ATOM | 3609 | O   | ARG | H | 69 | −4.062 | 9.903  | 8.055  | 1.00 | 41.83 | O   |
| ATOM | 3610 | CB  | ARG | H | 69 | −3.095 | 8.053  | 5.621  | 1.00 | 40.22 | C   |
| ATOM | 3611 | CG  | ARG | H | 69 | −3.615 | 7.140  | 4.504  | 1.00 | 41.48 | C   |
| ATOM | 3612 | CD  | ARG | H | 69 | −2.919 | 5.783  | 4.463  | 1.00 | 42.36 | C   |
| ATOM | 3613 | NE  | ARG | H | 69 | −1.467 | 5.877  | 4.320  | 1.00 | 43.38 | N   |
| ATOM | 3614 | CZ  | ARG | H | 69 | −0.612 | 5.516  | 5.267  | 1.00 | 45.33 | C   |
| ATOM | 3615 | NH1 | ARG | H | 69 | −1.079 | 5.051  | 6.416  | 1.00 | 43.33 | N1+ |
| ATOM | 3616 | NH2 | ARG | H | 69 | 0.703  | 5.620  | 5.078  | 1.00 | 42.85 | N1+ |
| ATOM | 3617 | N   | PHE | H | 70 | −2.354 | 10.879 | 6.956  | 1.00 | 32.96 | N   |
| ATOM | 3618 | CA  | PHE | H | 70 | −1.836 | 11.619 | 8.092  | 1.00 | 35.23 | C   |
| ATOM | 3619 | C   | PHE | H | 70 | −2.201 | 13.092 | 7.940  | 1.00 | 40.62 | C   |
| ATOM | 3620 | O   | PHE | H | 70 | −2.296 | 13.616 | 6.828  | 1.00 | 38.58 | O   |
| ATOM | 3621 | CB  | PHE | H | 70 | −0.306 | 11.508 | 8.209  | 1.00 | 33.70 | C   |
| ATOM | 3622 | CG  | PHE | H | 70 | 0.223  | 10.103 | 8.473  | 1.00 | 38.21 | C   |
| ATOM | 3623 | CD1 | PHE | H | 70 | −0.619 | 9.002  | 8.553  | 1.00 | 38.81 | C   |
| ATOM | 3624 | CD2 | PHE | H | 70 | 1.580  | 9.902  | 8.638  | 1.00 | 35.91 | C   |
| ATOM | 3625 | CE1 | PHE | H | 70 | −0.108 | 7.719  | 8.793  | 1.00 | 44.16 | C   |
| ATOM | 3626 | CE2 | PHE | H | 70 | 2.092  | 8.629  | 8.883  | 1.00 | 39.85 | C   |
| ATOM | 3627 | CZ  | PHE | H | 70 | 1.247  | 7.535  | 8.942  | 1.00 | 38.84 | C   |
| ATOM | 3628 | N   | THR | H | 71 | −2.389 | 13.761 | 9.073  | 1.00 | 34.40 | N   |
| ATOM | 3629 | CA  | THR | H | 71 | −2.686 | 15.187 | 9.097  | 1.00 | 35.49 | C   |
| ATOM | 3630 | C   | THR | H | 71 | −1.747 | 15.824 | 10.102 | 1.00 | 35.40 | C   |
| ATOM | 3631 | O   | THR | H | 71 | −1.669 | 15.381 | 11.250 | 1.00 | 38.26 | O   |
| ATOM | 3632 | CB  | THR | H | 71 | −4.150 | 15.448 | 9.469  | 1.00 | 37.77 | C   |
| ATOM | 3633 | OG1 | THR | H | 71 | −4.986 | 14.758 | 8.540  | 1.00 | 40.62 | O   |
| ATOM | 3634 | CG2 | THR | H | 71 | −4.477 | 16.94  | 9.423  | 1.00 | 36.57 | C   |
| ATOM | 3635 | N   | ILE | H | 72 | −1.007 | 16.823 | 9.662  | 1.00 | 35.32 | N   |
| ATOM | 3636 | CA  | ILE | H | 72 | −0.128 | 17.594 | 10.524 | 1.00 | 34.72 | C   |
| ATOM | 3637 | C   | ILE | H | 72 | −0.876 | 18.858 | 10.898 | 1.00 | 36.07 | C   |
| ATOM | 3638 | O   | ILE | H | 72 | −1.477 | 19.496 | 10.031 | 1.00 | 38.33 | O   |
| ATOM | 3639 | CB  | ILE | H | 72 | 1.200  | 17.920 | 9.814  | 1.00 | 33.83 | C   |
| ATOM | 3640 | CG1 | ILE | H | 72 | 1.951  | 16.640 | 9.492  | 1.00 | 35.59 | C   |
| ATOM | 3641 | CG2 | ILE | H | 72 | 2.049  | 18.876 | 10.659 | 1.00 | 34.10 | C   |
| ATOM | 3642 | CD1 | ILE | H | 72 | 3.201  | 16.860 | 8.618  | 1.00 | 36.53 | C   |
| ATOM | 3643 | N   | SER | H | 73 | −0.852 | 19.214 | 12.181 | 1.00 | 34.67 | N   |
| ATOM | 3644 | CA  | SER | H | 73 | −1.457 | 20.445 | 12.654 | 1.00 | 34.74 | C   |
| ATOM | 3645 | C   | SER | H | 73 | −0.598 | 20.979 | 13.779 | 1.00 | 35.12 | C   |
| ATOM | 3646 | O   | SER | H | 73 | 0.344  | 20.324 | 14.243 | 1.00 | 38.24 | O   |
| ATOM | 3647 | CB  | SER | H | 73 | −2.922 | 20.231 | 13.118 | 1.00 | 38.15 | C   |
| ATOM | 3648 | OG  | SER | H | 73 | −3.000 | 19.194 | 14.079 | 1.00 | 36.25 | O   |
| ATOM | 3649 | N   | ARG | H | 74 | −0.903 | 22.202 | 14.199 | 1.00 | 35.50 | N   |
| ATOM | 3650 | CA  | ARG | H | 74 | −0.173 | 22.826 | 15.285 | 1.00 | 33.90 | C   |
| ATOM | 3651 | C   | ARG | H | 74 | −1.127 | 23.629 | 16.148 | 1.00 | 40.94 | C   |
| ATOM | 3652 | O   | ARG | H | 74 | −2.155 | 24.134 | 15.684 | 1.00 | 42.57 | O   |
| ATOM | 3653 | CB  | ARG | H | 74 | 0.932  | 23.757 | 14.777 | 1.00 | 36.78 | C   |
| ATOM | 3654 | CG  | ARG | H | 74 | 0.400  | 25.026 | 14.134 | 1.00 | 37.64 | C   |
| ATOM | 3655 | CD  | ARG | H | 74 | 1.480  | 26.081 | 14.229 | 1.00 | 47.56 | C   |
| ATOM | 3656 | NE  | ARG | H | 74 | 2.477  | 25.873 | 13.223 | 1.00 | 47.31 | N   |

TABLE 77-continued

| | | | | | | | | | | |
|---|---|---|---|---|---|---|---|---|---|---|
| ATOM | 3657 | CZ | ARG | H | 74 | 3.774 | 26.151 | 13.320 | 1.00 | 40.64 | C |
| ATOM | 3658 | NH1 | ARG | H | 74 | 4.345 | 26.659 | 14.415 | 1.00 | 37.83 | N1+ |
| ATOM | 3659 | NH2 | ARG | H | 74 | 4.511 | 25.890 | 12.271 | 1.00 | 38.90 | N1+ |
| ATOM | 3660 | N | ASP | H | 75 | −0.761 | 23.762 | 17.411 | 1.00 | 38.71 | N |
| ATOM | 3661 | CA | ASP | H | 75 | −1.495 | 24.596 | 18.352 | 1.00 | 39.90 | C |
| ATOM | 3662 | C | ASP | H | 75 | −0.454 | 25.542 | 18.933 | 1.00 | 39.36 | C |
| ATOM | 3663 | O | ASP | H | 75 | 0.316 | 25.166 | 19.825 | 1.00 | 43.34 | O |
| ATOM | 3664 | CB | ASP | H | 75 | −2.195 | 23.750 | 19.411 | 1.00 | 41.91 | C |
| ATOM | 3665 | CG | ASP | H | 75 | −2.934 | 24.584 | 20.438 | 1.00 | 46.66 | C |
| ATOM | 3666 | OD1 | ASP | H | 75 | −2.763 | 25.827 | 20.472 | 1.00 | 49.56 | O |
| ATOM | 3667 | OD2 | ASP | H | 75 | −3.679 | 23.981 | 21.227 | 1.00 | 49.80 | O1− |
| ATOM | 3668 | N | ASP | H | 76 | −0.432 | 26.766 | 18.407 | 1.00 | 35.80 | N |
| ATOM | 3669 | CA | ASP | H | 76 | 0.574 | 27.737 | 18.811 | 1.00 | 39.95 | C |
| ATOM | 3670 | C | ASP | H | 76 | 0.395 | 28.180 | 20.257 | 1.00 | 43.24 | C |
| ATOM | 3671 | O | ASP | H | 76 | 1.379 | 28.523 | 20.927 | 1.00 | 48.52 | O |
| ATOM | 3672 | CB | ASP | H | 76 | 0.533 | 28.931 | 17.864 | 1.00 | 47.61 | C |
| ATOM | 3673 | CG | ASP | H | 76 | 1.184 | 28.627 | 16.528 | 1.00 | 48.23 | C |
| ATOM | 3674 | OD1 | ASP | H | 76 | 1.994 | 27.683 | 16.488 | 1.00 | 44.94 | O |
| ATOM | 3675 | OD2 | ASP | H | 76 | 0.901 | 29.317 | 15.529 | 1.00 | 47.38 | O1− |
| ATOM | 3676 | N | SER | H | 77 | −0.835 | 28.156 | 20.763 | 1.00 | 43.63 | N |
| ATOM | 3677 | CA | SER | H | 77 | −1.066 | 28.548 | 22.144 | 1.00 | 49.73 | C |
| ATOM | 3678 | C | SER | H | 77 | −0.465 | 27.554 | 23.124 | 1.00 | 50.31 | C |
| ATOM | 3679 | O | SER | H | 77 | −0.240 | 27.913 | 24.282 | 1.00 | 52.42 | O |
| ATOM | 3680 | CB | SER | H | 77 | −2.567 | 28.694 | 22.403 | 1.00 | 46.94 | C |
| ATOM | 3681 | OG | SER | H | 77 | −3.169 | 27.412 | 22.455 | 1.00 | 56.37 | O |
| ATOM | 3682 | N | LYS | H | 78 | −0.198 | 26.318 | 22.687 | 1.00 | 47.54 | N |
| ATOM | 3683 | CA | LYS | H | 78 | 0.387 | 25.293 | 23.545 | 1.00 | 43.63 | C |
| ATOM | 3684 | C | LYS | H | 78 | 1.750 | 24.811 | 23.055 | 1.00 | 45.37 | C |
| ATOM | 3685 | O | LYS | H | 78 | 2.258 | 23.812 | 23.573 | 1.00 | 45.59 | O |
| ATOM | 3686 | CB | LYS | H | 78 | −0.567 | 24.103 | 23.670 | 1.00 | 50.14 | C |
| ATOM | 3687 | CG | LYS | H | 78 | −1.978 | 24.488 | 24.084 | 1.00 | 54.76 | C |
| ATOM | 3688 | CD | LYS | H | 78 | −2.898 | 23.283 | 24.060 | 1.00 | 61.44 | C |
| ATOM | 3689 | CE | LYS | H | 78 | −4.321 | 23.671 | 24.421 | 1.00 | 63.98 | C |
| ATOM | 3690 | NZ | LYS | H | 78 | −5.042 | 24.384 | 23.319 | 1.00 | 60.27 | N1+ |
| ATOM | 3691 | N | ASN | H | 79 | 2.341 | 25.475 | 22.061 | 1.00 | 43.08 | N |
| ATOM | 3692 | CA | ASN | H | 79 | 3.679 | 25.139 | 21.567 | 1.00 | 40.79 | C |
| ATOM | 3693 | C | ASN | H | 79 | 3.770 | 23.680 | 21.147 | 1.00 | 38.39 | C |
| ATOM | 3694 | O | ASN | H | 79 | 4.795 | 23.026 | 21.349 | 1.00 | 39.80 | O |
| ATOM | 3695 | CB | ASN | H | 79 | 4.758 | 25.450 | 22.612 | 1.00 | 41.49 | C |
| ATOM | 3696 | CG | ASN | H | 79 | 4.829 | 26.930 | 22.955 | 1.00 | 47.08 | C |
| ATOM | 3697 | OD1 | ASN | H | 79 | 4.383 | 27.782 | 22.190 | 1.00 | 48.54 | O |
| ATOM | 3698 | ND2 | ASN | H | 79 | 5.396 | 27.238 | 24.110 | 1.00 | 48.25 | N |
| ATOM | 3699 | N | THR | H | 80 | 2.689 | 23.151 | 20.571 | 1.00 | 36.78 | N |
| ATOM | 3700 | CA | THR | H | 80 | 2.631 | 21.737 | 20.246 | 1.00 | 41.13 | C |
| ATOM | 3701 | C | THR | H | 80 | 2.359 | 21.506 | 18.763 | 1.00 | 40.07 | C |
| ATOM | 3702 | O | THR | H | 80 | 1.530 | 22.177 | 18.139 | 1.00 | 38.21 | O |
| ATOM | 3703 | CB | THR | H | 80 | 1.584 | 21.016 | 21.117 | 1.00 | 42.94 | C |
| ATOM | 3704 | OG1 | THR | H | 80 | 1.899 | 21.259 | 22.493 | 1.00 | 45.91 | O |
| ATOM | 3705 | CG2 | THR | H | 80 | 1.623 | 19.503 | 20.877 | 1.00 | 38.73 | C |
| ATOM | 3706 | N | LEU | H | 81 | 3.085 | 20.538 | 18.227 | 1.00 | 42.20 | N |
| ATOM | 3707 | CA | LEU | H | 81 | 2.970 | 20.034 | 16.871 | 1.00 | 38.49 | C |
| ATOM | 3708 | C | LEU | H | 81 | 2.285 | 18.680 | 16.942 | 1.00 | 40.06 | C |
| ATOM | 3709 | O | LEU | H | 81 | 2.615 | 17.866 | 17.811 | 1.00 | 37.61 | O |
| ATOM | 3710 | CB | LEU | H | 81 | 4.372 | 19.872 | 16.278 | 1.00 | 41.19 | C |
| ATOM | 3711 | CG | LEU | H | 81 | 4.808 | 19.720 | 14.822 | 1.00 | 45.24 | C |
| ATOM | 3712 | CD1 | LEU | H | 81 | 5.835 | 18.575 | 14.637 | 1.00 | 34.62 | C |
| ATOM | 3713 | CD2 | LEU | H | 81 | 3.705 | 19.673 | 13.817 | 1.00 | 37.13 | C |
| ATOM | 3714 | N | PHE | H | 82 | 1.366 | 18.416 | 16.021 | 1.00 | 35.74 | N |
| ATOM | 3715 | CA | PHE | H | 82 | 0.643 | 17.155 | 16.030 | 1.00 | 36.28 | C |
| ATOM | 3716 | C | PHE | H | 82 | 0.854 | 16.402 | 14.732 | 1.00 | 38.11 | C |
| ATOM | 3717 | O | PHE | H | 82 | 1.059 | 16.991 | 13.672 | 1.00 | 41.03 | O |
| ATOM | 3718 | CB | PHE | H | 82 | −0.858 | 17.355 | 16.247 | 1.00 | 41.05 | C |
| ATOM | 3719 | CG | PHE | H | 82 | −1.187 | 17.951 | 17.573 | 1.00 | 41.72 | C |
| ATOM | 3720 | CD1 | PHE | H | 82 | −1.217 | 17.155 | 18.713 | 1.00 | 39.90 | C |
| ATOM | 3721 | CD2 | PHE | H | 82 | −1.428 | 19.306 | 17.686 | 1.00 | 37.08 | C |
| ATOM | 3722 | CE1 | PHE | H | 82 | −1.497 | 17.704 | 19.945 | 1.00 | 43.44 | C |
| ATOM | 3723 | CE2 | PHE | H | 82 | −1.716 | 19.871 | 18.917 | 1.00 | 43.53 | C |
| ATOM | 3724 | CZ | PHE | H | 82 | −1.750 | 19.068 | 20.053 | 1.00 | 44.58 | C |
| ATOM | 3725 | N | LEU | H | 83 | 0.792 | 15.086 | 14.837 | 1.00 | 33.64 | N |
| ATOM | 3726 | CA | LEU | H | 83 | 0.726 | 14.202 | 13.684 | 1.00 | 33.38 | C |
| ATOM | 3727 | C | LEU | H | 83 | −0.434 | 13.254 | 13.968 | 1.00 | 39.38 | C |
| ATOM | 3728 | O | LEU | H | 83 | −0.318 | 12.362 | 14.815 | 1.00 | 35.35 | O |
| ATOM | 3729 | CB | LEU | H | 83 | 2.033 | 13.450 | 13.489 | 1.00 | 35.79 | C |
| ATOM | 3730 | CG | LEU | H | 83 | 2.024 | 12.499 | 12.292 | 1.00 | 39.06 | C |
| ATOM | 3731 | CD1 | LEU | H | 83 | 1.724 | 13.274 | 11.012 | 1.00 | 34.80 | C |
| ATOM | 3732 | CD2 | LEU | H | 83 | 3.358 | 11.813 | 12.204 | 1.00 | 39.07 | C |
| ATOM | 3733 | N | GLN | H | 84 | −1.555 | 13.467 | 13.290 | 1.00 | 35.09 | N |
| ATOM | 3734 | CA | GLN | H | 84 | −2.685 | 12.557 | 13.365 | 1.00 | 39.35 | C |
| ATOM | 3735 | C | GLN | H | 84 | −2.492 | 11.498 | 12.295 | 1.00 | 41.08 | C |
| ATOM | 3736 | O | GLN | H | 84 | −2.493 | 11.811 | 11.101 | 1.00 | 41.22 | O |

TABLE 77-continued

| | | | | | | | | | | |
|---|---|---|---|---|---|---|---|---|---|---|
| ATOM | 3737 | CB | GLN | H | 84 | −4.009 | 13.298 | 13.165 | 1.00 | 39.36 | C |
| ATOM | 3738 | CG | GLN | H | 84 | −5.226 | 12.389 | 13.199 | 1.00 | 43.21 | C |
| ATOM | 3739 | CD | GLN | H | 84 | −5.411 | 11.737 | 14.555 | 1.00 | 45.46 | C |
| ATOM | 3740 | OE1 | GLN | H | 84 | −5.169 | 12.356 | 15.591 | 1.00 | 41.68 | O |
| ATOM | 3741 | NE2 | GLN | H | 84 | −5.823 | 10.479 | 14.553 | 1.00 | 40.93 | N |
| ATOM | 3742 | N | MET | H | 85 | −2.297 | 10.255 | 12.714 | 1.00 | 36.05 | N |
| ATOM | 3743 | CA | MET | H | 85 | −2.076 | 9.152 | 11.792 | 1.00 | 36.91 | C |
| ATOM | 3744 | C | MET | H | 85 | −3.354 | 8.322 | 11.719 | 1.00 | 43.63 | C |
| ATOM | 3745 | O | MET | H | 85 | −3.753 | 7.708 | 12.710 | 1.00 | 43.19 | O |
| ATOM | 3746 | CB | MFT | H | 85 | −0.898 | 8.308 | 12.258 | 1.00 | 40.50 | C |
| ATOM | 3747 | CG | MET | H | 85 | 0.313 | 9.127 | 12.691 | 1.00 | 39.13 | C |
| ATOM | 3748 | SD | MET | H | 85 | 1.567 | 8.086 | 13.492 | 1.00 | 47.42 | S |
| ATOM | 3749 | CE | MET | H | 85 | 2.157 | 7.124 | 12.128 | 1.00 | 42.48 | C |
| ATOM | 3750 | N | ASN | H | 86 | −3.996 | 8.305 | 10.557 | 1.00 | 39.74 | N |
| ATOM | 3751 | CA | ASN | H | 86 | −5.156 | 7.450 | 10.323 | 1.00 | 46.20 | C |
| ATOM | 3752 | C | ASN | H | 86 | −4.805 | 6.368 | 9.312 | 1.00 | 46.63 | C |
| ATOM | 3753 | O | ASN | H | 86 | −3.768 | 6.431 | 8.641 | 1.00 | 44.06 | O |
| ATOM | 3754 | CB | ASN | H | 86 | −6.351 | 8.274 | 9.833 | 1.00 | 40.43 | C |
| ATOM | 3755 | CG | ASN | H | 86 | −6.770 | 9.307 | 10.839 | 1.00 | 49.51 | C |
| ATOM | 3756 | OD1 | ASN | H | 86 | −6.746 | 9.054 | 12.047 | 1.00 | 50.31 | O |
| ATOM | 3757 | ND2 | ASN | H | 86 | −7.145 | 10.486 | 10.30 | 1.00 | 52.82 | N |
| ATOM | 3758 | N | SER | H | 87 | −5.684 | 5.364 | 9.223 | 1.00 | 42.97 | N |
| ATOM | 3759 | CA | SER | H | 87 | −5.531 | 4.244 | 8.286 | 1.00 | 46.21 | C |
| ATOM | 3760 | C | SER | H | 87 | −4.112 | 3.687 | 8.315 | 1.00 | 45.28 | C |
| ATOM | 3761 | O | SER | H | 87 | −3.485 | 3.465 | 7.278 | 1.00 | 43.56 | O |
| ATOM | 3762 | CB | SER | H | 87 | −5.913 | 4.652 | 6.861 | 1.00 | 47.20 | C |
| ATOM | 3763 | OG | SER | H | 87 | −7.251 | 5.100 | 6.797 | 1.00 | 46.16 | O |
| ATOM | 3764 | N | LEU | H | 88 | −3.600 | 3.476 | 9.526 | 1.00 | 43.28 | N |
| ATOM | 3765 | CA | LEU | H | 88 | −2.226 | 3.019 | 9.690 | 1.00 | 40.98 | C |
| ATOM | 3766 | C | LEU | H | 88 | −1.951 | 1.747 | 8.890 | 1.00 | 45.06 | C |
| ATOM | 3767 | O | LEU | H | 88 | −2.799 | 0.849 | 8.777 | 1.00 | 45.45 | O |
| ATOM | 3768 | CB | LEU | H | 88 | −1.937 | 2.808 | 11.175 | 1.00 | 42.16 | C |
| ATOM | 3769 | CG | LEU | H | 88 | −1.700 | 4.160 | 11.859 | 1.00 | 44.18 | C |
| ATOM | 3770 | CD1 | LEU | H | 88 | −1.561 | 4.051 | 13.366 | 1.00 | 42.73 | C |
| ATOM | 3771 | CD2 | LEU | H | 88 | −0.456 | 4.792 | 11.251 | 1.00 | 41.81 | C |
| ATOM | 3772 | N | LYS | H | 89 | −0.764 | 1.696 | 8.305 | 1.00 | 43.33 | N |
| ATOM | 3773 | CA | LYS | H | 89 | −0.283 | 0.531 | 7.586 | 1.00 | 46.92 | C |
| ATOM | 3774 | C | LYS | H | 89 | 0.908 | −0.050 | 8.333 | 1.00 | 43.51 | C |
| ATOM | 3775 | O | LYS | H | 89 | 1.582 | 0.647 | 9.098 | 1.00 | 42.73 | O |
| ATOM | 3776 | CB | LYS | H | 89 | 0.117 | 0.888 | 6.151 | 1.00 | 46.48 | C |
| ATOM | 3777 | CG | LYS | H | 89 | −1.032 | 1.304 | 5.251 | 1.00 | 42.36 | C |
| ATOM | 3778 | CD | LYS | H | 89 | −0.470 | 1.718 | 3.903 | 1.00 | 52.27 | C |
| ATOM | 3779 | CE | LYS | H | 89 | −1.559 | 2.053 | 2.907 | 1.00 | 58.00 | C |
| ATOM | 3780 | NZ | LYS | H | 89 | −0.961 | 2.646 | 1.679 | 1.00 | 62.54 | N1+ |
| ATOM | 3781 | N | THR | H | 90 | 1.152 | −1.343 | 8.116 | 1.00 | 43.69 | N |
| ATOM | 3782 | CA | THR | H | 90 | 2.315 | −1.988 | 8.714 | 1.00 | 49.08 | C |
| ATOM | 3783 | C | THR | H | 90 | 3.597 | −1.231 | 8.369 | 1.00 | 46.67 | C |
| ATOM | 3784 | O | THR | H | 90 | 4.496 | −1.085 | 9.211 | 1.00 | 43.36 | O |
| ATOM | 3785 | CB | THR | H | 90 | 2.384 | −3.444 | 8.242 | 1.00 | 51.02 | C |
| ATOM | 3786 | OG1 | THR | H | 90 | 1.278 | −4.167 | 8.807 | 1.00 | 55.52 | O |
| ATOM | 3787 | CG2 | THR | H | 90 | 3.676 | −4.089 | 8.696 | 1.00 | 54.98 | C |
| ATOM | 3788 | N | GLU | H | 91 | 3.672 | −0.716 | 7.137 | 1.00 | 41.23 | N |
| ATOM | 3789 | CA | GLU | H | 91 | 4.788 | 0.066 | 6.613 | 1.00 | 48.75 | C |
| ATOM | 3790 | C | GLU | H | 91 | 5.008 | 1.380 | 7.349 | 1.00 | 44.53 | C |
| ATOM | 3791 | O | GLU | H | 91 | 6.064 | 1.985 | 7.169 | 1.00 | 44.38 | O |
| ATOM | 3792 | CB | GLU | H | 91 | 4.569 | 0.378 | 5.128 | 1.00 | 47.88 | C |
| ATOM | 3793 | CG | GLU | H | 91 | 4.548 | −0.860 | 4.237 | 1.00 | 61.84 | C |
| ATOM | 3794 | CD | GLU | H | 91 | 3.153 | −1.438 | 4.030 | 1.00 | 66.32 | C |
| ATOM | 3795 | OE1 | GLU | H | 91 | 2.356 | −1.460 | 4.997 | 1.00 | 58.73 | O |
| ATOM | 3796 | OE2 | GLU | H | 91 | 2.858 | −1.871 | 2.892 | 1.00 | 75.20 | O1− |
| ATOM | 3797 | N | ASP | H | 92 | 4.046 | 1.838 | 8.144 | 1.00 | 40.04 | N |
| ATOM | 3798 | CA | ASP | H | 92 | 4.205 | 3.052 | 8.931 | 1.00 | 41.35 | C |
| ATOM | 3799 | C | ASP | H | 92 | 4.964 | 2.813 | 10.218 | 1.00 | 41.29 | C |
| ATOM | 3800 | O | ASP | H | 92 | 5.207 | 3.770 | 10.964 | 1.00 | 39.33 | O |
| ATOM | 3801 | CB | ASP | H | 92 | 2.843 | 3.659 | 9.278 | 1.00 | 35.87 | C |
| ATOM | 3802 | CG | ASP | H | 92 | 2.084 | 4.113 | 8.067 | 1.00 | 41.81 | C |
| ATOM | 3803 | OD1 | ASP | H | 92 | 2.723 | 4.644 | 7.134 | 1.00 | 46.36 | O |
| ATOM | 3804 | OD2 | ASP | H | 92 | 0.843 | 3.964 | 8.055 | 1.00 | 39.62 | O1− |
| ATOM | 3805 | N | THR | H | 93 | 5.326 | 1.563 | 10.508 | 1.00 | 40.74 | N |
| ATOM | 3806 | CA | THR | H | 93 | 6.119 | 1.286 | 11.697 | 1.00 | 37.28 | C |
| ATOM | 3807 | C | THR | H | 93 | 7.474 | 1.968 | 11.593 | 1.00 | 36.76 | C |
| ATOM | 3808 | O | THR | H | 93 | 8.215 | 1.760 | 10.626 | 1.00 | 41.77 | O |
| ATOM | 3809 | CB | THR | H | 93 | 6.302 | −0.227 | 11.881 | 1.00 | 42.2.4 | C |
| ATOM | 3810 | OG1 | THR | H | 93 | 5.018 | −0.843 | 12.085 | 1.00 | 43.00 | O |
| ATOM | 3811 | CG2 | THR | H | 93 | 7.202 | −0.495 | 13.074 | 1.00 | 38.08 | C |
| ATOM | 3812 | N | ALA | H | 94 | 7.816 | 2.745 | 12.617 | 1.00 | 35.83 | N |
| ATOM | 3813 | CA | ALA | H | 94 | 8.983 | 3.614 | 12.578 | 1.00 | 36.03 | C |
| ATOM | 3814 | C | ALA | H | 94 | 9.065 | 4.382 | 13.888 | 1.00 | 38.38 | C |
| ATOM | 3815 | O | ALA | H | 94 | 8.073 | 4.521 | 14.611 | 1.00 | 39.01 | O |
| ATOM | 3816 | CB | ALA | H | 94 | 8.899 | 4.610 | 11.408 | 1.00 | 37.28 | C |

TABLE 77-continued

| ATOM | 3817 | N   | VAL | H | 95  | 10.261 | 4.872  | 14.185 | 1.00 | 33.25 | N |
|------|------|-----|-----|---|-----|--------|--------|--------|------|-------|---|
| ATOM | 3818 | CA  | VAL | H | 95  | 10.421 | 5.961  | 15.136 | 1.00 | 37.66 | C |
| ATOM | 3819 | C   | VAL | H | 95  | 10.063 | 7.250  | 14.411 | 1.00 | 40.84 | C |
| ATOM | 3820 | O   | VAL | H | 95  | 10.509 | 7.474  | 13.279 | 1.00 | 37.19 | O |
| ATOM | 3821 | CB  | VAL | H | 95  | 11.861 | 6.018  | 15.674 | 1.00 | 39.44 | C |
| ATOM | 3822 | CG1 | VAL | H | 95  | 11.986 | 7.136  | 16.691 | 1.00 | 39.48 | C |
| ATOM | 3823 | CG2 | VAL | H | 95  | 12.256 | 4.688  | 16.294 | 1.00 | 40.91 | C |
| ATOM | 3824 | N   | TYR | H | 96  | 9.248  | 8.088  | 15.044 | 1.00 | 38.18 | N |
| ATOM | 3825 | CA  | TYR | H | 96  | 8.812  | 9.355  | 14.461 | 1.00 | 38.85 | C |
| ATOM | 3826 | C   | TYR | H | 96  | 9.480  | 10.499 | 15.210 | 1.00 | 38.18 | C |
| ATOM | 3827 | O   | TYR | H | 96  | 9.364  | 10.593 | 16.434 | 1.00 | 37.71 | O |
| ATOM | 3828 | CB  | TYR | H | 96  | 7.289  | 9.479  | 14.496 | 1.00 | 35.37 | C |
| ATOM | 3829 | CG  | TYR | H | 96  | 6.636  | 8.656  | 13.410 | 1.00 | 37.71 | C |
| ATOM | 3830 | CD1 | TYR | H | 96  | 6.587  | 7.264  | 13.499 | 1.00 | 37.47 | C |
| ATOM | 3831 | CD2 | TYR | H | 96  | 6.078  | 9.262  | 12.294 | 1.00 | 35.19 | C |
| ATOM | 3832 | CE1 | TYR | H | 96  | 6.016  | 6.504  | 12.498 | 1.00 | 34.13 | C |
| ATOM | 3833 | CE2 | TYR | H | 96  | 5.494  | 8.514  | 11.296 | 1.00 | 34.88 | C |
| ATOM | 3834 | CZ  | TYR | H | 96  | 5.473  | 7.132  | 11.401 | 1.00 | 38.87 | C |
| ATOM | 3835 | OH  | TYR | H | 96  | 4.889  | 6.394  | 10.407 | 1.00 | 36.98 | O |
| ATOM | 3836 | N   | TYR | H | 97  | 10.214 | 11.337 | 14.483 | 1.00 | 34.89 | N |
| ATOM | 3837 | CA  | TYR | H | 97  | 10.891 | 12.487 | 15.065 | 1.00 | 36.58 | C |
| ATOM | 3838 | C   | TYR | H | 97  | 10.202 | 13.778 | 14.654 | 1.00 | 40.98 | C |
| ATOM | 3839 | O   | TYR | H | 97  | 9.804  | 13.949 | 13.494 | 1.00 | 37.06 | O |
| ATOM | 3840 | CB  | TYR | H | 97  | 12.362 | 12.597 | 14.638 | 1.00 | 35.36 | C |
| ATOM | 3841 | CG  | TYR | H | 97  | 13.236 | 11.413 | 14.982 | 1.00 | 41.75 | C |
| ATOM | 3842 | CD1 | TYR | H | 97  | 13.808 | 11.285 | 16.247 | 1.00 | 37.64 | C |
| ATOM | 3843 | CD2 | TYR | H | 97  | 13.509 | 10.432 | 14.029 | 1.00 | 40.85 | C |
| ATOM | 3844 | CE1 | TYR | H | 97  | 14.616 | 10.219 | 16.555 | 1.00 | 39.41 | C |
| ATOM | 3845 | CE2 | TYR | H | 97  | 14.325 | 9.360  | 14.332 | 1.00 | 40.30 | C |
| ATOM | 3846 | CZ  | TYR | H | 97  | 14.863 | 9.257  | 15.590 | 1.00 | 40.20 | C |
| ATOM | 3847 | OH  | TYR | H | 97  | 15.658 | 8.181  | 15.879 | 1.00 | 51.72 | O |
| ATOM | 3848 | N   | CYS | H | 98  | 10.112 | 14.678 | 15.624 | 1.00 | 34.33 | N |
| ATOM | 3849 | CA  | CYS | H | 98  | 9.803  | 16.079 | 15.450 | 1.00 | 39.00 | C |
| ATOM | 3850 | C   | CYS | H | 98  | 11.115 | 16.803 | 15.158 | 1.00 | 36.52 | C |
| ATOM | 3851 | O   | CYS | H | 98  | 12.129 | 16.497 | 15.781 | 1.00 | 37.18 | O |
| ATOM | 3852 | CB  | CYS | H | 98  | 9.180  | 16.584 | 16.769 | 1.00 | 32.06 | C |
| ATOM | 3853 | SG  | CYS | H | 98  | 8.566  | 18.216 | 16.755 | 0.43 | 47.24 | S |
| ATOM | 3854 | N   | THR | H | 99  | 11.115 | 17.751 | 14.206 | 1.00 | 35.18 | N |
| ATOM | 3855 | CA  | THR | H | 99  | 12.345 | 18.513 | 13.986 | 1.00 | 33.16 | C |
| ATOM | 3856 | C   | THR | H | 99  | 12.037 | 19.922 | 13.500 | 1.00 | 38.42 | C |
| ATOM | 3857 | O   | THR | H | 99  | 11.040 | 20.157 | 12.812 | 1.00 | 38.48 | C |
| ATOM | 3858 | CB  | THR | H | 99  | 13.310 | 17.814 | 13.002 | 1.00 | 39.18 | C |
| ATOM | 3859 | OG1 | THR | H | 99  | 14.518 | 18.585 | 12.870 | 1.00 | 44.07 | O |
| ATOM | 3860 | CG2 | THR | H | 99  | 12.694 | 17.633 | 11.641 | 1.00 | 39.45 | C |
| ATOM | 3861 | N   | THR | H | 100 | 12.914 | 20.854 | 13.876 | 1.00 | 37.01 | N |
| ATOM | 3862 | CA  | THR | H | 100 | 12.790 | 22.259 | 13.511 | 1.00 | 34.45 | C |
| ATOM | 3863 | C   | THR | H | 100 | 14.171 | 22.890 | 13.580 | 1.00 | 34.99 | C |
| ATOM | 3864 | O   | THR | H | 100 | 15.063 | 22.362 | 14.250 | 1.00 | 36.21 | O |
| ATOM | 3865 | CB  | THR | H | 100 | 11.806 | 22.994 | 14.446 | 1.00 | 39.19 | C |
| ATOM | 3866 | OG1 | THR | H | 100 | 11.386 | 24.220 | 13.845 | 1.00 | 38.25 | O |
| ATOM | 3867 | CG2 | THR | H | 100 | 12.459 | 23.312 | 15.789 | 1.00 | 34.48 | C |
| ATOM | 3868 | N   | PRO | H | 101 | 14.395 | 23.992 | 12.868 | 1.00 | 38.76 | N |
| ATOM | 3869 | CA  | PRO | H | 101 | 15.643 | 24.737 | 13.054 | 1.00 | 34.30 | C |
| ATOM | 3870 | C   | PRO | H | 101 | 15.688 | 25.393 | 14.422 | 1.00 | 37.14 | C |
| ATOM | 3871 | O   | PRO | H | 101 | 14.667 | 25.810 | 14.974 | 1.00 | 34.54 | O |
| ATOM | 3872 | CB  | PRO | H | 101 | 15.605 | 25.797 | 11.937 | 1.00 | 36.07 | C |
| ATOM | 3873 | CG  | PRO | H | 101 | 14.707 | 25.196 | 10.884 | 1.00 | 35.86 | C |
| ATOM | 3874 | CD  | PRO | H | 101 | 13.643 | 24.466 | 11.690 | 1.00 | 33.68 | C |
| ATOM | 3875 | N   | SER | H | 102 | 16.902 | 25.485 | 14.965 | 1.00 | 37.28 | N |
| ATOM | 3876 | CA  | SER | H | 102 | 17.123 | 26.184 | 16.229 | 1.00 | 37.98 | C |
| ATOM | 3877 | C   | SER | H | 102 | 16.849 | 27.679 | 16.120 | 1.00 | 45.49 | C |
| ATOM | 3878 | O   | SER | H | 102 | 16.581 | 28.328 | 17.138 | 1.00 | 43.52 | O |
| ATOM | 3879 | CB  | SER | H | 102 | 18.562 | 25.963 | 16.696 | 1.00 | 40.27 | C |
| ATOM | 3880 | OG  | SER | H | 102 | 19.455 | 26.273 | 15.634 | 1.00 | 41.14 | O |
| ATOM | 3881 | N   | TYR | H | 103 | 16.916 | 28.241 | 14.918 | 1.00 | 42.70 | N |
| ATOM | 3882 | CA  | TYR | H | 103 | 16.593 | 29.642 | 14.685 | 1.00 | 41.23 | C |
| ATOM | 3883 | C   | TYR | H | 103 | 15.491 | 29.708 | 13.638 | 1.00 | 40.52 | C |
| ATOM | 3884 | O   | TYR | H | 103 | 15.661 | 29.188 | 12.531 | 1.00 | 35.95 | O |
| ATOM | 3885 | CB  | TYR | H | 103 | 17.832 | 30.410 | 14.222 | 1.00 | 39.65 | C |
| ATOM | 3886 | CG  | TYR | H | 103 | 17.649 | 31.909 | 14.236 | 1.00 | 48.70 | C |
| ATOM | 3887 | CD1 | TYR | H | 103 | 17.590 | 32.605 | 15.436 | 1.00 | 55.84 | C |
| ATOM | 3888 | CD2 | TYR | H | 103 | 17.526 | 32.631 | 13.049 | 1.00 | 49.96 | C |
| ATOM | 3889 | CE1 | TYR | H | 103 | 17.424 | 33.984 | 15.459 | 1.00 | 56.67 | C |
| ATOM | 3890 | CE2 | TYR | H | 103 | 17.367 | 34.015 | 13.059 | 1.00 | 47.87 | C |
| ATOM | 3891 | CZ  | TYR | H | 103 | 17.317 | 34.683 | 14.269 | 1.00 | 56.59 | C |
| ATOM | 3892 | OH  | TYR | H | 103 | 17.156 | 36.053 | 14.300 | 1.00 | 58.54 | O |
| ATOM | 3893 | N   | SER | H | 104 | 14.359 | 30.331 | 13.989 | 1.00 | 34.99 | N |
| ATOM | 3894 | CA  | SER | H | 104 | 13.174 | 30.307 | 13.131 | 1.00 | 38.14 | C |
| ATOM | 3895 | C   | SER | H | 104 | 13.196 | 31.357 | 12.020 | 1.00 | 37.78 | C |
| ATOM | 3896 | O   | SER | H | 104 | 12.156 | 31.937 | 11.715 | 1.00 | 47.15 | O |

TABLE 77-continued

| ATOM | 3897 | CB | SER | H | 104 | 11.919 | 30.471 | 13.992 | 1.00 | 41.26 | C |
|---|---|---|---|---|---|---|---|---|---|---|---|
| ATOM | 3898 | OG | SER | H | 104 | 11.869 | 29.529 | 15.048 | 1.00 | 38.46 | O |
| ATOM | 3899 | N | GLY | H | 105 | 14.337 | 31.613 | 11.383 | 1.00 | 39.85 | N |
| ATOM | 3900 | CA | GLY | H | 105 | 14.422 | 32.571 | 10.299 | 1.00 | 33.87 | C |
| ATOM | 3901 | C | GLY | H | 105 | 14.401 | 31.905 | 8.928 | 1.00 | 30.70 | C |
| ATOM | 3902 | O | GLY | H | 105 | 14.583 | 30.699 | 8.800 | 1.00 | 32.19 | O |
| ATOM | 3903 | N | SER | H | 106 | 14.166 | 32.725 | 7.892 | 1.00 | 31.01 | N |
| ATOM | 3904 | CA | SER | H | 106 | 13.921 | 32.161 | 6.565 | 1.00 | 28.27 | C |
| ATOM | 3905 | C | SER | H | 106 | 15.167 | 31.535 | 5.969 | 1.00 | 29.11 | C |
| ATOM | 3906 | O | SER | H | 106 | 15.065 | 30.646 | 5.118 | 1.00 | 32.65 | O |
| ATOM | 3907 | CB | SER | H | 106 | 13.384 | 33.227 | 5.611 | 1.00 | 31.61 | C |
| ATOM | 3908 | OG | SER | H | 106 | 14.340 | 34.250 | 5.425 | 1.00 | 31.71 | O |
| ATOM | 3909 | N | TYR | H | 107 | 16.350 | 32.004 | 6.355 | 1.00 | 31.94 | N |
| ATOM | 3910 | CA | TYR | H | 107 | 17.538 | 31.303 | 5.904 | 1.00 | 34.94 | C |
| ATOM | 3911 | C | TYR | H | 107 | 17.512 | 29.863 | 6.401 | 1.00 | 32.34 | C |
| ATOM | 3912 | O | TYR | H | 107 | 17.725 | 28.926 | 5.627 | 1.00 | 32.06 | O |
| ATOM | 3913 | CB | TYR | H | 107 | 18.813 | 32.029 | 6.351 | 1.00 | 33.36 | C |
| ATOM | 3914 | CG | TYR | H | 107 | 20.038 | 31.426 | 5.713 | 1.00 | 36.52 | C |
| ATOM | 3915 | CD1 | TYR | H | 107 | 20.669 | 30.328 | 6.285 | 1.00 | 38.10 | C |
| ATOM | 3916 | CD2 | TYR | H | 107 | 20.535 | 31.917 | 4.514 | 1.00 | 38.47 | C |
| ATOM | 3917 | CE1 | TYR | H | 107 | 21.771 | 29.747 | 5.704 | 1.00 | 39.78 | C |
| ATOM | 3918 | CE2 | TYR | H | 107 | 21.665 | 31.339 | 3.917 | 1.00 | 43.26 | C |
| ATOM | 3919 | CZ | TYR | H | 107 | 22.267 | 30.252 | 4.526 | 1.00 | 43.82 | C |
| ATOM | 3920 | OH | TYR | H | 107 | 23.366 | 29.662 | 3.965 | 1.00 | 49.72 | O |
| ATOM | 3921 | N | TYR | H | 108 | 17.198 | 29.664 | 7.686 | 1.00 | 33.55 | N |
| ATOM | 3922 | CA | TYR | H | 108 | 17.168 | 28.306 | 8.231 | 1.00 | 33.99 | C |
| ATOM | 3923 | C | TYR | H | 108 | 15.996 | 27.516 | 7.692 | 1.00 | 35.69 | C |
| ATOM | 3924 | O | TYR | H | 108 | 16.099 | 26.297 | 7.521 | 1.00 | 33.92 | O |
| ATOM | 3925 | CB | TYR | H | 108 | 17.141 | 28.347 | 9.765 | 1.00 | 33.08 | C |
| ATOM | 3926 | CG | TYR | H | 108 | 18.443 | 28.897 | 10.277 | 1.00 | 36.29 | C |
| ATOM | 3927 | CD1 | TYR | H | 108 | 18.658 | 30.263 | 10.330 | 1.00 | 42.87 | C |
| ATOM | 3928 | CD2 | TYR | H | 108 | 19.486 | 28.060 | 10.639 | 1.00 | 50.01 | C |
| ATOM | 3929 | CE1 | TYR | H | 108 | 19.841 | 30.776 | 10.764 | 1.00 | 45.90 | C |
| ATOM | 3930 | CE2 | TYR | H | 108 | 20.691 | 28.574 | 11.076 | 1.00 | 48.64 | C |
| ATOM | 3931 | CZ | TYR | H | 108 | 20.856 | 29.932 | 11.128 | 1.00 | 52.45 | C |
| ATOM | 3932 | OH | TYR | H | 108 | 22.035 | 30.475 | 11.559 | 1.00 | 62.22 | O |
| ATOM | 3933 | N | ASN | H | 109 | 14.892 | 28.190 | 7.375 | 1.00 | 31.06 | N |
| ATOM | 3934 | CA | ASN | H | 109 | 13.736 | 27.465 | 6.865 | 1.00 | 32.11 | C |
| ATOM | 3935 | C | ASN | H | 109 | 13.889 | 27.103 | 5.395 | 1.00 | 33.66 | C |
| ATOM | 3936 | O | ASN | H | 109 | 13.577 | 25.968 | 5.009 | 1.00 | 32.93 | O |
| ATOM | 3937 | CB | ASN | H | 109 | 12.462 | 28.282 | 7.105 | 1.00 | 32.76 | C |
| ATOM | 3938 | CG | ASN | H | 109 | 12.030 | 28.226 | 8.555 | 1.00 | 34.69 | C |
| ATOM | 3939 | OD1 | ASN | H | 109 | 12.169 | 27.183 | 9.189 | 1.00 | 35.70 | O |
| ATOM | 3940 | ND2 | ASN | H | 109 | 11.559 | 29.347 | 9.101 | 1.00 | 33.86 | N |
| ATOM | 3941 | N | TYR | H | 110 | 14.370 | 28.035 | 4.558 | 1.00 | 28.71 | N |
| ATOM | 3942 | CA | TYR | H | 110 | 14.479 | 27.715 | 3.132 | 1.00 | 31.50 | C |
| ATOM | 3943 | C | TYR | H | 110 | 15.567 | 26.684 | 2.876 | 1.00 | 32.02 | C |
| ATOM | 3944 | O | TYR | H | 110 | 15.474 | 25.913 | 1.914 | 1.00 | 34.16 | O |
| ATOM | 3945 | CB | TYR | H | 110 | 14.760 | 28.973 | 2.291 | 1.00 | 33.84 | C |
| ATOM | 3946 | CG | TYR | H | 110 | 13.738 | 30.085 | 2.379 | 1.00 | 31.87 | C |
| ATOM | 3947 | CD1 | TYR | H | 110 | 12.514 | 29.912 | 3.025 | 1.00 | 33.16 | C |
| ATOM | 3948 | CD2 | TYR | H | 110 | 13.985 | 31.311 | 1.779 | 1.00 | 33.71 | C |
| ATOM | 3949 | CE1 | TYR | H | 110 | 11.585 | 30.956 | 3.096 | 1.00 | 33.67 | C |
| ATOM | 3950 | CE2 | TYR | H | 110 | 13.075 | 32.361 | 1.846 | 1.00 | 32.22 | C |
| ATOM | 3951 | CZ | TYR | H | 110 | 11.879 | 32.175 | 2.496 | 1.00 | 35.47 | C |
| ATOM | 3952 | OH | TYR | H | 110 | 10.994 | 33.217 | 2.552 | 1.00 | 34.54 | O |
| ATOM | 3953 | N | PHE | H | 111 | 16.596 | 26.641 | 3.718 | 1.00 | 31.53 | N |
| ATOM | 3954 | CA | PHE | H | 111 | 17.620 | 25.606 | 3.620 | 1.00 | 32.03 | C |
| ATOM | 3955 | C | PHE | H | 111 | 17.359 | 24.416 | 4.527 | 1.00 | 35.48 | C |
| ATOM | 3956 | O | PHE | H | 111 | 18.198 | 23.507 | 4.583 | 1.00 | 34.72 | O |
| ATOM | 3957 | CB | PHE | H | 111 | 19.011 | 26.203 | 3.915 | 1.00 | 29.54 | C |
| ATOM | 3958 | CG | PHE | H | 111 | 19.573 | 26.936 | 2.739 | 1.00 | 34.48 | C |
| ATOM | 3959 | CD1 | PHE | H | 111 | 20.224 | 26.248 | 1.740 | 1.00 | 33.97 | C |
| ATOM | 3960 | CD2 | PHE | H | 111 | 19.348 | 28.290 | 2.569 | 1.00 | 36.85 | C |
| ATOM | 3961 | CE1 | PHE | H | 111 | 20.705 | 26.916 | 0.631 | 1.00 | 35.11 | C |
| ATOM | 3962 | CE2 | PHE | H | 111 | 19.824 | 28.956 | 1.453 | 1.00 | 33.97 | C |
| ATOM | 3963 | CZ | PHE | H | 111 | 20.477 | 28.277 | 0.489 | 1.00 | 35.47 | C |
| ATOM | 3964 | N | SER | H | 112 | 16.224 | 24.396 | 5.225 | 1.00 | 32.82 | N |
| ATOM | 3965 | CA | SER | H | 112 | 15.814 | 23.256 | 6.049 | 1.00 | 35.89 | C |
| ATOM | 3966 | C | SER | H | 112 | 16.939 | 22.836 | 7.001 | 1.00 | 37.41 | C |
| ATOM | 3967 | O | SER | H | 112 | 17.389 | 21.687 | 7.020 | 1.00 | 40.24 | O |
| ATOM | 3968 | CB | SER | H | 112 | 15.361 | 22.082 | 5.170 | 1.00 | 34.07 | C |
| ATOM | 3969 | OG | SER | H | 112 | 14.107 | 22.341 | 4.558 | 1.00 | 37.63 | O |
| ATOM | 3970 | N | VAL | H | 113 | 17.397 | 23.799 | 7.791 | 1.00 | 35.72 | N |
| ATOM | 3971 | CA | VAL | H | 113 | 18.509 | 23.569 | 8.702 | 1.00 | 39.19 | C |
| ATOM | 3972 | C | VAL | H | 113 | 17.954 | 22.847 | 9.924 | 1.00 | 40.17 | C |
| ATOM | 3973 | O | VAL | H | 113 | 17.676 | 23.463 | 10.957 | 1.00 | 39.32 | O |
| ATOM | 3974 | CB | VAL | H | 113 | 19.212 | 24.896 | 9.056 | 1.00 | 35.69 | C |
| ATOM | 3975 | CG1 | VAL | H | 113 | 20.439 | 24.668 | 9.954 | 1.00 | 38.37 | C |
| ATOM | 3976 | CG2 | VAL | H | 113 | 19.645 | 25.621 | 7.772 | 1.00 | 35.52 | C |

TABLE 77-continued

| | | | | | | | | | | |
|---|---|---|---|---|---|---|---|---|---|---|
| ATOM | 3977 | N | MET | H | 114 | 17.779 | 21.532 | 9.802 | 1.00 | 37.60 | N |
| ATOM | 3978 | CA | MET | H | 114 | 17.067 | 20.727 | 10.797 | 1.00 | 37.31 | C |
| ATOM | 3979 | C | MET | H | 114 | 18.041 | 20.286 | 11.885 | 1.00 | 39.72 | C |
| ATOM | 3980 | O | MET | H | 114 | 18.480 | 19.140 | 11.926 | 1.00 | 37.15 | O |
| ATOM | 3981 | CB | MET | H | 114 | 16.430 | 19.508 | 10.143 | 1.00 | 39.53 | C |
| ATOM | 3982 | CG | MET | H | 114 | 15.401 | 19.824 | 9.093 | 1.00 | 47.78 | C |
| ATOM | 3983 | SD | MET | H | 114 | 14.121 | 20.817 | 9.869 | 1.00 | 58.98 | S |
| ATOM | 3984 | CE | MET | H | 114 | 14.336 | 22.292 | 8.937 | 1.00 | 50.05 | C |
| ATOM | 3985 | N | ASP | H | 115 | 18.368 | 21.203 | 12.796 | 1.00 | 35.00 | N |
| ATOM | 3986 | CA | ASP | H | 115 | 19.347 | 20.890 | 13.821 | 1.00 | 39.02 | C |
| ATOM | 3987 | C | ASP | H | 115 | 18.741 | 20.638 | 15.193 | 1.00 | 41.58 | C |
| ATOM | 3988 | O | ASP | H | 115 | 19.482 | 20.290 | 16.110 | 1.00 | 41.42 | O |
| ATOM | 3989 | CB | ASP | H | 115 | 20.408 | 21.994 | 13.917 | 1.00 | 39.15 | C |
| ATOM | 3990 | CG | ASP | H | 115 | 19.830 | 23.348 | 14.273 | 1.00 | 43.59 | C |
| ATOM | 3991 | OD1 | ASP | H | 115 | 18.647 | 23.586 | 13.998 | 1.00 | 45.95 | O1− |
| ATOM | 3992 | OD2 | ASP | H | 115 | 20.568 | 24.193 | 14.813 | 1.00 | 47.94 | O1− |
| ATOM | 3993 | N | VAL | H | 116 | 17.424 | 20.772 | 15.360 | 1.00 | 36.15 | N |
| ATOM | 3994 | CA | VAL | H | 116 | 16.764 | 20.431 | 16.620 | 1.00 | 34.18 | C |
| ATOM | 3995 | C | VAL | H | 116 | 15.858 | 19.246 | 16.357 | 1.00 | 39.56 | C |
| ATOM | 3996 | O | VAL | H | 116 | 14.992 | 19.304 | 15.480 | 1.00 | 38.01 | O |
| ATOM | 3997 | CB | VAL | H | 116 | 15.982 | 21.612 | 17.211 | 1.00 | 40.73 | C |
| ATOM | 3998 | CG1 | VAL | H | 116 | 15.247 | 21.184 | 18.495 | 1.00 | 37.04 | C |
| ATOM | 3999 | CG2 | VAL | H | 116 | 16.938 | 22.767 | 17.499 | 1.00 | 37.09 | C |
| ATOM | 4000 | N | TRP | H | 117 | 16.070 | 18.163 | 17.103 | 1.00 | 39.21 | N |
| ATOM | 4001 | CA | TRP | H | 117 | 15.312 | 16.929 | 16.943 | 1.00 | 39.21 | C |
| ATOM | 4002 | C | TRP | H | 117 | 14.724 | 16.532 | 18.283 | 1.00 | 41.53 | C |
| ATOM | 4003 | O | TRP | H | 117 | 15.347 | 16.748 | 19.329 | 1.00 | 41.74 | O |
| ATOM | 4004 | CB | TRP | H | 117 | 16.196 | 15.783 | 16.408 | 1.00 | 37.84 | C |
| ATOM | 4005 | CG | TRP | H | 117 | 16.650 | 16.001 | 15.011 | 1.00 | 35.03 | C |
| ATOM | 4006 | CD1 | TRP | H | 117 | 17.535 | 16.956 | 14.562 | 1.00 | 37.11 | C |
| ATOM | 4007 | CD2 | TRP | H | 117 | 16.248 | 15.258 | 13.865 | 1.00 | 35.56 | C |
| ATOM | 4008 | NE1 | TRP | H | 117 | 17.687 | 16.852 | 13.194 | 1.00 | 33.85 | N |
| ATOM | 4009 | CE2 | TRP | H | 117 | 16.910 | 15.812 | 12.749 | 1.00 | 36.10 | C |
| ATOM | 1010 | CE3 | TRP | H | 117 | 15.381 | 14.179 | 13.669 | 1.00 | 35.84 | C |
| ATOM | 4011 | CZ2 | TRP | H | 117 | 16.734 | 15.313 | 11.458 | 1.00 | 43.67 | C |
| ATOM | 4012 | CZ3 | TRP | H | 117 | 15.214 | 13.685 | 12.393 | 1.00 | 35.10 | C |
| ATOM | 4013 | CH2 | TRP | H | 117 | 15.879 | 14.258 | 11.302 | 1.00 | 37.95 | C |
| ATOM | 4014 | N | GLY | H | 118 | 13.511 | 15.981 | 18.248 | 1.00 | 40.02 | N |
| ATOM | 4015 | CA | GLY | H | 118 | 12.982 | 15.309 | 19.410 | 1.00 | 41.43 | C |
| ATOM | 4016 | C | GLY | H | 118 | 13.727 | 14.018 | 19.698 | 1.00 | 41.06 | C |
| ATOM | 4017 | O | GLY | H | 118 | 14.560 | 13.546 | 18.918 | 1.00 | 40.22 | O |
| ATOM | 4018 | N | GLN | H | 119 | 13.401 | 13.426 | 20.851 | 1.00 | 41.11 | N |
| ATOM | 4019 | CA | GLN | H | 119 | 13.970 | 12.127 | 21.185 | 1.00 | 46.26 | C |
| ATOM | 4020 | C | GLN | H | 119 | 13.342 | 11.001 | 20.373 | 1.00 | 41.38 | C |
| ATOM | 4021 | O | GLN | H | 119 | 13.895 | 9.902 | 20.329 | 1.00 | 43.57 | O |
| ATOM | 4022 | CB | GLN | H | 119 | 13.816 | 11.865 | 22.691 | 1.00 | 46.54 | C |
| ATOM | 4023 | CG | GLN | H | 119 | 12.506 | 11.174 | 23.119 | 1.00 | 47.51 | C |
| ATOM | 4024 | CD | GLN | H | 119 | 11.321 | 12.116 | 23.217 | 0.00 | 46.11 | C |
| ATOM | 4025 | OE1 | GLN | H | 119 | 11.371 | 13.252 | 22.792 | 0.90 | 47.92 | O |
| ATOM | 4026 | NE2 | GLN | H | 119 | 10.251 | 11.636 | 23.786 | 1.00 | 46.62 | N |
| ATOM | 4027 | N | GLY | H | 120 | 12.232 | 11.252 | 19.704 | 1.00 | 40.22 | N |
| ATOM | 4028 | CA | GLY | H | 120 | 11.597 | 10.196 | 18.939 | 1.00 | 39.56 | C |
| ATOM | 4029 | C | GLY | H | 120 | 10.535 | 9.478 | 19.747 | 1.00 | 40.92 | C |
| ATOM | 4030 | O | GLY | H | 120 | 10.613 | 9.357 | 20.969 | 1.00 | 41.67 | O |
| ATOM | 4031 | N | THR | H | 121 | 9.509 | 9.007 | 19.046 | 1.00 | 37.62 | N |
| ATOM | 4032 | CA | THR | H | 121 | 8.456 | 8.203 | 19.653 | 1.00 | 40.44 | C |
| ATOM | 4033 | C | THR | H | 121 | 8.148 | 7.050 | 18.705 | 1.00 | 42.81 | C |
| ATOM | 4034 | O | THR | H | 121 | 8.078 | 7.241 | 17.486 | 1.00 | 40.94 | O |
| ATOM | 4035 | CB | THR | H | 121 | 7.209 | 9.048 | 19.964 | 1.00 | 42.47 | C |
| ATOM | 4036 | OG1 | THR | H | 121 | 6.257 | 8.253 | 20.687 | 1.00 | 44.30 | O |
| ATOM | 4037 | CG2 | THR | H | 121 | 6.555 | 9.594 | 18.687 | 1.00 | 40.23 | C |
| ATOM | 4038 | N | THR | H | 122 | 8.037 | 5.840 | 19.244 | 1.00 | 38.96 | N |
| ATOM | 4039 | CA | THR | H | 122 | 7.996 | 4.658 | 18.401 | 1.00 | 37.02 | C |
| ATOM | 4040 | C | THR | H | 122 | 6.556 | 4.272 | 18.118 | 1.00 | 39.35 | C |
| ATOM | 4041 | O | THR | H | 122 | 5.743 | 4.178 | 19.039 | 1.00 | 43.83 | O |
| ATOM | 4042 | CB | THR | H | 122 | 8.739 | 3.492 | 19.053 | 1.00 | 41.24 | C |
| ATOM | 4043 | OG1 | THR | H | 122 | 10.109 | 3.846 | 19.216 | 1.00 | 43.67 | O |
| ATOM | 4044 | CG2 | THR | H | 122 | 8.663 | 2.252 | 18.165 | 1.00 | 40.66 | C |
| ATOM | 4045 | N | VAL | H | 123 | 6.244 | 4.062 | 16.842 | 1.00 | 34.74 | N |
| ATOM | 1046 | CA | VAL | H | 123 | 4.940 | 3.589 | 16.404 | 1.00 | 40.17 | C |
| ATOM | 4047 | C | VAL | H | 123 | 5.141 | 2.185 | 15.858 | 1.00 | 43.16 | C |
| ATOM | 4048 | O | VAL | H | 123 | 5.949 | 1.977 | 14.945 | 1.00 | 39.68 | O |
| ATOM | 4049 | CB | VAL | H | 123 | 4.316 | 4.509 | 15.336 | 1.00 | 36.62 | C |
| ATOM | 4050 | CG1 | VAL | H | 123 | 3.037 | 3.895 | 14.815 | 1.00 | 38.12 | C |
| ATOM | 4051 | CG2 | VAL | H | 123 | 4.036 | 5.928 | 15.898 | 1.00 | 38.68 | C |
| ATOM | 4052 | N | THR | H | 124 | 4.424 | 1.220 | 16.425 | 1.00 | 41.50 | N |
| ATOM | 4053 | CA | THR | H | 124 | 4.426 | −0.151 | 15.931 | 1.00 | 40.81 | C |
| ATOM | 4054 | C | THR | H | 124 | 3.012 | −0.479 | 15.492 | 1.00 | 43.48 | C |
| ATOM | 4055 | O | THR | H | 124 | 2.075 | −0.461 | 16.306 | 1.00 | 39.55 | O |
| ATOM | 4056 | CB | THR | H | 124 | 4.907 | −1.141 | 16.992 | 1.00 | 38.05 | C |

TABLE 77-continued

| | | | | | | | | | | |
|---|---|---|---|---|---|---|---|---|---|---|
| ATOM | 4057 | OG1 | THR | H | 124 | 6.127 | −0.668 | 17.558 | 1.00 | 41.56 | O |
| ATOM | 4058 | CG2 | THR | H | 124 | 5.159 | −2.523 | 16.384 | 1.00 | 39.45 | C |
| ATOM | 4059 | N | VAL | H | 125 | 2.858 | −0.749 | 14.206 | 1.00 | 39.81 | N |
| ATOM | 4060 | CA | VAL | H | 125 | 1.573 | −1.082 | 13.625 | 1.00 | 40.81 | C |
| ATOM | 4061 | C | VAL | H | 125 | 1.606 | −2.584 | 13.417 | 1.00 | 45.19 | C |
| ATOM | 4062 | O | VAL | H | 125 | 2.346 | −3.083 | 12.568 | 1.00 | 45.39 | O |
| ATOM | 4063 | CB | VAL | H | 125 | 1.323 | −0.315 | 12.321 | 1.00 | 43.30 | C |
| ATOM | 4064 | CG1 | VAL | H | 125 | −0.146 | −0.399 | 11.909 | 1.00 | 37.26 | C |
| ATOM | 4065 | CG2 | VAL | H | 125 | 1.771 | 1.154 | 12.479 | 1.00 | 40.24 | C |
| ATOM | 4066 | N | SER | H | 126 | 0.851 | −3.308 | 14.235 | 1.00 | 42.14 | N |
| ATOM | 4067 | CA | SER | H | 126 | 0.776 | −4.756 | 14.135 | 1.00 | 44.72 | C |
| ATOM | 4068 | C | SER | H | 126 | −0.582 | −5.213 | 14.640 | 1.00 | 44.67 | C |
| ATOM | 4069 | O | SER | H | 126 | −1.204 | −4.551 | 15.475 | 1.00 | 46.03 | O |
| ATOM | 4070 | CB | SER | H | 126 | 1.889 | −5.433 | 14.933 | 1.00 | 46.83 | C |
| ATOM | 4071 | OG | SER | H | 126 | 1.616 | −6.813 | 15.068 | 1.00 | 51.42 | O |
| ATOM | 4072 | N | SER | H | 127 | −1.054 | −6.336 | 14.108 | 1.00 | 48.10 | N |
| ATOM | 4073 | CA | SER | H | 127 | −2.239 | −6.950 | 14.699 | 1.00 | 50.32 | C |
| ATOM | 4074 | C | SER | H | 127 | −1.911 | −7.829 | 15.906 | 1.00 | 49.84 | C |
| ATOM | 4075 | O | SER | H | 127 | −2.837 | −8.306 | 16.573 | 1.00 | 54.04 | O |
| ATOM | 4076 | CB | SER | H | 127 | −2.988 | −7.769 | 13.652 | 1.00 | 49.15 | C |
| ATOM | 4077 | OG | SER | H | 127 | −2.115 | −8.667 | 13.010 | 1.00 | 55.97 | O |
| ATOM | 4078 | N | ALA | H | 128 | −0.633 | −8.028 | 16.214 | 1.00 | 44.21 | N |
| ATOM | 4079 | CA | ALA | H | 128 | −0.233 | −8.916 | 17.298 | 1.00 | 46.31 | C |
| ATOM | 4080 | C | ALA | H | 128 | −0.521 | −8.290 | 18.656 | 1.00 | 49.93 | C |
| ATOM | 4081 | O | ALA | H | 128 | −0.455 | −7.071 | 18.831 | 1.00 | 48.84 | O |
| ATOM | 4082 | CB | ALA | H | 128 | 1.260 | −9.249 | 17.195 | 1.00 | 41.41 | C |
| ATOM | 4083 | N | SER | H | 129 | −0.828 | −9.146 | 19.626 | 1.00 | 46.77 | N |
| ATOM | 4084 | CA | SER | H | 129 | −1.092 | −8.719 | 20.991 | 1.00 | 44.60 | C |
| ATOM | 4085 | C | SER | H | 129 | 0.210 | −8.542 | 21.763 | 1.00 | 43.08 | C |
| ATOM | 4086 | O | SER | H | 129 | 1.249 | −9.111 | 21.420 | 1.00 | 49.46 | O |
| ATOM | 4087 | CB | SER | H | 129 | −1.975 | −9.739 | 21.718 | 1.00 | 43.78 | C |
| ATOM | 4088 | OG | SER | H | 129 | −3.254 | −9.822 | 21.125 | 1.00 | 54.23 | O |
| ATOM | 4089 | N | THR | H | 130 | 0.137 | −7.744 | 22.827 | 1.00 | 44.28 | N |
| ATOM | 4090 | CA | THR | H | 130 | 1.253 | −7.604 | 23.749 | 1.00 | 43.09 | C |
| ATOM | 4091 | C | THR | H | 130 | 1.517 | −8.934 | 24.446 | 1.00 | 48.11 | C |
| ATOM | 4092 | O | THR | H | 130 | 0.587 | −9.693 | 24.734 | 1.00 | 44.06 | O |
| ATOM | 4093 | CB | THR | H | 130 | 0.953 | −6.505 | 24.771 | 1.00 | 47.77 | C |
| ATOM | 4094 | OG1 | THR | H | 130 | 0.704 | −5.271 | 24.081 | 1.00 | 51.82 | O |
| ATOM | 4095 | CG2 | THR | H | 130 | 2.125 | −6.299 | 25.702 | 1.00 | 44.79 | C |
| ATOM | 4096 | N | LYS | H | 131 | 2.794 | −9.243 | 24.672 | 1.00 | 48.20 | N |
| ATOM | 4097 | CA | LYS | H | 131 | 3.180 | −10.437 | 25.417 | 1.00 | 46.79 | C |
| ATOM | 4098 | C | LYS | H | 131 | 4.408 | −10.104 | 26.246 | 1.00 | 46.35 | C |
| ATOM | 4099 | O | LYS | H | 131 | 5.409 | −9.648 | 25.699 | 1.00 | 44.49 | O |
| ATOM | 4100 | CB | LYS | H | 131 | 3.470 | −11.616 | 24.479 | 1.00 | 53.77 | C |
| ATOM | 4101 | CG | LYS | H | 131 | 3.897 | −12.901 | 25.205 | 1.00 | 53.17 | C |
| ATOM | 4102 | CD | LYS | H | 131 | 2.788 | −13.409 | 26.120 | 1.00 | 62.81 | C |
| ATOM | 4103 | CE | LYS | H | 131 | 3.322 | −13.885 | 27.471 | 1.00 | 66.75 | C |
| ATOM | 4104 | NZ | LYS | H | 131 | 4.123 | −15.139 | 27.374 | 1.00 | 72.72 | N1+ |
| ATOM | 4105 | N | GLY | H | 132 | 4.325 | −10.303 | 27.559 | 1.00 | 41.01 | N |
| ATOM | 4106 | CA | GLY | H | 132 | 5.467 | −10.132 | 28.418 | 1.00 | 43.27 | C |
| ATOM | 4107 | C | GLY | H | 132 | 6.476 | −11.237 | 28.182 | 1.00 | 44.82 | C |
| ATOM | 4108 | O | GLY | H | 132 | 6.153 | −12.289 | 27.620 | 1.00 | 47.14 | O |
| ATOM | 4109 | N | PRO | H | 133 | 7.722 | −11.009 | 28.576 | 1.00 | 43.92 | N |
| ATOM | 4110 | CA | PRO | H | 133 | 8.759 | −12.026 | 28.398 | 1.00 | 45.08 | C |
| ATOM | 4111 | C | PRO | H | 133 | 8.889 | −12.972 | 29.580 | 1.00 | 48.01 | C |
| ATOM | 4112 | O | PRO | H | 133 | 8.652 | −12.622 | 30.736 | 1.00 | 46.40 | O |
| ATOM | 4113 | CB | PRO | H | 133 | 10.030 | −11.177 | 28.267 | 1.00 | 46.38 | C |
| ATOM | 4114 | CG | PRO | H | 133 | 9.758 | −10.015 | 29.169 | 1.00 | 44.52 | C |
| ATOM | 4115 | CD | PRO | H | 133 | 8.292 | −9.718 | 29.011 | 1.00 | 46.40 | O |
| ATOM | 4116 | N | SER | H | 134 | 9.288 | −14.197 | 29.272 | 1.00 | 48.13 | N |
| ATOM | 4117 | CA | SER | H | 134 | 9.879 | −15.052 | 30.282 | 1.00 | 45.60 | C |
| ATOM | 1118 | C | SER | H | 134 | 11.342 | −14.661 | 30.413 | 1.00 | 46.99 | C |
| ATOM | 4119 | O | SER | H | 134 | 12.004 | −14.351 | 29.419 | 1.00 | 47.80 | O |
| ATOM | 4120 | CB | SER | H | 134 | 9.740 | −16.524 | 29.895 | 1.00 | 50.70 | C |
| ATOM | 4121 | OG | SER | H | 134 | 8.507 | −16.771 | 29.243 | 1.00 | 58.58 | O |
| ATOM | 4122 | N | VAL | H | 135 | 11.843 | −14.640 | 31.641 | 1.00 | 47.59 | N |
| ATOM | 4123 | CA | VAL | H | 135 | 13.210 | −14.214 | 31.916 | 1.00 | 46.85 | C |
| ATOM | 4124 | C | VAL | H | 135 | 13.960 | −15.395 | 32.513 | 1.00 | 50.25 | C |
| ATOM | 4125 | O | VAL | H | 135 | 13.570 | −15.919 | 33.563 | 1.00 | 53.80 | O |
| ATOM | 4126 | CB | VAL | H | 135 | 13.253 | −12.993 | 32.849 | 1.00 | 50.48 | C |
| ATOM | 4127 | CG1 | VAL | H | 135 | 14.689 | −12.660 | 33.218 | 1.00 | 51.64 | C |
| ATOM | 4128 | CG2 | VAL | H | 135 | 12.579 | −11.805 | 32.185 | 1.00 | 44.67 | C |
| ATOM | 4129 | N | PHE | H | 136 | 15.042 | −15.803 | 31.852 | 1.00 | 47.55 | N |
| ATOM | 4130 | CA | PHE | H | 136 | 15.729 | −17.035 | 32.185 | 1.00 | 47.97 | C |
| ATOM | 4131 | C | PHE | H | 136 | 17.186 | −16.760 | 32.520 | 1.00 | 51.03 | C |
| ATOM | 4132 | O | PHE | H | 136 | 17.835 | −15.971 | 31.829 | 1.00 | 49.11 | O |
| ATOM | 4133 | CB | PHE | H | 136 | 15.666 | −18.025 | 31.015 | 1.00 | 45.30 | C |
| ATOM | 4134 | CG | PHE | H | 136 | 14.276 | −18.457 | 30.650 | 1.00 | 49.35 | C |
| ATOM | 4135 | CD1 | PHE | H | 136 | 13.396 | −18.899 | 31.620 | 1.00 | 49.36 | C |
| ATOM | 4136 | CD2 | PHE | H | 136 | 13.855 | −18.429 | 29.335 | 1.00 | 49.64 | C |

TABLE 77-continued

| | | | | | | | | | | |
|---|---|---|---|---|---|---|---|---|---|---|
| ATOM | 4137 | CE1 | PHE | H | 136 | 12.131 | −19.315 | 31.285 | 1.00 | 50.24 | C |
| ATOM | 4138 | CE2 | PHE | H | 136 | 12.580 | −18.834 | 28.992 | 1.00 | 49.90 | C |
| ATOM | 4139 | CZ | PHE | H | 136 | 11.717 | −19.283 | 29.967 | 1.00 | 48.84 | C |
| ATOM | 4140 | N | PRO | H | 137 | 17.734 | −17.399 | 33.556 | 1.00 | 50.56 | N |
| ATOM | 4141 | CA | PRO | H | 137 | 19.154 | −17.202 | 33.864 | 1.00 | 47.69 | C |
| ATOM | 4142 | C | PRO | H | 137 | 20.046 | −17.857 | 32.824 | 1.00 | 47.06 | C |
| ATOM | 4143 | O | PRO | H | 137 | 19.739 | −18.931 | 32.302 | 1.00 | 51.86 | O |
| ATOM | 4144 | CB | PRO | H | 137 | 19.319 | −17.875 | 35.231 | 1.00 | 48.48 | C |
| ATOM | 4145 | CG | PRO | H | 137 | 18.242 | −18.926 | 35.260 | 1.00 | 55.26 | C |
| ATOM | 4146 | CD | PRO | H | 137 | 17.083 | −18.329 | 34.500 | 1.00 | 51.63 | C |
| ATOM | 4147 | N | LEU | H | 138 | 21.150 | −17.179 | 32.517 | 1.00 | 48.65 | N |
| ATOM | 4148 | CA | LEU | H | 138 | 22.295 | −17.770 | 31.830 | 1.00 | 51.73 | C |
| ATOM | 4149 | C | LEU | H | 138 | 23.333 | −18.018 | 32.922 | 1.00 | 51.16 | C |
| ATOM | 4150 | O | LEU | H | 138 | 24.117 | −17.138 | 33.268 | 1.00 | 51.27 | O |
| ATOM | 4151 | CB | LEU | H | 138 | 22.809 | −16.849 | 30.728 | 1.00 | 45.26 | C |
| ATOM | 4152 | CG | LEU | H | 138 | 21.733 | −16.507 | 29.694 | 1.00 | 53.91 | C |
| ATOM | 4153 | CD1 | LEU | H | 138 | 22.154 | −15.376 | 28.751 | 1.00 | 51.81 | U |
| ATOM | 4154 | CD2 | LEU | H | 138 | 21.375 | −17.751 | 28.918 | 1.00 | 51.36 | C |
| ATOM | 4155 | N | ALA | H | 139 | 23.296 | −19.209 | 33.497 | 1.00 | 53.95 | N |
| ATOM | 4156 | CA | ALA | H | 139 | 24.050 | −19.477 | 34.715 | 1.00 | 58.00 | C |
| ATOM | 4157 | C | ALA | H | 139 | 25.537 | −19.611 | 34.418 | 1.00 | 63.15 | C |
| ATOM | 4158 | O | ALA | H | 139 | 25.919 | −20.345 | 33.496 | 1.00 | 57.31 | O |
| ATOM | 4159 | CB | ALA | H | 139 | 23.536 | −20.747 | 35.382 | 1.00 | 60.80 | C |
| ATOM | 4160 | N | PRO | H | 140 | 26.405 | −18.946 | 35.180 | 1.00 | 64.63 | N |
| ATOM | 4161 | CA | PRO | H | 140 | 27.843 | −19.137 | 34.988 | 1.00 | 67.41 | C |
| ATOM | 4162 | C | PRO | H | 140 | 28.250 | −20.561 | 35.339 | 1.00 | 66.91 | C |
| ATOM | 4163 | O | PRO | H | 140 | 27.753 | −21.154 | 36.297 | 1.00 | 67.77 | O |
| ATOM | 4164 | CB | PRO | H | 140 | 28.467 | −18.106 | 35.935 | 1.00 | 67.73 | C |
| ATOM | 4165 | CG | PRO | H | 140 | 27.437 | −17.894 | 36.985 | 1.00 | 67.63 | C |
| ATOM | 4166 | CD | PRO | H | 140 | 26.114 | −18.023 | 36.290 | 1.00 | 69.23 | C |
| ATOM | 4167 | N | SER | H | 141 | 29.132 | −21.121 | 34.518 | 1.00 | 67.28 | N |
| ATOM | 4168 | CA | SER | H | 141 | 29.673 | −22.454 | 34.729 | 1.00 | 70.52 | C |
| ATOM | 4169 | C | SER | H | 141 | 31.118 | −22.441 | 34.266 | 1.00 | 67.65 | C |
| ATOM | 4170 | O | SER | H | 141 | 31.611 | −21.432 | 33.754 | 1.00 | 69.37 | O |
| ATOM | 4171 | CB | SER | H | 141 | 28.862 | −23.517 | 33.978 | 1.00 | 71.25 | C |
| ATOM | 4172 | OG | SER | H | 141 | 29.015 | −23.366 | 32.578 | 1.00 | 69.25 | O |
| ATOM | 4173 | N | SER | H | 142 | 31.803 | −23.573 | 34.428 | 1.00 | 69.01 | N |
| ATOM | 4174 | CA | SER | H | 142 | 33.132 | −23.687 | 33.837 | 1.00 | 71.39 | C |
| ATOM | 4175 | C | SER | H | 142 | 33.079 | −23.472 | 32.330 | 1.00 | 69.34 | C |
| ATOM | 4176 | O | SER | H | 142 | 34.082 | −23.085 | 31.718 | 1.00 | 72.84 | C |
| ATOM | 4177 | CB | SER | H | 142 | 33.749 | −25.047 | 34.161 | 1.00 | 75.40 | C |
| ATOM | 4178 | OG | SER | H | 142 | 33.340 | −26.033 | 33.227 | 1.00 | 78.26 | O |
| ATOM | 4179 | N | LYS | H | 143 | 31.916 | −23.708 | 31.722 | 1.00 | 69.92 | N |
| ATOM | 4180 | CA | LYS | H | 143 | 31.700 | −23.449 | 30.306 | 1.00 | 67.28 | C |
| ATOM | 4181 | C | LYS | H | 143 | 31.533 | −21.967 | 29.992 | 1.00 | 66.12 | C |
| ATOM | 4182 | O | LYS | H | 143 | 31.492 | −21.606 | 28.810 | 1.00 | 60.20 | O |
| ATOM | 4183 | CB | LYS | H | 143 | 30.475 | −24.228 | 29.828 | 1.00 | 63.31 | C |
| ATOM | 4184 | CG | LYS | H | 143 | 30.570 | −25.717 | 30.068 | 1.00 | 61.93 | C |
| ATOM | 4185 | CD | LYS | H | 143 | 31.679 | −26.316 | 29.237 | 1.00 | 62.13 | C |
| ATOM | 4186 | CE | LYS | H | 143 | 31.726 | −27.823 | 29.377 | 1.00 | 60.32 | C |
| ATOM | 4187 | NZ | LYS | H | 143 | 32.655 | −28.373 | 28.351 | 1.00 | 59.17 | N |
| ATOM | 4188 | N | SER | H | 144 | 31.441 | −21.102 | 31.010 | 1.00 | 65.17 | N |
| ATOM | 4189 | CA | SER | H | 144 | 31.373 | −19.659 | 30.805 | 1.00 | 65.40 | C |
| ATOM | 4190 | C | SER | H | 144 | 32.500 | −18.924 | 31.522 | 1.00 | 67.45 | C |
| ATOM | 4191 | O | SER | H | 144 | 32.359 | −17.736 | 31.828 | 1.00 | 62.80 | O |
| ATOM | 4192 | CB | SER | H | 144 | 30.025 | −19.102 | 31.268 | 1.00 | 60.31 | C |
| ATOM | 4193 | OG | SER | H | 144 | 29.114 | −20.145 | 31.570 | 1.00 | 68.98 | O |
| ATOM | 4194 | N | THR | H | 145 | 33.609 | −19.604 | 31.798 | 1.00 | 68.10 | N |
| ATOM | 4195 | CA | THR | H | 145 | 34.722 | −19.046 | 32.552 | 1.00 | 71.87 | C |
| ATOM | 4196 | C | THR | H | 145 | 35.988 | −19.124 | 31.720 | 1.00 | 72.82 | C |
| ATOM | 4197 | O | THR | H | 145 | 36.203 | −20.100 | 30.993 | 1.00 | 73.37 | O |
| ATOM | 4198 | CB | THR | H | 145 | 34.943 | −19.806 | 33.862 | 1.00 | 76.04 | C |
| ATOM | 4199 | OG1 | THR | H | 145 | 35.069 | −21.204 | 33.572 | 1.00 | 77.12 | O |
| ATOM | 4200 | CG2 | THR | H | 145 | 33.785 | −19.586 | 34.821 | 1.00 | 68.72 | C |
| ATOM | 4201 | N | SER | H | 146 | 36.843 | −18.111 | 31.863 | 1.00 | 79.16 | N |
| ATOM | 4202 | CA | SER | H | 146 | 38.108 | −18.086 | 31.131 | 1.00 | 75.15 | C |
| ATOM | 4203 | C | SER | H | 146 | 39.032 | −17.058 | 31.769 | 1.00 | 78.81 | C |
| ATOM | 4204 | O | SER | H | 146 | 38.747 | −15.858 | 31.711 | 1.00 | 79.27 | O |
| ATOM | 4205 | CB | SER | H | 146 | 37.865 | −17.760 | 29.661 | 1.00 | 73.93 | C |
| ATOM | 4206 | OG | SER | H | 146 | 39.078 | −17.724 | 28.925 | 1.00 | 80.73 | O |
| ATOM | 4207 | N | GLY | H | 147 | 40.119 | −17.531 | 32.383 | 1.00 | 85.63 | N |
| ATOM | 4208 | CA | GLY | H | 147 | 41.186 | −16.664 | 32.846 | 1.00 | 77.41 | C |
| ATOM | 4209 | C | GLY | H | 147 | 40.778 | −15.586 | 33.829 | 1.00 | 81.57 | C |
| ATOM | 4210 | O | GLY | H | 147 | 41.023 | −14.397 | 33.595 | 1.00 | 84.05 | O |
| ATOM | 4211 | N | GLY | H | 148 | 40.160 | −15.985 | 34.940 | 1.00 | 82.07 | N |
| ATOM | 4212 | CA | GLY | H | 148 | 39.737 | −15.057 | 35.064 | 1.00 | 82.70 | C |
| ATOM | 4213 | C | GLY | H | 148 | 38.366 | −14.447 | 35.744 | 1.00 | 78.87 | C |
| ATOM | 4214 | O | GLY | H | 148 | 37.694 | −14.096 | 36.719 | 1.00 | 73.91 | O |
| ATOM | 4215 | N | THR | H | 149 | 37.936 | −14.314 | 34.490 | 1.00 | 78.54 | N |
| ATOM | 4216 | CA | THR | H | 149 | 36.633 | −13.753 | 34.166 | 1.00 | 77.38 | C |

TABLE 77-continued

| | | | | | | | | | | |
|---|---|---|---|---|---|---|---|---|---|---|
| ATOM | 4217 | C | THR | H | 149 | 35.602 | −14.864 | 33.981 | 1.00 | 77.72 | C |
| ATOM | 4218 | O | THR | H | 149 | 35.910 | −15.962 | 33.506 | 1.00 | 72.29 | O |
| ATOM | 4219 | CB | THR | H | 149 | 36.690 | −12.894 | 32.899 | 1.00 | 78.08 | C |
| ATOM | 4220 | OG1 | THR | H | 149 | 36.266 | −13.670 | 31.771 | 1.00 | 80.18 | O |
| ATOM | 4221 | CG2 | THR | H | 149 | 38.102 | −12.375 | 32.649 | 1.00 | 76.16 | C |
| ATOM | 4222 | N | ALA | H | 150 | 34.369 | −14.565 | 34.374 | 1.00 | 72.13 | N |
| ATOM | 4223 | CA | ALA | H | 150 | 33.243 | −15.461 | 34.165 | 1.00 | 71.74 | C |
| ATOM | 4224 | C | ALA | H | 150 | 32.080 | −14.661 | 33.600 | 1.00 | 69.42 | C |
| ATOM | 4225 | O | ALA | H | 150 | 31.837 | −13.527 | 34.022 | 1.00 | 68.01 | O |
| ATOM | 4226 | CB | ALA | H | 150 | 32.824 | −16.157 | 35.462 | 1.00 | 64.31 | C |
| ATOM | 4227 | N | ALA | H | 151 | 31.371 | −15.246 | 32.641 | 1.00 | 67.05 | N |
| ATOM | 4228 | CA | ALA | H | 151 | 30.229 | −14.599 | 32.012 | 1.00 | 64.94 | C |
| ATOM | 4229 | C | ALA | H | 151 | 28.935 | −15.208 | 32.533 | 1.00 | 58.92 | C |
| ATOM | 4230 | O | ALA | H | 151 | 28.826 | −16.426 | 32.702 | 1.00 | 60.50 | O |
| ATOM | 4231 | CB | ALA | H | 151 | 30.289 | −14.715 | 30.486 | 1.00 | 57.40 | C |
| ATOM | 4232 | N | LEU | H | 152 | 27.965 | −14.342 | 32.807 | 1.00 | 55.49 | N |
| ATOM | 4233 | CA | LEU | H | 152 | 26.626 | −14.758 | 33.194 | 1.00 | 61.23 | C |
| ATOM | 4234 | C | LEU | H | 152 | 25.648 | −13.744 | 32.626 | 1.00 | 52.52 | C |
| ATOM | 4235 | O | LEU | H | 152 | 26.028 | −12.633 | 32.255 | 1.00 | 57.24 | O |
| ATOM | 4236 | CB | LEU | H | 152 | 26.482 | −14.870 | 34.716 | 1.00 | 62.78 | C |
| ATOM | 4237 | CG | LEU | H | 152 | 26.828 | −13.598 | 35.496 | 1.00 | 68.26 | C |
| ATOM | 4238 | CD1 | LEU | H | 152 | 25.572 | −12.891 | 35.970 | 1.00 | 63.24 | C |
| ATOM | 4239 | CD2 | LEU | H | 152 | 27.759 | −13.914 | 36.664 | 1.00 | 70.10 | C |
| ATOM | 4240 | N | GLY | H | 153 | 24.390 | −14.132 | 32.540 | 1.00 | 52.60 | N |
| ATOM | 4241 | CA | GLY | H | 153 | 23.418 | −13.217 | 31.992 | 1.00 | 54.81 | C |
| ATOM | 4242 | C | GLY | H | 153 | 22.001 | −13.679 | 32.210 | 1.00 | 51.96 | C |
| ATOM | 4243 | O | GLY | H | 153 | 21.734 | −14.560 | 33.030 | 1.00 | 48.92 | O |
| ATOM | 4244 | N | CYS | H | 154 | 21.086 | −13.052 | 31.470 | 1.00 | 46.14 | N |
| ATOM | 4245 | CA | CYS | H | 154 | 19.710 | −13.518 | 31.395 | 1.00 | 51.66 | C |
| ATOM | 4246 | C | CYS | H | 154 | 19.242 | −13.511 | 29.957 | 1.00 | 50.00 | C |
| ATOM | 4247 | O | CYS | H | 154 | 19.681 | −12.697 | 29.140 | 1.00 | 50.60 | C |
| ATOM | 4248 | CB | CYS | H | 154 | 18.743 | −12.659 | 32.194 | 1.00 | 60.57 | C |
| ATOM | 4249 | SG | CYS | H | 154 | 19.476 | −12.064 | 33.651 | 1.00 | 86.65 | S |
| ATOM | 4250 | N | LEU | H | 155 | 18.323 | −14.415 | 29.676 | 1.00 | 48.33 | N |
| ATOM | 4251 | CA | LEU | H | 155 | 17.671 | −14.513 | 28.385 | 1.00 | 51.06 | C |
| ATOM | 4252 | C | LEU | H | 155 | 16.253 | −13.995 | 28.554 | 1.00 | 49.89 | C |
| ATOM | 4253 | O | LEU | H | 155 | 15.486 | −14.536 | 29.364 | 1.00 | 49.53 | O |
| ATOM | 4254 | CB | LEU | H | 155 | 17.675 | −15.956 | 27.888 | 1.00 | 50.57 | C |
| ATOM | 4255 | CG | LEU | H | 155 | 16.977 | −16.234 | 26.561 | 1.00 | 48.91 | C |
| ATOM | 4256 | CD1 | LEU | H | 155 | 17.648 | −15.478 | 25.416 | 1.00 | 45.37 | C |
| ATOM | 4257 | CD2 | LEU | H | 155 | 17.028 | −17.722 | 26.333 | 1.00 | 47.79 | C |
| ATOM | 4258 | N | VAL | H | 156 | 15.919 | −12.946 | 27.813 | 1.00 | 43.52 | N |
| ATOM | 4259 | CA | VAL | H | 156 | 14.608 | −12.308 | 27.876 | 1.00 | 45.06 | C |
| ATOM | 4260 | C | VAL | H | 156 | 13.842 | −12.740 | 26.630 | 1.00 | 48.32 | C |
| ATOM | 4261 | O | VAL | H | 156 | 14.009 | −12.166 | 25.547 | 1.00 | 45.49 | O |
| ATOM | 4262 | CB | VAL | H | 156 | 14.729 | −10.786 | 27.978 | 1.00 | 45.17 | C |
| ATOM | 4263 | CG1 | VAL | H | 156 | 13.357 | −10.143 | 27.998 | 1.00 | 45.73 | C |
| ATOM | 4264 | CG2 | VAL | H | 156 | 15.520 | −10.399 | 29.227 | 1.00 | 48.57 | C |
| ATOM | 4265 | N | LYS | H | 157 | 12.967 | −13.730 | 26.794 | 1.00 | 44.23 | N |
| ATOM | 4266 | CA | LYS | H | 157 | 12.450 | −14.527 | 25.691 | 1.00 | 48.07 | C |
| ATOM | 4267 | C | LYS | H | 157 | 10.971 | −14.280 | 25.447 | 1.00 | 45.94 | C |
| ATOM | 4268 | O | LYS | H | 157 | 10.169 | −14.286 | 26.386 | 1.00 | 41.21 | O |
| ATOM | 4269 | CB | LYS | H | 157 | 12.659 | −16.025 | 25.970 | 1.00 | 53.00 | O |
| ATOM | 4270 | CG | LYS | H | 157 | 13.453 | −16.792 | 24.915 | 1.00 | 52.55 | C |
| ATOM | 4271 | CD | LYS | H | 157 | 12.571 | −17.211 | 23.759 | 1.00 | 60.55 | C |
| ATOM | 4272 | CE | LYS | H | 157 | 12.770 | −18.672 | 23.389 | 1.00 | 58.02 | C |
| ATOM | 4273 | NZ | LYS | H | 157 | 11.604 | −19.231 | 22.640 | 1.00 | 57.09 | N |
| ATOM | 4274 | N | ASP | H | 158 | 10.622 | −14.115 | 24.171 | 1.00 | 45.84 | N |
| ATOM | 4275 | CA | ASP | H | 158 | 9.252 | −14.198 | 23.678 | 1.00 | 47.80 | C |
| ATOM | 4276 | C | ASP | H | 158 | 8.378 | −13.066 | 24.207 | 1.00 | 50.23 | C |
| ATOM | 4277 | O | ASP | H | 158 | 7.444 | −13.298 | 24.981 | 1.00 | 82.27 | O |
| ATOM | 4278 | CB | ASP | H | 158 | 8.636 | −15.558 | 24.027 | 1.00 | 50.70 | C |
| ATOM | 4279 | CG | ASP | H | 158 | 9.316 | −16.721 | 23.302 | 1.00 | 55.75 | C |
| ATOM | 4280 | OD1 | ASP | H | 158 | 9.917 | −16.510 | 22.227 | 1.00 | 49.22 | O |
| ATOM | 4281 | OD2 | ASP | H | 158 | 9.240 | −17.859 | 23.810 | 1.00 | 53.98 | O |
| ATOM | 4282 | N | TYR | H | 159 | 8.672 | −11.839 | 23.776 | 1.00 | 46.22 | N |
| ATOM | 4283 | CA | TYR | H | 159 | 7.871 | −10.674 | 24.130 | 1.00 | 43.35 | C |
| ATOM | 4284 | C | TYR | H | 159 | 7.514 | −9.884 | 22.876 | 1.00 | 43.38 | C |
| ATOM | 4285 | O | TYR | H | 159 | 8.168 | −9.996 | 21.841 | 1.00 | 42.81 | O |
| ATOM | 4286 | CB | TYR | H | 159 | 8.595 | −9.781 | 25.134 | 1.00 | 44.19 | C |
| ATOM | 4287 | CG | TYR | H | 159 | 9.859 | −9.142 | 24.610 | 1.00 | 43.80 | C |
| ATOM | 4288 | CD1 | TYR | H | 159 | 9.822 | −7.916 | 23.962 | 1.00 | 46.62 | C |
| ATOM | 4289 | CD2 | TYR | H | 159 | 11.092 | −9.755 | 24.776 | 1.00 | 43.06 | C |
| ATOM | 4290 | CE1 | TYR | H | 159 | 10.976 | −7.334 | 23.488 | 1.00 | 49.67 | C |
| ATOM | 4291 | CE2 | TYR | H | 159 | 12.254 | −9.168 | 24.309 | 1.00 | 46.37 | C |
| ATOM | 4292 | CZ | TYR | H | 159 | 12.186 | −7.955 | 23.669 | 1.00 | 40.19 | C |
| ATOM | 4293 | OH | TYR | H | 159 | 13.324 | −7.363 | 23.196 | 1.00 | 53.05 | O |
| ATOM | 4294 | N | PHE | H | 160 | 6.442 | −9.111 | 22.962 | 1.00 | 47.26 | N |
| ATOM | 4295 | CA | PHE | H | 160 | 6.094 | −8.208 | 21.872 | 1.00 | 45.95 | C |
| ATOM | 4296 | C | PHE | H | 160 | 5.698 | −6.850 | 22.453 | 1.00 | 53.25 | C |

TABLE 77-continued

| | | | | | | | | | | |
|---|---|---|---|---|---|---|---|---|---|---|
| ATOM | 4297 | O | PHE | H | 160 | 5.393 | −6.776 | 23.646 | 1.00 | 59.36 | O |
| ATOM | 4298 | CB | PHE | H | 160 | 1.997 | −8.806 | 20.986 | 1.00 | 46.47 | C |
| ATOM | 4299 | CG | PHE | H | 160 | 4.805 | −8.059 | 19.703 | 1.00 | 43.84 | C |
| ATOM | 4300 | CD1 | PHE | H | 160 | 5.799 | −8.048 | 18.743 | 1.00 | 43.60 | C |
| ATOM | 4301 | CD2 | PHE | H | 160 | 3.645 | −7.344 | 19.467 | 1.00 | 45.03 | C |
| ATOM | 4302 | CE1 | PHE | H | 160 | 5.638 | −7.337 | 17.574 | 1.00 | 50.33 | C |
| ATOM | 4303 | CE2 | PHE | H | 160 | 3.488 | −6.623 | 18.309 | 1.00 | 48.33 | C |
| ATOM | 4304 | CZ | PHE | H | 160 | 4.485 | −6.623 | 17.359 | 1.00 | 42.50 | C |
| ATOM | 4305 | N | PRO | H | 161 | 5.441 | −5.838 | 21.614 | 1.00 | 48.76 | N |
| ATOM | 4306 | CA | PRO | H | 161 | 6.241 | −4.605 | 21.576 | 1.00 | 53.55 | C |
| ATOM | 4307 | C | PRO | H | 161 | 7.693 | −4.736 | 22.009 | 1.00 | 44.58 | C |
| ATOM | 4308 | O | PRO | H | 161 | 7.997 | −5.134 | 23.132 | 1.00 | 44.86 | O |
| ATOM | 4309 | CB | PRO | H | 161 | 5.478 | −3.658 | 22.511 | 1.00 | 48.47 | C |
| ATOM | 4310 | CG | PRO | H | 161 | 4.136 | −4.195 | 22.617 | 1.00 | 52.28 | C |
| ATOM | 4311 | CD | PRO | H | 161 | 4.038 | −5.482 | 21.874 | 1.00 | 56.65 | C |
| ATOM | 4312 | N | GLU | H | 162 | 8.569 | −4.271 | 21.119 | 1.00 | 47.59 | N |
| ATOM | 4313 | CA | GLU | H | 162 | 10.019 | −4.336 | 21.303 | 1.00 | 54.97 | C |
| ATOM | 4314 | C | GLU | H | 162 | 10.554 | −3.847 | 22.639 | 1.00 | 62.88 | C |
| ATOM | 4315 | O | GLU | H | 162 | 11.371 | −4.567 | 23.240 | 1.00 | 68.03 | O |
| ATOM | 4316 | CB | GLU | H | 162 | 10.712 | −3.551 | 20.189 | 1.00 | 51.28 | C |
| ATOM | 4317 | CG | GLU | H | 162 | 11.754 | −4.351 | 19.450 | 1.00 | 54.87 | C |
| ATOM | 4318 | CD | GLU | H | 162 | 13.076 | −4.487 | 20.202 | 1.00 | 59.43 | C |
| ATOM | 4319 | OE1 | GLU | H | 162 | 13.092 | −4.990 | 21.350 | 1.00 | 56.91 | O |
| ATOM | 4320 | OE2 | GLU | H | 162 | 14.111 | −4.095 | 19.628 | 1.00 | 65.42 | O1− |
| ATOM | 4321 | N | PRO | H | 163 | 10.239 | −2.646 | 23.128 | 1.00 | 51.25 | N |
| ATOM | 4322 | CA | PRO | H | 163 | 11.100 | −2.084 | 24.179 | 1.00 | 55.14 | C |
| ATOM | 4323 | C | PRO | H | 163 | 11.175 | −2.961 | 25.428 | 1.00 | 47.21 | C |
| ATOM | 4324 | O | PRO | H | 163 | 10.194 | −3.164 | 26.139 | 1.00 | 48.97 | O |
| ATOM | 4325 | CH | PRO | H | 163 | 10.476 | −0.708 | 24.459 | 1.00 | 53.84 | C |
| ATOM | 4326 | CG | PRO | H | 163 | 9.092 | −0.815 | 23.992 | 1.00 | 53.48 | C |
| ATOM | 4327 | CD | PRO | H | 163 | 9.050 | −1.823 | 22.880 | 1.00 | 47.36 | C |
| ATOM | 4328 | N | VAL | H | 164 | 12.351 | −3.524 | 25.671 | 1.00 | 48.85 | N |
| ATOM | 4329 | CA | VAL | H | 164 | 12.689 | −4.161 | 26.936 | 1.00 | 48.08 | C |
| ATOM | 4330 | C | VAL | H | 164 | 13.914 | −3.443 | 27.494 | 1.00 | 52.92 | C |
| ATOM | 4331 | O | VAL | H | 164 | 14.822 | −3.087 | 26.739 | 1.00 | 49.19 | O |
| ATOM | 4332 | CB | VAL | H | 164 | 12.951 | −5.674 | 26.746 | 1.00 | 49.72 | C |
| ATOM | 4333 | CG1 | VAL | H | 164 | 14.207 | −6.117 | 27.464 | 1.00 | 51.62 | C |
| ATOM | 4334 | CG2 | VAL | H | 164 | 11.765 | −6.485 | 27.230 | 1.00 | 19.90 | C |
| ATOM | 4335 | N | THR | H | 165 | 13.931 | −3.189 | 28.800 | 1.00 | 50.03 | N |
| ATOM | 4336 | CA | THR | H | 165 | 15.121 | −2.642 | 29.439 | 1.00 | 53.15 | C |
| ATOM | 4337 | C | THR | H | 165 | 15.700 | −3.666 | 30.403 | 1.00 | 53.17 | C |
| ATOM | 4338 | O | THR | H | 165 | 14.964 | −4.441 | 31.022 | 1.00 | 51.66 | O |
| ATOM | 4339 | CB | THR | H | 165 | 14.844 | −1.327 | 30.187 | 1.00 | 52.68 | C |
| ATOM | 4340 | OG1 | THR | H | 165 | 13.710 | −1.479 | 31.042 | 1.00 | 58.68 | O |
| ATOM | 4341 | CG2 | THR | H | 165 | 14.619 | −0.181 | 29.211 | 1.00 | 43.77 | C |
| ATOM | 4342 | N | VAL | H | 166 | 17.025 | −3.670 | 30.511 | 1.00 | 53.71 | N |
| ATOM | 4343 | CA | VAL | H | 166 | 17.747 | −4.587 | 31.383 | 1.00 | 54.30 | C |
| ATOM | 4344 | C | VAL | H | 166 | 18.840 | −3.809 | 32.097 | 1.00 | 55.61 | C |
| ATOM | 4345 | O | VAL | H | 166 | 19.600 | −3.072 | 31.461 | 1.00 | 53.02 | O |
| ATOM | 4346 | CB | VAL | H | 166 | 18.373 | −5.766 | 30.616 | 1.00 | 52.51 | C |
| ATOM | 4347 | CG1 | VAL | H | 166 | 18.914 | −6.798 | 31.595 | 1.00 | 53.90 | C |
| ATOM | 4348 | CG2 | VAL | H | 166 | 17.370 | −6.389 | 29.663 | 1.00 | 56.83 | C |
| ATOM | 4349 | N | SER | H | 167 | 18.924 | −3.983 | 33.410 | 1.00 | 55.46 | N |
| ATOM | 4350 | CA | SER | H | 167 | 20.040 | −3.503 | 34.208 | 1.00 | 55.76 | C |
| ATOM | 4351 | C | SER | H | 167 | 20.497 | −4.638 | 35.110 | 1.00 | 57.53 | C |
| ATOM | 4352 | O | SER | H | 167 | 19.823 | −5.663 | 35.248 | 1.00 | 62.15 | O |
| ATOM | 4353 | CB | SER | H | 167 | 19.657 | −2.273 | 35.044 | 1.00 | 60.05 | C |
| ATOM | 4354 | OG | SER | H | 167 | 19.008 | −2.664 | 36.240 | 1.00 | 58.22 | O |
| ATOM | 4355 | N | TRP | H | 168 | 21.648 | −4.451 | 35.742 | 1.00 | 58.07 | N |
| ATOM | 4356 | CA | TRP | H | 168 | 22.224 | −5.478 | 36.596 | 1.00 | 62.80 | C |
| ATOM | 4357 | C | TRP | H | 168 | 22.463 | −4.913 | 37.986 | 1.00 | 68.54 | C |
| ATOM | 4358 | O | TRP | H | 168 | 23.069 | −3.845 | 38.132 | 1.00 | 70.95 | O |
| ATOM | 4359 | CB | TRP | H | 168 | 23.519 | −6.022 | 35.992 | 1.00 | 66.71 | C |
| ATOM | 4360 | CG | TRP | H | 168 | 23.263 | −7.011 | 34.901 | 1.00 | 62.21 | C |
| ATOM | 4361 | CD1 | TRP | H | 168 | 23.212 | −6.765 | 33.561 | 1.00 | 57.69 | C |
| ATOM | 4362 | CD2 | TRP | H | 168 | 23.006 | −8.408 | 35.064 | 1.00 | 63.07 | C |
| ATOM | 4363 | NE1 | TRP | H | 168 | 22.946 | −7.929 | 32.878 | 1.00 | 59.26 | N |
| ATOM | 4364 | CE2 | TRP | H | 168 | 22.814 | −8.951 | 33.780 | 1.00 | 61.23 | C |
| ATOM | 4365 | CE3 | TRP | H | 168 | 22.922 | −9.255 | 36.175 | 1.00 | 62.36 | C |
| ATOM | 4366 | CZ2 | TRP | H | 168 | 22.539 | −10.300 | 33.578 | 1.00 | 61.52 | C |
| ATOM | 4367 | CZ3 | TRP | H | 168 | 22.653 | −10.593 | 35.972 | 1.00 | 62.24 | C |
| ATOM | 4368 | CH2 | TRP | H | 168 | 22.468 | −11.103 | 34.685 | 1.00 | 62.22 | C |
| ATOM | 4369 | N | ASN | H | 169 | 21.976 | −5.634 | 38.997 | 1.00 | 70.21 | N |
| ATOM | 4370 | CA | ASN | H | 169 | 22.080 | −5.230 | 40.398 | 1.00 | 72.49 | C |
| ATOM | 4371 | C | ASN | H | 169 | 21.560 | −3.807 | 40.604 | 1.00 | 73.33 | C |
| ATOM | 4372 | O | ASN | H | 169 | 22.239 | −2.941 | 41.160 | 1.00 | 74.70 | O |
| ATOM | 4373 | CB | ASN | H | 169 | 23.512 | −5.381 | 40.901 | 1.00 | 69.58 | C |
| ATOM | 4374 | CG | ASN | H | 169 | 23.897 | −6.821 | 41.092 | 1.00 | 72.29 | C |
| ATOM | 4375 | OD1 | ASN | H | 169 | 25.049 | −7.204 | 40.898 | 1.00 | 78.92 | O |
| ATOM | 4376 | ND2 | ASN | H | 169 | 22.926 | −7.639 | 41.467 | 1.00 | 71.91 | N |

TABLE 77-continued

| ATOM | 4377 | N | SER | H | 170 | 20.331 | −3.580 | 40.135 | 1.00 | 70.72 | N |
|---|---|---|---|---|---|---|---|---|---|---|---|
| ATOM | 4378 | CA | SER | H | 170 | 19.616 | −2.312 | 40.294 | 1.00 | 70.73 | C |
| ATOM | 4379 | C | SER | H | 170 | 20.398 | −1.132 | 39.730 | 1.00 | 70.45 | C |
| ATOM | 4380 | O | SER | H | 170 | 20.265 | −0.007 | 40.211 | 1.00 | 75.07 | O |
| ATOM | 4381 | CB | SER | H | 170 | 19.251 | −2.057 | 41.758 | 1.00 | 68.40 | C |
| ATOM | 4382 | OG | SER | H | 170 | 18.391 | −3.071 | 42.247 | 1.00 | 74.36 | O |
| ATOM | 4383 | N | GLY | H | 171 | 21.202 | −1.370 | 38.698 | 1.00 | 70.93 | N |
| ATOM | 4384 | CA | GLY | H | 171 | 21.998 | −0.329 | 38.086 | 1.00 | 67.69 | C |
| ATOM | 4385 | C | GLY | H | 171 | 23.404 | −0.201 | 38.625 | 1.00 | 73.64 | C |
| ATOM | 4386 | O | GLY | H | 171 | 24.156 | 0.663 | 38.152 | 1.00 | 72.01 | O |
| ATOM | 4387 | N | ALA | H | 172 | 23.789 | −1.037 | 39.593 | 1.00 | 73.76 | N |
| ATOM | 4388 | CA | ALA | H | 172 | 25.111 | −0.922 | 40.199 | 1.00 | 77.91 | C |
| ATOM | 4389 | C | ALA | H | 172 | 26.201 | −1.543 | 39.339 | 1.00 | 77.47 | C |
| ATOM | 4390 | O | ALA | H | 172 | 27.356 | −1.108 | 39.404 | 1.00 | 79.00 | O |
| ATOM | 4391 | CB | ALA | H | 172 | 25.117 | −1.569 | 41.584 | 1.00 | 76.43 | C |
| ATOM | 4392 | N | LEU | H | 173 | 25.871 | −2.556 | 38.544 | 1.00 | 76.67 | N |
| ATOM | 4393 | CA | LEU | H | 173 | 26.828 | −3.186 | 37.643 | 1.00 | 74.75 | C |
| ATOM | 4394 | C | LEU | H | 173 | 26.636 | −2.595 | 36.255 | 1.00 | 75.97 | C |
| ATOM | 4395 | O | LEU | H | 173 | 25.567 | −2.740 | 35.655 | 1.00 | 78.29 | O |
| ATOM | 4396 | CB | LEU | H | 173 | 26.652 | −4.702 | 37.617 | 1.00 | 73.05 | C |
| ATOM | 4397 | CG | LEU | H | 173 | 27.835 | −5.534 | 38.105 | 1.00 | 76.23 | C |
| ATOM | 4398 | CD1 | LEU | H | 173 | 27.658 | −6.977 | 37.682 | 1.00 | 74.71 | C |
| ATOM | 4399 | CD2 | LEU | H | 173 | 29.157 | −4.977 | 37.601 | 1.00 | 74.98 | C |
| ATOM | 4400 | N | THR | H | 174 | 27.664 | −1.916 | 35.753 | 1.00 | 73.72 | N |
| ATOM | 4401 | CA | THR | H | 174 | 27.678 | −1.456 | 34.375 | 1.00 | 78.11 | C |
| ATOM | 4402 | C | THR | H | 174 | 28.933 | −1.867 | 33.624 | 1.00 | 76.49 | C |
| ATOM | 4403 | O | THR | H | 174 | 28.978 | −1.709 | 32.400 | 1.00 | 78.20 | O |
| ATOM | 4404 | CB | THR | H | 174 | 27.533 | 0.074 | 34.308 | 1.00 | 80.95 | C |
| ATOM | 4405 | OG1 | THR | H | 174 | 28.560 | 0.690 | 35.093 | 1.00 | 85.18 | O |
| ATOM | 4406 | CG2 | THR | H | 174 | 26.173 | 0.512 | 34.827 | 1.00 | 77.34 | C |
| ATOM | 4407 | N | SER | H | 175 | 29.939 | −2.397 | 34.305 | 1.00 | 79.55 | N |
| ATOM | 4408 | CA | SER | H | 175 | 31.214 | −2.710 | 33.681 | 1.00 | 80.96 | C |
| ATOM | 4409 | C | SER | H | 175 | 31.207 | −4.162 | 33.222 | 1.00 | 77.31 | C |
| ATOM | 4410 | O | SER | H | 175 | 31.028 | −5.078 | 34.034 | 1.00 | 77.66 | O |
| ATOM | 4411 | CB | SER | H | 175 | 32.357 | −2.446 | 34.658 | 1.00 | 86.41 | C |
| ATOM | 4412 | OG | SER | H | 175 | 32.156 | −1.212 | 35.326 | 1.00 | 93.70 | O |
| ATOM | 4413 | N | GLY | H | 176 | 31.405 | −4.369 | 31.924 | 1.00 | 71.98 | N |
| ATOM | 4414 | CA | GLY | H | 176 | 31.348 | −5.700 | 31.366 | 1.00 | 67.99 | C |
| ATOM | 4415 | C | GLY | H | 176 | 29.959 | −6.189 | 31.031 | 1.00 | 65.42 | C |
| ATOM | 4416 | O | GLY | H | 176 | 29.785 | −7.391 | 30.805 | 1.00 | 61.07 | O |
| ATOM | 4417 | N | VAL | H | 177 | 28.962 | −5.302 | 30.991 | 1.00 | 65.06 | N |
| ATOM | 4418 | CA | VAL | H | 177 | 27.607 | −5.681 | 30.603 | 1.00 | 62.88 | C |
| ATOM | 4419 | C | VAL | H | 177 | 27.442 | −5.482 | 29.102 | 1.00 | 61.64 | C |
| ATOM | 4420 | O | VAL | H | 177 | 27.764 | −4.419 | 28.559 | 1.00 | 58.39 | O |
| ATOM | 4421 | CB | VAL | H | 177 | 26.549 | −4.884 | 31.390 | 1.00 | 62.76 | C |
| ATOM | 4422 | CG1 | VAL | H | 177 | 26.681 | −3.393 | 31.146 | 1.00 | 70.19 | C |
| ATOM | 4423 | CG2 | VAL | H | 177 | 25.152 | −5.347 | 31.007 | 1.00 | 58.90 | C |
| ATOM | 4424 | N | HIS | H | 178 | 26.966 | −6.520 | 28.422 | 1.00 | 58.97 | N |
| ATOM | 4425 | CA | HIS | H | 178 | 26.577 | −6.431 | 27.021 | 1.00 | 53.83 | C |
| ATOM | 4426 | C | HIS | H | 178 | 25.104 | −6.810 | 26.923 | 1.00 | 54.28 | C |
| ATOM | 4427 | O | HIS | H | 178 | 24.736 | −7.963 | 27.166 | 1.00 | 53.40 | O |
| ATOM | 4428 | CB | HIS | H | 178 | 27.445 | −7.333 | 26.150 | 1.00 | 52.46 | C |
| ATOM | 4429 | CG | HIS | H | 178 | 28.811 | −6.783 | 25.891 | 1.00 | 62.52 | C |
| ATOM | 4430 | ND1 | HIS | H | 178 | 29.964 | −7.460 | 26.231 | 1.00 | 66.01 | N |
| ATOM | 4431 | CD2 | HIS | H | 178 | 29.210 | −5.620 | 25.325 | 1.00 | 60.81 | C |
| ATOM | 4432 | CE1 | HIS | H | 178 | 31.014 | −6.738 | 25.883 | 1.00 | 57.92 | C |
| ATOM | 4433 | NE2 | HIS | H | 178 | 30.584 | −5.618 | 25.331 | 1.00 | 65.12 | N |
| ATOM | 4434 | N | THR | H | 179 | 24.259 | −5.837 | 26.609 | 1.00 | 46.07 | N |
| ATOM | 4435 | CA | THR | H | 179 | 22.859 | −6.102 | 26.323 | 1.00 | 51.21 | C |
| ATOM | 4436 | C | THR | H | 179 | 22.688 | −6.082 | 24.810 | 1.00 | 45.65 | C |
| ATOM | 4437 | O | THR | H | 179 | 22.902 | −5.050 | 24.172 | 1.00 | 48.65 | O |
| ATOM | 4438 | CB | THR | H | 179 | 21.943 | −5.089 | 27.011 | 1.00 | 48.82 | C |
| ATOM | 4439 | OG1 | THR | H | 179 | 21.960 | −5.323 | 28.425 | 1.00 | 47.00 | O |
| ATOM | 4440 | CG2 | THR | H | 179 | 20.521 | −5.258 | 26.507 | 1.00 | 48.25 | C |
| ATOM | 4441 | N | PHE | H | 180 | 22.345 | −7.226 | 24.244 | 1.00 | 48.63 | N |
| ATOM | 4442 | CA | PHE | H | 180 | 22.351 | −7.397 | 22.801 | 1.00 | 50.74 | C |
| ATOM | 4443 | C | PHE | H | 180 | 21.064 | −6.875 | 22.171 | 1.00 | 48.34 | C |
| ATOM | 4444 | O | PHE | H | 180 | 20.016 | −6.855 | 22.818 | 1.00 | 50.17 | O |
| ATOM | 4445 | CB | PHE | H | 180 | 22.531 | −8.867 | 22.452 | 1.00 | 46.20 | C |
| ATOM | 4446 | CG | PHE | H | 180 | 23.905 | −9.375 | 22.726 | 1.00 | 46.66 | C |
| ATOM | 4447 | CD1 | PHE | H | 180 | 24.249 | −9.837 | 23.982 | 1.00 | 48.14 | C |
| ATOM | 4448 | CD2 | PHE | H | 180 | 24.864 | −9.361 | 21.729 | 1.00 | 46.17 | C |
| ATOM | 4449 | CE1 | PHE | H | 180 | 25.528 | −10.295 | 24.236 | 1.00 | 52.06 | C |
| ATOM | 4450 | CE2 | PHE | H | 180 | 26.144 | −9.816 | 21.973 | 1.00 | 46.25 | C |
| ATOM | 4451 | CZ | PHE | H | 180 | 26.478 | −10.287 | 23.226 | 1.00 | 46.84 | C |
| ATOM | 4452 | N | PRO | H | 181 | 21.121 | −6.445 | 20.911 | 1.00 | 49.35 | N |
| ATOM | 4453 | CA | PRO | H | 181 | 19.887 | −6.067 | 20.215 | 1.00 | 50.49 | C |
| ATOM | 4454 | C | PRO | H | 181 | 18.930 | −7.248 | 20.131 | 1.00 | 46.25 | C |
| ATOM | 4455 | O | PRO | H | 181 | 19.330 | −8.387 | 19.887 | 1.00 | 45.77 | O |
| ATOM | 4456 | CB | PRO | H | 181 | 20.371 | −5.635 | 18.823 | 1.00 | 49.27 | C |

TABLE 77-continued

| ATOM | 4457 | CG | PRO | H | 181 | 21.837 | −5.473 | 18.938 | 1.00 | 49.96 | C |
|---|---|---|---|---|---|---|---|---|---|---|---|
| ATOM | 4458 | CD | PRO | H | 181 | 22.289 | −6.397 | 20.019 | 1.00 | 48.28 | C |
| ATOM | 4459 | N | ALA | H | 182 | 17.657 | −6.964 | 20.360 | 1.00 | 44.95 | N |
| ATOM | 4460 | CA | ALA | H | 182 | 16.634 | −7.990 | 20.279 | 1.00 | 47.84 | C |
| ATOM | 4461 | C | ALA | H | 182 | 16.548 | −8.548 | 18.868 | 1.00 | 45.10 | C |
| ATOM | 4462 | O | ALA | H | 182 | 16.742 | −7.838 | 17.883 | 1.00 | 47.12 | O |
| ATOM | 4463 | CB | ALA | H | 182 | 15.281 | −7.420 | 20.694 | 1.00 | 46.60 | C |
| ATOM | 4464 | N | VAL | H | 183 | 16.243 | −9.833 | 18.772 | 1.00 | 45.78 | N |
| ATOM | 4465 | CA | VAL | H | 183 | 16.018 | −10.482 | 17.488 | 1.00 | 45.55 | C |
| ATOM | 4466 | C | VAL | H | 183 | 14.552 | −10.889 | 17.406 | 1.00 | 47.21 | C |
| ATOM | 4467 | O | VAL | H | 183 | 13.961 | −11.311 | 18.403 | 1.00 | 44.68 | O |
| ATOM | 4468 | CB | VAL | H | 183 | 16.962 | −11.691 | 17.290 | 1.00 | 52.33 | C |
| ATOM | 4469 | CG1 | VAL | H | 183 | 16.564 | −12.873 | 18.185 | 1.00 | 52.06 | C |
| ATOM | 4470 | CG2 | VAL | H | 183 | 17.008 | −12.094 | 15.836 | 1.00 | 59.89 | C |
| ATOM | 4471 | N | LEU | H | 184 | 13.956 | −10.715 | 16.228 | 1.00 | 46.84 | N |
| ATOM | 4472 | CA | LEU | H | 184 | 12.580 | −11.130 | 15.973 | 1.00 | 50.61 | C |
| ATOM | 4473 | C | LEU | H | 184 | 12.578 | −12.570 | 15.475 | 1.00 | 51.34 | C |
| ATOM | 4474 | O | LEU | H | 184 | 13.166 | −12.869 | 14.435 | 1.00 | 53.12 | O |
| ATOM | 4475 | CB | LEU | H | 184 | 11.908 | −10.214 | 14.953 | 1.00 | 46.09 | C |
| ATOM | 4476 | CG | LEU | H | 184 | 10.449 | −10.538 | 14.629 | 1.00 | 51.67 | C |
| ATOM | 4477 | CD1 | LEU | H | 184 | 9.582 | −10.412 | 15.870 | 1.00 | 46.49 | C |
| ATOM | 1478 | CD2 | LEU | H | 184 | 9.934 | −9.626 | 13.527 | 1.00 | 51.76 | C |
| ATOM | 4479 | N | GLN | H | 185 | 11.920 | −13.452 | 16.216 | 1.00 | 51.30 | N |
| ATOM | 4480 | CA | GLN | H | 185 | 11.876 | −14.869 | 15.897 | 1.00 | 48.74 | C |
| ATOM | 4481 | C | GLN | H | 185 | 10.743 | −15.172 | 14.911 | 1.00 | 53.82 | C |
| ATOM | 4482 | O | GLN | H | 185 | 9.908 | −14.319 | 14.598 | 1.00 | 50.03 | O |
| ATOM | 4483 | CB | GLN | H | 185 | 11.712 | −15.681 | 17.183 | 1.00 | 52.60 | C |
| ATOM | 4484 | CG | GLN | H | 185 | 12.652 | −15.255 | 18.324 | 1.00 | 48.65 | C |
| ATOM | 4485 | CD | GLN | H | 185 | 12.219 | −15.807 | 19.677 | 1.00 | 56.53 | C |
| ATOM | 4486 | OE1 | GLN | H | 185 | 12.916 | −16.620 | 20.286 | 1.00 | 56.63 | O |
| ATOM | 4487 | NE2 | GLN | H | 185 | 11.059 | −15.365 | 20.151 | 1.00 | 51.17 | N |
| ATOM | 4488 | N | SER | H | 186 | 10.720 | −16.422 | 14.428 | 1.00 | 54.27 | N |
| ATOM | 4489 | CA | SER | H | 186 | 9.686 | −16.854 | 13.487 | 1.00 | 61.97 | C |
| ATOM | 4490 | C | SER | H | 186 | 8.294 | −16.751 | 14.093 | 1.00 | 58.25 | C |
| ATOM | 4491 | O | SER | H | 186 | 7.319 | −16.513 | 13.373 | 1.00 | 61.23 | O |
| ATOM | 4492 | CB | SER | H | 186 | 9.933 | −18.297 | 13.042 | 1.00 | 55.30 | O |
| ATOM | 4493 | OG | SER | H | 186 | 11.311 | −18.561 | 12.874 | 1.00 | 68.18 | O |
| ATOM | 4494 | N | SER | H | 187 | 8.180 | −16.943 | 15.406 | 1.00 | 59.14 | N |
| ATOM | 4495 | CA | SER | H | 187 | 6.904 | −16.804 | 16.092 | 1.00 | 57.99 | C |
| ATOM | 4496 | C | SER | H | 187 | 6.347 | −15.390 | 16.033 | 1.00 | 55.44 | C |
| ATOM | 4497 | O | SER | H | 187 | 5.204 | −15.178 | 16.450 | 1.00 | 63.23 | O |
| ATOM | 4498 | CB | SER | H | 187 | 7.059 | −17.214 | 17.555 | 1.00 | 55.43 | C |
| ATOM | 4499 | OG | SER | H | 187 | 8.061 | −16.432 | 18.180 | 1.00 | 52.55 | O |
| ATOM | 4500 | N | GLY | H | 188 | 7.116 | −14.423 | 15.541 | 1.00 | 54.11 | N |
| ATOM | 4501 | CA | GLY | H | 188 | 6.732 | −13.034 | 15.640 | 1.00 | 52.19 | C |
| ATOM | 4502 | C | GLY | H | 188 | 7.000 | −12.402 | 16.986 | 1.00 | 49.48 | C |
| ATOM | 4503 | O | GLY | H | 188 | 6.639 | −11.239 | 17.188 | 1.00 | 54.62 | O |
| ATOM | 4504 | N | LEU | H | 189 | 7.616 | −13.124 | 17.911 | 1.00 | 49.75 | N |
| ATOM | 4505 | CA | LEU | H | 189 | 7.993 | −12.601 | 19.216 | 1.00 | 48.75 | C |
| ATOM | 4506 | C | LEU | H | 189 | 9.489 | −12.291 | 19.252 | 1.00 | 47.13 | C |
| ATOM | 4507 | O | LEU | H | 189 | 10.289 | −12.926 | 18.563 | 1.00 | 48.23 | O |
| ATOM | 4508 | CB | LEU | H | 189 | 7.645 | −13.610 | 20.312 | 1.00 | 50.96 | C |
| ATOM | 4509 | CG | LEU | H | 189 | 6.370 | −13.511 | 21.160 | 1.00 | 57.97 | C |
| ATOM | 4510 | CD1 | LEU | H | 189 | 5.264 | −12.649 | 20.552 | 1.00 | 46.22 | C |
| ATOM | 4511 | CD2 | LEU | H | 189 | 5.886 | −14.916 | 21.424 | 1.00 | 49.74 | C |
| ATOM | 4512 | N | TYR | H | 190 | 9.858 | −11.311 | 20.073 | 1.00 | 44.33 | N |
| ATOM | 4513 | CA | TYR | H | 190 | 11.245 | −10.914 | 20.240 | 1.00 | 43.90 | C |
| ATOM | 4514 | C | TYR | H | 190 | 11.919 | −11.736 | 21.326 | 1.00 | 45.28 | C |
| ATOM | 4515 | O | TYR | H | 190 | 11.278 | −12.310 | 22.207 | 1.00 | 46.53 | O |
| ATOM | 4516 | CB | TYR | H | 190 | 11.367 | −9.434 | 20.604 | 1.00 | 45.23 | C |
| ATOM | 4517 | CG | TYR | H | 190 | 10.984 | −8.488 | 19.499 | 1.00 | 48.85 | C |
| ATOM | 4518 | CD1 | TYR | H | 190 | 11.920 | −8.067 | 18.560 | 1.00 | 46.39 | C |
| ATOM | 4519 | CD2 | TYR | H | 190 | 9.686 | −8.002 | 19.398 | 1.00 | 49.61 | C |
| ATOM | 4520 | CE1 | TYR | H | 190 | 11.570 | −7.189 | 17.546 | 1.00 | 48.34 | C |
| ATOM | 4521 | CE2 | TYR | H | 190 | 9.332 | −7.129 | 18.388 | 1.00 | 48.93 | C |
| ATOM | 4522 | CZ | TYR | H | 190 | 10.277 | −6.726 | 17.468 | 1.00 | 47.61 | C |
| ATOM | 4523 | OH | TYR | H | 190 | 9.917 | −5.848 | 16.475 | 1.00 | 55.43 | O |
| ATOM | 4524 | N | SER | H | 191 | 13.239 | −11.766 | 21.260 | 1.00 | 45.26 | N |
| ATOM | 4525 | CA | SER | H | 191 | 14.044 | −12.384 | 22.292 | 1.00 | 45.46 | C |
| ATOM | 4526 | C | SER | H | 191 | 15.356 | −11.623 | 22.356 | 1.00 | 45.91 | C |
| ATOM | 4527 | O | SER | H | 191 | 15.872 | −11.157 | 21.338 | 1.00 | 47.29 | O |
| ATOM | 4528 | CB | SER | H | 191 | 14.262 | −13.878 | 22.014 | 1.00 | 48.74 | C |
| ATOM | 4529 | OG | SER | H | 191 | 15.163 | −14.443 | 22.949 | 1.00 | 58.57 | O |
| ATOM | 4530 | N | LEU | H | 192 | 15.875 | −11.473 | 23.566 | 1.00 | 44.84 | N |
| ATOM | 4531 | CA | LEU | H | 192 | 17.079 | −10.692 | 23.779 | 1.00 | 43.07 | C |
| ATOM | 4532 | C | LEU | H | 192 | 17.881 | −11.347 | 24.890 | 1.00 | 45.41 | C |
| ATOM | 4533 | O | LEU | H | 192 | 17.324 | −12.029 | 25.752 | 1.00 | 49.98 | O |
| ATOM | 4534 | CB | LEU | H | 192 | 16.714 | −9.236 | 24.116 | 1.00 | 47.63 | C |
| ATOM | 4535 | CG | LEU | H | 192 | 17.635 | −8.252 | 24.835 | 1.00 | 52.78 | C |
| ATOM | 4536 | CD1 | LEU | H | 192 | 17.152 | −6.849 | 24.522 | 1.00 | 51.90 | C |

TABLE 77-continued

| | | | | | | | | | | |
|---|---|---|---|---|---|---|---|---|---|---|
| ATOM | 4537 | CD2 | LEU | H | 192 | 17.642 | −8.461 | 26.341 | 1.00 | 44.90 | C |
| ATOM | 4538 | N | SER | H | 193 | 19.191 | −11.135 | 24.866 | 1.00 | 47.77 | N |
| ATOM | 4539 | CA | SER | H | 193 | 20.063 | −11.591 | 25.933 | 1.00 | 44.79 | C |
| ATOM | 4540 | C | SER | H | 193 | 20.870 | −10.416 | 26.467 | 1.00 | 45.92 | C |
| ATOM | 4541 | O | SER | H | 193 | 21.221 | −9.492 | 25.727 | 1.00 | 44.62 | O |
| ATOM | 4542 | CB | SER | H | 193 | 20.998 | −12.717 | 25.460 | 1.00 | 48.98 | C |
| ATOM | 4543 | OG | SER | H | 193 | 21.730 | −12.327 | 24.311 | 1.00 | 52.73 | O |
| ATOM | 4544 | N | SER | H | 194 | 21.128 | −10.444 | 27.766 | 1.00 | 48.41 | N |
| ATOM | 4545 | CA | SER | H | 194 | 22.019 | −9.498 | 28.414 | 1.00 | 43.65 | C |
| ATOM | 4546 | C | SER | H | 194 | 23.038 | −10.310 | 29.186 | 1.00 | 50.00 | C |
| ATOM | 4547 | O | SER | H | 194 | 22.673 | −11.225 | 29.923 | 1.00 | 49.23 | O |
| ATOM | 4548 | CB | SER | H | 194 | 21.279 | −8.553 | 29.354 | 1.00 | 49.34 | C |
| ATOM | 4549 | OG | SER | H | 194 | 22.174 | −7.590 | 29.879 | 1.00 | 51.36 | O |
| ATOM | 1550 | N | VAL | H | 195 | 21.305 | −9.986 | 29.012 | 1.00 | 48.91 | N |
| ATOM | 4551 | CA | VAL | H | 195 | 25.365 | −10.782 | 29.599 | 1.00 | 55.46 | C |
| ATOM | 4552 | C | VAL | H | 195 | 26.337 | −9.851 | 30.308 | 1.00 | 57.76 | C |
| ATOM | 4553 | O | VAL | H | 195 | 26.445 | −8.665 | 29.980 | 1.00 | 54.06 | O |
| ATOM | 4554 | CB | VAL | H | 195 | 26.063 | −11.636 | 28.523 | 1.00 | 55.32 | C |
| ATOM | 4555 | CG1 | VAL | H | 195 | 27.293 | −10.932 | 27.998 | 1.00 | 56.31 | C |
| ATOM | 4556 | CG2 | VAL | H | 195 | 26.365 | −13.025 | 29.060 | 1.00 | 58.59 | C |
| ATOM | 4557 | N | VAL | H | 196 | 27.031 | −10.388 | 31.306 | 1.00 | 59.96 | N |
| ATOM | 4558 | CA | VAL | H | 196 | 28.013 | −9.617 | 32.055 | 1.00 | 56.43 | C |
| ATOM | 4559 | C | VAL | H | 196 | 29.175 | −10.531 | 32.422 | 1.00 | 61.28 | C |
| ATOM | 4560 | O | VAL | H | 196 | 28.975 | −11.701 | 32.764 | 1.00 | 62.49 | O |
| ATOM | 4561 | CB | VAL | H | 196 | 27.384 | −8.957 | 33.303 | 1.00 | 59.19 | C |
| ATOM | 4562 | CG1 | VAL | H | 196 | 26.874 | −9.998 | 34.278 | 1.00 | 60.45 | C |
| ATOM | 4563 | CG2 | VAL | H | 196 | 28.377 | −8.016 | 33.976 | 1.00 | 64.27 | C |
| ATOM | 4564 | N | THR | H | 197 | 30.391 | −10.002 | 32.322 | 1.00 | 57.86 | N |
| ATOM | 4565 | CA | THR | H | 197 | 31.590 | −10.707 | 32.754 | 1.00 | 61.05 | C |
| ATOM | 4566 | C | THR | H | 197 | 31.977 | −10.218 | 34.141 | 1.00 | 67.79 | C |
| ATOM | 4567 | O | THR | H | 197 | 32.068 | −9.008 | 34.379 | 1.00 | 66.70 | O |
| ATOM | 4568 | CB | THR | H | 197 | 32.744 | −10.508 | 31.773 | 1.00 | 55.42 | C |
| ATOM | 4569 | OG1 | THR | H | 197 | 32.666 | −9.198 | 31.195 | 1.00 | 67.73 | O |
| ATOM | 4570 | CG2 | THR | H | 197 | 32.666 | −11.536 | 30.673 | 1.00 | 58.33 | C |
| ATOM | 4571 | N | VAL | H | 198 | 32.170 | −11.160 | 35.056 | 1.00 | 70.23 | N |
| ATOM | 4572 | CA | VAL | H | 198 | 32.433 | −10.839 | 36.458 | 1.00 | 72.67 | C |
| ATOM | 4573 | C | VAL | H | 198 | 33.691 | −11.576 | 36.884 | 1.00 | 75.55 | C |
| ATOM | 4574 | O | VAL | H | 198 | 34.097 | −12.567 | 36.252 | 1.00 | 69.16 | O |
| ATOM | 4575 | CB | VAL | H | 198 | 31.235 | −11.216 | 37.365 | 1.00 | 69.88 | C |
| ATOM | 4576 | CG1 | VAL | H | 198 | 29.944 | −10.594 | 36.855 | 1.00 | 68.55 | C |
| ATOM | 4577 | CG2 | VAL | H | 198 | 31.107 | −12.725 | 37.487 | 1.00 | 66.85 | C |
| ATOM | 4578 | N | PRO | H | 199 | 34.350 | −11.112 | 37.947 | 1.00 | 77.45 | N |
| ATOM | 4579 | CA | PRO | H | 199 | 35.420 | −11.917 | 38.546 | 1.00 | 76.34 | C |
| ATOM | 4580 | C | PRO | H | 199 | 34.870 | −13.264 | 38.982 | 1.00 | 74.20 | C |
| ATOM | 4581 | O | PRO | H | 199 | 33.889 | −13.343 | 39.725 | 1.00 | 74.44 | O |
| ATOM | 4582 | CB | PRO | H | 199 | 35.881 | −11.069 | 39.737 | 1.00 | 76.92 | C |
| ATOM | 4583 | CG | PRO | H | 199 | 34.737 | −10.142 | 40.014 | 1.00 | 79.92 | C |
| ATOM | 4584 | CD | PRO | H | 199 | 34.147 | −9.846 | 38.673 | 1.00 | 78.11 | C |
| ATOM | 4585 | N | SER | H | 200 | 35.497 | −14.331 | 38.489 | 1.00 | 69.17 | N |
| ATOM | 1586 | CA | SER | H | 200 | 35.035 | −15.674 | 38.813 | 1.00 | 73.87 | C |
| ATOM | 4587 | C | SER | H | 200 | 35.142 | −15.981 | 40.304 | 1.00 | 80.27 | C |
| ATOM | 4588 | O | SER | H | 200 | 34.446 | −16.880 | 40.790 | 1.00 | 77.51 | O |
| ATOM | 4589 | CB | SER | H | 200 | 35.820 | −16.702 | 37.995 | 1.00 | 75.81 | C |
| ATOM | 4590 | OG | SER | H | 200 | 37.220 | −16.520 | 38.153 | 1.00 | 82.81 | O |
| ATOM | 4591 | N | SER | H | 201 | 35.987 | −15.249 | 41.041 | 1.00 | 84.33 | N |
| ATOM | 4592 | CA | SER | H | 201 | 36.099 | −15.463 | 42.483 | 1.00 | 84.00 | C |
| ATOM | 4593 | C | SER | H | 201 | 34.842 | −15.023 | 43.221 | 1.00 | 82.31 | C |
| ATOM | 4594 | O | SER | H | 201 | 34.514 | −15.587 | 44.272 | 1.00 | 83.85 | O |
| ATOM | 4595 | CB | SER | H | 201 | 37.307 | −14.709 | 43.038 | 1.00 | 77.99 | C |
| ATOM | 4596 | OG | SER | H | 201 | 36.983 | −13.345 | 43.259 | 1.00 | 84.71 | O |
| ATOM | 4597 | N | SER | H | 202 | 34.133 | −14.028 | 42.693 | 1.00 | 84.81 | N |
| ATOM | 4598 | CA | SER | H | 202 | 32.968 | −13.447 | 43.351 | 1.00 | 82.23 | C |
| ATOM | 4599 | C | SER | H | 202 | 31.698 | −14.263 | 43.163 | 1.00 | 83.56 | C |
| ATOM | 4600 | O | SER | H | 202 | 30.616 | −13.774 | 43.508 | 1.00 | 82.37 | O |
| ATOM | 4601 | CB | SER | H | 202 | 32.728 | −12.030 | 42.830 | 1.00 | 81.25 | C |
| ATOM | 4602 | OG | SER | H | 202 | 32.331 | −12.066 | 41.469 | 1.00 | 81.40 | O |
| ATOM | 4603 | N | LEU | H | 203 | 31.790 | −15.481 | 42.629 | 1.00 | 80.56 | N |
| ATOM | 4604 | CA | LEU | H | 203 | 30.574 | −16.217 | 42.304 | 1.00 | 82.52 | C |
| ATOM | 4605 | C | LEU | H | 203 | 29.871 | −16.738 | 43.552 | 1.00 | 85.87 | C |
| ATOM | 4606 | O | LEU | H | 203 | 28.660 | −16.985 | 43.519 | 1.00 | 87.40 | O |
| ATOM | 4607 | CB | LEU | H | 203 | 30.892 | −17.362 | 41.342 | 1.00 | 80.73 | C |
| ATOM | 4608 | CG | LEU | H | 203 | 31.144 | −16.918 | 39.897 | 1.00 | 75.21 | C |
| ATOM | 4609 | CD1 | LEU | H | 203 | 31.185 | −18.112 | 38.961 | 1.00 | 74.36 | C |
| ATOM | 4610 | CD2 | LEU | H | 203 | 30.087 | −15.919 | 39.446 | 1.00 | 74.83 | C |
| ATOM | 4611 | N | GLY | H | 204 | 30.596 | −16.907 | 44.651 | 1.00 | 86.18 | N |
| ATOM | 4612 | CA | GLY | H | 204 | 29.971 | −17.333 | 45.886 | 1.00 | 87.69 | C |
| ATOM | 4613 | C | GLY | H | 204 | 29.696 | −16.174 | 46.818 | 1.00 | 87.81 | C |
| ATOM | 4614 | O | GLY | H | 204 | 28.946 | −16.310 | 47.789 | 1.00 | 91.93 | O |
| ATOM | 4615 | N | THR | H | 205 | 30.297 | −15.023 | 46.515 | 1.00 | 86.24 | N |
| ATOM | 4616 | CA | THR | H | 205 | 30.189 | −13.826 | 47.341 | 1.00 | 86.47 | C |

TABLE 77-continued

| | | | | | | | | | | |
|---|---|---|---|---|---|---|---|---|---|---|
| ATOM | 4617 | C | THR | H | 205 | 29.128 | −12.857 | 46.830 | 1.00 | 87.86 | C |
| ATOM | 4618 | O | THR | H | 205 | 28.181 | −12.528 | 47.550 | 1.00 | 91.34 | O |
| ATOM | 4619 | CB | THR | H | 205 | 31.548 | −13.120 | 47.403 | 1.00 | 85.33 | C |
| ATOM | 4620 | OG1 | THR | H | 205 | 32.528 | −14.017 | 47.934 | 1.00 | 88.61 | O |
| ATOM | 4621 | CG2 | THR | H | 205 | 31.470 | −11.882 | 48.283 | 1.00 | 86.87 | C |
| ATOM | 4622 | N | GLN | H | 206 | 29.278 | −12.384 | 45.597 | 1.00 | 87.77 | N |
| ATOM | 4623 | CA | GLN | H | 206 | 28.459 | −11.295 | 45.082 | 1.00 | 88.15 | C |
| ATOM | 4624 | C | GLN | H | 206 | 27.195 | −11.836 | 44.422 | 1.00 | 88.25 | C |
| ATOM | 4625 | O | GLN | H | 206 | 27.260 | −12.742 | 43.584 | 1.00 | 83.97 | O |
| ATOM | 4626 | CB | GLN | H | 206 | 29.259 | −10.452 | 44.088 | 1.00 | 83.53 | C |
| ATOM | 4627 | CG | GLN | H | 206 | 28.510 | −9.237 | 43.578 | 1.00 | 83.02 | C |
| ATOM | 4628 | CD | GLN | H | 206 | 28.070 | −8.321 | 44.701 | 1.00 | 84.91 | C |
| ATOM | 4629 | OE1 | GLN | H | 206 | 28.846 | −8.013 | 45.605 | 1.00 | 87.57 | O |
| ATOM | 4630 | NE2 | GLN | H | 206 | 26.819 | −7.887 | 44.654 | 1.00 | 79.11 | N |
| ATOM | 4631 | N | THR | H | 207 | 26.051 | −11.273 | 44.807 | 1.00 | 85.42 | N |
| ATOM | 4632 | CA | THR | H | 207 | 24.773 | −11.619 | 44.200 | 1.00 | 84.18 | C |
| ATOM | 4633 | C | THR | H | 207 | 24.561 | −10.819 | 42.918 | 1.00 | 82.54 | C |
| ATOM | 4634 | O | THR | H | 207 | 24.698 | −9.591 | 42.907 | 1.00 | 78.64 | O |
| ATOM | 4635 | CB | THR | H | 207 | 23.631 | −11.364 | 45.185 | 1.00 | 82.57 | C |
| ATOM | 4636 | OG1 | THR | H | 207 | 23.521 | −12.474 | 46.085 | 1.00 | 83.32 | O |
| ATOM | 4637 | CG2 | THR | H | 207 | 22.307 | −11.177 | 44.453 | 1.00 | 84.24 | C |
| ATOM | 4638 | N | TYR | H | 208 | 24.226 | −11.521 | 41.838 | 1.00 | 82.12 | N |
| ATOM | 4639 | CA | TYR | H | 208 | 24.001 | −10.906 | 40.536 | 1.00 | 76.27 | C |
| ATOM | 4640 | C | TYR | H | 208 | 22.540 | −11.088 | 40.156 | 1.00 | 71.03 | C |
| ATOM | 4641 | O | TYR | H | 208 | 22.050 | −12.219 | 40.086 | 1.00 | 66.71 | O |
| ATOM | 4642 | CB | TYR | H | 208 | 24.933 | −11.511 | 39.488 | 1.00 | 74.71 | C |
| ATOM | 4643 | CG | TYR | H | 208 | 26.386 | −11.238 | 39.786 | 1.00 | 73.89 | C |
| ATOM | 4644 | CD1 | TYR | H | 208 | 26.920 | −9.973 | 39.598 | 1.00 | 74.40 | C |
| ATOM | 4645 | CD2 | TYR | H | 208 | 27.219 | −12.235 | 40.274 | 1.00 | 75.14 | C |
| ATOM | 4646 | CE1 | TYR | H | 208 | 28.243 | −9.707 | 39.874 | 1.00 | 75.07 | C |
| ATOM | 4647 | CE2 | TYR | H | 208 | 28.553 | −11.977 | 40.555 | 1.00 | 78.93 | C |
| ATOM | 4648 | CZ | TYR | H | 208 | 29.055 | −10.708 | 40.352 | 1.00 | 76.25 | C |
| ATOM | 4649 | OH | TYR | H | 208 | 30.375 | −10.431 | 40.622 | 1.00 | 79.07 | O |
| ATOM | 4650 | N | ILE | H | 209 | 21.846 | −9.977 | 39.927 | 1.00 | 73.09 | N |
| ATOM | 4651 | CA | ILE | H | 209 | 20.406 | −9.984 | 39.719 | 1.00 | 68.77 | C |
| ATOM | 4652 | C | ILE | H | 209 | 20.080 | −9.293 | 38.406 | 1.00 | 69.54 | C |
| ATOM | 4653 | O | ILE | H | 209 | 20.601 | −8.209 | 38.115 | 1.00 | 63.44 | O |
| ATOM | 4654 | CB | ILE | H | 209 | 19.651 | −9.314 | 40.884 | 1.00 | 71.55 | C |
| ATOM | 4655 | CG1 | ILE | H | 209 | 19.684 | −10.228 | 42.114 | 1.00 | 76.87 | C |
| ATOM | 4656 | CG2 | ILE | H | 209 | 18.223 | −8.963 | 40.472 | 1.00 | 64.54 | C |
| ATOM | 4657 | CD1 | ILE | H | 209 | 18.444 | −10.168 | 42.980 | 1.00 | 72.21 | C |
| ATOM | 4658 | N | CYS | H | 210 | 19.218 | −9.932 | 37.622 | 1.00 | 68.04 | N |
| ATOM | 4659 | CA | CYS | H | 210 | 18.645 | −9.353 | 36.417 | 1.00 | 69.70 | C |
| ATOM | 4660 | C | CYS | H | 210 | 17.491 | −8.435 | 36.774 | 1.00 | 61.95 | C |
| ATOM | 4661 | O | CYS | H | 210 | 16.526 | −8.880 | 37.397 | 1.00 | 68.98 | O |
| ATOM | 4662 | CB | CYS | H | 210 | 18.109 | −10.454 | 35.519 | 1.00 | 69.60 | C |
| ATOM | 4663 | SG | CYS | H | 210 | 18.597 | −10.268 | 33.886 | 1.00 | 80.65 | S |
| ATOM | 4664 | N | ASN | H | 211 | 17.553 | −7.184 | 36.340 | 1.00 | 58.73 | N |
| ATOM | 4665 | CA | ASN | H | 211 | 16.416 | −6.270 | 36.440 | 1.00 | 59.09 | C |
| ATOM | 4666 | C | ASN | H | 211 | 15.864 | −6.073 | 35.035 | 1.00 | 52.69 | C |
| ATOM | 4667 | O | ASN | H | 211 | 16.441 | −5.341 | 34.229 | 1.00 | 50.51 | O |
| ATOM | 4668 | CB | ASN | H | 211 | 16.823 | −4.946 | 37.073 | 1.00 | 61.01 | C |
| ATOM | 4669 | CG | ASN | H | 211 | 17.702 | −5.139 | 38.279 | 1.00 | 62.79 | C |
| ATOM | 4670 | OD1 | ASN | H | 211 | 18.849 | −4.702 | 38.294 | 1.00 | 62.10 | O |
| ATOM | 4671 | ND2 | ASN | H | 211 | 17.178 | −5.823 | 39.292 | 1.00 | 57.55 | N |
| ATOM | 4672 | N | VAL | H | 212 | 14.750 | −6.737 | 34.749 | 1.00 | 50.42 | N |
| ATOM | 4673 | CA | VAL | H | 212 | 14.122 | −6.713 | 33.432 | 1.00 | 56.33 | C |
| ATOM | 4674 | C | VAL | H | 212 | 12.779 | −6.008 | 33.551 | 1.00 | 51.97 | C |
| ATOM | 4675 | O | VAL | H | 212 | 11.982 | −6.329 | 34.436 | 1.00 | 45.88 | O |
| ATOM | 4676 | CB | VAL | H | 212 | 13.942 | −8.133 | 32.864 | 1.00 | 49.03 | C |
| ATOM | 4677 | CG1 | VAL | H | 212 | 13.276 | −8.086 | 31.500 | 1.00 | 50.42 | C |
| ATOM | 4678 | CG2 | VAL | H | 212 | 15.291 | −8.859 | 32.775 | 1.00 | 53.82 | C |
| ATOM | 4679 | N | ASN | H | 213 | 12.526 | −5.063 | 32.648 | 1.00 | 50.88 | N |
| ATOM | 4680 | CA | ASN | H | 213 | 11.255 | −4.360 | 32.574 | 1.00 | 49.03 | C |
| ATOM | 4681 | C | ASN | H | 213 | 10.748 | −4.369 | 31.142 | 1.00 | 52.91 | C |
| ATOM | 4682 | O | ASN | H | 213 | 11.472 | −3.976 | 30.222 | 1.00 | 51.01 | O |
| ATOM | 4683 | CB | ASN | H | 213 | 11.384 | −2.918 | 33.069 | 1.00 | 55.32 | C |
| ATOM | 4684 | CG | ASN | H | 213 | 11.110 | −2.793 | 34.545 | 1.00 | 66.14 | C |
| ATOM | 4685 | OD1 | ASN | H | 213 | 12.027 | −2.854 | 35.362 | 1.00 | 68.02 | O |
| ATOM | 4686 | ND2 | ASN | H | 213 | 9.837 | −2.630 | 34.900 | 1.00 | 63.85 | N |
| ATOM | 4687 | N | HIS | H | 214 | 9.507 | −4.819 | 30.963 | 1.00 | 53.68 | N |
| ATOM | 4688 | CA | HIS | H | 214 | 8.779 | −4.740 | 29.695 | 1.00 | 53.09 | C |
| ATOM | 1689 | C | HIS | H | 214 | 7.504 | −3.929 | 29.953 | 1.00 | 50.58 | C |
| ATOM | 4690 | O | HIS | H | 214 | 6.450 | −4.484 | 30.280 | 1.00 | 49.89 | O |
| ATOM | 4691 | CB | HIS | H | 214 | 8.472 | −6.151 | 29.130 | 1.00 | 46.37 | C |
| ATOM | 4692 | CG | HIS | H | 214 | 7.797 | −6.131 | 27.793 | 1.00 | 43.22 | C |
| ATOM | 4693 | ND1 | HIS | H | 214 | 6.529 | −6.630 | 27.594 | 1.00 | 47.06 | N |
| ATOM | 4694 | CD2 | HIS | H | 214 | 8.205 | −5.655 | 26.592 | 1.00 | 14.18 | C |
| ATOM | 4695 | CE1 | HIS | H | 214 | 6.188 | −6.472 | 26.329 | 1.00 | 42.86 | C |
| ATOM | 4696 | NE2 | HIS | H | 214 | 7.186 | −5.881 | 25.699 | 1.00 | 44.90 | N |

TABLE 77-continued

| ATOM | 4697 | N | LYS | H | 215 | 7.615 | −2.608 | 29.786 | 1.00 | 49.31 | N |
|------|------|------|-----|---|-----|--------|--------|--------|------|-------|-----|
| ATOM | 4698 | CA | LYS | H | 215 | 6.520 | −1.691 | 30.103 | 1.00 | 50.10 | C |
| ATOM | 4699 | C | LYS | H | 215 | 5.213 | −2.016 | 29.391 | 1.00 | 50.78 | C |
| ATOM | 4700 | O | LYS | H | 215 | 4.158 | −1.984 | 30.051 | 1.00 | 47.35 | O |
| ATOM | 4701 | CB | LYS | H | 215 | 6.965 | −0.254 | 29.803 | 1.00 | 52.53 | C |
| ATOM | 4702 | CG | LYS | H | 215 | 5.890 | 0.790 | 30.054 | 1.00 | 61.01 | C |
| ATOM | 4703 | CD | LYS | H | 215 | 6.261 | 2.134 | 29.448 | 1.00 | 69.44 | C |
| ATOM | 4704 | CE | LYS | H | 215 | 5.120 | 3.129 | 29.587 | 1.00 | 73.80 | C |
| ATOM | 4705 | NZ | LYS | H | 215 | 5.341 | 4.324 | 28.727 | 1.00 | 88.01 | N1+ |
| ATOM | 4706 | N | PRO | H | 216 | 5.188 | −2.317 | 28.083 | 1.00 | 48.08 | N |
| ATOM | 4707 | CA | PRO | H | 216 | 3.895 | −2.555 | 27.415 | 1.00 | 48.04 | C |
| ATOM | 4708 | C | PRO | H | 216 | 3.055 | −3.663 | 28.038 | 1.00 | 47.11 | C |
| ATOM | 4709 | O | PRO | H | 216 | 1.825 | −3.653 | 27.897 | 1.00 | 49.23 | O |
| ATOM | 4710 | CB | PRO | H | 216 | 4.312 | −2.919 | 25.984 | 1.00 | 50.00 | C |
| ATOM | 4711 | CG | PRO | H | 216 | 5.619 | −2.278 | 25.792 | 1.00 | 46.42 | C |
| ATOM | 4712 | CD | PRO | H | 216 | 6.305 | −2.353 | 27.120 | 1.00 | 49.31 | C |
| ATOM | 4713 | N | SER | H | 217 | 3.678 | −4.632 | 28.702 | 1.00 | 45.02 | N |
| ATOM | 4714 | CA | SER | H | 217 | 2.955 | −5.720 | 29.346 | 1.00 | 47.45 | C |
| ATOM | 4715 | C | SER | H | 217 | 2.953 | −5.611 | 30.865 | 1.00 | 45.01 | C |
| ATOM | 4716 | O | SER | H | 217 | 2.463 | −6.530 | 31.528 | 1.00 | 44.95 | O |
| ATOM | 4717 | CB | SER | H | 217 | 3.566 | −7.068 | 28.947 | 1.00 | 41.59 | C |
| ATOM | 4718 | OG | SER | H | 217 | 4.838 | −7.180 | 29.555 | 1.00 | 42.28 | O |
| ATOM | 4719 | N | ASN | H | 218 | 3.512 | −4.532 | 31.430 | 1.00 | 42.69 | N |
| ATOM | 4720 | CA | ASN | H | 218 | 3.687 | −4.390 | 32.879 | 1.00 | 46.78 | C |
| ATOM | 4721 | C | ASN | H | 218 | 4.449 | −5.578 | 33.469 | 1.00 | 50.39 | C |
| ATOM | 4722 | O | ASN | H | 218 | 4.163 | −6.031 | 34.579 | 1.00 | 48.79 | O |
| ATOM | 4723 | CB | ASN | H | 218 | 2.339 | −4.210 | 33.592 | 1.00 | 47.15 | C |
| ATOM | 4724 | CG | ASN | H | 218 | 2.489 | −3.835 | 35.067 | 1.00 | 46.72 | C |
| ATOM | 4725 | OD1 | ASN | H | 218 | 3.235 | −2.920 | 35.417 | 1.00 | 47.17 | O |
| ATOM | 4726 | ND2 | ASN | H | 218 | 1.794 | −4.569 | 35.940 | 1.00 | 42.61 | N |
| ATOM | 4727 | N | THR | H | 219 | 5.412 | −6.117 | 32.730 | 1.00 | 50.47 | N |
| ATOM | 4728 | CA | THR | H | 219 | 6.221 | −7.218 | 33.236 | 1.00 | 48.66 | C |
| ATOM | 4729 | C | THR | H | 219 | 7.484 | −6.667 | 33.877 | 1.00 | 48.53 | C |
| ATOM | 1730 | O | THR | H | 219 | 8.194 | −5.860 | 33.268 | 1.00 | 53.43 | O |
| ATOM | 4731 | CB | THR | H | 219 | 6.578 | −8.198 | 32.118 | 1.00 | 51.89 | C |
| ATOM | 4732 | OG1 | THR | H | 219 | 5.374 | −8.722 | 31.544 | 1.00 | 46.48 | O |
| ATOM | 4733 | CG2 | THR | H | 219 | 7.425 | −9.351 | 32.670 | 1.00 | 49.41 | C |
| ATOM | 4734 | N | LYS | H | 220 | 7.746 | −7.083 | 35.114 | 1.00 | 50.43 | N |
| ATOM | 4735 | CA | LYS | H | 220 | 8.957 | −6.693 | 35.831 | 1.00 | 52.79 | C |
| ATOM | 4736 | C | LYS | H | 220 | 9.498 | −7.915 | 36.553 | 1.00 | 54.66 | C |
| ATOM | 4737 | O | LYS | H | 220 | 8.798 | −8.513 | 37.375 | 1.00 | 56.05 | O |
| ATOM | 4738 | CB | LYS | H | 220 | 8.691 | −5.564 | 36.833 | 1.00 | 60.50 | C |
| ATOM | 4739 | CG | LYS | H | 220 | 9.969 | −5.011 | 37.475 | 1.00 | 61.36 | C |
| ATOM | 4740 | CD | LYS | H | 220 | 9.698 | −4.242 | 38.770 | 1.00 | 68.09 | C |
| ATOM | 4741 | CE | LYS | H | 220 | 9.925 | −5.114 | 40.002 | 1.00 | 75.69 | C |
| ATOM | 4742 | NZ | LYS | H | 220 | 9.347 | −4.526 | 41.248 | 1.00 | 74.08 | N1+ |
| ATOM | 4743 | N | VAL | H | 221 | 10.741 | −8.279 | 36.262 | 1.00 | 55.15 | N |
| ATOM | 4744 | CA | VAL | H | 221 | 11.341 | −9.488 | 36.808 | 1.00 | 56.20 | C |
| ATOM | 4745 | C | VAL | H | 221 | 12.687 | −9.137 | 37.418 | 1.00 | 59.41 | C |
| ATOM | 4746 | O | VAL | H | 221 | 13.513 | −8.474 | 36.781 | 1.00 | 56.87 | O |
| ATOM | 4747 | CB | VAL | H | 221 | 11.501 | −10.587 | 35.742 | 1.00 | 52.69 | C |
| ATOM | 4748 | CG1 | VAL | H | 221 | 12.275 | −11.770 | 36.311 | 1.00 | 56.71 | C |
| ATOM | 4749 | CG2 | VAL | H | 221 | 10.142 | −11.038 | 35.252 | 1.00 | 52.09 | C |
| ATOM | 4750 | N | ASP | H | 222 | 12.898 | −9.574 | 38.650 | 1.00 | 64.15 | N |
| ATOM | 4751 | CA | ASP | H | 222 | 14.182 | −9.486 | 39.331 | 1.00 | 69.46 | C |
| ATOM | 4752 | C | ASP | H | 222 | 14.675 | −10.924 | 39.483 | 1.00 | 70.00 | C |
| ATOM | 4753 | O | ASP | H | 222 | 14.335 | −11.617 | 40.442 | 1.00 | 70.73 | O |
| ATOM | 4754 | CB | ASP | H | 222 | 14.040 | −8.767 | 40.670 | 1.00 | 71.02 | C |
| ATOM | 4755 | CG | ASP | H | 222 | 13.517 | −7.351 | 40.515 | 1.00 | 74.77 | C |
| ATOM | 4756 | OD1 | ASP | H | 222 | 14.190 | −6.538 | 39.844 | 1.00 | 73.63 | O |
| ATOM | 4757 | OD2 | ASP | H | 222 | 12.421 | −7.057 | 41.043 | 1.00 | 80.27 | O1− |
| ATOM | 4758 | N | LYS | H | 223 | 15.456 | −11.378 | 38.507 | 1.00 | 67.23 | N |
| ATOM | 4759 | CA | LYS | H | 223 | 15.937 | −12.753 | 38.463 | 1.00 | 65.51 | C |
| ATOM | 4760 | C | LYS | H | 223 | 17.368 | −12.791 | 38.980 | 1.00 | 69.75 | C |
| ATOM | 4761 | O | LYS | H | 223 | 18.244 | −12.105 | 38.442 | 1.00 | 71.98 | O |
| ATOM | 4762 | CB | LYS | H | 223 | 15.871 | −13.314 | 37.042 | 1.00 | 64.16 | C |
| ATOM | 4763 | CG | LYS | H | 223 | 15.731 | −14.834 | 36.962 | 1.00 | 63.90 | C |
| ATOM | 4764 | CD | LYS | H | 223 | 14.302 | −15.275 | 37.286 | 1.00 | 65.56 | C |
| ATOM | 4765 | CE | LYS | H | 223 | 14.094 | −16.755 | 37.029 | 1.00 | 66.23 | C |
| ATOM | 1766 | NZ | LYS | H | 223 | 15.059 | −17.590 | 37.792 | 1.00 | 73.96 | N1+ |
| ATOM | 4767 | N | LYS | H | 224 | 17.600 | −13.575 | 40.026 | 1.00 | 72.52 | N |
| ATOM | 4768 | CA | LYS | H | 224 | 18.960 | −13.800 | 40.490 | 1.00 | 73.61 | C |
| ATOM | 4769 | C | LYS | H | 224 | 19.599 | −14.881 | 39.630 | 1.00 | 64.75 | C |
| ATOM | 4770 | O | LYS | H | 224 | 18.980 | −15.910 | 39.353 | 1.00 | 64.26 | O |
| ATOM | 4771 | CB | LYS | H | 224 | 18.974 | −14.202 | 41.964 | 1.00 | 78.94 | C |
| ATOM | 4772 | CG | LYS | H | 224 | 20.363 | −14.167 | 42.589 | 1.00 | 79.94 | C |
| ATOM | 4773 | CD | LYS | H | 224 | 20.413 | −14.910 | 43.918 | 1.00 | 86.08 | C |
| ATOM | 4774 | CE | LYS | H | 224 | 21.827 | −14.922 | 44.494 | 1.00 | 88.86 | C |
| ATOM | 4775 | NZ | LYS | H | 224 | 21.988 | −15.893 | 45.617 | 1.00 | 93.60 | N1+ |
| ATOM | 4776 | N | VAL | H | 225 | 20.823 | −14.639 | 39.187 | 1.00 | 63.83 | N |

TABLE 77-continued

| | | | | | | | | | | |
|---|---|---|---|---|---|---|---|---|---|---|
| ATOM | 4777 | CA | VAL | H | 225 | 21.560 | −15.583 | 38.355 | 1.00 | 67.92 | C |
| ATOM | 4778 | C | VAL | H | 225 | 22.616 | −16.228 | 39.244 | 1.00 | 69.27 | C |
| ATOM | 4779 | O | VAL | H | 225 | 23.657 | −15.627 | 39.531 | 1.00 | 71.71 | O |
| ATOM | 4780 | CB | VAL | H | 225 | 22.193 | −14.906 | 37.134 | 1.00 | 65.56 | C |
| ATOM | 4781 | CG1 | VAL | H | 225 | 22.739 | −15.958 | 36.180 | 1.00 | 62.60 | C |
| ATOM | 4782 | CG2 | VAL | H | 225 | 21.185 | −13.997 | 36.436 | 1.00 | 64.92 | C |
| ATOM | 4783 | N | GLU | H | 226 | 22.360 | −17.444 | 39.678 | 1.00 | 69.57 | N |
| ATOM | 4784 | CA | GLU | H | 226 | 23.309 | −18.166 | 40.508 | 1.00 | 79.15 | C |
| ATOM | 4785 | C | GLU | H | 226 | 24.031 | −19.234 | 39.699 | 1.00 | 75.27 | C |
| ATOM | 4786 | O | GLU | H | 226 | 23.539 | −19.681 | 38.658 | 1.00 | 72.64 | O |
| ATOM | 4787 | CB | GLU | H | 226 | 22.595 | −18.800 | 41.710 | 1.00 | 84.04 | C |
| ATOM | 4788 | CG | GLU | H | 226 | 21.134 | −19.145 | 41.484 | 1.00 | 84.08 | C |
| ATOM | 4789 | CD | GLU | H | 226 | 20.403 | −19.429 | 42.786 | 1.00 | 93.81 | C |
| ATOM | 4790 | OE1 | GLU | H | 226 | 19.387 | −20.158 | 42.759 | 1.00 | 94.01 | O |
| ATOM | 4791 | OE2 | GLU | H | 226 | 20.848 | −18.920 | 43.838 | 1.00 | 94.02 | O1− |
| ATOM | 4792 | N | PRO | H | 227 | 25.224 | −19.657 | 40.146 | 1.00 | 75.27 | N |
| ATOM | 4793 | CA | PRO | H | 227 | 26.031 | −20.602 | 39.356 | 1.00 | 73.12 | C |
| ATOM | 4794 | C | PRO | H | 227 | 25.431 | −21.991 | 39.163 | 1.00 | 73.63 | C |
| ATOM | 4795 | O | PRO | H | 227 | 24.325 | −22.285 | 39.623 | 1.00 | 79.45 | O |
| ATOM | 4796 | CB | PRO | H | 227 | 27.338 | −20.680 | 40.155 | 1.00 | 76.55 | C |
| ATOM | 4797 | CG | PRO | H | 227 | 27.421 | −19.364 | 40.856 | 1.00 | 76.36 | C |
| ATOM | 4798 | CD | PRO | H | 227 | 26.009 | −19.033 | 41.227 | 1.00 | 73.13 | C |
| ATOM | 4799 | N | LYS | H | 228 | 26.192 | −22.845 | 38.473 | 1.00 | 80.44 | N |
| ATOM | 4800 | CA | LYS | H | 228 | 25.833 | −24.199 | 38.049 | 1.00 | 85.64 | C |
| ATOM | 4801 | C | LYS | H | 228 | 25.161 | −25.046 | 39.130 | 1.00 | 93.94 | C |
| ATOM | 4802 | O | LYS | H | 228 | 25.356 | −24.807 | 10.327 | 1.00 | 95.95 | O |
| ATOM | 4803 | CB | LYS | H | 228 | 27.102 | −24.896 | 37.539 | 1.00 | 85.48 | C |
| ATOM | 4804 | CG | LYS | H | 228 | 26.966 | −26.364 | 37.158 | 1.00 | 91.12 | C |
| ATOM | 4805 | CD | LYS | H | 228 | 28.248 | −26.872 | 36.535 | 1.00 | 85.38 | C |
| ATOM | 4806 | CE | LYS | H | 228 | 29.449 | −26.385 | 37.313 | 1.00 | 83.46 | C |
| ATOM | 4807 | NZ | LYS | H | 228 | 30.540 | −25.972 | 36.393 | 1.00 | 85.10 | N |
| ATOM | 4808 | N | SER | H | 229 | 24.375 | −26.038 | 38.695 | 1.00 | 96.15 | N |
| ATOM | 4809 | CA | SER | H | 229 | 23.593 | −26.959 | 39.534 | 1.00 | 96.86 | C |
| ATOM | 4810 | C | SER | H | 229 | 22.348 | −26.268 | 40.082 | 1.00 | 95.34 | C |
| ATOM | 4811 | O | SER | H | 229 | 21.336 | −26.154 | 39.384 | 1.00 | 95.73 | O |
| ATOM | 4812 | CB | SER | H | 229 | 24.432 | −27.543 | 40.681 | 1.00 | 97.16 | C |
| ATOM | 4813 | OG | SER | H | 229 | 23.665 | −28.433 | 41.475 | 1.00 | 97.10 | O |
| TER | | | | | | | | | | | |
| ATOM | 4814 | N | ASP | L | 1 | 10.933 | 12.972 | −7.968 | 1.00 | 53.53 | N1+ |
| ATOM | 4815 | CA | ASP | L | 1 | 11.693 | 13.204 | −6.745 | 1.00 | 53.38 | C |
| ATOM | 4816 | C | ASP | L | 1 | 13.176 | 13.256 | −7.050 | 1.00 | 53.25 | C |
| ATOM | 4817 | O | ASP | L | 1 | 13.631 | 12.775 | −8.085 | 1.00 | 49.65 | O |
| ATOM | 4818 | CB | ASP | L | 1 | 11.422 | 12.115 | −5.710 | 1.00 | 49.11 | C |
| ATOM | 4819 | CG | ASP | L | 1 | 9.956 | 12.008 | −5.352 | 1.00 | 56.45 | C |
| ATOM | 4820 | OD1 | ASP | L | 1 | 9.152 | 12.809 | −5.885 | 1.00 | 56.82 | O1− |
| ATOM | 4821 | OD2 | ASP | L | 1 | 9.610 | 11.118 | −4.549 | 1.00 | 59.00 | O |
| ATOM | 4822 | N | ILE | L | 2 | 13.932 | 13.838 | −6.134 | 1.00 | 43.84 | N |
| ATOM | 4823 | CA | ILE | L | 2 | 15.371 | 13.952 | −6.278 | 1.00 | 48.32 | C |
| ATOM | 4824 | C | ILE | L | 2 | 16.018 | 12.829 | −5.481 | 1.00 | 48.38 | C |
| ATOM | 4825 | O | ILE | L | 2 | 15.805 | 12.711 | −4.270 | 1.00 | 48.83 | O |
| ATOM | 4826 | CR | ILE | L | 2 | 15.864 | 15.336 | −5.834 | 1.00 | 41.43 | C |
| ATOM | 4827 | CG1 | ILE | L | 2 | 15.206 | 16.400 | −6.706 | 1.00 | 46.22 | C |
| ATOM | 4828 | CG2 | ILE | L | 2 | 17.328 | 15.418 | −6.023 | 1.00 | 47.05 | C |
| ATOM | 4829 | CD1 | ILE | L | 2 | 15.727 | 17.790 | −6.497 | 1.00 | 44.14 | C |
| ATOM | 4830 | N | GLN | L | 3 | 16.793 | 11.994 | −6.170 | 1.00 | 46.76 | N |
| ATOM | 4831 | CA | GLN | L | 3 | 17.440 | 10.824 | −5.580 | 1.00 | 50.88 | C |
| ATOM | 4832 | C | GLN | L | 3 | 18.875 | 11.147 | −5.189 | 1.00 | 46.54 | C |
| ATOM | 4833 | O | GLN | L | 3 | 19.656 | 11.611 | −6.023 | 1.00 | 44.93 | O |
| ATOM | 4834 | CB | GLN | L | 3 | 17.431 | 9.655 | −6.565 | 1.00 | 49.62 | C |
| ATOM | 4835 | CG | GLN | L | 3 | 16.046 | 9.087 | −6.815 | 1.00 | 60.20 | C |
| ATOM | 4836 | CD | GLN | L | 3 | 15.363 | 8.683 | −5.523 | 1.00 | 66.58 | C |
| ATOM | 1837 | OE1 | GLN | L | 3 | 15.975 | 8.046 | −4.660 | 1.00 | 71.72 | O |
| ATOM | 4838 | NE2 | GLN | L | 3 | 14.096 | 9.066 | −5.374 | 1.00 | 66.39 | N |
| ATOM | 4839 | N | MET | L | 4 | 19.215 | 10.898 | −3.925 | 1.00 | 41.76 | N |
| ATOM | 4840 | CA | MET | L | 4 | 20.577 | 11.044 | −3.427 | 1.00 | 44.19 | C |
| ATOM | 4841 | C | MET | L | 4 | 21.289 | 9.701 | −3.483 | 1.00 | 46.85 | C |
| ATOM | 4842 | O | MET | L | 4 | 20.839 | 8.739 | −2.858 | 1.00 | 44.45 | O |
| ATOM | 4843 | CB | MET | L | 4 | 20.575 | 11.552 | −1.989 | 1.00 | 42.84 | C |
| ATOM | 4844 | CG | MET | L | 4 | 19.740 | 12.786 | −1.754 | 1.00 | 47.45 | C |
| ATOM | 4845 | SD | MET | L | 4 | 20.630 | 14.167 | −2.460 | 1.00 | 59.98 | S |
| ATOM | 4846 | CE | MET | L | 4 | 19.862 | 14.241 | −4.033 | 1.00 | 36.29 | C |
| ATOM | 4847 | N | THR | L | 5 | 22.419 | 9.654 | −4.184 | 1.00 | 42.96 | N |
| ATOM | 4848 | CA | THR | L | 5 | 23.284 | 8.476 | −4.236 | 1.00 | 43.89 | C |
| ATOM | 4849 | C | THR | L | 5 | 24.489 | 8.738 | −3.348 | 1.00 | 40.59 | C |
| ATOM | 4850 | O | THR | L | 5 | 25.382 | 9.508 | −3.708 | 1.00 | 40.48 | O |
| ATOM | 4851 | CB | THR | L | 5 | 23.717 | 8.184 | −5.665 | 1.00 | 42.23 | C |
| ATOM | 4852 | OG1 | THR | L | 5 | 22.568 | 7.830 | −6.426 | 1.00 | 45.31 | O |
| ATOM | 4853 | CG2 | THR | L | 5 | 24.723 | 7.045 | −5.701 | 1.00 | 48.69 | C |
| ATOM | 4854 | N | GLN | L | 6 | 24.514 | 8.086 | −2.191 | 1.00 | 37.08 | N |
| ATOM | 4855 | CA | GLN | L | 6 | 25.561 | 8.267 | −1.194 | 1.00 | 40.45 | C |

TABLE 77-continued

| | | | | | | | | | | |
|---|---|---|---|---|---|---|---|---|---|---|
| ATOM | 4856 | C | GLN | L | 6 | 26.504 | 7.068 | −1.236 | 1.00 | 46.78 | C |
| ATOM | 4857 | O | GLN | L | 6 | 26.052 | 5.920 | −1.255 | 1.00 | 41.66 | O |
| ATOM | 4858 | CB | GLN | L | 6 | 24.951 | 8.412 | 0.203 | 1.00 | 38.50 | C |
| ATOM | 4859 | CG | GLN | L | 6 | 25.933 | 8.726 | 1.318 | 1.00 | 40.29 | C |
| ATOM | 4860 | CD | GLN | L | 6 | 25.240 | 8.963 | 2.648 | 1.00 | 41.99 | C |
| ATOM | 4861 | OE1 | GLN | L | 6 | 24.027 | 9.196 | 2.704 | 1.00 | 42.09 | O |
| ATOM | 4862 | NE2 | GLN | L | 6 | 26.006 | 8.926 | 3.721 | 1.00 | 42.16 | N |
| ATOM | 4863 | N | SER | L | 7 | 27.803 | 7.338 | −1.268 | 1.00 | 47.31 | N |
| ATOM | 4864 | CA | SER | L | 7 | 28.811 | 6.292 | −1.263 | 1.00 | 49.20 | C |
| ATOM | 4865 | C | SER | L | 7 | 30.003 | 6.746 | −0.439 | 1.00 | 50.10 | C |
| ATOM | 4866 | O | SER | L | 7 | 30.256 | 7.953 | −0.320 | 1.00 | 48.25 | O |
| ATOM | 4867 | CB | SER | L | 7 | 29.270 | 5.937 | −2.684 | 1.00 | 47.31 | C |
| ATOM | 4868 | OG | SER | L | 7 | 29.597 | 7.107 | −3.402 | 1.00 | 56.12 | O |
| ATOM | 4869 | N | PRO | L | 8 | 30.736 | 5.799 | 0.180 | 1.00 | 50.39 | N |
| ATOM | 4870 | CA | PRO | L | 8 | 30.368 | 4.376 | 0.211 | 1.00 | 49.18 | C |
| ATOM | 4871 | C | PRO | L | 8 | 29.264 | 4.102 | 1.228 | 1.00 | 54.76 | C |
| ATOM | 4872 | O | PRO | L | 8 | 29.048 | 4.930 | 2.109 | 1.00 | 53.88 | O |
| ATOM | 4873 | CB | PRO | L | 8 | 31.667 | 3.689 | 0.635 | 1.00 | 49.09 | C |
| ATOM | 4874 | CG | PRO | L | 8 | 32.296 | 4.705 | 1.558 | 1.00 | 54.58 | C |
| ATOM | 4875 | CD | PRO | L | 8 | 31.994 | 6.053 | 0.906 | 1.00 | 49.06 | C |
| ATOM | 4876 | N | SER | L | 9 | 28.585 | 2.957 | 1.122 | 1.00 | 54.61 | N |
| ATOM | 4877 | CA | SER | L | 9 | 27.568 | 2.632 | 2.115 | 1.00 | 51.50 | C |
| ATOM | 4878 | C | SER | L | 9 | 28.182 | 2.264 | 3.454 | 1.00 | 52.14 | C |
| ATOM | 4879 | O | SER | L | 9 | 27.543 | 2.450 | 4.496 | 1.00 | 50.63 | O |
| ATOM | 4880 | CB | SER | L | 9 | 26.675 | 1.496 | 1.610 | 1.00 | 51.91 | C |
| ATOM | 4881 | OG | SER | L | 9 | 27.438 | 0.402 | 1.137 | 1.00 | 63.50 | O |
| ATOM | 4882 | N | SER | L | 10 | 29.422 | 1.792 | 3.452 | 1.00 | 48.54 | N |
| ATOM | 4883 | CA | SER | L | 10 | 30.062 | 1.294 | 4.653 | 1.00 | 53.36 | C |
| ATOM | 4884 | C | SER | L | 10 | 31.550 | 1.575 | 4.549 | 1.00 | 52.81 | C |
| ATOM | 4885 | O | SER | L | 10 | 32.135 | 1.475 | 3.467 | 1.00 | 54.11 | O |
| ATOM | 4886 | CB | SER | L | 10 | 29.799 | −0.210 | 4.831 | 1.00 | 56.75 | C |
| ATOM | 4887 | OG | SER | L | 10 | 30.715 | −0.780 | 5.742 | 1.00 | 66.96 | O |
| ATOM | 4888 | N | LEU | L | 11 | 32.156 | 1.904 | 5.683 | 1.00 | 48.41 | N |
| ATOM | 4889 | CA | LEU | L | 11 | 33.503 | 2.443 | 5.694 | 1.00 | 51.46 | C |
| ATOM | 4890 | C | LEU | L | 11 | 34.183 | 2.040 | 6.988 | 1.00 | 51.63 | C |
| ATOM | 4891 | O | LEU | L | 11 | 33.571 | 2.095 | 8.057 | 1.00 | 55.46 | O |
| ATOM | 4892 | CB | LEU | L | 11 | 33.440 | 3.969 | 5.561 | 1.00 | 59.87 | C |
| ATOM | 4893 | CG | LEU | L | 11 | 34.637 | 4.887 | 5.426 | 1.00 | 58.63 | C |
| ATOM | 4894 | CD1 | LEU | L | 11 | 34.160 | 6.160 | 4.719 | 1.00 | 59.09 | C |
| ATOM | 4895 | CD2 | LEU | L | 11 | 35.225 | 5.222 | 6.784 | 1.00 | 59.49 | C |
| ATOM | 4896 | N | SER | L | 12 | 35.441 | 1.638 | 6.883 | 1.00 | 51.89 | N |
| ATOM | 4897 | CA | SER | L | 12 | 36.254 | 1.250 | 8.022 | 1.00 | 56.72 | C |
| ATOM | 4898 | C | SER | L | 12 | 37.553 | 2.037 | 7.966 | 1.00 | 55.81 | C |
| ATOM | 4899 | O | SER | L | 12 | 38.212 | 2.075 | 6.922 | 1.00 | 55.47 | O |
| ATOM | 4900 | CB | SER | L | 12 | 36.536 | −0.252 | 8.004 | 1.00 | 57.39 | C |
| ATOM | 4901 | OG | SER | L | 12 | 37.207 | −0.631 | 9.190 | 1.00 | 62.66 | O |
| ATOM | 4902 | N | ALA | L | 13 | 37.918 | 2.671 | 9.077 | 1.00 | 49.23 | N |
| ATOM | 4903 | CA | ALA | L | 13 | 39.062 | 3.561 | 9.060 | 1.00 | 48.67 | C |
| ATOM | 4904 | C | ALA | L | 13 | 39.650 | 3.658 | 10.456 | 1.00 | 53.94 | C |
| ATOM | 4905 | O | ALA | L | 13 | 38.938 | 3.551 | 11.455 | 1.00 | 51.34 | O |
| ATOM | 4906 | CB | ALA | L | 13 | 38.679 | 4.955 | 8.546 | 1.00 | 54.12 | C |
| ATOM | 4907 | N | SER | L | 14 | 40.962 | 3.871 | 10.513 | 1.00 | 57.79 | N |
| ATOM | 4908 | CA | SER | L | 14 | 41.631 | 4.008 | 11.794 | 1.00 | 56.88 | C |
| ATOM | 4909 | C | SER | L | 14 | 41.482 | 5.428 | 12.317 | 1.00 | 53.83 | C |
| ATOM | 4910 | O | SER | L | 14 | 41.204 | 6.375 | 11.570 | 1.00 | 57.66 | O |
| ATOM | 4911 | CB | SER | L | 14 | 43.122 | 3.656 | 11.679 | 1.00 | 59.24 | C |
| ATOM | 4912 | OG | SER | L | 14 | 43.339 | 2.585 | 10.777 | 1.00 | 66.78 | O |
| ATOM | 4913 | N | VAL | L | 15 | 41.683 | 5.571 | 13.626 | 1.00 | 47.43 | N |
| ATOM | 4914 | CA | VAL | L | 15 | 41.727 | 6.898 | 14.219 | 1.00 | 49.25 | C |
| ATOM | 4915 | C | VAL | L | 15 | 42.793 | 7.745 | 13.538 | 1.00 | 56.21 | C |
| ATOM | 4916 | O | VAL | L | 15 | 43.896 | 7.271 | 13.232 | 1.00 | 60.68 | O |
| ATOM | 4917 | CB | VAL | L | 15 | 41.985 | 6.777 | 15.726 | 1.00 | 52.79 | C |
| ATOM | 4918 | CG1 | VAL | L | 15 | 41.858 | 8.131 | 16.393 | 1.00 | 53.19 | C |
| ATOM | 4919 | CG2 | VAL | L | 15 | 41.023 | 5.763 | 16.321 | 1.00 | 56.03 | C |
| ATOM | 4920 | N | GLY | L | 16 | 42.462 | 9.010 | 13.286 | 1.00 | 56.68 | N |
| ATOM | 4921 | CA | GLY | L | 16 | 43.339 | 9.907 | 12.575 | 1.00 | 52.85 | C |
| ATOM | 4922 | C | GLY | L | 16 | 43.253 | 9.823 | 11.068 | 1.00 | 53.21 | C |
| ATOM | 4923 | O | GLY | L | 16 | 43.801 | 10.691 | 10.385 | 1.00 | 59.64 | O |
| ATOM | 4924 | N | ASP | L | 17 | 42.591 | 8.812 | 10.521 | 1.00 | 52.99 | N |
| ATOM | 4925 | CA | ASP | L | 17 | 42.399 | 8.766 | 9.082 | 1.00 | 54.61 | C |
| ATOM | 4926 | C | ASP | L | 17 | 41.512 | 9.917 | 8.610 | 1.00 | 59.39 | C |
| ATOM | 4927 | O | ASP | L | 17 | 40.763 | 10.530 | 9.379 | 1.00 | 57.40 | O |
| ATOM | 4928 | CB | ASP | L | 17 | 41.776 | 7.436 | 8.655 | 1.00 | 57.02 | C |
| ATOM | 4929 | CG | ASP | L | 17 | 42.748 | 6.279 | 8.769 | 1.00 | 68.42 | C |
| ATOM | 4930 | OD1 | ASP | L | 17 | 43.829 | 6.487 | 9.371 | 1.00 | 64.33 | O |
| ATOM | 4931 | OD2 | ASP | L | 17 | 42.435 | 5.174 | 8.258 | 1.00 | 66.97 | O1− |
| ATOM | 4932 | N | ARG | L | 18 | 41.625 | 10.210 | 7.322 | 1.00 | 55.49 | N |
| ATOM | 4933 | CA | ARG | L | 18 | 40.737 | 11.126 | 6.630 | 1.00 | 58.20 | C |
| ATOM | 4934 | C | ARG | L | 18 | 39.727 | 10.283 | 5.871 | 1.00 | 61.72 | C |
| ATOM | 4935 | O | ARG | L | 18 | 40.109 | 9.375 | 5.121 | 1.00 | 55.50 | O |

TABLE 77-continued

| | | | | | | | | | | |
|---|---|---|---|---|---|---|---|---|---|---|
| ATOM | 4936 | CB | ARG | L | 18 | 41.503 | 12.042 | 5.671 | 1.00 | 65.06 C |
| ATOM | 4937 | CG | ARG | L | 18 | 40.625 | 12.633 | 4.550 | 1.00 | 68.07 C |
| ATOM | 4938 | CD | ARG | L | 18 | 41.421 | 13.422 | 3.509 | 1.00 | 71.18 C |
| ATOM | 4939 | NE | ARG | L | 18 | 41.483 | 14.846 | 3.832 | 1.00 | 77.00 N |
| ATOM | 4940 | CZ | ARG | L | 18 | 42.332 | 15.371 | 4.709 | 1.00 | 81.60 C |
| ATOM | 4941 | NH1 | ARG | L | 18 | 43.189 | 14.588 | 5.351 | 1.00 | 85.44 N1+ |
| ATOM | 4942 | NH2 | ARG | L | 18 | 42.325 | 16.675 | 4.949 | 1.00 | 80.10 N1+ |
| ATOM | 4943 | N | VAL | L | 19 | 38.443 | 10.560 | 6.085 | 1.00 | 56.17 N |
| ATOM | 4944 | CA | VAL | L | 19 | 37.383 | 9.843 | 5.398 | 1.00 | 53.50 C |
| ATOM | 4915 | C | VAL | L | 19 | 36.555 | 10.855 | 4.625 | 1.00 | 51.57 O |
| ATOM | 4946 | O | VAL | L | 19 | 36.304 | 11.972 | 5.095 | 1.00 | 50.59 O |
| ATOM | 4947 | CB | VAL | L | 19 | 36.506 | 9.016 | 6.365 | 1.00 | 54.57 C |
| ATOM | 4948 | CG1 | VAL | L | 19 | 37.378 | 8.198 | 7.302 | 1.00 | 57.80 C |
| ATOM | 4949 | CG2 | VAL | L | 19 | 35.587 | 9.894 | 7.160 | 1.00 | 60.21 C |
| ATOM | 4950 | N | THR | L | 20 | 36.161 | 10.473 | 3.422 | 1.00 | 50.42 N |
| ATOM | 4951 | CA | THR | L | 20 | 35.293 | 11.295 | 2.601 | 1.00 | 55.23 C |
| ATOM | 4952 | C | THR | L | 20 | 34.073 | 10.468 | 2.225 | 1.00 | 50.81 C |
| ATOM | 4953 | O | THR | L | 20 | 34.188 | 9.276 | 1.916 | 1.00 | 50.24 O |
| ATOM | 4954 | CB | THR | L | 20 | 36.027 | 11.806 | 1.352 | 1.00 | 52.32 C |
| ATOM | 4955 | OG1 | THR | L | 20 | 36.592 | 10.695 | 0.650 | 1.00 | 60.92 O |
| ATOM | 4956 | CG2 | THR | L | 20 | 37.156 | 12.745 | 1.749 | 1.00 | 52.03 C |
| ATOM | 4957 | N | ILE | L | 21 | 32.907 | 11.099 | 2.294 | 1.00 | 44.98 N |
| ATOM | 4958 | CA | ILE | L | 21 | 31.640 | 10.496 | 1.903 | 1.00 | 45.37 C |
| ATOM | 4959 | C | ILE | L | 21 | 31.054 | 11.379 | 0.820 | 1.00 | 42.98 C |
| ATOM | 4960 | O | ILE | L | 21 | 31.071 | 12.606 | 0.946 | 1.00 | 46.39 O |
| ATOM | 4961 | CB | ILE | L | 21 | 30.683 | 10.375 | 3.103 | 1.00 | 48.26 C |
| ATOM | 4962 | CG1 | ILE | L | 21 | 31.326 | 9.520 | 4.198 | 1.00 | 51.11 C |
| ATOM | 4963 | CG2 | ILE | L | 21 | 29.343 | 9.798 | 2.675 | 1.00 | 45.62 C |
| ATOM | 4964 | CD1 | ILE | L | 21 | 30.897 | 9.887 | 5.617 | 1.00 | 51.53 C |
| ATOM | 4965 | N | THR | L | 22 | 30.564 | 10.773 | −0.247 | 1.00 | 44.78 N |
| ATOM | 4966 | CA | THR | L | 22 | 30.056 | 11.530 | −1.378 | 1.00 | 45.43 C |
| ATOM | 4967 | C | 'THR | L | 22 | 28.550 | 11.330 | −1.503 | 1.00 | 48.06 C |
| ATOM | 4968 | O | THR | L | 22 | 28.019 | 10.266 | −1.161 | 1.00 | 46.21 O |
| ATOM | 4969 | CB | THR | L | 22 | 30.803 | 11.129 | −2.665 | 1.00 | 48.87 C |
| ATOM | 4970 | OG1 | THR | L | 22 | 32.155 | 11.589 | −2.570 | 1.00 | 54.71 O |
| ATOM | 4971 | CG2 | THR | L | 22 | 30.193 | 11.754 | −3.906 | 1.00 | 48.58 C |
| ATOM | 4972 | N | CYS | L | 23 | 27.863 | 12.387 | −1.929 | 1.00 | 43.24 N |
| ATOM | 4973 | CA | CYS | L | 23 | 26.450 | 12.356 | −2.268 | 1.00 | 40.10 C |
| ATOM | 4974 | C | CYS | L | 23 | 26.333 | 12.925 | −3.678 | 1.00 | 37.96 C |
| ATOM | 4975 | O | CYS | L | 23 | 26.836 | 14.019 | −3.947 | 1.00 | 40.58 O |
| ATOM | 4976 | CB | CYS | L | 23 | 25.649 | 13.174 | −1.228 | 1.00 | 49.13 C |
| ATOM | 4977 | SG | CYS | L | 23 | 23.853 | 13.063 | −1.145 | 0.52 | 60.46 S |
| ATOM | 4978 | N | ARG | L | 24 | 25.707 | 12.179 | −4.583 | 1.00 | 41.57 N |
| ATOM | 4979 | CA | ARG | L | 24 | 25.586 | 12.580 | −5.983 | 1.00 | 42.01 C |
| ATOM | 4980 | C | ARG | L | 24 | 24.123 | 12.596 | −6.395 | 1.00 | 46.61 C |
| ATOM | 4981 | O | ARG | L | 24 | 23.345 | 11.732 | −5.972 | 1.00 | 45.64 O |
| ATOM | 4982 | CB | ARG | L | 24 | 26.354 | 11.626 | −6.926 | 1.00 | 41.97 C |
| ATOM | 4983 | CG | ARG | L | 24 | 27.869 | 11.841 | −6.983 | 1.00 | 51.35 C |
| ATOM | 4984 | CD | ARG | L | 24 | 28.248 | 12.831 | −8.093 | 1.00 | 56.09 C |
| ATOM | 4985 | NE | ARG | L | 24 | 27.783 | 12.390 | −9.413 | 1.00 | 65.01 N |
| ATOM | 4986 | CZ | ARG | L | 24 | 27.780 | 13.151 | −10.507 | 1.00 | 63.37 C |
| ATOM | 4987 | NH1 | ARG | L | 24 | 28.233 | 14.397 | −10.446 | 1.00 | 67.63 N1+ |
| ATOM | 4988 | NH2 | ARG | L | 24 | 27.340 | 12.666 | −11.667 | 1.00 | 57.18 N1+ |
| ATOM | 4989 | N | THR | L | 25 | 23.766 | 13.556 | −7.255 | 1.00 | 41.37 N |
| ATOM | 4990 | CA | THR | L | 25 | 22.434 | 13.641 | −7.836 | 1.00 | 46.46 C |
| ATOM | 4991 | C | THR | L | 25 | 22.534 | 13.854 | −9.331 | 1.00 | 44.23 C |
| ATOM | 4992 | O | THR | L | 25 | 23.511 | 14.407 | −9.827 | 1.00 | 45.67 O |
| ATOM | 4993 | CB | THR | L | 25 | 21.606 | 14.820 | −7.322 | 1.00 | 48.94 C |
| ATOM | 4994 | OG1 | THR | L | 25 | 21.932 | 15.113 | −5.963 | 1.00 | 60.39 O |
| ATOM | 4995 | CG2 | THR | L | 25 | 20.158 | 14.485 | −7.469 | 1.00 | 46.49 C |
| ATOM | 4996 | N | SER | L | 26 | 21.469 | 13.486 | −10.037 | 1.00 | 41.07 N |
| ATOM | 4997 | CA | SER | L | 26 | 21.375 | 13.814 | −11.450 | 1.00 | 48.17 C |
| ATOM | 4998 | C | SER | L | 26 | 20.833 | 15.218 | −11.681 | 1.00 | 49.89 C |
| ATOM | 4999 | O | SER | L | 26 | 21.006 | 15.758 | −12.779 | 1.00 | 43.41 O |
| ATOM | 5000 | CB | SER | L | 26 | 20.503 | 12.782 | −12.182 | 1.00 | 47.37 C |
| ATOM | 5001 | OG | SER | L | 26 | 19.118 | 13.022 | −11.990 | 1.00 | 60.18 O |
| ATOM | 5002 | N | GLN | L | 27 | 20.189 | 15.812 | −10.680 | 1.00 | 46.58 N |
| ATOM | 5003 | CA | GLN | L | 27 | 19.696 | 17.177 | −10.754 | 1.00 | 44.90 C |
| ATOM | 5004 | C | GLN | L | 27 | 20.658 | 18.127 | −10.052 | 1.00 | 40.02 C |
| ATOM | 5005 | O | GLN | L | 27 | 21.363 | 17.750 | −9.119 | 1.00 | 41.81 O |
| ATOM | 5006 | CB | GLN | L | 27 | 18.318 | 17.270 | −10.106 | 1.00 | 49.72 C |
| ATOM | 5007 | CG | GLN | L | 27 | 17.593 | 15.939 | −10.110 | 1.00 | 58.32 C |
| ATOM | 5008 | CD | GLN | L | 27 | 16.276 | 16.021 | −10.810 | 1.00 | 58.72 C |
| ATOM | 5009 | OE1 | GLN | L | 27 | 15.584 | 17.031 | −10.729 | 1.00 | 61.36 O |
| ATOM | 5010 | NE2 | GLN | L | 27 | 15.911 | 14.956 | −11.506 | 1.00 | 66.22 N |
| ATOM | 5011 | N | SER | L | 28 | 20.661 | 19.378 | −10.478 | 1.00 | 38.71 N |
| ATOM | 5012 | CA | SER | L | 28 | 21.570 | 20.364 | −9.906 | 1.00 | 39.34 C |
| ATOM | 5013 | C | SER | L | 28 | 20.804 | 21.186 | −8.869 | 1.00 | 37.88 C |
| ATOM | 5014 | O | SER | L | 28 | 19.816 | 21.845 | −9.204 | 1.00 | 36.95 O |
| ATOM | 5015 | CB | SER | L | 28 | 22.162 | 21.238 | −11.016 | 1.00 | 43.02 C |

TABLE 77-continued

| ATOM | 5016 | OG | SER | L | 28 | 23.227 | 22.032 | −10.529 | 1.00 | 49.86 | O |
|---|---|---|---|---|---|---|---|---|---|---|---|
| ATOM | 5017 | N | ILE | L | 29 | 21.235 | 21.108 | −7.606 | 1.00 | 35.41 | N |
| ATOM | 5018 | CA | ILE | L | 29 | 20.465 | 21.634 | −6.478 | 1.00 | 37.95 | C |
| ATOM | 5019 | C | ILE | L | 29 | 21.238 | 22.717 | −5.733 | 1.00 | 33.57 | C |
| ATOM | 5020 | O | ILE | L | 29 | 21.050 | 22.905 | −4.524 | 1.00 | 33.19 | O |
| ATOM | 5021 | CB | ILE | L | 29 | 20.060 | 20.511 | −5.502 | 1.00 | 37.26 | C |
| ATOM | 5022 | CG1 | ILE | L | 29 | 21.299 | 19.781 | −4.971 | 1.00 | 37.01 | C |
| ATOM | 5023 | CG2 | ILE | L | 29 | 19.083 | 19.537 | −6.172 | 1.00 | 37.56 | C |
| ATOM | 5024 | CD1 | ILE | L | 29 | 21.029 | 18.811 | −3.796 | 1.00 | 38.00 | C |
| ATOM | 5025 | N | SER | L | 30 | 22.100 | 23.440 | −6.441 | 1.00 | 34.30 | N |
| ATOM | 5026 | CA | SER | L | 30 | 22.820 | 24.584 | −5.863 | 1.00 | 35.19 | C |
| ATOM | 5027 | C | SER | L | 30 | 23.473 | 24.103 | −4.570 | 1.00 | 33.42 | C |
| ATOM | 5028 | O | SER | L | 30 | 24.161 | 23.074 | −4.580 | 1.00 | 38.92 | O |
| ATOM | 5029 | CB | SER | L | 30 | 21.854 | 25.759 | −5.719 | 1.00 | 32.49 | C |
| ATOM | 5030 | OG | SER | L | 30 | 22.432 | 26.797 | −4.929 | 1.00 | 37.15 | O |
| ATOM | 5031 | N | SER | L | 31 | 23.277 | 24.773 | −3.443 | 1.00 | 32.35 | N |
| ATOM | 5032 | CA | SER | L | 31 | 23.922 | 2.4.378 | −2.199 | 1.00 | 32.27 | C |
| ATOM | 5033 | C | SER | L | 31 | 22.904 | 23.896 | −1.169 | 1.00 | 33.39 | C |
| ATOM | 5034 | O | SER | L | 31 | 23.123 | 24.035 | 0.035 | 1.00 | 33.49 | O |
| ATOM | 5035 | CB | SER | L | 31 | 24.743 | 25.543 | −1.648 | 1.00 | 35.66 | C |
| ATOM | 5036 | OG | SER | L | 31 | 23.890 | 26.650 | −1.462 | 1.00 | 38.12 | O |
| ATOM | 5037 | N | TYR | L | 32 | 21.786 | 23.323 | −1.631 | 1.00 | 31.91 | N |
| ATOM | 5038 | CA | TYR | L | 32 | 20.706 | 22.881 | −0.742 | 1.00 | 37.21 | C |
| ATOM | 5039 | C | TYR | L | 32 | 20.960 | 21.434 | −0.335 | 1.00 | 33.92 | C |
| ATOM | 5040 | O | TYR | L | 32 | 20.409 | 20.483 | −0.897 | 1.00 | 34.53 | O |
| ATOM | 5041 | CB | TYR | L | 32 | 19.348 | 23.039 | −1.422 | 1.00 | 33.11 | C |
| ATOM | 5042 | CG | TYR | L | 32 | 18.904 | 24.485 | −1.590 | 1.00 | 32.05 | C |
| ATOM | 5043 | CD1 | TYR | L | 32 | 19.457 | 25.298 | −2.576 | 1.00 | 33.28 | C |
| ATOM | 5044 | CD2 | TYR | L | 32 | 17.944 | 25.027 | −0.756 | 1.00 | 33.25 | C |
| ATOM | 5045 | CE1 | TYR | L | 32 | 19.048 | 26.629 | −2.732 | 1.00 | 33.87 | C |
| ATOM | 5046 | CE2 | TYR | L | 32 | 17.545 | 26.348 | −0.888 | 1.00 | 32.38 | C |
| ATOM | 5047 | CZ | TYR | L | 32 | 18.098 | 27.134 | −1.885 | 1.00 | 35.77 | C |
| ATOM | 5048 | OH | TYR | L | 32 | 17.685 | 28.433 | −2.011 | 1.00 | 36.17 | O |
| ATOM | 5049 | N | LEU | L | 33 | 21.795 | 21.273 | 0.688 | 1.00 | 33.80 | N |
| ATOM | 5050 | CA | LEU | L | 33 | 22.182 | 19.946 | 1.137 | 1.00 | 35.64 | C |
| ATOM | 5051 | C | LEU | L | 33 | 22.678 | 20.035 | 2.576 | 1.00 | 35.08 | C |
| ATOM | 5052 | O | LEU | L | 33 | 23.429 | 20.956 | 2.930 | 1.00 | 33.43 | O |
| ATOM | 5053 | CB | LEU | L | 33 | 23.250 | 19.361 | 0.197 | 1.00 | 35.36 | C |
| ATOM | 5054 | CG | LEU | L | 33 | 23.839 | 17.938 | 0.229 | 1.00 | 38.35 | C |
| ATOM | 5055 | CD1 | LEU | L | 33 | 24.622 | 17.619 | 1.495 | 1.00 | 39.27 | C |
| ATOM | 5056 | CD2 | LEU | L | 33 | 22.834 | 16.890 | −0.070 | 1.00 | 36.12 | C |
| ATOM | 5057 | N | ASN | L | 34 | 22.223 | 19.086 | 3.397 | 1.00 | 32.15 | N |
| ATOM | 5058 | CA | ASN | L | 34 | 22.640 | 18.904 | 4.776 | 1.00 | 34.30 | C |
| ATOM | 5059 | C | ASN | L | 34 | 23.384 | 17.584 | 4.908 | 1.00 | 36.37 | C |
| ATOM | 5060 | O | ASN | L | 34 | 23.154 | 16.646 | 4.137 | 1.00 | 34.36 | O |
| ATOM | 5061 | CB | ASN | L | 34 | 21.447 | 18.869 | 5.751 | 1.00 | 34.10 | C |
| ATOM | 5062 | CG | ASN | L | 34 | 20.648 | 20.155 | 5.767 | 1.00 | 37.12 | C |
| ATOM | 5063 | OD1 | ASN | L | 34 | 21.143 | 21.220 | 5.394 | 1.00 | 39.69 | O |
| ATOM | 5064 | ND2 | ASN | L | 34 | 19.415 | 20.068 | 6.239 | 1.00 | 33.28 | N |
| ATOM | 5065 | N | TRP | L | 35 | 24.240 | 17.515 | 5.932 | 1.00 | 33.60 | N |
| ATOM | 5066 | CA | TRP | L | 35 | 24.880 | 16.280 | 6.379 | 1.00 | 36.84 | C |
| ATOM | 5067 | C | TRP | L | 35 | 24.523 | 16.043 | 7.842 | 1.00 | 37.38 | C |
| ATOM | 5068 | O | TRP | L | 35 | 24.633 | 16.960 | 8.662 | 1.00 | 38.12 | O |
| ATOM | 5069 | CB | TRP | L | 35 | 26.409 | 16.355 | 6.237 | 1.00 | 33.04 | C |
| ATOM | 5070 | CG | TRP | L | 35 | 26.915 | 16.295 | 4.826 | 1.00 | 37.12 | C |
| ATOM | 5071 | CD1 | TRP | L | 35 | 27.363 | 17.341 | 4.073 | 1.00 | 32.07 | C |
| ATOM | 5072 | CD2 | TRP | L | 35 | 27.047 | 15.121 | 4.007 | 1.00 | 37.70 | C |
| ATOM | 5073 | NE1 | TRP | L | 35 | 27.748 | 16.892 | 2.828 | 1.00 | 36.01 | N |
| ATOM | 5074 | CE2 | TRP | L | 35 | 27.574 | 15.534 | 2.766 | 1.00 | 40.65 | C |
| ATOM | 5075 | CE3 | TRP | L | 35 | 26.773 | 13.760 | 4.205 | 1.00 | 40.27 | C |
| ATOM | 5076 | CZ2 | TRP | L | 35 | 27.823 | 14.640 | 1.726 | 1.00 | 39.07 | C |
| ATOM | 5077 | CZ3 | TRP | L | 35 | 27.019 | 12.876 | 3.168 | 1.00 | 42.34 | C |
| ATOM | 5078 | CH2 | TRP | L | 35 | 27.546 | 13.321 | 1.947 | 1.00 | 38.90 | C |
| ATOM | 5079 | N | TYR | L | 36 | 24.111 | 14.815 | 8.171 | 1.00 | 35.72 | N |
| ATOM | 5080 | CA | TYR | L | 36 | 23.779 | 14.442 | 9.538 | 1.00 | 37.53 | C |
| ATOM | 5081 | O | TYR | L | 36 | 24.660 | 13.290 | 10.003 | 1.00 | 42.60 | C |
| ATOM | 5082 | O | TYR | L | 36 | 25.071 | 12.447 | 9.206 | 1.00 | 41.60 | O |
| ATOM | 5083 | CB | TYR | L | 36 | 22.328 | 13.989 | 9.676 | 1.00 | 37.64 | C |
| ATOM | 5084 | CG | TYR | L | 36 | 21.293 | 14.989 | 9.240 | 1.00 | 39.19 | C |
| ATOM | 5085 | CD1 | TYR | L | 36 | 20.731 | 15.878 | 10.149 | 1.00 | 36.00 | C |
| ATOM | 5086 | CD2 | TYR | L | 36 | 20.851 | 15.029 | 7.927 | 1.00 | 39.13 | C |
| ATOM | 5087 | CE1 | TYR | L | 36 | 19.764 | 16.794 | 9.754 | 1.00 | 39.88 | C |
| ATOM | 5088 | CE2 | TYR | L | 36 | 19.873 | 15.953 | 7.525 | 1.00 | 36.80 | C |
| ATOM | 5089 | CZ | TYR | L | 36 | 19.338 | 16.823 | 8.440 | 1.00 | 41.43 | C |
| ATOM | 5090 | OH | TYR | L | 36 | 18.360 | 17.721 | 8.040 | 1.00 | 40.29 | O |
| ATOM | 5091 | N | GLN | L | 37 | 24.915 | 13.251 | 11.305 | 1.00 | 41.95 | N |
| ATOM | 5092 | CA | GLN | L | 37 | 25.504 | 12.100 | 11.978 | 1.00 | 41.56 | C |
| ATOM | 5093 | C | GLN | L | 37 | 24.455 | 11.475 | 12.896 | 1.00 | 48.43 | C |
| ATOM | 5094 | O | GLN | L | 37 | 23.750 | 12.191 | 13.614 | 1.00 | 47.01 | O |
| ATOM | 5095 | CB | GLN | L | 37 | 26.725 | 12.537 | 12.776 | 1.00 | 49.00 | C |

TABLE 77-continued

| ATOM | 5096 | CG | GLN | L | 37 | 27.271 | 11.522 | 13.737 | 1.00 | 46.50 | C |
| --- | --- | --- | --- | --- | --- | --- | --- | --- | --- | --- | --- |
| ATOM | 5097 | CD | GLN | L | 37 | 28.252 | 12.159 | 14.669 | 1.00 | 54.35 | C |
| ATOM | 5098 | OE1 | GLN | L | 37 | 27.859 | 12.787 | 15.649 | 1.00 | 54.07 | O |
| ATOM | 5099 | NE2 | GLN | L | 37 | 29.547 | 12.049 | 14.351 | 1.00 | 52.38 | N |
| ATOM | 5100 | N | GLN | L | 38 | 24.325 | 10.152 | 12.858 | 1.00 | 44.79 | N |
| ATOM | 5101 | CA | GLN | L | 38 | 23.410 | 9.456 | 13.759 | 1.00 | 47.48 | C |
| ATOM | 5102 | C | GLN | L | 38 | 24.117 | 8.283 | 14.423 | 1.00 | 49.97 | C |
| ATOM | 5103 | O | GLN | L | 38 | 24.571 | 7.363 | 13.740 | 1.00 | 47.34 | O |
| ATOM | 5104 | CB | GLN | L | 38 | 22.164 | 8.958 | 13.032 | 1.00 | 44.16 | C |
| ATOM | 5105 | CG | GLN | L | 38 | 21.191 | 8.342 | 14.002 | 1.00 | 40.87 | C |
| ATOM | 5106 | CD | GLN | L | 38 | 19.898 | 7.931 | 13.378 | 1.00 | 42.75 | C |
| ATOM | 5107 | OE1 | GLN | L | 38 | 19.862 | 7.390 | 12.279 | 1.00 | 43.29 | O |
| ATOM | 5108 | NE2 | GLN | L | 38 | 18.809 | 8.186 | 14.082 | 1.00 | 42.78 | N |
| ATOM | 5109 | N | LYS | L | 39 | 24.177 | 8.303 | 15.720 | 1.00 | 46.55 | N |
| ATOM | 5110 | CA | LYS | L | 39 | 24.721 | 7.267 | 16.580 | 1.00 | 51.90 | C |
| ATOM | 5111 | C | LYS | L | 39 | 23.597 | 6.354 | 17.064 | 1.00 | 53.33 | C |
| ATOM | 5112 | O | LYS | L | 39 | 22.444 | 6.782 | 17.139 | 1.00 | 53.87 | O |
| ATOM | 5113 | CB | LYS | L | 39 | 25.455 | 7.901 | 17.761 | 1.00 | 53.12 | C |
| ATOM | 5114 | CG | LYS | L | 39 | 26.735 | 8.623 | 17.336 | 1.00 | 56.23 | C |
| ATOM | 5115 | CD | LYS | L | 39 | 27.352 | 9.528 | 18.420 | 1.00 | 65.41 | C |
| ATOM | 5116 | CE | LYS | L | 39 | 26.475 | 10.757 | 18.756 | 1.00 | 74.58 | C |
| ATOM | 5117 | NZ | LYS | L | 39 | 26.067 | 11.640 | 17.589 | 1.00 | 68.58 | N1+ |
| ATOM | 5118 | N | PRO | L | 40 | 23.899 | 5.088 | 17.378 | 1.00 | 52.76 | N |
| ATOM | 5119 | CA | PRO | L | 40 | 22.833 | 4.109 | 17.655 | 1.00 | 52.23 | C |
| ATOM | 5120 | C | PRO | L | 40 | 21.868 | 4.572 | 18.740 | 1.00 | 49.22 | C |
| ATOM | 5121 | O | PRO | L | 40 | 22.267 | 5.173 | 19.734 | 1.00 | 48.26 | O |
| ATOM | 5122 | CB | PRO | L | 40 | 23.609 | 2.862 | 18.092 | 1.00 | 56.13 | C |
| ATOM | 5123 | CG | PRO | L | 40 | 24.934 | 3.001 | 17.428 | 1.00 | 55.40 | C |
| ATOM | 5124 | CD | PRO | L | 40 | 25.237 | 4.470 | 17.439 | 1.00 | 52.53 | C |
| ATOM | 5125 | N | GLY | L | 41 | 20.579 | 1.313 | 18.510 | 1.00 | 51.47 | N |
| ATOM | 5126 | CA | GLY | L | 41 | 19.522 | 4.677 | 19.442 | 1.00 | 55.69 | C |
| ATOM | 5127 | C | GLY | L | 41 | 19.349 | 6.160 | 19.702 | 1.00 | 60.35 | C |
| ATOM | 5128 | O | GLY | L | 41 | 18.723 | 6.537 | 20.696 | 1.00 | 60.95 | O |
| ATOM | 5129 | N | ARG | L | 42 | 19.877 | 7.022 | 18.839 | 1.00 | 53.29 | N |
| ATOM | 5130 | CA | ARG | L | 42 | 19.822 | 8.459 | 19.057 | 1.00 | 55.45 | C |
| ATOM | 5131 | C | ARG | L | 42 | 19.262 | 9.134 | 17.814 | 1.00 | 46.30 | C |
| ATOM | 5132 | O | ARG | L | 42 | 19.331 | 8.590 | 16.711 | 1.00 | 46.57 | O |
| ATOM | 5133 | CB | ARG | L | 42 | 21.218 | 9.012 | 19.407 | 1.00 | 56.28 | C |
| ATOM | 5134 | CG | ARG | L | 42 | 21.262 | 10.489 | 19.806 | 1.00 | 65.51 | C |
| ATOM | 5135 | CD | ARG | L | 42 | 22.705 | 10.990 | 19.943 | 1.00 | 73.74 | C |
| ATOM | 5136 | NE | ARG | L | 42 | 23.220 | 11.637 | 18.729 | 1.00 | 73.45 | N |
| ATOM | 5137 | CZ | ARG | L | 42 | 23.352 | 11.042 | 17.540 | 1.00 | 58.88 | C |
| ATOM | 5138 | NH1 | ARG | L | 42 | 23.003 | 9.782 | 17.371 | 1.00 | 61.51 | N1+ |
| ATOM | 5139 | NH2 | ARG | L | 42 | 23.839 | 11.714 | 16.510 | 1.00 | 60.99 | N1+ |
| ATOM | 5140 | N | ALA | L | 43 | 18.670 | 10.308 | 18.001 | 1.00 | 46.88 | N |
| ATOM | 5141 | CA | ALA | L | 43 | 18.191 | 11.062 | 16.859 | 1.00 | 47.69 | C |
| ATOM | 5142 | C | ALA | L | 43 | 19.375 | 11.585 | 16.046 | 1.00 | 48.24 | C |
| ATOM | 5143 | O | ALA | L | 43 | 20.475 | 11.767 | 16.574 | 1.00 | 45.17 | O |
| ATOM | 5144 | CB | ALA | L | 43 | 17.316 | 12.227 | 17.309 | 1.00 | 40.98 | C |
| ATOM | 5145 | N | PRO | L | 44 | 19.175 | 11.834 | 14.756 | 1.00 | 42.84 | N |
| ATOM | 5146 | CA | PRO | L | 44 | 20.241 | 12.450 | 13.968 | 1.00 | 43.80 | C |
| ATOM | 5147 | C | PRO | L | 44 | 20.653 | 13.791 | 14.551 | 1.00 | 44.07 | C |
| ATOM | 5148 | O | PRO | L | 44 | 19.914 | 14.454 | 15.285 | 1.00 | 42.61 | O |
| ATOM | 5149 | CB | PRO | L | 44 | 19.609 | 12.612 | 12.580 | 1.00 | 45.78 | C |
| ATOM | 5150 | CG | PRO | L | 44 | 18.491 | 11.607 | 12.555 | 1.00 | 40.07 | C |
| ATOM | 5151 | CD | PRO | L | 44 | 17.971 | 11.579 | 13.948 | 1.00 | 43.11 | C |
| ATOM | 5152 | N | LYS | L | 45 | 21.869 | 14.177 | 14.217 | 1.00 | 39.76 | N |
| ATOM | 5153 | CA | LYS | L | 45 | 22.430 | 15.446 | 14.623 | 1.00 | 40.98 | C |
| ATOM | 5154 | C | LYS | L | 45 | 22.923 | 16.112 | 13.357 | 1.00 | 44.43 | C |
| ATOM | 5155 | O | LYS | L | 45 | 23.561 | 15.459 | 12.522 | 1.00 | 43.33 | O |
| ATOM | 5156 | CB | LYS | L | 45 | 23.553 | 15.242 | 15.635 | 1.00 | 42.82 | C |
| ATOM | 5157 | CG | LYS | L | 45 | 24.504 | 16.410 | 15.827 | 1.00 | 53.15 | C |
| ATOM | 5158 | CD | LYS | L | 45 | 25.608 | 16.010 | 16.820 | 1.00 | 53.61 | C |
| ATOM | 5159 | CE | LYS | L | 45 | 26.550 | 17.144 | 17.105 | 1.00 | 56.68 | C |
| ATOM | 5160 | NZ | LYS | L | 45 | 27.248 | 16.896 | 18.401 | 1.00 | 68.40 | N1+ |
| ATOM | 5161 | N | LEU | L | 46 | 22.592 | 17.387 | 13.193 | 1.00 | 38.52 | N |
| ATOM | 5162 | CA | LEU | L | 46 | 22.991 | 18.115 | 12.000 | 1.00 | 37.66 | C |
| ATOM | 5163 | C | LEU | L | 46 | 24.465 | 18.491 | 12.098 | 1.00 | 37.09 | C |
| ATOM | 5164 | O | LEU | L | 46 | 24.904 | 19.041 | 13.109 | 1.00 | 37.72 | O |
| ATOM | 5165 | CB | LEU | L | 46 | 22.137 | 19.371 | 11.830 | 1.00 | 36.94 | C |
| ATOM | 5166 | CG | LEU | L | 46 | 22.560 | 20.259 | 10.649 | 1.00 | 38.01 | C |
| ATOM | 5167 | CD1 | LEU | L | 46 | 22.138 | 19.573 | 9.347 | 1.00 | 39.59 | C |
| ATOM | 5168 | CD2 | LEU | L | 46 | 21.952 | 21.620 | 10.753 | 1.00 | 43.20 | C |
| ATOM | 5169 | N | LEU | L | 47 | 25.236 | 18.184 | 11.056 | 1.00 | 37.61 | N |
| ATOM | 5170 | CA | LEU | L | 47 | 26.642 | 18.587 | 11.008 | 1.00 | 41.52 | C |
| ATOM | 5171 | C | LEU | L | 47 | 26.892 | 19.755 | 10.068 | 1.00 | 39.08 | C |
| ATOM | 5172 | O | LEU | L | 47 | 27.588 | 20.712 | 10.423 | 1.00 | 40.45 | O |
| ATOM | 5173 | CB | LEU | L | 47 | 27.528 | 17.410 | 10.561 | 1.00 | 39.32 | C |
| ATOM | 5174 | CG | LEU | L | 47 | 27.405 | 16.108 | 11.340 | 1.00 | 44.21 | O |
| ATOM | 5175 | CD1 | LEU | L | 47 | 27.980 | 14.969 | 10.521 | 1.00 | 44.71 | C |

TABLE 77-continued

| | | | | | | | | | | |
|---|---|---|---|---|---|---|---|---|---|---|
| ATOM | 5176 | CD2 | LEU | L | 47 | 28.136 | 16.249 | 12.661 | 1.00 | 44.37 | C |
| ATOM | 5177 | N | ILE | L | 48 | 26.395 | 19.655 | 8.839 | 1.00 | 37.23 | N |
| ATOM | 5178 | CA | ILE | L | 48 | 26.622 | 20.644 | 7.798 | 1.00 | 37.53 | C |
| ATOM | 5179 | C | ILE | L | 48 | 25.264 | 21.032 | 7.235 | 1.00 | 35.54 | C |
| ATOM | 5180 | O | ILE | L | 48 | 24.395 | 20.171 | 7.065 | 1.00 | 35.18 | O |
| ATOM | 5181 | CB | ILE | L | 48 | 27.531 | 20.094 | 6.677 | 1.00 | 37.36 | C |
| ATOM | 5182 | CG1 | ILE | L | 48 | 28.877 | 19.591 | 7.234 | 1.00 | 39.64 | C |
| ATOM | 5183 | CG2 | ILE | L | 48 | 27.738 | 21.145 | 5.587 | 1.00 | 35.38 | C |
| ATOM | 5184 | CD1 | ILE | L | 48 | 29.776 | 20.676 | 7.769 | 1.00 | 42.11 | C |
| ATOM | 5185 | N | PHE | L | 49 | 25.070 | 22.321 | 6.951 | 1.00 | 34.66 | N |
| ATOM | 5186 | CA | PHE | L | 49 | 23.895 | 22.753 | 6.205 | 1.00 | 35.76 | C |
| ATOM | 5187 | C | PHE | L | 49 | 24.335 | 23.669 | 5.079 | 1.00 | 35.11 | C |
| ATOM | 5188 | O | PHE | L | 49 | 25.426 | 24.235 | 5.112 | 1.00 | 37.76 | O |
| ATOM | 5189 | CB | PHE | L | 49 | 22.868 | 23.468 | 7.083 | 1.00 | 34.87 | C |
| ATOM | 5190 | CG | PHE | L | 49 | 23.402 | 24.688 | 7.770 | 1.00 | 39.01 | C |
| ATOM | 5191 | CD1 | PHE | L | 49 | 24.011 | 24.585 | 9.013 | 1.00 | 41.59 | C |
| ATOM | 5192 | CD2 | PHE | L | 49 | 23.294 | 25.947 | 7.173 | 1.00 | 40.75 | C |
| ATOM | 5193 | CE1 | PHE | L | 49 | 24.48 | 25.722 | 9.662 | 1.00 | 43.62 | C |
| ATOM | 5194 | CE2 | PHE | L | 49 | 23.773 | 27.081 | 7.808 | 1.00 | 38.75 | C |
| ATOM | 5195 | CZ | PHE | L | 49 | 24.366 | 26.969 | 9.056 | 1.00 | 39.98 | C |
| ATOM | 5196 | N | ALA | L | 50 | 23.459 | 23.821 | 4.084 | 1.00 | 36.09 | N |
| ATOM | 5197 | CA | ALA | L | 50 | 23.755 | 24.643 | 2.922 | 1.00 | 35.85 | C |
| ATOM | 5198 | C | ALA | L | 50 | 25.067 | 24.185 | 2.287 | 1.00 | 33.80 | C |
| ATOM | 5199 | O | ALA | L | 50 | 25.923 | 24.990 | 1.909 | 1.00 | 35.19 | O |
| ATOM | 5200 | CB | ALA | L | 50 | 23.782 | 26.140 | 3.289 | 1.00 | 36.64 | C |
| ATOM | 5201 | N | ALA | L | 51 | 25.248 | 22.860 | 2.258 | 1.00 | 36.90 | N |
| ATOM | 5202 | CA | ALA | L | 51 | 26.356 | 22.190 | 1.591 | 1.00 | 35.34 | C |
| ATOM | 5203 | C | ALA | L | 51 | 27.696 | 22.371 | 2.310 | 1.00 | 40.13 | C |
| ATOM | 5204 | O | ALA | L | 51 | 28.478 | 21.420 | 2.392 | 1.00 | 38.18 | O |
| ATOM | 5205 | CB | ALA | L | 51 | 26.466 | 22.671 | 0.136 | 1.00 | 30.86 | C |
| ATOM | 5206 | N | ASER | L | 52 | 27.969 | 23.568 | 2.845 | 0.14 | 36.35 | N |
| ATOM | 5207 | CA | ASER | L | 52 | 29.306 | 23.855 | 3.353 | 0.14 | 40.13 | C |
| ATOM | 5208 | C | ASER | L | 52 | 29.338 | 24.643 | 4.659 | 0.14 | 39.79 | C |
| ATOM | 5209 | O | ASER | L | 52 | 30.422 | 25.080 | 5.064 | 0.14 | 41.00 | O |
| ATOM | 5210 | CB | ASER | L | 52 | 30.125 | 24.616 | 2.300 | 0.14 | 37.25 | C |
| ATOM | 5211 | OG | ASER | L | 52 | 30.387 | 23.812 | 1.166 | 0.14 | 37.10 | O |
| ATOM | 5212 | N | BSER | L | 52 | 27.980 | 23.564 | 2.846 | 0.86 | 35.94 | N |
| ATOM | 5213 | CA | BSER | L | 52 | 29.315 | 23.794 | 3.395 | 0.86 | 40.24 | C |
| ATOM | 5214 | C | BSER | L | 52 | 29.351 | 24.561 | 4.710 | 0.86 | 39.75 | C |
| ATOM | 5215 | O | BSER | L | 52 | 30.449 | 24.873 | 5.184 | 0.86 | 41.03 | O |
| ATOM | 5216 | CB | BSER | L | 52 | 30.203 | 24.525 | 2.368 | 0.86 | 37.11 | C |
| ATOM | 5217 | OG | BSER | L | 52 | 29.605 | 25.727 | 1.930 | 0.86 | 37.97 | O |
| ATOM | 5218 | N | SER | L | 53 | 28.213 | 24.847 | 5.336 | 1.00 | 36.29 | N |
| ATOM | 5219 | CA | SER | L | 53 | 28.193 | 25.648 | 6.556 | 1.00 | 38.91 | C |
| ATOM | 5220 | C | SER | L | 53 | 28.258 | 24.739 | 7.771 | 1.00 | 41.48 | C |
| ATOM | 5221 | O | SER | L | 53 | 27.403 | 23.872 | 7.950 | 1.00 | 41.89 | O |
| ATOM | 5222 | CB | SER | L | 53 | 26.953 | 26.533 | 6.631 | 1.00 | 41.62 | C |
| ATOM | 5223 | OG | SER | L | 53 | 27.068 | 27.592 | 5.717 | 1.00 | 45.94 | O |
| ATOM | 5224 | N | LEU | L | 54 | 29.263 | 24.954 | 8.612 | 1.00 | 43.53 | N |
| ATOM | 5225 | CA | LEU | L | 54 | 29.482 | 24.086 | 9.759 | 1.00 | 50.08 | C |
| ATOM | 5226 | C | LEU | L | 54 | 28.552 | 24.498 | 10.893 | 1.00 | 49.40 | C |
| ATOM | 5227 | O | LEU | L | 54 | 28.551 | 25.660 | 11.311 | 1.00 | 49.33 | O |
| ATOM | 5228 | CB | LEU | L | 54 | 30.946 | 24.149 | 10.197 | 1.00 | 46.82 | C |
| ATOM | 5229 | CG | LEU | L | 54 | 31.336 | 23.223 | 11.348 | 1.00 | 51.18 | C |
| ATOM | 5230 | CD1 | LEU | L | 54 | 31.153 | 21.770 | 10.934 | 1.00 | 48.65 | C |
| ATOM | 5231 | CD2 | LEU | L | 51 | 32.778 | 23.497 | 11.807 | 1.00 | 53.36 | C |
| ATOM | 5232 | N | GLN | L | 55 | 27.741 | 23.557 | 11.367 | 1.00 | 46.38 | N |
| ATOM | 5233 | CA | GLN | L | 55 | 26.848 | 23.846 | 12.479 | 1.00 | 48.49 | C |
| ATOM | 5234 | C | GLN | L | 55 | 27.654 | 24.229 | 13.716 | 1.00 | 52.45 | C |
| ATOM | 5235 | O | GLN | L | 55 | 28.670 | 23.605 | 14.037 | 1.00 | 54.64 | O |
| ATOM | 5236 | CB | GLN | L | 55 | 25.961 | 22.630 | 12.765 | 1.00 | 46.51 | C |
| ATOM | 5237 | CG | GLN | L | 55 | 25.323 | 22.628 | 14.133 | 1.00 | 52.16 | C |
| ATOM | 5238 | CD | GLN | L | 55 | 24.041 | 23.433 | 14.170 | 1.00 | 54.18 | C |
| ATOM | 5239 | OE1 | GLN | L | 55 | 23.608 | 23.965 | 13.151 | 1.00 | 57.40 | O |
| ATOM | 5240 | NE2 | GLN | L | 55 | 23.414 | 23.507 | 15.345 | 1.00 | 55.99 | N |
| ATOM | 5241 | N | GLY | L | 56 | 27.214 | 25.279 | 14.401 | 1.00 | 54.35 | N |
| ATOM | 5242 | CA | GLY | L | 56 | 27.897 | 25.679 | 15.615 | 1.00 | 53.34 | C |
| ATOM | 5243 | C | GLY | L | 56 | 27.985 | 24.517 | 16.582 | 1.00 | 53.82 | C |
| ATOM | 5244 | O | GLY | L | 56 | 26.999 | 23.807 | 16.795 | 1.00 | 55.95 | O |
| ATOM | 5245 | N | GLY | L | 57 | 29.155 | 24.289 | 17.154 | 1.00 | 58.38 | N |
| ATOM | 5246 | CA | GLY | L | 57 | 29.340 | 23.183 | 18.063 | 1.00 | 58.63 | C |
| ATOM | 5247 | C | GLY | L | 57 | 29.939 | 21.939 | 17.442 | 1.00 | 64.57 | C |
| ATOM | 5248 | O | GLY | L | 57 | 30.408 | 21.063 | 18.181 | 1.00 | 68.94 | O |
| ATOM | 5249 | N | VAL | L | 58 | 29.935 | 21.825 | 16.119 | 1.00 | 55.45 | N |
| ATOM | 5250 | CA | VAL | L | 58 | 30.527 | 20.662 | 15.466 | 1.00 | 52.85 | C |
| ATOM | 5251 | C | VAL | L | 58 | 32.020 | 20.929 | 15.301 | 1.00 | 54.90 | C |
| ATOM | 5252 | O | VAL | L | 58 | 32.403 | 22.024 | 14.862 | 1.00 | 58.36 | O |
| ATOM | 5253 | CB | VAL | L | 58 | 29.830 | 20.365 | 14.126 | 1.00 | 56.81 | C |
| ATOM | 5254 | CG1 | VAL | L | 58 | 30.444 | 19.130 | 13.428 | 1.00 | 52.08 | C |
| ATOM | 5255 | CG2 | VAL | L | 58 | 28.336 | 20.159 | 14.359 | 1.00 | 51.69 | C |

TABLE 77-continued

| ATOM | 5256 | N | PRO | L | 59 | 32.895 | 19.983 | 15.655 | 1.00 | 57.66 | N |
|---|---|---|---|---|---|---|---|---|---|---|---|
| ATOM | 5257 | CA | PRO | L | 59 | 34.339 | 20.231 | 15.541 | 1.00 | 58.33 | C |
| ATOM | 5258 | C | PRO | L | 59 | 34.742 | 20.579 | 14.120 | 1.00 | 58.28 | C |
| ATOM | 5259 | O | PRO | L | 59 | 34.137 | 20.126 | 13.148 | 1.00 | 57.21 | O |
| ATOM | 5260 | CB | PRO | L | 59 | 34.969 | 18.905 | 15.981 | 1.00 | 56.75 | C |
| ATOM | 5261 | CG | PRO | L | 59 | 33.930 | 18.248 | 16.822 | 1.00 | 62.56 | C |
| ATOM | 5262 | CD | PRO | L | 59 | 32.601 | 18.671 | 16.255 | 1.00 | 59.47 | C |
| ATOM | 5263 | N | SER | L | 60 | 35.803 | 21.371 | 14.013 | 1.00 | 60.44 | N |
| ATOM | 5264 | CA | SER | L | 60 | 36.298 | 21.857 | 12.733 | 0.96 | 61.40 | C |
| ATOM | 5265 | C | SER | L | 60 | 36.794 | 20.738 | 11.819 | 1.00 | 60.55 | C |
| ATOM | 5266 | O | SER | L | 60 | 37.123 | 20.995 | 10.658 | 1.00 | 59.76 | O |
| ATOM | 5267 | CB | SER | L | 60 | 37.420 | 22.869 | 12.971 | 1.00 | 61.08 | C |
| ATOM | 5268 | OG | SER | L | 60 | 37.930 | 23.354 | 11.742 | 0.50 | 60.69 | O |
| ATOM | 5269 | N | ARG | L | 61 | 36.857 | 19.497 | 12.316 | 1.00 | 56.68 | N |
| ATOM | 5270 | CA | ARG | L | 61 | 37.326 | 18.389 | 11.486 | 1.00 | 56.71 | C |
| ATOM | 5271 | C | ARG | L | 61 | 36.286 | 17.932 | 10.476 | 1.00 | 59.22 | C |
| ATOM | 5272 | O | ARG | L | 61 | 36.639 | 17.256 | 9.501 | 1.00 | 56.98 | O |
| ATOM | 5273 | CH | ARG | L | 61 | 37.726 | 17.201 | 12.356 | 1.00 | 58.93 | C |
| ATOM | 5274 | CG | ARG | L | 61 | 38.549 | 17.590 | 13.566 | 1.00 | 69.98 | C |
| ATOM | 5275 | CD | ARG | L | 61 | 37.864 | 17.120 | 14.815 | 1.00 | 68.70 | C |
| ATOM | 5276 | NE | ARG | L | 61 | 37.230 | 15.828 | 14.592 | 1.00 | 63.12 | N |
| ATOM | 5277 | CZ | ARG | L | 61 | 36.527 | 15.185 | 15.515 | 1.00 | 65.04 | C |
| ATOM | 5278 | NH1 | ARG | L | 61 | 36.371 | 15.709 | 16.720 | 1.00 | 69.03 | N1+ |
| ATOM | 5279 | NH2 | ARG | L | 61 | 35.983 | 14.020 | 15.234 | 1.00 | 59.61 | N1+ |
| ATOM | 5280 | N | PHE | L | 62 | 35.018 | 18.258 | 10.699 | 1.00 | 56.97 | N |
| ATOM | 5281 | CA | PHE | L | 62 | 33.971 | 18.022 | 9.717 | 1.00 | 52.36 | C |
| ATOM | 5282 | C | PHE | L | 62 | 33.903 | 19.206 | 8.763 | 1.00 | 49.09 | C |
| ATOM | 5283 | O | PHE | L | 62 | 33.846 | 20.358 | 9.201 | 1.00 | 52.62 | O |
| ATOM | 5284 | CB | PHE | L | 62 | 32.619 | 17.824 | 10.402 | 1.00 | 51.13 | C |
| ATOM | 5285 | CG | PHE | L | 62 | 32.573 | 16.645 | 11.316 | 1.00 | 52.27 | C |
| ATOM | 5286 | CD1 | PHE | L | 62 | 32.943 | 16.769 | 12.643 | 1.00 | 57.24 | C |
| ATOM | 5287 | CD2 | PHE | L | 62 | 32.165 | 15.412 | 10.850 | 1.00 | 47.01 | C |
| ATOM | 5288 | CE1 | PHE | L | 62 | 32.907 | 15.683 | 13.491 | 1.00 | 55.14 | C |
| ATOM | 5289 | CE2 | PHE | L | 62 | 32.131 | 14.322 | 11.692 | 1.00 | 52.62 | C |
| ATOM | 5290 | CZ | PHE | L | 62 | 32.495 | 14.461 | 13.018 | 1.00 | 54.73 | C |
| ATOM | 5291 | N | SER | L | 63 | 33.901 | 18.923 | 7.462 | 1.00 | 47.94 | N |
| ATOM | 5292 | CA | SER | L | 63 | 33.727 | 19.968 | 6.466 | 1.00 | 47.13 | C |
| ATOM | 5293 | C | SER | L | 63 | 32.914 | 19.416 | 5.305 | 1.00 | 46.54 | C |
| ATOM | 5294 | O | SER | L | 63 | 33.011 | 18.235 | 4.963 | 1.00 | 46.48 | O |
| ATOM | 5295 | CB | SER | L | 63 | 35.077 | 20.512 | 5.962 | 1.00 | 51.16 | C |
| ATOM | 5296 | OG | SER | L | 63 | 35.633 | 19.654 | 4.975 | 1.00 | 53.51 | O |
| ATOM | 5297 | N | GLY | L | 64 | 32.101 | 20.279 | 4.706 | 1.00 | 44.62 | N |
| ATOM | 5298 | CA | GLY | L | 64 | 31.316 | 19.916 | 3.549 | 1.00 | 37.39 | C |
| ATOM | 5299 | C | GLY | L | 64 | 31.712 | 20.772 | 2.368 | 1.00 | 36.66 | C |
| ATOM | 5300 | O | GLY | L | 64 | 32.091 | 21.934 | 2.526 | 1.00 | 41.19 | O |
| ATOM | 5301 | N | SER | L | 65 | 31.612 | 20.195 | 1.175 | 1.00 | 38.63 | N |
| ATOM | 5302 | CA | SER | L | 65 | 31.983 | 20.934 | −0.019 | 1.00 | 38.75 | C |
| ATOM | 5303 | C | SER | L | 65 | 31.139 | 20.432 | −1.175 | 1.00 | 41.66 | C |
| ATOM | 5304 | O | SER | L | 65 | 30.455 | 19.417 | −1.079 | 1.00 | 37.19 | O |
| ATOM | 5305 | CB | SER | L | 65 | 33.480 | 20.790 | −0.326 | 1.00 | 41.95 | C |
| ATOM | 5306 | OG | SER | L | 65 | 33.815 | 19.415 | −0.459 | 1.00 | 48.67 | O |
| ATOM | 5307 | N | GLY | L | 66 | 31.194 | 21.165 | −2.271 | 1.00 | 40.77 | N |
| ATOM | 5308 | CA | GLY | L | 66 | 30.454 | 20.820 | −3.464 | 1.00 | 41.22 | C |
| ATOM | 5309 | C | GLY | L | 66 | 29.224 | 21.686 | −3.630 | 1.00 | 38.85 | C |
| ATOM | 5310 | O | GLY | L | 66 | 28.874 | 22.516 | −2.786 | 1.00 | 42.57 | O |
| ATOM | 5311 | N | SER | L | 67 | 28.538 | 21.433 | −4.738 | 1.00 | 40.90 | N |
| ATOM | 5312 | CA | SER | L | 67 | 27.341 | 22.157 | −5.131 | 1.00 | 41.60 | C |
| ATOM | 5313 | C | SER | L | 67 | 26.801 | 21.464 | −6.369 | 1.00 | 41.57 | C |
| ATOM | 5314 | O | SER | L | 67 | 27.477 | 20.636 | −6.983 | 1.00 | 44.53 | O |
| ATOM | 5315 | CB | SER | L | 67 | 27.645 | 23.629 | −5.422 | 1.00 | 46.38 | C |
| ATOM | 5316 | OG | SER | L | 67 | 28.510 | 23.720 | −6.534 | 1.00 | 46.51 | O |
| ATOM | 5317 | N | GLY | L | 68 | 25.577 | 21.804 | −6.730 | 1.00 | 38.48 | N |
| ATOM | 5318 | CA | GLY | L | 68 | 25.045 | 21.258 | −7.960 | 1.00 | 36.37 | C |
| ATOM | 5319 | C | GLY | L | 68 | 24.685 | 19.794 | −7.855 | 1.00 | 39.13 | C |
| ATOM | 5320 | O | GLY | L | 68 | 23.639 | 19.430 | −7.301 | 1.00 | 41.08 | O |
| ATOM | 5321 | N | THR | L | 69 | 25.556 | 18.938 | −8.369 | 1.00 | 39.83 | N |
| ATOM | 5322 | CA | THR | L | 69 | 25.273 | 17.516 | −8.488 | 1.00 | 40.79 | C |
| ATOM | 5323 | C | THR | L | 69 | 26.146 | 16.654 | −7.598 | 1.00 | 44.12 | C |
| ATOM | 5324 | O | THR | L | 69 | 25.954 | 15.440 | −7.557 | 1.00 | 44.48 | O |
| ATOM | 5325 | CB | THIR | L | 69 | 25.460 | 17.093 | −9.942 | 1.00 | 43.05 | C |
| ATOM | 5326 | OG1 | THR | L | 69 | 26.801 | 17.432 | −10.349 | 1.00 | 42.16 | O |
| ATOM | 5327 | CG2 | THR | L | 69 | 24.458 | 17.853 | −10.814 | 1.00 | 41.64 | C |
| ATOM | 5328 | N | ASP | L | 70 | 27.094 | 17.244 | −6.883 | 1.00 | 42.74 | N |
| ATOM | 5329 | CA | ASP | L | 70 | 28.175 | 16.475 | −6.287 | 1.00 | 44.38 | C |
| ATOM | 5330 | C | ASP | L | 70 | 28.559 | 17.140 | −4.974 | 1.00 | 41.27 | C |
| ATOM | 5331 | O | ASP | L | 70 | 28.891 | 18.325 | −4.957 | 1.00 | 38.78 | O |
| ATOM | 5332 | CB | ASP | L | 70 | 29.356 | 16.413 | −7.272 | 1.00 | 49.61 | C |
| ATOM | 5333 | CG | ASP | L | 70 | 30.471 | 15.498 | −6.809 | 1.00 | 56.22 | C |
| ATOM | 5334 | OD1 | ASP | L | 70 | 30.213 | 14.633 | −5.953 | 1.00 | 57.43 | O1− |
| ATOM | 5335 | OD2 | ASP | L | 70 | 31.613 | 15.648 | −7.307 | 1.00 | 68.36 | O1− |

TABLE 77-continued

| | | | | | | | | | | |
|---|---|---|---|---|---|---|---|---|---|---|
| ATOM | 5336 | N | PHE | L | 71 | 28.494 | 16.388 | −3.877 | 1.00 | 43.09 N |
| ATOM | 5337 | CA | PHE | L | 71 | 28.739 | 16.923 | −2.549 | 1.00 | 38.96 C |
| ATOM | 5338 | C | PHE | L | 71 | 29.603 | 15.955 | −1.766 | 1.00 | 41.55 C |
| ATOM | 5339 | O | PHE | L | 71 | 29.511 | 14.737 | −1.943 | 1.00 | 44.69 O |
| ATOM | 5340 | CB | PHE | L | 71 | 27.423 | 17.153 | −1.791 | 1.00 | 37.22 C |
| ATOM | 5341 | CG | PHE | L | 71 | 26.476 | 18.060 | −2.498 | 1.00 | 36.10 C |
| ATOM | 5342 | CD1 | PHE | L | 71 | 25.671 | 17.581 | −3.517 | 1.00 | 36.41 C |
| ATOM | 5343 | CD2 | PHE | L | 71 | 26.382 | 19.395 | −2.147 | 1.00 | 41.23 C |
| ATOM | 5344 | CE1 | PHE | L | 71 | 24.786 | 18.415 | −4.177 | 1.00 | 38.37 C |
| ATOM | 5345 | CE2 | PHE | L | 71 | 25.492 | 20.245 | −2.814 | 1.00 | 35.78 C |
| ATOM | 5346 | CZ | PHE | L | 71 | 24.701 | 19.754 | −3.818 | 1.00 | 37.64 C |
| ATOM | 5347 | N | THR | L | 72 | 30.416 | 16.495 | −0.867 | 1.00 | 34.34 N |
| ATOM | 5348 | CA | THR | L | 72 | 31.345 | 15.664 | −0.126 | 1.00 | 39.72 C |
| ATOM | 5349 | C | THR | L | 72 | 31.395 | 16.103 | 1.327 | 1.00 | 40.98 C |
| ATOM | 5350 | O | THR | L | 72 | 31.536 | 17.295 | 1.624 | 1.00 | 41.65 O |
| ATOM | 5351 | CB | THR | L | 72 | 32.758 | 15.731 | −0.735 | 1.00 | 44.34 C |
| ATOM | 5352 | OG1 | THR | L | 72 | 32.716 | 15.251 | −2.084 | 1.00 | 50.31 O |
| ATOM | 5353 | CG2 | THR | L | 72 | 33.688 | 14.852 | 0.060 | 1.00 | 46.68 C |
| ATOM | 5354 | N | LEU | L | 73 | 31.282 | 15.137 | 2.222 | 1.00 | 38.52 N |
| ATOM | 5355 | CA | LEU | L | 73 | 31.554 | 15.332 | 3.634 | 1.00 | 41.15 C |
| ATOM | 5356 | C | LEU | L | 73 | 32.917 | 14.727 | 3.915 | 1.00 | 45.64 C |
| ATOM | 5357 | O | LEU | L | 73 | 33.163 | 13.566 | 3.575 | 1.00 | 42.54 O |
| ATOM | 5358 | CB | LEU | L | 73 | 30.494 | 14.662 | 4.514 | 1.00 | 41.86 C |
| ATOM | 5359 | CG | LEU | L | 73 | 30.722 | 14.678 | 6.027 | 1.00 | 43.13 C |
| ATOM | 5360 | CD1 | LEU | L | 73 | 30.549 | 16.064 | 6.596 | 1.00 | 42.82 C |
| ATOM | 5361 | CD2 | LEU | L | 73 | 29.797 | 13.670 | 6.737 | 1.00 | 42.55 C |
| ATOM | 5362 | N | THR | L | 74 | 33.799 | 15.523 | 4.507 | 1.00 | 47.21 N |
| ATOM | 5363 | CA | THR | L | 74 | 35.149 | 15.095 | 4.839 | 1.00 | 51.24 C |
| ATOM | 5364 | C | THR | L | 74 | 35.342 | 15.204 | 6.338 | 1.00 | 49.89 C |
| ATOM | 5365 | O | THR | L | 74 | 34.941 | 16.199 | 6.947 | 1.00 | 52.14 O |
| ATOM | 5366 | CB | THR | L | 74 | 36.190 | 15.936 | 4.100 | 1.00 | 45.77 C |
| ATOM | 5367 | OG1 | THR | L | 74 | 36.060 | 15.700 | 2.692 | 1.00 | 47.55 O |
| ATOM | 5368 | CG2 | THR | L | 74 | 37.611 | 15.557 | 4.553 | 1.00 | 54.73 C |
| ATOM | 5369 | N | ILE | L | 75 | 35.909 | 14.163 | 6.937 | 1.00 | 48.69 N |
| ATOM | 5370 | CA | ILE | L | 75 | 36.364 | 14.215 | 8.317 | 1.00 | 50.12 C |
| ATOM | 5371 | C | ILE | L | 75 | 37.880 | 14.121 | 8.276 | 1.00 | 56.59 C |
| ATOM | 5372 | O | ILE | L | 75 | 38.433 | 13.113 | 7.819 | 1.00 | 57.08 O |
| ATOM | 5373 | CB | ILE | L | 75 | 35.751 | 13.098 | 9.164 | 1.00 | 53.02 C |
| ATOM | 5374 | CG1 | ILE | L | 75 | 34.301 | 12.863 | 8.752 | 1.00 | 53.33 C |
| ATOM | 5375 | CG2 | ILE | L | 75 | 35.829 | 13.470 | 10.635 | 1.00 | 61.19 C |
| ATOM | 5376 | CD1 | ILE | L | 75 | 33.616 | 11.777 | 9.538 | 1.00 | 54.05 C |
| ATOM | 5377 | N | SER | L | 76 | 38.548 | 15.181 | 8.728 | 1.00 | 58.67 N |
| ATOM | 5378 | CA | SER | L | 76 | 39.965 | 15.339 | 8.424 | 1.00 | 62.40 C |
| ATOM | 5379 | C | SER | L | 76 | 40.832 | 14.428 | 9.286 | 1.00 | 65.87 C |
| ATOM | 5380 | O | SER | L | 76 | 41.840 | 13.896 | 8.807 | 1.00 | 68.65 O |
| ATOM | 5381 | CB | SER | L | 76 | 40.374 | 16.798 | 8.600 | 1.00 | 57.44 C |
| ATOM | 5382 | OG | SER | L | 76 | 40.328 | 17.173 | 9.966 | 1.00 | 60.76 O |
| ATOM | 5383 | N | SER | L | 77 | 40.460 | 14.238 | 10.551 | 1.00 | 66.12 N |
| ATOM | 5384 | CA | SER | L | 77 | 41.165 | 13.348 | 11.475 | 1.00 | 64.79 C |
| ATOM | 5385 | C | SER | L | 77 | 40.121 | 12.586 | 12.289 | 1.00 | 59.98 C |
| ATOM | 5386 | O | SER | L | 77 | 39.620 | 13.099 | 13.295 | 1.00 | 61.47 O |
| ATOM | 5387 | CB | SER | L | 77 | 42.104 | 14.138 | 12.376 | 1.00 | 62.12 C |
| ATOM | 5388 | OG | SER | L | 77 | 42.381 | 13.420 | 13.563 | 1.00 | 70.57 O |
| ATOM | 5389 | N | LEU | L | 78 | 39.797 | 11.369 | 11.855 | 1.00 | 63.08 N |
| ATOM | 5390 | CA | LEU | L | 78 | 38.786 | 10.569 | 12.537 | 1.00 | 59.68 C |
| ATOM | 5391 | C | LEU | L | 78 | 39.108 | 10.470 | 14.021 | 1.00 | 65.21 C |
| ATOM | 5392 | O | LEU | L | 78 | 40.214 | 10.081 | 14.405 | 1.00 | 61.22 O |
| ATOM | 5393 | CB | LEU | L | 78 | 38.707 | 9.175 | 11.917 | 1.00 | 54.73 C |
| ATOM | 5394 | CG | LEU | L | 78 | 37.510 | 8.719 | 11.082 | 1.00 | 63.58 C |
| ATOM | 5395 | CD1 | LEU | L | 78 | 37.327 | 7.223 | 11.238 | 1.00 | 65.03 C |
| ATOM | 5396 | CD2 | LEU | L | 78 | 36.211 | 9.456 | 11.435 | 1.00 | 66.37 C |
| ATOM | 5397 | N | GLN | L | 79 | 38.148 | 10.862 | 14.846 | 1.00 | 65.92 N |
| ATOM | 5398 | CA | GLN | L | 79 | 38.251 | 10.919 | 16.293 | 1.00 | 66.25 C |
| ATOM | 5399 | C | GLN | L | 79 | 37.353 | 9.846 | 16.914 | 1.00 | 73.56 C |
| ATOM | 5400 | O | GLN | L | 79 | 36.509 | 9.266 | 16.222 | 1.00 | 70.09 O |
| ATOM | 5401 | CB | GLN | L | 79 | 37.860 | 12.328 | 16.762 | 1.00 | 66.58 C |
| ATOM | 5402 | CG | GLN | L | 79 | 37.888 | 12.616 | 18.250 | 1.00 | 75.04 C |
| ATOM | 5403 | CD | GLN | L | 79 | 38.893 | 13.684 | 18.626 | 1.00 | 81.65 C |
| ATOM | 5404 | OE1 | GLN | L | 79 | 40.047 | 13.656 | 18.187 | 1.00 | 81.83 O |
| ATOM | 5405 | NE2 | GLN | L | 79 | 38.458 | 14.640 | 19.444 | 1.00 | 81.55 N |
| ATOM | 5406 | N | PRO | L | 80 | 37.575 | 9.483 | 18.192 | 1.00 | 81.75 N |
| ATOM | 5407 | CA | PRO | L | 80 | 36.633 | 8.564 | 18.864 | 1.00 | 76.25 C |
| ATOM | 5408 | C | PRO | L | 80 | 35.167 | 8.937 | 18.711 | 1.00 | 73.51 C |
| ATOM | 5409 | O | PRO | L | 80 | 34.350 | 8.093 | 18.322 | 1.00 | 69.24 O |
| ATOM | 5410 | CB | PRO | L | 80 | 37.085 | 8.622 | 20.336 | 1.00 | 75.95 C |
| ATOM | 5411 | CG | PRO | L | 80 | 38.419 | 9.413 | 20.348 | 1.00 | 79.65 C |
| ATOM | 5412 | CD | PRO | L | 80 | 38.858 | 9.521 | 18.916 | 1.00 | 77.60 C |
| ATOM | 5413 | N | GLU | L | 81 | 34.810 | 10.178 | 19.006 | 1.00 | 74.16 N |
| ATOM | 5414 | CA | GLU | L | 81 | 33.413 | 10.594 | 18.922 | 1.00 | 71.04 C |
| ATOM | 5415 | C | GLU | L | 81 | 32.805 | 10.523 | 17.463 | 1.00 | 71.95 O |

TABLE 77-continued

| ATOM | 5416 | O | GLU | L | 81 | 31.626 | 10.907 | 17.356 | 1.00 | 69.13 | O |
|---|---|---|---|---|---|---|---|---|---|---|---|
| ATOM | 5417 | CB | GLU | L | 81 | 33.279 | 12.008 | 19.487 | 1.00 | 74.12 | C |
| ATOM | 5418 | CG | GLU | L | 81 | 34.038 | 13.074 | 18.708 | 1.00 | 71.81 | C |
| ATOM | 5419 | CD | GLU | L | 81 | 34.972 | 13.890 | 19.583 | 1.00 | 82.59 | C |
| ATOM | 5420 | OE1 | GLU | L | 81 | 35.595 | 13.297 | 20.497 | 1.00 | 78.62 | O |
| ATOM | 5421 | OE2 | GLU | L | 81 | 35.078 | 15.120 | 19.355 | 1.00 | 81.67 | O1− |
| ATOM | 5422 | N | ASP | L | 82 | 33.493 | 10.048 | 16.416 | 1.00 | 65.53 | N |
| ATOM | 5423 | CA | ASP | L | 82 | 33.026 | 10.152 | 15.036 | 1.00 | 66.20 | C |
| ATOM | 5424 | C | ASP | L | 82 | 32.477 | 8.850 | 14.478 | 1.00 | 68.98 | C |
| ATOM | 5425 | O | ASP | L | 82 | 32.163 | 8.785 | 13.284 | 1.00 | 69.70 | O |
| ATOM | 5426 | CB | ASP | L | 82 | 34.150 | 10.630 | 14.119 | 1.00 | 60.56 | C |
| ATOM | 5427 | CG | ASP | L | 82 | 34.668 | 11.974 | 14.504 | 1.00 | 64.77 | C |
| ATOM | 5428 | OD1 | ASP | L | 82 | 34.035 | 12.629 | 15.360 | 1.00 | 66.99 | O1− |
| ATOM | 5429 | OD2 | ASP | L | 82 | 35.719 | 12.392 | 13.963 | 1.00 | 64.73 | O |
| ATOM | 5430 | N | PHE | L | 83 | 32.366 | 7.810 | 15.292 | 1.00 | 70.57 | N |
| ATOM | 5431 | CA | PHE | L | 83 | 31.992 | 6.491 | 14.789 | 1.00 | 64.36 | C |
| ATOM | 5432 | C | PHE | L | 83 | 30.476 | 6.377 | 14.832 | 1.00 | 68.70 | C |
| ATOM | 5433 | O | PHE | L | 83 | 29.878 | 6.132 | 15.883 | 1.00 | 77.27 | O |
| ATOM | 5434 | CB | PHE | L | 83 | 32.717 | 5.422 | 15.591 | 1.00 | 72.46 | C |
| ATOM | 5435 | CG | PHE | L | 83 | 34.189 | 5.691 | 15.695 | 1.00 | 73.53 | C |
| ATOM | 5436 | CD1 | PHE | L | 83 | 34.904 | 6.089 | 14.572 | 1.00 | 71.31 | C |
| ATOM | 5437 | CD2 | PHE | L | 83 | 34.847 | 5.618 | 16.909 | 1.00 | 75.61 | C |
| ATOM | 5438 | CE1 | PHE | L | 83 | 36.259 | 6.375 | 14.648 | 1.00 | 73.62 | C |
| ATOM | 5439 | CE2 | PHE | L | 83 | 36.205 | 5.895 | 16.989 | 1.00 | 79.35 | C |
| ATOM | 5440 | CZ | PHE | L | 83 | 36.909 | 6.281 | 15.860 | 1.00 | 75.83 | C |
| ATOM | 5441 | N | ALA | L | 84 | 29.855 | 6.561 | 13.675 | 1.00 | 62.38 | N |
| ATOM | 5442 | CA | ALA | L | 84 | 28.412 | 6.703 | 13.578 | 1.00 | 58.01 | C |
| ATOM | 5443 | C | ALA | L | 84 | 28.006 | 6.396 | 12.145 | 1.00 | 56.10 | C |
| ATOM | 5444 | O | ALA | L | 84 | 28.833 | 5.983 | 11.324 | 1.00 | 60.30 | O |
| ATOM | 5445 | CB | ALA | L | 84 | 27.978 | 8.109 | 14.006 | 1.00 | 52.39 | C |
| ATOM | 5446 | N | THR | L | 85 | 26.722 | 6.573 | 11.858 | 1.00 | 49.88 | N |
| ATOM | 5447 | CA | THR | L | 85 | 26.182 | 6.538 | 10.506 | 1.00 | 51.44 | C |
| ATOM | 5448 | C | THR | L | 85 | 25.976 | 7.970 | 10.026 | 1.00 | 54.14 | C |
| ATOM | 5449 | O | THR | L | 85 | 25.554 | 8.838 | 10.801 | 1.00 | 53.60 | O |
| ATOM | 5450 | CB | THR | L | 85 | 24.865 | 5.771 | 10.473 | 1.00 | 52.62 | C |
| ATOM | 5451 | OG1 | THR | L | 85 | 25.059 | 4.479 | 11.062 | 1.00 | 64.12 | C |
| ATOM | 5452 | CG2 | THR | L | 85 | 24.361 | 5.607 | 9.046 | 1.00 | 47.93 | C |
| ATOM | 5453 | N | TYR | L | 86 | 26.293 | 8.228 | 8.758 | 1.00 | 46.88 | N |
| ATOM | 5154 | CA | TYR | L | 86 | 26.208 | 9.578 | 8.210 | 1.00 | 41.77 | C |
| ATOM | 5455 | C | TYR | L | 86 | 25.226 | 9.599 | 7.052 | 1.00 | 43.45 | C |
| ATOM | 5456 | O | TYR | L | 86 | 25.139 | 8.630 | 6.287 | 1.00 | 45.61 | O |
| ATOM | 5457 | CB | TYR | L | 86 | 27.585 | 10.069 | 7.768 | 1.00 | 43.71 | C |
| ATOM | 5458 | CG | TYR | L | 86 | 28.513 | 10.267 | 8.945 | 1.00 | 46.07 | C |
| ATOM | 5459 | CD1 | TYR | L | 86 | 29.209 | 9.195 | 9.505 | 1.00 | 45.92 | C |
| ATOM | 5460 | CD2 | TYR | L | 86 | 28.648 | 11.510 | 9.531 | 1.00 | 41.24 | C |
| ATOM | 5461 | CE1 | TYR | L | 86 | 30.043 | 9.378 | 10.599 | 1.00 | 43.46 | C |
| ATOM | 5462 | CE2 | TYR | L | 86 | 29.473 | 11.705 | 10.612 | 1.00 | 50.15 | C |
| ATOM | 5463 | CZ | TYR | L | 86 | 30.173 | 10.635 | 11.143 | 1.00 | 50.56 | C |
| ATOM | 5464 | OH | TYR | L | 86 | 30.985 | 10.849 | 12.227 | 1.00 | 49.22 | O |
| ATOM | 5465 | N | TYR | L | 87 | 24.469 | 10.693 | 6.940 | 1.00 | 38.77 | N |
| ATOM | 5466 | CA | TYR | L | 87 | 23.433 | 10.815 | 5.916 | 1.00 | 37.03 | C |
| ATOM | 5467 | C | TYR | L | 87 | 23.541 | 12.179 | 5.246 | 1.00 | 35.99 | C |
| ATOM | 5468 | O | TYR | L | 87 | 23.687 | 13.193 | 5.929 | 1.00 | 36.10 | O |
| ATOM | 5469 | CB | TYR | L | 87 | 22.024 | 10.672 | 6.509 | 1.00 | 39.60 | C |
| ATOM | 5470 | CG | TYR | L | 87 | 21.667 | 9.322 | 7.108 | 1.00 | 37.91 | C |
| ATOM | 5471 | CD1 | TYR | L | 87 | 21.181 | 8.293 | 6.313 | 1.00 | 37.84 | C |
| ATOM | 5472 | CD2 | TYR | L | 87 | 21.753 | 9.109 | 8.478 | 1.00 | 40.68 | C |
| ATOM | 5473 | CE1 | TYR | L | 87 | 20.815 | 7.052 | 6.874 | 1.00 | 43.90 | C |
| ATOM | 5474 | CE2 | TYR | L | 87 | 21.388 | 7.874 | 9.049 | 1.00 | 41.09 | C |
| ATOM | 5475 | CZ | TYR | L | 87 | 20.926 | 6.862 | 8.236 | 1.00 | 39.81 | C |
| ATOM | 5476 | OH | TYR | L | 87 | 20.584 | 5.651 | 8.783 | 1.00 | 47.63 | O |
| ATOM | 5477 | N | CYS | L | 88 | 23.427 | 12.215 | 3.928 | 1.00 | 40.46 | N |
| ATOM | 5478 | CA | CYS | L | 88 | 23.118 | 13.484 | 3.289 | 1.00 | 40.25 | C |
| ATOM | 5479 | C | CYS | L | 88 | 21.603 | 13.622 | 3.149 | 1.00 | 37.72 | C |
| ATOM | 5480 | O | CYS | L | 88 | 20.864 | 12.642 | 3.178 | 1.00 | 38.90 | O |
| ATOM | 5481 | CB | CYS | L | 88 | 23.791 | 13.606 | 1.917 | 1.00 | 39.84 | C |
| ATOM | 5482 | SG | CYS | L | 88 | 23.332 | 12.320 | 0.721 | 1.00 | 48.00 | S |
| ATOM | 5483 | N | GLN | L | 89 | 21.147 | 14.862 | 3.016 | 1.00 | 37.39 | N |
| ATOM | 5484 | CA | GLN | L | 89 | 19.745 | 15.146 | 2.739 | 1.00 | 32.64 | C |
| ATOM | 5485 | C | GLN | L | 89 | 19.690 | 16.328 | 1.795 | 1.00 | 34.00 | C |
| ATOM | 5486 | O | GLN | L | 89 | 20.291 | 17.369 | 2.082 | 1.00 | 36.29 | O |
| ATOM | 5487 | CB | GLN | L | 89 | 18.962 | 15.482 | 4.000 | 1.00 | 35.68 | C |
| ATOM | 5488 | CG | GLN | L | 89 | 17.513 | 15.837 | 3.717 | 1.00 | 36.02 | C |
| ATOM | 5489 | CD | GLN | L | 89 | 16.761 | 16.365 | 4.924 | 1.00 | 39.98 | C |
| ATOM | 5490 | OE1 | GLN | L | 89 | 17.311 | 17.072 | 5.767 | 1.00 | 43.38 | O |
| ATOM | 5491 | NE2 | GLN | L | 89 | 15.496 | 16.004 | 5.017 | 1.00 | 45.81 | N |
| ATOM | 5492 | N | GLN | L | 90 | 18.985 | 16.180 | 0.676 | 1.00 | 33.31 | N |
| ATOM | 5493 | CA | GLN | L | 90 | 18.793 | 17.329 | −0.192 | 1.00 | 32.63 | C |
| ATOM | 5494 | C | GLN | L | 90 | 17.652 | 18.149 | 0.383 | 1.00 | 34.96 | C |
| ATOM | 5495 | O | GLN | L | 90 | 16.660 | 17.597 | 0.872 | 1.00 | 34.93 | O |

TABLE 77-continued

| ATOM | 5496 | CB | GLN | L | 90 | 18.525 | 16.902 | −1.636 | 1.00 | 34.38 | C |
|------|------|-----|-----|---|-----|--------|--------|--------|------|-------|---|
| ATOM | 5497 | CG | GLN | L | 90 | 17.229 | 16.123 | −1.857 | 1.00 | 38.42 | C |
| ATOM | 5498 | CD | GLN | L | 90 | 16.037 | 17.024 | −2.168 | 1.00 | 39.25 | C |
| ATOM | 5499 | OE1 | GLN | L | 90 | 16.171 | 18.250 | −2.268 | 1.00 | 36.78 | O |
| ATOM | 5500 | NE2 | GLN | L | 90 | 14.876 | 16.416 | −2.353 | 1.00 | 36.81 | N |
| ATOM | 5501 | N | THR | L | 91 | 17.856 | 19.463 | 0.429 | 1.00 | 36.77 | N |
| ATOM | 5502 | CA | THR | L | 91 | 16.868 | 20.411 | 0.928 | 1.00 | 35.51 | C |
| ATOM | 5503 | C | THR | L | 91 | 16.338 | 21.294 | −0.194 | 1.00 | 35.98 | C |
| ATOM | 5504 | O | THR | L | 91 | 15.721 | 22.333 | 0.070 | 1.00 | 33.02 | O |
| ATOM | 5505 | CB | THR | L | 91 | 17.486 | 21.266 | 2.031 | 1.00 | 36.17 | C |
| ATOM | 5506 | OG1 | THR | L | 91 | 18.593 | 22.004 | 1.495 | 1.00 | 35.71 | O |
| ATOM | 5507 | CG2 | THR | L | 91 | 17.979 | 20.381 | 3.176 | 1.00 | 32.75 | C |
| ATOM | 5508 | N | TYR | L | 92 | 16.571 | 20.888 | −1.439 | 1.00 | 33.59 | N |
| ATOM | 5509 | CA | TYR | L | 92 | 16.230 | 21.705 | −2.589 | 1.00 | 33.09 | C |
| ATOM | 5510 | C | TYR | L | 92 | 14.732 | 21.712 | −2.848 | 1.00 | 32.65 | C |
| ATOM | 5511 | O | TYR | L | 92 | 14.153 | 22.770 | −3.118 | 1.00 | 33.28 | O |
| ATOM | 5512 | CB | TYR | L | 92 | 16.998 | 21.196 | −3.807 | 1.00 | 34.20 | C |
| ATOM | 5513 | CG | TYR | L | 92 | 16.886 | 22.095 | −5.013 | 1.00 | 34.76 | C |
| ATOM | 5514 | CD1 | TYR | L | 92 | 17.675 | 23.241 | −5.126 | 1.00 | 34.26 | C |
| ATOM | 5515 | CD2 | TYR | L | 92 | 15.999 | 21.791 | −6.036 | 1.00 | 34.41 | C |
| ATOM | 5516 | CE1 | TYR | L | 92 | 17.571 | 24.062 | −6.236 | 1.00 | 35.29 | C |
| ATOM | 5517 | CE2 | TYR | L | 92 | 15.880 | 22.593 | −7.131 | 1.00 | 36.15 | C |
| ATOM | 5518 | CZ | TYR | L | 92 | 16.670 | 23.734 | −7.227 | 1.00 | 32.29 | C |
| ATOM | 5519 | OH | TYR | L | 92 | 16.557 | 24.546 | −8.321 | 1.00 | 36.77 | O |
| ATOM | 5520 | N | SER | L | 93 | 14.085 | 20.548 | −2.779 | 1.00 | 34.24 | N |
| ATOM | 5521 | CA | SER | L | 93 | 12.672 | 20.475 | −3.107 | 1.00 | 38.34 | C |
| ATOM | 5522 | C | SER | L | 93 | 12.036 | 19.256 | −2.455 | 1.00 | 41.94 | C |
| ATOM | 5523 | O | SER | L | 93 | 12.664 | 18.199 | −2.304 | 1.00 | 37.83 | O |
| ATOM | 5524 | CB | SER | L | 93 | 12.448 | 20.414 | −4.617 | 1.00 | 38.11 | C |
| ATOM | 5525 | OG | SER | L | 93 | 13.267 | 19.404 | −5.156 | 1.00 | 45.62 | O |
| ATOM | 5526 | N | MET | L | 94 | 10.768 | 19.418 | −2.109 | 1.00 | 38.68 | N |
| ATOM | 5527 | CA | MET | L | 94 | 10.022 | 18.342 | −1.492 | 1.00 | 41.14 | C |
| ATOM | 5528 | C | MET | L | 94 | 9.728 | 17.260 | −2.525 | 1.00 | 45.04 | C |
| ATOM | 5529 | O | MET | L | 94 | 9.497 | 17.571 | −3.698 | 1.00 | 47.36 | O |
| ATOM | 5530 | CB | MET | L | 94 | 8.727 | 18.879 | −0.904 | 1.00 | 39.41 | C |
| ATOM | 5531 | CG | MET | L | 94 | 8.965 | 19.737 | 0.318 | 1.00 | 43.39 | C |
| ATOM | 5532 | SD | MET | L | 94 | 7.472 | 20.565 | 0.887 | 1.00 | 43.57 | S |
| ATOM | 5533 | CE | MET | L | 94 | 7.149 | 21.698 | −0.471 | 1.00 | 54.10 | C |
| ATOM | 5534 | N | PRO | L | 95 | 9.747 | 15.979 | −2.128 | 1.00 | 47.57 | N |
| ATOM | 5535 | CA | PRO | L | 95 | 10.072 | 15.545 | −0.769 | 1.00 | 45.60 | C |
| ATOM | 5536 | C | PRO | L | 95 | 11.555 | 15.635 | −0.523 | 1.00 | 40.93 | C |
| ATOM | 5537 | O | PRO | L | 95 | 12.320 | 15.366 | −1.445 | 1.00 | 45.74 | O |
| ATOM | 5538 | CB | PRO | L | 95 | 9.583 | 14.086 | −0.728 | 1.00 | 44.17 | C |
| ATOM | 5539 | CG | PRO | L | 95 | 9.368 | 13.674 | −2.163 | 1.00 | 45.70 | C |
| ATOM | 5540 | CD | PRO | L | 95 | 9.600 | 14.842 | −3.055 | 1.00 | 52.89 | C |
| ATOM | 5541 | N | PHE | L | 96 | 11.960 | 16.022 | 0.686 | 1.00 | 41.84 | N |
| ATOM | 5542 | CA | PHE | L | 96 | 13.377 | 16.218 | 0.994 | 1.00 | 40.06 | C |
| ATOM | 5543 | C | PHE | L | 96 | 14.016 | 14.862 | 1.251 | 1.00 | 48.35 | C |
| ATOM | 5544 | O | PHE | L | 96 | 13.932 | 14.318 | 2.355 | 1.00 | 53.41 | O |
| ATOM | 5545 | CB | PHE | L | 96 | 13.567 | 17.125 | 2.203 | 1.00 | 35.80 | C |
| ATOM | 5546 | CG | PHE | L | 96 | 12.941 | 18.487 | 2.050 | 1.00 | 39.89 | C |
| ATOM | 5547 | CD1 | PHE | L | 96 | 13.331 | 19.340 | 1.030 | 1.00 | 38.82 | C |
| ATOM | 5548 | CD2 | PHE | L | 96 | 11.993 | 18.922 | 2.949 | 1.00 | 43.80 | C |
| ATOM | 5549 | CE1 | PHE | L | 96 | 12.766 | 20.612 | 0.893 | 1.00 | 40.82 | C |
| ATOM | 5550 | CE2 | PHE | L | 96 | 11.416 | 20.185 | 2.818 | 1.00 | 43.01 | C |
| ATOM | 5551 | CZ | PHE | L | 96 | 11.816 | 21.034 | 1.789 | 1.00 | 40.14 | C |
| ATOM | 5552 | N | THR | L | 97 | 14.691 | 14.332 | 0.251 | 1.00 | 42.63 | N |
| ATOM | 5553 | CA | THR | L | 97 | 15.138 | 12.955 | 0.284 | 1.00 | 38.50 | C |
| ATOM | 5554 | C | THR | L | 97 | 16.493 | 12.837 | 0.964 | 1.00 | 42.44 | C |
| ATOM | 5555 | O | THR | L | 97 | 17.335 | 13.740 | 0.883 | 1.00 | 42.78 | O |
| ATOM | 5556 | CB | THR | L | 97 | 15.176 | 12.429 | −1.143 | 1.00 | 40.59 | C |
| ATOM | 5557 | OG1 | THR | L | 97 | 15.766 | 13.433 | −1.963 | 1.00 | 42.84 | O |
| ATOM | 5558 | CG2 | THR | L | 97 | 13.747 | 12.226 | −1.656 | 1.00 | 40.89 | C |
| ATOM | 5559 | N | PHE | L | 98 | 16.689 | 11.730 | 1.667 | 1.00 | 36.07 | N |
| ATOM | 5560 | CA | PHE | L | 98 | 17.963 | 11.444 | 2.304 | 1.00 | 40.13 | C |
| ATOM | 5561 | C | PHE | L | 98 | 18.755 | 10.452 | 1.458 | 1.00 | 41.31 | C |
| ATOM | 5562 | O | PHE | L | 98 | 18.189 | 9.658 | 0.701 | 1.00 | 38.06 | O |
| ATOM | 5563 | CB | PHE | L | 98 | 17.777 | 10.857 | 3.703 | 1.00 | 39.90 | C |
| ATOM | 5564 | CG | PHE | L | 98 | 17.204 | 11.814 | 4.722 | 1.00 | 39.39 | C |
| ATOM | 5565 | CD1 | PHE | L | 98 | 15.844 | 12.027 | 4.803 | 1.00 | 40.36 | C |
| ATOM | 5566 | CD2 | PHE | L | 98 | 18.026 | 12.443 | 5.634 | 1.00 | 39.15 | C |
| ATOM | 5567 | CE1 | PHE | L | 98 | 15.312 | 12.872 | 5.759 | 1.00 | 38.60 | C |
| ATOM | 5568 | CE2 | PHE | L | 98 | 17.499 | 13.291 | 6.580 | 1.00 | 36.98 | C |
| ATOM | 5569 | CZ | PHE | L | 98 | 16.141 | 13.495 | 6.645 | 1.00 | 35.39 | C |
| ATOM | 5570 | N | GLY | L | 99 | 20.069 | 10.504 | 1.600 | 1.00 | 41.47 | N |
| ATOM | 5571 | CA | GLY | L | 99 | 20.909 | 9.445 | 1.079 | 1.00 | 46.15 | C |
| ATOM | 5572 | C | GLY | L | 99 | 20.748 | 8.153 | 1.869 | 1.00 | 49.01 | C |
| ATOM | 5573 | O | GLY | L | 99 | 20.232 | 8.124 | 2.992 | 1.00 | 43.54 | O |
| ATOM | 5574 | N | GLY | L | 100 | 21.217 | 7.060 | 1.257 | 1.00 | 46.20 | N |
| ATOM | 5575 | CA | GLY | L | 100 | 21.128 | 5.749 | 1.884 | 1.00 | 44.25 | C |

TABLE 77-continued

| | | | | | | | | | | |
|---|---|---|---|---|---|---|---|---|---|---|
| ATOM | 5576 | C | GLY | L | 100 | 21.924 | 5.602 | 3.163 | 1.00 | 41.90 C |
| ATOM | 5577 | O | GLY | L | 100 | 21.677 | 4.664 | 3.926 | 1.00 | 45.09 O |
| ATOM | 5578 | N | GLY | L | 101 | 22.869 | 6.491 | 3.416 | 1.00 | 42.89 N |
| ATOM | 5579 | CA | GLY | L | 101 | 23.644 | 6.424 | 4.633 | 1.00 | 41.25 C |
| ATOM | 5580 | C | GLY | L | 101 | 25.002 | 5.763 | 4.422 | 1.00 | 44.12 C |
| ATOM | 5581 | O | GLY | L | 101 | 25.223 | 5.000 | 3.482 | 1.00 | 48.73 O |
| ATOM | 5582 | N | THR | L | 102 | 25.917 | 6.071 | 5.332 | 1.00 | 42.21 N |
| ATOM | 5583 | CA | THR | L | 102 | 27.289 | 5.571 | 5.325 | 1.00 | 46.85 O |
| ATOM | 5584 | C | THR | L | 102 | 27.638 | 5.245 | 6.768 | 1.00 | 50.68 C |
| ATOM | 5585 | O | THR | L | 102 | 27.741 | 6.156 | 7.598 | 1.00 | 51.00 O |
| ATOM | 5586 | CB | THR | L | 102 | 28.273 | 6.612 | 4.764 | 1.00 | 46.80 C |
| ATOM | 5587 | OG1 | THR | L | 102 | 27.968 | 6.888 | 3.393 | 1.00 | 44.83 O |
| ATOM | 5588 | CG2 | THR | L | 102 | 29.714 | 6.112 | 4.885 | 1.00 | 51.40 C |
| ATOM | 5589 | N | LYS | L | 103 | 27.840 | 3.968 | 7.081 | 1.00 | 50.37 N |
| ATOM | 5590 | CA | LYS | L | 103 | 28.282 | 3.616 | 8.423 | 1.00 | 54.09 C |
| ATOM | 5591 | C | LYS | L | 103 | 29.805 | 3.593 | 8.476 | 1.00 | 53.62 C |
| ATOM | 5592 | O | LYS | L | 103 | 30.467 | 3.152 | 7.532 | 1.00 | 51.34 O |
| ATOM | 5593 | CB | LYS | L | 103 | 27.705 | 2.269 | 8.867 | 1.00 | 57.27 C |
| ATOM | 5594 | CG | LYS | L | 103 | 27.662 | 2.120 | 10.393 | 1.00 | 62.91 C |
| ATOM | 5595 | CD | LYS | L | 103 | 26.362 | 1.477 | 10.866 | 1.00 | 68.82 C |
| ATOM | 5596 | CE | LYS | L | 103 | 26.160 | 1.667 | 12.369 | 1.00 | 66.98 C |
| ATOM | 5597 | NZ | LYS | L | 103 | 24.923 | 0.968 | 12.852 | 1.00 | 65.66 N1+ |
| ATOM | 5598 | N | VAL | L | 104 | 30.353 | 4.085 | 9.587 | 1.00 | 51.35 N |
| ATOM | 5599 | CA | VAL | L | 104 | 31.785 | 4.292 | 9.756 | 1.00 | 54.10 C |
| ATOM | 5600 | C | VAL | L | 104 | 32.215 | 3.581 | 11.031 | 1.00 | 57.90 C |
| ATOM | 5601 | O | VAL | L | 104 | 31.880 | 4.029 | 12.135 | 1.00 | 60.19 O |
| ATOM | 5602 | CB | VAL | L | 104 | 32.143 | 5.783 | 9.834 | 1.00 | 55.77 C |
| ATOM | 5603 | CG1 | VAL | L | 104 | 33.591 | 5.954 | 10.219 | 1.00 | 53.81 C |
| ATOM | 5604 | CG2 | VAL | L | 104 | 31.837 | 6.491 | 8.519 | 1.00 | 49.45 C |
| ATOM | 5605 | N | GLU | L | 105 | 32.965 | 2.489 | 10.888 | 1.00 | 52.61 N |
| ATOM | 5606 | CA | GLU | L | 105 | 33.516 | 1.764 | 12.024 | 1.00 | 53.16 C |
| ATOM | 5607 | C | GLU | L | 105 | 34.973 | 2.168 | 12.241 | 1.00 | 55.19 C |
| ATOM | 5608 | O | GLU | L | 105 | 35.665 | 2.593 | 11.312 | 1.00 | 54.89 O |
| ATOM | 5609 | CB | GLU | L | 105 | 33.417 | 0.244 | 11.812 | 1.00 | 54.40 C |
| ATOM | 5610 | CG | GLU | L | 105 | 34.244 | −0.303 | 10.646 | 0.57 | 57.66 C |
| ATOM | 5611 | CD | GLU | L | 105 | 34.777 | −1.725 | 10.880 | 1.00 | 59.20 C |
| ATOM | 5612 | OE1 | GLU | L | 105 | 35.323 | −2.327 | 9.933 | 0.00 | 58.20 O |
| ATOM | 5613 | OE2 | GLU | L | 105 | 34.636 | −2.239 | 12.009 | 1.00 | 61.56 O1− |
| ATOM | 5614 | N | ILE | L | 106 | 35.442 | 2.046 | 13.473 | 1.00 | 52.72 N |
| ATOM | 5615 | CA | ILE | L | 106 | 36.850 | 2.291 | 13.751 | 1.00 | 57.67 C |
| ATOM | 5616 | C | ILE | L | 106 | 37.619 | 0.991 | 13.560 | 1.00 | 62.42 C |
| ATOM | 5617 | O | ILE | L | 106 | 37.216 | −0.071 | 14.055 | 1.00 | 56.81 O |
| ATOM | 5618 | CB | ILE | L | 106 | 37.065 | 2.885 | 15.157 | 1.00 | 64.16 C |
| ATOM | 5619 | CG1 | ILE | L | 106 | 38.486 | 2.612 | 15.660 | 1.00 | 67.70 C |
| ATOM | 5620 | CG2 | ILE | L | 106 | 36.050 | 2.398 | 16.142 | 1.00 | 67.23 C |
| ATOM | 5621 | CD1 | ILE | L | 106 | 38.722 | 3.066 | 17.092 | 1.00 | 74.53 C |
| ATOM | 5622 | N | LYS | L | 107 | 38.710 | 1.074 | 12.806 | 1.00 | 61.28 N |
| ATOM | 5623 | CA | LYS | L | 107 | 39.575 | −0.065 | 12.562 | 1.00 | 61.06 C |
| ATOM | 5624 | C | LYS | L | 107 | 40.584 | −0.178 | 13.696 | 1.00 | 58.29 C |
| ATOM | 5625 | O | LYS | L | 107 | 41.255 | 0.798 | 14.034 | 1.00 | 66.30 O |
| ATOM | 5626 | CB | LYS | L | 107 | 40.277 | 0.101 | 11.214 | 1.00 | 61.31 C |
| ATOM | 5627 | CG | LYS | L | 107 | 41.036 | −1.115 | 10.723 | 1.00 | 63.33 C |
| ATOM | 5628 | CD | LYS | L | 107 | 41.603 | −0.871 | 9.334 | 1.00 | 68.94 C |
| ATOM | 5629 | CE | LYS | L | 107 | 40.507 | −0.485 | 8.344 | 1.00 | 66.48 C |
| ATOM | 5630 | NZ | LYS | L | 107 | 41.063 | −0.204 | 6.985 | 1.00 | 68.97 N1+ |
| ATOM | 5631 | N | ARG | L | 108 | 40.668 | −1.358 | 14.302 | 1.00 | 58.79 N |
| ATOM | 5632 | CA | ARG | L | 108 | 41.654 | −1.642 | 15.336 | 1.00 | 58.02 C |
| ATOM | 5633 | C | ARG | L | 108 | 42.311 | −2.988 | 15.028 | 1.00 | 58.03 C |
| ATOM | 5634 | O | ARG | L | 108 | 42.082 | −3.583 | 13.969 | 1.00 | 55.95 O |
| ATOM | 5635 | CB | ARG | L | 108 | 41.007 | −1.609 | 16.726 | 1.00 | 56.31 C |
| ATOM | 5636 | CG | ARG | L | 108 | 39.741 | −2.450 | 16.848 | 1.00 | 55.86 C |
| ATOM | 5637 | CD | ARG | L | 108 | 40.032 | −3.726 | 17.581 | 1.00 | 57.32 C |
| ATOM | 5638 | NE | ARG | L | 108 | 40.118 | −3.530 | 19.022 | 1.00 | 61.73 N |
| ATOM | 5639 | CZ | ARG | L | 108 | 40.878 | −4.260 | 19.830 | 1.00 | 56.88 C |
| ATOM | 5640 | NH1 | ARG | L | 108 | 41.635 | −5.227 | 19.335 | 1.00 | 64.89 N1+ |
| ATOM | 5641 | NH2 | ARG | L | 108 | 40.882 | −4.021 | 21.135 | 1.00 | 63.81 N1+ |
| ATOM | 5642 | N | THR | L | 109 | 43.140 | −3.472 | 15.954 | 1.00 | 56.39 N |
| ATOM | 5643 | CA | THR | L | 109 | 43.865 | −4.719 | 15.726 | 1.00 | 60.88 C |
| ATOM | 5644 | C | THR | L | 109 | 42.919 | −5.916 | 15.783 | 1.00 | 58.40 C |
| ATOM | 5645 | O | THR | L | 109 | 41.904 | −5.897 | 16.487 | 1.00 | 56.83 O |
| ATOM | 5646 | CB | THR | L | 109 | 44.973 | −4.905 | 16.766 | 1.00 | 55.57 C |
| ATOM | 5647 | OG1 | THR | L | 109 | 44.398 | −4.960 | 18.079 | 1.00 | 57.86 O |
| ATOM | 5648 | CG2 | THR | L | 109 | 45.973 | −3.762 | 16.703 | 1.00 | 56.58 C |
| ATOM | 5649 | Z | VAL | L | 110 | 43.273 | −6.975 | 15.047 | 1.00 | 58.42 N |
| ATOM | 5650 | CA | VAL | L | 110 | 42.478 | −8.197 | 15.087 | 1.00 | 53.89 C |
| ATOM | 5651 | C | VAL | L | 110 | 42.433 | −8.721 | 16.514 | 1.00 | 57.39 C |
| ATOM | 5652 | O | VAL | L | 110 | 43.439 | −8.712 | 17.235 | 1.00 | 54.48 O |
| ATOM | 5653 | CB | VAL | L | 110 | 43.032 | −9.239 | 14.101 | 1.00 | 57.45 C |
| ATOM | 5654 | CG1 | VAL | L | 110 | 42.425 | −10.613 | 14.349 | 1.00 | 52.59 C |
| ATOM | 5655 | CG2 | VAL | L | 110 | 42.743 | −8.800 | 12.662 | 1.00 | 52.67 C |

TABLE 77-continued

| ATOM | 5656 | N | ALA | L | 111 | 41.241 | −9.124 | 16.955 | 1.00 | 55.23 | N |
|---|---|---|---|---|---|---|---|---|---|---|---|
| ATOM | 5657 | CA | ALA | L | 111 | 41.066 | −9.638 | 18.305 | 1.00 | 49.50 | C |
| ATOM | 5658 | C | ALA | L | 111 | 40.161 | −10.857 | 18.263 | 1.00 | 53.69 | C |
| ATOM | 5659 | O | ALA | L | 111 | 39.047 | −10.793 | 17.732 | 1.00 | 51.76 | O |
| ATOM | 5660 | CB | ALA | L | 111 | 40.486 | −8.573 | 19.239 | 1.00 | 53.39 | C |
| ATOM | 5661 | N | ALA | L | 112 | 40.640 | −11.952 | 18.817 | 1.00 | 48.75 | N |
| ATOM | 5662 | CA | ALA | L | 112 | 39.869 | −13.178 | 18.840 | 1.00 | 50.79 | C |
| ATOM | 5663 | C | ALA | L | 112 | 38.772 | −13.098 | 19.896 | 1.00 | 48.60 | C |
| ATOM | 5664 | O | ALA | L | 112 | 38.938 | −12.443 | 20.929 | 1.00 | 52.87 | O |
| ATOM | 5665 | CB | ALA | L | 112 | 40.770 | −14.371 | 19.126 | 1.00 | 53.66 | C |
| ATOM | 5666 | N | PRO | L | 113 | 37.640 | −13.747 | 19.652 | 1.00 | 44.16 | N |
| ATOM | 5667 | CA | PRO | L | 113 | 36.576 | −13.780 | 20.651 | 1.00 | 48.55 | C |
| ATOM | 5668 | C | PRO | L | 113 | 36.887 | −14.719 | 21.801 | 1.00 | 52.14 | C |
| ATOM | 5669 | O | PRO | L | 113 | 37.463 | −15.797 | 21.627 | 1.00 | 44.53 | O |
| ATOM | 5670 | CB | PRO | L | 113 | 35.371 | −14.307 | 19.857 | 1.00 | 45.86 | C |
| ATOM | 5671 | CG | PRO | L | 113 | 35.984 | −15.196 | 18.840 | 1.00 | 45.87 | C |
| ATOM | 5672 | CD | PRO | L | 113 | 37.276 | −14.502 | 18.438 | 1.00 | 50.32 | C |
| ATOM | 5673 | N | SER | L | 114 | 36.438 | −14.309 | 22.984 | 1.00 | 50.41 | N |
| ATOM | 5674 | CA | SER | L | 114 | 36.211 | −15.248 | 24.068 | 1.00 | 52.00 | C |
| ATOM | 5675 | C | SER | L | 114 | 34.865 | −15.924 | 23.833 | 1.00 | 53.52 | C |
| ATOM | 5676 | O | SER | L | 114 | 33.866 | −15.250 | 23.558 | 1.00 | 52.73 | O |
| ATOM | 5677 | CB | SER | L | 114 | 36.228 | −14.526 | 25.413 | 1.00 | 51.60 | C |
| ATOM | 5678 | OG | SER | L | 114 | 37.412 | −13.762 | 25.558 | 1.00 | 55.62 | O |
| ATOM | 5679 | N | VAL | L | 115 | 34.836 | −17.251 | 23.928 | 1.00 | 51.82 | N |
| ATOM | 5680 | CA | VAL | L | 115 | 33.662 | −18.035 | 23.570 | 1.00 | 49.20 | C |
| ATOM | 5681 | C | VAL | L | 115 | 33.138 | −18.735 | 24.817 | 1.00 | 55.00 | C |
| ATOM | 5682 | O | VAL | L | 115 | 33.842 | −19.560 | 25.418 | 1.00 | 52.69 | O |
| ATOM | 5683 | CB | VAL | L | 115 | 33.976 | −19.040 | 22.453 | 1.00 | 47.01 | C |
| ATOM | 5684 | CG1 | VAL | L | 115 | 32.776 | −19.944 | 22.193 | 1.00 | 51.37 | C |
| ATOM | 5685 | CG2 | VAL | L | 115 | 34.362 | −18.303 | 21.180 | 1.00 | 45.98 | C |
| ATOM | 5686 | N | PHE | L | 116 | 31.892 | −18.417 | 25.187 | 1.00 | 44.48 | N |
| ATOM | 5687 | CA | PHE | L | 116 | 31.198 | −19.011 | 26.324 | 1.00 | 45.01 | C |
| ATOM | 5688 | C | PHE | L | 116 | 29.896 | −19.651 | 25.860 | 1.00 | 52.59 | C |
| ATOM | 5689 | O | PHE | L | 116 | 29.330 | −19.271 | 24.827 | 1.00 | 46.75 | O |
| ATOM | 5690 | CB | PHE | L | 116 | 30.903 | −17.960 | 27.408 | 1.00 | 48.89 | C |
| ATOM | 5691 | CG | PHE | L | 116 | 32.083 | −17.073 | 27.736 | 1.00 | 53.75 | C |
| ATOM | 5692 | CD1 | PHE | L | 116 | 32.236 | −15.844 | 27.114 | 1.00 | 58.12 | C |
| ATOM | 5693 | CD2 | PHE | L | 116 | 33.037 | −17.473 | 28.654 | 1.00 | 60.22 | C |
| ATOM | 5694 | CE1 | PHE | L | 116 | 33.308 | −15.027 | 27.408 | 1.00 | 60.02 | C |
| ATOM | 5695 | CE2 | PHE | L | 116 | 34.117 | −16.656 | 28.959 | 1.00 | 62.51 | C |
| ATOM | 5696 | CZ | PHE | L | 116 | 34.252 | −15.436 | 28.331 | 1.00 | 61.17 | C |
| ATOM | 5697 | N | ILE | L | 117 | 29.411 | −20.631 | 26.622 | 1.00 | 48.46 | N |
| ATOM | 5698 | CA | ILE | L | 117 | 28.141 | −21.260 | 26.295 | 1.00 | 47.17 | C |
| ATOM | 5699 | C | ILE | L | 117 | 27.315 | −21.414 | 27.566 | 1.00 | 51.10 | C |
| ATOM | 5700 | O | ILE | L | 117 | 27.854 | −21.543 | 28.670 | 1.00 | 55.26 | O |
| ATOM | 5701 | CB | ILE | L | 117 | 28.336 | −22.613 | 25.570 | 1.00 | 49.60 | C |
| ATOM | 5702 | CG1 | ILE | L | 117 | 27.004 | −23.092 | 24.980 | 1.00 | 47.34 | C |
| ATOM | 5703 | CG2 | ILE | L | 117 | 28.932 | −23.658 | 26.513 | 1.00 | 55.41 | C |
| ATOM | 5704 | CD1 | ILE | L | 117 | 27.144 | −24.230 | 23.985 | 1.00 | 49.01 | C |
| ATOM | 5705 | N | PHE | L | 118 | 25.992 | −21.369 | 27.405 | 1.00 | 46.55 | N |
| ATOM | 5706 | CA | PHE | L | 118 | 25.054 | −21.404 | 28.525 | 1.00 | 48.89 | C |
| ATOM | 5707 | C | PHE | L | 118 | 23.970 | −22.440 | 28.261 | 1.00 | 49.43 | C |
| ATOM | 5708 | O | PRE | L | 118 | 23.235 | −22.323 | 27.259 | 1.00 | 50.59 | O |
| ATOM | 5709 | CB | PHE | L | 118 | 24.435 | −20.023 | 28.758 | 1.00 | 46.12 | C |
| ATOM | 5710 | CG | PHE | L | 118 | 25.444 | −18.951 | 29.054 | 1.00 | 51.93 | C |
| ATOM | 5711 | CD1 | PHE | L | 118 | 25.963 | −18.806 | 30.333 | 1.00 | 52.88 | C |
| ATOM | 5712 | CD2 | PHE | L | 118 | 25.879 | −18.094 | 28.057 | 1.00 | 47.10 | C |
| ATOM | 5713 | CE1 | PHE | L | 118 | 26.888 | −17.822 | 30.612 | 1.00 | 50.83 | C |
| ATOM | 5714 | CE2 | PHE | L | 118 | 26.811 | −17.116 | 28.331 | 1.00 | 49.99 | C |
| ATOM | 5715 | CZ | PHE | L | 118 | 27.312 | −16.976 | 29.611 | 1.00 | 54.45 | C |
| ATOM | 5716 | N | PRO | L | 119 | 23.813 | −23.443 | 29.119 | 1.00 | 51.03 | N |
| ATOM | 5717 | CA | PRO | L | 119 | 22.741 | −24.427 | 28.933 | 1.00 | 50.45 | C |
| ATOM | 5718 | C | PRO | L | 119 | 21.389 | −23.807 | 29.224 | 1.00 | 45.99 | C |
| ATOM | 5719 | O | PRO | L | 119 | 21.309 | −22.731 | 29.838 | 1.00 | 51.29 | O |
| ATOM | 5720 | CB | PRO | L | 119 | 23.085 | −25.515 | 29.961 | 1.00 | 50.38 | C |
| ATOM | 5721 | CG | PRO | L | 119 | 23.775 | −24.748 | 31.053 | 1.00 | 55.48 | C |
| ATOM | 5722 | CD | PRO | L | 119 | 24.608 | −23.717 | 30.328 | 1.00 | 52.41 | C |
| ATOM | 5723 | N | PRO | L | 120 | 20.303 | −24.450 | 28.806 | 1.00 | 47.68 | N |
| ATOM | 5724 | CA | PRO | L | 120 | 18.976 | −23.939 | 29.156 | 1.00 | 50.85 | C |
| ATOM | 5725 | C | PRO | L | 120 | 18.754 | −23.967 | 30.659 | 1.00 | 57.19 | C |
| ATOM | 5726 | O | PRO | L | 120 | 19.318 | −24.793 | 31.379 | 1.00 | 57.56 | O |
| ATOM | 5727 | CB | PRO | L | 120 | 18.024 | −24.894 | 28.433 | 1.00 | 47.36 | C |
| ATOM | 5728 | CG | PRO | L | 120 | 18.822 | −26.111 | 28.172 | 1.00 | 52.92 | C |
| ATOM | 5729 | CD | PRO | L | 120 | 20.219 | −25.656 | 27.963 | 1.00 | 49.99 | C |
| ATOM | 5730 | N | SER | L | 121 | 17.942 | −23.025 | 31.127 | 1.00 | 58.05 | N |
| ATOM | 5731 | CA | SER | L | 121 | 17.591 | −22.955 | 32.536 | 1.00 | 61.73 | C |
| ATOM | 5732 | C | SER | L | 121 | 16.588 | −24.043 | 32.878 | 1.00 | 61.83 | C |
| ATOM | 5733 | O | SER | L | 121 | 15.792 | −24.469 | 32.038 | 1.00 | 60.53 | O |
| ATOM | 5734 | CB | SER | L | 121 | 16.980 | −21.593 | 32.870 | 1.00 | 57.41 | C |
| ATOM | 5735 | OG | SER | L | 121 | 15.653 | −21.520 | 32.371 | 1.00 | 57.09 | O |

TABLE 77-continued

| ATOM | 5736 | N | ASP | L | 122 | 16.615 | −24.486 | 34.133 | 1.00 | 65.61 | N |
| --- | --- | --- | --- | --- | --- | --- | --- | --- | --- | --- | --- |
| ATOM | 5737 | CA | ASP | L | 122 | 15.567 | −25.399 | 34.573 | 1.00 | 67.32 | C |
| ATOM | 5738 | C | ASP | L | 122 | 14.201 | −24.744 | 34.462 | 1.00 | 62.67 | C |
| ATOM | 5739 | O | ASP | L | 122 | 13.202 | −25.425 | 34.200 | 1.00 | 64.06 | O |
| ATOM | 5740 | CB | ASP | L | 122 | 15.832 | −25.869 | 36.002 | 1.00 | 73.47 | C |
| ATOM | 5741 | CG | ASP | L | 122 | 16.893 | −26.953 | 36.068 | 1.00 | 76.65 | C |
| ATOM | 5742 | OD1 | ASP | L | 122 | 17.002 | −27.742 | 35.102 | 1.00 | 79.49 | O |
| ATOM | 5743 | OD2 | ASP | L | 122 | 17.615 | −27.018 | 37.083 | 1.00 | 80.11 | O |
| ATOM | 5744 | N | GLU | L | 123 | 14.151 | −23.419 | 34.615 | 1.00 | 62.24 | N |
| ATOM | 5745 | CA | GLU | L | 123 | 12.895 | −22.689 | 34.497 | 1.00 | 61.67 | C |
| ATOM | 5746 | C | GLU | L | 123 | 12.313 | −22.801 | 33.090 | 1.00 | 63.26 | C |
| ATOM | 5747 | O | GLU | L | 123 | 11.111 | −23.046 | 32.921 | 1.00 | 62.03 | O |
| ATOM | 5748 | CB | GLU | L | 123 | 13.125 | −21.227 | 34.870 | 1.00 | 65.27 | C |
| ATOM | 5749 | CG | GLU | L | 123 | 11.974 | −20.570 | 35.597 | 1.00 | 77.47 | C |
| ATOM | 5750 | CD | GLU | L | 123 | 12.415 | −19.975 | 36.921 | 1.00 | 87.49 | C |
| ATOM | 5751 | OE1 | GLU | L | 123 | 11.538 | −19.584 | 37.725 | 1.00 | 92.16 | O |
| ATOM | 5752 | OE2 | GLU | L | 123 | 13.645 | −19.912 | 37.153 | 1.00 | 82.28 | O |
| ATOM | 5753 | N | GLN | L | 124 | 13.145 | −22.619 | 32.066 | 1.00 | 58.55 | N |
| ATOM | 5754 | CA | GLN | L | 124 | 12.642 | −22.733 | 30.702 | 1.00 | 54.92 | C |
| ATOM | 5755 | C | GLN | L | 124 | 12.248 | −24.165 | 30.375 | 1.00 | 55.22 | C |
| ATOM | 5756 | O | GLN | L | 124 | 11.253 | −24.396 | 29.675 | 1.00 | 55.55 | O |
| ATOM | 5757 | CB | GLN | L | 124 | 13.688 | −22.230 | 29.710 | 1.00 | 55.13 | C |
| ATOM | 5758 | CG | GLN | L | 124 | 13.227 | −22.306 | 28.270 | 1.00 | 48.16 | C |
| ATOM | 5759 | CD | GLN | L | 124 | 14.297 | −21.871 | 27.305 | 1.00 | 46.35 | C |
| ATOM | 5760 | OE1 | GLN | L | 124 | 15.477 | −21.832 | 27.650 | 1.00 | 43.99 | O |
| ATOM | 5761 | NE2 | GLN | L | 124 | 13.898 | −21.559 | 26.084 | 1.00 | 40.69 | N |
| ATOM | 5762 | N | LEU | L | 125 | 13.008 | −25.143 | 30.872 | 1.00 | 53.70 | N |
| ATOM | 5763 | CA | LEU | L | 125 | 12.656 | −26.529 | 30.597 | 1.00 | 58.71 | C |
| ATOM | 5764 | C | LEU | L | 125 | 11.280 | −26.879 | 31.160 | 1.00 | 62.75 | C |
| ATOM | 5765 | O | LEU | L | 125 | 10.559 | −27.683 | 30.562 | 1.00 | 61.15 | O |
| ATOM | 5766 | CB | LEU | L | 125 | 13.741 | −27.458 | 31.139 | 1.00 | 56.77 | C |
| ATOM | 5767 | CG | LEU | L | 125 | 15.041 | −27.444 | 30.320 | 1.00 | 58.43 | C |
| ATOM | 5768 | CD1 | LEU | L | 125 | 16.114 | −28.262 | 30.994 | 1.00 | 63.56 | C |
| ATOM | 5769 | CD2 | LEU | L | 125 | 14.801 | −27.957 | 28.908 | 1.00 | 56.23 | C |
| ATOM | 5770 | N | LYS | L | 126 | 10.885 | −26.267 | 32.284 | 1.00 | 58.35 | N |
| ATOM | 5771 | CA | LYS | L | 126 | 9.553 | −26.523 | 32.832 | 1.00 | 62.39 | C |
| ATOM | 5772 | C | LYS | L | 126 | 8.465 | −26.135 | 31.840 | 1.00 | 66.59 | C |
| ATOM | 5773 | O | LYS | L | 126 | 7.485 | −26.870 | 31.668 | 1.00 | 72.61 | O |
| ATOM | 5774 | CB | LYS | L | 126 | 9.366 | −25.781 | 34.157 | 1.00 | 65.14 | C |
| ATOM | 5775 | CG | LYS | L | 126 | 9.491 | −26.663 | 35.407 | 1.00 | 67.59 | C |
| ATOM | 5776 | CD | LYS | L | 126 | 10.926 | −27.146 | 35.646 | 1.00 | 76.32 | C |
| ATOM | 5777 | CE | LYS | L | 126 | 11.156 | −28.591 | 35.175 | 1.00 | 76.99 | C |
| ATOM | 5778 | NZ | LYS | L | 126 | 12.597 | −29.006 | 35.261 | 1.00 | 75.18 | N |
| ATOM | 5779 | N | SER | L | 127 | 8.617 | −24.990 | 31.176 | 1.00 | 62.35 | N |
| ATOM | 5780 | CA | SER | L | 127 | 7.777 | −24.676 | 30.031 | 1.00 | 61.56 | C |
| ATOM | 5781 | C | SER | L | 127 | 8.182 | −25.558 | 28.849 | 1.00 | 64.43 | C |
| ATOM | 5782 | O | SER | L | 127 | 9.021 | −26.455 | 28.960 | 1.00 | 67.29 | O |
| ATOM | 5783 | CB | SER | L | 127 | 7.872 | −23.191 | 29.690 | 1.00 | 64.19 | C |
| ATOM | 5784 | OG | SER | L | 127 | 9.225 | −22.771 | 29.577 | 1.00 | 64.35 | O |
| ATOM | 5785 | N | GLY | L | 128 | 7.601 | −25.308 | 27.687 | 1.00 | 65.80 | N |
| ATOM | 5786 | CA | GLY | L | 128 | 7.820 | −26.265 | 26.615 | 1.00 | 72.46 | C |
| ATOM | 5787 | C | GLY | L | 128 | 9.111 | −26.186 | 25.812 | 1.00 | 69.39 | C |
| ATOM | 5788 | O | GLY | L | 128 | 9.161 | −26.740 | 24.708 | 1.00 | 70.95 | O |
| ATOM | 5789 | N | THR | L | 129 | 10.170 | −25.563 | 26.332 | 1.00 | 61.03 | N |
| ATOM | 5790 | CA | THR | L | 129 | 11.221 | −25.087 | 25.439 | 1.00 | 57.34 | C |
| ATOM | 5791 | C | THR | L | 129 | 12.605 | −25.215 | 26.074 | 1.00 | 54.96 | C |
| ATOM | 5792 | O | THR | L | 129 | 12.754 | −25.352 | 27.291 | 1.00 | 54.61 | O |
| ATOM | 5793 | CB | THR | L | 129 | 10.935 | −23.631 | 25.021 | 1.00 | 56.16 | C |
| ATOM | 5794 | OG1 | THR | L | 129 | 12.134 | −22.999 | 24.564 | 1.00 | 62.95 | O |
| ATOM | 5795 | CG2 | THR | L | 129 | 10.382 | −22.834 | 26.189 | 1.00 | 65.56 | C |
| ATOM | 5796 | N | ALA | L | 130 | 13.625 | −25.145 | 25.220 | 1.00 | 52.55 | N |
| ATOM | 5797 | CA | ALA | L | 130 | 15.014 | −25.171 | 25.661 | 1.00 | 48.33 | C |
| ATOM | 5798 | C | ALA | L | 130 | 15.848 | −24.291 | 24.741 | 1.00 | 51.52 | C |
| ATOM | 5799 | O | ALA | L | 130 | 15.867 | −24.498 | 23.523 | 1.00 | 48.73 | O |
| ATOM | 5800 | CB | ALA | L | 130 | 15.560 | −26.598 | 25.675 | 1.00 | 49.57 | C |
| ATOM | 5801 | N | SER | L | 131 | 16.553 | −23.328 | 25.326 | 1.00 | 47.92 | N |
| ATOM | 5802 | CA | SER | L | 131 | 17.429 | −22.432 | 24.588 | 1.00 | 46.41 | C |
| ATOM | 5803 | C | SER | L | 131 | 18.856 | −22.606 | 25.083 | 1.00 | 48.78 | C |
| ATOM | 5804 | O | SER | L | 131 | 19.110 | −22.581 | 26.292 | 1.00 | 49.57 | O |
| ATOM | 5805 | CB | SER | L | 131 | 16.981 | −20.973 | 24.727 | 1.00 | 44.76 | C |
| ATOM | 5806 | OG | SER | L | 131 | 15.713 | −20.765 | 24.116 | 1.00 | 44.13 | O |
| ATOM | 5807 | N | VAL | L | 132 | 19.774 | −22.830 | 24.151 | 1.00 | 41.33 | N |
| ATOM | 5808 | CA | VAL | L | 132 | 21.204 | −22.783 | 24.414 | 1.00 | 41.55 | C |
| ATOM | 5809 | C | VAL | L | 132 | 21.738 | −21.516 | 23.767 | 1.00 | 44.27 | C |
| ATOM | 5810 | O | VAL | L | 132 | 21.378 | −21.202 | 22.625 | 1.00 | 46.69 | O |
| ATOM | 5811 | CB | VAL | L | 132 | 21.925 | −24.024 | 23.861 | 1.00 | 44.22 | C |
| ATOM | 5812 | CG1 | VAL | L | 132 | 23.385 | −24.009 | 24.278 | 1.00 | 39.58 | C |
| ATOM | 5813 | CG2 | VAL | L | 132 | 21.236 | −25.289 | 24.331 | 1.00 | 49.93 | O |
| ATOM | 5814 | N | VAL | L | 133 | 22.575 | −20.773 | 24.478 | 1.00 | 41.82 | N |
| ATOM | 5815 | CA | VAL | L | 133 | 23.116 | −19.554 | 23.892 | 1.00 | 41.19 | C |

TABLE 77-continued

| | | | | | | | | | | |
|---|---|---|---|---|---|---|---|---|---|---|
| ATOM | 5816 | C | VAL | L | 133 | 24.630 | −19.582 | 23.956 | 1.00 | 43.80 | C |
| ATOM | 5817 | O | VAL | L | 133 | 25.235 | −20.083 | 24.910 | 1.00 | 45.00 | O |
| ATOM | 5818 | CB | VAL | L | 133 | 22.541 | −18.247 | 24.496 | 1.00 | 51.27 | C |
| ATOM | 5819 | CG1 | VAL | L | 133 | 21.362 | −18.506 | 25.416 | 1.00 | 48.07 | C |
| ATOM | 5820 | CG2 | VAL | L | 133 | 23.615 | −17.358 | 25.098 | 1.00 | 46.82 | C |
| ATOM | 5821 | N | CYS | L | 134 | 25.222 | −19.125 | 22.870 | 1.00 | 41.08 | N |
| ATOM | 5822 | CA | CYS | L | 134 | 26.654 | −19.032 | 22.690 | 1.00 | 40.78 | C |
| ATOM | 5823 | C | CYS | L | 134 | 27.020 | −17.556 | 22.685 | 1.00 | 45.08 | C |
| ATOM | 5824 | O | CYS | L | 134 | 26.375 | −16.752 | 21.994 | 1.00 | 41.51 | O |
| ATOM | 5825 | CB | CYS | L | 134 | 27.048 | −19.704 | 21.374 | 1.00 | 44.82 | C |
| ATOM | 5826 | SG | CYS | L | 134 | 28.782 | −19.961 | 21.144 | 1.00 | 64.49 | S |
| ATOM | 5827 | N | LEU | L | 135 | 28.031 | −17.197 | 23.465 | 1.00 | 41.54 | N |
| ATOM | 5828 | CA | LEU | L | 135 | 28.465 | −15.812 | 23.606 | 1.00 | 45.75 | C |
| ATOM | 5829 | C | LEU | L | 135 | 29.876 | −15.663 | 23.053 | 1.00 | 46.50 | C |
| ATOM | 5830 | O | LEU | L | 135 | 30.795 | −16.369 | 23.482 | 1.00 | 47.71 | O |
| ATOM | 5831 | CB | LEU | L | 135 | 28.409 | −15.375 | 25.071 | 1.00 | 43.18 | C |
| ATOM | 5832 | CG | LEU | L | 135 | 29.066 | −14.030 | 25.358 | 1.00 | 46.72 | C |
| ATOM | 5833 | CD1 | LEU | L | 135 | 28.359 | −12.910 | 24.608 | 1.00 | 48.09 | C |
| ATOM | 5834 | CD2 | LEU | L | 135 | 29.052 | −13.778 | 26.850 | 1.00 | 54.74 | C |
| ATOM | 5835 | N | LEU | L | 136 | 30.044 | −14.763 | 22.091 | 1.00 | 42.91 | N |
| ATOM | 5836 | CA | LEU | L | 136 | 31.357 | −14.419 | 21.556 | 1.00 | 39.59 | C |
| ATOM | 5837 | C | LEU | L | 136 | 31.675 | −13.026 | 22.067 | 1.00 | 50.33 | C |
| ATOM | 5838 | O | LEU | L | 136 | 30.997 | −12.057 | 21.705 | 1.00 | 47.98 | O |
| ATOM | 5839 | CB | LEU | L | 136 | 31.388 | −14.461 | 20.032 | 1.00 | 41.97 | C |
| ATOM | 5840 | CG | LEU | L | 136 | 31.420 | −15.812 | 19.306 | 1.00 | 43.89 | C |
| ATOM | 5841 | CD1 | LEU | L | 136 | 30.229 | −16.686 | 19.671 | 1.00 | 42.59 | C |
| ATOM | 5842 | CD2 | LEU | L | 136 | 31.438 | −15.554 | 17.806 | 1.00 | 44.42 | C |
| ATOM | 5843 | N | ASN | L | 137 | 32.689 | −12.917 | 22.916 | 1.00 | 45.21 | N |
| ATOM | 5844 | CA | ASN | L | 137 | 32.935 | −11.669 | 23.618 | 1.00 | 49.68 | C |
| ATOM | 5845 | C | ASN | L | 137 | 34.165 | −10.968 | 23.061 | 1.00 | 53.15 | C |
| ATOM | 5846 | O | ASN | L | 137 | 35.230 | −11.582 | 22.904 | 1.00 | 50.87 | O |
| ATOM | 5847 | CB | ASN | L | 137 | 33.078 | −11.902 | 25.121 | 1.00 | 52.92 | C |
| ATOM | 5848 | CG | ASN | L | 137 | 32.223 | −10.948 | 25.929 | 1.00 | 64.73 | C |
| ATOM | 5849 | OD1 | ASN | L | 137 | 31.198 | −10.463 | 25.448 | 1.00 | 66.14 | O |
| ATOM | 5850 | ND2 | ASN | L | 137 | 32.650 | −10.651 | 27.152 | 1.00 | 68.04 | N |
| ATOM | 5851 | N | ASN | L | 138 | 33.990 | −9.688 | 22.734 | 1.00 | 54.39 | N |
| ATOM | 5852 | CA | ASN | L | 138 | 35.084 | −8.778 | 22.441 | 1.00 | 54.25 | C |
| ATOM | 5853 | C | ASN | L | 138 | 36.002 | −9.319 | 21.357 | 1.00 | 54.33 | C |
| ATOM | 5854 | O | ASN | L | 138 | 37.078 | −9.839 | 21.658 | 1.00 | 59.61 | O |
| ATOM | 5855 | CB | ASN | L | 138 | 35.870 | −8.494 | 23.720 | 1.00 | 57.03 | C |
| ATOM | 5856 | CG | ASN | L | 138 | 34.964 | −8.245 | 24.906 | 1.00 | 58.62 | C |
| ATOM | 5857 | OD1 | ASN | L | 138 | 34.103 | −7.370 | 24.873 | 1.00 | 64.42 | O |
| ATOM | 5858 | ND2 | ASN | L | 138 | 35.132 | −9.039 | 25.954 | 1.00 | 68.79 | N |
| ATOM | 5859 | N | PHE | L | 139 | 35.599 | −9.185 | 20.098 | 1.00 | 47.69 | N |
| ATOM | 5860 | CA | PHE | L | 139 | 36.400 | −9.629 | 18.970 | 1.00 | 49.12 | C |
| ATOM | 5861 | C | PHE | L | 139 | 36.429 | −8.531 | 17.917 | 1.00 | 45.42 | C |
| ATOM | 5862 | O | PHE | L | 139 | 35.635 | −7.590 | 17.961 | 1.00 | 48.51 | O |
| ATOM | 5863 | CB | PHE | L | 139 | 35.862 | −10.933 | 18.373 | 1.00 | 49.17 | C |
| ATOM | 5864 | CG | PHE | L | 139 | 34.403 | −10.881 | 17.979 | 1.00 | 47.02 | C |
| ATOM | 5865 | CD1 | PHE | L | 139 | 34.028 | −10.515 | 16.693 | 1.00 | 43.62 | C |
| ATOM | 5866 | CD2 | PHE | L | 139 | 33.415 | −11.250 | 18.882 | 1.00 | 48.11 | C |
| ATOM | 5867 | CE1 | PHE | L | 139 | 32.688 | −10.494 | 16.326 | 1.00 | 46.16 | C |
| ATOM | 5868 | CE2 | PHE | L | 139 | 32.064 | −11.225 | 18.520 | 1.00 | 43.78 | C |
| ATOM | 5869 | CZ | PHE | L | 139 | 31.709 | −10.842 | 17.248 | 1.00 | 42.65 | C |
| ATOM | 5870 | N | TYR | L | 140 | 37.370 | −8.643 | 16.978 | 1.00 | 49.39 | N |
| ATOM | 5871 | CA | TYR | L | 140 | 37.395 | −7.670 | 15.894 | 1.00 | 48.19 | C |
| ATOM | 5872 | C | TYR | L | 140 | 38.169 | −8.086 | 14.653 | 1.00 | 52.31 | C |
| ATOM | 5873 | O | TYR | L | 140 | 39.402 | −8.075 | 14.663 | 1.00 | 62.61 | O |
| ATOM | 5874 | CB | TYR | L | 140 | 37.981 | −6.313 | 16.317 | 1.00 | 48.56 | C |
| ATOM | 5875 | CG | TYR | L | 140 | 37.962 | −5.344 | 15.141 | 1.00 | 52.45 | C |
| ATOM | 5876 | CD1 | TYR | L | 140 | 36.832 | −4.580 | 14.878 | 1.00 | 51.58 | C |
| ATOM | 5877 | CD2 | TYR | L | 140 | 39.054 | −5.225 | 14.265 | 1.00 | 53.01 | C |
| ATOM | 5878 | CE1 | TYR | L | 140 | 36.784 | −3.725 | 13.799 | 1.00 | 56.48 | C |
| ATOM | 5879 | CE2 | TYR | L | 140 | 39.013 | −4.373 | 13.178 | 1.00 | 52.69 | C |
| ATOM | 5880 | CZ | TYR | L | 140 | 37.876 | −3.620 | 12.954 | 1.00 | 57.96 | C |
| ATOM | 5881 | OH | TYR | L | 140 | 37.831 | −2.764 | 11.880 | 1.00 | 62.87 | O |
| ATOM | 5882 | N | PRO | L | 141 | 37.527 | −8.663 | 13.712 | 1.00 | 56.84 | N |
| ATOM | 5883 | CA | PRO | L | 141 | 36.764 | −7.865 | 12.750 | 1.00 | 51.26 | C |
| ATOM | 5884 | C | PRO | L | 141 | 35.335 | −8.255 | 13.099 | 1.00 | 50.99 | C |
| ATOM | 5885 | O | PRO | L | 141 | 35.174 | −9.169 | 13.919 | 1.00 | 46.20 | O |
| ATOM | 5886 | CB | PRO | L | 141 | 37.220 | −8.366 | 11.377 | 1.00 | 58.23 | C |
| ATOM | 5887 | CG | PRO | L | 141 | 38.480 | −9.122 | 11.642 | 1.00 | 54.33 | C |
| ATOM | 5888 | CD | PRO | L | 141 | 38.377 | −9.652 | 13.028 | 1.00 | 56.05 | C |
| ATOM | 5889 | N | ARG | L | 142 | 34.303 | −7.616 | 12.546 | 1.00 | 51.73 | N |
| ATOM | 5890 | CA | ARG | L | 142 | 32.944 | −7.950 | 12.982 | 1.00 | 48.70 | C |
| ATOM | 5891 | C | ARG | L | 142 | 32.505 | −9.321 | 12.470 | 1.00 | 46.84 | C |
| ATOM | 5892 | O | ARG | L | 142 | 31.715 | −10.005 | 13.127 | 1.00 | 45.85 | O |
| ATOM | 5893 | CB | ARG | L | 142 | 31.952 | −6.867 | 12.528 | 1.00 | 46.13 | C |
| ATOM | 5894 | CG | ARG | L | 142 | 30.554 | −7.000 | 13.151 | 1.00 | 48.95 | C |
| ATOM | 5895 | CD | ARG | L | 142 | 29.554 | −5.968 | 12.592 | 1.00 | 50.87 | C |

TABLE 77-continued

| ATOM | 5896 | NE | ARG | L | 142 | 28.394 | −6.627 | 11.992 | 1.00 | 61.20 | N |
|------|------|-----|-----|---|-----|--------|--------|--------|------|-------|---|
| ATOM | 5897 | CZ | ARG | L | 142 | 27.151 | −6.553 | 12.450 | 1.00 | 55.12 | C |
| ATOM | 5898 | NH1 | ARG | L | 142 | 26.863 | −5.818 | 13.510 | 1.00 | 66.90 | N |
| ATOM | 5899 | NH2 | ARG | L | 142 | 26.184 | −7.206 | 11.829 | 1.00 | 73.37 | N |
| ATOM | 5900 | N | GLU | L | 143 | 33.007 | −9.750 | 11.319 | 1.00 | 46.35 | N |
| ATOM | 5901 | CA | GLU | L | 143 | 32.527 | −10.978 | 10.692 | 1.00 | 49.89 | C |
| ATOM | 5902 | C | GLU | L | 143 | 32.928 | −12.182 | 11.534 | 1.00 | 51.11 | C |
| ATOM | 5903 | O | GLU | L | 143 | 34.113 | −12.485 | 11.665 | 1.00 | 53.11 | O |
| ATOM | 5904 | CB | GLU | L | 143 | 33.087 | −11.116 | 9.279 | 1.00 | 54.61 | C |
| ATOM | 5905 | CG | GLU | L | 143 | 33.076 | −9.832 | 8.464 | 1.00 | 64.87 | C |
| ATOM | 5906 | CD | GLU | L | 143 | 34.336 | −8.980 | 8.666 | 1.00 | 68.53 | C |
| ATOM | 5907 | OE1 | GLU | L | 143 | 35.462 | −9.491 | 8.425 | 1.00 | 69.58 | O |
| ATOM | 5908 | OE2 | GLU | L | 143 | 34.190 | −7.808 | 9.082 | 1.00 | 60.84 | O |
| ATOM | 5909 | N | ALA | L | 144 | 31.946 | −12.868 | 12.103 | 1.00 | 51.52 | N |
| ATOM | 5910 | CA | ALA | L | 144 | 32.176 | −14.096 | 12.847 | 1.00 | 50.22 | C |
| ATOM | 5911 | C | ALA | L | 144 | 31.106 | −15.088 | 12.435 | 1.00 | 47.65 | C |
| ATOM | 5912 | O | ALA | L | 144 | 29.968 | −14.700 | 12.163 | 1.00 | 48.70 | O |
| ATOM | 5913 | CB | ALA | L | 144 | 32.138 | −13.863 | 14.362 | 1.00 | 44.84 | C |
| ATOM | 5914 | N | LYS | L | 145 | 31.474 | −16.362 | 12.363 | 1.00 | 45.56 | N |
| ATOM | 5915 | CA | LYS | L | 145 | 30.537 | −17.402 | 11.964 | 1.00 | 51.68 | C |
| ATOM | 5916 | C | LYS | L | 145 | 30.380 | −18.369 | 13.123 | 1.00 | 49.16 | C |
| ATOM | 5917 | O | LYS | L | 145 | 31.357 | −18.986 | 13.553 | 1.00 | 44.42 | O |
| ATOM | 5918 | CB | LYS | L | 145 | 31.031 | −18.124 | 10.712 | 1.00 | 55.46 | C |
| ATOM | 5919 | CG | LYS | L | 145 | 30.274 | −19.392 | 10.370 | 1.00 | 51.58 | C |
| ATOM | 5920 | CD | LYS | L | 145 | 30.351 | −19.637 | 8.863 | 1.00 | 58.30 | C |
| ATOM | 5921 | CE | LYS | L | 145 | 30.252 | −21.107 | 8.518 | 1.00 | 53.98 | C |
| ATOM | 5922 | NZ | LYS | L | 145 | 31.588 | −21.752 | 8.713 | 1.00 | 72.49 | N |
| ATOM | 5923 | N | VAL | L | 146 | 29.168 | −18.500 | 13.646 | 1.00 | 42.79 | N |
| ATOM | 5924 | CA | VAL | L | 146 | 28.914 | −19.500 | 14.672 | 1.00 | 48.94 | C |
| ATOM | 5925 | C | VAL | L | 146 | 27.921 | −20.510 | 14.123 | 1.00 | 45.08 | C |
| ATOM | 5926 | O | VAL | L | 146 | 26.898 | −20.140 | 13.536 | 1.00 | 51.26 | O |
| ATOM | 5927 | CB | VAL | L | 146 | 28.464 | −18.867 | 16.003 | 1.00 | 45.84 | C |
| ATOM | 5928 | CG1 | VAL | L | 146 | 28.621 | −17.361 | 15.962 | 1.00 | 44.38 | C |
| ATOM | 5929 | CG2 | VAL | L | 146 | 27.096 | −19.329 | 16.435 | 1.00 | 49.75 | C |
| ATOM | 5930 | N | GLN | L | 147 | 28.260 | −21.785 | 14.264 | 1.00 | 42.46 | N |
| ATOM | 5931 | CA | GLN | L | 147 | 27.446 | −22.892 | 13.794 | 1.00 | 43.80 | C |
| ATOM | 5932 | C | GLN | L | 147 | 27.045 | −23.716 | 15.003 | 1.00 | 42.89 | C |
| ATOM | 5933 | O | GLN | L | 147 | 27.864 | −23.947 | 15.898 | 1.00 | 44.36 | O |
| ATOM | 5934 | CB | GLN | L | 147 | 28.218 | −23.765 | 12.782 | 1.00 | 47.28 | C |
| ATOM | 5935 | CG | GLN | L | 147 | 29.102 | −22.970 | 11.815 | 1.00 | 58.28 | C |
| ATOM | 5936 | CD | GLN | L | 147 | 29.771 | −23.836 | 10.742 | 1.00 | 70.22 | C |
| ATOM | 5937 | OE1 | GLN | L | 147 | 29.093 | −24.440 | 9.905 | 1.00 | 71.88 | O |
| ATOM | 5938 | NE2 | GLN | L | 147 | 31.108 | −23.887 | 10.758 | 1.00 | 66.98 | N |
| ATOM | 5939 | N | TRP | L | 148 | 25.788 | −24.143 | 15.042 | 1.00 | 37.48 | N |
| ATOM | 5940 | CA | TRP | L | 148 | 25.310 | −25.021 | 16.099 | 1.00 | 41.73 | C |
| ATOM | 5941 | C | TRP | L | 148 | 25.397 | −26.474 | 15.656 | 1.00 | 43.88 | C |
| ATOM | 5942 | O | TRP | L | 148 | 25.132 | −26.801 | 14.494 | 1.00 | 42.01 | O |
| ATOM | 5943 | CB | TRP | L | 148 | 23.871 | −24.681 | 16.507 | 1.00 | 38.50 | C |
| ATOM | 5944 | CG | TRP | L | 148 | 23.808 | −23.394 | 17.286 | 1.00 | 46.63 | C |
| ATOM | 5945 | CD1 | TRP | L | 148 | 23.540 | −22.143 | 16.797 | 1.00 | 37.99 | C |
| ATOM | 5946 | CD2 | TRP | L | 148 | 24.061 | −23.230 | 18.686 | 1.00 | 41.24 | C |
| ATOM | 5947 | NE1 | TRP | L | 148 | 23.591 | −21.219 | 17.808 | 1.00 | 42.94 | N |
| ATOM | 5948 | CE2 | TRP | L | 148 | 23.913 | −21.853 | 18.977 | 1.00 | 41.84 | C |
| ATOM | 5949 | CE3 | TRP | L | 148 | 24.394 | −24.113 | 19.723 | 1.00 | 42.37 | C |
| ATOM | 5950 | CZ2 | TRP | L | 148 | 24.079 | −21.336 | 20.260 | 1.00 | 46.91 | C |
| ATOM | 5951 | CZ3 | TRP | L | 148 | 24.559 | −23.595 | 21.006 | 1.00 | 48.44 | C |
| ATOM | 5952 | CH2 | TRP | L | 148 | 24.408 | −22.213 | 21.258 | 1.00 | 46.39 | C |
| ATOM | 5953 | N | LYS | L | 149 | 25.749 | −27.340 | 16.601 | 1.00 | 11.23 | N |
| ATOM | 5954 | CA | LYS | L | 149 | 25.825 | −28.776 | 16.381 | 1.00 | 44.05 | C |
| ATOM | 5955 | C | LYS | L | 149 | 25.208 | −29.468 | 17.587 | 1.00 | 48.14 | C |
| ATOM | 5956 | O | LYS | L | 149 | 25.529 | −29.126 | 18.728 | 1.00 | 44.06 | O |
| ATOM | 5957 | CB | LYS | L | 149 | 27.277 | −29.225 | 16.180 | 1.00 | 48.16 | C |
| ATOM | 5958 | CG | LYS | L | 149 | 27.525 | −29.989 | 14.892 | 1.00 | 60.22 | C |
| ATOM | 5959 | CD | LYS | L | 149 | 29.009 | −30.231 | 14.628 | 1.00 | 60.90 | C |
| ATOM | 5960 | CE | LYS | L | 149 | 29.605 | −29.170 | 13.707 | 1.00 | 66.83 | C |
| ATOM | 5961 | NZ | LYS | L | 149 | 31.016 | −29.504 | 13.297 | 1.00 | 65.17 | N |
| ATOM | 5962 | N | VAL | L | 150 | 24.311 | −30.414 | 17.329 | 1.00 | 40.25 | N |
| ATOM | 5963 | CA | VAL | L | 150 | 23.610 | −31.174 | 18.352 | 1.00 | 47.84 | C |
| ATOM | 5964 | C | VAL | L | 150 | 23.930 | −32.644 | 18.088 | 1.00 | 51.99 | C |
| ATOM | 5965 | O | VAL | L | 150 | 23.497 | −33.203 | 17.074 | 1.00 | 49.08 | O |
| ATOM | 5966 | CB | VAL | L | 150 | 22.092 | −30.910 | 18.317 | 1.00 | 51.32 | C |
| ATOM | 5967 | CG1 | VAL | L | 150 | 21.342 | −31.816 | 19.292 | 1.00 | 50.94 | C |
| ATOM | 5968 | CG2 | VAL | L | 150 | 21.784 | −29.430 | 18.612 | 1.00 | 44.93 | C |
| ATOM | 5969 | N | ASP | L | 151 | 24.704 | −33.264 | 18.979 | 1.00 | 52.77 | N |
| ATOM | 5970 | CA | ASP | L | 151 | 25.201 | −34.634 | 18.784 | 1.00 | 58.08 | C |
| ATOM | 5971 | C | ASP | L | 151 | 25.863 | −34.794 | 17.411 | 1.00 | 52.26 | C |
| ATOM | 5972 | O | ASP | L | 151 | 25.618 | −35.756 | 16.681 | 1.00 | 57.73 | O |
| ATOM | 5973 | CB | ASP | L | 151 | 24.077 | −35.665 | 18.980 | 1.00 | 54.36 | C |
| ATOM | 5974 | CG | ASP | L | 151 | 23.710 | −35.873 | 20.451 | 1.00 | 60.54 | C |
| ATOM | 5975 | OD1 | ASP | L | 151 | 24.544 | −35.573 | 21.338 | 1.00 | 60.24 | O |

TABLE 77-continued

| ATOM | 5976 | OD2 | ASP | L | 151 | 22.585 | −36.347 | 20.722 | 1.00 | 63.86 | O |
|------|------|-----|-----|---|-----|--------|---------|--------|------|-------|---|
| ATOM | 5977 | N | ASN | L | 152 | 26.705 | −33.822 | 17.055 | 1.00 | 50.92 | N |
| ATOM | 5978 | CA | ASN | L | 152 | 27.357 | −33.753 | 15.744 | 1.00 | 57.30 | C |
| ATOM | 5979 | C | ASN | L | 152 | 26.358 | −33.613 | 14.585 | 1.00 | 58.33 | C |
| ATOM | 5980 | O | ASN | L | 152 | 26.692 | −33.932 | 13.439 | 1.00 | 61.22 | O |
| ATOM | 5981 | CB | ASN | L | 152 | 28.270 | −34.967 | 15.503 | 1.00 | 60.53 | C |
| ATOM | 5982 | CG | ASN | L | 152 | 29.646 | −34.579 | 14.969 | 1.00 | 69.22 | C |
| ATOM | 5983 | OD1 | ASN | L | 152 | 30.172 | −33.505 | 15.280 | 1.00 | 76.04 | O |
| ATOM | 5984 | ND2 | ASN | L | 152 | 30.236 | −35.458 | 14.159 | 1.00 | 66.70 | N |
| ATOM | 5985 | N | ALA | L | 153 | 25.131 | −33.144 | 14.834 | 1.00 | 45.85 | N |
| ATOM | 5986 | CA | ALA | L | 153 | 24.205 | −32.790 | 13.758 | 1.00 | 48.62 | C |
| ATOM | 5987 | C | ALA | L | 153 | 24.276 | −31.278 | 13.550 | 1.00 | 44.37 | C |
| ATOM | 5988 | O | ALA | L | 153 | 23.842 | −30.511 | 14.414 | 1.00 | 47.93 | O |
| ATOM | 5989 | CB | ALA | L | 153 | 22.775 | −33.231 | 14.080 | 1.00 | 12.68 | C |
| ATOM | 5990 | N | LEU | L | 154 | 24.853 | −30.852 | 12.425 | 1.00 | 47.08 | N |
| ATOM | 5991 | CA | LEU | L | 154 | 24.796 | 29.443 | 12.035 | 1.00 | 44.19 | C |
| ATOM | 5992 | C | LEU | L | 154 | 23.337 | −28.982 | 11.975 | 1.00 | 39.79 | C |
| ATOM | 5993 | O | LEU | L | 154 | 22.497 | −29.631 | 11.344 | 1.00 | 38.40 | O |
| ATOM | 5994 | CB | LEU | L | 154 | 25.472 | −29.261 | 10.678 | 1.00 | 41.46 | C |
| ATOM | 5995 | CG | LEU | L | 154 | 25.989 | −27.926 | 10.115 | 1.00 | 53.50 | C |
| ATOM | 5996 | CD1 | LEU | L | 154 | 25.314 | −26.701 | 10.697 | 1.00 | 54.88 | C |
| ATOM | 5997 | CD2 | LEU | L | 154 | 27.496 | −27.820 | 10.284 | 1.00 | 58.28 | C |
| ATOM | 5998 | N | GLN | L | 155 | 23.036 | −27.864 | 12.637 | 1.00 | 39.23 | N |
| ATOM | 5999 | CA | GLN | L | 155 | 21.680 | −27.331 | 12.699 | 1.00 | 40.47 | C |
| ATOM | 6000 | C | GLN | L | 155 | 21.455 | −26.245 | 11.653 | 1.00 | 38.42 | C |
| ATOM | 6001 | O | GLN | L | 155 | 22.391 | −25.605 | 11.165 | 1.00 | 41.42 | O |
| ATOM | 6002 | CB | GLN | L | 155 | 21.378 | −26.748 | 14.082 | 1.00 | 36.66 | C |
| ATOM | 6003 | CG | GLN | L | 155 | 21.583 | −27.704 | 15.214 | 1.00 | 40.22 | C |
| ATOM | 6004 | CD | GLN | L | 155 | 20.550 | −28.790 | 15.225 | 1.00 | 42.49 | C |
| ATOM | 6005 | OE1 | GLN | L | 155 | 19.378 | −28.521 | 15.430 | 1.00 | 43.07 | O |
| ATOM | 6006 | NE2 | GLN | L | 155 | 20.975 | −30.027 | 14.998 | 1.00 | 41.62 | N |
| ATOM | 6007 | N | SER | L | 156 | 20.180 | −26.006 | 11.355 | 1.00 | 37.33 | N |
| ATOM | 6008 | CA | SER | L | 156 | 19.783 | −24.847 | 10.565 | 1.00 | 35.60 | C |
| ATOM | 6009 | C | SER | L | 156 | 18.384 | −24.431 | 10.991 | 1.00 | 39.34 | C |
| ATOM | 6010 | O | SER | L | 156 | 17.611 | −25.245 | 11.499 | 1.00 | 35.79 | O |
| ATOM | 6011 | CB | SER | L | 156 | 19.795 | −25.128 | 9.052 | 1.00 | 31.19 | C |
| ATOM | 6012 | OG | SER | L | 156 | 18.796 | −26.080 | 8.695 | 1.00 | 35.46 | O |
| ATOM | 6013 | N | GLY | L | 157 | 18.069 | −23.153 | 10.792 | 1.00 | 36.58 | N |
| ATOM | 6014 | CA | GLY | L | 157 | 16.705 | −22.700 | 10.959 | 1.00 | 35.69 | C |
| ATOM | 6015 | C | GLY | L | 157 | 16.198 | −22.617 | 12.382 | 1.00 | 41.41 | C |
| ATOM | 6016 | O | GLY | L | 157 | 15.067 | −22.171 | 12.583 | 1.00 | 40.29 | O |
| ATOM | 6017 | N | ASN | L | 158 | 16.981 | −23.011 | 13.389 | 1.00 | 37.03 | N |
| ATOM | 6018 | CA | ASN | L | 158 | 16.512 | −22.930 | 14.774 | 1.00 | 37.62 | C |
| ATOM | 6019 | C | ASN | L | 158 | 17.402 | −22.048 | 15.648 | 1.00 | 39.90 | C |
| ATOM | 6020 | O | ASN | L | 158 | 17.352 | −22.156 | 16.879 | 1.00 | 39.75 | O |
| ATOM | 6021 | CB | ASN | L | 158 | 16.400 | −24.327 | 15.388 | 1.00 | 39.97 | C |
| ATOM | 6022 | CG | ASN | L | 158 | 17.649 | −25.160 | 15.161 | 1.00 | 40.80 | C |
| ATOM | 6023 | OD1 | ASN | L | 158 | 18.674 | −24.655 | 14.709 | 1.00 | 40.34 | O |
| ATOM | 6024 | ND2 | ASN | L | 158 | 17.560 | −26.447 | 15.471 | 1.00 | 41.26 | N |
| ATOM | 6025 | N | SER | L | 159 | 18.224 | −21.190 | 15.044 | 1.00 | 34.83 | N |
| ATOM | 6026 | CA | SER | L | 159 | 19.072 | −20.273 | 15.794 | 1.00 | 38.81 | C |
| ATOM | 6027 | C | SER | L | 159 | 18.930 | −18.853 | 15.259 | 1.00 | 40.95 | C |
| ATOM | 6028 | O | SER | L | 159 | 18.628 | −18.628 | 14.085 | 1.00 | 40.77 | O |
| ATOM | 6029 | CB | SER | L | 159 | 20.554 | −20.693 | 15.754 | 1.00 | 37.10 | C |
| ATOM | 6030 | OG | SER | L | 159 | 21.032 | −20.701 | 14.426 | 1.00 | 38.86 | O |
| ATOM | 6031 | N | GLN | L | 160 | 19.129 | −17.890 | 16.145 | 1.00 | 39.51 | N |
| ATOM | 6032 | CA | GLN | L | 160 | 19.188 | −16.492 | 15.751 | 1.00 | 42.81 | C |
| ATOM | 6033 | C | GLN | L | 160 | 20.304 | −15.847 | 16.558 | 1.00 | 40.69 | C |
| ATOM | 6034 | O | GLN | L | 160 | 20.529 | −16.199 | 17.722 | 1.00 | 39.84 | O |
| ATOM | 6035 | CB | GLN | L | 160 | 17.834 | −15.772 | 15.967 | 1.00 | 42.02 | C |
| ATOM | 6036 | CG | GLN | L | 160 | 16.602 | −16.731 | 15.954 | 1.00 | 56.83 | C |
| ATOM | 6037 | CD | GLN | L | 160 | 15.409 | −16.268 | 15.103 | 1.00 | 61.57 | C |
| ATOM | 6038 | OE1 | GLN | L | 160 | 15.353 | −15.121 | 14.648 | 1.00 | 60.03 | O |
| ATOM | 6039 | NE2 | GLN | L | 160 | 14.446 | −17.181 | 14.885 | 1.00 | 63.58 | N |
| ATOM | 6040 | N | GLU | L | 161 | 21.020 | −14.925 | 15.934 | 1.00 | 41.37 | N |
| ATOM | 6041 | CA | GLU | L | 161 | 22.113 | −14.247 | 16.602 | 1.00 | 42.54 | C |
| ATOM | 6042 | C | GLU | L | 161 | 21.940 | −12.743 | 16.487 | 1.00 | 41.35 | C |
| ATOM | 6043 | O | GLU | L | 161 | 21.182 | −12.243 | 15.648 | 1.00 | 39.04 | O |
| ATOM | 6044 | CB | GLU | L | 161 | 23.474 | −14.660 | 16.024 | 1.00 | 44.93 | C |
| ATOM | 6045 | CG | GLU | L | 161 | 23.597 | −14.354 | 14.552 | 1.00 | 45.71 | C |
| ATOM | 6046 | CD | GLU | L | 161 | 24.931 | −14.779 | 13.966 | 1.00 | 49.58 | C |
| ATOM | 6047 | OE1 | GLU | L | 161 | 25.467 | −14.031 | 13.122 | 1.00 | 46.92 | O |
| ATOM | 6048 | OE2 | GLU | L | 161 | 25.436 | −15.863 | 14.344 | 1.00 | 51.56 | O |
| ATOM | 6049 | N | SER | L | 162 | 22.673 | −12.017 | 17.334 | 1.00 | 39.27 | N |
| ATOM | 6050 | CA | SER | L | 162 | 22.752 | −10.579 | 17.161 | 1.00 | 40.95 | C |
| ATOM | 6051 | C | SER | L | 162 | 24.075 | −10.077 | 17.710 | 1.00 | 43.18 | C |
| ATOM | 6052 | O | SER | L | 162 | 24.698 | −10.706 | 18.568 | 1.00 | 43.83 | O |
| ATOM | 6053 | CB | SER | L | 162 | 21.574 | −9.844 | 17.820 | 1.00 | 43.53 | C |
| ATOM | 6054 | OG | SER | L | 162 | 21.690 | −9.792 | 19.226 | 1.00 | 48.43 | O |
| ATOM | 6055 | N | VAL | L | 163 | 24.482 | −8.927 | 17.197 | 1.00 | 42.32 | N |

TABLE 77-continued

| | | | | | | | | | | |
|---|---|---|---|---|---|---|---|---|---|---|
| ATOM | 6056 | CA | VAL | L | 163 | 25.808 | −8.366 | 17.388 | 1.00 | 44.05 | C |
| ATOM | 6057 | C | VAL | L | 163 | 25.650 | −6.986 | 18.019 | 1.00 | 45.22 | C |
| ATOM | 6058 | O | VAL | L | 163 | 24.852 | −6.176 | 17.542 | 1.00 | 45.55 | O |
| ATOM | 6059 | CB | VAL | L | 163 | 26.554 | −8.274 | 16.044 | 1.00 | 46.96 | C |
| ATOM | 6060 | CG1 | VAL | L | 163 | 27.956 | −7.763 | 16.248 | 1.00 | 44.40 | C |
| ATOM | 6061 | CG2 | VAL | L | 163 | 26.551 | −9.628 | 15.327 | 1.00 | 44.58 | C |
| ATOM | 6062 | N | THR | L | 164 | 26.407 | −6.719 | 19.081 | 1.00 | 43.62 | N |
| ATOM | 6063 | CA | THR | L | 164 | 26.385 | −5.396 | 19.686 | 1.00 | 46.56 | C |
| ATOM | 6064 | C | THR | L | 164 | 26.954 | −4.340 | 18.735 | 1.00 | 48.09 | C |
| ATOM | 6065 | O | THR | L | 164 | 27.606 | −4.634 | 17.725 | 1.00 | 45.28 | O |
| ATOM | 6066 | CB | THR | L | 164 | 27.192 | −5.372 | 20.986 | 1.00 | 46.71 | C |
| ATOM | 6067 | OG1 | THR | L | 164 | 28.544 | −5.755 | 20.716 | 1.00 | 48.51 | O |
| ATOM | 6068 | CG2 | THR | L | 164 | 26.589 | −6.305 | 22.014 | 1.00 | 49.25 | C |
| ATOM | 6069 | N | GLU | L | 165 | 26.686 | −3.086 | 19.075 | 1.00 | 49.17 | N |
| ATOM | 6070 | CA | GLU | L | 165 | 27.416 | −1.975 | 18.498 | 1.00 | 50.83 | C |
| ATOM | 6071 | C | GLU | L | 165 | 28.883 | −2.045 | 18.929 | 1.00 | 50.38 | C |
| ATOM | 6072 | O | GLU | L | 165 | 29.215 | −2.564 | 19.998 | 1.00 | 49.60 | O |
| ATOM | 6073 | CB | GLU | L | 165 | 26.773 | −0.651 | 18.935 | 1.00 | 58.48 | C |
| ATOM | 6074 | CG | GLU | L | 165 | 27.438 | 0.611 | 18.395 | 1.00 | 71.22 | C |
| ATOM | 6075 | CD | GLU | L | 165 | 27.454 | 1.762 | 19.406 | 1.00 | 77.16 | C |
| ATOM | 6076 | OE1 | GLU | L | 165 | 28.482 | 2.476 | 19.490 | 1.00 | 74.20 | O |
| ATOM | 6077 | OE2 | GLU | L | 165 | 26.444 | 1.947 | 20.123 | 1.00 | 74.82 | O |
| ATOM | 6078 | N | GLN | L | 166 | 29.770 | −1.547 | 18.070 | 1.00 | 54.81 | C |
| ATOM | 6079 | CA | GLN | L | 166 | 31.183 | −1.448 | 18.416 | 1.00 | 57.58 | C |
| ATOM | 6080 | C | GLN | L | 166 | 31.360 | −0.693 | 19.729 | 1.00 | 60.22 | C |
| ATOM | 6081 | O | GLN | L | 166 | 30.776 | 0.376 | 19.927 | 1.00 | 56.40 | O |
| ATOM | 6082 | CB | GLN | L | 166 | 31.940 | −0.749 | 17.287 | 1.00 | 55.74 | C |
| ATOM | 6083 | CG | GLN | L | 166 | 33.444 | −0.696 | 17.456 | 1.00 | 51.87 | C |
| ATOM | 6084 | CD | GLN | L | 166 | 34.131 | −0.323 | 16.166 | 1.00 | 56.68 | C |
| ATOM | 6085 | OE1 | GLN | L | 166 | 33.741 | 0.638 | 15.505 | 1.00 | 55.32 | O |
| ATOM | 6086 | NE2 | GLN | L | 166 | 35.142 | −1.099 | 15.778 | 1.00 | 59.68 | N |
| ATOM | 6087 | N | ASP | L | 167 | 32.165 | −1.263 | 20.626 | 1.00 | 61.23 | N |
| ATOM | 6088 | CA | ASP | L | 167 | 32.256 | −0.792 | 22.002 | 1.00 | 63.81 | C |
| ATOM | 6089 | C | ASP | L | 167 | 33.171 | 0.418 | 22.102 | 1.00 | 67.38 | C |
| ATOM | 6090 | O | ASP | L | 167 | 34.232 | 0.461 | 21.479 | 1.00 | 67.47 | O |
| ATOM | 6091 | CB | ASP | L | 167 | 32.775 | −1.910 | 22.903 | 1.00 | 67.27 | C |
| ATOM | 6092 | CG | ASP | L | 167 | 32.346 | −1.742 | 24.343 | 1.00 | 78.72 | C |
| ATOM | 6093 | OD1 | ASP | L | 167 | 31.150 | −1.456 | 24.582 | 1.00 | 82.79 | O |
| ATOM | 6094 | OD2 | ASP | L | 167 | 33.203 | −1.915 | 25.234 | 1.00 | 78.53 | O |
| ATOM | 6095 | N | SER | L | 168 | 32.761 | 1.401 | 22.908 | 1.00 | 73.21 | N |
| ATOM | 6096 | CA | SER | L | 168 | 33.500 | 2.661 | 22.961 | 1.00 | 76.91 | C |
| ATOM | 6097 | C | SER | L | 168 | 34.857 | 2.512 | 23.645 | 1.00 | 73.84 | C |
| ATOM | 6098 | O | SER | L | 168 | 35.779 | 3.281 | 23.353 | 1.00 | 78.73 | O |
| ATOM | 6099 | CB | SER | L | 168 | 32.663 | 3.729 | 23.666 | 1.00 | 75.83 | C |
| ATOM | 6100 | OG | SER | L | 168 | 32.075 | 3.209 | 24.845 | 1.00 | 80.44 | O |
| ATOM | 6101 | N | LYS | L | 169 | 35.008 | 1.539 | 24.543 | 1.00 | 76.74 | N |
| ATOM | 6102 | CA | LYS | L | 169 | 36.270 | 1.366 | 25.256 | 1.00 | 75.02 | C |
| ATOM | 6103 | C | LYS | L | 169 | 37.333 | 0.733 | 24.360 | 1.00 | 78.71 | C |
| ATOM | 6104 | O | LYS | L | 169 | 38.326 | 1.386 | 24.017 | 1.00 | 81.42 | O |
| ATOM | 6105 | CB | LYS | L | 169 | 36.057 | 0.522 | 26.520 | 1.00 | 82.95 | C |
| ATOM | 6106 | CG | LYS | L | 169 | 36.943 | 0.910 | 27.721 | 1.00 | 92.43 | C |
| ATOM | 6107 | CD | LYS | L | 169 | 38.139 | −0.028 | 27.905 | 1.00 | 81.35 | C |
| ATOM | 6108 | CE | LYS | L | 169 | 38.499 | −0.222 | 29.387 | 1.00 | 78.23 | C |
| ATOM | 6109 | NZ | LYS | L | 169 | 39.283 | 0.907 | 29.969 | 1.00 | 81.66 | N |
| ATOM | 6110 | N | ASP | L | 170 | 37.134 | −0.525 | 23.955 | 1.00 | 73.93 | N |
| ATOM | 6111 | CA | ASP | L | 170 | 38.153 | −1.271 | 23.223 | 1.00 | 68.89 | C |
| ATOM | 6112 | C | ASP | L | 170 | 37.815 | −1.493 | 21.750 | 1.00 | 66.15 | C |
| ATOM | 6113 | O | ASP | L | 170 | 38.508 | −2.269 | 21.078 | 1.00 | 63.75 | O |
| ATOM | 6114 | CB | ASP | L | 170 | 38.420 | −2.611 | 23.913 | 1.00 | 74.09 | C |
| ATOM | 6115 | CG | ASP | L | 170 | 37.197 | −3.510 | 23.951 | 1.00 | 71.33 | C |
| ATOM | 6116 | OD1 | ASP | L | 170 | 36.062 | −2.993 | 23.919 | 1.00 | 74.75 | O |
| ATOM | 6117 | OD2 | ASP | L | 170 | 37.379 | −4.742 | 24.019 | 1.00 | 71.33 | O |
| ATOM | 6118 | N | SER | L | 171 | 36.778 | −0.832 | 21.227 | 1.00 | 61.66 | N |
| ATOM | 6119 | CA | SER | L | 171 | 36.483 | −0.823 | 19.789 | 1.00 | 59.94 | C |
| ATOM | 6120 | C | SER | L | 171 | 36.155 | −2.225 | 19.257 | 1.00 | 56.28 | C |
| ATOM | 6121 | O | SER | L | 171 | 36.280 | −2.510 | 18.063 | 1.00 | 48.61 | O |
| ATOM | 6122 | CB | SER | L | 171 | 37.639 | −0.186 | 19.009 | 1.00 | 58.92 | C |
| ATOM | 6123 | OG | SER | L | 171 | 37.357 | −0.097 | 17.625 | 1.00 | 64.41 | O |
| ATOM | 6124 | N | THR | L | 172 | 35.681 | −3.094 | 20.134 | 1.00 | 53.48 | N |
| ATOM | 6125 | CA | THR | L | 172 | 35.430 | −4.488 | 19.825 | 1.00 | 53.72 | C |
| ATOM | 6126 | C | THR | L | 172 | 33.935 | −4.770 | 19.653 | 1.00 | 57.86 | C |
| ATOM | 6127 | O | THR | L | 172 | 33.075 | −3.921 | 19.914 | 1.00 | 51.01 | O |
| ATOM | 6128 | CB | THR | L | 172 | 36.009 | −5.353 | 20.936 | 1.00 | 57.88 | C |
| ATOM | 6129 | OG1 | THR | L | 172 | 36.189 | −6.677 | 20.447 | 1.00 | 66.69 | O |
| ATOM | 6130 | CG2 | THR | L | 172 | 35.083 | −5.361 | 22.109 | 1.00 | 53.45 | C |
| ATOM | 6131 | N | TYR | L | 173 | 33.632 | −5.988 | 19.193 | 1.00 | 54.00 | N |
| ATOM | 6132 | CA | TYR | L | 173 | 32.266 | −6.445 | 18.978 | 1.00 | 49.51 | C |
| ATOM | 6133 | C | TYR | L | 173 | 31.971 | −7.665 | 19.842 | 1.00 | 49.41 | C |
| ATOM | 6134 | O | TYR | L | 173 | 32.869 | −8.433 | 20.194 | 1.00 | 49.36 | O |
| ATOM | 6135 | CB | TYR | L | 173 | 32.013 | −6.809 | 17.511 | 1.00 | 47.44 | C |

TABLE 77-continued

| ATOM | 6136 | CG | TYR | L | 173 | 32.040 | −5.649 | 16.545 | 1.00 | 50.00 | C |
|------|------|-----|-----|---|-----|--------|--------|--------|------|-------|---|
| ATOM | 6137 | CD1 | TYR | L | 173 | 30.919 | −4.849 | 16.355 | 1.00 | 47.18 | C |
| ATOM | 6138 | CD2 | TYR | L | 173 | 33.181 | −5.364 | 15.804 | 1.00 | 50.48 | C |
| ATOM | 6139 | CE1 | TYR | L | 173 | 30.941 | −3.793 | 15.469 | 1.00 | 50.49 | C |
| ATOM | 6140 | CE2 | TYR | L | 173 | 33.209 | −4.314 | 14.909 | 1.00 | 49.75 | C |
| ATOM | 6141 | CZ | TYR | L | 173 | 32.090 | −3.528 | 14.748 | 1.00 | 55.19 | C |
| ATOM | 6142 | OH | TYR | L | 173 | 32.123 | −2.478 | 13.856 | 1.00 | 59.34 | O |
| ATOM | 6143 | N | SER | L | 174 | 30.700 | −7.857 | 20.173 | 1.00 | 46.67 | N |
| ATOM | 6144 | CA | SER | L | 174 | 30.270 | −9.071 | 20.848 | 1.00 | 49.46 | C |
| ATOM | 6145 | C | SER | L | 174 | 29.051 | −9.635 | 20.137 | 1.00 | 44.86 | C |
| ATOM | 6146 | O | SER | L | 174 | 28.291 | −8.905 | 19.492 | 1.00 | 45.70 | O |
| ATOM | 6147 | CB | SER | L | 174 | 29.967 | −8.829 | 22.336 | 1.00 | 50.47 | C |
| ATOM | 6148 | OG | SER | L | 174 | 31.152 | −8.518 | 23.045 | 1.00 | 57.95 | O |
| ATOM | 6149 | N | LEU | L | 175 | 28.882 | −10.950 | 20.250 | 1.00 | 43.98 | N |
| ATOM | 6150 | CA | LEU | L | 175 | 27.843 | −11.646 | 19.514 | 1.00 | 42.01 | C |
| ATOM | 6151 | C | LEU | L | 175 | 27.204 | −12.700 | 20.410 | 1.00 | 45.02 | C |
| ATOM | 6152 | O | LEU | L | 175 | 27.894 | −13.425 | 21.131 | 1.00 | 41.15 | O |
| ATOM | 6153 | CB | LEU | L | 175 | 28.420 | −12.263 | 18.231 | 1.00 | 38.80 | C |
| ATOM | 6154 | CG | LEU | L | 175 | 27.521 | −13.060 | 17.277 | 1.00 | 41.32 | C |
| ATOM | 6155 | CD1 | LEU | L | 175 | 28.129 | −13.085 | 15.894 | 1.00 | 43.49 | C |
| ATOM | 6156 | CD2 | LEU | L | 175 | 27.246 | −14.492 | 17.745 | 1.00 | 44.18 | C |
| ATOM | 6157 | N | SER | L | 176 | 25.877 | −12.781 | 20.350 | 1.00 | 42.77 | N |
| ATOM | 6158 | CA | SER | L | 176 | 25.113 | −13.812 | 21.038 | 1.00 | 46.25 | C |
| ATOM | 6159 | C | SER | L | 176 | 24.289 | −14.574 | 20.007 | 1.00 | 45.07 | C |
| ATOM | 6160 | O | SER | L | 176 | 23.637 | −13.940 | 19.175 | 1.00 | 42.48 | O |
| ATOM | 6161 | CB | SER | L | 176 | 24.205 | −13.170 | 22.098 | 1.00 | 44.70 | C |
| ATOM | 6162 | OG | SER | L | 176 | 23.176 | −14.053 | 22.497 | 1.00 | 50.90 | O |
| ATOM | 6163 | N | SER | L | 177 | 24.347 | −15.920 | 20.035 | 1.00 | 38.08 | N |
| ATOM | 6164 | CA | SER | L | 177 | 23.462 | −16.800 | 19.263 | 1.00 | 42.98 | C |
| ATOM | 6165 | C | SER | L | 177 | 22.651 | −17.655 | 20.217 | 1.00 | 42.85 | C |
| ATOM | 6166 | O | SER | L | 177 | 23.207 | −18.246 | 21.148 | 1.00 | 46.47 | O |
| ATOM | 6167 | CB | SER | L | 177 | 24.190 | −17.781 | 18.328 | 1.00 | 37.23 | C |
| ATOM | 6168 | OG | SER | L | 177 | 24.908 | −17.132 | 17.311 | 1.00 | 62.48 | O |
| ATOM | 6169 | N | THR | L | 178 | 21.365 | −17.771 | 19.945 | 1.00 | 37.84 | N |
| ATOM | 6170 | CA | THR | L | 178 | 20.463 | −18.605 | 20.722 | 1.00 | 39.64 | C |
| ATOM | 6171 | C | THR | L | 178 | 19.976 | −19.736 | 19.834 | 1.00 | 43.11 | C |
| ATOM | 6172 | O | THR | L | 178 | 19.318 | −19.487 | 18.822 | 1.00 | 42.32 | O |
| ATOM | 6173 | CB | THR | L | 178 | 19.277 | −17.788 | 21.240 | 1.00 | 41.08 | C |
| ATOM | 6174 | OG1 | THR | L | 178 | 19.772 | −16.670 | 21.972 | 1.00 | 47.10 | O |
| ATOM | 6175 | CG2 | THR | L | 178 | 18.366 | −18.629 | 22.135 | 1.00 | 41.45 | C |
| ATOM | 6176 | N | LEU | L | 179 | 20.319 | −20.965 | 20.203 | 1.00 | 42.40 | N |
| ATOM | 6177 | CA | LEU | L | 179 | 19.696 | −22.153 | 19.643 | 1.00 | 39.98 | C |
| ATOM | 6178 | C | LEU | L | 179 | 18.482 | −22.494 | 20.491 | 1.00 | 43.13 | C |
| ATOM | 6179 | O | LEU | L | 179 | 18.591 | −22.573 | 21.718 | 1.00 | 45.35 | O |
| ATOM | 6180 | CB | LEU | L | 179 | 20.687 | −23.313 | 19.649 | 1.00 | 40.28 | C |
| ATOM | 6181 | CG | LEU | L | 179 | 20.110 | −24.670 | 19.278 | 1.00 | 41.84 | C |
| ATOM | 6182 | CD1 | LEU | L | 179 | 19.895 | −24.682 | 17.782 | 1.00 | 40.39 | C |
| ATOM | 6183 | CD2 | LEU | L | 179 | 21.066 | −25.771 | 19.709 | 1.00 | 39.71 | C |
| ATOM | 6184 | N | THR | L | 180 | 17.331 | −22.703 | 19.849 | 1.00 | 38.55 | N |
| ATOM | 6185 | CA | THR | L | 180 | 16.096 | −22.990 | 20.567 | 1.00 | 45.31 | C |
| ATOM | 6186 | C | THR | L | 180 | 15.478 | −24.266 | 20.019 | 1.00 | 46.95 | C |
| ATOM | 6187 | O | THR | L | 180 | 15.271 | −24.386 | 18.810 | 1.00 | 46.32 | O |
| ATOM | 6188 | CB | THR | L | 180 | 15.092 | −21.832 | 20.460 | 1.00 | 47.44 | C |
| ATOM | 6189 | OG1 | THR | L | 180 | 15.594 | −20.686 | 21.161 | 1.00 | 49.30 | O |
| ATOM | 6190 | CG2 | THR | L | 180 | 13.758 | −22.239 | 21.081 | 1.00 | 49.28 | C |
| ATOM | 6191 | N | LEU | L | 181 | 15.188 | −25.214 | 20.904 | 1.00 | 46.45 | N |
| ATOM | 6192 | CA | LEU | L | 181 | 14.521 | −26.455 | 20.534 | 1.00 | 48.58 | C |
| ATOM | 6193 | C | LEU | L | 181 | 13.357 | −26.682 | 21.480 | 1.00 | 48.97 | C |
| ATOM | 6194 | O | LEU | L | 181 | 13.256 | −26.044 | 22.527 | 1.00 | 48.70 | O |
| ATOM | 6195 | CB | LEU | L | 181 | 15.477 | −27.650 | 20.596 | 1.00 | 51.39 | C |
| ATOM | 6196 | CG | LEU | L | 181 | 16.803 | −27.461 | 19.875 | 1.00 | 51.48 | C |
| ATOM | 6197 | CD1 | LEU | L | 181 | 17.743 | −28.596 | 20.221 | 1.00 | 63.30 | C |
| ATOM | 6198 | CD2 | LEU | L | 181 | 16.556 | −27.394 | 18.388 | 1.00 | 53.16 | C |
| ATOM | 6199 | N | SER | L | 182 | 12.470 | −27.603 | 21.111 | 1.00 | 52.12 | N |
| ATOM | 6200 | CA | SER | L | 182 | 11.489 | −28.085 | 22.073 | 1.00 | 58.88 | C |
| ATOM | 6201 | C | SER | L | 182 | 12.205 | −28.765 | 23.235 | 1.00 | 59.36 | C |
| ATOM | 6202 | O | SER | L | 182 | 13.353 | −29.199 | 23.118 | 1.00 | 56.87 | O |
| ATOM | 6203 | CB | SER | L | 182 | 10.518 | −29.065 | 21.412 | 1.00 | 61.57 | C |
| ATOM | 6204 | OG | SER | L | 182 | 11.209 | −30.198 | 20.905 | 1.00 | 63.34 | O |
| ATOM | 6205 | N | LYS | L | 183 | 11.523 | −28.846 | 24.380 | 1.00 | 63.18 | N |
| ATOM | 6206 | CA | LYS | L | 183 | 12.105 | −29.585 | 25.498 | 1.00 | 60.75 | C |
| ATOM | 6207 | C | LYS | L | 183 | 12.229 | −31.064 | 25.156 | 1.00 | 62.21 | C |
| ATOM | 6208 | O | LYS | L | 183 | 13.234 | −31.708 | 25.489 | 1.00 | 64.30 | O |
| ATOM | 6209 | CB | LYS | L | 183 | 11.278 | −29.376 | 26.767 | 1.00 | 62.26 | C |
| ATOM | 6210 | CG | LYS | L | 183 | 11.168 | −30.605 | 27.653 | 1.00 | 67.41 | C |
| ATOM | 6211 | CD | LYS | L | 183 | 11.503 | −30.298 | 29.103 | 1.00 | 64.53 | C |
| ATOM | 6212 | CE | LYS | L | 183 | 10.910 | −31.346 | 30.035 | 1.00 | 70.00 | C |
| ATOM | 6213 | NZ | LYS | L | 183 | 9.439 | −31.464 | 29.869 | 1.00 | 74.37 | N |
| ATOM | 6214 | N | ALA | L | 184 | 11.230 | −31.607 | 24.455 | 1.00 | 64.91 | N |
| ATOM | 6215 | CA | ALA | L | 184 | 11.290 | −32.993 | 24.000 | 1.00 | 66.18 | C |

TABLE 77-continued

| | | | | | | | | | | |
|---|---|---|---|---|---|---|---|---|---|---|
| ATOM | 6216 | C | ALA | L | 184 | 12.524 | −33.237 | 23.147 | 1.00 | 68.33 | C |
| ATOM | 6217 | O | ALA | L | 184 | 13.304 | −34.158 | 23.413 | 1.00 | 66.40 | O |
| ATOM | 6218 | CB | ALA | L | 184 | 10.029 | −33.343 | 23.211 | 1.00 | 58.17 | C |
| ATOM | 6219 | N | ASP | L | 185 | 12.713 | −32.422 | 22.105 | 1.00 | 67.75 | N |
| ATOM | 6220 | CA | ASP | L | 185 | 13.863 | −32.622 | 21.234 | 1.00 | 65.62 | C |
| ATOM | 6221 | C | ASP | L | 185 | 15.172 | −32.373 | 21.975 | 1.00 | 66.83 | C |
| ATOM | 6222 | O | ASP | L | 185 | 16.163 | −33.069 | 21.724 | 1.00 | 71.42 | O |
| ATOM | 6223 | CB | ASP | L | 185 | 13.754 | −31.727 | 20.000 | 1.00 | 65.71 | C |
| ATOM | 6224 | CG | ASP | L | 185 | 14.645 | −32.195 | 18.866 | 1.00 | 84.54 | C |
| ATOM | 6225 | OD1 | ASP | L | 185 | 14.444 | −33.337 | 18.394 | 1.00 | 89.45 | O |
| ATOM | 6226 | OD2 | ASP | L | 185 | 15.545 | −31.428 | 18.445 | 1.00 | 87.34 | O |
| ATOM | 6227 | N | TYR | L | 186 | 15.193 | −31.409 | 22.901 | 1.00 | 60.45 | N |
| ATOM | 6228 | CA | TYR | L | 186 | 16.388 | −31.193 | 23.711 | 1.00 | 62.89 | C |
| ATOM | 6229 | C | TYR | L | 186 | 16.687 | −32.403 | 24.584 | 1.00 | 62.14 | C |
| ATOM | 6230 | O | TYR | L | 186 | 17.850 | −32.784 | 24.756 | 1.00 | 59.70 | O |
| ATOM | 6231 | CB | TYR | L | 186 | 16.232 | −29.946 | 24.584 | 1.00 | 59.73 | C |
| ATOM | 6232 | CG | TYR | L | 186 | 17.408 | −29.701 | 25.510 | 1.00 | 55.53 | C |
| ATOM | 6233 | CD1 | TYR | L | 186 | 18.595 | −29.173 | 25.026 | 1.00 | 56.54 | C |
| ATOM | 6234 | CD2 | TYR | L | 186 | 17.330 | −29.993 | 26.867 | 1.00 | 57.10 | C |
| ATOM | 6235 | CE1 | TYR | L | 186 | 19.673 | −28.945 | 25.860 | 1.00 | 55.39 | C |
| ATOM | 6236 | CE2 | TYR | L | 186 | 18.405 | −29.765 | 27.712 | 1.00 | 55.83 | C |
| ATOM | 6237 | CZ | TYR | L | 186 | 19.574 | −29.245 | 27.198 | 1.00 | 58.01 | C |
| ATOM | 6238 | OH | TYR | L | 186 | 20.648 | −29.019 | 28.017 | 1.00 | 58.94 | O |
| ATOM | 6239 | N | GLU | L | 187 | 15.653 | −33.018 | 25.152 | 1.00 | 65.04 | N |
| ATOM | 6240 | CA | GLU | L | 187 | 15.897 | −34.150 | 26.031 | 1.00 | 68.30 | C |
| ATOM | 6241 | C | GLU | L | 187 | 16.384 | −35.370 | 25.257 | 1.00 | 69.64 | C |
| ATOM | 6242 | O | GLU | L | 187 | 17.024 | −36.248 | 25.844 | 1.00 | 68.64 | O |
| ATOM | 6243 | CB | GLU | L | 187 | 14.632 | −34.471 | 26.834 | 1.00 | 69.18 | C |
| ATOM | 6244 | CG | GLU | L | 187 | 14.854 | −34.537 | 28.347 | 1.00 | 73.14 | C |
| ATOM | 6245 | CD | GLU | L | 187 | 14.696 | −33.195 | 29.033 | 1.00 | 78.63 | C |
| ATOM | 6246 | OE1 | GLU | L | 187 | 14.443 | −33.171 | 30.260 | 1.00 | 85.80 | O |
| ATOM | 6247 | OE2 | GLU | L | 187 | 14.816 | −32.160 | 28.347 | 1.00 | 80.67 | O |
| ATOM | 6248 | N | LYS | L | 188 | 16.125 | −35.424 | 23.951 | 1.00 | 67.90 | N |
| ATOM | 6249 | CA | LYS | L | 188 | 16.527 | −36.540 | 23.107 | 1.00 | 60.84 | C |
| ATOM | 6250 | C | LYS | L | 188 | 17.988 | −36.500 | 22.686 | 1.00 | 66.68 | C |
| ATOM | 6251 | O | LYS | L | 188 | 18.411 | −37.393 | 21.943 | 1.00 | 69.25 | O |
| ATOM | 6252 | CB | LYS | L | 188 | 15.650 | −36.584 | 21.854 | 1.00 | 68.70 | C |
| ATOM | 6253 | CG | LYS | L | 188 | 14.324 | −37.293 | 22.054 | 1.00 | 70.84 | C |
| ATOM | 6254 | CD | LYS | L | 188 | 13.225 | −36.680 | 21.206 | 1.00 | 70.28 | C |
| ATOM | 6255 | CE | LYS | L | 188 | 13.663 | −36.484 | 19.765 | 1.00 | 75.64 | C |
| ATOM | 6256 | NZ | LYS | L | 188 | 12.577 | −35.868 | 18.948 | 1.00 | 79.38 | N |
| ATOM | 6257 | N | HIS | L | 189 | 18.776 | −35.516 | 23.124 | 1.00 | 66.35 | N |
| ATOM | 6258 | CA | HIS | L | 189 | 20.162 | −35.410 | 22.683 | 1.00 | 61.61 | C |
| ATOM | 6259 | C | HIS | L | 189 | 21.066 | −35.115 | 23.865 | 1.00 | 60.51 | C |
| ATOM | 6260 | O | HIS | L | 189 | 20.613 | −34.731 | 24.946 | 1.00 | 65.99 | O |
| ATOM | 6261 | CB | HIS | L | 189 | 20.333 | −34.336 | 21.610 | 1.00 | 61.30 | C |
| ATOM | 6262 | CG | HIS | L | 189 | 19.552 | −34.608 | 20.367 | 1.00 | 62.46 | C |
| ATOM | 6263 | ND1 | HIS | L | 189 | 19.808 | −35.689 | 19.553 | 1.00 | 67.25 | N |
| ATOM | 6264 | CD2 | HIS | L | 189 | 18.515 | −33.946 | 19.803 | 1.00 | 64.88 | C |
| ATOM | 6265 | CF1 | HIS | L | 189 | 18.966 | −35.678 | 18.536 | 1.00 | 65.84 | C |
| ATOM | 6266 | NE2 | HIS | L | 189 | 18.171 | −34.630 | 18.664 | 1.00 | 68.39 | N |
| ATOM | 6267 | N | LYS | L | 190 | 22.368 | −35.279 | 23.629 | 1.00 | 63.11 | N |
| ATOM | 6268 | CA | LYS | L | 190 | 23.373 | −35.216 | 24.683 | 1.00 | 60.95 | C |
| ATOM | 6269 | C | LYS | L | 190 | 24.308 | −34.027 | 24.533 | 1.00 | 57.52 | C |
| ATOM | 6270 | O | LYS | L | 190 | 24.412 | −33.218 | 25.459 | 1.00 | 60.72 | O |
| ATOM | 6271 | CB | LYS | L | 190 | 24.190 | −36.514 | 24.717 | 1.00 | 60.60 | C |
| ATOM | 6272 | CG | LYS | L | 190 | 23.367 | −37.772 | 24.867 | 1.00 | 71.23 | C |
| ATOM | 6273 | CD | LYS | L | 190 | 24.262 | −38.948 | 25.256 | 1.00 | 86.33 | C |
| ATOM | 6274 | CE | LYS | L | 190 | 25.161 | −38.582 | 26.441 | 1.00 | 83.32 | C |
| ATOM | 6275 | NZ | LYS | L | 190 | 25.965 | −39.737 | 26.939 | 1.00 | 79.97 | N |
| ATOM | 6276 | N | VAL | L | 191 | 25.015 | −33.909 | 23.412 | 1.00 | 57.35 | N |
| ATOM | 6277 | CA | VAL | L | 191 | 26.074 | −32.918 | 23.256 | 1.00 | 55.14 | C |
| ATOM | 6278 | C | VAL | L | 191 | 25.528 | −31.724 | 22.486 | 1.00 | 56.88 | C |
| ATOM | 6279 | O | VAL | L | 191 | 24.957 | −31.878 | 21.398 | 1.00 | 49.94 | O |
| ATOM | 6280 | CB | VAL | L | 191 | 27.302 | −33.517 | 22.548 | 1.00 | 54.62 | C |
| ATOM | 6281 | CG1 | VAL | L | 191 | 28.450 | −32.518 | 22.540 | 1.00 | 51.46 | C |
| ATOM | 6282 | CG2 | VAL | L | 191 | 27.722 | −34.804 | 23.234 | 1.00 | 58.98 | C |
| ATOM | 6283 | N | TYR | L | 192 | 25.705 | −30.535 | 23.051 | 1.00 | 54.72 | N |
| ATOM | 6284 | CA | TYR | L | 192 | 25.295 | −29.286 | 22.422 | 1.00 | 47.07 | C |
| ATOM | 6285 | C | TYR | L | 192 | 26.539 | −28.437 | 22.248 | 1.00 | 49.40 | C |
| ATOM | 6286 | O | TYR | L | 192 | 27.223 | −28.130 | 23.231 | 1.00 | 51.85 | O |
| ATOM | 6287 | CB | TYR | L | 192 | 24.227 | −28.586 | 23.266 | 1.00 | 47.49 | C |
| ATOM | 6288 | CG | TYR | L | 192 | 22.932 | −29.365 | 23.269 | 1.00 | 55.90 | C |
| ATOM | 6289 | CD1 | TYR | L | 192 | 22.723 | −30.406 | 24.175 | 1.00 | 53.97 | C |
| ATOM | 6290 | CD2 | TYR | L | 192 | 21.943 | −29.102 | 22.331 | 1.00 | 52.14 | C |
| ATOM | 6291 | CE1 | TYR | L | 192 | 21.560 | −31.138 | 24.160 | 1.00 | 52.49 | C |
| ATOM | 6292 | CE2 | TYR | L | 192 | 20.772 | −29.829 | 22.307 | 1.00 | 49.39 | C |
| ATOM | 6293 | CZ | TYR | L | 192 | 20.587 | −30.849 | 23.223 | 1.00 | 59.21 | C |
| ATOM | 6294 | OH | TYR | L | 192 | 19.420 | −31.573 | 23.203 | 1.00 | 61.47 | O |
| ATOM | 6295 | N | ALA | L | 193 | 26.846 | −28.084 | 20.999 | 1.00 | 46.55 | N |

TABLE 77-continued

| | | | | | | | | | | |
|---|---|---|---|---|---|---|---|---|---|---|
| ATOM | 6296 | CA | ALA | L | 193 | 28.095 | −27.426 | 20.659 | 1.00 | 45.35 | C |
| ATOM | 6297 | C | ALA | L | 193 | 27.850 | −26.202 | 19.794 | 1.00 | 45.42 | C |
| ATOM | 6298 | O | ALA | L | 193 | 27.011 | −26.192 | 18.889 | 1.00 | 43.70 | O |
| ATOM | 6299 | CB | ALA | L | 193 | 29.052 | −28.358 | 19.918 | 1.00 | 41.86 | C |
| ATOM | 6300 | N | CYS | L | 194 | 28.641 | −25.188 | 20.065 | 1.00 | 43.56 | N |
| ATOM | 6301 | CA | CYS | L | 194 | 28.704 | −23.966 | 19.288 | 1.00 | 45.00 | C |
| ATOM | 6302 | C | CYS | L | 194 | 30.107 | −23.903 | 18.700 | 1.00 | 50.36 | C |
| ATOM | 6303 | O | CYS | L | 194 | 31.083 | −23.847 | 19.449 | 1.00 | 51.11 | O |
| ATOM | 6304 | CB | CYS | L | 194 | 28.420 | −22.778 | 20.204 | 1.00 | 50.40 | C |
| ATOM | 6305 | SG | CYS | L | 194 | 28.884 | −21.237 | 19.565 | 1.00 | 76.91 | S |
| ATOM | 6306 | N | GLU | L | 195 | 30.222 | −23.930 | 17.376 | 1.00 | 45.19 | N |
| ATOM | 6307 | CA | GLU | L | 195 | 31.512 | −23.809 | 16.702 | 1.00 | 47.29 | C |
| ATOM | 6308 | C | GLU | L | 195 | 31.640 | −22.410 | 16.117 | 1.00 | 50.95 | C |
| ATOM | 6309 | O | GLU | L | 195 | 30.783 | −21.984 | 15.333 | 1.00 | 47.20 | O |
| ATOM | 6310 | CB | GLU | L | 195 | 31.658 | −24.846 | 15.591 | 1.00 | 47.35 | C |
| ATOM | 6311 | CG | GLU | L | 195 | 32.995 | −24.746 | 14.845 | 1.00 | 60.76 | C |
| ATOM | 6312 | CD | GLU | L | 195 | 33.190 | −25.832 | 13.791 | 1.00 | 72.63 | C |
| ATOM | 6313 | OE1 | GLU | L | 195 | 33.645 | −25.506 | 12.669 | 1.00 | 80.66 | O |
| ATOM | 6314 | OE2 | GLU | L | 195 | 32.891 | −27.009 | 14.087 | 1.00 | 75.64 | O |
| ATOM | 6315 | N | VAL | L | 196 | 32.702 | −21.694 | 16.472 | 1.00 | 43.99 | N |
| ATOM | 6316 | CA | VAL | L | 196 | 32.875 | −20.340 | 15.960 | 1.00 | 51.69 | C |
| ATOM | 6317 | C | VAL | L | 196 | 34.177 | −20.249 | 15.182 | 1.00 | 50.53 | C |
| ATOM | 6318 | O | VAL | L | 196 | 35.212 | −20.774 | 15.606 | 1.00 | 51.59 | O |
| ATOM | 6319 | CB | VAL | L | 196 | 32.781 | −19.272 | 17.069 | 1.00 | 49.46 | C |
| ATOM | 6320 | CG1 | VAL | L | 196 | 32.516 | −19.900 | 18.423 | 1.00 | 52.34 | C |
| ATOM | 6321 | CG2 | VAL | L | 196 | 33.967 | −18.310 | 17.048 | 1.00 | 47.10 | C |
| ATOM | 6322 | N | THR | L | 197 | 34.102 | −19.629 | 14.014 | 1.00 | 43.22 | N |
| ATOM | 6323 | CA | THR | L | 197 | 35.258 | −19.393 | 13.172 | 1.00 | 52.83 | C |
| ATOM | 6324 | C | THR | L | 197 | 35.411 | −17.889 | 12.982 | 1.00 | 51.57 | C |
| ATOM | 6325 | O | THR | L | 197 | 34.424 | −17.160 | 12.849 | 1.00 | 43.89 | O |
| ATOM | 6326 | CB | THR | L | 197 | 35.123 | −20.139 | 11.830 | 1.00 | 50.79 | C |
| ATOM | 6327 | OG1 | THR | L | 197 | 34.941 | −19.208 | 10.764 | 1.00 | 61.74 | O |
| ATOM | 6328 | CG2 | THR | L | 197 | 33.947 | −21.079 | 11.864 | 1.00 | 53.00 | C |
| ATOM | 6329 | N | HIS | L | 198 | 36.651 | −17.421 | 13.022 | 1.00 | 49.73 | N |
| ATOM | 6330 | CA | HIS | L | 198 | 36.918 | −15.994 | 13.075 | 1.00 | 49.55 | C |
| ATOM | 6331 | C | HIS | L | 198 | 38.386 | −15.780 | 12.759 | 1.00 | 54.28 | C |
| ATOM | 6332 | O | HIS | L | 198 | 39.238 | −16.546 | 13.219 | 1.00 | 49.43 | O |
| ATOM | 6333 | CB | HIS | L | 198 | 36.585 | −15.419 | 14.462 | 1.00 | 45.35 | C |
| ATOM | 6334 | CG | HIS | L | 198 | 36.750 | −13.931 | 14.561 | 1.00 | 51.02 | C |
| ATOM | 6335 | ND1 | HIS | L | 198 | 37.893 | −13.340 | 15.054 | 1.00 | 52.04 | N |
| ATOM | 6336 | CD2 | HIS | L | 198 | 35.912 | −12.914 | 14.239 | 1.00 | 49.74 | C |
| ATOM | 6337 | CE1 | HIS | L | 198 | 37.751 | −12.025 | 15.041 | 1.00 | 53.74 | C |
| ATOM | 6338 | NE2 | HIS | L | 198 | 36.560 | −11.739 | 14.545 | 1.00 | 48.04 | N |
| ATOM | 6339 | N | GLN | L | 199 | 38.671 | −14.755 | 11.961 | 1.00 | 52.81 | N |
| ATOM | 6340 | CA | GLN | L | 199 | 40.045 | −14.303 | 11.807 | 1.00 | 58.88 | C |
| ATOM | 6341 | C | GLN | L | 199 | 40.625 | −14.018 | 13.188 | 1.00 | 56.29 | C |
| ATOM | 6342 | O | GLN | L | 199 | 39.928 | −13.548 | 14.084 | 1.00 | 69.45 | O |
| ATOM | 6343 | CB | GLN | L | 199 | 40.079 | −13.054 | 10.930 | 1.00 | 61.25 | C |
| ATOM | 6344 | CG | GLN | L | 199 | 41.461 | −12.630 | 10.502 | 1.00 | 69.41 | C |
| ATOM | 6345 | CD | GLN | L | 199 | 41.417 | −11.519 | 9.479 | 1.00 | 69.78 | C |
| ATOM | 6346 | OE1 | GLN | L | 199 | 40.530 | −10.669 | 9.512 | 1.00 | 68.68 | O |
| ATOM | 6347 | NE2 | GLN | L | 199 | 42.370 | −11.527 | 8.552 | 1.00 | 75.84 | N |
| ATOM | 6348 | N | GLY | L | 200 | 41.879 | −14.338 | 13.392 | 1.00 | 54.56 | N |
| ATOM | 6349 | CA | GLY | L | 200 | 42.406 | −14.234 | 14.734 | 1.00 | 65.61 | C |
| ATOM | 6350 | C | GLY | L | 200 | 42.228 | −15.477 | 15.577 | 1.00 | 63.79 | C |
| ATOM | 6351 | O | GLY | L | 200 | 42.813 | −15.561 | 16.664 | 1.00 | 63.93 | O |
| ATOM | 6352 | N | LEU | L | 201 | 41.419 | −16.426 | 15.126 | 1.00 | 54.93 | N |
| ATOM | 6353 | CA | LEU | L | 201 | 41.489 | −17.800 | 15.586 | 1.00 | 62.13 | C |
| ATOM | 6354 | C | LEU | L | 201 | 42.179 | −18.594 | 14.488 | 1.00 | 65.66 | C |
| ATOM | 6355 | O | LEU | L | 201 | 41.705 | −18.616 | 13.346 | 1.00 | 62.11 | O |
| ATOM | 6356 | CB | LEU | L | 201 | 40.103 | −18.373 | 15.870 | 1.00 | 59.20 | C |
| ATOM | 6357 | CG | LEU | L | 201 | 39.254 | −17.679 | 16.930 | 1.00 | 57.63 | C |
| ATOM | 6358 | CD1 | LEU | L | 201 | 37.839 | −18.234 | 16.849 | 1.00 | 54.33 | C |
| ATOM | 6359 | CD2 | LEU | L | 201 | 39.845 | −17.856 | 18.330 | 1.00 | 51.62 | C |
| ATOM | 6360 | N | SER | L | 202 | 43.305 | −19.225 | 14.828 | 1.00 | 67.09 | N |
| ATOM | 6361 | CA | SER | L | 202 | 44.031 | −20.012 | 13.838 | 1.00 | 67.71 | C |
| ATOM | 6362 | C | SER | L | 202 | 43.232 | −21.222 | 13.365 | 1.00 | 69.32 | C |
| ATOM | 6363 | O | SER | L | 202 | 43.466 | −21.709 | 12.252 | 1.00 | 74.99 | O |
| ATOM | 6364 | CB | SER | L | 202 | 45.381 | −20.452 | 14.403 | 1.00 | 66.69 | C |
| ATOM | 6365 | OG | SER | L | 202 | 45.243 | −20.949 | 15.721 | 1.00 | 77.16 | O |
| ATOM | 6366 | N | SER | L | 203 | 42.296 | −21.710 | 14.172 | 1.00 | 63.60 | N |
| ATOM | 6367 | CA | SER | L | 203 | 41.398 | −22.782 | 13.768 | 1.00 | 66.88 | C |
| ATOM | 6368 | C | SER | L | 203 | 40.074 | −22.587 | 14.488 | 1.00 | 62.02 | C |
| ATOM | 6369 | O | SER | L | 203 | 40.028 | −21.948 | 15.546 | 1.00 | 56.11 | O |
| ATOM | 6370 | CB | SER | L | 203 | 41.994 | −24.165 | 14.081 | 1.00 | 66.03 | C |
| ATOM | 6371 | OG | SER | L | 203 | 42.193 | −24.328 | 15.474 | 1.00 | 69.06 | O |
| ATOM | 6372 | N | PRO | L | 204 | 38.978 | −23.117 | 13.944 | 1.00 | 65.68 | N |
| ATOM | 6373 | CA | PRO | L | 204 | 37.686 | −22.989 | 14.630 | 1.00 | 64.13 | C |
| ATOM | 6374 | C | PRO | L | 204 | 37.765 | −23.493 | 16.063 | 1.00 | 63.01 | C |
| ATOM | 6375 | O | PRO | L | 204 | 38.457 | −24.468 | 16.361 | 1.00 | 62.91 | O |

TABLE 77-continued

| ATOM | 6376 | CB | PRO | L | 204 | 36.746 | −23.845 | 13.777 | 1.00 | 62.75 | C |
|---|---|---|---|---|---|---|---|---|---|---|---|
| ATOM | 6377 | CG | PRO | L | 204 | 37.350 | −23.799 | 12.418 | 1.00 | 69.44 | C |
| ATOM | 6378 | CD | PRO | L | 204 | 38.841 | −23.778 | 12.633 | 1.00 | 62.73 | C |
| ATOM | 6379 | N | VAL | L | 205 | 37.085 | −22.786 | 16.959 | 1.00 | 55.04 | N |
| ATOM | 6380 | CA | VAL | L | 205 | 36.920 | −23.215 | 18.342 | 1.00 | 54.56 | C |
| ATOM | 6381 | C | VAL | L | 205 | 35.474 | −23.627 | 18.539 | 1.00 | 60.09 | C |
| ATOM | 6382 | O | VAL | L | 205 | 34.549 | −22.934 | 18.095 | 1.00 | 55.13 | O |
| ATOM | 6383 | CB | VAL | L | 205 | 37.312 | −22.109 | 19.339 | 1.00 | 61.03 | C |
| ATOM | 6384 | CG1 | VAL | L | 205 | 36.718 | −20.803 | 18.914 | 1.00 | 62.74 | C |
| ATOM | 6385 | CG2 | VAL | L | 205 | 36.825 | −22.456 | 20.735 | 1.00 | 59.38 | C |
| ATOM | 6386 | N | THR | L | 206 | 35.269 | −24.757 | 19.197 | 1.00 | 50.36 | N |
| ATOM | 6387 | CA | THR | L | 206 | 33.933 | −25.179 | 19.563 | 1.00 | 55.15 | C |
| ATOM | 6388 | C | THR | L | 206 | 33.841 | −25.282 | 21.080 | 1.00 | 59.89 | C |
| ATOM | 6389 | O | THR | L | 206 | 34.783 | −25.726 | 21.739 | 1.00 | 57.58 | O |
| ATOM | 6390 | CB | THR | L | 206 | 33.579 | −26.496 | 18.887 | 1.00 | 54.40 | C |
| ATOM | 6391 | OG1 | THR | L | 206 | 33.319 | −27.490 | 19.881 | 1.00 | 66.21 | O |
| ATOM | 6392 | CG2 | THR | L | 206 | 34.705 | −26.941 | 17.980 | 1.00 | 58.24 | C |
| ATOM | 6393 | N | LYS | L | 207 | 32.730 | −24.802 | 21.635 | 1.00 | 53.77 | N |
| ATOM | 6394 | CA | LYS | L | 207 | 32.409 | −24.982 | 23.043 | 1.00 | 54.52 | C |
| ATOM | 6395 | C | LYS | L | 207 | 31.169 | −25.852 | 23.133 | 1.00 | 51.02 | C |
| ATOM | 6396 | O | LYS | L | 207 | 30.232 | −25.696 | 22.345 | 1.00 | 53.52 | O |
| ATOM | 6397 | CB | LYS | L | 207 | 32.195 | −23.636 | 23.770 | 1.00 | 51.44 | C |
| ATOM | 6398 | CG | LYS | L | 207 | 33.498 | −22.956 | 24.221 | 1.00 | 61.32 | C |
| ATOM | 6399 | CD | LYS | L | 207 | 33.994 | −23.498 | 25.577 | 1.00 | 61.52 | C |
| ATOM | 6400 | CE | LYS | L | 207 | 35.511 | −23.316 | 25.770 | 1.00 | 69.77 | C |
| ATOM | 6401 | NZ | LYS | L | 207 | 36.306 | −24.575 | 25.530 | 1.00 | 63.02 | N |
| ATOM | 6402 | N | SER | L | 208 | 31.179 | −26.783 | 24.079 | 1.00 | 51.72 | N |
| ATOM | 6403 | CA | SER | L | 208 | 30.148 | −27.802 | 24.168 | 1.00 | 56.69 | C |
| ATOM | 6404 | C | SER | L | 208 | 29.821 | −28.069 | 25.625 | 1.00 | 52.39 | C |
| ATOM | 6405 | O | SER | L | 208 | 30.530 | −27.643 | 26.537 | 1.00 | 60.81 | O |
| ATOM | 6406 | CB | SER | L | 208 | 30.579 | −29.102 | 23.482 | 1.00 | 53.67 | C |
| ATOM | 6407 | OG | SER | L | 208 | 31.815 | −29.559 | 24.002 | 1.00 | 57.26 | O |
| ATOM | 6408 | N | PHE | L | 209 | 28.720 | −28.773 | 25.829 | 1.00 | 54.59 | N |
| ATOM | 6409 | CA | PHE | L | 209 | 28.359 | −29.303 | 27.131 | 1.00 | 60.77 | C |
| ATOM | 6410 | C | PHE | L | 209 | 27.545 | −30.565 | 26.891 | 1.00 | 59.97 | C |
| ATOM | 6411 | O | PHE | L | 209 | 27.215 | −30.902 | 25.750 | 1.00 | 59.66 | O |
| ATOM | 6412. | CB | PHE | L | 209 | 27.609 | −28.267 | 27.981 | 1.00 | 53.94 | C |
| ATOM | 6413 | CG | PHE | L | 209 | 26.201 | −27.991 | 27.524 | 1.00 | 58.32 | C |
| ATOM | 6414 | CD1 | PHE | L | 209 | 25.143 | −28.796 | 27.939 | 1.00 | 52.24 | C |
| ATOM | 6415 | CD2 | PHE | L | 209 | 25.928 | −26.900 | 26.712 | 1.00 | 56.39 | C |
| ATOM | 6416 | CE1 | PHE | L | 209 | 23.854 | −28.536 | 27.532 | 1.00 | 55.15 | C |
| ATOM | 6417 | CE2 | PHE | L | 209 | 24.628 | −26.631 | 26.309 | 1.00 | 51.00 | C |
| ATOM | 6418 | CZ | PHE | L | 209 | 23.593 | −27.456 | 26.716 | 1.00 | 50.99 | C |
| ATOM | 6419 | N | ASN | L | 210 | 27.196 | −31.248 | 27.983 | 1.00 | 64.61 | N |
| ATOM | 6420 | CA | ASN | L | 210 | 26.664 | −32.612 | 27.928 | 1.00 | 64.06 | C |
| ATOM | 6421 | C | ASN | L | 210 | 25.526 | −32.776 | 28.935 | 1.00 | 69.42 | C |
| ATOM | 6422 | O | ASN | L | 210 | 25.780 | −33.097 | 30.098 | 1.00 | 77.43 | O |
| ATOM | 6423 | CB | ASN | L | 210 | 27.782 | −33.613 | 28.208 | 1.00 | 73.92 | C |
| ATOM | 6424 | CG | ASN | L | 210 | 28.256 | −34.329 | 26.969 | 1.00 | 70.69 | C |
| ATOM | 6425 | OD1 | ASN | L | 210 | 27.643 | −35.305 | 26.538 | 1.00 | 77.85 | O |
| ATOM | 6426 | ND2 | ASN | L | 210 | 29.363 | −33.864 | 26.395 | 1.00 | 72.14 | N |
| ATOM | 6427 | N | ARG | L | 211 | 24.285 | −32.573 | 28.477 | 1.00 | 66.45 | N |
| ATOM | 6428 | CA | ARG | L | 211 | 23.083 | −33.035 | 29.175 | 1.00 | 66.76 | C |
| ATOM | 6429 | C | ARG | L | 211 | 21.832 | −32.685 | 28.383 | 1.00 | 67.11 | C |
| ATOM | 6430 | O | ARG | L | 211 | 21.819 | −31.709 | 27.628 | 1.00 | 73.90 | O |
| ATOM | 6431 | CB | ARG | L | 211 | 22.968 | −32.450 | 30.585 | 1.00 | 72.64 | C |
| ATOM | 6432 | CG | ARG | L | 211 | 23.176 | −33.474 | 31.693 | 1.00 | 74.99 | C |
| ATOM | 6433 | CD | ARG | L | 211 | 23.791 | −32.821 | 32.925 | 1.00 | 75.65 | C |
| ATOM | 6434 | NE | ARG | L | 211 | 24.956 | −32.014 | 32.567 | 1.00 | 78.75 | N |
| ATOM | 6435 | CZ | ARG | L | 211 | 25.793 | −31.458 | 33.440 | 1.00 | 83.83 | C |
| ATOM | 6436 | NH1 | ARG | L | 211 | 25.605 | −31.620 | 34.744 | 1.00 | 81.57 | N |
| ATOM | 6437 | NH2 | ARG | L | 211 | 26.825 | −30.740 | 33.006 | 1.00 | 80.18 | N |
| ATOM | 6438 | N | GLY | L | 212 | 20.774 | −33.467 | 28.562 | 1.00 | 73.20 | N |
| ATOM | 6439 | CA | GLY | L | 212 | 19.528 | −33.251 | 27.859 | 1.00 | 66.86 | C |
| ATOM | 6440 | C | GLY | L | 212 | 18.677 | −34.501 | 27.847 | 1.00 | 68.75 | C |
| ATOM | 6441 | O | GLY | L | 212 | 19.130 | −35.562 | 27.420 | 1.00 | 74.51 | O |
| TER | | | | | | | | | | | |
| ATOM | 6442 | N | GLY | P | 1 | 16.500 | 38.002 | 1.405 | 1.00 | 30.65 | N |
| ATOM | 6443 | CA | GLY | P | 1 | 15.156 | 37.551 | 1.748 | 1.00 | 32.01 | C |
| ATOM | 6444 | C | GLY | P | 1 | 14.376 | 38.598 | 2.523 | 1.00 | 32.14 | C |
| ATOM | 6445 | O | GLY | P | 1 | 14.949 | 39.323 | 3.345 | 1.00 | 32.76 | O |
| ATOM | 6446 | N | VAL | P | 2 | 13.061 | 38.672 | 2.285 | 1.00 | 28.29 | N |
| ATOM | 6447 | CA | VAL | P | 2 | 12.252 | 39.743 | 2.836 | 1.00 | 27.73 | C |
| ATOM | 6448 | C | VAL | P | 2 | 12.099 | 39.505 | 4.332 | 1.00 | 31.34 | C |
| ATOM | 6449 | O | VAL | P | 2 | 12.444 | 38.424 | 4.832 | 1.00 | 30.28 | O |
| ATOM | 6450 | CB | VAL | P | 2 | 10.878 | 39.836 | 2.130 | 1.00 | 30.38 | C |
| ATOM | 6451 | CG1 | VAL | P | 2 | 11.040 | 40.208 | 0.634 | 1.00 | 28.49 | C |
| ATOM | 6452 | CG2 | VAL | P | 2 | 10.117 | 38.524 | 2.260 | 1.00 | 33.61 | C |
| ATOM | 6453 | N | TYR | P | 3 | 11.587 | 40.508 | 5.048 | 1.00 | 27.37 | N |
| ATOM | 6454 | CA | TYR | P | 3 | 11.225 | 40.383 | 6.457 | 1.00 | 30.02 | C |

TABLE 77-continued

| | | | | | | | | | | |
|---|---|---|---|---|---|---|---|---|---|---|
| ATOM | 6455 | C | TYR | P | 3 | 10.430 | 39.110 | 6.712 | 1.00 | 32.96 C |
| ATOM | 6456 | O | TYR | P | 3 | 9.363 | 38.903 | 6.131 | 1.00 | 34.19 O |
| ATOM | 6457 | CB | TYR | P | 3 | 10.408 | 41.597 | 6.894 | 1.00 | 33.92 C |
| ATOM | 6458 | CG | TYR | P | 3 | 9.822 | 41.428 | 8.268 | 1.00 | 31.94 C |
| ATOM | 6459 | CD1 | TYR | P | 3 | 10.638 | 41.390 | 9.392 | 1.00 | 33.37 C |
| ATOM | 6460 | CD2 | TYR | P | 3 | 8.464 | 41.308 | 8.441 | 1.00 | 33.30 C |
| ATOM | 6461 | CE1 | TYR | P | 3 | 10.098 | 41.223 | 10.662 | 1.00 | 31.74 C |
| ATOM | 6462 | CE2 | TYR | P | 3 | 7.909 | 41.146 | 9.705 | 1.00 | 37.28 C |
| ATOM | 6463 | CZ | TYR | P | 3 | 8.738 | 41.100 | 10.801 | 1.00 | 34.78 C |
| ATOM | 6464 | OH | TYR | P | 3 | 8.195 | 40.942 | 12.044 | 1.00 | 37.37 O |
| ATOM | 6465 | N | ASP | P | 4 | 10.938 | 38.260 | 7.605 | 1.00 | 34.01 N |
| ATOM | 6466 | CA | ASP | P | 4 | 10.442 | 36.896 | 7.753 | 1.00 | 33.20 C |
| ATOM | 6467 | C | ASP | P | 4 | 9.650 | 36.694 | 9.036 | 1.00 | 36.33 C |
| ATOM | 6468 | O | ASP | P | 4 | 9.306 | 35.551 | 9.367 | 1.00 | 39.34 O |
| ATOM | 6469 | CB | ASP | P | 4 | 11.611 | 35.891 | 7.706 | 1.00 | 29.93 C |
| ATOM | 6470 | CG | ASP | P | 4 | 12.659 | 36.161 | 8.785 | 1.00 | 34.48 C |
| ATOM | 6471 | OD1 | ASP | P | 4 | 12.642 | 37.247 | 9.396 | 1.00 | 35.74 O |
| ATOM | 6472 | OD2 | ASP | P | 4 | 13.553 | 35.307 | 8.987 | 1.00 | 39.55 O1− |
| ATOM | 6473 | N | GLY | P | 5 | 9.357 | 37.766 | 9.768 | 1.00 | 34.38 N |
| ATOM | 6474 | CA | GLY | P | 5 | 8.680 | 37.668 | 11.039 | 1.00 | 32.97 C |
| ATOM | 6475 | C | GLY | P | 5 | 7.188 | 37.904 | 10.919 | 1.00 | 37.53 C |
| ATOM | 6476 | O | GLY | P | 5 | 6.614 | 37.964 | 9.831 | 1.00 | 34.57 O |
| ATOM | 6477 | N | GLU | P | 6 | 6.553 | 38.025 | 12.073 | 1.00 | 35.66 N |
| ATOM | 6478 | CA | GLU | P | 6 | 5.138 | 38.344 | 12.110 | 1.00 | 40.72 C |
| ATOM | 6479 | C | GLU | P | 6 | 4.911 | 39.753 | 11.583 | 1.00 | 37.93 C |
| ATOM | 6480 | O | GLU | P | 6 | 5.632 | 40.687 | 11.933 | 1.00 | 38.70 O |
| ATOM | 6481 | CB | GLU | P | 6 | 4.603 | 38.224 | 13.530 | 1.00 | 42.20 C |
| ATOM | 6482 | CG | GLU | P | 6 | 3.252 | 37.526 | 13.586 | 1.00 | 57.87 C |
| ATOM | 6483 | CD | GLU | P | 6 | 3.063 | 36.753 | 14.870 | 1.00 | 71.13 C |
| ATOM | 6484 | OE1 | GLU | P | 6 | 3.078 | 37.398 | 15.947 | 1.00 | 74.42 O |
| ATOM | 6485 | OE2 | GLU | P | 6 | 2.917 | 35.508 | 14.794 | 1.00 | 71.63 O1− |
| ATOM | 6486 | N | GLU | P | 7 | 3.909 | 39.903 | 10.742 | 1.00 | 42.75 N |
| ATOM | 6487 | CA | GLU | P | 7 | 3.622 | 41.193 | 10.132 | 1.00 | 44.23 C |
| ATOM | 6488 | C | GLU | P | 7 | 2.500 | 41.917 | 10.857 | 1.00 | 39.09 C |
| ATOM | 6489 | O | GLU | P | 7 | 1.561 | 41.307 | 11.367 | 1.00 | 40.76 O |
| ATOM | 6490 | CB | GLU | P | 7 | 3.287 | 41.017 | 8.655 | 1.00 | 44.32 C |
| ATOM | 6491 | CG | GLU | P | 7 | 4.559 | 40.611 | 7.906 | 1.00 | 44.42 C |
| ATOM | 6492 | CD | GLU | P | 7 | 4.324 | 40.393 | 6.447 | 1.00 | 42.10 C |
| ATOM | 6493 | OE1 | GLU | P | 7 | 4.990 | 39.494 | 5.882 | 1.00 | 39.42 O |
| ATOM | 6494 | OE2 | GLU | P | 7 | 3.487 | 41.135 | 5.875 | 1.00 | 38.73 O1− |
| ATOM | 6495 | N | HIS | P | 8 | 2.625 | 43.237 | 10.905 | 1.00 | 41.34 N |
| ATOM | 6496 | CA | HIS | P | 8 | 1.748 | 44.096 | 11.680 | 1.00 | 41.56 C |
| ATOM | 6497 | C | HIS | P | 8 | 1.276 | 45.244 | 10.815 | 1.00 | 40.74 C |
| ATOM | 6498 | O | HIS | P | 8 | 2.085 | 45.898 | 10.154 | 1.00 | 39.10 O |
| ATOM | 6499 | CB | HIS | P | 8 | 2.472 | 44.637 | 12.913 | 1.00 | 41.72 C |
| ATOM | 6500 | CG | HIS | P | 8 | 3.077 | 43.557 | 13.743 | 1.00 | 46.19 C |
| ATOM | 6501 | ND1 | HIS | P | 8 | 2.371 | 42.896 | 14.727 | 1.00 | 49.00 N |
| ATOM | 6502 | CD2 | HIS | P | 8 | 4.289 | 42.957 | 13.678 | 1.00 | 43.21 C |
| ATOM | 6503 | CE1 | HIS | P | 8 | 3.136 | 41.955 | 15.253 | 1.00 | 44.04 C |
| ATOM | 6504 | NE2 | HIS | P | 8 | 4.306 | 41.977 | 14.639 | 1.00 | 45.16 N |
| ATOM | 6505 | N | ASER | P | 9 | −0.032 | 45.484 | 10.814 | 0.55 | 37.50 N |
| ATOM | 6506 | CA | ASER | P | 9 | −0.569 | 46.658 | 10.149 | 0.55 | 37.62 C |
| ATOM | 6507 | C | ASER | P | 9 | −0.444 | 47.878 | 11.056 | 0.55 | 38.04 C |
| ATOM | 6508 | O | ASER | P | 9 | −0.248 | 47.760 | 12.269 | 0.55 | 37.89 O |
| ATOM | 6509 | CB | ASER | P | 9 | −2.031 | 46.435 | 9.767 | 0.55 | 35.51 C |
| ATOM | 6510 | OG | ASER | P | 9 | −2.797 | 46.155 | 10.920 | 0.55 | 38.65 O |
| ATOM | 6511 | N | BSER | P | 9 | −0.028 | 45.497 | 10.840 | 0.45 | 37.57 N |
| ATOM | 6512 | CA | BSER | P | 9 | −0.569 | 46.669 | 10.180 | 0.45 | 37.55 C |
| ATOM | 6513 | C | BSER | P | 9 | −0.424 | 47.894 | 11.069 | 0.45 | 37.80 C |
| ATOM | 6514 | O | BSER | P | 9 | −0.195 | 47.794 | 12.278 | 0.45 | 38.37 O |
| ATOM | 6515 | CB | BSER | P | 9 | −2.037 | 46.457 | 9.821 | 0.45 | 35.69 C |
| ATOM | 6516 | OG | BSER | P | 9 | −2.145 | 45.585 | 8.720 | 0.45 | 36.50 O |
| ATOM | 6517 | N | VAL | P | 10 | −0.558 | 49.064 | 10.449 | 1.00 | 37.65 N |
| ATOM | 6518 | CA | VAL | P | 10 | −0.478 | 50.330 | 11.186 | 1.00 | 36.38 C |
| ATOM | 6519 | C | VAL | P | 10 | −1.697 | 50.519 | 12.102 | 0.66 | 36.93 C |
| ATOM | 6520 | O | VAL | P | 10 | −2.639 | 49.730 | 12.150 | 1.00 | 40.35 O |
| ATOM | 6521 | CB | VAL | P | 10 | −0.341 | 51.543 | 10.237 | 1.00 | 38.43 C |
| ATOM | 6522 | CG1 | VAL | P | 10 | 0.946 | 51.463 | 9.409 | 1.00 | 36.40 C |
| ATOM | 6523 | CG2 | VAL | P | 10 | −1.567 | 51.643 | 9.341 | 1.00 | 36.81 C |
| ATOM | 6524 | OXT | VAL | P | 10 | −1.770 | 51.497 | 12.841 | 1.00 | 37.79 O1− |
| TER | | | | | | | | | | |
| HETATM | 6525 | C1 | GOL | C | 1 | 0.806 | 75.593 | −28.305 | 0.44 | 74.01 C |
| HETATM | 6526 | C2 | GOL | C | 1 | −0.272 | 74.997 | −27.362 | 0.44 | 74.34 C |
| HETATM | 6527 | C3 | GOL | C | 1 | 0.054 | 75.594 | −25.971 | 0.44 | 73.44 C |
| HETATM | 6528 | O1 | GOL | C | 1 | 1.270 | 74.552 | −29.119 | 0.44 | 74.04 O |
| HETATM | 6529 | O2 | GOL | C | 1 | −0.256 | 73.604 | −27.353 | 0.44 | 74.22 O |
| HETATM | 6530 | O3 | GOL | C | 1 | −0.526 | 74.746 | −25.025 | 0.44 | 75.51 O |
| TER | | | | | | | | | | |
| HETATM | 6531 | C1 | GOL | C | 2 | 30.917 | 50.323 | −1.012 | 1.00 | 62.93 C |
| HETATM | 6532 | O2 | GOL | C | 2 | 31.051 | 49.730 | −2.438 | 1.00 | 62.82 C |

TABLE 77-continued

| | | | | | | | | | | |
|---|---|---|---|---|---|---|---|---|---|---|
| HETATM | 6533 | C3 | GOL | C | 2 | 29.895 | 48.690 | −2.614 | 1.00 | 64.85 C |
| HETATM | 6534 | O1 | GOL | C | 2 | 32.215 | 50.768 | −0.651 | 1.00 | 65.49 O |
| HETATM | 6535 | O2 | GOL | C | 2 | 32.302 | 49.180 | −2.643 | 1.00 | 63.36 O |
| HETATM | 6536 | O3 | GOL | C | 2 | 30.122 | 48.036 | −3.851 | 1.00 | 59.53 O |
| HETATM | 6537 | CI | GOL | C | 3 | 27.004 | 51.714 | 3.796 | 1.00 | 63.43 C |
| HETATM | 6538 | C2 | GOL | C | 3 | 25.819 | 51.075 | 3.012 | 1.00 | 53.50 C |
| HETATM | 6539 | O3 | GOL | C | 3 | 26.458 | 50.040 | 2.046 | 1.00 | 52.03 C |
| HETATM | 6540 | O1 | GOL | C | 3 | 26.487 | 52.334 | 4.949 | 1.00 | 66.42 O |
| HETATM | 6541 | O2 | GOL | C | 3 | 25.063 | 52.025 | 2.338 | 1.00 | 64.12 O |
| HETATM | 6542 | O3 | GOL | C | 3 | 26.275 | 50.518 | 0.720 | 1.00 | 60.87 O |
| HETATM | 6543 | C1 | GOL | C | 4 | 20.998 | 55.522 | −7.660 | 1.00 | 55.85 C |
| HETATM | 6544 | C2 | GOL | C | 4 | 20.566 | 54.563 | −6.512 | 1.00 | 68.45 C |
| HETATM | 6545 | C3 | GOL | C | 4 | 21.282 | 55.117 | −5.230 | 1.00 | 69.37 C |
| HETATM | 6546 | O1 | GOL | C | 4 | 20.102 | 55.290 | −8.724 | 1.00 | 64.72 O |
| HETATM | 6547 | O2 | GOL | C | 4 | 20.915 | 53.230 | −6.798 | 1.00 | 71.23 O |
| HETATM | 6548 | O3 | GOL | C | 4 | 20.887 | 54.317 | −4.128 | 1.00 | 68.11 O |
| HETATM | 6549 | C1 | GOL | C | 5 | 18.748 | 51.649 | −3.090 | 1.00 | 60.42 C |
| HETATM | 6550 | C2 | GOL | C | 5 | 18.877 | 51.993 | −4.610 | 1.00 | 58.73 C |
| HETATM | 6551 | C3 | GOL | C | 5 | 17.470 | 51.844 | −5.178 | 1.00 | 58.39 C |
| HETATM | 6552 | O1 | GOL | C | 5 | 19.613 | 50.588 | −2.821 | 1.00 | 62.64 O |
| HETATM | 6553 | O2 | GOL | C | 5 | 19.810 | 51.205 | −5.288 | 1.00 | 65.76 O |
| HETATM | 6554 | O3 | GOL | C | 5 | 16.875 | 53.151 | −5.209 | 1.00 | 63.09 O |
| SER | | | | | | | | | | |
| HETATM | 6555 | O | HOH | S | 2 | −3.550 | 20.720 | 8.768 | 1.00 | 41.01 O |
| HETATM | 6556 | O | HOH | S | 3 | 0.638 | 56.527 | −6.080 | 1.00 | 37.65 O |
| HETATM | 6557 | O | HOH | S | 4 | 8.095 | 49.826 | −4.953 | 1.00 | 32.52 O |
| HETATM | 6558 | O | HOH | S | 5 | 16.75 | 36.946 | 12.101 | 1.00 | 40.06 O |
| HETATM | 6559 | O | HOH | S | 6 | −7.457 | 49.275 | −4.793 | 1.00 | 34.25 O |
| HETATM | 6560 | O | HOH | S | 7 | −1.595 | 35.169 | −6.122 | 1.00 | 57.90 O |
| HETATM | 6561 | O | HOH | S | 9 | 22.552 | 52.402 | 4.095 | 1.00 | 50.92 O |
| HETATM | 6562 | O | HOH | S | 10 | −0.647 | 61.087 | −12.371 | 1.00 | 40.49 O |
| HETATM | 6563 | O | HOH | S | 11 | 2.437 | 48.014 | 8.247 | 1.00 | 39.38 O |
| HETATM | 6564 | O | HOH | S | 12 | 32.389 | 23.029 | 5.663 | 1.00 | 44.99 O |
| HETATM | 6565 | O | HOH | S | 13 | −7.934 | 4.967 | 11.193 | 1.00 | 45.78 O |
| HETATM | 6566 | O | HOH | S | 14 | 26.795 | 32.057 | −8.054 | 1.00 | 46.84 O |
| HETATM | 6567 | O | HOH | S | 15 | 24.967 | 41.390 | −9.979 | 1.00 | 40.37 O |
| HETATM | 6568 | O | HOH | S | 16 | −3.183 | 19.627 | 6.534 | 1.00 | 41.51 O |
| HETATM | 6569 | O | HOH | S | 17 | 17.172 | 33.333 | 8.870 | 1.00 | 34.85 O |
| HETATM | 6570 | O | HOH | S | 18 | 14.482 | 23.482 | 2.302 | 1.00 | 36.84 O |
| HETATM | 6571 | O | HOH | S | 19 | 20.574 | 22.897 | 3.550 | 1.00 | 34.90 O |
| HETATM | 6572 | O | HOH | S | 20 | 27.498 | 45.673 | −5.368 | 1.00 | 33.31 O |
| HETATM | 6573 | O | HOH | S | 21 | 9.885 | 27.553 | 1.531 | 1.00 | 35.30 O |
| HETATM | 6574 | O | HOH | S | 22 | 12.992 | 35.938 | 3.981 | 1.00 | 32.07 O |
| HETATM | 6575 | O | HOH | S | 23 | 5.397 | 53.887 | −26.217 | 1.00 | 43.78 O |
| HETATM | 6576 | O | HOH | S | 24 | 14.955 | 25.216 | −2.657 | 1.00 | 33.51 O |
| HETATM | 6577 | O | HOH | S | 25 | 23.063 | 23.984 | −9.157 | 1.00 | 35.82 O |
| HETATM | 6578 | O | HOH | S | 26 | 4.992 | 23.116 | 4.452 | 1.00 | 38.34 O |
| HETATM | 6579 | O | HOH | S | 27 | 14.424 | 61.895 | −14.555 | 1.00 | 37.81 O |
| HETATM | 6580 | O | HOH | S | 28 | −5.679 | 54.754 | 2.073 | 1.00 | 38.16 O |
| HETATM | 6581 | O | HOH | S | 29 | 3.519 | 56.900 | 0.499 | 1.00 | 34.86 O |
| HETATM | 6582 | O | HOH | S | 30 | 32.497 | 54.701 | −6.621 | 1.00 | 45.87 O |
| HETATM | 6583 | O | HOH | S | 31 | 11.315 | 44.022 | −14.097 | 1.00 | 50.70 O |
| HETATM | 6584 | O | HOH | S | 32 | 14.852 | 53.557 | 10.144 | 1.00 | 37.48 O |
| HETATM | 6585 | O | HOH | S | 34 | 11.509 | 27.631 | 11.701 | 1.00 | 34.06 O |
| HETATM | 6586 | O | HOH | S | 35 | 12.726 | 59.998 | −7.391 | 1.00 | 40.28 O |
| HETATM | 6587 | O | HOH | S | 36 | −0.888 | 59.061 | −2.874 | 1.00 | 39.82 O |
| HETATM | 6588 | O | HOH | S | 37 | 10.918 | 22.410 | 10.142 | 1.00 | 43.67 O |
| HETATM | 6589 | O | HOH | S | 38 | 22.226 | 33.401 | −4.239 | 1.00 | 39.64 O |
| HETATM | 6590 | O | HOH | S | 39 | 7.847 | 48.184 | 18.900 | 1.00 | 42.97 O |
| HETATM | 6591 | O | HOH | S | 40 | 9.701 | 11.270 | 1.997 | 1.00 | 43.56 O |
| HETATM | 6592 | O | HOH | S | 41 | 17.856 | 50.363 | −21.285 | 1.00 | 43.01 O |
| HETATM | 6593 | O | HOH | S | 42 | 20.977 | 50.353 | −15.129 | 1.00 | 42.69 O |
| HETATM | 6594 | O | HOH | S | 43 | 34.276 | 17.974 | 1.860 | 1.00 | 43.52 O |
| HETATM | 6595 | O | HOH | S | 44 | 20.634 | 48.061 | −1.481 | 1.00 | 35.65 O |
| HETATM | 6596 | O | HOH | S | 45 | 28.291 | 19.075 | 1.120 | 1.00 | 35.84 O |
| HETATM | 6597 | O | HOH | S | 16 | 32.715 | 36.020 | −1.283 | 1.00 | 37.14 O |
| HETATM | 6598 | O | HOH | S | 47 | 14.572 | 9.767 | 1.971 | 1.00 | 42.32 O |
| HETATM | 6599 | O | HOH | S | 48 | 10.812 | 33.108 | 9.769 | 1.00 | 44.71 O |
| HETATM | 6600 | O | HOH | S | 49 | 12.010 | 23.787 | 5.783 | 1.00 | 38.44 O |
| HETATM | 6601 | O | HOH | S | 50 | 2.570 | 29.680 | 13.478 | 1.00 | 40.36 O |
| HETATM | 6602 | O | HOH | S | 51 | 18.430 | −28.367 | 12.051 | 1.00 | 41.53 O |
| HETATM | 6603 | O | HOH | S | 52 | 7.403 | 25.006 | −0.525 | 1.00 | 45.80 O |
| HETATM | 6604 | O | HOH | S | 53 | 12.391 | 26.891 | 14.069 | 1.00 | 36.37 O |
| HETATM | 6605 | O | HOH | S | 54 | 3.939 | 4.564 | 4.824 | 1.00 | 44.16 O |
| HETATM | 6606 | O | HOH | S | 55 | 6.755 | 46.425 | −12.146 | 1.00 | 40.35 O |
| HETATM | 6607 | O | HOH | S | 56 | 24.793 | 30.054 | 1.887 | 1.00 | 47.31 O |
| HETATM | 6608 | O | HOH | S | 57 | −1.005 | 45.850 | −1.251 | 1.00 | 34.85 O |
| HETATM | 6609 | O | HOH | S | 58 | 38.531 | 57.700 | −7.743 | 1.00 | 50.98 O |
| HETATM | 6610 | O | HOH | S | 59 | −9.650 | 59.710 | −0.433 | 1.00 | 40.87 O |
| HETATM | 6611 | O | HOH | S | 60 | 5.938 | 39.299 | −10.033 | 1.00 | 34.17 O |

TABLE 77-continued

| | | | | | | | | | | |
|---|---|---|---|---|---|---|---|---|---|---|
| HETATM | 6612 | O | HOH | S | 61 | 7.692 | 60.025 | 17.795 | 1.00 | 53.57 | O |
| HETATM | 6613 | O | HOH | S | 62 | 17.912 | 7.201 | 4.307 | 1.00 | 45.55 | O |
| HETATM | 6614 | O | HOH | S | 63 | 6.784 | 49.139 | −12.173 | 1.00 | 39.13 | O |
| HETATM | 6615 | O | HOH | S | 64 | 13.744 | 37.930 | −2.074 | 1.00 | 33.33 | O |
| HETATM | 6616 | O | HOH | S | 65 | 20.138 | −12.258 | 21.663 | 1.00 | 56.88 | O |
| HETATM | 6617 | O | HOH | S | 66 | 12.068 | 24.265 | 8.311 | 1.00 | 38.45 | O |
| HETATM | 6618 | O | HOH | S | 67 | 18.205 | −20.153 | 11.954 | 1.00 | 41.20 | O |
| HETATM | 6619 | O | HOH | S | 68 | −6.884 | 60.606 | −4.253 | 1.00 | 52.11 | O |
| HETATM | 6620 | O | HOH | S | 69 | 5.500 | 46.124 | 10.410 | 1.00 | 58.77 | O |
| HETATM | 6621 | O | HOH | S | 70 | −0.594 | −2.979 | 6.853 | 1.00 | 52.65 | O |
| HETATM | 6622 | O | HOH | S | 71 | 11.468 | 30.641 | 17.272 | 1.00 | 49.44 | O |
| HETATM | 6623 | O | HOH | S | 72 | 7.411 | 34.198 | 11.377 | 1.00 | 47.20 | O |
| HETATM | 6624 | O | HOH | S | 73 | 22.028 | 6.819 | −1.309 | 1.00 | 43.45 | O |
| HETATM | 6625 | O | HOH | S | 74 | 1.547 | −11.803 | 20.314 | 1.00 | 54.61 | O |
| HETATM | 6626 | O | HOH | S | 75 | 18.426 | 17.669 | 18.417 | 1.00 | 47.89 | O |
| HETATM | 6627 | O | HOH | S | 76 | 25.878 | 60.419 | −23.776 | 1.00 | 67.90 | O |
| HETATM | 6628 | O | HOH | S | 77 | −3.001 | 16.853 | 13.349 | 1.00 | 40.26 | O |
| HETATM | 6629 | O | HOH | S | 78 | 21.445 | 18.571 | 15.528 | 1.00 | 42.53 | O |
| HETATM | 6630 | O | HOH | S | 79 | 10.512 | 19.710 | 6.333 | 1.00 | 43.92 | O |
| HETATM | 6631 | O | HOH | S | 80 | 25.733 | −32.841 | 10.331 | 1.00 | 45.57 | O |
| HETATM | 6632 | O | HOH | S | 81 | 45.866 | −6.992 | 13.750 | 1.00 | 56.34 | O |
| HETATM | 6633 | O | HOH | S | 82 | −5.451 | 11.948 | 9.084 | 1.00 | 48.49 | O |
| HETATM | 6634 | O | HOH | S | 83 | −0.284 | 57.787 | −24.644 | 1.00 | 56.76 | O |
| HETATM | 6635 | O | HOH | S | 84 | 12.855 | 4.611 | 7.120 | 1.00 | 49.16 | O |
| HETATM | 6636 | O | HOH | S | 85 | 10.889 | 31.641 | 7.790 | 1.00 | 34.43 | O |
| HETATM | 6637 | O | HOH | S | 86 | −4.588 | 48.158 | 10.953 | 1.00 | 48.55 | O |
| HETATM | 6638 | O | HOH | S | 87 | 26.177 | 27.915 | 1.691 | 1.00 | 46.07 | O |
| HETATM | 6639 | O | HOH | S | 88 | 28.808 | 35.568 | −9.096 | 1.00 | 46.96 | O |
| HETATM | 6640 | O | HOH | S | 89 | 16.990 | 64.539 | −21.618 | 1.00 | 49.48 | O |
| HETATM | 6641 | O | HOH | S | 90 | 5.116 | 44.340 | 9.039 | 1.00 | 53.74 | O |
| HETATM | 6642 | O | HOH | S | 91 | −7.162 | 53.775 | 0.098 | 1.00 | 37.68 | O |
| HETATM | 6643 | O | HOH | S | 92 | 24.710 | 58.543 | −23.843 | 1.00 | 53.74 | O |
| HETATM | 6644 | O | HOH | S | 93 | 15.845 | −19.282 | 11.162 | 1.00 | 49.40 | O |
| HETATM | 6645 | O | HOH | S | 94 | 25.896 | 58.957 | −7.601 | 1.00 | 53.33 | O |
| HETATM | 6646 | O | HOH | S | 95 | 0.381 | −7.155 | 11.796 | 1.00 | 50.79 | O |
| HETATM | 6647 | O | HOH | S | 96 | 9.055 | 30.004 | −9.399 | 1.00 | 55.75 | O |
| HETATM | 6648 | O | HOH | S | 98 | 16.824 | −21.127 | 29.732 | 1.00 | 49.96 | O |
| HETATM | 6649 | O | HOH | S | 99 | −6.476 | 10.007 | 19.929 | 1.00 | 64.81 | O |
| HETATM | 6650 | O | HOH | S | 100 | 9.737 | 22.165 | −2.599 | 1.00 | 45.49 | O |
| HETATM | 6651 | O | HOH | S | 101 | 1.288 | 67.948 | 3.070 | 1.00 | 60.46 | O |
| HETATM | 6652 | O | HOH | S | 102 | 10.027 | 43.100 | −15.743 | 1.00 | 54.06 | O |
| HETATM | 6653 | O | HOH | S | 103 | −2.215 | 57.275 | −6.635 | 1.00 | 37.98 | O |
| HETATM | 6654 | O | HOH | S | 104 | 3.032 | 68.445 | 4.221 | 1.00 | 70.99 | O |
| HETATM | 6655 | O | HOH | S | 105 | 4.206 | 23.632 | −0.988 | 1.00 | 57.14 | O |
| HETATM | 6656 | O | HOH | S | 106 | 8.780 | 56.975 | −38.135 | 1.00 | 69.27 | O |
| HETATM | 6657 | O | HOH | S | 107 | −6.479 | 9.191 | 17.532 | 1.00 | 57.31 | O |
| HETATM | 6658 | O | HOH | S | 108 | 20.784 | 50.506 | 13.167 | 1.00 | 52.67 | O |
| HETATM | 6659 | O | HOH | S | 109 | 32.343 | 71.209 | −9.175 | 1.00 | 54.55 | O |
| HETATM | 6660 | O | HOH | S | 110 | 14.503 | 62.254 | −7.414 | 1.00 | 49.91 | O |
| HETATM | 6661 | O | HOH | S | 111 | 18.242 | 59.152 | −10.346 | 1.00 | 50.55 | O |
| HETATM | 6662 | O | HOH | S | 112 | 21.463 | 55.685 | −41.322 | 1.00 | 49.70 | O |
| HETATM | 6663 | O | HOH | S | 113 | 29.261 | −10.909 | 11.966 | 1.00 | 51.78 | O |
| HETATM | 6664 | O | HOH | S | 114 | −2.932 | 14.521 | 4.219 | 1.00 | 51.12 | O |
| HETATM | 6665 | O | HOH | S | 115 | 6.575 | 12.310 | −1.652 | 1.00 | 51.43 | O |
| HETATM | 6666 | O | HOH | S | 116 | 12.617 | 11.668 | 2.567 | 1.00 | 42.03 | O |
| HETATM | 6667 | O | HOH | S | 117 | 21.222 | −14.691 | 20.991 | 1.00 | 46.40 | O |
| HETATM | 6668 | O | HOH | S | 118 | 13.530 | 47.255 | −12.286 | 1.00 | 46.79 | O |
| HETATM | 6669 | O | HOH | S | 119 | 20.063 | 16.370 | 17.220 | 1.00 | 47.88 | O |
| HETATM | 6670 | O | HOH | S | 120 | −2.784 | 59.346 | −5.132 | 1.00 | 44.89 | O |
| HETATM | 6671 | O | HOH | S | 121 | 27.506 | −16.495 | 12.474 | 1.00 | 44.98 | O |
| HETATM | 6672 | O | HOH | S | 122 | 19.857 | 43.356 | −11.838 | 1.00 | 45.46 | O |
| HETATM | 6673 | O | HOH | S | 123 | −0.724 | −12.138 | 18.853 | 1.00 | 50.10 | O |
| HETATM | 6674 | O | HOH | S | 124 | 17.097 | 7.056 | 2.262 | 1.00 | 53.05 | O |
| HETATM | 6675 | O | HOH | S | 125 | 12.507 | 15.910 | −4.577 | 1.00 | 49.09 | O |
| HETATM | 6676 | O | HOH | S | 126 | 6.530 | 29.587 | 22.106 | 1.00 | 51.52 | O |
| HETATM | 6677 | O | HOH | S | 127 | 28.561 | 3.038 | 16.627 | 1.00 | 65.73 | O |
| HETATM | 6678 | O | HOH | S | 128 | −8.780 | 53.273 | 11.099 | 1.00 | 44.53 | O |
| HETATM | 6679 | O | HOH | S | 130 | 11.201 | 38.499 | 13.598 | 1.00 | 45.16 | O |
| HETATM | 6680 | O | HOH | S | 131 | 22.576 | −31.825 | 9.895 | 1.00 | 34.31 | O |
| HETATM | 6681 | O | HOH | S | 132 | 38.057 | 72.265 | −20.165 | 1.00 | 48.40 | O |
| HETATM | 6682 | O | HOH | S | 133 | 41.172 | 73.399 | −13.902 | 1.00 | 39.97 | O |
| HETATM | 6683 | O | HOH | S | 134 | −2.896 | 23.615 | 12.400 | 1.00 | 41.97 | O |
| HETATM | 6684 | O | HOH | S | 135 | −15.703 | 47.887 | −7.009 | 1.00 | 45.05 | O |
| HETATM | 6685 | O | HOH | S | 136 | 8.259 | 31.867 | 10.235 | 1.00 | 40.24 | O |
| HETATM | 6686 | O | HOH | S | 137 | 20.793 | −23.236 | 13.626 | 1.00 | 40.59 | O |
| HETATM | 6687 | O | HOH | S | 138 | 17.802 | 64.303 | −24.124 | 1.00 | 52.34 | O |
| HETATM | 6688 | O | HOH | S | 139 | 12.067 | 51.900 | −11.418 | 1.00 | 43.45 | O |
| HETATM | 6689 | O | HOH | S | 140 | −13.592 | 53.043 | 3.934 | 1.00 | 55.57 | O |
| HETATM | 6690 | O | HOH | S | 141 | 33.762 | −27.052 | 25.515 | 1.00 | 59.31 | O |
| HETATM | 6691 | O | HOH | S | 143 | 36.630 | −12.778 | 11.164 | 1.00 | 50.22 | O |

TABLE 77-continued

| | | | | | | | | | | |
|---|---|---|---|---|---|---|---|---|---|---|
| HETATM | 6692 | O | HOH | S | 144 | 31.395 | 13.663 | 16.555 | 1.00 | 59.83 | O |
| HETATM | 6693 | O | HOH | S | 145 | 32.203 | −6.014 | 22.655 | 1.00 | 56.06 | O |
| HETATM | 6694 | O | HOH | S | 146 | −4.971 | 15.694 | 5.457 | 1.00 | 61.92 | O |
| HETATM | 6695 | O | HOH | S | 147 | 26.506 | 39.971 | 10.813 | 1.00 | 58.21 | O |
| HETATM | 6696 | O | HOH | S | 148 | 42.441 | −4.472 | 23.241 | 1.00 | 71.60 | O |
| HETATM | 6697 | O | HOH | S | 149 | 42.052 | 56.468 | −13.626 | 1.00 | 51.59 | O |
| HETATM | 6698 | O | HOH | S | 150 | 23.497 | −23.512 | 13.229 | 1.00 | 45.34 | O |
| HETATM | 6699 | O | HOH | S | 151 | 12.814 | 46.836 | −26.941 | 1.00 | 58.92 | O |
| HETATM | 6700 | O | HOH | S | 152 | 16.799 | −19.293 | 18.797 | 1.00 | 48.48 | O |
| HETATM | 6701 | O | HOH | S | 153 | 15.268 | 18.413 | 21.516 | 1.00 | 46.91 | O |
| HETATM | 6702 | O | HOH | S | 154 | 8.353 | 0.039 | 8.439 | 1.00 | 51.78 | O |
| HETATM | 6703 | O | HOH | S | 155 | 43.401 | 61.614 | −16.036 | 1.00 | 50.63 | O |
| HETATM | 6704 | O | HOH | S | 156 | 8.049 | −3.965 | 18.502 | 1.00 | 44.24 | O |
| HETATM | 6705 | O | HOH | S | 157 | 27.444 | 37.320 | −10.278 | 1.00 | 48.63 | O |
| HETATM | 6706 | O | HOH | S | 158 | 23.865 | 46.222 | −34.449 | 1.00 | 67.20 | O |
| HETATM | 6707 | O | HOH | S | 159 | −15.629 | 47.083 | −8.983 | 1.00 | 55.60 | O |
| HETATM | 6708 | O | HOH | S | 160 | 24.549 | −18.175 | 14.896 | 1.00 | 45.29 | O |
| HETATM | 6709 | O | HOH | S | 161 | 40.278 | 78.213 | −23.861 | 1.00 | 54.45 | O |
| HETATM | 6710 | O | HOH | S | 162 | −1.520 | 46.952 | −15.022 | 1.00 | 64.05 | O |
| HETATM | 6711 | O | HOH | S | 163 | 42.704 | −13.506 | 7.183 | 1.00 | 70.24 | O |
| HETATM | 6712 | O | HOH | S | 164 | 37.242 | 57.040 | −18.847 | 1.00 | 48.54 | O |
| HETATM | 6713 | O | HOH | S | 165 | 8.041 | 37.554 | 14.382 | 1.00 | 43.94 | O |
| HETATM | 6714 | O | HOH | S | 166 | 10.610 | 20.291 | 28.530 | 1.00 | 50.52 | O |
| HETATM | 6715 | O | HOH | S | 167 | 37.824 | −11.301 | 8.593 | 1.00 | 62.29 | O |
| HETATM | 6716 | O | HOH | S | 168 | 31.106 | 27.040 | 8.339 | 1.00 | 50.59 | O |
| HETATM | 6717 | O | HOH | S | 169 | 4.819 | 15.668 | 24.108 | 1.00 | 46.45 | O |
| HETATM | 6718 | O | HOH | S | 170 | 44.284 | 75.888 | −19.285 | 1.00 | 58.08 | O |
| HETATM | 6719 | O | HOH | S | 171 | 30.593 | −4.289 | 21.707 | 1.00 | 54.79 | O |
| HETATM | 6720 | O | HOH | S | 172 | 36.819 | 56.995 | −21.355 | 1.00 | 55.24 | O |
| HETATM | 6721 | O | HOH | S | 173 | 9.400 | 61.695 | −32.317 | 1.00 | 57.05 | O |
| HETATM | 6722 | O | HOH | S | 174 | 25.940 | 53.820 | −19.776 | 1.00 | 47.92 | O |
| HETATM | 6723 | O | HOH | S | 175 | 32.801 | 13.061 | −6.239 | 1.00 | 63.70 | O |
| HETATM | 6724 | O | HOH | S | 176 | 27.842 | 53.908 | 11.475 | 1.00 | 69.48 | O |
| HETATM | 6725 | O | HOH | S | 177 | 13.707 | −20.073 | 8.987 | 1.00 | 60.94 | O |
| HETATM | 6726 | O | HOH | S | 178 | 20.250 | −20.697 | 27.927 | 1.00 | 49.37 | O |
| HETATM | 6727 | O | HOH | S | 180 | 25.696 | 34.620 | 8.264 | 1.00 | 49.72 | O |
| HETATM | 6728 | O | HOH | S | 181 | 26.443 | 15.386 | 20.830 | 1.00 | 65.13 | O |
| HETATM | 6729 | O | HOH | S | 182 | 20.047 | 46.503 | −11.238 | 1.00 | 45.41 | O |
| HETATM | 6730 | O | HOH | S | 183 | 37.387 | 18.347 | 7.129 | 1.00 | 54.67 | O |
| HETATM | 6731 | O | HOH | S | 184 | 15.819 | 62.871 | −31.509 | 1.00 | 57.50 | O |
| HETATM | 6732 | O | HOH | S | 185 | 8.894 | −18.382 | 26.300 | 1.00 | 57.79 | O |
| HETATM | 6733 | O | HOH | S | 186 | 3.823 | 33.211 | 12.700 | 1.00 | 51.58 | O |
| HETATM | 6734 | O | HOH | S | 187 | 15.995 | 16.905 | 24.174 | 1.00 | 62.74 | O |
| HETATM | 6735 | O | HOH | S | 189 | −0.962 | 46.018 | 19.638 | 1.00 | 53.06 | O |
| HETATM | 6736 | O | HOH | S | 191 | −4.294 | 54.582 | −9.135 | 1.00 | 50.91 | O |
| HETATM | 6737 | O | HOH | S | 193 | 41.188 | −14.509 | 6.028 | 1.00 | 75.54 | O |
| HETATM | 6738 | O | HOH | S | 194 | 5.870 | 15.948 | −1.684 | 1.00 | 51.20 | O |
| HETATM | 6739 | O | HOH | S | 196 | 9.691 | 32.405 | −9.362 | 1.00 | 46.38 | O |
| HETATM | 6740 | O | HOH | S | 197 | 26.655 | 53.466 | −4.907 | 1.00 | 48.32 | O |
| HETATM | 6741 | O | HOH | S | 198 | −10.259 | 59.985 | 13.197 | 1.00 | 65.42 | O |
| HETATM | 6742 | O | HOH | S | 200 | 6.314 | −15.009 | 26.708 | 1.00 | 52.26 | O |
| HETATM | 6743 | O | HOH | S | 201 | 35.430 | 64.453 | −8.173 | 1.00 | 48.73 | O |
| HETATM | 6744 | O | HOH | S | 202 | 9.166 | 57.684 | 7.717 | 1.00 | 43.39 | O |
| HETATM | 6745 | O | HOH | S | 203 | 9.141 | 61.495 | 11.078 | 1.00 | 59.94 | O |
| HETATM | 6746 | O | HOH | S | 204 | 2.404 | 71.341 | −17.891 | 1.00 | 59.43 | O |
| HETATM | 6747 | O | HOH | S | 205 | 8.680 | −1.395 | 40.812 | 1.00 | 56.69 | O |
| HETATM | 6748 | O | HOH | S | 206 | 31.489 | 15.547 | 17.662 | 1.00 | 68.55 | O |
| HETATM | 6749 | O | HOH | S | 207 | 8.986 | −30.458 | 24.198 | 1.00 | 60.07 | O |
| HETATM | 6750 | O | HOH | S | 208 | −10.524 | 62.479 | 1.179 | 1.00 | 49.73 | O |
| HETATM | 6751 | O | HOH | S | 209 | −6.503 | 64.041 | 2.716 | 1.00 | 52.15 | O |
| HETATM | 6752 | O | HOH | S | 210 | 48.975 | 58.824 | −7.084 | 1.00 | 57.00 | O |
| HETATM | 6753 | O | HOH | S | 211 | −2.368 | 44.869 | −2.998 | 1.00 | 45.02 | O |
| HETATM | 6754 | O | HOH | S | 212 | 22.552 | −7.742 | 15.352 | 1.00 | 57.56 | O |
| HETATM | 6755 | O | HOH | S | 213 | 2.175 | 37.701 | 9.974 | 1.00 | 40.91 | O |
| HETATM | 6756 | O | HOH | S | 214 | 34.611 | −5.227 | 11.029 | 1.00 | 52.04 | O |
| HETATM | 6757 | O | HOH | S | 215 | 48.883 | 60.347 | −8.992 | 1.00 | 55.33 | O |
| HETATM | 6758 | O | HOH | S | 216 | 28.211 | 43.841 | 14.193 | 1.00 | 55.54 | O |
| HETATM | 6759 | O | HOH | S | 217 | 17.596 | 56.594 | −4.534 | 1.00 | 63.23 | O |
| HETATM | 6760 | O | HOH | S | 218 | 2.441 | 69.769 | −3.436 | 1.00 | 65.62 | O |
| HETATM | 6761 | O | HOH | S | 219 | 27.982 | 8.916 | −4.372 | 1.00 | 49.49 | O |
| HETATM | 6762 | O | HOH | S | 220 | 18.629 | −2.214 | 28.470 | 1.00 | 58.40 | O |
| HETATM | 6763 | O | HOH | S | 221 | 17.690 | −14.760 | 21.800 | 1.00 | 54.42 | O |
| HETATM | 6764 | O | HOH | S | 222 | 39.619 | 69.020 | −27.372 | 1.00 | 49.15 | O |
| HETATM | 6765 | O | HOH | S | 223 | 36.110 | 64.036 | −24.191 | 1.00 | 57.04 | O |
| HETATM | 6766 | O | HOH | S | 224 | 27.169 | 37.141 | −13.081 | 1.00 | 58.62 | O |
| HETATM | 6767 | O | HOH | S | 225 | 43.630 | 73.737 | −14.861 | 1.00 | 47.78 | O |
| HETATM | 6768 | O | HOH | S | 226 | 11.657 | −0.125 | 36.905 | 1.00 | 69.93 | O |
| HETATM | 6769 | O | HOH | S | 227 | 4.636 | 18.163 | −1.622 | 1.00 | 61.66 | O |
| HETATM | 6770 | O | HOH | S | 228 | 17.543 | 53.256 | 11.496 | 1.00 | 58.07 | O |
| HETATM | 6771 | O | HOH | S | 229 | 37.819 | −11.460 | 24.189 | 1.00 | 58.09 | O |

TABLE 77-continued

| HETATM | 6772 | O | HOH | S | 230 | −6.544 | 63.021 | 0.374 | 1.00 | 57.84 | O |
|---|---|---|---|---|---|---|---|---|---|---|---|
| HETATM | 6773 | O | HOH | S | 231 | 38.842 | −19.566 | 12.774 | 1.00 | 57.81 | O |
| HETATM | 6774 | O | HOH | S | 232 | 9.218 | −0.391 | 38.853 | 1.00 | 65.47 | O |
| TER | | | | | | | | | | | |
| END | | | | | | | | | | | |

TABLE 78 scFv Full Sequences

| Ab | Type | SCFV |
|---|---|---|
| I2E | NA | No nuc. seq available |
| | AA | EVQLVESGGGLVQPGGSLKLSCAASGFTENKYAINW VRQAPGKGLEWVARIRSKYNNYATYYADAVKDRFTI SRDDSKNTVYLQMNNLKTEDTAVYYCARAGNFGSSY ISYWAYWGQGTLVTVSSGGGGSGGGGSGGGGSQTVV TQEPSLTVSPGGTVTITCGSSTGAVTSGNYPNWVQK KPGQAPRGLIGGTKFLAPGTPARFSGSLSGGKAALT LSGVQPEDEAEYYCVLWYSNRWVFGSGTKLTVL (SEQ ID NO: 17223) |

TABLE 79 scFv VL CDRs

| Ab | Type | CDR1 | CDR2 | CDR3 |
|---|---|---|---|---|
| I2E | NA | No nuc. seq available | No nuc. seq available | No nuc. seq available |
| | AA | GSSTGAVTSGNYPN (SEQ ID NO: 17224) | GTKFLAP (SEQ ID NO: 17226) | VLWYSNRWV (SEQ ID NO: 17228) |
| I2E | NA | No nuc. seq available | No nuc. seq available | No nuc. seq available |
| | AA | KYAIN (SEQ ID NO: 17225) | RIRSKYNNYATYYADAVKD (SEQ ID NO: 17227) | AGNFGSSYISYWAY (SEQ ID NO: 17229) |

TABLE 80 scFv Variable Region Sequences

| Ab | Type | LC V-region | HC V-region |
|---|---|---|---|
| I2E | NA | No nuc. seq available | No nuc. seq available |
| | AA | QTVVTQEPSLTVSPGGTVTITCGSSTGA VTSGNYPNWVQKKPGQAPRGLIGGTKFL APGTPARFSGSLSGGKAALTLSGVQPED EAEYYCVLWYSNRWVFGSGTKLTVL (SEQ ID NO: 17230) | EVQLVESGGGLVQPGGSLKLSCAASGFT FNKYAINWVRQAPGKGLEWVARIRSKYN NYATYYADAVKDRFTISRDDSKNTVYLQ MNNLKTEDTAVYYCARAGNFGSSYISYW AYWGQGTLVTVSS (SEQ ID NO: 17231) |

TABLE 81 scFv Variable Region Protein Alignment
CDRs defined by Kabat
Alignment numbering defined by Amgen Reference (AHo)

LAMBDA_VARIABLE

| | Germline | | SEQ ID NO: |
|---|---|---|---|
| | | L_FR1 | |
| VL7\|7a/JL3b | | QTVVTQE-PSLTVSPGGTVTLTC | 17232 |
| I2E | VL7\|7a/JL3b | QTVVTQE-PSLTVSPGGTVTITC | 17233 |
| | | L_CDR1 | |
| VL7\|7a/JL3b | | ASST-GAVTSG----YYPN | 17236 |
| I2E | VL7\|7a/JL3b | GSST-GAVTSG----NYPN | 17237 |

TABLE 81-continued scFv Variable Region Protein Alignment
CDRs defined by Kabat
Alignment numbering defined by Amgen Reference (AHo)

L_FR2

| | | | |
|---|---|---|---|
| VL7\|7a/JL3b | | WFQQKPGQAPRALIY | 17240 |
| I2E | VL7\|7a/JL3b | WVQKKPGQAPRGLIG | 17241 |

HEAVY_VARIABLE

| Germline | | | SEQ ID NO: |
|---|---|---|---|

H_FR1

| | | | |
|---|---|---|---|
| VH3\|3-73/D2\|2-21\|RF2/JH4 | | EVQLVES-GGGLVQPGGSLKLSCAASG-FTFS | 17234 |
| I2E | VH3\|3-73/D2\|2-21\|RF2/JH4 | EVQLVES-GGGLVQPGGSLKLSCAASG-FTFN | 17235 |

H_CDR1

| | | | |
|---|---|---|---|
| VH3\|3-73/D2\|2-21\|RF2/JH4 | | G-----SAMH | 17238 |
| I2E | VH3\|3-73/D2\|2-21\|RF2/JH4 | K-----YAIN | 17239 |

H_FR2

| | | | |
|---|---|---|---|
| VH3\|3-73/D2\|2-21\|RF2/JH4 | | WVRQASGKGLEWVG | 17242 |
| I2E | VH3\|3-73/D2\|2-21\|RF2/JH4 | WVRQAPGKGLEWVA | 17243 |

LAMBDA_VARIABLE

| Germline | | | SEQ ID NO: |
|---|---|---|---|

L_CDR2

| | | | |
|---|---|---|---|
| VL7\|7a/JL3b | | S--------TSNKHS | 17244 |
| I2E | VL7\|7a/JL3b | G--------TKFLAP | 17245 |

L_FR3

| | | | |
|---|---|---|---|
| VL7\|7a/JL3b | | SGSLLG--GKAALTLSGVQPED | 17248 |
| I2E | VL7\|7a/JL3b | SGSLSG--GKAALTLSGVQPED | 17249 |

HEAVY_VARIABLE

| Germline | | | SEQ ID NO: |
|---|---|---|---|

H_CDR2

| | | | |
|---|---|---|---|
| VH3\|3-73/D2\|2-21\|RF2/JH4 | | RIRSKA-NSYATAYAASVKG | 17246 |
| I2E | VH3\|3-73/D2\|2-21\|RF2/JH4 | RIRSKY-NNYATYYADAVKD | 17247 |

H_FR3

| | | | |
|---|---|---|---|
| VH3\|3-73/D2\|2-21\|RF2/JH4 | | RDDSKNTAYLQMNSLKTEDTAV | 17250 |
| I2E | VH3\|3-73/D2\|2-21\|RF2/JH4 | RDDSKNTVYLQMNNLKTEDTAV | 17251 |

LAMBDA_VARIABLE

| Germline | | | SEQ ID NO: |
|---|---|---|---|

L_CDR3

| | | | |
|---|---|---|---|
| VL7\|7a/JL3b | | LLYYG---------------------GAQWV | 17252 |
| I2E | VL7\|7a/JL3b | VLWYS---------------------NRWV | 17253 |

TABLE 81-continued scFv Variable Region Protein Alignment
CDRs defined by Kabat
Alignment numbering defined by Amgen Reference (AHo)

| | | L_FR4 | |
|---|---|---|---|
| VL7\|7a/JL3b | | FGGGTKLTVL | 17256 |
| I2E | VL7\|7a/JL3b | FGSGTKLTVL | 17257 |

| HEAVY_VARIABLE | | | |
|---|---|---|---|
| Germline | | | |
| | | H_CDR3 | |
| VH3\|3-73/D2\|2-21\|RF2/JH4 | | AYCGGDC----------------YSYFDY | 17254 |
| I2E | VH3\|3-73/D2\|2-21\|RF2/JH4 | AGNFGSS----------------YISYWAY | 17255 |
| | | H_FR4 | |
| VH3\|3-73/D2\|2-21\|RF2/JH4 | | WGQGTLVTVSS | 17258 |
| I2E | VH3\|3-73/D2\|2-21\|RF2/JH4 | WGQGTLVTVSS | 17259 |

TABLE 82 scFv Variable Region Consensus Protein Alignment
CDRs defined by Kabat
Alignment numbering defined by Amgen Reference (AHo)

| LAMBDA_VARIABLE | | | |
|---|---|---|---|
| Germline | | | SEQ ID NO: |
| | | L_FR1 | |
| VL7\|7a/JL3b | | QTVVTQE-PSLTVSPGGTVTLTC | 17260 |
| I2E | VL7\|7a/JL3b | .....................I.. | 17261 |
| | | L_CDR1 | |
| VL7\|7a/JL3b | | ASST-GAVTSG----YYPN | 17264 |
| I2E | VL7\|7a/JL3b | G.............N... | 17265 |
| | | L_FR2 | |
| VL7\|7a/JL3b | | WFQQKPGQAPRALIY | 17268 |
| I2E | VL7\|7a/JL3b | .V.K.......G..G | 17269 |

| HEAVY_VARIABLE | | | |
|---|---|---|---|
| Germline | | | |
| | | H_FR1 | |
| VH3\|3-73/D2\|2-21\|RF2/JH4 | | EVQLVES-GGGLVQPGGSLKLSCAASG-FTFS | 17262 |
| I2E | VH3 VH3\|3-73/D2\|2-21\|RF2/JH4 | ..............................N | 17263 |
| | | H_CDR1 | |
| VH3\|3-73/D2\|2-21\|RF2/JH4 | | G-----SAMH | 17266 |
| I2E | VH3 VH3\|3-73/D2\|2-21\|RF2/JH4 | K.....Y.IN | 17267 |

TABLE 82-continued scFv Variable Region Consensus Protein Alignment
CDRs defined by Kabat
Alignment numbering defined by Amgen Reference (AHo)

| | | H_FR2 | |
|---|---|---|---|
| VH3\|3-73/D2\|2-21\|RF2/JH4 | | WVRQASGKGLEWVG | 17270 |
| I2E | VH3 VH3\|3-73/D2\|2-21\|RF2/JH4 | .....P.......A | 17271 |

LAMBDA_VARIABLE

| | Germline | | SEQ ID NO: |
|---|---|---|---|
| | | L_CDR2 | |
| VL7\|7a/JL3b | | S--------TSNKHS | 17272 |
| I2E | VL7\|7a/JL3b | G.........KFLAP | 17273 |
| | | L_FR3 | |
| VL7\|7a/JL3b | | SGSLLG--GKAALTLSGVQPEI | 17276 |
| I2E | VL7\|7a/JL3b | ....S................. | 17277 |

HEAVY_VARIABLE

| | Germline | | SEQ ID NO: |
|---|---|---|---|
| | | H_CDR2 | |
| VH3\|3-73/D2\|2-21\|RF2/JH4 | | RIRSKA-NSYATAYAASVKG | 17274 |
| I2E | VH3\|3-73/D2\|2-21\|RF2/JH4 | .....Y..N...Y..DA..D | 17275 |
| | | H_FR3 | |
| VH3\|3-73/D2\|2-21\|RF2/JH4 | | RDDSKNTAYLQMNSLKTEDTAY | 17278 |
| I2E | VH3\|3-73/D2\|2-21\|RF2/JH4 | .......V.....N........ | 17279 |

LAMBDA_VARIABLE

| | Germline | | SEQ ID NO: |
|---|---|---|---|
| | | L_CDR3 | |
| VL7\|7a/JL3b | | LLYYG---------------------GAQWV | 17280 |
| I2E | VL7\|7a/JL3b | V.W.S.....................-NR.. | 17281 |
| | | L_FR4 | |
| VL7\|7a/JL3b | | FGGGTKLTVL | 17284 |
| I2E | VL7\|7a/JL3b | ..S....... | 17285 |

TABLE 82-continued scFv Variable Region Consensus Protein Alignment
CDRs defined by Kabat
Alignment numbering defined by Amgen Reference (AHo)

HEAVY_VARIABLE

|  | Germline |  | SEQ ID NO: |
|---|---|---|---|
|  |  | H_CDR3 |  |
| VH3\|3-73\|D2\|2-21\|RF2/JH4 |  | AYCGGDC----------------YSYFDY | 17282 |
| I2E | VH3\|3-73\|D2\|2-21\|RF2/JH4 | .GNF.SS.............YI...WA. | 17283 |
|  |  | H_FR4 |  |
| VH3\|3-73\|D2\|2-21\|RF2/JH4 |  | WGQGTLVTVSS | 17286 |
| I2E | VH3\|3-73\|D2\|2-21\|RF2/JH4 | .......... | 17287 |

TABLE 83 scFv_scFc_Full Sequences

| Ab | Type | SCFV SCFC |
|---|---|---|
| I2E_x_scFc_variant_ | NA | No nuc. seq available |
|  | AA | EVQLVESGGGLVQPGGSLKLSCAASGFTENKYAINWVRQAPGKGLEWVARIRSK YNNYATYYADAVKDRFTISRDDSKNTVYLQMNNLKTEDTAVYYCARAGNFGSSY ISYWAYWGQGTLVTVSSGGGGSGGGGSGGGGSQTVVTQEPSLTVSPGGTVTITC GSSTGAVTSGNYPNWVQKKPGQAPRGLIGGTKFLAPGTPARFSGSLSGGKAALT LSGVQPEDEAEYYCVLWYSNRWVFGSGTKLTVLGGGGDKTHTCPPCPAPELLGG PSVFLFPPKPKDTLYITREPEVTCVVVDVSHEDPEVKFNWYVDGVEVHNAKTKP CEEQYGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGKGGGGSG GGGSGGGGSGGGGSGGGGSGGGGSDKTHTCPPCPAPELLGGPSVELFPPKPKDT LYITREPEVTCVVVDVSHEDPEVKFNWYVDGVEVHNAKTKPCEEQYGSTYRCVS VLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTV DKSRWQQGNVFSCSVMHEALHNHYTQKSLSLSPGK (SEQ ID NO: 17288 |
| I2E_x_scFc_ | NA | No nuc. seq available |
|  | AA | EVQLVESGGGLVQPGGSLKLSCAASGFTENKYAINWVRQAPGKGLEWVARIRSK YNNYATYYADAVKDRFTISRDDSKNTVYLQMNNLKTEDTAVYYCARAGNFGSSY ISYWAYWGQGTLVTVSSGGGGSGGGGSGGGGSQTVVTQEPSLTVSPGGTVTITC GSSTGAVTSGNYPNWVQKKPGQAPRGLIGGTKFLAPGTPARFSGSLSGGKAALT LSGVQPEDEAEYYCVLWYSNRWVFGSGTKLTVLGGGGDKTHTCPPCPAPELLGG PSVFLFPPKPKDTLMISRTPEVTCVVVDVSHEDPEVKFNWYVDGVEVHNAKTKP CEEQYGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGKGGGGSG GGGSGGGGSGGGGGGGSGGGGSDKTHTCPPCPAPELLGGPSVFLFPPKPKDT LMISRTPEVTCVVVDVSHEDPEVKFNWYVDGVEVHNAKTKPCEEQYGSTYRCVS VLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTV DKSRWQQGNVFSCSVMHEALHNHYTQKSLSLSPGK (SEQ ID NO: 17289 |

TABLE 84 scFv_scFc_VL CDRs

| Ab | Type | CDR1 | CDR2 | CDR3 |
|---|---|---|---|---|
| I2E_x_scFc_variant_ | NA | No nuc. seq available | No nuc. seq available | No nuc. seq available |
|  | AA | GSSTGAVTSGNYPN (SEQ ID NO: 17290) | GTKFLAP (SEQ ID NO: 17294) | VLWYSNRWV (SEQ ID NO: 17298) |

TABLE 84-continued scFv_scFc_VL CDRs

| Ab | Type | CDR1 | CDR2 | CDR3 |
|---|---|---|---|---|
| I2E_x_scFc_ | NA | No nuc. seq available | No nuc. seq available | No nuc. seq available |
| | AA | GSSTGAVTSGNYPN (SEQ ID NO: 17291) | GTKFLAP (SEQ ID NO: 17295) | VLWY SNRWV (SEQ ID NO: 17299) |
| I2E_x_scFc_variant_ | NA | No nuc. seq available | No nuc. seq available | No nuc. seq available |
| | AA | KYAIN (SEQ ID NO: 17292) | RIRSKYNNYATYYADAVKD (SEQ ID NO: 17296) | AGNFGSSYISYWAY (SEQ ID NO: 17300) |
| I2E_x_scFc_ | NA | No nuc. seq available | No nuc. seq available | No nuc. seq available |
| | AA | KYAIN (SEQ ID NO: 17293) | RIRSKYNNYATYYADAVKD (SEQ ID NO: 17297) | AGNFGSSYISYWAY (SEQ ID NO: 17301) |

TABLE 85 scFv_scFc_Variable Region Sequences

| Ab | Type | LC V-region | HC V-region |
|---|---|---|---|
| I2E_x_scFc_variant_ | NA | No nuc. seq available | No nuc. seq available |
| | AA | QTVVTQEPSLTVSPGGTVTITCGSSTGAVTSG NYPNWVQKKPGQAPRGLIGGTKFLAPGTPARF SGSLSGGKAALTLSGVQPEDEAEYYCVLWYSN RWVFGSGTKLTVL (SEQ ID NO: 17302) | EVQLVESGGGLVQPGGSLKLSCAASGFTENKYAINW VRQAPGKGLEWVARIRSKYNNYATYYADAVKDRFTI SRDDSKNTVYLQMNNLKTEDTAVYYCARAGNEGSSY ISYWAYWGQGTLVTVSS (SEQ ID NO: 17304) |
| I2E_x_scFc_ | NA | No nuc. seq available | No nuc. seq available |
| | AA | QTVVTQEPSLTVSPGGTVTITCGSSTGAVTSG NYPNWVQKKPGQAPRGLIGGTKFLAPGTPARF SGSLSGGKAALTLSGVQPEDEAEYYCVLWYSN RWVFGSGTKLTVL (SEQ ID NO: 17303) | EVQLVESGGGLVQPGGSLKLSCAASGFTENKYAINW VRQAPGKGLEWVARIRSKYNNYATYYADAVKDRETI SRDDSKNTVYLQMNNLKTEDTAVYYCARAGNFGSSY ISYWAYWGQGTLVTVSS (SEQ ID NO: 17305) |

TABLE 86 scFv_scFc_Variable Region Protein Alignment
CDRs defined by Kabat
Alignment numbering defined by Amgen Reference (AHo)

LAMBDA_VARIABLE

| | Germline | L_FR1 | SEQ ID NO: |
|---|---|---|---|
| VL7\|7a/JL3b | | QTVVTQE-PSLTVSPGGTVTLTC | 17306 |
| I2E_x_scFc_variant_ | VL7\|7a/JL3b | QTVVTQE-PSLTVSPGGTVTITC | 17307 |
| I2E_x_scFc_ | VL7\|7a/JL3b | QTVVTQE-PSLTVSPGGTVTITC | 17308 |
| | | L_CDR1 | |
| VL7\|7a/JL3b | | ASST-GAVTSG----YYPN | 17312 |
| I2E_x_scFc_variant_ | VL7\|7a/JL3b | GSST-GAVTSG----NYPN | 17313 |
| I2E_x_scFc_ | VL7\|7a/JL3b | GSST-GAVTSG----NYPN | 17314 |
| | | L_FR2 | |
| VL7\|7a/JL3b | | WFQQKPGQAPRALIY | 17318 |
| I2E_x_scFc_variant_ | VL7\|7a/JL3b | WVQKKPGQAPRGLIG | 17319 |
| I2E_x_scFc_ | VL7\|7a/JL3b | WVQKKPGQAPRGLIG | 17320 |

TABLE 86-continued scFv scFc_Variable Region Protein Alignment
CDRs defined by Kabat
Alignment numbering defined by Amgen Reference (AHo)

HEAVY_VARIABLE

| | Germline | H_FR1 | SEQ ID NO: |
|---|---|---|---|
| VH3\|3-73/D2\|2-21\|RF2/JH4 | | EVQLVES-GGGLVQPGGSLKLSCAASG-FTFS | 17309 |
| I2E_x_scFc_variant_ | VH3\|3-73/D2\|2-21\|RF2/JH4 | EVQLVES-GGGLVQPGGSLKLSCAASG-FTEN | 17310 |
| I2E_x_scFc_ | VH3\|3-73/D2\|2-21\|RF2/JH4 | EVQLVES-GGGLVQPGGSLKLSCAASG-FTEN | 17311 |
| | | H_CDR1 | |
| VH3\|3-73/D2\|2-21\|RF2/JH4 | | G-----SAMH | 17315 |
| I2E_x_scFc_variant_ | VH3\|3-73/D2\|2-21\|RF2/JH4 | K-----YAIN | 17316 |
| I2E_x_scFc_ | VH3\|3-73/D2\|2-21\|RF2/JH4 | K-----YAIN | 17317 |
| | | H_FR2 | |
| VH3\|3-73/D2\|2-21\|RF2/JH4 | | WVRQASGKGLEWVG | 17321 |
| I2E_x_scFc_variant_ | VH3\|3-73/D2\|2-21\|RF2/JH4 | WVRQAPGKGLEWVA | 17322 |
| I2E_x_scFc_ | VH3\|3-73/D2\|2-21\|RF2/JH4 | WVRQAPGKGLEWVA | 17323 |

LAMBDA_VARIABLE

| | Germline | L_CDR2 | SEQ ID NO: |
|---|---|---|---|
| VL7\|7a/JL3b | | S--------TSNKHS | 17324 |
| I2E_x_scFc_variant_ | VL7\|7a/JL3b | G--------TKFLAP | 17325 |
| I2E_x_scFc_ | VL7\|7a/JL3b | G--------TKFLAP | 17326 |
| | | L_FR3 | ID NO: |
| VL7\|7a/JL3b | | FSGSLLG--GKAALTLSGVQPED | 17330 |
| I2E_x_scFc_variant_ | VL7\|7a/JL3b | FSGSLSG--GKAALTLSGVQPED | 17331 |
| I2E_x_scFc_ | VL7\|7a/JL3b | FSGSLSG--GKAALTLSGVQPED | 17332 |

HEAVY_VARIABLE

| | Germline | H_CDR2 | SEQ ID NO: |
|---|---|---|---|
| VH3\|3-73/D2\|2-21\|RF2/JH4 | | RIRSKA-NSYATAYAASVKG | 17327 |
| I2E_x_scFc_variant_ | VH3\|3-73/D2\|2-21\|RF2/JH4 | RIRSKY-NNYATYYADAVKD | 17328 |
| I2E_x_scFc_ | VH3\|3-73/D2\|2-21\|RF2/JH4 | RIRSKY-NNYATYYADAVKD | 17329 |
| | | H_FR3 | |
| VH3\|3-73/D2\|2-21\|RF2/JH4 | | SRDDSKNTAYLQMNSLKTEDTAV | 17333 |
| I2E_x_scFc_variant_ | VH3\|3-73/D2\|2-21\|RF2/JH4 | SRDDSKNTVYLQMNNLKTEDTAV | 17334 |
| I2E_x_scFc_ | VH3\|3-73/D2\|2-21\|RF2/JH4 | SRDDSKNTVYLQMNNLKTEDTAV | 17335 |

TABLE 86-continued scFv scFc_Variable Region Protein Alignment
CDRs defined by Kabat
Alignment numbering defined by Amgen Reference (AHo)

LAMBDA_VARIABLE

|  | Germline |  | SEQ ID NO: |
|---|---|---|---|
|  |  | L_CDR3 |  |
| VL7\|7a/JL3b |  | LLYYG--------------------GAQWV | 17336 |
| I2E_x_scFc_variant_ | VL7\|7a/JL3b | VLWYS--------------------NRWV | 17337 |
| I2E_x_scFc_ | VL7\|7a/JL3b | VLWYS--------------------NRWV | 17338 |
|  |  | L_FR4 |  |
| VL7\|7a/JL3b |  | FGGGTKLTVL | 17342 |
| I2E_x_scFc_variant_ | VL7\|7a/JL3b | FGSGTKLTVL | 17343 |
| I2E_x_scFc_ | VL7\|7a/JL3b | FGSGTKLTVL | 17344 |

HEAVY_VARIABLE

|  | Germline |  | SEQ ID NO: |
|---|---|---|---|
|  |  | H_CDR3 |  |
| VH3\|3-73/D2\|2-21\|RF2/JH4 |  | AYCGGDC----------------YSYFDY | 17339 |
| I2E_x_scFc_variant_ | VH3\|3-73/D2\|2-21\|RF2/JH4 | AGNFGSS----------------YISYWAY | 17340 |
| I2E_x_scFc_ | VH3\|3-73/D2\|2-21\|RF2/JH4 | AGNFGSS----------------YISYWAY | 17341 |
|  |  | H_FR4 |  |
| VH3\|3-73/D2\|2-21\|RF2/JH4 |  | WGQGTLVTVSS | 17345 |
| I2E_x_scFc_variant_ | VH3\|3-73/D2\|2-21\|RF2/JH4 | WGQGTLVTVSS | 17346 |
| I2E_x_scFc_ | VH3\|3-73/D2\|2-21\|RF2/JH4 | WGQGTLVTVSS | 17347 |

TABLE 87 scFv scFc_Variable Region Consensus Protein Alignment
CDRs defined by Kabat
Alignment numbering defined by Amgen Reference (AHo)

LAMBDA_VARIABLE

|  | Germline |  | SEQ ID NO: |
|---|---|---|---|
|  |  | L_FR1 |  |
| VL7\|7a/JL3b |  | QTVVTQE-PSLTVSPGGTVTLTC | 17348 |
| I2E_x_scFc_variant_ | VL7\|7a/JL3b | .....................I.. | 17349 |
| I2E_x_scFc_ | VL7\|7a/JL3b | .....................I.. | 17350 |
|  |  | L_CDR1 |  |
| VL7\|7a/JL3b |  | ASST-GAVTSG----YYPN | 17354 |
| I2E_x_scFc_variant_ | VL7\|7a/JL3b | G.............N... | 17355 |
| I2E_x_scFc_ | VL7\|7a/JL3b | G.............N... | 17356 |

TABLE 87-continued scFv scFc_Variable Region Consensus Protein Alignment
CDRs defined by Kabat
Alignment numbering defined by Amgen Reference (AHo)

L_FR2

| | | | |
|---|---|---|---|
| VL7\|7a/JL3b | | WFQQKPGQAPRALIY | 17360 |
| I2E_x_scFc_variant_ | VL7\|7a/JL3b | .V.K.......G...G | 17361 |
| I2E_x_scFc_ | VL7\|7a/JL3b | .V.K.......G...G | 17362 |

HEAVY_VARIABLE

| Germline | | | SEQ ID NO: |
|---|---|---|---|

H_FR1

| | | | |
|---|---|---|---|
| VH3\|3-73/D2\|2-21\|RF2/JH4 | | EVQLVES-GGGLVQPGGSLKLSCAASG-FTFS | 17351 |
| I2E_x_scFc_variant_ | VH3\|3-73/D2\|2-21\|RF2/JH4 | ...............................N | 17352 |
| I2E_x_scFc_ | VH3\|3-73/D2\|2-21\|RF2/JH4 | ...............................N | 17353 |

H_CDR1

| | | | |
|---|---|---|---|
| VH3\|3-73/D2\|2-21\|RF2/JH4 | | G-----SAMH | 17357 |
| I2E_x_scFc_variant_ | VH3\|3-73/D2\|2-21\|RF2/JH4 | K.....Y.IN | 17358 |
| I2E_x_scFc_ | VH3\|3-73/D2\|2-21\|RF2/JH4 | K.....Y.IN | 17359 |

H_FR2

| | | | |
|---|---|---|---|
| VH3\|3-73/D2\|2-21\|RF2/JH4 | | WVRQASGKGLEWVG | 17363 |
| I2E_x_scFc_variant_ | VH3\|3-73/D2\|2-21\|RF2/JH4 | .....P.......A | 17364 |
| I2E_x_scFc_ | VH3\|3-73/D2\|2-21\|RF2/JH4 | .....P.......A | 17365 |

LAMBDA_VARIABLE

| Germline | | | SEQ ID NO: |
|---|---|---|---|

L_CDR2

| | | | |
|---|---|---|---|
| VL7\|7a/JL3b | | S--------TSNKHS | 17366 |
| I2E_x_scFc_variant_ | VL7\|7a/JL3b | G.........KFLAP | 17367 |
| I2E_x_scFc_ | VL7\|7a/JL3b | G.........KFLAP | 17368 |

L_FR3

| | | | |
|---|---|---|---|
| VL7\|7a/JL3b | | SGSLLG--GKAALTLSGVQPED | 17372 |
| I2E_x_scFc_variant_ | VL7\|7a/JL3b | ....S................. | 17373 |
| I2E_x_scFc_ | VL7\|7a/JL3b | ....S................. | 17374 |

HEAVY_VARIABLE

| Germline | | | SEQ ID NO: |
|---|---|---|---|

H_CDR2

| | | | |
|---|---|---|---|
| VH3\|3-73/D2\|2-21\|RF2/JH4 | | RIRSKA-NSYATAYAASVKG | 17369 |
| I2E_x_scFc_variant_ | VH3\|3-73/D2\|2-21\|RF2/JH4 | .....Y..N...Y..DA..D | 17370 |
| I2E_x_scFc_ | VH3\|3-73/D2\|2-21\|RF2/JH4 | .....Y..N...Y..DA..D | 17371 |

TABLE 87-continued scFv scFc_Variable Region Consensus Protein Alignment
CDRs defined by Kabat
Alignment numbering defined by Amgen Reference (AHo)

| | | H_FR3 | |
|---|---|---|---|
| VH3\|3-73/D2\|2-21\|RF2/JH4 | | RDDSKNTAYLQMNSLKTEDTAV | 17375 |
| I2E_x_scFc_variant_ | VH3\|3-73/D2\|2-21\|RF2/JH4 | .......V.....N........ | 17376 |
| I2E_x_scFc_ | VH3\|3-73/D2\|2-21\|RF2/JH4 | .......V.....N........ | 17377 |

LAMBDA_VARIABLE

| Germline | | | SEQ ID NO: |
|---|---|---|---|
| | | L_CDR3 | |
| VL7\|7a/JL3b | | LLYYG---------------------GAQWV | 17378 |
| I2E_x_scFc_variant_ | VL7\|7a/JL3b | V.W.S...................-NR.. | 17379 |
| I2E_x_scFc_ | VL7\|7a/JL3b | V.W.S...................-NR.. | 17380 |
| | | L_FR4 | |
| VL7\|7a/JL3b | | FGGGTKLTVL | 17384 |
| I2E_x_scFc_variant_ | VL7\|7a/JL3b | ...S....... | 17385 |
| I2E_x_scFc_ | VL7\|7a/JL3b | ...S....... | 17386 |

HEAVY_VARIABLE

| Germline | | | SEQ ID NO: |
|---|---|---|---|
| | | H_CDR3 | |
| VH3\|3-73/D2\|2-21\|RF2/JH4 | | AYCGGDC----------------YSYFDY | 17381 |
| I2E_x_scFc_variant_ | VH3\|3-73/D2\|2-21\|RF2/JH4 | .GNF.SS................YI..WA. | 17382 |
| I2E_x_scFc_ | VH3\|3-73/D2\|2-21\|RF2/JH4 | .GNF.SS................YI..WA. | 17383 |
| | | H_FR4 | |
| VH3\|3-73/D2\|2-21\|RF2/JH4 | | WGQGTLVTVSS | 17387 |
| I2E_x_scFc_variant_ | VH3\|3-73/D2\|2-21\|RF2/JH4 | ........... | 17388 |
| I2E_x_scFc_ | VH3\|3-73/D2\|2-21\|RF2/JH4 | ........... | 17389 |

TABLE 88

BiTE-scFc_Full Sequences

| Ab | Type | BITE_scFc |
|---|---|---|
| MA_03-G10_AS_CC_x_I2C0_x_scFc_(N3H)_ | NA<br>AA | No nuc. seq available<br>MDMRVPAQLLGLLLLWLRGARCEVQLLESGGGLVQPGGSLRLSCAASGFTFSSYAMSWVRQAPGKC<br>LEWVSAISGSGGGTYYAASVKGRFTISRDNSKNTLYLQMSSLRAEDTAVYYCATGKGVHLGFDYWG<br>QGTLVTVSSGGGGSGGGGSGGGGSSYVLTQPPSVSVLTQPPSVSVAPGQTARITCGGNNIGSKSVHWYQQKPGQA<br>PVMVVYDDNDRPSGIPERFSGSNSGNTATLTISRVEAGDEADYYCQVWDYSGQRQVFGCGTKLTVL<br>SGGGGSEVQLVESGGGLVQPGGSLKLSCAASGFTENKYAMNWVRQAPGKGLEWVARIRSKYNNYAT<br>YYADSVKDRFTISRDDSKNTAYLQMNNLKTEDTAVYYCVRHGNFGNSYISYWAYWGQGTLVTVSSG<br>GGGSGGGGSGGGGSGGGGSQTVVTQEPSLTVSPGGTVTLTCGSSTGAVTSGNYPNWVQQKPGQAPRGLIGG<br>TKFLAPGTPARFSGSLLGGKAALTLSGVQPEDEAEYYCVLWYSNRWVFGGGTKLTVLGGGGDKTHT<br>CPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGGGSDKTHTCPPCPAP<br>ELLGGPSVFLFPPKPKDTLMISRTPEVTCVVVDVSHEDPEVKFNWYVDGVEVHNAKTKPCEEQYGS<br>TYRCVSVLTVLHQDWLNGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDKSRWQQGNVFSCSVMHE<br>ALHNHYTQKSLSLSPGK<br>(SEQ ID NO: 17390) |
| MA_03-G10_AS_CC_x_I2E_x_scFc_ | NA<br>AA | No nuc. seq available<br>MDMRVPAQLLGLLLLWLRGARCEVQLLESGGGLVQPGGSLRLSCAASGFTFSSYAMSWVRQAPGKC<br>LEWVSAISGSGGGTYYAASVKGRFTISRDNSKNTLYLQMSSLRAEDTAVYYCATGKGVHLGFDYWG<br>QGTLVTVSSGGGGSGGGGSGGGGSSYVLTQPPSVSVAPGQTARITCGGNNIGSKSVHWYQQKPGQA<br>PVMVVYDDNDRPSGIPERFSGSNSGNTATLTISRVEAGDEADYYCQVWDYSGQRQVFGCGTKLTVL<br>SGGGGSEVQLVESGGGLVQPGGSLKLSCAASGFTENKYAINWVRQAPGKGLEWVARIRSKYNNYAT<br>YYADAVKDRFTISRDDSKNTVYLQMNNLKTEDTAVYYCARAGNFGSSYISYWAYWGQGTLVTVSSG<br>GGGSGGGGSGGGGSQTVVTQEPSLTVSPGGTVTITCGSSTGAVTSGNYPNWVQKKPGQAPRGLIGG<br>TKFLAPGTPARFSGSLSGGKAALTLSGVQPEDEAEYYCVLWYSNRWVFGSGTKLTVLGGGGDKTHT<br>CPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGGGSDKTHTCPPCPAP<br>ELLGGPSVFLFPPKPKDTLMISRTPEVTCVVVDVSHEDPEVKFNWYVDGVEVHNAKTKPCEEQYGS<br>TYRCVSVLTVLHQDWLNGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDKSRWQQGNVFSCSVMHE<br>ALHNHYTQKSLSLSPGK<br>(SEQ ID NO: 17391) |
| | NA<br>AA | No nuc. seq available<br>MDMRVPAQLLGLLLLWLRGARCEVQLLESGGGLVQPGGSLRLSCAASGFTFSSYAMSWVRQAPGKC<br>LEWVSAISGSGGGTYYAASVKGRFTISRDNSKNTLYLQMSSLRAEDTAVYYCATGKGVHLGEDYWG<br>QGTLVTVSSGGGGSGGGGSGGGGSSYVLTQPPSVSVAPGQTARITCGGNNIGSKSVHWYQQKPGQA<br>PVMVVYDDNDRPSGIPERFSGSNSGNTATLTISRVEAGDEADYYCQVWDYSGQRQVFGCGTKLTVL<br>SGGGGSEVQLVESGGGLVQPGGSLKLSCAASGFTENKYAINWVRQAPGKGLEWVARIRSKYNNYAT<br>YYADAVKDRFTISRDDSKNTVYLQMNNLKTEDTAVYYCARAGNFGSSYISYWAYWGQGTLVTVSSG<br>GGGSGGGGSGGGGSQTVVTQEPSLTVSPGGTVTITCGSSTGAVTSGNYPNWVQKKPGQAPRGLIGG<br>TKFLAPGTPARFSGSLSGGKAALTLSGVQPEDEAEYYCVLWYSNRWVFGSGTKLTVLGGGGDKTHT<br>CPPCPAPELLGGPSVFLFPPKPKDTLYITREPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGGGSDKTHTCPPCPAP<br>ELLGGPSVFLFPPKPKDTLYITREPEVTCVVVDVSHEDPEVKENWYVDGVEVHNAKTKPCEEQYGS<br>TYRCVSVLTVLHQDWLNGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDKSRWQQGNVFSCSVMHE<br>ALHNHYTQKSLSLSPGK<br>(SEQ ID NO: 17392) |
| MA_10-B5_CC_x_I2C0_x_scFc_(H6H)_ | NA<br>AA | No nuc. seq available<br>MDMRVPAQLLGLLLLWLRGARCEVQLVESGGGLVQPGGSLRLSCAASGFTFSNAWMSWVRQAPGKC<br>LEWVGRIRSRSYGGTTDYAAPVKGRFTISRDDSKNTLFLQMNSLKTEDTAVYYCTTPSYSGSYYNY<br>FSVMDVWGQGTTVTVSSGGGGSGGGGSGGGGSDIQMTQSPSSLSASVGDRVTITCRTSQSISSYLN<br>WYQQKPGRAPKLLIFAASSLQGGVPSRFSGSGSGTDFTLTISSLQPEDFATYYCQQTYSMPFTFGC<br>GTKVEIKSGGGGSEVQLVESGGGLVQPGGSLKLSCAASGFTENKYAMNWVRQAPGKGLEWVARIRS<br>KYNNYATYYADSVKDRFTISRDDSKNTAYLQMNNLKTEDTAVYYCVRHGNEGNSYISYWAYWGQGT<br>LVTVSSGGGGSGGGGSGGGGSQTVVTQEPSLTVSPGGTVTLTCGSSTGAVTSGNYPNWVQQKPGQA<br>PRGLIGGTKFLAPGTPARFSGSLLGGKAALTLSGVQPEDEAEYYCVLWYSNRWVFGGGTKLTVLGG<br>GGDKTHTCPPCPAPELLGGPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAPIEKTISKAKGQPREPQVYT<br>LPPSREEMTKNQVSLTCLVKGFYPSDIAVEWESNGQPENNYKTTPPVLDSDGSFFLYSKLTVDKSR<br>WQQGNVFSCSVMHEALHNHYTQKSLSLSPGKGGGGSGGGGSGGGGSGGGGSGGGGSGGGGSDKTHT<br>CPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGK<br>(SEQ ID NO: 17393) |

TABLE 88-continued

BiTE-scFc_Full Sequences

| Ab | Type | BITE_scFc |
|---|---|---|
| MA_10-B5_CC_x_<br>I2E_x_scFc_ | NA<br>AA | No nuc. seq available<br>MDMRVPAQLLGLLLLWLRGARCEVQLVESGGGLVQPGGSLRLSCAASGFTFSNAWMSWVRQAPGKC<br>LEWVGRIRSRSYGGTTDYAAPVKGRFTISRDDSKNTLFLQMNSLKTEDTAVYYCTTPSYSGSYYNY<br>FSVMDVWGQGTTVTVSSGGGGSGGGGSGGGGSDIQMTQSPSSLSASVGDRVTITCRTSQSISSYLN<br>WYQQKPGRAPKLLIFAASSLQGGVPSRFSGSGSGTDFTLTISSLQPEDFATYYCQQTYSMPFTFGC<br>GTKVEIKSGGGGSEVQLVESGGGLVQPGGSLKLSCAASGFTENKYAINWVRQAPGKGLEWVARIRS<br>KYNNYATYYADAVKDRFTISRDDSKNTVYLQMNNLKTEDTAVYYCARAGNFGSSYISYWAYWGQGT<br>LVTVSSGGGGSGGGGSGGGGSQTVVTQEPSLTVSPGGTVTITCGSSTGAVTSGNYPNWVQQKPGQA<br>PRGLIGGTKFLAPGTPARFSGSLSGGKAALTLSGVQPEDEAEYYCVLWYSNRWVFGSGTKLTVLGG<br>GGDKTHTCPPCPAPELLGGPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAPIEKTISKAKGQPREPQVYT<br>LPPSREEMTKNQVSLTCLVKGFYPSDIAVEWESNGQPENNYKTTPPVLDSDGSFFLYSKLTVDKSR<br>WQQGNVFSCSVMHEALHNHYTQKSLSLSPGKGGGGSGGGGSGGGGSGGGGSGGGGSGGGGSDKTHT<br>CPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGK<br>(SEQ ID NO: 17394) |
| MA_10-B5_CC_x_<br>I2E_x_scFc_variant_ | NA<br>AA | No nuc. seq available<br>MDMRVPAQLLGLLLLWLRGARCEVQLVESGGGLVQPGGSLRLSCAASGFTFSNAWMSWVRQAPGKC<br>LEWVGRIRSRSYGGTTDYAAPVKGRFTISRDDSKNTLFLQMNSLKTEDTAVYYCTTPSYSGSYYNY<br>FSVMDVWGQGTTVTVSSGGGGSGGGGSGGGGSDIQMTQSPSSLSASVGDRVTITCRTSQSISSYLN<br>WYQQKPGRAPKLLIFAASSLQGGVPSRFSGSGSGTDFTLTISSLQPEDFATYYCQQTYSMPFTFGC<br>GTKVEIKSGGGGSEVQLVESGGGLVQPGGSLKLSCAASGFTENKYAINWVRQAPGKGLEWVARIRS<br>KYNNYATYYADAVKDRFTISRDDSKNTVYLQMNNLKTEDTAVYYCARAGNFGSSYISYWAYWGQGT<br>LVTVSSGGGGSGGGGSGGGGSQTVVTQEPSLTVSPGGTVTITCGSSTGAVTSGNYPNWVQQKPGQA<br>PRGLIGGTKFLAPGTPARFSGSLSGGKAALTLSGVQPEDEAEYYCVLWYSNRWVFGSGTKLTVLGG<br>GGDKTHTCPPCPAPELLGGPSVFLFPPKPKDTLYITREPEVTCVVVDVSHEDPEVKENWYVDGVEV<br>HNAKTKPCEEQYGSTYRCVSVLTVLHQDWLNGKEYKCKVSNKALPAPIEKTISKAKGQPREPQVYT<br>LPPSREEMTKNQVSLTCLVKGFYPSDIAVEWESNGQPENNYKTTPPVLDSDGSFFLYSKLTVDKSR<br>WQQGNVFSCSVMHEALHNHYTQKSLSLSPGKGGGGSGGGGSGGGGSGGGGSGGGGSGGGGSDKTHT<br>CPPCPAPELLGGPSVFLFPPKPKDTLYITREPEVTCVVVDVSHEDPEVKENWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGK<br>(SEQ ID NO: 17395) |
| MA_98-C7_CC_x_<br>I2C0_x_scFc_(Y8P)_ | NA<br>AA | No nuc. seq available<br>MDMRVPAQLLGLLLLWLRGARCEVQLLESGGGLVQPGGSLRLSCAASGFTFSSHAMSWVRQAPGKC<br>LEWVSSISGSGGGTYYAASVKGRFTISRDNSKNTLYLQMNSLRAEDTAVYYCATGKGVHLGFDYWG<br>QGTLVTVSSGGGGSGGGGSGGGGSSYVLTQPPSVSVAPGQTARITCGGNNIGSKSVHWYQQKPGQA<br>PVMVVYDDNDRPSGIPERFSGSNSGNTATLTISRVEAGDEADYYCQVWDYSPLRHVFGCGTKLTVL<br>SGGGGSEVQLVESGGGLVQPGGSLKLSCAASGFTENKYAMNWVRQAPGKGLEWVARIRSKYNNYAT<br>YYADSVKDRETISRDDSKNTAYLQMNNLKTEDTAVYYCVRHGNFGNSYISYWAYWGQGTLVTVSSG<br>GGGSGGGGSGGGGSQTVVTQEPSLTVSPGGTVTLTCGSSTGAVTSGNYPNWVQQKPGQAPRGLIGG<br>TKFLAPGTPARFSGSLLGGKAALTLSGVQPEDEAEYYCVLWYSNRWVFGGGTKLTVLGGGGDKTHT<br>CPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGGGSGGGGSDKTHTCPPCPAP<br>ELLGGPSVFLFPPKPKDTLMISRTPEVTCVVVDVSHEDPEVKENWYVDGVEVHNAKTKPCEEQYGS<br>TYRCVSVLTVLHQDWLNGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDKSRWQQGNVFSCSVMHE<br>ALHNHYTQKSLSLSPGK<br>(SEQ ID NO: 17396) |
| MA_98-C7_CC_x_<br>I2E_x_scFc_ | NA<br>AA | No nuc. seq available<br>MDMRVPAQLLGLLLLWLRGARCEVQLLESGGGLVQPGGSLRLSCAASGFTFSSHAMSWVRQAPGKC<br>LEWVSSISGSGGGTYYAASVKGRFTISRDNSKNTLYLQMNSLRAEDTAVYYCATGKGVHLGFDYWG<br>QGTLVTVSSGGGGSGGGGSGGGGSSYVLTQPPSVSVAPGQTARITCGGNNIGSKSVHWYQQKPGQA<br>PVMVVYDDNDRPSGIPERFSGSNSGNTATLTISRVEAGDEADYYCQVWDYSPLRHVFGCGTKLTVL<br>SGGGGSEVQLVESGGGLVQPGGSLKLSCAASGFTENKYAINWVRQAPGKGLEWVARIRSKYNNYAT<br>YYADAVKDRFTISRDDSKNTVYLQMNNLKTEDTAVYYCARAGNFGSSYISYWAYWGQGTLVTVSSG<br>GGGSGGGGSGGGGSQTVVTQEPSLTVSPGGTVTITCGSSTGAVTSGNYPNWVQQKPGQAPRGLIGG<br>TKFLAPGTPARESGSLSGGKAALTLSGVQPEDEAEYYCVLWYSNRWVFGSGTKLTVLGGGGDKTHT<br>CPPCPAPELLGGPSVFLFPPKPKDTLMISRTPEVTCVVVDVSHEDPEVKFNWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGGGSGGGGSDKTHTCPPCPAP<br>ELLGGPSVFLFPPKPKDTLMISRTPEVTCVVVDVSHEDPEVKFNWYVDGVEVHNAKTKPCEEQYGS<br>TYRCVSVLTVLHQDWLNGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDKSRWQQGNVFSCSVMHE<br>ALHNHYTQKSLSLSPGK<br>(SEQ ID NO: 17397) |

TABLE 88-continued

BiTE-scFc_Full Sequences

| Ab | Type | BITE_scFc |
|---|---|---|
| MA_98-C7_CC_x_<br>I2E_x_scFc_variant_ | NA | No nuc. seq available |
| | AA | MDMRVPAQLLGLLLLWLRGARCEVQLLESGGGIVQPGGSLRLSCAASGFTFSSHAMSWVRQAPGKQ<br>LEWVSSISGSGGGTYYAASVKGRFTISRDNSKNTLYLQMNSLRAEDTAVYYCATGKGVHLGFDYWG<br>QGTLVTVSSGGGGSGGGGSGGGGSSYVLTQPPSVSVAPGQTARITCGGNNIGSKSVHWYQQKPGQA<br>PVMVVYDDNDRPSGIPERFSGSNSGNTATLTISRVEAGDEADYYCQVWDYSPLRHVFGCGTKLTVL<br>SGGGGSEVQLVESGGGLVQPGGSLKLSCAASGFTENKYA]NWVRQAPGKGLEWVARIRSKYNNYAT<br>YYADAVKDRFTISRDDSKNTVYLQMNNLKTEDTAVYYCARAGNFGSSYISYWAYWGQGTLVTVSSG<br>GGGSGGGGSGGGGSQTVVTQEPSLTVSPGGTVTITCGSSTGAVTSGNYPNWVQKKPGQAPRGLIGG<br>TKFLAPGTPARFSGSLSGGKAALTLSGVQPEDEAEYYCVLWYSNRWVFGSGTKLTVLGGGGDKTHT<br>CPPCPAPELLGGPSVFLFPPKPKDTLYITREPEVTCVVVDVSHEDPEVKENWYVDGVEVHNAKTKP<br>CEEQYGSTYRCVSVLTVLHQDWLNGKEYKCKVSNKALPAPIEKTISKAKGQPREPQVYTLPPSREE<br>MTKNQVSLTCLVKGFYPSDIAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGGGSGGGGSDKTHTCPPCPAP<br>ELLGGPSVFLFPPKPKDTLYITREPEVTCVVVDVSHEDPEVKENWYVDGVEVHNAKTKPCEEQYGS<br>TYRCVSVLTVLHQDWLNGKEYKCKVSNKALPAPIEKTISKAKGQPREPQVYTLPPSREEMTKNQVS<br>LTCLVKGFYPSDIAVEWESNGQPENNYKTTPPVLDSDGSFFLYSKLTVDKSRWQQGNVESCSVMHE<br>ALHNHYTQKSLSLSPGK<br>(SEQ ID NO: 17398) |

TABLE 89

| Ab | Type | CDR1 | CDR2 | CDR3 |
|---|---|---|---|---|
| BiTE-scFc_Fv#1 VL CDRs | | | | |
| MA_03-G10_AS_CC_x_<br>I2C0_x_scFc_(N3H)_ | NA | No nuc. seq available | No nuc. seq available | No nuc. seq available |
| | AA | GGNNIGSKSVH<br>(SEQ ID NO: 17399) | DDNDRPS<br>(SEQ ID NO: 17435) | QVWDYSGORQV<br>(SEQ ID NO: 17471) |
| MA_03-G10_AS_CC_x_<br>I2E_x_scFc_ | NA | No nuc. seq available | No nuc. seq available | No nuc. seq available |
| | AA | GGNNIGSKSVH<br>(SEQ ID NO: 17400) | DDNDRPS<br>(SEQ ID NO: 17436) | QVWDYSGORQV<br>(SEQ ID NO: 17472) |
| MA_03-<br>G10_AS_CC_x_I2E_x_<br>scFc_variant_ | NA | No nuc. seq available | No nuc. seq available | No nuc. seq available |
| | AA | GGNNIGSKSVH<br>(SEQ ID NO: 17401) | DDNDRPS<br>(SEQ ID NO: 17437) | QVWDYSGOROV<br>(SEQ ID NO: 17473) |
| MA_10-B5_CC_x_I2C0_<br>x_scFc_(H6H)_ | NA | No nuc. seq available | No nuc. seq available | No nuc. seq available |
| | AA | RTSQSISSYLN<br>(SEQ ID NO: 17402) | AASSLOG<br>(SEQ ID NO: 17438) | QQTYSMPFT<br>(SEQ ID NO: 17474) |
| MA_10-B5_CC_x_I2E_<br>x_scFc_ | NA | No nuc. seq available | No nuc. seq available | No nuc. seq available |
| | AA | RTSQSISSYLN<br>(SEQ ID NO: 17403) | AASSLOG<br>(SEQ ID NO: 17439) | QQTYSMPFT<br>(SEQ ID NO: 17475) |
| MA_10-B5_CC_x_I2E_x_<br>scFc_variant_ | NA | No nuc. seq available | No nuc. seq available | No nuc. seq available |
| | AA | RTSQSISSYLN<br>(SEQ ID NO: 17404) | AASSLOG<br>(SEQ ID NO: 17440) | QQTYSMPFT<br>(SEQ ID NO: 17476) |
| MA_98-C7_CC_x_I2C0_x_<br>scFc_(Y8P)_ | NA | No nuc. seq available | No nuc. seq available | No nuc. seq available |
| | AA | GGNNIGSKSVH<br>(SEQ ID NO: 17405) | DDNDRPS<br>(SEQ ID NO: 17441) | QVWDYSPLRHV<br>(SEQ ID NO: 17477) |
| MA_98-C7_CC_x_I2E_x_<br>scFc_ | NA | No nuc. seq available | No nuc. seq available | No nuc. seq available |
| | AA | GGNNIGSKSVH<br>(SEQ ID NO: 17406) | DDNDRPS<br>(SEQ ID NO: 17442) | QVWDYSPLRHV<br>(SEQ ID NO: 17478) |
| MA_98-C7_CC_x_I2E_x_<br>scFc_variant_ | NA | No nuc. seq available | No nuc. seq available | No nuc. seq available |
| | AA | GGNNIGSKSVH<br>(SEQ ID NO: 17407) | DDNDRPS<br>(SEQ ID NO: 17443) | QVWDYSPLRHV<br>(SEQ ID NO: 17479) |

TABLE 89-continued

| Ab | Type | CDR1 | CDR2 | CDR3 |
|---|---|---|---|---|
| BiTE-scFc_Fv#1 VH CDRs | | | | |
| MA_03-G10_AS_CC_x_I2C0_x_scFc_(N3H)_ | NA | No nuc. seq available | No nuc. seq available | No nuc. seq available |
| | AA | SYAMS (SEQ ID NO: 17408) | AISGSGGGTYYAASVKG (SEQ ID NO: 17444) | GKGVHLGFDY (SEQ ID NO: 17480) |
| MA_03-G10_AS_CC_x_I2E_x_scFc_ | NA | No nuc. seq available | No nuc. seq available | No nuc. seq available |
| | AA | SYAMS (SEQ ID NO: 17409) | AISGSGGGTYYAASVKG (SEQ ID NO: 17445) | GKGVHLGFDY (SEQ ID NO: 17481) |
| MA_03-G10_AS_CC_x_I2E_x_scFc_variant_ | NA | No nuc. seq available | No nuc. seq available | No nuc. seq available |
| | AA | SYAMS (SEQ ID NO: 17410) | AISGSGGGTYYAASVKG (SEQ ID NO: 17446) | GKGVHLGFDY (SEQ ID NO: 17482) |
| MA_10-B5_CC_x_I2C0_x_scFc_(H6H)_ | NA | No nuc. seq available | No nuc. seq available | No nuc. seq available |
| | AA | NAWMS (SEQ ID NO: 17411) | RIRSRSYGGTTDYAAPVKG (SEQ ID NO: 17447) | PSYSGSYYNYFSVMDV (SEQ ID NO: 17483) |
| MA_10-B5_CC_x_I2E_x_scFc_ | NA | No nuc. seq available | No nuc. seq available | No nuc. seq available |
| | AA | NAWMS (SEQ ID NO: 17412) | RIRSRSYGGTTDYAAPVKG (SEQ ID NO: 17448) | PSYSGSYYNYFSVMDV (SEQ ID NO: 17484) |
| MA_10-B5_CC_x_I2E_x_scFc_variant_ | NA | No nuc. seq available | No nuc. seq available | No nuc. seq available |
| | AA | NAWMS (SEQ ID NO: 17413) | RIRSRSYGGTTDYAAPVKG (SEQ ID NO: 17449) | PSYSGSYYNYFSVMDV (SEQ ID NO: 17485) |
| MA_98-C7_CC_x_I2C0_x_scFc_(Y8P)_ | NA | No nuc. seq available | No nuc. seq available | No nuc. seq available |
| | AA | SHAMS (SEQ ID NO: 17414) | SISGSGGGTYYAASVKG (SEQ ID NO: 17450) | GKGVHLGFDY (SEQ ID NO: 17486) |
| MA_98-C7_CC_x_I2E_x_scFc_ | NA | No nuc. seq available | No nuc. seq available | No nuc. seq available |
| | AA | SHAMS (SEQ ID NO: 17415) | SISGSGGGTYYAASVKG (SEQ ID NO: 17451) | GKGVHLGFDY (SEQ ID NO: 17487) |
| MA_98-C7_CC_x_I2E_x_scFc_variant_ | NA | No nuc. seq available | No nuc. seq available | No nuc. seq available |
| | AA | SHAMS (SEQ ID NO: 17416) | SISGSGGGTYYAASVKG (SEQ ID NO: 17452) | GKGVHLGFDY (SEQ ID NO: 17488) |

TABLE 90

| Ab | Type | CDR1 | CDR2 | CDR3 |
|---|---|---|---|---|
| BiTE-scFc_Fv#2 VL CDRs | | | | |
| MA_03-G10_AS_CC_x_I2C0_x_scFc_(N3H)_ | NA | No nuc. seq available | No nuc. seq available | No nuc. seq available |
| | AA | GSSTGAVTSGNYPN (SEQ ID NO: 17417) | GTKFLAP (SEQ ID NO: 17453) | VLWYSNRWV (SEQ ID NO: 17489) |
| MA_03-G10_AS_CC_x_I2E_x_scFc_ | NA | No nuc. seq available | No nuc. seq available | No nuc. seq available |
| | AA | GSSTGAVTSGNYPN (SEQ ID NO: 17418) | GTKFLAP (SEQ ID NO: 17454) | VLWYSNRWV (SEQ ID NO: 17490) |
| MA_03-G10_AS_CC_x_I2E_x_scFc_variant_ | NA | No nuc. seq available | No nuc. seq available | No nuc. seq available |
| | AA | GSSTGAVTSGNYPN (SEQ ID NO: 17419) | GTKFLAP (SEQ ID NO: 17455) | VLWYSNRWV (SEQ ID NO: 17491) |
| MA_10-B5_CC_x_I2C0_x_scFc_(H6H)_ | NA | No nuc. seq available | No nuc. seq available | No nuc. seq available |
| | AA | GSSTGAVTSGNYPN (SEQ ID NO: 17420) | GTKFLAP (SEQ ID NO: 17456) | VLWYSNRWV (SEQ ID NO: 17492) |

TABLE 90-continued

| Ab | Type | CDR1 | CDR2 | CDR3 |
|---|---|---|---|---|
| MA_10-B5_CC_x_I2E_x_scFc_ | NA<br>AA | No nuc. seq available<br>GSSTGAVTSGNYPN<br>(SEQ ID NO: 17421 | No nuc. seq available<br>GTKFLAP<br>(SEQ ID NO: 17457 | No nuc. seq available<br>VLWYSNRWV<br>(SEQ ID NO: 17493 |
| MA_10-B5_CC_x_I2E_x_scFc_variant_ | NA<br>AA | No nuc. seq available<br>GSSTGAVTSGNYPN<br>SEQ ID NO: 17422 | No nuc. seq available<br>GTKFLAP<br>(SEQ ID NO: 17458 | No nuc. seq available<br>VLWYSNRWV<br>(SEQ ID NO: 17494 |
| MA_98-C7_CC_x_I2C0_x_scFc_(Y8P)_ | NA<br>AA | No nuc. seq available<br>GSSTGAVTSGNYPN<br>SEQ ID NO: 17423 | No nuc. seq available<br>GTKFLAP<br>(SEQ ID NO: 17459 | No nuc. seq available<br>VLWYSNRWV<br>(SEQ ID NO: 17495 |
| MA_98-C7_CC_x_I2E_x_scFc_ | NA<br>AA | No nuc. seq available<br>GSSTGAVTSGNYPN<br>(SEQ ID NO: 17424 | No nuc. seq available<br>GTKFLAP<br>(SEQ ID NO: 17460 | No nuc. seq available<br>VLWYSNRWV<br>(SEQ ID NO: 17496 |
| MA_98-C7_CC_x_I2E_x_scFc_variant_ | NA<br>AA | No nuc. seq available<br>GSSTGAVTSGNYPN<br>(SEQ ID NO: 17425 | No nuc. seq available<br>GTKFLAP<br>(SEQ ID NO: 17461 | No nuc. seq available<br>VLWYSNRWV<br>(SEQ ID NO: 17497 |
| BiTE-scFc_Fv#2 VH CDRs | | | | |
| MA_03-G10_AS_CC_x_I2C0_x_scFc_(N3H)_ | NA<br>AA | No nuc. seq available<br>KYAMN<br>(SEQ ID NO: 17426 | No nuc. seq available<br>RIRSKYNNYATYYADSVKD<br>(SEQ ID NO: 17462 | No nuc. seq available<br>HGNFGNSYISYWAY<br>(SEQ ID NO: 17498 |
| MA_03-G10_AS_CC_x_I2E_x_scFc_ | NA<br>AA | No nuc. seq available<br>KYAIN<br>(SEQ ID NO: 17427 | No nuc. seq available<br>RIRSKYNNYATYYADAVKD<br>(SEQ ID NO: 17463 | No nuc. seq available<br>AGNFGSSYISYWAY<br>(SEQ ID NO: 17499 |
| MA_03-G10_AS_CC_x_I2E_x_scFc_variant_ | NA<br>AA | No nuc. seq available<br>KYAIN<br>(SEQ ID NO: 17428 | No nuc. seq available<br>RIRSKYNNYATYYADAVKD<br>(SEQ ID NO: 17464 | No nuc. seq available<br>AGNFGSSYISYWAY<br>(SEQ ID NO: 17500 |
| MA_10-B5_CC_x_I2C0_x_scFc_(H6H)_ | NA<br>AA | No nuc. seq available<br>KYAMN<br>(SEQ ID NO: 17429 | No nuc. seq available<br>RIRSKYNNYATYYADSVKD<br>(SEQ ID NO: 17465 | No nuc. seq available<br>HGNFGNSYISYWAY<br>(SEQ ID NO: 17501 |
| MA_10-B5_CC_x_I2E_x_scFc_ | NA<br>AA | No nuc. seq available<br>KYAIN<br>(SEQ ID NO: 17430 | No nuc. seq available<br>RIRSKYNNYATYYADAVKD<br>(SEQ ID NO: 17466 | No nuc. seq available<br>AGNFGSSYISYWAY<br>(SEQ ID NO: 17502 |
| MA_10-B5_CC_x_I2E_x_scFc_variant_ | NA<br>AA | No nuc. seq available<br>KYAIN<br>(SEQ ID NO: 17431 | No nuc. seq available<br>RIRSKYNNYATYYADAVKD<br>(SEQ ID NO: 17467 | No nuc. seq available<br>AGNFGSSYISYWAY<br>(SEQ ID NO: 17503 |
| MA_98-C7_CC_x_I2C0_x_scFc_(Y8P)_ | NA<br>AA | No nuc. seq available<br>KYAMN<br>(SEQ ID NO: 17432 | No nuc. seq available<br>RIRSKYNNYATYYADSVKD<br>(SEQ ID NO: 17468 | No nuc. seq available<br>HGNFGNSYISYWAY<br>(SEQ ID NO: 17504 |
| MA_98-C7_CC_x_I2E_x_scFc_ | NA<br>AA | No nuc. seq available<br>KYAIN<br>(SEQ ID NO: 17433 | No nuc. seq available<br>RIRSKYNNYATYYADAVKD<br>(SEQ ID NO: 17469 | No nuc. seq available<br>AGNFGSSYISYWAY<br>(SEQ ID NO: 17505 |
| MA_98-C7_CC_x_I2E_x_scFc_variant_ | NA<br>AA | No nuc. seq available<br>KYAIN<br>(SEQ ID NO: 17434 | No nuc. seq available<br>RIRSKYNNYATYYADAVKD<br>(SEQ ID NO: 17470 | No nuc. seq available<br>AGNFGSSYISYWAY<br>(SEQ ID NO: 17506 |

TABLE 91

BiTE-scFc Variable Region Sequences

| Ab | Type | LC V-region | HC V-region |
|---|---|---|---|
| | | Fv#1 | |
| MA_03-G10_AS_CC_x_I2C0_x_scFc_(N3H)_ | NA AA | No nuc. seq available<br>SYVLTQPPSVSVAPGQTARITCGGNN<br>IGSKSVHWYQQKPGQAPVMVVYDDND<br>RPSGIPERFSGSNSGNTATLTISRVE<br>AGDEADYYCQVWDYSGQRQVFGCGTK<br>LTVL<br>(SEQ ID NO: 17507) | No nuc. seq available<br>EVQLLESGGGLVQPGGSLRLSCAASG<br>FTFSSYAMSWVRQAPGKCLEWVSAIS<br>GSGGGTYYAASVKGRFTISRDNSKNT<br>LYLQMSSLRAEDTAVYYCATGKGVHL<br>GFDYWGQGTLVTVSS<br>(SEQ ID NO: 17516) |
| MA_03-G10_AS_CC_x_I2E_x_scFc_ | NA AA | No nuc. seq available<br>SYVLTQPPSVSVAPGQTARITCGGNN<br>IGSKSVHWYQQKPGQAPVMVVYDDND<br>RPSGIPERFSGSNSGNTATLTISRVE<br>AGDEADYYCQVWDYSGQRQVFGCGTK<br>LTVL<br>(SEQ ID NO: 17508) | No nuc. seq available<br>EVQLLESGGGLVQPGGSLRLSCAASG<br>FTFSSYAMSWVRQAPGKCLEWVSAIS<br>GSGGGTYYAASVKGRFTISRDNSKNT<br>LYLQMSSLRAEDTAVYYCATGKGVHL<br>GFDYWGQGTLVTVSS<br>(SEQ ID NO: 17517) |
| MA_03-G10_AS_CC_x_I2E_x_scFc_variant_ | NA AA | No nuc. seq available<br>SYVLTQPPSVSVAPGQTARITCGGNN<br>IGSKSVHWYQQKPGQAPVMVVYDDND<br>RPSGIPERFSGSNSGNTATLTISRVE<br>AGDEADYYCQVWDYSGQRQVFGCGTK<br>LTVL<br>(SEQ ID NO: 17509) | No nuc. seq available<br>EVQLLESGGGLVQPGGSLRLSCAASG<br>FTFSSYAMSWVRQAPGKCLEWVSAIS<br>GSGGGTYYAASVKGRFTISRDNSKNT<br>LYLQMSSLRAEDTAVYYCATGKGVHL<br>GEDYWGQGTLVTVSS<br>(SEQ ID NO: 17518) |
| MA_10-B5_CC_x_I2C0_x_scFc_(H6H)_ | NA AA | No nuc. seq available<br>DIQMTQSPSSLSASVGDRVTITCRTS<br>QSISSYLNWYQQKPGRAPKLLIFAAS<br>SLQGGVPSRFSGSGSGTDFTLTISSL<br>QPEDFATYYCQQTYSMPFTFGCGTKV<br>EIK<br>(SEQ ID NO: 17510) | No nuc. seq available<br>EVQLVESGGGLVQPGGSLRLSCAASG<br>FTFSNAWMSWVRQAPGKCLEWVGRIR<br>SRSYGGTTDYAAPVKGRFTISRDDSK<br>NTLFLQMNSLKTEDTAVYYCTTPSYS<br>GSYYNYFSVMDVWGQGTTVTVSS<br>(SEQ ID NO: 17519) |
| MA_10-B5_CC_x_I2E_x_scFc_ | NA AA | No nuc. seq available<br>DIQMTQSPSSLSASVGDRVTITCRTS<br>QSISSYLNWYQQKPGRAPKLLIFAAS<br>SLQGGVPSRFSGSGSGTDFTLTISSL<br>QPEDFATYYCQQTYSMPFTFGCGTKV<br>EIK<br>(SEQ ID NO: 17511) | No nuc. seq available<br>EVQLVESGGGLVQPGGSLRLSCAASG<br>FTFSNAWMSWVRQAPGKCLEWVGRIR<br>SRSYGGTTDYAAPVKGRFTISRDDSK<br>NTLFLQMNSLKTEDTAVYYCTTPSYS<br>GSYYNYFSVMDVWGQGTTVTVSS<br>(SEQ ID NO: 17520) |
| MA_10-B5_CC_x_I2E_x_scFc_variant_ | NA AA | No nuc. seq available<br>DIQMTQSPSSLSASVGDRVTITCRTS<br>QSISSYLNWYQQKPGRAPKLLIFAAS<br>SLQGGVPSRFSGSGSGTDFTLTISSL<br>QPEDFATYYCQQTYSMPFTFGCGTKV<br>EIK<br>(SEQ ID NO: 17512) | No nuc. seq available<br>EVQLVESGGGLVQPGGSLRLSCAASG<br>FTFSNAWMSWVRQAPGKCLEWVGRIR<br>SRSYGGTTDYAAPVKGRFTISRDDSK<br>NTLFLQMNSLKTEDTAVYYCTTPSYS<br>GSYYNYFSVMDVWGQGTTVTVSS<br>(SEQ ID NO: 17521) |
| MA_98-C7_CC_x_I2C0_x_scFc_(Y8P)_ | NA AA | No nuc. seq available<br>SYVLTQPPSVSVAPGQTARITCGGNN<br>IGSKSVHWYQQKPGQAPVMVVYDDND<br>RPSGIPERFSGSNSGNTATLTISRVE<br>AGDEADYYCQVWDYSPLRHVFGCGTK<br>LTVL<br>(SEQ ID NO: 17513) | No nuc. seq available<br>EVQLLESGGGLVQPGGSLRLSCAASG<br>FTFSSHAMSWVRQAPGKCLEWVSSIS<br>GSGGGTYYAASVKGRFTISRDNSKNT<br>LYLQMNSLRAEDTAVYYCATGKGVHL<br>GFDYWGQGTLVTVSS<br>(SEQ ID NO: 17522) |
| MA_98-C7_CC_x_I2E_x_scFc_ | NA AA | No nuc. seq available<br>SYVLTQPPSVSVAPGQTARITCGGNN<br>IGSKSVHWYQQKPGQAPVMVVYDDND<br>RPSGIPERFSGSNSGNTATLTISRVE<br>AGDEADYYCQVWDYSPLRHVFGCGTK<br>LTVL<br>(SEQ ID NO: 17514) | No nuc. seq available<br>EVQLLESGGGLVQPGGSLRLSCAASG<br>FTFSSHAMSWVRQAPGKCLEWVSSIS<br>GSGGGTYYAASVKGRFTISRDNSKNT<br>LYLQMNSLRAEDTAVYYCATGKGVHL<br>GEDYWGQGTLVTVSS<br>(SEQ ID NO: 17523) |
| MA_98-C7_CC_x_I2E_x_scFc_variant_ | NA AA | No nuc. seq available<br>SYVLTQPPSVSVAPGQTARITCGGNN<br>IGSKSVHWYQQKPGQAPVMVVYDDND<br>RPSGIPERFSGSNSGNTATLTISRVE<br>AGDEADYYCQVWDYSPLRHVFGCGTK<br>LTVL<br>(SEQ ID NO: 17515) | No nuc. seq available<br>EVQLLESGGGLVQPGGSLRLSCAASG<br>FTFSSHAMSWVRQAPGKCLEWVSSIS<br>GSGGGTYYAASVKGRFTISRDNSKNT<br>LYLQMNSLRAEDTAVYYCATGKGVHL<br>GFDYWGQGTLVTVSS<br>(SEQ ID NO: 17524) |

TABLE 91-continued

BiTE-scFc Variable Region Sequences

| Ab | Type | LC V-region | HC V-region |
|---|---|---|---|
| | | Fv#2 | |
| MA_03-G10_AS_CC_x_I2C0_x_scFc_(N3H)_ | NA AA | No nuc. seq available<br>QTVVTQEPSLTVSPGGTVTLTCGSST<br>GAVTSGNYPNWVQQKPGQAPRGLIGG<br>TKFLAPGTPARFSGSLLGGKAALTLS<br>GVQPEDEAEYYCVLWYSNRWVEGGGT<br>KLTVL<br>(SEQ ID NO: 17525) | No nuc. seq available<br>EVQLVESGGGLVQPGGSLKLSCAASG<br>FTFNKYAMNWVRQAPGKGLEWVARIR<br>SKYNNYATYYADSVKDRETISRDDSK<br>NTAYLQMNNLKTEDTAVYYCVRHGNE<br>GNSYISYWAYWGQGTLVTVSS<br>(SEQ ID NO: 17534) |
| MA_03-G10_AS_CC_x_I2E_x_scFc_ | NA AA | No nuc. seq available<br>QTVVTQEPSLTVSPGGTVTITCGSST<br>GAVTSGNYPNWVQQKPGQAPRGLIGG<br>TKFLAPGTPARFSGSLSGGKAALTLS<br>GVQPEDEAEYYCVLWYSNRWVFGSGT<br>KLTVL<br>(SEQ ID NO: 17526) | No nuc. seq available<br>EVQLVESGGGLVQPGGSLKLSCAASG<br>FTENKYAINWVRQAPGKGLEWVARIR<br>SKYNNYATYYADAVKDRFTISRDDSK<br>NTVYLQMNNLKTEDTAVYYCARAGNF<br>GSSYISYWAYWGQGTLVTVSS<br>(SEQ ID NO: 17535) |
| MA_03-G10_AS_CC_x_I2E_x_scFc_variant_ | NA AA | No nuc. seq available<br>QTVVTQEPSLTVSPGGTVTITCGSST<br>GAVTSGNYPNWVQQKPGQAPRGLIGG<br>TKFLAPGTPARFSGSLSGGKAALTLS<br>GVQPEDEAEYYCVLWYSNRWVEGSGT<br>KLTVL<br>(SEQ ID NO: 17527) | No nuc. seq available<br>EVQLVESGGGLVQPGGSLKLSCAASG<br>FTFNKYAINWVRQAPGKGLEWVARIR<br>SKYNNYATYYADAVKDRFTISRDDSK<br>NTVYLQMNNLKTEDTAVYYCARAGNF<br>GSSYISYWAYWGQGTLVTVSS<br>(SEQ ID NO: 17536) |
| MA_10-B5_CC_x_I2C0_x_scFc_(H6H)_ | NA AA | No nuc. seq available<br>QTVVTQEPSLTVSPGGTVTLTCGSST<br>GAVTSGNYPNWVQQKPGQAPRGLIGG<br>TKFLAPGTPARFSGSLLGGKAALTLS<br>GVQPEDEAEYYCVLWYSNRWVFGGGT<br>KLTVL<br>(SEQ ID NO: 17528) | No nuc. seq available<br>EVQLVESGGGLVQPGGSLKLSCAASG<br>FTENKYAMNWVRQAPGKGLEWVARIR<br>SKYNNYATYYADVKDRFTISRDDSK<br>NTAYLQMNNLKTEDTAVYYCVRHGNF<br>GNSYISYWAYWGQGTLVTVSS<br>(SEQ ID NO: 17537) |
| MA_10-B5_CC_x_I2E_x_scFc_ | NA AA | No nuc. seq available<br>QTVVTQEPSLTVSPGGTVTITCGSST<br>GAVTSGNYPNWVQQKPGQAPRGLIGG<br>TKFLAPGTPARFSGSLSGGKAALTLS<br>GVQPEDEAEYYCVLWYSNRWVFGSGT<br>KLTVL<br>(SEQ ID NO: 17529) | No nuc. seq available<br>EVQLVESGGGLVQPGGSLKLSCAASG<br>FTENKYAINWVRQAPGKGLEWVARIR<br>SKYNNYATYYADAVKDRFTISRDDSK<br>NTVYLQMNNLKTEDTAVYYCARAGNF<br>GSSYISYWAYWGQGTLVTVSS<br>(SEQ ID NO: 17538) |
| MA_10-B5_CC_x_I2E_x_scFc_variant_ | NA AA | No nuc. seq available<br>QTVVTQEPSLTVSPGGTVTITCGSST<br>GAVTSGNYPNWVQQKPGQAPRGLIGG<br>TKFLAPGTPARFSGSLSGGKAALTLS<br>GVQPEDEAEYYCVLWYSNRWVFGSGT<br>KLTVL<br>(SEQ ID NO: 17530) | No nuc. seq available<br>EVQLVESGGGLVQPGGSLKLSCAASG<br>FTENKYAINWVRQAPGKGLEWVARIR<br>SKYNNYATYYADAVKDRFTISRDDSK<br>NTVYLQMNNLKTEDTAVYYCARAGNF<br>GSSYISYWAYWGQGTLVTVSS<br>(SEQ ID NO: 17539) |
| MA_98-C7_CC_x_I2C0_x_scFc_(Y8P)_ | NA AA | No nuc. seq available<br>QTVVTQEPSLTVSPGGTVTLTCGSST<br>GAVTSGNYPNWVQQKPGQAPRGLIGG<br>TKFLAPGTPARFSGSLLGGKAALTLS<br>GVQPEDEAEYYCVLWYSNRWVEGGGT<br>KLTVL<br>(SEQ ID NO: 17531) | No nuc. seq available<br>EVQLVESGGGLVQPGGSLKLSCAASG<br>FTENKYAMNWVRQAPGKGLEWVARIR<br>SKYNNYATYYADSVKDRFTISRDDSK<br>NTAYLQMNNLKTEDTAVYYCVRHGNF<br>GNSYISYWAYWGQGTLVTVSS<br>(SEQ ID NO: 17540) |
| MA_98-C7_CC_x_I2E_x_scFc_ | NA AA | No nuc. seq available<br>QTVVTQEPSLTVSPGGTVTITCGSST<br>GAVTSGNYPNWVQQKPGQAPRGLIGG<br>TKFLAPGTPARFSGSLSGGKAALTLS<br>GVQPEDEAEYYCVLWYSNRWVFGSGT<br>KLTVL<br>(SEQ ID NO: 17532) | No nuc. seq available<br>EVQLVESGGGLVQPGGSLKLSCAASG<br>FTENKYAINWVRQAPGKGLEWVARIR<br>SKYNNYATYYADAVKDRFTISRDDSK<br>NTVYLQMNNLKTEDTAVYYCARAGNF<br>GSSYISYWAYWGQGTLVTVSS<br>(SEQ ID NO: 17541) |
| MA_98-C7_CC_x_I2E_x_scFc_variant_ | NA AA | No nuc. seq available<br>QTVVTQEPSLTVSPGGTVTITCGSST<br>GAVTSGNYPNWVQQKPGQAPRGLIGG<br>TKFLAPGTPARFSGSLSGGKAALTLS<br>GVQPEDEAEYYCVLWYSNRWVFGSGT<br>KLTVL<br>(SEQ ID NO: 17533) | No nuc. seq available<br>EVQLVESGGGLVQPGGSLKLSCAASG<br>FTENKYAINWVRQAPGKGLEWVARIR<br>SKYNNYATYYADAVKDRFTISRDDSK<br>NTVYLQMNNLKTEDTAVYYCARAGNF<br>GSSYISYWAYWGQGTLVTVSS<br>(SEQ ID NO: 17542) |

TABLE 92

BiTE-scFc_Variable Region Protein Alignment
CDRs defined by Kabat
Alignment numbering defined by Amgen Reference (AHo)

KAPPA VARIABLE

| | Germline | | SEQ ID NO: |
|---|---|---|---|
| | | K_FR1 | |
| VK1\|O12/JK1 | | DIQMTQSPSSLSASVGDRVTITC | 17543 |
| MA_10-B5_CC_x_I2C0_x_scFc_(H6H)_Fv#1 | VK1\|O12/JK1 | DIQMTQSPSSLSASVGDRVTITC | 17544 |
| MA_10-B5_CC_x_I2E_x_scFc_Fv#1 | VK1\|O12/JK1 | DIQMTQSPSSLSASVGDRVTITC | 17545 |
| MA_10-B5_CC_x_I2E_x_scFc_variant_Fv#1 | VK1\|O12/JK1 | DIQMTQSPSSLSASVGDRVTITC | 17546 |
| | | K_CDR1 | |
| VK1\|O12/JK1 | | RAS--QSIS------SYLN | 17586 |
| MA_10-B5_CC_x_I2C0_x_scFc_(H6H)_Fv#1 | VK1\|O12/JK1 | RTS--QSIS------SYLN | 17587 |
| MA_10-B5_CC_x_I2E_x_scFc_Fv#1 | VK1\|O12/JK1 | RTS--QSIS------SYLN | 17588 |
| MA_10-B5_CC_x_I2E_x_scFc_variant_Fv#1 | VK1\|O12/JK1 | RTS--QSIS------SYLN | 17589 |
| | | K_FR2 | |
| VK1\|O12/JK1 | | WYQQKPGKAPKLLIY | 17629 |
| MA_10-B5_CC_x_I2C0_x_scFc_(H6H)_Fv#1 | VK1\|O12/JK1 | WYQQKPGRAPKLLIF | 17630 |
| MA_10-B5_CC_x_I2E_x_scFc_Fv#1 | VK1\|O12/JK1 | WYQQKPGRAPKLLIF | 17631 |
| MA_10-B5_CC_x_I2E_x_scFc_variant_Fv#1 | VK1\|O12/JK1 | WYQQKPGRAPKLLIF | 17632 |

LAMBDA VARIABLE

| | Germline | | SEQ ID NO: |
|---|---|---|---|
| | | L_FR1 | |
| VL3\|3h/JL2 | | SYVLTQP-PSVSVAPGKTARITC | 17547 |
| MA_03-G10_AS_CC_x_I2C0_x_scFc_(N3H)_Fv#1 | VL3\|3h/JL2 | SYVLTQP-PSVSVAPGQTARITC | 17548 |
| MA_03-G10_AS_CC_x_I2E_x_scFc_Fv#1 | VL3\|3h/JL2 | SYVLTQP-PSVSVAPGQTARITC | 17549 |
| MA_03-G10_AS_CC_x_I2E_x_scFc_variant_Fv#1 | VL3\|3h/JL2 | SYVLTQP-PSVSVAPGQTARITC | 17550 |
| MA_98-C7_CC_x_I2C0_x_scFc_(Y8P)_Fv#1 | VL3\|3h/JL2 | SYVLTQP-PSVSVAPGQTARITC | 17551 |
| MA_98-C7_CC_x_I2E_x_scFc_Fv#1 | VL3\|3h/JL2 | SYVLTQP-PSVSVAPGQTARITC | 17552 |
| MA_98-C7_CC_x_I2E_x_scFc_variant_Fv#1 | VL3\|3h/JL2 | SYVLTQP-PSVSVAPGQTARITC | 17553 |
| VL7\|7a/JL3b | | QTVVTQE-PSLTVSPGGTVTLTC | 17554 |
| MA_03-G10_AS_CC_x_I2C0_x_scFc_(N3H)_Fv#2 | VL7\|7a/JL3b | QTVVTQE-PSLTVSPGGTVTLTC | 17555 |
| MA_03-G10_AS_CC_x_I2E_x_scFc_Fv#2 | VL7\|7a/JL3b | QTVVTQE-PSLTVSPGGTVTITC | 17556 |
| MA_03-G10_AS_CC_x_I2E_x_scFc_variant_Fv#2 | VL7\|7a/JL3b | QTVVTQE-PSLTVSPGGTVTITC | 17557 |
| MA_10-B5_CC_x_I2C0_x_scFc_(H6H)_Fv#2 | VL7\|7a/JL3b | QTVVTQE-PSLTVSPGGTVTLTC | 17558 |
| MA_10-B5_CC_x_I2E_x_scFc_Fv#2 | VL7\|7a/JL3b | QTVVTQE-PSLTVSPGGTVTITC | 17559 |
| MA_10-B5_CC_x_I2E_x_scFc_variant_Fv#2 | VL7\|7a/JL3b | QTVVTQE-PSLTVSPGGTVTITC | 17560 |
| MA_98-C7_CC_x_I2C0_x_scFc_(Y8P)_Fv#2 | VL7\|7a/JL3b | QTVVTQE-PSLTVSPGGTVTITC | 17561 |
| MA_98-C7_CC_x_I2E_x_scFc_Fv#2 | VL7\|7a/JL3b | QTVVTQE-PSLTVSPGGTVTITC | 17562 |
| MA_98-C7_CC_x_I2E_x_scFc_variant_Fv#2 | VL7\|7a/JL3b | QTVVTQE-PSLTVSPGGTVTITC | 17563 |

TABLE 92-continued

BiTE-scFc_Variable Region Protein Alignment
CDRs defined by Kabat
Alignment numbering defined by Amgen Reference (AHo)

| | | L_CDR1 | |
|---|---|---|---|
| VL3\|3h/JL2 | | GGN---NIGS-----KSVH | 17590 |
| MA_03-G10_AS_CC_x_I2C0_x_scFc_(N3H)_Fv#1 | VL3\|3h/JL2 | GGN---NIGS-----KSVH | 17591 |
| MA_03-G10_AS_CC_x_I2E_x_scFc_Fv#1 | VL3\|3h/JL2 | GGN---NIGS-----KSVH | 17592 |
| MA_03-G10_AS_CC_x_I2E_x_scFc_variant_Fv#1 | VL3\|3h/JL2 | GGN---NIGS-----KSVH | 17593 |
| MA_98-C7_CC_x_I2C0_x_scFc_(Y8P)_Fv#1 | VL3\|3h/JL2 | GGN---NIGS-----KSVH | 17594 |
| MA_98-C7_CC_x_I2E_x_scFc_Fv#1 | VL3\|3h/JL2 | GGN---NIGS-----KSVH | 17595 |
| MA_98-C7_CC_x_I2E_x_scFc_variant_Fv#1 | VL3\|3h/JL2 | GGN---NIGS-----KSVH | 17596 |
| VL7\|7a/JL3b | | ASST-GAVTSG----YYPN | 17597 |
| MA_03-G10_AS_CC_x_I2C0_x_scFc_(N3H)_Fv#2 | VL7\|7a/JL3b | GSST-GAVTSG----NYPN | 17598 |
| MA_03-G10_AS_CC_x_I2E_x_scFc_Fv#2 | VL7\|7a/JL3b | GSST-GAVTSG----NYPN | 17599 |
| MA_03-G10_AS_CC_x_I2E_x_scFc_variant_Fv#2 | VL7\|7a/JL3b | GSST-GAVTSG----NYPN | 17600 |
| MA_10-B5_CC_x_I2C0_x_scFc_(H6H)_Fv#2 | VL7\|7a/JL3b | GSST-GAVTSG----NYPN | 17601 |
| MA_10-B5_CC_x_I2E_x_scFc_Fv#2 | VL7\|7a/JL3b | GSST-GAVTSG----NYPN | 17602 |
| MA_10-B5_CC_x_I2E_x_scFc_variant_Fv#2 | VL7\|7a/JL3b | GSST-GAVTSG----NYPN | 17603 |
| MA_98-C7_CC_x_I2C0_x_scFc_(Y8P)_Fv#2 | VL7\|7a/JL3b | GSST-GAVTSG----NYPN | 17604 |
| MA_98-C7_CC_x_I2E_x_scFc_Fv#2 | VL7\|7a/JL3b | GSST-GAVTSG----NYPN | 17605 |
| MA_98-C7_CC_x_I2E_x_scFc_variant_Fv#2 | VL7\|7a/JL3b | GSST-GAVTSG----NYPN | 17606 |
| | | L_FR2 | |
| VL3\|3h/JL2 | | WYQQKPGQAPVLVIY | 17633 |
| MA_03-G10_AS_CC_x_I2C0_x_scFc_(N3H)_Fv#1 | VL3\|3h/JL2 | WYQQKPGQAPVMVVY | 17634 |
| MA_03-G10_AS_CC_x_I2E_x_scFc_Fv#1 | VL3\|3h/JL2 | WYQQKPGQAPVMVVY | 17635 |
| MA_03-G10_AS_CC_x_I2E_x_scFc_variant_Fv#1 | VL3\|3h/JL2 | WYQQKPGQAPVMVVY | 17636 |
| MA_98-C7_CC_x_I2C0_x_scFc_(Y8P)_Fv#1 | VL3\|3h/JL2 | WYQQKPGQAPVMVVY | 17637 |
| MA_98-C7_CC_x_I2E_x_scFc_Fv#1 | VL3\|3h/JL2 | WYQQKPGQAPVMVVY | 17638 |
| MA_98-C7_CC_x_I2E_x_scFc_variant_Fv#1 | VL3\|3h/JL2 | WYQQKPGQAPVMVVY | 17639 |
| VL7\|7a/JL3b | | WFQQKPGQAPRALIY | 17640 |
| MA_03-G10_AS_CC_x_I2C0_x_scFc_(N3H)_Fv#2 | VL7\|7a/JL3b | WVQQKPGQAPRGLIG | 17641 |
| MA_03-G10_AS_CC_x_I2E_x_scFc_Fv#2 | VL7\|7a/JL3b | WVQKKPGQAPRGLIG | 17642 |
| MA_03-G10_AS_CC_x_I2E_x_scFc_variant_Fv#2 | VL7\|7a/JL3b | WVQKKPGQAPRGLIG | 17643 |
| MA_10-B5_CC_x_I2C0_x_scFc_(H6H)_Fv#2 | VL7\|7a/JL3b | WVQQKPGQAPRGLIG | 17644 |
| MA_10-B5_CC_x_I2E_x_scFc_Fv#2 | VL7\|7a/JL3b | WVQKKPGQAPRGLIG | 17645 |
| MA_10-B5_CC_x_I2E_x_scFc_variant_Fv#2 | VL7\|7a/JL3b | WVQKKPGQAPRGLIG | 17646 |
| MA_98-C7_CC_x_I2C0_x_scFc_(Y8P)_Fv#2 | VL7\|7a/JL3b | WVQKKPGQAPRGLIG | 17647 |

TABLE 92-continued

BiTE-scFc_Variable Region Protein Alignment
CDRs defined by Kabat
Alignment numbering defined by Amgen Reference (AHo)

| | | | |
|---|---|---|---|
| MA_98-C7_CC_x_I2E_x_scFc_Fv#2 | VL7\|7a/JL3b | WVQKKPGQAPRGLIG | 17648 |
| MA_98-C7_CC_x_I2E_x_scFc_variant_Fv#2 | VL7\|7a/JL3b | WVQKKPGQAPRGLIG | 17649 |

HEAVY VARIABLE

| | Germline | | SEQ ID NO: |
|---|---|---|---|
| | | H_FR1 | |
| VH3\|3-23/D6\|6-19\|RF2/JH4 | | QLLES-GGGLVQPGGSLRLSCAASG-FT | 17564 |
| MA_03-G10_AS_CC_x_I2C0_x_scFc_(N3H)_Fv#1 | VH3\|3-23/D6\|6-19\|RF2/JH4 | QLLES-GGGLVQPGGSLRLSCAASG-FT | 17565 |
| MA_03-G10_AS_CC_x_I2E_x_scFc_Fv#1 | VH3\|3-23/D6\|6-19\|RF2/JH4 | QLLES-GGGLVQPGGSLRLSCAASG-FT | 17566 |
| MA_03-G10_AS_CC_x_I2E_x_scFc_variant_Fv#1 | VH3\|3-23/D6\|6-19\|RF2/JH4 | QLLES-GGGLVQPGGSLRLSCAASG-FT | 17567 |
| MA_98-C7_CC_x_I2C0_x_scFc_(Y8P)_Fv#1 | VH3\|3-23/D6\|6-19\|RF2/JH4 | QLLES-GGGLVQPGGSLRLSCAASG-FT | 17568 |
| MA_98-C7_CC_x_I2E_x_scFc_Fv#1 | VH3\|3-23/D6\|6-19\|RF2/JH4 | QLLES-GGGLVQPGGSLRLSCAASG-FT | 17569 |
| MA_98-C7_CC_x_I2E_x_scFc_variant_Fv#1 | VH3\|3-23/D6\|6-19\|RF2/JH4 | QLLES-GGGLVQPGGSLRLSCAASG-FT | 17570 |
| VH3\|3-73/D3\|3-3\|RF3/JH4 | | QLVES-GGGLVQPGGSLKLSCAASG-FT | 17571 |
| MA_03-G10_AS_CC_x_I2C0_x_scFc_(N3H)_Fv#2 | VH3\|3-73/D3\|3-3\|RF3/JH4 | QLVES-GGGLVQPGGSLKLSCAASG-FT | 17572 |
| MA_10-B5_CC_x_I2C0_x_scFc_(H6H)_Fv#2 | VH3\|3-73/D3\|3-3\|RF3/JH4 | QLVES-GGGLVQPGGSLKLSCAASG-FT | 17573 |
| MA_98-C7_CC_x_I2C0_x_scFc_(Y8P)_Fv#2 | VH3\|3-73/D3\|3-3\|RF3/JH4 | QLVES-GGGLVQPGGSLKLSCAASG-FT | 17574 |
| VH3\|3-73/D2\|2-21\|RF2/JH4 | | QLVES-GGGLVQPGGSLKLSCAASG-FT | 17575 |
| MA_03-G10_AS_CC_x_I2E_x_scFc_Fv#2 | VH3\|3-73/D2\|2-21\|RF2/JH4 | QLVES-GGGLVQPGGSLKLSCAASG-FT | 17576 |
| MA_03-G10_AS_CC_x_I2E_x_scFc_variant_Fv#2 | VH3\|3-73/D2\|2-21\|RF2/JH4 | QLVES-GGGLVQPGGSLKLSCAASG-FT | 17577 |
| MA_10-B5_CC_x_I2E_x_scFc_Fv#2 | VH3\|3-73/D2\|2-21\|RF2/JH4 | QLVES-GGGLVQPGGSLKLSCAASG-FT | 17578 |
| MA_10-B5_CC_x_I2E_x_scFc_variant_Fv#2 | VH3\|3-73/D2\|2-21\|RF2/JH4 | QLVES-GGGLVQPGGSLKLSCAASG-FT | 17579 |
| MA_98-C7_CC_x_I2E_x_scFc_Fv#2 | VH3\|3-73/D2\|2-21\|RF2/JH4 | QLVES-GGGLVQPGGSLKLSCAASG-FT | 17580 |
| MA_98-C7_CC_x_I2E_x_scFc_variant_Fv#2 | VH3\|3-73/D2\|2-21\|RF2/JH4 | QLVES-GGGLVQPGGSLKLSCAASG-FT | 17581 |
| VH3\|3-15/D3\|3-10\|RF2/JH6 | | QLVES-GGGLVKPGGSLRLSCAASG-FT | 17582 |
| MA_10-B5_CC_x_I2C0_x_scFc_(H6H)_Fv#1 | VH3\|3-15/D3\|3-10\|RF2/JH6 | QLVES-GGGLVQPGGSLRLSCAASG-FT | 17583 |
| MA_10-B5_CC_x_I2E_x_scFc_Fv#1 | VH3\|3-15/D3\|3-10\|RF2/JH6 | QLVES-GGGLVQPGGSLRLSCAASG-FT | 17584 |
| MA_10-B5_CC_x_I2E_x_scFc_variant_Fv#1 | VH3\|3-15/D3\|3-10\|RF2/JH6 | QLVES-GGGLVQPGGSLRLSCAASG-FT | 17585 |

TABLE 92-continued

BiTE-scFc_Variable Region Protein Alignment
CDRs defined by Kabat
Alignment numbering defined by Amgen Reference (AHo)

| | | H_CDR1 | |
|---|---|---|---|
| VH3\|3-23/D6\|6-19\|RF2/JH4 | | S-----YAMS | 17607 |
| MA_03-G10_AS_CC_x_I2C0_x_scFc_(N3H)_Fv#1 | VH3\|3-23/D6\|6-19\|RF2/JH4 | S-----YAMS | 17608 |
| MA_03-G10_AS_CC_x_I2E_x_scFc_Fv#1 | VH3\|3-23/D6\|6-19\|RF2/JH4 | S-----YAMS | 17609 |
| MA_03-G10_AS_CC_x_I2E_x_scFc_variant_Fv#1 | VH3\|3-23/D6\|6-19\|RF2/JH4 | S-----YAMS | 17610 |
| MA_98-C7_CC_x_I2C0_x_scFc_(Y8P)_Fv#1 | VH3\|3-23/D6\|6-19\|RF2/JH4 | S-----YAMS | 17611 |
| MA_98-C7_CC_x_I2E_x_scFc_Fv#1 | VH3\|3-23/D6\|6-19\|RF2/JH4 | S-----HAMS | 17612 |
| MA_98-C7_CC_x_I2E_x_scFc_variant_Fv#1 | VH3\|3-23/D6\|6-19\|RF2/JH4 | S-----HAMS | 17613 |
| VH3\|3-73/D3\|3-3\|RF3/JH4 | | G-----SAMH | 17614 |
| MA_03-G10_AS_CC_x_I2C0_x_scFc_(N3H)_Fv#2 | VH3\|3-73/D3\|3-3\|RF3/JH4 | K-----YAMN | 17615 |
| MA_10-B5_CC_x_I2C0_x_scFc_(H6H)_Fv#2 | VH3\|3-73/D3\|3-3\|RF3/JH4 | K-----YAMN | 17616 |
| MA_98-C7_CC_x_I2C0_x_scFc_(Y8P)_Fv#2 | VH3\|3-73/D3\|3-3\|RF3/JH4 | K-----YAMN | 17617 |
| VH3\|3-73/D2\|2-21\|RF2/JH4 | | G-----SAMH | 17618 |
| MA_03-G10_AS_CC_x_I2E_x_scFc_Fv#2 | VH3\|3-73/D2\|2-21\|RF2/JH4 | K-----YAIN | 17619 |
| MA_03-G10_AS_CC_x_I2E_x_scFc_variant_Fv#2 | VH3\|3-73/D2\|2-21\|RF2/JH4 | K-----YAIN | 17620 |
| MA_10-B5_CC_x_I2E_x_scFc_Fv#2 | VH3\|3-73/D2\|2-21\|RF2/JH4 | K-----YAIN | 17621 |
| MA_10-B5_CC_x_I2E_x_scFc_variant_Fv#2 | VH3\|3-73/D2\|2-21\|RF2/JH4 | K-----YAIN | 17622 |
| MA_98-C7_CC_x_I2E_x_scFc_Fv#2 | VH3\|3-73/D2\|2-21\|RF2/JH4 | K-----YAIN | 17623 |
| MA_98-C7_CC_x_I2E_x_scFc_variant_Fv#2 | VH3\|3-73/D2\|2-21\|RF2/JH4 | K-----YAIN | 17624 |
| VH3\|3-15/D3\|3-10\|RF2/JH6 | | N-----AWMS | 17625 |
| MA_10-B5_CC_x_I2C0_x_scFc_(H6H)_Fv#1 | VH3\|3-15/D3\|3-10\|RF2/JH6 | N-----AWMS | 17626 |
| MA_10-B5_CC_x_I2E_x_scFc_Fv#1 | VH3\|3-15/D3\|3-10\|RF2/JH6 | N-----AWMS | 17627 |
| MA_10-B5_CC_x_I2E_x_scFc_variant_Fv#1 | VH3\|3-15/D3\|3-10\|RF2/JH6 | N-----AWMS | 17628 |
| | | H_FR2 | |
| VH3\|3-23/D6\|6-19\|RF2/JH4 | | WVRQAPGKGLEWVS | 17650 |
| MA_03-G10_AS_CC_x_I2C0_x_scFc_(N3H)_Fv#1 | VH3\|3-23/D6\|6-19\|RF2/JH4 | WVRQAPGKCLEWVS | 17651 |
| MA_03-G10_AS_CC_x_I2E_x_scFc_Fv#1 | VH3\|3-23/D6\|6-19\|RF2/JH4 | WVRQAPGKCLEWVS | 17652 |
| MA_03-G10_AS_CC_x_I2E_x_scFc_variant_Fv#1 | VH3\|3-23/D6\|6-19\|RF2/JH4 | WVRQAPGKCLEWVS | 17653 |

TABLE 92-continued

BiTE-scFc_Variable Region Protein Alignment
CDRs defined by Kabat
Alignment numbering defined by Amgen Reference (AHo)

| Name | Germline | Sequence | SEQ ID NO: |
|---|---|---|---|
| MA_98-C7_CC_x_I2C0_x_scFc_(Y8P)_Fv#1 | VH3\|3-23/D6\|6-19\|RF2/JH4 | WVRQAPGKCLEWVS | 17654 |
| MA_98-C7_CC_x_I2E_x_scFc_Fv#1 | VH3\|3-23/D6\|6-19\|RF2/JH4 | WVRQAPGKCLEWVS | 17655 |
| MA_98-C7_CC_x_I2E_x_scFc_variant_Fv#1 | VH3\|3-23/D6\|6-19\|RF2/JH4 | WVRQAPGKCLEWVS | 17656 |
| VH3\|3-73/D3\|3-3\|RF3/JH4 | | WVRQASGKGLEWVG | 17657 |
| MA_03-G10_AS_CC_x_I2C0_x_scFc_(N3H)_Fv#2 | VH3\|3-73/D3\|3-3\|RF3/JH4 | WVRQAPGKGLEWVA | 17658 |
| MA_10-B5_CC_x_I2C0_x_scFc_(H6H)_Fv#2 | VH3\|3-73/D3\|3-3\|RF3/JH4 | WVRQAPGKGLEWVA | 17659 |
| MA_98-C7_CC_x_I2C0_x_scFc_(Y8P)_Fv#2 | VH3\|3-73/D3\|3-3\|RF3/JH4 | WVRQAPGKGLEWVA | 17660 |
| VH3\|3-73/D2\|2-21\|RF2/JH4 | | WVRQASGKGLEWVG | 17661 |
| MA_03-G10_AS_CC_x_I2E_x_scFc_Fv#2 | VH3\|3-73/D2\|2-21\|RF2/JH4 | WVRQAPGKGLEWVA | 17662 |
| MA_03-G10_AS_CC_x_I2E_x_scFc_variant_Fv#2 | VH3\|3-73/D2\|2-21\|RF2/JH4 | WVRQAPGKGLEWVA | 17663 |
| MA_10-B5_CC_x_I2E_x_scFc_Fv#2 | VH3\|3-73/D2\|2-21\|RF2/JH4 | WVRQAPGKGLEWVA | 17664 |
| MA_10-B5_CC_x_I2E_x_scFc_variant_Fv#2 | VH3\|3-73/D2\|2-21\|RF2/JH4 | WVRQAPGKGLEWVA | 17665 |
| MA_98-C7_CC_x_I2E_x_scFc_Fv#2 | VH3\|3-73/D2\|2-21\|RF2/JH4 | WVRQAPGKGLEWVA | 17666 |
| MA_98-C7_CC_x_I2E_x_scFc_variant_Fv#2 | VH3\|3-73/D2\|2-21\|RF2/JH4 | WVRQAPGKGLEWVA | 17667 |
| VH3\|3-15/D3\|3-10\|RF2/JH6 | | WVRQAPGKGLEWVG | 17668 |
| MA_10-B5_CC_x_I2C0_x_scFc_(H6H)_Fv#1 | VH3\|3-15/D3\|3-10\|RF2/JH6 | WVRQAPGKCLEWVG | 17669 |
| MA_10-B5_CC_x_I2E_x_scFc_Fv#1 | VH3\|3-15/D3\|3-10\|RF2/JH6 | WVRQAPGKCLEWVG | 17670 |
| MA_10-B5_CC_x_I2E_x_scFc_variant_Fv#1 | VH3\|3-15/D3\|3-10\|RF2/JH6 | WVRQAPGKCLEWVG | 17671 |

| KAPPA VARIABLE | | | |
|---|---|---|---|
| | Germline | | SEQ ID NO: |
| | | K_CDR2 | |
| VK1\|O12/JK1 | | A--------ASSLQS | 17672 |
| MA_10-B5_CC_x_I2C0_x_scFc_(H6H)_Fv#1 | VK1\|O12/JK1 | A--------ASSLQG | 17673 |
| MA_10-B5_CC_x_I2E_x_scFc_Fv#1 | VK1\|O12/JK1 | A--------ASSLQG | 17674 |
| MA_10-B5_CC_x_I2E_x_scFc_variant_Fv#1 | VK1\|O12/JK1 | A--------ASSLQG | 17675 |
| | | K_FR3 | |
| VK1\|O12/JK1 | | GVPSRFSGSGSG--TDFTLTISSLQPEDFATYYC | 17715 |
| MA_10-B5_CC_x_I2C0_x_scFc_(H6H)_Fv#1 | VK1\|O12/JK1 | GVPSRFSGSGSG--TDFTLTISSLQPEDFATYYC | 17716 |
| MA_10-B5_CC_x_I2E_x_scFc_Fv#1 | VK1\|O12/JK1 | GVPSRFSGSGSG--TDFTLTISSLQPEDFATYYC | 17717 |
| MA_10-B5_CC_x_I2E_x_scFc_variant_Fv#1 | VK1\|O12/JK1 | GVPSRFSGSGSG--TDFTLTISSLQPEDFATYYC | 17718 |

TABLE 92-continued

BiTE-scFc_Variable Region Protein Alignment
CDRs defined by Kabat
Alignment numbering defined by Amgen Reference (AHo)

LAMBDA VARIABLE

| | Germline | | SEQ ID NO: |
|---|---|---|---|
| | | L_CDR2 | |
| VL3\|3h/JL2 | | Y--------DSDRPS | 17676 |
| MA_03-G10_AS_CC_x_I2C0_x_scFc_(N3H)_Fv#1 | VL3\|3h/JL2 | D--------DNDRPS | 17677 |
| MA_03-G10_AS_CC_x_I2E_x_scFc_Fv#1 | VL3\|3h/JL2 | D--------DNDRPS | 17678 |
| MA_03-G10_AS_CC_x_I2E_x_scFc_variant_Fv#1 | VL3\|3h/JL2 | D--------DNDRPS | 17679 |
| MA_98-C7_CC_x_I2C0_x_scFc_(Y8P)_Fv#1 | VL3\|3h/JL2 | D--------DNDRPS | 17680 |
| MA_98-C7_CC_x_I2E_x_scFc_Fv#1 | VL3\|3h/JL2 | D--------DNDRPS | 17681 |
| MA_98-C7_CC_x_I2E_x_scFc_variant_Fv#1 | VL3\|3h/JL2 | D--------DNDRPS | 17682 |
| | | L_FR3 | |
| VL3\|3h/JL2 | | GIPERFSGSNSG--NTATLTISRVEAGDEADYYC | 17719 |
| MA_03-G10_AS_CC_x_I2C0_x_scFc_(N3H)_Fv#1 | VL3\|3h/JL2 | GIPERFSGSNSG--NTATLTISRVEAGDEADYYC | 17720 |
| MA_03-G10_AS_CC_x_I2E_x_scFc_Fv#1 | VL3\|3h/JL2 | GIPERFSGSNSG--NTATLTISRVEAGDEADYYC | 17721 |
| MA_03-G10_AS_CC_x_I2E_x_scFc_variant_Fv#1 | VL3\|3h/JL2 | GIPERFSGSNSG--NTATLTISRVEAGDEADYYC | 17722 |
| MA_98-C7_CC_x_I2C0_x_scFc_(Y8P)_Fv#1 | VL3\|3h/JL2 | GIPERFSGSNSG--NTATLTISRVEAGDEADYYC | 17723 |
| MA_98-C7_CC_x_I2E_x_scFc_Fv#1 | VL3\|3h/JL2 | GIPERFSGSNSG--NTATLTISRVEAGDEADYYC | 17724 |
| MA_98-C7_CC_x_I2E_x_scFc_variant_Fv#1 | VL3\|3h/JL2 | GIPERFSGSNSG--NTATLTISRVEAGDEADYYC | 17725 |
| | | L_CDR2 | |
| VL7\|7a/JL3b | | S--------TSNKHS | 17683 |
| MA_03-G10_AS_CC_x_I2C0_x_scFc_(N3H)_Fv#2 | VL7\|7a/JL3b | G--------TKFLAP | 17684 |
| MA_03-G10_AS_CC_x_I2E_x_scFc_Fv#2 | VL7\|7a/JL3b | G--------TKFLAP | 17685 |
| MA_03-G10_AS_CC_x_I2E_x_scFc_variant_Fv#2 | VL7\|7a/JL3b | G--------TKFLAP | 17686 |
| MA_10-B5_CC_x_I2C0_x_scFc_(H6H)_Fv#2 | VL7\|7a/JL3b | G--------TKFLAP | 17687 |
| MA_10-B5_CC_x_I2E_x_scFc_Fv#2 | VL7\|7a/JL3b | G--------TKFLAP | 17688 |
| MA_10-B5_CC_x_I2E_x_scFc_variant_Fv#2 | VL7\|7a/JL3b | G--------TKFLAP | 17689 |
| MA_98-C7_CC_x_I2C0_x_scFc_(Y8P)_Fv#2 | VL7\|7a/JL3b | G--------TKFLAP | 17690 |
| MA_98-C7_CC_x_I2E_x_scFc_Fv#2 | VL7\|7a/JL3b | G--------TKFLAP | 17691 |
| MA_98-C7_CC_x_I2E_x_scFc_variant_Fv#2 | VL7\|7a/JL3b | G--------TKFLAP | 17692 |
| | | L_FR3 | |
| VL7\|7a/JL3b | | WTPARFSGSLLG--GKAALTLSGVQPEDEAEYYC | 17726 |
| MA_03-G10_AS_CC_x_I2C0_x_scFc_(N3H)_Fv#2 | VL7\|7a/JL3b | GTPARFSGSLLG--GKAALTLSGVQPEDEAEYYC | 17727 |
| MA_03-G10_AS_CC_x_I2E_x_scFc_Fv#2 | VL7\|7a/JL3b | GTPARFSGSLSG--GKAALTLSGVQPEDEAEYYC | 17728 |
| MA_03-G10_AS_CC_x_I2E_x_scFc_variant_Fv#2 | VL7\|7a/JL3b | GTPARFSGSLSG--GKAALTLSGVQPEDEAEYYC | 17729 |

TABLE 92-continued

BiTE-scFc_Variable Region Protein Alignment
CDRs defined by Kabat
Alignment numbering defined by Amgen Reference (AHo)

| | | | SEQ ID NO: |
|---|---|---|---|
| MA_10-B5_CC_x_I2C0_x_scFc_(H6H)_Fv#2 | VL7\|7a/JL3b | GTPARFSGSLLG--GKAALTLSGVQPEDEAEYYC | 17730 |
| MA_10-B5_CC_x_I2E_x_scFc_Fv#2 | VL7\|7a/JL3b | GTPARFSGSLSG--GKAALTLSGVQPEDEAEYYC | 17731 |
| MA_10-B5_CC_x_I2E_x_scFc_variant_Fv#2 | VL7\|7a/JL3b | GTPARFSGSLSG--GKAALTLSGVQPEDEAEYYC | 17732 |
| MA_98-C7_CC_x_I2C0_x_scFc_(Y8P)_Fv#2 | VL7\|7a/JL3b | GTPARFSGSLLG--GKAALTLSGVQPEDEAEYYC | 17733 |
| MA_98-C7_CC_x_I2E_x_scFc_Fv#2 | VL7\|7a/JL3b | GTPARFSGSLSG--GKAALTLSGVQPEDEAEYYC | 17734 |
| MA_98-C7_CC_x_I2E_x_scFc_variant_Fv#2 | VL7\|7a/JL3b | GTPARFSGSLSG--GKAALTLSGVQPEDEAEYYC | 17735 |

HEAVY_VARIABLE

| | Germline | | SEQ ID NO: |
|---|---|---|---|
| | | H_CDR2 | |
| VH3\|3-23/D6\|6-19\|RF2/JH4 | | AISGS---GGSTYYADSVKG | 17693 |
| MA_03-G10_AS_CC_x_I2C0_x_scFc_(N3H)_Fv#1 | VH3\|3-23/D6\|6-19\|RF2/JH4 | AISGS---GGGTYYAASVKG | 17694 |
| MA_03-G10_AS_CC_x_I2E_x_scFc_Fv#1 | VH3\|3-23/D6\|6-19\|RF2/JH4 | AISGS---GGGTYYAASVKG | 17695 |
| MA_03-G10_AS_CC_x_I2E_x_scFc_variant_Fv#1 | VH3\|3-23/D6\|6-19\|RF2/JH4 | AISGS---GGGTYYAASVKG | 17696 |
| MA_98-C7_CC_x_I2C0_x_scFc_(Y8P)_Fv#1 | VH3\|3-23/D6\|6-19\|RF2/JH4 | SISGS---GGGTYYAASVKG | 17697 |
| MA_98-C7_CC_x_I2E_x_scFc_Fv#1 | VH3\|3-23/D6\|6-19\|RF2/JH4 | SISGS---GGGTYYAASVKG | 17698 |
| MA_98-C7_CC_x_I2E_x_scFc_variant_Fv#1 | VH3\|3-23/D6\|6-19\|RF2/JH4 | SISGS---GGGTYYAASVKG | 17699 |
| VH3\|3-73/D3\|3-3\|RF3/JH4 | | RIRSKA-NSYATAYAASVKG | 17700 |
| MA_03-G10_AS_CC_x_I2C0_x_scFc_(N3H)_Fv#2 | VH3\|3-73/D3\|3-3\|RF3/JH4 | RIRSKY-NNYATYYADSVKD | 17701 |
| MA_10-B5_CC_x_I2C0_x_scFc_(H6H)_Fv#2 | VH3\|3-73/D3\|3-3\|RF3/JH4 | RIRSKY-NNYATYYADSVKD | 17702 |
| MA_98-C7_CC_x_I2C0_x_scFc_(Y8P)_Fv#2 | VH3\|3-73/D3\|3-3\|RF3/JH4 | RIRSKY-NNYATYYADSVKD | 17703 |
| VH3\|3-73/D2\|2-21\|RF2/JH4 | | RIRSKA-NSYATAYAASVKG | 17704 |
| MA_03-G10_AS_CC_x_I2E_x_scFc_Fv#2 | VH3\|3-73/D2\|2-21\|RF2/JH4 | RIRSKY-NNYATYYADAVKD | 17705 |
| MA_03-G10_AS_CC_x_I2E_x_scFc_variant_Fv#2 | VH3\|3-73/D2\|2-21\|RF2/JH4 | RIRSKY-NNYATYYADAVKD | 17706 |
| MA_10-B5_CC_x_I2E_x_scFc_Fv#2 | VH3\|3-73/D2\|2-21\|RF2/JH4 | RIRSKY-NNYATYYADAVKD | 17707 |
| MA_10-B5_CC_x_I2E_x_scFc_variant_Fv#2 | VH3\|3-73/D2\|2-21\|RF2/JH4 | RIRSKY-NNYATYYADAVKD | 17708 |
| MA_98-C7_CC_x_I2E_x_scFc_Fv#2 | VH3\|3-73/D2\|2-21\|RF2/JH4 | RIRSKY-NNYATYYADAVKD | 17709 |
| MA_98-C7_CC_x_I2E_x_scFc_variant_Fv#2 | VH3\|3-73/D2\|2-21\|RF2/JH4 | RIRSKY-NNYATYYADAVKD | 17710 |
| VH3\|3-15/D3\|3-10\|RF2/JH6 | | RIKSKT-DGGTTDYAAPVKG | 17711 |
| MA_10-B5_CC_x_I2C0_x_scFc_(H6H)_Fv#1 | VH3\|3-15/D3\|3-10\|RF2/JH6 | RIRSRS-YGGTTDYAAPVKG | 17712 |
| MA_10-B5_CC_x_I2E_x_scFc_Fv#1 | VH3\|3-15/D3\|3-10\|RF2/JH6 | RIRSRS-YGGTTDYAAPVKG | 17713 |

TABLE 92-continued

BiTE-scFc_Variable Region Protein Alignment
CDRs defined by Kabat
Alignment numbering defined by Amgen Reference (AHo)

| | | | |
|---|---|---|---|
| MA_10-B5_CC_x_I2E_x_scFc_variant_Fv#1 | VH3\|3-15/D3\|3-10\|RF2/JH6 | RIRSRS-YGGTTDYAAPVKG | 17714 |
| | | H_FR3 | |
| VH3\|3-23/D6\|6-19\|RF2/JH4 | | RFTISRDNSKNTLYLQMNSLRAEDTAVYYCAK | 17736 |
| MA_03-G10_AS_CC_x_I2C0_x_scFc_(N3H)_Fv#1 | VH3\|3-23/D6\|6-19\|RF2/JH4 | RFTISRDNSKNTLYLQMSSLRAEDTAVYYCAT | 17737 |
| MA_03-G10_AS_CC_x_I2E_x_scFc_Fv#1 | VH3\|3-23/D6\|6-19\|RF2/JH4 | RFTISRDNSKNTLYLQMSSLRAEDTAVYYCAT | 17738 |
| MA_03-G10_AS_CC_x_I2E_x_scFc_variant_Fv#1 | VH3\|3-23/D6\|6-19\|RF2/JH4 | RFTISRDNSKNTLYLQMSSLRAEDTAVYYCAT | 17739 |
| MA_98-C7_CC_x_I2C0_x_scFc_(Y8P)_Fv#1 | VH3\|3-23/D6\|6-19\|RF2/JH4 | RFTISRDNSKNTLYLQMNSLRAEDTAVYYCAT | 17740 |
| MA_98-C7_CC_x_I2E_x_scFc_Fv#1 | VH3\|3-23/D6\|6-19\|RF2/JH4 | RFTISRDNSKNTLYLQMNSLRAEDTAVYYCAT | 17741 |
| MA_98-C7_CC_x_I2E_x_scFc_variant_Fv#1 | VH3\|3-23/D6\|6-19\|RF2/JH4 | RFTISRDNSKNTLYLQMNSLRAEDTAVYYCAT | 17742 |
| VH3\|3-73/D3\|3-3\|RF3/JH4 | | RFTISRDDSKNTAYLQMNSLKTEDTAVYYCTR | 17743 |
| MA_03-G10_AS_CC_x_I2C0_x_scFc_(N3H)_Fv#2 | VH3\|3-73/D3\|3-3\|RF3/JH4 | RFTISRDDSKNTAYLQMNNLKTEDTAVYYCVR | 17744 |
| MA_10-B5_CC_x_I2C0_x_scFc_(H6H)_Fv#2 | VH3\|3-73/D3\|3-3\|RF3/JH4 | RFTISRDDSKNTAYLQMNNLKTEDTAVYYCVR | 17745 |
| MA_98-C7_CC_x_I2C0_x_scFc_(Y8P)_Fv#2 | VH3\|3-73/D3\|3-3\|RF3/JH4 | RFTISRDDSKNTAYLQMNNLKTEDTAVYYCVR | 17746 |
| VH3\|3-73/D2\|2-21\|RF2/JH4 | | RFTISRDDSKNTAYLQMNSLKTEDTAVYYCTR | 17747 |
| MA_03-G10_AS_CC_x_I2E_x_scFc_Fv#2 | VH3\|3-73/D2\|2-21\|RF2/JH4 | RFTISRDDSKNTVYLQMNNLKTEDTAVYYCAR | 17748 |
| MA_03-G10_AS_CC_x_I2E_x_scFc_variant_Fv#2 | VH3\|3-73/D2\|2-21\|RF2/JH4 | RFTISRDDSKNTVYLQMNNLKTEDTAVYYCAR | 17749 |
| MA_10-B5_CC_x_I2E_x_scFc_Fv#2 | VH3\|3-73/D2\|2-21\|RF2/JH4 | RFTISRDDSKNTVYLQMNNLKTEDTAVYYCAR | 17750 |
| MA_10-B5_CC_x_I2E_x_scFc_variant_Fv#2 | VH3\|3-73/D2\|2-21\|RF2/JH4 | RFTISRDDSKNTVYLQMNNLKTEDTAVYYCAR | 17751 |
| MA_98-C7_CC_x_I2E_x_scFc_Fv#2 | VH3\|3-73/D2\|2-21\|RF2/JH4 | RFTISRDDSKNTVYLQMNNLKTEDTAVYYCAR | 17752 |
| MA_98-C7_CC_x_I2E_x_scFc_variant_Fv#2 | VH3\|3-73/D2\|2-21\|RF2/JH4 | RFTISRDDSKNTVYLQMNNLKTEDTAVYYCAR | 17753 |
| VH3\|3-15/D3\|3-10\|RF2/JH6 | | RFTISRDDSKNTLYLQMNSLKTEDTAVYYCTT | 17754 |
| MA_10-B5_CC_x_I2C0_x_scFc_(H6H)_Fv#1 | VH3\|3-15/D3\|3-10\|RF2/JH6 | RFTISRDDSKNTLFLQMNSLKTEDTAVYYCTT | 17755 |
| MA_10-B5_CC_x_I2E_x_scFc_Fv#1 | VH3\|3-15/D3\|3-10\|RF2/JH6 | RFTISRDDSKNTLFLQMNSLKTEDTAVYYCTT | 17756 |
| MA_10-B5_CC_x_I2E_x_scFc_variant_Fv#1 | VH3\|3-15/D3\|3-10\|RF2/JH6 | RFTISRDDSKNTLFLQMNSLKTEDTAVYYCTT | 17757 |

TABLE 92-continued

BiTE-scFc_Variable Region Protein Alignment
CDRs defined by Kabat
Alignment numbering defined by Amgen Reference (AHo)

KAPPA_VARIABLE

| | Germline | | SEQ ID NO: |
|---|---|---|---|
| | | K_CDR3 | |
| VK1\|O12/JK1 | | SYS----------------------TP | 17758 |
| MA_10-B5_CC_x_I2C0_x_scFc_(H6H)_Fv#1 | VK1\|O12/JK1 | TYS----------------------ME | 17759 |
| MA_10-B5_CC_x_I2E_x_scFc_Fv#1 | VK1\|O12/JK1 | TYS----------------------ME | 17760 |
| MA_10-B5_CC_x_I2E_x_scFc_variant_Fv#1 | VK1\|O12/JK1 | TYS----------------------MP | 17761 |
| | | K_FR4 | |
| VK1\|O12/JK1 | | FGQGTKVEIK | 17801 |
| MA_10-B5_CC_x_I2C0_x_scFc_(H6H)_Fv#1 | VK1\|O12/JK1 | FGCGTKVEIK | 17802 |
| MA_10-B5_CC_x_I2E_x_scFc_Fv#1 | VK1\|O12/JK1 | FGCGTKVEIK | 17803 |
| MA_10-B5_CC_x_I2E_x_scFc_variant_Fv#1 | VK1\|O12/JK1 | FGCGTKVEIK | 17804 |

LAMBDA_VARIABLE

| | Germline | | SEQ ID NO: |
|---|---|---|---|
| | | L_CDR3 | |
| VL3\|3h/JL2 | | WDSS--------------------SDH | 17762 |
| MA_03-G10_AS_CC_x_I2C0_x_scFc_(N3H)_Fv#1 | VL3\|3h/JL2 | WDYS--------------------GQR | 17763 |
| MA_03-G10_AS_CC_x_I2E_x_scFc_Fv#1 | VL3\|3h/JL2 | WDYS--------------------GQR | 17764 |
| MA_03-G10_AS_CC_x_I2E_x_scFc_variant_Fv#1 | VL3\|3h/JL2 | WDYS--------------------GQR | 17765 |
| MA_98-C7_CC_x_I2C0_x_scFc_(Y8P)_Fv#1 | VL3\|3h/JL2 | WDYS--------------------PLR | 17766 |
| MA_98-C7_CC_x_I2E_x_scFc_Fv#1 | VL3\|3h/JL2 | WDYS--------------------PLR | 17767 |
| MA_98-C7_CC_x_I2E_x_scFc_variant_Fv#1 | VL3\|3h/JL2 | WDYS--------------------PLR | 17768 |
| VL7\|7a/JL3b | | YYG--------------------GAQ | 17769 |
| MA_03-G10_AS_CC_x_I2C0_x_scFc_(N3H)_Fv#2 | VL7\|7a/JL3b | WYS----------------------NR | 17770 |
| MA_03-G10_AS_CC_x_I2E_x_scFc_Fv#2 | VL7\|7a/JL3b | WYS----------------------NR | 17771 |
| MA_03-G10_AS_CC_x_I2E_x_scFc_variant_Fv#2 | VL7\|7a/JL3b | WYS----------------------NR | 17772 |
| MA_10-B5_CC_x_I2C0_x_scFc_(H6H)_Fv#2 | VL7\|7a/JL3b | WYS----------------------NR | 17773 |
| MA_10-B5_CC_x_I2E_x_scFc_Fv#2 | VL7\|7a/JL3b | WYS----------------------NR | 17774 |
| MA_10-B5_CC_x_I2E_x_scFc_variant_Fv#2 | VL7\|7a/JL3b | WYS----------------------NR | 17775 |
| MA_98-C7_CC_x_I2C0_x_scFc_(Y8P)_Fv#2 | VL7\|7a/JL3b | WYS----------------------NR | 17776 |
| MA_98-C7_CC_x_I2E_x_scFc_Fv#2 | VL7\|7a/JL3b | WYS----------------------NR | 17777 |
| MA_98-C7_CC_x_I2E_x_scFc_variant_Fv#2 | VL7\|7a/JL3b | WYS----------------------NR | 17778 |
| | | L_FR4 | |
| VL3\|3h/JL2 | | FGGGTKLTVL | 17805 |
| MA_03-G10_AS_CC_x_I2C0_x_scFc_(N3H)_Fv#1 | VL3\|3h/JL2 | FGCGTKLTVL | 17806 |

TABLE 92-continued

BiTE-scFc_Variable Region Protein Alignment
CDRs defined by Kabat
Alignment numbering defined by Amgen Reference (AHo)

| Name | Germline | Sequence | SEQ ID NO: |
|---|---|---|---|
| MA_03-G10_AS_CC_x_I2E_x_scFc_Fv#1 | VL3\|3h/JL2 | FGCGTKLTVL | 17807 |
| MA_03-G10_AS_CC_x_I2E_x_scFc_variant_Fv#1 | VL3\|3h/JL2 | FGCGTKLTVL | 17808 |
| MA_98-C7_CC_x_I2C0_x_scFc_(Y8P)_Fv#1 | VL3\|3h/JL2 | FGCGTKLTVL | 17809 |
| MA_98-C7_CC_x_I2E_x_scFc_Fv#1 | VL3\|3h/JL2 | FGCGTKLTVL | 17810 |
| MA_98-C7_CC_x_I2E_x_scFc_variant_Fv#1 | VL3\|3h/JL2 | FGCGTKLTVL | 17811 |
| VL7\|7a/JL3b | | FGGGTKLTVL | 17812 |
| MA_03-G10_AS_CC_x_I2C0_x_scFc_(N3H)_Fv#2 | VL7\|7a/JL3b | FGGGTKLTVL | 17813 |
| MA_03-G10_AS_CC_x_I2E_x_scFc_Fv#2 | VL7\|7a/JL3b | FGSGTKLTVL | 17814 |
| MA_03-G10_AS_CC_x_I2E_x_scFc_variant_Fv#2 | VL7\|7a/JL3b | FGSGTKLTVL | 17815 |
| MA_10-B5_CC_x_I2C0_x_scFc_(H6H)_Fv#2 | VL7\|7a/JL3b | FGGGTKLTVL | 17816 |
| MA_10-B5_CC_x_I2E_x_scFc_Fv#2 | VL7\|7a/JL3b | FGSGTKLTVL | 17817 |
| MA_10-B5_CC_x_I2E_x_scFc_variant_Fv#2 | VL7\|7a/JL3b | FGSGTKLTVL | 17818 |
| MA_98-C7_CC_x_I2C0_x_scFc_(Y8P)_Fv#2 | VL7\|7a/JL3b | FGGGTKLTVL | 17819 |
| MA_98-C7_CC_x_I2E_x_scFc_Fv#2 | VL7\|7a/JL3b | FGSGTKLTVL | 17820 |
| MA_98-C7_CC_x_I2E_x_scFc_variant_Fv#2 | VL7\|7a/JL3b | FGSGTKLTVL | 17821 |

HEAVY_VARIABLE

| | Germline | | SEQ ID NO: |
|---|---|---|---|
| | | H_CDR3 | |
| VH3\|3-23/D6\|6-19\|RF2/JH4 | | IAVA--------------------GYFD | 17779 |
| MA_03-G10_AS_CC_x_I2C0_x_scFc_(N3H)_Fv#1 | VH3\|3-23/D6\|6-19\|RF2/JH4 | KGVH--------------------LGFD | 17780 |
| MA_03-G10_AS_CC_x_I2E_x_scFc_Fv#1 | VH3\|3-23/D6\|6-19\|RF2/JH4 | KGVH--------------------LGFD | 17781 |
| MA_03-G10_AS_CC_x_I2E_x_scFc_variant_Fv#1 | VH3\|3-23/D6\|6-19\|RF2/JH4 | KGVH--------------------LGED | 17782 |
| MA_98-C7_CC_x_I2C0_x_scFc_(Y8P)_Fv#1 | VH3\|3-23/D6\|6-19\|RF2/JH4 | KGVH--------------------LGED | 17783 |
| MA_98-C7_CC_x_I2E_x_scFc_Fv#1 | VH3\|3-23/D6\|6-19\|RF2/JH4 | KGVH--------------------LGED | 17784 |
| MA_98-C7_CC_x_I2E_x_scFc_variant_Fv#1 | VH3\|3-23/D6\|6-19\|RF2/JH4 | KGVH--------------------LGFD | 17785 |
| VH3\|3-73/D3\|3-3\|RF3/JH4 | | TIFGVV----------------IIYFD | 17786 |
| MA_03-G10_AS_CC_x_I2C0_x_scFc_(N3H)_Fv#2 | VH3\|3-73/D3\|3-3\|RF3/JH4 | GNFGNS----------------YISYWA | 17787 |
| MA_10-B5_CC_x_I2C0_x_scFc_(H6H)_Fv#2 | VH3\|3-73/D3\|3-3\|RF3/JH4 | GNFGNS----------------YISYWA | 17788 |
| MA_98-C7_CC_x_I2C0_x_scFc_(Y8P)_Fv#2 | VH3\|3-73/D3\|3-3\|RF3/JH4 | GNFGNS----------------YISYWA | 17789 |
| VH3\|3-73/D2\|2-21\|RF2/JH4 | | YCGGDC----------------YSYED | 17790 |
| MA_03-G10_AS_CC_x_I2E_x_scFc_Fv#2 | VH3\|3-73/D2\|2-21\|RF2/JH4 | GNFGSS----------------YISYWA | 17791 |

TABLE 92-continued

BiTE-scFc_Variable Region Protein Alignment
CDRs defined by Kabat
Alignment numbering defined by Amgen Reference (AHo)

| Name | V/D/J | CDR | SEQ ID NO |
|---|---|---|---|
| MA_03-G10_AS_CC_x_I2E_x_scFc_variant_Fv#2 | VH3\|3-73/D2\|2-21\|RF2/JH4 | GNFGSS----------------YISYWA | 17792 |
| MA_10-B5_CC_x_I2E_x_scFc_Fv#2 | VH3\|3-73/D2\|2-21\|RF2/JH4 | GNFGSS----------------YISYWA | 17793 |
| MA_10-B5_CC_x_I2E_x_scFc_variant_Fv#2 | VH3\|3-73/D2\|2-21\|RF2/JH4 | GNFGSS----------------YISYWA | 17794 |
| MA_98-C7_CC_x_I2E_x_scFc_Fv#2 | VH3\|3-73/D2\|2-21\|RF2/JH4 | GNFGSS----------------YISYWA | 17795 |
| MA_98-C7_CC_x_I2E_x_scFc_variant_Fv#2 | VH3\|3-73/D2\|2-21\|RF2/JH4 | GNFGSS----------------YISYWA | 17796 |
| VH3\|3-15/D3\|3-10\|RF2/JH6 | | YYGSGSYYN-----------YYYYYGMD | 17797 |
| MA_10-B5_CC_x_I2C0_x_scFc_(H6H)_Fv#1 | VH3\|3-15/D3\|3-10\|RF2/JH6 | SYSGSYY--------------NYFSVMD | 17798 |
| MA_10-B5_CC_x_I2E_x_scFc_Fv#1 | VH3\|3-15/D3\|3-10\|RF2/JH6 | SYSGSYY--------------NYFSVMD | 17799 |
| MA_10-B5_CC_x_I2E_x_scFc_variant_Fv#1 | VH3\|3-15/D3\|3-10\|RF2/JH6 | SYSGSYY--------------NYFSVMD | 17800 |
| | | H_FR4 | |
| VH3\|3-23/D6\|6-19\|RF2/JH4 | | WGQGTLVTVSS | 17822 |
| MA_03-G10_AS_CC_x_I2C0_x_scFc_(N3H)_Fv#1 | VH3\|3-23/D6\|6-19\|RF2/JH4 | WGQGTLVTVSS | |
| MA_03-G10_AS_CC_x_I2E_x_scFc_Fv#1 | VH3\|3-23/D6\|6-19\|RF2/JH4 | WGQGTLVTVSS | 17824 |
| MA_03-G10_AS_CC_x_I2E_x_scFc_variant_Fv#1 | VH3\|3-23/D6\|6-19\|RF2/JH4 | WGQGTLVTVSS | 17825 |
| MA_98-C7_CC_x_I2C0_x_scFc_(Y8P)_Fv#1 | VH3\|3-23/D6\|6-19\|RF2/JH4 | WGQGTLVTVSS | 17826 |
| MA_98-C7_CC_x_I2E_x_scFc_Fv#1 | VH3\|3-23/D6\|6-19\|RF2/JH4 | WGQGTLVTVSS | 17827 |
| MA_98-C7_CC_x_I2E_x_scFc_variant_Fv#1 | VH3\|3-23/D6\|6-19\|RF2/JH4 | WGQGTLVTVSS | 17828 |
| VH3\|3-73/D3\|3-3\|RF3/JH4 | | WGQGTLVTVSS | 17829 |
| MA_03-G10_AS_CC_x_I2C0_x_scFc_(N3H)_Fv#2 | VH3\|3-73/D3\|3-3\|RF3/JH4 | WGQGTLVTVSS | 17830 |
| MA_10-B5_CC_x_I2C0_x_scFc_(H6H)_Fv#2 | VH3\|3-73/D3\|3-3\|RF3/JH4 | WGQGTLVTVSS | 17831 |
| MA_98-C7_CC_x_I2C0_x_scFc_(Y8P)_Fv#2 | VH3\|3-73/D3\|3-3\|RF3/JH4 | WGQGTLVTVSS | 17832 |
| VH3\|3-73/D2\|2-21\|RF2/JH4 | | WGQGTLVTVSS | 17833 |
| MA_03-G10_AS_CC_x_I2E_x_scFc_Fv#2 | VH3\|3-73/D2\|2-21\|RF2/JH4 | WGQGTLVTVSS | 17834 |
| MA_03-G10_AS_CC_x_I2E_x_scFc_variant_Fv#2 | VH3\|3-73/D2\|2-21\|RF2/JH4 | WGQGTLVTVSS | 17835 |
| MA_10-B5_CC_x_I2E_x_scFc_Fv#2 | VH3\|3-73/D2\|2-21\|RF2/JH4 | WGQGTLVTVSS | 17836 |
| MA_10-B5_CC_x_I2E_x_scFc_variant_Fv#2 | VH3\|3-73/D2\|2-21\|RF2/JH4 | WGQGTLVTVSS | 17837 |
| MA_98-C7_CC_x_I2E_x_scFc_Fv#2 | VH3\|3-73/D2\|2-21\|RF2/JH4 | WGQGTLVTVSS | 17838 |

TABLE 92-continued

BiTE-scFc_Variable Region Protein Alignment
CDRs defined by Kabat
Alignment numbering defined by Amgen Reference (AHo)

| | | | |
|---|---|---|---|
| MA_98-C7_CC_x_I2E_x_scFc_variant_Fv#2 | VH3\|3-73/D2\|2-21\|RF2/JH4 | WGQGTLVTVSS | 17839 |
| | VH3\|3-15/D3\|3-10\|RF2/JH6 | WGQGTTVTVSS | 17840 |
| MA_10-B5_CC_x_I2C0_x_scFc_(H6H)_Fv#1 | VH3\|3-15/D3\|3-10\|RF2/JH6 | WGQGTTVTVSS | 17841 |
| MA_10-B5_CC_x_I2E_x_scFc_Fv#1 | VH3\|3-15/D3\|3-10\|RF2/JH6 | WGQGTTVTVSS | 17842 |
| MA_10-B5_CC_x_I2E_x_scFc_variant_Fv#1 | VH3\|3-15/D3\|3-10\|RF2/JH6 | WGQGTTVTVSS | 17843 |

TABLE 93

BiTE-scFc Variable Region Concensus Protein Alignment
CDRs defined by Kabat
Alignment numbering defined by Amgen Reference (AHo)

KAPPA_VARIABLE

| | Germline | | SEQ ID NO: |
|---|---|---|---|
| | | K_FR1 | |
| VK1\|O12/JK1 | | DIQMTQSPSSLSASVGDRVTITC | 17844 |
| MA_10-B5_CC_x_I2C0_x_scFc_(H6H)_Fv#1 | VK1\|O12/JK1 | ...................... | 17845 |
| MA_10-B5_CC_x_I2E_x_scFc_Fv#1 | VK1\|O12/JK1 | ...................... | 17846 |
| MA_10-B5_CC_x_I2E_x_scFc_variant_Fv#1 | VK1\|O12/JK1 | ...................... | 17847 |
| | | K_CDR1 | |
| VK1\|O12/JK1 | | RAS--QSIS------SYLN | 17887 |
| MA_10-B5_CC_x_I2C0_x_scFc_(H6H)_Fv#1 | VK1\|O12/JK1 | .T................. | 17888 |
| MA_10-B5_CC_x_I2E_x_scFc_Fv#1 | VK1\|O12/JK1 | .T................. | 17889 |
| MA_10-B5_CC_x_I2E_x_scFc_variant_Fv#1 | VK1\|O12/JK1 | .T................. | 17890 |
| | | K_FR2 | |
| VK1\|O12/JK1 | | WYQQKPGKAPKLLIY | 17930 |
| MA_10-B5_CC_x_I2C0_x_scFc_(H6H)_Fv#1 | VK1\|O12/JK1 | .......R......F | 17931 |
| MA_10-B5_CC_x_I2E_x_scFc_Fv#1 | VK1\|O12/JK1 | .......R......F | 17932 |
| MA_10-B5_CC_x_I2E_x_scFc_variant_Fv#1 | VK1\|O12/JK1 | .......R......F | 17933 |

LAMBDA_VARIABLE

| | Germline | | SEQ ID NO: |
|---|---|---|---|
| | | L_FR1 | |
| VL3\|3h/JL2 | | SYVLTQP-PSVSVAPGKTARITC | 17848 |
| MA_03-G10_AS_CC_x_I2C0_x_scFc_(N3H)_Fv#1 | VL3\|3h/JL2 | ................Q...... | 17849 |
| MA_03-G10_AS_CC_x_I2E_x_scFc_Fv#1 | VL3\|3h/JL2 | ................Q...... | 17850 |
| MA_03-G10_AS_CC_x_I2E_x_scFc_variant_Fv#1 | VL3\|3h/JL2 | ................Q...... | 17851 |
| MA_98-C7_CC_x_I2C0_x_scFc_(Y8P)_Fv#1 | VL3\|3h/JL2 | ................Q...... | 17852 |
| MA_98-C7_CC_x_I2E_x_scFc_Fv#1 | VL3\|3h/JL2 | ................Q...... | 17853 |

TABLE 93-continued

BiTE-scFc Variable Region Concensus Protein Alignment
CDRs defined by Kabat
Alignment numbering defined by Amgen Reference (AHo)

| Name | Type | Sequence | ID |
|---|---|---|---|
| MA_98-C7_CC_x_I2E_x_scFc_variant_Fv#1 | VL3\|3h/JL2 | ................Q...... | 17854 |
| VL7\|7a/JL3b | | QTVVTQE-PSLTVSPGGTVTLTC | 17855 |
| MA_03-G10_AS_CC_x_I2C0_x_scFc_(N3H)_Fv#2 | VL7\|7a/JL3b | ....................... | 17856 |
| MA_03-G10_AS_CC_x_I2E_x_scFc_Fv#2 | VL7\|7a/JL3b | ....................I.. | 17857 |
| MA_03-G10_AS_CC_x_I2E_x_scFc_variant_Fv#2 | VL7\|7a/JL3b | ....................I.. | 17858 |
| MA_10-B5_CC_x_I2C0_x_scFc_(H6H)_Fv#2 | VL7\|7a/JL3b | ....................... | 17859 |
| MA_10-B5_CC_x_I2E_x_scFc_Fv#2 | VL7\|7a/JL3b | ....................I.. | 17860 |
| MA_10-B5_CC_x_I2E_x_scFc_variant_Fv#2 | VL7\|7a/JL3b | ....................I.. | 17861 |
| MA_98-C7_CC_x_I2C0_x_scFc_(Y8P)_Fv#2 | VL7\|7a/JL3b | ....................... | 17862 |
| MA_98-C7_CC_x_I2E_x_scFc_Fv#2 | VL7\|7a/JL3b | ....................I.. | 17863 |
| MA_98-C7_CC_x_I2E_x_scFc_variant_Fv#2 | VL7\|7a/JL3b | ....................I.. | 17864 |
| | | L_CDR1 | |
| VL3\|3h/JL2 | | GGN---NIGS-----KSVH | 17891 |
| MA_03-G10_AS_CC_x_I2C0_x_scFc_(N3H)_Fv#1 | VL3\|3h/JL2 | ................... | 17892 |
| MA_03-G10_AS_CC_x_I2E_x_scFc_Fv#1 | VL3\|3h/JL2 | ................... | 17893 |
| MA_03-G10_AS_CC_x_I2E_x_scFc_variant_Fv#1 | VL3\|3h/JL2 | ................... | 17894 |
| MA_98-C7_CC_x_I2C0_x_scFc_(Y8P)_Fv#1 | VL3\|3h/JL2 | ................... | 17895 |
| MA_98-C7_CC_x_I2E_x_scFc_Fv#1 | VL3\|3h/JL2 | ................... | 17896 |
| MA_98-C7_CC_x_I2E_x_scFc_variant_Fv#1 | VL3\|3h/JL2 | ................... | 17897 |
| VL7\|7a/JL3b | | ASST-GAVTSG----YYPN | 17898 |
| MA_03-G10_AS_CC_x_I2C0_x_scFc_(N3H)_Fv#2 | VL7\|7a/JL3b | G.............N... | 17899 |
| MA_03-G10_AS_CC_x_I2E_x_scFc_Fv#2 | VL7\|7a/JL3b | G.............N... | 17900 |
| MA_03-G10_AS_CC_x_I2E_x_scFc_variant_Fv#2 | VL7\|7a/JL3b | G.............N... | 17901 |
| MA_10-B5_CC_x_I2C0_x_scFc_(H6H)_Fv#2 | VL7\|7a/JL3b | G.............N... | 17902 |
| MA_10-B5_CC_x_I2E_x_scFc_Fv#2 | VL7\|7a/JL3b | G.............N... | 17903 |
| MA_10-B5_CC_x_I2E_x_scFc_variant_Fv#2 | VL7\|7a/JL3b | G.............N... | 17904 |
| MA_98-C7_CC_x_I2C0_x_scFc_(Y8P)_Fv#2 | VL7\|7a/JL3b | G.............N... | 17905 |
| MA_98-C7_CC_x_I2E_x_scFc_Fv#2 | VL7\|7a/JL3b | G.............N... | 17906 |
| MA_98-C7_CC_x_I2E_x_scFc_variant_Fv#2 | VL7\|7a/JL3b | G.............N... | 17907 |
| | | L_FR2 | |
| VL3\|3h/JL2 | | WYQQKPGQAPVLVIY | 17934 |
| MA_03-G10_AS_CC_x_I2C0_x_scFc_(N3H)_Fv#1 | VL3\|3h/JL2 | ...........M.V. | 17935 |
| MA_03-G10_AS_CC_x_I2E_x_scFc_Fv#1 | VL3\|3h/JL2 | ...........M.V. | 17936 |
| MA_03-G10_AS_CC_x_I2E_x_scFc_variant_Fv#1 | VL3\|3h/JL2 | ...........M.V. | 17937 |

TABLE 93-continued

BiTE-scFc Variable Region Concensus Protein Alignment
CDRs defined by Kabat
Alignment numbering defined by Amgen Reference (AHo)

| Name | Germline | Sequence | SEQ ID NO: |
|---|---|---|---|
| MA_98-C7_CC_x_I2C0_x_scFc_(Y8P)_Fv#1 | VL3\|3h/JL2 | ...........M.V. | 17938 |
| MA_98-C7_CC_x_I2E_x_scFc_Fv#1 | VL3\|3h/JL2 | ...........M.V. | 17939 |
| MA_98-C7_CC_x_I2E_x_scFc_variant_Fv#1 | VL3\|3h/JL2 | ...........M.V. | 17940 |
| VL7\|7a/JL3b | | WVQQKPGQAPRALIY | 17941 |
| MA_03-G10_AS_CC_x_I2C0_x_scFc_(N3H)_Fv#2 | VL7\|7a/JL3b | .V.........G..G | 17642 |
| MA_03-G10_AS_CC_x_I2E_x_scFc_Fv#2 | VL7\|7a/JL3b | .V.K.......G..G | 17643 |
| MA_03-G10_AS_CC_x_I2E_x_scFc_variant_Fv#2 | VL7\|7a/JL3b | .V.K.......G..G | 17644 |
| MA_10-B5_CC_x_I2C0_x_scFc_(H6H)_Fv#2 | VL7\|7a/JL3b | .V.........G..G | 17645 |
| MA_10-B5_CC_x_I2E_x_scFc_Fv#2 | VL7\|7a/JL3b | .V.K.......G..G | 17646 |
| MA_10-B5_CC_x_I2E_x_scFc_variant_Fv#2 | VL7\|7a/JL3b | .V.K.......G..G | 17647 |
| MA_98-C7_CC_x_I2C0_x_scFc_(Y8P)_Fv#2 | VL7\|7a/JL3b | .V.........G..G | 17648 |
| MA_98-C7_CC_x_I2E_x_scFc_Fv#2 | VL7\|7a/JL3b | .V.K.......G..G | 17649 |
| MA_98-C7_CC_x_I2E_x_scFc_variant_Fv#2 | VL7\|7a/JL3b | .V.K.......G..G | 17650 |

HEAVY_VARIABLE

| Name | Germline | H_FR1 | SEQ ID NO: |
|---|---|---|---|
| VH3\|3-23/D6\|6-19\|RF2/JH4 | | EVQLLES-GGGLVQPGGSLRLSCAASG-FTFS | 17865 |
| MA_03-G10_AS_CC_x_I2C0_x_scFc_(N3H)_Fv#1 | VH3\|3-23/D6\|6-19\|RF2/JH4 | ............................... | 17866 |
| MA_03-G10_AS_CC_x_I2E_x_scFc_Fv#1 | VH3\|3-23/D6\|6-19\|RF2/JH4 | ............................... | 17867 |
| MA_03-G10_AS_CC_x_I2E_x_scFc_variant_Fv#1 | VH3\|3-23/D6\|6-19\|RF2/JH4 | ............................... | 17868 |
| MA_98-C7_CC_x_I2C0_x_scFc_(Y8P)_Fv#1 | VH3\|3-23/D6\|6-19\|RF2/JH4 | ............................... | 17869 |
| MA_98-C7_CC_x_I2E_x_scFc_Fv#1 | VH3\|3-23/D6\|6-19\|RF2/JH4 | ............................... | 17870 |
| MA_98-C7_CC_x_I2E_x_scFc_variant_Fv#1 | VH3\|3-23/D6\|6-19\|RF2/JH4 | ............................... | 17871 |
| VH3\|3-73/D3\|3-3\|RF3/JH4 | | EVQLVES-GGGLVQPGGSLKLSCAASG-FTFS | 17872 |
| MA_03-G10_AS_CC_x_I2C0_x_scFc_(N3H)_Fv#2 | VH3\|3-73/D3\|3-3\|RF3/JH4 | ..............................N | 17873 |
| MA_10-B5_CC_x_I2C0_x_scFc_(H6H)_Fv#2 | VH3\|3-73/D3\|3-3\|RF3/JH4 | ..............................N | 17874 |
| MA_98-C7_CC_x_I2C0_x_scFc_(Y8P)_Fv#2 | VH3\|3-73/D3\|3-3\|RF3/JH4 | ..............................N | 17875 |
| VH3\|3-73/D2\|2-21\|RF2/JH4 | | EVQLVES-GGGLVQPGGSLKLSCAASG-FTFS | 17876 |
| MA_03-G10_AS_CC_x_I2E_x_scFc_Fv#2 | VH3\|3-73/D2\|2-21\|RF2/JH4 | ..............................N | 17877 |
| MA_03-G10_AS_CC_x_I2E_x_scFc_variant_Fv#2 | VH3\|3-73/D2\|2-21\|RF2/JH4 | ..............................N | 17878 |
| MA_10-B5_CC_x_I2E_x_scFc_Fv#2 | VH3\|3-73/D2\|2-21\|RF2/JH4 | ..............................N | 17879 |

TABLE 93-continued

BiTE-scFc Variable Region Concensus Protein Alignment
CDRs defined by Kabat
Alignment numbering defined by Amgen Reference (AHo)

| | | | |
|---|---|---|---|
| MA_10-B5_CC_x_I2E_x_scFc_variant_Fv#2 | VH3\|3-73/D2\|2-21\|RF2/JH4 | ................................N | 17880 |
| MA_98-C7_CC_x_I2E_x_scFc_Fv#2 | VH3\|3-73/D2\|2-21\|RF2/JH4 | ................................N | 17881 |
| MA_98-C7_CC_x_I2E_x_scFc_variant_Fv#2 | VH3\|3-73/D2\|2-21\|RF2/JH4 | ................................N | 17882 |
| VH3\|3-15/D3\|3-10\|RF2/JH6 | | EVQLVES-GGGLVKPGGSLRLSCAASG-FTFS | 17883 |
| MA_10-B5_CC_x_I2C0_x_scFc_(H6H)_Fv#1 | VH3\|3-15/D3\|3-10\|RF2/JH6 | ................Q................ | 17884 |
| MA_10-B5_CC_x_I2E_x_scFc_Fv#1 | VH3\|3-15/D3\|3-10\|RF2/JH6 | ................Q................ | 17885 |
| MA_10-B5_CC_x_I2E_x_scFc_variant_Fv#1 | VH3\|3-15/D3\|3-10\|RF2/JH6 | ................Q................ | 17886 |
| | | H_CDR1 | |
| VH3\|3-23/D6\|6-19\|RF2/JH4 | | S-----YAMS | 17908 |
| MA_03-G10_AS_CC_x_I2C0_x_scFc_(N3H)_Fv#1 | VH3\|3-23/D6\|6-19\|RF2/JH4 | .......... | 17909 |
| MA_03-G10_AS_CC_x_I2E_x_scFc_Fv#1 | VH3\|3-23/D6\|6-19\|RF2/JH4 | .......... | 17910 |
| MA_03-G10_AS_CC_x_I2E_x_scFc_variant_Fv#1 | VH3\|3-23/D6\|6-19\|RF2/JH4 | .......... | 17911 |
| MA_98-C7_CC_x_I2C0_x_scFc_(Y8P)_Fv#1 | VH3\|3-23/D6\|6-19\|RF2/JH4 | ......H... | 17912 |
| MA_98-C7_CC_x_I2C0_x_scFc_Fv#1 | VH3\|3-23/D6\|6-19\|RF2/JH4 | ......H... | 17913 |
| MA_98-C7_CC_x_I2E_x_scFc_variant_Fv#1 | VH3\|3-23/D6\|6-19\|RF2/JH4 | ......H... | 17914 |
| VH3\|3-73/D3\|3-3\|RF3/JH4 | | G-----SAMH | 17915 |
| MA_03-G10_AS_CC_x_I2C0_x_scFc_(N3H)_Fv#2 | VH3\|3-73/D3\|3-3\|RF3/JH4 | K.....Y..N | 17916 |
| MA_10-B5_CC_x_I2C0_x_scFc_(H6H)_Fv#2 | VH3\|3-73/D3\|3-3\|RF3/JH4 | K.....Y..N | 17917 |
| MA_98-C7_CC_x_I2C0_x_scFc_(Y8P)_Fv#2 | VH3\|3-73/D3\|3-3\|RF3/JH4 | K.....Y..N | 17918 |
| VH3\|3-73/D2\|2-21\|RF2/JH4 | | G-----SAMH | 17919 |
| MA_03-G10_AS_CC_x_I2E_x_scFc_Fv#2 | VH3\|3-73/D2\|2-21\|RF2/JH4 | K.....Y.IN | 17920 |
| MA_03-G10_AS_CC_x_I2E_x_scFc_variant_Fv#2 | VH3\|3-73/D2\|2-21\|RF2/JH4 | K.....Y.IN | 17921 |
| MA_10-B5_CC_x_I2E_x_scFc_Fv#2 | VH3\|3-73/D2\|2-21\|RF2/JH4 | K.....Y.IN | 17922 |
| MA_10-B5_CC_x_I2E_x_scFc_variant_Fv#2 | VH3\|3-73/D2\|2-21\|RF2/JH4 | K.....Y.IN | 17923 |
| MA_98-C7_CC_x_I2E_x_scFc_Fv#2 | VH3\|3-73/D2\|2-21\|RF2/JH4 | K.....Y.IN | 17924 |
| MA_98-C7_CC_x_I2E_x_scFc_variant_Fv#2 | VH3\|3-73/D2\|2-21\|RF2/JH4 | K.....Y.IN | 17925 |

TABLE 93-continued

BiTE-scFc Variable Region Concensus Protein Alignment
CDRs defined by Kabat
Alignment numbering defined by Amgen Reference (AHo)

| Name | Germline | Sequence | SEQ ID |
|---|---|---|---|
| VH3\|3-15/D3\|3-10\|RF2/JH6 | | N-----AWMS | 17926 |
| MA_10-B5_CC_x_I2C0_x_scFc_(H6H)_Fv#1 | VH3\|3-15/D3\|3-10\|RF2/JH6 | .......... | 17927 |
| MA_10-B5_CC_x_I2E_x_scFc_Fv#1 | VH3\|3-15/D3\|3-10\|RF2/JH6 | .......... | 17928 |
| MA_10-B5_CC_x_I2E_x_scFc_variant_Fv#1 | VH3\|3-15/D3\|3-10\|RF2/JH6 | .......... | 17929 |
| | | H_FR2 | |
| VH3\|3-23/D6\|6-19\|RF2/JH4 | | WVRQAPGKGLEWVS | 17951 |
| MA_03-G10_AS_CC_x_I2C0_x_scFc_(N3H)_Fv#1 | VH3\|3-23/D6\|6-19\|RF2/JH4 | ........C..... | 17952 |
| MA_03-G10_AS_CC_x_I2E_x_scFc_Fv#1 | VH3\|3-23/D6\|6-19\|RF2/JH4 | ........C..... | 17953 |
| MA_03-G10_AS_CC_x_I2E_x_scFc_variant_Fv#1 | VH3\|3-23/D6\|6-19\|RF2/JH4 | ........C..... | 17954 |
| MA_98-C7_CC_x_I2C0_x_scFc_(Y8P)_Fv#1 | VH3\|3-23/D6\|6-19\|RF2/JH4 | ........C..... | 17955 |
| MA_98-C7_CC_x_I2E_x_scFc_Fv#1 | VH3\|3-23/D6\|6-19\|RF2/JH4 | ........C..... | 17956 |
| MA_98-C7_CC_x_I2E_x_scFc_variant_Fv#1 | VH3\|3-23/D6\|6-19\|RF2/JH4 | ........C..... | 17957 |
| VH3\|3-73/D3\|3-3\|RF3/JH4 | | WVRQASGKGLEWVG | 17958 |
| MA_03-G10_AS_CC_x_I2C0_x_scFc_(N3H)_Fv#2 | VH3\|3-73/D3\|3-3\|RF3/JH4 | .....P.......A | 17959 |
| MA_10-B5_CC_x_I2C0_x_scFc_(H6H)_Fv#2 | VH3\|3-73/D3\|3-3\|RF3/JH4 | .....P.......A | 17960 |
| MA_98-C7_CC_x_I2C0_x_scFc_(Y8P)_Fv#2 | VH3\|3-73/D3\|3-3\|RF3/JH4 | .....P.......A | 17961 |
| VH3\|3-73/D2\|2-21\|RF2/JH4 | | WVRQASGKGLEWVG | 17962 |
| MA_03-G10_AS_CC_x_I2E_x_scFc_Fv#2 | VH3\|3-73/D2\|2-21\|RF2/JH4 | .....P.......A | 17963 |
| MA_03-G10_AS_CC_x_I2E_x_scFc_variant_Fv#2 | VH3\|3-73/D2\|2-21\|RF2/JH4 | .....P.......A | 17964 |
| MA_10-B5_CC_x_I2E_x_scFc_Fv#2 | VH3\|3-73/D2\|2-21\|RF2/JH4 | .....P.......A | 17965 |
| MA_10-B5_CC_x_I2E_x_scFc_variant_Fv#2 | VH3\|3-73/D2\|2-21\|RF2/JH4 | .....P.......A | 17966 |
| MA_98-C7_CC_x_I2E_x_scFc_Fv#2 | VH3\|3-73/D2\|2-21\|RF2/JH4 | .....P.......A | 17967 |
| MA_98-C7_CC_x_I2E_x_scFc_variant_Fv#2 | VH3\|3-73/D2\|2-21\|RF2/JH4 | .....P.......A | 17968 |
| VH3\|3-15/D3\|3-10\|RF2/JH6 | | WVRQAPGKGLEWVG | 17969 |
| MA_10-B5_CC_x_I2C0_x_scFc_(H6H)_Fv#1 | VH3\|3-15/D3\|3-10\|RF2/JH6 | ........C..... | 17970 |
| MA_10-B5_CC_x_I2E_x_scFc_Fv#1 | VH3\|3-15/D3\|3-10\|RF2/JH6 | ........C..... | 17971 |
| MA_10-B5_CC_x_I2E_x_scFc_variant_Fv#1 | VH3\|3-15/D3\|3-10\|RF2/JH6 | ........C..... | 17972 |

TABLE 93-continued

BiTE-scFc Variable Region Concensus Protein Alignment
CDRs defined by Kabat
Alignment numbering defined by Amgen Reference (AHo)

KAPPA_VARIABLE

| | Germline | | SEQ ID NO: |
|---|---|---|---|
| | | K_CDR2 | |
| VK1\|O12/JK1 | | A--------ASSLQS | 17973 |
| MA_10-B5_CC_x_I2C0_x_scFc_(H6H)_Fv#1 | VK1\|O12/JK1 | ..............G | 17974 |
| MA_10-B5_CC_x_I2E_x_scFc_Fv#1 | VK1\|O12/JK1 | ..............G | 17975 |
| MA_10-B5_CC_x_I2E_x_scFc_variant_Fv#1 | VK1\|O12/JK1 | ..............G | 17976 |
| | | K_FR3 | |
| VK1\|O12/JK1 | | GVPSRFSGSGSG--TDFTLTISSLQPEDFATYY | 18016 |
| MA_10-B5_CC_x_I2C0_x_scFc_(H6H)_Fv#1 | VK1\|O12/JK1 | ................................ | 18017 |
| MA_10-B5_CC_x_I2E_x_scFc_Fv#1 | VK1\|O12/JK1 | ................................ | 18018 |
| MA_10-B5_CC_x_I2E_x_scFc_variant_Fv#1 | VK1\|O12/JK1 | ................................ | 18019 |

LAMBDA_VARIABLE

| | Germline | | SEQ ID NO: |
|---|---|---|---|
| | | L_CDR2 | |
| VL3\|3h/JL2 | | Y--------DSDRPS | 17977 |
| MA_03-G10_AS_CC_x_I2C0_x_scFc_(N3H)_Fv#1 | VL3\|3h/JL2 | D.........N.... | 17978 |
| MA_03-G10_AS_CC_x_I2E_x_scFc_Fv#1 | VL3\|3h/JL2 | D.........N.... | 17979 |
| MA_03-G10_AS_CC_x_I2E_x_scFc_variant_Fv#1 | VL3\|3h/JL2 | D.........N.... | 17980 |
| MA_98-C7_CC_x_I2C0_x_scFc_(Y8P)_Fv#1 | VL3\|3h/JL2 | D.........N.... | 17981 |
| MA_98-C7_CC_x_I2E_x_scFc_Fv#1 | VL3\|3h/JL2 | D.........N.... | 17982 |
| MA_98-C7_CC_x_I2E_x_scFc_variant_Fv#1 | VL3\|3h/JL2 | D.........N.... | 17983 |
| VL7\|7a/JL3b | | S--------TSNKHS | 17984 |
| MA_03-G10_AS_CC_x_I2C0_x_scFc_(N3H)_Fv#2 | VL7\|7a/JL3b | G.........KFLAP | 17985 |
| MA_03-G10_AS_CC_x_I2E_x_scFc_Fv#2 | VL7\|7a/JL3b | G.........KFLAP | 17986 |
| MA_03-G10_AS_CC_x_I2E_x_scFc_variant_Fv#2 | VL7\|7a/JL3b | G.........KFLAP | 17987 |
| MA_10-B5_CC_x_I2C0_x_scFc_(H6H)_Fv#2 | VL7\|7a/JL3b | G.........KFLAP | 17988 |
| MA_10-B5_CC_x_I2E_x_scFc_Fv#2 | VL7\|7a/JL3b | G.........KFLAP | 17989 |
| MA_10-B5_CC_x_I2E_x_scFc_variant_Fv#2 | VL7\|7a/JL3b | G.........KFLAP | 17990 |
| MA_98-C7_CC_x_I2C0_x_scFc_(Y8P)_Fv#2 | VL7\|7a/JL3b | G.........KFLAP | 17991 |
| MA_98-C7_CC_x_I2E_x_scFc_Fv#2 | VL7\|7a/JL3b | G.........KFLAP | 17992 |
| MA_98-C7_CC_x_I2E_x_scFc_variant_Fv#2 | VL7\|7a/JL3b | G.........KFLAP | 17993 |
| | | L_FR3 | |
| VL3\|3h/JL2 | | GIPERFSGSNSG--NTATLTISRVEAGDEADYY | 18020 |
| MA_03-G10_AS_CC_x_I2C0_x_scFc_(N3H)_Fv#1 | VL3\|3h/JL2 | ................................ | 18021 |
| MA_03-G10_AS_CC_x_I2E_x_scFc_Fv#1 | VL3\|3h/JL2 | ................................ | 18022 |

TABLE 93-continued

BiTE-scFc Variable Region Concensus Protein Alignment
CDRs defined by Kabat
Alignment numbering defined by Amgen Reference (AHo)

| Name | Germline | Sequence | SEQ ID NO: |
|---|---|---|---|
| MA_03-G10_AS_CC_x_I2E_x_scFc_variant_Fv#1 | VL3\|3h/JL2 | ................................. | 18023 |
| MA_98-C7_CC_x_I2C0_x_scFc_(Y8P)_Fv#1 | VL3\|3h/JL2 | ................................. | 18024 |
| MA_98-C7_CC_x_I2E_x_scFc_Fv#1 | VL3\|3h/JL2 | ................................. | 18025 |
| MA_98-C7_CC_x_I2E_x_scFc_variant_Fv#1 | VL3\|3h/JL2 | ................................. | 18026 |
| VL7\|7a/JL3b | | WTPARFSGSLLG--GKAALTLSGVQPEDEAEYYC | 18027 |
| MA_03-G10_AS_CC_x_I2C0_x_scFc_(N3H)_Fv#2 | VL7\|7a/JL3b | G................................ | 18028 |
| MA_03-G10_AS_CC_x_I2E_x_scFc_Fv#2 | VL7\|7a/JL3b | G.........S...................... | 18029 |
| MA_03-G10_AS_CC_x_I2E_x_scFc_variant_Fv#2 | VL7\|7a/JL3b | G.........S...................... | 18030 |
| MA_10-B5_CC_x_I2C0_x_scFc_(H6H)_Fv#2 | VL7\|7a/JL3b | G.........S...................... | 18031 |
| MA_10-B5_CC_x_I2E_x_scFc_Fv#2 | VL7\|7a/JL3b | G.........S...................... | 18032 |
| MA_10-B5_CC_x_I2E_x_scFc_variant_Fv#2 | VL7\|7a/JL3b | G.........S...................... | 18033 |
| MA_98-C7_CC_x_I2C0_x_scFc_(Y8P)_Fv#2 | VL7\|7a/JL3b | G.........S...................... | 18034 |
| MA_98-C7_CC_x_I2E_x_scFc_Fv#2 | VL7\|7a/JL3b | G.........S...................... | 18035 |
| MA_98-C7_CC_x_I2E_x_scFc_variant_Fv#2 | VL7\|7a/JL3b | G.........S...................... | 18036 |

HEAVY_VARIABLE

| Name | Germline | H_CDR2 | SEQ ID NO: |
|---|---|---|---|
| VH3\|3-23/D6\|6-19\|RF2/JH4 | | AISGS---GGSTYYADSVKG | 17994 |
| MA_03-G10_AS_CC_x_I2C0_x_scFc_(N3H)_Fv#1 | VH3\|3-23/D6\|6-19\|RF2/JH4 | .........G....A.... | 17995 |
| MA_03-G10_AS_CC_x_I2E_x_scFc_Fv#1 | VH3\|3-23/D6\|6-19\|RF2/JH4 | .........G....A.... | 17996 |
| MA_03-G10_AS_CC_x_I2E_x_scFc_variant_Fv#1 | VH3\|3-23/D6\|6-19\|RF2/JH4 | .........G....A.... | 17997 |
| MA_98-C7_CC_x_I2C0_x_scFc_(Y8P)_Fv#1 | VH3\|3-23/D6\|6-19\|RF2/JH4 | S........G....A.... | 17998 |
| MA_98-C7_CC_x_I2E_x_scFc_Fv#1 | VH3\|3-23/D6\|6-19\|RF2/JH4 | S........G....A.... | 17999 |
| MA_98-C7_CC_x_I2E_x_scFc_variant_Fv#1 | VH3\|3-23/D6\|6-19\|RF2/JH4 | S........G....A.... | 18000 |
| VH3\|3-73/D3\|3-3\|RF3/JH4 | | RIRSKA-NSYATAYAASVKG | 18001 |
| MA_03-G10_AS_CC_x_I2C0_x_scFc_(N3H)_Fv#2 | VH3\|3-73/D3\|3-3\|RF3/JH4 | .....Y..N...Y..D...D | 18002 |
| MA_10-B5_CC_x_I2C0_x_scFc_(H6H)_Fv#2 | VH3\|3-73/D3\|3-3\|RF3/JH4 | .....Y..N...Y..D...D | 18003 |
| MA_98-C7_CC_x_I2C0_x_scFc_(Y8P)_Fv#2 | VH3\|3-73/D3\|3-3\|RF3/JH4 | .....Y..N...Y..D...D | 18004 |
| VH3\|3-73/D2\|2-21\|RF2/JH4 | | RIRSKA-NSYATAYAASVKG | 18005 |
| MA_03-G10_AS_CC_x_I2E_x_scFc_Fv#2 | VH3\|3-73/D2\|2-21\|RF2/JH4 | .....Y..N...Y..DA..D | 18006 |
| MA_03-G10_AS_CC_x_I2E_x_scFc_variant_Fv#2 | VH3\|3-73/D2\|2-21\|RF2/JH4 | .....Y..N...Y..DA..D | 18007 |

TABLE 93-continued

BiTE-scFc Variable Region Concensus Protein Alignment
CDRs defined by Kabat
Alignment numbering defined by Amgen Reference (AHo)

| Name | Germline | Sequence | SEQ ID |
|---|---|---|---|
| MA_10-B5_CC_x_I2E_x_scFc_Fv#2 | VH3\|3-73/D2\|2-21\|RF2/JH4 | .....Y..N...Y..DA..D | 18008 |
| MA_10-B5_CC_x_I2E_x_scFc_variant_Fv#2 | VH3\|3-73/D2\|2-21\|RF2/JH4 | .....Y..N...Y..DA..D | 18009 |
| MA_98-C7_CC_x_I2E_x_scFc_Fv#2 | VH3\|3-73/D2\|2-21\|RF2/JH4 | .....Y..N...Y..DA..D | 18010 |
| MA_98-C7_CC_x_I2E_x_scFc_variant_Fv#2 | VH3\|3-73/D2\|2-21\|RF2/JH4 | .....Y..N...Y..DA..D | 18011 |
| VH3\|3-15/D3\|3-10\|RF2/JH6 | | RIKSKT-DGGTTDYAAPVKG | 18012 |
| MA_10-B5_CC_x_I2C0_x_scFc_(H6H)_Fv#1 | VH3\|3-15/D3\|3-10\|RF2/JH6 | ..R.RS.Y............ | 18013 |
| MA_10-B5_CC_x_I2E_x_scFc_Fv#1 | VH3\|3-15/D3\|3-10\|RF2/JH6 | ..R.RS.Y............ | 18014 |
| MA_10-B5_CC_x_I2E_x_scFc_variant_Fv#1 | VH3\|3-15/D3\|3-10\|RF2/JH6 | ..R.RS.Y............ | 18015 |
| | | H FR3 | |
| VH3\|3-23/D6\|6-19\|RF2/JH4 | | RFTISRDNSKNTLYLQMNSLRAEDTAVYYCAK | 18037 |
| MA_03-G10_AS_CC_x_I2C0_x_scFc_(N3H)_Fv#1 | VH3\|3-23/D6\|6-19\|RF2/JH4 | .................S............T | 18038 |
| MA_03-G10_AS_CC_x_I2E_x_scFc_Fv#1 | VH3\|3-23/D6\|6-19\|RF2/JH4 | .................S............T | 18039 |
| MA_03-G10_AS_CC_x_I2E_x_scFc_variant_Fv#1 | VH3\|3-23/D6\|6-19\|RF2/JH4 | .................S............T | 18040 |
| MA_98-C7_CC_x_I2C0_x_scFc_(Y8P)_Fv#1 | VH3\|3-23/D6\|6-19\|RF2/JH4 | ..............................T | 18041 |
| MA_98-C7_CC_x_I2E_x_scFc_Fv#1 | VH3\|3-23/D6\|6-19\|RF2/JH4 | ..............................T | 18042 |
| MA_98-C7_CC_x_I2E_x_scFc_variant_Fv#1 | VH3\|3-23/D6\|6-19\|RF2/JH4 | ..............................T | 18043 |
| VH3\|3-73/D3\|3-3\|RF3/JH4 | | RFTISRDDSKNTAYLQMNSLKTEDTAVYYCTR | 18044 |
| MA_03-G10_AS_CC_x_I2C0_x_scFc_(N3H)_Fv#2 | VH3\|3-73/D3\|3-3\|RF3/JH4 | ..................N...........V. | 18045 |
| MA_10-B5_CC_x_I2C0_x_scFc_(H6H)_Fv#2 | VH3\|3-73/D3\|3-3\|RF3/JH4 | ..................N...........V. | 18046 |
| MA_98-C7_CC_x_I2C0_x_scFc_(Y8P)_Fv#2 | VH3\|3-73/D3\|3-3\|RF3/JH4 | ..................N...........V. | 18047 |
| VH3\|3-73/D2\|2-21\|RF2/JH4 | | RFTISRDDSKNTAYLQMNSLKTEDTAVYYCTR | 18048 |
| MA_03-G10_AS_CC_x_I2E_x_scFc_Fv#2 | VH3\|3-73/D2\|2-21\|RF2/JH4 | ............V.....N...........A. | 18049 |
| MA_03-G10_AS_CC_x_I2E_x_scFc_variant_Fv#2 | VH3\|3-73/D2\|2-21\|RF2/JH4 | ............V.....N...........A. | 18050 |
| MA_10-B5_CC_x_I2E_x_scFc_Fv#2 | VH3\|3-73/D2\|2-21\|RF2/JH4 | ............V.....N...........A. | 18051 |
| MA_10-B5_CC_x_I2E_x_scFc_variant_Fv#2 | VH3\|3-73/D2\|2-21\|RF2/JH4 | ............V.....N...........A. | 18052 |
| MA_98-C7_CC_x_I2E_x_scFc_Fv#2 | VH3\|3-73/D2\|2-21\|RF2/JH4 | ............V.....N...........A. | 18053 |
| MA_98-C7_CC_x_I2E_x_scFc_variant_Fv#2 | VH3\|3-73/D2\|2-21\|RF2/JH4 | ............V.....N...........A. | 18054 |

TABLE 93-continued

BiTE-scFc Variable Region Concensus Protein Alignment
CDRs defined by Kabat
Alignment numbering defined by Amgen Reference (AHo)

| Name | Germline | Sequence | SEQ ID NO: |
|---|---|---|---|
| VH3\|3-15/D3\|3-10\|RF2/JH6 | | RFTISRDDSKNTLYLQMNSLKTEDTAVYYCTT | 18055 |
| MA_10-B5_CC_x_I2C0_x_scFc_(H6H)_Fv#1 | VH3\|3-15/D3\|3-10\|RF2/JH6 | ............F................ | 18056 |
| MA_10-B5_CC_x_I2E_x_scFc_Fv#1 | VH3\|3-15/D3\|3-10\|RF2/JH6 | ............F................ | 18057 |
| MA_10-B5_CC_x_I2E_x_scFc_variant_Fv#1 | VH3\|3-15/D3\|3-10\|RF2/JH6 | ............F................ | 18058 |

KAPPA_VARIABLE

| Name | Germline | Sequence | SEQ ID NO: |
|---|---|---|---|
| | | K_CDR3 | |
| VK1\|O12/JK1 | | QQSYS-------------------TPWT | 18059 |
| MA_10-B5_CC_x_I2C0_x_scFc_(H6H)_Fv#1 | VK1\|O12/JK1 | ..T.....................M.F. | 18060 |
| MA_10-B5_CC_x_I2E_x_scFc_Fv#1 | VK1\|O12/JK1 | ..T.....................M.F. | 18061 |
| MA_10-B5_CC_x_I2E_x_scFc_variant_Fv#1 | VK1\|O12/JK1 | ..T.....................M.F. | 18062 |
| | | K_FR4 | |
| VK1\|O12/JK1 | | FGQGTKVEIK | 18102 |
| MA_10-B5_CC_x_I2C0_x_scFc_(H6H)_Fv#1 | VK1\|O12/JK1 | ...C...... | 18103 |
| MA_10-B5_CC_x_I2E_x_scFc_Fv#1 | VK1\|O12/JK1 | ...C...... | 18104 |
| MA_10-B5_CC_x_I2E_x_scFc_variant_Fv#1 | VK1\|O12/JK1 | ...C...... | 18105 |

LAMBDA_VARIABLE

| Name | Germline | Sequence | SEQ ID NO: |
|---|---|---|---|
| | | L_CDR3 | |
| VL3\|3h/JL2 | | QVWDSS-------------------SDHVV | 18063 |
| MA_03-G10_AS_CC_x_I2C0_x_scFc_(N3H)_Fv#1 | VL3\|3h/JL2 | ....Y...................GQRQ. | 18064 |
| MA_03-G10_AS_CC_x_I2E_x_scFc_Fv#1 | VL3\|3h/JL2 | ....Y...................GQRQ. | 18065 |
| MA_03-G10_AS_CC_x_I2E_x_scFc_variant_Fv#1 | VL3\|3h/JL2 | ....Y...................GQRQ. | 18066 |
| MA_98-C7_CC_x_I2C0_x_scFc_(Y8P)_Fv#1 | VL3\|3h/JL2 | ....Y...................PLRH. | 18067 |
| MA_98-C7_CC_x_I2E_x_scFc_Fv#1 | VL3\|3h/JL2 | ....Y...................PLRH. | 18068 |
| MA_98-C7_CC_x_I2E_x_scFc_variant_Fv#1 | VL3\|3h/JL2 | ....Y...................PLRH. | 18069 |
| VL7\|7a/JL3b | | LLYYG-------------------GAQWV | 18070 |
| MA_03-G10_AS_CC_x_I2C0_x_scFc_(N3H)_Fv#2 | VL7\|7a/JL3b | V.W.S...................-NR.. | 18071 |
| MA_03-G10_AS_CC_x_I2E_x_scFc_Fv#2 | VL7\|7a/JL3b | V.W.S...................-NR.. | 18072 |
| MA_03-G10_AS_CC_x_I2E_x_scFc_variant_Fv#2 | VL7\|7a/JL3b | V.W.S...................-NR.. | 18073 |
| MA_10-B5_CC_x_I2C0_x_scFc_(H6H)_Fv#2 | VL7\|7a/JL3b | V.W.S...................-NR.. | 18074 |
| MA_10-B5_CC_x_I2E_x_scFc_Fv#2 | VL7\|7a/JL3b | V.W.S...................-NR.. | 18075 |
| MA_10-B5_CC_x_I2E_x_scFc_variant_Fv#2 | VL7\|7a/JL3b | V.W.S...................-NR.. | 18077 |
| MA_98-C7_CC_x_I2C0_x_scFc_(Y8P)_Fv#2 | VL7\|7a/JL3b | V.W.S...................-NR.. | 18078 |

TABLE 93-continued

BiTE-scFc Variable Region Concensus Protein Alignment
CDRs defined by Kabat
Alignment numbering defined by Amgen Reference (AHo)

| | | | SEQ ID NO: |
|---|---|---|---|
| MA_98-C7_CC_x_I2E_x_scFc_Fv#2 | VL7\|7a/JL3b | V.W.S....................-NR.. | 18079 |
| MA_98-C7_CC_x_I2E_x_scFc_variant_Fv#2 | VL7\|7a/JL3b | V.W.S....................-NR.. | 18080 |
| | | L_FR4 | |
| VL3\|3h/JL2 | | FGGGTKLTVL | 18106 |
| MA_03-G10_AS_CC_x_I2C0_x_scFc_(N3H)_Fv#1 | VL3\|3h/JL2 | ..C....... | 18107 |
| MA_03-G10_AS_CC_x_I2E_x_scFc_Fv#1 | VL3\|3h/JL2 | ..C....... | 18108 |
| MA_03-G10_AS_CC_x_I2E_x_scFc_variant_Fv#1 | VL3\|3h/JL2 | ..C....... | 18109 |
| MA_98-C7_CC_x_I2C0_x_scFc_(Y8P)_Fv#1 | VL3\|3h/JL2 | ..C....... | 18110 |
| MA_98-C7_CC_x_I2E_x_scFc_Fv#1 | VL3\|3h/JL2 | ..C....... | 18111 |
| MA_98-C7_CC_x_I2E_x_scFc_variant_Fv#1 | VL3\|3h/JL2 | ..C....... | 18112 |
| VL7\|7a/JL3b | | FGGGTKLTVL | 18113 |
| MA_03-G10_AS_CC_x_I2C0_x_scFc_(N3H)_Fv#2 | VL7\|7a/JL3b | .......... | 18114 |
| MA_03-G10_AS_CC_x_I2E_x_scFc_Fv#2 | VL7\|7a/JL3b | ...S...... | 18115 |
| MA_03-G10_AS_CC_x_I2E_x_scFc_variant_Fv#2 | VL7\|7a/JL3b | ...S...... | 18116 |
| MA_10-B5_CC_x_I2C0_x_scFc_(H6H)_Fv#2 | VL7\|7a/JL3b | .......... | 18117 |
| MA_10-B5_CC_x_I2E_x_scFc_Fv#2 | VL7\|7a/JL3b | ...S...... | 18118 |
| MA_10-B5_CC_x_I2E_x_scFc_variant_Fv#2 | VL7\|7a/JL3b | ...S...... | 18119 |
| MA_98-C7_CC_x_I2C0_x_scFc_(Y8P)_Fv#2 | VL7\|7a/JL3b | .......... | 18120 |
| MA_98-C7_CC_x_I2E_x_scFc_Fv#2 | VL7\|7a/JL3b | ...S...... | 18121 |
| MA_98-C7_CC_x_I2E_x_scFc_variant_Fv#2 | VL7\|7a/JL3b | ...S...... | 18122 |
| HEAVY_VARIABLE | | | |
| | Germline | | SEQ ID NO: |
| | | H_CDR3 | |
| VH3\|3-23/D6\|6-19\|RF2/JH4 | | GIAVA-------------------GYFDY | 18080 |
| MA_03-G10_AS_CC_x_I2C0_x_scFc_(N3H)_Fv#1 | VH3\|3-23/D6\|6-19\|RF2/JH4 | .KG.H.................LG... | 18081 |
| MA_03-G10_AS_CC_x_I2E_x_scFc_Fv#1 | VH3\|3-23/D6\|6-19\|RF2/JH4 | .KG.H.................LG... | 18082 |
| MA_03-G10_AS_CC_x_I2E_x_scFc_variant_Fv#1 | VH3\|3-23/D6\|6-19\|RF2/JH4 | .KG.H.................LG... | 18083 |
| MA_98-C7_CC_x_I2C0_x_scFc_(Y8P)_Fv#1 | VH3\|3-23/D6\|6-19\|RF2/JH4 | .KG.H.................LG... | 18084 |
| MA_98-C7_CC_x_I2E_x_scFc_Fv#1 | VH3\|3-23/D6\|6-19\|RF2/JH4 | .KG.H.................LG... | 18085 |
| MA_98-C7_CC_x_I2E_x_scFc_variant_Fv#1 | VH3\|3-23/D6\|6-19\|RF2/JH4 | .KG.H.................LG... | 18086 |
| VH3\|3-73/D3\|3-3\|RF3/JH4 | | ITIFGVV----------------IIYFDY | 18087 |
| MA_03-G10_AS_CC_x_I2C0_x_scFc_(N3H)_Fv#2 | VH3\|3-73/D3\|3-3\|RF3/JH4 | HGN..NS................Y.S.WA | 18088 |

TABLE 93-continued

BiTE-scFc Variable Region Concensus Protein Alignment
CDRs defined by Kabat
Alignment numbering defined by Amgen Reference (AHo)

| Name | VH/D/JH | Sequence | SEQ ID |
|---|---|---|---|
| MA_10-B5_CC_x_I2C0_x_scFc_(H6H)_Fv#2 | VH3\|3-73/D3\|3-3\|RF3/JH4 | HGN..NS................Y.S.WA | 18089 |
| MA_98-C7_CC_x_I2C0_x_scFc_(Y8P)_Fv#2 | VH3\|3-73/D3\|3-3\|RF3/JH4 | HGN..NS................Y.S.WA | 18090 |
| VH3\|3-73/D2\|2-21\|RF2/JH4 | | AYCGGDC----------------YSYFDY | 18091 |
| MA_03-G10_AS_CC_x_I2E_x_scFc_Fv#2 | VH3\|3-73/D2\|2-21\|RF2/JH4 | .GNF.SS................YI..WA. | 18092 |
| MA_03-G10_AS_CC_x_I2E_x_scFc_variant_Fv#2 | VH3\|3-73/D2\|2-21\|RF2/JH4 | .GNF.SS................YI..WA. | 18093 |
| MA_10-B5_CC_x_I2E_x_scFc_Fv#2 | VH3\|3-73/D2\|2-21\|RF2/JH4 | .GNF.SS................YI..WA. | 18094 |
| MA_10-B5_CC_x_I2E_x_scFc_variant_Fv#2 | VH3\|3-73/D2\|2-21\|RF2/JH4 | .GNF.SS................YI..WA. | 18095 |
| MA_98-C7_CC_x_I2E_x_scFc_Fv#2 | VH3\|3-73/D2\|2-21\|RF2/JH4 | .GNF.SS................YI..WA. | 18096 |
| MA_98-C7_CC_x_I2E_x_scFc_variant_Fv#2 | VH3\|3-73/D2\|2-21\|RF2/JH4 | .GNF.SS................YI..WA. | 18097 |
| VH3\|3-15/D3\|3-10\|RF2/JH6 | | YYYGSGSYYN-----------YYYYYGMDV | 18098 |
| MA_10-B5_CC_x_I2C0_x_scFc_(H6H)_Fv#1 | VH3\|3-15/D3\|3-10\|RF2/JH6 | PS.SGSY.--...........-N.FSV... | 18099 |
| MA_10-B5_CC_x_I2E_x_scFc_Fv#1 | VH3\|3-15/D3\|3-10\|RF2/JH6 | PS.SGSY.--...........-N.FSV... | 18100 |
| MA_10-B5_CC_x_I2E_x_scFc_variant_Fv#1 | VH3\|3-15/D3\|3-10\|RF2/JH6 | PS.SGSY.--...........-N.FSV... | 18101 |
| | | H_FR4 | |
| VH3\|3-23/D6\|6-19\|RF2/JH4 | | WGQGTLVTVSS | 18123 |
| MA_03-G10_AS_CC_x_I2C0_x_scFc_(N3H)_Fv#1 | VH3\|3-23/D6\|6-19\|RF2/JH4 | ........... | 18124 |
| MA_03-G10_AS_CC_x_I2E_x_scFc_Fv#1 | VH3\|3-23/D6\|6-19\|RF2/JH4 | ........... | 18125 |
| MA_03-G10_AS_CC_x_I2E_x_scFc_variant_Fv#1 | VH3\|3-23/D6\|6-19\|RF2/JH4 | ........... | 18126 |
| MA_98-C7_CC_x_I2C0_x_scFc_(Y8P)_Fv#1 | VH3\|3-23/D6\|6-19\|RF2/JH4 | ........... | 18127 |
| MA_98-C7_CC_x_I2E_x_scFc_Fv#1 | VH3\|3-23/D6\|6-19\|RF2/JH4 | ........... | 18128 |
| MA_98-C7_CC_x_I2E_x_scFc_variant_Fv#1 | VH3\|3-23/D6\|6-19\|RF2/JH4 | ........... | 18129 |
| VH3\|3-73/D3\|3-3\|RF3/JH4 | | WGQGTLVTVSS | 18130 |
| MA_03-G10_AS_CC_x_I2C0_x_scFc_(N3H)_Fv#2 | VH3\|3-73/D3\|3-3\|RF3/JH4 | ........... | 18131 |
| MA_10-B5_CC_x_I2C0_x_scFc_(H6H)_Fv#2 | VH3\|3-73/D3\|3-3\|RF3/JH4 | ........... | 18132 |
| MA_98-C7_CC_x_I2C0_x_scFc_(Y8P)_Fv#2 | VH3\|3-73/D3\|3-3\|RF3/JH4 | ........... | 18133 |
| VH3\|3-73/D2\|2-21\|RF2/JH4 | | WGQGTLVTVSS | 18134 |
| MA_03-G10_AS_CC_x_I2E_x_scFc_Fv#2 | VH3\|3-73/D2\|2-21\|RF2/JH4 | ........... | 18135 |

TABLE 93-continued

BiTE-scFc Variable Region Concensus Protein Alignment
CDRs defined by Kabat
Alignment numbering defined by Amgen Reference (AHo)

| | | | |
|---|---|---|---|
| MA_03-G10_AS_CC_x_I2E_x_scFc_variant_Fv#2 | VH3\|3-73/D2\|2-21\|RF2/JH4 | ............ | 18136 |
| MA_10-B5_CC_x_I2E_x_scFc_Fv#2 | VH3\|3-73/D2\|2-21\|RF2/JH4 | ............ | 18137 |
| MA_10-B5_CC_x_I2E_x_scFc_variant_Fv#2 | VH3\|3-73/D2\|2-21\|RF2/JH4 | ............ | 18138 |
| MA_98-C7_CC_x_I2E_x_scFc_Fv#2 | VH3\|3-73/D2\|2-21\|RF2/JH4 | ............ | 18139 |
| MA_98-C7_CC_x_I2E_x_scFc_variant_Fv#2 | VH3\|3-73/D2\|2-21\|RF2/JH4 | ............ | 18140 |
| VH3\|3-15/D3\|3-10\|RF2/JH6 | | WGQGTTVTVSS | 18141 |
| MA_10-B5_CC_x_I2C0_x_scFc_(H6H)_Fv#1 | VH3\|3-15/D3\|3-10\|RF2/JH6 | ............ | 18142 |
| MA_10-B5_CC_x_I2E_x_scFc_Fv#1 | VH3\|3-15/D3\|3-10\|RF2/JH6 | ............ | 18143 |
| MA_10-B5_CC_x_I2E_x_scFc_variant_Fv#1 | VH3\|3-15/D3\|3-10\|RF2/JH6 | ............ | 18144 |

TABLE 94

BiTE Full Sequences

| Ab | Type | BITE |
|---|---|---|
| MA_03-G10_AS_CC_x_I2E6 | NA | No nuc. seq available |
| | AA | MDMRVPAQLLGLLLLWLRGARCEVQLLESGGGLVQPGGSLRLSCAASG FTFSSYAMSWVRQAPGKCLEWVSAISGSGGGTYYAASVKGRFTISRDN SKNTLYLQMSSLRAEDTAVYYCATGKGVHLGFDYWGQGTLVTVSSGGG GSGGGGSGGGGSSYVLTQPPSVSVAPGQTARITCGGNNIGSKSVHWYQ QKPGQAPVMVVYDDNDRPSGIPERFSGSNSGNTATLTISRVEAGDEAD YYCQVWDYSGQRQVFGCGTKLTVLSGGGGSEVQLVESGGGLVQPGGSL KLSCAASGFTFNKYAINWVRQAPGKGLEWVARIRSKYNNYATYYADAV KDRFTISRDDSKNTVYLQMNNLKTEDTAVYYCARAGNFGSSYISYWAY WGQGTLVTVSSGGGGSGGGGSGGGGSQTVVTQEPSLTVSPGGTVTITC GSSTGAVTSGNYPNWVQKKPGQAPRGLIGGTKFLAPGTPARESGSLSG GKAALTLSGVQPEDEAEYYCVLWYSNRWVFGSGTKLTVLHHHHHH<br>(SEQ ID NO: 18145 |
| MA_10-B5_CC_x_I2E6 | NA | No nuc. seq available |
| | AA | MDMRVPAQLLGLLLLWLRGARCEVQLVESGGGLVQPGGSLRLSCAASG FTFSNAWMSWVRQAPGKCLEWVGRIRSRSYGGTTDYAAPVKGRFTISR DDSKNTLFLQMNSLKTEDTAVYYCTTPSYSGSYYNYFSVMDVWGQGTT VTVSSGGGGSGGGGSGGGGSDIQMTQSPSSLSASVGDRVTITCRTSQS ISSYLNWYQQKPGRAPKLLIFAASSLQGGVPSRESGSGSGTDFTLTIS SLQPEDFATYYCQQTYSMPFTFGCGTKVEIKSGGGGSEVQLVESGGGL VQPGGSLKLSCAASGFTFNKYAINWVRQAPGKGLEWVARIRSKYNNYA TYYADAVKDRFTISRDDSKNTVYLQMNNLKTEDTAVYYCARAGNEGSS YISYWAYWGQGTLVTVSSGGGGSGGGGSGGGGSQTVVTQEPSLTVSPG GTVTITCGSSTGAVTSGNYPNWVQKKPGQAPRGLIGGTKFLAPGTPAR FSGSLSGGKAALTLSGVQPEDEAEYYCVLWYSNRWVFGSGTKLTVLHH HHHH<br>(SEQ ID NO: 18146 |
| MA_98-C7_CC_x_I2E6 | NA | No nuc. seq available |
| | AA | MDMRVPAQLLGLLLLWLRGARCEVQLLESGGGLVQPGGSLRLSCAASG FTFSSHAMSWVRQAPGKCLEWVSSISGSGGGTYYAASVKGRFTISRDN SKNTLYLQMNSLRAEDTAVYYCATGKGVHLGFDYWGQGTLVTVSSGGG GSGGGGSGGGGSSYVLTQPPSVSVAPGQTARITCGGNNIGSKSVHWYQ QKPGQAPVMVVYDDNDRPSGIPERFSGSNSGNTATLTISRVEAGDEAD YYCQVWDYSPLRHVFGCGTKLTVLSGGGGSEVQLVESGGGLVQPGGSL KLSCAASGFTFNKYAINWVRQAPGKGLEWVARIRSKYNNYATYYADAV |

TABLE 94-continued

| | | BiTE Full Sequences |
|---|---|---|
| Ab | Type | BITE |
| | | KDRFTISRDDSKNTVYLQMNNLKTEDTAVYYCARAGNFGSSYISYWAY WGQGTLVTVSSGGGGSGGGGSGGGGSQTVVTQEPSLTVSPGGTVTITC GSSTGAVTSGNYPNWVQKKPGQAPRGLIGGTKFLAPGTPARESGSLSG GKAALTLSGVQPEDEAEYYCVLWYSNRWVFGSGTKLTVLHHHHHH (SEQ ID NO: 18147) |

TABLE 95

| Ab | Type | CDR1 | CDR2 | CDR3 |
|---|---|---|---|---|
| | | BITE Fv#1 VL CDRs | | |
| MA_03-G10_AS_CC_x_I2E6 | NA | No nuc. seq available | No nuc. seq available | No nuc. seq available |
| | AA | GGNNIGSKSVH (SEQ ID NO: 18148) | DDNDRPS (SEQ ID NO: 18160) | QVWDYSGQRQV (SEQ ID NO: 18172) |
| MA_10-B5_CC_x_I2E6 | NA | No nuc. seq available | No nuc. seq available | No nuc. seq available |
| | AA | RTSQSISSYLN (SEQ ID NO: 18149) | AASSLQG (SEQ ID NO: 18161) | QQTYSMPFT (SEQ ID NO: 18173) |
| MA_98-C7_CC_x_I2E6 | NA | No nuc. seq available | No nuc. seq available | No nuc. seq available |
| | AA | GGNNIGSKSVH (SEQ ID NO: 18150) | DDNDRPS (SEQ ID NO: 18162) | QVWDYSPLRHV (SEQ ID NO: 18174) |
| | | BITE Fv#1 VH CDRs | | |
| MA_03-G10_AS_CC_x_I2E6 | NA | No nuc. seq available | No nuc. seq available | No nuc. seq available |
| | AA | SYAMS (SEQ ID NO: 18151) | AISGSGGGTYYAASVKG (SEQ ID NO: 18163) | GKGVHLGFDY (SEQ ID NO: 18175) |
| MA_10-B5_CC_x_I2E6 | NA | No nuc. seq available | No nuc. seq available | No nuc. seq available |
| | AA | NAWMS (SEQ ID NO: 18152) | RIRSRSYGGTTDYAAPVKG (SEQ ID NO: 18164) | PSYGSYYNYFSVMDV (SEQ ID NO: 18176) |
| MA_98-C7_CC_x_I2E6 | NA | No nuc. seq available | No nuc. seq available | No nuc. seq available |
| | AA | SHAMS (SEQ ID NO: 18153) | SISGSGGGTYYAASVKG (SEQ ID NO: 18165) | GKGVHLGFDY (SEQ ID NO: 18177) |

TABLE 96

| Ab | Type | CDR1 | CDR2 | CDR3 |
|---|---|---|---|---|
| | | BiTE_Fv#2 VL CDRs | | |
| MA_03-G10_AS_CC_x_I2E6 | NA | No nuc. seq available | No nuc. seq available | No nuc. seq available |
| | AA | GSSTGAVTSGNYPN (SEQ ID NO: 18154) | GTKFLAP (SEQ ID NO: 18166) | VLWYSNRWV (SEQ ID NO: 18178) |
| MA_10-B5_CC_x_I2E6 | NA | No nuc. seq available | No nuc. seq available | No nuc. seq available |
| | AA | GSSTGAVTSGNYPN (SEQ ID NO: 18155) | GTKFLAP (SEQ ID NO: 18167) | VLWYSNRWV (SEQ ID NO: 18179) |
| MA_98-C7_CC_x_I2E6 | NA | No nuc. seq available | No nuc. seq available | No nuc. seq available |
| | AA | GSSTGAVTSGNYPN (SEQ ID NO: 18156) | GTKFLAP (SEQ ID NO: 18168) | VLWYSNRWV (SEQ ID NO: 18180) |

TABLE 96-continued

| Ab | Type | CDR1 | CDR2 | CDR3 |
|---|---|---|---|---|
| BiTE_Fv#2 VH CDRs | | | | |
| MA_03-G10_AS_CC_x_I2E6 | NA | No nuc. seq available | No nuc. seq available | No nuc. seq available |
| | AA | KYAIN (SEQ ID NO: 18157) | RIRSKYNNYATYYADAVKD (SEQ ID NO: 18169) | AGNFGSSYISYWAY (SEQ ID NO: 18181) |
| MA_10-B5_CC_x_I2E6 | NA | No nuc. seq available | No nuc. seq available | No nuc. seq available |
| | AA | KYAIN (SEQ ID NO: 18158) | RIRSKYNNYATYYADAVKD (SEQ ID NO: 18170) | AGNFGSSYISYWAY (SEQ ID NO: 18182) |
| MA_98-C7_CC_x_I2E6 | NA | No nuc. seq available | No nuc. seq available | No nuc. seq available |
| | AA | KYAIN (SEQ ID NO: 18159) | RIRSKYNNYATYYADAVKD (SEQ ID NO: 18171) | AGNFGSSYISYWAY (SEQ ID NO: 18183) |

TABLE 97

BiTE Variable Region Sequences

| Ab | Type | LC V-region | HC V-region |
|---|---|---|---|
| Fv#1 | | | |
| MA_03-G10_AS_CC_x_I2E6 | NA | No nuc. seq available | No nuc. seq available |
| | AP | SYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGCGTKLTVL (SEQ ID NO: 18184) | EVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGEDYWGQGTLVTVSS (SEQ ID NO: 18187) |
| MA_10-B5_CC_x_I2E6 | NA | No nuc. seq available | No nuc. seq available |
| | AA | DIQMTQSPSSLSASVGDRVTITCRTSQSISSYLNWYQQKPGRAPKLLIFAASSLQGGVPSRESGSGSGTDFTLTISSLQPEDFATYYCQQTYSMPFTFGCGTKVEIK (SEQ ID NO: 18185) | EVQLVESGGGLVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSS (SEQ ID NO: 18188) |
| MA_98-C7_CC_x_I2E6 | NA | No nuc. seq available | No nuc. seq available |
| | AA | SYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGCGTKLTVL (SEQ ID NO: 18186) | EVQLLESGGGLVQPGGSLRLSCAASGFTFSSHAMSWVRQAPGKCLEWVSSISGSGGGTYYAASVKGRFTISRDNSKNTLYLQMNSLRAEDTAVYYCATGKGVHLGFDYWGQGTLVTVSS (SEQ ID NO: 18189) |
| Fv#2 | | | |
| MA_03-G10_AS_CC_x_I2E6 | NA | No nuc. seq available | No nuc. seq available |
| | AA | QTVVTQEPSLTVSPGGTVTITCGSSTGAVTSGNYPNWVQKKPGQAPRGLIGGTKFLAPGTPARESGSLSGGKAALTLSGVQPEDEAEYYCVLWYSNRWVFGSGTKLTVL (SEQ ID NO: 18190) | EVQLVESGGGLVQPGGSLKLSCAASGFTENKYAINWVRQAPGKGLEWVARIRSKYIYNNYATYYADKDRFTISRDDSKNTVYLQMNNLKTEDTAVYYCARAGNFGSSYISYWAYWGQGTLVTVSS (SEQ ID NO: 18193) |
| MA_10-B5_CC_x_I2E6 | NA | No nuc. seq available | No nuc. seq available |
| | AA | QTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTV L (SEQ ID NO: 18191) | EVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSS (SEQ ID NO: 18194) |
| MA_98-C7_CC_x_I2E6 | NA | No nuc. seq available | No nuc. seq available |
| | AA | QTVVTQEPSLTVSPGGTVTITCGSSTGAVTSGNYPNWVQKKPGQAPRGLIGGTK | EVQLVESGGGLVQPGGSLKLSCAASGFTENKYAINWVRQAPGKGLEWVARIRSK |

TABLE 97-continued

BiTE Variable Region Sequences

| Ab | Type | LC V-region | HC V-region |
|---|---|---|---|
| | | FLAPGTPARESGSLSGGKAALTLSGVQ PEDEAEYYCVLWYSNRWVFGSGTKLTV L (SEQ ID NO: 18192) | YNNYATYYADAVKDRFTISRDDSKNTV YLQMNNLKTEDTAVYYCARAGNFGSSY ISYWAYWGQGTLVTVSS (SEQ ID NO: 18195) |

TABLE 98

BiTE Variable Region Protein Alignment
CDRs defined by Kabat
Alignment numbering defined by Amgen Reference (AHo)

KAPPA_VARIABLE

| Germline | | SEQ ID NO: |
|---|---|---|
| | K_FR1 | |
| VK1\|O12/JK1 | DIQMTQSPSSLSASVGDRVTITC | 18196 |
| MA_10-B5_CC_x_I2E6_Fv#1 VK1\|O12/JK1 | DIQMTQSPSSLSASVGDRVTITC | 18197 |
| | K_CDR1 | |
| VK1\|O12/JK1 | RAS--QSIS------SYLN | 18214 |
| MA_10-B5_CC_x_I2E6_Fv#1 VK1\|O12/JK1 | RTS--QSIS------SYLN | 18215 |
| | K_FR2 | |
| VK1\|O12/JK1 | WYQQKPGKAPKLLIY | 18232 |
| MA_10-B5_CC_x_I2E6_Fv#1 VK1\|O12/JK1 | WYQQKPGRAPKLLIF | 18233 |

LAMBDA_VARIABLE

| Germline | | SEQ ID NO: |
|---|---|---|
| | L_FR1 | |
| VL3\|3h/JL2 | SYVLTQP-PSVSVAPGKTARITC | 18198 |
| MA_03-G10_AS_CC_x_I2E6 Fv#1 VL3\|3h/JL2 | SYVLTQP-PSVSVAPGQTARITC | 18199 |
| MA_98-C7_CC_x_I2E6 Fv#1 VL3\|3h/JL2 | SYVLTQP-PSVSVAPGQTARITC | 18200 |
| VL7\|7a/JL3b | QTVVTQE-PSLTVSPGGTVTLTC | 18201 |
| MA_03-G10_AS_CC_x_I2E6 Fv#2 VL7\|7a/JL3b | QTVVTQE-PSLTVSPGGTVTITC | 18202 |
| MA_10-B5_CC_x_I2E6_Fv#2 VL7\|7a/JL3b | QTVVTQE-PSLTVSPGGTVTITC | 18203 |
| MA_98-C7_CC_x_I2E6 Fv#2 VL7\|7a/JL3b | QTVVTQE-PSLTVSPGGTVTITC | 18204 |
| | L_CDR1 | |
| VL3\|3h/JL2 | GGN---NIGS-----KSVH | 18216 |
| MA_03-G10_AS_CC_x_I2E6 Fv#1 VL3\|3h/JL2 | GGN---NIGS-----KSVH | 18217 |
| MA_98-C7_CC_x_I2E6 Fv#1 VL3\|3h/JL2 | GGN---NIGS-----KSVH | 18218 |
| VL7\|7a/JL3b | ASST-GAVTSG----YYPN | 18219 |
| MA_03-G10_AS_CC_x_I2E6 Fv#2 VL7\|7a/JL3b | GSST-GAVTSG----NYPN | 18220 |
| MA_10-B5_CC_x_I2E6_Fv#2 VL7\|7a/JL3b | GSST-GAVTSG----NYPN | 18221 |
| MA_98-C7_CC_x_I2E6 Fv#2 VL7\|7a/JL3b | GSST-GAVTSG----NYPN | 18222 |

TABLE 98-continued

BiTE Variable Region Protein Alignment
CDRs defined by Kabat
Alignment numbering defined by Amgen Reference (AHo)

| | | L_FR2 | |
|---|---|---|---|
| VL3\|3h/JL2 | | WYQQKPGQAPVLVIY | 18234 |
| MA_03-G10_AS_CC_x_I2E6 Fv#1 | VL3\|3h/JL2 | WYQQKPGQAPVMVVY | 18235 |
| MA_98-C7_CC_x_I2E6 Fv#1 VL3\|3h/JL2 | | WYQQKPGQAPVMVVY | 18236 |
| VL7\|7a/JL3b | | WFQQKPGQAPRALIY | 18237 |
| MA_03-G10_AS_CC_x_I2E6 Fv#2 | VL7\|7a/JL3b | WVQKKPGQAPRGLIG | 18238 |
| MA_10-B5_CC_x_I2E6_Fv#2 VL7\|7a/JL3b | | WVQKKPGQAPRGLIG | 18239 |
| MA_98-C7_CC_x_I2E6 Fv#2 VL7\|7a/JL3b | | WVQKKPGQAPRGLIG | 18240 |

| | HEAVY_VARIABLE | | |
|---|---|---|---|
| | Germline | | SEQ ID NO: |
| | | H_FR1 | |
| VH3\|3-23/D6\|6-19\|RF2/JH4 | | EVQLLES-GGGLVQPGGSLRLSCAASG-FTFS | 18205 |
| MA_03-G10_AS_CC_x_I2E6 Fv#1 | VH3\|3-23/D6\|6-19\|RF2/JH4 | EVQLLES-GGGLVQPGGSLRLSCAASG-FTFS | 18206 |
| MA_98-C7_CC_x_I2E6 Fv#1 | VH3\|3-23/D6\|6-19\|RF2/JH4 | EVQLLES-GGGLVQPGGSLRLSCAASG-FTFS | 18207 |
| VH3\|3-73/D2\|2-21\|RF2/JH4 | | EVQLVES-GGGLVQPGGSLKLSCAASG-FTFS | 18208 |
| MA_03-G10_AS_CC_x_I2E6 Fv#2 | VH3\|3-73/D2\|2-21\|RF2/JH4 | EVQLVES-GGGLVQPGGSLKLSCAASG-FTFN | 18209 |
| MA_10-B5_CC_x_I2E6_Fv#2 | VH3\|3-73/D2\|2-21\|RF2/JH4 | EVQLVES-GGGLVQPGGSLKLSCAASG-FTFN | 18210 |
| MA_98-C7_CC_x_I2E6 Fv#2 | VH3\|3-73/D2\|2-21\|RF2/JH4 | EVQLVES-GGGLVQPGGSLKLSCAASG-FTFN | 18211 |
| VH3\|3-15/D3\|3-10\|RF2/JH6 | | EVQLVES-GGGLVKPGGSLRLSCAASG-FTFS | 18212 |
| MA_10-B5_CC_x_I2E6_Fv#1 | VH3\|3-15/D3\|3-10\|RF2/JH6 | EVQLVES-GGGLVQPGGSLRLSCAASG-FTFS | 18213 |
| | | H_CDR1 | |
| VH3\|3-23/D6\|6-19\|RF2/JH4 | | S-----YAMS | 18223 |
| MA_03-G10_AS_CC_x_I2E6 Fv#1 | VH3\|3-23/D6\|6-19\|RF2/JH4 | S-----YAMS | 18224 |
| MA_98-C7_CC_x_I2E6 Fv#1 | VH3\|3-23/D6\|6-19\|RF2/JH4 | S-----HAMS | 18225 |
| VH3\|3-73/D2\|2-21\|RF2/JH4 | | G-----SAMH | 18226 |
| MA_03-G10_AS_CC_x_I2E6 Fv#2 | VH3\|3-73/D2\|2-21\|RF2/JH4 | K-----YAIN | 18227 |
| MA_10-B5_CC_x_I2E6_Fv#2 | VH3\|3-73/D2\|2-21\|RF2/JH4 | K-----YAIN | 18228 |

TABLE 98-continued

BiTE Variable Region Protein Alignment
CDRs defined by Kabat
Alignment numbering defined by Amgen Reference (AHo)

| | | |
|---|---|---|
| MA_98-C7_CC_x_I2E6 Fv#2 VH3\|3-73/D2\|2-21\|RF2/JH4 | K-----YAIN | 18229 |
| VH3\|3-15/D3\|3-10\|RF2/JH6 | N-----AWMS | 18230 |
| MA_10-B5_CC_x_I2E6 Fv#1 VH3\|3-15/D3\|3-10\|RF2/JH6 | N-----AWMS | 18231 |

| | H_FR2 | |
|---|---|---|
| VH3\|3-23/D6\|6-19\|RF2/JH4 | WVRQAPGKGLEWVS | 18241 |
| MA_03-G10_AS_CC_x_I2E6 Fv#1 VH3\|3-23/D6\|6-19\|RF2/JH4 | WVRQAPGKCLEWVS | 18242 |
| MA_98-C7_CC_x_I2E6 Fv#1 VH3\|3-23/D6\|6-19\|RF2/JH4 | WVRQAPGKCLEWVS | 18243 |
| VH3\|3-73/D2\|2-21\|RF2/JH4 | WVRQASGKGLEWVG | 18244 |
| MA_03-G10_AS_CC_x_I2E6 Fv#2 VH3\|3-73/D2\|2-21\|RF2/JH4 | WVRQAPGKGLEWVA | 18245 |
| MA_10-B5_CC_x_I2E6 Fv#2 VH3\|3-73/D2\|2-21\|RF2/JH4 | WVRQAPGKGLEWVA | 18246 |
| MA_98-C7_CC_x_I2E6 Fv#2 VH3\|3-73/D2\|2-21\|RF2/JH4 | WVRQAPGKGLEWVA | 18247 |
| VH3\|3-15/D3\|3-10\|RF2/JH6 | WVRQAPGKGLEWVG | 18248 |
| MA_10-B5_CC_x_I2E6 Fv#1 VH3\|3-15/D3\|3-10\|RF2/JH6 | WVRQAPGKCLEWVG | 18249 |

KAPPA_VARIABLE

| Germline | | SEQ ID NO: |
|---|---|---|
| | K_CDR2 | |
| VK1\|O12/JK1 | A--------ASSLQS | 18250 |
| MA_10-B5_CC_x_I2E6 Fv#1 VK1\|O12/JK1 | A--------ASSLQG | 18251 |
| | K_FR3 | |
| VK1\|O12/JK1 | GVPSRFSGSGSG--TDFTLTISSLQPEDFATYYC | 18268 |
| MA_10-B5_CC_x_I2E6 Fv#1 VK1\|O12/JK1 | GVPSRFSGSGSG--TDFTLTISSLQPEDFATYYC | 18269 |

LAMBDA_VARIABLE

| Germline | | SEQ ID NO: |
|---|---|---|
| | L_CDR2 | |
| VL3\|3h/JL2 | Y--------DSDRPS | 18252 |
| MA_03-G10_AS_CC_x_I2E6 Fv#1 VL3\|3h/JL2 | D--------DNDRPS | 18253 |
| MA_98-C7_CC_x_I2E6 Fv#1 VL3\|3h/JL2 | D--------DNDRPS | 18254 |
| VL7\|7a/JL3b | S--------TSNKHS | 18255 |
| MA_03-G10_AS_CC_x_I2E6 Fv#2 VL7\|7a/JL3b | G--------TKFLAP | 18256 |
| MA_10-B5_CC_x_I2E6 Fv#2 VL7\|7a/JL3b | G--------TKFLAP | 18257 |
| MA_98-C7_CC_x_I2E6 Fv#2 VL7\|7a/JL3b | G--------TKFLAP | 18258 |

TABLE 98-continued

BiTE Variable Region Protein Alignment
CDRs defined by Kabat
Alignment numbering defined by Amgen Reference (AHo)

L_FR3

| Name | Germline | Sequence | ID |
|---|---|---|---|
| VL3\|3h/JL2 | | GIPERFSGSNSG--NTATLTISRVEAGDEADYYC | 18270 |
| MA_03-G10_AS_CC_x_I2E6 Fv#1 | VL3\|3h/JL2 | GIPERFSGSNSG--NTATLTISRVEAGDEADYYC | 18271 |
| MA_98-C7_CC_x_I2E6 Fv#1 | VL3\|3h/JL2 | GIPERFSGSNSG--NTATLTISRVEAGDEADYYC | 18272 |
| VL7\|7a/JL3b | | WTPARFSGSLLG--GKAALTLSGVQPEDEAEYYC | 18273 |
| MA_03-G10_AS_CC_x_I2E6 Fv#2 | VL7\|7a/JL3b | GTPARFSGSLSG--GKAALTLSGVQPEDEAEYYC | 18274 |
| MA_10-B5_CC_x_I2E6_Fv#2 | VL7\|7a/JL3b | GTPARFSGSLSG--GKAALTLSGVQPEDEAEYYC | 18275 |
| MA_98-C7_CC_x_I2E6 Fv#2 | VL7\|7a/JL3b | GTPARFSGSLSG--GKAALTLSGVQPEDEAEYYC | 18276 |

HEAVY_VARIABLE

Germline

H_CDR2

| Name | Germline | Sequence | ID |
|---|---|---|---|
| VH3\|3-23/D6\|6-19\|RF2/JH4 | | AISGS---GGSTYYADSVKG | 18259 |
| MA_03-G10_AS_CC_x_I2E6 Fv#1 | VH3\|3-23/D6\|6-19\|RF2/JH4 | AISGS---GGGTYYAASVKG | 18260 |
| MA_98-C7_CC_x_I2E6 Fv#1 | VH3\|3-23/D6\|6-19\|RF2/JH4 | SISGS---GGGTYYAASVKG | 18261 |
| VH3\|3-73/D2\|2-21\|RF2/JH4 | | RIRSKA-NSYATAYAASVKG | 18262 |
| MA_03-G10_AS_CC_x_I2E6 Fv#2 | VH3\|3-73/D2\|2-21\|RF2/JH4 | RIRSKY-NNYATYYADAVKD | 18263 |
| MA_10-B5_CC_x_I2E6_Fv#2 | VH3\|3-73/D2\|2-21\|RF2/JH4 | RIRSKY-NNYATYYADAVKD | 18264 |
| MA_98-C7_CC_x_I2E6 Fv#2 | VH3\|3-73/D2\|2-21\|RF2/JH4 | RIRSKY-NNYATYYADAVKD | 18265 |
| VH3\|3-15/D3\|3-10\|RF2/JH6 | | RIKSKT-DGGTTDYAAPVKG | 18266 |
| MA_10-B5_CC_x_I2E6_Fv#1 | VH3\|3-15/D3\|3-10\|RF2/JH6 | RIRSRS-YGGTTDYAAPVKG | 18267 |

H_FR3

| Name | Germline | Sequence | ID |
|---|---|---|---|
| VH3\|3-23/D6\|6-19\|RF2/JH4 | | RFTISRDNSKNTLYLQMNSLRAEDTAVYYCAK | 18277 |
| MA_03-G10_AS_CC_x_I2E6 Fv#1 | VH3\|3-23/D6\|6-19\|RF2/JH4 | RFTISRDNSKNTLYLQMSSLRAEDTAVYYCAT | 18278 |
| MA_98-C7_CC_x_I2E6 Fv#1 | VH3\|3-23/D6\|6-19\|RF2/JH4 | RFTISRDNSKNTLYLQMNSLRAEDTAVYYCAT | 18279 |
| VH3\|3-73/D2\|2-21\|RF2/JH4 | | RFTISRDDSKNTAYLQMNSLKTEDTAVYYCTR | 18280 |
| MA_03-G10_AS_CC_x_I2E6 Fv#2 | VH3\|3-73/D2\|2-21\|RF2/JH4 | RFTISRDDSKNTVYLQMNNLKTEDTAVYYCAR | 18281 |
| MA_10-B5_CC_x_I2E6_Fv#2 | VH3\|3-73/D2\|2-21\|RF2/JH4 | RFTISRDDSKNTVYLQMNNLKTEDTAVYYCAR | 18282 |

TABLE 98-continued

BiTE Variable Region Protein Alignment
CDRs defined by Kabat
Alignment numbering defined by Amgen Reference (AHo)

| | | | |
|---|---|---|---|
| MA_98-C7_CC_x_I2E6 Fv#2 | VH3\|3-73/D2\|2-21\|RF2/JH4 | RFTISRDDSKNTVYLQMNNLKTEDTAVYYCAR | 18283 |
| | VH3\|3-15/D3\|3-10\|RF2/JH6 | RFTISRDDSKNTLYLQMNSLKTEDTAVYYCTT | 18284 |
| MA_10-B5_CC_x_I2E6 Fv#1 | VH3\|3-15/D3\|3-10\|RF2/JH6 | RFTISRDDSKNTLFLQMNSLKTEDTAVYYCTT | 18285 |

KAPPA_VARIABLE

Germline

| | | K_CDR3 | |
|---|---|---|---|
| VK1\|O12/JK1 | | QQSYS----------------------TPWT | 18286 |
| MA_10-B5_CC_x_I2E6 Fv#1 | VK1\|O12/JK1 | QQTYS----------------------MPFT | 18287 |

| | | K_FR4 | |
|---|---|---|---|
| VK1\|O12/JK1 | | FGQGTKVEIK | 18304 |
| MA_10-B5_CC_x_I2E6 Fv#1 | VK1\|O12/JK1 | FGCGTKVEIK | 18305 |

LAMBDA_VARIABLE

| Germline | | | SEQ ID NO: |
|---|---|---|---|
| | | L_CDR3 | |
| VL3\|3h/JL2 | | QVWDSS---------------------SDHVV | 18288 |
| MA_03-G10_AS_CC_x_I2E6 Fv#1 | VL3\|3h/JL2 | QVWDYS---------------------GQRQV | 18289 |
| MA_98-C7_CC_x_I2E6 Fv#1 | VL3\|3h/JL2 | QVWDYS---------------------PLRHV | 18290 |
| VL7\|7a/JL3b | | LLYYG----------------------GAQWV | 18291 |
| MA_03-G10_AS_CC_x_I2E6 Fv#2 | VL7\|7a/JL3b | VLWYS----------------------NRWV | 18292 |
| MA_10-B5_CC_x_I2E6 Fv#2 | VL7\|7a/JL3b | VLWYS----------------------NRWV | 18293 |
| MA_98-C7_CC_x_I2E6 Fv#2 | VL7\|7a/JL3b | VLWYS----------------------NRWV | 18294 |

| | | L_FR4 | |
|---|---|---|---|
| VL3\|3h/JL2 | | FGGGTKLTVL | 18306 |
| MA_03-G10_AS_CC_x_I2E6 Fv#1 | VL3\|3h/JL2 | FGCGTKLTVL | 18307 |
| MA_98-C7_CC_x_I2E6 Fv#1 | VL3\|3h/JL2 | FGCGTKLTVL | 18308 |
| VL7\|7a/JL3b | | FGGGTKLTVL | 18309 |
| MA_03-G10_AS_CC_x_I2E6 Fv#2 | VL7\|7a/JL3b | FGSGTKLTVL | 18310 |
| MA_10-B5_CC_x_I2E6 Fv#2 | VL7\|7a/JL3b | FGSGTKLTVL | 18311 |
| MA_98-C7_CC_x_I2E6 Fv#2 | VL7\|7a/JL3b | FGSGTKLTVL | 18312 |

TABLE 98-continued

BiTE Variable Region Protein Alignment
CDRs defined by Kabat
Alignment numbering defined by Amgen Reference (AHo)

HEAVY_VARIABLE

| Germline | | SEQ ID NO: |
|---|---|---|
| H_CDR3 | | |
| VH3\|3-23/D6\|6-19\|RF2/JH4 | GIAVA-------------------GYFDY | 18295 |
| MA_03-G10 AS CC_x_I2E6 Fv#1 | VH3\|3-23/D6\|6-19\|RF2/JH4 GKGVH-------------------LGFDY | 18296 |
| MA_98-C7_CC_x_I2E6 Fv#1 | VH3\|3-23/D6\|6-19\|RF2/JH4 GKGVH-------------------LGEDY | 18297 |
| VH3\|3-73/D2\|2-21\|RF2/JH4 | AYCGGDC----------------YSYFDY | 18298 |
| MA_03-G10 AS CC_x_I2E6 Fv#2 | VH3\|3-73/D2\|2-21\|RF2/JH4 AGNFGSS----------------YISYWAY | 18299 |
| MA_10-B5_CC_x_I2E6_Fv#2 | VH3\|3-73/D2\|2-21\|RF2/JH4 AGNEGSS----------------YISYWAY | 18300 |
| MA_98-C7_CC_x_I2E6 Fv#2 | VH3\|3-73/D2\|2-21\|RF2/JH4 AGNFGSS----------------YISYWAY | 18301 |
| VH3\|3-15/D3\|3-10\|RF2/JH6 | YYYGSGSYYN-----------YYYYYGMDV | 18302 |
| MA_10-B5_CC_x_I2E6_Fv#1 | VH3\|3-15/D3\|3-10\|RF2/JH6 PSYSGSYY--------------NYFSVMDV | 18303 |
| H_FR4 | | |
| VH3\|3-23/D6\|6-19\|RF2/JH4 | WGQGTLVTVSS | 18313 |
| MA_03-G10 AS CC_x_I2E6 Fv#1 | VH3\|3-23/D6\|6-19\|RF2/JH4 WGQGTLVTVSS | 18314 |
| MA_98-C7_CC_x_I2E6 Fv#1 | VH3\|3-23/D6\|6-19\|RF2/JH4 WGQGTLVTVSS | 18315 |
| VH3\|3-73/D2\|2-21\|RF2/JH4 | WGQGTLVTVSS | 18316 |
| MA_03-G10 AS CC_x_I2E6 Fv#2 | VH3\|3-73/D2\|2-21\|RF2/JH4 WGQGTLVTVSS | 18317 |
| MA_10-B5_CC_x_I2E6_Fv#2 | VH3\|3-73/D2\|2-21\|RF2/JH4 WGQGTLVTVSS | 18318 |
| MA_98-C7_CC_x_I2E6 Fv#2 | VH3\|3-73/D2\|2-21\|RF2/JH4 WGQGTLVTVSS | 18319 |
| VH3\|3-15/D3\|3-10\|RF2/JH6 | WGQGTTVTVSS | 18320 |
| MA_10-B5_CC_x_I2E6_Fv#1 | VH3\|3-15/D3\|3-10\|RF2/JH6 WGQGTTVTVSS | 18321 |

TABLE 99

BiTE Variable Region Concensus Protein Alignment
CDRs defined by Kabat
Alignment numbering defined by Amgen Reference (AHo)

KAPPA_VARIABLE

| Germline | | SEQ ID NO: |
|---|---|---|
| | K_FR1 | |
| VK1\|O12/JK1 | DIQMTQSPSSLSASVGDRVTITC | 18322 |
| MA_10-B5_CC_x_I2E6_Fv#1 VK1\|O12/JK1 | ....................... | 18323 |
| | K_CDR1 | |
| VK1\|O12/JK1 | RAS--QSIS------SYLN | 18340 |
| MA_10-B5_CC_x_I2E6_Fv#1 VK1\|O12/JK1 | .T................. | 18341 |
| | K_FR2 | |
| VK1\|O12/JK1 | WYQQKPGKAPKLLIY | 18358 |
| MA_10-B5_CC_x_I2E6_Fv#1 VK1\|O12/JK1 | .......R......F | 18359 |

LAMBDA_VARIABLE

| Germline | | SEQ ID NO: |
|---|---|---|
| | L_FR1 | |
| VL3\|3h/JL2 | SYVLTQP-PSVSVAPGKTARITC | 18324 |
| MA_03-G10_AS_CC_x_I2E6 VL3\|3h/JL2 Fv#1 | ................Q...... | 18325 |
| MA_98-C7_CC_x_I2E6_Fv#1 VL3\|3h/JL2 | ................Q...... | 18326 |
| VL7\|7a/JL3b | QTVVTQE-PSLTVSPGGTVTLTC | 18327 |
| MA_03-G10_AS_CC_x_I2E6 VL7\|7a/JL3b Fv#2 | ....................I.. | 18328 |
| MA_10-B5_CC_x_I2E6_Fv#2 VL7\|7a/JL3b | ....................I.. | 18329 |
| MA_98-C7_CC_x_I2E6_Fv#2 VL7\|7a/JL3b | ....................I.. | 18330 |
| | L_CDR1 | |
| VL3\|3h/JL2 | GGN---NIGS-----KSVH | 18342 |
| MA_03-G10_AS_CC_x_I2E6 VL3\|3h/JL2 Fv#1 | ................... | 18343 |
| MA_98-C7_CC_x_I2E6_Fv#1 VL3\|3h/JL2 | ................... | 18344 |
| VL7\|7a/JL3b | ASST-GAVTSG----YYPN | 18345 |
| MA_03-G10_AS_CC_x_I2E6 VL7\|7a/JL3b Fv#2 | G..............N... | 18346 |
| MA_10-B5_CC_x_I2E6_Fv#2 VL7\|7a/JL3b | G..............N... | 18347 |
| MA_98-C7_CC_x_I2E6_Fv#2 VL7\|7a/JL3b | G..............N... | 18348 |
| | L_FR2 | |
| VL3\|3h/JL2 | WYQQKPGQAPVLVIY | 18360 |
| MA_03-G10_AS_CC_x_I2E6 VL3\|3h/JL2 Fv#1 | ...........M.V. | 18361 |
| MA_98-C7_CC_x_I2E6_Fv#1 VL3\|3h/JL2 | ...........M.V. | 18362 |
| VL7\|7a/JL3b | WFQQKPGQAPRALIY | 18363 |
| MA_03-G10_AS_CC_x_I2E6 VL7\|7a/JL3b Fv#2 | .V.K.......G..G | 18364 |

TABLE 99-continued

BiTE Variable Region Concensus Protein Alignment
CDRs defined by Kabat
Alignment numbering defined by Amgen Reference (AHo)

| | | | |
|---|---|---|---|
| MA_10-B5_CC_x_I2E6_Fv#2 | VL7|7a/JL3b | .V.K.......G..G | 18365 |
| MA_98-C7_CC_x_I2E6 Fv#2 | VL7|7a/JL3b | .V.K.......G..G | 18366 |

HEAVY_VARIABLE

| | Germline | | SEQ ID NO: |
|---|---|---|---|

H_FR1

| | | | |
|---|---|---|---|
| VH3|3-23/D6|6-19|RF2/JH4 | | EVQLLES-GGGLVQPGGSLRLSCAASG-FTFS | 18331 |
| MA_03-G10_AS_CC_x_I2E6 Fv#1 | VH3|3-23/D6|6-19|RF2/JH4 | ................................ | 18332 |
| MA_98-C7_CC_x_I2E6 Fv#1 | VH3|3-23/D6|6-19|RF2/JH4 | ................................ | 18333 |
| VH3|3-73/D2|2-21|RF2/JH4 | | EVQLVES-GGGLVQPGGSLKLSCAASG-FTFS | 18334 |
| MA_03-G10_AS_CC_x_I2E6 Fv#2 | VH3|3-73/D2|2-21|RF2/JH4 | ...............................N | 18335 |
| MA_10-B5_CC_x_I2E6_Fv#2 | VH3|3-73/D2|2-21|RF2/JH4 | ...............................N | 18336 |
| MA_98-C7_CC_x_I2E6 Fv#2 | VH3|3-73/D2|2-21|RF2/JH4 | ...............................N | 18337 |
| VH3|3-15/D3|3-10|RF2/JH6 | | EVQLVES-GGGLVKPGGSLRLSCAASG-FTFS | 18338 |
| MA_10-B5_CC_x_I2E6_Fv#1 | VH3|3-15/D3|3-10|RF2/JH6 | .............Q.................. | 18339 |

H_CDR1

| | | | |
|---|---|---|---|
| VH3|3-23/D6|6-19|RF2/JH4 | | S-----YAMS | 18349 |
| MA_03-G10_AS_CC_x_I2E6 Fv#1 | VH3|3-23/D6|6-19|RF2/JH4 | .......... | 18350 |
| MA_98-C7_CC_x_I2E6 Fv#1 | VH3|3-23/D6|6-19|RF2/JH4 | ......H... | 18351 |
| VH3|3-73/D2|2-21|RF2/JH4 | | G-----SAMH | 18352 |
| MA_03-G10_AS_CC_x_I2E6 Fv#2 | VH3|3-73/D2|2-21|RF2/JH4 | K-....Y.IN | 18353 |
| MA_10-B5_CC_x_I2E6_Fv#2 | VH3|3-73/D2|2-21|RF2/JH4 | K-....Y.IN | 18354 |
| MA_98-C7_CC_x_I2E6 Fv#2 | VH3|3-73/D2|2-21|RF2/JH4 | K-....Y.IN | 18355 |
| VH3|3-15/D3|3-10|RF2/JH6 | | N-----AWMS | 18356 |
| MA_10-B5_CC_x_I2E6_Fv#1 | VH3|3-15/D3|3-10|RF2/JH6 | .......... | 18357 |

H_FR2

| | | | |
|---|---|---|---|
| VH3|3-23/D6|6-19|RF2/JH4 | | WVRQAPGKGLEWVS | 18367 |
| MA_03-G10_AS_CC_x_I2E6 Fv#1 | VH3|3-23/D6|6-19|RF2/JH4 | ........C..... | 18368 |
| MA_98-C7_CC_x_I2E6 Fv#1 | VH3|3-23/D6|6-19|RF2/JH4 | ........C..... | 18369 |

TABLE 99-continued

BiTE Variable Region Concensus Protein Alignment
CDRs defined by Kabat
Alignment numbering defined by Amgen Reference (AHo)

| | | | SEQ ID NO: |
|---|---|---|---|
| VH3\|3-73/D2\|2-21\|RF2/JH4 | | WVRQASGKGLEWVG | 18370 |
| MA_03-G10_AS_CC_x_I2E6 Fv#2 | VH3\|3-73/D2\|2-21\|RF2/JH4 | .....P.......A | 18371 |
| MA_10-B5_CC_x_I2E6_Fv#2 | VH3\|3-73/D2\|2-21\|RF2/JH4 | .....P.......A | 18372 |
| MA_98-C7_CC_x_I2E6 Fv#2 | VH3\|3-73/D2\|2-21\|RF2/JH4 | .....P.......A | 18373 |
| VH3\|3-15/D3\|3-10\|RF2/JH6 | | WVRQAPGKGLEWVG | 18374 |
| MA_10-B5_CC_x_I2E6_Fv#1 | VH3\|3-15/D3\|3-10\|RF2/JH6 | ........C..... | 18375 |

KAPPA_VARIABLE

| Germline | | | SEQ ID NO: |
|---|---|---|---|
| | | K_CDR2 | |
| VK1\|O12/JK1 | | A--------ASSLQS | 18376 |
| MA_10-B5_CC_x_I2E6_Fv#1 | VK1\|O12/JK1 | ..............G | 18377 |
| | | K_FR3 | |
| VK1\|O12/JK1 | | GVPSRFSGSGSG--TDFTLTISSLQPEDFATYYC | 18394 |
| MA_10-B5_CC_x_I2E6_Fv#1 | VK1\|O12/JK1 | ................................. | 18395 |

LAMBDA_VARIABLE

| Germline | | | SEQ ID NO: |
|---|---|---|---|
| | | L_CDR2 | |
| VL3\|3h/JL2 | | Y--------DSDRPS | 18378 |
| MA_03-G10_AS_CC_x_I2E6 Fv#1 | VL3\|3h/JL2 | D.........N.... | 18379 |
| MA_98-C7_CC_x_I2E6 Fv#1 | VL3\|3h/JL2 | D.........N.... | 18380 |
| VL7\|7a/JL3b | | S--------TSNKHS | 18381 |
| MA_03-G10_AS_CC_x_I2E6 Fv#2 | VL7\|7a/JL3b | G.........KFLAP | 18382 |
| MA_10-B5_CC_x_I2E6_Fv#2 | VL7\|7a/JL3b | G.........KFLAP | 18383 |
| MA_98-C7_CC_x_I2E6 Fv#2 | VL7\|7a/JL3b | G.........KFLAP | 18384 |
| | | L_FR3 | |
| VL3\|3h/JL2 | | GIPERFSGSNSG--NTATLTISRVEAGDEADYYC | 18396 |
| MA_03-G10_AS_CC_x_I2E6 Fv#1 | VL3\|3h/JL2 | ................................. | 18397 |
| MA_98-C7_CC_x_I2E6 Fv#1 | VL3\|3h/JL2 | ................................. | 18398 |
| VL7\|7a/JL3b | | WTPARFSGSLLG--GKAALTLSGVQPEDEAEYYC | 18399 |
| MA_03-G10_AS_CC_x_I2E6 Fv#2 | VL7\|7a/JL3b | G.........S...................... | 18400 |
| MA_10-B5_CC_x_I2E6_Fv#2 | VL7\|7a/JL3b | G.........S...................... | 18401 |
| MA_98-C7_CC_x_I2E6 Fv#2 | VL7\|7a/JL3b | G.........S...................... | 18402 |

TABLE 99-continued

BiTE Variable Region Concensus Protein Alignment
CDRs defined by Kabat
Alignment numbering defined by Amgen Reference (AHo)

HEAVY_VARIABLE

Germline

H_CDR2

| | | | |
|---|---|---|---|
| VH3\|3-23/D6\|6-19\|RF2/JH4 | | AISGS---GGSTYYADSVKG | 18385 |
| MA_03-G10_AS_CC_x_I2E6 Fv#1 | VH3\|3-23/D6\|6-19\|RF2/JH4 | ..........G....A.... | 18386 |
| MA_98-C7_CC_x_I2E6 Fv#1 | VH3\|3-23/D6\|6-19\|RF2/JH4 | ..........G....A.... | 18387 |
| VH3\|3-73/D2\|2-21\|RF2/JH4 | | RIRSKA-NSYATAYAASVKG | 18388 |
| MA_03-G10_AS_CC_x_I2E6 Fv#2 | VH3\|3-73/D2\|2-21\|RF2/JH4 | .....Y..N...Y..DA..D | 18389 |
| MA_10-B5_CC_x_I2E6 Fv#2 | VH3\|3-73/D2\|2-21\|RF2/JH4 | .....Y..N...Y..DA..D | 18390 |
| MA_98-C7_CC_x_I2E6 Fv#2 | VH3\|3-73/D2\|2-21\|RF2/JH4 | .....Y..N...Y..DA..D | 18391 |
| VH3\|3-15/D3\|3-10\|RF2/JH6 | | RIKSKT-DGGTTDYAAPVKG | 18392 |
| MA_10-B5_CC_x_I2E6 Fv#1 | VH3\|3-15/D3\|3-10\|RF2/JH6 | ...R.RS.Y........... | 18393 |

H_FR3

| | | | |
|---|---|---|---|
| VH3\|3-23/D6\|6-19\|RF2/JH4 | | RFTISRDNSKNTLYLQMNSLRAEDTAVYYCAK | 18403 |
| MA_03-G10_AS_CC_x_I2E6 Fv#1 | VH3\|3-23/D6\|6-19\|RF2/JH4 | .................S..............T | 18404 |
| MA_98-C7_CC_x_I2E6 Fv#1 | VH3\|3-23/D6\|6-19\|RF2/JH4 | ................................T | 18405 |
| VH3\|3-73/D2\|2-21\|RF2/JH4 | | RFTISRDDSKNTAYLQMNSLKTEDTAVYYCTR | 18406 |
| MA_03-G10_AS_CC_x_I2E6 Fv#2 | VH3\|3-73/D2\|2-21\|RF2/JH4 | ..............V.....N............A. | 18407 |
| MA_10-B5_CC_x_I2E6 Fv#2 | VH3\|3-73/D2\|2-21\|RF2/JH4 | ..............V.....N............A. | 18408 |
| MA_98-C7_CC_x_I2E6 Fv#2 | VH3\|3-73/D2\|2-21\|RF2/JH4 | ..............V.....N............A. | 18409 |
| VH3\|3-15/D3\|3-10\|RF2/JH6 | | RFTISRDDSKNTLYLQMNSLKTEDTAVYYCTT | 18410 |
| MA_10-B5_CC_x_I2E6 Fv#1 | VH3\|3-15/D3\|3-10\|RF2/JH6 | ..............F................. | 18411 |

KAPPA_VARIABLE

Germline

K_CDR3

| | | | |
|---|---|---|---|
| VK1\|O12/JK1 | | QQSYS--------------------TPWT | 18412 |
| MA_10-B5_CC_x_I2E6 Fv#1 | VK1\|O12/JK1 | ..T......................M.F. | 18413 |

TABLE 99-continued

BiTE Variable Region Concensus Protein Alignment
CDRs defined by Kabat
Alignment numbering defined by Amgen Reference (AHo)

K_FR4

| | | |
|---|---|---|
| VK1\|O12/JK1 | FGQGTKVEIK | 18430 |
| MA_10-B5_CC_x_I2E6_Fv#1 VK1\|O12/JK1 | ..C...... | 18431 |

LAMBDA_VARIABLE

| Germline | | SEQ ID NO: |
|---|---|---|

L_CDR3

| | | |
|---|---|---|
| VL3\|3h/JL2 | QVWDSS--------------------SDHVV | 18414 |
| MA_03-G10_AS_CC_x_I2E6 Fv#1 VL3\|3h/JL2 | ....Y...................GQRQ. | 18415 |
| MA_98-C7_CC_x_I2E6 Fv#1 VL3\|3h/JL2 | ....Y...................PLRH. | 18416 |
| VL7\|7a/JL3b | LLYYG--------------------GAQWV | 18417 |
| MA_03-G10_AS_CC_x_I2E6 Fv#2 VL7\|7a/JL3b | V.W.S...................-NR.. | 18418 |
| MA_10-B5_CC_x_I2E6_Fv#2 VL7\|7a/JL3b | V.W.S...................-NR.. | 18419 |
| MA_98-C7_CC_x_I2E6 Fv#2 VL7\|7a/JL3b | V.W.S...................-NR.. | 18420 |

L_FR4

| | | |
|---|---|---|
| VL3\|3h/JL2 | FGGGTKLTVL | 18306 |
| MA_03-G10_AS_CC_x_I2E6 Fv#1 VL3\|3h/JL2 | ..C...... | 18307 |
| MA_98-C7_CC_x_I2E6 Fv#1 VL3\|3h/JL2 | ..C...... | 18308 |
| VL7\|7a/JL3b | FGGGTKLTVL | 18309 |
| MA_03-G10_AS_CC_x_I2E6 Fv#2 VL7\|7a/JL3b | ..S...... | 18310 |
| MA_10-B5_CC_x_I2E6_Fv#2 VL7\|7a/JL3b | ..S...... | 18311 |
| MA_98-C7_CC_x_I2E6 Fv#2 VL7\|7a/JL3b | ..S...... | 18312 |

HEAVY_VARIABLE

| Germline | | SEQ ID NO: |
|---|---|---|

H_CDR3

| | | |
|---|---|---|
| VH3\|3-23/D6\|6-19\|RF2/JH4 | GIAVA--------------------GYFDY | 18421 |
| MA_03-G10 AS CC_x_I2E6 Fv#1 VH3\|3-23/D6\|6-19\|RF2/JH4 | .KG.H...................LG... | 18422 |
| MA_98-C7_CC_x_I2E6 Fv#1 VH3\|3-23/D6\|6-19\|RF2/JH4 | .KG.H...................LG... | 18423 |
| VH3\|3-73/D2\|2-21\|RF2/JH4 | AYCGGDC-----------------YSYFDY | 18424 |
| MA_03-G10 AS CC_x_I2E6 Fv#2 VH3\|3-73/D2\|2-21\|RF2/JH4 | .GNF.SS.................YI..WA. | 18425 |
| MA_10-B5_CC_x_I2E6_Fv#2 VH3\|3-73/D2\|2- | .GNF.SS.................YI..WA. | 18426 |

TABLE 99-continued

BiTE Variable Region Concensus Protein Alignment
CDRs defined by Kabat
Alignment numbering defined by Amgen Reference (AHo)

|  |  |  |  |
|---|---|---|---|
|  | 21\|RF2/JH4 |  |  |
| MA_98-C7_CC_x_I2E6 Fv#2 | VH3\|3-73/D2\|2-21\|RF2/JH4 | .GNF.SS................YI..WA. | 18427 |
| VH3\|3-15/D3\|3-10\|RF2/JH6 |  | YYYGSGSYYN-----------YYYYYGMDV | 18428 |
| MA_10-B5_CC_x_I2E6_Fv#1 | VH3\|3-15/D3\|3-10\|RF2/JH6 | PS.SGSY.---..............-N.FSV... | 18429 |
|  |  | H_FR4 |  |
| VH3\|3-23/D6\|6-19\|RF2/JH4 |  | WGQGTLVTVSS | 18439 |
| MA_03-G10 AS CC_x_I2E6 Fv#1 | VH3\|3-23/D6\|6-19\|RF2/JH4 | ........... | 18440 |
| MA_98-C7_CC_x_I2E6 Fv#1 | VH3\|3-23/D6\|6-19\|RF2/JH4 | ........... | 18441 |
| VH3\|3-73/D2\|2-21\|RF2/JH4 |  | WGQGTLVTVSS | 18442 |
| MA_03-G10 AS CC_x_I2E6 Fv#2 | VH3\|3-73/D2\|2-21\|RF2/JH4 | ........... | 18443 |
| MA_10-B5_CC_x_I2E6_Fv#2 | VH3\|3-73/D2\|2-21\|RF2/JH4 | ........... | 18444 |
| MA_98-C7_CC_x_I2E6 Fv#2 | VH3\|3-73/D2\|2-21\|RF2/JH4 | ........... | 18445 |
| VH3\|3-15/D3\|3-10\|RF2/JH6 |  | WGQGTTVTVSS | 18446 |
| MA_10-B5_CC_x_I2E6_Fv#1 | VH3\|3-15/D3\|3-10\|RF2/JH6 | ........... | 18447 |

SEQUENCE LISTING (18478 sequences)

SEQ ID NO: 1 - protein, 10 aa, Homo sapiens
GVYDGEEHSV

SEQ ID NO: 2 - protein, 10 aa, Homo sapiens
GVYDGREHTV

SEQ ID NO: 3 - protein, 10 aa, Homo sapiens
GLYDGREHSV

SEQ ID NO: 4 - protein, 10 aa, Artificial Sequence
  Description of Artificial Sequence: Synthetic peptide
DKTHTCPPCP

SEQ ID NO: 5 - protein, 12 aa, Artificial Sequence
  Description of Artificial Sequence: Synthetic peptide
ERKCCVECPPCP

SEQ ID NO: 6 - protein, 16 aa, Artificial Sequence
  Description of Artificial Sequence: Synthetic peptide
ELKTPLDTTHTCPRCP

SEQ ID NO: 7 - protein, 17 aa, Artificial Sequence
  Description of Artificial Sequence: Synthetic peptide
ELKTPLGDTTHTCPRCP

SEQ ID NO: 8 - protein, 12 aa, Artificial Sequence
  Description of Artificial Sequence: Synthetic peptide
ESKYGPPCPSCP

SEQ ID NO: 9 - protein, 15 aa, Artificial Sequence
  Description of Artificial Sequence: Synthetic peptide
EPKSCDKTHTCPPCP

SEQ ID NO: 10 - protein, 5 aa, Artificial Sequence
  Description of Artificial Sequence: Synthetic peptide
GGGGS

SEQ ID NO: 11 - protein, 10 aa, Artificial Sequence
  Description of Artificial Sequence: Synthetic peptide
GGGGSGGGGS

SEQ ID NO: 12 - protein, 15 aa, Artificial Sequence
  Description of Artificial Sequence: Synthetic peptide
GGGGSGGGGSGGGGS

SEQ ID NO: 13 - protein, 20 aa, Artificial Sequence
  Description of Artificial Sequence: Synthetic peptide
GGGGSGGGGSGGGGSGGGGS

SEQ ID NO: 14 - protein, 25 aa, Artificial Sequence
  Description of Artificial Sequence: Synthetic peptide
GGGGSGGGGSGGGGSGGGGSGGGGS

SEQ ID NO: 15 - protein, 30 aa, Artificial Sequence
  Description of Artificial Sequence: Synthetic polypeptide
GGGGSGGGGSGGGGSGGGGSGGGGSGGGGS

SEQ ID NO: 16 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 17 - protein, 40 aa, Artificial Sequence
  Description of Artificial Sequence: Synthetic polypeptide
GGGGSGGGGSGGGGSGGGGSGGGGSGGGGSGGGGSGGGGS

SEQ ID NO: 18 - protein, 6 aa, Artificial Sequence
  Description of Artificial Sequence: Synthetic peptide
PGGGGS

SEQ ID NO: 19 - protein, 6 aa, Artificial Sequence
  Description of Artificial Sequence: Synthetic peptide
PGGDGS

SEQ ID NO: 20 - protein, 6 aa, Artificial Sequence
  Description of Artificial Sequence: Synthetic peptide
SGGGGS

SEQ ID NO: 21 - protein, 4 aa, Artificial Sequence
  Description of Artificial Sequence: Synthetic peptide
GGGG

SEQ ID NO: 22 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 225 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 24 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 225 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 26 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 225 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 28 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 225 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 30 - protein, 6 aa, Artificial Sequence
  Description of Artificial Sequence: Synthetic 6xHis tag
HHHHHH

SEQ ID NO: 31 - protein, 109 aa, Artificial Sequence
  Description of Artificial Sequence: Synthetic polypeptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 32 - protein, 125 aa, Artificial Sequence
  Description of Artificial Sequence: Synthetic polypeptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 33 - protein, 249 aa, Artificial Sequence
  Description of Artificial Sequence: Synthetic polypeptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 34 - skipped

SEQ ID NO: 35 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYERPAMVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - skipped

SEQ ID NO: 37 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSTISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - skipped

SEQ ID NO: 39 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSTISGSGGGTYYADSVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - skipped

SEQ ID NO: 41 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYYAASVKARFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYLRQQQVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - skipped

SEQ ID NO: 43 - protein, 1007 aa, Artificial Sequence
  Description of Artificial Sequence: Synthetic polypeptide
MDMRVPAQLLGLLLLWLRGARCEVQLLESGGGVVQPGRSLRLSCAASGFTFSSHAMSWVRQAPGKCLEWVSAISGSGGGTYYAASGKGRFTISRDNSKNTLYLQMNSLRAEDTAAYYCVTGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYNMNVWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - skipped

SEQ ID NO: 45 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYNAASVKGRFTISRDNSKNTLYLQMNSLRAEDTAAYYCVTGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYYSNRAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - skipped

SEQ ID NO: 47 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - skipped

SEQ ID NO: 49 - protein, 1007 aa, Artificial Sequence
  Description of Artificial Sequence: Synthetic polypeptide
MDMRVPAQLLGLLLLWLRGARCEVQLLESGGGLVKPGGSLRLSCAASGFTFSSHAMSWVRQAPGKCLEWVSAISGSGGGTYYAASVKGRFTISRDNSKNTLYLQMNSLRAEDTAVYYCATGKGVHLNFDYWGQGTLVTVSSGGGGSGGGGSGGGGSSYVLTQPPSVSVAPGQTARITCGGNNIGSKSVHWYQQKPGQAPVLVVYDDNDRPSGIPERFSGSNFGNTATLIISRVEAGDEADYYCQVWDYLLPGQVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - skipped

SEQ ID NO: 51 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYNAASVKGRFTISRDNSKNTLYLQMNSLRAEDTAAYYCVTGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLTISRVEAGDEADYYCQVWDYVTPRWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - skipped

SEQ ID NO: 53 - protein, 1010 aa, Artificial Sequence
  Description of Artificial Sequence: Synthetic polypeptide
MDMRVPAQLLGLLLLWLRGARCQVTLKESGPALVKPTQTLTLTCTFSGFSFTTHKMGVDWIRQPPGKCLEWLAEIHSEDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCRASQSISNYFNWYQQKPGKAPKLLIYAASSLQSGVPSRFSGSGSGTDFTLTISSLQPEDFATYYCQQSYITPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - skipped

SEQ ID NO: 55 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIKSKTYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - skipped

SEQ ID NO: 57 - protein, 1010 aa, Artificial Sequence
  Description of Artificial Sequence: Synthetic polypeptide
MDMRVPAQLLGLLLLWLRGARCQITLKESGPMLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPDSLSASVGDRVTITCQASQDISNYLNWYQQKPGKAPKLLIYAASSLQSGVPSRFSGSGSGTDFTLTISSLQPEDFATYYCQQSYMWPTIFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - skipped

SEQ ID NO: 59 - protein, 1010 aa, Artificial Sequence
  Description of Artificial Sequence: Synthetic polypeptide
MDMRVPAQLLGLLLLWLRGARCQITLKESGPALVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYLNWYQQKPGKAPKLLIYAASSLQSGVPSRFSGRGSGTDFTLTISSLQPEDFATYYCQQSYYYPTLFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - skipped

SEQ ID NO: 61 - protein, 1010 aa, Artificial Sequence
  Description of Artificial Sequence: Synthetic polypeptide
MDMRVPAQLLGLLLLWLRGARCQITLKESGPTLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYLNWYQQKPGKAPKLLIYAASSLQSGVPSRFSGSGSGTDFTLTISSLQPEDFATYYCQQSYTLHPLFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - skipped

SEQ ID NO: 63 - protein, 1010 aa, Artificial Sequence
  Description of Artificial Sequence: Synthetic polypeptide
MDMRVPAQLLGLLLLWLRGARCQITLKESGPTLVKPTQTLTLTCTFSGFSFTTHKMGVDWIRQPPGKCLEWLAGIHIYDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYFNWYQQKPGKAPKLLIYAASSLQSGVPSRFSGSGSGTDFTLTISSLQPEDFATYYCQQSYITPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - skipped

SEQ ID NO: 65 - protein, 1010 aa, Artificial Sequence
  Description of Artificial Sequence: Synthetic polypeptide
MDMRVPAQLLGLLLLWLRGARCQITLKESGPMLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCRASQFISSYLNWYQQKPGKAPKLLIYAASSLQSGVPSRFSGRGSGTDFTLTISSLQPEDFATYYCQQSYQSPTTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - skipped

SEQ ID NO: 67 - protein, 1010 aa, Artificial Sequence
  Description of Artificial Sequence: Synthetic polypeptide
MDMRVPAQLLGLLLLWLRGARCQITLKESGPALVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYLNWYQQKPGKAPKLLIYAASSLQSGVPSRFSGSGSGTDFTLTISSLQPEDFATYYCQQSYFPVVEFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - skipped

SEQ ID NO: 69 - protein, 1010 aa, Artificial Sequence
  Description of Artificial Sequence: Synthetic polypeptide
MDMRVPAQLLGLLLLWLRGARCQITLKESGPTLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYLNWYQQKPGKAPKLLIYAASSLQSGVPSRFSGRGSGTDFTLTISSLQPEDFATYYCQQSYTPPTTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - skipped

SEQ ID NO: 71 - protein, 1010 aa, Artificial Sequence
  Description of Artificial Sequence: Synthetic polypeptide
MDMRVPAQLLGLLLLWLRGARCQITLKESGPTLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCRASQFISSYLNWYQQKPGKAPKLLIYAASSLQSGVPSRFSGSGSGTDFTLTISSLQPEDFATYYCQQSYSYPNSFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - skipped

SEQ ID NO: 73 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - skipped

SEQ ID NO: 75 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIKSKTYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCIQAYTSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - skipped

SEQ ID NO: 77 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRITSSRYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - skipped

SEQ ID NO: 79 - protein, 1014 aa, Artificial Sequence
  Description of Artificial Sequence: Synthetic polypeptide
MDMRVPAQLLGLLLLWLRGARCEVQLVESGGGLVKPGGSLRLSCAASGFTFSNAWMSWVRQAPGKCLEWVGRILNNAYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - skipped

SEQ ID NO: 81 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRILSMHYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWFQQKPGKAPKLLIFAASSLQSGVPSRFSGSGSGTDFTLTISSLQPEDFATYYCQQTYSMPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - skipped

SEQ ID NO: 83 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIVSSTYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - skipped

SEQ ID NO: 85 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYNAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - skipped

SEQ ID NO: 87 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYNADSVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - skipped

SEQ ID NO: 89 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRITSGIYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQSGVPSRFSGSGSGTDFTLTISSLQPEDFATYYCQQTYSMPFTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - skipped

SEQ ID NO: 91 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIRSRPYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - skipped

SEQ ID NO: 93 - protein, 1014 aa, Artificial Sequence
  Description of Artificial Sequence: Synthetic polypeptide
MDMRVPAQLLGLLLLWLRGARCQVQLQESGPGLVKPSETLSLTCTVSGDSISSSRYYWGWIRQPPGKCLEWIGSIYYSGSTYYNPSLKSRVTISVDTSKNQFSLKLSSVTAADTAVYYCARGIFGVITYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFYSTPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - skipped

SEQ ID NO: 95 - protein, 1003 aa, Artificial Sequence
  Description of Artificial Sequence: Synthetic polypeptide
MDMRVPAQLLGLLLLWLRGARCQVQLVESGGGVVQPGRSLRLSCAASGFTFSTYGMHWVRQAPGKCLEWVAVISYDASNKYYAESVKGRFTISRDNSKNTLYLQMNSLRAEDTAVYYCARGQLLTGYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDFATYYCQKYNSAPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - skipped

SEQ ID NO: 97 - protein, 1003 aa, Artificial Sequence
  Description of Artificial Sequence: Synthetic polypeptide
MDMRVPAQLLGLLLLWLRGARCQVQLVESGGGVVQPGRSLRLSCAASGFTFSTYGMHWVRQAPGKCLEWVAVISYDAETVKYAESVKGRFTISRDNSKNTLYLQMNSLRAEDTAVYYCARGQLLTGYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - skipped

SEQ ID NO: 99 - protein, 1006 aa, Artificial Sequence
  Description of Artificial Sequence: Synthetic polypeptide
MDMRVPAQLLGLLLLWLRGARCQVQLVESGGGLVKPGGSLRLSCAASGFTFSDYYMSWIRQAPGKCLEWVSYISKSSYTVTYADAVKGRFTISRDNAKNSLYLQMNSLRAEDTAVYYCATYNYGHFDYWGQGTLVTVSSGGGGSGGGGSGGGGSSYVLTQPPSVSVAPGQTARITCGGNNIGSKSVHWYQQKPGQAPVLVVYDDADRPSGIPERFSGSNSGNTATLTISRVEAGDEADYYCQVWDASAGYGVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - skipped

SEQ ID NO: 101 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSSISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - skipped

SEQ ID NO: 103 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYNAASVKGRFTISRDNSKNTLYLQMNSLRAEDTAAYYCVTGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVEAGDEADYYCQVWDYFSMTHVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - skipped

SEQ ID NO: 105 - protein, 1018 aa, Artificial Sequence
  Description of Artificial Sequence: Synthetic polypeptide
MDMRVPAQLLGLLLLWLRGARCQVQLQESGPGLVKPSQTLSLTCTVSGDSISSNPYYWSWIRQHPGKCLEWIGYISYSGITNYNPSLKSRVTMSVDTSKNQFSLKLTSLTAADTAVYYCAREKMWFGVLNYYYGMDVWGQGTTVTVSSGGGGSGGGGSGGGGSDIVMTQTPLSLPVTPGEPASISCRSSQSLLHRSGYNYLDWYLQKPGQSPQLLIYLGSNRASGVPDRFSGSGSGTDFTLKISRVEAGDVGVYYCMQALQTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106-108 - skipped (3 entries)

SEQ ID NO: 109 - protein, 11 aa, Artificial Sequence
  Description of Artificial Sequence: Synthetic peptide
GGNNIGSKSVH

SEQ ID NO: 110 - protein, 7 aa, Artificial Sequence
  Description of Artificial Sequence: Synthetic peptide
DDNDRPS

SEQ ID NO: 111 - protein, 11 aa, Artificial Sequence
  Description of Artificial Sequence: Synthetic peptide
QVWDYERPAMV

SEQ ID NO: 112-114 - skipped (3 entries)

SEQ ID NO: 115 - protein, 11 aa, Artificial Sequence
  Description of Artificial Sequence: Synthetic peptide
GGNNIGSKSVH

SEQ ID NO: 116 - protein, 7 aa, Artificial Sequence
  Description of Artificial Sequence: Synthetic peptide
DDNDRPS

SEQ ID NO: 117 - protein, 11 aa, Artificial Sequence
  Description of Artificial Sequence: Synthetic peptide
QVWDYRTLDWV

SEQ ID NO: 118-120 - skipped (3 entries)

SEQ ID NO: 121 - protein, 11 aa, Artificial Sequence
  Description of Artificial Sequence: Synthetic peptide
GGNNIGSKSVH

SEQ ID NO: 122 - protein, 7 aa, Artificial Sequence
  Description of Artificial Sequence: Synthetic peptide
DDNDRPS

SEQ ID NO: 123 - protein, 11 aa, Artificial Sequence
  Description of Artificial Sequence: Synthetic peptide
QVWDYRTLDWV

SEQ ID NO: 124-126 - skipped (3 entries)

SEQ ID NO: 127 - protein, 11 aa, Artificial Sequence
  Description of Artificial Sequence: Synthetic peptide
GGNNIGSKSVH

SEQ ID NO: 128 - protein, 7 aa, Artificial Sequence
  Description of Artificial Sequence: Synthetic peptide
DDNDRPS

SEQ ID NO: 129 - protein, 11 aa, Artificial Sequence
  Description of Artificial Sequence: Synthetic peptide
QVWDYLRQQQV

SEQ ID NO: 130-132 - skipped (3 entries)

SEQ ID NO: 133 - protein, 11 aa, Artificial Sequence
  Description of Artificial Sequence: Synthetic peptide
GGNNIGSKSVH

SEQ ID NO: 134 - protein, 7 aa, Artificial Sequence
  Description of Artificial Sequence: Synthetic peptide
DDNDRPS

SEQ ID NO: 135 - protein, 11 aa, Artificial Sequence
  Description of Artificial Sequence: Synthetic peptide
QVWDYNMNVWV

SEQ ID NO: 136-138 - skipped (3 entries)

SEQ ID NO: 139 - protein, 11 aa, Artificial Sequence
  Description of Artificial Sequence: Synthetic peptide
GGNNIGSKSVH

SEQ ID NO: 140 - protein, 7 aa, Artificial Sequence
  Description of Artificial Sequence: Synthetic peptide
DDNDRPS

SEQ ID NO: 141 - protein, 11 aa, Artificial Sequence
  Description of Artificial Sequence: Synthetic peptide
QVWDYYSNRAV

SEQ ID NO: 142-144 - skipped (3 entries)

SEQ ID NO: 145 - protein, 11 aa, Artificial Sequence
  Description of Artificial Sequence: Synthetic peptide
GGNNIGSKSVH

SEQ ID NO: 146 - protein, 7 aa, Artificial Sequence
  Description of Artificial Sequence: Synthetic peptide
DDNDRPS

SEQ ID NO: 147 - protein, 11 aa, Artificial Sequence
  Description of Artificial Sequence: Synthetic peptide
QVWDYSGQRQV

SEQ ID NO: 148-150 - skipped (3 entries)

SEQ ID NO: 151 - protein, 11 aa, Artificial Sequence
  Description of Artificial Sequence: Synthetic peptide
GGNNIGSKSVH

SEQ ID NO: 152 - protein, 7 aa, Artificial Sequence
  Description of Artificial Sequence: Synthetic peptide
DDNDRPS

SEQ ID NO: 153 - protein, 11 aa, Artificial Sequence
  Description of Artificial Sequence: Synthetic peptide
QVWDYLLPGQV

SEQ ID NO: 154-156 - skipped (3 entries)

SEQ ID NO: 157 - protein, 11 aa, Artificial Sequence
  Description of Artificial Sequence: Synthetic peptide
GGNNIGSKSVH

SEQ ID NO: 158 - protein, 7 aa, Artificial Sequence
  Description of Artificial Sequence: Synthetic peptide
DDNDRPS

SEQ ID NO: 159 - protein, 11 aa, Artificial Sequence
  Description of Artificial Sequence: Synthetic peptide
QVWDYVTPRWV

SEQ ID NO: 160-162 - skipped (3 entries)

SEQ ID NO: 163 - protein, 11 aa, Artificial Sequence
  Description of Artificial Sequence: Synthetic peptide
RASQSISNYFN

SEQ ID NO: 164 - protein, 7 aa, Artificial Sequence
  Description of Artificial Sequence: Synthetic peptide
AASSLQS

SEQ ID NO: 165 - protein, 9 aa, Artificial Sequence
  Description of Artificial Sequence: Synthetic peptide
QQSYITPFT

SEQ ID NO: 166-168 - skipped (3 entries)

SEQ ID NO: 169 - protein, 11 aa, Artificial Sequence
  Description of Artificial Sequence: Synthetic peptide
RTSQSISSYLN

SEQ ID NO: 170 - protein, 7 aa, Artificial Sequence
  Description of Artificial Sequence: Synthetic peptide
AASSLQG

SEQ ID NO: 171 - protein, 9 aa, Artificial Sequence
  Description of Artificial Sequence: Synthetic peptide
QQSYSSPFT

SEQ ID NO: 172-174 - skipped (3 entries)

SEQ ID NO: 175 - protein, 11 aa, Artificial Sequence
  Description of Artificial Sequence: Synthetic peptide
QASQDISNYLN

SEQ ID NO: 176 - protein, 7 aa, Artificial Sequence
  Description of Artificial Sequence: Synthetic peptide
AASSLQS

SEQ ID NO: 177 - protein, 9 aa, Artificial Sequence
  Description of Artificial Sequence: Synthetic peptide
QQSYMWPTI

SEQ ID NO: 178-180 - skipped (3 entries)

SEQ ID NO: 181 - protein, 11 aa, Artificial Sequence
  Description of Artificial Sequence: Synthetic peptide
QASQDISNYLN

SEQ ID NO: 182 - protein, 7 aa, Artificial Sequence
  Description of Artificial Sequence: Synthetic peptide
AASSLQS

SEQ ID NO: 183 - protein, 9 aa, Artificial Sequence
  Description of Artificial Sequence: Synthetic peptide
QQSYYYPTL

SEQ ID NO: 184-186 - skipped (3 entries)

SEQ ID NO: 187 - protein, 11 aa, Artificial Sequence
  Description of Artificial Sequence: Synthetic peptide
QASQDISNYLN

SEQ ID NO: 188 - protein, 7 aa, Artificial Sequence
  Description of Artificial Sequence: Synthetic peptide
AASSLQS

SEQ ID NO: 189 - protein, 9 aa, Artificial Sequence
  Description of Artificial Sequence: Synthetic peptide
QQSYTLHPL

SEQ ID NO: 190-192 - skipped (3 entries)

SEQ ID NO: 193 - protein, 11 aa, Artificial Sequence
  Description of Artificial Sequence: Synthetic peptide
QASQDISNYFN

SEQ ID NO: 194 - protein, 7 aa, Artificial Sequence
  Description of Artificial Sequence: Synthetic peptide
AASSLQS

SEQ ID NO: 195 - protein, 9 aa, Artificial Sequence
  Description of Artificial Sequence: Synthetic peptide
QQSYITPFT

SEQ ID NO: 196-198 - skipped (3 entries)

SEQ ID NO: 199 - protein, 11 aa, Artificial Sequence
  Description of Artificial Sequence: Synthetic peptide
RASQFISSYLN

SEQ ID NO: 200 - protein, 7 aa, Artificial Sequence
  Description of Artificial Sequence: Synthetic peptide
AASSLQS

SEQ ID NO: 201 - protein, 9 aa, Artificial Sequence
  Description of Artificial Sequence: Synthetic peptide
QQSYQSPTT

SEQ ID NO: 202-204 - skipped (3 entries)

SEQ ID NO: 205 - protein, 11 aa, Artificial Sequence
  Description of Artificial Sequence: Synthetic peptide
QASQDISNYLN

SEQ ID NO: 206 - protein, 7 aa, Artificial Sequence
  Description of Artificial Sequence: Synthetic peptide
AASSLQS

SEQ ID NO: 207 - protein, 9 aa, Artificial Sequence
  Description of Artificial Sequence: Synthetic peptide
QQSYFPVVE

SEQ ID NO: 208-210 - skipped (3 entries)

SEQ ID NO: 211 - protein, 11 aa, Artificial Sequence
  Description of Artificial Sequence: Synthetic peptide
QASQDISNYLN

SEQ ID NO: 212 - protein, 7 aa, Artificial Sequence
  Description of Artificial Sequence: Synthetic peptide
AASSLQS

SEQ ID NO: 213 - protein, 9 aa, Artificial Sequence
  Description of Artificial Sequence: Synthetic peptide
QQSYTPPTT

SEQ ID NO: 214-216 - skipped (3 entries)

SEQ ID NO: 217 - protein, 11 aa, Artificial Sequence
  Description of Artificial Sequence: Synthetic peptide
RASQFISSYLN

SEQ ID NO: 218 - protein, 7 aa, Artificial Sequence
  Description of Artificial Sequence: Synthetic peptide
AASSLQS

SEQ ID NO: 219 - protein, 9 aa, Artificial Sequence
  Description of Artificial Sequence: Synthetic peptide
QQSYSYPNS

SEQ ID NO: 220-222 - skipped (3 entries)

SEQ ID NO: 223 - protein, 11 aa, Artificial Sequence
  Description of Artificial Sequence: Synthetic peptide
RTSQSISSYLN

SEQ ID NO: 224 - protein, 7 aa, Artificial Sequence
  Description of Artificial Sequence: Synthetic peptide
AASSLQG

SEQ ID NO: 225 - protein, 9 aa, Artificial Sequence
  Description of Artificial Sequence: Synthetic peptide
QQTYSMPFT

SEQ ID NO: 226-228 - skipped (3 entries)

SEQ ID NO: 229 - protein, 11 aa, Artificial Sequence
  Description of Artificial Sequence: Synthetic peptide
RTSQSISSYLN

SEQ ID NO: 230 - protein, 7 aa, Artificial Sequence
  Description of Artificial Sequence: Synthetic peptide
AASSLQG

SEQ ID NO: 231 - protein, 9 aa, Artificial Sequence
  Description of Artificial Sequence: Synthetic peptide
IQAYTSPFT

SEQ ID NO: 232-234 - skipped (3 entries)

SEQ ID NO: 235 - protein, 11 aa, Artificial Sequence
  Description of Artificial Sequence: Synthetic peptide
RTSQSISSYLN

SEQ ID NO: 236 - protein, 7 aa, Artificial Sequence
  Description of Artificial Sequence: Synthetic peptide
AASSLQG

SEQ ID NO: 237 - protein, 9 aa, Artificial Sequence
  Description of Artificial Sequence: Synthetic peptide
QQTYSMPFT

SEQ ID NO: 238-240 - skipped (3 entries)

SEQ ID NO: 241 - protein, 11 aa, Artificial Sequence
  Description of Artificial Sequence: Synthetic peptide
RTSQSISSYLN

SEQ ID NO: 242 - protein, 7 aa, Artificial Sequence
  Description of Artificial Sequence: Synthetic peptide
AASSLQG

SEQ ID NO: 243 - protein, 9 aa, Artificial Sequence
  Description of Artificial Sequence: Synthetic peptide
QQTYSMPFT

SEQ ID NO: 244-246 - skipped (3 entries)

SEQ ID NO: 247 - protein, 11 aa, Artificial Sequence
  Description of Artificial Sequence: Synthetic peptide
RTSQSISSYLN

SEQ ID NO: 248 - protein, 7 aa, Artificial Sequence
  Description of Artificial Sequence: Synthetic peptide
AASSLQS

SEQ ID NO: 249 - protein, 9 aa, Artificial Sequence
  Description of Artificial Sequence: Synthetic peptide
QQTYSMPFT

SEQ ID NO: 250-252 - skipped (3 entries)

SEQ ID NO: 253 - protein, 11 aa, Artificial Sequence
  Description of Artificial Sequence: Synthetic peptide
RTSQSISSYLN

SEQ ID NO: 254 - protein, 7 aa, Artificial Sequence
  Description of Artificial Sequence: Synthetic peptide
AASSLQG

SEQ ID NO: 255 - protein, 9 aa, Artificial Sequence
  Description of Artificial Sequence: Synthetic peptide
QQTYSMPFT

SEQ ID NO: 256-258 - skipped (3 entries)

SEQ ID NO: 259 - protein, 11 aa, Artificial Sequence
  Description of Artificial Sequence: Synthetic peptide
GGNNIGSKSVH

SEQ ID NO: 260 - protein, 7 aa, Artificial Sequence
  Description of Artificial Sequence: Synthetic peptide
DDNDRPS

SEQ ID NO: 261 - protein, 11 aa, Artificial Sequence
  Description of Artificial Sequence: Synthetic peptide
QVWDYVAPRHV

SEQ ID NO: 262-264 - skipped (3 entries)

SEQ ID NO: 265 - protein, 11 aa, Artificial Sequence
  Description of Artificial Sequence: Synthetic peptide
GGNNIGSKSVH

SEQ ID NO: 266 - protein, 7 aa, Artificial Sequence
  Description of Artificial Sequence: Synthetic peptide
DDNDRPS

SEQ ID NO: 267 - protein, 11 aa, Artificial Sequence
  Description of Artificial Sequence: Synthetic peptide
QVWDYVAPRHV

SEQ ID NO: 268-270 - skipped (3 entries)

SEQ ID NO: 271 - protein, 11 aa, Artificial Sequence
  Description of Artificial Sequence: Synthetic peptide
RTSQSISSYLN

SEQ ID NO: 272 - protein, 7 aa, Artificial Sequence
  Description of Artificial Sequence: Synthetic peptide
AASSLQS

SEQ ID NO: 273 - protein, 9 aa, Artificial Sequence
  Description of Artificial Sequence: Synthetic peptide
QQTYSMPFT

SEQ ID NO: 274-276 - skipped (3 entries)

SEQ ID NO: 277 - protein, 11 aa, Artificial Sequence
  Description of Artificial Sequence: Synthetic peptide
RTSQSISSYLN

SEQ ID NO: 278 - protein, 7 aa, Artificial Sequence
  Description of Artificial Sequence: Synthetic peptide
AASSLQG

SEQ ID NO: 279 - protein, 9 aa, Artificial Sequence
  Description of Artificial Sequence: Synthetic peptide
QQTYSSPFT

SEQ ID NO: 280-282 - skipped (3 entries)

SEQ ID NO: 283 - protein, 17 aa, Artificial Sequence
  Description of Artificial Sequence: Synthetic peptide
KSSQSVLYSSNNKNYLA

SEQ ID NO: 284 - protein, 7 aa, Artificial Sequence
  Description of Artificial Sequence: Synthetic peptide
WASTRES

SEQ ID NO: 285 - protein, 9 aa, Artificial Sequence
  Description of Artificial Sequence: Synthetic peptide
QQFYSTPIT

SEQ ID NO: 286-288 - skipped (3 entries)

SEQ ID NO: 289 - protein, 11 aa, Artificial Sequence
  Description of Artificial Sequence: Synthetic peptide
RASQGISNYLA

SEQ ID NO: 290 - protein, 7 aa, Artificial Sequence
  Description of Artificial Sequence: Synthetic peptide
AASTLQS

SEQ ID NO: 291 - protein, 9 aa, Artificial Sequence
  Description of Artificial Sequence: Synthetic peptide
QKYNSAPFT

SEQ ID NO: 292-294 - skipped (3 entries)

SEQ ID NO: 295 - protein, 11 aa, Artificial Sequence
  Description of Artificial Sequence: Synthetic peptide
RASQGISNYLA

SEQ ID NO: 296 - protein, 7 aa, Artificial Sequence
  Description of Artificial Sequence: Synthetic peptide
AASTLQS

SEQ ID NO: 297 - protein, 9 aa, Artificial Sequence
  Description of Artificial Sequence: Synthetic peptide
QKYNSAPFT

SEQ ID NO: 298-300 - skipped (3 entries)

SEQ ID NO: 301 - protein, 11 aa, Artificial Sequence
  Description of Artificial Sequence: Synthetic peptide
GGNNIGSKSVH

SEQ ID NO: 302 - protein, 7 aa, Artificial Sequence
  Description of Artificial Sequence: Synthetic peptide
DDADRPS

SEQ ID NO: 303 - protein, 12 aa, Artificial Sequence
  Description of Artificial Sequence: Synthetic peptide
QVWDASAGYGVV

SEQ ID NO: 304-306 - skipped (3 entries)

SEQ ID NO: 307 - protein, 11 aa, Artificial Sequence
  Description of Artificial Sequence: Synthetic peptide
GGNNIGSKSVH

SEQ ID NO: 308 - protein, 7 aa, Artificial Sequence
  Description of Artificial Sequence: Synthetic peptide
DDNDRPS

SEQ ID NO: 309 - protein, 11 aa, Artificial Sequence
  Description of Artificial Sequence: Synthetic peptide
QVWDYSPLRHV

SEQ ID NO: 310-312 - skipped (3 entries)

SEQ ID NO: 313 - protein, 11 aa, Artificial Sequence
  Description of Artificial Sequence: Synthetic peptide
GGNNIGSKSVH

SEQ ID NO: 314 - protein, 7 aa, Artificial Sequence
  Description of Artificial Sequence: Synthetic peptide
DDNDRPS

SEQ ID NO: 315 - protein, 11 aa, Artificial Sequence
  Description of Artificial Sequence: Synthetic peptide
QVWDYFSMTHV

SEQ ID NO: 316-318 - skipped (3 entries)

SEQ ID NO: 319 - protein, 16 aa, Artificial Sequence
  Description of Artificial Sequence: Synthetic peptide
RSSQSLLHRSGYNYLD

SEQ ID NO: 320 - protein, 7 aa, Artificial Sequence
  Description of Artificial Sequence: Synthetic peptide
LGSNRAS

SEQ ID NO: 321 - protein, 9 aa, Artificial Sequence
  Description of Artificial Sequence: Synthetic peptide
MQALQTPWT

SEQ ID NO: 322-324 - skipped (3 entries)

SEQ ID NO: 325 - protein, 5 aa, Artificial Sequence
  Description of Artificial Sequence: Synthetic peptide
SHAMS

SEQ ID NO: 326 - protein, 17 aa, Artificial Sequence
  Description of Artificial Sequence: Synthetic peptide
AISGSGGGTYYAASVKG

SEQ ID NO: 327 - protein, 10 aa, Artificial Sequence
  Description of Artificial Sequence: Synthetic peptide
GKGVHLGFDY

SEQ ID NO: 328-330 - skipped (3 entries)

SEQ ID NO: 331 - protein, 5 aa, Artificial Sequence
  Description of Artificial Sequence: Synthetic peptide
SHAMS

SEQ ID NO: 332 - protein, 17 aa, Artificial Sequence
  Description of Artificial Sequence: Synthetic peptide
TISGSGGGTYYAASVKG

SEQ ID NO: 333 - protein, 10 aa, Artificial Sequence
  Description of Artificial Sequence: Synthetic peptide
GKGVHLGFDY

SEQ ID NO: 334-336 - skipped (3 entries)

SEQ ID NO: 337 - protein, 5 aa, Artificial Sequence
  Description of Artificial Sequence: Synthetic peptide
SHAMS

SEQ ID NO: 338 - protein, 17 aa, Artificial Sequence
  Description of Artificial Sequence: Synthetic peptide
TISGSGGGTYYADSVKG

SEQ ID NO: 339 - protein, 10 aa, Artificial Sequence
  Description of Artificial Sequence: Synthetic peptide
GKGVHLGFDY

SEQ ID NO: 340-342 - skipped (3 entries)

SEQ ID NO: 343 - protein, 5 aa, Artificial Sequence
  Description of Artificial Sequence: Synthetic peptide
SHAMS

SEQ ID NO: 344 - protein, 17 aa, Artificial Sequence
  Description of Artificial Sequence: Synthetic peptide
AISGSGGGTYYAASVKA

SEQ ID NO: 345 - protein, 10 aa, Artificial Sequence
  Description of Artificial Sequence: Synthetic peptide
GKGVHLGFDY

SEQ ID NO: 346-348 - skipped (3 entries)

SEQ ID NO: 349 - protein, 5 aa, Artificial Sequence
  Description of Artificial Sequence: Synthetic peptide
SHAMS

SEQ ID NO: 350 - protein, 17 aa, Artificial Sequence
  Description of Artificial Sequence: Synthetic peptide
AISGSGGGTYYAASGKG

SEQ ID NO: 351 - protein, 10 aa, Artificial Sequence
  Description of Artificial Sequence: Synthetic peptide
GKGVHLGFDY

SEQ ID NO: 352-354 - skipped (3 entries)

SEQ ID NO: 355 - protein, 5 aa, Artificial Sequence
  Description of Artificial Sequence: Synthetic peptide
SHAMS

SEQ ID NO: 356 - protein, 17 aa, Artificial Sequence
  Description of Artificial Sequence: Synthetic peptide
AISGSGGGTYNAASVKG

SEQ ID NO: 357 - protein, 10 aa, Artificial Sequence
  Description of Artificial Sequence: Synthetic peptide
GKGVHLGFDY

SEQ ID NO: 358-360 - skipped (3 entries)

SEQ ID NO: 361 - protein, 5 aa, Artificial Sequence
  Description of Artificial Sequence: Synthetic peptide
SYAMS

SEQ ID NO: 362 - protein, 17 aa, Artificial Sequence
  Description of Artificial Sequence: Synthetic peptide
AISGSGGGTYYAASVKG

SEQ ID NO: 363 - protein, 10 aa, Artificial Sequence
  Description of Artificial Sequence: Synthetic peptide
GKGVHLGFDY

SEQ ID NO: 364-366 - skipped (3 entries)

SEQ ID NO: 367 - protein, 5 aa, Artificial Sequence
  Description of Artificial Sequence: Synthetic peptide
SHAMS

SEQ ID NO: 368 - protein, 17 aa, Artificial Sequence
  Description of Artificial Sequence: Synthetic peptide
AISGSGGGTYYAASVKG

SEQ ID NO: 369 - protein, 10 aa, Artificial Sequence
  Description of Artificial Sequence: Synthetic peptide
GKGVHLNFDY

SEQ ID NO: 370-372 - skipped (3 entries)

SEQ ID NO: 373 - protein, 5 aa, Artificial Sequence
  Description of Artificial Sequence: Synthetic peptide
SHAMS

SEQ ID NO: 374 - protein, 17 aa, Artificial Sequence
  Description of Artificial Sequence: Synthetic peptide
AISGSGGGTYNAASVKG

SEQ ID NO: 375 - protein, 10 aa, Artificial Sequence
  Description of Artificial Sequence: Synthetic peptide
GKGVHLGFDY

SEQ ID NO: 376-378 - skipped (3 entries)

SEQ ID NO: 379 - protein, 7 aa, Artificial Sequence
  Description of Artificial Sequence: Synthetic peptide
THKMGVD

SEQ ID NO: 380 - protein, 16 aa, Artificial Sequence
  Description of Artificial Sequence: Synthetic peptide
EIHSEDDKRYSPSLQS

SEQ ID NO: 381 - protein, 13 aa, Artificial Sequence
  Description of Artificial Sequence: Synthetic peptide
RRYNWNYENWFDP

SEQ ID NO: 382-384 - skipped (3 entries)

SEQ ID NO: 385 - protein, 5 aa, Artificial Sequence
  Description of Artificial Sequence: Synthetic peptide
NAWMS

SEQ ID NO: 386 - protein, 19 aa, Artificial Sequence
  Description of Artificial Sequence: Synthetic peptide
RIKSKTYGGTTDYAAPVKG

SEQ ID NO: 387 - protein, 16 aa, Artificial Sequence
  Description of Artificial Sequence: Synthetic peptide
PSYSGSYYNYFSVMDV

SEQ ID NO: 388-390 - skipped (3 entries)

SEQ ID NO: 391 - protein, 7 aa, Artificial Sequence
  Description of Artificial Sequence: Synthetic peptide
THKMGVD

SEQ ID NO: 392 - protein, 16 aa, Artificial Sequence
  Description of Artificial Sequence: Synthetic peptide
LIYWNDDKRYSPSLQS

SEQ ID NO: 393 - protein, 13 aa, Artificial Sequence
  Description of Artificial Sequence: Synthetic peptide
RRYNWNYENWFDP

SEQ ID NO: 394-396 - skipped (3 entries)

SEQ ID NO: 397 - protein, 7 aa, Artificial Sequence
  Description of Artificial Sequence: Synthetic peptide
THKMGVD

SEQ ID NO: 398 - protein, 16 aa, Artificial Sequence
  Description of Artificial Sequence: Synthetic peptide
LIYWNDDKRYSPSLQS

SEQ ID NO: 399 - protein, 13 aa, Artificial Sequence
  Description of Artificial Sequence: Synthetic peptide
RRYNWNYENWFDP

SEQ ID NO: 400-402 - skipped (3 entries)

SEQ ID NO: 403 - protein, 7 aa, Artificial Sequence
  Description of Artificial Sequence: Synthetic peptide
THKMGVD

SEQ ID NO: 404 - protein, 16 aa, Artificial Sequence
  Description of Artificial Sequence: Synthetic peptide
LIYWNDDKRYSPSLQS

SEQ ID NO: 405 - protein, 13 aa, Artificial Sequence
  Description of Artificial Sequence: Synthetic peptide
RRYNWNYENWFDP

SEQ ID NO: 406-408 - skipped (3 entries)

SEQ ID NO: 409 - protein, 7 aa, Artificial Sequence
  Description of Artificial Sequence: Synthetic peptide
THKMGVD

SEQ ID NO: 410 - protein, 16 aa, Artificial Sequence
  Description of Artificial Sequence: Synthetic peptide
GIHIYDDKRYSPSLQS

SEQ ID NO: 411 - protein, 13 aa, Artificial Sequence
  Description of Artificial Sequence: Synthetic peptide
RRYNWNYENWFDP

SEQ ID NO: 412-414 - skipped (3 entries)

SEQ ID NO: 415 - protein, 7 aa, Artificial Sequence
  Description of Artificial Sequence: Synthetic peptide
THKMGVD

SEQ ID NO: 416 - protein, 16 aa, Artificial Sequence
  Description of Artificial Sequence: Synthetic peptide
LIYWNDDKRYSPSLQS

SEQ ID NO: 417 - protein, 13 aa, Artificial Sequence
  Description of Artificial Sequence: Synthetic peptide
RRYNWNYENWFDP

SEQ ID NO: 418-420 - skipped (3 entries)

SEQ ID NO: 421 - protein, 7 aa, Artificial Sequence
  Description of Artificial Sequence: Synthetic peptide
THKMGVD

SEQ ID NO: 422 - protein, 16 aa, Artificial Sequence
  Description of Artificial Sequence: Synthetic peptide
LIYWNDDKRYSPSLQS

SEQ ID NO: 423 - protein, 13 aa, Artificial Sequence
  Description of Artificial Sequence: Synthetic peptide
RRYNWNYENWFDP

SEQ ID NO: 424-426 - skipped (3 entries)

SEQ ID NO: 427 - protein, 7 aa, Artificial Sequence
  Description of Artificial Sequence: Synthetic peptide
THKMGVD

SEQ ID NO: 428 - protein, 16 aa, Artificial Sequence
  Description of Artificial Sequence: Synthetic peptide
LIYWNDDKRYSPSLQS

SEQ ID NO: 429 - protein, 13 aa, Artificial Sequence
  Description of Artificial Sequence: Synthetic peptide
RRYNWNYENWFDP

SEQ ID NO: 430-432 - skipped (3 entries)

SEQ ID NO: 433 - protein, 7 aa, Artificial Sequence
  Description of Artificial Sequence: Synthetic peptide
THKMGVD

SEQ ID NO: 434 - protein, 16 aa, Artificial Sequence
  Description of Artificial Sequence: Synthetic peptide
LIYWNDDKRYSPSLQS

SEQ ID NO: 435 - protein, 13 aa, Artificial Sequence
  Description of Artificial Sequence: Synthetic peptide
RRYNWNYENWFDP

SEQ ID NO: 436-438 - skipped (3 entries)

SEQ ID NO: 439 - protein, 5 aa, Artificial Sequence
  Description of Artificial Sequence: Synthetic peptide
NAWMS

SEQ ID NO: 440 - protein, 19 aa, Artificial Sequence
  Description of Artificial Sequence: Synthetic peptide
RIRSRSYGGTTDYAAPVKG

SEQ ID NO: 441 - protein, 16 aa, Artificial Sequence
  Description of Artificial Sequence: Synthetic peptide
PSYSGSYYNYFSVMDV

SEQ ID NO: 442-444 - skipped (3 entries)

SEQ ID NO: 445 - protein, 5 aa, Artificial Sequence
  Description of Artificial Sequence: Synthetic peptide
NAWMS

SEQ ID NO: 446 - protein, 19 aa, Artificial Sequence
  Description of Artificial Sequence: Synthetic peptide
RIKSKTYGGTTDYAAPVKG

SEQ ID NO: 447 - protein, 16 aa, Artificial Sequence
  Description of Artificial Sequence: Synthetic peptide
PSYSGSYYNYFSVMDV

SEQ ID NO: 448-450 - skipped (3 entries)

SEQ ID NO: 451 - protein, 5 aa, Artificial Sequence
  Description of Artificial Sequence: Synthetic peptide
NAWMS

SEQ ID NO: 452 - protein, 19 aa, Artificial Sequence
  Description of Artificial Sequence: Synthetic peptide
RITSSRYGGTTDYAAPVKG

SEQ ID NO: 453 - protein, 16 aa, Artificial Sequence
  Description of Artificial Sequence: Synthetic peptide
PSYSGSYYNYFSVMDV

SEQ ID NO: 454-456 - skipped (3 entries)

SEQ ID NO: 457 - protein, 5 aa, Artificial Sequence
  Description of Artificial Sequence: Synthetic peptide
NAWMS

SEQ ID NO: 458 - protein, 19 aa, Artificial Sequence
  Description of Artificial Sequence: Synthetic peptide
RILNNAYGGTTDYAAPVKG

SEQ ID NO: 459 - protein, 16 aa, Artificial Sequence
  Description of Artificial Sequence: Synthetic peptide
PSYSGSYYNYFSVMDV

SEQ ID NO: 460-462 - skipped (3 entries)

SEQ ID NO: 463 - protein, 5 aa, Artificial Sequence
  Description of Artificial Sequence: Synthetic peptide
NAWMS

SEQ ID NO: 464 - protein, 19 aa, Artificial Sequence
  Description of Artificial Sequence: Synthetic peptide
RILSMHYGGTTDYAAPVKG

SEQ ID NO: 465 - protein, 16 aa, Artificial Sequence
  Description of Artificial Sequence: Synthetic peptide
PSYSGSYYNYFSVMDV

SEQ ID NO: 466-468 - skipped (3 entries)

SEQ ID NO: 469 - protein, 5 aa, Artificial Sequence
  Description of Artificial Sequence: Synthetic peptide
NAWMS

SEQ ID NO: 470 - protein, 19 aa, Artificial Sequence
  Description of Artificial Sequence: Synthetic peptide
RIVSSTYGGTTDYAAPVKG

SEQ ID NO: 471 - protein, 16 aa, Artificial Sequence
  Description of Artificial Sequence: Synthetic peptide
PSYSGSYYNYFSVMDV

SEQ ID NO: 472-474 - skipped (3 entries)

SEQ ID NO: 475 - protein, 5 aa, Artificial Sequence
  Description of Artificial Sequence: Synthetic peptide
SHAMS

SEQ ID NO: 476 - protein, 17 aa, Artificial Sequence
  Description of Artificial Sequence: Synthetic peptide
AISGSGGGTYNAASVKG

SEQ ID NO: 477 - protein, 10 aa, Artificial Sequence
  Description of Artificial Sequence: Synthetic peptide
GKGVHLGFDY

SEQ ID NO: 478-480 - skipped (3 entries)

SEQ ID NO: 481 - protein, 5 aa, Artificial Sequence
  Description of Artificial Sequence: Synthetic peptide
SHAMS

SEQ ID NO: 482 - protein, 17 aa, Artificial Sequence
  Description of Artificial Sequence: Synthetic peptide
AISGSGGGTYNADSVKG

SEQ ID NO: 483 - protein, 10 aa, Artificial Sequence
  Description of Artificial Sequence: Synthetic peptide
GKGVHLGFDY

SEQ ID NO: 484-486 - skipped (3 entries)

SEQ ID NO: 487 - protein, 5 aa, Artificial Sequence
  Description of Artificial Sequence: Synthetic peptide
NAWMS

SEQ ID NO: 488 - protein, 19 aa, Artificial Sequence
  Description of Artificial Sequence: Synthetic peptide
RITSGIYGGTTDYAAPVKG

SEQ ID NO: 489 - protein, 16 aa, Artificial Sequence
  Description of Artificial Sequence: Synthetic peptide
PSYSGSYYNYFSVMDV

SEQ ID NO: 490-492 - skipped (3 entries)

SEQ ID NO: 493 - protein, 5 aa, Artificial Sequence
  Description of Artificial Sequence: Synthetic peptide
NAWMS

SEQ ID NO: 494 - protein, 19 aa, Artificial Sequence
  Description of Artificial Sequence: Synthetic peptide
RIRSRPYGGTTDYAAPVKG

SEQ ID NO: 495 - protein, 16 aa, Artificial Sequence
  Description of Artificial Sequence: Synthetic peptide
PSYSGSYYNYFSVMDV

SEQ ID NO: 496-498 - skipped (3 entries)

SEQ ID NO: 499 - protein, 7 aa, Artificial Sequence
  Description of Artificial Sequence: Synthetic peptide
SSRYYWG

SEQ ID NO: 500 - protein, 16 aa, Artificial Sequence
  Description of Artificial Sequence: Synthetic peptide
SIYYSGSTYYNPSLKS

SEQ ID NO: 501 - protein, 11 aa, Artificial Sequence
  Description of Artificial Sequence: Synthetic peptide
GIFGVITYFDY

SEQ ID NO: 502-504 - skipped (3 entries)

SEQ ID NO: 505 - protein, 5 aa, Artificial Sequence
  Description of Artificial Sequence: Synthetic peptide
TYGMH

SEQ ID NO: 506 - protein, 17 aa, Artificial Sequence
  Description of Artificial Sequence: Synthetic peptide
VISYDASNKYYAESVKG

SEQ ID NO: 507 - protein, 7 aa, Artificial Sequence
  Description of Artificial Sequence: Synthetic peptide
GQLLTGY

SEQ ID NO: 508-510 - skipped (3 entries)

SEQ ID NO: 511 - protein, 5 aa, Artificial Sequence
  Description of Artificial Sequence: Synthetic peptide
TYGMH

SEQ ID NO: 512 - protein, 17 aa, Artificial Sequence
  Description of Artificial Sequence: Synthetic peptide
VISYDAETVKYAESVKG

SEQ ID NO: 513 - protein, 7 aa, Artificial Sequence
  Description of Artificial Sequence: Synthetic peptide
GQLLTGY

SEQ ID NO: 514-516 - skipped (3 entries)

SEQ ID NO: 517 - protein, 5 aa, Artificial Sequence
  Description of Artificial Sequence: Synthetic peptide
DYYMS

SEQ ID NO: 518 - protein, 17 aa, Artificial Sequence
  Description of Artificial Sequence: Synthetic peptide
YISKSSYTVTYADAVKG

SEQ ID NO: 519 - protein, 8 aa, Artificial Sequence
  Description of Artificial Sequence: Synthetic peptide
YNYGHFDY

SEQ ID NO: 520-522 - skipped (3 entries)

SEQ ID NO: 523 - protein, 5 aa, Artificial Sequence
  Description of Artificial Sequence: Synthetic peptide
SHAMS

SEQ ID NO: 524 - protein, 17 aa, Artificial Sequence
  Description of Artificial Sequence: Synthetic peptide
SISGSGGGTYYAASVKG

SEQ ID NO: 525 - protein, 10 aa, Artificial Sequence
  Description of Artificial Sequence: Synthetic peptide
GKGVHLGFDY

SEQ ID NO: 526-528 - skipped (3 entries)

SEQ ID NO: 529 - protein, 5 aa, Artificial Sequence
  Description of Artificial Sequence: Synthetic peptide
SHAMS

SEQ ID NO: 530 - protein, 17 aa, Artificial Sequence
  Description of Artificial Sequence: Synthetic peptide
AISGSGGGTYNAASVKG

SEQ ID NO: 531 - protein, 10 aa, Artificial Sequence
  Description of Artificial Sequence: Synthetic peptide
GKGVHLGFDY

SEQ ID NO: 532-534 - skipped (3 entries)

SEQ ID NO: 535 - protein, 7 aa, Artificial Sequence
  Description of Artificial Sequence: Synthetic peptide
SNPYYWS

SEQ ID NO: 536 - protein, 16 aa, Artificial Sequence
  Description of Artificial Sequence: Synthetic peptide
YISYSGITNYNPSLKS

SEQ ID NO: 537 - protein, 16 aa, Artificial Sequence
  Description of Artificial Sequence: Synthetic peptide
EKMWFGVLNYYYGMDV

SEQ ID NO: 538-540 - skipped (3 entries)

SEQ ID NO: 541 - protein, 14 aa, Artificial Sequence
  Description of Artificial Sequence: Synthetic peptide
GSSTGAVTSGNYPN

SEQ ID NO: 542 - protein, 7 aa, Artificial Sequence
  Description of Artificial Sequence: Synthetic peptide
GTKFLAP

SEQ ID NO: 543 - protein, 9 aa, Artificial Sequence
  Description of Artificial Sequence: Synthetic peptide
VLWYSNRWV

SEQ ID NO: 544-546 - skipped (3 entries)

SEQ ID NO: 547 - protein, 5 aa, Artificial Sequence
  Description of Artificial Sequence: Synthetic peptide
KYAMN

SEQ ID NO: 548 - protein, 19 aa, Artificial Sequence
  Description of Artificial Sequence: Synthetic peptide
RIRSKYNNYATYYADSVKD

SEQ ID NO: 549 - protein, 14 aa, Artificial Sequence
  Description of Artificial Sequence: Synthetic peptide
HGNFGNSYISYWAY

SEQ ID NO: 550-551 - skipped (2 entries)

SEQ ID NO: 552 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYERPAMVFGCGTKLTVL

SEQ ID NO: 553 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSAISGSGGGTYYAASVKGRFTISRDNSKNTLYLQMNSLRAEDTAVYYCATGKGVHLGFDYWGQGTLVTVSS

SEQ ID NO: 554-555 - skipped (2 entries)

SEQ ID NO: 556 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGCGTKLTVL

SEQ ID NO: 557 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSTISGSGGGTYYAASVKGRFTISRDNSKNTLYLQMNSLRAEDTAVYYCATGKGVHLGFDYWGQGTLVTVSS

SEQ ID NO: 558-559 - skipped (2 entries)

SEQ ID NO: 560 - protein, 108 aa, Artificial Sequence; identical to SEQ ID NO: 556
  Description of Artificial Sequence: Synthetic polypeptide

SEQ ID NO: 561 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSTISGSGGGTYYADSVKGRFTISRDNSKNTLYLQMNSLRAEDTAVYYCATGKGVHLGFDYWGQGTLVTVSS

SEQ ID NO: 562-563 - skipped (2 entries)

SEQ ID NO: 564 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYLRQQQVFGCGTKLTVL

SEQ ID NO: 565 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSAISGSGGGTYYAASVKARFTISRDNSKNTLYLQMNSLRAEDTAVYYCATGKGVHLGFDYWGQGTLVTVSS

SEQ ID NO: 566-567 - skipped (2 entries)

SEQ ID NO: 568 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYNMNVWVFGCGTKLTVL

SEQ ID NO: 569 - protein, 119 aa, Artificial Sequence
  Description of Artificial Sequence: Synthetic polypeptide
EVQLLESGGGVVQPGRSLRLSCAASGFTFSSHAMSWVRQAPGKCLEWVSAISGSGGGTYYAASGKGRFTISRDNSKNTLYLQMNSLRAEDTAAYYCVTGKGVHLGFDYWGQGTLVTVSS

SEQ ID NO: 570-571 - skipped (2 entries)

SEQ ID NO: 572 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYYSNRAVFGCGTKLTVL

SEQ ID NO: 573 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSAISGSGGGTYNAASVKGRFTISRDNSKNTLYLQMNSLRAEDTAAYYCVTGKGVHLGFDYWGQGTLVTVSS

SEQ ID NO: 574-575 - skipped (2 entries)

SEQ ID NO: 576 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGCGTKLTVL

SEQ ID NO: 577 - protein, 119 aa, Artificial Sequence
  Description of Artificial Sequence: Synthetic polypeptide
EVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGFDYWGQGTLVTVSS

SEQ ID NO: 578-579 - skipped (2 entries)

SEQ ID NO: 580 - protein, 108 aa, Artificial Sequence
  Description of Artificial Sequence: Synthetic polypeptide
SYVLTQPPSVSVAPGQTARITCGGNNIGSKSVHWYQQKPGQAPVLVVYDDNDRPSGIPERFSGSNFGNTATLIISRVEAGDEADYYCQVWDYLLPGQVFGCGTKLTVL

SEQ ID NO: 581 - protein, 119 aa, Artificial Sequence
  Description of Artificial Sequence: Synthetic polypeptide
EVQLLESGGGLVKPGGSLRLSCAASGFTFSSHAMSWVRQAPGKCLEWVSAISGSGGGTYYAASVKGRFTISRDNSKNTLYLQMNSLRAEDTAVYYCATGKGVHLNFDYWGQGTLVTVSS

SEQ ID NO: 582-583 - skipped (2 entries)

SEQ ID NO: 584 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNFGNTATLTISRVEAGDEADYYCQVWDYVTPRWVFGCGTKLTVL

SEQ ID NO: 585 - protein, 119 aa, Artificial Sequence; identical to SEQ ID NO: 573
  Description of Artificial Sequence: Synthetic polypeptide

SEQ ID NO: 586-587 - skipped (2 entries)

SEQ ID NO: 588 - protein, 107 aa, Artificial Sequence
  Description of Artificial Sequence: Synthetic polypeptide
DIQMTQSPSSLSASVGDRVTITCRASQSISNYFNWYQQKPGKAPKLLIYAASSLQSGVPSRFSGSGSGTDFTLTISSLQPEDFATYYCQQSYITPFTFGCGTKVEIK

SEQ ID NO: 589 - protein, 123 aa, Artificial Sequence
  Description of Artificial Sequence: Synthetic polypeptide
QVTLKESGPALVKPTQTLTLTCTFSGFSFTTHKMGVDWIRQPPGKCLEWLAEIHSEDDKRYSPSLQSRLTITKDTSKNQVVLTMTNMDPVDTATYYCAYRRYNWNYENWFDPWGQGTLVTVSS

SEQ ID NO: 590-591 - skipped (2 entries)

SEQ ID NO: 592 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGCGTKVEIK

SEQ ID NO: 593 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRIKSKTYGGTTDYAAPVKGRFTISRDDSKNTLFLQMNSLKTEDTAVYYCTTPSYSGSYYNYFSVMDVWGQGTTVTVSS

SEQ ID NO: 594-595 - skipped (2 entries)

SEQ ID NO: 596 - protein, 107 aa, Artificial Sequence
  Description of Artificial Sequence: Synthetic polypeptide
DIQMTQSPDSLSASVGDRVTITCQASQDISNYLNWYQQKPGKAPKLLIYAASSLQSGVPSRFSGSGSGTDFTLTISSLQPEDFATYYCQQSYMWPTIFGCGTKVEIK

SEQ ID NO: 597 - protein, 123 aa, Artificial Sequence
  Description of Artificial Sequence: Synthetic polypeptide
QITLKESGPMLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSS

SEQ ID NO: 598-599 - skipped (2 entries)

SEQ ID NO: 600 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASSLQSGVPSRFSGRGSGTDFTLTISSLQPEDFATYYCQQSYYYPTLFGCGTKVEIK

SEQ ID NO: 601 - protein, 123 aa, Artificial Sequence
  Description of Artificial Sequence: Synthetic polypeptide
QITLKESGPALVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSS

SEQ ID NO: 602-603 - skipped (2 entries)

SEQ ID NO: 604 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASSLQSGVPSRFSGSGSGTDFTLTISSLQPEDFATYYCQQSYTLHPLFGCGTKVEIK

SEQ ID NO: 605 - protein, 123 aa, Artificial Sequence
  Description of Artificial Sequence: Synthetic polypeptide
QITLKESGPTLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSS

SEQ ID NO: 606-607 - skipped (2 entries)

SEQ ID NO: 608 - protein, 107 aa, Artificial Sequence
  Description of Artificial Sequence: Synthetic polypeptide
DIQMTQSPSSLSASVGDRVTITCQASQDISNYFNWYQQKPGKAPKLLIYAASSLQSGVPSRFSGSGSGTDFTLTISSLQPEDFATYYCQQSYITPFTFGCGTKVEIK

SEQ ID NO: 609 - protein, 123 aa, Artificial Sequence
  Description of Artificial Sequence: Synthetic polypeptide
QITLKESGPTLVKPTQTLTLTCTFSGFSFTTHKMGVDWIRQPPGKCLEWLAGIHIYDDKRYSPSLQSRLTITKDTSKNQVVLTMTNMDPVDTATYYCAYRRYNWNYENWFDPWGQGTLVTVSS

SEQ ID NO: 610-611 - skipped (2 entries)

SEQ ID NO: 612 - protein, 107 aa, Artificial Sequence
  Description of Artificial Sequence: Synthetic polypeptide
DIQMTQSPSSLSASVGDRVTITCRASQFISSYLNWYQQKPGKAPKLLIYAASSLQSGVPSRFSGRGSGTDFTLTISSLQPEDFATYYCQQSYQSPTTFGCGTKVEIK

SEQ ID NO: 613 - protein, 123 aa, Artificial Sequence; identical to SEQ ID NO: 597
  Description of Artificial Sequence: Synthetic polypeptide

SEQ ID NO: 614-615 - skipped (2 entries)

SEQ ID NO: 616 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASSLQSGVPSRFSGSGSGTDFTLTISSLQPEDFATYYCQQSYFPVVEFGCGTKVEIK

SEQ ID NO: 617 - protein, 123 aa, Artificial Sequence; identical to SEQ ID NO: 601
  Description of Artificial Sequence: Synthetic polypeptide

SEQ ID NO: 618-619 - skipped (2 entries)

SEQ ID NO: 620 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASSLQSGVPSRFSGRGSGTDFTLTISSLQPEDFATYYCQQSYTPPTTFGCGTKVEIK

SEQ ID NO: 621 - protein, 123 aa, Artificial Sequence; identical to SEQ ID NO: 605
  Description of Artificial Sequence: Synthetic polypeptide

SEQ ID NO: 622-623 - skipped (2 entries)

SEQ ID NO: 624 - protein, 107 aa, Artificial Sequence
  Description of Artificial Sequence: Synthetic polypeptide
DIQMTQSPSSLSASVGDRVTITCRASQFISSYLNWYQQKPGKAPKLLIYAASSLQSGVPSRFSGSGSGTDFTLTISSLQPEDFATYYCQQSYSYPNSFGCGTKVEIK

SEQ ID NO: 625 - protein, 123 aa, Artificial Sequence; identical to SEQ ID NO: 605
  Description of Artificial Sequence: Synthetic polypeptide

SEQ ID NO: 626-627 - skipped (2 entries)

SEQ ID NO: 628 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVEIK

SEQ ID NO: 629 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSS

SEQ ID NO: 630-631 - skipped (2 entries)

SEQ ID NO: 632 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCIQAYTSPFTFGCGTKLEIK

SEQ ID NO: 633 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRIKSKTYGGTTDYAAPVKGRFTISRDDSKNTLYLQMNSLKTEDTAVYYCTTPSYSGSYYNYFSVMDVWGQGTTVTVSS

SEQ ID NO: 634-635 - skipped (2 entries)

SEQ ID NO: 636 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVDIK

SEQ ID NO: 637 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRITSSRYGGTTDYAAPVKGRFTISRDDSKNTLFLQMNSLKTEDTAVYYCTTPSYSGSYYNYFSVMDVWGQGTTVTVSS

SEQ ID NO: 638-639 - skipped (2 entries)

SEQ ID NO: 640 - protein, 107 aa, Artificial Sequence; identical to SEQ ID NO: 636
  Description of Artificial Sequence: Synthetic polypeptide

SEQ ID NO: 641 - protein, 127 aa, Artificial Sequence
  Description of Artificial Sequence: Synthetic polypeptide
EVQLVESGGGLVKPGGSLRLSCAASGFTFSNAWMSWVRQAPGKCLEWVGRILNNAYGGTTDYAAPVKGRFTISRDDSKNTLYLQMNSLKTEDTAVYYCTTPSYSGSYYNYFSVMDVWGQGTTVTVSS

SEQ ID NO: 642-643 - skipped (2 entries)

SEQ ID NO: 644 - protein, 107 aa, Artificial Sequence
  Description of Artificial Sequence: Synthetic polypeptide
DIQMTQSPSSLSASVGDRVTITCRTSQSISSYLNWFQQKPGKAPKLLIFAASSLQSGVPSRFSGSGSGTDFTLTISSLQPEDFATYYCQQTYSMPFTFGCGTKVDIK

SEQ ID NO: 645 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRILSMHYGGTTDYAAPVKGRFTISRDDSKNTLYLQMNSLKTEDTAVYYCTTPSYSGSYYNYFSVMDVWGQGTTVTVSS

SEQ ID NO: 646-647 - skipped (2 entries)

SEQ ID NO: 648 - protein, 107 aa, Artificial Sequence; identical to SEQ ID NO: 636
  Description of Artificial Sequence: Synthetic polypeptide

SEQ ID NO: 649 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRIVSSTYGGTTDYAAPVKGRFTISRDDSKNTLYLQMNSLKTEDTAVYYCTTPSYSGSYYNYFSVMDVWGQGTTVTVSS

SEQ ID NO: 650-651 - skipped (2 entries)

SEQ ID NO: 652 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGCGTKLTVL

SEQ ID NO: 653 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSAISGSGGGTYNAASVKGRFTISRDNSKNTLYLQMNSLRAEDTAVYYCATGKGVHLGFDYWGQGTLVTVSS

SEQ ID NO: 654-655 - skipped (2 entries)

SEQ ID NO: 656 - protein, 108 aa, Artificial Sequence; identical to SEQ ID NO: 652
  Description of Artificial Sequence: Synthetic polypeptide

SEQ ID NO: 657 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSAISGSGGGTYNADSVKGRFTISRDNSKNTLYLQMNSLRAEDTAVYYCATGKGVHLGFDYWGQGTLVTVSS

SEQ ID NO: 658-659 - skipped (2 entries)

SEQ ID NO: 660 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQSGVPSRFSGSGSGTDFTLTISSLQPEDFATYYCQQTYSMPFTFGCGTKVDIK

SEQ ID NO: 661 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRITSGIYGGTTDYAAPVKGRFTISRDDSKNTLYLQMNSLKTEDTAVYYCTTPSYSGSYYNYFSVMDVWGQGTTVTVSS

SEQ ID NO: 662-663 - skipped (2 entries)

SEQ ID NO: 664 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGCGTKLEIK

SEQ ID NO: 665 - protein, 127 aa, Artificial Sequence
  Description of Artificial Sequence: Synthetic polypeptide
EVQLVESGGGLVQPGGSLRLSCAASGFTFSNAWMSWVRQAPGKCLEWVGRIRSRPYGGTTDYAAPVKGRFTISRDDSKNTLYLQMNSLKTEDTAVYYCTTPSYSGSYYNYFSVMDVWGQGTTVTVSS

SEQ ID NO: 666-667 - skipped (2 entries)

SEQ ID NO: 668 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFYSTPITFGCGTRLEIK

SEQ ID NO: 669 - protein, 121 aa, Artificial Sequence
  Description of Artificial Sequence: Synthetic polypeptide
QVQLQESGPGLVKPSETLSLTCTVSGDSISSSRYYWGWIRQPPGKCLEWIGSIYYSGSTYYNPSLKSRVTISVDTSKNQFSLKLSSVTAADTAVYYCARGIFGVITYFDYWGQGTLVTVSS

SEQ ID NO: 670-671 - skipped (2 entries)

SEQ ID NO: 672 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDFATYYCQKYNSAPFTFGCGTKVEIK

SEQ ID NO: 673 - protein, 116 aa, Artificial Sequence
  Description of Artificial Sequence: Synthetic polypeptide
QVQLVESGGGVVQPGRSLRLSCAASGFTFSTYGMHWVRQAPGKCLEWVAVISYDASNKYYAESVKGRFTISRDNSKNTLYLQMNSLRAEDTAVYYCARGQLLTGYWGQGTLVTVSS

SEQ ID NO: 674-675 - skipped (2 entries)

SEQ ID NO: 676 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGCGTKVEIK

SEQ ID NO: 677 - protein, 116 aa, Artificial Sequence
  Description of Artificial Sequence: Synthetic polypeptide
QVQLVESGGGVVQPGRSLRLSCAASGFTFSTYGMHWVRQAPGKCLEWVAVISYDAETVKYAESVKGRFTISRDNSKNTLYLQMNSLRAEDTAVYYCARGQLLTGYWGQGTLVTVSS

SEQ ID NO: 678-679 - skipped (2 entries)

SEQ ID NO: 680 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDADRPSGIPERFSGSNSGNTATLTISRVEAGDEADYYCQVWDASAGYGVVFGCGTKLTVL

SEQ ID NO: 681 - protein, 117 aa, Artificial Sequence
  Description of Artificial Sequence: Synthetic polypeptide
QVQLVESGGGLVKPGGSLRLSCAASGFTFSDYYMSWIRQAPGKCLEWVSYISKSSYTVTYADAVKGRFTISRDNAKNSLYLQMNSLRAEDTAVYYCATYNYGHFDYWGQGTLVTVSS

SEQ ID NO: 682-683 - skipped (2 entries)

SEQ ID NO: 684 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGCGTKLTVL

SEQ ID NO: 685 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSSISGSGGGTYYAASVKGRFTISRDNSKNTLYLQMNSLRAEDTAVYYCATGKGVHLGFDYWGQGTLVTVSS

SEQ ID NO: 686-687 - skipped (2 entries)

SEQ ID NO: 688 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNFGNTATLIISRVEAGDEADYYCQVWDYFSMTHVFGCGTKLTVL

SEQ ID NO: 689 - protein, 119 aa, Artificial Sequence; identical to SEQ ID NO: 573
  Description of Artificial Sequence: Synthetic polypeptide

SEQ ID NO: 690-691 - skipped (2 entries)

SEQ ID NO: 692 - protein, 112 aa, Artificial Sequence
  Description of Artificial Sequence: Synthetic polypeptide
DIVMTQTPLSLPVTPGEPASISCRSSQSLLHRSGYNYLDWYLQKPGQSPQLLIYLGSNRASGVPDRFSGSGSGTDFTLKISRVEAGDVGVYYCMQALQTPWTFGCGTKVEIK

SEQ ID NO: 693 - protein, 126 aa, Artificial Sequence
  Description of Artificial Sequence: Synthetic polypeptide
QVQLQESGPGLVKPSQTLSLTCTVSGDSISSNPYYWSWIRQHPGKCLEWIGYISYSGITNYNPSLKSRVTMSVDTSKNQFSLKLTSLTAADTAVYYCAREKMWFGVLNYYYGMDVWGQGTTVTVSS

SEQ ID NO: 694-695 - skipped (2 entries)

SEQ ID NO: 696 - protein, 109 aa, Artificial Sequence; identical to SEQ ID NO: 31
  Description of Artificial Sequence: Synthetic polypeptide

SEQ ID NO: 697 - protein, 125 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 698 - protein, 23 aa, Artificial Sequence
  Description of Artificial Sequence: Synthetic peptide
DIQMTQSPSSLSASVGDRVTITC

SEQ ID NO: 699 - protein, 23 aa, Artificial Sequence
  Description of Artificial Sequence: Synthetic peptide
DIQMTQSPSSLSASVGDRVTITC

SEQ ID NO: 700 - protein, 23 aa, Artificial Sequence
  Description of Artificial Sequence: Synthetic peptide
DIQMTQSPSSLSASVGDRVTITC

SEQ ID NO: 701 - protein, 23 aa, Artificial Sequence
  Description of Artificial Sequence: Synthetic peptide
DIQMTQSPDSLSASVGDRVTITC

SEQ ID NO: 702 - protein, 23 aa, Artificial Sequence
  Description of Artificial Sequence: Synthetic peptide
DIQMTQSPSSLSASVGDRVTITC

SEQ ID NO: 703 - protein, 23 aa, Artificial Sequence
  Description of Artificial Sequence: Synthetic peptide
DIQMTQSPSSLSASVGDRVTITC

SEQ ID NO: 704 - protein, 23 aa, Artificial Sequence
  Description of Artificial Sequence: Synthetic peptide
DIQMTQSPSSLSASVGDRVTITC

SEQ ID NO: 705 - protein, 23 aa, Artificial Sequence
  Description of Artificial Sequence: Synthetic peptide
DIQMTQSPSSLSASVGDRVTITC

SEQ ID NO: 706 - protein, 23 aa, Artificial Sequence
  Description of Artificial Sequence: Synthetic peptide
DIQMTQSPSSLSASVGDRVTITC

SEQ ID NO: 707 - protein, 23 aa, Artificial Sequence
  Description of Artificial Sequence: Synthetic peptide
DIQMTQSPSSLSASVGDRVTITC

SEQ ID NO: 708 - protein, 23 aa, Artificial Sequence
  Description of Artificial Sequence: Synthetic peptide
DIQMTQSPSSLSASVGDRVTITC

SEQ ID NO: 709 - protein, 23 aa, Artificial Sequence
  Description of Artificial Sequence: Synthetic peptide
DIQMTQSPSSLSASVGDRVTITC

SEQ ID NO: 710 - protein, 23 aa, Artificial Sequence
  Description of Artificial Sequence: Synthetic peptide
DIQMTQSPSSLSASVGDRVTITC

SEQ ID NO: 711 - protein, 23 aa, Artificial Sequence
  Description of Artificial Sequence: Synthetic peptide
DIQMTQSPSSLSASVGDRVTITC

SEQ ID NO: 712 - protein, 23 aa, Artificial Sequence
  Description of Artificial Sequence: Synthetic peptide
DIQMTQSPSSLSASVGDRVTITC

SEQ ID NO: 713 - protein, 23 aa, Artificial Sequence
  Description of Artificial Sequence: Synthetic peptide
DIQMTQSPSSLSASVGDRVTITC

SEQ ID NO: 714 - protein, 23 aa, Artificial Sequence
  Description of Artificial Sequence: Synthetic peptide
DIQMTQSPSSLSASVGDRVTITC

SEQ ID NO: 715 - protein, 23 aa, Artificial Sequence
  Description of Artificial Sequence: Synthetic peptide
DIQMTQSPSSLSASVGDRVTITC

SEQ ID NO: 716 - protein, 23 aa, Artificial Sequence
  Description of Artificial Sequence: Synthetic peptide
DIQMTQSPSSLSASVGDRVTITC

SEQ ID NO: 717 - protein, 23 aa, Artificial Sequence
  Description of Artificial Sequence: Synthetic peptide
DIQMTQSPSSLSASVGDRVTITC

SEQ ID NO: 718 - protein, 23 aa, Artificial Sequence
  Description of Artificial Sequence: Synthetic peptide
DIQMTQSPSSLSASVGDRVTITC

SEQ ID NO: 719 - protein, 23 aa, Artificial Sequence
  Description of Artificial Sequence: Synthetic peptide
DIVMTQSPDSLAVSLGERATINC

SEQ ID NO: 720 - protein, 23 aa, Artificial Sequence
  Description of Artificial Sequence: Synthetic peptide
DIVMTQSPDSLAVSLGERATINC

SEQ ID NO: 721 - protein, 23 aa, Artificial Sequence
  Description of Artificial Sequence: Synthetic peptide
DIQMTQSPSSLSASVGDRVTITC

SEQ ID NO: 722 - protein, 23 aa, Artificial Sequence
  Description of Artificial Sequence: Synthetic peptide
DIQMTQSPSSLSASVGDRVTITC

SEQ ID NO: 723 - protein, 23 aa, Artificial Sequence
  Description of Artificial Sequence: Synthetic peptide
DIQMTQSPSSLSASVGDRVTITC

SEQ ID NO: 724 - protein, 23 aa, Artificial Sequence
  Description of Artificial Sequence: Synthetic peptide
DIVMTQTPLSLPVTPGEPASISC

SEQ ID NO: 725 - protein, 23 aa, Artificial Sequence
  Description of Artificial Sequence: Synthetic peptide
DIVMTQTPLSLPVTPGEPASISC

SEQ ID NO: 726 - protein, 22 aa, Artificial Sequence
  Description of Artificial Sequence: Synthetic peptide
SYVLTQPPSVSVAPGKTARITC

SEQ ID NO: 727 - protein, 22 aa, Artificial Sequence
  Description of Artificial Sequence: Synthetic peptide
SYVLTQPPSVSVAPGQTARITC

SEQ ID NO: 728 - protein, 22 aa, Artificial Sequence
  Description of Artificial Sequence: Synthetic peptide
SYVLTQPPSVSVAPGQTARITC

SEQ ID NO: 729 - protein, 22 aa, Artificial Sequence
  Description of Artificial Sequence: Synthetic peptide
SYVLTQPPSVSVAPGQTARITC

SEQ ID NO: 730 - protein, 22 aa, Artificial Sequence
  Description of Artificial Sequence: Synthetic peptide
SYVLTQPPSVSVAPGQTARITC

SEQ ID NO: 731 - protein, 22 aa, Artificial Sequence
  Description of Artificial Sequence: Synthetic peptide
SYVLTQPPSVSVAPGQTARITC

SEQ ID NO: 732 - protein, 22 aa, Artificial Sequence
  Description of Artificial Sequence: Synthetic peptide
SYVLTQPPSVSVAPGQTARITC

SEQ ID NO: 733 - protein, 22 aa, Artificial Sequence
  Description of Artificial Sequence: Synthetic peptide
SYVLTQPPSVSVAPGQTARITC

SEQ ID NO: 734 - protein, 22 aa, Artificial Sequence
  Description of Artificial Sequence: Synthetic peptide
SYVLTQPPSVSVAPGQTARITC

SEQ ID NO: 735 - protein, 22 aa, Artificial Sequence
  Description of Artificial Sequence: Synthetic peptide
SYVLTQPPSVSVAPGQTARITC

SEQ ID NO: 736 - protein, 22 aa, Artificial Sequence
  Description of Artificial Sequence: Synthetic peptide
SYVLTQPPSVSVAPGQTARITC

SEQ ID NO: 737 - protein, 22 aa, Artificial Sequence
  Description of Artificial Sequence: Synthetic peptide
QTVVTQEPSLTVSPGGTVTLTC

SEQ ID NO: 738 - protein, 22 aa, Artificial Sequence
  Description of Artificial Sequence: Synthetic peptide
QTVVTQEPSLTVSPGGTVTLTC

SEQ ID NO: 739 - protein, 22 aa, Artificial Sequence
  Description of Artificial Sequence: Synthetic peptide
QTVVTQEPSLTVSPGGTVTLTC

SEQ ID NO: 740 - protein, 22 aa, Artificial Sequence
  Description of Artificial Sequence: Synthetic peptide
QTVVTQEPSLTVSPGGTVTLTC

SEQ ID NO: 741 - protein, 22 aa, Artificial Sequence
  Description of Artificial Sequence: Synthetic peptide
QTVVTQEPSLTVSPGGTVTLTC

SEQ ID NO: 742 - protein, 22 aa, Artificial Sequence
  Description of Artificial Sequence: Synthetic peptide
QTVVTQEPSLTVSPGGTVTLTC

SEQ ID NO: 743 - protein, 22 aa, Artificial Sequence
  Description of Artificial Sequence: Synthetic peptide
QTVVTQEPSLTVSPGGTVTLTC

SEQ ID NO: 744 - protein, 22 aa, Artificial Sequence
  Description of Artificial Sequence: Synthetic peptide
QTVVTQEPSLTVSPGGTVTLTC

SEQ ID NO: 745 - protein, 22 aa, Artificial Sequence
  Description of Artificial Sequence: Synthetic peptide
QTVVTQEPSLTVSPGGTVTLTC

SEQ ID NO: 746 - protein, 22 aa, Artificial Sequence
  Description of Artificial Sequence: Synthetic peptide
QTVVTQEPSLTVSPGGTVTLTC

SEQ ID NO: 747 - protein, 22 aa, Artificial Sequence
  Description of Artificial Sequence: Synthetic peptide
QTVVTQEPSLTVSPGGTVTLTC

SEQ ID NO: 748 - protein, 22 aa, Artificial Sequence
  Description of Artificial Sequence: Synthetic peptide
QTVVTQEPSLTVSPGGTVTLTC

SEQ ID NO: 749 - protein, 22 aa, Artificial Sequence
  Description of Artificial Sequence: Synthetic peptide
QTVVTQEPSLTVSPGGTVTLTC

SEQ ID NO: 750 - protein, 22 aa, Artificial Sequence
  Description of Artificial Sequence: Synthetic peptide
QTVVTQEPSLTVSPGGTVTLTC

SEQ ID NO: 751 - protein, 22 aa, Artificial Sequence
  Description of Artificial Sequence: Synthetic peptide
QTVVTQEPSLTVSPGGTVTLTC

SEQ ID NO: 752 - protein, 22 aa, Artificial Sequence
  Description of Artificial Sequence: Synthetic peptide
QTVVTQEPSLTVSPGGTVTLTC

SEQ ID NO: 753 - protein, 22 aa, Artificial Sequence
  Description of Artificial Sequence: Synthetic peptide
QTVVTQEPSLTVSPGGTVTLTC

SEQ ID NO: 754 - protein, 22 aa, Artificial Sequence
  Description of Artificial Sequence: Synthetic peptide
QTVVTQEPSLTVSPGGTVTLTC

SEQ ID NO: 755 - protein, 22 aa, Artificial Sequence
  Description of Artificial Sequence: Synthetic peptide
QTVVTQEPSLTVSPGGTVTLTC

SEQ ID NO: 756 - protein, 22 aa, Artificial Sequence
  Description of Artificial Sequence: Synthetic peptide
QTVVTQEPSLTVSPGGTVTLTC

SEQ ID NO: 757 - protein, 22 aa, Artificial Sequence
  Description of Artificial Sequence: Synthetic peptide
QTVVTQEPSLTVSPGGTVTLTC

SEQ ID NO: 758 - protein, 22 aa, Artificial Sequence
  Description of Artificial Sequence: Synthetic peptide
QTVVTQEPSLTVSPGGTVTLTC

SEQ ID NO: 759 - protein, 22 aa, Artificial Sequence
  Description of Artificial Sequence: Synthetic peptide
QTVVTQEPSLTVSPGGTVTLTC

SEQ ID NO: 760 - protein, 22 aa, Artificial Sequence
  Description of Artificial Sequence: Synthetic peptide
QTVVTQEPSLTVSPGGTVTLTC

SEQ ID NO: 761 - protein, 22 aa, Artificial Sequence
  Description of Artificial Sequence: Synthetic peptide
QTVVTQEPSLTVSPGGTVTLTC

SEQ ID NO: 762 - protein, 22 aa, Artificial Sequence
  Description of Artificial Sequence: Synthetic peptide
QTVVTQEPSLTVSPGGTVTLTC

SEQ ID NO: 763 - protein, 22 aa, Artificial Sequence
  Description of Artificial Sequence: Synthetic peptide
QTVVTQEPSLTVSPGGTVTLTC

SEQ ID NO: 764 - protein, 22 aa, Artificial Sequence
  Description of Artificial Sequence: Synthetic peptide
QTVVTQEPSLTVSPGGTVTLTC

SEQ ID NO: 765 - protein, 22 aa, Artificial Sequence
  Description of Artificial Sequence: Synthetic peptide
QTVVTQEPSLTVSPGGTVTLTC

SEQ ID NO: 766 - protein, 22 aa, Artificial Sequence
  Description of Artificial Sequence: Synthetic peptide
QTVVTQEPSLTVSPGGTVTLTC

SEQ ID NO: 767 - protein, 22 aa, Artificial Sequence
  Description of Artificial Sequence: Synthetic peptide
QTVVTQEPSLTVSPGGTVTLTC

SEQ ID NO: 768 - protein, 22 aa, Artificial Sequence
  Description of Artificial Sequence: Synthetic peptide
QTVVTQEPSLTVSPGGTVTLTC

SEQ ID NO: 769 - protein, 22 aa, Artificial Sequence
  Description of Artificial Sequence: Synthetic peptide
QTVVTQEPSLTVSPGGTVTLTC

SEQ ID NO: 770 - protein, 22 aa, Artificial Sequence
  Description of Artificial Sequence: Synthetic peptide
QTVVTQEPSLTVSPGGTVTLTC

SEQ ID NO: 771 - protein, 22 aa, Artificial Sequence
  Description of Artificial Sequence: Synthetic peptide
QTVVTQEPSLTVSPGGTVTLTC

SEQ ID NO: 772 - protein, 22 aa, Artificial Sequence
  Description of Artificial Sequence: Synthetic peptide
QTVVTQEPSLTVSPGGTVTLTC

SEQ ID NO: 773 - protein, 22 aa, Artificial Sequence
  Description of Artificial Sequence: Synthetic peptide
QTVVTQEPSLTVSPGGTVTLTC

SEQ ID NO: 774 - protein, 22 aa, Artificial Sequence
  Description of Artificial Sequence: Synthetic peptide
SYVLTQPPSVSVAPGKTARITC

SEQ ID NO: 775 - protein, 22 aa, Artificial Sequence
  Description of Artificial Sequence: Synthetic peptide
SYVLTQPPSVSVAPGQTARITC

SEQ ID NO: 776 - protein, 22 aa, Artificial Sequence
  Description of Artificial Sequence: Synthetic peptide
SYVLTQPPSVSVAPGQTARITC

SEQ ID NO: 777 - protein, 22 aa, Artificial Sequence
  Description of Artificial Sequence: Synthetic peptide
SYVLTQPPSVSVAPGQTARITC

SEQ ID NO: 778 - protein, 22 aa, Artificial Sequence
  Description of Artificial Sequence: Synthetic peptide
SYVLTQPPSVSVAPGQTARITC

SEQ ID NO: 779 - protein, 30 aa, Artificial Sequence
  Description of Artificial Sequence: Synthetic polypeptide
EVQLLESGGGLVQPGGSLRLSCAASGFTFS

SEQ ID NO: 780 - protein, 30 aa, Artificial Sequence; identical to SEQ ID NO: 779
  Description of Artificial Sequence: Synthetic polypeptide

SEQ ID NO: 781 - protein, 30 aa, Artificial Sequence; identical to SEQ ID NO: 779
  Description of Artificial Sequence: Synthetic polypeptide

SEQ ID NO: 782 - protein, 30 aa, Artificial Sequence; identical to SEQ ID NO: 779
  Description of Artificial Sequence: Synthetic polypeptide

SEQ ID NO: 783 - protein, 30 aa, Artificial Sequence; identical to SEQ ID NO: 779
  Description of Artificial Sequence: Synthetic polypeptide

SEQ ID NO: 784 - protein, 30 aa, Artificial Sequence
  Description of Artificial Sequence: Synthetic polypeptide
EVQLLESGGGVVQPGRSLRLSCAASGFTFS

SEQ ID NO: 785 - protein, 30 aa, Artificial Sequence; identical to SEQ ID NO: 779
  Description of Artificial Sequence: Synthetic polypeptide

SEQ ID NO: 786 - protein, 30 aa, Artificial Sequence; identical to SEQ ID NO: 779
  Description of Artificial Sequence: Synthetic polypeptide

SEQ ID NO: 787 - protein, 30 aa, Artificial Sequence
  Description of Artificial Sequence: Synthetic polypeptide
EVQLLESGGGLVKPGGSLRLSCAASGFTFS

SEQ ID NO: 788 - protein, 30 aa, Artificial Sequence; identical to SEQ ID NO: 779
  Description of Artificial Sequence: Synthetic polypeptide

SEQ ID NO: 789 - protein, 30 aa, Artificial Sequence; identical to SEQ ID NO: 779
  Description of Artificial Sequence: Synthetic polypeptide

SEQ ID NO: 790 - protein, 30 aa, Artificial Sequence; identical to SEQ ID NO: 779
  Description of Artificial Sequence: Synthetic polypeptide

SEQ ID NO: 791 - protein, 30 aa, Artificial Sequence; identical to SEQ ID NO: 779
  Description of Artificial Sequence: Synthetic polypeptide

SEQ ID NO: 792 - protein, 30 aa, Artificial Sequence; identical to SEQ ID NO: 779
  Description of Artificial Sequence: Synthetic polypeptide

SEQ ID NO: 793 - protein, 30 aa, Artificial Sequence
  Description of Artificial Sequence: Synthetic polypeptide
EVQLVESGGGLVQPGGSLKLSCAASGFTFS

SEQ ID NO: 794 - protein, 30 aa, Artificial Sequence
  Description of Artificial Sequence: Synthetic polypeptide
EVQLVESGGGLVQPGGSLKLSCAASGFTFN

SEQ ID NO: 795 - protein, 30 aa, Artificial Sequence; identical to SEQ ID NO: 794
  Description of Artificial Sequence: Synthetic polypeptide

SEQ ID NO: 796 - protein, 30 aa, Artificial Sequence; identical to SEQ ID NO: 794
  Description of Artificial Sequence: Synthetic polypeptide

SEQ ID NO: 797 - protein, 30 aa, Artificial Sequence; identical to SEQ ID NO: 794
  Description of Artificial Sequence: Synthetic polypeptide

SEQ ID NO: 798 - protein, 30 aa, Artificial Sequence; identical to SEQ ID NO: 794
  Description of Artificial Sequence: Synthetic polypeptide

SEQ ID NO: 799 - protein, 30 aa, Artificial Sequence; identical to SEQ ID NO: 794
  Description of Artificial Sequence: Synthetic polypeptide

SEQ ID NO: 800 - protein, 30 aa, Artificial Sequence; identical to SEQ ID NO: 794
  Description of Artificial Sequence: Synthetic polypeptide

SEQ ID NO: 801 - protein, 30 aa, Artificial Sequence; identical to SEQ ID NO: 794
  Description of Artificial Sequence: Synthetic polypeptide

SEQ ID NO: 802 - protein, 30 aa, Artificial Sequence; identical to SEQ ID NO: 794
  Description of Artificial Sequence: Synthetic polypeptide

SEQ ID NO: 803 - protein, 30 aa, Artificial Sequence; identical to SEQ ID NO: 794
  Description of Artificial Sequence: Synthetic polypeptide

SEQ ID NO: 804 - protein, 30 aa, Artificial Sequence; identical to SEQ ID NO: 794
  Description of Artificial Sequence: Synthetic polypeptide

SEQ ID NO: 805 - protein, 30 aa, Artificial Sequence; identical to SEQ ID NO: 794
  Description of Artificial Sequence: Synthetic polypeptide

SEQ ID NO: 806 - protein, 30 aa, Artificial Sequence; identical to SEQ ID NO: 794
  Description of Artificial Sequence: Synthetic polypeptide

SEQ ID NO: 807 - protein, 30 aa, Artificial Sequence; identical to SEQ ID NO: 794
  Description of Artificial Sequence: Synthetic polypeptide

SEQ ID NO: 808 - protein, 30 aa, Artificial Sequence; identical to SEQ ID NO: 794
  Description of Artificial Sequence: Synthetic polypeptide

SEQ ID NO: 809 - protein, 30 aa, Artificial Sequence; identical to SEQ ID NO: 794
  Description of Artificial Sequence: Synthetic polypeptide

SEQ ID NO: 810 - protein, 30 aa, Artificial Sequence; identical to SEQ ID NO: 794
  Description of Artificial Sequence: Synthetic polypeptide

SEQ ID NO: 811 - protein, 30 aa, Artificial Sequence; identical to SEQ ID NO: 794
  Description of Artificial Sequence: Synthetic polypeptide

SEQ ID NO: 812 - protein, 30 aa, Artificial Sequence; identical to SEQ ID NO: 794
  Description of Artificial Sequence: Synthetic polypeptide

SEQ ID NO: 813 - protein, 30 aa, Artificial Sequence; identical to SEQ ID NO: 794
  Description of Artificial Sequence: Synthetic polypeptide

SEQ ID NO: 814 - protein, 30 aa, Artificial Sequence; identical to SEQ ID NO: 794
  Description of Artificial Sequence: Synthetic polypeptide

SEQ ID NO: 815 - protein, 30 aa, Artificial Sequence; identical to SEQ ID NO: 794
  Description of Artificial Sequence: Synthetic polypeptide

SEQ ID NO: 816 - protein, 30 aa, Artificial Sequence; identical to SEQ ID NO: 794
  Description of Artificial Sequence: Synthetic polypeptide

SEQ ID NO: 817 - protein, 30 aa, Artificial Sequence; identical to SEQ ID NO: 794
  Description of Artificial Sequence: Synthetic polypeptide

SEQ ID NO: 818 - protein, 30 aa, Artificial Sequence; identical to SEQ ID NO: 794
  Description of Artificial Sequence: Synthetic polypeptide

SEQ ID NO: 819 - protein, 30 aa, Artificial Sequence; identical to SEQ ID NO: 794
  Description of Artificial Sequence: Synthetic polypeptide

SEQ ID NO: 820 - protein, 30 aa, Artificial Sequence; identical to SEQ ID NO: 794
  Description of Artificial Sequence: Synthetic polypeptide

SEQ ID NO: 821 - protein, 30 aa, Artificial Sequence; identical to SEQ ID NO: 794
  Description of Artificial Sequence: Synthetic polypeptide

SEQ ID NO: 822 - protein, 30 aa, Artificial Sequence; identical to SEQ ID NO: 794
  Description of Artificial Sequence: Synthetic polypeptide

SEQ ID NO: 823 - protein, 30 aa, Artificial Sequence; identical to SEQ ID NO: 794
  Description of Artificial Sequence: Synthetic polypeptide

SEQ ID NO: 824 - protein, 30 aa, Artificial Sequence; identical to SEQ ID NO: 794
  Description of Artificial Sequence: Synthetic polypeptide

SEQ ID NO: 825 - protein, 30 aa, Artificial Sequence; identical to SEQ ID NO: 794
  Description of Artificial Sequence: Synthetic polypeptide

SEQ ID NO: 826 - protein, 30 aa, Artificial Sequence; identical to SEQ ID NO: 794
  Description of Artificial Sequence: Synthetic polypeptide

SEQ ID NO: 827 - protein, 30 aa, Artificial Sequence; identical to SEQ ID NO: 794
  Description of Artificial Sequence: Synthetic polypeptide

SEQ ID NO: 828 - protein, 30 aa, Artificial Sequence; identical to SEQ ID NO: 794
  Description of Artificial Sequence: Synthetic polypeptide

SEQ ID NO: 829 - protein, 30 aa, Artificial Sequence; identical to SEQ ID NO: 794
  Description of Artificial Sequence: Synthetic polypeptide

SEQ ID NO: 830 - protein, 30 aa, Artificial Sequence
  Description of Artificial Sequence: Synthetic polypeptide
QVTLKESGPALVKPTQTLTLTCTFSGFSLS

SEQ ID NO: 831 - protein, 30 aa, Artificial Sequence
  Description of Artificial Sequence: Synthetic polypeptide
QVTLKESGPALVKPTQTLTLTCTFSGFSFT

SEQ ID NO: 832 - protein, 30 aa, Artificial Sequence
  Description of Artificial Sequence: Synthetic polypeptide
EVQLVESGGGLVKPGGSLRLSCAASGFTFS

SEQ ID NO: 833 - protein, 30 aa, Artificial Sequence
  Description of Artificial Sequence: Synthetic polypeptide
EVQLVESGGGLVQPGGSLRLSCAASGFTFS

SEQ ID NO: 834 - protein, 30 aa, Artificial Sequence; identical to SEQ ID NO: 833
  Description of Artificial Sequence: Synthetic polypeptide

SEQ ID NO: 835 - protein, 30 aa, Artificial Sequence; identical to SEQ ID NO: 833
  Description of Artificial Sequence: Synthetic polypeptide

SEQ ID NO: 836 - protein, 30 aa, Artificial Sequence; identical to SEQ ID NO: 833
  Description of Artificial Sequence: Synthetic polypeptide

SEQ ID NO: 837 - protein, 30 aa, Artificial Sequence; identical to SEQ ID NO: 832
  Description of Artificial Sequence: Synthetic polypeptide

SEQ ID NO: 838 - protein, 30 aa, Artificial Sequence; identical to SEQ ID NO: 833
  Description of Artificial Sequence: Synthetic polypeptide

SEQ ID NO: 839 - protein, 30 aa, Artificial Sequence; identical to SEQ ID NO: 833
  Description of Artificial Sequence: Synthetic polypeptide

SEQ ID NO: 840 - protein, 30 aa, Artificial Sequence; identical to SEQ ID NO: 833
  Description of Artificial Sequence: Synthetic polypeptide

SEQ ID NO: 841 - protein, 30 aa, Artificial Sequence; identical to SEQ ID NO: 833
  Description of Artificial Sequence: Synthetic polypeptide

SEQ ID NO: 842 - protein, 30 aa, Artificial Sequence
  Description of Artificial Sequence: Synthetic polypeptide
QITLKESGPTLVKPTQTLTLTCTFSGFSLS

SEQ ID NO: 843 - protein, 30 aa, Artificial Sequence
  Description of Artificial Sequence: Synthetic polypeptide
QITLKESGPMLVKPTQTLTLTCTFSGFSFT

SEQ ID NO: 844 - protein, 30 aa, Artificial Sequence
  Description of Artificial Sequence: Synthetic polypeptide
QITLKESGPALVKPTQTLTLTCTFSGFSFT

SEQ ID NO: 845 - protein, 30 aa, Artificial Sequence
  Description of Artificial Sequence: Synthetic polypeptide
QITLKESGPTLVKPTQTLTLTCTFSGFSFT

SEQ ID NO: 846 - protein, 30 aa, Artificial Sequence; identical to SEQ ID NO: 845
  Description of Artificial Sequence: Synthetic polypeptide

SEQ ID NO: 847 - protein, 30 aa, Artificial Sequence; identical to SEQ ID NO: 843
  Description of Artificial Sequence: Synthetic polypeptide

SEQ ID NO: 848 - protein, 30 aa, Artificial Sequence; identical to SEQ ID NO: 844
  Description of Artificial Sequence: Synthetic polypeptide

SEQ ID NO: 849 - protein, 30 aa, Artificial Sequence; identical to SEQ ID NO: 845
  Description of Artificial Sequence: Synthetic polypeptide

SEQ ID NO: 850 - protein, 30 aa, Artificial Sequence; identical to SEQ ID NO: 845
  Description of Artificial Sequence: Synthetic polypeptide

SEQ ID NO: 851 - protein, 30 aa, Artificial Sequence
  Description of Artificial Sequence: Synthetic polypeptide
QVQLQESGPGLVKPSETLSLTCTVSGGSIS

SEQ ID NO: 852 - protein, 30 aa, Artificial Sequence
  Description of Artificial Sequence: Synthetic polypeptide
QVQLQESGPGLVKPSETLSLTCTVSGDSIS

SEQ ID NO: 853 - protein, 30 aa, Artificial Sequence
  Description of Artificial Sequence: Synthetic polypeptide
QVQLVESGGGVVQPGRSLRLSCAASGFTFS

SEQ ID NO: 854 - protein, 30 aa, Artificial Sequence; identical to SEQ ID NO: 853
  Description of Artificial Sequence: Synthetic polypeptide

SEQ ID NO: 855 - protein, 30 aa, Artificial Sequence; identical to SEQ ID NO: 853
  Description of Artificial Sequence: Synthetic polypeptide

SEQ ID NO: 856 - protein, 30 aa, Artificial Sequence
  Description of Artificial Sequence: Synthetic polypeptide
QVQLVESGGGLVKPGGSLRLSCAASGFTFS

SEQ ID NO: 857 - protein, 30 aa, Artificial Sequence; identical to SEQ ID NO: 856
  Description of Artificial Sequence: Synthetic polypeptide

SEQ ID NO: 858 - protein, 30 aa, Artificial Sequence
  Description of Artificial Sequence: Synthetic polypeptide
QVQLQESGPGLVKPSQTLSLTCTVSGGSIS

SEQ ID NO: 859 - protein, 30 aa, Artificial Sequence
  Description of Artificial Sequence: Synthetic polypeptide
QVQLQESGPGLVKPSQTLSLTCTVSGDSIS

SEQ ID NO: 860 - protein, 11 aa, Artificial Sequence
  Description of Artificial Sequence: Synthetic peptide
RASQSISSYLN

SEQ ID NO: 861 - protein, 11 aa, Artificial Sequence
  Description of Artificial Sequence: Synthetic peptide
RASQSISNYFN

SEQ ID NO: 862 - protein, 11 aa, Artificial Sequence
  Description of Artificial Sequence: Synthetic peptide
RTSQSISSYLN

SEQ ID NO: 863 - protein, 11 aa, Artificial Sequence
  Description of Artificial Sequence: Synthetic peptide
QASQDISNYLN

SEQ ID NO: 864 - protein, 11 aa, Artificial Sequence
  Description of Artificial Sequence: Synthetic peptide
QASQDISNYLN

SEQ ID NO: 865 - protein, 11 aa, Artificial Sequence
  Description of Artificial Sequence: Synthetic peptide
QASQDISNYLN

SEQ ID NO: 866 - protein, 11 aa, Artificial Sequence
  Description of Artificial Sequence: Synthetic peptide
QASQDISNYFN

SEQ ID NO: 867 - protein, 11 aa, Artificial Sequence
  Description of Artificial Sequence: Synthetic peptide
RASQFISSYLN

SEQ ID NO: 868 - protein, 11 aa, Artificial Sequence
  Description of Artificial Sequence: Synthetic peptide
QASQDISNYLN

SEQ ID NO: 869 - protein, 11 aa, Artificial Sequence
  Description of Artificial Sequence: Synthetic peptide
QASQDISNYLN

SEQ ID NO: 870 - protein, 11 aa, Artificial Sequence
  Description of Artificial Sequence: Synthetic peptide
RASQFISSYLN

SEQ ID NO: 871 - protein, 11 aa, Artificial Sequence
  Description of Artificial Sequence: Synthetic peptide
RTSQSISSYLN

SEQ ID NO: 872 - protein, 11 aa, Artificial Sequence
  Description of Artificial Sequence: Synthetic peptide
RASQSISSYLN

SEQ ID NO: 873 - protein, 11 aa, Artificial Sequence
  Description of Artificial Sequence: Synthetic peptide
RTSQSISSYLN

SEQ ID NO: 874 - protein, 11 aa, Artificial Sequence
  Description of Artificial Sequence: Synthetic peptide
RTSQSISSYLN

SEQ ID NO: 875 - protein, 11 aa, Artificial Sequence
  Description of Artificial Sequence: Synthetic peptide
RASQSISSYLN

SEQ ID NO: 876 - protein, 11 aa, Artificial Sequence
  Description of Artificial Sequence: Synthetic peptide
RTSQSISSYLN

SEQ ID NO: 877 - protein, 11 aa, Artificial Sequence
  Description of Artificial Sequence: Synthetic peptide
RTSQSISSYLN

SEQ ID NO: 878 - protein, 11 aa, Artificial Sequence
  Description of Artificial Sequence: Synthetic peptide
RTSQSISSYLN

SEQ ID NO: 879 - protein, 11 aa, Artificial Sequence
  Description of Artificial Sequence: Synthetic peptide
RTSQSISSYLN

SEQ ID NO: 880 - protein, 11 aa, Artificial Sequence
  Description of Artificial Sequence: Synthetic peptide
RTSQSISSYLN

SEQ ID NO: 881 - protein, 17 aa, Artificial Sequence
  Description of Artificial Sequence: Synthetic peptide
KSSQSVLYSSNNKNYLA

SEQ ID NO: 882 - protein, 17 aa, Artificial Sequence
  Description of Artificial Sequence: Synthetic peptide
KSSQSVLYSSNNKNYLA

SEQ ID NO: 883 - protein, 11 aa, Artificial Sequence
  Description of Artificial Sequence: Synthetic peptide
RASQGISNYLA

SEQ ID NO: 884 - protein, 11 aa, Artificial Sequence
  Description of Artificial Sequence: Synthetic peptide
RASQGISNYLA

SEQ ID NO: 885 - protein, 11 aa, Artificial Sequence
  Description of Artificial Sequence: Synthetic peptide
RASQGISNYLA

SEQ ID NO: 886 - protein, 17 aa, Artificial Sequence
  Description of Artificial Sequence: Synthetic peptide
RSSQSLLDSDDGNTYLD

SEQ ID NO: 887 - protein, 16 aa, Artificial Sequence
  Description of Artificial Sequence: Synthetic peptide
RSSQSLLHRSGYNYLD

SEQ ID NO: 888 - protein, 11 aa, Artificial Sequence
  Description of Artificial Sequence: Synthetic peptide
GGNNIGSKSVH

SEQ ID NO: 889 - protein, 11 aa, Artificial Sequence
  Description of Artificial Sequence: Synthetic peptide
GGNNIGSKSVH

SEQ ID NO: 890 - protein, 11 aa, Artificial Sequence
  Description of Artificial Sequence: Synthetic peptide
GGNNIGSKSVH

SEQ ID NO: 891 - protein, 11 aa, Artificial Sequence
  Description of Artificial Sequence: Synthetic peptide
GGNNIGSKSVH

SEQ ID NO: 892 - protein, 11 aa, Artificial Sequence
  Description of Artificial Sequence: Synthetic peptide
GGNNIGSKSVH

SEQ ID NO: 893 - protein, 11 aa, Artificial Sequence
  Description of Artificial Sequence: Synthetic peptide
GGNNIGSKSVH

SEQ ID NO: 894 - protein, 11 aa, Artificial Sequence
  Description of Artificial Sequence: Synthetic peptide
GGNNIGSKSVH

SEQ ID NO: 895 - protein, 11 aa, Artificial Sequence
  Description of Artificial Sequence: Synthetic peptide
GGNNIGSKSVH

SEQ ID NO: 896 - protein, 11 aa, Artificial Sequence
  Description of Artificial Sequence: Synthetic peptide
GGNNIGSKSVH

SEQ ID NO: 897 - protein, 11 aa, Artificial Sequence
  Description of Artificial Sequence: Synthetic peptide
GGNNIGSKSVH

SEQ ID NO: 898 - protein, 11 aa, Artificial Sequence
  Description of Artificial Sequence: Synthetic peptide
GGNNIGSKSVH

SEQ ID NO: 899 - protein, 14 aa, Artificial Sequence
  Description of Artificial Sequence: Synthetic peptide
ASSTGAVTSGYYPN

SEQ ID NO: 900 - protein, 14 aa, Artificial Sequence
  Description of Artificial Sequence: Synthetic peptide
GSSTGAVTSGNYPN

SEQ ID NO: 901 - protein, 14 aa, Artificial Sequence
  Description of Artificial Sequence: Synthetic peptide
GSSTGAVTSGNYPN

SEQ ID NO: 902 - protein, 14 aa, Artificial Sequence
  Description of Artificial Sequence: Synthetic peptide
GSSTGAVTSGNYPN

SEQ ID NO: 903 - protein, 14 aa, Artificial Sequence
  Description of Artificial Sequence: Synthetic peptide
GSSTGAVTSGNYPN

SEQ ID NO: 904 - protein, 14 aa, Artificial Sequence
  Description of Artificial Sequence: Synthetic peptide
GSSTGAVTSGNYPN

SEQ ID NO: 905 - protein, 14 aa, Artificial Sequence
  Description of Artificial Sequence: Synthetic peptide
GSSTGAVTSGNYPN

SEQ ID NO: 906 - protein, 14 aa, Artificial Sequence
  Description of Artificial Sequence: Synthetic peptide
GSSTGAVTSGNYPN

SEQ ID NO: 907 - protein, 14 aa, Artificial Sequence
  Description of Artificial Sequence: Synthetic peptide
GSSTGAVTSGNYPN

SEQ ID NO: 908 - protein, 14 aa, Artificial Sequence
  Description of Artificial Sequence: Synthetic peptide
GSSTGAVTSGNYPN

SEQ ID NO: 909 - protein, 14 aa, Artificial Sequence
  Description of Artificial Sequence: Synthetic peptide
GSSTGAVTSGNYPN

SEQ ID NO: 910 - protein, 14 aa, Artificial Sequence
  Description of Artificial Sequence: Synthetic peptide
GSSTGAVTSGNYPN

SEQ ID NO: 911 - protein, 14 aa, Artificial Sequence
  Description of Artificial Sequence: Synthetic peptide
GSSTGAVTSGNYPN

SEQ ID NO: 912 - protein, 14 aa, Artificial Sequence
  Description of Artificial Sequence: Synthetic peptide
GSSTGAVTSGNYPN

SEQ ID NO: 913 - protein, 14 aa, Artificial Sequence
  Description of Artificial Sequence: Synthetic peptide
GSSTGAVTSGNYPN

SEQ ID NO: 914 - protein, 14 aa, Artificial Sequence
  Description of Artificial Sequence: Synthetic peptide
GSSTGAVTSGNYPN

SEQ ID NO: 915 - protein, 14 aa, Artificial Sequence
  Description of Artificial Sequence: Synthetic peptide
GSSTGAVTSGNYPN

SEQ ID NO: 916 - protein, 14 aa, Artificial Sequence
  Description of Artificial Sequence: Synthetic peptide
GSSTGAVTSGNYPN

SEQ ID NO: 917 - protein, 14 aa, Artificial Sequence
  Description of Artificial Sequence: Synthetic peptide
GSSTGAVTSGNYPN

SEQ ID NO: 918 - protein, 14 aa, Artificial Sequence
  Description of Artificial Sequence: Synthetic peptide
GSSTGAVTSGNYPN

SEQ ID NO: 919 - protein, 14 aa, Artificial Sequence
  Description of Artificial Sequence: Synthetic peptide
GSSTGAVTSGNYPN

SEQ ID NO: 920 - protein, 14 aa, Artificial Sequence
  Description of Artificial Sequence: Synthetic peptide
GSSTGAVTSGNYPN

SEQ ID NO: 921 - protein, 14 aa, Artificial Sequence
  Description of Artificial Sequence: Synthetic peptide
GSSTGAVTSGNYPN

SEQ ID NO: 922 - protein, 14 aa, Artificial Sequence
  Description of Artificial Sequence: Synthetic peptide
GSSTGAVTSGNYPN

SEQ ID NO: 923 - protein, 14 aa, Artificial Sequence
  Description of Artificial Sequence: Synthetic peptide
GSSTGAVTSGNYPN

SEQ ID NO: 924 - protein, 14 aa, Artificial Sequence
  Description of Artificial Sequence: Synthetic peptide
GSSTGAVTSGNYPN

SEQ ID NO: 925 - protein, 14 aa, Artificial Sequence
  Description of Artificial Sequence: Synthetic peptide
GSSTGAVTSGNYPN

SEQ ID NO: 926 - protein, 14 aa, Artificial Sequence
  Description of Artificial Sequence: Synthetic peptide
GSSTGAVTSGNYPN

SEQ ID NO: 927 - protein, 14 aa, Artificial Sequence
  Description of Artificial Sequence: Synthetic peptide
GSSTGAVTSGNYPN

SEQ ID NO: 928 - protein, 14 aa, Artificial Sequence
  Description of Artificial Sequence: Synthetic peptide
GSSTGAVTSGNYPN

SEQ ID NO: 929 - protein, 14 aa, Artificial Sequence
  Description of Artificial Sequence: Synthetic peptide
GSSTGAVTSGNYPN

SEQ ID NO: 930 - protein, 14 aa, Artificial Sequence
  Description of Artificial Sequence: Synthetic peptide
GSSTGAVTSGNYPN

SEQ ID NO: 931 - protein, 14 aa, Artificial Sequence
  Description of Artificial Sequence: Synthetic peptide
GSSTGAVTSGNYPN

SEQ ID NO: 932 - protein, 14 aa, Artificial Sequence
  Description of Artificial Sequence: Synthetic peptide
GSSTGAVTSGNYPN

SEQ ID NO: 933 - protein, 14 aa, Artificial Sequence
  Description of Artificial Sequence: Synthetic peptide
GSSTGAVTSGNYPN

SEQ ID NO: 934 - protein, 14 aa, Artificial Sequence
  Description of Artificial Sequence: Synthetic peptide
GSSTGAVTSGNYPN

SEQ ID NO: 935 - protein, 14 aa, Artificial Sequence
  Description of Artificial Sequence: Synthetic peptide
GSSTGAVTSGNYPN

SEQ ID NO: 936 - protein, 11 aa, Artificial Sequence
  Description of Artificial Sequence: Synthetic peptide
GGNNIGSKSVH

SEQ ID NO: 937 - protein, 11 aa, Artificial Sequence
  Description of Artificial Sequence: Synthetic peptide
GGNNIGSKSVH

SEQ ID NO: 938 - protein, 11 aa, Artificial Sequence
  Description of Artificial Sequence: Synthetic peptide
GGNNIGSKSVH

SEQ ID NO: 939 - protein, 11 aa, Artificial Sequence
  Description of Artificial Sequence: Synthetic peptide
GGNNIGSKSVH

SEQ ID NO: 940 - protein, 11 aa, Artificial Sequence
  Description of Artificial Sequence: Synthetic peptide
GGNNIGSKSVH

SEQ ID NO: 941 - protein, 5 aa, Artificial Sequence
  Description of Artificial Sequence: Synthetic peptide
SYAMS

SEQ ID NO: 942 - protein, 5 aa, Artificial Sequence
  Description of Artificial Sequence: Synthetic peptide
SHAMS

SEQ ID NO: 943 - protein, 5 aa, Artificial Sequence
  Description of Artificial Sequence: Synthetic peptide
SHAMS

SEQ ID NO: 944 - protein, 5 aa, Artificial Sequence
  Description of Artificial Sequence: Synthetic peptide
SHAMS

SEQ ID NO: 945 - protein, 5 aa, Artificial Sequence
  Description of Artificial Sequence: Synthetic peptide
SHAMS

SEQ ID NO: 946 - protein, 5 aa, Artificial Sequence
  Description of Artificial Sequence: Synthetic peptide
SHAMS

SEQ ID NO: 947 - protein, 5 aa, Artificial Sequence
  Description of Artificial Sequence: Synthetic peptide
SHAMS

SEQ ID NO: 948 - protein, 5 aa, Artificial Sequence
  Description of Artificial Sequence: Synthetic peptide
SYAMS

SEQ ID NO: 949 - protein, 5 aa, Artificial Sequence
  Description of Artificial Sequence: Synthetic peptide
SHAMS

SEQ ID NO: 950 - protein, 5 aa, Artificial Sequence
  Description of Artificial Sequence: Synthetic peptide
SHAMS

SEQ ID NO: 951 - protein, 5 aa, Artificial Sequence
  Description of Artificial Sequence: Synthetic peptide
SHAMS

SEQ ID NO: 952 - protein, 5 aa, Artificial Sequence
  Description of Artificial Sequence: Synthetic peptide
SHAMS

SEQ ID NO: 953 - protein, 5 aa, Artificial Sequence
  Description of Artificial Sequence: Synthetic peptide
SHAMS

SEQ ID NO: 954 - protein, 5 aa, Artificial Sequence
  Description of Artificial Sequence: Synthetic peptide
SHAMS

SEQ ID NO: 955 - protein, 5 aa, Artificial Sequence
  Description of Artificial Sequence: Synthetic peptide
GSAMH

SEQ ID NO: 956 - protein, 5 aa, Artificial Sequence
  Description of Artificial Sequence: Synthetic peptide
KYAMN

SEQ ID NO: 957 - protein, 5 aa, Artificial Sequence
  Description of Artificial Sequence: Synthetic peptide
KYAMN

SEQ ID NO: 958 - protein, 5 aa, Artificial Sequence
  Description of Artificial Sequence: Synthetic peptide
KYAMN

SEQ ID NO: 959 - protein, 5 aa, Artificial Sequence
  Description of Artificial Sequence: Synthetic peptide
KYAMN

SEQ ID NO: 960 - protein, 5 aa, Artificial Sequence
  Description of Artificial Sequence: Synthetic peptide
KYAMN

SEQ ID NO: 961 - protein, 5 aa, Artificial Sequence
  Description of Artificial Sequence: Synthetic peptide
KYAMN

SEQ ID NO: 962 - protein, 5 aa, Artificial Sequence
  Description of Artificial Sequence: Synthetic peptide
KYAMN

SEQ ID NO: 963 - protein, 5 aa, Artificial Sequence
  Description of Artificial Sequence: Synthetic peptide
KYAMN

SEQ ID NO: 964 - protein, 5 aa, Artificial Sequence
  Description of Artificial Sequence: Synthetic peptide
KYAMN

SEQ ID NO: 965 - protein, 5 aa, Artificial Sequence
  Description of Artificial Sequence: Synthetic peptide
KYAMN

SEQ ID NO: 966 - protein, 5 aa, Artificial Sequence
  Description of Artificial Sequence: Synthetic peptide
KYAMN

SEQ ID NO: 967 - protein, 5 aa, Artificial Sequence
  Description of Artificial Sequence: Synthetic peptide
KYAMN

SEQ ID NO: 968 - protein, 5 aa, Artificial Sequence
  Description of Artificial Sequence: Synthetic peptide
KYAMN

SEQ ID NO: 969 - protein, 5 aa, Artificial Sequence
  Description of Artificial Sequence: Synthetic peptide
KYAMN

SEQ ID NO: 970 - protein, 5 aa, Artificial Sequence
  Description of Artificial Sequence: Synthetic peptide
KYAMN

SEQ ID NO: 971 - protein, 5 aa, Artificial Sequence
  Description of Artificial Sequence: Synthetic peptide
KYAMN

SEQ ID NO: 972 - protein, 5 aa, Artificial Sequence
  Description of Artificial Sequence: Synthetic peptide
KYAMN

SEQ ID NO: 973 - protein, 5 aa, Artificial Sequence
  Description of Artificial Sequence: Synthetic peptide
KYAMN

SEQ ID NO: 974 - protein, 5 aa, Artificial Sequence
  Description of Artificial Sequence: Synthetic peptide
KYAMN

SEQ ID NO: 975 - protein, 5 aa, Artificial Sequence
  Description of Artificial Sequence: Synthetic peptide
KYAMN

SEQ ID NO: 976 - protein, 5 aa, Artificial Sequence
  Description of Artificial Sequence: Synthetic peptide
KYAMN

SEQ ID NO: 977 - protein, 5 aa, Artificial Sequence
  Description of Artificial Sequence: Synthetic peptide
KYAMN

SEQ ID NO: 978 - protein, 5 aa, Artificial Sequence
  Description of Artificial Sequence: Synthetic peptide
KYAMN

SEQ ID NO: 979 - protein, 5 aa, Artificial Sequence
  Description of Artificial Sequence: Synthetic peptide
KYAMN

SEQ ID NO: 980 - protein, 5 aa, Artificial Sequence
  Description of Artificial Sequence: Synthetic peptide
KYAMN

SEQ ID NO: 981 - protein, 5 aa, Artificial Sequence
  Description of Artificial Sequence: Synthetic peptide
KYAMN

SEQ ID NO: 982 - protein, 5 aa, Artificial Sequence
  Description of Artificial Sequence: Synthetic peptide
KYAMN

SEQ ID NO: 983 - protein, 5 aa, Artificial Sequence
  Description of Artificial Sequence: Synthetic peptide
KYAMN

SEQ ID NO: 984 - protein, 5 aa, Artificial Sequence
  Description of Artificial Sequence: Synthetic peptide
KYAMN

SEQ ID NO: 985 - protein, 5 aa, Artificial Sequence
  Description of Artificial Sequence: Synthetic peptide
KYAMN

SEQ ID NO: 986 - protein, 5 aa, Artificial Sequence
  Description of Artificial Sequence: Synthetic peptide
KYAMN

SEQ ID NO: 987 - protein, 5 aa, Artificial Sequence
  Description of Artificial Sequence: Synthetic peptide
KYAMN

SEQ ID NO: 988 - protein, 5 aa, Artificial Sequence
  Description of Artificial Sequence: Synthetic peptide
KYAMN

SEQ ID NO: 989 - protein, 5 aa, Artificial Sequence
  Description of Artificial Sequence: Synthetic peptide
KYAMN

SEQ ID NO: 990 - protein, 5 aa, Artificial Sequence
  Description of Artificial Sequence: Synthetic peptide
KYAMN

SEQ ID NO: 991 - protein, 5 aa, Artificial Sequence
  Description of Artificial Sequence: Synthetic peptide
KYAMN

SEQ ID NO: 992 - protein, 7 aa, Artificial Sequence
  Description of Artificial Sequence: Synthetic peptide
TSGMRVS

SEQ ID NO: 993 - protein, 7 aa, Artificial Sequence
  Description of Artificial Sequence: Synthetic peptide
THKMGVD

SEQ ID NO: 994 - protein, 5 aa, Artificial Sequence
  Description of Artificial Sequence: Synthetic peptide
NAWMS

SEQ ID NO: 995 - protein, 5 aa, Artificial Sequence
  Description of Artificial Sequence: Synthetic peptide
NAWMS

SEQ ID NO: 996 - protein, 5 aa, Artificial Sequence
  Description of Artificial Sequence: Synthetic peptide
NAWMS

SEQ ID NO: 997 - protein, 5 aa, Artificial Sequence
  Description of Artificial Sequence: Synthetic peptide
NAWMS

SEQ ID NO: 998 - protein, 5 aa, Artificial Sequence
  Description of Artificial Sequence: Synthetic peptide
NAWMS

SEQ ID NO: 999 - protein, 5 aa, Artificial Sequence
  Description of Artificial Sequence: Synthetic peptide
NAWMS

SEQ ID NO: 1000 - protein, 5 aa, Artificial Sequence
  Description of Artificial Sequence: Synthetic peptide
NAWMS

SEQ ID NO: 1001 - protein, 5 aa, Artificial Sequence
  Description of Artificial Sequence: Synthetic peptide
NAWMS

SEQ ID NO: 1002 - protein, 5 aa, Artificial Sequence
  Description of Artificial Sequence: Synthetic peptide
NAWMS

SEQ ID NO: 1003 - protein, 5 aa, Artificial Sequence
  Description of Artificial Sequence: Synthetic peptide
NAWMS

SEQ ID NO: 1004 - protein, 7 aa, Artificial Sequence
  Description of Artificial Sequence: Synthetic peptide
TSGVGVG

SEQ ID NO: 1005 - protein, 7 aa, Artificial Sequence
  Description of Artificial Sequence: Synthetic peptide
THKMGVD

SEQ ID NO: 1006 - protein, 7 aa, Artificial Sequence
  Description of Artificial Sequence: Synthetic peptide
THKMGVD

SEQ ID NO: 1007 - protein, 7 aa, Artificial Sequence
  Description of Artificial Sequence: Synthetic peptide
THKMGVD

SEQ ID NO: 1008 - protein, 7 aa, Artificial Sequence
  Description of Artificial Sequence: Synthetic peptide
THKMGVD

SEQ ID NO: 1009 - protein, 7 aa, Artificial Sequence
  Description of Artificial Sequence: Synthetic peptide
THKMGVD

SEQ ID NO: 1010 - protein, 7 aa, Artificial Sequence
  Description of Artificial Sequence: Synthetic peptide
THKMGVD

SEQ ID NO: 1011 - protein, 7 aa, Artificial Sequence
  Description of Artificial Sequence: Synthetic peptide
THKMGVD

SEQ ID NO: 1012 - protein, 7 aa, Artificial Sequence
  Description of Artificial Sequence: Synthetic peptide
THKMGVD

SEQ ID NO: 1013 - protein, 5 aa, Artificial Sequence
  Description of Artificial Sequence: Synthetic peptide
SYYWS

SEQ ID NO: 1014 - protein, 7 aa, Artificial Sequence
  Description of Artificial Sequence: Synthetic peptide
SSRYYWG

SEQ ID NO: 1015 - protein, 5 aa, Artificial Sequence
  Description of Artificial Sequence: Synthetic peptide
SYAMH

SEQ ID NO: 1016 - protein, 5 aa, Artificial Sequence
  Description of Artificial Sequence: Synthetic peptide
TYGMH

SEQ ID NO: 1017 - protein, 5 aa, Artificial Sequence
  Description of Artificial Sequence: Synthetic peptide
TYGMH

SEQ ID NO: 1018 - protein, 5 aa, Artificial Sequence
  Description of Artificial Sequence: Synthetic peptide
DYYMS

SEQ ID NO: 1019 - protein, 5 aa, Artificial Sequence
  Description of Artificial Sequence: Synthetic peptide
DYYMS

SEQ ID NO: 1020 - protein, 7 aa, Artificial Sequence
  Description of Artificial Sequence: Synthetic peptide
SGGYYWS

SEQ ID NO: 1021 - protein, 7 aa, Artificial Sequence
  Description of Artificial Sequence: Synthetic peptide
SNPYYWS

SEQ ID NO: 1022 - protein, 15 aa, Artificial Sequence
  Description of Artificial Sequence: Synthetic peptide
WYQQKPGKAPKLLIY

SEQ ID NO: 1023 - protein, 15 aa, Artificial Sequence
  Description of Artificial Sequence: Synthetic peptide
WYQQKPGKAPKLLIY

SEQ ID NO: 1024 - protein, 15 aa, Artificial Sequence
  Description of Artificial Sequence: Synthetic peptide
WYQQKPGRAPKLLIF

SEQ ID NO: 1025 - protein, 15 aa, Artificial Sequence
  Description of Artificial Sequence: Synthetic peptide
WYQQKPGKAPKLLIY

SEQ ID NO: 1026 - protein, 15 aa, Artificial Sequence
  Description of Artificial Sequence: Synthetic peptide
WYQQKPGKAPKLLIY

SEQ ID NO: 1027 - protein, 15 aa, Artificial Sequence
  Description of Artificial Sequence: Synthetic peptide
WYQQKPGKAPKLLIY

SEQ ID NO: 1028 - protein, 15 aa, Artificial Sequence
  Description of Artificial Sequence: Synthetic peptide
WYQQKPGKAPKLLIY

SEQ ID NO: 1029 - protein, 15 aa, Artificial Sequence
  Description of Artificial Sequence: Synthetic peptide
WYQQKPGKAPKLLIY

SEQ ID NO: 1030 - protein, 15 aa, Artificial Sequence
  Description of Artificial Sequence: Synthetic peptide
WYQQKPGKAPKLLIY

SEQ ID NO: 1031 - protein, 15 aa, Artificial Sequence
  Description of Artificial Sequence: Synthetic peptide
WYQQKPGKAPKLLIY

SEQ ID NO: 1032 - protein, 15 aa, Artificial Sequence
  Description of Artificial Sequence: Synthetic peptide
WYQQKPGKAPKLLIY

SEQ ID NO: 1033 - protein, 15 aa, Artificial Sequence
  Description of Artificial Sequence: Synthetic peptide
WYQQKPGRAPKLLIF

SEQ ID NO: 1034 - protein, 15 aa, Artificial Sequence
  Description of Artificial Sequence: Synthetic peptide
WYQQKPGKAPKLLIY

SEQ ID NO: 1035 - protein, 15 aa, Artificial Sequence
  Description of Artificial Sequence: Synthetic peptide
WYQQKPGRAPKLLIF

SEQ ID NO: 1036 - protein, 15 aa, Artificial Sequence
  Description of Artificial Sequence: Synthetic peptide
WYQQKPGRAPKLLIF

SEQ ID NO: 1037 - protein, 15 aa, Artificial Sequence
  Description of Artificial Sequence: Synthetic peptide
WYQQKPGKAPKLLIY

SEQ ID NO: 1038 - protein, 15 aa, Artificial Sequence
  Description of Artificial Sequence: Synthetic peptide
WYQQKPGRAPKLLIF

SEQ ID NO: 1039 - protein, 15 aa, Artificial Sequence
  Description of Artificial Sequence: Synthetic peptide
WYQQKPGRAPKLLIF

SEQ ID NO: 1040 - protein, 15 aa, Artificial Sequence
  Description of Artificial Sequence: Synthetic peptide
WFQQKPGKAPKLLIF

SEQ ID NO: 1041 - protein, 15 aa, Artificial Sequence
  Description of Artificial Sequence: Synthetic peptide
WYQQKPGRAPKLLIF

SEQ ID NO: 1042 - protein, 15 aa, Artificial Sequence
  Description of Artificial Sequence: Synthetic peptide
WYQQKPGRAPKLLIF

SEQ ID NO: 1043 - protein, 15 aa, Artificial Sequence
  Description of Artificial Sequence: Synthetic peptide
WYQQKPGQPPKLLIY

SEQ ID NO: 1044 - protein, 15 aa, Artificial Sequence
  Description of Artificial Sequence: Synthetic peptide
WYQQKPGQPPKLLIY

SEQ ID NO: 1045 - protein, 15 aa, Artificial Sequence
  Description of Artificial Sequence: Synthetic peptide
WYQQKPGKVPKLLIY

SEQ ID NO: 1046 - protein, 15 aa, Artificial Sequence
  Description of Artificial Sequence: Synthetic peptide
WYQQKPGKVPKLLIY

SEQ ID NO: 1047 - protein, 15 aa, Artificial Sequence
  Description of Artificial Sequence: Synthetic peptide
WYQQKPGKVPKLLIY

SEQ ID NO: 1048 - protein, 15 aa, Artificial Sequence
  Description of Artificial Sequence: Synthetic peptide
WYLQKPGQSPQLLIY

SEQ ID NO: 1049 - protein, 15 aa, Artificial Sequence
  Description of Artificial Sequence: Synthetic peptide
WYLQKPGQSPQLLIY

SEQ ID NO: 1050 - protein, 15 aa, Artificial Sequence
  Description of Artificial Sequence: Synthetic peptide
WYQQKPGQAPVLVIY

SEQ ID NO: 1051 - protein, 15 aa, Artificial Sequence
  Description of Artificial Sequence: Synthetic peptide
WYQQKPGQAPVMVVY

SEQ ID NO: 1052 - protein, 15 aa, Artificial Sequence
  Description of Artificial Sequence: Synthetic peptide
WYQQKPGQAPVMVVY

SEQ ID NO: 1053 - protein, 15 aa, Artificial Sequence
  Description of Artificial Sequence: Synthetic peptide
WYQQKPGQAPVMVVY

SEQ ID NO: 1054 - protein, 15 aa, Artificial Sequence
  Description of Artificial Sequence: Synthetic peptide
WYQQKPGQAPVMVVY

SEQ ID NO: 1055 - protein, 15 aa, Artificial Sequence
  Description of Artificial Sequence: Synthetic peptide
WYQQKPGQAPVLVVY

SEQ ID NO: 1056 - protein, 15 aa, Artificial Sequence
  Description of Artificial Sequence: Synthetic peptide
WYQQKPGQAPVMVVY

SEQ ID NO: 1057 - protein, 15 aa, Artificial Sequence
  Description of Artificial Sequence: Synthetic peptide
WYQQKPGQAPVMVVY

SEQ ID NO: 1058 - protein, 15 aa, Artificial Sequence
  Description of Artificial Sequence: Synthetic peptide
WYQQKPGQAPVLVVY

SEQ ID NO: 1059 - protein, 15 aa, Artificial Sequence
  Description of Artificial Sequence: Synthetic peptide
WYQQKPGQAPVMVVY

SEQ ID NO: 1060 - protein, 15 aa, Artificial Sequence
  Description of Artificial Sequence: Synthetic peptide
WYQQKPGQAPVMVVY

SEQ ID NO: 1061 - protein, 15 aa, Artificial Sequence
  Description of Artificial Sequence: Synthetic peptide
WFQQKPGQAPRALIY

SEQ ID NO: 1062 - protein, 15 aa, Artificial Sequence
  Description of Artificial Sequence: Synthetic peptide
WVQQKPGQAPRGLIG

SEQ ID NO: 1063 - protein, 15 aa, Artificial Sequence
  Description of Artificial Sequence: Synthetic peptide
WVQQKPGQAPRGLIG

SEQ ID NO: 1064 - protein, 15 aa, Artificial Sequence
  Description of Artificial Sequence: Synthetic peptide
WVQQKPGQAPRGLIG

SEQ ID NO: 1065 - protein, 15 aa, Artificial Sequence
  Description of Artificial Sequence: Synthetic peptide
WVQQKPGQAPRGLIG

SEQ ID NO: 1066 - protein, 15 aa, Artificial Sequence
  Description of Artificial Sequence: Synthetic peptide
WVQQKPGQAPRGLIG

SEQ ID NO: 1067 - protein, 15 aa, Artificial Sequence
  Description of Artificial Sequence: Synthetic peptide
WVQQKPGQAPRGLIG

SEQ ID NO: 1068 - protein, 15 aa, Artificial Sequence
  Description of Artificial Sequence: Synthetic peptide
WVQQKPGQAPRGLIG

SEQ ID NO: 1069 - protein, 15 aa, Artificial Sequence
  Description of Artificial Sequence: Synthetic peptide
WVQQKPGQAPRGLIG

SEQ ID NO: 1070 - protein, 15 aa, Artificial Sequence
  Description of Artificial Sequence: Synthetic peptide
WVQQKPGQAPRGLIG

SEQ ID NO: 1071 - protein, 15 aa, Artificial Sequence
  Description of Artificial Sequence: Synthetic peptide
WVQQKPGQAPRGLIG

SEQ ID NO: 1072 - protein, 15 aa, Artificial Sequence
  Description of Artificial Sequence: Synthetic peptide
WVQQKPGQAPRGLIG

SEQ ID NO: 1073 - protein, 15 aa, Artificial Sequence
  Description of Artificial Sequence: Synthetic peptide
WVQQKPGQAPRGLIG

SEQ ID NO: 1074 - protein, 15 aa, Artificial Sequence
  Description of Artificial Sequence: Synthetic peptide
WVQQKPGQAPRGLIG

SEQ ID NO: 1075 - protein, 15 aa, Artificial Sequence
  Description of Artificial Sequence: Synthetic peptide
WVQQKPGQAPRGLIG

SEQ ID NO: 1076 - protein, 15 aa, Artificial Sequence
  Description of Artificial Sequence: Synthetic peptide
WVQQKPGQAPRGLIG

SEQ ID NO: 1077 - protein, 15 aa, Artificial Sequence
  Description of Artificial Sequence: Synthetic peptide
WVQQKPGQAPRGLIG

SEQ ID NO: 1078 - protein, 15 aa, Artificial Sequence
  Description of Artificial Sequence: Synthetic peptide
WVQQKPGQAPRGLIG

SEQ ID NO: 1079 - protein, 15 aa, Artificial Sequence
  Description of Artificial Sequence: Synthetic peptide
WVQQKPGQAPRGLIG

SEQ ID NO: 1080 - protein, 15 aa, Artificial Sequence
  Description of Artificial Sequence: Synthetic peptide
WVQQKPGQAPRGLIG

SEQ ID NO: 1081 - protein, 15 aa, Artificial Sequence
  Description of Artificial Sequence: Synthetic peptide
WVQQKPGQAPRGLIG

SEQ ID NO: 1082 - protein, 15 aa, Artificial Sequence
  Description of Artificial Sequence: Synthetic peptide
WVQQKPGQAPRGLIG

SEQ ID NO: 1083 - protein, 15 aa, Artificial Sequence
  Description of Artificial Sequence: Synthetic peptide
WVQQKPGQAPRGLIG

SEQ ID NO: 1084 - protein, 15 aa, Artificial Sequence
  Description of Artificial Sequence: Synthetic peptide
WVQQKPGQAPRGLIG

SEQ ID NO: 1085 - protein, 15 aa, Artificial Sequence
  Description of Artificial Sequence: Synthetic peptide
WVQQKPGQAPRGLIG

SEQ ID NO: 1086 - protein, 15 aa, Artificial Sequence
  Description of Artificial Sequence: Synthetic peptide
WVQQKPGQAPRGLIG

SEQ ID NO: 1087 - protein, 15 aa, Artificial Sequence
  Description of Artificial Sequence: Synthetic peptide
WVQQKPGQAPRGLIG

SEQ ID NO: 1088 - protein, 15 aa, Artificial Sequence
  Description of Artificial Sequence: Synthetic peptide
WVQQKPGQAPRGLIG

SEQ ID NO: 1089 - protein, 15 aa, Artificial Sequence
  Description of Artificial Sequence: Synthetic peptide
WVQQKPGQAPRGLIG

SEQ ID NO: 1090 - protein, 15 aa, Artificial Sequence
  Description of Artificial Sequence: Synthetic peptide
WVQQKPGQAPRGLIG

SEQ ID NO: 1091 - protein, 15 aa, Artificial Sequence
  Description of Artificial Sequence: Synthetic peptide
WVQQKPGQAPRGLIG

SEQ ID NO: 1092 - protein, 15 aa, Artificial Sequence
  Description of Artificial Sequence: Synthetic peptide
WVQQKPGQAPRGLIG

SEQ ID NO: 1093 - protein, 15 aa, Artificial Sequence
  Description of Artificial Sequence: Synthetic peptide
WVQQKPGQAPRGLIG

SEQ ID NO: 1094 - protein, 15 aa, Artificial Sequence
  Description of Artificial Sequence: Synthetic peptide
WVQQKPGQAPRGLIG

SEQ ID NO: 1095 - protein, 15 aa, Artificial Sequence
  Description of Artificial Sequence: Synthetic peptide
WVQQKPGQAPRGLIG

SEQ ID NO: 1096 - protein, 15 aa, Artificial Sequence
  Description of Artificial Sequence: Synthetic peptide
WVQQKPGQAPRGLIG

SEQ ID NO: 1097 - protein, 15 aa, Artificial Sequence
  Description of Artificial Sequence: Synthetic peptide
WVQQKPGQAPRGLIG

SEQ ID NO: 1098 - protein, 15 aa, Artificial Sequence
  Description of Artificial Sequence: Synthetic peptide
WYQQKPGQAPVLVIY

SEQ ID NO: 1099 - protein, 15 aa, Artificial Sequence
  Description of Artificial Sequence: Synthetic peptide
WYQQKPGQAPVMVVY

SEQ ID NO: 1100 - protein, 15 aa, Artificial Sequence
  Description of Artificial Sequence: Synthetic peptide
WYQQKPGQAPVMVVY

SEQ ID NO: 1101 - protein, 15 aa, Artificial Sequence
  Description of Artificial Sequence: Synthetic peptide
WYQQKPGQAPVMVVY

SEQ ID NO: 1102 - protein, 15 aa, Artificial Sequence
  Description of Artificial Sequence: Synthetic peptide
WYQQKPGQAPVMVVY

SEQ ID NO: 1103 - protein, 14 aa, Artificial Sequence
  Description of Artificial Sequence: Synthetic peptide
WVRQAPGKGLEWVS

SEQ ID NO: 1104 - protein, 14 aa, Artificial Sequence
  Description of Artificial Sequence: Synthetic peptide
WVRQAPGKCLEWVS

SEQ ID NO: 1105 - protein, 14 aa, Artificial Sequence
  Description of Artificial Sequence: Synthetic peptide
WVRQAPGKCLEWVS

SEQ ID NO: 1106 - protein, 14 aa, Artificial Sequence
  Description of Artificial Sequence: Synthetic peptide
WVRQAPGKCLEWVS

SEQ ID NO: 1107 - protein, 14 aa, Artificial Sequence
  Description of Artificial Sequence: Synthetic peptide
WVRQAPGKCLEWVS

SEQ ID NO: 1108 - protein, 14 aa, Artificial Sequence
  Description of Artificial Sequence: Synthetic peptide
WVRQAPGKCLEWVS

SEQ ID NO: 1109 - protein, 14 aa, Artificial Sequence
  Description of Artificial Sequence: Synthetic peptide
WVRQAPGKCLEWVS

SEQ ID NO: 1110 - protein, 14 aa, Artificial Sequence
  Description of Artificial Sequence: Synthetic peptide
WVRQAPGKCLEWVS

SEQ ID NO: 1111 - protein, 14 aa, Artificial Sequence
  Description of Artificial Sequence: Synthetic peptide
WVRQAPGKCLEWVS

SEQ ID NO: 1112 - protein, 14 aa, Artificial Sequence
  Description of Artificial Sequence: Synthetic peptide
WVRQAPGKCLEWVS

SEQ ID NO: 1113 - protein, 14 aa, Artificial Sequence
  Description of Artificial Sequence: Synthetic peptide
WVRQAPGKCLEWVS

SEQ ID NO: 1114 - protein, 14 aa, Artificial Sequence
  Description of Artificial Sequence: Synthetic peptide
WVRQAPGKCLEWVS

SEQ ID NO: 1115 - protein, 14 aa, Artificial Sequence
  Description of Artificial Sequence: Synthetic peptide
WVRQAPGKCLEWVS

SEQ ID NO: 1116 - protein, 14 aa, Artificial Sequence
  Description of Artificial Sequence: Synthetic peptide
WVRQAPGKCLEWVS

SEQ ID NO: 1117 - protein, 14 aa, Artificial Sequence
  Description of Artificial Sequence: Synthetic peptide
WVRQASGKGLEWVG

SEQ ID NO: 1118 - protein, 14 aa, Artificial Sequence
  Description of Artificial Sequence: Synthetic peptide
WVRQAPGKGLEWVA

SEQ ID NO: 1119 - protein, 14 aa, Artificial Sequence
  Description of Artificial Sequence: Synthetic peptide
WVRQAPGKGLEWVA

SEQ ID NO: 1120 - protein, 14 aa, Artificial Sequence
  Description of Artificial Sequence: Synthetic peptide
WVRQAPGKGLEWVA

SEQ ID NO: 1121 - protein, 14 aa, Artificial Sequence
  Description of Artificial Sequence: Synthetic peptide
WVRQAPGKGLEWVA

SEQ ID NO: 1122 - protein, 14 aa, Artificial Sequence
  Description of Artificial Sequence: Synthetic peptide
WVRQAPGKGLEWVA

SEQ ID NO: 1123 - protein, 14 aa, Artificial Sequence
  Description of Artificial Sequence: Synthetic peptide
WVRQAPGKGLEWVA

SEQ ID NO: 1124 - protein, 14 aa, Artificial Sequence
  Description of Artificial Sequence: Synthetic peptide
WVRQAPGKGLEWVA

SEQ ID NO: 1125 - protein, 14 aa, Artificial Sequence
  Description of Artificial Sequence: Synthetic peptide
WVRQAPGKGLEWVA

SEQ ID NO: 1126 - protein, 14 aa, Artificial Sequence
  Description of Artificial Sequence: Synthetic peptide
WVRQAPGKGLEWVA

SEQ ID NO: 1127 - protein, 14 aa, Artificial Sequence
  Description of Artificial Sequence: Synthetic peptide
WVRQAPGKGLEWVA

SEQ ID NO: 1128 - protein, 14 aa, Artificial Sequence
  Description of Artificial Sequence: Synthetic peptide
WVRQAPGKGLEWVA

SEQ ID NO: 1129 - protein, 14 aa, Artificial Sequence
  Description of Artificial Sequence: Synthetic peptide
WVRQAPGKGLEWVA

SEQ ID NO: 1130 - protein, 14 aa, Artificial Sequence
  Description of Artificial Sequence: Synthetic peptide
WVRQAPGKGLEWVA

SEQ ID NO: 1131 - protein, 14 aa, Artificial Sequence
  Description of Artificial Sequence: Synthetic peptide
WVRQAPGKGLEWVA

SEQ ID NO: 1132 - protein, 14 aa, Artificial Sequence
  Description of Artificial Sequence: Synthetic peptide
WVRQAPGKGLEWVA

SEQ ID NO: 1133 - protein, 14 aa, Artificial Sequence
  Description of Artificial Sequence: Synthetic peptide
WVRQAPGKGLEWVA

SEQ ID NO: 1134 - protein, 14 aa, Artificial Sequence
  Description of Artificial Sequence: Synthetic peptide
WVRQAPGKGLEWVA

SEQ ID NO: 1135 - protein, 14 aa, Artificial Sequence
  Description of Artificial Sequence: Synthetic peptide
WVRQAPGKGLEWVA

SEQ ID NO: 1136 - protein, 14 aa, Artificial Sequence
  Description of Artificial Sequence: Synthetic peptide
WVRQAPGKGLEWVA

SEQ ID NO: 1137 - protein, 14 aa, Artificial Sequence
  Description of Artificial Sequence: Synthetic peptide
WVRQAPGKGLEWVA

SEQ ID NO: 1138 - protein, 14 aa, Artificial Sequence
  Description of Artificial Sequence: Synthetic peptide
WVRQAPGKGLEWVA

SEQ ID NO: 1139 - protein, 14 aa, Artificial Sequence
  Description of Artificial Sequence: Synthetic peptide
WVRQAPGKGLEWVA

SEQ ID NO: 1140 - protein, 14 aa, Artificial Sequence
  Description of Artificial Sequence: Synthetic peptide
WVRQAPGKGLEWVA

SEQ ID NO: 1141 - protein, 14 aa, Artificial Sequence
  Description of Artificial Sequence: Synthetic peptide
WVRQAPGKGLEWVA

SEQ ID NO: 1142 - protein, 14 aa, Artificial Sequence
  Description of Artificial Sequence: Synthetic peptide
WVRQAPGKGLEWVA

SEQ ID NO: 1143 - protein, 14 aa, Artificial Sequence
  Description of Artificial Sequence: Synthetic peptide
WVRQAPGKGLEWVA

SEQ ID NO: 1144 - protein, 14 aa, Artificial Sequence
  Description of Artificial Sequence: Synthetic peptide
WVRQAPGKGLEWVA

SEQ ID NO: 1145 - protein, 14 aa, Artificial Sequence
  Description of Artificial Sequence: Synthetic peptide
WVRQAPGKGLEWVA

SEQ ID NO: 1146 - protein, 14 aa, Artificial Sequence
  Description of Artificial Sequence: Synthetic peptide
WVRQAPGKGLEWVA

SEQ ID NO: 1147 - protein, 14 aa, Artificial Sequence
  Description of Artificial Sequence: Synthetic peptide
WVRQAPGKGLEWVA

SEQ ID NO: 1148 - protein, 14 aa, Artificial Sequence
  Description of Artificial Sequence: Synthetic peptide
WVRQAPGKGLEWVA

SEQ ID NO: 1149 - protein, 14 aa, Artificial Sequence
  Description of Artificial Sequence: Synthetic peptide
WVRQAPGKGLEWVA

SEQ ID NO: 1150 - protein, 14 aa, Artificial Sequence
  Description of Artificial Sequence: Synthetic peptide
WVRQAPGKGLEWVA

SEQ ID NO: 1151 - protein, 14 aa, Artificial Sequence
  Description of Artificial Sequence: Synthetic peptide
WVRQAPGKGLEWVA

SEQ ID NO: 1152 - protein, 14 aa, Artificial Sequence
  Description of Artificial Sequence: Synthetic peptide
WVRQAPGKGLEWVA

SEQ ID NO: 1153 - protein, 14 aa, Artificial Sequence
  Description of Artificial Sequence: Synthetic peptide
WVRQAPGKGLEWVA

SEQ ID NO: 1154 - protein, 14 aa, Artificial Sequence
  Description of Artificial Sequence: Synthetic peptide
WIRQPPGKALEWLA

SEQ ID NO: 1155 - protein, 14 aa, Artificial Sequence
  Description of Artificial Sequence: Synthetic peptide
WIRQPPGKCLEWLA

SEQ ID NO: 1156 - protein, 14 aa, Artificial Sequence
  Description of Artificial Sequence: Synthetic peptide
WVRQAPGKGLEWVG

SEQ ID NO: 1157 - protein, 14 aa, Artificial Sequence
  Description of Artificial Sequence: Synthetic peptide
WVRQAPGKCLEWVG

SEQ ID NO: 1158 - protein, 14 aa, Artificial Sequence
  Description of Artificial Sequence: Synthetic peptide
WVRQAPGKCLEWVG

SEQ ID NO: 1159 - protein, 14 aa, Artificial Sequence
  Description of Artificial Sequence: Synthetic peptide
WVRQAPGKCLEWVG

SEQ ID NO: 1160 - protein, 14 aa, Artificial Sequence
  Description of Artificial Sequence: Synthetic peptide
WVRQAPGKCLEWVG

SEQ ID NO: 1161 - protein, 14 aa, Artificial Sequence
  Description of Artificial Sequence: Synthetic peptide
WVRQAPGKCLEWVG

SEQ ID NO: 1162 - protein, 14 aa, Artificial Sequence
  Description of Artificial Sequence: Synthetic peptide
WVRQAPGKCLEWVG

SEQ ID NO: 1163 - protein, 14 aa, Artificial Sequence
  Description of Artificial Sequence: Synthetic peptide
WVRQAPGKCLEWVG

SEQ ID NO: 1164 - protein, 14 aa, Artificial Sequence
  Description of Artificial Sequence: Synthetic peptide
WVRQAPGKCLEWVG

SEQ ID NO: 1165 - protein, 14 aa, Artificial Sequence
  Description of Artificial Sequence: Synthetic peptide
WVRQAPGKCLEWVG

SEQ ID NO: 1166 - protein, 14 aa, Artificial Sequence
  Description of Artificial Sequence: Synthetic peptide
WIRQPPGKALEWLA

SEQ ID NO: 1167 - protein, 14 aa, Artificial Sequence
  Description of Artificial Sequence: Synthetic peptide
WIRQPPGKCLEWLA

SEQ ID NO: 1168 - protein, 14 aa, Artificial Sequence
  Description of Artificial Sequence: Synthetic peptide
WIRQPPGKCLEWLA

SEQ ID NO: 1169 - protein, 14 aa, Artificial Sequence
  Description of Artificial Sequence: Synthetic peptide
WIRQPPGKCLEWLA

SEQ ID NO: 1170 - protein, 14 aa, Artificial Sequence
  Description of Artificial Sequence: Synthetic peptide
WIRQPPGKCLEWLA

SEQ ID NO: 1171 - protein, 14 aa, Artificial Sequence
  Description of Artificial Sequence: Synthetic peptide
WIRQPPGKCLEWLA

SEQ ID NO: 1172 - protein, 14 aa, Artificial Sequence
  Description of Artificial Sequence: Synthetic peptide
WIRQPPGKCLEWLA

SEQ ID NO: 1173 - protein, 14 aa, Artificial Sequence
  Description of Artificial Sequence: Synthetic peptide
WIRQPPGKCLEWLA

SEQ ID NO: 1174 - protein, 14 aa, Artificial Sequence
  Description of Artificial Sequence: Synthetic peptide
WIRQPPGKCLEWLA

SEQ ID NO: 1175 - protein, 14 aa, Artificial Sequence
  Description of Artificial Sequence: Synthetic peptide
WIRQPPGKGLEWIG

SEQ ID NO: 1176 - protein, 14 aa, Artificial Sequence
  Description of Artificial Sequence: Synthetic peptide
WIRQPPGKCLEWIG

SEQ ID NO: 1177 - protein, 14 aa, Artificial Sequence
  Description of Artificial Sequence: Synthetic peptide
WVRQAPGKGLEWVA

SEQ ID NO: 1178 - protein, 14 aa, Artificial Sequence
  Description of Artificial Sequence: Synthetic peptide
WVRQAPGKCLEWVA

SEQ ID NO: 1179 - protein, 14 aa, Artificial Sequence
  Description of Artificial Sequence: Synthetic peptide
WVRQAPGKCLEWVA

SEQ ID NO: 1180 - protein, 14 aa, Artificial Sequence
  Description of Artificial Sequence: Synthetic peptide
WIRQAPGKGLEWVS

SEQ ID NO: 1181 - protein, 14 aa, Artificial Sequence
  Description of Artificial Sequence: Synthetic peptide
WIRQAPGKCLEWVS

SEQ ID NO: 1182 - protein, 14 aa, Artificial Sequence
  Description of Artificial Sequence: Synthetic peptide
WIRQHPGKGLEWIG

SEQ ID NO: 1183 - protein, 14 aa, Artificial Sequence
  Description of Artificial Sequence: Synthetic peptide
WIRQHPGKCLEWIG

SEQ ID NO: 1184 - protein, 7 aa, Artificial Sequence
  Description of Artificial Sequence: Synthetic peptide
AASSLQS

SEQ ID NO: 1185 - protein, 7 aa, Artificial Sequence
  Description of Artificial Sequence: Synthetic peptide
AASSLQS

SEQ ID NO: 1186 - protein, 7 aa, Artificial Sequence
  Description of Artificial Sequence: Synthetic peptide
AASSLQG

SEQ ID NO: 1187 - protein, 7 aa, Artificial Sequence
  Description of Artificial Sequence: Synthetic peptide
AASSLQS

SEQ ID NO: 1188 - protein, 7 aa, Artificial Sequence
  Description of Artificial Sequence: Synthetic peptide
AASSLQS

SEQ ID NO: 1189 - protein, 7 aa, Artificial Sequence
  Description of Artificial Sequence: Synthetic peptide
AASSLQS

SEQ ID NO: 1190 - protein, 7 aa, Artificial Sequence
  Description of Artificial Sequence: Synthetic peptide
AASSLQS

SEQ ID NO: 1191 - protein, 7 aa, Artificial Sequence
  Description of Artificial Sequence: Synthetic peptide
AASSLQS

SEQ ID NO: 1192 - protein, 7 aa, Artificial Sequence
  Description of Artificial Sequence: Synthetic peptide
AASSLQS

SEQ ID NO: 1193 - protein, 7 aa, Artificial Sequence
  Description of Artificial Sequence: Synthetic peptide
AASSLQS

SEQ ID NO: 1194 - protein, 7 aa, Artificial Sequence
  Description of Artificial Sequence: Synthetic peptide
AASSLQS

SEQ ID NO: 1195 - protein, 7 aa, Artificial Sequence
  Description of Artificial Sequence: Synthetic peptide
AASSLQG

SEQ ID NO: 1196 - protein, 7 aa, Artificial Sequence
  Description of Artificial Sequence: Synthetic peptide
AASSLQS

SEQ ID NO: 1197 - protein, 7 aa, Artificial Sequence
  Description of Artificial Sequence: Synthetic peptide
AASSLQG

SEQ ID NO: 1198 - protein, 7 aa, Artificial Sequence
  Description of Artificial Sequence: Synthetic peptide
AASSLQG

SEQ ID NO: 1199 - protein, 7 aa, Artificial Sequence
  Description of Artificial Sequence: Synthetic peptide
AASSLQS

SEQ ID NO: 1200 - protein, 7 aa, Artificial Sequence
  Description of Artificial Sequence: Synthetic peptide
AASSLQG

SEQ ID NO: 1201 - protein, 7 aa, Artificial Sequence
  Description of Artificial Sequence: Synthetic peptide
AASSLQG

SEQ ID NO: 1202 - protein, 7 aa, Artificial Sequence
  Description of Artificial Sequence: Synthetic peptide
AASSLQS

SEQ ID NO: 1203 - protein, 7 aa, Artificial Sequence
  Description of Artificial Sequence: Synthetic peptide
AASSLQG

SEQ ID NO: 1204 - protein, 7 aa, Artificial Sequence
  Description of Artificial Sequence: Synthetic peptide
AASSLQS

SEQ ID NO: 1205 - protein, 7 aa, Artificial Sequence
  Description of Artificial Sequence: Synthetic peptide
WASTRES

SEQ ID NO: 1206 - protein, 7 aa, Artificial Sequence
  Description of Artificial Sequence: Synthetic peptide
WASTRES

SEQ ID NO: 1207 - protein, 7 aa, Artificial Sequence
  Description of Artificial Sequence: Synthetic peptide
AASTLQS

SEQ ID NO: 1208 - protein, 7 aa, Artificial Sequence
  Description of Artificial Sequence: Synthetic peptide
AASTLQS

SEQ ID NO: 1209 - protein, 7 aa, Artificial Sequence
  Description of Artificial Sequence: Synthetic peptide
AASTLQS

SEQ ID NO: 1210 - protein, 7 aa, Artificial Sequence
  Description of Artificial Sequence: Synthetic peptide
TLSYRAS

SEQ ID NO: 1211 - protein, 7 aa, Artificial Sequence
  Description of Artificial Sequence: Synthetic peptide
LGSNRAS

SEQ ID NO: 1212 - protein, 7 aa, Artificial Sequence
  Description of Artificial Sequence: Synthetic peptide
YDSDRPS

SEQ ID NO: 1213 - protein, 7 aa, Artificial Sequence
  Description of Artificial Sequence: Synthetic peptide
DDNDRPS

SEQ ID NO: 1214 - protein, 7 aa, Artificial Sequence
  Description of Artificial Sequence: Synthetic peptide
DDNDRPS

SEQ ID NO: 1215 - protein, 7 aa, Artificial Sequence
  Description of Artificial Sequence: Synthetic peptide
DDNDRPS

SEQ ID NO: 1216 - protein, 7 aa, Artificial Sequence
  Description of Artificial Sequence: Synthetic peptide
DDNDRPS

SEQ ID NO: 1217 - protein, 7 aa, Artificial Sequence
  Description of Artificial Sequence: Synthetic peptide
DDNDRPS

SEQ ID NO: 1218 - protein, 7 aa, Artificial Sequence
  Description of Artificial Sequence: Synthetic peptide
DDNDRPS

SEQ ID NO: 1219 - protein, 7 aa, Artificial Sequence
  Description of Artificial Sequence: Synthetic peptide
DDNDRPS

SEQ ID NO: 1220 - protein, 7 aa, Artificial Sequence
  Description of Artificial Sequence: Synthetic peptide
DDADRPS

SEQ ID NO: 1221 - protein, 7 aa, Artificial Sequence
  Description of Artificial Sequence: Synthetic peptide
DDNDRPS

SEQ ID NO: 1222 - protein, 7 aa, Artificial Sequence
  Description of Artificial Sequence: Synthetic peptide
DDNDRPS

SEQ ID NO: 1223 - protein, 7 aa, Artificial Sequence
  Description of Artificial Sequence: Synthetic peptide
STSNKHS

SEQ ID NO: 1224 - protein, 7 aa, Artificial Sequence
  Description of Artificial Sequence: Synthetic peptide
GTKFLAP

SEQ ID NO: 1225 - protein, 7 aa, Artificial Sequence
  Description of Artificial Sequence: Synthetic peptide
GTKFLAP

SEQ ID NO: 1226 - protein, 7 aa, Artificial Sequence
  Description of Artificial Sequence: Synthetic peptide
GTKFLAP

SEQ ID NO: 1227 - protein, 7 aa, Artificial Sequence
  Description of Artificial Sequence: Synthetic peptide
GTKFLAP

SEQ ID NO: 1228 - protein, 7 aa, Artificial Sequence
  Description of Artificial Sequence: Synthetic peptide
GTKFLAP

SEQ ID NO: 1229 - protein, 7 aa, Artificial Sequence
  Description of Artificial Sequence: Synthetic peptide
GTKFLAP

SEQ ID NO: 1230 - protein, 7 aa, Artificial Sequence
  Description of Artificial Sequence: Synthetic peptide
GTKFLAP

SEQ ID NO: 1231 - protein, 7 aa, Artificial Sequence
  Description of Artificial Sequence: Synthetic peptide
GTKFLAP

SEQ ID NO: 1232 - protein, 7 aa, Artificial Sequence
  Description of Artificial Sequence: Synthetic peptide
GTKFLAP

SEQ ID NO: 1233 - protein, 7 aa, Artificial Sequence
  Description of Artificial Sequence: Synthetic peptide
GTKFLAP

SEQ ID NO: 1234 - protein, 7 aa, Artificial Sequence
  Description of Artificial Sequence: Synthetic peptide
GTKFLAP

SEQ ID NO: 1235 - protein, 7 aa, Artificial Sequence
  Description of Artificial Sequence: Synthetic peptide
GTKFLAP

SEQ ID NO: 1236 - protein, 7 aa, Artificial Sequence
  Description of Artificial Sequence: Synthetic peptide
GTKFLAP

SEQ ID NO: 1237 - protein, 7 aa, Artificial Sequence
  Description of Artificial Sequence: Synthetic peptide
GTKFLAP

SEQ ID NO: 1238 - protein, 7 aa, Artificial Sequence
  Description of Artificial Sequence: Synthetic peptide
GTKFLAP

SEQ ID NO: 1239 - protein, 7 aa, Artificial Sequence
  Description of Artificial Sequence: Synthetic peptide
GTKFLAP

SEQ ID NO: 1240 - protein, 7 aa, Artificial Sequence
  Description of Artificial Sequence: Synthetic peptide
GTKFLAP

SEQ ID NO: 1241 - protein, 7 aa, Artificial Sequence
  Description of Artificial Sequence: Synthetic peptide
GTKFLAP

SEQ ID NO: 1242 - protein, 7 aa, Artificial Sequence
  Description of Artificial Sequence: Synthetic peptide
GTKFLAP

SEQ ID NO: 1243 - protein, 7 aa, Artificial Sequence
  Description of Artificial Sequence: Synthetic peptide
GTKFLAP

SEQ ID NO: 1244 - protein, 7 aa, Artificial Sequence
  Description of Artificial Sequence: Synthetic peptide
GTKFLAP

SEQ ID NO: 1245 - protein, 7 aa, Artificial Sequence
  Description of Artificial Sequence: Synthetic peptide
GTKFLAP

SEQ ID NO: 1246 - protein, 7 aa, Artificial Sequence
  Description of Artificial Sequence: Synthetic peptide
GTKFLAP

SEQ ID NO: 1247 - protein, 7 aa, Artificial Sequence
  Description of Artificial Sequence: Synthetic peptide
GTKFLAP

SEQ ID NO: 1248 - protein, 7 aa, Artificial Sequence
  Description of Artificial Sequence: Synthetic peptide
GTKFLAP

SEQ ID NO: 1249 - protein, 7 aa, Artificial Sequence
  Description of Artificial Sequence: Synthetic peptide
GTKFLAP

SEQ ID NO: 1250 - protein, 7 aa, Artificial Sequence
  Description of Artificial Sequence: Synthetic peptide
GTKFLAP

SEQ ID NO: 1251 - protein, 7 aa, Artificial Sequence
  Description of Artificial Sequence: Synthetic peptide
GTKFLAP

SEQ ID NO: 1252 - protein, 7 aa, Artificial Sequence
  Description of Artificial Sequence: Synthetic peptide
GTKFLAP

SEQ ID NO: 1253 - protein, 7 aa, Artificial Sequence
  Description of Artificial Sequence: Synthetic peptide
GTKFLAP

SEQ ID NO: 1254 - protein, 7 aa, Artificial Sequence
  Description of Artificial Sequence: Synthetic peptide
GTKFLAP

SEQ ID NO: 1255 - protein, 7 aa, Artificial Sequence
  Description of Artificial Sequence: Synthetic peptide
GTKFLAP

SEQ ID NO: 1256 - protein, 7 aa, Artificial Sequence
  Description of Artificial Sequence: Synthetic peptide
GTKFLAP

SEQ ID NO: 1257 - protein, 7 aa, Artificial Sequence
  Description of Artificial Sequence: Synthetic peptide
GTKFLAP

SEQ ID NO: 1258 - protein, 7 aa, Artificial Sequence
  Description of Artificial Sequence: Synthetic peptide
GTKFLAP

SEQ ID NO: 1259 - protein, 7 aa, Artificial Sequence
  Description of Artificial Sequence: Synthetic peptide
GTKFLAP

SEQ ID NO: 1260 - protein, 7 aa, Artificial Sequence
  Description of Artificial Sequence: Synthetic peptide
YDSDRPS

SEQ ID NO: 1261 - protein, 7 aa, Artificial Sequence
  Description of Artificial Sequence: Synthetic peptide
DDNDRPS

SEQ ID NO: 1262 - protein, 7 aa, Artificial Sequence
  Description of Artificial Sequence: Synthetic peptide
DDNDRPS

SEQ ID NO: 1263 - protein, 7 aa, Artificial Sequence
  Description of Artificial Sequence: Synthetic peptide
DDNDRPS

SEQ ID NO: 1264 - protein, 7 aa, Artificial Sequence
  Description of Artificial Sequence: Synthetic peptide
DDNDRPS

SEQ ID NO: 1265 - protein, 17 aa, Artificial Sequence
  Description of Artificial Sequence: Synthetic peptide
AISGSGGSTYYADSVKG

SEQ ID NO: 1266 - protein, 17 aa, Artificial Sequence
  Description of Artificial Sequence: Synthetic peptide
AISGSGGGTYYAASVKG

SEQ ID NO: 1267 - protein, 17 aa, Artificial Sequence
  Description of Artificial Sequence: Synthetic peptide
TISGSGGGTYYAASVKG

SEQ ID NO: 1268 - protein, 17 aa, Artificial Sequence
  Description of Artificial Sequence: Synthetic peptide
TISGSGGGTYYADSVKG

SEQ ID NO: 1269 - protein, 17 aa, Artificial Sequence
  Description of Artificial Sequence: Synthetic peptide
AISGSGGGTYYAASVKA

SEQ ID NO: 1270 - protein, 17 aa, Artificial Sequence
  Description of Artificial Sequence: Synthetic peptide
AISGSGGGTYYAASGKG

SEQ ID NO: 1271 - protein, 17 aa, Artificial Sequence
  Description of Artificial Sequence: Synthetic peptide
AISGSGGGTYNAASVKG

SEQ ID NO: 1272 - protein, 17 aa, Artificial Sequence
  Description of Artificial Sequence: Synthetic peptide
AISGSGGGTYYAASVKG

SEQ ID NO: 1273 - protein, 17 aa, Artificial Sequence
  Description of Artificial Sequence: Synthetic peptide
AISGSGGGTYYAASVKG

SEQ ID NO: 1274 - protein, 17 aa, Artificial Sequence
  Description of Artificial Sequence: Synthetic peptide
AISGSGGGTYNAASVKG

SEQ ID NO: 1275 - protein, 17 aa, Artificial Sequence
  Description of Artificial Sequence: Synthetic peptide
AISGSGGGTYNAASVKG

SEQ ID NO: 1276 - protein, 17 aa, Artificial Sequence
  Description of Artificial Sequence: Synthetic peptide
AISGSGGGTYNADSVKG

SEQ ID NO: 1277 - protein, 17 aa, Artificial Sequence
  Description of Artificial Sequence: Synthetic peptide
SISGSGGGTYYAASVKG

SEQ ID NO: 1278 - protein, 17 aa, Artificial Sequence
  Description of Artificial Sequence: Synthetic peptide
AISGSGGGTYNAASVKG

SEQ ID NO: 1279 - protein, 19 aa, Artificial Sequence
  Description of Artificial Sequence: Synthetic peptide
RIRSKANSYATAYAASVKG

SEQ ID NO: 1280 - protein, 19 aa, Artificial Sequence
  Description of Artificial Sequence: Synthetic peptide
RIRSKYNNYATYYADSVKD

SEQ ID NO: 1281 - protein, 19 aa, Artificial Sequence
  Description of Artificial Sequence: Synthetic peptide
RIRSKYNNYATYYADSVKD

SEQ ID NO: 1282 - protein, 19 aa, Artificial Sequence
  Description of Artificial Sequence: Synthetic peptide
RIRSKYNNYATYYADSVKD

SEQ ID NO: 1283 - protein, 19 aa, Artificial Sequence
  Description of Artificial Sequence: Synthetic peptide
RIRSKYNNYATYYADSVKD

SEQ ID NO: 1284 - protein, 19 aa, Artificial Sequence
  Description of Artificial Sequence: Synthetic peptide
RIRSKYNNYATYYADSVKD

SEQ ID NO: 1285 - protein, 19 aa, Artificial Sequence
  Description of Artificial Sequence: Synthetic peptide
RIRSKYNNYATYYADSVKD

SEQ ID NO: 1286 - protein, 19 aa, Artificial Sequence
  Description of Artificial Sequence: Synthetic peptide
RIRSKYNNYATYYADSVKD

SEQ ID NO: 1287 - protein, 19 aa, Artificial Sequence
  Description of Artificial Sequence: Synthetic peptide
RIRSKYNNYATYYADSVKD

SEQ ID NO: 1288 - protein, 19 aa, Artificial Sequence
  Description of Artificial Sequence: Synthetic peptide
RIRSKYNNYATYYADSVKD

SEQ ID NO: 1289 - protein, 19 aa, Artificial Sequence
  Description of Artificial Sequence: Synthetic peptide
RIRSKYNNYATYYADSVKD

SEQ ID NO: 1290 - protein, 19 aa, Artificial Sequence
  Description of Artificial Sequence: Synthetic peptide
RIRSKYNNYATYYADSVKD

SEQ ID NO: 1291 - protein, 19 aa, Artificial Sequence
  Description of Artificial Sequence: Synthetic peptide
RIRSKYNNYATYYADSVKD

SEQ ID NO: 1292 - protein, 19 aa, Artificial Sequence
  Description of Artificial Sequence: Synthetic peptide
RIRSKYNNYATYYADSVKD

SEQ ID NO: 1293 - protein, 19 aa, Artificial Sequence
  Description of Artificial Sequence: Synthetic peptide
RIRSKYNNYATYYADSVKD

SEQ ID NO: 1294 - protein, 19 aa, Artificial Sequence
  Description of Artificial Sequence: Synthetic peptide
RIRSKYNNYATYYADSVKD

SEQ ID NO: 1295 - protein, 19 aa, Artificial Sequence
  Description of Artificial Sequence: Synthetic peptide
RIRSKYNNYATYYADSVKD

SEQ ID NO: 1296 - protein, 19 aa, Artificial Sequence
  Description of Artificial Sequence: Synthetic peptide
RIRSKYNNYATYYADSVKD

SEQ ID NO: 1297 - protein, 19 aa, Artificial Sequence
  Description of Artificial Sequence: Synthetic peptide
RIRSKYNNYATYYADSVKD

SEQ ID NO: 1298 - protein, 19 aa, Artificial Sequence
  Description of Artificial Sequence: Synthetic peptide
RIRSKYNNYATYYADSVKD

SEQ ID NO: 1299 - protein, 19 aa, Artificial Sequence
  Description of Artificial Sequence: Synthetic peptide
RIRSKYNNYATYYADSVKD

SEQ ID NO: 1300 - protein, 19 aa, Artificial Sequence
  Description of Artificial Sequence: Synthetic peptide
RIRSKYNNYATYYADSVKD

SEQ ID NO: 1301 - protein, 19 aa, Artificial Sequence
  Description of Artificial Sequence: Synthetic peptide
RIRSKYNNYATYYADSVKD

SEQ ID NO: 1302 - protein, 19 aa, Artificial Sequence
  Description of Artificial Sequence: Synthetic peptide
RIRSKYNNYATYYADSVKD

SEQ ID NO: 1303 - protein, 19 aa, Artificial Sequence
  Description of Artificial Sequence: Synthetic peptide
RIRSKYNNYATYYADSVKD

SEQ ID NO: 1304 - protein, 19 aa, Artificial Sequence
  Description of Artificial Sequence: Synthetic peptide
RIRSKYNNYATYYADSVKD

SEQ ID NO: 1305 - protein, 19 aa, Artificial Sequence
  Description of Artificial Sequence: Synthetic peptide
RIRSKYNNYATYYADSVKD

SEQ ID NO: 1306 - protein, 19 aa, Artificial Sequence
  Description of Artificial Sequence: Synthetic peptide
RIRSKYNNYATYYADSVKD

SEQ ID NO: 1307 - protein, 19 aa, Artificial Sequence
  Description of Artificial Sequence: Synthetic peptide
RIRSKYNNYATYYADSVKD

SEQ ID NO: 1308 - protein, 19 aa, Artificial Sequence
  Description of Artificial Sequence: Synthetic peptide
RIRSKYNNYATYYADSVKD

SEQ ID NO: 1309 - protein, 19 aa, Artificial Sequence
  Description of Artificial Sequence: Synthetic peptide
RIRSKYNNYATYYADSVKD

SEQ ID NO: 1310 - protein, 19 aa, Artificial Sequence
  Description of Artificial Sequence: Synthetic peptide
RIRSKYNNYATYYADSVKD

SEQ ID NO: 1311 - protein, 19 aa, Artificial Sequence
  Description of Artificial Sequence: Synthetic peptide
RIRSKYNNYATYYADSVKD

SEQ ID NO: 1312 - protein, 19 aa, Artificial Sequence
  Description of Artificial Sequence: Synthetic peptide
RIRSKYNNYATYYADSVKD

SEQ ID NO: 1313 - protein, 19 aa, Artificial Sequence
  Description of Artificial Sequence: Synthetic peptide
RIRSKYNNYATYYADSVKD

SEQ ID NO: 1314 - protein, 19 aa, Artificial Sequence
  Description of Artificial Sequence: Synthetic peptide
RIRSKYNNYATYYADSVKD

SEQ ID NO: 1315 - protein, 19 aa, Artificial Sequence
  Description of Artificial Sequence: Synthetic peptide
RIRSKYNNYATYYADSVKD

SEQ ID NO: 1316 - protein, 16 aa, Artificial Sequence
  Description of Artificial Sequence: Synthetic peptide
RIDWDDDKFYSTSLKT

SEQ ID NO: 1317 - protein, 16 aa, Artificial Sequence
  Description of Artificial Sequence: Synthetic peptide
EIHSEDDKRYSPSLQS

SEQ ID NO: 1318 - protein, 19 aa, Artificial Sequence
  Description of Artificial Sequence: Synthetic peptide
RIKSKTDGGTTDYAAPVKG

SEQ ID NO: 1319 - protein, 19 aa, Artificial Sequence
  Description of Artificial Sequence: Synthetic peptide
RIKSKTYGGTTDYAAPVKG

SEQ ID NO: 1320 - protein, 19 aa, Artificial Sequence
  Description of Artificial Sequence: Synthetic peptide
RIRSRSYGGTTDYAAPVKG

SEQ ID NO: 1321 - protein, 19 aa, Artificial Sequence
  Description of Artificial Sequence: Synthetic peptide
RIKSKTYGGTTDYAAPVKG

SEQ ID NO: 1322 - protein, 19 aa, Artificial Sequence
  Description of Artificial Sequence: Synthetic peptide
RITSSRYGGTTDYAAPVKG

SEQ ID NO: 1323 - protein, 19 aa, Artificial Sequence
  Description of Artificial Sequence: Synthetic peptide
RILNNAYGGTTDYAAPVKG

SEQ ID NO: 1324 - protein, 19 aa, Artificial Sequence
  Description of Artificial Sequence: Synthetic peptide
RILSMHYGGTTDYAAPVKG

SEQ ID NO: 1325 - protein, 19 aa, Artificial Sequence
  Description of Artificial Sequence: Synthetic peptide
RIVSSTYGGTTDYAAPVKG

SEQ ID NO: 1326 - protein, 19 aa, Artificial Sequence
  Description of Artificial Sequence: Synthetic peptide
RITSGIYGGTTDYAAPVKG

SEQ ID NO: 1327 - protein, 19 aa, Artificial Sequence
  Description of Artificial Sequence: Synthetic peptide
RIRSRPYGGTTDYAAPVKG

SEQ ID NO: 1328 - protein, 16 aa, Artificial Sequence
  Description of Artificial Sequence: Synthetic peptide
LIYWNDDKRYSPSLKS

SEQ ID NO: 1329 - protein, 16 aa, Artificial Sequence
  Description of Artificial Sequence: Synthetic peptide
LIYWNDDKRYSPSLQS

SEQ ID NO: 1330 - protein, 16 aa, Artificial Sequence
  Description of Artificial Sequence: Synthetic peptide
LIYWNDDKRYSPSLQS

SEQ ID NO: 1331 - protein, 16 aa, Artificial Sequence
  Description of Artificial Sequence: Synthetic peptide
LIYWNDDKRYSPSLQS

SEQ ID NO: 1332 - protein, 16 aa, Artificial Sequence
  Description of Artificial Sequence: Synthetic peptide
GIHIYDDKRYSPSLQS

SEQ ID NO: 1333 - protein, 16 aa, Artificial Sequence
  Description of Artificial Sequence: Synthetic peptide
LIYWNDDKRYSPSLQS

SEQ ID NO: 1334 - protein, 16 aa, Artificial Sequence
  Description of Artificial Sequence: Synthetic peptide
LIYWNDDKRYSPSLQS

SEQ ID NO: 1335 - protein, 16 aa, Artificial Sequence
  Description of Artificial Sequence: Synthetic peptide
LIYWNDDKRYSPSLQS

SEQ ID NO: 1336 - protein, 16 aa, Artificial Sequence
  Description of Artificial Sequence: Synthetic peptide
LIYWNDDKRYSPSLQS

SEQ ID NO: 1337 - protein, 16 aa, Artificial Sequence
  Description of Artificial Sequence: Synthetic peptide
YIYYSGSTNYNPSLKS

SEQ ID NO: 1338 - protein, 16 aa, Artificial Sequence
  Description of Artificial Sequence: Synthetic peptide
SIYYSGSTYYNPSLKS

SEQ ID NO: 1339 - protein, 17 aa, Artificial Sequence
  Description of Artificial Sequence: Synthetic peptide
VISYDGSNKYYADSVKG

SEQ ID NO: 1340 - protein, 17 aa, Artificial Sequence
  Description of Artificial Sequence: Synthetic peptide
VISYDASNKYYAESVKG

SEQ ID NO: 1341 - protein, 17 aa, Artificial Sequence
  Description of Artificial Sequence: Synthetic peptide
VISYDAETVKYAESVKG

SEQ ID NO: 1342 - protein, 17 aa, Artificial Sequence
  Description of Artificial Sequence: Synthetic peptide
YISSSGSTIYYADSVKG

SEQ ID NO: 1343 - protein, 17 aa, Artificial Sequence
  Description of Artificial Sequence: Synthetic peptide
YISKSSYTVTYADAVKG

SEQ ID NO: 1344 - protein, 16 aa, Artificial Sequence
  Description of Artificial Sequence: Synthetic peptide
YIYYSGSTYYNPSLKS

SEQ ID NO: 1345 - protein, 16 aa, Artificial Sequence
  Description of Artificial Sequence: Synthetic peptide
YISYSGITNYNPSLKS

SEQ ID NO: 1346 - protein, 32 aa, Artificial Sequence
  Description of Artificial Sequence: Synthetic polypeptide
GVPSRFSGSGSGTDFTLTISSLQPEDFATYYC

SEQ ID NO: 1347 - protein, 32 aa, Artificial Sequence; identical to SEQ ID NO: 1346
  Description of Artificial Sequence: Synthetic polypeptide

SEQ ID NO: 1348 - protein, 32 aa, Artificial Sequence; identical to SEQ ID NO: 1346
  Description of Artificial Sequence: Synthetic polypeptide

SEQ ID NO: 1349 - protein, 32 aa, Artificial Sequence; identical to SEQ ID NO: 1346
  Description of Artificial Sequence: Synthetic polypeptide

SEQ ID NO: 1350 - protein, 32 aa, Artificial Sequence
  Description of Artificial Sequence: Synthetic polypeptide
GVPSRFSGRGSGTDFTLTISSLQPEDFATYYC

SEQ ID NO: 1351 - protein, 32 aa, Artificial Sequence; identical to SEQ ID NO: 1346
  Description of Artificial Sequence: Synthetic polypeptide

SEQ ID NO: 1352 - protein, 32 aa, Artificial Sequence; identical to SEQ ID NO: 1346
  Description of Artificial Sequence: Synthetic polypeptide

SEQ ID NO: 1353 - protein, 32 aa, Artificial Sequence; identical to SEQ ID NO: 1350
  Description of Artificial Sequence: Synthetic polypeptide

SEQ ID NO: 1354 - protein, 32 aa, Artificial Sequence; identical to SEQ ID NO: 1346
  Description of Artificial Sequence: Synthetic polypeptide

SEQ ID NO: 1355 - protein, 32 aa, Artificial Sequence; identical to SEQ ID NO: 1350
  Description of Artificial Sequence: Synthetic polypeptide

SEQ ID NO: 1356 - protein, 32 aa, Artificial Sequence; identical to SEQ ID NO: 1346
  Description of Artificial Sequence: Synthetic polypeptide

SEQ ID NO: 1357 - protein, 32 aa, Artificial Sequence; identical to SEQ ID NO: 1346
  Description of Artificial Sequence: Synthetic polypeptide

SEQ ID NO: 1358 - protein, 32 aa, Artificial Sequence; identical to SEQ ID NO: 1346
  Description of Artificial Sequence: Synthetic polypeptide

SEQ ID NO: 1359 - protein, 32 aa, Artificial Sequence; identical to SEQ ID NO: 1346
  Description of Artificial Sequence: Synthetic polypeptide

SEQ ID NO: 1360 - protein, 32 aa, Artificial Sequence; identical to SEQ ID NO: 1346
  Description of Artificial Sequence: Synthetic polypeptide

SEQ ID NO: 1361 - protein, 32 aa, Artificial Sequence; identical to SEQ ID NO: 1346
  Description of Artificial Sequence: Synthetic polypeptide

SEQ ID NO: 1362 - protein, 32 aa, Artificial Sequence; identical to SEQ ID NO: 1346
  Description of Artificial Sequence: Synthetic polypeptide

SEQ ID NO: 1363 - protein, 32 aa, Artificial Sequence; identical to SEQ ID NO: 1346
  Description of Artificial Sequence: Synthetic polypeptide

SEQ ID NO: 1364 - protein, 32 aa, Artificial Sequence; identical to SEQ ID NO: 1346
  Description of Artificial Sequence: Synthetic polypeptide

SEQ ID NO: 1365 - protein, 32 aa, Artificial Sequence; identical to SEQ ID NO: 1346
  Description of Artificial Sequence: Synthetic polypeptide

SEQ ID NO: 1366 - protein, 32 aa, Artificial Sequence; identical to SEQ ID NO: 1346
  Description of Artificial Sequence: Synthetic polypeptide

SEQ ID NO: 1367 - protein, 32 aa, Artificial Sequence
  Description of Artificial Sequence: Synthetic polypeptide
GVPDRFSGSGSGTDFTLTISSLQAEDVAVYYC

SEQ ID NO: 1368 - protein, 32 aa, Artificial Sequence; identical to SEQ ID NO: 1367
  Description of Artificial Sequence: Synthetic polypeptide

SEQ ID NO: 1369 - protein, 32 aa, Artificial Sequence
  Description of Artificial Sequence: Synthetic polypeptide
GVPSRFSGSGSGTDFTLTISSLQPEDVATYYC

SEQ ID NO: 1370 - protein, 32 aa, Artificial Sequence; identical to SEQ ID NO: 1346
  Description of Artificial Sequence: Synthetic polypeptide

SEQ ID NO: 1371 - protein, 32 aa, Artificial Sequence; identical to SEQ ID NO: 1369
  Description of Artificial Sequence: Synthetic polypeptide

SEQ ID NO: 1372 - protein, 32 aa, Artificial Sequence
  Description of Artificial Sequence: Synthetic polypeptide
GVPDRFSGSGSGTDFTLKISRVEAEDVGVYYC

SEQ ID NO: 1373 - protein, 32 aa, Artificial Sequence
  Description of Artificial Sequence: Synthetic polypeptide
GVPDRFSGSGSGTDFTLKISRVEAGDVGVYYC

SEQ ID NO: 1374 - protein, 32 aa, Artificial Sequence
  Description of Artificial Sequence: Synthetic polypeptide
GIPERFSGSNSGNTATLTISRVEAGDEADYYC

SEQ ID NO: 1375 - protein, 32 aa, Artificial Sequence; identical to SEQ ID NO: 1374
  Description of Artificial Sequence: Synthetic polypeptide

SEQ ID NO: 1376 - protein, 32 aa, Artificial Sequence; identical to SEQ ID NO: 1374
  Description of Artificial Sequence: Synthetic polypeptide

SEQ ID NO: 1377 - protein, 32 aa, Artificial Sequence; identical to SEQ ID NO: 1374
  Description of Artificial Sequence: Synthetic polypeptide

SEQ ID NO: 1378 - protein, 32 aa, Artificial Sequence; identical to SEQ ID NO: 1374
  Description of Artificial Sequence: Synthetic polypeptide

SEQ ID NO: 1379 - protein, 32 aa, Artificial Sequence
  Description of Artificial Sequence: Synthetic polypeptide
GIPERFSGSNFGNTATLIISRVEAGDEADYYC

SEQ ID NO: 1380 - protein, 32 aa, Artificial Sequence; identical to SEQ ID NO: 1374
  Description of Artificial Sequence: Synthetic polypeptide

SEQ ID NO: 1381 - protein, 32 aa, Artificial Sequence; identical to SEQ ID NO: 1374
  Description of Artificial Sequence: Synthetic polypeptide

SEQ ID NO: 1382 - protein, 32 aa, Artificial Sequence; identical to SEQ ID NO: 1374
  Description of Artificial Sequence: Synthetic polypeptide

SEQ ID NO: 1383 - protein, 32 aa, Artificial Sequence; identical to SEQ ID NO: 1374
  Description of Artificial Sequence: Synthetic polypeptide

SEQ ID NO: 1384 - protein, 32 aa, Artificial Sequence; identical to SEQ ID NO: 1379
  Description of Artificial Sequence: Synthetic polypeptide

SEQ ID NO: 1385 - protein, 32 aa, Artificial Sequence
  Description of Artificial Sequence: Synthetic polypeptide
WTPARFSGSLLGGKAALTLSGVQPEDEAEYYC

SEQ ID NO: 1386 - protein, 32 aa, Artificial Sequence
  Description of Artificial Sequence: Synthetic polypeptide
GTPARFSGSLLGGKAALTLSGVQPEDEAEYYC

SEQ ID NO: 1387 - protein, 32 aa, Artificial Sequence; identical to SEQ ID NO: 1386
  Description of Artificial Sequence: Synthetic polypeptide

SEQ ID NO: 1388 - protein, 32 aa, Artificial Sequence; identical to SEQ ID NO: 1386
  Description of Artificial Sequence: Synthetic polypeptide

SEQ ID NO: 1389 - protein, 32 aa, Artificial Sequence; identical to SEQ ID NO: 1386
  Description of Artificial Sequence: Synthetic polypeptide

SEQ ID NO: 1390 - protein, 32 aa, Artificial Sequence; identical to SEQ ID NO: 1386
  Description of Artificial Sequence: Synthetic polypeptide

SEQ ID NO: 1391 - protein, 32 aa, Artificial Sequence; identical to SEQ ID NO: 1386
  Description of Artificial Sequence: Synthetic polypeptide

SEQ ID NO: 1392 - protein, 32 aa, Artificial Sequence; identical to SEQ ID NO: 1386
  Description of Artificial Sequence: Synthetic polypeptide

SEQ ID NO: 1393 - protein, 32 aa, Artificial Sequence; identical to SEQ ID NO: 1386
  Description of Artificial Sequence: Synthetic polypeptide

SEQ ID NO: 1394 - protein, 32 aa, Artificial Sequence; identical to SEQ ID NO: 1386
  Description of Artificial Sequence: Synthetic polypeptide

SEQ ID NO: 1395 - protein, 32 aa, Artificial Sequence; identical to SEQ ID NO: 1386
  Description of Artificial Sequence: Synthetic polypeptide

SEQ ID NO: 1396 - protein, 32 aa, Artificial Sequence; identical to SEQ ID NO: 1386
  Description of Artificial Sequence: Synthetic polypeptide

SEQ ID NO: 1397 - protein, 32 aa, Artificial Sequence; identical to SEQ ID NO: 1386
  Description of Artificial Sequence: Synthetic polypeptide

SEQ ID NO: 1398 - protein, 32 aa, Artificial Sequence; identical to SEQ ID NO: 1386
  Description of Artificial Sequence: Synthetic polypeptide

SEQ ID NO: 1399 - protein, 32 aa, Artificial Sequence; identical to SEQ ID NO: 1386
  Description of Artificial Sequence: Synthetic polypeptide

SEQ ID NO: 1400 - protein, 32 aa, Artificial Sequence; identical to SEQ ID NO: 1386
  Description of Artificial Sequence: Synthetic polypeptide

SEQ ID NO: 1401 - protein, 32 aa, Artificial Sequence; identical to SEQ ID NO: 1386
  Description of Artificial Sequence: Synthetic polypeptide

SEQ ID NO: 1402 - protein, 32 aa, Artificial Sequence; identical to SEQ ID NO: 1386
  Description of Artificial Sequence: Synthetic polypeptide

SEQ ID NO: 1403 - protein, 32 aa, Artificial Sequence; identical to SEQ ID NO: 1386
  Description of Artificial Sequence: Synthetic polypeptide

SEQ ID NO: 1404 - protein, 32 aa, Artificial Sequence; identical to SEQ ID NO: 1386
  Description of Artificial Sequence: Synthetic polypeptide

SEQ ID NO: 1405 - protein, 32 aa, Artificial Sequence; identical to SEQ ID NO: 1386
  Description of Artificial Sequence: Synthetic polypeptide

SEQ ID NO: 1406 - protein, 32 aa, Artificial Sequence; identical to SEQ ID NO: 1386
  Description of Artificial Sequence: Synthetic polypeptide

SEQ ID NO: 1407 - protein, 32 aa, Artificial Sequence; identical to SEQ ID NO: 1386
  Description of Artificial Sequence: Synthetic polypeptide

SEQ ID NO: 1408 - protein, 32 aa, Artificial Sequence; identical to SEQ ID NO: 1386
  Description of Artificial Sequence: Synthetic polypeptide

SEQ ID NO: 1409 - protein, 32 aa, Artificial Sequence; identical to SEQ ID NO: 1386
  Description of Artificial Sequence: Synthetic polypeptide

SEQ ID NO: 1410 - protein, 32 aa, Artificial Sequence; identical to SEQ ID NO: 1386
  Description of Artificial Sequence: Synthetic polypeptide

SEQ ID NO: 1411 - protein, 32 aa, Artificial Sequence; identical to SEQ ID NO: 1386
  Description of Artificial Sequence: Synthetic polypeptide

SEQ ID NO: 1412 - protein, 32 aa, Artificial Sequence; identical to SEQ ID NO: 1386
  Description of Artificial Sequence: Synthetic polypeptide

SEQ ID NO: 1413 - protein, 32 aa, Artificial Sequence; identical to SEQ ID NO: 1386
  Description of Artificial Sequence: Synthetic polypeptide

SEQ ID NO: 1414 - protein, 32 aa, Artificial Sequence; identical to SEQ ID NO: 1386
  Description of Artificial Sequence: Synthetic polypeptide

SEQ ID NO: 1415 - protein, 32 aa, Artificial Sequence; identical to SEQ ID NO: 1386
  Description of Artificial Sequence: Synthetic polypeptide

SEQ ID NO: 1416 - protein, 32 aa, Artificial Sequence; identical to SEQ ID NO: 1386
  Description of Artificial Sequence: Synthetic polypeptide

SEQ ID NO: 1417 - protein, 32 aa, Artificial Sequence; identical to SEQ ID NO: 1386
  Description of Artificial Sequence: Synthetic polypeptide

SEQ ID NO: 1418 - protein, 32 aa, Artificial Sequence; identical to SEQ ID NO: 1386
  Description of Artificial Sequence: Synthetic polypeptide

SEQ ID NO: 1419 - protein, 32 aa, Artificial Sequence; identical to SEQ ID NO: 1386
  Description of Artificial Sequence: Synthetic polypeptide

SEQ ID NO: 1420 - protein, 32 aa, Artificial Sequence; identical to SEQ ID NO: 1386
  Description of Artificial Sequence: Synthetic polypeptide

SEQ ID NO: 1421 - protein, 32 aa, Artificial Sequence; identical to SEQ ID NO: 1386
  Description of Artificial Sequence: Synthetic polypeptide

SEQ ID NO: 1422 - protein, 32 aa, Artificial Sequence; identical to SEQ ID NO: 1374
  Description of Artificial Sequence: Synthetic polypeptide

SEQ ID NO: 1423 - protein, 32 aa, Artificial Sequence; identical to SEQ ID NO: 1379
  Description of Artificial Sequence: Synthetic polypeptide

SEQ ID NO: 1424 - protein, 32 aa, Artificial Sequence; identical to SEQ ID NO: 1379
  Description of Artificial Sequence: Synthetic polypeptide

SEQ ID NO: 1425 - protein, 32 aa, Artificial Sequence; identical to SEQ ID NO: 1374
  Description of Artificial Sequence: Synthetic polypeptide

SEQ ID NO: 1426 - protein, 32 aa, Artificial Sequence
  Description of Artificial Sequence: Synthetic polypeptide
GIPERFSGSNFGNTATLTISRVEAGDEADYYC

SEQ ID NO: 1427 - protein, 32 aa, Artificial Sequence
  Description of Artificial Sequence: Synthetic polypeptide
RFTISRDNSKNTLYLQMNSLRAEDTAVYYCAK

SEQ ID NO: 1428 - protein, 32 aa, Artificial Sequence
  Description of Artificial Sequence: Synthetic polypeptide
RFTISRDNSKNTLYLQMNSLRAEDTAVYYCAT

SEQ ID NO: 1429 - protein, 32 aa, Artificial Sequence; identical to SEQ ID NO: 1428
  Description of Artificial Sequence: Synthetic polypeptide

SEQ ID NO: 1430 - protein, 32 aa, Artificial Sequence; identical to SEQ ID NO: 1428
  Description of Artificial Sequence: Synthetic polypeptide

SEQ ID NO: 1431 - protein, 32 aa, Artificial Sequence; identical to SEQ ID NO: 1428
  Description of Artificial Sequence: Synthetic polypeptide

SEQ ID NO: 1432 - protein, 32 aa, Artificial Sequence
  Description of Artificial Sequence: Synthetic polypeptide
RFTISRDNSKNTLYLQMNSLRAEDTAAYYCVT

SEQ ID NO: 1433 - protein, 32 aa, Artificial Sequence; identical to SEQ ID NO: 1432
  Description of Artificial Sequence: Synthetic polypeptide

SEQ ID NO: 1434 - protein, 32 aa, Artificial Sequence
  Description of Artificial Sequence: Synthetic polypeptide
RFTISRDNSKNTLYLQMSSLRAEDTAVYYCAT

SEQ ID NO: 1435 - protein, 32 aa, Artificial Sequence; identical to SEQ ID NO: 1428
  Description of Artificial Sequence: Synthetic polypeptide

SEQ ID NO: 1436 - protein, 32 aa, Artificial Sequence; identical to SEQ ID NO: 1432
  Description of Artificial Sequence: Synthetic polypeptide

SEQ ID NO: 1437 - protein, 32 aa, Artificial Sequence; identical to SEQ ID NO: 1428
  Description of Artificial Sequence: Synthetic polypeptide

SEQ ID NO: 1438 - protein, 32 aa, Artificial Sequence; identical to SEQ ID NO: 1428
  Description of Artificial Sequence: Synthetic polypeptide

SEQ ID NO: 1439 - protein, 32 aa, Artificial Sequence; identical to SEQ ID NO: 1428
  Description of Artificial Sequence: Synthetic polypeptide

SEQ ID NO: 1440 - protein, 32 aa, Artificial Sequence; identical to SEQ ID NO: 1432
  Description of Artificial Sequence: Synthetic polypeptide

SEQ ID NO: 1441 - protein, 32 aa, Artificial Sequence
  Description of Artificial Sequence: Synthetic polypeptide
RFTISRDDSKNTAYLQMNSLKTEDTAVYYCTR

SEQ ID NO: 1442 - protein, 32 aa, Artificial Sequence
  Description of Artificial Sequence: Synthetic polypeptide
RFTISRDDSKNTAYLQMNNLKTEDTAVYYCVR

SEQ ID NO: 1443 - protein, 32 aa, Artificial Sequence; identical to SEQ ID NO: 1442
  Description of Artificial Sequence: Synthetic polypeptide

SEQ ID NO: 1444 - protein, 32 aa, Artificial Sequence; identical to SEQ ID NO: 1442
  Description of Artificial Sequence: Synthetic polypeptide

SEQ ID NO: 1445 - protein, 32 aa, Artificial Sequence; identical to SEQ ID NO: 1442
  Description of Artificial Sequence: Synthetic polypeptide

SEQ ID NO: 1446 - protein, 32 aa, Artificial Sequence; identical to SEQ ID NO: 1442
  Description of Artificial Sequence: Synthetic polypeptide

SEQ ID NO: 1447 - protein, 32 aa, Artificial Sequence; identical to SEQ ID NO: 1442
  Description of Artificial Sequence: Synthetic polypeptide

SEQ ID NO: 1448 - protein, 32 aa, Artificial Sequence; identical to SEQ ID NO: 1442
  Description of Artificial Sequence: Synthetic polypeptide

SEQ ID NO: 1449 - protein, 32 aa, Artificial Sequence; identical to SEQ ID NO: 1442
  Description of Artificial Sequence: Synthetic polypeptide

SEQ ID NO: 1450 - protein, 32 aa, Artificial Sequence; identical to SEQ ID NO: 1442
  Description of Artificial Sequence: Synthetic polypeptide

SEQ ID NO: 1451 - protein, 32 aa, Artificial Sequence; identical to SEQ ID NO: 1442
  Description of Artificial Sequence: Synthetic polypeptide

SEQ ID NO: 1452 - protein, 32 aa, Artificial Sequence; identical to SEQ ID NO: 1442
  Description of Artificial Sequence: Synthetic polypeptide

SEQ ID NO: 1453 - protein, 32 aa, Artificial Sequence; identical to SEQ ID NO: 1442
  Description of Artificial Sequence: Synthetic polypeptide

SEQ ID NO: 1454 - protein, 32 aa, Artificial Sequence; identical to SEQ ID NO: 1442
  Description of Artificial Sequence: Synthetic polypeptide

SEQ ID NO: 1455 - protein, 32 aa, Artificial Sequence; identical to SEQ ID NO: 1442
  Description of Artificial Sequence: Synthetic polypeptide

SEQ ID NO: 1456 - protein, 32 aa, Artificial Sequence; identical to SEQ ID NO: 1442
  Description of Artificial Sequence: Synthetic polypeptide

SEQ ID NO: 1457 - protein, 32 aa, Artificial Sequence; identical to SEQ ID NO: 1442
  Description of Artificial Sequence: Synthetic polypeptide

SEQ ID NO: 1458 - protein, 32 aa, Artificial Sequence; identical to SEQ ID NO: 1442
  Description of Artificial Sequence: Synthetic polypeptide

SEQ ID NO: 1459 - protein, 32 aa, Artificial Sequence; identical to SEQ ID NO: 1442
  Description of Artificial Sequence: Synthetic polypeptide

SEQ ID NO: 1460 - protein, 32 aa, Artificial Sequence; identical to SEQ ID NO: 1442
  Description of Artificial Sequence: Synthetic polypeptide

SEQ ID NO: 1461 - protein, 32 aa, Artificial Sequence; identical to SEQ ID NO: 1442
  Description of Artificial Sequence: Synthetic polypeptide

SEQ ID NO: 1462 - protein, 32 aa, Artificial Sequence; identical to SEQ ID NO: 1442
  Description of Artificial Sequence: Synthetic polypeptide

SEQ ID NO: 1463 - protein, 32 aa, Artificial Sequence; identical to SEQ ID NO: 1442
  Description of Artificial Sequence: Synthetic polypeptide

SEQ ID NO: 1464 - protein, 32 aa, Artificial Sequence; identical to SEQ ID NO: 1442
  Description of Artificial Sequence: Synthetic polypeptide

SEQ ID NO: 1465 - protein, 32 aa, Artificial Sequence; identical to SEQ ID NO: 1442
  Description of Artificial Sequence: Synthetic polypeptide

SEQ ID NO: 1466 - protein, 32 aa, Artificial Sequence; identical to SEQ ID NO: 1442
  Description of Artificial Sequence: Synthetic polypeptide

SEQ ID NO: 1467 - protein, 32 aa, Artificial Sequence; identical to SEQ ID NO: 1442
  Description of Artificial Sequence: Synthetic polypeptide

SEQ ID NO: 1468 - protein, 32 aa, Artificial Sequence; identical to SEQ ID NO: 1442
  Description of Artificial Sequence: Synthetic polypeptide

SEQ ID NO: 1469 - protein, 32 aa, Artificial Sequence; identical to SEQ ID NO: 1442
  Description of Artificial Sequence: Synthetic polypeptide

SEQ ID NO: 1470 - protein, 32 aa, Artificial Sequence; identical to SEQ ID NO: 1442
  Description of Artificial Sequence: Synthetic polypeptide

SEQ ID NO: 1471 - protein, 32 aa, Artificial Sequence; identical to SEQ ID NO: 1442
  Description of Artificial Sequence: Synthetic polypeptide

SEQ ID NO: 1472 - protein, 32 aa, Artificial Sequence; identical to SEQ ID NO: 1442
  Description of Artificial Sequence: Synthetic polypeptide

SEQ ID NO: 1473 - protein, 32 aa, Artificial Sequence; identical to SEQ ID NO: 1442
  Description of Artificial Sequence: Synthetic polypeptide

SEQ ID NO: 1474 - protein, 32 aa, Artificial Sequence; identical to SEQ ID NO: 1442
  Description of Artificial Sequence: Synthetic polypeptide

SEQ ID NO: 1475 - protein, 32 aa, Artificial Sequence; identical to SEQ ID NO: 1442
  Description of Artificial Sequence: Synthetic polypeptide

SEQ ID NO: 1476 - protein, 32 aa, Artificial Sequence; identical to SEQ ID NO: 1442
  Description of Artificial Sequence: Synthetic polypeptide

SEQ ID NO: 1477 - protein, 32 aa, Artificial Sequence; identical to SEQ ID NO: 1442
  Description of Artificial Sequence: Synthetic polypeptide

SEQ ID NO: 1478 - protein, 32 aa, Artificial Sequence
  Description of Artificial Sequence: Synthetic polypeptide
RLTISKDTSKNQVVLTMTNMDPVDTATYYCAR

SEQ ID NO: 1479 - protein, 32 aa, Artificial Sequence
  Description of Artificial Sequence: Synthetic polypeptide
RLTITKDTSKNQVVLTMTNMDPVDTATYYCAY

SEQ ID NO: 1480 - protein, 32 aa, Artificial Sequence
  Description of Artificial Sequence: Synthetic polypeptide
RFTISRDDSKNTLYLQMNSLKTEDTAVYYCTT

SEQ ID NO: 1481 - protein, 32 aa, Artificial Sequence
  Description of Artificial Sequence: Synthetic polypeptide
RFTISRDDSKNTLFLQMNSLKTEDTAVYYCTT

SEQ ID NO: 1482 - protein, 32 aa, Artificial Sequence; identical to SEQ ID NO: 1481
  Description of Artificial Sequence: Synthetic polypeptide

SEQ ID NO: 1483 - protein, 32 aa, Artificial Sequence; identical to SEQ ID NO: 1480
  Description of Artificial Sequence: Synthetic polypeptide

SEQ ID NO: 1484 - protein, 32 aa, Artificial Sequence; identical to SEQ ID NO: 1481
  Description of Artificial Sequence: Synthetic polypeptide

SEQ ID NO: 1485 - protein, 32 aa, Artificial Sequence; identical to SEQ ID NO: 1480
  Description of Artificial Sequence: Synthetic polypeptide

SEQ ID NO: 1486 - protein, 32 aa, Artificial Sequence; identical to SEQ ID NO: 1480
  Description of Artificial Sequence: Synthetic polypeptide

SEQ ID NO: 1487 - protein, 32 aa, Artificial Sequence; identical to SEQ ID NO: 1480
  Description of Artificial Sequence: Synthetic polypeptide

SEQ ID NO: 1488 - protein, 32 aa, Artificial Sequence; identical to SEQ ID NO: 1480
  Description of Artificial Sequence: Synthetic polypeptide

SEQ ID NO: 1489 - protein, 32 aa, Artificial Sequence; identical to SEQ ID NO: 1480
  Description of Artificial Sequence: Synthetic polypeptide

SEQ ID NO: 1490 - protein, 32 aa, Artificial Sequence
  Description of Artificial Sequence: Synthetic polypeptide
RLTITKDTSKNQVVLTMTNMDPVDTATYYCAH

SEQ ID NO: 1491 - protein, 32 aa, Artificial Sequence; identical to SEQ ID NO: 1479
  Description of Artificial Sequence: Synthetic polypeptide

SEQ ID NO: 1492 - protein, 32 aa, Artificial Sequence; identical to SEQ ID NO: 1479
  Description of Artificial Sequence: Synthetic polypeptide

SEQ ID NO: 1493 - protein, 32 aa, Artificial Sequence; identical to SEQ ID NO: 1479
  Description of Artificial Sequence: Synthetic polypeptide

SEQ ID NO: 1494 - protein, 32 aa, Artificial Sequence; identical to SEQ ID NO: 1479
  Description of Artificial Sequence: Synthetic polypeptide

SEQ ID NO: 1495 - protein, 32 aa, Artificial Sequence; identical to SEQ ID NO: 1479
  Description of Artificial Sequence: Synthetic polypeptide

SEQ ID NO: 1496 - protein, 32 aa, Artificial Sequence; identical to SEQ ID NO: 1479
  Description of Artificial Sequence: Synthetic polypeptide

SEQ ID NO: 1497 - protein, 32 aa, Artificial Sequence; identical to SEQ ID NO: 1479
  Description of Artificial Sequence: Synthetic polypeptide

SEQ ID NO: 1498 - protein, 32 aa, Artificial Sequence; identical to SEQ ID NO: 1479
  Description of Artificial Sequence: Synthetic polypeptide

SEQ ID NO: 1499 - protein, 32 aa, Artificial Sequence
  Description of Artificial Sequence: Synthetic polypeptide
RVTISVDTSKNQFSLKLSSVTAADTAVYYCAR

SEQ ID NO: 1500 - protein, 32 aa, Artificial Sequence; identical to SEQ ID NO: 1499
  Description of Artificial Sequence: Synthetic polypeptide

SEQ ID NO: 1501 - protein, 32 aa, Artificial Sequence
  Description of Artificial Sequence: Synthetic polypeptide
RFTISRDNSKNTLYLQMNSLRAEDTAVYYCAR

SEQ ID NO: 1502 - protein, 32 aa, Artificial Sequence; identical to SEQ ID NO: 1501
  Description of Artificial Sequence: Synthetic polypeptide

SEQ ID NO: 1503 - protein, 32 aa, Artificial Sequence; identical to SEQ ID NO: 1501
  Description of Artificial Sequence: Synthetic polypeptide

SEQ ID NO: 1504 - protein, 32 aa, Artificial Sequence
  Description of Artificial Sequence: Synthetic polypeptide
RFTISRDNAKNSLYLQMNSLRAEDTAVYYCAR

SEQ ID NO: 1505 - protein, 32 aa, Artificial Sequence
  Description of Artificial Sequence: Synthetic polypeptide
RFTISRDNAKNSLYLQMNSLRAEDTAVYYCAT

SEQ ID NO: 1506 - protein, 32 aa, Artificial Sequence; identical to SEQ ID NO: 1499
  Description of Artificial Sequence: Synthetic polypeptide

SEQ ID NO: 1507 - protein, 32 aa, Artificial Sequence
  Description of Artificial Sequence: Synthetic polypeptide
RVTMSVDTSKNQFSLKLTSLTAADTAVYYCAR

SEQ ID NO: 1508 - protein, 9 aa, Artificial Sequence
  Description of Artificial Sequence: Synthetic peptide
QQSYSTPWT

SEQ ID NO: 1509 - protein, 9 aa, Artificial Sequence
  Description of Artificial Sequence: Synthetic peptide
QQSYITPFT

SEQ ID NO: 1510 - protein, 9 aa, Artificial Sequence
  Description of Artificial Sequence: Synthetic peptide
QQSYSSPFT

SEQ ID NO: 1511 - protein, 9 aa, Artificial Sequence
  Description of Artificial Sequence: Synthetic peptide
QQSYMWPTI

SEQ ID NO: 1512 - protein, 9 aa, Artificial Sequence
  Description of Artificial Sequence: Synthetic peptide
QQSYYYPTL

SEQ ID NO: 1513 - protein, 9 aa, Artificial Sequence
  Description of Artificial Sequence: Synthetic peptide
QQSYTLHPL

SEQ ID NO: 1514 - protein, 9 aa, Artificial Sequence
  Description of Artificial Sequence: Synthetic peptide
QQSYITPFT

SEQ ID NO: 1515 - protein, 9 aa, Artificial Sequence
  Description of Artificial Sequence: Synthetic peptide
QQSYQSPTT

SEQ ID NO: 1516 - protein, 9 aa, Artificial Sequence
  Description of Artificial Sequence: Synthetic peptide
QQSYFPVVE

SEQ ID NO: 1517 - protein, 9 aa, Artificial Sequence
  Description of Artificial Sequence: Synthetic peptide
QQSYTPPTT

SEQ ID NO: 1518 - protein, 9 aa, Artificial Sequence
  Description of Artificial Sequence: Synthetic peptide
QQSYSYPNS

SEQ ID NO: 1519 - protein, 9 aa, Artificial Sequence
  Description of Artificial Sequence: Synthetic peptide
QQTYSMPFT

SEQ ID NO: 1520 - protein, 9 aa, Artificial Sequence
  Description of Artificial Sequence: Synthetic peptide
QQSYSTPYT

SEQ ID NO: 1521 - protein, 9 aa, Artificial Sequence
  Description of Artificial Sequence: Synthetic peptide
IQAYTSPFT

SEQ ID NO: 1522 - protein, 9 aa, Artificial Sequence
  Description of Artificial Sequence: Synthetic peptide
QQTYSSPFT

SEQ ID NO: 1523 - protein, 9 aa, Artificial Sequence
  Description of Artificial Sequence: Synthetic peptide
QQSYSTPFT

SEQ ID NO: 1524 - protein, 9 aa, Artificial Sequence
  Description of Artificial Sequence: Synthetic peptide
QQTYSMPFT

SEQ ID NO: 1525 - protein, 9 aa, Artificial Sequence
  Description of Artificial Sequence: Synthetic peptide
QQTYSMPFT

SEQ ID NO: 1526 - protein, 9 aa, Artificial Sequence
  Description of Artificial Sequence: Synthetic peptide
QQTYSMPFT

SEQ ID NO: 1527 - protein, 9 aa, Artificial Sequence
  Description of Artificial Sequence: Synthetic peptide
QQTYSMPFT

SEQ ID NO: 1528 - protein, 9 aa, Artificial Sequence
  Description of Artificial Sequence: Synthetic peptide
QQTYSMPFT

SEQ ID NO: 1529 - protein, 9 aa, Artificial Sequence
  Description of Artificial Sequence: Synthetic peptide
QQYYSTPIT

SEQ ID NO: 1530 - protein, 9 aa, Artificial Sequence
  Description of Artificial Sequence: Synthetic peptide
QQFYSTPIT

SEQ ID NO: 1531 - protein, 9 aa, Artificial Sequence
  Description of Artificial Sequence: Synthetic peptide
QKYNSAPWT

SEQ ID NO: 1532 - protein, 9 aa, Artificial Sequence
  Description of Artificial Sequence: Synthetic peptide
QKYNSAPFT

SEQ ID NO: 1533 - protein, 9 aa, Artificial Sequence
  Description of Artificial Sequence: Synthetic peptide
QKYNSAPFT

SEQ ID NO: 1534 - protein, 9 aa, Artificial Sequence
  Description of Artificial Sequence: Synthetic peptide
MQRIEFPWT

SEQ ID NO: 1535 - protein, 9 aa, Artificial Sequence
  Description of Artificial Sequence: Synthetic peptide
MQALQTPWT

SEQ ID NO: 1536 - protein, 11 aa, Artificial Sequence
  Description of Artificial Sequence: Synthetic peptide
QVWDSSSDHVV

SEQ ID NO: 1537 - protein, 11 aa, Artificial Sequence
  Description of Artificial Sequence: Synthetic peptide
QVWDYERPAMV

SEQ ID NO: 1538 - protein, 11 aa, Artificial Sequence
  Description of Artificial Sequence: Synthetic peptide
QVWDYLRQQQV

SEQ ID NO: 1539 - protein, 11 aa, Artificial Sequence
  Description of Artificial Sequence: Synthetic peptide
QVWDYYSNRAV

SEQ ID NO: 1540 - protein, 11 aa, Artificial Sequence
  Description of Artificial Sequence: Synthetic peptide
QVWDYSGQRQV

SEQ ID NO: 1541 - protein, 11 aa, Artificial Sequence
  Description of Artificial Sequence: Synthetic peptide
QVWDYLLPGQV

SEQ ID NO: 1542 - protein, 11 aa, Artificial Sequence
  Description of Artificial Sequence: Synthetic peptide
QVWDYVAPRHV

SEQ ID NO: 1543 - protein, 11 aa, Artificial Sequence
  Description of Artificial Sequence: Synthetic peptide
QVWDYVAPRHV

SEQ ID NO: 1544 - protein, 12 aa, Artificial Sequence
  Description of Artificial Sequence: Synthetic peptide
QVWDASAGYGVV

SEQ ID NO: 1545 - protein, 11 aa, Artificial Sequence
  Description of Artificial Sequence: Synthetic peptide
QVWDYSPLRHV

SEQ ID NO: 1546 - protein, 11 aa, Artificial Sequence
  Description of Artificial Sequence: Synthetic peptide
QVWDYFSMTHV

SEQ ID NO: 1547 - protein, 10 aa, Artificial Sequence
  Description of Artificial Sequence: Synthetic peptide
LLYYGGAQWV

SEQ ID NO: 1548 - protein, 9 aa, Artificial Sequence
  Description of Artificial Sequence: Synthetic peptide
VLWYSNRWV

SEQ ID NO: 1549 - protein, 9 aa, Artificial Sequence
  Description of Artificial Sequence: Synthetic peptide
VLWYSNRWV

SEQ ID NO: 1550 - protein, 9 aa, Artificial Sequence
  Description of Artificial Sequence: Synthetic peptide
VLWYSNRWV

SEQ ID NO: 1551 - protein, 9 aa, Artificial Sequence
  Description of Artificial Sequence: Synthetic peptide
VLWYSNRWV

SEQ ID NO: 1552 - protein, 9 aa, Artificial Sequence
  Description of Artificial Sequence: Synthetic peptide
VLWYSNRWV

SEQ ID NO: 1553 - protein, 9 aa, Artificial Sequence
  Description of Artificial Sequence: Synthetic peptide
VLWYSNRWV

SEQ ID NO: 1554 - protein, 9 aa, Artificial Sequence
  Description of Artificial Sequence: Synthetic peptide
VLWYSNRWV

SEQ ID NO: 1555 - protein, 9 aa, Artificial Sequence
  Description of Artificial Sequence: Synthetic peptide
VLWYSNRWV

SEQ ID NO: 1556 - protein, 9 aa, Artificial Sequence
  Description of Artificial Sequence: Synthetic peptide
VLWYSNRWV

SEQ ID NO: 1557 - protein, 9 aa, Artificial Sequence
  Description of Artificial Sequence: Synthetic peptide
VLWYSNRWV

SEQ ID NO: 1558 - protein, 9 aa, Artificial Sequence
  Description of Artificial Sequence: Synthetic peptide
VLWYSNRWV

SEQ ID NO: 1559 - protein, 9 aa, Artificial Sequence
  Description of Artificial Sequence: Synthetic peptide
VLWYSNRWV

SEQ ID NO: 1560 - protein, 9 aa, Artificial Sequence
  Description of Artificial Sequence: Synthetic peptide
VLWYSNRWV

SEQ ID NO: 1561 - protein, 9 aa, Artificial Sequence
  Description of Artificial Sequence: Synthetic peptide
VLWYSNRWV

SEQ ID NO: 1562 - protein, 9 aa, Artificial Sequence
  Description of Artificial Sequence: Synthetic peptide
VLWYSNRWV

SEQ ID NO: 1563 - protein, 9 aa, Artificial Sequence
  Description of Artificial Sequence: Synthetic peptide
VLWYSNRWV

SEQ ID NO: 1564 - protein, 9 aa, Artificial Sequence
  Description of Artificial Sequence: Synthetic peptide
VLWYSNRWV

SEQ ID NO: 1565 - protein, 9 aa, Artificial Sequence
  Description of Artificial Sequence: Synthetic peptide
VLWYSNRWV

SEQ ID NO: 1566 - protein, 9 aa, Artificial Sequence
  Description of Artificial Sequence: Synthetic peptide
VLWYSNRWV

SEQ ID NO: 1567 - protein, 9 aa, Artificial Sequence
  Description of Artificial Sequence: Synthetic peptide
VLWYSNRWV

SEQ ID NO: 1568 - protein, 9 aa, Artificial Sequence
  Description of Artificial Sequence: Synthetic peptide
VLWYSNRWV

SEQ ID NO: 1569 - protein, 9 aa, Artificial Sequence
  Description of Artificial Sequence: Synthetic peptide
VLWYSNRWV

SEQ ID NO: 1570 - protein, 9 aa, Artificial Sequence
  Description of Artificial Sequence: Synthetic peptide
VLWYSNRWV

SEQ ID NO: 1571 - protein, 9 aa, Artificial Sequence
  Description of Artificial Sequence: Synthetic peptide
VLWYSNRWV

SEQ ID NO: 1572 - protein, 9 aa, Artificial Sequence
  Description of Artificial Sequence: Synthetic peptide
VLWYSNRWV

SEQ ID NO: 1573 - protein, 9 aa, Artificial Sequence
  Description of Artificial Sequence: Synthetic peptide
VLWYSNRWV

SEQ ID NO: 1574 - protein, 9 aa, Artificial Sequence
  Description of Artificial Sequence: Synthetic peptide
VLWYSNRWV

SEQ ID NO: 1575 - protein, 9 aa, Artificial Sequence
  Description of Artificial Sequence: Synthetic peptide
VLWYSNRWV

SEQ ID NO: 1576 - protein, 9 aa, Artificial Sequence
  Description of Artificial Sequence: Synthetic peptide
VLWYSNRWV

SEQ ID NO: 1577 - protein, 9 aa, Artificial Sequence
  Description of Artificial Sequence: Synthetic peptide
VLWYSNRWV

SEQ ID NO: 1578 - protein, 9 aa, Artificial Sequence
  Description of Artificial Sequence: Synthetic peptide
VLWYSNRWV

SEQ ID NO: 1579 - protein, 9 aa, Artificial Sequence
  Description of Artificial Sequence: Synthetic peptide
VLWYSNRWV

SEQ ID NO: 1580 - protein, 9 aa, Artificial Sequence
  Description of Artificial Sequence: Synthetic peptide
VLWYSNRWV

SEQ ID NO: 1581 - protein, 9 aa, Artificial Sequence
  Description of Artificial Sequence: Synthetic peptide
VLWYSNRWV

SEQ ID NO: 1582 - protein, 9 aa, Artificial Sequence
  Description of Artificial Sequence: Synthetic peptide
VLWYSNRWV

SEQ ID NO: 1583 - protein, 9 aa, Artificial Sequence
  Description of Artificial Sequence: Synthetic peptide
VLWYSNRWV

SEQ ID NO: 1584 - protein, 11 aa, Artificial Sequence
  Description of Artificial Sequence: Synthetic peptide
QVWDSSSDHWV

SEQ ID NO: 1585 - protein, 11 aa, Artificial Sequence
  Description of Artificial Sequence: Synthetic peptide
QVWDYRTLDWV

SEQ ID NO: 1586 - protein, 11 aa, Artificial Sequence
  Description of Artificial Sequence: Synthetic peptide
QVWDYRTLDWV

SEQ ID NO: 1587 - protein, 11 aa, Artificial Sequence
  Description of Artificial Sequence: Synthetic peptide
QVWDYNMNVWV

SEQ ID NO: 1588 - protein, 11 aa, Artificial Sequence
  Description of Artificial Sequence: Synthetic peptide
QVWDYVTPRWV

SEQ ID NO: 1589 - protein, 10 aa, Artificial Sequence
  Description of Artificial Sequence: Synthetic peptide
GIAVAGYFDY

SEQ ID NO: 1590 - protein, 10 aa, Artificial Sequence
  Description of Artificial Sequence: Synthetic peptide
GKGVHLGFDY

SEQ ID NO: 1591 - protein, 10 aa, Artificial Sequence
  Description of Artificial Sequence: Synthetic peptide
GKGVHLGFDY

SEQ ID NO: 1592 - protein, 10 aa, Artificial Sequence
  Description of Artificial Sequence: Synthetic peptide
GKGVHLGFDY

SEQ ID NO: 1593 - protein, 10 aa, Artificial Sequence
  Description of Artificial Sequence: Synthetic peptide
GKGVHLGFDY

SEQ ID NO: 1594 - protein, 10 aa, Artificial Sequence
  Description of Artificial Sequence: Synthetic peptide
GKGVHLGFDY

SEQ ID NO: 1595 - protein, 10 aa, Artificial Sequence
  Description of Artificial Sequence: Synthetic peptide
GKGVHLGFDY

SEQ ID NO: 1596 - protein, 10 aa, Artificial Sequence
  Description of Artificial Sequence: Synthetic peptide
GKGVHLGFDY

SEQ ID NO: 1597 - protein, 10 aa, Artificial Sequence
  Description of Artificial Sequence: Synthetic peptide
GKGVHLNFDY

SEQ ID NO: 1598 - protein, 10 aa, Artificial Sequence
  Description of Artificial Sequence: Synthetic peptide
GKGVHLGFDY

SEQ ID NO: 1599 - protein, 10 aa, Artificial Sequence
  Description of Artificial Sequence: Synthetic peptide
GKGVHLGFDY

SEQ ID NO: 1600 - protein, 10 aa, Artificial Sequence
  Description of Artificial Sequence: Synthetic peptide
GKGVHLGFDY

SEQ ID NO: 1601 - protein, 10 aa, Artificial Sequence
  Description of Artificial Sequence: Synthetic peptide
GKGVHLGFDY

SEQ ID NO: 1602 - protein, 10 aa, Artificial Sequence
  Description of Artificial Sequence: Synthetic peptide
GKGVHLGFDY

SEQ ID NO: 1603 - protein, 13 aa, Artificial Sequence
  Description of Artificial Sequence: Synthetic peptide
ITIFGVVIIYFDY

SEQ ID NO: 1604 - protein, 14 aa, Artificial Sequence
  Description of Artificial Sequence: Synthetic peptide
HGNFGNSYISYWAY

SEQ ID NO: 1605 - protein, 14 aa, Artificial Sequence
  Description of Artificial Sequence: Synthetic peptide
HGNFGNSYISYWAY

SEQ ID NO: 1606 - protein, 14 aa, Artificial Sequence
  Description of Artificial Sequence: Synthetic peptide
HGNFGNSYISYWAY

SEQ ID NO: 1607 - protein, 14 aa, Artificial Sequence
  Description of Artificial Sequence: Synthetic peptide
HGNFGNSYISYWAY

SEQ ID NO: 1608 - protein, 14 aa, Artificial Sequence
  Description of Artificial Sequence: Synthetic peptide
HGNFGNSYISYWAY

SEQ ID NO: 1609 - protein, 14 aa, Artificial Sequence
  Description of Artificial Sequence: Synthetic peptide
HGNFGNSYISYWAY

SEQ ID NO: 1610 - protein, 14 aa, Artificial Sequence
  Description of Artificial Sequence: Synthetic peptide
HGNFGNSYISYWAY

SEQ ID NO: 1611 - protein, 14 aa, Artificial Sequence
  Description of Artificial Sequence: Synthetic peptide
HGNFGNSYISYWAY

SEQ ID NO: 1612 - protein, 14 aa, Artificial Sequence
  Description of Artificial Sequence: Synthetic peptide
HGNFGNSYISYWAY

SEQ ID NO: 1613 - protein, 14 aa, Artificial Sequence
  Description of Artificial Sequence: Synthetic peptide
HGNFGNSYISYWAY

SEQ ID NO: 1614 - protein, 14 aa, Artificial Sequence
  Description of Artificial Sequence: Synthetic peptide
HGNFGNSYISYWAY

SEQ ID NO: 1615 - protein, 14 aa, Artificial Sequence
  Description of Artificial Sequence: Synthetic peptide
HGNFGNSYISYWAY

SEQ ID NO: 1616 - protein, 14 aa, Artificial Sequence
  Description of Artificial Sequence: Synthetic peptide
HGNFGNSYISYWAY

SEQ ID NO: 1617 - protein, 14 aa, Artificial Sequence
  Description of Artificial Sequence: Synthetic peptide
HGNFGNSYISYWAY

SEQ ID NO: 1618 - protein, 14 aa, Artificial Sequence
  Description of Artificial Sequence: Synthetic peptide
HGNFGNSYISYWAY

SEQ ID NO: 1619 - protein, 14 aa, Artificial Sequence
  Description of Artificial Sequence: Synthetic peptide
HGNFGNSYISYWAY

SEQ ID NO: 1620 - protein, 14 aa, Artificial Sequence
  Description of Artificial Sequence: Synthetic peptide
HGNFGNSYISYWAY

SEQ ID NO: 1621 - protein, 14 aa, Artificial Sequence
  Description of Artificial Sequence: Synthetic peptide
HGNFGNSYISYWAY

SEQ ID NO: 1622 - protein, 14 aa, Artificial Sequence
  Description of Artificial Sequence: Synthetic peptide
HGNFGNSYISYWAY

SEQ ID NO: 1623 - protein, 14 aa, Artificial Sequence
  Description of Artificial Sequence: Synthetic peptide
HGNFGNSYISYWAY

SEQ ID NO: 1624 - protein, 14 aa, Artificial Sequence
  Description of Artificial Sequence: Synthetic peptide
HGNFGNSYISYWAY

SEQ ID NO: 1625 - protein, 14 aa, Artificial Sequence
  Description of Artificial Sequence: Synthetic peptide
HGNFGNSYISYWAY

SEQ ID NO: 1626 - protein, 14 aa, Artificial Sequence
  Description of Artificial Sequence: Synthetic peptide
HGNFGNSYISYWAY

SEQ ID NO: 1627 - protein, 14 aa, Artificial Sequence
  Description of Artificial Sequence: Synthetic peptide
HGNFGNSYISYWAY

SEQ ID NO: 1628 - protein, 14 aa, Artificial Sequence
  Description of Artificial Sequence: Synthetic peptide
HGNFGNSYISYWAY

SEQ ID NO: 1629 - protein, 14 aa, Artificial Sequence
  Description of Artificial Sequence: Synthetic peptide
HGNFGNSYISYWAY

SEQ ID NO: 1630 - protein, 14 aa, Artificial Sequence
  Description of Artificial Sequence: Synthetic peptide
HGNFGNSYISYWAY

SEQ ID NO: 1631 - protein, 14 aa, Artificial Sequence
  Description of Artificial Sequence: Synthetic peptide
HGNFGNSYISYWAY

SEQ ID NO: 1632 - protein, 14 aa, Artificial Sequence
  Description of Artificial Sequence: Synthetic peptide
HGNFGNSYISYWAY

SEQ ID NO: 1633 - protein, 14 aa, Artificial Sequence
  Description of Artificial Sequence: Synthetic peptide
HGNFGNSYISYWAY

SEQ ID NO: 1634 - protein, 14 aa, Artificial Sequence
  Description of Artificial Sequence: Synthetic peptide
HGNFGNSYISYWAY

SEQ ID NO: 1635 - protein, 14 aa, Artificial Sequence
  Description of Artificial Sequence: Synthetic peptide
HGNFGNSYISYWAY

SEQ ID NO: 1636 - protein, 14 aa, Artificial Sequence
  Description of Artificial Sequence: Synthetic peptide
HGNFGNSYISYWAY

SEQ ID NO: 1637 - protein, 14 aa, Artificial Sequence
  Description of Artificial Sequence: Synthetic peptide
HGNFGNSYISYWAY

SEQ ID NO: 1638 - protein, 14 aa, Artificial Sequence
  Description of Artificial Sequence: Synthetic peptide
HGNFGNSYISYWAY

SEQ ID NO: 1639 - protein, 14 aa, Artificial Sequence
  Description of Artificial Sequence: Synthetic peptide
HGNFGNSYISYWAY

SEQ ID NO: 1640 - protein, 8 aa, Artificial Sequence
  Description of Artificial Sequence: Synthetic peptide
LLLNWFDP

SEQ ID NO: 1641 - protein, 13 aa, Artificial Sequence
  Description of Artificial Sequence: Synthetic peptide
RRYNWNYENWFDP

SEQ ID NO: 1642 - protein, 19 aa, Artificial Sequence
  Description of Artificial Sequence: Synthetic peptide
YYYGSGSYYNYYYYYGMDV

SEQ ID NO: 1643 - protein, 16 aa, Artificial Sequence
  Description of Artificial Sequence: Synthetic peptide
PSYSGSYYNYFSVMDV

SEQ ID NO: 1644 - protein, 16 aa, Artificial Sequence
  Description of Artificial Sequence: Synthetic peptide
PSYSGSYYNYFSVMDV

SEQ ID NO: 1645 - protein, 16 aa, Artificial Sequence
  Description of Artificial Sequence: Synthetic peptide
PSYSGSYYNYFSVMDV

SEQ ID NO: 1646 - protein, 16 aa, Artificial Sequence
  Description of Artificial Sequence: Synthetic peptide
PSYSGSYYNYFSVMDV

SEQ ID NO: 1647 - protein, 16 aa, Artificial Sequence
  Description of Artificial Sequence: Synthetic peptide
PSYSGSYYNYFSVMDV

SEQ ID NO: 1648 - protein, 16 aa, Artificial Sequence
  Description of Artificial Sequence: Synthetic peptide
PSYSGSYYNYFSVMDV

SEQ ID NO: 1649 - protein, 16 aa, Artificial Sequence
  Description of Artificial Sequence: Synthetic peptide
PSYSGSYYNYFSVMDV

SEQ ID NO: 1650 - protein, 16 aa, Artificial Sequence
  Description of Artificial Sequence: Synthetic peptide
PSYSGSYYNYFSVMDV

SEQ ID NO: 1651 - protein, 16 aa, Artificial Sequence
  Description of Artificial Sequence: Synthetic peptide
PSYSGSYYNYFSVMDV

SEQ ID NO: 1652 - protein, 8 aa, Artificial Sequence
  Description of Artificial Sequence: Synthetic peptide
LLLNWFDP

SEQ ID NO: 1653 - protein, 13 aa, Artificial Sequence
  Description of Artificial Sequence: Synthetic peptide
RRYNWNYENWFDP

SEQ ID NO: 1654 - protein, 13 aa, Artificial Sequence
  Description of Artificial Sequence: Synthetic peptide
RRYNWNYENWFDP

SEQ ID NO: 1655 - protein, 13 aa, Artificial Sequence
  Description of Artificial Sequence: Synthetic peptide
RRYNWNYENWFDP

SEQ ID NO: 1656 - protein, 13 aa, Artificial Sequence
  Description of Artificial Sequence: Synthetic peptide
RRYNWNYENWFDP

SEQ ID NO: 1657 - protein, 13 aa, Artificial Sequence
  Description of Artificial Sequence: Synthetic peptide
RRYNWNYENWFDP

SEQ ID NO: 1658 - protein, 13 aa, Artificial Sequence
  Description of Artificial Sequence: Synthetic peptide
RRYNWNYENWFDP

SEQ ID NO: 1659 - protein, 13 aa, Artificial Sequence
  Description of Artificial Sequence: Synthetic peptide
RRYNWNYENWFDP

SEQ ID NO: 1660 - protein, 13 aa, Artificial Sequence
  Description of Artificial Sequence: Synthetic peptide
RRYNWNYENWFDP

SEQ ID NO: 1661 - protein, 13 aa, Artificial Sequence
  Description of Artificial Sequence: Synthetic peptide
ITIFGVVIIYFDY

SEQ ID NO: 1662 - protein, 11 aa, Artificial Sequence
  Description of Artificial Sequence: Synthetic peptide
GIFGVITYFDY

SEQ ID NO: 1663 - protein, 9 aa, Artificial Sequence
  Description of Artificial Sequence: Synthetic peptide
VQLERYFDY

SEQ ID NO: 1664 - protein, 7 aa, Artificial Sequence
  Description of Artificial Sequence: Synthetic peptide
GQLLTGY

SEQ ID NO: 1665 - protein, 7 aa, Artificial Sequence
  Description of Artificial Sequence: Synthetic peptide
GQLLTGY

SEQ ID NO: 1666 - protein, 9 aa, Artificial Sequence
  Description of Artificial Sequence: Synthetic peptide
YNWNDYFDY

SEQ ID NO: 1667 - protein, 8 aa, Artificial Sequence
  Description of Artificial Sequence: Synthetic peptide
YNYGHFDY

SEQ ID NO: 1668 - protein, 18 aa, Artificial Sequence
  Description of Artificial Sequence: Synthetic peptide
ITMVRGVIIYYYYYGMDV

SEQ ID NO: 1669 - protein, 16 aa, Artificial Sequence
  Description of Artificial Sequence: Synthetic peptide
EKMWFGVLNYYYGMDV

SEQ ID NO: 1670 - protein, 10 aa, Artificial Sequence
  Description of Artificial Sequence: Synthetic peptide
FGQGTKVEIK

SEQ ID NO: 1671 - protein, 10 aa, Artificial Sequence
  Description of Artificial Sequence: Synthetic peptide
FGCGTKVEIK

SEQ ID NO: 1672 - protein, 10 aa, Artificial Sequence
  Description of Artificial Sequence: Synthetic peptide
FGCGTKVEIK

SEQ ID NO: 1673 - protein, 10 aa, Artificial Sequence
  Description of Artificial Sequence: Synthetic peptide
FGCGTKVEIK

SEQ ID NO: 1674 - protein, 10 aa, Artificial Sequence
  Description of Artificial Sequence: Synthetic peptide
FGCGTKVEIK

SEQ ID NO: 1675 - protein, 10 aa, Artificial Sequence
  Description of Artificial Sequence: Synthetic peptide
FGCGTKVEIK

SEQ ID NO: 1676 - protein, 10 aa, Artificial Sequence
  Description of Artificial Sequence: Synthetic peptide
FGCGTKVEIK

SEQ ID NO: 1677 - protein, 10 aa, Artificial Sequence
  Description of Artificial Sequence: Synthetic peptide
FGCGTKVEIK

SEQ ID NO: 1678 - protein, 10 aa, Artificial Sequence
  Description of Artificial Sequence: Synthetic peptide
FGCGTKVEIK

SEQ ID NO: 1679 - protein, 10 aa, Artificial Sequence
  Description of Artificial Sequence: Synthetic peptide
FGCGTKVEIK

SEQ ID NO: 1680 - protein, 10 aa, Artificial Sequence
  Description of Artificial Sequence: Synthetic peptide
FGCGTKVEIK

SEQ ID NO: 1681 - protein, 10 aa, Artificial Sequence
  Description of Artificial Sequence: Synthetic peptide
FGCGTKVEIK

SEQ ID NO: 1682 - protein, 10 aa, Artificial Sequence
  Description of Artificial Sequence: Synthetic peptide
FGQGTKLEIK

SEQ ID NO: 1683 - protein, 10 aa, Artificial Sequence
  Description of Artificial Sequence: Synthetic peptide
FGCGTKLEIK

SEQ ID NO: 1684 - protein, 10 aa, Artificial Sequence
  Description of Artificial Sequence: Synthetic peptide
FGCGTKLEIK

SEQ ID NO: 1685 - protein, 10 aa, Artificial Sequence
  Description of Artificial Sequence: Synthetic peptide
FGPGTKVDIK

SEQ ID NO: 1686 - protein, 10 aa, Artificial Sequence
  Description of Artificial Sequence: Synthetic peptide
FGCGTKVDIK

SEQ ID NO: 1687 - protein, 10 aa, Artificial Sequence
  Description of Artificial Sequence: Synthetic peptide
FGCGTKVDIK

SEQ ID NO: 1688 - protein, 10 aa, Artificial Sequence
  Description of Artificial Sequence: Synthetic peptide
FGCGTKVDIK

SEQ ID NO: 1689 - protein, 10 aa, Artificial Sequence
  Description of Artificial Sequence: Synthetic peptide
FGCGTKVDIK

SEQ ID NO: 1690 - protein, 10 aa, Artificial Sequence
  Description of Artificial Sequence: Synthetic peptide
FGCGTKVDIK

SEQ ID NO: 1691 - protein, 10 aa, Artificial Sequence
  Description of Artificial Sequence: Synthetic peptide
FGQGTRLEIK

SEQ ID NO: 1692 - protein, 10 aa, Artificial Sequence
  Description of Artificial Sequence: Synthetic peptide
FGCGTRLEIK

SEQ ID NO: 1693 - protein, 10 aa, Artificial Sequence
  Description of Artificial Sequence: Synthetic peptide
FGQGTKVEIK

SEQ ID NO: 1694 - protein, 10 aa, Artificial Sequence
  Description of Artificial Sequence: Synthetic peptide
FGCGTKVEIK

SEQ ID NO: 1695 - protein, 10 aa, Artificial Sequence
  Description of Artificial Sequence: Synthetic peptide
FGCGTKVEIK

SEQ ID NO: 1696 - protein, 10 aa, Artificial Sequence
  Description of Artificial Sequence: Synthetic peptide
FGQGTKVEIK

SEQ ID NO: 1697 - protein, 10 aa, Artificial Sequence
  Description of Artificial Sequence: Synthetic peptide
FGCGTKVEIK

SEQ ID NO: 1698 - protein, 10 aa, Artificial Sequence
  Description of Artificial Sequence: Synthetic peptide
FGGGTKLTVL

SEQ ID NO: 1699 - protein, 10 aa, Artificial Sequence
  Description of Artificial Sequence: Synthetic peptide
FGCGTKLTVL

SEQ ID NO: 1700 - protein, 10 aa, Artificial Sequence
  Description of Artificial Sequence: Synthetic peptide
FGCGTKLTVL

SEQ ID NO: 1701 - protein, 10 aa, Artificial Sequence
  Description of Artificial Sequence: Synthetic peptide
FGCGTKLTVL

SEQ ID NO: 1702 - protein, 10 aa, Artificial Sequence
  Description of Artificial Sequence: Synthetic peptide
FGCGTKLTVL

SEQ ID NO: 1703 - protein, 10 aa, Artificial Sequence
  Description of Artificial Sequence: Synthetic peptide
FGCGTKLTVL

SEQ ID NO: 1704 - protein, 10 aa, Artificial Sequence
  Description of Artificial Sequence: Synthetic peptide
FGCGTKLTVL

SEQ ID NO: 1705 - protein, 10 aa, Artificial Sequence
  Description of Artificial Sequence: Synthetic peptide
FGCGTKLTVL

SEQ ID NO: 1706 - protein, 10 aa, Artificial Sequence
  Description of Artificial Sequence: Synthetic peptide
FGCGTKLTVL

SEQ ID NO: 1707 - protein, 10 aa, Artificial Sequence
  Description of Artificial Sequence: Synthetic peptide
FGCGTKLTVL

SEQ ID NO: 1708 - protein, 10 aa, Artificial Sequence
  Description of Artificial Sequence: Synthetic peptide
FGCGTKLTVL

SEQ ID NO: 1709 - protein, 10 aa, Artificial Sequence
  Description of Artificial Sequence: Synthetic peptide
FGGGTKLTVL

SEQ ID NO: 1710 - protein, 10 aa, Artificial Sequence
  Description of Artificial Sequence: Synthetic peptide
FGGGTKLTVL

SEQ ID NO: 1711 - protein, 10 aa, Artificial Sequence
  Description of Artificial Sequence: Synthetic peptide
FGGGTKLTVL

SEQ ID NO: 1712 - protein, 10 aa, Artificial Sequence
  Description of Artificial Sequence: Synthetic peptide
FGGGTKLTVL

SEQ ID NO: 1713 - protein, 10 aa, Artificial Sequence
  Description of Artificial Sequence: Synthetic peptide
FGGGTKLTVL

SEQ ID NO: 1714 - protein, 10 aa, Artificial Sequence
  Description of Artificial Sequence: Synthetic peptide
FGGGTKLTVL

SEQ ID NO: 1715 - protein, 10 aa, Artificial Sequence
  Description of Artificial Sequence: Synthetic peptide
FGGGTKLTVL

SEQ ID NO: 1716 - protein, 10 aa, Artificial Sequence
  Description of Artificial Sequence: Synthetic peptide
FGGGTKLTVL

SEQ ID NO: 1717 - protein, 10 aa, Artificial Sequence
  Description of Artificial Sequence: Synthetic peptide
FGGGTKLTVL

SEQ ID NO: 1718 - protein, 10 aa, Artificial Sequence
  Description of Artificial Sequence: Synthetic peptide
FGGGTKLTVL

SEQ ID NO: 1719 - protein, 10 aa, Artificial Sequence
  Description of Artificial Sequence: Synthetic peptide
FGGGTKLTVL

SEQ ID NO: 1720 - protein, 10 aa, Artificial Sequence
  Description of Artificial Sequence: Synthetic peptide
FGGGTKLTVL

SEQ ID NO: 1721 - protein, 10 aa, Artificial Sequence
  Description of Artificial Sequence: Synthetic peptide
FGGGTKLTVL

SEQ ID NO: 1722 - protein, 10 aa, Artificial Sequence
  Description of Artificial Sequence: Synthetic peptide
FGGGTKLTVL

SEQ ID NO: 1723 - protein, 10 aa, Artificial Sequence
  Description of Artificial Sequence: Synthetic peptide
FGGGTKLTVL

SEQ ID NO: 1724 - protein, 10 aa, Artificial Sequence
  Description of Artificial Sequence: Synthetic peptide
FGGGTKLTVL

SEQ ID NO: 1725 - protein, 10 aa, Artificial Sequence
  Description of Artificial Sequence: Synthetic peptide
FGGGTKLTVL

SEQ ID NO: 1726 - protein, 10 aa, Artificial Sequence
  Description of Artificial Sequence: Synthetic peptide
FGGGTKLTVL

SEQ ID NO: 1727 - protein, 10 aa, Artificial Sequence
  Description of Artificial Sequence: Synthetic peptide
FGGGTKLTVL

SEQ ID NO: 1728 - protein, 10 aa, Artificial Sequence
  Description of Artificial Sequence: Synthetic peptide
FGGGTKLTVL

SEQ ID NO: 1729 - protein, 10 aa, Artificial Sequence
  Description of Artificial Sequence: Synthetic peptide
FGGGTKLTVL

SEQ ID NO: 1730 - protein, 10 aa, Artificial Sequence
  Description of Artificial Sequence: Synthetic peptide
FGGGTKLTVL

SEQ ID NO: 1731 - protein, 10 aa, Artificial Sequence
  Description of Artificial Sequence: Synthetic peptide
FGGGTKLTVL

SEQ ID NO: 1732 - protein, 10 aa, Artificial Sequence
  Description of Artificial Sequence: Synthetic peptide
FGGGTKLTVL

SEQ ID NO: 1733 - protein, 10 aa, Artificial Sequence
  Description of Artificial Sequence: Synthetic peptide
FGGGTKLTVL

SEQ ID NO: 1734 - protein, 10 aa, Artificial Sequence
  Description of Artificial Sequence: Synthetic peptide
FGGGTKLTVL

SEQ ID NO: 1735 - protein, 10 aa, Artificial Sequence
  Description of Artificial Sequence: Synthetic peptide
FGGGTKLTVL

SEQ ID NO: 1736 - protein, 10 aa, Artificial Sequence
  Description of Artificial Sequence: Synthetic peptide
FGGGTKLTVL

SEQ ID NO: 1737 - protein, 10 aa, Artificial Sequence
  Description of Artificial Sequence: Synthetic peptide
FGGGTKLTVL

SEQ ID NO: 1738 - protein, 10 aa, Artificial Sequence
  Description of Artificial Sequence: Synthetic peptide
FGGGTKLTVL

SEQ ID NO: 1739 - protein, 10 aa, Artificial Sequence
  Description of Artificial Sequence: Synthetic peptide
FGGGTKLTVL

SEQ ID NO: 1740 - protein, 10 aa, Artificial Sequence
  Description of Artificial Sequence: Synthetic peptide
FGGGTKLTVL

SEQ ID NO: 1741 - protein, 10 aa, Artificial Sequence
  Description of Artificial Sequence: Synthetic peptide
FGGGTKLTVL

SEQ ID NO: 1742 - protein, 10 aa, Artificial Sequence
  Description of Artificial Sequence: Synthetic peptide
FGGGTKLTVL

SEQ ID NO: 1743 - protein, 10 aa, Artificial Sequence
  Description of Artificial Sequence: Synthetic peptide
FGGGTKLTVL

SEQ ID NO: 1744 - protein, 10 aa, Artificial Sequence
  Description of Artificial Sequence: Synthetic peptide
FGGGTKLTVL

SEQ ID NO: 1745 - protein, 10 aa, Artificial Sequence
  Description of Artificial Sequence: Synthetic peptide
FGGGTKLTVL

SEQ ID NO: 1746 - protein, 10 aa, Artificial Sequence
  Description of Artificial Sequence: Synthetic peptide
FGGGTKLTVL

SEQ ID NO: 1747 - protein, 10 aa, Artificial Sequence
  Description of Artificial Sequence: Synthetic peptide
FGCGTKLTVL

SEQ ID NO: 1748 - protein, 10 aa, Artificial Sequence
  Description of Artificial Sequence: Synthetic peptide
FGCGTKLTVL

SEQ ID NO: 1749 - protein, 10 aa, Artificial Sequence
  Description of Artificial Sequence: Synthetic peptide
FGCGTKLTVL

SEQ ID NO: 1750 - protein, 10 aa, Artificial Sequence
  Description of Artificial Sequence: Synthetic peptide
FGCGTKLTVL

SEQ ID NO: 1751 - protein, 11 aa, Artificial Sequence
  Description of Artificial Sequence: Synthetic peptide
WGQGTLVTVSS

SEQ ID NO: 1752 - protein, 11 aa, Artificial Sequence
  Description of Artificial Sequence: Synthetic peptide
WGQGTLVTVSS

SEQ ID NO: 1753 - protein, 11 aa, Artificial Sequence
  Description of Artificial Sequence: Synthetic peptide
WGQGTLVTVSS

SEQ ID NO: 1754 - protein, 11 aa, Artificial Sequence
  Description of Artificial Sequence: Synthetic peptide
WGQGTLVTVSS

SEQ ID NO: 1755 - protein, 11 aa, Artificial Sequence
  Description of Artificial Sequence: Synthetic peptide
WGQGTLVTVSS

SEQ ID NO: 1756 - protein, 11 aa, Artificial Sequence
  Description of Artificial Sequence: Synthetic peptide
WGQGTLVTVSS

SEQ ID NO: 1757 - protein, 11 aa, Artificial Sequence
  Description of Artificial Sequence: Synthetic peptide
WGQGTLVTVSS

SEQ ID NO: 1758 - protein, 11 aa, Artificial Sequence
  Description of Artificial Sequence: Synthetic peptide
WGQGTLVTVSS

SEQ ID NO: 1759 - protein, 11 aa, Artificial Sequence
  Description of Artificial Sequence: Synthetic peptide
WGQGTLVTVSS

SEQ ID NO: 1760 - protein, 11 aa, Artificial Sequence
  Description of Artificial Sequence: Synthetic peptide
WGQGTLVTVSS

SEQ ID NO: 1761 - protein, 11 aa, Artificial Sequence
  Description of Artificial Sequence: Synthetic peptide
WGQGTLVTVSS

SEQ ID NO: 1762 - protein, 11 aa, Artificial Sequence
  Description of Artificial Sequence: Synthetic peptide
WGQGTLVTVSS

SEQ ID NO: 1763 - protein, 11 aa, Artificial Sequence
  Description of Artificial Sequence: Synthetic peptide
WGQGTLVTVSS

SEQ ID NO: 1764 - protein, 11 aa, Artificial Sequence
  Description of Artificial Sequence: Synthetic peptide
WGQGTLVTVSS

SEQ ID NO: 1765 - protein, 11 aa, Artificial Sequence
  Description of Artificial Sequence: Synthetic peptide
WGQGTLVTVSS

SEQ ID NO: 1766 - protein, 11 aa, Artificial Sequence
  Description of Artificial Sequence: Synthetic peptide
WGQGTLVTVSS

SEQ ID NO: 1767 - protein, 11 aa, Artificial Sequence
  Description of Artificial Sequence: Synthetic peptide
WGQGTLVTVSS

SEQ ID NO: 1768 - protein, 11 aa, Artificial Sequence
  Description of Artificial Sequence: Synthetic peptide
WGQGTLVTVSS

SEQ ID NO: 1769 - protein, 11 aa, Artificial Sequence
  Description of Artificial Sequence: Synthetic peptide
WGQGTLVTVSS

SEQ ID NO: 1770 - protein, 11 aa, Artificial Sequence
  Description of Artificial Sequence: Synthetic peptide
WGQGTLVTVSS

SEQ ID NO: 1771 - protein, 11 aa, Artificial Sequence
  Description of Artificial Sequence: Synthetic peptide
WGQGTLVTVSS

SEQ ID NO: 1772 - protein, 11 aa, Artificial Sequence
  Description of Artificial Sequence: Synthetic peptide
WGQGTLVTVSS

SEQ ID NO: 1773 - protein, 11 aa, Artificial Sequence
  Description of Artificial Sequence: Synthetic peptide
WGQGTLVTVSS

SEQ ID NO: 1774 - protein, 11 aa, Artificial Sequence
  Description of Artificial Sequence: Synthetic peptide
WGQGTLVTVSS

SEQ ID NO: 1775 - protein, 11 aa, Artificial Sequence
  Description of Artificial Sequence: Synthetic peptide
WGQGTLVTVSS

SEQ ID NO: 1776 - protein, 11 aa, Artificial Sequence
  Description of Artificial Sequence: Synthetic peptide
WGQGTLVTVSS

SEQ ID NO: 1777 - protein, 11 aa, Artificial Sequence
  Description of Artificial Sequence: Synthetic peptide
WGQGTLVTVSS

SEQ ID NO: 1778 - protein, 11 aa, Artificial Sequence
  Description of Artificial Sequence: Synthetic peptide
WGQGTLVTVSS

SEQ ID NO: 1779 - protein, 11 aa, Artificial Sequence
  Description of Artificial Sequence: Synthetic peptide
WGQGTLVTVSS

SEQ ID NO: 1780 - protein, 11 aa, Artificial Sequence
  Description of Artificial Sequence: Synthetic peptide
WGQGTLVTVSS

SEQ ID NO: 1781 - protein, 11 aa, Artificial Sequence
  Description of Artificial Sequence: Synthetic peptide
WGQGTLVTVSS

SEQ ID NO: 1782 - protein, 11 aa, Artificial Sequence
  Description of Artificial Sequence: Synthetic peptide
WGQGTLVTVSS

SEQ ID NO: 1783 - protein, 11 aa, Artificial Sequence
  Description of Artificial Sequence: Synthetic peptide
WGQGTLVTVSS

SEQ ID NO: 1784 - protein, 11 aa, Artificial Sequence
  Description of Artificial Sequence: Synthetic peptide
WGQGTLVTVSS

SEQ ID NO: 1785 - protein, 11 aa, Artificial Sequence
  Description of Artificial Sequence: Synthetic peptide
WGQGTLVTVSS

SEQ ID NO: 1786 - protein, 11 aa, Artificial Sequence
  Description of Artificial Sequence: Synthetic peptide
WGQGTLVTVSS

SEQ ID NO: 1787 - protein, 11 aa, Artificial Sequence
  Description of Artificial Sequence: Synthetic peptide
WGQGTLVTVSS

SEQ ID NO: 1788 - protein, 11 aa, Artificial Sequence
  Description of Artificial Sequence: Synthetic peptide
WGQGTLVTVSS

SEQ ID NO: 1789 - protein, 11 aa, Artificial Sequence
  Description of Artificial Sequence: Synthetic peptide
WGQGTLVTVSS

SEQ ID NO: 1790 - protein, 11 aa, Artificial Sequence
  Description of Artificial Sequence: Synthetic peptide
WGQGTLVTVSS

SEQ ID NO: 1791 - protein, 11 aa, Artificial Sequence
  Description of Artificial Sequence: Synthetic peptide
WGQGTLVTVSS

SEQ ID NO: 1792 - protein, 11 aa, Artificial Sequence
  Description of Artificial Sequence: Synthetic peptide
WGQGTLVTVSS

SEQ ID NO: 1793 - protein, 11 aa, Artificial Sequence
  Description of Artificial Sequence: Synthetic peptide
WGQGTLVTVSS

SEQ ID NO: 1794 - protein, 11 aa, Artificial Sequence
  Description of Artificial Sequence: Synthetic peptide
WGQGTLVTVSS

SEQ ID NO: 1795 - protein, 11 aa, Artificial Sequence
  Description of Artificial Sequence: Synthetic peptide
WGQGTLVTVSS

SEQ ID NO: 1796 - protein, 11 aa, Artificial Sequence
  Description of Artificial Sequence: Synthetic peptide
WGQGTLVTVSS

SEQ ID NO: 1797 - protein, 11 aa, Artificial Sequence
  Description of Artificial Sequence: Synthetic peptide
WGQGTLVTVSS

SEQ ID NO: 1798 - protein, 11 aa, Artificial Sequence
  Description of Artificial Sequence: Synthetic peptide
WGQGTLVTVSS

SEQ ID NO: 1799 - protein, 11 aa, Artificial Sequence
  Description of Artificial Sequence: Synthetic peptide
WGQGTLVTVSS

SEQ ID NO: 1800 - protein, 11 aa, Artificial Sequence
  Description of Artificial Sequence: Synthetic peptide
WGQGTLVTVSS

SEQ ID NO: 1801 - protein, 11 aa, Artificial Sequence
  Description of Artificial Sequence: Synthetic peptide
WGQGTLVTVSS

SEQ ID NO: 1802 - protein, 11 aa, Artificial Sequence
  Description of Artificial Sequence: Synthetic peptide
WGQGTLVTVSS

SEQ ID NO: 1803 - protein, 11 aa, Artificial Sequence
  Description of Artificial Sequence: Synthetic peptide
WGQGTLVTVSS

SEQ ID NO: 1804 - protein, 11 aa, Artificial Sequence
  Description of Artificial Sequence: Synthetic peptide
WGQGTTVTVSS

SEQ ID NO: 1805 - protein, 11 aa, Artificial Sequence
  Description of Artificial Sequence: Synthetic peptide
WGQGTTVTVSS

SEQ ID NO: 1806 - protein, 11 aa, Artificial Sequence
  Description of Artificial Sequence: Synthetic peptide
WGQGTTVTVSS

SEQ ID NO: 1807 - protein, 11 aa, Artificial Sequence
  Description of Artificial Sequence: Synthetic peptide
WGQGTTVTVSS

SEQ ID NO: 1808 - protein, 11 aa, Artificial Sequence
  Description of Artificial Sequence: Synthetic peptide
WGQGTTVTVSS

SEQ ID NO: 1809 - protein, 11 aa, Artificial Sequence
  Description of Artificial Sequence: Synthetic peptide
WGQGTTVTVSS

SEQ ID NO: 1810 - protein, 11 aa, Artificial Sequence
  Description of Artificial Sequence: Synthetic peptide
WGQGTTVTVSS

SEQ ID NO: 1811 - protein, 11 aa, Artificial Sequence
  Description of Artificial Sequence: Synthetic peptide
WGQGTTVTVSS

SEQ ID NO: 1812 - protein, 11 aa, Artificial Sequence
  Description of Artificial Sequence: Synthetic peptide
WGQGTTVTVSS

SEQ ID NO: 1813 - protein, 11 aa, Artificial Sequence
  Description of Artificial Sequence: Synthetic peptide
WGQGTTVTVSS

SEQ ID NO: 1814 - protein, 11 aa, Artificial Sequence
  Description of Artificial Sequence: Synthetic peptide
WGQGTLVTVSS

SEQ ID NO: 1815 - protein, 11 aa, Artificial Sequence
  Description of Artificial Sequence: Synthetic peptide
WGQGTLVTVSS

SEQ ID NO: 1816 - protein, 11 aa, Artificial Sequence
  Description of Artificial Sequence: Synthetic peptide
WGQGTLVTVSS

SEQ ID NO: 1817 - protein, 11 aa, Artificial Sequence
  Description of Artificial Sequence: Synthetic peptide
WGQGTLVTVSS

SEQ ID NO: 1818 - protein, 11 aa, Artificial Sequence
  Description of Artificial Sequence: Synthetic peptide
WGQGTLVTVSS

SEQ ID NO: 1819 - protein, 11 aa, Artificial Sequence
  Description of Artificial Sequence: Synthetic peptide
WGQGTLVTVSS

SEQ ID NO: 1820 - protein, 11 aa, Artificial Sequence
  Description of Artificial Sequence: Synthetic peptide
WGQGTLVTVSS

SEQ ID NO: 1821 - protein, 11 aa, Artificial Sequence
  Description of Artificial Sequence: Synthetic peptide
WGQGTLVTVSS

SEQ ID NO: 1822 - protein, 11 aa, Artificial Sequence
  Description of Artificial Sequence: Synthetic peptide
WGQGTLVTVSS

SEQ ID NO: 1823 - protein, 11 aa, Artificial Sequence
  Description of Artificial Sequence: Synthetic peptide
WGQGTLVTVSS

SEQ ID NO: 1824 - protein, 11 aa, Artificial Sequence
  Description of Artificial Sequence: Synthetic peptide
WGQGTLVTVSS

SEQ ID NO: 1825 - protein, 11 aa, Artificial Sequence
  Description of Artificial Sequence: Synthetic peptide
WGQGTLVTVSS

SEQ ID NO: 1826 - protein, 11 aa, Artificial Sequence
  Description of Artificial Sequence: Synthetic peptide
WGQGTLVTVSS

SEQ ID NO: 1827 - protein, 11 aa, Artificial Sequence
  Description of Artificial Sequence: Synthetic peptide
WGQGTLVTVSS

SEQ ID NO: 1828 - protein, 11 aa, Artificial Sequence
  Description of Artificial Sequence: Synthetic peptide
WGQGTLVTVSS

SEQ ID NO: 1829 - protein, 11 aa, Artificial Sequence
  Description of Artificial Sequence: Synthetic peptide
WGQGTLVTVSS

SEQ ID NO: 1830 - protein, 11 aa, Artificial Sequence
  Description of Artificial Sequence: Synthetic peptide
WGQGTTVTVSS

SEQ ID NO: 1831 - protein, 11 aa, Artificial Sequence
  Description of Artificial Sequence: Synthetic peptide
WGQGTTVTVSS

SEQ ID NO: 1832 - protein, 23 aa, Artificial Sequence
  Description of Artificial Sequence: Synthetic peptide
DIQMTQSPSSLSASVGDRVTITC

SEQ ID NO: 1833 - protein, 23 aa, Artificial Sequence
  Description of Artificial Sequence: Synthetic peptide
DIQMTQSPSSLSASVGDRVTITC

SEQ ID NO: 1834 - protein, 23 aa, Artificial Sequence
  Description of Artificial Sequence: Synthetic peptide
DIQMTQSPSSLSASVGDRVTITC

SEQ ID NO: 1835 - protein, 23 aa, Artificial Sequence
  Description of Artificial Sequence: Synthetic peptide
DIQMTQSPDSLSASVGDRVTITC

SEQ ID NO: 1836 - protein, 23 aa, Artificial Sequence
  Description of Artificial Sequence: Synthetic peptide
DIQMTQSPSSLSASVGDRVTITC

SEQ ID NO: 1837 - protein, 23 aa, Artificial Sequence
  Description of Artificial Sequence: Synthetic peptide
DIQMTQSPSSLSASVGDRVTITC

SEQ ID NO: 1838 - protein, 23 aa, Artificial Sequence
  Description of Artificial Sequence: Synthetic peptide
DIQMTQSPSSLSASVGDRVTITC

SEQ ID NO: 1839 - protein, 23 aa, Artificial Sequence
  Description of Artificial Sequence: Synthetic peptide
DIQMTQSPSSLSASVGDRVTITC

SEQ ID NO: 1840 - protein, 23 aa, Artificial Sequence
  Description of Artificial Sequence: Synthetic peptide
DIQMTQSPSSLSASVGDRVTITC

SEQ ID NO: 1841 - protein, 23 aa, Artificial Sequence
  Description of Artificial Sequence: Synthetic peptide
DIQMTQSPSSLSASVGDRVTITC

SEQ ID NO: 1842 - protein, 23 aa, Artificial Sequence
  Description of Artificial Sequence: Synthetic peptide
DIQMTQSPSSLSASVGDRVTITC

SEQ ID NO: 1843 - protein, 23 aa, Artificial Sequence
  Description of Artificial Sequence: Synthetic peptide
DIQMTQSPSSLSASVGDRVTITC

SEQ ID NO: 1844 - protein, 23 aa, Artificial Sequence
  Description of Artificial Sequence: Synthetic peptide
DIQMTQSPSSLSASVGDRVTITC

SEQ ID NO: 1845 - protein, 23 aa, Artificial Sequence
  Description of Artificial Sequence: Synthetic peptide
DIQMTQSPSSLSASVGDRVTITC

SEQ ID NO: 1846 - protein, 23 aa, Artificial Sequence
  Description of Artificial Sequence: Synthetic peptide
DIQMTQSPSSLSASVGDRVTITC

SEQ ID NO: 1847 - protein, 23 aa, Artificial Sequence
  Description of Artificial Sequence: Synthetic peptide
DIQMTQSPSSLSASVGDRVTITC

SEQ ID NO: 1848 - protein, 23 aa, Artificial Sequence
  Description of Artificial Sequence: Synthetic peptide
DIQMTQSPSSLSASVGDRVTITC

SEQ ID NO: 1849 - protein, 23 aa, Artificial Sequence
  Description of Artificial Sequence: Synthetic peptide
DIQMTQSPSSLSASVGDRVTITC

SEQ ID NO: 1850 - protein, 23 aa, Artificial Sequence
  Description of Artificial Sequence: Synthetic peptide
DIQMTQSPSSLSASVGDRVTITC

SEQ ID NO: 1851 - protein, 23 aa, Artificial Sequence
  Description of Artificial Sequence: Synthetic peptide
DIQMTQSPSSLSASVGDRVTITC

SEQ ID NO: 1852 - protein, 23 aa, Artificial Sequence
  Description of Artificial Sequence: Synthetic peptide
DIQMTQSPSSLSASVGDRVTITC

SEQ ID NO: 1853 - protein, 23 aa, Artificial Sequence
  Description of Artificial Sequence: Synthetic peptide
DIVMTQSPDSLAVSLGERATINC

SEQ ID NO: 1854 - protein, 23 aa, Artificial Sequence
  Description of Artificial Sequence: Synthetic peptide
DIVMTQSPDSLAVSLGERATINC

SEQ ID NO: 1855 - protein, 23 aa, Artificial Sequence
  Description of Artificial Sequence: Synthetic peptide
DIQMTQSPSSLSASVGDRVTITC

SEQ ID NO: 1856 - protein, 23 aa, Artificial Sequence
  Description of Artificial Sequence: Synthetic peptide
DIQMTQSPSSLSASVGDRVTITC

SEQ ID NO: 1857 - protein, 23 aa, Artificial Sequence
  Description of Artificial Sequence: Synthetic peptide
DIQMTQSPSSLSASVGDRVTITC

SEQ ID NO: 1858 - protein, 23 aa, Artificial Sequence
  Description of Artificial Sequence: Synthetic peptide
DIVMTQTPLSLPVTPGEPASISC

SEQ ID NO: 1859 - protein, 23 aa, Artificial Sequence
  Description of Artificial Sequence: Synthetic peptide
DIVMTQTPLSLPVTPGEPASISC

SEQ ID NO: 1860 - protein, 22 aa, Artificial Sequence
  Description of Artificial Sequence: Synthetic peptide
SYVLTQPPSVSVAPGKTARITC

SEQ ID NO: 1861 - protein, 22 aa, Artificial Sequence
  Description of Artificial Sequence: Synthetic peptide
SYVLTQPPSVSVAPGQTARITC

SEQ ID NO: 1862 - protein, 22 aa, Artificial Sequence
  Description of Artificial Sequence: Synthetic peptide
SYVLTQPPSVSVAPGQTARITC

SEQ ID NO: 1863 - protein, 22 aa, Artificial Sequence
  Description of Artificial Sequence: Synthetic peptide
SYVLTQPPSVSVAPGQTARITC

SEQ ID NO: 1864 - protein, 22 aa, Artificial Sequence
  Description of Artificial Sequence: Synthetic peptide
SYVLTQPPSVSVAPGQTARITC

SEQ ID NO: 1865 - protein, 22 aa, Artificial Sequence
  Description of Artificial Sequence: Synthetic peptide
SYVLTQPPSVSVAPGQTARITC

SEQ ID NO: 1866 - protein, 22 aa, Artificial Sequence
  Description of Artificial Sequence: Synthetic peptide
SYVLTQPPSVSVAPGQTARITC

SEQ ID NO: 1867 - protein, 22 aa, Artificial Sequence
  Description of Artificial Sequence: Synthetic peptide
SYVLTQPPSVSVAPGQTARITC

SEQ ID NO: 1868 - protein, 22 aa, Artificial Sequence
  Description of Artificial Sequence: Synthetic peptide
SYVLTQPPSVSVAPGQTARITC

SEQ ID NO: 1869 - protein, 22 aa, Artificial Sequence
  Description of Artificial Sequence: Synthetic peptide
SYVLTQPPSVSVAPGQTARITC

SEQ ID NO: 1870 - protein, 22 aa, Artificial Sequence
  Description of Artificial Sequence: Synthetic peptide
SYVLTQPPSVSVAPGQTARITC

SEQ ID NO: 1871 - protein, 22 aa, Artificial Sequence
  Description of Artificial Sequence: Synthetic peptide
QTVVTQEPSLTVSPGGTVTLTC

SEQ ID NO: 1872 - protein, 22 aa, Artificial Sequence
  Description of Artificial Sequence: Synthetic peptide
QTVVTQEPSLTVSPGGTVTLTC

SEQ ID NO: 1873 - protein, 22 aa, Artificial Sequence
  Description of Artificial Sequence: Synthetic peptide
QTVVTQEPSLTVSPGGTVTLTC

SEQ ID NO: 1874 - protein, 22 aa, Artificial Sequence
  Description of Artificial Sequence: Synthetic peptide
QTVVTQEPSLTVSPGGTVTLTC

SEQ ID NO: 1875 - protein, 22 aa, Artificial Sequence
  Description of Artificial Sequence: Synthetic peptide
QTVVTQEPSLTVSPGGTVTLTC

SEQ ID NO: 1876 - protein, 22 aa, Artificial Sequence
  Description of Artificial Sequence: Synthetic peptide
QTVVTQEPSLTVSPGGTVTLTC

SEQ ID NO: 1877 - protein, 22 aa, Artificial Sequence
  Description of Artificial Sequence: Synthetic peptide
QTVVTQEPSLTVSPGGTVTLTC

SEQ ID NO: 1878 - protein, 22 aa, Artificial Sequence
  Description of Artificial Sequence: Synthetic peptide
QTVVTQEPSLTVSPGGTVTLTC

SEQ ID NO: 1879 - protein, 22 aa, Artificial Sequence
  Description of Artificial Sequence: Synthetic peptide
QTVVTQEPSLTVSPGGTVTLTC

SEQ ID NO: 1880 - protein, 22 aa, Artificial Sequence
  Description of Artificial Sequence: Synthetic peptide
QTVVTQEPSLTVSPGGTVTLTC

SEQ ID NO: 1881 - protein, 22 aa, Artificial Sequence
  Description of Artificial Sequence: Synthetic peptide
QTVVTQEPSLTVSPGGTVTLTC

SEQ ID NO: 1882 - protein, 22 aa, Artificial Sequence
  Description of Artificial Sequence: Synthetic peptide
QTVVTQEPSLTVSPGGTVTLTC

SEQ ID NO: 1883 - protein, 22 aa, Artificial Sequence
  Description of Artificial Sequence: Synthetic peptide
QTVVTQEPSLTVSPGGTVTLTC

SEQ ID NO: 1884 - protein, 22 aa, Artificial Sequence
  Description of Artificial Sequence: Synthetic peptide
QTVVTQEPSLTVSPGGTVTLTC

SEQ ID NO: 1885 - protein, 22 aa, Artificial Sequence
  Description of Artificial Sequence: Synthetic peptide
QTVVTQEPSLTVSPGGTVTLTC

SEQ ID NO: 1886 - protein, 22 aa, Artificial Sequence
  Description of Artificial Sequence: Synthetic peptide
QTVVTQEPSLTVSPGGTVTLTC

SEQ ID NO: 1887 - protein, 22 aa, Artificial Sequence
  Description of Artificial Sequence: Synthetic peptide
QTVVTQEPSLTVSPGGTVTLTC

SEQ ID NO: 1888 - protein, 22 aa, Artificial Sequence
  Description of Artificial Sequence: Synthetic peptide
QTVVTQEPSLTVSPGGTVTLTC

SEQ ID NO: 1889 - protein, 22 aa, Artificial Sequence
  Description of Artificial Sequence: Synthetic peptide
QTVVTQEPSLTVSPGGTVTLTC

SEQ ID NO: 1890 - protein, 22 aa, Artificial Sequence
  Description of Artificial Sequence: Synthetic peptide
QTVVTQEPSLTVSPGGTVTLTC

SEQ ID NO: 1891 - protein, 22 aa, Artificial Sequence
  Description of Artificial Sequence: Synthetic peptide
QTVVTQEPSLTVSPGGTVTLTC

SEQ ID NO: 1892 - protein, 22 aa, Artificial Sequence
  Description of Artificial Sequence: Synthetic peptide
QTVVTQEPSLTVSPGGTVTLTC

SEQ ID NO: 1893 - protein, 22 aa, Artificial Sequence
  Description of Artificial Sequence: Synthetic peptide
QTVVTQEPSLTVSPGGTVTLTC

SEQ ID NO: 1894 - protein, 22 aa, Artificial Sequence
  Description of Artificial Sequence: Synthetic peptide
QTVVTQEPSLTVSPGGTVTLTC

SEQ ID NO: 1895 - protein, 22 aa, Artificial Sequence
  Description of Artificial Sequence: Synthetic peptide
QTVVTQEPSLTVSPGGTVTLTC

SEQ ID NO: 1896 - protein, 22 aa, Artificial Sequence
  Description of Artificial Sequence: Synthetic peptide
QTVVTQEPSLTVSPGGTVTLTC

SEQ ID NO: 1897 - protein, 22 aa, Artificial Sequence
  Description of Artificial Sequence: Synthetic peptide
QTVVTQEPSLTVSPGGTVTLTC

SEQ ID NO: 1898 - protein, 22 aa, Artificial Sequence
  Description of Artificial Sequence: Synthetic peptide
QTVVTQEPSLTVSPGGTVTLTC

SEQ ID NO: 1899 - protein, 22 aa, Artificial Sequence
  Description of Artificial Sequence: Synthetic peptide
QTVVTQEPSLTVSPGGTVTLTC

SEQ ID NO: 1900 - protein, 22 aa, Artificial Sequence
  Description of Artificial Sequence: Synthetic peptide
QTVVTQEPSLTVSPGGTVTLTC

SEQ ID NO: 1901 - protein, 22 aa, Artificial Sequence
  Description of Artificial Sequence: Synthetic peptide
QTVVTQEPSLTVSPGGTVTLTC

SEQ ID NO: 1902 - protein, 22 aa, Artificial Sequence
  Description of Artificial Sequence: Synthetic peptide
QTVVTQEPSLTVSPGGTVTLTC

SEQ ID NO: 1903 - protein, 22 aa, Artificial Sequence
  Description of Artificial Sequence: Synthetic peptide
QTVVTQEPSLTVSPGGTVTLTC

SEQ ID NO: 1904 - protein, 22 aa, Artificial Sequence
  Description of Artificial Sequence: Synthetic peptide
QTVVTQEPSLTVSPGGTVTLTC

SEQ ID NO: 1905 - protein, 22 aa, Artificial Sequence
  Description of Artificial Sequence: Synthetic peptide
QTVVTQEPSLTVSPGGTVTLTC

SEQ ID NO: 1906 - protein, 22 aa, Artificial Sequence
  Description of Artificial Sequence: Synthetic peptide
QTVVTQEPSLTVSPGGTVTLTC

SEQ ID NO: 1907 - protein, 22 aa, Artificial Sequence
  Description of Artificial Sequence: Synthetic peptide
QTVVTQEPSLTVSPGGTVTLTC

SEQ ID NO: 1908 - protein, 22 aa, Artificial Sequence
  Description of Artificial Sequence: Synthetic peptide
SYVLTQPPSVSVAPGKTARITC

SEQ ID NO: 1909 - protein, 22 aa, Artificial Sequence
  Description of Artificial Sequence: Synthetic peptide
SYVLTQPPSVSVAPGQTARITC

SEQ ID NO: 1910 - protein, 22 aa, Artificial Sequence
  Description of Artificial Sequence: Synthetic peptide
SYVLTQPPSVSVAPGQTARITC

SEQ ID NO: 1911 - protein, 22 aa, Artificial Sequence
  Description of Artificial Sequence: Synthetic peptide
SYVLTQPPSVSVAPGQTARITC

SEQ ID NO: 1912 - protein, 22 aa, Artificial Sequence
  Description of Artificial Sequence: Synthetic peptide
SYVLTQPPSVSVAPGQTARITC

SEQ ID NO: 1913 - protein, 30 aa, Artificial Sequence; identical to SEQ ID NO: 779
  Description of Artificial Sequence: Synthetic polypeptide

SEQ ID NO: 1914 - protein, 30 aa, Artificial Sequence; identical to SEQ ID NO: 779
  Description of Artificial Sequence: Synthetic polypeptide

SEQ ID NO: 1915 - protein, 30 aa, Artificial Sequence; identical to SEQ ID NO: 779
  Description of Artificial Sequence: Synthetic polypeptide

SEQ ID NO: 1916 - protein, 30 aa, Artificial Sequence; identical to SEQ ID NO: 779
  Description of Artificial Sequence: Synthetic polypeptide

SEQ ID NO: 1917 - protein, 30 aa, Artificial Sequence; identical to SEQ ID NO: 779
  Description of Artificial Sequence: Synthetic polypeptide

SEQ ID NO: 1918 - protein, 30 aa, Artificial Sequence; identical to SEQ ID NO: 784
  Description of Artificial Sequence: Synthetic polypeptide

SEQ ID NO: 1919 - protein, 30 aa, Artificial Sequence; identical to SEQ ID NO: 779
  Description of Artificial Sequence: Synthetic polypeptide

SEQ ID NO: 1920 - protein, 30 aa, Artificial Sequence; identical to SEQ ID NO: 779
  Description of Artificial Sequence: Synthetic polypeptide

SEQ ID NO: 1921 - protein, 30 aa, Artificial Sequence; identical to SEQ ID NO: 787
  Description of Artificial Sequence: Synthetic polypeptide

SEQ ID NO: 1922 - protein, 30 aa, Artificial Sequence; identical to SEQ ID NO: 779
  Description of Artificial Sequence: Synthetic polypeptide

SEQ ID NO: 1923 - protein, 30 aa, Artificial Sequence; identical to SEQ ID NO: 779
  Description of Artificial Sequence: Synthetic polypeptide

SEQ ID NO: 1924 - protein, 30 aa, Artificial Sequence; identical to SEQ ID NO: 779
  Description of Artificial Sequence: Synthetic polypeptide

SEQ ID NO: 1925 - protein, 30 aa, Artificial Sequence; identical to SEQ ID NO: 779
  Description of Artificial Sequence: Synthetic polypeptide

SEQ ID NO: 1926 - protein, 30 aa, Artificial Sequence; identical to SEQ ID NO: 779
  Description of Artificial Sequence: Synthetic polypeptide

SEQ ID NO: 1927 - protein, 30 aa, Artificial Sequence; identical to SEQ ID NO: 793
  Description of Artificial Sequence: Synthetic polypeptide

SEQ ID NO: 1928 - protein, 30 aa, Artificial Sequence; identical to SEQ ID NO: 794
  Description of Artificial Sequence: Synthetic polypeptide

SEQ ID NO: 1929 - protein, 30 aa, Artificial Sequence; identical to SEQ ID NO: 794
  Description of Artificial Sequence: Synthetic polypeptide

SEQ ID NO: 1930 - protein, 30 aa, Artificial Sequence; identical to SEQ ID NO: 794
  Description of Artificial Sequence: Synthetic polypeptide

SEQ ID NO: 1931 - protein, 30 aa, Artificial Sequence; identical to SEQ ID NO: 794
  Description of Artificial Sequence: Synthetic polypeptide

SEQ ID NO: 1932 - protein, 30 aa, Artificial Sequence; identical to SEQ ID NO: 794
  Description of Artificial Sequence: Synthetic polypeptide

SEQ ID NO: 1933 - protein, 30 aa, Artificial Sequence; identical to SEQ ID NO: 794
  Description of Artificial Sequence: Synthetic polypeptide

SEQ ID NO: 1934 - protein, 30 aa, Artificial Sequence; identical to SEQ ID NO: 794
  Description of Artificial Sequence: Synthetic polypeptide

SEQ ID NO: 1935 - protein, 30 aa, Artificial Sequence; identical to SEQ ID NO: 794
  Description of Artificial Sequence: Synthetic polypeptide

SEQ ID NO: 1936 - protein, 30 aa, Artificial Sequence; identical to SEQ ID NO: 794
  Description of Artificial Sequence: Synthetic polypeptide

SEQ ID NO: 1937 - protein, 30 aa, Artificial Sequence; identical to SEQ ID NO: 794
  Description of Artificial Sequence: Synthetic polypeptide

SEQ ID NO: 1938 - protein, 30 aa, Artificial Sequence; identical to SEQ ID NO: 794
  Description of Artificial Sequence: Synthetic polypeptide

SEQ ID NO: 1939 - protein, 30 aa, Artificial Sequence; identical to SEQ ID NO: 794
  Description of Artificial Sequence: Synthetic polypeptide

SEQ ID NO: 1940 - protein, 30 aa, Artificial Sequence; identical to SEQ ID NO: 794
  Description of Artificial Sequence: Synthetic polypeptide

SEQ ID NO: 1941 - protein, 30 aa, Artificial Sequence; identical to SEQ ID NO: 794
  Description of Artificial Sequence: Synthetic polypeptide

SEQ ID NO: 1942 - protein, 30 aa, Artificial Sequence; identical to SEQ ID NO: 794
  Description of Artificial Sequence: Synthetic polypeptide

SEQ ID NO: 1943 - protein, 30 aa, Artificial Sequence; identical to SEQ ID NO: 794
  Description of Artificial Sequence: Synthetic polypeptide

SEQ ID NO: 1944 - protein, 30 aa, Artificial Sequence; identical to SEQ ID NO: 794
  Description of Artificial Sequence: Synthetic polypeptide

SEQ ID NO: 1945 - protein, 30 aa, Artificial Sequence; identical to SEQ ID NO: 794
  Description of Artificial Sequence: Synthetic polypeptide

SEQ ID NO: 1946 - protein, 30 aa, Artificial Sequence; identical to SEQ ID NO: 794
  Description of Artificial Sequence: Synthetic polypeptide

SEQ ID NO: 1947 - protein, 30 aa, Artificial Sequence; identical to SEQ ID NO: 794
  Description of Artificial Sequence: Synthetic polypeptide

SEQ ID NO: 1948 - protein, 30 aa, Artificial Sequence; identical to SEQ ID NO: 794
  Description of Artificial Sequence: Synthetic polypeptide

SEQ ID NO: 1949 - protein, 30 aa, Artificial Sequence; identical to SEQ ID NO: 794
  Description of Artificial Sequence: Synthetic polypeptide

SEQ ID NO: 1950 - protein, 30 aa, Artificial Sequence; identical to SEQ ID NO: 794
  Description of Artificial Sequence: Synthetic polypeptide

SEQ ID NO: 1951 - protein, 30 aa, Artificial Sequence; identical to SEQ ID NO: 794
  Description of Artificial Sequence: Synthetic polypeptide

SEQ ID NO: 1952 - protein, 30 aa, Artificial Sequence; identical to SEQ ID NO: 794
  Description of Artificial Sequence: Synthetic polypeptide

SEQ ID NO: 1953 - protein, 30 aa, Artificial Sequence; identical to SEQ ID NO: 794
  Description of Artificial Sequence: Synthetic polypeptide

SEQ ID NO: 1954 - protein, 30 aa, Artificial Sequence; identical to SEQ ID NO: 794
  Description of Artificial Sequence: Synthetic polypeptide

SEQ ID NO: 1955 - protein, 30 aa, Artificial Sequence; identical to SEQ ID NO: 794
  Description of Artificial Sequence: Synthetic polypeptide

SEQ ID NO: 1956 - protein, 30 aa, Artificial Sequence; identical to SEQ ID NO: 794
  Description of Artificial Sequence: Synthetic polypeptide

SEQ ID NO: 1957 - protein, 30 aa, Artificial Sequence; identical to SEQ ID NO: 794
  Description of Artificial Sequence: Synthetic polypeptide

SEQ ID NO: 1958 - protein, 30 aa, Artificial Sequence; identical to SEQ ID NO: 794
  Description of Artificial Sequence: Synthetic polypeptide

SEQ ID NO: 1959 - protein, 30 aa, Artificial Sequence; identical to SEQ ID NO: 794
  Description of Artificial Sequence: Synthetic polypeptide

SEQ ID NO: 1960 - protein, 30 aa, Artificial Sequence; identical to SEQ ID NO: 794
  Description of Artificial Sequence: Synthetic polypeptide

SEQ ID NO: 1961 - protein, 30 aa, Artificial Sequence; identical to SEQ ID NO: 794
  Description of Artificial Sequence: Synthetic polypeptide

SEQ ID NO: 1962 - protein, 30 aa, Artificial Sequence; identical to SEQ ID NO: 794
  Description of Artificial Sequence: Synthetic polypeptide

SEQ ID NO: 1963 - protein, 30 aa, Artificial Sequence; identical to SEQ ID NO: 794
  Description of Artificial Sequence: Synthetic polypeptide

SEQ ID NO: 1964 - protein, 30 aa, Artificial Sequence; identical to SEQ ID NO: 830
  Description of Artificial Sequence: Synthetic polypeptide

SEQ ID NO: 1965 - protein, 30 aa, Artificial Sequence; identical to SEQ ID NO: 831
  Description of Artificial Sequence: Synthetic polypeptide

SEQ ID NO: 1966 - protein, 30 aa, Artificial Sequence; identical to SEQ ID NO: 832
  Description of Artificial Sequence: Synthetic polypeptide

SEQ ID NO: 1967 - protein, 30 aa, Artificial Sequence; identical to SEQ ID NO: 833
  Description of Artificial Sequence: Synthetic polypeptide

SEQ ID NO: 1968 - protein, 30 aa, Artificial Sequence; identical to SEQ ID NO: 833
  Description of Artificial Sequence: Synthetic polypeptide

SEQ ID NO: 1969 - protein, 30 aa, Artificial Sequence; identical to SEQ ID NO: 833
  Description of Artificial Sequence: Synthetic polypeptide

SEQ ID NO: 1970 - protein, 30 aa, Artificial Sequence; identical to SEQ ID NO: 833
  Description of Artificial Sequence: Synthetic polypeptide

SEQ ID NO: 1971 - protein, 30 aa, Artificial Sequence; identical to SEQ ID NO: 832
  Description of Artificial Sequence: Synthetic polypeptide

SEQ ID NO: 1972 - protein, 30 aa, Artificial Sequence; identical to SEQ ID NO: 833
  Description of Artificial Sequence: Synthetic polypeptide

SEQ ID NO: 1973 - protein, 30 aa, Artificial Sequence; identical to SEQ ID NO: 833
  Description of Artificial Sequence: Synthetic polypeptide

SEQ ID NO: 1974 - protein, 30 aa, Artificial Sequence; identical to SEQ ID NO: 833
  Description of Artificial Sequence: Synthetic polypeptide

SEQ ID NO: 1975 - protein, 30 aa, Artificial Sequence; identical to SEQ ID NO: 833
  Description of Artificial Sequence: Synthetic polypeptide

SEQ ID NO: 1976 - protein, 30 aa, Artificial Sequence; identical to SEQ ID NO: 842
  Description of Artificial Sequence: Synthetic polypeptide

SEQ ID NO: 1977 - protein, 30 aa, Artificial Sequence; identical to SEQ ID NO: 843
  Description of Artificial Sequence: Synthetic polypeptide

SEQ ID NO: 1978 - protein, 30 aa, Artificial Sequence; identical to SEQ ID NO: 844
  Description of Artificial Sequence: Synthetic polypeptide

SEQ ID NO: 1979 - protein, 30 aa, Artificial Sequence; identical to SEQ ID NO: 845
  Description of Artificial Sequence: Synthetic polypeptide

SEQ ID NO: 1980 - protein, 30 aa, Artificial Sequence; identical to SEQ ID NO: 845
  Description of Artificial Sequence: Synthetic polypeptide

SEQ ID NO: 1981 - protein, 30 aa, Artificial Sequence; identical to SEQ ID NO: 843
  Description of Artificial Sequence: Synthetic polypeptide

SEQ ID NO: 1982 - protein, 30 aa, Artificial Sequence; identical to SEQ ID NO: 844
  Description of Artificial Sequence: Synthetic polypeptide

SEQ ID NO: 1983 - protein, 30 aa, Artificial Sequence; identical to SEQ ID NO: 845
  Description of Artificial Sequence: Synthetic polypeptide

SEQ ID NO: 1984 - protein, 30 aa, Artificial Sequence; identical to SEQ ID NO: 845
  Description of Artificial Sequence: Synthetic polypeptide

SEQ ID NO: 1985 - protein, 30 aa, Artificial Sequence; identical to SEQ ID NO: 851
  Description of Artificial Sequence: Synthetic polypeptide

SEQ ID NO: 1986 - protein, 30 aa, Artificial Sequence; identical to SEQ ID NO: 852
  Description of Artificial Sequence: Synthetic polypeptide

SEQ ID NO: 1987 - protein, 30 aa, Artificial Sequence; identical to SEQ ID NO: 853
  Description of Artificial Sequence: Synthetic polypeptide

SEQ ID NO: 1988 - protein, 30 aa, Artificial Sequence; identical to SEQ ID NO: 853
  Description of Artificial Sequence: Synthetic polypeptide

SEQ ID NO: 1989 - protein, 30 aa, Artificial Sequence; identical to SEQ ID NO: 853
  Description of Artificial Sequence: Synthetic polypeptide

SEQ ID NO: 1990 - protein, 30 aa, Artificial Sequence; identical to SEQ ID NO: 856
  Description of Artificial Sequence: Synthetic polypeptide

SEQ ID NO: 1991 - protein, 30 aa, Artificial Sequence; identical to SEQ ID NO: 856
  Description of Artificial Sequence: Synthetic polypeptide

SEQ ID NO: 1992 - protein, 30 aa, Artificial Sequence; identical to SEQ ID NO: 858
  Description of Artificial Sequence: Synthetic polypeptide

SEQ ID NO: 1993 - protein, 30 aa, Artificial Sequence; identical to SEQ ID NO: 859
  Description of Artificial Sequence: Synthetic polypeptide

SEQ ID NO: 1994 - protein, 11 aa, Artificial Sequence
  Description of Artificial Sequence: Synthetic peptide
RASQSISSYLN

SEQ ID NO: 1995 - protein, 11 aa, Artificial Sequence
  Description of Artificial Sequence: Synthetic peptide
RASQSISNYFN

SEQ ID NO: 1996 - protein, 11 aa, Artificial Sequence
  Description of Artificial Sequence: Synthetic peptide
RTSQSISSYLN

SEQ ID NO: 1997 - protein, 11 aa, Artificial Sequence
  Description of Artificial Sequence: Synthetic peptide
QASQDISNYLN

SEQ ID NO: 1998 - protein, 11 aa, Artificial Sequence
  Description of Artificial Sequence: Synthetic peptide
QASQDISNYLN

SEQ ID NO: 1999 - protein, 11 aa, Artificial Sequence
  Description of Artificial Sequence: Synthetic peptide
QASQDISNYLN

SEQ ID NO: 2000 - protein, 11 aa, Artificial Sequence
  Description of Artificial Sequence: Synthetic peptide
QASQDISNYFN

SEQ ID NO: 2001 - protein, 11 aa, Artificial Sequence
  Description of Artificial Sequence: Synthetic peptide
RASQFISSYLN

SEQ ID NO: 2002 - protein, 11 aa, Artificial Sequence
  Description of Artificial Sequence: Synthetic peptide
QASQDISNYLN

SEQ ID NO: 2003 - protein, 11 aa, Artificial Sequence
  Description of Artificial Sequence: Synthetic peptide
QASQDISNYLN

SEQ ID NO: 2004 - protein, 11 aa, Artificial Sequence
  Description of Artificial Sequence: Synthetic peptide
RASQFISSYLN

SEQ ID NO: 2005 - protein, 11 aa, Artificial Sequence
  Description of Artificial Sequence: Synthetic peptide
RTSQSISSYLN

SEQ ID NO: 2006 - protein, 11 aa, Artificial Sequence
  Description of Artificial Sequence: Synthetic peptide
RASQSISSYLN

SEQ ID NO: 2007 - protein, 11 aa, Artificial Sequence
  Description of Artificial Sequence: Synthetic peptide
RTSQSISSYLN

SEQ ID NO: 2008 - protein, 11 aa, Artificial Sequence
  Description of Artificial Sequence: Synthetic peptide
RTSQSISSYLN

SEQ ID NO: 2009 - protein, 11 aa, Artificial Sequence
  Description of Artificial Sequence: Synthetic peptide
RASQSISSYLN

SEQ ID NO: 2010 - protein, 11 aa, Artificial Sequence
  Description of Artificial Sequence: Synthetic peptide
RTSQSISSYLN

SEQ ID NO: 2011 - protein, 11 aa, Artificial Sequence
  Description of Artificial Sequence: Synthetic peptide
RTSQSISSYLN

SEQ ID NO: 2012 - protein, 11 aa, Artificial Sequence
  Description of Artificial Sequence: Synthetic peptide
RTSQSISSYLN

SEQ ID NO: 2013 - protein, 11 aa, Artificial Sequence
  Description of Artificial Sequence: Synthetic peptide
RTSQSISSYLN

SEQ ID NO: 2014 - protein, 11 aa, Artificial Sequence
  Description of Artificial Sequence: Synthetic peptide
RTSQSISSYLN

SEQ ID NO: 2015 - protein, 17 aa, Artificial Sequence
  Description of Artificial Sequence: Synthetic peptide
KSSQSVLYSSNNKNYLA

SEQ ID NO: 2016 - protein, 17 aa, Artificial Sequence
  Description of Artificial Sequence: Synthetic peptide
KSSQSVLYSSNNKNYLA

SEQ ID NO: 2017 - protein, 11 aa, Artificial Sequence
  Description of Artificial Sequence: Synthetic peptide
RASQGISNYLA

SEQ ID NO: 2018 - protein, 11 aa, Artificial Sequence
  Description of Artificial Sequence: Synthetic peptide
RASQGISNYLA

SEQ ID NO: 2019 - protein, 11 aa, Artificial Sequence
  Description of Artificial Sequence: Synthetic peptide
RASQGISNYLA

SEQ ID NO: 2020 - protein, 17 aa, Artificial Sequence
  Description of Artificial Sequence: Synthetic peptide
RSSQSLLDSDDGNTYLD

SEQ ID NO: 2021 - protein, 16 aa, Artificial Sequence
  Description of Artificial Sequence: Synthetic peptide
RSSQSLLHRSGYNYLD

SEQ ID NO: 2022 - protein, 11 aa, Artificial Sequence
  Description of Artificial Sequence: Synthetic peptide
GGNNIGSKSVH

SEQ ID NO: 2023 - protein, 11 aa, Artificial Sequence
  Description of Artificial Sequence: Synthetic peptide
GGNNIGSKSVH

SEQ ID NO: 2024 - protein, 11 aa, Artificial Sequence
  Description of Artificial Sequence: Synthetic peptide
GGNNIGSKSVH

SEQ ID NO: 2025 - protein, 11 aa, Artificial Sequence
  Description of Artificial Sequence: Synthetic peptide
GGNNIGSKSVH

SEQ ID NO: 2026 - protein, 11 aa, Artificial Sequence
  Description of Artificial Sequence: Synthetic peptide
GGNNIGSKSVH

SEQ ID NO: 2027 - protein, 11 aa, Artificial Sequence
  Description of Artificial Sequence: Synthetic peptide
GGNNIGSKSVH

SEQ ID NO: 2028 - protein, 11 aa, Artificial Sequence
  Description of Artificial Sequence: Synthetic peptide
GGNNIGSKSVH

SEQ ID NO: 2029 - protein, 11 aa, Artificial Sequence
  Description of Artificial Sequence: Synthetic peptide
GGNNIGSKSVH

SEQ ID NO: 2030 - protein, 11 aa, Artificial Sequence
  Description of Artificial Sequence: Synthetic peptide
GGNNIGSKSVH

SEQ ID NO: 2031 - protein, 11 aa, Artificial Sequence
  Description of Artificial Sequence: Synthetic peptide
GGNNIGSKSVH

SEQ ID NO: 2032 - protein, 11 aa, Artificial Sequence
  Description of Artificial Sequence: Synthetic peptide
GGNNIGSKSVH

SEQ ID NO: 2033 - protein, 14 aa, Artificial Sequence
  Description of Artificial Sequence: Synthetic peptide
ASSTGAVTSGYYPN

SEQ ID NO: 2034 - protein, 14 aa, Artificial Sequence
  Description of Artificial Sequence: Synthetic peptide
GSSTGAVTSGNYPN

SEQ ID NO: 2035 - protein, 14 aa, Artificial Sequence
  Description of Artificial Sequence: Synthetic peptide
GSSTGAVTSGNYPN

SEQ ID NO: 2036 - protein, 14 aa, Artificial Sequence
  Description of Artificial Sequence: Synthetic peptide
GSSTGAVTSGNYPN

SEQ ID NO: 2037 - protein, 14 aa, Artificial Sequence
  Description of Artificial Sequence: Synthetic peptide
GSSTGAVTSGNYPN

SEQ ID NO: 2038 - protein, 14 aa, Artificial Sequence
  Description of Artificial Sequence: Synthetic peptide
GSSTGAVTSGNYPN

SEQ ID NO: 2039 - protein, 14 aa, Artificial Sequence
  Description of Artificial Sequence: Synthetic peptide
GSSTGAVTSGNYPN

SEQ ID NO: 2040 - protein, 14 aa, Artificial Sequence
  Description of Artificial Sequence: Synthetic peptide
GSSTGAVTSGNYPN

SEQ ID NO: 2041 - protein, 14 aa, Artificial Sequence
  Description of Artificial Sequence: Synthetic peptide
GSSTGAVTSGNYPN

SEQ ID NO: 2042 - protein, 14 aa, Artificial Sequence
  Description of Artificial Sequence: Synthetic peptide
GSSTGAVTSGNYPN

SEQ ID NO: 2043 - protein, 14 aa, Artificial Sequence
  Description of Artificial Sequence: Synthetic peptide
GSSTGAVTSGNYPN

SEQ ID NO: 2044 - protein, 14 aa, Artificial Sequence
  Description of Artificial Sequence: Synthetic peptide
GSSTGAVTSGNYPN

SEQ ID NO: 2045 - protein, 14 aa, Artificial Sequence
  Description of Artificial Sequence: Synthetic peptide
GSSTGAVTSGNYPN

SEQ ID NO: 2046 - protein, 14 aa, Artificial Sequence
  Description of Artificial Sequence: Synthetic peptide
GSSTGAVTSGNYPN

SEQ ID NO: 2047 - protein, 14 aa, Artificial Sequence
  Description of Artificial Sequence: Synthetic peptide
GSSTGAVTSGNYPN

SEQ ID NO: 2048 - protein, 14 aa, Artificial Sequence
  Description of Artificial Sequence: Synthetic peptide
GSSTGAVTSGNYPN

SEQ ID NO: 2049 - protein, 14 aa, Artificial Sequence
  Description of Artificial Sequence: Synthetic peptide
GSSTGAVTSGNYPN

SEQ ID NO: 2050 - protein, 14 aa, Artificial Sequence
  Description of Artificial Sequence: Synthetic peptide
GSSTGAVTSGNYPN

SEQ ID NO: 2051 - protein, 14 aa, Artificial Sequence
  Description of Artificial Sequence: Synthetic peptide
GSSTGAVTSGNYPN

SEQ ID NO: 2052 - protein, 14 aa, Artificial Sequence
  Description of Artificial Sequence: Synthetic peptide
GSSTGAVTSGNYPN

SEQ ID NO: 2053 - protein, 14 aa, Artificial Sequence
  Description of Artificial Sequence: Synthetic peptide
GSSTGAVTSGNYPN

SEQ ID NO: 2054 - protein, 14 aa, Artificial Sequence
  Description of Artificial Sequence: Synthetic peptide
GSSTGAVTSGNYPN

SEQ ID NO: 2055 - protein, 14 aa, Artificial Sequence
  Description of Artificial Sequence: Synthetic peptide
GSSTGAVTSGNYPN

SEQ ID NO: 2056 - protein, 14 aa, Artificial Sequence
  Description of Artificial Sequence: Synthetic peptide
GSSTGAVTSGNYPN

SEQ ID NO: 2057 - protein, 14 aa, Artificial Sequence
  Description of Artificial Sequence: Synthetic peptide
GSSTGAVTSGNYPN

SEQ ID NO: 2058 - protein, 14 aa, Artificial Sequence
  Description of Artificial Sequence: Synthetic peptide
GSSTGAVTSGNYPN

SEQ ID NO: 2059 - protein, 14 aa, Artificial Sequence
  Description of Artificial Sequence: Synthetic peptide
GSSTGAVTSGNYPN

SEQ ID NO: 2060 - protein, 14 aa, Artificial Sequence
  Description of Artificial Sequence: Synthetic peptide
GSSTGAVTSGNYPN

SEQ ID NO: 2061 - protein, 14 aa, Artificial Sequence
  Description of Artificial Sequence: Synthetic peptide
GSSTGAVTSGNYPN

SEQ ID NO: 2062 - protein, 14 aa, Artificial Sequence
  Description of Artificial Sequence: Synthetic peptide
GSSTGAVTSGNYPN

SEQ ID NO: 2063 - protein, 14 aa, Artificial Sequence
  Description of Artificial Sequence: Synthetic peptide
GSSTGAVTSGNYPN

SEQ ID NO: 2064 - protein, 14 aa, Artificial Sequence
  Description of Artificial Sequence: Synthetic peptide
GSSTGAVTSGNYPN

SEQ ID NO: 2065 - protein, 14 aa, Artificial Sequence
  Description of Artificial Sequence: Synthetic peptide
GSSTGAVTSGNYPN

SEQ ID NO: 2066 - protein, 14 aa, Artificial Sequence
  Description of Artificial Sequence: Synthetic peptide
GSSTGAVTSGNYPN

SEQ ID NO: 2067 - protein, 14 aa, Artificial Sequence
  Description of Artificial Sequence: Synthetic peptide
GSSTGAVTSGNYPN

SEQ ID NO: 2068 - protein, 14 aa, Artificial Sequence
  Description of Artificial Sequence: Synthetic peptide
GSSTGAVTSGNYPN

SEQ ID NO: 2069 - protein, 14 aa, Artificial Sequence
  Description of Artificial Sequence: Synthetic peptide
GSSTGAVTSGNYPN

SEQ ID NO: 2070 - protein, 11 aa, Artificial Sequence
  Description of Artificial Sequence: Synthetic peptide
GGNNIGSKSVH

SEQ ID NO: 2071 - protein, 11 aa, Artificial Sequence
  Description of Artificial Sequence: Synthetic peptide
GGNNIGSKSVH

SEQ ID NO: 2072 - protein, 11 aa, Artificial Sequence
  Description of Artificial Sequence: Synthetic peptide
GGNNIGSKSVH

SEQ ID NO: 2073 - protein, 11 aa, Artificial Sequence
  Description of Artificial Sequence: Synthetic peptide
GGNNIGSKSVH

SEQ ID NO: 2074 - protein, 11 aa, Artificial Sequence
  Description of Artificial Sequence: Synthetic peptide
GGNNIGSKSVH

SEQ ID NO: 2075 - protein, 5 aa, Artificial Sequence
  Description of Artificial Sequence: Synthetic peptide
SYAMS

SEQ ID NO: 2076 - protein, 5 aa, Artificial Sequence
  Description of Artificial Sequence: Synthetic peptide
SHAMS

SEQ ID NO: 2077 - protein, 5 aa, Artificial Sequence
  Description of Artificial Sequence: Synthetic peptide
SHAMS

SEQ ID NO: 2078 - protein, 5 aa, Artificial Sequence
  Description of Artificial Sequence: Synthetic peptide
SHAMS

SEQ ID NO: 2079 - protein, 5 aa, Artificial Sequence
  Description of Artificial Sequence: Synthetic peptide
SHAMS

SEQ ID NO: 2080 - protein, 5 aa, Artificial Sequence
  Description of Artificial Sequence: Synthetic peptide
SHAMS

SEQ ID NO: 2081 - protein, 5 aa, Artificial Sequence
  Description of Artificial Sequence: Synthetic peptide
SHAMS

SEQ ID NO: 2082 - protein, 5 aa, Artificial Sequence
  Description of Artificial Sequence: Synthetic peptide
SYAMS

SEQ ID NO: 2083 - protein, 5 aa, Artificial Sequence
  Description of Artificial Sequence: Synthetic peptide
SHAMS

SEQ ID NO: 2084 - protein, 5 aa, Artificial Sequence
  Description of Artificial Sequence: Synthetic peptide
SHAMS

SEQ ID NO: 2085 - protein, 5 aa, Artificial Sequence
  Description of Artificial Sequence: Synthetic peptide
SHAMS

SEQ ID NO: 2086 - protein, 5 aa, Artificial Sequence
  Description of Artificial Sequence: Synthetic peptide
SHAMS

SEQ ID NO: 2087 - protein, 5 aa, Artificial Sequence
  Description of Artificial Sequence: Synthetic peptide
SHAMS

SEQ ID NO: 2088 - protein, 5 aa, Artificial Sequence
  Description of Artificial Sequence: Synthetic peptide
SHAMS

SEQ ID NO: 2089 - protein, 5 aa, Artificial Sequence
  Description of Artificial Sequence: Synthetic peptide
GSAMH

SEQ ID NO: 2090 - protein, 5 aa, Artificial Sequence
  Description of Artificial Sequence: Synthetic peptide
KYAMN

SEQ ID NO: 2091 - protein, 5 aa, Artificial Sequence
  Description of Artificial Sequence: Synthetic peptide
KYAMN

SEQ ID NO: 2092 - protein, 5 aa, Artificial Sequence
  Description of Artificial Sequence: Synthetic peptide
KYAMN

SEQ ID NO: 2093 - protein, 5 aa, Artificial Sequence
  Description of Artificial Sequence: Synthetic peptide
KYAMN

SEQ ID NO: 2094 - protein, 5 aa, Artificial Sequence
  Description of Artificial Sequence: Synthetic peptide
KYAMN

SEQ ID NO: 2095 - protein, 5 aa, Artificial Sequence
  Description of Artificial Sequence: Synthetic peptide
KYAMN

SEQ ID NO: 2096 - protein, 5 aa, Artificial Sequence
  Description of Artificial Sequence: Synthetic peptide
KYAMN

SEQ ID NO: 2097 - protein, 5 aa, Artificial Sequence
  Description of Artificial Sequence: Synthetic peptide
KYAMN

SEQ ID NO: 2098 - protein, 5 aa, Artificial Sequence
  Description of Artificial Sequence: Synthetic peptide
KYAMN

SEQ ID NO: 2099 - protein, 5 aa, Artificial Sequence
  Description of Artificial Sequence: Synthetic peptide
KYAMN

SEQ ID NO: 2100 - protein, 5 aa, Artificial Sequence
  Description of Artificial Sequence: Synthetic peptide
KYAMN

SEQ ID NO: 2101 - protein, 5 aa, Artificial Sequence
  Description of Artificial Sequence: Synthetic peptide
KYAMN

SEQ ID NO: 2102 - protein, 5 aa, Artificial Sequence
  Description of Artificial Sequence: Synthetic peptide
KYAMN

SEQ ID NO: 2103 - protein, 5 aa, Artificial Sequence
  Description of Artificial Sequence: Synthetic peptide
KYAMN

SEQ ID NO: 2104 - protein, 5 aa, Artificial Sequence
  Description of Artificial Sequence: Synthetic peptide
KYAMN

SEQ ID NO: 2105 - protein, 5 aa, Artificial Sequence
  Description of Artificial Sequence: Synthetic peptide
KYAMN

SEQ ID NO: 2106 - protein, 5 aa, Artificial Sequence
  Description of Artificial Sequence: Synthetic peptide
KYAMN

SEQ ID NO: 2107 - protein, 5 aa, Artificial Sequence
  Description of Artificial Sequence: Synthetic peptide
KYAMN

SEQ ID NO: 2108 - protein, 5 aa, Artificial Sequence
  Description of Artificial Sequence: Synthetic peptide
KYAMN

SEQ ID NO: 2109 - protein, 5 aa, Artificial Sequence
  Description of Artificial Sequence: Synthetic peptide
KYAMN

SEQ ID NO: 2110 - protein, 5 aa, Artificial Sequence
  Description of Artificial Sequence: Synthetic peptide
KYAMN

SEQ ID NO: 2111 - protein, 5 aa, Artificial Sequence
  Description of Artificial Sequence: Synthetic peptide
KYAMN

SEQ ID NO: 2112 - protein, 5 aa, Artificial Sequence
  Description of Artificial Sequence: Synthetic peptide
KYAMN

SEQ ID NO: 2113 - protein, 5 aa, Artificial Sequence
  Description of Artificial Sequence: Synthetic peptide
KYAMN

SEQ ID NO: 2114 - protein, 5 aa, Artificial Sequence
  Description of Artificial Sequence: Synthetic peptide
KYAMN

SEQ ID NO: 2115 - protein, 5 aa, Artificial Sequence
  Description of Artificial Sequence: Synthetic peptide
KYAMN

SEQ ID NO: 2116 - protein, 5 aa, Artificial Sequence
  Description of Artificial Sequence: Synthetic peptide
KYAMN

SEQ ID NO: 2117 - protein, 5 aa, Artificial Sequence
  Description of Artificial Sequence: Synthetic peptide
KYAMN

SEQ ID NO: 2118 - protein, 5 aa, Artificial Sequence
  Description of Artificial Sequence: Synthetic peptide
KYAMN

SEQ ID NO: 2119 - protein, 5 aa, Artificial Sequence
  Description of Artificial Sequence: Synthetic peptide
KYAMN

SEQ ID NO: 2120 - protein, 5 aa, Artificial Sequence
  Description of Artificial Sequence: Synthetic peptide
KYAMN

SEQ ID NO: 2121 - protein, 5 aa, Artificial Sequence
  Description of Artificial Sequence: Synthetic peptide
KYAMN

SEQ ID NO: 2122 - protein, 5 aa, Artificial Sequence
  Description of Artificial Sequence: Synthetic peptide
KYAMN

SEQ ID NO: 2123 - protein, 5 aa, Artificial Sequence
  Description of Artificial Sequence: Synthetic peptide
KYAMN

SEQ ID NO: 2124 - protein, 5 aa, Artificial Sequence
  Description of Artificial Sequence: Synthetic peptide
KYAMN

SEQ ID NO: 2125 - protein, 5 aa, Artificial Sequence
  Description of Artificial Sequence: Synthetic peptide
KYAMN

SEQ ID NO: 2126 - protein, 7 aa, Artificial Sequence
  Description of Artificial Sequence: Synthetic peptide
TSGMRVS

SEQ ID NO: 2127 - protein, 7 aa, Artificial Sequence
  Description of Artificial Sequence: Synthetic peptide
THKMGVD

SEQ ID NO: 2128 - protein, 5 aa, Artificial Sequence
  Description of Artificial Sequence: Synthetic peptide
NAWMS

SEQ ID NO: 2129 - protein, 5 aa, Artificial Sequence
  Description of Artificial Sequence: Synthetic peptide
NAWMS

SEQ ID NO: 2130 - protein, 5 aa, Artificial Sequence
  Description of Artificial Sequence: Synthetic peptide
NAWMS

SEQ ID NO: 2131 - protein, 5 aa, Artificial Sequence
  Description of Artificial Sequence: Synthetic peptide
NAWMS

SEQ ID NO: 2132 - protein, 5 aa, Artificial Sequence
  Description of Artificial Sequence: Synthetic peptide
NAWMS

SEQ ID NO: 2133 - protein, 5 aa, Artificial Sequence
  Description of Artificial Sequence: Synthetic peptide
NAWMS

SEQ ID NO: 2134 - protein, 5 aa, Artificial Sequence
  Description of Artificial Sequence: Synthetic peptide
NAWMS

SEQ ID NO: 2135 - protein, 5 aa, Artificial Sequence
  Description of Artificial Sequence: Synthetic peptide
NAWMS

SEQ ID NO: 2136 - protein, 5 aa, Artificial Sequence
  Description of Artificial Sequence: Synthetic peptide
NAWMS

SEQ ID NO: 2137 - protein, 5 aa, Artificial Sequence
  Description of Artificial Sequence: Synthetic peptide
NAWMS

SEQ ID NO: 2138 - protein, 7 aa, Artificial Sequence
  Description of Artificial Sequence: Synthetic peptide
TSGVGVG

SEQ ID NO: 2139 - protein, 7 aa, Artificial Sequence
  Description of Artificial Sequence: Synthetic peptide
THKMGVD

SEQ ID NO: 2140 - protein, 7 aa, Artificial Sequence
  Description of Artificial Sequence: Synthetic peptide
THKMGVD

SEQ ID NO: 2141 - protein, 7 aa, Artificial Sequence
  Description of Artificial Sequence: Synthetic peptide
THKMGVD

SEQ ID NO: 2142 - protein, 7 aa, Artificial Sequence
  Description of Artificial Sequence: Synthetic peptide
THKMGVD

SEQ ID NO: 2143 - protein, 7 aa, Artificial Sequence
  Description of Artificial Sequence: Synthetic peptide
THKMGVD

SEQ ID NO: 2144 - protein, 7 aa, Artificial Sequence
  Description of Artificial Sequence: Synthetic peptide
THKMGVD

SEQ ID NO: 2145 - protein, 7 aa, Artificial Sequence
  Description of Artificial Sequence: Synthetic peptide
THKMGVD

SEQ ID NO: 2146 - protein, 7 aa, Artificial Sequence
  Description of Artificial Sequence: Synthetic peptide
THKMGVD

SEQ ID NO: 2147 - protein, 5 aa, Artificial Sequence
  Description of Artificial Sequence: Synthetic peptide
SYYWS

SEQ ID NO: 2148 - protein, 7 aa, Artificial Sequence
  Description of Artificial Sequence: Synthetic peptide
SSRYYWG

SEQ ID NO: 2149 - protein, 5 aa, Artificial Sequence
  Description of Artificial Sequence: Synthetic peptide
SYAMH

SEQ ID NO: 2150 - protein, 5 aa, Artificial Sequence
  Description of Artificial Sequence: Synthetic peptide
TYGMH

SEQ ID NO: 2151 - protein, 5 aa, Artificial Sequence
  Description of Artificial Sequence: Synthetic peptide
TYGMH

SEQ ID NO: 2152 - protein, 5 aa, Artificial Sequence
  Description of Artificial Sequence: Synthetic peptide
DYYMS

SEQ ID NO: 2153 - protein, 5 aa, Artificial Sequence
  Description of Artificial Sequence: Synthetic peptide
DYYMS

SEQ ID NO: 2154 - protein, 7 aa, Artificial Sequence
  Description of Artificial Sequence: Synthetic peptide
SGGYYWS

SEQ ID NO: 2155 - protein, 7 aa, Artificial Sequence
  Description of Artificial Sequence: Synthetic peptide
SNPYYWS

SEQ ID NO: 2156 - protein, 15 aa, Artificial Sequence
  Description of Artificial Sequence: Synthetic peptide
WYQQKPGKAPKLLIY

SEQ ID NO: 2157 - protein, 15 aa, Artificial Sequence
  Description of Artificial Sequence: Synthetic peptide
WYQQKPGKAPKLLIY

SEQ ID NO: 2158 - protein, 15 aa, Artificial Sequence
  Description of Artificial Sequence: Synthetic peptide
WYQQKPGRAPKLLIF

SEQ ID NO: 2159 - protein, 15 aa, Artificial Sequence
  Description of Artificial Sequence: Synthetic peptide
WYQQKPGKAPKLLIY

SEQ ID NO: 2160 - protein, 15 aa, Artificial Sequence
  Description of Artificial Sequence: Synthetic peptide
WYQQKPGKAPKLLIY

SEQ ID NO: 2161 - protein, 15 aa, Artificial Sequence
  Description of Artificial Sequence: Synthetic peptide
WYQQKPGKAPKLLIY

SEQ ID NO: 2162 - protein, 15 aa, Artificial Sequence
  Description of Artificial Sequence: Synthetic peptide
WYQQKPGKAPKLLIY

SEQ ID NO: 2163 - protein, 15 aa, Artificial Sequence
  Description of Artificial Sequence: Synthetic peptide
WYQQKPGKAPKLLIY

SEQ ID NO: 2164 - protein, 15 aa, Artificial Sequence
  Description of Artificial Sequence: Synthetic peptide
WYQQKPGKAPKLLIY

SEQ ID NO: 2165 - protein, 15 aa, Artificial Sequence
  Description of Artificial Sequence: Synthetic peptide
WYQQKPGKAPKLLIY

SEQ ID NO: 2166 - protein, 15 aa, Artificial Sequence
  Description of Artificial Sequence: Synthetic peptide
WYQQKPGKAPKLLIY

SEQ ID NO: 2167 - protein, 15 aa, Artificial Sequence
  Description of Artificial Sequence: Synthetic peptide
WYQQKPGRAPKLLIF

SEQ ID NO: 2168 - protein, 15 aa, Artificial Sequence
  Description of Artificial Sequence: Synthetic peptide
WYQQKPGKAPKLLIY

SEQ ID NO: 2169 - protein, 15 aa, Artificial Sequence
  Description of Artificial Sequence: Synthetic peptide
WYQQKPGRAPKLLIF

SEQ ID NO: 2170 - protein, 15 aa, Artificial Sequence
  Description of Artificial Sequence: Synthetic peptide
WYQQKPGRAPKLLIF

SEQ ID NO: 2171 - protein, 15 aa, Artificial Sequence
  Description of Artificial Sequence: Synthetic peptide
WYQQKPGKAPKLLIY

SEQ ID NO: 2172 - protein, 15 aa, Artificial Sequence
  Description of Artificial Sequence: Synthetic peptide
WYQQKPGRAPKLLIF

SEQ ID NO: 2173 - protein, 15 aa, Artificial Sequence
  Description of Artificial Sequence: Synthetic peptide
WYQQKPGRAPKLLIF

SEQ ID NO: 2174 - protein, 15 aa, Artificial Sequence
  Description of Artificial Sequence: Synthetic peptide
WFQQKPGKAPKLLIF

SEQ ID NO: 2175 - protein, 15 aa, Artificial Sequence
  Description of Artificial Sequence: Synthetic peptide
WYQQKPGRAPKLLIF

SEQ ID NO: 2176 - protein, 15 aa, Artificial Sequence
  Description of Artificial Sequence: Synthetic peptide
WYQQKPGRAPKLLIF

SEQ ID NO: 2177 - protein, 15 aa, Artificial Sequence
  Description of Artificial Sequence: Synthetic peptide
WYQQKPGQPPKLLIY

SEQ ID NO: 2178 - protein, 15 aa, Artificial Sequence
  Description of Artificial Sequence: Synthetic peptide
WYQQKPGQPPKLLIY

SEQ ID NO: 2179 - protein, 15 aa, Artificial Sequence
  Description of Artificial Sequence: Synthetic peptide
WYQQKPGKVPKLLIY

SEQ ID NO: 2180 - protein, 15 aa, Artificial Sequence
  Description of Artificial Sequence: Synthetic peptide
WYQQKPGKVPKLLIY

SEQ ID NO: 2181 - protein, 15 aa, Artificial Sequence
  Description of Artificial Sequence: Synthetic peptide
WYQQKPGKVPKLLIY

SEQ ID NO: 2182 - protein, 15 aa, Artificial Sequence
  Description of Artificial Sequence: Synthetic peptide
WYLQKPGQSPQLLIY

SEQ ID NO: 2183 - protein, 15 aa, Artificial Sequence
  Description of Artificial Sequence: Synthetic peptide
WYLQKPGQSPQLLIY

SEQ ID NO: 2184 - protein, 15 aa, Artificial Sequence
  Description of Artificial Sequence: Synthetic peptide
WYQQKPGQAPVLVIY

SEQ ID NO: 2185 - protein, 15 aa, Artificial Sequence
  Description of Artificial Sequence: Synthetic peptide
WYQQKPGQAPVMVVY

SEQ ID NO: 2186 - protein, 15 aa, Artificial Sequence
  Description of Artificial Sequence: Synthetic peptide
WYQQKPGQAPVMVVY

SEQ ID NO: 2187 - protein, 15 aa, Artificial Sequence
  Description of Artificial Sequence: Synthetic peptide
WYQQKPGQAPVMVVY

SEQ ID NO: 2188 - protein, 15 aa, Artificial Sequence
  Description of Artificial Sequence: Synthetic peptide
WYQQKPGQAPVMVVY

SEQ ID NO: 2189 - protein, 15 aa, Artificial Sequence
  Description of Artificial Sequence: Synthetic peptide
WYQQKPGQAPVLVVY

SEQ ID NO: 2190 - protein, 15 aa, Artificial Sequence
  Description of Artificial Sequence: Synthetic peptide
WYQQKPGQAPVMVVY

SEQ ID NO: 2191 - protein, 15 aa, Artificial Sequence
  Description of Artificial Sequence: Synthetic peptide
WYQQKPGQAPVMVVY

SEQ ID NO: 2192 - protein, 15 aa, Artificial Sequence
  Description of Artificial Sequence: Synthetic peptide
WYQQKPGQAPVLVVY

SEQ ID NO: 2193 - protein, 15 aa, Artificial Sequence
  Description of Artificial Sequence: Synthetic peptide
WYQQKPGQAPVMVVY

SEQ ID NO: 2194 - protein, 15 aa, Artificial Sequence
  Description of Artificial Sequence: Synthetic peptide
WYQQKPGQAPVMVVY

SEQ ID NO: 2195 - protein, 15 aa, Artificial Sequence
  Description of Artificial Sequence: Synthetic peptide
WFQQKPGQAPRALIY

SEQ ID NO: 2196 - protein, 15 aa, Artificial Sequence
  Description of Artificial Sequence: Synthetic peptide
WVQQKPGQAPRGLIG

SEQ ID NO: 2197 - protein, 15 aa, Artificial Sequence
  Description of Artificial Sequence: Synthetic peptide
WVQQKPGQAPRGLIG

SEQ ID NO: 2198 - protein, 15 aa, Artificial Sequence
  Description of Artificial Sequence: Synthetic peptide
WVQQKPGQAPRGLIG

SEQ ID NO: 2199 - protein, 15 aa, Artificial Sequence
  Description of Artificial Sequence: Synthetic peptide
WVQQKPGQAPRGLIG

SEQ ID NO: 2200 - protein, 15 aa, Artificial Sequence
  Description of Artificial Sequence: Synthetic peptide
WVQQKPGQAPRGLIG

SEQ ID NO: 2201 - protein, 15 aa, Artificial Sequence
  Description of Artificial Sequence: Synthetic peptide
WVQQKPGQAPRGLIG

SEQ ID NO: 2202 - protein, 15 aa, Artificial Sequence
  Description of Artificial Sequence: Synthetic peptide
WVQQKPGQAPRGLIG

SEQ ID NO: 2203 - protein, 15 aa, Artificial Sequence
  Description of Artificial Sequence: Synthetic peptide
WVQQKPGQAPRGLIG

SEQ ID NO: 2204 - protein, 15 aa, Artificial Sequence
  Description of Artificial Sequence: Synthetic peptide
WVQQKPGQAPRGLIG

SEQ ID NO: 2205 - protein, 15 aa, Artificial Sequence
  Description of Artificial Sequence: Synthetic peptide
WVQQKPGQAPRGLIG

SEQ ID NO: 2206 - protein, 15 aa, Artificial Sequence
  Description of Artificial Sequence: Synthetic peptide
WVQQKPGQAPRGLIG

SEQ ID NO: 2207 - protein, 15 aa, Artificial Sequence
  Description of Artificial Sequence: Synthetic peptide
WVQQKPGQAPRGLIG

SEQ ID NO: 2208 - protein, 15 aa, Artificial Sequence
  Description of Artificial Sequence: Synthetic peptide
WVQQKPGQAPRGLIG

SEQ ID NO: 2209 - protein, 15 aa, Artificial Sequence
  Description of Artificial Sequence: Synthetic peptide
WVQQKPGQAPRGLIG

SEQ ID NO: 2210 - protein, 15 aa, Artificial Sequence
  Description of Artificial Sequence: Synthetic peptide
WVQQKPGQAPRGLIG

SEQ ID NO: 2211 - protein, 15 aa, Artificial Sequence
  Description of Artificial Sequence: Synthetic peptide
WVQQKPGQAPRGLIG

SEQ ID NO: 2212 - protein, 15 aa, Artificial Sequence
  Description of Artificial Sequence: Synthetic peptide
WVQQKPGQAPRGLIG

SEQ ID NO: 2213 - protein, 15 aa, Artificial Sequence
  Description of Artificial Sequence: Synthetic peptide
WVQQKPGQAPRGLIG

SEQ ID NO: 2214 - protein, 15 aa, Artificial Sequence
  Description of Artificial Sequence: Synthetic peptide
WVQQKPGQAPRGLIG

SEQ ID NO: 2215 - protein, 15 aa, Artificial Sequence
  Description of Artificial Sequence: Synthetic peptide
WVQQKPGQAPRGLIG

SEQ ID NO: 2216 - protein, 15 aa, Artificial Sequence
  Description of Artificial Sequence: Synthetic peptide
WVQQKPGQAPRGLIG

SEQ ID NO: 2217 - protein, 15 aa, Artificial Sequence
  Description of Artificial Sequence: Synthetic peptide
WVQQKPGQAPRGLIG

SEQ ID NO: 2218 - protein, 15 aa, Artificial Sequence
  Description of Artificial Sequence: Synthetic peptide
WVQQKPGQAPRGLIG

SEQ ID NO: 2219 - protein, 15 aa, Artificial Sequence
  Description of Artificial Sequence: Synthetic peptide
WVQQKPGQAPRGLIG

SEQ ID NO: 2220 - protein, 15 aa, Artificial Sequence
  Description of Artificial Sequence: Synthetic peptide
WVQQKPGQAPRGLIG

SEQ ID NO: 2221 - protein, 15 aa, Artificial Sequence
  Description of Artificial Sequence: Synthetic peptide
WVQQKPGQAPRGLIG

SEQ ID NO: 2222 - protein, 15 aa, Artificial Sequence
  Description of Artificial Sequence: Synthetic peptide
WVQQKPGQAPRGLIG

SEQ ID NO: 2223 - protein, 15 aa, Artificial Sequence
  Description of Artificial Sequence: Synthetic peptide
WVQQKPGQAPRGLIG

SEQ ID NO: 2224 - protein, 15 aa, Artificial Sequence
  Description of Artificial Sequence: Synthetic peptide
WVQQKPGQAPRGLIG

SEQ ID NO: 2225 - protein, 15 aa, Artificial Sequence
  Description of Artificial Sequence: Synthetic peptide
WVQQKPGQAPRGLIG

SEQ ID NO: 2226 - protein, 15 aa, Artificial Sequence
  Description of Artificial Sequence: Synthetic peptide
WVQQKPGQAPRGLIG

SEQ ID NO: 2227 - protein, 15 aa, Artificial Sequence
  Description of Artificial Sequence: Synthetic peptide
WVQQKPGQAPRGLIG

SEQ ID NO: 2228 - protein, 15 aa, Artificial Sequence
  Description of Artificial Sequence: Synthetic peptide
WVQQKPGQAPRGLIG

SEQ ID NO: 2229 - protein, 15 aa, Artificial Sequence
  Description of Artificial Sequence: Synthetic peptide
WVQQKPGQAPRGLIG

SEQ ID NO: 2230 - protein, 15 aa, Artificial Sequence
  Description of Artificial Sequence: Synthetic peptide
WVQQKPGQAPRGLIG

SEQ ID NO: 2231 - protein, 15 aa, Artificial Sequence
  Description of Artificial Sequence: Synthetic peptide
WVQQKPGQAPRGLIG

SEQ ID NO: 2232 - protein, 15 aa, Artificial Sequence
  Description of Artificial Sequence: Synthetic peptide
WYQQKPGQAPVLVIY

SEQ ID NO: 2233 - protein, 15 aa, Artificial Sequence
  Description of Artificial Sequence: Synthetic peptide
WYQQKPGQAPVMVVY

SEQ ID NO: 2234 - protein, 15 aa, Artificial Sequence
  Description of Artificial Sequence: Synthetic peptide
WYQQKPGQAPVMVVY

SEQ ID NO: 2235 - protein, 15 aa, Artificial Sequence
  Description of Artificial Sequence: Synthetic peptide
WYQQKPGQAPVMVVY

SEQ ID NO: 2236 - protein, 15 aa, Artificial Sequence
  Description of Artificial Sequence: Synthetic peptide
WYQQKPGQAPVMVVY

SEQ ID NO: 2237 - protein, 14 aa, Artificial Sequence
  Description of Artificial Sequence: Synthetic peptide
WVRQAPGKGLEWVS

SEQ ID NO: 2238 - protein, 14 aa, Artificial Sequence
  Description of Artificial Sequence: Synthetic peptide
WVRQAPGKCLEWVS

SEQ ID NO: 2239 - protein, 14 aa, Artificial Sequence
  Description of Artificial Sequence: Synthetic peptide
WVRQAPGKCLEWVS

SEQ ID NO: 2240 - protein, 14 aa, Artificial Sequence
  Description of Artificial Sequence: Synthetic peptide
WVRQAPGKCLEWVS

SEQ ID NO: 2241 - protein, 14 aa, Artificial Sequence
  Description of Artificial Sequence: Synthetic peptide
WVRQAPGKCLEWVS

SEQ ID NO: 2242 - protein, 14 aa, Artificial Sequence
  Description of Artificial Sequence: Synthetic peptide
WVRQAPGKCLEWVS

SEQ ID NO: 2243 - protein, 14 aa, Artificial Sequence
  Description of Artificial Sequence: Synthetic peptide
WVRQAPGKCLEWVS

SEQ ID NO: 2244 - protein, 14 aa, Artificial Sequence
  Description of Artificial Sequence: Synthetic peptide
WVRQAPGKCLEWVS

SEQ ID NO: 2245 - protein, 14 aa, Artificial Sequence
  Description of Artificial Sequence: Synthetic peptide
WVRQAPGKCLEWVS

SEQ ID NO: 2246 - protein, 14 aa, Artificial Sequence
  Description of Artificial Sequence: Synthetic peptide
WVRQAPGKCLEWVS

SEQ ID NO: 2247 - protein, 14 aa, Artificial Sequence
  Description of Artificial Sequence: Synthetic peptide
WVRQAPGKCLEWVS

SEQ ID NO: 2248 - protein, 14 aa, Artificial Sequence
  Description of Artificial Sequence: Synthetic peptide
WVRQAPGKCLEWVS

SEQ ID NO: 2249 - protein, 14 aa, Artificial Sequence
  Description of Artificial Sequence: Synthetic peptide
WVRQAPGKCLEWVS

SEQ ID NO: 2250 - protein, 14 aa, Artificial Sequence
  Description of Artificial Sequence: Synthetic peptide
WVRQAPGKCLEWVS

SEQ ID NO: 2251 - protein, 14 aa, Artificial Sequence
  Description of Artificial Sequence: Synthetic peptide
WVRQASGKGLEWVG

SEQ ID NO: 2252 - protein, 14 aa, Artificial Sequence
  Description of Artificial Sequence: Synthetic peptide
WVRQAPGKGLEWVA

SEQ ID NO: 2253 - protein, 14 aa, Artificial Sequence
  Description of Artificial Sequence: Synthetic peptide
WVRQAPGKGLEWVA

SEQ ID NO: 2254 - protein, 14 aa, Artificial Sequence
  Description of Artificial Sequence: Synthetic peptide
WVRQAPGKGLEWVA

SEQ ID NO: 2255 - protein, 14 aa, Artificial Sequence
  Description of Artificial Sequence: Synthetic peptide
WVRQAPGKGLEWVA

SEQ ID NO: 2256 - protein, 14 aa, Artificial Sequence
  Description of Artificial Sequence: Synthetic peptide
WVRQAPGKGLEWVA

SEQ ID NO: 2257 - protein, 14 aa, Artificial Sequence
  Description of Artificial Sequence: Synthetic peptide
WVRQAPGKGLEWVA

SEQ ID NO: 2258 - protein, 14 aa, Artificial Sequence
  Description of Artificial Sequence: Synthetic peptide
WVRQAPGKGLEWVA

SEQ ID NO: 2259 - protein, 14 aa, Artificial Sequence
  Description of Artificial Sequence: Synthetic peptide
WVRQAPGKGLEWVA

SEQ ID NO: 2260 - protein, 14 aa, Artificial Sequence
  Description of Artificial Sequence: Synthetic peptide
WVRQAPGKGLEWVA

SEQ ID NO: 2261 - protein, 14 aa, Artificial Sequence
  Description of Artificial Sequence: Synthetic peptide
WVRQAPGKGLEWVA

SEQ ID NO: 2262 - protein, 14 aa, Artificial Sequence
  Description of Artificial Sequence: Synthetic peptide
WVRQAPGKGLEWVA

SEQ ID NO: 2263 - protein, 14 aa, Artificial Sequence
  Description of Artificial Sequence: Synthetic peptide
WVRQAPGKGLEWVA

SEQ ID NO: 2264 - protein, 14 aa, Artificial Sequence
  Description of Artificial Sequence: Synthetic peptide
WVRQAPGKGLEWVA

SEQ ID NO: 2265 - protein, 14 aa, Artificial Sequence
  Description of Artificial Sequence: Synthetic peptide
WVRQAPGKGLEWVA

SEQ ID NO: 2266 - protein, 14 aa, Artificial Sequence
  Description of Artificial Sequence: Synthetic peptide
WVRQAPGKGLEWVA

SEQ ID NO: 2267 - protein, 14 aa, Artificial Sequence
  Description of Artificial Sequence: Synthetic peptide
WVRQAPGKGLEWVA

SEQ ID NO: 2268 - protein, 14 aa, Artificial Sequence
  Description of Artificial Sequence: Synthetic peptide
WVRQAPGKGLEWVA

SEQ ID NO: 2269 - protein, 14 aa, Artificial Sequence
  Description of Artificial Sequence: Synthetic peptide
WVRQAPGKGLEWVA

SEQ ID NO: 2270 - protein, 14 aa, Artificial Sequence
  Description of Artificial Sequence: Synthetic peptide
WVRQAPGKGLEWVA

SEQ ID NO: 2271 - protein, 14 aa, Artificial Sequence
  Description of Artificial Sequence: Synthetic peptide
WVRQAPGKGLEWVA

SEQ ID NO: 2272 - protein, 14 aa, Artificial Sequence
  Description of Artificial Sequence: Synthetic peptide
WVRQAPGKGLEWVA

SEQ ID NO: 2273 - protein, 14 aa, Artificial Sequence
  Description of Artificial Sequence: Synthetic peptide
WVRQAPGKGLEWVA

SEQ ID NO: 2274 - protein, 14 aa, Artificial Sequence
  Description of Artificial Sequence: Synthetic peptide
WVRQAPGKGLEWVA

SEQ ID NO: 2275 - protein, 14 aa, Artificial Sequence
  Description of Artificial Sequence: Synthetic peptide
WVRQAPGKGLEWVA

SEQ ID NO: 2276 - protein, 14 aa, Artificial Sequence
  Description of Artificial Sequence: Synthetic peptide
WVRQAPGKGLEWVA

SEQ ID NO: 2277 - protein, 14 aa, Artificial Sequence
  Description of Artificial Sequence: Synthetic peptide
WVRQAPGKGLEWVA

SEQ ID NO: 2278 - protein, 14 aa, Artificial Sequence
  Description of Artificial Sequence: Synthetic peptide
WVRQAPGKGLEWVA

SEQ ID NO: 2279 - protein, 14 aa, Artificial Sequence
  Description of Artificial Sequence: Synthetic peptide
WVRQAPGKGLEWVA

SEQ ID NO: 2280 - protein, 14 aa, Artificial Sequence
  Description of Artificial Sequence: Synthetic peptide
WVRQAPGKGLEWVA

SEQ ID NO: 2281 - protein, 14 aa, Artificial Sequence
  Description of Artificial Sequence: Synthetic peptide
WVRQAPGKGLEWVA

SEQ ID NO: 2282 - protein, 14 aa, Artificial Sequence
  Description of Artificial Sequence: Synthetic peptide
WVRQAPGKGLEWVA

SEQ ID NO: 2283 - protein, 14 aa, Artificial Sequence
  Description of Artificial Sequence: Synthetic peptide
WVRQAPGKGLEWVA

SEQ ID NO: 2284 - protein, 14 aa, Artificial Sequence
  Description of Artificial Sequence: Synthetic peptide
WVRQAPGKGLEWVA

SEQ ID NO: 2285 - protein, 14 aa, Artificial Sequence
  Description of Artificial Sequence: Synthetic peptide
WVRQAPGKGLEWVA

SEQ ID NO: 2286 - protein, 14 aa, Artificial Sequence
  Description of Artificial Sequence: Synthetic peptide
WVRQAPGKGLEWVA

SEQ ID NO: 2287 - protein, 14 aa, Artificial Sequence
  Description of Artificial Sequence: Synthetic peptide
WVRQAPGKGLEWVA

SEQ ID NO: 2288 - protein, 14 aa, Artificial Sequence
  Description of Artificial Sequence: Synthetic peptide
WIRQPPGKALEWLA

SEQ ID NO: 2289 - protein, 14 aa, Artificial Sequence
  Description of Artificial Sequence: Synthetic peptide
WIRQPPGKCLEWLA

SEQ ID NO: 2290 - protein, 14 aa, Artificial Sequence
  Description of Artificial Sequence: Synthetic peptide
WVRQAPGKGLEWVG

SEQ ID NO: 2291 - protein, 14 aa, Artificial Sequence
  Description of Artificial Sequence: Synthetic peptide
WVRQAPGKCLEWVG

SEQ ID NO: 2292 - protein, 14 aa, Artificial Sequence
  Description of Artificial Sequence: Synthetic peptide
WVRQAPGKCLEWVG

SEQ ID NO: 2293 - protein, 14 aa, Artificial Sequence
  Description of Artificial Sequence: Synthetic peptide
WVRQAPGKCLEWVG

SEQ ID NO: 2294 - protein, 14 aa, Artificial Sequence
  Description of Artificial Sequence: Synthetic peptide
WVRQAPGKCLEWVG

SEQ ID NO: 2295 - protein, 14 aa, Artificial Sequence
  Description of Artificial Sequence: Synthetic peptide
WVRQAPGKCLEWVG

SEQ ID NO: 2296 - protein, 14 aa, Artificial Sequence
  Description of Artificial Sequence: Synthetic peptide
WVRQAPGKCLEWVG

SEQ ID NO: 2297 - protein, 14 aa, Artificial Sequence
  Description of Artificial Sequence: Synthetic peptide
WVRQAPGKCLEWVG

SEQ ID NO: 2298 - protein, 14 aa, Artificial Sequence
  Description of Artificial Sequence: Synthetic peptide
WVRQAPGKCLEWVG

SEQ ID NO: 2299 - protein, 14 aa, Artificial Sequence
  Description of Artificial Sequence: Synthetic peptide
WVRQAPGKCLEWVG

SEQ ID NO: 2300 - protein, 14 aa, Artificial Sequence
  Description of Artificial Sequence: Synthetic peptide
WIRQPPGKALEWLA

SEQ ID NO: 2301 - protein, 14 aa, Artificial Sequence
  Description of Artificial Sequence: Synthetic peptide
WIRQPPGKCLEWLA

SEQ ID NO: 2302 - protein, 14 aa, Artificial Sequence
  Description of Artificial Sequence: Synthetic peptide
WIRQPPGKCLEWLA

SEQ ID NO: 2303 - protein, 14 aa, Artificial Sequence
  Description of Artificial Sequence: Synthetic peptide
WIRQPPGKCLEWLA

SEQ ID NO: 2304 - protein, 14 aa, Artificial Sequence
  Description of Artificial Sequence: Synthetic peptide
WIRQPPGKCLEWLA

SEQ ID NO: 2305 - protein, 14 aa, Artificial Sequence
  Description of Artificial Sequence: Synthetic peptide
WIRQPPGKCLEWLA

SEQ ID NO: 2306 - protein, 14 aa, Artificial Sequence
  Description of Artificial Sequence: Synthetic peptide
WIRQPPGKCLEWLA

SEQ ID NO: 2307 - protein, 14 aa, Artificial Sequence
  Description of Artificial Sequence: Synthetic peptide
WIRQPPGKCLEWLA

SEQ ID NO: 2308 - protein, 14 aa, Artificial Sequence
  Description of Artificial Sequence: Synthetic peptide
WIRQPPGKCLEWLA

SEQ ID NO: 2309 - protein, 14 aa, Artificial Sequence
  Description of Artificial Sequence: Synthetic peptide
WIRQPPGKGLEWIG

SEQ ID NO: 2310 - protein, 14 aa, Artificial Sequence
  Description of Artificial Sequence: Synthetic peptide
WIRQPPGKCLEWIG

SEQ ID NO: 2311 - protein, 14 aa, Artificial Sequence
  Description of Artificial Sequence: Synthetic peptide
WVRQAPGKGLEWVA

SEQ ID NO: 2312 - protein, 14 aa, Artificial Sequence
  Description of Artificial Sequence: Synthetic peptide
WVRQAPGKCLEWVA

SEQ ID NO: 2313 - protein, 14 aa, Artificial Sequence
  Description of Artificial Sequence: Synthetic peptide
WVRQAPGKCLEWVA

SEQ ID NO: 2314 - protein, 14 aa, Artificial Sequence
  Description of Artificial Sequence: Synthetic peptide
WIRQAPGKGLEWVS

SEQ ID NO: 2315 - protein, 14 aa, Artificial Sequence
  Description of Artificial Sequence: Synthetic peptide
WIRQAPGKCLEWVS

SEQ ID NO: 2316 - protein, 14 aa, Artificial Sequence
  Description of Artificial Sequence: Synthetic peptide
WIRQHPGKGLEWIG

SEQ ID NO: 2317 - protein, 14 aa, Artificial Sequence
  Description of Artificial Sequence: Synthetic peptide
WIRQHPGKCLEWIG

SEQ ID NO: 2318 - protein, 7 aa, Artificial Sequence
  Description of Artificial Sequence: Synthetic peptide
AASSLQS

SEQ ID NO: 2319 - protein, 7 aa, Artificial Sequence
  Description of Artificial Sequence: Synthetic peptide
AASSLQS

SEQ ID NO: 2320 - protein, 7 aa, Artificial Sequence
  Description of Artificial Sequence: Synthetic peptide
AASSLQG

SEQ ID NO: 2321 - protein, 7 aa, Artificial Sequence
  Description of Artificial Sequence: Synthetic peptide
AASSLQS

SEQ ID NO: 2322 - protein, 7 aa, Artificial Sequence
  Description of Artificial Sequence: Synthetic peptide
AASSLQS

SEQ ID NO: 2323 - protein, 7 aa, Artificial Sequence
  Description of Artificial Sequence: Synthetic peptide
AASSLQS

SEQ ID NO: 2324 - protein, 7 aa, Artificial Sequence
  Description of Artificial Sequence: Synthetic peptide
AASSLQS

SEQ ID NO: 2325 - protein, 7 aa, Artificial Sequence
  Description of Artificial Sequence: Synthetic peptide
AASSLQS

SEQ ID NO: 2326 - protein, 7 aa, Artificial Sequence
  Description of Artificial Sequence: Synthetic peptide
AASSLQS

SEQ ID NO: 2327 - protein, 7 aa, Artificial Sequence
  Description of Artificial Sequence: Synthetic peptide
AASSLQS

SEQ ID NO: 2328 - protein, 7 aa, Artificial Sequence
  Description of Artificial Sequence: Synthetic peptide
AASSLQS

SEQ ID NO: 2329 - protein, 7 aa, Artificial Sequence
  Description of Artificial Sequence: Synthetic peptide
AASSLQG

SEQ ID NO: 2330 - protein, 7 aa, Artificial Sequence
  Description of Artificial Sequence: Synthetic peptide
AASSLQS

SEQ ID NO: 2331 - protein, 7 aa, Artificial Sequence
  Description of Artificial Sequence: Synthetic peptide
AASSLQG

SEQ ID NO: 2332 - protein, 7 aa, Artificial Sequence
  Description of Artificial Sequence: Synthetic peptide
AASSLQG

SEQ ID NO: 2333 - protein, 7 aa, Artificial Sequence
  Description of Artificial Sequence: Synthetic peptide
AASSLQS

SEQ ID NO: 2334 - protein, 7 aa, Artificial Sequence
  Description of Artificial Sequence: Synthetic peptide
AASSLQG

SEQ ID NO: 2335 - protein, 7 aa, Artificial Sequence
  Description of Artificial Sequence: Synthetic peptide
AASSLQG

SEQ ID NO: 2336 - protein, 7 aa, Artificial Sequence
  Description of Artificial Sequence: Synthetic peptide
AASSLQS

SEQ ID NO: 2337 - protein, 7 aa, Artificial Sequence
  Description of Artificial Sequence: Synthetic peptide
AASSLQG

SEQ ID NO: 2338 - protein, 7 aa, Artificial Sequence
  Description of Artificial Sequence: Synthetic peptide
AASSLQS

SEQ ID NO: 2339 - protein, 7 aa, Artificial Sequence
  Description of Artificial Sequence: Synthetic peptide
WASTRES

SEQ ID NO: 2340 - protein, 7 aa, Artificial Sequence
  Description of Artificial Sequence: Synthetic peptide
WASTRES

SEQ ID NO: 2341 - protein, 7 aa, Artificial Sequence
  Description of Artificial Sequence: Synthetic peptide
AASTLQS

SEQ ID NO: 2342 - protein, 7 aa, Artificial Sequence
  Description of Artificial Sequence: Synthetic peptide
AASTLQS

SEQ ID NO: 2343 - protein, 7 aa, Artificial Sequence
  Description of Artificial Sequence: Synthetic peptide
AASTLQS

SEQ ID NO: 2344 - protein, 7 aa, Artificial Sequence
  Description of Artificial Sequence: Synthetic peptide
TLSYRAS

SEQ ID NO: 2345 - protein, 7 aa, Artificial Sequence
  Description of Artificial Sequence: Synthetic peptide
LGSNRAS

SEQ ID NO: 2346 - protein, 7 aa, Artificial Sequence
  Description of Artificial Sequence: Synthetic peptide
YDSDRPS

SEQ ID NO: 2347 - protein, 7 aa, Artificial Sequence
  Description of Artificial Sequence: Synthetic peptide
DDNDRPS

SEQ ID NO: 2348 - protein, 7 aa, Artificial Sequence
  Description of Artificial Sequence: Synthetic peptide
DDNDRPS

SEQ ID NO: 2349 - protein, 7 aa, Artificial Sequence
  Description of Artificial Sequence: Synthetic peptide
DDNDRPS

SEQ ID NO: 2350 - protein, 7 aa, Artificial Sequence
  Description of Artificial Sequence: Synthetic peptide
DDNDRPS

SEQ ID NO: 2351 - protein, 7 aa, Artificial Sequence
  Description of Artificial Sequence: Synthetic peptide
DDNDRPS

SEQ ID NO: 2352 - protein, 7 aa, Artificial Sequence
  Description of Artificial Sequence: Synthetic peptide
DDNDRPS

SEQ ID NO: 2353 - protein, 7 aa, Artificial Sequence
  Description of Artificial Sequence: Synthetic peptide
DDNDRPS

SEQ ID NO: 2354 - protein, 7 aa, Artificial Sequence
  Description of Artificial Sequence: Synthetic peptide
DDADRPS

SEQ ID NO: 2355 - protein, 7 aa, Artificial Sequence
  Description of Artificial Sequence: Synthetic peptide
DDNDRPS

SEQ ID NO: 2356 - protein, 7 aa, Artificial Sequence
  Description of Artificial Sequence: Synthetic peptide
DDNDRPS

SEQ ID NO: 2357 - protein, 7 aa, Artificial Sequence
  Description of Artificial Sequence: Synthetic peptide
STSNKHS

SEQ ID NO: 2358 - protein, 7 aa, Artificial Sequence
  Description of Artificial Sequence: Synthetic peptide
GTKFLAP

SEQ ID NO: 2359 - protein, 7 aa, Artificial Sequence
  Description of Artificial Sequence: Synthetic peptide
GTKFLAP

SEQ ID NO: 2360 - protein, 7 aa, Artificial Sequence
  Description of Artificial Sequence: Synthetic peptide
GTKFLAP

SEQ ID NO: 2361 - protein, 7 aa, Artificial Sequence
  Description of Artificial Sequence: Synthetic peptide
GTKFLAP

SEQ ID NO: 2362 - protein, 7 aa, Artificial Sequence
  Description of Artificial Sequence: Synthetic peptide
GTKFLAP

SEQ ID NO: 2363 - protein, 7 aa, Artificial Sequence
  Description of Artificial Sequence: Synthetic peptide
GTKFLAP

SEQ ID NO: 2364 - protein, 7 aa, Artificial Sequence
  Description of Artificial Sequence: Synthetic peptide
GTKFLAP

SEQ ID NO: 2365 - protein, 7 aa, Artificial Sequence
  Description of Artificial Sequence: Synthetic peptide
GTKFLAP

SEQ ID NO: 2366 - protein, 7 aa, Artificial Sequence
  Description of Artificial Sequence: Synthetic peptide
GTKFLAP

SEQ ID NO: 2367 - protein, 7 aa, Artificial Sequence
  Description of Artificial Sequence: Synthetic peptide
GTKFLAP

SEQ ID NO: 2368 - protein, 7 aa, Artificial Sequence
  Description of Artificial Sequence: Synthetic peptide
GTKFLAP

SEQ ID NO: 2369 - protein, 7 aa, Artificial Sequence
  Description of Artificial Sequence: Synthetic peptide
GTKFLAP

SEQ ID NO: 2370 - protein, 7 aa, Artificial Sequence
  Description of Artificial Sequence: Synthetic peptide
GTKFLAP

SEQ ID NO: 2371 - protein, 7 aa, Artificial Sequence
  Description of Artificial Sequence: Synthetic peptide
GTKFLAP

SEQ ID NO: 2372 - protein, 7 aa, Artificial Sequence
  Description of Artificial Sequence: Synthetic peptide
GTKFLAP

SEQ ID NO: 2373 - protein, 7 aa, Artificial Sequence
  Description of Artificial Sequence: Synthetic peptide
GTKFLAP

SEQ ID NO: 2374 - protein, 7 aa, Artificial Sequence
  Description of Artificial Sequence: Synthetic peptide
GTKFLAP

SEQ ID NO: 2375 - protein, 7 aa, Artificial Sequence
  Description of Artificial Sequence: Synthetic peptide
GTKFLAP

SEQ ID NO: 2376 - protein, 7 aa, Artificial Sequence
  Description of Artificial Sequence: Synthetic peptide
GTKFLAP

SEQ ID NO: 2377 - protein, 7 aa, Artificial Sequence
  Description of Artificial Sequence: Synthetic peptide
GTKFLAP

SEQ ID NO: 2378 - protein, 7 aa, Artificial Sequence
  Description of Artificial Sequence: Synthetic peptide
GTKFLAP

SEQ ID NO: 2379 - protein, 7 aa, Artificial Sequence
  Description of Artificial Sequence: Synthetic peptide
GTKFLAP

SEQ ID NO: 2380 - protein, 7 aa, Artificial Sequence
  Description of Artificial Sequence: Synthetic peptide
GTKFLAP

SEQ ID NO: 2381 - protein, 7 aa, Artificial Sequence
  Description of Artificial Sequence: Synthetic peptide
GTKFLAP

SEQ ID NO: 2382 - protein, 7 aa, Artificial Sequence
  Description of Artificial Sequence: Synthetic peptide
GTKFLAP

SEQ ID NO: 2383 - protein, 7 aa, Artificial Sequence
  Description of Artificial Sequence: Synthetic peptide
GTKFLAP

SEQ ID NO: 2384 - protein, 7 aa, Artificial Sequence
  Description of Artificial Sequence: Synthetic peptide
GTKFLAP

SEQ ID NO: 2385 - protein, 7 aa, Artificial Sequence
  Description of Artificial Sequence: Synthetic peptide
GTKFLAP

SEQ ID NO: 2386 - protein, 7 aa, Artificial Sequence
  Description of Artificial Sequence: Synthetic peptide
GTKFLAP

SEQ ID NO: 2387 - protein, 7 aa, Artificial Sequence
  Description of Artificial Sequence: Synthetic peptide
GTKFLAP

SEQ ID NO: 2388 - protein, 7 aa, Artificial Sequence
  Description of Artificial Sequence: Synthetic peptide
GTKFLAP

SEQ ID NO: 2389 - protein, 7 aa, Artificial Sequence
  Description of Artificial Sequence: Synthetic peptide
GTKFLAP

SEQ ID NO: 2390 - protein, 7 aa, Artificial Sequence
  Description of Artificial Sequence: Synthetic peptide
GTKFLAP

SEQ ID NO: 2391 - protein, 7 aa, Artificial Sequence
  Description of Artificial Sequence: Synthetic peptide
GTKFLAP

SEQ ID NO: 2392 - protein, 7 aa, Artificial Sequence
  Description of Artificial Sequence: Synthetic peptide
GTKFLAP

SEQ ID NO: 2393 - protein, 7 aa, Artificial Sequence
  Description of Artificial Sequence: Synthetic peptide
GTKFLAP

SEQ ID NO: 2394 - protein, 7 aa, Artificial Sequence
  Description of Artificial Sequence: Synthetic peptide
YDSDRPS

SEQ ID NO: 2395 - protein, 7 aa, Artificial Sequence
  Description of Artificial Sequence: Synthetic peptide
DDNDRPS

SEQ ID NO: 2396 - protein, 7 aa, Artificial Sequence
  Description of Artificial Sequence: Synthetic peptide
DDNDRPS

SEQ ID NO: 2397 - protein, 7 aa, Artificial Sequence
  Description of Artificial Sequence: Synthetic peptide
DDNDRPS

SEQ ID NO: 2398 - protein, 7 aa, Artificial Sequence
  Description of Artificial Sequence: Synthetic peptide
DDNDRPS

SEQ ID NO: 2399 - protein, 17 aa, Artificial Sequence
  Description of Artificial Sequence: Synthetic peptide
AISGSGGSTYYADSVKG

SEQ ID NO: 2400 - protein, 17 aa, Artificial Sequence
  Description of Artificial Sequence: Synthetic peptide
AISGSGGGTYYAASVKG

SEQ ID NO: 2401 - protein, 17 aa, Artificial Sequence
  Description of Artificial Sequence: Synthetic peptide
TISGSGGGTYYAASVKG

SEQ ID NO: 2402 - protein, 17 aa, Artificial Sequence
  Description of Artificial Sequence: Synthetic peptide
TISGSGGGTYYADSVKG

SEQ ID NO: 2403 - protein, 17 aa, Artificial Sequence
  Description of Artificial Sequence: Synthetic peptide
AISGSGGGTYYAASVKA

SEQ ID NO: 2404 - protein, 17 aa, Artificial Sequence
  Description of Artificial Sequence: Synthetic peptide
AISGSGGGTYYAASGKG

SEQ ID NO: 2405 - protein, 17 aa, Artificial Sequence
  Description of Artificial Sequence: Synthetic peptide
AISGSGGGTYNAASVKG

SEQ ID NO: 2406 - protein, 17 aa, Artificial Sequence
  Description of Artificial Sequence: Synthetic peptide
AISGSGGGTYYAASVKG

SEQ ID NO: 2407 - protein, 17 aa, Artificial Sequence
  Description of Artificial Sequence: Synthetic peptide
AISGSGGGTYYAASVKG

SEQ ID NO: 2408 - protein, 17 aa, Artificial Sequence
  Description of Artificial Sequence: Synthetic peptide
AISGSGGGTYNAASVKG

SEQ ID NO: 2409 - protein, 17 aa, Artificial Sequence
  Description of Artificial Sequence: Synthetic peptide
AISGSGGGTYNAASVKG

SEQ ID NO: 2410 - protein, 17 aa, Artificial Sequence
  Description of Artificial Sequence: Synthetic peptide
AISGSGGGTYNADSVKG

SEQ ID NO: 2411 - protein, 17 aa, Artificial Sequence
  Description of Artificial Sequence: Synthetic peptide
SISGSGGGTYYAASVKG

SEQ ID NO: 2412 - protein, 17 aa, Artificial Sequence
  Description of Artificial Sequence: Synthetic peptide
AISGSGGGTYNAASVKG

SEQ ID NO: 2413 - protein, 19 aa, Artificial Sequence
  Description of Artificial Sequence: Synthetic peptide
RIRSKANSYATAYAASVKG

SEQ ID NO: 2414 - protein, 19 aa, Artificial Sequence
  Description of Artificial Sequence: Synthetic peptide
RIRSKYNNYATYYADSVKD

SEQ ID NO: 2415 - protein, 19 aa, Artificial Sequence
  Description of Artificial Sequence: Synthetic peptide
RIRSKYNNYATYYADSVKD

SEQ ID NO: 2416 - protein, 19 aa, Artificial Sequence
  Description of Artificial Sequence: Synthetic peptide
RIRSKYNNYATYYADSVKD

SEQ ID NO: 2417 - protein, 19 aa, Artificial Sequence
  Description of Artificial Sequence: Synthetic peptide
RIRSKYNNYATYYADSVKD

SEQ ID NO: 2418 - protein, 19 aa, Artificial Sequence
  Description of Artificial Sequence: Synthetic peptide
RIRSKYNNYATYYADSVKD

SEQ ID NO: 2419 - protein, 19 aa, Artificial Sequence
  Description of Artificial Sequence: Synthetic peptide
RIRSKYNNYATYYADSVKD

SEQ ID NO: 2420 - protein, 19 aa, Artificial Sequence
  Description of Artificial Sequence: Synthetic peptide
RIRSKYNNYATYYADSVKD

SEQ ID NO: 2421 - protein, 19 aa, Artificial Sequence
  Description of Artificial Sequence: Synthetic peptide
RIRSKYNNYATYYADSVKD

SEQ ID NO: 2422 - protein, 19 aa, Artificial Sequence
  Description of Artificial Sequence: Synthetic peptide
RIRSKYNNYATYYADSVKD

SEQ ID NO: 2423 - protein, 19 aa, Artificial Sequence
  Description of Artificial Sequence: Synthetic peptide
RIRSKYNNYATYYADSVKD

SEQ ID NO: 2424 - protein, 19 aa, Artificial Sequence
  Description of Artificial Sequence: Synthetic peptide
RIRSKYNNYATYYADSVKD

SEQ ID NO: 2425 - protein, 19 aa, Artificial Sequence
  Description of Artificial Sequence: Synthetic peptide
RIRSKYNNYATYYADSVKD

SEQ ID NO: 2426 - protein, 19 aa, Artificial Sequence
  Description of Artificial Sequence: Synthetic peptide
RIRSKYNNYATYYADSVKD

SEQ ID NO: 2427 - protein, 19 aa, Artificial Sequence
  Description of Artificial Sequence: Synthetic peptide
RIRSKYNNYATYYADSVKD

SEQ ID NO: 2428 - protein, 19 aa, Artificial Sequence
  Description of Artificial Sequence: Synthetic peptide
RIRSKYNNYATYYADSVKD

SEQ ID NO: 2429 - protein, 19 aa, Artificial Sequence
  Description of Artificial Sequence: Synthetic peptide
RIRSKYNNYATYYADSVKD

SEQ ID NO: 2430 - protein, 19 aa, Artificial Sequence
  Description of Artificial Sequence: Synthetic peptide
RIRSKYNNYATYYADSVKD

SEQ ID NO: 2431 - protein, 19 aa, Artificial Sequence
  Description of Artificial Sequence: Synthetic peptide
RIRSKYNNYATYYADSVKD

SEQ ID NO: 2432 - protein, 19 aa, Artificial Sequence
  Description of Artificial Sequence: Synthetic peptide
RIRSKYNNYATYYADSVKD

SEQ ID NO: 2433 - protein, 19 aa, Artificial Sequence
  Description of Artificial Sequence: Synthetic peptide
RIRSKYNNYATYYADSVKD

SEQ ID NO: 2434 - protein, 19 aa, Artificial Sequence
  Description of Artificial Sequence: Synthetic peptide
RIRSKYNNYATYYADSVKD

SEQ ID NO: 2435 - protein, 19 aa, Artificial Sequence
  Description of Artificial Sequence: Synthetic peptide
RIRSKYNNYATYYADSVKD

SEQ ID NO: 2436 - protein, 19 aa, Artificial Sequence
  Description of Artificial Sequence: Synthetic peptide
RIRSKYNNYATYYADSVKD

SEQ ID NO: 2437 - protein, 19 aa, Artificial Sequence
  Description of Artificial Sequence: Synthetic peptide
RIRSKYNNYATYYADSVKD

SEQ ID NO: 2438 - protein, 19 aa, Artificial Sequence
  Description of Artificial Sequence: Synthetic peptide
RIRSKYNNYATYYADSVKD

SEQ ID NO: 2439 - protein, 19 aa, Artificial Sequence
  Description of Artificial Sequence: Synthetic peptide
RIRSKYNNYATYYADSVKD

SEQ ID NO: 2440 - protein, 19 aa, Artificial Sequence
  Description of Artificial Sequence: Synthetic peptide
RIRSKYNNYATYYADSVKD

SEQ ID NO: 2441 - protein, 19 aa, Artificial Sequence
  Description of Artificial Sequence: Synthetic peptide
RIRSKYNNYATYYADSVKD

SEQ ID NO: 2442 - protein, 19 aa, Artificial Sequence
  Description of Artificial Sequence: Synthetic peptide
RIRSKYNNYATYYADSVKD

SEQ ID NO: 2443 - protein, 19 aa, Artificial Sequence
  Description of Artificial Sequence: Synthetic peptide
RIRSKYNNYATYYADSVKD

SEQ ID NO: 2444 - protein, 19 aa, Artificial Sequence
  Description of Artificial Sequence: Synthetic peptide
RIRSKYNNYATYYADSVKD

SEQ ID NO: 2445 - protein, 19 aa, Artificial Sequence
  Description of Artificial Sequence: Synthetic peptide
RIRSKYNNYATYYADSVKD

SEQ ID NO: 2446 - protein, 19 aa, Artificial Sequence
  Description of Artificial Sequence: Synthetic peptide
RIRSKYNNYATYYADSVKD

SEQ ID NO: 2447 - protein, 19 aa, Artificial Sequence
  Description of Artificial Sequence: Synthetic peptide
RIRSKYNNYATYYADSVKD

SEQ ID NO: 2448 - protein, 19 aa, Artificial Sequence
  Description of Artificial Sequence: Synthetic peptide
RIRSKYNNYATYYADSVKD

SEQ ID NO: 2449 - protein, 19 aa, Artificial Sequence
  Description of Artificial Sequence: Synthetic peptide
RIRSKYNNYATYYADSVKD

SEQ ID NO: 2450 - protein, 16 aa, Artificial Sequence
  Description of Artificial Sequence: Synthetic peptide
RIDWDDDKFYSTSLKT

SEQ ID NO: 2451 - protein, 16 aa, Artificial Sequence
  Description of Artificial Sequence: Synthetic peptide
EIHSEDDKRYSPSLQS

SEQ ID NO: 2452 - protein, 19 aa, Artificial Sequence
  Description of Artificial Sequence: Synthetic peptide
RIKSKTDGGTTDYAAPVKG

SEQ ID NO: 2453 - protein, 19 aa, Artificial Sequence
  Description of Artificial Sequence: Synthetic peptide
RIKSKTYGGTTDYAAPVKG

SEQ ID NO: 2454 - protein, 19 aa, Artificial Sequence
  Description of Artificial Sequence: Synthetic peptide
RIRSRSYGGTTDYAAPVKG

SEQ ID NO: 2455 - protein, 19 aa, Artificial Sequence
  Description of Artificial Sequence: Synthetic peptide
RIKSKTYGGTTDYAAPVKG

SEQ ID NO: 2456 - protein, 19 aa, Artificial Sequence
  Description of Artificial Sequence: Synthetic peptide
RITSSRYGGTTDYAAPVKG

SEQ ID NO: 2457 - protein, 19 aa, Artificial Sequence
  Description of Artificial Sequence: Synthetic peptide
RILNNAYGGTTDYAAPVKG

SEQ ID NO: 2458 - protein, 19 aa, Artificial Sequence
  Description of Artificial Sequence: Synthetic peptide
RILSMHYGGTTDYAAPVKG

SEQ ID NO: 2459 - protein, 19 aa, Artificial Sequence
  Description of Artificial Sequence: Synthetic peptide
RIVSSTYGGTTDYAAPVKG

SEQ ID NO: 2460 - protein, 19 aa, Artificial Sequence
  Description of Artificial Sequence: Synthetic peptide
RITSGIYGGTTDYAAPVKG

SEQ ID NO: 2461 - protein, 19 aa, Artificial Sequence
  Description of Artificial Sequence: Synthetic peptide
RIRSRPYGGTTDYAAPVKG

SEQ ID NO: 2462 - protein, 16 aa, Artificial Sequence
  Description of Artificial Sequence: Synthetic peptide
LIYWNDDKRYSPSLKS

SEQ ID NO: 2463 - protein, 16 aa, Artificial Sequence
  Description of Artificial Sequence: Synthetic peptide
LIYWNDDKRYSPSLQS

SEQ ID NO: 2464 - protein, 16 aa, Artificial Sequence
  Description of Artificial Sequence: Synthetic peptide
LIYWNDDKRYSPSLQS

SEQ ID NO: 2465 - protein, 16 aa, Artificial Sequence
  Description of Artificial Sequence: Synthetic peptide
LIYWNDDKRYSPSLQS

SEQ ID NO: 2466 - protein, 16 aa, Artificial Sequence
  Description of Artificial Sequence: Synthetic peptide
GIHIYDDKRYSPSLQS

SEQ ID NO: 2467 - protein, 16 aa, Artificial Sequence
  Description of Artificial Sequence: Synthetic peptide
LIYWNDDKRYSPSLQS

SEQ ID NO: 2468 - protein, 16 aa, Artificial Sequence
  Description of Artificial Sequence: Synthetic peptide
LIYWNDDKRYSPSLQS

SEQ ID NO: 2469 - protein, 16 aa, Artificial Sequence
  Description of Artificial Sequence: Synthetic peptide
LIYWNDDKRYSPSLQS

SEQ ID NO: 2470 - protein, 16 aa, Artificial Sequence
  Description of Artificial Sequence: Synthetic peptide
LIYWNDDKRYSPSLQS

SEQ ID NO: 2471 - protein, 16 aa, Artificial Sequence
  Description of Artificial Sequence: Synthetic peptide
YIYYSGSTNYNPSLKS

SEQ ID NO: 2472 - protein, 16 aa, Artificial Sequence
  Description of Artificial Sequence: Synthetic peptide
SIYYSGSTYYNPSLKS

SEQ ID NO: 2473 - protein, 17 aa, Artificial Sequence
  Description of Artificial Sequence: Synthetic peptide
VISYDGSNKYYADSVKG

SEQ ID NO: 2474 - protein, 17 aa, Artificial Sequence
  Description of Artificial Sequence: Synthetic peptide
VISYDASNKYYAESVKG

SEQ ID NO: 2475 - protein, 17 aa, Artificial Sequence
  Description of Artificial Sequence: Synthetic peptide
VISYDAETVKYAESVKG

SEQ ID NO: 2476 - protein, 17 aa, Artificial Sequence
  Description of Artificial Sequence: Synthetic peptide
YISSSGSTIYYADSVKG

SEQ ID NO: 2477 - protein, 17 aa, Artificial Sequence
  Description of Artificial Sequence: Synthetic peptide
YISKSSYTVTYADAVKG

SEQ ID NO: 2478 - protein, 16 aa, Artificial Sequence
  Description of Artificial Sequence: Synthetic peptide
YIYYSGSTYYNPSLKS

SEQ ID NO: 2479 - protein, 16 aa, Artificial Sequence
  Description of Artificial Sequence: Synthetic peptide
YISYSGITNYNPSLKS

SEQ ID NO: 2480 - protein, 32 aa, Artificial Sequence; identical to SEQ ID NO: 1346
  Description of Artificial Sequence: Synthetic polypeptide

SEQ ID NO: 2481 - protein, 32 aa, Artificial Sequence; identical to SEQ ID NO: 1346
  Description of Artificial Sequence: Synthetic polypeptide

SEQ ID NO: 2482 - protein, 32 aa, Artificial Sequence; identical to SEQ ID NO: 1346
  Description of Artificial Sequence: Synthetic polypeptide

SEQ ID NO: 2483 - protein, 32 aa, Artificial Sequence; identical to SEQ ID NO: 1346
  Description of Artificial Sequence: Synthetic polypeptide

SEQ ID NO: 2484 - protein, 32 aa, Artificial Sequence; identical to SEQ ID NO: 1350
  Description of Artificial Sequence: Synthetic polypeptide

SEQ ID NO: 2485 - protein, 32 aa, Artificial Sequence; identical to SEQ ID NO: 1346
  Description of Artificial Sequence: Synthetic polypeptide

SEQ ID NO: 2486 - protein, 32 aa, Artificial Sequence; identical to SEQ ID NO: 1346
  Description of Artificial Sequence: Synthetic polypeptide

SEQ ID NO: 2487 - protein, 32 aa, Artificial Sequence; identical to SEQ ID NO: 1350
  Description of Artificial Sequence: Synthetic polypeptide

SEQ ID NO: 2488 - protein, 32 aa, Artificial Sequence; identical to SEQ ID NO: 1346
  Description of Artificial Sequence: Synthetic polypeptide

SEQ ID NO: 2489 - protein, 32 aa, Artificial Sequence; identical to SEQ ID NO: 1350
  Description of Artificial Sequence: Synthetic polypeptide

SEQ ID NO: 2490 - protein, 32 aa, Artificial Sequence; identical to SEQ ID NO: 1346
  Description of Artificial Sequence: Synthetic polypeptide

SEQ ID NO: 2491 - protein, 32 aa, Artificial Sequence; identical to SEQ ID NO: 1346
  Description of Artificial Sequence: Synthetic polypeptide

SEQ ID NO: 2492 - protein, 32 aa, Artificial Sequence; identical to SEQ ID NO: 1346
  Description of Artificial Sequence: Synthetic polypeptide

SEQ ID NO: 2493 - protein, 32 aa, Artificial Sequence; identical to SEQ ID NO: 1346
  Description of Artificial Sequence: Synthetic polypeptide

SEQ ID NO: 2494 - protein, 32 aa, Artificial Sequence; identical to SEQ ID NO: 1346
  Description of Artificial Sequence: Synthetic polypeptide

SEQ ID NO: 2495 - protein, 32 aa, Artificial Sequence; identical to SEQ ID NO: 1346
  Description of Artificial Sequence: Synthetic polypeptide

SEQ ID NO: 2496 - protein, 32 aa, Artificial Sequence; identical to SEQ ID NO: 1346
  Description of Artificial Sequence: Synthetic polypeptide

SEQ ID NO: 2497 - protein, 32 aa, Artificial Sequence; identical to SEQ ID NO: 1346
  Description of Artificial Sequence: Synthetic polypeptide

SEQ ID NO: 2498 - protein, 32 aa, Artificial Sequence; identical to SEQ ID NO: 1346
  Description of Artificial Sequence: Synthetic polypeptide

SEQ ID NO: 2499 - protein, 32 aa, Artificial Sequence; identical to SEQ ID NO: 1346
  Description of Artificial Sequence: Synthetic polypeptide

SEQ ID NO: 2500 - protein, 32 aa, Artificial Sequence; identical to SEQ ID NO: 1346
  Description of Artificial Sequence: Synthetic polypeptide

SEQ ID NO: 2501 - protein, 32 aa, Artificial Sequence; identical to SEQ ID NO: 1367
  Description of Artificial Sequence: Synthetic polypeptide

SEQ ID NO: 2502 - protein, 32 aa, Artificial Sequence; identical to SEQ ID NO: 1367
  Description of Artificial Sequence: Synthetic polypeptide

SEQ ID NO: 2503 - protein, 32 aa, Artificial Sequence; identical to SEQ ID NO: 1369
  Description of Artificial Sequence: Synthetic polypeptide

SEQ ID NO: 2504 - protein, 32 aa, Artificial Sequence; identical to SEQ ID NO: 1346
  Description of Artificial Sequence: Synthetic polypeptide

SEQ ID NO: 2505 - protein, 32 aa, Artificial Sequence; identical to SEQ ID NO: 1369
  Description of Artificial Sequence: Synthetic polypeptide

SEQ ID NO: 2506 - protein, 32 aa, Artificial Sequence; identical to SEQ ID NO: 1372
  Description of Artificial Sequence: Synthetic polypeptide

SEQ ID NO: 2507 - protein, 32 aa, Artificial Sequence; identical to SEQ ID NO: 1373
  Description of Artificial Sequence: Synthetic polypeptide

SEQ ID NO: 2508 - protein, 32 aa, Artificial Sequence; identical to SEQ ID NO: 1374
  Description of Artificial Sequence: Synthetic polypeptide

SEQ ID NO: 2509 - protein, 32 aa, Artificial Sequence; identical to SEQ ID NO: 1374
  Description of Artificial Sequence: Synthetic polypeptide

SEQ ID NO: 2510 - protein, 32 aa, Artificial Sequence; identical to SEQ ID NO: 1374
  Description of Artificial Sequence: Synthetic polypeptide

SEQ ID NO: 2511 - protein, 32 aa, Artificial Sequence; identical to SEQ ID NO: 1374
  Description of Artificial Sequence: Synthetic polypeptide

SEQ ID NO: 2512 - protein, 32 aa, Artificial Sequence; identical to SEQ ID NO: 1374
  Description of Artificial Sequence: Synthetic polypeptide

SEQ ID NO: 2513 - protein, 32 aa, Artificial Sequence; identical to SEQ ID NO: 1379
  Description of Artificial Sequence: Synthetic polypeptide

SEQ ID NO: 2514 - protein, 32 aa, Artificial Sequence; identical to SEQ ID NO: 1374
  Description of Artificial Sequence: Synthetic polypeptide

SEQ ID NO: 2515 - protein, 32 aa, Artificial Sequence; identical to SEQ ID NO: 1374
  Description of Artificial Sequence: Synthetic polypeptide

SEQ ID NO: 2516 - protein, 32 aa, Artificial Sequence; identical to SEQ ID NO: 1374
  Description of Artificial Sequence: Synthetic polypeptide

SEQ ID NO: 2517 - protein, 32 aa, Artificial Sequence; identical to SEQ ID NO: 1374
  Description of Artificial Sequence: Synthetic polypeptide

SEQ ID NO: 2518 - protein, 32 aa, Artificial Sequence; identical to SEQ ID NO: 1379
  Description of Artificial Sequence: Synthetic polypeptide

SEQ ID NO: 2519 - protein, 32 aa, Artificial Sequence; identical to SEQ ID NO: 1385
  Description of Artificial Sequence: Synthetic polypeptide

SEQ ID NO: 2520 - protein, 32 aa, Artificial Sequence; identical to SEQ ID NO: 1386
  Description of Artificial Sequence: Synthetic polypeptide

SEQ ID NO: 2521 - protein, 32 aa, Artificial Sequence; identical to SEQ ID NO: 1386
  Description of Artificial Sequence: Synthetic polypeptide

SEQ ID NO: 2522 - protein, 32 aa, Artificial Sequence; identical to SEQ ID NO: 1386
  Description of Artificial Sequence: Synthetic polypeptide

SEQ ID NO: 2523 - protein, 32 aa, Artificial Sequence; identical to SEQ ID NO: 1386
  Description of Artificial Sequence: Synthetic polypeptide

SEQ ID NO: 2524 - protein, 32 aa, Artificial Sequence; identical to SEQ ID NO: 1386
  Description of Artificial Sequence: Synthetic polypeptide

SEQ ID NO: 2525 - protein, 32 aa, Artificial Sequence; identical to SEQ ID NO: 1386
  Description of Artificial Sequence: Synthetic polypeptide

SEQ ID NO: 2526 - protein, 32 aa, Artificial Sequence; identical to SEQ ID NO: 1386
  Description of Artificial Sequence: Synthetic polypeptide

SEQ ID NO: 2527 - protein, 32 aa, Artificial Sequence; identical to SEQ ID NO: 1386
  Description of Artificial Sequence: Synthetic polypeptide

SEQ ID NO: 2528 - protein, 32 aa, Artificial Sequence; identical to SEQ ID NO: 1386
  Description of Artificial Sequence: Synthetic polypeptide

SEQ ID NO: 2529 - protein, 32 aa, Artificial Sequence; identical to SEQ ID NO: 1386
  Description of Artificial Sequence: Synthetic polypeptide

SEQ ID NO: 2530 - protein, 32 aa, Artificial Sequence; identical to SEQ ID NO: 1386
  Description of Artificial Sequence: Synthetic polypeptide

SEQ ID NO: 2531 - protein, 32 aa, Artificial Sequence; identical to SEQ ID NO: 1386
  Description of Artificial Sequence: Synthetic polypeptide

SEQ ID NO: 2532 - protein, 32 aa, Artificial Sequence; identical to SEQ ID NO: 1386
  Description of Artificial Sequence: Synthetic polypeptide

SEQ ID NO: 2533 - protein, 32 aa, Artificial Sequence; identical to SEQ ID NO: 1386
  Description of Artificial Sequence: Synthetic polypeptide

SEQ ID NO: 2534 - protein, 32 aa, Artificial Sequence; identical to SEQ ID NO: 1386
  Description of Artificial Sequence: Synthetic polypeptide

SEQ ID NO: 2535 - protein, 32 aa, Artificial Sequence; identical to SEQ ID NO: 1386
  Description of Artificial Sequence: Synthetic polypeptide

SEQ ID NO: 2536 - protein, 32 aa, Artificial Sequence; identical to SEQ ID NO: 1386
  Description of Artificial Sequence: Synthetic polypeptide

SEQ ID NO: 2537 - protein, 32 aa, Artificial Sequence; identical to SEQ ID NO: 1386
  Description of Artificial Sequence: Synthetic polypeptide

SEQ ID NO: 2538 - protein, 32 aa, Artificial Sequence; identical to SEQ ID NO: 1386
  Description of Artificial Sequence: Synthetic polypeptide

SEQ ID NO: 2539 - protein, 32 aa, Artificial Sequence; identical to SEQ ID NO: 1386
  Description of Artificial Sequence: Synthetic polypeptide

SEQ ID NO: 2540 - protein, 32 aa, Artificial Sequence; identical to SEQ ID NO: 1386
  Description of Artificial Sequence: Synthetic polypeptide

SEQ ID NO: 2541 - protein, 32 aa, Artificial Sequence; identical to SEQ ID NO: 1386
  Description of Artificial Sequence: Synthetic polypeptide

SEQ ID NO: 2542 - protein, 32 aa, Artificial Sequence; identical to SEQ ID NO: 1386
  Description of Artificial Sequence: Synthetic polypeptide

SEQ ID NO: 2543 - protein, 32 aa, Artificial Sequence; identical to SEQ ID NO: 1386
  Description of Artificial Sequence: Synthetic polypeptide

SEQ ID NO: 2544 - protein, 32 aa, Artificial Sequence; identical to SEQ ID NO: 1386
  Description of Artificial Sequence: Synthetic polypeptide

SEQ ID NO: 2545 - protein, 32 aa, Artificial Sequence; identical to SEQ ID NO: 1386
  Description of Artificial Sequence: Synthetic polypeptide

SEQ ID NO: 2546 - protein, 32 aa, Artificial Sequence; identical to SEQ ID NO: 1386
  Description of Artificial Sequence: Synthetic polypeptide

SEQ ID NO: 2547 - protein, 32 aa, Artificial Sequence; identical to SEQ ID NO: 1386
  Description of Artificial Sequence: Synthetic polypeptide

SEQ ID NO: 2548 - protein, 32 aa, Artificial Sequence; identical to SEQ ID NO: 1386
  Description of Artificial Sequence: Synthetic polypeptide

SEQ ID NO: 2549 - protein, 32 aa, Artificial Sequence; identical to SEQ ID NO: 1386
  Description of Artificial Sequence: Synthetic polypeptide

SEQ ID NO: 2550 - protein, 32 aa, Artificial Sequence; identical to SEQ ID NO: 1386
  Description of Artificial Sequence: Synthetic polypeptide

SEQ ID NO: 2551 - protein, 32 aa, Artificial Sequence; identical to SEQ ID NO: 1386
  Description of Artificial Sequence: Synthetic polypeptide

SEQ ID NO: 2552 - protein, 32 aa, Artificial Sequence; identical to SEQ ID NO: 1386
  Description of Artificial Sequence: Synthetic polypeptide

SEQ ID NO: 2553 - protein, 32 aa, Artificial Sequence; identical to SEQ ID NO: 1386
  Description of Artificial Sequence: Synthetic polypeptide

SEQ ID NO: 2554 - protein, 32 aa, Artificial Sequence; identical to SEQ ID NO: 1386
  Description of Artificial Sequence: Synthetic polypeptide

SEQ ID NO: 2555 - protein, 32 aa, Artificial Sequence; identical to SEQ ID NO: 1386
  Description of Artificial Sequence: Synthetic polypeptide

SEQ ID NO: 2556 - protein, 32 aa, Artificial Sequence; identical to SEQ ID NO: 1374
  Description of Artificial Sequence: Synthetic polypeptide

SEQ ID NO: 2557 - protein, 32 aa, Artificial Sequence; identical to SEQ ID NO: 1379
  Description of Artificial Sequence: Synthetic polypeptide

SEQ ID NO: 2558 - protein, 32 aa, Artificial Sequence; identical to SEQ ID NO: 1379
  Description of Artificial Sequence: Synthetic polypeptide

SEQ ID NO: 2559 - protein, 32 aa, Artificial Sequence; identical to SEQ ID NO: 1374
  Description of Artificial Sequence: Synthetic polypeptide

SEQ ID NO: 2560 - protein, 32 aa, Artificial Sequence; identical to SEQ ID NO: 1426
  Description of Artificial Sequence: Synthetic polypeptide

SEQ ID NO: 2561 - protein, 32 aa, Artificial Sequence; identical to SEQ ID NO: 1427
  Description of Artificial Sequence: Synthetic polypeptide

SEQ ID NO: 2562 - protein, 32 aa, Artificial Sequence; identical to SEQ ID NO: 1428
  Description of Artificial Sequence: Synthetic polypeptide

SEQ ID NO: 2563 - protein, 32 aa, Artificial Sequence; identical to SEQ ID NO: 1428
  Description of Artificial Sequence: Synthetic polypeptide

SEQ ID NO: 2564 - protein, 32 aa, Artificial Sequence; identical to SEQ ID NO: 1428
  Description of Artificial Sequence: Synthetic polypeptide

SEQ ID NO: 2565 - protein, 32 aa, Artificial Sequence; identical to SEQ ID NO: 1428
  Description of Artificial Sequence: Synthetic polypeptide

SEQ ID NO: 2566 - protein, 32 aa, Artificial Sequence; identical to SEQ ID NO: 1432
  Description of Artificial Sequence: Synthetic polypeptide

SEQ ID NO: 2567 - protein, 32 aa, Artificial Sequence; identical to SEQ ID NO: 1432
  Description of Artificial Sequence: Synthetic polypeptide

SEQ ID NO: 2568 - protein, 32 aa, Artificial Sequence; identical to SEQ ID NO: 1434
  Description of Artificial Sequence: Synthetic polypeptide

SEQ ID NO: 2569 - protein, 32 aa, Artificial Sequence; identical to SEQ ID NO: 1428
  Description of Artificial Sequence: Synthetic polypeptide

SEQ ID NO: 2570 - protein, 32 aa, Artificial Sequence; identical to SEQ ID NO: 1432
  Description of Artificial Sequence: Synthetic polypeptide

SEQ ID NO: 2571 - protein, 32 aa, Artificial Sequence; identical to SEQ ID NO: 1428
  Description of Artificial Sequence: Synthetic polypeptide

SEQ ID NO: 2572 - protein, 32 aa, Artificial Sequence; identical to SEQ ID NO: 1428
  Description of Artificial Sequence: Synthetic polypeptide

SEQ ID NO: 2573 - protein, 32 aa, Artificial Sequence; identical to SEQ ID NO: 1428
  Description of Artificial Sequence: Synthetic polypeptide

SEQ ID NO: 2574 - protein, 32 aa, Artificial Sequence; identical to SEQ ID NO: 1432
  Description of Artificial Sequence: Synthetic polypeptide

SEQ ID NO: 2575 - protein, 32 aa, Artificial Sequence; identical to SEQ ID NO: 1441
  Description of Artificial Sequence: Synthetic polypeptide

SEQ ID NO: 2576 - protein, 32 aa, Artificial Sequence; identical to SEQ ID NO: 1442
  Description of Artificial Sequence: Synthetic polypeptide

SEQ ID NO: 2577 - protein, 32 aa, Artificial Sequence; identical to SEQ ID NO: 1442
  Description of Artificial Sequence: Synthetic polypeptide

SEQ ID NO: 2578 - protein, 32 aa, Artificial Sequence; identical to SEQ ID NO: 1442
  Description of Artificial Sequence: Synthetic polypeptide

SEQ ID NO: 2579 - protein, 32 aa, Artificial Sequence; identical to SEQ ID NO: 1442
  Description of Artificial Sequence: Synthetic polypeptide

SEQ ID NO: 2580 - protein, 32 aa, Artificial Sequence; identical to SEQ ID NO: 1442
  Description of Artificial Sequence: Synthetic polypeptide

SEQ ID NO: 2581 - protein, 32 aa, Artificial Sequence; identical to SEQ ID NO: 1442
  Description of Artificial Sequence: Synthetic polypeptide

SEQ ID NO: 2582 - protein, 32 aa, Artificial Sequence; identical to SEQ ID NO: 1442
  Description of Artificial Sequence: Synthetic polypeptide

SEQ ID NO: 2583 - protein, 32 aa, Artificial Sequence; identical to SEQ ID NO: 1442
  Description of Artificial Sequence: Synthetic polypeptide

SEQ ID NO: 2584 - protein, 32 aa, Artificial Sequence; identical to SEQ ID NO: 1442
  Description of Artificial Sequence: Synthetic polypeptide

SEQ ID NO: 2585 - protein, 32 aa, Artificial Sequence; identical to SEQ ID NO: 1442
  Description of Artificial Sequence: Synthetic polypeptide

SEQ ID NO: 2586 - protein, 32 aa, Artificial Sequence; identical to SEQ ID NO: 1442
  Description of Artificial Sequence: Synthetic polypeptide

SEQ ID NO: 2587 - protein, 32 aa, Artificial Sequence; identical to SEQ ID NO: 1442
  Description of Artificial Sequence: Synthetic polypeptide

SEQ ID NO: 2588 - protein, 32 aa, Artificial Sequence; identical to SEQ ID NO: 1442
  Description of Artificial Sequence: Synthetic polypeptide

SEQ ID NO: 2589 - protein, 32 aa, Artificial Sequence; identical to SEQ ID NO: 1442
  Description of Artificial Sequence: Synthetic polypeptide

SEQ ID NO: 2590 - protein, 32 aa, Artificial Sequence; identical to SEQ ID NO: 1442
  Description of Artificial Sequence: Synthetic polypeptide

SEQ ID NO: 2591 - protein, 32 aa, Artificial Sequence; identical to SEQ ID NO: 1442
  Description of Artificial Sequence: Synthetic polypeptide

SEQ ID NO: 2592 - protein, 32 aa, Artificial Sequence; identical to SEQ ID NO: 1442
  Description of Artificial Sequence: Synthetic polypeptide

SEQ ID NO: 2593 - protein, 32 aa, Artificial Sequence; identical to SEQ ID NO: 1442
  Description of Artificial Sequence: Synthetic polypeptide

SEQ ID NO: 2594 - protein, 32 aa, Artificial Sequence; identical to SEQ ID NO: 1442
  Description of Artificial Sequence: Synthetic polypeptide

SEQ ID NO: 2595 - protein, 32 aa, Artificial Sequence; identical to SEQ ID NO: 1442
  Description of Artificial Sequence: Synthetic polypeptide

SEQ ID NO: 2596 - protein, 32 aa, Artificial Sequence; identical to SEQ ID NO: 1442
  Description of Artificial Sequence: Synthetic polypeptide

SEQ ID NO: 2597 - protein, 32 aa, Artificial Sequence; identical to SEQ ID NO: 1442
  Description of Artificial Sequence: Synthetic polypeptide

SEQ ID NO: 2598 - protein, 32 aa, Artificial Sequence; identical to SEQ ID NO: 1442
  Description of Artificial Sequence: Synthetic polypeptide

SEQ ID NO: 2599 - protein, 32 aa, Artificial Sequence; identical to SEQ ID NO: 1442
  Description of Artificial Sequence: Synthetic polypeptide

SEQ ID NO: 2600 - protein, 32 aa, Artificial Sequence; identical to SEQ ID NO: 1442
  Description of Artificial Sequence: Synthetic polypeptide

SEQ ID NO: 2601 - protein, 32 aa, Artificial Sequence; identical to SEQ ID NO: 1442
  Description of Artificial Sequence: Synthetic polypeptide

SEQ ID NO: 2602 - protein, 32 aa, Artificial Sequence; identical to SEQ ID NO: 1442
  Description of Artificial Sequence: Synthetic polypeptide

SEQ ID NO: 2603 - protein, 32 aa, Artificial Sequence; identical to SEQ ID NO: 1442
  Description of Artificial Sequence: Synthetic polypeptide

SEQ ID NO: 2604 - protein, 32 aa, Artificial Sequence; identical to SEQ ID NO: 1442
  Description of Artificial Sequence: Synthetic polypeptide

SEQ ID NO: 2605 - protein, 32 aa, Artificial Sequence; identical to SEQ ID NO: 1442
  Description of Artificial Sequence: Synthetic polypeptide

SEQ ID NO: 2606 - protein, 32 aa, Artificial Sequence; identical to SEQ ID NO: 1442
  Description of Artificial Sequence: Synthetic polypeptide

SEQ ID NO: 2607 - protein, 32 aa, Artificial Sequence; identical to SEQ ID NO: 1442
  Description of Artificial Sequence: Synthetic polypeptide

SEQ ID NO: 2608 - protein, 32 aa, Artificial Sequence; identical to SEQ ID NO: 1442
  Description of Artificial Sequence: Synthetic polypeptide

SEQ ID NO: 2609 - protein, 32 aa, Artificial Sequence; identical to SEQ ID NO: 1442
  Description of Artificial Sequence: Synthetic polypeptide

SEQ ID NO: 2610 - protein, 32 aa, Artificial Sequence; identical to SEQ ID NO: 1442
  Description of Artificial Sequence: Synthetic polypeptide

SEQ ID NO: 2611 - protein, 32 aa, Artificial Sequence; identical to SEQ ID NO: 1442
  Description of Artificial Sequence: Synthetic polypeptide

SEQ ID NO: 2612 - protein, 32 aa, Artificial Sequence; identical to SEQ ID NO: 1478
  Description of Artificial Sequence: Synthetic polypeptide

SEQ ID NO: 2613 - protein, 32 aa, Artificial Sequence; identical to SEQ ID NO: 1479
  Description of Artificial Sequence: Synthetic polypeptide

SEQ ID NO: 2614 - protein, 32 aa, Artificial Sequence; identical to SEQ ID NO: 1480
  Description of Artificial Sequence: Synthetic polypeptide

SEQ ID NO: 2615 - protein, 32 aa, Artificial Sequence; identical to SEQ ID NO: 1481
  Description of Artificial Sequence: Synthetic polypeptide

SEQ ID NO: 2616 - protein, 32 aa, Artificial Sequence; identical to SEQ ID NO: 1481
  Description of Artificial Sequence: Synthetic polypeptide

SEQ ID NO: 2617 - protein, 32 aa, Artificial Sequence; identical to SEQ ID NO: 1480
  Description of Artificial Sequence: Synthetic polypeptide

SEQ ID NO: 2618 - protein, 32 aa, Artificial Sequence; identical to SEQ ID NO: 1481
  Description of Artificial Sequence: Synthetic polypeptide

SEQ ID NO: 2619 - protein, 32 aa, Artificial Sequence; identical to SEQ ID NO: 1480
  Description of Artificial Sequence: Synthetic polypeptide

SEQ ID NO: 2620 - protein, 32 aa, Artificial Sequence; identical to SEQ ID NO: 1480
  Description of Artificial Sequence: Synthetic polypeptide

SEQ ID NO: 2621 - protein, 32 aa, Artificial Sequence; identical to SEQ ID NO: 1480
  Description of Artificial Sequence: Synthetic polypeptide

SEQ ID NO: 2622 - protein, 32 aa, Artificial Sequence; identical to SEQ ID NO: 1480
  Description of Artificial Sequence: Synthetic polypeptide

SEQ ID NO: 2623 - protein, 32 aa, Artificial Sequence; identical to SEQ ID NO: 1480
  Description of Artificial Sequence: Synthetic polypeptide

SEQ ID NO: 2624 - protein, 32 aa, Artificial Sequence; identical to SEQ ID NO: 1490
  Description of Artificial Sequence: Synthetic polypeptide

SEQ ID NO: 2625 - protein, 32 aa, Artificial Sequence; identical to SEQ ID NO: 1479
  Description of Artificial Sequence: Synthetic polypeptide

SEQ ID NO: 2626 - protein, 32 aa, Artificial Sequence; identical to SEQ ID NO: 1479
  Description of Artificial Sequence: Synthetic polypeptide

SEQ ID NO: 2627 - protein, 32 aa, Artificial Sequence; identical to SEQ ID NO: 1479
  Description of Artificial Sequence: Synthetic polypeptide

SEQ ID NO: 2628 - protein, 32 aa, Artificial Sequence; identical to SEQ ID NO: 1479
  Description of Artificial Sequence: Synthetic polypeptide

SEQ ID NO: 2629 - protein, 32 aa, Artificial Sequence; identical to SEQ ID NO: 1479
  Description of Artificial Sequence: Synthetic polypeptide

SEQ ID NO: 2630 - protein, 32 aa, Artificial Sequence; identical to SEQ ID NO: 1479
  Description of Artificial Sequence: Synthetic polypeptide

SEQ ID NO: 2631 - protein, 32 aa, Artificial Sequence; identical to SEQ ID NO: 1479
  Description of Artificial Sequence: Synthetic polypeptide

SEQ ID NO: 2632 - protein, 32 aa, Artificial Sequence; identical to SEQ ID NO: 1479
  Description of Artificial Sequence: Synthetic polypeptide

SEQ ID NO: 2633 - protein, 32 aa, Artificial Sequence; identical to SEQ ID NO: 1499
  Description of Artificial Sequence: Synthetic polypeptide

SEQ ID NO: 2634 - protein, 32 aa, Artificial Sequence; identical to SEQ ID NO: 1499
  Description of Artificial Sequence: Synthetic polypeptide

SEQ ID NO: 2635 - protein, 32 aa, Artificial Sequence; identical to SEQ ID NO: 1501
  Description of Artificial Sequence: Synthetic polypeptide

SEQ ID NO: 2636 - protein, 32 aa, Artificial Sequence; identical to SEQ ID NO: 1501
  Description of Artificial Sequence: Synthetic polypeptide

SEQ ID NO: 2637 - protein, 32 aa, Artificial Sequence; identical to SEQ ID NO: 1501
  Description of Artificial Sequence: Synthetic polypeptide

SEQ ID NO: 2638 - protein, 32 aa, Artificial Sequence; identical to SEQ ID NO: 1504
  Description of Artificial Sequence: Synthetic polypeptide

SEQ ID NO: 2639 - protein, 32 aa, Artificial Sequence; identical to SEQ ID NO: 1505
  Description of Artificial Sequence: Synthetic polypeptide

SEQ ID NO: 2640 - protein, 32 aa, Artificial Sequence; identical to SEQ ID NO: 1499
  Description of Artificial Sequence: Synthetic polypeptide

SEQ ID NO: 2641 - protein, 32 aa, Artificial Sequence; identical to SEQ ID NO: 1507
  Description of Artificial Sequence: Synthetic polypeptide

SEQ ID NO: 2642 - protein, 9 aa, Artificial Sequence
  Description of Artificial Sequence: Synthetic peptide
QQSYSTPWT

SEQ ID NO: 2643 - protein, 9 aa, Artificial Sequence
  Description of Artificial Sequence: Synthetic peptide
QQSYITPFT

SEQ ID NO: 2644 - protein, 9 aa, Artificial Sequence
  Description of Artificial Sequence: Synthetic peptide
QQSYSSPFT

SEQ ID NO: 2645 - protein, 9 aa, Artificial Sequence
  Description of Artificial Sequence: Synthetic peptide
QQSYMWPTI

SEQ ID NO: 2646 - protein, 9 aa, Artificial Sequence
  Description of Artificial Sequence: Synthetic peptide
QQSYYYPTL

SEQ ID NO: 2647 - protein, 9 aa, Artificial Sequence
  Description of Artificial Sequence: Synthetic peptide
QQSYTLHPL

SEQ ID NO: 2648 - protein, 9 aa, Artificial Sequence
  Description of Artificial Sequence: Synthetic peptide
QQSYITPFT

SEQ ID NO: 2649 - protein, 9 aa, Artificial Sequence
  Description of Artificial Sequence: Synthetic peptide
QQSYQSPTT

SEQ ID NO: 2650 - protein, 9 aa, Artificial Sequence
  Description of Artificial Sequence: Synthetic peptide
QQSYFPVVE

SEQ ID NO: 2651 - protein, 9 aa, Artificial Sequence
  Description of Artificial Sequence: Synthetic peptide
QQSYTPPTT

SEQ ID NO: 2652 - protein, 9 aa, Artificial Sequence
  Description of Artificial Sequence: Synthetic peptide
QQSYSYPNS

SEQ ID NO: 2653 - protein, 9 aa, Artificial Sequence
  Description of Artificial Sequence: Synthetic peptide
QQTYSMPFT

SEQ ID NO: 2654 - protein, 9 aa, Artificial Sequence
  Description of Artificial Sequence: Synthetic peptide
QQSYSTPYT

SEQ ID NO: 2655 - protein, 9 aa, Artificial Sequence
  Description of Artificial Sequence: Synthetic peptide
IQAYTSPFT

SEQ ID NO: 2656 - protein, 9 aa, Artificial Sequence
  Description of Artificial Sequence: Synthetic peptide
QQTYSSPFT

SEQ ID NO: 2657 - protein, 9 aa, Artificial Sequence
  Description of Artificial Sequence: Synthetic peptide
QQSYSTPFT

SEQ ID NO: 2658 - protein, 9 aa, Artificial Sequence
  Description of Artificial Sequence: Synthetic peptide
QQTYSMPFT

SEQ ID NO: 2659 - protein, 9 aa, Artificial Sequence
  Description of Artificial Sequence: Synthetic peptide
QQTYSMPFT

SEQ ID NO: 2660 - protein, 9 aa, Artificial Sequence
  Description of Artificial Sequence: Synthetic peptide
QQTYSMPFT

SEQ ID NO: 2661 - protein, 9 aa, Artificial Sequence
  Description of Artificial Sequence: Synthetic peptide
QQTYSMPFT

SEQ ID NO: 2662 - protein, 9 aa, Artificial Sequence
  Description of Artificial Sequence: Synthetic peptide
QQTYSMPFT

SEQ ID NO: 2663 - protein, 9 aa, Artificial Sequence
  Description of Artificial Sequence: Synthetic peptide
QQYYSTPIT

SEQ ID NO: 2664 - protein, 9 aa, Artificial Sequence
  Description of Artificial Sequence: Synthetic peptide
QQFYSTPIT

SEQ ID NO: 2665 - protein, 9 aa, Artificial Sequence
  Description of Artificial Sequence: Synthetic peptide
QKYNSAPWT

SEQ ID NO: 2666 - protein, 9 aa, Artificial Sequence
  Description of Artificial Sequence: Synthetic peptide
QKYNSAPFT

SEQ ID NO: 2667 - protein, 9 aa, Artificial Sequence
  Description of Artificial Sequence: Synthetic peptide
QKYNSAPFT

SEQ ID NO: 2668 - protein, 9 aa, Artificial Sequence
  Description of Artificial Sequence: Synthetic peptide
MQRIEFPWT

SEQ ID NO: 2669 - protein, 9 aa, Artificial Sequence
  Description of Artificial Sequence: Synthetic peptide
MQALQTPWT

SEQ ID NO: 2670 - protein, 11 aa, Artificial Sequence
  Description of Artificial Sequence: Synthetic peptide
QVWDSSSDHVV

SEQ ID NO: 2671 - protein, 11 aa, Artificial Sequence
  Description of Artificial Sequence: Synthetic peptide
QVWDYERPAMV

SEQ ID NO: 2672 - protein, 11 aa, Artificial Sequence
  Description of Artificial Sequence: Synthetic peptide
QVWDYLRQQQV

SEQ ID NO: 2673 - protein, 11 aa, Artificial Sequence
  Description of Artificial Sequence: Synthetic peptide
QVWDYYSNRAV

SEQ ID NO: 2674 - protein, 11 aa, Artificial Sequence
  Description of Artificial Sequence: Synthetic peptide
QVWDYSGQRQV

SEQ ID NO: 2675 - protein, 11 aa, Artificial Sequence
  Description of Artificial Sequence: Synthetic peptide
QVWDYLLPGQV

SEQ ID NO: 2676 - protein, 11 aa, Artificial Sequence
  Description of Artificial Sequence: Synthetic peptide
QVWDYVAPRHV

SEQ ID NO: 2677 - protein, 11 aa, Artificial Sequence
  Description of Artificial Sequence: Synthetic peptide
QVWDYVAPRHV

SEQ ID NO: 2678 - protein, 12 aa, Artificial Sequence
  Description of Artificial Sequence: Synthetic peptide
QVWDASAGYGVV

SEQ ID NO: 2679 - protein, 11 aa, Artificial Sequence
  Description of Artificial Sequence: Synthetic peptide
QVWDYSPLRHV

SEQ ID NO: 2680 - protein, 11 aa, Artificial Sequence
  Description of Artificial Sequence: Synthetic peptide
QVWDYFSMTHV

SEQ ID NO: 2681 - protein, 10 aa, Artificial Sequence
  Description of Artificial Sequence: Synthetic peptide
LLYYGGAQWV

SEQ ID NO: 2682 - protein, 9 aa, Artificial Sequence
  Description of Artificial Sequence: Synthetic peptide
VLWYSNRWV

SEQ ID NO: 2683 - protein, 9 aa, Artificial Sequence
  Description of Artificial Sequence: Synthetic peptide
VLWYSNRWV

SEQ ID NO: 2684 - protein, 9 aa, Artificial Sequence
  Description of Artificial Sequence: Synthetic peptide
VLWYSNRWV

SEQ ID NO: 2685 - protein, 9 aa, Artificial Sequence
  Description of Artificial Sequence: Synthetic peptide
VLWYSNRWV

SEQ ID NO: 2686 - protein, 9 aa, Artificial Sequence
  Description of Artificial Sequence: Synthetic peptide
VLWYSNRWV

SEQ ID NO: 2687 - protein, 9 aa, Artificial Sequence
  Description of Artificial Sequence: Synthetic peptide
VLWYSNRWV

SEQ ID NO: 2688 - protein, 9 aa, Artificial Sequence
  Description of Artificial Sequence: Synthetic peptide
VLWYSNRWV

SEQ ID NO: 2689 - protein, 9 aa, Artificial Sequence
  Description of Artificial Sequence: Synthetic peptide
VLWYSNRWV

SEQ ID NO: 2690 - protein, 9 aa, Artificial Sequence
  Description of Artificial Sequence: Synthetic peptide
VLWYSNRWV

SEQ ID NO: 2691 - protein, 9 aa, Artificial Sequence
  Description of Artificial Sequence: Synthetic peptide
VLWYSNRWV

SEQ ID NO: 2692 - protein, 9 aa, Artificial Sequence
  Description of Artificial Sequence: Synthetic peptide
VLWYSNRWV

SEQ ID NO: 2693 - protein, 9 aa, Artificial Sequence
  Description of Artificial Sequence: Synthetic peptide
VLWYSNRWV

SEQ ID NO: 2694 - protein, 9 aa, Artificial Sequence
  Description of Artificial Sequence: Synthetic peptide
VLWYSNRWV

SEQ ID NO: 2695 - protein, 9 aa, Artificial Sequence
  Description of Artificial Sequence: Synthetic peptide
VLWYSNRWV

SEQ ID NO: 2696 - protein, 9 aa, Artificial Sequence
  Description of Artificial Sequence: Synthetic peptide
VLWYSNRWV

SEQ ID NO: 2697 - protein, 9 aa, Artificial Sequence
  Description of Artificial Sequence: Synthetic peptide
VLWYSNRWV

SEQ ID NO: 2698 - protein, 9 aa, Artificial Sequence
  Description of Artificial Sequence: Synthetic peptide
VLWYSNRWV

SEQ ID NO: 2699 - protein, 9 aa, Artificial Sequence
  Description of Artificial Sequence: Synthetic peptide
VLWYSNRWV

SEQ ID NO: 2700 - protein, 9 aa, Artificial Sequence
  Description of Artificial Sequence: Synthetic peptide
VLWYSNRWV

SEQ ID NO: 2701 - protein, 9 aa, Artificial Sequence
  Description of Artificial Sequence: Synthetic peptide
VLWYSNRWV

SEQ ID NO: 2702 - protein, 9 aa, Artificial Sequence
  Description of Artificial Sequence: Synthetic peptide
VLWYSNRWV

SEQ ID NO: 2703 - protein, 9 aa, Artificial Sequence
  Description of Artificial Sequence: Synthetic peptide
VLWYSNRWV

SEQ ID NO: 2704 - protein, 9 aa, Artificial Sequence
  Description of Artificial Sequence: Synthetic peptide
VLWYSNRWV

SEQ ID NO: 2705 - protein, 9 aa, Artificial Sequence
  Description of Artificial Sequence: Synthetic peptide
VLWYSNRWV

SEQ ID NO: 2706 - protein, 9 aa, Artificial Sequence
  Description of Artificial Sequence: Synthetic peptide
VLWYSNRWV

SEQ ID NO: 2707 - protein, 9 aa, Artificial Sequence
  Description of Artificial Sequence: Synthetic peptide
VLWYSNRWV

SEQ ID NO: 2708 - protein, 9 aa, Artificial Sequence
  Description of Artificial Sequence: Synthetic peptide
VLWYSNRWV

SEQ ID NO: 2709 - protein, 9 aa, Artificial Sequence
  Description of Artificial Sequence: Synthetic peptide
VLWYSNRWV

SEQ ID NO: 2710 - protein, 9 aa, Artificial Sequence
  Description of Artificial Sequence: Synthetic peptide
VLWYSNRWV

SEQ ID NO: 2711 - protein, 9 aa, Artificial Sequence
  Description of Artificial Sequence: Synthetic peptide
VLWYSNRWV

SEQ ID NO: 2712 - protein, 9 aa, Artificial Sequence
  Description of Artificial Sequence: Synthetic peptide
VLWYSNRWV

SEQ ID NO: 2713 - protein, 9 aa, Artificial Sequence
  Description of Artificial Sequence: Synthetic peptide
VLWYSNRWV

SEQ ID NO: 2714 - protein, 9 aa, Artificial Sequence
  Description of Artificial Sequence: Synthetic peptide
VLWYSNRWV

SEQ ID NO: 2715 - protein, 9 aa, Artificial Sequence
  Description of Artificial Sequence: Synthetic peptide
VLWYSNRWV

SEQ ID NO: 2716 - protein, 9 aa, Artificial Sequence
  Description of Artificial Sequence: Synthetic peptide
VLWYSNRWV

SEQ ID NO: 2717 - protein, 9 aa, Artificial Sequence
  Description of Artificial Sequence: Synthetic peptide
VLWYSNRWV

SEQ ID NO: 2718 - protein, 11 aa, Artificial Sequence
  Description of Artificial Sequence: Synthetic peptide
QVWDSSSDHWV

SEQ ID NO: 2719 - protein, 11 aa, Artificial Sequence
  Description of Artificial Sequence: Synthetic peptide
QVWDYRTLDWV

SEQ ID NO: 2720 - protein, 11 aa, Artificial Sequence
  Description of Artificial Sequence: Synthetic peptide
QVWDYRTLDWV

SEQ ID NO: 2721 - protein, 11 aa, Artificial Sequence
  Description of Artificial Sequence: Synthetic peptide
QVWDYNMNVWV

SEQ ID NO: 2722 - protein, 11 aa, Artificial Sequence
  Description of Artificial Sequence: Synthetic peptide
QVWDYVTPRWV

SEQ ID NO: 2723 - protein, 10 aa, Artificial Sequence
  Description of Artificial Sequence: Synthetic peptide
GIAVAGYFDY

SEQ ID NO: 2724 - protein, 10 aa, Artificial Sequence
  Description of Artificial Sequence: Synthetic peptide
GKGVHLGFDY

SEQ ID NO: 2725 - protein, 10 aa, Artificial Sequence
  Description of Artificial Sequence: Synthetic peptide
GKGVHLGFDY

SEQ ID NO: 2726 - protein, 10 aa, Artificial Sequence
  Description of Artificial Sequence: Synthetic peptide
GKGVHLGFDY

SEQ ID NO: 2727 - protein, 10 aa, Artificial Sequence
  Description of Artificial Sequence: Synthetic peptide
GKGVHLGFDY

SEQ ID NO: 2728 - protein, 10 aa, Artificial Sequence
  Description of Artificial Sequence: Synthetic peptide
GKGVHLGFDY

SEQ ID NO: 2729 - protein, 10 aa, Artificial Sequence
  Description of Artificial Sequence: Synthetic peptide
GKGVHLGFDY

SEQ ID NO: 2730 - protein, 10 aa, Artificial Sequence
  Description of Artificial Sequence: Synthetic peptide
GKGVHLGFDY

SEQ ID NO: 2731 - protein, 10 aa, Artificial Sequence
  Description of Artificial Sequence: Synthetic peptide
GKGVHLNFDY

SEQ ID NO: 2732 - protein, 10 aa, Artificial Sequence
  Description of Artificial Sequence: Synthetic peptide
GKGVHLGFDY

SEQ ID NO: 2733 - protein, 10 aa, Artificial Sequence
  Description of Artificial Sequence: Synthetic peptide
GKGVHLGFDY

SEQ ID NO: 2734 - protein, 10 aa, Artificial Sequence
  Description of Artificial Sequence: Synthetic peptide
GKGVHLGFDY

SEQ ID NO: 2735 - protein, 10 aa, Artificial Sequence
  Description of Artificial Sequence: Synthetic peptide
GKGVHLGFDY

SEQ ID NO: 2736 - protein, 10 aa, Artificial Sequence
  Description of Artificial Sequence: Synthetic peptide
GKGVHLGFDY

SEQ ID NO: 2737 - protein, 13 aa, Artificial Sequence
  Description of Artificial Sequence: Synthetic peptide
ITIFGVVIIYFDY

SEQ ID NO: 2738 - protein, 14 aa, Artificial Sequence
  Description of Artificial Sequence: Synthetic peptide
HGNFGNSYISYWAY

SEQ ID NO: 2739 - protein, 14 aa, Artificial Sequence
  Description of Artificial Sequence: Synthetic peptide
HGNFGNSYISYWAY

SEQ ID NO: 2740 - protein, 14 aa, Artificial Sequence
  Description of Artificial Sequence: Synthetic peptide
HGNFGNSYISYWAY

SEQ ID NO: 2741 - protein, 14 aa, Artificial Sequence
  Description of Artificial Sequence: Synthetic peptide
HGNFGNSYISYWAY

SEQ ID NO: 2742 - protein, 14 aa, Artificial Sequence
  Description of Artificial Sequence: Synthetic peptide
HGNFGNSYISYWAY

SEQ ID NO: 2743 - protein, 14 aa, Artificial Sequence
  Description of Artificial Sequence: Synthetic peptide
HGNFGNSYISYWAY

SEQ ID NO: 2744 - protein, 14 aa, Artificial Sequence
  Description of Artificial Sequence: Synthetic peptide
HGNFGNSYISYWAY

SEQ ID NO: 2745 - protein, 14 aa, Artificial Sequence
  Description of Artificial Sequence: Synthetic peptide
HGNFGNSYISYWAY

SEQ ID NO: 2746 - protein, 14 aa, Artificial Sequence
  Description of Artificial Sequence: Synthetic peptide
HGNFGNSYISYWAY

SEQ ID NO: 2747 - protein, 14 aa, Artificial Sequence
  Description of Artificial Sequence: Synthetic peptide
HGNFGNSYISYWAY

SEQ ID NO: 2748 - protein, 14 aa, Artificial Sequence
  Description of Artificial Sequence: Synthetic peptide
HGNFGNSYISYWAY

SEQ ID NO: 2749 - protein, 14 aa, Artificial Sequence
  Description of Artificial Sequence: Synthetic peptide
HGNFGNSYISYWAY

SEQ ID NO: 2750 - protein, 14 aa, Artificial Sequence
  Description of Artificial Sequence: Synthetic peptide
HGNFGNSYISYWAY

SEQ ID NO: 2751 - protein, 14 aa, Artificial Sequence
  Description of Artificial Sequence: Synthetic peptide
HGNFGNSYISYWAY

SEQ ID NO: 2752 - protein, 14 aa, Artificial Sequence
  Description of Artificial Sequence: Synthetic peptide
HGNFGNSYISYWAY

SEQ ID NO: 2753 - protein, 14 aa, Artificial Sequence
  Description of Artificial Sequence: Synthetic peptide
HGNFGNSYISYWAY

SEQ ID NO: 2754 - protein, 14 aa, Artificial Sequence
  Description of Artificial Sequence: Synthetic peptide
HGNFGNSYISYWAY

SEQ ID NO: 2755 - protein, 14 aa, Artificial Sequence
  Description of Artificial Sequence: Synthetic peptide
HGNFGNSYISYWAY

SEQ ID NO: 2756 - protein, 14 aa, Artificial Sequence
  Description of Artificial Sequence: Synthetic peptide
HGNFGNSYISYWAY

SEQ ID NO: 2757 - protein, 14 aa, Artificial Sequence
  Description of Artificial Sequence: Synthetic peptide
HGNFGNSYISYWAY

SEQ ID NO: 2758 - protein, 14 aa, Artificial Sequence
  Description of Artificial Sequence: Synthetic peptide
HGNFGNSYISYWAY

SEQ ID NO: 2759 - protein, 14 aa, Artificial Sequence
  Description of Artificial Sequence: Synthetic peptide
HGNFGNSYISYWAY

SEQ ID NO: 2760 - protein, 14 aa, Artificial Sequence
  Description of Artificial Sequence: Synthetic peptide
HGNFGNSYISYWAY

SEQ ID NO: 2761 - protein, 14 aa, Artificial Sequence
  Description of Artificial Sequence: Synthetic peptide
HGNFGNSYISYWAY

SEQ ID NO: 2762 - protein, 14 aa, Artificial Sequence
  Description of Artificial Sequence: Synthetic peptide
HGNFGNSYISYWAY

SEQ ID NO: 2763 - protein, 14 aa, Artificial Sequence
  Description of Artificial Sequence: Synthetic peptide
HGNFGNSYISYWAY

SEQ ID NO: 2764 - protein, 14 aa, Artificial Sequence
  Description of Artificial Sequence: Synthetic peptide
HGNFGNSYISYWAY

SEQ ID NO: 2765 - protein, 14 aa, Artificial Sequence
  Description of Artificial Sequence: Synthetic peptide
HGNFGNSYISYWAY

SEQ ID NO: 2766 - protein, 14 aa, Artificial Sequence
  Description of Artificial Sequence: Synthetic peptide
HGNFGNSYISYWAY

SEQ ID NO: 2767 - protein, 14 aa, Artificial Sequence
  Description of Artificial Sequence: Synthetic peptide
HGNFGNSYISYWAY

SEQ ID NO: 2768 - protein, 14 aa, Artificial Sequence
  Description of Artificial Sequence: Synthetic peptide
HGNFGNSYISYWAY

SEQ ID NO: 2769 - protein, 14 aa, Artificial Sequence
  Description of Artificial Sequence: Synthetic peptide
HGNFGNSYISYWAY

SEQ ID NO: 2770 - protein, 14 aa, Artificial Sequence
  Description of Artificial Sequence: Synthetic peptide
HGNFGNSYISYWAY

SEQ ID NO: 2771 - protein, 14 aa, Artificial Sequence
  Description of Artificial Sequence: Synthetic peptide
HGNFGNSYISYWAY

SEQ ID NO: 2772 - protein, 14 aa, Artificial Sequence
  Description of Artificial Sequence: Synthetic peptide
HGNFGNSYISYWAY

SEQ ID NO: 2773 - protein, 14 aa, Artificial Sequence
  Description of Artificial Sequence: Synthetic peptide
HGNFGNSYISYWAY

SEQ ID NO: 2774 - protein, 8 aa, Artificial Sequence
  Description of Artificial Sequence: Synthetic peptide
LLLNWFDP

SEQ ID NO: 2775 - protein, 13 aa, Artificial Sequence
  Description of Artificial Sequence: Synthetic peptide
RRYNWNYENWFDP

SEQ ID NO: 2776 - protein, 19 aa, Artificial Sequence
  Description of Artificial Sequence: Synthetic peptide
YYYGSGSYYNYYYYYGMDV

SEQ ID NO: 2777 - protein, 16 aa, Artificial Sequence
  Description of Artificial Sequence: Synthetic peptide
PSYSGSYYNYFSVMDV

SEQ ID NO: 2778 - protein, 16 aa, Artificial Sequence
  Description of Artificial Sequence: Synthetic peptide
PSYSGSYYNYFSVMDV

SEQ ID NO: 2779 - protein, 16 aa, Artificial Sequence
  Description of Artificial Sequence: Synthetic peptide
PSYSGSYYNYFSVMDV

SEQ ID NO: 2780 - protein, 16 aa, Artificial Sequence
  Description of Artificial Sequence: Synthetic peptide
PSYSGSYYNYFSVMDV

SEQ ID NO: 2781 - protein, 16 aa, Artificial Sequence
  Description of Artificial Sequence: Synthetic peptide
PSYSGSYYNYFSVMDV

SEQ ID NO: 2782 - protein, 16 aa, Artificial Sequence
  Description of Artificial Sequence: Synthetic peptide
PSYSGSYYNYFSVMDV

SEQ ID NO: 2783 - protein, 16 aa, Artificial Sequence
  Description of Artificial Sequence: Synthetic peptide
PSYSGSYYNYFSVMDV

SEQ ID NO: 2784 - protein, 16 aa, Artificial Sequence
  Description of Artificial Sequence: Synthetic peptide
PSYSGSYYNYFSVMDV

SEQ ID NO: 2785 - protein, 16 aa, Artificial Sequence
  Description of Artificial Sequence: Synthetic peptide
PSYSGSYYNYFSVMDV

SEQ ID NO: 2786 - protein, 8 aa, Artificial Sequence
  Description of Artificial Sequence: Synthetic peptide
LLLNWFDP

SEQ ID NO: 2787 - protein, 13 aa, Artificial Sequence
  Description of Artificial Sequence: Synthetic peptide
RRYNWNYENWFDP

SEQ ID NO: 2788 - protein, 13 aa, Artificial Sequence
  Description of Artificial Sequence: Synthetic peptide
RRYNWNYENWFDP

SEQ ID NO: 2789 - protein, 13 aa, Artificial Sequence
  Description of Artificial Sequence: Synthetic peptide
RRYNWNYENWFDP

SEQ ID NO: 2790 - protein, 13 aa, Artificial Sequence
  Description of Artificial Sequence: Synthetic peptide
RRYNWNYENWFDP

SEQ ID NO: 2791 - protein, 13 aa, Artificial Sequence
  Description of Artificial Sequence: Synthetic peptide
RRYNWNYENWFDP

SEQ ID NO: 2792 - protein, 13 aa, Artificial Sequence
  Description of Artificial Sequence: Synthetic peptide
RRYNWNYENWFDP

SEQ ID NO: 2793 - protein, 13 aa, Artificial Sequence
  Description of Artificial Sequence: Synthetic peptide
RRYNWNYENWFDP

SEQ ID NO: 2794 - protein, 13 aa, Artificial Sequence
  Description of Artificial Sequence: Synthetic peptide
RRYNWNYENWFDP

SEQ ID NO: 2795 - protein, 13 aa, Artificial Sequence
  Description of Artificial Sequence: Synthetic peptide
ITIFGVVIIYFDY

SEQ ID NO: 2796 - protein, 11 aa, Artificial Sequence
  Description of Artificial Sequence: Synthetic peptide
GIFGVITYFDY

SEQ ID NO: 2797 - protein, 9 aa, Artificial Sequence
  Description of Artificial Sequence: Synthetic peptide
VQLERYFDY

SEQ ID NO: 2798 - protein, 7 aa, Artificial Sequence
  Description of Artificial Sequence: Synthetic peptide
GQLLTGY

SEQ ID NO: 2799 - protein, 7 aa, Artificial Sequence
  Description of Artificial Sequence: Synthetic peptide
GQLLTGY

SEQ ID NO: 2800 - protein, 9 aa, Artificial Sequence
  Description of Artificial Sequence: Synthetic peptide
YNWNDYFDY

SEQ ID NO: 2801 - protein, 8 aa, Artificial Sequence
  Description of Artificial Sequence: Synthetic peptide
YNYGHFDY

SEQ ID NO: 2802 - protein, 18 aa, Artificial Sequence
  Description of Artificial Sequence: Synthetic peptide
ITMVRGVIIYYYYYGMDV

SEQ ID NO: 2803 - protein, 16 aa, Artificial Sequence
  Description of Artificial Sequence: Synthetic peptide
EKMWFGVLNYYYGMDV

SEQ ID NO: 2804 - protein, 10 aa, Artificial Sequence
  Description of Artificial Sequence: Synthetic peptide
FGQGTKVEIK

SEQ ID NO: 2805 - protein, 10 aa, Artificial Sequence
  Description of Artificial Sequence: Synthetic peptide
FGCGTKVEIK

SEQ ID NO: 2806 - protein, 10 aa, Artificial Sequence
  Description of Artificial Sequence: Synthetic peptide
FGCGTKVEIK

SEQ ID NO: 2807 - protein, 10 aa, Artificial Sequence
  Description of Artificial Sequence: Synthetic peptide
FGCGTKVEIK

SEQ ID NO: 2808 - protein, 10 aa, Artificial Sequence
  Description of Artificial Sequence: Synthetic peptide
FGCGTKVEIK

SEQ ID NO: 2809 - protein, 10 aa, Artificial Sequence
  Description of Artificial Sequence: Synthetic peptide
FGCGTKVEIK

SEQ ID NO: 2810 - protein, 10 aa, Artificial Sequence
  Description of Artificial Sequence: Synthetic peptide
FGCGTKVEIK

SEQ ID NO: 2811 - protein, 10 aa, Artificial Sequence
  Description of Artificial Sequence: Synthetic peptide
FGCGTKVEIK

SEQ ID NO: 2812 - protein, 10 aa, Artificial Sequence
  Description of Artificial Sequence: Synthetic peptide
FGCGTKVEIK

SEQ ID NO: 2813 - protein, 10 aa, Artificial Sequence
  Description of Artificial Sequence: Synthetic peptide
FGCGTKVEIK

SEQ ID NO: 2814 - protein, 10 aa, Artificial Sequence
  Description of Artificial Sequence: Synthetic peptide
FGCGTKVEIK

SEQ ID NO: 2815 - protein, 10 aa, Artificial Sequence
  Description of Artificial Sequence: Synthetic peptide
FGCGTKVEIK

SEQ ID NO: 2816 - protein, 10 aa, Artificial Sequence
  Description of Artificial Sequence: Synthetic peptide
FGQGTKLEIK

SEQ ID NO: 2817 - protein, 10 aa, Artificial Sequence
  Description of Artificial Sequence: Synthetic peptide
FGCGTKLEIK

SEQ ID NO: 2818 - protein, 10 aa, Artificial Sequence
  Description of Artificial Sequence: Synthetic peptide
FGCGTKLEIK

SEQ ID NO: 2819 - protein, 10 aa, Artificial Sequence
  Description of Artificial Sequence: Synthetic peptide
FGPGTKVDIK

SEQ ID NO: 2820 - protein, 10 aa, Artificial Sequence
  Description of Artificial Sequence: Synthetic peptide
FGCGTKVDIK

SEQ ID NO: 2821 - protein, 10 aa, Artificial Sequence
  Description of Artificial Sequence: Synthetic peptide
FGCGTKVDIK

SEQ ID NO: 2822 - protein, 10 aa, Artificial Sequence
  Description of Artificial Sequence: Synthetic peptide
FGCGTKVDIK

SEQ ID NO: 2823 - protein, 10 aa, Artificial Sequence
  Description of Artificial Sequence: Synthetic peptide
FGCGTKVDIK

SEQ ID NO: 2824 - protein, 10 aa, Artificial Sequence
  Description of Artificial Sequence: Synthetic peptide
FGCGTKVDIK

SEQ ID NO: 2825 - protein, 10 aa, Artificial Sequence
  Description of Artificial Sequence: Synthetic peptide
FGQGTRLEIK

SEQ ID NO: 2826 - protein, 10 aa, Artificial Sequence
  Description of Artificial Sequence: Synthetic peptide
FGCGTRLEIK

SEQ ID NO: 2827 - protein, 10 aa, Artificial Sequence
  Description of Artificial Sequence: Synthetic peptide
FGQGTKVEIK

SEQ ID NO: 2828 - protein, 10 aa, Artificial Sequence
  Description of Artificial Sequence: Synthetic peptide
FGCGTKVEIK

SEQ ID NO: 2829 - protein, 10 aa, Artificial Sequence
  Description of Artificial Sequence: Synthetic peptide
FGCGTKVEIK

SEQ ID NO: 2830 - protein, 10 aa, Artificial Sequence
  Description of Artificial Sequence: Synthetic peptide
FGQGTKVEIK

SEQ ID NO: 2831 - protein, 10 aa, Artificial Sequence
  Description of Artificial Sequence: Synthetic peptide
FGCGTKVEIK

SEQ ID NO: 2832 - protein, 10 aa, Artificial Sequence
  Description of Artificial Sequence: Synthetic peptide
FGGGTKLTVL

SEQ ID NO: 2833 - protein, 10 aa, Artificial Sequence
  Description of Artificial Sequence: Synthetic peptide
FGCGTKLTVL

SEQ ID NO: 2834 - protein, 10 aa, Artificial Sequence
  Description of Artificial Sequence: Synthetic peptide
FGCGTKLTVL

SEQ ID NO: 2835 - protein, 10 aa, Artificial Sequence
  Description of Artificial Sequence: Synthetic peptide
FGCGTKLTVL

SEQ ID NO: 2836 - protein, 10 aa, Artificial Sequence
  Description of Artificial Sequence: Synthetic peptide
FGCGTKLTVL

SEQ ID NO: 2837 - protein, 10 aa, Artificial Sequence
  Description of Artificial Sequence: Synthetic peptide
FGCGTKLTVL

SEQ ID NO: 2838 - protein, 10 aa, Artificial Sequence
  Description of Artificial Sequence: Synthetic peptide
FGCGTKLTVL

SEQ ID NO: 2839 - protein, 10 aa, Artificial Sequence
  Description of Artificial Sequence: Synthetic peptide
FGCGTKLTVL

SEQ ID NO: 2840 - protein, 10 aa, Artificial Sequence
  Description of Artificial Sequence: Synthetic peptide
FGCGTKLTVL

SEQ ID NO: 2841 - protein, 10 aa, Artificial Sequence
  Description of Artificial Sequence: Synthetic peptide
FGCGTKLTVL

SEQ ID NO: 2842 - protein, 10 aa, Artificial Sequence
  Description of Artificial Sequence: Synthetic peptide
FGCGTKLTVL

SEQ ID NO: 2843 - protein, 10 aa, Artificial Sequence
  Description of Artificial Sequence: Synthetic peptide
FGGGTKLTVL

SEQ ID NO: 2844 - protein, 10 aa, Artificial Sequence
  Description of Artificial Sequence: Synthetic peptide
FGGGTKLTVL

SEQ ID NO: 2845 - protein, 10 aa, Artificial Sequence
  Description of Artificial Sequence: Synthetic peptide
FGGGTKLTVL

SEQ ID NO: 2846 - protein, 10 aa, Artificial Sequence
  Description of Artificial Sequence: Synthetic peptide
FGGGTKLTVL

SEQ ID NO: 2847 - protein, 10 aa, Artificial Sequence
  Description of Artificial Sequence: Synthetic peptide
FGGGTKLTVL

SEQ ID NO: 2848 - protein, 10 aa, Artificial Sequence
  Description of Artificial Sequence: Synthetic peptide
FGGGTKLTVL

SEQ ID NO: 2849 - protein, 10 aa, Artificial Sequence
  Description of Artificial Sequence: Synthetic peptide
FGGGTKLTVL

SEQ ID NO: 2850 - protein, 10 aa, Artificial Sequence
  Description of Artificial Sequence: Synthetic peptide
FGGGTKLTVL

SEQ ID NO: 2851 - protein, 10 aa, Artificial Sequence
  Description of Artificial Sequence: Synthetic peptide
FGGGTKLTVL

SEQ ID NO: 2852 - protein, 10 aa, Artificial Sequence
  Description of Artificial Sequence: Synthetic peptide
FGGGTKLTVL

SEQ ID NO: 2853 - protein, 10 aa, Artificial Sequence
  Description of Artificial Sequence: Synthetic peptide
FGGGTKLTVL

SEQ ID NO: 2854 - protein, 10 aa, Artificial Sequence
  Description of Artificial Sequence: Synthetic peptide
FGGGTKLTVL

SEQ ID NO: 2855 - protein, 10 aa, Artificial Sequence
  Description of Artificial Sequence: Synthetic peptide
FGGGTKLTVL

SEQ ID NO: 2856 - protein, 10 aa, Artificial Sequence
  Description of Artificial Sequence: Synthetic peptide
FGGGTKLTVL

SEQ ID NO: 2857 - protein, 10 aa, Artificial Sequence
  Description of Artificial Sequence: Synthetic peptide
FGGGTKLTVL

SEQ ID NO: 2858 - protein, 10 aa, Artificial Sequence
  Description of Artificial Sequence: Synthetic peptide
FGGGTKLTVL

SEQ ID NO: 2859 - protein, 10 aa, Artificial Sequence
  Description of Artificial Sequence: Synthetic peptide
FGGGTKLTVL

SEQ ID NO: 2860 - protein, 10 aa, Artificial Sequence
  Description of Artificial Sequence: Synthetic peptide
FGGGTKLTVL

SEQ ID NO: 2861 - protein, 10 aa, Artificial Sequence
  Description of Artificial Sequence: Synthetic peptide
FGGGTKLTVL

SEQ ID NO: 2862 - protein, 10 aa, Artificial Sequence
  Description of Artificial Sequence: Synthetic peptide
FGGGTKLTVL

SEQ ID NO: 2863 - protein, 10 aa, Artificial Sequence
  Description of Artificial Sequence: Synthetic peptide
FGGGTKLTVL

SEQ ID NO: 2864 - protein, 10 aa, Artificial Sequence
  Description of Artificial Sequence: Synthetic peptide
FGGGTKLTVL

SEQ ID NO: 2865 - protein, 10 aa, Artificial Sequence
  Description of Artificial Sequence: Synthetic peptide
FGGGTKLTVL

SEQ ID NO: 2866 - protein, 10 aa, Artificial Sequence
  Description of Artificial Sequence: Synthetic peptide
FGGGTKLTVL

SEQ ID NO: 2867 - protein, 10 aa, Artificial Sequence
  Description of Artificial Sequence: Synthetic peptide
FGGGTKLTVL

SEQ ID NO: 2868 - protein, 10 aa, Artificial Sequence
  Description of Artificial Sequence: Synthetic peptide
FGGGTKLTVL

SEQ ID NO: 2869 - protein, 10 aa, Artificial Sequence
  Description of Artificial Sequence: Synthetic peptide
FGGGTKLTVL

SEQ ID NO: 2870 - protein, 10 aa, Artificial Sequence
  Description of Artificial Sequence: Synthetic peptide
FGGGTKLTVL

SEQ ID NO: 2871 - protein, 10 aa, Artificial Sequence
  Description of Artificial Sequence: Synthetic peptide
FGGGTKLTVL

SEQ ID NO: 2872 - protein, 10 aa, Artificial Sequence
  Description of Artificial Sequence: Synthetic peptide
FGGGTKLTVL

SEQ ID NO: 2873 - protein, 10 aa, Artificial Sequence
  Description of Artificial Sequence: Synthetic peptide
FGGGTKLTVL

SEQ ID NO: 2874 - protein, 10 aa, Artificial Sequence
  Description of Artificial Sequence: Synthetic peptide
FGGGTKLTVL

SEQ ID NO: 2875 - protein, 10 aa, Artificial Sequence
  Description of Artificial Sequence: Synthetic peptide
FGGGTKLTVL

SEQ ID NO: 2876 - protein, 10 aa, Artificial Sequence
  Description of Artificial Sequence: Synthetic peptide
FGGGTKLTVL

SEQ ID NO: 2877 - protein, 10 aa, Artificial Sequence
  Description of Artificial Sequence: Synthetic peptide
FGGGTKLTVL

SEQ ID NO: 2878 - protein, 10 aa, Artificial Sequence
  Description of Artificial Sequence: Synthetic peptide
FGGGTKLTVL

SEQ ID NO: 2879 - protein, 10 aa, Artificial Sequence
  Description of Artificial Sequence: Synthetic peptide
FGGGTKLTVL

SEQ ID NO: 2880 - protein, 10 aa, Artificial Sequence
  Description of Artificial Sequence: Synthetic peptide
FGGGTKLTVL

SEQ ID NO: 2881 - protein, 10 aa, Artificial Sequence
  Description of Artificial Sequence: Synthetic peptide
FGCGTKLTVL

SEQ ID NO: 2882 - protein, 10 aa, Artificial Sequence
  Description of Artificial Sequence: Synthetic peptide
FGCGTKLTVL

SEQ ID NO: 2883 - protein, 10 aa, Artificial Sequence
  Description of Artificial Sequence: Synthetic peptide
FGCGTKLTVL

SEQ ID NO: 2884 - protein, 10 aa, Artificial Sequence
  Description of Artificial Sequence: Synthetic peptide
FGCGTKLTVL

SEQ ID NO: 2885 - protein, 11 aa, Artificial Sequence
  Description of Artificial Sequence: Synthetic peptide
WGQGTLVTVSS

SEQ ID NO: 2886 - protein, 11 aa, Artificial Sequence
  Description of Artificial Sequence: Synthetic peptide
WGQGTLVTVSS

SEQ ID NO: 2887 - protein, 11 aa, Artificial Sequence
  Description of Artificial Sequence: Synthetic peptide
WGQGTLVTVSS

SEQ ID NO: 2888 - protein, 11 aa, Artificial Sequence
  Description of Artificial Sequence: Synthetic peptide
WGQGTLVTVSS

SEQ ID NO: 2889 - protein, 11 aa, Artificial Sequence
  Description of Artificial Sequence: Synthetic peptide
WGQGTLVTVSS

SEQ ID NO: 2890 - protein, 11 aa, Artificial Sequence
  Description of Artificial Sequence: Synthetic peptide
WGQGTLVTVSS

SEQ ID NO: 2891 - protein, 11 aa, Artificial Sequence
  Description of Artificial Sequence: Synthetic peptide
WGQGTLVTVSS

SEQ ID NO: 2892 - protein, 11 aa, Artificial Sequence
  Description of Artificial Sequence: Synthetic peptide
WGQGTLVTVSS

SEQ ID NO: 2893 - protein, 11 aa, Artificial Sequence
  Description of Artificial Sequence: Synthetic peptide
WGQGTLVTVSS

SEQ ID NO: 2894 - protein, 11 aa, Artificial Sequence
  Description of Artificial Sequence: Synthetic peptide
WGQGTLVTVSS

SEQ ID NO: 2895 - protein, 11 aa, Artificial Sequence
  Description of Artificial Sequence: Synthetic peptide
WGQGTLVTVSS

SEQ ID NO: 2896 - protein, 11 aa, Artificial Sequence
  Description of Artificial Sequence: Synthetic peptide
WGQGTLVTVSS

SEQ ID NO: 2897 - protein, 11 aa, Artificial Sequence
  Description of Artificial Sequence: Synthetic peptide
WGQGTLVTVSS

SEQ ID NO: 2898 - protein, 11 aa, Artificial Sequence
  Description of Artificial Sequence: Synthetic peptide
WGQGTLVTVSS

SEQ ID NO: 2899 - protein, 11 aa, Artificial Sequence
  Description of Artificial Sequence: Synthetic peptide
WGQGTLVTVSS

SEQ ID NO: 2900 - protein, 11 aa, Artificial Sequence
  Description of Artificial Sequence: Synthetic peptide
WGQGTLVTVSS

SEQ ID NO: 2901 - protein, 11 aa, Artificial Sequence
  Description of Artificial Sequence: Synthetic peptide
WGQGTLVTVSS

SEQ ID NO: 2902 - protein, 11 aa, Artificial Sequence
  Description of Artificial Sequence: Synthetic peptide
WGQGTLVTVSS

SEQ ID NO: 2903 - protein, 11 aa, Artificial Sequence
  Description of Artificial Sequence: Synthetic peptide
WGQGTLVTVSS

SEQ ID NO: 2904 - protein, 11 aa, Artificial Sequence
  Description of Artificial Sequence: Synthetic peptide
WGQGTLVTVSS

SEQ ID NO: 2905 - protein, 11 aa, Artificial Sequence
  Description of Artificial Sequence: Synthetic peptide
WGQGTLVTVSS

SEQ ID NO: 2906 - protein, 11 aa, Artificial Sequence
  Description of Artificial Sequence: Synthetic peptide
WGQGTLVTVSS

SEQ ID NO: 2907 - protein, 11 aa, Artificial Sequence
  Description of Artificial Sequence: Synthetic peptide
WGQGTLVTVSS

SEQ ID NO: 2908 - protein, 11 aa, Artificial Sequence
  Description of Artificial Sequence: Synthetic peptide
WGQGTLVTVSS

SEQ ID NO: 2909 - protein, 11 aa, Artificial Sequence
  Description of Artificial Sequence: Synthetic peptide
WGQGTLVTVSS

SEQ ID NO: 2910 - protein, 11 aa, Artificial Sequence
  Description of Artificial Sequence: Synthetic peptide
WGQGTLVTVSS

SEQ ID NO: 2911 - protein, 11 aa, Artificial Sequence
  Description of Artificial Sequence: Synthetic peptide
WGQGTLVTVSS

SEQ ID NO: 2912 - protein, 11 aa, Artificial Sequence
  Description of Artificial Sequence: Synthetic peptide
WGQGTLVTVSS

SEQ ID NO: 2913 - protein, 11 aa, Artificial Sequence
  Description of Artificial Sequence: Synthetic peptide
WGQGTLVTVSS

SEQ ID NO: 2914 - protein, 11 aa, Artificial Sequence
  Description of Artificial Sequence: Synthetic peptide
WGQGTLVTVSS

SEQ ID NO: 2915 - protein, 11 aa, Artificial Sequence
  Description of Artificial Sequence: Synthetic peptide
WGQGTLVTVSS

SEQ ID NO: 2916 - protein, 11 aa, Artificial Sequence
  Description of Artificial Sequence: Synthetic peptide
WGQGTLVTVSS

SEQ ID NO: 2917 - protein, 11 aa, Artificial Sequence
  Description of Artificial Sequence: Synthetic peptide
WGQGTLVTVSS

SEQ ID NO: 2918 - protein, 11 aa, Artificial Sequence
  Description of Artificial Sequence: Synthetic peptide
WGQGTLVTVSS

SEQ ID NO: 2919 - protein, 11 aa, Artificial Sequence
  Description of Artificial Sequence: Synthetic peptide
WGQGTLVTVSS

SEQ ID NO: 2920 - protein, 11 aa, Artificial Sequence
  Description of Artificial Sequence: Synthetic peptide
WGQGTLVTVSS

SEQ ID NO: 2921 - protein, 11 aa, Artificial Sequence
  Description of Artificial Sequence: Synthetic peptide
WGQGTLVTVSS

SEQ ID NO: 2922 - protein, 11 aa, Artificial Sequence
  Description of Artificial Sequence: Synthetic peptide
WGQGTLVTVSS

SEQ ID NO: 2923 - protein, 11 aa, Artificial Sequence
  Description of Artificial Sequence: Synthetic peptide
WGQGTLVTVSS

SEQ ID NO: 2924 - protein, 11 aa, Artificial Sequence
  Description of Artificial Sequence: Synthetic peptide
WGQGTLVTVSS

SEQ ID NO: 2925 - protein, 11 aa, Artificial Sequence
  Description of Artificial Sequence: Synthetic peptide
WGQGTLVTVSS

SEQ ID NO: 2926 - protein, 11 aa, Artificial Sequence
  Description of Artificial Sequence: Synthetic peptide
WGQGTLVTVSS

SEQ ID NO: 2927 - protein, 11 aa, Artificial Sequence
  Description of Artificial Sequence: Synthetic peptide
WGQGTLVTVSS

SEQ ID NO: 2928 - protein, 11 aa, Artificial Sequence
  Description of Artificial Sequence: Synthetic peptide
WGQGTLVTVSS

SEQ ID NO: 2929 - protein, 11 aa, Artificial Sequence
  Description of Artificial Sequence: Synthetic peptide
WGQGTLVTVSS

SEQ ID NO: 2930 - protein, 11 aa, Artificial Sequence
  Description of Artificial Sequence: Synthetic peptide
WGQGTLVTVSS

SEQ ID NO: 2931 - protein, 11 aa, Artificial Sequence
  Description of Artificial Sequence: Synthetic peptide
WGQGTLVTVSS

SEQ ID NO: 2932 - protein, 11 aa, Artificial Sequence
  Description of Artificial Sequence: Synthetic peptide
WGQGTLVTVSS

SEQ ID NO: 2933 - protein, 11 aa, Artificial Sequence
  Description of Artificial Sequence: Synthetic peptide
WGQGTLVTVSS

SEQ ID NO: 2934 - protein, 11 aa, Artificial Sequence
  Description of Artificial Sequence: Synthetic peptide
WGQGTLVTVSS

SEQ ID NO: 2935 - protein, 11 aa, Artificial Sequence
  Description of Artificial Sequence: Synthetic peptide
WGQGTLVTVSS

SEQ ID NO: 2936 - protein, 11 aa, Artificial Sequence
  Description of Artificial Sequence: Synthetic peptide
WGQGTLVTVSS

SEQ ID NO: 2937 - protein, 11 aa, Artificial Sequence
  Description of Artificial Sequence: Synthetic peptide
WGQGTLVTVSS

SEQ ID NO: 2938 - protein, 11 aa, Artificial Sequence
  Description of Artificial Sequence: Synthetic peptide
WGQGTTVTVSS

SEQ ID NO: 2939 - protein, 11 aa, Artificial Sequence
  Description of Artificial Sequence: Synthetic peptide
WGQGTTVTVSS

SEQ ID NO: 2940 - protein, 11 aa, Artificial Sequence
  Description of Artificial Sequence: Synthetic peptide
WGQGTTVTVSS

SEQ ID NO: 2941 - protein, 11 aa, Artificial Sequence
  Description of Artificial Sequence: Synthetic peptide
WGQGTTVTVSS

SEQ ID NO: 2942 - protein, 11 aa, Artificial Sequence
  Description of Artificial Sequence: Synthetic peptide
WGQGTTVTVSS

SEQ ID NO: 2943 - protein, 11 aa, Artificial Sequence
  Description of Artificial Sequence: Synthetic peptide
WGQGTTVTVSS

SEQ ID NO: 2944 - protein, 11 aa, Artificial Sequence
  Description of Artificial Sequence: Synthetic peptide
WGQGTTVTVSS

SEQ ID NO: 2945 - protein, 11 aa, Artificial Sequence
  Description of Artificial Sequence: Synthetic peptide
WGQGTTVTVSS

SEQ ID NO: 2946 - protein, 11 aa, Artificial Sequence
  Description of Artificial Sequence: Synthetic peptide
WGQGTTVTVSS

SEQ ID NO: 2947 - protein, 11 aa, Artificial Sequence
  Description of Artificial Sequence: Synthetic peptide
WGQGTTVTVSS

SEQ ID NO: 2948 - protein, 11 aa, Artificial Sequence
  Description of Artificial Sequence: Synthetic peptide
WGQGTLVTVSS

SEQ ID NO: 2949 - protein, 11 aa, Artificial Sequence
  Description of Artificial Sequence: Synthetic peptide
WGQGTLVTVSS

SEQ ID NO: 2950 - protein, 11 aa, Artificial Sequence
  Description of Artificial Sequence: Synthetic peptide
WGQGTLVTVSS

SEQ ID NO: 2951 - protein, 11 aa, Artificial Sequence
  Description of Artificial Sequence: Synthetic peptide
WGQGTLVTVSS

SEQ ID NO: 2952 - protein, 11 aa, Artificial Sequence
  Description of Artificial Sequence: Synthetic peptide
WGQGTLVTVSS

SEQ ID NO: 2953 - protein, 11 aa, Artificial Sequence
  Description of Artificial Sequence: Synthetic peptide
WGQGTLVTVSS

SEQ ID NO: 2954 - protein, 11 aa, Artificial Sequence
  Description of Artificial Sequence: Synthetic peptide
WGQGTLVTVSS

SEQ ID NO: 2955 - protein, 11 aa, Artificial Sequence
  Description of Artificial Sequence: Synthetic peptide
WGQGTLVTVSS

SEQ ID NO: 2956 - protein, 11 aa, Artificial Sequence
  Description of Artificial Sequence: Synthetic peptide
WGQGTLVTVSS

SEQ ID NO: 2957 - protein, 11 aa, Artificial Sequence
  Description of Artificial Sequence: Synthetic peptide
WGQGTLVTVSS

SEQ ID NO: 2958 - protein, 11 aa, Artificial Sequence
  Description of Artificial Sequence: Synthetic peptide
WGQGTLVTVSS

SEQ ID NO: 2959 - protein, 11 aa, Artificial Sequence
  Description of Artificial Sequence: Synthetic peptide
WGQGTLVTVSS

SEQ ID NO: 2960 - protein, 11 aa, Artificial Sequence
  Description of Artificial Sequence: Synthetic peptide
WGQGTLVTVSS

SEQ ID NO: 2961 - protein, 11 aa, Artificial Sequence
  Description of Artificial Sequence: Synthetic peptide
WGQGTLVTVSS

SEQ ID NO: 2962 - protein, 11 aa, Artificial Sequence
  Description of Artificial Sequence: Synthetic peptide
WGQGTLVTVSS

SEQ ID NO: 2963 - protein, 11 aa, Artificial Sequence
  Description of Artificial Sequence: Synthetic peptide
WGQGTLVTVSS

SEQ ID NO: 2964 - protein, 11 aa, Artificial Sequence
  Description of Artificial Sequence: Synthetic peptide
WGQGTTVTVSS

SEQ ID NO: 2965 - protein, 11 aa, Artificial Sequence
  Description of Artificial Sequence: Synthetic peptide
WGQGTTVTVSS

SEQ ID NO: 2966 - protein, 1003 aa, Artificial Sequence
  Description of Artificial Sequence: Synthetic polypeptide
MDMRVPAQLLGLLLLWLRGARCEVQLLESGAEVKKPGASVKVSCKASGYTFTRNGLSWVRQAPGQCLEWMGWISGYNGDTNYAQKLQGRGTMTTDTSTSTAYMELRSLRSDDTAVYYCARGRATFDYWGQGTLVTVSSGGGGSGGGGSGGGGSELVMTQSPSSLSASVGDRVTITCRASQGISNYLAWYQQKPGKVPKLLISAASTLQSGVPSRFSGSGSGTDFTLTISSLQPEDVATYYCQKYNSAPFTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2967 - protein, 1014 aa, Artificial Sequence
  Description of Artificial Sequence: Synthetic polypeptide
MDMRVPAQLLGLLLLWLRGARCEVQLLESGGGLVQPGGSLRLSCAASGFTFSNAWMSWVRQAPGKCLEWVGRIKSKTYGGTTDYAAPVKGRFTISRDDSKNTLYLQMNSLKTEDTAVYYCTTPSYSGSYYNYFSVMDVWGQGTTVTVSSGGGGSGGGGSGGGGSELQMTQSPSSLSASVGDRVTITCRTSQSISSYLNWFQQKPGKAPKLLIFAASSLQSGVPSRFSGSGSGTDFTLTISSLQPEDFATYYCQQSYSSPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2968 - protein, 1014 aa, Artificial Sequence
  Description of Artificial Sequence: Synthetic polypeptide
MDMRVPAQLLGLLLLWLRGARCEVQLLESGPGLVKPSETLSLTCTVSGDSISSSRYYWGWIRQPPGKCLEWIGSIYYSGSTYYNPSLKSRVTISVDTSKNQFSLKLSSVTAADTAVYYCARGIFGVITYFDYWGQGTLVTVSSGGGGSGGGGSGGGGSELVMTQTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2969 - protein, 1010 aa, Artificial Sequence
  Description of Artificial Sequence: Synthetic polypeptide
MDMRVPAQLLGLLLLWLRGARCEVQLLESGPMLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2970 - protein, 1018 aa, Artificial Sequence
  Description of Artificial Sequence: Synthetic polypeptide
MDMRVPAQLLGLLLLWLRGARCEVQLLESGPGLVKPSQTLSLTCTVSGDSISSNPYYWSWIRQHPGKCLEWIGYISYSGITNYNPSLKSRVTMSVDTSKNQFSLKLTSLTAADTAVYYCAREKMWFGVLNYYYGMDVWGQGTTVTVSSGGGGSGGGGSGGGGSELVMTQTPLSLPVTPGEPASISCRSSQSLLHRNGYNYLDWYLQKPGQSPQLLIYLGSNRASGVPDRFSGSGSGTDFTLKISRVEAGDVGVYYCMQALQTPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2971 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVLVVYDDNDRPSGIPERFSGSNFGNTATLIISRVEAGDEADYYCQVWDSSSDHVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2972 - protein, 1013 aa, Artificial Sequence
  Description of Artificial Sequence: Synthetic polypeptide
MDMRVPAQLLGLLLLWLRGARCEVQLLESGGGLVQPGGSLRLSCAASGFTFSSYAMSWVRQAPGRCLEWVSTISISGGSTNYADSVKGRFTISRDNSKNTLYLQMNSLRAEDTAVYYCAKDGGSGWFPKLLHYGLDVWGQGTTVTVSSGGGGSGGGGSGGGGSELQMTQSPSSLSASVGDRVTITCQASQDISNYLNWYQQKPGKAPKLLIYAASSLQSGVPSRFSGSGSGTDFTLTISSLQPEDFATYYCQQSYSIPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2973 - protein, 1003 aa, Artificial Sequence
  Description of Artificial Sequence: Synthetic polypeptide
MDMRVPAQLLGLLLLWLRGARCEVQLLESGGGVVQPGRSLRLSCAASGFTFSTYGMHWVRQAPGKCLEWVAVISYDGSNKYYADSVKGRFTISRDDSKNTLYLQMNSLRAEDTAVYYCARGQLLTGYWGQGTLVTVSSGGGGSGGGGSGGGGSELVMTQSPSSLSASVGDRVTITCRASQGISNYLAWYQQKPGKVPKLLIYAASTLQSGVPSRFSGSGSGTDFTLTISSLQPEDVATYYCQKYNSAPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2974 - protein, 1005 aa, Artificial Sequence
  Description of Artificial Sequence: Synthetic polypeptide
MDMRVPAQLLGLLLLWLRGARCEVQLLESGGGLVKPGGSLRLSCAASGFTFSDYYMSWIRQAPGKCLEWVSYISKSGSTIYYADSVKGRFTISRDNAKNSLYLQMNSLRAEDTAVYYCATYNYGHFDYWGQGTLVTVSSGGGGSGGGGSGGGGSELVLTQPPSVSVAPGQTARITCGGNNIGSKSVHWYQQKPGQAPVLVVYDDSDRPSGIPERFSGSNSGNTATLTISRVEAGDEADYYCQVWDSSSDHHVVFGCGTKLTVSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2975 - protein, 11 aa, Artificial Sequence
  Description of Artificial Sequence: Synthetic peptide
RASQGISNYLA

SEQ ID NO: 2976 - protein, 11 aa, Artificial Sequence
  Description of Artificial Sequence: Synthetic peptide
RTSQSISSYLN

SEQ ID NO: 2977 - protein, 17 aa, Artificial Sequence
  Description of Artificial Sequence: Synthetic peptide
KSSQSVLYSSNNKNYLA

SEQ ID NO: 2978 - protein, 11 aa, Artificial Sequence
  Description of Artificial Sequence: Synthetic peptide
RASQSISSYLN

SEQ ID NO: 2979 - protein, 16 aa, Artificial Sequence
  Description of Artificial Sequence: Synthetic peptide
RSSQSLLHRNGYNYLD

SEQ ID NO: 2980 - protein, 11 aa, Artificial Sequence
  Description of Artificial Sequence: Synthetic peptide
GGNNIGSKSVH

SEQ ID NO: 2981 - protein, 11 aa, Artificial Sequence
  Description of Artificial Sequence: Synthetic peptide
QASQDISNYLN

SEQ ID NO: 2982 - protein, 11 aa, Artificial Sequence
  Description of Artificial Sequence: Synthetic peptide
RASQGISNYLA

SEQ ID NO: 2983 - protein, 11 aa, Artificial Sequence
  Description of Artificial Sequence: Synthetic peptide
GGNNIGSKSVH

SEQ ID NO: 2984 - protein, 5 aa, Artificial Sequence
  Description of Artificial Sequence: Synthetic peptide
RNGLS

SEQ ID NO: 2985 - protein, 5 aa, Artificial Sequence
  Description of Artificial Sequence: Synthetic peptide
NAWMS

SEQ ID NO: 2986 - protein, 7 aa, Artificial Sequence
  Description of Artificial Sequence: Synthetic peptide
SSRYYWG

SEQ ID NO: 2987 - protein, 7 aa, Artificial Sequence
  Description of Artificial Sequence: Synthetic peptide
THKMGVD

SEQ ID NO: 2988 - protein, 7 aa, Artificial Sequence
  Description of Artificial Sequence: Synthetic peptide
SNPYYWS

SEQ ID NO: 2989 - protein, 5 aa, Artificial Sequence
  Description of Artificial Sequence: Synthetic peptide
SHAMS

SEQ ID NO: 2990 - protein, 5 aa, Artificial Sequence
  Description of Artificial Sequence: Synthetic peptide
SYAMS

SEQ ID NO: 2991 - protein, 5 aa, Artificial Sequence
  Description of Artificial Sequence: Synthetic peptide
TYGMH

SEQ ID NO: 2992 - protein, 5 aa, Artificial Sequence
  Description of Artificial Sequence: Synthetic peptide
DYYMS

SEQ ID NO: 2993 - protein, 14 aa, Artificial Sequence
  Description of Artificial Sequence: Synthetic peptide
GSSTGAVTSGNYPN

SEQ ID NO: 2994 - protein, 14 aa, Artificial Sequence
  Description of Artificial Sequence: Synthetic peptide
GSSTGAVTSGNYPN

SEQ ID NO: 2995 - protein, 14 aa, Artificial Sequence
  Description of Artificial Sequence: Synthetic peptide
GSSTGAVTSGNYPN

SEQ ID NO: 2996 - protein, 14 aa, Artificial Sequence
  Description of Artificial Sequence: Synthetic peptide
GSSTGAVTSGNYPN

SEQ ID NO: 2997 - protein, 14 aa, Artificial Sequence
  Description of Artificial Sequence: Synthetic peptide
GSSTGAVTSGNYPN

SEQ ID NO: 2998 - protein, 14 aa, Artificial Sequence
  Description of Artificial Sequence: Synthetic peptide
GSSTGAVTSGNYPN

SEQ ID NO: 2999 - protein, 14 aa, Artificial Sequence
  Description of Artificial Sequence: Synthetic peptide
GSSTGAVTSGNYPN

SEQ ID NO: 3000 - protein, 14 aa, Artificial Sequence
  Description of Artificial Sequence: Synthetic peptide
GSSTGAVTSGNYPN

SEQ ID NO: 3001 - protein, 14 aa, Artificial Sequence
  Description of Artificial Sequence: Synthetic peptide
GSSTGAVTSGNYPN

SEQ ID NO: 3002 - protein, 5 aa, Artificial Sequence
  Description of Artificial Sequence: Synthetic peptide
KYAMN

SEQ ID NO: 3003 - protein, 5 aa, Artificial Sequence
  Description of Artificial Sequence: Synthetic peptide
KYAMN

SEQ ID NO: 3004 - protein, 5 aa, Artificial Sequence
  Description of Artificial Sequence: Synthetic peptide
KYAMN

SEQ ID NO: 3005 - protein, 5 aa, Artificial Sequence
  Description of Artificial Sequence: Synthetic peptide
KYAMN

SEQ ID NO: 3006 - protein, 5 aa, Artificial Sequence
  Description of Artificial Sequence: Synthetic peptide
KYAMN

SEQ ID NO: 3007 - protein, 5 aa, Artificial Sequence
  Description of Artificial Sequence: Synthetic peptide
KYAMN

SEQ ID NO: 3008 - protein, 5 aa, Artificial Sequence
  Description of Artificial Sequence: Synthetic peptide
KYAMN

SEQ ID NO: 3009 - protein, 5 aa, Artificial Sequence
  Description of Artificial Sequence: Synthetic peptide
KYAMN

SEQ ID NO: 3010 - protein, 5 aa, Artificial Sequence
  Description of Artificial Sequence: Synthetic peptide
KYAMN

SEQ ID NO: 3011 - protein, 7 aa, Artificial Sequence
  Description of Artificial Sequence: Synthetic peptide
AASTLQS

SEQ ID NO: 3012 - protein, 7 aa, Artificial Sequence
  Description of Artificial Sequence: Synthetic peptide
AASSLQS

SEQ ID NO: 3013 - protein, 7 aa, Artificial Sequence
  Description of Artificial Sequence: Synthetic peptide
WASTRES

SEQ ID NO: 3014 - protein, 7 aa, Artificial Sequence
  Description of Artificial Sequence: Synthetic peptide
AASSLQS

SEQ ID NO: 3015 - protein, 7 aa, Artificial Sequence
  Description of Artificial Sequence: Synthetic peptide
LGSNRAS

SEQ ID NO: 3016 - protein, 7 aa, Artificial Sequence
  Description of Artificial Sequence: Synthetic peptide
DDNDRPS

SEQ ID NO: 3017 - protein, 7 aa, Artificial Sequence
  Description of Artificial Sequence: Synthetic peptide
AASSLQS

SEQ ID NO: 3018 - protein, 7 aa, Artificial Sequence
  Description of Artificial Sequence: Synthetic peptide
AASTLQS

SEQ ID NO: 3019 - protein, 7 aa, Artificial Sequence
  Description of Artificial Sequence: Synthetic peptide
DDSDRPS

SEQ ID NO: 3020 - protein, 17 aa, Artificial Sequence
  Description of Artificial Sequence: Synthetic peptide
WISGYNGDTNYAQKLQG

SEQ ID NO: 3021 - protein, 19 aa, Artificial Sequence
  Description of Artificial Sequence: Synthetic peptide
RIKSKTYGGTTDYAAPVKG

SEQ ID NO: 3022 - protein, 16 aa, Artificial Sequence
  Description of Artificial Sequence: Synthetic peptide
SIYYSGSTYYNPSLKS

SEQ ID NO: 3023 - protein, 16 aa, Artificial Sequence
  Description of Artificial Sequence: Synthetic peptide
LIYWNDDKRYSPSLQS

SEQ ID NO: 3024 - protein, 16 aa, Artificial Sequence
  Description of Artificial Sequence: Synthetic peptide
YISYSGITNYNPSLKS

SEQ ID NO: 3025 - protein, 17 aa, Artificial Sequence
  Description of Artificial Sequence: Synthetic peptide
AISGSGGGTYYADSVKG

SEQ ID NO: 3026 - protein, 17 aa, Artificial Sequence
  Description of Artificial Sequence: Synthetic peptide
TISISGGSTNYADSVKG

SEQ ID NO: 3027 - protein, 17 aa, Artificial Sequence
  Description of Artificial Sequence: Synthetic peptide
VISYDGSNKYYADSVKG

SEQ ID NO: 3028 - protein, 17 aa, Artificial Sequence
  Description of Artificial Sequence: Synthetic peptide
YISKSGSTIYYADSVKG

SEQ ID NO: 3029 - protein, 7 aa, Artificial Sequence
  Description of Artificial Sequence: Synthetic peptide
GTKFLAP

SEQ ID NO: 3030 - protein, 7 aa, Artificial Sequence
  Description of Artificial Sequence: Synthetic peptide
GTKFLAP

SEQ ID NO: 3031 - protein, 7 aa, Artificial Sequence
  Description of Artificial Sequence: Synthetic peptide
GTKFLAP

SEQ ID NO: 3032 - protein, 7 aa, Artificial Sequence
  Description of Artificial Sequence: Synthetic peptide
GTKFLAP

SEQ ID NO: 3033 - protein, 7 aa, Artificial Sequence
  Description of Artificial Sequence: Synthetic peptide
GTKFLAP

SEQ ID NO: 3034 - protein, 7 aa, Artificial Sequence
  Description of Artificial Sequence: Synthetic peptide
GTKFLAP

SEQ ID NO: 3035 - protein, 7 aa, Artificial Sequence
  Description of Artificial Sequence: Synthetic peptide
GTKFLAP

SEQ ID NO: 3036 - protein, 7 aa, Artificial Sequence
  Description of Artificial Sequence: Synthetic peptide
GTKFLAP

SEQ ID NO: 3037 - protein, 7 aa, Artificial Sequence
  Description of Artificial Sequence: Synthetic peptide
GTKFLAP

SEQ ID NO: 3038 - protein, 19 aa, Artificial Sequence
  Description of Artificial Sequence: Synthetic peptide
RIRSKYNNYATYYADSVKD

SEQ ID NO: 3039 - protein, 19 aa, Artificial Sequence
  Description of Artificial Sequence: Synthetic peptide
RIRSKYNNYATYYADSVKD

SEQ ID NO: 3040 - protein, 19 aa, Artificial Sequence
  Description of Artificial Sequence: Synthetic peptide
RIRSKYNNYATYYADSVKD

SEQ ID NO: 3041 - protein, 19 aa, Artificial Sequence
  Description of Artificial Sequence: Synthetic peptide
RIRSKYNNYATYYADSVKD

SEQ ID NO: 3042 - protein, 19 aa, Artificial Sequence
  Description of Artificial Sequence: Synthetic peptide
RIRSKYNNYATYYADSVKD

SEQ ID NO: 3043 - protein, 19 aa, Artificial Sequence
  Description of Artificial Sequence: Synthetic peptide
RIRSKYNNYATYYADSVKD

SEQ ID NO: 3044 - protein, 19 aa, Artificial Sequence
  Description of Artificial Sequence: Synthetic peptide
RIRSKYNNYATYYADSVKD

SEQ ID NO: 3045 - protein, 19 aa, Artificial Sequence
  Description of Artificial Sequence: Synthetic peptide
RIRSKYNNYATYYADSVKD

SEQ ID NO: 3046 - protein, 19 aa, Artificial Sequence
  Description of Artificial Sequence: Synthetic peptide
RIRSKYNNYATYYADSVKD

SEQ ID NO: 3047 - protein, 9 aa, Artificial Sequence
  Description of Artificial Sequence: Synthetic peptide
QKYNSAPFT

SEQ ID NO: 3048 - protein, 9 aa, Artificial Sequence
  Description of Artificial Sequence: Synthetic peptide
QQSYSSPFT

SEQ ID NO: 3049 - protein, 9 aa, Artificial Sequence
  Description of Artificial Sequence: Synthetic peptide
QQYYSTPLT

SEQ ID NO: 3050 - protein, 9 aa, Artificial Sequence
  Description of Artificial Sequence: Synthetic peptide
QQSYSTPFT

SEQ ID NO: 3051 - protein, 9 aa, Artificial Sequence
  Description of Artificial Sequence: Synthetic peptide
MQALQTPWT

SEQ ID NO: 3052 - protein, 11 aa, Artificial Sequence
  Description of Artificial Sequence: Synthetic peptide
QVWDSSSDHVV

SEQ ID NO: 3053 - protein, 9 aa, Artificial Sequence
  Description of Artificial Sequence: Synthetic peptide
QQSYSIPLT

SEQ ID NO: 3054 - protein, 9 aa, Artificial Sequence
  Description of Artificial Sequence: Synthetic peptide
QKYNSAPFT

SEQ ID NO: 3055 - protein, 12 aa, Artificial Sequence
  Description of Artificial Sequence: Synthetic peptide
QVWDSSSDHHVV

SEQ ID NO: 3056 - protein, 7 aa, Artificial Sequence
  Description of Artificial Sequence: Synthetic peptide
GRATFDY

SEQ ID NO: 3057 - protein, 16 aa, Artificial Sequence
  Description of Artificial Sequence: Synthetic peptide
PSYSGSYYNYFSVMDV

SEQ ID NO: 3058 - protein, 11 aa, Artificial Sequence
  Description of Artificial Sequence: Synthetic peptide
GIFGVITYFDY

SEQ ID NO: 3059 - protein, 13 aa, Artificial Sequence
  Description of Artificial Sequence: Synthetic peptide
RRYNWNYENWFDP

SEQ ID NO: 3060 - protein, 16 aa, Artificial Sequence
  Description of Artificial Sequence: Synthetic peptide
EKMWFGVLNYYYGMDV

SEQ ID NO: 3061 - protein, 10 aa, Artificial Sequence
  Description of Artificial Sequence: Synthetic peptide
GKGVHLGFDY

SEQ ID NO: 3062 - protein, 17 aa, Artificial Sequence
  Description of Artificial Sequence: Synthetic peptide
DGGSGWFPKLLHYGLDV

SEQ ID NO: 3063 - protein, 7 aa, Artificial Sequence
  Description of Artificial Sequence: Synthetic peptide
GQLLTGY

SEQ ID NO: 3064 - protein, 8 aa, Artificial Sequence
  Description of Artificial Sequence: Synthetic peptide
YNYGHFDY

SEQ ID NO: 3065 - protein, 9 aa, Artificial Sequence
  Description of Artificial Sequence: Synthetic peptide
VLWYSNRWV

SEQ ID NO: 3066 - protein, 9 aa, Artificial Sequence
  Description of Artificial Sequence: Synthetic peptide
VLWYSNRWV

SEQ ID NO: 3067 - protein, 9 aa, Artificial Sequence
  Description of Artificial Sequence: Synthetic peptide
VLWYSNRWV

SEQ ID NO: 3068 - protein, 9 aa, Artificial Sequence
  Description of Artificial Sequence: Synthetic peptide
VLWYSNRWV

SEQ ID NO: 3069 - protein, 9 aa, Artificial Sequence
  Description of Artificial Sequence: Synthetic peptide
VLWYSNRWV

SEQ ID NO: 3070 - protein, 9 aa, Artificial Sequence
  Description of Artificial Sequence: Synthetic peptide
VLWYSNRWV

SEQ ID NO: 3071 - protein, 9 aa, Artificial Sequence
  Description of Artificial Sequence: Synthetic peptide
VLWYSNRWV

SEQ ID NO: 3072 - protein, 9 aa, Artificial Sequence
  Description of Artificial Sequence: Synthetic peptide
VLWYSNRWV

SEQ ID NO: 3073 - protein, 9 aa, Artificial Sequence
  Description of Artificial Sequence: Synthetic peptide
VLWYSNRWV

SEQ ID NO: 3074 - protein, 14 aa, Artificial Sequence
  Description of Artificial Sequence: Synthetic peptide
HGNFGNSYISYWAY

SEQ ID NO: 3075 - protein, 14 aa, Artificial Sequence
  Description of Artificial Sequence: Synthetic peptide
HGNFGNSYISYWAY

SEQ ID NO: 3076 - protein, 14 aa, Artificial Sequence
  Description of Artificial Sequence: Synthetic peptide
HGNFGNSYISYWAY

SEQ ID NO: 3077 - protein, 14 aa, Artificial Sequence
  Description of Artificial Sequence: Synthetic peptide
HGNFGNSYISYWAY

SEQ ID NO: 3078 - protein, 14 aa, Artificial Sequence
  Description of Artificial Sequence: Synthetic peptide
HGNFGNSYISYWAY

SEQ ID NO: 3079 - protein, 14 aa, Artificial Sequence
  Description of Artificial Sequence: Synthetic peptide
HGNFGNSYISYWAY

SEQ ID NO: 3080 - protein, 14 aa, Artificial Sequence
  Description of Artificial Sequence: Synthetic peptide
HGNFGNSYISYWAY

SEQ ID NO: 3081 - protein, 14 aa, Artificial Sequence
  Description of Artificial Sequence: Synthetic peptide
HGNFGNSYISYWAY

SEQ ID NO: 3082 - protein, 14 aa, Artificial Sequence
  Description of Artificial Sequence: Synthetic peptide
HGNFGNSYISYWAY

SEQ ID NO: 3083 - protein, 107 aa, Artificial Sequence
  Description of Artificial Sequence: Synthetic polypeptide
ELVMTQSPSSLSASVGDRVTITCRASQGISNYLAWYQQKPGKVPKLLISAASTLQSGVPSRFSGSGSGTDFTLTISSLQPEDVATYYCQKYNSAPFTFGCGTKLEIK

SEQ ID NO: 3084 - protein, 107 aa, Artificial Sequence
  Description of Artificial Sequence: Synthetic polypeptide
ELQMTQSPSSLSASVGDRVTITCRTSQSISSYLNWFQQKPGKAPKLLIFAASSLQSGVPSRFSGSGSGTDFTLTISSLQPEDFATYYCQQSYSSPFTFGCGTKVEIK

SEQ ID NO: 3085 - protein, 113 aa, Artificial Sequence
  Description of Artificial Sequence: Synthetic polypeptide
ELVMTQTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGCGTKVEIK

SEQ ID NO: 3086 - protein, 107 aa, Artificial Sequence
  Description of Artificial Sequence: Synthetic polypeptide
ELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGCGTKVEIK

SEQ ID NO: 3087 - protein, 112 aa, Artificial Sequence
  Description of Artificial Sequence: Synthetic polypeptide
ELVMTQTPLSLPVTPGEPASISCRSSQSLLHRNGYNYLDWYLQKPGQSPQLLIYLGSNRASGVPDRFSGSGSGTDFTLKISRVEAGDVGVYYCMQALQTPWTFGCGTKVEIK

SEQ ID NO: 3088 - protein, 108 aa, Artificial Sequence
  Description of Artificial Sequence: Synthetic polypeptide
ELVLTQPPSVSVAPGQTARITCGGNNIGSKSVHWYQQKPGQAPVLVVYDDNDRPSGIPERFSGSNFGNTATLIISRVEAGDEADYYCQVWDSSSDHVVFGCGTKLTVL

SEQ ID NO: 3089 - protein, 107 aa, Artificial Sequence
  Description of Artificial Sequence: Synthetic polypeptide
ELQMTQSPSSLSASVGDRVTITCQASQDISNYLNWYQQKPGKAPKLLIYAASSLQSGVPSRFSGSGSGTDFTLTISSLQPEDFATYYCQQSYSIPLTFGCGTKVEIK

SEQ ID NO: 3090 - protein, 107 aa, Artificial Sequence
  Description of Artificial Sequence: Synthetic polypeptide
ELVMTQSPSSLSASVGDRVTITCRASQGISNYLAWYQQKPGKVPKLLIYAASTLQSGVPSRFSGSGSGTDFTLTISSLQPEDVATYYCQKYNSAPFTFGCGTKVEIK

SEQ ID NO: 3091 - protein, 109 aa, Artificial Sequence
  Description of Artificial Sequence: Synthetic polypeptide
ELVLTQPPSVSVAPGQTARITCGGNNIGSKSVHWYQQKPGQAPVLVVYDDSDRPSGIPERFSGSNSGNTATLTISRVEAGDEADYYCQVWDSSSDHHVVFGCGTKLTVS

SEQ ID NO: 3092 - protein, 116 aa, Artificial Sequence
  Description of Artificial Sequence: Synthetic polypeptide
EVQLLESGAEVKKPGASVKVSCKASGYTFTRNGLSWVRQAPGQCLEWMGWISGYNGDTNYAQKLQGRGTMTTDTSTSTAYMELRSLRSDDTAVYYCARGRATFDYWGQGTLVTVSS

SEQ ID NO: 3093 - protein, 127 aa, Artificial Sequence
  Description of Artificial Sequence: Synthetic polypeptide
EVQLLESGGGLVQPGGSLRLSCAASGFTFSNAWMSWVRQAPGKCLEWVGRIKSKTYGGTTDYAAPVKGRFTISRDDSKNTLYLQMNSLKTEDTAVYYCTTPSYSGSYYNYFSVMDVWGQGTTVTVSS

SEQ ID NO: 3094 - protein, 121 aa, Artificial Sequence
  Description of Artificial Sequence: Synthetic polypeptide
EVQLLESGPGLVKPSETLSLTCTVSGDSISSSRYYWGWIRQPPGKCLEWIGSIYYSGSTYYNPSLKSRVTISVDTSKNQFSLKLSSVTAADTAVYYCARGIFGVITYFDYWGQGTLVTVSS

SEQ ID NO: 3095 - protein, 123 aa, Artificial Sequence
  Description of Artificial Sequence: Synthetic polypeptide
EVQLLESGPMLVKPTQTLTLTCTFSGFSFTTHKMGVDWIRQPPGKCLEWLALIYWNDDKRYSPSLQSRLTITKDTSKNQVVLTMTNMDPVDTATYYCAYRRYNWNYENWFDPWGQGTLVTVSS

SEQ ID NO: 3096 - protein, 126 aa, Artificial Sequence
  Description of Artificial Sequence: Synthetic polypeptide
EVQLLESGPGLVKPSQTLSLTCTVSGDSISSNPYYWSWIRQHPGKCLEWIGYISYSGITNYNPSLKSRVTMSVDTSKNQFSLKLTSLTAADTAVYYCAREKMWFGVLNYYYGMDVWGQGTTVTVSS

SEQ ID NO: 3097 - protein, 119 aa, Artificial Sequence
  Description of Artificial Sequence: Synthetic polypeptide
EVQLLESGGGLVQPGGSLRLSCAASGFTFSSHAMSWVRQAPGKCLEWVSAISGSGGGTYYADSVKGRFTISRDNSKNTLYLQMNSLRAEDTAVYYCATGKGVHLGFDYWGQGTLVTVSS

SEQ ID NO: 3098 - protein, 126 aa, Artificial Sequence
  Description of Artificial Sequence: Synthetic polypeptide
EVQLLESGGGLVQPGGSLRLSCAASGFTFSSYAMSWVRQAPGRCLEWVSTISISGGSTNYADSVKGRFTISRDNSKNTLYLQMNSLRAEDTAVYYCAKDGGSGWFPKLLHYGLDVWGQGTTVTVSS

SEQ ID NO: 3099 - protein, 116 aa, Artificial Sequence
  Description of Artificial Sequence: Synthetic polypeptide
EVQLLESGGGVVQPGRSLRLSCAASGFTFSTYGMHWVRQAPGKCLEWVAVISYDGSNKYYADSVKGRFTISRDDSKNTLYLQMNSLRAEDTAVYYCARGQLLTGYWGQGTLVTVSS

SEQ ID NO: 3100 - protein, 117 aa, Artificial Sequence
  Description of Artificial Sequence: Synthetic polypeptide
EVQLLESGGGLVKPGGSLRLSCAASGFTFSDYYMSWIRQAPGKCLEWVSYISKSGSTIYYADSVKGRFTISRDNAKNSLYLQMNSLRAEDTAVYYCATYNYGHFDYWGQGTLVTVSS

SEQ ID NO: 3101 - protein, 109 aa, Artificial Sequence; identical to SEQ ID NO: 31
  Description of Artificial Sequence: Synthetic polypeptide

SEQ ID NO: 3102 - protein, 109 aa, Artificial Sequence; identical to SEQ ID NO: 31
  Description of Artificial Sequence: Synthetic polypeptide

SEQ ID NO: 3103 - protein, 109 aa, Artificial Sequence; identical to SEQ ID NO: 31
  Description of Artificial Sequence: Synthetic polypeptide

SEQ ID NO: 3104 - protein, 109 aa, Artificial Sequence; identical to SEQ ID NO: 31
  Description of Artificial Sequence: Synthetic polypeptide

SEQ ID NO: 3105 - protein, 109 aa, Artificial Sequence; identical to SEQ ID NO: 31
  Description of Artificial Sequence: Synthetic polypeptide

SEQ ID NO: 3106 - protein, 109 aa, Artificial Sequence; identical to SEQ ID NO: 31
  Description of Artificial Sequence: Synthetic polypeptide

SEQ ID NO: 3107 - protein, 109 aa, Artificial Sequence; identical to SEQ ID NO: 31
  Description of Artificial Sequence: Synthetic polypeptide

SEQ ID NO: 3108 - protein, 109 aa, Artificial Sequence; identical to SEQ ID NO: 31
  Description of Artificial Sequence: Synthetic polypeptide

SEQ ID NO: 3109 - protein, 109 aa, Artificial Sequence; identical to SEQ ID NO: 31
  Description of Artificial Sequence: Synthetic polypeptide

SEQ ID NO: 3110 - protein, 125 aa, Artificial Sequence; identical to SEQ ID NO: 697
  Description of Artificial Sequence: Synthetic polypeptide

SEQ ID NO: 3111 - protein, 125 aa, Artificial Sequence; identical to SEQ ID NO: 697
  Description of Artificial Sequence: Synthetic polypeptide

SEQ ID NO: 3112 - protein, 125 aa, Artificial Sequence; identical to SEQ ID NO: 697
  Description of Artificial Sequence: Synthetic polypeptide

SEQ ID NO: 3113 - protein, 125 aa, Artificial Sequence; identical to SEQ ID NO: 697
  Description of Artificial Sequence: Synthetic polypeptide

SEQ ID NO: 3114 - protein, 125 aa, Artificial Sequence; identical to SEQ ID NO: 697
  Description of Artificial Sequence: Synthetic polypeptide

SEQ ID NO: 3115 - protein, 125 aa, Artificial Sequence; identical to SEQ ID NO: 697
  Description of Artificial Sequence: Synthetic polypeptide

SEQ ID NO: 3116 - protein, 125 aa, Artificial Sequence; identical to SEQ ID NO: 697
  Description of Artificial Sequence: Synthetic polypeptide

SEQ ID NO: 3117 - protein, 125 aa, Artificial Sequence; identical to SEQ ID NO: 697
  Description of Artificial Sequence: Synthetic polypeptide

SEQ ID NO: 3118 - protein, 125 aa, Artificial Sequence; identical to SEQ ID NO: 697
  Description of Artificial Sequence: Synthetic polypeptide

SEQ ID NO: 3119 - protein, 23 aa, Artificial Sequence
  Description of Artificial Sequence: Synthetic peptide
DIQMTQSPSSLSASVGDRVTITC

SEQ ID NO: 3120 - protein, 23 aa, Artificial Sequence
  Description of Artificial Sequence: Synthetic peptide
ELVMTQSPSSLSASVGDRVTITC

SEQ ID NO: 3121 - protein, 23 aa, Artificial Sequence
  Description of Artificial Sequence: Synthetic peptide
DIQMTQSPSSLSASVGDRVTITC

SEQ ID NO: 3122 - protein, 23 aa, Artificial Sequence
  Description of Artificial Sequence: Synthetic peptide
ELQMTQSPSSLSASVGDRVTITC

SEQ ID NO: 3123 - protein, 23 aa, Artificial Sequence
  Description of Artificial Sequence: Synthetic peptide
ELQMTQSPSSLSASVGDRVTITC

SEQ ID NO: 3124 - protein, 23 aa, Artificial Sequence
  Description of Artificial Sequence: Synthetic peptide
DIVMTQSPDSLAVSLGERATINC

SEQ ID NO: 3125 - protein, 23 aa, Artificial Sequence
  Description of Artificial Sequence: Synthetic peptide
ELVMTQTPDSLAVSLGERATINC

SEQ ID NO: 3126 - protein, 23 aa, Artificial Sequence
  Description of Artificial Sequence: Synthetic peptide
DIVMTQTPLSLPVTPGEPASISC

SEQ ID NO: 3127 - protein, 23 aa, Artificial Sequence
  Description of Artificial Sequence: Synthetic peptide
ELVMTQTPLSLPVTPGEPASISC

SEQ ID NO: 3128 - protein, 23 aa, Artificial Sequence
  Description of Artificial Sequence: Synthetic peptide
DIQMTQSPSSLSASVGDRVTITC

SEQ ID NO: 3129 - protein, 23 aa, Artificial Sequence
  Description of Artificial Sequence: Synthetic peptide
ELQMTQSPSSLSASVGDRVTITC

SEQ ID NO: 3130 - protein, 23 aa, Artificial Sequence
  Description of Artificial Sequence: Synthetic peptide
DIQMTQSPSSLSASVGDRVTITC

SEQ ID NO: 3131 - protein, 23 aa, Artificial Sequence
  Description of Artificial Sequence: Synthetic peptide
ELVMTQSPSSLSASVGDRVTITC

SEQ ID NO: 3132 - protein, 22 aa, Artificial Sequence
  Description of Artificial Sequence: Synthetic peptide
QTVVTQEPSLTVSPGGTVTLTC

SEQ ID NO: 3133 - protein, 22 aa, Artificial Sequence
  Description of Artificial Sequence: Synthetic peptide
QTVVTQEPSLTVSPGGTVTLTC

SEQ ID NO: 3134 - protein, 22 aa, Artificial Sequence
  Description of Artificial Sequence: Synthetic peptide
QTVVTQEPSLTVSPGGTVTLTC

SEQ ID NO: 3135 - protein, 22 aa, Artificial Sequence
  Description of Artificial Sequence: Synthetic peptide
QTVVTQEPSLTVSPGGTVTLTC

SEQ ID NO: 3136 - protein, 22 aa, Artificial Sequence
  Description of Artificial Sequence: Synthetic peptide
QTVVTQEPSLTVSPGGTVTLTC

SEQ ID NO: 3137 - protein, 22 aa, Artificial Sequence
  Description of Artificial Sequence: Synthetic peptide
QTVVTQEPSLTVSPGGTVTLTC

SEQ ID NO: 3138 - protein, 22 aa, Artificial Sequence
  Description of Artificial Sequence: Synthetic peptide
QTVVTQEPSLTVSPGGTVTLTC

SEQ ID NO: 3139 - protein, 22 aa, Artificial Sequence
  Description of Artificial Sequence: Synthetic peptide
QTVVTQEPSLTVSPGGTVTLTC

SEQ ID NO: 3140 - protein, 22 aa, Artificial Sequence
  Description of Artificial Sequence: Synthetic peptide
QTVVTQEPSLTVSPGGTVTLTC

SEQ ID NO: 3141 - protein, 22 aa, Artificial Sequence
  Description of Artificial Sequence: Synthetic peptide
QTVVTQEPSLTVSPGGTVTLTC

SEQ ID NO: 3142 - protein, 22 aa, Artificial Sequence
  Description of Artificial Sequence: Synthetic peptide
SYVLTQPPSVSVAPGKTARITC

SEQ ID NO: 3143 - protein, 22 aa, Artificial Sequence
  Description of Artificial Sequence: Synthetic peptide
ELVLTQPPSVSVAPGQTARITC

SEQ ID NO: 3144 - protein, 22 aa, Artificial Sequence
  Description of Artificial Sequence: Synthetic peptide
ELVLTQPPSVSVAPGQTARITC

SEQ ID NO: 3145 - protein, 30 aa, Artificial Sequence
  Description of Artificial Sequence: Synthetic polypeptide
QVQLVQSGAEVKKPGASVKVSCKASGYTFT

SEQ ID NO: 3146 - protein, 30 aa, Artificial Sequence
  Description of Artificial Sequence: Synthetic polypeptide
EVQLLESGAEVKKPGASVKVSCKASGYTFT

SEQ ID NO: 3147 - protein, 30 aa, Artificial Sequence; identical to SEQ ID NO: 793
  Description of Artificial Sequence: Synthetic polypeptide

SEQ ID NO: 3148 - protein, 30 aa, Artificial Sequence; identical to SEQ ID NO: 794
  Description of Artificial Sequence: Synthetic polypeptide

SEQ ID NO: 3149 - protein, 30 aa, Artificial Sequence; identical to SEQ ID NO: 794
  Description of Artificial Sequence: Synthetic polypeptide

SEQ ID NO: 3150 - protein, 30 aa, Artificial Sequence; identical to SEQ ID NO: 794
  Description of Artificial Sequence: Synthetic polypeptide

SEQ ID NO: 3151 - protein, 30 aa, Artificial Sequence; identical to SEQ ID NO: 794
  Description of Artificial Sequence: Synthetic polypeptide

SEQ ID NO: 3152 - protein, 30 aa, Artificial Sequence; identical to SEQ ID NO: 794
  Description of Artificial Sequence: Synthetic polypeptide

SEQ ID NO: 3153 - protein, 30 aa, Artificial Sequence; identical to SEQ ID NO: 794
  Description of Artificial Sequence: Synthetic polypeptide

SEQ ID NO: 3154 - protein, 30 aa, Artificial Sequence; identical to SEQ ID NO: 794
  Description of Artificial Sequence: Synthetic polypeptide

SEQ ID NO: 3155 - protein, 30 aa, Artificial Sequence; identical to SEQ ID NO: 794
  Description of Artificial Sequence: Synthetic polypeptide

SEQ ID NO: 3156 - protein, 30 aa, Artificial Sequence; identical to SEQ ID NO: 794
  Description of Artificial Sequence: Synthetic polypeptide

SEQ ID NO: 3157 - protein, 30 aa, Artificial Sequence; identical to SEQ ID NO: 832
  Description of Artificial Sequence: Synthetic polypeptide

SEQ ID NO: 3158 - protein, 30 aa, Artificial Sequence; identical to SEQ ID NO: 779
  Description of Artificial Sequence: Synthetic polypeptide

SEQ ID NO: 3159 - protein, 30 aa, Artificial Sequence; identical to SEQ ID NO: 851
  Description of Artificial Sequence: Synthetic polypeptide

SEQ ID NO: 3160 - protein, 30 aa, Artificial Sequence
  Description of Artificial Sequence: Synthetic polypeptide
EVQLLESGPGLVKPSETLSLTCTVSGDSIS

SEQ ID NO: 3161 - protein, 30 aa, Artificial Sequence; identical to SEQ ID NO: 842
  Description of Artificial Sequence: Synthetic polypeptide

SEQ ID NO: 3162 - protein, 30 aa, Artificial Sequence
  Description of Artificial Sequence: Synthetic polypeptide
EVQLLESGPMLVKPTQTLTLTCTFSGFSFT

SEQ ID NO: 3163 - protein, 30 aa, Artificial Sequence; identical to SEQ ID NO: 858
  Description of Artificial Sequence: Synthetic polypeptide

SEQ ID NO: 3164 - protein, 30 aa, Artificial Sequence
  Description of Artificial Sequence: Synthetic polypeptide
EVQLLESGPGLVKPSQTLSLTCTVSGDSIS

SEQ ID NO: 3165 - protein, 30 aa, Artificial Sequence; identical to SEQ ID NO: 779
  Description of Artificial Sequence: Synthetic polypeptide

SEQ ID NO: 3166 - protein, 30 aa, Artificial Sequence; identical to SEQ ID NO: 779
  Description of Artificial Sequence: Synthetic polypeptide

SEQ ID NO: 3167 - protein, 30 aa, Artificial Sequence; identical to SEQ ID NO: 779
  Description of Artificial Sequence: Synthetic polypeptide

SEQ ID NO: 3168 - protein, 30 aa, Artificial Sequence; identical to SEQ ID NO: 779
  Description of Artificial Sequence: Synthetic polypeptide

SEQ ID NO: 3169 - protein, 30 aa, Artificial Sequence; identical to SEQ ID NO: 853
  Description of Artificial Sequence: Synthetic polypeptide

SEQ ID NO: 3170 - protein, 30 aa, Artificial Sequence; identical to SEQ ID NO: 784
  Description of Artificial Sequence: Synthetic polypeptide

SEQ ID NO: 3171 - protein, 30 aa, Artificial Sequence; identical to SEQ ID NO: 856
  Description of Artificial Sequence: Synthetic polypeptide

SEQ ID NO: 3172 - protein, 30 aa, Artificial Sequence; identical to SEQ ID NO: 787
  Description of Artificial Sequence: Synthetic polypeptide

SEQ ID NO: 3173 - protein, 11 aa, Artificial Sequence
  Description of Artificial Sequence: Synthetic peptide
RASQGISNYLA

SEQ ID NO: 3174 - protein, 11 aa, Artificial Sequence
  Description of Artificial Sequence: Synthetic peptide
RASQGISNYLA

SEQ ID NO: 3175 - protein, 11 aa, Artificial Sequence
  Description of Artificial Sequence: Synthetic peptide
RASQSISSYLN

SEQ ID NO: 3176 - protein, 11 aa, Artificial Sequence
  Description of Artificial Sequence: Synthetic peptide
RTSQSISSYLN

SEQ ID NO: 3177 - protein, 11 aa, Artificial Sequence
  Description of Artificial Sequence: Synthetic peptide
RASQSISSYLN

SEQ ID NO: 3178 - protein, 17 aa, Artificial Sequence
  Description of Artificial Sequence: Synthetic peptide
KSSQSVLYSSNNKNYLA

SEQ ID NO: 3179 - protein, 17 aa, Artificial Sequence
  Description of Artificial Sequence: Synthetic peptide
KSSQSVLYSSNNKNYLA

SEQ ID NO: 3180 - protein, 17 aa, Artificial Sequence
  Description of Artificial Sequence: Synthetic peptide
RSSQSLLDSDDGNTYLD

SEQ ID NO: 3181 - protein, 16 aa, Artificial Sequence
  Description of Artificial Sequence: Synthetic peptide
RSSQSLLHRNGYNYLD

SEQ ID NO: 3182 - protein, 11 aa, Artificial Sequence
  Description of Artificial Sequence: Synthetic peptide
RASQSISSYLN

SEQ ID NO: 3183 - protein, 11 aa, Artificial Sequence
  Description of Artificial Sequence: Synthetic peptide
QASQDISNYLN

SEQ ID NO: 3184 - protein, 11 aa, Artificial Sequence
  Description of Artificial Sequence: Synthetic peptide
RASQGISNYLA

SEQ ID NO: 3185 - protein, 11 aa, Artificial Sequence
  Description of Artificial Sequence: Synthetic peptide
RASQGISNYLA

SEQ ID NO: 3186 - protein, 14 aa, Artificial Sequence
  Description of Artificial Sequence: Synthetic peptide
ASSTGAVTSGYYPN

SEQ ID NO: 3187 - protein, 14 aa, Artificial Sequence
  Description of Artificial Sequence: Synthetic peptide
GSSTGAVTSGNYPN

SEQ ID NO: 3188 - protein, 14 aa, Artificial Sequence
  Description of Artificial Sequence: Synthetic peptide
GSSTGAVTSGNYPN

SEQ ID NO: 3189 - protein, 14 aa, Artificial Sequence
  Description of Artificial Sequence: Synthetic peptide
GSSTGAVTSGNYPN

SEQ ID NO: 3190 - protein, 14 aa, Artificial Sequence
  Description of Artificial Sequence: Synthetic peptide
GSSTGAVTSGNYPN

SEQ ID NO: 3191 - protein, 14 aa, Artificial Sequence
  Description of Artificial Sequence: Synthetic peptide
GSSTGAVTSGNYPN

SEQ ID NO: 3192 - protein, 14 aa, Artificial Sequence
  Description of Artificial Sequence: Synthetic peptide
GSSTGAVTSGNYPN

SEQ ID NO: 3193 - protein, 14 aa, Artificial Sequence
  Description of Artificial Sequence: Synthetic peptide
GSSTGAVTSGNYPN

SEQ ID NO: 3194 - protein, 14 aa, Artificial Sequence
  Description of Artificial Sequence: Synthetic peptide
GSSTGAVTSGNYPN

SEQ ID NO: 3195 - protein, 14 aa, Artificial Sequence
  Description of Artificial Sequence: Synthetic peptide
GSSTGAVTSGNYPN

SEQ ID NO: 3196 - protein, 11 aa, Artificial Sequence
  Description of Artificial Sequence: Synthetic peptide
GGNNIGSKSVH

SEQ ID NO: 3197 - protein, 11 aa, Artificial Sequence
  Description of Artificial Sequence: Synthetic peptide
GGNNIGSKSVH

SEQ ID NO: 3198 - protein, 11 aa, Artificial Sequence
  Description of Artificial Sequence: Synthetic peptide
GGNNIGSKSVH

SEQ ID NO: 3199 - protein, 5 aa, Artificial Sequence
  Description of Artificial Sequence: Synthetic peptide
SYGIS

SEQ ID NO: 3200 - protein, 5 aa, Artificial Sequence
  Description of Artificial Sequence: Synthetic peptide
RNGLS

SEQ ID NO: 3201 - protein, 5 aa, Artificial Sequence
  Description of Artificial Sequence: Synthetic peptide
GSAMH

SEQ ID NO: 3202 - protein, 5 aa, Artificial Sequence
  Description of Artificial Sequence: Synthetic peptide
KYAMN

SEQ ID NO: 3203 - protein, 5 aa, Artificial Sequence
  Description of Artificial Sequence: Synthetic peptide
KYAMN

SEQ ID NO: 3204 - protein, 5 aa, Artificial Sequence
  Description of Artificial Sequence: Synthetic peptide
KYAMN

SEQ ID NO: 3205 - protein, 5 aa, Artificial Sequence
  Description of Artificial Sequence: Synthetic peptide
KYAMN

SEQ ID NO: 3206 - protein, 5 aa, Artificial Sequence
  Description of Artificial Sequence: Synthetic peptide
KYAMN

SEQ ID NO: 3207 - protein, 5 aa, Artificial Sequence
  Description of Artificial Sequence: Synthetic peptide
KYAMN

SEQ ID NO: 3208 - protein, 5 aa, Artificial Sequence
  Description of Artificial Sequence: Synthetic peptide
KYAMN

SEQ ID NO: 3209 - protein, 5 aa, Artificial Sequence
  Description of Artificial Sequence: Synthetic peptide
KYAMN

SEQ ID NO: 3210 - protein, 5 aa, Artificial Sequence
  Description of Artificial Sequence: Synthetic peptide
KYAMN

SEQ ID NO: 3211 - protein, 5 aa, Artificial Sequence
  Description of Artificial Sequence: Synthetic peptide
NAWMS

SEQ ID NO: 3212 - protein, 5 aa, Artificial Sequence
  Description of Artificial Sequence: Synthetic peptide
NAWMS

SEQ ID NO: 3213 - protein, 5 aa, Artificial Sequence
  Description of Artificial Sequence: Synthetic peptide
SYYWS

SEQ ID NO: 3214 - protein, 7 aa, Artificial Sequence
  Description of Artificial Sequence: Synthetic peptide
SSRYYWG

SEQ ID NO: 3215 - protein, 7 aa, Artificial Sequence
  Description of Artificial Sequence: Synthetic peptide
TSGVGVG

SEQ ID NO: 3216 - protein, 7 aa, Artificial Sequence
  Description of Artificial Sequence: Synthetic peptide
THKMGVD

SEQ ID NO: 3217 - protein, 7 aa, Artificial Sequence
  Description of Artificial Sequence: Synthetic peptide
SGGYYWS

SEQ ID NO: 3218 - protein, 7 aa, Artificial Sequence
  Description of Artificial Sequence: Synthetic peptide
SNPYYWS

SEQ ID NO: 3219 - protein, 5 aa, Artificial Sequence
  Description of Artificial Sequence: Synthetic peptide
SYAMS

SEQ ID NO: 3220 - protein, 5 aa, Artificial Sequence
  Description of Artificial Sequence: Synthetic peptide
SHAMS

SEQ ID NO: 3221 - protein, 5 aa, Artificial Sequence
  Description of Artificial Sequence: Synthetic peptide
SYAMS

SEQ ID NO: 3222 - protein, 5 aa, Artificial Sequence
  Description of Artificial Sequence: Synthetic peptide
SYAMS

SEQ ID NO: 3223 - protein, 5 aa, Artificial Sequence
  Description of Artificial Sequence: Synthetic peptide
SYAMH

SEQ ID NO: 3224 - protein, 5 aa, Artificial Sequence
  Description of Artificial Sequence: Synthetic peptide
TYGMH

SEQ ID NO: 3225 - protein, 5 aa, Artificial Sequence
  Description of Artificial Sequence: Synthetic peptide
DYYMS

SEQ ID NO: 3226 - protein, 5 aa, Artificial Sequence
  Description of Artificial Sequence: Synthetic peptide
DYYMS

SEQ ID NO: 3227 - protein, 15 aa, Artificial Sequence
  Description of Artificial Sequence: Synthetic peptide
WYQQKPGKVPKLLIY

SEQ ID NO: 3228 - protein, 15 aa, Artificial Sequence
  Description of Artificial Sequence: Synthetic peptide
WYQQKPGKVPKLLIS

SEQ ID NO: 3229 - protein, 15 aa, Artificial Sequence
  Description of Artificial Sequence: Synthetic peptide
WYQQKPGKAPKLLIY

SEQ ID NO: 3230 - protein, 15 aa, Artificial Sequence
  Description of Artificial Sequence: Synthetic peptide
WFQQKPGKAPKLLIF

SEQ ID NO: 3231 - protein, 15 aa, Artificial Sequence
  Description of Artificial Sequence: Synthetic peptide
WYQQKPGKAPKLLIY

SEQ ID NO: 3232 - protein, 15 aa, Artificial Sequence
  Description of Artificial Sequence: Synthetic peptide
WYQQKPGQPPKLLIY

SEQ ID NO: 3233 - protein, 15 aa, Artificial Sequence
  Description of Artificial Sequence: Synthetic peptide
WYQQKPGQPPKLLIY

SEQ ID NO: 3234 - protein, 15 aa, Artificial Sequence
  Description of Artificial Sequence: Synthetic peptide
WYLQKPGQSPQLLIY

SEQ ID NO: 3235 - protein, 15 aa, Artificial Sequence
  Description of Artificial Sequence: Synthetic peptide
WYLQKPGQSPQLLIY

SEQ ID NO: 3236 - protein, 15 aa, Artificial Sequence
  Description of Artificial Sequence: Synthetic peptide
WYQQKPGKAPKLLIY

SEQ ID NO: 3237 - protein, 15 aa, Artificial Sequence
  Description of Artificial Sequence: Synthetic peptide
WYQQKPGKAPKLLIY

SEQ ID NO: 3238 - protein, 15 aa, Artificial Sequence
  Description of Artificial Sequence: Synthetic peptide
WYQQKPGKVPKLLIY

SEQ ID NO: 3239 - protein, 15 aa, Artificial Sequence
  Description of Artificial Sequence: Synthetic peptide
WYQQKPGKVPKLLIY

SEQ ID NO: 3240 - protein, 15 aa, Artificial Sequence
  Description of Artificial Sequence: Synthetic peptide
WFQQKPGQAPRALIY

SEQ ID NO: 3241 - protein, 15 aa, Artificial Sequence
  Description of Artificial Sequence: Synthetic peptide
WVQQKPGQAPRGLIG

SEQ ID NO: 3242 - protein, 15 aa, Artificial Sequence
  Description of Artificial Sequence: Synthetic peptide
WVQQKPGQAPRGLIG

SEQ ID NO: 3243 - protein, 15 aa, Artificial Sequence
  Description of Artificial Sequence: Synthetic peptide
WVQQKPGQAPRGLIG

SEQ ID NO: 3244 - protein, 15 aa, Artificial Sequence
  Description of Artificial Sequence: Synthetic peptide
WVQQKPGQAPRGLIG

SEQ ID NO: 3245 - protein, 15 aa, Artificial Sequence
  Description of Artificial Sequence: Synthetic peptide
WVQQKPGQAPRGLIG

SEQ ID NO: 3246 - protein, 15 aa, Artificial Sequence
  Description of Artificial Sequence: Synthetic peptide
WVQQKPGQAPRGLIG

SEQ ID NO: 3247 - protein, 15 aa, Artificial Sequence
  Description of Artificial Sequence: Synthetic peptide
WVQQKPGQAPRGLIG

SEQ ID NO: 3248 - protein, 15 aa, Artificial Sequence
  Description of Artificial Sequence: Synthetic peptide
WVQQKPGQAPRGLIG

SEQ ID NO: 3249 - protein, 15 aa, Artificial Sequence
  Description of Artificial Sequence: Synthetic peptide
WVQQKPGQAPRGLIG

SEQ ID NO: 3250 - protein, 15 aa, Artificial Sequence
  Description of Artificial Sequence: Synthetic peptide
WYQQKPGQAPVLVIY

SEQ ID NO: 3251 - protein, 15 aa, Artificial Sequence
  Description of Artificial Sequence: Synthetic peptide
WYQQKPGQAPVLVVY

SEQ ID NO: 3252 - protein, 15 aa, Artificial Sequence
  Description of Artificial Sequence: Synthetic peptide
WYQQKPGQAPVLVVY

SEQ ID NO: 3253 - protein, 14 aa, Artificial Sequence
  Description of Artificial Sequence: Synthetic peptide
WVRQAPGQGLEWMG

SEQ ID NO: 3254 - protein, 14 aa, Artificial Sequence
  Description of Artificial Sequence: Synthetic peptide
WVRQAPGQCLEWMG

SEQ ID NO: 3255 - protein, 14 aa, Artificial Sequence
  Description of Artificial Sequence: Synthetic peptide
WVRQASGKGLEWVG

SEQ ID NO: 3256 - protein, 14 aa, Artificial Sequence
  Description of Artificial Sequence: Synthetic peptide
WVRQAPGKGLEWVA

SEQ ID NO: 3257 - protein, 14 aa, Artificial Sequence
  Description of Artificial Sequence: Synthetic peptide
WVRQAPGKGLEWVA

SEQ ID NO: 3258 - protein, 14 aa, Artificial Sequence
  Description of Artificial Sequence: Synthetic peptide
WVRQAPGKGLEWVA

SEQ ID NO: 3259 - protein, 14 aa, Artificial Sequence
  Description of Artificial Sequence: Synthetic peptide
WVRQAPGKGLEWVA

SEQ ID NO: 3260 - protein, 14 aa, Artificial Sequence
  Description of Artificial Sequence: Synthetic peptide
WVRQAPGKGLEWVA

SEQ ID NO: 3261 - protein, 14 aa, Artificial Sequence
  Description of Artificial Sequence: Synthetic peptide
WVRQAPGKGLEWVA

SEQ ID NO: 3262 - protein, 14 aa, Artificial Sequence
  Description of Artificial Sequence: Synthetic peptide
WVRQAPGKGLEWVA

SEQ ID NO: 3263 - protein, 14 aa, Artificial Sequence
  Description of Artificial Sequence: Synthetic peptide
WVRQAPGKGLEWVA

SEQ ID NO: 3264 - protein, 14 aa, Artificial Sequence
  Description of Artificial Sequence: Synthetic peptide
WVRQAPGKGLEWVA

SEQ ID NO: 3265 - protein, 14 aa, Artificial Sequence
  Description of Artificial Sequence: Synthetic peptide
WVRQAPGKGLEWVG

SEQ ID NO: 3266 - protein, 14 aa, Artificial Sequence
  Description of Artificial Sequence: Synthetic peptide
WVRQAPGKCLEWVG

SEQ ID NO: 3267 - protein, 14 aa, Artificial Sequence
  Description of Artificial Sequence: Synthetic peptide
WIRQPPGKGLEWIG

SEQ ID NO: 3268 - protein, 14 aa, Artificial Sequence
  Description of Artificial Sequence: Synthetic peptide
WIRQPPGKCLEWIG

SEQ ID NO: 3269 - protein, 14 aa, Artificial Sequence
  Description of Artificial Sequence: Synthetic peptide
WIRQPPGKALEWLA

SEQ ID NO: 3270 - protein, 14 aa, Artificial Sequence
  Description of Artificial Sequence: Synthetic peptide
WIRQPPGKCLEWLA

SEQ ID NO: 3271 - protein, 14 aa, Artificial Sequence
  Description of Artificial Sequence: Synthetic peptide
WIRQHPGKGLEWIG

SEQ ID NO: 3272 - protein, 14 aa, Artificial Sequence
  Description of Artificial Sequence: Synthetic peptide
WIRQHPGKCLEWIG

SEQ ID NO: 3273 - protein, 14 aa, Artificial Sequence
  Description of Artificial Sequence: Synthetic peptide
WVRQAPGKGLEWVS

SEQ ID NO: 3274 - protein, 14 aa, Artificial Sequence
  Description of Artificial Sequence: Synthetic peptide
WVRQAPGKCLEWVS

SEQ ID NO: 3275 - protein, 14 aa, Artificial Sequence
  Description of Artificial Sequence: Synthetic peptide
WVRQAPGKGLEWVS

SEQ ID NO: 3276 - protein, 14 aa, Artificial Sequence
  Description of Artificial Sequence: Synthetic peptide
WVRQAPGRCLEWVS

SEQ ID NO: 3277 - protein, 14 aa, Artificial Sequence
  Description of Artificial Sequence: Synthetic peptide
WVRQAPGKGLEWVA

SEQ ID NO: 3278 - protein, 14 aa, Artificial Sequence
  Description of Artificial Sequence: Synthetic peptide
WVRQAPGKCLEWVA

SEQ ID NO: 3279 - protein, 14 aa, Artificial Sequence
  Description of Artificial Sequence: Synthetic peptide
WIRQAPGKGLEWVS

SEQ ID NO: 3280 - protein, 14 aa, Artificial Sequence
  Description of Artificial Sequence: Synthetic peptide
WIRQAPGKCLEWVS

SEQ ID NO: 3281 - protein, 7 aa, Artificial Sequence
  Description of Artificial Sequence: Synthetic peptide
AASTLQS

SEQ ID NO: 3282 - protein, 7 aa, Artificial Sequence
  Description of Artificial Sequence: Synthetic peptide
AASTLQS

SEQ ID NO: 3283 - protein, 7 aa, Artificial Sequence
  Description of Artificial Sequence: Synthetic peptide
AASSLQS

SEQ ID NO: 3284 - protein, 7 aa, Artificial Sequence
  Description of Artificial Sequence: Synthetic peptide
AASSLQS

SEQ ID NO: 3285 - protein, 7 aa, Artificial Sequence
  Description of Artificial Sequence: Synthetic peptide
AASSLQS

SEQ ID NO: 3286 - protein, 7 aa, Artificial Sequence
  Description of Artificial Sequence: Synthetic peptide
WASTRES

SEQ ID NO: 3287 - protein, 7 aa, Artificial Sequence
  Description of Artificial Sequence: Synthetic peptide
WASTRES

SEQ ID NO: 3288 - protein, 7 aa, Artificial Sequence
  Description of Artificial Sequence: Synthetic peptide
TLSYRAS

SEQ ID NO: 3289 - protein, 7 aa, Artificial Sequence
  Description of Artificial Sequence: Synthetic peptide
LGSNRAS

SEQ ID NO: 3290 - protein, 7 aa, Artificial Sequence
  Description of Artificial Sequence: Synthetic peptide
AASSLQS

SEQ ID NO: 3291 - protein, 7 aa, Artificial Sequence
  Description of Artificial Sequence: Synthetic peptide
AASSLQS

SEQ ID NO: 3292 - protein, 7 aa, Artificial Sequence
  Description of Artificial Sequence: Synthetic peptide
AASTLQS

SEQ ID NO: 3293 - protein, 7 aa, Artificial Sequence
  Description of Artificial Sequence: Synthetic peptide
AASTLQS

SEQ ID NO: 3294 - protein, 7 aa, Artificial Sequence
  Description of Artificial Sequence: Synthetic peptide
STSNKHS

SEQ ID NO: 3295 - protein, 7 aa, Artificial Sequence
  Description of Artificial Sequence: Synthetic peptide
GTKFLAP

SEQ ID NO: 3296 - protein, 7 aa, Artificial Sequence
  Description of Artificial Sequence: Synthetic peptide
GTKFLAP

SEQ ID NO: 3297 - protein, 7 aa, Artificial Sequence
  Description of Artificial Sequence: Synthetic peptide
GTKFLAP

SEQ ID NO: 3298 - protein, 7 aa, Artificial Sequence
  Description of Artificial Sequence: Synthetic peptide
GTKFLAP

SEQ ID NO: 3299 - protein, 7 aa, Artificial Sequence
  Description of Artificial Sequence: Synthetic peptide
GTKFLAP

SEQ ID NO: 3300 - protein, 7 aa, Artificial Sequence
  Description of Artificial Sequence: Synthetic peptide
GTKFLAP

SEQ ID NO: 3301 - protein, 7 aa, Artificial Sequence
  Description of Artificial Sequence: Synthetic peptide
GTKFLAP

SEQ ID NO: 3302 - protein, 7 aa, Artificial Sequence
  Description of Artificial Sequence: Synthetic peptide
GTKFLAP

SEQ ID NO: 3303 - protein, 7 aa, Artificial Sequence
  Description of Artificial Sequence: Synthetic peptide
GTKFLAP

SEQ ID NO: 3304 - protein, 7 aa, Artificial Sequence
  Description of Artificial Sequence: Synthetic peptide
YDSDRPS

SEQ ID NO: 3305 - protein, 7 aa, Artificial Sequence
  Description of Artificial Sequence: Synthetic peptide
DDNDRPS

SEQ ID NO: 3306 - protein, 7 aa, Artificial Sequence
  Description of Artificial Sequence: Synthetic peptide
DDSDRPS

SEQ ID NO: 3307 - protein, 17 aa, Artificial Sequence
  Description of Artificial Sequence: Synthetic peptide
WISAYNGNTNYAQKLQG

SEQ ID NO: 3308 - protein, 17 aa, Artificial Sequence
  Description of Artificial Sequence: Synthetic peptide
WISGYNGDTNYAQKLQG

SEQ ID NO: 3309 - protein, 19 aa, Artificial Sequence
  Description of Artificial Sequence: Synthetic peptide
RIRSKANSYATAYAASVKG

SEQ ID NO: 3310 - protein, 19 aa, Artificial Sequence
  Description of Artificial Sequence: Synthetic peptide
RIRSKYNNYATYYADSVKD

SEQ ID NO: 3311 - protein, 19 aa, Artificial Sequence
  Description of Artificial Sequence: Synthetic peptide
RIRSKYNNYATYYADSVKD

SEQ ID NO: 3312 - protein, 19 aa, Artificial Sequence
  Description of Artificial Sequence: Synthetic peptide
RIRSKYNNYATYYADSVKD

SEQ ID NO: 3313 - protein, 19 aa, Artificial Sequence
  Description of Artificial Sequence: Synthetic peptide
RIRSKYNNYATYYADSVKD

SEQ ID NO: 3314 - protein, 19 aa, Artificial Sequence
  Description of Artificial Sequence: Synthetic peptide
RIRSKYNNYATYYADSVKD

SEQ ID NO: 3315 - protein, 19 aa, Artificial Sequence
  Description of Artificial Sequence: Synthetic peptide
RIRSKYNNYATYYADSVKD

SEQ ID NO: 3316 - protein, 19 aa, Artificial Sequence
  Description of Artificial Sequence: Synthetic peptide
RIRSKYNNYATYYADSVKD

SEQ ID NO: 3317 - protein, 19 aa, Artificial Sequence
  Description of Artificial Sequence: Synthetic peptide
RIRSKYNNYATYYADSVKD

SEQ ID NO: 3318 - protein, 19 aa, Artificial Sequence
  Description of Artificial Sequence: Synthetic peptide
RIRSKYNNYATYYADSVKD

SEQ ID NO: 3319 - protein, 19 aa, Artificial Sequence
  Description of Artificial Sequence: Synthetic peptide
RIKSKTDGGTTDYAAPVKG

SEQ ID NO: 3320 - protein, 19 aa, Artificial Sequence
  Description of Artificial Sequence: Synthetic peptide
RIKSKTYGGTTDYAAPVKG

SEQ ID NO: 3321 - protein, 16 aa, Artificial Sequence
  Description of Artificial Sequence: Synthetic peptide
YIYYSGSTNYNPSLKS

SEQ ID NO: 3322 - protein, 16 aa, Artificial Sequence
  Description of Artificial Sequence: Synthetic peptide
SIYYSGSTYYNPSLKS

SEQ ID NO: 3323 - protein, 16 aa, Artificial Sequence
  Description of Artificial Sequence: Synthetic peptide
LIYWNDDKRYSPSLKS

SEQ ID NO: 3324 - protein, 16 aa, Artificial Sequence
  Description of Artificial Sequence: Synthetic peptide
LIYWNDDKRYSPSLQS

SEQ ID NO: 3325 - protein, 16 aa, Artificial Sequence
  Description of Artificial Sequence: Synthetic peptide
YIYYSGSTYYNPSLKS

SEQ ID NO: 3326 - protein, 16 aa, Artificial Sequence
  Description of Artificial Sequence: Synthetic peptide
YISYSGITNYNPSLKS

SEQ ID NO: 3327 - protein, 17 aa, Artificial Sequence
  Description of Artificial Sequence: Synthetic peptide
AISGSGGSTYYADSVKG

SEQ ID NO: 3328 - protein, 17 aa, Artificial Sequence
  Description of Artificial Sequence: Synthetic peptide
AISGSGGGTYYADSVKG

SEQ ID NO: 3329 - protein, 17 aa, Artificial Sequence
  Description of Artificial Sequence: Synthetic peptide
AISGSGGSTYYADSVKG

SEQ ID NO: 3330 - protein, 17 aa, Artificial Sequence
  Description of Artificial Sequence: Synthetic peptide
TISISGGSTNYADSVKG

SEQ ID NO: 3331 - protein, 17 aa, Artificial Sequence
  Description of Artificial Sequence: Synthetic peptide
VISYDGSNKYYADSVKG

SEQ ID NO: 3332 - protein, 17 aa, Artificial Sequence
  Description of Artificial Sequence: Synthetic peptide
VISYDGSNKYYADSVKG

SEQ ID NO: 3333 - protein, 17 aa, Artificial Sequence
  Description of Artificial Sequence: Synthetic peptide
YISSSGSTIYYADSVKG

SEQ ID NO: 3334 - protein, 17 aa, Artificial Sequence
  Description of Artificial Sequence: Synthetic peptide
YISKSGSTIYYADSVKG

SEQ ID NO: 3335 - protein, 32 aa, Artificial Sequence; identical to SEQ ID NO: 1369
  Description of Artificial Sequence: Synthetic polypeptide

SEQ ID NO: 3336 - protein, 32 aa, Artificial Sequence; identical to SEQ ID NO: 1369
  Description of Artificial Sequence: Synthetic polypeptide

SEQ ID NO: 3337 - protein, 32 aa, Artificial Sequence; identical to SEQ ID NO: 1346
  Description of Artificial Sequence: Synthetic polypeptide

SEQ ID NO: 3338 - protein, 32 aa, Artificial Sequence; identical to SEQ ID NO: 1346
  Description of Artificial Sequence: Synthetic polypeptide

SEQ ID NO: 3339 - protein, 32 aa, Artificial Sequence; identical to SEQ ID NO: 1346
  Description of Artificial Sequence: Synthetic polypeptide

SEQ ID NO: 3340 - protein, 32 aa, Artificial Sequence; identical to SEQ ID NO: 1367
  Description of Artificial Sequence: Synthetic polypeptide

SEQ ID NO: 3341 - protein, 32 aa, Artificial Sequence; identical to SEQ ID NO: 1367
  Description of Artificial Sequence: Synthetic polypeptide

SEQ ID NO: 3342 - protein, 32 aa, Artificial Sequence; identical to SEQ ID NO: 1372
  Description of Artificial Sequence: Synthetic polypeptide

SEQ ID NO: 3343 - protein, 32 aa, Artificial Sequence; identical to SEQ ID NO: 1373
  Description of Artificial Sequence: Synthetic polypeptide

SEQ ID NO: 3344 - protein, 32 aa, Artificial Sequence; identical to SEQ ID NO: 1346
  Description of Artificial Sequence: Synthetic polypeptide

SEQ ID NO: 3345 - protein, 32 aa, Artificial Sequence; identical to SEQ ID NO: 1346
  Description of Artificial Sequence: Synthetic polypeptide

SEQ ID NO: 3346 - protein, 32 aa, Artificial Sequence; identical to SEQ ID NO: 1369
  Description of Artificial Sequence: Synthetic polypeptide

SEQ ID NO: 3347 - protein, 32 aa, Artificial Sequence; identical to SEQ ID NO: 1369
  Description of Artificial Sequence: Synthetic polypeptide

SEQ ID NO: 3348 - protein, 32 aa, Artificial Sequence; identical to SEQ ID NO: 1385
  Description of Artificial Sequence: Synthetic polypeptide

SEQ ID NO: 3349 - protein, 32 aa, Artificial Sequence; identical to SEQ ID NO: 1386
  Description of Artificial Sequence: Synthetic polypeptide

SEQ ID NO: 3350 - protein, 32 aa, Artificial Sequence; identical to SEQ ID NO: 1386
  Description of Artificial Sequence: Synthetic polypeptide

SEQ ID NO: 3351 - protein, 32 aa, Artificial Sequence; identical to SEQ ID NO: 1386
  Description of Artificial Sequence: Synthetic polypeptide

SEQ ID NO: 3352 - protein, 32 aa, Artificial Sequence; identical to SEQ ID NO: 1386
  Description of Artificial Sequence: Synthetic polypeptide

SEQ ID NO: 3353 - protein, 32 aa, Artificial Sequence; identical to SEQ ID NO: 1386
  Description of Artificial Sequence: Synthetic polypeptide

SEQ ID NO: 3354 - protein, 32 aa, Artificial Sequence; identical to SEQ ID NO: 1386
  Description of Artificial Sequence: Synthetic polypeptide

SEQ ID NO: 3355 - protein, 32 aa, Artificial Sequence; identical to SEQ ID NO: 1386
  Description of Artificial Sequence: Synthetic polypeptide

SEQ ID NO: 3356 - protein, 32 aa, Artificial Sequence; identical to SEQ ID NO: 1386
  Description of Artificial Sequence: Synthetic polypeptide

SEQ ID NO: 3357 - protein, 32 aa, Artificial Sequence; identical to SEQ ID NO: 1386
  Description of Artificial Sequence: Synthetic polypeptide

SEQ ID NO: 3358 - protein, 32 aa, Artificial Sequence; identical to SEQ ID NO: 1374
  Description of Artificial Sequence: Synthetic polypeptide

SEQ ID NO: 3359 - protein, 32 aa, Artificial Sequence; identical to SEQ ID NO: 1379
  Description of Artificial Sequence: Synthetic polypeptide

SEQ ID NO: 3360 - protein, 32 aa, Artificial Sequence; identical to SEQ ID NO: 1374
  Description of Artificial Sequence: Synthetic polypeptide

(The sequence listing continues in the following parts.)

What is claimed is:

1. An isolated antibody construct, wherein the antibody construct comprises:
   a) a VH region comprising a CDR-H1 comprising the amino acid sequence of SEQ ID NO: 439, a CDR-H2 comprising the amino acid sequence of SEQ ID NO: 440, and a CDR-H3 comprising the amino acid sequence of SEQ ID NO: 441, and a VL region comprising a CDR-L1 comprising the amino acid sequence of SEQ ID NO: 223, a CDR-L2 comprising the amino acid sequence of SEQ ID NO: 224 and a CDR-L3 comprising the amino acid sequence of SEQ ID NO: 225; or
   b) a VH region comprising a CDR-H1 comprising the amino acid sequence of SEQ ID NO: 361, a CDR-H2 comprising the amino acid sequence of SEQ ID NO: 362, and a CDR-H3 comprising the amino acid sequence of SEQ ID NO: 363, and a VL region comprising a CDR-L1 comprising the amino acid sequence of SEQ ID NO: 145, a CDR-L2 comprising the amino acid sequence of SEQ ID NO: 146 and a CDR-L3 comprising the amino acid sequence of SEQ ID NO: 147; or
   c) a VH region comprising a CDR-H1 comprising the amino acid sequence of SEQ ID NO: 523, a CDR-H2 comprising the amino acid sequence of SEQ ID NO: 524, and a CDR-H3 comprising the amino acid sequence of SEQ ID NO: 525, and a VL region comprising a CDR-L1 comprising the amino acid sequence of SEQ ID NO: 307, a CDR-L2 comprising the amino acid sequence of SEQ ID NO: 308 and a CDR-L3 comprising the amino acid sequence of SEQ ID NO: 309; or d) a VH region comprising a CDR-H1 comprising the amino acid sequence of SEQ ID NO: 331, a CDR-H2 comprising the amino acid sequence of SEQ ID NO: 332, and a CDR-H3 comprising the amino acid sequence of SEQ ID NO: 333, and a VL region comprising a CDR-L1 comprising the amino acid sequence of SEQ ID NO: 115, a CDR-L2 comprising the amino acid sequence of SEQ ID NO: 116 and a CDR-L3 comprising the amino acid sequence of SEQ ID NO: 117; or e) a VH region comprising a CDR-H1 comprising the amino acid sequence of SEQ ID NO: 337, a CDR-H2 comprising the amino acid sequence of SEQ ID NO: 338, and a CDR-H3 comprising the amino acid sequence of SEQ ID NO: 339, and a VL region comprising a CDR-L1 comprising the amino acid sequence of SEQ ID NO: 121, a CDR-L2 comprising the amino acid sequence of SEQ ID NO: 122 and a CDR-L3 comprising the amino acid sequence of SEQ ID NO: 123; or f) a VH region comprising the amino acid sequence of SEQ ID NO: 629, and a VL region comprising the amino acid sequence of SEQ ID NO: 628; or g) a VH region comprising the amino acid sequence of SEQ ID NO: 577, and a VL region comprising the amino acid sequence of SEQ ID NO: 576; or h) a VH region comprising the amino acid sequence of SEQ ID NO: 684 685, and a VL region comprising the amino acid sequence of SEQ ID NO: 684 685; or i) a VH region comprising the amino acid sequence of SEQ ID NO: 557, and a VL region comprising the amino acid sequence of SEQ ID NO: 556; or j) a VH region comprising the amino acid sequence of SEQ ID NO: 561, and a VL region comprising the amino acid sequence of SEQ ID NO: 560.

2. The antibody construct of claim 1, wherein the antibody construct comprises a VH region comprising a CDR-H1 comprising the amino acid sequence of SEQ ID NO: 439, a CDR-H2 comprising the amino acid sequence of SEQ ID NO: 440, and a CDR-H3 comprising the amino acid sequence of SEQ ID NO: 441, and a VL region comprising a CDR-L1 comprising the amino acid sequence of SEQ ID NO: 223, a CDR-L2 comprising the amino acid sequence of SEQ ID NO: 224 and a CDR-L3 comprising the amino acid sequence of SEQ ID NO: 225.

3. The antibody construct of claim 1, wherein the antibody construct comprises a VH region comprising a CDR-H1 comprising the amino acid sequence of SEQ ID NO: 361, a CDR-H2 comprising the amino acid sequence of SEQ ID NO: 362, and a CDR-H3 comprising the amino acid sequence of SEQ ID NO: 363, and a VL region comprising a CDR-L1 comprising the amino acid sequence of SEQ ID NO: 145, a CDR-L2 comprising the amino acid sequence of SEQ ID NO: 146 and a CDR-L3 comprising the amino acid sequence of SEQ ID NO: 147.

4. The antibody construct of claim 1, wherein the antibody construct comprises a VH region comprising a CDR-H1 comprising the amino acid sequence of SEQ ID NO: 523, a CDR-H2 comprising the amino acid sequence of SEQ ID NO: 524, and a CDR-H3 comprising the amino acid sequence of SEQ ID NO: 525, and a VL region comprising a CDR-L1 comprising the amino acid sequence of SEQ ID NO: 307, a CDR-L2 comprising the amino acid sequence of SEQ ID NO: 308 and a CDR-L3 comprising the amino acid sequence of SEQ ID NO: 309.

5. The antibody construct of claim 1, wherein the antibody construct comprises a VH region comprising a CDR-H1 comprising the amino acid sequence of SEQ ID NO: 331, a CDR-H2 comprising the amino acid sequence of SEQ ID NO: 332, and a CDR-H3 comprising the amino acid sequence of SEQ ID NO: 333, and a VL region comprising a CDR-L1 comprising the amino acid sequence of SEQ ID NO: 115, a CDR-L2 comprising the amino acid sequence of SEQ ID NO: 116 and a CDR-L3 comprising the amino acid sequence of SEQ ID NO: 117.

6. The antibody construct of claim 1, wherein the antibody construct comprises a VH region comprising a CDR-H1 comprising the amino acid sequence of SEQ ID NO: 337, a CDR-H2 comprising the amino acid sequence of SEQ ID NO: 338, and a CDR-H3 comprising the amino acid sequence of SEQ ID NO: 339, and a VL region comprising a CDR-L1 comprising the amino acid sequence of SEQ ID NO: 121, a CDR-L2 comprising the amino acid sequence of SEQ ID NO: 122 and a CDR-L3 comprising the amino acid sequence of SEQ ID NO: 123.

7. The antibody construct of claim 1, wherein the antibody construct comprises a VH region comprising the amino acid sequence of SEQ ID NO: 629, and a VL region comprising the amino acid sequence of SEQ ID NO: 628.

8. The antibody construct of claim 1, wherein the antibody construct comprises a VH region comprising the amino acid sequence of SEQ ID NO: 577, and a VL region comprising the amino acid sequence of SEQ ID NO: 576.

9. The antibody construct of claim 1, wherein the antibody construct comprises a VH region comprising the amino acid sequence of SEQ ID NO: 684, and a VL region comprising the amino acid sequence of SEQ ID NO: 685.

10. The antibody construct of claim 1, wherein the antibody construct comprises a VH region comprising the amino acid sequence of SEQ ID NO: 557, and a VL region comprising the amino acid sequence of SEQ ID NO: 556.

11. The antibody construct of claim 1, wherein the antibody construct comprises a VH region comprising the amino acid sequence of SEQ ID NO: 561, and a VL region comprising the amino acid sequence of SEQ ID NO: 560.

* * * * *